(12) United States Patent
Nioi et al.

(10) Patent No.: US 10,358,497 B2
(45) Date of Patent: Jul. 23, 2019

(54) METHODS OF TREATING CARDIOVASCULAR DISEASE WITH AN ASGR INHIBITOR

(71) Applicant: Amgen Inc, Thousand Oaks, CA (US)

(72) Inventors: Paul Nioi, Wellesley, MA (US); Jun Zhang, Foster City, CA (US); Yang Li, Mountain View, CA (US)

(73) Assignee: AMGEN INC., Thousand Oaks, CA (US)

( * ) Notice: Subject to any disclaimer, the term of this patent is extended or adjusted under 35 U.S.C. 154(b) by 0 days.

(21) Appl. No.: 15/279,162

(22) Filed: Sep. 28, 2016

(65) Prior Publication Data

US 2017/0088620 A1    Mar. 30, 2017

Related U.S. Application Data

(60) Provisional application No. 62/234,546, filed on Sep. 29, 2015, provisional application No. 62/259,553, filed on Nov. 24, 2015, provisional application No. 62/319,740, filed on Apr. 7, 2016.

(51) Int. Cl.

| | |
|---|---|
| *C12N 15/113* | (2010.01) |
| *C07H 21/02* | (2006.01) |
| *A61P 9/04* | (2006.01) |
| *A61P 9/10* | (2006.01) |
| *C07K 16/28* | (2006.01) |
| *A61K 39/395* | (2006.01) |
| *A61K 45/06* | (2006.01) |
| *C07K 14/705* | (2006.01) |
| *A61K 39/00* | (2006.01) |

(52) U.S. Cl.
CPC ...... *C07K 16/2851* (2013.01); *A61K 39/3955* (2013.01); *A61K 45/06* (2013.01); *A61P 9/04* (2018.01); *A61P 9/10* (2018.01); *C07H 21/02* (2013.01); *C07K 16/28* (2013.01); *C12N 15/1138* (2013.01); *A61K 2039/505* (2013.01); *A61K 2039/507* (2013.01); *C07K 14/705* (2013.01); *C07K 2317/30* (2013.01); *C07K 2317/76* (2013.01); *C07K 2317/77* (2013.01); *C07K 2317/92* (2013.01); *C07K 2317/94* (2013.01)

(58) Field of Classification Search
None
See application file for complete search history.

(56) References Cited

U.S. PATENT DOCUMENTS

| 3,720,760 A | 3/1973 | Wide et al. |
|---|---|---|
| 4,179,337 A | 12/1979 | Davis et al. |
| 4,301,144 A | 11/1981 | Iwashita et al. |
| 4,331,647 A | 5/1982 | Goldenberg |
| 4,496,689 A | 1/1985 | Mitra |
| 4,518,584 A | 5/1985 | Mark et al. |
| 4,522,811 A | 6/1985 | Eppstein et al. |
| 4,640,835 A | 2/1987 | Shimizu et al. |
| 4,670,417 A | 6/1987 | Iwasaki et al. |
| 4,737,456 A | 4/1988 | Weng et al. |
| 4,737,462 A | 4/1988 | Mark et al. |
| 4,751,180 A | 6/1988 | Cousens et al. |
| 4,791,192 A | 12/1988 | Nakagawa et al. |
| 4,935,233 A | 6/1990 | Bell et al. |
| 5,011,912 A | 4/1991 | Hopp et al. |
| 5,208,020 A | 5/1993 | Chari et al. |
| 5,223,409 A | 6/1993 | Ladner et al. |
| 5,225,539 A | 7/1993 | Winter |
| 5,416,064 A | 6/1995 | Chari et al. |
| 5,457,035 A | 10/1995 | Baum et al. |
| 5,474,981 A | 12/1995 | Leder et al. |
| 5,475,092 A | 12/1995 | Chari et al. |
| 5,539,082 A | 7/1996 | Nielson et al. |
| 5,545,806 A | 8/1996 | Lonberg et al. |
| 5,569,825 A | 10/1996 | Lonberg et al. |
| 5,585,499 A | 12/1996 | Chari et al. |
| 5,624,821 A | 4/1997 | Winter et al. |
| 5,627,052 A | 5/1997 | Schrader |
| 5,698,426 A | 12/1997 | Husebird |
| 5,714,331 A | 2/1998 | Buchardt et al. |
| 5,719,262 A | 2/1998 | Buchardt et al. |
| 5,814,318 A | 9/1998 | Lonberg et al. |

(Continued)

FOREIGN PATENT DOCUMENTS

| EP | 404097 | 10/1991 |
|---|---|---|
| EP | 1144623 | 10/2001 |

(Continued)

OTHER PUBLICATIONS

Nioi et al, 2016 (N Engl J Med. 374(22):2131-2141).*
Adams et al., PHENIX: a comprehensive Python-based system for macromolecular structure solution, Acta crystallographica vol. 66, pp. 213-221 (2010).
Albert et al., The B-cell Epitope of the Monoclonal Anti-Factor VIII Antibody ESH8 Characterized by Peptide Array Analysis, Thromb Haemost vol. 99, pp. 634-637 (2008).
Aoki et al., Potential tumor-targeting peptide vector of histidylated oligolysine conjugated to a tumor-homing RGD motif, Cancer Gene Therapy vol. 8, pp. 783-787 (2001).
Arbones et al., Lymphocyte Homing and Leukocyte Rolling and Migration Are Impaired in L-Selectin-Deficient Mice, Immunity. vol. 1, pp. 247-260 (1994).

(Continued)

*Primary Examiner* — Zachary C Howard
(74) *Attorney, Agent, or Firm* — Knobbe, Martens, Olson & Bear, LLP.

(57) ABSTRACT

Antigen binding proteins that interact with ASGR, ASGR-1 and/or ASGR-2 are described as well as methods of making and using such antigen binding proteins. Methods of treating and preventing cardiovascular disease by administering a pharmaceutically effective amount of ASGR, ASGR-1 and/or ASGR-2 antigen binding proteins. Methods of treating and preventing cardiovascular disease by administering a pharmaceutically effective amount of interfering RNA compositions that reduce expression of ASGR, ASGR-1 and/or ASGR-2 are described.

108 Claims, 4126 Drawing Sheets

Specification includes a Sequence Listing.

(56) References Cited

U.S. PATENT DOCUMENTS

| | | | |
|---|---|---|---|
| 5,821,337 A | 10/1998 | Carter et al. | |
| 5,859,205 A | 1/1999 | Adair et al. | |
| 5,869,619 A | 2/1999 | Studnicka | |
| 5,877,293 A | 3/1999 | Adair et al. | |
| 5,877,397 A | 3/1999 | Lonberg et al. | |
| 5,886,152 A | 3/1999 | Nakatani et al. | |
| 5,898,031 A | 4/1999 | Crooke | |
| 6,054,297 A | 4/2000 | Carter et al. | |
| 6,107,094 A | 8/2000 | Crooke | |
| 6,133,426 A | 10/2000 | Gonzalez et al. | |
| 6,168,587 B1 | 1/2001 | Bellhouse et al. | |
| 6,194,389 B1 | 2/2001 | Johnston et al. | |
| 6,210,924 B1 | 4/2001 | Hu et al. | |
| 6,277,375 B1 | 8/2001 | Ward | |
| 6,340,701 B1 | 1/2002 | Chari et al. | |
| 6,372,738 B2 | 4/2002 | Chari et al. | |
| 6,395,272 B1 | 5/2002 | Deo et al. | |
| 6,436,931 B1 | 8/2002 | Chari et al. | |
| 6,471,996 B1 | 10/2002 | Sokoll et al. | |
| 6,472,375 B1 | 10/2002 | Hoon et al. | |
| 6,506,559 B1 | 1/2003 | Fire et al. | |
| 6,573,099 B2 | 6/2003 | Graham | |
| 6,602,684 B1 | 8/2003 | Umana et al. | |
| 6,693,187 B1 | 2/2004 | Dellinger | |
| 6,696,245 B2 | 2/2004 | Winter et al. | |
| 6,703,199 B1 | 3/2004 | Koide | |
| 6,846,634 B1 | 1/2005 | Tomlinson et al. | |
| 6,881,557 B2 | 4/2005 | Foote | |
| 7,029,872 B2 | 4/2006 | Gerngross | |
| 7,056,704 B2 | 6/2006 | Tuschl et al. | |
| 7,064,244 B2 | 6/2006 | Jakobovits et al. | |
| 7,078,196 B2 | 7/2006 | Tuschl et al. | |
| 7,563,459 B2 * | 7/2009 | Phillips | A61K 35/17 424/577 |
| 7,579,451 B2 | 8/2009 | Manoharan et al. | |
| 7,695,963 B2 | 4/2010 | Agulnick et al. | |
| 8,030,457 B2 | 10/2011 | Jackson et al. | |
| 8,394,628 B2 | 3/2013 | Tuschl et al. | |
| 8,502,014 B2 | 8/2013 | Grosveld | |
| 8,507,455 B2 | 8/2013 | Manoharan et al. | |
| 8,507,748 B2 | 8/2013 | Grosveld | |
| 8,877,917 B2 | 11/2014 | Forst et al. | |
| 9,181,551 B2 | 11/2015 | McSwiggen et al. | |
| 2001/0036459 A1 | 11/2001 | Ravetch | |
| 2003/0039958 A1 | 2/2003 | Holt et al. | |
| 2003/0133939 A1 | 7/2003 | Ledbetter et al. | |
| 2004/0009507 A1 | 1/2004 | Winter et al. | |
| 2004/0038291 A2 | 2/2004 | Tomlinson et al. | |
| 2004/0072290 A1 | 4/2004 | Umana et al. | |
| 2004/0185045 A1 | 9/2004 | Koenig et al. | |
| 2004/0202995 A1 | 10/2004 | De Wildt et al. | |
| 2004/0261148 A1 | 12/2004 | Dickey et al. | |
| 2005/0079605 A1 | 4/2005 | Umana et al. | |
| 2005/0118643 A1 | 6/2005 | Burgess et al. | |
| 2005/0202512 A1 | 9/2005 | Tomlinson et al. | |
| 2005/0238646 A1 | 10/2005 | Ledbetter et al. | |
| 2005/0272128 A1 | 12/2005 | Umana et al. | |
| 2006/0039904 A1 | 2/2006 | Wu et al. | |
| 2006/0040325 A1 | 2/2006 | Wu et al. | |
| 2006/0067930 A1 | 3/2006 | Adams et al. | |
| 2006/0257399 A1 | 11/2006 | Gerngross et al. | |
| 2007/0031402 A1 | 2/2007 | Zhang et al. | |
| 2007/0092521 A1 | 4/2007 | McPherson et al. | |
| 2009/0028856 A1 | 1/2009 | Chen et al. | |
| 2009/0169548 A1 | 7/2009 | Grosveld et al. | |
| 2009/0274713 A1 | 11/2009 | Chari et al. | |
| 2009/0285805 A1 | 11/2009 | Grosveld et al. | |
| 2009/0307787 A1 | 12/2009 | Grosveld et al. | |
| 2011/0092565 A1 | 4/2011 | Bumcrot et al. | |
| 2011/0314563 A1 | 12/2011 | Craig et al. | |
| 2012/0028596 A1 | 2/2012 | Yamada et al. | |
| 2012/0151610 A1 | 6/2012 | Craig et al. | |
| 2013/0024961 A1 | 1/2013 | Burlak et al. | |
| 2015/0197746 A1 | 7/2015 | Rajeev et al. | |
| 2015/0259689 A1 | 9/2015 | Kowalik et al. | |
| 2016/0122761 A1 | 5/2016 | Prakash et al. | |

FOREIGN PATENT DOCUMENTS

| | | |
|---|---|---|
| EP | 439095 | 12/2004 |
| WO | WO 87/05330 | 9/1987 |
| WO | WO 92/02551 | 2/1992 |
| WO | WO 93/10151 | 5/1993 |
| WO | WO 93/11161 | 6/1993 |
| WO | WO 93/21232 | 10/1993 |
| WO | WO 94/10308 | 5/1994 |
| WO | WO 97/34631 | 9/1997 |
| WO | WO 98/23289 | 6/1998 |
| WO | WO 98/24838 | 6/1998 |
| WO | WO 99/51642 | 10/1999 |
| WO | WO 99/58572 | 11/1999 |
| WO | WO 00/76310 | 12/2000 |
| WO | WO 01/79299 | 10/2001 |
| WO | WO 03/011878 | 2/2003 |
| WO | WO 2004/016750 | 2/2004 |
| WO | WO 2004/029207 | 4/2004 |
| WO | WO 2004/063351 | 7/2004 |
| WO | WO 2005/044859 | 5/2005 |
| WO | WO 2005/084390 | 9/2005 |
| WO | WO 2005/694879 | 10/2005 |
| WO | WO 2006/071280 | 7/2006 |
| WO | WO 2006/071856 | 7/2006 |
| WO | WO 2008/122886 | 10/2008 |
| WO | WO 2009/013620 | 1/2009 |
| WO | WO 2009/089004 | 7/2009 |
| WO | WO 2009/099728 | 8/2009 |
| WO | WO 2014/023709 A1 | 2/2014 |
| WO | WO 2017/058944 A1 | 4/2017 |
| WO | WO 2018/039647 | 3/2018 |

OTHER PUBLICATIONS

Babcock et al., A novel strategy for generating monoclonal antibodies from single, isolated lymphocytes producing antibodies of defined specificities, Proc. Natl. Acad. Sci. USA vol. 93, pp. 843-848 (1996).

Baines et al., Purification of Immunoglobulin G (IgG), Methods in Molecular Biology vol. 10, pp. 79-104, The Human Press Inc. (1992).

Baron et al., Co-regulation of two gene activities by tetracycline via a bidirectional promoter, Nucleic Acids Res. vol. 23, pp. 3605-3606 (1995).

Battye et al., iMOSFLM: a new graphical interface for diffraction-image processing with MOSFLM, Acta crystallographica vol. 67, pp. 271-281 (2011).

Bauer et al., A genetic enrichment for mutations constructed by oligodeoxynucleotide-directed mutagenesis Gene vol. 37, pp. 73 (1985).

Bebbington et al., The use of vectors based on gene amplification for the expression of cloned genes in mammalian cells, DNA Cloning, vol. 3. Academic Press (1987).

Boerner et al., Production of antigen-specific human monoclonal antibodies from in vitro-primed human splenocytes Journal or Immunology vol. 147, pp. 86-95 (1991).

Bruggemann et al., Production of human antibody repertoires in transgenic mice Current Opinions in Biotechnology vol. 8, pp. 455-458 (1997).

Burger et al., Human plasma R-type vitamin B12-binding proteins II. The role of transcobalamin I, transcobalamin III, and the normal granulocyte vitamin B12-binding protein in the plasma transport of vitamin B12, The Journal of Biological Chemistry vol. 250, pp. 7707-7713 (1975).

Chambers et al., Genome-wide association study identifies loci influencing concentrations of liver enzymes in plasma, Nature genetics vol. 43, pp. 1131-1138 (2011).

Chen et al., Immunoglobulin gene rearrangement in B-cell deficient mice generated by targeted deletion of the JH locus, International Immunology vol. 5, pp. 647-656 (1993).

(56) References Cited

OTHER PUBLICATIONS

Cheung et al., Epitope-Specific Antibody Response to the Surface Antigen of Duck Hepatitis 6 Virus in Infected Ducks Virology vol. 176, pp. 546-552 (1990).
Choi et al., Transgenic mice containing a human heavy chain immunoglobulin gene fragment cloned in a yeast artificial chromosome, Nature Genetics vol. 4, pp. 117-123 (1993).
Chothia, C et al., Canonical Structures for the Hypervariable Regions of Immunoglobulins, Journal of Molecular Biology vol. 196, pp. 901-917 (1987).
Chothia et al., Conformations of Immunoglobulin hypervariable regions, Nature vol. 342, pp. 878-883 (1989).
Chou et al., Prediction of the secondary structure of proteins from their amino acid sequence, Adv. Enzymol. Relat. Areas Mol. Biol. vol. 47, pp. 45-148 (1978).
Chou et al., Empirical predictions of protein conformation, Ann. Rev. Biochem. vol. 47, pp. 251-276.
Chou et al., Prediction of protein conformation, Biochemistry vol. 13(2), pp. 222-245 (1974).
Chou et al. Prediction of A-Turns, Biophys J. vol. 26, pp. 367-384 (1979).
Chou et al., Conformational Parameters for amino acids in helical b-sheet, and random coil regions calculated from proteins, Biochemistry vol. 113(2), pp. 211-222 (1974).
Clark, M:, Antibody humanization: a case of the 'Emperor's new clothes'? Immunology Today vol. 21(8), pp. 397-402 (2000).
Coates et al., Epitope mapping by amide hydrogen/deuterium exchange coupled with immobilization of antibody, on-line proteolysis, liquid chromatography and mass spectrometry, Rapid Communication Mass Pectrometry vol. 23, pp. 639-647 (2009).
Cockett et al., High level of tissue inhibitor of metalloproteinases in Chinese hamster ovary cells using glutamine synthetase gene amplification, Bio/Technology vol. 8, pp. 2 (1990).
Colberre-Garapin et al., A New Dominant Hybrid Selective Marker for Higher Eukaryotic Cells J. Mol. Biol. vol. 150, pp. 1 (1981).
Cortez-Retamozo et al., Efficient Cancer Therapy with a Nanobody-Based Conjugate, Cancer Research vol. 64, pp. 2853-2857 (2004).
Courtenay-Luck, Genetic Manipulation of Monoclonal Antibodies, Monoclonal Antibodies: Production, Engineering and Clinical Application, Ritter et al. (eds.), pp. 166, Cambridge University Press (1995).
Craik, Use of oligonucleotides for site-specific mutagenesis, BioTechniques, 12-19 (1985).
Crameri et al., DNA shuffling of a family of genes from diverse species accelerates directed evolution, Nature vol. 391, pp. 288-291 (1998).
Creighton, Ed., Proteins, Structures, and Molecular Principles, W.H. Freeman and Company (1984).
Creighton, Proteins: Structure and Molecular Properties, W.H. Freeman & Co., pp. 79-86 (1983).
Crouse et al., Expression and Amplification of Engineered Mouse Dihydrofolate Reductase Minigenes, Mol. Cell. Biol. vol. 3, pp. 257 (1983).
Cunningham and Wells, High-resolution epitope mapping og HGH-receptor interactions by alanine-scanning mutagenesis, Science vol. 244, pp. 1081085 (1989).
D'Souza et al., Asialoglycoprotein receptor mediated hepatocyte targeting—Strategies and applications Journal of Control Release vol. 203, pp. 126-139 (2015).
Dall'Acqua et al., Antibody humanization by framework shuffling, Methods vol. 36(1), pp. 43-60 (2005).
Davis et al., Transgenic mice as a source of fully human antibodies for the treatment of cancer, Cancer Metastasis Rev. vol. 18, pp. 421-425 (1999).
Davis et al., Production of human antibodies from transgenic mice in Lo, ed. Antibody Engineering: Methods and Protocols, Humana Press, NJ, pp. 191-200 (2003).
Deleavey et al., Designing Chemically Modified Oligonucleotides for Targeted Gene Silencing Chemistry and Biology, vol. 19, pp. 937-954 (2012).

Devereux et al., A comprehensive set of sequence analysis programs for the VAX, Nucl. Acids Res. vol. 12(1), pp. 387 (1984).
Di Angelantonio et al., Major lipids, apolipoproteins, and risk of vascular disease, Jama vol. 302, pp. 1993-2000 (2009).
Do et al., Common variants associated with plasma triglycerides and risk for coronary artery disease. Nature genetics vol. 45, pp. 1345-1352 (2013).
Emsley et al., Features and development of Coot, Acta crystallographica vol. 66, pp. 486-501 (2010).
Evans, Scaling and assessment of data quality, Acta crystallographica vol. 62, pp. 72-82 (2006).
Fanslow et al., Structural characteristics of CD40 ligand that determine biological function, Semin. Immunol. vol. 6, pp. 267-278 (1994).
Fell et al., Genetic construction and characterization of a fusion protein consisting of a chimeric F(ab') with specificity for carcinomas and human IL-2., J. Immunol. vol. 146, pp. 2446-2452 (1991).
Fishwild et al., High-avidity human IgGk monoclonal antibodies from a novel strain of miniolocus transgenic mice Nature Biotechnology vol. 14, pp. 845-851 (1996).
Foecking et al., Powerful and versatile enhancer-promoter unit for mammalian expression vectors Gene vol. 45, pp. 101 (1986).
Fredericks et al., Identification of potent human anti-IL-1RI antagonist antibodies, Protein Engineering, Design, & Selection vol. 17, pp. 95-106 (2004).
Friedewald et al., Estimation of the concentration of low-density lipoprotein cholesterol in plasma, without use of the preparative ultracentrifuge. Clin. Chem. vol. 18, pp. 499-502 (1972).
Furger et al., Comparison of recombinant human haptocorrin expressed in human embryonic kidney cells and native haptocorrin PloS one vol. 7, e37421 (2012).
Gallo et al., The human immunoglobulin loci introduced into mice: V (D) and J gene segment usage similar to that of adult humans European Journal of Immunology vol. 30, pp. 534-540 (2000).
Gentz et al., Bioassay for trans-activation using purified human immunodeficiency virus tat-encoded protein: Trans-activation requires mRNA synthesis Proc. Natl. Acad. Sci. USA vol. 86, pp. 821-824 (1989).
Gerhardt et al. Structure of IL-17A in complex with a potent, fully human neutralizing antibody, Journal of Molecular Biology vol. 394, pp. 905-921 (2009).
Gibskov et al, Profile analysis: Detection of distantly related proteins. Proc. Nat. Acad. Sci. vol. 84(13), pp. 4355-4358 (1987).
Gillies et al., Antibody-targeted interleukin 2 stimulates T-cell killing of autologous tumor cells, Proc. Natl. Acad. Sci. vol. 89, pp. 1428-1432 (1992).
Glasky et al., Stability of Specific Immunoglobulin Secretion by EBV-Transformed Lymphoblastoid Cells and Human-Murine Heterohybridomas, Hybridoma vol. 8, pp. 377-389 (1989).
Gluzman et-al., SV40-Transformed Simian Cells Support the Replication of Early SV40 Mutants, Cell vol. 23, pp. 175 (1981).
Goeddel, Gene Expression Technology: Methods in Enzymology vol. 185, Academic Press, (1990).
Gold et al., Aptamer-based multiplexed proteomic technology for biomarker discovery, PLoS One 5, e15004, doi:10.1371/journal.pone.0015004 (2010).
Green et al., Antigen-specific human monoclonal antibodies from mice engineered with human Ig heavy and light chain YACs Nat Genet. vol. 7, pp. 13-21 (1994).
Green et al., Regulation of B Cell Development by Variable Gene Complexity in Mice Reconstituted with Human Immunoglobulin Yeast Artificial Chromosomes, Journal of Experimental Medicine vol. 188, pp. 483-495 (1998).
Green, Antibody engineering via genetic engineering of the mouse: XenoMouse strains are a vehicle for the facile generation of therapeutic human monoclonal antibodies, Journal of Immunological Methods vol. 231, pp. 11-23 (1999).
Greene et al., Protection for the hydroxyl group, including 1, 2- and 1,3-diols, Protective Groups in Organic Synthesis, 2d. Ed., John Wiley and Sons (1991).

(56) References Cited

OTHER PUBLICATIONS

Gretarsdottir et al., Genome-wide association study identifies a sequence variant within the DAB2IP gene conferring susceptibility to abdominal aortic aneurysm, Nature genetics vol. 42, pp. 692 (2010).
Gretarsdottir et al., The gene encoding phosphodiesterase 4D confers risk of ischemic stroke, Nature genetics vol. 35, pp. 131-138 (2003).
Grewal, The Ashwell—Morell Receptor, Methods in Enzymology vol. 479, chapter 13, pp. 223-241 (2010).
Gribskov et al., Profile Analysis, Meth. Enzym. vol. 183, pp. 146-159 (1990).
Gribskov et al., Sequence analysis primer, eds., M Stockton Press, (1991).
Griffin, et al., Computer analysis of sequence data, part I, eds., Humana Press, (1994).
Gudbartssoon et al., Large Scale whole-genome sequencing of the Icelandic population, Nature Genetics vol. 47(5), pp. 435-444 (2015).
Haddad et al., Evidence for a third genetic locus causing familial hypercholesterolemia. A non-LDLR, non-APOB kindred, Journal of lipid research vol. 40, pp. 1113-1122 (1999).
Hamajima et al. Intranasal Administration of HIV-DNA vaccine formulated with a polymer, carboxymethycellulose, augments mucosal antibody production and cell-mediated immune response , Clin. Immunol. Immunopathol. vol. 88(2), pp, 205-210 (1998).
Hardonk al., A Histochemical Study about the zonal distribution of galactose-biding protein in rat liver, Histochemistry vol. 69(3), pp. 289-297 (1980).
Harlow and Lane, Antibodies: A Laboratory Manual, Cold Spring Laboratory Press (1988 and 1990).
Harris, Processing of C-terminal lysine and arginine residues of proteins isolated from mammalian cell culture Journal of Chromatography vol. 705, pp. 129-134 (1995).
Haubner et al. Glycosylated RGD-Containing Peptides: Tracer for Tumor Targeting and Angiogenesis Imaging with Improved Biokinetics, Jour. Nucl. Med. vol. 42, pp. 326-336 (2001).
Hollenbaugh et al., Construction of Immunoglobulin Fusion Proteins, Current Protocols in Immunology, Suppl. 4, pp. 10.19.1-10.19.11, (1992).
Hollinger and Hudson, Engineered antibody fragments and the rise of single domains, Nature Biotechnology vol. 23(9), pp. 1126-1136 (2005).
Hollinger et al. "Diabodies": Small bivalent and bispecific antibody fragments, Proc. Natl. Acad. Sci. USA vol. 90, pp. 6444-6448 (1993).
Holm et al., Protein folds and families: sequence and structure alignments, Nucl. Acid. Res. vol. 27(1), pp. 244-247 (1999).
Honegger and Pluckthun, Yet another numbering scheme for immunoglobulin variable domains: An automatic modeling and analysis tool, Journal of Molecular Biology vol. 309(3), pp. 657-670 (2001).
Hoogenboom et al., Human antibodies from synthetic repertoires of germline $V_H$ Gene Segments Rearranged in vitro Journal of Molecular Biology vol. 227, pp. 381-388 (1992).
Hoogendoorn et al., Thyroid function and prevalence of anti-thyroperoxidase antibodies in a population with borderline sufficient iodine intake: influences of age and sex, Clinical chemistry vol. 52, pp. 104-111 (2006).
Hopp et al. A Short Polypeptide Marker Sequence useful for recombinant protein identification and purification, Bio/Technology vol. 6, pp. 1204 (1988).
Hoppe et al., A parallel three stranded α-helical bundle at the nucleation site of collagen triple-helix formation, FEBS Letters vol. 344, pp. 191 (1994).
Hudson et al., Sodium-coupled glycine uptake by Ehrlich ascites tumor cells results in an increase in cell volume and plasma membrane channel activities, Proc. Natl. Acad. Sci. USA vol. 85, pp. 5879-5883 (1988).
Hunt et al., Genetic localization to chromosome 1p32 of the third locus for familial hypercholesterolemia in a Utah kindred, Arterioscler Thromb Vasc Biol vol. 20, pp. 1089-1093 (2000).
Huse et al., Generation of a Large Combinatorial Library of the Immunoglobulin Repertoire in Phage Lambda, Science vol. 246, pp. 1275-1281 (1989).
Hwang et al., Use of human germline genes in a CDR homology-based approach to antibody humanization, Methods vol. 36(1), pp. 35-42 (2005).
Jakobovits et al., Analysis of homozygousmutant chimeric mice: Deletion of the immunoglobulin heavy-chain joining region blocks B-cell development and antibody production, Proc. Natl. Acad. Sci. USA vol. 90, pp. 2551-2555 (1993).
Jakobovits et al., Germ-line transmission and expression of a human-derived yeast artificial chromosome, Nature vol. 362, pp. 255-258 (1993).
Jakobovits, A., The long-awaited magic bullets: therapeutic human monoclonal antibodies from transgenic mice, Exp. Opin. Invest. Drugs vol. 7, pp. 607-614 (1998).
Jakobovits, A., Production and Selection of antigen-specific fully human monoclonal antibodies from mice engineered with human Ig loci, Advanced Drug Delivery Reviews vol. 31, pp. 33-42 (1998).
Jakobovits, A., Humanizing the mouse genome, Curr. Biol. vol. 4, pp. 761-763 (1994).
Janssens et al. Generation of heavy-chain-only antibodies in mice, PNAS vol. 103, pp. 15130-15135; Harbour Biologics, Rotterdam, Netherlands 2006.
Jia et al., A novel method of Multiplexed Competitive Antibody Binning for the characterization of monoclonal antibodies, Journal of immunological Methods vol. 288, pp. 91-98 (2004).
Jones, D., Progress in protein structure prediction, Current Opinions on Structural Biology vol. 7(3), pp. 377-387 (1997).
Jorgensen et al., Loss-of-function mutations in APOC3 and risk of ischemic vascular disease, The New England journal of medicine vol. 371, pp. 32-41 (2014).
Kabat, E.A. et al., Sequences of Proteins of Immunological Interest, NIH, Bethesda, MD (1987 and 1991).
Kabat E.A. et al., Sequences of Proteins of Immunological Interest, NIH, Bethesda, MD (1991).
Kang et al., Linkage of recognition and replication functions by assembling combinatorial antibody Fab libraries along phase surfaces, Proc Natl. Acad Sci. USA vol. 88, pp. 363-366 (1991).
Kellerman et al., Antibody discovery: the use of transgenic mice to generate human monoclonal antibodies for therapeutics, Current Opinion in Biotechnology vol. 13, pp. 593-597 (2002).
Kenneth et al., Monoclonal Antibodies, Hybridomas: A New Dimension in Biological Analyses, Plenum Press (1980).
Kirkland et al., Analysis of the Fine Specificity and Cross-Reactivity of Monoclonal Anti-lipid A Antibodies, Journal of Immunology vol. 137, pp. 3614-3619 (1986).
Kohler, Immunoglobulin chain loss in hybridoma lines, Proc. Natl. Acad. Sci. USA vol. 77, pp. 2197 (1980).
Korndorfer et al., Crystallographic Analysis of an "Anticalin" with Tailored Specificity for Fluorescein Reveals High Structural Plasticity of the Lipocalin Loop Region, Proteins: Structure, Function, and Bioinformatics vol. 53(1), pp. 121-129 (2003).
Kortt et al. Dimeric and trimeric antibodies: high avidity scFvs for cancer targeting, Biomol. Eng. vol. 18, pp. 95-108 (2001).
Kortt et al., Single-chain Fv fragments of anti-neuraminidase antibody NC10 containing five- and ten-residue linkers form dimers-and with zero-residue linker a trimer, Protein Engineering vol. 10, pp. 423 (1997).
Kostelny et al., Formation of a Bispecific Antibody by the Use of Leucine Zippers, Journal of Immunology vol. 148, pp. 1547-1553 (1992).
Kriangkum et al., Bispecific and bifunctional single chain recombinant antibodies, Biomol. Eng. vol. 18, pp. 31-40 (2001).
Lam et al., A new type of synthetic peptide library for identifying ligand-binding activity, Nature vol. 354, pp. 82-84 (1991).
Landschulz et al., The Leucine Zipper: A Hypothetical Structural Common to a New Class of DNA Binding Proteins, Science vol. 240, pp. 1759 (1988).

(56) References Cited

OTHER PUBLICATIONS

Lanitto et al., Chain Shuffling to Modify Properties of Recombinant Immunoglobulins, Methods in Molecular Biology vol. 178, pp. 303-316 (2002).
Larock, Comprehensive Organic Transformations, VCH Publishers (1989).
Larrick et al., Polymerase Chain Reaction Using Mixed Primers: Cloning of Human Monoclonal Antibody Variable Region Genes from Single Hybridoma Cells, Bio/Technology vol. 7, pp. 934 (1989).
Larrick et al., Methods: A Companion to Methods in Enzymology vol. 2, pp. 106 (1991).
Lefranc et al., IMGT unique numbering for immunoglobulin and T cell receptor constant domains and Ig superfamily C-like domains, Dev. Comp. Immunol. vol. 29, pp. 185-203 (2005).
Lesk, Computational molecular biology, A. M., ed., Oxford University Press, (1988).
Lim et al., A diversity of antibody epitopes can induce signaling through the erythropoietin receptor, Biochemistry vol. 49, pp. 3797-3804 (2010).
Liu et al., Chimeric mouse-human IgG1 antibody that can mediate lysis of cancer cells, Proc. Nat. Acad. Sci. USA vol. 84, pp. 3439 (1987).
Lonberg et al., Human Antibodies from Transgenic Mice, Internal Review of Immunology vol. 13, pp. 65-93 (1995).
Lonberg et al., Antigen-specific human antibodies from mice comprising four distinct genetic modifications, Nature vol. 368, pp. 856-859 (1994).
Lonberg, Transgenic Approaches to Human Monoclonal Antibodies in Handbook of Experimental Pharmacology vol. 113, pp. 49-101 (1994).
Low et al., Mimicking Somatic Hypermutation: Affinity Maturation of Antibodies Displayed on Bacteriophae Using a Bacterial Mutator Strain, Journal of Molecular Biology vol. 250, pp. 350-368 (1996).
Lowy et al., Isolation of Transforming DNA: Cloning the Hamster aprt Gene, Cell vol. 22, pp. 817 (1980).
Liu et al., A new splice variant of the major subunit of human asialogycoprotein receptor encodes a secreted form in hepatocytes PloS one, vol. 5, e12934 (2010).
Maniatis et al., Regulation of Inducible and Tissue-Specific Gene Expression, Science vol. 236, pp. 1237 (1987).
Manoharan, Oligonucleotide Conjugates in Antisense Technology, Antisense Drug Technology, ed. S. T. Crooke, Marcel Dekker, Inc. (2001).
Marks et al., By-passing Immunication: Building High Affinity Human Antibodies by Chain Shuffling, Bio/Technology vol. 10, pp. 779-783 (1992).
McCoy et al., Phaser crystallographic software, Journal of applied crystallography vol. 40, pp. 658-674 (2007).
McMahan et al., A novel IL-1 receptor, cloned from B cells by mammalian expression, is expressed in many cell types, EMBO J. vol. 10, pp. 2821 (1991).
Meier et al., Crystal structure of the carbohydrate recognition domain of the H1 subunit of the asialoglycoprotein receptor. Journal of molecular biology vol. 300, 857-865 (2000).
Mendez et al., Functional transplant of megabase human immunoglobulin loci recapitulates human antibody response in mice, Nat Gen. vol. 15, pp. 146-156 (1997).
Miller et al., Epitope binning of murine monoclonal antibodies by a multiplexed pairing assay, Journal of Immunological Methods vol. 365, pp. 118-125 (2011).
Moldenhauer et al., Identity of HML-1 Antigen on Intestinal Intraepithelial T Cells and B-Iy7 Antigen on Hairy Cell Leukaemia, Scandinavian Journal of Immunology vol. 32, pp. 7-82 (1990).
Morel et al., Monoclonal Antibodies to Bovine Serum Albumin: Affinity and Specificity Determinations, Molecular Immunology vol. 25, pp. 7-15 (1988).
Morell et al., The role of sialic acid in determining the survival of glycoproteins in the circulation, The Journal of biological chemistry vol. 246, pp. 1461-1467 (1971).

Morgan et al., Precise epitope mapping of malaria parasite inhibitory antibodies by TROSY NMR cross-saturation, Biochemistry vol. 44, pp. 518-523 (2005).
Moult, J., The current state of the art in protein structure prediction, Current Operations in Biotechnology vol. 7(4), pp. 422-427 (1996).
Mulligan et al., Selection for animal cells that express the *Escherichia coil* gene coding for xanthine-guanine phosphoribosyltransferase, Proc. Natl. Acad. Sci. USA vol. 78, pp. 2072 (1981).
Nanevicz et al., Mechanisms of Thrombin Receptor Agonist Specificity, Journal of Biological Chemistry vol. 270(37), pp. 21619-21625 (1995).
Naramura et al., Mechanisms of cellular cytotoxicity mediated by a recombinant antibody-IL2 fusion protein against human melanoma cells, Immunol. Lett. vol. 39, pp. 91-99 (1994).
Neuberger, Generating high-avidity human Mabs in mice, Nature Biotechnology vol. 14, pp. 826 (1996).
Nioi et al., Variant ASGR1 Associated with a Reduced Risk of Coronary Artery Disease, The New England journal of medicine vol. 374, pp, 2131-2141, doi:10.1056/NEJMoa1508419 (2016).
Nisonoff et al., Separation of Univalent Fragments from the Bivalent Rabbit Antibody Molecule by Reduction of Disulfide Bonds, Arch. Biochem. Biophys. vol. 89, pp. 230 (1960).
Nygren and Uhlen, Scaffolds for engineering novel binding sites in proteins, Current Opinion in Structural Biology vol. 7, pp. 463-469 (1997).
O'Hare et al., Transformation of mouse fibroblasts to methotrexate resistance by a recombinant plasmid expressing a prokaryotic dihydrofolate reductase, Proc. Natl. Acad. Sci. USA vol. 78, pp. 1527 (1981).
Olafsen et al., Characterization of engineered anti-p185-$^{HER-2}$ (scFv-$C_H3)_2$ antibody fragments (minibodies) for tumor targeting, Protein Eng Des Sel. vol. 17, pp. 315-323 (2004).
Olsen et al., N-terminal pro-brain natriuretic peptide, but not high sensitivity C-reactive protein, improves cardiovascular risk prediction in the general population, European heart journal vol. 28, pp. 1374-1381 (2007).
Padlan et al., Identification of specificity-determining residues in antibodies, FASEB J. vol. 9, pp. 133-139 (1995).
Paquette, ed., Encyclopedia of Reagents for Organic Synthesis, John Wiley and Sons (1995).
Patten et al., Applications of DNA shuffling to pharmaceuticals and vaccines, Current Opinions in Biotechnology vol. 8, pp. 724-733 (1997).
Paul, ed., Fundamental Immunology, 4$^{th}$ ed., Lippincott-Raven, Philadelphia (1999).
Paul, W., Fundamental Immunology Ch. 7, 2d ed., Raven Press, N.Y. (1989).
Poljak et al., Production and structure of diabodies, Structure vol. 2, pp. 1121-1123 (1994).
Porter, The Hydrolysis of Rabbit γ-Globulin and Antibodies with Crystalline Papain, Biochemistry Journal vol. 73, pp. 119 (1959).
Pouwels et al., Cloning Vectors: A Laboratory Manual, Elsevier (1985).
Powers et al., Expression of single-chain Fv-Fc fusions in *Pichia pastoris*, Journal of Immunological Methods vol. 251, pp. 123-135 (2001).
Proudfoot, Transcriptional interference and termination between duplicated α-globin gene constructs suggests a novel mechanism for gene regulation, Nature vol. 322, pp. 52 (1986).
Rajeev et al., Hepatocyte-Specific Delivery of siRNAs Conjugated to Novel Non-nucleosidic Trivalent N-Acetylgalactosamine Elicits Robust Gene Silencing in Vivo, ChemBiochem vol. 16(6), pp. 903-908 (2015).
Rasmussen et al., Isolation, characterization and recombinant protein expression in Veggie-CHO: A serum-free CHO host cell line, Cytotechnology vol. 28, pp. 31 (1998).
Rathanaswami et al., High-affinity binding measurements of antibodies to cell-surface-expressed antigens, Analytical Biochemistry vol. 373, pp. 52-60 (2008).
Riechmann et al., Reshaping human antibodies for therapy, Nature vol. 332, pp. 323 (1988).

(56) References Cited

OTHER PUBLICATIONS

Roggenbuck et al., Asialoglycoprotein receptor (ASGPR): a peculiar target of liver-specific autoimmunity, Autoimmune Highlights vol. 3, pp. 119-125 (2012).
Roque et al., Antibodies and Genetically Engineered Related Molecules: Production and Purification, Biotechnology Progress vol. 20, pp. 639-654 (2004).
Rotundo et al., Circulating Cellular Fibronectin May be a Natural Ligand for the Hepatic Asialoglycoprotein Receptor: Possible Pathway for Fibronectin Deposition and Turnover in the Rat Liver, Hepatology vol. 28, pp. 475-485 (1998).
Russel et al., Production of Protective Human Antipneumococcal Antibodies by Transgenic Mice with Human Immunoglobulin Loci, Infect Immun. vol. 68, pp. 1820-1826 (2000).
Saitou and Nei, The Neighbor-joining Method: A New Method for Reconstructing Phylogenetic Trees Molecular Biology and Evolution vol. 4, pp. 406-425 (1987).
Samani et al., Genomewide association analysis of coronary artery disease, The New England journal of medicine vol. 357, pp. 443-453 (2007).
Sambrook et al., Molecular Cloning: A Laboratory Manual, 2d ed., Cold Spring Harbor Laboratory Press. (1989).
Santerre et al., Expression of prokaryotic genes for hygromycin B and G418 resistance as dominant-selection markers in mouse L cells, Gene vol. 30, pp. 147 (1984).
Sastry et al., Cloning of the immunological repertoire in *Escherichia coli* for generation of monoclonal catalytic antibodies: Construction of a heavy chain variable region-specific cDNA library, Proc. Natl. Acad. Sci. USA vol. 86, pp. 5728-5732 (1989).
Schier et al., Isolation of Picomolar Affinity Anti-c-erbB-2 Single-chain Fv by Molecular Evolution of the Complementarity Determining Regions in the Center of the Antibody Binding Site, Journal of Molecular Biology vol. 263, pp. 551 (1996).
Scholtens et al., A histochemical study on the distribution of injected canine intestinal alkaline phosphatase in rat liver, Liver vol. 2(1), pp. 14-21 (1982).
Sclebusch et al., Production of a Single-Chain Fragment of the Murine Anti-Idiotypic Antibody ACA125 as Phage-Displayed and Soluble Antibody by Recombinant Phage Antibody Technique, Hybridoma vol. 16, pp. 47-52 (1997).
Sham et al., Statistical power and significance testing in large-scale genetic studies, Nature reviews, Genetics vol. 15, 335-346, doi:10.1038/nrg3706 (2014).
Simeoni et al., Insight into the mechanism of the peptide-based gene delivery system MPG: implications for delivery of siRNA into mammalian cells, Nucl. Acids Res. vol. 31, pp. 2717-2724 (2003).
Sippl et al., Threading thrills and threats, Structure vol. 4(1), pp. 15-19 (1996).
Smith et al., Genetic Engineering: Principles and Methods, Plenum Press (1981).
Smith, Biocomputing: informatics and genome projects, ed., Academic Press, (1993).
Song et al., Epitope Mapping of Ibalizumab, a Humanized Anti-CD4 Monoclonal Antibody with Anti-HIV-1 Activity in Infected Patients, Journal of Virology vol. 84, pp. 6935-6942 (2010).
Songsivilai and Lachmann, Bispecific antibody: a tool for diagnosis and treatment of disease, Clinical Experimental Immunology vol. 79, pp. 315-321 (1990).
Stahli et al., Distinction of Epitopes by Monoclonal Antibodies, Methods in Enzymology vol. 9, pp. 242-253 (1983).
Steinthorsdottir et al., Identification of low-frequency and rare sequence variants associated with elevated or reduced risk of type 2 diabetes. Nature genetics vol. 46, pp. 294-298 (2014).
Steirer et al., The asialoglycoprotein receptor regulates levels of plasma glycoproteins terminating with sialic acid alpha2,6-galactose., The Journal of Biological Chemistry vol. 284, pp. 3777-3783 (2009).
Stockert et al., IgA interaction with asialoglycoprotein receptor, PNAS vol. 79, pp. 6229-6231 (1982).

Stockert et al., Hepatic Binding Protein: The Protective Role of its Sialic Acid Residues, Science vol. 197, pp. 667-668 (1977).
Subbarao et al., pH-Dependent Bilayer Destabilization by an Amphipathic Peptide, Biochemistry vol. 26, pp. 2964-2972 (1987).
Szybalska & Szybalski, Genetics of Human Cell Lines, IV. DNA-Mediated Heritable Transformation of a Biochemical Trait, Proc. Natl. Acad. Sci. USA vol. 48, pp. 202 (1992).
Taylor et al., Human immunoglobuline transgenes undergo rearrangement, somatic mutation and class switching in mice that lack endogenous IgM, International Immunology vol. 6, pp, 579-591 (1994).
Taylor et al., A transgenic mouse that expresses a diversity of human sequence heavy and light chain immunoglobulins, Nucleic Acid Research vol. 20, pp. 6287-6295 (1992).
Thompson et al. CLUSTAL W: improving the sensitivity of progressive multiple sequence alignment through sequence weighting, position-specific gap penalties and weight matrix choice, Nucleic Acids Res, vol. 22, pp, 4673-4680 (1994).
Thompson et al., Affinity Maturation of a High-Affinity Human Monoclonal Antibody Against the Third Hypervariable Loop of Human Immunodeficiency Virus: Use of Phase Display to Improve Affinity and Broaden Strain Reactivity, Journal of Molecular Biology vol. 256, pp. 7-88 (1996).
Thornton et al., Prediction of progress at last, Nature vol. 354, pp. 105 (1991).
Timms KM, Wagner S, Samuels ME, et al. A mutation in PCSK9 causing autosomal-dominant hypercholesterolemia in a Utah pedigree. Human genetics vol. 114, pp. 349-353 (2004).
Tomizuka et al., Functional expression and germline transmission of a human chromosome fragment in chimaeric mice, Nature Genetics vol. 16, pp. 133-143 (1997).
Tomizuka et al., Double trans-chromosomic mice: Maintenance of two individual human chromosome fragments containing Ig heavy and κ loci and expression of fully human antibodies, Proceedings of the National Academy of Sciences USA vol. 97, pp. 722-727 (2000).
Tozawa et al., Asialoglycoprotein receptor deficiency in mice lacking the major receptor subunit. It's obligate requirement for the stable expression of oligomeric receptor, The Journal of Biological Chemistry vol. 276, pp. 12624-12628 (2001).
Trufert et al., Synthesis, Purification and Characterization of Two Peptide-Oligonucleotide Conjugates as Potential Artificial Nucleases, Tetrahedron vol. 52, pp. 3005 (1996).
Tsuda et al., Inactivation of the Mouse HPR Locus by a 203-bp Retroposon Insertion and a 55-kb Gene-Targeted Deletion: Establishment of New HPRT-Deficient Mouse Embryonic Stem Cell Lines, Genomics vol. 42, pp. 413-421 (1997).
Tuaillon et al., Biased Utilization of $D_{HQ52}$ and $J_H4$ Gene Segments in a Human Ig Transgenic Minilocus is Independent of Antigenic Selection, Journal of Immunology vol. 152, pp. 2912-2920 (1994).
Tuaillon et al., Human immunoglobulin heavy-chain minilocus recombination in transgenic mice: Gene-segment use in μ and γ transcripts, Proceedings of the National Academy of Sciences USA vol. 90, pp. 3720-3724 (1993).
Tuin et al., On the role and fate of LPS-dephosphorylating activity in the rat liver, American Journal of Physiology Gastrointestinal and Liver Physiology vol. 290, pp. 377-385 (2006).
Turk et al., Characterization of a novel pH-sensitive peptide that enhances drug release from folate-targeted liposomes at endosomal pHs, Biochem. Biophys. Acta, vol. 1559, pp. 56-68 (2002).
Urlaub et al., Isolation of Chinese hamster cell mutants deficient in dihydrofolate reductase activity, Proc. Natl. Acad. Sci. USA vol. 77, pp. 4216-4220 (1980).
Van Den Hamer et al., Physical and chemical studies on ceruloplasmin. IX. The role of galactosyl residues in the clearance of ceruloplasmin from the circulation, The Journal of biological chemistry vol. 245, pp. 4397-4402 (1970).
Varret et al., A third major locus for autosomal dominant hypercholesterolemia maps to 1p34.1-p32, American journal of human genetics vol. 64, pp. 1378-1387 (1999).
Vaughan et al., Human antibodies by design, Nature Biotechnology vol. 16, pp. 535-539 (1998).

(56) References Cited

OTHER PUBLICATIONS

Vogel et al., Peptide-Mediated Release of Folate-Targeted Liposome Contents from Endosomal Compartments, J. Am. Chem. Soc. vol. 118, pp. 1581-1586 (1996).
Von Heinje, Sequence analysis in molecular biology, Academic Press, (1987).
Voss et al., The role of enhancers in the regulation of cell-type-specific transcriptional control, Trends Biochem. Sci. vol. 11, pp. 287 (1986).
Walder et al., Oligodeoxynucleotide-directed mutagenesis using the yeast transformation system, Gene vol. 42, pp. 133 (1986).
Ward et al., Binding activities of a repertoire of single immunoglobulin variable domains secreted from *Escherichia coli* Nature vol. 341, pp. 544-546 (1989).
Wei et al., Lactoferrin-modified PEGylated liposomes loaded with doxorubicin for targeting delivery to hepatocellular carcinoma, International Journal of Nanomedicine vol. 10, pp. 5123-5137 (2015).
Weigel et al., Galactosyl and N-acetylgalactosaminyl homeostasis: a function for mammalian asialoglycoprotein receptors, BioEssays: news and reviews in molecular, cellular and developmental biology vol. 16, pp. 519-524 (1994).
Wigler et al., Transfer of Purified Herpes Virus Thymidine Kinase Gene to Cultured Mouse Cells, Cell vol. 11, pp. 223 (1977).
Willer et al., Discovery and refinement of loci associated with lipid levels, Nature genetics vol. 45, pp. 1274-1283 (2013).
Willer et al., METAL: fast and efficient meta-analysis of genome wide association scans, Bioinformatics vol. 26, pp. 2190-2191 (2010).
Wilson et al., The Structure of a Antigenic Determinant in a Protein, Cell vol. 37, pp. 767 (1984).
Windler et al., The human asialoglycoprotein receptor is a possible binding site for low-density lipoproteins and chylomicron remnants, Biochem J vol. 276, pp. 79-87 (1991).
Winter et al., Making Antibodies by Phase Display Technology, Annu. Rev. Immunol. vol. 12, pp. 433-455 (1994).
Winter et al., Humanized antibodies, TIPS vol. 14, pp. 139 (1993).
Wu et al;, Delivery systems for gene therapy, Biotherapy vol. 3, pp. 87-95 (1991).
Yang et al., Hypomorphic sialidase expression decreases serum cholesterol by downregulation of VLDL production in mice, Journal of Lipid Research vol. 53, pp. 2573-2585 (2012).
Yang et al., CDR Walking Mutagenesis for the Affinity Maturation of a Potent Human Anti-HIV-1 Antibody into the Picomolar Range, Journal of Molecular Biology vol. 254, pp. 392-403 (1995).
Zapata et al., Engineering linear F(ab')$_2$ fragments for efficient production in *Escherichia coli* and enhanced antiproliferative activity, Protein Eng. vol. 8, pp. 1057-1062 (1995).
Zhang et al., Humanization of an anti-human TNF-60 antibody by variable region resurfacing with the aid of molecular modeling, Molecular Immunology vol. 42(12), pp. 1445-1451 (2005).
Zupnick et al., Mutational Analysis of the p53 Core Domain L1 Loop, Journal of Biological Chemistry vol. 281(29), pp. 20464-20473 (2006).
CCP4, The CCP4 suite: programs for protein crystallography, Acta crystallographica vol. 50, pp. 760-763 (1994).
Weigel et al., Glycans as endocytosis signals: the cases of the asiaglycoprotein and hyaluronan/chondroitin sulfate receptors, Biochimica et biophysica acta vol. 1572, pp. 341-363 (2002).
Alting-Mees et al., Monoclonal Antibody Expression Libraries: A Rapid Alternative to Hybridisms Strategies in Molecular Biology vol. 3, 1990).
Andrews et all Fragmentation of Immunoglobulin G, Current Protocols in Immunology, Unit 2.10A John Wiley & Sons (1997).
Aplin et al., Preparation, Properties, and Applications of Carbohydrate Conjugates of Proteins and Lipids, CRC Critical Reviews in Biochemistry, pp. 259-306, May 1981.
Ashkenazi et al., Protection Against Endotoxic Shock by a Tumor Necrosis Factor Receptor Immunoadhesin, Proceedings of the National Academy of Sciences USA, vol. 88, pp. 10535-10539, Dec. 1991.
Ashwell et al., "Carbohydrate-Specific Receptors of the Liver," Annual Review of Biochemistry, vol. 51, pp. 531-554. 1982.
Ausubel et al., Table of Contents of "Current Protocols in Molecular Biology," Book: Short Protocols in Molecular Biology, 2 ed., Greene Publishing Associates and John Wiley & Sons, 1992.
Baum et al., "Molecular Characterization of Murine and Human OX40/OX40 Ligand Systems: Identification of a Human OX40 Ligand as the HTLV-1-Regulated Protein GP34," The EMBO Journal, vol. 13, No. 17, pp. 3992-4001, 1994.
Bird et al., "Single-Chain Antigen-Binding Proteins," Science, vol. 242, pp. 423-426, 1988.
Bishop, Table of Contents of Guide to Huge Computers, ed., Academic Press, (1994).
Born, R., Benefit and Application of Antibodies Against the HI Carbohydrate Recognition Domain of the Human Hepatic Asialoglycoprotein Receptor High Yield Recombinant Production of the HI Carbohydrate Recognition Domain and Production and Characterization of Murine Monoclonal and Chicken Polyclonal Antibodies, Thesis, (2005).
Bloom et al., "Intrachain Disulfide Bond in the Core Hinge Region of Human IgG4," Protein Science, vol. 6, pp. 407-415, 1997.
Bowie et al., "A Method to Identify Protein Sequences That Fold Into a Known Three-Dimensional Structure," Science, vol. 253, pp. 164-170, Jul. 12, 1991.
Branden et al., Table of Contents of "Introduction to Protein Structure," Garland Publishing, Inc., 6 pages, 1991.
Burton et al., "Human Antibodies from Combinatorial Libraries," Advances in Immunology, vol. 57, pp. 191-280, 1994.
Byrn et al., "Biological Properties of a CD4 Immunoadhesion," Nature, vol. 344, pp. 667-670, Apr. 12, 1990.
Cao et al, "Characterization of a Single-Chain Variable Fragment (scFv) Antibody Directed Against the Human Asialoglycoprotein Receptor," Biotechnology and Applied Biochemistry, vol. 44, No. 2, pp. 65-72, 2006.
Carrillo, et al., "The Multiple Sequence Alignment Problem in Biology," SIAM Journal on Applied Mathematics, vol. 48,, No. 5, pp. 1073-1082, Oct. 5, 1988.
Dracopoli et al. (eds), Table of Contents of Current Protocols in Human Genetics, John Wiley & Sons (1994).
Fieser et al., Table of Contents of Fieser and Fieser's Reagents for Organic Synthesis, John Wiley and Sons (1994).
Gu et al. The asialoglycoprotein receptor suppresses the metastasis of hepatocellular carcinoma via LASS2-mediated inhibition of V-ATPase activity, Cancer Letters, vol. 379, pp. 107-116, (2016).
Harding et al., "Class Switching in Human Immunoglobulin Transgenic Mice," Annals of the New York Academy of Sciences, vol. 764, pp. 536-546, 1995.
International Preliminary Report on Patentability received in International Patent Application No. PCT/US2016/054222, dated Apr. 3, 2018.
International Search Report and Written Opinion received in International Patent Application No. PCT/US2016/054222, dated Mar. 10, 2017.
International Search Report and Written Opinion, dated Feb. 5, 2018, received in International Patent Application No. PCT/US2017/048757.
Kohgo, Y., et al., Production and Characterization of Specific Asialoglycoprotein Receptor Antibodies, Hybridoma, vol. 12, No. 5, pp. 591-598, (1993).
Kriegler, M., Table of Contents of Gene Transfer and Expression, A Laboratory Manual, Stockton Press (1990).
Massarelli et al., "Three-Dimensional Models of the Oligomeric Human Asialoglycoprotein Receptor (ASGP-R)", International Journal of Molecular Sciences, vol. 11, No. 10, pp. 3867-3884, 2010.
Molecular Operating Environment (MOE), 08, Chemical Computing Group, Inc., (2013).
Paris et al. ASGR1 expressed by porcine enriched liver sinusoidal endothelial cells mediates human platelet phagocytosis in vitro, Xenotransplantation vol. 18, pp. 245-251, (2011).
Park et al, "Detection of Surface Asialoglycoprotein Receptor Expression in Hepatic and Extra-Hepatic Cells Using a Novel Monoclonal Aantibody," Biotechnology Letters, vol. 28. No. 14, pp. 1061-1069, 2006.

(56) References Cited

OTHER PUBLICATIONS

Sabrautzki et al., "New Mouse Models for Metabolic Bone Disease Generated by ENU Mutagenesis Genome-Wide ENU Mutagenesis," Mammalian Genome, vol. 23, pp. 416-430, 2012.

Shimada, M. A monoclonal antibody to rat asialoglycoprotein receptor that recognizes an epitope specific to its major subunit, Hepatology Research, vol. 26, No. 1, pp. 55-60, (2003).

Stefanescu, R. et al., Epitope Structure of the Carbohydrate Recognition Domain of Asialoglycoprotein Receptor to a Monoclonal Antibody Revealed by High-Resolution Proteolytic Excision Mass Spectrometry, Journal of the American Society for Mass Spectrometry, vol. 22, No. 1, pp. 148-157, 2011.

Tamura et al., "Structural Correlates of an Anticarcinoma Antibody: Identification of Specificity-Determining Residues (SDRs) and Development of a Minimally Immunogenic Antibody Variant by Retention of SDRs Only," The Journal of Immunology, vol. 164, No. 3, pp. 1432-1441, 2000.

Trahtenherts et al., "An Internalizing Antibody Specific for the Human Asialoglycoprotein Receptor", Hybridoma, vol. 28, No. 4, pp. 225-233, Nov. 4, 2009.

Wang et al., "Screening of Specific Single-Chain Variable-Fragment (scFv) Antibody Against Human Asialoglycoprotein Receptor by Capture Phage Enzyme-Linked Immunosorbent Assay," African Journal of Biotechnology, pp. 1919-1925, 2011.

Ward, E. et al. Chapter 3, Genetic Manipulation and Expression of Antibodies, Monoclonal Antibodies: Principles and Applications, Birch et al., (eds.), pp. 137-185, Wiley-Liss, Inc. (1995).

Wigler et al., "Transformation of Mammalian Cells with an Amplifiable Dominant-Acting Gene," Proceedings of the National Academy of Sciences USA, vol. 77, No. 6, pp. 3567-3570, Jun. 1980.

Yamamato, T et al,, Serial incorporation of a monovalent GaINAc phosphoramidite unit into hepatocyte-targeting antisense oligonucleotides, Bioorganic & Medicinal Chemistry, vol. 24, pp. 26-32, (2016).

Yang, et al. Kukoamine B promotes TLR4-independent lipopolysaccharide uptake in murine hepatocytes, Oncotarget, vol. 7, No. 36, pp. 57948-57510, (2016).

Yang et al. Antisense oligonucleotides targeted against asialoglycoprotein receptor 1 block human hepatitis B virus replication, Journal of Viral Hepatitis, vol. 13, pp. 158-165, (2006).

Zeng et al., "A Specific Antibody to the Carbohydrate Recognition Domain of the Asialoglycoprotein Receptor RHL1 Subunit Does Not React with RHL2/3 But Blocks Ligand Binding," Biochemical and Biophysical Research Communications, vol. 249, No. 1, pp. 236-240, 1998.

* cited by examiner

Figure 1A

ASGR1 Full Seq Multiple Sequence Alignment

Figure 1B

Human ASGR1 Sequence Alignment

Figure 3

Human ASGR1 vs Human ASGR2v2 Alignment

Figure 5
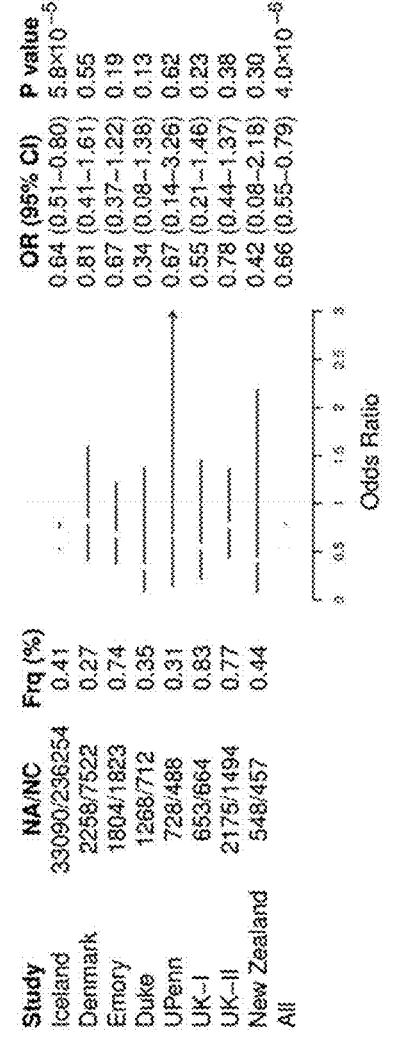
A.
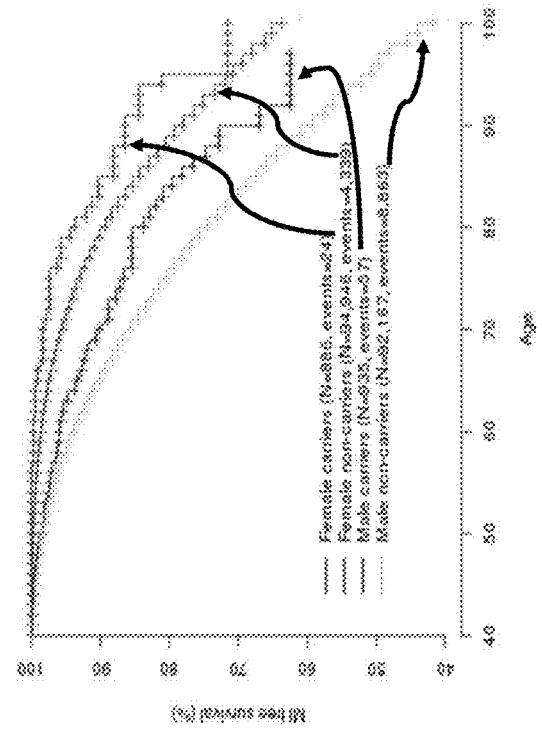
B.

Figure 8
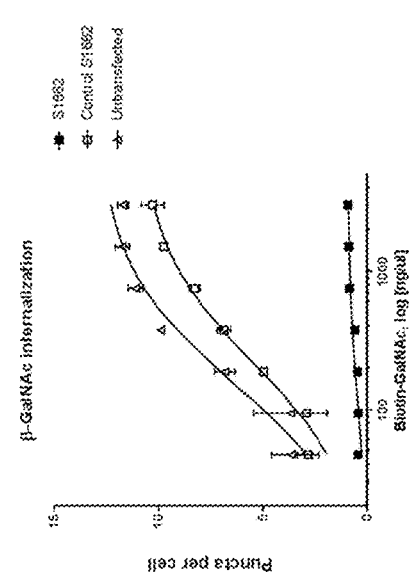
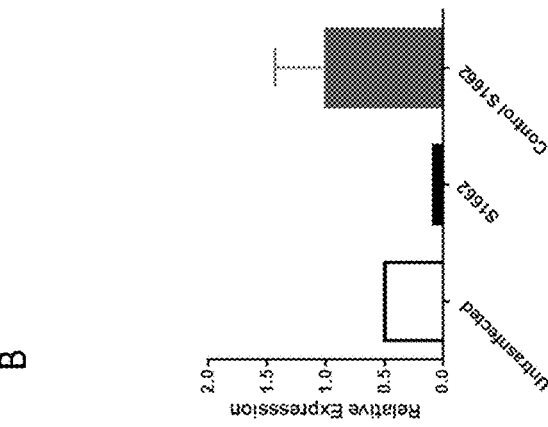
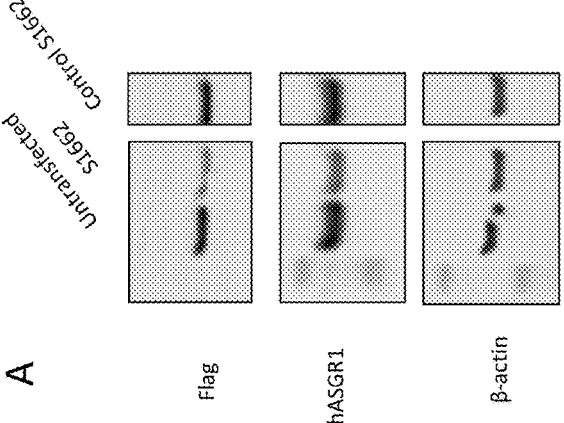

Figure 9
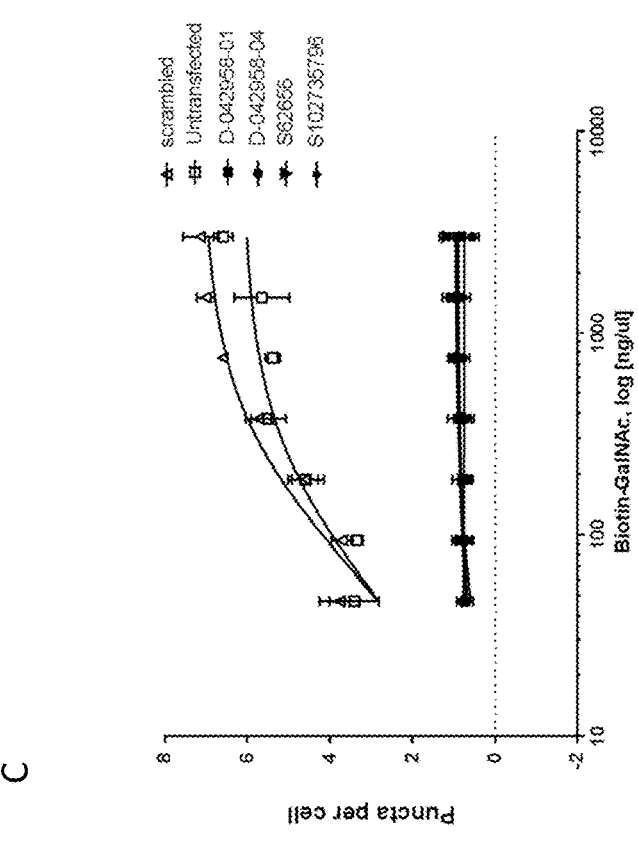
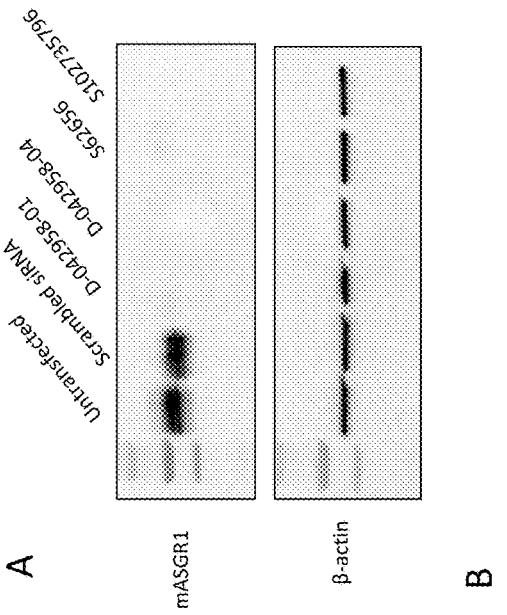
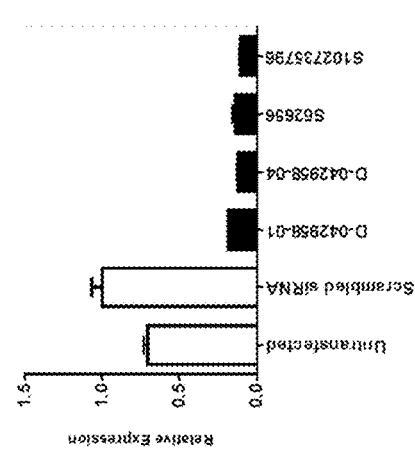

Figure 10
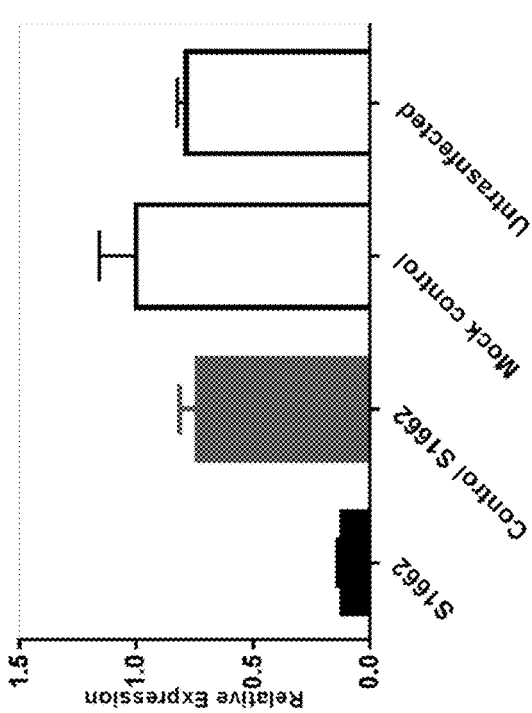
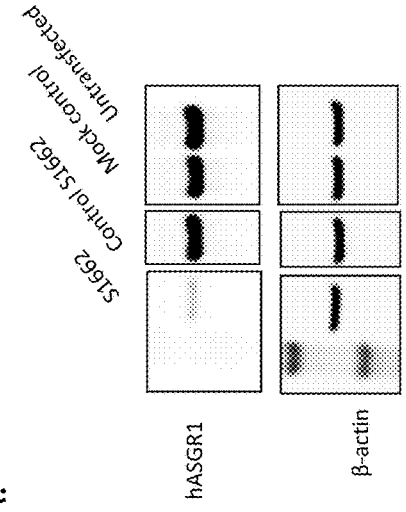

Figure 11
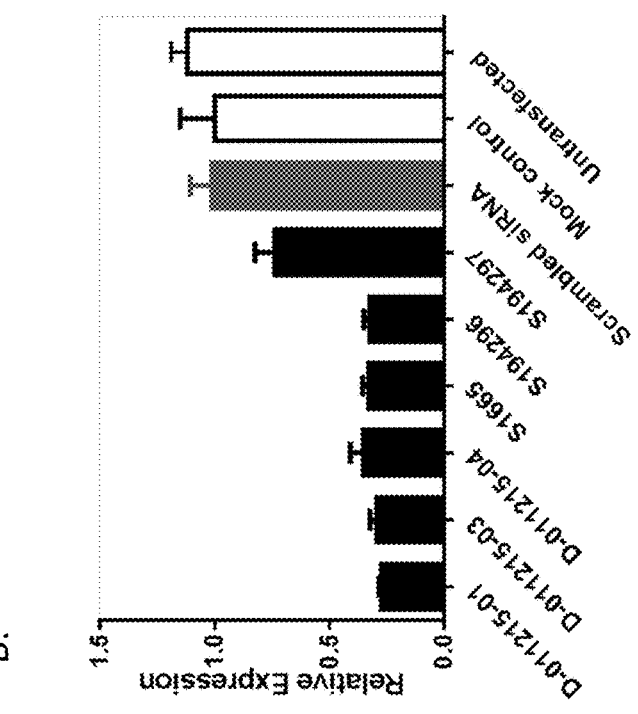
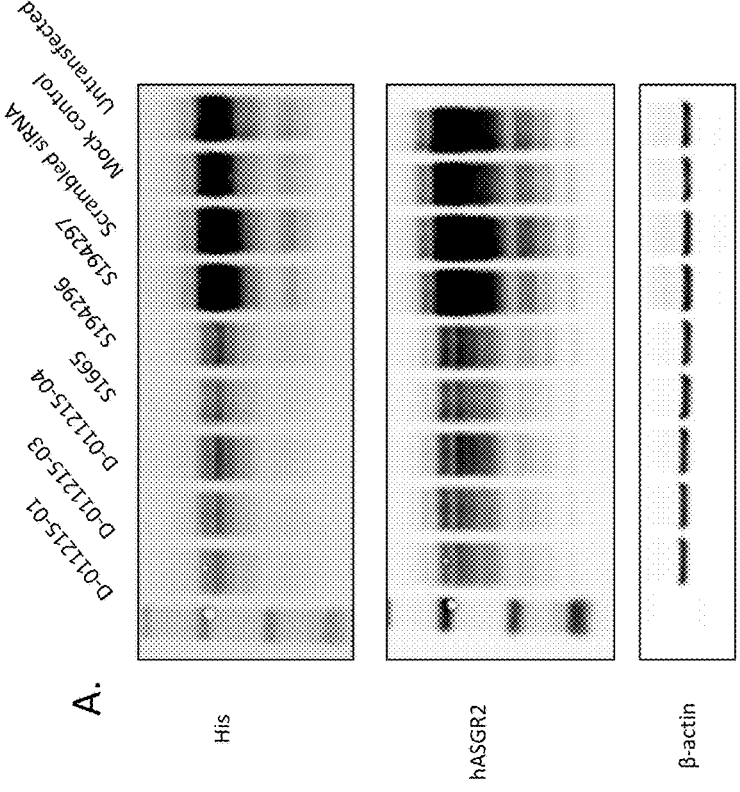

Figure 13
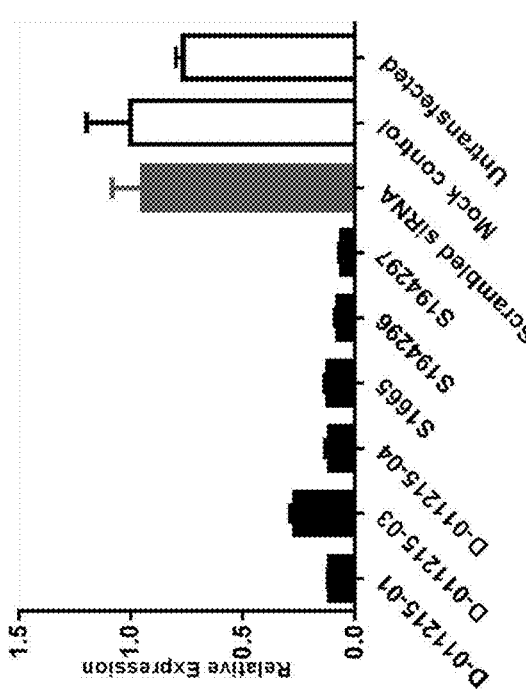
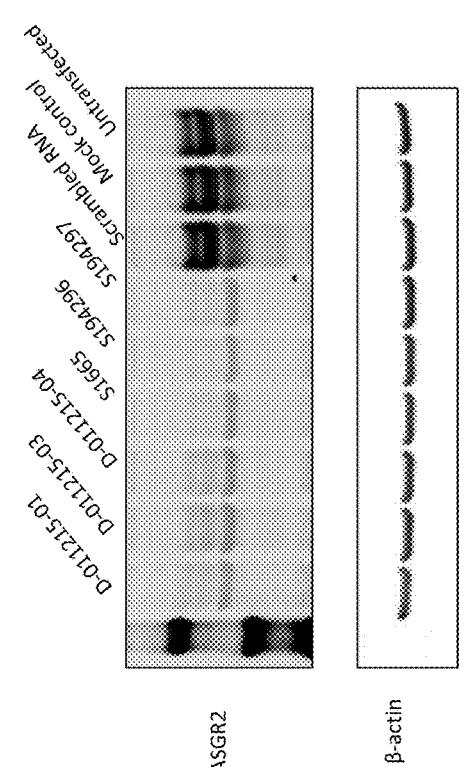

Figure 14
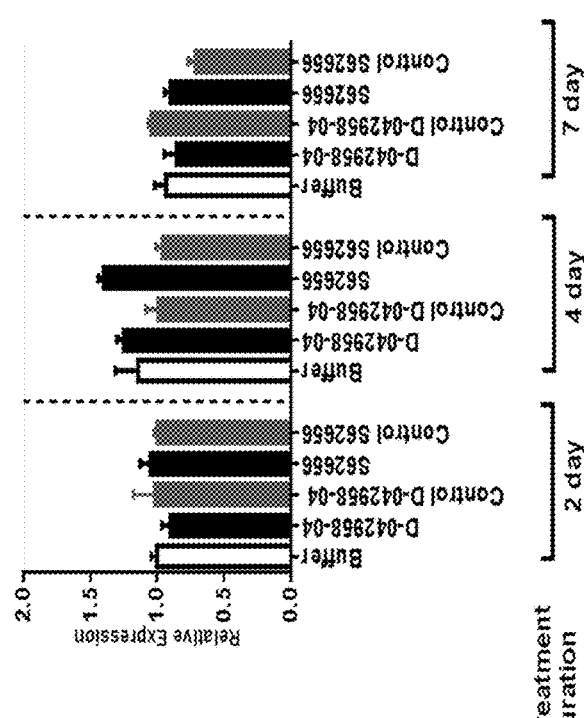
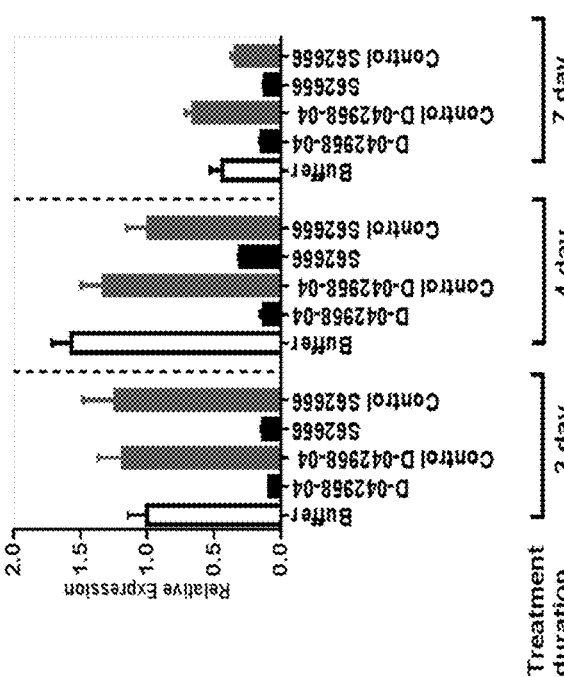

Figure 16
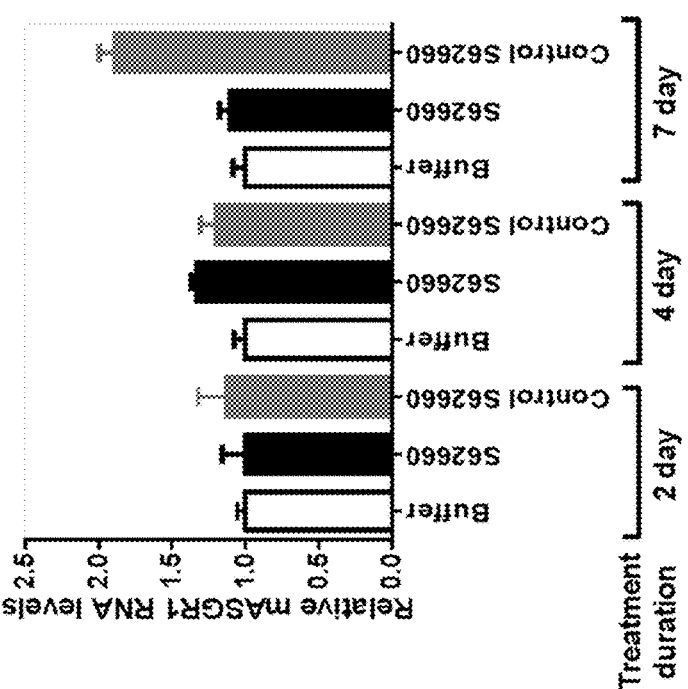
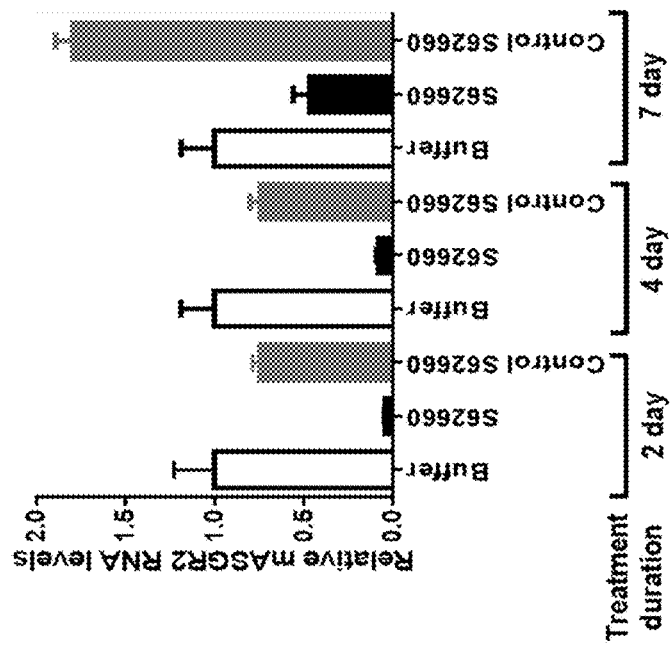

Figure 18
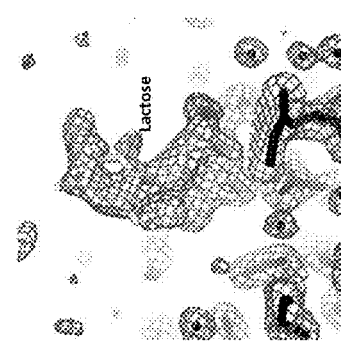
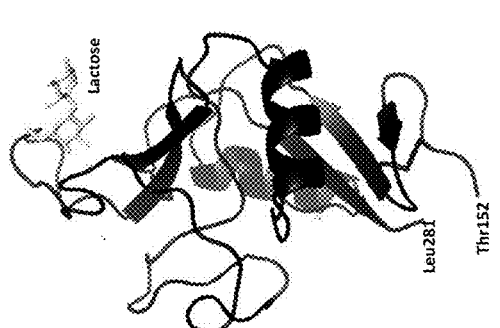
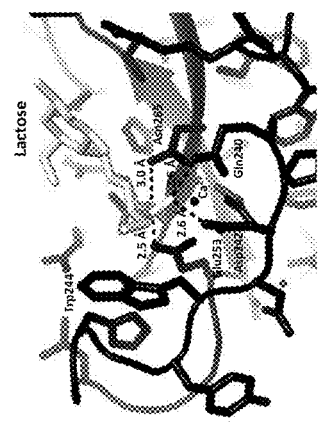

Figure 19
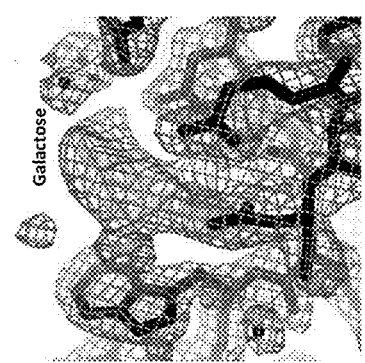
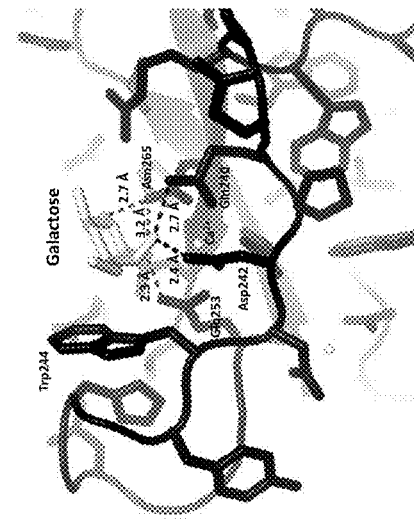
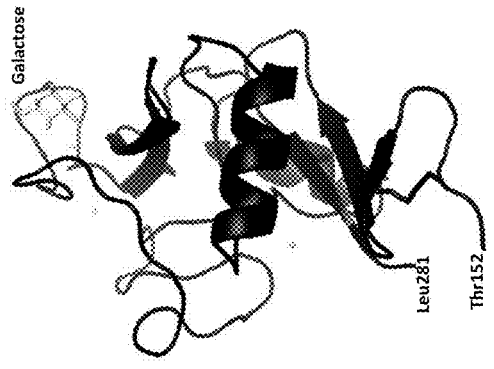

Figure 21
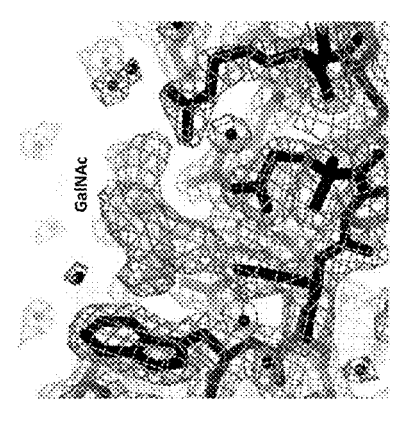
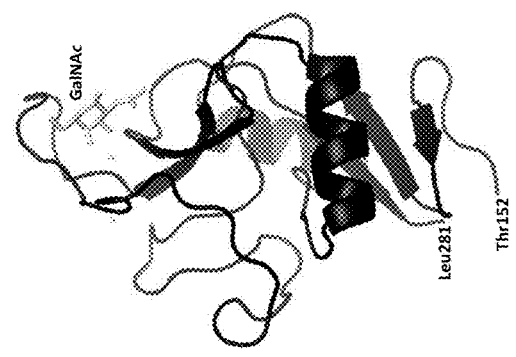
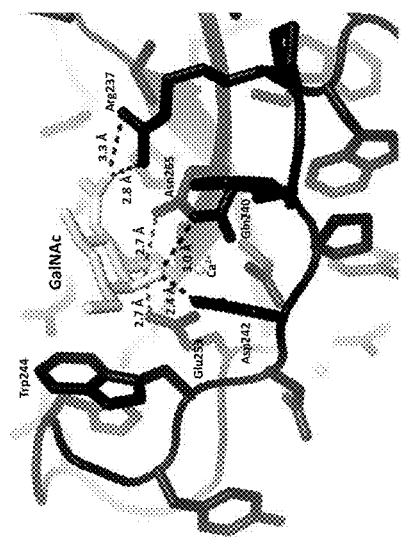

Figure 22
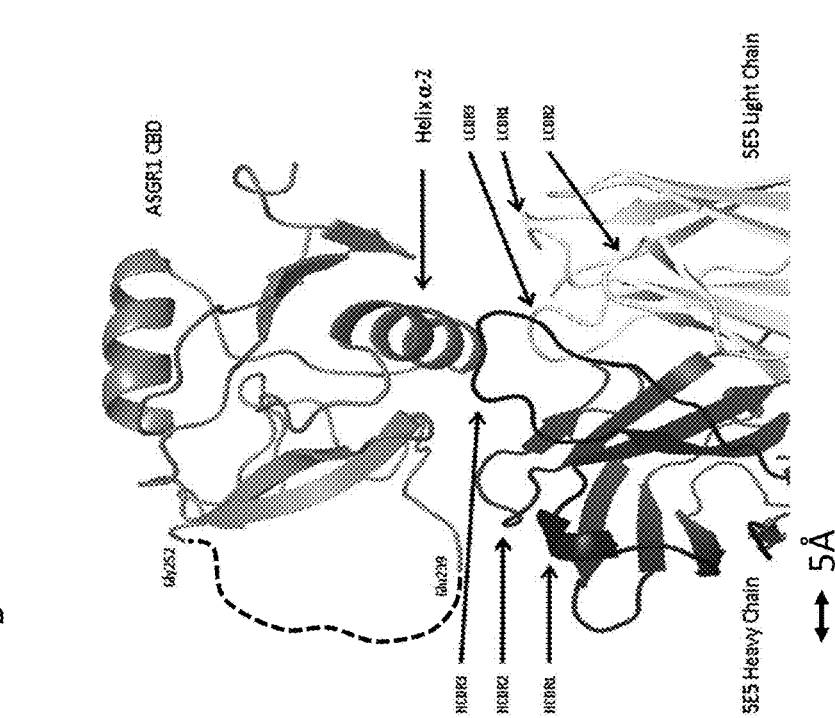
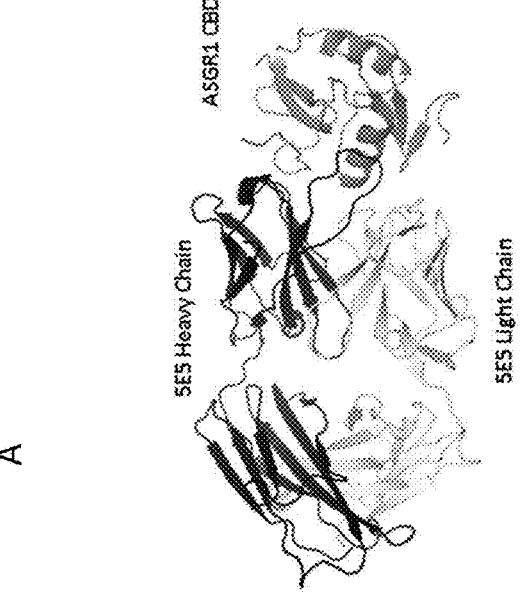

Figure 37
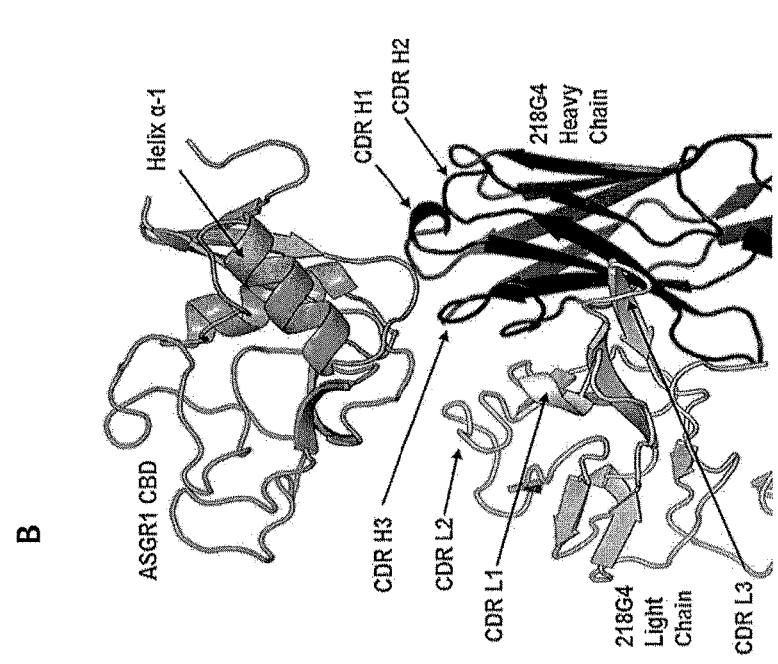
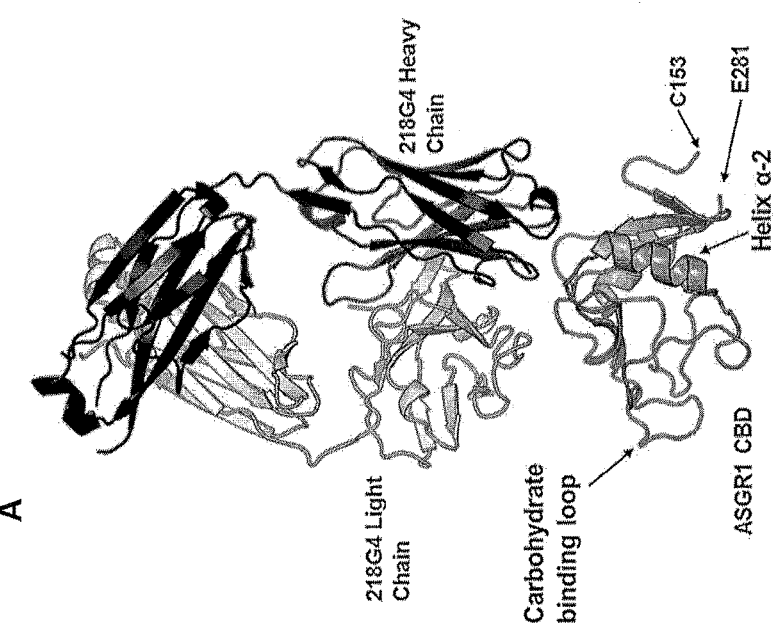

Data expressed as % change from baseline

FIGURE 48

Table 1

Immunogens

| Name | Sequence Range | Tags | Amino Acid Sequence | Vector | SEQ ID NO: |
|---|---|---|---|---|---|
| muASGR1 | 1-284 | TCE | MTKDYQDFQHLDNDNDHHQLRRGPPPTPRLLQRLCSGSRLLLSSSLSILLLVVVCVITSQNSQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPYRWVCETKLDKAN | pTT5 | 1 |
| muAsgr2 | 1-301 | TCE | MEKDCQDHQQLDSEENDHQLSGDDEHGSHVQDPRIENPHWKGGPLSRPFPQRLCSTFRLSLLALAFNILLLVVICVVSSQSIQLQEEFRTLKETFSNFSSSTLMEFGALDTLGGSTNAILTSWLAGLEEKQQQLKADHSTLLFHLKHFPMDLRTLTCQLAYFGSNGTECCPVNWVEFGGSCYWFSRDGLTWAEADQYCQLENAHLLVNSREEQDFVYKHRSQFHWIGLTDRDGSWKWVDGTDYRSNYRNWAFTQPDNWQGHEQGGGEDCAEILSDGHWNDNFCQQVNRWVCEKRRNITH | pTT5 | 2 |
| muASGR1(ECD) | 63-284 | TCE | SQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPYRWVCETKLDKAN | pSLX235a | 3 |
| muASGR1(CBD) | 153-284 | TCE | CPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPYRWVCETKLDKAN | pSLX235a | 4 |
| huASGR1 | 1-291 | TCE | MTKEYQDLQHLDNEESQHHHQLRKGPPPPQPLLQRLCSGPRLLLLSLGLSLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL | pTT5 | 5 |
| huASGR2 | 1-287 | TCE | MAKDFQDIQQLSSEENDHPFHQGPPPAQPLAQRLCSMVCFSLLALSFNILLLVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQYYRWVCEKRRNATGEVA | pTT5 | 6 |
| huASGR1(ECD) | 64-291 | TCE | SQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL | pSLX235a | 7 |
| huASGR1(CBD) | 154-291 | TCE | CPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL | pSLX235a | 8 |

FIGURE 48
(Continued)

| | | | | |
|---|---|---|---|---|
| huASGR2(ECD) | 61-287 | TCE | QSAQLQAELRSLKEAFSNFSSSTLTEVQAISTHGGSVGDKITSLGAKLEKQQQDLKADHDALLFHLKHFPVDLRFV ACQMELLHSNGSQRTCCPVNWVEHQGSCYWFSHSGKAWAEAEKYCQLENAHLVVINSWEEQKFIVQHTNPFN TWIGLTDSDGSWKWVDGTDYRHNYKNWAVTQPDNWHGHELGGSEDCVEVQPDGRWNDDFCLQVYRWVCEK RRNATGEVA | pSLX235a |
| huASGR2(CBD) | 153-287 | TCE | CPVNWVEHQGSCYWFSHSGKAWAEAEKYCQLENAHLVVINSWEEQKFIVQHTNPFNTWIGLTDSDGSWKWVD GTDYRHNYKNWAVTQPDNWHGHELGGSEDCVEVQPDGRWNDDFCLQVYRWVCEKRRNATGEVA | pSLX235a | 10 |

Structural Work

| Name | Sequence Range | Tags | Amino Acid Sequence | Vector | |
|---|---|---|---|---|---|
| M::huASGR1(154-281) | 154-281 | None | MCPVNWVEHERSCYWFSRSGKAWADADNYCRLEDAHLVVVTSWEEQKFVQHHIGPVNTWMGLHDQNGPWK WVDGTDYETGFKNWRPEQPDDWYGHGLGGGEDCAHFTDDGRWNDDVCQRPYRWVCETEL | pET21a | 11 |
| M::huASGR1(148-291) | 148-291 | None | MGSERTCCPVNWVEHERSCYWFSRSGKAWADADNYCRLEDAHLVVVTSWEEQKFVQHHIGPVNTWMGLHDQ NGPWKWVDGTDYETGFKNWRPEQPDDWYGHGLGGGEDCAHFTDDGRWNDDVCQRPYRWVCETELDKASQ EPPLL | pET21a | 12 |
| MA::huASGR1(148-291) | 148-291 | None | MAGSERTCCPVNWVEHERSCYWFSRSGKAWADADNYCRLEDAHLVVVTSWEEQKFVQHHIGPVNTWMGLHD QNGPWKWVDGTDYETGFKNWRPEOPDDWYGHGLGGGEDCAHFTDDGRWNDDVCQRPYRWVCETELDKAS QEPPLL | pET21a | 13 |
| MA::huASGR1(154-281) | 154-281 | None | MACPVNWVEHERSCYWFSRSGKAWADADNYCRLEDAHLVVVTSWEEQKFVQHHIGPVNTWMGLHDQNGPW KWVDGTDYETGFKNWRPEQPDDWYGHGLGGGEDCAHFTDDGRWNDDVCQRPYRWVCETEL | pET21a | 14 |
| MA::huASGR1(60-153) | 60-153 | None | MAGSQNSQLQEELRGLRETFSNFTASTEAQVKGLSTQGGNVGRKMKSLESQLEKQQKDLSEDHSSLLLHVKQF VSDLRSLSCQMAALQGNGSERTC | pET21a | 15 |
| MA::huASGR1(60-291) | 60-291 | None | MAGSQNSQLQEELRGLRETFSNFTASTEAQVKGLSTQGGNVGRKMKSLESQLEKQQKDLSEDHSSLLLHVKQF VSDLRSLSCQMAALQGNGSERTCCPVNWVEHERSCYWFSRSGKAWADADNYCRLEDAHLVVVTSWEEQKFV QHHHIGPVNTWMGLHDQNGPWKWVDGTDYETGFKNWRPEQPDDWYGHGLGGGEDCAHFTDDGRWNDDVCQ RPYRWVCETELDKASQEPPLL | pET21a | 16 |
| MA::huASGR1(62-153) | 62-153 | None | MAQNSQLQEELRGLRETFSNFTASTEAQVKGLSTQGGNVGRKMKSLESQLEKQQKDLSEDHSSLLLHVKQFVS DLRSLSCQMAALQGNGSERTC | pET21a | 17 |
| MA::huASGR1(58-153) | 58-153 | None | MAVIGSSQNSQLQEELRGLRETFSNFTASTEAQVKGLSTQGGNVGRKMKSLESQLEKQQKDLSEDHSSLLLHVKQ FVSDLRSLSCQMAALQGNGSERTC | pET21a | 18 |
| MA::huASGR1(58-143) | 58-143 | None | MAVIGSQNSQLQEELRGLRETFSNFTASTEAQVKGLSTQGGNVGRKMKSLESQLEKQQKDLSEDHSSLLLHVKQ FVSDLRSLSCQMAA | pET21a | 19 |
| MA::huASGR1(62-143) | 62-143 | None | MAQNSQLQEELRGLRETFSNFTASTEAQVKGLSTQGGNVGRKMKSLESQLEKQQKDLSEDHSSLLLHVKQFVS DLRSLSCQMAA | pET21a | 20 |
| MA::huASGR1(60-143) | 60-143 | None | MAGSQNSQLQEELRGLRETFSNFTASTEAQVKGLSTQGGNVGRKMKSLESQLEKQQKDLSEDHSSLLLHVKQF VSDLRSLSCQMAA | pET21a | 21 |

FIGURE 48
(Continued)

| | | | | |
|---|---|---|---|---|
| MA::huASGR1(60-282) | 60-282 | None | MAGSQNSQLQEELRGLRETFSNFTASTEAQVKGLSTQGGNVGRKMKSLESQLEKQQKDLSEDHSSLLLHVKQF VSDLRSLSCQMAALQGNGSERTCCPVNWVEHERSCYWFSRSGKAWADADNYCRLEDAHLVVVTSWEEQKFV QHHIGPVNTWMGLHDQNGPWKWVDGTDYETGFKNWRPEQPDDWYGHGLGGGEDCAHFTDDGRWNDDVCQ RPYRWVCETELD | pET21a | 22 |
| MA::huASGR1(62-291) | 62-291 | None | MAQNSQLQEELRGLRETFSNFTASTEAQVKGLSTQGGNVGRKMKSLESQLEKQQKDLSEDHSSLLLHVKQFVS DLRSLSCQMAALQGNGSERTCCPVNWVEHERSCYWFSRSGKAWADADNYCRLEDAHLVVVTSWEEQKFVQH HIGPVNTWMGLHDQNGPWKWVDGTDYETGFKNWRPEQPDDWYGHGLGGGEDCAHFTDDGRWNDDVCQRP YRWVCETELDKASQEPPLL | pET21a | 23 |
| MA::huASGR1(61-291) | 62-291 | None | MASQNSQLQEELRGLRETFSNFTASTEAQVKGLSTQGGNVGRKMKSLESQLEKQQKDLSEDHSSLLLHVKQFV SDLRSLSCQMAALQGNGSERTCCPVNWVEHERSCYWFSRSGKAWADADNYCRLEDAHLVVVTSWEEQKFVQ HHIGPVNTWMGLHDQNGPWKWVDGTDYETGFKNWRPEQPDDWYGHGLGGGEDCAHFTDDGRWNDDVCQR PYRWVCETELDKASQEPPLL | pET21a | 24 |
| MA::huASGR1(58-291) | 58-291 | None | MAVIGSQNSQLQEELRGLRETFSNFTASTEAQVKGLSTQGGNVGRKMKSLESQLEKQQKDLSEDHSSLLLHVKQ FVSDLRSLSCQMAALQGNGSERTCCPVNWVEHERSCYWFSRSGKAWADADNYCRLEDAHLVVVTSWEEQKF VQHHIGPVNTWMGLHDQNGPWKWVDGTDYETGFKNWRPEQPDDWYGHGLGGGEDCAHFTDDGRWNDDVC QRPYRWVCETELDKASQEPPLL | pET21a | 25 |
| MA::huASGR1(63-291) | 63-291 | None | MANSQLQEELRGLRETFSNFTASTEAQVKGLSTQGGNVGRKMKSLESQLEKQQKDLSEDHSSLLLHVKQFVSDL RSLSCQMAALQGNGSERTCCPVNWVEHERSCYWFSRSGKAWADADNYCRLEDAHLVVVTSWEEQKFVQHHI GPVNTWMGLHDQNGPWKWVDGTDYETGFKNWRPEQPDDWYGHGLGGGEDCAHFTDDGRWNDDVCQRPYR WVCETELDKASQEPPLL | pET21a | 26 |
| MA::huASGR2(59-287) | 59-287 | None | MAGSQSAQLQAELRSLKEAFSNFSSSTLTEVQAISTHGGSVGDKITSLGAKLEKQQDLKADHDALLFHLKHFPV DLRFVACQMELLHSNGSQRTCCPVNWVEHQGSCYWFSHSGKAWAEAEKYCQLENAHLVVINSWEEQKFVQH TNPFNTWIGLTDSDGSWKWVDGTDYRHNYKNWAVTQPDNWHGHELGGSEDCVEVQPDGRWNDDFCLQYR WVCEKRRNATGEVA | pET21a | 27 |
| MA::huASGR2(57-287) | 57-287 | None | MAVTGSQSAQLQAELRSLKEAFSNFSSSTLTEVQAISTHGGSVGDKITSLGAKLEKQQDLKADHDALLFHLKHF PVDLRFVACQMELLHSNGSQRTCCPVNWVEHQGSCYWFSHSGKAWAEAEKYCQLENAHLVVINSWEEQKFV QHTNPFNTWIGLTDSDGSWKWVDGTDYRHNYKNWAVTQPDNWHGHELGGSEDCVEVQPDGRWNDDFCLQV YRWVCEKRRNATGEVA | pET21a | 28 |
| MA::huASGR2(60-287) | 60-287 | None | MASQSAQLQAELRSLKEAFSNFSSSTLTEVQAISTHGGSVGDKITSLGAKLEKQQDLKADHDALLFHLKHFPVDL RFVACQMELLHSNGSQRTCCPVNWVEHQGSCYWFSHSGKAWAEAEKYCQLENAHLVVINSWEEQKFVQHTN PFNTWIGLTDSDGSWKWVDGTDYRHNYKNWAVTQPDNWHGHELGGSEDCVEVQPDGRWNDDFCLQYYRWV CEKRRNATGEVA | pET21a | 29 |
| MA::huASGR2(61-287) | 61-287 | None | MAQSQAQLQAELRSLKEAFSNFSSSTLTEVQAISTHGGSVGDKITSLGAKLEKQQDLKADHDALLFHLKHFPVDL RFVACQMELLHSNGSQRTCCPVNWVEHQGSCYWFSHSGKAWAEAEKYCQLENAHLVVINSWEEQKFVQHTN PFNTWIGLTDSDGSWKWVDGTDYRHNYKNWAVTQPDNWHGHELGGSEDCVEVQPDGRWNDDFCLQYYRWV CEKRRNATGEVA | pET21a | 30 |
| MA::huASGR2(62-287) | 62-287 | None | MASAQLQAELRSLKEAFSNFSSSTLTEVQAISTHGGSVGDKITSLGAKLEKQQQDLKADHDALLFHLKHFPVDLRF VACQMELLHSNGSQRTCCPVNWVEHQGSCYWFSHSGKAWAEAEKYCQLENAHLVVINSWEEQKFVQHTNPF NTWIGLTDSDGSWKWVDGTDYRHNYKNWAVTQPDNWHGHELGGSEDCVEVQPDGRWNDDFCLQVYRWVCE KRRNATGEVA | pET21a | 31 |

FIGURE 48
(Continued)

Complex Formation Assays

| Name | Sequence Range | Tags | Amino Acid Sequence | Vector | |
|---|---|---|---|---|---|
| huASGR1::GS::SNAP26f | 1-291 | SNAP26f | MTKEYQDLQHLDNEESDHHQLRKGPPPPQPLLQRLCSGPRLLLLSLGLSLLLLVVVCVIGSQNSQLQEELRGLRE TFSNFTASTEAQVKGLSTQGGNVGRKMKSLESQLEKQQKDLSEDHSSLLLHVKQFVSDLRSLSCQMAALQGNG SERTCCPVNWVEHERSCYWFSRSGKAWADADNYCRLEDAHLVVVTSWEEQKFVQHHGPVNTWMGLHDQNG PWKWVDGTDYETGFKNWRPEQPDDWYGHGLGGGEDCAHFTDDGRWNDDVCCQRPYRWVCETELDKASQEP PLLGSMDKDCEMKRTTLDSPLGKLELSGCEQGLHRIIFLGKGTSAADAVEVPAPAAVLGGPEPLMQATAWLNAYF HQPEAIEEFPVPALHHPVFQQESFTRQVLWKLLKVVKFGEVISYSHLAALAGNPAATAAVKTALSGNPVPILIPCHR VVQGDLDVGGYEGGLAVKEWLLAHEGHRLGKPGLG | pIRES_puro3.1 | 32 |
| huASGR1::GS::(G4S)3::SNAP26f | 1-291 | SNAP26f | MTKEYQDLQHLDNEESDHHQLRKGPPPPQPLLQRLCSGPRLLLLSLGLSLLLLVVVCVIGSQNSQLQEELRGLRE TFSNFTASTEAQVKGLSTQGGNVGRKMKSLESQLEKQQKDLSEDHSSLLLHVKQFVSDLRSLSCQMAALQGNG SERTCCPVNWVEHERSCYWFSRSGKAWADADNYCRLEDAHLVVVTSWEEQKFVQHHGPVNTWMGLHDQNG PWKWVDGTDYETGFKNWRPEQPDDWYGHGLGGGEDCAHFTDDGRWNDDVCCQRPYRWVCETELDKASQEP PLLGSGGGGSGGGGSGGGGSMDKDCEMKRTTLDSPLGKLELSGCEQGLHRIIFLGKGTSAADAVEVPAPAAVL GGPEPLMQATAWLNAYFHQPEAIEEFPVPALHHPVFQQESFTRQVLWKLLKVVKFGEVISYSHLAALAGNPAATA AVKTALSGNPVPILIPCHRVVQGDLDVGGYEGGLAVKEWLLAHEGHRLGKPGLG | pIRES_puro3.1, pJif1 | 33 |
| huASGR1::GS::CLIP | 1-291 | CLIP | MTKEYQDLQHLDNEESDHHQLRKGPPPPQPLLQRLCSGPRLLLLSLGLSLLLLVVVCVIGSQNSQLQEELRGLRE TFSNFTASTEAQVKGLSTQGGNVGRKMKSLESQLEKQQKDLSEDHSSLLLHVKQFVNTWEEQKFVQHHGPVNTWMGLHDQNG PWKWVDGTDYETGFKNWRPEQPDDWYGHGLGGGEDCAHFTDDGRWNDDVCCQRPYRWVCETELDKASQEP PLLGKLELSGCEQGLHRIIFLGKGTSAADAVEVPAPAAVLGGPEPLIQATAWLNAYF HQPEAIEEFPVPALHHPVFQQESFTRQVLWKLLKVVKFGEVISESHLAALVGNPAATAAVNTALDGNPVPILIPCH RVVQGDSDVGPYLGGLAVKEWLLAHEGHRLGKPGLG | pIRES_puro3.1, pJif1 | 34 |
| huASGR1::GS::(G4S)3::CLIP | 1-291 | CLIP | MTKEYQDLQHLDNEESDHHQLRKGPPPPQPLLQRLCSGPRLLLLSLGLSLLLLVVVCVIGSQNSQLQEELRGLRE TFSNFTASTEAQVKGLSTQGGNVGRKMKSLESQLEKQQKDLSEDHSSLLLHVKQFVSDLRSLSCQMAALQGNG SERTCCPVNWVEHERSCYWFSRSGKAWADADNYCRLEDAHLVVVTSWEEQKFVQHHGPVNTWMGLHDQNG PWKWVDGTDYETGFKNWRPEQPDDWYGHGLGGGEDCAHFTDDGRWNDDVCCQRPYRWVCETELDKASQEP PLLGSGGGGSGGGGSGGGGSMDKDCEMKRTTLDSPLGKLELSGCEQGLHRIIFLGKGTSAADAVEVPAPAAVL GGPEPLIQATAWLNAYFHQPEAIEEFPVPALHHPVFQQESFTRQVLWKLLKVVKFGEVISESHLAALVGNPAATAA VNTALDGNPVPILIPCHRVVQGDSDVGPYLGGLAVKEWLLAHEGHRLGKPGLG | pIRES_puro3.1 | 35 |
| huASGR2::GS::SNAP26f | 1-287 | SNAP26f | MAKDFQDIQQLSSEENDHPFHQGPPPAGPLAQRLCSMVCFSLLALSFNILLLVVVCVTGSQSAQLQAELRSLKEAF SNFSSSTLTEVQAISTHGGSVGDKITSLGAKLEKQQQDLKADHDALLFHLKHFPVDLRFVACQMELLHSNGSQRT CCPVNWVEHQGSCYWFSHSGKAWAAEAEKYCQLENAHLVVINSWEEQKFVQHTNPFNTWIGLTDSDGSWKWV DGTDYRHNYKNWAVTQPDNWHGHELGGSEDCVEVQPDGRWNDFCLQVYRWCEKRRNATGEVAGSMDKD CEMKRTTLDSPLGKLELSGCEQGLHRIIFLGKGTSAADAVEVPAPAAVLGGPEPLMQATAWLNAYFHQPEAIEEF PVPALHHPVFQQESFTRQVLWKLLKVVKFGEVISYSHLAALAGNPAATAAVKTALSGNPVPILIPCHRVVQGDLDV GGYEGGLAVKEWLLAHEGHRLGKPGLG | pIRES_puro3.1, pJif1 | 36 |

FIGURE 48
(Continued)

| Name | Range | Tag | Sequence | Vector | SEQ ID |
|---|---|---|---|---|---|
| huASGR2::GS::(G4S)3::SNAP26f | 1-287 | SNAP26f | MAKDFQDIQQLSSEENDHPFHQGPPAQPLAGRLCSMVCFSLLALSFNILLLVVICVTGSQSAQLQAELRSLKEAF SNFSSSTLTEVQAISTHGGSVGDKITSLGAKLEKQQQDLKADHDALLFHLKHFPVDLRFVACQMELLHSNGSQRT CCPVNWVEHQGSCYWFSHSGKAWAEAEKYCQLENAHLVVINSWEEQKFIVQHTNPFNTWIGLTDSDGSWKWV DGTDYRHNYKNWAVTQPDNWHGHELGGSEDCVEVQPDGRWNDDFCLQVYRWVCEKRRNATGEVAGSGGGG SGGGGSGGGGSMDKDCEMKRTTLDSPLGKLELSGCEQGLHRIIFLGKGTSAADAVEVPAPAAVLGGPEPLMQAT AWLNAYFHQPEAIEEFPVPALHHPVFQQESFTRQVLWKLLKVVKFGEVISYSHLAALAGNPAATAAVKTALSGNP VPILIPCHRVVQGDLDVGGYEGGLAVKEWLLAHEGHRLGKPGLG | pIRES_puro3.1 | 37 |
| huASGR2::GS::CLIP | 1-287 | CLIP | MAKDFQDIQQLSSEENDHPFHQGPPAQPLAGRLCSMVCFSLLALSFNILLLVVICVTGSQSAQLQAELRSLKEAF SNFSSSTLTEVQAISTHGGSVGDKITSLGAKLEKQQQDLKADHDALLFHLKHFPVDLRFVACQMELLHSNGSQRT CCPVNWVEHQGSCYWFSHSGKAWAEAEKYCQLENAHLVVINSWEEQKFIVQHTNPFNTWIGLTDSDGSWKWV DGTDYRHNYKNWAVTQPDNWHGHELGGSEDCVEVQPDGRWNDDFCLQVYRWVCEKRRNATGEVAGSMDKD CEMKRTTLDSPLGKLELSGCEQGLHRIIFLGKGTSAADAVEVPAPAAVLGNPAATAAVNTALDGNPVPILIPCHRVVQGDSDV GPYLGGLAVKEWLLAHEGHRLGKPGLG | pIRES_puro3.1, pJif1 | 38 |
| huASGR2::GS::(G4S)3::CLIP | 1-287 | CLIP | MAKDFQDIQQLSSEENDHPFHQGPPAQPLAGRLCSMVCFSLLALSFNILLLVVICVTGSQSAQLQAELRSLKEAF SNFSSSTLTEVQAISTHGGSVGDKITSLGAKLEKQQQDLKADHDALLFHLKHFPVDLRFVACQMELLHSNGSQRT CCPVNWVEHQGSCYWFSHSGKAWAEAEKYCQLENAHLVVINSWEEQKFIVQHTNPFNTWIGLTDSDGSWKWV DGTDYRHNYKNWAVTQPDNWHGHELGGSEDCVEVQPDGRWNDDFCLQVYRWVCEKRRNATGEVAGSGGGG SGGGGSGGGGSMDKDCEMKRTTLDSPLGKLELSGCEQGLHRIIFLGKGTSAADAVEVPAPAAVLGNPAATAAVNTALDGNP AWLNAYFHQPEAIEEFPVPALHHPVFQQESFTRQVLWKLLKVVKFGEVISESHLAALVGNPAATAAVNTALDGNP VPILIPCHRVVQGDSDVGPYLGGLAVKEWLLAHEGHRLGKPGLG | pIRES_puro3.1 | 39 |
| huASGR2(v4)::GS::SNAP26f | 1-306 | SNAP26f | MAKDFQDIQQLSSEENDHPFHQGEGPGTRRLNPRRGNPFLKGPPPAQPLAGRLCSMVCFSLLALSFNILLLVVIC VTGSQSAQLQAELRSLKEAFSNFSSSTLTEVQAISTHGGSVGDKITSLGAKLEKQQQDLKADHDALLFHLKHFPVD LRFVACQMELLHSNGSQRTCCPVNWVEHQGSCYWFSHSGKAWAEAEKYCQLENAHLVVINSWEEQKFIVQHT NPFNTWIGLTDSDGSWKWVDGTDYRHNYKNWAVTQPDNWHGHELGGSEDCVEVQPDGRWNDDFCLQVYRW VCEKRRNATGEVAGSMDKDCEMKRTTLDSPLGKLELSGCEQGLHRIIFLGKGTSAADAVEVPAPAAVLGGPEPL MQATAWLNAYFHQPEAIEEFPVPALHHPVFQQESFTRQVLWKLLKVVKFGEVISYSHLAALAGNPAATAAVKTAL SGNPVPILIPCHRVVQGDLDVGGYEGGLAVKEWLLAHEGHRLGKPGLG | pIRES_puro3.1, pJif1 | 40 |
| huASGR2(v4)::GS::(G4S)3::SNAP26f | 1-306 | SNAP26f | MAKDFQDIQQLSSEENDHPFHQGEGPGTRRLNPRRGNPFLKGPPPAQPLAGRLCSMVCFSLLALSFNILLLVVIC VTGSQSAQLQAELRSLKEAFSNFSSSTLTEVQAISTHGGSVGDKITSLGAKLEKQQQDLKADHDALLFHLKHFPVD LRFVACQMELLHSNGSQRTCCPVNWVEHQGSCYWFSHSGKAWAEAEKYCQLENAHLVVINSWEEQKFIVQHT NPFNTWIGLTDSDGSWKWVDGTDYRHNYKNWAVTQPDNWHGHELGGSEDCVEVQPDGRWNDDFCLQVYRW VCEKRRNATGEVAGSGGGGSGGGGSGGGGSMDKDCEMKRTTLDSPLGKLELSGCEQGLHRIIFLGKGTSAADA VEVPAPAAVLGGPEPLMQATAWLNAYFHQPEAIEEFPVPALHHPVFQQESFTRQVLWKLLKVVKFGEVISYSHLA ALAGNPAATAAVKTALSGNPVPILIPCHRVVQGDLDVGGYEGGLAVKEWLLAHEGHRLGKPGLG | pIRES_puro3.1 | 41 |
| huASGR2(v4)::GS::CLIP | 1-306 | CLIP | MAKDFQDIQQLSSEENDHPFHQGEGPGTRRLNPRRGNPFLKGPPPAQPLAGRLCSMVCFSLLALSFNILLLVVIC VTGSQSAQLQAELRSLKEAFSNFSSSTLTEVQAISTHGGSVGDKITSLGAKLEKQQQDLKADHDALLFHLKHFPVD LRFVACQMELLHSNGSQRTCCPVNWVEHQGSCYWFSHSGKAWAEAEKYCQLENAHLVVINSWEEQKFIVQHT NPFNTWIGLTDSDGSWKWVDGTDYRHNYKNWAVTQPDNWHGHELGGSEDCVEVQPDGRWNDDFCLQVYRW VCEKRRNATGEVAGSMDKDCEMKRTTLDSPLGKLELSGCEQGLHRIIFLGKGTSAADAVEVPAPAAVLGNPAATAAVNTALD QATAWLNAYFHQPEAIEEFPVPALHHPVFQQESFTRQVLWKLLKVVKFGEVISESHLAALVGNPAATAAVNTALD GNPVPILIPCHRVVQGDSDVGPYLGGLAVKEWLLAHEGHRLGKPGLG | pIRES_puro3.1 | 42 |

FIGURE 48
(Continued)

| | | | | | |
|---|---|---|---|---|---|
| huASGR2(v4)::GS::(G4S)3::CLIP | 1-306 | CLIP | MAKDFQDIQQLSSEENDHPFHQGEGPGTRRLNPRGRPGSTRRLNPRGNPFLKGPPPAQPLAQRLCSMVCFSLLALSFNILLLVVIC VTGSQSAQLQAELRSLKEAFSNFSSSTLTEVQAISTHGGSVGDKITSLGAKLEKQQQDLKADHDALLFHLKHFPVD LRFVACQMELLHSNGSQRTCCPVNMVEHQGSCYWFSHSGKAWAEAEKYCQLENAHLVVINSWEEQKFVQHT NPFNTWIGLTDSQGSWMKWVDGTDYRHNYKNWAYTQPDNWHGHELGGSEDCVEVQPDGRWNDFCLQVYRW VCEKRRNATGEVAGSGGGSGGGGSGGGGSMDKDCEMKRTTLDSPLGKLELSCCEQGLHRIFLGKGTSAADA VEVPAPAAVLGGPEPLIQATAWLNAYFHQPEAIEEFPVPALHHPVFQQESFTRQVLWKLLKVVKFGEVISESHLAA LVGNPAATAAVNTALDGNPVPILIPCHRVVQGDSDVGPYLGGLAVKEWLLAHEGHRLGKPGLG | pIRES_puro3.1 | 43 |
| | | | Mammalian Expression | | |
| huASGR1 | 1-291 | None | MTKEYQDLQHLDNEESDHHQLRKGPPPPQPLLQRLCSGPRLLLLSLGLSLLLLVVVCVIGSQNSQLQEELRGLRE TFSNFTASTEAQVKGLSTQGGNVGRKMKSLESQLEKQQKDLSEDHSSLLLHVKQFVSDLRSLSCQMAALQGNG SERTCCPVNWVEHERSCYWFSRSGKAWADADNYCRLEDAHLVVVTSWEEQKFVQHHIGPVNTWMGLHDQNG PWKWVDGTDYETGFKNWRPEQPDDWYGHGLGGGEDCAHFTDDGRWNDDVCQRPYRWVCETELDKASQEP PLL | pTT5, pSLX235a, pJIF1 | 44 |
| huASGR1(Y273C) | 1-291 | None | MTKEYQDLQHLDNEESDHHQLRKGPPPPQPLLQRLCSGPRLLLLSLGLSLLLLVVVCVIGSQNSQLQEELRGLRE TFSNFTASTEAQVKGLSTQGGNVGRKMKSLESQLEKQQKDLSEDHSSLLLHVKQFVSDLRSLSCQMAALQGNG SERTCCPVNWVEHERSCYWFSRSGKAWADADNYCRLEDAHLVVVTSWEEQKFVQHHIGPVNTWMGLHDQNG PWKWVDGTDYETGFKNWRPEQPDDWYGHGLGGGEDCAHFTDDGRWNDDVCQRPCRWVCETELDKASQEP PLL | pTT5, pSLX235a, pJIF1 | 45 |
| huASGR1::Flag | 1-291 | Flag | MTKEYQDLQHLDNEESDHHQLRKGPPPPQPLLQRLCSGPRLLLLSLGLSLLLLVVVCVIGSQNSQLQEELRGLRE TFSNFTASTEAQVKGLSTQGGNVGRKMKSLESQLEKQQKDLSEDHSSLLLHVKQFVSDLRSLSCQMAALQGNG SERTCCPVNWVEHERSCYWFSRSGKAWADADNYCRLEDAHLVVVTSWEEQKFVQHHIGPVNTWMGLHDQNG PWKWVDGTDYETGFKNWRPEQPDDWYGHGLGGGEDCAHFTDDGRWNDDVCQRPYRWVCETELDKASQEP PLLDYKDDDDK | pTT5, pSLX235a | 46 |
| huASGR1(Y273C)::Flag | 1-291 | Flag | MTKEYQDLQHLDNEESDHHQLRKGPPPPQPLLRRLCSGPRLLLLSLGLSLLLLVVVCVIGSQNSQLQEELRGLRE TFSNFTASTEAQVKGLSTQGGNVGRKMKSLESQLEKQQKDLSEDHSSLLLHVKQFVSDLRSLSCQMAALQGNG SERTCCPVNWVEHERSCYWFSRSGKAWADADNYCRLEDAHLVVVTSWEEQKFVQHHIGPVNTWMGLHDQNG PWKWVDGTDYETGFKNWRPEQPDDWYGHGLGGGEDCAHFTDDGRWNDDVCQRPCRWVCETELDKASQEP PLLDYKDDDDK | pTT5, pSLX235a | 47 |
| cyASGR1 | 1-291 | None | MTKEYQDLQHLDNEESDHHQLGKGPPPPQSLLRRLCSGPRLLLLSLGLSLLLLVVVCVIGSQNAQLQRELRGLRE TLSNFTASTEAQVKGLSTQGGNVGRKMKSLESQLEKQQKDLSEDHSSLLLHVKQFVSDLRSLSCQMAALQGNG SERACCPVNWVEHERSCYWFSRSGKAWADADNYCRLEDAHLVVVTSWEEQKFVQHHIGPVNTWMGLHDQNG PWKWVDGTDYETGFKNWRPEQPDDWYGHGLGGGEDCAHFTDDGRWNDDVCQRPYRWVCETELDKASQEP PLL | pTT5, pSLX235a | 48 |
| cyASGR1(Y273C) | 1-291 | None | MTKEYQDLQHLDNEESDHHQLGKGPPPPQSLLRRLCSGPRLLLLSLGLSLLLLVVVCVIGSQNAQLQRELRGLRE TLSNFTASTEAQVKGLSTQGGNVGRKMKSLESQLEKQQKDLSEDHSSLLLHVKQFVSDLRSLSCQMAALQGNG SERACCPVNWVEHERSCYWFSRSGKAWADADNYCRLEDAHLVVVTSWEEQKFVQHHIGPVNTWMGLHDQNG PWKWVDGTDYETGFKNWRPEQPDDWYGHGLGGGEDCAHFTDDGRWNDDVCQRPCRWVCETELDKASQEP PLL | pTT5, pSLX235a | 49 |
| cyASGR1::Flag | 1-291 | Flag | MTKEYQDLQHLDNEESDHHQLGKGPPPPQSLLRRLCSGPRLLLLSLGLSLLLLVVVCVIGSQNAQLQRELRGLRE TLSNFTASTEAQVKGLSTQGGNVGRKMKSLESQLEKQQKDLSEDHSSLLLHVKQFVSDLRSLSCQMAALQGNG SERACCPVNWVEHERSCYWFSRSGKAWADADNYCRLEDAHLVVVTSWEEQKFVQHHIGPVNTWMGLHDQNG PWKWVDGTDYETGFKNWRPEQPDDWYGHGLGGGEDCAHFTDDGRWNDDVCQRPYRWVCETELDKASQEP PLLDYKDDDDK | pTT5, pSLX235a | 50 |

FIGURE 48
(Continued)

| | | | | | |
|---|---|---|---|---|---|
| cyASGR1(Y273C)::Flag | 1-291 | Flag | MTKEYODLQHLDNEESDHHQLGKGPPPPQSLLRRLCSGPRLLLSLGLSLLLLVVVCVIGSQNAQLQREELRGLRETLSNFTASTEAQVKGLSTQGGNVGRKMKSLESQLEKQQKDLSEDHSSLLLHVKQFVSDLRSLSCQMAALQGNGSERACCPVNMVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPCRWVCETELDKASQEPPLLDYKDDDDK | pTT5, pSLX235a | 51 |
| muASGR1 | 1-284 | None | MTKDYQDFQHLDNDNDHHQLRRGPPPTPRLLQRLCSGSRLLLSSSLSILLLVVVCVITSQNSQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPCRWVCETKLDKAN | pTT5, pJIF1 | 52 |
| muASGR1(Y272C) | 1-284 | None | MTKDYQDFQHLDNDNDHHQLRRGPPPTPRLLQRLCSGSRLLLSSSLSILLLVVVCVITSQNSQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPCRWVCETKLDKAN | pTT5, pSLX235a, pJIF1 | 53 |
| ratASGR1 | 1-284 | None | MTKDYQDFQHLDNENDHHQLQRGPPPAPRLLQRLCSGFRLFLLSLGLSILLLHVKQLVSDVRSLSCQMAALRGNGSESNFTVSTEDQVKALTTQGERVGRKMKLVESQLEKHQEDLREDHSRLLLHVKQLVSDVRSLSCQMAALRGNGSERICCPINWVEYEGSCYWFSSSVKPWTEADKYCCQLENAHLVVVTSWEEQRFVQQHMGPLNTWIGLTDQNGPWKWVDGTDYETGFKNWRPGQPDDWYGHGLGGGEDCAHFTDGHWNDDVCRRPYRWVCETELGKAN | pTT5, pSLX235a | 54 |
| ratASGR1(Y272C) | 1-284 | None | MTKDYQDFQHLDNENDHHQLQRGPPPAPRLLQRLCSGFRLFLLSLGLSILLLHVKQLVSDVRSLSCQMAALRGNGSESNFTVSTEDQVKALTTQGERVGRKMKLVESQLEKHQEDLREDHSRLLLHVKQLVSDVRSLSCQMAALRGNGSERICCPINWVEYEGSCYWFSSSVKPWTEADKYCCQLENAHLVVVTSWEEQRFVQQHMGPLNTWIGLTDQNGPWKWVDGTDYETGFKNWRPGQPDDWYGHGLGGGEDCAHFTDGHWNDDVCRRPYRWVCETELGKAN | pTT5, pSLX235a | 55 |
| muASGR1::Flag | 1-284 | Flag | MTKDYQDFQHLDNDNDHHQLRRGPPPTPRLLQRLCSGSRLLLSSSLSILLLVVVCVITSQNSQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPCRWVCETKLDKANDYKDDDDK | pTT5, pSLX235a | 56 |
| muASGR1(Y272C)::Flag | 1-284 | Flag | MTKDYQDFQHLDNDNDHHQLRRGPPPTPRLLQRLCSGSRLLLSSSLSILLLVVVCVITSQNSQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPCRWVCETKLDKANDYKDDDDK | pTT5, pSLX235a | 57 |
| ratASGR1::Flag | 1-284 | Flag | MTKDYQDFQHLDNENDHHQLQRGPPPAPRLLQRLCSGFRLFLLSLGLSILLLHVKQLVSDVRSLSCQMAALRGNGSESNFTVSTEDQVKALTTQGERVGRKMKLVESQLEKHQEDLREDHSRLLLHVKQLVSDVRSLSCQMAALRGNGSERICCPINWVEYEGSCYWFSSSVKPWTEADKYCCQLENAHLVVVTSWEEQRFVQQHMGPLNTWIGLTDQNGPWKWVDGTDYETGFKNWRPGQPDDWYGHGLGGGEDCAHFTDGHWNDDVCRRPYRWVCETELGKANDYKDDDDK | pTT5, pSLX235a | 58 |

FIGURE 48
(Continued)

| | | | | | |
|---|---|---|---|---|---|
| ratASGR1(Y272C)::Flag | 1-284 | Flag | MTKDYQDFQHLDNENDHHQLORGPPPAPRLLQRLCSGFRLFLLSLGLSILLLVVVCVITSQNSQLREDLRVLRQNFSNFTVSTEDQVKALTTQGERVGRKMKLVESQLEKHQEDLREDHSRLLLHVKQLVSDVRSLSCQMAALRGNGSERICCPINWVEYEGSCYVVFSSSVKPWTEADKYCQLENAHLVVVTSWEEQRFVQQHMGPLNTWIGLTDQNGPWKWVDGTDYETGFKNWRPCGPDDWYGHGLGGGEDCAHFTTDGHWNDDVCRRPCRWVCETELGKANDYKDDDDK | pTT5, pSLX235a | 59 |
| huASGR2 | 1-306 | None | MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVNSWEEQKFVQHTNPFNTWIGLTDSDGSWKWVDGTDYRHNYKNWAVTQPDNWHGHELGGSEDCVEVQPDGRWNDDFCLQVYRWVCEKRRNATGEVA | pTT5, pSLX235a, pJF1 | 60 |
| muASGR2 | 1-301 | None | MEKDCCQDIQQLDSEENDHGLSGDDEHGSHVQDPRIENPHWKGQPLSRPFPQRLCSTFRLSLLALAFNILLLVVICVVSSQSIQLQEEFRTLKETFSNFSSSTLMEFGALDTLGGSTNAILTSWLAGLEEKQQQLKADHSTLLFHLKHFPMDLRTLTCQLAYFGSNGTECCPVNWVEFGGSCYWFSRDGLTWAEADQYCQLENAHLLVINSREEQDFVVKHRSQFHIWIGLTDRDGSWKWVDGTDYRSNYRNWAFTQPDNWQGHEQGGEDCAEILSDGHWNDNFCQQVNRWCEKRRNITH | pTT5, pJF1 | 61 |
| ratASGR2 | 1-301 | None | MEKDFQDIQQLDSEENDHQLIGDEEQGSHVQNLRTENPRWGGQPPSRPFPQRLCSKFRLSLLALAFNILLLVVICVVSSQSMQLQKEFWTLKETLSNFSTTTLMEFKALDSHGGSRNDNLTSWETILEKKQKDIKADHSTLLFHLKHFPLDLRTLTCQLAFFLSNGTECCPVNWVEFGGSCYWFSRDGLTWAEADQYCQMENAHLLVINSREEQEFVVKHRGAFHIWIGLTDKDGSWKWVDGTEYRSNFKNWAFTQPDNWQGHEEGGSEDCAEILSDGLWNDNFCQQVNRWACERKRDITY | pTT5, pSLX235a | 62 |
| huASGR2::6xHis | 1-306 | 6xHis | MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVNSWEEQKFVQHTNPFNTWIGLTDSDGSWKWVDGTDYRHNYKNWAVTQPDNWHGHELGGSEDCVEVQPDGRWNDDFCLQVYRWVCEKRRNATGEVAHHHHHH | pTT5, pSLX235a | 63 |
| muASGR2::6xHis | 1-301 | 6xHis | MEKDCCQDIQQLDSEENDHGLSGDDEHGSHVQDPRIENPHWKGQPLSRPFPQRLCSTFRLSLLALAFNILLLVVICVVSSQSIQLQEEFRTLKETFSNFSSSTLMEFGALDTLGGSTNAILTSWLAGLEEKQQQLKADHSTLLFHLKHFPMDLRTLTCQLAYFGSNGTECCPVNWVEFGGSCYWFSRDGLTWAEADQYCQLENAHLLVINSREEQDFVVKHRSQFHIWIGLTDRDGSWKWVDGTDYRSNYRNWAFTQPDNWQGHEQGGEDCAEILSDGHWNDNFCQQVNRWCEKRRNITHHHHHHH | pTT5, pSLX235a | 64 |
| ratA::6xHis | 1-301 | 6xHis | MEKDFQDIQQLDSEENDHOLIGDEEQGSHVQNLRTENPRWGGQPPSRPFPQRLCSKFRLSLLALAFNILLLVVICVVSSQSMQLQKEFWTLKETLSNFSTTTLMEFKALDSHGGSRNDNLTSWETILEKKQKDIKADHSTLLFHLKHFPLDLRTLTCQLAFFLSNGTECCPVNWVEFGGSCYWFSRDGLTWAEADQYCQMENAHLLVINSREEQEFVVKHRGAFHIWIGLTDKDGSWKWVDGTEYRSNFKNWAFTQPDNWQGHEEGGSEDCAEILSDGLWNDNFCQQVNRWACERKRDITYHHHHHH | pTT5, pSLX235a | 65 |
| dogASGR2::6xHis | 1-302 | 6xHis | MAKDCCQDIQQLSEDSDQQLGREGPGPRGHGPRRREDRFCRRLPPHQPLLLQRLCSGYRLNLVLGFNVLMLVAICVIGSQRAQLEEELRLKENFSHFSSGVLMELGVLLSDGGASSQLTSLEAKLEKQQRDVKADHATLLHLKHFPSDLRLTCQVAFFGSNGTDCCPVNWVLEYEGSCYVVFSRSGKTWEEAEKYCQLESAHLVVVNSREEQKFIQLHTNPFDTWIGLTDSDGSWRWVDGTDYQQSYKNWAATQPDWQGHEVGSGGEDCAEVRANGRWNDNFCKQVQRWVCEMRRNVTGHHHHHH | pTT5, pSLX235a | 66 |

FIGURE 48
(Continued)

| | | | | | |
|---|---|---|---|---|---|
| dogASGR2 | MAKDFQDIQQLDSEDSDQQLGRGEGPGPRGHGPPREDRFCRRLPPHQPLLLQRLCSGYRLNLLVLGFNVLMLVAICVIGSQRAQLEEELRILKENFSHFSSGVLMELGVILSDGGASSQLTSLEAKLEKQRDVKADHATLLLHLKHFPSDLRLLTCQVAFFQSNGTDCCPVNWLEYEGSCYWFSRSGKTWEEAEKYCQLESAHLVVNSREEQKFLQHTNPFDTWIGLTDSDGSWRWVDGTDYQQSYKNWAATQPDDWQGHEVGGGEDCAEVRANGRWNDNFCKQVQRWVCEMRRNVTG | None | 1-302 | pTT5, pSLX235a | 67 |
| cyASGR2 | MAKDFQDIQQLSSEENDHPFHRGEGPGPRGLNLRRGNPSLKGPPPAQPLAQRLCSMVRFSLLALSFNILLVAICVIGSQSAQLQAELWSLKEAFSNFSSSTLMEVHALGTHGGSVGDKITSLGDKLEKQQQDLKADHDILLHLKHFPVDLRFVACQMELLHSNGSQRTCCPVNWVEHQGSCYWFSRSGKAWAEAEKYCQLENSHLVVINSWEEQKFIVQHTNLFNTWIGLTDSDGSWKWVDGTDYRHNYKNWAVTQPDDWHGHELGGSEDCVEVRPDGRWNDDFCLQVHRWVCEKRRNATGEAA | None | 1-306 | pTT5, pSLX235a | 68 |
| cyASGR2(L225P)::6xHis | MAKDFQDIQQLSSEENDHPFHRGEGPGPRGLNLRRGNPSLKGPPPAQPLAQRLCSMVRFSLLALSFNILLVAICVIGSQSAQLQAELWSLKEAFSNFSSSTLMEVHALGTHGGSVGDKITSLGDKLEKQQQDLKADHDILLHLKHFPVDLRFVACQMELLHSNGSQRTCCPVNWVEHQGSCYWFSRSGKAWAEAEKYCQLENSHLVVINSWEEQKFIVQHTNPFNTWIGLTDSDGSWKWVDGTDYRHNYKNWAVTQPDDWHGHELGGSEDCVEVRPDGRWNDDFCLQVHRWVCEKRRNATGEAAHHHHHH | 6xHis | 1-306 | pTT5, pSLX235a | 69 |
| pigASGR2::6xHis | MARDFQDIQQLDSEENDHQLGRGTPLPQPLVLQRLCSKLRLSLLVLGFNVLMLVAVCVVGSQRTQLQMELQTLKETFSNFSSSLLMEMLTLSTRGGSAGDKVTSLEAKMEKQQQDLKADHATLRLHLKHFPRDVRTLTCRLVFLQSNGTECCPVNWVDYEGSCYWFSRSGKAWAEAEKYCQLENAHLVVINSREEQKFIAQRTNPFQTWIGLTDSDGSWKWVDGTDYGNGYKNWGALQPDDWQGHELGGSEDCVEIQGDGRWNDDFCQGVKRWVCEMKQNITMHHHHHH | 6xHis | 1-283 | pTT5, pSLX235a | 70 |
| cyASGR2(L225P) | MAKDFQDIQQLSSEENDHPFHRGEGPGPRGLNLRRGNPSLKGPPPAQPLAQRLCSMVRFSLLALSFNILLVAICVIGSQSAQLQAELWSLKEAFSNFSSSTLMEVHALGTHGGSVGDKITSLGDKLEKQQQDLKADHDILLHLKHFPVDLRFVACQMELLHSNGSQRTCCPVNWVEHQGSCYWFSRSGKAWAEAEKYCQLENSHLVVINSWEEQKFIVQHTNPFNTWIGLTDSDGSWKWVDGTDYRHNYKNWAVTQPDDWHGHELGGSEDCVEVRPDGRWNDDFCLQVHRWVCEKRRNATGEAA | None | 1-306 | pTT5, pSLX235a | 71 |
| pigASGR2 | MARDFQDIQQLDSEENDHQLGRGTPLPQPLVLQRLCSKLRLSLLVLGFNVLMLVAVCVVGSQRTQLQMELQTLKETFSNFSSSLLMEMLTLSTRGGSAGDKVTSLEAKMEKQQQDLKADHATLRLHLKHFPRDVRTLTCRLVFLQSNGTECCPVNWVDYEGSCYWFSRSGKAWAEAEKYCQLENAHLVVINSREEQKFIAQRTNPFQTWIGLTDSDGSWKWVDGTDYGNGYKNWGALQPDDWQGHELGGSEDCVEIQGDGRWNDDFCCQGVKRWVCEMKQNITM | None | 1-283 | pTT5, pSLX235a | 72 |
| dogASGR1 | MTNDYQDLQHLDNEDNDHHLRQVPPAPGPLLRRLCSGPCLLLLSLGLSVLLLVVVCVIGSQNSNSKLRGELQALRETFSNFTASTEVEKVKALSSQGGNVGRKMKSLESQLEKQQQKDLSEDHSDLLLHVKQFVSDLRSLSCQIAALHGNGSTLCCPVNWLEYEGSCYWFSRSGKSWPEADKYCQLESAHLVVNSREEQKFIQHHMGPVNTWMGLTDQSGPWKWVDGTDYETGFKNWRPEOGHFTDDGRWNDDVCQRPYRWVCEAARDPAT | None | 1-284 | pTT5, pSLX235a | 73 |
| pigASGR1 | MTKEYQDLQHLDNEENDQQHRKGPPPQPSLLRRLCSGPCLLLISMGLSILLLVVCVIGSQNSKLQEELQALRETFSNLTASTDAKVKTLSMQGGNVGRKMKSLESQLEKQQQDLSEDHSSLLLHVKQFVSDLRSLSCQMAVLQGNGSERTCCPVNWVGYEGSCYWFSRSGKPWPEAEKYCQLENAHLVVGSWEEQKFIQHHVGPVNSWIGLTDQSGPWKWVDGTDYESGFKNWRPEQPDDWYGHGLGGGEDCAHFTEDGGWNDDICQRPYRWVCETQRDRDSGS | None | 1-286 | pTT5, pSLX235a | 74 |
| dogASGR1::Flag | MTNDYQDLQHLDNEDNDHHLRQVPPAPGPLLRRLCSGPCLLLLSLGLSVLLLVVVCVIGSQNSKLRGELQALRETFSNFTASTEVEKVKALSSQGGNVLEYEGSCYWFSRSGKSWPEADKYCQLSEDHSDLLLHVKQFVSDLRSLSCQIAALHGNGSTLCCPVNWLEYEGSCYWFSRSGKSWPEADKYCQHHMGPVNTWMGLTDQSGPWKWVDGTDYETGFKNWRPEQPDDWYGHGLGGGEDCAHFTDDGRWNDDVCQRPYRWVCEAARDPATDYKDDDDK | Flag | 1-284 | pTT5, pSLX235a | 75 |

FIGURE 48
(Continued)

| | | | | | |
|---|---|---|---|---|---|
| pigASGR1::Flag | 1-286 | Flag | MTKEYQDLQHLDNEENDQQHRKGPPQPSLLRRLCSGPCLLLISMGLSLLLVVVCVIGSQNSKLQEELQALRET FSNLTASTDAKVKTLSMQGGNVGRKMKSLESQLEKQQQDLSEDHSSLLLHVKQFVSDLRSLSCQMAVLQGNGS ERTCCPVNWVGYEGSCYWFSRSGKPWPEAEKYCQLENAHLVVVGSWEEQKFIQHHVGPVNSWIGLTDQSGP WKWVDGTDYESGFKNWRPEQPDDWYGHGLGGGEDCAHFTEDGGWNDDICQRPYRWVCETQRDRDSGSDY KDDDDK | pTT5, pSLX235a | 76 |
| huASGR1(deCODE) | 1-94 | None | MTKEYQDLQHLDNEESDHHQLRKGPPPPQPLLQRLCSGPRLLLLSLGLSLLLLVVVCVIGSQNSQLQEELRGLRE TFSNFTASTEAQEAMWEER | pJiF1 | 77 |
| huASGR1(deCODE)::Myc | 1-94 | Myc | MTKEYQDLQHLDNEESDHHQLRKGPPPPQPLLQRLCSGPRLLLLSLGLSLLLLVVVCVIGSQNSQLQEELRGLRE TFSNFTASTEAQEAMWEERGQQKLISEEDL | pTT5 | 50759 |

FIGURE 49

Table 2A
Standard
IgG Antibody
VL CDRs

| IPS# | Ab | Type | CDR1 | CDR2 | CDR3 |
|---|---|---|---|---|---|
| iPS:451135 | 21-225_64A11 | NA | CGGGCAAGTCGGAGCGTTAGCAGATATTTAAAT<br>SEQ ID NO:79 | GTTGCATCCCGTTTGCAA<br>AGT<br>SEQ ID NO:8091 | CAACAGAGTGACAGTTTCCC<br>TCTCACT<br>SEQ ID NO:16103 |
|  |  | AA | RASRSVSRYLN<br>SEQ ID NO:80 | VASRLQS<br>SEQ ID NO:8092 | QQSDSFPLT<br>SEQ ID NO:16104 |
| iPS:451141 | 21-225_164B11 | NA | AAGTCCAGCCAGAGTCTTTT<br>AAAGAGCTCCAACAATAAG<br>AGCTACTTAGCT<br>SEQ ID NO:81 | TGGGCATCTTCCCGGGA<br>ATCC<br>SEQ ID NO:8093 | CAGCAATATTATAGTATTCC<br>TCCCACT<br>SEQ ID NO:16105 |
|  |  | AA | KSSQSLLKSSNNKSYLA<br>SEQ ID NO:82 | WASSRES<br>SEQ ID NO:8094 | QQYYSIPPT<br>SEQ ID NO:16106 |
| iPS:451137 | 21-225_74A7 | NA | AAGTCCAGCCAGAGTGTTTT<br>ATTCAGCTCCAACAATTATA<br>ACTACTTAGCT<br>SEQ ID NO:83 | TGGGCATCTACCCGGGA<br>ATCC<br>SEQ ID NO:8095 | CAGCAATATCATAGTTCTCC<br>TCCGACG<br>SEQ ID NO:16107 |
|  |  | AA | KSSQSVLFSSNNYNYLA<br>SEQ ID NO:84 | WASTRES<br>SEQ ID NO:8096 | QQYHSSPPT<br>SEQ ID NO:16108 |
| iPS:451139 | 21-225_71A6 | NA | AAGTCTAGTCAGAGCCTCCT<br>GCGTAGTGATGGAAAGACCC<br>ATTTGTAT<br>SEQ ID NO:85 | GAAGTTTCCAACCGGTTC<br>TCT<br>SEQ ID NO:8097 | ATGCAAAGTAAACAGCTTCC<br>TCTCACT<br>SEQ ID NO:16109 |
|  |  | AA | KSSQSLLRSDGKTHLY<br>SEQ ID NO:86 | EVSNRFS<br>SEQ ID NO:8098 | MQSKQLPLT<br>SEQ ID NO:16110 |

FIGURE 49
(Continued)

| | | | | | |
|---|---|---|---|---|---|
| iPS:451143 | 21-225_66H11 | NA | CCGGCGAGTCAGGGCATTAG CAATTATTTAGCT SEQ ID NO:87 | GGTGCATTCAATTTGCAC AGT SEQ ID NO:8099 | CAACAGTATAGTTGTTACCC ATTCACT SEQ ID NO:16111 |
| | | AA | PASQGISNYLA SEQ ID NO:88 | GAFNLHS SEQ ID NO:8100 | QQYSCYPFT SEQ ID NO:16112 |
| iPS:453445 | 21-225_148E10 | NA | TCTGGAGATAAATIGGGTAA TAAATATGTTTGT SEQ ID NO:89 | CAAGATAGCAAGCGGCC CTCA SEQ ID NO:8101 | CAGGCGTGGGACAGGAACAC TTATGTGGTG SEQ ID NO:16113 |
| | | AA | SGDKLGNKYVC SEQ ID NO:90 | QDSKRPS SEQ ID NO:8102 | QAWDRNTYVV SEQ ID NO:16114 |
| iPS:453447 | 21-225_65F10 | NA | CGGGGGGTCAGGGTATTAG CACATGGTTAGCA SEQ ID NO:91 | GCTGCATCCATTTGCAA AGT SEQ ID NO:8103 | CAACAGGGTAACATTTCCC ATTCACT SEQ ID NO:16115 |
| | | AA | RGGQGISTWLA SEQ ID NO:92 | AASILQS SEQ ID NO:8104 | QQGNIPFT SEQ ID NO:16116 |
| iPS:453449 | 21-225_208A2 | NA | CGGACAAGTCAGGGCATTAG AAATGATTAGGC SEQ ID NO:93 | GCTGCATCCAGTTTGCTT AGT SEQ ID NO:8105 | CTACAGTATAATAGTTACCC TCCCACC SEQ ID NO:16117 |
| | | AA | RTSQGIRNDLG SEQ ID NO:94 | AASSLLS SEQ ID NO:8106 | LQYNSYPPT SEQ ID NO:16118 |
| iPS:453451 | 21-225_52G11 | NA | CGGGCGAGTCAGGGTATTAG CAAATGGTTAGCC SEQ ID NO:95 | GCTGCATCCAGTTTGCAA AGT SEQ ID NO:8107 | CAACAGGCTAACAGTTTCCC ATTCACT SEQ ID NO:16119 |
| | | AA | RASQGISKWLA SEQ ID NO:96 | AASSLQS SEQ ID NO:8108 | QQANSFPFT SEQ ID NO:16120 |
| iPS:453453 | 21-225_53F2 | NA | CGGGCGAGTCAGGGTATTAG CAAGTGGTTAGCC SEQ ID NO:97 | GCTGCATCCAGTTTGCAA AGT SEQ ID NO:8109 | CAACAGGCTAACAGTTTCCC ATTCACT SEQ ID NO:16121 |
| | | AA | RASQGISKWLA SEQ ID NO:98 | AASSLQS SEQ ID NO:8110 | QQANSFPFT SEQ ID NO:16122 |

FIGURE 49
(Continued)

| | | | | |
|---|---|---|---|---|
| iPS:468810 | 21-225_74D5 | NA | AGGGCCAGTCAGAGTGTTAACAGCAACTACTTAGCC<br>SEQ ID NO:99 | GGTGCATCCAGCAGGGC<br>CACT<br>SEQ ID NO:8111 | CAGCAGTATGAAAGCTCGCC<br>GTGGACG<br>SEQ ID NO:16123 |
| | | AA | RASQSVNSNYLA<br>SEQ ID NO:100 | GASSRAT<br>SEQ ID NO:8112 | QQYESSPWT<br>SEQ ID NO:16124 |
| iPS:468812 | 21-225_48H4 | NA | CGGGCAAGTCAGAGACATTAG<br>AAATGATTTAGGC<br>SEQ ID NO:101 | GCTGCATCCAGTTTGCAA<br>AGT<br>SEQ ID NO:8113 | CTACAACATTATAGTTACCC<br>GCTCACT<br>SEQ ID NO:16125 |
| | | AA | RASRDIRNDLG<br>SEQ ID NO:102 | AASSLQS<br>SEQ ID NO:8114 | LQHYSYPLT<br>SEQ ID NO:16126 |
| iPS:468816 | 21-225_52G8 | NA | AAGTCTAGTCAGAGCCTCCT<br>GCATAGTGAAGGAAAGACC<br>TATTTGTAT<br>SEQ ID NO:103 | GAAGTTTCCAAGCGGCT<br>CTCT<br>SEQ ID NO:8115 | ATGCAAAGTATGCAGCTTCC<br>GATTATC<br>SEQ ID NO:16127 |
| | | AA | KSSQSLLHSEGKTYLY<br>SEQ ID NO:104 | EVSKRLS<br>SEQ ID NO:8116 | MQSMQLPII<br>SEQ ID NO:16128 |
| iPS:468814 | 21-225_223D11 | NA | CGGGCGAGTCAGGGCATTAG<br>CAATTATTTAGCC<br>SEQ ID NO:105 | GCTGCATCCACTTTGCAA<br>AGT<br>SEQ ID NO:8117 | CAACAGTATAGTGGTTACCC<br>ATTCACT<br>SEQ ID NO:16129 |
| | | AA | RASQGISNYLA<br>SEQ ID NO:106 | AASTLQS<br>SEQ ID NO:8118 | QQYSGYPFT<br>SEQ ID NO:16130 |
| iPS:468822 | 21-225_147E10 | NA | AAGTCTAGTCAGCGCCTCCT<br>GCATGGTGATGAAAGACCT<br>ATTTGTAT<br>SEQ ID NO:107 | GAAGTTTCCAACCGGTTC<br>TCT<br>SEQ ID NO:8119 | ATGCAAAGTATACAGGTTCC<br>GTGGACG<br>SEQ ID NO:16131 |
| | | AA | KSSQRLLHGDGKTYLY<br>SEQ ID NO:108 | EVSNRFS<br>SEQ ID NO:8120 | MQSIQVPWT<br>SEQ ID NO:16132 |
| iPS:468824 | 21-225_73G6 | NA | CGGGCAAGTCAGGGCATTAG<br>AAATGATTTAGGC<br>SEQ ID NO:109 | GCTGCATCCAGTTTGCAA<br>AGT<br>SEQ ID NO:8121 | CTACAGCATAATAGTTACCC<br>GCTCACT<br>SEQ ID NO:16133 |

FIGURE 49
(Continued)

| | | | | | | |
|---|---|---|---|---|---|---|
| iPS:468818 | 21-225_190C8 | AA | RASQGIRNDLG<br>SEQ ID NO:110 | AASSLQS<br>SEQ ID NO:8122 | LQHNSYPLT<br>SEQ ID NO:16134 |
| | | NA | CGGGCAAGTCAGGGCATTAG<br>AAATGATTTAGGC<br>SEQ ID NO:111 | GCTGCATCCAGTTTGCAA<br>AGT<br>SEQ ID NO:8123 | CTACAGCATAATGATTACCC<br>GTTCACT<br>SEQ ID NO:16135 |
| iPS:468826 | 21-225_201C5 | AA | RASQGIRNDLG<br>SEQ ID NO:112 | AASSLQS<br>SEQ ID NO:8124 | LQHNDYPFT<br>SEQ ID NO:16136 |
| | | NA | CGGGCAAGTCAGGGCATTAG<br>ACATGATTTAGGC<br>SEQ ID NO:113 | GCTGCATCCAGTTTGCAA<br>AGT<br>SEQ ID NO:8125 | CTACAGCATTATAGTTTCCCT<br>CGGACG<br>SEQ ID NO:16137 |
| iPS:468828 | 21-225_162A10 | AA | RASQGIRHDLG<br>SEQ ID NO:114 | AASSLQS<br>SEQ ID NO:8126 | LQHYSFPRT<br>SEQ ID NO:16138 |
| | | NA | AGGGCCAGTCAGAGACTGTTAA<br>CAGCAACTTAGCC<br>SEQ ID NO:115 | GGTGCATCCACCAGGGC<br>CACT<br>SEQ ID NO:8127 | CAGCAGTATAATGACTGGCC<br>GTGCAGT<br>SEQ ID NO:16139 |
| iPS:468830 | 21-225_191G11 | AA | RASQTVNSNLA<br>SEQ ID NO:116 | GASTRAT<br>SEQ ID NO:8128 | QQYNDWPCS<br>SEQ ID NO:16140 |
| | | NA | AGGACCAGTCAGAGTGTTTG<br>GATTAGCGTAGCC<br>SEQ ID NO:117 | GGTGCAGCAGCCACCAGGGC<br>CACT<br>SEQ ID NO:8129 | CAGCAGTATAATTACTGGCC<br>GCTCACT<br>SEQ ID NO:16141 |
| iPS:468832 | 21-225_76H10 | AA | RTSQSYWISVA<br>SEQ ID NO:118 | GAATRAT<br>SEQ ID NO:8130 | QQYNYWPLT<br>SEQ ID NO:16142 |
| | | NA | CGGGCAAGTCAGGACATTAG<br>AAATTATTTAGGC<br>SEQ ID NO:119 | GGTGCATCCAGTTTGCA<br>AAGT<br>SEQ ID NO:8131 | CTACAGTATAATAGTTACCC<br>ATTCACT<br>SEQ ID NO:16143 |
| iPS:468834 | 21-225_94G10 | AA | RASQDIRNYLG<br>SEQ ID NO:120 | GASSLQS<br>SEQ ID NO:8132 | LQYNSYPFT<br>SEQ ID NO:16144 |
| | | NA | AGGGCCAGTCAGAGTGTTAA<br>CAGCAACTACTTAGCC<br>SEQ ID NO:121 | GGTGCATCCAGCAGGGC<br>CACT<br>SEQ ID NO:8133 | CAGCAGTATGAAAGCTCGCC<br>GTGGACG<br>SEQ ID NO:16145 |

FIGURE 49
(Continued)

| | | | | | | |
|---|---|---|---|---|---|---|
| iPS:468836 | | AA | RASQSVNSNYLA SEQ ID NO:122 | GASSRAT SEQ ID NO:8134 | QQYESSPWT SEQ ID NO:16146 |
| | 21-225_198E3 | NA | CGGGCAAGTCAGGGCATTAA GAAAAGATTTAGGC SEQ ID NO:123 | GCTGCATCCAGTTTGCAA AGT SEQ ID NO:8135 | CTACAACATTATCGTTACCC TTTCACT SEQ ID NO:16147 |
| iPS:468838 | | AA | RASQGIRKDLG SEQ ID NO:124 | AASSLQS SEQ ID NO:8136 | LQHYRYPFT SEQ ID NO:16148 |
| | 21-225_80E12 | NA | AGGGCCAGTCAGAGCGTTAA CAGCAACTACTTAGCC SEQ ID NO:125 | GGTGCATCCAGCAGGGC CACT SEQ ID NO:8137 | CAGCAGTATGAAAGCTCGCC GTGGACG SEQ ID NO:16149 |
| iPS:468840 | | AA | RASQSVNSNYLA SEQ ID NO:126 | GASSRAT SEQ ID NO:8138 | QQYESSPWT SEQ ID NO:16150 |
| | 21-225_200H9 | NA | CGGGCAAGTCAGGGCATTAG AAATGATTTAGGC SEQ ID NO:127 | GCTGCATCCAGTTTGCAA AGT SEQ ID NO:8139 | CTACAGCATAATAGTTACCC TCTCACT SEQ ID NO:16151 |
| iPS:468820 | | AA | RASQGIRNDLG SEQ ID NO:128 | AASSLQS SEQ ID NO:8140 | LQHNSYPLT SEQ ID NO:16152 |
| | 21-225_76E10 | NA | AGGGCCAGTCAGAGTGTTAA CAGCAACTACTTAGCC SEQ ID NO:129 | GGTGCATCCAGCAGGGC CACT SEQ ID NO:8141 | CAGCAGTATGAAAGCTCGCC GTGGACG SEQ ID NO:16153 |
| iPS:468842 | | AA | RASQSVNSNYLA SEQ ID NO:130 | GASSRAT SEQ ID NO:8142 | QQYESSPWT SEQ ID NO:16154 |
| | 21-225_50H4 | NA | CGGGCAAGTCAGGGCATTAG AAATGATTTAGGC SEQ ID NO:131 | GCTGCATCCAGTTTGCAA AGT SEQ ID NO:8143 | CTACAACATTATAGTTACCC TCGGACG SEQ ID NO:16155 |
| iPS:468844 | | AA | RASQGIRNDLG SEQ ID NO:132 | AASSLQS SEQ ID NO:8144 | LQHYSYPRT SEQ ID NO:16156 |
| | 21-225_48E10 | NA | CGGGCAAGTCAGGGCATTAG AAGTGATTTAGGC SEQ ID NO:133 | ACTGCATCCAGTTTGCAA AGT SEQ ID NO:8145 | CTACAGTATAATAGTTACCC ATTCACT SEQ ID NO:16157 |

FIGURE 49
(Continued)

| | | RASQGIRSDLG | TASSLQS | LQYNSYPFT |
|---|---|---|---|---|
| | AA | SEQ ID NO:134 | SEQ ID NO:8146 | SEQ ID NO:16158 |
| iPS:468846 | | | | |
| 21-225_53B10 | NA | CGGGCAAGTCAGGACATTAGGGTGCATCCAGTTTGCAAAATTATTTAGGC | GGTGCATCCAGTTTGCAAGT | CTACAGTATAATAGTTACCCATTCACT |
| | | SEQ ID NO:135 | SEQ ID NO:8147 | SEQ ID NO:16159 |
| | AA | RASQDIRNYLG | GASSLQS | LQYNSYPFT |
| iPS:468848 | | SEQ ID NO:136 | SEQ ID NO:8148 | SEQ ID NO:16160 |
| 21-225_54B1 | NA | CGGGCAAGTCAGAACATTAGGCTGCATCCAGTTTGCATCAGCTATTTAAAT | GCTGCATCCAGTTTGCATAGT | CAACAGAGTTACAGAACCCCTCTGTGGACG |
| | | SEQ ID NO:137 | SEQ ID NO:8149 | SEQ ID NO:16161 |
| | AA | RASQNISSYLN | AASSLHS | QQSYRTPLWT |
| iPS:468850 | | SEQ ID NO:138 | SEQ ID NO:8150 | SEQ ID NO:16162 |
| 21-225_63F4 | NA | AAGTCCAGCCAGAGAGTGTTTTATCCAGCTCCAACAATAACAACTACTTAGCT | TGGGCATCTACCCGGGAATCC | CAGCAATATTATACTACTCCGTGCAGT |
| | | SEQ ID NO:139 | SEQ ID NO:8151 | SEQ ID NO:16163 |
| | AA | KSSQSVLSSSNNNNYLA | WASTRES | QQYYTTPCS |
| iPS:468852 | | SEQ ID NO:140 | SEQ ID NO:8152 | SEQ ID NO:16164 |
| 21-225_71F3 | NA | AAGTCCAGCCAGAGTGTTTTATCCAACTCCAACAATAACAACTACTTAGCT | TGGGCATCTACCCGGGAATCC | CAGCAATATTATACTACTCCGTGCAGT |
| | | SEQ ID NO:141 | SEQ ID NO:8153 | SEQ ID NO:16165 |
| | AA | KSSQSVLSNSNNNNYLA | WASTRES | QQYYTTPCS |
| iPS:468854 | | SEQ ID NO:142 | SEQ ID NO:8154 | SEQ ID NO:16166 |
| 21-225_72C4 | NA | AGGTCTGGTCAAAGCCTCGTATACAGTGATGAAACACCTACTTGAAT | GAGGTTTCTAAGTGGGACTCT | ATGCAAGGTACACACTGGCCGCTCACT |
| | | SEQ ID NO:143 | SEQ ID NO:8155 | SEQ ID NO:16167 |
| | AA | RSGQSLVYSDGNTYLN | EVSKWDS | MQGTHWPLT |
| | | SEQ ID NO:144 | SEQ ID NO:8156 | SEQ ID NO:16168 |

FIGURE 49
(Continued)

| | | | | | |
|---|---|---|---|---|---|
| iPS:468856 | 21-225_77C9 | NA | AGGTCTAGTCAAAGCCTCGT TTACAGTGTTGGAAACACCT CCTTGAGT<br>SEQ ID NO:145 | AAGGTTTCTAACTGGGA CTCT<br>SEQ ID NO:8157 | ATGCAAGGTACACACTGGCC ATTCACT<br>SEQ ID NO:16169 |
| | | AA | RSSQSLVYSVGNTSLS<br>SEQ ID NO:146 | KVSNWDS<br>SEQ ID NO:8158 | MQGTHWPFT<br>SEQ ID NO:16170 |
| iPS:468858 | 21-225_148C9 | NA | CGGGCAAGTCGGGGCATTAG AGATGATTTAGGC<br>SEQ ID NO:147 | GCTGCATCCAGTTTGCAG AGT<br>SEQ ID NO:8159 | CTACAGCATTATAGTTATCC TCGGACG<br>SEQ ID NO:16171 |
| | | AA | RASRGIRDDLG<br>SEQ ID NO:148 | AASSLQS<br>SEQ ID NO:8160 | LQHYSYPRT<br>SEQ ID NO:16172 |
| iPS:468860 | 21-225_224E7 | NA | CGGGCAAGTCAGGGCATTAG AAATGATTTAGGC<br>SEQ ID NO:149 | GCTGCATCCAGTTTGCAA AGT<br>SEQ ID NO:8161 | CTACAACATTATAGTTACCC TCGGACG<br>SEQ ID NO:16173 |
| | | AA | RASQGIRNDLG<br>SEQ ID NO:150 | AASSLQS<br>SEQ ID NO:8162 | LQHYSYPRT<br>SEQ ID NO:16174 |
| iPS:468862 | 21-225_178H8 | NA | ACTGGAACCAGCAGTGACGT TGGTGGTTATAATTTTGTCT CC<br>SEQ ID NO:151 | GAGGTCAGTAATCGGCC CTCA<br>SEQ ID NO:8163 | AGCTCATATACAAGCAGCTA CACTTGGGTG<br>SEQ ID NO:16175 |
| | | AA | TGTSSDVGGYNFVS<br>SEQ ID NO:152 | EVSNRPS<br>SEQ ID NO:8164 | SSYTSSYTWV<br>SEQ ID NO:16176 |
| iPS:468864 | 21-225_60D6 | NA | TCTGGAAGCAGCTCCAACAT CGGAAGTAATACIGTAAAC<br>SEQ ID NO:153 | AGTAATAATCAGCGGCC CTCA<br>SEQ ID NO:8165 | GCAGCATGGGATGACAGCCT GAATGGTCCG<br>SEQ ID NO:16177 |
| | | AA | SGSSSNIGSNTVN<br>SEQ ID NO:154 | SNNQRPS<br>SEQ ID NO:8166 | AAWDDSLNGP<br>SEQ ID NO:16178 |
| iPS:468866 | | NA | ACTGGAGATGCAATGCCGAA AAAATATGCTTAT | GAGGACAGCAAGCGACC CTCC | AACTCAACAGACAGCAGTGG TAATCGGGTG |

FIGURE 49
(Continued)

| | | | | | | |
|---|---|---|---|---|---|---|
| iPS:468868 | 21-225_190C1 | AA | SEQ ID NO:155<br>TGDAMPKKYAY | SEQ ID NO:8167<br>EDSKRPS | SEQ ID NO:16179<br>NSTDSSGNRV | |
| | | NA | SEQ ID NO:156<br>CGGGCAAGTCAGGGCATTAG<br>AAATGATTTAGGC | SEQ ID NO:8168<br>GCTGCATCCAGTTGCAA<br>AGT | SEQ ID NO:16180<br>CTACAGCATGATAGTTACCC<br>TCTCACT | |
| iPS:468870 | 21-225_74A1 | AA | SEQ ID NO:157<br>RASQGIRNDLG | SEQ ID NO:8169<br>AASSLQS | SEQ ID NO:16181<br>LQHDSYPLT | |
| | | NA | SEQ ID NO:158<br>AAGTCCAGCCAGAGTGTTTT<br>GTACAGCTCCAAACAGTCACA<br>ACTACTTAGCT | SEQ ID NO:8170<br>TGGGCATCTACCCGGGA<br>ATCC | SEQ ID NO:16182<br>CAGCAATATTATAGTACTCC<br>GTGCAGT | |
| iPS:472730 | 21-225_74A8 | AA | SEQ ID NO:159<br>KSSQSVLYSSNSHNYLA | SEQ ID NO:8171<br>WASTRES | SEQ ID NO:16183<br>QQYYSTPCS | |
| | | NA | SEQ ID NO:160<br>CGGGCAAGTCAGGACATTAG<br>AGATAATTTAGGC | SEQ ID NO:8172<br>ACTGCATACAGTTTGCA<br>AAGT | SEQ ID NO:16184<br>CTACAACATTATAATTACCC<br>GCTCACT | |
| iPS:472731 | 21-225_14B1_LC1 | AA | SEQ ID NO:161<br>RASQDIRDNLG | SEQ ID NO:8173<br>TAYSLQS | SEQ ID NO:16185<br>LQHYNYPLT | |
| | | NA | SEQ ID NO:162<br>TCTGGAGATAAATTGGGGGA<br>TAAATATGCTTAC | SEQ ID NO:8174<br>CAAGATAGGAAGCGCCC<br>CTCA | SEQ ID NO:16186<br>CAGGCGTGGGACAACAGCAC<br>TGTGGTG | |
| iPS:472732 | 21-225_14B1_LC2 | AA | SEQ ID NO:163<br>SGDKLGDKYAY | SEQ ID NO:8175<br>QDRKRPS | SEQ ID NO:16187<br>QAWDNSTVV | |
| | | NA | SEQ ID NO:164<br>AGGTCTAGTCAAAGCCTCGT<br>ATACAGTGATGAAACACCT<br>TCTTGAAT | SEQ ID NO:8176<br>AAGGTTTCTAACTGGGA<br>CTCT | SEQ ID NO:16188<br>ATACAAGGTACGCACTGGCC<br>TTTCCCC | |
| | 21-225_2B10_LC1 | AA | SEQ ID NO:165<br>RSSQSLVYSDGNTFLN | SEQ ID NO:8177<br>KVSNWDS | SEQ ID NO:16189<br>IQGTHWPFP | |
| | | | SEQ ID NO:166 | SEQ ID NO:8178 | SEQ ID NO:16190 | |

FIGURE 49
(Continued)

| | | | | | |
|---|---|---|---|---|---|
| iPS:472733 | 21-225_2B10_LC2 | NA | ACTGGAACCAGCAGTGACGT TGGTGGTTATAATTTGTCT CC<br>SEQ ID NO:167 | GAGGTCAGTAATCGGCC CTCA<br>SEQ ID NO:8179 | AGCTCATATACAAGCACCGG CACTGTGGTA<br>SEQ ID NO:16191 |
| | | AA | TGTSSDVGGYNFVS<br>SEQ ID NO:168 | EVSNRPS<br>SEQ ID NO:8180 | SSYTSTGTVV<br>SEQ ID NO:16192 |
| iPS:473253 | 21-225_7C3_LC1 | NA | CGGGCAAGTCAGGGCATTAG AAGTGATTTAGGC<br>SEQ ID NO:169 | GCTGCATCCAGTTTGCAA AGT<br>SEQ ID NO:8181 | CTACAGCATAATAGTTACCT CCCCATCACC<br>SEQ ID NO:16193 |
| | | AA | RASQGIRSDLG<br>SEQ ID NO:170 | AASSLQS<br>SEQ ID NO:8182 | LQHNSYLPIT<br>SEQ ID NO:16194 |
| iPS:473254 | 21-225_7C3_LC2 | NA | CGGGCGAGTCAGGGTATTAG CAGCTGGTTAGCC<br>SEQ ID NO:171 | GCTGCATCCAGGTTGCA AAGT<br>SEQ ID NO:8183 | CAACAGGCTAACAGTTTCCC ATTCACT<br>SEQ ID NO:16195 |
| | | AA | RASQGISSWLA<br>SEQ ID NO:172 | AASRLQS<br>SEQ ID NO:8184 | QQANSFPFT<br>SEQ ID NO:16196 |
| iPS:473255 | 21-225_9F12_LC1 | NA | CGGGCGAGTCAGGGTATTAG CAGGTGGTTAGCC<br>SEQ ID NO:173 | GCTGCATCCAGATTGCA AAGT<br>SEQ ID NO:8185 | CAACAGGCTAACAGTTTCCC ATTCACT<br>SEQ ID NO:16197 |
| | | AA | RASQGISRWLA<br>SEQ ID NO:174 | AASRLQS<br>SEQ ID NO:8186 | QQANSFPFT<br>SEQ ID NO:16198 |
| iPS:473256 | 21-225_9F12_LC2 | NA | CGGGCAAGTCAGGGCATTAG AAATGATTTAGGC<br>SEQ ID NO:175 | GCTGCATCCAGTTTGCAA AGT<br>SEQ ID NO:8187 | CTACAGCATAATAGTTACCT CCCCATCACC<br>SEQ ID NO:16199 |
| | | AA | RASQGIRNDLG<br>SEQ ID NO:176 | AASSLQS<br>SEQ ID NO:8188 | LQHNSYLPIT<br>SEQ ID NO:16200 |
| iPS:472742 | 21-225_30D9_LC2 | NA | TCTGGAGATAAATTGGGGGA TAAATATGTTTAC<br>SEQ ID NO:177 | CAAGATAGGAAGCGGCC CTCA<br>SEQ ID NO:8189 | CAGGCGTGGGACAACAGCAC TGCGGTA<br>SEQ ID NO:16201 |
| | | AA | SGDKLGDKYVY | QDRKRPS | QAWDNSTAV |

FIGURE 49
(Continued)

| | | | | | |
|---|---|---|---|---|---|
| iPS:472741 | 21-225_30D9_LC1 | NA | SEQ ID NO:178 AGGTCTAGTCAAAGCCTCGTATCCAGTGATGGAAACACCTTCTTGAAT | SEQ ID NO:8190 AAGGTTCTAACTGGGACTCT | SEQ ID NO:16202 TTGCAAGGTACACACTGGCCTCTCACC |
| | | AA | SEQ ID NO:179 RSSQSLVSSDGNTFLN | SEQ ID NO:8191 KVSNWDS | SEQ ID NO:16203 LQGTHWPLT |
| iPS:472743 | 21-225_68G6 | NA | SEQ ID NO:180 TCTGGAGATAAAATTGGGGGATAAATATACTTAC | SEQ ID NO:8192 CAAGATAGGAAGCGGCCCTCA | SEQ ID NO:16204 CAGGCGTGGGACAATAGTACTGCGGTA |
| | | AA | SEQ ID NO:181 SGDKLGDKYTY | SEQ ID NO:8193 QDRKRPS | SEQ ID NO:16205 QAWDNSTAV |
| iPS:392573 | 21-225_15G2 | NA | SEQ ID NO:182 ACTGGAACCAGCAGTGACGTTGGTGGTTATAACTATGTCTCC | SEQ ID NO:8194 GAGGTCAGTAATCGGCCCTCA | SEQ ID NO:16206 ACCTCATATACAAGCACCAGCACTGTGGTC |
| | | AA | SEQ ID NO:183 TGTSSDVGGYNYVS | SEQ ID NO:8195 EVSNRPS | SEQ ID NO:16207 TSYTSTSTVV |
| iPS:392583 | 21-225_10B10 | NA | SEQ ID NO:184 TCTGGAGATAAAATTGGGGGAATAAATATGCTTGG | SEQ ID NO:8196 CAAGATAGGAAGCGGCCCTCA | SEQ ID NO:16208 CAGGCGTGGGACAACAGCACTGTGGTT |
| | | AA | SEQ ID NO:185 SGDKLGNKYAW | SEQ ID NO:8197 QDRKRPS | SEQ ID NO:16209 QAWDNSTVV |
| iPS:392585 | 21-225_14H11 | NA | SEQ ID NO:186 TCTGGAGATAAAATTGGGGGAAAAATATGTTTGC | SEQ ID NO:8198 CAAGATACCAAGCGGCCCTCA | SEQ ID NO:16210 CAGGCGTGGGACAGCAGCACTATA |
| | | AA | SEQ ID NO:187 SGDKLGEKYVC | SEQ ID NO:8199 QDTKRPS | SEQ ID NO:16211 QAWDSSTI |
| iPS:392587 | | NA | SEQ ID NO:188 TCTGGAGAGAAATTGGGGGATAAAATATGTTTGT | SEQ ID NO:8200 CAAGATAGCAAGCGGCCCTCA | SEQ ID NO:16212 CAGGCGTGGAACAGCAGCAATGTGGTA |

FIGURE 49
(Continued)

| | | | | | | |
|---|---|---|---|---|---|---|
| iPS:392589 | 21-225_18G5 | | SEQ ID NO:189 | | SEQ ID NO:8201 | | SEQ ID NO:16213 |
| | | AA | SGEKLGDKYVC | | QDSKRPS | | QAWNSSNVV |
| | | | SEQ ID NO:190 | | SEQ ID NO:8202 | | SEQ ID NO:16214 |
| iPS:392593 | 21-225_27H2 | NA | TCTGGAGATAAATTGGGGGA TAAATATGCTTCC | | CAAGATGGCAAGCGGCC CTCA | | CAGGCGTGGGACAGCAGCAC TTATGTGGTA |
| | | | SEQ ID NO:191 | | SEQ ID NO:8203 | | SEQ ID NO:16215 |
| | | AA | SGDKLGDKYAS | | QDGKRPS | | QAWDSSTYVV |
| | | | SEQ ID NO:192 | | SEQ ID NO:8204 | | SEQ ID NO:16216 |
| iPS:392596 | 21-225_3E10 | NA | GGGGGAAACAACATTGGAA GTAAAGCTGTGCAC | | AGCGATAGCAACCGGCC CTCA | | CAGGTGTGGGACAGTAGTAG TGATCATGTGGTA |
| | | | SEQ ID NO:193 | | SEQ ID NO:8205 | | SEQ ID NO:16217 |
| | | AA | GGNNIGSKAVH | | SDSNRPS | | QVWDSSSDHVV |
| | | | SEQ ID NO:194 | | SEQ ID NO:8206 | | SEQ ID NO:16218 |
| iPS:392596 | 21-225_12D8 | NA | ACCCTAAGCAGTGAGCACAG CACCTACACCATCGAA | | GTTAAGAGTGATGGCAG CCACAGCAAGGGGGAC | | GGAGAGAGCCACACGATTGA TGGCCAAGTCGGTGTGGTA |
| | | | SEQ ID NO:195 | | SEQ ID NO:8207 | | SEQ ID NO:16219 |
| | | AA | TLSSEHSTYTIE | | VKSDGSHSKGD | | GESHTIDGQVGVV |
| | | | SEQ ID NO:196 | | SEQ ID NO:8208 | | SEQ ID NO:16220 |
| iPS:392598 | 21-225_18E10 | NA | TCTGGAGATAGATTGGGGGA TAAATATGCTTGG | | CAAGATCGCAAGCGGCC CTCA | | CAGGCGTGGGACAGCAGCAC AGTGGTA |
| | | | SEQ ID NO:197 | | SEQ ID NO:8209 | | SEQ ID NO:16221 |
| | | AA | SGDRLGDKYAW | | QDRKRPS | | QAWDSSTVV |
| | | | SEQ ID NO:198 | | SEQ ID NO:8210 | | SEQ ID NO:16222 |
| iPS:392618 | 21-225_16F10 | NA | AAGTCTAGTCAGAGCCTCCT GCATAGTGATGGAAAGACCC TCATTTGAAT | | GAAGTTCCTACCGGTTC TCT | | TTTCAAGTATACAGCTTCC GCTCACT |
| | | | SEQ ID NO:199 | | SEQ ID NO:8211 | | SEQ ID NO:16223 |
| | | AA | KSSQSLLHSDGKTHLN | | EVSYRFS | | FQSIQLPLT |
| | | | SEQ ID NO:200 | | SEQ ID NO:8212 | | SEQ ID NO:16224 |

FIGURE 49
(Continued)

| iPS:392620 | 21-225_17H5 | NA | CGGGCGAGTCAGGGCATTAG CAATTATTAGCC SEQ ID NO:201 | GCTGCATCCAGTTTACAA AGT SEQ ID NO:8213 | CAACAGTATCATAGTTACCC ATTCACT SEQ ID NO:16225 |
| --- | --- | --- | --- | --- | --- |
| | | AA | RASQGISNYLA SEQ ID NO:202 | AASSLQS SEQ ID NO:8214 | QQYHSYPFT SEQ ID NO:16226 |
| iPS:392622 | 21-225_17H8 | NA | CGGGCAAGTCAGGGCATTAG AAATGATTTAGGC SEQ ID NO:203 | GGTGCATCCAGTTTGCA AAGT SEQ ID NO:8215 | CTACAGCATAATAGTTACCC ACTCACT SEQ ID NO:16227 |
| | | AA | RASQGIRNDLG SEQ ID NO:204 | GASSLQS SEQ ID NO:8216 | LQHNSYPLT SEQ ID NO:16228 |
| iPS:392624 | 21-225_17H12 | NA | CGGGCAAGTCAGGACATTAG AAATGATTTAGGC SEQ ID NO:205 | GCTGCATCCAGTTTGCAA AGT SEQ ID NO:8217 | CTACAGCATTATAGTTATAT GTTCACT SEQ ID NO:16229 |
| | | AA | RASQDIRNDLG SEQ ID NO:206 | AASSLQS SEQ ID NO:8218 | LQHYSYMFT SEQ ID NO:16230 |
| iPS:392626 | 21-225_18A5 | NA | CGGGCAAGTCAGGGCATTAG AAATGATTTAGGC SEQ ID NO:207 | GCTGCATCCAGTTTGCAA AGT SEQ ID NO:8219 | CTACAGCATAATAGTTACCC GTGGACG SEQ ID NO:16231 |
| | | AA | RASQGIRNDLG SEQ ID NO:208 | AASSLQS SEQ ID NO:8220 | LQHNSYPWT SEQ ID NO:16232 |
| iPS:392628 | 21-225_20C2 | NA | CGGGCAAGTCAGGGCATTAG AAATGATTTAGGC SEQ ID NO:209 | GCTGCATCCAGTTTGCAA AGT SEQ ID NO:8221 | CTTCAACATGCTAGTTACCC GCTCACT SEQ ID NO:16233 |
| | | AA | RASQGIRNDLG SEQ ID NO:210 | AASSLQS SEQ ID NO:8222 | LQHASYPLT SEQ ID NO:16234 |
| iPS:392630 | 21-225_20E5 | NA | CGGGCAAGTCAGGGCATTAG AAATGATTTAGGC SEQ ID NO:211 | GCTGCATCCAGTTTGCAA AGT SEQ ID NO:8223 | CTACAGCATAATAGTTACCC GCTCACT SEQ ID NO:16235 |
| | | AA | RASQGIRNDLG SEQ ID NO:212 | AASSLQS SEQ ID NO:8224 | LQHNSYPLT SEQ ID NO:16236 |

FIGURE 49
(Continued)

| | | | | | |
|---|---|---|---|---|---|
| iPS:392632 | 21-225_16A11 | NA | CGGGCAAGTCAGGACATTAG AAATCATTTAGGC SEQ ID NO:213 | GCTGCATCCAGTTTGCAA AGT SEQ ID NO:8225 | CTACAGTATAATAGTTATCC ATTCACT SEQ ID NO:16237 |
| | | AA | RASQDIRNHLG SEQ ID NO:214 | AASSLQS SEQ ID NO:8226 | LQYNSYPFT SEQ ID NO:16238 |
| iPS:392634 | 21-225_17H3 | NA | CGGGCAAGTCAGGGCATTAG AAGTGATTTAGGC SEQ ID NO:215 | GCTGCATCCAGTTTGCAA AGT SEQ ID NO:8227 | CTACAGCAATATAGTTACCC TCGGACG SEQ ID NO:16239 |
| | | AA | RASQGIRSDLG SEQ ID NO:216 | AASSLQS SEQ ID NO:8228 | LQQYSYPRT SEQ ID NO:16240 |
| iPS:392636 | 21-225_17A6 | NA | CGGGCAAGTCAGACCATTAG CAACTATTTAAAT SEQ ID NO:217 | GCTGCTTCCAGTTTGCAA AGT SEQ ID NO:8229 | CAACAGAGTCACACTTCCCC GCTCACT SEQ ID NO:16241 |
| | | AA | RASQTISNYLN SEQ ID NO:218 | AASSLQS SEQ ID NO:8230 | QQSHTSPLT SEQ ID NO:16242 |
| iPS:392638 | 21-225_17F9 | NA | CGGGCAAGTCAGGTCATTAG AAATGATTTAGGC SEQ ID NO:219 | GCTGTATCCAGTTTGCAA AGT SEQ ID NO:8231 | CTACAACATAATACTTATCC GCTCACT SEQ ID NO:16243 |
| | | AA | RASQVIRNDLG SEQ ID NO:220 | AVSSLQS SEQ ID NO:8232 | LQHNTYPLT SEQ ID NO:16244 |
| iPS:392640 | 21-225_18A1 | NA | CGGGCAAGTCAGGGCATTAG AAATGATTTAGGC SEQ ID NO:221 | GCTGCATCCAGTTTACAA AGT SEQ ID NO:8233 | CTACAGCATAATAGTTACCC GCTCACT SEQ ID NO:16245 |
| | | AA | RASQGIRNDLG SEQ ID NO:222 | AASSLQS SEQ ID NO:8234 | LQHNSYPLT SEQ ID NO:16246 |
| iPS:392642 | 21-225_18C6 | NA | CGGACAAGTCAGGGCATTAG AAATGATTTAGGC SEQ ID NO:223 | GCTGCATCCAGTTTGCAA AGT SEQ ID NO:8235 | CTACAGCATAGTTCTTACCC GCTCACT SEQ ID NO:16247 |
| | | AA | RTSQGIRNDLG SEQ ID NO:224 | AASSLQS SEQ ID NO:8236 | LQHSSYPLT SEQ ID NO:16248 |

FIGURE 49
(Continued)

| | | | | | |
|---|---|---|---|---|---|
| iPS:392644 | 21-225_19E1 | NA | CGGGCAAGTCAGGGCATTAGAAATGATTTAGGC<br>SEQ ID NO:225 | GCTGCATCCAATTTACAA AGT<br>SEQ ID NO:8237 | CTACAGCATAATAGTTTCCCGCTCACT<br>SEQ ID NO:16249 |
| | | AA | RASQGIRNDLG<br>SEQ ID NO:226 | AASNLQS<br>SEQ ID NO:8238 | LQHNSFPLT<br>SEQ ID NO:16250 |
| iPS:392646 | 21-225_20G2 | NA | CGGGCAAGTCAGGGCATTAGAAATGATTTAGGC<br>SEQ ID NO:227 | GCTGCATCCAGTTCCAA AGT<br>SEQ ID NO:8239 | CTACAGCATAATAGTTACCCGCTCACT<br>SEQ ID NO:16251 |
| | | AA | RASQGIRNDLG<br>SEQ ID NO:228 | AASSFQS<br>SEQ ID NO:8240 | LQHNSYPLT<br>SEQ ID NO:16252 |
| iPS:392648 | 21-225_16D11 | NA | CGGGCAAGTCAGAGACCATTAGCAACTATTTAAAT<br>SEQ ID NO:229 | GCTGCATCCAGTTTGCAA AGT<br>SEQ ID NO:8241 | CAACAGAGTCACAGTTCCCGCTCACT<br>SEQ ID NO:16253 |
| | | AA | RASQTISNYLN<br>SEQ ID NO:230 | AASSLQS<br>SEQ ID NO:8242 | QQSHSSPLT<br>SEQ ID NO:16254 |
| iPS:392650 | 21-225_17A4 | NA | CGGGCGAGTCAGGGTATTGGCAACTGGTTAGCC<br>SEQ ID NO:231 | GCTGCATCCAGTTTGCAA AGT<br>SEQ ID NO:8243 | CAACAGGCTAACAGTTCCCTCGGACG<br>SEQ ID NO:16255 |
| | | AA | RASQGIGNWLA<br>SEQ ID NO:232 | AASSLQS<br>SEQ ID NO:8244 | QQANSFPRT<br>SEQ ID NO:16256 |
| iPS:392652 | 21-225_17C6 | NA | CGGGCAAGTCAGAGCATTAATACTTATTTAAAT<br>SEQ ID NO:233 | GCTGCATCCAGTTTGCAA AGT<br>SEQ ID NO:8245 | CAACAGAGTTACAGAACCCCCTTTTTCACT<br>SEQ ID NO:16257 |
| | | AA | RASQSINTYLN<br>SEQ ID NO:234 | AASSLQS<br>SEQ ID NO:8246 | QQSYRTPFFT<br>SEQ ID NO:16258 |
| iPS:392654 | 21-225_17A10 | NA | CGGGCAAGTCAGGGCATTAGAAATGATTTAGGC<br>SEQ ID NO:235 | GCTGCATCCAGTTTACAA AGT<br>SEQ ID NO:8247 | CTACAGCATAATAGTTACCCGCTCACT<br>SEQ ID NO:16259 |
| | | AA | RASQGIRNDLG<br>SEQ ID NO:236 | AASSLQS<br>SEQ ID NO:8248 | LQHNSYPLT<br>SEQ ID NO:16260 |

FIGURE 49
(Continued)

| | | | | | |
|---|---|---|---|---|---|
| iPS:392656 | 21-225_1F2 | NA | CGGGCAAGTCAGGGCATTAG AAATGATTAGGC SEQ ID NO:237 | GCTGCATCCAGTGTGCA AAGT SEQ ID NO:8249 | CTACAGCATAATAGTTACCC GCTCACT SEQ ID NO:16261 |
| | | AA | RASQGIRNDLG SEQ ID NO:238 | AASSVQS SEQ ID NO:8250 | LQHNSYPLT SEQ ID NO:16262 |
| iPS:392658 | 21-225_18E8 | NA | CGGGCAAGTCAGGGCATTAG AAATGATTAGGC SEQ ID NO:239 | GCTGCATCCAGTTTGCAA AGT SEQ ID NO:8251 | CTACAGCATAATAGTTACCC GCTCACT SEQ ID NO:16263 |
| | | AA | RASQGIRNDLG SEQ ID NO:240 | AASSLQS SEQ ID NO:8252 | LQHNSYPLT SEQ ID NO:16264 |
| iPS:392660 | 21-225_19B3 | NA | CGGGCAGGTCAGAGAACATTAT CAACTATTTAAAT SEQ ID NO:241 | GTTGCATCCAGTTTGCAA AGT SEQ ID NO:8253 | CAACAGAGTTACAGTACCCC TTTCACT SEQ ID NO:16265 |
| | | AA | RAGQNIINYLN SEQ ID NO:242 | VASSLQS SEQ ID NO:8254 | QQSYSTPFT SEQ ID NO:16266 |
| iPS:392664 | 21-225_20F6 | NA | CGGGCAAGTCAGAGCATTAT CACCTATTTAAAT SEQ ID NO:243 | ACTGCATCCAGTTTGCAA AGT SEQ ID NO:8255 | CAACAGACTTACAGTCCCCC GCTCACT SEQ ID NO:16267 |
| | | AA | RASQSITYLN SEQ ID NO:244 | TASSLQS SEQ ID NO:8256 | QQTYSPPLT SEQ ID NO:16268 |
| iPS:392666 | 21-225_16F11 | NA | CGGGCAAGTCAGGGCATTAG AAATGATTAGGC SEQ ID NO:245 | GCTGCATCCAGTGTACA AAGT SEQ ID NO:8257 | CTACAGCATAATAGTTACCC GCTCACT SEQ ID NO:16269 |
| | | AA | RASQGIRNDLG SEQ ID NO:246 | AASSVQS SEQ ID NO:8258 | LQHNSYPLT SEQ ID NO:16270 |
| iPS:392668 | 21-225_17B4 | NA | CGGGCAAGTCAGAACATTAG TAGTTATTTAAAT SEQ ID NO:247 | GGTGCATCCAGTTTGCAA AACT SEQ ID NO:8259 | CAACAGAGTTACAGAACCCC CTTTTCACT SEQ ID NO:16271 |
| | | AA | RASQNISSYLN SEQ ID NO:248 | GASSLQT SEQ ID NO:8260 | QQSYRTPFFT SEQ ID NO:16272 |

FIGURE 49
(Continued)

| | | | | | |
|---|---|---|---|---|---|
| iPS:392674 | 21-225_18C2 | NA | CGGGGCAAGTCAGGGCATTAG AAATGATTTAGGC<br>SEQ ID NO:249<br>RASQGIRNDLG<br>SEQ ID NO:250 | ACTGCATCCAGTTTGCAA AGT<br>SEQ ID NO:8261<br>TASSLQS<br>SEQ ID NO:8262 | CTACAACATAATAGTTACCC GTGGACG<br>SEQ ID NO:16273<br>LQHNSYPWT<br>SEQ ID NO:16274 |
| iPS:392676 | 21-225_19F3 | NA | CGGGCAAGTCAGGGCATTAA GAAATGATTTAGGC<br>SEQ ID NO:251<br>RASQGIRNDLG<br>SEQ ID NO:252 | GCTGTTTCCAGTTTGCAA AGT<br>SEQ ID NO:8263<br>AVSSLQS<br>SEQ ID NO:8264 | CTACAGCATGCCAGTTACCC GCTCACT<br>SEQ ID NO:16275<br>LQHASYPLT<br>SEQ ID NO:16276 |
| iPS:392678 | 21-225_20F3 | NA | CGGGCAAGTCAGAGAGCATTAG TAGTTATTTATAT<br>SEQ ID NO:253<br>RASQSISSYLY<br>SEQ ID NO:254 | GCTGCATCCAGTTTGCAA AGT<br>SEQ ID NO:8265<br>AASSLQS<br>SEQ ID NO:8266 | CAACAGAGTTACAGTGCCCC TCCATTCACT<br>SEQ ID NO:16277<br>QQSYSAPPFT<br>SEQ ID NO:16278 |
| iPS:392680 | 21-225_20A7 | NA | CGGGCAAGTCAGGGCATTAG AAATGATTTAGGC<br>SEQ ID NO:255<br>RASQGIRNDLG<br>SEQ ID NO:256 | GCTGCATCCAGTTTGCAA AGT<br>SEQ ID NO:8267<br>AASSLQS<br>SEQ ID NO:8268 | CTACAGCATAATAGTTACCC GCTCACT<br>SEQ ID NO:16279<br>LQHNSYPLT<br>SEQ ID NO:16280 |
| iPS:392682 | 21-225_16A12 | NA | CGGGCGAGTCAGGGCATTAAA CACTTATTTAGCC<br>SEQ ID NO:257<br>RASQAINTYLA<br>SEQ ID NO:258 | GCTGCATCCAGTTTGCAA AGT<br>SEQ ID NO:8269<br>AASSLQS<br>SEQ ID NO:8270 | CAACAGTATTATAGTTATCC GCTCACT<br>SEQ ID NO:16281<br>QQYYSYPLT<br>SEQ ID NO:16282 |
| iPS:392684 | 21-225_17F4 | NA | CGGGCAAGTCAGGGCATTAG AAATGATTTAGGC<br>SEQ ID NO:259<br>RASQGIRNDLG<br>SEQ ID NO:260 | GCTGCATCCAGTTTGCAA AGT<br>SEQ ID NO:8271<br>AASSLQS<br>SEQ ID NO:8272 | CTACAGCATAATAGTTACCC ATTCACT<br>SEQ ID NO:16283<br>LQHNSYPFT<br>SEQ ID NO:16284 |

FIGURE 49
(Continued)

| | | | | | | | |
|---|---|---|---|---|---|---|---|
| iPS:392686 | 21-225_17C7 | NA | CGGGCAAGTCAGGGCATTAG AAATGATTTAGGC | GCTGCATCCAGTTTGCAA AGT | CTACAGCATAATAGTTACCC GTGGACG | | |
| | | | SEQ ID NO:261 | SEQ ID NO:8273 | SEQ ID NO:16285 | | |
| | | AA | RASQGIRNDLG | AASSLQS | LQHNSYPWT | | |
| | | | SEQ ID NO:262 | SEQ ID NO:8274 | SEQ ID NO:16286 | | |
| iPS:392690 | 21-225_18F2 | NA | CGGGCAAGTCAGGGCATTAG AAATGATTTAGGC | GCTGCATCCAGTTTGCAA AGT | CTACAGCATAATAGTTACCC GTGGACG | | |
| | | | SEQ ID NO:263 | SEQ ID NO:8275 | SEQ ID NO:16287 | | |
| | | AA | RASQGIRNDLG | AASSLQS | LQHNSYPWT | | |
| | | | SEQ ID NO:264 | SEQ ID NO:8276 | SEQ ID NO:16288 | | |
| iPS:392692 | 21-225_18G10 | NA | CGGGCGAGTCAGGACATTAG CTATTATTTAGCC | GTTGCATCCAGTTTGCAA AGT | TTACAGTATAATAGTTACCC ATTCACT | | |
| | | | SEQ ID NO:265 | SEQ ID NO:8277 | SEQ ID NO:16289 | | |
| | | AA | RASQDISYYLA | VASSLQS | LQYNSYPFT | | |
| | | | SEQ ID NO:266 | SEQ ID NO:8278 | SEQ ID NO:16290 | | |
| iPS:392694 | 21-225_19A5 | NA | CGGGCAAGTCAGAACATTAT CAACTATTTAAAT | GTTGCATCCAATTTACAA GGT | CAACAGAGTTACAGTACCC TTTCACT | | |
| | | | SEQ ID NO:267 | SEQ ID NO:8279 | SEQ ID NO:16291 | | |
| | | AA | RASQNIINYLN | VASNLQG | QQSYSTPFT | | |
| | | | SEQ ID NO:268 | SEQ ID NO:8280 | SEQ ID NO:16292 | | |
| iPS:392696 | 21-225_20A4 | NA | CGGGCAAGTCAGAGAGCATTAT CAACTATTTAAAT | GCTGCATCCAGTTTGCAC AGT | CAACAGAGTTACAGAACCCC CTTATTCACT | | |
| | | | SEQ ID NO:269 | SEQ ID NO:8281 | SEQ ID NO:16293 | | |
| | | AA | RASQSIINYLN | AASSLHS | QQSYRTPLFT | | |
| | | | SEQ ID NO:270 | SEQ ID NO:8282 | SEQ ID NO:16294 | | |
| iPS:392700 | 21-225_16E12 | NA | CGGGCAAGTCAGGGCATTAG AAATGATTTAGGC | GCTGCATCCAGTTTACAA AGT | CTACAGCATAATAGTTACCC GCTCACT | | |
| | | | SEQ ID NO:271 | SEQ ID NO:8283 | SEQ ID NO:16295 | | |
| | | AA | RASQGIRNDLG | AASSLQS | LQHNSYPLT | | |
| | | | SEQ ID NO:272 | SEQ ID NO:8284 | SEQ ID NO:16296 | | |

FIGURE 49
(Continued)

| | | | | | |
|---|---|---|---|---|---|
| iPS:392702 | 21-225_17F7 | NA | CGGGGCAAGTCAGACCATTAG<br>TAGTTTTTAAAT<br>SEQ ID NO:273<br>RASQTISSFLN<br>SEQ ID NO:274 | GCTGCTTCCAGTTGCAA<br>AGT<br>SEQ ID NO:8285<br>AASSLQS<br>SEQ ID NO:8286 | CAACAGAGTTACAGAACCCC<br>CTTTTTCACT<br>SEQ ID NO:16297<br>QQSYRTPFT<br>SEQ ID NO:16298 |
| iPS:392704 | 21-225_17F11 | NA | CGGGCAAGTCGGACCATTAA<br>CAACTATTTAAAT<br>SEQ ID NO:275<br>RASRTINNYLN<br>SEQ ID NO:276 | GCTACATCCAGTTTACAA<br>AGT<br>SEQ ID NO:8287<br>ATSSLQS<br>SEQ ID NO:8288 | CAACAGACTTACAGTACCCC<br>CTTATTCGCT<br>SEQ ID NO:16299<br>QQTYSTPLFA<br>SEQ ID NO:16300 |
| iPS:392706 | 21-225_18A3 | NA | CGGGCAAGTCAGGGCATTAG<br>AAATGATTTAGGC<br>SEQ ID NO:277<br>RASQGIRNDLG<br>SEQ ID NO:278 | GTTGCATCCAGTTGCAA<br>AGT<br>SEQ ID NO:8289<br>VASSLQS<br>SEQ ID NO:8290 | CTACAGCATAGTAGTTACCC<br>GCTCACT<br>SEQ ID NO:16301<br>LQHSSYPLT<br>SEQ ID NO:16302 |
| iPS:392708 | 21-225_18D11 | NA | CGGGCGAGTCAGGGCATTAG<br>CTATTATTTAGCC<br>SEQ ID NO:279<br>RASQGISYYLA<br>SEQ ID NO:280 | GTTGCATCCAGTTGCAA<br>AGT<br>SEQ ID NO:8291<br>VASSLQS<br>SEQ ID NO:8292 | CAACAGTATATAATACTTACCC<br>ATTCACT<br>SEQ ID NO:16303<br>QQYNTYPFT<br>SEQ ID NO:16304 |
| iPS:392710 | 21-225_19A10 | NA | CGGGCAAGTCAGGGCATTAG<br>AACTGATTTAGGC<br>SEQ ID NO:281<br>RASQGIRTDLG<br>SEQ ID NO:282 | ACTGCATCCAGTTTGCAA<br>AGT<br>SEQ ID NO:8293<br>TASSLQS<br>SEQ ID NO:8294 | CTACAGCATAATGGTTACCC<br>GTGGACG<br>SEQ ID NO:16305<br>LQHNGYPWT<br>SEQ ID NO:16306 |
| iPS:392714 | 21-225_16G12 | NA | CGGGCGAGTCAGGACATTAG<br>CAATTATTTAGCC<br>SEQ ID NO:283<br>RASQDISNYLA<br>SEQ ID NO:284 | GCTGCATCCAGTTTGCAA<br>AGT<br>SEQ ID NO:8295<br>AASSLQS<br>SEQ ID NO:8296 | CAACAGTATCATAGTTTCCC<br>ATTCACT<br>SEQ ID NO:16307<br>QQYHSFPFT<br>SEQ ID NO:16308 |

FIGURE 49
(Continued)

| iPS:392716 | 21-225_17B5 | NA | CGGGCAAGTCAGGGCATTAG AAATGATTTAGGC | GCTGCATCCAATTTGCAA AGT | CTACAGCATAATAGTTACCC GCTCACT |
|---|---|---|---|---|---|
| | | | SEQ ID NO:285 | SEQ ID NO:8297 | SEQ ID NO:16309 |
| | | AA | RASQGIRNDLG | AASNLQS | LQHNSYPLT |
| | | | SEQ ID NO:286 | SEQ ID NO:8298 | SEQ ID NO:16310 |
| iPS:392718 | 21-225_17B8 | NA | AGGTCTAGTCAGAGCCTCCT GCATAGTAATGGGAACAACT CTTTGGAT | TTGGGTTCTCATCGGCC TCC | ATGCAAGTTCTACAAACTCC TCCCCTCACT |
| | | | SEQ ID NO:287 | SEQ ID NO:8299 | SEQ ID NO:16311 |
| | | AA | RSSQSLLHSNGNNSLD | LGSHRAS | MQVLQTPPLT |
| | | | SEQ ID NO:288 | SEQ ID NO:8300 | SEQ ID NO:16312 |
| iPS:392720 | 21-225_17A12 | NA | CGGGCAAGTCAGAGCATTAG TAGTTATTTAAAT | GCTGCATCCAGTTTGCAA AGT | CAACAGAGTTACAATACCCC CTTATTCACT |
| | | | SEQ ID NO:289 | SEQ ID NO:8301 | SEQ ID NO:16313 |
| | | AA | RASQSISSYLN | AASSLQS | QQSYNTPLFT |
| | | | SEQ ID NO:290 | SEQ ID NO:8302 | SEQ ID NO:16314 |
| iPS:392722 | 21-225_18E12 | NA | CGGGCAAGTCAGAGCATTAG TAGTTATTTAAAT | GCTGCATCCAGTTTACAA AGT | CAACAGAGTTACAGAACCCC CTTTTTCACT |
| | | | SEQ ID NO:291 | SEQ ID NO:8303 | SEQ ID NO:16315 |
| | | AA | RASQSISSYLN | AASSLQS | QQSYRTPFFT |
| | | | SEQ ID NO:292 | SEQ ID NO:8304 | SEQ ID NO:16316 |
| iPS:392726 | 21-225_20B5 | NA | CGGGCGAGTCAGGGCATTAA CAATTATTTAGCC | GCTGCATCCACTTTGCAA TCA | CAAAAGTATAACAGTGCCCC TCCGATCACC |
| | | | SEQ ID NO:293 | SEQ ID NO:8305 | SEQ ID NO:16317 |
| | | AA | RASQGINNYLA | AASTLQS | QKYNSAPIT |
| | | | SEQ ID NO:294 | SEQ ID NO:8306 | SEQ ID NO:16318 |
| iPS:392728 | 21-225_20F7 | NA | CGGGGCGAGTCAGGGTATTAG CAGCTGGTTAGCC | GCTGCATCCAGTTTGCAA AGT | CAACAGGCTAACAGTTTCCC TCGGACG |
| | | | SEQ ID NO:295 | SEQ ID NO:8307 | SEQ ID NO:16319 |
| | | AA | RASQGISSWLA | AASSLQS | QQANSFPRT |

FIGURE 49
(Continued)

| | | | | | | |
|---|---|---|---|---|---|---|
| iPS:392730 | 21-225_17A1 | NA | SEQ ID NO:296 CGGGCAAGTCAGAAACATTAA CAATTATTAAAT | SEQ ID NO:8308 ACTACATCTAGTTACAA AGT | SEQ ID NO:16320 CAACAGAGTTACACTACCCC CACGTGGACG |
| | | AA | SEQ ID NO:297 RASQNINNYLN | SEQ ID NO:8309 TTSSLQS | SEQ ID NO:16321 QQSYTTPTWT |
| iPS:392732 | 21-225_17E5 | NA | SEQ ID NO:298 CGGGCAAGTCAGGGCATTAG AAATGATTTAGGC | SEQ ID NO:8310 ACTGCATCCAGTTGCAA AGT | SEQ ID NO:16322 CTACAACATAATAGTTACCC GTTGACG |
| | | AA | SEQ ID NO:299 RASQGIRNDLG | SEQ ID NO:8311 TASSLQS | SEQ ID NO:16323 LQHNSYPLT |
| iPS:392734 | 21-225_17D8 | NA | SEQ ID NO:300 AGGGCCAGTCAGAGAGTGTTAG CAGCAACTTAGCC | SEQ ID NO:8312 GGTGCATCCACCAGGGC CAGT | SEQ ID NO:16324 CAGCAGTATAATAACTGGCC TCTGACG |
| | | AA | SEQ ID NO:301 RASQSVSSNLA | SEQ ID NO:8313 GASTRAS | SEQ ID NO:16325 QQYNNWPLT |
| iPS:392736 | 21-225_17B12 | NA | SEQ ID NO:302 CGGGCAAGTCAGAATATTAA CAACTATTAAAT | SEQ ID NO:8314 ACTGCATCCAGTTTGCAA ACT | SEQ ID NO:16326 CAACAGACTTACACTACCCC CACGTGGACG |
| | | AA | SEQ ID NO:303 RASQNINNYLN | SEQ ID NO:8315 TASSLQS | SEQ ID NO:16327 QQTYTTPTWT |
| iPS:392738 | 21-225_18G4 | NA | SEQ ID NO:304 CGGGCAAGTCAGAGCATTAT CAGCTATTAAAT | SEQ ID NO:8316 ACTGCATCCAGTTGCAA ACT | SEQ ID NO:16328 CAACAGACTTACAGTCCCCC GCTCACT |
| | | AA | SEQ ID NO:305 RASQSHSYLN | SEQ ID NO:8317 TASSLQT | SEQ ID NO:16329 QQTYSPPLT |
| iPS:392740 | 21-225_18H12 | NA | SEQ ID NO:306 CGGGCAAGTCAGGGCATTAG AAATGATTTAGGC | SEQ ID NO:8318 ACTGCATCCAATTGCAA AGT | SEQ ID NO:16330 CTACAACATAATAATTACCC GTGGACG |
| | | AA | SEQ ID NO:307 RASQGIRNDLG | SEQ ID NO:8319 TASNLQS | SEQ ID NO:16331 LQHNYPWT |

FIGURE 49
(Continued)

| | | | | | | |
|---|---|---|---|---|---|---|
| iPS:392742 | 21-225_20B2 | NA | SEQ ID NO:308<br>CGGGCAAGTCAGGACATTAG<br>AAATGATTTAGGC | SEQ ID NO:8320<br>GCTGCATCCAGTTTGCAA<br>AGT | SEQ ID NO:16332<br>CTACAGCATTATAATTACCC<br>TCGGGCG |
| | | AA | SEQ ID NO:309<br>RASQDIRNDLG | SEQ ID NO:8321<br>AASSLQS | SEQ ID NO:16333<br>LQHYNYPRA |
| iPS:392744 | 21-225_20D5 | NA | SEQ ID NO:310<br>CGGGCAAGTCAAGGCATTAG<br>AAATGATTTAGGC | SEQ ID NO:8322<br>GCTGCATCCAGTTTGCAA<br>AGT | SEQ ID NO:16334<br>CTACAGCATAATAGTTACCC<br>GTTCACT |
| | | AA | SEQ ID NO:311<br>RASQGIRNDLG | SEQ ID NO:8323<br>AASSLQS | SEQ ID NO:16335<br>LQHNSYPFT |
| iPS:392746 | 21-225_20H7 | NA | SEQ ID NO:312<br>CGGACGAGTCAGGGCATTAA<br>CAATTATTTAGTC | SEQ ID NO:8324<br>GCTGCATCCAGTTTGCAA<br>AGT | SEQ ID NO:16336<br>CAACAGTATTATAGTTACCC<br>ATTCACT |
| | | AA | SEQ ID NO:313<br>RTSQGINNYLV | SEQ ID NO:8325<br>AASSLQS | SEQ ID NO:16337<br>QQYYSYPFT |
| iPS:392748 | 21-225_20A8 | NA | SEQ ID NO:314<br>CGGGCGAGTCAGGCATTAA<br>TAATTATTTAGTC | SEQ ID NO:8326<br>GCTGCATCCAGTTTGCTG<br>AGT | SEQ ID NO:16338<br>CAACAGTATAATAGTTACCC<br>GATCACC |
| | | AA | SEQ ID NO:315<br>RASQGINNYLV | SEQ ID NO:8327<br>AASSLLS | SEQ ID NO:16339<br>QQYNSYPIT |
| iPS:392750 | 21-225_20A10 | NA | SEQ ID NO:316<br>CGGGCAAGTCAAGGCATTAG<br>AAATGATTTAGGC | SEQ ID NO:8328<br>GCTGCATCCAGTTTGCAA<br>AGT | SEQ ID NO:16340<br>CTACAGCATAATAGATACCC<br>GCTCACT |
| | | AA | SEQ ID NO:317<br>RASQGIRNDLG | SEQ ID NO:8329<br>AASSLQS | SEQ ID NO:16341<br>LQHNRYPLT |
| iPS:392754 | 21-225_21D3 | NA | SEQ ID NO:318<br>CGGGCAAGTCAGAGCATTAC<br>TGGTTATTCAAAT | SEQ ID NO:8330<br>GCTACATACAGTTTGGA<br>AAGT | SEQ ID NO:16342<br>CAACAGAGTTACAGTACCTC<br>GATCACC |
| | | AA | SEQ ID NO:319<br>RASQSITGYSN | SEQ ID NO:8331<br>ATYSLES | SEQ ID NO:16343<br>QQSYSTSIT |

FIGURE 49
(Continued)

| | | | | | | | | |
|---|---|---|---|---|---|---|---|---|
| iPS:392758 | 21-225_21G11 | NA | SEQ ID NO:320 | CGGGCAAGTCAGGGCATTAG AAATGATTTAGGC | SEQ ID NO:8332 | ACTGCATCCAGTTTGCAA AGT | SEQ ID NO:16344 | CTACAACATAATAATTACCC GTGGACG |
| | | AA | SEQ ID NO:321 | RASQGIRNDLG | SEQ ID NO:8333 | TASSLQS | SEQ ID NO:16345 | LQHNNYPWT |
| iPS:392760 | 21-225_22G3 | NA | SEQ ID NO:322 | CGGGCAAGTCAGAGCATTAG TAATTATTTAAAT | SEQ ID NO:8334 | GCTGCTTCCAGTTTGCAA AGT | SEQ ID NO:16346 | CAACAGAGTTTCAGAACCCC CTTTTCACT |
| | | AA | SEQ ID NO:323 | RASQSISNYLN | SEQ ID NO:8335 | AASSLQS | SEQ ID NO:16347 | QQSFRTPFFT |
| iPS:392762 | 21-225_22G5 | NA | SEQ ID NO:324 | CGGGCAAGTCAGAACATTAG CAGCTATTTAAAT | SEQ ID NO:8336 | GCTGCATCCAGTTTGCAA AAT | SEQ ID NO:16348 | CAACAGAGTTACAGAACCCC CTTATTCACT |
| | | AA | SEQ ID NO:325 | RASQNISSYLN | SEQ ID NO:8337 | AASSLQN | SEQ ID NO:16349 | QQSYRTPLFT |
| iPS:392764 | 21-225_22G10 | NA | SEQ ID NO:326 | CGGGCAAGTCAGAGCATTTT CAGTATTTAAAT | SEQ ID NO:8338 | GCTGCATCCAGTTTACAA AGT | SEQ ID NO:16350 | CAACAGAGTTTCAGAACCCC CTTATTCACT |
| | | AA | SEQ ID NO:327 | RASQSIFSYLN | SEQ ID NO:8339 | AASSLQS | SEQ ID NO:16351 | QQSFRTPLFT |
| iPS:392766 | 21-225_23H4 | NA | SEQ ID NO:328 | CGGGCAAGTCAGAGCATTAG CAGGTATTTAAAT | SEQ ID NO:8340 | TCTACATCCAGTTTGCAA AGT | SEQ ID NO:16352 | CAACAGAGTTACAGTACCCC CACGTGGACG |
| | | AA | SEQ ID NO:329 | RASQSISRYLN | SEQ ID NO:8341 | STSSLQS | SEQ ID NO:16353 | QQSYSTPTWT |
| iPS:392768 | 21-225_20B8 | NA | SEQ ID NO:330 | AGGGCCAGTCAGAGTGTTAG CAGCAACTTAGCC | SEQ ID NO:8342 | GGTGCATCCACCAGGGC CAGT | SEQ ID NO:16354 | CAGCAGTATAATAACTGTCC TCTGACG |
| | | AA | SEQ ID NO:331 | RASQSVSSNLA | SEQ ID NO:8343 | GASTRAS | SEQ ID NO:16355 | QQYNNCPLT |

FIGURE 49
(Continued)

| | | | | | | |
|---|---|---|---|---|---|---|
| iPS:392770 | 21-225_20C10 | NA | SEQ ID NO:332 CGGGCAAGTCAAGTCACCATATTAG CAACTATTTAAAT | SEQ ID NO:8344 ACTGCATCCAGTTTGCAA AGT | SEQ ID NO:16356 CAACAGAGTTACACTACCCC CACGTGGACG | |
| | | AA | SEQ ID NO:333 RASHHISNYLN | SEQ ID NO:8345 TASSLQS | SEQ ID NO:16357 QQSYTPTWT | |
| iPS:392772 | 21-225_20E12 | NA | SEQ ID NO:334 CGGGCAAGTCAGGGCATTAG AAATGATTTAGGC | SEQ ID NO:8346 GCTGCATCCAGTTTACAA AGT | SEQ ID NO:16358 CTACAGCATAATAGTTACCC GTTCACT | |
| | | AA | SEQ ID NO:335 RASQGIRNDLG | SEQ ID NO:8347 AASSLQS | SEQ ID NO:16359 LQHNSYPFT | |
| iPS:392774 | 21-225_21F3 | NA | SEQ ID NO:336 CGGGCAAGTCAGGGCATTAG AAATGATTTAGGC | SEQ ID NO:8348 GCTGCATCCAGTTTGCAA AGT | SEQ ID NO:16360 CTACAGCATAGTAGTTACCC CCTCACT | |
| | | AA | SEQ ID NO:337 RASQGIRNDLG | SEQ ID NO:8349 AASSLQS | SEQ ID NO:16361 LQHSSYPLT | |
| iPS:392776 | 21-225_21A12 | NA | SEQ ID NO:338 CGGGCGAGTCAAGGCATTAG CAAATATTTAGCC | SEQ ID NO:8350 GCTGCATCCAGTTTGCAA AGT | SEQ ID NO:16362 CAACAGTATAATAGTTACCC GTTCAGG | |
| | | AA | SEQ ID NO:339 RASQGISKYLA | SEQ ID NO:8351 AASSLQS | SEQ ID NO:16363 QQYNSYPFR | |
| iPS:392778 | 21-225_22H3 | NA | SEQ ID NO:340 CGGGCAAGTCAGGACATTAG AAATAATTTAGGC | SEQ ID NO:8352 CCTGCATCCAGTTTGCAA ACT | SEQ ID NO:16364 CTACAGGATAATAGTTACCC ATTCACT | |
| | | AA | SEQ ID NO:341 RASQDIRNNLG | SEQ ID NO:8353 PASSLQT | SEQ ID NO:16365 LQDNSYPFT | |
| iPS:392780 | 21-225_22B7 | NA | SEQ ID NO:342 CGGGCAAGTCAGGGCATTAG AAATGATTTAGGC | SEQ ID NO:8354 ACTGCATCCAGTTTGCAA AGT | SEQ ID NO:16366 CTACAGCATAATACTTACCC GCTCACT | |
| | | AA | SEQ ID NO:343 RASQGIRNDLG | SEQ ID NO:8355 TASSLQS | SEQ ID NO:16367 LQHNTYPLT | |

FIGURE 49
(Continued)

| | | | | | |
|---|---|---|---|---|---|
| iPS:392782 | 21-225_22B12 | NA | SEQ ID NO:344 CGGGCGAGTCAGGACATTAG CAATTATTTAGCC | SEQ ID NO:8356 GGTGCATCCAGTTGCG GAGT | SEQ ID NO:16368 CAACAGTATCATAGTTACCC ATTCACT |
| | | AA | SEQ ID NO:345 RASQDISNYLA | SEQ ID NO:8357 GASSLRS | SEQ ID NO:16369 QQYHSYPFT |
| iPS:392784 | 21-225_23C7 | NA | SEQ ID NO:346 CGGGCGAGTCAGGGCATTGG CATTTATTTAGCC | SEQ ID NO:8358 GCTGCATCCAGTTTGCAA AGT | SEQ ID NO:16370 CAACAGTATAATAGTTACCC ATTCACT |
| | | AA | SEQ ID NO:347 RASQGIGIYLA | SEQ ID NO:8359 AASSLQS | SEQ ID NO:16371 QQYNSYPFT |
| iPS:392786 | 21-225_24E1 | NA | SEQ ID NO:348 AAGTCCAGCCAGAGTGTTTT ATACACCTCCAACAATAACA ACTACTTAACT | SEQ ID NO:8360 TGGGCATCTACCCGGGA ATCC | SEQ ID NO:16372 CAGCAATTTTATAGTACTCC TCCGACG |
| | | AA | SEQ ID NO:349 KSSQSVLYTSNNNNYLT | SEQ ID NO:8361 WASTRES | SEQ ID NO:16373 QQFYSTPPT |
| iPS:392788 | 21-225_20C8 | NA | SEQ ID NO:350 CGGGCAAGTCAGGGCATTAG AAATGATTTAGGC | SEQ ID NO:8362 GCTGCATCCAGTTTGCAA AGT | SEQ ID NO:16374 CTACAAGATAATAGTTACCC GTTCACT |
| | | AA | SEQ ID NO:351 RASQGIRNDLG | SEQ ID NO:8363 AASSLQS | SEQ ID NO:16375 LQDNSYPFT |
| iPS:392790 | 21-225_20D10 | NA | SEQ ID NO:352 CGGGCAAGTCAGGGCATTAG AAATGATTTAGGC | SEQ ID NO:8364 GTTGCATACAGTTTGCAA AGT | SEQ ID NO:16376 ATACAGCAAAATAGTTACCC GTGGACG |
| | | AA | SEQ ID NO:353 RASQGIRNDLG | SEQ ID NO:8365 VAYSLQS | SEQ ID NO:16377 IQQNSYPWT |
| iPS:392792 | 21-225_20G12 | NA | SEQ ID NO:354 CGGGCGAGTCAGGGCATTAG CAATTATTTAGCC | SEQ ID NO:8366 ACTGCATCCACTTTGCAA TCA | SEQ ID NO:16378 CAAAAGTATAACAGTGCCCC TCCGATCACC |
| | | | SEQ ID NO:355 | SEQ ID NO:8367 | SEQ ID NO:16379 |

FIGURE 49
(Continued)

| | | RASQGISNYLA | | TASTLQS | | QKYNSAPPT | |
|---|---|---|---|---|---|---|---|
| | AA | RASQGISNYLA | SEQ ID NO:356 | TASTLQS | SEQ ID NO:8368 | QKYNSAPPT | SEQ ID NO:16380 |
| iPS:392794 | NA | CGGGCAAGTCAGGGCATTAG AAATGATTTAGGC | SEQ ID NO:357 | GCTGCGTCCAGTGTGCA AACT | SEQ ID NO:8369 | CTACAGCATAATAGTTATCC GCTCACT | SEQ ID NO:16381 |
| 21-225_21H3 | AA | RASQGIRNDLG | SEQ ID NO:358 | AASSVQT | SEQ ID NO:8370 | LQHNSYPLT | SEQ ID NO:16382 |
| iPS:392796 | NA | CGGGCAAGTCAGGGCATTAG AAATGATTTAGGC | SEQ ID NO:359 | GCTGCATCCAGTTTGCAA AGT | SEQ ID NO:8371 | CTTCAGCATAATAGTTACCC GTGGACG | SEQ ID NO:16383 |
| 21-225_22A4 | AA | RASQGIRNDLG | SEQ ID NO:360 | AASSLQS | SEQ ID NO:8372 | LQHNSYPWT | SEQ ID NO:16384 |
| iPS:392798 | NA | CGGGCAAGTCAGAACATTAT CAGCTATTTAAAT | SEQ ID NO:361 | ATTGCATCCAGTTTGCAA AGT | SEQ ID NO:8373 | CAACAGACTTACAGTACCCC GCTCACT | SEQ ID NO:16385 |
| 21-225_22C7 | AA | RASQNIISYLN | SEQ ID NO:362 | IASSLQS | SEQ ID NO:8374 | QQTYSTPLT | SEQ ID NO:16386 |
| iPS:392800 | NA | CGGGCAAGTCAGGGCATTAG AAATGATTTAGGC | SEQ ID NO:363 | GCTGCATCCAGTTTGCAG AGT | SEQ ID NO:8375 | CTACAGCATAGTACTTACCC TCTCACT | SEQ ID NO:16387 |
| 21-225_22D12 | AA | RASQGIRNDLG | SEQ ID NO:364 | AASSLQS | SEQ ID NO:8376 | LQHSTYPLT | SEQ ID NO:16388 |
| iPS:392802 | NA | CGGGCGAGTCAGGGCATTAG CAATTATTTAGCC | SEQ ID NO:365 | GCTGCATCCAGTTTGCAA AGT | SEQ ID NO:8377 | CAACAGTTTTATAGTTACCC ATTCACT | SEQ ID NO:16389 |
| 21-225_23E7 | AA | RASQGISNYLA | SEQ ID NO:366 | AASSLQS | SEQ ID NO:8378 | QQFYSYPFT | SEQ ID NO:16390 |
| iPS:392806 | NA | AGGGCCAGTCAGAGTGTTAG CAGCAACTTAGCC | SEQ ID NO:367 | TTTGCATCCATCAGGGCC ACT | SEQ ID NO:8379 | CAGCAGTATAATAACTGGCC CATGTGCAGT | SEQ ID NO:16391 |
| 21-225_24H3 | | | | | | | |

FIGURE 49
(Continued)

| | | | | | FASIRAT | | QQYNNWPMCS |
|---|---|---|---|---|---|---|---|
| | | AA | RASQSVSSNLA | | | | |
| | | | SEQ ID NO:368 | | SEQ ID NO:8380 | | SEQ ID NO:16392 |
| iPS:392808 | 21-225_20F8 | NA | CGGGCAAGTCAGAGCATTAG CAGGTATTTAAAT | GCTGCTTCCAGTTGCAA AGT | | CAACAGAGTTACAATACCCC CACGTGGACG | |
| | | | SEQ ID NO:369 | | SEQ ID NO:8381 | | SEQ ID NO:16393 |
| | | AA | RASQSISRYLN | AASSLQS | | QQSYNTPTWT | |
| | | | SEQ ID NO:370 | | SEQ ID NO:8382 | | SEQ ID NO:16394 |
| iPS:392810 | 21-225_20H12 | NA | CGGGCAAGTCAGGGCATTAG AAATGATTTAGAC | GCTGCATCCAGTTTGCAA AGT | | CTACAGCATAATAGTTACCC GCTCACT | |
| | | | SEQ ID NO:371 | | SEQ ID NO:8383 | | SEQ ID NO:16395 |
| | | AA | RASQGIRNDLD | AASSLQS | | LQHNSYPLT | |
| | | | SEQ ID NO:372 | | SEQ ID NO:8384 | | SEQ ID NO:16396 |
| iPS:392812 | 21-225_21F4 | NA | CGGGCAAGTCAGAACATTGG TAGTTATTTAAAT | GCTGCATCCAGTTGCAA AGT | | CAACAGAGTTACAGAACCCC CTTTTTCACT | |
| | | | SEQ ID NO:373 | | SEQ ID NO:8385 | | SEQ ID NO:16397 |
| | | AA | RASQNIGSYLN | AASSLQS | | QQSYRTPFT | |
| | | | SEQ ID NO:374 | | SEQ ID NO:8386 | | SEQ ID NO:16398 |
| iPS:392814 | 21-225_22A1 | NA | AAGTCTAGTCAGAGCCTCCT GCATAGTGGTGGAAAGACCT ATTTATAT | GAAGTTTCCAACCGGTTC TCT | | ATGCAAACTTTACACCTTCC GTGGACG | |
| | | | SEQ ID NO:375 | | SEQ ID NO:8387 | | SEQ ID NO:16399 |
| | | AA | KSSQSLLHSGGKTYLY | EVSNRFS | | MQTLHLPWT | |
| | | | SEQ ID NO:376 | | SEQ ID NO:8388 | | SEQ ID NO:16400 |
| iPS:392816 | 21-225_22E4 | NA | CGGGCAAGTCAGAACATTAG TAGTTATTTAAAT | GCTGCATCCAGTTTGCAA AGT | | CAACAGAGTTACAATACCCC CTTATTCACT | |
| | | | SEQ ID NO:377 | | SEQ ID NO:8389 | | SEQ ID NO:16401 |
| | | AA | RASQNISSYLN | AASSLQS | | QQSYNTPLFT | |
| | | | SEQ ID NO:378 | | SEQ ID NO:8390 | | SEQ ID NO:16402 |
| iPS:392818 | | NA | CGGACAAGTCAGAACAGTA ACAGTTATTTAAAT | GCTGCATACAGTTTGGA AAGT | | CAACAGACTTACGGTACCTC GATCACC | |

FIGURE 49
(Continued)

| | | | | | | | |
|---|---|---|---|---|---|---|---|
| iPS:392820 | 21-225_22D8 | AA | SEQ ID NO:379<br>RTSQNSNSYLN<br>SEQ ID NO:380 | | SEQ ID NO:8391<br>AAYSLES<br>SEQ ID NO:8392 | | SEQ ID NO:16403<br>QQTYGTSIT<br>SEQ ID NO:16404 |
| iPS:392822 | 21-225_23D1 | NA | CGGGCAAGTCAGGGCATCA<br>GAAATGATTTAGGC<br>SEQ ID NO:381 | | GCTGCATCCAGTTTACAA<br>AGT<br>SEQ ID NO:8393 | | CTACAGCATAGTAGTTACCC<br>TCTCACT<br>SEQ ID NO:16405 |
| | | AA | RASQGIRNDLG<br>SEQ ID NO:382 | | AASSLQS<br>SEQ ID NO:8394 | | LQHSSYPLT<br>SEQ ID NO:16406 |
| iPS:392824 | 21-225_23C8 | NA | CGGGCAAGTCAGGACATTAG<br>AAATGATTTAGGC<br>SEQ ID NO:383 | | GGTGCATCCAGTGTGCAA<br>AAGT<br>SEQ ID NO:8395 | | CTACAGCATAATAGTTACCC<br>GCTCACT<br>SEQ ID NO:16407 |
| | | AA | RASQDIRNDLG<br>SEQ ID NO:384 | | GASSVQS<br>SEQ ID NO:8396 | | LQHNSYPLT<br>SEQ ID NO:16408 |
| iPS:392826 | 21-225_24E5 | NA | CGGGCAAGTCAGGGCATTAG<br>AAATGATTTAGGC<br>SEQ ID NO:385 | | GCTGCATCCAGTTTGCAA<br>AGT<br>SEQ ID NO:8397 | | CTACAGCATAGTAATTACCC<br>GCTCACT<br>SEQ ID NO:16409 |
| | | AA | RASQGIRNDLG<br>SEQ ID NO:386 | | AASSLQS<br>SEQ ID NO:8398 | | LQHSNYPLT<br>SEQ ID NO:16410 |
| iPS:392828 | 21-225_20B9 | NA | CGGGCGAGTCAGGGCATTAG<br>CAATTATTTAGCC<br>SEQ ID NO:387 | | GTTGCATCCAGTTTGCAA<br>AGT<br>SEQ ID NO:8399 | | CAACAGTATAATACTTATCC<br>ATTCACT<br>SEQ ID NO:16411 |
| | | AA | RASQGISNYLA<br>SEQ ID NO:388 | | VASSLQS<br>SEQ ID NO:8400 | | QQYNTYPFT<br>SEQ ID NO:16412 |
| iPS:392830 | 21-225_21A5 | NA | CGGGCAAGTCAGACCATTAG<br>CAGCCATTTAAAT<br>SEQ ID NO:389 | | GCTGCATCCAGTTTGCAA<br>AGT<br>SEQ ID NO:8401 | | CAACAGAGTTACAATATCTC<br>ATTCACT<br>SEQ ID NO:16413 |
| | | AA | RASQTISSHLN<br>SEQ ID NO:390 | | AASSLQS<br>SEQ ID NO:8402 | | QQSYNISFT<br>SEQ ID NO:16414 |
| iPS:392832 | | NA | CGGGCAAGTCAGGGCATTAG<br>AAATGATTTAGGC | | GCTGCATCCAGTTTACAA<br>AGT | | CTACAGCATAATAGTTACCC<br>GTGGACG |

FIGURE 49
(Continued)

| | | | | | | |
|---|---|---|---|---|---|---|
| iPS:392834 | 21-225_21H8 | AA | SEQ ID NO:391 RASQGIRNDLG | SEQ ID NO:8403 AASSLQS | SEQ ID NO:16415 LQHNSYPWT | |
| | | NA | SEQ ID NO:392 CGGACAAGTCAGGGCATTAG AAATGATTAGGC | SEQ ID NO:8404 GCTGCATCCAGTTTGCAAAGT | SEQ ID NO:16416 CTACAGCATAGTACTTACCC GCTCACT | |
| iPS:392836 | 21-225_22C1 | AA | SEQ ID NO:393 RTSQGIRNDLG | SEQ ID NO:8405 AASSLQS | SEQ ID NO:16417 LQHSTYPLT | |
| | | NA | SEQ ID NO:394 CGGGCAAGTCAGGTCATTAG AGATGATTAGGC | SEQ ID NO:8406 GCTGCATCCAGTTTGCAAAGT | SEQ ID NO:16418 CTACACCACTATAGTTATCC TCGGACG | |
| iPS:392838 | 21-225_22F4 | AA | SEQ ID NO:395 RASQVIRDLG | SEQ ID NO:8407 AASSLQS | SEQ ID NO:16419 LHHYSYPRT | |
| | | NA | SEQ ID NO:396 CGGACAAGTCAGGGCATTAG AAATGATTAGGC | SEQ ID NO:8408 GCTGCATCCAGTTTGCAAAGT | SEQ ID NO:16420 CTACAGCATAATAGTTACCC GCTCACT | |
| iPS:392840 | 21-225_22G8 | AA | SEQ ID NO:397 RTSQGIRNDLG | SEQ ID NO:8409 AASSLQS | SEQ ID NO:16421 LQHNSYPLT | |
| | | NA | SEQ ID NO:398 CGGGCGAGTCAGGTCAGGGCATTAG CAATTATTTAGCC | SEQ ID NO:8410 GCTGCATCCAGTTTACAG AGT | SEQ ID NO:16422 CAACAGTATAATAGTTACCC ATTCACT | |
| iPS:392842 | 21-225_23G1 | AA | SEQ ID NO:399 RASQGISNYLA | SEQ ID NO:8411 AASSLQS | SEQ ID NO:16423 QQYNSYPFT | |
| | | NA | SEQ ID NO:400 | SEQ ID NO:8412 | SEQ ID NO:16424 CAACAGTATAATAGTTACCC TTTCACT | |
| iPS:392844 | 21-225_23G8 | AA | SEQ ID NO:401 RASQGIRNYLA | SEQ ID NO:8413 AASSLQS | SEQ ID NO:16425 QQYNSYPFT | |
| | | NA | SEQ ID NO:402 CGGGCAAGTCAGGGCATTAG AAATGATTTAGGC | SEQ ID NO:8414 CCTGCATCCAGTTTGCAAAGT | SEQ ID NO:16426 CTACAGCATAATAGTTACCC GTGGACG | |

FIGURE 49
(Continued)

| | | | | | | |
|---|---|---|---|---|---|---|
| iPS:392846 | 21-225_23E11 | AA | SEQ ID NO:403<br>RASQGIRNDLG<br>SEQ ID NO:404<br>CGGGCAAGTCAGGACATTAG<br>AAATGATTTAGGC | SEQ ID NO:8415<br>PASSLQS<br>SEQ ID NO:8416<br>GCTGCATCCAGTTGCAC<br>AGT | SEQ ID NO:16427<br>LQHNSYPWT<br>SEQ ID NO:16428<br>CTACAGCATTATAGTTACCC<br>TCGGACG |
| iPS:392848 | 21-225_24B6 | NA | SEQ ID NO:405<br>RASQDIRNDLG<br>SEQ ID NO:406 | SEQ ID NO:8417<br>AASSLHS<br>SEQ ID NO:8418 | SEQ ID NO:16429<br>LQHYSYPRT<br>SEQ ID NO:16430 |
| | | AA | SEQ ID NO:407<br>RASQGISNYLA<br>SEQ ID NO:408 | SEQ ID NO:8419<br>AASSLQS<br>SEQ ID NO:8420 | SEQ ID NO:16431<br>QQYHSYPWT<br>SEQ ID NO:16432 |
| iPS:392850 | 21-225_20F9 | NA | SEQ ID NO:409<br>RASQGKNNLG<br>SEQ ID NO:410 | SEQ ID NO:8421<br>AASSLQS<br>SEQ ID NO:8422 | SEQ ID NO:16433<br>LQHNSYPLT<br>SEQ ID NO:16434 |
| | 21-225_20H10 | AA | SEQ ID NO:409<br>RASQGKNNLG<br>SEQ ID NO:410 | SEQ ID NO:8421<br>AASSLQS<br>SEQ ID NO:8422 | SEQ ID NO:16433<br>LQHNSYPLT<br>SEQ ID NO:16434 |
| iPS:392852 | 21-225_21A2 | NA | SEQ ID NO:411<br>RASQSISSYLN<br>SEQ ID NO:412 | SEQ ID NO:8423<br>AASSLQS<br>SEQ ID NO:8424 | SEQ ID NO:16435<br>QQSYRTPFFT<br>SEQ ID NO:16436 |
| iPS:392854 | 21-225_21E5 | AA | SEQ ID NO:413<br>RASQGIRNDLG<br>SEQ ID NO:414 | SEQ ID NO:8425<br>ATSSLQS<br>SEQ ID NO:8426 | SEQ ID NO:16437<br>LQHNSYPLT<br>SEQ ID NO:16438 |
| iPS:392856 | | NA | | | |

Row details for iPS:392852 (21-225_21A2): CGGGCAAGTCAGAGTATTAG TAGTTATTTAAAT / GCTGCATCCAGTTGCAA AGT / CAACAGAGTTACAGAACCCC CTTTTTCACT Row details for iPS:392854 (21-225_21E5): CGGGCAAGTCAGGGCATTAG AAATGATTTAGGC / GCTACATCCAGTTGCAA AGT / CTACAGCATAATAGTTACCC CCTCACT Row details for iPS:392856: CGGGCGAGTCAGGACATTAG CAATTATTTAGCC / GCTGCATCCAGTTGCAA AGT / CAACAGTATAATAGTTTCCC GCTCACT

FIGURE 49
(Continued)

| | | | | | | | |
|---|---|---|---|---|---|---|---|
| iPS:392858 | 21-225_22A2 | AA | | SEQ ID NO:415<br>RASQDISNYLA<br>SEQ ID NO:416 | | SEQ ID NO:8427<br>AASSLQS<br>SEQ ID NO:8428 | SEQ ID NO:16439<br>QQYNSFPLT<br>SEQ ID NO:16440 |
| | | NA | CGGGCAAGTCAGGGCATTAG<br>AAATGATTTAGGC<br>SEQ ID NO:417 | | GCTGCATCCAGTGTGCA<br>AAGT<br>SEQ ID NO:8429 | CTACAGCATAATAGTTACCC<br>GCTCACT<br>SEQ ID NO:16441 |
| iPS:392860 | 21-225_22H4 | AA | | RASQGIRNDLG<br>SEQ ID NO:418 | | AASSVQS<br>SEQ ID NO:8430 | LQHNSYPLT<br>SEQ ID NO:16442 |
| | | NA | AAGTCTAGTCAGAGCCTCCT<br>GCATAGTGATGGAAAGACCT<br>TTTTGTAT<br>SEQ ID NO:419 | | GAAGTTTCCAACCGGTTC<br>TCT<br>SEQ ID NO:8431 | ATGCAAAGTATACAGCTTCC<br>GCTCTCA<br>SEQ ID NO:16443 |
| iPS:392864 | 21-225_22H8 | AA | | KSSQSLLHSDGKTFLY<br>SEQ ID NO:420 | | EVSNRFS<br>SEQ ID NO:8432 | MQSIQLPLS<br>SEQ ID NO:16444 |
| | | NA | AGGGCCAGTCAGAATGTTTA<br>CAGCAGCTACTTAGCC<br>SEQ ID NO:421 | | GGTGCATCCAGCAGGGC<br>CAGT<br>SEQ ID NO:8433 | CAGCAGTATGGTAGCTCACC<br>TCGGACG<br>SEQ ID NO:16445 |
| iPS:392866 | 21-225_23B9 | AA | | RASQNVYSSYLA<br>SEQ ID NO:422 | | GASSRAS<br>SEQ ID NO:8434 | QQYGSSPRT<br>SEQ ID NO:16446 |
| | | NA | CGGGCAAGTCAGGGCATTAG<br>AAATGATTTAGAC<br>SEQ ID NO:423 | | GCTGCATCCAGTTTGCAA<br>AGT<br>SEQ ID NO:8435 | CTACAGCATAATCGTTACCC<br>GCTCACT<br>SEQ ID NO:16447 |
| iPS:392868 | 21-225_23H11 | AA | | RASQGIRNDLD<br>SEQ ID NO:424 | | AASSLQS<br>SEQ ID NO:8436 | LQHNRYPLT<br>SEQ ID NO:16448 |
| | | NA | CAGGCGAGTCAGGACATTAA<br>CAACTATTTAAAT<br>SEQ ID NO:425 | | GATGCATCCGATTTGGA<br>AACA<br>SEQ ID NO:8437 | CAACAGTATGAAAATCTCCC<br>GATCACC<br>SEQ ID NO:16449 |
| | 21-225_24D6 | AA | | QASQDINNYLN<br>SEQ ID NO:426 | | DASDLET<br>SEQ ID NO:8438 | QQYENLPIT<br>SEQ ID NO:16450 |

FIGURE 49
(Continued)

| | | | | | |
|---|---|---|---|---|---|
| iPS:392870 | 21-225_20G9 | NA | CGGGCAAGTCAGGGCATTAG AAATGATTTAGGC SEQ ID NO:427 | GCTGCATCCAGTTTGCAA AGT SEQ ID NO:8439 | CTACAGCATAGTACTTACCC TCTCACT SEQ ID NO:16451 |
| | | AA | RASQGIRNDLG SEQ ID NO:428 | AASSLQS SEQ ID NO:8440 | LQHSTYPLT SEQ ID NO:16452 |
| iPS:392872 | 21-225_20B11 | NA | CGGGCAAGTCAGGGCATTGG AAATGATTTAGGC SEQ ID NO:429 | GCTGCATCCAGTTTGCAT AGT SEQ ID NO:8441 | CTACAGCATTATAGTTACCC TCGGACG SEQ ID NO:16453 |
| | | AA | RASQGIGNDLG SEQ ID NO:430 | AASSLHS SEQ ID NO:8442 | LQHYSYPRT SEQ ID NO:16454 |
| iPS:392874 | 21-225_21D2 | NA | CGGGCAAGTCAGAGCATTAG CGACTATTTAAAT SEQ ID NO:431 | GATACATCCAGTTTGCA AAGT SEQ ID NO:8443 | CAACAGACTTACAATATTCT TCCGGAGCGCAGT SEQ ID NO:16455 |
| | | AA | RASQSISDYLN SEQ ID NO:432 | DTSSLQS SEQ ID NO:8444 | QQTYNILPERS SEQ ID NO:16456 |
| iPS:392876 | 21-225_21F7 | NA | CGGGCAAGTCAGGACATTAG AAATGATTTAGGC SEQ ID NO:433 | GCTGCATCCAATTTCAA AGT SEQ ID NO:8445 | CTACAGCATAATAATTACCC GTGGACG SEQ ID NO:16457 |
| | | AA | RASQDIRNDLG SEQ ID NO:434 | AASNFQS SEQ ID NO:8446 | LQHNNYPWT SEQ ID NO:16458 |
| iPS:392878 | 21-225_22C5 | NA | CGGGCAAGTCAGAAACATTAG CAGCTATTTAAAT SEQ ID NO:435 | GCTGCATCCGTTTTGCAA CAT SEQ ID NO:8447 | CAACAGAGTTACAGAACCCC CTTATTCACT SEQ ID NO:16459 |
| | | AA | RASQNISSYLN SEQ ID NO:436 | AASVLQH SEQ ID NO:8448 | QQSYRTPLFT SEQ ID NO:16460 |
| iPS:392880 | 21-225_22F9 | NA | CGGGCAAGTCAGGGCATTAG AAATGATTTAGGC SEQ ID NO:437 | GCTGCATCCAGTTTACAA AGT SEQ ID NO:8449 | CTACAGCATAATAGTTACCC GCTCACT SEQ ID NO:16461 |
| | | AA | RASQGIRNDLG SEQ ID NO:438 | AASSLQS SEQ ID NO:8450 | LQHNSYPLT SEQ ID NO:16462 |

FIGURE 49
(Continued)

| | | | | |
|---|---|---|---|---|
| iPS:392882 | 21-225_23A3 | NA | CGGGCAAGTCAGGGCATTAG AAATGATTAGGC<br>SEQ ID NO:439 | GCTGCATCCAGTGTGCA AAGT<br>SEQ ID NO:8451 | CTACAGCATAATAGTTACCC GCTCACT<br>SEQ ID NO:16463 |
| | | AA | RASQGIRNDLG<br>SEQ ID NO:440 | AASSVQS<br>SEQ ID NO:8452 | LQHNSYPLT<br>SEQ ID NO:16464 |
| iPS:392884 | 21-225_23A10 | NA | CGGGCAAGTCAGGGCATTAG AAATGATTAGGC<br>SEQ ID NO:441 | GCTGCATCCAGTTGCAA AGT<br>SEQ ID NO:8453 | CTGCAACATTATAGTTACCC TCGGACG<br>SEQ ID NO:16465 |
| | | AA | RASQGIRNDLG<br>SEQ ID NO:442 | AASSLQS<br>SEQ ID NO:8454 | LQHYSYPRT<br>SEQ ID NO:16466 |
| iPS:392886 | 21-225_23A12 | NA | AAGTCCAGCCAGAGAGTGTTT ATACAGCTCCAACAATAACA ATTATTTAGCT<br>SEQ ID NO:443 | TGGACATCTACCCGGGA ATCC<br>SEQ ID NO:8455 | CAGCAGTATTATGATACTCC TCCGACG<br>SEQ ID NO:16467 |
| | | AA | KSSQSVLYSSNNNNYLA<br>SEQ ID NO:444 | WTSTRES<br>SEQ ID NO:8456 | QQYYDTPPT<br>SEQ ID NO:16468 |
| iPS:392888 | 21-225_25A2 | NA | AAGTCTAGTCAGAGCCTCCT ACATAGTGAAGGAAAGACC TATTTGTAT<br>SEQ ID NO:445 | GAAATTTCCAACCGGTTC TCT<br>SEQ ID NO:8457 | ATGCAAAGTACACAGTTTCC GCTCACT<br>SEQ ID NO:16469 |
| | | AA | KSSQSLLHSEGKTYLY<br>SEQ ID NO:446 | EISNRFS<br>SEQ ID NO:8458 | MQSTQFPLT<br>SEQ ID NO:16470 |
| iPS:392890 | 21-225_20H9 | NA | CGGGCGAGTCAGGGCATTAG CAATTATTTAGCC<br>SEQ ID NO:447 | GCTGCATCCAGTTGCAA AGT<br>SEQ ID NO:8459 | CAACAGTATAATAGTTACCC ATTCACT<br>SEQ ID NO:16471 |
| | | AA | RASQGISNYLA<br>SEQ ID NO:448 | AASSLQS<br>SEQ ID NO:8460 | QQYNSYPFT<br>SEQ ID NO:16472 |
| iPS:392892 | 21-225_20C11 | NA | CGGGCGAGTCAGGACATTAG CAATTATTTAGCC<br>SEQ ID NO:449 | GCTGCATCCAGTTGCAA AGT<br>SEQ ID NO:8461 | CAACAGTATCATAGTTTCCC ATTCACT<br>SEQ ID NO:16473 |

FIGURE 49
(Continued)

| | | | | | |
|---|---|---|---|---|---|
| iPS:392894 | 21-225_21G2 | AA | RASQDISNYLA SEQ ID NO:450 | AASSLQS SEQ ID NO:8462 | QQYHSFPFT SEQ ID NO:16474 |
| | | NA | CGGGCAAGTCAGGGCATTAG AAATGATTTAGGC SEQ ID NO:451 | ACTTCATCCAGTTTGCAA AGT SEQ ID NO:8463 | CTACAACATAATAGTTACCC GTGGACG SEQ ID NO:16475 |
| iPS:392896 | 21-225_21G7 | AA | RASQGIRNDLG SEQ ID NO:452 | TSSSLQS SEQ ID NO:8464 | LQHNSYPWT SEQ ID NO:16476 |
| | | NA | CGGGCAAGTCAGGGCGTTAG AAATGATTTAGGC SEQ ID NO:453 | GCTGCATCCAGTTTGCAA AGT SEQ ID NO:8465 | CTACAGCATAGTAGTTACCC GCTCACT SEQ ID NO:16477 |
| iPS:392898 | 21-225_21H10 | AA | RASQGVRNDLG SEQ ID NO:454 | AASSLQS SEQ ID NO:8466 | LQHSSYPLT SEQ ID NO:16478 |
| | | NA | AGGGCCAGTCAGAGTTTAG CAGCAGCTACTTAGCC SEQ ID NO:455 | GGTGCATCCAGCAGGGC CACT SEQ ID NO:8467 | CAGCAGTATGGTAGCTCACG CAGT SEQ ID NO:16479 |
| iPS:392900 | 21-225_22F2 | AA | RASQSFSSSYLA SEQ ID NO:456 | GASSRAT SEQ ID NO:8468 | QQYGSSRS SEQ ID NO:16480 |
| | | NA | CGGGCAAGTCAGGGCATTAG AAATGATTTAGGC SEQ ID NO:457 | GCTGCATCCAGTTTACAA AGT SEQ ID NO:8469 | CTACAGCATAATAGTTACCC GCTCACT SEQ ID NO:16481 |
| iPS:392902 | 21-225_22D5 | AA | RASQGIRNDLG SEQ ID NO:458 | AASSLQS SEQ ID NO:8470 | LQHNSYPLT SEQ ID NO:16482 |
| | | NA | CGGGCAAGTCAGAACATTTT TAGTTATTAAAT SEQ ID NO:459 | GCTGCATCCAGTTTGCAA AGT SEQ ID NO:8471 | CAACAGAGTTACAGTACCCC CTTATTCACT SEQ ID NO:16483 |
| iPS:392904 | 21-225_22G9 | AA | RASQNIFSYLN SEQ ID NO:460 | AASSLQS SEQ ID NO:8472 | QQSYSTPLFT SEQ ID NO:16484 |
| | | NA | CGGGCAAGTCAGGGCATTAG AAATGATTTAGGC SEQ ID NO:461 | GCTGCTTCCAGTTGCAA AGT SEQ ID NO:8473 | CTACAGCATGCCAGTTACCC GCTCACT SEQ ID NO:16485 |

FIGURE 49
(Continued)

| | | | AA | RASQGIRNDLG | AASSLQS | LQHASYPLT |
| --- | --- | --- | --- | --- | --- | --- |
| | | | | SEQ ID NO:462 | SEQ ID NO:8474 | SEQ ID NO:16486 |
| iPS:392908 | 21-225_23F12 | | NA | CGGGCAAGTCAGGGCATTAG AAATGATTTAGGC | GTTGCATCCAGTTTGCAA AGT | CTACAGCATAATAGTTACCC GTGGACG |
| | | | | SEQ ID NO:463 | SEQ ID NO:8475 | SEQ ID NO:16487 |
| | | | AA | RASQGIRNDLG | VASSLQS | LQHNSYPWT |
| | | | | SEQ ID NO:464 | SEQ ID NO:8476 | SEQ ID NO:16488 |
| iPS:392912 | 21-225_25A9 | | NA | CGGGCAAGTCAGGGCATTAG AAATGATTTAGGC | GCTGCATCCAGTTTGCAA AGT | CTACAGCATAATAGTTACCC ATTCACT |
| | | | | SEQ ID NO:465 | SEQ ID NO:8477 | SEQ ID NO:16489 |
| | | | AA | RASQGIRNDLG | AASSLQS | LQHNSYPFT |
| | | | | SEQ ID NO:466 | SEQ ID NO:8478 | SEQ ID NO:16490 |
| iPS:392914 | 21-225_25D12 | | NA | CGGACAAGTCAGGGCATTAG AAATGATTTAGGC | GCTGCATCCAGTTTACAA AGT | CTACAGCATTATAGTTTCCCT CGGACG |
| | | | | SEQ ID NO:467 | SEQ ID NO:8479 | SEQ ID NO:16491 |
| | | | AA | RTSQGIRNDLG | AASSLQS | LQHYSFPRT |
| | | | | SEQ ID NO:468 | SEQ ID NO:8480 | SEQ ID NO:16492 |
| iPS:392916 | 21-225_27C5 | | NA | CGGGCGAGTCAGGGTATTAG CAGCTGGTTAGCC | GGTGCATCCAGTTTGCA AAGT | CAACAGTATGACAGTTTCCC TCGGACG |
| | | | | SEQ ID NO:469 | SEQ ID NO:8481 | SEQ ID NO:16493 |
| | | | AA | RASQGISSWLA | GASSLQS | QQYDSFPRT |
| | | | | SEQ ID NO:470 | SEQ ID NO:8482 | SEQ ID NO:16494 |
| iPS:392918 | 21-225_28F5 | | NA | CGGGCAAGTCAGGGCATTAG AAATGATTTAGGC | ACTGCATCCAGTTTGCAA AGT | CTACAGCATAATACTTACCC GTGGACG |
| | | | | SEQ ID NO:471 | SEQ ID NO:8483 | SEQ ID NO:16495 |
| | | | AA | RASQGIRNDLG | TASSLQS | LQHNTYPWT |
| | | | | SEQ ID NO:472 | SEQ ID NO:8484 | SEQ ID NO:16496 |
| iPS:392920 | 21-225_29G4 | | NA | CGGGCAAGTCAGGGCATTAG AAATGATTTAGGC | GCTGCATCCAGTTTGCAA AGT | CTACAGCATAATAGTTACCC GCTCACT |
| | | | | SEQ ID NO:473 | SEQ ID NO:8485 | SEQ ID NO:16497 |

FIGURE 49
(Continued)

| | | | | | | |
|---|---|---|---|---|---|---|
| iPS:392922 | | AA | RASQGIRNDLG<br>SEQ ID NO:474 | AASSLQS<br>SEQ ID NO:8486 | LQHNSYPLT<br>SEQ ID NO:16498 |
| | 21-225_30G4 | NA | CGGGCAACTCAGAGAACATTTT<br>CAGCTATTTAAAT<br>SEQ ID NO:475 | ACTGCATCCAGTTGCAA<br>GGT<br>SEQ ID NO:8487 | CAACTCAGCTACAGTCCCCC<br>GTACACT<br>SEQ ID NO:16499 |
| | | AA | RATQNIFSYLN<br>SEQ ID NO:476 | TASSLQG<br>SEQ ID NO:8488 | QLSYSPPYT<br>SEQ ID NO:16500 |
| iPS:392924 | | NA | AGGTCTAGTCAGAGCCTCCT<br>CCATAGTGATGGAAGGACCT<br>ATTTGTAT<br>SEQ ID NO:477 | GAACTTTCCAACCGGTTC<br>TCT<br>SEQ ID NO:8489 | TTGCAAAGTATACAATATCC<br>CATCACC<br>SEQ ID NO:16501 |
| | 21-225_32H2 | AA | RSSQSLLHSDGRTYLY<br>SEQ ID NO:478 | ELSNRFS<br>SEQ ID NO:8490 | LQSIQYPIT<br>SEQ ID NO:16502 |
| iPS:392928 | | NA | AAGTCCAGCCAGAGTGTTTT<br>ATACAGCTCCACAATAACA<br>ACTACTTAGCT<br>SEQ ID NO:479 | TGGGCATCTACCCGGGA<br>ATCC<br>SEQ ID NO:8491 | CAGCAGTATTATAGTACTCC<br>TCCGACG<br>SEQ ID NO:16503 |
| | 21-225_25A4 | AA | KSSQSVLYSSHNNNYLA<br>SEQ ID NO:480 | WASTRES<br>SEQ ID NO:8492 | QQYYSTPPT<br>SEQ ID NO:16504 |
| iPS:392930 | | NA | AAGTCTAGTCAGAGCCTCCT<br>GCATGGTGATGGAAAGACCT<br>ATTTGTTT<br>SEQ ID NO:481 | GAAGTTTCCAATCGGTTC<br>TCT<br>SEQ ID NO:8493 | ATGCAAAGTATACAGCTTCC<br>GTGGACG<br>SEQ ID NO:16505 |
| | 21-225_25H9 | AA | KSSQSLLHGDGKTYLF<br>SEQ ID NO:482 | EVSNRFS<br>SEQ ID NO:8494 | MQSIQLPWT<br>SEQ ID NO:16506 |
| iPS:392934 | | NA | CGGGCAAGTCAGGGCATTAG<br>AAATGATTTAGGC<br>SEQ ID NO:483 | GCTGCATCCAGTTTGCAA<br>AGT<br>SEQ ID NO:8495 | CTACAGCATAATAGTTACCC<br>ATTCACT<br>SEQ ID NO:16507 |
| | 21-225_27D5 | AA | RASQGIRNDLG<br>SEQ ID NO:484 | AASSLQS<br>SEQ ID NO:8496 | LQHNSYPFT<br>SEQ ID NO:16508 |

FIGURE 49
(Continued)

| | | | | | |
|---|---|---|---|---|---|
| iPS:392936 | 21-225_28B6 | NA | CGGTCTAGTCAAAGCCTCGT ATATAGTGATGGAGACACCT ACTTGAAT SEQ ID NO:485 | AAGGTTTCTAACTGGGA CTCT SEQ ID NO:8497 | ATGCATTGTACACACTGGCT CCTT SEQ ID NO:16509 |
| | | AA | RSSQSLVYSDGDTYLN SEQ ID NO:486 | KVSNWDS SEQ ID NO:8498 | MHCTHWLL SEQ ID NO:16510 |
| iPS:392938 | 21-225_29H4 | NA | AAGTCTAGTCAGAGCCTCCT GCATAGTGATGGAAAGACCT ATTTGTAT SEQ ID NO:487 | GAGGTTTCCCACCGGTTC TCT SEQ ID NO:8499 | ATGCAAAGTATACAGCATCC GTTCACT SEQ ID NO:16511 |
| | | AA | KSSQSLLHSDGKTYLY SEQ ID NO:488 | EVSHRFS SEQ ID NO:8500 | MQSIQHPFT SEQ ID NO:16512 |
| iPS:392940 | 21-225_29D9 | NA | CGGGCAAGTCAGGGCATTAG AAATGATTTAGGC SEQ ID NO:489 | GCTGCATCCAGTTTGCAA AGT SEQ ID NO:8501 | CTACAGCATAATACTTACCC ATTCACT SEQ ID NO:16513 |
| | | AA | RASQGIRNDLG SEQ ID NO:490 | AASSLQS SEQ ID NO:8502 | LQHNTYPFT SEQ ID NO:16514 |
| iPS:392942 | 21-225_30E9 | NA | CGGGCAAGTCAGGACATTAG AGATGATTTAGGC SEQ ID NO:491 | GGTGCATTCAGCTTGCA AAGT SEQ ID NO:8503 | CTACAGCATACTAGTTACCC TCCTACT SEQ ID NO:16515 |
| | | AA | RASQDIRDDLG SEQ ID NO:492 | GAFSLQS SEQ ID NO:8504 | LQHTSYPPT SEQ ID NO:16516 |
| iPS:392944 | 21-225_31H5 | NA | CGGGCAAGTCAGGACATTAG AAGTGATTTAGGC SEQ ID NO:493 | GCTGCATCCAGTTTGCAA AGT SEQ ID NO:8505 | ATACAACATATTATTTACCC TCCTACT SEQ ID NO:16517 |
| | | AA | RASQDIRSDLG SEQ ID NO:494 | AASSLQS SEQ ID NO:8506 | IQHIYPPT SEQ ID NO:16518 |
| iPS:392948 | 21-225_25G5 | NA | CGGGCAAGTCAGGACATTAG AAATGATTTAGGC SEQ ID NO:495 | GCTGCATCCAGTTTGCAA AGT SEQ ID NO:8507 | CTACAGCATAATAGTTACCC CTTCACT SEQ ID NO:16519 |

FIGURE 49
(Continued)

| | | | | | |
|---|---|---|---|---|---|
| iPS:392950 | 21-225_25C10 | AA | RASQDIRNDLG SEQ ID NO:496 | AASSLQS SEQ ID NO:8508 | LQHNSYPFT SEQ ID NO:16520 |
| | | NA | CGGGCGAGTCAGGGCATTAGCAATTATTTAGCC SEQ ID NO:497 | GCTGCATCCAGTTTGCAAGT SEQ ID NO:8509 | CAACAGTATCATAGTTACCCATTCACT SEQ ID NO:16521 |
| iPS:392952 | 21-225_26G1 | AA | RASQGISNYLA SEQ ID NO:498 | AASSLQS SEQ ID NO:8510 | QQYHSYPFT SEQ ID NO:16522 |
| | | NA | CGGGCGAGTCAGGACATTAGCAATTATTTAGCC SEQ ID NO:499 | GCTGCATCCAGTTTGCGAAGT SEQ ID NO:8511 | CAACAGTATCATAGTTACCCATTCACT SEQ ID NO:16523 |
| iPS:392954 | 21-225_26A10 | AA | RASQDISNYLA SEQ ID NO:500 | AASSLRS SEQ ID NO:8512 | QQYHSYPFT SEQ ID NO:16524 |
| | | NA | CGGGCAAGTCAAGAGCATTAGCAGCTATTTAAAT SEQ ID NO:501 | GCTGCATCCAGCTTGCAAAGT SEQ ID NO:8513 | CAACAGAGTTACAGTACCCCTACGTGGACG SEQ ID NO:16525 |
| iPS:392956 | 21-225_27A11 | AA | RASQSISSYLN SEQ ID NO:502 | AASSLQS SEQ ID NO:8514 | QQSYSTPTWT SEQ ID NO:16526 |
| | | NA | CGGGCGAGTCAGGGTATTAGTAGTTGGTTAGCC SEQ ID NO:503 | GGTGCATCCAGTTTGCAAAGT SEQ ID NO:8515 | CAACAGTCTGACAGTTTCCCTCGGACG SEQ ID NO:16527 |
| iPS:392958 | 21-225_28C7 | AA | RASQGISSWLA SEQ ID NO:504 | GASSLQS SEQ ID NO:8516 | QQSDSFPRT SEQ ID NO:16528 |
| | | NA | CGGGCAAGTCAGGGCATTAGAAATGATTTAGGC SEQ ID NO:505 | ATTGCATCCAGTTTGCAAAGT SEQ ID NO:8517 | CTACAGCATAATACTTACCCGTGGACG SEQ ID NO:16529 |
| iPS:392960 | 21_225_29E6 | AA | RASQGIRNDLG SEQ ID NO:506 | IASSLQS SEQ ID NO:8518 | LQHNTYPWT SEQ ID NO:16530 |
| | | NA | AAGTCCAGCCAGAGTGTTTTATACAGCTCCCACAATAACTACTACTTAACT | TGGGCATCTTCCCGGGAATCC | CAGCAGTATTATAGTACTCCTCCGACG |

FIGURE 49
(Continued)

| | | | | | | |
|---|---|---|---|---|---|---|
| iPS:392962 | 21-225_29E6 | AA | SEQ ID NO:507<br>KSSQSVLYSSHNNYYLT | SEQ ID NO:8519<br>WASSRES | SEQ ID NO:16531<br>QQYYSTPPT | |
| iPS:392964 | 21-225_30A1 | NA | SEQ ID NO:508<br>CGGGCAAGTCAGGGCATTAG<br>CAATTATTTAGCC | SEQ ID NO:8520<br>GCTGCATCCAGTTTGCAA<br>ACT | SEQ ID NO:16532<br>CAACAGTATAATAGTTACCC<br>ATTCACT | |
| | | AA | SEQ ID NO:509<br>RASQGISNYLA | SEQ ID NO:8521<br>AASSLQT | SEQ ID NO:16533<br>QQYNSYPFT | |
| iPS:392966 | 21-225_31A8 | NA | SEQ ID NO:510<br>CGGGCAAGTCAGGACATTAG<br>AAGTGATTTAGGC | SEQ ID NO:8522<br>GCTGTATCCAGTTTGCAA<br>AGT | SEQ ID NO:16534<br>CTACAGCATACTATTTACCC<br>TCCTACT | |
| | | AA | SEQ ID NO:511<br>RASQDIRSDLG | SEQ ID NO:8523<br>AVSSLQS | SEQ ID NO:16535<br>LQHTIYPPT | |
| iPS:392968 | 21-225_32G3 | NA | SEQ ID NO:512<br>CGGGCGAGTCAGGCATTAG<br>CAATTATTTAGCC | SEQ ID NO:8524<br>GATACATCCAGTTTGCAA<br>AAGT | SEQ ID NO:16536<br>CAACAGTATCATAGTTACCC<br>GCTCACT | |
| | | AA | SEQ ID NO:513<br>RASQAISNYLA | SEQ ID NO:8525<br>DTSSLQS | SEQ ID NO:16537<br>QQYHSYPLT | |
| iPS:392972 | 21-225_25B6 | NA | SEQ ID NO:514<br>CGGGCAAGTCAGGGCATTAG<br>AAATGATTTAGGC | SEQ ID NO:8526<br>CGTGCATCCAGTTTGCAA<br>AGT | SEQ ID NO:16538<br>CTACAGCATAATAGTTACCC<br>ATTCACT | |
| | | AA | SEQ ID NO:515<br>RASQGIRNDLG | SEQ ID NO:8527<br>RASSLQS | SEQ ID NO:16539<br>LQHNSYPFT | |
| iPS:392974 | 21-225_26A2 | NA | SEQ ID NO:516<br>CGGGCAAGTCAGGGCCATTAG<br>AAGTGATTTAGGC | SEQ ID NO:8528<br>ACTGCATCCAGTTTGCAG<br>AGT | SEQ ID NO:16540<br>CTACAGCATAATCGTTACCC<br>GTGGACG | |
| | | AA | SEQ ID NO:517<br>RASQGIRSDLG | SEQ ID NO:8529<br>TASSLQS | SEQ ID NO:16541<br>LQHNRYPWT | |
| | | NA | SEQ ID NO:518<br>CGGGCAAGTCAGGCCATTAG<br>AAATGATTTAGGC | SEQ ID NO:8530<br>GCTGCATCCAGTTTGCAA<br>AGT | SEQ ID NO:16542<br>CTACAGCATTATAATTACCC<br>TCGCAGT | |

FIGURE 49
(Continued)

| | | | | | | |
|---|---|---|---|---|---|---|
| iPS:392976 | 21-225_26A11 | NA | SEQ ID NO:519 CGGGCGAGTCAGGGCATTAG CAATTATTTAGCC | SEQ ID NO:8531 GGTGCATCCAGTTGCA AAGT | SEQ ID NO:16543 CAACAGTATTATAGTTACCC ATTCACT | |
| | | AA | RASQAIRNDLG | AASSLQS | LQHYNYPRS | |
| | | | SEQ ID NO:520 | SEQ ID NO:8532 | SEQ ID NO:16544 | |
| iPS:392978 | 21-225_27H12 | NA | SEQ ID NO:521 | SEQ ID NO:8533 | SEQ ID NO:16545 | |
| | | AA | RASQGISNYLA | GASSLQS | QQYYSYPFT | |
| | | | SEQ ID NO:522 | SEQ ID NO:8534 | SEQ ID NO:16546 | |
| iPS:392980 | 21-225_28B8 | NA | SEQ ID NO:523 CGGGCAAGTCAGGGCATTAG AAATGATTTAGGC | SEQ ID NO:8535 GCTGCATCCAGTTGCAA AGT | SEQ ID NO:16547 CTACAGCATAATAGTTACCC ATTCACT | |
| | | AA | RASQGIRNDLG | AASSLQS | LQHNSYPFT | |
| | | | SEQ ID NO:524 | SEQ ID NO:8536 | SEQ ID NO:16548 | |
| iPS:392982 | 21-225_29H6 | NA | SEQ ID NO:525 CGGGCAAGTCAGGGCATTAG AAATGATTTAGGC | SEQ ID NO:8537 GCTGCATCCAGTTGCAA AGT | SEQ ID NO:16549 CTACAGCATAATAGTTACCC GCTCACT | |
| | | AA | RASQGIRNDLG | AASSLQS | LQHNSYPLT | |
| | | | SEQ ID NO:526 | SEQ ID NO:8538 | SEQ ID NO:16550 | |
| iPS:392984 | 21-225_30D1 | NA | SEQ ID NO:527 CGGGCAAGTCAGGAGCATTAG AAGTGATTTAGGC | SEQ ID NO:8539 GCTGCATCCAGTTTGCAA AGT | SEQ ID NO:16551 CTACAGCATACTATTTACCC TCCTACT | |
| | | AA | RASQDIRSDLG | AASSLQS | LQHTIYPPT | |
| | | | SEQ ID NO:528 | SEQ ID NO:8540 | SEQ ID NO:16552 | |
| iPS:392986 | 21-225_30E11 | NA | SEQ ID NO:529 CGGGCAAGTCAGGACATTAG CAACTATTTAAAT | SEQ ID NO:8541 GCTGCATCCAGTTGCAA AGT | SEQ ID NO:16553 CAACAGAGTTACAGTACCCC ATTCACT | |
| | | AA | RASQSISNYLN | AASSLQS | QQSYSTPFT | |
| | | | SEQ ID NO:530 | SEQ ID NO:8542 | SEQ ID NO:16554 | |
| iPS:392986 | | NA | CGGGCAAGTCAGGACATTAG AAGTGATTTAGGC | GGTGCATCCAGTTTGCA AAGT | CTACAGCATATTATTTACCCT CCTACT | |

FIGURE 49
(Continued)

| | | | | | | |
|---|---|---|---|---|---|---|
| iPS:392988 | 21-225_31B8 | AA | SEQ ID NO:531<br>RASQDIRSDLG | SEQ ID NO:8543<br>GASSLQS | SEQ ID NO:16555<br>LQHIYPPT | |
| iPS:392990 | 21-225_25E6 | NA | SEQ ID NO:532<br>CGGGCAAGTCAGGGCATTAG<br>AAATGATTTAGGC | SEQ ID NO:8544<br>GCTGCATCCAGTTTGCAA<br>AGT | SEQ ID NO:16556<br>CTACAGCATAATAGTTACCC<br>GCTCACT | |
| | | AA | SEQ ID NO:533<br>RASQGIRNDLG | SEQ ID NO:8545<br>AASSLQS | SEQ ID NO:16557<br>LQHNSYPLT | |
| iPS:392992 | 21-225_25H10 | NA | SEQ ID NO:534<br>CGGGCAAGTCGGGGCATTAG<br>AAATGATTTAGGC | SEQ ID NO:8546<br>GCTGCATTCAGTTTGCAA<br>AGT | SEQ ID NO:16558<br>CTACAGCATAATAGTTACCC<br>GCTCACT | |
| | | AA | SEQ ID NO:535<br>RASRGIRNDLG | SEQ ID NO:8547<br>AAFSLQS | SEQ ID NO:16559<br>LQHNSYPLT | |
| iPS:392992 | 21-225_26C4 | NA | SEQ ID NO:536<br>AAGTCCAGCCAGAGTGTTTT<br>ATACCGCTCCAACAATTACA<br>ACTACTTAGCT | SEQ ID NO:8548<br>TGGGCATCTACCGGGA<br>ATCC | SEQ ID NO:16560<br>CAGCAATATTATAGTACTCC<br>TCCGACG | |
| | | AA | SEQ ID NO:537<br>KSSQSVLYRSNNYNYLA | SEQ ID NO:8549<br>WASTRES | SEQ ID NO:16561<br>QQYYSTPPT | |
| iPS:392994 | 21-225_26G11 | NA | SEQ ID NO:538<br>AAGTCTAGTCAGACCCTCCT<br>GCATGGTGAAGGAAAGACC<br>TATTTGTAT | SEQ ID NO:8550<br>GAAGTTTCCAACCGGTTC<br>TCT | SEQ ID NO:16562<br>ATGCAAAGTATAAAGCTTCC<br>GCTCACT | |
| | | AA | SEQ ID NO:539<br>KSSQTLLHGEGKTYLY | SEQ ID NO:8551<br>EVSNRFS | SEQ ID NO:16563<br>MQSIKLPLT | |
| iPS:392996 | 21-225_28B1 | NA | SEQ ID NO:540<br>CGGGCGAGTCAGGCTATCAA<br>TGACTGGTTAGCC | SEQ ID NO:8552<br>GCTGCATCCAGTTTCCAA<br>AGT | SEQ ID NO:16564<br>CAACAGGCTAGCAGTTTCCC<br>ATTCACT | |
| | | AA | SEQ ID NO:541<br>RASQAINDWLA | SEQ ID NO:8553<br>AASSFQS | SEQ ID NO:16565<br>QQASSFPFT | |
| | | | SEQ ID NO:542 | SEQ ID NO:8554 | SEQ ID NO:16566 | |

FIGURE 49
(Continued)

| | | | | | |
|---|---|---|---|---|---|
| iPS:392998 | 21-225_28A9 | NA | CGGGCAAGTCAGGGCATTAG AAATGATTTAGGC SEQ ID NO:543 | GCTGCTCTCTAGTTTGCAA AAT SEQ ID NO:8555 | CTACAGCATAATCGTTACCC ATTCACT SEQ ID NO:16567 |
| | | AA | RASQGIRNDLG SEQ ID NO:544 | AASSLQN SEQ ID NO:8556 | LQHNRYPFT SEQ ID NO:16568 |
| iPS:393000 | 21-225_29D7 | NA | CGGGCAAGTCAGGGCATTAG AAATGATTTAGGC SEQ ID NO:545 | GCTGCATCCAGTTTACAA AGT SEQ ID NO:8557 | CTACAGCATAATAGTTACCC ATTCACT SEQ ID NO:16569 |
| | | AA | RASQGIRNDLG SEQ ID NO:546 | AASSLQS SEQ ID NO:8558 | LQHNSYPFT SEQ ID NO:16570 |
| iPS:393002 | 21-225_30G1 | NA | CGGGCAAGTCAGAACATTTA CAGCTATTTAAAT SEQ ID NO:547 | GCTGCATCCAGTTTGCAT AGT SEQ ID NO:8559 | CAACAGAGTTACAGTACTCC GCTCACT SEQ ID NO:16571 |
| | | AA | RASQNIYSYLN SEQ ID NO:548 | AASSLHS SEQ ID NO:8560 | QQSYSTPLT SEQ ID NO:16572 |
| iPS:393004 | 21-225_30G11 | NA | CGGGCAAGTCAGGACATTAG AAGTGATTTAGGC SEQ ID NO:549 | GCTGCATCCAGTTTGCAA AGT SEQ ID NO:8561 | CTACAGCATACTATTACCC TCCTACT SEQ ID NO:16573 |
| | | AA | RASQDIRSDLG SEQ ID NO:550 | AASSLQS SEQ ID NO:8562 | LQHTIYPPT SEQ ID NO:16574 |
| iPS:393006 | 21-225_31G9 | NA | CGGGCAAGTCAGGGCATTAG AAATGATTTAGGC SEQ ID NO:551 | CCTGCATCCAGTTTGCAA AGT SEQ ID NO:8563 | CTACAGGATAATAGTTACCC TTTCACT SEQ ID NO:16575 |
| | | AA | RASQGIRNDLG SEQ ID NO:552 | PASSLQS SEQ ID NO:8564 | LQDNSYPFT SEQ ID NO:16576 |
| iPS:393010 | 21-225_25E11 | NA | CGGGCGAGTCAGGGTATTAG CAACTGGTTAGCC SEQ ID NO:553 | ACTGCATCCAGTTTGCAA GGT SEQ ID NO:8565 | CAACAGGCTAACAGTTTCCC AATCACT SEQ ID NO:16577 |
| | | AA | RASQGISNWLA SEQ ID NO:554 | TASSLQG SEQ ID NO:8566 | QQANSFPIT SEQ ID NO:16578 |

FIGURE 49
(Continued)

| | | | AAGTCTAGTCAGAGCCTCCT GCATAGTGAGGGAAAGACC TATTTGTAT | GAAGTTCCACCGGCTC TCT | ATGCAAAGTATACAGCTTCC GCTCACT |
|---|---|---|---|---|---|
| iPS:393012 | 21-225_26G7 | NA | SEQ ID NO:555 | SEQ ID NO:8567 | SEQ ID NO:16579 |
| | | AA | KSSQSLLHSEGKTYLY | EVSHRLS | MQSIQLPLT |
| | | | SEQ ID NO:556 | SEQ ID NO:8568 | SEQ ID NO:16580 |
| iPS:393014 | 21-225_26D12 | NA | CGGGCGAGTCAGGGTATTAG TAGTTGGTTAGCC | GGTGCATCCAGTTTGCA AGT | CAACAGTCTGACAGTTTCCC TCGGACG |
| | | | SEQ ID NO:557 | SEQ ID NO:8569 | SEQ ID NO:16581 |
| | | AA | RASQGISSWLA | GASSLQS | QQSDSFPRT |
| | | | SEQ ID NO:558 | SEQ ID NO:8570 | SEQ ID NO:16582 |
| iPS:393016 | 21-225_28F11 | NA | CGGGCGAGTCAGGGTATTAG CAACTGGTTAGCC | GCTGCATCCAATTTGCAA AGT | CAACAGGCTAACAGTCTCCC ATTCACT |
| | | | SEQ ID NO:559 | SEQ ID NO:8571 | SEQ ID NO:16583 |
| | | AA | RASQGISNWLA | AASNLQS | QQANSLPFT |
| | | | SEQ ID NO:560 | SEQ ID NO:8572 | SEQ ID NO:16584 |
| iPS:393018 | 21-225_29B8 | NA | CGGGCAAGTCAGGGCATTAG AAATGATTTAGGC | GCTGCATCCAGTTTGCAA AGT | CTACAGCATAATAGTTACCC GCTCACT |
| | | | SEQ ID NO:561 | SEQ ID NO:8573 | SEQ ID NO:16585 |
| | | AA | RASQGIRNDLG | AASSLQS | LQHNSYPLT |
| | | | SEQ ID NO:562 | SEQ ID NO:8574 | SEQ ID NO:16586 |
| iPS:393020 | 21-225_30E2 | NA | CAGGCGAGTCAGTACATTAG CAACTATTTAAAT | GATGGATCCAGTTTGGA AACA | CAACAGTATGATAATCTCCC GATCACC |
| | | | SEQ ID NO:563 | SEQ ID NO:8575 | SEQ ID NO:16587 |
| | | AA | QASQYISNYLN | DGSSLET | QQYDNLPIT |
| | | | SEQ ID NO:564 | SEQ ID NO:8576 | SEQ ID NO:16588 |
| iPS:393022 | 21-225_30H11 | NA | CGGGCAAGTCAGGGCATTAG AAATGATTTAGGC | CCTGCATCCAGTTTGCAA AGT | CTACAGGATAATAGTCATCC ATTCACT |
| | | | SEQ ID NO:565 | SEQ ID NO:8577 | SEQ ID NO:16589 |
| | | AA | RASQGIRNDLG | PASSLQS | LQDNSHPFT |

FIGURE 49
(Continued)

| | | | | | | | | |
|---|---|---|---|---|---|---|---|---|
| | | | SEQ ID NO:566 | | SEQ ID NO:8578 | | SEQ ID NO:16590 | |
| iPS:393024 | 21-225_31H9 | NA | CGGGCAAGTCAGGTCAGGGTATTAC CAGCTGGTTAACT | SEQ ID NO:567 | GATACATCCAGTTTGCA AAGT | SEQ ID NO:8579 | CAACAGGTAACAGTTTCCC ATTCACT | SEQ ID NO:16591 |
| | | AA | RASQGITSWLT | SEQ ID NO:568 | DTSSLQS | SEQ ID NO:8580 | QQGNSFPFT | SEQ ID NO:16592 |
| iPS:393026 | 21-225_32B6 | NA | CGGGCAAGTCAGGTCAGGGCATTAG AAATGATTTAGGC | SEQ ID NO:569 | ATTGCATCCAGTTTGCAA AGT | SEQ ID NO:8581 | CTACAGCATAATAGTTACCC GTGGACG | SEQ ID NO:16593 |
| | | AA | RASQGIRNDLG | SEQ ID NO:570 | IASSLQS | SEQ ID NO:8582 | LQHNSYPWT | SEQ ID NO:16594 |
| iPS:393028 | 21-225_25D7 | NA | CGGGCCGAGTCAGGATATATTT CGACTGGTTAGCC | SEQ ID NO:571 | GCTGCATCCAGTTTGCAA AGT | SEQ ID NO:8583 | CAACAGGCTTACAGTTTCCC GTGGACG | SEQ ID NO:16595 |
| | | AA | RASQDIFDWLA | SEQ ID NO:572 | AASSLQS | SEQ ID NO:8584 | QQAYSFPWT | SEQ ID NO:16596 |
| iPS:393030 | 21-225_25H11 | NA | CGGGCAAGTCAGGTCAGGGCATTAG AACTGATTTAGGC | SEQ ID NO:573 | GCTGCATCCAGTTTACAA AGT | SEQ ID NO:8585 | CTACAGCATAATAGTTACCC GCTCACT | SEQ ID NO:16597 |
| | | AA | RASQGIRTDLG | SEQ ID NO:574 | AASSLQS | SEQ ID NO:8586 | LQHNSYPLT | SEQ ID NO:16598 |
| iPS:393032 | 21-225_26F8 | NA | AAGTCTAGTCAGGTCAGAGCCTCCT GCATGGTGATGGAAAGACCTTAT ATTTGTAT | SEQ ID NO:575 | GAAGTTCCAACCGGTTC TCT | SEQ ID NO:8587 | ATGCAAAGTATACAGCTTCC GTGGACG | SEQ ID NO:16599 |
| | | AA | KSSQSLLHGDGKTYLY | SEQ ID NO:576 | EVSNRFS | SEQ ID NO:8588 | MQSIQLPWT | SEQ ID NO:16600 |
| iPS:393034 | 21-225_27F2 | NA | CGGGCAAGTCAGGTCAGGGCATTAG AAATGATTTAGGC | SEQ ID NO:577 | GTTGCATCCAGTTTGCAA AGT | SEQ ID NO:8589 | CTACAGCATAATAGTTACCC GCTCACT | SEQ ID NO:16601 |

FIGURE 49
(Continued)

| | | | | | |
|---|---|---|---|---|---|
| iPS:393036 | | AA | RASQGIRNDLG SEQ ID NO:578 | VASSLQS SEQ ID NO:8590 | LQHNSYPLT SEQ ID NO:16602 |
| | 21-225_28G3 | NA | AAGTCTAGTCAGAGAGCCTCCT ACATGGTGATGGAAAGACCTTCT ATTTGTAT SEQ ID NO:579 | GAAGTTTCCAACCGGTTC TCT SEQ ID NO:8591 | ATGCAAAGTATACAGATTCC GTGGACG SEQ ID NO:16603 |
| iPS:393038 | | AA | KSSQSLLHGDGKTYLY SEQ ID NO:580 | EVSNRFS SEQ ID NO:8592 | MQSIQIPWT SEQ ID NO:16604 |
| | 21-225_29D8 | NA | CGGGCAAGTCAGGGCATTAG AAATGATTAGGC SEQ ID NO:581 | ACTGCATCCAGTTGCAA AGT SEQ ID NO:8593 | CTACAGCATAATAGTTACCC ATTCACT SEQ ID NO:16605 |
| iPS:393040 | | AA | RASQGIRNDLG SEQ ID NO:582 | TASSLQS SEQ ID NO:8594 | LQHNSYPFT SEQ ID NO:16606 |
| | 21-225_30E3 | NA | CGGGCAAGTCAGGACATTAG AGATGATTAGGC SEQ ID NO:583 | GCTGCATCAGTTGCAA AGT SEQ ID NO:8595 | CTACAGCATACTAGTTACCC TCCTACT SEQ ID NO:16607 |
| iPS:393042 | | AA | RASQDIRDDLG SEQ ID NO:584 | AAFSLQS SEQ ID NO:8596 | LQHTSYPPT SEQ ID NO:16608 |
| | 21-225_31F1 | NA | CGGGCAAGTCAGAGAGGATTA GCAGCTATTTAAAT SEQ ID NO:585 | GCTGCATCCAGTTCGCA AAGT SEQ ID NO:8597 | CAACAGAGTTACATTACCCC GCTCACT SEQ ID NO:16609 |
| iPS:393044 | | AA | RASQRISSYLN SEQ ID NO:586 | AASSSQS SEQ ID NO:8598 | QQSYITPLT SEQ ID NO:16610 |
| | 21-225_25B8 | NA | AGGGCCAGTCAGAGTGTTAG AAGTAATTAGCC SEQ ID NO:587 | GGTGCATCCACCAGGGC CACT SEQ ID NO:8599 | CAGCAGTATAATAATTGGCC TCCGTGGCCG SEQ ID NO:16611 |
| iPS:393046 | | AA | RASQSVRSNLA SEQ ID NO:588 | GASTRAT SEQ ID NO:8600 | QQYNWPPWP SEQ ID NO:16612 |
| | | NA | CGGGCAAGTCAGGCCATTAG AGATGATTAGGC | GCTGCATCCAGTTTGCAA AGT | CTACAGCATTATAATTACCC TCGCAGT |

FIGURE 49
(Continued)

| | | | | | | |
|---|---|---|---|---|---|---|
| iPS:393048 | 21-225_25A12 | | SEQ ID NO:589 | | SEQ ID NO:8601 | | SEQ ID NO:16613 |
| | | AA | RASQAIRDDLG | | AASSLQS | | LQHYNYPRS |
| iPS:393050 | 21-225_27C3 | NA | SEQ ID NO:590 CGGGCAAGTCAGGGCATTAG AAATGATTTAGGC | SEQ ID NO:8602 GCTGCATCCAGTTGCAA AGT | SEQ ID NO:16614 CTACAGCATAATCGTTACCC GCTCACT |
| | | | SEQ ID NO:591 | | SEQ ID NO:8603 | | SEQ ID NO:16615 |
| | | AA | RASQGIRNDLG | | AASSLQS | | LQHNRYPLT |
| iPS:393054 | 21-225_28C5 | NA | SEQ ID NO:592 AGGGCCAGTCAGAGTGTTAG CAGCAACTTAGCC | SEQ ID NO:8604 GGTGCATCCACCAGGGC CACT | SEQ ID NO:16616 CAGCAGTATAATAATTGGCC TCCGTGGCCG |
| | | | SEQ ID NO:593 | | SEQ ID NO:8605 | | SEQ ID NO:16617 |
| | | AA | RASQSVSSNLA | | GASTRAT | | QQYNNWPPWP |
| iPS:393056 | 21-225_29G8 | NA | SEQ ID NO:594 CGGGCAAGTCAGGGCATTAG AAATGATTTAGGC | SEQ ID NO:8606 GCTGCATCCAGTTGCAA AGT | SEQ ID NO:16618 CTACAGCATAATAGTTATCC GCTCACT |
| | | | SEQ ID NO:595 | | SEQ ID NO:8607 | | SEQ ID NO:16619 |
| | | AA | RASQGIRNDLG | | AASSLQS | | LQHNSYPLT |
| iPS:393058 | 21-225_30F3 | NA | SEQ ID NO:596 CGGGCAAGTCAGGGCATTAG AAATGATTTAGGC | SEQ ID NO:8608 ACTGCATCCAGTTTACAA AGT | SEQ ID NO:16620 CTACAGCATAATAGTTACCC GTTCACT |
| | | | SEQ ID NO:597 | | SEQ ID NO:8609 | | SEQ ID NO:16621 |
| | | AA | RASQGIRNDLG | | TASSLQS | | LQHNSYPFT |
| iPS:393060 | 21-225_31H3 | NA | SEQ ID NO:598 CGGGCAAGTCAGGGCATTAG AGATGATTTAGGC | SEQ ID NO:8610 GCTGCATTCAGCTTGCAA AGT | SEQ ID NO:16622 CTACAGCATACTAGTTACCC TCCTACT |
| | | | SEQ ID NO:599 | | SEQ ID NO:8611 | | SEQ ID NO:16623 |
| | | AA | RASQDIRDDLG | | AAFSLQS | | LQHTSYPPT |
| | | NA | SEQ ID NO:600 CGGGCAAGTCAGGACATTAG AAGTGATTTAGGC | SEQ ID NO:8612 GCTGCATCCAGTTGCAA AGT | SEQ ID NO:16624 CTGCAGCATACTATTTACCC TCCTACT |

FIGURE 49
(Continued)

| | | | | | | |
|---|---|---|---|---|---|---|
| 21-225_32G12 | | SEQ ID NO:601 RASQDIRSDLG | | SEQ ID NO:8613 AASSLQS | | SEQ ID NO:16625 LQHTYPPT |
| | AA | SEQ ID NO:602 | | SEQ ID NO:8614 | | SEQ ID NO:16626 |
| iPS:393062 | NA | CAGGCGAGTCAGGACACATTTC CAACTTTTTAAAT | | GATGCATCCAATTTGGTA ACA | | CAACAGTATGATAATCTCCC GATCACC |
| | | SEQ ID NO:603 QASQDISNFLN | | SEQ ID NO:8615 DASNLVT | | SEQ ID NO:16627 QQYDNLPIT |
| 21-225_33H3 | AA | SEQ ID NO:604 | | SEQ ID NO:8616 | | SEQ ID NO:16628 |
| iPS:393064 | NA | CGGGCAAGTCAGAGCATTAG CAGGTATTTAAGT | | GCTGCATCCAGTTTGCAA AGT | | CAACAGAGTTACAATATCCC GATCACC |
| | | SEQ ID NO:605 RASQSISRYLS | | SEQ ID NO:8617 AASSLQS | | SEQ ID NO:16629 QQSYNIPIT |
| 21-225_33A9 | AA | SEQ ID NO:606 | | SEQ ID NO:8618 | | SEQ ID NO:16630 |
| iPS:393066 | NA | CGGGCAAGTCAGAACATTTA CAGCTATTTAAAT | | GCTGCATCCAGTTTGCAT AGT | | CAACAGAGTTACAGTACTCC GCTCACT |
| | | SEQ ID NO:607 RASQNIYSYLN | | SEQ ID NO:8619 AASSLHS | | SEQ ID NO:16631 QQSYSTPLT |
| 21-225_34D3 | AA | SEQ ID NO:608 | | SEQ ID NO:8620 | | SEQ ID NO:16632 |
| iPS:393068 | NA | CGGGCAAGTCAGGACACATTAG AAGTGATTTAGGC | | GCTGCATCCAGTTTGCAA AGT | | CTCCAGCATACTATTTACCCT CCTACT |
| | | SEQ ID NO:609 RASQDIRSDLG | | SEQ ID NO:8621 AASSLQS | | SEQ ID NO:16633 LQHTYPPT |
| 21-225_34G9 | AA | SEQ ID NO:610 | | SEQ ID NO:8622 | | SEQ ID NO:16634 |
| iPS:393072 | NA | CGGGCAAGTCAGGACACATTAG AAGTGATTTAGGC | | GCTGCATCCAGTTTGCAA AGT | | CTCCATCATCCTATTTACCCT CCTACT |
| | | SEQ ID NO:611 RASQDIRSDLG | | SEQ ID NO:8623 AASSLQS | | SEQ ID NO:16635 LHHPIYPPT |
| 21-225_36C5 | AA | SEQ ID NO:612 | | SEQ ID NO:8624 | | SEQ ID NO:16636 |
| iPS:393074 | NA | CGGACAAGTCAGGGCATTAG AAATGATTTAGGC | | ACTGCATCCAGTTTGCAA AGT | | CTACAGCATAATAGTTACCC GCTCACT |

FIGURE 49
(Continued)

| | | | | | | |
|---|---|---|---|---|---|---|
| iPS:393076 | 21-225_33B1 | AA | SEQ ID NO:613<br>RTSQGIRNDLG | SEQ ID NO:8625<br>TASSLQS | SEQ ID NO:16637<br>LQHNSYPLT |
| | | NA | SEQ ID NO:614<br>CGGGCAAGTCAGGACATTAG<br>AAATGATGTAGGC | SEQ ID NO:8626<br>GCTGCATCCAGTTTGCAA<br>CGT | SEQ ID NO:16638<br>CTACACAGCATTATAGTTACCC<br>TCCTACT |
| iPS:393078 | 21-225_33A4 | AA | SEQ ID NO:615<br>RASQDIRNDVG | SEQ ID NO:8627<br>AASSLQR | SEQ ID NO:16639<br>LQHYSYPPT |
| | | NA | SEQ ID NO:616<br>TGGGCGAGTCAGGGCATTAA<br>CAGTTATTTAGCC | SEQ ID NO:8628<br>GCTGCATCCAGTTTGCAG<br>GGT | SEQ ID NO:16640<br>CAACAGTTTAATAGTTACCCG<br>TCTGACG |
| iPS:393080 | 21-225_33H11 | AA | SEQ ID NO:617<br>WASQGINSYLA | SEQ ID NO:8629<br>AASSLQG | SEQ ID NO:16641<br>QQFNSYPLT |
| | | NA | SEQ ID NO:618<br>CGGGCGAGTCAGGGTCAGGGTATTAG<br>TAAGTGGTTAGCC | SEQ ID NO:8630<br>GCTGCATCCAGTTTGCAA<br>AGT | SEQ ID NO:16642<br>CAACAGGCTAACAGTTTCCC<br>TTTCACT |
| iPS:393082 | 21-225_34F3 | AA | SEQ ID NO:619<br>RASQGISKWLA | SEQ ID NO:8631<br>AASSLQS | SEQ ID NO:16643<br>QQANSFPFT |
| | | NA | SEQ ID NO:620<br>CGGGCAAGTCAGAACATTAG<br>GAACTTTTTAAAT | SEQ ID NO:8632<br>GGTGCATCCACTTTGCAA<br>AGT | SEQ ID NO:16644<br>CAACAGACTTGCAGTACCCC<br>GCTCACT |
| iPS:393084 | 21-225_34C11 | AA | SEQ ID NO:621<br>RASQNIRNFLN | SEQ ID NO:8633<br>GASTLQS | SEQ ID NO:16645<br>QQTCSTPLT |
| | | NA | SEQ ID NO:622<br>CGGGCGAGTCAGGGTATTAG<br>CAAATGGTTAGCC | SEQ ID NO:8634<br>GCTGCATCCAGTTTGCAG<br>AGT | SEQ ID NO:16646<br>CAACAGGCTAACAGTTTCCC<br>ATTCACT |
| iPS:393086 | 21-225_35C6 | AA | SEQ ID NO:623<br>RASQGISKWLA | SEQ ID NO:8635<br>AASSLQS | SEQ ID NO:16647<br>QQANSFPFT |
| | | NA | SEQ ID NO:624<br>CGGGCGAGTCAGGGTATTAG<br>CAGATGGTTAGCC | SEQ ID NO:8636<br>GCTGCATCCCGTTTGCAA<br>AGT | SEQ ID NO:16648<br>CAACAGGCTAACAGTTTCCC<br>TTTCACT |

FIGURE 49
(Continued)

| | | | | | | | |
|---|---|---|---|---|---|---|---|
| iPS:393088 | 21-225_36H5 | AA | SEQ ID NO:625<br>RASQGISRWLA<br>SEQ ID NO:626 | SEQ ID NO:8637<br>AASRLQS<br>SEQ ID NO:8638 | SEQ ID NO:16649<br>QQANSFPFT<br>SEQ ID NO:16650 |
| iPS:393090 | 21-225_33D1 | NA | AAGTCCATCCAGAGTGTTT<br>ATACAGATCCAACAATAAGA<br>ACTACTTAACT<br>SEQ ID NO:627 | TGGGCATCTACCCGGGA<br>ATCC<br>SEQ ID NO:8639 | CAGCAATATTATAGTTCTCC<br>GTGCAGT<br>SEQ ID NO:16651 |
| | | AA | KSIQSVLYRSNNKNYLT<br>SEQ ID NO:628 | WASTRES<br>SEQ ID NO:8640 | QQYYSSPCS<br>SEQ ID NO:16652 |
| iPS:393090 | 21-225_33A5 | NA | CGGGCGAGTCAGGGCATTAG<br>CAATTACTTAGCC<br>SEQ ID NO:629 | GCTGCATCCAGTTGCAA<br>AGT<br>SEQ ID NO:8641 | CAACAGTATAATAGTTACCC<br>ATTCACT<br>SEQ ID NO:16653 |
| | | AA | RASQGISNYLA<br>SEQ ID NO:630 | AASSLQS<br>SEQ ID NO:8642 | QQYNSYPFT<br>SEQ ID NO:16654 |
| iPS:393092 | 21-225_33C12 | NA | CGGGCAAGTCAGAGCATTAT<br>CAGCTATTTAAAT<br>SEQ ID NO:631 | GTTGCATCCAGTTTGCAA<br>GGT<br>SEQ ID NO:8643 | CAACAGAGTTACAGTACCCC<br>GTACACT<br>SEQ ID NO:16655 |
| | | AA | RASQSIISYLN<br>SEQ ID NO:632 | VASSLQG<br>SEQ ID NO:8644 | QQSYSTPYT<br>SEQ ID NO:16656 |
| iPS:393094 | 21-225_34C4 | NA | CGGGCAAGTCAGGGCATTAG<br>AAATGATTTAGGC<br>SEQ ID NO:633 | ACTGCATCCAATTTGCAA<br>AGT<br>SEQ ID NO:8645 | CTACAACATAGTTCTTACCC<br>CATCACC<br>SEQ ID NO:16657 |
| | | AA | RASQGIRNDLG<br>SEQ ID NO:634 | TASNLQS<br>SEQ ID NO:8646 | LQHSSYPIT<br>SEQ ID NO:16658 |
| iPS:393096 | 21-225_34D11 | NA | CGGGCAAGTCAGGGACATTAG<br>AAGTGATTTAGGC<br>SEQ ID NO:635 | GCTGCATCCAGTTGCAA<br>AGT<br>SEQ ID NO:8647 | CTACAGCATACTATTTACCC<br>TCCTACT<br>SEQ ID NO:16659 |
| | | AA | RASQDIRSDLG<br>SEQ ID NO:636 | AASSLQS<br>SEQ ID NO:8648 | LQHTIYPPT<br>SEQ ID NO:16660 |

FIGURE 49
(Continued)

| | | | | | |
|---|---|---|---|---|---|
| iPS:393098 | 21-225_35G6 | NA | CGGGGCGAGTCAGGGTATTAG CCGGTGGTTAGCC<br>SEQ ID NO:637 | GCTGCATCCAGGTTGCA AAGT<br>SEQ ID NO:8649 | CAACAGGCTAACAGTTTCCC GTTCACT<br>SEQ ID NO:16661 |
| | | AA | RASQGISRWLA<br>SEQ ID NO:638 | AASRLQS<br>SEQ ID NO:8650 | QQANSFPFT<br>SEQ ID NO:16662 |
| iPS:393100 | 21-225_36B8 | NA | CGGGCAAGTCAGAGCATTAT CAGCTATTTAAAT<br>SEQ ID NO:639 | GTTGCATCCAGTTTGCAA AGT<br>SEQ ID NO:8651 | CAACAGAGTTACAGTACCCC GTACACT<br>SEQ ID NO:16663 |
| | | AA | RASQSHSYLN<br>SEQ ID NO:640 | VASSLQS<br>SEQ ID NO:8652 | QQSYSTPYT<br>SEQ ID NO:16664 |
| iPS:393102 | 21-225_33F1 | NA | CGGACAAGTCAGGACATTAG AAGTGATTTAGGC<br>SEQ ID NO:641 | GCTGCATCCAGTTTGCAA AGT<br>SEQ ID NO:8653 | CTACAGCATACTATTTACCC TCCTACT<br>SEQ ID NO:16665 |
| | | AA | RTSQDIRSDLG<br>SEQ ID NO:642 | AASSLQS<br>SEQ ID NO:8654 | LQHTYPPT<br>SEQ ID NO:16666 |
| iPS:393104 | 21-225_33A7 | NA | CGGGCAAGTCAGGACATTAG AAGTGATTTAGGC<br>SEQ ID NO:643 | GTTGCATCCAGTTTGCAA AGT<br>SEQ ID NO:8655 | CTACAGCATACTATTTACCC TCCTACT<br>SEQ ID NO:16667 |
| | | AA | RASQDIRSDLG<br>SEQ ID NO:644 | VASSLQS<br>SEQ ID NO:8656 | LQHTYPPT<br>SEQ ID NO:16668 |
| iPS:393106 | 21-225_34A6 | NA | CGGACAAGTCAGGACATCA GAAATGATTTAGGC<br>SEQ ID NO:645 | GCTGCATCCAGTTTGCAA AGT<br>SEQ ID NO:8657 | CTACAGCATAATAGTTACCC TCCTACT<br>SEQ ID NO:16669 |
| | | AA | RTSQDIRNDLG<br>SEQ ID NO:646 | AASSLQS<br>SEQ ID NO:8658 | LQHNSYPPT<br>SEQ ID NO:16670 |
| iPS:393108 | 21-225_34G11 | NA | CGGGCAAGTCAGAACATTAA CAGGTATTTAAAT<br>SEQ ID NO:647 | GGTGCATCCAGTTTGCA AAGT<br>SEQ ID NO:8659 | CAACAGACTTACATTACCCC GCTCACT<br>SEQ ID NO:16671 |
| | | AA | RASQNINRYLN<br>SEQ ID NO:648 | GASSLQS<br>SEQ ID NO:8660 | QQTYITPLT<br>SEQ ID NO:16672 |

FIGURE 49
(Continued)

| | | | | | |
|---|---|---|---|---|---|
| iPS:393110 | 21-225_35B7 | NA | CGGGCAAGTCAGGACATTAG AAGTGATTAGGC SEQ ID NO:649 | GCTGCATCCAGTTTGCAA AGT SEQ ID NO:8661 | CTACAGCATACTATTACCC TCCTACT SEQ ID NO:16673 |
| | | AA | RASQDIRSDLG SEQ ID NO:650 | AASSLQS SEQ ID NO:8662 | LQHTYPPT SEQ ID NO:16674 |
| iPS:393112 | 21-225_33G1 | NA | CGGGCGAGTCAGGGTATTAG CAGGTGGTTAGCC SEQ ID NO:651 | GGTGCATACAGTCTGCA AAGT SEQ ID NO:8663 | CAACAGGCTAACAGTTTCCC ATTCACT SEQ ID NO:16675 |
| | | AA | RASQGISRWLA SEQ ID NO:652 | GAYSLQS SEQ ID NO:8664 | QQANSFPFT SEQ ID NO:16676 |
| iPS:393114 | 21-225_33G12 | NA | CGGGCAAGTCAGAGCATTAG CAACTATTTAAAT SEQ ID NO:653 | GCTGCATCCAGTTTGCAA AGT SEQ ID NO:8665 | CAACAGAGTTACAGTACCCC ATTCACT SEQ ID NO:16677 |
| | | AA | RASQSISNYLN SEQ ID NO:654 | AASSLQS SEQ ID NO:8666 | QQSYSTPFT SEQ ID NO:16678 |
| iPS:393116 | 21-225_34G7 | NA | CGGGCGAGTCAGCTTATTAG CAAGTGGTTAGCC SEQ ID NO:655 | GCTGCATCCAGTTTGCAA AGT SEQ ID NO:8667 | CAACAGGCTAACAGTTTCCC ATTCACT SEQ ID NO:16679 |
| | | AA | RASQLISKWLA SEQ ID NO:656 | AASSLQS SEQ ID NO:8668 | QQANSFPFT SEQ ID NO:16680 |
| iPS:393118 | 21-225_34H11 | NA | CGGGCAAGTCAGGACATTAG AAATGATTAGGC SEQ ID NO:657 | GCTACATCCAGTTTGCAA AGT SEQ ID NO:8669 | CTACAGCATAATAGTTACCC TCCTACT SEQ ID NO:16681 |
| | | AA | RASQDIRNDLG SEQ ID NO:658 | ATSSLQS SEQ ID NO:8670 | LQHNSYPPT SEQ ID NO:16682 |
| iPS:393120 | 21-225_35H8 | NA | CGGGCGAGTCAGGCCATTAG TAATTATTTAGCC SEQ ID NO:659 | GGTGCGTCCGGTTTGCA AAGT SEQ ID NO:8671 | CAACAGTATAATAGTTACCC ATTCACT SEQ ID NO:16683 |
| | | AA | RASQAISNYLA SEQ ID NO:660 | GASGLQS SEQ ID NO:8672 | QQYNSYPFT SEQ ID NO:16684 |

FIGURE 49
(Continued)

| | | | | | | |
|---|---|---|---|---|---|---|
| iPS:393122 | 21-225_33B2 | NA | CGGGCAAGTCAGAGCATTAT CAGCTATTTAAAT | GTTGCATCCAGTTTGCAA AGT | CAACAGAGTTACAGTACCCC GTACACT | |
| | | | SEQ ID NO:661 | SEQ ID NO:8673 | SEQ ID NO:16685 | |
| | | AA | RASQSIISYLN | VASSLQS | QQSYSTPYT | |
| | | | SEQ ID NO:662 | SEQ ID NO:8674 | SEQ ID NO:16686 | |
| iPS:393124 | 21-225_33G7 | NA | CGGGCAAGTCAGGGCATTAG AAATGATTTAGGC | GCTGCATCCAGTTTGCAA AGT | CTACAGCATTATAGTTACCC TCCTACT | |
| | | | SEQ ID NO:663 | SEQ ID NO:8675 | SEQ ID NO:16687 | |
| | | AA | RASQGIRNDLG | AASSLQS | LQHYSYPPT | |
| | | | SEQ ID NO:664 | SEQ ID NO:8676 | SEQ ID NO:16688 | |
| iPS:393126 | 21-225_35D1 | NA | CGGGCAAGTCAGGACATTAG AAGTGATTTAGGC | GCTGCATCCAGTTTGCAA AGT | CTACAGCATACTATTTACCC TCCCACT | |
| | | | SEQ ID NO:665 | SEQ ID NO:8677 | SEQ ID NO:16689 | |
| | | AA | RASQDIRSDLG | AASSLQS | LQHTYPPT | |
| | | | SEQ ID NO:666 | SEQ ID NO:8678 | SEQ ID NO:16690 | |
| iPS:393128 | 21-225_35F11 | NA | CGGGCAAGTCAGGACATTAG AAGTGATTTAGGC | GCTGCATCCAGTTTGCAA AGT | CTACAGCATACTGTTTACCC TCCTACT | |
| | | | SEQ ID NO:667 | SEQ ID NO:8679 | SEQ ID NO:16691 | |
| | | AA | RASQDIRSDLG | AASSLQS | LQHTVYPPT | |
| | | | SEQ ID NO:668 | SEQ ID NO:8680 | SEQ ID NO:16692 | |
| iPS:393130 | 21-225_33C2 | NA | CGGGCAAGTCAGGGCATTAG AAATGATTTAGGC | GCTGCACCCAGTTTGCA AAGT | CTACAGCATAATAGTTACCC GTGGACG | |
| | | | SEQ ID NO:669 | SEQ ID NO:8681 | SEQ ID NO:16693 | |
| | | AA | RASQGIRNDLG | AAPSLQS | LQHNSYPWT | |
| | | | SEQ ID NO:670 | SEQ ID NO:8682 | SEQ ID NO:16694 | |
| iPS:393132 | 21-225_33H7 | NA | CGGGCGAGTCAGGGTATTAG CCGGTGGTTAGCC | GCTGCATCCAGGTTGCA AAGT | CAACAGGCTAACATTTTCCC GTTCACT | |
| | | | SEQ ID NO:671 | SEQ ID NO:8683 | SEQ ID NO:16695 | |
| | | AA | RASQGISRWLA | AASRLQS | QQANIFPFT | |
| | | | SEQ ID NO:672 | SEQ ID NO:8684 | SEQ ID NO:16696 | |

FIGURE 49
(Continued)

| | | | | |
|---|---|---|---|---|
| iPS:393134 | 21-225_34C2 | NA | CGGGCAAGTCAGAGAATTATCAGCTATTTAAAT SEQ ID NO:673 | GTTGCATCCAGTTTGCAA AGT SEQ ID NO:8685 | CAACAGAGTTACAGTACCCC GTACACT SEQ ID NO:16697 |
| | | AA | RASQRIISYLN SEQ ID NO:674 | VASSLQS SEQ ID NO:8686 | QQSYSTPYT SEQ ID NO:16698 |
| iPS:393136 | 21-225_34D8 | NA | CGGGCAAGTCAGAGATCATTAT CAGCTATTTAAAT SEQ ID NO:675 | GTTGCATCCAGTTTGCAA AGT SEQ ID NO:8687 | CAACAGAGTTACAGTACCCC GTACACT SEQ ID NO:16699 |
| | | AA | RASQIISYLN SEQ ID NO:676 | VASSLQS SEQ ID NO:8688 | QQSYSTPYT SEQ ID NO:16700 |
| iPS:393138 | 21-225_35E3 | NA | CAGGCGAGTCAGGACATTTT CAACTATTTAAAT SEQ ID NO:677 | GATGCCTCCAATTTGGA AACA SEQ ID NO:8689 | CAACAGTATGATAATCTCCC GATCACC SEQ ID NO:16701 |
| | | AA | QASQDIFNYLN SEQ ID NO:678 | DASNLET SEQ ID NO:8690 | QQYDNLPIT SEQ ID NO:16702 |
| iPS:393140 | 21-225_35H12 | NA | CGGGCGAGTCAGGGTATTAG CAGATGGTTAGCC SEQ ID NO:679 | GCTGCATCCGTTTGCAA AGT SEQ ID NO:8691 | CAACAGGCTAACAGTTTCCC ATTCACT SEQ ID NO:16703 |
| | | AA | RASQGISRWLA SEQ ID NO:680 | AASRLQS SEQ ID NO:8692 | QQANSFPFT SEQ ID NO:16704 |
| iPS:393142 | 21-225_33A3 | NA | CGGGCGAGTCAGGGCATTAA CAATTATTTAGCC SEQ ID NO:681 | GCTGCATCCAGTTTGCAA AGT SEQ ID NO:8693 | CAACAGTTTAATAGTTACCC TCCGACG SEQ ID NO:16705 |
| | | AA | RASQGINNYLA SEQ ID NO:682 | AASSLQS SEQ ID NO:8694 | QQFNSYPPT SEQ ID NO:16706 |
| iPS:393144 | 21-225_34D2 | NA | AAGTCTAGTCAGAGCCTCCT GCATAGTGATGATGAAAGACCCT ATTTGTAT SEQ ID NO:683 | GAAGTTTCCAACCGGTTC TCT SEQ ID NO:8695 | ATGCAAAGTAAACAGCTTCC TCCT SEQ ID NO:16707 |
| | | AA | KSSQSLLHSDGKTYLY | EVSNRFS | MQSKQLPP |

FIGURE 49
(Continued)

| | | | | | | |
|---|---|---|---|---|---|---|
| iPS:393146 | 21-225_34G8 | NA | SEQ ID NO:684<br>CGGGCAAGTCAGGACATTAG<br>AAGTGATTTAGGC | SEQ ID NO:8696<br>GCTGCATCCAGTTTGCAA<br>AGT | SEQ ID NO:16708<br>CTACAGCATACTATTTACCC<br>TCCTACT |
| | | AA | SEQ ID NO:685<br>RASQDIRSDLG | SEQ ID NO:8697<br>AASSLQS | SEQ ID NO:16709<br>LQHTIYPPT |
| iPS:393148 | 21-225_35E5 | NA | SEQ ID NO:686<br>CGGGCAAGTCAGAGACATTAG<br>CAGCTATTTAAAT | SEQ ID NO:8698<br>GGTGCATCCAGTTTCCAA<br>AGT | SEQ ID NO:16710<br>CACCAGAGTTACAATCTCCC<br>GATCACC |
| | | AA | SEQ ID NO:687<br>RASQSISSYLN | SEQ ID NO:8699<br>GASSFQS | SEQ ID NO:16711<br>HQSYNLPIT |
| iPS:393150 | 21-225_36A5 | NA | SEQ ID NO:688<br>CGGACAAGTCAGGACATTAG<br>AAATGATTTAGGC | SEQ ID NO:8700<br>GCTGCATCCAGTTTGCAA<br>AGT | SEQ ID NO:16712<br>CTACCACCAATAGTTACCC<br>TCCTAAG |
| | | AA | SEQ ID NO:689<br>RTSQDIRNDLG | SEQ ID NO:8701<br>AASSLQS | SEQ ID NO:16713<br>LHHNSYPPK |
| iPS:393152 | 21-225_25B3 | NA | SEQ ID NO:690<br>CGGGCGAGTCAGGGTATTAG<br>CAGCTGGTTAGCC | SEQ ID NO:8702<br>GGTGCATCCAGTTGCA<br>AAGT | SEQ ID NO:16714<br>CAACAGTCTGACAGTTTCCC<br>TCGGACG |
| | | AA | SEQ ID NO:691<br>RASQGISSWLA | SEQ ID NO:8703<br>GASSLQS | SEQ ID NO:16715<br>QQSDSFPRT |
| iPS:393166 | 21-225_27G6 | NA | SEQ ID NO:692<br>TCTGGAGATAAATTGGGGGA<br>TAAATATGCTTGC | SEQ ID NO:8704<br>CAAGATAGGAAGCGGCC<br>CTCA | SEQ ID NO:16716<br>CAGGCGTGGGACAGCAGCTC<br>TTATGTGGTA |
| | | AA | SEQ ID NO:693<br>SGDKLGDKYAC | SEQ ID NO:8705<br>QDRKRPS | SEQ ID NO:16717<br>QAWDSSSYVV |
| iPS:393168 | 21-225_32B11 | NA | SEQ ID NO:694<br>TCTGGAGATAAATTGGGGGA<br>TAAATATGCTTAC | SEQ ID NO:8706<br>CAAGATAGTAAGCGGTC<br>CTCA | SEQ ID NO:16718<br>CAGGCGTGGGACAACAGCAC<br>TGTGGTA |
| | | AA | SEQ ID NO:695<br>SGDKLGDKYAY | SEQ ID NO:8707<br>QDSKRSS | SEQ ID NO:16719<br>QAWDNSTVV |

FIGURE 49
(Continued)

| | | | | | | |
|---|---|---|---|---|---|---|
| iPS:393172 | 21-225_3B12 | NA | SEQ ID NO:696<br>TCTGGAGATAAATTGGGGGA<br>AAAATATGCTTGC | SEQ ID NO:8708<br>CAAGATAGGAAGGCGCC<br>CTCA | SEQ ID NO:16720<br>CAGGCGTGGGTCAACAACAC<br>TATGATA |
| | | AA | SEQ ID NO:697<br>SGDKLGEKYAC | SEQ ID NO:8709<br>QDRKRPS | SEQ ID NO:16721<br>QAWVNNTMI |
| iPS:393174 | 21-225_15D8 | NA | SEQ ID NO:698<br>ACCCTAAGCAGTGAGCACAG<br>CACCTACACCATCGAA | SEQ ID NO:8710<br>GTTAAGAGTGATGGCAG<br>CCACAGCAAGGGGGAC | SEQ ID NO:16722<br>GGAGAGAGCCACACGATCGA<br>TGGCCAAGTCGGTGTGGTA |
| | | AA | SEQ ID NO:699<br>TLSSEHSTYTIE | SEQ ID NO:8711<br>VKSDGSHSKGD | SEQ ID NO:16723<br>GESHTIDGQVGVV |
| iPS:393176 | 21-225_27E7 | NA | SEQ ID NO:700<br>TCTGGAGATAAATTGGGGGAA<br>TAAATATGCTTGC | SEQ ID NO:8712<br>CAAGATAGCAAGCGGCC<br>CTTA | SEQ ID NO:16724<br>CAGGCGTGGGACAGTAGTAC<br>TGTGGTA |
| | | AA | SEQ ID NO:701<br>SGDKLGEKYAC | SEQ ID NO:8713<br>QDSKRPL | SEQ ID NO:16725<br>QAWDSSTVV |
| iPS:393178 | 21-225_34D7 | NA | SEQ ID NO:702<br>TCTGGAGATAAATTGGGGGA<br>GAAATATGCTTAC | SEQ ID NO:8714<br>CAAGATAGCAAGCGGCC<br>CTCA | SEQ ID NO:16726<br>CAGGCGTGGGACAACACCAC<br>TGTGGTA |
| | | AA | SEQ ID NO:703<br>SGDKLGEKYAY | SEQ ID NO:8715<br>QDSKRPS | SEQ ID NO:16727<br>QAWDNTTVV |
| iPS:393180 | 21-225_4G12 | NA | SEQ ID NO:704<br>TCTGGAACCAACTCCAACAT<br>CGGAAGTTATACTGTAAAC | SEQ ID NO:8716<br>ATTAATAATCAGCGGCC<br>CTCA | SEQ ID NO:16728<br>GCAGCATGGGATGACAGCCT<br>GAATGGTCATGTGGTA |
| | | AA | SEQ ID NO:705<br>SGTNSNIGSYTVN | SEQ ID NO:8717<br>INNQRPS | SEQ ID NO:16729<br>AAWDDSLNGHVV |
| iPS:393182 | | NA | SEQ ID NO:706<br>TCTGGAGATAAATTGGGGGA<br>TAAATATGCTTGC | SEQ ID NO:8718<br>CAAGATCGCAAGCGGCC<br>CTCA | SEQ ID NO:16730<br>CAGGCGTGGGAACAACAAC<br>TGTGATA |

FIGURE 49
(Continued)

| | | | | | | | |
|---|---|---|---|---|---|---|---|
| iPS:393184 | 21-225_4B3 | AA | SEQ ID NO:707 SGDKLGDKYAC | SEQ ID NO:8719 QDRKRPS | SEQ ID NO:16731 QAWDNNTVI |
| | | | SEQ ID NO:708 | SEQ ID NO:8720 | SEQ ID NO:16732 |
| iPS:393186 | 21-225_15H11 | NA | TCTGGAGATAAATTGGGGGA GAAATATGCTTGC | CAAGATAGGAAGCGGCC CTCA | CAGGCGTGGGACAGCAGCAC TGCGGTA |
| | | | SEQ ID NO:709 SGDKLGEKYAC | SEQ ID NO:8721 QDRKRPS | SEQ ID NO:16733 QAWDSSTAV |
| | | AA | SEQ ID NO:710 | SEQ ID NO:8722 | SEQ ID NO:16734 |
| iPS:393186 | 21-225_27D9 | NA | TCTGGAGATAAATTGGGGGA TAAATATGCTTGC | CAAGATAGCAAGCGGCC CTCA | CAGGCGTGGGTCAACAACAC TGTA |
| | | | SEQ ID NO:711 SGYKLGDKYAC | SEQ ID NO:8723 QDSKRPS | SEQ ID NO:16735 QAWVNNTV |
| | | AA | SEQ ID NO:712 | SEQ ID NO:8724 | SEQ ID NO:16736 |
| iPS:393188 | 21-225_34B9 | NA | TCTGGAGATAAATTGGGGGA GAAATATGTTTCC | CAAGATAGTAAGCGGCC CTCA | CAGGCGTGGGACAGCAGCAC TGTA |
| | | | SEQ ID NO:713 SGDKLGEKYVS | SEQ ID NO:8725 QDSKRPS | SEQ ID NO:16737 QAWDSSTV |
| | | AA | SEQ ID NO:714 | SEQ ID NO:8726 | SEQ ID NO:16738 |
| iPS:393192 | 21-225_12B1 | NA | TCTGGAGATAAATTGGGGGA TAAATATGCTTGC | CAAGATCGCAAGCGGCC CTCA | CAGGCGTGGGACAACAACAC TGTGATA |
| | | | SEQ ID NO:715 SGDKLGDKYAC | SEQ ID NO:8727 QDRKRPS | SEQ ID NO:16739 QAWDNNTVI |
| | | AA | SEQ ID NO:716 | SEQ ID NO:8728 | SEQ ID NO:16740 |
| iPS:393194 | 21-225_16D2 | NA | TCTGGAGATAAATTGGGGGA TAAATATGCTTGC | CAAGATAGCAAGCGGCC CTCA | CAGGCGTGGGACAGCAGCAC TTATGTGTA |
| | | | SEQ ID NO:717 SGDKLGDKYAC | SEQ ID NO:8729 QDSKRPS | SEQ ID NO:16741 QAWDSSTYVV |
| | | AA | SEQ ID NO:718 | SEQ ID NO:8730 | SEQ ID NO:16742 |
| iPS:393196 | | NA | TCTGGAGATAAATTGGGGGA AAAATATGCTTGC | CAAGATAGGAAGCGGCC CTCA | CAGGCGTGGGTCAATAACAC TATGATA |

FIGURE 49
(Continued)

| | | | | | | |
|---|---|---|---|---|---|---|
| iPS:393198 | 21-225_16G8 | | SEQ ID NO:719 | SEQ ID NO:8731 | SEQ ID NO:16743 |
| | | AA | SGDKLGEKYAC | QDRKRPS | QAWVNNTMI |
| | | NA | SEQ ID NO:720 | SEQ ID NO:8732 | SEQ ID NO:16744 |
| | | | TCTGGAGATAAATTGGGGGA | CAAGATAGCAAGCGGCC | CAGGCGTGGGACAGTAGCAC |
| | | | TAAATATGCTTGC | CTCA | TTATGTGGTA |
| iPS:393200 | 21-225_28A11 | | SEQ ID NO:721 | SEQ ID NO:8733 | SEQ ID NO:16745 |
| | | AA | SGDKLGDKYAC | QDSKRPS | QAWDSSTYVV |
| | | | SEQ ID NO:722 | SEQ ID NO:8734 | SEQ ID NO:16746 |
| | | NA | TCTGGAGATAAATTGGGGGA | CAAGATAGGAAGCGGCC | CAGGCGTGGGACAACAGCAC |
| | | | AAAATATGCTTAC | CTCA | TGCGGTA |
| iPS:393202 | 21-225_35E1 | | SEQ ID NO:723 | SEQ ID NO:8735 | SEQ ID NO:16747 |
| | | AA | SGDKLGEKYAY | QDRKRPS | QAWDNSTAV |
| | | | SEQ ID NO:724 | SEQ ID NO:8736 | SEQ ID NO:16748 |
| | | NA | TCTGGAGATAAATTGGGGGA | CAAGATCGCAAGCGGCC | CAGGCGTGGGACAACAACAC |
| | | | TAAATATGCTTGC | CTCA | TGTGATA |
| iPS:393204 | 21-225_6B4 | | SEQ ID NO:725 | SEQ ID NO:8737 | SEQ ID NO:16749 |
| | | AA | SGDKLGDKYAC | QDRKRPS | QAWDNNTVI |
| | | | SEQ ID NO:726 | SEQ ID NO:8738 | SEQ ID NO:16750 |
| | | NA | GGGGGAAACAACATTGGAA | AGCGATAGCAACCGGCC | CAGGTGTGGGACAGTAGTAG |
| | | | GTAAAGCTGTGCAC | CTCA | TGATCATGTGGTA |
| iPS:393206 | 21-225_8C12 | | SEQ ID NO:727 | SEQ ID NO:8739 | SEQ ID NO:16751 |
| | | AA | GGNNIGSKAVH | SDSNRPS | QVWDSSSDHVV |
| | | | SEQ ID NO:728 | SEQ ID NO:8740 | SEQ ID NO:16752 |
| | | NA | TCTGGAGATAAATTGGGGGA | CAAGATAGCAAGCGGCC | CAGGCGTGGGCAACAGCAC |
| | | | TAAATATGCTTGC | CTCA | TGCTGTGGTA |
| iPS:393208 | 21-225_13F6 | | SEQ ID NO:729 | SEQ ID NO:8741 | SEQ ID NO:16753 |
| | | AA | SGDKLGDKYAC | QDSKRPS | QAWGNSTAVV |
| | | | SEQ ID NO:730 | SEQ ID NO:8742 | SEQ ID NO:16754 |
| | | NA | GGGGGAAACAACATTGGAA | GATGATACCGACCGGCC | CAGGTGTGGGATAGTAGCAG |
| | | | GTAAAGTGTGCAC | CTCA | TGATCATGTGGTA |

FIGURE 49
(Continued)

| | | | | | | |
|---|---|---|---|---|---|---|
| iPS:393210 | 21-225_16F3 | AA | SEQ ID NO:731<br>GGNNIGSKSVH | SEQ ID NO:8743<br>DDTDRPS | SEQ ID NO:16755<br>QVWDSSSDHVV | |
| | | NA | SEQ ID NO:732<br>TCTGGAGATAAATTGGGGGA<br>TAAATATGTTTAC | SEQ ID NO:8744<br>CAAGATAGGAAGCGGCC<br>CTCA | SEQ ID NO:16756<br>CAGGCGTGGGACAGCATCAC<br>TGCAGTA | |
| iPS:393212 | 21-225_17D3 | AA | SEQ ID NO:733<br>SGDKLGDKYVY | SEQ ID NO:8745<br>QDRKRPS | SEQ ID NO:16757<br>QAWDSITAV | |
| | | NA | SEQ ID NO:734<br>TCTGGAGATAAATTGGGTAA<br>TAAATATGCTTGC | SEQ ID NO:8746<br>CAAGATAGCAAGCGGCC<br>CTCA | SEQ ID NO:16758<br>CAGGCGTGGGACAGCAGCAC<br>TGTT | |
| iPS:393214 | 21-225_30H6 | AA | SEQ ID NO:735<br>SGDKLGNKYAC | SEQ ID NO:8747<br>QDSKRPS | SEQ ID NO:16759<br>QAWDSSTV | |
| | | NA | SEQ ID NO:736<br>TCTGGAGATAAATTGGGGGA<br>TAAATTTGTTTAT | SEQ ID NO:8748<br>CAAGATAGCAAGCAAGCGGCC<br>CTCA | SEQ ID NO:16760<br>CAGGCGTGGGACAGCACCAC<br>CGTGGTA | |
| iPS:393218 | 21-225_33A1 | AA | SEQ ID NO:737<br>SGDKLGDKFVY | SEQ ID NO:8749<br>QDSKRPS | SEQ ID NO:16761<br>QAWDSTTVV | |
| | | NA | SEQ ID NO:738<br>TCTGGAGATAAATTGGGGGA<br>TAAATATGTTTGC | SEQ ID NO:8750<br>CAAGATCGCAAGCGGCC<br>CTCA | SEQ ID NO:16762<br>CAGGCGTGGGGCAACAGCAC<br>TGCTGTGGTA | |
| iPS:393222 | 21-225_14G3 | AA | SEQ ID NO:739<br>SGDKLGDKYVC | SEQ ID NO:8751<br>QDRKRPS | SEQ ID NO:16763<br>QAWGNSTAVV | |
| | | NA | SEQ ID NO:740<br>TCTGGAGATAAATTGGGGGA<br>AAAATATGCTTGC | SEQ ID NO:8752<br>CAAGATAGAAAGCGGCC<br>CTCA | SEQ ID NO:16764<br>CAGGCGTGGGACAGCAGCAC<br>GGTA | |
| iPS:393224 | 21-225_17F5 | AA | SEQ ID NO:741<br>SGDKLGEKYAC | SEQ ID NO:8753<br>QDRKRPS | SEQ ID NO:16765<br>QAWDSSTV | |
| | | NA | SEQ ID NO:742<br>TCTGGAGATAAATTGGGAAA<br>TAAATATGCTTGC | SEQ ID NO:8754<br>CAAGATTCCAAGCGGCC<br>CTCA | SEQ ID NO:16766<br>CAGGCGTGGGACAGCAGCAC<br>TGTA | |

FIGURE 49
(Continued)

| | | | | | | |
|---|---|---|---|---|---|---|
| iPS:393226 | 21-225_31C2 | AA | SEQ ID NO:743<br>SGDKLGNKYAC<br>SEQ ID NO:744 | SEQ ID NO:8755<br>QDSKRPS<br>SEQ ID NO:8756 | SEQ ID NO:16767<br>QAWDSSTV<br>SEQ ID NO:16768 | |
| iPS:393230 | 21-225_33E6 | NA | TCTGGAGATAAATTGGGGGA<br>TAAATATGCTTAC | CAAGATAGGAAGCGGCC<br>CTCA | CAGGCGTGGGACAACAGCAC<br>TGCGGTA | |
| | | AA | SEQ ID NO:745<br>SGDKLGDKYAY<br>SEQ ID NO:746 | SEQ ID NO:8757<br>QDRKRPS<br>SEQ ID NO:8758 | SEQ ID NO:16769<br>QAWDNSTAV<br>SEQ ID NO:16770 | |
| iPS:393230 | 21-225_9G9 | NA | TCTGGAACCAACTCCAACAT<br>CGGAAGTTATACTGTAAAC | ATTAATAATCAGCGGCC<br>CTCA | GCAGCATGGGATGACAGCCT<br>GAATGGTCATGTGGTA | |
| | | AA | SEQ ID NO:747<br>SGTNSNIGSYTVN<br>SEQ ID NO:748 | SEQ ID NO:8759<br>INNQRPS<br>SEQ ID NO:8760 | SEQ ID NO:16771<br>AAWDDSLNGHVV<br>SEQ ID NO:16772 | |
| iPS:393232 | 21-225_17F12 | NA | ACTGGAGCCAGCAGTGACGT<br>TGGTGATTATAACTCTGTCT<br>CC | GAGGTCAGTAATCGGCC<br>CTCA | AGCTCATATACAAGCAGCAT<br>CACTGTGGTA | |
| | | AA | SEQ ID NO:749<br>TGASSDVGDYNSVS<br>SEQ ID NO:750 | SEQ ID NO:8761<br>EVSNRPS<br>SEQ ID NO:8762 | SEQ ID NO:16773<br>SSYTSSITVV<br>SEQ ID NO:16774 | |
| iPS:393234 | 21-225_26C10 | NA | TCTGGAGATAAATTGGGGGA<br>TAAATATGTTTGC | CAAGATAGCAAGCGGCC<br>CTCA | CAGGCGTGGGTCAACAACAC<br>TGTA | |
| | | AA | SEQ ID NO:751<br>SGDKLGDKYVC<br>SEQ ID NO:752 | SEQ ID NO:8763<br>QDSKRPS<br>SEQ ID NO:8764 | SEQ ID NO:16775<br>QAWVNNTV<br>SEQ ID NO:16776 | |
| iPS:393345 | 21-225_5G7 | NA | TCTGGAGATAAATTGGGGAA<br>TAAATATGCTTGG | CAAGATAGGAAGCGGCC<br>CTCA | CAGGCGTGGGACAACAGCAC<br>TGTGGTT | |
| | | AA | SEQ ID NO:753<br>SGDKLGNKYAW<br>SEQ ID NO:754 | SEQ ID NO:8765<br>QDRKRPS<br>SEQ ID NO:8766 | SEQ ID NO:16777<br>QAWDNSTVV<br>SEQ ID NO:16778 | |

FIGURE 49
(Continued)

| | | | | | |
|---|---|---|---|---|---|
| iPS:393368 | 21-225_29H8 | NA | AGGTCCAGCCAGACTATTT ACACAGTCCAACAATTACA ACTACTTAGCT | TGGGCATCTACCCGGGA ATCC | CAGCAATATTATTGTACTCC TCCGACG |
| | | | SEQ ID NO:755 | SEQ ID NO:8767 | SEQ ID NO:16779 |
| | | AA | RSSQTILHSSNNYNYLA | WASTRES | QQYYCTPPT |
| | | | SEQ ID NO:756 | SEQ ID NO:8768 | SEQ ID NO:16780 |
| iPS:393565 | 21-225_34B11 | NA | TCTGGAGATAAATGGGGGA TAAATATGCTTGC | CAAGATATGAAGCGGCC CTCA | CAGGCGTGGGACAACAGCAC TGCGGTA |
| | | | SEQ ID NO:757 | SEQ ID NO:8769 | SEQ ID NO:16781 |
| | | AA | SGDKLGDKYAC | QDMKRPS | QAWDNSTAV |
| | | | SEQ ID NO:758 | SEQ ID NO:8770 | SEQ ID NO:16782 |
| iPS:393802 | 21-225_3D12 | NA | AGGGCCAGTCAGAGTGTTAG CAGCAGCTACTTAGCC | GGTACATCCAGCAGGC CACT | CAGCAGTATGGTAGTTCACG CAGT |
| | | | SEQ ID NO:759 | SEQ ID NO:8771 | SEQ ID NO:16783 |
| | | AA | RASQSVSSSYLA | GTSSRAT | QQYGSSRS |
| | | | SEQ ID NO:760 | SEQ ID NO:8772 | SEQ ID NO:16784 |
| iPS:393804 | 21-225_5H7 | NA | CGGGCAAGTCAGGGCATTAG AAATGATTTAGGC | GTTACATCCAGTTTGCAA GGT | CTACAACATAATAGTTACCC GCTCACT |
| | | | SEQ ID NO:761 | SEQ ID NO:8773 | SEQ ID NO:16785 |
| | | AA | RASQGIRNDLG | VTSSLQG | LQHNSYPLT |
| | | | SEQ ID NO:762 | SEQ ID NO:8774 | SEQ ID NO:16786 |
| iPS:393806 | 21-225_6A6 | NA | CGGGCAAGTCAGGGCATTAG AAATGATTTAGGC | GCTGCATCCAGTTTGCAA AGT | CTACAGCAGTAGTTACCC GCTCACT |
| | | | SEQ ID NO:763 | SEQ ID NO:8775 | SEQ ID NO:16787 |
| | | AA | RASQGIRNDLG | AASSLQS | LQHSSYPLT |
| | | | SEQ ID NO:764 | SEQ ID NO:8776 | SEQ ID NO:16788 |
| iPS:393808 | 21-225_1A2 | NA | CGGGCAAGTCAGGGCATTAG AAATGATTTAGGC | GCTGCATCCAGTTTGCAA AGT | CTACAGCATAATAGTCACCC TCTCACT |
| | | | SEQ ID NO:765 | SEQ ID NO:8777 | SEQ ID NO:16789 |
| | | AA | RASQGIRNDLG | AASSLQS | LQHNSHPLT |

FIGURE 49
(Continued)

| | | | SEQ ID NO:766 | | SEQ ID NO:8778 | | SEQ ID NO:16790 |
|---|---|---|---|---|---|---|---|
| iPS:393810 | 21-225_5A4 | NA | CGGGCAAGTCAGGGTATTAG CACCTGGTTAGCC | GATGCATCCAGTTTGCA AAGT | CAACAGGCTAACAGTTTCCC GTGGACG |
| | | | SEQ ID NO:767 | | SEQ ID NO:8779 | | SEQ ID NO:16791 |
| | | AA | RASQGISTWLA | | DASSLQS | | QQANSFPWT |
| | | | SEQ ID NO:768 | | SEQ ID NO:8780 | | SEQ ID NO:16792 |
| iPS:393812 | 21-225_6A11 | NA | CGGGCAAGTCAGGGCATTAG AAATGATTTAGGC | GCTGCATCCAGTTTGCAA AGT | CTACAGCATAATAGTTACCC GTGGACG |
| | | | SEQ ID NO:769 | | SEQ ID NO:8781 | | SEQ ID NO:16793 |
| | | AA | RASQGIRNDLG | | AASSLQS | | LQHNSYPWT |
| | | | SEQ ID NO:770 | | SEQ ID NO:8782 | | SEQ ID NO:16794 |
| iPS:393814 | 21-225_7F4 | NA | CGGACAAGTCAGGGCATTAG AAATGATTTAGGC | GCTGCATCCAATTTGCAA AGT | CTACAGCATAGTGCTTACCC GCTCACT |
| | | | SEQ ID NO:771 | | SEQ ID NO:8783 | | SEQ ID NO:16795 |
| | | AA | RTSQGIRNDLG | | AASNLQS | | LQHSAYPLT |
| | | | SEQ ID NO:772 | | SEQ ID NO:8784 | | SEQ ID NO:16796 |
| iPS:393816 | 21-225_6D4 | NA | CGGGCAAGTCAGGGCCATTAG AAATGATTTAGGC | GCTGCATCCAGTTTGCAA AGT | CTACAGCATAGTAGTTACCC GCTCACT |
| | | | SEQ ID NO:773 | | SEQ ID NO:8785 | | SEQ ID NO:16797 |
| | | AA | RASQAIRNDLG | | AASSLQS | | LQHSSYPLT |
| | | | SEQ ID NO:774 | | SEQ ID NO:8786 | | SEQ ID NO:16798 |
| iPS:393818 | 21-225_6G12 | NA | CGGGCAAGTCAGGGCATTAG AAATGATTTAGGC | GCTGCATCCACTTTGCAA AGT | CTACAGCATAATAGTTACCC GCTCACT |
| | | | SEQ ID NO:775 | | SEQ ID NO:8787 | | SEQ ID NO:16799 |
| | | AA | RASQGIRNDLG | | AASTLQS | | LQHNSYPLT |
| | | | SEQ ID NO:776 | | SEQ ID NO:8788 | | SEQ ID NO:16800 |
| iPS:393820 | 21-225_8H7 | NA | CGGGCAAGTCAGGGCATTAG AAATGATTTAGGC | GCTGCATCCAGTTTGCAA AGT | CTACAGCATAATAGTTACCC GTTCACT |
| | | | SEQ ID NO:777 | | SEQ ID NO:8789 | | SEQ ID NO:16801 |
| | | AA | RASQGIRNDLG | | AASSLQS | | LQHNSYPFT |

FIGURE 49
(Continued)

| | | | | | | |
|---|---|---|---|---|---|---|
| iPS:393822 | 21-225_15B11 | NA | SEQ ID NO:778 CGGGCAAGTCAGGGCATTAGC AAATGATTTAGGC | SEQ ID NO:8790 GCTGCATCCAGTTTGCAA AGT | SEQ ID NO:16802 CTACAGCATAATAGTTACCC ATTCACT |
| | | AA | SEQ ID NO:779 RASQGIRNDLG | SEQ ID NO:8791 AASSLQS | SEQ ID NO:16803 LQHNSYPFT |
| iPS:393824 | 21-225_10F12 | NA | SEQ ID NO:780 CGGGCAAGTCAGAACATTAG TAGTTATTTAAAT | SEQ ID NO:8792 GCTGCATCCAGTTTGCAA AGT | SEQ ID NO:16804 CAACAGAGTTACAATACCCC CTTCTTCACT |
| | | AA | SEQ ID NO:781 RASQNISSYLN | SEQ ID NO:8793 AASSLQS | SEQ ID NO:16805 QQSYNTPFFT |
| iPS:393826 | 21-225_10G5 | NA | SEQ ID NO:782 CGGGCAAGTCAGGGCATTAG AAATGATTTAGGC | SEQ ID NO:8794 GCTGCATCCAGTTTGCAA AGT | SEQ ID NO:16806 CTACAGCATAATAGTTACCC GCTCACT |
| | | AA | SEQ ID NO:783 RASQGIRNDLG | SEQ ID NO:8795 AASSLQS | SEQ ID NO:16807 LQHNSYPLT |
| iPS:393828 | 21-225_10H12 | NA | SEQ ID NO:784 CGGGCAAGTCAGGGCATTAG AAATGATTTAGGC | SEQ ID NO:8796 GGTGCATCCAGTTTGCA AAGT | SEQ ID NO:16808 CTACAGCATAATAGTTACCC GCTCACT |
| | | AA | SEQ ID NO:785 RASQGIRNDLG | SEQ ID NO:8797 GASSLQS | SEQ ID NO:16809 LQHNSYPLT |
| iPS:393830 | 21-225_12A1 | NA | SEQ ID NO:786 CGGGCAAGTCAGGGCATTAG AAATGATTTAGGC | SEQ ID NO:8798 GCTGCATCCAGTTTGCAA AGT | SEQ ID NO:16810 CTACAGCATAATAGTTACCC GCTCACT |
| | | AA | SEQ ID NO:787 RASQGIRNDLG | SEQ ID NO:8799 AASSLQS | SEQ ID NO:16811 LQHNSYPLT |
| iPS:393832 | 21-225_14B2 | NA | SEQ ID NO:788 CGGGCAAGTCAGGGCATTAG AAATGATTTAGGC | SEQ ID NO:8800 GTTACATCCAGTTTGCAA GGT | SEQ ID NO:16812 CTACAACATAATAGTTACCC GCTCACT |
| | | AA | SEQ ID NO:789 RASQGIRNDLG | SEQ ID NO:8801 VTSSLQG | SEQ ID NO:16813 LQHNSYPLT |

FIGURE 49
(Continued)

| | | | | | | |
|---|---|---|---|---|---|---|
| iPS:393836 | 21-225_15A2 | NA | SEQ ID NO:790<br>CGGGCAAGTCAGGGCATTAG<br>CAATTATTTAGCC | SEQ ID NO:8802<br>GCTGCATCCAGTTGCAA<br>AGT | SEQ ID NO:16814<br>CAACAGTATTATAGTTACCC<br>ATTCACT |
| | | AA | SEQ ID NO:791<br>RASQGISNYLA | SEQ ID NO:8803<br>AASSLQS | SEQ ID NO:16815<br>QQYYSYPFT |
| iPS:393838 | 21-225_6G2 | NA | SEQ ID NO:792<br>CGGGCAAGTCAGGGCATTAG<br>AAATGATTTAGGC | SEQ ID NO:8804<br>GCTGCATCCAGTCTGCA<br>AAGT | SEQ ID NO:16816<br>ATACAGCATAATAGTTACCT<br>GTGGACG |
| | | AA | SEQ ID NO:793<br>RASQGIRNDLG | SEQ ID NO:8805<br>AASSLQS | SEQ ID NO:16817<br>IQHNSYLWT |
| iPS:393840 | 21-225_3F8 | NA | SEQ ID NO:794<br>CGGGCAAGTCAGAGTATTCT<br>CAGCTATTTAAAT | SEQ ID NO:8806<br>ACTACATCCAGTTTGCAA<br>AGT | SEQ ID NO:16818<br>CAACAGACTTACAGTACCCC<br>GCTCACT |
| | | AA | SEQ ID NO:795<br>RASQSILSYLN | SEQ ID NO:8807<br>TTSSLQS | SEQ ID NO:16819<br>QQTYSTPLT |
| iPS:393844 | 21-225_3G7 | NA | SEQ ID NO:796<br>CGGGCAAGTCAGAACATTTA<br>CAGGTATTTAAAT | SEQ ID NO:8808<br>GCTGCATCCAGTTCGCA<br>AAGT | SEQ ID NO:16820<br>CAACAGAGTTACAGTCCCCC<br>TTTCACT |
| | | AA | SEQ ID NO:797<br>RASQNIYRYLN | SEQ ID NO:8809<br>AASSSQS | SEQ ID NO:16821<br>QQSYSPPFT |
| iPS:393848 | 21-225_4H2 | NA | SEQ ID NO:798<br>CGGGCAATTCAGAACATTAG<br>CAGCTATTTAAAT | SEQ ID NO:8810<br>GCTGCATCCAGCTTGCA<br>AAGT | SEQ ID NO:16822<br>CAACAGAGTTACAGAACCCC<br>CTTATTCACT |
| | | AA | SEQ ID NO:799<br>RAIQNISSYLN | SEQ ID NO:8811<br>AASSLQS | SEQ ID NO:16823<br>QQSYRTPLFT |
| iPS:393852 | 21-225_12A10 | NA | SEQ ID NO:800<br>CGGGCAAGTCAGAACATTTA<br>CAGCTATTTAAAT | SEQ ID NO:8812<br>ACTGCATCCAGTTTGCAA<br>AGT | SEQ ID NO:16824<br>CAGCAGAGTTACAGTCCCCC<br>TCTCACT |
| | | AA | SEQ ID NO:801<br>RASQNIYSYLN | SEQ ID NO:8813<br>TASSLQS | SEQ ID NO:16825<br>QQSYSPPLT |

FIGURE 49
(Continued)

| | | | | | | |
|---|---|---|---|---|---|---|
| iPS:393854 | 21-225_7H11 | NA | SEQ ID NO:802 CTGGCAAGTCAGGGCATTAG AAATGATTAGGC | SEQ ID NO:8814 GTTGCATGTAGTTTCCAA AGT | SEQ ID NO:16826 CTACAACATAATCTTTACCC GCTCACT |
| | | AA | SEQ ID NO:803 LASQGIRNDLG | SEQ ID NO:8815 VACSFQS | SEQ ID NO:16827 LQHNLYPLT |
| iPS:393856 | 21-225_14C2 | NA | SEQ ID NO:804 CGGGCAAGTCAGGGCATTAG AAATGATTAGAC | SEQ ID NO:8816 GCTGCATCCAGTTGCAA AGT | SEQ ID NO:16828 GTACAGCATAATAGTTACCC GCTCACT |
| | | AA | SEQ ID NO:805 RASQGIRNDLD | SEQ ID NO:8817 AASSLQS | SEQ ID NO:16829 VQHNSYPLT |
| iPS:393862 | 21-225_5G2 | NA | SEQ ID NO:806 CGGGCAAGTCAGAACACATTAT TAGTTATTTAAAT | SEQ ID NO:8818 GGTGCATCCAGTTTGCA AAGT | SEQ ID NO:16830 CAACAGAGTTACAGTACTCC CTTATTCACT |
| | | AA | SEQ ID NO:807 RASQNIISYLN | SEQ ID NO:8819 GASSLQS | SEQ ID NO:16831 QQSYSTPLFT |
| iPS:393864 | 21-225_4C5 | NA | SEQ ID NO:808 CGGGCAAGTCGGGGCATCA GAGGTGATTTAGGT | SEQ ID NO:8820 GCTGCATCCAATTTGCAA AGT | SEQ ID NO:16832 CTACAGCATTATAGTTACCC TCGGACG |
| | | AA | SEQ ID NO:809 RASRGIRGDLG | SEQ ID NO:8821 AASNLQS | SEQ ID NO:16833 LQHYSYPRT |
| iPS:393866 | 21-225_14E3 | NA | SEQ ID NO:810 CGGGCAAGTCAGGGCATTAG AAATGATTAGGC | SEQ ID NO:8822 TCTGCATCCAGTTTGCAA AGT | SEQ ID NO:16834 GTACAGCATTATAGTTACCC GTTCACT |
| | | AA | SEQ ID NO:811 RASQGIRNDLG | SEQ ID NO:8823 SASSLQS | SEQ ID NO:16835 VQHYSYPFT |
| iPS:393868 | 21-225_9C11 | NA | SEQ ID NO:812 CGGGCAAGTCAGAACACATTAG AAATTATTTAAAT | SEQ ID NO:8824 GTTGCATCCAGTTTGCAA AGT | SEQ ID NO:16836 CATCAGAGTAACAGTACTCC TCTCACG |
| | | AA | SEQ ID NO:813 RASQNIRNYLN | SEQ ID NO:8825 VASSLQS | SEQ ID NO:16837 HQSNSTPLT |

FIGURE 49
(Continued)

| | | | | | | |
|---|---|---|---|---|---|---|
| iPS:393870 | 21-225_7B1 | NA | SEQ ID NO:814 CGGGCGAGTCAGGACATTAGCAATCATTAGTC | SEQ ID NO:8826 GCTGCATCCAGTTTACAA AGT | SEQ ID NO:16838 CACCAGTATAATAGTTACCC CTTCACT |
| | | AA | SEQ ID NO:815 RASQDISNHLV | SEQ ID NO:8827 AASSLQS | SEQ ID NO:16839 HQYNSYPFT |
| iPS:393872 | 21-225_2A11 | NA | SEQ ID NO:816 CGGGCAAGTCAGGGCATTAGAAATGATTTAGGC | SEQ ID NO:8828 GCTGCATCCAGTTTGCAA AGT | SEQ ID NO:16840 CTACAGCATAATAGTTACCC GCTCACT |
| | | AA | SEQ ID NO:817 RASQGIRNDLG | SEQ ID NO:8829 AASSLQS | SEQ ID NO:16841 LQHNSYPLT |
| iPS:393874 | 21-225_4C8 | NA | SEQ ID NO:818 CGGGCAAGTCAGGGCATTAGAAATGATTTAGGC | SEQ ID NO:8830 GCTGCATCCAGTTTGCAA AGT | SEQ ID NO:16842 CTACAGCATAATAGTTACCC GCTCACT |
| | | AA | SEQ ID NO:819 RASQGIRNDLG | SEQ ID NO:8831 AASSLQS | SEQ ID NO:16843 LQHNSYPLT |
| iPS:393876 | 21-225_9A1 | NA | SEQ ID NO:820 CGGGCAAGTCAGGGCATTAGAAATGATTTAGGG | SEQ ID NO:8832 ACTGCATCCAGTTTGCAA AGT | SEQ ID NO:16844 ATACAGCATAATAGTTACCT GTGGACG |
| | | AA | SEQ ID NO:821 RASQGIRNDLG | SEQ ID NO:8833 TASSLQS | SEQ ID NO:16845 IQHNSYLWT |
| iPS:393878 | 21-225_7G12 | NA | SEQ ID NO:822 CGGGCAAGTCAGAATATTAACAACTATTTAAAT | SEQ ID NO:8834 ACTGCATCCAGTTTGCAA AGT | SEQ ID NO:16846 CAACAGAGTTACACTACCCC CACGTGGACG |
| | | AA | SEQ ID NO:823 RASQNINNYLN | SEQ ID NO:8835 TASSLQS | SEQ ID NO:16847 QQSYTTPTWT |
| iPS:393880 | 21-225_15A1 | NA | SEQ ID NO:824 CGGGCAAGTCAGGGCATTAGAAATGATTTAGGC | SEQ ID NO:8836 GCTGCATCCAGTTTACAA AGT | SEQ ID NO:16848 CTACACAACAGTAGTTACCC TGTTAAG |
| | | AA | SEQ ID NO:825 RASQGIRNDLG | SEQ ID NO:8837 AASSLQS | SEQ ID NO:16849 LHNSSYPVK |

FIGURE 49
(Continued)

| | | | | | |
|---|---|---|---|---|---|
| iPS:393882 | | NA | SEQ ID NO:826<br>CGGGCAAGTCAGGGCATTAG<br>AAATGATTAGGC | SEQ ID NO:8838<br>GCTGCATCCAGTTCGCA<br>AAGT | SEQ ID NO:16850<br>CTACAGCATCATAGTTACCC<br>GCTCACT |
| | 21-225_15E3 | AA | SEQ ID NO:827<br>RASQGIRNDLG | SEQ ID NO:8839<br>AASSSQS | SEQ ID NO:16851<br>LQHHSYPLT |
| iPS:393884 | | NA | SEQ ID NO:828<br>CGGGCAAGTCAGGGCATTAG<br>AAATGATTAGGC | SEQ ID NO:8840<br>GTTGCATCCAGTTTGCAA<br>AGT | SEQ ID NO:16852<br>ATACAGCATAATAGTTATCC<br>GTTCACT |
| | 21-225_16F4 | AA | SEQ ID NO:829<br>RASQGIRNDLG | SEQ ID NO:8841<br>VASSLQS | SEQ ID NO:16853<br>IQHNSYPFT |
| iPS:393886 | | NA | SEQ ID NO:830<br>CGGGCAAGTCAGGGCATTAG<br>AAATGATTAGGT | SEQ ID NO:8842<br>GCTGCATCCAGTTTGCAA<br>AGT | SEQ ID NO:16854<br>TTACAGCATGAAAGTTACCC<br>TCTCACT |
| | 21-225_2G9 | AA | SEQ ID NO:831<br>RASQGIRNDLG | SEQ ID NO:8843<br>AASSLQS | SEQ ID NO:16855<br>LQHESYPLT |
| iPS:393888 | | NA | SEQ ID NO:832<br>CGGGCAAGTCAGAGGCATTAG<br>AAGTTATTTAAAT | SEQ ID NO:8844<br>GGTACATCCAGTTCCAG<br>AAGT | SEQ ID NO:16856<br>CAACAGAGTTACAGTACCCC<br>CTTGTTCACT |
| | 21-225_3E3 | AA | SEQ ID NO:833<br>RASQSIRSYLN | SEQ ID NO:8845<br>GTSSLQS | SEQ ID NO:16857<br>QQSYSTPLFT |
| iPS:393890 | | NA | SEQ ID NO:834<br>CGGGCAAGTCATACCATTAG<br>AACCTATTTAAAC | SEQ ID NO:8846<br>GCTGCATCCAGTTTGCAA<br>AGT | SEQ ID NO:16858<br>CAACAGAGTTACAATATCTC<br>ATTCACT |
| | 21-225_4B1 | AA | SEQ ID NO:835<br>RASHTRTYLN | SEQ ID NO:8847<br>AASSLQS | SEQ ID NO:16859<br>QQSYNISFT |
| iPS:393892 | | NA | SEQ ID NO:836<br>CAGGGCGAGTCAGGACATTAG<br>CAACTATTTAAAT | SEQ ID NO:8848<br>GATGCATCCACTTTGGA<br>AACA | SEQ ID NO:16860<br>CAACAGTATGATAATGTCCC<br>GATCACC |
| | 21-225_6G7 | AA | SEQ ID NO:837<br>QASQDISNYLN | SEQ ID NO:8849<br>DASTLET | SEQ ID NO:16861<br>QQYDNVPIT |

FIGURE 49
(Continued)

| | | | | | | |
|---|---|---|---|---|---|---|
| iPS:393894 | 21-225_5E11 | NA | SEQ ID NO:838 CGGGCGAGTCAGGGCATTAG CAATTATTTAGCC | SEQ ID NO:8850 GCTGCATCCAGTGTGCA GAGT | SEQ ID NO:16862 CACCAGTATCACAGTTACCC ATTCACT | |
| | | AA | SEQ ID NO:839 RASQGISNYLA | SEQ ID NO:8851 AASSVQS | SEQ ID NO:16863 HQYHSYPFT | |
| iPS:393896 | 21-225_2A4 | NA | SEQ ID NO:840 CGGGCGAGTCAGGGCATTAG CAATTATTTAGCC | SEQ ID NO:8852 ACTGCATCCAGTTTGCAA AGT | SEQ ID NO:16864 CAACAGTATAATAGTTACCC ATTCACT | |
| | | AA | SEQ ID NO:841 RASQGISNYLA | SEQ ID NO:8853 TASSLQS | SEQ ID NO:16865 QQYNSYPFT | |
| iPS:393898 | 21-225_5F7 | NA | SEQ ID NO:842 CGGGCAAGTCAGACCATTAG TAGTTATTTAAAT | SEQ ID NO:8854 GCTGCATCCAGTTTGCAA AGT | SEQ ID NO:16866 CAACAGTTACAATACCCC CTTATTCACT | |
| | | AA | SEQ ID NO:843 RASQTISSYLN | SEQ ID NO:8855 AASSLQS | SEQ ID NO:16867 QQSYNTPLFT | |
| iPS:393900 | 21-225_10E12 | NA | SEQ ID NO:844 CGGGCAAGTCAGAACATTTA CAGTTATTTAAAT | SEQ ID NO:8856 GCTACATCCAGTTTGCAA AGT | SEQ ID NO:16868 CAACAGAATTACAGTCCCCC TCTCACT | |
| | | AA | SEQ ID NO:845 RASQNIYSYLN | SEQ ID NO:8857 ATSSLQS | SEQ ID NO:16869 QQNYSPPLT | |
| iPS:393902 | 21-225_14E10 | NA | SEQ ID NO:846 CGGACAAGTCAGGGCATTAG AAATGATTTAGGC | SEQ ID NO:8858 GCTGCATCCAGTTTACAA AGT | SEQ ID NO:16870 CTGCAGCATTATAGTTACCC TCGGACG | |
| | | AA | SEQ ID NO:847 RTSQGIRNDLG | SEQ ID NO:8859 AASSLQS | SEQ ID NO:16871 LQHYSYPRT | |
| iPS:393904 | 21-225_8H11 | NA | SEQ ID NO:848 CGGGCAAGTCAGAACATTAT CAGCTATTTAAAT | SEQ ID NO:8860 GTTACATCCAGTTGCAC AGT | SEQ ID NO:16872 CAACAGAGTTACAGTACCCC TTTCACT | |
| | | AA | SEQ ID NO:849 RASQNIISYLN | SEQ ID NO:8861 VTSSLHS | SEQ ID NO:16873 QQSYSTPFT | |

FIGURE 49
(Continued)

| | | | | | | |
|---|---|---|---|---|---|---|
| iPS:393906 | 21-225_13D3 | NA | SEQ ID NO:850 AGGGCCAGTCAGTCAGACTGTTAG CAGCAACTTAGCC | SEQ ID NO:8862 GGTGCATCCACCAGGGC CACT | SEQ ID NO:16874 CAGCAGTATCATGACTGGCC TCCGACG |
| | | AA | SEQ ID NO:851 RASQTVSSNLA | SEQ ID NO:8863 GASTRAT | SEQ ID NO:16875 QQYHDWPPT |
| iPS:393908 | 21-225_10E9 | NA | SEQ ID NO:852 CGGGCAAGTCAGGACATTAG AAGTGATTTAGGC | SEQ ID NO:8864 GCTGCATCCAGTTGCAA AGT | SEQ ID NO:16876 CTACAGCATTATAGTTACCC TCGGACG |
| | | AA | SEQ ID NO:853 RASQDIRSDLG | SEQ ID NO:8865 AASSLQS | SEQ ID NO:16877 LQHYSYPRT |
| iPS:393910 | 21-225_15F10 | NA | SEQ ID NO:854 CAGGCGAATCAGGACATTAC CAACTTTTAAAT | SEQ ID NO:8866 GATGCATCCAATTTGGA AACA | SEQ ID NO:16878 CAACAGTATGATAATCTCCC GATCACC |
| | | AA | SEQ ID NO:855 QANQDITNFLN | SEQ ID NO:8867 DASNLET | SEQ ID NO:16879 QQYDNLPIT |
| iPS:393912 | 21-225_16F6 | NA | SEQ ID NO:856 CAGGCGAATCAGGACATTAC CAACTTTTAAAT | SEQ ID NO:8868 GATGCATCCAATTTGGA AACA | SEQ ID NO:16880 CAACAGTATGATAATCTCCC GATCACC |
| | | AA | SEQ ID NO:857 QANQDITNFLN | SEQ ID NO:8869 DASNLET | SEQ ID NO:16881 QQYDNLPIT |
| iPS:393914 | 21-225_16B8 | NA | SEQ ID NO:858 CGGGCGAGTCAGGGCATTAA CAATTATTTAGCC | SEQ ID NO:8870 GCTGCATCCAGTGTGCA GAGT | SEQ ID NO:16882 CACCAGTATCACAGTTACCC ATTCACT |
| | | AA | SEQ ID NO:859 RASQGINNYLA | SEQ ID NO:8871 AASSVQS | SEQ ID NO:16883 HQYHSYPFT |
| iPS:393916 | 21-225_2G4 | NA | SEQ ID NO:860 CGGGCAAGTCAGGGCATTAG AAATGATTTAGGC | SEQ ID NO:8872 GCTGCATCCAGTTTGCAC AGT | SEQ ID NO:16884 CTACAACATTATAGTTTCCCT CGGACG |
| | | AA | SEQ ID NO:861 RASQGIRNDLG | SEQ ID NO:8873 AASSLHS | SEQ ID NO:16885 LQHYSFPRT |

FIGURE 49
(Continued)

| | | | | | | |
|---|---|---|---|---|---|---|
| iPS:393920 | 21-225_1H12 | NA | SEQ ID NO:862 CGGGCAAGTCAGAACATTTACAGGTATTTAAAT | SEQ ID NO:8874 ACTGCATCCAGTTTACAAAGT | SEQ ID NO:16886 CAACAGAGTTACAGTCCCCCTCTCACT | |
| | | AA | SEQ ID NO:863 RASQNIYRYLN | SEQ ID NO:8875 TASSLQS | SEQ ID NO:16887 QQSYSPPLT | |
| iPS:393922 | 21-225_2B2 | NA | SEQ ID NO:864 CGGGCAAGTCAGGGCATTAGAAATGATTTAGGC | SEQ ID NO:8876 GCTGCATCCAGTTTACAAAGT | SEQ ID NO:16888 CTACAGCATAATAGTTACCCGCTCACT | |
| | | AA | SEQ ID NO:865 RASQGIRNDLG | SEQ ID NO:8877 AASSLQS | SEQ ID NO:16889 LQHNSYPLT | |
| iPS:393926 | 21-225_4G4 | NA | SEQ ID NO:866 CGGGCAAGTCAGACCATTATCAGCTATTTAAAT | SEQ ID NO:8878 ACTGCATCCAGTTTGCAAAGT | SEQ ID NO:16890 CAACAGACTTACAGTACTCCGCTCACT | |
| | | AA | SEQ ID NO:867 RASQTHSYLN | SEQ ID NO:8879 TASSLQS | SEQ ID NO:16891 QQTYSTPLT | |
| iPS:393928 | 21-225_4E10 | NA | SEQ ID NO:868 CGGGCAAGTCAGGGCATTAGAAATGATTTAGGC | SEQ ID NO:8880 GCTGCATCCAGTTTGCAAAGT | SEQ ID NO:16892 TTACAGCATGATAATTACCCTCTCACT | |
| | | AA | SEQ ID NO:869 RASQGIRNDLG | SEQ ID NO:8881 AASSLQS | SEQ ID NO:16893 LQHDNYPLT | |
| iPS:393930 | 21-225_7E11 | NA | SEQ ID NO:870 CGGGCAAGTCAAAACATTTACAGCTATTTAAAT | SEQ ID NO:8882 ACTGCATCCAGTTTGCAAAGT | SEQ ID NO:16894 CAACAGACTTACAGTACCCCGCTCACT | |
| | | AA | SEQ ID NO:871 RASQNHSYLN | SEQ ID NO:8883 TASSLQS | SEQ ID NO:16895 QQTYSTPLT | |
| iPS:393932 | 21-225_10F5 | NA | SEQ ID NO:872 CGGGCAAGTCAGAACATTTACAGGTATTTAAAT | SEQ ID NO:8884 ACTGCATCCAGTTTGCAAAGT | SEQ ID NO:16896 CAACAGAGTTACAGTCCCCCTCTCACT | |
| | | AA | SEQ ID NO:873 RASQNIYRYLN | SEQ ID NO:8885 TASSLQS | SEQ ID NO:16897 QQSYSPPLT | |

FIGURE 49
(Continued)

| | | | | | | |
|---|---|---|---|---|---|---|
| iPS:393934 | 21-225_13E6 | NA | SEQ ID NO:874 CGGGCAAGTCAGGGCATTAG AAATGATTTAGGC | SEQ ID NO:8886 GCTGCATCCAGTTTGCAA AGT | SEQ ID NO:16898 GTACAGCATAATAGTTACCC GCTCACT |
| | | AA | SEQ ID NO:875 RASQGIRNDLG | SEQ ID NO:8887 AASSLQS | SEQ ID NO:16899 VQHNSYPLT |
| iPS:393936 | 21-225_14A11 | NA | SEQ ID NO:876 CGGGCAAGTCAGAGAGCATTAG CAGTTATTTAAAT | SEQ ID NO:8888 GCTGCATCCAGTTTGCAA AAT | SEQ ID NO:16900 CAACAGACTTACAGTAGCCC TCCATTCACT |
| | | AA | SEQ ID NO:877 RASQSISSYLN | SEQ ID NO:8889 AASSLQN | SEQ ID NO:16901 QQTYSSPPFT |
| iPS:393940 | 21-225_16B2 | NA | SEQ ID NO:878 CGGGCAAGTCAGAGAGCATTAG CGGCTATTTAAAT | SEQ ID NO:8890 GCTGCATCCAGTTTGCAA AGT | SEQ ID NO:16902 CAACAGACTTACAATACCCC TCCGGAGCGCAGT |
| | | AA | SEQ ID NO:879 RASQSISGYLN | SEQ ID NO:8891 AASSLQS | SEQ ID NO:16903 QQTYNTPPERS |
| iPS:393942 | 21-225_11E5 | NA | SEQ ID NO:880 AAGTCCAGCCAGAGTGTTTT ATACAGCTCCAACAATAACA ACTACTTAACT | SEQ ID NO:8892 TGGGCATCTACCCGGA ATCC | SEQ ID NO:16904 CAGCAATATTATAGTACTCC TCCGACG |
| | | AA | SEQ ID NO:881 KSSQSVLYSSNNNNYLT | SEQ ID NO:8893 WASTRES | SEQ ID NO:16905 QQYYSTPPT |
| iPS:393944 | 21-225_14D6 | NA | SEQ ID NO:882 CGGGCAAGTCAGGACATTAG AAATCATTTAGGC | SEQ ID NO:8894 GCTGCATCCAGTTTGCAA AGT | SEQ ID NO:16906 CTACAGTATAATAGTTACCC ATTCACT |
| | | AA | SEQ ID NO:883 RASQDIRNHLG | SEQ ID NO:8895 AASSLQS | SEQ ID NO:16907 LQYNSYPFT |
| iPS:393946 | 21-225_16A4 | NA | SEQ ID NO:884 CGGGCGAGTCAGGACATTAG TAATTATTTAGCC | SEQ ID NO:8896 GCTGCATCCAGTTTGCAA AGT | SEQ ID NO:16908 CAACAGTATCATAGTTACCC GTGGACG |
| | | | SEQ ID NO:885 | SEQ ID NO:8897 | SEQ ID NO:16909 |

FIGURE 49
(Continued)

| | | | | | |
|---|---|---|---|---|---|
| iPS:393948 | | AA | RASQDISNYLA<br>SEQ ID NO:886 | AASSLQS<br>SEQ ID NO:8898 | QQYHSYPWT<br>SEQ ID NO:16910 |
| | 21-225_16A5 | NA | CGGGCAAGTCAGGGCATTAG<br>AAATGATTTAGGC<br>SEQ ID NO:887 | GCTGCATCCAGTTTGCAA<br>AGT<br>SEQ ID NO:8899 | CTACAGCATAATAGTTACCC<br>GTGGACG<br>SEQ ID NO:16911 |
| iPS:393950 | | AA | RASQGIRNDLG<br>SEQ ID NO:888 | AASSLQS<br>SEQ ID NO:8900 | LQHNSYPWT<br>SEQ ID NO:16912 |
| | 21-225_3H10 | NA | TCTGGAGATAAATTGGGGGA<br>AAAATATGCTTGC<br>SEQ ID NO:889 | CAAGATAGGAAGCGGCC<br>CTCA<br>SEQ ID NO:8901 | CAGGCGTGGGTCAACAACAC<br>TATGATA<br>SEQ ID NO:16913 |
| iPS:393952 | | AA | SGDKLGEKYAC<br>SEQ ID NO:890 | QDRKRPS<br>SEQ ID NO:8902 | QAWVNNTMI<br>SEQ ID NO:16914 |
| | 21-225_1F1 | NA | CGGGCGAGTCAGGGCATTAA<br>CAATTATTTAGCC<br>SEQ ID NO:891 | GTTGCATCCAGTTTGCAA<br>ACT<br>SEQ ID NO:8903 | CAACAGTATAATAGTTACCC<br>TCTCACT<br>SEQ ID NO:16915 |
| | | AA | RASQGINNYLA<br>SEQ ID NO:892 | VASSLQT<br>SEQ ID NO:8904 | QQYNSYPLT<br>SEQ ID NO:16916 |
| iPS:393954 | | NA | CGGGCGAGTCAGGGTATTAG<br>CAGGTGGTTAGCC<br>SEQ ID NO:893 | GGTGCATCCAGTTTGCA<br>AAGT<br>SEQ ID NO:8905 | CAACAGGCTAACAGTTCCC<br>ATTCACT<br>SEQ ID NO:16917 |
| | 21-225_4H6 | AA | RASQGISRWLA<br>SEQ ID NO:894 | GASSLQS<br>SEQ ID NO:8906 | QQANSFPFT<br>SEQ ID NO:16918 |
| iPS:393956 | | NA | CGGGCAAGTCAGAGCATTAG<br>CGACTATTTAAAT<br>SEQ ID NO:895 | GATACAACCAGTTTGCA<br>AAGT<br>SEQ ID NO:8907 | CAACAGACTTACAATACCCC<br>TCCGGAGCGCAGT<br>SEQ ID NO:16919 |
| | 21-225_4D7 | AA | RASQSISDYLN<br>SEQ ID NO:896 | DTTSLQS<br>SEQ ID NO:8908 | QQTYNTPPERS<br>SEQ ID NO:16920 |
| iPS:393958 | | NA | CGGGCAAGTCAGGGCATTAG<br>AAATGATTTAGGC<br>SEQ ID NO:897 | GCTGCATCCAGTTTGCAA<br>AGT<br>SEQ ID NO:8909 | CTACAGCATAATAGTTACCC<br>TCTCACT<br>SEQ ID NO:16921 |
| | 21-225_5H2 | | | | |

FIGURE 49
(Continued)

| | | | RASQGIRNDLG | AASSLQS | LQHNSYPLT |
|---|---|---|---|---|---|
| | | AA | SEQ ID NO:898 | SEQ ID NO:8910 | SEQ ID NO:16922 |
| iPS:393960 | 21-225_7G2 | NA | CGGGCAAGTCAGGGCATTAG AAATGATTTAGGC SEQ ID NO:899 | ACTGCATCCAGTTTGCAA AGT SEQ ID NO:8911 | CTACAACATAATAGTTACCC GTGGACG SEQ ID NO:16923 |
| | | AA | RASQGIRNDLG SEQ ID NO:900 | TASSLQS SEQ ID NO:8912 | LQHNSYPWT SEQ ID NO:16924 |
| iPS:393962 | 21-225_7H7 | NA | CGGGCGAGTCAGGGCATTAG AAATGATTTAGGC SEQ ID NO:901 | GCTGCATCCAGTTTGCAA AGT SEQ ID NO:8913 | CTACAGCATAGTAGTTACCC GTTCACT SEQ ID NO:16925 |
| | | AA | RASQGIRNDLG SEQ ID NO:902 | AASSLQS SEQ ID NO:8914 | LQHSSYPFT SEQ ID NO:16926 |
| iPS:393964 | 21-225_6G1 | NA | CGGACAAGTCAGAGAACATTAT CAGCTATTTAAAT SEQ ID NO:903 | ACTGCATCCAATTGCAA ACT SEQ ID NO:8915 | CAACAGCCTCACAGTCCCCC GCTCACT SEQ ID NO:16927 |
| | | AA | RTSQNHSYLN SEQ ID NO:904 | TASNLQT SEQ ID NO:8916 | QQPHSPPLT SEQ ID NO:16928 |
| iPS:393966 | 21-225_7F8 | NA | CGGGCAAGTCAGGGCATTGG AAATGATTTAGGC SEQ ID NO:905 | GCTGCATCCAGTTTGCAA AGT SEQ ID NO:8917 | CTACAACATTATACTTACCC TCGGACG SEQ ID NO:16929 |
| | | AA | RASQGIGNDLG SEQ ID NO:906 | AASSLQS SEQ ID NO:8918 | LQHYTYPRT SEQ ID NO:16930 |
| iPS:393968 | 21-225_5A5 | NA | CGGGCGAGTCAGGGCATTAG CAATTATTTAGCC SEQ ID NO:907 | GCTGCATCCAGTTTGCAA AGT SEQ ID NO:8919 | CAACAGTATAATAGTTACCC ATTCACT SEQ ID NO:16931 |
| | | AA | RASQGISNYLA SEQ ID NO:908 | AASSLQS SEQ ID NO:8920 | QQYNSYPFT SEQ ID NO:16932 |
| iPS:393972 | 21-225_7C9 | NA | CGGGCAAGTCAGGGCATTAG AAACGATTTAGGC SEQ ID NO:909 | GCTGCATCCAGTTTGCAA AGT SEQ ID NO:8921 | CTACAGCTTTATAGTTACCCT CGGACG SEQ ID NO:16933 |

FIGURE 49
(Continued)

| | | | | | |
|---|---|---|---|---|---|
| iPS:393974 | | AA | RASQGIRNDLG<br>SEQ ID NO:910 | AASSLQS<br>SEQ ID NO:8922 | LQLYSYPRT<br>SEQ ID NO:16934 |
| | 21-225_7C4 | NA | CGGGCAAGTCAGGGCATTAG<br>AAATGATTTAGGC<br>SEQ ID NO:911 | GCTGCATCCAGTTTGCAA<br>AGT<br>SEQ ID NO:8923 | CTACAGCATAATAGTTACCC<br>GCTCACT<br>SEQ ID NO:16935 |
| iPS:393976 | | AA | RASQGIRNDLG<br>SEQ ID NO:912 | AASSLQS<br>SEQ ID NO:8924 | LQHNSYPLT<br>SEQ ID NO:16936 |
| | 21-225_7E9 | NA | CGGACAAGTCAGGGCATTAG<br>AAATGATTTAGGC<br>SEQ ID NO:913 | ACTGCATCCAGTTTGCAA<br>AGT<br>SEQ ID NO:8925 | CTACAGGCATAATAGTTACCC<br>GCTCACT<br>SEQ ID NO:16937 |
| iPS:393978 | | AA | RASQGIRNDLG<br>SEQ ID NO:914 | TASSLQS<br>SEQ ID NO:8926 | LQHNSYPLT<br>SEQ ID NO:16938 |
| | 21-225_4C12 | NA | CGGGCAAGTCAGGGCATTAG<br>AAATGATTTAGGC<br>SEQ ID NO:915 | GCTGCATCCAGTTTGCAC<br>AGT<br>SEQ ID NO:8927 | CTACAACATTATAGTTTCCCT<br>CGGACG<br>SEQ ID NO:16939 |
| | | AA | RASQGIRNDLG<br>SEQ ID NO:916 | AASSLHS<br>SEQ ID NO:8928 | LQHYSFPRT<br>SEQ ID NO:16940 |
| iPS:393980 | 21-225_6D3 | NA | CGGACAAGTCAGAGCATTAG<br>TACTTATTTAAAT<br>SEQ ID NO:917 | GCTGCATCCAGTTTGCAA<br>AGT<br>SEQ ID NO:8929 | CAACAGAGTTACAGAACCCC<br>CTTTTTCACT<br>SEQ ID NO:16941 |
| | | AA | RTSQSISTYLN<br>SEQ ID NO:918 | AASSLQS<br>SEQ ID NO:8930 | QQSYRTPFFT<br>SEQ ID NO:16942 |
| iPS:393982 | 21-225_6C12 | NA | CGGGCAAGTCAGGGCATTAG<br>AAGTAATTTAGGC<br>SEQ ID NO:919 | GCTGCATCCAGTTTGGA<br>AAGT<br>SEQ ID NO:8931 | CTACAGGATAATAGTTATCC<br>GTTCACT<br>SEQ ID NO:16943 |
| | | AA | RASQGIRSNLG<br>SEQ ID NO:920 | AASSLES<br>SEQ ID NO:8932 | LQDNSYPFT<br>SEQ ID NO:16944 |
| iPS:393984 | 21-225_4F12 | NA | CGGACAAGTCAGGGCATTAG<br>AAATGATTTAGGC<br>SEQ ID NO:921 | GCTGCATCCAGTTTGCAA<br>AGT<br>SEQ ID NO:8933 | CTACAGCATAATAGTTACGC<br>GCTCACT<br>SEQ ID NO:16945 |

FIGURE 49
(Continued)

| | | | | | | |
|---|---|---|---|---|---|---|
| | | AA | RASQGIRNDLG | AASSLQS | | LQHNSYALT |
| iPS:393986 | | | SEQ ID NO:922 | SEQ ID NO:8934 | | SEQ ID NO:16946 |
| | 21-225_7G4 | NA | CGGGCAAGTCAGGGCATTAG AAATGATTTAGGC | GCTGCATCCAGTTTGCAA AGT | | CTACATCAATATAGTTACCC TCGGACG |
| | | | SEQ ID NO:923 | SEQ ID NO:8935 | | SEQ ID NO:16947 |
| iPS:393988 | | AA | RASQGIRNDLG | AASSLQS | | LHQYSYPRT |
| | | | SEQ ID NO:924 | SEQ ID NO:8936 | | SEQ ID NO:16948 |
| | 21-225_7F10 | NA | CGGGCGAGTCAGGACATTAG GAATTATTTAGCC | GTTGCATCCAGTTTGCAA AGT | | CAACAGTATAATAGTTACCC TCTCACT |
| | | | SEQ ID NO:925 | SEQ ID NO:8937 | | SEQ ID NO:16949 |
| iPS:393990 | | AA | RASQDIRNYLA | VASSLQS | | QQYNSYPLT |
| | | | SEQ ID NO:926 | SEQ ID NO:8938 | | SEQ ID NO:16950 |
| | 21-225_11G7 | NA | CGGGCAAGTCAGGGCATTAG AAATGATTTAGGC | GCTGCATCCAGTTTGCAA AGT | | CTACAGCATAGTAATTACCC TCTCACT |
| | | | SEQ ID NO:927 | SEQ ID NO:8939 | | SEQ ID NO:16951 |
| iPS:393992 | | AA | RASQGIRNDLG | AASSLQS | | LQHSNYPLT |
| | | | SEQ ID NO:928 | SEQ ID NO:8940 | | SEQ ID NO:16952 |
| | 21-225_14H8 | NA | CGGGCGAGTCAGGGCATTAG CTATTATTTAGCC | GTTGCATCCAGTTTGCAA AGT | | CAACAGTATAATAGTTACCC ATTCACT |
| | | | SEQ ID NO:929 | SEQ ID NO:8941 | | SEQ ID NO:16953 |
| iPS:393994 | | AA | RASQGISYYLA | VASSLQS | | QQYNSYPFT |
| | | | SEQ ID NO:930 | SEQ ID NO:8942 | | SEQ ID NO:16954 |
| | 21-225_8C9 | NA | CGGGCAAGTCAGGGCATTAG AAATGATTTAGAC | GCTGCATCCAGTTTGCAA AGT | | CTACAGCATAATAGTTATCC GCTCACT |
| | | | SEQ ID NO:931 | SEQ ID NO:8943 | | SEQ ID NO:16955 |
| iPS:393996 | | AA | RASQAIRNDLD | AASSLQS | | LQHNSYPLT |
| | | | SEQ ID NO:932 | SEQ ID NO:8944 | | SEQ ID NO:16956 |
| | 21-225_15C11 | NA | CGGGCAAGTCAGGGCATTAG AAATGATTTAGGC | GCTGCATCCAGTTTGCAA AGT | | CTACTGCATTATAGTTACCCT CGGACG |
| | | | SEQ ID NO:933 | SEQ ID NO:8945 | | SEQ ID NO:16957 |

FIGURE 49
(Continued)

| | | | RASQGIRNDLG | AASSLQS | LLHYSYPRT |
|---|---|---|---|---|---|
| | | AA | SEQ ID NO:934 | SEQ ID NO:8946 | SEQ ID NO:16958 |
| iPS:393998 | 21-225_12B12 | NA | CGGGCAAGTCAGGGCATTAGAAATGATTTAGGC | ACTGCATCCAGTTTGCAAAGT | CTACAACATAATAGTTACCCGTGGACG |
| | | | SEQ ID NO:935 | SEQ ID NO:8947 | SEQ ID NO:16959 |
| | | AA | RASQGIRNDLG | TASSLQS | LQHNSYPWT |
| | | | SEQ ID NO:936 | SEQ ID NO:8948 | SEQ ID NO:16960 |
| iPS:394000 | 21-225_11A2 | NA | CAGGCGAGTCAGGACATTAGCAACTATTTAAAT | GATGCATCCAATTTGGAAACA | CAACAGTATGATAATCTCCCGATCACC |
| | | | SEQ ID NO:937 | SEQ ID NO:8949 | SEQ ID NO:16961 |
| | | AA | QASQDISNYLN | DASNLET | QQYDNLPIT |
| | | | SEQ ID NO:938 | SEQ ID NO:8950 | SEQ ID NO:16962 |
| iPS:394002 | 21-225_15G7 | NA | CGGGCAAGTCAGGGCATTAGAAATGATTTAGGC | GCTGCATCCAGTTTGCAAAGT | CTACAGCATAGTAATTACCCTCTCACT |
| | | | SEQ ID NO:939 | SEQ ID NO:8951 | SEQ ID NO:16963 |
| | | AA | RASQGIRNDLG | AASSLQS | LQHSNYPLT |
| | | | SEQ ID NO:940 | SEQ ID NO:8952 | SEQ ID NO:16964 |
| iPS:394004 | 21-225_13A1 | NA | CAGGCGAGTCAGGACATTAACAACTATTTAAAT | GATGGATCCAATTTGGAAACA | CAACAGTATGAAAATCTCCCGATCACT |
| | | | SEQ ID NO:941 | SEQ ID NO:8953 | SEQ ID NO:16965 |
| | | AA | QASQDINNYLN | DGSNLET | QQYENLPIT |
| | | | SEQ ID NO:942 | SEQ ID NO:8954 | SEQ ID NO:16966 |
| iPS:394006 | 21-225_15C2 | NA | CAGGCGAGTCAGGACATTACCAACTATTTAAAT | GATGCATCCAATTTGGAAACA | CAACAGTATGATAATCTCCCGATCACC |
| | | | SEQ ID NO:943 | SEQ ID NO:8955 | SEQ ID NO:16967 |
| | | AA | QASQDITNYLN | DASNLET | QQYDNLPIT |
| | | | SEQ ID NO:944 | SEQ ID NO:8956 | SEQ ID NO:16968 |
| iPS:394008 | 21-225_15H8 | NA | CGGGCAAGTCAGGGCATTAGAAATGATTTAGGC | GCTGCATCCAGTTTGCAAAGT | CTACAGCATAATAGTTACCCGCTCACT |
| | | | SEQ ID NO:945 | SEQ ID NO:8957 | SEQ ID NO:16969 |

FIGURE 49
(Continued)

| | | | RASQGIRNDLG | AASSLQS | LQHNSYPLT |
|---|---|---|---|---|---|
| | | AA | SEQ ID NO:946 | SEQ ID NO:8958 | SEQ ID NO:16970 |
| iPS:394010 | 21-225_12G5 | NA | CGGGGCAAGTCAGGGACATTAG CAATTATTTAGCC | GCTGCATACATTTTGCAA TCA | CAAAAGTATGACAGTGCCCC ATTCACT |
| | | | SEQ ID NO:947 | SEQ ID NO:8959 | SEQ ID NO:16971 |
| | | AA | RASQDISNYLA | AAYILQS | QKYDSAPFT |
| | | | SEQ ID NO:948 | SEQ ID NO:8960 | SEQ ID NO:16972 |
| iPS:394012 | 21-225_15A3 | NA | CGGGCAAGTCAGAGCATTAT CAGCTATTTAAAT | ACTGCATCCAGTTGCAA AGT | CAACAGACTTACAGTACCCC GCTCACT |
| | | | SEQ ID NO:949 | SEQ ID NO:8961 | SEQ ID NO:16973 |
| | | AA | RASQSISYLN | TASSLQS | QQTYSTPLT |
| | | | SEQ ID NO:950 | SEQ ID NO:8962 | SEQ ID NO:16974 |
| iPS:394014 | 21-225_8G6 | NA | CGGGCAAGTCAGAGCATTAG TAGTTATTTAAAT | GCTGCATCCAGTTTGCAA AGT | CAACAGAGTTACAGAACCCC CTTTTTCACT |
| | | | SEQ ID NO:951 | SEQ ID NO:8963 | SEQ ID NO:16975 |
| | | AA | RASQSISSYLN | AASSLQS | QQSYRTPFFT |
| | | | SEQ ID NO:952 | SEQ ID NO:8964 | SEQ ID NO:16976 |
| iPS:394016 | 21-225_13D4 | NA | CGGGCAAGTCAGAGCATTTT CAGCTACTTAAAT | ACTGCATCCAGTTTGCAA AAT | CAACAGACTTACAGTCTTCC GCTCACT |
| | | | SEQ ID NO:953 | SEQ ID NO:8965 | SEQ ID NO:16977 |
| | | AA | RASQSIFSYLN | TASSLQN | QQTYSLPLT |
| | | | SEQ ID NO:954 | SEQ ID NO:8966 | SEQ ID NO:16978 |
| iPS:394018 | 21-225_15B1 | NA | CGGGGCAAGTCAGGGCATTAG CAATTATTTAGCC | GCTGCATCCAGTTTGCAA AGT | CAACAGTATCATAGTTACCC ATTCACT |
| | | | SEQ ID NO:955 | SEQ ID NO:8967 | SEQ ID NO:16979 |
| | | AA | RASQGISNYLA | AASSLQS | QQYHSYPFT |
| | | | SEQ ID NO:956 | SEQ ID NO:8968 | SEQ ID NO:16980 |
| iPS:394020 | 21-225_15H10 | NA | CGGGCAAGTCAGGGCATTAG AAATGATTTAGGC | GCTGCATCCAGTTTGCAA AGT | CTACAGCATAATAGTTACCC GCTCACT |
| | | | SEQ ID NO:957 | SEQ ID NO:8969 | SEQ ID NO:16981 |

FIGURE 49
(Continued)

| | | | | | | |
|---|---|---|---|---|---|---|
| iPS:394022 | 21-225_16H6 | AA | RASQGIRNDLG SEQ ID NO:958 | AASSLQS SEQ ID NO:8970 | LQHNSYPLT SEQ ID NO:16982 | |
| | | NA | CGGGCAAGTCAGAACATTAG CAGCTATTTAAAT SEQ ID NO:959 | GCTGCATCCAGTTTGCAA AGT SEQ ID NO:8971 | CAACAGAGTTACAGAACCCC CTTATTCACT SEQ ID NO:16983 | |
| iPS:394024 | 21-225_16B7 | AA | RASQNISSYLN SEQ ID NO:960 | AASSLQS SEQ ID NO:8972 | QQSYRTPLFT SEQ ID NO:16984 | |
| | | NA | CGGGCAAGTCAGGGCATTAG AAATGATTTAGGC SEQ ID NO:961 | GCTGCATCCAGTTTGCAA AGT SEQ ID NO:8973 | CTACAGCATAATAGTTACCC GCTCACT SEQ ID NO:16985 | |
| iPS:394026 | 21-225_16C7 | AA | RASQGIRNDLG SEQ ID NO:962 | AASSLQS SEQ ID NO:8974 | LQHNSYPLT SEQ ID NO:16986 | |
| | | NA | CGGGCGAGTCAGGGCATTAG CAATTATTTAGCC SEQ ID NO:963 | GCTGCATCCAGTTTGCAA AGT SEQ ID NO:8975 | CAACAGTATAATAGTTACCC ATTCACT SEQ ID NO:16987 | |
| iPS:394029 | 21-225_1B12 | AA | RASQGISNYLA SEQ ID NO:964 | AASSLQS SEQ ID NO:8976 | QQYNSYPFT SEQ ID NO:16988 | |
| | | NA | CAGGCGAGTCAGGACATTAA CAACTATTTAAAT SEQ ID NO:965 | GATGCATCCAAATTTGGA AACA SEQ ID NO:8977 | CAACAGTATGAAAATCTCCC GATCACC SEQ ID NO:16989 | |
| iPS:394033 | 21-225_5F4 | AA | QASQDINNYLN SEQ ID NO:966 | DASNLET SEQ ID NO:8978 | QQYENLPIT SEQ ID NO:16990 | |
| | | NA | CGGGCAAGTCAGGGCATTCG AAATCATTTAGGC SEQ ID NO:967 | GCTGCCTCCAGTTTGCAA AGT SEQ ID NO:8979 | CTACAGTATAATGGTTACCC ATTCACT SEQ ID NO:16991 | |
| iPS:394035 | 21-225_5G9 | AA | RASQGIRNHLG SEQ ID NO:968 | AASSLQS SEQ ID NO:8980 | LQYNGYPFT SEQ ID NO:16992 | |
| | | NA | CAGGCGAGTCAGGGCATTAG CAACTCTTTAAAT SEQ ID NO:969 | GATGCATCCAATTTGGA AACA SEQ ID NO:8981 | CAACAATATGATAATCTCCC GCTCACT SEQ ID NO:16993 | |

FIGURE 49
(Continued)

| | | AA | QASQGISNSLN | | DASNLET | | QQYDNLPLT | |
|---|---|---|---|---|---|---|---|---|
| iPS:394037 | | | SEQ ID NO:970 | | SEQ ID NO:8982 | | SEQ ID NO:16994 | |
| | 21-225_4F4 | NA | CGGGCAAGTCAGGGCATTAG AAATGATTTAGGC | | GCTGCGTCCAGTGTGCA AACT | | CTACAGCATAATAGTTACCC GCTCACT | |
| | | | SEQ ID NO:971 | | SEQ ID NO:8983 | | SEQ ID NO:16995 | |
| | | AA | RASQGIRNDLG | | AASSVQT | | LQHNSYPLT | |
| iPS:394041 | | | SEQ ID NO:972 | | SEQ ID NO:8984 | | SEQ ID NO:16996 | |
| | 21-225_5E5 | NA | CGGGCAAGTCAGGGCATTAG AAATGATTTAGGC | | GCTGCATCCAGTTTGCAA AGT | | CTACAGCATTATAGTTACCC TCGGACG | |
| | | | SEQ ID NO:973 | | SEQ ID NO:8985 | | SEQ ID NO:16997 | |
| | | AA | RASQGIRNDLG | | AASSLQS | | LQHYSYPRT | |
| iPS:394043 | | | SEQ ID NO:974 | | SEQ ID NO:8986 | | SEQ ID NO:16998 | |
| | 21-225_3B1 | NA | CGGGCAAGTCAGAGTATTAA TAATTATTTAAAT | | GCTACATCCAGTTTGCAA AAT | | CAACAGAGTTACAGTACCCC CTTATTCACT | |
| | | | SEQ ID NO:975 | | SEQ ID NO:8987 | | SEQ ID NO:16999 | |
| | | AA | RASQSINNYLN | | ATSSLQN | | QQSYSTPLFT | |
| iPS:394045 | | | SEQ ID NO:976 | | SEQ ID NO:8988 | | SEQ ID NO:17000 | |
| | 21-225_4H4 | NA | CGGGCAAGTCAGGGCATTAG AAATGATTTAGGC | | GCTGCATCCAGTGTGCA AAGT | | CTACAGCATAATAGTTACCC GCTCACT | |
| | | | SEQ ID NO:977 | | SEQ ID NO:8989 | | SEQ ID NO:17001 | |
| | | AA | RASQGIRNDLG | | AASSVQS | | LQHNSYPLT | |
| iPS:394047 | | | SEQ ID NO:978 | | SEQ ID NO:8990 | | SEQ ID NO:17002 | |
| | 21-225_5E6 | NA | CAGGGCGAGTCAGGACATTAA CAACTATTTAAAT | | GATGCATCCAATTTGGA AACA | | CAACAGTATGATAATCTCCC GATCACC | |
| | | | SEQ ID NO:979 | | SEQ ID NO:8991 | | SEQ ID NO:17003 | |
| | | AA | QASQDINNYLN | | DASNLET | | QQYDNLPIT | |
| iPS:394049 | | | SEQ ID NO:980 | | SEQ ID NO:8992 | | SEQ ID NO:17004 | |
| | 21-225_13H5 | NA | CGGGCAAGTCAGGGCATTAG AAATGATTTAGGC | | GCTGCATCCAGTTTGCAA ACT | | CTACAGCATAATAGTTACCC TCTCACT | |
| | | | SEQ ID NO:981 | | SEQ ID NO:8993 | | SEQ ID NO:17005 | |

FIGURE 49
(Continued)

| | | | | | | | |
|---|---|---|---|---|---|---|---|
| iPS:394051 | | AA | RASQGIRNDLG<br>SEQ ID NO:982 | | AASSLQT<br>SEQ ID NO:8994 | | LQHNSYPLT<br>SEQ ID NO:17006 |
| | 21-225_9E5 | NA | CGGGCAAGTCAGAGCATTGC<br>CAGTTATTTAAAT<br>SEQ ID NO:983 | | GGTGCATCCAGTTTGCA<br>AAGT<br>SEQ ID NO:8995 | | CAACAGAGTTACAGTACCCC<br>CTTATTCAGT<br>SEQ ID NO:17007 |
| iPS:394053 | | AA | RASQSIASYLN<br>SEQ ID NO:984 | | GASSLQS<br>SEQ ID NO:8996 | | QQSYSTPLFS<br>SEQ ID NO:17008 |
| | 21-225_11F10 | NA | CGGGCAAGTCAGGGCATTAG<br>AAATGATTTAGGC<br>SEQ ID NO:985 | | GCTGCATCCAGTTTACAA<br>AGT<br>SEQ ID NO:8997 | | CTACAGCATAGTAGTTACCC<br>TCTCACT<br>SEQ ID NO:17009 |
| iPS:394055 | | AA | RASQGIRNDLG<br>SEQ ID NO:986 | | AASSLQS<br>SEQ ID NO:8998 | | LQHSSYPLT<br>SEQ ID NO:17010 |
| | 21-225_9C8 | NA | CGGGCGAGTCAGGGCATTAG<br>CTATTATTTAGCC<br>SEQ ID NO:987 | | GTTGCATCCAGTTTGCAA<br>AGT<br>SEQ ID NO:8999 | | CAACAGTATGATAGTTACCC<br>ATTCACT<br>SEQ ID NO:17011 |
| iPS:394057 | | AA | RASQGISYYLA<br>SEQ ID NO:988 | | VASSLQS<br>SEQ ID NO:9000 | | QQYDSYPFT<br>SEQ ID NO:17012 |
| | 21-225_15H1 | NA | CGGGCAAGTCAGGGCATTAG<br>AAATGATTTAGGC<br>SEQ ID NO:989 | | ACTGCATCCAGTTTGCAA<br>AGT<br>SEQ ID NO:9001 | | CTACAGCATAGTAGTTACCC<br>GCTCACT<br>SEQ ID NO:17013 |
| iPS:394059 | | AA | RASQGIRNDLG<br>SEQ ID NO:990 | | TASSLQS<br>SEQ ID NO:9002 | | LQHSSYPLT<br>SEQ ID NO:17014 |
| | 21-225_9E8 | NA | CGGGCAAGTCAGGGCATTAG<br>AAATGATTTAGGC<br>SEQ ID NO:991 | | GCTGCATCCAGTTTGCAA<br>AGT<br>SEQ ID NO:9003 | | CTACAGCATAATAGTTACCC<br>GCTCACT<br>SEQ ID NO:17015 |
| iPS:394061 | | AA | RASQGIRNDLG<br>SEQ ID NO:992 | | AASSLQS<br>SEQ ID NO:9004 | | LQHNSYPLT<br>SEQ ID NO:17016 |
| | 21_225_12D2 | NA | AGGTCTAGTCAGAGCCTCCT<br>CCATAGTAATGGATACAACT<br>ATTTGGAT | | TTGGGTTCTAATCGGGCC<br>TCC | | ATGCAAGCTCTACAAACTCC<br>TATCACC |

FIGURE 49
(Continued)

| | | | SEQ ID NO:993 | SEQ ID NO:9005 | SEQ ID NO:17017 |
|---|---|---|---|---|---|
| iPS:394063 | 21-225_12D2 | AA | RSSQSLLHSNGYNYLD | LGSNRAS | MQALQTPIT |
| | | | SEQ ID NO:994 | SEQ ID NO:9006 | SEQ ID NO:17018 |
| iPS:394065 | 21-225_16A1 | NA | CGGGCAAGTCAGGGCATTAGAAATGATTTAGGC | GCTGCGTCCAGTTTGCAAAGT | CTACACCATAGTAATTACCCTCTCACT |
| | | | SEQ ID NO:995 | SEQ ID NO:9007 | SEQ ID NO:17019 |
| | | AA | RASQGIRNDLG | AASSLQS | LHHSNYPLT |
| | | | SEQ ID NO:996 | SEQ ID NO:9008 | SEQ ID NO:17020 |
| iPS:394067 | 21-225_11E2 | NA | AAGTCCAACCAGAGAGTTTTATCCAGCTCCAACAATCACAACTACTTAGCT | TGGGCATCTCTACCCGGGAATCC | CAGCAATATTTTAGTACTCCATTCACT |
| | | | SEQ ID NO:997 | SEQ ID NO:9009 | SEQ ID NO:17021 |
| | | AA | KSNQRVLSSSNNHNYLA | WASTRES | QQYFSTPFT |
| | | | SEQ ID NO:998 | SEQ ID NO:9010 | SEQ ID NO:17022 |
| iPS:394069 | 21-225_12F2 | NA | CGGGCAAGTCAGGGCATTAGAAATGATTTAGGC | GCTGCATCCAGTTTGCAAAGT | CTACAGCATAATAGTTATCCGTGGACG |
| | | | SEQ ID NO:999 | SEQ ID NO:9011 | SEQ ID NO:17023 |
| | | AA | RASQGIRNDLG | AASSLQS | LQHNSYPWT |
| | | | SEQ ID NO:1000 | SEQ ID NO:9012 | SEQ ID NO:17024 |
| iPS:394069 | 21-225_16H1 | NA | CGGGCAAGTCAGGGCATTAGAGATATTTTAGGC | GCTGCATCCAGTTTGCAAAAT | CTACAGTATCATAGTTACCCATTCACT |
| | | | SEQ ID NO:1001 | SEQ ID NO:9013 | SEQ ID NO:17025 |
| | | AA | RASQGIRDILG | AASSLQN | LQYHSYPFT |
| | | | SEQ ID NO:1002 | SEQ ID NO:9014 | SEQ ID NO:17026 |
| iPS:394071 | 21-225_10C7 | NA | AGGTCTAGTCAGAGCCTCCTGCATAGTAAGGGATACAACTATTTGGAT | TTGGGTTCTAATCGGGCCTCC | ATGCAAGCTCTACAAACTCCTCTCACC |
| | | | SEQ ID NO:1003 | SEQ ID NO:9015 | SEQ ID NO:17027 |
| | | AA | RSSQSLLHSKGYNYLD | LGSNRAS | MQALQTPLT |
| | | | SEQ ID NO:1004 | SEQ ID NO:9016 | SEQ ID NO:17028 |

FIGURE 49
(Continued)

| | | | | | |
|---|---|---|---|---|---|
| iPS:394073 | 21-225_15C9 | NA | CGGGCAAGTCAGGGCATTAG AAATGATTTAGGC SEQ ID NO:1005 | GCTGCATCCAGTTTGCAA AGT SEQ ID NO:9017 | CTACAACATACTAGTTACCC GCTCACT SEQ ID NO:17029 |
| | | AA | RASQGIRNDLG SEQ ID NO:1006 | AASSLQS SEQ ID NO:9018 | LQHTSYPLT SEQ ID NO:17030 |
| iPS:394075 | 21-225_8D12 | NA | CGGGCAAGTCAGGGCATTAG AAATGATTTAGGC SEQ ID NO:1007 | GCTGCATCCAGTTTGCAA AGT SEQ ID NO:9019 | CTACAGGCATAGTAGTTACCC GCTCACT SEQ ID NO:17031 |
| | | AA | RASQGIRNDLG SEQ ID NO:1008 | AASSLQS SEQ ID NO:9020 | LQHSSYPLT SEQ ID NO:17032 |
| iPS:394077 | 21-225_8E12 | NA | CGGGCAAGTCAGAGCATTAG TAATTATTTAAAT SEQ ID NO:1009 | GCTGCATCCAGTTTACAA AGT SEQ ID NO:9021 | CAACAGAGTTACAGAACCCC CTTTTTCACT SEQ ID NO:17033 |
| | | AA | RASQSISNYLN SEQ ID NO:1010 | AASSLQS SEQ ID NO:9022 | QQSYRTPFFT SEQ ID NO:17034 |
| iPS:394079 | 21-225_11F5 | NA | CGGGCAAGTCAGGGCATTAG AAATGATTTAGGC SEQ ID NO:1011 | GCTGCATCCAGTGTGCA AAGT SEQ ID NO:9023 | CTACAGCATAATAGTTACCC GCTCACT SEQ ID NO:17035 |
| | | AA | RASQGIRNDLG SEQ ID NO:1012 | AASSVQS SEQ ID NO:9024 | LQHNSYPLT SEQ ID NO:17036 |
| iPS:394081 | 21-225_16B3 | NA | CAGGCGAGTCAGGACATTAA CAACTATTTAAAT SEQ ID NO:1013 | GATGCATCCAATTTGGA AACA SEQ ID NO:9025 | CAACAGTTTGATAATCTCCC GATCACC SEQ ID NO:17037 |
| | | AA | QASQDINNYLN SEQ ID NO:1014 | DASNLET SEQ ID NO:9026 | QQFDNLPIT SEQ ID NO:17038 |
| iPS:394083 | 21-225_16E6 | NA | CGGGCAAGTCAGAGCATTAT CAGCTATTTAAAT SEQ ID NO:1015 | ACTACATCCAGTTTGCAA AGT SEQ ID NO:9027 | CAGCAGACTTACAGTACCCC GCTCACT SEQ ID NO:17039 |
| | | AA | RASQSISYLN SEQ ID NO:1016 | TTSSLQS SEQ ID NO:9028 | QQTYSTPLT SEQ ID NO:17040 |

FIGURE 49
(Continued)

| | | | | | |
|---|---|---|---|---|---|
| iPS:394085 | 21-225_8B11 | NA | AAGTCCAGCCAGAATGTTTT ATACAACTCCAACAATAACA ACTACTTAGCT SEQ ID NO:1017 | TGGGCATCTACCCGGAA ATCC SEQ ID NO:9029 | CAGCAATATATACTACTCC GTGCAGT SEQ ID NO:17041 |
| | | AA | KSSQNVLYNSNNNNYLA SEQ ID NO:1018 | WASTRKS SEQ ID NO:9030 | QQYYTTPCS SEQ ID NO:17042 |
| iPS:394087 | 21-225_11A5 | NA | CGGGCAAGTCAGAACATTTA TAGTTATTTAAAT SEQ ID NO:1019 | GCTGCATCCAGTTGCAA AGT SEQ ID NO:9031 | CAACAGAGTTACAATACCCC CTTATTCACT SEQ ID NO:17043 |
| | | AA | RASQNIYSYLN SEQ ID NO:1020 | AASSLQS SEQ ID NO:9032 | QQSYNTPLFT SEQ ID NO:17044 |
| iPS:394089 | 21-225_12E6 | NA | CGGGCAAGTCAGGGCATTAG AAGTGATTTAGGC SEQ ID NO:1021 | GCTGCATCCAGTTGCAA AGT SEQ ID NO:9033 | CTACAGCATAATAGTTACCC GTGGACG SEQ ID NO:17045 |
| | | AA | RASQGIRSDLG SEQ ID NO:1022 | AASSLQS SEQ ID NO:9034 | LQHNSYPWT SEQ ID NO:17046 |
| iPS:394091 | 21-225_13H3 | NA | CGGGCAAGTCAGGGCATTAG AAATGATTTAGGC SEQ ID NO:1023 | GCTGCATCCAGTTACAA AGT SEQ ID NO:9035 | CTACAGCATAATAGTTACCC GCTCACT SEQ ID NO:17047 |
| | | AA | RASQGIRNDLG SEQ ID NO:1024 | AASSLQS SEQ ID NO:9036 | LQHNSYPLT SEQ ID NO:17048 |
| iPS:394093 | 21-225_9D12 | NA | CGGGCAAGTCAGGGCATTAG AAATGATTTAGGC SEQ ID NO:1025 | GCTGCATCCAGTTGCAA AGT SEQ ID NO:9037 | CTACAGCATAATAGTTACCC GTGGACG SEQ ID NO:17049 |
| | | AA | RASQGIRNDLG SEQ ID NO:1026 | AASSLQS SEQ ID NO:9038 | LQHNSYPWT SEQ ID NO:17050 |
| iPS:394095 | 21-225_16H4 | NA | CGGGCAAGTCAGGGCATTAG AAATGATTTAGGC SEQ ID NO:1027 | ACTGCATCCAGTTGCAA AGT SEQ ID NO:9039 | CTACAGCATAATAGTTACCC GTGGACG SEQ ID NO:17051 |
| | | AA | RASQGIRNDLG | TASSLQS | LQHNSYPWT |

FIGURE 49
(Continued)

| | | | | | | |
|---|---|---|---|---|---|---|
| iPS:394097 | 21-225_16G7 | NA | SEQ ID NO:1028 CGGGCAAGTCAGGGCATTAG AAATGATTTAGGC | SEQ ID NO:9040 GCTGCATCCAGTTTGCAA AGT | SEQ ID NO:17052 CTACAACATAATAGTTACCC GTGGACG |
| | | AA | SEQ ID NO:1029 RASQGIRNDLG | SEQ ID NO:9041 AASSLQS | SEQ ID NO:17053 LQHNSYPWT |
| iPS:398470 | 21-225_14B7 | NA | SEQ ID NO:1030 TCTGGAGATAAATTGGGGAA TAAATATGCTTAC | SEQ ID NO:9042 CAAGATAGAAAGCGGCC CTCA | SEQ ID NO:17054 CAGGCGTGGAACAACAGCAC TGTGGTA |
| | | AA | SEQ ID NO:1031 SGDKLGNKYAY | SEQ ID NO:9043 QDRKRPS | SEQ ID NO:17055 QAWNNSTVV |
| iPS:398472 | 21-225_16E4 | NA | SEQ ID NO:1032 TCTGGAGATAAATTGGGGGA TAAATATGTTTAC | SEQ ID NO:9044 CAAGATAGCAAGCGGCC CTCA | SEQ ID NO:17056 CAGGCGTGGGACAGCAGCAC TGTGGTT |
| | | AA | SEQ ID NO:1033 SGDKLGDKYVY | SEQ ID NO:9045 QDSKRPS | SEQ ID NO:17057 QAWDSSTVV |
| iPS:398474 | 21-225_17B10 | NA | SEQ ID NO:1034 CGGTCAAGTCAGAGCATTAA CAGCTATTTAAAT | SEQ ID NO:9046 GCTGCATCCAGTTTGCAC AGT | SEQ ID NO:17058 CAACAGGGTTACAATACCCC CACGTGGACG |
| | | AA | SEQ ID NO:1035 RSSQSINSYLN | SEQ ID NO:9047 AASSLHS | SEQ ID NO:17059 QQGYNTPTWT |
| iPS:398476 | 21-225_17C1 | NA | SEQ ID NO:1036 CGGGCAAGTCAGAACATTAA CGACTATTTAAAT | SEQ ID NO:9048 GCTGCATCCAATTTGCAA AGT | SEQ ID NO:17060 CAACAGACTTACAATACCCC TCCGGAGCGCAGT |
| | | AA | SEQ ID NO:1037 RASQNENDYLN | SEQ ID NO:9049 AASNLQS | SEQ ID NO:17061 QQTYNTPPERS |
| iPS:398478 | 21-225_17C10 | NA | SEQ ID NO:1038 CGGGCGAGTCAGGGCATTAG CAATTATTTAGCC | SEQ ID NO:9050 GCTGCATCCACTTTGCAA TCA | SEQ ID NO:17062 CAAAAGTATAACAGTGCCCC TCCGCTCACC |
| | | AA | SEQ ID NO:1039 RASQGISNYLA | SEQ ID NO:9051 AASTLQS | SEQ ID NO:17063 QKYNSAPPLT |

FIGURE 49
(Continued)

| | | SEQ ID NO:1040 | | SEQ ID NO:9052 | | SEQ ID NO:17064 | |
|---|---|---|---|---|---|---|---|
| iPS:398480 | | CGGACAAGTCAGAGAATATTAG CAACTATTAAAT | NA | GTTGCGTCCAGTTCCCA AGT | | CAACAGAGTAACTTTTCCC GCTCACT | |
| | 21-225_17G4 | SEQ ID NO:1041 | | SEQ ID NO:9053 | | SEQ ID NO:17065 | |
| | | RTSQNISNYLN | AA | VASSFPS | | QQSNFFPLT | |
| | | SEQ ID NO:1042 | | SEQ ID NO:9054 | | SEQ ID NO:17066 | |
| iPS:398482 | | CGGGCGAGTCGGGACATTAG CAATTATTTAGCC | NA | ACTGCATCCAGTTGCAA AGT | | CAACAGTATCATAGTTACCC ATTCACT | |
| | 21-225_17H6 | SEQ ID NO:1043 | | SEQ ID NO:9055 | | SEQ ID NO:17067 | |
| | | RASRDISNYLA | AA | TASSLQS | | QQYHSYPFT | |
| | | SEQ ID NO:1044 | | SEQ ID NO:9056 | | SEQ ID NO:17068 | |
| iPS:398484 | | CGGGCAAGTCAGGGCATTAG AAATGATTTAGGC | NA | GCTGCATCCAGTTTGGA AAGT | | CTACATCATAATAATTACCT CCCCATCACC | |
| | 21-225_18D4 | SEQ ID NO:1045 | | SEQ ID NO:9057 | | SEQ ID NO:17069 | |
| | | RASQGIRNDLG | AA | AASSLES | | LHHNNYLPIT | |
| | | SEQ ID NO:1046 | | SEQ ID NO:9058 | | SEQ ID NO:17070 | |
| iPS:398486 | | CGGGCAAGTCATACCATTAC CAGCTATTTAAAT | NA | GCTACACATCCAATCTCCAA AGT | | CAACAGAGTTACAACTTCCC GCTCACT | |
| | 21-225_19A1 | SEQ ID NO:1047 | | SEQ ID NO:9059 | | SEQ ID NO:17071 | |
| | | RASHTITSYLN | AA | ATSNLQS | | QQSYNFPLT | |
| | | SEQ ID NO:1048 | | SEQ ID NO:9060 | | SEQ ID NO:17072 | |
| iPS:398488 | | TCTGGAGATAAATTGGGGGA TAAATATGCTTGC | NA | CAAGATAGCAAGCGGCC CTCA | | CAGGCGTGGGACAACAACAC TGTGGTA | |
| | 21-225_19F6 | SEQ ID NO:1049 | | SEQ ID NO:9061 | | SEQ ID NO:17073 | |
| | | SGDKLGDKYAC | AA | QDSKRPS | | QAWDNNTVV | |
| | | SEQ ID NO:1050 | | SEQ ID NO:9062 | | SEQ ID NO:17074 | |
| iPS:398490 | | TCTGGAGATAAATTGGGGAA TAAATATGCTTAC | NA | CAAGATAGAAAGAGGCC CTCA | | CAGGCGTGGGACAACAGCAC TGTGGTA | |
| | 21-225_21D12 | SEQ ID NO:1051 | | SEQ ID NO:9063 | | SEQ ID NO:17075 | |
| | | SGDKLGNKYAY | AA | QDRKRPS | | QAWDNSTVV | |

FIGURE 49
(Continued)

| | | | | | |
|---|---|---|---|---|---|
| iPS:398492 | | SEQ ID NO:1052 CGGGCGAGTCAGGGCATTAGGAATTTTTAGCC | SEQ ID NO:9064 GCTGCATCCAGTTTGCAA ACT | SEQ ID NO:17076 CAACAGTATAATAGTTTCCC ATTCACT |
| | 21-225_21F12 | NA | | | |
| | | AA | SEQ ID NO:1053 RASQGIRNFLA | SEQ ID NO:9065 AASSLQT | SEQ ID NO:17077 QQYNSFPFT |
| iPS:398494 | | NA | SEQ ID NO:1054 ACTGGAACCAGCAGTGACGTTGGTGGTTATAACTCTGTCTCC | SEQ ID NO:9066 GAGGTCAGTAATCGGCC CTCA | SEQ ID NO:17078 AGCTCATATACAAGGAGCAGCACTGTGGTA |
| | 21-225_21H4 | | | | |
| | | AA | SEQ ID NO:1055 TGTSSDVGGYNSVS | SEQ ID NO:9067 EVSNRPS | SEQ ID NO:17079 SSYTRSSTVV |
| iPS:398496 | | NA | SEQ ID NO:1056 AAGTCCAGCCAGAGTGTTTTACACAGCTCCAACATAACAACTACTTAGCT | SEQ ID NO:9068 TGGGCATCTACCCGGAA ATCC | SEQ ID NO:17080 CAGCAATATTATAGTACTCCGTGCAGT |
| | 21-225_22D2 | | | | |
| | | AA | SEQ ID NO:1057 KSSQSVLHSSNNNNYLA | SEQ ID NO:9069 WASTRKS | SEQ ID NO:17081 QQYYSTPCS |
| iPS:398498 | | NA | SEQ ID NO:1058 TCTGGAGATAAATTGGGGGAGAAATATGCTTGC | SEQ ID NO:9070 CAAGATAGAAAGCGGCC CTCA | SEQ ID NO:17082 CAGGCGTGGGACAGCAGCACTGCGGTA |
| | 21-225_22E6 | | | | |
| | | AA | SEQ ID NO:1059 SGDKLGEKYAC | SEQ ID NO:9071 QDRKRPS | SEQ ID NO:17083 QAWDSSTAV |
| iPS:398500 | | NA | SEQ ID NO:1060 CGGGCGAGTCAGGACATTAGCAATTATTTAGCC | SEQ ID NO:9072 GCTGCATCCACTTTGCAA AGT | SEQ ID NO:17084 CAACAGTATAATAGTTACCC ATTCACT |
| | 21-225_23A11 | | | | |
| | | AA | SEQ ID NO:1061 RASQDISNYLA | SEQ ID NO:9073 AASTLQS | SEQ ID NO:17085 QQYNSYPFT |
| iPS:398502 | | NA | SEQ ID NO:1062 CGGGCGAGTCAGGGTATTACCAAGTGGTTAGCC | SEQ ID NO:9074 GCTGCATCCAGTTTGCAA AGT | SEQ ID NO:17086 CAACAGGCTAACAGTTTCCC ATTCACT |

FIGURE 49
(Continued)

| | | | | | | |
|---|---|---|---|---|---|---|
| iPS:398504 | 21-225_23B11 | AA | SEQ ID NO:1063 RASQGITKWLA | | SEQ ID NO:9075 AASSLQS | SEQ ID NO:17087 QQANSFPFT |
| | | NA | SEQ ID NO:1064 TCTGGAGAAAAATTGGGGG ATAAATATGTTTGT | | SEQ ID NO:9076 CAAGATAGCAAGCGGCC CTCA | SEQ ID NO:17088 CAGGCGTGAACAGCAGCAA TGTGGTA |
| iPS:398506 | 21-225_23D7 | AA | SEQ ID NO:1065 SGEKLGDKYVC | | SEQ ID NO:9077 QDSKRPS | SEQ ID NO:17089 QAWNSSNVV |
| | | NA | SEQ ID NO:1066 AAGTCCAGCCAGAGTATTT ATTCAGCTCCAACAATAACA ACTACTTAGCT | | SEQ ID NO:9078 TGGGCATCTACCCGGGA ATCC | SEQ ID NO:17090 CAGCAATATTCTAGTACTCC GTGGACG |
| iPS:398508 | 21-225_23G12 | AA | SEQ ID NO:1067 KSSQSILFSSNNNNYLA | | SEQ ID NO:9079 WASTRES | SEQ ID NO:17091 QQYSSTPWT |
| | | NA | SEQ ID NO:1068 AGGTCTAGTCAAAGCCTCGT ATACAGTGATGAAACACCT ACTTGAAT | | SEQ ID NO:9080 AAGGTTTCTAACTGGGA CTCT | SEQ ID NO:17092 ATGCAAGGTGCACACTGGCC TCCGATCACC |
| iPS:398510 | 21-225_24B1 | AA | SEQ ID NO:1069 RSSQSLVYSDGNTYLN | | SEQ ID NO:9081 KVSNWDS | SEQ ID NO:17093 MQGAHWPPIT |
| | | NA | SEQ ID NO:1070 AAGTCCAGCCAGAGTGTTTT ATACAGCTCCAACAATAAGA ACTACTTAGCT | | SEQ ID NO:9082 TGGGCATCTACCCGGGA ATCC | SEQ ID NO:17094 CAGCAATATTATAGTACTCC GTGCAGT |
| iPS:398512 | 21-225_25A3 | AA | SEQ ID NO:1071 KSSQSVLYSSNNKNYLA | | SEQ ID NO:9083 WASTRES | SEQ ID NO:17095 QQYYSTPCS |
| | | NA | SEQ ID NO:1072 AAGTCCAGCCAGAGTGTTTT ATACCACTCCAACAATTACA ACTACTTAGCT | | SEQ ID NO:9084 TGGGCATCTACCCGGGA GTCC | SEQ ID NO:17096 CAGCAATATTACAGTACTCC GTGCAGT |
| iPS:398512 | 21-225_25E12 | | SEQ ID NO:1073 | | SEQ ID NO:9085 | SEQ ID NO:17097 |

FIGURE 49
(Continued)

| | | | | | | |
|---|---|---|---|---|---|---|
| iPS:398516 | | AA | KSSQSVLYHSNNYNYLA SEQ ID NO:1074 | WASTRES SEQ ID NO:9086 | QQYYSTPCS SEQ ID NO:17098 |
| | 21-225_26A9 | NA | AAGTCCAGCCAGAGTGTTTT ATACAGCTCCAACAATAAGA ACTACTTAGCT SEQ ID NO:1075 | TGGGCATCTACCCGGGA ATCC SEQ ID NO:9087 | CAGCAATATTATAGTAGTCC GTGCAGT SEQ ID NO:17099 |
| iPS:398520 | | AA | KSSQSVLYSSNNKNYLA SEQ ID NO:1076 | WASTRES SEQ ID NO:9088 | QQYYSSPCS SEQ ID NO:17100 |
| | 21-225_31C4 | NA | CGGGCGAGTCAGGGTATTAG CAAATGGTTAGCC SEQ ID NO:1077 | GCTGCATCCAGTTGCAG AGT SEQ ID NO:9089 | CAACAGGCTAACAGTTTCCC ATTCACT SEQ ID NO:17101 |
| iPS:398522 | | AA | RASQGISKWLA SEQ ID NO:1078 | AASSLQS SEQ ID NO:9090 | QQANSFPFT SEQ ID NO:17102 |
| | 21-225_32A1 | NA | AAGTCCAGCCAGAGTGTTTT ATACAGCTCCAACAATACA ACTACTTAGCT SEQ ID NO:1079 | TGGGCATCTACCCGGAA ATCC SEQ ID NO:9091 | CAACAATATTATACTTCTCC GTGCAGT SEQ ID NO:17103 |
| iPS:398524 | | AA | KSSQSVLYSSNNYNYLA SEQ ID NO:1080 | WASTRKS SEQ ID NO:9092 | QQYYTSPCS SEQ ID NO:17104 |
| | 21-225_32A5 | NA | AAGTCCAGCCAGAGTGTTTT ACACAGCTCCAACAATAAGA ACTACTTAGCT SEQ ID NO:1081 | TGGGCATCTACCCGGGA ATCC SEQ ID NO:9093 | CAGCAATATTATAGTTCTCC GTGCAGT SEQ ID NO:17105 |
| iPS:398526 | | AA | KSSQSVLHSSNNKNYLA SEQ ID NO:1082 | WASTRES SEQ ID NO:9094 | QQYYSSPCS SEQ ID NO:17106 |
| | 21-225_32B3 | NA | CGGGCGAGTCAGGGCATTAG CAATTATTTAGCC SEQ ID NO:1083 | GCTGCATCCAGTTTACAA AGT SEQ ID NO:9095 | CAACAGTATAATAGTTATCC ATTCACT SEQ ID NO:17107 |
| | | AA | RASQGISNYLA SEQ ID NO:1084 | AASSLQS SEQ ID NO:9096 | QQYNSYPFT SEQ ID NO:17108 |

FIGURE 49
(Continued)

| | | | | | |
|---|---|---|---|---|---|
| iPS:398528 | 21-225_32G1 | NA | CGGGCAAGTCAGGACATGA GAAGTGATTTAGGC SEQ ID NO:1085 | GCTGCATCCAGTTTGCAA AGT SEQ ID NO:9097 | CTACAGCATACTATTTCCCCT CCTACT SEQ ID NO:17109 |
| | | AA | RASQDMRSDLG SEQ ID NO:1086 | AASSLQS SEQ ID NO:9098 | LQHTISPPT SEQ ID NO:17110 |
| iPS:398530 | 21-225_32G4 | NA | AGGTCAAGTCAAAGCCTCGT ATACAGTGATGGAAACACCT ACTTGAAT SEQ ID NO:1087 | AAGGTTTCTAACTGGGA CTCT SEQ ID NO:9099 | ATGCAAGGTATACACTGGCT CACT SEQ ID NO:17111 |
| | | AA | RSSQSLVYSDGNTYLN SEQ ID NO:1088 | KVSNWDS SEQ ID NO:9100 | MQGIHWLT SEQ ID NO:17112 |
| iPS:398532 | 21-225_33B7 | NA | CGGGCGAGTCAGGACATTAG CAATTATTTGGCC SEQ ID NO:1089 | GCTGCATCTAGTTTGCAA AGT SEQ ID NO:9101 | CAACAGTATCATAGTTACCC GCTCACC SEQ ID NO:17113 |
| | | AA | RASQDISNYLA SEQ ID NO:1090 | AASSLQS SEQ ID NO:9102 | QQYHSYPLT SEQ ID NO:17114 |
| iPS:398534 | 21-225_33B8 | NA | CGGGCAAGTCAGAGACATTAG AAGTGATTTAGGC SEQ ID NO:1091 | GCTGCATCCAGTTTGCAA AGT SEQ ID NO:9103 | CTACAGCATACTATTTACCC TCCTACT SEQ ID NO:17115 |
| | | AA | RASQDIRSDLG SEQ ID NO:1092 | AASSLQS SEQ ID NO:9104 | LQHTYPPT SEQ ID NO:17116 |
| iPS:398536 | 21-225_33D12 | NA | CGGGCAAGTCAGAGCATTAG AAGCTATTTAAAT SEQ ID NO:1093 | AGTTGCATCCAGTTTGCA AAGT SEQ ID NO:9105 | CAACAGAGTTACAGTATCCC GATCACC SEQ ID NO:17117 |
| | | AA | RASQSIRSYLN SEQ ID NO:1094 | SASSLQS SEQ ID NO:9106 | QQSYSIPIT SEQ ID NO:17118 |
| iPS:398538 | 21-225_34H7 | NA | AAGTCCAGCCAGAGTGTTTT ATACAGCTCCAACAATTACA ACTACTTAGCT SEQ ID NO:1095 | TGGGCATCTACCCGGAA ATCC SEQ ID NO:9107 | CAGCAATATATTACTTCTCC GTGCAGT SEQ ID NO:17119 |

FIGURE 49
(Continued)

| | | | KSSQSVLYSSNNYNYLA | WASTRKS | QQYYTSPCS |
|---|---|---|---|---|---|
| | | AA | SEQ ID NO:1096 | SEQ ID NO:9108 | SEQ ID NO:17120 |
| iPS:398540 | 21-225_35A6 | NA | CGGGCAAGTCAGGACATTAG AAGTGATTTAGGC SEQ ID NO:1097 | GCTACATCCAGTTTGCAA AGT SEQ ID NO:9109 | CTACAGCATACTATTTACCC TCCTACT SEQ ID NO:17121 |
| | | AA | RASQDIRSDLG SEQ ID NO:1098 | ATSSLQS SEQ ID NO:9110 | LQHTIYPPT SEQ ID NO:17122 |
| iPS:398544 | 21-225_7C8 | NA | ACCCTAAGCAGTGAGCACAG CACCTACACCATCGAA SEQ ID NO:1099 | GTTAAGAGTGATGGCAG CCACAGCAAGGGGAC SEQ ID NO:9111 | GGAGAGAGCCACCCGATTGA TGGCCAAGTCGGTGTGGTA SEQ ID NO:17123 |
| | | AA | TLSSEHSTYTIE SEQ ID NO:1100 | VKSDGSHSKGD SEQ ID NO:9112 | GESHPIDGQVGVV SEQ ID NO:17124 |
| iPS:398546 | 21-225_9H10 | NA | TCTGGAGATAAATTGGGGA TAAATATGCTTGC SEQ ID NO:1101 | CAAGATAGCAAGCGGCC CTCA SEQ ID NO:9113 | CAGGCGTGGGACAGCAGCAC TTATGTGGTA SEQ ID NO:17125 |
| | | AA | SGDKLGDKYAC SEQ ID NO:1102 | QDSKRPS SEQ ID NO:9114 | QAWDSSTYVV SEQ ID NO:17126 |
| iPS:402219 | 21-225_1C12 | NA | CGGGCAAGTCAGGGCATTAG AAATGATTTAGGC SEQ ID NO:1103 | GCTGCATCCAGTTTGCAA AGT SEQ ID NO:9115 | CTACAACATAATAGTTACCC GCTCACT SEQ ID NO:17127 |
| | | AA | RASQGIRNDLG SEQ ID NO:1104 | AASSLQS SEQ ID NO:9116 | LQHNSYPLT SEQ ID NO:17128 |
| iPS:402221 | 21-225_2C12 | NA | CGGGCGAGTCAGGGCATTAG CAATTATTTAGCC SEQ ID NO:1105 | GCTGCAACCAGTTTGCA AAGT SEQ ID NO:9117 | CAACAGTATTATAGTTACCC GATCACC SEQ ID NO:17129 |
| | | AA | RASQGISNYLA SEQ ID NO:1106 | AATSLQS SEQ ID NO:9118 | QQYYSYPIT SEQ ID NO:17130 |
| iPS:402223 | | NA | CGGGCGAGTCAGGGTATTAG CAGATGGTTAGCC | GCTGCATCCCGTTTGCAA AGT | CAACAGGCTAACAGTTTCCC ATTCACT |

FIGURE 49
(Continued)

| | | | | | | | |
|---|---|---|---|---|---|---|---|
| iPS:402225 | 21-225_30A11 | AA | SEQ ID NO:1107 RASQGISRWLA | SEQ ID NO:9119 AASRLQS | SEQ ID NO:17131 QQANSFPFT | | |
| | | NA | SEQ ID NO:1108 TCTGGAGATAAATTGGGGGA TAAATATGCTTGC | SEQ ID NO:9120 CAAGATCGCAAGCGGCC CTCA | SEQ ID NO:17132 CAGGCGTGGACAACAACAC TGTGGTA | | |
| iPS:402229 | 21-225_2B1 | AA | SEQ ID NO:1109 SGDKLGDKYAC | SEQ ID NO:9121 QDRKRPS | SEQ ID NO:17133 QAWDNNTVV | | |
| | | NA | SEQ ID NO:1110 CGGGCAAGTCAGGGCATTAG AAATTATTTAGGC | SEQ ID NO:9122 GGTGCATCCAGTTGCA AAGT | SEQ ID NO:17134 CTACAGTATCATAGTTATCT ATTCACT | | |
| iPS:402231 | 21-225_16H9 | AA | SEQ ID NO:1111 RASQGIRNYLG | SEQ ID NO:9123 GASSLQS | SEQ ID NO:17135 LQYHSYLFT | | |
| | | NA | SEQ ID NO:1112 TCTGGAGATAAATTGGGGGA AAAATATGCTTGC | SEQ ID NO:9124 CAAGATAAGAAGCGGCC CTCA | SEQ ID NO:17136 CAGGCGTGGGACAGCAGCAC TGTA | | |
| iPS:402233 | 21-225_6D9 | AA | SEQ ID NO:1113 SGDKLGEKYAC | SEQ ID NO:9125 QDKKRPS | SEQ ID NO:17137 QAWDSSTV | | |
| | | NA | SEQ ID NO:1114 CGGGCGAGTCAGGACATAA GTAATTATTTAGCC | SEQ ID NO:9126 GCTACACCCAGTTGCA GAGT | SEQ ID NO:17138 CAACAGTATAATAGTTACCC GCTCACT | | |
| iPS:402235 | 21-225_16D10 | AA | SEQ ID NO:1115 RASQDISNYLA | SEQ ID NO:9127 ATPSLQS | SEQ ID NO:17139 QQYNSYPLT | | |
| | | NA | SEQ ID NO:1116 CGGGCGAGTCAGGGCATTAA CAATTATTTAGCC | SEQ ID NO:9128 GCTGCATCCAGTTTGCAA AGT | SEQ ID NO:17140 CAGCAATATAATAGTTACCC ATTCACT | | |
| iPS:402237 | 21-225_20F10 | AA | SEQ ID NO:1117 RASQGINNYLA | SEQ ID NO:9129 AASSLQS | SEQ ID NO:17141 QQYNSYPFT | | |
| | | NA | SEQ ID NO:1118 CGGGCGAGTCAGGGCATTGC CAATTATTTAGCC | SEQ ID NO:9130 GCTGCATCCAGTTTGCAA AGT | SEQ ID NO:17142 CAACAGTATCATAGTTACCC GCTCACT | | |

FIGURE 49
(Continued)

| | | | | | | | |
|---|---|---|---|---|---|---|---|
| 21-225_23D11 | | | SEQ ID NO:1119 | | SEQ ID NO:9131 | | SEQ ID NO:17143 |
| | | AA | RASQGIANYLA | | AASSLQS | | QQYHSYPLT |
| iPS:403868 | | | SEQ ID NO:1120 | | SEQ ID NO:9132 | | SEQ ID NO:17144 |
| 21-225_19D11 | | NA | CGGGCAAGTCAGGGCATTAGC AAATGATTTAGGC | | GCTACATCCAGTTTGCAA AGT | | CTACAGTATTATAGTTACCCC GCTCACT |
| | | | SEQ ID NO:1121 | | SEQ ID NO:9133 | | SEQ ID NO:17145 |
| | | AA | RASQGIRNDLG | | ATSSLQS | | LQYYSYPLT |
| iPS:403870 | | | SEQ ID NO:1122 | | SEQ ID NO:9134 | | SEQ ID NO:17146 |
| 21-225_23G4 | | NA | CGGGCAAGTCAGAGAACATTTA CAGCTATTTAAAT | | GCTGCATCCAGTTTGCAA AGT | | CAACAGAGTTACAATACCCC TCCGGAGTGCAAT |
| | | | SEQ ID NO:1123 | | SEQ ID NO:9135 | | SEQ ID NO:17147 |
| | | AA | RASQNIYSYLN | | AASSLQS | | QQSYNTPPFCN |
| iPS:403872 | | | SEQ ID NO:1124 | | SEQ ID NO:9136 | | SEQ ID NO:17148 |
| 21-225_8F11 | | NA | CGGGCAAGTCAGGGCATTAG GAGTGATTTAGGC | | GATGCATCCAGTGTGCA AAGT | | CTACAACATTATACTTACCC GCTCACT |
| | | | SEQ ID NO:1125 | | SEQ ID NO:9137 | | SEQ ID NO:17149 |
| | | AA | RASQGIRSDLG | | DASSVQS | | LQHYTYPLT |
| iPS:404090 | | | SEQ ID NO:1126 | | SEQ ID NO:9138 | | SEQ ID NO:17150 |
| 21-225_8D8 | | NA | TCTGGAGATAAATTGGGGGA GAAATATGCTTGC | | CAAGATAGGAAGCGGCC CTCA | | CAGGCGTGGGACAGCAGCAC TGCGGTA |
| | | | SEQ ID NO:1127 | | SEQ ID NO:9139 | | SEQ ID NO:17151 |
| | | AA | SGDKLGEKYAC | | QDRKRPS | | QAWDSSTAV |
| iPS:412232 | | | SEQ ID NO:1128 | | SEQ ID NO:9140 | | SEQ ID NO:17152 |
| 21-225_4A2 | | NA | AAGTCCAGCCAGAGTATTTT ACACAGCTCCAACAATAACA ACTACTTAGCT | | TGGGCATCTACCCGGGA ATCC | | CAGCAATATTATATATACTCC AGTCACT |
| | | | SEQ ID NO:1129 | | SEQ ID NO:9141 | | SEQ ID NO:17153 |
| | | AA | KSSQSILHSSNNNYLA | | WASTRES | | QQYYNTPVT |
| | | | SEQ ID NO:1130 | | SEQ ID NO:9142 | | SEQ ID NO:17154 |

FIGURE 49
(Continued)

| | | | | |
|---|---|---|---|---|
| iPS:422894 | NA | AAGTCCAGCCAGAGTATTT ACACAGCTCCAACAATAACA ACTACTTAGCT | TGGGCATCTACCCGGGA ATCC | CAGCAATATTATAATACTCC AGTCACT |
| | | SEQ ID NO:1131 | SEQ ID NO:9143 | SEQ ID NO:17155 |
| 21-225_4A2.001 | AA | KSSQSILHSSNNNNYLA | WASTRES | QQYYNTPVT |
| | | SEQ ID NO:1132 | SEQ ID NO:9144 | SEQ ID NO:17156 |
| iPS:423018 | NA | TCTGGAGATAAATTGGGGGA TAAATATGCTTAC | CAAGATAGGAAGCGGCC CTCA | CAGGCGTGGGACAACAGCAC TGCGGTA |
| | | SEQ ID NO:1133 | SEQ ID NO:9145 | SEQ ID NO:17157 |
| 21-225_31D12_LC2 | AA | SGDKLGDKYAY | QDRKRPS | QAWDNSTAV |
| | | SEQ ID NO:1134 | SEQ ID NO:9146 | SEQ ID NO:17158 |
| iPS:423019 | NA | AGGTCTAGTCAAAGCCTCAT ATACAGTGATGAAACACCT TCTTGAAT | AAGGTTTCTAATTGGGA CTCT | ATGCAAGGTACACACTGGCC TCTCACC |
| | | SEQ ID NO:1135 | SEQ ID NO:9147 | SEQ ID NO:17159 |
| 21-225_31D12_LC1 | AA | RSSQSLIYSDGNTFLN | KVSNWDS | MQGTHWPLT |
| | | SEQ ID NO:1136 | SEQ ID NO:9148 | SEQ ID NO:17160 |
| iPS:423314 | NA | AAGTCCAGCCAGAGTGTTTT ACACAGCTCCAACAATTATA ACTACTTAGCT | TGGGCATCTACCCGGGA ATCC | CAGCAATATTATGATACTCC ATTCACT |
| | | SEQ ID NO:1137 | SEQ ID NO:9149 | SEQ ID NO:17161 |
| 21-225_12F11 | AA | KSSQSVLHSSNNYNYLA | WASTRES | QQYYDTPFT |
| | | SEQ ID NO:1138 | SEQ ID NO:9150 | SEQ ID NO:17162 |
| iPS:424419 | NA | AAGTCCAGCCAGAGTGTTTT ATACAGCTCCCACAATAACA ACTACTTAGCT | TGGGCATCTACCCGGGA ATCC | CAGCAGTATTATAGTACTCC TCCGACG |
| | | SEQ ID NO:1139 | SEQ ID NO:9151 | SEQ ID NO:17163 |
| 21-225_25A4.001 | AA | KSSQSVLYSSHNNNYLA | WASTRES | QQYYSTPPT |
| | | SEQ ID NO:1140 | SEQ ID NO:9152 | SEQ ID NO:17164 |

FIGURE 49
(Continued)

| | | | | | |
|---|---|---|---|---|---|
| iPS:424460 | 21-225_7E11.001 | NA | CGGGCAAGTCAAAACATTAT CAGCTATTTAAAT SEQ ID NO:1141 | ACTGCATCCAGTTTGCAA AGT SEQ ID NO:9153 | CAACAGAGACTTACAGTACCCC GCTCACT SEQ ID NO:17165 |
| | | AA | RASQNHSYLN SEQ ID NO:1142 | TASSLQS SEQ ID NO:9154 | QQTYSTPLT SEQ ID NO:17166 |
| iPS:426108 | 21-225_10G6 | NA | CGGGCGAGTCAGGGTATTAG CAAATGGTTAGCC SEQ ID NO:1143 | GCTGCATATAGTTTACAA AGT SEQ ID NO:9155 | CAACAGGCTAACAGTTTCCC ATTCACT SEQ ID NO:17167 |
| | | AA | RASQGISKWLA SEQ ID NO:1144 | AAYSLQS SEQ ID NO:9156 | QQANSFPFT SEQ ID NO:17168 |
| iPS:426110 | 21-225_12E9 | NA | CGGGCGAGTCAGGGTATTAG CAGCTGGTTAGCC SEQ ID NO:1145 | GCTGCATCCAGGTTGCA AAGT SEQ ID NO:9157 | CAACAGGCTAACAGTTTCCC ATTCACT SEQ ID NO:17169 |
| | | AA | RASQGISSWLA SEQ ID NO:1146 | AASRLQS SEQ ID NO:9158 | QQANSFPFT SEQ ID NO:17170 |
| iPS:426112 | 21-225_12F12 | NA | AAGTCCAGCAGGCCAGACTGTTTT ATTCAGCTCCAACAATAACC ACTACTTAGCA SEQ ID NO:1147 | TGGGCATCTACCCCGGGC ATCC SEQ ID NO:9159 | CAGCAATATTATAGTAGTCC GTGGACG SEQ ID NO:17171 |
| | | AA | KSSQTVLFSSNNNHYLA SEQ ID NO:1148 | WASTRAS SEQ ID NO:9160 | QQYYSSPWT SEQ ID NO:17172 |
| iPS:426114 | 21-225_28H2 | NA | CGGGCAAGTCAGGGCATTAG AAATGATTTAGGC SEQ ID NO:1149 | GCTGCATCCAGTTTGCAA AGT SEQ ID NO:9161 | CTACAACATTATAGTTACCC TCGCAGT SEQ ID NO:17173 |
| | | AA | RASQGIRNDLG SEQ ID NO:1150 | AASSLQS SEQ ID NO:9162 | LQHYSYPRS SEQ ID NO:17174 |
| iPS:426116 | 21-225_29E2 | NA | CGGGCAAGTCAGGCCATTAG AAATGATTTAGGC SEQ ID NO:1151 | GCTGCATCCAGTTTGCAA AGT SEQ ID NO:9163 | TTACAGCATTATAATTACCC TCGCAGT SEQ ID NO:17175 |
| | | AA | RASQAIRNDLG | AASSLQS | LQHYNYPRS |

FIGURE 49
(Continued)

| | | | | | | | |
|---|---|---|---|---|---|---|---|
| iPS:426118 | | NA | SEQ ID NO:1152 CGGGCAAGTCAGAACATTTA CAGCTATTTAAAT | SEQ ID NO:9164 TCTACATCCAGTTTGCAA AGT | SEQ ID NO:17176 CAACAGAGTTACAGTCCCCC TCTCACT |
| | 21-225_7A10 | AA | SEQ ID NO:1153 RASQNIYSYLN | SEQ ID NO:9165 STSSLQS | SEQ ID NO:17177 QQSYSPPLT |
| iPS:426124 | | NA | SEQ ID NO:1154 CGGGCAAGTCAGAACATTAT CAGCTATTTAAAT | SEQ ID NO:9166 GTTGCATCCCGTTTGCAA AGT | SEQ ID NO:17178 CAACAGAGTTACAGTACCCC GTACACT |
| | 21-225_32D6 | AA | SEQ ID NO:1155 RASQNIISYLN | SEQ ID NO:9167 VASRLQS | SEQ ID NO:17179 QQSYSTPYT |
| iPS:426126 | | NA | SEQ ID NO:1156 AAGTCCAGCCAGAGTGTTT ACACAACTCCAACAATTATA ACTATTTAGCT | SEQ ID NO:9168 TGGGCATCTACCCGGGA ATCC | SEQ ID NO:17180 CAGCAATATTATGATACTCC ATTCACT |
| | 21-225_6G6 | AA | SEQ ID NO:1157 KSSQSVLHNSNNYNYLA | SEQ ID NO:9169 WASTRES | SEQ ID NO:17181 QQYYDTPFT |
| iPS:433895 | | NA | SEQ ID NO:1158 CGGGCAAGTCAGGGCATTAG AAATGATTTAGGC | SEQ ID NO:9170 GCTGCATCCAGTTTGCAA AGT | SEQ ID NO:17182 CTACAGCATAATAGTTACCC ATTCACT |
| | 21-225_43E1 | AA | SEQ ID NO:1159 RASQGIRNDLG | SEQ ID NO:9171 AASSLQS | SEQ ID NO:17183 LQHNSYPFT |
| iPS:433897 | | NA | SEQ ID NO:1160 CGGGCGAGTCAGGGTATTAG CGACTGGTTAGCC | SEQ ID NO:9172 GCTGCATCCAGTTTGCAA AGT | SEQ ID NO:17184 CAACAGACTAACAGTTTCCC GTGGACG |
| | 21-225_43C2 | AA | SEQ ID NO:1161 RASQGISDWLA | SEQ ID NO:9173 AASSLQS | SEQ ID NO:17185 QQTNSFPWT |
| iPS:433899 | | NA | SEQ ID NO:1162 CGGGCAAGTCAGGGCATTAG AAATGATTTAGGC | SEQ ID NO:9174 GCTGCATCCAGTTTGCAA AGT | SEQ ID NO:17186 CTACAGCATAATAGTTACCC TCTCACT |
| | 21-225_43C3 | | SEQ ID NO:1163 | SEQ ID NO:9175 | SEQ ID NO:17187 |

FIGURE 49
(Continued)

| | | | | | AA | RASQGIRNDLG<br>SEQ ID NO:1164 | AASSLQS<br>SEQ ID NO:9176 | LQHNSYPLT<br>SEQ ID NO:17188 |
|---|---|---|---|---|---|---|---|---|
| iPS:433901 | | 21-225_43A4 | | NA | | CGGGCGAGTCAGGGCATTAA<br>CAATTATTTAGCC<br>SEQ ID NO:1165 | GCTGCATCCAGTTTGCAA<br>AGT<br>SEQ ID NO:9177 | CAACAGTATTATAGTTACC<br>ATTCACT<br>SEQ ID NO:17189 |
| | | | AA | | RASQGINNYLA<br>SEQ ID NO:1166 | AASSLQS<br>SEQ ID NO:9178 | QQYYSYPFT<br>SEQ ID NO:17190 |
| iPS:433903 | | 21-225_43H4 | | NA | | CGGGCGAGTCAGGGTATTAT<br>CAACTGGTTAGCC<br>SEQ ID NO:1167 | GCTGCATCCAGTTTGCAA<br>AGT<br>SEQ ID NO:9179 | CAACAGACTAACAGTTTCCC<br>GTGGACG<br>SEQ ID NO:17191 |
| | | | AA | | RASQGIINWLA<br>SEQ ID NO:1168 | AASSLQS<br>SEQ ID NO:9180 | QQTNSFPWT<br>SEQ ID NO:17192 |
| iPS:433905 | | 21-225_43E5 | | NA | | CGGGCAAGTCAGGGCATTAG<br>AAATGATTTAGGC<br>SEQ ID NO:1169 | GGTGCATCCAATTTGCA<br>AAGT<br>SEQ ID NO:9181 | CTACAGCATACTAGTTTCCC<br>ATTCACT<br>SEQ ID NO:17193 |
| | | | AA | | RASQGIRNDLG<br>SEQ ID NO:1170 | GASNLQS<br>SEQ ID NO:9182 | LQHTSFPFT<br>SEQ ID NO:17194 |
| iPS:433909 | | 21-225_43D8 | | NA | | AAGTCCAGCCAGAGTGTTT<br>AATGACCTCCAACGATAAGA<br>ACTACTTAACT<br>SEQ ID NO:1171 | TGGGCTTCTACCCGGGA<br>ATCC<br>SEQ ID NO:9183 | CAGCAATATTATAGTACTCC<br>TCCGACG<br>SEQ ID NO:17195 |
| | | | AA | | KSSQSVLMTSNDKNYLT<br>SEQ ID NO:1172 | WASTRES<br>SEQ ID NO:9184 | QQYYSTPPT<br>SEQ ID NO:17196 |
| iPS:433911 | | 21-225_43E8 | | NA | | CGGGCGAGTCAGGGTATTAG<br>CAACTGGTTAGCC<br>SEQ ID NO:1173 | GCTGCATCCAGTTTGCAA<br>AGT<br>SEQ ID NO:9185 | CAACAGACTAACAGTTTCCC<br>GTGGACG<br>SEQ ID NO:17197 |
| | | | AA | | RASQGISNWLA<br>SEQ ID NO:1174 | AASSLQS<br>SEQ ID NO:9186 | QQTNSFPWT<br>SEQ ID NO:17198 |
| iPS:433913 | | | | NA | | CGGGCAAGTCAGGGCATTAG<br>AAATGATTTAGGC | GCTGCATCCAGTTTGCAA<br>AGT | CTACAGCATAATAGTTTCCC<br>ATTCACT |

FIGURE 49
(Continued)

| | | | | | | |
|---|---|---|---|---|---|---|
| iPS:433915 | 21-225_43H8 | AA | SEQ ID NO:1175 RASQGIRNDLG | SEQ ID NO:9187 AASSLQS | SEQ ID NO:17199 LQHNSFPFT | |
| | | NA | SEQ ID NO:1176 CGGGCAAGTCAGGGTCAGGATATTAG CAGCTGGTTAGCC | SEQ ID NO:9188 GATGCATCCAGTTTGCA AAGT | SEQ ID NO:17200 CAACAGGCTAACAGTCTCCC ATTCACT | |
| iPS:433917 | 21-225_43H9 | AA | SEQ ID NO:1177 RASQDISSWLA | SEQ ID NO:9189 DASSLQS | SEQ ID NO:17201 QQANSLPFT | |
| | | NA | SEQ ID NO:1178 AAGTCTAGTCAGAGCCTCCT GCACAGTGATGGAAGGACCT ATTTGTAT | SEQ ID NO:9190 GAAGTTCCAACCGGTTC TCT | SEQ ID NO:17202 ATGCAAAGTATACAGCTTCC GTGGACG | |
| iPS:433919 | 21-225_43E11 | AA | SEQ ID NO:1179 KSSQSLLHSDGRTYLY | SEQ ID NO:9191 EVSNRFS | SEQ ID NO:17203 MQSIQLPWT | |
| | | NA | SEQ ID NO:1180 CGGGCAAGTCAGGGCATTAG AAATGATTTAGGC | SEQ ID NO:9192 GCTGCATCCAGTTTGCAA AGT | SEQ ID NO:17204 CTACTGCATTATAATTACCCT CGGACG | |
| iPS:433921 | 21-225_44B3 | AA | SEQ ID NO:1181 RASQGIRNDLG | SEQ ID NO:9193 AASSLQS | SEQ ID NO:17205 LLHYNYPRT | |
| | | NA | SEQ ID NO:1182 CGGGCAAGTCAGGGCATTAG AAATGATTTAGGC | SEQ ID NO:9194 GCTGCATCCAGTTTGCAA AGT | SEQ ID NO:17206 CTACAGCATAGTAGTTACCC TCTCACT | |
| iPS:433923 | 21-225_44C3 | AA | SEQ ID NO:1183 RASQGIRNDLG | SEQ ID NO:9195 AASSLQS | SEQ ID NO:17207 LQHSSYPLT | |
| | | NA | SEQ ID NO:1184 CGGGCAAGTCAGGGCATTAG AGATGATTTAGGC | SEQ ID NO:9196 GCTGCATCCAGTTTGCAA AGT | SEQ ID NO:17208 CTACAGCATTATAGTTACCC TCGGACG | |
| | 21-225_44D3 | AA | SEQ ID NO:1185 RASQGIRDDLG | SEQ ID NO:9197 AASSLQS | SEQ ID NO:17209 LQHYSYPRT | |
| | | | SEQ ID NO:1186 | SEQ ID NO:9198 | SEQ ID NO:17210 | |

FIGURE 49
(Continued)

| | | | | | |
|---|---|---|---|---|---|
| iPS:433925 | 21-225_44F3 | NA | CGGGGCGAGTCAGGGTATTAGC CGACTGGTTAGCC SEQ ID NO:1187 | GCTGCATCCAGTTTACAA AGT SEQ ID NO:9199 | CAACAGGCTAACAGTTCCC ATTCACT SEQ ID NO:17211 |
| | | AA | RASQGISDWLA SEQ ID NO:1188 | AASSLQS SEQ ID NO:9200 | QQANSFPFT SEQ ID NO:17212 |
| iPS:433929 | 21-225_44D5 | NA | CGGGCAAGTCAGGACATTAG AAAAGATTTAGGC SEQ ID NO:1189 | GCTGCATCCACTTTGGAA AGT SEQ ID NO:9201 | CTACAGCATTATAGTTTCCC GTGGACG SEQ ID NO:17213 |
| | | AA | RASQDIRKDLG SEQ ID NO:1190 | AASTLES SEQ ID NO:9202 | LQHYSFPWT SEQ ID NO:17214 |
| iPS:433931 | 21-225_44F6 | NA | AGGGCCAGTCAGAGTGTTAG TGGAAGCTACTTAGCC SEQ ID NO:1191 | GGTGCATCCAGCAGGGC CACT SEQ ID NO:9203 | CAGCAGTATGGTAGTTCACC GTGGACG SEQ ID NO:17215 |
| | | AA | RASQSVSGSYLA SEQ ID NO:1192 | GASSRAT SEQ ID NO:9204 | QQYGSSPWT SEQ ID NO:17216 |
| iPS:433933 | 21-225_44C8 | NA | CGGGCAAGTCAGGGCATTAG AAATGATTTAGGC SEQ ID NO:1193 | GCTGCATCCAATTGCAA AGT SEQ ID NO:9205 | CTACAGCATAATAGTTACCC ATTCACT SEQ ID NO:17217 |
| | | AA | RASQGIRNDLG SEQ ID NO:1194 | AASNLQS SEQ ID NO:9206 | LQHNSYPFT SEQ ID NO:17218 |
| iPS:433935 | 21-225_44F9 | NA | CGGGCAAGTCAGGGCATTAG AAATGATTTAGGC SEQ ID NO:1195 | GCTGCATCCAGTTTGCAA AGT SEQ ID NO:9207 | CTCCACCATTATAATTACCCT CGGACG SEQ ID NO:17219 |
| | | AA | RASQGIRNDLG SEQ ID NO:1196 | AASSLQS SEQ ID NO:9208 | LHHYNYPRT SEQ ID NO:17220 |
| iPS:433937 | 21-225_44B10 | NA | AAGTCTAGTCAGAGCCTCCT GCATAGTGAGGGAAGGACC TATTTGTAT SEQ ID NO:1197 | GAAATTTCCCACCGGTTC TCT SEQ ID NO:9209 | ATGCAAAGTATCCACCTTCC GTTCACT SEQ ID NO:17221 |
| | | AA | KSSQSLLHSEGRTYLY | EISHRFS | MQSIHLPFT |

FIGURE 49
(Continued)

| | | | | | |
|---|---|---|---|---|---|
| iPS:433939 | 21-225_44C10 | NA | SEQ ID NO:1198<br>CGGGCAAGTCAGGGCATTAG<br>AGATGATTTAGGC<br>SEQ ID NO:1199 | SEQ ID NO:9210<br>GCTACATCCAGTTGCAA<br>AGT<br>SEQ ID NO:9211 | SEQ ID NO:17222<br>CTACAGCATTATAGTTACCC<br>TCGGACG<br>SEQ ID NO:17223 |
| | | AA | RASQGIRDLG<br>SEQ ID NO:1200 | ATSSLQS<br>SEQ ID NO:9212 | LQHYSYPRT<br>SEQ ID NO:17224 |
| iPS:433941 | 21-225_44D10 | NA | CGGGCGAGTCAGGGTATTAG<br>CGACTGGTTAGCC<br>SEQ ID NO:1201 | GCTGCATCCAGTTTGCAA<br>AGT<br>SEQ ID NO:9213 | CAACAGACTAACACAGTTCCC<br>GTGGACG<br>SEQ ID NO:17225 |
| | | AA | RASQGISDWLA<br>SEQ ID NO:1202 | AASSLQS<br>SEQ ID NO:9214 | QQTNSFPWT<br>SEQ ID NO:17226 |
| iPS:433943 | 21-225_44E10 | NA | AGGTCTAGTCAGAGCCTCCT<br>GCATAGTAATGGATACAGCT<br>ATTTGGAG<br>SEQ ID NO:1203 | TTGGGTTCTAATCGGGCC<br>TCC<br>SEQ ID NO:9215 | ATGCAAACTCTACAAACTCC<br>ATTCACT<br>SEQ ID NO:17227 |
| | | AA | RSSQSLLHSNGYSYLE<br>SEQ ID NO:1204 | LGSNRAS<br>SEQ ID NO:9216 | MQTLQTPFT<br>SEQ ID NO:17228 |
| iPS:433945 | 21-225_44C12 | NA | CGGGGCGAGTCAGGGTATTAG<br>CAACTGGTTAGCC<br>SEQ ID NO:1205 | GCTGCATTCAGTTGCAA<br>AGT<br>SEQ ID NO:9217 | CAACAGTCTAACAGTTCCC<br>GTGGACG<br>SEQ ID NO:17229 |
| | | AA | RASQGISNWLA<br>SEQ ID NO:1206 | AAFSLQS<br>SEQ ID NO:9218 | QQSNSFPWT<br>SEQ ID NO:17230 |
| iPS:433947 | 21-225_44E12 | NA | CGGACAAGTCAGGGCATTAG<br>AAATGATTTAGGC<br>SEQ ID NO:1207 | GCTGCATCCAGTTTGCAA<br>AGT<br>SEQ ID NO:9219 | CTACAACATAATAGTTACCC<br>GCTCACT<br>SEQ ID NO:17231 |
| | | AA | RTSQGIRNDLG<br>SEQ ID NO:1208 | AASSLQS<br>SEQ ID NO:9220 | LQHNSYPLT<br>SEQ ID NO:17232 |
| iPS:433949 | 21-225_45H2 | NA | CGGGCAAGTCAGGGCATTAG<br>AAATGATTTAGGC<br>SEQ ID NO:1209 | GGTGCATCCAATTTGCA<br>AAGT<br>SEQ ID NO:9221 | CTACAGCATACTAGTTCCC<br>ATTCACT<br>SEQ ID NO:17233 |

FIGURE 49
(Continued)

| | | | | | |
|---|---|---|---|---|---|
| iPS:433951 | | AA | RASQGIRNDLG SEQ ID NO:1210 | GASSLQS SEQ ID NO:9222 | LQHTSFPFT SEQ ID NO:17234 |
| | 21-225_45B4 | NA | CGGGCAAGTCAGGGCATTAG AGATGATTAGGCC SEQ ID NO:1211 | GCTGCATCCAGTTGCAA AGT SEQ ID NO:9223 | CTACAGCATTATAGTTACCC TCGGACG SEQ ID NO:17235 |
| iPS:433953 | | AA | RASQGIRDDLG SEQ ID NO:1212 | AASSLQS SEQ ID NO:9224 | LQHYSYPRT SEQ ID NO:17236 |
| | 21-225_45H4 | NA | CGGGCGAGTCAGGATATTAG CAGCTGGTTAGCC SEQ ID NO:1213 | GATGCATCCAGTTTGA AAGT SEQ ID NO:9225 | CAACAGGCTAACAGTCTCCC TTTCACT SEQ ID NO:17237 |
| iPS:433955 | | AA | RASQDISSWLA SEQ ID NO:1214 | DASSLQS SEQ ID NO:9226 | QQANSLPFT SEQ ID NO:17238 |
| | 21-225_45B8 | NA | CGGGCAAGTCAGGACATTAG AGATGATTAGGCC SEQ ID NO:1215 | GCTGCATCCAGTTTGCAA AGT SEQ ID NO:9227 | CTACAGCATTATAATTACCC TCGGACG SEQ ID NO:17239 |
| iPS:433957 | | AA | RASQDIRDDLG SEQ ID NO:1216 | AASSLQS SEQ ID NO:9228 | LQHYNYPRT SEQ ID NO:17240 |
| | 21-225_45F8 | NA | CGGGCGAGTCAGGGTATTAG CGACTGGTTAGCC SEQ ID NO:1217 | GGTGCATCCAGTTTGCA AAGT SEQ ID NO:9229 | CAACAGACTAACACAGTTCCC GTGGACG SEQ ID NO:17241 |
| iPS:433959 | | AA | RASQGISDWLA SEQ ID NO:1218 | GASSLQS SEQ ID NO:9230 | QQTNSFPWT SEQ ID NO:17242 |
| | 21-225_45C9 | NA | CGGGCGAGTCAGGATATTAG CGACTGGTTAGCT SEQ ID NO:1219 | GCTGCATCCAGTTTGGA AAGT SEQ ID NO:9231 | CAACAGGCTAACAGTTTCCC ATTCACT SEQ ID NO:17243 |
| iPS:433961 | | AA | RASQDISDWLA SEQ ID NO:1220 | AASSLES SEQ ID NO:9232 | QQANSFPFT SEQ ID NO:17244 |
| | 21-225_45D9 | NA | CGGGCAAGTCAGGGCATTAA CAATTATTTAGCC SEQ ID NO:1221 | GCTGCATCCAGTTTGCAA AGT SEQ ID NO:9233 | CAACACTATATAGTTACCC ATTCACT SEQ ID NO:17245 |

FIGURE 49
(Continued)

| | | | | | |
|---|---|---|---|---|---|
| | | RASQGINNYLA | AASSLQS | | QHYYSYPFT |
| | AA | SEQ ID NO:1222 | SEQ ID NO:9234 | | SEQ ID NO:17246 |
| iPS:433963 | | | | | |
| | NA | CGGGCAAGTCAGGGCATTAG AAATGATTTAGGC | GCTGCATCCAGTTTGCAA GGT | | CTACAGCATAATAGTTACCC GCTCACT |
| | | SEQ ID NO:1223 | SEQ ID NO:9235 | | SEQ ID NO:17247 |
| 21-225_46B1 | | | | | |
| | AA | RASQGIRNDLG | AASSLQG | | LQHNSYPLT |
| | | SEQ ID NO:1224 | SEQ ID NO:9236 | | SEQ ID NO:17248 |
| iPS:433965 | | | | | |
| | NA | AAGTCTAGTCAGGAGAGCCTCCT GCATGGTGATGGAAAGACAT ATTTGTAT | GAAGTTCCAATCGGTTC TCT | | ATGCAAAGTATACAGCTTCC GTGGACG |
| | | SEQ ID NO:1225 | SEQ ID NO:9237 | | SEQ ID NO:17249 |
| 21-225_46F2 | | | | | |
| | AA | KSSQSLLHGDGKTYLY | EVSNRFS | | MQSIQLPWT |
| | | SEQ ID NO:1226 | SEQ ID NO:9238 | | SEQ ID NO:17250 |
| iPS:433967 | | | | | |
| | NA | CGGGCAAGTCAGGGCATTAG AGATGATTTAGGC | GCTGCATCCAGTTTGCAA AGT | | CTACAGCATTATAGTTACCC TCGGACG |
| | | SEQ ID NO:1227 | SEQ ID NO:9239 | | SEQ ID NO:17251 |
| 21-225_46C3 | | | | | |
| | AA | RASQGIRDDLG | AASSLQS | | LQHYSYPRT |
| | | SEQ ID NO:1228 | SEQ ID NO:9240 | | SEQ ID NO:17252 |
| iPS:433969 | | | | | |
| | NA | CGGGCAAGTCAGGGCATTAG AAAAGATTTAGGC | GCTGCATCCAGTTTGCAA AGT | | CTACAGCATAATAGTTACCC TCTCACT |
| | | SEQ ID NO:1229 | SEQ ID NO:9241 | | SEQ ID NO:17253 |
| 21-225_46F3 | | | | | |
| | AA | RASQGIRKDLG | AASSLQS | | LQHNSYPLT |
| | | SEQ ID NO:1230 | SEQ ID NO:9242 | | SEQ ID NO:17254 |
| iPS:433971 | | | | | |
| | NA | CGGACAAGTCAGGACATTAG AAAAGATTTAGGC | GCTGCATCCAGTTTGGA AAGT | | CTACAGCATTATAGTTCCC GTGGACG |
| | | SEQ ID NO:1231 | SEQ ID NO:9243 | | SEQ ID NO:17255 |
| 21-225_46D4 | | | | | |
| | AA | RTSQDIRKDLG | AASSLES | | LQHYSFPWT |
| | | SEQ ID NO:1232 | SEQ ID NO:9244 | | SEQ ID NO:17256 |
| iPS:433973 | | | | | |
| | NA | CGGGCGAGTCAGGGTATTAG CAACTGGTTAGCC | GCTGCATCCAGTTTGCAA AGT | | CAACAGACTAACAGTTTCCC GTGGACG |

FIGURE 49
(Continued)

| | | | | | | |
|---|---|---|---|---|---|---|
| iPS:433975 | 21-225_46A6 | AA | SEQ ID NO:1233<br>RASQGISNWLA<br>SEQ ID NO:1234 | SEQ ID NO:9245<br>AASSLQS<br>SEQ ID NO:9246 | SEQ ID NO:17257<br>QQTNSFPWT<br>SEQ ID NO:17258 | |
| iPS:433977 | 21-225_46C6 | NA | CGGGCAAGTCAGGGCATTAG<br>AAATGATTTAGGC<br>SEQ ID NO:1235 | GCTGCATCCAGTTTGCAA<br>AGT<br>SEQ ID NO:9247 | CTACAGCATAATAGTTACCC<br>TCTCACT<br>SEQ ID NO:17259 | |
| | | AA | RASQGIRNDLG<br>SEQ ID NO:1236 | AASSLQS<br>SEQ ID NO:9248 | LQHNSYPLT<br>SEQ ID NO:17260 | |
| iPS:433977 | 21-225_46D8 | NA | CGGGCAAGTCAGGGCATTAG<br>AAAAGATTTAGGC<br>SEQ ID NO:1237 | GCTGCATCCAGTTTGCAA<br>AGT<br>SEQ ID NO:9249 | CTACAGCATAATAGTTACCC<br>TCTCACT<br>SEQ ID NO:17261 | |
| | | AA | RASQGIRKDLG<br>SEQ ID NO:1238 | AASSLQS<br>SEQ ID NO:9250 | LQHNSYPLT<br>SEQ ID NO:17262 | |
| iPS:433979 | 21-225_46B9 | NA | AAGTCTAGTCAGAGCCTCCT<br>GCATAGTGAGGGAAAGACC<br>TATTTGTAT<br>SEQ ID NO:1239 | GAAGTTTCTTACCGGTTC<br>TCT<br>SEQ ID NO:9251 | ATGCACAGTATACAGTATCC<br>GCTCACG<br>SEQ ID NO:17263 | |
| | | AA | KSSQSLLHSEGKTYLY<br>SEQ ID NO:1240 | EVSYRFS<br>SEQ ID NO:9252 | MHSIQYPLT<br>SEQ ID NO:17264 | |
| iPS:433981 | 21-225_46E9 | NA | CGGGCAAGTCAGGGCATTAG<br>AAATGATTTAGGC<br>SEQ ID NO:1241 | GCTGCATCCAGTTTGCAA<br>AGT<br>SEQ ID NO:9253 | CTTCAGCATACTAGTTTCCC<br>ATTCACT<br>SEQ ID NO:17265 | |
| | | AA | RASQGIRNDLG<br>SEQ ID NO:1242 | AASSLQS<br>SEQ ID NO:9254 | LQHTSFPFT<br>SEQ ID NO:17266 | |
| iPS:433983 | 21-225_47A1 | NA | CGGGCAAGTCAGGACATTAG<br>AAATGATTTAGGC<br>SEQ ID NO:1243 | GCTGCATTCAGTTTGCAA<br>AGT<br>SEQ ID NO:9255 | CTGCAACATAATAGTTACCC<br>GCTCACT<br>SEQ ID NO:17267 | |
| | | AA | RASQDIRNDLG<br>SEQ ID NO:1244 | AAFSLQS<br>SEQ ID NO:9256 | LQHNSYPLT<br>SEQ ID NO:17268 | |

FIGURE 49
(Continued)

| | | | | | |
|---|---|---|---|---|---|
| iPS:433985 | 21-225_47C1 | NA | ACGTCTAGTCAGAGCCTCCT GCATAGTGAAGGAAAGACC TATTTGTAT | GAAGTTTCCAACCGGTTC TCT | ATGCAAAGTATACAGCTTCC GTGGACG |
| | | | SEQ ID NO:1245 | SEQ ID NO:9257 | SEQ ID NO:17269 |
| | | AA | TSSQSLLHSEGKTYLY | EVSNRFS | MQSIQLPWT |
| | | | SEQ ID NO:1246 | SEQ ID NO:9258 | SEQ ID NO:17270 |
| iPS:433987 | 21-225_47A5 | NA | CGGGCAAGTCAGGGCATTAG AAATGATTTAGGC | GCTGCATCCAGTTTGCAA AGT | CTACAGCATAATAGTTACCC GCTCACT |
| | | | SEQ ID NO:1247 | SEQ ID NO:9259 | SEQ ID NO:17271 |
| | | AA | RASQGIRNDLG | AASSLQS | LQHNSYPLT |
| | | | SEQ ID NO:1248 | SEQ ID NO:9260 | SEQ ID NO:17272 |
| iPS:433989 | 21-225_47C7 | NA | AGGTCTAGTCAGAGCCTCCT GCATAGTAATGGATACAACT ATTTGGAA | TTGGGTTTTAATCGGGCC TCC | ATGCAAGTTCTACAAACTCC ATTCACT |
| | | | SEQ ID NO:1249 | SEQ ID NO:9261 | SEQ ID NO:17273 |
| | | AA | RSSQSLLHSNGYNYLE | LGFNRAS | MQVLQTPFT |
| | | | SEQ ID NO:1250 | SEQ ID NO:9262 | SEQ ID NO:17274 |
| iPS:433991 | 21-225_47E7 | NA | AAGTCTAGTCAGAGCCTCCT GCATAGTGATGGAAGGACCT ATTTGTAT | GAAGTTTCCAGCCGGTTC TCT | ATGCAAAGTACACAACTTCC GTGGACG |
| | | | SEQ ID NO:1251 | SEQ ID NO:9263 | SEQ ID NO:17275 |
| | | AA | KSSQSLLHSDGRTYLY | EVSSRFS | MQSTQLPWT |
| | | | SEQ ID NO:1252 | SEQ ID NO:9264 | SEQ ID NO:17276 |
| iPS:433993 | 21-225_47G7 | NA | CGGGCGAGTCAGGGTATTAG CAACTGGTTAGCC | GCTGCCTCCAATTTGCAA AGT | CAACAGGTTAACAGTTTCCC GTGGACG |
| | | | SEQ ID NO:1253 | SEQ ID NO:9265 | SEQ ID NO:17277 |
| | | AA | RASQGISNWLA | AASNLQS | QQVNSFPWT |
| | | | SEQ ID NO:1254 | SEQ ID NO:9266 | SEQ ID NO:17278 |
| iPS:433995 | | NA | CGGACAAGTCAGGGCATTAG AAATGATTTAGGC | GCTGCATCCAGTTTGCAA AGT | CTACAACATACTAGTTTCCC ATTCACT |

FIGURE 49
(Continued)

| | | | | | | |
|---|---|---|---|---|---|---|
| 21-225_47H7 | | SEQ ID NO:1255 RTSQGIRNDLG | SEQ ID NO:9267 AASSLQS | SEQ ID NO:17279 LQHTSFPFT | | |
| | AA | SEQ ID NO:1256 | SEQ ID NO:9268 | SEQ ID NO:17280 | | |
| iPS:433997 | NA | CGGACAAGTCAGGGCATTAG AAATGATTTAGGC | AGAGCATCCAGTTTGCA AAGT | CTACAGCATAATTTTTACCC GTGGACG | | |
| 21-225_48C1 | | SEQ ID NO:1257 RTSQGIRNDLG | SEQ ID NO:9269 RASSLQS | SEQ ID NO:17281 LQHNFYPWT | | |
| | AA | SEQ ID NO:1258 | SEQ ID NO:9270 | SEQ ID NO:17282 | | |
| iPS:433999 | NA | CGGGCAAGTCAGAGCATTAG CAGCTATTTAATT | GCTGCATCCAGTTTGCAA AGT | CAACAGAGTAACAGTATTCC ATTCACT | | |
| 21-225_48D1 | | SEQ ID NO:1259 RASQSISSYLI | SEQ ID NO:9271 AASSLQS | SEQ ID NO:17283 QQSNSIPFT | | |
| | AA | SEQ ID NO:1260 | SEQ ID NO:9272 | SEQ ID NO:17284 | | |
| iPS:434001 | NA | CGGGCAAGTCGGGGCATTAG AGATGATTTAGGC | GCTGACATCCAGTTTGCAA AGT | CTACAGCAATATAGTTATCC TCGGACG | | |
| 21-225_48F2 | | SEQ ID NO:1261 RASRGIRDDLG | SEQ ID NO:9273 AASSLQS | SEQ ID NO:17285 LQQYSYPRT | | |
| | AA | SEQ ID NO:1262 | SEQ ID NO:9274 | SEQ ID NO:17286 | | |
| iPS:434003 | NA | CGGGCAAGTCAGAGCATTAT CAGCTATTTAATT | GCTGCATCCAGTTTGCAA AGT | CAACAGACTAACAGTATTCC ATTCACT | | |
| 21-225_48C3 | | SEQ ID NO:1263 RASQSISSYLI | SEQ ID NO:9275 AASSLQS | SEQ ID NO:17287 QQTNSIPFT | | |
| | AA | SEQ ID NO:1264 | SEQ ID NO:9276 | SEQ ID NO:17288 | | |
| iPS:434007 | NA | CGGGCGAGTCAAAATATTAC CAGCTGGTTAGCC | AGTGCATCCAGTTTGCA AAAT | CAACAGGCTAACAGTTTCCC GTGGACG | | |
| 21-225_48D7 | | SEQ ID NO:1265 RASQNITSWLA | SEQ ID NO:9277 SASSLQN | SEQ ID NO:17289 QQANSFPWT | | |
| | AA | SEQ ID NO:1266 | SEQ ID NO:9278 | SEQ ID NO:17290 | | |
| iPS:434009 | NA | CGGGCAAGTCAGGGCATTAG AAATGATTTAGGC | ATTGCATCCAGTTTGCAA AGT | CTACAGCATAATCGTTACC GTGGACG | | |

FIGURE 49
(Continued)

| | | | | | | |
|---|---|---|---|---|---|---|
| iPS:434011 | 21-225_48A9 | AA | SEQ ID NO:1267 RASQGIRNDLG SEQ ID NO:1268 | SEQ ID NO:9279 IASSLQS SEQ ID NO:9280 | | SEQ ID NO:17291 LQHNRYPWT SEQ ID NO:17292 |
| | 21-225_48B10 | NA | CGGGCAAGTCAGAGCATTAG GAAGTATTTAAAT SEQ ID NO:1269 | GCTGCTTCCAGTTTGCAA AGT SEQ ID NO:9281 | CAACAGACTTACAGTAACCC ACTCACT SEQ ID NO:17293 | |
| iPS:434013 | | AA | RASQSIRKYLN SEQ ID NO:1270 | AASSLQS SEQ ID NO:9282 | QQTYSNPLT SEQ ID NO:17294 | |
| | 21-225_48D12 | NA | CGGGCAAGTCAGGGCATTAG AAATGATTTAGGC SEQ ID NO:1271 | GCTGCATCCACTTTGCAA AGT SEQ ID NO:9283 | CTACAGCATAATAGTTACCC GCTCACT SEQ ID NO:17295 | |
| iPS:434015 | | AA | RASQGIRNDLG SEQ ID NO:1272 | AASTLQS SEQ ID NO:9284 | LQHNSYPLT SEQ ID NO:17296 | |
| | 21-225_48F12 | NA | CGGGCAAGTCAGAGCATTAG GAAGTATTTAAAT SEQ ID NO:1273 | GCTGCTTCCAGTTTGCAA AGT SEQ ID NO:9285 | CAACAGACTTACAGTAACCC GCTCACT SEQ ID NO:17297 | |
| iPS:434017 | | AA | RASQSIRKYLN SEQ ID NO:1274 | AASSLQS SEQ ID NO:9286 | QQTYSNPLT SEQ ID NO:17298 | |
| | 21-225_48G12 | NA | CGGGCAAGTCAGAGCATTAG GAAGTATTTAAAT SEQ ID NO:1275 | GCTGCTTCCAGTTTGCAA AGT SEQ ID NO:9287 | CAACAGACTTACAGTAACCC GCTCACT SEQ ID NO:17299 | |
| iPS:434019 | | AA | RASQSIRKYLN SEQ ID NO:1276 | AASSLQS SEQ ID NO:9288 | QQTYSNPLT SEQ ID NO:17300 | |
| | 21-225_49A1 | NA | CGGGCAAGTCAGGGCATTAG AAATGATTTAGAC SEQ ID NO:1277 | GCTGCATCCAGTTTGCAA AGT SEQ ID NO:9289 | CTACAGCATAATAGTTACCC GCTCACT SEQ ID NO:17301 | |
| | | AA | RASQGIRNDLD SEQ ID NO:1278 | AASSLQS SEQ ID NO:9290 | LQHNSYPLT SEQ ID NO:17302 | |

FIGURE 49
(Continued)

| | | | | | |
|---|---|---|---|---|---|
| iPS:434021 | 21-225_49C1 | NA | AAGTCTAGTCAGAGCCTCCTGCATAGGGAAGGAAAGACCTATTTGTAC SEQ ID NO:1279 | GAAGTTTCCCACCGGTTCTCT SEQ ID NO:9291 | ATGCAAAGTATACAGATTCCGATCACC SEQ ID NO:17303 |
| | | AA | KSSQSLLHREGKTYLY SEQ ID NO:1280 | EVSHRFS SEQ ID NO:9292 | MQSIQPIT SEQ ID NO:17304 |
| iPS:434023 | 21-225_49F1 | NA | CGGGGCGAGTCGGGATATTAACGGCTGGTTAGCC SEQ ID NO:1281 | ACTGTCTCCAGTTTGCAAAGT SEQ ID NO:9293 | CAACAGTCTAACAGTTTCCCATTCACT SEQ ID NO:17305 |
| | | AA | RASRDINGWLA SEQ ID NO:1282 | TVSSLQS SEQ ID NO:9294 | QQSNSFPFT SEQ ID NO:17306 |
| iPS:434025 | 21-225_49G3 | NA | AAGTCTAGTCAGAGCCTCCTGCATAGTGAAGGAAAGACCTATTTGTAT SEQ ID NO:1283 | GAAGTTTCCAACCGGCTCTCT SEQ ID NO:9295 | ATGCAAAGTATGCAGCTTCCGATCACC SEQ ID NO:17307 |
| | | AA | KSSQSLLHSEGKTYLY SEQ ID NO:1284 | EVSNRLS SEQ ID NO:9296 | MQSMQLPIT SEQ ID NO:17308 |
| iPS:434027 | 21-225_49H5 | NA | CGGGGCGAGTCAGGGTTTTAGCACCTGGTTAGCC SEQ ID NO:1285 | GCTGCATCCAGTTTGCAAGAT SEQ ID NO:9297 | CAACAGACTAACAGTTTCCCGTTCACT SEQ ID NO:17309 |
| | | AA | RASQGFSTWLA SEQ ID NO:1286 | AASSLQD SEQ ID NO:9298 | QQTNSFPFT SEQ ID NO:17310 |
| iPS:434029 | 21-225_49C6 | NA | CGGGCAAGTCAGGGCATTAGAAATGATTAGGC SEQ ID NO:1287 | GCTGCATCCAGTTTGCAAAGT SEQ ID NO:9299 | CTACAGCATAATAGTTACCCTCTCACT SEQ ID NO:17311 |
| | | AA | RASQGIRNDLG SEQ ID NO:1288 | AASSLQS SEQ ID NO:9300 | LQHNSYPLT SEQ ID NO:17312 |
| iPS:434031 | 21_225_49E7 | NA | AAGTCTAGTCAGATCTTCTTGCATAGTGAAGGAAAGACCTATTTGTAT | GAAGTTTCCAAGCGGCTCTCT | ATGCAAAGTATGCAGCTTCCGATTATC |

FIGURE 49
(Continued)

| | | | SEQ ID NO:1289 | | SEQ ID NO:9301 | | SEQ ID NO:17313 |
|---|---|---|---|---|---|---|---|
| iPS:434033 | 21-225_49E7 | AA | KSSQIFLHSEGKTYLY | | EVSKRLS | | MQSMQLPII |
| | | | SEQ ID NO:1290 | | SEQ ID NO:9302 | | SEQ ID NO:17314 |
| iPS:434035 | 21-225_49F9 | NA | AAGTCTAATCAGAGAGCCTCGT GCATAATGAAGGAAAGACC TATTTGTAT | | GAAGTTTCCAACCGGTTC TCT | | ATGCAAAGTATACAGTATCC GATCACC |
| | | | SEQ ID NO:1291 | | SEQ ID NO:9303 | | SEQ ID NO:17315 |
| | | AA | KSNQSLVHNEGKTYLY | | EVSNRFS | | MQSIQYPIT |
| | | | SEQ ID NO:1292 | | SEQ ID NO:9304 | | SEQ ID NO:17316 |
| iPS:434037 | 21-225_49F10 | NA | CGGGGCGAGTCAGGGTATTAG CAGGTGGTTAGCC | | GCTGCATCCACTTTGCAA AGT | | CAACAGGCTAACAGTTTCCC ATTCACT |
| | | | SEQ ID NO:1293 | | SEQ ID NO:9305 | | SEQ ID NO:17317 |
| | | AA | RASQGISRWLA | | AASTLQS | | QQANSFPFT |
| | | | SEQ ID NO:1294 | | SEQ ID NO:9306 | | SEQ ID NO:17318 |
| iPS:434039 | 21-225_49G12 | NA | CGGTCAAGTCAGAGCATTAG TACCTATTTAATG | | GCTGCATCCAGTTTGCAA ATT | | CAACAGAGTTACAGTATCCC ATTCACT |
| | | | SEQ ID NO:1295 | | SEQ ID NO:9307 | | SEQ ID NO:17319 |
| | | AA | RSSQSISTYLM | | AASSLQI | | QQSYSIPFT |
| | | | SEQ ID NO:1296 | | SEQ ID NO:9308 | | SEQ ID NO:17320 |
| iPS:434039 | 21-225_43B1 | NA | CGGGCAAGTCAGGGCATTAG AAATGATTTAGGC | | GCTGCATCCAGTTTGCAA AGT | | CTACAGCATACTAGTTTCCC ATTCACT |
| | | | SEQ ID NO:1297 | | SEQ ID NO:9309 | | SEQ ID NO:17321 |
| | | AA | RASQGIRNDLG | | AASSLQS | | LQHTSFPFT |
| | | | SEQ ID NO:1298 | | SEQ ID NO:9310 | | SEQ ID NO:17322 |
| iPS:434041 | 21-225_50H8 | NA | CGGGCAAGTCAGAGCATTAG CAGCTATTTAATT | | GCTGCATCCAGTCTGCA AAGT | | CAACAGAGTAACAGTCTTCC ATTCACT |
| | | | SEQ ID NO:1299 | | SEQ ID NO:9311 | | SEQ ID NO:17323 |
| | | AA | RASQSISSYLI | | AASSLQS | | QQSNSLPFT |
| | | | SEQ ID NO:1300 | | SEQ ID NO:9312 | | SEQ ID NO:17324 |

FIGURE 49
(Continued)

| | | | | | |
|---|---|---|---|---|---|
| iPS:434043 | 21-225_50G10 | NA | CGGGCAAGTCAGGGCATTAG AAATAATTAGGC SEQ ID NO:1301 | GCTGCATCCAGTTTGCAA AGT SEQ ID NO:9313 | CTACAGTATAATAGTTACCC GTTCACT SEQ ID NO:17325 |
| | | AA | RASQGIRNNLG SEQ ID NO:1302 | AASSLQS SEQ ID NO:9314 | LQYNSYPFT SEQ ID NO:17326 |
| iPS:434045 | 21-225_50H10 | NA | CGGGCAAGTCAGAGAGCATTTA CAGCTATTTAATT SEQ ID NO:1303 | GCTGCATCCAGTTTGCAA AGT SEQ ID NO:9315 | CAACAGAGTAACAGTATTCC ATTCACT SEQ ID NO:17327 |
| | | AA | RASQSIYSYLI SEQ ID NO:1304 | AASSLQS SEQ ID NO:9316 | QQSNSIPFT SEQ ID NO:17328 |
| iPS:434047 | 21-225_50A12 | NA | CGGGCAAGTCAGGGCATTAG AAATGATTTAGGC SEQ ID NO:1305 | ACTGCATCCAATTTACAA AGT SEQ ID NO:9317 | CTACAGCATAATAGTTACCC GTGGACG SEQ ID NO:17329 |
| | | AA | RASQGIRNDLG SEQ ID NO:1306 | TASNLQS SEQ ID NO:9318 | LQHNSYPWT SEQ ID NO:17330 |
| iPS:434049 | 21-225_50B12 | NA | CGGGCAAGTCAGAGAGCATTAG TAGTTATTTAAAT SEQ ID NO:1307 | GCTGCATCCAGTTTGCAA AGT SEQ ID NO:9319 | CAACAGAGTTACACATTGCCCC ATTCACT SEQ ID NO:17331 |
| | | AA | RASQSISSYLN SEQ ID NO:1308 | AASSLQS SEQ ID NO:9320 | QQSY1APFT SEQ ID NO:17332 |
| iPS:434053 | 21-225_51E1 | NA | AAGTCTAGTCAGAGCCTCCT GCATAGTGAGGGAAAGACC TATTTGTAT SEQ ID NO:1309 | GAAGTTTCCAACGGTTC TCT SEQ ID NO:9321 | ATGCAAAGTATACAGCTTCC ATTCACT SEQ ID NO:17333 |
| | | AA | KSSQSLLHSEGKTYLY SEQ ID NO:1310 | EVSNRFS SEQ ID NO:9322 | MQSIQLPFT SEQ ID NO:17334 |
| iPS:434055 | 21-225_51B4 | NA | CAGGCGAGTCGGGACATTAC CTTCTATTTAAAT SEQ ID NO:1311 | GATGCATCCAATTTGGA AACA SEQ ID NO:9323 | CAACAGTATGATAATCTTCC ATTCACT SEQ ID NO:17335 |
| | | AA | QASRDITFYLN | DASNLET | QQYDNLPFT |

FIGURE 49
(Continued)

| | | | | | |
|---|---|---|---|---|---|
| iPS:434057 | 21-225_51E4 | NA | SEQ ID NO:1312 CGGGCAAGTCAGGGCATTAG AAATGATTTAGGC | SEQ ID NO:9324 GCTGCATCCAGTTTGCAA AGT | SEQ ID NO:17336 CTACAGCATAATAGTTACCC ATTCACT |
| | | AA | SEQ ID NO:1313 RASQGIRNDLG | SEQ ID NO:9325 AASSLQS | SEQ ID NO:17337 LQHNSYPFT |
| iPS:434059 | 21-225_51C5 | NA | SEQ ID NO:1314 CGGGCGAGTCAGGGCATTAG CAATTATTTAGCC | SEQ ID NO:9326 GCTGCATCCAGTTTGCGA AGT | SEQ ID NO:17338 CAACAGTATTATAGTTACCC ATTCACT |
| | | AA | SEQ ID NO:1315 RASQGISNYLA | SEQ ID NO:9327 AASSLRS | SEQ ID NO:17339 QQYYSYPFT |
| iPS:434061 | 21-225_51C7 | NA | SEQ ID NO:1316 CGGGCGAGTCAGGATGTTAA CAACTACTTAGCC | SEQ ID NO:9328 GCTGCATCCAGTTTGCAA AAT | SEQ ID NO:17340 CAACAAACTAACAGTTTCCC ATTCACT |
| | | AA | SEQ ID NO:1317 RASQDVNNYLA | SEQ ID NO:9329 AASSLQN | SEQ ID NO:17341 QQTNSFPFT |
| iPS:434063 | 21-225_51G7 | NA | SEQ ID NO:1318 CGGGCCAGTCAGGATATTAG CAGTTGGTTAGCC | SEQ ID NO:9330 GCTCCATCCAATTTGCAA AGT | SEQ ID NO:17342 CAACAGGCTCACAGTTTCCC GTGGACG |
| | | AA | SEQ ID NO:1319 RASQDISSWLA | SEQ ID NO:9331 APSNLQS | SEQ ID NO:17343 QQAHSFPWT |
| iPS:434065 | 21-225_50D4 | NA | SEQ ID NO:1320 CGGGCGAGTCAGGGTATTAG CAGGTGGTTAGCC | SEQ ID NO:9332 GCTGCATCCACTTTGCAA AGT | SEQ ID NO:17344 CAACAGGCTAACAGTTTCCC ATTCACT |
| | | AA | SEQ ID NO:1321 RASQGISRWLA | SEQ ID NO:9333 AASTLQS | SEQ ID NO:17345 QQANSFPFT |
| iPS:434067 | 21-225_51H8 | NA | SEQ ID NO:1322 CGGGCAAGTCAGGGCATTAG AAATGATTTGGGC | SEQ ID NO:9334 GCTGCTTCCAGTTTGCAA AGT | SEQ ID NO:17346 CTACAGCATAATAGTTACCC GTGGACG |
| | | AA | SEQ ID NO:1323 RASQGIRNDLG | SEQ ID NO:9335 AASSLQS | SEQ ID NO:17347 LQHNSYPWT |

FIGURE 49
(Continued)

| | | | | | |
|---|---|---|---|---|---|
| iPS:434069 | 21-225_51E9 | NA | SEQ ID NO:1324 CGGGCGAAGTCAGGGTATTAG CAGTTGGTTAGCC | SEQ ID NO:9336 GTTGCATCCAGTTTGCAA AGT | SEQ ID NO:17348 CAACAGGCTAAAAGTTTCCC ATTCACT |
| | | AA | SEQ ID NO:1325 RASQGISSWLA | SEQ ID NO:9337 VASSLQS | SEQ ID NO:17349 QQAKSFPFT |
| iPS:434071 | 21-225_51F9 | NA | SEQ ID NO:1326 CGGGCAAGTCAGGGCATTAG GACTGATTTAGGC | SEQ ID NO:9338 GCTGCATCCAGTTTGCAA CGT | SEQ ID NO:17350 CTACAGCATAATAGTTACCC ATTCACT |
| | | AA | SEQ ID NO:1327 RASQGIRTDLG | SEQ ID NO:9339 AASSLQR | SEQ ID NO:17351 LQHNSYPFT |
| iPS:434073 | 21-225_51H10 | NA | SEQ ID NO:1328 CGGGCAAGTCAGAGCATTAG TACCTATTTAATG | SEQ ID NO:9340 GCTGCATCCAGTTTGCAA AGT | SEQ ID NO:17352 CAACAGAGTTACAGTATCCC ATTCACT |
| | | AA | SEQ ID NO:1329 RASQSISTYLM | SEQ ID NO:9341 AASSLQS | SEQ ID NO:17353 QQSYSIPFT |
| iPS:434075 | 21-225_51B11 | NA | SEQ ID NO:1330 CGGACAAGTCAGGGCATTAG AAATGATTTAGGC | SEQ ID NO:9342 GCTGCATCCAGTTTGCAA AGT | SEQ ID NO:17354 CTACAGCATAATAGTTACCC ATTCACT |
| | | AA | SEQ ID NO:1331 RTSQGIRNDLG | SEQ ID NO:9343 AASSLQS | SEQ ID NO:17355 LQHNSYPFT |
| iPS:434077 | 21-225_51F11 | NA | SEQ ID NO:1332 CGGGCAAGTCAGGGCATTAG AAATGATTTAGGC | SEQ ID NO:9344 GCTGCATCCAGTTTGCAA AGT | SEQ ID NO:17356 CTACAGCATAATAGTTACCC GTTCACT |
| | | AA | SEQ ID NO:1333 RASQGIRNDLG | SEQ ID NO:9345 AASSLQS | SEQ ID NO:17357 LQHNSYPFT |
| iPS:434079 | 21-225_52B1 | NA | SEQ ID NO:1334 CGGGCGAGTCAGGATATTCG CACCTGGTTAGCC | SEQ ID NO:9346 GCTGCATCCAGTTTGCAA AAT | SEQ ID NO:17358 CAACAGGCTAAAAGTTTCCC ATTCACT |
| | | AA | SEQ ID NO:1335 RASQDIRTWLA | SEQ ID NO:9347 AASSLQN | SEQ ID NO:17359 QQAKSFPFT |

FIGURE 49
(Continued)

| | | | | | |
|---|---|---|---|---|---|
| iPS:434081 | 21-225_52B2 | NA | SEQ ID NO:1336 CGGGCAAGTCAGGGCATTAG AAATGATTTAGGC | SEQ ID NO:9348 GCTGCATCCTTTTGCAA AGT | SEQ ID NO:17360 CTGCAGCATAATAGCTACCC TCTCACT |
| | | AA | SEQ ID NO:1337 RASQGIRNDLG | SEQ ID NO:9349 AASFLQS | SEQ ID NO:17361 LQHNSYPLT |
| iPS:434083 | 21-225_52H2 | NA | SEQ ID NO:1338 CGGGCGAGTCAGAATATTAC CAACTGGTTAGCC | SEQ ID NO:9350 ACTACATCCAGTTTGCAA AGT | SEQ ID NO:17362 CAACAGACTAACAGTTTCCC GTGGACG |
| | | AA | SEQ ID NO:1339 RASQNITNWLA | SEQ ID NO:9351 TTSSLQS | SEQ ID NO:17363 QQTNSFPWT |
| iPS:434085 | 21-225_52E3 | NA | SEQ ID NO:1340 CGGGCGAGTCAGGGCATTAG CAATTATTTAGCC | SEQ ID NO:9352 GCTGCATCCAGTTTACAA AGT | SEQ ID NO:17364 CAACAGTATAATAGTTTCCC TTTCACT |
| | | AA | SEQ ID NO:1341 RASQGISNYLA | SEQ ID NO:9353 AASSLQS | SEQ ID NO:17365 QQYNSFPFT |
| iPS:434087 | 21-225_52F6 | NA | SEQ ID NO:1342 CAGGCGAGTCAGGACATTAG TAACTATTTACAT | SEQ ID NO:9354 GATGCATCCACTTTGGG AACA | SEQ ID NO:17366 CAACAGTGTGATAATCTCCC GCTCACT |
| | | AA | SEQ ID NO:1343 QASQDISNYLH | SEQ ID NO:9355 DASTLGT | SEQ ID NO:17367 QQCDNLPLT |
| iPS:434091 | 21-225_52B9 | NA | SEQ ID NO:1344 CGGGCAAGTCAGGGCATTAG AAATGATTTAGGC | SEQ ID NO:9356 GCTGCATCCAGTTTGCAA AGT | SEQ ID NO:17368 CTACAGCATAATAGTTACCC ATTCACT |
| | | AA | SEQ ID NO:1345 RASQGIRNDLG | SEQ ID NO:9357 AASSLQS | SEQ ID NO:17369 LQHNSYPFT |
| iPS:434093 | 21-225_52D10 | NA | SEQ ID NO:1346 AAGTCTAGTCAGAGCCTCCT GCATAGTGAAGGAAAGACC TATTTGTAT | SEQ ID NO:9358 GAAGTTCCAACCGGT CTCT | SEQ ID NO:17370 ATGCAAAGTATACAGTATCC GATCACC |
| | | | SEQ ID NO:1347 | SEQ ID NO:9359 | SEQ ID NO:17371 |

FIGURE 49
(Continued)

| | | | | | |
|---|---|---|---|---|---|
| | | KSSQSLLHSEGKTYLY | | EVSNRVS | MQSIQYPT |
| | AA | SEQ ID NO:1348 | | SEQ ID NO:9360 | SEQ ID NO:17372 |
| iPS:434095 | NA | CGGGCGAGTCAGGGTATTAG TAATTATTTAGGC | | GCTGCATCTAGTTTGCAA AGT | CAACAGTATAATAGTTATCC TCCGACG |
| | | SEQ ID NO:1349 | | SEQ ID NO:9361 | SEQ ID NO:17373 |
| 21-225_52F10 | AA | RASQGISNYLG | | AASSLQS | QQYNSYPPT |
| | | SEQ ID NO:1350 | | SEQ ID NO:9362 | SEQ ID NO:17374 |
| iPS:434097 | NA | CGGGCGAGTCAGGATATTAA CAGTTGGTTAGCC | | GTTGCATCCAGTTTGCAA AGT | CAACAGGCTAAAAGTTTCCC ATTCACT |
| | | SEQ ID NO:1351 | | SEQ ID NO:9363 | SEQ ID NO:17375 |
| 21-225_52H10 | AA | RASQDINSWLA | | VASSLQS | QQAKSFPFT |
| | | SEQ ID NO:1352 | | SEQ ID NO:9364 | SEQ ID NO:17376 |
| iPS:434101 | NA | CGGGCAAGTCAGGGCATAA GAAATAATTTAGGC | | GGTGCATCCAGTTTGCA AAGT | CTACAGTATAATAGTTATCC ATTCACT |
| | | SEQ ID NO:1353 | | SEQ ID NO:9365 | SEQ ID NO:17377 |
| 21-225_52H12 | AA | RASQGIRNNLG | | GASSLQS | LQYNSYPFT |
| | | SEQ ID NO:1354 | | SEQ ID NO:9366 | SEQ ID NO:17378 |
| iPS:434103 | NA | CGGGCAAGTCAGGGCATTAG AAATGATTTAGGC | | CCTGCATCCAGTTTACAA AGT | CTACAGGATAATAGTTACCC ATTCACT |
| | | SEQ ID NO:1355 | | SEQ ID NO:9367 | SEQ ID NO:17379 |
| 21-225_53G1 | AA | RASQGIRNDLG | | PASSLQS | LQDNSYPFT |
| | | SEQ ID NO:1356 | | SEQ ID NO:9368 | SEQ ID NO:17380 |
| iPS:434105 | NA | CGGGCAAGTCAGGGCATTAG AAATGATTTAGGC | | GCTGCATCCAGTTTGCAA AGT | CTACAACATAATAGATACCC GCTCACT |
| | | SEQ ID NO:1357 | | SEQ ID NO:9369 | SEQ ID NO:17381 |
| 21-225_53D2 | AA | RASQGIRNDLG | | AASSLQS | LQHNRYPLT |
| | | SEQ ID NO:1358 | | SEQ ID NO:9370 | SEQ ID NO:17382 |
| iPS:434107 | NA | CGGGCAAGTCAGAGAGTTTTAG CCACTATTTAAAT | | GCTGTATCCAGTTTGCAA AGT | CAACAGAGTTTCAGTACCCC ATTCACT |
| | | SEQ ID NO:1359 | | SEQ ID NO:9371 | SEQ ID NO:17383 |
| 21-225_53E2 | NA | | | | |

FIGURE 49
(Continued)

| | | | RASQSFSHYLN | | AVSSLQS | | QQSFSTPFT | |
|---|---|---|---|---|---|---|---|---|
| | | AA | SEQ ID NO:1360 | | SEQ ID NO:9372 | | SEQ ID NO:17384 | |
| iPS:434111 | 21-225_53H2 | NA | CAGGCGAGTCAGGACATTAG CAACTATTTACAT | SEQ ID NO:1361 | GATGCATCCAATTTGGA AACA | SEQ ID NO:9373 | CATCAGTATGATAATCTCCC GCTCACT | SEQ ID NO:17385 |
| | | AA | QASQDISNYLH | SEQ ID NO:1362 | DASNLET | SEQ ID NO:9374 | HQYDNLPLT | SEQ ID NO:17386 |
| iPS:434115 | 21-225_53E4 | NA | CGGGCGAGTCAGGTCATTAG CAATTATTTAGCC | SEQ ID NO:1363 | GCTGCATCCAGTTTGCAA AGT | SEQ ID NO:9375 | CAACAGTATCATAGTTACCC ACTCACT | SEQ ID NO:17387 |
| | | AA | RASQVISNYLA | SEQ ID NO:1364 | AASSLQS | SEQ ID NO:9376 | QQYHSYPLT | SEQ ID NO:17388 |
| iPS:434117 | 21-225_53C6 | NA | CGGGCAAGTCAGTACAGTAG CGACTATTTAAAT | SEQ ID NO:1365 | GCTGCATCCAGTTTGAA AAGT | SEQ ID NO:9377 | CAACAGAGTTACAGTACCCC GTTCACC | SEQ ID NO:17389 |
| | | AA | RASQYSSDYLN | SEQ ID NO:1366 | AASSLKS | SEQ ID NO:9378 | QQSYSTPFT | SEQ ID NO:17390 |
| iPS:434119 | 21-225_53E6 | NA | CGGGCAAGTCAGGGCATTAG AAATGATTTAGGC | SEQ ID NO:1367 | GCTGCATCCAATTTGCAA AGT | SEQ ID NO:9379 | CTACAACATAATCGTTACCC GCTCACT | SEQ ID NO:17391 |
| | | AA | RASQGIRNDLG | SEQ ID NO:1368 | AASNLQS | SEQ ID NO:9380 | LQHNRYPLT | SEQ ID NO:17392 |
| iPS:434121 | 21-225_53F6 | NA | CAGGCGAGTCAAGACATTAC CAACTATTTAGAT | SEQ ID NO:1369 | GATGCATCCAATTTGGG AACA | SEQ ID NO:9381 | CAACAGTGTGATAATCTCCC GCTCACT | SEQ ID NO:17393 |
| | | AA | QASQDITNYLD | SEQ ID NO:1370 | DASNLGT | SEQ ID NO:9382 | QQCDNLPLT | SEQ ID NO:17394 |
| iPS:434123 | 21-225_53F7 | NA | CGGGCGAGTCAGGGTATTAG CAGGTGGTTAGCC | SEQ ID NO:1371 | GCTGCATCCAGTTTGCAA AGT | SEQ ID NO:9383 | CAGCAGGCTAACAGTTTCCC ATTCACT | SEQ ID NO:17395 |

FIGURE 49
(Continued)

| | | | | | | |
|---|---|---|---|---|---|---|
| iPS:434127 | | AA | RASQGISRWLA SEQ ID NO:1372 | AASSLQS SEQ ID NO:9384 | QQANSFPFT SEQ ID NO:17396 |
| | 21-225_53H8 | NA | AGGGCCAGTCAGTCAGAGTATTAC AAGCAGCTACTTAGCC SEQ ID NO:1373 | GGTGCGTCCGGCAGGGC CACT SEQ ID NO:9385 | CAGCAGTTTGAAAGCTCACC CATGTGCAGT SEQ ID NO:17397 |
| iPS:434129 | | AA | RASQSITSSYLA SEQ ID NO:1374 | GASGRAT SEQ ID NO:9386 | QQFESSPMCS SEQ ID NO:17398 |
| | 21-225_53B12 | NA | CGGGCAAGTCAGGGCATTAG AAATGATTTAGGC SEQ ID NO:1375 | GCTGCATCCAGTTTGCAA AGT SEQ ID NO:9387 | CTACAGCATAATAGTTACCC ATTCACT SEQ ID NO:17399 |
| iPS:434131 | | AA | RASQGIRNDLG SEQ ID NO:1376 | AASSLQS SEQ ID NO:9388 | LQHNSYPFT SEQ ID NO:17400 |
| | 21-225_54D3 | NA | CGGGCAAGTCAGGGCATTAG AATGATTTAGGC SEQ ID NO:1377 | GCTGCATCCAGTTTGCAA AGT SEQ ID NO:9389 | CTACAACATAATAGTTACCC ATTCACT SEQ ID NO:17401 |
| iPS:434133 | | AA | RASQGIRNDLG SEQ ID NO:1378 | AASSLQS SEQ ID NO:9390 | LQHNSYPFT SEQ ID NO:17402 |
| | 21-225_54G3 | NA | CGGGCAAGTCAGGGTATTAG CAGCTGGTTAGCC SEQ ID NO:1379 | GATGCATCCAGTTTGCA AAGT SEQ ID NO:9391 | CAACAGGCTAACAGTTTCCC GTGGACG SEQ ID NO:17403 |
| iPS:434135 | | AA | RASQGISSWLA SEQ ID NO:1380 | DASSLQS SEQ ID NO:9392 | QQANSFPWT SEQ ID NO:17404 |
| | 21-225_54H3 | NA | CGGGCAAGTCAGGACATTAG AAATATTTAGGC SEQ ID NO:1381 | GCTGCATCCAATTTGCAA AGT SEQ ID NO:9393 | CTACAGTATATAATAGTTACCC GTGGACG SEQ ID NO:17405 |
| iPS:434137 | | AA | RASQDIRNILG SEQ ID NO:1382 | AASNLQS SEQ ID NO:9394 | LQYNSYPWT SEQ ID NO:17406 |
| | 21_225_54D4 | NA | AAGTCTAGTCAGAGCCTCCT GCATAGTGAGGGAAAGACC TATTTGTAT | GAAGTTTCCAACCGGTTC TCT | ATGCAAAGTATACAGTTTCC ATTCACT |

FIGURE 49
(Continued)

| | | | | | | |
|---|---|---|---|---|---|---|
| iPS:434141 | 21-225_54D4 | AA | SEQ ID NO:1383<br>KSSQSLLHSEGKTYLY | SEQ ID NO:9395<br>EVSNRFS | SEQ ID NO:17407<br>MQSIQPPFT | |
| | | NA | SEQ ID NO:1384<br>CGGGCAAGTCAGGGCATTAG<br>AAATGATTTAGGC | SEQ ID NO:9396<br>GCTGCATCCAATTTGCAA<br>AGT | SEQ ID NO:17408<br>CTACAGCATAATCGTTACCC<br>GCTCACT | |
| iPS:434143 | 21-225_54C6 | AA | SEQ ID NO:1385<br>RASQGIRNDLG | SEQ ID NO:9397<br>AASNLQS | SEQ ID NO:17409<br>LQHNRYPLT | |
| | | NA | SEQ ID NO:1386<br>CGGGCAAGTCAGGGCATTAG<br>AAATGATTTAGGC | SEQ ID NO:9398<br>GCTGCATCCAGTTTGCAA<br>AGT | SEQ ID NO:17410<br>CTACATCATAATACTTACCC<br>ATTCACT | |
| iPS:434145 | 21-225_54G7 | AA | SEQ ID NO:1387<br>RASQGIRNDLG | SEQ ID NO:9399<br>AASSLQS | SEQ ID NO:17411<br>LHHNTYPFT | |
| | | NA | SEQ ID NO:1388<br>CGGGCGAGTCAGGTTATTAG<br>CCGCTGGTTAGCC | SEQ ID NO:9400<br>GCTGCATCCAGTTTGCAA<br>AGT | SEQ ID NO:17412<br>CAACAGGCTAACAGTTTCCC<br>ATTCACT | |
| iPS:434147 | 21-225_55B1 | AA | SEQ ID NO:1389<br>RASQVISRWLA | SEQ ID NO:9401<br>AASSLQS | SEQ ID NO:17413<br>QQANSPPFT | |
| | | NA | SEQ ID NO:1390<br>AGGGCCAGTCAGAGTGTTAG<br>CAGCGACTTAGCC | SEQ ID NO:9402<br>GATGCATCCGCCAGGGC<br>CACT | SEQ ID NO:17414<br>CAGCAGTATTATAACTGGCC<br>TCTCACT | |
| iPS:434149 | 21-225_55E1 | AA | SEQ ID NO:1391<br>RASQSVSSDLA | SEQ ID NO:9403<br>DASARAT | SEQ ID NO:17415<br>QQYYNWPLT | |
| | | NA | SEQ ID NO:1392<br>AAATCTAGTCAGAGCCTCCT<br>GCATAGTGAAGGAAAGACC<br>TATTTGTAT | SEQ ID NO:9404<br>GAAGTTTCCCACCGGTTC<br>TCT | SEQ ID NO:17416<br>ATGCAAAGTATACAGCTTCC<br>ATTCACT | |
| | 21-225_55H1 | AA | SEQ ID NO:1393<br>KSSQSLLHSEGKTYLY | SEQ ID NO:9405<br>EVSHRFS | SEQ ID NO:17417<br>MQSIQLPFT | |
| | | | SEQ ID NO:1394 | SEQ ID NO:9406 | SEQ ID NO:17418 | |

FIGURE 49
(Continued)

| | | | | | |
|---|---|---|---|---|---|
| iPS:434151 | 21-225_55C2 | NA | AAGTCTAGTCAGAGCCTCGTGCATAGTGAAGGAAAGACCTATTTGTAT SEQ ID NO:1395 | GAAGTTTCCAACCGGGTCTCT SEQ ID NO:9407 | ATGCAAAGTATACTGTATCCGATCACC SEQ ID NO:17419 |
| | | AA | KSSQSLVHSEGKTYLY SEQ ID NO:1396 | EVSNRVS SEQ ID NO:9408 | MQSILYPIT SEQ ID NO:17420 |
| iPS:434155 | 21-225_55B3 | NA | CGGGCAAGTCAGGGCATTAGAAATGATTTAGGC SEQ ID NO:1397 | GCTGCATCCAGTTGCAAAGT SEQ ID NO:9409 | CTACAACATAATAGTTACCCATTCACT SEQ ID NO:17421 |
| | | AA | RASQGIRNDLG SEQ ID NO:1398 | AASSLQS SEQ ID NO:9410 | LQHNSYPFT SEQ ID NO:17422 |
| iPS:434157 | 21-225_55D4 | NA | CGGGCGAGTCAGGACACATTAGCAATTATTTAATC SEQ ID NO:1399 | ACTGCATCCAGTTGCAAAGT SEQ ID NO:9411 | CAACAGTATCATAGTTTCCCTCTCACT SEQ ID NO:17423 |
| | | AA | RASQDISNYLI SEQ ID NO:1400 | TASSLQS SEQ ID NO:9412 | QQYHSFPLT SEQ ID NO:17424 |
| iPS:434159 | 21-225_55B8 | NA | CGGGCAAGTCAGGCCATTAGAAATGATTTAGGC SEQ ID NO:1401 | GCTGCATTCAGGTTGCAAAGT SEQ ID NO:9413 | CTACAGCATAATAGTTACCCTCTCACT SEQ ID NO:17425 |
| | | AA | RASQAIRNDLG SEQ ID NO:1402 | AAFRLQS SEQ ID NO:9414 | LQHNSYPLT SEQ ID NO:17426 |
| iPS:434161 | 21-225_55F9 | NA | AAGTCTAGTCAAAGCCTCCTGCATAGTGAAGGAAAGACCTATTTGTAT SEQ ID NO:1403 | GAAGTTTCCAACCGGTTCTCT SEQ ID NO:9415 | ATACAAAGTATACAACTTCCGATCACC SEQ ID NO:17427 |
| | | AA | KSSQSLLHSEGKTYLY SEQ ID NO:1404 | EVSNRFS SEQ ID NO:9416 | IQSIQLPIT SEQ ID NO:17428 |
| iPS:434163 | 21-225_50H1 | NA | CAGGCGAGTCAAGACATTAGCAACTATTTAGAT SEQ ID NO:1405 | GATGCATCCAATTTGGAAACA SEQ ID NO:9417 | CAACAGTGTGATAATCTCCCGCTCACT SEQ ID NO:17429 |

FIGURE 49
(Continued)

|   |   |   | AA | QASQDISNYLD | DASNLET | QQCDNLPLT |
|---|---|---|---|---|---|---|
|   |   |   |   | SEQ ID NO:1406 | SEQ ID NO:9418 | SEQ ID NO:17430 |
| iPS:434165 | 21-225_50F2 | | NA | CGGGCAAGTCAGAGCATTCT CAGCTATTTGAAT SEQ ID NO:1407 | GTTGCATCCAGTTTCCAA AGT SEQ ID NO:9419 | CAACAGAGTTACAGTCCCC TCTCACT SEQ ID NO:17431 |
|   |   |   | AA | RASQSILSYLN SEQ ID NO:1408 | VASSFQS SEQ ID NO:9420 | QQSYSPPLT SEQ ID NO:17432 |
| iPS:434167 | 21-225_50F3 | | NA | CGGGCGAGTCAGGATATTAG CAGCTGGTTGGCC SEQ ID NO:1409 | GCTGCATCCAGTTTGCAA AAT SEQ ID NO:9421 | CAACAGACTAACAGTTCC ATTCACT SEQ ID NO:17433 |
|   |   |   | AA | RASQDISSWLA SEQ ID NO:1410 | AASSLQN SEQ ID NO:9422 | QQTNSFPFT SEQ ID NO:17434 |
| iPS:434169 | 21-225_50C4 | | NA | CGGGCAAGTCAGGCATTAG AAATGATTAGGC SEQ ID NO:1411 | GCTGCATCCAGTTTGCAA AGT SEQ ID NO:9423 | CTACAGCATAATCGTTACC ATTCACT SEQ ID NO:17435 |
|   |   |   | AA | RASQGIRNDLG SEQ ID NO:1412 | AASSLQS SEQ ID NO:9424 | LQHNRYPFT SEQ ID NO:17436 |
| iPS:434171 | 21-225_50G4 | | NA | CAGGCGAGTCAGGACATTAC CAACTTTTAAAT SEQ ID NO:1413 | GATGCCTCCAATTTGGA AACA SEQ ID NO:9425 | CAACAGTATGATAATCTGAT CACC SEQ ID NO:17437 |
|   |   |   | AA | QASQDITNFLN SEQ ID NO:1414 | DASNLET SEQ ID NO:9426 | QQYDNLIT SEQ ID NO:17438 |
| iPS:434175 | 21-225_55A11 | | NA | CGGGCGAGTCAGGACATTAA CATTTATTTAGCC SEQ ID NO:1415 | GCTGCATCCAGTTTGCAA AGT SEQ ID NO:9427 | CAACAGTATAATAGTTATCC TCTCACT SEQ ID NO:17439 |
|   |   |   | AA | RASQDINIYLA SEQ ID NO:1416 | AASSLQS SEQ ID NO:9428 | QQYNSYPLT SEQ ID NO:17440 |
| iPS:434177 | 21_225_56A1 | | NA | AAGTCCAGCCAGAGTGTTTT ACATAGTTCCAACAATAAGA ACTACTTAGTT | TGGGCATCTACCCGGGA ATCC | CAGCAATATTATAGTACTCC TCCGACG |

FIGURE 49
(Continued)

| | | | | | | | |
|---|---|---|---|---|---|---|---|
| iPS:434179 | 21-225_56A1 | AA | SEQ ID NO:1417 KSSQSVLHSSNNKNYLV | SEQ ID NO:9429 WASTRES | SEQ ID NO:17441 QQYYSTPPT | | |
| | | NA | SEQ ID NO:1418 CGGGCAAGTCAGGACACATTAG AAATAATTTAGGC | SEQ ID NO:9430 GCTGCATCCAGTTACAA AGT | SEQ ID NO:17442 CTACAGGATAATAGTCACCC GTTCACT | | |
| iPS:434181 | 21-225_56F1 | AA | SEQ ID NO:1419 RASQDIRNNLG | SEQ ID NO:9431 AASSLQS | SEQ ID NO:17443 LQDNSHPFT | | |
| iPS:434181 | 21-225_56B2 | NA | SEQ ID NO:1420 CGGGCAAGTCAGAGTTTTAG CCACTATTTAAAT | SEQ ID NO:9432 GCTGTATCCAGTTTGCAA AGT | SEQ ID NO:17444 CAACAGAGTTACAGTACCCC ATTCACT | | |
| | | AA | SEQ ID NO:1421 RASQSFSHYLN | SEQ ID NO:9433 AVSSLQS | SEQ ID NO:17445 QQSYSTPFT | | |
| iPS:434187 | 21-225_56A5 | NA | SEQ ID NO:1422 CGGGCAAGTCAGGACACATTAG AAATCTTTTAGGC | SEQ ID NO:9434 GCTGCATCCAGTTTGCAA AGT | SEQ ID NO:17446 CTACAGTATAATAGTTACCC ATTCACT | | |
| | | AA | SEQ ID NO:1423 RASQDIRNLLG | SEQ ID NO:9435 AASSLQS | SEQ ID NO:17447 LQYNSYPFT | | |
| iPS:434189 | 21-225_56E5 | NA | SEQ ID NO:1424 CGGGCGAGTCAGGGTATTAG GAAGTGGTTAGCC | SEQ ID NO:9436 GCTGCATCCAGTTTGCAA AGT | SEQ ID NO:17448 CAACAGGCTAACAGTTTCCC ATTCACT | | |
| | | AA | SEQ ID NO:1425 RASQGIRKWLA | SEQ ID NO:9437 AASSLQS | SEQ ID NO:17449 QQANSFPFT | | |
| iPS:434191 | 21-225_56B6 | NA | SEQ ID NO:1426 CGGGCAAGTCAGAGACATTTT CAGATATTTAAAT | SEQ ID NO:9438 GCTGCATCCAGTTCCAA AGT | SEQ ID NO:17450 CAACAGACTTACAGTCCCCC TCTCACT | | |
| | | AA | SEQ ID NO:1427 RASQSIFRYLN | SEQ ID NO:9439 AASSFQS | SEQ ID NO:17451 QQTYSPPLT | | |
| iPS:434193 | | NA | SEQ ID NO:1428 CGGGCGAGTCAGGGTATTAG CAGCTGGTTAGCC | SEQ ID NO:9440 GCTGCATCCAGATTGCA AAGT | SEQ ID NO:17452 CAACAGGCTAACAGTTTCCC ATTCACT | | |

FIGURE 49
(Continued)

| | | | SEQ ID NO:1429 | SEQ ID NO:9441 | SEQ ID NO:17453 |
|---|---|---|---|---|---|
| iPS:434195 | 21-225_56C6 | AA | RASQGISSWLA | AASRLQS | QQANSFPFT |
| | | | SEQ ID NO:1430 | SEQ ID NO:9442 | SEQ ID NO:17454 |
| | | NA | CGGGTGAGTCAGGATATTAG CAAATGGTTAGCC | GTTGCATCCGGTTTGCAA AGT | CAACAGGCTAACAGTTTCCC ATTCACT |
| iPS:434197 | 21-225_56F6 | | SEQ ID NO:1431 | SEQ ID NO:9443 | SEQ ID NO:17455 |
| | | AA | RVSQDISKWLA | VASGLQS | QQANSFPFT |
| | | | SEQ ID NO:1432 | SEQ ID NO:9444 | SEQ ID NO:17456 |
| | | NA | CGGGCAAGTCAGGGCATTAG AAATGATTTAGGC | ACTGCATCCAATTTACAA AGT | CTACAGCATAATAGTTATCC GTGGACG |
| | 21-225_56C7 | | SEQ ID NO:1433 | SEQ ID NO:9445 | SEQ ID NO:17457 |
| | | AA | RASQGIRNDLG | TASNLQS | LQHNSYPWT |
| | | | SEQ ID NO:1434 | SEQ ID NO:9446 | SEQ ID NO:17458 |
| | | NA | CGGGCAAGTCAGGGCATTAG AAATGATTTAGGC | GCTGCATCCAGTTTGCAA AGT | CTACAGCATAATCGTTACCC TTTCACT |
| iPS:434199 | 21-225_59F11 | | SEQ ID NO:1435 | SEQ ID NO:9447 | SEQ ID NO:17459 |
| | | AA | RASQGIRNDLG | AASSLQS | LQHNRYPFT |
| | | | SEQ ID NO:1436 | SEQ ID NO:9448 | SEQ ID NO:17460 |
| | | NA | AAGTCTAGTCAGAGCCTCCA GCATGGTGAAGGAAAGACC TATTTGTAT | GAAGTTTCCTATCGGTTT TCT | ATGCAAAGTACACAGCTTCC GCTCACC |
| iPS:434201 | 21-225_59A12 | | SEQ ID NO:1437 | SEQ ID NO:9449 | SEQ ID NO:17461 |
| | | AA | KSSQSLQHGEGKTYLY | EVSYRFS | MQSTQLPLT |
| | | | SEQ ID NO:1438 | SEQ ID NO:9450 | SEQ ID NO:17462 |
| | | NA | CGGGCAAGTCAGGGCATTAG AAAAGATTTAGGC | GCTGCATCCAGTTTGCAA AGT | CTACAGCATAATAGTTACCC GTGGACG |
| iPS:434203 | 21-225_60E2 | | SEQ ID NO:1439 | SEQ ID NO:9451 | SEQ ID NO:17463 |
| | | AA | RASQGIRKDLG | AASSLQS | LQHNSYPWT |
| | | | SEQ ID NO:1440 | SEQ ID NO:9452 | SEQ ID NO:17464 |

FIGURE 49
(Continued)

| | | | | | |
|---|---|---|---|---|---|
| iPS:434205 | 21-225_60G2 | NA | AAGTCTAGTCAGAGCCTCCTGCATAGTGAAGGAAAGACCTATTTGTAT SEQ ID NO:1441 | GAAGTTTCCAACCGGAT CTCT SEQ ID NO:9453 | ATGCAAAGTATACAGCTTCC GCTCACT SEQ ID NO:17465 |
| | | AA | KSSQSLLHSEGKTYLY SEQ ID NO:1442 | EVSNRIS SEQ ID NO:9454 | MQSIQLPLT SEQ ID NO:17466 |
| iPS:434207 | 21-225_60A3 | NA | CGGGCAAGTCAGGGCATTAGAAATGATTTAGGC SEQ ID NO:1443 | GCTGCATTAGTTTGCAA AGT SEQ ID NO:9455 | CTACAGCATAATAGTTACCC TTTCACT SEQ ID NO:17467 |
| | | AA | RASQGIRNDLG SEQ ID NO:1444 | AAFSLQS SEQ ID NO:9456 | LQHNSYPFT SEQ ID NO:17468 |
| iPS:434209 | 21-225_60C3 | NA | CGGGCAAGTCAGGGCATTAGTCTGCATCCAGTTTACAAAAATGATTTAGGC SEQ ID NO:1445 | AGT SEQ ID NO:9457 | CTACAGCATAATAGTTACCC GTGGACG SEQ ID NO:17469 |
| | | AA | RASQGIRNDLG SEQ ID NO:1446 | SASSLQS SEQ ID NO:9458 | LQHNSYPWT SEQ ID NO:17470 |
| iPS:434211 | 21-225_60F3 | NA | AAGTCCAGCCAGAGTGTTTTATACAGCTCAACAATAAGAACTACTTAGCT SEQ ID NO:1447 | TGGGCATCTACCCGGGA ATCC SEQ ID NO:9459 | CAGCAATATTATAGTACTCC GTGCAGT SEQ ID NO:17471 |
| | | AA | KSSQSVLYSSNNKNYLA SEQ ID NO:1448 | WASTRES SEQ ID NO:9460 | QQYYSTPCS SEQ ID NO:17472 |
| iPS:434213 | 21-225_60A4 | NA | CGGGCGAGTCAGGGCATTAGCAATTACTTAGCC SEQ ID NO:1449 | GCTGCATCCAGTTTGCAA AGT SEQ ID NO:9461 | CAACAATATAAAAGTCACCC ATTCACT SEQ ID NO:17473 |
| | | AA | RASQGISNYLA SEQ ID NO:1450 | AASSLQS SEQ ID NO:9462 | QQYKSHPFT SEQ ID NO:17474 |
| iPS:434215 | 21-225_60F7 | NA | CGGGGCGAGTCAGGTCATTAAGAATTATTTAGTC SEQ ID NO:1451 | GCTGCGTCCAGTTTGCAA AGT SEQ ID NO:9463 | CTACAGTTTCATAGTTACCC ATTCACT SEQ ID NO:17475 |

FIGURE 49
(Continued)

| | | | | | |
|---|---|---|---|---|---|
| iPS:434217 | | AA | RASQVIKNYLV SEQ ID NO:1452 | AASSLQS SEQ ID NO:9464 | LQPHSYPFT SEQ ID NO:17476 |
| | 21-225_60E8 | NA | CGGGCAAGTCAGGGCATTAGAAATGATTAGGC SEQ ID NO:1453 | GCTGCATCCAGTTTGCAAAGT SEQ ID NO:9465 | CTACAGCATAGTAGTTACCCGCTCACT SEQ ID NO:17477 |
| iPS:434219 | | AA | RASQGIRNDLG SEQ ID NO:1454 | AASSLQS SEQ ID NO:9466 | LQHSSYPLT SEQ ID NO:17478 |
| | 21-225_60E9 | NA | AGGGCCAGTCAGAGTGTTAGCAGTTCCTTAGCC SEQ ID NO:1455 | GGTGCATCCACCAGGGCCACT SEQ ID NO:9467 | CAGCAGTATAATAACTGGCCATTCACT SEQ ID NO:17479 |
| iPS:434221 | | AA | RASQSVSSSLA SEQ ID NO:1456 | GASTRAT SEQ ID NO:9468 | QQYNNWPFT SEQ ID NO:17480 |
| | 21-225_60A11 | NA | CGGGCGAGTCAGAGTCAGGTTATTAGCAACTGGTTAGCC SEQ ID NO:1457 | ACTGCATCCAGTTTGCAAAGT SEQ ID NO:9469 | CAACAGGCTAACAGGTTTCCCGTGGACG SEQ ID NO:17481 |
| iPS:434223 | | AA | RASQVISNWLA SEQ ID NO:1458 | TASSLQS SEQ ID NO:9470 | QQANSFPWT SEQ ID NO:17482 |
| | 21-225_60C12 | NA | AAGTCTAGTCAGAGCCTCCTGCATAGTGAGGGAAAGACCTATTTGTAT SEQ ID NO:1459 | GAAGTTTCCAACCGGTTCTCT SEQ ID NO:9471 | ATGCAAAGTATAAAGTATCCGCTCACT SEQ ID NO:17483 |
| | | AA | KSSQSLLHSEGKTYLY SEQ ID NO:1460 | EVSNRFS SEQ ID NO:9472 | MQSIKYPLT SEQ ID NO:17484 |
| iPS:434225 | 21-225_60E12 | NA | CGGGCAAGTCAGAGCATTAGCAGCTATTTAAAT SEQ ID NO:1461 | GCTGCATCCAGTTTGCAAAGT SEQ ID NO:9473 | CAACAGAGTTACAATATTTCATTCACT SEQ ID NO:17485 |
| | | AA | RASQSISSYLN SEQ ID NO:1462 | AASSLQS SEQ ID NO:9474 | QQSYNISFT SEQ ID NO:17486 |
| iPS:434227 | | NA | CGGGCAAGTCAGAGCATTAGCAGCTATTTAAAT | GCTGCATCCAGTTTGCAAAGT | CAACAGAGTTACAATATTTCATTCACT |

FIGURE 49
(Continued)

| | | | | | | | |
|---|---|---|---|---|---|---|---|
| 21-225_61A1 | | | SEQ ID NO:1463 | | SEQ ID NO:9475 | | SEQ ID NO:17487 |
| | AA | | RASQSISSYLN | | AASSLQS | | QQSYNISFT |
| iPS:434229 | | | SEQ ID NO:1464 | | SEQ ID NO:9476 | | SEQ ID NO:17488 |
| | NA | | CGGGCAAGTCAGGGCATTAG AAAAGATTTAGGC | | GCTGCATCCAGTTTGCAA AGT | | CTACAGCATAATAGTTACCC GTGGACG |
| 21-225_61H1 | | | SEQ ID NO:1465 | | SEQ ID NO:9477 | | SEQ ID NO:17489 |
| | AA | | RASQGIRKDLG | | AASSLQS | | LQHNSYPWT |
| iPS:434231 | | | SEQ ID NO:1466 | | SEQ ID NO:9478 | | SEQ ID NO:17490 |
| | NA | | CGGGCAAGTCAGGGCATTAG AGATGATTTAGGC | | GCTGCATCCAGTTGCAA AGT | | CTACAGCATTATAGTTACCC TCGCAGT |
| 21-225_61F2 | | | SEQ ID NO:1467 | | SEQ ID NO:9479 | | SEQ ID NO:17491 |
| | AA | | RASQGIRDDLG | | AASSLQS | | LQHYSYPRS |
| iPS:434233 | | | SEQ ID NO:1468 | | SEQ ID NO:9480 | | SEQ ID NO:17492 |
| | NA | | AAGTCTAGTCAGAGCCTCCT GCATAGTGAAGGAAAGACC TATTTGTAT | | GAAGTTTCCAACCGGAT CTCT | | ATGCAAAGTATACAGCTTCC GCTCACT |
| 21-225_61B3 | | | SEQ ID NO:1469 | | SEQ ID NO:9481 | | SEQ ID NO:17493 |
| | AA | | KSSQSLLHSEGKTYLY | | EVSNRIS | | MQSIQLPLT |
| iPS:434235 | | | SEQ ID NO:1470 | | SEQ ID NO:9482 | | SEQ ID NO:17494 |
| | NA | | AAGTCCAGCCAGAGTGTTTT ACACATCTCCAACATAACA ATTACTTAGCT | | TGGGCATCTATCCGGGA ATCC | | CAGCAATATTATAGTACTCC GTGCAGT |
| 21-225_61E3 | | | SEQ ID NO:1471 | | SEQ ID NO:9483 | | SEQ ID NO:17495 |
| | AA | | KSSQSVLHISNNNNYLA | | WASIRES | | QQYYSIPCS |
| iPS:434237 | | | SEQ ID NO:1472 | | SEQ ID NO:9484 | | SEQ ID NO:17496 |
| | NA | | AAGTCCAGCCAGAGTGTTTT ATACAGCTCCAACAATAACA ACTCCTTAACT | | TGGGCATCTACCCGGGA ATCC | | CAGCAATATTATAGTACTCC TCCGACG |
| 21-225_61B5 | | | SEQ ID NO:1473 | | SEQ ID NO:9485 | | SEQ ID NO:17497 |
| | AA | | KSSQSVLYSSNNNNSLT | | WASTRES | | QQYYSTPPT |

FIGURE 49
(Continued)

| | | | | | | |
|---|---|---|---|---|---|---|
| iPS:434239 | | | SEQ ID NO:1474 | SEQ ID NO:9486 | SEQ ID NO:17498 | |
| | 21-225_58F1 | NA | CGGGCAAGTCAGAGCATTAC CAACTTTTAAAT | GCTGCATCCAGTTGCAA AGT | CAACAGAGTTACAGTATCCC GTGGACG |
| | | AA | SEQ ID NO:1475 RASQSITNFLN | SEQ ID NO:9487 AASSLQS | SEQ ID NO:17499 QQSYSIPWT |
| iPS:434241 | | | SEQ ID NO:1476 | SEQ ID NO:9488 | SEQ ID NO:17500 |
| | 21-225_61E6 | NA | CGGGCAAGTCAGGGCATTGG AAATGATTTAGGC | GCTGCATCCAGTTTGCAA AGT | CTACAACATAATAGTTTCCC TCCGTGGACG |
| | | AA | SEQ ID NO:1477 RASQGIGNDLG | SEQ ID NO:9489 AASSLQS | SEQ ID NO:17501 LQHNSFPPWT |
| iPS:434243 | | | SEQ ID NO:1478 | SEQ ID NO:9490 | SEQ ID NO:17502 |
| | 21-225_62C1 | NA | AGGTCTAGTCAGAGCCTCCT ACATAGTAATGGATACAACT ATTGGAT | TTGGTTTCTAATGGGCC TCC | CTGCAAGCTCTACAAACTCC TCTCACC |
| | | AA | SEQ ID NO:1479 RSSQSLLHSNGYNYLD | SEQ ID NO:9491 LVSNRAS | SEQ ID NO:17503 LQALQTPLT |
| iPS:434245 | | | SEQ ID NO:1480 | SEQ ID NO:9492 | SEQ ID NO:17504 |
| | 21-225_62H1 | NA | CGGGCAAGTCAGAACATTTT CAGTATTTAAAT | GCTGTATTTAGTTTGCAA AGT | CAACAGAGTTACAGTACCCC ATTCACT |
| | | AA | SEQ ID NO:1481 RASQNIFSYLN | SEQ ID NO:9493 AVFSLQS | SEQ ID NO:17505 QQSYSTPFT |
| iPS:434247 | | | SEQ ID NO:1482 | SEQ ID NO:9494 | SEQ ID NO:17506 |
| | 21-225_62D2 | NA | CGGGCAAGTCAGAGCATTAT CAGTTATTTAAAT | GCTACATCCAGTTTGCAA AGT | CAACAGACTTACAGTCCCCC GCTCACT |
| | | AA | SEQ ID NO:1483 RASQSISYLN | SEQ ID NO:9495 ATSSLQS | SEQ ID NO:17507 QQTYSPPLT |
| iPS:434249 | | | SEQ ID NO:1484 | SEQ ID NO:9496 | SEQ ID NO:17508 |
| | 21-225_62E2 | NA | CGGGCAAGTCAGGGCATTAG AAATGATTTAGGC | GCTGCATCCCGTTTGCAA AGT | CTACAGCATAGTAATTACCC TCTCACT |
| | | | SEQ ID NO:1485 | SEQ ID NO:9497 | SEQ ID NO:17509 |

FIGURE 49
(Continued)

| | | | | | | |
|---|---|---|---|---|---|---|
| iPS:434251 | | AA | RASQGIRNDLG | | AASRLQS | LQHSNYPLT |
| | | | SEQ ID NO:1486 | | SEQ ID NO:9498 | SEQ ID NO:17510 |
| | 21-225_62G3 | NA | CGGGCAAGTCAGGGACATTAG AAATAATTTAGGC | | ACTGCATCCAGTTTGCAA AGT | CTACAGTATAATAGTTACCC ATTCACT |
| | | | SEQ ID NO:1487 | | SEQ ID NO:9499 | SEQ ID NO:17511 |
| iPS:434253 | | AA | RASQDIRNNLG | | TASSLQS | LQYNSYPFT |
| | | | SEQ ID NO:1488 | | SEQ ID NO:9500 | SEQ ID NO:17512 |
| | 21-225_62E4 | NA | CGGGCAAGTCAGGGCATTAG AAATGATTTAGGC | | GCTGCATCCAGTTTGCAA AGT | CTACAGCATAATAGTTATCC GCTCACT |
| | | | SEQ ID NO:1489 | | SEQ ID NO:9501 | SEQ ID NO:17513 |
| iPS:434255 | | AA | RASQGIRNDLG | | AAFSLQS | LQHNSYPLT |
| | | | SEQ ID NO:1490 | | SEQ ID NO:9502 | SEQ ID NO:17514 |
| | 21-225_62E6 | NA | AGGGCCAGTCAGAGTGTTAA CAGCAACTTAGCC | | GTTGCATCCACCAGGGC CACT | CAGCAGTATAATGACTGGCC GTGTAGT |
| | | | SEQ ID NO:1491 | | SEQ ID NO:9503 | SEQ ID NO:17515 |
| iPS:434257 | | AA | RASQSVNSNLA | | VASTRAT | QQYNDWPCS |
| | | | SEQ ID NO:1492 | | SEQ ID NO:9504 | SEQ ID NO:17516 |
| | 21-225_62F7 | NA | CGGGCAAGTCAGGGCCATTAG AAATGATTTAGGC | | CCTGCATCCGTTTGCAA AGT | CTACAGTATAATAGTTACCC TCCGTGGACG |
| | | | SEQ ID NO:1493 | | SEQ ID NO:9505 | SEQ ID NO:17517 |
| iPS:434259 | | AA | RASQAIRNDLG | | PASRLQS | LQYNSYPPWT |
| | | | SEQ ID NO:1494 | | SEQ ID NO:9506 | SEQ ID NO:17518 |
| | 21-225_62G7 | NA | CGGGCGAGTCAGGATATTAG CAGCTGGTTAGCC | | GCTGCATCCAGTTTGCAA AGT | CAACAGACTAACAGTTTCCC TCTCACT |
| | | | SEQ ID NO:1495 | | SEQ ID NO:9507 | SEQ ID NO:17519 |
| iPS:434261 | | AA | RASQDISSWLA | | AASSLQS | QQTNSFPLT |
| | | | SEQ ID NO:1496 | | SEQ ID NO:9508 | SEQ ID NO:17520 |
| | 21-225_56F7 | NA | CGGGCGAGTCAGGGCATTAG CACTTATTTAGCC | | GCTGCATCCAGTTTGCAA GGT | CATCAGTATAATAGTTTCCC ATTTAAG |
| | | | SEQ ID NO:1497 | | SEQ ID NO:9509 | SEQ ID NO:17521 |

FIGURE 49
(Continued)

| | | | RASQGISTYLA | AASSLQG | HQYNSFPFK |
|---|---|---|---|---|---|
| iPS:434263 | | AA | SEQ ID NO:1498 | SEQ ID NO:9510 | SEQ ID NO:17522 |
| | 21-225_56H7 | NA | CGGGCAAGTCAGGACACATTAGAAATGATTTAGGC | CCTGCATCCAGTTTGCTAAGT | CTACAGGATAATAGTTACCCATTCACT |
| | | | SEQ ID NO:1499 | SEQ ID NO:9511 | SEQ ID NO:17523 |
| iPS:434265 | | AA | RASQDIRNDLG | PASSLLS | LQDNSYPFT |
| | | | SEQ ID NO:1500 | SEQ ID NO:9512 | SEQ ID NO:17524 |
| | 21-225_57B2 | NA | CGGGCAAGTCAGGGCATTAGAAATGCTTTAGGC | GCTGCATCCAGTTTGCAAAGT | CTACAGCATAATAGTTACCCATTCACT |
| | | | SEQ ID NO:1501 | SEQ ID NO:9513 | SEQ ID NO:17525 |
| iPS:434267 | | AA | RASQGIRNALG | AASSLQS | LQHNSYPFT |
| | | | SEQ ID NO:1502 | SEQ ID NO:9514 | SEQ ID NO:17526 |
| | 21-225_57F2 | NA | CGGGCAAGTCAGAGAGCATTAGCAGCTATTTAAAT | GCTGCATCCAGTTTGCAAAGT | CAACAGAGTTACAATATTTCATTCACT |
| | | | SEQ ID NO:1503 | SEQ ID NO:9515 | SEQ ID NO:17527 |
| iPS:434269 | | AA | RASQSISSYLN | AASSLQS | QQSYNISFT |
| | | | SEQ ID NO:1504 | SEQ ID NO:9516 | SEQ ID NO:17528 |
| | 21-225_57H3 | NA | AGGGCCAGTCAGAGTGTTAGCAGCAGCTTAGCC | GGTGCATCCACCAGGGCCACT | CAGCAGTATAATGACTGGCCGTGCAGT |
| | | | SEQ ID NO:1505 | SEQ ID NO:9517 | SEQ ID NO:17529 |
| iPS:434271 | | AA | RASQSVSSSLA | GASTRAT | QQYNDWPCS |
| | | | SEQ ID NO:1506 | SEQ ID NO:9518 | SEQ ID NO:17530 |
| | 21-225_57A4 | NA | CGGGCAAGTCAGGGCATTAGAAATGATTTAGGC | GCTGCATCCAGTTTGCTAAGT | CTACAGCATAATAGTTACCCATTCACT |
| | | | SEQ ID NO:1507 | SEQ ID NO:9519 | SEQ ID NO:17531 |
| iPS:434273 | | AA | RASQGIRNDLG | AASSLLS | LQHNSYPFT |
| | | | SEQ ID NO:1508 | SEQ ID NO:9520 | SEQ ID NO:17532 |
| | 21-225_57E4 | NA | CGGGCGAGTCAGGATATTAGCAACTGGTTAGCC | GCTGCATCCAGTTTGCAAAGT | CAACAGGTAACAGTTTCCCATTCACT |
| | | | SEQ ID NO:1509 | SEQ ID NO:9521 | SEQ ID NO:17533 |

FIGURE 49
(Continued)

| | | | | | AA | RASQDISNWLA | | AASSLQS | | QQGNSFPFT |
|---|---|---|---|---|---|---|---|---|---|---|
| iPS:434275 | | | | | | SEQ ID NO:1510 | | SEQ ID NO:9522 | | SEQ ID NO:17534 |
| | 21-225_57F4 | | | | NA | CGGGCAAGTCAGGTCATTAG AAATGATTTAGGC | | GCTGCATCCAGTTTGCAA AGT | | CTACAGTATGGTAGTTTCCC ATTCACT |
| | | | | | | SEQ ID NO:1511 | | SEQ ID NO:9523 | | SEQ ID NO:17535 |
| iPS:434277 | | | | | AA | RASQVIRNDLG | | AASSLQS | | LQYGSFPFT |
| | | | | | | SEQ ID NO:1512 | | SEQ ID NO:9524 | | SEQ ID NO:17536 |
| | 21-225_57A7 | | | | NA | CGGGCGAGTCAGGGTATTAG CAGGTGGTTAGCC | | GCTGCATCCAATTTGCAA AGT | | CAACAGGCTAACAGTTTCCC ATTCACT |
| | | | | | | SEQ ID NO:1513 | | SEQ ID NO:9525 | | SEQ ID NO:17537 |
| iPS:434279 | | | | | AA | RASQGISRWLA | | AASNLQS | | QQANSFPFT |
| | | | | | | SEQ ID NO:1514 | | SEQ ID NO:9526 | | SEQ ID NO:17538 |
| | 21-225_57F7 | | | | NA | AGGGCCAGTCAGAGTGTTAG CAGCGACTTAGCC | | GGTGCATCCACCAGGGC CACT | | CAGCAGTATAGTAACTGGCC ATTCACT |
| | | | | | | SEQ ID NO:1515 | | SEQ ID NO:9527 | | SEQ ID NO:17539 |
| iPS:434281 | | | | | AA | RASQSVSSDLA | | GASTRAT | | QQYSNWPFT |
| | | | | | | SEQ ID NO:1516 | | SEQ ID NO:9528 | | SEQ ID NO:17540 |
| | 21-225_57B8 | | | | NA | CGGGCAAGTCAGGGCATTGG AAATGATTTAGGC | | GCTGCATCCAGTTTGCAA AGT | | CTACAACATAATAGTTTCCC TCCGTGGACG |
| | | | | | | SEQ ID NO:1517 | | SEQ ID NO:9529 | | SEQ ID NO:17541 |
| iPS:434283 | | | | | AA | RASQGIGNDLG | | AASSLQS | | LQHNSFPPWT |
| | | | | | | SEQ ID NO:1518 | | SEQ ID NO:9530 | | SEQ ID NO:17542 |
| | 21-225_57F8 | | | | NA | CGGGCGAGTCAGGGTATTAG CAACTGGTTAGCC | | ACTGCATCCAGTTTGCAA AGT | | CAACAGGCTAACAGTTTCCC GTGGACG |
| | | | | | | SEQ ID NO:1519 | | SEQ ID NO:9531 | | SEQ ID NO:17543 |
| iPS:434285 | | | | | AA | RASQGISNWLA | | TASSLQS | | QQANSFPWT |
| | | | | | | SEQ ID NO:1520 | | SEQ ID NO:9532 | | SEQ ID NO:17544 |
| | 21_225_57A11 | | | | NA | AAGTCCAGCCAAAGTGTTTT ACACAGCTCAACAATTATA ACTACTTAGCT | | TGGGCATCTACCCGGGC ATCC | | CAGCAATATTATAGTACTCC GTGGACG |

FIGURE 49
(Continued)

| | | | | | | | |
|---|---|---|---|---|---|---|---|
| iPS:434287 | 21-225_57A11 | AA | SEQ ID NO:1521<br>KSSQSVLHSSNNYNYLA | SEQ ID NO:9533<br>WASTRAS | SEQ ID NO:17545<br>QQYYSTPWT | | |
| iPS:434289 | 21-225_57F12 | NA | SEQ ID NO:1522<br>AAGTCCAGCCAGAGTGTTTT ATTCAGCTCCAACAATTACA ATTACTTAGCT | SEQ ID NO:9534<br>TGGGCATCTACCCGGGA ATCC | SEQ ID NO:17546<br>CAGCAATATTATAGTAATCC GTGTAGT | | |
| | | AA | SEQ ID NO:1523<br>KSSQSVLFSSNNYNYLA | SEQ ID NO:9535<br>WASTRES | SEQ ID NO:17547<br>QQYYSNPCS | | |
| iPS:434291 | 21-225_57H12 | NA | SEQ ID NO:1524<br>AGGGCCAGTCAGAGTGTTAG CAGCGACTTAGCC | SEQ ID NO:9536<br>GCTGCATCTACCAGGGC CACT | SEQ ID NO:17548<br>CAGCAGTATGATAACTGGCC ATTCACT | | |
| | | AA | SEQ ID NO:1525<br>RASQSVSSDLA | SEQ ID NO:9537<br>AASTRAT | SEQ ID NO:17549<br>QQYDNWPFT | | |
| iPS:434293 | 21-225_58A4 | NA | SEQ ID NO:1526<br>AGGGCCAGTCAGAGTGTTAG CAGCGACTTAGCC | SEQ ID NO:9538<br>GCTGCATCTACCAGGGC CACT | SEQ ID NO:17550<br>CAGCAGTTTAATAACTGGCC ATTCACT | | |
| | | AA | SEQ ID NO:1527<br>RASQSVSSDLA | SEQ ID NO:9539<br>AASTRAT | SEQ ID NO:17551<br>QQFNNWPFT | | |
| iPS:434295 | 21-225_58F5 | NA | SEQ ID NO:1528<br>CGGGCAAGTCAGGGCATTAG AAATGATTTAGGC | SEQ ID NO:9540<br>GCTGCATCCAGTTTGCTA AGT | SEQ ID NO:17552<br>CTACAGCAGTTAATAACTGGCC ATTCACT | | |
| | | AA | SEQ ID NO:1529<br>RASQGIRNDLG | SEQ ID NO:9541<br>AASSLLS | SEQ ID NO:17553<br>LQHNSYPFT | | |
| | 21-225_58B9 | NA | SEQ ID NO:1530<br>AAGTCCGGCCAGAGTATTT ATACAGCTCCAACAATAACA ACTACTTAGCT | SEQ ID NO:9542<br>TGGGCATCTACCCGGGA TTCC | SEQ ID NO:17554<br>CAGCAATATTATAGTACTCC TCCGACG | | |
| | | AA | SEQ ID NO:1531<br>KSGQSILYSSNNNNYLA | SEQ ID NO:9543<br>WASTRDS | SEQ ID NO:17555<br>QQYYSTPPT | | |
| | | | SEQ ID NO:1532 | SEQ ID NO:9544 | SEQ ID NO:17556 | | |

FIGURE 49
(Continued)

| | | | | | |
|---|---|---|---|---|---|
| iPS:434297 | 21-225_58A10 | NA | AGGGCCAGTCAGAGTGTTAG CAGCTCCTTAGCC SEQ ID NO:1533 | GGTGCATCCACCAGGGC CACT SEQ ID NO:9545 | CAGCAGTATAATAACTGGCC ATTCACT SEQ ID NO:17557 |
| | | AA | RASQSVSSSLA SEQ ID NO:1534 | GASTRAT SEQ ID NO:9546 | QQYNNWPFT SEQ ID NO:17558 |
| iPS:434299 | 21-225_58D11 | NA | CGGGCAAGTCAGGGCATTAG AAGTGATTTAGAC SEQ ID NO:1535 | GCTGCATCCAGTTGCAA AGT SEQ ID NO:9547 | CTCCAGCATAATAATTCCC ATTCACT SEQ ID NO:17559 |
| | | AA | RASQGIRSDLD SEQ ID NO:1536 | AASSLQS SEQ ID NO:9548 | LQHNNFPFT SEQ ID NO:17560 |
| iPS:434301 | 21-225_58F11 | NA | AGGGCCAGTCAGAGTGTTAG CAGCGACTTAGTC SEQ ID NO:1537 | GGTGTATCCACCAGGGC CACT SEQ ID NO:9549 | CAGCAGTATAATAACTGGCC ATTCACT SEQ ID NO:17561 |
| | | AA | RASQSVSSDLV SEQ ID NO:1538 | GVSTRAT SEQ ID NO:9550 | QQYNNWPFT SEQ ID NO:17562 |
| iPS:434303 | 21-225_58H11 | NA | AAGTCTAGTCAGAGCCTCCT GCATAGTGAGGGAAAGACC TATTTGTAT SEQ ID NO:1539 | GAAGTTCCTATCGGTTT TCT SEQ ID NO:9551 | ATGCAAAGTATACAGCTTCC GCTCACT SEQ ID NO:17563 |
| | | AA | KSSQSLLHSEGKTYLY SEQ ID NO:1540 | EVSYRFS SEQ ID NO:9552 | MQSIQLPLT SEQ ID NO:17564 |
| iPS:434305 | 21-225_59E1 | NA | AAGTCCAGCCAGAGTGTTT ATACAGCTCCAACAATAACA ACTACTTAGCT SEQ ID NO:1541 | TGGTCATCTACCCGGGA ATCC SEQ ID NO:9553 | CAGCAATATTTTAGTATTCC GTGCAGT SEQ ID NO:17565 |
| | | AA | KSSQSVLYSSNNNNYLA SEQ ID NO:1542 | WSSTRES SEQ ID NO:9554 | QQYFSIPCS SEQ ID NO:17566 |
| iPS:434307 | 21-225_59B2 | NA | TGGGCCAGTCAGAGTGTTTA CAGCAGCTTCTTAGCC SEQ ID NO:1543 | GGTGCATCCAGCAGGGC CACT SEQ ID NO:9555 | CAGCAATATGGTACCTCACC GTGGACG SEQ ID NO:17567 |

FIGURE 49
(Continued)

| | | | | | |
|---|---|---|---|---|---|
| iPS:434309 | | AA | WASQSVYSSFLA SEQ ID NO:1544 | GASSRAT SEQ ID NO:9556 | QQYGTSPWT SEQ ID NO:17568 |
| | 21-225_59B5 | NA | CGGGCAAGTCAGAGAGCATTAT CAGCTATTTAAAT SEQ ID NO:1545 | GGTGCATCCAGTTTGCA GAGT SEQ ID NO:9557 | CAACAGAGTTACAGTACCCC TATGTTCAGT SEQ ID NO:17569 |
| | | AA | RASQSHSYLN SEQ ID NO:1546 | GASSLQS SEQ ID NO:9558 | QQSYSTPMFS SEQ ID NO:17570 |
| iPS:434311 | 21-225_59H5 | NA | AGGGCCAGTCAGAGTGTTAG CAGCATCTACTTAGCC SEQ ID NO:1547 | GGTGCATCCAGCAGGGC CACT SEQ ID NO:9559 | CACCAGTATGGTAACTCACC ATTCACT SEQ ID NO:17571 |
| | | AA | RASQSVSSIYLA SEQ ID NO:1548 | GASSRAT SEQ ID NO:9560 | HQYGNSPFT SEQ ID NO:17572 |
| iPS:434313 | 21-225_59E6 | NA | CGGGCAAGTCAGGGCATTAG AAATGATTTAGGC SEQ ID NO:1549 | GCTGCATCCAGTTTGCAA AGT SEQ ID NO:9561 | CTACAGCATAATAGTTACCC GCTCACT SEQ ID NO:17573 |
| | | AA | RASQGIRNDLG SEQ ID NO:1550 | AASSLQS SEQ ID NO:9562 | LQHNSYPLT SEQ ID NO:17574 |
| iPS:434315 | 21-225_59G7 | NA | CGGGCAAGTCAGGACATTAG AAATGATTTAGGC SEQ ID NO:1551 | TCTGCATCCAGTTTACAA AGT SEQ ID NO:9563 | CTACAGCATAATAGTTACCC GTGGACG SEQ ID NO:17575 |
| | | AA | RASQGIRNDLG SEQ ID NO:1552 | SASSLQS SEQ ID NO:9564 | LQHNSYPWT SEQ ID NO:17576 |
| iPS:434317 | 21-225_59E8 | NA | CGGGCAAGTCAGAGCATTAG CAGCTATTTAAAT SEQ ID NO:1553 | GCTGCATCCAGTTTGCAA AGT SEQ ID NO:9565 | CAACAGAGTTTCAGTAATTC GATCACC SEQ ID NO:17577 |
| | | AA | RASQSISSYLN SEQ ID NO:1554 | AASSLQS SEQ ID NO:9566 | QQSFSNSIT SEQ ID NO:17578 |
| iPS:434319 | 21-225_59B9 | NA | CGGGCAAGTCAGGACATTAG AAATGATTTAGGC SEQ ID NO:1555 | GCTGCATCCAGTTTACAA AGT SEQ ID NO:9567 | CTACAGCATAATAGTTACCC GTGGACG SEQ ID NO:17579 |

FIGURE 49
(Continued)

| | | | | | | |
|---|---|---|---|---|---|---|
| iPS:434321 | | AA | RASQDIRNDLG<br>SEQ ID NO:1556 | AASSLQS<br>SEQ ID NO:9568 | LQHNSYPWT<br>SEQ ID NO:17580 |
| | 21-225_59F10 | NA | AAGTCCAGCCAGACTGTTTT<br>ATACAGGTCCAACAATTACA<br>ACTACTTAGCT<br>SEQ ID NO:1557 | TGGGCATCTACCCGGGA<br>ATCC<br>SEQ ID NO:9569 | CAGCAATATTTAGTACTCC<br>TCCGACG<br>SEQ ID NO:17581 |
| iPS:434323 | | AA | KSSQTVLYRSNNYNYLA<br>SEQ ID NO:1558 | WASTRES<br>SEQ ID NO:9570 | QQYFSTPPT<br>SEQ ID NO:17582 |
| | 21-225_62H8 | NA | CGGGCAAGTCAGAGCATTTT<br>CAGTATTTAAAT<br>SEQ ID NO:1559 | GCGTCATCCAGTTTGCAA<br>AGT<br>SEQ ID NO:9571 | CAACAGAGTTACAGTTACCCC<br>ATTCACT<br>SEQ ID NO:17583 |
| iPS:434327 | | AA | RASQSIFSYLN<br>SEQ ID NO:1560 | ASSSLQS<br>SEQ ID NO:9572 | QQSYSTPFT<br>SEQ ID NO:17584 |
| | 21-225_63G6 | NA | CGGGCAAGTCAGAGCATTTT<br>CAGTATTTAAAT<br>SEQ ID NO:1561 | GATACATCCACTTTGCAA<br>ACT<br>SEQ ID NO:9573 | CAACAGAGTTACGGTATCC<br>CATCACC<br>SEQ ID NO:17585 |
| iPS:434331 | | AA | RASQSIFSYLN<br>SEQ ID NO:1562 | DTSTLQT<br>SEQ ID NO:9574 | QQSYGIPIT<br>SEQ ID NO:17586 |
| | 21-225_63H8 | NA | CGGGCGAGTCAGGGCATTAG<br>CAATTATTTAGCC<br>SEQ ID NO:1563 | GCTGCATCCAGTTTGCAA<br>AGT<br>SEQ ID NO:9575 | CAACAATATCATAGTTACCC<br>ATTCACT<br>SEQ ID NO:17587 |
| iPS:434333 | | AA | RASQGISNYLA<br>SEQ ID NO:1564 | AASSLQS<br>SEQ ID NO:9576 | QQYHSYPFT<br>SEQ ID NO:17588 |
| | 21-225_63C9 | NA | CGGGCGAGTCAGGGTATTAG<br>CAGCTGGTTAGCC<br>SEQ ID NO:1565 | GCTGCATCCAGTTTGCAA<br>AGT<br>SEQ ID NO:9577 | CAACAGATTAACAGTTTCCC<br>TCTCACT<br>SEQ ID NO:17589 |
| iPS:434335 | | AA | RASQGISSWLA<br>SEQ ID NO:1566 | AASSLQS<br>SEQ ID NO:9578 | QQINSFPLT<br>SEQ ID NO:17590 |
| | | NA | CGGGCAAGTCAGAGCATTTT<br>CAGTATTTACAT | GCTGCATCCAGTTTACAA<br>AGT | CAACAGACTTACAGTCCCCC<br>GCTCACT |

FIGURE 49
(Continued)

| | | | | | | | |
|---|---|---|---|---|---|---|---|
| iPS:434337 | 21-225_63C10 | AA | SEQ ID NO:1567<br>RASQSIFSYLH | SEQ ID NO:9579<br>AASSLQS | SEQ ID NO:17591<br>QQTYSPPLT |
| | | | SEQ ID NO:1568 | SEQ ID NO:9580 | SEQ ID NO:17592 |
| iPS:434339 | 21-225_64E1 | NA | CGGGCAAGTCAGGGCATTAG<br>AAATGATTTAGGC | GCTGCATCCAGTTTGCAA<br>AGT | CTACAGCATAATAGTTACCC<br>GCTCACT |
| | | | SEQ ID NO:1569 | SEQ ID NO:9581 | SEQ ID NO:17593 |
| | | AA | RASQGIRNDLG | AASSLQS | LQHNSYPLT |
| | | | SEQ ID NO:1570 | SEQ ID NO:9582 | SEQ ID NO:17594 |
| iPS:434341 | 21-225_64A4 | NA | CGGGCAAGTCAGGGCATTAG<br>AAATGATTTAGGC | GCTGCATCCAGTTTGCAA<br>AGT | CTACAGCATTATAGTTACCC<br>TCGGACG |
| | | | SEQ ID NO:1571 | SEQ ID NO:9583 | SEQ ID NO:17595 |
| | | AA | RASQGIRNDLG | AASSLQS | LQHYSYPRT |
| | | | SEQ ID NO:1572 | SEQ ID NO:9584 | SEQ ID NO:17596 |
| iPS:434343 | 21-225_64F7 | NA | CGGGCAAGTCAGAACATTAA<br>GAAATATTTAAAT | GGTGCATCCAGTTTGCA<br>AAGT | CAACAGAGTTACAATATTTC<br>GTTCACT |
| | | | SEQ ID NO:1573 | SEQ ID NO:9585 | SEQ ID NO:17597 |
| | | AA | RASQNIKKYLN | GASSLQS | QQSYNISFT |
| | | | SEQ ID NO:1574 | SEQ ID NO:9586 | SEQ ID NO:17598 |
| iPS:434345 | 21-225_64C8 | NA | CGGGCAAGTCAGGGCATTAG<br>AAATGATTTAGGC | GCTGCATCCAGTTTGCAA<br>AGT | CTACACCATTATAGTTACCC<br>TCGGACG |
| | | | SEQ ID NO:1575 | SEQ ID NO:9587 | SEQ ID NO:17599 |
| | | AA | RASQGIRNDLG | AASSLQS | LHHYSYPRT |
| | | | SEQ ID NO:1576 | SEQ ID NO:9588 | SEQ ID NO:17600 |
| | 21-225_64H9 | NA | AAGTCTAGTCAGAGCCTCCT<br>TCATGGTGATGGAAAGACCT<br>ATTTGTTT | GAAGTTTCCAACCGGT<br>GTGT | ATGCAAAGTATACAGGTTCC<br>GTGGACG |
| | | | SEQ ID NO:1577 | SEQ ID NO:9589 | SEQ ID NO:17601 |
| | | AA | KSSQSLLHGDGKTYLF | EVSNRLC | MQSIQVPWT |
| | | | SEQ ID NO:1578 | SEQ ID NO:9590 | SEQ ID NO:17602 |

FIGURE 49
(Continued)

| | | | | | |
|---|---|---|---|---|---|
| iPS:434347 | 21-225_64H10 | NA | CGGGGCGAGTCAGGGTATTAG CAGCTGGTTAGCC SEQ ID NO:1579 | GCTGCATCCAGTTTGCAA AGT SEQ ID NO:9591 | CAACAGATTAACAGTTTCCC TCTCACT SEQ ID NO:17603 |
| | | AA | RASQGISSWLA SEQ ID NO:1580 | AASSLQS SEQ ID NO:9592 | QQINSFPLT SEQ ID NO:17604 |
| iPS:434351 | 21-225_64A12 | NA | CGGGCAAGTCAGGGCATTAG AAATGATTTAGGC SEQ ID NO:1581 | ACTGCATCCACTTTGCAA AGT SEQ ID NO:9593 | CTACAGCATAATGGTTACCC ATTCACT SEQ ID NO:17605 |
| | | AA | RASQGIRNDLG SEQ ID NO:1582 | TASTLQS SEQ ID NO:9594 | LQHNGYPFT SEQ ID NO:17606 |
| iPS:434353 | 21-225_64B12 | NA | CGGGGCGAGTCAGGACATTAG CAATTATTTAAAT SEQ ID NO:1583 | GATGCATCCATTTTGGAA ACA SEQ ID NO:9595 | CAACAGAGTGATAATCTCCC GTGCAGT SEQ ID NO:17607 |
| | | AA | RASQDISNYLN SEQ ID NO:1584 | DASILET SEQ ID NO:9596 | QQSDNLPCS SEQ ID NO:17608 |
| iPS:434355 | 21-225_64G12 | NA | CGGGCGAGTCAGAGATATTAC CACCTGGTTAGCC SEQ ID NO:1585 | GCTGCATCCAGTTTGCAA AGT SEQ ID NO:9597 | CAACAGGCTAACAGTTTCCC ATTCACT SEQ ID NO:17609 |
| | | AA | RASQNITWLA SEQ ID NO:1586 | AASSLQS SEQ ID NO:9598 | QQANSFPFT SEQ ID NO:17610 |
| iPS:434357 | 21-225_65C1 | NA | CGGGCGAGTCAGGTCATTAG CAGTTATTTACAT SEQ ID NO:1587 | AGTTGCATCCAATTTGCA ATGT SEQ ID NO:9599 | CAACGGCCTTACAATGCCCC GCTCACT SEQ ID NO:17611 |
| | | AA | RASQVISSYLH SEQ ID NO:1588 | SASNLQC SEQ ID NO:9600 | QRPYNAPLT SEQ ID NO:17612 |
| iPS:434359 | 21-225_65G3 | NA | CGGGGCGAGTCAGGGTATTAG CAGCTGGTTAGCC SEQ ID NO:1589 | GCTGCATCCAGTTTGCAA AGT SEQ ID NO:9601 | CAACAGGTTAACAGTTTCCC TCTCACT SEQ ID NO:17613 |
| | | AA | RASQGISSWLA SEQ ID NO:1590 | AASSLQS SEQ ID NO:9602 | QQVNSFPLT SEQ ID NO:17614 |

FIGURE 49
(Continued)

| | | | | | |
|---|---|---|---|---|---|
| iPS:434361 | | NA | CGGGGCGAGTCAGGACATTAA CAATTATTTAGCC SEQ ID NO:1591 | GCTGCATCCAGTTTGCAC AGT SEQ ID NO:9603 | CCACTGTATAAAGTTATCC ACTCACT SEQ ID NO:17615 |
| | 21-225_65D5 | AA | RASQDINNYLA SEQ ID NO:1592 | AASSLHS SEQ ID NO:9604 | PLYKSYPLT SEQ ID NO:17616 |
| iPS:434363 | | NA | AGGGCCAGTCAGAGAGTGTTAA CAGCAACTTAGCC SEQ ID NO:1593 | GGTGCATCCACCAGGGC CACT SEQ ID NO:9605 | CAGCAGTATAATGACTGGCC GTGCAGT SEQ ID NO:17617 |
| | 21-225_65A6 | AA | RASQSVNSNLA SEQ ID NO:1594 | GASTRAT SEQ ID NO:9606 | QQYNDWPCS SEQ ID NO:17618 |
| iPS:434367 | | NA | CGGGGCGAGTCAGGACATTAG CACTTATTTAGCC SEQ ID NO:1595 | GCTGCATCCAGTTTGCAA AGT SEQ ID NO:9607 | CAACAGTATAATAGTTTCCC TCTCACT SEQ ID NO:17619 |
| | 21-225_65H11 | AA | RASQDISTYLA SEQ ID NO:1596 | AASSLQS SEQ ID NO:9608 | QQYNSFPLT SEQ ID NO:17620 |
| iPS:434369 | | NA | CGGGGCGAGTCAGGGTATTAG CAGCTGGTTAGCC SEQ ID NO:1597 | GCTGCATCCAGTTTGCAA AGT SEQ ID NO:9609 | CAACAGACTAACAGTTTCCC TCTCACT SEQ ID NO:17621 |
| | 21-225_66B1 | AA | RASQGISSWLA SEQ ID NO:1598 | AASSLQS SEQ ID NO:9610 | QQTNSFPLT SEQ ID NO:17622 |
| iPS:434373 | | NA | CGGGGCGAGTCAGGGTATTAG CAGCTGGTTAGCC SEQ ID NO:1599 | GCTGCATCCAGTTTGCAA AGT SEQ ID NO:9611 | CAACAGATTAATAGTTTCCC TCTCACT SEQ ID NO:17623 |
| | 21-225_66A7 | AA | RASQGISSWLA SEQ ID NO:1600 | AASSLQS SEQ ID NO:9612 | QQINSFPLT SEQ ID NO:17624 |
| iPS:434375 | | NA | CGGGGCGAGTCAGGGCATTAG CAATTATTTACAT SEQ ID NO:1601 | TGTGCATCCAATTTACAA TGT SEQ ID NO:9613 | CAACAGCATAATAATTCCCC GCTCACT SEQ ID NO:17625 |
| | 21-225_66C7 | AA | RASQGISNYLH SEQ ID NO:1602 | CASNLQC SEQ ID NO:9614 | QQHNNSPLT SEQ ID NO:17626 |

FIGURE 49
(Continued)

| | | | | | |
|---|---|---|---|---|---|
| iPS:434379 | 21-225_66A9 | NA | CGGGCAAGTCAGGAACATTTT CAGCTATTTAAAT SEQ ID NO:1603 | GCTGCATCCAGTTTACAA AGT SEQ ID NO:9615 | CAACAGACTTACAGTGTCCC TTTCACT SEQ ID NO:17627 |
| | | AA | RASQNIFSYLN SEQ ID NO:1604 | AASSLQS SEQ ID NO:9616 | QQTYSVPFT SEQ ID NO:17628 |
| iPS:434383 | 21-225_66F9 | NA | CGGGCAAGTCAGGACATTAG AAATGTTTTAGGC SEQ ID NO:1605 | ACTGCATCCAGTTTACAA AGT SEQ ID NO:9617 | CTACAGTATAATAGTTACCC ATTCACT SEQ ID NO:17629 |
| | | AA | RASQDIRNVLG SEQ ID NO:1606 | TASSLQS SEQ ID NO:9618 | LQYNSYPFT SEQ ID NO:17630 |
| iPS:434385 | 21-225_66C10 | NA | CGGGCAAGTCAGGCCATTAG AAATGATTTAGGC SEQ ID NO:1607 | CCTGCATCCAGTTTGCAA AGT SEQ ID NO:9619 | CTACAGTATAATAGTTACCC TCCGTGGACG SEQ ID NO:17631 |
| | | AA | RASQAIRNDLG SEQ ID NO:1608 | PASSLQS SEQ ID NO:9620 | LQYNSYPPWT SEQ ID NO:17632 |
| iPS:434387 | 21-225_66D11 | NA | CGGGCAAGTCAGGGCATTAG AAATGATTTAGGT SEQ ID NO:1609 | GCTGCATCCAGTGTCAA AGT SEQ ID NO:9621 | ATAGTGCATAATAGTTACCC TCGGACG SEQ ID NO:17633 |
| | | AA | RASQGIRNDLG SEQ ID NO:1610 | AASSCQS SEQ ID NO:9622 | IVHNSYPRT SEQ ID NO:17634 |
| iPS:434389 | 21-225_66F11 | NA | CGGGAGAGTCAGGGTATTAG CATCTGGTTAGCC SEQ ID NO:1611 | GCTGCATCCAGTTTGCAA AGT SEQ ID NO:9623 | CAACAGGCTAACAGTTCCC ATTCACT SEQ ID NO:17635 |
| | | AA | RESQGISIWLA SEQ ID NO:1612 | AASSLQS SEQ ID NO:9624 | QQANSPPFT SEQ ID NO:17636 |
| iPS:434393 | 21-225_67C3 | NA | AGGGCCAGTCAGAGTGTTAA CAGCAACTTAGCC SEQ ID NO:1613 | ATTGCATCCACCAGGGC CACT SEQ ID NO:9625 | CAGCAGTATAATGACTGGCC GTGTAGT SEQ ID NO:17637 |
| | | AA | RASQSVNSNLA SEQ ID NO:1614 | IASTRAT SEQ ID NO:9626 | QQYNDWPCS SEQ ID NO:17638 |

FIGURE 49
(Continued)

| | | | | | |
|---|---|---|---|---|---|
| iPS:434397 | 21-225_67H4 | NA | CGGGGCGAGTCAGGGTATTAG CAGCTGGTTAGCC SEQ ID NO:1615 | GCTGCATCCAGTTTGCAA AGT SEQ ID NO:9627 | CAACAGATTAACAGTTTCCC TCTCACT SEQ ID NO:17639 |
| | | AA | RASQGISSWLA SEQ ID NO:1616 | AASSLQS SEQ ID NO:9628 | QQINSFPLT SEQ ID NO:17640 |
| iPS:434399 | 21-225_67B7 | NA | CGGGCAAGTCAGGGCATTAG AAATGATTTAGGC SEQ ID NO:1617 | GCTGCATCCAGTTTGCAA AGT SEQ ID NO:9629 | CTACCACCATAATAGTTATCC ATTCAAA SEQ ID NO:17641 |
| | | AA | RASQGIRNDLG SEQ ID NO:1618 | AASSLQS SEQ ID NO:9630 | LHHNSYPFK SEQ ID NO:17642 |
| iPS:434405 | 21-225_68E6 | NA | CGGGCGAGTCAGGGCATTAG CTATTATTTAGCC SEQ ID NO:1619 | GTTGCATCCAGTTTGCAA AGT SEQ ID NO:9631 | CAACAGTATGATAGTTACCC ATTCACT SEQ ID NO:17643 |
| | | AA | RASQGISYYLA SEQ ID NO:1620 | VASSLQS SEQ ID NO:9632 | QQYDSYPFT SEQ ID NO:17644 |
| iPS:434407 | 21-225_68G8 | NA | CGGGCAAGTCAGGGCATTAG AAATAATTTAGGC SEQ ID NO:1621 | GCTGCATCCAGTGTGCA AAGT SEQ ID NO:9633 | CTACAGTATAATAGTTACCC ATTCACT SEQ ID NO:17645 |
| | | AA | RASQGIRNNLG SEQ ID NO:1622 | AASSVQS SEQ ID NO:9634 | LQYNSYPFT SEQ ID NO:17646 |
| iPS:434411 | 21-225_68F11 | NA | CGGGCAAGTCAGGGCATTAG AAATGATTTAGGC SEQ ID NO:1623 | GCTGCATCCAGTTTGCAA AGT SEQ ID NO:9635 | CTACAGCATAATAGTTATCC GTTCACT SEQ ID NO:17647 |
| | | AA | RASQGIRNDLG SEQ ID NO:1624 | AASSLQS SEQ ID NO:9636 | LQHNSYPFT SEQ ID NO:17648 |
| iPS:434413 | 21-225_68D12 | NA | CGGGCAAGTCAGGGCATTAG AAATGATTTAGGC SEQ ID NO:1625 | GCTGCATCCAGTTTGCAA AGT SEQ ID NO:9637 | CTACAGCATAGTACTTACCC GCTCACT SEQ ID NO:17649 |
| | | AA | RASQGIRNDLG SEQ ID NO:1626 | AASSLQS SEQ ID NO:9638 | LQHSTYPLT SEQ ID NO:17650 |

FIGURE 49
(Continued)

| | | | | | |
|---|---|---|---|---|---|
| iPS:434417 | 21-225_69C8 | NA | CGGGCAGGTCAGACCATTTA CAATTATTTAAAT SEQ ID NO:1627 | GTTGCGTCCAGTTTGCAA AGT SEQ ID NO:9639 | CAACAGAGTTACAGTACCCC ATTCACT SEQ ID NO:17651 |
| | | AA | RAGQTIYNYLN SEQ ID NO:1628 | VASSLQS SEQ ID NO:9640 | QQSYSTPFT SEQ ID NO:17652 |
| iPS:434423 | 21-225_70D1 | NA | CGGGCGAGTCAGGGTGTTAG CAGGTGGTTAGCC SEQ ID NO:1629 | GCTGCATCCAGTTTGCAA AGT SEQ ID NO:9641 | CAACAGGCTAACAGTTTCCC ATTCACT SEQ ID NO:17653 |
| | | AA | RASQGVSRWLA SEQ ID NO:1630 | AASSLQS SEQ ID NO:9642 | QQANSFPFT SEQ ID NO:17654 |
| iPS:434425 | 21-225_70A5 | NA | AGGGCCAGTCAGAGTGTTAA CAGCAACTTAGCC SEQ ID NO:1631 | ATTGCATCCACCAGGGC CACT SEQ ID NO:9643 | CAGCAGTATAATGACTGGCC GTGTAGT SEQ ID NO:17655 |
| | | AA | RASQSVNSNLA SEQ ID NO:1632 | IASTRAT SEQ ID NO:9644 | QQYNDWPCS SEQ ID NO:17656 |
| iPS:434427 | 21-225_70D6 | NA | CGGGCGAGTCAGGGTATTAG CAAATGGTTAGCC SEQ ID NO:1633 | GCTGCATCCAGTTTGCAA AGT SEQ ID NO:9645 | CAACAGACTAACAGTTTCCC TCTCACT SEQ ID NO:17657 |
| | | AA | RASQGISKWLA SEQ ID NO:1634 | AASSLQS SEQ ID NO:9646 | QQTNSFPLT SEQ ID NO:17658 |
| iPS:434429 | 21-225_70H6 | NA | CGGACAAGTCAGAGCATTTT CAACTATTTAAAT SEQ ID NO:1635 | ACTGCATCCAGTTTGCAA AGT SEQ ID NO:9647 | CAACAGAGTTACAGTATCCC GCTCACT SEQ ID NO:17659 |
| | | AA | RTSQSIFNYLN SEQ ID NO:1636 | TASSLQS SEQ ID NO:9648 | QQSYSIPLT SEQ ID NO:17660 |
| iPS:434431 | 21-225_70E7 | NA | AAGTCCAGCCAGAGTGTTTT ATACAGCTCCAACAATAACA ACTACTTGGCT SEQ ID NO:1637 | TGGGCATCTACCCGGGA ATCC SEQ ID NO:9649 | CAGCAATATTATAATATTCC TCCGACG SEQ ID NO:17661 |
| | | AA | KSSQSVLYSSNNNNYLA | WASTRES | QQYYNIPPT |

FIGURE 49
(Continued)

| | | | | | | |
|---|---|---|---|---|---|---|
| iPS:434433 | 21-225_70E8 | NA | SEQ ID NO:1638 CGGGCAAGTCAGGGCATTAG AAAGGATTAGGC | SEQ ID NO:9650 GCTGCATCCAGTTGCAA AGT | SEQ ID NO:17662 CTACAGCATAATCGTTACCC GCTCACT |
| | | | SEQ ID NO:1639 RASQGIRKDLG | SEQ ID NO:9651 AASSLQS | SEQ ID NO:17663 LQHNRYPLT |
| | | AA | SEQ ID NO:1640 | SEQ ID NO:9652 | SEQ ID NO:17664 |
| iPS:434435 | 21-225_70G9 | NA | SEQ ID NO:1641 CGGGCGAGTCAGGATATTAG CAGCTGGTTAGCC | SEQ ID NO:9653 GCTGCATCCAGTTGCAA AGT | SEQ ID NO:17665 CAACAGACTAACAGTTTCCC TCTCACT |
| | | | SEQ ID NO:1642 RASQDISSWLA | SEQ ID NO:9654 AASSLQS | SEQ ID NO:17666 QQTNSFPLT |
| | | AA | | | |
| iPS:434437 | 21-225_70A12 | NA | SEQ ID NO:1643 CGGGCGAGTCAGGGTATTAG CAGCTGGTTAGCC | SEQ ID NO:9655 GCTGCATCCAGTTGCAA AGT | SEQ ID NO:17667 CAACAGATTAACAGTTTCCC TCTCACT |
| | | | SEQ ID NO:1644 RASQGISSWLA | SEQ ID NO:9656 AASSLQS | SEQ ID NO:17668 QQINSFPLT |
| | | AA | | | |
| iPS:434439 | 21-225_70E12 | NA | SEQ ID NO:1645 CGGGCAAGTCAGGGCATTAA CAATAATTTAAAC | SEQ ID NO:9657 GCTGCATCCAGTTGCAA AGT | SEQ ID NO:17669 CTACAGCATAATAGTTACCC GCTCACT |
| | | | SEQ ID NO:1646 RASQGINNNLN | SEQ ID NO:9658 AASSLQS | SEQ ID NO:17670 LQHNSYPLT |
| | | AA | | | |
| iPS:434441 | 21-225_71A2 | NA | SEQ ID NO:1647 CGTGCAAGTCAGGGCATTAG AAATGATTAGGA | SEQ ID NO:9659 ATTGCATTCAGATTGCAA ATT | SEQ ID NO:17671 ATACACCATAATAGTTACCC GTGGACG |
| | | | SEQ ID NO:1648 RASQGIRNDLG | SEQ ID NO:9660 IAFRLQI | SEQ ID NO:17672 IHHNSYPWT |
| | | AA | | | |
| iPS:434443 | 21-225_71G3 | NA | SEQ ID NO:1649 AAGTCCAGCCAGAGTGTTTT ACACAGCTCCAACAATAACA ACTACTTAGAT | SEQ ID NO:9661 TGGGCATCTACCCGGGA ATTC | SEQ ID NO:17673 CAACAATATTATATTACTCC GTGCAGT |

FIGURE 49
(Continued)

| | | KSSQSVLHSSNNNNYLD | | WASTREF | | QQYYITPCS | |
|---|---|---|---|---|---|---|---|
| | AA | SEQ ID NO:1650 | | SEQ ID NO:9662 | | SEQ ID NO:17674 | |
| iPS:434447 | NA | CGGGCAAGTCAGGGCATTAG AAATGATTTAGAT | | GCTGCATCCAGTTTGCAA AGT | | CTACAGCATAATAGTTACCC ATTCACT | |
| 21-225_71B6 | | SEQ ID NO:1651 | | SEQ ID NO:9663 | | SEQ ID NO:17675 | |
| | AA | RASQGIRNDLD | | AASSLQS | | LQHNSYPFT | |
| iPS:434449 | | SEQ ID NO:1652 | | SEQ ID NO:9664 | | SEQ ID NO:17676 | |
| | NA | CGGGCAAGTCAGGGCATTAG AAATGTTTTAGGC | | GCTGCATCCAGTTTACAA AGT | | CTACAGTATAATAGTTACCC ATTCACT | |
| 21-225_71H6 | | SEQ ID NO:1653 | | SEQ ID NO:9665 | | SEQ ID NO:17677 | |
| | AA | RASQGIRNVLG | | AASSLQS | | LQYNSYPFT | |
| iPS:434451 | | SEQ ID NO:1654 | | SEQ ID NO:9666 | | SEQ ID NO:17678 | |
| | NA | CGGGCGAGTCAGGGTATTAG CAGCTGGTTAGCC | | GCTGCATCCAGTTTGCAA GGT | | CAACAGACTAATAGTTTCCC TCTCACT | |
| 21-225_71B7 | | SEQ ID NO:1655 | | SEQ ID NO:9667 | | SEQ ID NO:17679 | |
| | AA | RASQGISSWLA | | AASSLQG | | QQTNSFPLT | |
| iPS:434453 | | SEQ ID NO:1656 | | SEQ ID NO:9668 | | SEQ ID NO:17680 | |
| | NA | CGGGCAAGTCAGGGCATTAG AAATGATTTAGAT | | GCTGCATCCAGTTTGCAA AGT | | CTACAGCATAATACTTACCC ATTCACT | |
| 21-225_71B11 | | SEQ ID NO:1657 | | SEQ ID NO:9669 | | SEQ ID NO:17681 | |
| | AA | RASQGIRNDLD | | AASSLQS | | LQHNTYPFT | |
| iPS:434455 | | SEQ ID NO:1658 | | SEQ ID NO:9670 | | SEQ ID NO:17682 | |
| | NA | CGGGCAAGTCAGAACATTAG CAGCTATTTAAAT | | GCTGCATCCAGTTTGCAA AGT | | CAACAGACTTACAGTACCCC CACC | |
| 21-225_72F5 | | SEQ ID NO:1659 | | SEQ ID NO:9671 | | SEQ ID NO:17683 | |
| | AA | RASQNISSYLN | | AASSLQS | | QQTYSTPT | |
| iPS:434457 | | SEQ ID NO:1660 | | SEQ ID NO:9672 | | SEQ ID NO:17684 | |
| | NA | CGGGCGAGTCAGGGCATTAG CAGTTATTTAAAT | | GGTGCTTCCAATTTGCAA TCT | | CAACAGAATTACAATGCCCC GCTCACT | |
| 21-225_72G12 | | SEQ ID NO:1661 | | SEQ ID NO:9673 | | SEQ ID NO:17685 | |

FIGURE 49
(Continued)

| | | AA | RASQGISSYLN | GASNLQS | QQNYNAPLT |
|---|---|---|---|---|---|
| iPS:434459 | | | SEQ ID NO:1662 | SEQ ID NO:9674 | SEQ ID NO:17686 |
| | 21-225_71A7 | NA | CGGGCGAGTCAGGGTATTAG CAGCTGGTTAGCC | GCTGCATCCAGTTTGCAA AGT | CAACAGGTTAACAGTTTCCC TCTCACT |
| | | | SEQ ID NO:1663 | SEQ ID NO:9675 | SEQ ID NO:17687 |
| iPS:434461 | | AA | RASQGISSWLA | AASSLQS | QQVNSFPLT |
| | | | SEQ ID NO:1664 | SEQ ID NO:9676 | SEQ ID NO:17688 |
| | 21-225_73A3 | NA | CGGGCGAGTCAGGGTATTAG CAACTGGTTAGCC | GCTGCATCCAGTTTGCAA AGT | CAACAGGTTAACAGTTTCCC TCTCACT |
| | | | SEQ ID NO:1665 | SEQ ID NO:9677 | SEQ ID NO:17689 |
| iPS:434463 | | AA | RASQGISNWLA | AASSLQS | QQVNSFPLT |
| | | | SEQ ID NO:1666 | SEQ ID NO:9678 | SEQ ID NO:17690 |
| | 21-225_73A6 | NA | CGGGCAAGTCAGGGCATTAG AAATGATTTAGGC | GCTGCATCCAATTTGCAA AGT | CTACAGTATAATAGTTACCC ATTCACT |
| | | | SEQ ID NO:1667 | SEQ ID NO:9679 | SEQ ID NO:17691 |
| iPS:434467 | | AA | RASQDIRNDLG | AASNLQS | LQHNSYPFT |
| | | | SEQ ID NO:1668 | SEQ ID NO:9680 | SEQ ID NO:17692 |
| | 21-225_73H8 | NA | CGGGCAAGTCAGGACATCA GAAATGATTTAGGC | GCTGCATCCAGTTTGCAA AGT | ATACAGCATAATAGTTACCC TCCGATCACC |
| | | | SEQ ID NO:1669 | SEQ ID NO:9681 | SEQ ID NO:17693 |
| iPS:434469 | | AA | RASQDIRNDLG | AASSLQS | IQHNSYPPTT |
| | | | SEQ ID NO:1670 | SEQ ID NO:9682 | SEQ ID NO:17694 |
| | 21-225_73C9 | NA | CGGGCAAGTCAGGGCATTAG AAATGATTTAGGC | GCTGCATCCAGTTTGCAA AGT | CTACAGCATTATAGTTACCC TCGGACG |
| | | | SEQ ID NO:1671 | SEQ ID NO:9683 | SEQ ID NO:17695 |
| iPS:434471 | | AA | RASQGIRNDLG | AASSLQS | LQHYSYPRT |
| | | | SEQ ID NO:1672 | SEQ ID NO:9684 | SEQ ID NO:17696 |
| | 21-225_75G3 | NA | AGGGCCCGTCAGAAATGTTGA CAGCAGTACTTAGCC | GGTGCATCCAGCAGGGC CACT | CAGCAGTATGAACGCTCACC GTGGACG |
| | | | SEQ ID NO:1673 | SEQ ID NO:9685 | SEQ ID NO:17697 |

FIGURE 49
(Continued)

| | | | | | | |
|---|---|---|---|---|---|---|
| iPS:434473 | | AA | RARQNVDSSYLA<br>SEQ ID NO:1674 | | GASSRAT<br>SEQ ID NO:9686 | QQYERSPWT<br>SEQ ID NO:17698 |
| | 21-225_76D1 | NA | AGGGCCAGTCAGAGAATATTTA<br>CAGCAACTACCTAGCC<br>SEQ ID NO:1675 | GGTGCATCCAGCAGGGC<br>CACT<br>SEQ ID NO:9687 | | CAGCAGTATGAAAGTTCACC<br>GTGGACG<br>SEQ ID NO:17699 |
| iPS:434475 | | AA | RASQNIYSNYLA<br>SEQ ID NO:1676 | | GASSRAT<br>SEQ ID NO:9688 | QQYESSPWT<br>SEQ ID NO:17700 |
| | 21-225_74F9 | NA | AAGTCCAGCCAGAGTGTTTT<br>ATACAGCTCCAACAATTACA<br>ACTACTTAGCT<br>SEQ ID NO:1677 | TGGGCATCTACCCGGGA<br>ATCC<br>SEQ ID NO:9689 | | CAGCAATATTATAGTAGTCC<br>TCCGACG<br>SEQ ID NO:17701 |
| iPS:434477 | | AA | KSSQSVLYSSNNYNYLA<br>SEQ ID NO:1678 | | WASTRES<br>SEQ ID NO:9690 | QQYYSSPPT<br>SEQ ID NO:17702 |
| | 21-225_74A6 | NA | AAGTCCAGCCAGAGTGTTTT<br>ACACAGCTCCAACAACAACA<br>ATTACTTAGCC<br>SEQ ID NO:1679 | TGGGCATCAACCCGGGA<br>ATCC<br>SEQ ID NO:9691 | | CAGCAATATTTAGTACTCC<br>GTGGACG<br>SEQ ID NO:17703 |
| iPS:434479 | | AA | KSSQSVLHSSNNNNYLA<br>SEQ ID NO:1680 | | WASTRES<br>SEQ ID NO:9692 | QQYFSTPWT<br>SEQ ID NO:17704 |
| | 21-225_76H1 | NA | AGGGCCAGTCAGAGTGTTAG<br>CAGCAGCTACTTAGTC<br>SEQ ID NO:1681 | GGTGCATCCACCAGGGC<br>CACT<br>SEQ ID NO:9693 | | CAGCAGTATGGTTGCTCACC<br>GCTCACT<br>SEQ ID NO:17705 |
| iPS:434481 | | AA | RASQSVSSSYLV<br>SEQ ID NO:1682 | | GASTRAT<br>SEQ ID NO:9694 | QQYGCSPLT<br>SEQ ID NO:17706 |
| | 21-225_74B10 | NA | AAGTCCAGCCAGAGTGTTTT<br>ACACAGCTCCAACAATAAGA<br>ACTACTTAACT<br>SEQ ID NO:1683 | TGGGCATCTACTCGGGA<br>ATCC<br>SEQ ID NO:9695 | | CAGCAATATTATAGTATTCC<br>TCCGACG<br>SEQ ID NO:17707 |
| | | AA | KSSQSVLHSSNNKNYLT<br>SEQ ID NO:1684 | | WASTRES<br>SEQ ID NO:9696 | QQYYSIPPT<br>SEQ ID NO:17708 |

FIGURE 49
(Continued)

| | | | | | |
|---|---|---|---|---|---|
| iPS:434483 | 21-225_74C12 | NA | AAGTCCAGCCAGAGTGTTTTATACAGCTCCAACAATGCGAACTACTTAGCT | TGGGCATCTACCCGGAATCC | CAGCAATATTATAGTACTCCGTGCAGT |
| | | | SEQ ID NO:1685 | SEQ ID NO:9697 | SEQ ID NO:17709 |
| | | AA | KSSQSVLYSSNNANYLA | WASTRES | QQYYSTPCS |
| | | | SEQ ID NO:1686 | SEQ ID NO:9698 | SEQ ID NO:17710 |
| iPS:434485 | 21-225_76D2 | NA | AGGGCCAGTGTGAGTGTTGTCAACAGCTTAGCC | GGTGCATCCACCAGGGCCACT | CAGCAATATAATGACTGGGCCGTGCAGT |
| | | | SEQ ID NO:1687 | SEQ ID NO:9699 | SEQ ID NO:17711 |
| | | AA | RASVSVVNSLA | GASTRAT | QQYNDWPCS |
| | | | SEQ ID NO:1688 | SEQ ID NO:9700 | SEQ ID NO:17712 |
| iPS:434487 | 21-225_76G2 | NA | AAGTCCAGCCAGAGTGTTTTACACAGCTCCAACAATTACAACTACTTAGCT | TGGGCATCTACCCGGAATCC | CAGCAATATTATAGTTCTCCTCCGACG |
| | | | SEQ ID NO:1689 | SEQ ID NO:9701 | SEQ ID NO:17713 |
| | | AA | KSSQSVLHSSNNYNYLA | WASTRES | QQYSSPPT |
| | | | SEQ ID NO:1690 | SEQ ID NO:9702 | SEQ ID NO:17714 |
| iPS:434489 | 21-225_74E4 | NA | CGGGCAAGTCAGGGCATTAGAAATGATTTAGGC | GCTGCATCCACTTTGCAAAGT | CTACAGCATAGTAATTACCCGCTCACT |
| | | | SEQ ID NO:1691 | SEQ ID NO:9703 | SEQ ID NO:17715 |
| | | AA | RASQGIRNDLG | AASTLQS | LQHSNYPLT |
| | | | SEQ ID NO:1692 | SEQ ID NO:9704 | SEQ ID NO:17716 |
| iPS:434493 | 21-225_76F3 | NA | AAGTCCAGCCAGAGTGTTTTATTCAGCTCCAACAATTATAATTACTTAGCT | TGGGCATCTACCCGGAATCC | CAGCAATATCATAGTTCTCCTCTGACG |
| | | | SEQ ID NO:1693 | SEQ ID NO:9705 | SEQ ID NO:17717 |
| | | AA | KSSQSVLFSSNNYNYLA | WASTRES | QQYHSSPLT |
| | | | SEQ ID NO:1694 | SEQ ID NO:9706 | SEQ ID NO:17718 |
| iPS:434495 | | NA | AGGGCCAGTCAGAATATTTACAGCAGTTACTTAGCC | GGTGCATCCAGCAGGGCCACT | CAGCAGTATGAAAGCTCACCGTGGACC |

FIGURE 49
(Continued)

| | | | | | | | |
|---|---|---|---|---|---|---|---|
| iPS:434497 | 21-225_74B2 | AA | SEQ ID NO:1695<br>RASQNIYSSYLA | SEQ ID NO:9707<br>GASSRAT | SEQ ID NO:17719<br>QQYESSPWT | | |
| | | NA | SEQ ID NO:1696<br>AGGGCCAGTCAGAGTGTTTA<br>CAGCAGCTACTTAGCC | SEQ ID NO:9708<br>GGTGCATCCAGCCGGGC<br>CACT | SEQ ID NO:17720<br>CAGCACTCTGATAACTCACC<br>GTGGACG | | |
| iPS:434501 | 21-225_76A4 | AA | SEQ ID NO:1697<br>RASQSVYSSYLA | SEQ ID NO:9709<br>GASSRAT | SEQ ID NO:17721<br>QHSDNSPWT | | |
| | | NA | SEQ ID NO:1698<br>AGGGCCAGTCAGAGTGTTTA<br>CAGCAGCTACTTAGCC | SEQ ID NO:9710<br>GGTGCATCCAGCCGGGC<br>CACT | SEQ ID NO:17722<br>CAGCACTCTGATAACTCACC<br>GTGGACG | | |
| | 21-225_76G4 | AA | SEQ ID NO:1699<br>RASQSVYSSYLA | SEQ ID NO:9711<br>GASSRAT | SEQ ID NO:17723<br>QHSDNSPWT | | |
| | | NA | SEQ ID NO:1700<br>CGGGCAAGTCAGGGCATTAG<br>AAATGATTTAGGC | SEQ ID NO:9712<br>GCTGCATCCAGTTGCAA<br>AGT | SEQ ID NO:17724<br>CTTCAGCATAGTAATTACCC<br>GCTCACT | | |
| iPS:434503 | 21-225_74D7 | AA | SEQ ID NO:1701<br>RASQGIRNDLG | SEQ ID NO:9713<br>AASSLQS | SEQ ID NO:17725<br>LQHSNYPLT | | |
| | | NA | SEQ ID NO:1702<br>AGGGCCAGTCAGAGTGTTAA<br>CAGCAACTACTTAGCC | SEQ ID NO:9714<br>GGTGCATTCAGCAGGGC<br>CACT | SEQ ID NO:17726<br>CAGCAGTATGAAAGCTCACC<br>GTGGACG | | |
| iPS:434507 | 21-225_74C5 | AA | SEQ ID NO:1703<br>RASQSVNSNYLA | SEQ ID NO:9715<br>GAFSRAT | SEQ ID NO:17727<br>QQYESSPWT | | |
| | | NA | SEQ ID NO:1704<br>AAGTCCAGCCAGAGTGTATT<br>ACACAGCTCCAACAGTTACA<br>ACTACTTAGCT | SEQ ID NO:9716<br>TGGACATCTACCCGGGA<br>ATCC | SEQ ID NO:17728<br>CAGCAATATTATAGTAGTCC<br>TCCGACG | | |
| iPS:434509 | 21-225_76F5 | AA | SEQ ID NO:1705<br>KSSQSVLHSSNSYNYLA | SEQ ID NO:9717<br>WTSTRES | SEQ ID NO:17729<br>QQYYSSPPT | | |
| | | | SEQ ID NO:1706 | SEQ ID NO:9718 | SEQ ID NO:17730 | | |

FIGURE 49
(Continued)

| | | | | | |
|---|---|---|---|---|---|
| iPS:434511 | 21-225_74B11 | NA | AAGTCCAGCCAGAGTATTT ATACAACTCCAACAATAACA ACTACTTAGCT SEQ ID NO:1707 | TGGGCATCTACCCGGGA ATCC SEQ ID NO:9719 | CAGCAATATTATAGCACTCC TCCTACT SEQ ID NO:17731 |
| | | AA | KSSQSILYNSNNNYLA SEQ ID NO:1708 | WASTRES SEQ ID NO:9720 | QQYYSTPPT SEQ ID NO:17732 |
| iPS:434513 | 21-225_76A6 | NA | AGGGCCAGTCAGAGTGTTAG CAGCAGCTACTTAGCC SEQ ID NO:1709 | GGTGCATCCACCAGGGC CACT SEQ ID NO:9721 | CAGCAGTATGGTAACTCACC GCTCACT SEQ ID NO:17733 |
| | | AA | RASQSVSSSYLA SEQ ID NO:1710 | GASTRAT SEQ ID NO:9722 | QQYGNSPLT SEQ ID NO:17734 |
| iPS:434515 | 21-225_74A5 | NA | AGGGCCAGTCAGAGTGTTAG CAGCAGCTACTTAGTC SEQ ID NO:1711 | GGTGCATCCACCAGGGC CACT SEQ ID NO:9723 | CAGCAGTATGGTTGCTCACC GCTCACT SEQ ID NO:17735 |
| | | AA | RASQSVSSSYLV SEQ ID NO:1712 | GASTRAT SEQ ID NO:9724 | QQYGCSPLT SEQ ID NO:17736 |
| iPS:434517 | 21-225_76A7 | NA | AGGGCCAGTCCGAGTGTTGA CAGCAGCTATCAGCC SEQ ID NO:1713 | GGTGCATCCAGCAGGGC CCCT SEQ ID NO:9725 | CAGCAGTATGAAAGTTCACC GTGGACG SEQ ID NO:17737 |
| | | AA | RASPSVDSSYLA SEQ ID NO:1714 | GASSRAP SEQ ID NO:9726 | QQYESSPWT SEQ ID NO:17738 |
| iPS:434519 | 21-225_74C7 | NA | AGGACCAGTCCGAATGTTGA CAGCAGCTACTTAGCC SEQ ID NO:1715 | GGTGCATCCAGCAGGGC CACT SEQ ID NO:9727 | CAGCAGTATGAACGCTCACC GTGGACG SEQ ID NO:17739 |
| | | AA | RTSPNVDSSYLA SEQ ID NO:1716 | GASSRAT SEQ ID NO:9728 | QQYERSPWT SEQ ID NO:17740 |
| iPS:434523 | 21-225_75C3 | NA | AGGGCCAGTCAGAGTGTTAG CAGCAGGTACTTAGCC SEQ ID NO:1717 | GGTGCATCCAGCAGGGC CACT SEQ ID NO:9729 | CAGCATTATGATAGCTCACC GTGGACG SEQ ID NO:17741 |
| | | AA | RASQSVSSRYLA | GASSRAT | QHYDSSPWT |

FIGURE 49
(Continued)

| | | | | | | |
|---|---|---|---|---|---|---|
| iPS:434525 | | NA | SEQ ID NO:1718<br>AAGTCCAGCCAGAGCTGTTT<br>ACACAGCTCCAACAATTATA<br>ACTACTTAGCT<br>SEQ ID NO:1719 | SEQ ID NO:9730<br>TGGACATCTACCCGGGA<br>ATCC<br>SEQ ID NO:9731 | SEQ ID NO:17742<br>CAGCAATATTTTAGTAGTCC<br>TCTGACG<br>SEQ ID NO:17743 |
| 21-225_76E8 | | AA | KSSQTVLHSSNNYNYLA<br>SEQ ID NO:1720 | WTSTRES<br>SEQ ID NO:9732 | QQYFSSPLT<br>SEQ ID NO:17744 |
| iPS:434529 | | NA | AGGGCCAGTCAGAGTGTTAG<br>CAGCAGTACTTAGTC<br>SEQ ID NO:1721 | GGTGCATCCACCAGGGC<br>CACT<br>SEQ ID NO:9733 | CAGCAGTATGGTTGCTCACC<br>GCTCACT<br>SEQ ID NO:17745 |
| 21-225_76B9 | | AA | RASQSVSSSYLV<br>SEQ ID NO:1722 | GASTRAT<br>SEQ ID NO:9734 | QQYGCSPLT<br>SEQ ID NO:17746 |
| iPS:434531 | | NA | AGGGCCAGTCAGAGTGTTAG<br>CAGCAGTACTTATCC<br>SEQ ID NO:1723 | GGTGCATCCAGCAGGGC<br>CACT<br>SEQ ID NO:9735 | CAGCAGTATGGTAGGTCACG<br>GACG<br>SEQ ID NO:17747 |
| 21-225_76C9 | | AA | RASQSVSSSYLS<br>SEQ ID NO:1724 | GASSRAT<br>SEQ ID NO:9736 | QQYGRSRT<br>SEQ ID NO:17748 |
| iPS:434533 | | NA | AGGGCCAGTCAGAATATTA<br>CAGCAACTACTTAGCC<br>SEQ ID NO:1725 | GGTGCATCCAGCAGGGC<br>CACT<br>SEQ ID NO:9737 | CAGCAGTATGAAAGCTCACC<br>GTGGACC<br>SEQ ID NO:17749 |
| 21-225_85F7 | | AA | RASQNIYSNYLA<br>SEQ ID NO:1726 | GASSRAT<br>SEQ ID NO:9738 | QQYESSPWT<br>SEQ ID NO:17750 |
| iPS:434535 | | NA | CGGGCGAGTCAGGGCATTGG<br>CAAGTATTTAGCC<br>SEQ ID NO:1727 | ACTACATCCAATTTACAA<br>AGT<br>SEQ ID NO:9739 | CAACAGTATACAGTAATTACCC<br>GCTCACT<br>SEQ ID NO:17751 |
| 21-225_74C8 | | AA | RASQGIGKYLA<br>SEQ ID NO:1728 | TTSNLQS<br>SEQ ID NO:9740 | QQYSNYPLT<br>SEQ ID NO:17752 |
| iPS:434537 | | NA | AGGGCCAGTCTGAGTGTTGT<br>CAACAGTTAGCC<br>SEQ ID NO:1729 | GGTGCATCCACCAGGGC<br>CACT<br>SEQ ID NO:9741 | CAGCAGTATAATGACTGGCC<br>GTGCAGT<br>SEQ ID NO:17753 |
| 21-225_74E11 | | | | | |

FIGURE 49
(Continued)

| | | | AA | RASLSVVNSLA | | GASTRAT | | QQYNDWPCS | |
|---|---|---|---|---|---|---|---|---|---|
| iPS:434539 | | | | SEQ ID NO:1730 | | SEQ ID NO:9742 | | SEQ ID NO:17754 | |
| | 21-225_74A2 | | NA | AGGTCTAGTCAGAGCCTCCTGCATAGTAATGGACACAACTATTTGGAT | | TTGGGTTCTAATCGGGCCTCC | | ATGCAACCTCTACAAACTCCGTTCACT | |
| | | | | SEQ ID NO:1731 | | SEQ ID NO:9743 | | SEQ ID NO:17755 | |
| | | | AA | RSSQSLLHSNGHNYLD | | LGSNRAS | | MQPLQTPFT | |
| | | | | SEQ ID NO:1732 | | SEQ ID NO:9744 | | SEQ ID NO:17756 | |
| iPS:434547 | | | NA | AGGGCCAGTCAGAGTGTTAACAGCAACTACTTAGCC | | GGTGCATCCAGCAGGCCACT | | CAGCAGTATGAAAGCTCGCCGTGGACG | |
| | 21-225_74H5 | | | SEQ ID NO:1733 | | SEQ ID NO:9745 | | SEQ ID NO:17757 | |
| | | | AA | RASQSVNSNYLA | | GASSRAT | | QQYESSPWT | |
| | | | | SEQ ID NO:1734 | | SEQ ID NO:9746 | | SEQ ID NO:17758 | |
| iPS:434549 | | | NA | AAGTCCCGCCAGAGTGTTTTACACAGCTCCAACAATTACAACTACTTAGCT | | TGGGCTTCTACCCGGGAATCC | | CAGCAATATTATAGTACTCCTCCGACG | |
| | 21-225_76E11 | | | SEQ ID NO:1735 | | SEQ ID NO:9747 | | SEQ ID NO:17759 | |
| | | | AA | KSRQSVLHSSNNYNYLA | | WASTRES | | QQYYSTPPT | |
| | | | | SEQ ID NO:1736 | | SEQ ID NO:9748 | | SEQ ID NO:17760 | |
| iPS:434551 | | | NA | AAGTCCAGCCAGAGTATTTTATACAGCTCCAACAATAATAACTACTTAGCT | | TGGGCATCTACCCGGGAATCC | | CAGCAATATTATATTACTCCTCCGACG | |
| | 21-225_75C4 | | | SEQ ID NO:1737 | | SEQ ID NO:9749 | | SEQ ID NO:17761 | |
| | | | AA | KSSQSLLYSSNNNNYLA | | WASTRES | | QQYYITPPT | |
| | | | | SEQ ID NO:1738 | | SEQ ID NO:9750 | | SEQ ID NO:17762 | |
| iPS:434559 | | | NA | AGGGCCAGTCAGAGTGTTTACAGCAGCTACTTAGCC | | GGTGCATCCAGCCGGGCCACT | | CAGCACTATGATAACTCACCGTGGACG | |
| | 21-225_74D11 | | | SEQ ID NO:1739 | | SEQ ID NO:9751 | | SEQ ID NO:17763 | |
| | | | AA | RASQSVYSSYLA | | GASSRAT | | QHYDNSPWT | |
| | | | | SEQ ID NO:1740 | | SEQ ID NO:9752 | | SEQ ID NO:17764 | |

FIGURE 49
(Continued)

| | | | | | |
|---|---|---|---|---|---|
| iPS:434561 | 21-225_77G1 | NA | AGGGCCAGTCAGAGTGTTTA<br>CAGCAGCTACTTAGCC<br>SEQ ID NO:1741 | GGTGCATCCAGCCGGGC<br>CACT<br>SEQ ID NO:9753 | CAGCACTATGATAACTCACC<br>GTGGACG<br>SEQ ID NO:17765 |
| | | AA | RASQSVYSSYLA<br>SEQ ID NO:1742 | GASSRAT<br>SEQ ID NO:9754 | QHYDNSPWT<br>SEQ ID NO:17766 |
| iPS:434563 | 21-225_75D8 | NA | AGGTCTAGTCAGAGCCTCCT<br>GCATAGTAGTGGATACAACT<br>ATTTGGAT<br>SEQ ID NO:1743 | TTGGGTTCTAATCGGGCC<br>TCC<br>SEQ ID NO:9755 | ATGCAAGCTCTACACCCTCC<br>TCTCACT<br>SEQ ID NO:17767 |
| | | AA | RSSQSLLHSSGYNYLD<br>SEQ ID NO:1744 | LGSNRAS<br>SEQ ID NO:9756 | MQALHPPLT<br>SEQ ID NO:17768 |
| iPS:434565 | 21-225_75B10 | NA | AGGGCCAGTCCGAGTGTTAA<br>CAGCTACTACTTAGCC<br>SEQ ID NO:1745 | GGTGCAACCAGCAGGGC<br>CACT<br>SEQ ID NO:9757 | CAGCAGTATGAAGACTCACC<br>GTGGACG<br>SEQ ID NO:17769 |
| | | AA | RASPSVNSYYLA<br>SEQ ID NO:1746 | GATSRAT<br>SEQ ID NO:9758 | QQYEDSPWT<br>SEQ ID NO:17770 |
| iPS:434569 | 21-225_77H5 | NA | AGGGCCAGTCAGAGTGTTAG<br>CAGCAGCTTAGCC<br>SEQ ID NO:1747 | GGTGCATCCACCAGGGC<br>CACT<br>SEQ ID NO:9759 | CAGCAGTATAATGACTGGCC<br>GTGCAGT<br>SEQ ID NO:17771 |
| | | AA | RASQSVSSSLA<br>SEQ ID NO:1748 | GASTRAT<br>SEQ ID NO:9760 | QQYNDWPCS<br>SEQ ID NO:17772 |
| iPS:434571 | 21-225_74D2 | NA | AGGGCCAGTCAGAGTGTTGA<br>CAGCAACTACTTAGCC<br>SEQ ID NO:1749 | GGTGCATCCAGCAGGGC<br>CCCT<br>SEQ ID NO:9761 | CAGCAGTATGAAAGCTCACC<br>GTGGACG<br>SEQ ID NO:17773 |
| | | AA | RASQSVDSNYLA<br>SEQ ID NO:1750 | GASSRAP<br>SEQ ID NO:9762 | QQYESSPWT<br>SEQ ID NO:17774 |
| iPS:434573 | 21-225_77E6 | NA | CGGGCGAGTCAGGGCATTAG<br>CAAGTATTTAGCC<br>SEQ ID NO:1751 | GCTGCATCCAGTTTGCAA<br>GGT<br>SEQ ID NO:9763 | CAACAGTACAGTAATTACCC<br>GCTCACT<br>SEQ ID NO:17775 |
| | | AA | RASQGISKYLA | AASSLQG | QQYSNYPLT |

FIGURE 49
(Continued)

| | | | | |
|---|---|---|---|---|
| iPS:434575 | 21-225_77C7 | NA | SEQ ID NO:1752<br>AAGTCCAGCCAGACTGTTTTACACAGCTCCAACAATTATAACTACTTAGCT | SEQ ID NO:9764<br>TGGACATCTACCCGGGAATCC | SEQ ID NO:17776<br>CAGCAATATTTTAGTAGTCCTCCGACG |
| | | AA | SEQ ID NO:1753<br>KSSQTVLHSSNNYNYLA | SEQ ID NO:9765<br>WTSTRES | SEQ ID NO:17777<br>QQYFSSPPT |
| iPS:434579 | 21-225_77F7 | NA | SEQ ID NO:1754<br>AGGGCCAGTCAGAGTGTTTACAGCAGCTACTTAGCG | SEQ ID NO:9766<br>GGTGCATCCAGCCGGGCCACT | SEQ ID NO:17778<br>CAGCACTATGATAACTCACCGTGGACG |
| | | AA | SEQ ID NO:1755<br>RASQSVYSSYLA | SEQ ID NO:9767<br>GASSRAT | SEQ ID NO:17779<br>QHYDNSPWT |
| iPS:434581 | 21-225_74B12 | NA | SEQ ID NO:1756<br>AGGGCCAGTCAGAGTGTTTACAGCAGCTACTTAGCC | SEQ ID NO:9768<br>GGTGCATCCAGCCGGTCCACT | SEQ ID NO:17780<br>CAGCACTATGATAACTCACCGTGGACG |
| | | AA | SEQ ID NO:1757<br>RASQSVYSSYLA | SEQ ID NO:9769<br>GASSRST | SEQ ID NO:17781<br>QHYDNSPWT |
| iPS:434583 | 21-225_74B6 | NA | SEQ ID NO:1758<br>AGGGCCAGTCAGAGTGTTAGCAGCAGCTACTTAGCC | SEQ ID NO:9770<br>GGTGCATCCACCAGGGCCACT | SEQ ID NO:17782<br>CAGCAGTATGGTAACTCACCGCTCACT |
| | | AA | SEQ ID NO:1759<br>RASQSVSSSYLA | SEQ ID NO:9771<br>GASTRAT | SEQ ID NO:17783<br>QQYGNSPLT |
| iPS:434585 | 21-225_75A12 | NA | SEQ ID NO:1760<br>AGGGCCAGTCAGAGTGTTAGCAGCAGCTACTTAGCC | SEQ ID NO:9772<br>GGTGCATCCAGCAGGGCCACT | SEQ ID NO:17784<br>CAGCATTATGATAGCTCACCGTGGACG |
| | | AA | SEQ ID NO:1761<br>RASQSVSSRYLA | SEQ ID NO:9773<br>GASSRAT | SEQ ID NO:17785<br>QHYDSSPWT |
| iPS:434587 | 21-225_74G3 | NA | SEQ ID NO:1762<br>AGGGCCAGTCAGAGTGTTAGCAGCAGCTACTTAGTC | SEQ ID NO:9774<br>GGTGCATCCACCAGGGCCACT | SEQ ID NO:17786<br>CAGCAGTATGGTTGCTCACCGCTCACT |
| | | | SEQ ID NO:1763 | SEQ ID NO:9775 | SEQ ID NO:17787 |

FIGURE 49
(Continued)

| | | | | | | | |
|---|---|---|---|---|---|---|---|
| iPS:434595 | | AA | RASQSVSSSYLV<br>SEQ ID NO:1764 | | GASTRAT<br>SEQ ID NO:9776 | | QQYGCSPLT<br>SEQ ID NO:17788 |
| | 21-225_77A10 | NA | AGGGCCAGTCAGTCAGAGTGTTCA<br>CAGCAGGTACTTAGCC<br>SEQ ID NO:1765 | | GGTGCATCCAGCAGGGC<br>CACT<br>SEQ ID NO:9777 | | CAGCATTATGATAGCTCACC<br>GTGGACG<br>SEQ ID NO:17789 |
| iPS:434597 | | AA | RASQSVHSRYLA<br>SEQ ID NO:1766 | | GASSRAT<br>SEQ ID NO:9778 | | QHYDSSPWT<br>SEQ ID NO:17790 |
| | 21-225_77C10 | NA | AAGTCCAGCCAGAGTGTTT<br>ATACACCTCCAACAATAACA<br>ACTACTTAGCT<br>SEQ ID NO:1767 | | TGGGCATCTACCCGGGA<br>ATCC<br>SEQ ID NO:9779 | | CAGCACTATTATAATACTCC<br>GTGGAAG<br>SEQ ID NO:17791 |
| iPS:434603 | | AA | KSSQSVLYTSNNNNYLA<br>SEQ ID NO:1768 | | WASTRES<br>SEQ ID NO:9780 | | QHYYNTPWK<br>SEQ ID NO:17792 |
| | 21-225_77D11 | NA | AGGGCCAGTCAGTCAGAGTGTTAG<br>CAGCAGTACTTAGTC<br>SEQ ID NO:1769 | | GGTGCATCCACCAGGGC<br>CACT<br>SEQ ID NO:9781 | | CAGCAGTATGGTTGCTCACC<br>GCTCACT<br>SEQ ID NO:17793 |
| iPS:434611 | | AA | RASQSVSSSYLV<br>SEQ ID NO:1770 | | GASTRAT<br>SEQ ID NO:9782 | | QQYGCSPLT<br>SEQ ID NO:17794 |
| | 21-225_77C12 | NA | AGGGCCAGGCAGAGTGTTG<br>ACAGCAGTTATTAGCC<br>SEQ ID NO:1771 | | GGTGCATCCAGCAGGGC<br>CACT<br>SEQ ID NO:9783 | | CAGCAGTATGAAAGCTCACC<br>GTGGACG<br>SEQ ID NO:17795 |
| iPS:434613 | | AA | RARQSVDSSYLA<br>SEQ ID NO:1772 | | GASSRAT<br>SEQ ID NO:9784 | | QQYESSPWT<br>SEQ ID NO:17796 |
| | 21-225_77D12 | NA | AGGTCCAGCCAGAGTGTTTT<br>ATACAGCTCCAACAATTATA<br>ACTACTTAGCT<br>SEQ ID NO:1773 | | TGGGCATCTACCCGGGA<br>TTCC<br>SEQ ID NO:9785 | | CAGCAATATTATACTACTCC<br>GTGCAGT<br>SEQ ID NO:17797 |
| | | AA | RSSQSVLYSSNNYNYLA<br>SEQ ID NO:1774 | | WASTRDS<br>SEQ ID NO:9786 | | QQYYTTPCS<br>SEQ ID NO:17798 |

FIGURE 49
(Continued)

| | | | | | |
|---|---|---|---|---|---|
| iPS:434615 | 21-225_76C5 | NA | CGGGCGAGTCAGGTCATTAG CAAGTATTAGCC SEQ ID NO:1775 | GCTGCATCCAGTTTGCAA AGT SEQ ID NO:9787 | CAACAGTACAGTAATTACCC GCTCACT SEQ ID NO:17799 |
| | | AA | RASQVISKYLA SEQ ID NO:1776 | AASSLQS SEQ ID NO:9788 | QQYSNYPLT SEQ ID NO:17800 |
| iPS:434617 | 21-225_74B8 | NA | AAGTCCAGCCAGAGTGTTT ACACAGCTCTAATAAAAGA ACTACTTAGCT SEQ ID NO:1777 | TGGGCATCTACCCGGA ATCC SEQ ID NO:9789 | CAGCAATATTATAGGACTCC GTGGACG SEQ ID NO:17801 |
| | | AA | KSSQSVLHSSNKKNYLA SEQ ID NO:1778 | WASTRES SEQ ID NO:9790 | QQYYRTPWT SEQ ID NO:17802 |
| iPS:434619 | 21-225_78C1 | NA | AAGTCCAGCCAGAGTGTTT ATACACCTCCAACAATAACA ACTACTTAGCT SEQ ID NO:1779 | TGGGCATCTACCCGGA ATCC SEQ ID NO:9791 | CAGCACTATTATAATACTCC GTGGAAG SEQ ID NO:17803 |
| | | AA | KSSQSVLYTSNNNNYLA SEQ ID NO:1780 | WASTRES SEQ ID NO:9792 | QHYYNTPWK SEQ ID NO:17804 |
| iPS:434621 | 21-225_74D1 | NA | AGGGCCAGTCAGAGTGTTAG CAGAAATTTAGCC SEQ ID NO:1781 | GGTGCATCCATCAGGGC CACT SEQ ID NO:9793 | CAGCAGTATAATAACTGGCC TCCGCTCACT SEQ ID NO:17805 |
| | | AA | RASQSVSRNLA SEQ ID NO:1782 | GASIRAT SEQ ID NO:9794 | QQYNNWPPLT SEQ ID NO:17806 |
| iPS:434629 | 21-225_74C3 | NA | AGGGCCAGTCAGAGTGTTGC CAGCAGCTTAGCC SEQ ID NO:1783 | GGTACATCCACCAGGGC CACT SEQ ID NO:9795 | CAGCAGTATAATGACTGGCC GTGCAGT SEQ ID NO:17807 |
| | | AA | RASQSVASSLA SEQ ID NO:1784 | GTSTRAT SEQ ID NO:9796 | QQYNDWPCS SEQ ID NO:17808 |
| iPS:434633 | 21-225_74G8 | NA | AGGGCCAGTCAGAGTTTTAG CAGCGCCTACTTAGCC SEQ ID NO:1785 | GGTACTTCCAGCAGGGC CACT SEQ ID NO:9797 | CAACAGTATGGTAACTCAAG GACG SEQ ID NO:17809 |

FIGURE 49
(Continued)

| | | | | | |
|---|---|---|---|---|---|
| iPS:434635 | 21-225_78E6 | AA | RASQSFSSAYLA SEQ ID NO:1786 | GTSSRAT SEQ ID NO:9798 | QQYGNSRT SEQ ID NO:17810 |
| | | NA | AAGTCCAGCCAGAGTGTTTTGTACAGCTCCAACAGTCACAACTACTTAGCT SEQ ID NO:1787 | TGGGCATCTATCCGGGAATCC SEQ ID NO:9799 | CAGCAATATTATAGTACTCCGTGCAGT SEQ ID NO:17811 |
| iPS:434637 | 21-225_78E7 | AA | KSSQSVLYSSNSHNYLA SEQ ID NO:1788 | WASIRES SEQ ID NO:9800 | QQYYSTPCS SEQ ID NO:17812 |
| | | NA | AGGGCCAGTCAGAATGTTGACAGCAACTACTTAGCC SEQ ID NO:1789 | GGTGCATCCAGCAGGGCCACT SEQ ID NO:9801 | CAGCAGTATGAACGCTCACCGTGGACG SEQ ID NO:17813 |
| iPS:434639 | 21-225_74B7 | AA | RASQNVDSNYLA SEQ ID NO:1790 | GASSRAT SEQ ID NO:9802 | QQYERSPWT SEQ ID NO:17814 |
| | | NA | AAGTCCAGCCAGACTGTTTTACACAGCTCCAACAATTATAACTACTTAGCT SEQ ID NO:1791 | TGGACATCTACCCGGGAATCC SEQ ID NO:9803 | CAGCAATATTTTAGTAGTCCTCCGACG SEQ ID NO:17815 |
| iPS:434649 | 21-225_78E11 | AA | KSSQTVLHSSNNYNYLA SEQ ID NO:1792 | WTSTRES SEQ ID NO:9804 | QQYFSSPPT SEQ ID NO:17816 |
| | | NA | AAGTCCAGCCAGAGTGTTTTATACAGCTTCAACAATTACAACTACTTAGCT SEQ ID NO:1793 | TGGGCATCTACCCGGGAATCC SEQ ID NO:9805 | CAGCAATATTATAGTAGTCCTCCGACG SEQ ID NO:17817 |
| iPS:434653 | 21-225_74B5 | AA | KSSQSVLYSFNNYNYLA SEQ ID NO:1794 | WASTRES SEQ ID NO:9806 | QQYYSSPPT SEQ ID NO:17818 |
| | | NA | AAGTCCAGCCAGAGTGTTTTATTCAGCTCCAACAATTATAACTACTTAGCT SEQ ID NO:1795 | TGGGCATCTACCCGGGAATCC SEQ ID NO:9807 | CAGCAATATTATAGTTCTCCTCCGACG SEQ ID NO:17819 |
| | | AA | KSSQSVLFSSNNYNYLA | WASTRES | QQYYSSPPT |

FIGURE 49
(Continued)

| | | | SEQ ID NO:1796 | SEQ ID NO:9808 | SEQ ID NO:17820 |
|---|---|---|---|---|---|
| iPS:434655 | 21-225_78H12 | NA | AAGTCCAGCCAGAGACTGTTT ACACAGCTTCAACAATTATA ACTACTTAGCT | TGGACATCTACCCGGGA ATCC | CAGCAATATTTAGTAGTCC TCCGACG |
| | | AA | SEQ ID NO:1797 KSSQTVLHSFNNYNYLA | SEQ ID NO:9809 WTSTRES | SEQ ID NO:17821 QQYFSSPPT |
| iPS:434657 | 21-225_79G1 | NA | SEQ ID NO:1798 AGGGCCAGTCAGAGTGTTTA CAGCAGCTACTTAGCC | SEQ ID NO:9810 GGTGCATCCAGCCGGTC CACT | SEQ ID NO:17822 CAGCACTATGATAACTCACC GTGGACG |
| | | AA | SEQ ID NO:1799 RASQSVYSSYLA | SEQ ID NO:9811 GASSRST | SEQ ID NO:17823 QHYDNSPWT |
| iPS:434663 | 21-225_79F3 | NA | SEQ ID NO:1800 AGGGCCAGTCAGAGTGTTTA CAGCAGCTACTTAGCC | SEQ ID NO:9812 GGTGCATCCAGCCGGTC CACT | SEQ ID NO:17824 CAGCACTATGATAACTCACC GTGGACG |
| | | AA | SEQ ID NO:1801 RASQSVYSSYLA | SEQ ID NO:9813 GASSRST | SEQ ID NO:17825 QHYDNSPWT |
| iPS:434665 | 21-225_74G4 | NA | SEQ ID NO:1802 AAGTCCAGCCAGAGTGTTT ATACAGTTCCAACAATAATA ACTACTTAGCT | SEQ ID NO:9814 TGGGCATCTACCCGGGA ATCC | SEQ ID NO:17826 CAGCAATATATAGTATTCC TCCGACG |
| | | AA | SEQ ID NO:1803 KSSQSVLYSSNNNNYLA | SEQ ID NO:9815 WASTRES | SEQ ID NO:17827 QQYYSIPPT |
| iPS:434669 | 21-225_79F4 | NA | SEQ ID NO:1804 CGGGCGAGTCAGGGCATTAG CAAGTATTTAGCC | SEQ ID NO:9816 GCTGCATCCAGTTGCAA GGT | SEQ ID NO:17828 CAACAGTACAGTAATTACCC ACTCACT |
| | | AA | SEQ ID NO:1805 RASQGISKYLA | SEQ ID NO:9817 AASSLQG | SEQ ID NO:17829 QQYSNYPLT |
| iPS:434671 | | NA | SEQ ID NO:1806 AGGGCCAGTCAGATTTTTAG CAGCAGCTACTTAGCC | SEQ ID NO:9818 GGTGCATCCAGCAGGGC CACT | SEQ ID NO:17830 CAGCAGTATGGTAGCTCACG GACG |

FIGURE 49
(Continued)

| | | | | | | |
|---|---|---|---|---|---|---|
| iPS:434673 | 21-225_74F4 | AA | SEQ ID NO:1807 RASQIFSSSYLA | SEQ ID NO:9819 GASSRAT | SEQ ID NO:17831 QQYGSSRT | |
| | | NA | SEQ ID NO:1808 AGGGCCAGTCTGAGTGTTGT CAACAGCTTAGCC | SEQ ID NO:9820 GGTGCATCCACCAGGGC CACT | SEQ ID NO:17832 CAGCAGTATAATGACTGGCC GTGCAGT | |
| iPS:434675 | 21-225_74E3 | AA | SEQ ID NO:1809 RASLSVVNSLA | SEQ ID NO:9821 GASTRAT | SEQ ID NO:17833 QQYNDWPCS | |
| | | NA | SEQ ID NO:1810 ATGTCCAGCCAGAGTGTTTT ACACAGCTTCAACAATAAGA ACTACTTAACT | SEQ ID NO:9822 TGGGCATCTACTTGGGA ATCC | SEQ ID NO:17834 CAGCAATATTATAGTATTCC TCCGACG | |
| iPS:434679 | 21-225_79G6 | AA | SEQ ID NO:1811 MSSQSVLHSFNNKNYLT | SEQ ID NO:9823 WASTWES | SEQ ID NO:17835 QQYSIPPT | |
| | | NA | SEQ ID NO:1812 AAGTCCAGCCAGAGTGTTTT GTACAGCTCCAACAGTCACA ACTACTTAGCT | SEQ ID NO:9824 TGGGCATCTATCCGGA ATCC | SEQ ID NO:17836 CAGCAATATTATAGTACTCC GTGCAGT | |
| iPS:434685 | 21-225_79G7 | AA | SEQ ID NO:1813 KSSQSVLYSSNSHNYLA | SEQ ID NO:9825 WASIRES | SEQ ID NO:17837 QQYYSTPCS | |
| | | NA | SEQ ID NO:1814 AAGTCCAGCCAGAGTATTTT ATACAGCTCCAACAATAATA ACTACTTAGCT | SEQ ID NO:9826 TGGGCATCTACCCGGGA ATCC | SEQ ID NO:17838 CAGCAATATTATATTACTCC TCCGACG | |
| iPS:434687 | 21-225_79E9 | AA | SEQ ID NO:1815 KSSQSILYSSNNNNYLA | SEQ ID NO:9827 WASTRES | SEQ ID NO:17839 QQYYITPPT | |
| | | NA | SEQ ID NO:1816 AGGGCCAGTCAGAGTGTTTA CAGCAGCTACTTAGCC | SEQ ID NO:9828 GGTGCATCCAGCCGGGC CACT | SEQ ID NO:17840 CAGCACTATGATAACTCACC GTGGACG | |
| | 21-225_75A5 | AA | SEQ ID NO:1817 RASQSVYSSYLA | SEQ ID NO:9829 GASSRAT | SEQ ID NO:17841 QHYDNSPWT | |

FIGURE 49
(Continued)

| | | | SEQ ID NO:1818 | SEQ ID NO:9830 | SEQ ID NO:17842 |
|---|---|---|---|---|---|
| iPS:434689 | 21-225_79G10 | NA | AAGTCCAGCCAGAGTGTTT ATTCAGCTCCAACAATTATA ATTACTTAGCT | TGGGCATCTACCCGGGA ATCC | CAGCAATATCATAGTTCTCC TCTGACG |
| | | AA | SEQ ID NO:1819 KSSQSVLFSSNNYNYLA | SEQ ID NO:9831 WASTRES | SEQ ID NO:17843 QQYHSSPLT |
| iPS:434691 | 21-225_75G7 | NA | SEQ ID NO:1820 AGGGCCAGGCAGAGTGTTG ACAGCAGTTATTTAGCC | SEQ ID NO:9832 GGTGCATCCAGCAGGGC CACT | SEQ ID NO:17844 CAGCAGTATGAAAGCTCACC GTGGACG |
| | | AA | SEQ ID NO:1821 RARQSVDSSYLA | SEQ ID NO:9833 GASSRAT | SEQ ID NO:17845 QQYESSPWT |
| iPS:434693 | 21-225_79F11 | NA | SEQ ID NO:1822 AGGGCCAGTCAGAGTGTTTA CAGCAGCTACTTAGCC | SEQ ID NO:9834 GGTGCATCCAGCAGCCGGGC CACT | SEQ ID NO:17846 CAGCACTCTGATAACTCACC GTGGACG |
| | | AA | SEQ ID NO:1823 RASQSVYSSYLA | SEQ ID NO:9835 GASSRAT | SEQ ID NO:17847 QHSDNSPWT |
| iPS:434697 | 21-225_79F12 | NA | SEQ ID NO:1824 AAGTCCAGCCAGAGTATTT ATACAGCTCCAACAATTACA ACTACTTAGCT | SEQ ID NO:9836 TGGGCATCTACCCGGGA ATCC | SEQ ID NO:17848 CAGCAATATTATAGTACTCC GTGGACG |
| | | AA | SEQ ID NO:1825 KSSQSILYSSNNYNYLA | SEQ ID NO:9837 WASTRES | SEQ ID NO:17849 QQYYSTPWT |
| iPS:434699 | 21-225_79G12 | NA | SEQ ID NO:1826 AGGGCCAGTCAGAGTGTTTA CAGCAGCTACTTAGCC | SEQ ID NO:9838 GGTGCATCCAGCCGGTC CACT | SEQ ID NO:17850 CAGCACTCTGATAACTCACC GTGGACG |
| | | AA | SEQ ID NO:1827 RASQSVYSSYLA | SEQ ID NO:9839 GASSRST | SEQ ID NO:17851 QHSDNSPWT |
| iPS:434701 | | NA | SEQ ID NO:1828 AGGGCCAGTCAGAGTGTTTA CAGCAGCTACTTAGCC | SEQ ID NO:9840 GGTGCATCCAGCCGGTC CACT | SEQ ID NO:17852 CAGCACTCTGATAACTCACC GTGGACG |

FIGURE 49
(Continued)

| | | | | | | |
|---|---|---|---|---|---|---|
| iPS:434703 | 21-225_80A1 | AA | SEQ ID NO:1829<br>RASQSVYSSYLA<br>SEQ ID NO:1830 | SEQ ID NO:9841<br>GASSRST<br>SEQ ID NO:9842 | SEQ ID NO:17853<br>QHSDNSPWT<br>SEQ ID NO:17854 | |
| iPS:434705 | 21-225_80C1 | NA | AGGGCCAGTCAGAGTGTTTA<br>CAGCAGCTACTTAGCC<br>SEQ ID NO:1831 | GGTGCATCCAGCCGGTC<br>CACT<br>SEQ ID NO:9843 | CAGCACTCTGATAACTCACC<br>GTGGACG<br>SEQ ID NO:17855 | |
| | | AA | RASQSVYSSYLA<br>SEQ ID NO:1832 | GASSRST<br>SEQ ID NO:9844 | QHSDNSPWT<br>SEQ ID NO:17856 | |
| iPS:434707 | 21-225_80A2 | NA | AGGGCCAGTCAGAGTGTTAG<br>CAGCAGCTACTTAGTC<br>SEQ ID NO:1833 | GGTGCATCCACCAGGGC<br>CACT<br>SEQ ID NO:9845 | CAGCAGTATGGTTGCTCACC<br>GCTCACT<br>SEQ ID NO:17857 | |
| | | AA | RASQSVSSSYLV<br>SEQ ID NO:1834 | GASTRAT<br>SEQ ID NO:9846 | QQYGCSPLT<br>SEQ ID NO:17858 | |
| iPS:434709 | 21-225_80D3 | NA | AAGTCCAGCCAGAGTGTTTT<br>ATACACCTCCAACAATAACA<br>ACTACTTAGCT<br>SEQ ID NO:1835 | TGGGCATCTACCCGGGA<br>ATCC<br>SEQ ID NO:9847 | CAGCACTACAATGAAACTCC<br>AGGGAAG<br>SEQ ID NO:17859 | |
| | | AA | KSSQSVLYTSNNNNYLA<br>SEQ ID NO:1836 | WASTRES<br>SEQ ID NO:9848 | QHYNETPGK<br>SEQ ID NO:17860 | |
| iPS:434709 | 21-225_80E3 | NA | AGGGCCAGTCAGAGTGTTTA<br>CAGCAGCTACTTAGCC<br>SEQ ID NO:1837 | GGTGCATCCAGCCGGTC<br>CACT<br>SEQ ID NO:9849 | CAGCATTCTGATAACTCACC<br>GTGGACG<br>SEQ ID NO:17861 | |
| | | AA | RASQSVYSSYLA<br>SEQ ID NO:1838 | GASSRST<br>SEQ ID NO:9850 | QHSDNSPWT<br>SEQ ID NO:17862 | |
| iPS:434711 | 21-225_80H3 | NA | AAGTCCAGCCAGAGTGTTTT<br>ACACAGGTCCAACAATTACA<br>ACTACTTAGCG<br>SEQ ID NO:1839 | TGGGCATCTACCCGGGA<br>ATCC<br>SEQ ID NO:9851 | CAGCAATATTATAGTACTCC<br>TCCGACG<br>SEQ ID NO:17863 | |
| | | AA | KSSQSVLHRSNNYNYLA<br>SEQ ID NO:1840 | WASTRES<br>SEQ ID NO:9852 | QQYSTPPT<br>SEQ ID NO:17864 | |

FIGURE 49
(Continued)

| | | | | | |
|---|---|---|---|---|---|
| iPS:434715 | 21-225_80D5 | NA | AGGGCCAGTCAGAATATTTACAGCAGCTACTTAGCC SEQ ID NO:1841 | GGTGCATCCAGCAGGGCCACT SEQ ID NO:9853 | CAGCAGTATGAAAGCTCACCGTGGACC SEQ ID NO:17865 |
| | | AA | RASQNIYSSYLA SEQ ID NO:1842 | GASSRAT SEQ ID NO:9854 | QQYESSPWT SEQ ID NO:17866 |
| iPS:434717 | 21-225_80A6 | NA | AGGGCCAGTCAGAGTGTTGACAGCGGCTACTTAGCC SEQ ID NO:1843 | GGTGCATCCAGCAGGGCCCCT SEQ ID NO:9855 | CAGCAGTATGAAAGCTCACCGTGGACG SEQ ID NO:17867 |
| | | AA | RASQSVDSGYLA SEQ ID NO:1844 | GASSRAP SEQ ID NO:9856 | QQYESSPWT SEQ ID NO:17868 |
| iPS:434725 | 21-225_80H7 | NA | AGGGCCAGTCAGAGTATTAACAGCAACTACTTAGCC SEQ ID NO:1845 | GGTGCATCCAGCAGGGCCACT SEQ ID NO:9857 | CAGCAGTATGAGAGCTCACCGTGGACG SEQ ID NO:17869 |
| | | AA | RASQSINSNYLA SEQ ID NO:1846 | GASSRAT SEQ ID NO:9858 | QQYESSPWT SEQ ID NO:17870 |
| iPS:434729 | 21-225_80B12 | NA | AAGTCCAGACAGAGTGTTTTATACAGCTCCAACAATTACAACTACTTAACT SEQ ID NO:1847 | TGGGCATCTACCCGGGAATCC SEQ ID NO:9859 | CAGCAATATTATAGTTCTCCTCCTACT SEQ ID NO:17871 |
| | | AA | KSRQSVLYSSNNYNYLT SEQ ID NO:1848 | WASTRES SEQ ID NO:9860 | QQYYSSPPT SEQ ID NO:17872 |
| iPS:434731 | 21-225_80E9 | NA | AAGTCCAGCAGAGTGTTTTATACACCTCCAACAATAACAACTACTTAGCT SEQ ID NO:1849 | TGGGCATCTACCCGGGAATCC SEQ ID NO:9861 | CAGCAATATTATAATACTCCGTGGACG SEQ ID NO:17873 |
| | | AA | KSSQSVLYTSNNNNYLA SEQ ID NO:1850 | WASTRES SEQ ID NO:9862 | QQYYNTPWT SEQ ID NO:17874 |
| iPS:434735 | 21-225_80B10 | NA | AGGGCCAGTCAGAGTGTTGACAGCAGCTACTTAGCC SEQ ID NO:1851 | GGTGCATCCAGCAGGGCCCCT SEQ ID NO:9863 | CAGCAGTATGAAAGCTCACCGTGGACG SEQ ID NO:17875 |

FIGURE 49
(Continued)

| | | | | | | |
|---|---|---|---|---|---|---|
| iPS:434737 | 21-225_74G6 | AA | RASQSVDSSYLA<br>SEQ ID NO:1852 | GASSRAP<br>SEQ ID NO:9864 | QQYESSPWT<br>SEQ ID NO:17876 | |
| | | NA | CGGGCGAGTCAGGGCATTGG<br>CAAGTATTTAGCC<br>SEQ ID NO:1853 | ACTACATCCAGTTTGCAA<br>AGT<br>SEQ ID NO:9865 | CAACAGTACAGTAATTACCC<br>GCTCACT<br>SEQ ID NO:17877 | |
| iPS:434741 | 21-225_80C11 | AA | RASQGIGKYLA<br>SEQ ID NO:1854 | TTSSLQS<br>SEQ ID NO:9866 | QQYSNYPLT<br>SEQ ID NO:17878 | |
| | | NA | CGGGCGAGTCAGGGCATTGG<br>CAGGTATTTAGCC<br>SEQ ID NO:1855 | ACTGCATCCAGTTTGCAA<br>AGT<br>SEQ ID NO:9867 | CAACAGTACAGTAATTACCC<br>GCTCACT<br>SEQ ID NO:17879 | |
| iPS:434743 | 21-225_74A4 | AA | RASQGIGRYLA<br>SEQ ID NO:1856 | TASSLQS<br>SEQ ID NO:9868 | QQYSNYPLT<br>SEQ ID NO:17880 | |
| | | NA | AGGGCCAGTCAGAGTGTTTA<br>CAGCAGCTACTTAGCC<br>SEQ ID NO:1857 | GGTGCATCCAGCGGTC<br>CACT<br>SEQ ID NO:9869 | CAGCACTCTGATAACTCACC<br>GTGGACG<br>SEQ ID NO:17881 | |
| iPS:434747 | 21-225_80C12 | AA | RASQSVYSSYLA<br>SEQ ID NO:1858 | GASSRST<br>SEQ ID NO:9870 | QHSDNSPWT<br>SEQ ID NO:17882 | |
| | | NA | AGGGCCAGTCAGAGTGTTAG<br>CAGCAGCTACTTAGCC<br>SEQ ID NO:1859 | GGTGCATCCACCAGGGC<br>CACT<br>SEQ ID NO:9871 | CAGCAGTATGGTAACTCACC<br>GCTCACT<br>SEQ ID NO:17883 | |
| iPS:434751 | 21-225_80H12 | AA | RASQSVSSSYLA<br>SEQ ID NO:1860 | GASTRAT<br>SEQ ID NO:9872 | QQYGNSPLT<br>SEQ ID NO:17884 | |
| | | NA | AGGGCCAGTCAGAGTGTTTA<br>CAGCAGCTACTTAGCC<br>SEQ ID NO:1861 | GGTGCATCCAGCCGGTC<br>CACT<br>SEQ ID NO:9873 | CAGCACTCTGATAACTCACC<br>GTGGACG<br>SEQ ID NO:17885 | |
| iPS:434759 | 21-225_81C5 | AA | RASQSVYSSYLA<br>SEQ ID NO:1862 | GASSRST<br>SEQ ID NO:9874 | QHSDNSPWT<br>SEQ ID NO:17886 | |
| | | NA | AGGGCCAGTCAGAGTGTTTA<br>CAGCAGCTACTTAGCC<br>SEQ ID NO:1863 | GGTGCATCCAGCCGGTC<br>CACT<br>SEQ ID NO:9875 | CAGCATTCTGATAACTCACC<br>GTGGACG<br>SEQ ID NO:17887 | |

FIGURE 49
(Continued)

| | | | | | |
|---|---|---|---|---|---|
| iPS:434761 | 21-225_81E5 | AA | RASQSVYSSYLA<br>SEQ ID NO:1864 | GASSRST<br>SEQ ID NO:9876 | QHSDNSPWT<br>SEQ ID NO:17888 |
| | | NA | AAGTCCAGCCAGAGTGTTT<br>ATTCAGCTCCAACAATTATA<br>ATTACTTAGCT<br>SEQ ID NO:1865 | TGGGCATCTACCCGGGA<br>ATCC<br>SEQ ID NO:9877 | CAGCAATATTATAGTTCTCC<br>TCTGACG<br>SEQ ID NO:17889 |
| iPS:434771 | 21-225_81F9 | AA | KSSQSVLFSSNNYNYLA<br>SEQ ID NO:1866 | WASTRES<br>SEQ ID NO:9878 | QQYYSSPLT<br>SEQ ID NO:17890 |
| | | NA | AAGTCCAGCCAGAGTGTTT<br>ATACACCTCCAACAACA<br>ACTACTTAGCT<br>SEQ ID NO:1867 | TGGGCATCTACCCGGGA<br>ATCC<br>SEQ ID NO:9879 | CAGCACTACAATGATACTCC<br>AGGGAAG<br>SEQ ID NO:17891 |
| iPS:434773 | 21-225_75D9 | AA | KSSQSVLYTSNNNNYLA<br>SEQ ID NO:1868 | WASTRES<br>SEQ ID NO:9880 | QHYNDTPGK<br>SEQ ID NO:17892 |
| | | NA | AGGGCCAGTCAGAGTGTTAG<br>CAGCAGTACTTAGCC<br>SEQ ID NO:1869 | GGTGCATCCAGCAGGGC<br>CACT<br>SEQ ID NO:9881 | CAGCAGTATGAAAGCTCACC<br>GTGGACG<br>SEQ ID NO:17893 |
| iPS:434777 | 21-225_81C11 | AA | RASQSVSSSYLA<br>SEQ ID NO:1870 | GASSRAT<br>SEQ ID NO:9882 | QQYESSPWT<br>SEQ ID NO:17894 |
| | | NA | AGGGCCAGTCAGAGTGTTTA<br>CAGCAGTACTTAGCC<br>SEQ ID NO:1871 | GGTGCATCCAGCCGTC<br>CACT<br>SEQ ID NO:9883 | CAGCATTCTGATAACTCACC<br>GTGGACG<br>SEQ ID NO:17895 |
| | | AA | RASQSVSSYLA<br>SEQ ID NO:1872 | GASSRST<br>SEQ ID NO:9884 | QHSDNSPWT<br>SEQ ID NO:17896 |
| iPS:434793 | 21-225_82A5 | NA | AGGGCCAGTCAGAGTGTTAG<br>CAGCAGTACTTAGCC<br>SEQ ID NO:1873 | GGTGCATCCACCAGGGC<br>CACT<br>SEQ ID NO:9885 | CAGCAGTATGGTAACTCACC<br>GCTCACT<br>SEQ ID NO:17897 |
| | | AA | RASQSVSSSYLA<br>SEQ ID NO:1874 | GASTRAT<br>SEQ ID NO:9886 | QQYGNSPLT<br>SEQ ID NO:17898 |

FIGURE 49
(Continued)

| | | | | | |
|---|---|---|---|---|---|
| iPS:434797 | 21-225_82G5 | NA | AGGGCCAGTGAGAGTGTTAG CAGCAGCTACTTAGTC SEQ ID NO:1875 | GGTGCATCCACCAGGGC CACT SEQ ID NO:9887 | CAGCAGTATGGTTGCTCACC GCTCACT SEQ ID NO:17899 |
| | | AA | RASESVSSSYLV SEQ ID NO:1876 | GASTRAT SEQ ID NO:9888 | QQYGCSPLT SEQ ID NO:17900 |
| iPS:434805 | 21-225_82D9 | NA | AGGGCCAGTGAGAGTGTTAG CAGCAGCTACTTAGTC SEQ ID NO:1877 | GGTGCATCCACCAGGGC CACT SEQ ID NO:9889 | CAGCAGTATGGTTGCTCACC GCTCACT SEQ ID NO:17901 |
| | | AA | RASESVSSSYLV SEQ ID NO:1878 | GASTRAT SEQ ID NO:9890 | QQYGCSPLT SEQ ID NO:17902 |
| iPS:434809 | 21-225_74F5 | NA | AGGGCCAGTCAGAGTGTTTA CAGCAGCTACTTAGCC SEQ ID NO:1879 | GGTGCATCCAGCCGGTC CACT SEQ ID NO:9891 | CAGCACTCTGATAACTCACC GTGGACG SEQ ID NO:17903 |
| | | AA | RASQSVYSSYLA SEQ ID NO:1880 | GASSRST SEQ ID NO:9892 | QHSDNSPWT SEQ ID NO:17904 |
| iPS:434813 | 21-225_82C12 | NA | AGGGCCAGTCAGAGTGTTAG CAGCAGCTACTTAGCC SEQ ID NO:1881 | GGTGCATCCACCAGGGC CTCT SEQ ID NO:9893 | CAGCAGTATGGTAACTCACC GCTCACT SEQ ID NO:17905 |
| | | AA | RASQSVSSSYLA SEQ ID NO:1882 | GASTRAS SEQ ID NO:9894 | QQYGNSPLT SEQ ID NO:17906 |
| iPS:434815 | 21-225_74A11 | NA | CGGGCAAGTCAGGACATTAG AAATGATTTAGGC SEQ ID NO:1883 | GCTGCATCCAGTTGCAA AGT SEQ ID NO:9895 | CTACAGCATAATGATTACCC ATTCACT SEQ ID NO:17907 |
| | | AA | RASQDIRNDLG SEQ ID NO:1884 | AASSLQS SEQ ID NO:9896 | LQHNDYPFT SEQ ID NO:17908 |
| iPS:434821 | 21-225_83G1 | NA | AGGGCCAGTCAGAGTGTTTA CAGCAGCTACTTAGCC SEQ ID NO:1885 | GGTGCATCCAGCCGGTC CACG SEQ ID NO:9897 | CAGCACTCTGATAACTCACC GTGGACG SEQ ID NO:17909 |
| | | AA | RASQSVYSSYLA SEQ ID NO:1886 | GASSRST SEQ ID NO:9898 | QHSDNSPWT SEQ ID NO:17910 |

FIGURE 49
(Continued)

| | | | | |
|---|---|---|---|---|
| iPS:434825 | 21-225_83C2 | NA | AGGGCCAGTCAGAGTGTTAG CAGCAGCTACTTAGTC SEQ ID NO:1887 | GGTGCATCCACCAGGGC CACT SEQ ID NO:9899 | CAGCAGTATGGTTGCTCACC GCTCACT SEQ ID NO:17911 |
| | | AA | RASQSVSSSYLV SEQ ID NO:1888 | GASTRAT SEQ ID NO:9900 | QQYGCSPLT SEQ ID NO:17912 |
| iPS:434827 | 21-225_83F3 | NA | AAGTCCAGCCAGAGTGTTT ATACACCTCCAACAATAACA ACTACTTAGCT SEQ ID NO:1889 | TGGGCATCTACCCGGGA ATCC SEQ ID NO:9901 | CAGCACTATAATGATACTCC ATGAAG SEQ ID NO:17913 |
| | | AA | KSSQSVLYTSNNNNYLA SEQ ID NO:1890 | WASTRES SEQ ID NO:9902 | QHYNDTPWK SEQ ID NO:17914 |
| iPS:434829 | 21-225_83G3 | NA | AAGTCCAGCCAGAGTGTTT ATACACCTCCAACAATAACA ACTACTTAGCT SEQ ID NO:1891 | TGGGCATCTACCCGGGA ATCC SEQ ID NO:9903 | CAGCACTATTATAATACTCC GTGGACG SEQ ID NO:17915 |
| | | AA | KSSQSVLYTSNNNNYLA SEQ ID NO:1892 | WASTRES SEQ ID NO:9904 | QHYNTPWT SEQ ID NO:17916 |
| iPS:434833 | 21-225_83C5 | NA | AGGGCCAGTCAGAGTGTTAG CAGCAGCTACTTAGTC SEQ ID NO:1893 | GGTGCATCCACCAGGGC CACT SEQ ID NO:9905 | CAGCAGTATGGTTGCTCACC GCTCACT SEQ ID NO:17917 |
| | | AA | RASESVSSSYLV SEQ ID NO:1894 | GASTRAT SEQ ID NO:9906 | QQYGCSPLT SEQ ID NO:17918 |
| iPS:434835 | 21-225_83B6 | NA | AGGGCCAGTCAGAGTGTTGA CAGCGGCTACTTAGCC SEQ ID NO:1895 | GGTGCATCCAGCAGGAC CCCT SEQ ID NO:9907 | CAGCAGTATGAAAGCTCACC GTGGACG SEQ ID NO:17919 |
| | | AA | RASQSVDSGYLA SEQ ID NO:1896 | GASSRTP SEQ ID NO:9908 | QQYESSPWT SEQ ID NO:17920 |
| iPS:434839 | 21-225_83B7 | NA | AGGGCCAGTCAGAGTGTTTA CAGCAGCTACTTAGCG SEQ ID NO:1897 | GGTGCATCCAGCCGGTC CACT SEQ ID NO:9909 | CAGCACTCTGATAACTCACC GTGGACG SEQ ID NO:17921 |

FIGURE 49
(Continued)

| | | | | | | | |
|---|---|---|---|---|---|---|---|
| iPS:434841 | 21-225_83G7 | AA | RASQSVYSSYLA<br>SEQ ID NO:1898 | GASSRST<br>SEQ ID NO:9910 | QHSDNSPWT<br>SEQ ID NO:17922 |
| | | NA | AAGTCCAGCCAGAGTGTTTT<br>ACACAGCTCCAACAATTATA<br>ACTACTTAGCT<br>SEQ ID NO:1899 | TGGACATCTACCCGGGA<br>ATCC<br>SEQ ID NO:9911 | CAGCAATATTTTAGTAGTCC<br>TCTGACG<br>SEQ ID NO:17923 |
| iPS:434849 | 21-225_83C10 | AA | KSSQTVLHSSNNYNYLA<br>SEQ ID NO:1900 | WTSTRES<br>SEQ ID NO:9912 | QQYFSSPLT<br>SEQ ID NO:17924 |
| | | NA | AGGGCCAGTCCGAGTGTTCA<br>CAGCAACTACTTAGCC<br>SEQ ID NO:1901 | GGTGCATCCAGCAGGGC<br>CACT<br>SEQ ID NO:9913 | CAGCAGTATGAAAGTTCACC<br>GTGGACG<br>SEQ ID NO:17925 |
| iPS:434851 | 21-225_75A6 | AA | RASPSVHSNYLA<br>SEQ ID NO:1902 | GASSRAT<br>SEQ ID NO:9914 | QQYESSPWT<br>SEQ ID NO:17926 |
| | | NA | AAGTCCAGACAGAGTGTTTT<br>ACACAGCTCCAACAATTACA<br>ACTACTTAGCT<br>SEQ ID NO:1903 | TGGGCATCTACCCGGGA<br>ATCC<br>SEQ ID NO:9915 | CAGCAATATTATAGTACTCC<br>TCCTACT<br>SEQ ID NO:17927 |
| iPS:434863 | 21-225_84G7 | AA | KSRQSVLHSSNNYNYLA<br>SEQ ID NO:1904 | WASTRES<br>SEQ ID NO:9916 | QQYYSTPPT<br>SEQ ID NO:17928 |
| | | NA | AAGTCCAGCCAGAGTGTTTT<br>ACACAGCTCCAACAATTATA<br>ACTACTTAGCT<br>SEQ ID NO:1905 | TGGACATCTACCCGGGA<br>ATCC<br>SEQ ID NO:9917 | CAGCAATATTTTAGTAGTCC<br>TCCGACG<br>SEQ ID NO:17929 |
| iPS:434867 | 21-225_79A12 | AA | KSSQTVLHSSNNYNYLA<br>SEQ ID NO:1906 | WTSTRES<br>SEQ ID NO:9918 | QQYFSSPPT<br>SEQ ID NO:17930 |
| | | NA | CGGGCGAGTCAGGTCATTAG<br>CAAGTATTTAGCC<br>SEQ ID NO:1907 | GCTGCATCCAGTTTGCAA<br>AGT<br>SEQ ID NO:9919 | CAACAGTACAGTAATTACCC<br>GCTCACT<br>SEQ ID NO:17931 |
| | | AA | RASQVISKYLA<br>SEQ ID NO:1908 | AASSLQS<br>SEQ ID NO:9920 | QQYSNYPLT<br>SEQ ID NO:17932 |

FIGURE 49
(Continued)

| | | | | |
|---|---|---|---|---|
| iPS:434869 | 21-225_84E12 | NA | AGGGCCAGTCAGAGTATTAA CAGCAACTACTTAGCC SEQ ID NO:1909 | GGTGCATCCAGCAGGGC CACT SEQ ID NO:9921 | CAGCAGTATGAGAGCTCACC GTGGACG SEQ ID NO:17933 |
| | | AA | RASQSINSNYLA SEQ ID NO:1910 | GASSRAT SEQ ID NO:9922 | QQYESSPWT SEQ ID NO:17934 |
| iPS:434871 | 21-225_85H1 | NA | AGGGCCAGTCAGGATGTTAT CACCTACTTAGCC SEQ ID NO:1911 | GGTGCATCCACCAGGGC CACT SEQ ID NO:9923 | CAGGAGTATAATGACTGGCC GTGCAGT SEQ ID NO:17935 |
| | | AA | RASQDVITYLA SEQ ID NO:1912 | GASTRAT SEQ ID NO:9924 | QEYNDWPCS SEQ ID NO:17936 |
| iPS:434877 | 21-225_85H2 | NA | AAGTCCAGCCAGAGTGTTTT ACACAGCTCTAATAAAAGA ACTACTTAGCT SEQ ID NO:1913 | TGGGCATCTACCCGGGA ATCC SEQ ID NO:9925 | CAGCAATATATTATAGGACTCC GTGGACG SEQ ID NO:17937 |
| | | AA | KSSQSVLHSSNKKNYLA SEQ ID NO:1914 | WASTRES SEQ ID NO:9926 | QQYYRTPWT SEQ ID NO:17938 |
| iPS:434879 | 21-225_85A3 | NA | AGGGCCAGTCAGAGTGTTTA CAGCAGCTACTTAGCC SEQ ID NO:1915 | GGTGCATCCAGCCGGGC CAGT SEQ ID NO:9927 | CAGCACTATGATAACTCACC GTGGACG SEQ ID NO:17939 |
| | | AA | RASQSVYSSYLA SEQ ID NO:1916 | GASSRAS SEQ ID NO:9928 | QHYDNSPWT SEQ ID NO:17940 |
| iPS:434881 | 21-225_85B4 | NA | AGGGCCAGTCAGAGTGTTTA CAGCAGCTACTTAGCC SEQ ID NO:1917 | GGTGCATCCAGCCGGGC CACT SEQ ID NO:9929 | CAGCACTATGATAACTCACC GTGGACG SEQ ID NO:17941 |
| | | AA | RASQSVYSSYLA SEQ ID NO:1918 | GASTRAT SEQ ID NO:9930 | QHYDNSPWT SEQ ID NO:17942 |
| iPS:434883 | 21-225_85B5 | NA | AGGTCCAGTCAGAGTGTTAG CAGCAGCTACTTAGTC SEQ ID NO:1919 | GGTGCATCCACCAGGGC CACT SEQ ID NO:9931 | CAGCAGTATGGTTGCTCACC GCTCACT SEQ ID NO:17943 |
| | | AA | RSSQSVSSSYLV | GASTRAT | QQYGCSPLT |

FIGURE 49
(Continued)

| | | | | | |
|---|---|---|---|---|---|
| iPS:434887 | | SEQ ID NO:1920 AGGGCCAGTCAGAGTGTTAG CAGCAGGTACTTAGCC | SEQ ID NO:9932 GGTGCATCCAGCCAGGGGC CACT | SEQ ID NO:17944 CAGCATTATGATAGCTCACC GTGGACG | |
| | 21-225_85D6 | NA | SEQ ID NO:1921 RASQSVSSRYLA | SEQ ID NO:9933 GASSRAT | SEQ ID NO:17945 QHYDSSPWT |
| | | AA | SEQ ID NO:1922 | SEQ ID NO:9934 | SEQ ID NO:17946 |
| iPS:434891 | | NA | SEQ ID NO:1923 AGGGCCAGTCAGTCCGAGTGTTGA CAGCAGCTACTTAGCC | SEQ ID NO:9935 GGTGCAGCCAGCCAGGGGC CCCT | SEQ ID NO:17947 CAGCAGTATGAAAGTTCACC GTGGACG |
| | 21-225_85G6 | AA | SEQ ID NO:1924 RASPSVDSSYLA | SEQ ID NO:9936 GAASRAP | SEQ ID NO:17948 QQYESSPWT |
| iPS:434895 | | NA | SEQ ID NO:1925 AGGGCCAGTCAGAATATTTA CAGCAGCTACTTAGCC | SEQ ID NO:9937 GGTGCATCCAGCAGCAGGGC CACT | SEQ ID NO:17949 CAGCAGTATGAAAGCTCACC GTGGACC |
| | 21-225_74H7 | AA | SEQ ID NO:1926 RASQNIYSSYLA | SEQ ID NO:9938 GASSRAT | SEQ ID NO:17950 QQYESSPWT |
| iPS:434899 | | NA | SEQ ID NO:1927 AGGGCCAGTCAGAGTGTTAA CAGCAACTACTTAGCC | SEQ ID NO:9939 GGTGCATCCAGCCAGGGGC CACT | SEQ ID NO:17951 CAGCAGTATGAAAGCTCGCC GTGGACG |
| | 21-225_85B9 | AA | SEQ ID NO:1928 RASQSVNSNYLA | SEQ ID NO:9940 GASSRAT | SEQ ID NO:17952 QQYESSPWT |
| iPS:434901 | | NA | SEQ ID NO:1929 AAGTCCAGCCAGAGTGTTTT ACACAGGTCCAACAATTACA ACTACTTAGCG | SEQ ID NO:9941 TGGGCATCTACCCGGGA ATCC | SEQ ID NO:17953 CAGCAATATTATAGTACTCC TCCGACG |
| | 21-225_85H9 | AA | SEQ ID NO:1930 KSSQSVLHRSNNYNYLA | SEQ ID NO:9942 WASTRES | SEQ ID NO:17954 QQYYSTPPT |
| iPS:434907 | 21-225_85G10 | NA | SEQ ID NO:1931 AGGGCCAGTCAGAGTGTTTG GAGCGGCTACTTAGCC | SEQ ID NO:9943 GGTGCATCTAGCAGGGGC CACT | SEQ ID NO:17955 CAGCAGTATGAGAGTTCACC GTGGACG |

FIGURE 49
(Continued)

| | | | | | |
|---|---|---|---|---|---|
| iPS:434909 | 21-225_85C11 | AA | RASQSVWSGYLA SEQ ID NO:1932 | GASSRAT SEQ ID NO:9944 | QQYESSPWT SEQ ID NO:17956 |
| | | NA | AAGTCCAGCCAGAGTGTTTTGTACAGCTCCAACAGTCACAACTTCTTAGCT | TGGGCATTTATCCGGGAATCC | CAGCAATATTATAGTACTCCGTGCAGT |
| | | | SEQ ID NO:1933 | SEQ ID NO:9945 | SEQ ID NO:17957 |
| iPS:434911 | 21-225_85D11 | AA | KSSQSVLYSSNSHNFLA SEQ ID NO:1934 | WAFIRES SEQ ID NO:9946 | QQYYSTPCS SEQ ID NO:17958 |
| | | NA | AGGTCCAGTCAGAGTGTTAGCAGCAGCTACTTAGTC | GGTGCATCCACCAGGGCCACT | CAGCAGTATGGTTGCTCACCGCTCACT |
| | | | SEQ ID NO:1935 | SEQ ID NO:9947 | SEQ ID NO:17959 |
| iPS:434913 | 21-225_86C1 | AA | RSSQSVSSSYLV SEQ ID NO:1936 | GASTRAT SEQ ID NO:9948 | QQYGCSPLT SEQ ID NO:17960 |
| | | NA | AGGGCCAGTCAGAGTGTTTACAGCAGCTACTTAGCC | GGTGCATCCAGCCGGGCCACT | CAGCACTATGATAACTCACCGTGGACG |
| | | | SEQ ID NO:1937 | SEQ ID NO:9949 | SEQ ID NO:17961 |
| iPS:434921 | 21-225_86E4 | AA | RASQSVYSSYLA SEQ ID NO:1938 | GASSRAT SEQ ID NO:9950 | QHYDNSPWT SEQ ID NO:17962 |
| | | NA | AGGGCCAGTCAGAGTGTTTACAGCAGCTACTTAGCC | GGTGCATCCAGCCGGTCCACT | CAGCACTCTGATAACTCACCGTGGACG |
| | | | SEQ ID NO:1939 | SEQ ID NO:9951 | SEQ ID NO:17963 |
| iPS:434935 | 21-225_86E9 | AA | RASQSVYSSYLA SEQ ID NO:1940 | GASSRST SEQ ID NO:9952 | QHSDNSPWT SEQ ID NO:17964 |
| | | NA | AAGTCCAGCCAGAGTGTTTTGCACAGATCCAACAATTATAATTACTTAGCT | TGGGCATCTACCCGGGAATCC | CAGCAATATCATAGTAGTACGACTGACG |
| | | | SEQ ID NO:1941 | SEQ ID NO:9953 | SEQ ID NO:17965 |
| | | AA | KSSQSVLHRSNNYNYLA SEQ ID NO:1942 | WASTRES SEQ ID NO:9954 | QQYHSSPLT SEQ ID NO:17966 |

FIGURE 49
(Continued)

| | | | | | |
|---|---|---|---|---|---|
| iPS:434939 | 21-225_86C11 | NA | AGGGCCAGTCAGAGTGTTTA CAGCAGCTACTTAGCC SEQ ID NO:1943 | GGTGCATCCAGCCGGTC CACT SEQ ID NO:9955 | CAGCACTCTGATAACTCACC GTGGACG SEQ ID NO:17967 |
| | | AA | RASQSVYSSYLA SEQ ID NO:1944 | GASSRST SEQ ID NO:9956 | QHSDNSPWT SEQ ID NO:17968 |
| iPS:434943 | 21-225_87H1 | NA | AGGGCCAGTCAGAGTGTTGA CAGCAACTACTTAGCC SEQ ID NO:1945 | GGTGCATCTGCCAGGAC CACT SEQ ID NO:9957 | CAGCAGTATGATGAAAGCTCACC GTGGACG SEQ ID NO:17969 |
| | | AA | RASQSVDSNYLA SEQ ID NO:1946 | GASARTT SEQ ID NO:9958 | QQYESSPWT SEQ ID NO:17970 |
| iPS:434945 | 21-225_87E5 | NA | AGGGCCAGTCAGAGTGTTTA CAGCAGCTACTTAGCC SEQ ID NO:1947 | GGTGCATCCAGCCGGTC CACT SEQ ID NO:9959 | CAGCATTCTGATAACTCACC GTGGACG SEQ ID NO:17971 |
| | | AA | RASQSVYSSYLA SEQ ID NO:1948 | GASSRST SEQ ID NO:9960 | QHSDNSPWT SEQ ID NO:17972 |
| iPS:434947 | 21-225_87B7 | NA | CGGGCCAGTCAGGGCATTAG CAATTATTTAGCC SEQ ID NO:1949 | GCTGCATCCAGTTGCAC AGT SEQ ID NO:9961 | CTACTCTATCTATCTTACTTACCCG CTCACC SEQ ID NO:17973 |
| | | AA | RASQGISNYLA SEQ ID NO:1950 | AASSLHS SEQ ID NO:9962 | LLYLTYPLT SEQ ID NO:17974 |
| iPS:434955 | 21-225_87C9 | NA | AGGGCCAGTCAGAGTGTTTA CAGCAGCTACTTAGCC SEQ ID NO:1951 | GGTGCATCCAGCCGGTC CACT SEQ ID NO:9963 | CAGCATTCTGATAACTCACC GTGGACG SEQ ID NO:17975 |
| | | AA | RASQSVYSSYLA SEQ ID NO:1952 | GASSRST SEQ ID NO:9964 | QHSDNSPWT SEQ ID NO:17976 |
| iPS:434957 | 21-225_87A10 | NA | AGGGCCAGTCAGAGTGTTAG CAGCAGCTACTTAGCC SEQ ID NO:1953 | GGTGCATCCACCAGGGC CTCT SEQ ID NO:9965 | CAGCAGTATGGTAACTCACC GCTCACT SEQ ID NO:17977 |
| | | AA | RASQSVSSSYLA SEQ ID NO:1954 | GASTRAS SEQ ID NO:9966 | QQYGNSPLT SEQ ID NO:17978 |

FIGURE 49
(Continued)

| | | | | | |
|---|---|---|---|---|---|
| iPS:434959 | 21-225_87E10 | NA | AAGTCCAGCCAGAGTGTTT ACACAGCTCCAACAATATGA ACTACTTAGCT SEQ ID NO:1955 | TGGGCATCTACCCGGAA ATCC SEQ ID NO:9967 | CAGCAATATTATAGTAGTCC GTGCAGT SEQ ID NO:17979 |
| | | AA | KSSQSVLHSSNNMNYLA SEQ ID NO:1956 | WASTRKS SEQ ID NO:9968 | QQYYSSPCS SEQ ID NO:17980 |
| iPS:434961 | 21-225_87A12 | NA | AGGGCCAGTCAGAGTGTTTA CAGCAGCTACTTAGCC SEQ ID NO:1957 | GGTGCATCCAGCCGGTC CACT SEQ ID NO:9969 | CAGCACTCTGATAACTCACC GTGGACG SEQ ID NO:17981 |
| | | AA | RASQSVYSSYLA SEQ ID NO:1958 | GASSRST SEQ ID NO:9970 | QHSDNSPWT SEQ ID NO:17982 |
| iPS:434965 | 21-225_88A1 | NA | AAGTCCAGCCAGAGTGTTTT ACACAGCTCCAACAATTACA ACTACTTAACT SEQ ID NO:1959 | TGGGCATCTACCCGGAA ATCC SEQ ID NO:9971 | CAGCAATATTATAGTTCTCC TCCGACG SEQ ID NO:17983 |
| | | AA | KSSQSVLHSSNNYNYLT SEQ ID NO:1960 | WASTRKS SEQ ID NO:9972 | QQYYSSPPT SEQ ID NO:17984 |
| iPS:434969 | 21-225_88H1 | NA | AGGGCCAGTCAGAGTGTTTA CAGCAGCTACTTAGCC SEQ ID NO:1961 | GGTGCATCCAGCCGGTC CACG SEQ ID NO:9973 | CAGCATTCTGATAACTCACC GTGGACG SEQ ID NO:17985 |
| | | AA | RASQSVYSSYLA SEQ ID NO:1962 | GASSRST SEQ ID NO:9974 | QHSDNSPWT SEQ ID NO:17986 |
| iPS:434971 | 21-225_88G2 | NA | AAGTCCAGCCAGAGTGTTTT ATACACCTCCAACAATAACA ACTACTTAGCT SEQ ID NO:1963 | TGGGCATCTACCCGGGA ATCC SEQ ID NO:9975 | CAGCAATATTATAATACTCC GTGGACG SEQ ID NO:17987 |
| | | AA | KSSQSVLYTSNNNNYLA SEQ ID NO:1964 | WASTRES SEQ ID NO:9976 | QQYYNTPWT SEQ ID NO:17988 |

FIGURE 49
(Continued)

| | | | | | |
|---|---|---|---|---|---|
| iPS:434973 | 21-225_88B4 | NA | AAGTCCAGCCAGAGTGTTT ATACATCTCCAACAATAATA ATTACTTAGCT SEQ ID NO:1965 | TGGGCATCTACCCGGGA ATCC SEQ ID NO:9977 | CAGCAATATTATAGTACTCC TCCGACG SEQ ID NO:17989 |
| | | AA | KSSQSVLYISNNNNYLA SEQ ID NO:1966 | WASTRES SEQ ID NO:9978 | QQYYSTPPT SEQ ID NO:17990 |
| iPS:434977 | 21-225_88A5 | NA | CGGGCAAGTCAGGGCATTAG AAATGATTTAGGC SEQ ID NO:1967 | GCTGCATCCAGTTTGCAA AGT SEQ ID NO:9979 | CTACAGCATAATGATTACCC ATTCACT SEQ ID NO:17991 |
| | | AA | RASQGIRNDLG SEQ ID NO:1968 | AASSLQS SEQ ID NO:9980 | LQHNDYPFT SEQ ID NO:17992 |
| iPS:434981 | 21-225_88E7 | NA | AGGGCCAGTCAGAGTGTTTA CAGCAGCTACTTAGCC SEQ ID NO:1969 | GGTGCATCCAGCCGGTC CACT SEQ ID NO:9981 | CAGCACTCTGATAACTCACC GTGGACG SEQ ID NO:17993 |
| | | AA | RASQSVYSSYLA SEQ ID NO:1970 | GASSRST SEQ ID NO:9982 | QHSDNSPWT SEQ ID NO:17994 |
| iPS:434983 | 21-225_88F7 | NA | AGGGCCAGTCAGAGTGTTTA CAGCAGCTACTTAGCC SEQ ID NO:1971 | GGTGCATCCAGCCGGTC CACT SEQ ID NO:9983 | CAGCACTCTGATAACTCACC GTGGACG SEQ ID NO:17995 |
| | | AA | RASQSVYSSYLA SEQ ID NO:1972 | GASSRST SEQ ID NO:9984 | QHSDNSPWT SEQ ID NO:17996 |
| iPS:434995 | 21-225_88G9 | NA | AGGGCCAGTCAGAGTGTTTA CAGCAGCTACTTAGCC SEQ ID NO:1973 | GGTGCATCCAGCCGGTC CACT SEQ ID NO:9985 | CAGCACTCTGATAACTCACC GTGGACG SEQ ID NO:17997 |
| | | AA | RASQSVYSSYLA SEQ ID NO:1974 | GASSRST SEQ ID NO:9986 | QHSDNSPWT SEQ ID NO:17998 |
| iPS:434997 | 21-225_88C10 | NA | AAGTCCAGCCAGAGTGTTT ACACAGCTCCAACAATTGGA ATTACTTAGCT SEQ ID NO:1975 | TGGGCATTTACTCGGAA ATCC SEQ ID NO:9987 | CAGCAATATTATAGAGCTCC TCCGACG SEQ ID NO:17999 |

FIGURE 49
(Continued)

| | | KSSQSVLHSSNNWNYLA | WAFTRKS | QQYYRAPPT |
|---|---|---|---|---|
| | AA | SEQ ID NO:1976 | SEQ ID NO:9988 | SEQ ID NO:18800 |
| iPS:434999 | NA | AGGGCCAGTCAGAGTGTTTA CAGCAGCTACTTAGCC | GGTGCATCCAGCCGGGC CACT | CAGCACTCTGATAACTCACC GTGGACG |
| 21-225_75A8 | | SEQ ID NO:1977 | SEQ ID NO:9989 | SEQ ID NO:18801 |
| | AA | RASQSVYSSYLA | GASSRAT | QHSDNSPWT |
| iPS:435009 | | SEQ ID NO:1978 | SEQ ID NO:9990 | SEQ ID NO:18802 |
| | NA | AGGTCTAGTCAGAGCCTCCT GCATAGTAGTGGATACAACT ATTTGGAT | TTGGGTTCTAATCGGGCC TCC | ATGCAAGCTCTACATATTCC TCTCACT |
| 21-225_89G4 | | SEQ ID NO:1979 | SEQ ID NO:9991 | SEQ ID NO:18803 |
| | AA | RSSQSLLHSSGYNYLD | LGSNRAS | MQALHIPLT |
| iPS:435013 | | SEQ ID NO:1980 | SEQ ID NO:9992 | SEQ ID NO:18804 |
| | NA | AGGGCCAGTCAGAGTGTTTA CAGCAGCTACTTAGCC | GGTGCATCCAGCCGGTC CACT | CAGCACTATGATAACTCACC GTGGACG |
| 21-225_89D5 | | SEQ ID NO:1981 | SEQ ID NO:9993 | SEQ ID NO:18805 |
| | AA | RASQSVYSSYLA | GASSRST | QHYDNSPWT |
| iPS:435015 | | SEQ ID NO:1982 | SEQ ID NO:9994 | SEQ ID NO:18806 |
| | NA | AGGGCCAGTCAGAGTGTTAA CAGCAGCTACTTAGCC | GGTGCATTCAGCAGGGC CACT | CAGCAGTATGAAAGCTCAGT GTGGACG |
| 21-225_89H5 | | SEQ ID NO:1983 | SEQ ID NO:9995 | SEQ ID NO:18807 |
| | AA | RASQSVNSNYLA | GAFSRAT | QQYESSVWT |
| iPS:435025 | | SEQ ID NO:1984 | SEQ ID NO:9996 | SEQ ID NO:18808 |
| | NA | AGGGCCAGTCAGAGTGTTTA CAGCAGCTACTTAGCC | GGTGCATCCAGCCGGTC CACT | CAGCATTCTGATAACTCTCC GTGGACG |
| 21-225_89E10 | | SEQ ID NO:1985 | SEQ ID NO:9997 | SEQ ID NO:18809 |
| | AA | RASQSVYSSYLA | GASSRST | QHSDNSPWT |
| iPS:435029 | | SEQ ID NO:1986 | SEQ ID NO:9998 | SEQ ID NO:18810 |
| | NA | AGGGCCAGTCAGAGTGTTGA CAGCAACTTCTTAGCC | GGTGCATCTGCCAGGAC CACT | CAGCAGTATGAAATCTCACC GTGGACG |

FIGURE 49
(Continued)

| | | | | | | |
|---|---|---|---|---|---|---|
| iPS:435039 | 21-225_89A11 | AA | SEQ ID NO:1987<br>RASQSVDSNFLA<br>SEQ ID NO:1988 | SEQ ID NO:9999<br>GASARTT<br>SEQ ID NO:10000 | SEQ ID NO:18011<br>QQYEISPWT<br>SEQ ID NO:18012 |
| iPS:435041 | 21-225_90G4 | NA | AGGGCCAGTCAGAGTGTTTA<br>CAGCAGCTACTTAGCC<br>SEQ ID NO:1989 | GGTGCATCCAGCCGGTC<br>CACT<br>SEQ ID NO:10001 | CAGCACTCTGATAACTCACC<br>GTGGACG<br>SEQ ID NO:18013 |
| | | AA | RASQSVYSSYLA<br>SEQ ID NO:1990 | GASSRST<br>SEQ ID NO:10002 | QHSDNSPWT<br>SEQ ID NO:18014 |
| iPS:435043 | 21-225_90A5 | NA | AGGGCCAGTCAGAGTGTTTA<br>CAGCAGCTACTTAGCC<br>SEQ ID NO:1991 | GGTGCATCCAGCCGGGC<br>CACT<br>SEQ ID NO:10003 | CAGCACTATGATAACTCACC<br>GTGGACG<br>SEQ ID NO:18015 |
| | | AA | RASQSVYSSYLA<br>SEQ ID NO:1992 | GASSRAT<br>SEQ ID NO:10004 | QHYDNSPWT<br>SEQ ID NO:18016 |
| iPS:435045 | 21-225_90G5 | NA | AGGGCCAGTCAGAGTGTTTA<br>CAGCAGCTACTTAGCC<br>SEQ ID NO:1993 | GGTGCATCCAGCCGGGC<br>CACT<br>SEQ ID NO:10005 | CAGCACTATGATAACTCACC<br>GTGGACG<br>SEQ ID NO:18017 |
| | | AA | RASQSVYSSYLA<br>SEQ ID NO:1994 | GASSRAT<br>SEQ ID NO:10006 | QHYDNSPWT<br>SEQ ID NO:18018 |
| iPS:435045 | 21-225_90H5 | NA | CGGGCAAGTCAGGCATTAG<br>AAATGATTTAGGC<br>SEQ ID NO:1995 | ATTGCATCCAGTTTGCAA<br>AGT<br>SEQ ID NO:10007 | CTACAGCATAATAGTTACCC<br>GATCACC<br>SEQ ID NO:18019 |
| | | AA | RASQGIRNDLG<br>SEQ ID NO:1996 | IASSLQS<br>SEQ ID NO:10008 | LQHNSYPIT<br>SEQ ID NO:18020 |
| iPS:435051 | 21-225_90D9 | NA | AAGTCCAGCCAGAGTGTTTT<br>ACACAGCTCCAACAATTATA<br>ACTACTTAGCT<br>SEQ ID NO:1997 | TGGACATCTACCCGGGA<br>ATCC<br>SEQ ID NO:10009 | CAGCAATATCTTAGTAGTCC<br>TCTGACG<br>SEQ ID NO:18021 |
| | | AA | KSSQTVLHSSNNYNYLA<br>SEQ ID NO:1998 | WTSTRES<br>SEQ ID NO:10010 | QQYLSSPLT<br>SEQ ID NO:18022 |

FIGURE 49
(Continued)

| | | | | |
|---|---|---|---|---|
| iPS:435053 | 21-225_75F9 | NA | AAGTCCAGCCAGAGTGTTTT ACACAACTCCAACAATAATA ACTACTTGGCT | TGGGCATCTACGCGGGA GTCC | CAACAATATTATAGTAGTCC TCCGACG |
| | | | SEQ ID NO:1999 | SEQ ID NO:10011 | SEQ ID NO:18023 |
| | | AA | KSSQSVLHNSNNNNYLA | WASTRES | QQYYSSPPT |
| | | | SEQ ID NO:2000 | SEQ ID NO:10012 | SEQ ID NO:18024 |
| iPS:435055 | 21-225_90F10 | NA | AGGGCCAGTCAGAGTGTTTA CAGCAGCTACTTAGCC | GGTGCATCCAGCCGGTC CACT | CAGCACTATGATAACTCACC GTGGACG |
| | | | SEQ ID NO:2001 | SEQ ID NO:10013 | SEQ ID NO:18025 |
| | | AA | RASQSVYSSYLA | GASSRST | QHYDNSPWT |
| | | | SEQ ID NO:2002 | SEQ ID NO:10014 | SEQ ID NO:18026 |
| iPS:435059 | 21-225_90C11 | NA | AGGTATAGTCAGAGCCTCGT GCATAGTAGTGGATACAACT ATTTGGAT | TTGGGTTCTAATCGGGCC TCC | ATGCAAGCTCTACACCCTCC TCTCACT |
| | | | SEQ ID NO:2003 | SEQ ID NO:10015 | SEQ ID NO:18027 |
| | | AA | RYSQSLVHSSGYNYLD | LGSNRAS | MQALHPPLT |
| | | | SEQ ID NO:2004 | SEQ ID NO:10016 | SEQ ID NO:18028 |
| iPS:435071 | 21-225_91F1 | NA | AAGTCCAGCCAGAGTGTTTT ATACACCTCCAACAATAACA ACTACTTAGCT | TGGGCATCTACCCGGGA ATCC | CAGCACTATTATAATACTCC GTGGAAG |
| | | | SEQ ID NO:2005 | SEQ ID NO:10017 | SEQ ID NO:18029 |
| | | AA | KSSQSVLYTSNNNNYLA | WASTRES | QHYYNTPWK |
| | | | SEQ ID NO:2006 | SEQ ID NO:10018 | SEQ ID NO:18030 |
| iPS:435073 | 21-225_91B2 | NA | AGGGCCAGTCAGAGTGTTTA CAGCAGCTACTTAGCC | GGTGCATCCAGCCGGTC CACT | CAGCACTATGATAACTCACC GTGGACG |
| | | | SEQ ID NO:2007 | SEQ ID NO:10019 | SEQ ID NO:18031 |
| | | AA | RASQSVYSSYLA | GASSRST | QHYDNSPWT |
| | | | SEQ ID NO:2008 | SEQ ID NO:10020 | SEQ ID NO:18032 |
| iPS:435075 | | NA | AGGGCCAGTCAGAGTGTTTA CAGCAGCTACTTAGCC | GGTGCATCCAGCCGGTC CACT | CAGCACTATGATAACTCACC GTGGACG |

FIGURE 49
(Continued)

| | | | | | | |
|---|---|---|---|---|---|---|
| iPS:435077 | 21-225_91B3 | AA | SEQ ID NO:2009<br>RASQSVYSSYLA<br>SEQ ID NO:2010 | | SEQ ID NO:10021<br>GASSRST<br>SEQ ID NO:10022 | SEQ ID NO:18033<br>QHYDNSPWT<br>SEQ ID NO:18034 |
| iPS:435079 | 21-225_91F3 | NA | AGGGCCAGTCAGAGTGTTTA<br>CAGCAGCTACTTAGCC<br>SEQ ID NO:2011<br>RASQSVYSSYLA<br>SEQ ID NO:2012 | | GGTGCATCCAGCCGGTC<br>CACT<br>SEQ ID NO:10023<br>GASSRST<br>SEQ ID NO:10024 | CAGCATTCTGATAACTCACC<br>GTGGACG<br>SEQ ID NO:18035<br>QHSDNSPWT<br>SEQ ID NO:18036 |
| iPS:435087 | 21-225_91B4 | NA | AGGGCCAGTCAGAGTGTTTA<br>CAGCAGCTACTTAGCC<br>SEQ ID NO:2013<br>RASQSVYSSYLA<br>SEQ ID NO:2014 | | GGTGCATCCAGCCGGTC<br>CACT<br>SEQ ID NO:10025<br>GASSRST<br>SEQ ID NO:10026 | CAGCACTATGATAACTCACC<br>GTGGACG<br>SEQ ID NO:18037<br>QHYDNSPWT<br>SEQ ID NO:18038 |
| | 21-225_91G8 | AA | AAGTCCAGCCAGAGTGTTTT<br>ATACACCTCCAACAATAACA<br>ACTACTTAGCT<br>SEQ ID NO:2015<br>KSSQSVLYTSNNNNYLA<br>SEQ ID NO:2016 | | TGGGCATCTACCCGGGA<br>ATCC<br>SEQ ID NO:10027<br>WASTRES<br>SEQ ID NO:10028 | CAGCAATATTATACTACTCC<br>GTGGACG<br>SEQ ID NO:18039<br>QQYTTPWT<br>SEQ ID NO:18040 |
| iPS:435089 | 21-225_91E9 | NA | AGGGCCAGTCAGAGTGTTTA<br>CAGCAGCTACTTAGCG<br>SEQ ID NO:2017<br>RASQSVYSSYLA<br>SEQ ID NO:2018 | | GGTGCATCCAGCCGGGC<br>CACG<br>SEQ ID NO:10029<br>GASSRAT<br>SEQ ID NO:10030 | CAGCACTCTGATAACTCACC<br>GTGGACG<br>SEQ ID NO:18041<br>QHSDNSPWT<br>SEQ ID NO:18042 |
| iPS:435097 | 21-225_92B1 | AA | AGGGCCAGTCAGAGTGTTGG<br>CAGCAACTACTTAGCC<br>SEQ ID NO:2019<br>RASQSVGSNYLA<br>SEQ ID NO:2020 | | GGTGCATCCAGCCAGGGC<br>CACT<br>SEQ ID NO:10031<br>GASSRAT<br>SEQ ID NO:10032 | CAGCAGTATGAAAGTTCACC<br>GTGGACG<br>SEQ ID NO:18043<br>QQYESSPWT<br>SEQ ID NO:18044 |

FIGURE 49
(Continued)

| | | | | | |
|---|---|---|---|---|---|
| iPS:435103 | 21-225_92B2 | NA | AGGTCTAGTCAGAGCCTCGTGCATAGTAGTGGATACAACTATTTGGAT | TTGGGTTCTAATCGGGCC TCC | ATGCAAGCTCTACATATTCC TCTCACT |
| | | | SEQ ID NO:2021 | SEQ ID NO:10033 | SEQ ID NO:18045 |
| | | AA | RSSQSLVHSSGYNYLD | LGSNRAS | MQALHPLT |
| | | | SEQ ID NO:2022 | SEQ ID NO:10034 | SEQ ID NO:18046 |
| iPS:435109 | 21-225_92H5 | NA | CGGGCCAGTCAGGATGTTAT CACTTACTTAGCC | GGTGCATCCACCAGGGC CACT | CAGGAGTATAATGACTGGCC GTGCAGT |
| | | | SEQ ID NO:2023 | SEQ ID NO:10035 | SEQ ID NO:18047 |
| | | AA | RASQDVITYLA | GASTRAT | QEYNDWPCS |
| | | | SEQ ID NO:2024 | SEQ ID NO:10036 | SEQ ID NO:18048 |
| iPS:435111 | 21-225_92D6 | NA | AGGGCCAGTCAGAGTGTTTA CAGCAGCTACTTAGCC | GGTGCATCCAGCCGGTC CACT | CAGCATTATGATAACTCTCC GTGGACG |
| | | | SEQ ID NO:2025 | SEQ ID NO:10037 | SEQ ID NO:18049 |
| | | AA | RASQSVYSSYLA | GASSRST | QHYDNSPWT |
| | | | SEQ ID NO:2026 | SEQ ID NO:10038 | SEQ ID NO:18050 |
| iPS:435113 | 21-225_92E6 | NA | AAGTCCAGTCAGAATATTTT ATCCAGTCCAACAATAAGAATCCAGTCCAACAATAAGA ACTACTTAACT | TGGACATCTACCGGGA ATCC | CAGCAATATATTTTAGTGTTCCT CCGACG |
| | | | SEQ ID NO:2027 | SEQ ID NO:10039 | SEQ ID NO:18051 |
| | | AA | KSSQNILSSSNNKNYLT | WTSTRES | QQYFSVPPT |
| | | | SEQ ID NO:2028 | SEQ ID NO:10040 | SEQ ID NO:18052 |
| iPS:435115 | 21-225_77C5 | NA | AGGGCCAGTCAGAGTGTTTA CAGCAGCTACTTAGCC | GGTGCATCCAGCCGGTC CACT | CAGCACTATGATAACTCACC GTGGACG |
| | | | SEQ ID NO:2029 | SEQ ID NO:10041 | SEQ ID NO:18053 |
| | | AA | RASQSVYSSYLA | GASSRST | QHYDNSPWT |
| | | | SEQ ID NO:2030 | SEQ ID NO:10042 | SEQ ID NO:18054 |
| iPS:435167 | 21_225_92F12 | NA | AAGTCCAGCCAGAGTGTTTT ACACAGGTCCAACAATTACA ACTACTTAGCG | TGGGCATCTACCGGGA ATCC | CAGCAATATTATAGTACTCC TCCGACG |

FIGURE 49
(Continued)

| | | | | | | | |
|---|---|---|---|---|---|---|---|
| iPS:435171 | 21-225_92F12 | AA | | SEQ ID NO:2031<br>KSSQSVLHRSNNYNYLA | SEQ ID NO:10043<br>WASTRES | SEQ ID NO:18055<br>QQYYSTPPT | |
| | | NA | | SEQ ID NO:2032<br>AGGGCCAGTCAGAGTGTTTA<br>CAGCAGCTACTTAGCC | SEQ ID NO:10044<br>GGTGCATCCAGCGGGC<br>CACT | SEQ ID NO:18056<br>CAGCACTATGATAACTCACC<br>GTGGACG | |
| iPS:435177 | 21-225_93C2 | AA | | SEQ ID NO:2033<br>RASQSVYSSYLA | SEQ ID NO:10045<br>GASSRAT | SEQ ID NO:18057<br>QHYDNSPWT | |
| | | NA | | SEQ ID NO:2034<br>AGGGCCAGTCAGAGTGTTTA<br>CAGCAGCTACTTAGCC | SEQ ID NO:10046<br>GGTGCATCCAGCGGTC<br>CACT | SEQ ID NO:18058<br>CAGCACTCTGATAACTCACC<br>GTGGACG | |
| iPS:435183 | 21-225_93E4 | AA | | SEQ ID NO:2035<br>RASQSVYSSYLA | SEQ ID NO:10047<br>GASSRST | SEQ ID NO:18059<br>QHSDNSPWT | |
| | | NA | | SEQ ID NO:2036<br>AGGGCCAGTCAGAGTGTTGA<br>CAGCAGCTACCTAGCC | SEQ ID NO:10048<br>GGTGCATCCAGCAGGGC<br>CCCT | SEQ ID NO:18060<br>CAGCAGTATGAAAGCTCACC<br>GTGGACG | |
| iPS:435195 | 21-225_93E9 | AA | | SEQ ID NO:2037<br>RASQSVDSSYLA | SEQ ID NO:10049<br>GASSRAP | SEQ ID NO:18061<br>QQYESSPWT | |
| | | NA | | SEQ ID NO:2038<br>AGGGCCAGTCAGAGTGTTAG<br>CAGCAGCTACTTAGCC | SEQ ID NO:10050<br>GGTGCATCCAGCAGGGC<br>CACT | SEQ ID NO:18062<br>CAGCATTATGATAGCTCACC<br>GTGGACG | |
| iPS:435195 | 21-225_94D3 | AA | | SEQ ID NO:2039<br>RASQSVSSRYLA | SEQ ID NO:10051<br>GASSRAT | SEQ ID NO:18063<br>QHYDSSPWT | |
| | | NA | | SEQ ID NO:2040<br>CGGGCAAGTCAGGCCATTAG<br>AGATGATTAGGC | SEQ ID NO:10052<br>GCTGCATCCAGTTGCAA<br>AGT | SEQ ID NO:18064<br>CTCCAGCATTATAGTTACCC<br>TCGGACG | |
| iPS:435197 | 21-225_94F3 | AA | | SEQ ID NO:2041<br>RASQAIRDDLG | SEQ ID NO:10053<br>AASSLQS | SEQ ID NO:18065<br>LQHYSYPRT | |
| | | | | SEQ ID NO:2042 | SEQ ID NO:10054 | SEQ ID NO:18066 | |

FIGURE 49
(Continued)

| | | | | | |
|---|---|---|---|---|---|
| iPS:435203 | 21-225_75A7 | NA | AAGTCCAGCCAGACTGTTTTACACAGCTCCAACAATTATAACTACTTAGCT<br>SEQ ID NO:2043 | TGGACATCTACCCGGGAATCC<br>SEQ ID NO:10055 | CAGCAATATTTAGTAGTCCTCCGACG<br>SEQ ID NO:18067 |
| | | AA | KSSQTVLHSSNNYNYLA<br>SEQ ID NO:2044 | WTSTRES<br>SEQ ID NO:10056 | QQYFSSPPT<br>SEQ ID NO:18068 |
| iPS:435209 | 21-225_75A10 | NA | AAGTCCAGCCAGAGTGTTTTACACAACTCCAACAATTACAACTACTTAACT<br>SEQ ID NO:2045 | TGGGCATCTACCCGGAAATCC<br>SEQ ID NO:10057 | CAGCAATATTATAGTTCTCCTCCGACG<br>SEQ ID NO:18069 |
| | | AA | KSSQSVLHNSNNYNYLT<br>SEQ ID NO:2046 | WASTRKS<br>SEQ ID NO:10058 | QQYYSSPPT<br>SEQ ID NO:18070 |
| iPS:435211 | 21-225_94E11 | NA | AAGTCCAGCCAGAGTGTTTATTCAGCTCCAACAATTATAATTACTTAGCT<br>SEQ ID NO:2047 | TGGGCATCTACCCGGGAATCC<br>SEQ ID NO:10059 | CAGCAATATCATAGTTCTCTCTGACG<br>SEQ ID NO:18071 |
| | | AA | KSSQSVLFSSNNYNYLA<br>SEQ ID NO:2048 | WASTRES<br>SEQ ID NO:10060 | QQYHSSPLT<br>SEQ ID NO:18072 |
| iPS:435215 | 21-225_94E12 | NA | AAGTCCAGCCAGAGTGTTTTACACAGGTCCAACAATTACAACTACTTAGCG<br>SEQ ID NO:2049 | TGGGCATCTACCCGGGAATCC<br>SEQ ID NO:10061 | CAGCAATATTATAGTACTCCTCCGACG<br>SEQ ID NO:18073 |
| | | AA | KSSQSVLHRSNNYNYLA<br>SEQ ID NO:2050 | WASTRES<br>SEQ ID NO:10062 | QQYYSTPPT<br>SEQ ID NO:18074 |
| iPS:435217 | 21-225_94F12 | NA | AGGGCCAGTCAGAGTGTTTACAGCAGCTACTTAGCG<br>SEQ ID NO:2051 | GGTGCATCCAGCCGGTCCACT<br>SEQ ID NO:10063 | CAGCATTATGATAACTCACCGTGGACG<br>SEQ ID NO:18075 |
| | | AA | RASQSVYSSYLA<br>SEQ ID NO:2052 | GASSRST<br>SEQ ID NO:10064 | QHYDNSPWT<br>SEQ ID NO:18076 |

FIGURE 49
(Continued)

| | | | | |
|---|---|---|---|---|
| iPS:435219 | 21-225_95D2 | NA | AGGGCCAGTCAGAGTGTTTA CAGCAGCTACTTAGCC SEQ ID NO:2053 | GGTGCATCCAGCCGGGC CACT SEQ ID NO:10065 | CAGCACTATGATAACTCACC GTGGACG SEQ ID NO:18077 |
| | | AA | RASQSVYSSYLA SEQ ID NO:2054 | GASSRAT SEQ ID NO:10066 | QHYDNSPWT SEQ ID NO:18078 |
| iPS:435221 | 21-225_95G2 | NA | AGGGCCAGTCAGTATGAGTGTTGT CAACAGCTTAGCC SEQ ID NO:2055 | GGTGCATCCACCAGGGC CACT SEQ ID NO:10067 | CAGCAGTATAATGACTGGCC GTGCAGT SEQ ID NO:18079 |
| | | AA | RASMSVVNSLA SEQ ID NO:2056 | GASTRAT SEQ ID NO:10068 | QQYNDWPCS SEQ ID NO:18080 |
| iPS:435227 | 21-225_95G4 | NA | AAGTCCAGCCAGAGTGTTTT ATTCAGATCAACAATTATA ATTACTTAGCT SEQ ID NO:2057 | TGGGCATCTACCCGGGA ATCC SEQ ID NO:10069 | CAGCAATATCATAGTTCTCC TCTGACG SEQ ID NO:18081 |
| | | AA | KSSQSVLFRSNNYNYLA SEQ ID NO:2058 | WASTRES SEQ ID NO:10070 | QQYHSSPLT SEQ ID NO:18082 |
| iPS:435235 | 21-225_95F9 | NA | AGGGCCAGTCAGAGTGTTTA CAGCAGCTACTTAGCC SEQ ID NO:2059 | GGTGCATCCAGCCGGTC CACT SEQ ID NO:10071 | CAGCACTATGATAACTCACC GTGGACG SEQ ID NO:18083 |
| | | AA | RASQSVYSSYLA SEQ ID NO:2060 | GASSRST SEQ ID NO:10072 | QHYDNSPWT SEQ ID NO:18084 |
| iPS:435237 | 21-225_95G9 | NA | AGGGCCAGTCAGAGTGTTTA CAGCAGCTACTTAGCG SEQ ID NO:2061 | GGTGCATCCAGCCGGTC CACT SEQ ID NO:10073 | CAGCACTATGATAACTCACC GTGGACG SEQ ID NO:18085 |
| | | AA | RASQSVYSSYLA SEQ ID NO:2062 | GASSRST SEQ ID NO:10074 | QHYDNSPWT SEQ ID NO:18086 |
| iPS:435239 | 21-225_95H10 | NA | AGGGCCAGTCAGAGTGTTTA CAGCAGCTACTTAGCC SEQ ID NO:2063 | GGTGCATCCAGCCGGGC CACT SEQ ID NO:10075 | CAGCACTATGATAACTCTCC GTGGACG SEQ ID NO:18087 |
| | | AA | RASQSVYSSYLA | GASSRAT | QHYDNSPWT |

FIGURE 49
(Continued)

| | | | | | |
|---|---|---|---|---|---|
| iPS:435245 | | SEQ ID NO:2064 AAGTCCAGCCAGAGTGTTT ATACAGCTCCAACAATGCGA ACTACTTAGCT | SEQ ID NO:10076 TGGGCATCTACCCGGGA ATCC | SEQ ID NO:18088 CAGCAATATTATAGTACTCC GTGCAGT | |
| | 21-225_95E12 | NA | | | |
| | | AA | SEQ ID NO:2065 KSSQSVLYSSNNANYLA | SEQ ID NO:10077 WASTRES | SEQ ID NO:18089 QQYYSTPCS |
| iPS:435247 | | NA | SEQ ID NO:2066 AGGGCCAGTCAGAGCGTTAG CAGCAGTACTTAGCT | SEQ ID NO:10078 GGTGCATCCACCAGGGC CTCT | SEQ ID NO:18090 CAGCAGTATGGTAACTCACC GCTCACT |
| | 21-225_96G1 | | | | |
| | | AA | SEQ ID NO:2067 RASQSVSSSYLA | SEQ ID NO:10079 GASTRAS | SEQ ID NO:18091 QQYGNSPLT |
| iPS:435249 | | NA | SEQ ID NO:2068 AAGTCCAGCCAGAGTGTTT ACACAGCTCTAATAAAAGA ACTACTTAGCT | SEQ ID NO:10080 TGGGCATCTACCTGGGA ATCC | SEQ ID NO:18092 CAGCAATATTATAGGACTCC GTGGACG |
| | 21-225_96E2 | | | | |
| | | AA | SEQ ID NO:2069 KSSQSVLHSSNKKNYLA | SEQ ID NO:10081 WASTWES | SEQ ID NO:18093 QQYYRTPWT |
| iPS:435251 | | NA | SEQ ID NO:2070 CGGGCAAGTCAGGGCATTAG AAATGATTTAGGC | SEQ ID NO:10082 GCTGCATCCACTTTGCAA AGT | SEQ ID NO:18094 CTACAGCATAGTAATTACCC GCTCACT |
| | 21-225_96A3 | | | | |
| | | AA | SEQ ID NO:2071 RASQGIRNDLG | SEQ ID NO:10083 AASTLQS | SEQ ID NO:18095 LQHSNYPLT |
| iPS:435253 | | NA | SEQ ID NO:2072 CGGGCAAGTCAGGACATTAG AAATGATTTAGGC | SEQ ID NO:10084 GGTGTATCCAGTTTGCAA AGT | SEQ ID NO:18096 CTACAGCATAATGATTACCC ATTCACT |
| | 21-225_96A4 | | | | |
| | | AA | SEQ ID NO:2073 RASQDIRNDLG | SEQ ID NO:10085 GVSSLQS | SEQ ID NO:18097 LQHNDYPFT |
| | | | SEQ ID NO:2074 | SEQ ID NO:10086 | SEQ ID NO:18098 |

FIGURE 49
(Continued)

| | | | | | |
|---|---|---|---|---|---|
| iPS:435255 | 21-225_96D5 | NA | AAGTCCAGCCAGAGTGTTTTGCACAGCTCCAACAATTATAATTACTTAGCT<br>SEQ ID NO:2075 | TGGGCATCTACCCGGGAATCC<br>SEQ ID NO:10087 | CAGCAATATTATAGTAGTCCACCGACG<br>SEQ ID NO:18099 |
| | | AA | KSSQSVLHSSNNYNYLA<br>SEQ ID NO:2076 | WASTRES<br>SEQ ID NO:10088 | QQYSSPPT<br>SEQ ID NO:18100 |
| iPS:435257 | 21-225_96H5 | NA | AAGTCCAGCCAGAGTGTTTTGTACAGCTCCAACAGTCACAACTACTTAGCT<br>SEQ ID NO:2077 | TGGGCATCTATCCGGGAATCC<br>SEQ ID NO:10089 | CAGCAATATTATAGTACTCCGTGCAGT<br>SEQ ID NO:18101 |
| | | AA | KSSQSVLYSSNSHNYLA<br>SEQ ID NO:2078 | WASIRES<br>SEQ ID NO:10090 | QQYYSTPCS<br>SEQ ID NO:18102 |
| iPS:435259 | 21-225_96C6 | NA | CGGGCGAGTCAGGGCATTAGCAATTATTAGCC<br>SEQ ID NO:2079 | GCTGCTTCCAGTTTGCAAAGT<br>SEQ ID NO:10091 | CACCAGTATAATGATTACCCATTCACT<br>SEQ ID NO:18103 |
| | | AA | RASQGISNYLA<br>SEQ ID NO:2080 | AASSLQS<br>SEQ ID NO:10092 | HQYNDYPFT<br>SEQ ID NO:18104 |
| iPS:435267 | 21-225_96D10 | NA | AAGTCCAGTCAGAATATTTATCCAGCTCCAACAACAATAAGAACTACTTAACT<br>SEQ ID NO:2081 | TGGACATCTACCCGGGAATCC<br>SEQ ID NO:10093 | CAGCAATATTTTAGTGTTCCTCCGACG<br>SEQ ID NO:18105 |
| | | AA | KSSQNILSSSNNKNYLT<br>SEQ ID NO:2082 | WTSTRES<br>SEQ ID NO:10094 | QQYFSVPPT<br>SEQ ID NO:18106 |
| iPS:435273 | 21-225_97A2 | NA | AGGGCCAGTCAGAGTGTTTACAGCAGCTACTTAGCC<br>SEQ ID NO:2083 | GGTGCATCCAGCGGTCCACT<br>SEQ ID NO:10095 | CAGCATTCTGATAACTCACCGTGGACG<br>SEQ ID NO:18107 |
| | | AA | RASQSVYSSYLA<br>SEQ ID NO:2084 | GASSRST<br>SEQ ID NO:10096 | QHSDNSPWT<br>SEQ ID NO:18108 |

FIGURE 49
(Continued)

| | | | | | |
|---|---|---|---|---|---|
| iPS:435279 | 21-225_97H4 | NA | AAGTCCAGCCAGAGAGTGTTTATACACCTCCAACAATAACAACTACTTAGCT<br>SEQ ID NO:2085 | TGGGCATCTACCCGGGAATCC<br>SEQ ID NO:10097 | CAGCACTACAATGATACTCCATGGAAG<br>SEQ ID NO:18109 |
| | | AA | KSSQSVLYTSNNNNYLAACTACTTAGCT<br>SEQ ID NO:2086 | WASTRES<br>SEQ ID NO:10098 | QHYNDTPWK<br>SEQ ID NO:18110 |
| iPS:435281 | 21-225_97E5 | NA | AGGGCCAGTCAGAGTGTTTACAGCAGCTACTTAGCC<br>SEQ ID NO:2087 | GGTGCATCCAGCCGGGCCACT<br>SEQ ID NO:10099 | CAGCACTCTGATAACTCACCGTGGACG<br>SEQ ID NO:18111 |
| | | AA | RASQSVYSSYLA<br>SEQ ID NO:2088 | GASSRAT<br>SEQ ID NO:10100 | QHSDNSPWT<br>SEQ ID NO:18112 |
| iPS:435291 | 21-225_146E1 | NA | CGGGCGAGTCAGGGTATTAACAACTGGTTAGTC<br>SEQ ID NO:2089 | GCTGCATCCAGTTGCAAAGT<br>SEQ ID NO:10101 | CAACAGGCTAACAGTTTCCCATTCACT<br>SEQ ID NO:18113 |
| | | AA | RASQGINNWLV<br>SEQ ID NO:2090 | AASSLQS<br>SEQ ID NO:10102 | QQANSFPFT<br>SEQ ID NO:18114 |
| iPS:435293 | 21-225_146F1 | NA | CGGGCAAGTCAGGAGCATTAGAAATGATTTAGGC<br>SEQ ID NO:2091 | GCTGCATCCAGTTGCAAAGT<br>SEQ ID NO:10103 | CTTCAGCATAGTACTTACCCGCTCACT<br>SEQ ID NO:18115 |
| | | AA | RASQGIRNDLG<br>SEQ ID NO:2092 | AASSLQS<br>SEQ ID NO:10104 | LQHSTYPLT<br>SEQ ID NO:18116 |
| iPS:435295 | 21-225_146H1 | NA | CGGGCAAGTCAGAGCATTAGCGACTATTTAAAT<br>SEQ ID NO:2093 | ACTACATCCAGTTTGCAAAGT<br>SEQ ID NO:10105 | CAACAGAGTTACAGTACCCCCACT<br>SEQ ID NO:18117 |
| | | AA | RASQSISDYLN<br>SEQ ID NO:2094 | TTSSLQS<br>SEQ ID NO:10106 | QQSYSTPT<br>SEQ ID NO:18118 |
| iPS:435297 | 21-225_146B3 | NA | AAGTCTAGTCAGAGCCTCCTGCATGGTGATGGAAAGACCTATTTGTAT<br>SEQ ID NO:2095 | GAAGTTCCAACCGGTTCTCT<br>SEQ ID NO:10107 | ATGCAAAGTATACAGCTTCCGTGGACG<br>SEQ ID NO:18119 |

FIGURE 49
(Continued)

| | | AA | KSSQSLLHGDGKTYLY | EVSNRFS | MQSIQLPWT |
|---|---|---|---|---|---|
| | | | SEQ ID NO:2096 | SEQ ID NO:10108 | SEQ ID NO:18120 |
| iPS:435299 | 21-225_146D4 | NA | AAGTCCAGCCAGAGTGTTT ATACAGCTCCAACAATAACA ACTACTTAGCT | TGGGCATCTACCCGGGA ATCC | CAGCAATATTATAGTACTCC GTGCAGT |
| | | | SEQ ID NO:2097 | SEQ ID NO:10109 | SEQ ID NO:18121 |
| | | AA | KSSQSVLYSSNNNNYLA | WASTRES | QQYYSTPCS |
| | | | SEQ ID NO:2098 | SEQ ID NO:10110 | SEQ ID NO:18122 |
| iPS:435301 | 21-225_146G4 | NA | AGGGCCAGTCAGAATATTAT CAGCAGCTATTTAGCC | GGTGTATCTAGTCGGGC CACT | CAACAATATGGTAGGTCACC ATTCAAT |
| | | | SEQ ID NO:2099 | SEQ ID NO:10111 | SEQ ID NO:18123 |
| | | AA | RASQNIISSYLA | GVSSRAT | QQYGRSPFN |
| | | | SEQ ID NO:2100 | SEQ ID NO:10112 | SEQ ID NO:18124 |
| iPS:435303 | 21-225_146A6 | NA | CGGGCGAGTCAGGGTATTAG CAACTGGTTAGCC | GCTGCATCCAGTTTGCAA GGT | CAACAGACTGACAGTTTCCC ATTCACT |
| | | | SEQ ID NO:2101 | SEQ ID NO:10113 | SEQ ID NO:18125 |
| | | AA | RASQGISNWLA | AASSLQG | QQTDSFPFT |
| | | | SEQ ID NO:2102 | SEQ ID NO:10114 | SEQ ID NO:18126 |
| iPS:435305 | 21-225_146C9 | NA | AAGTCCAGCCAGAGTGTTT ACACAGCTCCAACAATTATA ATTACTTAGCT | TGGGCATCTACCCGGAA ATCC | CAGCAATATTATAGTACTCC GTGCAGT |
| | | | SEQ ID NO:2103 | SEQ ID NO:10115 | SEQ ID NO:18127 |
| | | AA | KSSQSVLHSSNNYNYLA | WASTRKS | QQYYSTPCS |
| | | | SEQ ID NO:2104 | SEQ ID NO:10116 | SEQ ID NO:18128 |
| iPS:435307 | 21-225_146E9 | NA | CGGGCAAGTCAGAGCATTAG CGACTATTTAAAT | ACTACATCCAGTTTGCAA AGT | CAACAGAGTTACAGTACCCC CACT |
| | | | SEQ ID NO:2105 | SEQ ID NO:10117 | SEQ ID NO:18129 |
| | | AA | RASQSISDYLN | TTSSLQS | QQSYSTPT |
| | | | SEQ ID NO:2106 | SEQ ID NO:10118 | SEQ ID NO:18130 |

FIGURE 49
(Continued)

| | | | | | |
|---|---|---|---|---|---|
| iPS:435309 | 21-225_146F9 | NA | AAGTCCAGCCAGAATATTT ACACAGTCCAACAATAACA ACTACTTAGCT | TGGGCATCTACCCGGGA ATCC | CAGCAATATTATACTACTCC GTGCAGT |
| | | | SEQ ID NO:2107 | SEQ ID NO:10119 | SEQ ID NO:18131 |
| | | AA | KSSQNILHSSNNNNYLA | WASTRES | QQYYTTPCS |
| | | | SEQ ID NO:2108 | SEQ ID NO:10120 | SEQ ID NO:18132 |
| iPS:435311 | 21-225_146H9 | NA | CGGGCAAGTCAGGGCATTAG AAATGATTTAGGC | GCTGCATCCAGTTTGCAA AGT | CTACAGCATAATAGTTACCC GCTCACT |
| | | | SEQ ID NO:2109 | SEQ ID NO:10121 | SEQ ID NO:18133 |
| | | AA | RASQGIRNDLG | AASSLQS | LQHNSYPLT |
| | | | SEQ ID NO:2110 | SEQ ID NO:10122 | SEQ ID NO:18134 |
| iPS:435313 | 21-225_146G11 | NA | CGGGCAAGTCAGGACATTAG AAATAATTTTGGC | GCTGCATCCAGTTTGCAA AGT | CTCCAACATGATAGTTACCC GCTCACT |
| | | | SEQ ID NO:2111 | SEQ ID NO:10123 | SEQ ID NO:18135 |
| | | AA | RASQDIRNNFG | AASSLQS | LQHDSYPLT |
| | | | SEQ ID NO:2112 | SEQ ID NO:10124 | SEQ ID NO:18136 |
| iPS:435315 | 21-225_147B2 | NA | AAGTCTAGTCAGAGCCTCCT GCATAGTGAAGGAAAGACC TATTTGTAT | GAAGTTTCCACCGGGT CTCT | ATGCAAAGTACACAGTTTCC TCCCACT |
| | | | SEQ ID NO:2113 | SEQ ID NO:10125 | SEQ ID NO:18137 |
| | | AA | KSSQSLLHSEGKTYLY | EVSHRVS | MQSTQFPPT |
| | | | SEQ ID NO:2114 | SEQ ID NO:10126 | SEQ ID NO:18138 |
| iPS:435317 | 21-225_147D2 | NA | AGGGCCAGTCAGAGTGTTAT CAGCAGCTACTTAGCC | GGTGCATCCAGCAGGGC CACT | CAGCAGTATGGTAGCTTATT CACT |
| | | | SEQ ID NO:2115 | SEQ ID NO:10127 | SEQ ID NO:18139 |
| | | AA | RASQSVGSSYLA | GASSRAT | QQYGSLFT |
| | | | SEQ ID NO:2116 | SEQ ID NO:10128 | SEQ ID NO:18140 |
| iPS:435319 | 21-225_147E3 | NA | AGGGCCAGTCAGAGTGTTAT CAGTAGCTACTTAGCC | GGTGCATCCAGCAGGGC CACT | CAACAATATGGTAGGTCACC ATTCAAT |
| | | | SEQ ID NO:2117 | SEQ ID NO:10129 | SEQ ID NO:18141 |

FIGURE 49
(Continued)

| | | | | | | |
|---|---|---|---|---|---|---|
| iPS:435321 | 21-225_147E4 | AA | RASQSVISSYLA | | GASSRAT | QQYGRSPFN |
| | | | SEQ ID NO:2118 | | SEQ ID NO:10130 | SEQ ID NO:18142 |
| | | NA | AAGTCCAGCCAGAGTGTTTT ACACAGCTCCAACAATTACA ACTACTTAGCT | | TGGGCATCTACCCGGGA ATCC | CAGCAATATTATAGTACTCC ATCCACT |
| | | | SEQ ID NO:2119 | | SEQ ID NO:10131 | SEQ ID NO:18143 |
| iPS:435323 | | AA | KSSQSVLHSSNNYNYLA | | WASTRES | QQYYSTPST |
| | | | SEQ ID NO:2120 | | SEQ ID NO:10132 | SEQ ID NO:18144 |
| | 21-225_147D5 | NA | AAGTCCAGCCAGAGTGTTTT ATACAGCTCCAACAATAACA ACTACTTAGCT | | TGGGCATCTACCCGGGA ATCC | CACCAATATTATAGTACTCC GTGCAGT |
| | | | SEQ ID NO:2121 | | SEQ ID NO:10133 | SEQ ID NO:18145 |
| iPS:435325 | | AA | KSSQSVLYSSNNNNYLA | | WASTRES | HQYYSTPCS |
| | | | SEQ ID NO:2122 | | SEQ ID NO:10134 | SEQ ID NO:18146 |
| | 21-225_147H5 | NA | CGGGCAAGTCGGGGCATTAG AGATGATTAGGC | | GCTGCATCCAGTTTGCAG AGT | CTACAGCATTATAGTTATCC TCGGACG |
| | | | SEQ ID NO:2123 | | SEQ ID NO:10135 | SEQ ID NO:18147 |
| iPS:435327 | | AA | RASRGIRDLG | | AASSLQS | LQHYSYPRT |
| | | | SEQ ID NO:2124 | | SEQ ID NO:10136 | SEQ ID NO:18148 |
| | 21-225_147G6 | NA | AAGTCCAGCCAGAGTGTTTT ATACAGCTCCAACAGTAACA ACTACTTAGCT | | TGGGCATCTGCCCGGGA ATCC | CAGCAATATTATACTACTCC TCCCACT |
| | | | SEQ ID NO:2125 | | SEQ ID NO:10137 | SEQ ID NO:18149 |
| iPS:435329 | | AA | KSSQSVLYSSNSNNYLA | | WASARES | QQYYTTPPT |
| | | | SEQ ID NO:2126 | | SEQ ID NO:10138 | SEQ ID NO:18150 |
| | 21-225_147A8 | NA | AAGACTAGTCAGAGCCTCCT GCATAGTGAAGGAAAGACC TATTTGTAT | | GAAGTTTCCAACCGGTTC TCT | ATGCAAAGTATACAGCTAAT CACC |
| | | | SEQ ID NO:2127 | | SEQ ID NO:10139 | SEQ ID NO:18151 |
| | | AA | KTSQSLLHSEGKTYLY | | EVSNRFS | MQSIQLIT |

FIGURE 49
(Continued)

| | | | | | | |
|---|---|---|---|---|---|---|
| | | | SEQ ID NO:2128 | | SEQ ID NO:10140 | SEQ ID NO:18152 |
| iPS:435331 | 21-225_147G8 | NA | AGGGCCAGTCAGAGAAATTTT CAGCAACTACTTAGCC | | GGTGCATCCAGCAGGGC CACT | CAGCAGTATGATAGCTCACC GTGGACG |
| | | | SEQ ID NO:2129 | | SEQ ID NO:10141 | SEQ ID NO:18153 |
| | | AA | RASQRIFSNYLA | | GASSRAT | QQYDSSPWT |
| | | | SEQ ID NO:2130 | | SEQ ID NO:10142 | SEQ ID NO:18154 |
| iPS:435333 | 21-225_147E9 | NA | CGGGCGAGTCAGGACAGATTAA CAATTATTTAGCC | | GCTGCATCCAGTTTGCAA AGT | CAACAGTATAATAGTTACCC TCTCACT |
| | | | SEQ ID NO:2131 | | SEQ ID NO:10143 | SEQ ID NO:18155 |
| | | AA | RASQDINNYLA | | AASSLQS | QQYNSYPLT |
| | | | SEQ ID NO:2132 | | SEQ ID NO:10144 | SEQ ID NO:18156 |
| iPS:435335 | 21-225_147D10 | NA | CGGGCGAGTCAGAATATTAG CAACTGGTTAACC | | GCTGCATCCAGTTTGCAA AGT | CAACAGACTGACAGTTTCCC ATTCACT |
| | | | SEQ ID NO:2133 | | SEQ ID NO:10145 | SEQ ID NO:18157 |
| | | AA | RASQNISNWLT | | AASSLQS | QQTDSFPFT |
| | | | SEQ ID NO:2134 | | SEQ ID NO:10146 | SEQ ID NO:18158 |
| iPS:435339 | 21-225_147D12 | NA | CGGGCGAGTCAGGTATTAG CAACTGGTTAGCC | | GCTGCATCCAGTTTGCAA AGT | CAACAGACTGACAGTTTCCC ATTCACT |
| | | | SEQ ID NO:2135 | | SEQ ID NO:10147 | SEQ ID NO:18159 |
| | | AA | RASQGISNWLA | | AASSLQS | QQTDSFPFT |
| | | | SEQ ID NO:2136 | | SEQ ID NO:10148 | SEQ ID NO:18160 |
| iPS:435341 | 21-225_148B2 | NA | AAGTCTAGTCAGAGCCTCCT GCATGGTGATGGAAAGACCTT ATTTTTAT | | GAAGTTTCCACCGGTTC TCT | ATGCAAAGTATACAGATTCC GTGGACG |
| | | | SEQ ID NO:2137 | | SEQ ID NO:10149 | SEQ ID NO:18161 |
| | | AA | KSSQSLLHGDGKTYFY | | EVSHRFS | MQSIQIPWT |
| | | | SEQ ID NO:2138 | | SEQ ID NO:10150 | SEQ ID NO:18162 |
| iPS:435343 | 21-225_148E2 | NA | CGGGCGAGTCAGGGTATTAG CAACTGGTTAGCC | | GCTGCATCCAGTTTGCAA AGT | CAACAGACTGACAGTTTCCC ATTCACT |
| | | | SEQ ID NO:2139 | | SEQ ID NO:10151 | SEQ ID NO:18163 |

FIGURE 49
(Continued)

| | | | RASQGISNWLA | AAGTCCAGCCAACGTGTTT ACACAGCTCCAACAATTATA ACTACTTAGCT | AASSLQS | TGGGCATCTACCCGGGA TTCC | QQTDSPPFT | CAGCAATATTATAGTACTCC ATTCACT |
|---|---|---|---|---|---|---|---|---|
| iPS:435345 | 21-225_148G3 | AA | SEQ ID NO:2140 | | SEQ ID NO:10152 | | SEQ ID NO:18164 | |
| | | NA | | SEQ ID NO:2141 | | SEQ ID NO:10153 | | SEQ ID NO:18165 |
| | | AA | KSSQRVLHSSNNYNYLA | | WASTRDS | | QQYYSTPFT | |
| iPS:435347 | 21-225_148C4 | | SEQ ID NO:2142 | | SEQ ID NO:10154 | | SEQ ID NO:18166 | |
| | | NA | | CGGGCAAGTCAGAGCATTAT CAACTATTTAAAT | | ACTGCATCCAGTTTACAG AGT | | CAACAGAGTTACAGTACCCC CACT |
| | | | | SEQ ID NO:2143 | | SEQ ID NO:10155 | | SEQ ID NO:18167 |
| | | AA | RASQSIINYLN | | TASSLQS | | QQSYSTPT | |
| iPS:435349 | 21-225_148F5 | | SEQ ID NO:2144 | | SEQ ID NO:10156 | | SEQ ID NO:18168 | |
| | | NA | | AAGTCTAGTCAGAGCCTCCT GCATAGTGAAGGAAAGACC TATTTGTAT | | GAAGTTTCCTACCGGGTC TCT | | ATGCAAAGTATACAGCTTCC GCTCACT |
| | | | | SEQ ID NO:2145 | | SEQ ID NO:10157 | | SEQ ID NO:18169 |
| | | AA | KSSQSLLHSEGKTYLY | | EVSYRVS | | MQSIQLPLT | |
| iPS:435351 | 21-225_148B6 | | SEQ ID NO:2146 | | SEQ ID NO:10158 | | SEQ ID NO:18170 | |
| | | NA | | CGGGCGAGTCAGGGCATTAG CAAATATTTAGCC | | GCTGCATCCAGTTTGCAA AGT | | CAACAGTATAATAGTTTCCC ATTCACT |
| | | | | SEQ ID NO:2147 | | SEQ ID NO:10159 | | SEQ ID NO:18171 |
| | | AA | RASQGISKYLA | | AASSLQS | | QQYNSFPFT | |
| iPS:435353 | 21-225_148F8 | | SEQ ID NO:2148 | | SEQ ID NO:10160 | | SEQ ID NO:18172 | |
| | | NA | | AAGTCCAGCCAGAGTGCTTT ACACAGCTCCAACAATTACA ACTACTTAGCT | | TGGGCATCTACCCGGAA ATCC | | CAGCAATATTATAGTATTCC TCCGACG |
| | | | | SEQ ID NO:2149 | | SEQ ID NO:10161 | | SEQ ID NO:18173 |
| | | AA | KSSQSALHSSNNYNYLA | | WASTRKS | | QQYYSIPPT | |
| | | | SEQ ID NO:2150 | | SEQ ID NO:10162 | | SEQ ID NO:18174 | |

FIGURE 49
(Continued)

| | | | | | |
|---|---|---|---|---|---|
| iPS:435355 | 21-225_148H9 | NA | CGGGCAAGTCAGAGCATTAG TAACTATTTAAAT SEQ ID NO:2151 | ATTGCATCCAGTTTGCAA AGT SEQ ID NO:10163 | CAACAGAGTTACAGTACCCC CACT SEQ ID NO:18175 |
| | | AA | RASQSISNYLN SEQ ID NO:2152 | IASSLQS SEQ ID NO:10164 | QQSYSTPT SEQ ID NO:18176 |
| iPS:435357 | 21-225_148G10 | NA | AAGTCTAGTCAGAGCCTCCT GCATGGTGATGGAAAGACCT ATTTGTAT SEQ ID NO:2153 | GAAGTTTCCAACCGGTTC TCT SEQ ID NO:10165 | ATGCAAAGTATACAGCTTCC GTGGACG SEQ ID NO:18177 |
| | | AA | KSSQSLLHGDGKTYLY SEQ ID NO:2154 | EVSNRFS SEQ ID NO:10166 | MQSIQLPWT SEQ ID NO:18178 |
| iPS:435359 | 21-225_148H10 | NA | AAGTCTAGTCAGAGCCTCCT GCATAGTGAGGGAAAGACC TATTTGTAT SEQ ID NO:2155 | GAAGTTTCCTACCGGGTC TCT SEQ ID NO:10167 | ATGCAGAGTATACAGCTTCC GCTCACT SEQ ID NO:18179 |
| | | AA | KSSQSLLHSEGKTYLY SEQ ID NO:2156 | EVSYRVS SEQ ID NO:10168 | MQSIQLPLT SEQ ID NO:18180 |
| iPS:435361 | 21-225_148E11 | NA | CGGGCAAGTCAGGGCATTAG AAATGATTTAGGC SEQ ID NO:2157 | GCTGCATCCAGTTTGCAA AGT SEQ ID NO:10169 | CTACAGCATCGTAATTACCC GCTCACT SEQ ID NO:18181 |
| | | AA | RASQGIRNDLG SEQ ID NO:2158 | AASSLQS SEQ ID NO:10170 | LQHRNYPLT SEQ ID NO:18182 |
| iPS:435363 | 21-225_148F12 | NA | CGGGCAAGTCAGGGCATTAG AAATGCCTTAGGC SEQ ID NO:2159 | GCTGCATCCAGTTTGCAA AGT SEQ ID NO:10171 | CTACAGCATAATAGTTACCC TCTCATT SEQ ID NO:18183 |
| | | AA | RASQGIRNALG SEQ ID NO:2160 | AASSLQS SEQ ID NO:10172 | LQHNSYPLI SEQ ID NO:18184 |
| iPS:435365 | 21_225_149F1 | NA | AAGTCTAGTCAGAGCCTCCT GCATGGTGATGGAAAGACCT ATTTTTAT | GAAGTTTCCCACCGGTTC TCT | ATGCAAAGTATACAGATTCC GTGGACG |

FIGURE 49
(Continued)

| | | | | | |
|---|---|---|---|---|---|
| iPS:435367 | 21-225_149F1 | AA | SEQ ID NO:2161<br>KSSQSLLHGDGKTYFY | SEQ ID NO:10173<br>EVSHRFS | SEQ ID NO:18185<br>MQSIQIPWT |
| | | | SEQ ID NO:2162 | SEQ ID NO:10174 | SEQ ID NO:18186 |
| iPS:435369 | 21-225_149G1 | NA | CGGGCAAGTCAGGGCATTAG<br>AAATGATTTAGGC | GCTGCATCCAATTTGCAA<br>AGT | CTACAGCATAATAGTTACCC<br>GCTCACT |
| | | | SEQ ID NO:2163<br>RASQGIRNDLG | SEQ ID NO:10175<br>AASNLQS | SEQ ID NO:18187<br>LQHNSYPLT |
| | | AA | SEQ ID NO:2164 | SEQ ID NO:10176 | SEQ ID NO:18188 |
| iPS:435369 | 21-225_149A2 | NA | AAGTCCAGCCAGAGTGTTT<br>ATACAGTCCCAACAATAACA<br>ACTACTTAGCT | TGGGCATCTACCCGGGA<br>ATCC | CAGCAATATTATAGTACTCC<br>GTGCAGT |
| | | | SEQ ID NO:2165<br>KSSQSVLYSPNNNNYLA | SEQ ID NO:10177<br>WASTRES | SEQ ID NO:18189<br>QQYYSTPCS |
| | | AA | SEQ ID NO:2166 | SEQ ID NO:10178 | SEQ ID NO:18190 |
| iPS:435371 | 21-225_149A3 | NA | CGGGCAAGTCAGAGCATTAG<br>CAGTTATTTAAAT | ACTGCATCCAGTTTGCAA<br>AGT | CAACAGAGTTACACAGTATCCC<br>CACT |
| | | | SEQ ID NO:2167<br>RASQSISSYLN | SEQ ID NO:10179<br>TASSLQS | SEQ ID NO:18191<br>QQSYSIPT |
| | | AA | SEQ ID NO:2168 | SEQ ID NO:10180 | SEQ ID NO:18192 |
| iPS:435373 | 21-225_149E3 | NA | AAGTCCAGCCAGAGTGTTT<br>ACACAACTCCAATAATCACA<br>ATTACTTTGCT | TGGGCATCTACCCTGAG<br>ATCC | CAGCAATATTATAGTACTCC<br>TCCGACG |
| | | | SEQ ID NO:2169<br>KSSQTVLHNSNNHNYFA | SEQ ID NO:10181<br>WASTLRS | SEQ ID NO:18193<br>QQYYSTPPT |
| | | AA | SEQ ID NO:2170 | SEQ ID NO:10182 | SEQ ID NO:18194 |
| iPS:435375 | 21-225_149H4 | NA | AAGTCCAGCCAGAGTGTTTT<br>ATCCAGTCCAACGATAACA<br>ACTACTTAGCT | TGGTCATCTACCCGGGA<br>ATCC | CACCAATATTATAGTTATCC<br>TCCGACG |
| | | | SEQ ID NO:2171<br>KSSQSVLSSSNDNNYLA | SEQ ID NO:10183<br>WSSTRES | SEQ ID NO:18195<br>HQYYSYPPT |

FIGURE 49
(Continued)

| | | | | | | |
|---|---|---|---|---|---|---|
| iPS:435377 | 21-225_149G5 | NA | SEQ ID NO:2172 CGGGCAAGTCAGGGCATTAG AAATGCCTTAGGC | SEQ ID NO:10184 GCTGCATCCAGTTTGCAA AGT | SEQ ID NO:18196 CTACAGCATAATAGTTACCC TCTCACT |
| | | AA | SEQ ID NO:2173 RASQGIRNALG | SEQ ID NO:10185 AASSLQS | SEQ ID NO:18197 LQHNSYPLT |
| iPS:435379 | 21-225_149B6 | NA | SEQ ID NO:2174 CGGGCGAGTCAGGGTATTAT CAGTTGGTTAGCC | SEQ ID NO:10186 GCTGCATCCAGTTTGCAA AGT | SEQ ID NO:18198 CAACAGGGTAACAGTTTCCC ATTCACT |
| | | AA | SEQ ID NO:2175 RASQGIISWLA | SEQ ID NO:10187 AASSLQS | SEQ ID NO:18199 QQGNSFPFT |
| iPS:435381 | 21-225_149C6 | NA | SEQ ID NO:2176 CGGGCGAGTCAGGGTATTAG CAACTGGTTAGCC | SEQ ID NO:10188 GCTGCATCCAGTTTGCAA GGT | SEQ ID NO:18200 CAACAGACTGACAGTTTCCC ATTCACT |
| | | AA | SEQ ID NO:2177 RASQGISNWLA | SEQ ID NO:10189 AASSLQG | SEQ ID NO:18201 QQTDSFPFT |
| iPS:435383 | 21-225_149D7 | NA | SEQ ID NO:2178 AGGGCCAGTCAGAGTATTAT CAGCAACTACTTAGCC | SEQ ID NO:10190 GGTGTATCTAGTAGGGC CACT | SEQ ID NO:18202 CAACAATATGGTCGGTCACC ATTCAAT |
| | | AA | SEQ ID NO:2179 RASQSISNYLA | SEQ ID NO:10191 GVSSRAT | SEQ ID NO:18203 QQYGRSPFN |
| iPS:435391 | 21-225_149F8 | NA | SEQ ID NO:2180 CGGGCGAGTCAGGGTATTAG CAACTGGTTAGCC | SEQ ID NO:10192 GCTGCATCCAGTTTGCAA AGT | SEQ ID NO:18204 CAACAGACTGACAGTTTCCC ATTCACT |
| | | AA | SEQ ID NO:2181 RASQGISNWLA | SEQ ID NO:10193 AASSLQS | SEQ ID NO:18205 QQTDSFPFT |
| iPS:435393 | 21-225_149D10 | NA | SEQ ID NO:2182 CGGGCAAGTCGGGGCATTAG AAATGATTTAGGC | SEQ ID NO:10194 GCTGCATCCAGTTTGCAG AGT | SEQ ID NO:18206 CTACAGCATTATAGTTATCC TCGGACG |
| | | AA | SEQ ID NO:2183 RASRGIRNDLG | SEQ ID NO:10195 AASSLQS | SEQ ID NO:18207 LQHYSYPRT |

FIGURE 49
(Continued)

| | | | | | | |
|---|---|---|---|---|---|---|
| iPS:435395 | 21-225_149D11 | NA | SEQ ID NO:2184 CGGGCGAGTCAGAGAATATTAG CAACTGGTTAACC | SEQ ID NO:10196 GCTGCATCCAGTTTGCAA AGT | SEQ ID NO:18208 CAACAGACTGACAGTTTCCC ATTCACT |
| | | AA | SEQ ID NO:2185 RASQNISNWLT | SEQ ID NO:10197 AASSLQS | SEQ ID NO:18209 QQTDSFPFT |
| iPS:435397 | 21-225_149F12 | NA | SEQ ID NO:2186 CGGGCAAGTCAGGGCATTAG AAATGATTTAGGC | SEQ ID NO:10198 GCTGCATCCAATTTGCAA AGT | SEQ ID NO:18210 CTACAGCATAATAGTTACCC GCTCACT |
| | | AA | SEQ ID NO:2187 RASQGIRNDLG | SEQ ID NO:10199 AASNLQS | SEQ ID NO:18211 LQHNSYPLT |
| iPS:435399 | 21-225_150D2 | NA | SEQ ID NO:2188 AAGTCCAGCCAGAGAGTGTTT ATACAGATCCAACAGTAAGAA ATACTTAACT | SEQ ID NO:10200 TGGGCATCTACCCCGAA ATCC | SEQ ID NO:18212 CAGCAATATATTTAGTACTCC GTACAAT |
| | | AA | SEQ ID NO:2189 KSSQSVLYRSNSKKYLT | SEQ ID NO:10201 WASTRKS | SEQ ID NO:18213 QQYFSTPYN |
| iPS:435401 | 21-225_150E2 | NA | SEQ ID NO:2190 CGGGCAAGTCAGGGCATTGG AAATGATTTAGGC | SEQ ID NO:10202 GCTGCATCCAGTTTGCAA AGT | SEQ ID NO:18214 CTACAACATTATAGTTTCCC GTACAGT |
| | | AA | SEQ ID NO:2191 RASQGIGNDLG | SEQ ID NO:10203 AASSLQS | SEQ ID NO:18215 LQHYSFPYS |
| iPS:435403 | 21-225_150C5 | NA | SEQ ID NO:2192 CGGGCGAGTCAGGGTATTAA CAACTGGTTAGCC | SEQ ID NO:10204 GCTGCATCCAGTTTGCAA GGT | SEQ ID NO:18216 CAACAGACTGACAGTTTCCC ATTCACT |
| | | AA | SEQ ID NO:2193 RASQGINNWLA | SEQ ID NO:10205 AASSLQG | SEQ ID NO:18217 QQTDSFPFT |
| iPS:435405 | 21_225_150B7 | NA | SEQ ID NO:2194 AAGTCCAGCCAGAATGTTTT ATACAGCTCCCACAATAACA ACTACTTAGCT | SEQ ID NO:10206 TGGGCATCTACCCGGAA ATCC | SEQ ID NO:18218 CAGCAATATTATAGTACTCC ATTCACT |

FIGURE 49
(Continued)

| | | | | | | | |
|---|---|---|---|---|---|---|---|
| iPS:435407 | 21-225_150B7 | AA | SEQ ID NO:2195 KSSQNVLYSSHNNNYLA SEQ ID NO:2196 CGGGCAAGTCAGGGCATTAG AAATGATTTAGGC | SEQ ID NO:10207 WASTRKS SEQ ID NO:10208 GCTGCATCCAATTTGCAA AGT | SEQ ID NO:18219 QQYYSTPFT SEQ ID NO:18220 CTACAGCATAATAGTTACCC GCTCACT |
| iPS:435409 | 21-225_150E7 | NA | SEQ ID NO:2197 RASQGIRNDLG SEQ ID NO:2198 CGGGCGAGTCAGGGCATTAG CCATTATTTAGCC | SEQ ID NO:10209 AASNLQS SEQ ID NO:10210 GTTGCATCCAGTTTGCAA AAT | SEQ ID NO:18221 LQHNSYPLT SEQ ID NO:18222 CAACAGTATAATAATTACCC GCTCACT |
| | 21-225_150G8 | AA | SEQ ID NO:2199 RASQGISHYLA SEQ ID NO:2200 | SEQ ID NO:10211 VASSLQN SEQ ID NO:10212 | SEQ ID NO:18223 QQYNNYPLT SEQ ID NO:18224 |
| iPS:435413 | 21-225_150B11 | NA | AAGTCTAGTCAGAGCCTCGT GCATGGTGATGGAAAGACCT ATTTGTAT SEQ ID NO:2201 | GAAGTTTCCAACCGGTTC TCT SEQ ID NO:10213 | ATGCAAAGTATACAGCTTCC GTGGACG SEQ ID NO:18225 |
| | | | KSSQSLVHGDGKTYLY SEQ ID NO:2202 | EVSNRFS SEQ ID NO:10214 | MQSIQLPWT SEQ ID NO:18226 |
| iPS:435415 | 21-225_150C11 | NA | CGGGCAAGTCAGAGCATTAG CAGCTATTTAAAT SEQ ID NO:2203 | ACTGCATCCAGTTTGCAA AGT SEQ ID NO:10215 | CAACAGAGTTACAGTATTTA CACT SEQ ID NO:18227 |
| | | AA | RASQSISSYLN SEQ ID NO:2204 | TASSLQS SEQ ID NO:10216 | QQSYSIYT SEQ ID NO:18228 |
| iPS:435417 | 21-225_150D11 | NA | AAGTCTAGTCAGAGCCTCCT GCATAGTGAGGGAAAGACC TATTTGTAT SEQ ID NO:2205 | GAAGTTTCCTACCGGTTC TCT SEQ ID NO:10217 | ATGCAAGGTATACAGCTTCC GCTCACT SEQ ID NO:18229 |
| | | AA | KSSQSLLHSEGKTYLY SEQ ID NO:2206 | EVSYRFS SEQ ID NO:10218 | MQGIQLPLT SEQ ID NO:18230 |

FIGURE 49
(Continued)

| | | | | | |
|---|---|---|---|---|---|
| iPS:435419 | 21-225_150C12 | NA | CGGGCAAGTCAGAGCATTAGCGACTATTTAAAT<br>SEQ ID NO:2207 | ACTACATCCAGTTGCAA<br>AGT<br>SEQ ID NO:10219 | CAACAGAGTTTCAGTACCCC<br>CACT<br>SEQ ID NO:18231 |
| | | AA | RASQSISDYLN<br>SEQ ID NO:2208 | TTSSLQS<br>SEQ ID NO:10220 | QQSFSTPT<br>SEQ ID NO:18232 |
| iPS:435421 | 21-225_151F1 | NA | AGGGCCAGTCAGAGTATTAA<br>CATCAATATAGCC<br>SEQ ID NO:2209 | GGTGCATCCACCAGGGC<br>CACT<br>SEQ ID NO:10221 | CAGCAGTATAATGACTGGCC<br>TCCGTGGACG<br>SEQ ID NO:18233 |
| | | AA | RASQSININIA<br>SEQ ID NO:2210 | GASTRAT<br>SEQ ID NO:10222 | QQYNDWPPWT<br>SEQ ID NO:18234 |
| iPS:435423 | 21-225_151G5 | NA | AAGTCTAGTCAGGCGCCTCCT<br>GCATGGTGATGGAAAGACCT<br>ATTTGTAT<br>SEQ ID NO:2211 | GAAGTTCCAACCGGTTC<br>TCT<br>SEQ ID NO:10223 | ATGCAAAGTATACAGGTTCC<br>GTGGACG<br>SEQ ID NO:18235 |
| | | AA | KSSQRLLHGDGKTYLY<br>SEQ ID NO:2212 | EVSNRFS<br>SEQ ID NO:10224 | MQSIQVPWT<br>SEQ ID NO:18236 |
| iPS:435425 | 21-225_151B12 | NA | CGGGCAAGTCAGAGCATTAG<br>CAACTTTTAAAT<br>SEQ ID NO:2213 | ACTGCATCCAGTTGGA<br>AAGT<br>SEQ ID NO:10225 | CAACAGAGTTACAGTACCCC<br>CACT<br>SEQ ID NO:18237 |
| | | AA | RASQSISNFLN<br>SEQ ID NO:2214 | TASSLES<br>SEQ ID NO:10226 | QQSYSTPT<br>SEQ ID NO:18238 |
| iPS:435427 | 21-225_151C9 | NA | CGGGCGAGTCAGGGCATTAG<br>CAAGTATTTAGCC<br>SEQ ID NO:2215 | GATGCATCCAGGTTGCA<br>AAGT<br>SEQ ID NO:10227 | CATCAGTATAAACATTACCC<br>GATCACC<br>SEQ ID NO:18239 |
| | | AA | RASQGISKYLA<br>SEQ ID NO:2216 | DASRLQS<br>SEQ ID NO:10228 | HQYKHYPIT<br>SEQ ID NO:18240 |
| iPS:435429 | 21-225_151A10 | NA | AAGTCTAGTCAGAGCCTCCT<br>GCATGGTGATGGAAAGACCT<br>ATTTGTAT<br>SEQ ID NO:2217 | GAAGTTCCACCGGTTC<br>TCT<br>SEQ ID NO:10229 | ATGCAAAGTATACAGATTCC<br>GTGGACG<br>SEQ ID NO:18241 |

FIGURE 49
(Continued)

| | | AA | KSSQSLLHGDGKTYLY | EVSHRFS | MQSIQPWT |
|---|---|---|---|---|---|
| | | | SEQ ID NO:2218 | SEQ ID NO:10230 | SEQ ID NO:18242 |
| iPS:435431 | 21-225_152D2 | NA | CGGGCAAGTCAGAGCATTAGACTACATCCAGTTTGCAACAACAGAGTTACAGTACCCCCGACTATTTAAAT | AGT | CACT |
| | | | SEQ ID NO:2219 | SEQ ID NO:10231 | SEQ ID NO:18243 |
| | | AA | RASQSISDYLN | TTSSLQS | QQSYSTPT |
| | | | SEQ ID NO:2220 | SEQ ID NO:10232 | SEQ ID NO:18244 |
| iPS:435433 | 21-225_152E3 | NA | AAGTCCAGCCAGAGTGTTTTACACAGCTCCAACAATTACAACTACTTAGTT | TGGGCATCTACCCGGGAATCC | CAGCAATATTACAGTACTCCATTCACT |
| | | | SEQ ID NO:2221 | SEQ ID NO:10233 | SEQ ID NO:18245 |
| | | AA | KSSQSVLHSSNNYNYLV | WASTRES | QQYYSTPFT |
| | | | SEQ ID NO:2222 | SEQ ID NO:10234 | SEQ ID NO:18246 |
| iPS:435435 | 21-225_152H3 | NA | AAGTCCAGCCAGAGTGTTTTGCACAGCTCCAACAATTACAACTACTTAACT | TGGGCATCTACCCCGGAATCC | CAGCAATATTATAGTACTCCGTGCAGT |
| | | | SEQ ID NO:2223 | SEQ ID NO:10235 | SEQ ID NO:18247 |
| | | AA | KSSQSVLHSSNNYNYLT | WASTRKS | QQYYSTPCS |
| | | | SEQ ID NO:2224 | SEQ ID NO:10236 | SEQ ID NO:18248 |
| iPS:435437 | 21-225_152F4 | NA | AAGTCCAGCCAGAGTGTTTTATACAGCTCCAACAATTACAACTACTTAGCT | TGGGCATCTACCCCGGAATCC | CAGCAATATTTTAATACTCCTCCCACT |
| | | | SEQ ID NO:2225 | SEQ ID NO:10237 | SEQ ID NO:18249 |
| | | AA | KSSQSVLYSSNNYNYLA | WASTRKS | QQYFNTPPT |
| | | | SEQ ID NO:2226 | SEQ ID NO:10238 | SEQ ID NO:18250 |
| iPS:435439 | 21-225_152G4 | NA | CGGGCAAGTCAGAGCATTAGACTACATCCAGTTTGCAACAACAGAGTTACAGTACCCCCGACTATTTAAAT | AGT | CACT |
| | | | SEQ ID NO:2227 | SEQ ID NO:10239 | SEQ ID NO:18251 |
| | | AA | RASQSISDYLN | TTSSLQS | QQSYSTPT |
| | | | SEQ ID NO:2228 | SEQ ID NO:10240 | SEQ ID NO:18252 |

FIGURE 49
(Continued)

| | | | | | |
|---|---|---|---|---|---|
| iPS:435441 | 21-225_152F6 | NA | AAGTCTAGTCAGAGCCTCCGGCATGGTGATGGAAAGACCTATTTGACT | GAAATTTCCAAGCGGTCACT | ATGCAAAGTATACAGGTTCCGTGGACG |
| | | | SEQ ID NO:2229 | SEQ ID NO:10241 | SEQ ID NO:18253 |
| | | AA | KSSQSLRHGDGKTYLT | EISKRFT | MQSIQVPWT |
| | | | SEQ ID NO:2230 | SEQ ID NO:10242 | SEQ ID NO:18254 |
| iPS:435443 | 21-225_152E7 | NA | AGGGCCAGTCAGAGTGTTATCAGCAGCTACTTAGCC | GGTGTATCTAGTAGGGCCACT | CAACAATATGGTAGGTCACCATTCAAT |
| | | | SEQ ID NO:2231 | SEQ ID NO:10243 | SEQ ID NO:18255 |
| | | AA | RASQSVISSYLA | GVSSRAT | QQYGRSPFN |
| | | | SEQ ID NO:2232 | SEQ ID NO:10244 | SEQ ID NO:18256 |
| iPS:435445 | 21-225_152F7 | NA | CGGGCAAGTCAGGGCATTAGAAATGATTTAGGC | GCTACATCCAGTTTGCAAAGT | CTACAGCATTATAATTTCCCGTACAGT |
| | | | SEQ ID NO:2233 | SEQ ID NO:10245 | SEQ ID NO:18257 |
| | | AA | RASQGIRNDLG | ATSSLQS | LQHYNFPYS |
| | | | SEQ ID NO:2234 | SEQ ID NO:10246 | SEQ ID NO:18258 |
| iPS:435447 | 21-225_152H7 | NA | CGGGCGAGTCAGGATATTAGCAACTGGTTAGCC | GCTGCATCCAGTTTGCAAGGT | CAACAGACTGACAGTTTCCCATTCACT |
| | | | SEQ ID NO:2235 | SEQ ID NO:10247 | SEQ ID NO:18259 |
| | | AA | RASQDISNWLA | AASSLQG | QQTDSFPFT |
| | | | SEQ ID NO:2236 | SEQ ID NO:10248 | SEQ ID NO:18260 |
| iPS:435449 | 21-225_152H9 | NA | CGGGCAAGTCAGGGCATTAGAAATGATTTAGGC | GCTGCATCCAGTTTGCAAAGT | CTACAGCATAGTAATTACCCGCTCACT |
| | | | SEQ ID NO:2237 | SEQ ID NO:10249 | SEQ ID NO:18261 |
| | | AA | RASQGIRNDLG | AASSLQS | LQHSNYPLT |
| | | | SEQ ID NO:2238 | SEQ ID NO:10250 | SEQ ID NO:18262 |
| iPS:435451 | 21-225_152D10 | NA | AAGTCCAGCCAGAGTGTTTTATACAGCTCCAACAATAAGAACTACTTAGCT | TGGGCATCTACCCGGAATCC | CAGCAATATTATCGTAGTCCTAGT |
| | | | SEQ ID NO:2239 | SEQ ID NO:10251 | SEQ ID NO:18263 |

FIGURE 49
(Continued)

| | | | | | |
|---|---|---|---|---|---|
| iPS:435453 | | AA | KSSQSVLYSSNNKNYLA SEQ ID NO:2240 | WASTRES SEQ ID NO:10252 | QQYYRSPS SEQ ID NO:18264 |
| | 21-225_152G10 | NA | CGGGCGAGTCAGGGTATTAG CAACTGGTTAGCC SEQ ID NO:2241 | GCTGCATCCAGTTTGCAA AGT SEQ ID NO:10253 | CAACAGACTGACAGTTTCCC ATTCACT SEQ ID NO:18265 |
| iPS:435455 | | AA | RASQGISNWLA SEQ ID NO:2242 | AASSLQS SEQ ID NO:10254 | QQTDSFPFT SEQ ID NO:18266 |
| | 21-225_152B11 | NA | CGGGCAAGTCAGAGAGCATTAG CGACTATTTAAAT SEQ ID NO:2243 | ACTACATCCAGTTTGCAA AGT SEQ ID NO:10255 | CAACAGAGTTACAGTACCCC CACT SEQ ID NO:18267 |
| iPS:435457 | | AA | RASQSISDYLN SEQ ID NO:2244 | TTSSLQS SEQ ID NO:10256 | QQSYSTPT SEQ ID NO:18268 |
| | 21-225_152C11 | NA | AAGTCTAGTCAGAGCCTCCT GCATGGTGATGGAAAGACCT ATTTATAT SEQ ID NO:2245 | GAAGTTTCCAACCGGTTC TCT SEQ ID NO:10257 | ATGCAAAGTATACAGATTCC GTGGACG SEQ ID NO:18269 |
| iPS:435459 | | AA | KSSQSLLHGDGKTYLY SEQ ID NO:2246 | EVSNRFS SEQ ID NO:10258 | MQSIQIPWT SEQ ID NO:18270 |
| | 21-225_152E12 | NA | ACGTCCAGCCAGCAGAGTATTT ACACAGCTCCAATAATTACA ACTACTTAGCT SEQ ID NO:2247 | TGGGCATCTACCCGGGA ATCC SEQ ID NO:10259 | CAACAATATTATAGTGGTCC GTGCAGT SEQ ID NO:18271 |
| iPS:435461 | | AA | TSSQSILHSSNNYNYLA SEQ ID NO:2248 | WASTRES SEQ ID NO:10260 | QQYYSGPCS SEQ ID NO:18272 |
| | 21-225_153A1 | NA | CGGGCGAGTCAGGGTCATTAG CAATTATTTAGCC SEQ ID NO:2249 | GCTGCATCCAGTTTGCGA AGT SEQ ID NO:10261 | CAACAGTATCATAGTTACC ATTCACT SEQ ID NO:18273 |
| | | AA | RASQVISNYLA SEQ ID NO:2250 | AASSLRS SEQ ID NO:10262 | QQYHSYPFT SEQ ID NO:18274 |

FIGURE 49
(Continued)

| | | | | |
|---|---|---|---|---|
| iPS:435463 | 21-225_153D2 | NA | AAGTCTAGTCAGAGCCTCCGGCATGGTGATGGAAAGACCTATTTGACT SEQ ID NO:2251 | GAAGTTCCAAGCGGTTCACT SEQ ID NO:10263 | ATGCAAAGTATACAGGTTCCGTGGACG SEQ ID NO:18275 |
| | | AA | KSSQSLRHGDGKTYLT SEQ ID NO:2252 | EVSKRFT SEQ ID NO:10264 | MQSIQVPWT SEQ ID NO:18276 |
| iPS:435465 | 21-225_153A6 | NA | AGGGCCAGTCAGAGTGTTATCAGCAGCTACTTAGCC SEQ ID NO:2253 | GGTGTATCTAGTAGGGCCACT SEQ ID NO:10265 | CAACAATATGGTAGGTCACCATTCAAT SEQ ID NO:18277 |
| | | AA | RASQSVISSYLA SEQ ID NO:2254 | GVSSRAT SEQ ID NO:10266 | QQYGRSPFN SEQ ID NO:18278 |
| iPS:435467 | 21-225_153B9 | NA | AAGTCCAGCCAGAGTGTTTATACAGCTCCAACAATAAGAACTACTTAGCT SEQ ID NO:2255 | TGGGCATCTACCCGGAATTT SEQ ID NO:10267 | CAGCAATATAATGTAGTCTTAGT SEQ ID NO:18279 |
| | | AA | KSSQSVLYSSNNKNYLA SEQ ID NO:2256 | WASTREF SEQ ID NO:10268 | QQYNRSLS SEQ ID NO:18280 |
| iPS:435469 | 21-225_153G9 | NA | AAGTCTAGTCAGAGCCTCCTGCATAGTGATGGAAAGACCTATTTGTAT SEQ ID NO:2257 | GAAGTTCCAACCGGTTCTCT SEQ ID NO:10269 | ATGCAAAATATAAAGTATCCGCTCACT SEQ ID NO:18281 |
| | | AA | KSSQSLLHSDGKTYLY SEQ ID NO:2258 | EVSNRFS SEQ ID NO:10270 | MQNIKYPLT SEQ ID NO:18282 |
| iPS:435471 | 21-225_153F11 | NA | AAGTCCAGCCAGAGTGTTTATACAGCTCCAACAATTACAAGTACTTAGCT SEQ ID NO:2259 | TGGGCATCTACCCGAAATCC SEQ ID NO:10271 | CAGCAATATTATAGTACTCCGTGCAGT SEQ ID NO:18283 |
| | | AA | KSSQSVLYSSNNYKYLA SEQ ID NO:2260 | WASTRKS SEQ ID NO:10272 | QQYYSTPCS SEQ ID NO:18284 |

FIGURE 49
(Continued)

| | | | | | |
|---|---|---|---|---|---|
| iPS:435475 | 21-225_154H6 | NA | AAGTCCAGCCAGAGTGTTT ACACAGTTCCAACAATTACA ACTATTTAGCT | TGGACATCTACCCGAA ATCC | CAGCATTATTATAGTACTCC GTGCAGT |
| | | | SEQ ID NO:2261 | SEQ ID NO:10273 | SEQ ID NO:18285 |
| | | AA | KSSQSVLHSSNNYNYLA ACTATTLAGCT | WTSTRKS | QHYYSTPCS |
| | | | SEQ ID NO:2262 | SEQ ID NO:10274 | SEQ ID NO:18286 |
| iPS:435479 | 21-225_154E9 | NA | CGGGCGAGTCAGGATATTAG CAACTGGTTAGCC | GCTGCATCCAGTTTGCAA AGT | CAACAGGGTAACAGTTTCCC GCTCACT |
| | | | SEQ ID NO:2263 | SEQ ID NO:10275 | SEQ ID NO:18287 |
| | | AA | RASQDISNWLA | AASSLQS | QQGNSFPLT |
| | | | SEQ ID NO:2264 | SEQ ID NO:10276 | SEQ ID NO:18288 |
| iPS:435481 | 21-225_154A11 | NA | AGGTCAAGCCAGAGTGTTT ACACAGCTCCAACAATTATA ACTACTTAGCT | TGGGCATCTAAACGGGA TTCC | CAGCAATATTTTAGTTCTCCT CGGACG |
| | | | SEQ ID NO:2265 | SEQ ID NO:10277 | SEQ ID NO:18289 |
| | | AA | RSSQSVLHSSNNYNYLA | WASKRDS | QQYFSSPRT |
| | | | SEQ ID NO:2266 | SEQ ID NO:10278 | SEQ ID NO:18290 |
| iPS:435483 | 21-225_155A4 | NA | CGGGCGAGTCAGGGTATTAG CAACTGGTTAGCC | GCTGCATCCAGTTTGCAA GGT | CACCAGACTGACAGTTTCCC ATTCACT |
| | | | SEQ ID NO:2267 | SEQ ID NO:10279 | SEQ ID NO:18291 |
| | | AA | RASQGISNWLA | AASSLQG | HQTDSFPFT |
| | | | SEQ ID NO:2268 | SEQ ID NO:10280 | SEQ ID NO:18292 |
| iPS:435485 | 21-225_155B4 | NA | CGGGCGAGTCAGGATATTAG CAACTGGTTAGCC | GCTGCATCCAGTTTGCAA GGT | CACCAGACTGACAGTTTCCC ATTCACT |
| | | | SEQ ID NO:2269 | SEQ ID NO:10281 | SEQ ID NO:18293 |
| | | AA | RASQDISNWLA | AASSLQG | HQTDSFPFT |
| | | | SEQ ID NO:2270 | SEQ ID NO:10282 | SEQ ID NO:18294 |
| iPS:435487 | 21-225_155C4 | NA | CGGGCAAGTCAGAGCATTAG CAGCTATTTAAAT | ACTGCATCCAGTTTGCAA AGT | CAACAGAGTTACAGTACCCC CACT |
| | | | SEQ ID NO:2271 | SEQ ID NO:10283 | SEQ ID NO:18295 |

FIGURE 49
(Continued)

| | | | | | | | |
|---|---|---|---|---|---|---|---|
| iPS:435489 | 21-225_155A5 | AA | RASQSISSYLN<br>SEQ ID NO:2272 | AAGTCTAGTCAGAGCCTCTCT<br>GCATGGTCAGTGATGAAAGACCTT<br>ATTTGTAT<br>SEQ ID NO:2273 | TASSLQS<br>SEQ ID NO:10284<br>GAAGTTTCCAATCGGTTC<br>TCT<br>SEQ ID NO:10285 | QQSYSTPT<br>SEQ ID NO:18296<br>ATGCAAAGTATACAGGTTCC<br>GTGGACG<br>SEQ ID NO:18297 |
| iPS:435491 | 21-225_155E5 | NA | KSSQSLLHGDGKTYLY<br>SEQ ID NO:2274 | AAGTCCAGCCAGAGTGTTTT<br>ATCCAGCTCCAACAATAATA<br>ATTATTTAGCT<br>SEQ ID NO:2275 | EVSNRFS<br>SEQ ID NO:10286<br>TGGCATCTACCCGGAA<br>ATCC<br>SEQ ID NO:10287 | MQSIQVPWT<br>SEQ ID NO:18298<br>CAGCAATATTATAGTACTCC<br>GTGCAGT<br>SEQ ID NO:18299 |
| iPS:435495 | 21-225_155B6 | AA | KSSQSVLSSSNNNNYLA<br>SEQ ID NO:2276 | AAGTCCAGCCAGAGTGTTTT<br>ACACAGCTCCAATAATTACA<br>ACTACTTAGCT<br>SEQ ID NO:2277 | WASTRKS<br>SEQ ID NO:10288<br>TGGACATCTACCCGGGA<br>ATCC<br>SEQ ID NO:10289 | QQYYSTPCS<br>SEQ ID NO:18300<br>CAACAATATTATAGTACTCC<br>GTGCAGT<br>SEQ ID NO:18301 |
| iPS:435497 | 21-225_155H9 | NA | KSSQSVLHSSNNYNYLA<br>SEQ ID NO:2278 | AGGGCCAGTCAGAGTGTTAG<br>TAGTAACTTAGCC<br>SEQ ID NO:2279 | WTSTRES<br>SEQ ID NO:10290<br>GGTGCATCCACCAGGGC<br>CACT<br>SEQ ID NO:10291 | QQYYSTPCS<br>SEQ ID NO:18302<br>CAGCAGTATGATGACTGGCC<br>TCCGTGGACG<br>SEQ ID NO:18303 |
| iPS:435499 | 21-225_156G1 | AA | RASQSVSSNLA<br>SEQ ID NO:2280 | CGGGCAAGTCAGGGCATTAG<br>AAATGATTTAGGC<br>SEQ ID NO:2281 | GASTRAT<br>SEQ ID NO:10292<br>GCTGCATCCAGTTTGCAA<br>AGT<br>SEQ ID NO:10293 | QQYDDWPPWT<br>SEQ ID NO:18304<br>CTACAGCATAGTAATTACCC<br>GCTCACT<br>SEQ ID NO:18305 |
| | | | RASQGIRNDLG<br>SEQ ID NO:2282 | | AASSLQS<br>SEQ ID NO:10294 | LQHSNYPLT<br>SEQ ID NO:18306 |

FIGURE 49
(Continued)

| | | | | | |
|---|---|---|---|---|---|
| iPS:435501 | 21-225_156H1 | NA | AAGTCCAGCAGAGTGTTTT ATACAGCTCCAACAATAACA ACTACTTAGCT | TGGGCATCTACCCGGGA ATCC | CACCAATATTATAGTACTCC GTGCAGT |
| | | | SEQ ID NO:2283 | SEQ ID NO:10295 | SEQ ID NO:18307 |
| | | AA | KSSQSVLYSSNNNNYLA | WASTRES | HQYYSTPCS |
| | | | SEQ ID NO:2284 | SEQ ID NO:10296 | SEQ ID NO:18308 |
| iPS:435503 | 21-225_156E4 | NA | CGGGCAAGTCAGAGCATTAG CAGCTATTTAAAT | ACTGCATCCAGTTTGCAA AGT | CAACAGAGTTACAGTGCCCC CACT |
| | | | SEQ ID NO:2285 | SEQ ID NO:10297 | SEQ ID NO:18309 |
| | | AA | RASQSISSYLN | TASSLQS | QQSYSAPT |
| | | | SEQ ID NO:2286 | SEQ ID NO:10298 | SEQ ID NO:18310 |
| iPS:435505 | 21-225_157C1 | NA | CGGGCGAGTCAGGGCATTAG CAATTATTTAGCC | GCTGCATCCAGTTGCTA AGT | CAACAGTATAATAGTTTTCC ATTCACT |
| | | | SEQ ID NO:2287 | SEQ ID NO:10299 | SEQ ID NO:18311 |
| | | AA | RASQGISNYLA | AASSLLS | QQYNSFPFT |
| | | | SEQ ID NO:2288 | SEQ ID NO:10300 | SEQ ID NO:18312 |
| iPS:435509 | 21-225_157H1 | NA | CGGGCGAGTCAGGACATTAG CAATTATTTAGTC | GCTGCATCCAGTTTGCAA AGT | CAACAATATCATAGTTACCC ATTCACT |
| | | | SEQ ID NO:2289 | SEQ ID NO:10301 | SEQ ID NO:18313 |
| | | AA | RASQDISNYLV | AASSLQS | QQYHSYPFT |
| | | | SEQ ID NO:2290 | SEQ ID NO:10302 | SEQ ID NO:18314 |
| iPS:435511 | 21-225_157C3 | NA | CGGGCAAGTCAGGGCATTAG AAATGATTTAGGC | GCTGCATCCAGTTTGCAA AGT | CTACAGCATAATAGTTACCC ATTCACT |
| | | | SEQ ID NO:2291 | SEQ ID NO:10303 | SEQ ID NO:18315 |
| | | AA | RASQGIRNDLG | AASSLQS | LQHNSYPFT |
| | | | SEQ ID NO:2292 | SEQ ID NO:10304 | SEQ ID NO:18316 |
| iPS:435513 | 21-225_157F3 | NA | CGGGCAAGTCAGAACATTAG CAGTTATTTAAAT | ACTGCATCCAGTTTGCAA AGT | CAACAGAGTTACAATACCCC CACGTGGACG |
| | | | SEQ ID NO:2293 | SEQ ID NO:10305 | SEQ ID NO:18317 |
| | | AA | RASQNISSYLN | TASSLQS | QQSYNTPTWT |

FIGURE 49
(Continued)

| | | | SEQ ID NO:2294 | SEQ ID NO:10306 | SEQ ID NO:18318 |
|---|---|---|---|---|---|
| iPS:435515 | 21-225_157E4 | NA | CGGGCGAGTCAGGGCATTAG CAATTATTTAGCC | GCTGCATCCAGTTTGCGA AGT | CAACAGTATCATAGTTATCC ATTCACT |
| | | | SEQ ID NO:2295 | SEQ ID NO:10307 | SEQ ID NO:18319 |
| | | AA | RASQGISNYLA | AASSLRS | QQYHSYPFT |
| iPS:435521 | 21-225_157H4 | NA | SEQ ID NO:2296 | SEQ ID NO:10308 | SEQ ID NO:18320 |
| | | | CGGGCAAGTCAGGGCATTAG AAATGATTTAGGC | CCTGCATCCAGTTTACAA ACT | CTACAGGATAATAGTTACCC ATTCACT |
| | | | SEQ ID NO:2297 | SEQ ID NO:10309 | SEQ ID NO:18321 |
| | | AA | RASQGIRNDLG | PASSLQT | LQDNSYPFT |
| iPS:435523 | 21-225_157G5 | NA | SEQ ID NO:2298 | SEQ ID NO:10310 | SEQ ID NO:18322 |
| | | | CGGGCGAGTCAGGGCATTAA CAATTATTTAGCC | GCTGCATCCAGTTTACAA AGT | CAACAGTATAATAGTTATCC ATTCACT |
| | | | SEQ ID NO:2299 | SEQ ID NO:10311 | SEQ ID NO:18323 |
| | | AA | RASQGINNYLA | AASSLQS | QQYNSYPFT |
| iPS:435525 | 21-225_157E7 | NA | SEQ ID NO:2300 | SEQ ID NO:10312 | SEQ ID NO:18324 |
| | | | CGGGCAAGTCAGAGCTTTAG CAGCTATTTAAAT | GCTGCATCCAGTTTGCAA AGT | CAAGAGAGTTATAGTATCCG CTTCGCC |
| | | | SEQ ID NO:2301 | SEQ ID NO:10313 | SEQ ID NO:18325 |
| | | AA | RASQSFSSYLN | AASSLQS | QESYSIRFA |
| iPS:435527 | 21-225_157G7 | NA | SEQ ID NO:2302 | SEQ ID NO:10314 | SEQ ID NO:18326 |
| | | | CGGGCAAGTCAGGGCATTAG AAATGATTTAGGC | GTTGCATCCAGTTTGCAA AGT | ATACAGGATAATAGTCACCC ATTCACT |
| | | | SEQ ID NO:2303 | SEQ ID NO:10315 | SEQ ID NO:18327 |
| | | AA | RASQGIRNDLG | VASSLQS | IQDNSHPFT |
| iPS:435529 | 21-225_157H7 | NA | SEQ ID NO:2304 | SEQ ID NO:10316 | SEQ ID NO:18328 |
| | | | CGGGCGAGTCAGGACATTAG CAATTTTTAGCC | ACTGCATCCAGTTTGCAA AGT | CAACAGTATCATAGTTACCC GATCACC |
| | | | SEQ ID NO:2305 | SEQ ID NO:10317 | SEQ ID NO:18329 |
| | | AA | RASQDISNFLA | TASSLQS | QQYHSYPIT |

FIGURE 49
(Continued)

| | | | | | | |
|---|---|---|---|---|---|---|
| iPS:435531 | 21-225_157G8 | NA | SEQ ID NO:2306 AAGTCTAGTCAGAGCCTCCTGCATGGTGATGGAAAGACCTATTTATAT | SEQ ID NO:10318 GAAATTTCCAAGCGGTTCTCT | SEQ ID NO:18330 ATGCAAAGTATACAGGTTCCGTGGACG |
| | | AA | SEQ ID NO:2307 KSSQSLLHGDGKTYLY | SEQ ID NO:10319 EISKRFS | SEQ ID NO:18331 MQSIQVPWT |
| iPS:435533 | 21-225_157H8 | NA | SEQ ID NO:2308 CGGGCAAGTCAGGGCATTAGAAATGATTTAGGC | SEQ ID NO:10320 GCTGCATCCAGTTGCAAAGT | SEQ ID NO:18332 CTACAGCATAATAGTTACCCATTCACT |
| | | AA | SEQ ID NO:2309 RASQGIRNDLG | SEQ ID NO:10321 AASSLQS | SEQ ID NO:18333 LQHNSYPFT |
| iPS:435535 | 21-225_157H10 | NA | SEQ ID NO:2310 CGGGCGAGTCAGGGCATTACCAATTATTTAGCC | SEQ ID NO:10322 ACTGCATCCAATTGCAAAGT | SEQ ID NO:18334 CAACAGTATCATAGTTACCCATTCACT |
| | | AA | SEQ ID NO:2311 RASQGITNYLA | SEQ ID NO:10323 TASNLQS | SEQ ID NO:18335 QQYHSYPFT |
| iPS:435537 | 21-225_157H12 | NA | SEQ ID NO:2312 CGGGCAAGTCAGGGCATTAGAAATGATTTTGGC | SEQ ID NO:10324 GCTGCATCCAGTTTACAGAGT | SEQ ID NO:18336 CTACAGCATTATAGTTACCCATTCACT |
| | | AA | SEQ ID NO:2313 RASQGIRNDFG | SEQ ID NO:10325 AASSLQS | SEQ ID NO:18337 LQHYSYPFT |
| iPS:435539 | 21-225_158G1 | NA | SEQ ID NO:2314 CGGGCAAGTCAGGACATTAGAAATGATTTAGGC | SEQ ID NO:10326 ACTGCATCCAATTGCAAAGT | SEQ ID NO:18338 CTACAGCATAATAGTTACCCGTGGACG |
| | | AA | SEQ ID NO:2315 RASQGIRNDLG | SEQ ID NO:10327 TASNLQS | SEQ ID NO:18339 LQHNSYPWT |
| iPS:435543 | 21-225_158D4 | NA | SEQ ID NO:2316 CGGGCAAGTCAGGGCATTAGAAAGGATTTAGGC | SEQ ID NO:10328 GCTGCATCCAGTTGCAAAGT | SEQ ID NO:18340 CTACAGCATTATAGTTACCCTCGGACG |
| | | | SEQ ID NO:2317 | SEQ ID NO:10329 | SEQ ID NO:18341 |

FIGURE 49
(Continued)

| | | | | | | | |
|---|---|---|---|---|---|---|---|
| iPS:435545 | 21-225_158F4 | AA | RASQDIRKDLG<br>SEQ ID NO:2318 | | AASSLQS<br>SEQ ID NO:10330 | | LQHYSYPRT<br>SEQ ID NO:18342 |
| | | NA | CGGGCAAGTCAGGAGAACATTAG<br>AAAGTATTTACAT<br>SEQ ID NO:2319 | | ACTGCATCCACTTTACAA<br>AGT<br>SEQ ID NO:10331 | | CAACAGAGTTACAATATTTC<br>ATTCACT<br>SEQ ID NO:18343 |
| iPS:435547 | 21-225_158F5 | AA | RASQNIRKYLH<br>SEQ ID NO:2320 | | TASTLQS<br>SEQ ID NO:10332 | | QQSYNISFT<br>SEQ ID NO:18344 |
| | | NA | CGGGCAAGTCAGGGCATTAG<br>AAATGATTTAGGC<br>SEQ ID NO:2321 | | GCTGCATCCAGTTTGCAA<br>AGT<br>SEQ ID NO:10333 | | CTACAGGATAATAGTTCACCC<br>ATTCACT<br>SEQ ID NO:18345 |
| iPS:435549 | 21-225_158H5 | AA | RASQGIRNDLG<br>SEQ ID NO:2322 | | AASSLQS<br>SEQ ID NO:10334 | | LQDNSHPFT<br>SEQ ID NO:18346 |
| | | NA | CGGGCAAGTCAGGGCATGA<br>GAATTGATTTAGGG<br>SEQ ID NO:2323 | | CGTGCATCCAGTTTGCAA<br>AGT<br>SEQ ID NO:10335 | | GTACAGCATAATAGTTACCC<br>TCTCACT<br>SEQ ID NO:18347 |
| iPS:435551 | 21-225_158H6 | AA | RASQGMRIDLG<br>SEQ ID NO:2324 | | RASSLQS<br>SEQ ID NO:10336 | | VQHNSYPLT<br>SEQ ID NO:18348 |
| | | NA | CGGGCAAGTCAGGGCATTAG<br>AAGTGATTTAGGC<br>SEQ ID NO:2325 | | ACTGCATCCAGTTTGCAA<br>AGT<br>SEQ ID NO:10337 | | CTACAGCATAATAGTTACCC<br>ATTCACT<br>SEQ ID NO:18349 |
| iPS:435553 | 21-225_158G8 | AA | RASQGIRSDLG<br>SEQ ID NO:2326 | | TASSLQS<br>SEQ ID NO:10338 | | LQHNSYPFT<br>SEQ ID NO:18350 |
| | | NA | CGGGCAAGTCAGGACATTAG<br>AAATGATTTAGGG<br>SEQ ID NO:2327 | | ACTGCATCCAGTTTGCAA<br>AGT<br>SEQ ID NO:10339 | | CTACAGCATAATAGTTACCC<br>ATTCACT<br>SEQ ID NO:18351 |
| iPS:435557 | 21_225_158B12 | AA | RASQDIRNDLG<br>SEQ ID NO:2328 | | TASSLQS<br>SEQ ID NO:10340 | | LQHNSYPFT<br>SEQ ID NO:18352 |
| | | NA | AAGTCCAGCCAGAATGTTTT<br>ACACAGCTCCAACAATAACA<br>ACTACTTAACT | | TGGGCATCTACCCGGGA<br>ATCC | | CAGCAATATTATAGTACTCC<br>TCCGACG |

FIGURE 49
(Continued)

| | | | | | |
|---|---|---|---|---|---|
| iPS:435559 | 21-225_158B12 | AA | SEQ ID NO:2329<br>KSSQNVLHSSNNNNYLT | SEQ ID NO:10341<br>WASTRES | SEQ ID NO:18353<br>QQYYSTPPT |
| iPS:435561 | 21-225_158H12 | NA | SEQ ID NO:2330<br>CGGGCGAGTCAGGGCATTAA<br>CAATTATTTAGCC | SEQ ID NO:10342<br>GCTGCATCCAGTTACAA<br>AGT | SEQ ID NO:18354<br>CAACAGTATCATAGTTACCC<br>ATTCACT |
| | | AA | SEQ ID NO:2331<br>RASQGINNYLA | SEQ ID NO:10343<br>AASSLQS | SEQ ID NO:18355<br>QQYHSYPFT |
| iPS:435563 | 21-225_159F1 | NA | SEQ ID NO:2332<br>CGGGCAAGTCAGGCGGTCAG<br>AAATGATTTAGGC | SEQ ID NO:10344<br>GATGCATCCAATTTGCA<br>AAGT | SEQ ID NO:18356<br>CTACAGCATCATAGTTTCCC<br>GATCACC |
| | | AA | SEQ ID NO:2333<br>RASQRVRNDLG | SEQ ID NO:10345<br>DASNLQS | SEQ ID NO:18357<br>LQHHSFPIT |
| iPS:435565 | 21-225_159H2 | NA | SEQ ID NO:2334<br>CGGGCAAGTCAGAGAGCATTAG<br>CAAATATTTAAAT | SEQ ID NO:10346<br>GCTACATCCAATTTGCAA<br>AGT | SEQ ID NO:18358<br>CAACAGAGTTACAGTCTCCC<br>GGTCACT |
| | | AA | SEQ ID NO:2335<br>RASQSISKYLN | SEQ ID NO:10347<br>ATSNLQS | SEQ ID NO:18359<br>QQSYSLPVT |
| iPS:435569 | 21-225_159C4 | NA | SEQ ID NO:2336<br>CAGGGCAAGTCAGGACATTAG<br>CGACTATTTAAAT | SEQ ID NO:10348<br>GATGCCTCCACTTTGGAA<br>ACA | SEQ ID NO:18360<br>CAACAATATGATAATCTCCC<br>GATCACC |
| | | AA | SEQ ID NO:2337<br>QASQDISDYLN | SEQ ID NO:10349<br>DASTLET | SEQ ID NO:18361<br>QQYDNLPIT |
| iPS:435569 | 21-225_159C5 | NA | SEQ ID NO:2338<br>CGGGACAAGTCAGGGCATTAG<br>AAATGATTTAGGC | SEQ ID NO:10350<br>GCTGCATCCAGTTTGCAA<br>AGT | SEQ ID NO:18362<br>CTACAGCATAATAGTTATCC<br>ATTCACT |
| | | AA | SEQ ID NO:2339<br>RTSQGIRNDLG | SEQ ID NO:10351<br>AASSLQS | SEQ ID NO:18363<br>LQHNSYPFT |
| iPS:435571 | | NA | SEQ ID NO:2340<br>CGGGCAAGTCAGGACATTAGG<br>AAAGGATTTAGGG | SEQ ID NO:10352<br>GCTGCATCCAGTTTGCAA<br>AGT | SEQ ID NO:18364<br>CTACAGCATCATAGTTATCC<br>TCGGACG |

FIGURE 49
(Continued)

| | | | | | | | |
|---|---|---|---|---|---|---|---|
| iPS:435573 | 21-225_159C8 | | SEQ ID NO:2341 | | SEQ ID NO:10353 | | SEQ ID NO:18365 |
| | | AA | RASQDIRKDLG | | AASSLQS | | LQHHSYPRT |
| | | | SEQ ID NO:2342 | | SEQ ID NO:10354 | | SEQ ID NO:18366 |
| iPS:435575 | 21-225_159D8 | NA | CGGGCAAGTCGGGACACATTGG AAATGATTTAGGC | GCTGCATCCAGTTGCAA AGT | CTACAGCAGCATTATAGTTACCC TCGGACG |
| | | | SEQ ID NO:2343 | | SEQ ID NO:10355 | | SEQ ID NO:18367 |
| | | AA | RASRDIGNDLG | | AASSLQS | | LQHYSYPRT |
| | | | SEQ ID NO:2344 | | SEQ ID NO:10356 | | SEQ ID NO:18368 |
| iPS:435577 | 21-225_159H11 | NA | CGGGCGAGTCAGGGCATTAG CAAATATTTAGTC | GCTGCATCCAGTCTGCA AAGT | CAACAGTATAATAGTTACCC ATTCACT |
| | | | SEQ ID NO:2345 | | SEQ ID NO:10357 | | SEQ ID NO:18369 |
| | | AA | RASQGISKYLV | | AASSLQS | | QQYNSYPFT |
| | | | SEQ ID NO:2346 | | SEQ ID NO:10358 | | SEQ ID NO:18370 |
| iPS:435577 | 21-225_160B1 | NA | AAGTCTAGTCAGAGCCTCCT GCATGGTGATGGGAAGACCT ATTTCTAT | GAAGTATCCAAGCGGTT CTCT | ATGCAAAGTATACAGATTCC GTGGACG |
| | | | SEQ ID NO:2347 | | SEQ ID NO:10359 | | SEQ ID NO:18371 |
| | | AA | KSSQSLLHGDGKTYFY | | EVSKRFS | | MQSIQIPWT |
| | | | SEQ ID NO:2348 | | SEQ ID NO:10360 | | SEQ ID NO:18372 |
| iPS:435579 | 21-225_160G1 | NA | CGGGCGAGTCAGGACACATTAA CAATTATTTAGCC | GCTTCATCCAGTTTGCAA AGT | CAACAATATCATAGTTACCC ATTCACT |
| | | | SEQ ID NO:2349 | | SEQ ID NO:10361 | | SEQ ID NO:18373 |
| | | AA | RASQDINNYLA | | ASSSLQS | | QQYHSYPFT |
| | | | SEQ ID NO:2350 | | SEQ ID NO:10362 | | SEQ ID NO:18374 |
| iPS:435581 | 21-225_160H1 | NA | CGGGCAAGTCAGGACATTAG AAATGATTTAGGC | GCTGCATCCAGTTGCAG AAT | CTACAGCAGCATAATAGTTTCCC GTGGACG |
| | | | SEQ ID NO:2351 | | SEQ ID NO:10363 | | SEQ ID NO:18375 |
| | | AA | RASQDIRNDLG | | AASSLQN | | LQHNSFPWT |
| | | | SEQ ID NO:2352 | | SEQ ID NO:10364 | | SEQ ID NO:18376 |

FIGURE 49
(Continued)

| | | | | | |
|---|---|---|---|---|---|
| iPS:435583 | 21-225_160F2 | NA | CGGGGCAAGTCAGGGCATTAGGC AAATGATTTAGGC<br>SEQ ID NO:2353 | ACTGCATCCAATTTGCAA AGT<br>SEQ ID NO:10365 | CTACAGCATAATAGTTACCC GTGGACG<br>SEQ ID NO:18377 |
| | | AA | RASQGIRNDLG<br>SEQ ID NO:2354 | TASNLQS<br>SEQ ID NO:10366 | LQHNSYPWT<br>SEQ ID NO:18378 |
| iPS:435585 | 21-225_160G3 | NA | CGGGCGAGTCAGGACATTAA CAATTATTTAGCC<br>SEQ ID NO:2355 | GCTTCATCCAGTTTGCAA AGT<br>SEQ ID NO:10367 | CAACAATATCATAGTTACCC ATTCACT<br>SEQ ID NO:18379 |
| | | AA | RASQDINNYLA<br>SEQ ID NO:2356 | ASSSLQS<br>SEQ ID NO:10368 | QQYHSYPFT<br>SEQ ID NO:18380 |
| iPS:435587 | 21-225_160H3 | NA | CGGGCAAGTCAGGGCATTAG AAATGATTTAGGC<br>SEQ ID NO:2357 | GCTGCATCCAGTTTGCAA AGT<br>SEQ ID NO:10369 | CTACAGCATAGTAATTACCC GCTCACT<br>SEQ ID NO:18381 |
| | | AA | RASQGIRNDLG<br>SEQ ID NO:2358 | AASSLQS<br>SEQ ID NO:10370 | LQHSNYPLT<br>SEQ ID NO:18382 |
| iPS:435589 | 21-225_160A4 | NA | AAGTCCAGCCAGAGTGTTTT ACACAGCTCCAACAATAATA ACTACTTAGCT<br>SEQ ID NO:2359 | TGGGCATCTACCCGGGA ATCC<br>SEQ ID NO:10371 | CAGCAATATTATAATAGTTCC GTGCAGT<br>SEQ ID NO:18383 |
| | | AA | KSSQSVLHSSNNNNYLA<br>SEQ ID NO:2360 | WASTRES<br>SEQ ID NO:10372 | QQYYNSPCS<br>SEQ ID NO:18384 |
| iPS:435591 | 21-225_160C4 | NA | CGGGCAAGTCAGGACATTAG AAAGGATTTAGGG<br>SEQ ID NO:2361 | GCTGCATCCAGTTTGCAA AGT<br>SEQ ID NO:10373 | CTACAGCATTATAGTTATCC TCGGACG<br>SEQ ID NO:18385 |
| | | AA | RASQDIRKDLG<br>SEQ ID NO:2362 | AASSLQS<br>SEQ ID NO:10374 | LQHYSYPRT<br>SEQ ID NO:18386 |
| iPS:435593 | 21-225_160F4 | NA | CGGGGCAAGTCAGGGCATTAG AAATGATTTAGGC<br>SEQ ID NO:2363 | GTTGCATCCAGTTTGCAA AGT<br>SEQ ID NO:10375 | ATACAGGATAATAGTCACCC ATTCACT<br>SEQ ID NO:18387 |
| | | AA | RASQGIRNDLG | VASSLQS | IQDNSHPFT |

FIGURE 49
(Continued)

| | | | | | |
|---|---|---|---|---|---|
| iPS:435595 | 21-225_160H4 | NA | SEQ ID NO:2364 CGGGCGAGTCAGGACATTAG TAATTATTTAGTC | SEQ ID NO:10376 GTTGCATCCAGTTTGCAA AGT | SEQ ID NO:18388 CAACAGTATAATAGTTACCC TCTCACT |
| | | AA | SEQ ID NO:2365 RASQDISNYLV | SEQ ID NO:10377 VASSLQS | SEQ ID NO:18389 QQYNSYPLT |
| iPS:435599 | 21-225_160B10 | NA | SEQ ID NO:2366 CGGGCAAGTCAGGGCATTAG AAATGATTTAGGC | SEQ ID NO:10378 GCTGCATCCAGTTTGCAA AGT | SEQ ID NO:18390 CTACAGCATAGTAGTTACCC GCTCACT |
| | | AA | SEQ ID NO:2367 RASQGIRNDLG | SEQ ID NO:10379 AASSLQS | SEQ ID NO:18391 LQHSSYPLT |
| iPS:435601 | 21-225_160G10 | NA | SEQ ID NO:2368 AAGTCTAGTCAGAGCCTCCT GCACGGTGATGGAAAGACCT ATTTGTAT | SEQ ID NO:10380 GAAGTTTCCAAACGGTT CTCT | SEQ ID NO:18392 ATGCAAAGTATACAGCTTCC GTGGACG |
| | | AA | SEQ ID NO:2369 KSSQSLLHGDGKTYLY | SEQ ID NO:10381 EVSKRFS | SEQ ID NO:18393 MQSIQLPWT |
| iPS:435605 | 21-225_161A4 | NA | SEQ ID NO:2370 AGGTCCAGTCAGAGTGTTAA CAGCAACTTAGCC | SEQ ID NO:10382 GGTGCATCCATCAGGGC CACT | SEQ ID NO:18394 CAGCAGTATAATAACTGGTG GACG |
| | | AA | SEQ ID NO:2371 RSSQSVNSNLA | SEQ ID NO:10383 GASIRAT | SEQ ID NO:18395 QQYNNWWT |
| iPS:435607 | 21-225_161G4 | NA | SEQ ID NO:2372 CAGGCGAGTCAGGGACATTTA CAATTATTTAAAT | SEQ ID NO:10384 GATGCATCCAATTTGGA AACA | SEQ ID NO:18396 CAACAGTATGATATTCCCC GATCACC |
| | | AA | SEQ ID NO:2373 QASQDIYNYLN | SEQ ID NO:10385 DASNLET | SEQ ID NO:18397 QQYDILPIT |
| iPS:435609 | 21-225_161F7 | NA | SEQ ID NO:2374 CGGGCAAGTCAGGGCATTAG AAATGATTTGGGC | SEQ ID NO:10386 GCTGCATCCACTTTGCAA AGT | SEQ ID NO:18398 CTACTATATATTCGTTACCCA TTCACT |
| | | | SEQ ID NO:2375 | SEQ ID NO:10387 | SEQ ID NO:18399 |

FIGURE 49
(Continued)

| | | | RASQGIRNDLG<br>SEQ ID NO:2376 | AASTLQS<br>SEQ ID NO:10388 | LLYIRYPFT<br>SEQ ID NO:18400 |
|---|---|---|---|---|---|
| iPS:435611 | 21-225_161F10 | NA | CAGGCGAGTCAGGGACATTTA<br>CAACCATTTAAGT<br>SEQ ID NO:2377 | GATGCATCCAATTGGGA<br>AACA<br>SEQ ID NO:10389 | CAACAGTATGAAAATCTCCC<br>GCTCACC<br>SEQ ID NO:18401 |
| | | AA | QASQDIYNHLS<br>SEQ ID NO:2378 | DASNWET<br>SEQ ID NO:10390 | QQYENLPLT<br>SEQ ID NO:18402 |
| iPS:435613 | 21-225_161D11 | NA | CGGGCAAGTCAGGGACATTAG<br>AAATGATTTGGGC<br>SEQ ID NO:2379 | GCTGCATCCACTTTGCAA<br>AGT<br>SEQ ID NO:10391 | CTACAATATAATCGTTACCC<br>ATTCACT<br>SEQ ID NO:18403 |
| | | AA | RASQGIRNDLG<br>SEQ ID NO:2380 | AASTLQS<br>SEQ ID NO:10392 | LQYNRYPFT<br>SEQ ID NO:18404 |
| iPS:435615 | 21-225_161G12 | NA | CGGGCAAGTCAGGGACATTAG<br>AAAGGATTTAGGG<br>SEQ ID NO:2381 | GCTGCATCCAGTTTGCAA<br>AGT<br>SEQ ID NO:10393 | CTACAGCATCATAGTTATCC<br>TCGGACG<br>SEQ ID NO:18405 |
| | | AA | RASQDIRKDLG<br>SEQ ID NO:2382 | AASSLQS<br>SEQ ID NO:10394 | LQHHSYPRT<br>SEQ ID NO:18406 |
| iPS:435617 | 21-225_162F2 | NA | CGGGCAAGTCAGGGACATTAG<br>AAATGATTTAGGC<br>SEQ ID NO:2383 | GCTGCATCCAGTTTGCAA<br>AGT<br>SEQ ID NO:10395 | ATACAGGATAATAGTCACCC<br>ATTCACT<br>SEQ ID NO:18407 |
| | | AA | RASQGIRNDLG<br>SEQ ID NO:2384 | AASSLQS<br>SEQ ID NO:10396 | IQDNSHPFT<br>SEQ ID NO:18408 |
| iPS:435621 | 21-225_162H3 | NA | CGGGCAAGTCAGGGCATTAG<br>AAATGATTTAGGC<br>SEQ ID NO:2385 | GCTGCATCCAGTTTGCAA<br>AGT<br>SEQ ID NO:10397 | CTACAGGATAATAGTCACCC<br>ATTCACT<br>SEQ ID NO:18409 |
| | | AA | RASQGIRNDLG<br>SEQ ID NO:2386 | AASSLQS<br>SEQ ID NO:10398 | LQDNSHPFT<br>SEQ ID NO:18410 |
| iPS:435623 | 21_225_162D5 | NA | AAGTCCAACCATAGTGTTT<br>ATACAGGTCCAACAATAATC<br>AATACTTAGCT | CGGACATCTATCCGGAA<br>ATCC | CAGCAATATTATAGTACTCC<br>TCCCACT |

FIGURE 49
(Continued)

| | | | SEQ ID NO:2387 | SEQ ID NO:10399 | SEQ ID NO:18411 |
|---|---|---|---|---|---|
| iPS:435627 | 21-225_162D5 | AA | KSNHSVLYRSNNNQYLA | RTSIRKS | QQYYSTPPT |
| | | | SEQ ID NO:2388 | SEQ ID NO:10400 | SEQ ID NO:18412 |
| iPS:435629 | 21-225_162F6 | NA | AAGTCCAGCCAGAATGTTTT ACACAGCTCCAACAATAACA ACTACTTAACT | TGGGCATCTACCCGGGA ATCC | CAGCAATATTATAGTACTCC TCCGACG |
| | | | SEQ ID NO:2389 | SEQ ID NO:10401 | SEQ ID NO:18413 |
| | | AA | KSSQNVLHSSNNNNYLT | WASTRES | QQYYSTPPT |
| | | | SEQ ID NO:2390 | SEQ ID NO:10402 | SEQ ID NO:18414 |
| iPS:435629 | 21-225_162H6 | NA | AAGTCTACTCAGAGCCTCCT GCATGGTGATGGAAAGACCT ATTTGTAT | GAAGTTTCCAAGCGGTT CTCT | AAGCAAAGTATACAGCTTCC GTGGACG |
| | | | SEQ ID NO:2391 | SEQ ID NO:10403 | SEQ ID NO:18415 |
| | | AA | KSTQSLLHGDGKTYLY | EVSKRFS | KQSIQLPWT |
| | | | SEQ ID NO:2392 | SEQ ID NO:10404 | SEQ ID NO:18416 |
| iPS:435635 | 21-225_163F1 | NA | CGGGCGAGTCAGGACATTAG CAATTATTTAGCC | GCTGCATCCAGTTTGCAA AGT | CAACAGTATAATAGTTACCC ATTCACT |
| | | | SEQ ID NO:2393 | SEQ ID NO:10405 | SEQ ID NO:18417 |
| | | AA | RASQDISNYLA | AASSLQS | QQYNSYPFT |
| | | | SEQ ID NO:2394 | SEQ ID NO:10406 | SEQ ID NO:18418 |
| iPS:435637 | 21-225_163E2 | NA | CGGGCAAGTCAGGACATTAG AAATGATTTAGGC | CCTGCATCCAGTTTGCAA AGT | CTACAGCATAATAGTCACCC ATTCACT |
| | | | SEQ ID NO:2395 | SEQ ID NO:10407 | SEQ ID NO:18419 |
| | | AA | RASQDIRNDLG | PASSLQS | LQHNSHPFT |
| | | | SEQ ID NO:2396 | SEQ ID NO:10408 | SEQ ID NO:18420 |
| iPS:435639 | 21-225_163G6 | NA | CGGGCGAGTCAGGACATTAG CAATTATTTAGTC | GCTGCATCCAGTTTGCTA AGT | CAACAGTATCATAGTTACCC GCTCACT |
| | | | SEQ ID NO:2397 | SEQ ID NO:10409 | SEQ ID NO:18421 |
| | | AA | RASQDISNYLV | AASSLLS | QQYHSYPLT |
| | | | SEQ ID NO:2398 | SEQ ID NO:10410 | SEQ ID NO:18422 |

FIGURE 49
(Continued)

| | | | | |
|---|---|---|---|---|
| iPS:435641 | 21-225_163F9 | NA | CGGGCAAGTCAGGACATTAG AGATGATTTAGGC SEQ ID NO:2399 | CCTGCATCCAGTTTGCAA AGT SEQ ID NO:10411 | CTACAGGATAATAGTTACCC ATTCACT SEQ ID NO:18423 |
| | | AA | RASQDIRDDLG SEQ ID NO:2400 | PASSLQS SEQ ID NO:10412 | LQDNSYPFT SEQ ID NO:18424 |
| iPS:435643 | 21-225_163G10 | NA | CGGGCAAGTCAGGACATTAG AAATAATTTAGGC SEQ ID NO:2401 | CCTGCATCCAGTTTGCAA AGT SEQ ID NO:10413 | CTACAGGATTATAGTTACCC ATTCACT SEQ ID NO:18425 |
| | | AA | RASQDIRNNLG SEQ ID NO:2402 | PASSLQS SEQ ID NO:10414 | LQDYSYPFT SEQ ID NO:18426 |
| iPS:435649 | 21-225_165H2 | NA | AAGTCCAGCCAGAGTGTTT ACACAGCTCCAACAATAAGA ACTACTTAACT SEQ ID NO:2403 | TGGGCATCTACCCGAGA ATCC SEQ ID NO:10415 | CAGCAATCTTATAGTATTCC TCCCACT SEQ ID NO:18427 |
| | | AA | KSSQSVLHSSNNKNYLT SEQ ID NO:2404 | WASTRES SEQ ID NO:10416 | QQSYSIPPT SEQ ID NO:18428 |
| iPS:435653 | 21-225_166H12 | NA | CGGGCGAGTCAGGACATTAG CCATTATTTAGCC SEQ ID NO:2405 | GCTGCATCCAGTTTGCAA AGT SEQ ID NO:10417 | CAACAGTATAATAGTTTCCC GCTCACT SEQ ID NO:18429 |
| | | AA | RASQDISHYLA SEQ ID NO:2406 | AASSLQS SEQ ID NO:10418 | QQYNSFPLT SEQ ID NO:18430 |
| iPS:435655 | 21-225_167E2 | NA | AAGTCTAGTCAGAGCCTCCT GCACGGTGATGGAAAGACCT ATTTGTAT SEQ ID NO:2407 | GAAGTTTCCAAACGGTT CTCT SEQ ID NO:10419 | ATGCAAAGCATACAGCTTCC GTGGACG SEQ ID NO:18431 |
| | | AA | KSSQSLLHGDGKTYLY SEQ ID NO:2408 | EVSKRFS SEQ ID NO:10420 | MQSIQLPWT SEQ ID NO:18432 |
| iPS:435657 | 21_225_167H10 | NA | AAGTCTAGTCAGAGCCTCCT GCACGGTGATGGAAAGACCT ATTTGTAT | GAAGTTTCCAAACGGTT CTCT | ATGCAAAGCATACAGCTTCC GTGGACG |

FIGURE 49
(Continued)

| | | | | | | |
|---|---|---|---|---|---|---|
| iPS:435659 | 21-225_167H10 | AA | SEQ ID NO:2409<br>KSSQSLLHGDGKTYLY<br>SEQ ID NO:2410 | SEQ ID NO:10421<br>EVSKRFS<br>SEQ ID NO:10422 | SEQ ID NO:18433<br>MQSIQLPWT<br>SEQ ID NO:18434 | |
| iPS:435663 | 21-225_167D12 | NA | CGGGCGAGTCAGGGCATTAA<br>CAATTATTTAGCC<br>SEQ ID NO:2411 | GCTGCATCCAGTTGCAA<br>AGT<br>SEQ ID NO:10423 | CAACAGTATATAAGTTATCC<br>ATTCACT<br>SEQ ID NO:18435 | |
| | | AA | RASQGINNYLA<br>SEQ ID NO:2412 | AASSLQS<br>SEQ ID NO:10424 | QQYNSYPFT<br>SEQ ID NO:18436 | |
| iPS:435665 | 21-225_169B1 | NA | CGGGCTAGTCAGGGCATTAG<br>AAATGATTTAGGC<br>SEQ ID NO:2413 | GCTGAATCCAGTTGCA<br>AAGT<br>SEQ ID NO:10425 | CTACAGCATTATAGTTACCC<br>GCTCACT<br>SEQ ID NO:18437 | |
| | | AA | RASQGIRNDLG<br>SEQ ID NO:2414 | AESSLQS<br>SEQ ID NO:10426 | LQHYSYPLT<br>SEQ ID NO:18438 | |
| iPS:435665 | 21-225_169F2 | NA | AAGTCCAGCCAGTGTGTTT<br>ATACATCTCCAACAATAAAA<br>ACTACTTAGCT<br>SEQ ID NO:2415 | TGGGCATCTACCCGGGA<br>ATCC<br>SEQ ID NO:10427 | CAGCAATATTATCGTGCTCC<br>CACC<br>SEQ ID NO:18439 | |
| | | AA | KSSQSVLYISNNKNYLA<br>SEQ ID NO:2416 | WASTRES<br>SEQ ID NO:10428 | QQYYRAPT<br>SEQ ID NO:18440 | |
| iPS:435667 | 21-225_169E3 | NA | AGGTCTAGTCAGAGCCTCCT<br>GCATAATAATGGATACAAGT<br>ATTTGGAT<br>SEQ ID NO:2417 | TTGGGTTCTAATCGGGCC<br>TCC<br>SEQ ID NO:10429 | ATGCAAGTTCTACAAACTCC<br>GTGGACG<br>SEQ ID NO:18441 | |
| | | AA | RSSQSLLHNNGYKYLD<br>SEQ ID NO:2418 | LGSNRAS<br>SEQ ID NO:10430 | MQVLQTPWT<br>SEQ ID NO:18442 | |
| iPS:435669 | 21-225_169F9 | NA | CGGGCAAGTCAGGGCATTAG<br>AAATGATTTAGGC<br>SEQ ID NO:2419 | GCTGCATCCAGTTGCAA<br>AGT<br>SEQ ID NO:10431 | CTACAGCATTATAGTTACCC<br>GCTCACT<br>SEQ ID NO:18443 | |
| | | AA | RASQGIRNDLG<br>SEQ ID NO:2420 | AASSLQS<br>SEQ ID NO:10432 | LQHYSYPLT<br>SEQ ID NO:18444 | |

FIGURE 49
(Continued)

| iPS:435671 | 21-225_169H5 | NA | AAGTCCAGCCAGAGTGTTTTATACATCTCAACAATAAAAACTACTTAGCT<br>SEQ ID NO:2421 | TGGGCATCTACCCGGGAATCC<br>SEQ ID NO:10433 | CAGCAATATTATGTGCTCCCACC<br>SEQ ID NO:18445 |
|---|---|---|---|---|---|
| | | AA | KSSQSVLYISNNKNYLA<br>SEQ ID NO:2422 | WASTRES<br>SEQ ID NO:10434 | QQYYRAPT<br>SEQ ID NO:18446 |
| iPS:435673 | 21-225_169E6 | NA | AGGTCTAGTCAGAGCCTCCTGCATAATAATGGATACAAGTATTTGGAT<br>SEQ ID NO:2423 | TTGGGTTCTAAATCGGGCCTCC<br>SEQ ID NO:10435 | ATGCAAGTTCTACAAACTCCGTGGACG<br>SEQ ID NO:18447 |
| | | AA | RSSQSLLHNNGYKYLD<br>SEQ ID NO:2424 | LGSNRAS<br>SEQ ID NO:10436 | MQVLQTPWT<br>SEQ ID NO:18448 |
| iPS:435675 | 21-225_169D7 | NA | CGGGCAAGTCAGGGCATTAGAAATGATTTAGGC<br>SEQ ID NO:2425 | GCTGCATCCAGTTTGCAAAGT<br>SEQ ID NO:10437 | CTACAGCATCATAGTTGCCCGTGGACG<br>SEQ ID NO:18449 |
| | | AA | RASQGIRNDLG<br>SEQ ID NO:2426 | AASSLQS<br>SEQ ID NO:10438 | LQHHSCPWT<br>SEQ ID NO:18450 |
| iPS:435677 | 21-225_169C10 | NA | CGGGCGAGTCAGGACATTAGCAATTATTTAGCC<br>SEQ ID NO:2427 | TCTGCATCCAGTTTGCAAAGT<br>SEQ ID NO:10439 | CAACAATCTGATAGTTACCCTCTCACT<br>SEQ ID NO:18451 |
| | | AA | RASQDISNYLA<br>SEQ ID NO:2428 | SASSLQS<br>SEQ ID NO:10440 | QQSDSYPLT<br>SEQ ID NO:18452 |
| iPS:435679 | 21-225_169D10 | NA | CGGGCGAGTCAGGACATTAGCAATTATTTAGCC<br>SEQ ID NO:2429 | GCTGCATCCAGTTTGCAAAGT<br>SEQ ID NO:10441 | CAACAGTATCATAGTTACCCATTCACT<br>SEQ ID NO:18453 |
| | | AA | RASQDISNYLA<br>SEQ ID NO:2430 | AASSLQS<br>SEQ ID NO:10442 | QQYHSYPFT<br>SEQ ID NO:18454 |
| iPS:435681 | 21-225_169D11 | NA | CGGGCAAGTCAGGGCATTAGAGATGATTTAGGC<br>SEQ ID NO:2431 | GCTGCATCCAGTTTGCAAAGT<br>SEQ ID NO:10443 | CTTCAGCATTATAGTTACCCTCGGACG<br>SEQ ID NO:18455 |

FIGURE 49
(Continued)

| | | | | | | |
|---|---|---|---|---|---|---|
| | | AA | RASQGIRDDLG | | AASSLQS | LQHYSYPRT |
| iPS:435683 | 21-225_170A1 | | SEQ ID NO:2432 | | SEQ ID NO:10444 | SEQ ID NO:18456 |
| | | NA | AAGTCTAGTCAGAGAGCCTCCTGCATGGTGATGGAAAGACCTTATTTGTTT | | GAAGTTCCAACCGGTTCTCT | ATGCAAAGTATTCAGCTTCCGTGGACG |
| | | AA | SEQ ID NO:2433 | KSSQSLLHGDGKTYLF | SEQ ID NO:10445 EVSNRFS | SEQ ID NO:18457 MQSIQLPWT |
| iPS:435685 | 21-225_170E1 | NA | SEQ ID NO:2434 CGGGCGAAGTCAGGGCATTAGCAATTATTTAGGC | | SEQ ID NO:10446 GCTGCATCCAGTTTGCAAAGT | SEQ ID NO:18458 CAACAGTATCATAGTTACCCATTCACT |
| | | AA | SEQ ID NO:2435 RASQGISNYLA | | SEQ ID NO:10447 AASSLQS | SEQ ID NO:18459 QQYHSYPFT |
| iPS:435687 | 21-225_170H1 | NA | SEQ ID NO:2436 CGGGCAAGTCAGGGCATTAGAAATGATTTAGGC | | SEQ ID NO:10448 GCTACATCCAGTTTGCAAAGT | SEQ ID NO:18460 CTACAGCATAGTAACCCGTGGACG |
| | | AA | SEQ ID NO:2437 RASQGIRNDLG | | SEQ ID NO:10449 ATSSLQS | SEQ ID NO:18461 LQHSSNPWT |
| iPS:435689 | 21-225_170F3 | NA | SEQ ID NO:2438 CGGGCAAGTCGGGGCATTAGAAATGATTTAGGC | | SEQ ID NO:10450 GCTGCATCCAGTTTGCAAAGT | SEQ ID NO:18462 CTACAGCATTATAGTTACCCTCGGACG |
| | | AA | SEQ ID NO:2439 RASRGIRNDLG | | SEQ ID NO:10451 AASSLQS | SEQ ID NO:18463 LQHYSYPRT |
| iPS:435693 | 21-225_170G4 | NA | SEQ ID NO:2440 CGGGCAAGTCAGGGCATTAGAAATGATTTAGGC | | SEQ ID NO:10452 GCTGCATCCACTTTGCAAAGT | SEQ ID NO:18464 CTACAGCATTATAGTTACCCGCTCACT |
| | | AA | SEQ ID NO:2441 RASQGIRNDLG | | SEQ ID NO:10453 AASTLQS | SEQ ID NO:18465 LQHYSYPLT |
| iPS:435695 | | NA | SEQ ID NO:2442 CGGGCAAGTCAGGGCATTAGAAATGATTTAGGC | | SEQ ID NO:10454 GCTGCATCCAGTTTGCAAAAT | SEQ ID NO:18466 CTACAGCATTATAGTTTCCCGCTCACT |

FIGURE 49
(Continued)

| | | | | | | |
|---|---|---|---|---|---|---|
| iPS:435697 | 21-225_170D5 | NA | SEQ ID NO:2443 CGGGCAAGTCAGGGCATTAG AACTGATTTAGGC | SEQ ID NO:10455 GCTGCATCCAGTTTGCAA AAT | SEQ ID NO:18467 CTACAGCATTATAGTTACCC GCTCACT |
| | | AA | SEQ ID NO:2444 RASQGIRNDLG | SEQ ID NO:10456 AASSLQN | SEQ ID NO:18468 LQHYSFPLT |
| iPS:435699 | 21-225_170G5 | NA | SEQ ID NO:2445 CGGGCAAGTCAGGGCATTAG AACTGATTTAGGC | SEQ ID NO:10457 ACTGCATCCAGTTTGCAA AGT | SEQ ID NO:18469 CTACAGCATTATAGTTACCC GCTCACT |
| | | AA | SEQ ID NO:2446 RASQGIRTDLG | SEQ ID NO:10458 TASSLQS | SEQ ID NO:18470 LQHYSYPLT |
| iPS:435699 | 21-225_170D6 | NA | SEQ ID NO:2447 CGGGCGAGTCAGGACATTGG CAATTGTTTAGCC | SEQ ID NO:10459 TCTGCGTCCAGTTTGCAA AGT | SEQ ID NO:18471 CAACAATCTGATAGTTACCC TCTCACT |
| | | AA | SEQ ID NO:2448 RASQDIGNCLA | SEQ ID NO:10460 SASSLQS | SEQ ID NO:18472 QQSDSYPLT |
| iPS:435701 | 21-225_170F6 | NA | SEQ ID NO:2449 AAGTCCAGCCAGAGTGTTTT ACACAGCTCCAACAATTACA ACTACTTAGCT | SEQ ID NO:10461 TGGGCATCTACCCGGAA ATCC | SEQ ID NO:18473 CAGCAATATTATAGTACTCC GTGGACG |
| | | AA | SEQ ID NO:2450 KSSQSVLHSSNNYNYLA | SEQ ID NO:10462 WASTRKS | SEQ ID NO:18474 QQYYSTPWT |
| iPS:435703 | 21-225_170D11 | NA | SEQ ID NO:2451 CGGGCAAGTCAGGGCATTAG AAATGATTTAGGC | SEQ ID NO:10463 GCTGCATCCAGTTTGCAA AAT | SEQ ID NO:18475 CTACAGCATTATAGTTTCCC GCTCACT |
| | | AA | SEQ ID NO:2452 RASQGIRNDLG | SEQ ID NO:10464 AASSLQN | SEQ ID NO:18476 LQHYSFPLT |
| iPS:435705 | 21-225_171C3 | NA | SEQ ID NO:2453 CGGGCAAGTCAGGGCATTAG AACTGATTTAGGC | SEQ ID NO:10465 ACTGCATCCAGTTTGCAA AGT | SEQ ID NO:18477 CTACAGCATTATAGTTACCC GCTCACT |
| | | AA | SEQ ID NO:2454 RASQGIRTDLG | SEQ ID NO:10466 TASSLQS | SEQ ID NO:18478 LQHYSYPLT |

FIGURE 49
(Continued)

| | | | | | |
|---|---|---|---|---|---|
| iPS:435709 | 21-225_171A4 | NA | CGGGCAAGTCAGGGCATTAG AAATGATTAGGC | ACTGCATCCAGTTTGCAA AGT | CTACAGCATTATAGTTACCC GCTCACT |
| | | | SEQ ID NO:2455 | SEQ ID NO:10467 | SEQ ID NO:18479 |
| | | AA | RASQGIRNDLG | TASSLQS | LQHYSYPLT |
| | | | SEQ ID NO:2456 | SEQ ID NO:10468 | SEQ ID NO:18480 |
| iPS:435711 | 21-225_171G4 | NA | CGGGCGAGTCAGGGTGTTAA CGACTGGTTAGCC | GATGCATCAAGTTTGCA AAGT | CAACAGGCTAACAGTTTCCC GTGGACG |
| | | | SEQ ID NO:2457 | SEQ ID NO:10469 | SEQ ID NO:18481 |
| | | AA | RASQGVNDWLA | DASSLQS | QQANSFPWT |
| | | | SEQ ID NO:2458 | SEQ ID NO:10470 | SEQ ID NO:18482 |
| iPS:435713 | 21-225_171D7 | NA | AGGTCTAGTCAGAGCCTCCT GTATCATAATGGATACAACT ATTTGGAT | GTGGGTTCTAATCGGGC CTCC | ATGCAAACTCTACAAACTCC GCTCACT |
| | | | SEQ ID NO:2459 | SEQ ID NO:10471 | SEQ ID NO:18483 |
| | | AA | RSSQSLLYHNGYNYLD | VGSNRAS | MQTLQTPLT |
| | | | SEQ ID NO:2460 | SEQ ID NO:10472 | SEQ ID NO:18484 |
| iPS:435715 | 21-225_171A8 | NA | CGGGCGAGTCAGGGTATTAG CAACTGGTTAGCC | GCTGCATTCAGTTTGCAA GGT | CAACAGACTAACAGTTTCCC GTGGACG |
| | | | SEQ ID NO:2461 | SEQ ID NO:10473 | SEQ ID NO:18485 |
| | | AA | RASQGISNWLA | AAFSLQG | QQTNSFPWT |
| | | | SEQ ID NO:2462 | SEQ ID NO:10474 | SEQ ID NO:18486 |
| iPS:435717 | 21-225_171A9 | NA | CGGGCGAGTCAGGATATTAC CACCTGGTTAGCC | GATGCATCCAGTTTGCA AAGT | CTACAGACTAACAGTTTCCC GTGGACG |
| | | | SEQ ID NO:2463 | SEQ ID NO:10475 | SEQ ID NO:18487 |
| | | AA | RASQDITTWLA | DASSLQS | LQTNSFPWT |
| | | | SEQ ID NO:2464 | SEQ ID NO:10476 | SEQ ID NO:18488 |
| iPS:435719 | 21-225_171A11 | NA | CGGGCAAGTCAGGGCATTAG AAATAATTAGGC | CCTGCATCCAGTTTGCAA AGT | CTACAGGATCATAGTTACCC ATTCACT |
| | | | SEQ ID NO:2465 | SEQ ID NO:10477 | SEQ ID NO:18489 |
| | | AA | RASQGIRNNLG | PASSLQS | LQDHSYPFT |

FIGURE 49
(Continued)

| | | | SEQ ID NO:2466 | SEQ ID NO:10478 | SEQ ID NO:18490 |
|---|---|---|---|---|---|
| iPS:435721 | 21-225_172B3 | NA | CGGGCTAGTCAGGGCATTAG AAATGATTAGGC | GCTGAATCCAGTTGCA AAGT | CTACAGCATTATAGTTACCC GCTCACT |
| | | AA | SEQ ID NO:2467 RASQGIRNDLG | SEQ ID NO:10479 AESSLQS | SEQ ID NO:18491 LQHYSYPLT |
| iPS:435723 | 21-225_172B7 | NA | SEQ ID NO:2468 AAGTCTAGTCAGAGCCTCCT GCATGGTGATGGAAAGACCT ATTTCTAT | SEQ ID NO:10480 GAAGTTTCCCACCGGTTC TCT | SEQ ID NO:18492 ATGCAAAGTATACAGTTCCC GTGGACG |
| | | AA | SEQ ID NO:2469 KSSQSLLHGDGKTYFY | SEQ ID NO:10481 EVSHRFS | SEQ ID NO:18493 MQSIQFPWT |
| iPS:435725 | 21-225_172G8 | NA | SEQ ID NO:2470 CGGGCAAGTCAGGGCGTTAG AAATGATTAGGC | SEQ ID NO:10482 GCTGCATCCAGTTGCAA AAT | SEQ ID NO:18494 CTACACCATTATAGTTTCCC GCTCACT |
| | | AA | SEQ ID NO:2471 RASQGVRNDLG | SEQ ID NO:10483 AASSLQN | SEQ ID NO:18495 LHHYSFPLT |
| iPS:435727 | 21-225_172E11 | NA | SEQ ID NO:2472 AAGTCCAGCAGAGTGTTT ACACAGCTCCAACAATAACA ACTACTTAGCT | SEQ ID NO:10484 TGGGCATCTACTCGGGA ATCC | SEQ ID NO:18496 CAGCAATATTTTACTACTCC GTGCAGT |
| | | AA | SEQ ID NO:2473 KSSQSVLHSSNNNNYLA | SEQ ID NO:10485 WASTRES | SEQ ID NO:18497 QQYFTTPCS |
| iPS:435729 | 21-225_173E7 | NA | SEQ ID NO:2474 CGTGCAAGTCAGACCATTAG CAACTATTTAAAT | SEQ ID NO:10486 GCTGCATCCAGTTTGCAA ATT | SEQ ID NO:18498 CAACAGAGTTACAGAACCCC TCAGTGGACG |
| | | AA | SEQ ID NO:2475 RASQTISNYLN | SEQ ID NO:10487 AASSLQI | SEQ ID NO:18499 QQSYRTPQWT |
| | | | SEQ ID NO:2476 | SEQ ID NO:10488 | SEQ ID NO:18500 |

FIGURE 49
(Continued)

| | | | | | |
|---|---|---|---|---|---|
| iPS:435731 | 21-225_173A11 | NA | AAGTCTAGTCAGAGCCTCCT GCATGGTGATGGAAAGACCT ATTTGTAT SEQ ID NO:2477 | GAAGTTTCCAACCGGTTC TCT SEQ ID NO:10489 | ATGCAAAGTATACAGGTTCC GTGGACG SEQ ID NO:18501 |
| | | AA | KSSQSLLHGDGKTYLY SEQ ID NO:2478 | EVSNRFS SEQ ID NO:10490 | MQSIQVPWT SEQ ID NO:18502 |
| iPS:435733 | 21-225_173C11 | NA | AAGTCTAGTCAGAGCCTCCT GCATAGTGAGGGAAAGACC TACTTGTAT SEQ ID NO:2479 | GAAGTTTCCCACCGGTTC TCT SEQ ID NO:10491 | ATGCAAAGTATACAGGTTCT CACT SEQ ID NO:18503 |
| | | AA | KSSQSLLHSEGKTYLY SEQ ID NO:2480 | EVSHRFS SEQ ID NO:10492 | MQSIQLLT SEQ ID NO:18504 |
| iPS:435735 | 21-225_173H12 | NA | CGGGCAAGTCAGGGCATTAG AAATGATTTAGGC SEQ ID NO:2481 | ACTACAGTCCAGTTGCAA AGT SEQ ID NO:10493 | CTACAGCATTATAGTTTCCC GAACACT SEQ ID NO:18505 |
| | | AA | RASQGIRNDLG SEQ ID NO:2482 | TTSSLQS SEQ ID NO:10494 | LQHYSFPNT SEQ ID NO:18506 |
| iPS:435737 | 21-225_174G5 | NA | AAGTCCAGCCAGAGTGTATT ACACAGTCCAACAATTACA ACTACTTAACT SEQ ID NO:2483 | TGGGCATCTACCCGGGA ATCC SEQ ID NO:10495 | CAGCAATATTATCGTACTCC GTGGACG SEQ ID NO:18507 |
| | | AA | KSSQSVLHSSNNYNYLT SEQ ID NO:2484 | WASTRES SEQ ID NO:10496 | QQYYRTPWT SEQ ID NO:18508 |
| iPS:435739 | 21-225_174G7 | NA | CGGGCGAGTCAGGGTATTAG CAACTGGTTAGCC SEQ ID NO:2485 | GCTGCATTCAGTTTGCAA GGT SEQ ID NO:10497 | CAACAGACTAACAGTTTCCC GTGGACG SEQ ID NO:18509 |
| | | AA | RASQGISNWLA SEQ ID NO:2486 | AAFSLQG SEQ ID NO:10498 | QQTNSFPWT SEQ ID NO:18510 |
| iPS:435741 | | NA | CGGGCAAGTCAGGGCATTAG AGATGATTTAGGC | GCTGCATCCAGTTGCAA AGT | CTTCAGCATCATAGTTACCC TCGGACG |

FIGURE 49
(Continued)

| | | | | | | |
|---|---|---|---|---|---|---|
| iPS:435743 | 21-225_174G10 | | SEQ ID NO:2487 | | SEQ ID NO:10499 | | SEQ ID NO:18511 |
| | | AA | RASQGIRDLG | AASSLQS | LQHHSYPRT |
| | | | SEQ ID NO:2488 | SEQ ID NO:10500 | SEQ ID NO:18512 |
| iPS:435745 | 21-225_175G1 | NA | CGGGCAAGTCAGGGCATTAG AACTGATTTAGGC | ACTGCATCCAGTTTGCAA AGT | CTACAGCATTATAGTTACCC GCTCACT |
| | | | SEQ ID NO:2489 | SEQ ID NO:10501 | SEQ ID NO:18513 |
| | | AA | RASQGIRIDLG | TASSLQS | LQHYSYPLT |
| | | | SEQ ID NO:2490 | SEQ ID NO:10502 | SEQ ID NO:18514 |
| iPS:435747 | 21-225_175G3 | NA | CGGGCGAGTCAGGACACATTAG CAATGATTTAGCC | TCTGCATCCAGTTTGCAA AGT | CAACAATCTGATAGTTACCC TCTCACT |
| | | | SEQ ID NO:2491 | SEQ ID NO:10503 | SEQ ID NO:18515 |
| | | AA | RASQDISNDLA | SASSLQS | QQSDSYPLT |
| | | | SEQ ID NO:2492 | SEQ ID NO:10504 | SEQ ID NO:18516 |
| iPS:435747 | 21-225_175C4 | NA | CGGGCGAGTCAGGGCATTGG GAATTATTTAGCC | GCTGCATCCGGTTTGCAA AGT | CAACAGTATTATAGTTACCC ATTCACT |
| | | | SEQ ID NO:2493 | SEQ ID NO:10505 | SEQ ID NO:18517 |
| | | AA | RASQGIGNYLA | AASGLQS | QQYYSYPFT |
| | | | SEQ ID NO:2494 | SEQ ID NO:10506 | SEQ ID NO:18518 |
| iPS:435749 | 21-225_175C10 | NA | CGGGCGAGTCAGGGTATTAC CGACTGGTTAGCC | GCTGCATCCAGTTTGCAA AGT | CAACAGACTAACAGTTTCCC GTGGACG |
| | | | SEQ ID NO:2495 | SEQ ID NO:10507 | SEQ ID NO:18519 |
| | | AA | RASQGITDWLA | AASSLQS | QQTNSFPWT |
| | | | SEQ ID NO:2496 | SEQ ID NO:10508 | SEQ ID NO:18520 |
| iPS:435751 | 21-225_175D10 | NA | AAGTCCAGCAGCCAGAGTGTTTT ATACAGCTCCAACAATAACA ACTACTTAGCT | TGGACATCTACCCGGGA ATCC | CAGCAATATTATAGTACTCC TCCGACG |
| | | | SEQ ID NO:2497 | SEQ ID NO:10509 | SEQ ID NO:18521 |
| | | AA | KSSQSVLYSSNNNNYLA | WTSTRES | QQYYSTPPT |
| | | | SEQ ID NO:2498 | SEQ ID NO:10510 | SEQ ID NO:18522 |

FIGURE 49
(Continued)

| | | | | | | |
|---|---|---|---|---|---|---|
| iPS:435753 | 21-225_175G10 | NA | CGGGCAAGTCAGAGACCATTGG CAACTATTTAAAT SEQ ID NO:2499 | GCTGCATCCAGTTGCAC AGT SEQ ID NO:10511 | CAACAGAGTTACAGAACCCC TCAGTGGACG SEQ ID NO:18523 |
| | | AA | RASQTIGNYLN SEQ ID NO:2500 | AASSLHS SEQ ID NO:10512 | QQSYRTPQWT SEQ ID NO:18524 |
| iPS:435755 | 21-225_176H4 | NA | AAGTCTAGTCAGAGCCTCCT GCATGGTGATGGAAAGACCT ATTTGTAT SEQ ID NO:2501 | GAAGTTCCAACCGGTTC TCT SEQ ID NO:10513 | ATGCAAAGTATACAGATTCC GTGGACG SEQ ID NO:18525 |
| | | AA | KSSQSLLHGDGKTYLY SEQ ID NO:2502 | EVSNRFS SEQ ID NO:10514 | MQSIQIPWT SEQ ID NO:18526 |
| iPS:435759 | 21-225_176E6 | NA | AGGTCTAGTCAGAGCCTCCT GCATAATAATGGATACAAGT ATTTGGAT SEQ ID NO:2503 | TTGGGTTCTAATCGGGCC TCC SEQ ID NO:10515 | ATGCAAGTTCTACAAACTCC GTGGACG SEQ ID NO:18527 |
| | | AA | RSSQSLLHNNGYKYLD SEQ ID NO:2504 | LGSNRAS SEQ ID NO:10516 | MQVLQTPWT SEQ ID NO:18528 |
| iPS:435761 | 21-225_176B11 | NA | CGGGCAAGTCAGGGCATTAG AAATGATTTAGGC SEQ ID NO:2505 | GCTGCATCCAGTTTGCAA AGT SEQ ID NO:10517 | CTACAGCATTATAGTTACCC GCTCACT SEQ ID NO:18529 |
| | | AA | RASQGIRNDLG SEQ ID NO:2506 | AASSLQS SEQ ID NO:10518 | LQHYSYPLT SEQ ID NO:18530 |
| iPS:435763 | 21-225_176H12 | NA | CGGGCAAGTCAGGGCATTAG AAATGATTTAGGC SEQ ID NO:2507 | GCTGCATCCAGTTTGCAA AGT SEQ ID NO:10519 | CTACAGCATAATAGTTACCC TCGCAGT SEQ ID NO:18531 |
| | | AA | RASQGIRNDLG SEQ ID NO:2508 | AASSLQS SEQ ID NO:10520 | LQHNSYPRS SEQ ID NO:18532 |
| iPS:435765 | 21-225_177D3 | NA | CGGGCGAGTCAGGGCATTAC CAATTATTTAGCC SEQ ID NO:2509 | GCTGCATCCAGTTTGCAA AGT SEQ ID NO:10521 | CAACAGTATAATAGTTACCT ATTCACT SEQ ID NO:18533 |

FIGURE 49
(Continued)

| | | | | | |
|---|---|---|---|---|---|
| iPS:435767 | 21-225_177B4 | AA | RASQGITNYLA<br>SEQ ID NO:2510 | AASSLQS<br>SEQ ID NO:10522 | QQYNSYPFT<br>SEQ ID NO:18534 |
| | | NA | CGGGCAAGTCAGGGCATTAG<br>AAATGATTTAGGC<br>SEQ ID NO:2511 | GCTGCATCCAGTTTGCAA<br>AGT<br>SEQ ID NO:10523 | CTACAGCATTATAGTTCCCT<br>CGCAGT<br>SEQ ID NO:18535 |
| iPS:435769 | 21-225_177B6 | AA | RASQGIRNDLG<br>SEQ ID NO:2512 | AASSLQS<br>SEQ ID NO:10524 | LQHYSFPRS<br>SEQ ID NO:18536 |
| | | NA | CGGGCAAGTCAGGACATTAG<br>CAATGATTTAGGC<br>SEQ ID NO:2513 | GCTGCATCCAGTTTGCAA<br>AGT<br>SEQ ID NO:10525 | CTACAGCTTAATAGTTACCC<br>ATTCACT<br>SEQ ID NO:18537 |
| | | AA | RASQDISNDLG<br>SEQ ID NO:2514 | AASSLQS<br>SEQ ID NO:10526 | LQLNSYPFT<br>SEQ ID NO:18538 |
| iPS:435771 | 21-225_177B11 | NA | AAGTCTAGTCAGCGCCTCCT<br>GCATGGTGATGGAAAGACCT<br>ATTTGTAT<br>SEQ ID NO:2515 | GAAGTTTCCAACCGGTTC<br>TCT<br>SEQ ID NO:10527 | ATGCAAAGTATACAGATTCC<br>GTGGACG<br>SEQ ID NO:18539 |
| | | AA | KSSQRLLHGDGKTYLY<br>SEQ ID NO:2516 | EVSNRFS<br>SEQ ID NO:10528 | MQSIQIPWT<br>SEQ ID NO:18540 |
| iPS:435773 | 21-225_177B12 | NA | AAGTCCAGCCAGAGTGTTTT<br>ACACAGCTCCAACAATAACA<br>ACTACTTAACT<br>SEQ ID NO:2517 | TGGGCATCTCTACCCGGGA<br>ATCC<br>SEQ ID NO:10529 | CAGCAATATTATAGTAGTCC<br>TCCGACG<br>SEQ ID NO:18541 |
| | | AA | KSSQSVLHSSNNNNYLT<br>SEQ ID NO:2518 | WASTRES<br>SEQ ID NO:10530 | QQYYSSPPT<br>SEQ ID NO:18542 |
| iPS:435775 | 21-225_178A5 | NA | CGGGCGAGTCAGGGTATTAG<br>CAACTGGTTAGCC<br>SEQ ID NO:2519 | GCTGCTTCCAGTTTGCAA<br>AGT<br>SEQ ID NO:10531 | CAACAGGCTAACAGTTTACC<br>GTGGACG<br>SEQ ID NO:18543 |
| | | AA | RASQGISNWLA<br>SEQ ID NO:2520 | AASSLQS<br>SEQ ID NO:10532 | QQANSLPWT<br>SEQ ID NO:18544 |

FIGURE 49
(Continued)

| | | | | | |
|---|---|---|---|---|---|
| iPS:435777 | 21-225_178F7 | NA | CGGGGCGAGTCAGGATATTAC TGACTGGTTAGCC SEQ ID NO:2521 | GCTGCATCCAGTTTGCAG AGT SEQ ID NO:10533 | CAACAGGCTAACAGTTTACC GTGGACG SEQ ID NO:18545 |
| | | AA | RASQDITDWLA SEQ ID NO:2522 | AASSLQS SEQ ID NO:10534 | QQANSLPWT SEQ ID NO:18546 |
| iPS:435779 | 21-225_178B10 | NA | CGGGCAAGTCAGGGCATTAG AAATGATTTAGGC SEQ ID NO:2523 | GCTGCATCCAGTTTGCAA AAT SEQ ID NO:10535 | CTACACCATTATAGTTTCCC GCTCACT SEQ ID NO:18547 |
| | | AA | RASQGIRNDLG SEQ ID NO:2524 | AASSLQN SEQ ID NO:10536 | LHHYSFPLT SEQ ID NO:18548 |
| iPS:435781 | 21-225_178G10 | NA | AAGTCTAGTCAGAGCCTCCT GCATGGTGATGGAAAGACCT ATTTGTAT SEQ ID NO:2525 | GAAGTTTCCAACCGTTT TCT SEQ ID NO:10537 | ATGCAAAGTATACAGGTTCC GTGGACG SEQ ID NO:18549 |
| | | AA | KSSQSLLHGDGKTYLY SEQ ID NO:2526 | EVSNRFS SEQ ID NO:10538 | MQSIQVPWT SEQ ID NO:18550 |
| iPS:435783 | 21-225_179G1 | NA | CGGGCGAGTCAGGATATTAG CGACTGGTTAGCC SEQ ID NO:2527 | GCTGCATCCAGTTTGCAA AGT SEQ ID NO:10539 | CAACAGGCTAACAGTTTACC GTGGACG SEQ ID NO:18551 |
| | | AA | RASQDISDWLA SEQ ID NO:2528 | AASSLQS SEQ ID NO:10540 | QQANSLPWT SEQ ID NO:18552 |
| iPS:435785 | 21-225_179C2 | NA | AAATCTAGTCAGAGCCTCCT GCATAGTGAGGGAAAGACC TACTTGTAT SEQ ID NO:2529 | GAGGTTTCCACCGGTTC TCT SEQ ID NO:10541 | ATGCAAAGTATACAGGTTCT CACT SEQ ID NO:18553 |
| | | AA | KSSQSLLHSEGKTYLY SEQ ID NO:2530 | EVSHRFS SEQ ID NO:10542 | MQSIQVLT SEQ ID NO:18554 |
| iPS:435787 | 21-225_180A3 | NA | CGGGCGAGTCAGGATATTAC CAGCTGGTTAGCC SEQ ID NO:2531 | GCTGCATCCAGTTTGCAA AGT SEQ ID NO:10543 | CAACAGGCTAACAGTATCCC ATTCACT SEQ ID NO:18555 |

FIGURE 49
(Continued)

| | | | | | | | |
|---|---|---|---|---|---|---|---|
| iPS:435789 | 21-225_180C4 | AA | RASQDITSWLA | | AASSLQS | | QQANSIPFT |
| | | | SEQ ID NO:2532 | | SEQ ID NO:10544 | | SEQ ID NO:18556 |
| | | NA | AAGTCTAGTCAGAGCCTCCT GCATGGTGATGGAAAGACCT ATTTGTAT | | GCAACTTCCAACCGGTTC CCT | | ATGCAAAGTATACAGGTTCC GTGGACG |
| | | | SEQ ID NO:2533 | | SEQ ID NO:10545 | | SEQ ID NO:18557 |
| iPS:435791 | 21-225_180H7 | AA | KSSQSLLHGDGKTYLY | | ATSNRFP | | MQSIQVPWT |
| | | | SEQ ID NO:2534 | | SEQ ID NO:10546 | | SEQ ID NO:18558 |
| | | NA | CGGGCAAGTCAGGGCATTAG AAATGATTAGGC | | ACTGCATCCAGTTTGCAA AGT | | CTACAGCATAATAGTTACCC ATTCACT |
| | | | SEQ ID NO:2535 | | SEQ ID NO:10547 | | SEQ ID NO:18559 |
| iPS:435793 | 21-225_180F8 | AA | RASQGIRNDLG | | TASSLQS | | LQHNSYPFT |
| | | | SEQ ID NO:2536 | | SEQ ID NO:10548 | | SEQ ID NO:18560 |
| | | NA | CGGGCAAGTCAGACCATTCT CAGCTATTTAAAT | | GGTGTATCCAGTTTACAA AGT | | CAGCAGAGTTACAGTACCCC ATTCACT |
| | | | SEQ ID NO:2537 | | SEQ ID NO:10549 | | SEQ ID NO:18561 |
| iPS:435795 | 21-225_181C2 | AA | RASQTILSYLN | | GVSSLQS | | QQSYSTPFT |
| | | | SEQ ID NO:2538 | | SEQ ID NO:10550 | | SEQ ID NO:18562 |
| | | NA | AAGTCTAGTCAGAGCCTCCT GCATGGTGATGGAAAGACCT ATTTGTAT | | GAAGTTTCCAACCGGTTC TCT | | ATGCAAAGTATACAGGTTCC CTGGACG |
| | | | SEQ ID NO:2539 | | SEQ ID NO:10551 | | SEQ ID NO:18563 |
| iPS:435797 | 21-225_181G2 | AA | KSSQSLLHGDGKTYLY | | EVSNRFS | | MQSIQVPWT |
| | | | SEQ ID NO:2540 | | SEQ ID NO:10552 | | SEQ ID NO:18564 |
| | | NA | CGGGCGAGTCAGGGCATTAG CAATTATTTAGCC | | GCTGCATCCAGTTTGCAA AGT | | CAACAGTATAATGGTTACCC ATTCACT |
| | | | SEQ ID NO:2541 | | SEQ ID NO:10553 | | SEQ ID NO:18565 |
| | | AA | RASQGISNYLA | | AASSLQS | | QQYNGYPFT |
| | | | SEQ ID NO:2542 | | SEQ ID NO:10554 | | SEQ ID NO:18566 |

FIGURE 49
(Continued)

| | | | | | |
|---|---|---|---|---|---|
| iPS:435799 | 21-225_181G3 | NA | CGGGGCAAGTCACAGCAGCATTAG CAACTATTTAAAT SEQ ID NO:2543 | ACTACATTGAATTTGCAA AGT SEQ ID NO:10555 | CAACAGAGTTACAGTTCTCC TCCGTGGACG SEQ ID NO:18567 |
| | | AA | RASHSISNYLN SEQ ID NO:2544 | TTLNLQS SEQ ID NO:10556 | QQSYSSPPWT SEQ ID NO:18568 |
| iPS:435801 | 21-225_181E5 | NA | AAGTCCAGCCAGCAGAGTGTTT ACACAGCTCCAACAATTACA ACTACTTAACT SEQ ID NO:2545 | TGGGCATCTACCCGGGA ATCC SEQ ID NO:10557 | CATCAGTATTTTATTACTCCG TGGACG SEQ ID NO:18569 |
| | | AA | KSSQSVLHSSNNYNYLT SEQ ID NO:2546 | WASTRES SEQ ID NO:10558 | HQYFITPWT SEQ ID NO:18570 |
| iPS:435805 | 21-225_181A8 | NA | CGGGGCAAGTCAGGGCATTAG AAATGATTTAGGC SEQ ID NO:2547 | ACTGCATCCAGTTTGCAA AGT SEQ ID NO:10559 | CTACAGCATAATAGTTACCC ATTCACT SEQ ID NO:18571 |
| | | AA | RASQGIRNDLG SEQ ID NO:2548 | TASSLQS SEQ ID NO:10560 | LQHNSYPFT SEQ ID NO:18572 |
| iPS:435807 | 21-225_181C10 | NA | AAGTCTAGTCAGAGCCTCCT GCATGGTGATGGAAAGACCTT ATTTGTAT SEQ ID NO:2549 | GAAGTTTCCAATCGGTTC TCT SEQ ID NO:10561 | ATGCAAAGTATACAGATTCC CTGGACG SEQ ID NO:18573 |
| | | AA | KSSQSLLHGDGKTYLY SEQ ID NO:2550 | EVSNRFS SEQ ID NO:10562 | MQSIQIPWT SEQ ID NO:18574 |
| iPS:435809 | 21-225_182H5 | NA | CGGGCGAGTCAGGATATTAC CAGCTGGTTAGCC SEQ ID NO:2551 | GCTGCATCCAGTTTACAA AGT SEQ ID NO:10563 | CAACAGGTTAACAGTTTCCC ATTCACT SEQ ID NO:18575 |
| | | AA | RASQDITSWLA SEQ ID NO:2552 | AASSLQS SEQ ID NO:10564 | QQVNSFPFT SEQ ID NO:18576 |
| iPS:435811 | 21-225_183H6 | NA | CAGGCGAGTCAGGACATTAG CAACTATTTAAAT SEQ ID NO:2553 | GATGCATCCAATTTGGA AACA SEQ ID NO:10565 | CAACAGTATGATAATCTCCC TCTCACT SEQ ID NO:18577 |

FIGURE 49
(Continued)

| | | | | | | |
|---|---|---|---|---|---|---|
| iPS:435813 | | AA | QASQDISNYLN | DASNLET | | QQYDNLPLT |
| | | | SEQ ID NO:2554 | SEQ ID NO:10566 | | SEQ ID NO:18578 |
| | 21-225_183A12 | NA | CGGGCAAGTCGGAACATCA GCAACTATTTAAAT | GTTGTATCCAGTTTGCAA AGT | | CAACAGAGTTACAGTTCCCC TCCGTGGACG |
| | | | SEQ ID NO:2555 | SEQ ID NO:10567 | | SEQ ID NO:18579 |
| iPS:435815 | | AA | RASRNISNYLN | VVSSLQS | | QQSYSSPPWT |
| | | | SEQ ID NO:2556 | SEQ ID NO:10568 | | SEQ ID NO:18580 |
| | 21-225_190G10 | NA | AGGGCCAGTCCAGAGTGTTAG CAGCAGATTCTTAGCC | GGTGCATCCAGCAGGGC CACT | | CAGCAGTATGGTAGCTCACC TCCGTGGACG |
| | | | SEQ ID NO:2557 | SEQ ID NO:10569 | | SEQ ID NO:18581 |
| iPS:435817 | | AA | RASPSVSSRFLA | GASSRAT | | QQYGSSPPWT |
| | | | SEQ ID NO:2558 | SEQ ID NO:10570 | | SEQ ID NO:18582 |
| | 21-225_190B11 | NA | CGGGCCAGTCAGAGTATTGG TAGTAACTTACAC | TCTGCTTCCCAGTCCTTC TCA | | CAGCAGAGTAGTAGTTTACC GTGGACG |
| | | | SEQ ID NO:2559 | SEQ ID NO:10571 | | SEQ ID NO:18583 |
| iPS:435819 | | AA | RASQSIGSNLH | SASQSFS | | QQSSSLPWT |
| | | | SEQ ID NO:2560 | SEQ ID NO:10572 | | SEQ ID NO:18584 |
| | 21-225_190C11 | NA | CGGACGAGTCAGGGCATTGG CAATTATTTAGCC | AAAACATCCAGTTTACA AAGT | | CAACAGTATATGACTTACCC GCTCACT |
| | | | SEQ ID NO:2561 | SEQ ID NO:10573 | | SEQ ID NO:18585 |
| iPS:435821 | | AA | RTSQGIGNYLA | KTSSLQS | | QQYMTYPLT |
| | | | SEQ ID NO:2562 | SEQ ID NO:10574 | | SEQ ID NO:18586 |
| | 21-225_190E11 | NA | AGGGCCAGTCAGAGTTTTCG CATCAACTTAGCC | GGTGCATCCACCAGGGC CACT | | CAGCAGTATAATAACTGGCC GCTCACT |
| | | | SEQ ID NO:2563 | SEQ ID NO:10575 | | SEQ ID NO:18587 |
| iPS:435823 | | AA | RASQSFRINLA | GASTRAT | | QQYNNWPLT |
| | | | SEQ ID NO:2564 | SEQ ID NO:10576 | | SEQ ID NO:18588 |
| | 21-225_190F11 | NA | CGGGCCAGTCAGAACATTGG TAGTAGCTTACAC | TATGCTTCCCAGTCCTTC TCA | | CATCCAGAGTAGTAGTTTCCC TCGGACG |
| | | | SEQ ID NO:2565 | SEQ ID NO:10577 | | SEQ ID NO:18589 |

FIGURE 49
(Continued)

| | | | | | | | |
|---|---|---|---|---|---|---|---|
| iPS:435825 | 21-225_190G11 | AA | RASQNIGSSLH<br>SEQ ID NO:2566 | | YASQSFS<br>SEQ ID NO:10578 | | HQSSSFPRT<br>SEQ ID NO:18590 |
| | | NA | CGGACGAGTCAGGGCATTGG<br>CAATTATTTAGCC<br>SEQ ID NO:2567 | | AAAGCATCCAGTTTGCA<br>AAGT<br>SEQ ID NO:10579 | | CAACAGTATATGACTTACCC<br>GCTCACT<br>SEQ ID NO:18591 |
| iPS:435827 | 21-225_190H11 | AA | RTSQGIGNYLA<br>SEQ ID NO:2568 | | KASSLQS<br>SEQ ID NO:10580 | | QQYMTYPLT<br>SEQ ID NO:18592 |
| | | NA | AAGTCTAGTCAGAGCCTCT<br>CCATAGTGATGGAAGGACCT<br>ATTTGTAT<br>SEQ ID NO:2569 | | GAGGTTCCAACCGGTTC<br>GCT<br>SEQ ID NO:10581 | | ATGCAAAGTATACAGTTCC<br>CTGGACG<br>SEQ ID NO:18593 |
| iPS:435829 | 21-225_190B12 | AA | KSSQSLLHSDGRTYLY<br>SEQ ID NO:2570 | | EVSNRFA<br>SEQ ID NO:10582 | | MQSIQFPWT<br>SEQ ID NO:18594 |
| | | NA | CGGGCCAGTCAGAGTATTGG<br>TAGTAGCTTACAC<br>SEQ ID NO:2571 | | TATGCTTCCCAGTCCTTC<br>TCA<br>SEQ ID NO:10583 | | CATCAGACTAGAAGTTTACC<br>TCTCACT<br>SEQ ID NO:18595 |
| iPS:435831 | 21-225_190C12 | AA | RASQSIGSSLH<br>SEQ ID NO:2572 | | YASQSFS<br>SEQ ID NO:10584 | | HQTRSLPLT<br>SEQ ID NO:18596 |
| | | NA | CGGGCAAGTCAGGGCATTAG<br>AAAAGATTTAGGC<br>SEQ ID NO:2573 | | ACTGCATCCAGTTTGCAA<br>AGT<br>SEQ ID NO:10585 | | CTACAGCATAATAGTTACCC<br>GTGGACG<br>SEQ ID NO:18597 |
| iPS:435833 | 21-225_190D12 | AA | RASQGIRKDLG<br>SEQ ID NO:2574 | | TASSLQS<br>SEQ ID NO:10586 | | LQHNSYPWT<br>SEQ ID NO:18598 |
| | | NA | CGGGCGAGTCAGGGCATTAG<br>CAATTATTTAGCC<br>SEQ ID NO:2575 | | GTTGCATCCACTTTGCAA<br>TCA<br>SEQ ID NO:10587 | | CAAAAGTATAACAGTGCCCC<br>ATTCACT<br>SEQ ID NO:18599 |
| iPS:435835 | | AA | RASQGISNYLA<br>SEQ ID NO:2576 | | VASTLQS<br>SEQ ID NO:10588 | | QKYNSAPFT<br>SEQ ID NO:18600 |
| | | NA | CGGGCGAGTCAGGGCATTGG<br>CAAGTATTTAGCC | | GCTGCATCCAGTTTGCAA<br>AGT | | CAAGATATGATACTTACCC<br>ATTCACT |

FIGURE 49
(Continued)

| | | | | | | | |
|---|---|---|---|---|---|---|---|
| iPS:435837 | 21-225_190F12 | AA | SEQ ID NO:2577<br>RASQGIGKYLA<br>SEQ ID NO:2578 | SEQ ID NO:10589<br>AASSLQS<br>SEQ ID NO:10590 | SEQ ID NO:18601<br>QRYDTYPFT<br>SEQ ID NO:18602 |
| iPS:435839 | 21-225_198G3 | NA | CGGACGAGTCAGGGCATTGG<br>CAAGTATTTAGCC<br>SEQ ID NO:2579 | AAAGCATCCAGTTGCA<br>AGGT<br>SEQ ID NO:10591 | CAACAGTATATGACTTACCC<br>GCTCACT<br>SEQ ID NO:18603 |
| | | AA | RTSQGIGKYLA<br>SEQ ID NO:2580 | KASSLQG<br>SEQ ID NO:10592 | QQYMTYPLT<br>SEQ ID NO:18604 |
| iPS:435841 | 21-225_191B1 | NA | AGGTCTAGTCAGAGCCTCCT<br>GCATAGTGATGGAAAGACCT<br>ATTTGTTT<br>SEQ ID NO:2581 | GAACTTTCCAACCGGTTC<br>TCT<br>SEQ ID NO:10593 | ATGCAAAGTTTCCAGCTTCC<br>CTGGACG<br>SEQ ID NO:18605 |
| | | AA | RSSQSLLHSDGKTYLF<br>SEQ ID NO:2582 | ELSNRFS<br>SEQ ID NO:10594 | MQSFQLPWT<br>SEQ ID NO:18606 |
| iPS:435843 | 21-225_191D8 | NA | AGGTCCAGCCAGAGTGTTT<br>ACACAGCTCCAACAATTACA<br>ACTACTAGCT<br>SEQ ID NO:2583 | TGGGCATCTACCCGGGA<br>ATCC<br>SEQ ID NO:10595 | CAACAATATTATAGTACTCC<br>TCCGACG<br>SEQ ID NO:18607 |
| | | AA | RSSQSVLHSSNNYNYLA<br>SEQ ID NO:2584 | WASTRES<br>SEQ ID NO:10596 | QQYYSTPPT<br>SEQ ID NO:18608 |
| iPS:435843 | 21-225_191F1 | NA | AGGGCCAGTCAGAGTATTAG<br>CCTCAACTTCTTAGCC<br>SEQ ID NO:2585 | GGTGCATCCAGCAGGGC<br>CACT<br>SEQ ID NO:10597 | CAGCAGTATGGTAGGTCACC<br>GTGGACG<br>SEQ ID NO:18609 |
| | | AA | RASQSISLNFLA<br>SEQ ID NO:2586 | GASSRAT<br>SEQ ID NO:10598 | QQYGRSPWT<br>SEQ ID NO:18610 |
| iPS:435845 | 21-225_191G1 | NA | CGGGCGAGTCAGGGCATTAG<br>CAATTATTTAGCC<br>SEQ ID NO:2587 | GCTGCATCCAGTTTGCAA<br>AGT<br>SEQ ID NO:10599 | CAACATTATCTTACTTACCCT<br>CTCACT<br>SEQ ID NO:18611 |
| | | AA | RASQGISNYLA<br>SEQ ID NO:2588 | AASSLQS<br>SEQ ID NO:10600 | QHYLTYPLT<br>SEQ ID NO:18612 |

FIGURE 49
(Continued)

| | | | | |
|---|---|---|---|---|
| iPS:435847 | 21-225_191A3 | NA | AGGGCCAGTCAGAGTATTCG CAGCAGCTTCTTAGCC SEQ ID NO:2589 | GGTGCATCCAGCAGGGC CACT SEQ ID NO:10601 | CAGCAATATGGTAACTCACC GTGGGCG SEQ ID NO:18613 |
| | | AA | RASQSIRSSFLA SEQ ID NO:2590 | GASSRAT SEQ ID NO:10602 | QQYGNSPWA SEQ ID NO:18614 |
| iPS:435849 | 21-225_191C3 | NA | AGGGCCAGTCAGAGTATTCG CAGCAGCTTCTTAGCC SEQ ID NO:2591 | GGTGCATCCAGCAGGGC CACT SEQ ID NO:10603 | CAGCAGTATGGTAACTCACC GTGGGCG SEQ ID NO:18615 |
| | | AA | RASQSIRSSFLA SEQ ID NO:2592 | GASSRAT SEQ ID NO:10604 | QQYGNSPWA SEQ ID NO:18616 |
| iPS:435851 | 21-225_191D3 | NA | AGGGCCGGTCAAAGTATTAG AACCAACTTCTTAGCC SEQ ID NO:2593 | GGTGCATCCAGCAGGGC CACT SEQ ID NO:10605 | CAGCAGTATGGTAGCTCACC GTGGACG SEQ ID NO:18617 |
| | | AA | RAGQSIRTNFLA SEQ ID NO:2594 | GASSRAT SEQ ID NO:10606 | QQYGSSPWT SEQ ID NO:18618 |
| iPS:435853 | 21-225_191E3 | NA | AAGTCTAGTCAGAGCCTCCT CCATAGTGATGGAAGGACCT ATTTGTAT SEQ ID NO:2595 | GAGGTTTCCAACCGGTTC GCT SEQ ID NO:10607 | ATGCAAAGTATACAACTTCC CTGGACG SEQ ID NO:18619 |
| | | AA | KSSQSLLHSDGRTYLY SEQ ID NO:2596 | EVSNRFA SEQ ID NO:10608 | MQSIQLPWT SEQ ID NO:18620 |
| iPS:435855 | 21-225_191G3 | NA | AAGTCCAGCAGTCAGAGTGTTT ACACAGTCCAACAGTACA ACTACTTAGCT SEQ ID NO:2597 | TGGGCATCTACCCGAAA ATCC SEQ ID NO:10609 | CAGCAATATATTATAGTAGTCC TCCCACT SEQ ID NO:18621 |
| | | AA | KSSQSVLHSSNSYNYLA SEQ ID NO:2598 | WASTRKS SEQ ID NO:10610 | QQYYSSPPT SEQ ID NO:18622 |
| iPS:435857 | 21-225_191A4 | NA | CGGGCAAGTCAGGGCATTAG AAAAGATTAGGC SEQ ID NO:2599 | ACTGCATCCAGTTTGCAA AAT SEQ ID NO:10611 | CTACAGCATAATAGTTACCC GTGGACG SEQ ID NO:18623 |

FIGURE 49
(Continued)

| | | | | | TASSLQN | | LQHNSYPWT | |
|---|---|---|---|---|---|---|---|---|
| | | | RASQGIRKDLG | | | | | |
| | | AA | SEQ ID NO:2600 | | SEQ ID NO:10612 | | SEQ ID NO:18624 | |
| iPS:435859 | 21-225_190E6 | NA | CGGACGAGTCAGGGCATTGG CAATTATTTAGCC SEQ ID NO:2601 | | AAAGCATCCAGTTTGCA AGT SEQ ID NO:10613 | | CAACAGTATATGACTTACCC GCTCACT SEQ ID NO:18625 | |
| | | AA | RTSQGIGNYLA SEQ ID NO:2602 | | KASSLQS SEQ ID NO:10614 | | QQYMTYPLT SEQ ID NO:18626 | |
| iPS:435861 | 21-225_190A5 | NA | CGGGCGAGTCAGGGGATTG GCAATCATTTAGCC SEQ ID NO:2603 | | GCTGCATCCAGTTTGCAA AGT SEQ ID NO:10615 | | CAACAGTATAGTAATTACCC AGTCACT SEQ ID NO:18627 | |
| | | AA | RASQGIGNHLA SEQ ID NO:2604 | | AASSLQS SEQ ID NO:10616 | | QQYSNYPVT SEQ ID NO:18628 | |
| iPS:435863 | 21-225_191H4 | NA | CGGGCCAATCAGAGACATTGG TAGTAGCTTACAC SEQ ID NO:2605 | | TATGCTTCCCAGTCCCTC TCA SEQ ID NO:10617 | | CATCAGACTGGTAGGTTACC TCTCACT SEQ ID NO:18629 | |
| | | AA | RANQSIGSSLH SEQ ID NO:2606 | | YASQSLS SEQ ID NO:10618 | | HQTGRLPLT SEQ ID NO:18630 | |
| iPS:435865 | 21-225_191A5 | NA | AGGGCCAGTCAGAGTGTTAG CAGCAGGTTCTTAGCC SEQ ID NO:2607 | | GGTGCTTCCAACAGGGC CACT SEQ ID NO:10619 | | CAGCAGTATGGTGGTTCACC TCCGTGGACG SEQ ID NO:18631 | |
| | | AA | RASQSVSSRFLA SEQ ID NO:2608 | | GASNRAT SEQ ID NO:10620 | | QQYGGSPPWT SEQ ID NO:18632 | |
| iPS:435867 | 21-225_191E5 | NA | CGGGCCAGTCAGAGACATTGG TAGTAGCTTACAC SEQ ID NO:2609 | | TATGCTTCCCAGTCCTTC TCA SEQ ID NO:10621 | | CATCAGAGTAGTAGTTTCCC TCGGACG SEQ ID NO:18633 | |
| | | AA | RASQSIGSSLH SEQ ID NO:2610 | | YASQSFS SEQ ID NO:10622 | | HQSSSFPRT SEQ ID NO:18634 | |
| iPS:435869 | 21-225_190B1 | NA | CGGGCGAGTCAGGGCATTAG AAATTATTTAGCC SEQ ID NO:2611 | | GTTGCATCCAGTTTGGAA AGT SEQ ID NO:10623 | | CAACAGTATCTTAATTACCC AGTCACT SEQ ID NO:18635 | |

FIGURE 49
(Continued)

| | | | | | | | |
|---|---|---|---|---|---|---|---|
| iPS:435871 | 21-225_191E6 | AA | RASQGIRNYLA | | VASSLES | | QQYLNYPVT |
| | | | SEQ ID NO:2612 | | SEQ ID NO:10624 | | SEQ ID NO:18636 |
| | | NA | AAGTCTAGTCAGAGCCTCCT CCATAGTGATGGAAGGACCT ATTTGTAT | | GAGGTTTCCAACCGGTTC GCT | | ATGCAAAGTATACATTTTCC CTGGACG |
| | | | SEQ ID NO:2613 | | SEQ ID NO:10625 | | SEQ ID NO:18637 |
| iPS:435873 | 21-225_190G4 | AA | KSSQSLLHSDGRTYLY | | EVSNRFA | | MQSIHFPWT |
| | | | SEQ ID NO:2614 | | SEQ ID NO:10626 | | SEQ ID NO:18638 |
| | | NA | CGGGCGAGTCAGGACATTGG CAGATATTTAGCC | | GCTGCATCCAGTTTGCAA AGT | | CAACAATATAGTACTTACCC GCTCACT |
| | | | SEQ ID NO:2615 | | SEQ ID NO:10627 | | SEQ ID NO:18639 |
| iPS:435875 | 21-225_190B9 | AA | RASQDIGRYLA | | AASSLQS | | QQYSTYPLT |
| | | | SEQ ID NO:2616 | | SEQ ID NO:10628 | | SEQ ID NO:18640 |
| | | NA | CGGGCGAGTCAGGGTATTAA CAACTGGTTAGCC | | GGTGTTTCCAGTTTGCAG AGT | | CAACAGGCTAACAGTTTCCC GTGGACG |
| | | | SEQ ID NO:2617 | | SEQ ID NO:10629 | | SEQ ID NO:18641 |
| iPS:435877 | 21-225_184E7 | AA | RASQGINNWLA | | GVSSLQS | | QQANSFPWT |
| | | | SEQ ID NO:2618 | | SEQ ID NO:10630 | | SEQ ID NO:18642 |
| | | NA | CGGGCGAGTCAGGGCATTAG CAATTATTTAGCC | | GCTGCATCCAGTTTGCAA AGT | | CAACAGTATAATGGTTACCC ATTCACT |
| | | | SEQ ID NO:2619 | | SEQ ID NO:10631 | | SEQ ID NO:18643 |
| iPS:435879 | 21-225_184H10 | AA | RASQGISNYLA | | AASSLQS | | QQYNGYPFT |
| | | | SEQ ID NO:2620 | | SEQ ID NO:10632 | | SEQ ID NO:18644 |
| | | NA | CGGGCAAGTCAGGGCATTAG AAATGATTTAGGC | | ATTGCATCCAGTTTGCAA AGT | | CTACAGCATAATAGTTACCC ATTCACT |
| | | | SEQ ID NO:2621 | | SEQ ID NO:10633 | | SEQ ID NO:18645 |
| iPS:435881 | | AA | RASQGIRNDLG | | IASSLQS | | LQHNSYPFT |
| | | | SEQ ID NO:2622 | | SEQ ID NO:10634 | | SEQ ID NO:18646 |
| | | NA | CGGGCAAGTCAGGGCATTAG AAATGATTTAGGC | | ATTGCATCCAGTTTGCAA AGT | | CTACAGCATAATAGTTACCC ATTCACT |

FIGURE 49
(Continued)

| | | | | | | |
|---|---|---|---|---|---|---|
| iPS:435883 | 21-225_184D11 | | SEQ ID NO:2623 | SEQ ID NO:10635 | | SEQ ID NO:18647 |
| | | AA | RASQGIRNDLG | IASSLQS | | LQHNSYPFT |
| | | NA | SEQ ID NO:2624 | SEQ ID NO:10636 | | SEQ ID NO:18648 |
| iPS:435885 | 21-225_185A1 | | CGGGCGAGTCAGGGCATTAGGCATTAG CAATTATTAGCC | GTTGCATCCAGTTTGCAA AGT | | CGACAATATCATAGTTACCC ATTCACT |
| | | | SEQ ID NO:2625 | SEQ ID NO:10637 | | SEQ ID NO:18649 |
| | | AA | RASQGISNYLA | VASSLQS | | RQYHSYPFT |
| | | NA | SEQ ID NO:2626 | SEQ ID NO:10638 | | SEQ ID NO:18650 |
| iPS:435885 | 21-225_185E10 | | CGGGCGAGTCAGGGCATTAG CAATTATTAGCC | GCTGCATCCAGTTTGCAA AGT | | CAACAGTATAATGGTTACCC ATTCACT |
| | | | SEQ ID NO:2627 | SEQ ID NO:10639 | | SEQ ID NO:18651 |
| | | AA | RASQGISNYLA | AASSLQS | | QQYNGYPFT |
| | | NA | SEQ ID NO:2628 | SEQ ID NO:10640 | | SEQ ID NO:18652 |
| iPS:435887 | 21-225_186F7 | | AAGTCTAGTCAGAGCCTCCT GCATGGTGATGAAAGACCT ATTTGTGT | GAAGTTTCCAAGCGGTT CTCT | | ATGCAAAGTATACAGGTTCC CTGGACG |
| | | | SEQ ID NO:2629 | SEQ ID NO:10641 | | SEQ ID NO:18653 |
| | | AA | KSSQSLLHGDGKTYLC | EVSKRFS | | MQSIQVPWT |
| | | NA | SEQ ID NO:2630 | SEQ ID NO:10642 | | SEQ ID NO:18654 |
| iPS:435889 | 21-225_186A11 | | CGGGCGAGTCAGGGATATTAC CAGCTGGTTAGCC | GCTGCATCCAGTTTACAA AGT | | CAACAGGTTAACAGTTTCCC ATTCACT |
| | | | SEQ ID NO:2631 | SEQ ID NO:10643 | | SEQ ID NO:18655 |
| | | AA | RASQDITSWLA | AASSLQS | | QQVNSFPFT |
| | | NA | SEQ ID NO:2632 | SEQ ID NO:10644 | | SEQ ID NO:18656 |
| iPS:435891 | 21-225_188H5 | | CGGGCGAGTCAGGGCATTAG CAATTATTAGCC | GCTGCTTCCAGTTTGCAA AGT | | CAACAGTATAATAGTTATCC ATTCACT |
| | | | SEQ ID NO:2633 | SEQ ID NO:10645 | | SEQ ID NO:18657 |
| | | AA | RASQGISNYLA | AASSLQS | | QQYNSYPFT |
| | | NA | SEQ ID NO:2634 | SEQ ID NO:10646 | | SEQ ID NO:18658 |

FIGURE 49
(Continued)

| | | | | | |
|---|---|---|---|---|---|
| iPS:435895 | 21-225_188E8 | NA | CGGGCGAATCAGGATATTTC CAGCTGGTTAGCC SEQ ID NO:2635 | GCTGCATCCAATTTGCAA AGT SEQ ID NO:10647 | CAGCAGGCTAACAGTTTCCC GTGGACG SEQ ID NO:18659 |
| | | AA | RANQDISSWLA SEQ ID NO:2636 | AASNLQS SEQ ID NO:10648 | QQANSFPWT SEQ ID NO:18660 |
| iPS:435897 | 21-225_188B9 | NA | CGGGCGAGTCAGGCATTAG CAATTATTTAGCC SEQ ID NO:2637 | GCTGCATCCAGTTTGCAA AGT SEQ ID NO:10649 | CAACAGTATAATAGTTACCC ATTCACT SEQ ID NO:18661 |
| | | AA | RASQGISNYLA SEQ ID NO:2638 | AASSLQS SEQ ID NO:10650 | QQYNSYPFT SEQ ID NO:18662 |
| iPS:435899 | 21-225_188G11 | NA | ATGTCTAGTCAGAGCCTCCT GCATGGTGATGGAAAGACCT ATTTATAT SEQ ID NO:2639 | GAAGTTTCCAACCGGTTC TCT SEQ ID NO:10651 | ATGCAAAGTATACAGATTCC TTGGACG SEQ ID NO:18663 |
| | | AA | MSSQSLLHGDGKTYLY SEQ ID NO:2640 | EVSNRFS SEQ ID NO:10652 | MQSIQIPWT SEQ ID NO:18664 |
| iPS:435901 | 21-225_189G2 | NA | AAGTCTAGTCAGAGCCTCCT GCATGGTGATGGAAAGACCT ATTTGTTT SEQ ID NO:2641 | GAAGTTTCCAACCGGTTC TCT SEQ ID NO:10653 | ATGCAAAGTATACAGATTCC GTGGACG SEQ ID NO:18665 |
| | | AA | KSSQSLLHGDGKTYLF SEQ ID NO:2642 | EVSNRFS SEQ ID NO:10654 | MQSIQIPWT SEQ ID NO:18666 |
| iPS:435903 | 21-225_190E2 | NA | AAGTCCAGCCAGAGTGTTT ATTCAACTCCAACAATAAGA ACTACTTAGCT SEQ ID NO:2643 | TGGGCATCTACCCGGGA ATCC SEQ ID NO:10655 | CAGCAATATTGTAGTCTTCC ATTCACT SEQ ID NO:18667 |
| | | AA | KSSQSVLFNSNKNYLA SEQ ID NO:2644 | WASTRES SEQ ID NO:10656 | QQYCSLPFT SEQ ID NO:18668 |
| iPS:435905 | | NA | AGGGCCAGTCAGAATATAA GGAGCAACTTCTTAGCC | GGTGCATCCAGCAGGGC CACT | CAGCAGTATGGTAACTCACC GTGGACG |

FIGURE 49
(Continued)

| | | | SEQ ID NO:2645 | SEQ ID NO:10657 | SEQ ID NO:18669 |
|---|---|---|---|---|---|
| | 21-225_190A3 | AA | RASQNIRSNFLA | GASSRAT | QQYGNSPWT |
| iPS:435907 | | NA | SEQ ID NO:2646<br>CGGGCAAGTCAGGGCATTAG<br>AAAAGATTAGGC | SEQ ID NO:10658<br>ACTGCATCCAGTTGCAA<br>AGT | SEQ ID NO:18670<br>CTACAGCATAATAGTTACCC<br>GTGGACG |
| iPS:435909 | 21-225_190G3 | AA | SEQ ID NO:2647<br>RASQGIRKDLG | SEQ ID NO:10659<br>TASSLQS | SEQ ID NO:18671<br>LQHNSYPWT |
| | | | SEQ ID NO:2648 | SEQ ID NO:10660 | SEQ ID NO:18672 |
| | 21-225_190H3 | NA | CGGGCGAGTCAGGGTCTTAA<br>CAACTGGTTAGCC | GCTGTGTCCAGTTGCAA<br>AGT | CAACAGGCTAACAGTCTCCC<br>GTGGACG |
| iPS:435911 | | AA | SEQ ID NO:2649<br>RASQGLNNWLA | SEQ ID NO:10661<br>AVSSLQS | SEQ ID NO:18673<br>QQANSLPWT |
| | | | SEQ ID NO:2650 | SEQ ID NO:10662 | SEQ ID NO:18674 |
| | 21-225_190B4 | NA | AGGGCCAGTCAGAGTATTCG<br>CAGCAGCTTCTTAGCC | GGTGCATCCAGCAGGGC<br>CACT | CAGCAGTATGGTAACTCACC<br>GTGGGCG |
| iPS:435913 | | AA | SEQ ID NO:2651<br>RASQSIRSSFLA | SEQ ID NO:10663<br>GASSRAT | SEQ ID NO:18675<br>QQYGNSPWA |
| | | | SEQ ID NO:2652 | SEQ ID NO:10664 | SEQ ID NO:18676 |
| | 21-225_190A7 | NA | AGGGCCAGTCAGAGTGTTAG<br>AAGCAACTTCTTAGCC | GGTGCATACCGCAGGGC<br>CACT | CAGCAGTATGGTAACTCACC<br>GTGGACG |
| iPS:435915 | | AA | SEQ ID NO:2653<br>RASQSVRSNFLA | SEQ ID NO:10665<br>GAYRRAT | SEQ ID NO:18677<br>QQYGNSPWT |
| | | | SEQ ID NO:2654 | SEQ ID NO:10666 | SEQ ID NO:18678 |
| | 21-225_190H4 | NA | AAGTCCAGCCAGAGTGTTT<br>ACACAGCTCCAACAATTACA<br>ACTACTTAGCT | TGGGCATCTACCCGGGA<br>ATCC | CAGCAATATTATAGTATTCC<br>TCCCACT |
| | | AA | SEQ ID NO:2655<br>KSSQSVLHSSNNYNYLA | SEQ ID NO:10667<br>WASTRES | SEQ ID NO:18679<br>QQYYSIPPT |
| | | | SEQ ID NO:2656 | SEQ ID NO:10668 | SEQ ID NO:18680 |

FIGURE 49
(Continued)

| | | | | |
|---|---|---|---|---|
| iPS:435917 | 21-225_190D5 | NA | CGGGCCAGTCAGAGTATTGGTAGTAACTTACAC SEQ ID NO:2657 | TCTGCTTCCCAGTCCTTCTCA SEQ ID NO:10669 | CAGCAGAGTAGTAGTTTACCGTGGACG SEQ ID NO:18681 |
| | | AA | RASQSIGSNLH SEQ ID NO:2658 | SASQSFS SEQ ID NO:10670 | QQSSSLPWT SEQ ID NO:18682 |
| iPS:435919 | 21-225_190H5 | NA | CGGGCAAGTCAGGGCATTAGAAAAGATTTAGGC SEQ ID NO:2659 | ACTGCATCCAGTTGCAAAGT SEQ ID NO:10671 | CTACACGCATATAATAATTACCCGTGGACG SEQ ID NO:18683 |
| | | AA | RASQGIRKDLG SEQ ID NO:2660 | TASSLQS SEQ ID NO:10672 | LQHNNYPWT SEQ ID NO:18684 |
| iPS:435921 | 21-225_190D6 | NA | CGGGCAAGTCAGGGCATTAGAAATGATTTAGGC SEQ ID NO:2661 | GCTGCATCCAGTTTGCAAAGT SEQ ID NO:10673 | CTACAGCATTATAGTTTCCCATTCACT SEQ ID NO:18685 |
| | | AA | RASQGIRNDLG SEQ ID NO:2662 | AASSLQS SEQ ID NO:10674 | LQHYSFPFT SEQ ID NO:18686 |
| iPS:435923 | 21-225_190H6 | NA | AAGTCCAGCCAGAGTGTTTTATTCAACTCCAACAATAAGAACTACTTAGCT SEQ ID NO:2663 | TGGGCATCTACCCGGAAATCC SEQ ID NO:10675 | CAGCAATATTGTAGTCTTCCATTCACT SEQ ID NO:18687 |
| | | AA | KSSQSVLFNSNMKNYLA SEQ ID NO:2664 | WASTRES SEQ ID NO:10676 | QQYCSLPFT SEQ ID NO:18688 |
| iPS:435925 | 21-225_190D7 | NA | AAGTCCAGCCAGAGTGTTTTATCCAGCTCCAACAATTACAACTATTTAGTT SEQ ID NO:2665 | TGGGCATCTACCCGGAAATCC SEQ ID NO:10677 | CAACAATATTATCGTACTCCGTGGACG SEQ ID NO:18689 |
| | | AA | KSSQSVLSSSNNYNYLV SEQ ID NO:2666 | WASTRKS SEQ ID NO:10678 | QQYYRTPWT SEQ ID NO:18690 |
| iPS:435927 | 21_225_190E7 | NA | AAGTCTAGTCAGAGCCTCCTCCATAGTGATGGAAGGACCTATTTGTAT | GAGGTTTCCAACCGGTTCTCT | ATGCAAAGTATACAGCTTCCCTGGACG |

FIGURE 49
(Continued)

| | | | | | |
|---|---|---|---|---|---|
| iPS:435929 | 21-225_190E7 | AA | SEQ ID NO:2667 KSSQSLLHSDGRTYLY | SEQ ID NO:10679 EVSNRFS | SEQ ID NO:18691 MQSIQLPWT |
| | | NA | SEQ ID NO:2668 CGGGCCAGTCAGAGCATTGGTAGTAGCTTACAC | SEQ ID NO:10680 TATGCTTCCCAGTCCTTCTCA | SEQ ID NO:18692 CATCAGAGTAGTAGTTTCCCTCGGACG |
| iPS:435933 | 21-225_190D9 | AA | SEQ ID NO:2669 RASQSIGSSLH | SEQ ID NO:10681 YASQSFS | SEQ ID NO:18693 HQSSSFPRT |
| | | NA | SEQ ID NO:2670 CGGACGAGTCAGGGCATTGGCAATTATTTAGCC | SEQ ID NO:10682 AAAGCATCCAGTTTACAAGT | SEQ ID NO:18694 CAACAGTATATGACTTACCCACTCACT |
| iPS:435935 | 21-225_190F8 | AA | SEQ ID NO:2671 RTSQGIGNYLA | SEQ ID NO:10683 KASSLQS | SEQ ID NO:18695 QQYMTYPLT |
| | | NA | SEQ ID NO:2672 CGGGCCAGTCAGAGCATTGGTAGTAGCTTACAC | SEQ ID NO:10684 TATGCTTCCCAGTCCTTCTCA | SEQ ID NO:18696 CATCAGAGTAGTAGTTTCCCTCGGACG |
| iPS:435937 | 21-225_190H8 | AA | SEQ ID NO:2673 RASQSIGSSLH | SEQ ID NO:10685 YASQSFS | SEQ ID NO:18697 HQSSSFPRT |
| | | NA | SEQ ID NO:2674 CGGGCGAGTCAGGGCATTGGCAAGTATTTAGCC | SEQ ID NO:10686 GCTGCATCCAGTTTGCAAAGT | SEQ ID NO:18698 CAACGATATGATACTTACCCATTCACT |
| iPS:435939 | 21-225_190H9 | AA | SEQ ID NO:2675 RASQGIGKYLA | SEQ ID NO:10687 AASSLQS | SEQ ID NO:18699 QRYDTYPPT |
| | | NA | SEQ ID NO:2676 AGGGCCGGTCAAAGTATTAGAACCGACTTCTTAGCC | SEQ ID NO:10688 GGTCCATCCAGCAGGGCCACT | SEQ ID NO:18700 CAGCAGTATGGTAGCTCACCGTGGACG |
| iPS:435941 | 21-225_191H7 | AA | SEQ ID NO:2677 RAGQSIRTDFLA | SEQ ID NO:10689 GPSSRAT | SEQ ID NO:18701 QQYGSSPWT |
| | | NA | SEQ ID NO:2678 AGGCCCAGTCAGAGTTTTAGCAGAAACTTAGCC | SEQ ID NO:10690 GGTGCATCCACTAGGGCCACT | SEQ ID NO:18702 CAGCAGTATAATAACTGGCCGCTCACT |

FIGURE 49
(Continued)

| | | | | SEQ ID NO:2679 | | SEQ ID NO:10691 | | SEQ ID NO:18703 |
|---|---|---|---|---|---|---|---|---|
| | 21-225_191E8 | | AA | RPSQSFSRNLA | | GASTRAT | | QQYNNWPLT |
| iPS:435943 | | | | SEQ ID NO:2680 | | SEQ ID NO:10692 | | SEQ ID NO:18704 |
| | 21-225_191C9 | | NA | CGGGCCAGTCAGAGTATTGG TAGTAGTTTACAC | | TATGCTTCCCAGTCCTTC TCA | | CATCAGACTAGAAGTTTACC TCTCACT |
| | | | | SEQ ID NO:2681 | | SEQ ID NO:10693 | | SEQ ID NO:18705 |
| iPS:435945 | | | AA | RASQSIGSSLH | | YASQSFS | | HQTRSLPLT |
| | | | | SEQ ID NO:2682 | | SEQ ID NO:10694 | | SEQ ID NO:18706 |
| | 21-225_191A10 | | NA | CGGGCGAGTCAGGGCATTGG CAAGTATTTAGCC | | GCTGCATCCAGTTTGCAA AGT | | CAACAGTATAGTACTTACCC GCTCACT |
| | | | | SEQ ID NO:2683 | | SEQ ID NO:10695 | | SEQ ID NO:18707 |
| iPS:435947 | | | AA | RASQGIGKYLA | | AASSLQS | | QQYSTYPLT |
| | | | | SEQ ID NO:2684 | | SEQ ID NO:10696 | | SEQ ID NO:18708 |
| | 21-225_191E10 | | NA | CGGGCGAGTCAGGGCATTGG CAAGTATTTAGCC | | GCTGCATCCAGTTTGCAA AGT | | CAACAGTATAGTACTTACCC GCTCACT |
| | | | | SEQ ID NO:2685 | | SEQ ID NO:10697 | | SEQ ID NO:18709 |
| | | | AA | RASQGIGKYLA | | AASSLQS | | QQYSTYPLT |
| | | | | SEQ ID NO:2686 | | SEQ ID NO:10698 | | SEQ ID NO:18710 |
| | 21-225_191B12 | | NA | AAGTCCAGCCAGCCAGAGTGTTTT ATTCAACTCCAACAATAAGA ACTACTTAGCT | | TGGGCCTCTACCCGGGA ATCC | | CAGCAATATTCTAGTCTTCC ATTCACT |
| iPS:435953 | | | | SEQ ID NO:2687 | | SEQ ID NO:10699 | | SEQ ID NO:18711 |
| | | | AA | KSSQSVLFNSNNKNYLA | | WASTRES | | QQYSSLPFT |
| | | | | SEQ ID NO:2688 | | SEQ ID NO:10700 | | SEQ ID NO:18712 |
| | 21-225_191G12 | | NA | CGGACGAGTCAGGGCATTGG CAATTATTTAGCC | | AAAGCATCCAGTTTGCA AAGT | | CAACAGTATATCACTTACCC GCTCACT |
| iPS:435957 | | | | SEQ ID NO:2689 | | SEQ ID NO:10701 | | SEQ ID NO:18713 |
| | | | AA | RTSQGIGNYLA | | KASSLQS | | QQYITYPLT |
| | | | | SEQ ID NO:2690 | | SEQ ID NO:10702 | | SEQ ID NO:18714 |

FIGURE 49
(Continued)

| | | | | | |
|---|---|---|---|---|---|
| iPS:435961 | 21-225_192A2 | NA | CGGGGCGAATCAGGGCATTAA CAATTATTTAGCC<br>SEQ ID NO:2691 | GCTGCATCCAGTTTGCAA AGT<br>SEQ ID NO:10703 | CAACAGTATAATAGTTACCC ATTCACT<br>SEQ ID NO:18715 |
| | | AA | RANQGINNYLA<br>SEQ ID NO:2692 | AASSLQS<br>SEQ ID NO:10704 | QQYNSYPFT<br>SEQ ID NO:18716 |
| iPS:435963 | 21-225_192D2 | NA | CGGGCGAGTCAGGGCATTAG CAATTATTTAGCC<br>SEQ ID NO:2693 | GCTGCATCCAGTTTGCAA AGT<br>SEQ ID NO:10705 | CAACATTATGTTACTTACCC GAACACT<br>SEQ ID NO:18717 |
| | | AA | RASQGISNYLA<br>SEQ ID NO:2694 | AASSLQS<br>SEQ ID NO:10706 | QHYVTYPNT<br>SEQ ID NO:18718 |
| iPS:435965 | 21-225_192H2 | NA | CGGGCGAGTCAGGGTATAA GTAGTTGGATATAGCC<br>SEQ ID NO:2695 | GGTGCATCCAGTTTGCA AAGT<br>SEQ ID NO:10707 | CAACAGTCTAACAGTTTCCC ATTCACT<br>SEQ ID NO:18719 |
| | | AA | RASQGISSWIA<br>SEQ ID NO:2696 | GASSLQS<br>SEQ ID NO:10708 | QQSNSFPFT<br>SEQ ID NO:18720 |
| iPS:435967 | 21-225_192B3 | NA | AGGGCCAGTCAGAGTGTTCG CAGCAGCTTCCTTGCC<br>SEQ ID NO:2697 | GGTGCATCTAGCAGGGC CACT<br>SEQ ID NO:10709 | CAGCAGTATGGTAACTCACC GTGGGCG<br>SEQ ID NO:18721 |
| | | AA | RASQSVRSSFLA<br>SEQ ID NO:2698 | GASSRAT<br>SEQ ID NO:10710 | QQYGNSPWA<br>SEQ ID NO:18722 |
| iPS:435971 | 21-225_192D3 | NA | CGGGCGAGTCAGGGCATTAG CAATTATTTAGCC<br>SEQ ID NO:2699 | GCTGCATCCAGTTTGCAA AGT<br>SEQ ID NO:10711 | CTACATTATCTTACTTACCCT CTCACT<br>SEQ ID NO:18723 |
| | | AA | RASQGISNYLA<br>SEQ ID NO:2700 | AASSLQS<br>SEQ ID NO:10712 | LHYLTYPLT<br>SEQ ID NO:18724 |
| iPS:435973 | 21-225_192H3 | NA | AGGGCCAGTCAGAGTGTTAG CAGCAACTTCTTAGCC<br>SEQ ID NO:2701 | GGTGCATCCAGCAGGGC CACT<br>SEQ ID NO:10713 | CAGCAATATGGTATCTCACC GTGGACG<br>SEQ ID NO:18725 |
| | | AA | RASQSVSSNFLA<br>SEQ ID NO:2702 | GASSRAT<br>SEQ ID NO:10714 | QQYGISPWT<br>SEQ ID NO:18726 |

FIGURE 49
(Continued)

| | | | | | |
|---|---|---|---|---|---|
| iPS:435977 | 21-225_192E4 | NA | CGGGGCGAGTCAGGGCATTAG CAATTATTTAGCC SEQ ID NO:2703 | GTTGTATCCAGTTTACAA AGT SEQ ID NO:10715 | CAACGGTATGATACTTACCC ATTCACT SEQ ID NO:18727 |
| | | AA | RASQGIGNYLA SEQ ID NO:2704 | VVSSLQS SEQ ID NO:10716 | QRYDTYPFT SEQ ID NO:18728 |
| iPS:435979 | 21-225_192H4 | NA | CGGGCGAGTCAGGACATTAG CAATTATTTAGCC SEQ ID NO:2705 | GCTGCATCCAGTTTGCAA AGT SEQ ID NO:10717 | CTACATTATCTCAATTACCC GCTCACT SEQ ID NO:18729 |
| | | AA | RASQDISNYLA SEQ ID NO:2706 | AASSLQS SEQ ID NO:10718 | LHYLNYPLT SEQ ID NO:18730 |
| iPS:435983 | 21-225_192E5 | NA | CGGGCCAGTCAGAGCATTGG TAGGAGTTTACAC SEQ ID NO:2707 | TATGCTTCCCAGTCATTC TCA SEQ ID NO:10719 | CATCAGAGTAGTCGTTACC GCTCACT SEQ ID NO:18731 |
| | | AA | RASQSIGRSLH SEQ ID NO:2708 | YASQSFS SEQ ID NO:10720 | HQSSRLPLT SEQ ID NO:18732 |
| iPS:435985 | 21-225_192F6 | NA | CGGGCAAGTCAGGGCATTAG AAATGATTTAGCC SEQ ID NO:2709 | GCTGCATCCAGTTTGCAA AGT SEQ ID NO:10721 | CTACAGCATTATAGTTTCCC ATTCACT SEQ ID NO:18733 |
| | | AA | RASQGIRNDLG SEQ ID NO:2710 | AASSLQS SEQ ID NO:10722 | LQHYSFPFT SEQ ID NO:18734 |
| iPS:435987 | 21-225_192G6 | NA | CGGACGAGTCAGGGCATTGG CAATTATTTAGCC SEQ ID NO:2711 | AAAGCATCCAGTTTGCA AAGT SEQ ID NO:10723 | CAACAGTATATGACTTACCC GCTCACT SEQ ID NO:18735 |
| | | AA | RTSQGIGNYLA SEQ ID NO:2712 | KASSLQS SEQ ID NO:10724 | QQYMTYPLT SEQ ID NO:18736 |
| iPS:435989 | 21-225_192F7 | NA | CGGGCAAGTCAGGGCATTAG AAAAGATTTAGGC SEQ ID NO:2713 | ACTGCATCCAGTTTGCAA AGT SEQ ID NO:10725 | CTACAGCATACTAGTTACCC GTGGACG SEQ ID NO:18737 |
| | | AA | RASQGIRKDLG SEQ ID NO:2714 | TASSLQS SEQ ID NO:10726 | LQHTSYPWT SEQ ID NO:18738 |

FIGURE 49
(Continued)

| | | | | | |
|---|---|---|---|---|---|
| iPS:435993 | 21-225_192C8 | NA | CGGGCGAGTCAGGGCATTAG CAATTATTTAGCC SEQ ID NO:2715 | GCTGCATCCAGTTTGCAA AGT SEQ ID NO:10727 | CAACATTATCTTACTTACCCT CTCACT SEQ ID NO:18739 |
| | | AA | RASQGISNYLA SEQ ID NO:2716 | AASSLQS SEQ ID NO:10728 | QHYLTYPLT SEQ ID NO:18740 |
| iPS:435995 | 21-225_192F8 | NA | AGGGCCAGTCAGAGTATTAG CAGCAGCTACTTAGCC SEQ ID NO:2717 | GGTGCATCCAGCAGGGC CACT SEQ ID NO:10729 | CAGCAGTATGAGAGTTCACC GTGGACG SEQ ID NO:18741 |
| | | AA | RASQSISSSYLA SEQ ID NO:2718 | GASSRAT SEQ ID NO:10730 | QQYESSPWT SEQ ID NO:18742 |
| iPS:435997 | 21-225_192G8 | NA | CGGACGAGTCAGGGCATTGG CAATTATTTAGCC SEQ ID NO:2719 | AAAGCATCCAGTTTGCA AAGT SEQ ID NO:10731 | CAACAGTATATCACTTACCC GCTCACT SEQ ID NO:18743 |
| | | AA | RTSQGIGNYLA SEQ ID NO:2720 | KASSLQS SEQ ID NO:10732 | QQYITYPLT SEQ ID NO:18744 |
| iPS:435999 | 21-225_192F9 | NA | AAGTCTAGTCAGAGCCTCCT CCATAGTGATGGAAGGACCT ATTTGTAT SEQ ID NO:2721 | GAGGTTTCCAACCGGTC GCT SEQ ID NO:10733 | ATGCAAAGTATACAGCTTCC CTGGACG SEQ ID NO:18745 |
| | | AA | KSSQSLLHSDGRTYLY SEQ ID NO:2722 | EVSNRFA SEQ ID NO:10734 | MQSIQLPWT SEQ ID NO:18746 |
| iPS:436001 | 21-225_192C10 | NA | CGGGCGAGTCAGGGCATTGG CAAGTATTTAGCC SEQ ID NO:2723 | GCTGCATCCAGTTTGCAA AGT SEQ ID NO:10735 | CAACGATATGATACTTACCC ATTCACT SEQ ID NO:18747 |
| | | AA | RASQGIGKYLA SEQ ID NO:2724 | AASSLQS SEQ ID NO:10736 | QRYDTYPFT SEQ ID NO:18748 |
| iPS:436003 | 21-225_192G10 | NA | CGGGCAAGTCAGAGACATTAG CAACTATTTAAAT SEQ ID NO:2725 | GCTGAATCCAGTTTACA AAGT SEQ ID NO:10737 | CAACAGAGTTACAGTTCCCC TCCGTGGACG SEQ ID NO:18749 |
| | | AA | RASQSISNYLN | AESSLQS | QQSYSSPPWT |

FIGURE 49
(Continued)

| | | | | | |
|---|---|---|---|---|---|
| iPS:436005 | 21-225_192H10 | NA | SEQ ID NO:2726 CGGGCGAGTCAGGGCATTGGCAAGTATTTAGCC | SEQ ID NO:10738 GCTGCATCCAGTTTGCAAAGT | SEQ ID NO:18750 CAACAGTATAGTACTTACCGCTCACT |
| | | AA | SEQ ID NO:2727 RASQGIGKYLA | SEQ ID NO:10739 AASSLQS | SEQ ID NO:18751 QQYSTYPLT |
| iPS:436007 | 21-225_192G12 | NA | SEQ ID NO:2728 AGGGCCAGTCAGAGTGTCAGAAGGCGACTTCTTAGCC | SEQ ID NO:10740 GGTGTATCCCGCAGGGCCACT | SEQ ID NO:18752 CAGCAGTATGGTAACTCACCGTGGACG |
| | | AA | SEQ ID NO:2729 RASQSVRSDFLA | SEQ ID NO:10741 GVSRRAT | SEQ ID NO:18753 QQYGNSPWT |
| iPS:436009 | 21-225_193A1 | NA | SEQ ID NO:2730 AGGGCCAGTCAGAGTGTTAGAAGCAACTTCTTAGCC | SEQ ID NO:10742 GGTGCATCCCGCAGGGCCACT | SEQ ID NO:18754 CAGCAGTATGGTAACTCACCGTGGACG |
| | | AA | SEQ ID NO:2731 RASQSVRSNFLA | SEQ ID NO:10743 GASRRAT | SEQ ID NO:18755 QQYGNSPWT |
| iPS:436011 | 21-225_193B1 | NA | SEQ ID NO:2732 AGGGCCAGTCAGAGTGTTAGAAGCAACTTCTTAGCC | SEQ ID NO:10744 GGTGCATCCCGCAGGGCCACT | SEQ ID NO:18756 CAGCAGTATGGTAACTCACCGTGGACG |
| | | AA | SEQ ID NO:2733 RASQSVRSNFLA | SEQ ID NO:10745 GASRRAT | SEQ ID NO:18757 QQYGNSPWT |
| iPS:436013 | 21-225_193F2 | NA | SEQ ID NO:2734 CGGGCGAGTCAGGGTATTAACAACTGGTTAGCC | SEQ ID NO:10746 GGTGTTTCCAGTTTGCAAAGT | SEQ ID NO:18758 CAACAGGCTAACAGTTTCCCGTGGACG |
| | | AA | SEQ ID NO:2735 RASQGINNWLA | SEQ ID NO:10747 GVSSLQS | SEQ ID NO:18759 QQANSFPWT |
| iPS:436015 | 21-225_193D3 | NA | SEQ ID NO:2736 AGGGCCAGTCAGAGTATTCGCAGCAGCTTCTTAGCC | SEQ ID NO:10748 GGTGCATCCAACAGGGCCACT | SEQ ID NO:18760 CAGCAGTATGGTAACTCACCGTGGGCG |
| | | AA | SEQ ID NO:2737 RASQSIRSSFLA | SEQ ID NO:10749 GASNRAT | SEQ ID NO:18761 QQYGNSPWA |

FIGURE 49
(Continued)

| | | | | | |
|---|---|---|---|---|---|
| iPS:436017 | | SEQ ID NO:2738 AGGGGCCGGTCAAAGTATTAG AACCGACTTCTTAGTC | SEQ ID NO:10750 GGTGCATCCAGCAGGGC CACT | SEQ ID NO:18762 CAGCAGTATGGAAGCTCACC GTGGACG |
| | 21-225_193F3 | NA | SEQ ID NO:2739 RAGQSIRTDFLV | SEQ ID NO:10751 GASSRAT | SEQ ID NO:18763 QQYGSSPWT |
| | | AA | SEQ ID NO:2740 | SEQ ID NO:10752 | SEQ ID NO:18764 |
| iPS:436019 | | | SEQ ID NO:2741 CGGCCGAGTCAGGGCATTAG CATTTATTTAGCC | SEQ ID NO:10753 GCTGCATCCACTTTACAA TCA | SEQ ID NO:18765 CAAAAGTATAAACAGTGCCCC ATTCACT |
| | 21-225_193C4 | NA | SEQ ID NO:2741 RPSQGISIYLA | SEQ ID NO:10753 AASTLQS | SEQ ID NO:18765 QKYNSAPFT |
| | | AA | SEQ ID NO:2742 | SEQ ID NO:10754 | SEQ ID NO:18766 |
| iPS:436021 | | | SEQ ID NO:2743 AAGTCCAGCCAGAGTGTTT ATACAGCTCCAACAATTATA ACTACTTGACT | SEQ ID NO:10755 TGGGCATCTACCGAAA ATCC | SEQ ID NO:18767 CAGCAATATTATATTACTCC GTGGACG |
| | 21-225_193G4 | NA | SEQ ID NO:2743 KSSQSVLYSSNNYNYLT | SEQ ID NO:10755 WASTRKS | SEQ ID NO:18767 QQYITPWT |
| | | AA | SEQ ID NO:2744 | SEQ ID NO:10756 | SEQ ID NO:18768 |
| iPS:436023 | | | SEQ ID NO:2745 CGGGCAAGTCAGGGCATTAG AAATGATTTAGGG | SEQ ID NO:10757 GCTGCATCCAGTTTGCAA AGT | SEQ ID NO:18769 CTACAGCATAATGATTTCCC GTTCACT |
| | 21-225_193A5 | NA | SEQ ID NO:2745 RASQGIRNDLG | SEQ ID NO:10757 AASSLQS | SEQ ID NO:18769 LQHNDFPFT |
| | | AA | SEQ ID NO:2746 | SEQ ID NO:10758 | SEQ ID NO:18770 |
| iPS:436025 | | | SEQ ID NO:2747 CGGGCCAGTCAGAGAGCATTGG TAGTAGCTTACAC | SEQ ID NO:10759 TATGCTTCCCAGTCCTTC TCA | SEQ ID NO:18771 CATCAGAGTAGTCGTTTACC ATTCACT |
| | 21-225_193B5 | NA | SEQ ID NO:2747 RASQSIGSSLH | SEQ ID NO:10759 YASQSFS | SEQ ID NO:18771 HQSSRLPFT |
| | | AA | SEQ ID NO:2748 | SEQ ID NO:10760 | SEQ ID NO:18772 |
| iPS:436027 | | | SEQ ID NO:2749 AGGGCCAGTCAGAGTGTTAG GAGCGGTTACTTAGCC | SEQ ID NO:10761 GGTGCATCCAGCAGGGC CACT | SEQ ID NO:18773 CAGCAGTATGAGAGTTCACC GTGGACG |
| | 21-225_193E6 | NA | SEQ ID NO:2749 | SEQ ID NO:10761 | SEQ ID NO:18773 |

FIGURE 49
(Continued)

| | | | | | | |
|---|---|---|---|---|---|---|
| iPS:436029 | | AA | RASQSVRSGYLA SEQ ID NO:2750 | GASSRAT SEQ ID NO:10762 | QQYESSPWT SEQ ID NO:18774 |
| | 21-225_193H6 | NA | AGGGCCGGTCAAAGTATTAG AACCAACTTCTTAGCC SEQ ID NO:2751 | GGTGCATCCAGCAGGGC CACT SEQ ID NO:10763 | CAGCAGTATGGTAGCTCACC GTGGACG SEQ ID NO:18775 |
| iPS:436031 | | AA | RAGQSIRTNFLA SEQ ID NO:2752 | GASSRAT SEQ ID NO:10764 | QQYGSSPWT SEQ ID NO:18776 |
| | 21-225_193C7 | NA | CGGGCGAGTCAGGGCATTGG CAAGTATTTAGCC SEQ ID NO:2753 | GCTGCATCCAGTTTGCAA AGT SEQ ID NO:10765 | CAACAGTATAGTACTTACCC GCTCACT SEQ ID NO:18777 |
| iPS:436033 | | AA | RASQGIGKYLA SEQ ID NO:2754 | AASSLQS SEQ ID NO:10766 | QQYSTYPLT SEQ ID NO:18778 |
| | 21-225_193E7 | NA | CGGGCAAGTCAGGGCATTAG AAATGATTTAGGC SEQ ID NO:2755 | TCTGCATCCAGTTTGCAA AGG SEQ ID NO:10767 | CTACAGTATAAAAGGTACCC GCTCACT SEQ ID NO:18779 |
| iPS:436035 | | AA | RASQGIRNDLG SEQ ID NO:2756 | SASSLQR SEQ ID NO:10768 | LQHKRYPLT SEQ ID NO:18780 |
| | 21-225_193C8 | NA | AGGGCCAGTCAGTCAGAGTATTCG CAGCAGCTTCTTAGCC SEQ ID NO:2757 | GGTGCATCCAGCAGGGC CACT SEQ ID NO:10769 | CAGCAATATGGTAACTCACC GTGGGCG SEQ ID NO:18781 |
| iPS:436037 | | AA | RASQSIRSSFLA SEQ ID NO:2758 | GASSRAT SEQ ID NO:10770 | QQYGNSPWA SEQ ID NO:18782 |
| | 21-225_193D8 | NA | AGGGCCAGTCAGAGTATAA GGACCAACTTCTTAGCC SEQ ID NO:2759 | GGTGCATCCAGCAGGGC CACT SEQ ID NO:10771 | CAGCAGTATGGTAACTCACC GTGGACG SEQ ID NO:18783 |
| iPS:436039 | | AA | RASQSIRTNFLA SEQ ID NO:2760 | GASSRAT SEQ ID NO:10772 | QQYGNSPWT SEQ ID NO:18784 |
| | 21-225_193F8 | NA | CGGGCGAGTCAGGGCGTTAG CAATCATTTAGCC SEQ ID NO:2761 | GCTGCATCCAGTTTGCAA AGT SEQ ID NO:10773 | CAACAGTATAATAGTTACCC ATTCACT SEQ ID NO:18785 |

FIGURE 49
(Continued)

| | | RASQGVSNHLA | AASSLQS | QQYNSYPFT |
|---|---|---|---|---|
| iPS:436041 | AA | SEQ ID NO:2762 | SEQ ID NO:10774 | SEQ ID NO:18786 |
| | NA | AGGGCCAGTCAGAGTGTTAG AACCAACTTCTTAGCC | GGTGCATCCCGCAGGGC CACT | CAGCAGTATGGTAACTCACC GTGGACG |
| 21-225_193G8 | | SEQ ID NO:2763 | SEQ ID NO:10775 | SEQ ID NO:18787 |
| | AA | RASQSVRTNFLA | GASRRAT | QQYGNSPWT |
| | | SEQ ID NO:2764 | SEQ ID NO:10776 | SEQ ID NO:18788 |
| iPS:436043 | NA | CGGGCCAGTCAGAGCAGCATTGG TAGGAGTTTACAC | TATGCTTCCCAGTCATTC TCA | CATCAGAGTAGTCGTTTACC GCTCACT |
| | | SEQ ID NO:2765 | SEQ ID NO:10777 | SEQ ID NO:18789 |
| 21-225_193G9 | AA | RASQSIGRSLH | YASQSFS | HQSSRLPLT |
| | | SEQ ID NO:2766 | SEQ ID NO:10778 | SEQ ID NO:18790 |
| iPS:436045 | NA | CGGGCGAGTCAGGGCATTAG CAATTATTTAGCC | GCTGCATCCAGTTTGCAA AGT | CAACATTATCTTACTTACCCT CTCACT |
| | | SEQ ID NO:2767 | SEQ ID NO:10779 | SEQ ID NO:18791 |
| 21-225_193A10 | AA | RASQGISNYLA | AASSLQS | QHYLTYPLT |
| | | SEQ ID NO:2768 | SEQ ID NO:10780 | SEQ ID NO:18792 |
| iPS:436047 | NA | AGGGCCAGTCGAGTGTTAG CAGCAGTACTTAGCC | GGTGCATCCAGGAGGGC CACT | CAGCAGTATGGTAGCTCACC TCCGTGGACG |
| | | SEQ ID NO:2769 | SEQ ID NO:10781 | SEQ ID NO:18793 |
| 21-225_193B10 | AA | RASPSVSSSYLA | GASRRAT | QQYGSSPPWT |
| | | SEQ ID NO:2770 | SEQ ID NO:10782 | SEQ ID NO:18794 |
| iPS:436049 | NA | AGGGCCAGTCAGAGTATTCG CAGCAGCTTCTTAGCC | GATGCATCCAGCAGGGC CACT | CAGCAGTATGGTAACTCACC GTGGGCG |
| | | SEQ ID NO:2771 | SEQ ID NO:10783 | SEQ ID NO:18795 |
| 21-225_193B12 | AA | RASQSIRSSFLA | DASSRAT | QQYGNSPWA |
| | | SEQ ID NO:2772 | SEQ ID NO:10784 | SEQ ID NO:18796 |
| iPS:436051 | NA | AGGGCCAGTCAGAGTGTTAG CAGCAGCTTAGCC | GGTGCATCCACCAGGGC CACT | CAGCAGTATAATAACTGGCC GTGCAGT |
| 21-225_193G12 | | SEQ ID NO:2773 | SEQ ID NO:10785 | SEQ ID NO:18797 |

FIGURE 49
(Continued)

| | | | | GASTRAT | | QQYNNWPCS | |
|---|---|---|---|---|---|---|---|
| | | | RASQSVSSSLA | | | | |
| iPS:436054 | | AA | SEQ ID NO:2774 | | SEQ ID NO:10786 | | SEQ ID NO:18798 |
| | 21-225_194C1 | NA | CGGGCGAGTCAGGGCATTAG CAATTATTTAGCC | GCTGCATCCAGTTGCAA AGT | CTACATTATCTTACTTACCCT CTCACT | |
| | | | SEQ ID NO:2775 | SEQ ID NO:10787 | SEQ ID NO:18799 | |
| iPS:436056 | | AA | RASQGISNYLA | AASSLQS | LHYLTYPLT | |
| | | | SEQ ID NO:2776 | SEQ ID NO:10788 | SEQ ID NO:18800 | |
| | 21-225_194C3 | NA | CGGGCCAGTCAGAGTATTGG TAGTAACTTACAC | TCTGCTTCCCAGTCCTTC TCA | CAGCAGAGTAGTAGTTTACC GTGGACG | |
| | | | SEQ ID NO:2777 | SEQ ID NO:10789 | SEQ ID NO:18801 | |
| iPS:436058 | | AA | RASQSIGSNLH | SASQSFS | QQSSSLPWT | |
| | | | SEQ ID NO:2778 | SEQ ID NO:10790 | SEQ ID NO:18802 | |
| | 21-225_194A4 | NA | AGGGCCAGTCGGGGTGTTAG CAACATCTACTTAGCC | GGTGCTTCCAACAGGGC CACT | CAGCACAATGATTACTCAAT GTTCACT | |
| | | | SEQ ID NO:2779 | SEQ ID NO:10791 | SEQ ID NO:18803 | |
| iPS:436060 | | AA | RASRGVSNIYLA | GASNRAT | QHNDYSMFT | |
| | | | SEQ ID NO:2780 | SEQ ID NO:10792 | SEQ ID NO:18804 | |
| | 21-225_194F4 | NA | AAGTCTAGTCAGAGCCTCCT CCATAGTGATGGAAGGACCT ATTTGTAT | GAGGTTTCCAACCGGTTC TCT | ATGCAAAGTATACAGCTTCC CTGGACG | |
| | | | SEQ ID NO:2781 | SEQ ID NO:10793 | SEQ ID NO:18805 | |
| iPS:436062 | | AA | KSSQSLLHSDGRTYLY | EVSNRFS | MQSIQLPWT | |
| | | | SEQ ID NO:2782 | SEQ ID NO:10794 | SEQ ID NO:18806 | |
| | 21-225_194E5 | NA | AGGGCCGGTCAAAGTATTAG AACCAACTTCTTAGCC | GGTGCATCCAGCAGGGC CACT | CAGCAGTATGGTAGTTCACC GTGGACG | |
| | | | SEQ ID NO:2783 | SEQ ID NO:10795 | SEQ ID NO:18807 | |
| iPS:436064 | | AA | RAGQSIRTNFLA | GASSRAT | QQYGSSPWT | |
| | | | SEQ ID NO:2784 | SEQ ID NO:10796 | SEQ ID NO:18808 | |
| | | NA | AGGGCCAGTCAGAGTATTAG AAGCAACTTCTTAGCC | GGTGCATCCAGCAGGGC CACT | CAGCAGTATGGTAGCTCACG GTGGACG | |

FIGURE 49
(Continued)

| | | | | | | | |
|---|---|---|---|---|---|---|---|
| iPS:436066 | 21-225_194E6 | AA | SEQ ID NO:2785 RASQSIRSNFLA | | SEQ ID NO:10797 GASSRAT | | SEQ ID NO:18809 QQYGSSPWT |
| | | NA | SEQ ID NO:2786 CGGGCGAGTCAGGGCATTAG CAAATATTTAGCC | | SEQ ID NO:10798 GGTGCATCCAGGTTGCA AAGT | | SEQ ID NO:18810 CAACATTATCTTAATTACCCT CTCACC |
| iPS:436068 | 21-225_194B7 | AA | SEQ ID NO:2787 RASQGISKYLA | | SEQ ID NO:10799 GASRLQS | | SEQ ID NO:18811 QHYLNYPLT |
| | | NA | SEQ ID NO:2788 CGGGCAAGTCAGGGTATTAG CAGGTGGTTAGCC | | SEQ ID NO:10800 GCTGCATCCAGTTTGCAA AGT | | SEQ ID NO:18812 CAACAGGCTAACAGTTCCC GTGGACG |
| iPS:436072 | 21-225_194F7 | AA | SEQ ID NO:2789 RASQGISRWLA | | SEQ ID NO:10801 AASSLQS | | SEQ ID NO:18813 QQANSFPWT |
| | | NA | SEQ ID NO:2790 AGGGCCAGTCCGAGTGTTAA CAGCGGCTACTTAGCC | | SEQ ID NO:10802 GGTGCATCCAGCAGGGC CACT | | SEQ ID NO:18814 CAGCAGTATGAAAGCTCACC GTGGACG |
| iPS:436072 | 21-225_194C10 | AA | SEQ ID NO:2791 RASPSVNSGYLA | | SEQ ID NO:10803 GASSRAT | | SEQ ID NO:18815 QQYESSPWT |
| | | NA | SEQ ID NO:2792 CGGGCAAGTCAGGGCATTAG AAATGATTTAGGC | | SEQ ID NO:10804 GCTGCATCCAGTTTACAA AGT | | SEQ ID NO:18816 CTACAGCATTATAGTTTCCC ATTCACT |
| iPS:436074 | 21-225_194F10 | AA | SEQ ID NO:2793 RASQGIRNDLG | | SEQ ID NO:10805 AASSLQS | | SEQ ID NO:18817 LQHYSFPFT |
| | | NA | SEQ ID NO:2794 CGGGCAAGTCAGGGCATTAG CAATTATTTAGCC | | SEQ ID NO:10806 GCTGCATCCAGTTTACAA AGT | | SEQ ID NO:18818 CAACATTATCTTACTTACCCT CTCACT |
| iPS:436076 | 21-225_194H11 | AA | SEQ ID NO:2795 RASQGISNYLA | | SEQ ID NO:10807 AASSLQS | | SEQ ID NO:18819 QHYLTYPLT |
| | | NA | SEQ ID NO:2796 CGGGCGAGTCAGGGCATTGG CAAGTATTTAGCA | | SEQ ID NO:10808 GCTGCATCCAGTTTGCAA AGT | | SEQ ID NO:18820 CAACGATATGATACTTACCC ATTCACT |
| iPS:436078 | | | | | | | |

FIGURE 49
(Continued)

| | | | | | | |
|---|---|---|---|---|---|---|
| | 21-225_194H12 | | | SEQ ID NO:2797 | | SEQ ID NO:10809 | | SEQ ID NO:18821 |
| | | AA | | RASQGIGKYLA | | AASSLQS | | QRYDTYPFT |
| iPS:436080 | | | | SEQ ID NO:2798 | | SEQ ID NO:10810 | | SEQ ID NO:18822 |
| | 21-225_195B1 | NA | | AGGGCCAGTCCGAGTGTTAA CAGTAACTACTTAGCC | | GGTGCATCCAACAGGGC CACT | | CAGCAGTATGAAAGCTCACC GTGGACG |
| | | | | SEQ ID NO:2799 | | SEQ ID NO:10811 | | SEQ ID NO:18823 |
| | | AA | | RASPSVNSNYLA | | GASNRAT | | QQYESSPWT |
| iPS:436082 | | | | SEQ ID NO:2800 | | SEQ ID NO:10812 | | SEQ ID NO:18824 |
| | 21-225_195D9 | NA | | CGGGCGAGTCAGGGTATTAG CAGGTGGTTAGCC | | GCTGCATCCAGTTGCTA GGT | | CAACGGGCTAACAGTTTCCC GTGCAGT |
| | | | | SEQ ID NO:2801 | | SEQ ID NO:10813 | | SEQ ID NO:18825 |
| | | AA | | RASQGISRWLA | | AASSLLG | | QRANSFPCS |
| iPS:436084 | | | | SEQ ID NO:2802 | | SEQ ID NO:10814 | | SEQ ID NO:18826 |
| | 21-225_195F2 | NA | | CGGGCCAGTCAGAGAGCATTGG TAGTAGCTTACAC | | TATGCTTCCCAGTCCTTC TCA | | CATCAGAGTAGAACTTTACC GCTCACT |
| | | | | SEQ ID NO:2803 | | SEQ ID NO:10815 | | SEQ ID NO:18827 |
| | | AA | | RASQSIGSSLH | | YASQSFS | | HQSRTLPLT |
| iPS:436086 | | | | SEQ ID NO:2804 | | SEQ ID NO:10816 | | SEQ ID NO:18828 |
| | 21-225_191G10 | NA | | CGGACGAGTCAGGGCATTGG CAAGTATTAGCC | | AAAGTATCCAGTTTGCA AAGT | | CAACAGTATATGACTTACCC GCTCACT |
| | | | | SEQ ID NO:2805 | | SEQ ID NO:10817 | | SEQ ID NO:18829 |
| | | AA | | RTSQGIGKYLA | | KVSSLQS | | QQYMTYPLT |
| iPS:436088 | | | | SEQ ID NO:2806 | | SEQ ID NO:10818 | | SEQ ID NO:18830 |
| | 21-225_195C8 | NA | | AGGGCCAGTCAGAGTCAGAGTATTCG CAGCAGCTTCTTAGCC | | GGTGCATTTAGTAGGGC CACT | | CAGCAGTATGGTAACTCACC GTGGGCG |
| | | | | SEQ ID NO:2807 | | SEQ ID NO:10819 | | SEQ ID NO:18831 |
| | | AA | | RASQSIRSSFLA | | GAFSRAT | | QQYGNSPWA |
| iPS:436090 | | | | SEQ ID NO:2808 | | SEQ ID NO:10820 | | SEQ ID NO:18832 |
| | | NA | | CGGGCGAGTCAGGGCATTAG CAATTATTAGCC | | GCTGCATCCAGTTTGCAA AGT | | CAACATTATCTTACTTACCCT CTCACT |

FIGURE 49
(Continued)

| | | | | | | |
|---|---|---|---|---|---|---|
| iPS:436092 | 21-225_195A9 | AA | SEQ ID NO:2809<br>RASQGISNYLA<br>SEQ ID NO:2810 | SEQ ID NO:10821<br>AASSLQS<br>SEQ ID NO:10822 | SEQ ID NO:18833<br>QHYLTYPLT<br>SEQ ID NO:18834 | |
| iPS:436094 | 21-225_195B9 | NA | CGGGCAAGTCAGGGCATAA<br>GAAAAGATTTAGGC<br>SEQ ID NO:2811<br>RASQGIRKDLG<br>SEQ ID NO:2812 | GCTGCATCCGATTGCAA<br>AGT<br>SEQ ID NO:10823<br>AASDLQS<br>SEQ ID NO:10824 | CTACAGCATTATCGTTACCC<br>ATTCACT<br>SEQ ID NO:18835<br>LQHYRYPFT<br>SEQ ID NO:18836 | |
| | 21-225_195B10 | NA | CGGGCCAGTCAGAGCATTGG<br>TAGTAGCTTACAC<br>SEQ ID NO:2813<br>RASQSIGSSLH<br>SEQ ID NO:2814 | TATGCTTCCCAGTCCTTC<br>TCA<br>SEQ ID NO:10825<br>YASQSFS<br>SEQ ID NO:10826 | CATCAGAGTGGTCGTTTACC<br>GCTCACT<br>SEQ ID NO:18837<br>HQSGRLPLT<br>SEQ ID NO:18838 | |
| iPS:436096 | 21-225_195E10 | AA | CGGGCCAGTCAGAGCATTGG<br>TAGTAGCTTACAC<br>SEQ ID NO:2815<br>RASQSIGSSLH<br>SEQ ID NO:2816 | TATGCTTCCCAGTCCTTC<br>TCA<br>SEQ ID NO:10827<br>YASQSFS<br>SEQ ID NO:10828 | CATCAGAGTAGTCGTTTACC<br>ATTCACT<br>SEQ ID NO:18839<br>HQSSRLPFT<br>SEQ ID NO:18840 | |
| iPS:436098 | 21-225_195G11 | NA | AAGTCCAGCCAGAGTGTTTT<br>ATTCAACTCCAACAATAAGA<br>ACTACTTAGCT<br>SEQ ID NO:2817<br>KSSQSVLFNSNNKNYLA<br>SEQ ID NO:2818 | TGGGCATCTACCCTGGA<br>ATCT<br>SEQ ID NO:10829<br>WASTLES<br>SEQ ID NO:10830 | CAGCAATATTGTAGTTTTCC<br>ATTCACT<br>SEQ ID NO:18841<br>QQYCSFPFT<br>SEQ ID NO:18842 | |
| iPS:436100 | 21-225_195G12 | NA | CGGGCGAGTCAGGGTATTAA<br>CAACTGGTTAGCC<br>SEQ ID NO:2819<br>RASQGNNWLA<br>SEQ ID NO:2820 | GGTGTTTCCAGTTTGCAG<br>AGT<br>SEQ ID NO:10831<br>GVSSLQS<br>SEQ ID NO:10832 | CAACAGGCTAACAGTTTCCC<br>GTGGACG<br>SEQ ID NO:18843<br>QQANSFPWT<br>SEQ ID NO:18844 | |

FIGURE 49
(Continued)

| | | | | | |
|---|---|---|---|---|---|
| iPS:436102 | 21-225_196B1 | NA | AAGTCCAGCCAGAGTATTT ATTCAACTCCAACAATAAGA GGTACTTAGCT SEQ ID NO:2821 | TGGGCATCTATCCGGGA ATCC SEQ ID NO:10833 | CAGCAATATTCTAGTCTTCC ATTCACT SEQ ID NO:18845 |
| | | AA | KSSQSILFSSNNKRYLA SEQ ID NO:2822 | WASIRES SEQ ID NO:10834 | QQYSSLPFT SEQ ID NO:18846 |
| iPS:436104 | 21-225_196C1 | NA | AAGTCCAGCCAGAGTGTTT ATTCAACTCCAACAATAAGA ACTACTTAGCT SEQ ID NO:2823 | TGGGCATCTACCCTGGA ATCT SEQ ID NO:10835 | CAGCAATATTGTAGTTTTCC ATTCACT SEQ ID NO:18847 |
| | | AA | KSSQSVLFNSSNNKNYLA SEQ ID NO:2824 | WASTLES SEQ ID NO:10836 | QQYCSFPFT SEQ ID NO:18848 |
| iPS:436106 | 21-225_196F2 | NA | CGGGGCGAGTCAGGGTATTAG CAGCTGGTTAGCC SEQ ID NO:2825 | GCTGCATCCAGTTTGCAA AGT SEQ ID NO:10837 | CAACAGACTAACAGTGTCCC ATTCACT SEQ ID NO:18849 |
| | | AA | RASQGISSWLA SEQ ID NO:2826 | AASSLQS SEQ ID NO:10838 | QQTNSVPFT SEQ ID NO:18850 |
| iPS:436110 | 21-225_196F4 | NA | CGGGCAAGTCAGCGCATTCA CAGCTATTTAAAT SEQ ID NO:2827 | ACTGCATCCAGTTTGCAA GGT SEQ ID NO:10839 | CAACAGAGCTACGGTTCCCC TCTCACT SEQ ID NO:18851 |
| | | AA | RASQRIHSYLN SEQ ID NO:2828 | TASSLQG SEQ ID NO:10840 | QQSYGSPLT SEQ ID NO:18852 |
| iPS:436112 | 21-225_196C7 | NA | CGGGGCGAATCAGGCCATTAG CAATTATTTAGCC SEQ ID NO:2829 | GCTGCATCCAGTTTGCAA AGT SEQ ID NO:10841 | CAACATTATCTCACTTACCCT CTCACT SEQ ID NO:18853 |
| | | AA | RANQAISNYLA SEQ ID NO:2830 | AASSLQS SEQ ID NO:10842 | QHYLTYPLT SEQ ID NO:18854 |
| iPS:436114 | 21_225_196G8 | NA | AAGTCCAGCCAGAGTGTTTT ACACAGCTCCAACAATAACA ACTACTTAGCT | TGGGCATCTACCCGGGA ATCC | CAGCAATATTATAATACTCC TCCGACA |

FIGURE 49
(Continued)

| | | | | | | |
|---|---|---|---|---|---|---|
| iPS:436116 | 21-225_196G8 | AA | SEQ ID NO:2831 KSSQSVLHSSNNNNYLA | SEQ ID NO:2832 | SEQ ID NO:10843 WASTRES | SEQ ID NO:10844 GCTGCATCCAGTTTGCAA AGT | SEQ ID NO:18855 QQYYNTPPT | SEQ ID NO:18856 CAACAGGGTGACAGTTTCCC TCCGACG |
| iPS:436118 | 21-225_196B9 | NA | SEQ ID NO:2833 RASQGISNCLA | SEQ ID NO:2834 CGGGCGAGTCAGGGTATTAG CAACTGCTTAGCC | SEQ ID NO:10845 AASSLQS | SEQ ID NO:10846 GCTGCATCCAGTTTGCTA GGT | SEQ ID NO:18857 QQGDSFPPT | SEQ ID NO:18858 CAACGGGATAACAGTTTACC GTGCAGT |
| iPS:436120 | 21-225_196A10 | AA | SEQ ID NO:2835 RASQGISRWLA | SEQ ID NO:2836 CGGGCGAGTCAGGGTATTAG CAGGTGGTTAGCC | SEQ ID NO:10847 AASSLLG | SEQ ID NO:10848 GCTGCATCCAGTTTGCAA AGT | SEQ ID NO:18859 QRDNSLPCS | SEQ ID NO:18860 CTACAATATAATAGTTACCC TCTCACT |
| iPS:436122 | 21-225_196C10 | NA | SEQ ID NO:2837 RASQGIRNDLG | SEQ ID NO:2838 CGGGCAAGTCAGGGCATTAG AAATGATTTAGGC | SEQ ID NO:10849 AASSLQS | SEQ ID NO:10850 GCTGCATCCAGTTTGCAA AGT | SEQ ID NO:18861 LQYNSYPLT | SEQ ID NO:18862 CAGCAGTATGGTAGCTCACC TCCGTGGACG |
| iPS:436132 | 21-225_196G10 | AA | SEQ ID NO:2839 RASPSVSNSFLA | SEQ ID NO:2840 AGGGCCAGTCCGAGTGTTAG CAACAGCTTCTTAGCC | SEQ ID NO:10851 GASSRAT | SEQ ID NO:10852 GGTGCATCCAGCAGGGC CACT | SEQ ID NO:18863 QQYGSSPPWT | SEQ ID NO:18864 CTACAGCATAATGATTTCCC GTTCACT |
| iPS:436132 | 21-225_196C12 | NA | SEQ ID NO:2841 RASQGIRNDLG | SEQ ID NO:2842 CGGGCAAGTCAGGGCATTAG AAATGATCTAGGC | SEQ ID NO:10853 AASSLQS | SEQ ID NO:10854 GCTGCATCCAGTTTGCAA AGT | SEQ ID NO:18865 LQHNDFPFT | SEQ ID NO:18866 CAGCAGTATGGTAACTCACG GTGGACG |
| iPS:436134 | | NA | | AGGGCAAGTCAGAGAGTGTTAG AAGCAACTTCTTAGCC | | GGTGCATACCGCAGGGC CACT | | |

FIGURE 49
(Continued)

| | | | | | | |
|---|---|---|---|---|---|---|
| iPS:436138 | 21-225_196H12 | AA | SEQ ID NO:2843<br>RASQSVRSNFLA | SEQ ID NO:10855<br>GAYRRAT | SEQ ID NO:18867<br>QQYGNSPWT | |
| | | NA | SEQ ID NO:2844<br>CGGACGAGTCAGGGCATTGG<br>CAATTATTTAGCC | SEQ ID NO:10856<br>AAAACATCCAGTTTGCA<br>AAGT | SEQ ID NO:18868<br>CAACAATATCACTTACCC<br>GCTCACT | |
| iPS:436140 | 21-225_197F2 | AA | SEQ ID NO:2845<br>RTSQGIGNYLA | SEQ ID NO:10857<br>KTSSLQS | SEQ ID NO:18869<br>QQYITYPLT | |
| | | NA | SEQ ID NO:2846<br>CGGGCGAGTCAGGGCATTGG<br>CAATCATTTAGCC | SEQ ID NO:10858<br>GCTGCATCCAGTTTGCAA<br>AGT | SEQ ID NO:18870<br>CAACAGTATAGTAATTACC<br>GGTCACT | |
| iPS:436146 | 21-225_197G3 | AA | SEQ ID NO:2847<br>RASQGIGNHLA | SEQ ID NO:10859<br>AASSLQS | SEQ ID NO:18871<br>QQYSNYPVT | |
| | | NA | SEQ ID NO:2848<br>AGGGCCAGTCAGTCAGAGTATTCG<br>CAGCAGCTTCTTAGCC | SEQ ID NO:10860<br>GGTGCATCCAGCAGGGC<br>CACT | SEQ ID NO:18872<br>CAGCAGTATGGAAACTCACC<br>GTGGGCG | |
| iPS:436150 | 21-225_197F4 | AA | SEQ ID NO:2849<br>RASQSIRSSFLA | SEQ ID NO:10861<br>GASSRAT | SEQ ID NO:18873<br>QQYGNSPWA | |
| | | NA | SEQ ID NO:2850<br>AGGTCCAGCCAGAGTGTTT<br>ACACAGCTTCAACAATTACA<br>ACTACTTAGCT | SEQ ID NO:10862<br>TGGGCATCTACCCGGGA<br>ATCC | SEQ ID NO:18874<br>CAACAATATTATAGTACTCC<br>TCCGACG | |
| iPS:436152 | 21-225_197H4 | AA | SEQ ID NO:2851<br>RSSQSVLHSFNNYNYLA | SEQ ID NO:10863<br>WASTRES | SEQ ID NO:18875<br>QQYYSTPPT | |
| | | NA | SEQ ID NO:2852<br>CGGGCGAGTCAGGGCATTGG<br>CAAATATTTAGCC | SEQ ID NO:10864<br>GGTGCATCCAGTTTGCA<br>AAGT | SEQ ID NO:18876<br>CAACAATATAGTACTTACCC<br>GCTCACT | |
| | 21-225_197B6 | AA | SEQ ID NO:2853<br>RASQGIGKYLA | SEQ ID NO:10865<br>GASSLQS | SEQ ID NO:18877<br>QQYSTYPLT | |
| | | | SEQ ID NO:2854 | SEQ ID NO:10866 | SEQ ID NO:18878 | |

FIGURE 49
(Continued)

| | | | | | |
|---|---|---|---|---|---|
| iPS:436154 | 21-225_197C6 | NA | AGGTCCAGCCAGAGTGTTTT ACACAGTTCCAACAATTACA ACTACTTAGCT SEQ ID NO:2855 | TGGGCATCTACCCGGGA ATCC SEQ ID NO:10867 | CAACAATATTATAGTACTCC TCCGACG SEQ ID NO:18879 |
| | | AA | RSSQSVLHSSNNYNYLA SEQ ID NO:2856 | WASTRES SEQ ID NO:10868 | QQYYSTPPT SEQ ID NO:18880 |
| iPS:436156 | 21-225_197C8 | NA | AAGTCCAGCCAGAGTGTTTT ACACAGTTCCAACAATAAGA ACTACTTAGCT SEQ ID NO:2857 | TGGGCATCTACCCGGGA ATCC SEQ ID NO:10869 | CAGCAGTCTTATACTATTCC ATTCACT SEQ ID NO:18881 |
| | | AA | KSSQSVLHSSNNKNYLA SEQ ID NO:2858 | WASTRES SEQ ID NO:10870 | QQSYTIPFT SEQ ID NO:18882 |
| iPS:436158 | 21-225_197G8 | NA | AAGTCTAGTCAGAGAACCTCCT GCATAGTGATGGAAAGACCT ATTTGTAT SEQ ID NO:2859 | GAAGTTTCCAACCGGTTC TCT SEQ ID NO:10871 | ATGCAAAGTATACAGCTTCC CTGGACG SEQ ID NO:18883 |
| | | AA | KSSQNLLHSDGKTYLY SEQ ID NO:2860 | EVSNRFS SEQ ID NO:10872 | MQSIQLPWT SEQ ID NO:18884 |
| iPS:436160 | 21-225_197C9 | NA | CGGGCGAGTCAGTCAGGGTATTAG CAACTGGTTAGCC SEQ ID NO:2861 | GCTGCATCCAGTTTGCAA AGT SEQ ID NO:10873 | CAACAGGCTAACAGTTTCCC GTGGACG SEQ ID NO:18885 |
| | | AA | RASQGISNWLA SEQ ID NO:2862 | AASSLQS SEQ ID NO:10874 | QQANSFPWT SEQ ID NO:18886 |
| iPS:436164 | 21-225_197G10 | NA | CGGGCAAGTCAGGGCATTAG AAATGATTTAGGC SEQ ID NO:2863 | GGTGCATCCAGTTACA AGT SEQ ID NO:10875 | CTACAGCATTATAGGTACCC ATTCACT SEQ ID NO:18887 |
| | | AA | RASQGIRNDLG SEQ ID NO:2864 | GASSLQS SEQ ID NO:10876 | LQHYRYPFT SEQ ID NO:18888 |
| iPS:436167 | | NA | CGGGCGAGTCAGGGCATTAA CAAGTATTTATCC | GCTGCATCCAGTGTGCA AAGT | CAACGATATGACACTTACCC ATTCACT |

FIGURE 49
(Continued)

| | | | SEQ ID NO:2865 | SEQ ID NO:10877 | SEQ ID NO:18889 |
|---|---|---|---|---|---|
| | 21-225_197E11 | AA | RASQGINKYLS | AASSVQS | QRYDTYPFT |
| iPS:436173 | | | SEQ ID NO:2866 | SEQ ID NO:10878 | SEQ ID NO:18890 |
| | 21-225_197G12 | NA | CGGACGAGTCAGGGCATTGGCAATTATTTAGCC | AAAACATCCAGTTGCAAAGT | CAACAATATAGACTTACCCGCTCACT |
| | | | SEQ ID NO:2867 | SEQ ID NO:10879 | SEQ ID NO:18891 |
| iPS:436177 | | AA | RTSQGIGNYLA | KTSSLQS | QQYMTYPLT |
| | | | SEQ ID NO:2868 | SEQ ID NO:10880 | SEQ ID NO:18892 |
| | 21-225_198B1 | NA | AGGGCCGGTCAAAGTATTAGAACCAACTTCTTAGCC | GGTGCATCCAGACAGGGCCACT | CAGCAGTATGGTAGCTCACCGTGGACG |
| iPS:436179 | | | SEQ ID NO:2869 | SEQ ID NO:10881 | SEQ ID NO:18893 |
| | | AA | RAGQSIRTNFLA | GASSRAT | QQYGSSPWT |
| | | | SEQ ID NO:2870 | SEQ ID NO:10882 | SEQ ID NO:18894 |
| | 21-225_198E1 | NA | AGGGCCAGTCAGAGTATAAGGAGCAACTTCTTAGCC | GGTGCATTCAGTCAGTAGGGCCACT | CAGCAGTATGGTAATTCACCGTGGACG |
| iPS:436181 | | | SEQ ID NO:2871 | SEQ ID NO:10883 | SEQ ID NO:18895 |
| | | AA | RASQSIRSNFLA | GAFSRAT | QQYGNSPWT |
| | | | SEQ ID NO:2872 | SEQ ID NO:10884 | SEQ ID NO:18896 |
| | 21-225_198C2 | NA | AGGGCCAGTCAGAGTGTTAGAAGCAGCTACTTAGCC | GGTGCATTCAGCAGGGCCAGT | CAGCAGTATGGTAACTCACCGTGGACG |
| iPS:436189 | | | SEQ ID NO:2873 | SEQ ID NO:10885 | SEQ ID NO:18897 |
| | | AA | RASQSVRSSYLA | GAFSRAS | QQYGNSPWT |
| | | | SEQ ID NO:2874 | SEQ ID NO:10886 | SEQ ID NO:18898 |
| | 21-225_198B6 | NA | CGGGCGAGTCAGGGCATTGGCAATTATTTAGCC | GCTGCATCCAGTTTGCAAAGT | CAACAATATAGTACTTACCCGCTCACT |
| iPS:436191 | | | SEQ ID NO:2875 | SEQ ID NO:10887 | SEQ ID NO:18899 |
| | | AA | RASQGIGNYLA | AASSLQS | QQYSTYPLT |
| | | | SEQ ID NO:2876 | SEQ ID NO:10888 | SEQ ID NO:18900 |
| | | NA | CGGGCAAGTCAGGGCATAAGAAAAGATTTAGGC | GCTGCATCCAGTTTGCAAAGT | CTACAACATTATGTTACCCTTTCACT |

FIGURE 49
(Continued)

| | | | SEQ ID NO:2877 | SEQ ID NO:10889 | SEQ ID NO:18901 |
|---|---|---|---|---|---|
| iPS:436193 | 21-225_198B9 | AA | RASQGIRKDLG | AASSLQS | LQHYRYPFT |
| | | | SEQ ID NO:2878 | SEQ ID NO:10890 | SEQ ID NO:18902 |
| | | NA | AAGTCTAGTCAGAGCCTCCTCTATAGTGATGGAAGGACCTATTTGTAT | GAGGTTTCCAACCGGTTCTCT | ATGCAAAGTATACAGCTTCCCTGGACG |
| iPS:436195 | 21-225_198A10 | | SEQ ID NO:2879 | SEQ ID NO:10891 | SEQ ID NO:18903 |
| | | AA | KSSQSLLYSDGRTYLY | EVSNRFS | MQSIQLPWT |
| | | | SEQ ID NO:2880 | SEQ ID NO:10892 | SEQ ID NO:18904 |
| | | NA | AGGGCCAGTCAGAGTATTCGCAGCAGCTTCTTAGCC | GGTGCATCCAGCAGGGCCACT | CAGCAGTATGGTAACTCACCGTGGGCG |
| iPS:436197 | 21-225_198G10 | | SEQ ID NO:2881 | SEQ ID NO:10893 | SEQ ID NO:18905 |
| | | AA | RASQSIRSSFLA | GASSRAT | QQYGNSPWA |
| | | | SEQ ID NO:2882 | SEQ ID NO:10894 | SEQ ID NO:18906 |
| | | NA | AGGGCCAGTCAGAGTATTCGCAGCAGCTTCTTAGCC | GGTGCATCCAGCAGGGCCACT | CAGCAGTATGGTAACTCACCGTGGGCG |
| iPS:436199 | 21-225_199C2 | | SEQ ID NO:2883 | SEQ ID NO:10895 | SEQ ID NO:18907 |
| | | AA | RASQSIRSSFLA | GASSRAT | QQYGNSPWA |
| | | | SEQ ID NO:2884 | SEQ ID NO:10896 | SEQ ID NO:18908 |
| | | NA | CGGGCAAGTCAGGGCATTAGAAATGATTTAGGC | TCTGCATCCAGTTTGCAAAGG | CTACAGCATAAAAGGTACCCGCTCACT |
| iPS:436201 | 21-225_199E3 | | SEQ ID NO:2885 | SEQ ID NO:10897 | SEQ ID NO:18909 |
| | | AA | RASQGIRNDLG | SASSLQR | LQHKRYPLT |
| | | | SEQ ID NO:2886 | SEQ ID NO:10898 | SEQ ID NO:18910 |
| | | NA | CGGGCGAGTCAGGGCATTAGCAAGTATTAGCC | GCTGCATCCAGTTTGCAAAGT | CAACAGTATCTTACTTACCGCTCACT |
| | 21-225_199C5 | | SEQ ID NO:2887 | SEQ ID NO:10899 | SEQ ID NO:18911 |
| | | AA | RASQGISKYLA | AASSLQS | QQYLTYPLT |
| | | | SEQ ID NO:2888 | SEQ ID NO:10900 | SEQ ID NO:18912 |

FIGURE 49
(Continued)

| | | | | |
|---|---|---|---|---|
| iPS:436203 | 21-225_199A6 | NA | AGGGCCAGTCAGAGTTTTAG CAGAAACTTAGCC SEQ ID NO:2889 | GGTGCATCCACTAGGGC CACT SEQ ID NO:10901 | CAGCAGTATAATAACTGGCC GCTCACT SEQ ID NO:18913 |
| | | AA | RPSQSFSRNLA SEQ ID NO:2890 | GASTRAT SEQ ID NO:10902 | QQYNNWPLT SEQ ID NO:18914 |
| iPS:436205 | 21-225_199A7 | NA | CGGGCAAGTCAGGGCATAA GAAAAGATTTAGGC SEQ ID NO:2891 | GCTGCATCCAGTTGCAA AGT SEQ ID NO:10903 | CTACAACATTATCGTTACCC TTTCACT SEQ ID NO:18915 |
| | | AA | RASQGIRKDLG SEQ ID NO:2892 | AASSLQS SEQ ID NO:10904 | LQHYRYPFT SEQ ID NO:18916 |
| iPS:436207 | 21-225_199C7 | NA | AGGGCCAGTCAGAGTATAA GGACCAACTTCTTAGCC SEQ ID NO:2893 | GGTGCATCCAGCAGGGC CACT SEQ ID NO:10905 | CAGCAGTATGGTAACTCACC GTGGACG SEQ ID NO:18917 |
| | | AA | RASQSIRTNFLA SEQ ID NO:2894 | GASSRAT SEQ ID NO:10906 | QQYGNSPWT SEQ ID NO:18918 |
| iPS:436210 | 21-225_199G11 | NA | AGGGCCAGTCAGAGTGTTAG AAGCAGTACTTAGCC SEQ ID NO:2895 | GGTGCATTCAGCAGGGC CACT SEQ ID NO:10907 | CAGCAGTATGGTAACTCACC GTGGACG SEQ ID NO:18919 |
| | | AA | RASQSVRSSYLA SEQ ID NO:2896 | GAFSRAT SEQ ID NO:10908 | QQYGNSPWT SEQ ID NO:18920 |
| iPS:436212 | 21-225_200G1 | NA | CGGGCAAGTCAGAGCATTAG CAGCTATTTAAAT SEQ ID NO:2897 | GCTGAGTCCAGTTACA AAGT SEQ ID NO:10909 | CAACAGAGTTACAGTTCCCC TCCGTGGACG SEQ ID NO:18921 |
| | | AA | RASQSISSYLN SEQ ID NO:2898 | AESSLQS SEQ ID NO:10910 | QQSYSSPPWT SEQ ID NO:18922 |
| iPS:436214 | 21-225_200F6 | NA | CGGGCAAGTCAGGACATTAG AAATGATTTAGGC SEQ ID NO:2899 | GCTGCATCCAGTTGCAA AGT SEQ ID NO:10911 | CTACAGCATTATCGTTACCC ATTCACT SEQ ID NO:18923 |
| | | AA | RASQDIRNDLG SEQ ID NO:2900 | AASSLQS SEQ ID NO:10912 | LQHYRYPFT SEQ ID NO:18924 |

FIGURE 49
(Continued)

| | | | | | |
|---|---|---|---|---|---|
| iPS:436216 | 21-225_200B7 | NA | CGGGCCAGTCAGAACAATTGG TAATACCTTGCAC<br>SEQ ID NO:2901 | TATGCTTCCCAGTCCTTC TCA<br>SEQ ID NO:10913 | CATCAGAGTGGTAGTTTACC TCAGACG<br>SEQ ID NO:18925 |
| | | AA | RASQNIGNTLH<br>SEQ ID NO:2902 | YASQSFS<br>SEQ ID NO:10914 | HQSGSLPQT<br>SEQ ID NO:18926 |
| iPS:436218 | 21-225_200G7 | NA | AAGTCCAGCCAGAGTGTTTT ACACAGCTCCAACAATAACA ACTACTTAGCT<br>SEQ ID NO:2903 | TGGGCATCTACCCGGGA ATCC<br>SEQ ID NO:10915 | CAGCAATATTATAATACTCC TCCGACA<br>SEQ ID NO:18927 |
| | | AA | KSSQSVLHSSNNNNYLA<br>SEQ ID NO:2904 | WASTRES<br>SEQ ID NO:10916 | QQYYNTPPT<br>SEQ ID NO:18928 |
| iPS:436220 | 21-225_200F8 | NA | CGGGCCAGTCAGAGTATTGG TAGTAACTTACAC<br>SEQ ID NO:2905 | TCTGCTTCCCAGTCCTTC TCA<br>SEQ ID NO:10917 | CAGCAGAGTAGTAGTTTACC GTGGACG<br>SEQ ID NO:18929 |
| | | AA | RASQSIGSNLH<br>SEQ ID NO:2906 | SASQSFS<br>SEQ ID NO:10918 | QQSSSLPWT<br>SEQ ID NO:18930 |
| iPS:436222 | 21-225_200C9 | NA | CGGGCAACTCAGGGCATTAG AAAAGATTTAGGC<br>SEQ ID NO:2907 | ACTGCATCCAGTTTGCAA AGT<br>SEQ ID NO:10919 | CTACAGCATAATAGTTACCC GTGGACG<br>SEQ ID NO:18931 |
| | | AA | RATQGIRKDLG<br>SEQ ID NO:2908 | TASSLQS<br>SEQ ID NO:10920 | LQHNSYPWT<br>SEQ ID NO:18932 |
| iPS:436226 | 21-225_200F10 | NA | AGGGCCAGTCAGAATATTCG CAGCAGCTTCTTAGCC<br>SEQ ID NO:2909 | GGTGCATCCAGCAGGGC CACT<br>SEQ ID NO:10921 | CAGCAGTATGGTAACTCACC GTGGGCG<br>SEQ ID NO:18933 |
| | | AA | RASQNIRSSFLA<br>SEQ ID NO:2910 | GASSRAT<br>SEQ ID NO:10922 | QQYGNSPWA<br>SEQ ID NO:18934 |
| iPS:436228 | 21-225_200F12 | NA | CGGGCAAGTCAGGGCATTAG AAATGATTTAGGC<br>SEQ ID NO:2911 | TCTGCATCCAGTTTGCAT ACT<br>SEQ ID NO:10923 | CTACAGCATAAGAGTTACCC GCTCACT<br>SEQ ID NO:18935 |
| | | AA | RASQGIRNDLG | SASSLHT | LQHKSYPLT |

FIGURE 49
(Continued)

| | | | | | |
|---|---|---|---|---|---|
| iPS:436230 | | NA | SEQ ID NO:2912<br>CGGGCAAGTCAGGGCATTAGT<br>GAATGATTTAGGC | SEQ ID NO:10924<br>TCTGCATCCATTTTACAA<br>AGG | SEQ ID NO:18936<br>CTACAGCATAAAAGTTACCC<br>TCTCACT |
| | 21-225_201A1 | AA | SEQ ID NO:2913<br>RASQGIRNDLG | SEQ ID NO:10925<br>SASILQR | SEQ ID NO:18937<br>LQHKSYPLT |
| iPS:436232 | | NA | SEQ ID NO:2914<br>AGGGCCAGTCCGAGTATTAA<br>CAGCGGCTTCTTAGCC | SEQ ID NO:10926<br>GGTGCATCCAGCAGGGC<br>CACT | SEQ ID NO:18938<br>CACCAGTATGAGACCTCACC<br>GTGGACG |
| | 21-225_201E1 | AA | SEQ ID NO:2915<br>RASPSINSGFLA | SEQ ID NO:10927<br>GASSRAT | SEQ ID NO:18939<br>HQYETSPWT |
| iPS:436234 | | NA | SEQ ID NO:2916<br>TCTGGAAGCAACTCCAACAT<br>CGGAAGTAATATTGTAACC | SEQ ID NO:10928<br>AGTAATGATCAGCGGCC<br>CTCA | SEQ ID NO:18940<br>ACAGCATGGGATGACAGCCT<br>GAATGGTTGGGTG |
| | 21-225_51E3 | AA | SEQ ID NO:2917<br>SGSNSNIGSNIVT | SEQ ID NO:10929<br>SNDQRPS | SEQ ID NO:18941<br>TAWDDSLNGWV |
| iPS:436236 | | NA | SEQ ID NO:2918<br>AGGGCCAGTCAGAGATATTAA<br>AAACAACTTAGCC | SEQ ID NO:10930<br>GGTGCATCCACCAGGGC<br>CACT | SEQ ID NO:18942<br>CAGCAGTTTTATAACTGGCT<br>GTGCAGT |
| | 21-225_201F7 | AA | SEQ ID NO:2919<br>RASQNIKNNLA | SEQ ID NO:10931<br>GASTRAT | SEQ ID NO:18943<br>QQFYNWLCS |
| iPS:436238 | | NA | SEQ ID NO:2920<br>AGGGCCAGTCAGAGTGTTAG<br>CAGCAACTACTTAGCC | SEQ ID NO:10932<br>GGTGCATCCAGCAGGGC<br>CACT | SEQ ID NO:18944<br>CAGCAGTATGAAAACTCACC<br>GTGGACG |
| | 21-225_201B2 | AA | SEQ ID NO:2921<br>RASQSVSSNYLA | SEQ ID NO:10933<br>GASSRAT | SEQ ID NO:18945<br>QQYENSPWT |
| iPS:436240 | | NA | SEQ ID NO:2922<br>CGGGCCAGTCAGAACATTGG<br>TCGTAGTTTACAC | SEQ ID NO:10934<br>TATGCTTCCCAGTCCTTC<br>TCA | SEQ ID NO:18946<br>CATCAGAGTCGAAGTTTACC<br>GCTCACT |
| | 21-225_201E8 | NA | SEQ ID NO:2923 | SEQ ID NO:10935 | SEQ ID NO:18947 |

FIGURE 49
(Continued)

| | | | | | | | |
|---|---|---|---|---|---|---|---|
| iPS:436242 | | AA | RASQNIGRSLH | | YASQSFS | | HQSRSLPLT |
| | | | SEQ ID NO:2924 | | SEQ ID NO:10936 | | SEQ ID NO:18948 |
| | 21-225_201A10 | NA | CGGGCAAGTCAGGGCATTAG AAATGATTAGGC | | TCTACATCCAGTTTGCAT TCT | | CTACAGCATAATAGTTACCC GCTCACT |
| | | | SEQ ID NO:2925 | | SEQ ID NO:10937 | | SEQ ID NO:18949 |
| iPS:436244 | | AA | RASQGIRNDLG | | STSSLHS | | LQHNSYPLT |
| | | | SEQ ID NO:2926 | | SEQ ID NO:10938 | | SEQ ID NO:18950 |
| | 21-225_201H10 | NA | CGGGCAAGTCACAACATTAA CAGTATTTAAAT | | GCTGCATCCAGTTTGCAA AGT | | CAACAGAGTTACAGTTTCCC GCTCACT |
| | | | SEQ ID NO:2927 | | SEQ ID NO:10939 | | SEQ ID NO:18951 |
| iPS:436246 | | AA | RASHNINSYLN | | AASSLQS | | QQSYSFPLT |
| | | | SEQ ID NO:2928 | | SEQ ID NO:10940 | | SEQ ID NO:18952 |
| | 21-225_201G6 | NA | AGGTCTAGTCAGAGCCTCCT CCATAATAATAGATACAACC ATTTGGAT | | TTGGGTTCTAATCGGGCC TCC | | ATGCAAGCTCTACAAACTCC CACT |
| | | | SEQ ID NO:2929 | | SEQ ID NO:10941 | | SEQ ID NO:18953 |
| iPS:436248 | | AA | RSSQSLLHNNRYNHLD | | LGSNRAS | | MQALQTPT |
| | | | SEQ ID NO:2930 | | SEQ ID NO:10942 | | SEQ ID NO:18954 |
| | 21-225_202A3 | NA | CGGGCAAGTCAGGGCATTAG AAATGATTAGGC | | GCTGCATCCAGGTTGCA AAGT | | CTACAGCATCATGACTACC ATTCACT |
| | | | SEQ ID NO:2931 | | SEQ ID NO:10943 | | SEQ ID NO:18955 |
| iPS:436250 | | AA | RASQGIRNDLG | | AASRLQS | | LQHHDYPFT |
| | | | SEQ ID NO:2932 | | SEQ ID NO:10944 | | SEQ ID NO:18956 |
| | 21-225_201A4 | NA | AGGTCCAGTCAGAATATTAA AAGCAACTTAGCC | | GGTGCATCCACCAGGGC CACT | | CAGCAGTTTTATAACTGGCT GTGCAGT |
| | | | SEQ ID NO:2933 | | SEQ ID NO:10945 | | SEQ ID NO:18957 |
| iPS:436252 | | AA | RSSQNIKSNLA | | GASTRAT | | QQFYNWLCS |
| | | | SEQ ID NO:2934 | | SEQ ID NO:10946 | | SEQ ID NO:18958 |
| | | NA | AGGGCCAGTCAGAGAATTA ACAACAACTTAGCC | | GGTGCATCCACCAGGGC CACT | | CAGCAGTATTATAACTGGCT GTGCAGT |

FIGURE 49
(Continued)

| | | | | | | |
|---|---|---|---|---|---|---|
| iPS:436254 | 21-225_202A8 | AA | SEQ ID NO:2935<br>RASQRINNNLA<br>SEQ ID NO:2936 | SEQ ID NO:10947<br>GASTRAT<br>SEQ ID NO:10948 | SEQ ID NO:18959<br>QQYYNWLCS<br>SEQ ID NO:18960 | |
| iPS:436256 | 21-225_202C12 | NA | AGGTCTAGTCAGAGAGCCTCCTGCATAATAATAAATACAACCATTTGGAT<br>SEQ ID NO:2937<br>RSSQSLLHNNKYNHLD<br>SEQ ID NO:2938 | TTGGGTTCTAATCGGGCCTCC<br>SEQ ID NO:10949<br>LGSNRAS<br>SEQ ID NO:10950 | ATGCAAGCTCTACAAACTCCCACT<br>SEQ ID NO:18961<br>MQALQTPT<br>SEQ ID NO:18962 | |
| iPS:436258 | 21-225_202D9 | AA | AGGGCCAGTCAGAGTGTTAACAGCGGCTACTTAGCC<br>SEQ ID NO:2939<br>RASQSVNSGYLA<br>SEQ ID NO:2940 | GGTGCATCCAGCAGGGCCACT<br>SEQ ID NO:10951<br>GASSRAT<br>SEQ ID NO:10952 | CAACAATATGAGACCTCACCGTGGACG<br>SEQ ID NO:18963<br>QQYETSPWT<br>SEQ ID NO:18964 | |
| iPS:436260 | 21-225_202F12 | NA | AGGGCCAGTCAGAGTGTTCTGAACAACTTAGCC<br>SEQ ID NO:2941<br>RASQSVLNNLA<br>SEQ ID NO:2942 | GGTGCATCCACTAGGGCCACT<br>SEQ ID NO:10953<br>GASTRAT<br>SEQ ID NO:10954 | CAGCAGTATGATAACTGGCCTCCGTGCAGT<br>SEQ ID NO:18965<br>QQYDNWPPCS<br>SEQ ID NO:18966 | |
| iPS:436262 | 21-225_203H1 | AA | CGGGCGAGTCAGGGCATTGGCAATTATTTAGCC<br>SEQ ID NO:2943<br>RASQGIGNYLA<br>SEQ ID NO:2944 | GTTGCATCCAGGTTGCAAAGT<br>SEQ ID NO:10955<br>VASRLQS<br>SEQ ID NO:10956 | CAACGGTATCATACTTACCCGCTCACT<br>SEQ ID NO:18967<br>QRYHTYPLT<br>SEQ ID NO:18968 | |
| | 21-225_203E3 | NA | CGGGCAAGTCACAACATTAACAGCTATTTAAAT<br>SEQ ID NO:2945<br>RASHNINSYLN<br>SEQ ID NO:2946 | GCTGCATCCAGTTTGCAAAGT<br>SEQ ID NO:10957<br>AASSLQS<br>SEQ ID NO:10958 | CAACAGAGTTACAGTTTCCCGCTCACT<br>SEQ ID NO:18969<br>QQSYSFPLT<br>SEQ ID NO:18970 | |

FIGURE 49
(Continued)

| | | | | | |
|---|---|---|---|---|---|
| iPS:436264 | 21-225_203F7 | NA | CGGGCAAGTCAGGGCATTAG ACATGATTTAGGC<br>SEQ ID NO:2947 | GCTGCATCCAGTTTGCAA AGT<br>SEQ ID NO:10959 | CTACAGCATTATAGTTTCCCT CGGACG<br>SEQ ID NO:18971 |
| | | AA | RASQGIRHDLG<br>SEQ ID NO:2948 | AASSLQS<br>SEQ ID NO:10960 | LQHYSFPRT<br>SEQ ID NO:18972 |
| iPS:436268 | 21-225_203B9 | NA | CGGGCAAGTCAGGGCATTAG AAATGATTTAGGC<br>SEQ ID NO:2949 | AGGGCATCCAGTGTGCA AAAT<br>SEQ ID NO:10961 | CTACAGCATAATAGTTACCC ATTCACT<br>SEQ ID NO:18973 |
| | | AA | RASQGIRNDLG<br>SEQ ID NO:2950 | RASSVQN<br>SEQ ID NO:10962 | LQHNSYPFT<br>SEQ ID NO:18974 |
| iPS:436270 | 21-225_203F10 | NA | AAGTCCAGCCAGAGTGTTT TTTCCACTCGAACAATAAGA ACTACTTAGCT<br>SEQ ID NO:2951 | TGGGCATCTACCCGGGA ATCC<br>SEQ ID NO:10963 | CAACAATATTTAGTCTTCC ATTCACT<br>SEQ ID NO:18975 |
| | | AA | KSSQSVFFHSNNKNYLA<br>SEQ ID NO:2952 | WASTRES<br>SEQ ID NO:10964 | QQYFSLPFT<br>SEQ ID NO:18976 |
| iPS:436272 | 21-225_201F5 | NA | AAGTCCAGCCAGAGTGTTT ATACAGTTCCAACAATAAGA ACTACTTAGTT<br>SEQ ID NO:2953 | TGGGCATCTACCCGGGA ATCC<br>SEQ ID NO:10965 | CAGCAATATTATAGTACTCC TCCGACG<br>SEQ ID NO:18977 |
| | | AA | KSSQSVLYSSNNKNYLV<br>SEQ ID NO:2954 | WASTRES<br>SEQ ID NO:10966 | QQYYSTPPT<br>SEQ ID NO:18978 |
| iPS:436274 | 21-225_204H3 | NA | CGGGCAAGTCAGGGCATTAG AAATGATTTAGGC<br>SEQ ID NO:2955 | GCTGCAGCCAGTTTGCA AGGT<br>SEQ ID NO:10967 | CTACAGCATTATAGTTACCC TCGGACG<br>SEQ ID NO:18979 |
| | | AA | RASQGIRNDLG<br>SEQ ID NO:2956 | AAASLQG<br>SEQ ID NO:10968 | LQHYSYPRT<br>SEQ ID NO:18980 |
| iPS:436276 | 21-225_204H4 | NA | CGGGCAAGTCACAACATTAA CAGCTATTTAAAT<br>SEQ ID NO:2957 | GCTGCATCCAGTTTGCAA AGT<br>SEQ ID NO:10969 | CAACAGAGTTACAGTTTCCC GCTCACT<br>SEQ ID NO:18981 |

FIGURE 49
(Continued)

| | | | | | | | |
|---|---|---|---|---|---|---|---|
| iPS:436278 | 21-225_201F2 | AA | RASHNINSYLN<br>SEQ ID NO:2958 | AASSLQS<br>SEQ ID NO:10970 | QQSYSFPLT<br>SEQ ID NO:18982 |
| | | NA | AGGGCCAGTCAGTCAGAATATTAA<br>AAGCAACTTAGCC<br>SEQ ID NO:2959 | GGTGCATCCACCAGGGC<br>CACT<br>SEQ ID NO:10971 | CAGCAGTTTTATAACTGGCT<br>GTGCAGT<br>SEQ ID NO:18983 |
| iPS:436280 | 21-225_204D6 | AA | RASQNIKSNLA<br>SEQ ID NO:2960 | GASTRAT<br>SEQ ID NO:10972 | QQFYNWLCS<br>SEQ ID NO:18984 |
| | | NA | CGGGCAAGTCAGTCGGAGCGTTCA<br>CACCTATTTAAAT<br>SEQ ID NO:2961 | GGTGCATCCAGTTGCA<br>ACGT<br>SEQ ID NO:10973 | CAACAGAGTTACAGTTCCCC<br>GCTCACT<br>SEQ ID NO:18985 |
| iPS:436282 | 21-225_204G6 | AA | RASRSVHTYLN<br>SEQ ID NO:2962 | GASSLQR<br>SEQ ID NO:10974 | QQSYSSPLT<br>SEQ ID NO:18986 |
| | | NA | CGGACGAGTCAGGGCATTGG<br>CAATTATTTAGCC<br>SEQ ID NO:2963 | GCTGCATCCAGTTTGCAA<br>AGT<br>SEQ ID NO:10975 | CAACACTATCTTAGTTACCC<br>TCTCACT<br>SEQ ID NO:18987 |
| | | AA | RTSQGIGNYLA<br>SEQ ID NO:2964 | AASSLQS<br>SEQ ID NO:10976 | QHYLSYPLT<br>SEQ ID NO:18988 |
| iPS:436284 | 21-225_204G8 | NA | CGGGCGAGTCAGGGCATAA<br>GTAATCATTTAGCC<br>SEQ ID NO:2965 | GCTGCATCCAGTTTGCAA<br>AGT<br>SEQ ID NO:10977 | CAACAGTATAGTAATTACCC<br>GGTCACT<br>SEQ ID NO:18989 |
| | | AA | RASQGISNHLA<br>SEQ ID NO:2966 | AASSLQS<br>SEQ ID NO:10978 | QQYSNYPVT<br>SEQ ID NO:18990 |
| iPS:436286 | 21-225_204H8 | NA | CGGGCAAGTCAGGGCATTAG<br>AAATGATTTAGGC<br>SEQ ID NO:2967 | TCTGCATCCAGTTTGCAA<br>AGT<br>SEQ ID NO:10979 | CTACAACATAATAGTTACCC<br>TCTCACT<br>SEQ ID NO:18991 |
| | | AA | RASQGIRNDLG<br>SEQ ID NO:2968 | SASSLQS<br>SEQ ID NO:10980 | LQHNSYPLT<br>SEQ ID NO:18992 |
| iPS:436290 | 21-225_205G3 | NA | AGGGCCAGTCAGTCAGAATGTTAG<br>TTACAGCTACTTAGCC<br>SEQ ID NO:2969 | GGTGCATCCAGGAGGGC<br>CACT<br>SEQ ID NO:10981 | CAGCAGTATGGTAGCTCACC<br>GTGCAGT<br>SEQ ID NO:18993 |

FIGURE 49
(Continued)

| | | | | | |
|---|---|---|---|---|---|
| | | RASQNVSYSYLA | | GASRRAT | QQYGSSPCS |
| | AA | SEQ ID NO:2970 | | SEQ ID NO:10982 | SEQ ID NO:18994 |
| iPS:436292 | | | | | |
| | NA | CGGGCCAGTCAGGCCATTAG TAATCATTTAGCC | | GCTGCATCCAGTTTGCAA AGT | CAACAATATAGTAATTACCC ACTCACT |
| | | SEQ ID NO:2971 | | SEQ ID NO:10983 | SEQ ID NO:18995 |
| 21-225_205H3 | AA | RASQAISNHLA | | AASSLQS | QQYSNYPLT |
| | | SEQ ID NO:2972 | | SEQ ID NO:10984 | SEQ ID NO:18996 |
| iPS:436294 | NA | AGGGCCAGTCAGTCAGAGAATATTAA AAGCAACTTAGCC | | GGTGCATCCACCAGGGC CACT | CAGCAGTTTATAAACTGGCT GTGCAGT |
| | | SEQ ID NO:2973 | | SEQ ID NO:10985 | SEQ ID NO:18997 |
| 21-225_205G4 | AA | RASQNIKSNLA | | GASTRAT | QQFYNWLCS |
| | | SEQ ID NO:2974 | | SEQ ID NO:10986 | SEQ ID NO:18998 |
| iPS:436296 | NA | CGGGCCGAGTCAGGGCATTGG CAATTATTTAGCC | | GGTGTCTCCAGTTTGCAA AGT | CAACAATATAGTAATTACCC TCTCACT |
| | | SEQ ID NO:2975 | | SEQ ID NO:10987 | SEQ ID NO:18999 |
| 21-225_205F5 | AA | RASQGIGNYLA | | GVSSLQS | QQYSNYPLT |
| | | SEQ ID NO:2976 | | SEQ ID NO:10988 | SEQ ID NO:19000 |
| iPS:436302 | NA | AGGGCCAGTCAGTCAGAGTGTTT CAGCAACTACTTAGCC | | GGTGCATCCAGCAGGGC CGCT | CAGCAGTATGAAAGTTCACC GTGGACG |
| | | SEQ ID NO:2977 | | SEQ ID NO:10989 | SEQ ID NO:19001 |
| 21-225_205G7 | AA | RASQSVFSNYLA | | GASSRAA | QQYESSPWT |
| | | SEQ ID NO:2978 | | SEQ ID NO:10990 | SEQ ID NO:19002 |
| iPS:436304 | NA | AGGTCTAGTCAGAGCCTCCT GCATAATAATAGATACAACC ATTTGGAT | | TTGGGTTCTAATCGGGCC TCC | ATGCAAGCTCTACAAACTCC CACT |
| | | SEQ ID NO:2979 | | SEQ ID NO:10991 | SEQ ID NO:19003 |
| 21-225_201F3 | AA | RSSQSLLHNRYNHLD | | LGSNRAS | MQALQTPT |
| | | SEQ ID NO:2980 | | SEQ ID NO:10992 | SEQ ID NO:19004 |
| iPS:436306 | NA | AGGGCCAGTCAGAGTGTTAA TAGCTACTTAGCC | | GGTGCATCCACCAGGGC CACT | CAAGAGTATAATGACTGGCC GTGCAGT |

FIGURE 49
(Continued)

| | | | | | | |
|---|---|---|---|---|---|---|
| iPS:436308 | 21-225_201H4 | AA | SEQ ID NO:2981<br>RASQSVNSYLA | SEQ ID NO:10993<br>GASTRAT | SEQ ID NO:19005<br>QEYNDWPCS | |
| | | NA | SEQ ID NO:2982<br>CGGGCAAGTCAGGGCATTAGT<br>AAATGATTAGGC | SEQ ID NO:10994<br>TCTGCATCCTTTTGCAA<br>AGA | SEQ ID NO:19006<br>CTACAGCATAATAGTTACCC<br>GCTCACT | |
| iPS:436310 | 21-225_205H8 | AA | SEQ ID NO:2983<br>RASQGIRNDLG | SEQ ID NO:10995<br>SASFLQR | SEQ ID NO:19007<br>LQHNSYPLT | |
| | | NA | SEQ ID NO:2984<br>AGGGCCAGTCAGTCAGAGTATTAA<br>CAGCAAACTACTTAGCC | SEQ ID NO:10996<br>GGTGCATCCAGCAGGGC<br>CACT | SEQ ID NO:19008<br>CAGCAGTATGAAAACTCACC<br>GTGGACG | |
| iPS:436312 | 21-225_202D11 | AA | SEQ ID NO:2985<br>RASQSINSNYLA | SEQ ID NO:10997<br>GASSRAT | SEQ ID NO:19009<br>QQYENSPWT | |
| | | NA | SEQ ID NO:2986<br>CGGGCAAGTCACAACATTAA<br>CAGCTATTTAAAT | SEQ ID NO:10998<br>GCTGCATCCAGTTGCAA<br>AGT | SEQ ID NO:19010<br>CAACAGAGTTACAGTTTCCC<br>GCTCACT | |
| iPS:436314 | 21-225_206A4 | AA | SEQ ID NO:2987<br>RASHNINSYLN | SEQ ID NO:10999<br>AASSLQS | SEQ ID NO:19011<br>QQSYSFPLT | |
| | | NA | SEQ ID NO:2988<br>CGGGCCAGTCAGAGCATTGG<br>TCGTAGCTTACAC | SEQ ID NO:11000<br>TATGCTTCCCAGTCCTTC<br>TCA | SEQ ID NO:19012<br>CATCAGAGTAGAAGTTTACC<br>GCTCACT | |
| iPS:436316 | 21-225_206G4 | AA | SEQ ID NO:2989<br>RASQSIGRSLH | SEQ ID NO:11001<br>YASQSFS | SEQ ID NO:19013<br>HQSRSLPLT | |
| | | NA | SEQ ID NO:2990<br>CGGGCAAGTCACAACATTAA<br>CAGCTATTTAAAT | SEQ ID NO:11002<br>GCTGCATCCAGTTGCAA<br>AGT | SEQ ID NO:19014<br>CAACAGAGTTACAGTTTCCC<br>GCTCACT | |
| iPS:436324 | 21-225_206A5 | AA | SEQ ID NO:2991<br>RASHNINSYLN | SEQ ID NO:11003<br>AASSLQS | SEQ ID NO:19015<br>QQSYSFPLT | |
| | | NA | SEQ ID NO:2992<br>CGGGCGAGTCAGGGCATTAG<br>AAATTATTTAGCC | SEQ ID NO:11004<br>GCTGCATCCAGTTGCAA<br>AGT | SEQ ID NO:19016<br>CAACAGTACAGTAATTACCC<br>TCTCACT | |

FIGURE 49
(Continued)

| | | | | | |
|---|---|---|---|---|---|
| iPS:436328 | 21-225_207G6 | | SEQ ID NO:2993 | SEQ ID NO:11005 | SEQ ID NO:19017 |
| | | AA | RASQGIRNYLA | AASSLQS | QQYSNYPLT |
| | | NA | SEQ ID NO:2994 | SEQ ID NO:11006 | SEQ ID NO:19018 |
| | | | CGGGCAAGTCAGGGCATTAG AAATGATTTAGGC | GCTGCATCCAGTTTGCAA AGT | CTACAGCATAATAGTTACCC TCTCACC |
| iPS:436332 | 21-225_207F12 | | SEQ ID NO:2995 | SEQ ID NO:11007 | SEQ ID NO:19019 |
| | | AA | RASQGIRNDLG | AASSLQS | LQHNSYPLT |
| | | NA | SEQ ID NO:2996 | SEQ ID NO:11008 | SEQ ID NO:19020 |
| | | | CGGGCAAGTCAGGGCATTAG ACATGATTTAGGC | GCTGCATCCAGTTTGCAA AGT | CTACAGCATTATAGTTACCC TCGGACG |
| iPS:436334 | 21-225_208B2 | | SEQ ID NO:2997 | SEQ ID NO:11009 | SEQ ID NO:19021 |
| | | AA | RASQGIRHDLG | AASSLQS | LQHYSYPRT |
| | | NA | SEQ ID NO:2998 | SEQ ID NO:11010 | SEQ ID NO:19022 |
| | | | AGGTCTAGTCAGAGAGCCTCCT GCATAATAATAAATACAACC ATTTGGAT | TTGGGTTCTAATCGGGCC TCC | ATGCAAGCTCTACAAACTCC CACT |
| iPS:436336 | 21-225_208G3 | | SEQ ID NO:2999 | SEQ ID NO:11011 | SEQ ID NO:19023 |
| | | AA | RSSQSLLHNNKYNHLD | LGSNRAS | MQALQTPT |
| | | NA | SEQ ID NO:3000 | SEQ ID NO:11012 | SEQ ID NO:19024 |
| | | | AGGGCCAGTCAGAGAGTGTTAG CAGCAACTACTTAGCC | GGTGCATCCAGCAGGGC CACT | CAGCACTACGAAAACTCACC GTGGACG |
| iPS:436336 | 21-225_208B5 | | SEQ ID NO:3001 | SEQ ID NO:11013 | SEQ ID NO:19025 |
| | | AA | RASQVSSNYLA | GASSRAT | QHYENSPWT |
| | | NA | SEQ ID NO:3002 | SEQ ID NO:11014 | SEQ ID NO:19026 |
| | | | CGGGCAAGTCACACAACATTAA CAGCTATTTAAAT | GCTGCATCCAGTTTGCAA AGT | CAACAGAGTTACAGTTTCCC GCTCACT |
| iPS:436338 | 21-225_208E8 | | SEQ ID NO:3003 | SEQ ID NO:11015 | SEQ ID NO:19027 |
| | | AA | RASHNINSYLN | AASSLQS | QQSYSFPLT |
| | | | SEQ ID NO:3004 | SEQ ID NO:11016 | SEQ ID NO:19028 |

FIGURE 49
(Continued)

| | | | | | |
|---|---|---|---|---|---|
| iPS:436340 | 21-225_208A9 | NA | AGGGCCAGTCAGAGTGTTAG CAACAACTACTTAGCC SEQ ID NO:3005 | GGTGCATCCAGCAGGGC CACT SEQ ID NO:11017 | CAGCACTATCATAGCTTCACC GTGGACG SEQ ID NO:19029 |
| | | AA | RASQSVSNNYLA SEQ ID NO:3006 | GASSRAT SEQ ID NO:11018 | QHYHSSPWT SEQ ID NO:19030 |
| iPS:436344 | 21-225_208B11 | NA | CGGGCAAGTCACAACATTAA CAGCTATTTAAAT SEQ ID NO:3007 | GCTGCATCCAGTTGCAA AGT SEQ ID NO:11019 | CAACAGAGTTACAGTTTCCC GCTCACT SEQ ID NO:19031 |
| | | AA | RASHNINSYLN SEQ ID NO:3008 | AASSLQS SEQ ID NO:11020 | QQSYSFPLT SEQ ID NO:19032 |
| iPS:436350 | 21-225_210E4 | NA | CGGGCAAGTCAGGGCATTAG AAATGATTTAGGC SEQ ID NO:3009 | GCTGCATCCAGTTGCAA AGT SEQ ID NO:11021 | CTACAGCATAATAGTTACCC ATTCACT SEQ ID NO:19033 |
| | | AA | RASQGIRNDLG SEQ ID NO:3010 | AASSLQS SEQ ID NO:11022 | LQHNSYPFT SEQ ID NO:19034 |
| iPS:436352 | 21-225_210G5 | NA | CGGGCAAGTCAGGGCATTAG ACATGATTTAGGC SEQ ID NO:3011 | GCTGCATCCAGTTGCAA AGT SEQ ID NO:11023 | CTACACCATTATAGTTACCC TCGGACG SEQ ID NO:19035 |
| | | AA | RASQGIRHDLG SEQ ID NO:3012 | AASSLQS SEQ ID NO:11024 | LHHYSYPRT SEQ ID NO:19036 |
| iPS:436354 | 21-225_210G10 | NA | CGGACAAGTCAGGGCATTAG AAATGATTTAGGC SEQ ID NO:3013 | GCTGCATCCAGTTTGTTT AGT SEQ ID NO:11025 | CTACAGTATAATAGTTACCC TCCCACC SEQ ID NO:19037 |
| | | AA | RTSQGIRNDLG SEQ ID NO:3014 | AASSLFS SEQ ID NO:11026 | LQYNSYPPT SEQ ID NO:19038 |
| iPS:436356 | 21-225_210H10 | NA | AGGGCCAGTCAGAGTGTTAA AGCAACTTAGCC SEQ ID NO:3015 | GGTGCATCCACCAGGGC CACT SEQ ID NO:11027 | CAGCAGTATTATAAACTGGCT GTGCAGT SEQ ID NO:19039 |
| | | AA | RASQSVKSNLA SEQ ID NO:3016 | GASTRAT SEQ ID NO:11028 | QQYYNWLCS SEQ ID NO:19040 |

FIGURE 49
(Continued)

| | | | | |
|---|---|---|---|---|
| iPS:436358 | 21-225_210D11 | NA | CGGGGCAAGTCACAACATTAAA CAGCTATTTAAAT SEQ ID NO:3017 | GCTGCATCCAGTTTGCAA AGT SEQ ID NO:11029 | CAACAGAGTTACAGTTTCCC GCTCACT SEQ ID NO:19041 |
| | | AA | RASHNINSYLN SEQ ID NO:3018 | AASSLQS SEQ ID NO:11030 | QQSYSFPLT SEQ ID NO:19042 |
| iPS:436360 | 21-225_210H11 | NA | CGGGCGAGTCAGGGTATTAG CATCTGGTTAGCC SEQ ID NO:3019 | GCTGCATCCAGTTTGCAA AGT SEQ ID NO:11031 | CAACAGGCTAAAAGTTTCCC ATTCACT SEQ ID NO:19043 |
| | | AA | RASQGISIWLA SEQ ID NO:3020 | AASSLQS SEQ ID NO:11032 | QQAKSFPFT SEQ ID NO:19044 |
| iPS:436362 | 21-225_210C12 | NA | AGGTCTAGTCAGAGACCTCCT GCATTATAATGGACACAACT TTTTGGAT SEQ ID NO:3021 | TTGGTTTCTAATCGGGCC TCC SEQ ID NO:11033 | ATGCAAGCTCTACAAACTCC CATGTGCAGT SEQ ID NO:19045 |
| | | AA | RSSQSLLHYNGHNFLD SEQ ID NO:3022 | LVSNRAS SEQ ID NO:11034 | MQALQTPMCS SEQ ID NO:19046 |
| iPS:436364 | 21-225_211A11 | NA | CGGGCGAGTCAGGGCATTGG CAATTATTTAGCC SEQ ID NO:3023 | GATGCATCCAGTTTGGA AAGT SEQ ID NO:11035 | CAACACTATATGACTTACCC GCTCACT SEQ ID NO:19047 |
| | | AA | RASQGIGNYLA SEQ ID NO:3024 | DASSLES SEQ ID NO:11036 | QHYMTYPLT SEQ ID NO:19048 |
| iPS:436366 | 21-225_211A3 | NA | CGGGCGAGTCAGGCCATTGG GAAACATTTAGCC SEQ ID NO:3025 | GCTGCATCCAGATTGCA AAGT SEQ ID NO:11037 | CAACAGTATAGTAATTATCC GCTCACT SEQ ID NO:19049 |
| | | AA | RASQAIGKHLA SEQ ID NO:3026 | AASRLQS SEQ ID NO:11038 | QQYSNYPLT SEQ ID NO:19050 |
| iPS:436368 | 21-225_211G3 | NA | AGGGCCAGTCAGAGTGTTAG CAGCAGCTTCTTAGCC SEQ ID NO:3027 | GGTGCATCCAGCAGGGC CACT SEQ ID NO:11039 | CAGCAGTATGTTAGCTCACC GCTCACT SEQ ID NO:19051 |
| | | AA | RASQSVSSSFLA | GASSRAT | QQYVSSPLT |

FIGURE 49
(Continued)

| | | | | | | |
|---|---|---|---|---|---|---|
| iPS:436370 | 21-225_211A6 | NA | SEQ ID NO:3028 CGGGCGAGTCAGGGCATTAGCAAGTATTTAGCC | SEQ ID NO:11040 GCTGCATCCAGTTTGCTAAGT | SEQ ID NO:19052 CAAAAGTATGATACTTACCCATTCACT |
| | | AA | SEQ ID NO:3029 RASQGIGKYLA | SEQ ID NO:11041 AASSLLS | SEQ ID NO:19053 QKYDTYPFT |
| iPS:436372 | 21-225_211A8 | NA | SEQ ID NO:3030 CGGGCGAGTCAGGGCATTAGCAGATATTTAGCC | SEQ ID NO:11042 GCTGCATCCAGTTTGCAAAGT | SEQ ID NO:19054 CTACGGTATGATACTTACCCTCTCATT |
| | | AA | SEQ ID NO:3031 RASQGISRYLA | SEQ ID NO:11043 AASSLQS | SEQ ID NO:19055 LRYDTYPLI |
| iPS:436374 | 21-225_211C10 | NA | SEQ ID NO:3032 AGGTCTAGTCAGAGCCTCCTCCATAGTAATGGATACAACTATTTGGAT | SEQ ID NO:11044 TTGGGTTCTAATCGGGCCTCC | SEQ ID NO:19056 ATGCAAGCTCTACTAACTCCCGTGTGCAGT |
| | | AA | SEQ ID NO:3033 RSSQSLLHSNGYNYLD | SEQ ID NO:11045 LGSNRAS | SEQ ID NO:19057 MQALLTPVCS |
| iPS:436376 | 21-225_212E6 | NA | SEQ ID NO:3034 CGGGCGAGTCAGGGCATTAGCAATCATTTAGCC | SEQ ID NO:11046 GCTGCATCCAGTTTGCAAAGT | SEQ ID NO:19058 CAACAGTATGTTACCTACCCTCTCACT |
| | | AA | SEQ ID NO:3035 RASQGISNHLA | SEQ ID NO:11047 AASSLQS | SEQ ID NO:19059 QQYVTYPLT |
| iPS:436378 | 21-225_212D7 | NA | SEQ ID NO:3036 CGGGCGAGTCAGGGCATTAGCAATCATTTAGCC | SEQ ID NO:11048 GCTGCATCCAGTTTGCAAAGT | SEQ ID NO:19060 CAGCAGTATAGTAATTACCCTCTCACT |
| | | AA | SEQ ID NO:3037 RASQGISNHLA | SEQ ID NO:11049 AASSLQS | SEQ ID NO:19061 QQYSNYPLT |
| iPS:436380 | 21-225_212H9 | NA | SEQ ID NO:3038 CGGGCGAGTCAGGGCATTAGCAGTTATTTAGCC | SEQ ID NO:11050 GCTGCATCCAGTTTGCAAAGT | SEQ ID NO:19062 CTACGGTATGATACTTACCCTCTCACT |
| | | | SEQ ID NO:3039 | SEQ ID NO:11051 | SEQ ID NO:19063 |

FIGURE 49
(Continued)

| | | | | | | |
|---|---|---|---|---|---|---|
| iPS:436382 | 21-225_212C10 | AA | RASQGISSYLA SEQ ID NO:3040 | | AASSLQS SEQ ID NO:11052 | | LRYDTYPLT SEQ ID NO:19064 |
| | | NA | AGGGCCAGTCAGAGTGTTGC CAGCAGCTTAGCC SEQ ID NO:3041 | GGTACATCCAGCACCAGGGC CACT SEQ ID NO:11053 | CAGCAGTATAATGACTGGCC GTGCAGT SEQ ID NO:19065 |
| iPS:436384 | 21-225_212F10 | AA | RASQSVASSLA SEQ ID NO:3042 | GTSTRAT SEQ ID NO:11054 | QQYNDWPCS SEQ ID NO:19066 |
| | | NA | CGGGCGAGTCAGGGCATTAG CAATTATTTAGAC SEQ ID NO:3043 | TCTGCATCCAATTTGCAA AGT SEQ ID NO:11055 | CAACACTATAGTAATTACCC GCTCACT SEQ ID NO:19067 |
| iPS:436386 | 21-225_212B11 | AA | RASQGISNYLD SEQ ID NO:3044 | SASNLQS SEQ ID NO:11056 | QHYSNYPLT SEQ ID NO:19068 |
| | | NA | CGGGCAAGTCAGGGCATTAG AAATGATTTAGGC SEQ ID NO:3045 | GCTGCATCCAGTTTGCAA AGT SEQ ID NO:11057 | CTACTGCATTATAGTTACCCT CGGACG SEQ ID NO:19069 |
| iPS:436388 | 21-225_212H11 | AA | RASQGIRNDLG SEQ ID NO:3046 | AASSLQS SEQ ID NO:11058 | LLHYSYPRT SEQ ID NO:19070 |
| | | NA | CGGGCGAGTCAGGGCCATTGG GAAACATTTAGCC SEQ ID NO:3047 | GCTGCATCCAGATTGCA AAGT SEQ ID NO:11059 | CAACACTATAGTAATTATCC GCTCACT SEQ ID NO:19071 |
| iPS:436390 | 21-225_213D2 | AA | RASQAIGKHLA SEQ ID NO:3048 | AASRLQS SEQ ID NO:11060 | QHYSNYPLT SEQ ID NO:19072 |
| | | NA | CGGGCGAGTCAGGGCATTAG CAATCATTTAGCC SEQ ID NO:3049 | GCTGCATCCAGTTTGCAA AGT SEQ ID NO:11061 | CACCAGTATAGTAATTACCC TCTCACT SEQ ID NO:19073 |
| iPS:436392 | 21-225_213B3 | AA | RASQGISNHLA SEQ ID NO:3050 | AASSLQS SEQ ID NO:11062 | HQYSNYPLT SEQ ID NO:19074 |
| | | NA | CGGGCGAGTCAGGGCATTGG CAAGTATTTAGCC SEQ ID NO:3051 | GCTGCATCCAGTGTGCTA AGT SEQ ID NO:11063 | CAAAAGTATGATACTTACCC ATTCACT SEQ ID NO:19075 |

FIGURE 49
(Continued)

| | | | | | | |
|---|---|---|---|---|---|---|
| | | AA | RASQGIGKYLA | AASSVLS | | QKYDTYPFT |
| iPS:436394 | | | SEQ ID NO:3052 | SEQ ID NO:11064 | | SEQ ID NO:19076 |
| | 21-225_213C4 | NA | CGGGCGAGTCAGGGCCATTAG GAATTATTTAGCC | GCTGCATCCAGTTTGCAA AGT | | CAACAGTATAGTAATTACCC TCTCACT |
| | | | SEQ ID NO:3053 | SEQ ID NO:11065 | | SEQ ID NO:19077 |
| iPS:436396 | | AA | RASQAIRNYLA | AASSLQS | | QQYSNYPLT |
| | | | SEQ ID NO:3054 | SEQ ID NO:11066 | | SEQ ID NO:19078 |
| | 21-225_213E5 | NA | CGGGCGAGTCAGGGCCATTGG GAAACATTTAGCC | GCTGCATCCAGATTGCA AAGT | | CAACACTATAGTAATTATCC GCTCACT |
| | | | SEQ ID NO:3055 | SEQ ID NO:11067 | | SEQ ID NO:19079 |
| iPS:436398 | | AA | RASQAIGKHLA | AASRLQS | | QHYSNYPLT |
| | | | SEQ ID NO:3056 | SEQ ID NO:11068 | | SEQ ID NO:19080 |
| | 21-225_213B8 | NA | CGGGCGAGTCAGGGCATTAG CAATCATTTAGCC | GCTGCATCCAGTTTGCAA AGT | | CAACAGTATAGTAATTACCC TCTCACT |
| | | | SEQ ID NO:3057 | SEQ ID NO:11069 | | SEQ ID NO:19081 |
| iPS:436400 | | AA | RASQGISNHLA | AASSLQS | | QQYSNYPLT |
| | | | SEQ ID NO:3058 | SEQ ID NO:11070 | | SEQ ID NO:19082 |
| | 21-225_213H7 | NA | AAGTCCAGCCAGAATGTTT AGACATCTCCAACAATAAGA ATTCCTTAGGT | TGGGCATCTACCCGGGA ATCC | | CAGCAATATATTATAACATTCC TCCGACG |
| | | | SEQ ID NO:3059 | SEQ ID NO:11071 | | SEQ ID NO:19083 |
| iPS:436402 | | AA | KSSQNVLDISNKNSLG | WASTRES | | QQYYNIPPT |
| | | | SEQ ID NO:3060 | SEQ ID NO:11072 | | SEQ ID NO:19084 |
| | 21-225_213H12 | NA | AAGTCCAGCCAGAATGTTT AAAGACCTCCAACAATAGG AACTACTTAGCT | TGGGCATCTACCCGGGA ATCC | | CACCAATATTATAGTATTCC GTGGACC |
| | | | SEQ ID NO:3061 | SEQ ID NO:11073 | | SEQ ID NO:19085 |
| | | AA | KSSQNVLKTSNNRNYLA | WASTRES | | HQYYSIPWT |
| | | | SEQ ID NO:3062 | SEQ ID NO:11074 | | SEQ ID NO:19086 |

FIGURE 49
(Continued)

| | | | | | |
|---|---|---|---|---|---|
| iPS:436404 | 21-225_214C3 | NA | CGGGCGAGTCAGGGCATTGG CAATTATTTAGCC SEQ ID NO:3063 | GCTGCATCCAGTTTGCAA AGT SEQ ID NO:11075 | CAACAATATATGACTTACCC AATCACT SEQ ID NO:19087 |
| | | AA | RASQGIGNYLA SEQ ID NO:3064 | AASSLQS SEQ ID NO:11076 | QQYMTYPIT SEQ ID NO:19088 |
| iPS:436406 | 21-225_214E4 | NA | CGGGCGAGTCAGGGCATTAG CAATTATTTAGCC SEQ ID NO:3065 | GCTGCATCCAGTTTGCAA AGT SEQ ID NO:11077 | CAACAGTATCTTACTTACCC ATTCACT SEQ ID NO:19089 |
| | | AA | RASQGISNYLA SEQ ID NO:3066 | AASSLQS SEQ ID NO:11078 | QQYLTYPFT SEQ ID NO:19090 |
| iPS:436408 | 21-225_214H8 | NA | CGGGCCAGTCAGAGAGCATTGG TGTTAGCTTACAC SEQ ID NO:3067 | TATGCTTCCCAGTCCTTC TCA SEQ ID NO:11079 | CATCAGAGTCGTAGTTACC ATTCACT SEQ ID NO:19091 |
| | | AA | RASQSIGVSLH SEQ ID NO:3068 | YASQSFS SEQ ID NO:11080 | HQSRSLPFT SEQ ID NO:19092 |
| iPS:436410 | 21-225_212E10 | NA | CGGGCGAGTCAGGGCATTAG CAATCATTTAGCC SEQ ID NO:3069 | GCTGCATCCAGTTTGCAA AGT SEQ ID NO:11081 | CAACAGTATAGTAATTACCC TCTCACT SEQ ID NO:19093 |
| | | AA | RASQGISNHLA SEQ ID NO:3070 | AASSLQS SEQ ID NO:11082 | QQYSNYPLT SEQ ID NO:19094 |
| iPS:436412 | 21-225_214H9 | NA | CGGGCGAAGTCAGGGCATTAG AAATGATTTAGGC SEQ ID NO:3071 | GCTGCATCCAGTTTGCAA AGT SEQ ID NO:11083 | CTACAGCATTATAGTTACCC TCGGACG SEQ ID NO:19095 |
| | | AA | RASQGIRNDLG SEQ ID NO:3072 | AASSLQS SEQ ID NO:11084 | LQHYSYPRT SEQ ID NO:19096 |
| iPS:436414 | 21-225_214G10 | NA | CGGGCCAAGTCAGGGCATTAG AAATGATTTAGGC SEQ ID NO:3073 | GCTGCATCCAGTTTGCAA AGT SEQ ID NO:11085 | CTACTGCATAATAGTTACCC TCGGACG SEQ ID NO:19097 |
| | | AA | RASQGIRNDLG SEQ ID NO:3074 | AASSLQS SEQ ID NO:11086 | LLHNSYPRT SEQ ID NO:19098 |

FIGURE 49
(Continued)

| | | | | | |
|---|---|---|---|---|---|
| iPS:436416 | 21-225_214G12 | NA | CGGGCAAGTCAGGGCATTAG AAATGATTTAGGC<br>SEQ ID NO:3075 | GCTGCATCCAGTTTGCAA AGT<br>SEQ ID NO:11087 | GTAATGCATTATAGTTACCC TCGGACG<br>SEQ ID NO:19099 |
| | | AA | RASQGIRNDLG<br>SEQ ID NO:3076 | AASSLQS<br>SEQ ID NO:11088 | VMHYSYPRT<br>SEQ ID NO:19100 |
| iPS:436418 | 21-225_215E3 | NA | CGGGCAAGTCAGGGCATTAG AAATGATTTAGGC<br>SEQ ID NO:3077 | GCTGCATCCAGTTTGCAA AGT<br>SEQ ID NO:11089 | GTAATGCATAATAGTTACCC TCGGACG<br>SEQ ID NO:19101 |
| | | AA | RASQGIRNDLG<br>SEQ ID NO:3078 | AASSLQS<br>SEQ ID NO:11090 | VMHNSYPRT<br>SEQ ID NO:19102 |
| iPS:436420 | 21-225_215B5 | NA | CGGGCGAGTCAGGGCATTAG CAATCATTTAGCC<br>SEQ ID NO:3079 | GCTGCATCCAGTTTGCAA AGT<br>SEQ ID NO:11091 | CAGCAGTATATTAATTACCC TCTCACT<br>SEQ ID NO:19103 |
| | | AA | RASQGISNHLA<br>SEQ ID NO:3080 | AASSLQS<br>SEQ ID NO:11092 | QQYINYPLT<br>SEQ ID NO:19104 |
| iPS:436422 | 21-225_215D6 | NA | CGGGCGAGTCAGGGCATTAG CAATCATTTAGCC<br>SEQ ID NO:3081 | GCTGCATCCAGTTTGCAT AGT<br>SEQ ID NO:11093 | CAACAGTATGTTACTTACCC TCTCACT<br>SEQ ID NO:19105 |
| | | AA | RASQGISNHLA<br>SEQ ID NO:3082 | AASSLHS<br>SEQ ID NO:11094 | QQYVTYPLT<br>SEQ ID NO:19106 |
| iPS:436424 | 21-225_215H6 | NA | CGGGCCAGTCAGAGCATCGG TGTTAGCTTACAC<br>SEQ ID NO:3083 | TATGCTTCCCAGTCCCTC TCA<br>SEQ ID NO:11095 | CATCAGAGTCGCAGTTTACC ATTCACT<br>SEQ ID NO:19107 |
| | | AA | RASQSIGVSLH<br>SEQ ID NO:3084 | YASQSLS<br>SEQ ID NO:11096 | HQSRSLPFT<br>SEQ ID NO:19108 |
| iPS:436426 | 21-225_215C7 | NA | AGGGCCAGTCAGAGGATTAC CACCAACTTCTTAGCT<br>SEQ ID NO:3085 | GGTGCATCCAGCAGGGC CACT<br>SEQ ID NO:11097 | CAGCAGTATGTTAGTTCATT GCTCACT<br>SEQ ID NO:19109 |
| | | AA | RASQRITNFLA<br>SEQ ID NO:3086 | GASSRAT<br>SEQ ID NO:11098 | QQYVSSLLT<br>SEQ ID NO:19110 |

FIGURE 49
(Continued)

| | | | | | |
|---|---|---|---|---|---|
| iPS:436428 | 21-225_215E11 | NA | CGGGCAAGTCAGGGCATTAG AAATGATTTAGGC SEQ ID NO:3087 | GCTGCATCCAGTTTGCAA AGT SEQ ID NO:11099 | GTAATGCATTATAGTTACCC TCGGACG SEQ ID NO:19111 |
| | | AA | RASQGIRNDLG SEQ ID NO:3088 | AASSLQS SEQ ID NO:11100 | VMHYSYPRT SEQ ID NO:19112 |
| iPS:436430 | 21-225_215A12 | NA | CGGACGAGTCAGGACATTGG CAATTATTTAGCC SEQ ID NO:3089 | GCTGCATCCAGTTTACAG AGT SEQ ID NO:11101 | CAACAGTATGTTACTTACCC GCTCACT SEQ ID NO:19113 |
| | | AA | RTSQDIGNYLA SEQ ID NO:3090 | AASSLQS SEQ ID NO:11102 | QQYVTYPLT SEQ ID NO:19114 |
| iPS:436432 | 21-225_215H12 | NA | AGGGCCAGTCAGAGTGTTAG CAGCAGCTTCTTAGCT SEQ ID NO:3091 | GGTGCATCCAGCAGGGC CATT SEQ ID NO:11103 | CAGCAGTATGTTAGCTCACC GCTCACT SEQ ID NO:19115 |
| | | AA | RASQSVSSSFLA SEQ ID NO:3092 | GASSRAI SEQ ID NO:11104 | QQYVSSPLT SEQ ID NO:19116 |
| iPS:436434 | 21-225_216B10 | NA | AGGGCCAGTCAGAGTGTTAA CAACAACTTAGCC SEQ ID NO:3093 | GGTGCATCCACCAGGGC CACT SEQ ID NO:11105 | CAGCAGTATAATGACTGGCC GTGCAGT SEQ ID NO:19117 |
| | | AA | RASQSVNNNLA SEQ ID NO:3094 | GASTRAT SEQ ID NO:11106 | QQYNDWPCS SEQ ID NO:19118 |
| iPS:436436 | 21-225_216F10 | NA | AGGGCCAGTCAGAGTGTTAG CAGCAGCTTCTTAGCC SEQ ID NO:3095 | GGTACATCCACCAGGGC CACT SEQ ID NO:11107 | CAACAGTATGATAGGTCACC ATTCACT SEQ ID NO:19119 |
| | | AA | RASQSVSSSFLA SEQ ID NO:3096 | GTSTRAT SEQ ID NO:11108 | QQYDRSPFT SEQ ID NO:19120 |
| iPS:436438 | 21-225_216E8 | NA | CGGGCAAGTCAGGGCATTAG AAATGATTTAGGC SEQ ID NO:3097 | GCTGCATCCAGTTTGCAA AGT SEQ ID NO:11109 | CTAATGCATTATAGTTACCC TCGGACG SEQ ID NO:19121 |
| | | AA | RASQGIRNDLG SEQ ID NO:3098 | AASSLQS SEQ ID NO:11110 | LMHYSYPRT SEQ ID NO:19122 |

FIGURE 49
(Continued)

| iPS:436440 | 21-225_216H12 | NA | CGGGCAAGTCAGGGCATTAG AAATGATTTAGGC SEQ ID NO:3099 | GGTGCATCCAGTTTGCA AAGT SEQ ID NO:11111 | GTAATGCATAATAGTTACCC TCGGACG SEQ ID NO:19123 |
|---|---|---|---|---|---|
| | | AA | RASQGIRNDLG SEQ ID NO:3100 | GASSLQS SEQ ID NO:11112 | VMHNSYPRT SEQ ID NO:19124 |
| iPS:436448 | 21-225_217A3 | NA | CGGGCCAGTCAGAGCATTGG TAGTAGCTTACAC SEQ ID NO:3101 | TATGCTTCCCAGTCCTTC TCA SEQ ID NO:11113 | CATCAGAGTAGAAGTTTACC GTGGACG SEQ ID NO:19125 |
| | | AA | RASQSIGSSLH SEQ ID NO:3102 | YASQSFS SEQ ID NO:11114 | HQSRSLPWT SEQ ID NO:19126 |
| iPS:436450 | 21-225_217E5 | NA | CGGGCAAGTCAGGGCATTAG AAATGATTTAGGC SEQ ID NO:3103 | GCTGCATCCAGTTTGCAA AGT SEQ ID NO:11115 | GTAATGCATAATAGTTACCC TCGGACG SEQ ID NO:19127 |
| | | AA | RASQGIRNDLG SEQ ID NO:3104 | AASSLQS SEQ ID NO:11116 | VMHNSYPRT SEQ ID NO:19128 |
| iPS:436452 | 21-225_217G5 | NA | CGGGCGAGTCAGGGCATTGG CAATTATTTAGCC SEQ ID NO:3105 | GCTGCATCCAGTTTGCAA AGT SEQ ID NO:11117 | CAACAGTATGTTAATTACCC TCTCACT SEQ ID NO:19129 |
| | | AA | RASQGIGNYLA SEQ ID NO:3106 | AASSLQS SEQ ID NO:11118 | QQYVNYPLT SEQ ID NO:19130 |
| iPS:436454 | 21-225_217B10 | NA | CGGGCCGAGTCAGGGCATTGG GAAACATTTAGCC SEQ ID NO:3107 | GCTGCATCCAGATTGCA AAGT SEQ ID NO:11119 | CAACACCAGTAAAATCTCC AGTGCAG SEQ ID NO:19131 |
| | | AA | RASQAIGKHLA SEQ ID NO:3108 | AASRLQS SEQ ID NO:11120 | QHTSKSPVQ SEQ ID NO:19132 |
| iPS:436456 | 21-225_217G10 | NA | CGGGCAAGTCAGGGCATTAG AAATGATTTAGGC SEQ ID NO:3109 | GCTGCATCCAGTTTGCAA AGT SEQ ID NO:11121 | GTAATGCATAATAGTTACCC TCGGACG SEQ ID NO:19133 |
| | | AA | RASQGIRNDLG SEQ ID NO:3110 | AASSLQS SEQ ID NO:11122 | VMHNSYPRT SEQ ID NO:19134 |

FIGURE 49
(Continued)

| | | | | | |
|---|---|---|---|---|---|
| iPS:436458 | 21-225_217H12 | NA | CGGGCAAGTCAGGGCATTAG AAATGATTTAGGC<br>SEQ ID NO:3111 | GCTGCATCCAGTTTGCAA AGT<br>SEQ ID NO:11123 | CTAATGCATTATAGTTACCC TCGGACG<br>SEQ ID NO:19135 |
| | | AA | RASQGIRNDLG<br>SEQ ID NO:3112 | AASSLQS<br>SEQ ID NO:11124 | LMHYSYPRT<br>SEQ ID NO:19136 |
| iPS:436462 | 21-225_218C4 | NA | CGGGCAAGTCAGGGCATTAG AAATGATTTAGGC<br>SEQ ID NO:3113 | GCTGCATCCAGTTTGCAA AGT<br>SEQ ID NO:11125 | GTAATGCATTATAGTTACCC TCGGACG<br>SEQ ID NO:19137 |
| | | AA | RASQGIRNDLG<br>SEQ ID NO:3114 | AASSLQS<br>SEQ ID NO:11126 | VMHYSYPRT<br>SEQ ID NO:19138 |
| iPS:436464 | 21-225_219H1 | NA | CGGGCGAGTCAGGGCATTAG CAATTATTTAGAC<br>SEQ ID NO:3115 | TCTGCATCCAATTTGCAA AGT<br>SEQ ID NO:11127 | CAACACTATAGTAATTACCC GCTCACT<br>SEQ ID NO:19139 |
| | | AA | RASQGISNYLD<br>SEQ ID NO:3116 | SASNLQS<br>SEQ ID NO:11128 | QHYSNYPLT<br>SEQ ID NO:19140 |
| iPS:436472 | 21-225_220E1 | NA | AGGGCCAGTCAGTCAGAGTATTAG CCGCAGCCACTTAGTC<br>SEQ ID NO:3117 | GTTACATCCAGCAGGGC CACT<br>SEQ ID NO:11129 | CAGCAGTATGGTAGCTCACC GTGGACG<br>SEQ ID NO:19141 |
| | | AA | RASQSISRSHLV<br>SEQ ID NO:3118 | VTSSRAT<br>SEQ ID NO:11130 | QQYGSSPWT<br>SEQ ID NO:19142 |
| iPS:436480 | 21-225_220F8 | NA | CGGGCAAGTCAGGGCATTAG AAATGATTTAGGC<br>SEQ ID NO:3119 | GGTGCATCCAGTTTGCA AAGT<br>SEQ ID NO:11131 | GTAATGCATAATAGTTACC TCGGACG<br>SEQ ID NO:19143 |
| | | AA | RASQGIRNDLG<br>SEQ ID NO:3120 | GASSLQS<br>SEQ ID NO:11132 | VMHNSYPRT<br>SEQ ID NO:19144 |
| iPS:436488 | 21-225_221A6 | NA | CGGGCGAGTCAGGGTATTAG CAGCTGGTTAGCC<br>SEQ ID NO:3121 | ACTGCATCCAATTTGCAA AGT<br>SEQ ID NO:11133 | CAACAGGCTAACAGTTTCCC ATTCACT<br>SEQ ID NO:19145 |
| | | AA | RASQGISSWLA<br>SEQ ID NO:3122 | TASNLQS<br>SEQ ID NO:11134 | QQANSFPFT<br>SEQ ID NO:19146 |

FIGURE 49
(Continued)

| | | | | | |
|---|---|---|---|---|---|
| iPS:436490 | 21-225_221F6 | NA | CGGGCGAGTCAGGGCATTAG CAATTATTTAGCC<br>SEQ ID NO:3123 | GCTGCATCCAATTTACAA AGT<br>SEQ ID NO:11135 | CAACAGTATATGACTTACCC GCTCACT<br>SEQ ID NO:19147 |
| | | AA | RASQGISNYLA<br>SEQ ID NO:3124 | AASNLQS<br>SEQ ID NO:11136 | QQYMTYPLT<br>SEQ ID NO:19148 |
| iPS:436494 | 21-225_221F12 | NA | CGGGCGAGTCAGGGTATTAG CAGCTGGTTAGCC<br>SEQ ID NO:3125 | ACTGCATCCAATTTGCAA AGT<br>SEQ ID NO:11137 | CAACAGGCTAACAGTTTCCC ATTCACT<br>SEQ ID NO:19149 |
| | | AA | RASQGISSWLA<br>SEQ ID NO:3126 | TASNLQS<br>SEQ ID NO:11138 | QQANSFPFT<br>SEQ ID NO:19150 |
| iPS:436496 | 21-225_222E1 | NA | CGGGCGAGTCAGGGTATTAG CAGCTGGTTAGCC<br>SEQ ID NO:3127 | ACTGCATCCAATTTGCAA AGT<br>SEQ ID NO:11139 | CAACAGGCTAACAGTTTCCC ATTCACT<br>SEQ ID NO:19151 |
| | | AA | RASQGISSWLA<br>SEQ ID NO:3128 | TASNLQS<br>SEQ ID NO:11140 | QQANSFPFT<br>SEQ ID NO:19152 |
| iPS:436500 | 21-225_222H3 | NA | AAGTCCAGCCAGAGTGTTT GAAAAGTTCCAACCATAGGA ACTACTTAGCT<br>SEQ ID NO:3129 | TGGGCATCTACCCGGGA AACC<br>SEQ ID NO:11141 | CAGCAATATTCTTCTATTCCG TGGACG<br>SEQ ID NO:19153 |
| | | AA | KSSQSVLKSSNHRNYLA<br>SEQ ID NO:3130 | WASTRET<br>SEQ ID NO:11142 | QQYSSIPWT<br>SEQ ID NO:19154 |
| iPS:436502 | 21-225_222A11 | NA | CGGGCGAGTCAGGGCATTAG CAATTATTTGGCC<br>SEQ ID NO:3131 | GCTGCATCCAGTTTGCAA AGT<br>SEQ ID NO:11143 | CTATATTATCTTAATTATCCG CTCACT<br>SEQ ID NO:19155 |
| | | AA | RASQGISNYLA<br>SEQ ID NO:3132 | AASSLQS<br>SEQ ID NO:11144 | LYYLNYPLT<br>SEQ ID NO:19156 |
| iPS:436504 | 21-225_222H4 | NA | CGGGCAAGTCAGAACATTAG TAATTATGTTAAT<br>SEQ ID NO:3133 | ACTGCATCGAGTTTGCA AAGT<br>SEQ ID NO:11145 | CAGCAGTATTACTTTACCCC ATTCACT<br>SEQ ID NO:19157 |
| | | AA | RASQNISNYVN | TASSLQS | QQYYTPFT |

FIGURE 49
(Continued)

| | | | | | |
|---|---|---|---|---|---|
| iPS:436506 | 21-225_222C7 | NA | SEQ ID NO:3134<br>AGGGCCAGTCAGAGTGTTTA<br>CAGCAACTACTTAGCC | SEQ ID NO:11146<br>GGTGCATCCAAGCAGGGC<br>CACT | SEQ ID NO:19158<br>CAGCAGTATGAAGACTCACC<br>GTGGACG |
| | | AA | SEQ ID NO:3135<br>RASQSVYSNYLA | SEQ ID NO:11147<br>GASSRAT | SEQ ID NO:19159<br>QQYEDSPWT |
| iPS:436508 | 21-225_222F7 | NA | SEQ ID NO:3136<br>CGGGCGAGTCAGGGTATTAG<br>CAGCTGGTTAGCC | SEQ ID NO:11148<br>ACTGCATCCAATTTGCAA<br>AGT | SEQ ID NO:19160<br>CAACAGGCTAACACAGTTCCC<br>ATTCACT |
| | | AA | SEQ ID NO:3137<br>RASQGISSWLA | SEQ ID NO:11149<br>TASNLQS | SEQ ID NO:19161<br>QQANSFPFT |
| iPS:436510 | 21-225_222H8 | NA | SEQ ID NO:3138<br>CGGGCAAGTCAGAACATTAG<br>TAATTATGTTAAT | SEQ ID NO:11150<br>ATTGCATGGAGTTTGCAA<br>AGT | SEQ ID NO:19162<br>CAGCAGTATTACTTTACCCC<br>ATTCACT |
| | | AA | SEQ ID NO:3139<br>RASQNISNYVN | SEQ ID NO:11151<br>IASSLQS | SEQ ID NO:19163<br>QQYYFTPFT |
| iPS:436514 | 21-225_222D10 | NA | SEQ ID NO:3140<br>CGGGCGAGTCAGGGCATTAG<br>CAATTATTTGGCC | SEQ ID NO:11152<br>GCTGCATCCAGTTTGCAA<br>AGT | SEQ ID NO:19164<br>CTACATTATCTTAATTACCCG<br>CTCACT |
| | | AA | SEQ ID NO:3141<br>RASQGISNYLA | SEQ ID NO:11153<br>AASSLQS | SEQ ID NO:19165<br>LHYLNYPLT |
| iPS:436516 | 21-225_222C12 | NA | SEQ ID NO:3142<br>CGGGTGAGTCAGGGTATTAG<br>CAGCTGGTTAGCC | SEQ ID NO:11154<br>ACTGCATCCAATTTGCAA<br>AGT | SEQ ID NO:19166<br>CAACAGGATAACAGTTTCCC<br>ATTCACT |
| | | AA | SEQ ID NO:3143<br>RVSQGISSWLA | SEQ ID NO:11155<br>TASNLQS | SEQ ID NO:19167<br>QQDNSFPFT |
| iPS:436520 | 21-225_223G10 | NA | SEQ ID NO:3144<br>AAGTCCAGCCAGAGTATTTT<br>ACTCAGCTCAACAATAAGA<br>ACTACTTAGCT | SEQ ID NO:11156<br>TGGGCATCTACCCGGGA<br>ATCC | SEQ ID NO:19168<br>CTGCAATATTTTAGTACTCC<br>GTGGACG |
| | | | SEQ ID NO:3145 | SEQ ID NO:11157 | SEQ ID NO:19169 |

FIGURE 49
(Continued)

| | | | | | | |
|---|---|---|---|---|---|---|
| | | AA | KSSQSILLSSNNKNYLA | WASTRES | | LQYFSTPWT |
| iPS:436522 | | | SEQ ID NO:3146 | SEQ ID NO:11158 | | SEQ ID NO:19170 |
| | 21-225_223H10 | NA | CGGGCGAGTCAGGGCATTAG TAATTATTTGGCC | GCTGCATCCAATTTGCAA AGT | CTACATTATCTTAATTACCCA CTCACT |
| | | | SEQ ID NO:3147 | SEQ ID NO:11159 | | SEQ ID NO:19171 |
| | | AA | RASQGISNYLA | AASNLQS | | LHYLNYPLT |
| iPS:436526 | | | SEQ ID NO:3148 | SEQ ID NO:11160 | | SEQ ID NO:19172 |
| | 21-225_224A1 | NA | CGGGCAAGTCAGGGCATTGA AAATGATTAGGC | GCTGCATCCAGTTTGCAA AGT | CTACAGCATAATAGTTACCC GCTCACT |
| | | | SEQ ID NO:3149 | SEQ ID NO:11161 | | SEQ ID NO:19173 |
| | | AA | RASQGIENDLG | AASSLQS | | LQHNSYPLT |
| iPS:436528 | | | SEQ ID NO:3150 | SEQ ID NO:11162 | | SEQ ID NO:19174 |
| | 21-225_224B1 | NA | CGGGCAAGTCAGGGCATTAG TAATGATTTAGGC | GCTGCATCCAGTTTGCAA AGT | CTACAGCATAATAGTTATCC TCCTACT |
| | | | SEQ ID NO:3151 | SEQ ID NO:11163 | | SEQ ID NO:19175 |
| | | AA | RASQGISNDLG | AASSLQS | | LQHNSYPPT |
| iPS:436534 | | | SEQ ID NO:3152 | SEQ ID NO:11164 | | SEQ ID NO:19176 |
| | 21-225_224F1 | NA | CGGGCAAGTCAGGGCATTAG AGATGATTAGGC | GCTGCATCCAGTTTGCAA AGT | CTACAGCATTATAGTTACCC TCGGACG |
| | | | SEQ ID NO:3153 | SEQ ID NO:11165 | | SEQ ID NO:19177 |
| | | AA | RASQGIRDDLG | AASSLQS | | LQHYSYPRT |
| iPS:436536 | | | SEQ ID NO:3154 | SEQ ID NO:11166 | | SEQ ID NO:19178 |
| | 21-225_224G1 | NA | AAGTCTGGTCAGAGAGCTCCT GCATAGTGATGGAAAGACCT TTTTGTCT | GAAATTTCCAACCGGTTC TCT | ATGCAAAGTACACAGCTTCC TCGGACG |
| | | | SEQ ID NO:3155 | SEQ ID NO:11167 | | SEQ ID NO:19179 |
| | | AA | KSGQSLLHSDGKTFLS | EISNRFS | | MQSTQLPRT |
| iPS:436538 | | | SEQ ID NO:3156 | SEQ ID NO:11168 | | SEQ ID NO:19180 |
| | | NA | CGGGCAAGTCAGGACATTAG AAATGATTAGGC | GCTACATCCAGTTTGCAA AGT | CTACAGCATAATAGTTACCC GCTCACT |

FIGURE 49
(Continued)

| | | | | | | |
|---|---|---|---|---|---|---|
| 21-225_224C3 | | | SEQ ID NO:3157 | SEQ ID NO:11169 | SEQ ID NO:19181 | |
| | AA | | RASQDIRNDLG | ATSSLQS | LQHNSYPLT | |
| iPS:436540 | | | SEQ ID NO:3158 | SEQ ID NO:11170 | SEQ ID NO:19182 | |
| | NA | | CGGGCAAGTCAGGGCATTAG AAATGATTTAGGC | GCTGCATCCAGTTTGCAA AGT | CTTCAGCATTATAATTACCCT CGGGCG | |
| 21-225_224F3 | | | SEQ ID NO:3159 | SEQ ID NO:11171 | SEQ ID NO:19183 | |
| | AA | | RASQGIRNDLG | AASSLQS | LQHYNYPRA | |
| iPS:436544 | | | SEQ ID NO:3160 | SEQ ID NO:11172 | SEQ ID NO:19184 | |
| | NA | | AAGTCCAGCAGCCAGAGTGTTT ATACAGCTCCAACAATTTCA ACTACTTAACT | TGGGCATCTACCCGGGA ATCC | CAGCAATATTATAGTACTCC TCCGACG | |
| 21-225_224H5 | | | SEQ ID NO:3161 | SEQ ID NO:11173 | SEQ ID NO:19185 | |
| | AA | | KSSQSVLYSSNNFNYLT | WASTRES | QQYYSTPPT | |
| iPS:436546 | | | SEQ ID NO:3162 | SEQ ID NO:11174 | SEQ ID NO:19186 | |
| | NA | | CGGGCGAGTCAGGGTATTAG CAGCTGGTTAGCC | GCTGCATCCAGTTTGCAA AGT | CAACAGGCTAACAGTTTCCC GTGGACG | |
| 21-225_224D6 | | | SEQ ID NO:3163 | SEQ ID NO:11175 | SEQ ID NO:19187 | |
| | AA | | RASQGISSWLA | AASSLQS | QQANSFPWT | |
| iPS:436548 | | | SEQ ID NO:3164 | SEQ ID NO:11176 | SEQ ID NO:19188 | |
| | NA | | AAGTCTAGTCAGAGCCTCCT GCATAGTGATGGAAAGACCT TTTTGTAT | GAAATTTCCAACCGGTTC TCT | ATGCAAAGTACACAGCTTCC TCCGACG | |
| 21-225_224A7 | | | SEQ ID NO:3165 | SEQ ID NO:11177 | SEQ ID NO:19189 | |
| | AA | | KSSQSLLHSDGKTFLY | EISNRFS | MQSTQLPRT | |
| iPS:436550 | | | SEQ ID NO:3166 | SEQ ID NO:11178 | SEQ ID NO:19190 | |
| | NA | | AAGTCCAGCAGCCAGAGTGTTT ATACAGCTCCAACAATAAGA ACTACTTAGCT | TGGTCGTCTACCCGGAA ATCC | CAGCAATATTTAGTACTCC TCCGACG | |
| 21-225_224D8 | | | SEQ ID NO:3167 | SEQ ID NO:11179 | SEQ ID NO:19191 | |
| | AA | | KSSQSVLYSSNNKNYLA | WSSTRKS | QQYFSTPPT | |

FIGURE 49
(Continued)

| | | | SEQ ID NO:3168 | SEQ ID NO:11180 | SEQ ID NO:19192 |
|---|---|---|---|---|---|
| iPS:436554 | | NA | AAGTCCAGCCAGAGTGTTTTATACAATTCCAACAATAAGAACTACTTAGCT | TGGGCATCTACCCGGGAGTCC | CAACAATATTATATTAATCCGTGCAGT |
| | 21-225_224C10 | | SEQ ID NO:3169 | SEQ ID NO:11181 | SEQ ID NO:19193 |
| | | AA | KSSQSVLYNSNNKNYLA | WASTRES | QQYYINPCS |
| | | | SEQ ID NO:3170 | SEQ ID NO:11182 | SEQ ID NO:19194 |
| iPS:436556 | | NA | CGGGCAAGTCAGGGCATTAGAAATGATTTAGGC | GCTGCATCCAGTTTACAAAGT | CTACAACATAATAGTTACCCGCTCACT |
| | 21-225_224D10 | | SEQ ID NO:3171 | SEQ ID NO:11183 | SEQ ID NO:19195 |
| | | AA | RASQGIRNDLG | AASSLQS | LQHNSYPLT |
| | | | SEQ ID NO:3172 | SEQ ID NO:11184 | SEQ ID NO:19196 |
| iPS:436558 | | NA | AAGTCTAGTCAGAGCCTCCTGCATAGTGATGGAAAGACCTTTTTGTAT | GAAATTTCCAACCGGTTCTCT | ATGCAAAGTACACAGCTTCCTCGGACG |
| | 21-225_224C11 | | SEQ ID NO:3173 | SEQ ID NO:11185 | SEQ ID NO:19197 |
| | | AA | KSSQSLLHSDGKTFLY | EISNRFS | MQSTQLPRT |
| | | | SEQ ID NO:3174 | SEQ ID NO:11186 | SEQ ID NO:19198 |
| iPS:436560 | | NA | AAGTCCAGCCAGAGTGTTTTATCCAGCTCCAACAATCACAACTACTTAGCT | TGGGCATCTACCCGGGAATCC | CAGCAATATTATACTACTCCGTGCAGT |
| | 21-225_224F11 | | SEQ ID NO:3175 | SEQ ID NO:11187 | SEQ ID NO:19199 |
| | | AA | KSSQSVLSSSNNHNYLA | WASTRES | QQYYTTPCS |
| | | | SEQ ID NO:3176 | SEQ ID NO:11188 | SEQ ID NO:19200 |
| iPS:436562 | | NA | AAGTCTAGTCAGAGCCTCCTGCATAGTGATGGAAAGACCTTTTTGTAT | GAAATTTCCAACCGGTTCTCT | ATGCAAAGTACACAGCTTCCTCGGACG |
| | 21-225_224H11 | | SEQ ID NO:3177 | SEQ ID NO:11189 | SEQ ID NO:19201 |
| | | AA | KSSQSLLHSDGKTFLY | EISNRFS | MQSTQLPRT |
| | | | SEQ ID NO:3178 | SEQ ID NO:11190 | SEQ ID NO:19202 |

FIGURE 49
(Continued)

| | | | | | |
|---|---|---|---|---|---|
| iPS:436564 | 21-225_225A1 | NA | CGGGCAAGTCAGGGCATTAG AGATGATTAGGC | GCTGCATCCAGTTTGCAA AGT | CTGCAGCATTATAGTTACCC TCGGACG |
| | | | SEQ ID NO:3179 | SEQ ID NO:11191 | SEQ ID NO:19203 |
| | | AA | RASQGIRDDLG | AASSLQS | LQHYSYPRT |
| | | | SEQ ID NO:3180 | SEQ ID NO:11192 | SEQ ID NO:19204 |
| iPS:436568 | 21-225_225B3 | NA | AGGGCCAGTCAGAATCTTAG CAGCAGCTACTTAGGC | GATACATCCAGCAGGGC CACT | CAGGAGTATGGTAGCTCACT CATGTGCAGT |
| | | | SEQ ID NO:3181 | SEQ ID NO:11193 | SEQ ID NO:19205 |
| | | AA | RASQNLSSSYLG | DTSSRAT | QEYGSSLMCS |
| | | | SEQ ID NO:3182 | SEQ ID NO:11194 | SEQ ID NO:19206 |
| iPS:436570 | 21-225_225F4 | NA | AAGTCCAGCCAGAGTGTTT ATATAGCTCAACATAAGA ACTACTTAGCT | TGGGCATCTACCCGGGA ATCC | CACCAATATCATAATTCTCC TCCCACT |
| | | | SEQ ID NO:3183 | SEQ ID NO:11195 | SEQ ID NO:19207 |
| | | AA | KSSQSVLYSSNNKNYLA | WASTRES | HQYHNSPPT |
| | | | SEQ ID NO:3184 | SEQ ID NO:11196 | SEQ ID NO:19208 |
| iPS:436572 | 21-225_225G4 | NA | AAGTCTAGTCAGAGCCTCCT GCATAGTGATGGAAAGACCT TTTTGTAT | GAAATTTCCAACCGGTTC TCT | ATGCAAAGTACACAGCTTCC TCGGACG |
| | | | SEQ ID NO:3185 | SEQ ID NO:11197 | SEQ ID NO:19209 |
| | | AA | KSSQSLLHSDGKTFLY | EISNRFS | MQSTQLPRT |
| | | | SEQ ID NO:3186 | SEQ ID NO:11198 | SEQ ID NO:19210 |
| iPS:436574 | 21-225_225F5 | NA | AAGTCCAGCCAGAATGTTT ATACAACTCAACAATAACA ACTACTTAGCT | TGGGCATCTACCCGGGA ATCC | CAGCAATATTATAGTTCTCC TCCGACG |
| | | | SEQ ID NO:3187 | SEQ ID NO:11199 | SEQ ID NO:19211 |
| | | AA | KSSQNVLYNSNNNNYLA | WASTRES | QQYYSSPPT |
| | | | SEQ ID NO:3188 | SEQ ID NO:11200 | SEQ ID NO:19212 |
| iPS:436576 | | NA | CGGGCAAGTCAGGGCATGA GAAAAGATTTAGGC | GCTGCAACCAGTTTGCA AAGT | CTACAGCATAATAGTTATCC ATTCACT |

FIGURE 49
(Continued)

| | | | | | | |
|---|---|---|---|---|---|---|
| iPS:436578 | 21-225_225B6 | AA | SEQ ID NO:3189<br>RASQGMRKDLG | SEQ ID NO:11201<br>AATSLQS | SEQ ID NO:19213<br>LQHNSYPFT | |
| | | NA | SEQ ID NO:3190<br>CGGGCAAGTCAGGGCATTAG<br>AAATGATTTAGGC | SEQ ID NO:11202<br>GCTGCATCCAGTTACAA<br>AGT | SEQ ID NO:19214<br>CTTCAGCATAATACTTACCC<br>ATTCACT | |
| iPS:436580 | 21-225_225D6 | AA | SEQ ID NO:3191<br>RASQGIRNDLG | SEQ ID NO:11203<br>AASSLQS | SEQ ID NO:19215<br>LQHNTYPFT | |
| | | NA | SEQ ID NO:3192<br>AGGGCCAGTCAGAGTGTTTA<br>CAGCAGCTACTTAGCC | SEQ ID NO:11204<br>GGTGCATCCAGCAGGGC<br>CACT | SEQ ID NO:19216<br>CAGCAGTATGGTACCTCACC<br>TCGGACG | |
| iPS:436582 | 21-225_225E7 | AA | SEQ ID NO:3193<br>RASQSVYSSYLA | SEQ ID NO:11205<br>GASSRAT | SEQ ID NO:19217<br>QQYGTSPRT | |
| | | NA | SEQ ID NO:3194<br>CGGGCAAGTCAGGGCATTAG<br>AAATGATTTAGGC | SEQ ID NO:11206<br>GCTGCATCCAGTTGCTA<br>GGT | SEQ ID NO:19218<br>CTACAACATAATAGTTACCC<br>ATTCACT | |
| iPS:436584 | 21-225_225F8 | AA | SEQ ID NO:3195<br>RASQGIRNDLG | SEQ ID NO:11207<br>AASSLLG | SEQ ID NO:19219<br>LQHNSYPFT | |
| | | NA | SEQ ID NO:3196<br>AAGTCCAGCCAGAGTGTTTT<br>ATACAGCTCCAACAATAACA<br>ACTACTTAGCT | SEQ ID NO:11208<br>TGGGCATCTACCCGGGA<br>ATCC | SEQ ID NO:19220<br>CAACACTCCAAGAGTATTCC<br>TGGTAAG | |
| iPS:436586 | 21-225_225B9 | AA | SEQ ID NO:3197<br>KSSQSVLYSSNNNYLA | SEQ ID NO:11209<br>WASTRES | SEQ ID NO:19221<br>QHSKSIPGK | |
| | | NA | SEQ ID NO:3198<br>AAGTCCAGCCAGAGTGTTTT<br>ATACAGCTCCAACAATTACA<br>ACTACTTAGCT | SEQ ID NO:11210<br>TGGGCTTCTACCCGGGA<br>ATCC | SEQ ID NO:19222<br>CAGCAATATTATACTACTCC<br>TCCGACG | |
| | 21-225_225F11 | AA | SEQ ID NO:3199<br>KSSQSVLYSSNNYNYLA | SEQ ID NO:11211<br>WASTRES | SEQ ID NO:19223<br>QQYYTPPT | |
| | | | SEQ ID NO:3200 | SEQ ID NO:11212 | SEQ ID NO:19224 | |

FIGURE 49
(Continued)

| | | | | |
|---|---|---|---|---|
| iPS:436588 | 21-225_225F12 | NA | AAGTCCAGCCAGAGTGTTTT ATACAGCTCCAACAATCAGA ACTACTTAGCT SEQ ID NO:3201 | TGGACATCTACCCGGGA ATCC SEQ ID NO:11213 | CAGCAATATTATATTACTCC GTGCAGT SEQ ID NO:19225 |
| | | AA | KSSQSVLYSSNNQNYLA SEQ ID NO:3202 | WTSTRES SEQ ID NO:11214 | QQYYITPCS SEQ ID NO:19226 |
| iPS:436590 | 21-225_225H12 | NA | AAGTCCAGCCAGAGTGTTTT ATACAACTCCAACAATAACA ACTACTTAGCT SEQ ID NO:3203 | TGGGCATCTACCCGGGA ATCC SEQ ID NO:11215 | CAGCAATATTATATTACTCC GTGCAGT SEQ ID NO:19227 |
| | | AA | KSSQSVLYNSNNNNYLA SEQ ID NO:3204 | WASTRES SEQ ID NO:11216 | QQYYITPCS SEQ ID NO:19228 |
| iPS:436592 | 21-225_226B1 | NA | AAGTCTAGTCAGAGCCTCCT GCATGGTGATGGAAAGACCT ATTTGTAT SEQ ID NO:3205 | GAAGTTTCCATCCGGTTC TCT SEQ ID NO:11217 | ATGCAAAGTATACAGATTCC GTGGACG SEQ ID NO:19229 |
| | | AA | KSSQSLLHGDGKTYLY SEQ ID NO:3206 | EVSIRFS SEQ ID NO:11218 | MQSIQIPWT SEQ ID NO:19230 |
| iPS:436594 | 21-225_226A5 | NA | AAGTCTAGTCAGAGCCTCCT ACATGGTGATGGAAAGACCT ATTTGTAT SEQ ID NO:3207 | GAAGTTTCCAACCGGTTC TCT SEQ ID NO:11219 | ATGCAAAGTATACAGATTCC GTGGACG SEQ ID NO:19231 |
| | | AA | KSSQSLLHGDGKTYLY SEQ ID NO:3208 | EVSNRFS SEQ ID NO:11220 | MQSIQIPWT SEQ ID NO:19232 |
| iPS:436596 | 21-225_226C6 | NA | CGGGCAAGTCAGGGCATTAG AAATGATTTAGGC SEQ ID NO:3209 | GCTGCATCCAGTTTGCAA AGT SEQ ID NO:11221 | CTACAGCATTATAATTACCC TCGGGCG SEQ ID NO:19233 |
| | | AA | RASQGIRNDLG SEQ ID NO:3210 | AASSLQS SEQ ID NO:11222 | LQHYNYPRA SEQ ID NO:19234 |

FIGURE 49
(Continued)

| | | | | | |
|---|---|---|---|---|---|
| iPS:436598 | 21-225_226D6 | NA | AGGTCCAGCCAGAGTATTTTATACATCTCCAACAATAAGAACTACTTAGCT SEQ ID NO:3211 | TGGGCATCTACCCGGGAATCC SEQ ID NO:11223 | CAGCAATATTATAGTTCTCCGTGCAGT SEQ ID NO:19235 |
| | | AA | RSSQSILYISNNKNYLA SEQ ID NO:3212 | WASTRES SEQ ID NO:11224 | QQYYSSPCS SEQ ID NO:19236 |
| iPS:436600 | 21-225_226F6 | NA | AAGTCCAGCCAGAGTATTTTATACAGCTCCAACAATTACAACTACTTAGCT SEQ ID NO:3213 | TGGGCTTCTACCCGGGAATCC SEQ ID NO:11225 | CAGCAATATTATACTACTCCTCCGACG SEQ ID NO:19237 |
| | | AA | KSSQSILYSSNNYNYLA SEQ ID NO:3214 | WASTRES SEQ ID NO:11226 | QQYYTTPPT SEQ ID NO:19238 |
| iPS:436602 | 21-225_226E7 | NA | AAGTCTAGTCAGAGCCTCCTGCATAGTGATGGAAAGACCTATTTGTAT SEQ ID NO:3215 | GAAGTTTCCAACCGGTTCTCT SEQ ID NO:11227 | ATGCAAAGTATACAGGTTCCGTGGACG SEQ ID NO:19239 |
| | | AA | KSSQSLLHGDGKTYLY SEQ ID NO:3216 | EVSNRFS SEQ ID NO:11228 | MQSIQVPWT SEQ ID NO:19240 |
| iPS:436604 | 21-225_226F7 | NA | CGGGCAAGTCAGGGCATTGGGAATGATTTAGGC SEQ ID NO:3217 | GCTGCCTCCAGTTTGCAAAGT SEQ ID NO:11229 | CTACATCATTATAGTTACCCTCGGACG SEQ ID NO:19241 |
| | | AA | RASQGIGNDLG SEQ ID NO:3218 | AASSLQS SEQ ID NO:11230 | LHHYSYPRT SEQ ID NO:19242 |
| iPS:436606 | 21-225_226G8 | NA | AAGTCTAGTCAGAGCCTCCTGCATAGTGATGGAAAGACCTTCTTTTGTAT SEQ ID NO:3219 | GAAATTTCCAACCGGTTCTCT SEQ ID NO:11231 | ATGCAAAGTACACAGCTTCCTCGGACG SEQ ID NO:19243 |
| | | AA | KSSQSLLHSDGKTFLY SEQ ID NO:3220 | EISNRFS SEQ ID NO:11232 | MQSTQLPRT SEQ ID NO:19244 |

FIGURE 49
(Continued)

| | | | | | |
|---|---|---|---|---|---|
| iPS:436608 | 21-225_226A9 | NA | CGGGCAAGTCAGGGCATTAG AAATGATTTAGGC SEQ ID NO:3221 | GCTGCATCCAGTTTGCAA AGT SEQ ID NO:11233 | CTACAGCATAATAGTTACCC ATTCACT SEQ ID NO:19245 |
| | | AA | RASQGIRNDLG SEQ ID NO:3222 | AASSLQS SEQ ID NO:11234 | LQHNSYPFT SEQ ID NO:19246 |
| iPS:436610 | 21-225_226F9 | NA | AAGTCTAGTCAGAGCCTCCT GCATAGTGATGGAAAGACCT TTTTGTAT SEQ ID NO:3223 | GAAATTTCCAACCGGTTC TCT SEQ ID NO:11235 | ATGCAAAGTACACAGCTTCC TCGGACG SEQ ID NO:19247 |
| | | AA | KSSQSLLHSDGKTFLY SEQ ID NO:3224 | EISNRFS SEQ ID NO:11236 | MQSTQLPRT SEQ ID NO:19248 |
| iPS:436612 | 21-225_226H9 | NA | AAGTCTAGTCAGAGCCTCCT GCATAGTGATGGAAAGACCT TTTTGTAT SEQ ID NO:3225 | GAAGTTTCCAACCGGTTC TCT SEQ ID NO:11237 | ATGCAAAGTACACAGCTTCC TCGGACG SEQ ID NO:19249 |
| | | AA | KSSQSLLHSDGKTFLY SEQ ID NO:3226 | EVSNRFS SEQ ID NO:11238 | MQSTQLPRT SEQ ID NO:19250 |
| iPS:436614 | 21-225_226F10 | NA | AAGTCTAGTCAGAGCCTCCT GCATAGTGATGGAAAGACCT TTTTGTAT SEQ ID NO:3227 | GAAATTTCCAACCGGTTC TCT SEQ ID NO:11239 | ATGCAAAGTACACAGCTTCC TCGGACG SEQ ID NO:19251 |
| | | AA | KSSQSLLHSDGKTFLY SEQ ID NO:3228 | EISNRFS SEQ ID NO:11240 | MQSTQLPRT SEQ ID NO:19252 |
| iPS:436616 | 21-225_226D11 | NA | AAGTCCAGCCAGAATGTTTT ACACAGTCCAACAGTAATA ACTACTTAGTT SEQ ID NO:3229 | TGGGCATCTACCCGGGA ATCC SEQ ID NO:11241 | CAGCAATATTATAAAACTCC GTGGACG SEQ ID NO:19253 |
| | | AA | KSSQNVLHSSNSNNYLV SEQ ID NO:3230 | WASTRES SEQ ID NO:11242 | QQYYKTPWT SEQ ID NO:19254 |

FIGURE 49
(Continued)

| | | | | | |
|---|---|---|---|---|---|
| iPS:436618 | 21-225_226E11 | NA | AAGTCTAGTCAGAGAGCCTCCT GCATAGTGATGGAAAGACCT TTTTGTAT | GAAATTTCCAACCGGTTC TCT | ATGCAAAGTACACAGCTTCC TCGGACG |
| | | | SEQ ID NO:3231 | SEQ ID NO:11243 | SEQ ID NO:19255 |
| | | AA | KSSQSLLHSDGKTFLY | EISNRFS | MQSTQLPRT |
| | | | SEQ ID NO:3232 | SEQ ID NO:11244 | SEQ ID NO:19256 |
| iPS:436620 | 21-225_226H11 | NA | CGGACAAGTCAGGGCATTAG AAATGATTAGGC | GCTGCATCCAGTTTGCAA AGT | CTACAGCATTATAGTTACCC TCGGACG |
| | | | SEQ ID NO:3233 | SEQ ID NO:11245 | SEQ ID NO:19257 |
| | | AA | RTSQGIRNDLG | AASSLQS | LQHYSYPRT |
| | | | SEQ ID NO:3234 | SEQ ID NO:11246 | SEQ ID NO:19258 |
| iPS:436622 | 21-225_226A12 | NA | AAGTCCAGCCAGAATGTTT ATACAGTTCCAACAATAACA ACTACTTAGCT | TGGGCATCTACCCGGAA ATCC | CAGCAATATTATAGTAGTCC TCCGACG |
| | | | SEQ ID NO:3235 | SEQ ID NO:11247 | SEQ ID NO:19259 |
| | | AA | KSSQNVLYSSNNNNYLA | WASTRKS | QQYYSSPPT |
| | | | SEQ ID NO:3236 | SEQ ID NO:11248 | SEQ ID NO:19260 |
| iPS:436624 | 21-225_226H12 | NA | AAGTCTAGTAAGACCCTCCT GCATAGTGATGGAAAGACCT TTTTGTAT | GAAATTTCCAACCGGTTC TCT | ATGCAAAGTACACAGCTTCC TCGGACG |
| | | | SEQ ID NO:3237 | SEQ ID NO:11249 | SEQ ID NO:19261 |
| | | AA | KSSKTLLHSDGKTFLY | EISNRFS | MQSTQLPRT |
| | | | SEQ ID NO:3238 | SEQ ID NO:11250 | SEQ ID NO:19262 |
| iPS:436626 | 21-225_227C1 | NA | AAGTCTAGTCAGAGAGCCTCCT GCATAGTGATGGAAAGACCT TTTTGTAT | GAAATTTCCAACCGGTTC TCT | ATGCAAAGTACACAGCTTCC TCGGACG |
| | | | SEQ ID NO:3239 | SEQ ID NO:11251 | SEQ ID NO:19263 |
| | | AA | KSSQSLLHSDGKTFLY | EISNRFS | MQSTQLPRT |
| | | | SEQ ID NO:3240 | SEQ ID NO:11252 | SEQ ID NO:19264 |

FIGURE 49
(Continued)

| | | | | | |
|---|---|---|---|---|---|
| iPS:436628 | 21-225_227F2 | NA | AAGTCTAGTCAGAGCCTCCTGCATAGTGATGGAAAGACCTTTTTGTAT<br>SEQ ID NO:3241 | GAAATTTCCAACCGGTTCTCT<br>SEQ ID NO:11253 | ATGCAAAGTACACAGCTTCCTCGGACG<br>SEQ ID NO:19265 |
| | | AA | KSSQSLLHSDGKTFLY<br>SEQ ID NO:3242 | EISNRFS | MQSTQLPRT<br>SEQ ID NO:19266 |
| iPS:436630 | 21-225_227G3 | NA | CGGGCAAGTCAGGGCATTAGAAATGATTTAGGC<br>SEQ ID NO:3243 | GCTGCATCCAGTTTGCAAAGT<br>SEQ ID NO:11255 | CTACACCATAATAGTTACCCATTCACT<br>SEQ ID NO:19267 |
| | | AA | RASQGIRNDLG<br>SEQ ID NO:3244 | AASSLQS<br>SEQ ID NO:11256 | LHHNSYPFT<br>SEQ ID NO:19268 |
| iPS:436632 | 21-225_227E4 | NA | CGGGCGAGTCAGGGTATTATCAACTGGTTAGCC<br>SEQ ID NO:3245 | GCTGCATCCAGTTTGCAAAGT<br>SEQ ID NO:11257 | CAACAGGCTAACAGTTTCCCGTGGACG<br>SEQ ID NO:19269 |
| | | AA | RASQGIINWLA<br>SEQ ID NO:3246 | AASSLQS<br>SEQ ID NO:11258 | QQANSFPWT<br>SEQ ID NO:19270 |
| iPS:436634 | 21-225_227H5 | NA | CGGGCAAGTCAGGACATTAGAAATGATTTAGGC<br>SEQ ID NO:3247 | GCTGCATCCAGTTTGCAAAGT<br>SEQ ID NO:11259 | CTACAGCATAATAGTTACCCATTCACT<br>SEQ ID NO:19271 |
| | | AA | RASQDIRNDLG<br>SEQ ID NO:3248 | AASSLQS<br>SEQ ID NO:11260 | LQHNSYPFT<br>SEQ ID NO:19272 |
| iPS:436636 | 21-225_227E6 | NA | AAGTCCAGCCAGAGTGTTTTATACAGCTCCAACGATAAGAACTACTTAGCT<br>SEQ ID NO:3249 | TGGGCATCTACCCGGGAATCC<br>SEQ ID NO:11261 | CAGCAATATTATATTACTCCGTGCAGT<br>SEQ ID NO:19273 |
| | | AA | KSSQSVLYSSNDKNYLA<br>SEQ ID NO:3250 | WASTRES<br>SEQ ID NO:11262 | QQYYITPCS<br>SEQ ID NO:19274 |
| iPS:436638 | 21_225_227C7 | NA | AGGTCCAGCCAGATTGTTTATCCGACTCCAACAATAACAACTACTTAGCT | TGGGCATCTACCCGGGAATCC | CAGCAATATTATAGTTCTCCTCCGACG |

FIGURE 49
(Continued)

| | | | SEQ ID NO:3251 | SEQ ID NO:11263 | SEQ ID NO:19275 |
|---|---|---|---|---|---|
| iPS:436640 | 21-225_227C7 | AA | RSSQIVLSDSNNNNYLA | WASTRES | QQYYSSPPT |
| | | | SEQ ID NO:3252 | SEQ ID NO:11264 | SEQ ID NO:19276 |
| iPS:436644 | 21-225_227A8 | NA | AAGTCTAGTCAGAGCCTCCT GCATAGTGATGGAAAGACCT TTTTGTAT | GAAATTCCAACCGGTTC TCT | ATGCAAAGTACACAGCTTCC TCGGACG |
| | | | SEQ ID NO:3253 | SEQ ID NO:11265 | SEQ ID NO:19277 |
| | | AA | KSSQSLLHSDGKTFLY | EISNRFS | MQSTQLPRT |
| | | | SEQ ID NO:3254 | SEQ ID NO:11266 | SEQ ID NO:19278 |
| iPS:436644 | 21-225_227G9 | NA | AAGTCCAGCCAGAGTGTTTT ACACAGTTCCAACAATAACA ACTACTTAGCT | TGGGGATCTACCCGGGA ATCC | CAGCAATATTATAGTGCTCC GTACAGT |
| | | | SEQ ID NO:3255 | SEQ ID NO:11267 | SEQ ID NO:19279 |
| | | AA | KSSQSVLHSSNNNNYLA | WGSTRES | QQYYSAPYS |
| | | | SEQ ID NO:3256 | SEQ ID NO:11268 | SEQ ID NO:19280 |
| iPS:436646 | 21-225_227D11 | NA | AAGTCCAGCCAGAGTGTTTT ACACAGTTCCAACAATAATA ACTACTTAGCT | TGGGCATCTACCCGGGA ATCC | CAGCAATATTATAATACTCC GTGCAGT |
| | | | SEQ ID NO:3257 | SEQ ID NO:11269 | SEQ ID NO:19281 |
| | | AA | KSSQSVLHSSNNNNYLA | WASTRES | QQYYNTPCS |
| | | | SEQ ID NO:3258 | SEQ ID NO:11270 | SEQ ID NO:19282 |
| iPS:436648 | 21-225_227F11 | NA | TGGTCTAGTCAGAGCCTCCT GCATAGTAATGGATACAACT ATTTGGAT | TTGGGTTCTAATCGGGCC TCC | ATGCAAGCTCTACAAACTCC TCTCACC |
| | | | SEQ ID NO:3259 | SEQ ID NO:11271 | SEQ ID NO:19283 |
| | | AA | WSSQSLLHSNGYNYLD | LGSNRAS | MQALQTPLT |
| | | | SEQ ID NO:3260 | SEQ ID NO:11272 | SEQ ID NO:19284 |
| iPS:436650 | 21-225_227C12 | NA | CGGGCAAGTCAGGGCATTAG AAATGATTTAGGC | GCTGCATCCAGTTTGCAA AGT | CTACAGCATAATAGTTACCC ATTCACT |
| | | | SEQ ID NO:3261 | SEQ ID NO:11273 | SEQ ID NO:19285 |

FIGURE 49
(Continued)

| | | AA | RASQGIRNDLG | AASSLQS | LQHNSYPFT |
|---|---|---|---|---|---|
| | | | SEQ ID NO:3262 | SEQ ID NO:11274 | SEQ ID NO:19286 |
| iPS:436652 | 21-225_146B11 | NA | TCTGGAGATAAATTGGGGGA TAAATATGCTTCC | CAAGATAGCAAGCGGCC CTCA | CAGGCGTGGGACAGCAGCAC TGTGGTA |
| | | | SEQ ID NO:3263 | SEQ ID NO:11275 | SEQ ID NO:19287 |
| | | AA | SGDKLGDKYAS | QDSKRPS | QAWDSSTVV |
| iPS:436654 | 21-225_146C11 | | SEQ ID NO:3264 | SEQ ID NO:11276 | SEQ ID NO:19288 |
| | | NA | TCTGGAGATAAATTGGGGGA TAAATATGCTTCC | CAAGATAGCAAGCGGCC CTCA | CAGGCGTGGGACAGCAGCAC TGTGGTA |
| | | | SEQ ID NO:3265 | SEQ ID NO:11277 | SEQ ID NO:19289 |
| | | AA | SGDKLGDKYAS | QDSKRPS | QAWDSSTVV |
| iPS:436658 | 21-225_146A2 | | SEQ ID NO:3266 | SEQ ID NO:11278 | SEQ ID NO:19290 |
| | | NA | TCTGGAGATAAATTGGGGGA TAAATATGCTTCC | CAAGATAGCAAGCGGCC CTCA | CAGGCGTGGGACAGCAGCAC TGTGGTA |
| | | | SEQ ID NO:3267 | SEQ ID NO:11279 | SEQ ID NO:19291 |
| | | AA | SGDKLGDKYAS | QDSKRPS | QAWDSSTVV |
| iPS:436660 | 21-225_146D8 | | SEQ ID NO:3268 | SEQ ID NO:11280 | SEQ ID NO:19292 |
| | | NA | TCTGGAAGCAGCTCCTACAT CGGAAGTAATACTGTAGAC | AGTAATAATCAGCGGCC CTCA | GCAGCATGGGATGACAGCCT TAATGGCGTGGTA |
| | | | SEQ ID NO:3269 | SEQ ID NO:11281 | SEQ ID NO:19293 |
| | | AA | SGSSSYIGSNTVD | SNNQRPS | AAWDDSLNGVV |
| iPS:436662 | 21-225_147D7 | | SEQ ID NO:3270 | SEQ ID NO:11282 | SEQ ID NO:19294 |
| | | NA | TCTGGAGATAAATTGGGGGA TAAATTTGCTTGC | CAAGATAGGAAGCGGCC CTCA | CAGGCGTGGGACAGGAACAC CGCTGTC |
| | | | SEQ ID NO:3271 | SEQ ID NO:11283 | SEQ ID NO:19295 |
| | | AA | SGDKLGDKFAC | QDRKRPS | QAWDRNTAV |
| iPS:436664 | | | SEQ ID NO:3272 | SEQ ID NO:11284 | SEQ ID NO:19296 |
| | | NA | TCTGGAGATAAATTGGGGGA TAAATATGCTTCC | CAAGATAGCAAGCGCCC CTCA | CAGGCGTGGGACAGCAGCAC TGTGGTA |

FIGURE 49
(Continued)

| | | | | | | | |
|---|---|---|---|---|---|---|---|
| iPS:436666 | 21-225_147E7 | NA | SEQ ID NO:3273<br>TCTGGAGATAAATTGGGGGA<br>TAAATATGTTTGC | SEQ ID NO:11285<br>CAAGATAGGAAGCGGCC<br>CTCA | SEQ ID NO:19297<br>CAGGCGTGGGCAGTAACAC<br>TGCTGTGGTA |
| | | AA | SEQ ID NO:3274<br>SGDKLGDKYAS | SEQ ID NO:11286<br>QDSKRPS | SEQ ID NO:19298<br>QAWDSSTVV |
| iPS:436668 | 21-225_147B8 | NA | SEQ ID NO:3275<br>TCTGGAGATAAATTGGGGGA<br>TAAATATGTTTGC | SEQ ID NO:11287<br>CAAGATAGGAAGCGGCC<br>CTCA | SEQ ID NO:19299<br>CAGGCGTGGGACAGCAGCAC<br>TGTGTGGTG |
| | | AA | SEQ ID NO:3276<br>SGDKLGDKYVC | SEQ ID NO:11288<br>QDRKRPS | SEQ ID NO:19300<br>QAWGSNTAVV |
| iPS:436670 | 21-225_147B9 | NA | SEQ ID NO:3277<br>TCTGGAGATAAATTGGGGGA<br>TAAATATGTTTCC | SEQ ID NO:11289<br>CAAGATAGGAAGCGGCC<br>CTCA | SEQ ID NO:19301<br>CTGGCGTGGGACACAGCAGCAC<br>TTTTGTGGTA |
| | | AA | SEQ ID NO:3278<br>SGDKLGDKYVS | SEQ ID NO:11290<br>QDRKRPS | SEQ ID NO:19302<br>LAWDSSTFVV |
| iPS:436672 | 21-225_147D9 | NA | SEQ ID NO:3279<br>TCTGGAGATAAATTGGGTAA<br>TAAATATGTTTGC | SEQ ID NO:11291<br>CAAGATAGCAAGCGGCC<br>CTCA | SEQ ID NO:19303<br>CAGGCGTGGGACAGGAACAC<br>TTATGTGGTG |
| | | AA | SEQ ID NO:3280<br>SGDKLGNKYVC | SEQ ID NO:11292<br>QDSKRPS | SEQ ID NO:19304<br>QAWDRNTYVV |
| iPS:436674 | 21-225_147F9 | NA | SEQ ID NO:3281<br>TCTGGAGATGAATTGGGGAA<br>TAAATATGCTTGC | SEQ ID NO:11293<br>CAAGATAGCAAGCGGCC<br>CTCA | SEQ ID NO:19305<br>CAGGCGTGGCACAGCAGCAC<br>TGTGGTA |
| | | AA | SEQ ID NO:3282<br>SGDELGNKYAC | SEQ ID NO:11294<br>QDSKRPS | SEQ ID NO:19306<br>QAWHSSTVV |
| iPS:436676 | 21-225_147G9 | NA | SEQ ID NO:3283<br>TCTGGAGATAAATTGGGGGA<br>TAAATATGCTTGC | SEQ ID NO:11295<br>CAAGATAGGAAGCGGCC<br>CTCA | SEQ ID NO:19307<br>CAGGCGTGGCACAGCAGTAC<br>TGTGGTA |
| | | AA | SEQ ID NO:3284<br>SGDKLGDKYAC | SEQ ID NO:11296<br>QDRKRPS | SEQ ID NO:19308<br>QAWHSSTVV |
| | | NA | TCTGGAGATAAATTGGGGGA<br>TAAATATGCTTCC | CAAGATAGCAAGCGGCC<br>CTCA | CAGGCGTGGGACAGCAGCAC<br>TGTGGTA |

FIGURE 49
(Continued)

| | | | | | | | |
|---|---|---|---|---|---|---|---|
| iPS:436678 | 21-225_147E11 | | | SEQ ID NO:3285 | | SEQ ID NO:11297 | | SEQ ID NO:19309 |
| | | AA | SGDKLGDKYAS | | QDSKRPS | | QAWDSSTVV |
| iPS:436680 | 21-225_147B12 | NA | SEQ ID NO:3286 TCTGGAGATAAATTGGGGA TAAATATGCTTCC | SEQ ID NO:11298 CAAGATAGCAAGCGGCC CTCA | SEQ ID NO:19310 CAGGCGTGGGACAGCAGCAC TGTGGTA |
| | | AA | SEQ ID NO:3287 SGDKLGDKYAS | SEQ ID NO:11299 QDSKRPS | SEQ ID NO:19311 QAWDSSTVV |
| iPS:436682 | 21-225_147H12 | NA | SEQ ID NO:3288 TCTGGAAGCAGCTCCAACAT CGGAAGTTATGCTGTAAAC | SEQ ID NO:11300 AGTAATAATCACCGGCC CTCA | SEQ ID NO:19312 GAAGCATGGGATGACAGCCT GAATGGTCCGGTA |
| | | AA | SEQ ID NO:3289 SGSSSNIGSYAVN | SEQ ID NO:11301 SNNHRPS | SEQ ID NO:19313 EAWDDSLNGPV |
| iPS:436684 | 21-225_146A8 | NA | SEQ ID NO:3290 TCTGGAAGCAGCTCCAACAT CGGAAGTAATTCTATAAAC | SEQ ID NO:11302 AGTAATGATCAGCGGCC CTCA | SEQ ID NO:19314 GCAGCATGGGATGACAGCCT GAACGGCGTGGTA |
| | | AA | SEQ ID NO:3291 SGSSSNIGSNSIN | SEQ ID NO:11303 SNDQRPS | SEQ ID NO:19315 AAWDDSLNGVV |
| iPS:436684 | 21-225_146B6 | NA | SEQ ID NO:3292 TCTGGAAGCAGCTCCAACAT CGGAAGTAATGCTGTAAAC | SEQ ID NO:11304 AGTAATAATCAGCGGCC CTCA | SEQ ID NO:19316 GCAGCATGGGATGACAGCCT GAATGCGTGGTA |
| | | AA | SEQ ID NO:3293 SGSSSNIGSNAVN | SEQ ID NO:11305 SNNQRPS | SEQ ID NO:19317 AAWDDSLNGVV |
| iPS:436686 | 21-225_148G6 | NA | SEQ ID NO:3294 TCTGGAGATAAATTGGGGA TAAATATGCTTCC | SEQ ID NO:11306 CAAGATAGCAAGCGGCC CTCA | SEQ ID NO:19318 CAGGCGTGGGACAGCAGCAC TGTGGTA |
| | | AA | SEQ ID NO:3295 SGDKLGDKYAS | SEQ ID NO:11307 QDSKRPS | SEQ ID NO:19319 QAWDSSTVV |

FIGURE 49
(Continued)

| | | | | | | |
|---|---|---|---|---|---|---|
| iPS:436688 | 21-225_148C8 | NA | SEQ ID NO:3296 TCTGGAGATAAATTGGGGGA TAAATATGTTTCC | SEQ ID NO:11308 CAAGATAGGAAGCGGCC CTCA | SEQ ID NO:19320 CTGGCGTGGACAGCAGCAC TTTTGTGGTA |
| | | AA | SEQ ID NO:3297 SGDKLGDKYVS | SEQ ID NO:11309 QDRKRPS | SEQ ID NO:19321 LAWDSSTFVV |
| iPS:436690 | 21-225_148A9 | NA | SEQ ID NO:3298 TCTGGAGATAAATTGGGGGAA TAAATATGTTTGC | SEQ ID NO:11310 CAAGATAGCAAGCGGCC CTCA | SEQ ID NO:19322 CAGGCGTGGCACAGCAGCAC TGTGGTA |
| | | AA | SEQ ID NO:3299 SGDKLGNKYVC | SEQ ID NO:11311 QDSKRPS | SEQ ID NO:19323 QAWHSSTVV |
| iPS:436694 | 21-225_148G11 | NA | SEQ ID NO:3300 TCTGGAGATAAATTGGGGGA TAAATTTGCTTCC | SEQ ID NO:11312 CAAGATAGCAAGCGGCC CTCA | SEQ ID NO:19324 CAGGCGTGGACAGCAGCAC TGTGGTA |
| | | AA | SEQ ID NO:3301 SGDKLGDKFAS | SEQ ID NO:11313 QDSKRPS | SEQ ID NO:19325 QAWDSSTVV |
| iPS:436696 | 21-225_149A1 | NA | SEQ ID NO:3302 TCTGAAGCAGCTCCAACAT CGGAAGTAATGCTGTAAAC | SEQ ID NO:11314 AGTAATAATCAGCGGCC CTCA | SEQ ID NO:19326 GCAGCATGGGATGACAGCCT GAATGGCGTGGTA |
| | | AA | SEQ ID NO:3303 SGSSSNIGSNAVN | SEQ ID NO:11315 SNNQRPS | SEQ ID NO:19327 AAWDDSLNGVV |
| iPS:436698 | 21-225_149B5 | NA | SEQ ID NO:3304 TCTGGAGATATAAATTGGGGTA TAAATATGTTTGC | SEQ ID NO:11316 CAAAATAACCAGCGGCC CTCA | SEQ ID NO:19328 CAGGCGTGGACAGCAGCAC TGTGGTA |
| | | AA | SEQ ID NO:3305 SGYKLGYKYVC | SEQ ID NO:11317 QNNQRPS | SEQ ID NO:19329 QAWDSSTVV |
| iPS:436700 | 21-225_149C7 | NA | SEQ ID NO:3306 TCTGAAATAAATTGGGGGA TAAATATGCTTCC | SEQ ID NO:11318 CAAGATAGCAAGCGGCC CTCA | SEQ ID NO:19330 CAGGCGTGGACAGCAGCAC TGTGGTA |
| | | | SEQ ID NO:3307 | SEQ ID NO:11319 | SEQ ID NO:19331 |

FIGURE 49
(Continued)

| | | AA/NA | | | | | | |
|---|---|---|---|---|---|---|---|---|
| iPS:436702 | 21-225_149E8 | AA | SGNKLGDKYAS | SEQ ID NO:3308 | QDSKRPS | SEQ ID NO:11320 | QAWDSSTVV | SEQ ID NO:19332 |
| | | NA | ACCTTACGCAGTGGCATCACTGTTACTACCTATAGGATATAC | SEQ ID NO:3309 | TACACATCAGACTCAGATAAACACCAGGGCTCT | SEQ ID NO:11321 | ATGATTTGGCACAGCAGCGCTTGGGTG | SEQ ID NO:19333 |
| iPS:436704 | 21-225_149C10 | AA | TLRSGITVTTYRIY | SEQ ID NO:3310 | YTSDSDKHQGS | SEQ ID NO:11322 | MIWHSSAWV | SEQ ID NO:19334 |
| | | NA | TCTGGAGATAAAATTGGGGGATAAATATGCTTCC | SEQ ID NO:3311 | CAAGATAACAAGCGGCCCTCA | SEQ ID NO:11323 | CAGGCGTGGGACAGCAGCACTGTGGTA | SEQ ID NO:19335 |
| iPS:436706 | 21-225_149A11 | AA | SGDKLGDKYAS | SEQ ID NO:3312 | QDNKRPS | SEQ ID NO:11324 | QAWDSSTVV | SEQ ID NO:19336 |
| | | NA | TCTGGAGATAAATTGGGGAATAAATATGTTTCC | SEQ ID NO:3313 | CAAGATAGCAGGCGGCCCTCA | SEQ ID NO:11325 | CTGGCGTGGGACAGCAGCACTTTTGTGGTC | SEQ ID NO:19337 |
| iPS:436708 | 21-225_150D3 | AA | SGDKLGNKYVS | SEQ ID NO:3314 | QDSRRPS | SEQ ID NO:11326 | LAWDSSTFVV | SEQ ID NO:19338 |
| | | NA | TCTGGAGATGAATTGGGGAATAAATATGCTTGC | SEQ ID NO:3315 | CAAGATAACAAGCGGCCCTCA | SEQ ID NO:11327 | CAGGCGTGGCACAGCAGCACTGTGGTA | SEQ ID NO:19339 |
| iPS:436710 | 21-225_150F6 | AA | SGDELGNKYAC | SEQ ID NO:3316 | QDNKRPS | SEQ ID NO:11328 | QAWHSSTVV | SEQ ID NO:19340 |
| | | NA | TCTGGAGATAAATTGGGGGATAAATATGCTTCC | SEQ ID NO:3317 | CAAGATAGCAAGCGGCCCTCA | SEQ ID NO:11329 | CAGGCGTGGGACAGCAGCACTGTGGTA | SEQ ID NO:19341 |
| | | AA | SGDKLGDKYAS | SEQ ID NO:3318 | QDSKRPS | SEQ ID NO:11330 | QAWDSSTVV | SEQ ID NO:19342 |

FIGURE 49
(Continued)

| | | | | | |
|---|---|---|---|---|---|
| iPS:436712 | 21-225_150F9 | NA | TCTGGAAGCAGCTCCAACAT CGGAAGTAATGCTGTAAAC | AGTAATAGTCAGCGGCC CTCA | GCAGCATGGGATGACAGCCT GAATGGCGTGGTA |
| | | | SEQ ID NO:3319 | SEQ ID NO:11331 | SEQ ID NO:19343 |
| | | AA | SGSSSNIGSNAVN | SNSQRPS | AAWDDSLNGVV |
| | | | SEQ ID NO:3320 | SEQ ID NO:11332 | SEQ ID NO:19344 |
| iPS:436714 | 21-225_150H11 | NA | TCTGGAGATAAATTGGGGGA TAAATATGCTTCC | CAAGATAGCAAGCGGCC CTCA | CAGGCGTGGGACAGCAGCAC TGTGGTA |
| | | | SEQ ID NO:3321 | SEQ ID NO:11333 | SEQ ID NO:19345 |
| | | AA | SGDKLGDKYAS | QDSKRPS | QAWDSSTVV |
| | | | SEQ ID NO:3322 | SEQ ID NO:11334 | SEQ ID NO:19346 |
| iPS:436716 | 21-225_151F3 | NA | TCTGGAGATAAATTGGGGGA TAAATATGTTTGC | CAAGATCGCAAGCGGCC CTCA | CAGGCGTGGGACAGCAGCAC TGTGGTA |
| | | | SEQ ID NO:3323 | SEQ ID NO:11335 | SEQ ID NO:19347 |
| | | AA | SGDKLGDKYVC | QDRKRPS | QAWHSSTVV |
| | | | SEQ ID NO:3324 | SEQ ID NO:11336 | SEQ ID NO:19348 |
| iPS:436718 | 21-225_151H5 | NA | TCTGGAGATAAATTGGGGGA TAAATATGCTTCC | CAAGATAGCAAGCGGCC CTCA | CAGGCGTGGGACAGCAGCAC TGTGGTA |
| | | | SEQ ID NO:3325 | SEQ ID NO:11337 | SEQ ID NO:19349 |
| | | AA | SGDKLGDKYAS | QDSKRPS | QAWDSSTVV |
| | | | SEQ ID NO:3326 | SEQ ID NO:11338 | SEQ ID NO:19350 |
| iPS:436720 | 21-225_151H6 | NA | TCTGGAGATAAATTGGGGGA TAAATATGCTTGC | CAAGATACCAAGCGGCC CTCA | CAGGCGTGGGACAGCAGCAC TTATGTC |
| | | | SEQ ID NO:3327 | SEQ ID NO:11339 | SEQ ID NO:19351 |
| | | AA | SGDKLGDKYAC | QDTKRPS | QAWDSSTYV |
| | | | SEQ ID NO:3328 | SEQ ID NO:11340 | SEQ ID NO:19352 |
| iPS:436722 | 21-225_151H7 | NA | TCTGGAGATAAATTGGGGGA TAAATATGCTTCC | CAAGATAGCAAGCGGCC CTCA | CAGGCGTGGGACAGCAGCAC TGTGGTA |
| | | | SEQ ID NO:3329 | SEQ ID NO:11341 | SEQ ID NO:19353 |
| | | AA | SGDKLGDKYAS | QDSKRPS | QAWDSSTVV |

FIGURE 49
(Continued)

| | | | | | | |
|---|---|---|---|---|---|---|
| iPS:436724 | 21-225_151B9 | NA | SEQ ID NO:3330 TCTGGAGATAAATTGGGGGA TAAATATGCTTCC | SEQ ID NO:11342 CAAGATAGCAAGCGGCC CTCA | SEQ ID NO:19354 CAGGCGTGGGACAGCAGCAC TGTGGTA |
| | | AA | SEQ ID NO:3331 SGDNLGDKYAS | SEQ ID NO:11343 QDSKRPS | SEQ ID NO:19355 QAWDSSTVV |
| iPS:436726 | 21-225_152G5 | NA | SEQ ID NO:3332 TCTGGAGATAAATTGGGGGA TAAATATGCTTGC | SEQ ID NO:11344 CAAGATTCCAAGCGGCC CTCA | SEQ ID NO:19356 CAGGCGTGGGACAGCAGCAC TTATGTC |
| | | AA | SEQ ID NO:3333 SGDKLGDKYAC | SEQ ID NO:11345 QDSKRPS | SEQ ID NO:19357 QAWDSSTYV |
| iPS:436728 | 21-225_152G6 | NA | SEQ ID NO:3334 SGDKLGDKYAS | SEQ ID NO:11346 QDSKRPS | SEQ ID NO:19358 CAGGCGTGGGACAACAGCAC TGTGGTA |
| | | AA | SEQ ID NO:3335 TCTGGAGATAAATTGGGGGA TAAATATGCTTCC | SEQ ID NO:11347 CAAGATAGCAAGCGGCC CTCA | SEQ ID NO:19359 QAWDNSTVV |
| | | | SEQ ID NO:3336 SGDKLGDKYAS | SEQ ID NO:11348 QDSKRPS | SEQ ID NO:19360 |
| iPS:436730 | 21-225_152D7 | NA | SEQ ID NO:3337 TCTGGAGATAAATTGGGGGA TAAATATGCTTCC | SEQ ID NO:11349 CAAGATAGCAAGCGGCC CTCA | SEQ ID NO:19361 CAGGCGTGGGACAGCAGCAC TGTGGTA |
| | | AA | SEQ ID NO:3338 SGDKLGDKYAS | SEQ ID NO:11350 QDSKRPS | SEQ ID NO:19362 QAWDSSTVV |
| iPS:436732 | 21-225_152B12 | NA | SEQ ID NO:3339 TCTGGCGATAAATTGGGAAA TAAATATGCTTGC | SEQ ID NO:11351 CAAGATACCAAGCGGCC CTCA | SEQ ID NO:19363 CAGGCGTGGGACAGCAGCAC TTATGTC |
| | | AA | SEQ ID NO:3340 SGDKLGNKYAC | SEQ ID NO:11352 QDTKRPS | SEQ ID NO:19364 QAWDSSTYV |
| iPS:436734 | 21-225_153A8 | NA | SEQ ID NO:3341 TCTGGAGATAAATTGGGGGA TAAATATGCTTGC | SEQ ID NO:11353 CAAGATACCAAGCGGCC CTCA | SEQ ID NO:19365 CAGGCGTGGGACAGCAGCAC TTATGTC |
| | | AA | SGDKLGDKYAC | QDTKRPS | QAWDSSTYV |

FIGURE 49
(Continued)

| | | | | | |
|---|---|---|---|---|---|
| iPS:436736 | 21-225_153E8 | NA | SEQ ID NO:3342 TCTGGAAGTAAATTGGGTAA TAAATATGTTTGC | SEQ ID NO:11354 CAAGATAACAAGCGGCC CTCA | SEQ ID NO:19366 CAGGCGTGGGACAGCAGCAC TTATGTGATA |
| | | AA | SEQ ID NO:3343 SGSKLGNKYVC | SEQ ID NO:11355 QDNKRPS | SEQ ID NO:19367 QAWDSSTYV1 |
| iPS:436738 | 21-225_153D9 | NA | SEQ ID NO:3344 TCTGGAGATAAATTGGGGGA TAAATATGCTTGC | SEQ ID NO:11356 CAAGATAGGAAGCGGCC CTCA | SEQ ID NO:19368 CAGGCGTGGCACAGCAGTAC TGTGGTA |
| | | AA | SEQ ID NO:3345 SGDKLGDKYAC | SEQ ID NO:11357 QDRKRPS | SEQ ID NO:19369 QAWHSSTVV |
| iPS:436740 | 21-225_154C3 | NA | SEQ ID NO:3346 TCTGGAGATAAATTGGGGGA TAAATATGTTTGC | SEQ ID NO:11358 CAAGATAGGAAGCGGCC CTCA | SEQ ID NO:19370 CAGGCGTGGCACAGCAGCAC TGTGGTA |
| | | AA | SEQ ID NO:3347 SGDKLGDKYVC | SEQ ID NO:11359 QDRKRPS | SEQ ID NO:19371 QAWHSSTVV |
| iPS:436742 | 21-225_154C4 | NA | SEQ ID NO:3348 TCTGGAGATAAATTGGGGGA TAAATATGCTTCC | SEQ ID NO:11360 CAAGATAGCAAGCGGCC CTCA | SEQ ID NO:19372 CAGGCGTGGGACAGCAGCAC TGTGGTA |
| | | AA | SEQ ID NO:3349 SGDKLGDKYAS | SEQ ID NO:11361 QDSKRPS | SEQ ID NO:19373 QAWDSSTVV |
| iPS:436744 | 21-225_154F4 | NA | SEQ ID NO:3350 TCTGGAGATAAATTGGGAAA TAAATATGTTTGT | SEQ ID NO:11362 AAAGATAGTAAGCGGCC CTCA | SEQ ID NO:19374 CAGGCGTGGGACAACAGTAC TTTAGTA |
| | | AA | SEQ ID NO:3351 SGDKLGNKYVC | SEQ ID NO:11363 KDSKRPS | SEQ ID NO:19375 QAWDNSTLV |
| iPS:436746 | 21-225_154E10 | NA | SEQ ID NO:3352 TCTGGAGATAAATTGGGGGA TAAATATGCTTCC | SEQ ID NO:11364 CAAGATAGCAAGCGGCC CTCA | SEQ ID NO:19376 CAGGCGTGGGACAACAGCAC TGTGGTA |
| | | AA | SEQ ID NO:3353 SGDKLGDKYAS | SEQ ID NO:11365 QDSKRPS | SEQ ID NO:19377 QAWDNSTVV |

FIGURE 49
(Continued)

| | | | | | | |
|---|---|---|---|---|---|---|
| iPS:436748 | 21-225_154D11 | NA | SEQ ID NO:3354 TCTGGAGATAAATTGGGGGA TAAATATGCTTGC | SEQ ID NO:11366 CAAGATAAGAAGCGGCC CTCA | SEQ ID NO:19378 CAGGCGTGGCACAGCAGTAT TGTGGTA |
| | | AA | SEQ ID NO:3355 SGDKLGDKYAC | SEQ ID NO:11367 QDKKRPS | SEQ ID NO:19379 QAWHSSIVV |
| iPS:436750 | 21-225_154G12 | NA | SEQ ID NO:3356 TCTGGAAGCAGCTCCAACAT CGGAAATAATGCTGTAAGC | SEQ ID NO:11368 AGTAATGATCACCGGCC CTCA | SEQ ID NO:19380 GCAGCATGGGATGACAGCCT GAAGGGTCCGGTA |
| | | AA | SEQ ID NO:3357 SGSSSNIGNNAVS | SEQ ID NO:11369 SNDHRPS | SEQ ID NO:19381 AAWDDSLKGPV |
| iPS:436752 | 21-225_155H1 | NA | SEQ ID NO:3358 ACTGGGAGCAGCTCCAATAT CGGGGCAGGTTATGATGTAC AC | SEQ ID NO:11370 GGTAACAGCAATCGGCC CTCA | SEQ ID NO:19382 CAGTCCTATGACAGCAGCCT GAGTGGTCCTGTGATA |
| | | AA | SEQ ID NO:3359 TGSSSNIGAGYDVH | SEQ ID NO:11371 GNSNRPS | SEQ ID NO:19383 QSYDSSLSGPVI |
| iPS:436754 | 21-225_155G3 | NA | SEQ ID NO:3360 TCTGGAGATAAGTTGGGGGA TAAATATGTTTGC | SEQ ID NO:11372 CAAGATAGTAAGCGGCC CTCA | SEQ ID NO:19384 CAGGCGTGGGACAATAGTAT TTATGTC |
| | | AA | SEQ ID NO:3361 SGDKLGDKYVC | SEQ ID NO:11373 QDSKRPS | SEQ ID NO:19385 QAWDNSIYV |
| iPS:436756 | 21-225_146A10 | NA | SEQ ID NO:3362 TCTGGAGATAAATTGGGGGA TAAATATGTTTGC | SEQ ID NO:11374 CAAGATAGAAAGCGGCC CTCA | SEQ ID NO:19386 CAGGCGTGGGACAGCAGCAC TGTGGTG |
| | | AA | SEQ ID NO:3363 SGDKLGDKYVC | SEQ ID NO:11375 QDRKRPS | SEQ ID NO:19387 QAWDSSTVV |
| iPS:436758 | | NA | SEQ ID NO:3364 TCTGGAGATAAATTGGGGGA TAAATATGTTTCC | SEQ ID NO:11376 CAAGATAGCAAGCGGCC CTCA | SEQ ID NO:19388 CAGGCGTGGGACAGCAGCAC TGTGGTA |

FIGURE 49
(Continued)

| | | | | | | | |
|---|---|---|---|---|---|---|---|
| iPS:436760 | 21-225_155C10 | AA | SEQ ID NO:3365 | SGDKLGDKYVS | SEQ ID NO:11377 | QDSKRPS | SEQ ID NO:19389 | QAWDSSTVV |
| | | | SEQ ID NO:3366 | | SEQ ID NO:11378 | | SEQ ID NO:19390 |
| | | NA | TCTGGAGATAAATTGGGGGA TAAATATGTTTCC | | CAAGATAGGAAGCGGCC CTCA | | CTGGCGTGGACAGCAGCAC TTTTGTGTA |
| iPS:436762 | 21-225_155E10 | AA | SEQ ID NO:3367 | SGDKLGDKYVS | SEQ ID NO:11379 | QDRKRPS | SEQ ID NO:19391 | LAWDSSTFVV |
| | | | SEQ ID NO:3368 | | SEQ ID NO:11380 | | SEQ ID NO:19392 |
| | | NA | TCTGGAAGCAGCTCCAACAT CGGAAGTAATACTGTAAAT | | AGTAGTAATCAGCGGCC CTCA | | GCAGCATGGGATGACAGCCT GAATGGCGTGGTA |
| iPS:436763 | 21-225_156H2 | AA | SEQ ID NO:3369 | SGSSSNIGSNTVN | SEQ ID NO:11381 | SSNQRPS | SEQ ID NO:19393 | AAWDDSLNGVV |
| | | | SEQ ID NO:3370 | | SEQ ID NO:11382 | | SEQ ID NO:19394 |
| | | NA | TCTGGAGATAAATTGGGGGA TAAATATGTTTGC | | CAAGATAGTAAGCGGCC CTCA | | CAGGCGTGGGACAACAGCAG CTTTGTGCTA |
| iPS:436764 | 21-225_158E9 | AA | SEQ ID NO:3371 | SGDKLGDKYVC | SEQ ID NO:11383 | QDSKRPS | SEQ ID NO:19395 | QAWDNSSFVL |
| | | | SEQ ID NO:3372 | | SEQ ID NO:11384 | | SEQ ID NO:19396 |
| | | NA | TCTGGAGATAAATTGGGGGA TAAATATGTTTGC | | CAAGATCGCAAGCGGCC CTCA | | CAGGCGTGGGGCAACAGCAG CTTTGTGGTA |
| iPS:436766 | 21-225_158D10 | AA | SEQ ID NO:3373 | SGDKLGDKYVC | SEQ ID NO:11385 | QDRKRPS | SEQ ID NO:19397 | QAWGNSSFVV |
| | | | SEQ ID NO:3374 | | SEQ ID NO:11386 | | SEQ ID NO:19398 |
| | | NA | TCTGGAGATAAATTGGGGGA TAAATATGTTTGC | | CAAGATAGGAAGCGGCC CTCA | | CAGGCGTGGGGCAACAGCAG CTTTGTGGTA |
| iPS:436768 | 21-225_159H8 | AA | SEQ ID NO:3375 | SGDKLGDKYVC | SEQ ID NO:11387 | QDRKRPS | SEQ ID NO:19399 | QAWGNSSFVV |
| | | | SEQ ID NO:3376 | | SEQ ID NO:11388 | | SEQ ID NO:19400 |

FIGURE 49
(Continued)

| | | | | | |
|---|---|---|---|---|---|
| iPS:436770 | 21-225_160B12 | NA | TCTGGAGATAAATTGGGGGA TAAATATGTTTGC SEQ ID NO:3377 | CAAGATAGCAAGCGGCC CTCA SEQ ID NO:11389 | CAGGCGTGGGGCAACAGCAG CTTTGTGGTA SEQ ID NO:19401 |
| | | AA | SGDKLGDKYVC SEQ ID NO:3378 | QDSKRPS SEQ ID NO:11390 | QAWGNSSFVV SEQ ID NO:19402 |
| iPS:436772 | 21-225_161H3 | NA | TCTGGAGATAGATTGGGGGA TAAATATGTTTGC SEQ ID NO:3379 | CAAGATAACAACAAGCGGCC CTCA SEQ ID NO:11391 | CAGGCGTGGGTCAACAACAC TGCAGTGGTT SEQ ID NO:19403 |
| | | AA | SGDRLGDKYVC SEQ ID NO:3380 | QDNKRPS SEQ ID NO:11392 | QAWVNNTAVV SEQ ID NO:19404 |
| iPS:436774 | 21-225_161E10 | NA | TCTGGAGATAAATTGGGGGA TAAATATGTTTGC SEQ ID NO:3381 | CAAGATAGCAGACAAGCGGCC CTCA SEQ ID NO:11393 | CAGACGTGGGACAACAGTAG TTTTGCGCTT SEQ ID NO:19405 |
| | | AA | SGDKLGDKYVC SEQ ID NO:3382 | QDSKRPS SEQ ID NO:11394 | QTWDNSSFAL SEQ ID NO:19406 |
| iPS:436776 | 21-225_161F12 | NA | TCTGGAGATAAATTGGGTGA TAAATATGCTTGC SEQ ID NO:3383 | CAAGATACCAAGCGGCC CTCA SEQ ID NO:11395 | CAGGCGTGGGACAGCACCAC TCTGGTT SEQ ID NO:19407 |
| | | AA | SGDKLGDKYAC SEQ ID NO:3384 | QDTKRPS SEQ ID NO:11396 | QAWDSTTLV SEQ ID NO:19408 |
| iPS:436780 | 21-225_165H3 | NA | TCTGGAGATAAATTGGGTGA TAAATATGCTTGC SEQ ID NO:3385 | CAAGATAGCAAGCGGCC CTCA SEQ ID NO:11397 | CAGGCGTGGGACAGCACCAC TCTGGTT SEQ ID NO:19409 |
| | | AA | SGDKLGDKYAC SEQ ID NO:3386 | QDSKRPS SEQ ID NO:11398 | QAWDSTTLV SEQ ID NO:19410 |
| iPS:436782 | 21-225_166G11 | NA | TCTGGAGATAAATTGGGGGA TAAATATGTTCAC SEQ ID NO:3387 | CAAGATAGCAAGCGGCC CTCA SEQ ID NO:11399 | CAGGCGTGGGACAACAGCAC TGCGGTA SEQ ID NO:19411 |
| | | AA | SGDKLGDKYVH SEQ ID NO:3388 | QDSKRPS SEQ ID NO:11400 | QAWDNSTAV SEQ ID NO:19412 |

FIGURE 49
(Continued)

| | | | | | |
|---|---|---|---|---|---|
| iPS:436784 | 21-225_169C1 | NA | TCTGGAGATAAATTGGGGGATAAATATGTTTGT SEQ ID NO:3389 | AAAGATATCAAGCGGCCCTCA SEQ ID NO:11401 | CAGGCGTGGGACACCAACAC TGTGATA SEQ ID NO:19413 |
| | | AA | SGDKLGDKYVC SEQ ID NO:3390 | KDIKRPS SEQ ID NO:11402 | QAWDTNTV1 SEQ ID NO:19414 |
| iPS:436786 | 21-225_169A6 | NA | TCTGGAGATAAATTGGGGGATAAATATGTTTGT SEQ ID NO:3391 | CAGGATTACAAGCGGCCCTCA SEQ ID NO:11403 | CAGGCGTGGGACACCAACAC TGTGCTT SEQ ID NO:19415 |
| | | AA | SGDKLGDKYVC SEQ ID NO:3392 | QDYKRPS SEQ ID NO:11404 | QAWDTNTVL SEQ ID NO:19416 |
| iPS:436788 | 21-225_169B7 | NA | TCTGGAGATAAATTGGGGGGCAAGATAGGAAGCGGCC AAAATATGCTTCC CTCA SEQ ID NO:3393 SEQ ID NO:11405 | | CAGGCGTGGGACAAGAACAC TGTGGTA SEQ ID NO:19417 |
| | | AA | SGDKLGGKYAS SEQ ID NO:3394 | QDRKRPS SEQ ID NO:11406 | QAWDKNTVV SEQ ID NO:19418 |
| iPS:436790 | 21-225_169G11 | NA | TCTGGAGATAAATTGGGGGATAAATATGCTTGC SEQ ID NO:3395 | CAAGATAGTAAGCGGCCCTCA SEQ ID NO:11407 | CAGGCGTGGGACAACAGCAC TGCGGTA SEQ ID NO:19419 |
| | | AA | SGDKLGDKYAC SEQ ID NO:3396 | QDSKRPS SEQ ID NO:11408 | QAWDNSTAV SEQ ID NO:19420 |
| iPS:436792 | 21-225_169D12 | NA | ACCCGCAGCAGTGGCAGCAT TACCGGCAACTATGTGCAG SEQ ID NO:3397 | GAGGATAAAAAAAGACC CTCT SEQ ID NO:11409 | CAGTCTTATTATAGCGGCAA TTGGGTG SEQ ID NO:19421 |
| | | AA | TRSSGSITGNYVQ SEQ ID NO:3398 | EDKKRPS SEQ ID NO:11410 | QSYYSGNWV SEQ ID NO:19422 |
| iPS:436794 | 21-225_170F1 | NA | TCTGGAGATAAATTGGGGGATAAATATTCTTGC SEQ ID NO:3399 | CAAGATAGTAAGCGGCCCTCA SEQ ID NO:11411 | CAGGCGTGGGACAGCAACAC TGCGGTA SEQ ID NO:19423 |
| | | AA | SGDKLGDKYSC | QDSKRPS | QAWDSNTAV |

FIGURE 49
(Continued)

| | | | | | | |
|---|---|---|---|---|---|---|
| iPS:436796 | 21-225_170A5 | NA | SEQ ID NO:3400<br>TCTGGAGATAAATTGGGGGA<br>TAAATATGCTTGT | SEQ ID NO:3401 | SEQ ID NO:11412<br>CAAGATTACAAGCGCC<br>CTCA | SEQ ID NO:19424<br>CAGGCGTGGGACAACAGCAC<br>TATGGTA |
| | | AA | SEQ ID NO:3401<br>SGDKLGDKYAC | | SEQ ID NO:11413<br>QDYKRPS | SEQ ID NO:19425<br>QAWDNSTMV |
| iPS:436798 | 21-225_171F5 | NA | SEQ ID NO:3402<br>TCTGGAGATAAATTGGGGGG<br>AAAATATGCTTCC | | SEQ ID NO:11414<br>CAAGATAGGAAGCGGCC<br>CTCA | SEQ ID NO:19426<br>CAGGCGTGGGACAAGAACAC<br>TGTGGTA |
| | | AA | SEQ ID NO:3403<br>SGDKLGGKYAS | | SEQ ID NO:11415<br>QDRKRPS | SEQ ID NO:19427<br>QAWDKNTVV |
| iPS:436800 | 21-225_171D12 | NA | SEQ ID NO:3404<br>CAAGGAGACAGCCTCAGAA<br>GCTATTATGCAAGC | | SEQ ID NO:11416<br>GCTAAAAACAACCGGCC<br>CTCA | SEQ ID NO:19428<br>AACTCCCGGGACAGCAGTGG<br>CAGCCATGTGGTA |
| | | AA | SEQ ID NO:3405<br>QGDSLRSYYAS | | SEQ ID NO:11417<br>AKNNRPS | SEQ ID NO:19429<br>NSRDSSGSHVV |
| iPS:436802 | 21-225_171E12 | NA | SEQ ID NO:3406<br>TCTGGAGATAAATTGGGGGA<br>TAAATATGCTTGC | | SEQ ID NO:11418<br>CAAGATCGCAAGCGGCC<br>CTCA | SEQ ID NO:19430<br>CAGGCGTGGGACATCAGCAC<br>TTATGTGGTA |
| | | AA | SEQ ID NO:3407<br>SGDKLGDKYAC | | SEQ ID NO:11419<br>QDRKRPS | SEQ ID NO:19431<br>QAWDISTYVV |
| iPS:436804 | 21-225_172C3 | NA | SEQ ID NO:3408<br>CAAGGAGACAGCCTCAGAA<br>ACTATTATGTAAGC | | SEQ ID NO:11420<br>ACTAAAAACAGCCGGCC<br>CTCA | SEQ ID NO:19432<br>AACTCCCGGGACAGCAGTGG<br>CAACCATGTGGTA |
| | | AA | SEQ ID NO:3409<br>QGDSLRNYYVS | | SEQ ID NO:11421<br>TKNSRPS | SEQ ID NO:19433<br>NSRDSSGNHVV |
| iPS:436806 | 21-225_172B12 | NA | SEQ ID NO:3410<br>CAAGGAGACAGCCTCAGAA<br>ACTATTATGCAAGC | | SEQ ID NO:11422<br>ACTAAAAACAGCCGGCC<br>CTCA | SEQ ID NO:19434<br>AACTCCCGGGACAGCAGTGG<br>CAACCATGTGGTA |
| | | AA | SEQ ID NO:3411<br>QGDSLRNYYAS | | SEQ ID NO:11423<br>TKNSRPS | SEQ ID NO:19435<br>NSRDSSGNHVV |

FIGURE 49
(Continued)

| | | | | | | |
|---|---|---|---|---|---|---|
| iPS:436808 | 21-225_173F8 | NA | SEQ ID NO:3412 TCTGGAAATAAATTGGGGAA TAAATATGTTTGC | SEQ ID NO:11424 CAAGATAGCAGGCGGCC CTCA | SEQ ID NO:19436 CAGGCGTGGGACAGCAGCTTCAC TGTGGTA |
| | | AA | SEQ ID NO:3413 SGNKLGNKYVC | SEQ ID NO:11425 QDSRRPS | SEQ ID NO:19437 QAWDSFTVV |
| iPS:436810 | 21-225_175F4 | NA | SEQ ID NO:3414 ACTGGAACCAGCAGTGATGT TGGACGTTTTAACCTTGTCT CC | SEQ ID NO:11426 GAGGTCAGTAAGCGGCC CTCA | SEQ ID NO:19438 TGCTCATATGCAGGTAGTAG CACCTATGTGGTA |
| | | AA | SEQ ID NO:3415 TGTSSDVGRFNLVS | SEQ ID NO:11427 EVSKRPS | SEQ ID NO:19439 CSYAGSSTYVV |
| iPS:436812 | 21-225_175C6 | NA | SEQ ID NO:3416 TCTGGAGATAAATTGGGGGA TAAATATGCTTGT | SEQ ID NO:11428 CAAGATTACAAGCGGCC CTCA | SEQ ID NO:19440 CAGGCGTGGGACAACAGCAC TATGGTA |
| | | AA | SEQ ID NO:3417 SGDKLGDKYAC | SEQ ID NO:11429 QDYKRPS | SEQ ID NO:19441 QAWDNSTMV |
| iPS:436814 | 21-225_178H10 | NA | SEQ ID NO:3418 ACTGGAACCAGCAGTGATGT TGGACGTTTTAACCTTGTCT CC | SEQ ID NO:11430 GAAGTCAGTAAGCGGCC CTCA | SEQ ID NO:19442 TGCTCATATGCAGGTAGTAG CACCTTTGTAGTA |
| | | AA | SEQ ID NO:3419 TGTSSDVGRFNLVS | SEQ ID NO:11431 EVSKRPS | SEQ ID NO:19443 CSYAGSSTFVV |
| iPS:436816 | 21-225_179H5 | NA | SEQ ID NO:3420 CAAGGAGACAGTCTCAGAA ACTATTATGCAAGC | SEQ ID NO:11432 GGTAAAAACAACCGGCC CTCA | SEQ ID NO:19444 AACTCCCGGACAGCAGTGG TAACCATTGGGTG |
| | | AA | SEQ ID NO:3421 QGDSLRNYYAS | SEQ ID NO:11433 GKNNRPS | SEQ ID NO:19445 NSRDSSGNHWV |
| iPS:436818 | | NA | SEQ ID NO:3422 TCTGGAGATAAATTGGGGGA TAAATATGTTTGC | SEQ ID NO:11434 CAGGATAGTAAGCGGCC CTCA | SEQ ID NO:19446 CAGGCGTGGGACAGCAACAC TGCAGTGGTA |

FIGURE 49
(Continued)

| | | | | | | |
|---|---|---|---|---|---|---|
| iPS:436820 | 21-225_179C7 | | SEQ ID NO:3423 | | SEQ ID NO:11435 | | SEQ ID NO:19447 |
| | | AA | SGDKLGDKYVC | | QDSKRPS | | QAWDSNTAVV |
| | | | SEQ ID NO:3424 | | SEQ ID NO:11436 | | SEQ ID NO:19448 |
| iPS:436822 | 21-225_179D10 | NA | ACTGGGAGCAGCTCCAACTTCGGGACAGATTATGATGTAC AC | GGTCACAGCAGCAACCGGCC CTCA | CAGTCCTATGATAGAAGCCT GAATGTGGTC |
| | | | SEQ ID NO:3425 | | SEQ ID NO:11437 | | SEQ ID NO:19449 |
| | | AA | TGSSSNFGTDYDVH | | GHSNRPS | | QSYDRSLNVV |
| | | | SEQ ID NO:3426 | | SEQ ID NO:11438 | | SEQ ID NO:19450 |
| iPS:436824 | 21-225_180D4 | NA | TCTGGAGATAGAATTGGGGGA TAAATATGCTTGC | GAAGATAGGAAGCGGCC CTCA | CAGGCGTGGGACAGTAGGAA AGTGGTA |
| | | | SEQ ID NO:3427 | | SEQ ID NO:11439 | | SEQ ID NO:19451 |
| | | AA | SGDRLGDKYAC | | EDRKRPS | | QAWDSRKVV |
| | | | SEQ ID NO:3428 | | SEQ ID NO:11440 | | SEQ ID NO:19452 |
| iPS:436826 | 21-225_180C5 | NA | TCTGGAGATAAATTGGGGGA AAAATATGCTTGC | CAAGATAGAAAGCGGCC CTCA | CAGGCGTGGGACAGCAGCAC TGCGGTA |
| | | | SEQ ID NO:3429 | | SEQ ID NO:11441 | | SEQ ID NO:19453 |
| | | AA | SGDKLGEKYAC | | QDRKRPS | | QAWDSSTAV |
| | | | SEQ ID NO:3430 | | SEQ ID NO:11442 | | SEQ ID NO:19454 |
| iPS:436826 | 21-225_180G5 | NA | TCTGGAGATAAATTGGGGGA TAAATATGTTAGC | CAAGATAGCAAGCGGCC CTCA | CAGGCGTGGGACATCACCAC TGCGGTA |
| | | | SEQ ID NO:3431 | | SEQ ID NO:11443 | | SEQ ID NO:19455 |
| | | AA | SGDKLGDKYVS | | QDSKRPS | | QAWDITTAV |
| | | | SEQ ID NO:3432 | | SEQ ID NO:11444 | | SEQ ID NO:19456 |
| iPS:436828 | 21-225_181H1 | NA | TCTGGAGATAAATTGGGGGA TAAATATGCTTGC | GAAGATAGGAAGCGGCC CTCA | CAGGCGTGGGACAGCAGGA AAGTGGTA |
| | | | SEQ ID NO:3433 | | SEQ ID NO:11445 | | SEQ ID NO:19457 |
| | | AA | SGDKLGDKYAC | | EDRKRPS | | QAWDSRKVV |
| | | | SEQ ID NO:3434 | | SEQ ID NO:11446 | | SEQ ID NO:19458 |

FIGURE 49
(Continued)

| | | | | | |
|---|---|---|---|---|---|
| iPS:436830 | 21-225_51F4 | NA | TCTGGAAGCAGCTCCAACAT CGGAAGTAATATTGTGACC | AGTAATGATCAGCGGCC CTCA | ACAGCATGGGATGACAGCCT GAATGGTTGGGTG |
| | | | SEQ ID NO:3435 | SEQ ID NO:11447 | SEQ ID NO:19459 |
| | | AA | SGSSSNIGSNIVT | SNDQRPS | TAWDSLNGWV |
| | | | SEQ ID NO:3436 | SEQ ID NO:11448 | SEQ ID NO:19460 |
| iPS:436832 | 21-225_51D8 | NA | ACTGGGAGCAGCTCCAACAT CGGGGCAGTTTTGAAGTAC AC | GGTAACAGCAATCGGCC CTCA | CAGTCCTATGACAGCAGCCT GAGTGGTTATGTC |
| | | | SEQ ID NO:3437 | SEQ ID NO:11449 | SEQ ID NO:19461 |
| | | AA | TGSSSNIGAGFEVH | GNSNRPS | QSYDSSLSGYV |
| | | | SEQ ID NO:3438 | SEQ ID NO:11450 | SEQ ID NO:19462 |
| iPS:436834 | 21-225_52F1 | NA | TCTGGAAGCAGCTCCAACAT CGGAAGTAATATTGTGACC | AGTAATGATCAGCGGCC CTCA | GCAGCATGGGATGACAGCCT GAATGGTTGGGTG |
| | | | SEQ ID NO:3439 | SEQ ID NO:11451 | SEQ ID NO:19463 |
| | | AA | SGSSSNIGSNIVT | SNDQRPS | AAWDDSLNGWV |
| | | | SEQ ID NO:3440 | SEQ ID NO:11452 | SEQ ID NO:19464 |
| iPS:436836 | 21-225_52H1 | NA | TCTGGAGATAAATTGGGGGA TAAATATGTTTCC | CAAGATAGAAAGCGCC CTCA | CAGGCGTGGGACAACAGCAC TGTGGTA |
| | | | SEQ ID NO:3441 | SEQ ID NO:11453 | SEQ ID NO:19465 |
| | | AA | SGDKLGDKYVS | QDRKRPS | QAWDNSTVV |
| | | | SEQ ID NO:3442 | SEQ ID NO:11454 | SEQ ID NO:19466 |
| iPS:436838 | 21-225_52H4 | NA | ACTGGAACCAGCAGTGACGT TGGTGGTTATAACTATGTCT CC | GAGGTCAGTAATCGGCC CTCA | AACTCATATACAAGCAACAT CACTTGGGTG |
| | | | SEQ ID NO:3443 | SEQ ID NO:11455 | SEQ ID NO:19467 |
| | | AA | TGTSSDVGGYNYVS | EVSNRPS | NSYTSNITWV |
| | | | SEQ ID NO:3444 | SEQ ID NO:11456 | SEQ ID NO:19468 |

FIGURE 49
(Continued)

| | | | | | |
|---|---|---|---|---|---|
| iPS:436840 | 21-225_53E9 | NA | TCTGGAACTAAATTGGGGGA TAAATATGTTTGC SEQ ID NO:3445 | CAAGATACAATGCGGCC CTCA SEQ ID NO:11457 | CAGACGTGGGACAGCAC TGCGGTT SEQ ID NO:19469 |
| | | AA | SGTKLGDKYVC SEQ ID NO:3446 | QDTMRPS SEQ ID NO:11458 | QTWDSSTAV SEQ ID NO:19470 |
| iPS:436842 | 21-225_54E9 | NA | TCTGGAAGCAACTCCAACAT CGGAAATAATATTGTTACC SEQ ID NO:3447 | GTTAATGATCAGCGGCC CTCA SEQ ID NO:11459 | GCAGCATGGGATGACAGCCT GAATGGTTGGGTG SEQ ID NO:19471 |
| | | AA | SGSNSNIGNNIVT SEQ ID NO:3448 | VNDQRPS SEQ ID NO:11460 | AAWDDSLNGWV SEQ ID NO:19472 |
| iPS:436844 | 21-225_56G1 | NA | TCTGGAAGCAGCTCCAACAT CGGAAGTCATATTGTTACC SEQ ID NO:3449 | AGTAATGATCAGCGGCC CTCA SEQ ID NO:11461 | GCAGTATGGGATGACAGCCT GATTGGTTGGGTG SEQ ID NO:19473 |
| | | AA | SGSSSNIGSHIVT SEQ ID NO:3450 | SNDQRPS SEQ ID NO:11462 | AVWDDSLIGWV SEQ ID NO:19474 |
| iPS:436846 | 21-225_56E3 | NA | TCTGGAAGCAGCTCCAACAT CGGAAGTAATATTGTTACC SEQ ID NO:3451 | AGTAATAATCAGCGGCC CTCA SEQ ID NO:11463 | GCAGCATGGGATGACAGCCT GAATGGTTGGGTG SEQ ID NO:19475 |
| | | AA | SGSSSNIGSNIVT SEQ ID NO:3452 | SNNQRPS SEQ ID NO:11464 | AAWDDSLNGWV SEQ ID NO:19476 |
| iPS:436848 | 21-225_57F1 | NA | TCTGGAGATAAACTGGGGGA AAAATATGCTTGC SEQ ID NO:3453 | CAAGATAGGAAGCGGCC CTCA SEQ ID NO:11465 | CAGGCGTGGGACAGCAGCAC TGTGGTA SEQ ID NO:19477 |
| | | AA | SGDKLGEKYAC SEQ ID NO:3454 | QDRKRPS SEQ ID NO:11466 | QAWDSSTVV SEQ ID NO:19478 |
| iPS:436850 | | NA | TCTGGAGAGAAATTGGGGG AAAAATTTGCTTGC | CAAGATAGCAAGCGGCC CTCA | CAGGCGTGGGACAGCAGCAC TGTGGTA |

FIGURE 49
(Continued)

| | | | | | | | |
|---|---|---|---|---|---|---|---|
| | 21-225_57D9 | | SEQ ID NO:3455 SGEKLGEKFAC | | SEQ ID NO:11467 QDSKRPS | | SEQ ID NO:19479 QAWDSSTVV |
| iPS:436852 | | AA | SEQ ID NO:3456 | | SEQ ID NO:11468 | | SEQ ID NO:19480 |
| | 21-225_57H11 | NA | TCTGGAGATAAACTGGGGGA AAAATATGCTTGC | | CAAGATAGGAAGCGGCC CTCA | | CAGGCGTGGGACAGCAGCAC TGTGGTA |
| | | | SEQ ID NO:3457 SGDKLGEKYAC | | SEQ ID NO:11469 QDRKRPS | | SEQ ID NO:19481 QAWDSSTVV |
| iPS:436854 | | AA | SEQ ID NO:3458 | | SEQ ID NO:11470 | | SEQ ID NO:19482 |
| | 21-225_58C1 | NA | TCTGGAGATAAATTGGGGAA TAAATATGCTTGC | | CAAGATAGGAAGCGGCC CTCA | | CAGGCGTGGGACAGCAGCAC TGCA |
| | | | SEQ ID NO:3459 SGDKLGNKYAC | | SEQ ID NO:11471 QDRKRPS | | SEQ ID NO:19483 QAWDSSTA |
| iPS:436856 | | AA | SEQ ID NO:3460 | | SEQ ID NO:11472 | | SEQ ID NO:19484 |
| | 21-225_58C5 | NA | TCTGGAAGCAGCTCCAACAT TGGGAATAATTATGTATCC | | GACAATAATAAGCGACC CTCA | | GGAACATGGGATATCAGTCT GAGTGTTGGGGTA |
| | | | SEQ ID NO:3461 SGSSSNIGNNYVS | | SEQ ID NO:11473 DNNKRPS | | SEQ ID NO:19485 GTWDISLSVGV |
| iPS:436858 | | AA | SEQ ID NO:3462 | | SEQ ID NO:11474 | | SEQ ID NO:19486 |
| | 21-225_58E7 | NA | TCTGGAGATAAATTGGGGGA TAAATATACTTGC | | CAAGATAACAAGCGGCC CTCA | | CAGGCGTGGAACAACTACAC TGTGGTA |
| | | | SEQ ID NO:3463 SGDKLGDKYTC | | SEQ ID NO:11475 QDNKRPS | | SEQ ID NO:19487 QAWNNYTVV |
| iPS:436860 | | AA | SEQ ID NO:3464 | | SEQ ID NO:11476 | | SEQ ID NO:19488 |
| | 21-225_58F7 | NA | TCTGGAGATAAATTGGGGGA TAAATATGCTTGC | | CAAGATAGGAAGCGGCC CTCA | | CAGGCGTGGGACAGCAGCAC TGTGGTA |
| | | | SEQ ID NO:3465 SGDKLGDKYAC | | SEQ ID NO:11477 QDRKRPS | | SEQ ID NO:19489 QAWDSSTVV |
| | | AA | SEQ ID NO:3466 | | SEQ ID NO:11478 | | SEQ ID NO:19490 |

FIGURE 49
(Continued)

| | | | | |
|---|---|---|---|---|
| iPS:436862 | 21-225_58F8 | NA | TCTGGAGATAAATTGGGAAA TAAATATGCTTGC SEQ ID NO:3467 | CAAGATAGCAAGCGGCC CTCA SEQ ID NO:11479 | CAGGCGTGGGACAGCAGCAC TGTGGTA SEQ ID NO:19491 |
| | | AA | SGDKLGNKYAC SEQ ID NO:3468 | QDSKRPS SEQ ID NO:11480 | QAWDSSTVV SEQ ID NO:19492 |
| iPS:436864 | 21-225_58G11 | NA | TCTGGAGATAAATTGGGGGA TAAATATGCTTCC SEQ ID NO:3469 | CAAGATAACAAGCGGCC CTCA SEQ ID NO:11481 | CAGGCGTGGAACAACAACAC TGTAATG SEQ ID NO:19493 |
| | | AA | SGDKLGDKYAS SEQ ID NO:3470 | QDNKRPS SEQ ID NO:11482 | QAWNNTVM SEQ ID NO:19494 |
| iPS:436866 | 21-225_59F2 | NA | TCTGGAGATAAATTGGGGGA TAAATATGCTTCT SEQ ID NO:3471 | CAAGATAACAAGCGGCC CTCA SEQ ID NO:11483 | CAGGCGTGGGACAACAACAC TGTGGTC SEQ ID NO:19495 |
| | | AA | SGDKLGDKYAS SEQ ID NO:3472 | QDNKRPS SEQ ID NO:11484 | QAWDNNTVV SEQ ID NO:19496 |
| iPS:436868 | 21-225_59B11 | NA | TCTGGAGATAAATTGGGGGA TAAATATGCTTGC SEQ ID NO:3473 | CAAGATAGCAAGCAAGCGGCC CTCA SEQ ID NO:11485 | CAGGCGTGGGACAGCAGCAC TTATGTGGTA SEQ ID NO:19497 |
| | | AA | SGDKLGDKYAC SEQ ID NO:3474 | QDSKRPS SEQ ID NO:11486 | QAWDSSTYVV SEQ ID NO:19498 |
| iPS:436870 | 21-225_60B1 | NA | TCTGGAGATAAACTGGGGGA AAAATATGCTTGC SEQ ID NO:3475 | CAAGATAGGAAGCGGCC CTCA SEQ ID NO:11487 | CAGGCGTGGGACAGCAGCAC TGTGGTA SEQ ID NO:19499 |
| | | AA | SGDKLGEKYAC SEQ ID NO:3476 | QDRKRPS SEQ ID NO:11488 | QAWDSSTVV SEQ ID NO:19500 |
| iPS:436872 | 21-225_60D2 | NA | TCTGGAAATAAATTGGGGGA TAAATATGCTTCT SEQ ID NO:3477 | CAAGATAACAAGCGGCC CTCA SEQ ID NO:11489 | CAGGCGTGGGACAACAACAC TGTGGTC SEQ ID NO:19501 |
| | | AA | SGNKLGDKYAS SEQ ID NO:3478 | QDNKRPS SEQ ID NO:11490 | QAWDNNTVV SEQ ID NO:19502 |

FIGURE 49
(Continued)

| | | | | | |
|---|---|---|---|---|---|
| iPS:436874 | 21-225_60A12 | NA | TCTGGAGATAAATTGGGGAA TAAATATGCTTGC SEQ ID NO:3479 | CAAGATAGGAAGCGGCC CTCA SEQ ID NO:11491 | CAGGGGTGGGACAGCAGCAC TGCT SEQ ID NO:19503 |
| | | AA | SGDKLGNKYAC SEQ ID NO:3480 | QDRKRPS SEQ ID NO:11492 | QAWDSSTA SEQ ID NO:19504 |
| iPS:436876 | 21-225_61F5 | NA | TCTGGAGATAAATTGGGGGA AAAATATGCTTGC SEQ ID NO:3481 | CAAGATAGCAAGCGGCC CTCA SEQ ID NO:11493 | CAGGCGTGGGACAGCAGCAC TGTGGTT SEQ ID NO:19505 |
| | | AA | SGDKLGEKYAC SEQ ID NO:3482 | QDSKRPS SEQ ID NO:11494 | QAWDSSTVV SEQ ID NO:19506 |
| iPS:436878 | 21-225_62E3 | NA | TCTGGAGATAAATTGGGGAA TAAATATGCTTGC SEQ ID NO:3483 | CAAGATAGGAAGCGGCC CTCA SEQ ID NO:11495 | CAGGCGTGGGACAGCAGCAC TGCGGTA SEQ ID NO:19507 |
| | | AA | SGDKLGNKYAC SEQ ID NO:3484 | QDRKRPS SEQ ID NO:11496 | QAWDSSTAV SEQ ID NO:19508 |
| iPS:436880 | 21-225_62E8 | NA | TCTGGAGATAGATTGGGGAA TAAATATGCTTCC SEQ ID NO:3485 | CAAGATAGGAAGCGGCC CTCA SEQ ID NO:11497 | CAGGCGTGGGACAGCAGCAC TGCGGTA SEQ ID NO:19509 |
| | | AA | SGDRLGNKYAS SEQ ID NO:3486 | QDRKRPS SEQ ID NO:11498 | QAWDSSTAV SEQ ID NO:19510 |
| iPS:436882 | 21-225_62D10 | NA | TCTGGAGATAAATTGGGGAA TAAATATGCTTGC SEQ ID NO:3487 | CAAGATAGGAAGCGGCC CTCA SEQ ID NO:11499 | CAGGCGTGGGACAGCAGCAC TGCGGTA SEQ ID NO:19511 |
| | | AA | SGDKLGNKYAC SEQ ID NO:3488 | QDRKRPS SEQ ID NO:11500 | QAWDSSTAV SEQ ID NO:19512 |
| iPS:436884 | 21-225_62A12 | NA | TCTGGAGATAAATTGGGGAA TAAATATGCTTGC SEQ ID NO:3489 | CAAGATAGGAAGCGGCC CTCA SEQ ID NO:11501 | CAGGCGTGGGACAGCAGCAC TGCGGTA SEQ ID NO:19513 |
| | | AA | SGDKLGNKYAC SEQ ID NO:3490 | QDRKRPS SEQ ID NO:11502 | QAWDSSTAV SEQ ID NO:19514 |

FIGURE 49
(Continued)

| | | | | |
|---|---|---|---|---|
| iPS:436886 | 21-225_62B12 | NA | TCTGGAGATAAATTGGGGAATAAATATACTTGC SEQ ID NO:3491 | CAAGATAGGAAGCGGCCCTCA SEQ ID NO:11503 | CAGGCGTGGGACAGCAGCACTGCGGTA SEQ ID NO:19515 |
| | | AA | SGDKLGNKYTC SEQ ID NO:3492 | QDRKRPS SEQ ID NO:11504 | QAWDSSTAV SEQ ID NO:19516 |
| iPS:436888 | 21-225_63G7 | NA | ACCCGCAGCAATGGCAGCATTGTCAGCAACTATGTGCAG SEQ ID NO:3493 | GAGGATAGCCGAAGACCCTCT SEQ ID NO:11505 | CAGTCTTATGATGGCATCAATGTGGTA SEQ ID NO:19517 |
| | | AA | TRSNGSIVSNYVQ SEQ ID NO:3494 | EDSRRPS SEQ ID NO:11506 | QSYDGINVV SEQ ID NO:19518 |
| iPS:436890 | 21-225_63A10 | NA | ACCCGCAGCAATGGCAGCATTGTCAGCAACTATGTGCAG SEQ ID NO:3495 | GAGGATAAAAGAAGACCCTCA SEQ ID NO:11507 | CAGTCTTATGATAGCATCAATGTGGTA SEQ ID NO:19519 |
| | | AA | TRSNGSIVSNYVQ SEQ ID NO:3496 | EDKRRPS SEQ ID NO:11508 | QSYDSINVV SEQ ID NO:19520 |
| iPS:436892 | 21-225_65E9 | NA | TCTGGAGATAAATTGGGGAATAAATATGATTAC SEQ ID NO:3497 | CAAGATAGAAAGCGGCCCTCA SEQ ID NO:11509 | CAGGCGTGGGACAACAGCACTGTGGTA SEQ ID NO:19521 |
| | | AA | SGDKLGNKYDY SEQ ID NO:3498 | QDRKRPS SEQ ID NO:11510 | QAWDNSTVV SEQ ID NO:19522 |
| iPS:436894 | 21-225_66G9 | NA | TCTGGAGATAAATTGGGGAATAAATATGCTTGC SEQ ID NO:3499 | CAAGATAGGAAGCGGCCCTCA SEQ ID NO:11511 | CAGGCGTGGGACATCAACACTGCGGTA SEQ ID NO:19523 |
| | | AA | SGDKLGNKYAC SEQ ID NO:3500 | QDRKRPS SEQ ID NO:11512 | QAWDINTAV SEQ ID NO:19524 |
| iPS:436896 | 21-225_67F10 | NA | TCTGGAGATAAATTGGGGTATAAATATGCTTGG SEQ ID NO:3501 | GAAGATAGGAAGCGGCCCTCA SEQ ID NO:11513 | CAGGCGTGGGACAACAGCACTGTGGTA SEQ ID NO:19525 |

FIGURE 49
(Continued)

| | | AA | SGDKLGYKYAW<br>SEQ ID NO:3502 | EDRKRPS<br>SEQ ID NO:11514 | QAWDNSTVV<br>SEQ ID NO:19526 |
|---|---|---|---|---|---|
| iPS:436898 | 21-225_68D8 | NA | TCTGGAGATAAATTGGGGGA<br>TAAATATGCTTGC<br>SEQ ID NO:3503 | CAAGATAGCAAGCGGCC<br>CTCA<br>SEQ ID NO:11515 | CAGGCGTGGGACAACAGCAC<br>TGTGGTA<br>SEQ ID NO:19527 |
| | | AA | SGDKLGDKYAC<br>SEQ ID NO:3504 | QDSKRPS<br>SEQ ID NO:11516 | QAWDNSTVV<br>SEQ ID NO:19528 |
| iPS:436900 | 21-225_69B9 | NA | TCTGGAGATAAATTGGGGGA<br>TAAATATGATTAC<br>SEQ ID NO:3505 | CAAGATAGAAAGCGGCC<br>CTCA<br>SEQ ID NO:11517 | CAGGCGTGGGACAACAGCAC<br>TGTGGTA<br>SEQ ID NO:19529 |
| | | AA | SGDKLGNKYDY<br>SEQ ID NO:3506 | QDRKRPS<br>SEQ ID NO:11518 | QAWDNSTVV<br>SEQ ID NO:19530 |
| iPS:436902 | 21-225_69B11 | NA | TCTGGAGATAAATTGGGGGA<br>TAAATATGCTTGG<br>SEQ ID NO:3507 | GAAGATAGGAAGCGGCC<br>CTCA<br>SEQ ID NO:11519 | CAGGCGTGGGACAACAGCAC<br>TGTGGTA<br>SEQ ID NO:19531 |
| | | AA | SGDKLGDKYAW<br>SEQ ID NO:3508 | EDRKRPS<br>SEQ ID NO:11520 | QAWDNSTVV<br>SEQ ID NO:19532 |
| iPS:436904 | 21-225_71D4 | NA | TCTGGAGATAAATTGGGGGA<br>TAAATATGCTTAC<br>SEQ ID NO:3509 | CAAGATAGGAAGCGGCC<br>CTCA<br>SEQ ID NO:11521 | CAGGCGTGGGTCAACAGCAC<br>TGTGGTA<br>SEQ ID NO:19533 |
| | | AA | SGDKLGKYAY<br>SEQ ID NO:3510 | QDRKRPS<br>SEQ ID NO:11522 | QAWVNSTVV<br>SEQ ID NO:19534 |
| iPS:436906 | 21-225_72B4 | NA | TCTGGAGATAAATTGGGGGA<br>TAAATATGCTTGG<br>SEQ ID NO:3511 | GAAGATAGGAAGCGGCC<br>CTCA<br>SEQ ID NO:11523 | CAGGCGTGGGACAACAGCAC<br>TGTGGTA<br>SEQ ID NO:19535 |
| | | AA | SGDKLGDKYAW<br>SEQ ID NO:3512 | EDRKRPS<br>SEQ ID NO:11524 | QAWDNSTVV<br>SEQ ID NO:19536 |
| iPS:436908 | 21-225_72D5 | NA | TCTGGAGATAAATTGGGGGA<br>TAAATATGCTTGC<br>SEQ ID NO:3513 | CAAGATAGGAAGCGGCC<br>CTCA<br>SEQ ID NO:11525 | CAGGCGTGGGACAGCAGCAC<br>TGCGGTA<br>SEQ ID NO:19537 |

FIGURE 49
(Continued)

| | | | | | |
|---|---|---|---|---|---|
| iPS:436910 | | AA | SGDKLGNKYAC | QDRKRPS | QAWDSSTAV |
| | | | SEQ ID NO:3514 | SEQ ID NO:11526 | SEQ ID NO:19538 |
| | 21-225_73G1 | NA | GGCTTGAGCTCTGGCTCAGT CTCTACTAGTTACTACCCCA GC | AACACAAACACTCGCTC TTCT | GTTCTATATATGGGTAGTGC CATTTGGGTG |
| | | | SEQ ID NO:3515 | SEQ ID NO:11527 | SEQ ID NO:19539 |
| iPS:436912 | | AA | GLSSGSVSTSYYPS | NTNTRSS | VLYMGSAIWV |
| | | | SEQ ID NO:3516 | SEQ ID NO:11528 | SEQ ID NO:19540 |
| | 21-225_73C4 | NA | TCTGGAGATAAATTGGGGAA TAAATATGCTTGC | CAAGATATGAAGCGGCC CTCA | CAGGCGTGGGACAGCAGCAC TGCGGTA |
| | | | SEQ ID NO:3517 | SEQ ID NO:11529 | SEQ ID NO:19541 |
| iPS:436914 | | AA | SGDKLGNKYAC | QDMKRPS | QAWDSSTAV |
| | | | SEQ ID NO:3518 | SEQ ID NO:11530 | SEQ ID NO:19542 |
| | 21-225_76B4 | NA | TCTGGAGATAGATTGGGGAC TAAATTTGCTTGC | CAAGATAGCAAGCGGCC CTCA | CAGGCGTGGGACAGCAGCAC TGTA |
| | | | SEQ ID NO:3519 | SEQ ID NO:11531 | SEQ ID NO:19543 |
| | | AA | SGDRLGTKFAC | QDSKRPS | QAWDSSTV |
| | | | SEQ ID NO:3520 | SEQ ID NO:11532 | SEQ ID NO:19544 |
| iPS:436916 | 21-225_74A9 | NA | TCTGGAGATAAATTGGGGTAA TAAATATGTTTGT | CAAGATAACAGGCGGCC CTCA | CAGGCGTGGGACAGCAGTCC TGTGATA |
| | | | SEQ ID NO:3521 | SEQ ID NO:11533 | SEQ ID NO:19545 |
| | | AA | SGDKLGNKYVC | QDNRRPS | QAWDSSPVI |
| | | | SEQ ID NO:3522 | SEQ ID NO:11534 | SEQ ID NO:19546 |
| iPS:436918 | 21-225_77A2 | NA | TCTGGAGATAGATTGGGGGA TAAATATGCTTGC | CAAGATAGGAAGCGGCC CTCA | CAGGCGTGGGACAGCAGTAC TGCGGTA |
| | | | SEQ ID NO:3523 | SEQ ID NO:11535 | SEQ ID NO:19547 |
| | | AA | SGDRLGDKYAC | QDRKRPS | QAWDSSTAV |
| | | | SEQ ID NO:3524 | SEQ ID NO:11536 | SEQ ID NO:19548 |

FIGURE 49
(Continued)

| | | | | | |
|---|---|---|---|---|---|
| iPS:436920 | 21-225_74E5 | NA | GCTTCCAGCACTGAAACAGTCACCAGTGGTTCTTATCCGAAC | AGTACAAGCAACAAACACTCC | CTGCTCTACTATGGTGGTGCTCAACTGGTA |
| | | | SEQ ID NO:3525 | SEQ ID NO:11537 | SEQ ID NO:19549 |
| | | AA | ASSTETVTSGSYPN | STSNKHS | LLYYGGAQLV |
| | | | SEQ ID NO:3526 | SEQ ID NO:11538 | SEQ ID NO:19550 |
| iPS:436922 | 21-225_78E9 | NA | TCAGGAGATAAATTGGGGAATAAATATGTTTCC | CAAGATAACAGGCGGCCGTCA | CAGGCGTGGGACAGCAGCCCTGTGATA |
| | | | SEQ ID NO:3527 | SEQ ID NO:11539 | SEQ ID NO:19551 |
| | | AA | SGDKLGNKYVS | QDNRRPS | QAWDSSPVI |
| | | | SEQ ID NO:3528 | SEQ ID NO:11540 | SEQ ID NO:19552 |
| iPS:436924 | 21-225_74B3 | NA | TCTGGAGATAAATTGGGGGATAAATATGCTTGC | CAAGATAGCAAGCAAGCGGGCCTCA | CAGGCGTGGGACAGCACCACTGTGGTA |
| | | | SEQ ID NO:3529 | SEQ ID NO:11541 | SEQ ID NO:19553 |
| | | AA | SGDKLGDKYAC | QDSKRPS | QAWDSTTVV |
| | | | SEQ ID NO:3530 | SEQ ID NO:11542 | SEQ ID NO:19554 |
| iPS:436926 | 21-225_78D10 | NA | GCTTCCAGCACTGGAGCAGTCACCAGTGGTTACTTTCCAAC | AGTACAAGACAACAAACACTCC | CTCCTCTACTATGGTGGTGCTCAGCTGATG |
| | | | SEQ ID NO:3531 | SEQ ID NO:11543 | SEQ ID NO:19555 |
| | | AA | ASSTGAVTSGYFPN | STDNKHS | LLYYGGAQLM |
| | | | SEQ ID NO:3532 | SEQ ID NO:11544 | SEQ ID NO:19556 |
| iPS:436928 | 21-225_79E7 | NA | TCAGGAGATAAATTGGGGAATAAATATGTTTCC | CAAGATAACAGGCGGCCCTCA | CAGGCGTGGGACAGCAGCCCTGTGATA |
| | | | SEQ ID NO:3533 | SEQ ID NO:11545 | SEQ ID NO:19557 |
| | | AA | SGDKLGNKYVS | QDNRRPS | QAWDSSPVI |
| | | | SEQ ID NO:3534 | SEQ ID NO:11546 | SEQ ID NO:19558 |
| iPS:436932 | 21-225_92A4 | NA | TCTGGAGATAAATTGGGGAATAAATATGTTTGC | CAAGATAACAGGCGGCCCTCA | CAGGCGTGGGACAGCAGCCCTGTGATA |
| | | | SEQ ID NO:3535 | SEQ ID NO:11547 | SEQ ID NO:19559 |

FIGURE 49
(Continued)

| | | AA/NA | | | | | | |
|---|---|---|---|---|---|---|---|---|
| iPS:436934 | 21-225_96B5 | AA | SGDKLGNKYVC | SEQ ID NO:3536 | QDNRRPS | SEQ ID NO:11548 | QAWDSSPVI | SEQ ID NO:19560 |
| | | NA | TCTGGAGATAAATTGGGGAC TAAATTGCTTGC | SEQ ID NO:3537 | CAAGATAGCAAGCGGCC CTCA | SEQ ID NO:11549 | CAGGCGTGGGACAGCAGCAC TGTA | SEQ ID NO:19561 |
| iPS:436936 | 21-225_97E6 | AA | SGDRLGTKFAC | SEQ ID NO:3538 | QDSKRPS | SEQ ID NO:11550 | QAWDSSTV | SEQ ID NO:19562 |
| | | NA | TCTGGAGATAAATTGGGGAA TAAATATGTTTCC | SEQ ID NO:3539 | CAAGATAACAGGCGGCC GTCA | SEQ ID NO:11551 | CAGGCGTGGGACAGCACCCC TGTGATA | SEQ ID NO:19563 |
| iPS:436938 | 21-225_146A3 | AA | SGDKLGNKYVS | SEQ ID NO:3540 | QDNRRPS | SEQ ID NO:11552 | QAWDSTPVI | SEQ ID NO:19564 |
| | | NA | TCTGGAAATAAATTGGGGAA TAGATATGCTTGC | SEQ ID NO:3541 | CAAGATAGCAAGCGGCC CTCA | SEQ ID NO:11553 | CAGGCGTGGGACAGCAGCAC TGTGGTA | SEQ ID NO:19565 |
| iPS:436940 | 21-225_146B8 | AA | SGNKLGNRYAC | SEQ ID NO:3542 | QDSKRPS | SEQ ID NO:11554 | QAWDSSTVV | SEQ ID NO:19566 |
| | | NA | TCTGGAGATAAATTGGGGGA TAAATATGTTTGC | SEQ ID NO:3543 | CAAGATAGGAAGCGGCC CTCA | SEQ ID NO:11555 | CAGGCGTGCACAGCAGCAC TGTGGTA | SEQ ID NO:19567 |
| iPS:436942 | 21-225_146H8 | AA | SGDKLGDKYVC | SEQ ID NO:3544 | QDRKRPS | SEQ ID NO:11556 | QAWHSSTVV | SEQ ID NO:19568 |
| | | NA | TCTGGAGATAAATTGGGGGA TAAATTGCTTGC | SEQ ID NO:3545 | CAAGATAAGAAGCGGCC CTCA | SEQ ID NO:11557 | CAGGCGTGGGACATCAGAAC TGTGGTA | SEQ ID NO:19569 |
| iPS:436944 | 21-225_182D12 | AA | SGDKLGDKYAC | SEQ ID NO:3546 | QDKKRPS | SEQ ID NO:11558 | QAWDIRTVV | SEQ ID NO:19570 |
| | | NA | TCTGGAGATAAATTGGGGGA GAAATATGCTTGC | SEQ ID NO:3547 | CAAGATAGAAAGCGGCC CTCA | SEQ ID NO:11559 | CAGGCGTGGGACAGTAGAAC TGCGGTA | SEQ ID NO:19571 |

FIGURE 49
(Continued)

| | | | | | | |
|---|---|---|---|---|---|---|
| iPS:436946 | | AA | SGDKLGEKYAC | QDRKRPS | QAWDSRTAV | |
| | | | SEQ ID NO:3548 | SEQ ID NO:11560 | SEQ ID NO:19572 | |
| | 21-225_183F4 | NA | TCTGGAGATAAATTGGGGGA TAAATATGCTTGT | CAAGATAAGAAACGGCC CTCA | CAGGCGTGGGACAACAGCAC TGCTGTGGTA | |
| | | | SEQ ID NO:3549 | SEQ ID NO:11561 | SEQ ID NO:19573 | |
| iPS:436948 | | AA | SGDKLGDKYAC | QDKKRPS | QAWDNSTAVV | |
| | | | SEQ ID NO:3550 | SEQ ID NO:11562 | SEQ ID NO:19574 | |
| | 21-225_183F5 | NA | GGCTTGAGCTCTGGCTCAGT CTCTACTACTTTCTACCCCA GC | AACACAAACACTCGCTC TTCT | GTGCTTTATATGGGTAGTGG CATTTGGGTG | |
| | | | SEQ ID NO:3551 | SEQ ID NO:11563 | SEQ ID NO:19575 | |
| | | AA | GLSSGSVSTTFYPS | NTNTRSS | VLYMGSGHWV | |
| | | | SEQ ID NO:3552 | SEQ ID NO:11564 | SEQ ID NO:19576 | |
| iPS:436950 | 21-225_184G4 | NA | TCTGGAGATAAATTGGGGGA TAAATTTGCTTGC | GAAGATAGGAAGCGGCC CTCA | CAGGCGTGGGACAGCAGCCAC TGTGGTA | |
| | | | SEQ ID NO:3553 | SEQ ID NO:11565 | SEQ ID NO:19577 | |
| | | AA | SGDKLGDKFAC | EDRKRPS | QAWDSRTVV | |
| | | | SEQ ID NO:3554 | SEQ ID NO:11566 | SEQ ID NO:19578 | |
| iPS:436952 | 21-225_185D2 | NA | TCTGGAGATAAATTGGGGGA TAAATATGCTTGC | GAAGATAGGAAGCGGCC CTCA | CAGGCGTGGGACAGCAGGA AAGTGGTA | |
| | | | SEQ ID NO:3555 | SEQ ID NO:11567 | SEQ ID NO:19579 | |
| | | AA | SGDKLGDKYAC | EDRKRPS | QAWDSRKVV | |
| | | | SEQ ID NO:3556 | SEQ ID NO:11568 | SEQ ID NO:19580 | |
| iPS:436954 | 21-225_185G7 | NA | TCTGGAGATAAATTGGGGCA TAAATTTGTTTGC | CAAGATCGCAAGCGGCC CTCA | CAGGCGTGGGACAGCAGCAC GGTA | |
| | | | SEQ ID NO:3557 | SEQ ID NO:11569 | SEQ ID NO:19581 | |
| | | AA | SGDKLGHKFVC | QDRKRPS | QAWDSSTV | |
| | | | SEQ ID NO:3558 | SEQ ID NO:11570 | SEQ ID NO:19582 | |
| iPS:436956 | | NA | TCTGGAGATAAATGGGGG AAAAATATGCTTGC | CAAGATAGAAAGCGGCC CTCA | CAGGCGTGGGACAGCAGCAC TGCGGTA | |

FIGURE 49
(Continued)

| | | | | | | |
|---|---|---|---|---|---|---|
| iPS:436958 | 21-225_186H6 | AA | SEQ ID NO:3559 SGDKMGEKYAC | SEQ ID NO:11571 QDRKRPS | SEQ ID NO:19583 QAWDSSTAV | |
| iPS:436960 | 21-225_190D1 | NA | SEQ ID NO:3560 GCTTCCAGCACTGGAGCAGT CACCAGTGGTTCCTATCCAA AC | SEQ ID NO:11572 AGTACAAGTAACAAACA CTCC | SEQ ID NO:19584 CTGCTCTACTATGGTGGTGC TCAGGTGGCA | |
| | | AA | SEQ ID NO:3561 ASSTGAVTSGSYPN | SEQ ID NO:11573 STSNKHS | SEQ ID NO:19585 LLYYGGAQVA | |
| iPS:436962 | 21-225_198D2 | NA | SEQ ID NO:3562 TCTGGAAGCAGCTCCAACAT TGGGAGTAATTATGTTTCC | SEQ ID NO:11574 GACAATAATAAGCGACC CTCA | SEQ ID NO:19586 GGAACATGGGATAGCAGACT GAATGTTGGGGTA | |
| | | AA | SEQ ID NO:3563 SGSSSNIGSNYVS | SEQ ID NO:11575 DNNKRPS | SEQ ID NO:19587 GTWDSRLNVGV | |
| iPS:436964 | 21-225_190H1 | NA | SEQ ID NO:3564 TCTGGAGATAAATTGGGGA TAGATTTGCTTAC | SEQ ID NO:11576 CAAGATAGCAAGCGGCC CTCA | SEQ ID NO:19588 AAGGCGTGGGACAGCAGCAC TGTGGTA | |
| | | AA | SEQ ID NO:3565 SGDKLGDRFAY | SEQ ID NO:11577 QDSKRPS | SEQ ID NO:19589 KAWDSSTVV | |
| iPS:436964 | 21-225_190B3 | NA | SEQ ID NO:3566 CAAGGAGACAAACTCAGAA CCTATTATGCAAGC | SEQ ID NO:11578 GGAAAAAACAACCGGCC CTCA | SEQ ID NO:19590 AACTCCCGGGACAGCAGTGG TAACCATCTTGTACTA | |
| | | AA | SEQ ID NO:3567 QGDKLRTYYAS | SEQ ID NO:11579 GKNNRPS | SEQ ID NO:19591 NSRDSSGNHLVL | |
| iPS:436966 | 21-225_190C3 | NA | SEQ ID NO:3568 TCTGGAAGCAGCTCCAACAT TGGAAATAATTATGTATCC | SEQ ID NO:11580 GACAGTAATAAGCGACC CTCA | SEQ ID NO:19592 GGAACATGGGATAGCAGCCT GAGTACTGTGGTA | |
| | | AA | SEQ ID NO:3569 SGSSSNIGNNYVS | SEQ ID NO:11581 DSNKRPS | SEQ ID NO:19593 GTWDSSLSTVV | |
| | | | SEQ ID NO:3570 | SEQ ID NO:11582 | SEQ ID NO:19594 | |

FIGURE 49
(Continued)

| | | | | | |
|---|---|---|---|---|---|
| iPS:436968 | 21-225_190B10 | NA | TCTGGAAGCAGCTCCAACAT TGGGAATAATTATGTATCC SEQ ID NO:3571 | GACAATAATAAGCGACC CTCA SEQ ID NO:11583 | GGAACATGGGATAGCAGCCT GAGTGCTGGGGTT SEQ ID NO:19595 |
| | | AA | SGSSSNIGNNYVS SEQ ID NO:3572 | DNNKRPS SEQ ID NO:11584 | GTWDSSLSAGV SEQ ID NO:19596 |
| iPS:436970 | 21-225_190B8 | NA | CAAGGAGACACCCTCAGACC CTATTATGTAAGC SEQ ID NO:3573 | GGTAAAAACAACCGGCC CTCA SEQ ID NO:11585 | AACTCCCGGGACAGCAGTGG TAACCATCTGTGGTA SEQ ID NO:19597 |
| | | AA | QGDTLRPYYVS SEQ ID NO:3574 | GKNNRPS SEQ ID NO:11586 | NSRDSSGNHLVV SEQ ID NO:19598 |
| iPS:436972 | 21-225_190C7 | NA | TCTGGAGGCAGCTCCAACAT TGGGAATAATTATGTATCC SEQ ID NO:3575 | GACAATAATAAGCGACC CTCA SEQ ID NO:11587 | GGAACATGGATCGCACCCT GAGTGATTGGGTA SEQ ID NO:19599 |
| | | AA | SGGSSNIGNNYVS SEQ ID NO:3576 | DNNKRPS SEQ ID NO:11588 | GTWDRTLSDWV SEQ ID NO:19600 |
| iPS:436974 | 21-225_190H7 | NA | TCTGGAAGCAGCTCCAACAT TGGGAGTAATTATGTTTCC SEQ ID NO:3577 | GACAATAATAAGCGACC CTCA SEQ ID NO:11589 | GGAACATGGGATGGCAGACT GAATGTTGGGGTA SEQ ID NO:19601 |
| | | AA | SGSSSNIGSNYVS SEQ ID NO:3578 | DNNKRPS SEQ ID NO:11590 | GTWDGRLNVGV SEQ ID NO:19602 |
| iPS:436976 | 21-225_190D8 | NA | TCTGGAAGCAGCTCCAACAT TGGGAATCATTATGTCTCC SEQ ID NO:3579 | GACAGTAGTAAGCGACC CTCA SEQ ID NO:11591 | GGAACATGGGATAGTAGTCT GAGTACTGTGGTA SEQ ID NO:19603 |
| | | AA | SGSSSNIGNHYVS SEQ ID NO:3580 | DSSKRPS SEQ ID NO:11592 | GTWDSSLSTVV SEQ ID NO:19604 |
| iPS:436978 | 21-225_190G9 | NA | TCTGGAGATAAATTGGGGA TAGATTTGCTTAC SEQ ID NO:3581 | CAAGATAACAAGCGGCC CTCA SEQ ID NO:11593 | CAGGCGTGGGACAGCAGCAC TGTGGTA SEQ ID NO:19605 |

FIGURE 49
(Continued)

| | | | | | |
|---|---|---|---|---|---|
| iPS:436980 | 21-225_190C10 | AA | SGDKLGDRFAY<br>SEQ ID NO:3582 | QDNKRPS<br>SEQ ID NO:11594 | QAWDSSTVV<br>SEQ ID NO:19606 |
| | | NA | CAAGGAGACAGCCTCAGAC<br>CCTATTATGCAAGC<br>SEQ ID NO:3583 | GGTAAAACAACCGGCC<br>CTCA<br>SEQ ID NO:11595 | AACTCCGGGACAGCAGTGG<br>TAACCATCTTGTGGTA<br>SEQ ID NO:19607 |
| iPS:436982 | 21-225_190D10 | AA | QGDSLRPYYAS<br>SEQ ID NO:3584 | GKNNRPS<br>SEQ ID NO:11596 | NSRDSSGNHLVV<br>SEQ ID NO:19608 |
| | | NA | TCTGGAAGCAGCTCCAACAT<br>TGGGAGTAATTATGTTTCC<br>SEQ ID NO:3585 | GACAATAATAAGCGACC<br>CTCA<br>SEQ ID NO:11597 | GGAACATGGGATAGCAGACT<br>GAATGTTGGGGTA<br>SEQ ID NO:19609 |
| iPS:436984 | 21-225_190F10 | AA | SGSSSNIGSNYVS<br>SEQ ID NO:3586 | DNNKRPS<br>SEQ ID NO:11598 | GTWDSRLNVGV<br>SEQ ID NO:19610 |
| | | NA | GTTTTTAGCACTGGAGCAGT<br>CACCAGTGGTTCCTTTCCAA<br>AC<br>SEQ ID NO:3587 | AGTACAAGCAACAAACA<br>CTCC<br>SEQ ID NO:11599 | CTGCTCTACTGTGGTGGTGC<br>TCAGCTGGTG<br>SEQ ID NO:19611 |
| iPS:436986 | 21-225_191A1 | AA | VFSTGAVTSGSFPN<br>SEQ ID NO:3588 | STSNKHS<br>SEQ ID NO:11600 | LLYCGGAQLV<br>SEQ ID NO:19612 |
| | | NA | TCTGGAAGCAGCTCCAACCT<br>TGGAAATAATTTTGTATCC<br>SEQ ID NO:3589 | GACAATTATAAGGGACC<br>CTCA<br>SEQ ID NO:11601 | GGAACATGGGATAGCAGCCT<br>GAATACTGGGGTA<br>SEQ ID NO:19613 |
| | | AA | SGSSSNLGNNFVS<br>SEQ ID NO:3590 | DNYKRPS<br>SEQ ID NO:11602 | GTWDSSLNTGV<br>SEQ ID NO:19614 |
| iPS:436988 | 21-225_191A2 | NA | GTTCTTAGCACTGGAGCAGT<br>CACCAGTGGTTCCTTTCCAA<br>AC<br>SEQ ID NO:3591 | AGTACAAGCAACAAACA<br>CTCC<br>SEQ ID NO:11603 | ATGCTCTACTGTGGTGGTGC<br>TCAGCTGGTG<br>SEQ ID NO:19615 |
| | | AA | VLSTGAVTSGSFPN<br>SEQ ID NO:3592 | STSNKHS<br>SEQ ID NO:11604 | MLYCGGAQLV<br>SEQ ID NO:19616 |

FIGURE 49
(Continued)

| | | | | | |
|---|---|---|---|---|---|
| iPS:436992 | | NA | CAAGGAGACACCCTCAGACCCTATTATGCAAGT<br>SEQ ID NO:3593 | GGTAAAAACAACCGGCCTCA<br>SEQ ID NO:11605 | AACTCCCGGGACAGCAGTGGTAACCATCTTGTGGTA<br>SEQ ID NO:19617 |
| | 21-225_191B8 | AA | QGDTLRPYYAS<br>SEQ ID NO:3594 | GKNNRPS<br>SEQ ID NO:11606 | NSRDSSGNHLVV<br>SEQ ID NO:19618 |
| iPS:436994 | | NA | CAAGGAGACAGCCTCAGACCCTATTATGCAAGC<br>SEQ ID NO:3595 | GGTAAAAACAACCGGCCTCA<br>SEQ ID NO:11607 | AACTCCCGGGACAGCAGTGTGGTAACCATCTTGTGGTA<br>SEQ ID NO:19619 |
| | 21-225_191A9 | AA | QGDSLRPYYAS<br>SEQ ID NO:3596 | GKNNRPS<br>SEQ ID NO:11608 | NSRDSCGNHLVV<br>SEQ ID NO:19620 |
| iPS:436996 | | NA | TCTGGAAGCAGCTCCAACATCGGGAATAATTATGTATCC<br>SEQ ID NO:3597 | GACAATAAAAGCGACCCTCA<br>SEQ ID NO:11609 | GGAACATGGGATAGCAGCCTGAGTGTTTGTGTC<br>SEQ ID NO:19621 |
| | 21-225_191B9 | AA | SGSSSNIGNNYVS<br>SEQ ID NO:3598 | DNKKRPS<br>SEQ ID NO:11610 | GTWDSSLSVCV<br>SEQ ID NO:19622 |
| iPS:437000 | | NA | ACCTTACGCAGTGGCATCAATGTTGGTACCTACAGGATATAC<br>SEQ ID NO:3599 | TACAAATCAGACTCAGATAAGCAGCAGGGCTCT<br>SEQ ID NO:11611 | ATGATTGGCACAGCAGCGCTGTGGTA<br>SEQ ID NO:19623 |
| | 21-225_191G9 | AA | TLRSGINVGTYRIY<br>SEQ ID NO:3600 | YKSDSDKQQGS<br>SEQ ID NO:11612 | MIWHSSAVV<br>SEQ ID NO:19624 |
| iPS:437002 | | NA | GCTTCCAGCACTGGAGCAGTCACCAGTGCTTACTATCCAAAC<br>SEQ ID NO:3601 | AGTACAAACAACAAACACTCC<br>SEQ ID NO:11613 | CTGATCTTCTATGGTGGTGTACATGTGATA<br>SEQ ID NO:19625 |
| | 21-225_191H9 | AA | ASSTGAVTSAYYPN<br>SEQ ID NO:3602 | STNNKHS<br>SEQ ID NO:11614 | LIFYGGVHVI<br>SEQ ID NO:19626 |

FIGURE 49
(Continued)

| | | NA | TCTGGAAGCAGCTCCAACAT TGGGAATAATTATGTATCC | GACAATAATAAGCGACC CTCA | GGAACATGGGATAGCAGCCT GAGTGCTGGGGTA |
|---|---|---|---|---|---|
| iPS:437006 | 21-225_192G2 | | SEQ ID NO:3603 | SEQ ID NO:11615 | SEQ ID NO:19627 |
| | | AA | SGSSSNIGNNYVS | DNNKRPS | GTWDSSLSAGV |
| | | | SEQ ID NO:3604 | SEQ ID NO:11616 | SEQ ID NO:19628 |
| iPS:437008 | 21-225_192E3 | NA | GCTTTCAGCACTGGATCAGT CACCAGTGGTTCCTATCCAA AC | AGTACAAACAACAAACA CTCC | CTGCTATACTATGGTGGTGC TCAGCTGGTG |
| | | | SEQ ID NO:3605 | SEQ ID NO:11617 | SEQ ID NO:19629 |
| | | AA | AFSTGSVTSGSYPN | STNNKHS | LLYYGGAQLV |
| | | | SEQ ID NO:3606 | SEQ ID NO:11618 | SEQ ID NO:19630 |
| iPS:437010 | 21-225_192G3 | NA | TCTGGAAGCAGCTCCAACAT CGGAAGTAATACTGTAAAC | GGTAATAAGCAGCGGCC CTCA | GCAGCGTGGGATGACAGCCT GAATGGTTGGGTG |
| | | | SEQ ID NO:3607 | SEQ ID NO:11619 | SEQ ID NO:19631 |
| | | AA | SGSSSNIGSNTVN | GNKQRPS | AAWDDSLNGWV |
| | | | SEQ ID NO:3608 | SEQ ID NO:11620 | SEQ ID NO:19632 |
| iPS:437012 | 21-225_192G7 | NA | GCTTCCAGCACTGGAGCAGT CACCAGTGGTAACTATCCAC AG | AGTACAACCAACAACAGACA TTCC | CTGTTCTACTATGGTGGTGCT CAGGTGATA |
| | | | SEQ ID NO:3609 | SEQ ID NO:11621 | SEQ ID NO:19633 |
| | | AA | ASSTGAVTSGNYPQ | STTNRHS | LFYYGGAQVI |
| | | | SEQ ID NO:3610 | SEQ ID NO:11622 | SEQ ID NO:19634 |
| iPS:437014 | 21-225_192H8 | NA | GCTTTCAGCACTGGAACAGT CACCAGTGGTTTCTATCCAA AC | AATACAAGCAACAGACA CTCC | CTGCTGTACTATGGTGGTGC TCAGCTGATG |
| | | | SEQ ID NO:3611 | SEQ ID NO:11623 | SEQ ID NO:19635 |
| | | AA | AFSTGTVTSGFYPN | NTSNRHS | LLYYGGAQLM |
| | | | SEQ ID NO:3612 | SEQ ID NO:11624 | SEQ ID NO:19636 |

FIGURE 49
(Continued)

| iPS:437016 | 21-225_193A6 | NA | CAAGGAGACAGCCTCAGAA GCTATTATGCAAAC | GCTAAGAACAACCGGCC CTCA | AATTCCCGGGACAGCAGTGG TAACCATCTGGTA |
|---|---|---|---|---|---|
| | | | SEQ ID NO:3613 | SEQ ID NO:11625 | SEQ ID NO:19637 |
| | | AA | QGDSLRSYYAN | AKNRPS | NSRDSSGNHLV |
| | | | SEQ ID NO:3614 | SEQ ID NO:11626 | SEQ ID NO:19638 |
| iPS:437018 | 21-225_193H5 | NA | TCTGGAGATAAATTGGGGGA TAGATTTGCTTGC | CAAGATAGCAAGCGGCC CTCA | CAGGCGTGGGACAGCAGCAC TGCGGTA |
| | | | SEQ ID NO:3615 | SEQ ID NO:11627 | SEQ ID NO:19639 |
| | | AA | SGDKLGDRFAC | QDSKRPS | QAWDSSTAV |
| | | | SEQ ID NO:3616 | SEQ ID NO:11628 | SEQ ID NO:19640 |
| iPS:437020 | 21-225_193F11 | NA | TTCGGAGGCAGCTCCAACAT TGGGAATAATTATGTATCC | GACAATAATAAGCGACC CTCA | GGAACATGGGATCGCACCAT GAGTGATTGGGTA |
| | | | SEQ ID NO:3617 | SEQ ID NO:11629 | SEQ ID NO:19641 |
| | | AA | FGGSSNIGNNYVS | DNNKRPS | GTWDRTMSDWV |
| | | | SEQ ID NO:3618 | SEQ ID NO:11630 | SEQ ID NO:19642 |
| iPS:437022 | 21-225_194G5 | NA | GCTTCCAGCACTGGAGCAGT CACCAGTGGTAACTATCCAA AC | AGTACAAGCAACAAACA CTCC | CTGATCTACTATGGTGGTGC TCAGCTGATG |
| | | | SEQ ID NO:3619 | SEQ ID NO:11631 | SEQ ID NO:19643 |
| | | AA | ASSTGAVTSGNYPN | STSNKHS | LIYYGGAQLM |
| | | | SEQ ID NO:3620 | SEQ ID NO:11632 | SEQ ID NO:19644 |
| iPS:437024 | 21-225_194F11 | NA | TCTGGAAGCAGCTCCAACAT TGGGAATAATTATGTATCC | GACAATAATAAGCGACC CTCA | GGAACATGGGATAGCAGCCT GAGTGCTGGGGTT |
| | | | SEQ ID NO:3621 | SEQ ID NO:11633 | SEQ ID NO:19645 |
| | | AA | SGSSSNIGNNYVS | DNNKRPS | GTWDSSLSAGV |
| | | | SEQ ID NO:3622 | SEQ ID NO:11634 | SEQ ID NO:19646 |

FIGURE 49
(Continued)

| | | | | | |
|---|---|---|---|---|---|
| iPS:437026 | 21-225_194D12 | NA | GCTTCCAGCACTGGAGCAGTCACCAGTGGTTCCTTTCCAAGC<br>SEQ ID NO:3623 | AGTACAAGCAACAGACACTCC<br>SEQ ID NO:11635 | CTGATCTACTACTATGGTGGTGCTCAGCTGGCA<br>SEQ ID NO:19647 |
| | | AA | ASSTGAVTSGSFPS<br>SEQ ID NO:3624 | STSNRHS<br>SEQ ID NO:11636 | LIYYGGAQLA<br>SEQ ID NO:19648 |
| iPS:437028 | 21-225_194G12 | NA | TCTGGAAGCAGCTCCAACATTGGGAATAATTATGTATCC<br>SEQ ID NO:3625 | GACAATAATAAGCGACCCTCA<br>SEQ ID NO:11637 | GGAACATGGGATAGCAGCCTGAGTGTTGGGGTA<br>SEQ ID NO:19649 |
| | | AA | SGSSSNIGNNYVS<br>SEQ ID NO:3626 | DNNKRPS<br>SEQ ID NO:11638 | GTWDSSLSVGV<br>SEQ ID NO:19650 |
| iPS:437030 | 21-225_195E3 | NA | TCTGGAGATAAAATTGGGGTATAGATCTGTTTGC<br>SEQ ID NO:3627 | GAAGATAGCAAGCGACCCTCA<br>SEQ ID NO:11639 | CAGGCGTGGGACAGTGTCACTGTGGTA<br>SEQ ID NO:19651 |
| | | AA | SGDKLGYRSVC<br>SEQ ID NO:3628 | EDSKRPS<br>SEQ ID NO:11640 | QAWDSVTVV<br>SEQ ID NO:19652 |
| iPS:437032 | 21-225_195H6 | NA | TCTGGAAGCAGCTCCAACATCGGAAGTCATATACTGTAAAC<br>SEQ ID NO:3629 | AATAATTATCAGCGGCCCTCA<br>SEQ ID NO:11641 | GCAACATGGGATGACAGCCTGAGTGTTTGGGTG<br>SEQ ID NO:19653 |
| | | AA | SGSSSNIGSHTVN<br>SEQ ID NO:3630 | NNYQRPS<br>SEQ ID NO:11642 | ATWDDSLSVWV<br>SEQ ID NO:19654 |
| iPS:437034 | 21-225_195E9 | NA | TCAGGAGATAAATTGGGAATAAATATGCTTAC<br>SEQ ID NO:3631 | CAAGATAGGAAGCGGCCCTCA<br>SEQ ID NO:11643 | CAGGCGTGGGACAGAGGAATTGTGGTA<br>SEQ ID NO:19655 |
| | | AA | SGDKLGNKYAY<br>SEQ ID NO:3632 | QDRKRPS<br>SEQ ID NO:11644 | QAWDRGIVV<br>SEQ ID NO:19656 |

FIGURE 49
(Continued)

| iPS:      |            |    |                                                              |                                            |                                                      |
|-----------|------------|----|--------------------------------------------------------------|--------------------------------------------|------------------------------------------------------|
| iPS:437036 | 21-225_195H9 | NA | TCTGGAGGCAGCTCCAACAT TGGGAATAATTATGTATCC                   | GACAATAATAAGGCGACC CTCA                    | GGAACATGGGATCGCACCAT GAGTGATTGGGTA                   |
|           |            |    | SEQ ID NO:3633                                                | SEQ ID NO:11645                            | SEQ ID NO:19657                                      |
|           |            | AA | SGGSSNIGNNYVS                                                 | DNNKRPS                                    | GTWDRTMSDWV                                          |
|           |            |    | SEQ ID NO:3634                                                | SEQ ID NO:11646                            | SEQ ID NO:19658                                      |
| iPS:437040 | 21-225_196E7 | NA | GCTTCCAGCACTGGAGCAGT CACCAGTGCTTACTATCCAA AC                | AGTACAAACAACAAACA CTCC                    | CTGATTTCTATGGTGGTGTA CATGTGATA                       |
|           |            |    | SEQ ID NO:3635                                                | SEQ ID NO:11647                            | SEQ ID NO:19659                                      |
|           |            | AA | ASSTGAVTSAYYPN                                                | STNNKHS                                    | LIFYGGVHVI                                           |
|           |            |    | SEQ ID NO:3636                                                | SEQ ID NO:11648                            | SEQ ID NO:19660                                      |
| iPS:437042 | 21-225_197E8 | NA | TCTGGAAGCAGCTCCAACAT TGGGAATAAATATGTATCC                    | GACAATAATAAGGCGACC CTCA                    | GGAATATGGGATCGCAGTCT GAGTGTTATGGTG                   |
|           |            |    | SEQ ID NO:3637                                                | SEQ ID NO:11649                            | SEQ ID NO:19661                                      |
|           |            | AA | SGSSSNIGNKYVS                                                 | DNNKRPS                                    | GIWDRSLSVMV                                          |
|           |            |    | SEQ ID NO:3638                                                | SEQ ID NO:11650                            | SEQ ID NO:19662                                      |
| iPS:437044 | 21-225_197F9 | NA | TCTGGAAGCAGCTCCAACAT CGGAAGTAATACTGTAAAC                    | AGTAATAATCAGCGGCC CTCA                     | GCAGCATGGGATGACAGTAT GAATGGTCCGGTG                   |
|           |            |    | SEQ ID NO:3639                                                | SEQ ID NO:11651                            | SEQ ID NO:19663                                      |
|           |            | AA | SGSSSNIGSNTVN                                                 | SNNQRPS                                    | AAWDDSMNGPV                                          |
|           |            |    | SEQ ID NO:3640                                                | SEQ ID NO:11652                            | SEQ ID NO:19664                                      |
| iPS:437048 | 21-225_197B11 | NA | GCTTTCAGCACTGGATCAGT CACCAGTGTTCCTATCCAA AC                | AGTACAAACAACAAACA CTCC                    | CTGCTCTACTATGGTGGTGC TCAGCTGGTG                      |
|           |            |    | SEQ ID NO:3641                                                | SEQ ID NO:11653                            | SEQ ID NO:19665                                      |
|           |            | AA | AFSTGSVTSGSYPN                                                | STNNKHS                                    | LLYYGGAQLV                                           |
|           |            |    | SEQ ID NO:3642                                                | SEQ ID NO:11654                            | SEQ ID NO:19666                                      |

FIGURE 49
(Continued)

| | | | | | |
|---|---|---|---|---|---|
| iPS:437050 | 21-225_197C11 | NA | GCTTCCAGCACTGGAGCAGTCACCAGTGCTTACTACTCCAAAC | AGTACAAGCAACAAACACTCC | CTGATCTCTCTATGGTGGTGTACATGTGATA |
| | | | SEQ ID NO:3643 | SEQ ID NO:11655 | SEQ ID NO:19667 |
| | | AA | ASSTGAVTSAYYPN | STSNKHS | LIFYGGVHVI |
| | | | SEQ ID NO:3644 | SEQ ID NO:11656 | SEQ ID NO:19668 |
| iPS:437054 | 21-225_194G3 | NA | TCTGAAGCAGCTCCAACATCGGGAATAATTATATATCC | GACAATAAAAAGCGACCCTCA | GGAACATGGATAGCAGCCTGAGTGTTTGTGTC |
| | | | SEQ ID NO:3645 | SEQ ID NO:11657 | SEQ ID NO:19669 |
| | | AA | SGSSSNIGNNYIS | DNKKRPS | GTWDSSLSVCV |
| | | | SEQ ID NO:3646 | SEQ ID NO:11658 | SEQ ID NO:19670 |
| iPS:437056 | 21-225_198B8 | NA | GTTCTTAGCACTGGAGCAGTCACCAGTGGTTCCTTCCAAAC | AGTACAAGCAACAAACATTCC | ATGCTTTACAGTGGTGGAGCTCAGATGGTG |
| | | | SEQ ID NO:3647 | SEQ ID NO:11659 | SEQ ID NO:19671 |
| | | AA | VLSTGAVTSGSFPN | STSNKHS | MLYSGGAQMV |
| | | | SEQ ID NO:3648 | SEQ ID NO:11660 | SEQ ID NO:19672 |
| iPS:437058 | 21-225_199F3 | NA | TCTGAAGCAGCTCCAACATTGGGAATAATTATGTATCC | GACAATAATAAGCGCCCTCA | GGAACATGGATAGCAGCCTGAGTGCTTGTGTC |
| | | | SEQ ID NO:3649 | SEQ ID NO:11661 | SEQ ID NO:19673 |
| | | AA | SGSSSNIGNNYVS | DNNKRPS | GTWDSSLSACV |
| | | | SEQ ID NO:3650 | SEQ ID NO:11662 | SEQ ID NO:19674 |
| iPS:437060 | 21-225_199C3 | NA | TCTGAAGCAGCTCCAACATCGGAAGTAATACTGTAAAC | AGTAATAATCAGCGGCCCTCA | GCAGCATGGGATGACAGCCTGAATGGTCCGGTG |
| | | | SEQ ID NO:3651 | SEQ ID NO:11663 | SEQ ID NO:19675 |
| | | AA | SGSSSNIGSNTVN | SNNQRPS | AAWDDSLNGPV |
| | | | SEQ ID NO:3652 | SEQ ID NO:11664 | SEQ ID NO:19676 |

FIGURE 49
(Continued)

| | | | | | |
|---|---|---|---|---|---|
| iPS:437062 | 21-225_200H1 | NA | GCTTCCAACACTGGAGCAGT CACCAGTGGTTCCTATCCAA AC | CATACAAACAACAAACA CTCC | CTGATCTACTATGGTGGTGC TCAGCTGGTG |
| | | | SEQ ID NO:3653 | SEQ ID NO:11665 | SEQ ID NO:19677 |
| | | AA | ASNTGAVTSGSYPN | HTNNKHS | LIYYGGAQLV |
| | | | SEQ ID NO:3654 | SEQ ID NO:11666 | SEQ ID NO:19678 |
| iPS:437064 | 21-225_200G8 | NA | TCTGGAAGCAGCTCCAACCT TGGAAATAATTTTGTATCC | GACAATTATAAGCGACC CTCA | GGAACTTGGGATAGCAGCCT GAATACTGGGGTA |
| | | | SEQ ID NO:3655 | SEQ ID NO:11667 | SEQ ID NO:19679 |
| | | AA | SGSSSNLGNNFVS | DNYKRPS | GTWDSSLNTGV |
| | | | SEQ ID NO:3656 | SEQ ID NO:11668 | SEQ ID NO:19680 |
| iPS:437066 | 21-225_200G9 | NA | GCTTCCAACACTGGAGCAGT CACCAGTGGTTCCTATCCAA AT | CATACAGACAACAAACA CTCC | CTGATCTACTATGGTGGTGC TCAGCTGGTG |
| | | | SEQ ID NO:3657 | SEQ ID NO:11669 | SEQ ID NO:19681 |
| | | AA | ASNTGAVTSGSYPN | HTDNKHS | LIYYGGAQLV |
| | | | SEQ ID NO:3658 | SEQ ID NO:11670 | SEQ ID NO:19682 |
| iPS:437068 | 21-225_200A11 | NA | GCTTCCAGCACTGGAGCAGT CACCAGTGGTTACTATCCAA AC | AGTACAAACAACAAACA CTCC | CTGCTCTATTATGGTGGTGCT CACCTGGCA |
| | | | SEQ ID NO:3659 | SEQ ID NO:11671 | SEQ ID NO:19683 |
| | | AA | ASSTGAVTSGYYPN | STNNKHS | LLYYGGAHLA |
| | | | SEQ ID NO:3660 | SEQ ID NO:11672 | SEQ ID NO:19684 |
| iPS:437070 | 21-225_201G11 | NA | TCTGGAGATAAATTGGGGGA TAGATTTGCTTGC | CAAGATAGCAAGCGGCC CTCA | CAGGCGTGGGACAGCAGCAC TGTGGTA |
| | | | SEQ ID NO:3661 | SEQ ID NO:11673 | SEQ ID NO:19685 |
| | | AA | SGDKLGDRFAC | QDSKRPS | QAWDSSTVV |
| | | | SEQ ID NO:3662 | SEQ ID NO:11674 | SEQ ID NO:19686 |

FIGURE 49
(Continued)

| | | | | |
|---|---|---|---|---|
| iPS:437074 | 21-225_203B2 | NA | GGGGGAAACAACATTGGAA GAAAAATGTGCAC SEQ ID NO:3663 | AGGGATAGCGACCGGCC CTCT SEQ ID NO:11675 | CAGGTGTGGGACAGCGGCAC TGCGGTA SEQ ID NO:19687 |
| | | AA | GGNNIGRKNVH SEQ ID NO:3664 | RDSDRPS SEQ ID NO:11676 | QVWDSGTAV SEQ ID NO:19688 |
| iPS:437076 | 21-225_203G6 | NA | TCTGGAGATAAATTGGGGGA TAGATTTGCTTGC SEQ ID NO:3665 | CAAGATAACAAGCGGCC CTCA SEQ ID NO:11677 | CAGGCGTGGGACACAGCAGCAC TGTGGTA SEQ ID NO:19689 |
| | | AA | SGDKLGDRFAC SEQ ID NO:3666 | QDNKRPS SEQ ID NO:11678 | QAWDSSTVV SEQ ID NO:19690 |
| iPS:437082 | 21-225_205E12 | NA | GGGGGAAACAACATTGGAA GAAAAATGTGCAC SEQ ID NO:3667 | AGGGATAGCGACCGGCC CTCT SEQ ID NO:11679 | CAGGTGTGGGACAGCGGCAC TGCGGTA SEQ ID NO:19691 |
| | | AA | GGNNIGRKNVH SEQ ID NO:3668 | RDSDRPS SEQ ID NO:11680 | QVWDSGTAV SEQ ID NO:19692 |
| iPS:437084 | 21-225_206B5 | NA | GGGGGAAACAACATTGGAA GAAAAATGTGCAC SEQ ID NO:3669 | AGGGATAGCTACCGATC TTCT SEQ ID NO:11681 | CAGGATTGGGACAGCAGCAC TGTGGTG SEQ ID NO:19693 |
| | | AA | GGNNIGRKNVH SEQ ID NO:3670 | RDSYRSS SEQ ID NO:11682 | QDWDSSTVV SEQ ID NO:19694 |
| iPS:437086 | 21-225_209A8 | NA | TCTGGAAGCAGCTCCAACAT TGGGAGTAATTTTTTATCC SEQ ID NO:3671 | GACAATAATAAGCGACC CTCA SEQ ID NO:11683 | GGAACATGGGATAGCAGCCT GAGTGCTGGGGTA SEQ ID NO:19695 |
| | | AA | SGSSSNIGSNFLS SEQ ID NO:3672 | DNNKRPS SEQ ID NO:11684 | GTWDSSLSAGV SEQ ID NO:19696 |
| iPS:437088 | 21-225_209H10 | NA | GGGGGAAACAACATTGGAA GAAAAATGTGCAC SEQ ID NO:3673 | AGGGATAGCTACCCGGTC TTCT SEQ ID NO:11685 | CAGGATTGGGACAGCAGCAC TGTGGTG SEQ ID NO:19697 |
| | | AA | GGNNIGRKNVH SEQ ID NO:3674 | RDSYRSS SEQ ID NO:11686 | QDWDSSTVV SEQ ID NO:19698 |

FIGURE 49
(Continued)

| | | | | | |
|---|---|---|---|---|---|
| iPS:437090 | 21-225_210F11 | NA | GCTTTCAGCACTGGAGCAGTCACCAGTGGTAATTATCCAAAC | AGTACAAGCAACAAACACTCC | CTGCTCTACTATGGTGGTGCTCAGCTGGTG |
| | | | SEQ ID NO:3675 | SEQ ID NO:11687 | SEQ ID NO:19699 |
| | | AA | AFSTGAVTSGNYPN | STSNKHS | LLYYGGAQLV |
| | | | SEQ ID NO:3676 | SEQ ID NO:11688 | SEQ ID NO:19700 |
| iPS:437092 | 21-225_210B12 | NA | ACTGGAACCAGCAGTGACGTTGGTGGTTATAACTATGTCTCC | GAGGTCAGGAATCGGCCCTCA | AGTCATATACCAGCAGCCGCACTCTGGTA |
| | | | SEQ ID NO:3677 | SEQ ID NO:11689 | SEQ ID NO:19701 |
| | | AA | TGTSSDVGGYNYVS | EVRNRPS | SSYTSSRTLV |
| | | | SEQ ID NO:3678 | SEQ ID NO:11690 | SEQ ID NO:19702 |
| iPS:437094 | 21-225_210D12 | NA | ACTGGAACCAGCAGTGACGTTGGTGGTTATAATTATGTCTCC | GAGGTCAGTAATCGGCCCTCA | AACTCATATACAAGCAGCATCACTTGGGTG |
| | | | SEQ ID NO:3679 | SEQ ID NO:11691 | SEQ ID NO:19703 |
| | | AA | TGTSSDVGGYNYVS | EVSNRPS | NSYTSSITWV |
| | | | SEQ ID NO:3680 | SEQ ID NO:11692 | SEQ ID NO:19704 |
| iPS:437096 | 21-225_210E12 | NA | ACTGGAACCAGCAGTAGTGACGTTGGTAGTTATAACTATGTCTCC | GAGGTCAGTAATCGGCCCTCA | GGCTCATATGTAAAAGGCATCACTTGGGTG |
| | | | SEQ ID NO:3681 | SEQ ID NO:11693 | SEQ ID NO:19705 |
| | | AA | TGTSSDVGGYNYVS | EVSNRPS | GSYVKGITWV |
| | | | SEQ ID NO:3682 | SEQ ID NO:11694 | SEQ ID NO:19706 |
| iPS:437098 | 21-225_211C1 | NA | ACTGGAACCAGCAGTAGTGACGTTGGTAGTTATAACTATGTCTCC | GAGGTCAGTAATCGGCCCTCA | AACTCATATACAAGCAGCATCACTTGGGTG |
| | | | SEQ ID NO:3683 | SEQ ID NO:11695 | SEQ ID NO:19707 |
| | | AA | TGTSSDVGSYNYVS | EVSNRPS | NSYTSSITWV |
| | | | SEQ ID NO:3684 | SEQ ID NO:11696 | SEQ ID NO:19708 |

FIGURE 49
(Continued)

| | | | | |
|---|---|---|---|---|
| iPS:437100 | 21-225_211H2 | NA | GGGGGAAACAACATTGGACGTAGAAATGTGCAC SEQ ID NO:3685 | AGAGATCGCGACCGGCC CTCT SEQ ID NO:11697 | CAGGTGTGGGACAGCAGTAC TGCGGTG SEQ ID NO:19709 |
| | | AA | GGNNIGRRNVH SEQ ID NO:3686 | RDRDRPS SEQ ID NO:11698 | QVWDSSTAV SEQ ID NO:19710 |
| iPS:437102 | 21-225_211E5 | NA | TCTGGAGATGCATTGCCAAAGCAATATGCTTAT SEQ ID NO:3687 | AAAGACAGTGCGAGGCC CTCA SEQ ID NO:11699 | CAATTAGTGTACAGCAGTGA TACTTATGTC SEQ ID NO:19711 |
| | | AA | SGDALPKQYAY SEQ ID NO:3688 | KDSARPS SEQ ID NO:11700 | QLVYSSDTYV SEQ ID NO:19712 |
| iPS:437104 | 21-225_211G5 | NA | ACTGGAACCAGCAGTGACGTTGGTGGTTATAACTATGTCTCC SEQ ID NO:3689 | GAGGTCAGTAATCGGCC CTCA SEQ ID NO:11701 | AACTCATATACAAGAAGCAT CACTTGGGTG SEQ ID NO:19713 |
| | | AA | TGTSSDVGGYNYVS SEQ ID NO:3690 | EVSNRPS SEQ ID NO:11702 | NSYTRSITWV SEQ ID NO:19714 |
| iPS:437106 | 21-225_211H7 | NA | GCTTTCAGCACTGGAGCAGTCACCAGTGGTAACTATCCAAGT SEQ ID NO:3691 | AGTACAAGCAACAACAGACA CTCC SEQ ID NO:11703 | CTGCTCTACTATGGTGGTGC TCAGCTGGTG SEQ ID NO:19715 |
| | | AA | AFSTGAVTSGNYPS SEQ ID NO:3692 | STSNRHS SEQ ID NO:11704 | LLYYGGAQLV SEQ ID NO:19716 |
| iPS:437108 | 21-225_211C9 | NA | GGTTCCAGCACTGGATCAGTCACCAGTGGTTACTTTCCAAAC SEQ ID NO:3693 | AGTACAAACAACAAGCA CTCC SEQ ID NO:11705 | CTGCTCTACTATGGTGGTGC TCAGCTGGCA SEQ ID NO:19717 |
| | | AA | GSSTGSVTSGYFPN SEQ ID NO:3694 | STNNKHS SEQ ID NO:11706 | LLYYGGAQLA SEQ ID NO:19718 |

FIGURE 49
(Continued)

| | | | | | |
|---|---|---|---|---|---|
| iPS:437110 | 21-225_211E9 | NA | GCTTCCAGCACTGGAGCAGT CACCAGTGGTAACTATCCAA AC | AGTACAATCAACAAACA CTCC | CTGCTCTACTATGTGGTGC TCAGCTGGCA |
| | | | SEQ ID NO:3695 | SEQ ID NO:11707 | SEQ ID NO:19719 |
| | | AA | ASSTGAVTSGNYPN | STINKHS | LLYYGGAQLA |
| | | | SEQ ID NO:3696 | SEQ ID NO:11708 | SEQ ID NO:19720 |
| iPS:437112 | 21-225_212C2 | NA | ACTGGAACCAGCAGTGACGT TGGTGGTTATAACTATGTCT CC | GAGGTCAGAAATCGGCC CTCA | AGCTCATATACACGCAGCAT CACTTGGGTG |
| | | | SEQ ID NO:3697 | SEQ ID NO:11709 | SEQ ID NO:19721 |
| | | AA | TGTSSDVGGYNYVS | EVRNRPS | SSYTRSITWV |
| | | | SEQ ID NO:3698 | SEQ ID NO:11710 | SEQ ID NO:19722 |
| iPS:437114 | 21-225_212A4 | NA | ACTGGAACCAGCAGTGACGT TGGTGGTTATAACTATGTCT CC | GAGGTCAGTAATCGGCC CTCA | GGCTCATATGTAAAAGGCAT CACTTGGGTG |
| | | | SEQ ID NO:3699 | SEQ ID NO:11711 | SEQ ID NO:19723 |
| | | AA | TGTSSDVGGYNYVS | EVSNRPS | GSYVKGITWV |
| | | | SEQ ID NO:3700 | SEQ ID NO:11712 | SEQ ID NO:19724 |
| iPS:437116 | 21-225_212F6 | NA | ACTGGAACCAGTAGTGACGT TGGTGGTTATAACTATGTCT CC | GAGGTCAGTAATCGGCC CTCA | AACTCATATACAAGCAGCAT CACTTGGGTG |
| | | | SEQ ID NO:3701 | SEQ ID NO:11713 | SEQ ID NO:19725 |
| | | AA | TGTSSDVGGYNYVS | EVSNRPS | NSYTSSITWV |
| | | | SEQ ID NO:3702 | SEQ ID NO:11714 | SEQ ID NO:19726 |
| iPS:437118 | 21-225_212G7 | NA | ACTGGAACCAGCAGTGACGT TGGTGGTTATAATTATGTCT CC | GAGGTCAGTAATCGGCC CTCA | AACTCATATACAAGCAGCAT CACTTGGGTG |
| | | | SEQ ID NO:3703 | SEQ ID NO:11715 | SEQ ID NO:19727 |
| | | AA | TGTSSDVGGYNYVS | EVSNRPS | NSYTSSITWV |
| | | | SEQ ID NO:3704 | SEQ ID NO:11716 | SEQ ID NO:19728 |

FIGURE 49
(Continued)

| | | | | | |
|---|---|---|---|---|---|
| iPS-437120 | 21-225_212A9 | NA | GCTTCCAGCACTGGAGCAGT CACCAGTGGTTACTATCCAA AC | AGTACAAACAACAAACA CTCC | CTGCTCTACTATGGTGGTGC TCAGGTGGGA |
| | | | SEQ ID NO:3705 | SEQ ID NO:11717 | SEQ ID NO:19729 |
| | | AA | ASSTGAVTSGYYPN | STNKHS | LLYYGGAHVG |
| | | | SEQ ID NO:3706 | SEQ ID NO:11718 | SEQ ID NO:19730 |
| iPS-437124 | 21-225_212H12 | NA | GCTTCCAGCACTGGAGCAGT CACCAGTGGTTACTATCCAA AC | AGTACAAGCAACAAACA CTCC | CTGCTCTACTATGGTGGTGC TCATGTGGTA |
| | | | SEQ ID NO:3707 | SEQ ID NO:11719 | SEQ ID NO:19731 |
| | | AA | ASSTGAVTSGYYPN | STSNKHS | LLYYGGAHVV |
| | | | SEQ ID NO:3708 | SEQ ID NO:11720 | SEQ ID NO:19732 |
| iPS-437128 | 21-225_213G3 | NA | ACTGGAACCAGCAGTGACGT TGGTGGTTATAACTATGTCT CC | GAGGTCAGGAATCGGCC CTCA | AACTCATATACACGCAGCAT CACTTGGGTG |
| | | | SEQ ID NO:3709 | SEQ ID NO:11721 | SEQ ID NO:19733 |
| | | AA | TGTSSDVGGYNYVS | EVRNRPS | NSYTRSITWV |
| | | | SEQ ID NO:3710 | SEQ ID NO:11722 | SEQ ID NO:19734 |
| iPS-437130 | 21-225_213D5 | NA | ACTGGAACCAGCAGTGACGT TGGTGGTTATAACTATGTCT CC | GAGGTCCGTAATCGGCC CTCA | TGCTCATATACAAGAAGAAT CACTTGGGTG |
| | | | SEQ ID NO:3711 | SEQ ID NO:11723 | SEQ ID NO:19735 |
| | | AA | TGTSSDVGGYNYVS | EVRNRPS | CSYTRRITWV |
| | | | SEQ ID NO:3712 | SEQ ID NO:11724 | SEQ ID NO:19736 |
| iPS-437132 | 21-225_213F5 | NA | GGTTCCAGCACTGGATCAGT CACCAGTGGTTACTTTCCAA AC | AGTACAAACAACAAGCA CTCC | CTGCTCTACTTTGGTGGTGCT CAGCTGGCA |
| | | | SEQ ID NO:3713 | SEQ ID NO:11725 | SEQ ID NO:19737 |
| | | AA | GSSTGSVTSGYFPN | STNKHS | LLYFGGAQLA |
| | | | SEQ ID NO:3714 | SEQ ID NO:11726 | SEQ ID NO:19738 |

FIGURE 49
(Continued)

| | | | | | |
|---|---|---|---|---|---|
| iPS:437134 | 21-225_213A7 | NA | ACTGGAACCAGCAGTGACGT TGGTGGTTATAACTATGTCT CC SEQ ID NO:3715 | GAGGTCAGGAATCGGCC CTCA SEQ ID NO:11727 | AGCTCATATACCAGCAGCCG CACTCTGGTA SEQ ID NO:19739 |
| | | AA | TGTSSDVGGYNYVS SEQ ID NO:3716 | EVRNRPS SEQ ID NO:11728 | SSYTSSRTLV SEQ ID NO:19740 |
| iPS:437136 | 21-225_214H3 | NA | GCTTCCAGCACTGGAGCAGT CACCAGTGGTTACTATCCAA AC SEQ ID NO:3717 | AGTACAAGCAACAAACA CTCC SEQ ID NO:11729 | CTGCTCTACTATGGTGGTGC TCATGTGGTA SEQ ID NO:19741 |
| | | AA | ASSTGAVTSGYYPN SEQ ID NO:3718 | STSNKHS SEQ ID NO:11730 | LLYYGGAHVV SEQ ID NO:19742 |
| iPS:437138 | 21-225_214D8 | NA | TCTGGAAGCAGCTCCAACAT TGGGAATAATTATGTATCC SEQ ID NO:3719 | GACAATAATAAGCGACC CTCA SEQ ID NO:11731 | GGAGCATGGGATAGCAGCCT GAGTGCTGTGGTA SEQ ID NO:19743 |
| | | AA | SGSSSNIGNNYVS SEQ ID NO:3720 | DNNKRPS SEQ ID NO:11732 | GAWDSSLSAVV SEQ ID NO:19744 |
| iPS:437140 | 21-225_214E12 | NA | GCTTCCAGCACTGGAGCAGT CACCAGTGGCTACTATCCAA AC SEQ ID NO:3721 | AGTACAAGCAATAAACA CTCC SEQ ID NO:11733 | CTGCTCTACTGTGATGGTGC CCAGCTGGTG SEQ ID NO:19745 |
| | | AA | ASSTGAVTSGYYPN SEQ ID NO:3722 | STSNKHS SEQ ID NO:11734 | LLYCDGAQLV SEQ ID NO:19746 |
| iPS:437142 | 21-225_215A3 | NA | GCTTCCAGCACTGAAGCCGT CACCAGTGGTAACTATCCAA GC SEQ ID NO:3723 | AGTACAAGCAACAAACA CTCC SEQ ID NO:11735 | CTGCTCTACTATGGTGGCGC TCAGCTGGCA SEQ ID NO:19747 |
| | | AA | ASSTEAVTSGNYPS SEQ ID NO:3724 | STSNKHS SEQ ID NO:11736 | LLYYGGAQLA SEQ ID NO:19748 |

FIGURE 49
(Continued)

| | | | | | |
|---|---|---|---|---|---|
| iPS:437144 | 21-225_215B3 | NA | TCTGAGATAAATTGGGGGATAAATTGCTTGC<br>SEQ ID NO:3725 | CAAGATAGCAAGCGGCCCTCA<br>SEQ ID NO:11737 | CAGGCGTGGGACAGCAGCACTGTGGTA<br>SEQ ID NO:19749 |
| | | AA | SGDKLGDKFAC<br>SEQ ID NO:3726 | QDSKRPS<br>SEQ ID NO:11738 | QAWDSSTVV<br>SEQ ID NO:19750 |
| iPS:437146 | 21-225_215D3 | NA | ACTGGAACCAGCAGTGACATTGGTGGTTATAACTATGTCTCC<br>SEQ ID NO:3727 | GAGGTCAGTAATCGGCCCTCA<br>SEQ ID NO:11739 | AACTCATATAAAAGGGGCAGCACTTGGGTG<br>SEQ ID NO:19751 |
| | | AA | TGTSSDIGGYNYVS<br>SEQ ID NO:3728 | EVSNRPS<br>SEQ ID NO:11740 | NSYKRGSTWV<br>SEQ ID NO:19752 |
| iPS:437148 | 21-225_215H3 | NA | GCTTCCAGCACTGGAGCAGTCACCAGTGGTTACTATCCAAAC<br>SEQ ID NO:3729 | AGTACAAACAACAAACACTCC<br>SEQ ID NO:11741 | CTGCTCTACTATGGTGGTGCTCAGGTGGGA<br>SEQ ID NO:19753 |
| | | AA | ASSTGAVTSGYYPN<br>SEQ ID NO:3730 | STNNKHS<br>SEQ ID NO:11742 | LLYYGGAQVG<br>SEQ ID NO:19754 |
| iPS:437150 | 21-225_216A3 | NA | ACTGGAACCAGCAGTGACGTTGGTGGTTATAATTATGTCTCC<br>SEQ ID NO:3731 | GAGGTCAGTAATCGGCCCTCA<br>SEQ ID NO:11743 | AACTCATATACAAGCAGCATCACTTGGGTG<br>SEQ ID NO:19755 |
| | | AA | TGTSSDVGGYNYVS<br>SEQ ID NO:3732 | EVSNRPS<br>SEQ ID NO:11744 | NSYTSSITWV<br>SEQ ID NO:19756 |
| iPS:437154 | 21-225_216A7 | NA | GCTTCCAGCACTGGAGCAGTCACCAGTGGTTACTATCCAAAC<br>SEQ ID NO:3733 | AGTACAAACAACAAACACTCC<br>SEQ ID NO:11745 | CTGCTCTACTATGGTGGTGCTCAGGTGGGA<br>SEQ ID NO:19757 |
| | | AA | ASSTGAVTSGYYPN<br>SEQ ID NO:3734 | STNNKHS<br>SEQ ID NO:11746 | LLYYGGAQVG<br>SEQ ID NO:19758 |

FIGURE 49
(Continued)

| | | | | | |
|---|---|---|---|---|---|
| iPS:437158 | 21-225_216H11 | NA | GCTTCCAGAGCACTGGAGCAGT CACCAGTGGCTACTATCCAA AC SEQ ID NO:3735 | AGTACAAGCAATAAACA CTCC SEQ ID NO:11747 | CTGCTCTACTGTGATGGTGC TCAGCTGGTG SEQ ID NO:19759 |
| | | AA | ASSTGAVTSGYYPN SEQ ID NO:3736 | STSNKHS SEQ ID NO:11748 | LLYCDGAQLV SEQ ID NO:19760 |
| iPS:437160 | 21-225_216B12 | NA | GGGGGAGACAACATTAGAA GAAGAAATGTGCAC SEQ ID NO:3737 | AGGGATAGCAACCGGCC CTCT SEQ ID NO:11749 | CAGGTGTGGGACAGCAGCAC TGGGGTG SEQ ID NO:19761 |
| | | AA | GGDNIRRRNVH SEQ ID NO:3738 | RDSNRPS SEQ ID NO:11750 | QVWDSSTGV SEQ ID NO:19762 |
| iPS:437162 | 21-225_217B2 | NA | ACTGGAACCAGCAGTGACGT TGGTGGTTATAACTATGTCT CC SEQ ID NO:3739 | GAGGTCAGTAATCGGCC CTCA SEQ ID NO:11751 | GGCTCATATGTAAAAGGCAT CACTTGGGTG SEQ ID NO:19763 |
| | | AA | TGTSSDVGGYNYVS SEQ ID NO:3740 | EVSNRPS SEQ ID NO:11752 | GSYVKGITWV SEQ ID NO:19764 |
| iPS:437164 | 21-225_217C6 | NA | TCTGGAGATGCATTGCCAAA GCAATATGCTTAT SEQ ID NO:3741 | AAAGACAGTGAGAGGCC CTCA SEQ ID NO:11753 | CAATTAATAGTCAGCAGTGA TACTTATGTC SEQ ID NO:19765 |
| | | AA | SGDALPKQYAY SEQ ID NO:3742 | KDSERPS SEQ ID NO:11754 | QLIVSSDTYV SEQ ID NO:19766 |
| iPS:437166 | 21-225_217G11 | NA | TCTGGAGATGCATTGCCAAA ACAATATGCTTAT SEQ ID NO:3743 | AAAGACAGTGAGAGGCC CTCA SEQ ID NO:11755 | CAATTAGTGTACAGCAGTGA TACTTATGTC SEQ ID NO:19767 |
| | | AA | SGDALPKQYAY SEQ ID NO:3744 | KDSERPS SEQ ID NO:11756 | QLVYSSDTYV SEQ ID NO:19768 |
| iPS:437168 | 21_225_218G4 | NA | TCTGGAAGCAGCTCCAACAT TGGGAATAATTATGTATCC | GACAGTAATAAGCGACC CTCA | GGAACATGGGATAGCAGCCT GAATACTGTGTA |

FIGURE 49
(Continued)

| | | | | | |
|---|---|---|---|---|---|
| iPS:437170 | 21-225_218G4 | AA | SEQ ID NO:3745<br>SGSSSNIGNNYVS | SEQ ID NO:11757<br>DSNKRPS | SEQ ID NO:19769<br>GTWDSSLNTVV |
| | | NA | SEQ ID NO:3746<br>TCTAGAGATGTATTGCCGAA<br>GCAATATGCTTAT | SEQ ID NO:11758<br>AAAGACAGTGAGAGGCC<br>CTCA | SEQ ID NO:19770<br>CAATTAGTTGTCAGCAGTGA<br>TACTTATGTC |
| iPS:437172 | 21-225_218E5 | AA | SEQ ID NO:3747<br>SRDVLPKQYAY | SEQ ID NO:11759<br>KDSERPS | SEQ ID NO:19771<br>QLVVSSDTYV |
| | | NA | SEQ ID NO:3748<br>ACTGGAACCAGCAGTGACGT<br>TGGTGGTTATAATTATGTCT<br>CC | SEQ ID NO:11760<br>GAGGTCAGAAATCGGCC<br>CTCA | SEQ ID NO:19772<br>TGCTCATATACAAGGAGCAT<br>CACTGGGTG |
| iPS:437182 | 21-225_219A7 | AA | SEQ ID NO:3749<br>TGTSSDVGGYNYVS | SEQ ID NO:11761<br>EVRNRPS | SEQ ID NO:19773<br>CSYTRSITWV |
| | | NA | SEQ ID NO:3750<br>ACTGGAACCAGCAGTGACGT<br>TGGTGGTTATAACTATGTCT<br>CC | SEQ ID NO:11762<br>GAGGTCAGGAATCGGCC<br>CTCA | SEQ ID NO:19774<br>AACTCATATACACGCAGCAT<br>CACTTGGGTG |
| iPS:437184 | 21-225_221H2 | AA | SEQ ID NO:3751<br>TGTSSDVGGYNYVS | SEQ ID NO:11763<br>EVRNRPS | SEQ ID NO:19775<br>NSYTRSITWV |
| | | NA | SEQ ID NO:3752<br>ACTGGAACCAGCAGTGACGT<br>TGGTGGTTATAACTATGTCT<br>CC | SEQ ID NO:11764<br>GAGGTCAGGAATCGGCC<br>CTCA | SEQ ID NO:19776<br>AACTCATATACACGCAGCAT<br>CACTTGGGTG |
| iPS:437186 | 21-225_221G4 | AA | SEQ ID NO:3753<br>TGTSSDVGGYNYVS | SEQ ID NO:11765<br>EVRNRPS | SEQ ID NO:19777<br>NSYTRSITWV |
| | | NA | SEQ ID NO:3754<br>TCTGGAGATAATTGGGGGT<br>TAAATATACTTAC | SEQ ID NO:11766<br>CAAGATAGCAAGCGGCC<br>CTCA | SEQ ID NO:19778<br>CAGGGCGTGGGACAGCAGCAC<br>TGTGGTA |
| | 21-225_224H2 | AA | SEQ ID NO:3755<br>SGDNLGVKYTY | SEQ ID NO:11767<br>QDSKRPS | SEQ ID NO:19779<br>QAWDSSTVV |

FIGURE 49
(Continued)

| | | | | | | |
|---|---|---|---|---|---|---|
| iPS:437188 | 21-225_224B11 | NA | SEQ ID NO:3756 ACTGGGAGCAGCTCCAACAT CGGGGCAGGTTATGATGTAC AC | SEQ ID NO:11768 GGTAACAGCAGCAATCGGCC CTCA | SEQ ID NO:19780 CAGTCCTATGACAACAGCCT GAGTGGTGTG |
| | | AA | SEQ ID NO:3757 TGSSSNIGAGYDVH | SEQ ID NO:11769 GNSNRPS | SEQ ID NO:19781 QSYDNSLSGV |
| iPS:437190 | 21-225_225A9 | NA | SEQ ID NO:3758 TCTGGAGATAAATTGGGGAA TAAATATGCTTGC | SEQ ID NO:11770 CAAGATAGCAAGCGGCC CTCA | SEQ ID NO:19782 CAGGCGTGGGACAGCAACAC TGCATGTGTC |
| | | AA | SEQ ID NO:3759 SGDKLGNKYAC | SEQ ID NO:11771 QDSKRPS | SEQ ID NO:19783 QAWDSNTACV |
| iPS:437192 | 21-225_225E9 | NA | SEQ ID NO:3760 TCTGGAGATAATTTGGGGAA TAGATATGCTTGC | SEQ ID NO:11772 CAAGATCGCAAGCGGCC CTCA | SEQ ID NO:19784 CAGGCGTGGGACAGCAGAAC TGCTGTGGTA |
| | | AA | SEQ ID NO:3761 SGDNLGNRYAC | SEQ ID NO:11773 QDRKRPS | SEQ ID NO:19785 QAWDSRTAVV |
| iPS:437194 | 21-225_226B2 | NA | SEQ ID NO:3762 TCTGGAGATACATTGGGGGG TAAATATGCTTGG | SEQ ID NO:11774 CAAGATCGCAAGCGGCC CTCA | SEQ ID NO:19786 CAGGCGTGGGACAACGGCGC TGCGGTT |
| | | AA | SEQ ID NO:3763 SGDTLGGKYAW | SEQ ID NO:11775 QDRKRPS | SEQ ID NO:19787 QAWDNGAAV |
| iPS:437196 | 21-225_226B7 | NA | SEQ ID NO:3764 TCTGGAGATGCATTGCCAAG GCATTATGTTTAT | SEQ ID NO:11776 AAAGACAGTGAGAGGCC CTCA | SEQ ID NO:19788 CAATCAGCAGACAGCAGTGG TACTTATGTC |
| | | AA | SEQ ID NO:3765 SGDALPRHYVY | SEQ ID NO:11777 KDSERPS | SEQ ID NO:19789 QSADSSGTYV |
| iPS:437198 | 21_225_226F8 | NA | SEQ ID NO:3766 ACTGGGAGCAGCTCCAACAT CGGGGCAGGTTATGATGTAC AC | SEQ ID NO:11778 GGTAACAGCAGCAATCGGCC CTCA | SEQ ID NO:19790 CAGTCCTATGACAACAGCCT GAGTGGTGTG |

FIGURE 49
(Continued)

| | | | | | | |
|---|---|---|---|---|---|---|
| iPS:437200 | 21-225_226F8 | AA | SEQ ID NO:3767<br>TGSSSNIGAGYDVH<br>SEQ ID NO:3768 | SEQ ID NO:11779<br>GNSNRPS<br>SEQ ID NO:11780 | SEQ ID NO:19791<br>QSYDNSLSGV<br>SEQ ID NO:19792 |
| iPS:437202 | 21-225_226A10 | NA | TCTGGAGATACATTGGGGGG<br>TAAATATGCTTGG<br>SEQ ID NO:3769 | CAAGATCGCAAGCGCC<br>CTCA<br>SEQ ID NO:11781 | CAGGCGTGGGACAACGGCGC<br>TGCGGTT<br>SEQ ID NO:19793 |
| | | AA | SGDTLGGKYAW<br>SEQ ID NO:3770 | QDRKRPS<br>SEQ ID NO:11782 | QAWDNGAAV<br>SEQ ID NO:19794 |
| iPS:437204 | 21-225_227D3 | NA | ACTGGGAGCAGCTCCAACAT<br>CGGGGCAGGTTATGATGTAC<br>AC<br>SEQ ID NO:3771 | GGTAACAGCAATCGGCC<br>CTCA<br>SEQ ID NO:11783 | CAGTCCTATGACAACAGCCT<br>GAGTGGTGTG<br>SEQ ID NO:19795 |
| | | AA | TGSSSNIGAGYDVH<br>SEQ ID NO:3772 | GNSNRPS<br>SEQ ID NO:11784 | QSYDNSLSGV<br>SEQ ID NO:19796 |
| iPS:437208 | 21-225_227E5 | NA | TCTGGAGATAAAATTGGGGGA<br>AAAATATGCTTGC<br>SEQ ID NO:3773 | CAAGATAGGAAGCGGCC<br>CTCA<br>SEQ ID NO:11785 | CAGGCGTGGGTCAACAACAC<br>TATGATA<br>SEQ ID NO:19797 |
| | | AA | SGDKLGEKYAC<br>SEQ ID NO:3774 | QDRKRPS<br>SEQ ID NO:11786 | QAWVNNTMI<br>SEQ ID NO:19798 |
| iPS:437208 | 21-225_227C10 | NA | ACTGGGAGCAGCTCCAACAT<br>CGGGGCAGGTTATGATGTAC<br>AC<br>SEQ ID NO:3775 | GGTAACAGCAATCGGCC<br>CTCA<br>SEQ ID NO:11787 | CAGTCCTATGACAACAACCT<br>GAGTGGTGTG<br>SEQ ID NO:19799 |
| | | AA | TGSSSNIGAGYDVH<br>SEQ ID NO:3776 | GNSNRPS<br>SEQ ID NO:11788 | QSYDNNLSGV<br>SEQ ID NO:19800 |
| iPS:437210 | 21-225_227E12 | NA | TCTGGAGATAAATTGGGGGA<br>TAAATATGTTTGT<br>SEQ ID NO:3777 | CAAGATAGCAAGCGGCC<br>CTCA<br>SEQ ID NO:11789 | CAGGCGTGGAACAGCAGCAA<br>TGTGGTA<br>SEQ ID NO:19801 |
| | | AA | SGDKLGDKYVC<br>SEQ ID NO:3778 | QDSKRPS<br>SEQ ID NO:11790 | QAWNSSNVV<br>SEQ ID NO:19802 |

FIGURE 49
(Continued)

| | | | | | |
|---|---|---|---|---|---|
| iPS:437214 | 21-225_48B12 | NA | TCTGGAGATGCATTGCCAAAAAAATATGCTTAT SEQ ID NO:3779 | GAGGACAGCAAACGACCCTCC SEQ ID NO:11791 | AACTCAACAGACAGCAGTGGTAATCATGTGGTA SEQ ID NO:19803 |
| | | AA | SGDALPKKYAY SEQ ID NO:3780 | EDSKRPS SEQ ID NO:11792 | NSTDSSGNHVV SEQ ID NO:19804 |
| iPS:437216 | 21-225_51D5 | NA | CGGGCGAGTCAGGGCATTAACAATTATTTAGCC SEQ ID NO:3781 | GCTGCATCCAGTTGCGAAGT SEQ ID NO:11793 | CAACAGTATTATAGTTACCCATTCACT SEQ ID NO:19805 |
| | | AA | RASQGINNYLA SEQ ID NO:3782 | AASSLRS SEQ ID NO:11794 | QQYYSYPFT SEQ ID NO:19806 |
| iPS:437220 | 21-225_55H6 | NA | CGGGCAAGTCAGGGCATTAGAAACGATTAGGC SEQ ID NO:3783 | GGTGCATCCAGTTTGCAAAGT SEQ ID NO:11795 | CTACAGCGTGATAGTTACCCGTTCACT SEQ ID NO:19807 |
| | | AA | RASQGIRNDLG SEQ ID NO:3784 | GASSLQS SEQ ID NO:11796 | LQRDSYPFT SEQ ID NO:19808 |
| iPS:437224 | 21-225_56H1 | NA | CGGGCGAGTCAGGGCATTAGCCATTATTTAGCC SEQ ID NO:3785 | GCTGCATCCGGTTTGCAAAGT SEQ ID NO:11797 | CAACATATCAGAATTACCCCTTCACT SEQ ID NO:19809 |
| | | AA | RASQGISHYLA SEQ ID NO:3786 | AASGLQS SEQ ID NO:11798 | QQYQNYPFT SEQ ID NO:19810 |
| iPS:437226 | 21-225_57C2 | NA | AGGTCTAGTCAAAGCCTCGTATACAGTGATGGAAACACCTACTTGAAT SEQ ID NO:3787 | GAGGTTTCTAACTGGGACTCT SEQ ID NO:11799 | GTGCAAGGTACACACTGGCCTCGGACG SEQ ID NO:19811 |
| | | AA | RSSQSLVYSDGNTYLN SEQ ID NO:3788 | EVSNWDS SEQ ID NO:11800 | VQGTHWPRT SEQ ID NO:19812 |
| iPS:437228 | 21-225_60C11 | NA | AGGGCCAGTCAGAGTGTTAGCAACGACTTAGCC SEQ ID NO:3789 | GGTGCATCCACCAGGGCCACT SEQ ID NO:11801 | CAGCAGTATAGTAACTGGCCATTCACT SEQ ID NO:19813 |
| | | AA | RASQSVSNDLA | GASTRAT | QQYSNWPFT |

FIGURE 49
(Continued)

| | | | | | |
|---|---|---|---|---|---|
| iPS:437230 | 21-225_62H10 | NA | SEQ ID NO:3790 CGGGCAAGTCAGAGCATTAC CAGCTATTTAAAT | SEQ ID NO:11802 ACTGCATCCAGTTTGCAA AGT | SEQ ID NO:19814 CAACAGAGTCACAGTTTCCC ATTCACT |
| | | AA | SEQ ID NO:3791 RASQSITSYLN | SEQ ID NO:11803 TASSLQS | SEQ ID NO:19815 QQSHSFPFT |
| iPS:437232 | 21-225_63E1 | NA | SEQ ID NO:3792 CGTGCGAGTCAGGGTATTAG CAGCTACTTAGCC | SEQ ID NO:11804 GCTGCATCCAGTTTGCAA AGT | SEQ ID NO:19816 CAACAGGCTAACAGTTTCCC GCTCACT |
| | | AA | SEQ ID NO:3793 RASQGISSYLA | SEQ ID NO:11805 AASSLQS | SEQ ID NO:19817 QQANSFPLT |
| iPS:437234 | 21-225_64E2 | NA | SEQ ID NO:3794 CGGGCGAGTCAGGGTATTAG CAGGTGGTTAGCC | SEQ ID NO:11806 GCTGCATCCAGTTTGCAA AGT | SEQ ID NO:19818 CAACAGGCTAACAGTTTCCC ATTCACT |
| | | AA | SEQ ID NO:3795 RASQGISRWLA | SEQ ID NO:11807 AASSLQS | SEQ ID NO:19819 QQANSFPFT |
| iPS:437248 | 21-225_97H3 | NA | SEQ ID NO:3796 AGGTCTAGTCAGAGCCTCCT GCATAGTAATGGACACAACT ATTTGGAT | SEQ ID NO:11808 TTGGGTTCTAATCGGGCC TCC | SEQ ID NO:19820 ATGCAACCTCTACAAACTCC GTTCACT |
| | | AA | SEQ ID NO:3797 RSSQSLLHSNGHNYLD | SEQ ID NO:11809 LGSNRAS | SEQ ID NO:19821 MQPLQTPFT |
| iPS:437250 | 21-225_148C6 | NA | SEQ ID NO:3798 AGGTCTAGTCAAAGCCTCGT ATACAGTGATGGAAACACCT ACTTGAAT | SEQ ID NO:11810 AAGGTTTCTAACTGGGA CTCT | SEQ ID NO:19822 ATGCAAGTACACACTGGTC GCTCACT |
| | | AA | SEQ ID NO:3799 RSSQSLVYSDGNTYLN | SEQ ID NO:11811 KVSNWDS | SEQ ID NO:19823 MQGTHWSLT |
| | | | SEQ ID NO:3800 | SEQ ID NO:11812 | SEQ ID NO:19824 |

FIGURE 49
(Continued)

| | | | | | |
|---|---|---|---|---|---|
| iPS:437252 | 21-225_148H11 | NA | AGGTCTAGTCAAAGCCTCGTATACAGTGATGGAAACACCTACTTGAAT<br>SEQ ID NO:3801 | AAGGTTTCTAACTGGGACTCT<br>SEQ ID NO:11813 | ATGCAAGGTACACACTGGTTGCTCACT<br>SEQ ID NO:19825 |
| | | AA | RSSQSLVYSDGNTYLN<br>SEQ ID NO:3802 | KVSNWDS<br>SEQ ID NO:11814 | MQGTHWLLT<br>SEQ ID NO:19826 |
| iPS:437254 | 21-225_149F2 | NA | AGGTCTAGTCAAAGCCTCGTATACAGTGATGGAAACACCTCCTTGAAT<br>SEQ ID NO:3803 | AAGGTTTCTAACTGGGACTCT<br>SEQ ID NO:11815 | ATGCAAGGTACACACTGGCCTCCCACT<br>SEQ ID NO:19827 |
| | | AA | RSSQSLVYSDGNTSLN<br>SEQ ID NO:3804 | KVSNWDS<br>SEQ ID NO:11816 | MQGTHWPPT<br>SEQ ID NO:19828 |
| iPS:437256 | 21-225_150F11 | NA | AGGTCTAGTCAAAGCCTCGTATACAGTGATGGAAACACCTCCTTGAAT<br>SEQ ID NO:3805 | AAGGTTTCTAACTGGGACTAT<br>SEQ ID NO:11817 | ATGCAAGGTACACACTGGCCTCCCACT<br>SEQ ID NO:19829 |
| | | AA | RSSQSLVYSDGNTSLN<br>SEQ ID NO:3806 | KVSNWDY<br>SEQ ID NO:11818 | MQGTHWPPT<br>SEQ ID NO:19830 |
| iPS:437258 | 21-225_153F9 | NA | CGGGCGAGTCAGGGCATTAGCAATTATTTAGCC<br>SEQ ID NO:3807 | GCTGCATCCAGTTGCAAAGT<br>SEQ ID NO:11819 | CAACAGTATAATAGTTACCCGCTCAGT<br>SEQ ID NO:19831 |
| | | AA | RASQGISNYLA<br>SEQ ID NO:3808 | AASSLQS<br>SEQ ID NO:11820 | QQYNSYPLS<br>SEQ ID NO:19832 |
| iPS:437260 | 21-225_170D1 | NA | CGGGCGAGTCAGGACATTAGCAATTATTTAGCC<br>SEQ ID NO:3809 | GCTGCATCCAGTTGCAAAGT<br>SEQ ID NO:11821 | CAACAGTGTGATAGTTTCCCTCTCACT<br>SEQ ID NO:19833 |
| | | AA | RASQDISNYLA<br>SEQ ID NO:3810 | AASSLQS<br>SEQ ID NO:11822 | QQCDSFPLT<br>SEQ ID NO:19834 |
| iPS:437262 | | NA | CGGGCAAGTCAGGGCATTAGAAATGATTTAGGC | GTTGCATCCGGTTTGCAAAGT | CTACAGCACAATAGTTACCCTCCGTGGACG |

FIGURE 49
(Continued)

| | | | | | | |
|---|---|---|---|---|---|---|
| iPS:437264 | 21-225_170E4 | AA | SEQ ID NO:3811 RASQGIRNDLG | SEQ ID NO:11823 VASGLQS | SEQ ID NO:19835 LQHNSYPPWT | |
| | | NA | SEQ ID NO:3812 CGGGCGAGTCAGGAGACATTAG CAATTATTAGCC | SEQ ID NO:11824 TCTGCATCCAGTTTGCAA AGT | SEQ ID NO:19836 CAACAATCTGATAGTTACCC TCTCACT | |
| iPS:437266 | 21-225_171H12 | AA | SEQ ID NO:3813 RASQDISNYLA | SEQ ID NO:11825 SASSLQS | SEQ ID NO:19837 QQSDSYPLT | |
| | | NA | SEQ ID NO:3814 CGGGCGAGTCAGGACATTAG CAATTATTAGCC | SEQ ID NO:11826 TCTGCATCCAGTTTGCAA AGT | SEQ ID NO:19838 CAACAATCTGATAGTTACCC TCTCACT | |
| iPS:437268 | 21-225_177A5 | AA | SEQ ID NO:3815 RASQDISNYLA | SEQ ID NO:11827 SASSLQS | SEQ ID NO:19839 QQSDSYPLT | |
| | | NA | SEQ ID NO:3816 AGGTCTAGTCAAAGCCTCGT ATACAGTGATGGAAACACCT ACTTGAAT | SEQ ID NO:11828 AAGGTTTCTAACTGGGA CTCT | SEQ ID NO:19840 ATGCAAGGTACACACTGGCC TCTCACT | |
| iPS:437270 | 21-225_177D2 | AA | SEQ ID NO:3817 RSSSQSLVYSDGNTYLN | SEQ ID NO:11829 KVSNWDS | SEQ ID NO:19841 MQGTHWPLT | |
| | | NA | SEQ ID NO:3818 CGGGCGAGTCAGGACATTAG CAATTATTAGCC | SEQ ID NO:11830 TCTGCATCCAGTTTGCAA AGT | SEQ ID NO:19842 CAACAATCTAATAGTTACCC TCTCACT | |
| iPS:437272 | 21-225_178H4 | AA | SEQ ID NO:3819 RASQDISNYLA | SEQ ID NO:11831 SASSLQS | SEQ ID NO:19843 QQSNSYPLT | |
| | | NA | SEQ ID NO:3820 CGGGCGAGTCAGGGCATTAG CAATTATTAGCC | SEQ ID NO:11832 GCTGCATCCAGTTTGCAA AGT | SEQ ID NO:19844 CAACATTATCTTAATTACCCT CTCACC | |
| iPS:437274 | 21-225_196D4 | AA | SEQ ID NO:3821 RASQGISNYLA | SEQ ID NO:11833 AASSLQS | SEQ ID NO:19845 QHYLNYPLT | |
| | | NA | SEQ ID NO:3822 | SEQ ID NO:11834 | SEQ ID NO:19846 | |

FIGURE 49
(Continued)

| | | | | | |
|---|---|---|---|---|---|
| iPS:437280 | 21-225_203C10 | NA | CGGGGCAAGTCAGGACATTAG AAATGATTAGGC<br>SEQ ID NO:3823 | AGAGCATCCAGTTTGCA AAGT<br>SEQ ID NO:11835 | CTACAGCATAATAGTTACCC GTGGACG<br>SEQ ID NO:19847 |
| | | AA | RASQDIRNDLG<br>SEQ ID NO:3824 | RASSLQS<br>SEQ ID NO:11836 | LQHNSYPWT<br>SEQ ID NO:19848 |
| iPS:437282 | 21-225_207C9 | NA | CGGGCAAGTCAGAGGTTTAG TAACTATTTAAAT<br>SEQ ID NO:3825 | ACTGCATCCAGTTTGCAA AGT<br>SEQ ID NO:11837 | CAACAGAGTTACAGTATTCC GCTCACT<br>SEQ ID NO:19849 |
| | | AA | RASQRFSNYLN<br>SEQ ID NO:3826 | TASSLQS<br>SEQ ID NO:11838 | QQSYSIPLT<br>SEQ ID NO:19850 |
| iPS:437286 | 21-225_208F1 | NA | CGGGCAAGTCAGGCATTAG ACATGATTAGGC<br>SEQ ID NO:3827 | GCTGCATCCAGTTTGCAA AGT<br>SEQ ID NO:11839 | CTACAGCATTATAGTTTCCCT CGGACG<br>SEQ ID NO:19851 |
| | | AA | RASQGIRHDLG<br>SEQ ID NO:3828 | AASSLQS<br>SEQ ID NO:11840 | LQHYSFPRT<br>SEQ ID NO:19852 |
| iPS:437290 | 21-225_210G6 | NA | CGGGCAAGTCAGGCATTAG ACATGATTAGGC<br>SEQ ID NO:3829 | GCTGCATCCAGTTCGCA AAGT<br>SEQ ID NO:11841 | GTACAGCATTATAGTTTCCC TCGGACG<br>SEQ ID NO:19853 |
| | | AA | RASQGIRHDLG<br>SEQ ID NO:3830 | AASSSQS<br>SEQ ID NO:11842 | VQHYSFPRT<br>SEQ ID NO:19854 |
| iPS:437294 | 21-225_216D5 | NA | AGGTCTAGTCAAAGCCTCGT ATACAGTGATGGAAACACCT ACTTGAAT<br>SEQ ID NO:3831 | AAGGTTTCTAACTGGGA CTCT<br>SEQ ID NO:11843 | ATGCAAGGTGCACACTGGTT CACC<br>SEQ ID NO:19855 |
| | | AA | RSSQSLVYSDGNTYLN<br>SEQ ID NO:3832 | KVSNWDS<br>SEQ ID NO:11844 | MQGAHWFT<br>SEQ ID NO:19856 |
| iPS:437302 | 21-225_225B11 | NA | CAGGCGAGTCAGGACATTTT CAACTATTTAAAT<br>SEQ ID NO:3833 | GATGCATCCACTTTGGA AACA<br>SEQ ID NO:11845 | CAACAGTATGATAATCTCCC GATCACC<br>SEQ ID NO:19857 |
| | | AA | QASQDIFNYLN | DASTLET | QQYDNLPIT |

FIGURE 49
(Continued)

| | | | | | | |
|---|---|---|---|---|---|---|
| iPS:437320 | 21-225_75A1 | NA | SEQ ID NO:3834 AGGTCTAGTCAGAGCCTCCT GCATAGTAATGGAACACAACT ATTTGGAT | SEQ ID NO:11846 TTGGGTTCTAATCGGGCC TCC | SEQ ID NO:19858 ATGCAACCTCTACAAACTCC GTTCACT |
| | | AA | SEQ ID NO:3835 RSSQSLLHSNGHNYLD | SEQ ID NO:11847 LGSNRAS | SEQ ID NO:19859 MQPLQTPFT |
| iPS:437322 | 21-225_75B1 | NA | SEQ ID NO:3836 AGGGCCAGTCAGAGTGTTAG CAGCAGCTACTTAGTC | SEQ ID NO:11848 GGTGCATCCACCAGGGC CACT | SEQ ID NO:19860 CAGCAGTATGGTTGCTCACC GCTCACT |
| | | AA | SEQ ID NO:3837 RASQSVSSSYLV | SEQ ID NO:11849 GASTRAT | SEQ ID NO:19861 QQYGCSPLT |
| iPS:437324 | 21-225_75C2 | NA | SEQ ID NO:3838 AGGGCCAGTCAGAGTGTTTA CAGCAGCTACTTAGCC | SEQ ID NO:11850 GGTGCATCCAGCCGGC CACT | SEQ ID NO:19862 CAGCACTATGATAACTCACC GTGGACG |
| | | AA | SEQ ID NO:3839 RASQSVYSSYLA | SEQ ID NO:11851 GASSRAT | SEQ ID NO:19863 QHYDNSPWT |
| iPS:437326 | 21-225_75C10 | NA | SEQ ID NO:3840 CGGGCGAGTCAGGGCATTAG CATCTGGTTAGCC | SEQ ID NO:11852 GCTGCATCCAGTTTGCAA AGT | SEQ ID NO:19864 CAACAGGCTAAAAGTTTCCC GCTCACT |
| | | AA | SEQ ID NO:3841 RASQGISIWLA | SEQ ID NO:11853 AASSLQS | SEQ ID NO:19865 QQAKSFPLT |
| iPS:437328 | 21-225_75D3 | NA | SEQ ID NO:3842 AGGGCCAGTCAGAGTGTTTA CAGCAGCTACTTAGCC | SEQ ID NO:11854 GGTGCATCCAGCCGGTC CACT | SEQ ID NO:19866 CAGCACTATGATAACTCACC GTGGACG |
| | | AA | SEQ ID NO:3843 RASQSVYSSYLA | SEQ ID NO:11855 GASSRST | SEQ ID NO:19867 QHYDNSPWT |
| iPS:437332 | 21-225_75F3 | NA | SEQ ID NO:3844 AGGGCCAGTCAGAGTGTTTA CAGCAGCTACTTAGCC | SEQ ID NO:11856 GGTGCATCCAGCCGGGC CACT | SEQ ID NO:19868 CAGCACTATGATAACTCACC GTGGACG |
| | | | SEQ ID NO:3845 | SEQ ID NO:11857 | SEQ ID NO:19869 |

FIGURE 49
(Continued)

| | | | | | |
|---|---|---|---|---|---|
| | | RASQSVYSSYLA | | GASSRAT | QHYDNSPWT |
| | AA | SEQ ID NO:3846 | | SEQ ID NO:11858 | SEQ ID NO:19870 |
| iPS:437334 | NA | AGGGCCAGTCAGAGTGTTAG CAGAAATTTAGCC | | GGTGCATCCATCAGGGC CACT | CAGCAGTATAATAACTGGCC TCCGCTCACT |
| 21-225_75F11 | | SEQ ID NO:3847 | | SEQ ID NO:11859 | SEQ ID NO:19871 |
| | AA | RASQSVSRNLA | | GASIRAT | QQYNNWPPLT |
| | | SEQ ID NO:3848 | | SEQ ID NO:11860 | SEQ ID NO:19872 |
| iPS:437340 | NA | AGGGCCAGTCAGTCCGAGTGTGA CAGCAGCTACTTAGCC | | GGTGCATCCAGCAGGGC CCCT | CAGCAGTATGAAAGTTCACC GTGGACG |
| 21-225_75G9 | | SEQ ID NO:3849 | | SEQ ID NO:11861 | SEQ ID NO:19873 |
| | AA | RASPSVDSSYLA | | GASSRAP | QQYESSPWT |
| | | SEQ ID NO:3850 | | SEQ ID NO:11862 | SEQ ID NO:19874 |
| iPS:437344 | NA | AGGGCCAGTCAGAGTGTTTA CAGCAGCTACTTAGCC | | GGTGCATCCAGCCGGGC CACT | CAGCACTATGATAACTCACC GTGGACG |
| 21-225_75G12 | | SEQ ID NO:3851 | | SEQ ID NO:11863 | SEQ ID NO:19875 |
| | AA | RASQSVYSSYLA | | GASSRAT | QHYDNSPWT |
| | | SEQ ID NO:3852 | | SEQ ID NO:11864 | SEQ ID NO:19876 |
| iPS:437346 | NA | CGGGCAAGTCAGGGCATAA GAAATGATTTAGGC | | GATGCATCCAGTTTGCA AAGT | ATACAGCATAGTAATTACCC GCTCACT |
| 21-225_75H7 | | SEQ ID NO:3853 | | SEQ ID NO:11865 | SEQ ID NO:19877 |
| | AA | RASQGIRNDLG | | DASSLQS | IQHSNYPLT |
| | | SEQ ID NO:3854 | | SEQ ID NO:11866 | SEQ ID NO:19878 |
| iPS:437350 | NA | AGGGCCAGTCAGAGTGTTTA CAGCAGCTACTTAGCC | | GGTGCATCCAGCCGGTC CACT | CAGCACTCTGATAACTCACC GTGGACG |
| 21-225_74A3 | | SEQ ID NO:3855 | | SEQ ID NO:11867 | SEQ ID NO:19879 |
| | AA | RASQSVYSSYLA | | GASSRST | QHSDNSPWT |
| | | SEQ ID NO:3856 | | SEQ ID NO:11868 | SEQ ID NO:19880 |
| iPS:437356 21 225_74B1 | NA | AAGTCCAGCCAGCAGAGTGTTTT ACACAGGTCCAACAATTACA ACTACTTAGCG | | TGGGCATCTACCCGGGA ATCC | CAGCAATATTATAGTACTCC TCCGACG |

FIGURE 49
(Continued)

| | | SEQ ID NO:3857 | SEQ ID NO:11869 | SEQ ID NO:19881 |
|---|---|---|---|---|
| 21-225_74B1 | AA | KSSQSVLHRSNNYNYLA | WASTRES | QQYYSTPPT |
| | | SEQ ID NO:3858 | SEQ ID NO:11870 | SEQ ID NO:19882 |
| iPS:437361 | NA | AAGTCCAGCCAGAGTATTTT ACACAGCTCCAACAATTACA ATTACTTAGCT | TGGGCATCTACCCGGGA ATCC | CAGCAATATTATAGTACTCC GTGGACG |
| | | SEQ ID NO:3859 | SEQ ID NO:11871 | SEQ ID NO:19883 |
| 21-225_74C1 | AA | KSSQSILHSSNNYNYLA | WASTRES | QQYYSTPWT |
| | | SEQ ID NO:3860 | SEQ ID NO:11872 | SEQ ID NO:19884 |
| iPS:437363 | NA | AAGTCCAGCCAGAGTGTTTT ATACAGCTCCAACAATGCGA ACTACTTAGCT | TGGGCATCTACCCGGGA ATCC | CAGCAATATTATAGTACTCC GTGCAGT |
| | | SEQ ID NO:3861 | SEQ ID NO:11873 | SEQ ID NO:19885 |
| 21-225_74C10 | AA | KSSQSVLYSSNNANYLA | WASTRES | QQYYSTPCS |
| | | SEQ ID NO:3862 | SEQ ID NO:11874 | SEQ ID NO:19886 |
| iPS:437369 | NA | AGGGCCAGTCAGAGTGTTTA CAGCAGCTACTTAGCC | GGTGCATCCAGCCGGGC CACT | CAGCATTATGATAACTCACC GTGGACG |
| | | SEQ ID NO:3863 | SEQ ID NO:11875 | SEQ ID NO:19887 |
| 21-225_74D6 | AA | RASQSVYSSYLA | GASSRAT | QHYDNSPWT |
| | | SEQ ID NO:3864 | SEQ ID NO:11876 | SEQ ID NO:19888 |
| iPS:437371 | NA | AGGTCTAGTCAGAGCCTCGT GCATAGTAGTGGATACAACT ATTTGGAT | TTGGGTTCTAATCGGGCC TCC | ATGCAAGCTCTACACCCTCC TCTCACT |
| | | SEQ ID NO:3865 | SEQ ID NO:11877 | SEQ ID NO:19889 |
| 21-225_74D8 | AA | RSSQSLVHSSGYNYLD | LGSNRAS | MQALHPPLT |
| | | SEQ ID NO:3866 | SEQ ID NO:11878 | SEQ ID NO:19890 |
| iPS:437377 | NA | AGGGCCAGTCAGAGTGTTAG CAGCAGCTACTTAGTC | GGTGCATCCACCAGGGC CACT | CAGCAGTATGGTTGCTCACC GCTCACT |
| | | SEQ ID NO:3867 | SEQ ID NO:11879 | SEQ ID NO:19891 |
| 21-225_74G9 | AA | RASQSVSSSYLV | GASTRAT | QQYGCSPLT |

FIGURE 49
(Continued)

| | | | | | | |
|---|---|---|---|---|---|---|
| iPS:437379 | 21-225_74H2 | NA | SEQ ID NO:3868 AAGTCCAGCCAGAGTGTTT ACACAGCTCCAACAATAAGA ACTACTTAACT | SEQ ID NO:11880 TGGGCATCTACTCGGGA ATCC | SEQ ID NO:19892 CAGCAATATTATAGTATTCC TCCGACG | |
| | | AA | SEQ ID NO:3869 KSSQSVLHSSNNKNYLT | SEQ ID NO:11881 WASTRES | SEQ ID NO:19893 QQYYSIPPT | |
| iPS:437383 | 21-225_74H8 | NA | SEQ ID NO:3870 AGGGCCAGTCAGAGTTTTAG CAGCAGCTACTTAGCC | SEQ ID NO:11882 GGTGCATCCAGCAGGGC CACT | SEQ ID NO:19894 CAGCAGTATGTGAGCTCAAG GACG | |
| | | AA | SEQ ID NO:3871 RASQSFSSSYLA | SEQ ID NO:11883 GASSRAT | SEQ ID NO:19895 QQYGSSRT | |
| iPS:438664 | 21-225_216G1 | NA | SEQ ID NO:3872 CGGGCGAGTCAGGGCATTAG CAGTTATTTAGCC | SEQ ID NO:11884 GCTGCATCCAGTTTGCAA AGT | SEQ ID NO:19896 CTACGGTATGATACTTACCC TCTCACT | |
| | | AA | SEQ ID NO:3873 RASQGISSYLA | SEQ ID NO:11885 AASSLQS | SEQ ID NO:19897 LRYDTYPLT | |
| iPS:441468 | 21-225_25A4.001.001 | NA | SEQ ID NO:3874 AAGTCCAGCCAGAGTGTTT ATACAGCTCCCACAATAACA ACTACTTAGCT | SEQ ID NO:11886 TGGGCATCTACCCGGGA ATCC | SEQ ID NO:19898 CAGCAGTATTATAGTACTCC TCCGACG | |
| | | AA | SEQ ID NO:3875 KSSQSVLYSSHNNNYLA | SEQ ID NO:11887 WASTRES | SEQ ID NO:19899 QQYYSTPPT | |
| iPS:441475 | 21-225_25A4.001.002 | NA | SEQ ID NO:3876 AAGTCCAGCCAGAGTGTTT ATACAGCTCCCACAATAACA ACTACTTAGCT | SEQ ID NO:11888 TGGGCATCTACCCGGGA ATCC | SEQ ID NO:19900 CAGCAGTATTATAGTACTCC TCCGACG | |
| | | AA | SEQ ID NO:3877 KSSQSVLYSSHNNNYLA | SEQ ID NO:11889 WASTRES | SEQ ID NO:19901 QQYYSTPPT | |
| | | | SEQ ID NO:3878 | SEQ ID NO:11890 | SEQ ID NO:19902 | |

FIGURE 49
(Continued)

| iPS:441482 | 21-225_25A4.001.003 | NA | AAGTCCAGCCAGAGTGTTTTATACAGCTCCCACAATAACAACTACTTAGCT SEQ ID NO:3879 | TGGGCATCTACCCGGGAATCC SEQ ID NO:11891 | CAGCAGTATTATAGTACTCCTCCGACG SEQ ID NO:19903 |
|---|---|---|---|---|---|
| | | AA | KSSQSVLYSSHNNNYLA SEQ ID NO:3880 | WASTRES SEQ ID NO:11892 | QQYYSTPPT SEQ ID NO:19904 |
| iPS:441489 | 21-225_25A4.001.004 | NA | AAGTCCAGCCAGAGTGTTTTATACAGCTCCCACAATAACAACTACTTAGCT SEQ ID NO:3881 | TGGGCATCTACCCGGGAATCC SEQ ID NO:11893 | CAGCAGTATTATAGTACTCCTCCGACG SEQ ID NO:19905 |
| | | AA | KSSQSVLYSSHNNNYLA SEQ ID NO:3882 | WASTRES SEQ ID NO:11894 | QQYYSTPPT SEQ ID NO:19906 |
| iPS:441496 | 21-225_25A4.001.005 | NA | AAGTCCAGCCAGAGTGTTTTATACAGCTCCCACAATAACAACTACTTAGCT SEQ ID NO:3883 | TGGGCATCTACCCGGGAATCC SEQ ID NO:11895 | CAGCAGTATTATAGTACTCCTCCGACG SEQ ID NO:19907 |
| | | AA | KSSQSVLYSSHNNNYLA SEQ ID NO:3884 | WASTRES SEQ ID NO:11896 | QQYYSTPPT SEQ ID NO:19908 |
| iPS:441505 | 21-225_25A4.001.006 | NA | AAGTCCAGCCAGAGTGTTTTATACAGCTCCCACAATAACAACTACTTAGCT SEQ ID NO:3885 | TGGGCATCTACCCGGGAATCC SEQ ID NO:11897 | CAGCAGTATTATAGTACTCCTCCGACG SEQ ID NO:19909 |
| | | AA | KSSQSVLYSSHNNNYLA SEQ ID NO:3886 | WASTRES SEQ ID NO:11898 | QQYYSTPPT SEQ ID NO:19910 |
| iPS:441512 | 21-225_25A4.001.007 | NA | AAGTCCAGCCAGAGTGTTTTATACAGCTCCCACAATAACAACTACTTAGCT SEQ ID NO:3887 | TGGGCATCTACCCGGGAATCC SEQ ID NO:11899 | CAGCAGTATTATAGTACTCCTCCGACG SEQ ID NO:19911 |
| | | AA | KSSQSVLYSSHNNNYLA SEQ ID NO:3888 | WASTRES SEQ ID NO:11900 | QQYYSTPPT SEQ ID NO:19912 |

FIGURE 49
(Continued)

| | | | | |
|---|---|---|---|---|
| iPS:441519 | 21-<br>225_25A4.001.008 | NA | AAGTCCAGCCAGAGTGTTTT<br>ATACAGCTCCCACAATAACA<br>ACTACTTAGCT<br>SEQ ID NO:3889 | TGGGCATCTACCCGGGA<br>ATCC<br>SEQ ID NO:11901 | CAGCAGTATTATAGTACTCC<br>TCCGACG<br>SEQ ID NO:19913 |
| | | AA | KSSQSVLYSSHNNNYLA<br>SEQ ID NO:3890 | WASTRES<br>SEQ ID NO:11902 | QQYYSTPPT<br>SEQ ID NO:19914 |
| iPS:441554 | 21-<br>225_25A4.001.013 | NA | AAGTCCAGCCAGAGTGTTTT<br>ATACAGCTCCCACAATAACA<br>ACTACTTAGCT<br>SEQ ID NO:3891 | TGGGCATCTACCCGGGA<br>ATCC<br>SEQ ID NO:11903 | CAGCAGTATTATAGTACTCC<br>TCCGACG<br>SEQ ID NO:19915 |
| | | AA | KSSQSVLYSSHNNNYLA<br>SEQ ID NO:3892 | WASTRES<br>SEQ ID NO:11904 | QQYYSTPPT<br>SEQ ID NO:19916 |
| iPS:441595 | 21-<br>225_25A4.001.019 | NA | AAGTCCAGCCAGAGTGTTTT<br>ATACAGCTCCCACAATAACA<br>ACTACTTAGCT<br>SEQ ID NO:3893 | TGGGCATCTACCCGGGA<br>ATCC<br>SEQ ID NO:11905 | CAGCAGTATTATAGTACTCC<br>TCCGACG<br>SEQ ID NO:19917 |
| | | AA | KSSQSVLYSSHNNNYLA<br>SEQ ID NO:3894 | WASTRES<br>SEQ ID NO:11906 | QQYYSTPPT<br>SEQ ID NO:19918 |
| iPS:441604 | 21-<br>225_25A4.001.020 | NA | AAGTCCAGCCAGAGTGTTTT<br>ATACAGCTCCCACAATAACA<br>ACTACTTAGCT<br>SEQ ID NO:3895 | TGGGCATCTACCCGGGA<br>ATCC<br>SEQ ID NO:11907 | CAGCAGTATTATAGTACTCC<br>TCCGACG<br>SEQ ID NO:19919 |
| | | AA | KSSQSVLYSSHNNNYLA<br>SEQ ID NO:3896 | WASTRES<br>SEQ ID NO:11908 | QQYYSTPPT<br>SEQ ID NO:19920 |
| iPS:441613 | 21-<br>225_25A4.001.021 | NA | AAGTCCAGCCAGAGTGTTTT<br>ATACAGCTCCCACAATAACA<br>ACTACTTAGCT<br>SEQ ID NO:3897 | TGGGCATCTACCCGGGA<br>ATCC<br>SEQ ID NO:11909 | CAGCAGTATTATAGTACTCC<br>TCCGACG<br>SEQ ID NO:19921 |
| | | AA | KSSQSVLYSSHNNNYLA<br>SEQ ID NO:3898 | WASTRES<br>SEQ ID NO:11910 | QQYYSTPPT<br>SEQ ID NO:19922 |

FIGURE 49
(Continued)

| | | | AAGTCCAGCCAGAGTATTTT ACACAGCTCCAACAATAACA ACTACTTAGCT | TGGGCATCTACCCGGGA ATCC | CAGCAATATTATAGTACTCC AGTCACT |
|---|---|---|---|---|---|
| iPS:441841 | | NA | SEQ ID NO:3899 | SEQ ID NO:11911 | SEQ ID NO:19923 |
| | 21-225_4A2.001.001 | AA | KSSQSILHSSNNNNYLA SEQ ID NO:3900 | WASTRES SEQ ID NO:11912 | QQYYSTPVT SEQ ID NO:19924 |
| iPS:441847 | | NA | AAGTCCAGCCAGAGTATTTT ACACAGCTCCAACAATAACA ACTACTTAGCT SEQ ID NO:3901 | TGGGCATCTACCCGGGA ATCC SEQ ID NO:11913 | CAGCAATATTATAATGCTCC AGTCACT SEQ ID NO:19925 |
| | 21-225_4A2.001.002 | AA | KSSQSILHSSNNNNYLA SEQ ID NO:3902 | WASTRES SEQ ID NO:11914 | QQYYNAPVT SEQ ID NO:19926 |
| iPS:441853 | | NA | AAGTCCAGCCAGAGTATTTT ACACAGCTCCAACAATAACA ACTACTTAGCT SEQ ID NO:3903 | TGGGCATCTACCCGGGA ATCC SEQ ID NO:11915 | CAGCAATATTATCAAACTCC AGTCACT SEQ ID NO:19927 |
| | 21-225_4A2.001.003 | AA | KSSQSILHSSNNNNYLA SEQ ID NO:3904 | WASTRES SEQ ID NO:11916 | QQYYQTPVT SEQ ID NO:19928 |
| iPS:441859 | | NA | AAGTCCAGCCAGAGTATTTT ACACAGCTCCAACAATAACA ACTACTTAGCT SEQ ID NO:3905 | TGGGCATCTACCCGGGA ATCC SEQ ID NO:11917 | CAGCAATATTATAATACTCC AGTCACT SEQ ID NO:19929 |
| | 21-225_4A2.001.004 | AA | KSSQSILHSSNNNNYLA SEQ ID NO:3906 | WASTRES SEQ ID NO:11918 | QQYYNTPVT SEQ ID NO:19930 |
| iPS:441866 | | NA | AAGTCCAGCCAGAGTATTTT ACACAGCTCCAACAATAACA ACTACTTAGCT SEQ ID NO:3907 | TGGGCATCTACCCGGGA ATCC SEQ ID NO:11919 | CAGCAATATTATAATACTCC AGTCACT SEQ ID NO:19931 |
| | 21-225_4A2.001.005 | AA | KSSQSILHSSNNNNYLA SEQ ID NO:3908 | WASTRES SEQ ID NO:11920 | QQYYNTPVT SEQ ID NO:19932 |

FIGURE 49
(Continued)

| | | | | | |
|---|---|---|---|---|---|
| iPS:441873 | 21-225_4A2.001.006 | NA | AAGTCCAGCCAGAGTATTTT ACACAGCTCCAACAATAACA ACTACTTAGCT SEQ ID NO:3909 | TGGGCATCTACCCGGGA ATCC SEQ ID NO:11921 | CAGCAATATTATAATACTCC AGTCACT SEQ ID NO:19933 |
| | | AA | KSSQSILHSSNNNNYLA SEQ ID NO:3910 | WASTRES SEQ ID NO:11922 | QQYYNTPVT SEQ ID NO:19934 |
| iPS:441880 | 21-225_4A2.001.007 | NA | AAGTCCAGCCAGAGTATTTT ACACAGCTCCAACAATAACA ACTACTTAGCT SEQ ID NO:3911 | TGGGCATCTACCCGGGA ATCC SEQ ID NO:11923 | CAGCAATATTATATAGTACTCC AGTCACT SEQ ID NO:19935 |
| | | AA | KSSQSILHSSNNNNYLA SEQ ID NO:3912 | WASTRES SEQ ID NO:11924 | QQYYSTPVT SEQ ID NO:19936 |
| iPS:441884 | 21-225_4A2.001.008 | NA | AAGTCCAGCCAGAGTATTTT ACACAGCTCCAACAATAACA ACTACTTAGCT SEQ ID NO:3913 | TGGGCATCTACCCGGGA ATCC SEQ ID NO:11925 | CAGCAATATTATATAGTACTCC AGTCACT SEQ ID NO:19937 |
| | | AA | KSSQSILHSSNNNNYLA SEQ ID NO:3914 | WASTRES SEQ ID NO:11926 | QQYYSTPVT SEQ ID NO:19938 |
| iPS:441888 | 21-225_4A2.001.009 | NA | AAGTCCAGCCAGAGTATTTT ACACAGCTCCAACAATAACA ACTACTTAGCT SEQ ID NO:3915 | TGGGCATCTACCCGGGA ATCC SEQ ID NO:11927 | CAGCAATATTATAATGCTCC AGTCACT SEQ ID NO:19939 |
| | | AA | KSSQSILHSSNNNNYLA SEQ ID NO:3916 | WASTRES SEQ ID NO:11928 | QQYYNAPVT SEQ ID NO:19940 |
| iPS:441892 | 21-225_4A2.001.010 | NA | AAGTCCAGCCAGAGTATTTT ACACAGCTCCAACAATAACA ACTACTTAGCT SEQ ID NO:3917 | TGGGCATCTACCCGGGA ATCC SEQ ID NO:11929 | CAGCAATATTATCAAACTCC AGTCACT SEQ ID NO:19941 |
| | | AA | KSSQSILHSSNNNNYLA SEQ ID NO:3918 | WASTRES SEQ ID NO:11930 | QQYYQTPVT SEQ ID NO:19942 |

FIGURE 49
(Continued)

| iPS:441896 | 21-225_4A2.001.011 | NA | AAGTCCAGCCAGAGTATTT ACACAGCTCCAACAATAACA ACTACTTAGCT | TGGGCATCTACCCGGGA ATCC | CAGCAATATTATCAAACTCC AGTCACT |
| --- | --- | --- | --- | --- | --- |
| | | | SEQ ID NO:3919 | SEQ ID NO:11931 | SEQ ID NO:19943 |
| | | AA | KSSQSILHSSNNNNYLA | WASTRES | QQYYQTPVT |
| | | | SEQ ID NO:3920 | SEQ ID NO:11932 | SEQ ID NO:19944 |
| iPS:441900 | 21-225_4A2.001.012 | NA | AAGTCCAGCCAGAGTATTT ACACAGCTCCAACAATAACA ACTACTTAGCT | TGGGCATCTACCCGGGA ATCC | CAGCAATATTATCAAACTCC AGTCACT |
| | | | SEQ ID NO:3921 | SEQ ID NO:11933 | SEQ ID NO:19945 |
| | | AA | KSSQSILHSSNNNNYLA | WASTRES | QQYYQTPVT |
| | | | SEQ ID NO:3922 | SEQ ID NO:11934 | SEQ ID NO:19946 |
| iPS:441955 | 21-225_4A2.001.022 | NA | AAGTCCAGCCAGAGTATTT ACACAGCTCCAACAATAACA ACTACTTAGCT | TGGGCATCTACCCGGGA ATCC | CAGCAATATTATAGTACTCC AGTCACT |
| | | | SEQ ID NO:3923 | SEQ ID NO:11935 | SEQ ID NO:19947 |
| | | AA | KSSQSILHSSNNNNYLA | WASTRES | QQYYSTPVT |
| | | | SEQ ID NO:3924 | SEQ ID NO:11936 | SEQ ID NO:19948 |
| iPS:441962 | 21-225_4A2.001.023 | NA | AAGTCCAGCCAGAGTATTT ACACAGCTCCAACAATAACA ACTACTTAGCT | TGGGCATCTACCCGGGA ATCC | CAGCAATATTATAGTACTCC AGTCACT |
| | | | SEQ ID NO:3925 | SEQ ID NO:11937 | SEQ ID NO:19949 |
| | | AA | KSSQSILHSSNNNNYLA | WASTRES | QQYYSTPVT |
| | | | SEQ ID NO:3926 | SEQ ID NO:11938 | SEQ ID NO:19950 |
| iPS:441971 | 21-225_4A2.001.024 | NA | AAGTCCAGCCAGAGTATTT ACACAGCTCCAACAATAACA ACTACTTAGCT | TGGGCATCTACCCGGGA ATCC | CAGCAATATTATAGTACTCC AGTCACT |
| | | | SEQ ID NO:3927 | SEQ ID NO:11939 | SEQ ID NO:19951 |
| | | AA | KSSQSILHSSNNNNYLA | WASTRES | QQYYSTPVT |
| | | | SEQ ID NO:3928 | SEQ ID NO:11940 | SEQ ID NO:19952 |

FIGURE 49
(Continued)

| | | | | | |
|---|---|---|---|---|---|
| iPS:441999 | 21-225_4A2.001.028 | NA | AAGTCCAGCCAGAGTATTTTACACAGCTCCAACAATAACAACTACTTAGCT<br>SEQ ID NO:3929<br>KSSQSILHSSNNNNYLA<br>SEQ ID NO:3930 | TGGGCATCTACCCGGGAATCC<br>SEQ ID NO:11941<br>WASTRES<br>SEQ ID NO:11942 | CAGCAATATTATAGTACTCCAGTCACT<br>SEQ ID NO:19953<br>QQYYSTPVT<br>SEQ ID NO:19954 |
| | | AA | | | |
| iPS:442006 | 21-225_4A2.001.029 | NA | AAGTCCAGCCAGAGTATTTTACACAGCTCCAACAATAACAACTACTTAGCT<br>SEQ ID NO:3931<br>KSSQSILHSSNNNNYLA<br>SEQ ID NO:3932 | TGGGCATCTACCCGGGAATCC<br>SEQ ID NO:11943<br>WASTRES<br>SEQ ID NO:11944 | CAGCAATATTATAGTACTCCAGTCACT<br>SEQ ID NO:19955<br>QQYYSTPVT<br>SEQ ID NO:19956 |
| | | AA | | | |
| iPS:442020 | 21-225_4A2.001.031 | NA | AAGTCCAGCCAGAGTATTTTACACAGCTCCAACAATAACAACTACTTAGCT<br>SEQ ID NO:3933<br>KSSQSILHSSNNNNYLA<br>SEQ ID NO:3934 | TGGGCATCTACCCGGGAATCC<br>SEQ ID NO:11945<br>WASTRES<br>SEQ ID NO:11946 | CAGCAATATTATAATACTCCAGTCACT<br>SEQ ID NO:19957<br>QQYYNTPVT<br>SEQ ID NO:19958 |
| | | AA | | | |
| iPS:442050 | 21-225_4H6.004 | NA | CGGGCGAGTCAGGGTATTAGCAGGTGGTTAGCC<br>SEQ ID NO:3935<br>RASQGISRWLA<br>SEQ ID NO:3936 | GGTGCATCCAGTTTGCAAAGT<br>SEQ ID NO:11947<br>GASSLQS<br>SEQ ID NO:11948 | CAACAGGCTAACAGTTTCCCATTCACT<br>SEQ ID NO:19959<br>QQANSFPFT<br>SEQ ID NO:19960 |
| | | AA | | | |
| iPS:442059 | 21-225_4H6.005 | NA | CGGGCGAGTCAGGGTATTAGCAGGTGGTTAGCC<br>SEQ ID NO:3937<br>RASQGISRWLA<br>SEQ ID NO:3938 | GGTGCATCCAGTTTGCAAAGT<br>SEQ ID NO:11949<br>GASSLQS<br>SEQ ID NO:11950 | CAACAGGCTAACAGTTTCCCATTCACT<br>SEQ ID NO:19961<br>QQANSFPFT<br>SEQ ID NO:19962 |
| iPS:442065 | | NA | CGGGCGAGTCAGGGTATTAGCAGGTGGTTAGCC | GGTGCATCCAGTTTGCAAAGT | CAACAGGCTAACAGTTTCCCATTCACT |

FIGURE 49
(Continued)

| | | | | | | |
|---|---|---|---|---|---|---|
| iPS:442071 | 21-225_4H6.006 | | SEQ ID NO:3939 | | SEQ ID NO:11951 | SEQ ID NO:19963 |
| | | AA | RASQGISRWLA | | GASSLQS | QQANSFPFT |
| | | | SEQ ID NO:3940 | | SEQ ID NO:11952 | SEQ ID NO:19964 |
| iPS:442078 | 21-225_4H6.007 | NA | CGGGCGAGTCAGGGTATTAG CAGGTGGTTAGCC | | GGTGCATCCAGTTTGCA AAGT | CAACAGGCTAACAGTTTCCC ATTCACT |
| | | | SEQ ID NO:3941 | | SEQ ID NO:11953 | SEQ ID NO:19965 |
| | | AA | RASQGISRWLA | | GASSLQS | QQANSFPFT |
| | | | SEQ ID NO:3942 | | SEQ ID NO:11954 | SEQ ID NO:19966 |
| iPS:442085 | 21-225_4H6.008 | NA | CGGGCGAGTCAGGGTATTAG CAGGTGGTTAGCC | | GGTGCATCCAGTTTGCA AAGT | CAACAGGCTAACAGTTTCCC ATTCACT |
| | | | SEQ ID NO:3943 | | SEQ ID NO:11955 | SEQ ID NO:19967 |
| | | AA | RASQGISRWLA | | GASSLQS | QQANSFPFT |
| | | | SEQ ID NO:3944 | | SEQ ID NO:11956 | SEQ ID NO:19968 |
| iPS:442089 | 21-225_4H6.009 | NA | CGGGCGAGTCAGGGTATTAG CAGGTGGTTAGCC | | GGTGCATCCAGTTTGCA AAGT | CAACAGGCTAACAGTTTCCC ATTCACT |
| | | | SEQ ID NO:3945 | | SEQ ID NO:11957 | SEQ ID NO:19969 |
| | | AA | RASQGISRWLA | | GASSLQS | QQANSFPFT |
| | | | SEQ ID NO:3946 | | SEQ ID NO:11958 | SEQ ID NO:19970 |
| iPS:442093 | 21-225_4H6.010 | NA | CGGGCGAGTCAGGGTATTAG CAGGTGGTTAGCC | | GGTGCATCCAGTTTGCA AAGT | CAACAGGCTAACAGTTTCCC ATTCACT |
| | | | SEQ ID NO:3947 | | SEQ ID NO:11959 | SEQ ID NO:19971 |
| | | AA | RASQGISRWLA | | GASSLQS | QQANSFPFT |
| | | | SEQ ID NO:3948 | | SEQ ID NO:11960 | SEQ ID NO:19972 |
| iPS:442115 | 21-225_4H6.011 | NA | CGGGCGAGTCAGGGTATTAG CAGGTGGTTAGCC | | GGTGCATCCAGTTTGCA AAGT | CAACAGGCTAACAGTTTCCC ATTCACT |
| | | | SEQ ID NO:3949 | | SEQ ID NO:11961 | SEQ ID NO:19973 |
| | | AA | RASQGISRWLA | | GASSLQS | QQANSFPFT |
| | | | SEQ ID NO:3950 | | SEQ ID NO:11962 | SEQ ID NO:19974 |
| | | NA | CGGGCAAGTCAGGGCATTAG AAATGATTTAGGC | | GCTGCATCCAGTTTGCAA AGT | CTACAGCATTATAGTTACCC TCGGACG |

FIGURE 49
(Continued)

| | | | | | | |
|---|---|---|---|---|---|---|
| 21-225_5E5.003 | | | SEQ ID NO:3951 | SEQ ID NO:11963 | | SEQ ID NO:19975 |
| | | AA | RASQGIRNDLG | AASSLQS | | LQHYSYPRT |
| iPS:442122 | | | SEQ ID NO:3952 | SEQ ID NO:11964 | | SEQ ID NO:19976 |
| | 21-225_5E5.004 | NA | CGGGCAAGTCAGGGCATTAG AAATGATTTAGGC | GCTGCATCCAGTTTGCAA AGT | CTACAGCATTATAGTTACCC TCGGACG |
| | | | SEQ ID NO:3953 | SEQ ID NO:11965 | | SEQ ID NO:19977 |
| iPS:442129 | | AA | RASQGIRNDLG | AASSLQS | | LQHYSYPRT |
| | | | SEQ ID NO:3954 | SEQ ID NO:11966 | | SEQ ID NO:19978 |
| | 21-225_5E5.005 | NA | CGGGCAAGTCAGGGCATTAG AAATGATTTAGGC | GCTGCATCCAGTTTGCAA AGT | CTACAGCATTATAGTTACCC TCGGACG |
| | | | SEQ ID NO:3955 | SEQ ID NO:11967 | | SEQ ID NO:19979 |
| iPS:442136 | | AA | RASQGIRNDLG | AASSLQS | | LQHYSYPRT |
| | | | SEQ ID NO:3956 | SEQ ID NO:11968 | | SEQ ID NO:19980 |
| | 21-225_5E5.006 | NA | CGGGCAAGTCAGGGCATTAG AAATGATTTAGGC | GCTGCATCCAGTTTGCAA AGT | CTACAGCATTATAGTTACCC TCGGACG |
| | | | SEQ ID NO:3957 | SEQ ID NO:11969 | | SEQ ID NO:19981 |
| iPS:442171 | | AA | RASQGIRNDLG | AASSLQS | | LQHYSYPRT |
| | | | SEQ ID NO:3958 | SEQ ID NO:11970 | | SEQ ID NO:19982 |
| | 21-225_5E5.011 | NA | CGGGCAAGTCAGGGCATTAG AAATGATTTAGGC | GCTGCATCCAGTTTGCAA AGT | CTACAGCATTATAGTTACCC TCGGACG |
| | | | SEQ ID NO:3959 | SEQ ID NO:11971 | | SEQ ID NO:19983 |
| iPS:442178 | | AA | RASQGIRNDLG | AASSLQS | | LQHYSYPRT |
| | | | SEQ ID NO:3960 | SEQ ID NO:11972 | | SEQ ID NO:19984 |
| | 21-225_5E5.012 | NA | CGGGCAAGTCAGGGCATTAG AAATGATTTAGGC | GCTGCATCCAGTTTGCAA AGT | CTACAGCATTATAGTTACCC TCGGACG |
| | | | SEQ ID NO:3961 | SEQ ID NO:11973 | | SEQ ID NO:19985 |
| iPS:442199 | | AA | RASQGIRNDLG | AASSLQS | | LQHYSYPRT |
| | | | SEQ ID NO:3962 | SEQ ID NO:11974 | | SEQ ID NO:19986 |
| | | NA | CGGGCAAGTCAGGGCATTAG AAATGATTTAGGC | GCTGCATCCAGTTTGCAA AGT | CTACAGCATTATAGTTACCC TCGGACG |

FIGURE 49
(Continued)

| | | | | | | | |
|---|---|---|---|---|---|---|---|
| iPS:442206 | 21-225_5E5.015 | AA | SEQ ID NO:3963 RASQGIRNDLG | SEQ ID NO:3964 CGGGCAAGTCAGGGCATTAG AAATGATTTAGGC | SEQ ID NO:11975 AASSLQS | SEQ ID NO:11976 GCTGCATCCAGTTGCAA AGT | SEQ ID NO:19987 LQHYSYPRT | SEQ ID NO:19988 CTACAGCATTATAGTTACCC TCGGACG |
| iPS:442213 | 21-225_5E5.016 | NA | SEQ ID NO:3965 RASQGIRNDLG | SEQ ID NO:3966 CGGGCAAGTCAGGGCATTAG AAATGATTTAGGC | SEQ ID NO:11977 AASSLQS | SEQ ID NO:11978 GCTGCATCCAGTTGCAA AGT | SEQ ID NO:19989 LQHYSYPRT | SEQ ID NO:19990 CTACAGCATTATAGTTACCC TCGGACG |
| iPS:442220 | 21-225_5E5.017 | AA | SEQ ID NO:3967 RASQGIRNDLG | SEQ ID NO:3968 CGGGCAAGTCAGGGCATTAG AAATGATTTAGGC | SEQ ID NO:11979 AASSLQS | SEQ ID NO:11980 GCTGCATCCAGTTGCAA AGT | SEQ ID NO:19991 LQHYSYPRT | SEQ ID NO:19992 CTACAGCATTATAGTTACCC TCGGACG |
| iPS:442227 | 21-225_5E5.018 | NA | SEQ ID NO:3969 RASQGIRNDLG | SEQ ID NO:3970 CGGGCAAGTCAGGGCATTAG AAATGATTTAGGC | SEQ ID NO:11981 AASSLQS | SEQ ID NO:11982 GCTGCATCCAGTTGCAA AGT | SEQ ID NO:19993 LQHYSYPRT | SEQ ID NO:19994 CTACAGCATTATAGTTACCC TCGGACG |
| iPS:442255 | 21-225_5E5.019 | AA | SEQ ID NO:3971 RASQGIRNDLG | SEQ ID NO:3972 CGGGCAAGTCAGGGCATTAG AAATGATTTAGGC | SEQ ID NO:11983 AASSLQS | SEQ ID NO:11984 GCTGCATCCAGTTGCAA AGT | SEQ ID NO:19995 LQHYSYPRT | SEQ ID NO:19996 CTACAGCATTATAGTTACCC TCGGACG |
| iPS:442262 | 21-225_5E5.023 | NA | SEQ ID NO:3973 RASQGIRNDLG | SEQ ID NO:3974 CGGGCAAGTCAGGGCATTAG AAATGATTTAGGC | SEQ ID NO:11985 AASSLQS | SEQ ID NO:11986 GCTGCATCCAGTTGCAA AGT | SEQ ID NO:19997 LQHYSYPRT | SEQ ID NO:19998 CTACAGCATTATAGTTACCC TCGGACG |

FIGURE 49
(Continued)

| | | | | | | | |
|---|---|---|---|---|---|---|---|
| iPS:442269 | 21-225_5E5.024 | AA | SEQ ID NO:3975 RASQGIRNDLG | SEQ ID NO:11987 AASSLQS | SEQ ID NO:19999 LQHYSYPRT |
| | | NA | SEQ ID NO:3976 CGGGCAAGTCAGGGCATTAG AAATGATTAGGC | SEQ ID NO:11988 GCTGCATCCAGTTTGCAA AGT | SEQ ID NO:20000 CTACAGCATTATAGTTACCC TCGGACG |
| iPS:442311 | 21-225_5E5.025 | AA | SEQ ID NO:3977 RASQGIRNDLG | SEQ ID NO:11989 AASSLQS | SEQ ID NO:20001 LQHYSYPRT |
| | | NA | SEQ ID NO:3978 CGGGCAAGTCAAAACATTAT CAGCTATTTAAAT | SEQ ID NO:11990 ACTGCATCCAGTTTGCAA AGT | SEQ ID NO:20002 CAACAGACTTACAGTACCCC GCTCACT |
| iPS:442317 | 21-225_7E11.001.001 | AA | SEQ ID NO:3979 RASQNIISYLN | SEQ ID NO:11991 TASSLQS | SEQ ID NO:20003 QQTYSTPLT |
| | | NA | SEQ ID NO:3980 CGGGCAAGTCAAAACATTAT CAGCTATTTAAAT | SEQ ID NO:11992 ACTGCATCCAGTTTGCAA AGT | SEQ ID NO:20004 CAACAGACTTACAGTACCCC GCTCACT |
| iPS:442323 | 21-225_7E11.001.002 | AA | SEQ ID NO:3981 RASQNIISYLN | SEQ ID NO:11993 TASSLQS | SEQ ID NO:20005 QQTYSTPLT |
| | | NA | SEQ ID NO:3982 CGGGCAAGTCAAAACATTAT CAGCTATTTAAAT | SEQ ID NO:11994 ACTGCATCCAGTTTGCAA AGT | SEQ ID NO:20006 CAACAGACTTACAGTACCCC GCTCACT |
| iPS:442330 | 21-225_7E11.001.003 | AA | SEQ ID NO:3983 RASQNIISYLN | SEQ ID NO:11995 TASSLQS | SEQ ID NO:20007 QQTYSTPLT |
| | | NA | SEQ ID NO:3984 CGGGCAAGTCAAAACATTAT CAGCTATTTAAAT | SEQ ID NO:11996 ACTGCATCCAGTTTGCAA AGT | SEQ ID NO:20008 CAACAGACTTACAGTACCCC GCTCACT |
| iPS:442337 | 21-225_7E11.001.004 | AA | SEQ ID NO:3985 RASQNIISYLN | SEQ ID NO:11997 TASSLQS | SEQ ID NO:20009 QQTYSTPLT |
| | | NA | SEQ ID NO:3986 CGGGCAAGTCAAAACATTAT CAGCTATTTAAAT | SEQ ID NO:11998 ACTGCATCCAGTTTGCAA AGT | SEQ ID NO:20010 CAACAGACTTACAGTACCCC GCTCACT |

FIGURE 49
(Continued)

| | | | | | | |
|---|---|---|---|---|---|---|
| iPS:442344 | 21-225_7E11.001.005 | AA | SEQ ID NO:3987 RASQNIISYLN SEQ ID NO:3988 | SEQ ID NO:11999 TASSLQS SEQ ID NO:12000 | SEQ ID NO:20011 QQTYSTPLT SEQ ID NO:20012 |
| | 21-225_7E11.001.006 | NA | CGGGCAAGTCAAAACATTAT CAGCTATTTAAAT SEQ ID NO:3989 RASQNIISYLN SEQ ID NO:3990 | ACTGCATCCAGTTTGCAA AGT SEQ ID NO:12001 TASSLQS SEQ ID NO:12002 | CAACAGACTTACAGTACCCC GCTCACT SEQ ID NO:20013 QQTYSTPLT SEQ ID NO:20014 |
| iPS:442351 | 21-225_7E11.001.007 | NA AA | CGGGCAAGTCAAAACATTAT CAGCTATTTAAAT SEQ ID NO:3991 RASQNIISYLN SEQ ID NO:3992 | ACTGCATCCAGTTTGCAA AGT SEQ ID NO:12003 TASSLQS SEQ ID NO:12004 | CAACAGACTTACAGTACCCC GCTCACT SEQ ID NO:20015 QQTYSTPLT SEQ ID NO:20016 |
| iPS:442358 | 21-225_7E11.001.008 | NA AA | CGGGCAAGTCAAAACATTAT CAGCTATTTAAAT SEQ ID NO:3993 RASQNIISYLN SEQ ID NO:3994 | ACTGCATCCAGTTTGCAA AGT SEQ ID NO:12005 TASSLQS SEQ ID NO:12006 | CAACAGACTTACAGTACCCC GCTCACT SEQ ID NO:20017 QQTYSTPLT SEQ ID NO:20018 |
| iPS:442365 | 21-225_7E11.001.009 | NA AA | CGGGCAAGTCAAAACATTAT CAGCTATTTAAAT SEQ ID NO:3995 RASQNIISYLN SEQ ID NO:3996 | ACTGCATCCAGTTTGCAA AGT SEQ ID NO:12007 TASSLQS SEQ ID NO:12008 | CAACAGACTTACAGTACCCC GCTCACT SEQ ID NO:20019 QQTYSTPLT SEQ ID NO:20020 |
| iPS:442372 | 21-225_7E11.001.010 | NA AA | CGGGCAAGTCAAAACATTAT CAGCTATTTAAAT SEQ ID NO:3997 RASQNIISYLN SEQ ID NO:3998 | ACTGCATCCAGTTTGCAA AGT SEQ ID NO:12009 TASSLQS SEQ ID NO:12010 | CAACAGACTTACAGTACCCC GCTCACT SEQ ID NO:20021 QQTYSTPLT SEQ ID NO:20022 |
| iPS:442379 | | NA | CGGGCAAGTCAAAACATTAT CAGCTATTTAAAT | ACTGCATCCAGTTTGCAA AGT | CAACAGACTTACAGTACCCC GCTCACT |

FIGURE 49
(Continued)

| | | | | | | | |
|---|---|---|---|---|---|---|---|
| iPS:442386 | 21-225_7E11.001.011 | AA | SEQ ID NO:3999<br>RASQNIISYLN<br>SEQ ID NO:4000<br>CAGCTATTTAAAT | SEQ ID NO:12011<br>TASSLQS<br>SEQ ID NO:12012<br>ACTGCATCCAGTTTGCAA<br>AGT | SEQ ID NO:20023<br>QQTYSTPLT<br>SEQ ID NO:20024<br>CAACAGACTTACAGTACCCC<br>GCTCACT |
| | 21-225_7E11.001.012 | NA | SEQ ID NO:4001<br>RASQNIISYLN<br>SEQ ID NO:4002<br>CGGGCAAGTCAAAACATTAT<br>CAGCTATTTAAAT | SEQ ID NO:12013<br>TASSLQS<br>SEQ ID NO:12014<br>ACTGCATCCAGTTTGCAA<br>AGT | SEQ ID NO:20025<br>QQTYSTPLT<br>SEQ ID NO:20026<br>CAACAGACTTACAGTACCCC<br>GCTCACT |
| iPS:442390 | 21-225_7E11.001.013 | AA | SEQ ID NO:4003<br>RASQNIISYLN<br>SEQ ID NO:4004 | SEQ ID NO:12015<br>TASSLQS<br>SEQ ID NO:12016 | SEQ ID NO:20027<br>QQTYSTPLT<br>SEQ ID NO:20028 |
| | 21-225_7E11.001.014 | NA | SEQ ID NO:4005<br>RASQNIISYLN<br>SEQ ID NO:4006<br>CGGGCAAGTCAAAACATTAT<br>CAGCTATTTAAAT | SEQ ID NO:12017<br>TASSLQS<br>SEQ ID NO:12018<br>ACTGCATCCAGTTTGCAA<br>AGT | SEQ ID NO:20029<br>QQTYSTPLT<br>SEQ ID NO:20030<br>CAACAGACTTACAGTACCCC<br>GCTCACT |
| iPS:442394 | 21-225_7E11.001.015 | AA | SEQ ID NO:4007<br>RASQNIISYLN<br>SEQ ID NO:4008 | SEQ ID NO:12019<br>TASSLQS<br>SEQ ID NO:12020 | SEQ ID NO:20031<br>QQTYSTPLT<br>SEQ ID NO:20032 |
| iPS:442398 | 21-225_7E11.001.016 | NA | SEQ ID NO:4009<br>RASQNIISYLN<br>SEQ ID NO:4010<br>CGGGCAAGTCAAAACATTAT<br>CAGCTATTTAAAT | SEQ ID NO:12021<br>TASSLQS<br>SEQ ID NO:12022<br>ACTGCATCCAGTTTGCAA<br>AGT | SEQ ID NO:20033<br>QQTYSTPLT<br>SEQ ID NO:20034<br>CAACAGACTTACAGTACCCC<br>GCTCACT |
| iPS:442402 | | AA | | | |
| iPS:442406 | | NA | | | |

FIGURE 49
(Continued)

| | | | | | | | |
|---|---|---|---|---|---|---|---|
| iPS:442410 | 21-225_7E11.001.017 | AA | SEQ ID NO:4011 RASQNIISYLN SEQ ID NO:4012 | SEQ ID NO:12023 TASSLQS SEQ ID NO:12024 | SEQ ID NO:20035 QQTYSTPLT SEQ ID NO:20036 | | |
| | 21-225_7E11.001.018 | NA | CGGGCAAGTCAAAACATTAT CAGCTATTTAAAT SEQ ID NO:4013 | ACTGCATCCAGTTTGCAA AGT SEQ ID NO:12025 | CAACAGACTTACAGTACCCC GCTCACT SEQ ID NO:20037 | | |
| iPS:442417 | | AA | RASQNIISYLN SEQ ID NO:4014 | TASSLQS SEQ ID NO:12026 | QQTYSTPLT SEQ ID NO:20038 | | |
| | 21-225_7E11.001.019 | NA | CGGGCAAGTCAAAACATTAT CAGCTATTTAAAT SEQ ID NO:4015 | ACTGCATCCAGTTTGCAA AGT SEQ ID NO:12027 | CAACAGACTTACAGTACCCC GCTCACT SEQ ID NO:20039 | | |
| iPS:442431 | | AA | RASQNIISYLN SEQ ID NO:4016 | TASSLQS SEQ ID NO:12028 | QQTYSTPLT SEQ ID NO:20040 | | |
| | 21-225_7E11.001.021 | NA | CGGGCAAGTCAAAACATTAT CAGCTATTTAAAT SEQ ID NO:4017 | ACTGCATCCAGTTTGCAA AGT SEQ ID NO:12029 | CAACAGACTTACAGTACCCC GCTCACT SEQ ID NO:20041 | | |
| iPS:442438 | | AA | RASQNIISYLN SEQ ID NO:4018 | TASSLQS SEQ ID NO:12030 | QQTYSTPLT SEQ ID NO:20042 | | |
| | 21-225_7E11.001.022 | NA | CGGGCAAGTCAAAACATTAT CAGCTATTTAAAT SEQ ID NO:4019 | ACTGCATCCAGTTTGCAA AGT SEQ ID NO:12031 | CAACAGACTTACAGTACCCC GCTCACT SEQ ID NO:20043 | | |
| iPS:442568 | 21-225_149D8 | AA | RASQNIISYLN SEQ ID NO:4020 | TASSLQS SEQ ID NO:12032 | QQTYSTPLT SEQ ID NO:20044 | | |
| | | NA | AGGGCCAGTCAGAGTGTGAT CAGCAGCTACTTAGCC SEQ ID NO:4021 | GGTGTATCTAGTTGGGCC ACT SEQ ID NO:12033 | CAACAATATGGTAGGTCACC ATTCAAT SEQ ID NO:20045 | | |
| | | AA | RASQSVISSYLA SEQ ID NO:4022 | GVSSWAT SEQ ID NO:12034 | QQYGRSPFN SEQ ID NO:20046 | | |

FIGURE 49
(Continued)

| | | | | | |
|---|---|---|---|---|---|
| iPS:443003 | 21-225_43F11_LC2 | NA | ACTGGGAGCAGCTCCAACAT CGGGGCAGGTTATGATGTAC AC | GGTAACAGCAATCGGCC CTCA | CAGTCCTATGACAACAGCCT GAGTGGTTCGGTA |
| | | | SEQ ID NO:4023 | SEQ ID NO:12035 | SEQ ID NO:20047 |
| | | AA | TGSSSNIGAGYDVH | GNSNRPS | QSYDNSLSGSV |
| | | | SEQ ID NO:4024 | SEQ ID NO:12036 | SEQ ID NO:20048 |
| iPS:443005 | 21-225_43F11_LC1 | NA | AGGTCTAGTCAAAGCCTCGT ATACAGTGATGGAAACACCT ACTTGAAT | AAGGTTTCTAACTGGGA CTCT | ATGCAAGGTACACACTGGCC GCTCACT |
| | | | SEQ ID NO:4025 | SEQ ID NO:12037 | SEQ ID NO:20049 |
| | | AA | RSSQSLVYSDGNTYLN | KVSNWDS | MQGTHWPLT |
| | | | SEQ ID NO:4026 | SEQ ID NO:12038 | SEQ ID NO:20050 |
| iPS:443006 | 21-225_25A4.001.029 | NA | AAGTCCAGCCAGAGTGTTTT ATACAGCTCCCACAATAACA ACTACTTAGCT | TGGGCATCTACCCGGGA ATCC | CAGCAGTATTATAGTACTCC TCCGACG |
| | | | SEQ ID NO:4027 | SEQ ID NO:12039 | SEQ ID NO:20051 |
| | | AA | KSSQSVLYSSHNNNYLA | WASTRES | QQYYSTPPT |
| | | | SEQ ID NO:4028 | SEQ ID NO:12040 | SEQ ID NO:20052 |
| iPS:443016 | 21-225_4H6.014 | NA | CGGGCGAGTCAGGGTATTAG CAGGTGGTTAGCC | GGTGCATCCAGTTTGCA AAGT | CAACAGGCTAACAGTTTCCC ATTCACT |
| | | | SEQ ID NO:4029 | SEQ ID NO:12041 | SEQ ID NO:20053 |
| | | AA | RASQGISRWLA | GASSLQS | QQANSFPFT |
| | | | SEQ ID NO:4030 | SEQ ID NO:12042 | SEQ ID NO:20054 |
| iPS:443027 | 21-225_7E11.001.023 | NA | CGGGCAAGTCAAAACATTAT CAGCTATTTAAAT | ACTGCATCCAGTTTGCAA AGT | CAACAGACTTACAGTACCCC GCTCACT |
| | | | SEQ ID NO:4031 | SEQ ID NO:12043 | SEQ ID NO:20055 |
| | | AA | RASQNIISYLN | TASSLQS | QQTYSTPLT |
| | | | SEQ ID NO:4032 | SEQ ID NO:12044 | SEQ ID NO:20056 |

FIGURE 49
(Continued)

| | | | | | |
|---|---|---|---|---|---|
| iPS:446086 | 21-225_94D8 | NA | AAGTCCAGACAGAGTGTTT ATACAGCTCCAACAATTACA ACTACTTAACT<br>SEQ ID NO:4033 | TGGGCATCTACCCGGGA ATCC<br>SEQ ID NO:12045 | CAGCAATATTATAGTTCTCC TCCTACT<br>SEQ ID NO:20057 |
| | | AA | KSRQSVLYSSNNYNYLT<br>SEQ ID NO:4034 | WASTRES<br>SEQ ID NO:12046 | QQYYSSPPT<br>SEQ ID NO:20058 |
| iPS:446094 | 21-225_77E1 | NA | AAGTCCAGCCAGACTGTCTT ACACAGCTCCAACAATTATA ACTACTTAGCT<br>SEQ ID NO:4035 | TGGACATCTACCCGGGA ATCC<br>SEQ ID NO:12047 | CACCAATATCTTAGTAGTCC TCTGACG<br>SEQ ID NO:20059 |
| | | AA | KSSQTVLHSSNNYNYLA<br>SEQ ID NO:4036 | WTSTRES<br>SEQ ID NO:12048 | HQYLSSPLT<br>SEQ ID NO:20060 |
| iPS:448904 | 21-225_65C12 | NA | AGGGCCAGTCAGAGTGTTAG CATCAACTTAGCC<br>SEQ ID NO:4037 | GGTGCATCCACCAGGGC CACT<br>SEQ ID NO:12049 | CAGCAGTATAATACCTGGCC TCTCACT<br>SEQ ID NO:20061 |
| | | AA | RASQSVSINLA<br>SEQ ID NO:4038 | GASTRAT<br>SEQ ID NO:12050 | QQYNTWPLT<br>SEQ ID NO:20062 |
| iPS:448906 | 21-225_72G9 | NA | CGGGCAAGTCAGAGCATTAC CAGCTATTTAAAT<br>SEQ ID NO:4039 | ACTGCATCCAGTTTGCAA AGT<br>SEQ ID NO:12051 | CAACAGAGTCACAGTTTCCC ATTCACT<br>SEQ ID NO:20063 |
| | | AA | RASQSITSYLN<br>SEQ ID NO:4040 | TASSLQS<br>SEQ ID NO:12052 | QQHSFPFT<br>SEQ ID NO:20064 |
| iPS:448908 | 21-225_50G9 | NA | TCTGGAGATAAATTGGGGGA TAAATATGCTTGC<br>SEQ ID NO:4041 | CAAGATAGCAAGCGGCC CTCA<br>SEQ ID NO:12053 | CAGGCGCGGAACAGCCGCAG AGGGGTA<br>SEQ ID NO:20065 |
| | | AA | SGDKLGDKYAC<br>SEQ ID NO:4042 | QDSKRPS<br>SEQ ID NO:12054 | QARNSRRGV<br>SEQ ID NO:20066 |
| iPS:451102 | 21-225_45F6 | NA | TCTGGAGATAAATTGGGGGA TAAATATGCTTCC<br>SEQ ID NO:4043 | CAAGATAGTAAGCGGCC CTCA<br>SEQ ID NO:12055 | CAGGCGTGGGACAACAGAAC TATGGTA<br>SEQ ID NO:20067 |

FIGURE 49
(Continued)

| | | | | | | | |
|---|---|---|---|---|---|---|---|
| iPS:451104 | | AA | SGDKLGDKYAS | | QDSKRPS | | QAWDNRTMV |
| | | | SEQ ID NO:4044 | | SEQ ID NO:12056 | | SEQ ID NO:20068 |
| | 21-225_49C5 | NA | TCTGGAAGCAGCTCCAACAT CGGAAGTAATATTGTGACC | | AGTAATGATCAGCGGCC CTCA | | ACAGCATGGGATGACAGCCT GAATGGTTGGGTG |
| | | | SEQ ID NO:4045 | | SEQ ID NO:12057 | | SEQ ID NO:20069 |
| iPS:451106 | | AA | SGSSSNIGSNIVT | | SNDQRPS | | TAWDDSLNGWV |
| | | | SEQ ID NO:4046 | | SEQ ID NO:12058 | | SEQ ID NO:20070 |
| | 21-225_49D10 | NA | TCTGGAAGCAACTCCAACAT CGGAAGTAATATTGTAACC | | AGTAATGATCAGCGGCC CTCA | | GCAGCATGGGATGACAGCCT GAATGGTTGGGTG |
| | | | SEQ ID NO:4047 | | SEQ ID NO:12059 | | SEQ ID NO:20071 |
| iPS:451108 | | AA | SGSNSNIGSNIVT | | SNDQRPS | | AAWDDSLNGWV |
| | | | SEQ ID NO:4048 | | SEQ ID NO:12060 | | SEQ ID NO:20072 |
| | 21-225_53E8 | NA | TCTGGAAGCTGCTCCAACAT CGGAAGTAATATTGTGACC | | AGTAATGATCAGCGGCC CTCA | | ACAGCATGGGATGACAGCCT GAATGATTGGGTG |
| | | | SEQ ID NO:4049 | | SEQ ID NO:12061 | | SEQ ID NO:20073 |
| iPS:451110 | | AA | SGSCSNIGSNIVT | | SNDQRPS | | TAWDDSLNDWV |
| | | | SEQ ID NO:4050 | | SEQ ID NO:12062 | | SEQ ID NO:20074 |
| | 21-225_74C9 | NA | TCAGGAGATAAATCGGGGA ATAAATATGTTTCC | | CAAGATAACAGGCGGCC GTCA | | CAGGCGTGGGACAGCACCCC TGTGATA |
| | | | SEQ ID NO:4051 | | SEQ ID NO:12063 | | SEQ ID NO:20075 |
| iPS:451112 | | AA | SGDKSGNKYVS | | QDNRRPS | | QAWDSTPVI |
| | | | SEQ ID NO:4052 | | SEQ ID NO:12064 | | SEQ ID NO:20076 |
| | 21-225_53D10 | NA | TCTGGAGATAAATTGGGGAA TAAATATGCTTGC | | CAAGATCGCAAGCGGCC CTCA | | CAGGCGTGGGACAGCAGCAC TGTGGTA |
| | | | SEQ ID NO:4053 | | SEQ ID NO:12065 | | SEQ ID NO:20077 |
| | | AA | SGDKLGNKYAC | | QDRKRPS | | QAWDSSTVV |
| | | | SEQ ID NO:4054 | | SEQ ID NO:12066 | | SEQ ID NO:20078 |

FIGURE 49
(Continued)

| | | | | | |
|---|---|---|---|---|---|
| iPS:451114 | 21-225_159A3 | NA | CGGGCAAGTCAGGACATTAGI AAAGGATTTAGGC SEQ ID NO:4055 | GCTGCATCCAGTTGCAA AGT SEQ ID NO:12067 | CTACAGCATCATAGTTATCC TCGGACG SEQ ID NO:20079 |
| | | AA | RASQDIRKDLG SEQ ID NO:4056 | AASSLQS SEQ ID NO:12068 | LQHSYPRT SEQ ID NO:20080 |
| iPS:451116 | 21-225_164A4 | NA | AAGTCCAGCCAGAGTGTTT ATACAGCTCCAACAATAAGA ACTACTTAACT SEQ ID NO:4057 | TGGGCATCTACCCGGGA ATCC SEQ ID NO:12069 | CAGCAATATTTTAGTACTCC GTGGACG SEQ ID NO:20081 |
| | | AA | KSSQSVLYSSNNKNYLT SEQ ID NO:4058 | WASTRES SEQ ID NO:12070 | QQYFSTPWT SEQ ID NO:20082 |
| iPS:451118 | 21-225_191C8 | NA | AGGGCCAGTCAGAGTGTTCG CAGTAACTTAGCC SEQ ID NO:4059 | GGTGCATCCACCAGGGC CACT SEQ ID NO:12071 | CAGCAGTCTTTTACCTGGCT CCGGACG SEQ ID NO:20083 |
| | | AA | RASQSVRSNLA SEQ ID NO:4060 | GASTRAT SEQ ID NO:12072 | QQSFTWLRT SEQ ID NO:20084 |
| iPS:451120 | 21-225_197D3 | NA | CGGGCGAGTCAGGGCATTAG AAATTATTTAGCC SEQ ID NO:4061 | GCTGCATCCAGTTTGCAA AGT SEQ ID NO:12073 | CAACATTATCTACTTACCC GCTCACT SEQ ID NO:20085 |
| | | AA | RASQGIRNYLA SEQ ID NO:4062 | AASSLQS SEQ ID NO:12074 | QHYLTYPLT SEQ ID NO:20086 |
| iPS:451122 | 21-225_200A1 | NA | AGGGCCAGTCAGAGTGTTAA CAGCAACTATTTAGCC SEQ ID NO:4063 | GGGGCATCCAGCAGGGC CACT SEQ ID NO:12075 | CAGCAGTATGAGATCTCACC GTGGACG SEQ ID NO:20087 |
| | | AA | RASQSVNSNYLA SEQ ID NO:4064 | GASSRAT SEQ ID NO:12076 | QQYEISPWT SEQ ID NO:20088 |
| iPS:451124 | 21-225_74F6 | NA | AAGTCCAGTCAGAGAATATTT ATCCAGCTCCAACAACAATAAGA ACTACTTAACT SEQ ID NO:4065 | TGGACATCTACCCGGGA ATCC SEQ ID NO:12077 | CAGCAATATTTTAGTGTTCCT CTGACG SEQ ID NO:20089 |

FIGURE 49
(Continued)

| | | | | | | |
|---|---|---|---|---|---|---|
| iPS:451127 | 21-225_164A7 | AA | KSSQNILSSSNNKNYLT SEQ ID NO:4066 | WTSTRES SEQ ID NO:12078 | QQYFSVPLT SEQ ID NO:20090 |
| | | NA | AAGTCCAGCCAGAGTGTTT ACACAGCTCCAACAATAACA ACTACTTAGCT SEQ ID NO:4067 | TGGACATCTACCCGGGA ATCC SEQ ID NO:12079 | CAGCAATATTATAGTATTCC TCTGACG SEQ ID NO:20091 |
| iPS:451129 | 21-225_94D2 | AA | KSSQSVLHSSNNNNYLA SEQ ID NO:4068 | WTSTRES SEQ ID NO:12080 | QQYYSIPLT SEQ ID NO:20092 |
| | | NA | AAGTCCAGCCAGAGTGTTT ACACAGCTCCAACAATAAGA ACTACTTAACT SEQ ID NO:4069 | TGGGCATCTACTCGGGA ATCC SEQ ID NO:12081 | CAGCAATATCATAGTATTCC TCCGACG SEQ ID NO:20093 |
| iPS:451131 | 21-225_160A7 | AA | KSSQSVLHSSNNKNYLT SEQ ID NO:4070 | WASTRES SEQ ID NO:12082 | QQYHSIPPT SEQ ID NO:20094 |
| | | NA | AAGTCCAGCCAGAGTGTTT ATCCAACTCCCACAATAACA ACTACTTAGCT SEQ ID NO:4071 | TGGGCATCTACCCGGGA ATCC SEQ ID NO:12083 | CAGCAATATTATAGTACTCC GTGCAGT SEQ ID NO:20095 |
| iPS:451133 | 21-225_95H4 | AA | KSSQSVLSNSHNNNYLA SEQ ID NO:4072 | WASTRES SEQ ID NO:12084 | QQYYSTPCS SEQ ID NO:20096 |
| | | NA | AAGTCCAGCCAGAGTGTTT ATTCAGCTCCAACAATTATA ATTACTTAGCT SEQ ID NO:4073 | TGGGCATCTACCCGGGA ATCC SEQ ID NO:12085 | CAGCAATATCATAGTTCTCC TCTGACG SEQ ID NO:20097 |
| iPS:437240 | 21-225_84H12 | AA | KSSQSVLFSSNNYNYLA SEQ ID NO:4074 | WASTRES SEQ ID NO:12086 | QQYHSSPLT SEQ ID NO:20098 |
| | | NA | CGGGCAAGTCAGGGCATTAG AAATGATTTAGGC SEQ ID NO:4075 | GCTGCATCCAGTTTGCAA AGT SEQ ID NO:12087 | TTACAGCATAATGATTACCC ATTCACT SEQ ID NO:20099 |
| | | AA | RASQGIRNDLG | AASSLQS | LQHNDYPFT |

FIGURE 49
(Continued)

| | | | | | | |
|---|---|---|---|---|---|---|
| iPS:434577 | 21-225_75C11 | NA | SEQ ID NO:4076 CGGGCAAGTCAGGGCATTAG AAATGATTAGGC | SEQ ID NO:12088 GCTGCATCCAGTTTGCAA AGT | SEQ ID NO:20100 CTACAGCATAATGATTACCC ATTCACT |
| | | AA | SEQ ID NO:4077 RASQGIRNDLG | SEQ ID NO:12089 AASSLQS | SEQ ID NO:20101 LQHNDYPFT |
| iPS:435477 | 21-225_154E8 | NA | SEQ ID NO:4078 CGGGGCGAGTCAGTTTATTAG CAGCTGGTTAGCC | SEQ ID NO:12090 ACTGCATCCAGTTTGCAA AGT | SEQ ID NO:20102 CAACAGGCTAACAGTTTCCC GTGGACG |
| | | AA | SEQ ID NO:4079 RASQFISSWLA | SEQ ID NO:12091 TASSLQS | SEQ ID NO:20103 QQANSFPWT |
| iPS:434553 | 21-225_76H12 | NA | SEQ ID NO:4080 CGGGCAAGTCAGGGCATTAG AAATGATTAGGC | SEQ ID NO:12092 GCTGCATCCAGATTGCA AAGT | SEQ ID NO:20104 CTACAGCATAATGATTACCC ATTCACT |
| | | AA | SEQ ID NO:4081 RASQGIRNDLG | SEQ ID NO:12093 AASRLQS | SEQ ID NO:20105 LQHNDYPFT |
| iPS:434927 | 21-225_86E5 | NA | SEQ ID NO:4082 CGGGCAAGTCAGGGCATTAG AAATGATTAGGC | SEQ ID NO:12094 GCTGCATCCAGTTTGCAA AGT | SEQ ID NO:20106 CTACAGCATAATGATTACCC ATTCACT |
| | | AA | SEQ ID NO:4083 RASQGIRNDLG | SEQ ID NO:12095 AASSLQS | SEQ ID NO:20107 LQHNDYPFT |
| iPS:435385 | 21-225_149G7 | NA | SEQ ID NO:4084 CGGGCGAGTCAGTTTATTAG CAGCTGGTTAGCC | SEQ ID NO:12096 GCTGCATCCAGTTTGCAA AGT | SEQ ID NO:20108 CAACAGGCTAACAGTTTCCC GTGGACG |
| | | AA | SEQ ID NO:4085 RASQFISSWLA | SEQ ID NO:12097 AASSLQS | SEQ ID NO:20109 QQANSFPWT |
| | | | SEQ ID NO:4086 | SEQ ID NO:12098 | SEQ ID NO:20110 |

Table 2B

FIGURE 49
(Continued)

Standard
IgG Antibody
VH CDRs

| iPS# | Ab | Type | CDR1 | CDR2 | CDR3 |
|---|---|---|---|---|---|
| iPS:451135 | 21-225_64A11 | NA | AACTATGGCATGCAC | GTTATATCATATGTTGGAAGTAATAAATACTATGCAGACTCCGTGAAGGGC | AGAGGAGCAGTGGCTCCGTACTACGGTATGGACGTC |
| | | | SEQ ID NO:4087 | SEQ ID NO:12099 | SEQ ID NO:20111 |
| | | AA | NYGMH | VISYYGSNKYYADSVKG | RGAVAPYYGMDV |
| iPS:451141 | 21-225_164B11 | NA | SEQ ID NO:4088 | SEQ ID NO:12100 | SEQ ID NO:20112 |
| | | | AATTATGATATCAAC | TGGATGACCCCTAACAGTGGTAACACAGGCTATGCACAGAAGTTCCAGGGC | AGCAGTGGCTGGTACATGTTTGACTAC |
| | | | SEQ ID NO:4089 | SEQ ID NO:12101 | SEQ ID NO:20113 |
| | | AA | NYDIN | WMTPNSGNTGYAQKFQG | SSGWYMFDY |
| iPS:451137 | 21-225_74A7 | NA | SEQ ID NO:4090 | SEQ ID NO:12102 | SEQ ID NO:20114 |
| | | | AATTATGATATCAAC | TGGATGAACCCTAACAGTGGTAACACAGGCTATGCACAGAAGTTCCAGGGC | TCCAGTGGCTGGAACTGGTTCGACCCC |
| | | | SEQ ID NO:4091 | SEQ ID NO:12103 | SEQ ID NO:20115 |
| | | AA | NYDIN | WMNPNSGNTGYAQKFQG | SSGWNWFDP |
| iPS:451139 | 21-225_71A6 | NA | AACTATGGCATGCAC | GTTATATCATATGATGGAAGTAATGAATACTATGCAGACTCCGTGAAGGGC | SEQ ID NO:20116 GATCACAGATATGGGGTTCGGGGAGGCTTTGACTAC |
| | | | SEQ ID NO:4092 | SEQ ID NO:12104 | SEQ ID NO:20117 |
| | | AA | NYGMH | VISYDGSNEYYADSVKG | DHRYGVRGGFDY |
| | | | SEQ ID NO:4093 | SEQ ID NO:12105 | |

FIGURE 49
(Continued)

| | | | | | |
|---|---|---|---|---|---|
| iPS:451143 | 21-225_66H11 | NA | SEQ ID NO:4094 ACCTATGGTATCAGC | SEQ ID NO:12106 TGGATCAGCGCTTACAA TGGTAACACAAACTATG CACAGAAGCTCCAGGGC | SEQ ID NO:20118 GGGGAAGCAGTGGCTGTCTT CGACCCC |
| | | AA | SEQ ID NO:4095 TYGIS | SEQ ID NO:12107 WISAYNGNTNYAQKLQG | SEQ ID NO:20119 GEAVAVFDP |
| iPS:453445 | 21-225_148E10 | NA | SEQ ID NO:4096 AGCTATGGCATGCAC | SEQ ID NO:12108 GTTATATGGTTTGATGGC AGTAATAAATACTATGT AGACTCCGTGAAGGAC | SEQ ID NO:20120 GATCGGGTGGAGGGTTCGGG GACTCCCTACTACTACTACG GTATGGACGTC |
| | | AA | SEQ ID NO:4097 SYGMH | SEQ ID NO:12109 VIWFDGSNKYYVDSVKD | SEQ ID NO:20121 DRVEGSGTPYYYYGMDV |
| iPS:453447 | 21-225_65F10 | NA | SEQ ID NO:4098 GGCTACCATATGCAC | SEQ ID NO:12110 TGGATCAACCCTAACAA TGGTGGCACAAGCTATG CACAGAAGTTTCAGGAC | SEQ ID NO:20122 GATAGTAGGTCGTCCTGGGA CTAC |
| | | AA | SEQ ID NO:4099 GYHMH | SEQ ID NO:12111 WINPNNGGTSYAQKFQD | SEQ ID NO:20123 DSRSSWDY |
| iPS:453449 | 21-225_208A2 | NA | SEQ ID NO:4100 AGTTACTACTGGAGC | SEQ ID NO:12112 CGTATCTATACCAGTGG GAGCACCGACTACAACC CCTCCCTCAAGAGT | SEQ ID NO:20124 GGGTTCGGTGACTGGGACTA C |
| | | AA | SEQ ID NO:4101 SYYWS | SEQ ID NO:12113 RIYTSGSTDYNPSLKS | SEQ ID NO:20125 GFGDWDY |
| | | | SEQ ID NO:4102 | SEQ ID NO:12114 | SEQ ID NO:20126 |

FIGURE 49
(Continued)

| | | | | |
|---|---|---|---|---|
| iPS:453451 | | NA | GGCTACTATTTGCAC | TGGATCAACCCTAATAG AAATGGCACAAACTATG CACAGAAGTTTCAGGGC | GACGGTACCAGCAGCTTTGA CTAC |
| | 21-225_52G11 | | SEQ ID NO:4103 | SEQ ID NO:12115 | SEQ ID NO:20127 |
| | | AA | GYYLH | WINPNRNGTNYAQKFQG | DGTSSFDY |
| | | | SEQ ID NO:4104 | SEQ ID NO:12116 | SEQ ID NO:20128 |
| iPS:453453 | | NA | GGCTACTATTTGCAC | TGGATCAACCCTAACAG AAATGGCACAAACTATG CACAGAATTTTCAGGGC | GACGGTACCAGTAGCTTTGA CTAC |
| | 21-225_53F2 | | SEQ ID NO:4105 | SEQ ID NO:12117 | SEQ ID NO:20129 |
| | | AA | GYYLH | WINPNRNGTNYAQNFQG | DGTSSFDY |
| | | | SEQ ID NO:4106 | SEQ ID NO:12118 | SEQ ID NO:20130 |
| iPS:468810 | | NA | GGTTGCTACTGGAGC | GAAATCAATTATAGTGG AAGGACCAACTTCAACC CGTCCCTCAAGAGT | GACTACGGCGGTATGGACGT C |
| | 21-225_74D5 | | SEQ ID NO:4107 | SEQ ID NO:12119 | SEQ ID NO:20131 |
| | | AA | GCYWS | EINYSGRTNFNPSLKS | DYGGMDV |
| | | | SEQ ID NO:4108 | SEQ ID NO:12120 | SEQ ID NO:20132 |
| iPS:468812 | | NA | GACTCTCTCATGCAC | GTTATATGGTATGATGG AAGTAATAAATACTATA CAGACTCCGTTAAGGGC | GAAAACTATAGCAGTGGCTG GTACGGGTACGGTATGGACG TC |
| | 21-225_48H4 | | SEQ ID NO:4109 | SEQ ID NO:12121 | SEQ ID NO:20133 |
| | | AA | DSLMH | VIWYDGSNKYYTDSVKG | ENYSSGWYGYGMDV |
| | | | SEQ ID NO:4110 | SEQ ID NO:12122 | SEQ ID NO:20134 |

FIGURE 49
(Continued)

| | | | | | |
|---|---|---|---|---|---|
| iPS:468816 | 21-225_52G8 | NA | AGCTATGGCATGCAC | GTTATATGGTATGATGG AAGTAATAAATACTATG CAGACTCCGTGAAGGGC | AGGTATAGCAGCAGCTGGTC GGGCGGTATGGACGTC |
| | | | SEQ ID NO:4111 | SEQ ID NO:12123 | SEQ ID NO:20135 |
| | | AA | SYGMH | VIWYDGSNKYYADSVKG | RYSSSWSGGMDV |
| | | | SEQ ID NO:4112 | SEQ ID NO:12124 | SEQ ID NO:20136 |
| iPS:468814 | 21-225_223D11 | NA | AACTATGGCATGGAC | GTTATATGGTATGATGG AAGTAATGACTACTATG CAGACTCCGTGAAGGGC | GATCGGGGGATCGGGTACAA CGATATGGACGTC |
| | | | SEQ ID NO:4113 | SEQ ID NO:12125 | SEQ ID NO:20137 |
| | | AA | NYGMD | VIWYDGSNDYYADSVKG | DRGIGYNDMDV |
| | | | SEQ ID NO:4114 | SEQ ID NO:12126 | SEQ ID NO:20138 |
| iPS:468822 | 21-225_147E10 | NA | AACTATGGCTTACAC | ATTATATGGTATGATGG AAGTAATAAATACTATG CAGACTCCGTGAAGGGC | GATCATTACGATTTTGAG TGGTCACTTTGACTAC |
| | | | SEQ ID NO:4115 | SEQ ID NO:12127 | SEQ ID NO:20139 |
| | | AA | NYGLH | IIWYDGSNKYYADSVKG | DHYDFWSGHFDY |
| | | | SEQ ID NO:4116 | SEQ ID NO:12128 | SEQ ID NO:20140 |
| iPS:468824 | 21-225_73G6 | NA | AGCTATGGCATGCAC | GTTATATGGTATGATGTA AGTAATAAATACTATGG AGACTCCGTGAAGGGC | GAAGTGGGGATGACTTCTGA CTAC |
| | | | SEQ ID NO:4117 | SEQ ID NO:12129 | SEQ ID NO:20141 |
| | | AA | SYGMH | VIWYDVSNKYYGDSVKG | EVGMTSDY |
| | | | SEQ ID NO:4118 | SEQ ID NO:12130 | SEQ ID NO:20142 |

FIGURE 49
(Continued)

| iPS:468818 | 21-225_190C8 | NA | AGTTATGATATCAAC | | TGGATGAACCCTAAAAG GGGTAACACAGGCTATG CACAGAAGTTCCAGGGC | GGAGACCCGTATAACTGGAA CTCCTACGCTATGGACGTC |
|---|---|---|---|---|---|---|
| | | | SEQ ID NO:4119 | | SEQ ID NO:12131 | SEQ ID NO:20143 |
| | | AA | SYDIN | | WMNPKRGNTGYAQKFQG | GDPYNWNSYAMDV |
| | | | SEQ ID NO:4120 | | SEQ ID NO:12132 | SEQ ID NO:20144 |
| iPS:468826 | 21-225_201C5 | NA | GACTATGTCATGCAC | | GTTATATGGTATGATGG AAGTAATAAATACTATG TAGACTCCGTGAAGGGC | GAACGGTATAGCAGTGGCTT GTACGACTACGGTATGGACG TC |
| | | | SEQ ID NO:4121 | | SEQ ID NO:12133 | SEQ ID NO:20145 |
| | | AA | DYVMH | | VIWYDGSNKYYVDSVKG | ERYSSGLYDYGMDV |
| | | | SEQ ID NO:4122 | | SEQ ID NO:12134 | SEQ ID NO:20146 |
| iPS:468828 | 21-225_162A10 | NA | AGCTGTGGCATGCAC | | GCTATATGGTATGATGG AAGCAATAAATACTATG CAGACTCCGTGAAGGGC | GACAAAATATAATGGGAGA TACTTGGTTTGACTTC |
| | | | SEQ ID NO:4123 | | SEQ ID NO:12135 | SEQ ID NO:20147 |
| | | AA | SCGMH | | AIWYDGSNKYYADSVKG | DKNIMGDTWFDF |
| | | | SEQ ID NO:4124 | | SEQ ID NO:12136 | SEQ ID NO:20148 |
| iPS:468830 | 21-225_191G11 | NA | GGCTACTATATGCAC | | TGGATCAACCCTAATAG TGGTGGCACAAACTTTG CACAGAAGTTTCAGGGC | GGAAAGAACTATGGCTCCTA CTTTGACTAC |
| | | | SEQ ID NO:4125 | | SEQ ID NO:12137 | SEQ ID NO:20149 |
| | | AA | GYYMH | | WINPNSGGTNFAQKFQG | GKNYGSYFDY |
| | | | SEQ ID NO:4126 | | SEQ ID NO:12138 | SEQ ID NO:20150 |

FIGURE 49
(Continued)

| | | | | | |
|---|---|---|---|---|---|
| iPS:468832 | 21-225_76H10 | NA | GGTTGCTACTGGAGC | GAAATCAATTATAGTGG AAGGACCAACTTCAACC CGTCCCTCAAGAGT | GACTACGGCGGTATGGACGT C |
| | | | SEQ ID NO:4127 | SEQ ID NO:12139 | SEQ ID NO:20151 |
| | | AA | GCYWS | EINYSGRTNFNPSLKS | DYGGMDV |
| | | | SEQ ID NO:4128 | SEQ ID NO:12140 | SEQ ID NO:20152 |
| iPS:468834 | 21-225_94G10 | NA | GGTTGCTACTGGAGC | GAAATCAATTATAGTGG AAGGACCAACTTCAACC CGTCCCTCAAGAGT | GACTACGGCGGTATGGACGT C |
| | | | SEQ ID NO:4129 | SEQ ID NO:12141 | SEQ ID NO:20153 |
| | | AA | GCYWS | EINYSGRTNFNPSLKS | DYGGMDV |
| | | | SEQ ID NO:4130 | SEQ ID NO:12142 | SEQ ID NO:20154 |
| iPS:468836 | 21-225_198E3 | NA | AGCTATGGCATGCAC | GTTATATCATATGATGGA GGTTATAAAACTATGC AGACTCCGTGAAGGGC | GGTACCCACGGGTACTACTA CGGTGTGGACGTC |
| | | | SEQ ID NO:4131 | SEQ ID NO:12143 | SEQ ID NO:20155 |
| | | AA | SYGMH | VISYDGGYKNYADSVKG | GTHGYYYGVDV |
| | | | SEQ ID NO:4132 | SEQ ID NO:12144 | SEQ ID NO:20156 |
| iPS:468838 | 21-225_80E12 | NA | GGTTGCTACTGGAGC | GAAATCAATTATAGTGG AAGGACCAACTTCAACC CGTCCCTCAAGAGT | GACTACGGCGGTATGGACGT C |
| | | | SEQ ID NO:4133 | SEQ ID NO:12145 | SEQ ID NO:20157 |
| | | AA | GCYWS | EINYSGRTNFNPSLKS | DYGGMDV |
| | | | SEQ ID NO:4134 | SEQ ID NO:12146 | SEQ ID NO:20158 |
| iPS:468840 | 21-225_200H9 | NA | AGTGGTGGTGTGACTACTGGAG C | TACATCTATTACAGTGGG AGCACCTACTACAACCC GTCCCTCAAGAGT | ATGGACTACAGTAACTACTA CTACGGTATGGACGTC |
| | | | SEQ ID NO:4135 | SEQ ID NO:12147 | SEQ ID NO:20159 |
| | | AA | SGGDYWS | YIYYSGSTYYNPSLKS | MDYSNYYYGMDV |
| | | | SEQ ID NO:4136 | SEQ ID NO:12148 | SEQ ID NO:20160 |

FIGURE 49
(Continued)

| | | | | | |
|---|---|---|---|---|---|
| iPS:468820 | 21-225_76E10 | NA | GGTTCCTACTGGAGC | GAAATCAATTATAGTGG AAGGACCAACTTCAACC CGTCCCTCAAGAGT | GACTACGGCGGTATGGACGT C |
| | | | SEQ ID NO:4137 | SEQ ID NO:12149 | SEQ ID NO:20161 |
| | | AA | GSYWS | EINYSGRTNFNPSLKS | DYGGMDV |
| | | | SEQ ID NO:4138 | SEQ ID NO:12150 | SEQ ID NO:20162 |
| iPS:468842 | 21-225_50H4 | NA | AGCTATGTCATGCAC | GCTATATGGTATGATGG AAGTAATAAATACTATG CAGACTCCGTGAAGGGC | GAGTTGTATAGCAGCAACTG GTACGACTACGGTATGGACG TC |
| | | | SEQ ID NO:4139 | SEQ ID NO:12151 | SEQ ID NO:20163 |
| | | AA | SYVMH | AIWYDGSNKYYADSVKG | ELYSSNWYDYGMDV |
| | | | SEQ ID NO:4140 | SEQ ID NO:12152 | SEQ ID NO:20164 |
| iPS:468844 | 21-225_48E10 | NA | AGCTATAACATGAAC | TCCATTAGTGGTAGTAGT AGTTACATATACTACGC AGACTCAGTGAAGGGC | AGCCTCGACCTC |
| | | | SEQ ID NO:4141 | SEQ ID NO:12153 | SEQ ID NO:20165 |
| | | AA | SYNMN | SISGSSSYIYYADSVKG | SLDL |
| | | | SEQ ID NO:4142 | SEQ ID NO:12154 | SEQ ID NO:20166 |
| iPS:468846 | 21-225_53B10 | NA | AGCTATAGCCATGAGC | TCCATTAGTGGTAGTAGC AGTTACATATACTACGTA GACTCAGTGAAGGGC | GTCAACTCTTTGACTCC |
| | | | SEQ ID NO:4143 | SEQ ID NO:12155 | SEQ ID NO:20167 |
| | | AA | SYSMS | SISGSSSYIYYVDSVKG | VNSFDS |
| | | | SEQ ID NO:4144 | SEQ ID NO:12156 | SEQ ID NO:20168 |
| iPS:468848 | 21-225_54B1 | NA | AGCTATGCCATGAGC | GTTCTTAGTGGTAGTGGT GGTAGCACATTCTACGC AGACTCCGTGAAGGGC | AGAGGCCGTGAATATAGTGG CTACGATTACTTTGACTAC |
| | | | SEQ ID NO:4145 | SEQ ID NO:12157 | SEQ ID NO:20169 |

FIGURE 49
(Continued)

| | | | | | | |
|---|---|---|---|---|---|---|
| iPS:468850 | | AA | SYAMS | | VLSGSGGSTFYADSVKG | RGREYSGYDYFDY |
| | | | SEQ ID NO:4146 | | SEQ ID NO:12158 | SEQ ID NO:20170 |
| | 21-225_63F4 | NA | AATTATGATGTCAAC | | TGGATGCACCCTAACAG TGGTAACACAGGCTATG CACAGAAGTTCCGGGGC | AGCAGTGGCTGGTACGTTTT TGACTAC |
| | | | SEQ ID NO:4147 | | SEQ ID NO:12159 | SEQ ID NO:20171 |
| | | AA | NYDVN | | WMHPNSGNTGYAQKFRG | SSGWYVFDY |
| iPS:468852 | | | SEQ ID NO:4148 | | SEQ ID NO:12160 | SEQ ID NO:20172 |
| | 21-225_71F3 | NA | AATTATGATGTCAAC | | TGGATGCACCCTAACAG TGGTAACACAGGCTATG CACAGAAGTTCCAGGGC | AGCAGTGGCTGGTACGTTTT TGACTCC |
| | | | SEQ ID NO:4149 | | SEQ ID NO:12161 | SEQ ID NO:20173 |
| | | AA | NYDVN | | WMHPNSGNTGYAQKFQG | SSGWYVFDS |
| iPS:468854 | | | SEQ ID NO:4150 | | SEQ ID NO:12162 | SEQ ID NO:20174 |
| | 21-225_72C4 | NA | AATTATGATATCAAC | | TGGATGCACCCTAACAG TGGTAACACAGGCTATG CACAGAAGTTCCAGGGC | AGCAGTGGCTGGTACCTCTT TGACTAC |
| | | | SEQ ID NO:4151 | | SEQ ID NO:12163 | SEQ ID NO:20175 |
| | | AA | NYDIN | | WMHPNSGNTGYAQKFQG | SSGWYLFDY |
| iPS:468856 | | | SEQ ID NO:4152 | | SEQ ID NO:12164 | SEQ ID NO:20176 |
| | 21-225_77C9 | NA | AGGAGTAGTTACTACTGGGG C | | AGTATCTATTATAGTGGG AGCGCCTACTCCAACCC GTCCCTCAAGAGT | CTTGACTCTAACTGGGGTCT TGACTAC |
| | | | SEQ ID NO:4153 | | SEQ ID NO:12165 | SEQ ID NO:20177 |
| | | AA | RSSYYWG | | SIYYSGSAYSNPSLKS | LDSNWGLDY |
| | | | SEQ ID NO:4154 | | SEQ ID NO:12166 | SEQ ID NO:20178 |

FIGURE 49
(Continued)

| | | | | |
|---|---|---|---|---|
| iPS:468858 | 21-225_148C9 | NA | GACTATGGCATGCAC | GTTATATGGTATGATGG AAGTAATAAGTACTATG CAGACTCCGTGAAGGGC | GAGAGGTATAGCAGTGGCTG GTACGACTACGGTTTGGACG TC |
| | | | SEQ ID NO:4155 | SEQ ID NO:12167 | SEQ ID NO:20179 |
| | | AA | DYGMH | VIWYDGSNKYYADSVKG | ERYSSGWYDYGLDV |
| | | | SEQ ID NO:4156 | SEQ ID NO:12168 | SEQ ID NO:20180 |
| iPS:468860 | 21-225_224E7 | NA | AGCTATGTCATGCAC | GTTATATGGTATGATGG AAGTAATAAATACTATG CAGACTCCGTGAAGGGC | GAACAGTATAGCAGCAGCTG GTACGACTTCGGTCTGGACG TC |
| | | | SEQ ID NO:4157 | SEQ ID NO:12169 | SEQ ID NO:20181 |
| | | AA | SYVMH | VIWYDGSNKYYADSVKG | EQYSSSWYDFGLDV |
| | | | SEQ ID NO:4158 | SEQ ID NO:12170 | SEQ ID NO:20182 |
| iPS:468862 | 21-225_178H8 | NA | GACTATTATATGCAC | TGGATCAACCCTAACAG AGGTGGCACAAACTATG CTCAGAAGTTTCAGGGC | GAGGAGGATCGCAGTGGCTG GTACTACTACGGTATGG ACGTC |
| | | | SEQ ID NO:4159 | SEQ ID NO:12171 | SEQ ID NO:20183 |
| | | AA | DYYMH | WINPNRGGTNYAQKFQG | EEDRSGWYYYYGMDV |
| | | | SEQ ID NO:4160 | SEQ ID NO:12172 | SEQ ID NO:20184 |
| iPS:468864 | 21-225_60D6 | NA | ACTAGTGGAGTGGGTGTGGG C | CTCATTTATTGGAAAGAT GATGAGCGCTACAGCCC ATCTCTGAAGAGC | GCAGTGGCTGTCTCCTTTGA CTAC |
| | | | SEQ ID NO:4161 | SEQ ID NO:12173 | SEQ ID NO:20185 |
| | | AA | TSGVGVG | LIYWKDDERYSPSLKS | AVAVSFDY |
| | | | SEQ ID NO:4162 | SEQ ID NO:12174 | SEQ ID NO:20186 |
| iPS:468866 | 21_225_190C1 | NA | GGCTACTATATGCAC | TGGATCAACCCTTACAGT GGTGGCACAAACTATGC ACAGAAGTTTCAGGGC | GATAGAGCAGTGGCTGGAAA CTACTTCTACTACGGTATGG ACGTC |

FIGURE 49
(Continued)

| | | | | | |
|---|---|---|---|---|---|
| iPS:468868 | 21-225_190C1 | AA | SEQ ID NO:4163<br>GYYMH | SEQ ID NO:12175<br>WINPYSGGTNYAQKFQG | SEQ ID NO:20187<br>DRAVAGNYFYYGMDV |
| | | NA | SEQ ID NO:4164<br>GGTAGTAGTTACTACTGGGGC | SEQ ID NO:12176<br>AATATCTATTATAGTGGGAGCACCTACCACAACCCGTCCCTCAAGAGT | SEQ ID NO:20188<br>CATGATTACTTTGGTCCCTTGACTTC |
| iPS:468870 | 21-225_74A1 | AA | SEQ ID NO:4165<br>GSSYYWG | SEQ ID NO:12177<br>NIYYSGSTYHNPSLKS | SEQ ID NO:20189<br>HDLLWSLDF |
| | | NA | SEQ ID NO:4166<br>AATTATGATATCAAC | SEQ ID NO:12178<br>TGGATGCACCCTAACAGTGGTAACACAGGCTATGCACAGAAGTTCCAGGGC | SEQ ID NO:20190<br>AGTAGTGGCTGGTACAAATTTGACTAC |
| | 21-225_74A8 | AA | SEQ ID NO:4167<br>NYDIN | SEQ ID NO:12179<br>WMHPNSGNTGYAQKFQG | SEQ ID NO:20191<br>SSGWYKFDY |
| iPS:472730 | 21-225_14B1_LC1 | NA | SEQ ID NO:4168<br>AGCTATACCATGAAC | SEQ ID NO:12180<br>TCCATAAGTGGTAGTAGTAGTTACTTATACTACCCAGACTCAGTGAAGGGC | SEQ ID NO:20192<br>GATAGAGGCAGCAGC |
| | | AA | SEQ ID NO:4169<br>SYTMN | SEQ ID NO:12181<br>SISGSSSYLYYPDSVKG | SEQ ID NO:20193<br>DRGSS |
| iPS:472731 | 21-225_14B1_LC2 | NA | SEQ ID NO:4170<br>AGCTATACCATGAAC | SEQ ID NO:12182<br>TCCATAAGTGGTAGTAGTAGTTACTTATACTACCCAGACTCAGTGAAGGGC | SEQ ID NO:20194<br>GATAGAGGCAGCAGC |
| | | AA | SEQ ID NO:4171<br>SYTMN | SEQ ID NO:12183<br>SISGSSSYLYYPDSVKG | SEQ ID NO:20195<br>DRGSS |
| | | | SEQ ID NO:4172 | SEQ ID NO:12184 | SEQ ID NO:20196 |

FIGURE 49
(Continued)

| | | | | | |
|---|---|---|---|---|---|
| iPS:472732 | 21-225_2B10_LC1 | NA | AGCTATGTCATGCAC | GTTATATGGTATGATGG AAGTAATAAATACTATG CAGACTCCGTGAAGGTC | GAGAGATATACCAGTGGCTG GTATGACTACGGTATGGACG TC |
| | | | SEQ ID NO:4173 | SEQ ID NO:12185 | SEQ ID NO:20197 |
| | | AA | SYVMH | VIWYDGSNKYYADSVKV | ERYTSGWYDYGMDV |
| | | | SEQ ID NO:4174 | SEQ ID NO:12186 | SEQ ID NO:20198 |
| iPS:472733 | 21-225_2B10_LC2 | NA | AGCTATGTCATGCAC | GTTATATGGTATGATGG AAGTAATAAATACTATG CAGACTCCGTGAAGGTC | GAGAGATATACCAGTGGCTG GTATGACTACGGTATGGACG TC |
| | | | SEQ ID NO:4175 | SEQ ID NO:12187 | SEQ ID NO:20199 |
| | | AA | SYVMH | VIWYDGSNKYYADSVKV | ERYTSGWYDYGMDV |
| | | | SEQ ID NO:4176 | SEQ ID NO:12188 | SEQ ID NO:20200 |
| iPS:473253 | 21-225_7C3_LC1 | NA | GACTACTATTTGCAC | TGGATCCACCCTAACAG TGGTGGCACAAACTATG CACAGAAGTTTCAGGGC | GATGGTACCAGCTCGTTTGA CTAC |
| | | | SEQ ID NO:4177 | SEQ ID NO:12189 | SEQ ID NO:20201 |
| | | AA | DYYLH | WIHPNSGGTNYAQKFQG | DGTSSFDY |
| | | | SEQ ID NO:4178 | SEQ ID NO:12190 | SEQ ID NO:20202 |
| iPS:473254 | 21-225_7C3_LC2 | NA | GACTACTATTTGCAC | TGGATCCACCCTAACAG TGGTGGCACAAACTATG CACAGAAGTTTCAGGGC | GATGGTACCAGCTCGTTTGA CTAC |
| | | | SEQ ID NO:4179 | SEQ ID NO:12191 | SEQ ID NO:20203 |
| | | AA | DYYLH | WIHPNSGGTNYAQKFQG | DGTSSFDY |
| | | | SEQ ID NO:4180 | SEQ ID NO:12192 | SEQ ID NO:20204 |

FIGURE 49
(Continued)

| | | | | | | |
|---|---|---|---|---|---|---|
| iPS:473255 | 21-225_9F12_LC1 | NA | GACTACTATTTGCAC | | TGGATCCACCCTAACAG TGGTGGCACAAACTTTG CACAGAAGTTTCAGGGC | GATGGTACCAGCTCGTTTGA CTAC |
| | | | SEQ ID NO:4181 | | SEQ ID NO:12193 | SEQ ID NO:20205 |
| | | AA | DYYLH | | WIHPNSGGTNFAQKFQG | DGTSSFDY |
| | | | SEQ ID NO:4182 | | SEQ ID NO:12194 | SEQ ID NO:20206 |
| iPS:473256 | 21-225_9F12_LC2 | NA | GACTACTATTTGCAC | | TGGATCCACCCTAACAG TGGTGGCACAAACTTTG CACAGAAGTTTCAGGGC | GATGGTACCAGCTCGTTTGA CTAC |
| | | | SEQ ID NO:4183 | | SEQ ID NO:12195 | SEQ ID NO:20207 |
| | | AA | DYYLH | | WIHPNSGGTNFAQKFQG | DGTSSFDY |
| | | | SEQ ID NO:4184 | | SEQ ID NO:12196 | SEQ ID NO:20208 |
| iPS:472742 | 21-225_30D9_LC2 | NA | GGCTACTATCTGCAC | | TGGATCAACCCTAACAG TGGTGGCACAAACTATG CACAGAAGTTTCAGGGC | GTGTATTACTATGGTTCGGG GAGTTATTATAACGAGTTTG ACAAC |
| | | | SEQ ID NO:4185 | | SEQ ID NO:12197 | SEQ ID NO:20209 |
| | | AA | GYYLH | | WINPNSGGTNYAQKFQG | VYYYGSGSYYNEFDN |
| | | | SEQ ID NO:4186 | | SEQ ID NO:12198 | SEQ ID NO:20210 |
| iPS:472741 | 21-225_30D9_LC1 | NA | GGCTACTATCTGCAC | | TGGATCAACCCTAACAG TGGTGGCACAAACTATG CACAGAAGTTTCAGGGC | GTGTATTACTATGGTTCGGG GAGTTATTATAACGAGTTTG ACAAC |
| | | | SEQ ID NO:4187 | | SEQ ID NO:12199 | SEQ ID NO:20211 |
| | | AA | GYYLH | | WINPNSGGTNYAQKFQG | VYYYGSGSYYNEFDN |
| | | | SEQ ID NO:4188 | | SEQ ID NO:12200 | SEQ ID NO:20212 |
| iPS:472743 | 21-225_68G6 | NA | GGGTACTACTATATGCAC | | TCGATCTACCGTAACAGT GGTGGCACAAATTATGC ACAGAAGTTTCAGGGC | GCCTTTTACTATGGTTCGGG GACTTATTATAACGAATTTG ACTAC |
| | | | SEQ ID NO:4189 | | SEQ ID NO:12201 | SEQ ID NO:20213 |
| | | AA | GYYMH | | SIYRNSGGTNYAQKFQG | AFYYGSGTYYNEFDY |
| | | | SEQ ID NO:4190 | | SEQ ID NO:12202 | SEQ ID NO:20214 |

FIGURE 49
(Continued)

| | | | | |
|---|---|---|---|---|
| iPS:392573 | 21-225_15G2 | NA | ACTAGTGGAGTGGGTGTGGGC SEQ ID NO:4191 | CTCATTTATTGGAATGAT GATAAGCGCTACAGCCC ATCTCTGAAGAGC SEQ ID NO:12203 | ACCGGTGTCAGCTGCTGCTA TTTTCACTAT SEQ ID NO:20215 |
| | | AA | TSGVGVG SEQ ID NO:4192 | LIYWNDDKRYSPSLKS SEQ ID NO:12204 | TGVSCCYFHY SEQ ID NO:20216 |
| iPS:392583 | 21-225_10B10 | NA | ACTGGTGGAGTGGGTGTGGG C SEQ ID NO:4193 | TTCATTTATTGGAGTGAT GATAAGCGCTACAGCCC ATCTCTGAAGAGC SEQ ID NO:12205 | ATAGCAGCAGTTGCCTTTGA CTAC SEQ ID NO:20217 |
| | | AA | TGGVGVG SEQ ID NO:4194 | FIYWSDDKRYSPSLKS SEQ ID NO:12206 | IAAVAFDY SEQ ID NO:20218 |
| iPS:392585 | 21-225_14H11 | NA | GGCCACTATATGTGC SEQ ID NO:4195 | TGGATCAACCCTAATAG TGGTGGCACAAACTATG CACAGAAGTTTCAGGGC SEQ ID NO:12207 | GGATATTGTAGTAGTTCCAG CTGCTATTTGCAACCGGGTT ATTACGGTATGGACGTC SEQ ID NO:20219 |
| | | AA | GHYMC SEQ ID NO:4196 | WINPNSGGTNYAQKFQG SEQ ID NO:12208 | GYCSSSSCYLQPGYYGMDV SEQ ID NO:20220 |
| iPS:392587 | 21-225_18G5 | NA | ACTAGTGGAGTGGGTGTGGG C SEQ ID NO:4197 | CTCATTTATTGGAATGAT GATAAGGTCTACAGCCC ATCTCTGAAGAGC SEQ ID NO:12209 | AGGGGACAGCAGCTGGCCCT CGACTAC SEQ ID NO:20221 |
| | | AA | TSGVGVG SEQ ID NO:4198 | LIYWNDDKVYSPSLKS SEQ ID NO:12210 | RGQQLALDY SEQ ID NO:20222 |
| iPS:392589 | 21-225_27H2 | NA | GGCTATGGCATGCAC SEQ ID NO:4199 | GTTATATGTATGATGG AAGTAATAAATACTATG CAGACTCCGTGAAGGGC SEQ ID NO:12211 | GATAGGGTATATTGTAGTAG TACCAGCTGCTCCCCTTACT ACTACTACGGTATGGAC GTC SEQ ID NO:20223 |

FIGURE 49
(Continued)

| | | AA | GYGMH | VIWYDGSNKYADSVKG | DRVYCSSTSCSPYYYYGMDV |
|---|---|---|---|---|---|
| iPS:392593 | 21-225_3E10 | NA | ACTGGTGGAAGTGGGTGTGGGC | SEQ ID NO:4200 | SEQ ID NO:12212 | SEQ ID NO:20224 |
| | | | | CTCATTATTGGAATGATGATAAGGCCACAGCCCATCTCTGAAGAGC | CTTATAGAAGTGGCCTTTGACTAT |
| | | AA | TGGVGVG | SEQ ID NO:4201 | SEQ ID NO:12213 | SEQ ID NO:20225 |
| | | | | LIYWNDDKRHSPSLKS | LIEVAFDY |
| iPS:392596 | 21-225_12D8 | NA | AGCTATGTCATGAGC | SEQ ID NO:4202 | SEQ ID NO:12214 | SEQ ID NO:20226 |
| | | | | ACTATTAGTGTTGGTGGTGGTAGCACATACTACGCAGACTCCGTGAAGGGC | TGGGGACGTGGATACAGCTATGAATACTACTACGGTATGGACGTC |
| | | AA | SYVMS | SEQ ID NO:4203 | SEQ ID NO:12215 | SEQ ID NO:20227 |
| | | | | TISVGGSTYYADSVKG | WGRGYSYEYYYGMDV |
| iPS:392598 | 21-225_18E10 | NA | GGCTACTATATGCAC | SEQ ID NO:4204 | SEQ ID NO:12216 | SEQ ID NO:20228 |
| | | | | TGGATCAACCCTAACAGTGGTGGCACAAAACTATGCACAGAAGTTTCAGGGC | TCGTACTACTATGGTTCGGGAGTTATTATAACGAGTTTGACTAC |
| | | AA | GYYMH | SEQ ID NO:4205 | SEQ ID NO:12217 | SEQ ID NO:20229 |
| | | | | WINPNSGGTNYAQKFQG | SYYYGSGSYYNEFDY |
| iPS:392618 | 21-225_16F10 | NA | GACTATGGCATGCAC | SEQ ID NO:4206 | SEQ ID NO:12218 | SEQ ID NO:20230 |
| | | | | GTCATATGGTATGATGGAAATATAAATACTATGTAGACTCCGTGAAGGGC | GAGCTTGCCTGGTACGAGGACTAC |
| | | AA | DYGMH | SEQ ID NO:4207 | SEQ ID NO:12219 | SEQ ID NO:20231 |
| | | | | VIWYDGNNKYYVDSVKG | ELAWYEDY |
| | | | SEQ ID NO:4208 | SEQ ID NO:12220 | SEQ ID NO:20232 |

FIGURE 49
(Continued)

| | | | | | |
|---|---|---|---|---|---|
| iPS:392620 | 21-225_17H5 | NA | AGCTATAGCATGAAC | TCCATTAGTAGTAGTAGT ACTTACATATACTACGCA GACTCAGTGAAGGC | GTGGCTTCATTTGACTAC |
| | | | SEQ ID NO:4209 | SEQ ID NO:12221 | SEQ ID NO:20233 |
| | | AA | SYSMN | SISSSSTYIYYADSVKG | VASFDY |
| | | | SEQ ID NO:4210 | SEQ ID NO:12222 | SEQ ID NO:20234 |
| iPS:392622 | 21-225_17H8 | NA | AGAAGTAGTTACTACTGGGG C | AATATCTATTATGGTGGG AACACCTACTACAACCC GTCCCTCAAGAGT | CATGGAAAAGACTGGGGCCT TGACTAC |
| | | | SEQ ID NO:4211 | SEQ ID NO:12223 | SEQ ID NO:20235 |
| | | AA | RSSYYWG | NIYYGGNTYYNPSLKS | HGKDWGLDY |
| | | | SEQ ID NO:4212 | SEQ ID NO:12224 | SEQ ID NO:20236 |
| iPS:392624 | 21-225_17H12 | NA | AGCTATACCATGAAC | TCCATTAGTGGTAGTAGT AGTTACATATACTACGC AGACTCAGTGAAGGGC | GATCGAGGCTCCATC |
| | | | SEQ ID NO:4213 | SEQ ID NO:12225 | SEQ ID NO:20237 |
| | | AA | SYTMN | SISGSSSYIYYADSVKG | DRGSI |
| | | | SEQ ID NO:4214 | SEQ ID NO:12226 | SEQ ID NO:20238 |
| iPS:392626 | 21-225_18A5 | NA | GACTATGGCATGCAC | GTTATATGGTTTGATGGA AGTAATAAATACTATGC AGACTCCGTGAAGGGC | GATCTTGGCTGGACGGAAGA GTAC |
| | | | SEQ ID NO:4215 | SEQ ID NO:12227 | SEQ ID NO:20239 |
| | | AA | DYGMH | VIWFDGSNKYYADSVKG | DLGWTEEY |
| | | | SEQ ID NO:4216 | SEQ ID NO:12228 | SEQ ID NO:20240 |
| iPS:392628 | 21-225_20C2 | NA | AGAAGTAGTTACTACTGGGG C | AATATCTATTATAGTGGG ACTGCCTACTGTAATTCG TCCCTCAAGAGT | CATAGTAGCAGCTGGTCCCT TGACAAC |
| | | | SEQ ID NO:4217 | SEQ ID NO:12229 | SEQ ID NO:20241 |
| | | AA | RSSYYWG | NIYYSGTAYCNSSLKS | HSSSWSLDN |

FIGURE 49
(Continued)

| | | | | | | |
|---|---|---|---|---|---|---|
| iPS:392630 | 21-225_20E5 | NA | SEQ ID NO:4218 GACTATGGCATGCAC | SEQ ID NO:12230 GTTATTTGGTATGAAGA AATAATCAATACTATG CAGACTCCGTGAAGGGC | SEQ ID NO:20242 GAACTGGGGTTCCGGTCTGA CTAC | |
| | | AA | SEQ ID NO:4219 DYGMH | SEQ ID NO:12231 VIWYEENNQYYADSVKG | SEQ ID NO:20243 ELGFRSDY | |
| iPS:392632 | 21-225_16A11 | NA | SEQ ID NO:4220 AGCTATAGCATGAAC | SEQ ID NO:12232 TCCATTAGTGGTAGTAGT AGTCTCATATACTACGCA GACTCAGTGAAGGGC | SEQ ID NO:20244 GTAGCAGCCTTTGACTAC | |
| | | AA | SEQ ID NO:4221 SYSMN | SEQ ID NO:12233 SISGSSSLIYYADSVKG | SEQ ID NO:20245 VAAFDY | |
| iPS:392634 | 21-225_17H3 | NA | SEQ ID NO:4222 AACTGTGTCATGCAC | SEQ ID NO:12234 GTTATATGGTATGATGG AAGTAATAAATACTATG CAGACTCCGTGAAGGGC | SEQ ID NO:20246 GAAAAGTATAGCAGCAGCTG GTACGACTACGGTATGGACG TC | |
| | | AA | SEQ ID NO:4223 NCVMH | SEQ ID NO:12235 VIWYDGSNKYYADSVKG | SEQ ID NO:20247 EKYSSSWYDYGMDV | |
| iPS:392636 | 21-225_17A6 | NA | SEQ ID NO:4224 CGCAACACTGCTGCTTGGAG C | SEQ ID NO:12236 AGGACATACTACAGGTC CAAGTGGTATAATGATT ATGCAGTATCTGTGAAA AGT | SEQ ID NO:20248 GTAAGCAGTGGCTGGTCCCA TCACTACTACTACTACGGTA TGGACGTC | |
| | | AA | SEQ ID NO:4225 RNTAAWS | SEQ ID NO:12237 RTYYRSKWYNDYAVSVK S | SEQ ID NO:20249 VSSGWSHHYYYYGMDV | |

FIGURE 49
(Continued)

| | | | | | | |
|---|---|---|---|---|---|---|
| iPS:392638 | 21-225_17F9 | NA | SEQ ID NO:4226<br>AGAAGTAGTTACTTACTATTGGGGC | SEQ ID NO:12238<br>AATATCTATTATAGTGGGAGCACCTACTACAATCCGTCCCTCAAGAGT | SEQ ID NO:20250<br>CATGGAAAAGACTGGGGCCTTGACTAC | |
| | | AA | SEQ ID NO:4227<br>RSSYYWG | SEQ ID NO:12239<br>NIYYSGSTYYNPSLKS | SEQ ID NO:20251<br>HGKDWGLDY | |
| iPS:392640 | 21-225_18A1 | NA | SEQ ID NO:4228<br>AGCTATGGCATGCAT | SEQ ID NO:12240<br>GTTATATGGTATGAGGAAAATAAATATATGTAGACTCCGTGAAGGGC | SEQ ID NO:20252<br>GAGCTAGGCTTCCAGTCTGACTAC | |
| | | AA | SEQ ID NO:4229<br>SYGMH | SEQ ID NO:12241<br>VIWYEENNKYYVDSVKG | SEQ ID NO:20253<br>ELGFQSDY | |
| iPS:392642 | 21-225_18C6 | NA | SEQ ID NO:4230<br>AGGAGTAGTTATTACTGGGGC | SEQ ID NO:12242<br>AATATCTATTATAGTGGGTACACCTACTACAACCCGTCCCTCAAGAGT | SEQ ID NO:20254<br>CATAGTAGCAGTTGGTCCCTTGACGAC | |
| | | AA | SEQ ID NO:4231<br>RSSYYWG | SEQ ID NO:12243<br>NIYYSGYTYYNPSLKS | SEQ ID NO:20255<br>HSSSWSLDD | |
| iPS:392644 | 21-225_19E1 | NA | SEQ ID NO:4232<br>AACTATGGCATGCAC | SEQ ID NO:12244<br>GTTATTTGGTATGAAGAAAATAATCAATACTATGCAGACTCCGTGAAGGGC | SEQ ID NO:20256<br>GAACTGGGGTTCCGGTCTGACTAC | |
| | | AA | SEQ ID NO:4233<br>NYGMH | SEQ ID NO:12245<br>VIWYEENNQYYADSVKG | SEQ ID NO:20257<br>ELGFRSDY | |
| | | | SEQ ID NO:4234 | SEQ ID NO:12246 | SEQ ID NO:20258 | |

FIGURE 49
(Continued)

| | | | | |
|---|---|---|---|---|
| iPS:392646 | 21-225_20G2 | NA | AGCGATGACATGCAC | GTTATATGGTTTGATGGAAGTAATAAATACTATGCAGACTCCGTGAAGGGC | GATCTGATAGCAGCAGCTGGTACGGTTGACTAC |
| | | | SEQ ID NO:4235 | SEQ ID NO:12247 | SEQ ID NO:20259 |
| | | AA | SDDMH | VIWFDGSNKYYADSVKG | DLIAAAGTVDY |
| | | | SEQ ID NO:4236 | SEQ ID NO:12248 | SEQ ID NO:20260 |
| iPS:392648 | 21-225_16D11 | NA | CGCAACACTGCTGCTTGGAGC | AGGACATACTACAGGTCCAAGTGGTATAATGATTATGCAGTATCTGTGAAAAGT | GTAAACAGTGGCTGGTCCCATCACTACTACTACGGTATGGACGTC |
| | | | SEQ ID NO:4237 | SEQ ID NO:12249 | SEQ ID NO:20261 |
| | | AA | RNTAAWS | RTYYRSKWYNDYAVSVKS | VNSGWSHHYYYYGMDV |
| | | | SEQ ID NO:4238 | SEQ ID NO:12250 | SEQ ID NO:20262 |
| iPS:392650 | 21-225_17A4 | NA | GACTACTACATGAGC | CACATTAGTAGTAGTGGTAGTACCATATATTACGCAGACTCTGTGAAGGGC | TATCGGAATAACCGGGGATACTTCGATCTC |
| | | | SEQ ID NO:4239 | SEQ ID NO:12251 | SEQ ID NO:20263 |
| | | AA | DYYMS | HISSSGSTIYYADSVKG | YRNNRGYFDL |
| | | | SEQ ID NO:4240 | SEQ ID NO:12252 | SEQ ID NO:20264 |
| iPS:392652 | 21-225_17C6 | NA | AGCTATGCCATGAAC | GTTATTAGTGGTCGTGGTGGTAACACATTCTACGCAGACTCCGTGAAGGGC | CGTTTGGCAGTGGCTGGCTCGGAGGCTTTTGATATC |
| | | | SEQ ID NO:4241 | SEQ ID NO:12253 | SEQ ID NO:20265 |
| | | AA | SYAMN | VISGRGGNTFYADSVKG | RLAVAGSEAFDI |
| | | | SEQ ID NO:4242 | SEQ ID NO:12254 | SEQ ID NO:20266 |

FIGURE 49
(Continued)

| iPS:392654 | 21-225_17A10 | NA | AACTATGGCATGCAC | GTTATTTGGTATGAAGAAAATAATCAATACTATGCAGACTCCGTGAAGGGC | GAACTGGGGTTCCGGTCTGACTAC |
|---|---|---|---|---|---|
| | | | SEQ ID NO:4243 | SEQ ID NO:12255 | SEQ ID NO:20267 |
| | | AA | NYGMH | VIWYEENNQYYADSVKG | ELGFRSDY |
| | | | SEQ ID NO:4244 | SEQ ID NO:12256 | SEQ ID NO:20268 |
| iPS:392656 | 21-225_1F2 | NA | AGGAGTAGTTACTACTGGGC | AATATTTATTATAGTGGGAGCGCCTACAACAACCCGTCCCTCAAGGGT | CATGAAAAGACTGGGGCCTTGACTAC |
| | | | SEQ ID NO:4245 | SEQ ID NO:12257 | SEQ ID NO:20269 |
| | | AA | RSSYYWG | NIYYSGSAYNNPSLKG | HGKDWGLDY |
| | | | SEQ ID NO:4246 | SEQ ID NO:12258 | SEQ ID NO:20270 |
| iPS:392658 | 21-225_18E8 | NA | AACTATGGCATGCAC | GTTATTTGGTATGAAGAAAATAATCAATACTATGCAGACTCCGTGAAGGGC | GAACTGGGGTTCCGGTCTGACTAC |
| | | | SEQ ID NO:4247 | SEQ ID NO:12259 | SEQ ID NO:20271 |
| | | AA | NYGMH | VIWYEENNQYYADSVKG | ELGFRSDY |
| | | | SEQ ID NO:4248 | SEQ ID NO:12260 | SEQ ID NO:20272 |
| iPS:392660 | 21-225_19B3 | NA | AGTTATGACATGCAC | GTTATATGGTATGACGGAAGTGATAAATACTATGCAGACTCCGTGAAGGGC | GATCGGGCCTATAGCAGCTCGTCTGACTAC |
| | | | SEQ ID NO:4249 | SEQ ID NO:12261 | SEQ ID NO:20273 |
| | | AA | SYDMH | VIWYDGSDKYYADSVKG | DRAYSSSSDY |
| | | | SEQ ID NO:4250 | SEQ ID NO:12262 | SEQ ID NO:20274 |

FIGURE 49
(Continued)

| | | | | | |
|---|---|---|---|---|---|
| iPS:392664 | 21-225_20F6 | NA | AGCTATGGCATGCAC | GTTATATGGCATGATGGAAGTAATAAATACTATGCAGACTCCGTGAAGGGC | GATCTGAGTATGGGCGGAATGGACGTC |
| | | | SEQ ID NO:4251 | SEQ ID NO:12263 | SEQ ID NO:20275 |
| | | AA | SYGMH | VIWHDGSNKYYADSVKG | DLSMGGMDV |
| | | | SEQ ID NO:4252 | SEQ ID NO:12264 | SEQ ID NO:20276 |
| iPS:392666 | 21-225_16F11 | NA | AGCTATGGCATGCAC | GTTATATGGTATGAGGAAATAATAAATACTATGTAGACTCCGTGAAGGGC | GAACTAGGCTTCCAGTCTGACTAC |
| | | | SEQ ID NO:4253 | SEQ ID NO:12265 | SEQ ID NO:20277 |
| | | AA | SYGMH | VIWYEENNKYYVDSVKG | ELGFQSDY |
| | | | SEQ ID NO:4254 | SEQ ID NO:12266 | SEQ ID NO:20278 |
| iPS:392668 | 21-225_17B4 | NA | AGCTATGCCATGAAC | GTTATTAGTGGCCGTGGTGGTAACACATTCTACGCAGACTCCGTGAAGGGC | CGTTTGGCAGTGGCTGGCTCGGAGGCTTTTGATATC |
| | | | SEQ ID NO:4255 | SEQ ID NO:12267 | SEQ ID NO:20279 |
| | | AA | SYAMN | VISGRGGNTFYADSVKG | RLAVAGSEAFDI |
| | | | SEQ ID NO:4256 | SEQ ID NO:12268 | SEQ ID NO:20280 |
| iPS:392674 | 21-225_18C2 | NA | GACTATGGCATGCAC | GTTATATGGTATGATGTAACTAATAAATACTATGCAGACTCCGTGAAGGGC | GAGCTTGGCTGGTACGAGGACTAC |
| | | | SEQ ID NO:4257 | SEQ ID NO:12269 | SEQ ID NO:20281 |
| | | AA | DYGMH | VIWYDVTNKYYADSVKG | ELGWYEDY |
| | | | SEQ ID NO:4258 | SEQ ID NO:12270 | SEQ ID NO:20282 |

FIGURE 49
(Continued)

| | | | | |
|---|---|---|---|---|
| iPS:392676 | 21-225_19F3 | NA | GGTAGTAGTTACTACTGGGG C | AATATCTATTATAGTGGG AGCACCTACTACAACCC GTCCTTCAAGAGT | CATTCCAGTAGCTGGTCCCT TGACTAC |
| | | AA | SEQ ID NO:4259 GSSYYWG | SEQ ID NO:12271 NIYYSGSTYYNPSFKS | SEQ ID NO:20283 HSSSWSLDY |
| iPS:392678 | 21-225_20F3 | NA | SEQ ID NO:4260 AGCTATGCCATGAAC | SEQ ID NO:12272 GTTATTAGTGGTAGTGGT GGTAGCACATACTACGC AGACTCCGTGAAGGGC | SEQ ID NO:20284 AGGATAGCAGCAGCTGGTAC GGAGTACTTCGATCTC |
| | | AA | SEQ ID NO:4261 SYAMN | SEQ ID NO:12273 VISGSGGSTYYADSVKG | SEQ ID NO:20285 RIAAAGTEYFDL |
| iPS:392680 | 21-225_20A7 | NA | SEQ ID NO:4262 AACTATGGCATGAAC | SEQ ID NO:12274 GTTATTGGTATGATGAAGA AAATAATCAATACTATG CAGACTCCGTGAAGGGC | SEQ ID NO:20286 GAACTGGGGTTCCGGTCTGA CTAC |
| | | AA | SEQ ID NO:4263 NYGMH | SEQ ID NO:12275 VIWYEENNQYYADSVKG | SEQ ID NO:20287 ELGFRSDY |
| iPS:392682 | 21-225_16A12 | NA | SEQ ID NO:4264 AGCTATAGAATGAAC | SEQ ID NO:12276 TCCATTAGTGGTAGTAGT ACTGACATATACTACGC AGACTCAGTGAAGGGC | SEQ ID NO:20288 AGGGACTTC |
| | | AA | SEQ ID NO:4265 SYRMN | SEQ ID NO:12277 SISGSSTDIYYADSVKG | SEQ ID NO:20289 RDF |
| iPS:392684 | 21_225_17F4 | NA | SEQ ID NO:4266 AACTATGGCATGAAC | SEQ ID NO:12278 GTTATATGGTATGATGG AAATAATAAACACTATG CAGACTCCGTGAAGGGC | SEQ ID NO:20290 AGTGGGAGCTACTTCTTTGA CTAC |

FIGURE 49
(Continued)

| | | | SEQ ID NO:4267 | SEQ ID NO:12279 | SEQ ID NO:20291 |
|---|---|---|---|---|---|
| iPS:392686 | 21-225_17F4 | AA | NYGMN | VIWYDGNNKHYADSVKG | SGSYFFDY |
| | | | SEQ ID NO:4268 | SEQ ID NO:12280 | SEQ ID NO:20292 |
| iPS:392690 | 21-225_17C7 | NA | GACTATGGCATGCAC | GTTATATGGTTTGATGGA AGTAATAAATACTATGC AGACTCCGTGAAGGGC | GATCTTGGCTGGACGGAAGA ATAC |
| | | | SEQ ID NO:4269 | SEQ ID NO:12281 | SEQ ID NO:20293 |
| | 21-225_17C7 | AA | DYGMH | VIWFDGSNKYYADSVKG | DLGWTEEY |
| | | | SEQ ID NO:4270 | SEQ ID NO:12282 | SEQ ID NO:20294 |
| iPS:392690 | 21-225_18F2 | NA | GACTATGGCATGCAC | GTTATATGGTTTGATGGA AGTAATAAATACTATGT AGACTCCGTGAAGGGC | GATCTTGGCTGGACGGAAGA GTAC |
| | | | SEQ ID NO:4271 | SEQ ID NO:12283 | SEQ ID NO:20295 |
| | 21-225_18F2 | AA | DYGMH | VIWFDGSNKYYVDSVKG | DLGWTEEY |
| | | | SEQ ID NO:4272 | SEQ ID NO:12284 | SEQ ID NO:20296 |
| iPS:392692 | 21-225_18G10 | NA | ACCTATAGGCATGAAC | TACATTAGTAGGAGTAG TAGTACCATAGACTACG CAGACTCTGTGAAGGGC | GGAGGTGGGAGCCCTTTGA CTAC |
| | | | SEQ ID NO:4273 | SEQ ID NO:12285 | SEQ ID NO:20297 |
| | 21-225_18G10 | AA | TYSMN | YISRSSTIDYADSVKG | GGGSPFDY |
| | | | SEQ ID NO:4274 | SEQ ID NO:12286 | SEQ ID NO:20298 |
| iPS:392694 | 21-225_19A5 | NA | AGCTATGCCATGCAC | GTTATATGGTTTGATGGA AGTGATAAATACTATGC AGACTCCGTGAAGGGC | GATCGGGCCTATAGTAGCTC GTCTGACTAC |
| | | | SEQ ID NO:4275 | SEQ ID NO:12287 | SEQ ID NO:20299 |
| | 21-225_19A5 | AA | SYAMH | VIWFDGSDKYYADSVKG | DRAYSSSSDY |
| | | | SEQ ID NO:4276 | SEQ ID NO:12288 | SEQ ID NO:20300 |

FIGURE 49
(Continued)

| | | | | | |
|---|---|---|---|---|---|
| iPS:392696 | 21-225_20A4 | NA | AGCTATGCCATGACC | GTTATAAGTGGTGTAGTGGTGGTTACACATACAACGCGGACTCCGTGAAGGGC | CGTATAGCAGTGGCTGGCTCGGAGGCTTTTGATATC |
| | | | SEQ ID NO:4277 | SEQ ID NO:12289 | SEQ ID NO:20301 |
| | | AA | SYAMT | VISGSGGYTYNADSVKG | RIAVAGSEAFDI |
| | | | SEQ ID NO:4278 | SEQ ID NO:12290 | SEQ ID NO:20302 |
| iPS:392700 | 21-225_16E12 | NA | AACTATGGCATGCAC | GTTATATGGTATGAGGGAAGTAATAAATATTATGTAGACTCCGTGAGGGGC | GAGCTAGGCTTCCAGTCTGATCAC |
| | | | SEQ ID NO:4279 | SEQ ID NO:12291 | SEQ ID NO:20303 |
| | | AA | NYGMH | VIWYEGSNKYYVDSVRG | ELGFQSDH |
| | | | SEQ ID NO:4280 | SEQ ID NO:12292 | SEQ ID NO:20304 |
| iPS:392702 | 21-225_17F7 | NA | AGCTATGCCATGAAC | ATTATTAGTGGTCGTGGTGGTAACACATTCTACGCAGACTCCGTGAAGGGC | CGTTTGGCAGTGGCTGGCTCGGAGGCTTTTGATATC |
| | | | SEQ ID NO:4281 | SEQ ID NO:12293 | SEQ ID NO:20305 |
| | | AA | SYAMS | IISGRGGNTFYADSVKG | RLAVAGSEAFDI |
| | | | SEQ ID NO:4282 | SEQ ID NO:12294 | SEQ ID NO:20306 |
| iPS:392704 | 21-225_17F11 | NA | AGCTATGCCATGAGC | GTTATTAGTGGTGTAGAGGTGGTAACACATACTCCGCAGACTCCGTGAAGGGC | CGTTTAGCAGTGGCTGGCTCGGAGGCTTTTCATATC |
| | | | SEQ ID NO:4283 | SEQ ID NO:12295 | SEQ ID NO:20307 |
| | | AA | SYAMS | VISGRGGNTYSADSVKG | RLAVAGSEAFHI |
| | | | SEQ ID NO:4284 | SEQ ID NO:12296 | SEQ ID NO:20308 |
| iPS:392706 | 21-225_18A3 | NA | AGAAGTAGTTATTACTGGGGC | AATATCTATTATAGTGGGTATACCTACTACACTCCGTCCCTCAAGAGT | CATAGCACCAGCTGGTCCCTTGACTAC |
| | | | SEQ ID NO:4285 | SEQ ID NO:12297 | SEQ ID NO:20309 |
| | | AA | RSSYYWG | NYYSGYTYTPSLKS | HSTSWSLDY |
| | | | SEQ ID NO:4286 | SEQ ID NO:12298 | SEQ ID NO:20310 |

FIGURE 49
(Continued)

| | | | | |
|---|---|---|---|---|
| iPS:392708 | | NA | AGCTATAGCATGAAC | TACATTAGTAGTAGTAGT GGTACCATATACTACGC AGACTCTGTGAAGGGC | GGAGGTGGGAGCCCTTTTGA CTAC |
| | 21-225_18D11 | | SEQ ID NO:4287 | SEQ ID NO:12299 | SEQ ID NO:20311 |
| | | AA | SYSMN | YISSSSGTIYYADSVKG | GGGSPFDY |
| | | | SEQ ID NO:4288 | SEQ ID NO:12300 | SEQ ID NO:20312 |
| iPS:392710 | | NA | AGCTATGGCATGCAC | GTTATATGGTATGATGA AAGTAATAAATACTATG CAGACTCCGTGAAGGGC | GAGCTTGCCTGGTACGAGGA CTCC |
| | 21-225_19A10 | | SEQ ID NO:4289 | SEQ ID NO:12301 | SEQ ID NO:20313 |
| | | AA | SYGMH | VIWYDESNKYYADSVKG | ELAWYEDS |
| | | | SEQ ID NO:4290 | SEQ ID NO:12302 | SEQ ID NO:20314 |
| iPS:392714 | | NA | AGCTATGCCATGACC | ACTATTAGTGGTCGTGGT GGTCACACATACTACGC AGACTCCGTGAGGGGC | CAGGACTGC |
| | 21-225_16G12 | | SEQ ID NO:4291 | SEQ ID NO:12303 | SEQ ID NO:20315 |
| | | AA | SYAMT | TISGRGGHTYYADSVRG | QDC |
| | | | SEQ ID NO:4292 | SEQ ID NO:12304 | SEQ ID NO:20316 |
| iPS:392716 | | NA | GACTATGGCATGCAC | GTTATATGGTATGATGA AAGTAATAAACACTATA TAGACTCCGTGAAGGGC | GAACTGGGGTTCCGGTTTGA CTAC |
| | 21-225_17B5 | | SEQ ID NO:4293 | SEQ ID NO:12305 | SEQ ID NO:20317 |
| | | AA | DYGMH | VIWYDESNKHYIDSVKG | ELGFRFDY |
| | | | SEQ ID NO:4294 | SEQ ID NO:12306 | SEQ ID NO:20318 |
| iPS:392718 | | NA | AGCTATGCTATCAAC | TGGATGAACCCTAACAC TGGTAACACAGGCTATG CACAGAAGTTCCAGGGC | AAGGCTGGGTTTGACTAC |

FIGURE 49
(Continued)

| | | | | | | |
|---|---|---|---|---|---|---|
| iPS:392720 | 21-225_17B8 | AA | SEQ ID NO:4295<br>SYAIN | SEQ ID NO:12307<br>WMNPNTGNTGYAQKFQG | SEQ ID NO:20319<br>KAGFDY |
| | | NA | SEQ ID NO:4296<br>AGCTATGCCATGAGC | SEQ ID NO:12308<br>ATTATTAGTGGTCGTGTGGG<br>GGAAACGCCATTCTACGC<br>AGACTCCGTGAAGGGC | SEQ ID NO:20320<br>CGTATAGCAGTGGCTGGCTC<br>GGAGGCTTTTGATATC |
| iPS:392722 | 21-225_17A12 | AA | SEQ ID NO:4297<br>SYAMS | SEQ ID NO:12309<br>IISGRGGNAFYADSVKG | SEQ ID NO:20321<br>RIAVAGSEAFDI |
| | | NA | SEQ ID NO:4298<br>AGCTATGCCATGAGC | SEQ ID NO:12310<br>ATTATTAGTGGTCGTGGT<br>GGTAACACATTCTACGC<br>AGACTCCGTGAAGGGC | SEQ ID NO:20322<br>CGTCTGGCAGTGGCTGGCTC<br>GGAGGCTTTTGATATC |
| iPS:392726 | 21-225_18E12 | AA | SEQ ID NO:4299<br>SYAMS | SEQ ID NO:12311<br>IISGRGGNTFYADSVKG | SEQ ID NO:20323<br>RLAVAGSEAFDI |
| | | NA | SEQ ID NO:4300<br>AGCTATAGCATGAAC | SEQ ID NO:12312<br>TCCATTAGTGGGAGTAG<br>TAGTTACATATACTACGC<br>AGACTCAGTGAAGGGC | SEQ ID NO:20324<br>GATCGTGGGAGCTAC |
| iPS:392728 | 21-225_20B5 | AA | SEQ ID NO:4301<br>SYSMN | SEQ ID NO:12313<br>SISGSSSYIYYADSVKG | SEQ ID NO:20325<br>DRGSY |
| | | NA | SEQ ID NO:4302<br>GACTATTACATGAGC | SEQ ID NO:12314<br>CACATTAGTAGTAGTGG<br>TAGTACCATATACTACGC<br>AGACTCTGTGAAGGGC | SEQ ID NO:20326<br>TATCGGAATAACCGGGGGTA<br>CTTCGATCTC |
| | 21-225_20F7 | AA | SEQ ID NO:4303<br>DYYMS | SEQ ID NO:12315<br>HISSSGSTIYYADSVKG | SEQ ID NO:20327<br>YRNNRGYFDL |
| | | NA | SEQ ID NO:4304 | SEQ ID NO:12316 | SEQ ID NO:20328 |

FIGURE 49
(Continued)

| | | | | |
|---|---|---|---|---|
| iPS:392730 | 21-225_17A1 | NA | AGCTATGCCATGAAC | GTTATTAGTGGTAGTGGT AGTAACACATACTACGC AGACTCCGTGAAGGGC | AGATATACCAGTGACTGGCA TGATGCTTTTGATATC |
| | | | SEQ ID NO:4305 | SEQ ID NO:12317 | SEQ ID NO:20329 |
| | | AA | SYAMN | VISGSGSNTYYADSVKG | RYTSDWHDAFDI |
| | | | SEQ ID NO:4306 | SEQ ID NO:12318 | SEQ ID NO:20330 |
| iPS:392732 | 21-225_17E5 | NA | GACTATGGCATGCAC | CTTATATGGTATGATGTA ACTAATAAATACTATGG AGACTCCGTGAAGGGC | GAGCTTGGCTGGTACGAGGA CTAC |
| | | | SEQ ID NO:4307 | SEQ ID NO:12319 | SEQ ID NO:20331 |
| | | AA | DYGMH | LIWYDVTNKYYGDSVKG | ELGWYEDY |
| | | | SEQ ID NO:4308 | SEQ ID NO:12320 | SEQ ID NO:20332 |
| iPS:392734 | 21-225_17D8 | NA | AGCTATGGCTTGAAC | TCCATTAGTGGTAGTGGT AGTCACATATCCTACGC GGACTCAGTGAAGGGC | GATCGGGGCAGTGGC |
| | | | SEQ ID NO:4309 | SEQ ID NO:12321 | SEQ ID NO:20333 |
| | | AA | SYGLN | SISGSGSHISYADSVKG | DRGSG |
| | | | SEQ ID NO:4310 | SEQ ID NO:12322 | SEQ ID NO:20334 |
| iPS:392736 | 21-225_17B12 | NA | AGCTATGCCATGAAC | GTTATTAGTGGTAGTGGT GGTAGCACATACTACGC AGACTCCGTGAAGGGC | AGGTATACCAGTGACTGGCA TGATGCTTTTGATATC |
| | | | SEQ ID NO:4311 | SEQ ID NO:12323 | SEQ ID NO:20335 |
| | | AA | SYAMN | VISGSGGSTYYADSVKG | RYTSDWHDAFDI |
| | | | SEQ ID NO:4312 | SEQ ID NO:12324 | SEQ ID NO:20336 |
| iPS:392738 | 21-225_18G4 | NA | AGCTATGGCATGCAC | ATTATATGGTATGATGG AAGTAATAAATACTATG CAGACTCCGTGAAGGGC | GATCTGAGTATGGGCGGTAT GGACGTC |

FIGURE 49
(Continued)

| | | | | | | |
|---|---|---|---|---|---|---|
| iPS:392740 | 21-225_18H12 | AA | SEQ ID NO:4313<br>SYGMH | SEQ ID NO:12325<br>IIWYDGSNKYYADSVKG | SEQ ID NO:20337<br>DLSMGGMDV | |
| | | NA | SEQ ID NO:4314<br>GACTATGGCATGCAC | SEQ ID NO:12326<br>GTTATATGGTATGATGTA<br>ACTAATAAATACTATGC<br>AGACTCCGTGAAGGGC | SEQ ID NO:20338<br>GAGGTTGGCTGGTACGAGGA<br>CTAC | |
| iPS:392742 | 21-225_20B2 | AA | SEQ ID NO:4315<br>DYGMH | SEQ ID NO:12327<br>VIWYDVTNKYYADSVKG | SEQ ID NO:20339<br>EVGWYEDY | |
| | | NA | SEQ ID NO:4316<br>AATTATGTCATTCAC | SEQ ID NO:12328<br>GTTATATGGTATGATGG<br>AAGTAATAAATACTATG<br>CAGACTCCGTGAAGGGC | SEQ ID NO:20340<br>GAGAAGTATAGCAGCAGCTG<br>GTACGACTACGGTATGGACG<br>TC | |
| iPS:392744 | 21-225_20D5 | AA | SEQ ID NO:4317<br>NYVIH | SEQ ID NO:12329<br>VIWYDGSNKYYADSVKG | SEQ ID NO:20341<br>EKYSSSWYDYGMDV | |
| | | NA | SEQ ID NO:4318<br>AGCTATGGCATGCAC | SEQ ID NO:12330<br>GTTATTTGGTATGAAGA<br>AAATAATCAATACTATG<br>CAGACTCCGTGAAGGGC | SEQ ID NO:20342<br>GAACTGGGGTTCCGGTCTGA<br>CTAC | |
| iPS:392746 | 21_225_20H7 | AA | SEQ ID NO:4319<br>SYGMH | SEQ ID NO:12331<br>VIWYEENNQYYADSVKG | SEQ ID NO:20343<br>ELGFRSDY | |
| | | NA | SEQ ID NO:4320<br>AGCTATAGCATGAAC | SEQ ID NO:12332<br>TCCATTAGTGGTAGTAGT<br>AGTTTCATATACTACGCA<br>GACTCAGTGAAGGGC | SEQ ID NO:20344<br>GTAGCAGCTCTTGACTAC | |

FIGURE 49
(Continued)

| | | | | | | |
|---|---|---|---|---|---|---|
| iPS:392748 | 21-225_20H7 | AA | SEQ ID NO:4321<br>SYSMN | SEQ ID NO:12333<br>SISGSSSFIYYADSVKG | SEQ ID NO:20345<br>VAALDY | |
| | | NA | SEQ ID NO:4322<br>AGTATAGGCGTGAAC | SEQ ID NO:12334<br>TCCATTAGTAGTAGT<br>AGTTTCCTATACTAGCA<br>GACTCAGTGAAGGGC | SEQ ID NO:20346<br>AACTGGGACTAC | |
| iPS:392750 | 21-225_20A8 | AA | SEQ ID NO:4323<br>SYSVN | SEQ ID NO:12335<br>SISSSSFLYYADSVKG | SEQ ID NO:20347<br>NWDY | |
| | | NA | SEQ ID NO:4324<br>AGGGATGACATGCAC | SEQ ID NO:12336<br>GTTATATGGTTGATGGA<br>AGTAATAAATACTATGC<br>AGACTCCGTGAAGGGC | SEQ ID NO:20348<br>GATCTAATAGCAGCAGCTGG<br>TACGGTTGACTAC | |
| iPS:392750 | 21-225_20A10 | AA | SEQ ID NO:4325<br>SDDMH | SEQ ID NO:12337<br>VIWFDGSNKYYADSVKG | SEQ ID NO:20349<br>DLIAAAGTVDY | |
| | | NA | SEQ ID NO:4326<br>AGCTATGGCATGCAC | SEQ ID NO:12338<br>GTTATATCATATGATGGA<br>AGTAATAAATACTATGC<br>AGACTCCGTGAAGGGC | SEQ ID NO:20350<br>GGGGTATGGTTCGGGGACCT<br>C | |
| iPS:392754 | 21-225_21D3 | AA | SEQ ID NO:4327<br>SYGMH | SEQ ID NO:12339<br>VISYDGSNKYYADSVKG | SEQ ID NO:20351<br>GVWFGDL | |
| | | NA | SEQ ID NO:4328<br>GACTATGGCATGCAC | SEQ ID NO:12340<br>GTTATATGGTATGATGTA<br>ACTAATGAATACTATGC<br>AGACTCCGTGAAGGGC | SEQ ID NO:20352<br>GAGCTTGGCTGGTACGAGGA<br>CTAC | |
| iPS:392758 | 21-225_21G11 | AA | SEQ ID NO:4329<br>DYGMH | SEQ ID NO:12341<br>VIWYDVTNEYYADSVKG | SEQ ID NO:20353<br>ELGWYEDY | |
| | | NA | SEQ ID NO:4330 | SEQ ID NO:12342 | SEQ ID NO:20354 | |

FIGURE 49
(Continued)

| iPS:392760 | 21-225_22G3 | NA | AGCTATGCCATGAAC | ATTATTAGTGGTCGTGGT GTTAACACATTCTACGCA GACTCCGTGAAGGGC | CGTTTGGCAGTGGCTGGCTC GGAGGCTTTTGATATC |
|---|---|---|---|---|---|
| | | | SEQ ID NO:4331 | SEQ ID NO:12343 | SEQ ID NO:20355 |
| | | AA | SYAMN | IISGRGVNTFYADSVKG | RLAVAGSEAFDI |
| | | | SEQ ID NO:4332 | SEQ ID NO:12344 | SEQ ID NO:20356 |
| iPS:392762 | 21-225_22G5 | NA | AGCTATGCCATGAAC | GTTATTAGTCGTAGTGGT GGTTACACATACTACGC GGACTCCGTGAAGGGC | CGTTTAGCAGTGGCTGGCTC GGAGGCTTTTGATATC |
| | | | SEQ ID NO:4333 | SEQ ID NO:12345 | SEQ ID NO:20357 |
| | | AA | SYAMN | VISRSGGYTYYADSVKG | RLAVAGSEAFDI |
| | | | SEQ ID NO:4334 | SEQ ID NO:12346 | SEQ ID NO:20358 |
| iPS:392764 | 21-225_22G10 | NA | AGCTATGCCATGAAC | GTTATTAGTGGTAGTGGT GGTAACACATTCTACGC AGACTCCGTGAAGGGC | CGTATGGCAGTGGCTGGCTC GGAGGCTTTTGATATC |
| | | | SEQ ID NO:4335 | SEQ ID NO:12347 | SEQ ID NO:20359 |
| | | AA | SYAMN | VISGSGGNTFYADSVKG | RMAVAGSEAFDI |
| | | | SEQ ID NO:4336 | SEQ ID NO:12348 | SEQ ID NO:20360 |
| iPS:392766 | 21-225_23H4 | NA | AGCTATGCCATGAAC | GTTATTAGTGGTAGTGGT GGTACCACATACTTCGC AGACTCCGTGAAGGGC | AGAAATAGCAGTGGCTGGCA TGATGTTTTGATATC |
| | | | SEQ ID NO:4337 | SEQ ID NO:12349 | SEQ ID NO:20361 |
| | | AA | SYAMN | VISGSGGTTYFADSVKG | RNSSGWHDVFDI |
| | | | SEQ ID NO:4338 | SEQ ID NO:12350 | SEQ ID NO:20362 |
| iPS:392768 | 21-225_20B8 | NA | AGTTATAGCATGAAC | TCCATCAGTGGCAGTGG TAGTCACATATACTACGC GGACTCAGTGAAGGGC | GATCGGGGCAGTGGC |
| | | | SEQ ID NO:4339 | SEQ ID NO:12351 | SEQ ID NO:20363 |
| | | AA | SYSMN | SISGSGSHIYYADSVKG | DRGSG |
| | | | SEQ ID NO:4340 | SEQ ID NO:12352 | SEQ ID NO:20364 |

FIGURE 49
(Continued)

| | | | | |
|---|---|---|---|---|
| iPS:392770 | 21-225_20C10 | NA | AGCTATGCCATGAAC | GTTATTAGTGGTAGTGGT GGTACCACATACTACGC AGACTCCGTGAAGGGC | AGGTATACCAGTGACTGGCA TGATGCTTTTGATATC |
| | | | SEQ ID NO:4341 | SEQ ID NO:12353 | SEQ ID NO:20365 |
| | | AA | SYAMN | VISGSGTTYYADSVKG | RYTSDWHDAFDI |
| | | | SEQ ID NO:4342 | SEQ ID NO:12354 | SEQ ID NO:20366 |
| iPS:392772 | 21-225_20E12 | NA | AGCTATGGCATGCAC | GTTATGTGGTATGATGA AGTAATAAACACTATG CAGACTCCGTGAAGGGC | GAACTGGGGTTCCGGTTTGA CTAC |
| | | | SEQ ID NO:4343 | SEQ ID NO:12355 | SEQ ID NO:20367 |
| | | AA | SYGMH | VMWYDESNKHYADSVKG | ELGFRFDY |
| | | | SEQ ID NO:4344 | SEQ ID NO:12356 | SEQ ID NO:20368 |
| iPS:392774 | 21-225_21F3 | NA | AGAAGTAGTTACTACTGGGG C | AGCATCTATTATAGTGG GAGCACCTACTACAACC CGTCCCTCAAGAGT | CTTAGCAGCAGCTGGGACTT CCAGCAC |
| | | | SEQ ID NO:4345 | SEQ ID NO:12357 | SEQ ID NO:20369 |
| | | AA | RSSYYWG | SIYYSGSTYYNPSLKS | LSSSWDFQH |
| | | | SEQ ID NO:4346 | SEQ ID NO:12358 | SEQ ID NO:20370 |
| iPS:392776 | 21-225_21A12 | NA | AGCTATAGCATGAAC | TCCATTAGTGGTAGTAGT AGTTACATATACTACGC AGACTCAGTGAAGGGC | GCGGCTGGCTTTGACTAC |
| | | | SEQ ID NO:4347 | SEQ ID NO:12359 | SEQ ID NO:20371 |
| | | AA | SYSMN | SISGSSSYIYYADSVKG | AAGFDY |
| | | | SEQ ID NO:4348 | SEQ ID NO:12360 | SEQ ID NO:20372 |
| iPS:392778 | 21-225_22H3 | NA | AGCTATAGCATGAAC | TCCATTAGTAGTAGTAGT AGTTACATATACTACGC AGACTCAGTGAAGGGC | GATAGGGGCAGCCTC |
| | | | SEQ ID NO:4349 | SEQ ID NO:12361 | SEQ ID NO:20373 |

FIGURE 49
(Continued)

| | | | | | | |
|---|---|---|---|---|---|---|
| iPS:392780 | 21-225_22B7 | AA | SYSMN | | SISSSSSYIYYADSVKG | | DRGSL |
| | | | SEQ ID NO:4350 | | SEQ ID NO:12362 | | SEQ ID NO:20374 |
| | | NA | AGCTATGGCATGCAC | | GTTATTTGGTATGAAGA AATAATCAATACTATG CAGACTCCGTGAAGGGC | | GAAGTGGGGTTCCGGTCTGA CTAC |
| | | | SEQ ID NO:4351 | | SEQ ID NO:12363 | | SEQ ID NO:20375 |
| | | AA | SYGMH | | VIWYEENNQYYADSVKG | | EVGFRSDY |
| | | | SEQ ID NO:4352 | | SEQ ID NO:12364 | | SEQ ID NO:20376 |
| iPS:392782 | 21-225_22B12 | NA | AGCTATAGCATGAAC | | TCCATTAGTGGTAGTAGT AGTTACACATACTACGC AGACTCAGTGAAGGGC | | GTAGCAGCCCTTGACTCC |
| | | | SEQ ID NO:4353 | | SEQ ID NO:12365 | | SEQ ID NO:20377 |
| | | AA | SYSMN | | SISGSSSYTYYADSVKG | | VAALDS |
| | | | SEQ ID NO:4354 | | SEQ ID NO:12366 | | SEQ ID NO:20378 |
| iPS:392784 | 21-225_23C7 | NA | AGCTATGTTATGAGC | | GCTATGAGTGGTAGTGG TGGTAGCACATATTATGT AGACTCCGTGAAGGGC | | ACTGGGGTCTTTGACTAC |
| | | | SEQ ID NO:4355 | | SEQ ID NO:12367 | | SEQ ID NO:20379 |
| | | AA | SYVMS | | AMSGSGGSTYYVDSVKG | | TGVFDY |
| | | | SEQ ID NO:4356 | | SEQ ID NO:12368 | | SEQ ID NO:20380 |
| iPS:392786 | 21-225_24E1 | NA | AATTATGATATCAAC | | TGGATGCACCCTAACAG TGGTAACACAGGCTATG CACAGAGGTTCCAGGGC | | AGCAGTGGCTGGGAGGTCTT TGACTAC |
| | | | SEQ ID NO:4357 | | SEQ ID NO:12369 | | SEQ ID NO:20381 |
| | | AA | NYDIN | | WMHPNSGNTGYAQRFQG | | SSGWEVFDY |
| | | | SEQ ID NO:4358 | | SEQ ID NO:12370 | | SEQ ID NO:20382 |

FIGURE 49
(Continued)

| | | NA | AGCTATAGCATGAAC | TCCATTAGTGGCAGTAGT AGTTACATATACGC AGACTCAGTGAAGGCC | GACAGAGGCAGCTC |
|---|---|---|---|---|---|
| iPS:392788 | 21-225_20C8 | | SEQ ID NO:4359 | SEQ ID NO:12371 | SEQ ID NO:20383 |
| | | AA | SYSMN | SISGSSSYIYYADSVKA | DRGSL |
| | | | SEQ ID NO:4360 | SEQ ID NO:12372 | SEQ ID NO:20384 |
| iPS:392790 | 21-225_20D10 | NA | GACTATGGCATGCAC | GTTATATGGTTTGATGGA AGTAATAAATACTATGT AGACTCCGTGAAGGGC | GATCTTGGCTGGACGGAAGA GTAC |
| | | | SEQ ID NO:4361 | SEQ ID NO:12373 | SEQ ID NO:20385 |
| | | AA | DYGMH | VIWFDGSNKYYVDSVKG | DLGWTEEY |
| | | | SEQ ID NO:4362 | SEQ ID NO:12374 | SEQ ID NO:20386 |
| iPS:392792 | 21-225_20G12 | NA | AGCTATAGCATGAAC | TCCATTAGCGGTAGTAGT AGTTACATCTACTACGCA GACTCACTGAAGGGC | GATCGTGGGAGCTAC |
| | | | SEQ ID NO:4363 | SEQ ID NO:12375 | SEQ ID NO:20387 |
| | | AA | SYSMN | SISGSSSYIYYADSLKG | DRGSY |
| | | | SEQ ID NO:4364 | SEQ ID NO:12376 | SEQ ID NO:20388 |
| iPS:392794 | 21-225_21H3 | NA | AGGAGTAGTTACTACTGGGG C | AATATTTATTATATAGTGGG AGCACCTACGACAACCC GTCCCTCAAGAGT | CATGGAAAAGACTGGGGCCT TGACTAC |
| | | | SEQ ID NO:4365 | SEQ ID NO:12377 | SEQ ID NO:20389 |
| | | AA | RSSYYWG | NIYYSGSTYDNPSLKS | HGKDWGLDY |
| | | | SEQ ID NO:4366 | SEQ ID NO:12378 | SEQ ID NO:20390 |
| iPS:392796 | 21-225_22A4 | NA | GACTATGGCATACAC | GTTATATGGTTTGATGGA AGTAATAAATACTATGC AGACTCCGTGAAGGGC | GATCTTGGCTGGACGGAAGA GTAC |
| | | | SEQ ID NO:4367 | SEQ ID NO:12379 | SEQ ID NO:20391 |

FIGURE 49
(Continued)

| | | | | | | |
|---|---|---|---|---|---|---|
| iPS:392798 | 21-225_22C7 | AA | DYGIH | | VIWFDGSNKYYADSVKG | DLGWTEEY |
| | | | SEQ ID NO:4368 | | SEQ ID NO:12380 | SEQ ID NO:20392 |
| | | NA | AGCTATGGCATGCAC | | GTTATATGGCATGATGG AAGTAATAAATACTATG CAGACTCCGTGAAGGGC | GATCTGAGTATGGGCGGTAT GGACGTC |
| | | | SEQ ID NO:4369 | | SEQ ID NO:12381 | SEQ ID NO:20393 |
| iPS:392800 | 21-225_22D12 | AA | SYGMH | | VIWHDGSNKYYADSVKG | DLSMGGMDV |
| | | | SEQ ID NO:4370 | | SEQ ID NO:12382 | SEQ ID NO:20394 |
| | | NA | AGGAGTAGTTACTACTGGGG C | | AATATCTATTATAGTGGG ACCACCTCCTACAACCC GTCCCTCAAGAGT | CTCAGCAGCAGCTGGTCCGT TGACTAC |
| | | | SEQ ID NO:4371 | | SEQ ID NO:12383 | SEQ ID NO:20395 |
| iPS:392802 | 21-225_23E7 | AA | RSSYYWG | | NIYYSGTTSYNPSLKS | LSSSWSVDY |
| | | | SEQ ID NO:4372 | | SEQ ID NO:12384 | SEQ ID NO:20396 |
| | | NA | AGCTATGCCATGAAC | | GCTATTAGTGGTAGTGGT GGTTTCACATACTACGCA GACTCCGTGAAGGGC | ACCAGTGGCTTTGACTAC |
| | | | SEQ ID NO:4373 | | SEQ ID NO:12385 | SEQ ID NO:20397 |
| | | AA | SYAMN | | AISGSGGFTYYADSVKG | TSGFDY |
| | | | SEQ ID NO:4374 | | SEQ ID NO:12386 | SEQ ID NO:20398 |
| iPS:392806 | 21-225_24H3 | NA | AGCTATGGCATGCAC | | GTTATATGGTATGATGG AAGTAATAAATACTATG CAGACTCCGTGAAGGGC | GTAGCAGTGGCAGGCGGTAT GGACGTC |
| | | | SEQ ID NO:4375 | | SEQ ID NO:12387 | SEQ ID NO:20399 |
| | | AA | SYGMH | | VIWYDGSNKYYADSVKG | VAVAGGMDV |
| | | | SEQ ID NO:4376 | | SEQ ID NO:12388 | SEQ ID NO:20400 |

FIGURE 49
(Continued)

| | | | | |
|---|---|---|---|---|
| iPS:392808 | 21-225_20F8 | NA | AGCTATGCCATGAGC | GTTATTAGTGGTGGTAGTGGT GGTAGCACATATTACGC AGACTCCGTGAAGGGC | AGGTATAACAGTGGCTGGCA TGATGTTTTTGATATC |
| | | | SEQ ID NO:4377 | SEQ ID NO:12389 | SEQ ID NO:20401 |
| | | AA | SYAMS | VISGSGSTYYADSVKG | RYNSGWHDVFDI |
| | | | SEQ ID NO:4378 | SEQ ID NO:12390 | SEQ ID NO:20402 |
| iPS:392810 | 21-225_20H12 | NA | AACTATGGCATGCAC | GTTATATGTATGATGA AAATATAAATACTATG TAGACTCCGTGAAGGGC | GAGTTGGGGTTCCGGTCTGA CTAC |
| | | | SEQ ID NO:4379 | SEQ ID NO:12391 | SEQ ID NO:20403 |
| | | AA | NYGMH | VIWYDENNKYYVDSVKG | ELGFRSDY |
| | | | SEQ ID NO:4380 | SEQ ID NO:12392 | SEQ ID NO:20404 |
| iPS:392812 | 21-225_21F4 | NA | AGCTATGGCATGAAC | GTTATTAGTGGTGTCGTGGT GGTAACACATTCTACGC AGACTCCGTGAAGGGC | CGTTGGCAGTGGCTGGCTC GGAGGCTTGTGATATC |
| | | | SEQ ID NO:4381 | SEQ ID NO:12393 | SEQ ID NO:20405 |
| | | AA | SYAMN | VISGRGGNTFYADSVKG | RLAVAGSEACDI |
| | | | SEQ ID NO:4382 | SEQ ID NO:12394 | SEQ ID NO:20406 |
| iPS:392814 | 21-225_22A1 | NA | AGCTATGGCATGCAC | GTTATGTGGTATGATGG AAGTAATAAATATTATG CAGACTCCGTGAAGGGC | GATGGGGATTTTTGGAGTG GTTAGACTAC |
| | | | SEQ ID NO:4383 | SEQ ID NO:12395 | SEQ ID NO:20407 |
| | | AA | SYGMH | VMWYDGSNKYYADSVK G | DGGFLEWLDY |
| | | | SEQ ID NO:4384 | SEQ ID NO:12396 | SEQ ID NO:20408 |
| iPS:392816 | 21_225_22E4 | NA | AGCTATGCCATGAGC | ATTATTAGTGGTCGTGGT ACTAACACATTCTACGC AGACTCCGTGAAGGGC | CGTATAGCAGTGGCTGGCTC GGAGGCTTTGATATC |

FIGURE 49
(Continued)

| | | | | | | | |
|---|---|---|---|---|---|---|---|
| iPS:392818 | 21-225_22E4 | AA | SEQ ID NO:4385<br>SYAMS | SEQ ID NO:12397<br>IISGRGTNTFYADSVKG | SEQ ID NO:20409<br>RIAVAGSEAFDI | | |
| | | NA | SEQ ID NO:4386<br>AGCTATGGCATGCAC | SEQ ID NO:12398<br>ATTATATCATATGATGGA<br>AGTAATAAATACTATGC<br>AGACTCCGTGAAGGGC | SEQ ID NO:20410<br>GGGGTTTGGTTCGGGGACTT<br>C | | |
| iPS:392820 | 21-225_22D8 | AA | SEQ ID NO:4387<br>SYGMH | SEQ ID NO:12399<br>IISYDGSNKYYADSVKG | SEQ ID NO:20411<br>GVWFGDF | | |
| | | NA | SEQ ID NO:4388<br>AGAAGTAGTTACTACTGGGG<br>C | SEQ ID NO:12400<br>AGTATCTATTATAGTGGG<br>AGCGCCAGTACAACCC<br>GTCCCTCAAGAGT | SEQ ID NO:20412<br>CTGAGCAGCAGCTGGTCTTT<br>TGACTAC | | |
| iPS:392822 | 21-225_23D1 | AA | SEQ ID NO:4389<br>RSSYYWG | SEQ ID NO:12401<br>SIYYSGSAQYNPSLKS | SEQ ID NO:20413<br>LSSSWSFDY | | |
| | | NA | SEQ ID NO:4390<br>AGGAGTAGTTACTACTGGGG<br>C | SEQ ID NO:12402<br>AATATTTATTATAGTGGG<br>ACCACTTACAACAACCC<br>GTCCCTCAAGAGT | SEQ ID NO:20414<br>CATGGAAAAGACTGGGGCCT<br>TGACTAC | | |
| iPS:392824 | 21-225_23C8 | AA | SEQ ID NO:4391<br>RSSYYWG | SEQ ID NO:12403<br>NIYYSGTTYNNPSLKS | SEQ ID NO:20415<br>HGKDWGLDY | | |
| | | NA | SEQ ID NO:4392<br>AGGAGTAGTTACTACTGGGG<br>C | SEQ ID NO:12404<br>AGTATCTATTATAGTGGG<br>AGCGCCAACTACAACCC<br>GTCCCTCAAGAGT | SEQ ID NO:20416<br>CTCAGCAGCAGCTGGTCCAT<br>TGACAAC | | |
| | 21-225_24E5 | AA | SEQ ID NO:4393<br>RSSYYWG | SEQ ID NO:12405<br>SIYYSGSANYNPSLKS | SEQ ID NO:20417<br>LSSSWSIDN | | |
| | | NA | SEQ ID NO:4394 | SEQ ID NO:12406 | SEQ ID NO:20418 | | |

FIGURE 49
(Continued)

| | | | | |
|---|---|---|---|---|
| iPS:392826 | 21-225_20B9 | NA | AGCTATAGCATGAAC SEQ ID NO:4395 | TACATTAGTAGTAGTAGT AGTACCATATACTATGC AGACTCTGTGAAGGGC SEQ ID NO:12407 | TCACTATGGTCCCCTTTGAC TAC SEQ ID NO:20419 |
| | | AA | SYSMN SEQ ID NO:4396 | YISSSSTIYYADSVKG SEQ ID NO:12408 | SLWSPFDY SEQ ID NO:20420 |
| iPS:392830 | 21-225_21A5 | NA | AGTTACTTCTGGAGC SEQ ID NO:4397 | CGTATCTATACCAGTGG GATCACCAACTACAACC CCTCCCTCAAGAGT SEQ ID NO:12409 | GGCCCGACTTCGGGGTGGTT CGACCCC SEQ ID NO:20421 |
| | | AA | SYFWS SEQ ID NO:4398 | RIYTSGITNYNPSLKS SEQ ID NO:12410 | GPTSGWFDP SEQ ID NO:20422 |
| iPS:392832 | 21-225_21H8 | NA | GACTATGGCATGCAC SEQ ID NO:4399 | GTTATATGGTTTGATGGA AGTAATAAATACTATGC AGACTCCGTGAAGGGC SEQ ID NO:12411 | GATCTTGGCTGGACGGAAGA GTAC SEQ ID NO:20423 |
| | | AA | DYGMH SEQ ID NO:4400 | VIWFDGSNKYYADSVKG SEQ ID NO:12412 | DLGWTEEY SEQ ID NO:20424 |
| iPS:392834 | 21-225_22C1 | NA | AGGAGTAGTTACTACTGGGG C SEQ ID NO:4401 | AATATCTATTATAGTGGG GCCACCTATTATAATTCG TCCCTCAAGAGT SEQ ID NO:12413 | CATAGCGGCAGCTGGTCCCT TGAACTAC SEQ ID NO:20425 |
| | | AA | RSSYYWG SEQ ID NO:4402 | NIYYSGATYYNSSLKS SEQ ID NO:12414 | HSGSWSLDY SEQ ID NO:20426 |
| iPS:392836 | 21-225_22F4 | NA | GACTATGGCATGCAC SEQ ID NO:4403 | GTTATATGGTATGATGG AAGTAATAAATACTATG TAGACTCCGTGAAGGGC SEQ ID NO:12415 | GAAAAGTATAGCAGCAGCTG GTACGACTACGGTATGGACG TC SEQ ID NO:20427 |

FIGURE 49
(Continued)

| | | AA | DYGMH | | VIWYDGSNKYYVDSVKG | | EKYSSSWYDYGMDV | |
|---|---|---|---|---|---|---|---|---|
| | | | | SEQ ID NO:4404 | | SEQ ID NO:12416 | | SEQ ID NO:20428 |
| iPS:392838 | 21-225_22G8 | NA | AGGAGTAGTTACTACTGGGG C | | AATATCTATTATAGTGGG AGCACCTACTACAACCC GTCCGTCAAGAGT | | CATGGAAAAGACTGGGGCCT TGACTAC | |
| | | AA | RSSYYWG | | NIYYSGSTYYNPSVKS | | HGKDWGLDY | |
| | | | | SEQ ID NO:4405 | | SEQ ID NO:12417 | | SEQ ID NO:20429 |
| iPS:392840 | 21-225_23G1 | NA | AGCTATGCCATGAGC | | GTTATTAGTGGTGTAGTGGT GGTACCACATATAACAC AGACTCCGTGAAGGGC | | AGCTCCTGTTGTTTGACTAC | |
| | | | | SEQ ID NO:4406 | | SEQ ID NO:12418 | | SEQ ID NO:20430 |
| | | AA | SYAMS | | VISGSGGTTYNTDSVKG | | SSLFDY | |
| | | | | SEQ ID NO:4407 | | SEQ ID NO:12419 | | SEQ ID NO:20431 |
| iPS:392842 | 21-225_23G8 | NA | AGCTATGCCATGAGC | | GCTATTAGTGGTGTAGTGGT GGTAGCACATACTACGC AGACTCCGTGAAGGGC | | AGCAGTGGCTGGCTGGTTCGCC | |
| | | | | SEQ ID NO:4408 | | SEQ ID NO:12420 | | SEQ ID NO:20432 |
| | | AA | SYAMS | | AISGSGGSTYYADSVKG | | SSGWFA | |
| | | | | SEQ ID NO:4409 | | SEQ ID NO:12421 | | SEQ ID NO:20433 |
| iPS:392844 | 21-225_23E11 | NA | TCCTATACCATGAAC | | TCCATTAGTGGTAGTAGT AGTTACATATGGTATGTA GACTCAGTGAAGGGC | | GATCGGGGCAGTCTC | |
| | | | | SEQ ID NO:4410 | | SEQ ID NO:12422 | | SEQ ID NO:20434 |
| | | AA | SYTMN | | SISGSSSYIWYVDSVKG | | DRGSL | |
| | | | | SEQ ID NO:4411 | | SEQ ID NO:12423 | | SEQ ID NO:20435 |
| | | | | SEQ ID NO:4412 | | SEQ ID NO:12424 | | SEQ ID NO:20436 |

FIGURE 49
(Continued)

| | | | | | |
|---|---|---|---|---|---|
| iPS:392846 | 21-225_24B6 | NA | AACTATGTCATGCAC | GTTATATGGTATGATGG AAGTAATAAATACTATG CAGACTCCGTGAAGGGC | GAGGAATATAGTAGTGGCTG GTACGACTACGGTATGGACG TC |
| | | | SEQ ID NO:4413 | SEQ ID NO:12425 | SEQ ID NO:20437 |
| | | AA | NYVMH | VIWYDGSNKYYADSVKG | EEYSSGWYDYGMDV |
| | | | SEQ ID NO:4414 | SEQ ID NO:12426 | SEQ ID NO:20438 |
| iPS:392848 | 21-225_20F9 | NA | AGCTATAGCATGAAC | TCCATTAGTAGTAGTAGT AGTTACATATACTACGC AGACTCAGTGAAGGGC | GATCGTGGGAGCTGC |
| | | | SEQ ID NO:4415 | SEQ ID NO:12427 | SEQ ID NO:20439 |
| | | AA | SYSMN | SISSSSSYIYYADSVKG | DRGSC |
| | | | SEQ ID NO:4416 | SEQ ID NO:12428 | SEQ ID NO:20440 |
| iPS:392850 | 21-225_20H10 | NA | ACCTATAGCATGAAC | TCCATTAGTAGTAGTAGT AGTTACATATACTACGC AGACTCAGTGAAGGGC | GATCGTGGGAGCCTC |
| | | | SEQ ID NO:4417 | SEQ ID NO:12429 | SEQ ID NO:20441 |
| | | AA | TYSMN | SISSSSSYIYYADSVKG | DRGSL |
| | | | SEQ ID NO:4418 | SEQ ID NO:12430 | SEQ ID NO:20442 |
| iPS:392852 | 21-225_21A2 | NA | AGCTATGCCATGAAC | ATTATTAGTGGTCGTGGT GGTAACACATTCTACGC AGACTCCGTGAAGGGC | CGTTTGGCAGTGGCTGGCTC GGAGGCTTTTGATATC |
| | | | SEQ ID NO:4419 | SEQ ID NO:12431 | SEQ ID NO:20443 |
| | | AA | SYAMN | IISGRGGNTFYADSVKG | RLAVAGSEAFDI |
| | | | SEQ ID NO:4420 | SEQ ID NO:12432 | SEQ ID NO:20444 |
| iPS:392854 | 21_225_21E5 | NA | GACTATGGCATGCAC | GTTATATGGTATGATGA AAGTAATAAATACTATG CAGACTCCGTGAAGGGC | GAACTGGGGTTCCGGTCTGA CTAT |

FIGURE 49
(Continued)

| | | | | | | |
|---|---|---|---|---|---|---|
| iPS:392856 | 21-225_21E5 | AA | SEQ ID NO:4421<br>DYGMH | SEQ ID NO:12433<br>VIWYDESNKYYADSVKG | SEQ ID NO:20445<br>ELGFRSDY |
| | | NA | SEQ ID NO:4422<br>AGCTATGCCATGAGC | SEQ ID NO:12434<br>GGTATTAGTGGTAGTGG<br>AGGTAACACACCCTACG<br>CAGACTCCGTGAAGGGC | SEQ ID NO:20446<br>GTAGTGGGAGCTGTCCAC |
| iPS:392858 | 21-225_22A2 | AA | SEQ ID NO:4423<br>SYAMS | SEQ ID NO:12435<br>GISGSGGNTPYADSVKG | SEQ ID NO:20447<br>VVGAVH |
| | | NA | SEQ ID NO:4424<br>AGGAGTAGTTACTACTGGGG<br>C | SEQ ID NO:12436<br>AATATTATTATATAGTGGG<br>AGCACCTACCACACAACCC<br>GTCTCTCAAGAGT | SEQ ID NO:20448<br>CATGGAAAAGACTGGGGCCT<br>TGACTAC |
| iPS:392860 | 21-225_22H4 | AA | SEQ ID NO:4425<br>RSSYYWG | SEQ ID NO:12437<br>NIYYSGSTYHNPSLKS | SEQ ID NO:20449<br>HGKDWGLDY |
| | | NA | SEQ ID NO:4426<br>AGCTATGGCATGCAC | SEQ ID NO:12438<br>GTTATCTGGTATGATGGA<br>AATAATAAATACTATGC<br>AGACTCCGTGAAGGGC | SEQ ID NO:20450<br>GAGCTTGCCTGGTACGAAGA<br>CTAC |
| iPS:392864 | 21-225_22H8 | AA | SEQ ID NO:4427<br>SYGMH | SEQ ID NO:12439<br>VIWYDGNNKYYADSVKG | SEQ ID NO:20451<br>ELAWYEDY |
| | | NA | SEQ ID NO:4428<br>AGTGGTGGTTACTACTGGAG<br>C | SEQ ID NO:12440<br>TACATCTATTACAGTGGG<br>AGCACCTACTACAACCC<br>GTCCCTCAAGAGT | SEQ ID NO:20452<br>GAGGACGGTGCCTTCGGCTA<br>CTACGGTATGGACGTC |
| | 21-225_23B9 | AA | SEQ ID NO:4429<br>SGGYYWS | SEQ ID NO:12441<br>YIYYSGSTYYNPSLKS | SEQ ID NO:20453<br>EDGAFGYYGMDV |

FIGURE 49
(Continued)

| | | | SEQ ID NO:4430 AGCTATGGCATGCAC | SEQ ID NO:12442 GTTATATGGTATGATGA AATAATAAATACTATG TAGACTCCGTGAAGGGC | SEQ ID NO:20454 GAATTGGGGTTCCGGTCTGA CTAC |
|---|---|---|---|---|---|
| iPS:392866 | | NA | | | |
| | 21-225_23H11 | AA | SEQ ID NO:4431 SYGMH | SEQ ID NO:12443 VIWYDENNKYYVDSVKG | SEQ ID NO:20455 ELGFRSDY |
| iPS:392868 | | NA | SEQ ID NO:4432 AGCTATGGCATGCAC | SEQ ID NO:12444 ATTATATCATATGCTGGA AGTAATAAATCCTATGC AGACTCCGTGAAGGGC | SEQ ID NO:20456 CGGGGATACAGCTATGGCGG GTACGGTATGGACGTC |
| | 21-225_24D6 | AA | SEQ ID NO:4433 SYGMH | SEQ ID NO:12445 IISYAGSNKSYADSVKG | SEQ ID NO:20457 RGYSYGGYGMDV |
| iPS:392870 | | NA | SEQ ID NO:4434 AGGAGTAGTTACTACTGGGG C | SEQ ID NO:12446 AGTATCTATTATAGTGGG AGCGCCTCTTACAACCC GTCCCTCAAGAGT | SEQ ID NO:20458 CTGAGCAGCAGCTGGTCTTT TGACTAC |
| | 21-225_20G9 | AA | SEQ ID NO:4435 RSSYYWG | SEQ ID NO:12447 SIYYSGSASYNPSLKS | SEQ ID NO:20459 LSSSWSFDY |
| iPS:392872 | | NA | SEQ ID NO:4436 AGCTATGTCATGCAC | SEQ ID NO:12448 GTTATATGGTATGATGG AAGTAATAAATACTATG CAGACTCCGTGAAGGTC | SEQ ID NO:20460 GAGAGATATACCAGTGGCTG GTATGACTACGGTATGGACG TC |
| | 21-225_20B11 | AA | SEQ ID NO:4437 SYVMH | SEQ ID NO:12449 VIWYDGSNKYYADSVKV | SEQ ID NO:20461 ERYTSGWYDYGMDV |
| | | | SEQ ID NO:4438 | SEQ ID NO:12450 | SEQ ID NO:20462 |

FIGURE 49
(Continued)

| | | | | | |
|---|---|---|---|---|---|
| iPS:392874 | 21-225_21D2 | NA | AACTATGCCATGAGC | GTTCTTAGTGGTAGTGGT GGTAGCACATTCTACGC AGACTCCGTGAAGGGC | TATTGTAGTAGTAGTGCCAGGTG CCCTTATGATGCCTTTGATAT C |
| | | | SEQ ID NO:4439 | SEQ ID NO:12451 | SEQ ID NO:20463 |
| | | AA | NYAMS | VLSGSGGSTFYADSVKG | YCSSARCPYDAFDI |
| | | | SEQ ID NO:4440 | SEQ ID NO:12452 | SEQ ID NO:20464 |
| iPS:392876 | 21-225_21F7 | NA | GACTATGGCATGCAC | GTTATATGGTTTGATGGA AATAATAAATACTATGT AGACTCCGTGAAGGGC | GATCTTGGCTGGACGGAAGA GTAC |
| | | | SEQ ID NO:4441 | SEQ ID NO:12453 | SEQ ID NO:20465 |
| | | AA | DYGMH | VIWFDGNNKYYVDSVKG | DLGWTEEY |
| | | | SEQ ID NO:4442 | SEQ ID NO:12454 | SEQ ID NO:20466 |
| iPS:392878 | 21-225_22C5 | NA | AGCTATGCCATGAGC | ATTATTAGTGGTAGTGGT GGTTACACATACTACGC GGACTCCGTGAAGGGC | CGTATAGCAGTGGCTGGCTC GGAGGCTTTTGATATC |
| | | | SEQ ID NO:4443 | SEQ ID NO:12455 | SEQ ID NO:20467 |
| | | AA | SYAMS | IISGSGGYTYYADSVKG | RIAVAGSEAFDI |
| | | | SEQ ID NO:4444 | SEQ ID NO:12456 | SEQ ID NO:20468 |
| iPS:392880 | 21-225_22F9 | NA | AGCTATGGCATGCAC | GTTATATGGTATGAGGA AAATAATAAAGACTATG TAGACTCCGTGAAGGGC | GAGTTAGGCTTCCAGTCTGA CTAC |
| | | | SEQ ID NO:4445 | SEQ ID NO:12457 | SEQ ID NO:20469 |
| | | AA | SYGMH | VIWYEENNKDYVDSVKG | ELGFQSDY |
| | | | SEQ ID NO:4446 | SEQ ID NO:12458 | SEQ ID NO:20470 |

FIGURE 49
(Continued)

| | | | | |
|---|---|---|---|---|
| iPS:392882 | 21-225_23A3 | NA | AGGAGTAGTTACTACTGGGG C | AATATTTATTATAGTGGG AGCACCTACAACAACCC GTCCCTCAAGAGT | CATGGAAAAGACTGGGCCT TGACTTC |
| | | | SEQ ID NO:4447 | SEQ ID NO:12459 | SEQ ID NO:20471 |
| | | AA | RSSYYWG | NIYYSGSTYNNPSLKS | HGKDWGLDF |
| | | | SEQ ID NO:4448 | SEQ ID NO:12460 | SEQ ID NO:20472 |
| iPS:392884 | 21-225_23A10 | NA | AGCTATGGCATGCAC | GTTATATGGTATGATGG AAGTAATAAATACTATG CAGACTCCGTGAAGGGC | GAAAGGTATAGCAGTGGCTG GCACGACTACGGTATGGACG TC |
| | | | SEQ ID NO:4449 | SEQ ID NO:12461 | SEQ ID NO:20473 |
| | | AA | SYGMH | VIWYDGSNKYYADSVKG | ERYSSGWHDYGMDV |
| | | | SEQ ID NO:4450 | SEQ ID NO:12462 | SEQ ID NO:20474 |
| iPS:392886 | 21-225_23A12 | NA | AATTATGATATCAAC | TGGATGCACCCTAACAG TGGTAACACAGGCTATG CACAGAAGTTCCAGGGC | AGCAGTGGCTGGTACTACTT TGACTAC |
| | | | SEQ ID NO:4451 | SEQ ID NO:12463 | SEQ ID NO:20475 |
| | | AA | NYDIN | WMHPNSGNTGYAQKFQG | SSGWYYFDY |
| | | | SEQ ID NO:4452 | SEQ ID NO:12464 | SEQ ID NO:20476 |
| iPS:392888 | 21-225_25A2 | NA | AGCTATGGCATGCAC | GTTATATGGTATGATGG AAGTAATAAATACTATG CAGACTCCGTGAAGGGC | AGGTATAGCAGCAGCTGGTC AGGGGGTATGGACGTC |
| | | | SEQ ID NO:4453 | SEQ ID NO:12465 | SEQ ID NO:20477 |
| | | AA | SYGMH | VIWYDGSNKYYADSVKG | RYSSSWSGGMDV |
| | | | SEQ ID NO:4454 | SEQ ID NO:12466 | SEQ ID NO:20478 |

FIGURE 49
(Continued)

| | | | | | |
|---|---|---|---|---|---|
| iPS:392890 | 21-225_20H9 | NA | AGCTATGCCATGAGC | GCTATTAGTGGTAGTGGT GGTTACACATACTACGC AGACTCCGTGAAGGGC | GGGGGGTCCCTCTTCTAC |
| | | | SEQ ID NO:4455 | SEQ ID NO:12467 | SEQ ID NO:20479 |
| | | AA | SYAMS | AISGSGGYTYYADSVKG | GGSLFY |
| | | | SEQ ID NO:4456 | SEQ ID NO:12468 | SEQ ID NO:20480 |
| iPS:392892 | 21-225_20C11 | NA | AGCTATGCCATGAGC | ACTATTAGTGGTCGTGGT GGTCACACATACTACGC AGACTCCGTGAAGGGC | CAGGACTGC |
| | | | SEQ ID NO:4457 | SEQ ID NO:12469 | SEQ ID NO:20481 |
| | | AA | SYAMS | TISGRGGHTYYADSVKG | QDC |
| | | | SEQ ID NO:4458 | SEQ ID NO:12470 | SEQ ID NO:20482 |
| iPS:392894 | 21-225_21G2 | NA | GACTATGGCATGCAC | GTTATATGGTATGATGTA ACTAATAAATACTATGC AGACTCCGTGAAGGGC | GAGCTTGGCTGGTACGAGGA CTAC |
| | | | SEQ ID NO:4459 | SEQ ID NO:12471 | SEQ ID NO:20483 |
| | | AA | DYGMH | VIWYDVTNKYYADSVKG | ELGWYEDY |
| | | | SEQ ID NO:4460 | SEQ ID NO:12472 | SEQ ID NO:20484 |
| iPS:392896 | 21-225_21G7 | NA | AGAAGTAGTTACTACTGGGG C | AATATCTATTATTAGTGGG TATAGTTACTACAATCCG TCCCTCAAGAGT | CATAGCACCAGCTGGTCCCT TGACTAC |
| | | | SEQ ID NO:4461 | SEQ ID NO:12473 | SEQ ID NO:20485 |
| | | AA | RSSYYWG | NIYYSGYSYNPSLKS | HSTSWSLDY |
| | | | SEQ ID NO:4462 | SEQ ID NO:12474 | SEQ ID NO:20486 |
| iPS:392898 | 21_225_21H10 | NA | AACGCCTGGATGAAC | CGTATTAAAAGCAAAAC TGATGGTGGGACAACAG ACTACGCTGCACCCGTG AAAGGC | GAAGGCTGGAACACGGACTA C |

FIGURE 49
(Continued)

| | | | | | | |
|---|---|---|---|---|---|---|
| iPS:392900 | 21-225_21H10 | AA | SEQ ID NO:4463<br>NAWMN | SEQ ID NO:12475<br>RIKSKTDGGTTDYAAPVKG | SEQ ID NO:20487<br>EGWNTDY | |
| | | NA | SEQ ID NO:4464<br>GACTATGGCATGCAC | SEQ ID NO:12476<br>GTTATATGGTATGAGGGAAGTAATAAATACTATGTAGACTCCGTGAGGGGC | SEQ ID NO:20488<br>GAGCTAGGCTTCCAGTCTGACTAC | |
| iPS:392902 | 21-225_22F2 | AA | SEQ ID NO:4465<br>DYGMH | SEQ ID NO:12477<br>VIWYEGSNKYYVDSVRG | SEQ ID NO:20489<br>ELGFQSDY | |
| | | NA | SEQ ID NO:4466<br>AGCTATGCCATGAGC | SEQ ID NO:12478<br>GTTATTAGTGGTCGTGGTGGTAACACATTCTACGCAGACTCCGTGAAGGGC | SEQ ID NO:20490<br>CGTATAGCAGTGGCTGGCTCGGAGGCTTTTGATATC | |
| iPS:392904 | 21-225_22D5 | AA | SEQ ID NO:4467<br>SYAMS | SEQ ID NO:12479<br>VISGRGGNTFYADSVKG | SEQ ID NO:20491<br>RIAVAGSEAFDI | |
| | | NA | SEQ ID NO:4468<br>GGTAGTAATTACTACTGGGGC | SEQ ID NO:12480<br>AATATCTATTATAGTGGGAGCACCTACTACAACCCGTCCCTCAAGAGT | SEQ ID NO:20492<br>CATAGCAGTAGCTGGTCCCTTGACTAC | |
| iPS:392906 | 21-225_22G9 | AA | SEQ ID NO:4469<br>GSNYYWG | SEQ ID NO:12481<br>NIYYSGSTYYNPSLKS | SEQ ID NO:20493<br>HSSSWSLDY | |
| | | NA | SEQ ID NO:4470<br>AGCTATGGCATGCAC | SEQ ID NO:12482<br>GTTATATGGTATGATGAAACTAATAAATACTATGCAGACTCCGTGAAGGGC | SEQ ID NO:20494<br>GAGCTTGCCTGGTACGAGGACTAC | |
| iPS:392908 | 21-225_23F12 | AA | SEQ ID NO:4471<br>SYGMH | SEQ ID NO:12483<br>VIWYDETNKYYADSVKG | SEQ ID NO:20495<br>ELAWYEDY | |

FIGURE 49
(Continued)

| | | | | | | |
|---|---|---|---|---|---|---|
| iPS:392912 | 21-225_25A9 | NA | SEQ ID NO:4472 AGCTATGGCATGCAC | SEQ ID NO:12484 GTTATATGGTATGATGTAACTAATAAATACTATACAGGCTCCGTGAAGGGC | SEQ ID NO:20496 GAAATTGGCTGGTTAGATGACTAC | |
| | | AA | SEQ ID NO:4473 SYGMH | SEQ ID NO:12485 VIWYDVTNKYYTGSVKG | SEQ ID NO:20497 EIGWLDDY | |
| iPS:392914 | 21-225_25D12 | NA | SEQ ID NO:4474 AGCGATGGCATGCAC | SEQ ID NO:12486 GTTATATGGTATGATGGAAGTAATAAATACTATGCAGACTCCGTGAAGGGC | SEQ ID NO:20498 GAGAGGTATAGCAGCAGCTGGTACGACTACGGTATGGACGTC | |
| | | AA | SEQ ID NO:4475 SIDGMH | SEQ ID NO:12487 VIWYDGSNKYYADSVKG | SEQ ID NO:20499 ERYSSSWYDYGMDV | |
| iPS:392916 | 21-225_27C5 | NA | SEQ ID NO:4476 AGCTATAGCATGAAC | SEQ ID NO:12488 TCCACTAGTAGTAGTGATAGTTATATATACGCAGACTCAGTGAAGGGC | SEQ ID NO:20500 GTGGCGTCCTTTGACTGC | |
| | | AA | SEQ ID NO:4477 SYSMN | SEQ ID NO:12489 STSSSDSYIYYADSVKG | SEQ ID NO:20501 VASFDC | |
| iPS:392918 | 21-225_28F5 | NA | SEQ ID NO:4478 AGCTATGGCATGCAC | SEQ ID NO:12490 GTTATATGGTATGATGAAAATAATAAATACTATGCAGACTCCGTGAAGGGC | SEQ ID NO:20502 GAATTAGGCTGGTACGACGACTAC | |
| | | AA | SEQ ID NO:4479 SYGMH | SEQ ID NO:12491 VIWYDENNKYYADSVKG | SEQ ID NO:20503 ELGWYDDY | |

FIGURE 49
(Continued)

| | | | | | | |
|---|---|---|---|---|---|---|
| iPS:392920 | 21-225_29G4 | NA | SEQ ID NO:4480 GACTATGGCATACAC | SEQ ID NO:12492 GTTATATGGTATGATGA AAGTAATAAATACTATG CAGACTCCATGAAGGGC | SEQ ID NO:20504 GAACTGGGAATGACGGGTGA CTAC | |
| | | AA | SEQ ID NO:4481 DYGIH | SEQ ID NO:12493 VIWYDESNKYYADSMKG | SEQ ID NO:20505 ELGMTGDY | |
| iPS:392922 | 21-225_30G4 | NA | SEQ ID NO:4482 AGCTATGGCATGCAC | SEQ ID NO:12494 GTTATATGGTATGATGG AACTGATAAATACTATG TAGACTCCGTGAAGGGC | SEQ ID NO:20506 GAAAATAGCAGCTCGTACTA CTTTGACTAC | |
| | | AA | SEQ ID NO:4483 SYGMH | SEQ ID NO:12495 VIWYDGTDKYYVDSVKG | SEQ ID NO:20507 ENSSSYYFDY | |
| iPS:392924 | 21-225_32H2 | NA | SEQ ID NO:4484 AGCTATGGCATGCAC | SEQ ID NO:12496 GTTATATGGTATGATGG AAGTAATAAATACTATG CAGACTCCGTGAAGGGC | SEQ ID NO:20508 AGATATAGCAGCAGCTGGAC GGGGGGTATGGACGTC | |
| | | AA | SEQ ID NO:4485 SYGMH | SEQ ID NO:12497 VIWYDGSNKYYADSVKG | SEQ ID NO:20509 RYSSSWTGGMDV | |
| iPS:392928 | 21-225_25A4 | NA | SEQ ID NO:4486 AATTATGATATTAAT | SEQ ID NO:12498 TGGATGTACCCTAACAG TGGTAACACAGGCTATG CACAGAAATTCCAGGGC | SEQ ID NO:20510 AGCAGTGGCTGGTACTACTT TGACTAC | |
| | | | SEQ ID NO:4487 | SEQ ID NO:12499 | SEQ ID NO:20511 | |

FIGURE 49
(Continued)

| | | | | WMYPNSGNTYAQKFQG | SSGWYYFDY |
|---|---|---|---|---|---|
| | | AA | NYDIN | | |
| iPS:392930 | | | SEQ ID NO:4488 | SEQ ID NO:12500 | SEQ ID NO:20512 |
| | 21-225_25H9 | NA | AACTATGGCATGCAC | ATTATATGGTATGATGG AAGTTATAAATACTATG CAGACTCCGTGAAGGGC | GAGGGATACGATTTTTGGAG TGGCTTCTTTGACTCC |
| | | | SEQ ID NO:4489 | SEQ ID NO:12501 | SEQ ID NO:20513 |
| | | AA | NYGMH | IIWYDGSYKYYADSVKG | EGYDFWSGFFDS |
| iPS:392934 | | | SEQ ID NO:4490 | SEQ ID NO:12502 | SEQ ID NO:20514 |
| | 21-225_27D5 | NA | AGCTATGGCATGCAC | GTTATATGGTATGATGA AAGTAATAAATACTATG GAGACTCCGTGAAGGGC | GAACTGGGGTTCCTCTCTGA CTAC |
| | | | SEQ ID NO:4491 | SEQ ID NO:12503 | SEQ ID NO:20515 |
| | | AA | SYGMH | VIWYDESNKYYGDSVKG | ELGFLSDY |
| iPS:392936 | | | SEQ ID NO:4492 | SEQ ID NO:12504 | SEQ ID NO:20516 |
| | 21-225_28B6 | NA | AATTATGATATTAAT | TGGATGCACCCTGACAG TGGTAACACAGGCTATG CACAGAAGTTCCAGGGC | AGCAGTGGCTGGTACTACTT TGACTAC |
| | | | SEQ ID NO:4493 | SEQ ID NO:12505 | SEQ ID NO:20517 |
| | | AA | NYDIN | WMHPDSGNTYAQKFQG | SSGWYYFDY |
| iPS:392938 | | | SEQ ID NO:4494 | SEQ ID NO:12506 | SEQ ID NO:20518 |
| | 21-225_29H4 | NA | AGCTATGGCATACAC | GTTATATGGTATGATGG AAGTAATAAATACTATG CAGACTCCGTGAAGGGC | AGGTATAGCAGCAGCTGGTC AGGGGTATGGACGTC |
| | | | SEQ ID NO:4495 | SEQ ID NO:12507 | SEQ ID NO:20519 |

FIGURE 49
(Continued)

| | | AA | SYGIH | | VIWYDGSNKYYADSVKG | RYSSSWSGGMDV |
|---|---|---|---|---|---|---|
| iPS:392940 | | | SEQ ID NO:4496 | | SEQ ID NO:12508 | SEQ ID NO:20520 |
| | 21-225_29D9 | NA | GACTATGGCATTCAC | | GTTATATGGTATGATGA AGTAATAACTACTATG CAGACTCCGTGAAGGGC | GAAATTGGCTGGTTAGATGA CTAC |
| | | | SEQ ID NO:4497 | | SEQ ID NO:12509 | SEQ ID NO:20521 |
| iPS:392942 | | AA | DYGIH | | VIWYDESNNYYADSVKG | EIGWLDDY |
| | | | SEQ ID NO:4498 | | SEQ ID NO:12510 | SEQ ID NO:20522 |
| | 21-225_30E9 | NA | AGCTGTGCCATGAAC | | GCTATTAGTGGTCGTGGT GGTAGCACATTCTACGC AGACTCCGTGAAGGGC | GGGGAGCTACTAGAGGACTA CTACTACTACGGAATGGACG TC |
| | | | SEQ ID NO:4499 | | SEQ ID NO:12511 | SEQ ID NO:20523 |
| iPS:392944 | | AA | SCAMN | | AISGRGGSTFYADSVKG | GELLEDYYYGMDV |
| | | | SEQ ID NO:4500 | | SEQ ID NO:12512 | SEQ ID NO:20524 |
| | 21-225_31H5 | NA | AGCTATGCCATGAGC | | GCTATTAGTGGTGGTCGTGGT GGAAGCATATTCCACGC AGACTCCGTGAAGGGC | GGGGAGCTACTAGAGGACTA CTACTTCTACGGTATGGACG TC |
| | | | SEQ ID NO:4501 | | SEQ ID NO:12513 | SEQ ID NO:20525 |
| iPS:392948 | | AA | SYAMS | | AISGRGGSIFHADSVKG | GELLEDYYFYGMDV |
| | | | SEQ ID NO:4502 | | SEQ ID NO:12514 | SEQ ID NO:20526 |
| | 21-225_25G5 | NA | GACTATGGCATACAC | | GTTATTTGGTATGATGGA AATAATAAATATTATGC AGACTCCGTGAAGGGC | GAAATTGGCTGGTTAGATGA CTAC |
| | | | SEQ ID NO:4503 | | SEQ ID NO:12515 | SEQ ID NO:20527 |
| | | AA | DYGIH | | VIWYDGNNKYYADSVKG | EIGWLDDY |
| | | | SEQ ID NO:4504 | | SEQ ID NO:12516 | SEQ ID NO:20528 |

FIGURE 49
(Continued)

| | | | | |
|---|---|---|---|---|
| iPS:392950 | NA | AGCTATAGGATGAAC | TCCATTAGTAGTAGTAGT AGTACCATATACTACGC AGACTCTGTGAAGGGC | ACGGCTGTGTTTTGACTAC |
| | | SEQ ID NO:4505 | SEQ ID NO:12517 | SEQ ID NO:20529 |
| 21-225_25C10 | AA | SYRMN | SISSSSSTIYYADSVKG | TAGFDY |
| | | SEQ ID NO:4506 | SEQ ID NO:12518 | SEQ ID NO:20530 |
| iPS:392952 | NA | AGCTATGGCATGAAC | TCCATTAGTGGTAGTAGT AGTTACATATACTACGC GGACTCAGTGAAGGGC | CTGACTACCTTTGACTTC |
| | | SEQ ID NO:4507 | SEQ ID NO:12519 | SEQ ID NO:20531 |
| 21-225_26G1 | AA | SYGMN | SISGSSYIYYADSVKG | LTTFDF |
| | | SEQ ID NO:4508 | SEQ ID NO:12520 | SEQ ID NO:20532 |
| iPS:392954 | NA | AGCTATGCCATGAGC | GTTATTAGTGGTAGTGGT GTTAACACATTCTACGCA GACTCCGTGAAGGGC | AAGATAGCAGTGGCTGGTAC TCACTACTTTGACTAC |
| | | SEQ ID NO:4509 | SEQ ID NO:12521 | SEQ ID NO:20533 |
| 21-225_26A10 | AA | SYAMS | VISGSGVNTFYADSVKG | KIAVAGTHYFDY |
| | | SEQ ID NO:4510 | SEQ ID NO:12522 | SEQ ID NO:20534 |
| iPS:392956 | NA | AGCTATGGCATGCAC | GTTATATGGTATGATGG AAGTAATAAATACTATG CAGACTCCGTGAAGGGC | GATTCCTCCCCTACGGTAT GGACGTC |
| | | SEQ ID NO:4511 | SEQ ID NO:12523 | SEQ ID NO:20535 |
| 21-225_27A11 | AA | SYGMH | VIWYDGSNKYYADSVKG | DSSPYGMDV |
| | | SEQ ID NO:4512 | SEQ ID NO:12524 | SEQ ID NO:20536 |
| iPS:392958 | NA | AGCTATGGCATGCAC | GTTATATGGTATGATGA AAGTAATAAATACTATG CAGACTCCGTGAAGGGC | GAATTAGGCTGGTACGACGA CTAC |
| 21_225_28C7 | | | | |

FIGURE 49
(Continued)

| | | | | | | |
|---|---|---|---|---|---|---|
| iPS:392960 | 21-225_28C7 | AA | SEQ ID NO:4513<br>SYGMH | SEQ ID NO:12525<br>VIWYDESNKYYADSVKG | SEQ ID NO:20537<br>ELGWYDDY | |
| | | NA | SEQ ID NO:4514<br>AATTATGATATTAAT | SEQ ID NO:12526<br>TGGATGCACCCTAACAG TGGTAACACAGGCTATG CACAGAAATTCCAGGGC | SEQ ID NO:20538<br>AGCAGTGGCTGGTACTACTT TGACTAC | |
| iPS:392962 | 21-225_29E6 | AA | SEQ ID NO:4515<br>NYDIN | SEQ ID NO:12527<br>WMHPNSGNTGYAQKFQG | SEQ ID NO:20539<br>SSGWYYFDY | |
| | | NA | SEQ ID NO:4516<br>AGCTATGTCATGAAC | SEQ ID NO:12528<br>GCTATTAGTGGTAGTGGT GGTAGCACATACTACGC AGACTCCGTGAAGGGC | SEQ ID NO:20540<br>ACTGGGGTCTTTGACTAC | |
| iPS:392964 | 21-225_30A1 | AA | SEQ ID NO:4517<br>SYVMN | SEQ ID NO:12529<br>AISGSGGSTYYADSVKG | SEQ ID NO:20541<br>TGVFDY | |
| | | NA | SEQ ID NO:4518<br>AGCTATGCCATGAGC | SEQ ID NO:12530<br>GCTATTAGTGGTCGTGGT GGTAGCACATTCCACGC AGACTCCGTGAAGGGC | SEQ ID NO:20542<br>GGGGAGCTACTAGAGGACTA CTACTTCTACGGTATGGACG TC | |
| iPS:392966 | 21-225_31A8 | AA | SEQ ID NO:4519<br>SYAMS | SEQ ID NO:12531<br>AISGRGGSTFHADSVKG | SEQ ID NO:20543<br>GELLEDYYFYGMDV | |
| | | NA | SEQ ID NO:4520<br>AGCTATAGCATGAAC | SEQ ID NO:12532<br>TCCATTAGTGGTAGTAGT AGTTACATATACTACGC AGACTCAGTGAAGGGC | SEQ ID NO:20544<br>GGCAATATAGCAAGGGACTA C | |
| | 21-225_32G3 | AA | SEQ ID NO:4521<br>SYSMN | SEQ ID NO:12533<br>SISGSSSYIYYADSVKG | SEQ ID NO:20545<br>GNIARDY | |
| | | | SEQ ID NO:4522 | SEQ ID NO:12534 | SEQ ID NO:20546 | |

FIGURE 49
(Continued)

| | | NA | AACTATGGCATGCAC | GTTATATGGTATGAGGA AAGTAATAAATACTATA CAGAGTCCGTGAAGGGC | GAACTGGGGTTCCTCTCTGA CTAC |
|---|---|---|---|---|---|
| iPS:392968 | 21-225_25B6 | | SEQ ID NO:4523 | SEQ ID NO:12535 | SEQ ID NO:20547 |
| | | AA | NYGMH | VIWYEESNKYYTESVKG | ELGFLSDY |
| | | | SEQ ID NO:4524 | SEQ ID NO:12536 | SEQ ID NO:20548 |
| iPS:392972 | 21-225_26A2 | NA | AGCTATGGCATGCAC | GTTATATGGTATGAAGG AAGTAATAAATACTATG TAGACTCCGTGAAGGGC | GAATTAGGCTGGTACGACGA CTAC |
| | | | SEQ ID NO:4525 | SEQ ID NO:12537 | SEQ ID NO:20549 |
| | | AA | SYGMH | VIWYEGSNKYYVDSVKG | ELGWYDDY |
| | | | SEQ ID NO:4526 | SEQ ID NO:12538 | SEQ ID NO:20550 |
| iPS:392974 | 21-225_26A11 | NA | AACTGTGTCATGCAC | GTTATATGGTATGATGG AAGTAATAAATACTATG CAGACTCCGTGAAGGGC | GAGGAGTATAGCAGTGGCTG GTACGACTACGGTATGGACG TC |
| | | | SEQ ID NO:4527 | SEQ ID NO:12539 | SEQ ID NO:20551 |
| | | AA | NCVMH | VIWYDGSNKYYADSVKG | EEYSSGWYDYGMDV |
| | | | SEQ ID NO:4528 | SEQ ID NO:12540 | SEQ ID NO:20552 |
| iPS:392976 | 21-225_27H12 | NA | AGCTATAGCCTGAAC | TCCATTAGTGGTAGTAGT AGTAACATATACTACAC AGACTCAGTGAAGGGC | GTGGCGTCCTTTGACTAC |
| | | | SEQ ID NO:4529 | SEQ ID NO:12541 | SEQ ID NO:20553 |
| | | AA | SYSLN | SISGSSSNIYTDSVKG | VASFDY |
| | | | SEQ ID NO:4530 | SEQ ID NO:12542 | SEQ ID NO:20554 |

FIGURE 49
(Continued)

| | | | | |
|---|---|---|---|---|
| iPS:392978 | 21-225_28B8 | NA | GACTATGGCATGCAC | GTTATATGGTATGATGCAAATAATAAATACTATGCAGACTCCGTGAAGGGC | GAAATTGGCTGGTTAGATGACTAC |
| | | | SEQ ID NO:4531 | SEQ ID NO:12543 | SEQ ID NO:20555 |
| | | AA | DYGMH | VIWYDANNKYYADSVKG | EIGWLDDY |
| | | | SEQ ID NO:4532 | SEQ ID NO:12544 | SEQ ID NO:20556 |
| iPS:392980 | 21-225_29H6 | NA | GACTATGGCATGCAC | GTTATATGGTATAATGAAATAATAAATACTATGCAGACTCCGTGAAGGGC | GAACTGGGGATGACGGGTGACTCC |
| | | | SEQ ID NO:4533 | SEQ ID NO:12545 | SEQ ID NO:20557 |
| | | AA | DYGMH | VIWYNENNKYYADSVKG | ELGMTGDS |
| | | | SEQ ID NO:4534 | SEQ ID NO:12546 | SEQ ID NO:20558 |
| iPS:392982 | 21-225_30D1 | NA | AGCTATGCCATGAGC | GCTATTAGTGGTCGTGGTGGTAGCACATTCCACGCAGACTCCGTGAAGGGC | GGGGAGTACTAGAGGACTACTACTTCTACGGTTTGGACGTC |
| | | | SEQ ID NO:4535 | SEQ ID NO:12547 | SEQ ID NO:20559 |
| | | AA | SYAMS | AISGRGGSTFHADSVKG | GELLEDYYFYGLDV |
| | | | SEQ ID NO:4536 | SEQ ID NO:12548 | SEQ ID NO:20560 |
| iPS:392984 | 21-225_30E11 | NA | ATCTATGCCATGAGC | GTTATTAGTGGTAGTGGTGGTAGCTCATTCTACGCAGACTCCGTGAAGGGC | GATCGGGTGAAAGCTCATGATGGTTTTGATATC |
| | | | SEQ ID NO:4537 | SEQ ID NO:12549 | SEQ ID NO:20561 |
| | | AA | IYAMS | VISGSGGSSFYADSVKG | DRVKAHDGFDI |
| | | | SEQ ID NO:4538 | SEQ ID NO:12550 | SEQ ID NO:20562 |

FIGURE 49
(Continued)

| | | | | |
|---|---|---|---|---|
| iPS:392986 | 21-225_31B8 | NA | AGCTATGCCATGAGC | GCTATTAGTGGTCGTGGT GGTAGCACATTCCACGC AGACTCCGTGAAGGGC | GGGGAGCTACTAGAGGACTA CTACTTCTACGGTATGGACG TC |
| | | AA | SEQ ID NO:4539 SYAMS | SEQ ID NO:12551 AISGRGGSTFHADSVKG | SEQ ID NO:20563 GELLEDYYFYGMDV |
| iPS:392988 | 21-225_25E6 | NA | SEQ ID NO:4540 GACTATGGCATGCAC | SEQ ID NO:12552 GTTATATGGTATGATGA AAATAATAAATACTATG CAGACTCCGTGAAGGGC | SEQ ID NO:20564 GAACTGGGGATGACGGGTGA CTCC |
| | | AA | SEQ ID NO:4541 DYGMH | SEQ ID NO:12553 VIWYDENNKYYADSVKG | SEQ ID NO:20565 ELGMTGDS |
| iPS:392990 | 21-225_25H10 | NA | SEQ ID NO:4542 GACTATGGCATGCAC | SEQ ID NO:12554 GTTATATGGTATGATGA AAGTAATAAATACTATG CAGACTCCATGAAGGGC | SEQ ID NO:20566 GAACTGGGGATGACGGGTGA CTAC |
| | | AA | SEQ ID NO:4543 DYGMH | SEQ ID NO:12555 VIWYDESNKYYADSMKG | SEQ ID NO:20567 ELGMTGDY |
| iPS:392992 | 21-225_26C4 | NA | SEQ ID NO:4544 AATTATGATATCAAC | SEQ ID NO:12556 TGGATGAACCCTAACAG TGGTAACACAGGCTATG CACAGAGATTCCAGGGC | SEQ ID NO:20568 AGCAGTGGCTGGTACTACTT TGACTAC |
| | | AA | SEQ ID NO:4545 NYDIN | SEQ ID NO:12557 WMNPNSGNTGYAQRFQG | SEQ ID NO:20569 SSGWYYFDY |
| | | | SEQ ID NO:4546 | SEQ ID NO:12558 | SEQ ID NO:20570 |

FIGURE 49
(Continued)

| | | | | |
|---|---|---|---|---|
| iPS:392994 | 21-225_26G11 | NA | AGCTATGGCATGCAC | GTTATATGGTATGATGG AAGTAATAAATACTATG CAGACTCCGTGAAGGGC | AGGTATAGCAACAGCTGGTC AGGGGGTATGGACGTC |
| | | | SEQ ID NO:4547 | SEQ ID NO:12559 | SEQ ID NO:20571 |
| | | AA | SYGMH | VIWYDGSNKYYADSVKG | RYSNSWSGGMDV |
| | | | SEQ ID NO:4548 | SEQ ID NO:12560 | SEQ ID NO:20572 |
| iPS:392996 | 21-225_28B1 | NA | AGCTATGCCATGAGC | GCTATTAGTGGTAGTGG AGGTAACACATTCTACG CAGACTCCGTGAAGGGC | TTGGGGCGTATAGCAGTGAC TGGTCCTTACTTTGACTAC |
| | | | SEQ ID NO:4549 | SEQ ID NO:12561 | SEQ ID NO:20573 |
| | | AA | SYAMS | AISGSGGNTFYADSVKG | LGRIAVTGPYFDY |
| | | | SEQ ID NO:4550 | SEQ ID NO:12562 | SEQ ID NO:20574 |
| iPS:392998 | 21-225_28A9 | NA | AGCTATGGCATACAC | GTTATATGGTTTGATGGA AGTAATAAATACTATGC AGACTCCGTGAAGGGC | GAAATTGGCTGGTTAGATGA CTAC |
| | | | SEQ ID NO:4551 | SEQ ID NO:12563 | SEQ ID NO:20575 |
| | | AA | SYGIH | VIWFDGSNKYYADSVKG | EIGWLDDY |
| | | | SEQ ID NO:4552 | SEQ ID NO:12564 | SEQ ID NO:20576 |
| iPS:393000 | 21-225_29D7 | NA | AGCTATGGCATGCAC | GTTATATGGTATGATGA AAGTAATAAATACTATG GAGACTCCGTGAAGGGC | GAACTGGGGTTCCTCTCTGA CTAC |
| | | | SEQ ID NO:4553 | SEQ ID NO:12565 | SEQ ID NO:20577 |
| | | AA | SYGMH | VIWYDESNKYYGDSVKG | ELGFLSDY |
| | | | SEQ ID NO:4554 | SEQ ID NO:12566 | SEQ ID NO:20578 |

FIGURE 49
(Continued)

| | | | | |
|---|---|---|---|---|
| iPS:393002 | 21-225_30G1 | NA | TACTATGGCATGCAC | GTTATATGGCATGATGG AAGTAATAAATACTATG TAGACTCCGTGAAGGGC | GAAAATAGCAGTTCGTACTA CTTTGACTAC |
| | | | SEQ ID NO:4555 | SEQ ID NO:12567 | SEQ ID NO:20579 |
| | | AA | YYGMH | VIWHDGSNKYYVDSVKG | ENSSSYYFDY |
| | | | SEQ ID NO:4556 | SEQ ID NO:12568 | SEQ ID NO:20580 |
| iPS:393004 | 21-225_30G11 | NA | AGCTATGCCATGAGC | GCTATTAGTGGTCGTGGT GGTAGCACATTCAACGC AGACTCCGTGAAGGGC | GGGGAGCTACTAGAGGACTA CTACTTCTACGGTATGGACG TC |
| | | | SEQ ID NO:4557 | SEQ ID NO:12569 | SEQ ID NO:20581 |
| | | AA | SYAMS | AISGRGGSTFNADSVKG | GELLEDYFYGMDV |
| | | | SEQ ID NO:4558 | SEQ ID NO:12570 | SEQ ID NO:20582 |
| iPS:393006 | 21-225_31G9 | NA | AGCTATAGCATGAAC | TCAATTAGTAGTAGTAGT AGTTACATATACTACGC AGACTCAGTGAAGGGC | GATCGAGGCAGCAGC |
| | | | SEQ ID NO:4559 | SEQ ID NO:12571 | SEQ ID NO:20583 |
| | | AA | SYSMN | SISSSSSYIYYADSVKG | DRGSS |
| | | | SEQ ID NO:4560 | SEQ ID NO:12572 | SEQ ID NO:20584 |
| iPS:393010 | 21-225_25E11 | NA | AGCTATGCCATGAGC | GTTATTAGTGGTGGTGGT GGTAGCACATACTACGC AGACTCCGTGAAGGGC | CGTGGATATAGTGGCTACGA GGACCTCCTCTACTTTGACT GC |
| | | | SEQ ID NO:4561 | SEQ ID NO:12573 | SEQ ID NO:20585 |
| | | AA | SYAMS | VISGGGSTYYADSVKG | RGYSGYEDLLYFDC |
| | | | SEQ ID NO:4562 | SEQ ID NO:12574 | SEQ ID NO:20586 |
| iPS:393012 | 21-225_26G7 | NA | AGCTATGGCATGCAC | GTTATATGGTATGATGG AAGTAATAAATATTATG CAGACTCCGTGAAGGGC | AGGTATAGCAGCAGCTGGTC AGGGGGTATGGACGTC |
| | | | SEQ ID NO:4563 | SEQ ID NO:12575 | SEQ ID NO:20587 |

FIGURE 49
(Continued)

| | | | VIWYDGSNKYYADSVKG | RYSSSWSGGMDV |
|---|---|---|---|---|
| iPS:393014 | 21-225_26D12 | AA | SYGMH | |
| | | | SEQ ID NO:4564 | SEQ ID NO:12576 | SEQ ID NO:20588 |
| | | NA | AGTTATGGCCATGCAC | GTTATATGGTATGATGG AAGTAATGAATACTATG CAGACTCCGTGAAGGGC | GATTCCTCCCCCTACGGTAT GGACGTC |
| | | | SEQ ID NO:4565 | SEQ ID NO:12577 | SEQ ID NO:20589 |
| iPS:393016 | 21-225_28F11 | AA | SYGMH | VIWYDGSNEYYADSVKG | DSSPYGMDV |
| | | | SEQ ID NO:4566 | SEQ ID NO:12578 | SEQ ID NO:20590 |
| | | NA | AGCTATGGCCATGAGC | GTTACTAGTGGTAGTGGT GGTACCACATTCTACGC AGACTCCGTGAAGGGC | CGGACCCAGTTTGATGATTT TGATATC |
| | | | SEQ ID NO:4567 | SEQ ID NO:12579 | SEQ ID NO:20591 |
| | | AA | SYAMS | VTSGSGGTTFYADSVKG | RTQFDDFDI |
| | | | SEQ ID NO:4568 | SEQ ID NO:12580 | SEQ ID NO:20592 |
| iPS:393018 | 21-225_29B8 | NA | GACTATGGCCATGCAC | GTTATATGGTATGATGA AATAATAAATACTATG CAGACTCCGTGAAGGGC | GAACTGGGGATGACGGGTGA CTCC |
| | | | SEQ ID NO:4569 | SEQ ID NO:12581 | SEQ ID NO:20593 |
| | | AA | DYGMH | VIWYDENNKYYADSVKG | ELGMIGDS |
| | | | SEQ ID NO:4570 | SEQ ID NO:12582 | SEQ ID NO:20594 |
| iPS:393020 | 21-225_30E2 | NA | AGCTATGGCCATGCAC | GTTATATCATATGTGGA AGTAATAAATTCTATGC AGTCTCCGTGAAGGGC | AGGGGGTATAGCAGTGGAGG CTACGGTATGGACGTC |
| | | | SEQ ID NO:4571 | SEQ ID NO:12583 | SEQ ID NO:20595 |
| | | AA | SYGMH | VISYGGSNKFYAVSVKG | RGYSSGGYGMDV |
| | | | SEQ ID NO:4572 | SEQ ID NO:12584 | SEQ ID NO:20596 |

FIGURE 49
(Continued)

| | | | | | |
|---|---|---|---|---|---|
| iPS:393022 | 21-225_30H11 | NA | AGCTATAGCATGAAC | TCCATTAGTGGTAGTAGT AGTTACATATACGC AGACTCAGTGAAGGGC | GATAGGGGGAGCCTC |
| | | | SEQ ID NO:4573 | SEQ ID NO:12585 | SEQ ID NO:20597 |
| | | AA | SYSMN | SISGSSYIYYADSVKG | DRGSL |
| | | | SEQ ID NO:4574 | SEQ ID NO:12586 | SEQ ID NO:20598 |
| iPS:393024 | 21-225_31H9 | NA | AGCTGTGCCATGAAC | GCTATTAGTGGTAGTGGT GGTAGCTCATTCTACGCA GACTCCGTGAAGGGC | CGGACTCCCTATGATGTCTTT GATATC |
| | | | SEQ ID NO:4575 | SEQ ID NO:12587 | SEQ ID NO:20599 |
| | | AA | SCAMN | AISGSGGSSFYADSVKG | RTPYDVFDI |
| | | | SEQ ID NO:4576 | SEQ ID NO:12588 | SEQ ID NO:20600 |
| iPS:393026 | 21-225_32B6 | NA | GACTATGGCATGCAC | GTTATATGGTATGATGA AAATACTAAATACTATG CAGACTCCGTGAAGGGC | GAGTGGGGGGACTAC |
| | | | SEQ ID NO:4577 | SEQ ID NO:12589 | SEQ ID NO:20601 |
| | | AA | DYGMH | VIWYDENTKYYADSVKG | EWGDY |
| | | | SEQ ID NO:4578 | SEQ ID NO:12590 | SEQ ID NO:20602 |
| iPS:393028 | 21-225_25D7 | NA | AGCTATGCCATGAGC | GCTATTAGTGGTAGAGG TGGTACCACATTCTACGC AGACTCCGTGAAGGGC | GACGGGTACGGTGGTAACTC CTTCTTTGACTAC |
| | | | SEQ ID NO:4579 | SEQ ID NO:12591 | SEQ ID NO:20603 |
| | | AA | SYAMS | AISGRGGTTFYADSVKG | DGYGGNSFFDY |
| | | | SEQ ID NO:4580 | SEQ ID NO:12592 | SEQ ID NO:20604 |
| iPS:393030 | 21_225_25H11 | NA | GACTATGGCATGCAC | GTTATATGGTATGATGA AAATAATGAATACTATG CAGACTCCGTGAAGGGC | GAACTGGGGATGACGGGTGA CTCC |

FIGURE 49
(Continued)

| | | | | | | | |
|---|---|---|---|---|---|---|---|
| iPS:393032 | 21-225_25H11 | AA | SEQ ID NO:4581<br>DYGMH | SEQ ID NO:12593<br>VIWYDENNEYYADSVKG | SEQ ID NO:20605<br>ELGMTGDS |
| | | NA | SEQ ID NO:4582<br>GGCTATGGCATGCAC | SEQ ID NO:12594<br>ATTATATGGTATGATGG<br>AAGTAATAAATACTATG<br>CAGACTCCGTGAAGGGC | SEQ ID NO:20606<br>GAGAGGTACGATTTTTGGAG<br>TGGTTGTATGGACGTC |
| iPS:393034 | 21-225_26F8 | AA | SEQ ID NO:4583<br>GYGMH | SEQ ID NO:12595<br>IIWYDGSNKYYADSVKG | SEQ ID NO:20607<br>ERYDFWSGCMDV |
| | | NA | SEQ ID NO:4584<br>GACTATGGCATGCAC | SEQ ID NO:12596<br>GTTATATGGTATGATGA<br>AATAATAAATACTATG<br>TAGACTCCGTGAGGGGC | SEQ ID NO:20608<br>GAACTGGGGATGACGGGTGA<br>CTCC |
| iPS:393034 | 21-225_27F2 | AA | SEQ ID NO:4585<br>DYGMH | SEQ ID NO:12597<br>VIWYDENNKYYVDSVRG | SEQ ID NO:20609<br>ELGMTGDS |
| | | NA | SEQ ID NO:4586<br>ACCTATGGCATGCAC | SEQ ID NO:12598<br>GTTATATGGTATGATGG<br>AAGTAATAAATACTATG<br>CAGACTCCGTGAAGGGC | SEQ ID NO:20610<br>GATCGATACGATTTTTGGAG<br>TGGTTATTTTGACTAC |
| iPS:393036 | 21-225_28G3 | AA | SEQ ID NO:4587<br>TYGMH | SEQ ID NO:12599<br>VIWYDGSNKYYADSVKG | SEQ ID NO:20611<br>DRYDFWSGYFDY |
| | | | SEQ ID NO:4588 | SEQ ID NO:12600 | SEQ ID NO:20612 |

FIGURE 49
(Continued)

| | | | | |
|---|---|---|---|---|
| iPS:393038 | 21-225_29D8 | NA | GACTATGGCATACAC | GTTATATGGTTGATGGAACTAATAAATACTATGCAGACTCCGTGAAGGGC | GAAATTGGCTGGTTAGATGACTAC |
| | | | SEQ ID NO:4589 | SEQ ID NO:12601 | SEQ ID NO:20613 |
| | | AA | DYGIH | VIWFDGTNKYYADSVKG | EIGWLDDY |
| | | | SEQ ID NO:4590 | SEQ ID NO:12602 | SEQ ID NO:20614 |
| iPS:393040 | 21-225_30E3 | NA | AGCTATGCCATGAAC | GCTATTAGTGGTGTCGTGGTGGTAGCACATTCTACGCAGACTCCGAGAAGGGC | GGGGAGCTATTAGAGGACTACTACTACTACGGAATGGACGTC |
| | | | SEQ ID NO:4591 | SEQ ID NO:12603 | SEQ ID NO:20615 |
| | | AA | SYAMN | AISGRGGSTFYADSEKG | GELLEDYYYGMDV |
| | | | SEQ ID NO:4592 | SEQ ID NO:12604 | SEQ ID NO:20616 |
| iPS:393042 | 21-225_31F1 | NA | GACTACTATATGCAC | TGGATCAACCCTAACAGTGGTGGCACAAACTATGCACAGAAGTTTCAGGGC | GATAGTAGCAATTTCAGCAACTGGTACGATTACTACGGTATGGACGTC |
| | | | SEQ ID NO:4593 | SEQ ID NO:12605 | SEQ ID NO:20617 |
| | | AA | DYYMH | WINPNSGGTNYAQKFQG | DSSNFSNWYDYYGMDV |
| | | | SEQ ID NO:4594 | SEQ ID NO:12606 | SEQ ID NO:20618 |
| iPS:393044 | 21-225_25B8 | NA | AGCTATGGTATCAGC | TGGATCAGCGCTTACAATGTAACACAACCTATGCACAGAAGCTCCGGGGC | ACCGCTGCTGGGTATAGCAGCAGCTGGTTTGACTAC |
| | | | SEQ ID NO:4595 | SEQ ID NO:12607 | SEQ ID NO:20619 |
| | | AA | SYGIS | WISAYNGNTTYAQKLRG | TAAGYSSSWFDY |
| | | | SEQ ID NO:4596 | SEQ ID NO:12608 | SEQ ID NO:20620 |

FIGURE 49
(Continued)

| | | | | | |
|---|---|---|---|---|---|
| iPS:393046 | 21-225_25A12 | NA | AACTGTGTCATGCAC | GTTATATGGTATGATGG AAGTAATAAATACTATG CAGACTCCGTGAAGGGC | GAGGAGTATAGCAGTGGCTG GTACGACTACGGTATGACG TC |
| | | | SEQ ID NO:4597 | SEQ ID NO:12609 | SEQ ID NO:20621 |
| | | AA | NCVMH | VIWYDGSNKYYADSVKG | EEYSSGWYDYGMDV |
| | | | SEQ ID NO:4598 | SEQ ID NO:12610 | SEQ ID NO:20622 |
| iPS:393048 | 21-225_27C3 | NA | GACTATGGCATGCAC | GTTATATGGTATGATGA AATATAAATCCTATG CAGACTCCGTGAAGGGC | GAACTGGGGATGACGGGTGA CTCC |
| | | | SEQ ID NO:4599 | SEQ ID NO:12611 | SEQ ID NO:20623 |
| | | AA | DYGMH | VIWYDENNKSYADSVKG | ELGMTGDS |
| | | | SEQ ID NO:4600 | SEQ ID NO:12612 | SEQ ID NO:20624 |
| iPS:393050 | 21-225_28C5 | NA | AGCTATGGTATCAGC | TGGATCAGCGCTTACAA TGTAACACAACCTATG CACAGAAGCTCCGGGGC | ACCGCTGCTGGGTATAGCAG CAGCTGGTTTGACTAC |
| | | | SEQ ID NO:4601 | SEQ ID NO:12613 | SEQ ID NO:20625 |
| | | AA | SYGIS | WISAYNGNTTYAQKLRG | TAAGYSSSWFDY |
| | | | SEQ ID NO:4602 | SEQ ID NO:12614 | SEQ ID NO:20626 |
| iPS:393054 | 21-225_29G8 | NA | GACTATGGCATGCAC | GTTATATGGTATGATGA AACTAATAAATACTATG CAGACTCCGTGAAGGGC | GAACTGGGGATGACGAGTGA CTAC |
| | | | SEQ ID NO:4603 | SEQ ID NO:12615 | SEQ ID NO:20627 |
| | | AA | DYGMH | VIWYDETNKYYADSVKG | ELGMTSDY |
| | | | SEQ ID NO:4604 | SEQ ID NO:12616 | SEQ ID NO:20628 |

FIGURE 49
(Continued)

| iPS:393056 | 21-225_30F3 | NA | AGCTATGGCATGCAC SEQ ID NO:4605 | GTTATATGGTATGATGTA AGTAATAAATACTATGC AGACTCCGTGAAGGGC SEQ ID NO:12617 | GAAATGGGCTGGTACGATGA CTAC SEQ ID NO:20629 |
|---|---|---|---|---|---|
| | | AA | SYGMH SEQ ID NO:4606 | VIWYDVSNKYYADSVKG SEQ ID NO:12618 | EMGWYDDY SEQ ID NO:20630 |
| iPS:393058 | 21-225_31H3 | NA | AGCTATGCCATGAAC SEQ ID NO:4607 | GCTATTAGTGGTCGTGGT GGTAACACATTCTACGC AGACTCCGTGAAGGGC SEQ ID NO:12619 | GGGGAGTTACTAGAGGACTA CTACTACTACGGAATGGACG TC SEQ ID NO:20631 |
| | | AA | SYAMN SEQ ID NO:4608 | AISGRGGNTFYADSVKG SEQ ID NO:12620 | GELLEDYYYYGMDV SEQ ID NO:20632 |
| iPS:393060 | 21-225_32G12 | NA | AGCTATGCCATGAGC SEQ ID NO:4609 | TCTATTAGTGGTCGTGGT GGTAGCACATTCCACGC AGACTCCGTGAAGGGC SEQ ID NO:12621 | GGGGAGCTACTAGAGGACTA CTACTTCTACGGTATGGACG TC SEQ ID NO:20633 |
| | | AA | SYAMS SEQ ID NO:4610 | SISGRGGSTFHADSVKG SEQ ID NO:12622 | GELLEDYYFYGMDV SEQ ID NO:20634 |
| iPS:393062 | 21-225_33H3 | NA | AGCTATGGCATGCAC SEQ ID NO:4611 | ATTATATCATATGGTGGA AGTAATAACTTCTATGCA GACTCCGTGAAGGGC SEQ ID NO:12623 | AGGGGGTATAGCAGTGGAGG CTACGGTATGGACGTC SEQ ID NO:20635 |
| | | AA | SYGMH SEQ ID NO:4612 | IISYGGSNNFYADSVKG SEQ ID NO:12624 | RGYSSGGYGMDV SEQ ID NO:20636 |
| iPS:393064 | 21-225_33A9 | NA | AGTTATGATATCAAC SEQ ID NO:4613 | TGGATGAACCCTAACAG TGGTAACACAGGCTATG CACAGAAGTTCCAGGGC SEQ ID NO:12625 | AAGAAGGCTAACGACTAC SEQ ID NO:20637 |

FIGURE 49
(Continued)

| | | AA | SYDIN | | WMNPNSGNTYAQKFQG | KKANDY |
|---|---|---|---|---|---|---|
| | | | SEQ ID NO:4614 | | SEQ ID NO:12626 | SEQ ID NO:20638 |
| iPS:393066 | | NA | TACTATGGCATGCAC | | GTTATATGGCATGATGG AAGTAATAAATACTATG TAGACTCCGTGAAGGGC | GAAAATAGCAGTTCGTTCTA CTTTGACTAC |
| | 21-225_34D3 | | SEQ ID NO:4615 | | SEQ ID NO:12627 | SEQ ID NO:20639 |
| | | AA | YYGMH | | VIWHDGSNKYYVDSVKG | ENSSSFYFDY |
| | | | SEQ ID NO:4616 | | SEQ ID NO:12628 | SEQ ID NO:20640 |
| iPS:393068 | | NA | AGCTATGCCATGAGC | | GCTATTAGTGGTCGTGGT GGTAGCACATTCCACGC AGACTCCGTGAAGGGC | GGGGAGCTACTAGAGGACTA CTACTTCTACGGTATGGACG TC |
| | 21-225_34G9 | | SEQ ID NO:4617 | | SEQ ID NO:12629 | SEQ ID NO:20641 |
| | | AA | SYAMS | | AISGRGGSTFHADSVKG | GELLEDYYFYGMDV |
| | | | SEQ ID NO:4618 | | SEQ ID NO:12630 | SEQ ID NO:20642 |
| iPS:393072 | | NA | AGCTATGCCATGAAC | | GCTATTAGTGGTCGTGGT GGTAGCACATTCCACGC AGACTCCGTGAAGGGC | GGGGAGCTATTAGAGGACTA CTACTTCTACGGTATGGACG TC |
| | 21-225_36C5 | | SEQ ID NO:4619 | | SEQ ID NO:12631 | SEQ ID NO:20643 |
| | | AA | SYAMN | | AISGRGGSTFHADSVKG | GELLEDYYFYGMDV |
| | | | SEQ ID NO:4620 | | SEQ ID NO:12632 | SEQ ID NO:20644 |
| iPS:393074 | | NA | GACTATGGCATGCAC | | GTTATATGGTATGATAG AAATAATAAATACTATG CAGACTCCGTGAAGGGC | GAAATGGGCTGGTACGATGA CTAC |
| | 21-225_33B1 | | SEQ ID NO:4621 | | SEQ ID NO:12633 | SEQ ID NO:20645 |
| | | AA | DYGMH | | VIWYDRNNKYYADSVKG | EMGWYDDY |

FIGURE 49
(Continued)

| | | | | |
|---|---|---|---|---|
| iPS:393076 | 21-225_33A4 | NA | SEQ ID NO:4622<br>AGCTATGCCATGAAC | SEQ ID NO:12634<br>GCTATTAGTCGTCGTGGT<br>GGTAGCACATTCTACGC<br>AGACTCCGTGAAGGGC | SEQ ID NO:20646<br>GGGGAACTACTAGAGGACTA<br>CTCCTACTACGGTATCGACG<br>TC |
| | | AA | SEQ ID NO:4623<br>SYAMN | SEQ ID NO:12635<br>AISRRGGSTFYADSVKG | SEQ ID NO:20647<br>GELLEDYSYYGIDV |
| iPS:393078 | 21-225_33H11 | NA | SEQ ID NO:4624<br>AGCTATAGCATGAAC | SEQ ID NO:12636<br>TCCATTAGTGGTAGTAGT<br>AGTTACATATACTACGC<br>AGACTCAGTGAAGGGC | SEQ ID NO:20648<br>ACAAACGGTATGGACGTC |
| | | AA | SEQ ID NO:4625<br>SYSMN | SEQ ID NO:12637<br>SISGSSSYIYYADSVKG | SEQ ID NO:20649<br>TNGMDV |
| iPS:393080 | 21-225_34F3 | NA | SEQ ID NO:4626<br>GGCTACCATATGCAC | SEQ ID NO:12638<br>TGGATCAACCTAACAG<br>TGGTGGCACAAACTATG<br>CACAGAAGTTTCAGGGC | SEQ ID NO:20650<br>GACGGTACCAGCTCCTTTGA<br>CTAC |
| | | AA | SEQ ID NO:4627<br>GYHMH | SEQ ID NO:12639<br>WINPNSGGTNYAQKFQG | SEQ ID NO:20651<br>DGTSSFDY |
| iPS:393082 | 21-225_34C11 | NA | SEQ ID NO:4628<br>AGTTATACCATGAGC | SEQ ID NO:12640<br>TCCATTAGTGGTAGTAGT<br>AATTACATATACTACGC<br>AGACTCAGTGAAGGGC | SEQ ID NO:20652<br>TTAACTGGTTTTGACTAC |
| | | AA | SEQ ID NO:4629<br>SYTMS | SEQ ID NO:12641<br>SISGSSNYIYYADSVKG | SEQ ID NO:20653<br>LTGFDY |
| iPS:393084 | 21-225_35C6 | NA | SEQ ID NO:4630<br>GGCGATTATATGCAC | SEQ ID NO:12642<br>TGGATCAGCCCTAAAAA<br>TGGTGGCACAAACTATG<br>CACAGAAGTTTCAGGGC | SEQ ID NO:20654<br>GATGGAACTGGGTCCTTTGA<br>CTAC |
| | | | SEQ ID NO:4631 | SEQ ID NO:12643 | SEQ ID NO:20655 |

FIGURE 49
(Continued)

| | | | | | | |
|---|---|---|---|---|---|---|
| iPS:393086 | 21-225_36H5 | AA | GDYMH | | WISPKNGGTNYAQKFQG | DGTGSFDY |
| | | | SEQ ID NO:4632 | | SEQ ID NO:12644 | SEQ ID NO:20656 |
| | | NA | GACTATCATATGCAC | | TGGATCAACCCTAATAGGGGTGGCACAAACTATGCACAGAAGTTCAGGAC | GATGGAACTGGGTCCTTTGACTAC |
| | | | SEQ ID NO:4633 | | SEQ ID NO:12645 | SEQ ID NO:20657 |
| | | AA | DYHMH | | WINPNRGGTNYAQKFQD | DGTGSFDY |
| | | | SEQ ID NO:4634 | | SEQ ID NO:12646 | SEQ ID NO:20658 |
| iPS:393088 | 21-225_33D1 | NA | AATTATGACATTAAAC | | TGGATGCACCCTAACAGTGGTAACACAGGCTTTGCACAGAAGTTCCGGGGC | AGCAGTGGCTGGTACTTTTTGACTAC |
| | | | SEQ ID NO:4635 | | SEQ ID NO:12647 | SEQ ID NO:20659 |
| | | AA | NYDIN | | WMHPNSGNTGFAQKFRG | SSGWYFFDY |
| | | | SEQ ID NO:4636 | | SEQ ID NO:12648 | SEQ ID NO:20660 |
| iPS:393090 | 21-225_33A5 | NA | AGCTATGTCATAAAC | | GCTATTAGTGGTAGTGGTGTTAGCACATACTACGCAGACTCCGTGAAGGGC | ACTTCCCTCTTTGACTAC |
| | | | SEQ ID NO:4637 | | SEQ ID NO:12649 | SEQ ID NO:20661 |
| | | AA | SYVIN | | AISGSGVSTYYADSVKG | TSLFDY |
| | | | SEQ ID NO:4638 | | SEQ ID NO:12650 | SEQ ID NO:20662 |
| iPS:393092 | 21-225_33C12 | NA | CACTATGGCATGCAC | | GTTATATGGTATGATGGAAGTAATAAATACTATGCAGACTCCGTGAAGGGC | GAAAATAGCAGCTCGTACTACTTTGACTAC |
| | | | SEQ ID NO:4639 | | SEQ ID NO:12651 | SEQ ID NO:20663 |
| | | AA | HYGMH | | VIWYDGSNKYYADSVKG | ENSSSYYFDY |
| | | | SEQ ID NO:4640 | | SEQ ID NO:12652 | SEQ ID NO:20664 |

FIGURE 49
(Continued)

| | | | | | |
|---|---|---|---|---|---|
| iPS:393094 | 21-225_34C4 | NA | AGAAGTAGTTACTACTGGGG C | AGTATCTATTATAGTGGG AGCACCGCCTACAATCC GTCCCTCAAGAGT | CTGAGCAGCAGCTGGTCTTT TGACTAC |
| | | AA | SEQ ID NO:4641 RSSYYWG | SEQ ID NO:12653 SIYYSGSTAYNPSLKS | SEQ ID NO:20665 LSSSWSFDY |
| iPS:393096 | 21-225_34D11 | NA | SEQ ID NO:4642 AGCTATGCCATGAAC | SEQ ID NO:12654 GCTATTAGTGGTCGTGGT GGTAGCACATTCCACGC AGACTCCGTGAAGGGC | SEQ ID NO:20666 GGGGAGTTAGTAGAGAGACTA CTACTTCTACGGTATGGACG TC |
| | | AA | SEQ ID NO:4643 SYAMN | SEQ ID NO:12655 AISGRGGSTFHADSVKG | SEQ ID NO:20667 GELVEDYYFYGMDV |
| iPS:393098 | 21-225_35G6 | NA | SEQ ID NO:4644 GACTACCATATACAC | SEQ ID NO:12656 TGGATCAACCCTAACAA TGGTGGCACACACTATG CACAGGAGTTTCAGGGC | SEQ ID NO:20668 GATGGAACTGGGTCCTTTGA CTAC |
| | | AA | SEQ ID NO:4645 DYHIH | SEQ ID NO:12657 WINPNNGGTHYAQEFQG | SEQ ID NO:20669 DGTGSFDY |
| iPS:393100 | 21-225_36B8 | NA | SEQ ID NO:4646 AACTATATGGCATGCAC | SEQ ID NO:12658 GTTATATGGCATGATGG AAGTAATAAATACTATG GAGACTCCGTGAAGGGC | SEQ ID NO:20670 GAAAATAGCAGCTCGTACTA CTTTGACTAC |
| | | AA | SEQ ID NO:4647 NYGMH | SEQ ID NO:12659 VIWHDGSNKYYGDSVKG | SEQ ID NO:20671 ENSSSYYFDY |
| iPS:393102 | 21_225_33F1 | NA | SEQ ID NO:4648 AGCTATGCCATGAGC | SEQ ID NO:12660 TCTATTAGTGGTCGTGGT GGTAGCACATTCCACGC AGACTCCGTGAAGGGC | SEQ ID NO:20672 GGGGAGCTACTTGAGGACTA CTACTTCTACGGTATGGACG TC |

FIGURE 49
(Continued)

| | | | SEQ ID NO:4649 | | SEQ ID NO:12661 | | SEQ ID NO:20673 |
|---|---|---|---|---|---|---|---|
| iPS:393104 | 21-225_33F1 | AA | SYAMS | | SISGRGGSTFHADSVKG | | GELLEDYYFYGMDV |
| | | NA | AGCTGTGCCATGAGC | | GGTAGCACATTCCACGC<br>AGACTCCGTGAAGGGC | | GGGGAACTACTAGAGGACTA<br>CTACTTCTACGGTATGGACG<br>TC |
| iPS:393106 | 21-225_33A7 | | SEQ ID NO:4651 | | SEQ ID NO:12663 | | SEQ ID NO:20675 |
| | | AA | SCAMS | | AISGRGGSTFHADSVKG | | GELLEDYYFYGMDV |
| | | | SEQ ID NO:4652 | | SEQ ID NO:12664 | | SEQ ID NO:20676 |
| | | NA | AACTATGCCATGAAC | | GCTATTAGTCGTCGTGGT<br>GGTAGCACATTCTACGC<br>AGACTCCGTGAAGGGC | | GGGGAGCTACTAGAGGACTA<br>CTACTACTTCGCTATGGACG<br>TC |
| iPS:393108 | 21-225_34A6 | | SEQ ID NO:4653 | | SEQ ID NO:12665 | | SEQ ID NO:20677 |
| | | AA | NYAMN | | AISRRGGSTFYADSVKG | | GELLEDYYYFAMDV |
| | | | SEQ ID NO:4654 | | SEQ ID NO:12666 | | SEQ ID NO:20678 |
| | | NA | GGCTACTATATGCAC | | TGGATCAACCCTAACAG<br>TGGTGGCACAAACTATG<br>CACAGAAGTTTCAGGGC | | GATATTAGTAATTTCAGCAG<br>CTGGTACGATTACTACGCTA<br>TGGACGTC |
| iPS:393110 | 21-225_34G11 | | SEQ ID NO:4655 | | SEQ ID NO:12667 | | SEQ ID NO:20679 |
| | | AA | GYYMH | | WINPNSGGTNYAQKFQG | | DISNFSSWYDYYAMDV |
| | | | SEQ ID NO:4656 | | SEQ ID NO:12668 | | SEQ ID NO:20680 |
| | | NA | AGCTATGCCATGAGC | | GCTATTAGTGGTGGTGGT<br>GGTAGCACATTCCACGC<br>AGACTCCGTGAAGGGC | | GGGGAGCTACTACGAGGACTA<br>CTACTTCTACGGTATGGACG<br>TC |
| iPS:393112 | 21-225_35B7 | | SEQ ID NO:4657 | | SEQ ID NO:12669 | | SEQ ID NO:20681 |
| | | AA | SYAMS | | AISGRGGSTFHADSVKG | | GELLEDYYFYGMDV |
| | | | SEQ ID NO:4658 | | SEQ ID NO:12670 | | SEQ ID NO:20682 |
| iPS:393112 | 21_225_33G1 | NA | GGCTACTATATGCAC | | TGGATCAGCCCTAACAA<br>TGGTGGCACAAACTATG<br>CACAGAAGTTTCAGGGC | | GATGGAACTGGGTCCTTTGA<br>CTAC |

FIGURE 49
(Continued)

| | | | | | | |
|---|---|---|---|---|---|---|
| iPS:393114 | 21-225_33G1 | AA | SEQ ID NO:4659<br>GYYMH | SEQ ID NO:12671<br>WISPNNGGTNYAQKFQG | SEQ ID NO:20683<br>DGTGSFDY | |
| | | NA | SEQ ID NO:4660<br>AGCTATGCCATGAGC | SEQ ID NO:12672<br>GTTATTAGTGGTAGTGGT<br>GGTAGCTCATTCTACGCA<br>GACTCCGTGAAGGGC | SEQ ID NO:20684<br>GATCGGGTGAGAGCTCATGA<br>TGGTTTGATATC | |
| iPS:393116 | 21-225_33G12 | AA | SEQ ID NO:4661<br>SYAMS | SEQ ID NO:12673<br>VISGSGGSSFYADSVKG | SEQ ID NO:20685<br>DRVRAHDGFDI | |
| | | NA | SEQ ID NO:4662<br>GACTACCATATTCAC | SEQ ID NO:12674<br>TGGATCAACCCTAACAA<br>TGGTGGCACACACTATG<br>CACAGAAGTTTCAGGGC | SEQ ID NO:20686<br>GATGGAACTGGGTCCTTTGA<br>CTAC | |
| iPS:393118 | 21-225_34G7 | AA | SEQ ID NO:4663<br>DYHIH | SEQ ID NO:12675<br>WINPNNGGTHYAQKFQG | SEQ ID NO:20687<br>DGTGSFDY | |
| | | NA | SEQ ID NO:4664<br>AGCTATGCCATGAAC | SEQ ID NO:12676<br>GCTATTAGTGGTGGTCGTGGT<br>GGTAGCACATTCTACGC<br>AGACTCCGTGAAGGGC | SEQ ID NO:20688<br>GGGGAGCTACTAGAGGACTA<br>CTACTACTACGGTATGGACG<br>TC | |
| iPS:393120 | 21-225_34H11 | AA | SEQ ID NO:4665<br>SYAMN | SEQ ID NO:12677<br>AISGRGGSTFYADSVKG | SEQ ID NO:20689<br>GELLEDYYYGMDV | |
| | | NA | SEQ ID NO:4666<br>AGTTATAGCATGAAC | SEQ ID NO:12678<br>TCCATTAGTGGTACTGGT<br>AGTTTCATATACTACGCA<br>GACTCAGTGAAGGGC | SEQ ID NO:20690<br>GTCTCTGGCTTTGACTAC | |
| iPS:393120 | 21-225_35H8 | AA | SEQ ID NO:4667<br>SYSMN | SEQ ID NO:12679<br>SISGTGSFTYYADSVKG | SEQ ID NO:20691<br>VSGFDY | |
| | | | SEQ ID NO:4668 | SEQ ID NO:12680 | SEQ ID NO:20692 | |

FIGURE 49
(Continued)

| | | | | |
|---|---|---|---|---|
| iPS:393122 | 21-225_33B2 | NA | AACTATGGCATGCAC SEQ ID NO:4669 | GTTATATGGCATGATGG AAGTAATAAATACTATG CAGACTCCGTGAAGGGC SEQ ID NO:12681 | GAAAATAGCAGCTGTACTA CTTTGACTAC SEQ ID NO:20693 |
| | | AA | NYGMH SEQ ID NO:4670 | VIWHDGSNKYYADSVKG SEQ ID NO:12682 | ENSSSYYFDY SEQ ID NO:20694 |
| iPS:393124 | 21-225_33G7 | NA | AACTATGCCATGAGC SEQ ID NO:4671 | GCTATTAGTCGTCGTGGT GGTAGCACATTCTACGC AGACTCCGTGAAGGGC SEQ ID NO:12683 | GGGGAGCTACTAGAGGACTA CTCCTACTACGGTATGGACG TC SEQ ID NO:20695 |
| | | AA | NYAMS SEQ ID NO:4672 | AISRRGGSTFYADSVKG SEQ ID NO:12684 | GELLEDYSYYGMDV SEQ ID NO:20696 |
| iPS:393126 | 21-225_35D1 | NA | AGCTATGCCATGAGC SEQ ID NO:4673 | GCTATTAGTGGTCGTGGT GGTAGCACATTCCACGC AGACTCCGTGAAGGGC SEQ ID NO:12685 | GGGGAGTTACTAGAGGACTA CTACTTCTACGGTATGGACG TC SEQ ID NO:20697 |
| | | AA | SYAMS SEQ ID NO:4674 | AISGRGGSTFHADSVKG SEQ ID NO:12686 | GELLEDYYFYGMDV SEQ ID NO:20698 |
| iPS:393128 | 21-225_35F11 | NA | AGCTATGCCATGAGC SEQ ID NO:4675 | GCTATTAGTGGTCGTGGT GGTAGCACATTCCACGC AGACTCCATGAAGGGC SEQ ID NO:12687 | GGGGAGCTACTAGAGGACTA CTACTTCTACGGTATGGACG TC SEQ ID NO:20699 |
| | | AA | SYAMS SEQ ID NO:4676 | AISGRGGSTFHADSMKG SEQ ID NO:12688 | GELLEDYYFYGMDV SEQ ID NO:20700 |
| iPS:393130 | 21-225_33C2 | NA | AGCTATACCATGAAC SEQ ID NO:4677 | TCCATTAGTGGTAGTAGT AGTTACATATACTACGC GGACTCAGTGAAGGGC SEQ ID NO:12689 | GATCGGGGGGGGACC SEQ ID NO:20701 |

FIGURE 49
(Continued)

| | | AA | SYTMN | | SISGSSSYIYYADSVKG | | DRGGT | |
|---|---|---|---|---|---|---|---|---|
| iPS:393132 | | | SEQ ID NO:4678 | | SEQ ID NO:12690 | | SEQ ID NO:20702 | |
| | 21-225_33H7 | NA | GACTACCATATACAC | | TGGATCAACCCTAACAATGGTGGCACACACTATGCACAGGAGTTTCAGGGC | | GATGGAACTGGGTCCTTTGACTAC | |
| | | | SEQ ID NO:4679 | | SEQ ID NO:12691 | | SEQ ID NO:20703 | |
| | | AA | DYHIH | | WINPNNGGTHYAQEFQG | | DGTGSFDY | |
| iPS:393134 | | | SEQ ID NO:4680 | | SEQ ID NO:12692 | | SEQ ID NO:20704 | |
| | 21-225_34C2 | NA | AACTATGTCATGCAC | | CTTATATGGTATGATGGAAGTAATAAATACTATGCAGACTCCGTGAAGGGC | | GAAAATAGCAGCTCGTACTACTTTGACTAC | |
| | | | SEQ ID NO:4681 | | SEQ ID NO:12693 | | SEQ ID NO:20705 | |
| | | AA | NYVMH | | LIWYDGSNKYYADSVKG | | ENSSSYYFDY | |
| iPS:393136 | | | SEQ ID NO:4682 | | SEQ ID NO:12694 | | SEQ ID NO:20706 | |
| | 21-225_34D8 | NA | AACTATGGCATGCAC | | GTTATATGGTATGATGGAAGTAATAAATACTATGCAGACTCCGTGAAGGGC | | GAAAATAGCAGCTCGTACTACTTTGACTAC | |
| | | | SEQ ID NO:4683 | | SEQ ID NO:12695 | | SEQ ID NO:20707 | |
| | | AA | NYGMH | | VIWYDGSNKYYADSVKG | | ENSSSYYFDY | |
| iPS:393138 | | | SEQ ID NO:4684 | | SEQ ID NO:12696 | | SEQ ID NO:20708 | |
| | 21-225_35E3 | NA | AGCTATGGCATGCAC | | GTTATATCATATGTGTGGAAGTAATAAATACTATGCAGACTCCGTGAAGGGC | | AGGGGGTATAGCAGTGGAGGCTACGGTATGGACGTC | |
| | | | SEQ ID NO:4685 | | SEQ ID NO:12697 | | SEQ ID NO:20709 | |

FIGURE 49
(Continued)

| | | AA | SYGMH | VISYGGSNKYYADSVKG | RGYSSGGYGMDV |
|---|---|---|---|---|---|
| iPS:393140 | 21-225_35H12 | | SEQ ID NO:4686 | SEQ ID NO:12698 | SEQ ID NO:20710 |
| | | NA | GACTACTATATACAC | TGGATCAACCCTAATAGGGGTGGCACAAACTATGCACAGAAGTTTCAGGGC | GATGAACTGGGTCCTTTGACTAC |
| | | | SEQ ID NO:4687 | SEQ ID NO:12699 | SEQ ID NO:20711 |
| | | AA | DYYIH | WINPNRGGTNYAQKFQG | DGTGSFDY |
| iPS:393142 | 21-225_33A3 | | SEQ ID NO:4688 | SEQ ID NO:12700 | SEQ ID NO:20712 |
| | | NA | AGCTATGGCATGAAC | TCCATTAGTGGTAGTAGTACTTACATATACTACGCAGACTCAGTGAAGGGC | ACAAACGGTATGGACGTC |
| | | | SEQ ID NO:4689 | SEQ ID NO:12701 | SEQ ID NO:20713 |
| | | AA | SYGMN | SISGSSTYIYYADSVKG | TNGMDV |
| iPS:393144 | 21-225_34D2 | | SEQ ID NO:4690 | SEQ ID NO:12702 | SEQ ID NO:20714 |
| | | NA | AATTATGACATTAAC | TGGCTGCACCCTAACAGTGGTACCACAGGCTTTGCACAGAAGTTCCGGGGC | AGCAGTGGCTGGTACTTTTTTGACTAC |
| | | | SEQ ID NO:4691 | SEQ ID NO:12703 | SEQ ID NO:20715 |
| | | AA | NYDIN | WLHPNSGTTGFAQKFRG | SSGWYFFDY |
| iPS:393146 | 21-225_34G8 | | SEQ ID NO:4692 | SEQ ID NO:12704 | SEQ ID NO:20716 |
| | | NA | AGCTATGCCATGAGC | GCTATTAGTGGTGGTGGTGGTAGCACATTCCACGCAGACTCCGTGAAGGGC | GGGGAGCTACTAGAGGACTACTACTTCTACGGTATGGACGTC |
| | | | SEQ ID NO:4693 | SEQ ID NO:12705 | SEQ ID NO:20717 |
| | | AA | SYAMS | AISGRGGSTFHADSVKG | GELLEDYFYFGMDV |
| iPS:393148 | 21-225_35E5 | | SEQ ID NO:4694 | SEQ ID NO:12706 | SEQ ID NO:20718 |
| | | NA | AGTTATGATATCAAC | TGGATGAACCCTAACAGTGGTAACACAGGCTATGCACAGAAGTTCCAGGGC | AAGAAGTCTAACGACTAC |
| | | | SEQ ID NO:4695 | SEQ ID NO:12707 | SEQ ID NO:20719 |

FIGURE 49
(Continued)

| | | | | SYDIN | | WMNPNSGNTGYAQKFQG | KKSNDY |
|---|---|---|---|---|---|---|---|
| iPS:393150 | | | | SEQ ID NO:4696 | AACTATGCCATGAAC | SEQ ID NO:12708 GCTATTAGTCGTCGTGGT GGTAACACATTCTACGC AGACTCCGTGAAGGGC | SEQ ID NO:20720 GGGGAGCTACTAGAGGACTA CTACTACGCTATGGACG TC |
| | 21-225_36A5 | | AA | | | | |
| | | | | | SEQ ID NO:4697 | SEQ ID NO:12709 AISRRGGNTFYADSVKG | SEQ ID NO:20721 GELLEDYYYAMDV |
| | | | | NYAMN | | | |
| | | | | SEQ ID NO:4698 | | SEQ ID NO:12710 | SEQ ID NO:20722 |
| iPS:393152 | | | NA | AGCTATGGCATGCAC | | GTTATATGGTATGATGG AAGTAATAAATATTATG CAGACTCCGTGAAGGGC | GATTCCTCCCCCTACGGTAT GGACGTC |
| | 21-225_25B3 | | | SEQ ID NO:4699 | | SEQ ID NO:12711 | SEQ ID NO:20723 |
| | | | AA | SYGMH | | VIWYDGSNKYYADSVKG | DSSPYGMDV |
| | | | | SEQ ID NO:4700 | | SEQ ID NO:12712 | SEQ ID NO:20724 |
| iPS:393166 | | | NA | GGCTATGGCATGCAC | | ATTATATGGTATGATGG AAGTAAAAATACAATG CAGACTCCGTGAAGGGC | GATAGGGTATATTGTAGTAG TACCAGCTGCTCCCCTTACT ACTACTACGGTATGGAC GTC |
| | 21-225_27G6 | | | SEQ ID NO:4701 | | SEQ ID NO:12713 | SEQ ID NO:20725 |
| | | | AA | GYGMH | | IIWYDGSKKYNADSVKG | DRVYCSSTSCSPYYYYGMD V |
| | | | | SEQ ID NO:4702 | | SEQ ID NO:12714 | SEQ ID NO:20726 |
| iPS:393168 | | | NA | GGCTACTATATGCAC | | TGGATCAACCTAACCTAACAG TGATGGCACTAACTATG CACAGAAGTTTCAGGGC | GGGTTTTACTATGGTTCGGG GAGTTATTATAACGACCTCG ACCCC |
| | 21-225_32B11 | | | SEQ ID NO:4703 | | SEQ ID NO:12715 | SEQ ID NO:20727 |
| | | | AA | GYYMH | | WINPNSDGTNYAQKFQG | GFYYGSGSYYNDLDP |
| | | | | SEQ ID NO:4704 | | SEQ ID NO:12716 | SEQ ID NO:20728 |

FIGURE 49
(Continued)

| | | | | | |
|---|---|---|---|---|---|
| iPS:393172 | 21-225_3B12 | NA | TACTATGGCATGCAC | GTTATATCATATGATGGAAGTAATAAATACTATGCAGACTCCGTGAAGGGC | GATCGGAAGGGGGGCTATGGAGTCCCCGATGCTTTTGATATC |
| | | | SEQ ID NO:4705 | SEQ ID NO:12717 | SEQ ID NO:20729 |
| | | AA | YYGMH | VISYDGSNKYYADSVKG | DRRGGYGVPDAFDI |
| | | | SEQ ID NO:4706 | SEQ ID NO:12718 | SEQ ID NO:20730 |
| iPS:393174 | 21-225_15D8 | NA | GGCTATGGCATGCAC | GTTATATCATATGATGGAAGTAATAAATACTATGCAGACTCCGTGAAGGGC | GATCGGGTCTATTGTAGTAGTACCAGCTGCGTCCCTTACTACGACTACGGTATGGAC GTC |
| | | | SEQ ID NO:4707 | SEQ ID NO:12719 | SEQ ID NO:20731 |
| | | AA | GYGMH | VISYDGSNKYYADSVKG | DRVYCSSTSCVPYYDYYGMDV |
| | | | SEQ ID NO:4708 | SEQ ID NO:12720 | SEQ ID NO:20732 |
| iPS:393176 | 21-225_27E7 | NA | AGCTATGGCATGCAC | GTTATATGGTATGATGGAAGTAATAAATACTATGCAGACTCCGTGAAGGGC | GAGGATTCCTATTGTAGTAGTACCAGCTGCCCTTACTACTACTACTACGGTATGGACGTC |
| | | | SEQ ID NO:4709 | SEQ ID NO:12721 | SEQ ID NO:20733 |
| | | AA | SYGMH | VIWYDGSNKYYADSVKG | EDSYCSSTSCPYYYYGMDV |
| | | | SEQ ID NO:4710 | SEQ ID NO:12722 | SEQ ID NO:20734 |
| iPS:393178 | 21-225_34D7 | NA | GGCTACTATATGCAC | TGGATCAACCCTAACAGTGGTGGCACAAACTATGCACAGAAGTTTCAGGGC | GGGTATTACTATGGTTCGGGAGTTATTATAACGACCTCGACCCC |
| | | | SEQ ID NO:4711 | SEQ ID NO:12723 | SEQ ID NO:20735 |
| | | AA | GYYMH | WINPNSGGTNYAQKFQG | GYYYGSGSYYNDLDP |
| | | | SEQ ID NO:4712 | SEQ ID NO:12724 | SEQ ID NO:20736 |

FIGURE 49
(Continued)

| | | | | | |
|---|---|---|---|---|---|
| iPS:393180 | 21-225_4G12 | NA | AGCTATGCCATGAGC | ACTCTTAGTGGTGGTCGTGGT GGTAGCACATACTACGC AGACTCCGTGAAGGGC | TGGGGACGTGTGATACAGCTA TGAGTACTACTACGGTATGG ACGTC |
| | | | SEQ ID NO:4713 | SEQ ID NO:12725 | SEQ ID NO:20737 |
| | | AA | SYAMS | TLSGRGGSTYYADSVKG | WGRGYSYEYYYGMDV |
| | | | SEQ ID NO:4714 | SEQ ID NO:12726 | SEQ ID NO:20738 |
| iPS:393182 | 21-225_4B3 | NA | GGCTACTACTATATGCAC | TGGATCAACCCTAACAG TGGTGGCACAAACTCTG CACAGAAGTTTCAGGGC | TCCTATTACTATGGTTCGGG GAGTTATTATAACGAGTTTG ACTAC |
| | | | SEQ ID NO:4715 | SEQ ID NO:12727 | SEQ ID NO:20739 |
| | | AA | GYYMH | WINPNSGGTNSAQKFQG | SYYYGSGSYYNEFDY |
| | | | SEQ ID NO:4716 | SEQ ID NO:12728 | SEQ ID NO:20740 |
| iPS:393184 | 21-225_15H11 | NA | ACTGGTGGAGTGGGTGTGGG C | CTCATTTATTGGCATGAT GATAAGCGCTACAGTCC ATCTCTGAGGAG | ATAGTAGCAGTTGCCTTTGA CTAC |
| | | | SEQ ID NO:4717 | SEQ ID NO:12729 | SEQ ID NO:20741 |
| | | AA | TGGVGVG | LIYWHDDKRYSPSLRS | IVAVAFDY |
| | | | SEQ ID NO:4718 | SEQ ID NO:12730 | SEQ ID NO:20742 |
| iPS:393186 | 21-225_27D9 | NA | GGCTACTACTATATGCAC | TGGATCAACCCTAACAG TGGTGGCACAAAGTATG CACAGAAGTTTCAGGGC | GAGAGGTGTAGTACTACCAG TTGCTATTTAGGAATTACGG GCTACTACGGTATGGACGTC |
| | | | SEQ ID NO:4719 | SEQ ID NO:12731 | SEQ ID NO:20743 |
| | | AA | GYYMH | WINPNSGGTKYAQKFQG | ERCSTTSCYLGITGYYGMDV |
| | | | SEQ ID NO:4720 | SEQ ID NO:12732 | SEQ ID NO:20744 |
| iPS:393188 | 21-225_34B9 | NA | ACTAGTGGAGTGGGTGTGGG C | CTCATTTATTGGAATGAT GATAAGCGCTACAGCCC ATCTCTGAAGAGC | TTAATAGCAGTGACTTTGA CTCC |
| | | | SEQ ID NO:4721 | SEQ ID NO:12733 | SEQ ID NO:20745 |
| | | AA | TSGVGVG | LIYWNDDKRYSPSLKS | LIAVTFDS |

FIGURE 49
(Continued)

| | | | SEQ ID NO:4722 AGCTATGGCATGCAC | SEQ ID NO:12734 GTTATATGGAATGATGG AAGTAATAAATACTATG CAGACTCCGTGAAGGGC | SEQ ID NO:20746 GATCGGGTAGCAGCAGCTGG TACCCCTACTACTACTACG GTATGGACGTC |
|---|---|---|---|---|---|
| iPS:393192 | | NA | | | |
| | 21-225_12B1 | | SEQ ID NO:4723 SYGMH | SEQ ID NO:12735 VIWNDGSNKYYADSVKG | SEQ ID NO:20747 DRVAAAGTPYYYGMDV |
| | | AA | | | |
| | | | SEQ ID NO:4724 NAWMN | SEQ ID NO:12736 CGTATTAAAGCAAAAC TGATGGTGGACAACAG ACTACGCTGCACCCGTG AAAGGC | SEQ ID NO:20748 GATACGGGTCCTATAGCAGC TCGTCTCGCTTACTACTACTA CTACGCTATGGACGTC |
| iPS:393194 | | NA | | | |
| | 21-225_16D2 | | SEQ ID NO:4725 NAWMN | SEQ ID NO:12737 RIKSKTDGGTTDYAAPVK G | SEQ ID NO:20749 DIGPIAARLAYYYYAMDV |
| | | AA | | | |
| | | | SEQ ID NO:4726 AGCTATGCCATGAGC | SEQ ID NO:12738 GGTATTAGTGGTAGTGG TGGTAGCACATACTACG CAGACTCCGTGAAGGGC | SEQ ID NO:20750 GAATATTGTGGTGGTGACTG CTATTCCCCTTACTACTACTA CTACGGTATGGACGTC |
| iPS:393196 | | NA | | | |
| | 21-225_16G8 | | SEQ ID NO:4727 SYAMS | SEQ ID NO:12739 GISGSGGSTYYADSVKG | SEQ ID NO:20751 EYCGGDCYSPYYYYGMDV |
| | | AA | | | |
| | | | SEQ ID NO:4728 GGCTATGGCCTGCAC | SEQ ID NO:12740 CTTATATGGTATGATGGA AATAATACATACTATGC AGACTCCGTGAAGGGC | SEQ ID NO:20752 GATAGGGTATATTGTAGTAG TACCAGCTGCTCCCCTTACT ACTACTACTACGGTATGGAC GTC |
| iPS:393198 | | NA | | | |
| | 21-225_28A11 | | SEQ ID NO:4729 | SEQ ID NO:12741 | SEQ ID NO:20753 |

FIGURE 49
(Continued)

| | | AA | GYGLH | | LIWYDGNNTYYADSVKG | DRVYCSSTSCSPYYYYGMDV |
|---|---|---|---|---|---|---|
| iPS:393200 | 21-225_35E1 | NA | GGCTACTATATGCAC | | TGGATCAACCCTAAAAG TGGTGGCACAAATTATG CACAGAAGTTTCAGGGC | GTGTATTACCATGGTTCGGG GAGTTATTATAACGAGTTTG ATTAT |
| | | | SEQ ID NO:4730 | | SEQ ID NO:12742 | SEQ ID NO:20754 |
| | | AA | GYYMH | | WINPKSGGTNYAQKFQG | VYYHGSGSYYNEFDY |
| | | | SEQ ID NO:4731 | | SEQ ID NO:12743 | SEQ ID NO:20755 |
| iPS:393202 | 21-225_6B4 | NA | AGCTATGCCATGAGC | | GCTATTAGTGGTAGTGGT AGTAGCACATACTACGC AGACTCCGTGAAGGGC | GAATATTGTGGTGGTGACTG CTATTCCCCTTACTACTACTA CTACGGTATGGACGTC |
| | | | SEQ ID NO:4732 | | SEQ ID NO:12744 | SEQ ID NO:20756 |
| | | AA | SYAMS | | AISGSGSSTYYADSVKG | EYCGGDCYSPYYYYGMDV |
| | | | SEQ ID NO:4733 | | SEQ ID NO:12745 | SEQ ID NO:20757 |
| iPS:393204 | 21-225_8C12 | NA | AGCTATGGCATGCAC | | CTTATATGGTATGATGGA AGTAATAAATACTATGC AGACTCCGTGAAGGGC | GATCGGGTATCTTGTAGTAG TTCCAGCTGCTATCCTTACTA CTACTACTACGGTATGGACG TC |
| | | | SEQ ID NO:4734 | | SEQ ID NO:12746 | SEQ ID NO:20758 |
| | | AA | SYGMH | | LIWYDGSNKYYADSVKG | DRVSCSSSSCYPYYYYGMDV |
| | | | SEQ ID NO:4735 | | SEQ ID NO:12747 | SEQ ID NO:20759 |
| iPS:393206 | 21-225_13F6 | NA | GGCTACTATATGCAC | | TGGATCAACCCTAACAG TGGTGGCCAAACTATG CACAGAAGTTTCAGGGC | TCGTTTTACTATGGTTCGGG GACTTATTATAACGAGTTTG ACTAC |
| | | | SEQ ID NO:4736 | | SEQ ID NO:12748 | SEQ ID NO:20760 |
| | | AA | GYYMH | | WINPNSGGANYAQKFQG | SFYYGSGTYNEFDY |
| | | | SEQ ID NO:4737 | | SEQ ID NO:12749 | SEQ ID NO:20761 |

FIGURE 49
(Continued)

| | | | | | | |
|---|---|---|---|---|---|---|
| iPS:393208 | 21-225_16F3 | NA | SEQ ID NO:4738<br>GGGCACTATATGCAC | SEQ ID NO:12750<br>TGGATCAACCCTAACAG<br>TGGTGGCACAAACTATG<br>CACAGAAGTTTCAGGGC | SEQ ID NO:20762<br>TCGTATTACTATGGTTCGGG<br>GACTTATTATAACGAGTTTG<br>ACTAC |
| | | AA | SEQ ID NO:4739<br>GHYMH | SEQ ID NO:12751<br>WINPNSGGTNYAQKFQG | SEQ ID NO:20763<br>SYYYGSGTYYNEFDY |
| iPS:393210 | 21-225_17D3 | NA | SEQ ID NO:4740<br>GGCTACTATATGCAC | SEQ ID NO:12752<br>TGGATCAACCCTAACAG<br>TGGTGGCACAAACTATG<br>CACAGAAGTTTCAGGGC | SEQ ID NO:20764<br>GCGAATTACTATGGTTCGGG<br>GAGTTATTATAACGACTTTG<br>ACTAC |
| | | AA | SEQ ID NO:4741<br>GYYMH | SEQ ID NO:12753<br>WINPNSGGTNYAQKFQG | SEQ ID NO:20765<br>ANYYGSGSYYNDFDY |
| iPS:393212 | 21-225_30H6 | NA | SEQ ID NO:4742<br>ACTGGTGGTGGAGTGGGTGTGGG<br>C | SEQ ID NO:12754<br>CTCATTTATTGGCATGAT<br>GATAAGCGCTACAGTCC<br>CTCTCTGAAGAGC | SEQ ID NO:20766<br>TTAATAGCAGTGGCTTTTGA<br>CTAT |
| | | AA | SEQ ID NO:4743<br>TGGVGVG | SEQ ID NO:12755<br>LIYWHDDKRYSPSLKS | SEQ ID NO:20767<br>LIAVAFDY |
| iPS:393214 | 21-225_33A1 | NA | SEQ ID NO:4744<br>GGCTACTATATGCAC | SEQ ID NO:12756<br>TGGATCAACCCTAACAA<br>TGGTGGCACACACTATG<br>CACAGAAGTTTCAGGGC | SEQ ID NO:20768<br>GGATATTATTATGCTTCGGG<br>GAGTTATTATAACGACCTCG<br>ACCCC |
| | | AA | SEQ ID NO:4745<br>GYYMH | SEQ ID NO:12757<br>WINPNNGGTHYAQKFQG | SEQ ID NO:20769<br>GYYYASGSYYNDLDP |
| iPS:393218 | 21_225_14G3 | NA | SEQ ID NO:4746<br>GGCTACTATATGTAC | SEQ ID NO:12758<br>TGGATCAACCCTAACAG<br>TGGTGGCACAAACTATG<br>CACAGAAGTTTCAGGGC | SEQ ID NO:20770<br>TCGTATTTTATGGTTCGGGG<br>AGTTATTATAACGAGTTTGA<br>CTAC |

FIGURE 49
(Continued)

| | | | | | | |
|---|---|---|---|---|---|---|
| iPS:393222 | 21-225_14G3 | AA | SEQ ID NO:4747<br>GYYMY | SEQ ID NO:12759<br>WINPNSGGTNYAQKFQG | SEQ ID NO:20771<br>SYFYGSGSYYNEFDY | |
| | | NA | SEQ ID NO:4748<br>ACTAGTGGAGTGGGTGTGGG<br>C | SEQ ID NO:12760<br>CTCATTTATTGGGATGAT<br>GATAAGCGCTACAGCCC<br>ATCTCTGAAGAGC | SEQ ID NO:20772<br>ATTATAGCAGTGGCTTTTGA<br>CTAC | |
| iPS:393224 | 21-225_17F5 | AA | SEQ ID NO:4749<br>TSGVGVG | SEQ ID NO:12761<br>LIYWDDDKRYSPSLKS | SEQ ID NO:20773<br>HAVAFDY | |
| | | NA | SEQ ID NO:4750<br>ACTGGTGGAGTGGGTGTGGG<br>C | SEQ ID NO:12762<br>CTCATTTATTGGAATGAT<br>GATGAGCGCTACAGCCC<br>ATCTCTGAAGAGC | SEQ ID NO:20774<br>TTAATAGCAGTTCCTTTGAC<br>TAC | |
| iPS:393226 | 21-225_31C2 | AA | SEQ ID NO:4751<br>TGGVGVG | SEQ ID NO:12763<br>LIYWNDDERYSPSLKS | SEQ ID NO:20775<br>LIAVSFDY | |
| | | NA | SEQ ID NO:4752<br>GGCTACTATATGCAC | SEQ ID NO:12764<br>TGGATCAACCCTAACAG<br>TGGTGGCACAAACTATG<br>CACAGAAGTTTCAGGGC | SEQ ID NO:20776<br>GTGTATTACTATGGTTCGGG<br>GAGTTATTATAACGAGTTTG<br>ACTAC | |
| iPS:393230 | 21-225_33E6 | AA | SEQ ID NO:4753<br>GYYMH | SEQ ID NO:12765<br>WINPNSGGTNYAQKFQG | SEQ ID NO:20777<br>VYYYGSGSYYNEFDY | |
| | | NA | SEQ ID NO:4754<br>GGCTACTATATACAC | SEQ ID NO:12766<br>TGGATCAACCCTAACAG<br>TGGTGGCACAGACTATG<br>CACAGAAGTTTCAGGGC | SEQ ID NO:20778<br>TCGTATTACTATGGTTCGGG<br>GACTTATTATAACGAGTTTG<br>ACTAC | |
| iPS:393232 | 21-225_9G9 | AA | SEQ ID NO:4755<br>GYYIH | SEQ ID NO:12767<br>WINPNSGGTDYAQKFQG | SEQ ID NO:20779<br>SYFYGSGTYYNEFDY | |
| | 21_225_17F12 | NA | SEQ ID NO:4756<br>AGTCTATGCCATGAGC | SEQ ID NO:12768<br>GCTATTAGTTGGTGTGGT<br>GGTAGCACATACTACGC<br>AGACTCCGTGAAGGGC | SEQ ID NO:20780<br>TGGGGACGTGGATACAACTA<br>TGAGTACTACTACGGTATGG<br>ACGTC | |

FIGURE 49
(Continued)

| | | | | | | |
|---|---|---|---|---|---|---|
| iPS:393234 | 21-225_17F12 | AA | SEQ ID NO:4757 SYAMS | SEQ ID NO:12769 AISGGGSTYYADSVKG | SEQ ID NO:20781 WGRGYNYEYYYGMDV | |
| | | NA | SEQ ID NO:4758 GGCTACTATATGTGCAC | SEQ ID NO:12770 TGGATCAACCCTAACAG TGGTGGCACAAACTATG CACAGAAGTTTCAGGGC | SEQ ID NO:20782 GAGAGGTGTAGTACTACCAG CTGCTATTTAGGAATTACGG GCTACTACGGTATGGACGTC | |
| iPS:393345 | 21-225_26C10 | AA | SEQ ID NO:4759 GYYVH | SEQ ID NO:12771 WINPNSGGTNYAQKFQG | SEQ ID NO:20783 ERCSTTSCYLGITGYYGMDV | |
| | | NA | SEQ ID NO:4760 AGCTATGCCATGAGC | SEQ ID NO:12772 GCTATTAGTGGTAGTGGT GGTAGCACATACTACGC AGACTCCGTGAAGGGC | SEQ ID NO:20784 GAATATGTGTGGTGTGACTG CTATTCCCCTACTACTACTA CTACGGTATGGACGTC | |
| iPS:393368 | 21-225_5G7 | AA | SEQ ID NO:4761 SYAMS | SEQ ID NO:12773 AISGSGGSTYYADSVKG | SEQ ID NO:20785 EYCGGDCYSPYYYYGMDV | |
| | | NA | SEQ ID NO:4762 AATTATGATATCAAC | SEQ ID NO:12774 TGGATGAACCCTAACAG TGGTAACACAGGCTATG CACAGAGGTTCCAGGGC | SEQ ID NO:20786 AGCAGTGGCTGGTACTACTT TGACTAC | |
| iPS:393565 | 21-225_29H8 | AA | SEQ ID NO:4763 NYDIN | SEQ ID NO:12775 WMNPNSGNTGYAQRFQG | SEQ ID NO:20787 SSGWYYFDY | |
| | | NA | SEQ ID NO:4764 GGCTACTATATGCAC | SEQ ID NO:12776 TGGATCAACCCTAACAG TGGTGGCACAAACTATG CACAGAAGTTTCAGGGC | SEQ ID NO:20788 GTGTATTTCTATGTGTTCGGG GAGTTATTATAACGAGTTTG ACTAC | |
| | 21-225_34B11 | AA | SEQ ID NO:4765 GYYMH | SEQ ID NO:12777 WINPNSGGTNYAQKFQG | SEQ ID NO:20789 VYFYGSGSYYNEFDY | |
| | | | SEQ ID NO:4766 | SEQ ID NO:12778 | SEQ ID NO:20790 | |

FIGURE 49
(Continued)

| | | | | |
|---|---|---|---|---|
| iPS:393802 | 21-225_3D12 | NA | ACCGCCTGGATGAAC | CGGATTAAAAACAAAT TGATGGTGGGACAACAG ACTACGTTGCACCCGTG AAAGGC | GAAGGCTGGAACACGGACTA C |
| | | | SEQ ID NO:4767 | SEQ ID NO:12779 | SEQ ID NO:20791 |
| | | AA | TAWMN | RIKNKIDGGTTDYVAPVK G | EGWNTDY |
| | | | SEQ ID NO:4768 | SEQ ID NO:12780 | SEQ ID NO:20792 |
| iPS:393804 | 21-225_5H7 | NA | AGAAGTAGTTATTACTGGGG C | AATATCTATTATAGTGGG ACCACTACTACAACCC GTCCCTCAAGAGT | CATGGAAAAGACTGGGGCCT TGACTAC |
| | | | SEQ ID NO:4769 | SEQ ID NO:12781 | SEQ ID NO:20793 |
| | | AA | RSSYYWG | NIYYSGTTYYNPSLKS | HGKDWGLDY |
| | | | SEQ ID NO:4770 | SEQ ID NO:12782 | SEQ ID NO:20794 |
| iPS:393806 | 21-225_6A6 | NA | AGAAGTAGTTACTACTGGGG C | AATATCTATTATAGTGGG ATCCCCTACTACAACCCG TCCCTCAAGAGT | CACAGCAGCAGCTGGTCTCT TGACTAC |
| | | | SEQ ID NO:4771 | SEQ ID NO:12783 | SEQ ID NO:20795 |
| | | AA | RSSYYWG | NIYYSGIPYYNPSLKS | HSSSWSLDY |
| | | | SEQ ID NO:4772 | SEQ ID NO:12784 | SEQ ID NO:20796 |
| iPS:393808 | 21-225_1A2 | NA | AGCTATACCATGAAC | TCCATTAGTGGTAGTGGT AGTTACATATACTACGC AGACTCAGTGAAGGGC | GGGAGCAGCTCGTCCGGGTT TGACTAC |
| | | | SEQ ID NO:4773 | SEQ ID NO:12785 | SEQ ID NO:20797 |
| | | AA | SYTMN | SISGSGSYIYYADSVKG | GSSSSGFDY |
| | | | SEQ ID NO:4774 | SEQ ID NO:12786 | SEQ ID NO:20798 |
| iPS:393810 | 21-225_5A4 | NA | AGCTCTGCCATGAGC | GCTATTAGTGGTGGTGGT GGTAACACATTCTACAC AGACTCCGTGAAGGGC | CTGGGGAAAGACTACTACTA CTACGGTATGGACGTC |
| | | | SEQ ID NO:4775 | SEQ ID NO:12787 | SEQ ID NO:20799 |

FIGURE 49
(Continued)

| | | AA | SSAMS | AISGRGGNTFYTDSVKG | LGKDYYYGMDV |
|---|---|---|---|---|---|
| | | | SEQ ID NO:4776 | SEQ ID NO:12788 | SEQ ID NO:20800 |
| iPS:393812 | 21-225_6A11 | NA | GACTATGGCATGCAC | GTTATATGGTTTGATGAAGTAATAAATACTATGCAGACTCCGTGAAGGGC | GATCTTGGCTGGACGGAAGAGTAC |
| | | | | SEQ ID NO:12789 | SEQ ID NO:20801 |
| | | AA | DYGMH | VIWFDGSNKYYADSVKG | DLGWTEEY |
| | | | SEQ ID NO:4778 | SEQ ID NO:12790 | SEQ ID NO:20802 |
| iPS:393814 | 21-225_7F4 | NA | AGGAGTAGTTACTACTGGGGC | AATATCTATTATAGTGGGGCCACCTACTACAACCCGTCCCTCAAGAGT | CATAGCGGCAGCTGGTCCCTTGACTAC |
| | | | SEQ ID NO:4779 | SEQ ID NO:12791 | SEQ ID NO:20803 |
| | | AA | RSSSYYWG | NIYYSGATYYNPSLKS | HSGSWSLDY |
| | | | SEQ ID NO:4780 | SEQ ID NO:12792 | SEQ ID NO:20804 |
| iPS:393816 | 21-225_6D4 | NA | AGRAAGTAGTTCCTACTGGGGC | AATATCTATTATAGTGGGAGGCCTACTACATTCCGTCCCTCAAGAGT | CACAGCAGCAGCTGGTCTCTTGACTGC |
| | | | SEQ ID NO:4781 | SEQ ID NO:12793 | SEQ ID NO:20805 |
| | | AA | RSSSYYWG | NIYYSGSAYYIPSLKS | HSSSWSLDC |
| | | | SEQ ID NO:4782 | SEQ ID NO:12794 | SEQ ID NO:20806 |
| iPS:393818 | 21-225_6G12 | NA | AGCTATGGCATGCAC | GTTATTGGTATGATGATAGAAGTAATAACTACTATGCAGACTCCGTGAAGGGC | GAACTGGGGGTTCCGGTCTGACTAC |
| | | | SEQ ID NO:4783 | SEQ ID NO:12795 | SEQ ID NO:20807 |
| | | AA | SYGMH | VIWYDRSNNYYADSVKG | ELGFRSDY |
| | | | SEQ ID NO:4784 | SEQ ID NO:12796 | SEQ ID NO:20808 |

FIGURE 49
(Continued)

| | | | | | |
|---|---|---|---|---|---|
| iPS:393820 | 21-225_8H7 | NA | GACTTTGGCATGCAC | GTTATTTGGTATGAAGA AAATAATCAATACTATG CAGACTCCGTGAAGGGC | GAGCTGGGGTTCCGGTCTGA CTAC |
| | | | SEQ ID NO:4785 | SEQ ID NO:12797 | SEQ ID NO:20809 |
| | | AA | DFGMH | VIWYEENNQYYADSVKG | ELGFRSDY |
| | | | SEQ ID NO:4786 | SEQ ID NO:12798 | SEQ ID NO:20810 |
| iPS:393822 | 21-225_15B11 | NA | AACTATGGCATGCAC | GTTATATGGTATGAGGA AAGTAATAAATACTATA CAGACTCCGTGAAGGGC | GAAGTGGGATTCACTGAGGA CTAC |
| | | | SEQ ID NO:4787 | SEQ ID NO:12799 | SEQ ID NO:20811 |
| | | AA | NYGMH | VIWYEESNKYYTDSVKG | EVGFTEDY |
| | | | SEQ ID NO:4788 | SEQ ID NO:12800 | SEQ ID NO:20812 |
| iPS:393824 | 21-225_10F12 | NA | AGCTATGCCATGAGC | ATTATTAGTGGTCGTGGT GGTAACACATTCTACGC AGACTCCGTGAAGGGC | CGTGTAGCAGTGGCTGGCTC GGAGGCTTTTGCTATC |
| | | | SEQ ID NO:4789 | SEQ ID NO:12801 | SEQ ID NO:20813 |
| | | AA | SYAMS | IISGRGGNTFYADSVKG | RVAVAGSEAFAI |
| | | | SEQ ID NO:4790 | SEQ ID NO:12802 | SEQ ID NO:20814 |
| iPS:393826 | 21-225_10G5 | NA | AACTATGGCATGCAC | GTTATTTGGTATGAAGA AAATAATCAATACTATG CAGACTCCGTGAAGGGC | GAACTGGGGTTCCGGTCTGA CTAC |
| | | | SEQ ID NO:4791 | SEQ ID NO:12803 | SEQ ID NO:20815 |
| | | AA | NYGMH | VIWYEENNQYYADSVKG | ELGFRSDY |
| | | | SEQ ID NO:4792 | SEQ ID NO:12804 | SEQ ID NO:20816 |

FIGURE 49
(Continued)

| | | | | |
|---|---|---|---|---|
| iPS:393828 | 21-225_10H12 | NA | GACTATGGCATGCAC<br>SEQ ID NO:4793 | GTTATTTGGTATGAAGAC<br>AATAATCAATACTATGC<br>AGACTCCGTGAAGGGC<br>SEQ ID NO:12805 | GAACTGGGGGTTCCGGTCTGA<br>CTAC<br>SEQ ID NO:20817 |
| | | AA | DYGMH<br>SEQ ID NO:4794 | VIWYEDNQYYADSVKG<br>SEQ ID NO:12806 | ELGFRSDY<br>SEQ ID NO:20818 |
| iPS:393830 | 21-225_12A1 | NA | AGCTATGGCATGCAC<br>SEQ ID NO:4795 | GTTATTTGGTATGAAGA<br>AAATAATCAATACTATG<br>CAGACTCCGTGAAGGGC<br>SEQ ID NO:12807 | GAACTGGGGGTTCCGGTCTGA<br>CTAC<br>SEQ ID NO:20819 |
| | | AA | SYGMH<br>SEQ ID NO:4796 | VIWYEENNQYYADSVKG<br>SEQ ID NO:12808 | ELGFRSDY<br>SEQ ID NO:20820 |
| iPS:393832 | 21-225_14B2 | NA | AGAAGTAGTTATTACTGGGG<br>T<br>SEQ ID NO:4797 | AATATCTATTATAGTGGG<br>ACCACTACTACAACCC<br>GTCCCTCAAGAGT<br>SEQ ID NO:12809 | CATGGAAAAGACTGGGGCCT<br>TGACTAC<br>SEQ ID NO:20821 |
| | | AA | RSSYYWG<br>SEQ ID NO:4798 | NIYYSGTTYYNPSLKS<br>SEQ ID NO:12810 | HGKDWGLDY<br>SEQ ID NO:20822 |
| iPS:393836 | 21-225_15A2 | NA | AGCTATACCATGAAC<br>SEQ ID NO:4799 | TCCATTAGTGGTAGTGGT<br>AGTTACATATACTACGC<br>AGACTCAGTGAAGGGC<br>SEQ ID NO:12811 | GTGGCTTCATTTGACTAC<br>SEQ ID NO:20823 |
| | | AA | SYTMN<br>SEQ ID NO:4800 | SISGSGSYIYYADSVKG<br>SEQ ID NO:12812 | VASFDY<br>SEQ ID NO:20824 |

FIGURE 49
(Continued)

| | | | | | |
|---|---|---|---|---|---|
| iPS:393838 | 21-225_6G2 | NA | GACTATGGCATACAC | GTCATTGGTTTGATGGAAGTAATAAATACTATGCAGACTCCGTGAAGGGC | GATCTTGGCTGGACGGAAGAGTAC |
| | | | SEQ ID NO:4801 | SEQ ID NO:12813 | SEQ ID NO:20825 |
| | | AA | DYGIH | VIWFDGSNKYYADSVKG | DLGWTEEY |
| | | | SEQ ID NO:4802 | SEQ ID NO:12814 | SEQ ID NO:20826 |
| iPS:393840 | 21-225_3F8 | NA | AGCTATGGCATGCAC | GTTATATGGCATGATGGAAGTAATAAATACTATGCAGACTCCGTGAAGGGC | GATCTGAGTATGGGCGGTATGGACGTC |
| | | | SEQ ID NO:4803 | SEQ ID NO:12815 | SEQ ID NO:20827 |
| | | AA | SYGMH | VIWHDGSNKYYADSVKG | DLSMGGMDV |
| | | | SEQ ID NO:4804 | SEQ ID NO:12816 | SEQ ID NO:20828 |
| iPS:393844 | 21-225_3G7 | NA | AACTATGGCATGCAC | GTCATATGGCATGATGGAAGTAATAAATACTATGTAGACTCCGTGAAGGGC | GATGAGAGGCTGGGGATTTTTGACTAC |
| | | | SEQ ID NO:4805 | SEQ ID NO:12817 | SEQ ID NO:20829 |
| | | AA | NYGMH | VIWHDGSNKYYVDSVKG | DERLGIFDY |
| | | | SEQ ID NO:4806 | SEQ ID NO:12818 | SEQ ID NO:20830 |
| iPS:393848 | 21-225_4H2 | NA | GGCTATGCCATGAAC | GTTATTAGTCGTAGTGGTGGTTACACATACTACGCGGACTCCGTGAAGGGC | CGTTTAGCAGTGGCTGGCTCGGAGGCTTTTGATATC |
| | | | SEQ ID NO:4807 | SEQ ID NO:12819 | SEQ ID NO:20831 |
| | | AA | GYAMN | VISRSGGYTYYADSVKG | RLAVAGSEAFDI |
| | | | SEQ ID NO:4808 | SEQ ID NO:12820 | SEQ ID NO:20832 |

FIGURE 49
(Continued)

| | | | | |
|---|---|---|---|---|
| iPS:393852 | 21-225_12A10 | NA | AGCTATGGCATGCAC | GTTATATGGCATGATGA AAGTAATAAATACTATA CAGACTCCGTGAAGGGC | GACGAGAGGCTGGGGATTTT TGACTAC |
| | | | SEQ ID NO:4809 | SEQ ID NO:12821 | SEQ ID NO:20833 |
| | | AA | SYGMH | VIWHDESNKYYTDSVKG | DERLGIFDY |
| | | | SEQ ID NO:4810 | SEQ ID NO:12822 | SEQ ID NO:20834 |
| iPS:393854 | 21-225_7H11 | NA | GACTATGGCATGCAC | GTTATATGGTATGATGA AATAATAAATACTATG CAGACTCCGTGAAGGGC | GAACTGGGGTTCCGGTCTGA CTAC |
| | | | SEQ ID NO:4811 | SEQ ID NO:12823 | SEQ ID NO:20835 |
| | | AA | DYGMH | VIWYDENNKYYADSVKG | ELGFRSDY |
| | | | SEQ ID NO:4812 | SEQ ID NO:12824 | SEQ ID NO:20836 |
| iPS:393856 | 21-225_14C2 | NA | GACTATGGCATGCAC | GTTATATGGTATGACGA AAGTAATAAATACTATG AAGACTCCGTGAAGGGC | GAAGTGGGATTCCGGTCTGA CTAC |
| | | | SEQ ID NO:4813 | SEQ ID NO:12825 | SEQ ID NO:20837 |
| | | AA | DYGMH | VIWYDESNKYYEDSVKG | EVGFRSDY |
| | | | SEQ ID NO:4814 | SEQ ID NO:12826 | SEQ ID NO:20838 |
| iPS:393862 | 21-225_5G2 | NA | AGCTATGCCATGAGC | GTTATTAGTGGTCGTGGT GTTAACACATTCTACGCA GACTCCGTGAAGGGC | CGTATAGCAGTGGCTGGCTC GGAGGCTTTTGATATC |
| | | | SEQ ID NO:4815 | SEQ ID NO:12827 | SEQ ID NO:20839 |
| | | AA | SYAMS | VISGRGVNTFYADSVKG | RIAVAGSEAFDI |
| | | | SEQ ID NO:4816 | SEQ ID NO:12828 | SEQ ID NO:20840 |

FIGURE 49
(Continued)

| | | | | |
|---|---|---|---|---|
| iPS:393864 | 21-225_4C5 | NA | AGCTATGTCCTGCAC | GTTATATGGTATGATGGAAGTAATAAATACTATGCAGACTCCGTGAAGGGC | GAAAAGTATACCAGCAGCTGGTACGACTACGGTATGGACGTC |
| | | | SEQ ID NO:4817 | SEQ ID NO:12829 | SEQ ID NO:20841 |
| | | AA | SYVLH | VIWYDGSNKYYADSVKG | EKYTSSWYDYGMDV |
| | | | SEQ ID NO:4818 | SEQ ID NO:12830 | SEQ ID NO:20842 |
| iPS:393866 | 21-225_14E3 | NA | GACTTTGGCATGCAC | GTTATTTGGTATGAAGAAAATAATCAATACTATGCAGACTCCGTGAAGGGC | GAGCTGGGGTTCCGGTCTGACTAC |
| | | | SEQ ID NO:4819 | SEQ ID NO:12831 | SEQ ID NO:20843 |
| | | AA | DFGMH | VIWYEENNQYYADSVKG | ELGFRSDY |
| | | | SEQ ID NO:4820 | SEQ ID NO:12832 | SEQ ID NO:20844 |
| iPS:393868 | 21-225_9C11 | NA | AGCTATGGCATGCAC | GTTATATGGCATGATGAAACTAATAAATACTATGCAGATTCCGTGAAGGGC | GACGAGAGGCTGGGGATTTTTGACTAC |
| | | | SEQ ID NO:4821 | SEQ ID NO:12833 | SEQ ID NO:20845 |
| | | AA | SYGMH | VIWHDETNKYYADSVKG | DERLGIFDY |
| | | | SEQ ID NO:4822 | SEQ ID NO:12834 | SEQ ID NO:20846 |
| iPS:393870 | 21-225_7B1 | NA | AGCTATGACACATGAGC | ACTATTAGTAGTGTAGTGGTGGTATCACATACTACGCAGACTCCGTGAAGGGC | GATCGGGGCAGCGTC |
| | | | SEQ ID NO:4823 | SEQ ID NO:12835 | SEQ ID NO:20847 |
| | | AA | SYDMS | TISGSGGITYYADSVKG | DRGSV |
| | | | SEQ ID NO:4824 | SEQ ID NO:12836 | SEQ ID NO:20848 |

FIGURE 49
(Continued)

| | | | | | | |
|---|---|---|---|---|---|---|
| iPS:393872 | 21-225_2A11 | NA | AGGAGTAGTTACTACTGGGG C | AATATCTATTATAGTGGG AGCACCTACTACAACCC GTCCGTCAAGAGT | CATGGAAAAGACTGGGCCT TGAAGAC | |
| | | AA | SEQ ID NO:4825 RSSYYWG | SEQ ID NO:12837 NIYYSGSTYYNPSVKS | SEQ ID NO:20849 HGKDWGLED | |
| iPS:393874 | 21-225_4C8 | NA | SEQ ID NO:4826 AACTATGGCATGCAC | SEQ ID NO:12838 GTTATTGGTATGAAGA AATAATCAATACTATG CAGACTCCGTGAAGGGC | SEQ ID NO:20850 GAAATGGGGTTCCTGTCTGA CTAC | |
| | | AA | SEQ ID NO:4827 NYGMH | SEQ ID NO:12839 VIWYEENNQYYADSVKG | SEQ ID NO:20851 EMGFLSDY | |
| iPS:393876 | 21-225_9A1 | NA | SEQ ID NO:4828 GACTATGGCATGCAC | SEQ ID NO:12840 GTTATATGGTTTGATGA AGTAATAAATACTATGC AGACTCCGTGAAGGGC | SEQ ID NO:20852 GATCTTGGCTGGACGGAAGA GTAC | |
| | | AA | SEQ ID NO:4829 DYGMH | SEQ ID NO:12841 VIWFDGSNKYYADSVKG | SEQ ID NO:20853 DLGWTEEY | |
| iPS:393878 | 21-225_7G12 | NA | SEQ ID NO:4830 AGCTATGCCATGAAC | SEQ ID NO:12842 GTTATTAGTGGTAGTGGT GGTAGCACATACTACGC AGACTCCGTGAAGGGC | SEQ ID NO:20854 AGGTATACCAGTGACTGGCA TGATGCTTTTGATATC | |
| | | AA | SEQ ID NO:4831 SYAMN | SEQ ID NO:12843 VISGSGGSTYYADSVKG | SEQ ID NO:20855 RYTSDWHDAFDI | |
| iPS:393880 | 21_225_15A1 | NA | SEQ ID NO:4832 AGAAGTAGTTACTACTGGGG C | SEQ ID NO:12844 AGTATCTATTATAGTGGG AGCGCCAGTACAACCC GTCCCTCAAGAGT | SEQ ID NO:20856 CTGAGCAGCAGCTGGTCTTT TGACTAC | |

FIGURE 49
(Continued)

| | | | | | | |
|---|---|---|---|---|---|---|
| iPS:393882 | 21-225_15A1 | AA | SEQ ID NO:4833<br>RSSYYWG | SEQ ID NO:12845<br>SIYYSGSAQYNPSLKS | SEQ ID NO:20857<br>LSSSWSFDY |
| | | NA | SEQ ID NO:4834<br>AGCTATGGCATGCAC | SEQ ID NO:12846<br>GTTATATGGTATGAGGA<br>AATAATAAACACTATG<br>CAGACTCCGTGAAGGGC | SEQ ID NO:20858<br>GAGCTGGGGTTCCTCTCTGA<br>CTAC |
| iPS:393884 | 21-225_15E3 | AA | SEQ ID NO:4835<br>SYGMH | SEQ ID NO:12847<br>VIWYEENNKHYADSVKG | SEQ ID NO:20859<br>ELGFLSDY |
| | | NA | SEQ ID NO:4836<br>AACTATGGCATGCAC | SEQ ID NO:12848<br>GTTATATGGTATGAAGG<br>AAGTAATCAATACTATG<br>GAGACTCCGTGAAGGGC | SEQ ID NO:20860<br>GAGCTGGGGTTCCTCTCTGA<br>CTAC |
| iPS:393886 | 21-225_16F4 | AA | SEQ ID NO:4837<br>NYGMH | SEQ ID NO:12849<br>VIWYEGSNQYYGDSVKG | SEQ ID NO:20861<br>ELGFLSDY |
| | | NA | SEQ ID NO:4838<br>CCTAATTACTACTGGGGC | SEQ ID NO:12850<br>AGTATCTATTATAGTGGA<br>AGCACCTCCTACAACCC<br>GTCCCTCAACAGT | SEQ ID NO:20862<br>CTAAGCAGCAACTGGGACTT<br>TGACAAC |
| iPS:393888 | 21-225_2G9 | AA | SEQ ID NO:4839<br>PNYYWG | SEQ ID NO:12851<br>SIYYSGSTSYNPSLNS | SEQ ID NO:20863<br>LSSNWDFDN |
| | | NA | SEQ ID NO:4840<br>AGCTATGTCATGAGC | SEQ ID NO:12852<br>ATTATTAGTAGTGGTCGTGGT<br>GGTAACACATTCTACGC<br>AGACTCCGTGAAGGGC | SEQ ID NO:20864<br>CGTTTAGCAGTAGTGGCTGGCTC<br>GGAGGCTTTTGATATC |
| | 21-225_3E3 | AA | SEQ ID NO:4841<br>SYVMS | SEQ ID NO:12853<br>IISGRGGNTFYADSVKG | SEQ ID NO:20865<br>RLAVAGSEAFDI |
| | | NA | SEQ ID NO:4842 | SEQ ID NO:12854 | SEQ ID NO:20866 |

FIGURE 49
(Continued)

| | | | | | |
|---|---|---|---|---|---|
| iPS:393890 | 21-225_4B1 | NA | AGTTACTCCTGGAGC | CGTATCTATACCAGTGGGAGCACCAACTACATCCCCTCCCTCAAGAGT | GATTTGAAGAGCAGTGGCTGCCTTTCTTGACTAC |
| | | AA | SEQ ID NO:4843<br>SYSWS | SEQ ID NO:12855<br>RIYTSGSTNYIPSLKS | SEQ ID NO:20867<br>DLKSSGCLFFDY |
| iPS:393892 | 21-225_6G7 | NA | SEQ ID NO:4844<br>AGCTATGGCATGCAC | SEQ ID NO:12856<br>ATTATATCATATGTTGGAAAGAATAAATATTATGCAGACTCCGTGAAGGGC | SEQ ID NO:20868<br>CGGGGAAACAGCTATGGCGGGTACGGTATGGACGTC |
| | | AA | SEQ ID NO:4845<br>SYGMH | SEQ ID NO:12857<br>IISYVGKNKYYADSVKG | SEQ ID NO:20869<br>RGNSYGGYGMDV |
| iPS:393894 | 21-225_5E11 | NA | SEQ ID NO:4846<br>AGCTATAGCATGAAC | SEQ ID NO:12858<br>TCCATTAGTGGTAGTAGTACTTACATATACTACGCAGACTCAGTGAAGGGC | SEQ ID NO:20870<br>GTGGCTTCATTTGACTAC |
| | | AA | SEQ ID NO:4847<br>SYSMN | SEQ ID NO:12859<br>SISGSSTYIYYADSVKG | SEQ ID NO:20871<br>VASFDY |
| iPS:393896 | 21-225_2A4 | NA | SEQ ID NO:4848<br>AGCTATAGCATGAAC | SEQ ID NO:12860<br>TCCATTAGTGGTAGTAGTACTTACATATACTACGCAGACTCAGTGAAGGGC | SEQ ID NO:20872<br>GTGGCTTCATTTGACTAC |
| | | AA | SEQ ID NO:4849<br>SYSMN | SEQ ID NO:12861<br>SISGSSTYIYYADSVKG | SEQ ID NO:20873<br>VASFDY |
| iPS:393898 | 21-225_5F7 | NA | SEQ ID NO:4850<br>AGCTATGCCATGAGC | SEQ ID NO:12862<br>ATTATTAGTGGTCGTGGTGGTAACACATTCTACGCAGACTCCGTGAAGGGC | SEQ ID NO:20874<br>CGTATAGCAGTGGCTGGCTCGGAGGCTTTGCTATC |
| | | AA | SEQ ID NO:4851<br>SYAMS | SEQ ID NO:12863<br>IISGRGGNTFYADSVKG | SEQ ID NO:20875<br>RIAVAGSEAFAI |

FIGURE 49
(Continued)

| | | | | | |
|---|---|---|---|---|---|
| iPS:393900 | 21-225_10E12 | NA | SEQ ID NO:4852<br>AACTATGGCATGCAC | SEQ ID NO:12864<br>GTTATATGGCATGATGG<br>AAGTAATAAATACTATG<br>TAGACTCCGTGAAGGGC | SEQ ID NO:20876<br>GATGAGAGGCTGGGGATTTT<br>TGACTAC |
| | | AA | SEQ ID NO:4853<br>NYGMH | SEQ ID NO:12865<br>VIWHDGSNKYYVDSVKG | SEQ ID NO:20877<br>DERLGIFDY |
| iPS:393902 | 21-225_14E10 | NA | SEQ ID NO:4854<br>GACTATGGCATGCAC | SEQ ID NO:12866<br>GTTATATGGTATGATGG<br>AAGTAATAAATACTATG<br>CAGACTCCGTGAAGGGC | SEQ ID NO:20878<br>GAGAAGTATAGCAGCAGCTG<br>GTACGACTACGGTATGGACG<br>TC |
| | | AA | SEQ ID NO:4855<br>DYGMH | SEQ ID NO:12867<br>VIWYDGSNKYYADSVKG | SEQ ID NO:20879<br>EKYSSSWYDYGMDV |
| iPS:393904 | 21-225_8H11 | NA | SEQ ID NO:4856<br>ACCTATAACATGCAC | SEQ ID NO:12868<br>GTTATATGGTATGATGG<br>AAGTGATAGATACTCTG<br>CAGACTCCGTGAAGGGC | SEQ ID NO:20880<br>GATCGGGCCTATAGCAGCTC<br>GTCTGACTTC |
| | | AA | SEQ ID NO:4857<br>TYNMH | SEQ ID NO:12869<br>VIWYDGSDRYSADSVKG | SEQ ID NO:20881<br>DRAYSSSSDF |
| iPS:393906 | 21-225_13D3 | NA | SEQ ID NO:4858<br>AGTTATACCATGAAC | SEQ ID NO:12870<br>TCCATTAGTGGTAGTAGT<br>AGTTACATATACTACGC<br>GGACTCAGTGAAGGGC | SEQ ID NO:20882<br>GATCGGGGCAGTGGC |
| | | AA | SEQ ID NO:4859<br>SYTMN | SEQ ID NO:12871<br>SISGSSYIYYADSVKG | SEQ ID NO:20883<br>DRGSG |
| | | | SEQ ID NO:4860 | SEQ ID NO:12872 | SEQ ID NO:20884 |

FIGURE 49
(Continued)

| | | | | |
|---|---|---|---|---|
| iPS:393908 | 21-225_10E9 | NA | AACTATGTCATACAC<br><br>SEQ ID NO:4861<br>NYVIH | GTTATATGGTATGATGG<br>AAGTAATAAATACTATG<br>CAGACTCCGTGAAGGGC<br><br>SEQ ID NO:12873<br>VIWYDGSNKYYADSVKG | GAAAAGTATAGCAGCAGCTG<br>GTACGACTACGGTATGGACG<br>TC<br><br>SEQ ID NO:20885<br>EKYSSSWYDYGMDV |
| | | AA | SEQ ID NO:4862<br>NYVIH | SEQ ID NO:12874 | SEQ ID NO:20886 |
| iPS:393910 | 21-225_15F10 | NA | AGCTATGGCATGCAC<br><br>SEQ ID NO:4863<br>SYGMH | GTTATATCATATGGTGGA<br>AGTAATAATTACTATGC<br>AGACTCCGTGAAGGGC<br><br>SEQ ID NO:12875<br>VISYGGSNNYYADSVKG | CGGGGATACAGCTATGGCGG<br>GTACGGTATGGACGTC<br><br>SEQ ID NO:20887<br>RGYSYGGYGMDV |
| | | AA | SEQ ID NO:4864 | SEQ ID NO:12876 | SEQ ID NO:20888 |
| iPS:393912 | 21-225_16F6 | NA | AACTATGGCATGCAC<br><br>SEQ ID NO:4865<br>NYGMH | GTTATATGGTATGAAGG<br>AAGTAATCAATACTATG<br>GAGACTCCGTGAAGGGC<br><br>SEQ ID NO:12877<br>VIWYEGSNQYYGDSVKG | GAGCTGGGGTTCCTCTCTGA<br>TTAC<br><br>SEQ ID NO:20889<br>ELGFLSDY |
| | | AA | SEQ ID NO:4866 | SEQ ID NO:12878 | SEQ ID NO:20890 |
| iPS:393914 | 21-225_16B8 | NA | AGCTATAGCATGAAC<br><br>SEQ ID NO:4867<br>SYSMN | TCCATTAGTGGTAGTAGT<br>ACTTACATATACTACGCA<br>GACTCAGTGAAGGGC<br><br>SEQ ID NO:12879<br>SISGSSTYIYYADSVKG | GTGGCTTCATTCGACTAC<br><br>SEQ ID NO:20891<br>VASFDY |
| | | AA | SEQ ID NO:4868 | SEQ ID NO:12880 | SEQ ID NO:20892 |
| iPS:393916 | 21_225_2G4 | NA | AGCTATGTCATGCAC | GTTATATGGTATGATGG<br>AAGTAATAAATACTATG<br>CAGACTCCGTGAAGGGC | GAGAAGTATAGCAGCAGCTG<br>GTACGACTACGGTATGGACG<br>TC |

FIGURE 49
(Continued)

| | | AA | | NA | |
|---|---|---|---|---|---|
| iPS:393920 | 21-225_2G4 | SEQ ID NO:4869 SYVMH | SEQ ID NO:12881 VIWYDGSNKYYADSVKG | SEQ ID NO:20893 EKYSSSWYDYGMDV | |
| iPS:393922 | 21-225_1H12 | SEQ ID NO:4870 AGCTATGGCATGCAC | SEQ ID NO:12882 ATTATATGGCATGATGG AAGTAATAAATACTATG TAGACTCCGTGAAGGGC | SEQ ID NO:20894 GATGAGAGGCTGGGGATTTT TGACTAC | |
| | | SEQ ID NO:4871 SYGMH | SEQ ID NO:12883 IIWHDGSNKYYVDSVKG | SEQ ID NO:20895 DERLGIPDY | |
| iPS:393926 | 21-225_2B2 | SEQ ID NO:4872 AGCTATGGCATGCAC | SEQ ID NO:12884 GTTATATGGTATGAGGA AAATAAATACTATG TAGACTCCGTGAAGGGC | SEQ ID NO:20896 GAACTAGGCTTCCAGTCTGA CTAC | |
| | | SEQ ID NO:4873 SYGMH | SEQ ID NO:12885 VIWYEENNKYYVDSVKG | SEQ ID NO:20897 ELGFQSDY | |
| iPS:393926 | 21-225_4G4 | SEQ ID NO:4874 AGCTATGGCATGCAC | SEQ ID NO:12886 GTTATATGGCATGATGG AAGTAATAAATACTATG CAGACTCCGTGAAGGGC | SEQ ID NO:20898 GATCTGAGAATGGGCGGTAT GGACGTC | |
| | | SEQ ID NO:4875 SYGMH | SEQ ID NO:12887 VIWHDGSNKYYADSVKG | SEQ ID NO:20899 DLRMGGMDV | |
| iPS:393928 | 21_225_4E10 | SEQ ID NO:4876 CGTAGTAGTTACTACTGGGG C | SEQ ID NO:12888 AGTGTCTATTATAGTGGG GCCACCTCCTACAACCC GTCCCTCAAGAGT | SEQ ID NO:20900 CTAAGCAGCAACTGGGACTT TGACTAC | |

FIGURE 49
(Continued)

| | | | SEQ ID NO:4877 | SEQ ID NO:12889 | SEQ ID NO:20901 |
|---|---|---|---|---|---|
| | 21-225_4E10 | AA | RSSYYWG | SVYYSGATSYNPSLKS | LSSNWDFDY |
| iPS:393930 | | NA | SEQ ID NO:4878 AGCTTTGGCATGCAC | SEQ ID NO:12890 ATTATATGGCATGATGG AAGTAATAAATACTATG CAGACTCCGTGAAGGGC | SEQ ID NO:20902 GATCTGAGTATGGCGGTAT GGACGTC |
| | 21-225_7E11 | AA | SEQ ID NO:4879 SFGMH | SEQ ID NO:12891 IIWHDGSNKYYADSVKG | SEQ ID NO:20903 DLSMGGMDV |
| iPS:393932 | | NA | SEQ ID NO:4880 AGCTATGGCATGCAC | SEQ ID NO:12892 ATTATATGGCATGATGG AAGTAATAAATATTATG TAGACTCCGTGAAGGGC | SEQ ID NO:20904 GATGAGAGGCTGGGGATTTT TGACTAC |
| | 21-225_10F5 | AA | SEQ ID NO:4881 SYGMH | SEQ ID NO:12893 IIWHDGSNKYYVDSVKG | SEQ ID NO:20905 DERLGIFDY |
| iPS:393934 | | NA | SEQ ID NO:4882 AACTATGGCATGCAC | SEQ ID NO:12894 GTTATATGGTATGATGA AAATAATAAATATTATA TAGACTCCGTGAAGGGC | SEQ ID NO:20906 GAATGGGGTTCCGGTCTGA CTAC |
| | 21-225_13E6 | AA | SEQ ID NO:4883 NYGMH | SEQ ID NO:12895 VIWYDENNKYYIDSVKG | SEQ ID NO:20907 ELGFRSDY |
| iPS:393936 | | NA | SEQ ID NO:4884 AGCTATGCCATGAAC | SEQ ID NO:12896 GTTATTAGTGTGTAGAGG TGTAGTAGCATACTACG CAGACTCCGTGAAGGGC | SEQ ID NO:20908 AGGATAGCAGCTGGTATGGA GTACTTCGATCTC |
| | 21-225_14A11 | AA | SEQ ID NO:4885 SYAMN | SEQ ID NO:12897 VISGRGGSTYYADSVKG | SEQ ID NO:20909 RIAAGMEYFDL |
| | | | SEQ ID NO:4886 | SEQ ID NO:12898 | SEQ ID NO:20910 |

FIGURE 49
(Continued)

| iPS:393940 | 21-225_16B2 | NA | AGCTATGCCATGACC | GTTATTAGTGTGGTAGTGGT GGTAGCACATTCTACGC AGACTCCGTGAAGGGC | TATTGTAGTAGTAGTACCAGGTG CCCTTATGATGCCTTTGATAT C |
|---|---|---|---|---|---|
| | | | SEQ ID NO:4887 | SEQ ID NO:12899 | SEQ ID NO:20911 |
| | | AA | SYAMT | VISGSGGSTFYADSVKG | YCSSTRCPYDAFDI |
| | | | SEQ ID NO:4888 | SEQ ID NO:12900 | SEQ ID NO:20912 |
| iPS:393942 | 21-225_11E5 | NA | AATTATGATATCAAC | TGGATGCACCCTAACAG TGGTGCCACCGGCTATG CACAGAGGTTCCAGGGC | AGCAGTGGCTGGGAGGTCTT TGACTAC |
| | | | SEQ ID NO:4889 | SEQ ID NO:12901 | SEQ ID NO:20913 |
| | | AA | NYDIN | WMHPNSGATGYAQRFQG | SSGWEVFDY |
| | | | SEQ ID NO:4890 | SEQ ID NO:12902 | SEQ ID NO:20914 |
| iPS:393944 | 21-225_14D6 | NA | AGTTATATACCATGAAC | TCCATTAGTGGTAGTGGT AGTTACATATACTACGC AGACTCAGTGAAGGGC | GTAGCAGCCTTTGACTCC |
| | | | SEQ ID NO:4891 | SEQ ID NO:12903 | SEQ ID NO:20915 |
| | | AA | SYTMN | SISGSGSYIYYADSVKG | VAAFDS |
| | | | SEQ ID NO:4892 | SEQ ID NO:12904 | SEQ ID NO:20916 |
| iPS:393946 | 21-225_16A4 | NA | AGCTATAGCATGAAC | TCCATTAGTGGTAGTAGT ACTTACAAATACTACGC AGACTCAGTGAAGGGC | GATCGTGGGAGCTAC |
| | | | SEQ ID NO:4893 | SEQ ID NO:12905 | SEQ ID NO:20917 |
| | | AA | SYSMN | SISGSSTYKYADSVKG | DRGSY |
| | | | SEQ ID NO:4894 | SEQ ID NO:12906 | SEQ ID NO:20918 |
| iPS:393948 | 21-225_16A5 | NA | GACTATGGCATGCAC | GTTATATGGTTTGATGGA AGTAATAAATACTATGT AGACTCCGTGAAGGGC | GATCTTGGCTGGACGGAAGA GTAC |
| | | | SEQ ID NO:4895 | SEQ ID NO:12907 | SEQ ID NO:20919 |

FIGURE 49
(Continued)

| | | AA | DYGMH | | VIWFDGSNKYYVDSVKG | | DLGWTEEY | |
|---|---|---|---|---|---|---|---|---|
| iPS:393950 | | | | SEQ ID NO:4896 | | SEQ ID NO:12908 | | SEQ ID NO:20920 |
| | 21-225_3H10 | NA | AGCTATGTCATGCAC | | GTTATATGGTATGATGG AAGTAATAAATACTATG CAGACTCCGTGAAGGGC | | GAGAGATAGCAGTGGCTG GTATGACTACGGTTGGACG TC | |
| | | | | SEQ ID NO:4897 | | SEQ ID NO:12909 | | SEQ ID NO:20921 |
| iPS:393952 | | AA | SYVMH | | VIWYDGSNKYYADSVKG | | ERYSSGWYDYGLDV | |
| | 21-225_1F1 | | | SEQ ID NO:4898 | | SEQ ID NO:12910 | | SEQ ID NO:20922 |
| | | NA | AGCTATAACATGAAC | | TCCATTAGTAGTAGTAGT AGTTACATATACTACGC AGACTCAGTGAAGGGC | | GTTAACCTCTTGACTAC | |
| | | | | SEQ ID NO:4899 | | SEQ ID NO:12911 | | SEQ ID NO:20923 |
| iPS:393954 | | AA | SYNMN | | SISSSSYIYYADSVKG | | VNLFDY | |
| | 21-225_4H6 | | | SEQ ID NO:4900 | | SEQ ID NO:12912 | | SEQ ID NO:20924 |
| | | NA | GACTACTATTTGCAC | | TGGATCCACCTAACAG TGGTTGGCACAAACTATG CACAGAAGTTTCAGGGC | | GATGGTACCAGCTCGTTTGA CTAC | |
| | | | | SEQ ID NO:4901 | | SEQ ID NO:12913 | | SEQ ID NO:20925 |
| iPS:393956 | | AA | DYYLH | | WIHPNSGGTNYAQKFQG | | DGTSSFDY | |
| | 21-225_4D7 | | | SEQ ID NO:4902 | | SEQ ID NO:12914 | | SEQ ID NO:20926 |
| | | NA | AGCTATGCCATGAGC | | GTTCTTAGTGGTAGTGGT GGTAGCACATTCTACGC AGACTCCGTGAAGGGC | | TATTGTAGTAGTGCCAGGTG CCCTTATGATGCCTTTGATAT C | |
| | | | | SEQ ID NO:4903 | | SEQ ID NO:12915 | | SEQ ID NO:20927 |
| | | AA | SYAMS | | VLSGGGSTFYADSVKG | | YCSSARCPYDAFDI | |
| | | | | SEQ ID NO:4904 | | SEQ ID NO:12916 | | SEQ ID NO:20928 |

FIGURE 49
(Continued)

| | | NA | AGCTATACCATGAAC | TCCATTAGTAGTGGTAGTAGT AGTTACATATACTACGC AGACTCAGTGAAGGGC | GGGAGCAGCTCGTCCGGCTT TGACTAC |
|---|---|---|---|---|---|
| iPS:393958 | 21-225_5H2 | | SEQ ID NO:4905 | SEQ ID NO:12917 | SEQ ID NO:20929 |
| | | AA | SYTMN | SISGSSSYIYYADSVKG | GSSSSGFDY |
| | | | SEQ ID NO:4906 | SEQ ID NO:12918 | SEQ ID NO:20930 |
| iPS:393960 | 21-225_7G2 | NA | GACTATGGCATGCAC | GTTATATGGTATGATGATGTA ACTAATAAATACTATGC AGACTCCGTGAAGGGC | GAACTTGGCTGTGTACGAGGA CTAC |
| | | | SEQ ID NO:4907 | SEQ ID NO:12919 | SEQ ID NO:20931 |
| | | AA | DYGMH | VIWYDVTNKYYADSVKG | ELGWYEDY |
| | | | SEQ ID NO:4908 | SEQ ID NO:12920 | SEQ ID NO:20932 |
| iPS:393962 | 21-225_7H7 | NA | AGAAGTAGTTACTACTGGGG C | AATATCTATTATAGTGGG AGCACCTACTACATCCC GTCCCTCAAGAGT | CACAGTACCAGCTGGTCTCT TGACCAC |
| | | | SEQ ID NO:4909 | SEQ ID NO:12921 | SEQ ID NO:20933 |
| | | AA | RSSYYWG | NIYYSGSTYYIPSLKS | HSTSWSLDH |
| | | | SEQ ID NO:4910 | SEQ ID NO:12922 | SEQ ID NO:20934 |
| iPS:393964 | 21-225_6G1 | NA | AGCTATGGCATGCAC | ATTATATGGTGATGATGG AAGTAATAAATACTATG CAGACTCCGTGAAGGGC | GATCTGAGTATGGGCGGTAT GGACGTC |
| | | | SEQ ID NO:4911 | SEQ ID NO:12923 | SEQ ID NO:20935 |
| | | AA | SYGMH | IIWYDGSNKYYADSVKG | DLSMGGMDV |
| | | | SEQ ID NO:4912 | SEQ ID NO:12924 | SEQ ID NO:20936 |

FIGURE 49
(Continued)

| | | NA | AGCTGTGTCATGCAC | GTTATATGGTATGATGG AAGTAATAAATACTATG CAGACTCCGTGAAGGGC | GAAAGGTATACCAGTGGCTG GCACGACTACGGTATGGACG TC |
|---|---|---|---|---|---|
| iPS:393966 | 21-225_7F8 | | SEQ ID NO:4913 | SEQ ID NO:12925 | SEQ ID NO:20937 |
| | | AA | SCVMH | VIWYDGSNKYYADSVKG | ERYTSGWHDYGMDV |
| | | | SEQ ID NO:4914 | SEQ ID NO:12926 | SEQ ID NO:20938 |
| | | NA | AGCTATGCCATGAAC | GCTATTAGTGGTAGTGGT GGTTACACATACTACGC AGACTCCGTGAAGGGC | GGGGGTCCCTCTTCTAC |
| iPS:393968 | 21-225_5A5 | | SEQ ID NO:4915 | SEQ ID NO:12927 | SEQ ID NO:20939 |
| | | AA | SYAMN | AISGSGGYTYYADSVKG | GGSLFY |
| | | | SEQ ID NO:4916 | SEQ ID NO:12928 | SEQ ID NO:20940 |
| | | NA | AACTATGTCATGCAC | GTTATATGGTATGATGG AAGTAATAAATACTATG CAGACTCCGTGAAGGGC | GAGAAGTATAGCAGCAGCTG GTACGACTACGGTATGGACG TC |
| iPS:393972 | 21-225_7C9 | | SEQ ID NO:4917 | SEQ ID NO:12929 | SEQ ID NO:20941 |
| | | AA | NYVMH | VIWYDGSNKYYADSVKG | EKYSSSWYDYGMDV |
| | | | SEQ ID NO:4918 | SEQ ID NO:12930 | SEQ ID NO:20942 |
| | | NA | AACTATGGCATGCAC | GTTATTTGGTATGAAGA AATAATCAATACTATG CAGACTCCGTGAAGGGC | GAACTGGGGTTCCGGTCTGA CTAC |
| iPS:393974 | 21-225_7C4 | | SEQ ID NO:4919 | SEQ ID NO:12931 | SEQ ID NO:20943 |
| | | AA | NYGMH | VIWYEENNQYYADSVKG | ELGFRSDY |
| | | | SEQ ID NO:4920 | SEQ ID NO:12932 | SEQ ID NO:20944 |

FIGURE 49
(Continued)

| | | | | GTTATATGGTATGATGA | GAATTGGGGTTCCGGTCTGA |
|---|---|---|---|---|---|
| iPS:393976 | | | NA | GACTATGGCATGCAC | AAATAATAAATACTATG | CTAC |
| | | | | | TAGACTCCGTGAAGGGC | |
| | 21-225_7E9 | | | SEQ ID NO:4921 | SEQ ID NO:12933 | SEQ ID NO:20945 |
| | | | AA | DYGMH | VIWYDENNKYYVDSVKG | ELGFRSDY |
| | | | | SEQ ID NO:4922 | SEQ ID NO:12934 | SEQ ID NO:20946 |
| iPS:393978 | | | NA | AGCTATGTCATGCAC | GTTATATGGTATGATGG | GAGAAGTATAGCAGCAGCTG |
| | | | | | AAGTAATAAATACTATG | GTACGACTACGGTATGGACG |
| | | | | | CAGACTCCGTGAAGGGC | TC |
| | 21-225_4C12 | | | SEQ ID NO:4923 | SEQ ID NO:12935 | SEQ ID NO:20947 |
| | | | AA | SYVMH | VIWYDGSNKYYADSVKG | EKYSSSWYDYGMDV |
| | | | | SEQ ID NO:4924 | SEQ ID NO:12936 | SEQ ID NO:20948 |
| iPS:393980 | | | NA | AGCTATGCCATGAAC | GTTATTAGTGGTCGTGGT | CGTTGGCAGTGGCTGGCTC |
| | | | | | GGTAACACATTCTACGC | GGAGGCTTTTGATATC |
| | | | | | AGACTCCGTGAAGGGC | |
| | 21-225_6D3 | | | SEQ ID NO:4925 | SEQ ID NO:12937 | SEQ ID NO:20949 |
| | | | AA | SYAMN | VISGRGGNTFYADSVKG | RLAVAGSEAFDI |
| | | | | SEQ ID NO:4926 | SEQ ID NO:12938 | SEQ ID NO:20950 |
| iPS:393982 | | | NA | AGCTATAGCATGAAC | TCCATTAGTAGTAGTAGT | GATCGTGGGAGCCTC |
| | | | | | AGTTACATATACTACGC | |
| | | | | | AGACTCAGTGAAGGGC | |
| | 21-225_6C12 | | | SEQ ID NO:4927 | SEQ ID NO:12939 | SEQ ID NO:20951 |
| | | | AA | SYSMN | SISSSSYIYYADSVKG | DRGSL |
| | | | | SEQ ID NO:4928 | SEQ ID NO:12940 | SEQ ID NO:20952 |

FIGURE 49
(Continued)

| iPS:393984 | 21-225_4F12 | NA | AGCTATGGCATGCAC | GTTATATGGTATGATGTT ACTAATAAAAAGTATGC AGACTCCGTGAAGGGC | GAAAAGGGGGGGTCTATTTGA CTAC |
| --- | --- | --- | --- | --- | --- |
| | | | SEQ ID NO:4929 | SEQ ID NO:12941 | SEQ ID NO:20953 |
| | | AA | SYGMH | VIWYDVTNKKYADSVKG | EKGGLFDY |
| | | | SEQ ID NO:4930 | SEQ ID NO:12942 | SEQ ID NO:20954 |
| iPS:393986 | 21-225_7G4 | NA | AACTATGTCATGCAC | GTTATATGGTATGATGG AAGTAATAAATACTATG CAGACTCCGTGAAGGGC | GAGAAGTATAGCAGCAACTG GTACGACTACGGTATGGACG TC |
| | | | SEQ ID NO:4931 | SEQ ID NO:12943 | SEQ ID NO:20955 |
| | | AA | NYVMH | VIWYDGSNKYYADSVKG | EKYSSNWYDYGMDV |
| | | | SEQ ID NO:4932 | SEQ ID NO:12944 | SEQ ID NO:20956 |
| iPS:393988 | 21-225_7F10 | NA | AGCTATAGCATGAAC | TCCATTAGTAGTAGTAGT AGTTACATATACTACGC AGACTCAGTGAAGGGC | GCTAACCTCTTTGACTAC |
| | | | SEQ ID NO:4933 | SEQ ID NO:12945 | SEQ ID NO:20957 |
| | | AA | SYSMN | SISSSSYIYYADSVKG | ANLFDY |
| | | | SEQ ID NO:4934 | SEQ ID NO:12946 | SEQ ID NO:20958 |
| iPS:393990 | 21-225_11G7 | NA | AGGAGTACTTACTACTGGGG C | AGTATCTATTATAGTGGG AGCACCTCCTACAGCCC GTCCCTCAAGAGT | CTGAACAGCAGCAGCTGGTCTTT TGACTAC |
| | | | SEQ ID NO:4935 | SEQ ID NO:12947 | SEQ ID NO:20959 |
| | | AA | RSTYYWG | SIYYSGSTSYSPSLKS | LNSSWSFDY |
| | | | SEQ ID NO:4936 | SEQ ID NO:12948 | SEQ ID NO:20960 |

FIGURE 49
(Continued)

| | | | | |
|---|---|---|---|---|
| iPS:393992 | 21-225_14H8 | NA | AGCAATAGCATGAAC | TACATTAGTAGTAGTAGT AGTACCATATACTACGC AGACTCTGTGAAGGGC | GGAGGTGGGAGCCCTTTTGA CTAC |
| | | | SEQ ID NO:4937 | SEQ ID NO:12949 | SEQ ID NO:20961 |
| | | AA | SNSMN | YISSSSSTTYYADSVKG | GGGSPFDY |
| | | | SEQ ID NO:4938 | SEQ ID NO:12950 | SEQ ID NO:20962 |
| iPS:393994 | 21-225_8C9 | NA | AGCTATGGCATGCAC | GTTATATGGTATGATGA AATAATAAATACTATG TAGACTCCGTGAAGGGC | GAATTGGGGTTCCGGTCTGA CTAC |
| | | | SEQ ID NO:4939 | SEQ ID NO:12951 | SEQ ID NO:20963 |
| | | AA | SYGMH | VIWYDENNKYYVDSVKG | ELGFRSDY |
| | | | SEQ ID NO:4940 | SEQ ID NO:12952 | SEQ ID NO:20964 |
| iPS:393996 | 21-225_15C11 | NA | GACTATGTCATGCAC | GTTATATGGTATGATGG AAGTAATAAATACTATG CAGACTCCGTGAAGGGC | GAGAAGTATAGCAGCAGCTG GTACGACTACGGTTTGGACG TC |
| | | | SEQ ID NO:4941 | SEQ ID NO:12953 | SEQ ID NO:20965 |
| | | AA | DYVMH | VIWYDGSNKYYADSVKG | EKYSSSWYDYGLDV |
| | | | SEQ ID NO:4942 | SEQ ID NO:12954 | SEQ ID NO:20966 |
| iPS:393998 | 21-225_12B12 | NA | GACTATGGCATGCAC | GTTATATGGTATGATGTA ACTAATAAATACTATGC AGACTCCGTGAAGGGC | GAGCTTGGCTGGTACGAGGA CTAC |
| | | | SEQ ID NO:4943 | SEQ ID NO:12955 | SEQ ID NO:20967 |
| | | AA | DYGMH | VIWYDVTNKYYADSVKG | ELGWYEDY |
| | | | SEQ ID NO:4944 | SEQ ID NO:12956 | SEQ ID NO:20968 |

FIGURE 49
(Continued)

| iPS | | | | | |
|---|---|---|---|---|---|
| iPS:394000 | 21-225_11A2 | NA | AGCTATGGCATGCAC | GTTATATCATATGGTGGAAGTAATAAAGACTCTGCAGACTCCGTGAAGGGC | CGGGGATACAGCTATGGCGGGTACGGTATGGACGTC |
| | | | SEQ ID NO:4945 | SEQ ID NO:12957 | SEQ ID NO:20969 |
| | | AA | SYGMH | VISYGGSNKDSADSVKG | RGYSYGGYGMDV |
| | | | SEQ ID NO:4946 | SEQ ID NO:12958 | SEQ ID NO:20970 |
| iPS:394002 | 21-225_15G7 | NA | AGGAGTAGTTCCTACTGGGGC | AGTATCTATTATAGTGGGTACACCTATTACACCCCGTCCCTCAAGAGT | CTGAGCAGCAGTTGGTCTTTTGACTTC |
| | | | SEQ ID NO:4947 | SEQ ID NO:12959 | SEQ ID NO:20971 |
| | | AA | RSSSYWG | SIYYSGYTYTPSLKS | LSSSWSFDF |
| | | | SEQ ID NO:4948 | SEQ ID NO:12960 | SEQ ID NO:20972 |
| iPS:394004 | 21-225_13A1 | NA | AGCTATGGCATGCAC | GTTATATCATATGCGGGAACTAATCAATACTATGCAGACTCCGTGAAGGGC | CGGGGATACAGCTATGGCGGGTACGGTATGGACGTC |
| | | | SEQ ID NO:4949 | SEQ ID NO:12961 | SEQ ID NO:20973 |
| | | AA | SYGMH | VISYAGTNQYYADSVKG | RGYSYGGYGMDV |
| | | | SEQ ID NO:4950 | SEQ ID NO:12962 | SEQ ID NO:20974 |
| iPS:394006 | 21-225_15C2 | NA | AGCTATGGCATGCAC | ATAATATCATATGGTGGACGTAATAATCACTATGCAGACTCCGTGAAGGGC | CGGGGATACAGCTATGGCGGGTACGGTATGGACGTC |
| | | | SEQ ID NO:4951 | SEQ ID NO:12963 | SEQ ID NO:20975 |
| | | AA | SYGMH | IISYGGRNNHYADSVKG | RGYSYGGYGMDV |
| | | | SEQ ID NO:4952 | SEQ ID NO:12964 | SEQ ID NO:20976 |
| iPS:394008 | 21-225_15H8 | NA | AGCTATGTCATGAAC | TCCATTAGTGGTAGTAGTACTTACATATACTGCGCAGACTCAATCAAGGGC | GATCGAGGCTCCATC |
| | | | SEQ ID NO:4953 | SEQ ID NO:12965 | SEQ ID NO:20977 |

FIGURE 49
(Continued)

| | | AA | SYVMN | SISGSSTYIYCADSIKG | DRGSI |
| --- | --- | --- | --- | --- | --- |
| iPS:394010 | | | SEQ ID NO:4954 | SEQ ID NO:12966 | SEQ ID NO:20978 |
| | 21-225_12G5 | NA | AACTATGGCATTCAC | GTTATATCATATGATGGA AGTAATAAATACTATGC AGACTCCGTGAAGGGC | GATCGGGGAGCAGTGGCTGC TTACTACTACGGTATAG ACGTC |
| | | | SEQ ID NO:4955 | SEQ ID NO:12967 | SEQ ID NO:20979 |
| | | AA | NYGIY | VISYDGSNKYYADSVKG | DRGAVAAYYYYGIDV |
| iPS:394012 | | | SEQ ID NO:4956 | SEQ ID NO:12968 | SEQ ID NO:20980 |
| | 21-225_15A3 | NA | AGCTATGGCATTCAC | GTTATATGGCATGATGG AAGTAATAAATACTATG CAGACTCCGTGAAGGGC | GATCTGAGTATGGGCGGTAT GGACGTC |
| | | | SEQ ID NO:4957 | SEQ ID NO:12969 | SEQ ID NO:20981 |
| | | AA | SYGIH | VIWHDGSNKYYADSVKG | DLSMGGMDV |
| iPS:394014 | | | SEQ ID NO:4958 | SEQ ID NO:12970 | SEQ ID NO:20982 |
| | 21-225_8G6 | NA | AGCTATGTCATGAAC | GTTATTAGTGGTCGTGGT GGTAACACATTCTACGC AGACTCCGTGAAGGGC | CGTTTGGCAGTGGCTGGCTC GGAGGCTTTTGATATC |
| | | | SEQ ID NO:4959 | SEQ ID NO:12971 | SEQ ID NO:20983 |
| | | AA | SYVMN | VISGRGGNTFYADSVKG | RLAVAGSEAFDI |
| iPS:394016 | | | SEQ ID NO:4960 | SEQ ID NO:12972 | SEQ ID NO:20984 |
| | 21-225_13D4 | NA | AGCTATGGCATGCAC | GTTATATGGCATGATGG AAGTAATAAATACTATG CAGACTCCGTGAAGGGC | GATCTGAGTATGGGCGGTAT GGACGTC |
| | | | SEQ ID NO:4961 | SEQ ID NO:12973 | SEQ ID NO:20985 |
| | | AA | SYGMH | VIWHDGSNKYYADSVKG | DLSMGGMDV |

FIGURE 49
(Continued)

| | | | | SEQ ID NO:4962 | SEQ ID NO:12974 | SEQ ID NO:20986 |
|---|---|---|---|---|---|---|
| iPS:394018 | | | NA | AGCTATGTCATGAGC | GGTATTAGTGGTAGTGGTGGTAGCACAAACAACGCAGACTCCGTGAAGGGC | AGCTCCTTGTTTGACTAC |
| | 21-225_15B1 | | | SEQ ID NO:4963 | SEQ ID NO:12975 | SEQ ID NO:20987 |
| | | | AA | SYVMS | GISGSGGSTNNADSVKG | SSLFDY |
| | | | | SEQ ID NO:4964 | SEQ ID NO:12976 | SEQ ID NO:20988 |
| iPS:394020 | | | NA | AACTATGGCATGCAC | GTTATATGGTATGATGAAGTAATAAATACTATGAAGACTCCGTGAAGGGC | GAAGTGGGGTTTCTTTCTGACTAC |
| | 21-225_15H10 | | | SEQ ID NO:4965 | SEQ ID NO:12977 | SEQ ID NO:20989 |
| | | | AA | NYGMH | VIWYDESNKYYEDSVKG | EVGFLSDY |
| | | | | SEQ ID NO:4966 | SEQ ID NO:12978 | SEQ ID NO:20990 |
| iPS:394022 | | | NA | AGCTATGCCATGAAC | GTTATTAGTCGTAGTGGTGGTTACACATACTACGCGGACTCCGTGAAGGGC | CGTTTAGCAGTGGCAGTGGCTCGGAGGCTTTTGATATC |
| | 21-225_16H6 | | | SEQ ID NO:4967 | SEQ ID NO:12979 | SEQ ID NO:20991 |
| | | | AA | SYAMN | VISRSGGYTYYADSVKG | RLAVAGSFAFDI |
| | | | | SEQ ID NO:4968 | SEQ ID NO:12980 | SEQ ID NO:20992 |
| iPS:394024 | | | NA | AGCTATGGCATGCAC | GTTATATGGTATGATGAAGTAATAAATACTATGCAGACTCCGTGAAGGGC | GAACTGGGGGTTTCTCTCTGACTAC |
| | 21-225_16B7 | | | SEQ ID NO:4969 | SEQ ID NO:12981 | SEQ ID NO:20993 |
| | | | AA | SYGMH | VIWYDESNKYYADSVKG | ELGFLSDY |
| | | | | SEQ ID NO:4970 | SEQ ID NO:12982 | SEQ ID NO:20994 |

FIGURE 49
(Continued)

| | | | | | |
|---|---|---|---|---|---|
| iPS:394026 | 21-225_16C7 | NA | AGCTATGTCATGACC | ACTATTAGTGGTAGTGGT GGTTGGACATATTATGC AGACTCCGTGAAGGGC | AGCTCCTTGTTTGACTAT |
| | | | SEQ ID NO:4971 | SEQ ID NO:12983 | SEQ ID NO:20995 |
| | | AA | SYVMT | TISGSGGWTYYADSVKG | SSLFDY |
| | | | SEQ ID NO:4972 | SEQ ID NO:12984 | SEQ ID NO:20996 |
| iPS:394029 | 21-225_1B12 | NA | AGCTATGGCATGCAC | ATTATATCATATGCTGGA AGTAATAAATCCTATGC AGACTCCGTGAAGGGC | CGGGGATACAGCTATGGCGG GTACGGTATGGACGTC |
| | | | SEQ ID NO:4973 | SEQ ID NO:12985 | SEQ ID NO:20997 |
| | | AA | SYGMH | IISYAGSNKSYADSVKG | RGYSYGGYGMDV |
| | | | SEQ ID NO:4974 | SEQ ID NO:12986 | SEQ ID NO:20998 |
| iPS:394033 | 21-225_5F4 | NA | AGCTATAGCATGAAC | TCCATTAGTGGTAGTAGT AGTTACATATACTACGC AGACTGAGTGAAGGGC | GTTAACAACTTTGACTAC |
| | | | SEQ ID NO:4975 | SEQ ID NO:12987 | SEQ ID NO:20999 |
| | | AA | SYSMN | SISGSSSYIYYADSVKG | VNNFDY |
| | | | SEQ ID NO:4976 | SEQ ID NO:12988 | SEQ ID NO:21000 |
| iPS:394035 | 21-225_5G9 | NA | AATTATGGCATGCAC | ATTATATCATATGCTGGA AGTAATAAATACTATGC AGACTCCGTGAAGGGC | CGTATAACAGCTCGTCTCTA CTACGGTATGGACGTC |
| | | | SEQ ID NO:4977 | SEQ ID NO:12989 | SEQ ID NO:21001 |
| | | AA | NYGMH | IISYAGSNKYYADSVKG | RITARLYYGMDV |
| | | | SEQ ID NO:4978 | SEQ ID NO:12990 | SEQ ID NO:21002 |
| iPS:394037 | 21-225_4F4 | NA | AGGAGTAGTTACTACTGGGG C | AATATTTATTATATAGTGG AGCACCTACGACAACCC GTCCCTCAAGAGT | CATGAAAAGACTGGGGCCT TGACTAC |
| | | | SEQ ID NO:4979 | SEQ ID NO:12991 | SEQ ID NO:21003 |
| | | AA | RSSYYWG | NIYYSGSTYDNPSLKS | HGKDWGLDY |

FIGURE 49
(Continued)

| | | | | | |
|---|---|---|---|---|---|
| iPS:394041 | 21-225_5E5 | NA | SEQ ID NO:4980 AACTATGTCATGCAC | SEQ ID NO:12992 GTTATATGGTGTATGGAAGTAATAAATACTATGCAGACTCCGTGAAGGGC | SEQ ID NO:21004 GAGGTATATAGCAGTGGCTGGTACGACTACGGTATGGACGTC |
| | | AA | SEQ ID NO:4981 NYVMH | SEQ ID NO:12993 VIWYDGSNKYYADSVKG | SEQ ID NO:21005 EVYSSGWYDYGMDV |
| iPS:394043 | 21-225_3B1 | NA | SEQ ID NO:4982 AGCTATGCCATGAAC | SEQ ID NO:12994 GTTTATTAGTGGTGGTGGTATTAACACATTCTACGCAGACTCCGTGAAGGGC | SEQ ID NO:21006 CGTTTAGCAGTGGCTGGCTCGGAGGCTTTTGATATC |
| | | AA | SEQ ID NO:4983 SYAMN | SEQ ID NO:12995 VISGRGINTFYADSVKG | SEQ ID NO:21007 RLAVAGSEAFDI |
| iPS:394045 | 21-225_4H4 | NA | SEQ ID NO:4984 AGGAGTAGTTACTACTGGGGC | SEQ ID NO:12996 AATATTTATTATAGTGGGAACACTACAACAACCCGTCCCTCAAGAGT | SEQ ID NO:21008 CATGGAAAAGACTGGGGCCTTGACTAC |
| | | AA | SEQ ID NO:4985 RSSYYWG | SEQ ID NO:12997 NIYYSGNTYNNPSLKS | SEQ ID NO:21009 HGKDWGLDY |
| iPS:394047 | 21-225_5E6 | NA | SEQ ID NO:4986 AGCTATGGCCATGCAC | SEQ ID NO:12998 ATTATATCATATGTTGGAAATAATAAATACTATGCAGACTCCGTGAAGGGC | SEQ ID NO:21010 CGGGGATACAGCTATGGCGGGTACGGTATGGACGTC |
| | | AA | SEQ ID NO:4987 SYGMH | SEQ ID NO:12999 IISYVGNNKYYADSVKG | SEQ ID NO:21011 RGYSYGGYGMDV |
| | | | SEQ ID NO:4988 SYGMH | SEQ ID NO:13000 | SEQ ID NO:21012 |

FIGURE 49
(Continued)

| | | | | | |
|---|---|---|---|---|---|
| iPS:394049 | 21-225_13H5 | NA | AGAAGTAGTTACTACTGGGG C | AGTATCTATTATATAGTGGG AGCACCTACTACAACCC GTCCCTCAAGAGT | CTTAGCAGCAGCTGGGACTT CCAGCAC |
| | | | SEQ ID NO:4989 | SEQ ID NO:13001 | SEQ ID NO:21013 |
| | | AA | RSSYYWG | SIYYSGSTYYNPSLKS | LSSSWDFQH |
| | | | SEQ ID NO:4990 | SEQ ID NO:13002 | SEQ ID NO:21014 |
| iPS:394051 | 21-225_9E5 | NA | AACTATGCCATGAAC | GCTATTAGTGGTGGTGGTGGT GGTAACACATTCTACGC AGACTCCGTGAAGGGC | CGTATAGCAGTGGCTGGCTC GGAGGCTTTTGCTATC |
| | | | SEQ ID NO:4991 | SEQ ID NO:13003 | SEQ ID NO:21015 |
| | | AA | NYAMN | AISGGGGNTFYADSVKG | RIAVAGSEAFAI |
| | | | SEQ ID NO:4992 | SEQ ID NO:13004 | SEQ ID NO:21016 |
| iPS:394053 | 21-225_11F10 | NA | AGAAGTAGTTACTACTGGGG C | AGTATTTATTATAGTGGG AGCGCCCAGTACAACCC GTCCCTCAAGAGT | CTGAGCAGCAGCTGGTCTTT TGACTAC |
| | | | SEQ ID NO:4993 | SEQ ID NO:13005 | SEQ ID NO:21017 |
| | | AA | RSSYYWG | SIYYSGSAQYNPSLKS | LSSSWSFDY |
| | | | SEQ ID NO:4994 | SEQ ID NO:13006 | SEQ ID NO:21018 |
| iPS:394055 | 21-225_9C8 | NA | AGCCAGAGCATGAAC | TACATTAGTATTAGTAGT ACCATATACTATGCAGA CTCTGTGAAGGGC | GGAGGTGGGAGCCCTTTTGA CTCC |
| | | | SEQ ID NO:4995 | SEQ ID NO:13007 | SEQ ID NO:21019 |
| | | AA | SQSMN | YISISSTYYADSVKG | GGGSPFDS |
| | | | SEQ ID NO:4996 | SEQ ID NO:13008 | SEQ ID NO:21020 |
| iPS:394057 | 21-225_15H1 | NA | AGAAGTAGTTACTACTGGGG C | AATATCTATTATATAGTGGG TATCCTACTACAATCCG TCCCTCAAGAGT | CATAGCACCAGCTGGTCCCT TGACTAC |
| | | | SEQ ID NO:4997 | SEQ ID NO:13009 | SEQ ID NO:21021 |
| | | AA | RSSYYWG | NIYYSGYPYYNPSLKS | HSTSWSLDY |
| | | | SEQ ID NO:4998 | SEQ ID NO:13010 | SEQ ID NO:21022 |

FIGURE 49
(Continued)

| | | | | |
|---|---|---|---|---|
| iPS:394059 | 21-225_9E8 | NA | AGCTATGGCATGCAC | GTTATTTGGTATGAAGAAATAATCAATACTATGCAGACTCCGTGAAGGGC | GAACTGGGGTTCCGGTCTGACTAC |
| | | | SEQ ID NO:4999 | SEQ ID NO:13011 | SEQ ID NO:21023 |
| | | AA | SYGMH | VIWYEENNQYYADSVKG | ELGFRSDY |
| | | | SEQ ID NO:5000 | SEQ ID NO:13012 | SEQ ID NO:21024 |
| iPS:394061 | 21-225_12D2 | NA | AGCTATAGCCATGAAAC | TCCATTAGTAGTAGTAGTAGTTACATATACTACGCAGACTCAGTGAAGGGC | TTAGGGGACTAC |
| | | | SEQ ID NO:5001 | SEQ ID NO:13013 | SEQ ID NO:21025 |
| | | AA | SYSMN | SISSSSYIYYADSVKG | LGDY |
| | | | SEQ ID NO:5002 | SEQ ID NO:13014 | SEQ ID NO:21026 |
| iPS:394063 | 21-225_16A1 | NA | AGGAGTAGTTACTACTGGGGC | AGTATCTATTATAGTGGGAGCGCCTATCACAACCCGTCCCTCAAGAGT | CTGAGCAGCAGCTGGTCCTTTGACTAC |
| | | | SEQ ID NO:5003 | SEQ ID NO:13015 | SEQ ID NO:21027 |
| | | AA | RSSYYWG | SIYYSGSAYHNPSLKS | LSSSWSFDY |
| | | | SEQ ID NO:5004 | SEQ ID NO:13016 | SEQ ID NO:21028 |
| iPS:394065 | 21-225_11E2 | NA | AATTATGATATCAAC | TGGATGAACACTAACAGTGGTAACACAGGCTATGCACAGAAGTTCCAGGGC | AGTCATGGCTGGTTCCTCTTTGACTAC |
| | | | SEQ ID NO:5005 | SEQ ID NO:13017 | SEQ ID NO:21029 |
| | | AA | NYDIN | WMNTNSGNTGYAQKFQG | SHGWFLFDY |
| | | | SEQ ID NO:5006 | SEQ ID NO:13018 | SEQ ID NO:21030 |

FIGURE 49
(Continued)

| | | | | | |
|---|---|---|---|---|---|
| iPS:394067 | 21-225_12F2 | NA | GACTATGGCATGCAC | GTTATATGGTTTGATGGAAATAATAAATACTATGTAGATTCCGTGAAGGGC | GAGCTTGCCTGGTCCGAGGACTAC |
| | | AA | SEQ ID NO:5007 DYGMH | SEQ ID NO:13019 VIWFDGNNKYYVDSVKG | SEQ ID NO:21031 ELAWSEDY |
| iPS:394069 | 21-225_16H1 | NA | SEQ ID NO:5008 AGCTATAGCATGAAC | SEQ ID NO:13020 TCCATTAGTGGTAGTAGTACTTACATATACTACGCAGACTCAGTGAAGGGC | SEQ ID NO:21032 GTAGCAGCCTTTGACTAC |
| | | AA | SEQ ID NO:5009 SYSMN | SEQ ID NO:13021 SISGSSTYIYYADSVKG | SEQ ID NO:21033 VAAFDY |
| iPS:394071 | 21-225_10C7 | NA | SEQ ID NO:5010 AGCTATAGCATGAAC | SEQ ID NO:13022 TCCATTAGTAGTAGTAGTAATAATTACATATACTACGCAGACTCAGTGAAGGGC | SEQ ID NO:21034 TTAGGGGTCTAC |
| | | AA | SEQ ID NO:5011 SYSMN | SEQ ID NO:13023 SISSSNNYIYYADSVKG | SEQ ID NO:21035 LGVY |
| iPS:394073 | 21-225_15C9 | NA | SEQ ID NO:5012 AGAAGTAGTTACTACTGGGGC | SEQ ID NO:13024 AATATCTATTATATAGTGGGAGCACCTACAACAACCCGTCCCTCAAGAGT | SEQ ID NO:21036 CAGGGCAGTGGCTGGGAGGTTGACTAC |
| | | AA | SEQ ID NO:5013 RSSYYWG | SEQ ID NO:13025 NIYYSGSTYNNPSLKS | SEQ ID NO:21037 QGSGWEVDY |
| iPS:394075 | 21-225_8D12 | NA | SEQ ID NO:5014 AGAAGTAGTTACTACTGGGGC | SEQ ID NO:13026 AATATCTATTATATAGTGGGTATCCCTACTACAATCCGTCCCTCAAGAGT | SEQ ID NO:21038 CATAGCACCAGCAGTGGTCCCTTGACTAC |
| | | AA | SEQ ID NO:5015 | SEQ ID NO:13027 | SEQ ID NO:21039 |

FIGURE 49
(Continued)

| | | | | | | |
|---|---|---|---|---|---|---|
| iPS:394077 | 21-225_8E12 | AA | RSSYYWG | NIYYSGYPYYNPSLKS | HSTSWSLDY | |
| | | | SEQ ID NO:5016 | SEQ ID NO:13028 | SEQ ID NO:21040 | |
| | | NA | AGCTATGGCCATGAGC | ATTATTAGTGGTCGTGGT GGTAACACATTCTACGC AGACTCCGTGAAGGGC | CGTATGGCAGTGGCTGGCTC GGAGGCTTTTGATATC | |
| | | | SEQ ID NO:5017 | SEQ ID NO:13029 | SEQ ID NO:21041 | |
| | | AA | SYAMS | IISGRGGNTFYADSVKG | RMAVAGSEAFDI | |
| | | | SEQ ID NO:5018 | SEQ ID NO:13030 | SEQ ID NO:21042 | |
| iPS:394079 | 21-225_11F5 | NA | AGGAGTAGTTACTACTGGGG C | AATATTTATTATTAGTGGG AGCACCTACACCAACCC GTCCCTCAAGAGT | CATGGAAAAGACTGGGGCCT TGACAAC | |
| | | | SEQ ID NO:5019 | SEQ ID NO:13031 | SEQ ID NO:21043 | |
| | | AA | RSSYYWG | NIYYSGSTYTNPSLKS | HGKDWGLDN | |
| | | | SEQ ID NO:5020 | SEQ ID NO:13032 | SEQ ID NO:21044 | |
| iPS:394081 | 21-225_16B3 | NA | AGCTATGGCATGCAC | GTTATATCATATGCTGA ATTAATAAATCCTATGCA GACTCCGTGAAGGGC | CGGGGATACAGCTATGGCGG GTATGGTATGGACGTC | |
| | | | SEQ ID NO:5021 | SEQ ID NO:13033 | SEQ ID NO:21045 | |
| | | AA | SYGMH | VISYAGINKSYADSVKG | RGYSYGGYGMDV | |
| | | | SEQ ID NO:5022 | SEQ ID NO:13034 | SEQ ID NO:21046 | |
| iPS:394083 | 21-225_16E6 | NA | AGCTATGGCATGCAC | GTTATATGGCATGATGG AAGTAATAAATACTATG TAGACTCCGTGAAGGGC | GATCTGAGTATGGGCGGTAT GGACGTC | |
| | | | SEQ ID NO:5023 | SEQ ID NO:13035 | SEQ ID NO:21047 | |
| | | AA | SYGMH | VIWHDGSNKYYVDSVKG | DLSMGGMDV | |
| | | | SEQ ID NO:5024 | SEQ ID NO:13036 | SEQ ID NO:21048 | |

FIGURE 49
(Continued)

| | | | | | |
|---|---|---|---|---|---|
| iPS:394085 | 21-225_8B11 | NA | AATTATGATATCAAC | TGGATGCACCCTAACAG TGGTAACACAGGCTATG CACAGAAGTTCCAGGGC | AGCAGTGGCTGGTACTTCTT TGACTAC |
| | | | SEQ ID NO:5025 | SEQ ID NO:13037 | SEQ ID NO:21049 |
| | | AA | NYDIN | WMHPNSGNTGYAQKFQG | SSGWYFFDY |
| | | | SEQ ID NO:5026 | SEQ ID NO:13038 | SEQ ID NO:21050 |
| iPS:394087 | 21-225_11A5 | NA | AGCTATGCCATGAGC | GTTATTAGTGGTCGTGGT GTTAACACATTCTACGCA GACTCCGTGAAGGGC | CGTATCGCAGTGGCTGGCTC GGAGGCTTTTGATATC |
| | | | SEQ ID NO:5027 | SEQ ID NO:13039 | SEQ ID NO:21051 |
| | | AA | SYAMS | VISGRGVNTFYADSVKG | RIAVAGSEAFDI |
| | | | SEQ ID NO:5028 | SEQ ID NO:13040 | SEQ ID NO:21052 |
| iPS:394089 | 21-225_12E6 | NA | GACTATGGCATGCAC | GTTATATGGTATGATGA AAGTAATAAATACTATG CAGACTCCGTGAAGGGC | GAGCTTGCCTGGTACGAGGA CTAC |
| | | | SEQ ID NO:5029 | SEQ ID NO:13041 | SEQ ID NO:21053 |
| | | AA | DYGMH | VIWYDESNKYYADSVKG | ELAWYEDY |
| | | | SEQ ID NO:5030 | SEQ ID NO:13042 | SEQ ID NO:21054 |
| iPS:394091 | 21-225_13H3 | NA | AGCTATGGCATGCAC | GTTATTTGGTATGAGGA AAGTAATAAATACTATG TAGACTCCGTGAGGGGC | GAACTAGGCTTCCAGTCTGA CTTC |
| | | | SEQ ID NO:5031 | SEQ ID NO:13043 | SEQ ID NO:21055 |
| | | AA | SYGMH | VIWYEESNKYYVDSVRG | ELGFQSDF |
| | | | SEQ ID NO:5032 | SEQ ID NO:13044 | SEQ ID NO:21056 |

FIGURE 49
(Continued)

| | | | | GAGCTTGCCTGGTACGAGGA |
|---|---|---|---|---|
| iPS:394093 | | NA | GACTATGGCATGCAC | CTTC |
| | 21-225_9D12 | | SEQ ID NO:5033 | SEQ ID NO:13045 | SEQ ID NO:21057 |
| | | AA | DYGMH | VIWYDGNNNYYADSVKG | ELAWYEDF |
| | | | SEQ ID NO:5034 | SEQ ID NO:13046 | SEQ ID NO:21058 |
| iPS:394095 | | NA | AACTATGGCATGCAC | GTTATATGGTATGATGTAAGTAATAAATACTATGCAGACTCCGTGAAGGGC | GAAATGGGCTGGACCGATGACTGC |
| | 21-225_16H4 | | SEQ ID NO:5035 | SEQ ID NO:13047 | SEQ ID NO:21059 |
| | | AA | NYGMH | VIWYDVSNKYYADSVKG | EMGWTDDC |
| | | | SEQ ID NO:5036 | SEQ ID NO:13048 | SEQ ID NO:21060 |
| iPS:394097 | | NA | GACTATGGCATGCAC | GTTATTTGGTATGATGAAAATAATGAATACTATGCAGACTCCGTGAAGGGC | GAGCTTGCCTGGTACGAGGACTAC |
| | 21-225_16G7 | | SEQ ID NO:5037 | SEQ ID NO:13049 | SEQ ID NO:21061 |
| | | AA | DYGMH | VIWYDENNEYYADSVKG | ELAWYEDY |
| | | | SEQ ID NO:5038 | SEQ ID NO:13050 | SEQ ID NO:21062 |
| iPS:398470 | | NA | GGCTACTATATGCAC | TGGATCAACCCTAACAGTGGTGGCACAAACTATGTACAGAAGTTTCAGGGC | TCGTTTTCTATGTTCGGGGAGTTATTATAACGAATTTGACTAC |
| | 21-225_14B7 | | SEQ ID NO:5039 | SEQ ID NO:13051 | SEQ ID NO:21063 |
| | | AA | GYYMH | WINPNSGGTNYVQKFQG | SFFYGSGSYYNEFDY |
| | | | SEQ ID NO:5040 | SEQ ID NO:13052 | SEQ ID NO:21064 |

FIGURE 49
(Continued)

| iPS:398472 | 21-225_16E4 | NA | AGCTATGTCATGAGC | ACTATTAGTGTTGGTGGT GGTACCACATACTACGC AGACTCCGTGAAGGGC | TGGGGACGTGGCAACAGCTA TGAGTACTACTACGGTATGG ACGTC |
|---|---|---|---|---|---|
| | | | SEQ ID NO:5041 | SEQ ID NO:13053 | SEQ ID NO:21065 |
| | | AA | SYVMS | TISVGGGTTYYADSVKG | WGRGNSYEYYYGMDV |
| | | | SEQ ID NO:5042 | SEQ ID NO:13054 | SEQ ID NO:21066 |
| iPS:398474 | 21-225_17B10 | NA | AGCTATGCCATGAGC | GTTATTAGTGGTAGTGGT GGTAACACATACTTCGC AGACTCCGTGAAGGGC | AGGGGTATACCAGAGGCTGA TGCTTTTGATATC |
| | | | SEQ ID NO:5043 | SEQ ID NO:13055 | SEQ ID NO:21067 |
| | | AA | SYAMS | VISGSGGNTYFADSVKG | RGIPEADAFDI |
| | | | SEQ ID NO:5044 | SEQ ID NO:13056 | SEQ ID NO:21068 |
| iPS:398476 | 21-225_17C1 | NA | AGCTATGCCATGAGC | GTTATTAGTGGTAGTGGT GGTACCACATTCTACGC AGACTCCGTGAAGGGC | TATTGTAGTAGTACCAGGTG TCCTTATGATGCCTTTGATAT C |
| | | | SEQ ID NO:5045 | SEQ ID NO:13057 | SEQ ID NO:21069 |
| | | AA | SYAMS | VISGSGGTTFYADSVKG | YCSSTRCPYDAFDI |
| | | | SEQ ID NO:5046 | SEQ ID NO:13058 | SEQ ID NO:21070 |
| iPS:398478 | 21-225_17C10 | NA | AGCTATAGCATGAAC | TCCATTAGTGGTAGTAGT AGTTACATGTACTACGC AGACTCAGTGAAGGGC | GATCGTGGGAGCTCC |
| | | | SEQ ID NO:5047 | SEQ ID NO:13059 | SEQ ID NO:21071 |
| | | AA | SYSMN | SISGSSSYMYYADSVKG | DRGSS |
| | | | SEQ ID NO:5048 | SEQ ID NO:13060 | SEQ ID NO:21072 |
| iPS:398480 | 21-225_17G4 | NA | GACTATTATATGCAC | TGGATCAACCCTAACAG TGGTGGCACAAACTATG AACAGAAGTTTCAGGGC | GGATACAGCTATGGGTACAA CTGGTTCGACCCC |
| | | | SEQ ID NO:5049 | SEQ ID NO:13061 | SEQ ID NO:21073 |
| | | AA | DYYMH | WINPNSGGTNYEQKFQG | GYSYGYNWFDP |
| | | | SEQ ID NO:5050 | SEQ ID NO:13062 | SEQ ID NO:21074 |

FIGURE 49
(Continued)

| | | | | |
|---|---|---|---|---|
| iPS:398482 | 21-225_17H6 | NA | AGCTATAGCATGAAC | TCCATTAGTGGTAGTAGT AGTTACATATACTAGC AGACTCAGTGAAGGGC | GTGGCTTCATTTGACTAC |
| | | | SEQ ID NO:5051 | SEQ ID NO:13063 | SEQ ID NO:21075 |
| | | AA | SYSMN | SISGSSSYIYYADSVKG | VASFDY |
| | | | SEQ ID NO:5052 | SEQ ID NO:13064 | SEQ ID NO:21076 |
| iPS:398484 | 21-225_18D4 | NA | GGCTACTATTTGCAC | TGGATCAACCCTAACAG TAATGGCACAATCTCTGC ACAGAAGTTTCAGGGC | GATGGTACCAGCTCGCTTGA CTAC |
| | | | SEQ ID NO:5053 | SEQ ID NO:13065 | SEQ ID NO:21077 |
| | | AA | GYYLH | WINPNSNGTISAQKFQG | DGTSSLDY |
| | | | SEQ ID NO:5054 | SEQ ID NO:13066 | SEQ ID NO:21078 |
| iPS:398486 | 21-225_19A1 | NA | GGCTACTATATGCAC | TGGATCAATCCTAACAG TGGTGGCACAAACTATG CACAGAAGTTTCAGGGC | GGATACAGCTATGGGTACAA CTGGTTCGACCCC |
| | | | SEQ ID NO:5055 | SEQ ID NO:13067 | SEQ ID NO:21079 |
| | | AA | GYYMH | WINPNSGTNYAQKFQG | GYSYGYNWFDP |
| | | | SEQ ID NO:5056 | SEQ ID NO:13068 | SEQ ID NO:21080 |
| iPS:398488 | 21-225_19F6 | NA | AACGCCTGGATGAAC | CGTATTAAAAGCAAAAC TGATGGTGGGACAACAG ACTACGCTGCACCCGTG AAAGGC | GATACGGGTCCTATAGCAGC TCGTCTCGCTTACTACTACTA TTACGCTATGGACGTC |
| | | | SEQ ID NO:5057 | SEQ ID NO:13069 | SEQ ID NO:21081 |
| | | AA | NAWMN | RIKSKTDGGTTDYAAPVK G | DTGPIAARLAYYYYYAMDV |
| | | | SEQ ID NO:5058 | SEQ ID NO:13070 | SEQ ID NO:21082 |
| iPS:398490 | 21-225_21D12 | NA | GACTACTATATTCAC | TGGATCAACCCTAACAG TGGTGGGACAAACAATG CACAGAAGTTTCAGGGC | TCGTATTACTATGGTTCGGG GACTTATTATAACGAATTTG ACTAC |
| | | | SEQ ID NO:5059 | SEQ ID NO:13071 | SEQ ID NO:21083 |

FIGURE 49
(Continued)

| | | AA/NA | | | |
|---|---|---|---|---|---|
| iPS:398494 | 21-225_21H4 | AA | DYYIH<br>SEQ ID NO:5060 | WINPNSGGTNNAQKFQG<br>SEQ ID NO:13072 | SYYYGSGTYYNEFDY<br>SEQ ID NO:21084 |
| | | NA | AGCTATGCCATGAGC<br>SEQ ID NO:5061 | GCTCTTAGTGGTCGTGGT<br>GGTAGCACATACTACGC<br>AGACTCCGTGAAGGGC<br>SEQ ID NO:13073 | TGGGGACGTGGATACAGCTA<br>TGAGTACTACTACGGTATGG<br>ACGTC<br>SEQ ID NO:21085 |
| | | AA | SYAMS<br>SEQ ID NO:5062 | ALSGRGGSTYYADSVKG<br>SEQ ID NO:13074 | WGRGYSYEYYYGMDV<br>SEQ ID NO:21086 |
| iPS:398496 | 21-225_22D2 | NA | AATTATGATATCAAC<br>SEQ ID NO:5063 | TGGATGCACCCTGACAG<br>TGGTAACACAGGCTATG<br>CACAGAAGTTCCAGGGC<br>SEQ ID NO:13075 | AGTAGTGGCTGGTACTACTT<br>TGACTAC<br>SEQ ID NO:21087 |
| | | AA | NYDIN<br>SEQ ID NO:5064 | WMHPDSGNTGYAQKFQG<br>SEQ ID NO:13076 | SSGWYYFDY<br>SEQ ID NO:21088 |
| iPS:398498 | 21-225_22E6 | NA | ACTGGTGGAGTGGGTGTGGG<br>C<br>SEQ ID NO:5065 | CTCATTTATTGGAATGAT<br>GATAAGCGCTACAGCCC<br>ATCTCTGAAGAGC<br>SEQ ID NO:13077 | ACTATAGCAGTTCGTGGCTT<br>TGACTAC<br>SEQ ID NO:21089 |
| | | AA | TGGVGVG<br>SEQ ID NO:5066 | LIYWNDDKRYSPSLKS<br>SEQ ID NO:13078 | TIAVRGFDY<br>SEQ ID NO:21090 |
| iPS:398500 | 21-225_23A11 | NA | AGTTATAGCATGAAC<br>SEQ ID NO:5067 | TCCATTAGTGGTAGTAGT<br>ACTTACATATACTACGCA<br>GACTCAGTGAAGGGC<br>SEQ ID NO:13079 | GTGGCTTCATTTGACTAC<br>SEQ ID NO:21091 |
| | | AA | SYSMN<br>SEQ ID NO:5068 | SISGSSTYIYYADSVKG<br>SEQ ID NO:13080 | VASFDY<br>SEQ ID NO:21092 |

FIGURE 49
(Continued)

| | | | | |
|---|---|---|---|---|
| iPS:398502 | 21-225_23B11 | NA | GGCTACTATCTGCAC | TGGATCAACCCTAACAA TAATGGCACAAACTATG CACAGAAGTTCAGGGC | GATGGTACCAGCTCGTTTGA CTAC |
| | | | SEQ ID NO:5069 | SEQ ID NO:13081 | SEQ ID NO:21093 |
| | | AA | GYYLH | WINPNNGTNYAQKFQG | DGTSSFDY |
| | | | SEQ ID NO:5070 | SEQ ID NO:13082 | SEQ ID NO:21094 |
| iPS:398504 | 21-225_23D7 | NA | ACTAGTGGAGTGGGTGTGGG C | CTCATTTATTGGAATAAT GATAAGGTCTACAGCCC ATCTCTGAAGAGC | AGGGGACAGCAGCTGGCCCT CGACTAC |
| | | | SEQ ID NO:5071 | SEQ ID NO:13083 | SEQ ID NO:21095 |
| | | AA | TSGVGVG | LIYWNDKVYSPSLKS | RGQQLALDY |
| | | | SEQ ID NO:5072 | SEQ ID NO:13084 | SEQ ID NO:21096 |
| iPS:398506 | 21-225_23G12 | NA | AATTATGATATCAAC | TGGATGTACCCTAACAG TGGTAACACGGGCTATG CACAGAAGTTCCAGGGC | AGCGGTGGCTGGTACTACTT TGACTAC |
| | | | SEQ ID NO:5073 | SEQ ID NO:13085 | SEQ ID NO:21097 |
| | | AA | NYDIN | WMYPNSGNTGYAQKFQG | SGGWYYFDY |
| | | | SEQ ID NO:5074 | SEQ ID NO:13086 | SEQ ID NO:21098 |
| iPS:398508 | 21-225_24B1 | NA | AGCTATGCCATGAGC | GCTATTAGTGGTGTCGTGGT GGTAGCACATACTACGC AGACTCCGTGAAGGGC | TGGGGACGTGGATACAGCTA TGAGTACTACTACGGTATGG ACGTC |
| | | | SEQ ID NO:5075 | SEQ ID NO:13087 | SEQ ID NO:21099 |
| | | AA | SYAMS | AISGRGSTYYADSVKG | WGRGYSYEYYYGMDV |
| | | | SEQ ID NO:5076 | SEQ ID NO:13088 | SEQ ID NO:21100 |
| iPS:398510 | | NA | AATTATGATATCAAC | TGGATGCACCCTAACAG TGGTAACACAGGCTATG CACAGAAGTTCCAGGGC | AGCAGTGGCTGGTATTGGTT CGACCCC |

FIGURE 49
(Continued)

| | | | | | | |
|---|---|---|---|---|---|---|
| iPS:398512 | 21-225_25A3 | AA | SEQ ID NO:5077 NYDIN | SEQ ID NO:13089 WMHPNSGNTGYAQKFQG | SEQ ID NO:21101 SSGWYWFDP | |
| | | NA | SEQ ID NO:5078 AATTATGATATCAAC | SEQ ID NO:13090 TGGATGAACCCTAACAG TGGTAACACAGGCTATG CACAGAAGTTCCAGGGC | SEQ ID NO:21102 AGCAATGGCTGGTACTACTT TGACTAC | |
| iPS:398516 | 21-225_25E12 | AA | SEQ ID NO:5079 NYDIN | SEQ ID NO:13091 WMNPNSGNTGYAQKFQG | SEQ ID NO:21103 SNGWYYFDY | |
| | | NA | SEQ ID NO:5080 AATTATGATATCAAC | SEQ ID NO:13092 TGGATGCACCCTAACAG TGGTAACACAGGCTGTG CACAGAAGTTCCAGGGC | SEQ ID NO:21104 AGCAGTGGCTGGTACTGGTT CGACCCC | |
| iPS:398520 | 21-225_26A9 | AA | SEQ ID NO:5081 NYDIN | SEQ ID NO:13093 WMHPNSGNTGCAQKFQG | SEQ ID NO:21105 SSGWYWFDP | |
| | | NA | SEQ ID NO:5082 GGCGATTATATGCAC | SEQ ID NO:13094 TGGATCAGCCCTAAAAA TGGTGGCACAAACTATG CACAGAAGTTCCAGGGC | SEQ ID NO:21106 GATGGAACTGGGTCCTTTGA CTAC | |
| iPS:398522 | 21-225_31C4 | AA | SEQ ID NO:5083 GDYMH | SEQ ID NO:13095 WISPKNGGTNYAQKFQG | SEQ ID NO:21107 DGTGSFDY | |
| | | NA | SEQ ID NO:5084 AACTATGATATTAAC | SEQ ID NO:13096 TGGATGAACCCTAACAG TGGTAACACAGGCTATG CACAGAAGTTCCAGGGC | SEQ ID NO:21108 AGCAGTGGCTGGTACTTTTT TGACTAC | |
| | 21-225_32A1 | | SEQ ID NO:5085 | SEQ ID NO:13097 | SEQ ID NO:21109 | |

FIGURE 49
(Continued)

| | | AA | NYDIN | | WMNPNSGNTGYAQKFQG | | SSGWYFFDY |
|---|---|---|---|---|---|---|---|
| iPS:398524 | | | | SEQ ID NO:5086 | | SEQ ID NO:13098 | SEQ ID NO:21110 |
| | 21-225_32A5 | NA | AATTATGACATCAAC | | TGGATGCACCCTAACAG TGGTAACACAGGCTTTG CACAGAAGTTCCGGGGC | | AGCAGTGGCTGGTACTTTTT TGACTAC |
| | | | | SEQ ID NO:5087 | | SEQ ID NO:13099 | SEQ ID NO:21111 |
| iPS:398526 | | AA | NYDIN | | WMHPNSGNTGFAQKFRG | | SSGWYFFDY |
| | | | | SEQ ID NO:5088 | | SEQ ID NO:13100 | SEQ ID NO:21112 |
| | 21-225_32B3 | NA | AGCTATAGCCATGAAC | | TCCATTAGTGGTAGTAGT ACTTACATATACTACGCA GACTCAGTGAAGGGC | | GTGGCTGGCTTTGACTAC |
| | | | | SEQ ID NO:5089 | | SEQ ID NO:13101 | SEQ ID NO:21113 |
| iPS:398528 | | AA | SYSMN | | SISGSSTYIYYADSVKG | | VAGFDY |
| | | | | SEQ ID NO:5090 | | SEQ ID NO:13102 | SEQ ID NO:21114 |
| | 21-225_32G1 | NA | AGCTATGCCATGAGC | | GCTATTAGTGGTCGTGGT GGTAGCACATTCCACGC AGACTCCGTGAAGGGC | | GGGGAGCTACTAGAGGACTA CTACTTCTACGGTATGGACG TC |
| | | | | SEQ ID NO:5091 | | SEQ ID NO:13103 | SEQ ID NO:21115 |
| iPS:398530 | | AA | SYAMS | | AISGRGGSTFHADSVKG | | GELLEDYYFYGMDV |
| | | | | SEQ ID NO:5092 | | SEQ ID NO:13104 | SEQ ID NO:21116 |
| | 21-225_32G4 | NA | AGTTATGATATCAAC | | TGGATGAACCCTAACAG TGGTAACACAGGCTATG CACAGAAGTTCCAGGGC | | AAGAAGGCTAACGACTAC |
| | | | | SEQ ID NO:5093 | | SEQ ID NO:13105 | SEQ ID NO:21117 |
| | | AA | SYDIN | | WMNPNSGNTGYAQKFQG | | KKANDY |
| | | | | SEQ ID NO:5094 | | SEQ ID NO:13106 | SEQ ID NO:21118 |

FIGURE 49
(Continued)

| | | | | | |
|---|---|---|---|---|---|
| iPS:398532 | 21-225_33B7 | NA | AGCTATAACATGAAC | TCCATTAGTGTGGTAGTAGT AGTTACATATACTACGC AGACTCAGTGAAGGGC | TTAAATGGTTTTGACTAC |
| | | | SEQ ID NO:5095 | SEQ ID NO:13107 | SEQ ID NO:21119 |
| | | AA | SYNMN | SISGSSSYIYYADSVKG | LNGFDY |
| | | | SEQ ID NO:5096 | SEQ ID NO:13108 | SEQ ID NO:21120 |
| iPS:398534 | 21-225_33B8 | NA | AGCTATGCCATGAGC | GCTATTAGTGGTCGTGGT GGTAGCACATTCCACGC AGACTCCGTGAAGGGC | GGGGAGCTACTAGAGGACTA CTACTTCTACGGTATGGACG TC |
| | | | SEQ ID NO:5097 | SEQ ID NO:13109 | SEQ ID NO:21121 |
| | | AA | SYAMS | AISGRGGSTFHADSVKG | GELLEDYYFYGMDV |
| | | | SEQ ID NO:5098 | SEQ ID NO:13110 | SEQ ID NO:21122 |
| iPS:398536 | 21-225_33D12 | NA | AGTTATGATATCAGC | TGGATGAACCCTAACAG TGGTAACACAGGCTATG CACAGAAGTTCCAGGGC | AAGAGGGCTAACGACTAC |
| | | | SEQ ID NO:5099 | SEQ ID NO:13111 | SEQ ID NO:21123 |
| | | AA | SYDIS | WMNPNSGNTGYAQKFQG | KRANDY |
| | | | SEQ ID NO:5100 | SEQ ID NO:13112 | SEQ ID NO:21124 |
| iPS:398538 | 21-225_34H7 | NA | AACTATGATATTAAC | TGGATGAACCCTAACAG TGGTAACACAGGCTATG CACAGAAGTTCCAGGGC | AGCAGTGGCTGGTACTTTTT TGACTAC |
| | | | SEQ ID NO:5101 | SEQ ID NO:13113 | SEQ ID NO:21125 |
| | | AA | NYDIN | WMNPNSGNTGYAQKFQG | SSGWYFDY |
| | | | SEQ ID NO:5102 | SEQ ID NO:13114 | SEQ ID NO:21126 |
| iPS:398540 | 21-225_35A6 | NA | AGCTATGCCATGAGC | ACTATTAGTGGTCGTGGT GGTAGCACATTCCACGC AGACTCCGTGAAGGGC | GGGGAGCTACTAGAGGACTA CTACTTCTACGGTATGGACG TC |
| | | | SEQ ID NO:5103 | SEQ ID NO:13115 | SEQ ID NO:21127 |

FIGURE 49
(Continued)

| | | | | | |
|---|---|---|---|---|---|
| iPS:398544 | 21-225_7C8 | AA | SYAMS | TISGRGGSTFHADSVKG | GELLEDYFYGMDV |
| | | | SEQ ID NO:5104 | SEQ ID NO:13116 | SEQ ID NO:21128 |
| | | NA | AACGCCCGGATGAAAC | CGTATTAAAAGCAAAAC TGATGGTGGGACAACAG ACTACGCTGCACCCGTG AAAGGC | GATACGGGTCCTATAGCAGC TCGTCTCGCTTACTACTACTA CTACGCTATGGACGTC |
| | | | SEQ ID NO:5105 | SEQ ID NO:13117 | SEQ ID NO:21129 |
| iPS:398546 | 21-225_9H10 | AA | NARMN | RIKSKTDGGTTDYAAPVK G | DTGPIAARLAYYYYAMDV |
| | | | SEQ ID NO:5106 | SEQ ID NO:13118 | SEQ ID NO:21130 |
| | | NA | ACTAGTGGAGTGGGTGTGGG C | CTCATTTATTGGAGTGAT GATAAGCGCTACAGCCC ATCTCTGAAGAGC | ACCGGTTCTAGCTGCTGCTA TTTTGACTAC |
| | | | SEQ ID NO:5107 | SEQ ID NO:13119 | SEQ ID NO:21131 |
| | | AA | TSGVGVG | LIYWSDDKRYSPSLKS | TGSSCCYFDY |
| | | | SEQ ID NO:5108 | SEQ ID NO:13120 | SEQ ID NO:21132 |
| iPS:402219 | 21-225_1C12 | NA | AACTATGGCATGCAC | GTTATATGGTATGATGA AAATAATAAATACTATG TAGACTCCGTGAAGGGC | GAATTGGGGTTCCGGTCTGA CTAC |
| | | | SEQ ID NO:5109 | SEQ ID NO:13121 | SEQ ID NO:21133 |
| | | AA | NYGMH | VIWYDENNKYYVDSVKG | ELGFRSDY |
| | | | SEQ ID NO:5110 | SEQ ID NO:13122 | SEQ ID NO:21134 |
| iPS:402221 | 21-225_2C12 | NA | AGCTATAGCATGAAC | TCCATTAGTGGTAGTAGT AGTTACATGTACTACGC AGACTCAGTGAAGGGC | GTGAATCTCTTTGACTAC |
| | | | SEQ ID NO:5111 | SEQ ID NO:13123 | SEQ ID NO:21135 |
| | | AA | SYSMN | SISGSSSYMYYADSVKG | VNLFDY |
| | | | SEQ ID NO:5112 | SEQ ID NO:13124 | SEQ ID NO:21136 |

FIGURE 49
(Continued)

| | | | | |
|---|---|---|---|---|
| iPS:402223 | 21-225_30A11 | NA | GACTATCATATGCAC SEQ ID NO:5113 | TGGATCAACCCTAATAGGGGTGGCACAAACTATGCACAGAAGTTTCAGGAC SEQ ID NO:13125 | GATGGAACTGGGTCCTTTGACTAC SEQ ID NO:21137 |
| | | AA | DYHMH | WINPNRGGTNYAQKFQD | DGTGSFDY |
| iPS:402225 | 21-225_2B1 | NA | AGCTATAGCATGAAC SEQ ID NO:5114 | TCCATTAGTAGTAGTAGTAGTTACATATACTGCAGACTCAGTGAAGGGC SEQ ID NO:13126 | CTGGGGAACTAC SEQ ID NO:21138 |
| | | AA | SYSMN SEQ ID NO:5115 | SISSSSSYIYYADSVKG SEQ ID NO:13127 | LGNY SEQ ID NO:21139 |
| iPS:402229 | 21-225_16H9 | NA | AGCTATAGCATGAAC SEQ ID NO:5116 | TCCATTAGTGGTAGTAGTAGTTACATATACTACGAGACTCAGTGAAGGGC SEQ ID NO:13128 | GTCAACGGTATGGACGTC SEQ ID NO:21140 |
| | | AA | SYSMN SEQ ID NO:5117 | SISGSSSYIYYADSVKG SEQ ID NO:13129 | VNGMDV SEQ ID NO:21141 |
| iPS:402231 | 21-225_6D9 | NA | AACGGCCTGGATGAAC SEQ ID NO:5118 | CGTATTAAAAGCAAAACTGATGGTGGGACAACAGACTACGCTGCACCCGTGAAAGgC SEQ ID NO:13130 | GATACGGGTCCTATAGCAGCTCGTCTCGCTTACTACTACTACTACGCTATGGACGTC SEQ ID NO:21142 |
| | | AA | NAWMN SEQ ID NO:5119 | RIKSKTDGGTDYAAPVKG SEQ ID NO:13131 | DIGPIAARLAYYYYAMDV SEQ ID NO:21143 |
| iPS:402233 | 21_225_16D10 | NA | ACCTATAACTTGAAC SEQ ID NO:5120 | TCCATTAGTGGTGGTGCCGGTCACATATATTACTCAGACTCAGTGAAGGGC SEQ ID NO:13132 | ACTAATGGGTTTGACTTC SEQ ID NO:21144 |

FIGURE 49
(Continued)

| | | | | | | |
|---|---|---|---|---|---|---|
| iPS:402235 | 21-225_16D10 | AA | SEQ ID NO:5121<br>TYNLN | SEQ ID NO:13133<br>SISGGAGHIYYSDSVKG | SEQ ID NO:21145<br>TNGFDF | |
| | | NA | SEQ ID NO:5122<br>AGCTATAGCATGAAC | SEQ ID NO:13134<br>TCCATTAGTACTAGTACT<br>TTCATATACTACGCAGAT<br>TCAGTGAAGGGC | SEQ ID NO:21146<br>AAGGCTGGGCTTGATATC | |
| iPS:402237 | 21-225_20F10 | AA | SEQ ID NO:5123<br>SYSMN | SEQ ID NO:13135<br>SISTSTFIYYADSVKG | SEQ ID NO:21147<br>KAGLDI | |
| iPS:402237 | 21-225_23D11 | NA | SEQ ID NO:5124<br>AGCTATAACATAAAC | SEQ ID NO:13136<br>TCCATTAGTGGTAATAGT<br>GGTTACATATACTACGC<br>AGACTCAGTGAAGGGC | SEQ ID NO:21148<br>ACTAACCTCTTTGACTAC | |
| | | AA | SEQ ID NO:5125<br>SYNIN | SEQ ID NO:13137<br>SISGNSGYIYYADSVKG | SEQ ID NO:21149<br>TNLFDY | |
| iPS:403868 | 21-225_19D11 | NA | SEQ ID NO:5126<br>AGAAGTAGTTATTACTGGGG<br>C | SEQ ID NO:13138<br>AGTATCTATTATTATAGTGGG<br>AGGGCCAACTACACAACCC<br>GTCCCTCAAGAGT | SEQ ID NO:21150<br>CTGGACAGGGGCTGGTCCTT<br>TGACTAC | |
| | | AA | SEQ ID NO:5127<br>RSSYYWG | SEQ ID NO:13139<br>SIYYSGSANYNPSLKS | SEQ ID NO:21151<br>LDRGWSFDY | |
| iPS:403870 | 21-225_23G4 | NA | SEQ ID NO:5128<br>AGCTATGCCATGAGC | SEQ ID NO:13140<br>GTTATTAGTGGGCGTGGT<br>GGTAGCACATACTACGC<br>AGACTCCGTGAAGGGC | SEQ ID NO:21152<br>AGGGGGATAGTGGGAGCTAC<br>TGAGGCTTTTGATATC | |
| | | AA | SEQ ID NO:5129<br>SYAMS | SEQ ID NO:13141<br>VISGRGGSTYYADSVKG | SEQ ID NO:21153<br>RGIVGATEAFDI | |
| iPS:403872 | 21_225_8F11 | NA | SEQ ID NO:5130<br>AGGACTAGTTACTACTGGGG<br>C | SEQ ID NO:13142<br>AATATTTATTATTATAGTGGG<br>AGGGCCTACAACAACCC<br>GTCCCTCAAGAGT | SEQ ID NO:21154<br>CATGGACAAGACTGGGGCCT<br>TGACTAC | |

FIGURE 49
(Continued)

| | | | | | | |
|---|---|---|---|---|---|---|
| iPS:404090 | 21-225_8F11 | AA | SEQ ID NO:5131<br>RTSYYWG | SEQ ID NO:13143<br>NIYYSGSAYNNPSLKS | SEQ ID NO:21155<br>HGQDWGLDY |
| | | NA | SEQ ID NO:5132<br>AGCTATAGCATGAAC | SEQ ID NO:13144<br>TCCATTAGTAGTAGTAGT<br>AGTTACATATACTACGC<br>AGACTCAGTGAAGGGC | SEQ ID NO:21156<br>CTGGGTAACTAC |
| iPS:412232 | 21-225_8D8 | AA | SEQ ID NO:5133<br>SYSMN | SEQ ID NO:13145<br>SISSSSYIYYADSVKG | SEQ ID NO:21157<br>LGNY |
| | | NA | SEQ ID NO:5134<br>AATTATGATATCAAC | SEQ ID NO:13146<br>TGGATGCACCCTAACAG<br>TGGTAACACAGGCTATG<br>CACAGAAGTTCCAGGGC | SEQ ID NO:21158<br>AGCAGTGGCTGGTACTACTT<br>TGACTAC |
| iPS:422894 | 21-225_4A2 | AA | SEQ ID NO:5135<br>NYDIN | SEQ ID NO:13147<br>WMHPNSGNTGYAQKFQG | SEQ ID NO:21159<br>SSGWYYFDY |
| | | NA | SEQ ID NO:5136<br>AATTATGATATCAAC | SEQ ID NO:13148<br>TGGATGCACCCTAACAG<br>TGGTAACACAGGCTATG<br>CACAGAAGTTCCAGGGC | SEQ ID NO:21160<br>AGCAGTGGCTGGTACTACTT<br>TGACTAC |
| | 21-225_4A2.001 | AA | SEQ ID NO:5137<br>NYDIN | SEQ ID NO:13149<br>WMHPNSGNTGYAQKFQG | SEQ ID NO:21161<br>SSGWYYFDY |
| iPS:423018 | 21-225_31D12_LC2 | NA | SEQ ID NO:5138<br>GGCTACTATATGCAC | SEQ ID NO:13150<br>TGGATCAACCCTAACAG<br>TGGTGGCACAAACTATG<br>TACAGAAGTTTCAGGGC | SEQ ID NO:21162<br>GTGTATTACTATGGTTCGGG<br>GAGTTATTATTAACGAGTTTG<br>ACTAC |
| | | AA | SEQ ID NO:5139<br>GYYMH | SEQ ID NO:13151<br>WINPNSGGTNYVQKFQG | SEQ ID NO:21163<br>VYYYGSGSYYNEFDY |
| | | | SEQ ID NO:5140 | SEQ ID NO:13152 | SEQ ID NO:21164 |

FIGURE 49
(Continued)

| | | | | |
|---|---|---|---|---|
| iPS:423019 | 21-225_31D12_LC1 | NA | GGCTACTACTATATGCAC | TGGATCAACCCTAACAG TGGTGGCACAAACTATG TACAGAAGTTTCAGGGC | GTGTATTACTATGGTTCGGG GAGTTATTATAACGAGTTTG ACTAC |
| | | | SEQ ID NO:5141 | SEQ ID NO:13153 | SEQ ID NO:21165 |
| | | AA | GYYMH | WINPNSGGTNYVQKFQG | VYYYGSGSYYNEFDY |
| | | | SEQ ID NO:5142 | SEQ ID NO:13154 | SEQ ID NO:21166 |
| iPS:423314 | 21-225_12F11 | NA | AATTATGATATCAAC | TGGATGCACCCTAACAG TGGTAACACAGGCTATG CAAAGAAGTTCCAGGGC | AGCAGTGGCTGGTACTACTT TGACTAC |
| | | | SEQ ID NO:5143 | SEQ ID NO:13155 | SEQ ID NO:21167 |
| | | AA | NYDIN | WMHPNSGNTGYAKKFQG | SSGWYYFDY |
| | | | SEQ ID NO:5144 | SEQ ID NO:13156 | SEQ ID NO:21168 |
| iPS:424419 | 21-225_25A4.001 | NA | AATTATGATATTAAT | TGGATGTACCCTAACAG TGGTAACAGGCTATG CACAGAAATTCCAGGGC | AGCAGTGGCTGGTACTACTT TGACTAC |
| | | | SEQ ID NO:5145 | SEQ ID NO:13157 | SEQ ID NO:21169 |
| | | AA | NYDIN | WMYPNSGNTGYAQKFQG | SSGWYYFDY |
| | | | SEQ ID NO:5146 | SEQ ID NO:13158 | SEQ ID NO:21170 |
| iPS:424460 | 21-225_7E11.001 | NA | AGCTTTGGCATGCAC | ATTATCTGGCATGATGG AAGTAATAAATACTATG CAGACTCCGTGAAGGGC | GATCTGAGTATGGGCGGTAT GGACGTC |
| | | | SEQ ID NO:5147 | SEQ ID NO:13159 | SEQ ID NO:21171 |
| | | AA | SFGMH | IIWHDGSNKYYADSVKG | DLSMGGMDV |
| | | | SEQ ID NO:5148 | SEQ ID NO:13160 | SEQ ID NO:21172 |

FIGURE 49
(Continued)

| | | | | |
|---|---|---|---|---|
| iPS:426108 | 21-225_10G6 | NA | GCCTACCATATGCAC | TGGATCAACCCTAACAA TAATGGCACAAACTATG CACAGAAGTTTCAGGGC | GATGTTACCAGCTCGTTTGA CTAT |
| | | | SEQ ID NO:5149 | SEQ ID NO:13161 | SEQ ID NO:21173 |
| | | AA | AYHMH | WINPNNGTNYAQKFQG | DVTSSFDY |
| | | | SEQ ID NO:5150 | SEQ ID NO:13162 | SEQ ID NO:21174 |
| iPS:426110 | 21-225_12E9 | NA | GACTACTATTGCAC | TGGGTCCACCCTAACAG TGGTGGCACAAACTTTG CACAGAAGTTTCAGGAC | GATGGTACCAGCTCGTTTGA CTAC |
| | | | SEQ ID NO:5151 | SEQ ID NO:13163 | SEQ ID NO:21175 |
| | | AA | DYYLH | WVHPNSGGTNFAQKFQD | DGTSSFDY |
| | | | SEQ ID NO:5152 | SEQ ID NO:13164 | SEQ ID NO:21176 |
| iPS:426112 | 21-225_12F12 | NA | AATTATGATATCAAC | TGGATGTACCCTAACAG TGGTAACACGGGCTATG CACAGAAGTTCCAGGGC | AGCAGTGGCTGGTACTACTT TGACTTC |
| | | | SEQ ID NO:5153 | SEQ ID NO:13165 | SEQ ID NO:21177 |
| | | AA | NYDIN | WMYPNSGNTGYAQKFQG | SSGWYYFDF |
| | | | SEQ ID NO:5154 | SEQ ID NO:13166 | SEQ ID NO:21178 |
| iPS:426114 | 21-225_28H2 | NA | AACTATGTCATGCAC | GTTATATGGTATGATGG AAGTAATAAGTACTATG CAGACTCCGTGAAGGGC | GAGGAGTATAGCAGTGGCTG GTACGACTACGGTATGGACG TC |
| | | | SEQ ID NO:5155 | SEQ ID NO:13167 | SEQ ID NO:21179 |
| | | AA | NYVMH | VIWYDGSNKYYADSVKG | EEYSSGWYDYGMDV |
| | | | SEQ ID NO:5156 | SEQ ID NO:13168 | SEQ ID NO:21180 |

FIGURE 49
(Continued)

| | | | | | |
|---|---|---|---|---|---|
| iPS:426116 | 21-225_29E2 | NA | AACTGTGTCATGCAC | GTTATATGTGTATGATGG AAGTAATAAATACTATG CAGACTCCGTGAAGGGC | GAGGAGTATAGCAGTGGCTG GTACGACTACGGTATGGACG TC |
| | | AA | SEQ ID NO:5157<br>NCVMH | SEQ ID NO:13169<br>VIWYDGSNKYYADSVKG | SEQ ID NO:21181<br>EEYSSGWYDYGMDV |
| iPS:426118 | 21-225_7A10 | NA | SEQ ID NO:5158<br>AGCTATGGCATGCAC | SEQ ID NO:13170<br>GTTATATGGTATGATGG AAGTAATAAATACTATG CAGACTCCGTGAAGGGC | SEQ ID NO:21182<br>GATGAGAGGCTGGGGATTT TGACTAC |
| | | AA | SEQ ID NO:5159<br>SYGMH | SEQ ID NO:13171<br>VIWYDGSNKYYADSVKG | SEQ ID NO:21183<br>DERLGIFDY |
| iPS:426124 | 21-225_32D6 | NA | SEQ ID NO:5160<br>AGCTATGGCATGCAC | SEQ ID NO:13172<br>GTTATATGGCATGATGG AAGTAATGCATACTATG CAGACTCCGTGAAGGGC | SEQ ID NO:21184<br>GAAAATAGCAGCTCGTACTA CTTTGACTAC |
| | | AA | SEQ ID NO:5161<br>SYGMH | SEQ ID NO:13173<br>VIWHDGSNAYYADSVKG | SEQ ID NO:21185<br>ENSSSYYFDY |
| iPS:426126 | 21-225_6G6 | NA | SEQ ID NO:5162<br>AATTATGATATCAAC | SEQ ID NO:13174<br>TGGATGCACCCTAACAG TGGTAACACAGGCTATG CAAAGAAGTTCCAGGGC | SEQ ID NO:21186<br>AGCAGTGGCTGGTACTACTT TGACTAC |
| | | AA | SEQ ID NO:5163<br>NYDIN | SEQ ID NO:13175<br>WMHPNSGNTGYAKKFQG | SEQ ID NO:21187<br>SSGWYYFDY |

FIGURE 49
(Continued)

| | | | | | | |
|---|---|---|---|---|---|---|
| iPS:433895 | 21-225_43E1 | NA | SEQ ID NO:5164 AGCTATAGCCATGAAC | SEQ ID NO:13176 GCCATTAGTGGTAATAG TACTTACATATACTACGC AGACTCGTTGAAGGGC | SEQ ID NO:21188 GATCGGGGCAGTGAA | |
| | | AA | SEQ ID NO:5165 SYSMN | SEQ ID NO:13177 AISGNSTYIYYADSLKG | SEQ ID NO:21189 DRGSE | |
| iPS:433897 | 21-225_43C2 | NA | SEQ ID NO:5166 AGCTATGCCATGAGC | SEQ ID NO:13178 GCTATTAGTGGTCGTGGT GTTAACACATTCGACGC AGACTCCGTGAAGGGC | SEQ ID NO:21190 GAAAGGAGTGGGAGCTATTT TGACTAC | |
| | | AA | SEQ ID NO:5167 SYAMS | SEQ ID NO:13179 AISGRGVNTFDADSVKG | SEQ ID NO:21191 ERSGSYFDY | |
| iPS:433899 | 21-225_43C3 | NA | SEQ ID NO:5168 AGCTATGGCATACAC | SEQ ID NO:13180 GTTATATGGTATGATGA AATAATAAATACTATG CAGACTCCGTGAAGGGC | SEQ ID NO:21192 GAGCTAGGATTTTCCAATGA CTAC | |
| | | AA | SEQ ID NO:5169 SYGIH | SEQ ID NO:13181 VIWYDENNKYYADSVKG | SEQ ID NO:21193 ELGFSNDY | |
| iPS:433901 | 21-225_43A4 | NA | SEQ ID NO:5170 AGCTATACCATGAAC | SEQ ID NO:13182 TCCATTAGTGGAAGTAG TACTTACATATACTACGC AGACTCAGTGAAGGGC | SEQ ID NO:21194 GTGACCTCTTTTGACTAC | |
| | | AA | SEQ ID NO:5171 SYTMN | SEQ ID NO:13183 SISGSSTYIYYADSVKG | SEQ ID NO:21195 VTSFDY | |
| iPS:433903 | 21 225 43H4 | NA | SEQ ID NO:5172 AGCTATGCCATGAGC | SEQ ID NO:13184 GCTATTAGTGGTCGTGGT ATTAACACATTCGACGC AGACTCCGTGAAGGGC | SEQ ID NO:21196 GAAAGGAGTGGGAGCTATTT TGACTAC | |

FIGURE 49
(Continued)

| | | | | | | |
|---|---|---|---|---|---|---|
| | 21-225_43H4 | AA | SEQ ID NO:5173 SYAMS | SEQ ID NO:13185 AISRGINTFDADSVKG | SEQ ID NO:21197 ERSGSYFDY | |
| iPS:433905 | | NA | SEQ ID NO:5174 GACTACTACATGATC | SEQ ID NO:13186 TACATTAGTAGTAGTGGT ATTACCAAATACTACGC AGACTCTATGAAGGGC | SEQ ID NO:21198 GATACAATCTAC | |
| | 21-225_43E5 | AA | SEQ ID NO:5175 DYYMI | SEQ ID NO:13187 YISSSGITKYYADSMKG | SEQ ID NO:21199 DTIY | |
| iPS:433909 | | NA | SEQ ID NO:5176 AATTATGATATCAAC | SEQ ID NO:13188 TGGATGCACCCTAACAG TGGTAACACAGGCTATG CACAGAAGTTCCAGGGC | SEQ ID NO:21200 AGCAGTGGCTGGACCCTCTT TGACTAC | |
| | 21-225_43D8 | AA | SEQ ID NO:5177 NYDIN | SEQ ID NO:13189 WMHPNSGNTGYAQKFQG | SEQ ID NO:21201 SSGWTLFDY | |
| iPS:433911 | | NA | SEQ ID NO:5178 AGCTATGCCATGAGC | SEQ ID NO:13190 GCTATTAGTGGTCGTGGT ATTAACACATTCGACGC AGACTCCGTGAAGGGC | SEQ ID NO:21202 GAAAGGAGTGGGAGCTATTT TGACTAC | |
| | 21-225_43E8 | AA | SEQ ID NO:5179 SYAMS | SEQ ID NO:13191 AISRGINTFDADSVKG | SEQ ID NO:21203 ERSGSYFDY | |
| iPS:433913 | | NA | SEQ ID NO:5180 GACTACTACATGAAC | SEQ ID NO:13192 TACATTAGTAGTAGTGGT AGAACCATATTCTACGC AGACTCTTTGAAGGGC | SEQ ID NO:21204 GATACAATCTAC | |
| | 21-225_43H8 | AA | SEQ ID NO:5181 DYYMN | SEQ ID NO:13193 YISSSGRTIFYADSLKG | SEQ ID NO:21205 DTIY | |
| | | | SEQ ID NO:5182 | SEQ ID NO:13194 | SEQ ID NO:21206 | |

FIGURE 49
(Continued)

| | | | | |
|---|---|---|---|---|
| iPS:433915 | 21-225_43H9 | NA | AGCTATGCCATGAGT | GCTATTAGTGGTAGTGGT AGTAACACATTCTACGC AGACTCCGTGAAGGGC | CGAACGCCCTCTGATGTTTT GATATC |
| | | | SEQ ID NO:5183 | SEQ ID NO:13195 | SEQ ID NO:21207 |
| | | AA | SYAMS | AISGSGSNTFYADSVKG | RTPSDVFDI |
| | | | SEQ ID NO:5184 | SEQ ID NO:13196 | SEQ ID NO:21208 |
| iPS:433917 | 21-225_43E11 | NA | GACTATGGCATGCAC | GTTATATGGTATGATGG AAGTAATAAATACTATG CAGACTCCGTGAAGGGC | CGGTATGTCAGAAGCTGGGT GGGAGGTATGGACGTC |
| | | | SEQ ID NO:5185 | SEQ ID NO:13197 | SEQ ID NO:21209 |
| | | AA | DYGMH | VIWYDGSNKYYADSVKG | RYVRSWVGGMDV |
| | | | SEQ ID NO:5186 | SEQ ID NO:13198 | SEQ ID NO:21210 |
| iPS:433919 | 21-225_44B3 | NA | GACTATGGCATGCAC | GTTATATGGTATGATGG AAGTAATAAATACTATG CAGACTCCGTGAAGGGC | GAGAGGTATAGCAGTGGCTG GTACGACTACGGTATGGACG TC |
| | | | SEQ ID NO:5187 | SEQ ID NO:13199 | SEQ ID NO:21211 |
| | | AA | DYGMH | VIWYDGSNKYYADSVKG | ERYSSGWYDYGMDV |
| | | | SEQ ID NO:5188 | SEQ ID NO:13200 | SEQ ID NO:21212 |
| iPS:433921 | 21-225_44C3 | NA | AGCTATGGCATGCAC | GTTATATGGTTTGAAGG AAGTAATAAATACTATG CAGATTCCGTGAAGGGC | GAACTAGGATTTTCCACCGA CTAC |
| | | | SEQ ID NO:5189 | SEQ ID NO:13201 | SEQ ID NO:21213 |
| | | AA | SYGMH | VIWFEGSNKYYADSVKG | ELGFSTDY |
| | | | SEQ ID NO:5190 | SEQ ID NO:13202 | SEQ ID NO:21214 |

FIGURE 49
(Continued)

| | | | | | |
|---|---|---|---|---|---|
| iPS:433923 | 21-225_44D3 | NA | AGCTATGTCATGCAC | GTTATATGTGTATGATGG AAGTAATAAATACTATG CTGACTCCGTGAAGGGC | GAAAGGTATAGCAGTGGCTT GTACGACTACGGTATGGACG TC |
| | | | SEQ ID NO:5191 | SEQ ID NO:13203 | SEQ ID NO:21215 |
| | | AA | SYVMH | VIWYDGSNKYYADSVKG | ERYSSGLYDYGMDV |
| | | | SEQ ID NO:5192 | SEQ ID NO:13204 | SEQ ID NO:21216 |
| iPS:433925 | 21-225_44F3 | NA | AGCTATGCCATGAGC | ATTCTCAGTGGTGGTGGT AAGACCACATACTACGC AGACTCCGTGAAGGGC | CGAACGCCCTCTGATGCTTT TGATATC |
| | | | SEQ ID NO:5193 | SEQ ID NO:13205 | SEQ ID NO:21217 |
| | | AA | SYAMS | ILSGGGKTTYYADSVKG | RTPSDAFDI |
| | | | SEQ ID NO:5194 | SEQ ID NO:13206 | SEQ ID NO:21218 |
| iPS:433929 | 21-225_44D5 | NA | AGCTATGTCATGCAC | GTTATATGTGTATGATGG AAGTAATAAATACTATG CAGACTCCGTGAAGGGC | GTCCCGTATAGCAGCAGCTG GTACGACTACGGTATGGACG TC |
| | | | SEQ ID NO:5195 | SEQ ID NO:13207 | SEQ ID NO:21219 |
| | | AA | SYVMH | VIWYDGSNKYYADSVKG | VPYSSSWYDYGMDV |
| | | | SEQ ID NO:5196 | SEQ ID NO:13208 | SEQ ID NO:21220 |
| iPS:433931 | 21-225_44F6 | NA | AGTTACTACTGGAGC | TATATCTATTACAGTGGA AACACCAACTACAACCC CTCCCTCAAGAGT | GGGGTGGCTATAAAGAACTA C |
| | | | SEQ ID NO:5197 | SEQ ID NO:13209 | SEQ ID NO:21221 |
| | | AA | SYYWS | YIYYSGNTNYNPSLKS | GVAIKNY |
| | | | SEQ ID NO:5198 | SEQ ID NO:13210 | SEQ ID NO:21222 |

FIGURE 49
(Continued)

| | | | | |
|---|---|---|---|---|
| iPS:433933 | 21-225_44C8 | NA | AACTATGGCATGCAC | GTTATATGGTATGAAGG AAGTAATAAATACTATG CAGACTCCGTGAAGGGC | GAACTGGGGTTCTCTCTGA CTAC |
| | | | SEQ ID NO:5199 | SEQ ID NO:13211 | SEQ ID NO:21223 |
| | | AA | NYGMH | VIWYEGSNKYYADSVKG | ELGFLSDY |
| | | | SEQ ID NO:5200 | SEQ ID NO:13212 | SEQ ID NO:21224 |
| iPS:433935 | 21-225_44F9 | NA | AGCTATGTCATGCAC | GTTATATGGTATGATGG AAGTAATAAATACTATG CAGACTCCGTGAAGGGC | GAACCATATAGCAGCAGCTG GTACGACTACGGTATGGACG TC |
| | | | SEQ ID NO:5201 | SEQ ID NO:13213 | SEQ ID NO:21225 |
| | | AA | SYVMH | VIWYDGSNKYYADSVKG | EPYSSSWYDYGMDV |
| | | | SEQ ID NO:5202 | SEQ ID NO:13214 | SEQ ID NO:21226 |
| iPS:433937 | 21-225_44B10 | NA | AGCTATGGCATGCAC | GTTATATGGTATGATGATGG AAGTAATAAATACTATG CAGACTCCGTGAAGGGC | CGGTATAGCAGCAGCTGGGT GGGGGTATGGACGTC |
| | | | SEQ ID NO:5203 | SEQ ID NO:13215 | SEQ ID NO:21227 |
| | | AA | SYGMH | VIWYDGSNKYYADSVKG | RYSSSWVGGMDV |
| | | | SEQ ID NO:5204 | SEQ ID NO:13216 | SEQ ID NO:21228 |
| iPS:433939 | 21-225_44C10 | NA | GACTGTGTCATGCAC | GTTATATGGTATGATGG AAGTAATAAATACTATG CTGACTCCGTGAAGGGC | GAAAGGTATAGCAGTGGCTT GTACGACTACGGTATGGACG TC |
| | | | SEQ ID NO:5205 | SEQ ID NO:13217 | SEQ ID NO:21229 |

FIGURE 49
(Continued)

| | | | | VIWYDGSNKYYADSVKG | ERYSSGLYDYGMDV |
|---|---|---|---|---|---|
| iPS:433941 | 21-225_44D10 | AA | DCVMH | | |
| | | | SEQ ID NO:5206 | SEQ ID NO:13218 | SEQ ID NO:21230 |
| | | NA | AGCTATGCCATGAGC | GCTATTAGTGGTCGTGGT GTTAACACATTCGACGC AGACTCCGTGAAGGGC | GAAAGGAGTGGGAGCTATTT TGACTAC |
| | | | SEQ ID NO:5207 | SEQ ID NO:13219 | SEQ ID NO:21231 |
| | | AA | SYAMS | AISGRGVNTFDADSVKG | ERSGSYFDY |
| | | | SEQ ID NO:5208 | SEQ ID NO:13220 | SEQ ID NO:21232 |
| iPS:433943 | 21-225_44E10 | NA | AGCTATGCCATGAAC | GGTGTTGTTGGTAGTGGT GGTAGAACATACTACGC AGACTCCGTGAAGGGC | GATCGGGGCAGTGGCTCCT AGGCGGTATGACGTC |
| | | | SEQ ID NO:5209 | SEQ ID NO:13221 | SEQ ID NO:21233 |
| | | AA | SYAMN | GVVGSGGRTYYADSVKG | DRGQWLLGGMDV |
| | | | SEQ ID NO:5210 | SEQ ID NO:13222 | SEQ ID NO:21234 |
| iPS:433945 | 21-225_44C12 | NA | AGCTATAGCGTGAAC | TACATTAGTAGTAGTAGT AGTACCATATACTACGC AGACTCTGTGAAGGGC | AGTGGATACAGCTATGCTTA CTACTACTACGGTATGG ACGTC |
| | | | SEQ ID NO:5211 | SEQ ID NO:13223 | SEQ ID NO:21235 |
| | | AA | SYSVN | YISSSSSTIYYADSVKG | SGYSYAYYYYYGMDV |
| | | | SEQ ID NO:5212 | SEQ ID NO:13224 | SEQ ID NO:21236 |
| iPS:433947 | 21-225_44E12 | NA | AGCGATGACACGCAC | GTTATATGGTTTGATGAA TATAATAAATACTATGC AGACTCCGTGAAGGGC | GATCTAATAGCAGCAGCTGG GACGGGAGACTAC |
| | | | SEQ ID NO:5213 | SEQ ID NO:13225 | SEQ ID NO:21237 |
| | | AA | SDDTH | VIWFDEYNKYYADSVKG | DLIAAAGTGDY |
| | | | SEQ ID NO:5214 | SEQ ID NO:13226 | SEQ ID NO:21238 |

FIGURE 49
(Continued)

| | | | | | |
|---|---|---|---|---|---|
| iPS:433949 | 21-225_45H2 | NA | GACTACTACATGAAC | TACATTAGTAGTAGTGGT ATTACCAAATACTACGC AGACTCTGTGAAGGGC | GATACAATCTAC |
| | | | SEQ ID NO:5215 | SEQ ID NO:13227 | SEQ ID NO:21239 |
| | | AA | DYYMN | YISSSGITKYYADSVKG | DTIY |
| | | | SEQ ID NO:5216 | SEQ ID NO:13228 | SEQ ID NO:21240 |
| iPS:433951 | 21-225_45B4 | NA | GACTGTGTCATGCAC | GTTATATGGTATGATGG AAGTAATAAATACTATG CTGACTCCGTGAAGGGC | GAAAGGTATAGCAGTGGCTT GTACGACTACGGGTATGGACG TC |
| | | | SEQ ID NO:5217 | SEQ ID NO:13229 | SEQ ID NO:21241 |
| | | AA | DCVMH | VIWYDGSNKYYADSVKG | ERYSSGLYDYGMDV |
| | | | SEQ ID NO:5218 | SEQ ID NO:13230 | SEQ ID NO:21242 |
| iPS:433953 | 21-225_45H4 | NA | AGCTATGCCATGAGT | GCTATTAGTGGTAGTGGT AGTAACACATTCTACGC AGACTCCGTGAAGGGC | CGAACGCCCTCTGATGTTTTT GATATC |
| | | | SEQ ID NO:5219 | SEQ ID NO:13231 | SEQ ID NO:21243 |
| | | AA | SYAMS | AISGSGSNTFYADSVKG | RTPSDVFDI |
| | | | SEQ ID NO:5220 | SEQ ID NO:13232 | SEQ ID NO:21244 |
| iPS:433955 | 21-225_45B8 | NA | GACTGTGTCATGCAC | GTTATATGGTATGATGG AAGTAATAAATACTATG CTGACTCCGTGAAGGGC | GAAAGGTATAGCAGTGGCTT GTACGACTACGGGTATGGACG TC |
| | | | SEQ ID NO:5221 | SEQ ID NO:13233 | SEQ ID NO:21245 |
| | | AA | DCVMH | VIWYDGSNKYYADSVKG | ERYSSGLYDYGMDV |
| | | | SEQ ID NO:5222 | SEQ ID NO:13234 | SEQ ID NO:21246 |

FIGURE 49
(Continued)

| | | | | | |
|---|---|---|---|---|---|
| iPS:433957 | 21-225_45F8 | NA | AGCTATGCCATGAGC | GCTATTAGTGGTGTCGTGGT GTTAACACATTGGACGC AGACTCCGTGAAGGGC | GAAAGGAGTGGGAGCTATTT TGACTAC |
| | | AA | SEQ ID NO:5223 SYAMS | SEQ ID NO:13235 AISGRGVNTFDADSVKG | SEQ ID NO:21247 ERSGSYFDY |
| iPS:433959 | 21-225_45C9 | NA | SEQ ID NO:5224 AGCTATGCCATGAGC | SEQ ID NO:13236 GTTATTAGTGGTGTCGTGGT GGTACCACATACTACGC AGACTCCGTGAAGGGC | SEQ ID NO:21248 CGAACGCCCTCTGATGCTTT TGATATC |
| | | AA | SEQ ID NO:5225 SYAMS | SEQ ID NO:13237 VISGRGGTTYYADSVKG | SEQ ID NO:21249 RTPSDAFDI |
| iPS:433961 | 21-225_45D9 | NA | SEQ ID NO:5226 AGCTATACCATGAAC | SEQ ID NO:13238 TCCATTAGTGGAAGTAG TACTTACATATACGC AGACTCAGTGAAGGGC | SEQ ID NO:21250 GTGACCTCTTTTGACTAC |
| | | AA | SEQ ID NO:5227 SYTMN | SEQ ID NO:13239 SISGSSTYIYYADSVKG | SEQ ID NO:21251 VTSFDY |
| iPS:433963 | 21-225_46B1 | NA | SEQ ID NO:5228 AGCGATGACTCGCAC | SEQ ID NO:13240 GTTATATGGTTTGATGAA TATACTAAATACTATGCA GACTCCGTGAAGGGC | SEQ ID NO:21252 GATCTAATAGCAGCAACTGG GACGGGAGACTAC |
| | | AA | SEQ ID NO:5229 SDDSH | SEQ ID NO:13241 VIWFDEYTKYYADSVKG | SEQ ID NO:21253 DLIAATGTGDY |
| iPS:433965 | 21-225_46F2 | NA | SEQ ID NO:5230 AGCTATGGCATGCAC | SEQ ID NO:13242 ATTATATGGTATGATGG AAGTAATAAATACTATG TAGACTCCGTGAAGGGC | SEQ ID NO:21254 GATCGATACGATTTTGGAG TGGTTACTTTGACTAC |
| | | AA | SEQ ID NO:5231 SYGMH | SEQ ID NO:13243 IIWYDGSNKYYVDSVKG | SEQ ID NO:21255 DRYDFWSGYFDY |

FIGURE 49
(Continued)

| | | | SEQ ID NO:5232 AGCTATGTCATGCAC | SEQ ID NO:13244 GTTATATGGTATGATGG AAGTAATAAATACTATG CTGACTCCGTGAAGGGC | SEQ ID NO:21256 GAAAGGTATAGCAGTGGCTT GTACGACTACGGTATGGACG TC |
|---|---|---|---|---|---|
| iPS:433967 | 21-225_46C3 | NA | | | |
| | | AA | SEQ ID NO:5233 SYVMH | SEQ ID NO:13245 VIWYDGSNKYYADSVKG | SEQ ID NO:21257 ERYSSGLYDYGMDV |
| iPS:433969 | 21-225_46F3 | NA | SEQ ID NO:5234 GATTATGGCATGCAC | SEQ ID NO:13246 GTTATATGGTTTGAAGG AAGTAATAAATACTATG CAGATTCCGTGAAGGGC | SEQ ID NO:21258 GAACTAGGATTTTCCAATGA CTAC |
| | | AA | SEQ ID NO:5235 DYGMH | SEQ ID NO:13247 VIWFEGSNKYYADSVKG | SEQ ID NO:21259 ELGFSNDY |
| iPS:433971 | 21-225_46D4 | NA | SEQ ID NO:5236 AGCTATGTCATGCAC | SEQ ID NO:13248 GTTATATGGTATGATGG AAGTAATAAATACTATG CAGACTCCGTGAAGGGC | SEQ ID NO:21260 GTCCCGTATAGCAGCAGTTG GTACGACTACGGTATGGACG TC |
| | | AA | SEQ ID NO:5237 SYVMH | SEQ ID NO:13249 VIWYDGSNKYYADSVKG | SEQ ID NO:21261 VPYSSSWYDYGMDV |
| iPS:433973 | 21-225_46A6 | NA | SEQ ID NO:5238 AGCTATGCCATGAGC | SEQ ID NO:13250 GCTATTAGTGGTCGTGGT ATTAACACATTCGACGC AGACTCCGTGAAGGGC | SEQ ID NO:21262 GAAAGGAGTGGGAGCTATTT TGACTAC |
| | | AA | SEQ ID NO:5239 SYAMS | SEQ ID NO:13251 AISGRGINTFDADSVKG | SEQ ID NO:21263 ERSGSYFDY |
| | | | SEQ ID NO:5240 | SEQ ID NO:13252 | SEQ ID NO:21264 |

FIGURE 49
(Continued)

| | | | | |
|---|---|---|---|---|
| iPS:433975 | 21-225_46C6 | NA | AGCTATGGCATACAC | GTTATATGGTATGATGA AATAATAAATACTATG CAGACTCCGTGAAGGGC | GAGCTAGGATTTTCCAATGA CTAC |
| | | | SEQ ID NO:5241 | SEQ ID NO:13253 | SEQ ID NO:21265 |
| | | AA | SYGIH | VIWYDENNKYYADSVKG | ELGFSNDY |
| | | | SEQ ID NO:5242 | SEQ ID NO:13254 | SEQ ID NO:21266 |
| iPS:433977 | 21-225_46D8 | NA | GATTATGGCATACAC | GTTATATGGTTGAAGG AAGTAATAAATACTATG CAGATTCCGTGAAGGGC | GAACTAGGATTTTCCAATGA CTAC |
| | | | SEQ ID NO:5243 | SEQ ID NO:13255 | SEQ ID NO:21267 |
| | | AA | DYGIH | VIWFEGSNKYYADSVKG | ELGFSNDY |
| | | | SEQ ID NO:5244 | SEQ ID NO:13256 | SEQ ID NO:21268 |
| iPS:433979 | 21-225_46B9 | NA | AGCTATGGCATGCAC | GTTATATGGTATGATGG AAGAAATAAATACTATG CAGACTCCGTGAAGGGC | CGGTATAGCAGCAGCTGGAT GGGAGGTATGGACGTC |
| | | | SEQ ID NO:5245 | SEQ ID NO:13257 | SEQ ID NO:21269 |
| | | AA | SYGMH | VIWYDGRNKYYADSVKG | RYSSSWMGGMDV |
| | | | SEQ ID NO:5246 | SEQ ID NO:13258 | SEQ ID NO:21270 |
| iPS:433981 | 21-225_46E9 | NA | GACTACTACATGAAC | TACATTAATAGTAATGGT TTACCATATACGCA GACTCTGTGAAGGC | GATACAATCTAC |
| | | | SEQ ID NO:5247 | SEQ ID NO:13259 | SEQ ID NO:21271 |
| | | AA | DYYMN | YINSNGFTIYYADSVKG | DTIY |
| | | | SEQ ID NO:5248 | SEQ ID NO:13260 | SEQ ID NO:21272 |

FIGURE 49
(Continued)

| | | | | | |
|---|---|---|---|---|---|
| iPS:433983 | 21-225_47A1 | NA | GACTATGGCATGCAC | GTTATATGGTATGATGAC TATAATAAAAGTATGC AGACTCCGTGAAGGGC | GAACTGGGGATGCTCTTTGA CTAC |
| | | | SEQ ID NO:5249 | SEQ ID NO:13261 | SEQ ID NO:21273 |
| | | AA | DYGMH | VIWYDDYNKKYADSVKG | ELGMLFDY |
| | | | SEQ ID NO:5250 | SEQ ID NO:13262 | SEQ ID NO:21274 |
| iPS:433985 | 21-225_47C1 | NA | GACTATGGCATGCAC | GTTATATGGTATGATGG AAGTAATAAATACTATG CAGACTCCGTGAAGGGC | CGGTATAGCCGCAGCTGGGT GGGAGGTATGGACGTC |
| | | | SEQ ID NO:5251 | SEQ ID NO:13263 | SEQ ID NO:21275 |
| | | AA | DYGMH | VIWYDGSNKYYADSVKG | RYSRSWVGGMDV |
| | | | SEQ ID NO:5252 | SEQ ID NO:13264 | SEQ ID NO:21276 |
| iPS:433987 | 21-225_47A5 | NA | GACGATGACACACAC | GTTATATGGTTTGATGGA AGTAATAAATACTATGC AGACTCCGTGAAGGGC | GATCTTATAGCAGCAGCTGG TACAGTTGACTAC |
| | | | SEQ ID NO:5253 | SEQ ID NO:13265 | SEQ ID NO:21277 |
| | | AA | DDDTH | VIWFDGSNKYYADSVKG | DLIAAAGTVDY |
| | | | SEQ ID NO:5254 | SEQ ID NO:13266 | SEQ ID NO:21278 |
| iPS:433989 | 21-225_47C7 | NA | AACTATGCCATGAGC | GGTATTAGTGGTAGTGG TAGTGCACATACTACG CAGACTCCGTGAAGGGC | GATCGGGGCAGTGGCTCAT AGGCGGTATGGACGTC |
| | | | SEQ ID NO:5255 | SEQ ID NO:13267 | SEQ ID NO:21279 |
| | | AA | NYAMS | GISGSGSRTYYADSVKG | DRGQWLIGGMDV |
| | | | SEQ ID NO:5256 | SEQ ID NO:13268 | SEQ ID NO:21280 |

FIGURE 49
(Continued)

| | | | | | |
|---|---|---|---|---|---|
| iPS:433991 | 21-225_47E7 | NA | ATCTATGGCATGCAC | GTTATATGGTATGATGGAAGTAATAAATACTATGCAGACTCCGTGAAGGGC | CGGTATAGCAGAAGCTGGGTGGGAGGTATGGACGTC |
| | | | SEQ ID NO:5257 | SEQ ID NO:13269 | SEQ ID NO:21281 |
| | | AA | IYGMH | VIWYDGSNKYYADSVKG | RYSRSWVGGMDV |
| | | | SEQ ID NO:5258 | SEQ ID NO:13270 | SEQ ID NO:21282 |
| iPS:433993 | 21-225_47G7 | NA | AGCTATGCCATGAGT | GCTATTAGTGGTCGTGGTGGTAACACATTCTACGCAGAGTCCGTGAGGGGC | ATTATCCGGGAGCAGTGGGCCTTTGACTAC |
| | | | SEQ ID NO:5259 | SEQ ID NO:13271 | SEQ ID NO:21283 |
| | | AA | SYAMS | AISGRGGNTFYAESVRG | IIREQWAFDY |
| | | | SEQ ID NO:5260 | SEQ ID NO:13272 | SEQ ID NO:21284 |
| iPS:433995 | 21-225_47H7 | NA | GACTACTACATGATC | TACATTAATAGTAATGGTTTTACCAAATACTACGCAGACTCTGTGAAGGGC | GATACAGTCTAC |
| | | | SEQ ID NO:5261 | SEQ ID NO:13273 | SEQ ID NO:21285 |
| | | AA | DYYMI | YINSNGFTKYYADSVKG | DTVY |
| | | | SEQ ID NO:5262 | SEQ ID NO:13274 | SEQ ID NO:21286 |
| iPS:433997 | 21-225_48C1 | NA | AGCTATGGCATGCAC | GTTGTATGGTATGATGAAATTAATAAAAGTATGCAGACTCCGTGAAGGGC | GAATTAGGGGTGGGAGGCTGACTAC |
| | | | SEQ ID NO:5263 | SEQ ID NO:13275 | SEQ ID NO:21287 |
| | | AA | SYGMH | VVWYDEINKKYADSVKG | ELGWEADY |
| | | | SEQ ID NO:5264 | SEQ ID NO:13276 | SEQ ID NO:21288 |

FIGURE 49
(Continued)

| iPS:433999 | 21-225_48D1 | NA | AGTTATGCCATGAGC | GTTATTAGTGGTCGTGTGGT GGTAGCACATTCTACGC AGACTCCGTGAAGGGC | CGTATAGCAGTGGCTGGGAA TGAGGCTTTTGATATC |
|---|---|---|---|---|---|
| | | | SEQ ID NO:5265 | SEQ ID NO:13277 | SEQ ID NO:21289 |
| | | AA | SYAMS | VISGRGGSTFYADSVKG | RIAVAGNEAFDI |
| | | | SEQ ID NO:5266 | SEQ ID NO:13278 | SEQ ID NO:21290 |
| iPS:434001 | 21-225_48F2 | NA | AACTATGTCATGCAC | GTTATATGGTATGATGG AAGTAATAAATACTATG CAGACTCCGTGAAGGGC | GAGAGGTATAGCAGCAGCTG GTACGACTACGGTCTGACG TC |
| | | | SEQ ID NO:5267 | SEQ ID NO:13279 | SEQ ID NO:21291 |
| | | AA | NYVMH | VIWYDGSNKYYADSVKG | ERYSSSWYDYGLDV |
| | | | SEQ ID NO:5268 | SEQ ID NO:13280 | SEQ ID NO:21292 |
| iPS:434003 | 21-225_48C3 | NA | AGTTATGCCATGAGC | GTTATTAGTGGTCGTGTGGT GGTAGCACATTCTACGC AGACTCCGTGAAGGGC | CGTATAGCAGTGGCTGGGAA TGAGGCTTTTGATATC |
| | | | SEQ ID NO:5269 | SEQ ID NO:13281 | SEQ ID NO:21293 |
| | | AA | SYAMS | VISGRGGSTFYADSVKG | RIAVAGNEAFDI |
| | | | SEQ ID NO:5270 | SEQ ID NO:13282 | SEQ ID NO:21294 |
| iPS:434007 | 21-225_48D7 | NA | AACTCTGCCATGAAC | GCTATTAGTGGTAGTGGT GGTACCACATTCTACGC AGACTCCGTGAAGGGC | TGTGGGCGGGAGCAGTGGCT TGACTAC |
| | | | SEQ ID NO:5271 | SEQ ID NO:13283 | SEQ ID NO:21295 |
| | | AA | NSAMN | AISGSGGTTFYADSVKG | CGREQWLDY |
| | | | SEQ ID NO:5272 | SEQ ID NO:13284 | SEQ ID NO:21296 |
| iPS:434009 | 21_225_48A9 | NA | AGTTATGGCATGCAC | GTTATATGGTATGAGGA AAATAAGAAATACTATG CAGACTCCGTGAAGGGC | GAACTTGCCTGGTACGAGGA CTAC |

FIGURE 49
(Continued)

| | | | | SEQ ID NO:5273 | | SEQ ID NO:13285 | | SEQ ID NO:21297 |
|---|---|---|---|---|---|---|---|---|
| iPS:434011 | 21-225_48A9 | | AA | SYGMH | | VIWYEENKKYYADSVKG | | ELAWYEDY |
| | | | | SEQ ID NO:5274 | | SEQ ID NO:13286 | | SEQ ID NO:21298 |
| | | | NA | GACTACTTCATGACC | | TACATTAGTAGTGCTGGT GGTGCCATATACTACGC AGACTCTGTGAAGGGC | | GCAGTGGCTGCCCCTGGTGT TTTTGATATC |
| iPS:434013 | 21-225_48B10 | | | SEQ ID NO:5275 | | SEQ ID NO:13287 | | SEQ ID NO:21299 |
| | | | AA | DYFMT | | YISSAGGAIYYADSVKG | | AVAAPGVFDI |
| | | | | SEQ ID NO:5276 | | SEQ ID NO:13288 | | SEQ ID NO:21300 |
| | | | NA | GACTATGGCATGCAC | | GTTATATGGTATGATGTA AGTAATAAATACTATGT AGACTCCGTGAAGGGC | | GAACTGGGGATGAGATCTGA CTAC |
| iPS:434015 | 21-225_48D12 | | | SEQ ID NO:5277 | | SEQ ID NO:13289 | | SEQ ID NO:21301 |
| | | | AA | DYGMH | | VIWYDVSNKYYVDSVKG | | ELGMRSDY |
| | | | | SEQ ID NO:5278 | | SEQ ID NO:13290 | | SEQ ID NO:21302 |
| | | | NA | GACTACTTCATGACC | | TACATTAGTAGTGCTGGT GGTGCCATATACTACGC AGACTCTGTGAAGGGC | | GCAGTGGCTGCCCCTGGTGC TTTTGATATC |
| iPS:434015 | 21-225_48F12 | | | SEQ ID NO:5279 | | SEQ ID NO:13291 | | SEQ ID NO:21303 |
| | | | AA | DYFMT | | YISSAGGAIYYADSVKG | | AVAAPGAFDI |
| | | | | SEQ ID NO:5280 | | SEQ ID NO:13292 | | SEQ ID NO:21304 |
| | | | NA | GACTACTTCATGACC | | TACATTAGTAGTGCTGGT GGTGCCATATACTACGC AGACTCTGTGAAGGGC | | GCAGTGGCTGCCCCTGGTGC TTTTGATATC |
| iPS:434017 | 21-225_48G12 | | | SEQ ID NO:5281 | | SEQ ID NO:13293 | | SEQ ID NO:21305 |
| | | | AA | DYFMT | | YISSAGGAIYYADSVKG | | AVAAPGAFDI |
| | | | | SEQ ID NO:5282 | | SEQ ID NO:13294 | | SEQ ID NO:21306 |

FIGURE 49
(Continued)

| | | | | | |
|---|---|---|---|---|---|
| iPS:434019 | 21-225_49A1 | NA | GACTATGGCATGCAC | GTTATATGGTATGATGA AGATAATAAATATTATG TAGACTCCGTGAAGGGC | GAACTGGGGTTCCTCTCTGA CTAC |
| | | | SEQ ID NO:5283 | SEQ ID NO:13295 | SEQ ID NO:21307 |
| | | AA | DYGMH | VIWYDEDNKYYVDSVKG | ELGFLSDY |
| | | | SEQ ID NO:5284 | SEQ ID NO:13296 | SEQ ID NO:21308 |
| iPS:434021 | 21-225_49C1 | NA | AGCTATGGCATGCAC | GTTATATGGTATGATGG AAGTAATAAATACTATG CAGACTCCGTGAAGGGC | AGGTATAGCAGCAGCTGGTC GGGCGGTATGGACGTC |
| | | | SEQ ID NO:5285 | SEQ ID NO:13297 | SEQ ID NO:21309 |
| | | AA | SYGMH | VIWYDGSNKYYADSVKG | RYSSSWSGGMDV |
| | | | SEQ ID NO:5286 | SEQ ID NO:13298 | SEQ ID NO:21310 |
| iPS:434023 | 21-225_49F1 | NA | AGCTATGCCATGAGC | GTTATTAGTGGTAGTGGT GGTAGCACATTCTACGC AGACTCCGTGAAGGGC | GCTATAGCAGCGGCTGGTGC CCACTATTTTGACTAC |
| | | | SEQ ID NO:5287 | SEQ ID NO:13299 | SEQ ID NO:21311 |
| | | AA | SYAMS | VISGSGGSTFYADSVKG | AIAAAGAHYFDY |
| | | | SEQ ID NO:5288 | SEQ ID NO:13300 | SEQ ID NO:21312 |
| iPS:434025 | 21-225_49G3 | NA | AGTTATGGCATGCAC | GTTATATGGTATGATGG AAGTAATAAATACTATG CAGACTCCGTGAAGGGC | AGGTATAGCAGCAGCTGGTC GGGCGGAATGGACGTC |
| | | | SEQ ID NO:5289 | SEQ ID NO:13301 | SEQ ID NO:21313 |
| | | AA | SYGMH | VIWYDGSNKYYADSVKG | RYSSSWSGGMDV |
| | | | SEQ ID NO:5290 | SEQ ID NO:13302 | SEQ ID NO:21314 |

FIGURE 49
(Continued)

| | | | | | |
|---|---|---|---|---|---|
| iPS:434027 | 21-225_49H5 | NA | AGCTATGCCATGACC | | GCTATTAGTAGTGGTAGTGGT GGTAACTCATTCTACGCA GACTCCGTGAAGGGC | GCAAGGGCAGTGGCTGGGTC ACACTGGTTCGACCCC |
| | | | SEQ ID NO:5291 | SEQ ID NO:13303 | SEQ ID NO:21315 |
| | | AA | SYAMT | AISGSGGNSFYADSVKG | ARAVAGSHWFDP |
| | | | SEQ ID NO:5292 | SEQ ID NO:13304 | SEQ ID NO:21316 |
| iPS:434029 | 21-225_49C6 | NA | AACTATGGCATGCAC | GTTATATGGTTTGATGTA AGTAATAAAAGTATGT AGACTCCGTGAAGGGC | GATCTGGGGATGATCGAGGA CTAC |
| | | | SEQ ID NO:5293 | SEQ ID NO:13305 | SEQ ID NO:21317 |
| | | AA | NYGMH | VIWFDVSNKYVDSVKG | DLGMIEDY |
| | | | SEQ ID NO:5294 | SEQ ID NO:13306 | SEQ ID NO:21318 |
| iPS:434031 | 21-225_49E7 | NA | AGCTATGGCATGCAC | GTTATATGGTATGATGG AAGTAATAAATACTATG CAGACTCCGTGAAGGGC | AGGTATAGCAGCAGCTGGTC GGGCGGTATGGACGTC |
| | | | SEQ ID NO:5295 | SEQ ID NO:13307 | SEQ ID NO:21319 |
| | | AA | SYGMH | VIWYDGSNKYYADSVKG | RYSSSWSGGMDV |
| | | | SEQ ID NO:5296 | SEQ ID NO:13308 | SEQ ID NO:21320 |
| iPS:434033 | 21-225_49F9 | NA | AGTTATGGCATGCAC | CTTATATGGTATGATGGA AGGAATAAATACTATGC AGACTCCGTGAAGGGC | AGGTATAGCAGCAGCTGGTC GGGCGGTATGGACGTC |
| | | | SEQ ID NO:5297 | SEQ ID NO:13309 | SEQ ID NO:21321 |
| | | AA | SYGMH | LIWYDGRNKYYADSVKG | RYSSSWSGGMDV |
| | | | SEQ ID NO:5298 | SEQ ID NO:13310 | SEQ ID NO:21322 |

FIGURE 49
(Continued)

| iPS: | | NA | GGCTACCATATGCAC | TGGATCAACCCTAATAA CAATGCCACAAACTATG CTCAGAACTTTCAGGGC | GACGGTACCAGCAGCTTTGA CTTC |
|---|---|---|---|---|---|
| iPS:434035 | 21-225_49F10 | | SEQ ID NO:5299 | SEQ ID NO:13311 | SEQ ID NO:21323 |
| | | AA | GYHMH | WINPNNATNYAQNFQG | DGTSSFDF |
| | | | SEQ ID NO:5300 | SEQ ID NO:13312 | SEQ ID NO:21324 |
| iPS:434037 | 21-225_49G12 | NA | AGCTATGCCATGAGC | GTTATTAGTGGTAGTGGT GGTACCACATTCTACGC AGACTCCGTGAAGGGC | CGTATAGCAGTGGCTGGGAA TGATGCTTTTGATATC |
| | | | SEQ ID NO:5301 | SEQ ID NO:13313 | SEQ ID NO:21325 |
| | | AA | SYAMS | VISGSGGTTFYADSVKG | RIAVAGNDAFDI |
| | | | SEQ ID NO:5302 | SEQ ID NO:13314 | SEQ ID NO:21326 |
| iPS:434039 | 21-225_43B1 | NA | GACTACTACATGAAC | TACATTAATAGTAATGGT TTTACCATATACTACGCA GACTCTGTGAAGGGC | GATACAATCTAC |
| | | | SEQ ID NO:5303 | SEQ ID NO:13315 | SEQ ID NO:21327 |
| | | AA | DYYMN | YINSNGFTIYYADSVKG | DTIY |
| | | | SEQ ID NO:5304 | SEQ ID NO:13316 | SEQ ID NO:21328 |
| iPS:434041 | 21-225_50H8 | NA | AGTTATGCCATGAGC | GTTATTAGTGGTCGTGGT GGTACCACATTCTACGC AGACTCCGTGAAGGGC | CGTATAGCAGTGGCTGGGAA TGAGGCTTTTGATATC |
| | | | SEQ ID NO:5305 | SEQ ID NO:13317 | SEQ ID NO:21329 |
| | | AA | SYAMS | VISGRGGTTFYADSVKG | RIAVAGNEAFDI |
| | | | SEQ ID NO:5306 | SEQ ID NO:13318 | SEQ ID NO:21330 |
| iPS:434043 | 21-225_50G10 | NA | AGCTATAGCATGAAC | TCCATTAGTGGTAGTAGT AGTTACATATACTACGC AGACTCAGTGAAGGGC | GTAGCAACTTTTGACTAC |
| | | | SEQ ID NO:5307 | SEQ ID NO:13319 | SEQ ID NO:21331 |

FIGURE 49
(Continued)

| | | AA | SYSMN | SISGSSSYIYYADSVKG | VATFDY |
|---|---|---|---|---|---|
| | | | SEQ ID NO:5308 | SEQ ID NO:13320 | SEQ ID NO:21332 |
| iPS:434045 | 21-225_50H10 | NA | AGTTATGCCATGAGC | GTTATTAGTGGTCGTGGT GGTAGCACATTCTACGC AGACTCCGTGAAGGGC | CGTATAGCAGTGGCTGGGAA TGAGGCTTTTGATATC |
| | | | SEQ ID NO:5309 | SEQ ID NO:13321 | SEQ ID NO:21333 |
| | | AA | SYAMS | VISGRGGSTFYADSVKG | RIAVAGNEAFDI |
| | | | SEQ ID NO:5310 | SEQ ID NO:13322 | SEQ ID NO:21334 |
| iPS:434047 | 21-225_50A12 | NA | GGCCACTATATAAAC | TGGGTCAACCCTAACAG TGGTGGCACAAACTCTG CACAGAAGTTTCAGGGC | GGAGGGCAGCTCGGCGGGTT TAACTACTACTACTACGGTA TGGACGTC |
| | | | SEQ ID NO:5311 | SEQ ID NO:13323 | SEQ ID NO:21335 |
| | | AA | GHYIN | WVNPNSGGTNSAQKFQG | GGQLGGFNYYYYGMDV |
| | | | SEQ ID NO:5312 | SEQ ID NO:13324 | SEQ ID NO:21336 |
| iPS:434049 | 21-225_50B12 | NA | AGCCATAGCATGAAC | TCCATCAGTAGTAGTAGT AATTACATATACTACGC AGACTCAGTGAAGGGC | GATCGGAGCATAGTAGTGGC TGGTCCCTGGGACTACTACG GTATGGACGTC |
| | | | SEQ ID NO:5313 | SEQ ID NO:13325 | SEQ ID NO:21337 |
| | | AA | SHSMN | SISSSSNYIYYADSVKG | DRSIVVAGPWDYYGMDV |
| | | | SEQ ID NO:5314 | SEQ ID NO:13326 | SEQ ID NO:21338 |
| iPS:434053 | 21-225_51E1 | NA | AGCTATGGCATGCAC | GTTATATGGTATGATGG AAGTAGTAAATACTATG CAGACTCCGTGAAGGGC | AGGTATAGCAGCAGTTGGTC GGGCGGTATGGACGTC |
| | | | SEQ ID NO:5315 | SEQ ID NO:13327 | SEQ ID NO:21339 |
| | | AA | SYGMH | VIWYDGSSKYYADSVKG | RYSSSWSGGMDV |
| | | | SEQ ID NO:5316 | SEQ ID NO:13328 | SEQ ID NO:21340 |
| iPS:434055 | 21_225_51B4 | NA | AGCTATGTCATGAGC | GCTATTAGTGGTCGTGGT AGTAACACATTCTACAC AGACTCCGTGAAGGGC | GGGATAACTGGATCACACGG TGCTTTTGATATC |

FIGURE 49
(Continued)

| | | | SEQ ID NO:5317 | | SEQ ID NO:13329 | | SEQ ID NO:21341 |
|---|---|---|---|---|---|---|---|
| iPS:434057 | 21-225_51B4 | AA | SYVMS | | AISGRGSNTFYTDSVKG | | GITGSHGAFDI |
| | | | SEQ ID NO:5318 | | SEQ ID NO:13330 | | SEQ ID NO:21342 |
| | | NA | AGCTATGGCATGCAC | | GTTATATGGTATGATGA AGTAATAAATACTATG CAGACTCCGTGAAGGGC | | GAACTGGGATTTCTCTGA CTAC |
| iPS:434059 | 21-225_51E4 | | SEQ ID NO:5319 | | SEQ ID NO:13331 | | SEQ ID NO:21343 |
| | | AA | SYGMH | | VIWYDESNKYYADSVKG | | ELGFLSDY |
| | | | SEQ ID NO:5320 | | SEQ ID NO:13332 | | SEQ ID NO:21344 |
| | | NA | AGCTATGTCATGAGC | | ACTATGAGTGGTAGTGG TGGTCGCACATACTACG CAGACTCCGTGAACGGC | | GTGACTGCTTTGACTAC |
| iPS:434061 | 21-225_51C5 | | SEQ ID NO:5321 | | SEQ ID NO:13333 | | SEQ ID NO:21345 |
| | | AA | SYVMS | | TMSGSGGRTYYADSVNG | | VTAFDY |
| | | | SEQ ID NO:5322 | | SEQ ID NO:13334 | | SEQ ID NO:21346 |
| | | NA | AACTATGCCATGACC | | GTTATTAGTGCTAGTGGT GGTAACTCATTCTACGCA GACTCCGTGAAGGGC | | GCAAGGGCAGTGGCTGGGTC ACACTGGTTCGACCCC |
| iPS:434063 | 21-225_51C7 | | SEQ ID NO:5323 | | SEQ ID NO:13335 | | SEQ ID NO:21347 |
| | | AA | NYAMT | | VISASGGNSFYADSVKG | | ARAVAGSHWFDP |
| | | | SEQ ID NO:5324 | | SEQ ID NO:13336 | | SEQ ID NO:21348 |
| | | NA | AGCTATAGCATGAAC | | TCCATTAGTAGTAGTAGT AGTTACATATACTACGC AGACTCAGTGAAGGGC | | GCTCGCCTTGACTAC |
| | 21-225_51G7 | | SEQ ID NO:5325 | | SEQ ID NO:13337 | | SEQ ID NO:21349 |
| | | AA | SYSMN | | SISSSSYIYYADSVKG | | ARLDY |
| | | | SEQ ID NO:5326 | | SEQ ID NO:13338 | | SEQ ID NO:21350 |

FIGURE 49
(Continued)

| | | | | GGCTACCATATGCAC | | TGGATCAACCCTAATAA TAATGCCACAAACTATG CTCAGAGCTTTCAGGGC | GACGGTACCAGCAGCTTTGA CTTC |
|---|---|---|---|---|---|---|---|
| iPS:434065 | 21-225_50D4 | NA | | SEQ ID NO:5327 | | SEQ ID NO:13338 | SEQ ID NO:21351 |
| | | AA | | GYHMH | | WINPNNNATNYAQSFQG | DGTSSFDF |
| | | | | SEQ ID NO:5328 | | SEQ ID NO:13340 | SEQ ID NO:21352 |
| iPS:434067 | 21-225_51H8 | NA | | GGCCACTATATGAAC | | TGGGTCAACCCTAACAG TGGTGGCTCAAACTCTGC ACAGCAGTTTCAGGGC | GGAGGGCAGCTCGGCGGCTT TAACTTCTACTACTACGGTA TGGACGTC |
| | | | | SEQ ID NO:5329 | | SEQ ID NO:13341 | SEQ ID NO:21353 |
| | | AA | | GHYMN | | WVNPNSGGSNSAQQFQG | GGQLGGFNFYYYGMDV |
| | | | | SEQ ID NO:5330 | | SEQ ID NO:13342 | SEQ ID NO:21354 |
| iPS:434069 | 21-225_51E9 | NA | | GGCTACCATATACAC | | TGGATCAACCCTAACAC TAATGGCACACAGTATG CACAGAAGTTTCAGGGC | GATGGCACCTCGTCCTTTGA CTAC |
| | | | | SEQ ID NO:5331 | | SEQ ID NO:13343 | SEQ ID NO:21355 |
| | | AA | | GYHIH | | WINPNTNGTQYAQKFQG | DGTSSFDY |
| | | | | SEQ ID NO:5332 | | SEQ ID NO:13344 | SEQ ID NO:21356 |
| iPS:434071 | 21-225_51F9 | NA | | GACTATGGCATGCAC | | GTTATATGGTTGATGGA AATAATAAATACTATGC AGACTCCGTGAAGGGC | GAGCTGGGATTTCTCTCTGA CTAC |
| | | | | SEQ ID NO:5333 | | SEQ ID NO:13345 | SEQ ID NO:21357 |
| | | AA | | DYGMH | | VIWFDGNNKYYADSVKG | ELGFLSDY |
| | | | | SEQ ID NO:5334 | | SEQ ID NO:13346 | SEQ ID NO:21358 |
| iPS:434073 | 21-225_51H10 | NA | | AGCTATGCCATGAGC | | GTTATTAGTGGTAGTGGT GGTACCACATTCTACGC AGACTCCGTGAAGGGC | CGTATAGCAGTGGCTGGGAA TGATGCTTTGATATC |
| | | | | SEQ ID NO:5335 | | SEQ ID NO:13347 | SEQ ID NO:21359 |

FIGURE 49
(Continued)

| | | | | | |
|---|---|---|---|---|---|
| iPS:434075 | 21-225_51B11 | AA | SYAMS<br>SEQ ID NO:5336 | VISGSGGTTFYADSVKG<br>SEQ ID NO:13348 | RIAVAGNDAFDI<br>SEQ ID NO:21360 |
| | | NA | GACTATGGCATGCAC<br>SEQ ID NO:5337 | GTTATATGGTTTGGTGGA<br>AATAATAAATACTATGG<br>AGACTCCGTGAAGGGC<br>SEQ ID NO:13349 | GAGCTGGGATTTCTCTCTGA<br>CTAC<br>SEQ ID NO:21361 |
| | | AA | DYGMH<br>SEQ ID NO:5338 | VIWFGGNNKYYGDSVKG<br>SEQ ID NO:13350 | ELGFLSDY<br>SEQ ID NO:21362 |
| iPS:434077 | 21-225_51F11 | NA | AACTTTGGCATGCAC<br>SEQ ID NO:5339 | GTTATATGGTATGAGGA<br>AAGTAATAAATACTATG<br>CAGACTCCGTGAAGGGC<br>SEQ ID NO:13351 | GAACTGGGGTTCCTCTCTGA<br>CTTC<br>SEQ ID NO:21363 |
| | | AA | NFGMH<br>SEQ ID NO:5340 | VIWYEESNKYYADSVKG<br>SEQ ID NO:13352 | ELGFLSDF<br>SEQ ID NO:21364 |
| iPS:434079 | 21-225_52B1 | NA | GGCTATCATATGCAG<br>SEQ ID NO:5341 | TGGATCAACCCTAACAG<br>TGGTGCCACAAACTATG<br>CACAGAACTTTCAGGGC<br>SEQ ID NO:13353 | GATGGCACCTCGTCCTTTGA<br>CTAC<br>SEQ ID NO:21365 |
| | | AA | GYHMQ<br>SEQ ID NO:5342 | WINPNSGATNYAQNFQG<br>SEQ ID NO:13354 | DGTSSFDY<br>SEQ ID NO:21366 |
| iPS:434081 | 21-225_52B2 | NA | AACTATGGCATGCAC<br>SEQ ID NO:5343 | GTTACATGTTTGATGGA<br>AGTAATCAACGCTATGC<br>AGACTCCGTGAAGGGC<br>SEQ ID NO:13355 | GATCTGGGGATGATCGAGGA<br>CTTC<br>SEQ ID NO:21367 |
| | | AA | NYGMH<br>SEQ ID NO:5344 | VTWFDGSNQRYADSVKG<br>SEQ ID NO:13356 | DLGMIEDF<br>SEQ ID NO:21368 |

FIGURE 49
(Continued)

| | | | | | |
|---|---|---|---|---|---|
| iPS:434083 | 21-225_52H2 | NA | AGAAATGCCATGAGC | GCTATTAGTGGTGTCGTGGT GGTAATACATTCTACGC AGACTCCGTGAAGGGC | AATGGGCGAGAGCAGTGGCT TGACTAC |
| | | | SEQ ID NO:5345 | SEQ ID NO:13357 | SEQ ID NO:21369 |
| | | AA | RNAMS | AISGRGGNTFYADSVKG | NGREQWLDY |
| | | | SEQ ID NO:5346 | SEQ ID NO:13358 | SEQ ID NO:21370 |
| iPS:434085 | 21-225_52E3 | NA | AGCTATAAAATGAAC | TCCATTAGTAGTGGTAAT AGTTCCATATACTACGCA GACTCAGTGAAGGGC | GTTAGCAGTAATGACTAC |
| | | | SEQ ID NO:5347 | SEQ ID NO:13359 | SEQ ID NO:21371 |
| | | AA | SYKMN | SISSGNSSIYYADSVKG | VSSNDY |
| | | | SEQ ID NO:5348 | SEQ ID NO:13360 | SEQ ID NO:21372 |
| iPS:434087 | 21-225_52F6 | NA | AGCTATGGCATGCAC | ATTATATCATATGGAGG AAGTAATAAATACTATG CAGACTCCGTGAAGGGC | AGGTCAGCAGCTCGGCCGGG CTACGGTATGGACGTC |
| | | | SEQ ID NO:5349 | SEQ ID NO:13361 | SEQ ID NO:21373 |
| | | AA | SYGMH | IISYGGSNKYYADSVKG | RSAARPGYGMDV |
| | | | SEQ ID NO:5350 | SEQ ID NO:13362 | SEQ ID NO:21374 |
| iPS:434091 | 21-225_52B9 | NA | GACTATGGCATGCAC | GTTATATGGTTTGATGGA AATAATAAATACTATGC AGACTCCGTGAAGGGC | GAGCTGGGATTTCTCTCTGA CTAC |
| | | | SEQ ID NO:5351 | SEQ ID NO:13363 | SEQ ID NO:21375 |
| | | AA | DYGMH | VIWFDGNNKYYADSVKG | ELGFLSDY |
| | | | SEQ ID NO:5352 | SEQ ID NO:13364 | SEQ ID NO:21376 |

FIGURE 49
(Continued)

| iPS:434093 | 21-225_52D10 | NA | AGTTATGGCATGCAC | | CTTATATGGTATGATGGA AGTAATAAATACCATGC AGACTCCGTGAAGGGC | AGGTATAGCAGCAGCTGGTC GGGCGGTATGGACGTC |
|---|---|---|---|---|---|---|
| | | | SEQ ID NO:5353 | | SEQ ID NO:13365 | SEQ ID NO:21377 |
| | | AA | SYGMH | | LIWYDGSNKYHADSVKG | RYSSSWSGGMDV |
| | | | SEQ ID NO:5354 | | SEQ ID NO:13366 | SEQ ID NO:21378 |
| iPS:434095 | 21-225_52F10 | NA | TTCTATGGCATGCAC | | GTTATATGGGACGATGG AAGTAATAAATACTATG CAGACTCCGTGAAGGGC | GATTCTCTGTATAGCAGCAG CTGGTTGTTTGACTAC |
| | | | SEQ ID NO:5355 | | SEQ ID NO:13367 | SEQ ID NO:21379 |
| | | AA | FYGMH | | VIWDDGSNKYYADSVKG | DSLYSSSWLFDY |
| | | | SEQ ID NO:5356 | | SEQ ID NO:13368 | SEQ ID NO:21380 |
| iPS:434097 | 21-225_52H10 | NA | GGCTACCATATGCAG | | TGGATCAACCTAACAA TGGTGGCACACAGTATG CACAGAAGTTTCAGGGC | GATGGCAACCTCGTCCTTTGA CTAC |
| | | | SEQ ID NO:5357 | | SEQ ID NO:13369 | SEQ ID NO:21381 |
| | | AA | GYHMQ | | WINPNNGGTQYAQKFQG | DGTSSFDY |
| | | | SEQ ID NO:5358 | | SEQ ID NO:13370 | SEQ ID NO:21382 |
| iPS:434101 | 21-225_52H12 | NA | AGCTATAGCATGAAC | | TCCATTAGTGGTAGTAGT ACTTACATATACTACGCA GACTCAGTGAAGGGC | GTCAACTCCTTTGACTAC |
| | | | SEQ ID NO:5359 | | SEQ ID NO:13371 | SEQ ID NO:21383 |
| | | AA | SYSMN | | SISGSSTYIYYADSVKG | VNSFDY |
| | | | SEQ ID NO:5360 | | SEQ ID NO:13372 | SEQ ID NO:21384 |

FIGURE 49
(Continued)

| iPS: | | | | |
|---|---|---|---|---|
| iPS:434103 | 21-225_53G1 | NA | AGCTATAGCATGAAC | TCCATTAGTAGTGGTAGTAGT AGTTACATATACTACGC AGACTCAGTGAAGGGC | GATCGGGGCAGCACC |
| | | | SEQ ID NO:5361 | SEQ ID NO:13373 | SEQ ID NO:21385 |
| | | AA | SYSMN | SISGSSSYIYYADSVKG | DRGST |
| | | | SEQ ID NO:5362 | SEQ ID NO:13374 | SEQ ID NO:21386 |
| iPS:434105 | 21-225_53D2 | NA | AACTATGGCATGCAC | GTTGTATGGGATGATGG AAGTAATAAATACTATG CAGACTCCGTGAAGGGC | GGCCTTGGCTTTACGGGAGA CTAC |
| | | | SEQ ID NO:5363 | SEQ ID NO:13375 | SEQ ID NO:21387 |
| | | AA | NYGMH | VVWDDGSNKYYADSVKG | GLGFTGDY |
| | | | SEQ ID NO:5364 | SEQ ID NO:13376 | SEQ ID NO:21388 |
| iPS:434107 | 21-225_53E2 | NA | AGCTATGCCATGAGC | GCTATTAGTGGTAGTGGT GGTAACACATTCTACGC AGACTCCGTGAAGGGC | AAGGTCGTGGATACAGCCAT GGCTCTTGACTAC |
| | | | SEQ ID NO:5365 | SEQ ID NO:13377 | SEQ ID NO:21389 |
| | | AA | SYAMS | AISGSGGNTFYADSVKG | KVVDTAMALDY |
| | | | SEQ ID NO:5366 | SEQ ID NO:13378 | SEQ ID NO:21390 |
| iPS:434111 | 21-225_53H2 | NA | AGCTATGGCATGCAC | GTTATATCATATGGTGGA AGTAATAAATACCATGC AGACTCCGTGAAGGGC | CGGGAGCAGCTCGTCCTGG CTACGGTATGGACGTC |
| | | | SEQ ID NO:5367 | SEQ ID NO:13379 | SEQ ID NO:21391 |
| | | AA | SYGMH | VISYGGSNKYHADSVKG | RGAARPGYGMDV |
| | | | SEQ ID NO:5368 | SEQ ID NO:13380 | SEQ ID NO:21392 |
| iPS:434115 | 21_225_53E4 | NA | AGCTATGTCATGAGC | GGTATTAGTGGTAGTGG TGGTCGCACATACTACG CAGACTCCGTGAAGGGC | GTGGCCCTTTTTGACTAC |

FIGURE 49
(Continued)

| | | | | | | |
|---|---|---|---|---|---|---|
| iPS:434117 | 21-225_53E4 | AA | SEQ ID NO:5369<br>SYVMS | SEQ ID NO:13381<br>GISGSGGRTYYADSVKG | SEQ ID NO:21393<br>VALFDY | |
| | | NA | SEQ ID NO:5370<br>AGCTATGCCATGAAC | SEQ ID NO:13382<br>GCTATTAGTGGTAGTGGT<br>GGTGCCACATACTACGC<br>AGACTCCGTGAAGGGC | SEQ ID NO:21394<br>CCTCTAGTGGGAGCCCATGA<br>TGCTTTTGAAATC | |
| iPS:434119 | 21-225_53C6 | AA | SEQ ID NO:5371<br>SYAMN | SEQ ID NO:13383<br>AISGSGGATYYADSVKG | SEQ ID NO:21395<br>PLVGAHDAFEI | |
| | | NA | SEQ ID NO:5372<br>GACTATGGCATCCAC | SEQ ID NO:13384<br>GTTATATGGTATGATGA<br>AAGTAATAAATACTATG<br>GAGACTCCGTGAAGGGC | SEQ ID NO:21396<br>GAACTGGGGATGACGTCTGA<br>CTAC | |
| | 21-225_53E6 | AA | SEQ ID NO:5373<br>DYGIH | SEQ ID NO:13385<br>VIWYDESNKYYGDSVKG | SEQ ID NO:21397<br>ELGMTSDY | |
| iPS:434121 | | NA | SEQ ID NO:5374<br>AGCTATGGCATGCAC | SEQ ID NO:13386<br>GTTATATCATATGGTGGA<br>AGTAATAAATACGATGC<br>AGACTCCGTGAAGGGC | SEQ ID NO:21398<br>CGACGGGCAGCTCGTCCAGG<br>GTACGGTATGGACGTC | |
| | 21-225_53F6 | AA | SEQ ID NO:5375<br>SYGMH | SEQ ID NO:13387<br>VISYGGSNKYDADSVKG | SEQ ID NO:21399<br>RRAARPGYGMDV | |
| iPS:434123 | | NA | SEQ ID NO:5376<br>GGCTACCATATGCAC | SEQ ID NO:13388<br>TGGATCAACCCTAACAA<br>TAACGGCACAAACTATG<br>CACAGAAGTTTCAGGGC | SEQ ID NO:21400<br>GACGGTACCAGCAGCTTTGA<br>CTAC | |
| | 21-225_53F7 | | SEQ ID NO:5377 | SEQ ID NO:13389 | SEQ ID NO:21401 | |

FIGURE 49
(Continued)

| | | AA | GYHMH | | WINPNNGTNYAQKFQG | | DGTSSFDY | |
|---|---|---|---|---|---|---|---|---|
| iPS:434127 | 21-225_53H8 | NA | SEQ ID NO:5378 AGCTATGGCATGCAC | SEQ ID NO:13390 GTTATATGGTATGATGG AAGTAATAAATACTATG CAGACTCCGTGAAGGGC | | SEQ ID NO:21402 GCCCGTATTGGTACTTTGA CTCC | |
| | | AA | SEQ ID NO:5379 SYGMH | | SEQ ID NO:13391 VIWYDGSNKYYADSVKG | | SEQ ID NO:21403 ARIGYFDS | |
| iPS:434129 | 21-225_53B12 | NA | SEQ ID NO:5380 AACTTTGGCATGCAC | SEQ ID NO:13392 GTTGTATGGTATGATGG AAATAATAGATACTATG CAGACTCCGTGAAGGGC | | SEQ ID NO:21404 GAACTGGGATTTCTCTCTGA CTTC | |
| | | AA | SEQ ID NO:5381 NFGMH | | SEQ ID NO:13393 VVWYDGNNRYYADSVKG | | SEQ ID NO:21405 ELGFLSDF | |
| iPS:434131 | 21-225_54D3 | NA | SEQ ID NO:5382 AACTATGGCATGCAC | SEQ ID NO:13394 GTTACATGGTTTGATGGA AATAATAACTACTATGC AGACTCCGTGAAGGGC | | SEQ ID NO:21406 GAACTGGGGTTCCTTTCTGA TTAT | |
| | | AA | SEQ ID NO:5383 NYGMH | | SEQ ID NO:13395 VTWFDGNNNYYADSVKG | | SEQ ID NO:21407 ELGFLSDY | |
| iPS:434133 | 21_225_54G3 | NA | SEQ ID NO:5384 ACCTATGCCATGAGT | SEQ ID NO:13396 GCTATTAGTAGTGGTAGTGGT GTTAACACATTCTACGCA GACTCCGTGAAGGGC | | SEQ ID NO:21408 CTGGGGAAGGACTACTACTA CTACGGTATGGACGTC | |

FIGURE 49
(Continued)

| | | | | | | |
|---|---|---|---|---|---|---|
| iPS:434135 | 21-225_54G3 | AA | SEQ ID NO:5385 TYAMS | SEQ ID NO:13397 AISGSGVNTFYADSVKG | SEQ ID NO:21409 LGKDYYYGMDV | |
| | | NA | SEQ ID NO:5386 AGCTATAGCATGATC | SEQ ID NO:13398 TCCATTAGTGGTACTAGT AGTTACATATACTACGC AGACTCAGTCAAGGGC | SEQ ID NO:21410 ATGACTACAGTAATT | |
| iPS:434137 | 21-225_54H3 | AA | SEQ ID NO:5387 SYSMI | SEQ ID NO:13399 SISGTSSYIYYADSVKG | SEQ ID NO:21411 MTTVI | |
| | | NA | SEQ ID NO:5388 AGCTATGGCATGCAC | SEQ ID NO:13400 GTTATATGGTATGATGG AAGTAATAAATACTATG CAGACTCCGTGAAGGGC | SEQ ID NO:21412 AGGTATAGCAGCAGCTGGTC GGGCGGTATGACGTC | |
| | 21-225_54D4 | AA | SEQ ID NO:5389 SYGMH | SEQ ID NO:13401 VIWYDGSNKYYADSVKG | SEQ ID NO:21413 RYSSSWSGGMDV | |
| iPS:434141 | 21-225_54C6 | NA | SEQ ID NO:5390 GACTATGGCATCCAC | SEQ ID NO:13402 GTTATATGGTATGATGA AATAATAAATACTATG CAGACTCCGTGAAGGGC | SEQ ID NO:21414 GAACTGGGATGACGTCTGA CTAC | |
| | | AA | SEQ ID NO:5391 DYGIH | SEQ ID NO:13403 VIWYDENNKYYADSVKG | SEQ ID NO:21415 ELGMTSDY | |
| iPS:434143 | 21-225_54G7 | NA | SEQ ID NO:5392 AACTATGGCATGCAC | SEQ ID NO:13404 GTTATATGGTATGAGGA AAGTAATAAATACTATG GAGACTCCGTGAAGGGC | SEQ ID NO:21416 GAATTGGGGTTCCTCTCTGA CTAC | |
| | | | SEQ ID NO:5393 | SEQ ID NO:13405 | SEQ ID NO:21417 | |

FIGURE 49
(Continued)

| | | AA | NYGMH | | VIWYFESNKYYGDSVKG | ELGFLSDY |
|---|---|---|---|---|---|---|
| | | | SEQ ID NO:5394 | | SEQ ID NO:13406 | SEQ ID NO:21418 |
| iPS:434145 | | NA | GGCTACTATTTCCAC | | TGGATCCACCTAACAA TAATGCCACAAACTATG CACAGAAGTTTCAGGGC | GATGGCAGATCGTCCTTTGA CTAC |
| | 21-225_55B1 | | SEQ ID NO:5395 | | SEQ ID NO:13407 | SEQ ID NO:21419 |
| | | AA | GYYFH | | WIHPNNNATNYAQKFQG | DGRSSFDY |
| | | | SEQ ID NO:5396 | | SEQ ID NO:13408 | SEQ ID NO:21420 |
| iPS:434147 | | NA | AGCTATGCCATGAGC | | GCTATTAGTGGTCGTGGT AGTAGCACATTCTACGC AGACTCCGTGAAGGGC | GATCACGGTATAGTGGGAAC TATTTACTTTGACTAC |
| | 21-225_55E1 | | SEQ ID NO:5397 | | SEQ ID NO:13409 | SEQ ID NO:21421 |
| | | AA | SYAMS | | AISGRGSSTFYADSVKG | DHGIVGTIYFDY |
| | | | SEQ ID NO:5398 | | SEQ ID NO:13410 | SEQ ID NO:21422 |
| iPS:434149 | | NA | AGCTATGGCATGCAC | | GTTATATGGTATGATGG AAGTAATAAATACTATG CAGACTCCGTGAAGGGC | AGGTATAGCAGCAGCTGGTC GGGCGGTATGGACGTC |
| | 21-225_55H1 | | SEQ ID NO:5399 | | SEQ ID NO:13411 | SEQ ID NO:21423 |
| | | AA | SYGMH | | VIWYDGSNKYYADSVKG | RYSSSWSGGMDV |
| | | | SEQ ID NO:5400 | | SEQ ID NO:13412 | SEQ ID NO:21424 |
| iPS:434151 | | NA | AGTTATGGCATGCAC | | CTTATATGGTATGATGGA AGTAATAAATACCATGC AGACTCCGTGAAGGGC | AGGTATAGCAGCAGCTGGTC GGGCGGTATGGACGTC |
| | 21-225_55C2 | | SEQ ID NO:5401 | | SEQ ID NO:13413 | SEQ ID NO:21425 |
| | | AA | SYGMH | | LIWYDGSNKYHADSVKG | RYSSSWSGGMDV |

FIGURE 49
(Continued)

| | | | | SEQ ID NO:5402 AGCTATGGCATGCAC | SEQ ID NO:13414 GTTATATGGTTGATGA AATAATAAATACTATGA AGACTCCGTGAAGGGC | SEQ ID NO:21426 GAACTGGGATTCTCTGA CTAC |
|---|---|---|---|---|---|---|
| iPS:434155 | 21-225_55B3 | NA | | | | |
| | | AA | | SEQ ID NO:5403 SYGMH | SEQ ID NO:13415 VIWFDGNNKYYEDSVKG | SEQ ID NO:21427 ELGFLSDY |
| iPS:434157 | 21-225_55D4 | NA | | SEQ ID NO:5404 AGTTATAGGATGAAC | SEQ ID NO:13416 TCCATTAGTAGTAGTAGT AATCACATAGACTACGC AGACTCAGTGAAGGGC | SEQ ID NO:21428 GGGACTGACTAC |
| | | AA | | SEQ ID NO:5405 SYRMN | SEQ ID NO:13417 SISSSSNHIDYADSVKG | SEQ ID NO:21429 GTDY |
| | | | | SEQ ID NO:5406 GACTATGGCATGCAC | SEQ ID NO:13418 GTTATATGGTATGATGA AATATAAATACTATG CAGACTCCGTGAAGGGC | SEQ ID NO:21430 GAATGGTTTGACTAC |
| iPS:434159 | 21-225_55B8 | NA | | | | |
| | | AA | | SEQ ID NO:5407 DYGMH | SEQ ID NO:13419 VIWYDENNKYYADSVKG | SEQ ID NO:21431 EWFDY |
| iPS:434161 | 21-225_55F9 | NA | | SEQ ID NO:5408 AGCTATGGCATGCAC | SEQ ID NO:13420 GTTATATGGTATGATGG AAATGGCAAATATTATG CAGACTCCGTGAAGGGC | SEQ ID NO:21432 AGGTATAGCAGCAGCTGGTC GGGCGGTATGGACGTC |
| | | AA | | SEQ ID NO:5409 SYGMH | SEQ ID NO:13421 VIWYDGNGKYYADSVKG | SEQ ID NO:21433 RYSSSWSGGMDV |
| | | | | SEQ ID NO:5410 | SEQ ID NO:13422 | SEQ ID NO:21434 |

FIGURE 49
(Continued)

| | | | | | |
|---|---|---|---|---|---|
| iPS:434163 | 21-225_50H1 | NA | AGCTATGGCATGCAC | ATTATATCATATGGTGGAAGTAATAAATACGATGCAGACTCCGTGAAGGGC | CGACGGGCAGCTCGTCCAGGGTACGGTATGGACGTC |
| | | | SEQ ID NO:5411 | SEQ ID NO:13423 | SEQ ID NO:21435 |
| | | AA | SYGMH | IISYGGSNKYDADSVKG | RRAARPGYGMDV |
| | | | SEQ ID NO:5412 | SEQ ID NO:13424 | SEQ ID NO:21436 |
| iPS:434165 | 21-225_50F2 | NA | AGCTATGGCATGCAC | GTTATATGGCATGATGGAAGTAATAAATACTATGCAGACTCCGTGAAGGGC | GACGAGCAGCTCGGGACCTTTGACTAC |
| | | | SEQ ID NO:5413 | SEQ ID NO:13425 | SEQ ID NO:21437 |
| | | AA | SYGMH | VIWHDGSNKYYADSVKG | DEQLGTFDY |
| | | | SEQ ID NO:5414 | SEQ ID NO:13426 | SEQ ID NO:21438 |
| iPS:434167 | 21-225_50F3 | NA | ACCTATGCCATGACC | GCTATCAGTGGTAGTGGTGTTAACTCATTCTACGCAGACTCCGTGAAGGGC | GCAAGGGCAGTGGCTGGGTCACACTGGTTCGACCCC |
| | | | SEQ ID NO:5415 | SEQ ID NO:13427 | SEQ ID NO:21439 |
| | | AA | TYAMT | AISGSGVNSFYADSVKG | ARAVAGSHWFDP |
| | | | SEQ ID NO:5416 | SEQ ID NO:13428 | SEQ ID NO:21440 |
| iPS:434169 | 21-225_50C4 | NA | GACTATGGCATGCAC | GTTATATGGTATGAAGAAACTAATAAATACTATGCAGACTCCGTGAAGGGC | GAAGTGGGGTTCCTGAATGACTAC |
| | | | SEQ ID NO:5417 | SEQ ID NO:13429 | SEQ ID NO:21441 |
| | | AA | DYGMH | VIWYEETNKYYADSVKG | EVGFLNDY |
| | | | SEQ ID NO:5418 | SEQ ID NO:13430 | SEQ ID NO:21442 |

FIGURE 49
(Continued)

| | | | | | |
|---|---|---|---|---|---|
| iPS:434171 | 21-225_50G4 | NA | AGTTACTATATACAC | GTAATCAACCCTAGTAA TGGTAGAACAAGCTACG CACAGAAGTTCCAGGGC | GATCGAGGAGGAGATGGTTACTA CTTCTACTACGGTATGGACG TC |
| | | AA | SEQ ID NO:5419 SYYIH | SEQ ID NO:13431 VINPSNGRTSYAQKFQG | SEQ ID NO:21443 DRGDGYYFYYGMDV |
| iPS:434175 | 21-225_55A11 | NA | SEQ ID NO:5420 AGCTATGGCATGCAC | SEQ ID NO:13432 GTTATATCATATGTTGGA AGTACTAAATACTATGC AGACTCCGTGAGGGC | SEQ ID NO:21444 GGGAGAGGTCGATATAGTGA CTACGGTCATGATGCTTTTG ATATC |
| | | AA | SEQ ID NO:5421 SYGMH | SEQ ID NO:13433 VISYVGSTKYYADSVRG | SEQ ID NO:21445 GRGRYSDYGHDAFDI |
| iPS:434177 | 21-225_56A1 | NA | SEQ ID NO:5422 AATTATGATATCAAC | SEQ ID NO:13434 TGGATGCACCCTAACAG TGGTAACACAGGCTATG CACAGAAGTTCCAGGGC | SEQ ID NO:21446 AGCAGTGGCTGGTACGTTTT TGACTAC |
| | | AA | SEQ ID NO:5423 NYDIN | SEQ ID NO:13435 WMHPNSGNTGYAQKFQG | SEQ ID NO:21447 SSGWYVFDY |
| iPS:434179 | 21-225_56F1 | NA | SEQ ID NO:5424 AGCTATAGCATGAAC | SEQ ID NO:13436 TCCATTAGTAGTAGTAGT ACTTACATATACTACGG AGACTCAGTGAAGGGC | SEQ ID NO:21448 GATCGGGGCAGCAGC |
| | | AA | SEQ ID NO:5425 SYSMN | SEQ ID NO:13437 SISSSSTYIYYGDSVKG | SEQ ID NO:21449 DRGSS |
| iPS:434181 | 21-225_56B2 | NA | SEQ ID NO:5426 AGCTATGCCATGAGC | SEQ ID NO:13438 GCTATTAGTGGTAGTGGT GGTAACACATTCTACGC AGACTCCGTGAAGGGC | SEQ ID NO:21450 AAGGTCGTGGATACAGCCAT GGCTCTTGACTAC |
| | | AA | SEQ ID NO:5427 SYAMS | SEQ ID NO:13439 AISGSGGNTFYADSVKG | SEQ ID NO:21451 KVVDTAMALDY |

FIGURE 49
(Continued)

| | | | | | | |
|---|---|---|---|---|---|---|
| iPS:434187 | 21-225_56A5 | NA | SEQ ID NO:5428 AGCTATAGCATGAAAC | SEQ ID NO:13440 TCCATTAGTGGTAGTAGT AGTTACATATACTACGC AGACTCAGTGAAGGGC | SEQ ID NO:21452 GTGGCTACTTTTGACTAC | |
| | | AA | SEQ ID NO:5429 SYSMN | SEQ ID NO:13441 SISGSSSYIYYADSVKG | SEQ ID NO:21453 VATFDY | |
| iPS:434189 | 21-225_56E5 | NA | SEQ ID NO:5430 GGCTACCATATGCAC | SEQ ID NO:13442 TGGATCAACCCTAACAA TAATGCCACAAACTATG CACAGAAGTTTCAGGGC | SEQ ID NO:21454 GATGGCACCTCGTCTTTTGA CTAC | |
| | | AA | SEQ ID NO:5431 GYHMH | SEQ ID NO:13443 WINPNNATNYAQKFQG | SEQ ID NO:21455 DGTSSFDY | |
| iPS:434191 | 21-225_56B6 | NA | SEQ ID NO:5432 AGCTATGGCATGCAC | SEQ ID NO:13444 GTTATATGGCATGATGG AAGTAATAAATATTATG TAGACTCCGTGAAGGGC | SEQ ID NO:21456 GACGAGCAGCTCGGGACCTT TGACTAC | |
| | | AA | SEQ ID NO:5433 SYGMH | SEQ ID NO:13445 VIWHDGSNKYYVDSVKG | SEQ ID NO:21457 DEQLGTFDY | |
| iPS:434193 | 21-225_56C6 | NA | SEQ ID NO:5434 GACTACCATATGCAC | SEQ ID NO:13446 TGGATCAACCCTAACAG AGGTGGCACAAATTATG TACAGAAGTTTCAGGGT | SEQ ID NO:21458 GATGGCACCTCGTCTTTTGA CTAT | |
| | | AA | SEQ ID NO:5435 DYHMH | SEQ ID NO:13447 WINPNRGTNYVQKFQG | SEQ ID NO:21459 DGTSSFDY | |
| | | | SEQ ID NO:5436 | SEQ ID NO:13448 | SEQ ID NO:21460 | |

FIGURE 49
(Continued)

| | | | | |
|---|---|---|---|---|
| iPS:434195 | 21-225_56F6 | NA | GACTACTATATGCAC | TGGATCAACCCTAACAGTGGTGGCACAAACTATGCACAGAGGTTTCAGGGC | GAGGGAGCAACTCGTCGACGGGTTTTGACTAC |
| | | | SEQ ID NO:5437 | SEQ ID NO:13449 | SEQ ID NO:21461 |
| | | AA | DYYMH | WINPNSGGTNYAQRFQG | EGATRPTGFDY |
| | | | SEQ ID NO:5438 | SEQ ID NO:13450 | SEQ ID NO:21462 |
| iPS:434197 | 21-225_56C7 | NA | GGCCACTATATAAAAC | TGGGTCAACCCTAACAGTGGTGGCACAAACTCTGCACAGAAGTTTCAGGGC | GGAGGGCAGCTCGGCGGGTTTAACTACTACTACTACGGTATGGACGTC |
| | | | SEQ ID NO:5439 | SEQ ID NO:13451 | SEQ ID NO:21463 |
| | | AA | GHYIN | WVNPNSGGTNSAQKFQG | GGQLGGFNYYYYGMDV |
| | | | SEQ ID NO:5440 | SEQ ID NO:13452 | SEQ ID NO:21464 |
| iPS:434199 | 21-225_59F11 | NA | AACTATGGCATGCAC | GTTATATGGTATGATGAAGTAATAAACACTATGCAGACTCCGTGAAGGGC | GAACTGGGGATGAACGGAGACTAC |
| | | | SEQ ID NO:5441 | SEQ ID NO:13453 | SEQ ID NO:21465 |
| | | AA | NYGMH | VIWYDESNKHYADSVKG | ELGMNGDY |
| | | | SEQ ID NO:5442 | SEQ ID NO:13454 | SEQ ID NO:21466 |
| iPS:434201 | 21-225_59A12 | NA | AGCTATGGCATGCAC | GTTATATGGTATGATGGAAGTAATAAATACTATGCAGACTCCGTGAAGGGC | CGGTATAGCAGCAGCTGGGACGGGGGTATGGACGTC |
| | | | SEQ ID NO:5443 | SEQ ID NO:13455 | SEQ ID NO:21467 |
| | | AA | SYGMH | VIWYDGSNKYYADSVKG | RYSSSWDGGMDV |
| | | | SEQ ID NO:5444 | SEQ ID NO:13456 | SEQ ID NO:21468 |

FIGURE 49
(Continued)

| | | | | |
|---|---|---|---|---|
| iPS:434203 | 21-225_60E2 | NA | GACTATGGCATGCAC | ATTATATGGTATGATGA AATAATACTATG CAGACTCCGTGAAGGGC | GATGTTCTGGACCCTTTTGA CTAC |
| | | | SEQ ID NO:5445 | SEQ ID NO:13457 | SEQ ID NO:21469 |
| | | AA | DYGMH | IIWYDENNKYYADSVKG | DVLDPFDY |
| | | | SEQ ID NO:5446 | SEQ ID NO:13458 | SEQ ID NO:21470 |
| iPS:434205 | 21-225_60G2 | NA | AGTTATGGCATGCAC | GTTATATGGTATGATGG AAGTAATAAATACTATG CAGACTCCGTGAAGGGC | AGGTATAGCAGAAGCTGGAC GGGAGGCATGGACGTC |
| | | | SEQ ID NO:5447 | SEQ ID NO:13459 | SEQ ID NO:21471 |
| | | AA | SYGMH | VIWYDGSNKYYADSVKG | RYSRSWTGGMDV |
| | | | SEQ ID NO:5448 | SEQ ID NO:13460 | SEQ ID NO:21472 |
| iPS:434207 | 21-225_60A3 | NA | AGCTATGGCATGCAC | GTTATATGGTATGAAGA AAGTAATAAATACTATG CAGACTCCGTGAAGGGC | GAACTGGGGATGACCGGAGA CTAC |
| | | | SEQ ID NO:5449 | SEQ ID NO:13461 | SEQ ID NO:21473 |
| | | AA | SYGMH | VIWYEESNKYYADSVKG | ELGMTGDY |
| | | | SEQ ID NO:5450 | SEQ ID NO:13462 | SEQ ID NO:21474 |
| iPS:434209 | 21-225_60C3 | NA | GGCCACTATATACAC | TGGATCAACCCTAACAG CGGTGGCACAAACTATG TACAGAAATTTCAGGGC | GGGGGCCTACTGGGAGCTAC CAACTACTATTATTACGGTA TGGACGTC |
| | | | SEQ ID NO:5451 | SEQ ID NO:13463 | SEQ ID NO:21475 |
| | | AA | GHYIH | WINPNSGGTNYVQKFQG | GGLLGATNYYYYGMDV |
| | | | SEQ ID NO:5452 | SEQ ID NO:13464 | SEQ ID NO:21476 |

FIGURE 49
(Continued)

| iPS:434211 | 21-225_60F3 | NA | AATTATGATATCAAC SEQ ID NO:5453 | TGGATGCACCCTAACAG TGGTAACACAGGCTATG CACAGAAGTTCCAGGGC SEQ ID NO:13465 | AGCAGTGGCTGGTACTTCTT TGACTAC SEQ ID NO:21477 |
|---|---|---|---|---|---|
| | | AA | NYDIN | WMHPNSGNTGYAQKFQG SEQ ID NO:13466 | SSGWYFFDY SEQ ID NO:21478 |
| iPS:434213 | 21-225_60A4 | NA | AGCTATGTCATGAGC SEQ ID NO:5455 | TCTATTAGTGGTAGTGGT GGTTGGACAAACTACGC AGACTCCGTGAAGGGC SEQ ID NO:13467 | CTAACTGGATTTGACTAT SEQ ID NO:21479 |
| | | AA | SYVMS SEQ ID NO:5456 | SISGSGGWTNYADSVKG SEQ ID NO:13468 | LTGFDY SEQ ID NO:21480 |
| iPS:434215 | 21-225_60F7 | NA | AGCTATGTCATGAGC SEQ ID NO:5457 | GGTATTAGTAGTAGTGG TAATAGAACATACTACG CAGACTCCGTGAAGGGC SEQ ID NO:13469 | TTGGGGATTGAC SEQ ID NO:21481 |
| | | AA | SYVMS SEQ ID NO:5458 | GISGSGNRTYYADSVKG SEQ ID NO:13470 | LGID SEQ ID NO:21482 |
| iPS:434217 | 21-225_60E8 | NA | AGGAGTAGTTACTACTGGGG C SEQ ID NO:5459 | AGTATCTCATTATAGTGGG AGCGCCTCCTACACCC GTCCCTCAAGAGT SEQ ID NO:13471 | CTGGACAGTGGCTGGTCGTT TGACTAC SEQ ID NO:21483 |
| | | AA | RSSYYWG SEQ ID NO:5460 | SIYYSGSASYNPSLKS SEQ ID NO:13472 | LDSGWSFDY SEQ ID NO:21484 |
| iPS:434219 | 21-225_60E9 | NA | AGCTATGCCATGAGC SEQ ID NO:5461 | GCTATTAGTGGTGGTAGTGGT GGTAACACATTCTACGC AGACTCCGTGAAGGGC SEQ ID NO:13473 | TTTTTCGTATAGTGGGAGC CGGGTACTTTGACTAC SEQ ID NO:21485 |

FIGURE 49
(Continued)

| | | AA | SYAMS | | AISGSGGNTFYADSVKG | FFGIVGAGYFDY |
|---|---|---|---|---|---|---|
| iPS:434221 | | NA | AACTATGCCATGACC | | GCTATTAGTGGTAGTGGT GGTAACACATTCTACGC AGACTCCGTGACGGGC | CTGGGGAAGGACTACCACTA CTACGGTATGGACGTC |
| | 21-225_60A11 | | SEQ ID NO:5462 | | SEQ ID NO:13474 | SEQ ID NO:21486 |
| | | | SEQ ID NO:5463 | | SEQ ID NO:13475 | SEQ ID NO:21487 |
| | | AA | NYAMT | | AISGSGGNTFYADSVTG | LGKDYHYYGMDV |
| | | | SEQ ID NO:5464 | | SEQ ID NO:13476 | SEQ ID NO:21488 |
| iPS:434223 | | NA | AGCTATGGCATGCAC | | GTTATATGGTATGATGG AAGTAATAAATACTATG TAGACTCCGTGAAGGGC | AGGTATAGCAGAAGCTGGAC GGGAGGTATGGACGTC |
| | 21-225_60C12 | | SEQ ID NO:5465 | | SEQ ID NO:13477 | SEQ ID NO:21489 |
| | | AA | SYGMH | | VIWYDGSNKYYVDSVKG | RYSRSWTGGMDV |
| | | | SEQ ID NO:5466 | | SEQ ID NO:13478 | SEQ ID NO:21490 |
| iPS:434225 | | NA | AGTTACTTCTGGAGC | | CGCATCTATACCAGGGG GAGCACCAACTACAACC CCTCCCTCAAGAGT | GAGGGAAAAACTGGGGGGG TTTCTTACTTTGACTAC |
| | 21-225_60E12 | | SEQ ID NO:5467 | | SEQ ID NO:13479 | SEQ ID NO:21491 |
| | | AA | SYFWS | | RIYTRGSTNYNPSLKS | EGKTGGVSYFDY |
| | | | SEQ ID NO:5468 | | SEQ ID NO:13480 | SEQ ID NO:21492 |
| iPS:434227 | | NA | AGTCACTTCTGGAGC | | CGCATCTATATCAGGGG GAGCACCAACTACAACC CCTCCCTCAAGAGT | GAGGGAAAAACTGGGGGGG TTTCTTACTTTGACTAC |
| | 21-225_61A1 | | SEQ ID NO:5469 | | SEQ ID NO:13481 | SEQ ID NO:21493 |
| | | AA | SHFWS | | RIYIRGSTNYNPSLKS | EGKTGGVSYFDY |
| | | | SEQ ID NO:5470 | | SEQ ID NO:13482 | SEQ ID NO:21494 |

FIGURE 49
(Continued)

| | | | | | |
|---|---|---|---|---|---|
| iPS:434229 | 21-225_61H1 | NA | GACTATGGCATGCAC | ATTATATGGTATGATGAAGTAATAAATACTATGCAGACTCCGTGAAGGGC | GATGTTCTGGACCCTTTTGACTAC |
| | | | SEQ ID NO:5471 | SEQ ID NO:13483 | SEQ ID NO:21495 |
| | | AA | DYGMH | IIWYDESNKYYADSVKG | DVLDPFDY |
| | | | SEQ ID NO:5472 | SEQ ID NO:13484 | SEQ ID NO:21496 |
| iPS:434231 | 21-225_61F2 | NA | AGCTATGGCATGCAC | GTTATATGGTATGATGGAAGTAATAAATACTATGCAGACTCCGTGAAGGGC | GAGAGGTATAGCAGTGGCTGGTACGACTACGGTATGGACGTC |
| | | | SEQ ID NO:5473 | SEQ ID NO:13485 | SEQ ID NO:21497 |
| | | AA | SYGMH | VIWYDGSNKYYADSVKG | ERYSSGWYDYGMDV |
| | | | SEQ ID NO:5474 | SEQ ID NO:13486 | SEQ ID NO:21498 |
| iPS:434233 | 21-225_61B3 | NA | AGCTATGGCATGCAC | GTTATATGGTATGATGGAAGTAATAAATACTATGCAGACTCCGTGAAGGGC | AGGTATAGCAGAAGCTGGGCGGGAGGCATGGACGTC |
| | | | SEQ ID NO:5475 | SEQ ID NO:13487 | SEQ ID NO:21499 |
| | | AA | SYGMH | VIWYDGSNKYYADSVKG | RYSRSWAGGMDV |
| | | | SEQ ID NO:5476 | SEQ ID NO:13488 | SEQ ID NO:21500 |
| iPS:434235 | 21-225_61E3 | NA | AATTATGATATCAAC | TGGATGACCCCTAACAGTGGTAACACAGGCTATGCACAGAAGTTCCAGGGC | AGCAGTGGCTGGTACCGCTTTGACTAC |
| | | | SEQ ID NO:5477 | SEQ ID NO:13489 | SEQ ID NO:21501 |
| | | AA | NYDIN | WMTPNSGNTGYAQKFQG | SSGWYRFDY |
| | | | SEQ ID NO:5478 | SEQ ID NO:13490 | SEQ ID NO:21502 |

FIGURE 49
(Continued)

| | | | | |
|---|---|---|---|---|
| iPS:434237 | 21-225_61B5 | NA | AATTATGATATCAAC | TGGATGCACCTAACAG TGGTAGCACAGGCTATG CACAGAAGTTCCAGGGC | AGCAGTGGCTGTGTACTACTT TGACTAC |
| | | | SEQ ID NO:5479 | SEQ ID NO:13491 | SEQ ID NO:21503 |
| | | AA | NYDIN | WMHPNSGSTGYAQKFQG | SSGWYYFDY |
| | | | SEQ ID NO:5480 | SEQ ID NO:13492 | SEQ ID NO:21504 |
| iPS:434239 | 21-225_58F1 | NA | AGCTATGCCATGAGT | GCTATTAGTACTGGTGGT GGTAACACATACTACGC AGACTCCGTGAAGGGC | CGGGGGGTCTACGGTGACTT TGATGCTTTTGATATC |
| | | | SEQ ID NO:5481 | SEQ ID NO:13493 | SEQ ID NO:21505 |
| | | AA | SYAMS | AISTGGGNTYYADSVKG | RGVYGDFDAFDI |
| | | | SEQ ID NO:5482 | SEQ ID NO:13494 | SEQ ID NO:21506 |
| iPS:434241 | 21-225_61E6 | NA | AGCTATGCCATGAGC | GCTACTAGTGGTGGTAGTGG TGTTAACACATTCTACGC AGACTCCGTGAAGGGC | TTGGAACTGGGGATCTTTGA CTAC |
| | | | SEQ ID NO:5483 | SEQ ID NO:13495 | SEQ ID NO:21507 |
| | | AA | SYAMS | ATSGSGVNTFYADSVKG | LELGIFDY |
| | | | SEQ ID NO:5484 | SEQ ID NO:13496 | SEQ ID NO:21508 |
| iPS:434243 | 21-225_62C1 | NA | AGCTATAGCATGAAC | TCCATTAGTAGTAGTAGT AGTTACATATACTACGC AGACTCAGTGAAGGGC | TTTGGAGTGGAC |
| | | | SEQ ID NO:5485 | SEQ ID NO:13497 | SEQ ID NO:21509 |
| | | AA | SYSMN | SISSSSSYIYYADSVKG | FGVD |
| | | | SEQ ID NO:5486 | SEQ ID NO:13498 | SEQ ID NO:21510 |
| iPS:434245 | 21-225_62H1 | NA | AGCTATGGCATGCAC | ATTATATGGTATGATGG AAGTAATAAATACTATG CAGACTCCGTGAAGGGC | GAAGACCCGCGTACCAGCTG CTCTGACTAC |
| | | | SEQ ID NO:5487 | SEQ ID NO:13499 | SEQ ID NO:21511 |

FIGURE 49
(Continued)

| | | | | | | | |
|---|---|---|---|---|---|---|---|
| iPS:434247 | 21-225_62D2 | AA | SYGMH | | IIWYDGSNKYYADSVKG | | EDPRTSCSDY |
| | | | SEQ ID NO:5488 | | SEQ ID NO:13500 | | SEQ ID NO:21512 |
| | | NA | AGCTATGGCATGCAC | | GTTATATGGTATGATGG AAGTAATAAATACTCTG CAGACTCCGTGAAGGGC | | GATAATGGTAACTGGAACTA CCTTGACTAC |
| | | | SEQ ID NO:5489 | | SEQ ID NO:13501 | | SEQ ID NO:21513 |
| iPS:434249 | 21-225_62E2 | AA | SYGMH | | VIWYDGSNKYSADSVKG | | DNGNWNYLDY |
| | | | SEQ ID NO:5490 | | SEQ ID NO:13502 | | SEQ ID NO:21514 |
| | | NA | AGAAGTAGTTACTACTGGGG C | | AGCATCTATTATAGTGG GATCGCCTCCTATAATCC GTCCCTCAAGAGT | | CTGAGCAGTGGCTGGTCCTT TGACTAC |
| | | | SEQ ID NO:5491 | | SEQ ID NO:13503 | | SEQ ID NO:21515 |
| | | AA | RSSYYWG | | SIYYSGIASYNPSLKS | | LSSGWSFDY |
| | | | SEQ ID NO:5492 | | SEQ ID NO:13504 | | SEQ ID NO:21516 |
| iPS:434251 | 21-225_62G3 | NA | AGCTATAGCATGAAC | | TCCATTAGTAGTAGT AGTTACATATACTACGC AGACTCAGTGAAGGGC | | GTTAACTCTTTTGACTCC |
| | | | SEQ ID NO:5493 | | SEQ ID NO:13505 | | SEQ ID NO:21517 |
| | | AA | SYSMN | | SISSSSSYIYYADSVKG | | VNSFDS |
| | | | SEQ ID NO:5494 | | SEQ ID NO:13506 | | SEQ ID NO:21518 |
| iPS:434253 | 21-225_62E4 | NA | GACTATGGCATGCAC | | GTTATATGGTATGATAG AAGTAATAAATACTATG CAGACTCCGTGAAGGGC | | GAGCTTGGGTTCAGCAGTGA CTAC |
| | | | SEQ ID NO:5495 | | SEQ ID NO:13507 | | SEQ ID NO:21519 |
| | | AA | DYGMH | | VIWYDRSNKYYADSVKG | | ELGFSSDY |
| | | | SEQ ID NO:5496 | | SEQ ID NO:13508 | | SEQ ID NO:21520 |

FIGURE 49
(Continued)

| | | | | |
|---|---|---|---|---|
| iPS:434255 | 21-225_62E6 | NA | TCCTATGGCATGCAC | GCTATATGGTATGATGG AAGTAATAAATACTATG GAGACTCCGTGAAGGGC | GATCAGGGCATAGTGGGAGC TACTTGGTTTGACTAC |
| | | AA | SEQ ID NO:5497 SYGMH | SEQ ID NO:13509 AIWYDGSNKYYGDSVKG | SEQ ID NO:21521 DQGIVGATWFDY |
| iPS:434257 | 21-225_62F7 | NA | SEQ ID NO:5498 AGCTATGTTATGAGC | SEQ ID NO:13510 GGTATTAGTGGTAGTGG TGCTAAAACATACTATG CAGACTCCGTGAAGGGC | SEQ ID NO:21522 CTGGGGATAGAGTACTACTA CGGTATGGACGTC |
| | | AA | SEQ ID NO:5499 SYVMS | SEQ ID NO:13511 GISGSGAKTYYADSVKG | SEQ ID NO:21523 LGIDYYYGMDV |
| iPS:434259 | 21-225_62G7 | NA | SEQ ID NO:5500 GGCTACTATATGCAC | SEQ ID NO:13512 TGGATCAAACCTAAAAG TGGTGGCACAAACCAAG CACAGAAGTTTCAGGGC | SEQ ID NO:21524 GCTCCGGGTATAGCAGCAGC TGGTACATGGGGATACTTTG ACTAC |
| | | AA | SEQ ID NO:5501 GYYMH | SEQ ID NO:13513 WIKPKSGGTNQAQKFQG | SEQ ID NO:21525 APGIAAAGTWGYFDY |
| iPS:434261 | 21-225_56F7 | NA | SEQ ID NO:5502 AGCTATGTCTTAAAC | SEQ ID NO:13514 GCTATGAGTGGTAGTGG TGGTAGAACATACTACG CAGACTCCGTGAAGGGC | SEQ ID NO:21526 ACTACGCACTTTGACTAC |
| | | AA | SEQ ID NO:5503 SYVLN | SEQ ID NO:13515 AMSGSGGRTYYADSVKG | SEQ ID NO:21527 TTHFDY |
| iPS:434263 | 21_225_56H7 | NA | SEQ ID NO:5504 AGCTATAGCATGAAC | SEQ ID NO:13516 TCCATTAGTAGTAGTAGT ACTTACATATACTACG AGACTCAGTGAAGGGC | SEQ ID NO:21528 GATCGGGGCAGCAGC |

FIGURE 49
(Continued)

| | | | | | | |
|---|---|---|---|---|---|---|
| iPS:434265 | 21-225_56H7 | AA | SEQ ID NO:5505<br>SYSMN | SEQ ID NO:13517<br>SISSSSTYTYYGDSVKG | SEQ ID NO:21529<br>DRGSS | |
| | | NA | SEQ ID NO:5506<br>AGCTATAGCATGAAC | SEQ ID NO:13518<br>TCCATTAGTGGTAGTAGT<br>AGTTACATAAACTACAC<br>AGACTCAGTGAAGGGC | SEQ ID NO:21530<br>GTGGCTGGCTTTGACTAC | |
| iPS:434267 | 21-225_57B2 | AA | SEQ ID NO:5507<br>SYSMN | SEQ ID NO:13519<br>SISGSSSYINYTDSVKG | SEQ ID NO:21531<br>VAGFDY | |
| | | NA | SEQ ID NO:5508<br>AGTTACTACTGGAGC | SEQ ID NO:13520<br>CGCATCTATACCAGGGG<br>GAGCACCAACTACAACC<br>CCTCCCTCAAGAGT | SEQ ID NO:21532<br>GAGGGAAAAACTGGGGGG<br>TTTCTTACTTTGACTAC | |
| iPS:434269 | 21-225_57F2 | AA | SEQ ID NO:5509<br>SYYWS | SEQ ID NO:13521<br>RIYTRGSTNYNPSLKS | SEQ ID NO:21533<br>EGKTGGVSYFDY | |
| | | NA | SEQ ID NO:5510<br>AGCTATGGCATGCAC | SEQ ID NO:13522<br>GCTATATGGTATGATGG<br>AAGTAATAAATACTATG<br>CAGACTCCGTGAAGGGC | SEQ ID NO:21534<br>GATTATGGTATAGTGGGAGC<br>TACATATTTGACTAC | |
| | 21-225_57H3 | AA | SEQ ID NO:5511<br>SYGMH | SEQ ID NO:13523<br>AIWYDGSNKYYADSVKG | SEQ ID NO:21535<br>DYGIVGATYFDY | |
| iPS:434271 | | NA | SEQ ID NO:5512<br>GACTATGGCATGCAC | SEQ ID NO:13524<br>GTTATATGGTATGCTGGA<br>AGTAATAAATACTATGT<br>AGACTCCGTGAAGGGC | SEQ ID NO:21536<br>GAACTGGGGATGAGGTCTGA<br>CTAC | |
| | 21-225_57A4 | AA | SEQ ID NO:5513<br>DYGMH | SEQ ID NO:13525<br>VIWYAGSNKYYVDSVKG | SEQ ID NO:21537<br>ELGMRSDY | |

FIGURE 49
(Continued)

| | | | | | |
|---|---|---|---|---|---|
| iPS:434273 | 21-225_57E4 | NA | SEQ ID NO:5514<br>AGCTATGCCATGAGC | SEQ ID NO:13526<br>GTTATTAGTGGTAGTGGT<br>GGTAGTACATTCTACGC<br>AGACTCCGTGAAGGGC | SEQ ID NO:21538<br>AGGGACTGGAACGACGTTTT<br>TGACTAC |
| | | AA | SEQ ID NO:5515<br>SYAMS | SEQ ID NO:13527<br>VISGSGGSTFYADSVKG | SEQ ID NO:21539<br>RDWNDVFDY |
| iPS:434275 | 21-225_57F4 | NA | SEQ ID NO:5516<br>GACTACTACATGAAC | SEQ ID NO:13528<br>TACATTAGTAGTGGT<br>AGTACCATATACTACGC<br>AGACTCTGTGAAGGGC | SEQ ID NO:21540<br>GATATGATTACG |
| | | AA | SEQ ID NO:5517<br>DYYMN | SEQ ID NO:13529<br>YISSSGSTIYYADSVKG | SEQ ID NO:21541<br>DMIT |
| iPS:434277 | 21-225_57A7 | NA | SEQ ID NO:5518<br>GGCTACCATATACAC | SEQ ID NO:13530<br>TGGATCAACCCTAACAA<br>TAATGGCACAAACTATG<br>CACAGAAGTTTCAGGGC | SEQ ID NO:21542<br>GATGGGAGAAGTGGTTTTGA<br>CTAC |
| | | AA | SEQ ID NO:5519<br>GYHIH | SEQ ID NO:13531<br>WINPNNGTNYAQKFQG | SEQ ID NO:21543<br>DGRSGFDY |
| iPS:434279 | 21-225_57F7 | NA | SEQ ID NO:5520<br>AGCTATGCCATGAGC | SEQ ID NO:13532<br>GCTATTAGTGGTAGTGGT<br>GGTAACACATTCTACGC<br>AGACTCCGTGAAGGGC | SEQ ID NO:21544<br>TTTTCGGTGTAGTGGGAGT<br>CGGGTGCTTTGACTAC |
| | | AA | SEQ ID NO:5521<br>SYAMS | SEQ ID NO:13533<br>AISGSGGNTFYADSVKG | SEQ ID NO:21545<br>FFGVVGVGCFDY |
| iPS:434281 | 21_225_57B8 | NA | SEQ ID NO:5522<br>AGCTATGCCATGAGC | SEQ ID NO:13534<br>GCTATTAGTGGTAGTGGT<br>GGTAACACATTCTACGC<br>AGACTCCGTGAAGGGC | SEQ ID NO:21546<br>TTGAACTGGGGATCTTTGA<br>CTAC |

FIGURE 49
(Continued)

| | | | | | | |
|---|---|---|---|---|---|---|
| iPS:434283 | 21-225_57B8 | AA | SEQ ID NO:5523<br>SYAMS | SEQ ID NO:13535<br>AISGSGGNTFYADSVKG | SEQ ID NO:21547<br>LELGIFDY | |
| | | NA | SEQ ID NO:5524<br>AACTATGCCATGAGC | SEQ ID NO:13536<br>GCTAGCAGTGGTAGTGG<br>TGGTAACACATTCTACGC<br>AGACTCCGTGACGGGC | SEQ ID NO:21548<br>CTGGGGAAGGACTACCACTA<br>CTACGGTATGGACGTC | |
| iPS:434285 | 21-225_57F8 | AA | SEQ ID NO:5525<br>NYAMS | SEQ ID NO:13537<br>ASSGSGGNTFYADSVTG | SEQ ID NO:21549<br>LGKDYHYYGMDV | |
| | | NA | SEQ ID NO:5526<br>AATTATGATATCAAC | SEQ ID NO:13538<br>TGGATGAACCCTAACAG<br>TGTTAACACAGGCTATG<br>CACAGAAGTTCCAGGGC | SEQ ID NO:21550<br>AGCAGTGGCTGGAACTGGTT<br>CGACCCC | |
| iPS:434287 | 21-225_57A11 | AA | SEQ ID NO:5527<br>NYDIN | SEQ ID NO:13539<br>WMNPNSVNTGYAQKFQG | SEQ ID NO:21551<br>SSGWNWFDP | |
| | | NA | SEQ ID NO:5528<br>AATTATGATATCAAC | SEQ ID NO:13540<br>TGGATGAACCCTAACAG<br>TGTAACACAGGCTATG<br>CACAGAAGTTCCAGGGC | SEQ ID NO:21552<br>AGCAGTGGCTGGTACCGGTT<br>CGACCCC | |
| iPS:434289 | 21-225_57F12 | AA | SEQ ID NO:5529<br>NYDIN | SEQ ID NO:13541<br>WMNPNSGNTGYAQKFQG | SEQ ID NO:21553<br>SSGWYRFDP | |
| | | NA | SEQ ID NO:5530<br>AGCTACGCCATGAGC | SEQ ID NO:13542<br>GCTATTAGTGGTAGTGGT<br>GGTAACACATTCTACGG<br>AGACTCCGTGAAGGGC | SEQ ID NO:21554<br>TTTTTCCGTATAGTGGGTGC<br>CGGGTACTTTGACTAC | |
| | 21-225_57H12 | AA | SEQ ID NO:5531<br>SYAMS | SEQ ID NO:13543<br>AISGSGGNTFYGDSVKG | SEQ ID NO:21555<br>FFGIVGAGYFDY | |
| | | | SEQ ID NO:5532 | SEQ ID NO:13544 | SEQ ID NO:21556 | |

FIGURE 49
(Continued)

| | | | | | |
|---|---|---|---|---|---|
| iPS:434291 | 21-225_58A4 | NA | AGCTACGCCATGAGC | GCTATTAGTGGTAGTGGT GGTAACACATTCTACGG AGACTCCGTGAAGGGC | TTTTTCGGTATAGTGGAGC CGGGTTCTTTGACTCC |
| | | | SEQ ID NO:5533 | SEQ ID NO:13545 | SEQ ID NO:21557 |
| | | AA | SYAMS | AISGSGGNTFYGDSVKG | FFGIVGAGFFDS |
| | | | SEQ ID NO:5534 | SEQ ID NO:13546 | SEQ ID NO:21558 |
| iPS:434293 | 21-225_58F5 | NA | GACTATGGCATGCAC | GTTATATGGTATGCTGGA AGTAATAAATACCATGT AGACTCCGTGAAGGGC | GAACTGGGGATGAGGTCTGA CTAC |
| | | | SEQ ID NO:5535 | SEQ ID NO:13547 | SEQ ID NO:21559 |
| | | AA | DYGMH | VIWYAGSNKYHVDSVKG | ELGMRSDY |
| | | | SEQ ID NO:5536 | SEQ ID NO:13548 | SEQ ID NO:21560 |
| iPS:434295 | 21-225_58B9 | NA | AATTATGATATCAAC | TGGATGAACCCTAACAG TGGTAGCACAGGCTATG CACAGAAGTTCCAGGGC | AGCAGTGGCTGGTACTACTT TGACTAC |
| | | | SEQ ID NO:5537 | SEQ ID NO:13549 | SEQ ID NO:21561 |
| | | AA | NYDIN | WMNPNSGSTGYAQKFQG | SSGWYYFDY |
| | | | SEQ ID NO:5538 | SEQ ID NO:13550 | SEQ ID NO:21562 |
| iPS:434297 | 21-225_58A10 | NA | AGCTATGCCATGAGC | GCTATTAGTGGTAGTGGT GGTAACACATTCTACGC AGACTCCGTGAAGGGC | TTTTTCGGTATAGTGGAGC CGGGTACTTTGACTAC |
| | | | SEQ ID NO:5539 | SEQ ID NO:13551 | SEQ ID NO:21563 |
| | | AA | SYAMS | AISGSGGNTFYADSVKG | FFGIVGAGYFDY |
| | | | SEQ ID NO:5540 | SEQ ID NO:13552 | SEQ ID NO:21564 |

FIGURE 49
(Continued)

| | | | | | | |
|---|---|---|---|---|---|---|
| iPS:434299 | 21-225_58D11 | NA | GACTATGACATACAC | | GTTATATGGTATGATGG AAGTAAAAATATTATG CAGACTCCGTGAAGGGC | GATCGGGTCACTTTGACTA C |
| | | | SEQ ID NO:5541 | | SEQ ID NO:13553 | SEQ ID NO:21565 |
| | | AA | DYDIH | | VIWYDGSKKYYADSVKG | DRVTFDY |
| | | | SEQ ID NO:5542 | | SEQ ID NO:13554 | SEQ ID NO:21566 |
| iPS:434301 | 21-225_58F11 | NA | AGCTATGCCATGAGC | | GCTATTAGTGGTAGTGGT GGTAACACATTCTACGC AGACTCCGTGAAGGGC | TTTTTCGGTATGGTGGGAGC CGGATTCTTTGACTAC |
| | | | SEQ ID NO:5543 | | SEQ ID NO:13555 | SEQ ID NO:21567 |
| | | AA | SYAMS | | AISGSGGNTFYADSVKG | FFGMVGAGFFDY |
| | | | SEQ ID NO:5544 | | SEQ ID NO:13556 | SEQ ID NO:21568 |
| iPS:434303 | 21-225_58H11 | NA | AGCTATGGCATGCAC | | GTTATATGGTATGATGG AAGTAATAAATACCATG CAGACTCCGTGAAGGGC | CGGTATAGCAGCAGCTGGGA CGGGGGTATGGACGTC |
| | | | SEQ ID NO:5545 | | SEQ ID NO:13557 | SEQ ID NO:21569 |
| | | AA | SYGMH | | VIWYDGSNKYHADSVKG | RYSSSWDGGMDV |
| | | | SEQ ID NO:5546 | | SEQ ID NO:13558 | SEQ ID NO:21570 |
| iPS:434305 | 21-225_59E1 | NA | AATTATGATATCAAC | | TGGATGACTCCTAACAG TGGTAACACAGGCTATG CACAGAAGTTCCAGGGC | AGCAGTGGCTGGTACTTCTT TGACTAC |
| | | | SEQ ID NO:5547 | | SEQ ID NO:13559 | SEQ ID NO:21571 |
| | | AA | NYDIN | | WMTPNSGNTGYAQKFQG | SSGWYFFDY |
| | | | SEQ ID NO:5548 | | SEQ ID NO:13560 | SEQ ID NO:21572 |

FIGURE 49
(Continued)

| | | | | | |
|---|---|---|---|---|---|
| iPS:434307 | 21-225_59B2 | NA | GGCTACTATATACAC | TGGATCAACCCTAACAGTGGTGGCACAAACTATGCACAGAAGTTTCAGGGC | GATCCGGGGCCCTTTGACTAC |
| | | | SEQ ID NO:5549 | SEQ ID NO:13561 | SEQ ID NO:21573 |
| | | AA | GYYIH | WINPNSGGTNYAQKFQG | DPGPFDY |
| | | | SEQ ID NO:5550 | SEQ ID NO:13562 | SEQ ID NO:21574 |
| iPS:434309 | 21-225_59B5 | NA | AGCTATGCCATGAAC | GCTATTAGTGGTAGTGGTGGTAACACATTCTACGCAGACTCCGTGAAGGGC | AGGGGGGTCTACGGTGACTACCGAGGCTTTTGATATC |
| | | | SEQ ID NO:5551 | SEQ ID NO:13563 | SEQ ID NO:21575 |
| | | AA | SYAMN | AISGSGGNTFYADSVKG | RGVYGDYEAFDI |
| | | | SEQ ID NO:5552 | SEQ ID NO:13564 | SEQ ID NO:21576 |
| iPS:434311 | 21-225_59H5 | NA | AGCTATGGCATGCAC | GTTATATGGTATGATGGAAGTAATAAATACTATGCAGACTCCGTGAAGGGC | GAGAGGGGTATAGCAGTGGGGTACTACGGTATGGACGTC |
| | | | SEQ ID NO:5553 | SEQ ID NO:13565 | SEQ ID NO:21577 |
| | | AA | SYGMH | VIWYDGSNKYYADSVKG | ERGIAVGYYGMDV |
| | | | SEQ ID NO:5554 | SEQ ID NO:13566 | SEQ ID NO:21578 |
| iPS:434313 | 21-225_59E6 | NA | AGAAGTAGTTACTACTGGGGC | AATATCTATTATAGTGGGAGCACCTACTACAACCCGTCCCTCAAGAGT | CATAGCAGCAGCTGGTCCCTTGACTAC |
| | | | SEQ ID NO:5555 | SEQ ID NO:13567 | SEQ ID NO:21579 |
| | | AA | RSSYYWG | NIYYSGSTYYNPSLKS | HSSSWSLDY |
| | | | SEQ ID NO:5556 | SEQ ID NO:13568 | SEQ ID NO:21580 |
| iPS:434315 | 21-225_59G7 | NA | GGCCACTATATACAC | TGGATCAACCCGAACAGTGGTGGCACAAACTATGTACAGAAATTTCAGGGC | GGGGGCCTACTGGGAGCTACCAACTACTACTACGGTATGGACGTC |

FIGURE 49
(Continued)

| | | | SEQ ID NO:5557 | SEQ ID NO:13569 | SEQ ID NO:21581 |
|---|---|---|---|---|---|
| iPS:434317 | 21-225_59E8 | AA | GHYIH | WINPNSGGTNYVQKFQG | GGLLGATNYYYGMDV |
| | | NA | SEQ ID NO:5558 AGCTATAGCATGAAT | SEQ ID NO:13570 TACATTAGTAGTAGTAGT GGGACCATATACTACGC AGACTCTGTGAAGGGC | SEQ ID NO:21582 GAATGGGGAATGGCAGTGGC TGGCCCGTTTGACTAC |
| iPS:434319 | 21-225_59B9 | AA | SEQ ID NO:5559 SYSMN | SEQ ID NO:13571 YISSSSGTIYYADSVKG | SEQ ID NO:21583 EWGMAVAGPFDY |
| | | NA | SEQ ID NO:5560 GGCAATTATATACAC | SEQ ID NO:13572 TGGATCAACCCTAACAG TGGTGGCACAAACTATG TACAGAAGTTCAGGGC | SEQ ID NO:21584 GGGGGCCTACTGGGAGCTAC CTACTACTACTACTACGGTA TGGACGTC |
| iPS:434321 | 21-225_59F10 | AA | SEQ ID NO:5561 GNYIH | SEQ ID NO:13573 WINPNSGGTNYVQKFQG | SEQ ID NO:21585 GGLLGATYYYYGMDV |
| | | NA | SEQ ID NO:5562 AATTATGATATCAAC | SEQ ID NO:13574 TGGATGAACCCTAACAG TGGTAACACAGGCTATG CACAGAAGTTCCAGGGC | SEQ ID NO:21586 AGCAGTGGCTGGTACTACTT TGACTAC |
| iPS:434323 | 21-225_62H8 | AA | SEQ ID NO:5563 NYDIN | SEQ ID NO:13575 WMNPNSGNTGYAQKFQG | SEQ ID NO:21587 SSGWYYFDY |
| | | NA | SEQ ID NO:5564 ACCTATGGCATGCAC | SEQ ID NO:13576 GTTATATGGCATGATGG AAGTGATAAATATTATG TAGACTCCGTGAAGGGC | SEQ ID NO:21588 GAAGACCCGCGTACCAGCTG CTCTGACTAC |
| | | AA | SEQ ID NO:5565 TYGMH | SEQ ID NO:13577 VIWHDGSDKYYVDSVKG | SEQ ID NO:21589 EDPRTSCSDY |
| | | | SEQ ID NO:5566 | SEQ ID NO:13578 | SEQ ID NO:21590 |

FIGURE 49
(Continued)

| | | | | |
|---|---|---|---|---|
| iPS:434327 | 21-225_63G6 | NA | AGCTATGGCATGCAC | GTTATATGGTATGATGG AAGTAATAAATACTATG CAGACTCCGTGAAGGGC | GATAGCCTCTCGGGTATAGC AGCAGCTTTGACTAC |
| | | | SEQ ID NO:5567 | SEQ ID NO:13579 | SEQ ID NO:21591 |
| | | AA | SYGMH | VIWYDGSNKYYADSVKG | DSLSGIAAAFDY |
| | | | SEQ ID NO:5568 | SEQ ID NO:13580 | SEQ ID NO:21592 |
| iPS:434331 | 21-225_63H8 | NA | AGCTATAACATGAAC | TCCATTAGTGGTAGTAGC ACTTACATGAACTACAC AGACTCAGTGAAGGGC | CTACGTAATTTTGACTAC |
| | | | SEQ ID NO:5569 | SEQ ID NO:13581 | SEQ ID NO:21593 |
| | | AA | SYNMN | SISGSSTYMNYTDSVKG | LRNFDY |
| | | | SEQ ID NO:5570 | SEQ ID NO:13582 | SEQ ID NO:21594 |
| iPS:434333 | 21-225_63C9 | NA | GGCTACTATATGCAC | TGGATCAACCCTAACAG TGGTGGCACAAACTTTG CACAGAAGTTTCAGGGC | GCTCCGGGTGTAGCAGCAGC TGGTTCATGGGGATACTTTG ACTAC |
| | | | SEQ ID NO:5571 | SEQ ID NO:13583 | SEQ ID NO:21595 |
| | | AA | GYYMH | WINPNSGGTNFAQKFQG | APGVAAAGSWGYFDY |
| | | | SEQ ID NO:5572 | SEQ ID NO:13584 | SEQ ID NO:21596 |
| iPS:434335 | 21-225_63C10 | NA | AGCTATGGCATGCAC | GTCATATGGTATGATGG AAGTAATAAATACTATG CAGACTCCGTGAAGGGC | GATGATCCCAGATCCTCGGC CGGGGACTAC |
| | | | SEQ ID NO:5573 | SEQ ID NO:13585 | SEQ ID NO:21597 |
| | | AA | SYGMH | VIWYDGSNKYYADSVKG | DDPRSSAGDY |
| | | | SEQ ID NO:5574 | SEQ ID NO:13586 | SEQ ID NO:21598 |

FIGURE 49
(Continued)

| | | | | |
|---|---|---|---|---|
| iPS:434337 | 21-225_64E1 | NA | AGCTATGGCATGCAC | GTTATATGGTTTGATGAAACTAATAAATACTATGGAGACTCCGTGAAGGGC | GAGCTTGGGGTTCAGCAGTGACTAT |
| | | | SEQ ID NO:5575 | SEQ ID NO:13587 | SEQ ID NO:21599 |
| | | AA | SYGMH | VIWFDETNKYYGDSVKG | ELGFSSDY |
| | | | SEQ ID NO:5576 | SEQ ID NO:13588 | SEQ ID NO:21600 |
| iPS:434339 | 21-225_64A4 | NA | GATTATGTCATGCAC | GTCATATGGTATGATGGAAGTAATAAATACTATGCAGACTCCGTGAAGGGC | GAAAGGTATAGCAGCAGCTGGTACGACTACGGTATGGACGTC |
| | | | SEQ ID NO:5577 | SEQ ID NO:13589 | SEQ ID NO:21601 |
| | | AA | DYVMH | VIWYDGSNKYYADSVKG | ERYSSSWYDYGMDV |
| | | | SEQ ID NO:5578 | SEQ ID NO:13590 | SEQ ID NO:21602 |
| iPS:434341 | 21-225_64F7 | NA | AGTTACTTCTGGAGC | CGTATCTATACCAGTGGGATCTCCAACTACAATCCTACCTCCCTCAAGAGT | TTTAGCAGTGGCTTTTTGAC |
| | | | SEQ ID NO:5579 | SEQ ID NO:13591 | SEQ ID NO:21603 |
| | | AA | SYFWS | RIYTSGISNYNPSLKS | FSSGFFDY |
| | | | SEQ ID NO:5580 | SEQ ID NO:13592 | SEQ ID NO:21604 |
| iPS:434343 | 21-225_64C8 | NA | GACTATGTCATGCAC | GTTATATGGTATGATGGAAGTAATAAATACTATGCAGACTCCATGAAGGGC | GAACGGTATAGCAGCAGTGGCTGGTACGACTACGGTATGGACGTC |
| | | | SEQ ID NO:5581 | SEQ ID NO:13593 | SEQ ID NO:21605 |
| | | AA | DYVMH | VIWYDGSNKYYADSMKG | ERYSSGWYDYGMDV |
| | | | SEQ ID NO:5582 | SEQ ID NO:13594 | SEQ ID NO:21606 |

FIGURE 49
(Continued)

| | | | | | |
|---|---|---|---|---|---|
| iPS:434345 | 21-225_64H9 | NA | ACCTATGGCATGCAC | ATTATATGGTATGATGG AAGTAATAAATACTATG CAGACTCCGTGAAGGGC | GATACATACGATTTTTGGAG TGGTTATTTGGGCTAC |
| | | | SEQ ID NO:5583 | SEQ ID NO:13595 | SEQ ID NO:21607 |
| | | AA | TYGMH | IIWYDGSNKYYADSVKG | DTYDFWSGYLGY |
| | | | SEQ ID NO:5584 | SEQ ID NO:13596 | SEQ ID NO:21608 |
| iPS:434347 | 21-225_64H10 | NA | GGCTACTATATGCAC | TGGATCAAACCAAACAG TGGTGGCACAAACCAAG CACAGAAGTTTCAGGGC | GCTCCGGGTACTGCAGCAAC TGGTACATGGGGATACTTTG ACTAC |
| | | | SEQ ID NO:5585 | SEQ ID NO:13597 | SEQ ID NO:21609 |
| | | AA | GYYMH | WIKPNSGGTNQAQKFQG | APGTAATGTWGYFDY |
| | | | SEQ ID NO:5586 | SEQ ID NO:13598 | SEQ ID NO:21610 |
| iPS:434351 | 21-225_64A12 | NA | AGCTATGGCATGCAC | GTTATATGGTATGATGA AAGTAATAAATACTATG TAGACTCCGTGAAGGGC | GAACTCGGGTTCCTCTCTGA CCAC |
| | | | SEQ ID NO:5587 | SEQ ID NO:13599 | SEQ ID NO:21611 |
| | | AA | SYGMH | VIWYDESNKYYVDSVKG | ELGFLSDH |
| | | | SEQ ID NO:5588 | SEQ ID NO:13600 | SEQ ID NO:21612 |
| iPS:434353 | 21-225_64B12 | NA | AGAAGTAGTTACTACTGGGG C | AGTATCTATTACAGTGG GAGCACCTCCTACAACC CGTCCCTCAAGAGT | CTGGACAGTGGCTGGTCCTT TGACTAC |
| | | | SEQ ID NO:5589 | SEQ ID NO:13601 | SEQ ID NO:21613 |
| | | AA | RSSYYWG | SIYYSGSTSYNPSLKS | LDSGWSFDY |
| | | | SEQ ID NO:5590 | SEQ ID NO:13602 | SEQ ID NO:21614 |

FIGURE 49
(Continued)

| | | | | |
|---|---|---|---|---|
| iPS:434355 | 21-225_64G12 | NA | AGTAATGCCATGAGC | GTTATTAGTGGTAGTGGT GGTAGCACATACTACGC AGACTCCGTGAAGGGC | AGGAACTACGACGATGCTTT TGATATC |
| | | | SEQ ID NO:5591 | SEQ ID NO:13603 | SEQ ID NO:21615 |
| | | AA | SNAMS | VISGSGSTYYADSVKG | RNYDDAFDI |
| | | | SEQ ID NO:5592 | SEQ ID NO:13604 | SEQ ID NO:21616 |
| iPS:434357 | 21-225_65C1 | NA | GACTATGGCATGCAC | GTGATATGTTTGAGGG AAGTAATAAACACTATA CAGACTCCGTGAAGGGC | GAACTTGGGTTCAGCAGTGA CTAC |
| | | | SEQ ID NO:5593 | SEQ ID NO:13605 | SEQ ID NO:21617 |
| | | AA | DYGMH | VIWFEGSNKHYTDSVKG | ELGFSSDY |
| | | | SEQ ID NO:5594 | SEQ ID NO:13606 | SEQ ID NO:21618 |
| iPS:434359 | 21-225_65G3 | NA | GGCTACTATATACAC | TGGATCAACCCTAACAG TGGTGGCACAAACTCTG CACAGAAGTTTCAGGGC | GCTCCGGGTAAAGCAGCAGC TGGTACATGGGGATACTTTG ACTAC |
| | | | SEQ ID NO:5595 | SEQ ID NO:13607 | SEQ ID NO:21619 |
| | | AA | GYYIH | WINPNSGGTNSAQKFQG | APGKAAAGTWGYFDY |
| | | | SEQ ID NO:5596 | SEQ ID NO:13608 | SEQ ID NO:21620 |
| iPS:434361 | 21-225_65D5 | NA | AGCTATGGTATCAGT | TGGATCAGCGCTTACAG TGGTAACACAAACTATG CACAGAAGCTCCAGGGC | GGGGAAGCAGTGGCTGTCTT CGACCCC |
| | | | SEQ ID NO:5597 | SEQ ID NO:13609 | SEQ ID NO:21621 |
| | | AA | SYGIS | WISAYSGNTNYAQKLQG | GEAVAVFDP |
| | | | SEQ ID NO:5598 | SEQ ID NO:13610 | SEQ ID NO:21622 |
| iPS:434363 | 21_225_65A6 | NA | AACTATGGCATGCAC | GTTATATGGTATGATGG AAGTAATAAATACTATG GAGACTCCGTGAAGGGC | GATCAGGGCATAGTGGGAGC TACTTGGTTTGACTAC |

FIGURE 49
(Continued)

| | | | SEQ ID NO:5599 NYGMH | SEQ ID NO:13611 VIWYDGSNKYYGDSVKG | SEQ ID NO:21623 DQGIVGATWFDY |
|---|---|---|---|---|---|
| iPS:434367 | 21-225_65A6 | AA | SEQ ID NO:5600 AGCTATAGGATGAAC | SEQ ID NO:13612 TCCATTAGTAGTAGTAAT AGTTCCATATACTACGCA GACTCAGTGAAGGGC | SEQ ID NO:21624 ACAAGTGGGAGC |
| iPS:434369 | 21-225_65H11 | NA | SEQ ID NO:5601 SYRMN | SEQ ID NO:13613 SISSSNSSIIYYADSVKG | SEQ ID NO:21625 TSGS |
| | | AA | SEQ ID NO:5602 GGCTACTATATGCAC | SEQ ID NO:13614 TGGATCAACCCTAACAG TGGTGGCACAAACAATG CACAGAAGTTCAGGGC | SEQ ID NO:21626 GCTCCGGGCACAGCAGCAGC TGGTACATGGGGATACTTTG ACTAC |
| iPS:434373 | 21-225_66B1 | NA | SEQ ID NO:5603 GYYMH | SEQ ID NO:13615 WINPNSGGTNNAQKFQG | SEQ ID NO:21627 APGTAAAGTWGYFDY |
| | | AA | SEQ ID NO:5604 GGCTACTATATGCAC | SEQ ID NO:13616 TGGATCAACCAACCAAACAG TGGTGGCACAAACCAAG CACAGAAGTTCCAGGGC | SEQ ID NO:21628 GCTCCGGGCACAGCAGTAGCAGC TGGTACATGGGGATACTTTG ACTAT |
| iPS:434375 | 21-225_66A7 | NA | SEQ ID NO:5605 GYYMH | SEQ ID NO:13617 WIKPNSGGTNQAQKFQG | SEQ ID NO:21629 APGTVAAGTWGYFDY |
| | | AA | SEQ ID NO:5606 GACTATGGCATGCAC | SEQ ID NO:13618 GTTATATGGTTTGAGGG AAGTCATAAATACTATA CAGACTCCGTGAAGGGC | SEQ ID NO:21630 GAACTGGGTTCAGCAGTGA CTAC |
| | 21-225_66C7 | NA | SEQ ID NO:5607 DYGMH | SEQ ID NO:13619 VIWFEGSHKYYTDSVKG | SEQ ID NO:21631 ELGFSSDY |
| | | AA | SEQ ID NO:5608 | SEQ ID NO:13620 | SEQ ID NO:21632 |

FIGURE 49
(Continued)

| | | | | |
|---|---|---|---|---|
| iPS:434379 | 21-225_66A9 | NA | AGCTATGGCATGCAC | GTTATATGGCATGATGG AAGTGATAAATACTATG CAGACTCCGTGAAGGGC | GAAGACCCGCGTACCAGTTG TTCTGACTAC |
| | | | SEQ ID NO:5609 | SEQ ID NO:13621 | SEQ ID NO:21633 |
| | | AA | SYGMH | VIWHDGSDKYYADSVKG | EDPRTSCSDY |
| | | | SEQ ID NO:5610 | SEQ ID NO:13622 | SEQ ID NO:21634 |
| iPS:434383 | 21-225_66F9 | NA | AGCTATAGCATGAAC | TCCATTAGTGGTACTAGT AGTTACATATACTACGC AGACTCAGTGAAGGGC | ACCAATGCTTTTGATATC |
| | | | SEQ ID NO:5611 | SEQ ID NO:13623 | SEQ ID NO:21635 |
| | | AA | SYSMN | SISGTSSYIYYADSVKG | TNAFDI |
| | | | SEQ ID NO:5612 | SEQ ID NO:13624 | SEQ ID NO:21636 |
| iPS:434385 | 21-225_66C10 | NA | AGCTATGTTATGAGC | GGTATTAGTGGTAGTGG TGCTAGAACATACTACG CAGACTCCGTGAAGGGC | CTGGGGATAGACTACTACTA CGGTATGGACGTC |
| | | | SEQ ID NO:5613 | SEQ ID NO:13625 | SEQ ID NO:21637 |
| | | AA | SYVMS | GISGSGARTYYADSVKG | LGIDYYYGMDV |
| | | | SEQ ID NO:5614 | SEQ ID NO:13626 | SEQ ID NO:21638 |
| iPS:434387 | 21-225_66D11 | NA | AGTTATGGCATGCAC | GTTATATGTATGATGATG AAGTAATAAATACTATG CAGACTCCGTGAAGGGC | GAGATGTATAGCAGCAACTG GTACGACTACGGTTTGGACG TC |
| | | | SEQ ID NO:5615 | SEQ ID NO:13627 | SEQ ID NO:21639 |
| | | AA | SYGMH | VIWYDGSNKYYADSVKG | EMYSSNWYDYGLDV |
| | | | SEQ ID NO:5616 | SEQ ID NO:13628 | SEQ ID NO:21640 |

FIGURE 49
(Continued)

| | | | | GGCTACCATATGCAC | TGGATCAACCCTAACAATGGTGGCACACACTATGCACAGAAGTTTCAGGAC | GATAGTAGAAGTTCGTGGGACTAC |
|---|---|---|---|---|---|---|
| iPS:434389 | 21-225_66F11 | NA | | SEQ ID NO:5617 | SEQ ID NO:13629 | SEQ ID NO:21641 |
| | | AA | | GYHMH | WINPNNGGTHYAQKFQD | DSRSSWDY |
| | | | | SEQ ID NO:5618 | SEQ ID NO:13630 | SEQ ID NO:21642 |
| iPS:434393 | 21-225_67C3 | NA | | AGTTATGGCATGCAC | GCTATATGGTATGATGGAAGTAATAAATATTATGGAGACTCCGTGAAGGGC | GATCAGGGCATAGTGGGAGCTACTTGGTTTGACTAC |
| | | | | SEQ ID NO:5619 | SEQ ID NO:13631 | SEQ ID NO:21643 |
| | | AA | | SYGMH | AIWYDGSNKYYGDSVKG | DQGIVGATWFDY |
| | | | | SEQ ID NO:5620 | SEQ ID NO:13632 | SEQ ID NO:21644 |
| iPS:434397 | 21-225_67H4 | NA | | GGCTACTATATGCAC | TGGATCAAACCAAACAGTGGTGCACAAACCAAGCACAGAAGTTTCAGGGC | GCTCCGGGTACTGCAGCAACTGGTACATGGGGATACTTTGACTAC |
| | | | | SEQ ID NO:5621 | SEQ ID NO:13633 | SEQ ID NO:21645 |
| | | AA | | GYYMH | WIKPNSGGTNQAQKFQG | APGTAATGTWGYFDY |
| | | | | SEQ ID NO:5622 | SEQ ID NO:13634 | SEQ ID NO:21646 |
| iPS:434399 | 21-225_67B7 | NA | | AACTATGGCATGCAC | GTTATATTATATGATGAAGTAAGAAATACTATGCAGACTCCGTGAAGGGC | AGTATCCCGGAATTTGACTAT |
| | | | | SEQ ID NO:5623 | SEQ ID NO:13635 | SEQ ID NO:21647 |
| | | AA | | NYGMH | VILYDGSKKYYADSVKG | SIPEFDY |
| | | | | SEQ ID NO:5624 | SEQ ID NO:13636 | SEQ ID NO:21648 |

FIGURE 49
(Continued)

| | | | | |
|---|---|---|---|---|
| iPS:434405 | 21-225_68E6 | NA | AGCTTTGGCATGAAC | TACATTAGTAGAAGTAG TAGTCACATATACGC AGACTCAGTGAAGGGC | TCTAGTGGGAGCCCCTTTGA CTAC |
| | | | SEQ ID NO:5625 | SEQ ID NO:13637 | SEQ ID NO:21649 |
| | | AA | SFGMN | YISRSSSHIYYADSVKG | SSGSPFDY |
| | | | SEQ ID NO:5626 | SEQ ID NO:13638 | SEQ ID NO:21650 |
| iPS:434407 | 21-225_68G8 | NA | AGCTATAGGCATGAAC | TCCATTAGTGGTAGTAGT AGTTACATATATTACGCA GACTCAGTGATGGGC | GTCAACAGCTTTGACTCC |
| | | | SEQ ID NO:5627 | SEQ ID NO:13639 | SEQ ID NO:21651 |
| | | AA | SYSMN | SISGSSYIYYADSVMG | VNSFDS |
| | | | SEQ ID NO:5628 | SEQ ID NO:13640 | SEQ ID NO:21652 |
| iPS:434411 | 21-225_68F11 | NA | GACTATGGCATGCAC | GTTATATGGTATGATGA AGTAATAAATACTATGC AGACTCCGTGAAGGGC | GAACTGGGGATGACCTCTGA CTGC |
| | | | SEQ ID NO:5629 | SEQ ID NO:13641 | SEQ ID NO:21653 |
| | | AA | DYGMH | VIWYDVSNKYYADSVKG | ELGMTSDC |
| | | | SEQ ID NO:5630 | SEQ ID NO:13642 | SEQ ID NO:21654 |
| iPS:434413 | 21-225_68D12 | NA | AGAAGTAGTTACTACTGGGG C | AATATCTATTATAGTGGG AGCACCTATTACATCCCG TCCCTCAAGAGT | CATAGCACCAGCTGGTCCAT TGACTAC |
| | | | SEQ ID NO:5631 | SEQ ID NO:13643 | SEQ ID NO:21655 |
| | | AA | RSSYYWG | NIYYSGSTYYIPSLKS | HSTSWSIDY |
| | | | SEQ ID NO:5632 | SEQ ID NO:13644 | SEQ ID NO:21656 |
| iPS:434417 | 21-225_69C8 | NA | AACTATGCCATGCAC | GTTATATGGTATGATGG AAGTGATAAATACTATG CAGACTCCGTGAAGGGC | GATATCCTAGCAACTCGGC GGGGACTAC |
| | | | SEQ ID NO:5633 | SEQ ID NO:13645 | SEQ ID NO:21657 |

FIGURE 49
(Continued)

| | | AA | NYAMH | | VIWYDGSDKYYADSVKG | | DIPSNSAGDY | |
|---|---|---|---|---|---|---|---|---|
| iPS:434423 | | | | SEQ ID NO:5634 | | SEQ ID NO:13646 | | SEQ ID NO:21658 |
| | 21-225_70D1 | NA | GGCTACCATATGCAC | | TGGATCAACCCTAACAGTAATGCCACAAACTATGCACAGAAGTTTCAGGGC | | GATAGCATATCGTCGTGGGACTAC | |
| | | | | SEQ ID NO:5635 | | SEQ ID NO:13647 | | SEQ ID NO:21659 |
| | | AA | GYHMH | | WINPNSNATNYAQKFQG | | DSISSWDY | |
| iPS:434425 | | | | SEQ ID NO:5636 | | SEQ ID NO:13648 | | SEQ ID NO:21660 |
| | 21-225_70A5 | NA | AGCTATGGCATGCAC | | GTTATATGGTATGATGGAAGTAATAAATACTATGCAGACTCCGTGAAGGGC | | GATCAGGGCATAGTGGGAGCTACTTGGTTTGACTAC | |
| | | | | SEQ ID NO:5637 | | SEQ ID NO:13649 | | SEQ ID NO:21661 |
| | | AA | SYGMH | | VIWYDGSNKYYADSVKG | | DQGIVGATWFDY | |
| iPS:434427 | | | | SEQ ID NO:5638 | | SEQ ID NO:13650 | | SEQ ID NO:21662 |
| | 21-225_70D6 | NA | GGCTACTACTATGCAC | | TGGATCAACCCTAAGAGTGGTGCACAAACTCTGCACAGAAGTTTCAGGGC | | GCTCCGGGTAAAGCAGCAGCTGGTACATGGGGATTCTTTGACTAC | |
| | | | | SEQ ID NO:5639 | | SEQ ID NO:13651 | | SEQ ID NO:21663 |
| | | AA | GYYMH | | WINPKSGGTNSAQKFQG | | APGKAAAGTWGFFDY | |
| iPS:434429 | | | | SEQ ID NO:5640 | | SEQ ID NO:13652 | | SEQ ID NO:21664 |
| | 21-225_70H6 | NA | AGTTATGGCATGCAC | | GTTATATGGCATGATGGAAGTAATAAATACTATGCAGACTCCGTGAAGGGC | | GATGATCCAGATCCTCGGCCGGGGACTAC | |
| | | | | SEQ ID NO:5641 | | SEQ ID NO:13653 | | SEQ ID NO:21665 |
| | | AA | SYGMH | | VIWHDGSNKYYADSVKG | | DDPRSSAGDY | |

FIGURE 49
(Continued)

| | | | | | | |
|---|---|---|---|---|---|---|
| iPS:434431 | 21-225_70E7 | NA | SEQ ID NO:5642<br>AATTATGATATCAAC | SEQ ID NO:13654<br>TGGATGCACCTAACAG<br>TGGTAACACAGGCTATG<br>CACAGAAGTTCCAGGGC | SEQ ID NO:21666<br>AGCAGTGGCTGGTACGTCTT<br>TGACTAC | |
| | | AA | SEQ ID NO:5643<br>NYDIN | SEQ ID NO:13655<br>WMHPNSGNTGYAQKFQG | SEQ ID NO:21667<br>SSGWYVFDY | |
| iPS:434433 | 21-225_70E8 | NA | SEQ ID NO:5644<br>AGCTATGGCATGCTC | SEQ ID NO:13656<br>ATTATATGGTATGATGA<br>AAGTAATAAATACTATG<br>CAGACTCCGTGAAGGGC | SEQ ID NO:21668<br>GACCTACTGGACCCACGGGA<br>CTAC | |
| | | AA | SEQ ID NO:5645<br>SYGML | SEQ ID NO:13657<br>IIWYDESNKYYADSVKG | SEQ ID NO:21669<br>DLLDPRDY | |
| iPS:434435 | 21-225_70G9 | NA | SEQ ID NO:5646<br>GGCTACTATATGCAC | SEQ ID NO:13658<br>TGGATCAAACCTAACAG<br>TGGTGGCACAAACCAAG<br>CACAGAAGTTTCAGGGC | SEQ ID NO:21670<br>GCTCCGGGTATAGCAGCAGC<br>TGGTACATGGGGATACTTTG<br>ACTAC | |
| | | AA | SEQ ID NO:5647<br>GYYMH | SEQ ID NO:13659<br>WIKPNSGGTNQAQKFQG | SEQ ID NO:21671<br>APGIAAAGTWGYFDY | |
| iPS:434437 | 21-225_70A12 | NA | SEQ ID NO:5648<br>GGCTACTATATGCAC | SEQ ID NO:13660<br>TGGATCAAACCAAACAG<br>TGGTGGCACAAACCAAG<br>CACAGAAGTTTCAGGGC | SEQ ID NO:21672<br>GCTCCGGGTACTGCAGCAAC<br>TGGTACATGGGGATACTTTG<br>ACTAC | |
| | | AA | SEQ ID NO:5649<br>GYYMH | SEQ ID NO:13661<br>WIKPNSGGTNQAQKFQG | SEQ ID NO:21673<br>APGTAATGTWGYFDY | |
| | | | SEQ ID NO:5650 | SEQ ID NO:13662 | SEQ ID NO:21674 | |

FIGURE 49
(Continued)

| | | | | | | |
|---|---|---|---|---|---|---|
| iPS:434439 | 21-225_70E12 | NA | AGCTATAGCATGAAC | | TCCATTAGTGGTAATAGT ACTTACATATACTACACA GACTCAGTGAAGGGC | GTGGCCGCGCCTTTGACTGC |
| | | | SEQ ID NO:5651 | | SEQ ID NO:13663 | SEQ ID NO:21675 |
| | | AA | SYSMN | | SISGNSTYIYYTDSVKG | VAAFDC |
| | | | SEQ ID NO:5652 | | SEQ ID NO:13664 | SEQ ID NO:21676 |
| iPS:434441 | 21-225_71A2 | NA | GACTATGGCATGCAC | | GTGATATGGTATGATGA AGTAATAAATACTATG CAGACTCCGTGAAGGGC | GAATTGGGGTGGCAGGATGA TTAC |
| | | | SEQ ID NO:5653 | | SEQ ID NO:13665 | SEQ ID NO:21677 |
| | | AA | DYGMH | | VIWYDESNKYYADSVKG | ELGWQDDY |
| | | | SEQ ID NO:5654 | | SEQ ID NO:13666 | SEQ ID NO:21678 |
| iPS:434443 | 21-225_71G3 | NA | AATTATGATATCAAC | | TGGATGCACCCTAACAG TGGTAGCACAGGCTATG CACAGAAGTTCCAGGGC | AGCAGTGGCTGGTACTACTT TGACTAC |
| | | | SEQ ID NO:5655 | | SEQ ID NO:13667 | SEQ ID NO:21679 |
| | | AA | NYDIN | | WMHPNSGSTGYAQKFQG | SSGWYYFDY |
| | | | SEQ ID NO:5656 | | SEQ ID NO:13668 | SEQ ID NO:21680 |
| iPS:434447 | 21-225_71B6 | NA | AACTATGGCATGCAC | | GTTATTGGTATGATAGA ACAAATAAATACTATGC AGACTCCGTGAAGGGC | GAACTGGGGATGTTGTCTGA CTAC |
| | | | SEQ ID NO:5657 | | SEQ ID NO:13669 | SEQ ID NO:21681 |
| | | AA | NYGMH | | VIWYDRTNKYYADSVKG | ELGMLSDY |
| | | | SEQ ID NO:5658 | | SEQ ID NO:13670 | SEQ ID NO:21682 |

FIGURE 49
(Continued)

| | | | | |
|---|---|---|---|---|
| iPS:434449 | 21-225_71H6 | NA | AGCTATAGCATGAAC | TCCATTAGTGTGGTACTAGT AGTTACATATACTACGC AGACTCAGTGAAGGGC | ACCAATGCTTTGATATC |
| | | | SEQ ID NO:5659 | SEQ ID NO:13671 | SEQ ID NO:21683 |
| | | AA | SYSMN | SISGTSSYIYYADSVKG | TNAFDI |
| | | | SEQ ID NO:5660 | SEQ ID NO:13672 | SEQ ID NO:21684 |
| iPS:434451 | 21-225_71B7 | NA | GGCTACTATATGCAC | TGGATCAACCCTAACAG TGGTGGCACAAACTCTG CACAGAAGTTTCAGGGC | GCTCCGGGTAAAGCAGCAGC TGGTACATGGGGATTCTTTG ACTAC |
| | | | SEQ ID NO:5661 | SEQ ID NO:13673 | SEQ ID NO:21685 |
| | | AA | GYYMH | WINPNSGGTNSAQKFQG | APGKAAAGTWGFFDY |
| | | | SEQ ID NO:5662 | SEQ ID NO:13674 | SEQ ID NO:21686 |
| iPS:434453 | 21-225_71B11 | NA | GACTATGGCATGCAC | GTTATATGGTATGATAG AAATAATAAATACTATG GAGACTCCGTGAAGGGC | GAACTGGGGATGTGTCTGA CTAC |
| | | | SEQ ID NO:5663 | SEQ ID NO:13675 | SEQ ID NO:21687 |
| | | AA | DYGMH | VIWYDRNNKYYGDSVKG | ELGMLSDY |
| | | | SEQ ID NO:5664 | SEQ ID NO:13676 | SEQ ID NO:21688 |
| iPS:434455 | 21-225_72F5 | NA | AGCTATGCCATGATC | ACTATTAGTGGTAGTGGT GGTTACACATACTCCGC AGACTCCGTGAAGGGC | CGTATAGCAGTGACTGGGAC GGAATGGTACGACCCC |
| | | | SEQ ID NO:5665 | SEQ ID NO:13677 | SEQ ID NO:21689 |
| | | AA | SYAMI | TISGSGGYTYSADSVKG | RIAVTGTEWYDP |
| | | | SEQ ID NO:5666 | SEQ ID NO:13678 | SEQ ID NO:21690 |
| iPS:434457 | 21-225_72G12 | NA | AGCTATGGCATGCAC | GTTATATGGTTTGATGAA AGTAATAAATACTATGC AGACTCCGTGAAGGGC | GAGCTTGGTTTCAGCAGTGA CTAC |

FIGURE 49
(Continued)

| | | | SEQ ID NO:5667 | SEQ ID NO:13679 | SEQ ID NO:21691 |
|---|---|---|---|---|---|
| | | AA | SYGMH | VIWFDESNKYYADSVKG | ELGFSSDY |
| iPS:434459 | 21-225_71A7 | | SEQ ID NO:5668 | SEQ ID NO:13680 | SEQ ID NO:21692 |
| | | NA | GGCTACTATATGCAC | TGGATCAACCCTAAAAG TGGTGGCACAAATTATG TACAGAAGTTTCAGGGC | GCTCCGGGTACAGCACCAGC TGGGTCATGGGGATACTTTG ACTAC |
| | | | SEQ ID NO:5669 | SEQ ID NO:13681 | SEQ ID NO:21693 |
| | | AA | GYYMH | WINPKSGGTNYVQKFQG | APGTAPAGSWGYFDY |
| iPS:434461 | 21-225_73A3 | | SEQ ID NO:5670 | SEQ ID NO:13682 | SEQ ID NO:21694 |
| | | NA | GGCTACTATATGCAC | TGGATCAACCCTAAAAG TGGTGGCACGAATCATG TCCAGAAGTTTCAGGGC | GCTCCGGGTACAGCAGCAGC TGGGTCATGGGGATGCTTTG ACTAC |
| | | | SEQ ID NO:5671 | SEQ ID NO:13683 | SEQ ID NO:21695 |
| | | AA | GYYMH | WINPKSGGTNHVQKFQG | APGTAAAGSWGCFDY |
| iPS:434463 | 21-225_73A6 | | SEQ ID NO:5672 | SEQ ID NO:13684 | SEQ ID NO:21696 |
| | | NA | TACTATGGCATGCAC | GTTATATTATATGATGGA AGTAAGAAATACTATGC AGCCTCCGTGAAGGGC | AGTATCCCGGACTTTGACTA C |
| | | | SEQ ID NO:5673 | SEQ ID NO:13685 | SEQ ID NO:21697 |
| | | AA | YYGMH | VILYDGSKKYYAASVKG | SIPDFDY |
| iPS:434467 | 21-225_73H8 | | SEQ ID NO:5674 | SEQ ID NO:13686 | SEQ ID NO:21698 |
| | | NA | AGCAATGCCATGAGC | GACATTAGTCGTAGTGG TGGTACCACATTCTACGC AGACTCCGTGAAGGGC | TGGGATAGCAGCAGCTGGTA CGACGTGACTCCCTTTGACT AC |
| | | | SEQ ID NO:5675 | SEQ ID NO:13687 | SEQ ID NO:21699 |
| | | AA | SNAMS | DISRSGGTTFYADSVKG | WDSSSWYDVTPFDY |
| | | | SEQ ID NO:5676 | SEQ ID NO:13688 | SEQ ID NO:21700 |

FIGURE 49
(Continued)

| | | NA | AATTATGTCATGCAC | GTTATATGGTATGATGG AAGTAATAAATACTATG CAGACTCCGTGAAGGGC | GAAAGGTATAGCAGCAGCTG GTTCGACTACGGTATGGACG TC |
|---|---|---|---|---|---|
| iPS:434469 | 21-225_73C9 | | SEQ ID NO:5677 | SEQ ID NO:13689 | SEQ ID NO:21701 |
| | | AA | NYVMH | VIWYDGSNKYYADSVKG | ERYSSSWFDYGMDV |
| | | | SEQ ID NO:5678 | SEQ ID NO:13690 | SEQ ID NO:21702 |
| iPS:434471 | 21-225_75G3 | NA | GGTTCCTACTGGAGC | GAAATCAATCTTAGTGG AAGTACCAACTACAACC CGTCCCTCAAGAGT | GACTACGGTGGCCTTGACTA C |
| | | | SEQ ID NO:5679 | SEQ ID NO:13691 | SEQ ID NO:21703 |
| | | AA | GSYWS | EINLSGSTNYNPSLKS | DYGGLDY |
| | | | SEQ ID NO:5680 | SEQ ID NO:13692 | SEQ ID NO:21704 |
| iPS:434473 | 21-225_76D1 | NA | GGTTGCTACTGGAGC | GAAATCAATCATAGTGG AAGAACCAACTACAACC CGTCCCTCAAGAGT | GACTACGGCGGTATGGACGT C |
| | | | SEQ ID NO:5681 | SEQ ID NO:13693 | SEQ ID NO:21705 |
| | | AA | GCYWS | EINHSGRTNYNPSLKS | DYGGMDV |
| | | | SEQ ID NO:5682 | SEQ ID NO:13694 | SEQ ID NO:21706 |
| iPS:434475 | 21-225_74F9 | NA | AATTATGATATCAAC | TGGATGAACCCTAACAG TGGTAACACAGGCTGTG CACAGAAGTTCCAGGGC | AGCAGTGGCTGGAACTTCTT TGACTAC |
| | | | SEQ ID NO:5683 | SEQ ID NO:13695 | SEQ ID NO:21707 |
| | | AA | NYDIN | WMNPNSGNTGCAQKFQG | SSGWNFFDY |
| | | | SEQ ID NO:5684 | SEQ ID NO:13696 | SEQ ID NO:21708 |
| iPS:434477 | | NA | AATTATGATATCAAC | TGGATGCACCCTAACAG TGGTAACACAGGCTATG CACAGAAGTTCCGGGGC | AGCAGTGGCTGGTACTACTT TGACTAC |

FIGURE 49
(Continued)

| | | | | SEQ ID NO:5685 NYDIN | SEQ ID NO:13697 WMHPNSGNTGYAQKFRG | SEQ ID NO:21709 SSGWYYFDY |
|---|---|---|---|---|---|---|
| iPS:434479 | 21-225_74A6 | | AA | SEQ ID NO:5686 AATTATGATATCAAC | SEQ ID NO:13698 TGGATGCACCCTAACAG TGGTAACACAGGCTATG CACAGAAGTTCCAGGGC | SEQ ID NO:21710 AGTAGTGGCTGGTACTGGTT CGACCCC |
| | 21-225_76H1 | | NA | SEQ ID NO:5687 | SEQ ID NO:13699 | SEQ ID NO:21711 |
| iPS:434481 | | | AA | SEQ ID NO:5688 NYDIN | SEQ ID NO:13700 WMHPNSGNTGYAQKFQG | SEQ ID NO:21712 SSGWYWFDP |
| | 21-225_74B10 | | NA | SEQ ID NO:5689 AATTATGATATCAAC | SEQ ID NO:13701 TGGATGCACCCTAACAG TGGTAACACAGGCTTTG CACAGAAGTTCCAGGGC | SEQ ID NO:21713 TCCAGTGGCTGGTACTGGTT CGACCCC |
| iPS:434483 | | | AA | SEQ ID NO:5690 NYDIN | SEQ ID NO:13702 WMHPNSGNTGFAQKFQG | SEQ ID NO:21714 SSGWYWFDP |
| | 21-225_74C12 | | NA | SEQ ID NO:5691 AATTATGATATCAAC | SEQ ID NO:13703 TGGATGAACCCTAACAG TGGTAACACAGGCTATG CACAGAAGTTCCAGGGC | SEQ ID NO:21715 AGCAGTGGCTGGTACTGGTT CGACCCC |
| | | | AA | SEQ ID NO:5692 NYDIN | SEQ ID NO:13704 WMNPNSGNTGYAQKFQG | SEQ ID NO:21716 SSGWYWFDP |
| iPS:434485 | 21-225_76D2 | | NA | SEQ ID NO:5693 AGCTATGGCATGCAC | SEQ ID NO:13705 GTTATTTGGTATGATGGA AGTAATAAATACTATGC AGACTCCGTGAAGGGC | SEQ ID NO:21717 GATCGCAATATAGTGGGAGC TACTTACTTTGAGTCC |

FIGURE 49
(Continued)

| | | | | SYGMH | | VIWYDGSNKYYADSVKG | DRNIVGATYFES |
|---|---|---|---|---|---|---|---|
| iPS:434487 | | | AA | SEQ ID NO:5694 | | SEQ ID NO:13706 | SEQ ID NO:21718 |
| | 21-225_76G2 | | NA | AATTATGATATCAAC | | TGGATGAACCCTAACAG TGGTAACACAGGCTATG CACAGAAGTTCCAGGGC | AGCAGTGGCTGGTACATGTT TGACTAC |
| | | | | | | SEQ ID NO:13707 | SEQ ID NO:21719 |
| iPS:434489 | | | AA | SEQ ID NO:5695 NYDIN | | WMNPNSGNTGYAQKFQG | SSGWYMFDY |
| | | | | SEQ ID NO:5696 | | SEQ ID NO:13708 | SEQ ID NO:21720 |
| | 21-225_74E4 | | NA | AGTAGTAATTACTACTGGGG C | | AGTATCTATTATAGTGGA TACACCTCTACAACCCG TCCCTCAAGAGT | CTTGACTCTAACTGGGGTCT TGACTAC |
| | | | | | | SEQ ID NO:13709 | SEQ ID NO:21721 |
| | | | AA | SEQ ID NO:5697 SSNYYWG | | SIYYSGYTSYNPSLKS | LDSNWGLDY |
| | | | | SEQ ID NO:5698 | | SEQ ID NO:13710 | SEQ ID NO:21722 |
| iPS:434493 | | | NA | AATTATGATATCAAC | | TGGATGAACCCTAACAG TGGTAACACAGGCTATG CACAGAAGTTCCAGGGC | TCCAGTGGCTGGAACTGGTT CGACCCC |
| | 21-225_76F3 | | | | | SEQ ID NO:13711 | SEQ ID NO:21723 |
| | | | AA | SEQ ID NO:5699 NYDIN | | WMNPNSGNTGYAQKFQG | SSGWNWFDP |
| | | | | SEQ ID NO:5700 | | SEQ ID NO:13712 | SEQ ID NO:21724 |
| iPS:434495 | | | NA | GGTCCCTACTGGAGC | | GAAATCAATCATAGTGG AAGCACCAACTACAACC CGTCCCCTCACGAGT | GACTACGGGGGGTTTGGACGT C |
| | 21-225_74B2 | | | | | SEQ ID NO:13713 | SEQ ID NO:21725 |
| | | | AA | SEQ ID NO:5701 GPYWS | | EINHSGSTNYNPSLTS | DYGGLDV |
| | | | | SEQ ID NO:5702 | | SEQ ID NO:13714 | SEQ ID NO:21726 |

FIGURE 49
(Continued)

| | | | | | |
|---|---|---|---|---|---|
| iPS:434497 | 21-225_76A4 | NA | GGTTGCTACTGGAGC | GAAATCAATCATAGTGG AAGCACCAACTACAACC CGTCCCTCAAGAGT | GACTACGGCGGTATGGACGT C |
| | | AA | SEQ ID NO:5703 GCYWS | SEQ ID NO:13715 EINHSGSTNYNPSLKS | SEQ ID NO:21727 DYGGMDV |
| iPS:434501 | 21-225_76G4 | NA | SEQ ID NO:5704 GGTTGCTACTGGAGC | SEQ ID NO:13716 GAAATCAATCATAGTGG AAGCACCAACTACAACC CGTCCCTCAAGAGT | SEQ ID NO:21728 GACTACGGCGGTATGGACGT C |
| | | AA | SEQ ID NO:5705 GCYWS | SEQ ID NO:13717 EINHSGSTNYNPSLKS | SEQ ID NO:21729 DYGGMDV |
| iPS:434503 | 21-225_74D7 | NA | SEQ ID NO:5706 AGAAGTAGTTACTACTGGGG C | SEQ ID NO:13718 GGTATCTATTATAGTGGG AGCACCTCCTACAACCC GTCCCTCAAGAGT | SEQ ID NO:21730 CTGCGACTAACTGGGACTT TGACTAC |
| | | AA | SEQ ID NO:5707 RSSYYWG | SEQ ID NO:13719 GIYYSGSTSYNPSLKS | SEQ ID NO:21731 LRPNWDFDY |
| iPS:434507 | 21-225_74C5 | NA | SEQ ID NO:5708 GGTTGCTACTGGAGC | SEQ ID NO:13720 GAAATCAATCATAGTGG ATGCACCAACTTCAACC CGTCCCTCAAGAGT | SEQ ID NO:21732 GACTACGGCGGTATGGACGT C |
| | | AA | SEQ ID NO:5709 GCYWS | SEQ ID NO:13721 EINHSGCTNFNPSLKS | SEQ ID NO:21733 DYGGMDV |
| iPS:434509 | 21-225_76F5 | NA | SEQ ID NO:5710 AATTATGATATCAAC | SEQ ID NO:13722 TGGATGAACCCTAACAG TGGTAACACAGGCTATG CACAGAAGTTCCAGGGC | SEQ ID NO:21734 AGCAGTGGCTGGTACTGGTT CGACCCC |
| | | AA | SEQ ID NO:5711 NYDIN | SEQ ID NO:13723 WMNPNSGNTGYAQKFQG | SEQ ID NO:21735 SSGWYWFDP |

FIGURE 49
(Continued)

| | | | | | |
|---|---|---|---|---|---|
| iPS:434511 | 21-225_74B11 | NA | SEQ ID NO:5712 AATTATGATATCAAC | SEQ ID NO:13724 TGGATGCACCCTAACAG TGGTAACACAGGCTATG CACAGAAGTTCCAGGGC | SEQ ID NO:21736 AGCAGTGGCTGGTACTACTT TGACTAC |
| | | AA | SEQ ID NO:5713 NYDIN | SEQ ID NO:13725 WMHPNSGNTGYAQKFQG | SEQ ID NO:21737 SSGWYYFDY |
| iPS:434513 | 21-225_76A6 | NA | SEQ ID NO:5714 AATTATGATATCAAC | SEQ ID NO:13726 TGGATGCACCCTAACAA TGGTAACACAGGCTATG CACAGAAGTTCCAGGGC | SEQ ID NO:21738 AGCAGTGGCTGGTACTGGTT CGACCCC |
| | | AA | SEQ ID NO:5715 NYDIN | SEQ ID NO:13727 WMHPNNGNTGYAQKFQG | SEQ ID NO:21739 SSGWYWFDP |
| iPS:434515 | 21-225_74A5 | NA | SEQ ID NO:5716 AATTATGATATCAAC | SEQ ID NO:13728 TGGATGCACCCTAACAG TGGTAACACAGGCTATG CACAGAAGTTCCAGGGC | SEQ ID NO:21740 AGTAGTGGCTGGTACTGGTT CGACCCC |
| | | AA | SEQ ID NO:5717 NYDIN | SEQ ID NO:13729 WMHPNSGNTGYAQKFQG | SEQ ID NO:21741 SSGWYWFDP |
| iPS:434517 | 21-225_76A7 | NA | SEQ ID NO:5718 GGTTGCTACTGGAGC | SEQ ID NO:13730 GAAATCAATCATAGTGG AAGGACCAACTACAACC CGTCCCTCAAGAGT | SEQ ID NO:21742 GACTACGGTGGGCTTGACTA C |
| | | AA | SEQ ID NO:5719 GCYWS | SEQ ID NO:13731 EINHSGRTNYNPSLKS | SEQ ID NO:21743 DYGGLDY |
| | | | SEQ ID NO:5720 | SEQ ID NO:13732 | SEQ ID NO:21744 |

FIGURE 49
(Continued)

| | | | | | | |
|---|---|---|---|---|---|---|
| iPS:434519 | 21-225_74C7 | NA | GGTTCCTACTGGAGC | | GAAATCAATCTTAGTGG AAGCACCAACTACAACC CGTCCCTCAAGAGT | | GACTACGGTGGCCTTGACTA C |
| | | AA | SEQ ID NO:5721 GSYWS | | SEQ ID NO:13733 EINLSGSTNYNPSLKS | | SEQ ID NO:21745 DYGGLDY |
| iPS:434523 | 21-225_75C3 | NA | SEQ ID NO:5722 GGTTGCTACTGGAGC | | SEQ ID NO:13734 GAAATCAATTATAGTGG AAGAACCAACTACAACC CGTCCCTCAAGAGT | | SEQ ID NO:21746 GACTACGGCGGTATGGACGT C |
| | | AA | SEQ ID NO:5723 GCYWS | | SEQ ID NO:13735 EINYSGRTNYNPSLKS | | SEQ ID NO:21747 DYGGMDV |
| iPS:434525 | 21-225_76E8 | NA | SEQ ID NO:5724 AATTATGATATCAAC | | SEQ ID NO:13736 TGGATGAACCCTAACAG TGGTAACACAGGCTATG CACAGAAGTTCCAGGGC | | SEQ ID NO:21748 TCCAGTGGCTGGCACTGGTT CGACCCC |
| | | AA | SEQ ID NO:5725 NYDIN | | SEQ ID NO:13737 WMNPNSGNTGYAQKFQG | | SEQ ID NO:21749 SSGWHWFDP |
| iPS:434529 | 21-225_76B9 | NA | SEQ ID NO:5726 AATTATGATATCAAC | | SEQ ID NO:13738 TGGATGCACCCTAACAG TGGTAACACAGGCTATG CACAGAAGTTCCAGGGC | | SEQ ID NO:21750 AGTAGTGGCTGGTACTGGTT CGACCCC |
| | | AA | SEQ ID NO:5727 NYDIN | | SEQ ID NO:13739 WMHPNSGNTGYAQKFQG | | SEQ ID NO:21751 SSGWYWFDP |
| iPS:434531 | 21_225_76C9 | NA | SEQ ID NO:5728 AACGCCTGGATGAAC | | SEQ ID NO:13740 CGTATTAAAAACAAAGC TGATGGTGGGACAACAG ACTTCGCTGCACCCGTGA AAGGC | | SEQ ID NO:21752 GTGGGACCTACTACGGACTA C |

FIGURE 49
(Continued)

| | | | | | | |
|---|---|---|---|---|---|---|
| iPS:434533 | 21-225_76C9 | AA | SEQ ID NO:5729 NAWMN | SEQ ID NO:13741 RIKNKADGGTTDPAAPVK G | SEQ ID NO:21753 VGPTTDY | |
| | | NA | SEQ ID NO:5730 GGTCCCTACTGGAGC | SEQ ID NO:13742 GAAATCAATCATAGTGG AAGCACCAACTACAACC CGTCCCTCAAGAGT | SEQ ID NO:21754 GACTACGGGGGTTTGGACGT C | |
| iPS:434535 | 21-225_85F7 | AA | SEQ ID NO:5731 GPYWS | SEQ ID NO:13743 EINHSGSTNYNPSLKS | SEQ ID NO:21755 DYGGLDV | |
| | | NA | SEQ ID NO:5732 AGCTATGGCATGCAC | SEQ ID NO:13744 GTTATATGGTATGGATGGA AGTAATAAAAACTATG CAGACTCCGTGAAGGGC | SEQ ID NO:21756 GATGGCAGCTATGGTTATGA CGGCCTTGACTAC | |
| | 21-225_74C8 | AA | SEQ ID NO:5733 SYGMH | SEQ ID NO:13745 VIWYDGSNKNYADSVKG | SEQ ID NO:21757 DGSYGYDGLDY | |
| iPS:434537 | | NA | SEQ ID NO:5734 AGCTATGGCATGCAC | SEQ ID NO:13746 GTTATTTGGTATGGATGGA AGTAATAAATACTATGC AGACTCCGTGAAGGGC | SEQ ID NO:21758 GATCGCAATATAGTGGGAGC TACTTACTTTGAGTCC | |
| | 21-225_74E11 | AA | SEQ ID NO:5735 SYGMH | SEQ ID NO:13747 VIWYDGSNKYYADSVKG | SEQ ID NO:21759 DRNIVGATYFES | |
| iPS:434539 | | NA | SEQ ID NO:5736 GATTACTACTGGAGC | SEQ ID NO:13748 GAAATCAATCATAGTGG AGACACCAACTACAACC CGTCCCTCAAGAGT | SEQ ID NO:21760 GAGTTTCCATATAGTGGAAG CTACCTCTACTACTACGGTA TGGACGTC | |
| | 21-225_74A2 | | SEQ ID NO:5737 | SEQ ID NO:13749 | SEQ ID NO:21761 | |

FIGURE 49
(Continued)

| | | AA | DYYWS | | EINHSGDTNYNPSLKS | | EFPYSGSYLYYYGMDV |
|---|---|---|---|---|---|---|---|
| iPS:434547 | | | SEQ ID NO:5738 | | SEQ ID NO:13750 | | SEQ ID NO:21762 |
| | 21-225_74H5 | NA | GGTTGCTACTGGAGC | | GAAATCAATCATAGTGG AAGGACCAACTTCAACC CGTCCCTCAAGAGT | | GACTACGGCGGTATGGACGT C |
| | | | SEQ ID NO:5739 | | SEQ ID NO:13751 | | SEQ ID NO:21763 |
| | | AA | GCYWS | | EINHSGRTNFNPSLKS | | DYGGMDV |
| iPS:434549 | | | SEQ ID NO:5740 | | SEQ ID NO:13752 | | SEQ ID NO:21764 |
| | 21-225_76E11 | NA | AATTATGATATCAAC | | TGGATGAACCCTAACAG TGGTAACACAGGCTATG CACAGAAGTTCCAGGGC | | AGCAGTGGCTGGTACTACTT TGACTAC |
| | | | SEQ ID NO:5741 | | SEQ ID NO:13753 | | SEQ ID NO:21765 |
| | | AA | NYDIN | | WMNPNSGNTGYAQKFQG | | SSGWYYFDY |
| iPS:434551 | | | SEQ ID NO:5742 | | SEQ ID NO:13754 | | SEQ ID NO:21766 |
| | 21-225_75C4 | NA | AATTATGATATCAAC | | TGGATGCATCCTAACAG TGGTAACACAGGCTATG CACAGAAGTTCCAGGGC | | AGCAGTGGCTGGTACTACTT TGACTAC |
| | | | SEQ ID NO:5743 | | SEQ ID NO:13755 | | SEQ ID NO:21767 |
| | | AA | NYDIN | | WMHPNSGNTGYAQKFQG | | SSGWYYFDY |
| iPS:434559 | | | SEQ ID NO:5744 | | SEQ ID NO:13756 | | SEQ ID NO:21768 |
| | 21-225_74D11 | NA | GGTTGCTACTGGAGC | | GAAATCAATCATAGTGG AAGCACCAACTACAACC CGTCCCTCAAGAGT | | GACTACGGCGGTATGGACGT C |
| | | | SEQ ID NO:5745 | | SEQ ID NO:13757 | | SEQ ID NO:21769 |
| | | AA | GCYWS | | EINHSGSTNYNPSLKS | | DYGGMDV |
| | | | SEQ ID NO:5746 | | SEQ ID NO:13758 | | SEQ ID NO:21770 |

FIGURE 49
(Continued)

| | | | | |
|---|---|---|---|---|
| iPS:434561 | 21-225_77G1 | NA | GGTTGCTACTGGAGC SEQ ID NO:5747 | GAAATCAATCATAGTGG AAGCACCAACTACAACC CGTCCCTCAAGAGT SEQ ID NO:13759 | GACTACGGCGGTATGGACGT C SEQ ID NO:21771 |
| | | AA | GCYWS SEQ ID NO:5748 | EINHSGSTNYNPSLKS SEQ ID NO:13760 | DYGGMDV SEQ ID NO:21772 |
| iPS:434563 | 21-225_75D8 | NA | AACTACGACATGCAC SEQ ID NO:5749 | GCTATTGGTACTGCTGGT GACACATACTATCCAGG CTCCGTGAAGGGC SEQ ID NO:13761 | GTTCTTGACTACGGTGACTC CTTGGGCTACTACTACG GTATGGACGTC SEQ ID NO:21773 |
| | | AA | NYDMH SEQ ID NO:5750 | AIGTAGDTYYPGSVKG SEQ ID NO:13762 | VLDYGDSLGYYYYGMDV SEQ ID NO:21774 |
| iPS:434565 | 21-225_75B10 | NA | GGTTACTACTGGAGC SEQ ID NO:5751 | GAAATCAATCACAGTGG AAGCACCAACTACAACC CGTCCCTCAAGAGT SEQ ID NO:13763 | GACTACGGTGGTTTGGACGT C SEQ ID NO:21775 |
| | | AA | GYYWS SEQ ID NO:5752 | EINHSGSTNYNPSLKS SEQ ID NO:13764 | DYGGLDV SEQ ID NO:21776 |
| iPS:434569 | 21-225_77H5 | NA | AATTATGGCATGCAC SEQ ID NO:5753 | GTTATATGGTATGATGG AAGAAATAAATACTATG CAGACTCCGTGAAGGGC SEQ ID NO:13765 | GATCGGAGTATATTGGGAGC TACTTTCTTTGACTAC SEQ ID NO:21777 |
| | | AA | NYGMH SEQ ID NO:5754 | VIWYDGRNKYYADSVKG SEQ ID NO:13766 | DRSILGATFFDY SEQ ID NO:21778 |
| iPS:434571 | 21-225_74D2 | NA | GGTTGCTACTGGAGC SEQ ID NO:5755 | GAAATCAATCATAGTGG AAGGACCAACTACAACC CGTCCCTCAAGAGT SEQ ID NO:13767 | GACTACGGTGGGCTTGACTA C SEQ ID NO:21779 |

FIGURE 49
(Continued)

| | | | | | | |
|---|---|---|---|---|---|---|
| iPS:434573 | 21-225_77E6 | AA | GCYWS | | EINHSGRTNYNPSLKS | DYGGLDY |
| | | | SEQ ID NO:5756 | | SEQ ID NO:13768 | SEQ ID NO:21780 |
| | | NA | AGCTATGGCATGCAC | | GTTATATGGTATGATGG AAGTAATCAAAACTATG CAGACTCCGTGAAGGGC | GATGGCAGCTATGGTTACGA CGGCCTTGACTAC |
| | | | SEQ ID NO:5757 | | SEQ ID NO:13769 | SEQ ID NO:21781 |
| | | AA | SYGMH | | VIWYDGSNQNYADSVKG | DGSYGYDGLDY |
| | | | SEQ ID NO:5758 | | SEQ ID NO:13770 | SEQ ID NO:21782 |
| iPS:434575 | 21-225_77C7 | NA | AATTATGATATCAAC | | TGGATGAACCCTAACAG TGGTAACACAGGCTATG CACAGAAGTTCCAGGGC | TCCAGTGGCTGGCACTGGTT CGACCCC |
| | | | SEQ ID NO:5759 | | SEQ ID NO:13771 | SEQ ID NO:21783 |
| | | AA | NYDIN | | WMNPNSGNTGYAQKFQG | SSGWHWFDP |
| | | | SEQ ID NO:5760 | | SEQ ID NO:13772 | SEQ ID NO:21784 |
| iPS:434579 | 21-225_77F7 | NA | GGTTGCTACTGGAGC | | GAAATCAATCATAGTGG AAGCACCAACTACAACC CGTCCCTCAAGAGT | GACTACGGCGGTATGGACGT C |
| | | | SEQ ID NO:5761 | | SEQ ID NO:13773 | SEQ ID NO:21785 |
| | | AA | GCYWS | | EINHSGTNYNPSLKS | DYGGMDV |
| | | | SEQ ID NO:5762 | | SEQ ID NO:13774 | SEQ ID NO:21786 |
| iPS:434581 | 21-225_74B12 | NA | GGTTGCTACTGGAGC | | GAAATCAATCATAGTGG AAGCACCAACTACAACC CGTCCCTCAAGAGT | GACTACGGCGGTATGGACGT C |
| | | | SEQ ID NO:5763 | | SEQ ID NO:13775 | SEQ ID NO:21787 |
| | | AA | GCYWS | | EINHSGTNYNPSLKS | DYGGMDV |
| | | | SEQ ID NO:5764 | | SEQ ID NO:13776 | SEQ ID NO:21788 |

FIGURE 49
(Continued)

| | | | | | |
|---|---|---|---|---|---|
| iPS:434583 | 21-225_74B6 | NA | AATTATGATATCAAC | TGGATGCACCCTAACAA TGGTAACACAGGCTATG CACAGAAGTTCCAGGGC | AGCAGTGGCTGGTACTGGTT CGACCCC |
| | | | SEQ ID NO:5765 | SEQ ID NO:13777 | SEQ ID NO:21789 |
| | | AA | NYDIN | WMHPNNGNTGYAQKFQG | SSGWYWFDP |
| | | | SEQ ID NO:5766 | SEQ ID NO:13778 | SEQ ID NO:21790 |
| iPS:434585 | 21-225_75A12 | NA | GGTTGCTACTGGAGC | GAAATCAATTATAGTGG AAGAACCAACTACAACC CGTCCCTCAAGAGT | GACTACGGCGGTATGGACGT C |
| | | | SEQ ID NO:5767 | SEQ ID NO:13779 | SEQ ID NO:21791 |
| | | AA | GCYWS | EINYSGRTNYNPSLKS | DYGGMDV |
| | | | SEQ ID NO:5768 | SEQ ID NO:13780 | SEQ ID NO:21792 |
| iPS:434587 | 21-225_74G3 | NA | AATTATGATATCAAC | TGGATGCACCCTAACAG TGGTAACACAGGCTATG CACAGAAGTTCCAGGGC | AGTAGTGGCTGGTACTGGTT CGACCCC |
| | | | SEQ ID NO:5769 | SEQ ID NO:13781 | SEQ ID NO:21793 |
| | | AA | NYDIN | WMHPNSGNTGYAQKFQG | SSGWYWFDP |
| | | | SEQ ID NO:5770 | SEQ ID NO:13782 | SEQ ID NO:21794 |
| iPS:434595 | 21-225_77A10 | NA | GGTTGCTACTGGAGC | GAAATCAATTATAGTGG AAGAACCAACTACAACC CGTCCCTCAAGAGT | GACTACGGCGGTATGGACGT C |
| | | | SEQ ID NO:5771 | SEQ ID NO:13783 | SEQ ID NO:21795 |
| | | AA | GCYWS | EINYSGRTNYNPSLKS | DYGGMDV |
| | | | SEQ ID NO:5772 | SEQ ID NO:13784 | SEQ ID NO:21796 |
| iPS:434597 | 21-225_77C10 | NA | AATTATGATATCAAC | TGGATGCACCCTAACAG TGGTAACACAGGCTATG CACAGAAGTTCCAGGGC | AGCAGTGGCTGGTACTGGTT CGACCCC |
| | | | SEQ ID NO:5773 | SEQ ID NO:13785 | SEQ ID NO:21797 |

FIGURE 49
(Continued)

| | | | | | | |
|---|---|---|---|---|---|---|
| iPS:434603 | 21-225_77D11 | AA | NYDIN | | WMHPNSGNTGYAQKFQG | SSGWYWFDP |
| | | | SEQ ID NO:5774 | | SEQ ID NO:13786 | SEQ ID NO:21798 |
| | | NA | AATTATGATATCAAC | | TGGATGCACCCTAACAGTGGTAACACAGGCTATGCACAGAAGTTCCAGGGC | AGTAGTGGCTGGTACTGGTTCGACCCC |
| | | | SEQ ID NO:5775 | | SEQ ID NO:13787 | SEQ ID NO:21799 |
| iPS:434611 | 21-225_77C12 | AA | NYDIN | | WMHPNSGNTGYAQKFQG | SSGWYWFDP |
| | | | SEQ ID NO:5776 | | SEQ ID NO:13788 | SEQ ID NO:21800 |
| | | NA | GGTTCCTACTGGAGC | | GAAATCAATTATAGGGGAAGCACCAACTACAACCCGTCCCTCAAGAGT | GACTACGGGGGTATGGACGTC |
| | | | SEQ ID NO:5777 | | SEQ ID NO:13789 | SEQ ID NO:21801 |
| | | AA | GSYWS | | EINYRGSTNYNPSLKS | DYGGMDV |
| | | | SEQ ID NO:5778 | | SEQ ID NO:13790 | SEQ ID NO:21802 |
| iPS:434613 | 21-225_77D12 | NA | AATTATGATATCAAC | | TGGATGAACCCTAACAGTGGTAACACAGGCTATGCACAGAAGTTCCAGGGC | AGCAGTGGCTGGTACTGGTTCGACCCC |
| | | | SEQ ID NO:5779 | | SEQ ID NO:13791 | SEQ ID NO:21803 |
| | | AA | NYDIN | | WMNPNSGNTGYAQKFQG | SSGWYWFDP |
| | | | SEQ ID NO:5780 | | SEQ ID NO:13792 | SEQ ID NO:21804 |
| iPS:434615 | 21-225_76C5 | NA | AGCTATGGCATGCAC | | GTTATATGGTATGATGGAAGTAATAAAAACTATGCAGACTCCGTGAAGGGC | GATGGCAGCTATGGTTACGACGGCCCTTGACTAC |
| | | | SEQ ID NO:5781 | | SEQ ID NO:13793 | SEQ ID NO:21805 |
| | | AA | SYGMH | | VIWYDGSNKNYADSVKG | DGSYGYDGLDY |

FIGURE 49
(Continued)

| | | | | | | |
|---|---|---|---|---|---|---|
| iPS:434617 | 21-225_74B8 | NA | SEQ ID NO:5782 AATTATGATATCAAC | SEQ ID NO:13794 TGGATGCACCCTAATAGTGGTAACACAGGCTATGCACAGAAGTTCCAGGGC | SEQ ID NO:21806 TCCAGTGGCTGGTACTGGTTCGACCCC |
| | | AA | SEQ ID NO:5783 NYDIN | SEQ ID NO:13795 WMHPNSGNTGYAQKFQG | SEQ ID NO:21807 SSGWYWFDP |
| iPS:434619 | 21-225_78C1 | NA | SEQ ID NO:5784 AATTATGATATCAAC | SEQ ID NO:13796 TGGATGCACCCTAACAGTGGTAACACAGGCTATGCACAGAAGTTCCAGGGC | SEQ ID NO:21808 AGCAGTGGCTGGTACTGGTTCGACCCC |
| | | AA | SEQ ID NO:5785 NYDIN | SEQ ID NO:13797 WMHPNSGNTGYAQKFQG | SEQ ID NO:21809 SSGWYWFDP |
| iPS:434621 | 21-225_74D1 | NA | SEQ ID NO:5786 AGCTATGGCATGCAC | SEQ ID NO:13798 GTTATATGGTATGATGGAAGTAATAAATACCATGCAGACTCCGTGAAGGGC | SEQ ID NO:21810 GATGAGGGGTTCGGGGAGTTCGACTACTACAACTACGGTATGGACGTC |
| | | AA | SEQ ID NO:5787 SYGMH | SEQ ID NO:13799 VIWYDGSNKYHADSVKG | SEQ ID NO:21811 DEGFGEFDYYNYGMDV |
| iPS:434629 | 21-225_74C3 | NA | SEQ ID NO:5788 AGCTTTGGCATGCAC | SEQ ID NO:13800 GCTATTTGGTATGATGGAAGTAATAAATACTGTGCAGACTCCGTGAAGGGC | SEQ ID NO:21812 GATCGGAGTATCGGGAGCTGCTTTCTTTGACTAC |
| | | AA | SEQ ID NO:5789 SFGMH | SEQ ID NO:13801 AIWYDGSNKYCADSVKG | SEQ ID NO:21813 DRSILGAAFFDY |
| | | | SEQ ID NO:5790 | SEQ ID NO:13802 | SEQ ID NO:21814 |

FIGURE 49
(Continued)

| | | | | | |
|---|---|---|---|---|---|
| iPS:434633 | 21-225_74G8 | NA | AACGCCTGGATGAAC SEQ ID NO:5791 | CGTATTAAAAACAAAGC TGATGGTGGGACAACAG ACTACGCTGCACCCGTG AAAGGC SEQ ID NO:13803 | GTGGGAGCTACTACGGACTA C SEQ ID NO:21815 |
| | | AA | NAWMN SEQ ID NO:5792 | RIKNKADGGTTDYAAPVK G SEQ ID NO:13804 | VGATTDY SEQ ID NO:21816 |
| iPS:434635 | 21-225_78E6 | NA | AATTATGATATCAAC SEQ ID NO:5793 | TGGATGCACCCTAACAG TGGTAACACAGGCTATG CACAGAAGTTCCAGGGC SEQ ID NO:13805 | AGTAGTGGCTGGTGTACAAATT TGACTAC SEQ ID NO:21817 |
| | | AA | NYDIN SEQ ID NO:5794 | WMHPNSGNTGYAQKFQG SEQ ID NO:13806 | SSGWYKFDY SEQ ID NO:21818 |
| iPS:434637 | 21-225_78E7 | NA | GGTTCCTACTGGAGC SEQ ID NO:5795 | GAAATCAATCTTAGTGG AAGCACCAACTACAACC CGTCCCTCAAGAGT SEQ ID NO:13807 | GACTACGGTGGCCTTGACTA C SEQ ID NO:21819 |
| | | AA | GSYWS SEQ ID NO:5796 | EINLSGSTNYNPSLKS SEQ ID NO:13808 | DYGGLDY SEQ ID NO:21820 |
| iPS:434639 | 21-225_74B7 | NA | AATTATGATATCAAC SEQ ID NO:5797 | TGGATGAACCCTAACAG TGGTAACACAGGCTATG CACAGAAGTTCCAGGGC SEQ ID NO:13809 | TCCAGTGGCTGGCACTGGTT CGACCCC SEQ ID NO:21821 |
| | | AA | NYDIN SEQ ID NO:5798 | WMNPNSGNTGYAQKFQG SEQ ID NO:13810 | SSGWHWFDP SEQ ID NO:21822 |

FIGURE 49
(Continued)

| | | | | | |
|---|---|---|---|---|---|
| iPS:434649 | 21-225_78E11 | NA | AATTATGATATCAAC<br>SEQ ID NO:5799 | TGGATGAACCCTAACAG<br>TGGTAACACAGGCTGTG<br>CACAGAAGTTCCAGGGC<br>SEQ ID NO:13811 | AGCAGTGGCTGGAACTTCTT<br>TGACTAC<br>SEQ ID NO:21823 |
| | | AA | NYDIN<br>SEQ ID NO:5800 | WMNPNSGNTGCAQKFQG<br>SEQ ID NO:13812 | SSGWNFFDY<br>SEQ ID NO:21824 |
| iPS:434653 | 21-225_74B5 | NA | AATTATGATATCAAC<br>SEQ ID NO:5801 | TGGATGAACCCTAACAG<br>TGGTAACACAGGCTATG<br>CACAGAAGTTCCAGGGC<br>SEQ ID NO:13813 | TCCAGTGGCTGGAACTGGTT<br>CGACCCC<br>SEQ ID NO:21825 |
| | | AA | NYDIN<br>SEQ ID NO:5802 | WMNPNSGNTGYAQKFQG<br>SEQ ID NO:13814 | SSGWNWFDP<br>SEQ ID NO:21826 |
| iPS:434655 | 21-225_78H12 | NA | AATTATGATATCAAC<br>SEQ ID NO:5803 | TGGATGAACCCTAACAG<br>TGGTAACACAGGCTATG<br>CACAGAAGTTCCAGGGC<br>SEQ ID NO:13815 | TCCAGTGGCTGGCACTGGTT<br>CGACCCC<br>SEQ ID NO:21827 |
| | | AA | NYDIN<br>SEQ ID NO:5804 | WMNPNSGNTGYAQKFQG<br>SEQ ID NO:13816 | SSGWHWFDP<br>SEQ ID NO:21828 |
| iPS:434657 | 21-225_79G1 | NA | GGTTGCTACTGGAGC<br>SEQ ID NO:5805 | GAAATCAATCATAGTGG<br>AAGCACCAACTACAACC<br>CGTCCCTCAAGAGT<br>SEQ ID NO:13817 | GACTACGGCGGTATGGACGT<br>C<br>SEQ ID NO:21829 |
| | | AA | GCYWS<br>SEQ ID NO:5806 | EINHSGSTNYNPSLKS<br>SEQ ID NO:13818 | DYGGMDV<br>SEQ ID NO:21830 |
| iPS:434663 | 21_225_79F3 | NA | GGTTGCTACTGGAGC | GAAATCAATCATAGTGG<br>AAGCACCAACTACAACC<br>CGTCCCTCAAGAGT | GACTACGGCGGTATGGACGT<br>C |

FIGURE 49
(Continued)

| | | | | | | |
|---|---|---|---|---|---|---|
| iPS:434665 | 21-225_79F3 | AA | SEQ ID NO:5807 GCYWS | SEQ ID NO:13819 EINHSGSTNYNPSLKS | SEQ ID NO:21831 DYGGMDV | |
| | | NA | SEQ ID NO:5808 AATTATGATGTCAAC | SEQ ID NO:13820 TGGATGCACCCTAACAG TGGTAACACAGGCTATG CACAGAAGTTCCAGGGC | SEQ ID NO:21832 AGCAGTGGCTGGTACCATTT TGACTAC | |
| iPS:434669 | 21-225_74G4 | AA | SEQ ID NO:5809 NYDVN | SEQ ID NO:13821 WMHPNSGNTGYAQKFQG | SEQ ID NO:21833 SSGWYHFDY | |
| | | NA | SEQ ID NO:5810 AACTATGGCATGCAC | SEQ ID NO:13822 GTTATATGGTATGATGG AAGTAATCAAAACTATG CAGACTCCGTGAAGGGC | SEQ ID NO:21834 GATGGCAGCTATGGTTATGA CGGCCTTGACTAC | |
| iPS:434671 | 21-225_79F4 | AA | SEQ ID NO:5811 NYGMH | SEQ ID NO:13823 VIWYDGSNQNYADSVKG | SEQ ID NO:21835 DGSYGYDGLDY | |
| | | NA | SEQ ID NO:5812 AACGCCTGGATGAAC | SEQ ID NO:13824 CGAATTAAAACAAAAT TGATGGTGGGACAACAG ACTACGCTGCACCCGTG AAAGGC | SEQ ID NO:21836 GTGGGAGCTACTACGGACTA C | |
| iPS:434673 | 21-225_74F4 | AA | SEQ ID NO:5813 NAWMN | SEQ ID NO:13825 RIKNKIDGGTTDYAAPVK G | SEQ ID NO:21837 VGATTDY | |
| | 21_225_74E3 | NA | SEQ ID NO:5814 AGCTATGGCATGCAC | SEQ ID NO:13826 GTTATTTGGTATGATGGA AGTAATAAATACTATGC AGACTCCGTGAAGGGC | SEQ ID NO:21838 GATCGCAATATAGTGGGAGC TACTTACTTGAGTCC | |

FIGURE 49
(Continued)

| | | | | | | |
|---|---|---|---|---|---|---|
| iPS:434675 | 21-225_74E3 | AA | SEQ ID NO:5815<br>SYGMH | SEQ ID NO:13827<br>VIWYDGSNKYYADSVKG | SEQ ID NO:21839<br>DRNIVGATYFES | |
| | | NA | SEQ ID NO:5816<br>AATTATGATATCAAC | SEQ ID NO:13828<br>TGGATGCACCTAACAG<br>TGGTAACACAGGCTTTG<br>CACAGAAGTTCCAGGGC | SEQ ID NO:21840<br>TCCAGTGGCTGGTACTGGTT<br>CGACCCC | |
| iPS:434679 | 21-225_79G6 | AA | SEQ ID NO:5817<br>NYDIN | SEQ ID NO:13829<br>WMHPNSGNTGFAQKFQG | SEQ ID NO:21841<br>SSGWYWFDP | |
| | | NA | SEQ ID NO:5818<br>AATTATGATATCAAC | SEQ ID NO:13830<br>TGGATGCACCTAACAG<br>TGGTAACACAGGCTATG<br>CACAGAAGTTCCAGGGC | SEQ ID NO:21842<br>AGTAGTGGCTGGTACAAATT<br>TGACTAC | |
| iPS:434685 | 21-225_79G7 | AA | SEQ ID NO:5819<br>NYDIN | SEQ ID NO:13831<br>WMHPNSGNTGYAQKFQG | SEQ ID NO:21843<br>SSGWYKFDY | |
| | | NA | SEQ ID NO:5820<br>AATTATGATATCAAC | SEQ ID NO:13832<br>TGGATGCATCCTAACAG<br>TGGTAACACAGGCTATG<br>CACAGAAGTTCCAGGGC | SEQ ID NO:21844<br>AGCAGTGGCTGGTACTACTT<br>TGACTAC | |
| | 21-225_79E9 | AA | SEQ ID NO:5821<br>NYDIN | SEQ ID NO:13833<br>WMHPNSGNTGYAQKFQG | SEQ ID NO:21845<br>SSGWYYFDY | |
| iPS:434687 | | NA | SEQ ID NO:5822<br>GGTTGCTACTGGAGC | SEQ ID NO:13834<br>GAAATCAATCATAGTGG<br>AAGCACCAACTACAACC<br>CGTCCCTCAAGAGT | SEQ ID NO:21846<br>GACTACGGCGGTATGGACGT<br>C | |
| | 21-225_75A5 | AA | SEQ ID NO:5823<br>GCYWS | SEQ ID NO:13835<br>EINHSGSTNYNPSLKS | SEQ ID NO:21847<br>DYGGMDV | |

FIGURE 49
(Continued)

| | | | | | |
|---|---|---|---|---|---|
| iPS:434689 | 21-225_79G10 | NA | SEQ ID NO:5824 AATTATGATATCAAC | SEQ ID NO:13836 TGGATGAACCCTAACAG TGGTAACACAGGCTATG CACAGAAGTTCCAGGGC | SEQ ID NO:21848 TCCAGTGGCTGGAACTGGTT CGACCCC |
| | | AA | SEQ ID NO:5825 NYDIN | SEQ ID NO:13837 WMNPNSGNTGYAQKFQG | SEQ ID NO:21849 SSGWNWFDP |
| iPS:434691 | 21-225_75G7 | NA | SEQ ID NO:5826 GGTTCCTACTGGAGC | SEQ ID NO:13838 GAAATCAATTATAGGGG AAGCACCAACTACAACC CGTCCCTCAAGAGT | SEQ ID NO:21850 GACTACGGCGGTATGGACGT C |
| | | AA | SEQ ID NO:5827 GSYWS | SEQ ID NO:13839 EINYRGSTNYNPSLKS | SEQ ID NO:21851 DYGGMDV |
| iPS:434693 | 21-225_79F11 | NA | SEQ ID NO:5828 GGTTGCTACTGGAGC | SEQ ID NO:13840 GAAATCAATCATAGTGG AAGCACCAACTACAACC CGTCCCTCAAGAGT | SEQ ID NO:21852 GACTACGGCGGTATGGACGT C |
| | | AA | SEQ ID NO:5829 GCYWS | SEQ ID NO:13841 EINHSGSTNYNPSLKS | SEQ ID NO:21853 DYGGMDV |
| iPS:434697 | 21-225_79F12 | NA | SEQ ID NO:5830 AATTATGATATCAAC | SEQ ID NO:13842 TGGATGAACCCTAACAG TGGTAACACAGGCTATG CACAGAAGTTCCAGGGC | SEQ ID NO:21854 AGCAGTGGCTGGTACTTCTT TGACTAC |
| | | AA | SEQ ID NO:5831 NYDIN | SEQ ID NO:13843 WMNPNSGNTGYAQKFQG | SEQ ID NO:21855 SSGWYFFDY |
| iPS:434699 | 21_225_79G12 | NA | SEQ ID NO:5832 GGTTGCTACTGGAGC | SEQ ID NO:13844 GAAATCAATCATAGTGG AAGCACCAACTACAACC CGTCCCTCAAGAGT | SEQ ID NO:21856 GACTACGGCGGTATGGACGT C |

FIGURE 49
(Continued)

| | | | | | | |
|---|---|---|---|---|---|---|
| iPS:434701 | 21-225_79G12 | AA | SEQ ID NO:5833 GCYWS | SEQ ID NO:13845 EINHSGSTNYNPSLKS | SEQ ID NO:21857 DYGGMDV | |
| | | NA | SEQ ID NO:5834 GGTTGCTACTGGAGC | SEQ ID NO:13846 GAAATCAATCATAGTGG AAGCACCAACTACAACC CGTCCCTCAAGAGT | SEQ ID NO:21858 GACTACGGCGGGTATGGACGT C | |
| iPS:434703 | 21-225_80A1 | AA | SEQ ID NO:5835 GCYWS | SEQ ID NO:13847 EINHSGSTNYNPSLKS | SEQ ID NO:21859 DYGGMDV | |
| | | NA | SEQ ID NO:5836 GGTTGCTACTGGAGC | SEQ ID NO:13848 GAAATCAATCATAGTGG AAGCACCAACTACAACC CGTCCCTCAAGAGT | SEQ ID NO:21860 GACTACGGCGGGTATGGACGT C | |
| iPS:434705 | 21-225_80C1 | AA | SEQ ID NO:5837 GCYWS | SEQ ID NO:13849 EINHSGSTNYNPSLKS | SEQ ID NO:21861 DYGGMDV | |
| | | NA | SEQ ID NO:5838 AATTATGATATCAAC | SEQ ID NO:13850 TGGATGCACCCTAACAG TGGTAACACAGGCTATG CACAGAAGTTCCAGGGC | SEQ ID NO:21862 AGTAGTGGCTGGTACTGGTT CGACCCC | |
| iPS:434705 | 21-225_80A2 | AA | SEQ ID NO:5839 NYDIN | SEQ ID NO:13851 WMHPNSGNTGYAQKFQG | SEQ ID NO:21863 SSGWYWFDP | |
| | | NA | SEQ ID NO:5840 AATTATGATATCAAC | SEQ ID NO:13852 TGGATGCACCCTAACAG TGGTAACACAGGCTATG CACAGAAGTTCCAGGGC | SEQ ID NO:21864 AGCAGTGGCTGGTACTGGTT CGACCCC | |
| iPS:434707 | 21-225_80D3 | AA | SEQ ID NO:5841 NYDIN | SEQ ID NO:13853 WMHPNSGNTGYAQKFQG | SEQ ID NO:21865 SSGWYWFDP | |
| | | | SEQ ID NO:5842 | SEQ ID NO:13854 | SEQ ID NO:21866 | |

FIGURE 49
(Continued)

| | | | | | |
|---|---|---|---|---|---|
| iPS:434709 | 21-225_80E3 | NA | GGTTGCTACTGGAGC | GAAATCAATCATAGTGG AAGCACCAACTACAACC CGTCCCTCAAGAGT | GACTACGGGCGGTATGGACGT C |
| | | AA | SEQ ID NO:5843 GCYWS | SEQ ID NO:13855 EINHSGSTNYNPSLKS | SEQ ID NO:21867 DYGGMDV |
| iPS:434711 | 21-225_80H3 | NA | SEQ ID NO:5844 AATTATGATATCAAC | SEQ ID NO:13856 TGGATGAACCCTAACAG TGGTAACACAGGCTATG CACAGAAGTTCCAGGGC | SEQ ID NO:21868 ACCAGTGGCTGGAACTTCTT TGACTAC |
| | | AA | SEQ ID NO:5845 NYDIN | SEQ ID NO:13857 WMNPNSGNTGYAQKFQG | SEQ ID NO:21869 TSGWNFFDY |
| iPS:434715 | 21-225_80D5 | NA | SEQ ID NO:5846 GGTCCCTACTGGAGC | SEQ ID NO:13858 GAAATCAATCATAGTGG AAGCACCAACTACAACC CGTCCCTCAAGAGT | SEQ ID NO:21870 GACTACGGGGGTTTGGACGT C |
| | | AA | SEQ ID NO:5847 GPYWS | SEQ ID NO:13859 EINHSGSTNYNPSLKS | SEQ ID NO:21871 DYGGLDV |
| iPS:434717 | 21-225_80A6 | NA | SEQ ID NO:5848 GGTTGCTACTGGAGC | SEQ ID NO:13860 GAAATCAATCATAGTGG AAGGACCAACTACAACC CGTCCCTCAAGAGT | SEQ ID NO:21872 GACTACGGTGGGCTTGACTA C |
| | | AA | SEQ ID NO:5849 GCYWS | SEQ ID NO:13861 EINHSGRTNYNPSLKS | SEQ ID NO:21873 DYGGLDY |
| iPS:434725 | 21-225_80H7 | NA | SEQ ID NO:5850 GGTTCCTACTGGAGC | SEQ ID NO:13862 GAAATCAATCAAAGTGG ACGCACCAACTACAACC CGTCCCTCAAGAGT | SEQ ID NO:21874 GACTACGGGGGTATAGACGT C |
| | | AA | SEQ ID NO:5851 GSYWS | SEQ ID NO:13863 EINQSGRTNYNPSLKS | SEQ ID NO:21875 DYGGIDV |

FIGURE 49
(Continued)

| | | | | | | |
|---|---|---|---|---|---|---|
| iPS:434729 | 21-225_80B12 | NA | SEQ ID NO:5852<br>AATTATGATATCAAC | SEQ ID NO:13864<br>TGGATGAACCCTAACAG<br>TGGTAACACAGGCTATG<br>CACAGAAGTTCCAGGTC | SEQ ID NO:21876<br>AGCAGTGGCTGGTACATCTT<br>TGACTAC | |
| | | AA | SEQ ID NO:5853<br>NYDIN | SEQ ID NO:13865<br>WMNPNSGNTGYAQKFQV | SEQ ID NO:21877<br>SSGWYIFDY | |
| iPS:434731 | 21-225_80E9 | NA | SEQ ID NO:5854<br>AATTATGATATCAAC | SEQ ID NO:13866<br>TGGATGCACCCTAACAG<br>TGGTAACACAGGCTATG<br>CACAGAAGTTCCAGGGC | SEQ ID NO:21878<br>AGCAGTGGCTGGTACTGGTT<br>CGACCCC | |
| | | AA | SEQ ID NO:5855<br>NYDIN | SEQ ID NO:13867<br>WMHPNSGNTGYAQKFQG | SEQ ID NO:21879<br>SSGWYWFDP | |
| iPS:434735 | 21-225_80B10 | NA | SEQ ID NO:5856<br>GGTTGCTACTGGAGC | SEQ ID NO:13868<br>GAAATCAATCATAGTGG<br>AAGCACCAACTACAACC<br>CGTCCCTCAAGAGT | SEQ ID NO:21880<br>GACTACGGTGGGCTTGACTA<br>C | |
| | | AA | SEQ ID NO:5857<br>GCYWS | SEQ ID NO:13869<br>EINHSGSTNYNPSLKS | SEQ ID NO:21881<br>DYGGLDY | |
| iPS:434737 | 21-225_74G6 | NA | SEQ ID NO:5858<br>AGCTATGGCATGCAC | SEQ ID NO:13870<br>GTTATATGGTATGATGG<br>AAGTAATAAAAACTATG<br>CAGACTCCGTGAAGGGC | SEQ ID NO:21882<br>GATGGCAGCTATGGTTATGA<br>CGGCCTTGACTAC | |
| | | AA | SEQ ID NO:5859<br>SYGMH | SEQ ID NO:13871<br>VIWYDGSNKNYADSVKG | SEQ ID NO:21883<br>DGSYGYDGLDY | |
| | | | SEQ ID NO:5860 | SEQ ID NO:13872 | SEQ ID NO:21884 | |

FIGURE 49
(Continued)

| | | | | | |
|---|---|---|---|---|---|
| iPS:434741 | 21-225_80C11 | NA | AGCTATGGCATGCAC SEQ ID NO:5861 | GTTATATGGTATGATGG AAGTAATAAAACTATG CAGACTCCGTGAAGGGC SEQ ID NO:13873 | GATGGCAGCTATGGGTATGA CGGCCTTGACTAC SEQ ID NO:21885 |
| | | AA | SYGMH SEQ ID NO:5862 | VIWYDGSNKNYADSVKG SEQ ID NO:13874 | DGSYGYDGLDY SEQ ID NO:21886 |
| iPS:434743 | 21-225_74A4 | NA | GGTTGCTACTGGAGC SEQ ID NO:5863 | GAAATCAATCATAGTGG AAGCACCAACTACAACC CGTCCCTCAAGAGT SEQ ID NO:13875 | GACTACGGCGGTATGGACGT C SEQ ID NO:21887 |
| | | AA | GCYWS SEQ ID NO:5864 | EINHSGSTNYNPSLKS SEQ ID NO:13876 | DYGGMDV SEQ ID NO:21888 |
| iPS:434747 | 21-225_80C12 | NA | AATTATGATATCAAC SEQ ID NO:5865 | TGGATGCACCCTAACAA TGGTAACACAGGCTATG CACAGAAGTTCCAGGGC SEQ ID NO:13877 | AGCAGTGGCTGGTACTGGTT CGACCCC SEQ ID NO:21889 |
| | | AA | NYDIN SEQ ID NO:5866 | WMHPNNGNTGYAQKFQG SEQ ID NO:13878 | SSGWYWFDP SEQ ID NO:21890 |
| iPS:434751 | 21-225_80H12 | NA | GGTTGCTACTGGAGC SEQ ID NO:5867 | GAAATCAATCATAGTGG AAGCACCAACTACAACC CGTCCCTCAAGAGT SEQ ID NO:13879 | GACTACGGCGGTATGGACGT C SEQ ID NO:21891 |
| | | AA | GCYWS SEQ ID NO:5868 | EINHSGSTNYNPSLKS SEQ ID NO:13880 | DYGGMDV SEQ ID NO:21892 |
| iPS:434759 | 21_225_81C5 | NA | GGTTGCTACTGGAGC | GAAATCAATCATAGTGG AAGCACCAACTACAACC CGTCCCTCAAGAGT | GACTACGGCGGTATGGACGT C |

FIGURE 49
(Continued)

| | | | SEQ ID NO:5869 | | SEQ ID NO:13881 | | SEQ ID NO:21893 |
|---|---|---|---|---|---|---|---|
| | | AA | GCYWS | | EINHSGSTNYNPSLKS | | DYGGMDV |
| | | | SEQ ID NO:5870 | | SEQ ID NO:13882 | | SEQ ID NO:21894 |
| iPS:434761 | | NA | AATTATGATATCAAC | | TGGATGAACCCTAACAG TGGTAACACAGGCTATG CACAGAAGTTCCAGGGC | | TCCAGTGGCTGGAACTGGTT CGACCCC |
| | | | SEQ ID NO:5871 | | SEQ ID NO:13883 | | SEQ ID NO:21895 |
| | 21-225_81E5 | AA | NYDIN | | WMNPNSGNTGYAQKFQG | | SSGWNWFDP |
| | | | SEQ ID NO:5872 | | SEQ ID NO:13884 | | SEQ ID NO:21896 |
| | | NA | AATTATGATATCAAC | | TGGATGCACCCTAACAG TGGTAACACAGGCTATG CACAGAAGTTCCAGGGC | | AGCAGTGGCTGGTACTGGTT CGACCCC |
| | 21-225_81F9 | | SEQ ID NO:5873 | | SEQ ID NO:13885 | | SEQ ID NO:21897 |
| | | AA | NYDIN | | WMHPNSGNTGYAQKFQG | | SSGWYWFDP |
| | | | SEQ ID NO:5874 | | SEQ ID NO:13886 | | SEQ ID NO:21898 |
| iPS:434771 | | NA | GGTTCCCTACTGGAGC | | GAAATCAATTATAGGGG AAGCACCAACTACAACC CGTCCCTCAAGAGT | | GACTACGGCGGTATGGACGT C |
| | | | SEQ ID NO:5875 | | SEQ ID NO:13887 | | SEQ ID NO:21899 |
| | 21-225_75D9 | AA | GPYWS | | EINYRGSTNYNPSLKS | | DYGGMDV |
| | | | SEQ ID NO:5876 | | SEQ ID NO:13888 | | SEQ ID NO:21900 |
| iPS:434773 | | NA | GGTTGCTACTGGAGC | | GAAATCAATCATAGTGG AAGCACCAACTACAACC CGTCCCTCAAGAGT | | GACTACGGCGGTATGGACGT C |
| | | | SEQ ID NO:5877 | | SEQ ID NO:13889 | | SEQ ID NO:21901 |
| | 21-225_81C11 | AA | GCYWS | | EINHSGSTNYNPSLKS | | DYGGMDV |
| iPS:434777 | | | SEQ ID NO:5878 | | SEQ ID NO:13890 | | SEQ ID NO:21902 |

FIGURE 49
(Continued)

| | | | | | |
|---|---|---|---|---|---|
| iPS:434793 | 21-225_82A5 | NA | AATTATGATATCAAC | TGGATGCACCCTAACAA TGGTAACACAGGCTATG CACAGAAGTTCCAGGGC | AGCAGTGGCTGGTACTGGTT CGACCCC |
| | | | SEQ ID NO:5879 | SEQ ID NO:13891 | SEQ ID NO:21903 |
| | | AA | NYDIN | WMHPNNGNTGYAQKFQG | SSGWYWFDP |
| | | | SEQ ID NO:5880 | SEQ ID NO:13892 | SEQ ID NO:21904 |
| iPS:434797 | 21-225_82G5 | NA | AATTATGATATCAAC | TGGATGCACCCTAACAG TGGTAACACAGGCTATG CACAGAAGTTCCAGGGC | AGTAGTGGCTGGTACTGGTT CGACCCC |
| | | | SEQ ID NO:5881 | SEQ ID NO:13893 | SEQ ID NO:21905 |
| | | AA | NYDIN | WMHPNSGNTGYAQKFQG | SSGWYWFDP |
| | | | SEQ ID NO:5882 | SEQ ID NO:13894 | SEQ ID NO:21906 |
| iPS:434805 | 21-225_82D9 | NA | AATTATGATATCAAC | TGGATGCACCCTAACAG TGGTAACACAGGCTATG CACAGAAGTTCCAGGGC | AGTAGTGGCTGGTACTGGTT CGACCCC |
| | | | SEQ ID NO:5883 | SEQ ID NO:13895 | SEQ ID NO:21907 |
| | | AA | NYDIN | WMHPNSGNTGYAQKFQG | SSGWYWFDP |
| | | | SEQ ID NO:5884 | SEQ ID NO:13896 | SEQ ID NO:21908 |
| iPS:434809 | 21-225_74F5 | NA | GGTTGCTACTGGAGC | GAAATCAATCATAGTGG AAGCACCAACTACAACC CGTCCCTCAAGAGT | GACTACGGCGGGTATGGACGT C |
| | | | SEQ ID NO:5885 | SEQ ID NO:13897 | SEQ ID NO:21909 |
| | | AA | GCYWS | EINHSGSTNYNPSLKS | DYGGMDV |
| | | | SEQ ID NO:5886 | SEQ ID NO:13898 | SEQ ID NO:21910 |
| iPS:434813 | | NA | AATTATGATATCAAC | TGGATGCACCCTAACAA TGGTAACACAGGCTATG CACAGAAGTTCCAGGGC | AGCAGTGGCTGGTACTGGTT CGACCCC |

FIGURE 49
(Continued)

| | | | | | | |
|---|---|---|---|---|---|---|
| iPS:434815 | 21-225_82C12 | AA | SEQ ID NO:5887 NYDIN | SEQ ID NO:13899 WMHPNSGNTGYAQKFQG | SEQ ID NO:21911 SSGWYWFDP | |
| | | NA | SEQ ID NO:5888 AGTTATGATATCAAC | SEQ ID NO:13900 TGGATGAACCCTAACAG TGGTAACACAGGCTATG CACAGAAGTTCCAGGGC | SEQ ID NO:21912 GGCTTTTACGATACTTTGACT GGTTCCGGCTACTACTACGT TATGGACGTC | |
| iPS:434821 | 21-225_74A11 | AA | SEQ ID NO:5889 SYDIN | SEQ ID NO:13901 WMNPNSGNTGYAQKFQG | SEQ ID NO:21913 GFYDTLTGSGYYYVMDV | |
| | | NA | SEQ ID NO:5890 GGTTGCTACTGGAGC | SEQ ID NO:13902 GAAATCAATCATAGTGG AGCACCAACTACAACC CGTCCCTCAAGAGT | SEQ ID NO:21914 GACTACGGCGGGTATGGACGT C | |
| iPS:434825 | 21-225_83G1 | AA | SEQ ID NO:5891 GCYWS | SEQ ID NO:13903 EINHSGSTNYNPSLKS | SEQ ID NO:21915 DYGGMDV | |
| | | NA | SEQ ID NO:5892 AATTATGATATCAAC | SEQ ID NO:13904 TGGATGCACCCTAACAG TGGTAACACAGGCTATG CACAGAAGTTCCAGGGC | SEQ ID NO:21916 AGTAGTGGCTGGTACTGGTT CGACCCC | |
| iPS:434827 | 21-225_83C2 | AA | SEQ ID NO:5893 NYDIN | SEQ ID NO:13905 WMHPNSGNTGYAQKFQG | SEQ ID NO:21917 SSGWYWFDP | |
| | | NA | SEQ ID NO:5894 AATTATGATATCAAC | SEQ ID NO:13906 TGGATGCACCCTAACAG TGGTAACACAGGCTATG CACAGAAGTTCCAGGGC | SEQ ID NO:21918 AGCAGTGGCTGGTACTGGTT CGACCCC | |
| | 21-225_83F3 | AA | SEQ ID NO:5895 NYDIN | SEQ ID NO:13907 WMHPNSGNTGYAQKFQG | SEQ ID NO:21919 SSGWYWFDP | |

FIGURE 49
(Continued)

| | | | | | |
|---|---|---|---|---|---|
| iPS:434829 | 21-225_83G3 | NA | SEQ ID NO:5896<br>AATTATGATATCAAC | SEQ ID NO:13908<br>TGGATGCACCCTAACAG<br>TGGTAACACAGGCTATG<br>CACAGAAGTTCCAGGGC | SEQ ID NO:21920<br>AGCAGTGGCTGGTACTGGTT<br>CGACCCC |
| | | AA | SEQ ID NO:5897<br>NYDIN | SEQ ID NO:13909<br>WMHPNSGNTGYAQKFQG | SEQ ID NO:21921<br>SSGWYWFDP |
| iPS:434833 | 21-225_83C5 | NA | SEQ ID NO:5898<br>AATTATGATATCAAC | SEQ ID NO:13910<br>TGGATGCACCCTAACAG<br>TGGTAACACAGGCTATG<br>CACAGAAGTTCCAGGGC | SEQ ID NO:21922<br>AGTAGTGGCTGGTACTGGTT<br>CGACCCC |
| | | AA | SEQ ID NO:5899<br>NYDIN | SEQ ID NO:13911<br>WMHPNSGNTGYAQKFQG | SEQ ID NO:21923<br>SSGWYWFDP |
| iPS:434835 | 21-225_83B6 | NA | SEQ ID NO:5900<br>GGTTGTTACTGGAGC | SEQ ID NO:13912<br>GAAATCAATCATAGTGG<br>AAGGACCAACTACAACC<br>CCTCCCTCAAGAGT | SEQ ID NO:21924<br>GACTACGGTGGGCTTGACTA<br>C |
| | | AA | SEQ ID NO:5901<br>GCYWS | SEQ ID NO:13913<br>EINHSGRTNYNPSLKS | SEQ ID NO:21925<br>DYGGLDY |
| iPS:434839 | 21-225_83B7 | NA | SEQ ID NO:5902<br>GGTTGCTACTGGAGC | SEQ ID NO:13914<br>GAAATCAATCATAGTGG<br>AAGCACCAACTACAACC<br>CGTCCCTCAAGAGT | SEQ ID NO:21926<br>GACTACGGCGGTATGGACGT<br>C |
| | | AA | SEQ ID NO:5903<br>GCYWS | SEQ ID NO:13915<br>EINHSGSTNYNPSLKS | SEQ ID NO:21927<br>DYGGMDV |
| iPS:434841 | | NA | SEQ ID NO:5904<br>AATTATGATATCAAC | SEQ ID NO:13916<br>TGGATGAACCCTAACAG<br>TGGTAACACAGGCTATG<br>CACAGAAGTTCCAGGGC | SEQ ID NO:21928<br>TCCAGTGGCTGGCACTGGTT<br>CGACCCC |

FIGURE 49
(Continued)

| | | | | | | | |
|---|---|---|---|---|---|---|---|
| iPS:434849 | 21-225_83G7 | AA | SEQ ID NO:5905<br>NYDIN | SEQ ID NO:13917<br>WMNPNSGNTGYAQKFQG | SEQ ID NO:21929<br>SSGWHWFDP | | |
| | 21-225_83C10 | NA | SEQ ID NO:5906<br>GGTTACTACTGGAGC | SEQ ID NO:13918<br>GAAATCAATCATAGTGG<br>AAGCACCAACTTCAACC<br>CGTCCCTCAAGAGT | SEQ ID NO:21930<br>GACTACGGTGGGCTTGACTA<br>C | | |
| | | AA | SEQ ID NO:5907<br>GYYWS | SEQ ID NO:13919<br>EINHSGSTNFNPSLKS | SEQ ID NO:21931<br>DYGGLDY | | |
| iPS:434851 | 21-225_75A6 | NA | SEQ ID NO:5908<br>AATTATGATATCAAC | SEQ ID NO:13920<br>TGGATGAACCCTAACAG<br>TGGTAACACAGGCTATG<br>CACAGAAGTTCCAGGGC | SEQ ID NO:21932<br>AGCAGTGGCTGGTACATCTT<br>TGACTAC | | |
| | | AA | SEQ ID NO:5909<br>NYDIN | SEQ ID NO:13921<br>WMNPNSGNTGYAQKFQG | SEQ ID NO:21933<br>SSGWYIFDY | | |
| iPS:434863 | 21-225_84G7 | NA | SEQ ID NO:5910<br>AATTATGATATCAAC | SEQ ID NO:13922<br>TGGATGAACCCTAACAG<br>TGGTAACACAGGCTATG<br>CACAGAAGTTCCAGGAC | SEQ ID NO:21934<br>TCCAGTGGCTGGCACTGGTT<br>CGACCCC | | |
| | | AA | SEQ ID NO:5911<br>NYDIN | SEQ ID NO:13923<br>WMNPNSGNTGYAQKFQD | SEQ ID NO:21935<br>SSGWHWFDP | | |
| iPS:434867 | 21-225_79A12 | NA | SEQ ID NO:5912<br>AGCTATGGCATGCAC | SEQ ID NO:13924<br>GTTATATGGTATGATGG<br>AAGTAATAAAAACTATG<br>CAGACTCCGTGAAGGGC | SEQ ID NO:21936<br>GATGGCAGCTATGGTTACGA<br>CGGCCTTGACTAC | | |
| | | | SEQ ID NO:5913 | SEQ ID NO:13925 | SEQ ID NO:21937 | | |

FIGURE 49
(Continued)

| | | | | | |
|---|---|---|---|---|---|
| iPS:434869 | 21-225_84E12 | AA | SYGMH<br>SEQ ID NO:5914 | VIWYDGSNKNYADSVKG<br>SEQ ID NO:13926 | DGSYGYDGLDY<br>SEQ ID NO:21938 |
| | | NA | GGTTCCTACTGGAGC<br>SEQ ID NO:5915 | GAAATCAATCAAAGTGG<br>ACGCACCAACTACAACC<br>CGTCCCTCAAGAGT<br>SEQ ID NO:13927 | GACTACGGGGGTATAGACGT<br>C<br>SEQ ID NO:21939 |
| | | AA | GSYWS<br>SEQ ID NO:5916 | EINQSGRTNYNPSLKS<br>SEQ ID NO:13928 | DYGGIDV<br>SEQ ID NO:21940 |
| iPS:434871 | 21-225_85H1 | NA | AGCTATGGCATACAC<br>SEQ ID NO:5917 | GTTATATGGTATGATGG<br>AAGTAATAAATACTATG<br>CAGACTCCGTGAAGGGC<br>SEQ ID NO:13929 | GATCCCTTTATAGTGGGAGC<br>TACTTACTTTGACTAC<br>SEQ ID NO:21941 |
| | | AA | SYGIH<br>SEQ ID NO:5918 | VIWYDGSNKYYADSVKG<br>SEQ ID NO:13930 | DPFIVGATYFDY<br>SEQ ID NO:21942 |
| iPS:434877 | 21-225_85H2 | NA | AATTATGATATCAAC<br>SEQ ID NO:5919 | TGGATGCACCTAATAG<br>TGGTAACACAGGCTATG<br>CACAGAAGTTCCAGGGC<br>SEQ ID NO:13931 | TCCAGTGGCTGGTACTGGTT<br>CGACCCC<br>SEQ ID NO:21943 |
| | | AA | NYDIN<br>SEQ ID NO:5920 | WMHPNSGNTGYAQKFQG<br>SEQ ID NO:13932 | SSGWYWFDP<br>SEQ ID NO:21944 |
| iPS:434879 | 21-225_85A3 | NA | GGTTGCTACTGGAGC<br>SEQ ID NO:5921 | GAAATCAATCAATAGTGG<br>AAGCACCAACTACAACC<br>CGTCCCTCAAGAGT<br>SEQ ID NO:13933 | GACTACGCGGGTATGGACGT<br>C<br>SEQ ID NO:21945 |
| | | AA | GCYWS<br>SEQ ID NO:5922 | EINHSGSTNYNPSLKS<br>SEQ ID NO:13934 | DYGGMDV<br>SEQ ID NO:21946 |

FIGURE 49
(Continued)

| | | | | | |
|---|---|---|---|---|---|
| iPS:434881 | 21-225_85B4 | NA | GGTTGCTACTGGAGC | GAAATCAATCATAGTGG AAGCACCAACTACAACC CGTCCCTCAAGAGT | GACTACGGGCGGTATGGACGT C |
| | | | SEQ ID NO:5923 | SEQ ID NO:13935 | SEQ ID NO:21947 |
| | | AA | GCYWS | EINHSGSTNYNPSLKS | DYGGMDV |
| | | | SEQ ID NO:5924 | SEQ ID NO:13936 | SEQ ID NO:21948 |
| iPS:434883 | 21-225_85B5 | NA | AATTATGATATCAAC | TGGATGCACCCTAACAG TGGTAACACAGGCTATG CACAGAAGTTCCAGGGC | AGTAGTGGCTGGTACTGGTT CGACCCC |
| | | | SEQ ID NO:5925 | SEQ ID NO:13937 | SEQ ID NO:21949 |
| | | AA | NYDIN | WMHPNSGNTGYAQKFQG | SSGWYWFDP |
| | | | SEQ ID NO:5926 | SEQ ID NO:13938 | SEQ ID NO:21950 |
| iPS:434887 | 21-225_85D6 | NA | GGTTGCTACTGGAGC | GAAATCAATTATATGTGG AAGAACCAACTACAACC CGTCCCTCAAGAGT | GACTACGGGCGGTATGGACGT C |
| | | | SEQ ID NO:5927 | SEQ ID NO:13939 | SEQ ID NO:21951 |
| | | AA | GCYWS | EINYSGRTNYNPSLKS | DYGGMDV |
| | | | SEQ ID NO:5928 | SEQ ID NO:13940 | SEQ ID NO:21952 |
| iPS:434891 | 21-225_85G6 | NA | GATTGCTACTGGAGC | GAAATCAATCATAGTGG AAGGACCAACTACAACC CGTCCCTCAAGAGT | GACTACGGTGGGCTTGACTA C |
| | | | SEQ ID NO:5929 | SEQ ID NO:13941 | SEQ ID NO:21953 |
| | | AA | DCYWS | EINHSGRTNYNPSLKS | DYGGLDY |
| | | | SEQ ID NO:5930 | SEQ ID NO:13942 | SEQ ID NO:21954 |
| iPS:434895 | 21-225_74H7 | NA | GGTCCCTACTGGAGC | GAAATCAATCATAGTGG AAGCACCAACTACAACC CGTCCCTCAAGAGT | GACTACGGGGGTTTGGACGT C |
| | | | SEQ ID NO:5931 | SEQ ID NO:13943 | SEQ ID NO:21955 |
| | | AA | GPYWS | EINHSGSTNYNPSLKS | DYGGLDV |

FIGURE 49
(Continued)

| | | | | | | |
|---|---|---|---|---|---|---|
| iPS:434899 | 21-225_85B9 | NA | SEQ ID NO:5932 GGTTGTTACTGGAGC | SEQ ID NO:13944 GAAATCAATCATAGTGG AAGGACCAACTTCAACC CGTCCCTCAAGAGT | SEQ ID NO:21956 GACTACGGCGGTATGGACGT C | |
| | | AA | SEQ ID NO:5933 GCYWS | SEQ ID NO:13945 EINHSGRTNFNPSLKS | SEQ ID NO:21957 DYGGMDV | |
| iPS:434901 | | NA | SEQ ID NO:5934 AATTATGATATCAAC | SEQ ID NO:13946 TGGATGAACCCTAACAG TGGTAACACAGGCTATG CACAGAAGTTCCAGGGC | SEQ ID NO:21958 ACCAGTGGCTGGAACTTCTT TGACTAC | |
| | 21-225_85H9 | AA | SEQ ID NO:5935 NYDIN | SEQ ID NO:13947 WMNPNSGNTGYAQKFQG | SEQ ID NO:21959 TSGWNFFDY | |
| iPS:434907 | 21-225_85G10 | NA | SEQ ID NO:5936 GGTTGTTACTGGAGC | SEQ ID NO:13948 GAAATCAATCATAGTGG AATCACCAACTACAACC CGTCCCTCAAGAGT | SEQ ID NO:21960 GACTACGGTGGTTTGGACGT C | |
| | | AA | SEQ ID NO:5937 GCYWS | SEQ ID NO:13949 EINHSGITNYNPSLKS | SEQ ID NO:21961 DYGGLDV | |
| iPS:434909 | 21-225_85C11 | NA | SEQ ID NO:5938 AATTATGATATCAAC | SEQ ID NO:13950 TGGATGCACCCTAACAG TGGTAACACAGGCTATG CACAGAAGTTCCAGGGC | SEQ ID NO:21962 AGTAGTGGCTGGTACAAATT TGACTAC | |
| | | AA | SEQ ID NO:5939 NYDIN | SEQ ID NO:13951 WMHPNSGNTGYAQKFQG | SEQ ID NO:21963 SSGWYKFDY | |
| iPS:434911 | | NA | SEQ ID NO:5940 AATTATGATATCAAC | SEQ ID NO:13952 TGGATGCACCCTAACAG TGGTAACACAGGCTATG CACAGAAGTTCCAGGGC | SEQ ID NO:21964 AGTAGTGGCTGGTACTGGTT CGACCCC | |

FIGURE 49
(Continued)

| | | | SEQ ID NO:5941<br>NYDIN | SEQ ID NO:13953<br>WMHPNSGNTGYAQKFQG | SEQ ID NO:21965<br>SSGWYWFDP |
|---|---|---|---|---|---|
| iPS:434913 | 21-225_85D11 | AA | | | |
| | | NA | SEQ ID NO:5942<br>GGTTGCTACTGGAGC | SEQ ID NO:13954<br>GAAATCAATCATAGTGG<br>AAGCACCAACTACAACC<br>CGTCCCTCAAGAGT | SEQ ID NO:21966<br>GACTACGGCGGTATGGACGT<br>C |
| iPS:434921 | 21-225_86C1 | AA | SEQ ID NO:5943<br>GCYWS | SEQ ID NO:13955<br>EINHSGSTNYNPSLKS | SEQ ID NO:21967<br>DYGGMDV |
| | | NA | SEQ ID NO:5944<br>GGTTGCTACTGGAGC | SEQ ID NO:13956<br>GAAATCAATCATAGTGG<br>AAGCACCAACTACAACC<br>CGTCCCTCAAGAGT | SEQ ID NO:21968<br>GACTACGGCGGTATGGACGT<br>C |
| iPS:434935 | 21-225_86E4 | AA | SEQ ID NO:5945<br>GCYWS | SEQ ID NO:13957<br>EINHSGSTNYNPSLKS | SEQ ID NO:21969<br>DYGGMDV |
| | | NA | SEQ ID NO:5946<br>AATTATGATATCAAC | SEQ ID NO:13958<br>TGGATGAACCCTAACAG<br>TGGTAACACAGGCTATG<br>CACAGAAGTTCCAGGGC | SEQ ID NO:21970<br>TCCAGTGGCTGGTCCTGGTT<br>CGACCCC |
| iPS:434939 | 21-225_86E9 | AA | SEQ ID NO:5947<br>NYDIN | SEQ ID NO:13959<br>WMNPNSGNTGYAQKFQG | SEQ ID NO:21971<br>SSGWSWFDP |
| | | NA | SEQ ID NO:5948<br>GGTTGCTACTGGAGC | SEQ ID NO:13960<br>GAAATCAATCATAGTGG<br>AAGCACCAACTACAACC<br>CGTCCCTCAAGAGT | SEQ ID NO:21972<br>GACTACGGCGGTATGGACGT<br>C |
| | 21-225_86C11 | AA | SEQ ID NO:5949<br>GCYWS | SEQ ID NO:13961<br>EINHSGSTNYNPSLKS | SEQ ID NO:21973<br>DYGGMDV |
| | | | SEQ ID NO:5950 | SEQ ID NO:13962 | SEQ ID NO:21974 |

FIGURE 49
(Continued)

| | | | | | |
|---|---|---|---|---|---|
| iPS:434943 | 21-225_87H1 | NA | GGTTACTACTGGAGC | GAAATCAATCATAGTGG ACGACCAACTACAACC CGTCCCTCAAGAGT | GACTACGGTGGTTTGGACGT C |
| | | | SEQ ID NO:5951 | SEQ ID NO:13963 | SEQ ID NO:21975 |
| | | AA | GYYWS | EINHSGRTNYNPSLKS | DYGGLDV |
| | | | SEQ ID NO:5952 | SEQ ID NO:13964 | SEQ ID NO:21976 |
| iPS:434945 | 21-225_87E5 | NA | GGTTGCTACTGGAGC | GAAATCAATCATAGTGG AAGCACCAACTACAACC CGTCCCTCAAGAGT | GACTACGGCGGTATGGACGT C |
| | | | SEQ ID NO:5953 | SEQ ID NO:13965 | SEQ ID NO:21977 |
| | | AA | GCYWS | EINHSGSTNYNPSLKS | DYGGMDV |
| | | | SEQ ID NO:5954 | SEQ ID NO:13966 | SEQ ID NO:21978 |
| iPS:434947 | 21-225_87B7 | NA | AGCTATGGCATGCAC | GTTATATGGTATGATGG AAGTAATAAAAACTATG CAGACTCCGTGAAGGGC | GATTTGGAGTGGGCTACTA CGGTATGGACGTC |
| | | | SEQ ID NO:5955 | SEQ ID NO:13967 | SEQ ID NO:21979 |
| | | AA | SYGMH | VIWYDGSNKNYADSVKG | DFGVGYYGMDV |
| | | | SEQ ID NO:5956 | SEQ ID NO:13968 | SEQ ID NO:21980 |
| iPS:434955 | 21-225_87C9 | NA | GGTTGCTACTGGAGC | GAAATCAATCATAGTGG AAGCACCAACTACAACC CGTCCCTCAAGAGT | GACTACGGCGGTATGGACGT C |
| | | | SEQ ID NO:5957 | SEQ ID NO:13969 | SEQ ID NO:21981 |
| | | AA | GCYWS | EINHSGSTNYNPSLKS | DYGGMDV |
| | | | SEQ ID NO:5958 | SEQ ID NO:13970 | SEQ ID NO:21982 |
| iPS:434957 | 21-225_87A10 | NA | AATTATGATATCAAC | TGGATGCACCCTAACAA TGGTAACACAGGCTATG CACAGAAGTTCCAGGGC | AGCAGTGGCTGGTACTGGTT CGACCCC |
| | | | SEQ ID NO:5959 | SEQ ID NO:13971 | SEQ ID NO:21983 |

FIGURE 49
(Continued)

| | | | | | |
|---|---|---|---|---|---|
| iPS:434959 | 21-225_87E10 | AA | NYDIN | WMHPNNGNTGYAQKFQG | SSGWYWFDP |
| | | | SEQ ID NO:5960 | SEQ ID NO:13972 | SEQ ID NO:21984 |
| | | NA | AATTATGATATCAAC | TGGATGAACCCTAACAG TGGTAACACAGGCTATG CACAGAAGTTCCAGGGC | AGCAGTGGCTGGTACTTCTT TGACTAC |
| | | | SEQ ID NO:5961 | SEQ ID NO:13973 | SEQ ID NO:21985 |
| iPS:434961 | 21-225_87A12 | AA | NYDIN | WMNPNSGNTGYAQKFQG | SSGWYFFDY |
| | | | SEQ ID NO:5962 | SEQ ID NO:13974 | SEQ ID NO:21986 |
| | | NA | GGTTGCTACTGGAGC | GAAATCAATCATAGTGG AAGCACCAACTACAACC CGTCCCTCAAGAGT | GACTACGGCGGTATGGACGT C |
| | | | SEQ ID NO:5963 | SEQ ID NO:13975 | SEQ ID NO:21987 |
| | | AA | GCYWS | EINHSGSTNYNPSLKS | DYGGMDV |
| | | | SEQ ID NO:5964 | SEQ ID NO:13976 | SEQ ID NO:21988 |
| iPS:434965 | 21-225_88A1 | NA | AATTATGATATCAAC | TGGATGAACCCTAACAG TGGTAACACAGGCTATG CACAGAAGTTCCAGGGC | AGCAGTGGCTGGTACTACTT TGACTAC |
| | | | SEQ ID NO:5965 | SEQ ID NO:13977 | SEQ ID NO:21989 |
| | | AA | NYDIN | WMNPNSGNTGYAQKFQG | SSGWYYFDY |
| | | | SEQ ID NO:5966 | SEQ ID NO:13978 | SEQ ID NO:21990 |
| iPS:434969 | 21-225_88H1 | NA | GGTTGCTACTGGAGC | GAAATCAATCATAGTGG AAGCACCAACTACAACC CGTCCCTCAAGAGT | GACTACGGCGGTATGGACGT C |
| | | | SEQ ID NO:5967 | SEQ ID NO:13979 | SEQ ID NO:21991 |
| | | AA | GCYWS | EINHSGSTNYNPSLKS | DYGGMDV |
| | | | SEQ ID NO:5968 | SEQ ID NO:13980 | SEQ ID NO:21992 |

FIGURE 49
(Continued)

| | | | | |
|---|---|---|---|---|
| iPS:434971 | 21-225_88G2 | NA | AATTATGATATCAAC<br>SEQ ID NO:5969 | TGGATGCACCCTAACAG<br>TGGTAACACAGGCTATG<br>CACAGAAGTTCCAGGGC<br>SEQ ID NO:13981 | AGCAGTGGCTGGTACTGGTT<br>CGACCCC<br>SEQ ID NO:21993 |
| | | AA | NYDIN<br>SEQ ID NO:5970 | WMHPNSGNTGYAQKFQG<br>SEQ ID NO:13982 | SSGWYWFDP<br>SEQ ID NO:21994 |
| iPS:434973 | 21-225_88B4 | NA | AATTATGATATCAAC<br>SEQ ID NO:5971 | TGGATGAACCCTAACAG<br>TGGTGACACAGGCTATG<br>CACAGAAGTTCCAGGGC<br>SEQ ID NO:13983 | AGCAGTGGCTGGTACTACTT<br>TGACTAC<br>SEQ ID NO:21995 |
| | | AA | NYDIN<br>SEQ ID NO:5972 | WMNPNSGDTGYAQKFQG<br>SEQ ID NO:13984 | SSGWYYFDY<br>SEQ ID NO:21996 |
| iPS:434977 | 21-225_88A5 | NA | AGTTATGATATCAAC<br>SEQ ID NO:5973 | TGGATGAACCCTAACAG<br>TGGTAACACAGGCTATG<br>CACAGAAGTTCCAGGGC<br>SEQ ID NO:13985 | GGGTTTACGATTTTTGACT<br>GGTTATTCCCCACCTACTA<br>CTACTACGATATGGACGTC<br>SEQ ID NO:21997 |
| | | AA | SYDIN<br>SEQ ID NO:5974 | WMNPNSGNTGYAQKFQG<br>SEQ ID NO:13986 | GFYDFLIGYSPTYYYYDMDV<br>SEQ ID NO:21998 |
| iPS:434981 | 21-225_88E7 | NA | GGTTGCTACTGGAGC<br>SEQ ID NO:5975 | GAAATCAATCATAGTGG<br>AAGCACCAACTACAACC<br>CGTCCCTCAAGAGT<br>SEQ ID NO:13987 | GACTACGGCGGTATGGACGT<br>C<br>SEQ ID NO:21999 |
| | | AA | GCYWS<br>SEQ ID NO:5976 | EINHSGSTNYNPSLKS<br>SEQ ID NO:13988 | DYGGMDV<br>SEQ ID NO:22000 |

FIGURE 49
(Continued)

| | | | | |
|---|---|---|---|---|
| iPS:434983 | 21-225_88F7 | NA | GGTTGCTACTGGAGC | GAAATCAATCATAGTGG AAGCACCAACTACAACC CGTCCCTCAAGAGT | GACTACGGCGCGGTATGGACGT C |
| | | | SEQ ID NO:5977 | SEQ ID NO:13989 | SEQ ID NO:22001 |
| | | AA | GCYWS | EINHSGSTNYNPSLKS | DYGGMDV |
| | | | SEQ ID NO:5978 | SEQ ID NO:13990 | SEQ ID NO:22002 |
| iPS:434995 | 21-225_88G9 | NA | GGTTGCTACTGGAGC | GAAATCAATCATAGTGG AAGCACCAACTACAACC CGTCCCTCAAGAGT | GACTACGGCGGGTATGGACGT C |
| | | | SEQ ID NO:5979 | SEQ ID NO:13991 | SEQ ID NO:22003 |
| | | AA | GCYWS | EINHSGSTNYNPSLKS | DYGGMDV |
| | | | SEQ ID NO:5980 | SEQ ID NO:13992 | SEQ ID NO:22004 |
| iPS:434997 | 21-225_88C10 | NA | AATTATGATATCAAC | TGGATGACCCCTAACAG TGGTAACACAGGCTATG CACAGAAGTTCCAGGGC | AGCAGTGGCTGGTACTACTT TGACTCC |
| | | | SEQ ID NO:5981 | SEQ ID NO:13993 | SEQ ID NO:22005 |
| | | AA | NYDIN | WMTPNSGNTGYAQKFQG | SSGWYYFDS |
| | | | SEQ ID NO:5982 | SEQ ID NO:13994 | SEQ ID NO:22006 |
| iPS:434999 | 21-225_75A8 | NA | GGTTGCTACTGGAGC | GAAATCAATCATAGTGG AAGCACCAACTACAACC CGTCCCTCAAGAGT | GACTACGGCGGGTATGGACGT C |
| | | | SEQ ID NO:5983 | SEQ ID NO:13995 | SEQ ID NO:22007 |
| | | AA | GCYWS | EINHSGSTNYNPSLKS | DYGGMDV |
| | | | SEQ ID NO:5984 | SEQ ID NO:13996 | SEQ ID NO:22008 |
| iPS:435009 | 21-225_89G4 | NA | AGCTACGACATGCAC | GCTATTGGTACTGCTGGT GACACATACTATCCAGG CTCCGTGAAGGGC | GCTCTTGACTACGGTGACTC CTTGGGCTACTACTACTACG GTATGGACGTC |
| | | | SEQ ID NO:5985 | SEQ ID NO:13997 | SEQ ID NO:22009 |
| | | AA | SYDMH | AIGTAGDTYYPGSVKG | ALDYGDSLGYYYYGMDV |

FIGURE 49
(Continued)

| | | | | | |
|---|---|---|---|---|---|
| iPS:435013 | 21-225_89D5 | NA | SEQ ID NO:5986 GGTTGCTACTGGAGC | SEQ ID NO:13998 GAAATCAATCATAGTGG AAGCACCAACTACAACC CGTCCCTCAAGAGT | SEQ ID NO:22010 GACTACGGCGGGTATGGACGT C |
| | | AA | SEQ ID NO:5987 GCYWS | SEQ ID NO:13999 EINHSGSTNYNPSLKS | SEQ ID NO:22011 DYGGMDV |
| iPS:435015 | 21-225_89H5 | NA | SEQ ID NO:5988 GGTTGCTACTGGAGC | SEQ ID NO:14000 GAAATCAATTATATGTGG AAGCACCAACTTCAACC CGTCCCTCAAGAGT | SEQ ID NO:22012 GACTACGGCGGGTATGGACGT C |
| | | AA | SEQ ID NO:5989 GCYWS | SEQ ID NO:14001 EINYSGSTNFNPSLKS | SEQ ID NO:22013 DYGGMDV |
| iPS:435025 | 21-225_89E10 | NA | SEQ ID NO:5990 GGTTGCTACTGGAGC | SEQ ID NO:14002 GAAATCAATCATAGTGG AAGCACCAACTACAACC CGTCCCTCAAGAGT | SEQ ID NO:22014 GACTACGGCGGGTATGGACGT C |
| | | AA | SEQ ID NO:5991 GCYWS | SEQ ID NO:14003 EINHSGSTNYNPSLKS | SEQ ID NO:22015 DYGGMDV |
| iPS:435029 | 21-225_89A11 | NA | SEQ ID NO:5992 GGTTACTACTGGAGC | SEQ ID NO:14004 GAAATCAATCATAGTGG ACGCACCAGCTACAACC CGTCCCTCAAGAGT | SEQ ID NO:22016 GACTACGGTGGTTTGGACGT C |
| | | AA | SEQ ID NO:5993 GYYWS | SEQ ID NO:14005 EINHSGRTSYNPSLKS | SEQ ID NO:22017 DYGGLDV |
| iPS:435039 | 21-225_90G4 | NA | SEQ ID NO:5994 GGTTGCTACTGGAGC | SEQ ID NO:14006 GAAATCAATCATAGTGG AAGCACCAACTACAACC CGTCCCTCAAGAGT | SEQ ID NO:22018 GACTACGGCGGGTATGGACGT C |
| | | AA | SEQ ID NO:5995 GCYWS | SEQ ID NO:14007 EINHSGSTNYNPSLKS | SEQ ID NO:22019 DYGGMDV |

FIGURE 49
(Continued)

| | | | | | | |
|---|---|---|---|---|---|---|
| iPS:435041 | 21-225_90A5 | NA | SEQ ID NO:5996<br>GGTTGCTACTGGAGC | SEQ ID NO:14008<br>GAAATCAATCATAGTGG<br>AAGCACCAACTACAACC<br>CGTCCCTCAAGAGT | SEQ ID NO:22020<br>GACTACGGCGGTATGGACGT<br>C | |
| | | AA | SEQ ID NO:5997<br>GCYWS | SEQ ID NO:14009<br>EINHSGSTNYNPSLKS | SEQ ID NO:22021<br>DYGGMDV | |
| iPS:435043 | 21-225_90G5 | NA | SEQ ID NO:5998<br>GGTTGCTACTGGAGC | SEQ ID NO:14010<br>GAAATCAATCATAGTGG<br>AAGCACCAACTACAACC<br>CGTCCCTCAAGAGT | SEQ ID NO:22022<br>GACTACGGCGGTATGGACGT<br>C | |
| | | AA | SEQ ID NO:5999<br>GCYWS | SEQ ID NO:14011<br>EINHSGSTNYNPSLKS | SEQ ID NO:22023<br>DYGGMDV | |
| iPS:435045 | 21-225_90H5 | NA | SEQ ID NO:6000<br>GACTATGGCATGCAC | SEQ ID NO:14012<br>GTTATATGGTATGAAGG<br>AAGTAATACATACTATG<br>CAGACTCCGTGAAGGGC | SEQ ID NO:22024<br>GAGATGGGGTGGTTAGATGA<br>CTAC | |
| | | AA | SEQ ID NO:6001<br>DYGMH | SEQ ID NO:14013<br>VIWYEGSNTYYADSVKG | SEQ ID NO:22025<br>EMGWLDDY | |
| iPS:435051 | 21-225_90D9 | NA | SEQ ID NO:6002<br>AATTATGATATCAAC | SEQ ID NO:14014<br>TGGATGAACCCTAACAG<br>TGGTAACACAGGCTATG<br>CACAGAAGTTCCAGGGC | SEQ ID NO:22026<br>TCCAGTGGCTGGCACTGGTT<br>CGACCCC | |
| | | AA | SEQ ID NO:6003<br>NYDIN | SEQ ID NO:14015<br>WMNPNSGNTGYAQKFQG | SEQ ID NO:22027<br>SSGWHWFDP | |
| iPS:435053 | 21-225_75F9 | NA | SEQ ID NO:6004<br>AATTATGATATCAAC | SEQ ID NO:14016<br>TGGATGCACCTAACAG<br>TGGTAACACAGGCTATG<br>CACAGAAGTTCCAGGGC | SEQ ID NO:22028<br>AGCAGTGGCTGGTACATCTT<br>TGACTAC | |
| | | | SEQ ID NO:6005 | SEQ ID NO:14017 | SEQ ID NO:22029 | |

FIGURE 49
(Continued)

| | | AA | NYDIN | | WMHPNSGNTGYAQKFQG | | SSGWYIFDY | |
|---|---|---|---|---|---|---|---|---|
| iPS:435055 | | | SEQ ID NO:6006 | | SEQ ID NO:14018 | | SEQ ID NO:22030 | |
| | 21-225_90F10 | NA | GGTTGCTACTGGAGC | | GAAATCAATCATAGTGG AAGCACCAACTACAACC CGTCCCTCAAGAGT | | GACTACGGCGGTATGGACGT C | |
| | | AA | GCYWS | | EINHSGSTNYNPSLKS | | DYGGMDV | |
| | | | SEQ ID NO:6007 | | SEQ ID NO:14019 | | SEQ ID NO:22031 | |
| iPS:435059 | | | SEQ ID NO:6008 | | SEQ ID NO:14020 | | SEQ ID NO:22032 | |
| | 21-225_90C11 | NA | AACTACGACATGCAC | | GCTATTGGTACTGCTGGT GACACATACTATCCAGG CTCCGTGAAGGGC | | GTTCTTGACTACGGTGACTC CTTGGGCTACTACTACTACG GTATGGACGTC | |
| | | AA | NYDMH | | AIGTAGDTYYPGSVKG | | VLDYGDSLGYYYYGMDV | |
| | | | SEQ ID NO:6009 | | SEQ ID NO:14021 | | SEQ ID NO:22033 | |
| iPS:435071 | | | SEQ ID NO:6010 | | SEQ ID NO:14022 | | SEQ ID NO:22034 | |
| | 21-225_91F1 | NA | AATTATGATATCAAC | | TGGATGCACCCTAACAG TGGTAACACAGGCTATG CACAGAAGTTCCAGGGC | | AGCAGTGGCTGGTACTGGTT CGACCCC | |
| | | AA | NYDIN | | WMHPNSGNTGYAQKFQG | | SSGWYWFDP | |
| | | | SEQ ID NO:6011 | | SEQ ID NO:14023 | | SEQ ID NO:22035 | |
| iPS:435073 | | | SEQ ID NO:6012 | | SEQ ID NO:14024 | | SEQ ID NO:22036 | |
| | 21-225_91B2 | NA | GGTTGCTACTGGAGC | | GAAATCAATCATAGTGG AAGCACCAACTACAACC CGTCCCTCAAGAGT | | GACTACGGCGGTATGGACGT C | |
| | | AA | GCYWS | | EINHSGSTNYNPSLKS | | DYGGMDV | |
| | | | SEQ ID NO:6013 | | SEQ ID NO:14025 | | SEQ ID NO:22037 | |
| | | | SEQ ID NO:6014 | | SEQ ID NO:14026 | | SEQ ID NO:22038 | |

FIGURE 49
(Continued)

| | | | | | | |
|---|---|---|---|---|---|---|
| iPS:435075 | 21-225_91B3 | NA | GGTTGCTACTGGAGC | | GAAATCAATCATAGTGG AAGCACCAACTACAACC CGTCCCTCAAGAGT | GACTACGGCGGTATGGACGT C |
| | | | SEQ ID NO:6015 | | SEQ ID NO:14027 | SEQ ID NO:22039 |
| | | AA | GCYWS | | EINHSGSTNYNPSLKS | DYGGMDV |
| | | | SEQ ID NO:6016 | | SEQ ID NO:14028 | SEQ ID NO:22040 |
| iPS:435077 | 21-225_91F3 | NA | GGTTGCTACTGGAGC | | GAAATCAATCATAGTGG AAGCACCAACTACAACC CGTCCCTCAAGAGT | GACTACGGCGGTATGGACGT C |
| | | | SEQ ID NO:6017 | | SEQ ID NO:14029 | SEQ ID NO:22041 |
| | | AA | GCYWS | | EINHSGSTNYNPSLKS | DYGGMDV |
| | | | SEQ ID NO:6018 | | SEQ ID NO:14030 | SEQ ID NO:22042 |
| iPS:435079 | 21-225_91B4 | NA | GGTTGCTACTGGAGC | | GAAATCAATCATAGTGG AAGCACCAACTACAACC CGTCCCTCAAGAGT | GACTACGGCGGTATGGACGT C |
| | | | SEQ ID NO:6019 | | SEQ ID NO:14031 | SEQ ID NO:22043 |
| | | AA | GCYWS | | EINHSGSTNYNPSLKS | DYGGMDV |
| | | | SEQ ID NO:6020 | | SEQ ID NO:14032 | SEQ ID NO:22044 |
| iPS:435087 | 21-225_91G8 | NA | AATTATGATATCAAC | | TGGATGCACCCTAACAG TGGTAACACAGGCTATG CACAGAAGTTCCAGGGC | AGCAGTGGCTGGTACTGGTT CGACCCC |
| | | | SEQ ID NO:6021 | | SEQ ID NO:14033 | SEQ ID NO:22045 |
| | | AA | NYDIN | | WMHPNSGNTGYAQKFQG | SSGWYWFDP |
| | | | SEQ ID NO:6022 | | SEQ ID NO:14034 | SEQ ID NO:22046 |
| iPS:435089 | 21-225_91E9 | NA | GGTTGCTACTGGAGC | | GAAATCAATCATAGTGG AAGCACCAACTACAACC CGTCCCTCAAGAGT | GACTACGGCGGTATGGACGT C |
| | | | SEQ ID NO:6023 | | SEQ ID NO:14035 | SEQ ID NO:22047 |
| | | AA | GCYWS | | EINHSGSTNYNPSLKS | DYGGMDV |

FIGURE 49
(Continued)

| | | | | | | |
|---|---|---|---|---|---|---|
| iPS:435097 | 21-225_92B1 | NA | SEQ ID NO:6024<br>GGTTCCTACTGGAGC | | SEQ ID NO:14036<br>GAAATCAATTATAGGGG<br>AAGCACCAACTACAACC<br>CGTCCCTCAAGAGT | SEQ ID NO:22048<br>GACTACGGCGGTTGGACGT<br>C |
| | | AA | SEQ ID NO:6025<br>GSYWS | | SEQ ID NO:14037<br>EINYRGSTNYNPSLKS | SEQ ID NO:22049<br>DYGGLDV |
| iPS:435103 | 21-225_92B2 | NA | SEQ ID NO:6026<br>AACTACGACATGCAC | | SEQ ID NO:14038<br>GCTATTGGTACTGCTGGT<br>GACACATACTATCCAGG<br>CTCCGTGAAGGGC | SEQ ID NO:22050<br>GCTCTTGACTACGGTGACTC<br>CTTGGGCTACTACTACACG<br>GTATGGACGTC |
| | | AA | SEQ ID NO:6027<br>NYDMH | | SEQ ID NO:14039<br>AIGTAGDTYYPGSVKG | SEQ ID NO:22051<br>ALDYGDSLGYYYYGMDV |
| iPS:435109 | 21-225_92H5 | NA | SEQ ID NO:6028<br>AGCTATGGCATGCAC | | SEQ ID NO:14040<br>GTTATATGGTATGATGG<br>AAGTAATAAATACTATG<br>CAGACTCCGTGAAGGGC | SEQ ID NO:22052<br>GATCCCTTTATAGTGGGAGC<br>TACTTACTTTGACTAC |
| | | AA | SEQ ID NO:6029<br>SYGMH | | SEQ ID NO:14041<br>VIWYDGSNKYYADSVKG | SEQ ID NO:22053<br>DPFIVGATYFDY |
| iPS:435111 | 21-225_92D6 | NA | SEQ ID NO:6030<br>GGTTGCTACTGGAGC | | SEQ ID NO:14042<br>GAAATCAATCATAGTGG<br>AAGCACCAACTACAACC<br>CGTCCCTCAAGAGT | SEQ ID NO:22054<br>GACTACGGCGGGTATGGACGT<br>C |
| | | AA | SEQ ID NO:6031<br>GCYWS | | SEQ ID NO:14043<br>EINHSGSTNYNPSLKS | SEQ ID NO:22055<br>DYGGMDV |
| iPS:435113 | | NA | SEQ ID NO:6032<br>AATTATGATATCAAC | | SEQ ID NO:14044<br>TGGATGCACCCTAACAG<br>TGGTAACACAGGCTATG<br>CACAGAAGTTCCAGGGC | SEQ ID NO:22056<br>AGCAGTGGCTGGTACTTTTT<br>TGACTAC |

FIGURE 49
(Continued)

| | | | | | | |
|---|---|---|---|---|---|---|
| 21-225_92E6 | | | SEQ ID NO:6033 | | SEQ ID NO:14045 | SEQ ID NO:22057 |
| | | | NYDIN | | WMHPNSGNTGYAQKFQG | SSGWYFFDY |
| iPS:435115 | | AA | SEQ ID NO:6034 | | SEQ ID NO:14046 | SEQ ID NO:22058 |
| | | NA | GGTTGCTACTGGAGC | | GAAATCAATCATAGTGG AAGCACCAACTACAACC CGTCCCTCAAGAGT | GACTACGGCGGTATGGACGT C |
| 21-225_77C5 | | | SEQ ID NO:6035 | | SEQ ID NO:14047 | SEQ ID NO:22059 |
| | | | GCYWS | | EINHSGSTNYNPSLKS | DYGGMDV |
| | | AA | SEQ ID NO:6036 | | SEQ ID NO:14048 | SEQ ID NO:22060 |
| iPS:435167 | | NA | AATTATGATATCAAC | | TGGATGAACCCTAACAG TGGTAACACAGGCTATG CACAGAAGTTCCAGGGC | ACCAGTGGCGGGAAGTTCTT CGACTAC |
| 21-225_92F12 | | | SEQ ID NO:6037 | | SEQ ID NO:14049 | SEQ ID NO:22061 |
| | | AA | NYDIN | | WMNPNSGNTGYAQKFQG | TSGGKFFDY |
| iPS:435171 | | NA | SEQ ID NO:6038 | | SEQ ID NO:14050 | SEQ ID NO:22062 |
| | | | GGTTGCTACTGGAGC | | GAAATCAATCATAGTGG AAGCACCAACTACAACC CGTCCCTCAAGAGT | GACTACGGCGGTATGGACGT C |
| 21-225_93C2 | | | SEQ ID NO:6039 | | SEQ ID NO:14051 | SEQ ID NO:22063 |
| | | AA | GCYWS | | EINHSGSTNYNPSLKS | DYGGMDV |
| | | | SEQ ID NO:6040 | | SEQ ID NO:14052 | SEQ ID NO:22064 |
| iPS:435177 | | NA | GGTTGCTACTGGAGC | | GAAATCAATCATAGTGG AAGCACCAACTACAACC CGTCCCTCAAGAGT | GACTACGGCGGTATGGACGT C |
| 21-225_93E4 | | | SEQ ID NO:6041 | | SEQ ID NO:14053 | SEQ ID NO:22065 |
| | | AA | GCYWS | | EINHSGSTNYNPSLKS | DYGGMDV |
| | | | SEQ ID NO:6042 | | SEQ ID NO:14054 | SEQ ID NO:22066 |

FIGURE 49
(Continued)

| | | | | |
|---|---|---|---|---|
| iPS:435183 | 21-225_93E9 | NA | GGTTGCTACTGGAGC | GAAATCAATCATAGTGG AAGGACCAACTACAACC CGTCCCTCAAGAGT | GACTACGGTGGCTTGACTA C |
| | | | SEQ ID NO:6043 | SEQ ID NO:14055 | SEQ ID NO:22067 |
| | | AA | GCYWS | EINHSGRTNYNPSLKS | DYGGLDY |
| | | | SEQ ID NO:6044 | SEQ ID NO:14056 | SEQ ID NO:22068 |
| iPS:435195 | 21-225_94D3 | NA | GGTTGCTACTGGAGC | GAAATCAATTATAGTGG AAGAACCAACTACAACC CGTCCCTCAAGAGT | GACTACGGCGGTATGGACGT C |
| | | | SEQ ID NO:6045 | SEQ ID NO:14057 | SEQ ID NO:22069 |
| | | AA | GCYWS | EINYSGRTNYNPSLKS | DYGGMDV |
| | | | SEQ ID NO:6046 | SEQ ID NO:14058 | SEQ ID NO:22070 |
| iPS:435197 | 21-225_94F3 | NA | AACGATATCATGCAC | GTTATATGGTATGATGG AAGTAATAAATACTATG CAGACTCCGTGAAGGGC | GAAAAATATAGCAGTGGCTG GTACGACTACGGTATGGACG TC |
| | | | SEQ ID NO:6047 | SEQ ID NO:14059 | SEQ ID NO:22071 |
| | | AA | NDIMH | VIWYDGSNKYYADSVKG | EKYSSGWYDYGMDV |
| | | | SEQ ID NO:6048 | SEQ ID NO:14060 | SEQ ID NO:22072 |
| iPS:435203 | 21-225_75A7 | NA | AATTATGATATCAAC | TGGATGAACCCTAACAG TGGTAACACAGGCTATG CACAGAAGTTCCAGGAC | TCCAGTGGCTGGCACTGGTT CGACCCC |
| | | | SEQ ID NO:6049 | SEQ ID NO:14061 | SEQ ID NO:22073 |
| | | AA | NYDIN | WMNPNSGNTGYAQKFQD | SSGWHWFDP |
| | | | SEQ ID NO:6050 | SEQ ID NO:14062 | SEQ ID NO:22074 |

FIGURE 49
(Continued)

| | | | | |
|---|---|---|---|---|
| iPS:435209 | | NA | AATTATGATATCAAC | TGGATGAACCCTAACAG TGGTAACACAGGCTATG CACAGAAGTTCCAGGGC | AGCAGTGGCTGGTACTACTT TGACTAC |
| | 21-225_75A10 | | SEQ ID NO:6051 | SEQ ID NO:14063 | SEQ ID NO:22075 |
| | | AA | NYDIN | WMNPNSGNTGYAQKFQG | SSGWYYFDY |
| iPS:435211 | | | SEQ ID NO:6052 | SEQ ID NO:14064 | SEQ ID NO:22076 |
| | | NA | AATTATGATATCAAC | TGGATGAACCCTAACAG TGGTAACACAGGCTATG CACAGAAGTTCCAGGGC | TCCAGTGGCTGGAAGTGGTT CGACCCC |
| | 21-225_94E11 | | SEQ ID NO:6053 | SEQ ID NO:14065 | SEQ ID NO:22077 |
| | | AA | NYDIN | WMNPNSGNTGYAQKFQG | SSGWKWFDP |
| iPS:435215 | | | SEQ ID NO:6054 | SEQ ID NO:14066 | SEQ ID NO:22078 |
| | | NA | AATTATGATATCAAC | TGGATGAACCCTAACAG TGGTAACACAGGCTATG CACAGAAGTTCCAGGGC | ACCAGTGGCTGGAAGTTCTT TGACTAC |
| | 21-225_94E12 | | SEQ ID NO:6055 | SEQ ID NO:14067 | SEQ ID NO:22079 |
| | | AA | NYDIN | WMNPNSGNTGYAQKFQG | TSGWKFFDY |
| iPS:435217 | | | SEQ ID NO:6056 | SEQ ID NO:14068 | SEQ ID NO:22080 |
| | | NA | GGTTGCTACTGGAGC | GAAATCAATCATAGTGG AAGCACCAACTACAACC CGTCCCTCAAGAGT | GACTACGGCGGGTATGGACGT C |
| | 21-225_94F12 | | SEQ ID NO:6057 | SEQ ID NO:14069 | SEQ ID NO:22081 |
| | | AA | GCYWS | EINHSGSTNYNPSLKS | DYGGMDV |
| iPS:435219 | | | SEQ ID NO:6058 | SEQ ID NO:14070 | SEQ ID NO:22082 |
| | 21_225_95D2 | NA | GGTTGCTACTGGAGC | GAAATCAATCATAGTGG AAGCACCAACTACAACC CGTCCCTCAAGAGT | GACTACGGCGGGTATGGACGT C |

FIGURE 49
(Continued)

| | | | | | | |
|---|---|---|---|---|---|---|
| iPS:435221 | 21-225_95D2 | AA | SEQ ID NO:6059<br>GCYWS | SEQ ID NO:14071<br>EINHSGSTNYNPSLKS | SEQ ID NO:22083<br>DYGGMDV | |
| | | NA | SEQ ID NO:6060<br>AGCTATGGCATGCAC | SEQ ID NO:14072<br>GTTATTTGGTATGATGGAAGTAATAAATACTATGCAGACTCCGTGAAGGGC | SEQ ID NO:22084<br>GATCGCAATATAGTGGGAGCTACTTACTTTGAGTCC | |
| iPS:435227 | 21-225_95G2 | AA | SEQ ID NO:6061<br>SYGMH | SEQ ID NO:14073<br>VIWYDGSNKYYADSVKG | SEQ ID NO:22085<br>DRNIVGATYFES | |
| | | NA | SEQ ID NO:6062<br>AATTATGATATCAAC | SEQ ID NO:14074<br>TGGATGAACCCTAACAGTGGTAACACAGGCTATGCACAGAAGTTCCAGGGC | SEQ ID NO:22086<br>TCCAGTGGCTGGAACTGGTTCGACCCC | |
| iPS:435235 | 21-225_95G4 | AA | SEQ ID NO:6063<br>NYDIN | SEQ ID NO:14075<br>WMNPNSGNTGYAQKFQG | SEQ ID NO:22087<br>SSGWNWFDP | |
| | | NA | SEQ ID NO:6064<br>GGTTGCTACTGGAGC | SEQ ID NO:14076<br>GAAATCAATCATAGTGGAAGCACCAACTACAACCCGTCCCTCAAGAGT | SEQ ID NO:22088<br>GACTACGGCGGTATGGACGTC | |
| | 21-225_95F9 | AA | SEQ ID NO:6065<br>GCYWS | SEQ ID NO:14077<br>EINHSGSTNYNPSLKS | SEQ ID NO:22089<br>DYGGMDV | |
| iPS:435237 | | NA | SEQ ID NO:6066 | SEQ ID NO:14078 | SEQ ID NO:22090 | |
| | 21-225_95G9 | NA | SEQ ID NO:6067<br>GGTTGCTACTGGAGC | SEQ ID NO:14079<br>GAAATCAATCATAGTGGAAGCACCAACTACAACCCGTCCCTCAAGAGT | SEQ ID NO:22091<br>GACTACGGCGGTATGGACGTC | |
| | | AA | SEQ ID NO:6068<br>GCYWS | SEQ ID NO:14080<br>EINHSGSTNYNPSLKS | SEQ ID NO:22092<br>DYGGMDV | |

FIGURE 49
(Continued)

| | | | | | |
|---|---|---|---|---|---|
| iPS:435239 | 21-225_95H10 | NA | GGTTGCTACTGGAGC | GAAATCAATCATAGTGG AAGCACCAACTACAACC CGTCCCTCAAGAGT | GACTACGGCGGTATGGACGT C |
| | | | SEQ ID NO:6069 | SEQ ID NO:14081 | SEQ ID NO:22093 |
| | | AA | GCYWS | EINHSGSTNYNPSLKS | DYGGMDV |
| | | | SEQ ID NO:6070 | SEQ ID NO:14082 | SEQ ID NO:22094 |
| iPS:435245 | 21-225_95E12 | NA | AATTATGATATCAAC | TGGATGAACCCTAACAG TGGTAACACAGGCTATG CACAGAAGTTCCAGGGC | AGCAGTGGCTGGTACTGGTT CGACCCC |
| | | | SEQ ID NO:6071 | SEQ ID NO:14083 | SEQ ID NO:22095 |
| | | AA | NYDIN | WMNPNSGNTGYAQKFQG | SSGWYWFDP |
| | | | SEQ ID NO:6072 | SEQ ID NO:14084 | SEQ ID NO:22096 |
| iPS:435247 | 21-225_96G1 | NA | AATTATGATATCAAC | TGGATGCACCCTAACAA TGGTAACACAGGCTATG CACAGAAGTTCCAGGGC | AGCAGTGGCTGGTACTGGTT CGACCCC |
| | | | SEQ ID NO:6073 | SEQ ID NO:14085 | SEQ ID NO:22097 |
| | | AA | NYDIN | WMHPNNGNTGYAQKFQG | SSGWYWFDP |
| | | | SEQ ID NO:6074 | SEQ ID NO:14086 | SEQ ID NO:22098 |
| iPS:435249 | 21-225_96E2 | NA | AATTATGATATCAAC | TGGATGCACCCTAATAG TGGTAACACAGGCTATG CACAGAAGTTCCAGGGC | TCCAGTGGCTGGTACTGGTT CGACCCC |
| | | | SEQ ID NO:6075 | SEQ ID NO:14087 | SEQ ID NO:22099 |
| | | AA | NYDIN | WMHPNSGNTGYAQKFQG | SSGWYWFDP |
| | | | SEQ ID NO:6076 | SEQ ID NO:14088 | SEQ ID NO:22100 |
| iPS:435251 | 21_225_96A3 | NA | AGTAGTAATTACTACTGGGG C | AGTATCTATTATAGTGGA TACACCTCCTACAACCCG TCCCTCAAGAGT | CTTGACTCTAACTGGGGTCT TGACTAC |

FIGURE 49
(Continued)

| | | | | | | |
|---|---|---|---|---|---|---|
| iPS:435253 | 21-225_96A3 | AA | SEQ ID NO:6077<br>SSNYYWG | SEQ ID NO:14089<br>SIYYSGYTSYNPSLKS | SEQ ID NO:22101<br>LDSNWGLDY | |
| | | NA | SEQ ID NO:6078<br>AGTTATGATATCAAC | SEQ ID NO:14090<br>TGGATGAACCCTAACAG<br>TGGTAACACAGGCTATG<br>CACAGAAGTTCCAGGGC | SEQ ID NO:22102<br>GGCTTTTACGATACTTTGACT<br>GGTTCCGGCTACTACTACGT<br>TATGGACGTC | |
| iPS:435255 | 21-225_96A4 | AA | SEQ ID NO:6079<br>SYDIN | SEQ ID NO:14091<br>WMNPNSGNTGYAQKFQG | SEQ ID NO:22103<br>GFYDILTGSGYYYVMDV | |
| | | NA | SEQ ID NO:6080<br>AATTATGATATCAAC | SEQ ID NO:14092<br>TGGATGAACCCTAACAG<br>TGGTAACACAGGCTATG<br>CACAGAAGTTCCAGGGC | SEQ ID NO:22104<br>TCCAGTGGCTGGTCCTGGTT<br>CGACCCC | |
| iPS:435257 | 21-225_96D5 | AA | SEQ ID NO:6081<br>NYDIN | SEQ ID NO:14093<br>WMNPNSGNTGYAQKFQG | SEQ ID NO:22105<br>SSGWSWFDP | |
| | | NA | SEQ ID NO:6082<br>AATTATGATATCAAC | SEQ ID NO:14094<br>TGGATGCACCCTAACAG<br>TGGTAACACAGGCTATG<br>CACAGAAGTTCCAGGGC | SEQ ID NO:22106<br>AGTAGTGGCTGGTACAAATT<br>TGACTAC | |
| | 21-225_96H5 | AA | SEQ ID NO:6083<br>NYDIN | SEQ ID NO:14095<br>WMHPNSGNTGYAQKFQG | SEQ ID NO:22107<br>SSGWYKFDY | |
| iPS:435259 | | NA | SEQ ID NO:6084<br>AGTTATGATATCAAC | SEQ ID NO:14096<br>TGGATGAACCCTAACAG<br>TCGTAACACAGGCTATG<br>CACAGAAGTTCCAGGGC | SEQ ID NO:22108<br>GGCGGCTACGATGTTTGCC<br>TGGAATAACTACTACTACG<br>ATATGGACGTC | |
| | 21-225_96C6 | AA | SEQ ID NO:6085<br>SYDIN | SEQ ID NO:14097<br>WMNPNSRNTGYAQKFQG | SEQ ID NO:22109<br>GGYDVLPGNNYYYDMDV | |

FIGURE 49
(Continued)

| | | | SEQ ID NO:6086 | SEQ ID NO:14098 | SEQ ID NO:22110 |
|---|---|---|---|---|---|
| iPS:435267 | | NA | AATTATGATATCAAC | TGGATGCACCCTAACAG TGGTAACACAGGCTATG CACAGAAGTTCCAGGGC | AGCAGTGGCTGGTACTTTT TGACTAC |
| | 21-225_96D10 | | SEQ ID NO:6087 | SEQ ID NO:14099 | SEQ ID NO:22111 |
| | | AA | NYDIN | WMHPNSGNTGYAQKFQG | SSGWYFFDY |
| | | | SEQ ID NO:6088 | SEQ ID NO:14100 | SEQ ID NO:22112 |
| iPS:435273 | | NA | GGTTGCTACTGGAGC | GAAATCAATCATAGTGG AAGCACCAACTACAACC CGTCCCTCAAGAGT | GACTACGGCGGTATGGACGT C |
| | 21-225_97A2 | | SEQ ID NO:6089 | SEQ ID NO:14101 | SEQ ID NO:22113 |
| | | AA | GCYWS | EINHSGSTNYNPSLKS | DYGGMDV |
| | | | SEQ ID NO:6090 | SEQ ID NO:14102 | SEQ ID NO:22114 |
| iPS:435279 | | NA | AATTATGATATCAAC | TGGATGCACCCTAACAG TGGTAACACAGGCTATG CACAGAAGTTCCAGGGC | AGCAGTGGCTGGTACTGGTT CGACCCC |
| | 21-225_97H4 | | SEQ ID NO:6091 | SEQ ID NO:14103 | SEQ ID NO:22115 |
| | | AA | NYDIN | WMHPNSGNTGYAQKFQG | SSGWYWFDP |
| | | | SEQ ID NO:6092 | SEQ ID NO:14104 | SEQ ID NO:22116 |
| iPS:435281 | | NA | GGTTGCTACTGGAGC | GAAATCAATCATAGTGG AAGCACCAACTACAACC CGTCCCTCAAGAGT | GACTACGGCGGGTATGGACGT C |
| | 21-225_97E5 | | SEQ ID NO:6093 | SEQ ID NO:14105 | SEQ ID NO:22117 |
| | | AA | GCYWS | EINHSGSTNYNPSLKS | DYGGMDV |
| | | | SEQ ID NO:6094 | SEQ ID NO:14106 | SEQ ID NO:22118 |

FIGURE 49
(Continued)

| | | | | | |
|---|---|---|---|---|---|
| iPS:435291 | 21-225_146E1 | NA | AGCTATGGCATGCAC | ATTATATGGTATGATGG AAGTAATAAATACTATG CAGACTCCGTGAAGGGC | GATCGTTAGTGGGAGCTAC CGCTGATGCTTTGATATC |
| | | | SEQ ID NO:6095 | SEQ ID NO:14107 | SEQ ID NO:22119 |
| | | AA | SYGMH | IIWYDGSNKYYADSVKG | DRLVGATADAFDI |
| | | | SEQ ID NO:6096 | SEQ ID NO:14108 | SEQ ID NO:22120 |
| iPS:435293 | 21-225_146F1 | NA | AGAAGTAGTTACTACTGGGG C | AGTATATATTATAGTGG GAGTACCTCCTACAACC CGTCCCTCAAGAGT | CTTGATCTCCTGTGAGTTTT GACTAC |
| | | | SEQ ID NO:6097 | SEQ ID NO:14109 | SEQ ID NO:22121 |
| | | AA | RSSYYWG | SIYYSGSTSYNPSLKS | LDLLWSFDY |
| | | | SEQ ID NO:6098 | SEQ ID NO:14110 | SEQ ID NO:22122 |
| iPS:435295 | 21-225_146H1 | NA | AGCTATGCCATGAGC | GCTATTAGTGGTCGTGGT GGTAACACATTCTACGC AGACTCCGTGAAGGGC | CGGGTGACGGACTACGGTGG TAACGACTGGTTCGACCCC |
| | | | SEQ ID NO:6099 | SEQ ID NO:14111 | SEQ ID NO:22123 |
| | | AA | SYAMS | AISGRGGNTFYADSVKG | RVTDYGGNDWFDP |
| | | | SEQ ID NO:6100 | SEQ ID NO:14112 | SEQ ID NO:22124 |
| iPS:435297 | 21-225_146B3 | NA | AGCTATGGCATGCAC | GTTATATGGTATGATGG AAGTTATAAATACTATG CAGACTCCGTGAAGGGC | ATGGGTATAGAAGTGGCTGT GGACTACTACTACGGTATGG ACGTC |
| | | | SEQ ID NO:6101 | SEQ ID NO:14113 | SEQ ID NO:22125 |
| | | AA | SYGMH | VIWYDGSYKYYADSVKG | MGIEVAVDYYYGMDV |
| | | | SEQ ID NO:6102 | SEQ ID NO:14114 | SEQ ID NO:22126 |
| iPS:435299 | 21-225_146D4 | NA | AATTATGATATCAAC | TGGGTGCACCTAACAG TGGTAACACAGGCTATG CACAGAAGTTCCAGGGC | AGCAGTGGCTGGTACTACTT TGACTAC |
| | | | SEQ ID NO:6103 | SEQ ID NO:14115 | SEQ ID NO:22127 |

FIGURE 49
(Continued)

| | | AA | NYDIN | | WVHPNSGNTGYAQKFQG | SSGWYYFDY |
|---|---|---|---|---|---|---|
| iPS:435301 | 21-225_146G4 | NA | SEQ ID NO:6104 AACAGTGGTTACTACTGGAG C | SEQ ID NO:14116 TACAGCTATTACAGTGG GAGCACCTACTACAACC CGTCCCTCAAGAGT | SEQ ID NO:22128 GGGAAATATAACTGAACCA TGCTTTTGATATC |
| | | AA | SEQ ID NO:6105 NSGYYWS | SEQ ID NO:14117 YSYYSGSTYYNPSLKS | SEQ ID NO:22129 GKYNWNHAFDI |
| iPS:435303 | 21-225_146A6 | NA | SEQ ID NO:6106 AGCTATGCCATGAAC | SEQ ID NO:14118 GCTATTAGTAGTGGTAGTGGT GGTAACACATTCTACGC AGACTCCGTGAAGGGC | SEQ ID NO:22130 AAGGATAATGATTACGTTTG GGGGAGTCCTTACTTTGACT AC |
| | | AA | SEQ ID NO:6107 SYAMN | SEQ ID NO:14119 AISGSGGNTFYADSVKG | SEQ ID NO:22131 KDNDYVWGSPYFDY |
| iPS:435305 | 21-225_146C9 | NA | SEQ ID NO:6108 AATTATGATATCAAC | SEQ ID NO:14120 TGGATGCACCCTAACAG TGGTAACACAGGCTATG CACAGAAGTTCCAGGGC | SEQ ID NO:22132 AGCAGTGGCTGGTACTCCTT TGACTAC |
| | | AA | SEQ ID NO:6109 NYDIN | SEQ ID NO:14121 WMHPNSGNTGYAQKFQG | SEQ ID NO:22133 SSGWYSFDY |
| iPS:435307 | 21-225_146E9 | NA | SEQ ID NO:6110 AGCTATGCCATGAGC | SEQ ID NO:14122 GCTATTAGTGGTGGTGGT GGTAACACATTCTACGC AGACTCCGTGAAGGGC | SEQ ID NO:22134 CGGGTGACGGACTACGGTGG TAACGACTGGTTCGACCCC |
| | | AA | SEQ ID NO:6111 SYAMS | SEQ ID NO:14123 AISGRGGNTFYADSVKG | SEQ ID NO:22135 RVTDYGGNDWFDP |
| | | | SEQ ID NO:6112 | SEQ ID NO:14124 | SEQ ID NO:22136 |

FIGURE 49
(Continued)

| | | | | | | |
|---|---|---|---|---|---|---|
| iPS:435309 | 21-225_146F9 | NA | AATTATGATATCAAC | | TGGATGCACCCTAACAGTGGTAACACAGGCTATGCACAGAAGTTCCAGGGC | | AGCAGTGGCTGGTGTACTTTTTGACTAC |
| | | | SEQ ID NO:6113 | | SEQ ID NO:14125 | | SEQ ID NO:22137 |
| | | AA | NYDIN | | WMHPNSGNTGYAQKFQG | | SSGWYFFDY |
| | | | SEQ ID NO:6114 | | SEQ ID NO:14126 | | SEQ ID NO:22138 |
| iPS:435311 | 21-225_146H9 | NA | AGCTATGGCATGCAC | | GTGATATGGTTTGATGAAAGTAATAAACACTATGGAGACTCCGTGAAGGGC | | GAATTGGGATTCTCTCTGACTAT |
| | | | SEQ ID NO:6115 | | SEQ ID NO:14127 | | SEQ ID NO:22139 |
| | | AA | SYGMH | | VIWFDESNKHYGDSVKG | | ELGFLSDY |
| | | | SEQ ID NO:6116 | | SEQ ID NO:14128 | | SEQ ID NO:22140 |
| iPS:435313 | 21-225_146G11 | NA | AGCTATAGCATGAAC | | TCCATTAGTGGTAGTGGTAGTACACATACTACGAGACTCAGTGAAGGGC | | GGTAGCAGCTCGTCCGGGTTTGACTAC |
| | | | SEQ ID NO:6117 | | SEQ ID NO:14129 | | SEQ ID NO:22141 |
| | | AA | SYSMN | | SISGSGSYTYYADSVKG | | GSSSSGFFDY |
| | | | SEQ ID NO:6118 | | SEQ ID NO:14130 | | SEQ ID NO:22142 |
| iPS:435315 | 21-225_147B2 | NA | AGCTATGGCATGCAC | | GTTATATGGTATGATGGAAGTAATAAATACTATGCAGACTCCGTGAAGGGC | | AGGTATAGCAGCAGCTGGTCGGGGGGTATGGACGTC |
| | | | SEQ ID NO:6119 | | SEQ ID NO:14131 | | SEQ ID NO:22143 |
| | | AA | SYGMH | | VIWYDGSNKYYADSVKG | | RYSSSWSGGMDV |
| | | | SEQ ID NO:6120 | | SEQ ID NO:14132 | | SEQ ID NO:22144 |

FIGURE 49
(Continued)

| | | | | | |
|---|---|---|---|---|---|
| iPS:435317 | 21-225_147D2 | NA | AGTGGTGATTACTACTGGAAC | TTCATCTATTACACTGGGAGCACCTACTACAACCCGTCCCTCAAGAGT | GGGGGAGCTTACTACTCCTACTACGGTATGGACGTC |
| | | | SEQ ID NO:6121 | SEQ ID NO:14133 | SEQ ID NO:22145 |
| | | AA | SGDYYWN | FIYYTGSTYYNPSLKS | GGAYYSYYGMDV |
| | | | SEQ ID NO:6122 | SEQ ID NO:14134 | SEQ ID NO:22146 |
| iPS:435319 | 21-225_147E3 | NA | AATAGTGGTTACTACTATAGC | TACATCTATTACAGTGGGGGCACCTACTACAACCCGTCCCTCAAGAGT | GGGGGATATAACTGGAACCATGCTTTTGATTTC |
| | | | SEQ ID NO:6123 | SEQ ID NO:14135 | SEQ ID NO:22147 |
| | | AA | NSGYYYS | YIYYSGGTYYNPSLKS | GGYNWNHAFDF |
| | | | SEQ ID NO:6124 | SEQ ID NO:14136 | SEQ ID NO:22148 |
| iPS:435321 | 21-225_147E4 | NA | AATTATGATATCAAC | TGGATGAACCCTAACAGTGGTAACACAGGCTATGCACAGAAGTTCCAGGGC | AGCAGTGGCTGGTACTTTTTGACTAC |
| | | | SEQ ID NO:6125 | SEQ ID NO:14137 | SEQ ID NO:22149 |
| | | AA | NYDIN | WMNPNSGNTGYAQKFQG | SSGWYFFDY |
| | | | SEQ ID NO:6126 | SEQ ID NO:14138 | SEQ ID NO:22150 |
| iPS:435323 | 21-225_147D5 | NA | AATTATGATATCAAC | TGGGTGCACCCTAACAGTGGTAACACAGGCTATGCACAGAAGTTCCAGGGC | AGCAGTGGCTGGTACTACTTTGACTAC |
| | | | SEQ ID NO:6127 | SEQ ID NO:14139 | SEQ ID NO:22151 |
| | | AA | NYDIN | WVHPNSGNTGYAQKFQG | SSGWYYFDY |
| | | | SEQ ID NO:6128 | SEQ ID NO:14140 | SEQ ID NO:22152 |
| iPS:435325 | 21-225_147H5 | NA | GACTATGGCATGCAC | GTTATATGGTATGATGGAAGTAATAAGTACTATGCAGACTCCGTGAAGGGC | GAGAGGTATAGCAGTGGCTGGTACGACTACGGTTTGGACGTC |
| | | | SEQ ID NO:6129 | SEQ ID NO:14141 | SEQ ID NO:22153 |

FIGURE 49
(Continued)

| | | AA | DYGMH | | VIWYDGSNKYYADSVKG | ERYSSGWYDYGLDV |
|---|---|---|---|---|---|---|
| iPS:435327 | | | SEQ ID NO:6130 | | SEQ ID NO:14142 | SEQ ID NO:22154 |
| | 21-225_147G6 | NA | AATTATGATATCAAC | | TGGATGCACCCCAACAGTGGTAACACAGGCTATGCACAGAAGTTCCAGGGC | AGCAGTGGCTGGTACTGGTTCGACCCC |
| | | | SEQ ID NO:6131 | | SEQ ID NO:14143 | SEQ ID NO:22155 |
| iPS:435329 | | AA | NYDIN | | WMHPNSGNTGYAQKFQG | SSGWYWFDP |
| | | | SEQ ID NO:6132 | | SEQ ID NO:14144 | SEQ ID NO:22156 |
| | 21-225_147A8 | NA | AGCTATAGGCATGCAC | | GTTATATGGTATGATGGAAGTAATAAATACTATGCAGACTCCGTGAAGGGC | AGGTATAGCAGCAGCTGGACGGGGGTATGGACGTC |
| | | | SEQ ID NO:6133 | | SEQ ID NO:14145 | SEQ ID NO:22157 |
| iPS:435331 | | AA | SYGMH | | VIWYDGSNKYYADSVKG | RYSSSWTGGMDV |
| | | | SEQ ID NO:6134 | | SEQ ID NO:14146 | SEQ ID NO:22158 |
| | 21-225_147G8 | NA | GCTTACTACTGGAGC | | GAAATCAATCATAGTGGAAGTACCAACTACAAACCGTCCCTCAAGAGT | GACTACGGTGTGTTTTGACTAC |
| | | | SEQ ID NO:6135 | | SEQ ID NO:14147 | SEQ ID NO:22159 |
| iPS:435333 | | AA | AYYWS | | EINHSGSTNYKPSLKS | DYGVFDY |
| | | | SEQ ID NO:6136 | | SEQ ID NO:14148 | SEQ ID NO:22160 |
| | 21-225_147E9 | NA | AGCTATAGGCATGAAC | | TCCATTAGTGGTAGAAACACTACCATATACTATGCAGACTCTGTGAAGGGC | GATCGGGGCAGTTGC |
| | | | SEQ ID NO:6137 | | SEQ ID NO:14149 | SEQ ID NO:22161 |
| | | AA | SYSMN | | SISGRNTTIYYADSVKG | DRGSC |
| | | | SEQ ID NO:6138 | | SEQ ID NO:14150 | SEQ ID NO:22162 |

FIGURE 49
(Continued)

| | | | | | | |
|---|---|---|---|---|---|---|
| iPS:435335 | 21-225_147D10 | NA | AGCTATGCCATGAGC | | GCTATTAGTGGTCGTGGT GGTAACACATTCTACGC AGACTCCGTGAAGGGC | AAGGATTATGATTACGTTTG GGGGAGTCCTTACTTTGACT AC |
| | | | SEQ ID NO:6139 | | SEQ ID NO:14151 | SEQ ID NO:22163 |
| | | AA | SYAMS | | AISGRGGNTFYADSVKG | KDYDYVWGSPYFDY |
| | | | SEQ ID NO:6140 | | SEQ ID NO:14152 | SEQ ID NO:22164 |
| iPS:435339 | 21-225_147D12 | NA | AGCTATGCCATGAGC | | GCTATTAGTGGTCGTGGT GGTAACACATTCTACGC AGACTCCGTGAAGGGC | AAGGATTATGATTACGTTTG GGGGAGTCCTTACTTTGACT AC |
| | | | SEQ ID NO:6141 | | SEQ ID NO:14153 | SEQ ID NO:22165 |
| | | AA | SYAMS | | AISGRGGNTFYADSVKG | KDYDYVWGSPYFDY |
| | | | SEQ ID NO:6142 | | SEQ ID NO:14154 | SEQ ID NO:22166 |
| iPS:435341 | 21-225_148B2 | NA | AGCTATGGCATGCAC | | ATTATCTGGTATGATGGA AGTTATAAATACTATGC AGACTCCGTGAAGGGC | GATCATTCGATTTTGGAGT GGTCACTTTGACTAC |
| | | | SEQ ID NO:6143 | | SEQ ID NO:14155 | SEQ ID NO:22167 |
| | | AA | SYGMH | | IIWYDGSYKYYADSVKG | DHFDFWSGHFDY |
| | | | SEQ ID NO:6144 | | SEQ ID NO:14156 | SEQ ID NO:22168 |
| iPS:435343 | 21-225_148E2 | NA | AGCTATGCCATGAGC | | GCTATTAGTGGTCGTGGT GGTAACACATTCTACGC AGACTCCGTGAAGGGC | AAGGATTATGATTACGTTTG GGGGAGTCCTTACTTTGACT AC |
| | | | SEQ ID NO:6145 | | SEQ ID NO:14157 | SEQ ID NO:22169 |
| | | AA | SYAMS | | AISGRGGNTFYADSVKG | KDYDYVWGSPYFDY |
| | | | SEQ ID NO:6146 | | SEQ ID NO:14158 | SEQ ID NO:22170 |
| iPS:435345 | 21-225_148G3 | NA | AATTATGATATCAAC | | TGGATGCACCCTAACAG TGGTAACACAGGCTATG CACAGAACTTCCAGGGC | AGCAGTGGCTGGTACTTTT TGACTAC |
| | | | SEQ ID NO:6147 | | SEQ ID NO:14159 | SEQ ID NO:22171 |
| | | AA | NYDIN | | WMHPNSGNTGYAQNFQG | SSGWYFFDY |

FIGURE 49
(Continued)

| | | | | | | |
|---|---|---|---|---|---|---|
| iPS:435347 | 21-225_148C4 | NA | SEQ ID NO:6148<br>AGCTATGGCCATGAAC | SEQ ID NO:14160<br>GCTATTAGTGGTAGTGGT<br>GGTAACACATTCTACGC<br>AGACTCCGTGAAGGGC | SEQ ID NO:22172<br>CGGGTGACGGACTACGGTGG<br>TAACGACTGGTTCGACCCC | |
| | | AA | SEQ ID NO:6149<br>SYAMN | SEQ ID NO:14161<br>AISGSGGNTFYADSVKG | SEQ ID NO:22173<br>RVTDYGGNDWFDP | |
| iPS:435349 | 21-225_148F5 | NA | SEQ ID NO:6150<br>AGCTATGGCATGCAC | SEQ ID NO:14162<br>GTTATATGGTATGATGG<br>AAGTAATAAATACTATG<br>CAGACTCCGTGAAGGGC | SEQ ID NO:22174<br>AGGTATAGCAGCAGCTGGTC<br>GGGGGTATGGACGTC | |
| | | AA | SEQ ID NO:6151<br>SYGMH | SEQ ID NO:14163<br>VIWYDGSNKYYADSVKG | SEQ ID NO:22175<br>RYSSSWSGGMDV | |
| iPS:435351 | 21-225_148B6 | NA | SEQ ID NO:6152<br>GGCTACTATATGCAC | SEQ ID NO:14164<br>TGGATCCACCCTAACAA<br>TGGTGGCACAAACTATG<br>CACAGACGTTTCAGGGC | SEQ ID NO:22176<br>GATCCTGTAGTAGTACCAGC<br>TGCCCCCTTTGACTAC | |
| | | AA | SEQ ID NO:6153<br>GYYMH | SEQ ID NO:14165<br>WIHPNNGGTNYAQTFQG | SEQ ID NO:22177<br>DPVVVPAAPFDY | |
| iPS:435353 | 21-225_148F8 | NA | SEQ ID NO:6154<br>AATTATGATATCAAC | SEQ ID NO:14166<br>TGGATGAACCCTAACAG<br>TGGTAACACAGGCTATG<br>CACAGAAGTTCCAGGGC | SEQ ID NO:22178<br>AGCAGTGGCTGGTACTACTT<br>TGACTAC | |
| | | AA | SEQ ID NO:6155<br>NYDIN | SEQ ID NO:14167<br>WMNPNSGNTGYAQKFQG | SEQ ID NO:22179<br>SSGWYYFDY | |
| | | | SEQ ID NO:6156 | SEQ ID NO:14168 | SEQ ID NO:22180 | |

FIGURE 49
(Continued)

| | | | | | | |
|---|---|---|---|---|---|---|
| iPS:435355 | 21-225_148H9 | NA | AGCTATGCCATGAGC | GCTATTAGTGGTCGTGGT GGTAACACATTCTACGC AGACTCCGTGAAGGGC | CGGGTGACGGACTACGGTGG TAACGACTGGTTCGACCCC | |
| | | | SEQ ID NO:6157 | SEQ ID NO:14169 | SEQ ID NO:22181 | |
| | | AA | SYAMS | AISGRGGNTFYADSVKG | RVTDYGGNDWFDP | |
| | | | SEQ ID NO:6158 | SEQ ID NO:14170 | SEQ ID NO:22182 | |
| iPS:435357 | 21-225_148G10 | NA | AGCTATGGCATGCAC | ATTATATGGTATGATGG AAGTAATAAATACTATG CAGACTCCGTGAAGGGC | GATCGTTACGATTTTTGGAG TGGTCACTTTGACTAC | |
| | | | SEQ ID NO:6159 | SEQ ID NO:14171 | SEQ ID NO:22183 | |
| | | AA | SYGMH | IIWYDGSNKYYADSVKG | DRYDFWSGHFDY | |
| | | | SEQ ID NO:6160 | SEQ ID NO:14172 | SEQ ID NO:22184 | |
| iPS:435359 | 21-225_148H10 | NA | AGCTATGGCATGCAC | GTTATATGGTATGATGG AAGTAATAAATACTATG GAGACTCCGTGAAGGGC | AGGTATAGCAGCAGCTGGTC GGGGGGTATGGACGTC | |
| | | | SEQ ID NO:6161 | SEQ ID NO:14173 | SEQ ID NO:22185 | |
| | | AA | SYGMH | VIWYDGSNKYYGDSVKG | RYSSSWSGGMDV | |
| | | | SEQ ID NO:6162 | SEQ ID NO:14174 | SEQ ID NO:22186 | |
| iPS:435361 | 21-225_148E11 | NA | AGAAGTAGTTACTACTGGGG C | AGTATCTATTATTATAGTGGG AGCACCCTCCTACAACCC GTCCCTCAAGAGT | CTTGATCCCCAGTGGAGTTT TGACTAC | |
| | | | SEQ ID NO:6163 | SEQ ID NO:14175 | SEQ ID NO:22187 | |
| | | AA | RSSYYWG | SIYYSGSTSYNPSLKS | LDPQWSFDY | |
| | | | SEQ ID NO:6164 | SEQ ID NO:14176 | SEQ ID NO:22188 | |
| iPS:435363 | 21_225_148F12 | NA | AATGGTGGTTACTACTGGAA C | TACATCTATTACAGTGGG AGCACCTACTACAACCC GTCCCTCAAGAGT | TACAGTACTACGACTACTA CTACGGTATGGACGTC | |

FIGURE 49
(Continued)

| | | | | | | | |
|---|---|---|---|---|---|---|---|
| | 21-225_148F12 | AA | SEQ ID NO:6165<br>NGGYYWN | SEQ ID NO:14177<br>YIYYSGSTYYNPSLKS | SEQ ID NO:22189<br>YSTYDYYYGMDV | | |
| iPS:435365 | 21-225_149F1 | NA | SEQ ID NO:6166<br>AGCTATGGCATGCAC | SEQ ID NO:14178<br>ATTATCTGGTATGATGGA<br>AGTTATAAATACTATGC<br>AGACTCCGTGAAGGGC | SEQ ID NO:22190<br>GATCATTTCGATTTTTGGAGT<br>GGTCACTTTGACTAC | | |
| | | AA | SEQ ID NO:6167<br>SYGMH | SEQ ID NO:14179<br>IIWYDGSYKYYADSVKG | SEQ ID NO:22191<br>DHFDFWSGHFDY | | |
| iPS:435367 | 21-225_149G1 | NA | SEQ ID NO:6168<br>GACTATGGCATGCAC | SEQ ID NO:14180<br>GTTATATGGTATGAAGG<br>AAGTAATAAATACTATG<br>CAGACTCCGTGAAGGGC | SEQ ID NO:22192<br>GAAATAGGATTCAGTGAGGA<br>CTAC | | |
| | | AA | SEQ ID NO:6169<br>DYGMH | SEQ ID NO:14181<br>VIWYEGSNKYYADSVKG | SEQ ID NO:22193<br>EIGFSEDY | | |
| iPS:435369 | 21-225_149A2 | NA | SEQ ID NO:6170<br>AATTATGATATCAAC | SEQ ID NO:14182<br>TGGGTGCACCTAACAG<br>TGGTAACACAGGCTATG<br>CACAGAAGTTCCAGGGC | SEQ ID NO:22194<br>AGCAGTGGCTGGTACTACTT<br>TGACTAC | | |
| | | AA | SEQ ID NO:6171<br>NYDIN | SEQ ID NO:14183<br>WVHPNSGNTGYAQKFQG | SEQ ID NO:22195<br>SSGWYYFDY | | |
| iPS:435371 | 21-225_149A3 | NA | SEQ ID NO:6172<br>AACTATGCCATGACC | SEQ ID NO:14184<br>GCTATTAGTGGTCGTGGT<br>GGTAACACATTCTACGC<br>AGACTCCGTGAAGGGC | SEQ ID NO:22196<br>CGGGTGACGGACTACGGTGG<br>TAACGACTGGTTCGACCCC | | |
| | | AA | SEQ ID NO:6173<br>NYAMT | SEQ ID NO:14185<br>AISGRGGNTFYADSVKG | SEQ ID NO:22197<br>RVTDYGGNDWFDP | | |
| | | | SEQ ID NO:6174 | SEQ ID NO:14186 | SEQ ID NO:22198 | | |

FIGURE 49
(Continued)

| | | | | | |
|---|---|---|---|---|---|
| iPS:435373 | 21-225_149E3 | NA | AATTATGATATCAAC<br>SEQ ID NO:6175 | TGGATGCACCCTAACAG<br>TGGTAACACAGGCTATG<br>CACAGAAGTTCCAGGGC<br>SEQ ID NO:14187 | AGCAGTGGCTGGTACTGGTT<br>TGACTAC<br>SEQ ID NO:22199 |
| | | AA | NYDIN<br>SEQ ID NO:6176 | WMHPNSGNTGYAQKFQG<br>SEQ ID NO:14188 | SSGWYWFDY<br>SEQ ID NO:22200 |
| iPS:435375 | 21-225_149H4 | NA | AATTATGATATCAAC<br>SEQ ID NO:6177 | TGGATGCACCCTAACAG<br>TGGTAACACAGACTATG<br>CACAGAAGTTCCAGGGC<br>SEQ ID NO:14189 | AGCAGTGGCTGGTACTACTT<br>TGACTAC<br>SEQ ID NO:22201 |
| | | AA | NYDIN<br>SEQ ID NO:6178 | WMHPNSGNTDYAQKFQG<br>SEQ ID NO:14190 | SSGWYYFDY<br>SEQ ID NO:22202 |
| iPS:435377 | 21-225_149G5 | NA | AATGGTGGTTACTACTGGAA<br>C<br>SEQ ID NO:6179 | TACATCTATTACAGTGGG<br>AGCACCTACTACAACCC<br>GTCCCTCAAGAGT<br>SEQ ID NO:14191 | TACAGTACTACTACGACTACTA<br>CTACGGTATGGACGTC<br>SEQ ID NO:22203 |
| | | AA | NGGYYWN<br>SEQ ID NO:6180 | YIYYSGSTYYNPSLKS<br>SEQ ID NO:14192 | YSTYDYYYGMDV<br>SEQ ID NO:22204 |
| iPS:435379 | 21-225_149B6 | NA | AGCTATGCCATGAGC<br>SEQ ID NO:6181 | GTTATTAGTGGTAGTGGT<br>GGTAGCACATTCTACG<br>AGACTCCGTGAAGGGC<br>SEQ ID NO:14193 | CGAACTCCGGAAGATGTTTT<br>TGATATC<br>SEQ ID NO:22205 |
| | | AA | SYAMS<br>SEQ ID NO:6182 | VISGSGGSTFYADSVKG<br>SEQ ID NO:14194 | RTPEDVFDI<br>SEQ ID NO:22206 |
| iPS:435381 | 21-225_149C6 | NA | AGCTATGCCATGAGC<br>SEQ ID NO:6183 | GCTATTAGTGGTAGTGGT<br>GGTAACACATTCTACGC<br>AGACTCCGTGAAGGGC<br>SEQ ID NO:14195 | AAGGATTATGATTACGTTTG<br>GGGGAGTCCTTACTTTGACT<br>AC<br>SEQ ID NO:22207 |

FIGURE 49
(Continued)

| | | | | | |
|---|---|---|---|---|---|
| iPS:435383 | 21-225_149D7 | AA | SYAMS<br>SEQ ID NO:6184 | AISGSGGNTFYADSVKG<br>SEQ ID NO:14195 | KDYDYVWGSPYFDY<br>SEQ ID NO:22208 |
| | | NA | AACAGTGGTTACTACTGGAG<br>C<br>SEQ ID NO:6185 | TACAGTATTACAGTGG<br>GAGCACTACTACAACC<br>CGTCCCTCAAGAGT<br>SEQ ID NO:14197 | GGGGGATATAACTGGAACCA<br>TGCTTTTTGATATC<br>SEQ ID NO:22209 |
| iPS:435391 | 21-225_149F8 | AA | NSGYYWS<br>SEQ ID NO:6186 | YSYYSGSTYYNPSLKS<br>SEQ ID NO:14198 | GGYNWNHAFDI<br>SEQ ID NO:22210 |
| | | NA | AGCTATGCCATGAGC<br>SEQ ID NO:6187 | GCTATTAGTGGTCGTGGT<br>GGTAACACATTCTACGC<br>AGACTCCGTGAAGGGC<br>SEQ ID NO:14199 | AAGGATTATGATTACGTTTG<br>GGGGAGTCCTTACTTTGACT<br>AC<br>SEQ ID NO:22211 |
| iPS:435393 | 21-225_149D10 | AA | SYAMS<br>SEQ ID NO:6188 | AISGRGGNTFYADSVKG<br>SEQ ID NO:14200 | KDYDYVWGSPYFDY<br>SEQ ID NO:22212 |
| | | NA | GACTATGGCATGCAC<br>SEQ ID NO:6189 | GTTATATGGTATGATGG<br>AAGTAATAAGTACTATG<br>CAGACTCCGTGAAGGGC<br>SEQ ID NO:14201 | GAGAGGTATAGCAGTGGCTG<br>GTACGACTACGGTATGGACG<br>TC<br>SEQ ID NO:22213 |
| iPS:435395 | 21-225_149D11 | AA | DYGMH<br>SEQ ID NO:6190 | VIWYDGSNKYYADSVKG<br>SEQ ID NO:14202 | ERYSSGWYDYGMDV<br>SEQ ID NO:22214 |
| | | NA | AGCTATGCCATGAGC<br>SEQ ID NO:6191 | GCTATTAGTGGTCGTGGT<br>GGTAACACATTCTACGC<br>AGACTCCGTGAAGGGC<br>SEQ ID NO:14203 | AAGGATTATGATTACGTTTG<br>GGGGAGTCCTTACTTTGACT<br>AC<br>SEQ ID NO:22215 |
| | | AA | SYAMS<br>SEQ ID NO:6192 | AISGRGGNTFYADSVKG<br>SEQ ID NO:14204 | KDYDYVWGSPYFDY<br>SEQ ID NO:22216 |

FIGURE 49
(Continued)

| | | NA/AA | | | |
|---|---|---|---|---|---|
| iPS:435397 | 21-225_149F12 | NA | GACTATGGCATGCAC | GTTATATGGTATGAAGA AATAATAAATACTATG CAGACTCCGTGAAGGGC | GAAATAGGGTTCAGTGAAGA CTAC |
| | | | SEQ ID NO:6193 | SEQ ID NO:14205 | SEQ ID NO:22217 |
| | | AA | DYGMH | VIWYEENNKYYADSVKG | EIGFSEDY |
| | | | SEQ ID NO:6194 | SEQ ID NO:14206 | SEQ ID NO:22218 |
| iPS:435399 | 21-225_150D2 | NA | AATTATGATATCAAC | TGGATGCACCCTAACAG TGGTAACACAGGCTATG CACAGAAGTTCCAGGGC | AGCAGTGGCTGGTACTACTT TGACTAC |
| | | | SEQ ID NO:6195 | SEQ ID NO:14207 | SEQ ID NO:22219 |
| | | AA | NYDIN | WMHPNSGNTGYAQKFQG | SSGWYYFDY |
| | | | SEQ ID NO:6196 | SEQ ID NO:14208 | SEQ ID NO:22220 |
| iPS:435401 | 21-225_150E2 | NA | AGCTATGTCATGCAC | GTTATATGGTATGATGG AAGTAATAAATACTATG CAGACTCCGTGAAGGGC | GAGGAGTATAGCAGCAGCTG GTACGGGTACGGTATGGACG TC |
| | | | SEQ ID NO:6197 | SEQ ID NO:14209 | SEQ ID NO:22221 |
| | | AA | SYVMH | VIWYDGSNKYYADSVKG | EEYSSSWYGYGMDV |
| | | | SEQ ID NO:6198 | SEQ ID NO:14210 | SEQ ID NO:22222 |
| iPS:435403 | 21-225_150C5 | NA | AGCTATGCCATGAGC | GCTATTAGTGGTAGTGGT GGTAACACATTCTACGC AGACTCCGTGAAGGGC | AAGGATTATGATTACGTTTG GGGGAGTCCTTACTTTGACT AC |
| | | | SEQ ID NO:6199 | SEQ ID NO:14211 | SEQ ID NO:22223 |
| | | AA | SYAMS | AISGSGGNTFYADSVKG | KDYDYVWGSPYFDY |
| | | | SEQ ID NO:6200 | SEQ ID NO:14212 | SEQ ID NO:22224 |

FIGURE 49
(Continued)

| | | | | |
|---|---|---|---|---|
| iPS:435405 | 21-225_150B7 | NA | AATTATGATATCAAC | TGGATGCACCCTAACAG TGGTAACACAGGCTATG CACAGAAGTTCCAGGGC | AGCAGTGGCTGGTACTTTTT TGACTAC |
| | | | SEQ ID NO:6201 | SEQ ID NO:14213 | SEQ ID NO:22225 |
| | | AA | NYDIN | WMHPNSGNTGYAQKFQG | SSGWYFFDY |
| | | | SEQ ID NO:6202 | SEQ ID NO:14214 | SEQ ID NO:22226 |
| iPS:435407 | 21-225_150E7 | NA | GACTATGGCATGCAC | GTTATATGGTATGAAGA AATAATAAATACTATG CAGACTCCGTGAAGGGC | GAAATAGGGTTCAGTGAGGA CTAC |
| | | | SEQ ID NO:6203 | SEQ ID NO:14215 | SEQ ID NO:22227 |
| | | AA | DYGMH | VIWYEENNKYYADSVKG | EIGFSEDY |
| | | | SEQ ID NO:6204 | SEQ ID NO:14216 | SEQ ID NO:22228 |
| iPS:435409 | 21-225_150G8 | NA | ACCTATAGCATGACT | TACATTAGTAGGAGTAG TAGTACCATATACTACGC AGACTCTGTGAAGGGC | TCGGCATTTAGCCCTTTTGAT TAC |
| | | | SEQ ID NO:6205 | SEQ ID NO:14217 | SEQ ID NO:22229 |
| | | AA | TYSMT | YISRSSSTIYYADSVKG | SAFSPFDY |
| | | | SEQ ID NO:6206 | SEQ ID NO:14218 | SEQ ID NO:22230 |
| iPS:435413 | 21-225_150B11 | NA | AGCTATGGCATGCAC | ATTATATGGTATGATGG AAGTAATAAATACTATG CAGACTCCGTGAAGGGC | GATCGTTACGATTTTTGGAG TGGTCACTTTGACTAC |
| | | | SEQ ID NO:6207 | SEQ ID NO:14219 | SEQ ID NO:22231 |
| | | AA | SYGMH | IIWYDGSNKYYADSVKG | DRYDFWSGHFDY |
| | | | SEQ ID NO:6208 | SEQ ID NO:14220 | SEQ ID NO:22232 |

FIGURE 49
(Continued)

| | | | | |
|---|---|---|---|---|
| iPS:435415 | 21-225_150C11 | NA | AGCTATGCCATGAAC | GCTATTAGTGGTAGTGGT GGTAACACATTCTACGC AGACTCCGTGAAGGGC | CGGGTGACGGACTACGGTGG TAACGACTGGTTCGACCCC |
| | | | SEQ ID NO:6209 | SEQ ID NO:14221 | SEQ ID NO:22233 |
| | | AA | SYAMN | AISGSGGNTFYADSVKG | RVTDYGGNDWFDP |
| | | | SEQ ID NO:6210 | SEQ ID NO:14222 | SEQ ID NO:22234 |
| iPS:435417 | 21-225_150D11 | NA | AGCTATGGCATGCAC | GTTATATTCTATGATGGA AGTAATAAACACTATGC AGACTCCGTGAAGGGC | AGGTTTAGCAGCAGCTGGTC GGGGGTATGGACGTC |
| | | | SEQ ID NO:6211 | SEQ ID NO:14223 | SEQ ID NO:22235 |
| | | AA | SYGMH | VIFYDGSNKHYADSVKG | RFSSSWSGGMDV |
| | | | SEQ ID NO:6212 | SEQ ID NO:14224 | SEQ ID NO:22236 |
| iPS:435419 | 21-225_150C12 | NA | AGCTATGCCATGAGC | GCTATTAGTGGTCGTGGT GGTAACACATTCTACGC AGACTCCGTGAAGGGC | CGGGTGACGGACTACGGTGG TAACGACTGGTTCGACCCC |
| | | | SEQ ID NO:6213 | SEQ ID NO:14225 | SEQ ID NO:22237 |
| | | AA | SYAMS | AISGRGNTFYADSVKG | RVTDYGGNDWFDP |
| | | | SEQ ID NO:6214 | SEQ ID NO:14226 | SEQ ID NO:22238 |
| iPS:435421 | 21-225_151F1 | NA | AGCTTTAGCATGAAC | TCCATTAGTAGTAGTAGT TATTACATATACTACGCA GACTCAGTGAAGGGC | GATACACCACTGGTTTAC |
| | | | SEQ ID NO:6215 | SEQ ID NO:14227 | SEQ ID NO:22239 |
| | | AA | SFSMN | SISSSSYYIYYADSVKG | DTPLVY |
| | | | SEQ ID NO:6216 | SEQ ID NO:14228 | SEQ ID NO:22240 |
| iPS:435423 | 21-225_151G5 | NA | AGCTATGGCATGCAC | ATTATATGGTATGATGG AAGTAATAAATACTATG CAGACTCCGTGAAGGGC | GATCGATACGATTTTGGAG TGGTCACTTTGACTAC |
| | | | SEQ ID NO:6217 | SEQ ID NO:14229 | SEQ ID NO:22241 |

FIGURE 49
(Continued)

| | | | | | | |
|---|---|---|---|---|---|---|
| iPS:435425 | 21-225_151B12 | AA | SYGMH | | IIWYDGSNKYYADSVKG | DRYDFWSGHFDY |
| | | | SEQ ID NO:6218 | | SEQ ID NO:14230 | SEQ ID NO:22242 |
| | | NA | AGCTATGCCATGAAC | | GCTATTAGTGGTAGTGGT AAAAACACATTCTACGC AGACTCCGTGAAGGGC | CGGGTGACGGACTACGGTGG TAACGACTGGTTCGACCCC |
| | | | SEQ ID NO:6219 | | SEQ ID NO:14231 | SEQ ID NO:22243 |
| | | AA | SYAMN | | AISGSGKNTFYADSVKG | RVTDYGGNDWFDP |
| | | | SEQ ID NO:6220 | | SEQ ID NO:14232 | SEQ ID NO:22244 |
| iPS:435427 | 21-225_151C9 | NA | AGCTATGGCATGCAC | | GTTATATCATATGATGGA AGTAATAAATACTATGC AGACTCCGTGAAGGGC | GGGGTATTACTATGGTTCGG GGAGCTAGAAGATGACTGGT TCGACCCC |
| | | | SEQ ID NO:6221 | | SEQ ID NO:14233 | SEQ ID NO:22245 |
| | | AA | SYGMH | | VISYDGSNKYYADSVKG | GVLLWFGELEDDWFDP |
| | | | SEQ ID NO:6222 | | SEQ ID NO:14234 | SEQ ID NO:22246 |
| iPS:435429 | 21-225_151A10 | NA | AACTATGGCATGCAC | | ATTATATGGTATGATGG AAGTAATAAATACTATG CAGACTCCGTGAAGGGC | GATCATTACGATTTTTGGAG TGGTCACTTTGACTAC |
| | | | | | SEQ ID NO:14235 | SEQ ID NO:22247 |
| | | AA | NYGMH | | IIWYDGSNKYYADSVKG | DHYDFWSGHFDY |
| | | | SEQ ID NO:6224 | | SEQ ID NO:14236 | SEQ ID NO:22248 |
| iPS:435431 | 21-225_152D2 | NA | AGCTATGCCATGAGC | | GCTATTAGTGGTGTCGTGGT GGTAACACATTCTACGC AGACTCCGTGAAGGGC | CGGGTGACGGACTACGGTGG TAACGACTGGTTCGACCCC |
| | | | SEQ ID NO:6225 | | SEQ ID NO:14237 | SEQ ID NO:22249 |
| | | AA | SYAMS | | AISGRGNTFYADSVKG | RVTDYGGNDWFDP |
| | | | SEQ ID NO:6226 | | SEQ ID NO:14238 | SEQ ID NO:22250 |

FIGURE 49
(Continued)

| | | | | | |
|---|---|---|---|---|---|
| iPS:435433 | 21-225_152E3 | NA | AATTATGATATCAAC SEQ ID NO:6227 | TGGATGCACCCTAACAG TGGTAACACAGGCTATG CACAGAAGTTCCAGGGC SEQ ID NO:14239 | AGCAGTGGCTGGTACTTTTT TGACTAC SEQ ID NO:22251 |
| | | AA | NYDIN SEQ ID NO:6228 | WMHPNSGNTGYAQKFQG SEQ ID NO:14240 | SSGWYFFDY SEQ ID NO:22252 |
| iPS:435435 | 21-225_152H3 | NA | AATTATGATATCAAC SEQ ID NO:6229 | TGGATGCACCCTAACAG TGGTAACACAGGCTATG CACAGAAGTTCCAGGGC SEQ ID NO:14241 | AGCAGTGGCTGGTACTGGTT TGACTAC SEQ ID NO:22253 |
| | | AA | NYDIN SEQ ID NO:6230 | WMHPNSGNTGYAQKFQG SEQ ID NO:14242 | SSGWYWFDY SEQ ID NO:22254 |
| iPS:435437 | 21-225_152F4 | NA | AATTATGATATCAAC SEQ ID NO:6231 | TGGATGCACCCTAACAG TGGTAACACAGGCTATG CACAGAAGTTCCAGGGC SEQ ID NO:14243 | AGCAGTGGCTGGTACTGGTT CGACCCC SEQ ID NO:22255 |
| | | AA | NYDIN SEQ ID NO:6232 | WMHPNSGNTGYAQKFQG SEQ ID NO:14244 | SSGWYWFDP SEQ ID NO:22256 |
| iPS:435439 | 21-225_152G4 | NA | AGCTATGCCATGAGC SEQ ID NO:6233 | GCTATTAGTGGTCGTGGT GGTAACACATTCTACGC AGACTCCGTGAAGGGC SEQ ID NO:14245 | CGGGTGACGGACTACGGTGG TAACGACTGGTTCGACCCC SEQ ID NO:22257 |
| | | AA | SYAMS SEQ ID NO:6234 | AISRGRGNTFYADSVKG SEQ ID NO:14246 | RVTDYGGNDWFDP SEQ ID NO:22258 |
| iPS:435441 | 21_225_152F6 | NA | AGCTATGGCATGCAC | ATTATATGGTATGATGG AAGTTATAAATACTATG CAGACTCCGTGAAGGGC | GAGGGGTACGATTTTTGGAG TGGTTACCTTGGCTAC |

FIGURE 49
(Continued)

| | | | | | | |
|---|---|---|---|---|---|---|
| iPS:435443 | 21-225_152F6 | AA | SEQ ID NO:6235<br>SYGMH | SEQ ID NO:14247<br>IIWYDGSYKYYADSVKG | SEQ ID NO:22259<br>EGYDFWSGYLGY |
| | | NA | SEQ ID NO:6236<br>AACAGTGGTTACTACTGGAGC | SEQ ID NO:14248<br>TACAGTTATTACAGTGGGAGCACCTACTACAACCCGTCCCTCAAGAGT | SEQ ID NO:22260<br>GGGGGATATAACTGGAACCATGCTTTTGATATC |
| iPS:435445 | 21-225_152E7 | AA | SEQ ID NO:6237<br>NSGYYWS | SEQ ID NO:14249<br>YSYYSGSTYYNPSLKS | SEQ ID NO:22261<br>GGYNWNHAFDI |
| | | NA | SEQ ID NO:6238<br>AGCTATATCATGCAC | SEQ ID NO:14250<br>GTTATATGGTATGGATGGAAGTAATAAATACTATGCAGACTCCGTGAAGGGC | SEQ ID NO:22262<br>GAGGAGTATAGCAGCAGCTGGTACGGGTACGGTATGGACGTC |
| iPS:435447 | 21-225_152F7 | AA | SEQ ID NO:6239<br>SYIMH | SEQ ID NO:14251<br>VIWYDGSNKYYADSVKG | SEQ ID NO:22263<br>EEYSSSWYGYGMDV |
| | | NA | SEQ ID NO:6240<br>AGCTATGCCATGAAC | SEQ ID NO:14252<br>GCTATTAGTGGTAGTGGTGGTAACACATTCTACGCAGACTCCGTGAAGGGC | SEQ ID NO:22264<br>AAGGATAATGATTACGTTTGGGGGAGTCCTTACTTTGACTAC |
| iPS:435449 | 21-225_152H7 | AA | SEQ ID NO:6241<br>SYAMN | SEQ ID NO:14253<br>AISGSGGNTFYADSVKG | SEQ ID NO:22265<br>KDNDYVWGSPYFDY |
| | | NA | SEQ ID NO:6242<br>AGAAGTAGTTACTACTGGGGC | SEQ ID NO:14254<br>AGTATCTATTATAGTGGGAGCGCCTCTACAACCCGTCCCTCAAGAGT | SEQ ID NO:22266<br>CTTGATCTCCAGTGGAGTTTTGACTTC |
| | 21-225_152H9 | AA | SEQ ID NO:6243<br>RSSYYWG | SEQ ID NO:14255<br>SIYYSGSASYNPSLKS | SEQ ID NO:22267<br>LDLQWSFDF |
| | | | SEQ ID NO:6244 | SEQ ID NO:14256 | SEQ ID NO:22268 |

FIGURE 49
(Continued)

| | | | | |
|---|---|---|---|---|
| iPS:435451 | 21-225_152D10 | NA | AATTACTACTGGAGC | CGTATCGATATACCAGTGG GATCACCAACTACAACC CCTCCCTCAAGAGT | GAGGGGGGATTGGGAGCTAC CTTCTTTGACTAC |
| | | | SEQ ID NO:6245 | SEQ ID NO:14257 | SEQ ID NO:22269 |
| | | AA | NYYWS | RIDTSGITNYNPSLKS | EGGLGATFFDY |
| | | | SEQ ID NO:6246 | SEQ ID NO:14258 | SEQ ID NO:22270 |
| iPS:435453 | 21-225_152G10 | NA | AGCTATGCCATGAGC | GCTATTAGTGGTCGTGGT GGTAACACATTCTACGC AGACTCCGTGAAGGGC | AAGGATTATGATTACGTTTG GGGGAGTCCTTACTTTGACT AC |
| | | | SEQ ID NO:6247 | SEQ ID NO:14259 | SEQ ID NO:22271 |
| | | AA | SYAMS | AISGRGGNTFYADSVKG | KDYDYVWGSPYFDY |
| | | | SEQ ID NO:6248 | SEQ ID NO:14260 | SEQ ID NO:22272 |
| iPS:435455 | 21-225_152B11 | NA | AGCTATGCCATGAAC | GCTATTAGTGGTCGTGGT GGTAACACATTCTACGC AGACTCCGTGAAGGGC | CGGGTGACGGACTACGGTGG TAACGACTGGTTCGACCCC |
| | | | SEQ ID NO:6249 | SEQ ID NO:14261 | SEQ ID NO:22273 |
| | | AA | SYAMN | AISGRGGNTFYADSVKG | RVTDYGGNDWFDP |
| | | | SEQ ID NO:6250 | SEQ ID NO:14262 | SEQ ID NO:22274 |
| iPS:435457 | 21-225_152C11 | NA | AACTATGGCATGCAC | ATTATATGGTATGATGG AAGTAATAAATACTATG CAGACTCCGTGAAGGGC | GAGGCTTACGATTTTTGGAG TGGTTATTTGACTAC |
| | | | SEQ ID NO:6251 | SEQ ID NO:14263 | SEQ ID NO:22275 |
| | | AA | NYGMH | IIWYDGSNKYYADSVKG | EAYDFWSGYFDY |
| | | | SEQ ID NO:6252 | SEQ ID NO:14264 | SEQ ID NO:22276 |
| iPS:435459 | 21-225_152E12 | NA | AATTATGATATCAAC | TGGATGAACCTAACAG TGGTAACACAGGCTATG CACAGAAGTTCCAGGGC | AGCAGTGGCTGGTACTACTT TGACTAC |
| | | | SEQ ID NO:6253 | SEQ ID NO:14265 | SEQ ID NO:22277 |

FIGURE 49
(Continued)

| | | AA | NYDIN | | WMNPNSGNTGYAQKFQG | | SSGWYYFDY | |
|---|---|---|---|---|---|---|---|---|
| iPS:435461 | 21-225_153A1 | | | SEQ ID NO:6254 | | SEQ ID NO:14266 | | SEQ ID NO:22278 |
| | | NA | AGCTATGTCATGAGT | | GCTATTAGTGGAAGTGG TGATAGAACATACTACG CAGACTCCGTGAAGGGC | | ACGGGCGACTAAGGACTAC | |
| iPS:435463 | 21-225_153D2 | AA | SYVMS | SEQ ID NO:6255 | AISGSGDRTYYADSVKG | SEQ ID NO:14267 | TATKDY | SEQ ID NO:22279 |
| | | NA | AGCTATGGCATGCAC | SEQ ID NO:6256 | ATTATATGGTATGATGG AAGTTATAAATACTATG CAGACTCCGTGAAGGGC | SEQ ID NO:14268 | GAGGGGTACGATTTTTGGAG TGGTTACCTTGGCTAC | SEQ ID NO:22280 |
| iPS:435465 | 21-225_153A6 | AA | SYGMH | SEQ ID NO:6257 | IIWYDGSYKYYADSVKG | SEQ ID NO:14269 | EGYDFWSGYLGY | SEQ ID NO:22281 |
| | | NA | AACAGTGGTTACTACTGGAGC | SEQ ID NO:6258 | TACAGTTATTACAGTGG GAGCACCTACTACAACC CGTCCCTCAAGAGT | SEQ ID NO:14270 | GGGGGATATAACTGGAACCA TGCTTTTGATATC | SEQ ID NO:22282 |
| iPS:435467 | 21-225_153B9 | AA | NSGYYWS | SEQ ID NO:6259 | YSYYSGSTYYNPSLKS | SEQ ID NO:14271 | GGYNWNHAFDI | SEQ ID NO:22283 |
| | | NA | AGTTACTACTGGAGC | SEQ ID NO:6260 | CGTATCGATACCAGTGG GATCACCAACTACAACC CCTCCCTCAAGAGT | SEQ ID NO:14272 | GAGGGGGGAGTGGGAGCTA CGTACTTTGACTAC | SEQ ID NO:22284 |
| | | AA | SYYWS | SEQ ID NO:6261 | RIDTSGITNYNPSLKS | SEQ ID NO:14273 | EGGVGATYFDY | SEQ ID NO:22285 |
| | | | | SEQ ID NO:6262 | | SEQ ID NO:14274 | | SEQ ID NO:22286 |

FIGURE 49
(Continued)

| iPS:435469 | 21-225_153G9 | NA | AGCTATGGCATGCAC | CTTATATTCTATGATGA AGTAATAAATACTATGC AGACTCCGTGAAGGGC | CGCTATAGCCGCAGCTGGGC CGGGGGTATGGACGTC |
|---|---|---|---|---|---|
| | | | SEQ ID NO:6263 | SEQ ID NO:14275 | SEQ ID NO:22287 |
| | | AA | SYGMH | LIFYDGSNKYYADSVKG | RYSRSWAGGMDV |
| iPS:435471 | | NA | SEQ ID NO:6264 AATTATGATATCAAC | SEQ ID NO:14276 TGGATGCACCCTAACAG TGGTAACACAGGCTATG CACAGAAGTTCCAGGGC | SEQ ID NO:22288 AGCAGTGGCTGGTACTTCTT TGACAAC |
| | 21-225_153F11 | AA | SEQ ID NO:6265 NYDIN | SEQ ID NO:14277 WMHPNSGNTGYAQKFQG | SEQ ID NO:22289 SSGWYFFDN |
| iPS:435475 | | NA | SEQ ID NO:6266 AATTATGATATCAAC | SEQ ID NO:14278 TGGATGAACCCTAACAG TGGTAACACAGGCTATG CACAGAAGTTCCAGGGC | SEQ ID NO:22290 AGCAGTGGCTGGTACATCTT TGACTAC |
| | 21-225_154H6 | AA | SEQ ID NO:6267 NYDIN | SEQ ID NO:14279 WMNPNSGNTGYAQKFQG | SEQ ID NO:22291 SSGWYIFDY |
| iPS:435479 | | NA | SEQ ID NO:6268 AGCTATGCCATGAGC | SEQ ID NO:14280 GCTATTAGTGGTGTCGTGGT GGTAACACATTCTACGC AGACTCCGTGAAGGGC | SEQ ID NO:22292 AGGGGATTTCGATTTTTGGA GTGGTTGGGGGGCTTTGACT AC |
| | 21-225_154E9 | AA | SEQ ID NO:6269 SYAMS | SEQ ID NO:14281 AISGRGGNTFYADSVKG | SEQ ID NO:22293 RGFRFLEWLGFDY |
| iPS:435481 | | NA | SEQ ID NO:6270 AATTATGATATCAAC | SEQ ID NO:14282 TGGATGAACCCTAACAG TGGTAACACAGGCTATG CACAGAAGTTCCAGGGC | SEQ ID NO:22294 AGCAGTGGCTGGTACTACTT CGACTAC |

FIGURE 49
(Continued)

| | | | | | | |
|---|---|---|---|---|---|---|
| iPS:435483 | 21-225_154A11 | AA | SEQ ID NO:6271<br>NYDIN | SEQ ID NO:14283<br>WMNPNSGNTGYAQKPQG | SEQ ID NO:22295<br>SSGWYYFDY | |
| | | NA | SEQ ID NO:6272<br>AGCTATGCCATGAGC | SEQ ID NO:14284<br>GCTATTAGTGGTAGTGGT<br>GGTAACACATTCTACGC<br>AGACTCCGTGAAGGGC | SEQ ID NO:22296<br>AAGGATTATGATTACGTTTG<br>GGGGAGTCCTTACTTTGACT<br>AC | |
| iPS:435485 | 21-225_155A4 | AA | SEQ ID NO:6273<br>SYAMS | SEQ ID NO:14285<br>AISGSGGNTFYADSVKG | SEQ ID NO:22297<br>KDYDYVWGSPYFDY | |
| | | NA | SEQ ID NO:6274<br>AGCTATGCCATGAGC | SEQ ID NO:14286<br>GCTATTAGTGGTAGTGGT<br>GGTAACACATTCTACGC<br>AGACTCCGTGAAGGGC | SEQ ID NO:22298<br>AAGGATTATGATTACGTTTG<br>GGGGAGTCCTTACTTTGACT<br>AC | |
| iPS:435487 | 21-225_155B4 | AA | SEQ ID NO:6275<br>SYAMS | SEQ ID NO:14287<br>AISGSGGNTFYADSVKG | SEQ ID NO:22299<br>KDYDYVWGSPYFDY | |
| | | NA | SEQ ID NO:6276<br>AGCTATGCCATGAGC | SEQ ID NO:14288<br>GCTATTAGTGGTGGTCGTGGT<br>GGTAACACATTCTACGC<br>AGACTCCGTGAAGGGC | SEQ ID NO:22300<br>CGGGTGACGGACTACGGTGG<br>TAACGACTGGTTCGACCCC | |
| iPS:435489 | 21-225_155C4 | AA | SEQ ID NO:6277<br>SYAMS | SEQ ID NO:14289<br>AISGRGGNTFYADSVKG | SEQ ID NO:22301<br>RVTDYGGNDWFDP | |
| | | NA | SEQ ID NO:6278<br>SYAMS | SEQ ID NO:14290<br>AISGRGGNTFYADSVKG | SEQ ID NO:22302 | |
| iPS:435489 | 21-225_155A5 | AA | SEQ ID NO:6279<br>AGCTATGGCATGCAC | SEQ ID NO:14291<br>ATTATATGGTATGATGG<br>AAGTAGTAAATACTATG<br>CAGACTCCGTGAAGGGC | SEQ ID NO:22303<br>GATCGATACGATTTTTGGAG<br>TGGTCACTTTGACTAC | |
| | | NA | SEQ ID NO:6280<br>SYGMH | SEQ ID NO:14292<br>IIWYDGSSKYYADSVKG | SEQ ID NO:22304<br>DRYDFWSGHFDY | |

FIGURE 49
(Continued)

| | | | | |
|---|---|---|---|---|
| iPS:435491 | 21-225_155E5 | NA | AATTATGATATCAAC | TGGATGCACCCTAACAGTGGTAGTACAGGCTATGCACAGAGGTTCCAGGGC | AGCAGTGGCTGGTACTATTTGACTAC |
| | | | SEQ ID NO:6281 | SEQ ID NO:14293 | SEQ ID NO:22305 |
| | | AA | NYDIN | WMHPNSGSTGYAQRFQG | SSGWYYFDY |
| | | | SEQ ID NO:6282 | SEQ ID NO:14294 | SEQ ID NO:22306 |
| iPS:435495 | | NA | AATTATGATATCAAC | TGGATGAACCCTAACAGTGGTAACACAGGCTATGCACAGAAGTTCCAGGGC | AGCAGTGGCTGGTACTACTTTGACTAC |
| | 21-225_155B6 | | SEQ ID NO:6283 | SEQ ID NO:14295 | SEQ ID NO:22307 |
| | | AA | NYDIN | WMNPNSGNTGYAQKFQG | SSGWYYFDY |
| | | | SEQ ID NO:6284 | SEQ ID NO:14296 | SEQ ID NO:22308 |
| iPS:435497 | 21-225_155H9 | NA | AGCTATGCCATGAAC | ACTATTAGTGGTAGAGGTCTTGGCACATACTACGCAGACTCCGTGAAGGGC | GACCATGATGACTACGGTGACTACAATATCTACTTTGACTAC |
| | | | SEQ ID NO:6285 | SEQ ID NO:14297 | SEQ ID NO:22309 |
| | | AA | SYAMN | TISGRGLGTYYADSVKG | DHDYGDYNIYFDY |
| | | | SEQ ID NO:6286 | SEQ ID NO:14298 | SEQ ID NO:22310 |
| iPS:435499 | 21-225_156G1 | NA | AGAAGTAGTTACTACTGGGGC | AGTATCTATTATATAGTGGGAGCGCCTCCTACAACCCGTCCCTCAAGAGT | CTTGATCTCCAGTGGAGTTTTGACTTC |
| | | | SEQ ID NO:6287 | SEQ ID NO:14299 | SEQ ID NO:22311 |
| | | AA | RSSYYWG | SIYYSGSASYNPSLKS | LDLQWSFDF |
| | | | SEQ ID NO:6288 | SEQ ID NO:14300 | SEQ ID NO:22312 |
| iPS:435501 | 21-225_156H1 | NA | AATTATGATATCAAC | TGGGTGCACCCTAACAGTGGTAACACAGGCTATGCACAGAAGTTCCAGGGC | AGCAGTGGCTGGTACTACTTTGACTAC |
| | | | SEQ ID NO:6289 | SEQ ID NO:14301 | SEQ ID NO:22313 |

FIGURE 49
(Continued)

| iPS# | Name | | | | | |
|---|---|---|---|---|---|---|
| iPS:435503 | 21-225_156E4 | AA | NYDIN | WVHPNSGNTGYAQKFQG | SSGWYYFDY | |
| | | | SEQ ID NO:6290 | SEQ ID NO:14302 | SEQ ID NO:22314 | |
| | | NA | AGCTATGCCATGAGC | GCTATTAGTGGTCGTGGT GGTAACACATTCTACGC AGACTCCGTGAAGGGC | CGGGTGACGGACTACGGTGG TAACGACTGGTTCGACCCC | |
| | | | SEQ ID NO:6291 | SEQ ID NO:14303 | SEQ ID NO:22315 | |
| | | AA | SYAMS | AISGRGGNTFYADSVKG | RVTDYGGNDWFDP | |
| | | | SEQ ID NO:6292 | SEQ ID NO:14304 | SEQ ID NO:22316 | |
| iPS:435505 | 21-225_157C1 | NA | AGCTATAGAAATGAAC | TCCATGAGTAATAGTAG TAGTTCCATATACTACGC AGACTCAGTGAAGGGC | CAGGCAGCCCAGGACTAC | |
| | | | SEQ ID NO:6293 | SEQ ID NO:14305 | SEQ ID NO:22317 | |
| | | AA | SYRMN | SMSNSSSIYYADSVKG | QAAQDY | |
| | | | SEQ ID NO:6294 | SEQ ID NO:14306 | SEQ ID NO:22318 | |
| iPS:435509 | 21-225_157H1 | NA | AGTTATATGCCATGAGG | GATATTAGTGGTAGTGG TGGTACCACATACTACG CAGACTCCGTGAAGGGC | ACCTACCTC | |
| | | | SEQ ID NO:6295 | SEQ ID NO:14307 | SEQ ID NO:22319 | |
| | | AA | SYAMR | DISGSGGTTYYADSVKG | TYL | |
| | | | SEQ ID NO:6296 | SEQ ID NO:14308 | SEQ ID NO:22320 | |
| iPS:435511 | 21-225_157C3 | NA | ACCTATGGCCATGCAC | GTTATATGGTATGATGTA AATAATAAATACTATGC AGACTCCGTGAAGGGC | GAGCTGGGGTTCCTCTCTGA CTAT | |
| | | | SEQ ID NO:6297 | SEQ ID NO:14309 | SEQ ID NO:22321 | |
| | | AA | TYGMH | VIWYDVNKYYADSVKG | ELGFLSDY | |
| | | | SEQ ID NO:6298 | SEQ ID NO:14310 | SEQ ID NO:22322 | |

FIGURE 49
(Continued)

| iPS:435513 | 21-225_157F3 | NA | ACCTATGCCATGAGC SEQ ID NO:6299 | GTTATTAGTGGTAGTGGT GGTAGCACATACTACGC AGACTCCGTGAAGGGC SEQ ID NO:14311 | AGGAGCAGTGGCTGGTACGA GGATGCTCTTGATATC SEQ ID NO:22323 |
|---|---|---|---|---|---|
| | | AA | TYAMS SEQ ID NO:6300 | VISGSGGSTYYADSVKG SEQ ID NO:14312 | RSSGWYEDALDI SEQ ID NO:22324 |
| iPS:435515 | 21-225_157E4 | NA | AGTATACCATGAAC SEQ ID NO:6301 | TCCATTAGTGGTAGTAGT AGTTACATATACTACGC AGACTCAGTGAAGGGC SEQ ID NO:14313 | GTAGCTACCTTTGACTAC SEQ ID NO:22325 |
| | | AA | SYTMN SEQ ID NO:6302 | SISGSSSYIYYADSVKG SEQ ID NO:14314 | VATFDY SEQ ID NO:22326 |
| iPS:435521 | 21-225_157H4 | NA | AGTTATAAGCATGAAC SEQ ID NO:6303 | TCCATTAGTAGTAGTAGT ACTTACATACTACTACGCA GACTCAGTGAAGGGC SEQ ID NO:14315 | GATAGAGGGTCCATC SEQ ID NO:22327 |
| | | AA | SYSMN SEQ ID NO:6304 | SISSSSTYIYYADSVKG SEQ ID NO:14316 | DRGSI SEQ ID NO:22328 |
| iPS:435523 | 21-225_157G5 | NA | AGCTATGTCATGAGC SEQ ID NO:6305 | GCTATGAGTGGTAGTGG TGGTAGAACATACTACG CAGACTCCGTGAAGGGC SEQ ID NO:14317 | TATACCTGGAACGGCTAC SEQ ID NO:22329 |
| | | AA | SYVMS SEQ ID NO:6306 | AMSGSGGRTYYADSVKG SEQ ID NO:14318 | YTWNGY SEQ ID NO:22330 |
| iPS:435525 | 21-225_157E7 | NA | AGTGGTAGTTACTACTGGGG C SEQ ID NO:6307 | AGTATCTACTATAGTGG GAGCACCTACTACAATC CGTCCCTCAAGAGT SEQ ID NO:14319 | CATAAAGTGGCTGGTCCCTT TGACTAC SEQ ID NO:22331 |
| | | AA | SGSYYWG SEQ ID NO:6308 | SIYYSGSTYYNPSLKS SEQ ID NO:14320 | HKVAGPFDY SEQ ID NO:22332 |

FIGURE 49
(Continued)

| iPS:435527 | 21-225_157G7 | NA | AGTTATAGCATGAAC | | TCCATTAGTGGTAGTAGT AGTACATATACTACGC AGACTCAGTGAAGGGC | | GATCGGGGCAGCAGC | |
|---|---|---|---|---|---|---|---|---|
| | | | | SEQ ID NO:6309 | | SEQ ID NO:14321 | | SEQ ID NO:22333 |
| | | AA | SYSMN | | SISGSSTYIYYADSVKG | | DRGSS | |
| | | | | SEQ ID NO:6310 | | SEQ ID NO:14322 | | SEQ ID NO:22334 |
| iPS:435529 | 21-225_157H7 | NA | AGCTATAGCATGAAC | | TGCATTAGTGGTAGTAGT AGTTACATATATTATGCA GACTCAGTGAAGGGC | | GATCGAGGGGGCTAT | |
| | | | | SEQ ID NO:6311 | | SEQ ID NO:14323 | | SEQ ID NO:22335 |
| | | AA | SYSMN | | CISGSSSYIYYADSVKG | | DRGGY | |
| | | | | SEQ ID NO:6312 | | SEQ ID NO:14324 | | SEQ ID NO:22336 |
| iPS:435531 | 21-225_157G8 | NA | AATTATGGCATGCAC | | ATTATATGGTATGATGG AAGTTATAAATACTATG CAGACTCCGTGAAGGGC | | GAGGGATACGATTTTTGGAG TGGTTTCTTTGACTCC | |
| | | | | SEQ ID NO:6313 | | SEQ ID NO:14325 | | SEQ ID NO:22337 |
| | | AA | NYGMH | | IIWYDGSYKYYADSVKG | | EGYDFWSGFFDS | |
| | | | | SEQ ID NO:6314 | | SEQ ID NO:14326 | | SEQ ID NO:22338 |
| iPS:435533 | 21-225_157H8 | NA | AGCTATATGGCATGCAC | | GTTATATGGTATGATGTA AATAATAAATACTATGC AGACTCCGTGAAGGGC | | GAGCTGGGGTTCCTCTCTGA CTAC | |
| | | | | SEQ ID NO:6315 | | SEQ ID NO:14327 | | SEQ ID NO:22339 |
| | | AA | SYGMH | | VIWYDVNNKYYADSVKG | | ELGFLSDY | |
| | | | | SEQ ID NO:6316 | | SEQ ID NO:14328 | | SEQ ID NO:22340 |
| iPS:435535 | 21-225_157H10 | NA | AGCTATACCATGAAC | | TCCATTAGTGGTAGCAGT AGTTACATAAACTACGC AGACTCAGTGAAGGGC | | GTGGCTCACTTTGACTAC | |
| | | | | SEQ ID NO:6317 | | SEQ ID NO:14329 | | SEQ ID NO:22341 |

FIGURE 49
(Continued)

| | | | | | | |
|---|---|---|---|---|---|---|
| iPS:435537 | 21-225_157H12 | AA | SYTMN<br>SEQ ID NO:6318 | | SISGSSSYINYADSVKG<br>SEQ ID NO:14330 | VAHFDY<br>SEQ ID NO:22342 |
| | | NA | AGCTATAGCATGAAC<br>SEQ ID NO:6319 | | TCCATTAGTGGTAGTGGT<br>AGTTACATAAACTACGC<br>AGACTCAGTGAAGGGC<br>SEQ ID NO:14331 | TCCAAGTTTGACTCC<br>SEQ ID NO:22343 |
| iPS:435539 | 21-225_158G1 | AA | SYSMN<br>SEQ ID NO:6320 | | SISGSGSYINYADSVKG<br>SEQ ID NO:14332 | SKFDS<br>SEQ ID NO:22344 |
| | | NA | AGTTATATGGCATGAAC<br>SEQ ID NO:6321 | | TCCATTAGTGGTAGTGGT<br>AGTTACATATACTACGC<br>AGACTCAGTGAAGGGC<br>SEQ ID NO:14333 | AGCAGTGGCTGGTCT<br>SEQ ID NO:22345 |
| iPS:435543 | 21-225_158D4 | AA | SYGMN<br>SEQ ID NO:6322 | | SISGSGSYIYYADSVKG<br>SEQ ID NO:14334 | SSGWS<br>SEQ ID NO:22346 |
| | | NA | GACTATGTCATGCAC<br>SEQ ID NO:6323 | | GTTATATGGTATGATGG<br>AAGTAATAAATACTATG<br>CAGACTCCGTGAAGGGC<br>SEQ ID NO:14335 | GAACCGTATACTAGTGGCTG<br>GTACGACTACGGTATGGACG<br>TC<br>SEQ ID NO:22347 |
| iPS:435545 | 21-225_158F4 | AA | DYVMH<br>SEQ ID NO:6324 | | VIWYDGSNKYYADSVKG<br>SEQ ID NO:14336 | EPYTSGWYDYGMDV<br>SEQ ID NO:22348 |
| | | NA | AGTCACTTCTGGAGC<br>SEQ ID NO:6325 | | CGTATCTATACCAGTGG<br>GACCACCAACTACACCC<br>CCTCCCTCAAGAGT<br>SEQ ID NO:14337 | TTGAGCAGTGGCTGGTTTGA<br>CTAC<br>SEQ ID NO:22349 |
| | | AA | SHFWS<br>SEQ ID NO:6326 | | RIYTSGTTNYTPSLKS<br>SEQ ID NO:14338 | LSSGWFDY<br>SEQ ID NO:22350 |

FIGURE 49
(Continued)

| | | | | | |
|---|---|---|---|---|---|
| iPS:435547 | 21-225_158F5 | NA | AGTTATAGCATGAAC | TCCATTAGTGGTAGTAGT AGTACATATACTACGC AGACTCAGTGAAGGGC | GATCGGGGCAGCAGC |
| | | | SEQ ID NO:6327 | SEQ ID NO:14339 | SEQ ID NO:22351 |
| | | AA | SYSMN | SISGSSTYIYYADSVKG | DRGSS |
| | | | SEQ ID NO:6328 | SEQ ID NO:14340 | SEQ ID NO:22352 |
| iPS:435549 | 21-225_158H5 | NA | AGCTATAGCATGAAC | TCCATCAGTGGTAGTAGT ACTTACATATACTACGCA GACTCAGTGAAGGGC | GATCGGGGCAGCAGC |
| | | | SEQ ID NO:6329 | SEQ ID NO:14341 | SEQ ID NO:22353 |
| | | AA | SYSMN | SISGSSTYIYYADSVKG | DRGSS |
| | | | SEQ ID NO:6330 | SEQ ID NO:14342 | SEQ ID NO:22354 |
| iPS:435551 | 21-225_158H6 | NA | AGCTATGGGCATGCAC | GTTATATGGTATGATGTA ACTAATAAATACTATGC AGACTCCGTGAAGGGC | GAACTGGGATGGGCGGAGG ACTAC |
| | | | SEQ ID NO:6331 | SEQ ID NO:14343 | SEQ ID NO:22355 |
| | | AA | SYGMH | VIWYDVTNKYYADSVKG | ELGWAEDY |
| | | | SEQ ID NO:6332 | SEQ ID NO:14344 | SEQ ID NO:22356 |
| iPS:435553 | 21-225_158G8 | NA | AGCTATACCATGAAC | TTGATTAGTGGCAGTAGT AGTTACATATACTACGC AGACTCAGTGAAGGGC | GATCGAGGCAGCCTC |
| | | | SEQ ID NO:6333 | SEQ ID NO:14345 | SEQ ID NO:22357 |
| | | AA | SYTMN | LISGSSSYIYYADSVKG | DRGSL |
| | | | SEQ ID NO:6334 | SEQ ID NO:14346 | SEQ ID NO:22358 |
| iPS:435557 | 21-225_158B12 | NA | AATTATGATATCAAC | TGGATGCACCCTAACAG TGGTAACACAGGCTATG CACAGAAGTTCCAGGGC | AGCAGTGGCTGGTACCGCTT TGACTAC |
| | | | SEQ ID NO:6335 | SEQ ID NO:14347 | SEQ ID NO:22359 |

FIGURE 49
(Continued)

| | | AA | NYDIN | WMHPNSGNTGYAQKFQG | SSGWYRFDY |
|---|---|---|---|---|---|
| iPS:435559 | 21-225_158H12 | | SEQ ID NO:6336 | SEQ ID NO:14348 | SEQ ID NO:22360 |
| | | NA | AGCTATGTCATGAGC | GCTATTAGTGGTAGTGGT GGTAGGACAGACTACGC AGACTCCGTAAAGGGC | GGGGGCTGGAACCACGAC |
| | | AA | SYVMS | AISGSGGRTDYADSVKG | GGWNHD |
| iPS:435561 | 21-225_159F1 | | SEQ ID NO:6337 | SEQ ID NO:14349 | SEQ ID NO:22361 |
| | | NA | AGCTATAGAATGAAC | TCCATAAGTGGTAGTGG TAATTACATAGACTACG CAGACTCAGTGAAGGGC | GGTTGGGACGTC |
| | | | SEQ ID NO:6338 | SEQ ID NO:14350 | SEQ ID NO:22362 |
| | | AA | SYRMN | SISGSGNYIDYADSVKG | GWDV |
| iPS:435563 | 21-225_159H2 | | SEQ ID NO:6339 | SEQ ID NO:14351 | SEQ ID NO:22363 |
| | | NA | AGTTATGATATCAAC | TGGATGAACCCTAACAG TGGTAACACAGGCTATG TACAGAAGTTCCAGGGC | AAGAAAACTGGGGACTAC |
| | | | SEQ ID NO:6340 | SEQ ID NO:14352 | SEQ ID NO:22364 |
| | | AA | SYDIN | WMNPNSGNTGYVQKFQG | KKTGDY |
| iPS:435565 | 21-225_159C4 | | SEQ ID NO:6341 | SEQ ID NO:14353 | SEQ ID NO:22365 |
| | | NA | AACTATGGCATGCAC | GTTATATCATATTCTGGA AACAATAAATACTATGC AGACTCCGTGAAGGGC | CGGAGCAGCTCGTGGGGGGG CTACGGTATGGACGTC |
| | | | SEQ ID NO:6342 | SEQ ID NO:14354 | SEQ ID NO:22366 |
| | | AA | NYGMH | VISYSGNNKYYADSVKG | RSSSWGGYGMDV |
| | | | SEQ ID NO:6343 | SEQ ID NO:14355 | SEQ ID NO:22367 |
| | | | SEQ ID NO:6344 | SEQ ID NO:14356 | SEQ ID NO:22368 |

FIGURE 49
(Continued)

| | | | | | |
|---|---|---|---|---|---|
| iPS:435569 | 21-225_159C5 | NA | AGCTATGGCATACAC | GTTGTATGGTATGATGTAAATAATAAATACTATGCAGACTCCGTGAAGGGC | GAGCTGGGGGTTCCTCTCTGACTAC |
| | | | SEQ ID NO:6345 | SEQ ID NO:14357 | SEQ ID NO:22369 |
| | | AA | SYGIH | VVWYDVNNKYYADSVKG | ELGFLSDY |
| | | | SEQ ID NO:6346 | SEQ ID NO:14358 | SEQ ID NO:22370 |
| iPS:435571 | 21-225_159C8 | NA | GACTATGTCATGCAG | GTTATATGGTATGATGGAAGTAATAAATACTATGCAGACTCCGTGAAGGGC | GAACCGTATAATAGTGGCTGGTACGACTACGGTATGGACGTC |
| | | | SEQ ID NO:6347 | SEQ ID NO:14359 | SEQ ID NO:22371 |
| | | AA | DYVMQ | VIWYDGSNKYYADSVKG | EPYNSGWYDYGMDV |
| | | | SEQ ID NO:6348 | SEQ ID NO:14360 | SEQ ID NO:22372 |
| iPS:435573 | 21-225_159D8 | NA | AACTATGTCATGCAC | GTTATATGGTATGATGGAAGTAATAAATACTATGCAGACTCCGTGAAGGGC | GAACCGTATATAGTAGTGGCTGGTACGACTACGGTATGGACGTC |
| | | | SEQ ID NO:6349 | SEQ ID NO:14361 | SEQ ID NO:22373 |
| | | AA | NYVMH | VIWYDGSNKYYADSVKG | EPYSSGWYDYGMDV |
| | | | SEQ ID NO:6350 | SEQ ID NO:14362 | SEQ ID NO:22374 |
| iPS:435575 | 21-225_159H11 | NA | AGCTATACCATGAAC | TCCATTAGTGGTAGTAGTAGTTACATATACGCGAGACTCAGTGAAGGGC | GTGAGCTGGGCTGACTGC |
| | | | SEQ ID NO:6351 | SEQ ID NO:14363 | SEQ ID NO:22375 |
| | | AA | SYTMN | SISGSSSYIYYADSVKG | VSWADC |
| | | | SEQ ID NO:6352 | SEQ ID NO:14364 | SEQ ID NO:22376 |

FIGURE 49
(Continued)

| | | | | |
|---|---|---|---|---|
| iPS:435577 | 21-225_160B1 | NA | AGCTATGGCATGCAC SEQ ID NO:6353 | GTTATATGGTATGATGG AAGTTATAAATACTATG CAGACTCCGTGAAGGGC SEQ ID NO:14365 | GAGGCCTACGATTTTTGGAG TGGTTATTATGACTAC SEQ ID NO:22377 |
| | | AA | SYGMH SEQ ID NO:6354 | VIWYDGSYKYYADSVKG SEQ ID NO:14366 | EAYDFWSGYYDY SEQ ID NO:22378 |
| iPS:435579 | 21-225_160G1 | NA | AGCTATGTCATGAGC SEQ ID NO:6355 | GCTATGAGTGGTAGTGG TGGTCACACATACTACG CAGACTCCGTGAAGGGC SEQ ID NO:14367 | CATGGATACAGC SEQ ID NO:22379 |
| | | AA | SYVMS SEQ ID NO:6356 | AMSGSGGHTYYADSVKG SEQ ID NO:14368 | HGYS SEQ ID NO:22380 |
| iPS:435581 | 21-225_160H1 | NA | AGCTATCGCATGAAC SEQ ID NO:6357 | TCCATTAGTAGTAGTACT GGTTACATGTACTACGC AGACTCAGTGAAGGGC SEQ ID NO:14369 | GATAAAGATTAC SEQ ID NO:22381 |
| | | AA | SYRMN SEQ ID NO:6358 | SISSSTGYMYYADSVKG SEQ ID NO:14370 | DKDY SEQ ID NO:22382 |
| iPS:435583 | 21-225_160F2 | NA | AGTTATGGCATGAAC SEQ ID NO:6359 | TCCATTAGTGGTAGTGGT AGTTACATATACTACGC AGACTCAGTGAAGGGC SEQ ID NO:14371 | AGCAGTGGCTGGTCT SEQ ID NO:22383 |
| | | AA | SYGMN SEQ ID NO:6360 | SISGSGSYIYYADSVKG SEQ ID NO:14372 | SSGWS SEQ ID NO:22384 |
| iPS:435585 | 21-225_160G3 | NA | AGCTATGTCATGAGC SEQ ID NO:6361 | GCTATGAGTGGTAGTGG TGGTCACACATACTACG CAGACTCCGTGAAGGGC SEQ ID NO:14373 | CATGGATACAGC SEQ ID NO:22385 |

FIGURE 49
(Continued)

| | | | | | AMSGSGGHTYYADSVKG | HGYS |
|---|---|---|---|---|---|---|
| iPS:435587 | 21-225_160H3 | AA | | SYVMS | | |
| | | | | SEQ ID NO:6362 | | |
| | | NA | AGAAGTAGTTACTACTGGGG C | AGTATCTATTATATAGTGGG AGTACCCTCCTACAACCC GTCTCTCGAGAGT | SEQ ID NO:14374 | CTCTCTCAACGGTGGGACTT TGACTAC |
| | | | | | | SEQ ID NO:22386 |
| | | AA | | RSSYYWG | SIYYSGSTSYNPSLES | LSQRWDFDY |
| | | | | SEQ ID NO:6363 | SEQ ID NO:14375 | SEQ ID NO:22387 |
| iPS:435589 | 21-225_160A4 | NA | AATTATGATATCAAC | SEQ ID NO:6364 | TGGATGCACCCTAACAG TGGTAACACAGGCTATC CACAGAAGTTCCAGGGC | AGCAGCGGCTGGTACATTTT TGACTAC |
| | | | | | SEQ ID NO:14376 | SEQ ID NO:22388 |
| | | AA | | NYDIN | WMHPNSGNTGYPQKFQG | SSGWYIFDY |
| | | | | SEQ ID NO:6365 | SEQ ID NO:14377 | SEQ ID NO:22389 |
| iPS:435591 | 21-225_160C4 | NA | GACTATGTCATGCAG | SEQ ID NO:6366 | GTTATATGGTATGATGG AAGTAATAAATACTATG CAGACTCCGTGAAGGGC | GAACCGTATAATAGTGGCTG GTACGACTACGGTATGGACG TC |
| | | | | | SEQ ID NO:14378 | SEQ ID NO:22390 |
| | | AA | | DYVMQ | VIWYDGSNKYYADSVKG | EPYNSGWYDYGMDV |
| | | | | SEQ ID NO:6367 | SEQ ID NO:14379 | SEQ ID NO:22391 |
| iPS:435593 | 21-225_160F4 | NA | AGTTATAGCATGAAC | SEQ ID NO:6368 | TCCATTAGTGGTAGTAGT ACGTACATATACTACGC AGACTCAGTGAAGGGC | GATCGGGGCAGCAGC |
| | | | | | SEQ ID NO:14380 | SEQ ID NO:22392 |
| | | AA | | SYSMN | SISGSSTYIYYADSVKG | DRGSS |
| | | | | SEQ ID NO:6369 | SEQ ID NO:14381 | SEQ ID NO:22393 |
| | | | | SEQ ID NO:6370 | SEQ ID NO:14382 | SEQ ID NO:22394 |

FIGURE 49
(Continued)

| | | | | |
|---|---|---|---|---|
| iPS:435595 | 21-225_160H4 | NA | AGCTATAGGATGAAC | TCCATTAGTAGTGGTAGTAGT AGTTACATAGACTACGC AGACTCAGTGAAGGGC | AAGAGTTGGTTTGACTAC |
| | | | SEQ ID NO:6371 | SEQ ID NO:14383 | SEQ ID NO:22395 |
| | | AA | SYRMN | SISGSSSYIDYADSVKG | KSWFDY |
| | | | SEQ ID NO:6372 | SEQ ID NO:14384 | SEQ ID NO:22396 |
| iPS:435599 | 21-225_160B10 | NA | AGAAGTAGCTACTACTGGGG C | AATATCTATTATAGTGGG AGCGCTACCACATTCC GTCCCTCAAGAGT | CATGACCCAAACTGGGAGT TGACTAC |
| | | | SEQ ID NO:6373 | SEQ ID NO:14385 | SEQ ID NO:22397 |
| | | AA | RSSYYWG | NIYYSGSAYHIPSLKS | HDPNWGVDY |
| | | | SEQ ID NO:6374 | SEQ ID NO:14386 | SEQ ID NO:22398 |
| iPS:435601 | 21-225_160G10 | NA | AGCTTTGGCATGCAC | GTCATATGGTATGATGG AAGTTATAAATACTATG CAGACTCCGTGAAGGGC | GTTGGTATAGAAGTGGCTGG TGACTACTACTTCGGTATGG AAGTC |
| | | | SEQ ID NO:6375 | SEQ ID NO:14387 | SEQ ID NO:22399 |
| | | AA | SFGMH | VIWYDGSYKYYADSVKG | VGIEVAGDYYFGMEV |
| | | | SEQ ID NO:6376 | SEQ ID NO:14388 | SEQ ID NO:22400 |
| iPS:435605 | 21-225_161A4 | NA | AGCAACTACATGAGC | GTTATTTATACCGGTGGT AGCACATACAACGCAGA CTCCGTGAAGGGC | AATTGGGGAATGGCTGGCCC CTTTGACTAC |
| | | | SEQ ID NO:6377 | SEQ ID NO:14389 | SEQ ID NO:22401 |
| | | AA | SNYMS | VIYTGGSTYNADSVKG | NWGMAGPFDY |
| | | | SEQ ID NO:6378 | SEQ ID NO:14390 | SEQ ID NO:22402 |
| iPS:435607 | 21-225_161G4 | NA | AGCTATGGCATGCAC | GTTATATCATATGGTGGA AGTAATAAATACCATGC AGACTCCGTGAAGGGC | CGGAGCAGCTCGTCGGGGGG CTACGGTATGGACGTC |
| | | | SEQ ID NO:6379 | SEQ ID NO:14391 | SEQ ID NO:22403 |

FIGURE 49
(Continued)

| | | | | | |
|---|---|---|---|---|---|
| iPS:435609 | 21-225_161F7 | AA | SYGMH | VISYGGSNKYHADSVKG | RSSSSGGYGMDV |
| | | | SEQ ID NO:6380 | SEQ ID NO:14392 | SEQ ID NO:22404 |
| | | NA | GACTTTGGCTTGCAC | GTTATATGGTTTGATGGA AGTAATAAATACTATGC AGACTCCGTGAAGGGC | GAGATTGGCTGGCTCTGA CTAC |
| | | | SEQ ID NO:6381 | SEQ ID NO:14393 | SEQ ID NO:22405 |
| iPS:435611 | 21-225_161F10 | AA | DFGLH | VIWFDGSNKYYADSVKG | EIGWLSDY |
| | | | SEQ ID NO:6382 | SEQ ID NO:14394 | SEQ ID NO:22406 |
| | | NA | AGCTATGGCATGCAC | ATTATATCATATTCTGAA AGAAATGATTTCTATGC AGACTCCGTGAAGGGC | CGTATAGCAGCAGCTGGTCA CTACGGTATGGACGTC |
| | | | SEQ ID NO:6383 | SEQ ID NO:14395 | SEQ ID NO:22407 |
| iPS:435613 | 21-225_161D11 | AA | SYGMH | IISYSGRNDFYADSVKG | RIAAAGHYGMDV |
| | | | SEQ ID NO:6384 | SEQ ID NO:14396 | SEQ ID NO:22408 |
| | | NA | GACTTTGGCTTGCAC | GTTATATGGTTTGATGGA AGTAATAAATACTATGC AGACTCCGTGAAGGGC | GAGATTGGCTGGCTCTGA CTAC |
| | | | SEQ ID NO:6385 | SEQ ID NO:14397 | SEQ ID NO:22409 |
| iPS:435615 | 21-225_161G12 | AA | DFGLH | VIWFDGSNKYYADSVKG | EIGWLSDY |
| | | | SEQ ID NO:6386 | SEQ ID NO:14398 | SEQ ID NO:22410 |
| | | NA | GACTATGTCATGCAG | GTTATATGGTATGATGG AAGTAATAAATACTATG CAGACTCCGTGAAGGGC | GAACCGTATAATAGTGGCTG GTACGACTACGGTATGGACG TC |
| | | | SEQ ID NO:6387 | SEQ ID NO:14399 | SEQ ID NO:22411 |
| | | AA | DYVMQ | VIWYDGSNKYYADSVKG | EPYNSGWYDYGMDV |
| | | | SEQ ID NO:6388 | SEQ ID NO:14400 | SEQ ID NO:22412 |

FIGURE 49
(Continued)

| | | | | | |
|---|---|---|---|---|---|
| iPS:435617 | 21-225_162F2 | NA | AGTTATAGCATGAAC | TCCATTAGTGGTAGTAGT ACGTACATATACTACGC AGACTCAGTGAAGGGC | GATCGGGGCAGCAGC |
| | | | SEQ ID NO:6389 | SEQ ID NO:14401 | SEQ ID NO:22413 |
| | | AA | SYSMN | SISGSSTYIYYADSVKG | DRGSS |
| | | | SEQ ID NO:6390 | SEQ ID NO:14402 | SEQ ID NO:22414 |
| iPS:435621 | 21-225_162H3 | NA | AGTTATAGCATGAAC | TCCATTAGTGGTAGTAGT ACGTACATATACTACGC AGACTCAGTGAAGGGC | GATCGGGGCAGCAGC |
| | | | SEQ ID NO:6391 | SEQ ID NO:14403 | SEQ ID NO:22415 |
| | | AA | SYSMN | SISGSSTYIYYADSVKG | DRGSS |
| | | | SEQ ID NO:6392 | SEQ ID NO:14404 | SEQ ID NO:22416 |
| iPS:435623 | 21-225_162D5 | NA | AATTATGATATCAAC | TGGATGCACCCTAACAG TGGTAACACAGGCTATG CACAGAAGTTCCAGGGC | AGCAGTGGCTGGTACTTCTT TGACTAC |
| | | | SEQ ID NO:6393 | SEQ ID NO:14405 | SEQ ID NO:22417 |
| | | AA | NYDIN | WMHPNSGNTGYAQKFQG | SSGWYFFDY |
| | | | SEQ ID NO:6394 | SEQ ID NO:14406 | SEQ ID NO:22418 |
| iPS:435627 | 21-225_162F6 | NA | AATTATGATATCAAC | TGGATGCACCCTAACAG TGGTAACACAGGCTATG CACAGAAGTTCCAGGGC | AGCAGTGGCTGGTACCGCTT TGACTAC |
| | | | SEQ ID NO:6395 | SEQ ID NO:14407 | SEQ ID NO:22419 |
| | | AA | NYDIN | WMHPNSGNTGYAQKFQG | SSGWYRFDY |
| | | | SEQ ID NO:6396 | SEQ ID NO:14408 | SEQ ID NO:22420 |
| iPS:435629 | 21_225_162H6 | NA | AACTATGGCATGCAC | GTTATATGGTATGATGG AGTAATAAATACTATG CAGACTCCGTGAAGGGC | AAAGGTATAGCAGCAGTTGG AGACTACTACTACGGTATGG ACGTC |

FIGURE 49
(Continued)

| | | | | | | |
|---|---|---|---|---|---|---|
| iPS:435635 | 21-225_162H6 | AA | SEQ ID NO:6397<br>NYGMH | SEQ ID NO:14409<br>VIWYDGSNKYYADSVKG | SEQ ID NO:22421<br>KGIAAVGDYYYGMDV | |
| | | NA | SEQ ID NO:6398<br>AGCTATAGCATGAAC | SEQ ID NO:14410<br>TCCATTAGTGGTAGTGGT<br>AGTTACATATACTACGC<br>AGACTCAGTGAAGGGC | SEQ ID NO:22422<br>TATAGCAGCTCGCACTAT | |
| iPS:435637 | 21-225_163F1 | AA | SEQ ID NO:6399<br>SYSMN | SEQ ID NO:14411<br>SISGSGSYIYYADSVKG | SEQ ID NO:22423<br>YSSSHY | |
| | | NA | SEQ ID NO:6400<br>AGCTATAGCATGAAC | SEQ ID NO:14412<br>TCCACTAGTGGGAGTTCT<br>ACTTACATATACTACGCA<br>GACTCAGTGAAGGGC | SEQ ID NO:22424<br>GATCGAGGCAGCCTC | |
| iPS:435639 | 21-225_163E2 | AA | SEQ ID NO:6401<br>SYSMS | SEQ ID NO:14413<br>STSGSSTYIYYADSVKG | SEQ ID NO:22425<br>DRGSL | |
| | | NA | SEQ ID NO:6402<br>AGTTATAGCATGAGC | SEQ ID NO:14414<br>TCCATTAGTGGTAGTAGT<br>GCTTACATATACTACGCA<br>GACTCAGTGAAGGGC | SEQ ID NO:22426<br>TTGAGCGGTATGGACGTC | |
| iPS:435641 | 21-225_163G6 | AA | SEQ ID NO:6403<br>SYSMS | SEQ ID NO:14415<br>SISGSSAYIYYADSVKG | SEQ ID NO:22427<br>LSGMDV | |
| | | NA | SEQ ID NO:6404<br>AGCTATAGCATGAAC | SEQ ID NO:14416<br>TCCATTAGTGGTAGTAGT<br>ACTTACATATACTACGCA<br>GACTCAGTGAAGGGC | SEQ ID NO:22428<br>GATCGAGGCAGCCTC | |
| | 21-225_163F9 | AA | SEQ ID NO:6405<br>SYSMN | SEQ ID NO:14417<br>SISGSSTYIYYADSVKG | SEQ ID NO:22429<br>DRGSL | |
| | | NA | SEQ ID NO:6406 | SEQ ID NO:14418 | SEQ ID NO:22430 | |

FIGURE 49
(Continued)

| | | | | |
|---|---|---|---|---|
| iPS:435643 | 21-225_163G10 | NA | AGCTATAGCATGAAC | TCCATTAGTGTGGTAGTAGT ACTTACATATACTACGCA GACTCAGTGAAGGGC | GCCCGTATGGACGTC |
| | | | SEQ ID NO:6407 | SEQ ID NO:14419 | SEQ ID NO:22431 |
| | | AA | SYSMN | SISGSSTYIYYADSVKG | ARMDV |
| | | | SEQ ID NO:6408 | SEQ ID NO:14420 | SEQ ID NO:22432 |
| iPS:435649 | 21-225_165H2 | NA | CATTATGATATCAAC | TGGATGCACCCTAACAG TCATAAGACAGGCTATG CACAGAAGTTCCAGGGC | AGCAGTGGCTGGTACATGTT TGACTAC |
| | | | SEQ ID NO:6409 | SEQ ID NO:14421 | SEQ ID NO:22433 |
| | | AA | HYDIN | WMHPNSHKTGYAQKFQG | SSGWYMFDY |
| | | | SEQ ID NO:6410 | SEQ ID NO:14422 | SEQ ID NO:22434 |
| iPS:435653 | 21-225_166H12 | NA | AGCTATAGCATGAGC | TCCATTAGTGGAGTAG TAGTTACAGTTACTACGC AGACTCAGTGAAGGGC | CTAACTGGCTTTGACTAC |
| | | | SEQ ID NO:6411 | SEQ ID NO:14423 | SEQ ID NO:22435 |
| | | AA | SYSMS | SISGSSSYSYYADSVKG | LTGFDY |
| | | | SEQ ID NO:6412 | SEQ ID NO:14424 | SEQ ID NO:22436 |
| iPS:435655 | 21-225_167E2 | NA | AGCTTTGGCATGCAC | GTCATATGGTATGATGG AACTTATAAATACTATGC AGACTCCGTGAAGGGC | GTTGGTATTGAAGTGGCTGG TGACTACTACTACGGTATGG AAGTC |
| | | | SEQ ID NO:6413 | SEQ ID NO:14425 | SEQ ID NO:22437 |
| | | AA | SFGMH | VIWYDGTYKYYADSVKG | VGIEVAGDYYYGMEV |
| | | | SEQ ID NO:6414 | SEQ ID NO:14426 | SEQ ID NO:22438 |
| iPS:435657 | 21-225_167H10 | NA | AGCTTTGGCATGCAC | GTCATATGGTATGATGG AAGTTATAAGTACCATG CAGACTCCGTGAAGGGC | GTTGGTATAGAAGTGGCTGG TGACTACTACTACGGTATGG AAGTC |
| | | | SEQ ID NO:6415 | SEQ ID NO:14427 | SEQ ID NO:22439 |

FIGURE 49
(Continued)

| | | AA | SFGMH | VIWYDGSYKYHADSVKG | VGIEVAGDYYYGMEV |
|---|---|---|---|---|---|
| iPS:435659 | 21-225_167D12 | | SEQ ID NO:6416 | SEQ ID NO:14428 | SEQ ID NO:22440 |
| | | NA | AGCTATGTCATGAGC | GCTATGAGTGGTAGTGG TGGTAGAACATACTACG CAGACTCCGTGAAGGGC | TATACCTGGAACGGCTAC |
| | | | SEQ ID NO:6417 | SEQ ID NO:14429 | SEQ ID NO:22441 |
| | | AA | SYVMS | AMSGSGGRTYYADSVKG | YTWNGY |
| iPS:435663 | 21-225_169B1 | | SEQ ID NO:6418 | SEQ ID NO:14430 | SEQ ID NO:22442 |
| | | NA | AGCTATGGCATGCAC | GTTATATGGTATGATGG AAGTAATAAATACTATG CAGACTCCGTGAGGGGC | GATCCCTTACGTGGATACAA TGACCCGGTTATGGACTAC |
| | | | SEQ ID NO:6419 | SEQ ID NO:14431 | SEQ ID NO:22443 |
| | | AA | SYGMH | VIWYDGSNKYYADSVRG | DPLRGYNDPVMDY |
| iPS:435665 | 21-225_169F2 | | SEQ ID NO:6420 | SEQ ID NO:14432 | SEQ ID NO:22444 |
| | | NA | AGTTACTACTGGAGT | CGTATCGATACCAGTGG GATCACCAACTACAACC CCTCCCTCAAGAGT | GAGGGAGGAGTGGGAGCTA CCTACTTTGACTAC |
| | | | SEQ ID NO:6421 | SEQ ID NO:14433 | SEQ ID NO:22445 |
| | | AA | SYYWS | RIDTSGITNYNPSLKS | EGGVGATYFDY |
| iPS:435667 | 21-225_169E3 | | SEQ ID NO:6422 | SEQ ID NO:14434 | SEQ ID NO:22446 |
| | | NA | GGCCATAGCATGAAC | TACATTAGCCTTAGTGGT AGTACCATAAAGTACGC AGACTCTGTGAAGGGC | AGGGGGATTACTGTGGTTCG GAATGAGGACGGTTTGGACG TC |
| | | | SEQ ID NO:6423 | SEQ ID NO:14435 | SEQ ID NO:22447 |
| | | AA | GHSMN | YISLSGSTIKYADSVKG | RGITVVRNEDGLDV |
| | | | SEQ ID NO:6424 | SEQ ID NO:14436 | SEQ ID NO:22448 |

FIGURE 49
(Continued)

| | | | | | |
|---|---|---|---|---|---|
| iPS:435669 | 21-225_169F9 | NA | ACCTATGGCATGCAC | ATTATATGGTATGATGG AACTAATAAATACTATG CAGACTCCGTGAAGGGC | GATCCCTTACGTGGATACAA TGACCCGGTTATGGACTAC |
| | | | SEQ ID NO:6425 | SEQ ID NO:14437 | SEQ ID NO:22449 |
| | | AA | TYGMH | IIWYDGTNKYYADSVKG | DPLRGYNDPVMDY |
| iPS:435671 | 21-225_169H5 | NA | SEQ ID NO:6426 AGTTACTACTGGAGT | SEQ ID NO:14438 CGTATCGATACCAGTGG GATCACCAACTACAACC CCTCCCTCAAGAGT | SEQ ID NO:22450 GAGGGAGGAGTGGGAGCTA CCTACTTTGACTAC |
| | | | SEQ ID NO:6427 | SEQ ID NO:14439 | SEQ ID NO:22451 |
| | | AA | SYYWS | RIDTSGITNYNPSLKS | EGGVGATYFDY |
| iPS:435673 | 21-225_169E6 | NA | SEQ ID NO:6428 GGCCATAGCATGAAC | SEQ ID NO:14440 TACATTAGCATTAGTAGT AGTACCATAAAGTACGC AGACTCTGTGAAGGC | SEQ ID NO:22452 AGGGGGATTACTGTGGTTCG GAATGAGGACGGTTTGGACG TC |
| | | | SEQ ID NO:6429 | SEQ ID NO:14441 | SEQ ID NO:22453 |
| | | AA | GHSMN | YISISSSTIKYADSVKG | RGITVVRNEDGLDV |
| iPS:435675 | 21-225_169D7 | NA | SEQ ID NO:6430 AGTTACTACTGGACC | SEQ ID NO:14442 CGTATCTATACCAGTGG GAGCACCAACTACAACC CCTCCCTCAAGAGT | SEQ ID NO:22454 GTCGGGAGGTACTACTACGG TATGGACGTC |
| | | | SEQ ID NO:6431 | SEQ ID NO:14443 | SEQ ID NO:22455 |
| | | AA | SYYWT | RIYTSGSTNYNPSLKS | VGRYYYGMDV |
| iPS:435677 | 21-225_169C10 | NA | SEQ ID NO:6432 GGCTACTTTATGCAC | SEQ ID NO:14444 TGGATCAAGCCTAAGAG TGGTGGCACAAACTCTG CACAGAGGTTTCAGGGC | SEQ ID NO:22456 GGGGGGACTACGGTGGCTAC GTGGGGGTCTTTGACTAC |
| | | | SEQ ID NO:6433 | SEQ ID NO:14445 | SEQ ID NO:22457 |
| | | AA | GYFMH | WIKPKSGGTNSAQRFQG | GGTTVATWGVFDY |

FIGURE 49
(Continued)

| | | | | | | |
|---|---|---|---|---|---|---|
| iPS:435679 | 21-225_169D10 | NA | SEQ ID NO:6434 AGCTATGTCATGAGT | SEQ ID NO:14446 GCTATTAGTGGTAGTGGT AGTAGAATATACTACGC GGACTCCGTGAAGGGC | SEQ ID NO:22458 GTGGCTTTCTTTGACTAT | |
| | | AA | SEQ ID NO:6435 SYVMS | SEQ ID NO:14447 AISGSGSRIYYADSVKG | SEQ ID NO:22459 VAFFDY | |
| iPS:435681 | 21-225_169D11 | NA | SEQ ID NO:6436 GACTATGTCATGCAC | SEQ ID NO:14448 GTTATATGGTATGATGG AAGTAATAAATACTATG CAGACTCCGTGAAGGGC | SEQ ID NO:22460 GAAAGGTATAGCAGTGGCTG GTACGACTACGGTATGGACG TC | |
| | | AA | SEQ ID NO:6437 DYVMH | SEQ ID NO:14449 VIWYDGSNKYYADSVKG | SEQ ID NO:22461 ERYSSGWYDYGMDV | |
| iPS:435683 | 21-225_170A1 | NA | SEQ ID NO:6438 AGCTATGGCATGCAC | SEQ ID NO:14450 ATTATATGGTATGATGG AAGTTATAAATACTATG CAGATTCCGTGAAGGGC | SEQ ID NO:22462 GATGCCCACGATTTTTGGAG TGGTTACTTTGACTCC | |
| | | AA | SEQ ID NO:6439 SYGMH | SEQ ID NO:14451 IIWYDGSYKYYADSVKG | SEQ ID NO:22463 DAHDFWSGYFDS | |
| iPS:435685 | 21-225_170E1 | NA | SEQ ID NO:6440 AGCTATGTCATGAGT | SEQ ID NO:14452 GCTATTAGTGGTAGTGGT AATAGAATATACTACGC AGACTCCGTGAAGGGC | SEQ ID NO:22464 GTGGCTTTCTTTGACTAT | |
| | | AA | SEQ ID NO:6441 SYVMS | SEQ ID NO:14453 AISGSGNRIYYADSVKG | SEQ ID NO:22465 VAFFDY | |
| iPS:435687 | 21_225_170H1 | NA | SEQ ID NO:6442 AGTTATTACTGGAGC | SEQ ID NO:14454 CGTATCTATACCAGTGG GAGCACCAACTACAACC CCTCCCTCAAGAGT | SEQ ID NO:22466 GTCGGGAGGTACTACTATGG TATGGACGTC | |

FIGURE 49
(Continued)

| | | | | | | |
|---|---|---|---|---|---|---|
| iPS:435689 | 21-225_170H1 | AA | SEQ ID NO:6443<br>SYYWS | SEQ ID NO:14455<br>RIYTSGSTNYNPSLKS | SEQ ID NO:22467<br>VGRYYYGMDV |
| | | NA | SEQ ID NO:6444<br>GACTATGTCATGCAC | SEQ ID NO:14456<br>GTTATATGGTATGATGG<br>AAGTAATAAATACTATG<br>AAGACTCCGTGAAGGGC | SEQ ID NO:22468<br>GAGACGTATAGCAGCAGCTG<br>GTACGACTACGGTATGGACG<br>TC |
| iPS:435693 | 21-225_170F3 | AA | SEQ ID NO:6445<br>DYVMH | SEQ ID NO:14457<br>VIWYDGSNKYYEDSVKG | SEQ ID NO:22469<br>ETYSSSWYDYGMDV |
| | | NA | SEQ ID NO:6446<br>ACCTATGGCATGCAC | SEQ ID NO:14458<br>ATTATATGGTATGATGG<br>AACTAATAAATACTATG<br>CAGACTCCGTGAAGGGC | SEQ ID NO:22470<br>GATCCCTTACGTGGATACAA<br>TGACCCGGTTATGGACTAC |
| | 21-225_170G4 | AA | SEQ ID NO:6447<br>TYGMH | SEQ ID NO:14459<br>IIWYDGTNKYYADSVKG | SEQ ID NO:22471<br>DPLRGYNDPVMDY |
| iPS:435695 | | NA | SEQ ID NO:6448<br>AGCTATGGCATGCAC | SEQ ID NO:14460<br>ATTATATGGTATGATGG<br>AACTAATAAATACTATG<br>CAGACTCCGTGAAGGGC | SEQ ID NO:22472<br>GATCCCTTACGTGGATACAA<br>TGACCCGGTTATGGACTAC |
| | 21-225_170D5 | AA | SEQ ID NO:6449<br>SYGMH | SEQ ID NO:14461<br>IIWYDGTNKYYADSVKG | SEQ ID NO:22473<br>DPLRGYNDPVMDY |
| iPS:435697 | | NA | SEQ ID NO:6450<br>ACCTATGGCATGCAC | SEQ ID NO:14462<br>ATTATATGGTATGATGG<br>GACTAATAAATACTATG<br>CAGACTCCGTGAAGGGC | SEQ ID NO:22474<br>GATCCCTTACGTGGATACAA<br>TGACCCGGTTATGGACTAC |
| | 21-225_170G5 | AA | SEQ ID NO:6451<br>TYGMH | SEQ ID NO:14463<br>IIWYDGTNKYYADSVKG | SEQ ID NO:22475<br>DPLRGYNDPVMDY |

FIGURE 49
(Continued)

| | | | | | | |
|---|---|---|---|---|---|---|
| iPS:435699 | 21-225_170D6 | NA | SEQ ID NO:6452 GGCTACTTTATACAC | SEQ ID NO:14464 TGGATCAAGGCTAACAG TGGTGGCACAAACTCTG CACAGAGGTTTCAGGGC | SEQ ID NO:22476 GGGGGACTACGGTGGCTAC GTGGGGGGTCTTTGACTAC |
| | | AA | SEQ ID NO:6453 GYFIH | SEQ ID NO:14465 WIKPNSGGTNSAQRFQG | SEQ ID NO:22477 GGTTVATWGVFDY |
| iPS:435701 | 21-225_170F6 | NA | SEQ ID NO:6454 AATTATATGATATCAAC | SEQ ID NO:14466 TGGATGAACCCTAACAG TGGTAACACAGGCTATG CACAGAAGTTCCAGGAC | SEQ ID NO:22478 AGCAGTGGCTGGTACTGGTT CGACCCC |
| | | AA | SEQ ID NO:6455 NYDIN | SEQ ID NO:14467 WMNPNSGNTGYAQKFQD | SEQ ID NO:22479 SSGWYWFDP |
| iPS:435703 | 21-225_170D11 | NA | SEQ ID NO:6456 AGCTATGGCATGCAC | SEQ ID NO:14468 ATTATATGGTATGATGG AACTAATAAATACTATG CAGACTCCGTGAAGGGC | SEQ ID NO:22480 GATCCCTTACGTGGATACAA TGACCCGGTTATGGACTAC |
| | | AA | SEQ ID NO:6457 SYGMH | SEQ ID NO:14469 IIWYDGTNKYYADSVKG | SEQ ID NO:22481 DPLRGYNDPVMDY |
| iPS:435705 | 21-225_171C3 | NA | SEQ ID NO:6458 ACCTATGGCATGCAC | SEQ ID NO:14470 ATTATATGGTATGATGG GACTAATAAATACTATG CAGACTCCGTGAAGGGC | SEQ ID NO:22482 GATCCCTTACGTGGATACAA TGACCCGGTTATGGACTAC |
| | | AA | SEQ ID NO:6459 TYGMH | SEQ ID NO:14471 IIWYDGTNKYYADSVKG | SEQ ID NO:22483 DPLRGYNDPVMDY |
| | | | SEQ ID NO:6460 | SEQ ID NO:14472 | SEQ ID NO:22484 |

FIGURE 49
(Continued)

| | | | | |
|---|---|---|---|---|
| iPS:435709 | 21-225_171A4 | NA | ACCTATGGCATGCAC | ATTATATGGTATGATGG AAGTAATAAATACTATG CAGACTCCGTGAAGGGC | GATCCCTTACGTGGATACAA TGACCCGGTTATGGACTAC |
| | | | SEQ ID NO:6461 | SEQ ID NO:14473 | SEQ ID NO:22485 |
| | | AA | TYGMH | IIWYDGSNKYYADSVKG | DPLRGYNDPVMDY |
| | | | SEQ ID NO:6462 | SEQ ID NO:14474 | SEQ ID NO:22486 |
| iPS:435711 | 21-225_171G4 | NA | AGCTGTGCCATGACC | GCTATTAGTGGTCGTGGT GGTACCACGTTCTACGC AGACTCCGTGAGGGC | GATCTTATTGGGGGAGCTAC TTACTTTGACTAC |
| | | | SEQ ID NO:6463 | SEQ ID NO:14475 | SEQ ID NO:22487 |
| | | AA | SCAMT | AISGRGGTTFYADSVRG | DLIGGATYFDY |
| | | | SEQ ID NO:6464 | SEQ ID NO:14476 | SEQ ID NO:22488 |
| iPS:435713 | 21-225_171D7 | NA | AGCTATGGCATGCAC | GTTATATCATATGACGG AAACAATAGACACTATG CAGACTCCGTGCAGGGC | GATCGTCACGCGTTGGACTA CTACGCTTTGGACGTC |
| | | | SEQ ID NO:6465 | SEQ ID NO:14477 | SEQ ID NO:22489 |
| | | AA | SYGMH | VISYDGNNRHYADSVQG | DRHRLDYYALDV |
| | | | SEQ ID NO:6466 | SEQ ID NO:14478 | SEQ ID NO:22490 |
| iPS:435715 | 21-225_171A8 | NA | AGCTCTGCCATGAGC | GTTATTAGTGGTAGTGGT GGTAGCACATTCTACAC AGACTCCGTGAAGGGC | TCGAATAGCAGTGGCTGGTT TGACTAC |
| | | | SEQ ID NO:6467 | SEQ ID NO:14479 | SEQ ID NO:22491 |
| | | AA | SSAMS | VISGSGGSTFYTDSVKG | SNSSGWFDY |
| | | | SEQ ID NO:6468 | SEQ ID NO:14480 | SEQ ID NO:22492 |
| iPS:435717 | 21-225_171A9 | NA | AGCTATGCCATGACT | GCTATTAGTGGTAGTGGT GGTAACACATTCAACGC AGACTCCGTGAAGGGC | CTGGGGATCGACTACTACTA CTACGGTATGGACGTC |
| | | | SEQ ID NO:6469 | SEQ ID NO:14481 | SEQ ID NO:22493 |

FIGURE 49
(Continued)

| | | AA | SYAMT | | AISGSGGNTFNADSVKG | | LGIDYYYYGMDV | |
|---|---|---|---|---|---|---|---|---|
| iPS:435719 | | | SEQ ID NO:6470 | | SEQ ID NO:14482 | | SEQ ID NO:22494 | |
| | 21-225_171A11 | NA | AGCTATAGCATGAAC | | TCCATTAGTGGTAGTAGT AGTTACATATACTACGC AGACTCAGTGAAGGGC | | GATAGGGGCAGCTCC | |
| | | | SEQ ID NO:6471 | | SEQ ID NO:14483 | | SEQ ID NO:22495 | |
| | | AA | SYSMN | | SISGSSSYIYYADSVKG | | DRGSS | |
| iPS:435721 | | | SEQ ID NO:6472 | | SEQ ID NO:14484 | | SEQ ID NO:22496 | |
| | 21-225_172B3 | NA | ACCTATGGCATGCAC | | GTTATATGGTATGATGG AAGTAATAAATACTATG CAGACTCCGTGAAGGGC | | GATCCCTTACGTGGATACAA TGACCCGGTTATGGGACTAC | |
| | | | SEQ ID NO:6473 | | SEQ ID NO:14485 | | SEQ ID NO:22497 | |
| | | AA | TYGMH | | VIWYDGSNKYYADSVKG | | DPLRGYNDPVMDY | |
| iPS:435723 | | | SEQ ID NO:6474 | | SEQ ID NO:14486 | | SEQ ID NO:22498 | |
| | 21-225_172B7 | NA | AACTATGGCATGCAC | | ATTATATGGTATGATGG AAGTAATAAATACTATG TAGACTCCGTGAAGGGC | | GAGGCGTACGATTTTTGGAG TGGTTATTGGGACTAC | |
| | | | SEQ ID NO:6475 | | SEQ ID NO:14487 | | SEQ ID NO:22499 | |
| | | AA | NYGMH | | IIWYDGSNKYYVDSVKG | | EAYDFWSGYWDY | |
| iPS:435725 | | | SEQ ID NO:6476 | | SEQ ID NO:14488 | | SEQ ID NO:22500 | |
| | 21-225_172G8 | NA | ACCTATGGCATGCAC | | ATTATATGGTATGATGG AACTAATAAATACTATG CAGACTCCGTGAAGGGC | | GATCCCTTACGTGGATACAA TGACCCGGTTATGGGACTAC | |
| | | | SEQ ID NO:6477 | | SEQ ID NO:14489 | | SEQ ID NO:22501 | |
| | | AA | TYGMH | | IIWYDGTNKYYADSVKG | | DPLRGYNDPVMDY | |
| | | | SEQ ID NO:6478 | | SEQ ID NO:14490 | | SEQ ID NO:22502 | |

FIGURE 49
(Continued)

| | | | | | |
|---|---|---|---|---|---|
| iPS:435727 | 21-225_172E11 | NA | AATTATGATATCAAC | TGGATGCACCCTAACAGTGGTAACACAGGCTATGCACGAAGTTCCAGGGC | AGCAGTGGCTGGTACCGGTTTGACTAC |
| | | | SEQ ID NO:6479 | SEQ ID NO:14491 | SEQ ID NO:22503 |
| | | AA | NYDIN | WMHPNSGNTGYAQKFQG | SSGWYRFDY |
| | | | SEQ ID NO:6480 | SEQ ID NO:14492 | SEQ ID NO:22504 |
| iPS:435729 | 21-225_173E7 | NA | AGCTATGCCATGAGC | TTTATTAGTGGTAGTGGTGGTAACACATTCTACGCAGACTCCGTGAAGGGC | AGGGATACCTACAACGGTTGGGATGCTTTTGATATC |
| | | | SEQ ID NO:6481 | SEQ ID NO:14493 | SEQ ID NO:22505 |
| | | AA | SYAMS | FISGSGGNTFYADSVKG | RDTYNGWDAFDI |
| | | | SEQ ID NO:6482 | SEQ ID NO:14494 | SEQ ID NO:22506 |
| iPS:435731 | 21-225_173A11 | NA | AGCTATGGCATGCAC | ATTATATGGTATGATGGAAGTAATAAATACTATGCAGACTCCGTGAAGGGC | GAGGCCTACGATTTTTGGAGTGGTTTCTTTGACTCC |
| | | | SEQ ID NO:6483 | SEQ ID NO:14495 | SEQ ID NO:22507 |
| | | AA | SYGMH | IIWYDGSNKYYADSVKG | EAYDFWSGFFDS |
| | | | SEQ ID NO:6484 | SEQ ID NO:14496 | SEQ ID NO:22508 |
| iPS:435733 | 21-225_173C11 | NA | AGCTATGGCATACAC | CTTATATTTTATGATGAAGTAATAAATACTATGCAGACTCCGTGAAGGGC | CGGTATAGCAGCAGCTGGTCCGGTGGTATGGACGTC |
| | | | SEQ ID NO:6485 | SEQ ID NO:14497 | SEQ ID NO:22509 |
| | | AA | SYGIH | LIFYDGSNKYYADSVKG | RYSSSWSGGMDV |
| | | | SEQ ID NO:6486 | SEQ ID NO:14498 | SEQ ID NO:22510 |

FIGURE 49
(Continued)

| | | | | | | |
|---|---|---|---|---|---|---|
| iPS:435735 | 21-225_173H12 | NA | AGCTATGGCATGCAC | ATTATATGGTATGATGGAACTAACAAATACTATGCAGACTCCGTGAAGGGC | SEQ ID NO:22511 | GATCCCTTACGTGGATACAATGACCCGGTTATGGACTAC |
| | | | SEQ ID NO:6487 | SEQ ID NO:14499 | | |
| | | AA | SYGMH | IIWYDGTNKYYADSVKG | DPLRGYNDPVMDY | |
| | | | SEQ ID NO:6488 | SEQ ID NO:14500 | SEQ ID NO:22512 | |
| iPS:435737 | 21-225_174G5 | NA | AATTATGATATCAAC | TGGATGCACCCTAACAGTGGTAACACAGGCTATGCACAGAAGTTCCAGGGC | SEQ ID NO:22513 | AGCAGTGGCTGGTACTGGTTCGACCCC |
| | | | SEQ ID NO:6489 | SEQ ID NO:14501 | | |
| | | AA | NYDIN | WMHPNSGNTGYAQKFQG | SSGWYWFDP | |
| | | | SEQ ID NO:6490 | SEQ ID NO:14502 | SEQ ID NO:22514 | |
| iPS:435739 | 21-225_174G7 | NA | AGCTCTGCCATGAGC | GTTATTAGTGGTGGTAGTGGTGGTAGCACATTCTACACAGACTCCGTGAAGGGC | SEQ ID NO:22515 | TCGAATAGCAGTGGCTGGTTTGACTAC |
| | | | SEQ ID NO:6491 | SEQ ID NO:14503 | | |
| | | AA | SSAMS | VISGSGGSTFYTDSVKG | SNSSGWFDY | |
| | | | SEQ ID NO:6492 | SEQ ID NO:14504 | SEQ ID NO:22516 | |
| iPS:435741 | 21-225_174G10 | NA | GACTATGTCATGCAC | GTTATATGGTATGATGGAAGTAATAAATACTATGCAGACTCCGTGAAGGGC | SEQ ID NO:22517 | GAAAGGTATAGCAGTGGCTGGTACGACTACGGTATGGACGTC |
| | | | SEQ ID NO:6493 | SEQ ID NO:14505 | | |
| | | AA | DYVMH | VIWYDGSNKYYADSVKG | ERYSSGWYDYGMDV | |
| | | | SEQ ID NO:6494 | SEQ ID NO:14506 | SEQ ID NO:22518 | |

FIGURE 49
(Continued)

| | | | | | |
|---|---|---|---|---|---|
| iPS:435743 | 21-225_175G1 | NA | ACCTATGGCATGCAC | GTTATATGGTATGATGG AAGTAATAAATACTATG CAGACTCCGTGAAGGGC | GATCCCTTACGTGGATACAA TGACCCGGTTATGGACTAC |
| | | | SEQ ID NO:6495 | SEQ ID NO:14507 | SEQ ID NO:22519 |
| | | AA | TYGMH | VIWYDGSNKYYADSVKG | DPLRGYNDPVMDY |
| | | | SEQ ID NO:6496 | SEQ ID NO:14508 | SEQ ID NO:22520 |
| iPS:435745 | 21-225_175G3 | NA | GGCTACTTTATGCAC | TGGATCAAGCCTAAAAG TGGTGGCACAAACTGTG CACAGAGGTTTCAGGGC | GGGGGGACTACGGTGACTAC GTGGGGGTCTTTGACTAC |
| | | | SEQ ID NO:6497 | SEQ ID NO:14509 | SEQ ID NO:22521 |
| | | AA | GYFMH | WIKPKSGGTNCAQRFQG | GGTTVTTWGVFDY |
| | | | SEQ ID NO:6498 | SEQ ID NO:14510 | SEQ ID NO:22522 |
| iPS:435747 | 21-225_175C4 | NA | AGCTATGTCATGAGC | GCTATTAGTGGTGGTAGTGGT GATAGAACATATCGC AGACTCCGTGAAGGGC | ACAGCGGGCTTTGACTAC |
| | | | SEQ ID NO:6499 | SEQ ID NO:14511 | SEQ ID NO:22523 |
| | | AA | SYVMS | AISGSGDRTYYADSVKG | TAGFDY |
| | | | SEQ ID NO:6500 | SEQ ID NO:14512 | SEQ ID NO:22524 |
| iPS:435749 | 21-225_175C10 | NA | AGCTATGCCATGAGC | TCTATTAGTGGTCGTGGT GGTAGCACGTTCTACGC AGACTCCGTGAAGGGC | TCGAATAGCAGTGGCTGGTT TGACTAC |
| | | | SEQ ID NO:6501 | SEQ ID NO:14513 | SEQ ID NO:22525 |
| | | AA | SYAMS | SISGRGGSTFYADSVKG | SNSSGWFDY |
| | | | SEQ ID NO:6502 | SEQ ID NO:14514 | SEQ ID NO:22526 |
| iPS:435751 | | NA | AATTATGATCTCAAC | TGGATGCACCCTAACAG TGGTAACACAGGCTATG CACAGAAGTTCCAGGGC | AGCAGTGGCTGGTACTACTT TGACTAC |

FIGURE 49
(Continued)

| | | | | | |
|---|---|---|---|---|---|
| 21-225_175D10 | | AA | SEQ ID NO:6503<br>NYDLN | SEQ ID NO:14515<br>WMHPNSGNTGYAQKFQG | SEQ ID NO:22527<br>SSGWYYFDY |
| iPS:435753 | 21-225_175G10 | NA | SEQ ID NO:6504<br>AGCTATGCCATGAGC | SEQ ID NO:14516<br>ATTATTAGTGGTAGTGGT<br>GGTAACACATACTACGC<br>AGACTCCGTGAAGGGC | SEQ ID NO:22528<br>AGGGATACCTGGAACGGTTG<br>GGATGCTTTTGATATC |
| | | AA | SEQ ID NO:6505<br>SYAMS | SEQ ID NO:14517<br>IISGSGGNTYYADSVKG | SEQ ID NO:22529<br>RDTWNGWDAFDI |
| iPS:435755 | 21-225_176H4 | NA | SEQ ID NO:6506<br>AGCTATGGCATGCAC | SEQ ID NO:14518<br>ATTATATGGTATGATGG<br>AAGTTATAAATACTATG<br>CAGACTCCGTGAAGGGC | SEQ ID NO:22530<br>GATGCCCACGATTTTGGAG<br>TGGTTACTTTGCCTAC |
| iPS:435759 | 21-225_176E6 | AA | SEQ ID NO:6507<br>SYGMH | SEQ ID NO:14519<br>IIWYDGSYKYYADSVKG | SEQ ID NO:22531<br>DAHDFWSGYFAY |
| | | NA | SEQ ID NO:6508<br>GGCCATAGTATGAAC | SEQ ID NO:14520<br>TACATTAGCATTAGTGGT<br>AGTACCATAAAGTACGC<br>AGACTCTGTGAAGGGC | SEQ ID NO:22532<br>AGGGGGATTACTGTGGTTCG<br>GAATGAGGACGGTTGGACG<br>TC |
| | | AA | SEQ ID NO:6509<br>GHSMN | SEQ ID NO:14521<br>YISISGSTIKYADSVKG | SEQ ID NO:22533<br>RGITVRNEDGLDV |
| iPS:435761 | 21-225_176B11 | NA | SEQ ID NO:6510<br>ACCTATGGCATGCAC | SEQ ID NO:14522<br>ATTATATGGTATGATGG<br>AACTAATAAATACTATG<br>CAGACTCCGTGAAGGGC | SEQ ID NO:22534<br>GATCCCTTACGTGGATACAA<br>TGACCCGGTTTTGGACTAC |
| | | AA | SEQ ID NO:6511<br>TYGMH | SEQ ID NO:14523<br>IIWYDGTNKYYADSVKG | SEQ ID NO:22535<br>DPLRGYNDPVLDY |
| | | | SEQ ID NO:6512 | SEQ ID NO:14524 | SEQ ID NO:22536 |

FIGURE 49
(Continued)

| | | | | | |
|---|---|---|---|---|---|
| iPS:435763 | 21-225_176H12 | NA | GACTATGTCATGCAC | GTTATATGGTATGATGG AAGTAATAAATACTATG CCGACTCCGTGAAGGGC | GAAAAGTATAGCAGCAACTG GTACGACTACGGTATGGACG TC |
| | | | SEQ ID NO:6513 | SEQ ID NO:14525 | SEQ ID NO:22537 |
| | | AA | DYVMH | VIWYDGSNKYYADSVKG | EKYSSNWYDYGMDV |
| | | | SEQ ID NO:6514 | SEQ ID NO:14526 | SEQ ID NO:22538 |
| iPS:435765 | 21-225_177D3 | NA | AGCTATGTCATGAAC | GGTATGAGCGGTAGTGG TGGTAGAACATACTACG CAGACTCCGTGAAGGAC | GTGACTTTCTTTGACTAT |
| | | | SEQ ID NO:6515 | SEQ ID NO:14527 | SEQ ID NO:22539 |
| | | AA | SYVMN | GMSGSGGRTYYADSVKD | VTFFDY |
| | | | SEQ ID NO:6516 | SEQ ID NO:14528 | SEQ ID NO:22540 |
| iPS:435767 | 21-225_177B4 | NA | GATTATGTCATGCAC | GTTATATGGTATGATGG AAGTAATAAATACTATG CAGACTCCGTGAAGGGC | GAAAAGTATAGCAGCAGCTG GTACGACTACGGTTTGGACG TC |
| | | | SEQ ID NO:6517 | SEQ ID NO:14529 | SEQ ID NO:22541 |
| | | AA | DYVMH | VIWYDGSNKYYADSVKG | EKYSSSWYDYGLDV |
| | | | SEQ ID NO:6518 | SEQ ID NO:14530 | SEQ ID NO:22542 |
| iPS:435769 | 21-225_177B6 | NA | AGTTATGCCATGAGC | GTTATTAGTGGTAGTGGT AGTAACACATACTACGT AGACTCCGTGAAGGGC | GGTTACTATGATAGTAGTGG TTATTACTACCCTTTTGACTT C |
| | | | SEQ ID NO:6519 | SEQ ID NO:14531 | SEQ ID NO:22543 |
| | | AA | SYAMS | VISGSGSNTYYVDSVKG | GYYDSSGYYYPFDF |
| | | | SEQ ID NO:6520 | SEQ ID NO:14532 | SEQ ID NO:22544 |

FIGURE 49
(Continued)

| iPS:435771 | 21-225_177B11 | NA | AGCTATGGCATGCAC | ATTATATGGTATGATGG AAGTTATAAATACTATA CAGACTCCGTGAAGGGC | GAGACTTACGATTTTGGAG TGGTTATTTGTCTTC |
|---|---|---|---|---|---|
| | | | SEQ ID NO:6521 | SEQ ID NO:14533 | SEQ ID NO:22545 |
| | | AA | SYGMH | IIWYDGSYKYTDSVKG | ETYDFWSGYFVF |
| | | | SEQ ID NO:6522 | SEQ ID NO:14534 | SEQ ID NO:22546 |
| iPS:435773 | 21-225_177B12 | NA | AATTATGATATCAAC | TGGATGCACCTAACAG TGGTAACACAGGCTATG CACAGAAGTTCCAGGGC | AGCAGTGGCTGGTACTACTT TGACTTC |
| | | | SEQ ID NO:6523 | SEQ ID NO:14535 | SEQ ID NO:22547 |
| | | AA | NYDIN | WMHPNSGNTGYAQKFQG | SSGWYYFDF |
| | | | SEQ ID NO:6524 | SEQ ID NO:14536 | SEQ ID NO:22548 |
| iPS:435775 | 21-225_178A5 | NA | AGCTATGCCATGACC | GTTATTAGTGGTAGTGGT GGTAATACATTCTACGC AGACTCCGTGAAGGGC | CGGGACGGTGACTACTTTGA CTAC |
| | | | SEQ ID NO:6525 | SEQ ID NO:14537 | SEQ ID NO:22549 |
| | | AA | SYAMT | VISGSGGNTFYADSVKG | RDGDYFDY |
| | | | SEQ ID NO:6526 | SEQ ID NO:14538 | SEQ ID NO:22550 |
| iPS:435777 | 21-225_178F7 | NA | AGCTATGCCATGACC | GTTATTAGTGGTAGTGGT GGTAACACATTCTACGC AGACTCCGTGAAGGGC | CGGTACGGTGACTACTTTGA CTAC |
| | | | SEQ ID NO:6527 | SEQ ID NO:14539 | SEQ ID NO:22551 |
| | | AA | SYAMT | VISGSGGNTFYADSVKG | RYGDYFDY |
| | | | SEQ ID NO:6528 | SEQ ID NO:14540 | SEQ ID NO:22552 |
| iPS:435779 | 21-225_178B10 | NA | ACCTATGGCATGCAC | ATTATATGGTATGATGG AACTAATAAATACTATG CAGACTCCGTGAAGGGC | GATCCCTTACGTGGATACAA TGACCCGGTTATGGACTAC |
| | | | SEQ ID NO:6529 | SEQ ID NO:14541 | SEQ ID NO:22553 |

FIGURE 49
(Continued)

| | | | | | |
|---|---|---|---|---|---|
| iPS:435781 | 21-225_178G10 | AA | TYGMH<br>SEQ ID NO:6530 | IIWYDGTNKYYADSVKG<br>SEQ ID NO:14542 | DPLRGYNDPVMDY<br>SEQ ID NO:22554 |
| | | NA | ACCTATGGCCATGCAC<br>SEQ ID NO:6531 | GTTATATGGTATGATGG<br>AAGTAATAAATACTACG<br>CAGACTCCGTGAAGGGC<br>SEQ ID NO:14543 | GAACGGTACGATTTTGGAG<br>TGGTCATTTTGACTAC<br>SEQ ID NO:22555 |
| iPS:435783 | 21-225_179G1 | AA | TYGMH<br>SEQ ID NO:6532 | VIWYDGSNKYYADSVKG<br>SEQ ID NO:14544 | ERYDFWSGHFDY<br>SEQ ID NO:22556 |
| | | NA | AGCTATGCCATGACC<br>SEQ ID NO:6533 | GTTATTAGTGGTTTTGGT<br>GGTAACACATTCTACGC<br>AGACTCCGTGAAGGGC<br>SEQ ID NO:14545 | CGGTACGGGTGACTACTTTGA<br>CTAC<br>SEQ ID NO:22557 |
| iPS:435785 | 21-225_179C2 | AA | SYAMT<br>SEQ ID NO:6534 | VISGFGGNTFYADSVKG<br>SEQ ID NO:14546 | RYGDYFDY<br>SEQ ID NO:22558 |
| | | NA | AGCTATGGCATGCAC<br>SEQ ID NO:6535 | CTTATATTTATGATGGA<br>AGTAATAAATACTATGC<br>AGACTCCGTGAAGGGC<br>SEQ ID NO:14547 | CGGTATAGCGGCAGCTGGTC<br>CGGTGGTATGGACGTC<br>SEQ ID NO:22559 |
| iPS:435787 | 21-225_180A3 | AA | SYGMH<br>SEQ ID NO:6536 | LIFYDGSNKYYADSVKG<br>SEQ ID NO:14548 | RYSGSWSGGMDV<br>SEQ ID NO:22560 |
| | | NA | AGCTTTGCCATGAAC<br>SEQ ID NO:6537 | GTTATTAGCGGTCGCGGT<br>GGTAACACATTCTACGC<br>AGACTCCGTGAAGGGC<br>SEQ ID NO:14549 | CGGACTGGGGATGATGTTTT<br>TGATGTC<br>SEQ ID NO:22561 |
| | | AA | SFAMN<br>SEQ ID NO:6538 | VISGRGGNTFYADSVKG<br>SEQ ID NO:14550 | RTGDDVFDV<br>SEQ ID NO:22562 |

FIGURE 49
(Continued)

| | | | | | | |
|---|---|---|---|---|---|---|
| iPS:435789 | 21-225_180C4 | NA | GCCTATGGCATGCAC | | ATTATTGGTATGATGAAGTTATAAATACTATGCAGACTCCGTGAAGGGC | ACCGGTGTGATCCCTGGGACTACTACAACGGAATGGACGTC |
| | | | SEQ ID NO:6539 | | SEQ ID NO:14551 | SEQ ID NO:22563 |
| | | AA | AYGMH | | IIWYDGSYKYYADSVKG | TGVDPWDYYNGMDV |
| | | | SEQ ID NO:6540 | | SEQ ID NO:14552 | SEQ ID NO:22564 |
| iPS:435791 | 21-225_180H7 | NA | GACTATGGCATGCAC | | GTTATATGGTATGATGAAATAATAAACACTATGCAGACTCCGCGAAGGGC | GAGGTTGGCTGGTCCGATGACTAC |
| | | | SEQ ID NO:6541 | | SEQ ID NO:14553 | SEQ ID NO:22565 |
| | | AA | DYGMH | | VIWYDENNKHYADSAKG | EVGWSDDY |
| | | | SEQ ID NO:6542 | | SEQ ID NO:14554 | SEQ ID NO:22566 |
| iPS:435793 | 21-225_180F8 | NA | AGCTATGGCATGCAC | | GTTATATGGTATGATGAAGTGATAAATACTATGAAGACTCCGTGAAGGGC | GATCATCCCGGTGGAGCTACGGAGACTAC |
| | | | SEQ ID NO:6543 | | SEQ ID NO:14555 | SEQ ID NO:22567 |
| | | AA | SYGMH | | VIWYDGSDKYYEDSVKG | DHPRWSYGDY |
| | | | SEQ ID NO:6544 | | SEQ ID NO:14556 | SEQ ID NO:22568 |
| iPS:435795 | 21-225_181C2 | NA | AGCTATGGCATGCAC | | ATTATTGGTATGATGAAGTTATAAATACTATGCAGACTCCGTGAAGGGC | GATCATTACGATTTTTGGAGTGGGCACTTTGACTTC |
| | | | SEQ ID NO:6545 | | SEQ ID NO:14557 | SEQ ID NO:22569 |
| | | AA | SYGMH | | IIWYDGSYKYYADSVKG | DHYDFWSGHFDF |
| | | | SEQ ID NO:6546 | | SEQ ID NO:14558 | SEQ ID NO:22570 |

FIGURE 49
(Continued)

| | | | | | |
|---|---|---|---|---|---|
| iPS:435797 | 21-225_181G2 | NA | AGCTACAATATGCAC | TGGATCAACCCTAACAATGGTGGCTCAAACTATACACAGAAGTTTCAGGGC | AAGTTTGGGGAC |
| | | | SEQ ID NO:6547 | SEQ ID NO:14559 | |
| | | AA | SYNMH | WINPNNGGSNYTQKFQG | KFGD |
| | | | SEQ ID NO:6548 | SEQ ID NO:14560 | SEQ ID NO:22571 |
| iPS:435799 | 21-225_181G3 | NA | AGCTATGCCATGAGT | GTTATTAGTGGTAGTGGTGGTAACACATTCTACGGAGACTCCGTGAAGGGC | CGGGAGACCTACGACTGGGGATCCGATGCTTTTGATATC |
| | | | SEQ ID NO:6549 | SEQ ID NO:14561 | SEQ ID NO:22572 |
| | | AA | SYAMS | VISGSGGNTFYGDSVKG | RETYDWGSDAFDI |
| | | | SEQ ID NO:6550 | SEQ ID NO:14562 | SEQ ID NO:22573 |
| iPS:435801 | 21-225_181E5 | NA | AATTATGATATCAAC | TGGATGAACCCTAACAGTGGTAACACAGGCTATGCACAGAAGTTCCAGGGC | AGTAGTGGCTGGTACATCTTTGACTAC |
| | | | SEQ ID NO:6551 | SEQ ID NO:14563 | SEQ ID NO:22574 |
| | | AA | NYDIN | WMNPNSGNTGYAQKFQG | SSGWYIFDY |
| | | | SEQ ID NO:6552 | SEQ ID NO:14564 | SEQ ID NO:22575 |
| iPS:435805 | 21-225_181A8 | NA | GACTATGGCATGCAC | GTTATATGGTATGATGAAATAATAAACACTATGCAGACTCCGCGAAGGGC | GAGGTTGGCTGGTCCGATGACTAC |
| | | | SEQ ID NO:6553 | SEQ ID NO:14565 | SEQ ID NO:22576 |
| | | AA | DYGMH | VIWYDENNKHYADSAKG | EVGWSDDY |
| | | | SEQ ID NO:6554 | SEQ ID NO:14566 | SEQ ID NO:22577 |

FIGURE 49
(Continued)

| iPS:435807 | 21-225_181C10 | NA | AGCTATGGCATGCAC | ATTATATGGTATGATGG AAGTATAAATACTATG CAGACTCCGTGAAGGGC | GATCATTACGATTTTGGAG TGGGCACTTTGACTAC |
| --- | --- | --- | --- | --- | --- |
| | | | SEQ ID NO:6555 | SEQ ID NO:14567 | SEQ ID NO:22579 |
| | | AA | SYGMH | IIWYDGSYKYYADSVKG | DHYDFWSGHFDY |
| | | | SEQ ID NO:6556 | SEQ ID NO:14568 | SEQ ID NO:22580 |
| iPS:435809 | 21-225_182H5 | NA | AGCTATGGCATGAGT | GTTATTAGTGGTAGAGG TGGTACCACATTCTACGC AGACTCCGTGAAGGGC | CGGACTGGGGATGATGTTTT TGATATC |
| | | | SEQ ID NO:6557 | SEQ ID NO:14569 | SEQ ID NO:22581 |
| | | AA | SYAMS | VISGRGTTFYADSVKG | RTGDDVFDI |
| | | | SEQ ID NO:6558 | SEQ ID NO:14570 | SEQ ID NO:22582 |
| iPS:435811 | 21-225_183H6 | NA | AGCTATGGCATGCAC | ATTATATCATCTGCTGGA AGTACTAAATTCTATGCA GACTCCGTGAAGGGC | AGGCCCCGCAGTGGCTGGT AGAGGGCTACGGTATGGACG TC |
| | | | SEQ ID NO:6559 | SEQ ID NO:14571 | SEQ ID NO:22583 |
| | | AA | SYGMH | IISYAGSTKFYADSVKG | RPPQWLVEGYGMDV |
| | | | SEQ ID NO:6560 | SEQ ID NO:14572 | SEQ ID NO:22584 |
| iPS:435813 | 21-225_183A12 | NA | AGCTATGGCATGCAC | GTTATATCATCTGCTGGA AGTAATAAATACTATGC AGACTCCGTGAAGGGC | AGGTATAGCAGTGGCTGGGA CTGGTTCGACCCC |
| | | | SEQ ID NO:6561 | SEQ ID NO:14573 | SEQ ID NO:22585 |
| | | AA | SYGMH | VISSAGSNKYYADSVKG | RYSSGWDWFDP |
| | | | SEQ ID NO:6562 | SEQ ID NO:14574 | SEQ ID NO:22586 |
| iPS:435815 | 21-225_190G10 | NA | GACTATAGCATGAAC | TCTATTAGTAGTGGTAGT GGTTACATACACTACGC AGACTCAGTGAAGGGC | GCAACTATGGCCCTTGACTA C |
| | | | SEQ ID NO:6563 | SEQ ID NO:14575 | SEQ ID NO:22587 |
| | | AA | DYSMN | SISSGSGYIHYADSVKG | ATMALDY |

FIGURE 49
(Continued)

| | | | | | | | |
|---|---|---|---|---|---|---|---|
| iPS:435817 | 21-225_190B11 | NA | SEQ ID NO:6564 | AATTACTACTGGAGC | SEQ ID NO:14576 | CGTATCTATACCAGTGG GAGCACCAACTACAACC CCTCCCTCAAGAGT | SEQ ID NO:22588 | GATCGGGGATACTATGGCTA CTACGGTATGGACGTC |
| | | AA | SEQ ID NO:6565 | NYYWS | SEQ ID NO:14577 | RIYTSGSTNYNPSLKS | SEQ ID NO:22589 | DRGYYGYYGMDV |
| iPS:435819 | 21-225_190C11 | NA | SEQ ID NO:6566 | AGCTATGGCATGCAC | SEQ ID NO:14578 | GTTATATGGTATGATGG AAGTAATAAAAACTATG CAGACTCCGTGAAGGGC | SEQ ID NO:22590 | GATCAGGGCGTGGGCTACGA CGGTTTGGACGTC |
| | | AA | SEQ ID NO:6567 | SYGMH | SEQ ID NO:14579 | VIWYDGSNKNYADSVKG | SEQ ID NO:22591 | DQGVGYDGLDV |
| iPS:435821 | 21-225_190E11 | NA | SEQ ID NO:6568 | AACTATGGCATGCAC | SEQ ID NO:14580 | ATTATATGGTTTGATGGA AGTAATAAATACTATGC AGACTCCGTGAAGGGC | SEQ ID NO:22592 | GCCCAGGGGGTCTACTACTA CGTTATGGACGTC |
| | | AA | SEQ ID NO:6569 | NYGMH | SEQ ID NO:14581 | IIWFDGSNKYYADSVKG | SEQ ID NO:22593 | AQGVYYVMDV |
| iPS:435823 | 21-225_190F11 | NA | SEQ ID NO:6570 | AGCTATGCCATGAAC | SEQ ID NO:14582 | ACTATTAGTGGTACTGGT CGTAGGACATACTACGC AGACTCCGTGAAGGGC | SEQ ID NO:22594 | GAGGAGGATTACTATGATAG TAGTGGCCCGGGGTTCGACC CC |
| | | AA | SEQ ID NO:6571 | SYAMN | SEQ ID NO:14583 | TISGTGRRTYYADSVKG | SEQ ID NO:22595 | EEDYYDSSGPGFDP |
| | | | SEQ ID NO:6572 | | SEQ ID NO:14584 | | SEQ ID NO:22596 | |

FIGURE 49
(Continued)

| | | | | | |
|---|---|---|---|---|---|
| iPS:435825 | 21-225_190G11 | NA | ATTTATGGCATGCAC | GTTATATGGTATGATGGAAGTAATAAAACTATGCAGACTCCGTGAAGGGC | GATCAGGGCGTGGGCTACGACGGTTTGGACGTC |
| | | | SEQ ID NO:6573 | SEQ ID NO:14585 | SEQ ID NO:22597 |
| | | AA | IYGMH | VIWYDGSNKNYADSVKG | DQGVGYDGLDV |
| | | | SEQ ID NO:6574 | SEQ ID NO:14586 | SEQ ID NO:22598 |
| iPS:435827 | 21-225_190H11 | NA | AGCTACCACTGGAGC | CTTATCTATACCAGTAGGAGCACCATTTACAACCCCTCCCTCAAGAGT | CTCCGGTATAACTGGAACTTCCCTTACTTTGACTAC |
| | | | SEQ ID NO:6575 | SEQ ID NO:14587 | SEQ ID NO:22599 |
| | | AA | SYHWS | LIYTSRSTIYNPSLKS | LRYNWNFPYFDY |
| | | | SEQ ID NO:6576 | SEQ ID NO:14588 | SEQ ID NO:22600 |
| iPS:435829 | 21-225_190B12 | NA | AGTGGTGGTTACTACTGAAC | TATATCTATTACAGTGGGAGCACTACTACAACCCGTCCCTCAAGAGT | TCCGGGTATAATTGGGACGCCGGGGTCGACCCC |
| | | | SEQ ID NO:6577 | SEQ ID NO:14589 | SEQ ID NO:22601 |
| | | AA | SGGYYWN | YIYYSGSTYYNPSLKS | SGYNWDAGVDP |
| | | | SEQ ID NO:6578 | SEQ ID NO:14590 | SEQ ID NO:22602 |
| iPS:435831 | 21-225_190C12 | NA | AGCTATGGCATGCAC | GTTATATCATATGATGAGGTTATAAAAACTATGTAGACTCCGTGAAGGGC | GGTACCCACGGGTACTACTACGGTGTGGACGTC |
| | | | SEQ ID NO:6579 | SEQ ID NO:14591 | SEQ ID NO:22603 |
| | | AA | SYGMH | VISYDGGYKNYVDSVKG | GTHGYYYGVDV |
| | | | SEQ ID NO:6580 | SEQ ID NO:14592 | SEQ ID NO:22604 |
| iPS:435833 | 21-225_190D12 | NA | AGCTATGCCATGAGC | GCTATTATTGGTAATGGTGGTAGGACATACTACGCAGACTCCGTGAAGGGC | GATATGGTAGATACAGCTATGGTTCTTTGACTAC |
| | | | SEQ ID NO:6581 | SEQ ID NO:14593 | SEQ ID NO:22605 |

FIGURE 49
(Continued)

| | | | AA | SYAMS | AHGNGGRTYYADSVKG | DMGRYSYGFFDY |
|---|---|---|---|---|---|---|
| iPS:435835 | | | | SEQ ID NO:6582 | SEQ ID NO:14594 | SEQ ID NO:22606 |
| | 21-225_190F12 | | NA | AACTATGGCATGCAC | GTTATATGGTTTGATGGA AGTAATGACTACTATGC AGACTCCGTGAAGGGC | GATAGAAGCGTCGGCTACGA CGGTTTAGATGTC |
| | | | | SEQ ID NO:6583 | SEQ ID NO:14595 | SEQ ID NO:22607 |
| | | | AA | NYGMH | VIWFDGSNDYYADSVKG | DRSVGYDGLDV |
| iPS:435837 | | | | SEQ ID NO:6584 | SEQ ID NO:14596 | SEQ ID NO:22608 |
| | 21-225_198G3 | | NA | ACCTATGGCATGCAC | GTTATATGGTATGATGG AACTAATAAAACTATG CAGACTCCGTGAAGGGC | GATCAGGGCGTGGGCTACGA CGGTTTGGACGTC |
| | | | | SEQ ID NO:6585 | SEQ ID NO:14597 | SEQ ID NO:22609 |
| | | | AA | TYGMH | VIWYDGTNKNYADSVKG | DQGVGYDGLDV |
| iPS:435839 | | | | SEQ ID NO:6586 | SEQ ID NO:14598 | SEQ ID NO:22610 |
| | 21-225_191B1 | | NA | AGTTATCACTGGAGC | CATATCTATACCAGTGG GAGCACCAAGTACAACC CCTCCCTCAAGAGT | CTCCGGTATAACTGGAACTT CCCTTCTTTGACTAT |
| | | | | SEQ ID NO:6587 | SEQ ID NO:14599 | SEQ ID NO:22611 |
| | | | AA | SYHWS | HIYTSGSTKYNPSLKS | LRYNWNPFFDY |
| iPS:435841 | | | | SEQ ID NO:6588 | SEQ ID NO:14600 | SEQ ID NO:22612 |
| | 21-225_191D8 | | NA | AATTATGATATCAAC | TGGATGCACCCTAACAG TGGTAACACAGGCTATG CACAGAAGTTCCAGGGC | AGCAGTGGCTGGTACTACTT TGACTAC |
| | | | | SEQ ID NO:6589 | SEQ ID NO:14601 | SEQ ID NO:22613 |
| | | | AA | NYDIN | WMHPNSGNTGYAQKFQG | SSGWYYFDY |
| | | | | SEQ ID NO:6590 | SEQ ID NO:14602 | SEQ ID NO:22614 |

FIGURE 49
(Continued)

| | | | | | |
|---|---|---|---|---|---|
| iPS:435843 | 21-225_191F1 | NA | AGTGGTGGTTACTACTGGAAC<br>SEQ ID NO:6591 | TACATCTTTTACAGTGGG<br>AGCACCTACTACAACCC<br>GTCCCTCAAGAGT<br>SEQ ID NO:14603 | GGGGATTACGATGGTTCGGG<br>GAGTTATCACTACTATTACG<br>GTATGACGTC<br>SEQ ID NO:22615 |
| | | AA | SGGYYWN<br>SEQ ID NO:6592 | YIFYSGSTYYNPSLKS<br>SEQ ID NO:14604 | GDYDGSGSYHYYYGMDV<br>SEQ ID NO:22616 |
| iPS:435845 | 21-225_191G1 | NA | AGCTATGGCATGCAC<br>SEQ ID NO:6593 | GTTATATGGTATGATGG<br>AAGTAATGAACACTATG<br>CAGACTCCGTGAAGGGC<br>SEQ ID NO:14605 | GATAGGGGGGTGGGTTACTA<br>CGGTTTGGACGTC<br>SEQ ID NO:22617 |
| | | AA | SYGMH<br>SEQ ID NO:6594 | VIWYDGSNEHYADSVKG<br>SEQ ID NO:14606 | DRGVGYYGLDV<br>SEQ ID NO:22618 |
| iPS:435847 | 21-225_191A3 | NA | AGTGGTGATTACTACTGGAAC<br>SEQ ID NO:6595 | TACATCTTTTACAGTGGG<br>AGCACCTACTACAACCC<br>GTCCCTCAAGAGT<br>SEQ ID NO:14607 | GGGGATTACGATGGTTCGGG<br>GAGTTATCACTACTACTACG<br>GTATGACGTC<br>SEQ ID NO:22619 |
| | | AA | SGDYYWN<br>SEQ ID NO:6596 | YIFYSGSTYYNPSLKS<br>SEQ ID NO:14608 | GDYDGSGSYHYYYGMDV<br>SEQ ID NO:22620 |
| iPS:435849 | 21-225_191C3 | NA | AGTGGTGATTACTACTGGAAC<br>SEQ ID NO:6597 | TACATCTTTTACAGTGGG<br>AGCACCTACTACAACCC<br>GTCCCTCAAGAGT<br>SEQ ID NO:14609 | GGGGATTACGATGGTTCGGG<br>GAGTTATCACTTCTACTACG<br>GTATGACGTC<br>SEQ ID NO:22621 |
| | | AA | SGDYYWN<br>SEQ ID NO:6598 | YIFYSGSTYYNPSLKS<br>SEQ ID NO:14610 | GDYDGSGSYHFYYGMDV<br>SEQ ID NO:22622 |
| iPS:435851 | 21-225_191D3 | NA | AGTGGTGATTACTACTGGAAC<br>SEQ ID NO:6599 | TACATCTTTTACAGTGGG<br>AGCACCTACTACAACCC<br>GTCCCTCAAGAGT<br>SEQ ID NO:14611 | GGGGATTACGATGGTTCGGG<br>GAGTTATCACTACTATTACG<br>GTATGACGTC<br>SEQ ID NO:22623 |

FIGURE 49
(Continued)

| | | AA | SGDYYWN | YIFYSGSTYYNPSLKS | GDYDGSGSYHYYGMDV |
|---|---|---|---|---|---|
| iPS:435853 | | | SEQ ID NO:6600 | SEQ ID NO:14612 | SEQ ID NO:22624 |
| | 21-225_191E3 | NA | AGCTACCACTGGAGC | CTTATCTATACCAGTAGG AGCACCAATTACAACCC CTCCCTCAAGAGT | CTCCGGTATAACTGGAACTT CCCTTACTTTGACTAC |
| | | | SEQ ID NO:6601 | SEQ ID NO:14613 | SEQ ID NO:22625 |
| | | AA | SYHWS | LIYTSRSTNYNPSLKS | LRYNWNFPYFDY |
| iPS:435855 | | | SEQ ID NO:6602 | SEQ ID NO:14614 | SEQ ID NO:22626 |
| | 21-225_191G3 | NA | AATTATGATATCAAC | CGGATGAACCCTAACAG TGGTAACACAGGCTATG CACAGAAGTTCCAGGGC | AGCAGTGGCTGGTACATCTT TGACTAC |
| | | | SEQ ID NO:6603 | SEQ ID NO:14615 | SEQ ID NO:22627 |
| | | AA | NYDIN | RMNPNSGNTGYAQKFQG | SSGWYIFDY |
| iPS:435857 | | | SEQ ID NO:6604 | SEQ ID NO:14616 | SEQ ID NO:22628 |
| | 21-225_191A4 | NA | AGCTATGGCATGCAC | GTTATATCATATGATGGA GGTTATAAAAACTATGC AGACTCCGTGAAGGGC | GGTACCCACGGGTACTACTA CGGTGTGGACGTC |
| | | | SEQ ID NO:6605 | SEQ ID NO:14617 | SEQ ID NO:22629 |
| | | AA | SYGMH | VISYDGGYKNYADSVKG | GTHGYYYGVDV |
| iPS:435859 | | | SEQ ID NO:6606 | SEQ ID NO:14618 | SEQ ID NO:22630 |
| | 21-225_190E6 | NA | AGCTATGGCATGCAC | GTTATATGGTATGATGG AAGTAATAAAAACTATG CAGACTCCGTGAAGGGC | GATCAGGGCGTGGGCTACGA CGGTTTGGACGTC |
| | | | SEQ ID NO:6607 | SEQ ID NO:14619 | SEQ ID NO:22631 |
| | | AA | SYGMH | VIWYDGSNKNYADSVKG | DQGVGYDGLDV |
| | | | SEQ ID NO:6608 | SEQ ID NO:14620 | SEQ ID NO:22632 |

FIGURE 49
(Continued)

| iPS: | | | | |
|---|---|---|---|---|
| iPS:435861 | 21-225_190A5 | NA | AGTTATGGCATGCAC | GTTATATGGTATGATGG AAGTAATAAAAACTATG CAGACTCCGTGAAGGGC | GATTTCTCTGTAGGGTACGA CGGTATGGACGTC |
| | | | SEQ ID NO:6609 | SEQ ID NO:14621 | SEQ ID NO:22633 |
| | | AA | SYGMH | VIWYDGSNKNYADSVKG | DFSVGYDGMDV |
| | | | SEQ ID NO:6610 | SEQ ID NO:14622 | SEQ ID NO:22634 |
| iPS:435863 | 21-225_191H4 | NA | AGTGGTGGTTACTACTGGAA C | TACATCTTTTACAGTGGG AGCACCTACTACAACCC GTCCCTCAGGAGT | TCCGGGTATAACTGGGACAA CGGGGTCGACCCC |
| | | | SEQ ID NO:6611 | SEQ ID NO:14623 | SEQ ID NO:22635 |
| | | AA | SGGYYWN | YIFYSGSTYYNPSLRS | SGYNWDNGVDP |
| | | | SEQ ID NO:6612 | SEQ ID NO:14624 | SEQ ID NO:22636 |
| iPS:435865 | 21-225_191A5 | NA | GACTATAGACATGAAC | TCCATTAGTAGTGGTAGT GGTTACATATATTATGCA C GACTCAGTGAAGGGC | GCTACTATGGCCCTTGACTA |
| | | | SEQ ID NO:6613 | SEQ ID NO:14625 | SEQ ID NO:22637 |
| | | AA | DYSMN | SISSGSGYIYYADSVKG | ATMALDY |
| | | | SEQ ID NO:6614 | SEQ ID NO:14626 | SEQ ID NO:22638 |
| iPS:435867 | 21-225_191E5 | NA | AGCTATGCCATGAAC | ACTATTAGTGGTACTGGT CGTAGGACATACTACGC AGACTCCGTGAAGGGC | GAGGAGGATTACTATGATAG TAGTGGCCCGGGGTTCGACC CC |
| | | | SEQ ID NO:6615 | SEQ ID NO:14627 | SEQ ID NO:22639 |
| | | AA | SYAMN | TISGTGRRTYYADSVKG | EEDYYDSSGPGFDP |
| | | | SEQ ID NO:6616 | SEQ ID NO:14628 | SEQ ID NO:22640 |
| iPS:435869 | 21_225_190B1 | NA | AGCTATGGCATGCAC | GTTATATGGTATGATGG AAGTAATAAACATTATG CAGACTCCGTGAAGGGC | GATAGAACAGTGGGATACTC CGGTATGGACGTC |

FIGURE 49
(Continued)

| | | | | | | |
|---|---|---|---|---|---|---|
| iPS:435871 | 21-225_190B1 | AA | SEQ ID NO:6617<br>SYGMH | SEQ ID NO:14629<br>VIWYDGSNKHYADSVKG | SEQ ID NO:22641<br>DRTVGYSGMDV |
| | | NA | SEQ ID NO:6618<br>AGCTACCACTGGAGC | SEQ ID NO:14630<br>CTTATCTATACCAGTAGG<br>AGCACCAATTACAACCC<br>CTCCCTCAAGAGT | SEQ ID NO:22642<br>CTCCGTATAACTGGAACTT<br>CCCTTACTTTGACTTC |
| iPS:435873 | 21-225_191E6 | AA | SEQ ID NO:6619<br>SYHWS | SEQ ID NO:14631<br>LIYTSRSTNYNPSLKS | SEQ ID NO:22643<br>LRYNWNFPYFDF |
| | | NA | SEQ ID NO:6620<br>AGCTATGGCATGCAC | SEQ ID NO:14632<br>GTTATATGGTATGATGG<br>AAGTAATAAAAACTACG<br>CAGACTCCGTGAAGGGC | SEQ ID NO:22644<br>GATCAGGGCGTGGGCTACGA<br>CGGTTTGACGTC |
| iPS:435875 | 21-225_190G4 | AA | SEQ ID NO:6621<br>SYGMH | SEQ ID NO:14633<br>VIWYDGSNKNYADSVKG | SEQ ID NO:22645<br>DQGVGYDGLDV |
| | | NA | SEQ ID NO:6622<br>ACCTATGCCATGAGT | SEQ ID NO:14634<br>GCTATTAGTCGTAGTGGT<br>GGTAACACACACTACGC<br>AGACTCCGTGAAGGGC | SEQ ID NO:22646<br>GATGGATTCGGTGGGAGCTC<br>CTACTTTGACTAC |
| iPS:435877 | 21-225_190B9 | AA | SEQ ID NO:6623<br>TYAMS | SEQ ID NO:14635<br>AISRSGGNTHYADSVKG | SEQ ID NO:22647<br>DGFGGSSYFDY |
| | | NA | SEQ ID NO:6624<br>AGCTACACAATATGCAC | SEQ ID NO:14636<br>TGGATCAACCCTAACAA<br>TGGTGGCTCAAACTATA<br>CACAGAAGTTTCAGGGC | SEQ ID NO:22648<br>AAGTTTGGGGAC |
| | 21-225_184E7 | AA | SEQ ID NO:6625<br>SYNMH | SEQ ID NO:14637<br>WINPNNGGSNYTQKFQG | SEQ ID NO:22649<br>KFGD |

FIGURE 49
(Continued)

| | | | | | | |
|---|---|---|---|---|---|---|
| iPS:435879 | 21-225_184H10 | NA | SEQ ID NO:6626<br>GACTATGGCATGCAC | SEQ ID NO:14638<br>GTTATTTGGTATGATGAA<br>ACTAATAAACACTATGG<br>AGACTCCGTGAAGGGC | SEQ ID NO:22650<br>GAGGTTGGCTGGCACGATGA<br>CTAT |
| | | AA | SEQ ID NO:6627<br>DYGMH | SEQ ID NO:14639<br>VIWYDETNKHYGDSVKG | SEQ ID NO:22651<br>EVGWHDDY |
| iPS:435881 | 21-225_184D11 | NA | SEQ ID NO:6628<br>GACTATGGCATGCAC | SEQ ID NO:14640<br>GTTATTTGGTATGATGAA<br>ACTAATAAACACTATGG<br>AGACTCCGTGAAGGGC | SEQ ID NO:22652<br>GAGGTTGGCTGGCACGATGA<br>CTAT |
| | | AA | SEQ ID NO:6629<br>DYGMH | SEQ ID NO:14641<br>VIWYDETNKHYGDSVKG | SEQ ID NO:22653<br>EVGWHDDY |
| iPS:435883 | 21-225_185A1 | NA | SEQ ID NO:6630<br>AGCTATAGCATGAAC | SEQ ID NO:14642<br>TCCATTAGCAGTAGTGGT<br>AGTTACATATATTACGCA<br>GACTCAGTGAAGGGC | SEQ ID NO:22654<br>AGCAACCTTTTTGACTGC |
| | | AA | SEQ ID NO:6631<br>SYSMN | SEQ ID NO:14643<br>SISSSGSYIYYADSVKG | SEQ ID NO:22655<br>SNLFDC |
| iPS:435885 | 21-225_185E10 | NA | SEQ ID NO:6632<br>AGCTACAATATGCAC | SEQ ID NO:14644<br>TGGATCAACCCTAACAA<br>TGGTGGCTCAAACTATA<br>CACAGAAGTTTCAGGGC | SEQ ID NO:22656<br>AAGTTTGGGGAC |
| | | AA | SEQ ID NO:6633<br>SYNMH | SEQ ID NO:14645<br>WINPNNGGSNYTQKFQG | SEQ ID NO:22657<br>KFGD |
| | | | SEQ ID NO:6634 | SEQ ID NO:14646 | SEQ ID NO:22658 |

FIGURE 49
(Continued)

| | | NA/AA | | | |
|---|---|---|---|---|---|
| iPS:435887 | 21-225_186F7 | NA | ACCTATGGCATGCAC | ATTATATGGTATGATGG AAGTTATAAATATTATGC AGACTCCGTGAAGGGC | GATCATTACGATTTTGGAG TGGGCACTTTGACTAC |
| | | | SEQ ID NO:6635 | SEQ ID NO:14647 | SEQ ID NO:22659 |
| | | AA | TYGMH | HWYDGSYKYYADSVKG | DHYDFWSGHFDY |
| | | | SEQ ID NO:6636 | SEQ ID NO:14648 | SEQ ID NO:22660 |
| iPS:435889 | 21-225_186A11 | NA | AGCTATGCCATGAGT | GTTATTAGTGGTAGAGG TGGTACCACATTCTACGC AGACTCCGTGAAGGGC | CGGACTGGGGATGATGTTT TGATATC |
| | | | SEQ ID NO:6637 | SEQ ID NO:14649 | SEQ ID NO:22661 |
| | | AA | SYAMS | VISGRGGTTFYADSVKG | RTGDDVFDI |
| | | | SEQ ID NO:6638 | SEQ ID NO:14650 | SEQ ID NO:22662 |
| iPS:435891 | 21-225_188H5 | NA | AGCTACAATATGCAC | TGGATCAACCCTAACAG TGGTGGCTCAAACTATA CACAGAAGTTTCAGGGC | AAGTTTGGGGAC |
| | | | SEQ ID NO:6639 | SEQ ID NO:14651 | SEQ ID NO:22663 |
| | | AA | SYNMH | WINPNSGGSNYTQKFQG | KFGD |
| | | | SEQ ID NO:6640 | SEQ ID NO:14652 | SEQ ID NO:22664 |
| iPS:435895 | 21-225_188E8 | NA | AGCTCTGCCATGAAC | GTTATTAGTGGTAGTGGT GGTTACACATACTACGC AGACTCCGTGAAGGGC | AGGAACACCGATGATGCTTT TGATATC |
| | | | SEQ ID NO:6641 | SEQ ID NO:14653 | SEQ ID NO:22665 |
| | | AA | SSAMN | VISGSGGYTYYADSVKG | RNTDDAFDI |
| | | | SEQ ID NO:6642 | SEQ ID NO:14654 | SEQ ID NO:22666 |
| iPS:435897 | 21-225_188B9 | NA | AGCTACAATATGCAC | TGGATCAACCCTAACAG TGGTGGCTCAAACTATA CACAGAAGTTTCAGGGC | AAGTTTGGGGAC |
| | | | SEQ ID NO:6643 | SEQ ID NO:14655 | SEQ ID NO:22667 |
| | | AA | SYNMH | WINPNSGGSNYTQKFQG | KFGD |
| | | | SEQ ID NO:6644 | SEQ ID NO:14656 | SEQ ID NO:22668 |

FIGURE 49
(Continued)

| | | | | | |
|---|---|---|---|---|---|
| iPS:435899 | 21-225_188G11 | NA | AGTTATGGCATGCAC | ATTATATGGTATGATGG AAGTTATAAATACTATG CAGACTCCGTGAAGGGC | GAGAGATACGATTTTGGAG TGGTCATTTTGACTAC |
| | | | SEQ ID NO:6645 | SEQ ID NO:14657 | SEQ ID NO:22669 |
| | | AA | SYGMH | IIWYDGSYKYYADSVKG | ERYDFWSGHFDY |
| | | | SEQ ID NO:6646 | SEQ ID NO:14658 | SEQ ID NO:22670 |
| iPS:435901 | 21-225_189G2 | NA | AACTATGGCATGCAC | ATTATATGGTATGATGG AAGTTATAAATACTATG CAGACTCCGTGAAGGGC | GATCGATTCGATTTTGGAG TGGTTATTCCGACTAC |
| | | | SEQ ID NO:6647 | SEQ ID NO:14659 | SEQ ID NO:22671 |
| | | AA | NYGMH | IIWYDGSYKYYADSVKG | DRFDFWSGYSDY |
| | | | SEQ ID NO:6648 | SEQ ID NO:14660 | SEQ ID NO:22672 |
| iPS:435903 | 21-225_190E2 | NA | GACTACTACATGAGC | TACATTAGTAGTAGTGGT ACTACCGTATTCTACGCA GACTCTGTGAAGGGC | GAATGGGTGGGAGCCGACTA C |
| | | | SEQ ID NO:6649 | SEQ ID NO:14661 | SEQ ID NO:22673 |
| | | AA | DYYMS | YISSSGTTVFYADSVKG | EWVGADY |
| | | | SEQ ID NO:6650 | SEQ ID NO:14662 | SEQ ID NO:22674 |
| iPS:435905 | 21-225_190A3 | NA | AGTGGTGGTTACTACTGGAA C | TTCATCTTTATAGTGGG AGCACCTACTACAACCC GTCCCTCAAGAGT | GGGGATTACGATGGTTCGGG GAGTTATCACTACTATTACG GTATGGACGTC |
| | | | SEQ ID NO:6651 | SEQ ID NO:14663 | SEQ ID NO:22675 |
| | | AA | SGGYYWN | FIFYSGSTYYNPSLKS | GDYDGSGYHYYGMDV |
| | | | SEQ ID NO:6652 | SEQ ID NO:14664 | SEQ ID NO:22676 |
| iPS:435907 | 21-225_190G3 | NA | AGCTATGGCATGCAC | GTTATATCATATGATGGA GGTTATAAAAACTATGT AGACTCCGTGAAGGGC | GGTACCCACGGGTACTACTA CGGTGTGGACGTC |
| | | | SEQ ID NO:6653 | SEQ ID NO:14665 | SEQ ID NO:22677 |
| | | AA | SYGMH | VISYDGGYKNYVDSVKG | GTHGYYYGVDV |
| | | | SEQ ID NO:6654 | SEQ ID NO:14666 | SEQ ID NO:22678 |

FIGURE 49
(Continued)

| | | | | |
|---|---|---|---|---|
| iPS:435909 | 21-225_190H3 | NA | AGCTATGCCATGAGC | GCTATTAGTGGTCGTGGT GGTAACACATACTACGC AGACTCCGTGAAGGGC |GATGGATTCGGTGGGAGCTC CTATTTTGACTAC |
| | | | SEQ ID NO:6655 | SEQ ID NO:14667 | SEQ ID NO:22679 |
| | | AA | SYAMS | AISGRGGNTYYADSVKG | DGFGGSSYFDY |
| | | | SEQ ID NO:6656 | SEQ ID NO:14668 | SEQ ID NO:22680 |
| iPS:435911 | 21-225_190B4 | NA | AGTGGTGATTACTACTGGAGC | TACATCTTTACAGTGGG AGCACCTACTACAACCC GTCCCTCAAGAGT | GGGGATTACGATGGTTCGGG GAGTTATCACTACTACTACG GTATGGACGTC |
| | | | SEQ ID NO:6657 | SEQ ID NO:14669 | SEQ ID NO:22681 |
| | | AA | SGDYYWN | YIFYSGSTYYNPSLKS | GDYDGSGSYHYYYGMDV |
| | | | SEQ ID NO:6658 | SEQ ID NO:14670 | SEQ ID NO:22682 |
| iPS:435913 | 21-225_190A7 | NA | AGTGGTGTGTTTACTACTGGAGC | AACATCTATTACAGTGG GAGCACCTACAACAACC CGTCCCTCAAGAGT | GGGGATTACGATGGTTCGGG GAGTTATCACTACTACTACG GTTTGGACGTC |
| | | | SEQ ID NO:6659 | SEQ ID NO:14671 | SEQ ID NO:22683 |
| | | AA | SGVYYWS | NIYYSGSTYNNPSLKS | GDYDGSGSYHYYYGLDV |
| | | | SEQ ID NO:6660 | SEQ ID NO:14672 | SEQ ID NO:22684 |
| iPS:435915 | 21-225_190H4 | NA | AATTATGATATCAAC | TGGATGAACCCTAACAG TGGTAACACAGGCTATG CACAGAAGTTCCAGGGC | AGCAGTGGCTGGTACATCTT TGACTAC |
| | | | SEQ ID NO:6661 | SEQ ID NO:14673 | SEQ ID NO:22685 |
| | | AA | NYDIN | WMNPNSGNTGYAQKFQG | SSGWYIFDY |
| | | | SEQ ID NO:6662 | SEQ ID NO:14674 | SEQ ID NO:22686 |
| iPS:435917 | 21-225_190D5 | NA | AATTACTACTGGAGC | CGTATCTATGCCAGTGG GAGCACCAACTACAACC CCTCCCTCAAGAGT | GATCGGGGATACTATGGCTA CTACGGTATGGACGTC |
| | | | SEQ ID NO:6663 | SEQ ID NO:14675 | SEQ ID NO:22687 |
| | | AA | NYYWS | RIYASGSTNYNPSLKS | DRGYYGYYGMDV |

FIGURE 49
(Continued)

| | | | | | | |
|---|---|---|---|---|---|---|
| iPS:435919 | 21-225_190H5 | NA | SEQ ID NO:6664 AGCTATGGCATGCAC | SEQ ID NO:14676 GTTATATCATATGATGGA GGTTATAAAAACTATGC AGACTCCGTGAAGGGC | SEQ ID NO:22688 GGTACCCACGGGTACTACTA CGGTGTGGACGTC | |
| | | AA | SEQ ID NO:6665 SYGMH | SEQ ID NO:14677 VISYDGGYKNYADSVKG | SEQ ID NO:22689 GTHGYYYGVDV | |
| iPS:435921 | 21-225_190D6 | NA | SEQ ID NO:6666 AGCTTTATCATGCAC | SEQ ID NO:14678 GTTATATGGTATGATGG AAGTAATAAATACTATG CAGACTCCGTGAAGGGC | SEQ ID NO:22690 GAGGAGTATAGCAGTGGCTG GTTCGGGTACGGTATGGACG TC | |
| | | AA | SEQ ID NO:6667 SFIMH | SEQ ID NO:14679 VIWYDGSNKYYADSVKG | SEQ ID NO:22691 EEYSSGWFGYGMDV | |
| iPS:435923 | 21-225_190H6 | NA | SEQ ID NO:6668 GACTACTACATGAGC | SEQ ID NO:14680 TACATTAGTAGTAGTGGT ACTACCGTATTCTACGCA GACTCTGTGAAGGGC | SEQ ID NO:22692 GAATGGGTGGGAGCCGACTA C | |
| | | AA | SEQ ID NO:6669 DYYMS | SEQ ID NO:14681 YISSSGTTVFYADSVKG | SEQ ID NO:22693 EWVGADY | |
| iPS:435925 | 21-225_190D7 | NA | SEQ ID NO:6670 AATTATGATATCAAC | SEQ ID NO:14682 TGGATGAACCCTAATAG TGGTAATACAGGCTATG CACAGAAGTTCCAGGGC | SEQ ID NO:22694 AGCAGTGGCTGGTACTTCTT TGACTAC | |
| | | AA | SEQ ID NO:6671 NYDIN | SEQ ID NO:14683 WMNPNSGNTGYAQKFQG | SEQ ID NO:22695 SSGWYFFDY | |
| | | | SEQ ID NO:6672 | SEQ ID NO:14684 | SEQ ID NO:22696 | |

FIGURE 49
(Continued)

| | | | | | |
|---|---|---|---|---|---|
| iPS:435927 | 21-225_190E7 | NA | AGTTACCACTGGAGT SEQ ID NO:6673 | CATATCTATACCAGTAG GAGCACCAACTACAACC CCTCCCTCAAGAGT SEQ ID NO:14685 | CTCCGTATAACTGGAACTT CCCTTACTTTGACTAC SEQ ID NO:22697 |
| | | AA | SYHWS SEQ ID NO:6674 | HIYTSRSTNYNPSLKS SEQ ID NO:14686 | LRYNWNFPYFDY SEQ ID NO:22698 |
| iPS:435929 | 21-225_190D9 | NA | AGCTATGCCATGAGT SEQ ID NO:6675 | ACTATTAGTGGTACTGGT CGTAGGACATACTACGC AGACTCCGTGAAGGGC SEQ ID NO:14687 | GAGGAGGATTACTATGATAG TAGTGGCCCGGGGTTCGACC CC SEQ ID NO:22699 |
| | | AA | SYAMS SEQ ID NO:6676 | TISGTGRRTYYADSVKG SEQ ID NO:14688 | EEDYYDSSGPGFDP SEQ ID NO:22700 |
| iPS:435933 | 21-225_190F8 | NA | ACTTATGGCATGCAC SEQ ID NO:6677 | GTTATATGGTATGATGG AAGTAATAAAAACTATG CAGACTCCGTGAAGGGC SEQ ID NO:14689 | GATCAGGGCGTGGGCTACGA CGGTTTGGACGTC SEQ ID NO:22701 |
| | | AA | TYGMH SEQ ID NO:6678 | VIWYDGSNKNYADSVKG SEQ ID NO:14690 | DQGVGYDGLDV SEQ ID NO:22702 |
| iPS:435935 | 21-225_190H8 | NA | AGCTATGCCATGAGC SEQ ID NO:6679 | ACTATTAGTGGTACTGGT CGTAGGACATATTACGC AGACTCCGTGAAGGGC SEQ ID NO:14691 | GAGGAGGATTACTATGATAG TAGTGCCCGGGGTTCGACC CC SEQ ID NO:22703 |
| | | AA | SYAMS SEQ ID NO:6680 | TISGTGRRTYYADSVKG SEQ ID NO:14692 | EEDYYDSSGPGFDP SEQ ID NO:22704 |
| iPS:435937 | 21-225_190H9 | NA | AACTATGGCATGCAC SEQ ID NO:6681 | GTTATATGGTTTGATGGA AGTAATGACTACTATGC AGACTCCGTGAAGGGC SEQ ID NO:14693 | GATAGAAGCGTCGGCTACGA CGGTTTAGATGTC SEQ ID NO:22705 |

FIGURE 49
(Continued)

| | | AA | NYGMH | VIWFDGSNDYYADSVKG | DRSVGYDGLDV |
|---|---|---|---|---|---|
| iPS:435939 | | | SEQ ID NO:6682 | SEQ ID NO:14694 | SEQ ID NO:22706 |
| | 21-225_191H7 | NA | AGTGGTGATTACTACTGGAAC | TACATCTTTACAGTGGGAGCACCTACTACACCCGTCCCTCAAGAGT | GGGGATTACGATGGTTCGGGGAGTTATCACTACTATTACGGTATGGACGTC |
| | | | SEQ ID NO:6683 | SEQ ID NO:14695 | SEQ ID NO:22707 |
| | | AA | SGDYYWN | YIFYSGSTYYNPSLKS | GDYDGSGSYHYYYGMDV |
| iPS:435941 | | | SEQ ID NO:6684 | SEQ ID NO:14696 | SEQ ID NO:22708 |
| | 21-225_191E8 | NA | AACTATGGCATGCAC | ATTATATGGTTTGATGGAAGTAATCAATACTATGCCGACTCCGTGAAGGGC | GCCCACGGGGTCTACTACTACGGCTATGGACGTC |
| | | | SEQ ID NO:6685 | SEQ ID NO:14697 | SEQ ID NO:22709 |
| | | AA | NYGMH | IIWFDGSNQYYADSVKG | AHGVYYYAMDV |
| iPS:435943 | | | SEQ ID NO:6686 | SEQ ID NO:14698 | SEQ ID NO:22710 |
| | 21-225_191C9 | NA | AGTGGTGGTTACTACTGGAAC | TATATCTATTACAGTGGGAGCACCTACTACACCCGTCCCTCAAGAGT | TCCGGGTATAATTGGGACGCCGGGGTCGACCCC |
| | | | SEQ ID NO:6687 | SEQ ID NO:14699 | SEQ ID NO:22711 |
| | | AA | SGGYYWN | YTYYSGSTYYNPSLKS | SGYNWDAGVDP |
| iPS:435945 | | | SEQ ID NO:6688 | SEQ ID NO:14700 | SEQ ID NO:22712 |
| | 21-225_191A10 | NA | AGCTATGGCATGCAC | GTTATATGGTATGATGGAAGTAATAAAAACTACGCAGACTCCGTGAAGGGC | GATCAGGGCGTGGGCTACGACGGTTTGGACGTC |
| | | | SEQ ID NO:6689 | SEQ ID NO:14701 | SEQ ID NO:22713 |
| | | AA | SYGMH | VIWYDGSNKNYADSVKG | DQGVGYDGLDV |
| | | | SEQ ID NO:6690 | SEQ ID NO:14702 | SEQ ID NO:22714 |

FIGURE 49
(Continued)

| iPS:435947 | 21-225_191E10 | NA | AGCTATGGCATGCAC | GTTATATGGTATGATGG AAGTAATAAAACTACG CAGACTCCGTGAAGGGC | GATCAGGGCGTGGGCTACGA CGGTTTGGACGTC |
|---|---|---|---|---|---|
| | | | SEQ ID NO:6691 | SEQ ID NO:14703 | SEQ ID NO:22715 |
| | | AA | SYGMH | VIWYDGSNKNYADSVKG | DQGVGYDGLDV |
| | | | SEQ ID NO:6692 | SEQ ID NO:14704 | SEQ ID NO:22716 |
| iPS:435953 | 21-225_191B12 | NA | GACTACTACATGAGC | TACATTAGTAGTAGTGGT ACTACCGTATTCTACGCA GACTCTGTGAAGGGC | GAATGGGTGGGAGCCGACTA C |
| | | | SEQ ID NO:6693 | SEQ ID NO:14705 | SEQ ID NO:22717 |
| | | AA | DYYMS | YISSSGTTVFYADSVKG | EWVGADY |
| | | | SEQ ID NO:6694 | SEQ ID NO:14706 | SEQ ID NO:22718 |
| iPS:435957 | 21-225_191G12 | NA | AGCTATGGCATGCAC | GTTATATGGTATGATGG AAGTAATAAAACTATG CAGACTCCGTGAAGGGC | GATCAGGGCGTGGGCTACGA CGGTTTGGACGTC |
| | | | SEQ ID NO:6695 | SEQ ID NO:14707 | SEQ ID NO:22719 |
| | | AA | SYGMH | VIWYDGSNKNYADSVKG | DQGVGYDGLDV |
| | | | SEQ ID NO:6696 | SEQ ID NO:14708 | SEQ ID NO:22720 |
| iPS:435961 | 21-225_192A2 | NA | AGCTATGGCATGCAC | GTTATATGGTATGATGG AAGTTATAAATACTATG CAGACTCCGTGAAGGGC | GAGGATTCCCCTTATAGTGG CTACGCCTTGGACTACTTCT ACGGTATGGACGTC |
| | | | SEQ ID NO:6697 | SEQ ID NO:14709 | SEQ ID NO:22721 |
| | | AA | SYGMH | VIWYDGSYKYYADSVKG | EDSPYSGYALDYFYGMDV |
| | | | SEQ ID NO:6698 | SEQ ID NO:14710 | SEQ ID NO:22722 |

FIGURE 49
(Continued)

| | | | | |
|---|---|---|---|---|
| iPS:435963 | 21-225_192D2 | NA | AGCTATGGCATGCAC | GTTATATGGTATGATGG AAGTAATAAAAACTATG CAGACTCCGTGAAGGGC | GATCGTGGGGTTGGCTACTA CGGTATGGACGTC |
| | | | SEQ ID NO:6699 | SEQ ID NO:14711 | SEQ ID NO:22723 |
| | | AA | SYGMH | VIWYDGSNKNYADSVKG | DRGVGYYGMDV |
| | | | SEQ ID NO:6700 | SEQ ID NO:14712 | SEQ ID NO:22724 |
| iPS:435965 | 21-225_192H2 | NA | AGCTCTGCCATGAGC | GCCATTAGTGGTAGTGG TGGTAACACATTCTACGC AGACTCCGTGAAGGGC | CTCATAGCAGTAGTTGGGTC CCACTACTTTGACTAC |
| | | | SEQ ID NO:6701 | SEQ ID NO:14713 | SEQ ID NO:22725 |
| | | AA | SSAMS | AISGSGGNTFYADSVKG | LIAVVGSHYFDY |
| | | | SEQ ID NO:6702 | SEQ ID NO:14714 | SEQ ID NO:22726 |
| iPS:435967 | 21-225_192B3 | NA | AGTGGTGATTACTGGAAC | TTCATCTTTTACAGTGGG AGCACTACTACAACCC GTCCCTCAAGAGT | GGGGATTACGATGGTTCGGG GAGTTATCACCACTACTACG GTATGGACGTC |
| | | | SEQ ID NO:6703 | SEQ ID NO:14715 | SEQ ID NO:22727 |
| | | AA | SGDYYWN | FIFYSGSTYYNPSLKS | GDYDGSGSYHHYYGMDV |
| | | | SEQ ID NO:6704 | SEQ ID NO:14716 | SEQ ID NO:22728 |
| iPS:435971 | 21-225_192D3 | NA | AGCTATGGCATGCAC | GTTATATGGTATGATGG AAGTAATGAACACTATG CAGACTCCGTGAAGGGC | GATAGGGGGGTGGGTTACTA CGGTTTGGACGTC |
| | | | SEQ ID NO:6705 | SEQ ID NO:14717 | SEQ ID NO:22729 |
| | | AA | SYGMH | VIWYDGSNEHYADSVKG | DRGVGYYGLDV |
| | | | SEQ ID NO:6706 | SEQ ID NO:14718 | SEQ ID NO:22730 |

FIGURE 49
(Continued)

| | | | | | |
|---|---|---|---|---|---|
| iPS:435973 | 21-225_192H3 | NA | AGTGTTAGTTACTACTGGAGC | AACCTCTATTACAGTGGGAGCACCTACTACAACCCGTCCCTCAGGAGT | GGGGATTACGATGGTTCGGGGAGTTATCACTACTACCACGGTATGACGTC |
| | | AA | SVSYYWS<br>SEQ ID NO:6707 | NLYYSGSTYYNPSLRS<br>SEQ ID NO:14719 | GDYDGSGSYHYYHGMDV<br>SEQ ID NO:22731 |
| | | | SEQ ID NO:6708 | SEQ ID NO:14720 | SEQ ID NO:22732 |
| iPS:435977 | 21-225_192E4 | NA | AGTTATGGCATGCAC | GTTATATGGTATGATGGAAGTAACAAAAACTATGTAGACTCCGTGAGGGGC | GATAGAAGCGTCGGCTACGACGGTATGGACGTC |
| | | AA | SYGMH<br>SEQ ID NO:6709 | VIWYDGSNKNYVDSVRG<br>SEQ ID NO:14721 | DRSVGYDGMDV<br>SEQ ID NO:22733 |
| | | | SEQ ID NO:6710 | SEQ ID NO:14722 | SEQ ID NO:22734 |
| iPS:435979 | 21-225_192H4 | NA | AGCTATGGCATGCAC | GTTATATGGTATGATGGAAAGCAATAAAAACTATGCAGACTCCGTGAAGGGC | GATCAAGGTGTGGGGTACTACGGTATGGACGTC |
| | | AA | SYGMH<br>SEQ ID NO:6711 | VIWYDGSNKNYADSVKG<br>SEQ ID NO:14723 | DQGVGYYGMDV<br>SEQ ID NO:22735 |
| | | | SEQ ID NO:6712 | SEQ ID NO:14724 | SEQ ID NO:22736 |
| iPS:435983 | 21-225_192E5 | NA | AATGGTGGATATACTACTGGAGC | TACATCTTTTACAGCGGGAGCACCTACTACAACCCGTCCCTCAAGAGT | GCGGGATATAACTGGGACAACGGGTTTGACTAC |
| | | AA | NGGYYWS<br>SEQ ID NO:6713 | YIFYSGSTYYNPSLKS<br>SEQ ID NO:14725 | AGYNWDNGFDY<br>SEQ ID NO:22737 |
| | | | SEQ ID NO:6714 | SEQ ID NO:14726 | SEQ ID NO:22738 |

FIGURE 49
(Continued)

| | | | | |
|---|---|---|---|---|
| iPS:435985 | 21-225_192F6 | NA | AGCTTTATCATGCAC SEQ ID NO:6715 | GTTATATGGTATGATGG AAGTAATAAATACTATG TAGACTCCGTGAAGGGC SEQ ID NO:14727 | GAGGAGTATAGTAGCGGCTG GTTCGGGTACGGTATGGACG TC SEQ ID NO:22739 |
| | | AA | SFIMH SEQ ID NO:6716 | VIWYDGSNKYYVDSVKG SEQ ID NO:14728 | EEYSSGWFGYGMDV SEQ ID NO:22740 |
| iPS:435987 | 21-225_192G6 | NA | AGCTATGGCATGCAC SEQ ID NO:6717 | GTTTTATGGTATGATGGA ACTAATAAAAACTATGC AGACTCCGTGAAGGGC SEQ ID NO:14729 | GATCAGGGCGTGGGCTACGA CGGTTTGGACGTC SEQ ID NO:22741 |
| | | AA | SYGMH SEQ ID NO:6718 | VLWYDGTNKNYADSVKG SEQ ID NO:14730 | DQGVGYDGLDV SEQ ID NO:22742 |
| iPS:435989 | 21-225_192F7 | NA | AGCTATGGCATGCAC SEQ ID NO:6719 | GTTATATCATATGATGGA GGTTATAAAACTATGC AGACTCCGTGAAGGGC SEQ ID NO:14731 | GGTACCCACGGGTACTACTA CGGTGTGGACGTC SEQ ID NO:22743 |
| | | AA | SYGMH SEQ ID NO:6720 | VISYDGGYKNYADSVKG SEQ ID NO:14732 | GTHGYYYGVDV SEQ ID NO:22744 |
| iPS:435993 | 21-225_192C8 | NA | AGCTATGGCATGCAC SEQ ID NO:6721 | GTTATATGGTATGATGG AAGTAATGAACACTATG CAGACTCCGTGAAGGGC SEQ ID NO:14733 | GATAGGGGAGTGGGTTACTA CGGTATGGACGTC SEQ ID NO:22745 |
| | | AA | SYGMH SEQ ID NO:6722 | VIWYDGSNEHYADSVKG SEQ ID NO:14734 | DRGVGYYGMDV SEQ ID NO:22746 |

FIGURE 49
(Continued)

| | | | | |
|---|---|---|---|---|
| iPS:435995 | 21-225_192F8 | NA | GGTTGCTACTGGAGC | GAAATCAATCAAAGTGG AAGGTCCAACTACAACC CGTCCCTCAAGAGT | GACTACGGTGTCTTTGACTA C |
| | | | SEQ ID NO:6723 | SEQ ID NO:14735 | SEQ ID NO:22747 |
| | | AA | GCYWS | EINQSGRSNYNPSLKS | DYGVFDY |
| | | | SEQ ID NO:6724 | SEQ ID NO:14736 | SEQ ID NO:22748 |
| iPS:435997 | 21-225_192G8 | NA | AGCTATGGCATGCAC | GTTATATGGTATGATGG AAGTAATAAAAACTATG CAGACTCCGTGAAGGGC | GATCAGGGCGTGGCTACGA CGGTTTGGACGTC |
| | | | SEQ ID NO:6725 | SEQ ID NO:14737 | SEQ ID NO:22749 |
| | | AA | SYGMH | VIWYDGSNKNYADSVKG | DQGVGYDGLDV |
| | | | SEQ ID NO:6726 | SEQ ID NO:14738 | SEQ ID NO:22750 |
| iPS:435999 | 21-225_192F9 | NA | AGCTACCACTGGAGC | CTTATCTATACCAGTAGG AGCACCAATTACAACCC CTCCCTCAAGAGT | CTCCGGTATAACTGGAACTT CCCTTACTTTGACTAC |
| | | | SEQ ID NO:6727 | SEQ ID NO:14739 | SEQ ID NO:22751 |
| | | AA | SYHWS | LIYTSRSTNYNPSLKS | LRYNWNFPYFDY |
| | | | SEQ ID NO:6728 | SEQ ID NO:14740 | SEQ ID NO:22752 |
| iPS:436001 | 21-225_192C10 | NA | AACTATGGCATGCAC | GTTATATGGTTTGATGGA AGTAATGACTACTATGC AGACTCCGTGAAGGGC | GATAGAAGCGTCGGCTACGA CGGTTTAGATGTC |
| | | | SEQ ID NO:6729 | SEQ ID NO:14741 | SEQ ID NO:22753 |
| | | AA | NYGMH | VIWFDGSNDYYADSVKG | DRSVGYDGLDV |
| | | | SEQ ID NO:6730 | SEQ ID NO:14742 | SEQ ID NO:22754 |
| iPS:436003 | 21-225_192G10 | NA | AGCTATGCCATGAGC | GCTATTAGTGGTAGAGG CGGTAGTACATTCTACGC AGACTCCGTGAAGGGC | CGTTTAGCACTGGATGGCTA TGATGCTTTGATATC |
| | | | SEQ ID NO:6731 | SEQ ID NO:14743 | SEQ ID NO:22755 |

FIGURE 49
(Continued)

| | | AA | SYAMS | AISGRGGSTFYADSVKG | RLALDGYDAFDI |
|---|---|---|---|---|---|
| | | | SEQ ID NO:6732 | SEQ ID NO:14744 | SEQ ID NO:22756 |
| iPS:436005 | 21-225_192H10 | NA | AGCTATGGCATGCAC | GTTATATGGTATGATGG AAGTAATAAAAACTACG CAGACTCCGTGAAGGGC | GATCAGGGCGTGGGCTACGA CGGTTTGGACGTC |
| | | | SEQ ID NO:6733 | SEQ ID NO:14745 | SEQ ID NO:22757 |
| | | AA | SYGMH | VIWYDGSNKNYADSVKG | DQGVGYDGLDV |
| | | | SEQ ID NO:6734 | SEQ ID NO:14746 | SEQ ID NO:22758 |
| iPS:436007 | 21-225_192G12 | NA | AGTGGTGTTTACCACTGGAG C | AACATCCATTACAGCGG GAGCACCTACAACAACC CGTCCCTCAAGAGT | GGGGATTACGATGGTTCGGG GAGTTATCACTACTACTACG GTATGGACGTC |
| | | | SEQ ID NO:6735 | SEQ ID NO:14747 | SEQ ID NO:22759 |
| | | AA | SGVYHWS | NIHYSGSTYNPSLKS | GDYDGSGSYHYYGMDV |
| | | | SEQ ID NO:6736 | SEQ ID NO:14748 | SEQ ID NO:22760 |
| iPS:436009 | 21-225_193A1 | NA | AGTGGTGTTTACTACTGGAG C | AACATCTATTACAGTGG GAGCACCTACAACAACC CGTCCCTCAAGAGT | GGGGATTACGATGGTTCGGG GAGTTATCACTACTACTACG GTATGGACGTC |
| | | | SEQ ID NO:6737 | SEQ ID NO:14749 | SEQ ID NO:22761 |
| | | AA | SGVYYWS | NIYYSGSTYNNPSLKS | GDYDGSGSYHYYGMDV |
| | | | SEQ ID NO:6738 | SEQ ID NO:14750 | SEQ ID NO:22762 |
| iPS:436011 | 21-225_193B1 | NA | AGTGGTGTTTACTACTGGAG C | AACATCTATTACAGTGG GAGCACCTACAACAACC CGTCCCTCAAGAGT | GGGGATTACGATGGTTCGGG GAGTTATCACTACTACTACG GTATGGACGTC |
| | | | SEQ ID NO:6739 | SEQ ID NO:14751 | SEQ ID NO:22763 |
| | | AA | SGVYYWS | NIYYSGSTYNNPSLKS | GDYDGSGSYHYYGMDV |
| | | | SEQ ID NO:6740 | SEQ ID NO:14752 | SEQ ID NO:22764 |

FIGURE 49
(Continued)

| | | | | |
|---|---|---|---|---|
| iPS:436013 | 21-225_193F2 | NA | ACCTTTGCCATGAGT | GCTATTAGTCGTAGTGGTGGTAACACACACTACGCAGACTCCGTGAAGGGC | GATGGATTCGGTGGGAGCTCCTACTTTGACTAC |
| | | | SEQ ID NO:6741 | SEQ ID NO:14753 | SEQ ID NO:22765 |
| | | AA | TFAMS | AISRSGGNTHYADSVKG | DGFGGSSYFDY |
| | | | SEQ ID NO:6742 | SEQ ID NO:14754 | SEQ ID NO:22766 |
| iPS:436015 | 21-225_193D3 | NA | AGTGGTGATTACTACTGGAAC | TACATCTTTTACAGTGGGAGCACCTACTACAACCCGTCCCTCAAGAGT | GGGGATTACGATGGTTCGGGGAGTTATCACTTCTACTACGGTATGGACGTC |
| | | | SEQ ID NO:6743 | SEQ ID NO:14755 | SEQ ID NO:22767 |
| | | AA | SGDYYWN | YIFYSGSTYYNPSLKS | GDYDGSGSYHFYYGMDV |
| | | | SEQ ID NO:6744 | SEQ ID NO:14756 | SEQ ID NO:22768 |
| iPS:436017 | 21-225_193F3 | NA | AGTGGTGATTACTACTGGAAC | TACATCTTTTACAGTGGGAGCACCTACTACAACCCGTCCCTCAAGAGT | GGGGATTACGATGGTTCGGGGAGTTATCACTACTATTACGGTATGGACGTC |
| | | | SEQ ID NO:6745 | SEQ ID NO:14757 | SEQ ID NO:22769 |
| | | AA | SGDYYWN | YIFYSGSTYYNPSLKS | GDYDGSGSYHYYGMDV |
| | | | SEQ ID NO:6746 | SEQ ID NO:14758 | SEQ ID NO:22770 |
| iPS:436019 | 21-225_193C4 | NA | AGCTATGCCATGAAC | GCTATTATTGGTAATGGTGGTAGAACATACTACGCAGACTCCGTGAAGGGC | GATCTGGGTAGATACAGCTATGGTTTCTTTGACTAC |
| | | | SEQ ID NO:6747 | SEQ ID NO:14759 | SEQ ID NO:22771 |
| | | AA | SYAMN | AIIGNGGRTYYADSVKG | DLGRYSYGFFDY |
| | | | SEQ ID NO:6748 | SEQ ID NO:14760 | SEQ ID NO:22772 |
| iPS:436021 | 21-225_193G4 | NA | AATTATGATATCAAC | TGGATGAACCCTAACAGTGGTAACACAGGCTATGCACAGAAGTTCCAGGGC | AGCAGTGGCTGGTACTTCTTTGACTAC |
| | | | SEQ ID NO:6749 | SEQ ID NO:14761 | SEQ ID NO:22773 |
| | | AA | NYDIN | WMNPNSGNTGYAQKFQG | SSGWYFFDY |

FIGURE 49
(Continued)

| | | | | | | |
|---|---|---|---|---|---|---|
| iPS:436023 | 21-225_193A5 | NA | SEQ ID NO:6750 AGTTATGATATCAAC | SEQ ID NO:14762 TGGATGAACCCTAAAAG GGGTAACACAGGCTATG CACAGAAGTTCCAGGGC | SEQ ID NO:22774 GGAGACCCGTATAACTGGAA CTCCTACGCTATGGACGTC | |
| | | AA | SEQ ID NO:6751 SYDIN | SEQ ID NO:14763 WMNPKRGNTGYAQKFQG | SEQ ID NO:22775 GDPYNWNSYAMDV | |
| iPS:436025 | 21-225_193B5 | NA | SEQ ID NO:6752 AGTGGTGGTTACTACTGAG C | SEQ ID NO:14764 TACATCTATTACAGTGGG AGCACCTACTACAACCC GTCCCTCAAGAGT | SEQ ID NO:22776 GGAGAGTATAACTGGAACCA CGGTATGGACGTC | |
| | | AA | SEQ ID NO:6753 SGGYYWS | SEQ ID NO:14765 YIYYSGSTYYNPSLKS | SEQ ID NO:22777 GEYNWNHGMDV | |
| iPS:436027 | 21-225_193E6 | NA | SEQ ID NO:6754 GGTCCCTACTGGAGT | SEQ ID NO:14766 GAATCAATCATAGTGG ACGACCAACTACAACC CGTCCCTCAAGAGT | SEQ ID NO:22778 GACTACGGTGGTTGGACTA C | |
| | | AA | SEQ ID NO:6755 GPYWS | SEQ ID NO:14767 ESNHSGRTNYNPSLKS | SEQ ID NO:22779 DYGGLDY | |
| iPS:436029 | 21-225_193H6 | NA | SEQ ID NO:6756 AGTGGTGATTACTACTGGAA C | SEQ ID NO:14768 TACATCTTTTACAGTGGG AGCACCTACTACAACCC GTCCCTCAAGAGT | SEQ ID NO:22780 GGGGATTACGATGGTTCGGG GAGTTATCACTACTATTACG GTATGGACGTC | |
| | | AA | SEQ ID NO:6757 SGDYYWN | SEQ ID NO:14769 YIFYSGSTYYNPSLKS | SEQ ID NO:22781 GDYDGSGSYHYYYGMDV | |
| | | | SEQ ID NO:6758 | SEQ ID NO:14770 | SEQ ID NO:22782 | |

FIGURE 49
(Continued)

| | | | | | |
|---|---|---|---|---|---|
| iPS:436031 | 21-225_193C7 | NA | AGCTATGGCATGCAC | GTTATATGGTATGATGG AAGTAATAAAACTACG CAGACTCCGTGAAGGGC | GATCAGGGCGTGGGCTACGA CGGCTTGGACGTC |
| | | | SEQ ID NO:6759 | SEQ ID NO:14771 | SEQ ID NO:22783 |
| | | AA | SYGMH | VIWYDGSNKNYADSVKG | DQGVGYDGLDV |
| | | | SEQ ID NO:6760 | SEQ ID NO:14772 | SEQ ID NO:22784 |
| iPS:436033 | 21-225_193E7 | NA | GGTTACTTCTGGACC | GAAATCAATCATAGTGG AAGCACCAACTACAACC CGTCCCTCAAGAGT | GACTACGGTGCTGACTAC |
| | | | SEQ ID NO:6761 | SEQ ID NO:14773 | SEQ ID NO:22785 |
| | | AA | GYFWT | EINHSGSTNYNPSLKS | DYGADY |
| | | | SEQ ID NO:6762 | SEQ ID NO:14774 | SEQ ID NO:22786 |
| iPS:436035 | 21-225_193C8 | NA | AGTGGTGATTACTGGAA C | TACATCTTTTACAGTGGG AGCACCTACTACAACCC GTCCCTCAAGAGT | GGGGATTACGATGGTTCGGG GAGTTATCACTACTACTACG GTATGGACGTC |
| | | | SEQ ID NO:6763 | SEQ ID NO:14775 | SEQ ID NO:22787 |
| | | AA | SGDYYWN | YIFYSGSTYYNPSLKS | GDYDGSGSYHYYYGMDV |
| | | | SEQ ID NO:6764 | SEQ ID NO:14776 | SEQ ID NO:22788 |
| iPS:436037 | 21-225_193D8 | NA | AGTGGTGGTTACTACTGGAA C | TTCATCTTTTACAGTGGG AGCACCTACTACAACCC GTCCCTCAAGAGT | GGGGATTACGATGGTTCGGG GAGTTATCACTACTATTACG GTATGGACGTC |
| | | | SEQ ID NO:6765 | SEQ ID NO:14777 | SEQ ID NO:22789 |
| | | AA | SGGYYWN | FIFYSGSTYYNPSLKS | GDYDGSGSYHYYYGMDV |
| | | | SEQ ID NO:6766 | SEQ ID NO:14778 | SEQ ID NO:22790 |
| iPS:436039 | 21-225_193F8 | NA | ATCTATGGCATGGAC | GTTATATGGTATGATGG AAGTTATAAATACTATG CAGACTCCGTGAAGGGC | GAGGATTCCCCTTATAGTGG CTACGGCTTGGACTACACT ACGGTATGGACGTC |
| | | | SEQ ID NO:6767 | SEQ ID NO:14779 | SEQ ID NO:22791 |

FIGURE 49
(Continued)

| | | AA | IYGMD | | VIWYDGSYKYYADSVKG | | EDSPYSGYGLDYYYGMDV | |
|---|---|---|---|---|---|---|---|---|
| iPS:436041 | 21-225_193G8 | | SEQ ID NO:6768 | | SEQ ID NO:14780 | | SEQ ID NO:22792 | |
| | | NA | AGTGGTGTTTACTACTGGAG C | | AACATCTATTACAGTGG GAGCACCTACACAACC CGTCCCTCAAGAGT | | GGGGATTACGATGGTTCGGG GAGTTATCACTTCTACTACG GTTTGGACGTC | |
| | | | SEQ ID NO:6769 | | SEQ ID NO:14781 | | SEQ ID NO:22793 | |
| | | AA | SGVYYWS | | NIYYSGSTYYNPSLKS | | GDYDGSGSYHFYYGLDV | |
| iPS:436043 | 21-225_193G9 | | SEQ ID NO:6770 | | SEQ ID NO:14782 | | SEQ ID NO:22794 | |
| | | NA | AATGGTGGATACTACTGGAG C | | TACATCTTTTACAGCGGG AGCACCTACTACAACCC GTCCCTCAAGAGT | | GCGGGATATAACTGGGACAA CGGGTTTGACTAC | |
| | | | SEQ ID NO:6771 | | SEQ ID NO:14783 | | SEQ ID NO:22795 | |
| | | AA | NGGYYWS | | YIFYSGSTYYNPSLKS | | AGYNWDNGFDY | |
| iPS:436045 | 21-225_193A10 | | SEQ ID NO:6772 | | SEQ ID NO:14784 | | SEQ ID NO:22796 | |
| | | NA | AGCTATGGCATGCAC | | GTTATATGGTATGATGG AAGTAATGAACACTATG CAGACTCCGTGAAGGGC | | GATAGGGGGGTGGGTTACTA CGGTTTGGACGTC | |
| | | | SEQ ID NO:6773 | | SEQ ID NO:14785 | | SEQ ID NO:22797 | |
| | | AA | SYGMH | | VIWYDGSNEHYADSVKG | | DRGVGYYGLDV | |
| iPS:436047 | 21-225_193B10 | | SEQ ID NO:6774 | | SEQ ID NO:14786 | | SEQ ID NO:22798 | |
| | | NA | GACTATAGCATGAAC | | TCCATTAGTAGTGCTGGT GGTTACATATACTACGC AGACTCACTGAAGGGC | | GCAACTATGGCCCTTGACTA C | |
| | | | SEQ ID NO:6775 | | SEQ ID NO:14787 | | SEQ ID NO:22799 | |
| | | AA | DYSMN | | SISSAGGYIYYADSLKG | | ATMALDY | |
| | | | SEQ ID NO:6776 | | SEQ ID NO:14788 | | SEQ ID NO:22800 | |

FIGURE 49
(Continued)

| | | | | | |
|---|---|---|---|---|---|
| iPS:436049 | 21-225_193B12 | NA | AGTGCTGATTACTACTGGAAC | TACATCTTTTACACAGTGGGAGCACCTACTACAACCCGTCCCTCAAGAGT | GGGGATTACGATGATGTTCGGGGAGTTATCACTTCTACTACGGTATGGACGTC |
| | | | SEQ ID NO:6777 | SEQ ID NO:14789 | SEQ ID NO:22801 |
| | | AA | SADYYWN | YIFYSGSTYNPSLKS | GDYDGSGSYHFYYGMDV |
| | | | SEQ ID NO:6778 | SEQ ID NO:14790 | SEQ ID NO:22802 |
| iPS:436051 | 21-225_193G12 | NA | AGCTATGCCATGCAC | GTTATATGGTATGATGGAACTAATAAATACTATGGAGACTCCGTGAAGGGC | GATTTCACTATAACTGGAGCTACATATTTTGACTAC |
| | | | SEQ ID NO:6779 | SEQ ID NO:14791 | SEQ ID NO:22803 |
| | | AA | SYAMH | VIWYDGTNKYYGDSVKG | DFTITGATYFDY |
| | | | SEQ ID NO:6780 | SEQ ID NO:14792 | SEQ ID NO:22804 |
| iPS:436054 | 21-225_194C1 | NA | AGCTATGGCATGCAC | GTTATATGGTATGATGGAAGTAATGAACACTATGCAGACTCCGTGAAGGGC | AATAGGGGGGTGGGTTACTACGGTTTGGACGTC |
| | | | SEQ ID NO:6781 | SEQ ID NO:14793 | SEQ ID NO:22805 |
| | | AA | SYGMH | VIWYDGSNEHYADSVKG | NRGVGYYGLDV |
| | | | SEQ ID NO:6782 | SEQ ID NO:14794 | SEQ ID NO:22806 |
| iPS:436056 | 21-225_194C3 | NA | AATTACTACTGGAGC | CGTATCTATGCCAGTGGGAGCACCAACTACAACCCCTCCCTCAAGAGT | GATCGGGGATACTATGGCTACTACGGTATGGACGTC |
| | | | SEQ ID NO:6783 | SEQ ID NO:14795 | SEQ ID NO:22807 |
| | | AA | NYYWS | RIYASGSTNYNPSLKS | DRGYYGYYGMDV |
| | | | SEQ ID NO:6784 | SEQ ID NO:14796 | SEQ ID NO:22808 |

FIGURE 49
(Continued)

| | | | | |
|---|---|---|---|---|
| iPS:436058 | 21-225_194A4 | NA | GTCTACTATTTGAAC | TGGATCAACCCTAACAGTGGTGGCACAAACTATGCACAGAAGTTTCAGGGC | GGCTACGATATTTGACTGGT |
| | | | SEQ ID NO:6785 | SEQ ID NO:14797 | SEQ ID NO:22809 |
| | | AA | VYYLN | WINPNSGGTNYAQKFQG | GYDILTG |
| | | | SEQ ID NO:6786 | SEQ ID NO:14798 | SEQ ID NO:22810 |
| iPS:436060 | 21-225_194F4 | NA | AGTTACCACTGGAGC | CTTATCTATACCAGTAGGAGCACCAACTACAACCCCTCCCTCAAGAGT | CTCCGGTATAACTGGAACTTCCCTTACTTTGACTAC |
| | | | SEQ ID NO:6787 | SEQ ID NO:14799 | SEQ ID NO:22811 |
| | | AA | SYHWS | LIYTSRSTNYNPSLKS | LRYNWNFPYFDY |
| | | | SEQ ID NO:6788 | SEQ ID NO:14800 | SEQ ID NO:22812 |
| iPS:436062 | 21-225_194E5 | NA | AGTGGTGATTACTGGAAC | TACATCTTTTACAGTGGGAGCACCTACTACAACCCGTCCCTCAAGAGT | GGGGATTACGATGGTTCGGGGAGTTATCACTACTATTACGGTATGGACGTC |
| | | | SEQ ID NO:6789 | SEQ ID NO:14801 | SEQ ID NO:22813 |
| | | AA | SGDYYWN | YIFYSGSTYYNPSLKS | GDYDGSGSYHYYYGMDV |
| | | | SEQ ID NO:6790 | SEQ ID NO:14802 | SEQ ID NO:22814 |
| iPS:436064 | 21-225_194E6 | NA | AGTGGTGATTACTGGAAC | TTCATCTTTTACAGTGGGAGCACCTACTACAACCCGTCCCTCAAGAGT | GGGGATTACGATGGTTCGGGGAGTTATCACTACTATTACGGTATGGACGTC |
| | | | SEQ ID NO:6791 | SEQ ID NO:14803 | SEQ ID NO:22815 |
| | | AA | SGDYYWN | FIFYSGSTYYNPSLKS | GDYDGSGSYHYYYGMDV |
| | | | SEQ ID NO:6792 | SEQ ID NO:14804 | SEQ ID NO:22816 |
| iPS:436066 | 21-225_194B7 | NA | AGCTATGGCATGCAC | GTTATATGGTATGATGGAAGTAATAAAAACTATGCAGACTCCGTGAAGGGC | GATCGGTCTAAGGGTTACGACGGTATGGACGTC |
| | | | SEQ ID NO:6793 | SEQ ID NO:14805 | SEQ ID NO:22817 |

FIGURE 49
(Continued)

| | | AA | SYGMH | | VIWYDGSNKNYADSVKG | DRSKGYDGMDV |
|---|---|---|---|---|---|---|
| iPS:436068 | | | | SEQ ID NO:6794 | SEQ ID NO:14806 | SEQ ID NO:22818 |
| | 21-225_194F7 | NA | GACTACTACATACAC | | TGGATCAACCTAACAA TGGTGGCACAAACTATG CACAGAAATTTCAGGGC | GAACCCTTGGTTACTATGG TTCGGGGAGTTATGGGGCCT ACGGTATGGACGTC |
| | | AA | DYYIH | SEQ ID NO:6795 | SEQ ID NO:14807 | SEQ ID NO:22819 |
| iPS:436072 | | | | | WINPNNGGTNYAQKFQG | EPLGYYGSGSYGAYGMDV |
| | | | | SEQ ID NO:6796 | SEQ ID NO:14808 | SEQ ID NO:22820 |
| | 21-225_194C10 | NA | TATTACTACTGGAGC | | GAAATCAATCATAGTGG AAGCACCAACTACAACC CGTCCCTCAAGAGT | GACTACGGTGCTTTTGATAT C |
| | | AA | YYYWS | SEQ ID NO:6797 | SEQ ID NO:14809 | SEQ ID NO:22821 |
| iPS:436074 | | | | | EINHSGSTNYNPSLKS | DYGAFDI |
| | | | | SEQ ID NO:6798 | SEQ ID NO:14810 | SEQ ID NO:22822 |
| | 21-225_194F10 | NA | AGCTTTATCATGCAC | | GTTATATGGTATGATGG AAGTAATAAATACTATG CAGACTCCGTGAAGGGC | GAGGAGTATAGCAGTGGCTG GTTCGGGTACGGTATGGACG TC |
| | | AA | SFIMH | SEQ ID NO:6799 | SEQ ID NO:14811 | SEQ ID NO:22823 |
| iPS:436076 | | | | | VIWYDGSNKYYADSVKG | EEYSSGWFGYGMDV |
| | | | | SEQ ID NO:6800 | SEQ ID NO:14812 | SEQ ID NO:22824 |
| | 21-225_194H11 | NA | AGCTATGGCATGCAC | | GTTATATGGTATGATGG AAGTAATGAACACTATG CAGACTCCGTGAAGGGC | GATAGGGGGGTGGGTTATTA CGGTTTTGGACGTC |
| | | | | SEQ ID NO:6801 | SEQ ID NO:14813 | SEQ ID NO:22825 |

FIGURE 49
(Continued)

| | | AA | SYGMH | | VIWYDGSNEHYADSVKG | | DRGVGYYGLDV | |
|---|---|---|---|---|---|---|---|---|
| iPS:436078 | | NA | SEQ ID NO:6802<br>AACTATGGCATGCAC | | SEQ ID NO:14814<br>GTTATATGGTTTGATGGA<br>AGTAATGACTACTATGC<br>AGACTCCGTGAAGGGC | | SEQ ID NO:22826<br>GATAGAAGCGTCGGCTACGA<br>CGGTTTAGATGTC | |
| | 21-225_194H12 | AA | SEQ ID NO:6803<br>NYGMH | | SEQ ID NO:14815<br>VIWFDGSNDYYADSVKG | | SEQ ID NO:22827<br>DRSVGYDGLDV | |
| iPS:436080 | | NA | SEQ ID NO:6804<br>TATTACTTCTGGAGC | | SEQ ID NO:14816<br>GAAATCAATCATAGTGG<br>ACGCACCAACTACAACC<br>CGTCCCTCAAGAGT | | SEQ ID NO:22828<br>GACTACGGTGCTTTTGATAT<br>C | |
| | 21-225_195B1 | AA | SEQ ID NO:6805<br>YYFWS | | SEQ ID NO:14817<br>EINHSGRTNYNPSLKS | | SEQ ID NO:22829<br>DYGAFDI | |
| iPS:436082 | | NA | SEQ ID NO:6806<br>CACTATGTCATGCAC | | SEQ ID NO:14818<br>GTTATTGGTATGATGGA<br>ACTAATAAATACTATGC<br>AGACTCCGTGAAGGGC | | SEQ ID NO:22830<br>GATTGGTTCGGGGAGGGGAA<br>CTACTACGGTATGGACGTC | |
| | 21-225_195D9 | AA | SEQ ID NO:6807<br>HYVMH | | SEQ ID NO:14819<br>VIWYDGTNKYYADSVKG | | SEQ ID NO:22831<br>DWFGEGNYYGMDV | |
| iPS:436084 | | NA | SEQ ID NO:6808<br>AGCGGTGGTTACTACTGGAG<br>C | | SEQ ID NO:14820<br>TACAGCTATTACAGTGG<br>GAGCACCAACTATAACC<br>CGTCCCTCAAGAGT | | SEQ ID NO:22832<br>GGGGGTATAACTGGAACAA<br>CGGGTTTGACTAC | |
| | 21-225_195F2 | AA | SEQ ID NO:6809<br>SGGYYWS | | SEQ ID NO:14821<br>YSYYSGSTNYNPSLKS | | SEQ ID NO:22833<br>GGYNWNNGFDY | |
| | | | SEQ ID NO:6810 | | SEQ ID NO:14822 | | SEQ ID NO:22834 | |

FIGURE 49
(Continued)

| | | | | | |
|---|---|---|---|---|---|
| iPS:436086 | 21-225_191G10 | NA | AGCTATGGCATGCAC | GTTATATGGTATGATGG AAGTAATAAAAACTATG CAGACTCCGTGAAGGGC | GATCAGGGCGTGGGCTACGA CGGTTTGGACGTC |
| | | | SEQ ID NO:6811 | SEQ ID NO:14823 | SEQ ID NO:22835 |
| | | AA | SYGMH | VIWYDGSNKNYADSVKG | DQGVGYDGLDV |
| | | | SEQ ID NO:6812 | SEQ ID NO:14824 | SEQ ID NO:22836 |
| iPS:436088 | 21-225_195C8 | NA | AGTGGTGATTACTACTGGAA C | TACATCTTTTACAGTGGG AGCACCTACTACAACCC GTCCCTCAAGAGT | GGGGATTACGATGGTTCGGG GAGTTATCACTTCTACTACG GTATGGACGTC |
| | | | SEQ ID NO:6813 | SEQ ID NO:14825 | SEQ ID NO:22837 |
| | | AA | SGDYYWN | YIFYSGSTYYNPSLKS | GDYDGSGSYHFYYGMDV |
| | | | SEQ ID NO:6814 | SEQ ID NO:14826 | SEQ ID NO:22838 |
| iPS:436090 | 21-225_195A9 | NA | AGCTATGGCATGCAC | GTTATATGGTATGATGG AAGTAATGAACACTATG CAGACTCCGTGAAGGGC | GATAGGGGGGTGGGTTACTA CGGTTTGGACGTC |
| | | | SEQ ID NO:6815 | SEQ ID NO:14827 | SEQ ID NO:22839 |
| | | AA | SYGMH | VIWYDGSNEHYADSVKG | DRGVGYYGLDV |
| | | | SEQ ID NO:6816 | SEQ ID NO:14828 | SEQ ID NO:22840 |
| iPS:436092 | 21-225_195B9 | NA | AGCTATGGCATGCAC | GTTATATGGTATGATGG AAGTAATAAAATACTATG CAGACTCCGTGAAGGGC | GAATGGCTACAATTCAGGTA CTACTACGGTATGGACGTC |
| | | | SEQ ID NO:6817 | SEQ ID NO:14829 | SEQ ID NO:22841 |
| | | AA | SYGMH | VIWYDGSNKYYADSVKG | EWLQFRYYYGMDV |
| | | | SEQ ID NO:6818 | SEQ ID NO:14830 | SEQ ID NO:22842 |

FIGURE 49
(Continued)

| | | | | | | |
|---|---|---|---|---|---|---|
| iPS:436094 | 21-225_195B10 | NA | AATAGTGGTTACTACTGGAGC | TACATGTATTACAGTGGGAGCACCTACTACAACCCGTCCCTCAAGAGT | GGGGGGTATAAACTGGAACCATGGGTTTGACTGT |
| | | | SEQ ID NO:6819 | SEQ ID NO:14831 | SEQ ID NO:22843 |
| | | AA | NSGYYWS | YMYYSGSTYYNPSLKS | GGYNWNNGFDC |
| | | | SEQ ID NO:6820 | SEQ ID NO:14832 | SEQ ID NO:22844 |
| iPS:436096 | 21-225_195E10 | NA | AGTGGTGGTTACTACTGGAGC | TACATCTATTACAGTGTGGGAGCACCTACTACAACCCGTCCCTCAAGAGT | GGGGGGTATAAACTGGAACCACGGTATGGACGTC |
| | | | SEQ ID NO:6821 | SEQ ID NO:14833 | SEQ ID NO:22845 |
| | | AA | SGGYYWS | YIYYSGSTYYNPSLKS | GGYNWNHGMDV |
| | | | SEQ ID NO:6822 | SEQ ID NO:14834 | SEQ ID NO:22846 |
| iPS:436098 | 21-225_195G11 | NA | GACTACTACATGAGC | TACATTAGTAGTAGTGGTACTACCGTATTCTACGCAGACTCTGTGAAGGGC | GAATGGGTGGGAGCCGACTAC |
| | | | SEQ ID NO:6823 | SEQ ID NO:14835 | SEQ ID NO:22847 |
| | | AA | DYYMS | YISSSGTTVFYADSVKG | EWVGADY |
| | | | SEQ ID NO:6824 | SEQ ID NO:14836 | SEQ ID NO:22848 |
| iPS:436100 | 21-225_195G12 | NA | ACCTATGCCATGAGT | GCTATTAGTCGTGGTGGTAACACACTACGCAGACTCCGTGAAGGGC | GATGGATTCGGTGGGAGCTCCTACTTTGACTAC |
| | | | SEQ ID NO:6825 | SEQ ID NO:14837 | SEQ ID NO:22849 |
| | | AA | TYAMS | AISRGGNTHYADSVKG | DGFGGSSYFDY |
| | | | SEQ ID NO:6826 | SEQ ID NO:14838 | SEQ ID NO:22850 |
| iPS:436102 | 21-225_196B1 | NA | GACTACTACATGAGC | TACATTAGTAGTAGTGGTATTACCATGTACTACGCACGACTCTGTGAAGGGC | GAATGGGTGGGAGCCGACTAC |
| | | | SEQ ID NO:6827 | SEQ ID NO:14839 | SEQ ID NO:22851 |
| | | AA | DYYMS | YISSSGITMYYADSVKG | EWVGADY |
| | | | SEQ ID NO:6828 | SEQ ID NO:14840 | SEQ ID NO:22852 |

FIGURE 49
(Continued)

| | | | | | |
|---|---|---|---|---|---|
| iPS:436104 | 21-225_196C1 | NA | GACTACTACATGAGC | TACATTAGTAGTAGTGGT ACTACCGTATTCTACGCA C GACTCTGTGAAGGGC | GAATGGGTGGGAGCCGACTA |
| | | | SEQ ID NO:6829 | SEQ ID NO:14841 | SEQ ID NO:22853 |
| | | AA | DYYMS | YISSSGTTVFYADSVKG | EWVGADY |
| | | | SEQ ID NO:6830 | SEQ ID NO:14842 | SEQ ID NO:22854 |
| iPS:436106 | 21-225_196F2 | NA | AGCTTTGGCATGCAC | GTTATATTAAATGATGG AAGTAATAAAAGTGTG CAGACTCCGTGAAGGGC | GGACAGCAGTGGCTGGTAAA CGGTGTGGACGTC |
| | | | SEQ ID NO:6831 | SEQ ID NO:14843 | SEQ ID NO:22855 |
| | | AA | SFGMH | VILNDGSNKKCADSVKG | GQQWLVNGVDV |
| | | | SEQ ID NO:6832 | SEQ ID NO:14844 | SEQ ID NO:22856 |
| iPS:436110 | 21-225_196F4 | NA | AGCTGTGCCATGACC | GCTATTAGTGGTAGTGGT GGTAGCACATACTACGC AGACTCCGTGAAGGGC | GTGGGGGGTTTGACTGGCTC CTACTACTACGGTATGG ACGTC |
| | | | SEQ ID NO:6833 | SEQ ID NO:14845 | SEQ ID NO:22857 |
| | | AA | SCAMT | AISGSGGSTYYADSVKG | VGGLTGSYYYYGMDV |
| | | | SEQ ID NO:6834 | SEQ ID NO:14846 | SEQ ID NO:22858 |
| iPS:436112 | 21-225_196C7 | NA | AGCTATGGCATGCAC | GTTATATGGTATGATGG AAGTAATGAACACTATG CAGACTCCGTGAAGGGC | GATAGGGGGGTGGGTTACTA CGGTTTGGACGTC |
| | | | SEQ ID NO:6835 | SEQ ID NO:14847 | SEQ ID NO:22859 |
| | | AA | SYGMH | VIWYDGSNEHYADSVKG | DRGVGYYGLDV |
| | | | SEQ ID NO:6836 | SEQ ID NO:14848 | SEQ ID NO:22860 |
| iPS:436114 | | NA | AATTATGATATCAAC | TGGATGCACCTTAACAG TGGTAACACAGGCTATG CACCGAAGTTCCAGGGC | AGCGGTGGCTGGTACGTGTT CGACCCC |

FIGURE 49
(Continued)

| | | | SEQ ID NO:6837 | SEQ ID NO:14849 | SEQ ID NO:22861 |
| --- | --- | --- | --- | --- | --- |
| 21-225_196G8 | | AA | NYDIN | WMHLNSGNTGYAPKFQG | SGGWYVFDP |
| | | | SEQ ID NO:6838 | SEQ ID NO:14850 | SEQ ID NO:22862 |
| iPS:436116 | 21-225_196B9 | NA | GGCTACTACTATATGCAC | TGGATCAACCCTAACAG TGGTGGCACAAACTTTG CACAGAAGTTCGGGGC | GGGGGGGTTCGGGGAGTTCC CAACTACTACTACGTTATGG ACGTC |
| | | | SEQ ID NO:6839 | SEQ ID NO:14851 | SEQ ID NO:22863 |
| | | AA | GYYMH | WINPNSGGTNFAQKFRG | GGVRGVPNYYYVMDV |
| | | | SEQ ID NO:6840 | SEQ ID NO:14852 | SEQ ID NO:22864 |
| iPS:436118 | 21-225_196A10 | NA | CACTATGTCATGCAC | GTTATTTGGTATGATGGA ACTAATAAATACTATGC AGACTCCGTGAAGGGC | GATTGGTTCGGGGAGGGGAA CTACTACGGTATGGACGTC |
| | | | SEQ ID NO:6841 | SEQ ID NO:14853 | SEQ ID NO:22865 |
| | | AA | HYVMH | VIWYDGTNKYYADSVKG | DWFGEGNYYGMDV |
| | | | SEQ ID NO:6842 | SEQ ID NO:14854 | SEQ ID NO:22866 |
| iPS:436120 | 21-225_196C10 | NA | AGTGGTGGTGACTACTGGAG C | TTCATCTATTACAGTGGG AGCACCTACTACAATCC GTCCCTCAAGAGT | ATGGACTACAGTAACTACTA CTACGGTATGGACGTC |
| | | | SEQ ID NO:6843 | SEQ ID NO:14855 | SEQ ID NO:22867 |
| | | AA | SGGDYWS | FIYYSGSTYYNPSLKS | MDYSNYYYGMDV |
| | | | SEQ ID NO:6844 | SEQ ID NO:14856 | SEQ ID NO:22868 |
| iPS:436122 | 21-225_196G10 | NA | GACTATAGCATGAAC | TCTATTAGTAGTGGTAGT GGTTACATACACTACGC AGACTCAGTGAAGGGC | GCAACTATGGCCCTTGACTA C |
| | | | SEQ ID NO:6845 | SEQ ID NO:14857 | SEQ ID NO:22869 |
| | | AA | DYSMN | SISSGSGYIHYADSVKG | ATMALDY |
| | | | SEQ ID NO:6846 | SEQ ID NO:14858 | SEQ ID NO:22870 |

FIGURE 49
(Continued)

| | | | | |
|---|---|---|---|---|
| iPS:436132 | 21-225_196C12 | NA | AGTTATGATATCAAC | TGGATGAACCCTAAAAG GGGTAACACAGGCTATG CACAGAAGTTCCAGGGC | GGAGACCCGTATAACTGGAA CTCCTACGCTATGGACGTC |
| | | | SEQ ID NO:6847 | SEQ ID NO:14859 | SEQ ID NO:22871 |
| | | AA | SYDIN | WMNPKRGNTGYAQKFQG | GDPYNWNSYAMDV |
| | | | SEQ ID NO:6848 | SEQ ID NO:14860 | SEQ ID NO:22872 |
| iPS:436134 | 21-225_196H12 | NA | AGTGGTGTTTACTACTGGAG C | AACATCTATTACAGTGG GAGCACCTACAACAACC CGTCCCTCAAGAGT | GGGGATTACGATGGTTCGGG GAGTTATCACTACTACTACG GTTTGGACGTC |
| | | | SEQ ID NO:6849 | SEQ ID NO:14861 | SEQ ID NO:22873 |
| | | AA | SGVYYWS | NIYYSGSTYNPSLKS | GDYDGSGSYHYYYGLDV |
| | | | SEQ ID NO:6850 | SEQ ID NO:14862 | SEQ ID NO:22874 |
| iPS:436138 | 21-225_197F2 | NA | AGCTATGGCATGCAC | GTTATATGGTATGATGG AAGTAATAAAAACTATG CAGACTCCGTGAAGGGC | GATCAGGGCGTGGGCTACGA CGGTTTGGACGTC |
| | | | SEQ ID NO:6851 | SEQ ID NO:14863 | SEQ ID NO:22875 |
| | | AA | SYGMH | VIWYDGSNKNYADSVKG | DQGVGYDGLDV |
| | | | SEQ ID NO:6852 | SEQ ID NO:14864 | SEQ ID NO:22876 |
| iPS:436140 | 21-225_197G3 | NA | AGCCATGGCATGCAC | GTTATATGGTATGATGG AAGTAATAAAAACTATG CAGACTCCGTGAAGGGC | GATCCCTCTGTAGGGTACGA CGGTATGGACGTC |
| | | | SEQ ID NO:6853 | SEQ ID NO:14865 | SEQ ID NO:22877 |
| | | AA | SHGMH | VIWYDGSNKNYADSVKG | DPSVGYDGMDV |
| | | | SEQ ID NO:6854 | SEQ ID NO:14866 | SEQ ID NO:22878 |

FIGURE 49
(Continued)

| iPS:436146 | 21-225_197F4 | NA | AGTGGTGATTACTACTGGAA C | TACATCTTTTACAGTGGG AGCACCTACTACAACCC GTCCCTCAAGAGT | GGGGATTACGATGGTCGGG GAGTTATCACTACTACTACG GTTTGGACGTC |
|---|---|---|---|---|---|
| | | | SEQ ID NO:6855 | SEQ ID NO:14867 | SEQ ID NO:22879 |
| | | AA | SGDYYWN | YIFYSGSTYYNPSLKS | GDYDGSGSYHYYGLDV |
| | | | SEQ ID NO:6856 | SEQ ID NO:14868 | SEQ ID NO:22880 |
| iPS:436150 | 21-225_197H4 | NA | AATTATGATATCAAC | TGGATGCACCTAACAG TGGTAACACAGGCTATG CACAGAAGTTCCAGGGC | AGCAGTGGCTGGTACTACTT TGACTAC |
| | | | SEQ ID NO:6857 | SEQ ID NO:14869 | SEQ ID NO:22881 |
| | | AA | NYDIN | WMHPNSGNTGYAQKFQG | SSGWYYFDY |
| | | | SEQ ID NO:6858 | SEQ ID NO:14870 | SEQ ID NO:22882 |
| iPS:436152 | 21-225_197B6 | NA | AGCTATGGCATGCAC | GTTATATGGTATGATGG AAGTAATAAAAACTACG CAGACTCCGTGAAGGGC | GATCAGGGCGTGGGCTACGA CGGTTTGGACGTC |
| | | | SEQ ID NO:6859 | SEQ ID NO:14871 | SEQ ID NO:22883 |
| | | AA | SYGMH | VIWYDGSNKNYADSVKG | DQGVGYDGLDV |
| | | | SEQ ID NO:6860 | SEQ ID NO:14872 | SEQ ID NO:22884 |
| iPS:436154 | 21-225_197C6 | NA | AATTATGATATCAAC | TGGATGCACCTAACAG TGGTAACACAGGCTATG CACAGAAGTTCCAGGGC | AGCAGTGGCTGGTACTACTT TGACTAC |
| | | | SEQ ID NO:6861 | SEQ ID NO:14873 | SEQ ID NO:22885 |
| | | AA | NYDIN | WMHPNSGNTGYAQKFQG | SSGWYYFDY |
| | | | SEQ ID NO:6862 | SEQ ID NO:14874 | SEQ ID NO:22886 |

FIGURE 49
(Continued)

| | | | | | |
|---|---|---|---|---|---|
| iPS:436156 | 21-225_197C8 | NA | AGCTCTGCCATGACC SEQ ID NO:6863 | GCTATCATTGGTAATGGT GGTAGAGCATACTACGC AGACTCCGTGAAGGGC SEQ ID NO:14875 | GATCGGGGATATAGCAGGAT AGCAGTGGCTGGTACCTTTG ACTAC SEQ ID NO:22887 |
| | | AA | SSAMT SEQ ID NO:6864 | AIIGNGGRAYYADSVKG SEQ ID NO:14876 | DRGYSRIAVAGTFDY SEQ ID NO:22888 |
| iPS:436158 | 21-225_197G8 | NA | GCTTACTCCTGGAGC SEQ ID NO:6865 | CGTCTCTCTCCTGGTGGG AGCACCAACTTCAACCC CTCCCTCAAGAGT SEQ ID NO:14877 | CTCCGGTATAACTGGAACTT CCCTTACTTTGACTAC SEQ ID NO:22889 |
| | | AA | AYSWS SEQ ID NO:6866 | RLSPGGSTNFNPSLKS SEQ ID NO:14878 | LRYNWNFPYFDY SEQ ID NO:22890 |
| iPS:436160 | 21-225_197C9 | NA | AGCTATGCCATGAGC SEQ ID NO:6867 | GTTATTAGTGGTAGAGG TGGTAACACATACTACG CAGACTCCGTGAAGGGC SEQ ID NO:14879 | GGCATAGCAGTGGCTGGCTC GCACTACTTTGACTAC SEQ ID NO:22891 |
| | | AA | SYAMS SEQ ID NO:6868 | VISGRGGNTYYADSVKG SEQ ID NO:14880 | GIAVAGSHYFDY SEQ ID NO:22892 |
| iPS:436164 | 21-225_197G10 | NA | AGCTATGGCATGCAC SEQ ID NO:6869 | GTTACATGGTATGATGG AAGTAATAAATACTATG CAGACTCCGTGAAGGGC SEQ ID NO:14881 | GAATGGCTACAATTTAGGTA CTACTACGGTATAGACGTC SEQ ID NO:22893 |
| | | AA | SYGMH SEQ ID NO:6870 | VTWYDGSNKYYADSVKG SEQ ID NO:14882 | EWLQFRYYYGIDV SEQ ID NO:22894 |
| iPS:436167 | 21-225_197E11 | NA | AACTATGGCATGCAC SEQ ID NO:6871 | GTTATATGGTTTGATGGA AGTAATGACTACTATGC AGACTCCGTGAAGGGC SEQ ID NO:14883 | GATAGAAGCGTCGGCTACGA CGGTTTAGATGTC SEQ ID NO:22895 |

FIGURE 49
(Continued)

| | | | | NYGMH | VIWFDGSNDYYADSVKG | DRSVGYDGLDV |
|---|---|---|---|---|---|---|
| | | | AA | SEQ ID NO:6872 | SEQ ID NO:14884 | SEQ ID NO:22896 |
| iPS:436173 | 21-225_197G12 | | NA | AGCTATGGCATGCAC | GTTATATGGTATGATGG AAGTAATAAAAACTATG CAGACTCCGTGAAGGGC | GATCAGGGCGTGGGCTACGA CGGTTTGGACGTC |
| | | | | SEQ ID NO:6873 | SEQ ID NO:14885 | SEQ ID NO:22897 |
| | | | AA | SYGMH | VIWYDGSNKNYADSVKG | DQGVGYDGLDV |
| | | | | SEQ ID NO:6874 | SEQ ID NO:14886 | SEQ ID NO:22898 |
| iPS:436177 | 21-225_198B1 | | NA | AGTGGTGTGATTACTACTGGAAC | TACATCTTCCACAGTGGG AGCACCTACTACAACC GTCCCTCAAGAGT | GGGGATTACGATGGTTCGGG GAGTTATCACTACTATTACG GTATGGACGTC |
| | | | | SEQ ID NO:6875 | SEQ ID NO:14887 | SEQ ID NO:22899 |
| | | | AA | SGDYYWN | YIFHSGSTYYNPSLKS | GDYDGSGSYHYYYGMDV |
| | | | | SEQ ID NO:6876 | SEQ ID NO:14888 | SEQ ID NO:22900 |
| iPS:436179 | 21-225_198E1 | | NA | AGTGGTGGTTACTACTGGAAC | TTCATCTTTACAGTGGG AGCACCTACTACAACC GTCCCTCAAGAGT | GGGGATTACGATGGTTCGGG GAGTTATCACTACTATTACG GTATGGACGTC |
| | | | | SEQ ID NO:6877 | SEQ ID NO:14889 | SEQ ID NO:22901 |
| | | | AA | SGGYYWN | FIFYSGSTYYNPSLKS | GDYDGSGSYHYYYGMDV |
| | | | | SEQ ID NO:6878 | SEQ ID NO:14890 | SEQ ID NO:22902 |
| iPS:436181 | 21-225_198C2 | | NA | AGTGGTGGTTACTACTGGAG C | AACACTCTATTACAGTGG GAGCACCTACTACAACC CGTCCCTCAAGAGT | GGGGATTACTATGGTTCGGG GAGTTATCACAACTACTACG GTTTGGACGTC |
| | | | | SEQ ID NO:6879 | SEQ ID NO:14891 | SEQ ID NO:22903 |
| | | | AA | SGGYYWS | NIYYSGSTYYNPSLKS | GDYYGSGSYHNYYGLDV |
| | | | | SEQ ID NO:6880 | SEQ ID NO:14892 | SEQ ID NO:22904 |

FIGURE 49
(Continued)

| | | | | | |
|---|---|---|---|---|---|
| iPS:436189 | 21-225_198B6 | NA | AGTTATGGCATGCAC | GTTATATGGTATGATGG AAGTAATAAACACTATG CAGACTCCGTGAAGGGC | GATCAGGGCGTGGCTACTA CGGTATGGACGTC |
| | | | SEQ ID NO:6881 | SEQ ID NO:14893 | SEQ ID NO:22905 |
| | | AA | SYGMH | VIWYDGSNKHYADSVKG | DQGVGYYGMDV |
| | | | SEQ ID NO:6882 | SEQ ID NO:14894 | SEQ ID NO:22906 |
| iPS:436191 | 21-225_198B9 | NA | AACTATGGCATGCAC | ATTATATGGTTTGATGGA AGTAATAAATACTATGT AGACTCCGTGAAGGGC | GAATGGCTACAATTCAGGTA CTACTACGGTATGGACGTC |
| | | | SEQ ID NO:6883 | SEQ ID NO:14895 | SEQ ID NO:22907 |
| | | AA | NYGMH | IIWFDGSNKYYVDSVKG | EWLQFRYYYGMDV |
| | | | SEQ ID NO:6884 | SEQ ID NO:14896 | SEQ ID NO:22908 |
| iPS:436193 | 21-225_198A10 | NA | AGTTACCACTGGAGT | CATATCTATACCAGTAG GAGCACCAACTACAACC CCTCCCTCAAGAGT | CTCCGGTATAACTGGAACTT CCCTTACTTTGACTAC |
| | | | SEQ ID NO:6885 | SEQ ID NO:14897 | SEQ ID NO:22909 |
| | | AA | SYHWS | HIYTSRSTNYNPSLKS | LRYNWNFPYFDY |
| | | | SEQ ID NO:6886 | SEQ ID NO:14898 | SEQ ID NO:22910 |
| iPS:436195 | 21-225_198G10 | NA | AGTGGTGATTACTACTGGAAC | TACATCTTTTACAGTGGG AGCACCTACTACAACCC GTCCCTCAAGAGT | GGGGATTACGATGGTTCGGG GAGTATCACTTCTACTACG GTATGGACGTC |
| | | | SEQ ID NO:6887 | SEQ ID NO:14899 | SEQ ID NO:22911 |
| | | AA | SGDYYWN | YIFYSGSTYYNPSLKS | GDYDGSGSYHFYYGMDV |
| | | | SEQ ID NO:6888 | SEQ ID NO:14900 | SEQ ID NO:22912 |
| iPS:436197 | 21_225_199C2 | NA | AGTGGTGATTACTACTGGAAC | TACATCTTTTACAGTGGG AGCACCTACTACAACCC GTCCCTCAAGAGT | GGGGATTACGATGGTTCGGG GAGTTATCACTACTACTACG GTATGGACGTC |

FIGURE 49
(Continued)

| | | | | | | | |
|---|---|---|---|---|---|---|---|
| iPS:436199 | 21-225_199C2 | AA | SEQ ID NO:6889<br>SGDYYWN | SEQ ID NO:14901<br>YIFYSGSTYYNPSLKS | SEQ ID NO:22913<br>GDYDGSGSYHYYYGMDV | | |
| | | NA | SEQ ID NO:6890<br>GGTTACTTCTGGACC | SEQ ID NO:14902<br>GAAATCAATCATAGTGG<br>AAGCACCAACTACAACC<br>CGTCCCTCAAGAGT | SEQ ID NO:22914<br>GACTACGGTGCTGACTAC | | |
| iPS:436201 | 21-225_199E3 | AA | SEQ ID NO:6891<br>GYFWT | SEQ ID NO:14903<br>EINHSGSTNYNPSLKS | SEQ ID NO:22915<br>DYGADY | | |
| | | NA | SEQ ID NO:6892<br>AGCTATGGCATGCAC | SEQ ID NO:14904<br>GTTATATGGTATGATGG<br>AAGTAATAAAAACTATG<br>CAGACTCCGTGAAGGGC | SEQ ID NO:22916<br>GATCAGGGCGTGGGCTACTA<br>CGGTATGGACGTC | | |
| iPS:436203 | 21-225_199C5 | AA | SEQ ID NO:6893<br>SYGMH | SEQ ID NO:14905<br>VIWYDGSNKNYADSVKG | SEQ ID NO:22917<br>DQGVGYYYGMDV | | |
| | | NA | SEQ ID NO:6894<br>AACTATGGCATGCAC | SEQ ID NO:14906<br>ATTATATGGTTTGATGGA<br>AGTAATCAATACTATGC<br>CGACTCCGTGAAGGGC | SEQ ID NO:22918<br>GCCCACGGGGTCTACTACTA<br>CGCTATGGACGTC | | |
| iPS:436205 | 21-225_199A6 | AA | SEQ ID NO:6895<br>NYGMH | SEQ ID NO:14907<br>IIWFDGSNQYYADSVKG | SEQ ID NO:22919<br>AHGVYYYAMDV | | |
| | | NA | SEQ ID NO:6896<br>AACTATGGCATGCAC | SEQ ID NO:14908<br>ATTATATGGTTTGATGGA<br>AGTAATAAATACTATGC<br>AGACTCCGTGAAGGGC | SEQ ID NO:22920<br>GAATGGCTACAATTCAGGTA<br>CTACTACGGTATGGACGTC | | |
| | 21-225_199A7 | AA | SEQ ID NO:6897<br>NYGMH | SEQ ID NO:14909<br>IIWFDGSNKYYADSVKG | SEQ ID NO:22921<br>EWLQFRYYYGMDV | | |
| | | | SEQ ID NO:6898 | SEQ ID NO:14910 | SEQ ID NO:22922 | | |

FIGURE 49
(Continued)

| | | | | | |
|---|---|---|---|---|---|
| iPS:436207 | 21-225_199C7 | NA | AGTGGTGGTTACTACTGGAA C | TTCATCTTTTACAGTGGG AGCACCTACTACAACCC GTCCCTCAAGAGT | GGGGATTACGATGGTTCGGG GAGTTATCACTACTATTACG GTATGGACGTC |
| | | | SEQ ID NO:6899 | SEQ ID NO:14911 | SEQ ID NO:22923 |
| | | AA | SGGYYWN | FIFYSGSTYYNPSLKS | GDYDGSGSYHYYYGMDV |
| | | | SEQ ID NO:6900 | SEQ ID NO:14912 | SEQ ID NO:22924 |
| iPS:436210 | 21-225_199G11 | NA | AGTGGTGGTTACTACTGGAG C | AACATCTATTACAGTGG GAGCACCTACTACAACC CGTCCCTCAAGAGT | GGGGATTACTATGGTTCGGG GAGTTATCACAACTACTACG GTTTGGACGTC |
| | | | SEQ ID NO:6901 | SEQ ID NO:14913 | SEQ ID NO:22925 |
| | | AA | SGGYYWS | NIYYSGSTYYNPSLKS | GDYYGSGSYHNYYGLDV |
| | | | SEQ ID NO:6902 | SEQ ID NO:14914 | SEQ ID NO:22926 |
| iPS:436212 | 21-225_200G1 | NA | AGCTATGCCATGAGC | GCTATTAGTGGTAGAGG CGGTAATACATTCTACGC AGACTCCGTGAGGGGC | CGTATAGCAGTGGATGGCTA TGATGCTTTTGATGTC |
| | | | SEQ ID NO:6903 | SEQ ID NO:14915 | SEQ ID NO:22927 |
| | | AA | SYAMS | AISGRGGNTFYADSVRG | RIAVDGYDAFDV |
| | | | SEQ ID NO:6904 | SEQ ID NO:14916 | SEQ ID NO:22928 |
| iPS:436214 | 21-225_200F6 | NA | AGTTATGGCATGCAC | GTTATATGGTATGATGG AAGTAATAAATACTATG CAGACTCCGTGAAGGGC | GAATGGCTACAATTAGGTA TTACTACGGTATGGACGTC |
| | | | SEQ ID NO:6905 | SEQ ID NO:14917 | SEQ ID NO:22929 |
| | | AA | SYGMH | VIWYDGSNKYYADSVKG | EWLQFRYYYGMDV |
| | | | SEQ ID NO:6906 | SEQ ID NO:14918 | SEQ ID NO:22930 |
| iPS:436216 | 21-225_200B7 | NA | AGTGGTGGTTACTACTGGAG C | TACATCTTTTACAGTGGG AGCACCAACTACAACCC GTCCCTCAGGAGT | GCCGGGTATAACTGAACAA CGGTATGGACGTC |
| | | | SEQ ID NO:6907 | SEQ ID NO:14919 | SEQ ID NO:22931 |

FIGURE 49
(Continued)

| | | | | | |
|---|---|---|---|---|---|
| iPS:436218 | 21-225_200G7 | AA | SGGYYWS | YIFYSGSTNYNPSLRS | AGYNWNGMDV |
| | | | SEQ ID NO:6908 | SEQ ID NO:14920 | SEQ ID NO:22932 |
| | | NA | AATTATGATATCAAC | TGGATGCACCTTAACAG TGGTAACACAGGCTATG CACCGAAGTTCCAGGGC | AGCGGTGGCTGGTACGTGTT CGACCCC |
| | | | SEQ ID NO:6909 | SEQ ID NO:14921 | SEQ ID NO:22933 |
| iPS:436220 | 21-225_200F8 | AA | NYDIN | WMHLNSGNTGYAPKFQG | SGGWYVFDP |
| | | | SEQ ID NO:6910 | SEQ ID NO:14922 | SEQ ID NO:22934 |
| | | NA | AATTACTACTGGAGC | CGTATCTATACCAGTGG AGCACCAACTACAACC CCTCCCTCAAGAGT | GATCGGGGATACTATGGCTA CTACGGTATGGACGTC |
| | | | SEQ ID NO:6911 | SEQ ID NO:14923 | SEQ ID NO:22935 |
| iPS:436222 | 21-225_200C9 | AA | NYYWS | RIYTSGSTNYNPSLKS | DRGYYGYYGMDV |
| | | | SEQ ID NO:6912 | SEQ ID NO:14924 | SEQ ID NO:22936 |
| | | NA | AGCTATGGCATGCAC | GTTATATCATATGATGA GGTTATAAAAACTATAT AGACTCCGTGAAGGGC | GGTACCACGGGTACTACTA CGGTGTGGACGTC |
| | | | SEQ ID NO:6913 | SEQ ID NO:14925 | SEQ ID NO:22937 |
| iPS:436226 | 21-225_200F10 | AA | SYGMH | VISYDGGYKNYIDSVKG | GTHGYYYGVDV |
| | | | SEQ ID NO:6914 | SEQ ID NO:14926 | SEQ ID NO:22938 |
| | | NA | AGTGGTGATTACTACTGGAA C | TACATCTTTTACAGTGGG AGCACCTACTACAACCC GTCCCTCAAGAGT | GGGGATTACGATGGTTCGGG GAGTTATCACTACTACTACG GTATGGACGTC |
| | | | SEQ ID NO:6915 | SEQ ID NO:14927 | SEQ ID NO:22939 |
| | | AA | SGDYYWN | YIFYSGSTYYNPSLKS | GDYDGSGSYHYYYGMDV |
| | | | SEQ ID NO:6916 | SEQ ID NO:14928 | SEQ ID NO:22940 |

FIGURE 49
(Continued)

| iPS:436228 | 21-225_200F12 | NA | GGTTACTTCTGGACC<br>SEQ ID NO:6917 | GAAATCAGTCATAGTGG<br>AAGCACCAACTACAACC<br>CGTCCCTCAAGAGT<br>SEQ ID NO:14929 | GACTACGGGGCGGACTAC<br>SEQ ID NO:22941 |
|---|---|---|---|---|---|
| | | AA | GYFWT<br>SEQ ID NO:6918 | EISHSGSTNYNPSLKS<br>SEQ ID NO:14930 | DYGADY<br>SEQ ID NO:22942 |
| iPS:436230 | 21-225_201A1 | NA | GGTTACTTCTGGACC<br>SEQ ID NO:6919 | GAAATCAGTCATAGTGG<br>ACGCACCAACTACAACC<br>CGTCCCTCAAGAGT<br>SEQ ID NO:14931 | GACTACGGGGCGGACTAC<br>SEQ ID NO:22943 |
| | | AA | GYFWT<br>SEQ ID NO:6920 | EISHSGRTNYNPSLKS<br>SEQ ID NO:14932 | DYGADY<br>SEQ ID NO:22944 |
| iPS:436232 | 21-225_201E1 | NA | CCTTACTACTGGAGC<br>SEQ ID NO:6921 | GAAGTCAATCATAGTGG<br>AAGCACCAACTACAACC<br>CGTCCCTCAAGAGT<br>SEQ ID NO:14933 | GACTACGGGGTTTAGACTA<br>C<br>SEQ ID NO:22945 |
| | | AA | PYYWS<br>SEQ ID NO:6922 | EVNHSGSTNYNPSLKS<br>SEQ ID NO:14934 | DYGGLDY<br>SEQ ID NO:22946 |
| iPS:436234 | 21-225_51E3 | NA | AGCTATGTGTATCAGC<br>SEQ ID NO:6923 | TGGATCAGCGCTTATAAT<br>GGTAACACAAAGAATGC<br>ACAGAGGTTCCAGGGC<br>SEQ ID NO:14935 | CACGATTTTGGAGTGGTTA<br>TTATAAGGGTATGGACGTC<br>SEQ ID NO:22947 |
| | | AA | SYGIS<br>SEQ ID NO:6924 | WISAYNGNTKNAQRFQG<br>SEQ ID NO:14936 | HDFWSGYYKGMDV<br>SEQ ID NO:22948 |
| iPS:436236 | 21-225_201F7 | NA | AGCAACAGTGCTGCTTGGAA<br>C<br>SEQ ID NO:6925 | AGGACATACTACAGGTC<br>CAAGTGTATAATTATTA<br>TGAAGTATCTGTGAGAA<br>GT<br>SEQ ID NO:14937 | GATCAACGGTACTACGGTAT<br>GGACGTC<br>SEQ ID NO:22949 |

FIGURE 49
(Continued)

| | | | SNSAAWN | | RTYYRSKWYNYYEVSVRS | DQRYYGMDV |
|---|---|---|---|---|---|---|
| | | AA | | | | |
| iPS:436238 | 21-225_201B2 | NA | GTTTACTACTGGACC | SEQ ID NO:6926 | GAAATCAATCATAGTGG AAGCACCAACTACAACC CGTCCCTCAAGAGT | SEQ ID NO:14938 | GACTATGGTGTCTTTGATTA C | SEQ ID NO:22950 |
| | | AA | VYYWT | SEQ ID NO:6927 | EINHSGSTNYNPSLKS | SEQ ID NO:14939 | DYGVFDY | SEQ ID NO:22951 |
| iPS:436240 | 21-225_201E8 | NA | GGCTACTATATGCAC | SEQ ID NO:6928 | TGGATCGACCCTAACAG TGGTGGCACAAACTATC CACAGAAGTTTCAGGGC | SEQ ID NO:14940 | GATCAAGGGTATAACTGGAA CTCTTTTGACTAC | SEQ ID NO:22952 |
| | | AA | GYYMH | SEQ ID NO:6929 | WIDPNSGGTNYPQKFQG | SEQ ID NO:14941 | DQGYNWNSFDY | SEQ ID NO:22953 |
| iPS:436242 | 21-225_201A10 | NA | GGTTACTTCTGGACC | SEQ ID NO:6930 | GAAATCAGTCATAGTGG AAGCACCAACTACAACC CGTCCCTCAAGAGT | SEQ ID NO:14942 | GACTACGGGGCGGACTAC | SEQ ID NO:22954 |
| | | AA | GYFWT | SEQ ID NO:6931 | EISHSGSTNYNPSLKS | SEQ ID NO:14943 | DYGADY | SEQ ID NO:22955 |
| iPS:436244 | 21-225_201H10 | NA | GGCTACTATATCCAC | SEQ ID NO:6932 | TGGATCAACCCTAATAG TGGTGGCACAAACTATG CACAGAAGTTTCAGGGC | SEQ ID NO:14944 | GGATACAGCTATGGTTACAA CTGGTTCGACCCC | SEQ ID NO:22956 |
| | | AA | GYYIH | SEQ ID NO:6933 | WINPNSGGTNYAQKFQG | SEQ ID NO:14945 | GYSYGYNWFDP | SEQ ID NO:22957 |
| iPS:436246 | 21_225_201G6 | NA | AGCTATGCCATGAGC | SEQ ID NO:6934 | ACTATTAGTGGTAGTGGT GTTAGAACATACTACGC AGACTCCGTGAAGGGC | SEQ ID NO:14946 | GGGGGAGCTAGGAGCAGTG GCTGGTTCCACTTTGACTAC | SEQ ID NO:22958 |

FIGURE 49
(Continued)

| | | | | | | |
|---|---|---|---|---|---|---|
| iPS:436248 | 21-225_201G6 | AA | SEQ ID NO:6935 SYAMS | SEQ ID NO:14947 TISGSGVRTYYADSVKG | SEQ ID NO:22959 GGARSSGWFHFDY | |
| | | NA | SEQ ID NO:6936 AGTTATGATATCAAC | SEQ ID NO:14948 TGGATGAACCCTAAGAG AGGTAACACAGGCTATG CACAGAAGTTCCAGGGC | SEQ ID NO:22960 GGAAGGTATAGCAGGGAGG ATTACTACTACTATTATGAT ATGGACGTC | |
| iPS:436250 | 21-225_202A3 | AA | SEQ ID NO:6937 SYDIN | SEQ ID NO:14949 WMNPKRGNTGYAQKFQG | SEQ ID NO:22961 GRYSREDYYYYDMDV | |
| | | NA | SEQ ID NO:6938 AGCAACAGTGCTGCTTGGAA C | SEQ ID NO:14950 AGGACATACTACAGGTC CAAGTGGTATAATTATTA TGAAGTATCTGTGAAAA GT | SEQ ID NO:22962 GATCAACGGTACTACGGTAT GGACGTC | |
| iPS:436252 | 21-225_201A4 | AA | SEQ ID NO:6939 SNSAAWN | SEQ ID NO:14951 RTYYRSKWYNYYEVSVK S | SEQ ID NO:22963 DQRYYGMDV | |
| | | NA | SEQ ID NO:6940 AGCAACAGTGCTGCTTGGAA C | SEQ ID NO:14952 AGGACATACTACAGGTC CAAGTGGTATAATGAGT ATGCAGTATCTGTGAGA AGT | SEQ ID NO:22964 GATCAACGGTACTACGGTAT GGACGTC | |
| iPS:436254 | 21-225_202A8 | AA | SEQ ID NO:6941 SNSAAWN | SEQ ID NO:14953 RTYYRSKWYNEYAVSVRS | SEQ ID NO:22965 DQRYYGMDV | |
| | | NA | SEQ ID NO:6942 AGCTATGCCATGAGC | SEQ ID NO:14954 ACTATTAGTGGTAGTGGT GTTAGAACATACTACGC AGACTCCGTGAAGGGC | SEQ ID NO:22966 GGGGAGCTAGGAGCAGTG GCTGGTTCCACTTTGACTAC | |
| | 21-225_202C12 | | SEQ ID NO:6943 | SEQ ID NO:14955 | SEQ ID NO:22967 | |

FIGURE 49
(Continued)

| | | | | | |
|---|---|---|---|---|---|
| iPS:436256 | 21-225_202D9 | AA | SYAMS<br>SEQ ID NO:6944 | TISGSGVRTYYADSVKG<br>SEQ ID NO:14956 | GGARSSGWFHFDY<br>SEQ ID NO:22968 |
| | | NA | CCTTACTACTGGAGC<br>SEQ ID NO:6945 | GAAATCAATCATAGTGG<br>AAGCACCAACTACAATC<br>CGTCCCTCAAGAGT<br>SEQ ID NO:14957 | GACTACGGGGGGTTTAGACTA<br>C<br>SEQ ID NO:22969 |
| iPS:436258 | 21-225_202F12 | AA | PYYWS<br>SEQ ID NO:6946 | EINHSGSTNYNPSLKS<br>SEQ ID NO:14958 | DYGGLDY<br>SEQ ID NO:22970 |
| | | NA | TACTATGGCATGCAC<br>SEQ ID NO:6947 | ATTATATGGTATGATGG<br>AAGTAATAAATTCTATG<br>CAGACTCCGTGAAGGGC<br>SEQ ID NO:14959 | AATATAGCAGCAGCTGCCCC<br>TTACTTTGACTAC<br>SEQ ID NO:22971 |
| iPS:436260 | 21-225_203H1 | AA | YYGMH<br>SEQ ID NO:6948 | IIWYDGSNKFYADSVKG<br>SEQ ID NO:14960 | NIAAAAPYFDY<br>SEQ ID NO:22972 |
| | | NA | AGCTATGGCATGCAC<br>SEQ ID NO:6949 | GTTATATGGTATGATGG<br>AAGTAATAAAAACTATG<br>CAGACTCCGTGAAGGGC<br>SEQ ID NO:14961 | GATAGAACAGTTGGCTACAA<br>CGGTATGGACGTC<br>SEQ ID NO:22973 |
| | | AA | SYGMH<br>SEQ ID NO:6950 | VIWYDGSNKNYADSVKG<br>SEQ ID NO:14962 | DRTVGYNGMDV<br>SEQ ID NO:22974 |
| iPS:436262 | 21-225_203E3 | NA | GGCTACTACTATATCCAC<br>SEQ ID NO:6951 | TGGATCAACCCTAATAG<br>TGGTGGCACAAACTATG<br>CACAGAAGTTTCAGGGC<br>SEQ ID NO:14963 | GGATACAGCTATGTTACAA<br>CTGGTTCGACCCC<br>SEQ ID NO:22975 |
| | | AA | GYYIH<br>SEQ ID NO:6952 | WINPNSGGTNYAQKFQG<br>SEQ ID NO:14964 | GYSYGYNWFDP<br>SEQ ID NO:22976 |

FIGURE 49
(Continued)

| | | | | |
|---|---|---|---|---|
| iPS:436264 | 21-225_203F7 | NA | GACTATGTCATGCAC | GTTATATGGTATGATGG AAGTAATAAATACTATG TAGACTCCGTGAAGGGC | GAACGGTATAGCAGTGGCTT GTACGACTACGGTATGGACG TC |
| | | AA | SEQ ID NO:6953 DYVMH | SEQ ID NO:14965 VIWYDGSNKYYVDSVKG | SEQ ID NO:22977 ERYSSGLYDYGMDV |
| iPS:436268 | 21-225_203B9 | NA | SEQ ID NO:6954 AGTTTTGGCATGCAC | SEQ ID NO:14966 GTTATATGGTATGATGTA AATAATAAATACTATG AGACTCCGTGAAGGGC | SEQ ID NO:22978 GAACTGGGGTTCCTCTCTGA CTAC |
| | | AA | SEQ ID NO:6955 SFGMH | SEQ ID NO:14967 VIWYDVNNKYYADSVKG | SEQ ID NO:22979 ELGFLSDY |
| iPS:436270 | 21-225_203F10 | NA | SEQ ID NO:6956 GACTACTACATGAGC | SEQ ID NO:14968 TACATTAGTGGTAGTGGT ACTACCACATACTACGC AGACTCTGTGAAGGGC | SEQ ID NO:22980 GATAGGGGGGGTTTGGACGT C |
| | | AA | SEQ ID NO:6957 DYYMS | SEQ ID NO:14969 YISGSGTTTYYADSVKG | SEQ ID NO:22981 DRGGLDV |
| iPS:436272 | 21-225_201F5 | NA | SEQ ID NO:6958 AATTATGATATCAAC | SEQ ID NO:14970 TGGATGCACCCTAACAG TGGTAACACAGGCTATG CACAGAAGTTCCAGGGC | SEQ ID NO:22982 AGCAGTGGCTGGTACTACTT TGACTAC |
| | | AA | SEQ ID NO:6959 NYDIN | SEQ ID NO:14971 WMHPNSGNTGYAQKFQG | SEQ ID NO:22983 SSGWYYFDY |
| | | | SEQ ID NO:6960 | SEQ ID NO:14972 | SEQ ID NO:22984 |

FIGURE 49
(Continued)

| | | | | | |
|---|---|---|---|---|---|
| iPS:436274 | 21-225_204H3 | NA | AGCTATGTCATGCAC | GTTATATGGTATGATGG AAGTAATAAATATAATG CAGACTCCGTGAAGGGC | GAACCGTATAGCAGCAGCTG GTACGACTACGGTATGGACG TC |
| | | | SEQ ID NO:6961 | SEQ ID NO:14973 | SEQ ID NO:22985 |
| | | AA | SYVMH | VIWYDGSNKYNADSVKG | EPYSSSWYDYGMDV |
| | | | SEQ ID NO:6962 | SEQ ID NO:14974 | SEQ ID NO:22986 |
| iPS:436276 | 21-225_204H4 | NA | GGCTACTACTATATCCAC | TGGATCAACCCTAATAG TGGTGGCACAAACTATG CACAGAAGTTTCAGGGC | GGATACAGTACTATGGTTACAA CTGGTTCGACCCC |
| | | | SEQ ID NO:6963 | SEQ ID NO:14975 | SEQ ID NO:22987 |
| | | AA | GYYIH | WINPNSGGTNYAQKFQG | GYSYGYNWFDP |
| | | | SEQ ID NO:6964 | SEQ ID NO:14976 | SEQ ID NO:22988 |
| iPS:436278 | 21-225_201F2 | NA | AGCAACAGTGCTGCTTGGAA C | AGGACATACTACAGGTC CAAGTGGTATAATTATTA TGAAGTATCTGTGAGAA GT | GATCAACGGTACTACGGTAT GGACGTC |
| | | | SEQ ID NO:6965 | SEQ ID NO:14977 | SEQ ID NO:22989 |
| | | AA | SNSAAWN | RTYYRSKWYNYYEVSVRS | DQRYYGMDV |
| | | | SEQ ID NO:6966 | SEQ ID NO:14978 | SEQ ID NO:22990 |
| iPS:436280 | 21-225_204D6 | NA | ACCTATGCCATGAGC | GCTATTAGTGGTAGTGGT GGTAGCACATATTACGC AGACTCCGTGAAGGGC | GGGATAAGTGGAACCGGCTC CTACTACTACGGTGTGG ACGTC |
| | | | SEQ ID NO:6967 | SEQ ID NO:14979 | SEQ ID NO:22991 |
| | | AA | TYAMS | AISGSGGSTYYADSVKG | GISGTGSYYYYGVDV |
| | | | SEQ ID NO:6968 | SEQ ID NO:14980 | SEQ ID NO:22992 |

FIGURE 49
(Continued)

| | | | | | |
|---|---|---|---|---|---|
| iPS:436282 | 21-225_204G6 | NA | AGCTATGGCATGCAC | GTTATATGGTATGATGG AAGTAATAAAAACTATG CAGACTCCGTGAAGGGC | GATCGAGGTGTCGGCTACGA CGGTATGGACGTC |
| | | | SEQ ID NO:6969 | SEQ ID NO:14981 | SEQ ID NO:22993 |
| | | AA | SYGMH | VIWYDGSNKNYADSVKG | DRGVGYDGMDV |
| | | | SEQ ID NO:6970 | SEQ ID NO:14982 | SEQ ID NO:22994 |
| iPS:436284 | 21-225_204G8 | NA | AGCTATGGCATGCAC | GTTATATGGTATGATGGT AGCAAATGAAAATTATGT AGCCTCCGTGAAGGGC | GATCTGGGGATAGGGTATTA CGGTATGGACGTC |
| | | | SEQ ID NO:6971 | SEQ ID NO:14983 | SEQ ID NO:22995 |
| | | AA | SYGMH | VIWYDGSNENYVASVKG | DLGIGYYGMDV |
| | | | SEQ ID NO:6972 | SEQ ID NO:14984 | SEQ ID NO:22996 |
| iPS:436286 | 21-225_204H8 | NA | GGTTACTTCTGGACC | GAAATCAGTCATAGTGG AAGCACCAGTTACAACC CGTCCCTCAAGAGT | GACTACGGGGCCGACTAC |
| | | | SEQ ID NO:6973 | SEQ ID NO:14985 | SEQ ID NO:22997 |
| | | AA | GYFWT | EISHSGSTSYNPSLKS | DYGADY |
| | | | SEQ ID NO:6974 | SEQ ID NO:14986 | SEQ ID NO:22998 |
| iPS:436290 | 21-225_205G3 | NA | GGTCACTACTGGAGC | GAAATGTATCATTTTGGA AACACCAACTACAACCC GTCCCTCAAGAGT | GTGGGGCAGTGGCTGGCTTT TGATATC |
| | | | SEQ ID NO:6975 | SEQ ID NO:14987 | SEQ ID NO:22999 |
| | | AA | GHYWS | EMYHFGNTNYNPSLKS | VGQWLAFDI |
| | | | SEQ ID NO:6976 | SEQ ID NO:14988 | SEQ ID NO:23000 |

FIGURE 49
(Continued)

| | | | | |
|---|---|---|---|---|
| iPS:436292 | 21-225_205H3 | NA | AGCTATGGCATGCAC | GTTATATGGTATGATGG AAGTAATAAATACTATG CAGACTCCGTGAAGGGC | GATAGATCAGTTGGCTACGA CGGTACGGACGTC |
| | | | SEQ ID NO:6977 | SEQ ID NO:14989 | SEQ ID NO:23001 |
| | | AA | SYGMH | VIWYDGSNKYADSVKG | DRSVGYDGTDV |
| | | | SEQ ID NO:6978 | SEQ ID NO:14990 | SEQ ID NO:23002 |
| iPS:436294 | 21-225_205G4 | NA | AGCAACAGTGCTGCTTGGAAC | AGGACATATTACAGGTCCAAGTGGTATAATTATTATGAAGTATCTGTGAGAAGT | GATCAACGGTACTACGGTAT GGACGTC |
| | | | SEQ ID NO:6979 | SEQ ID NO:14991 | SEQ ID NO:23003 |
| | | AA | SNSAAWN | RTYYRSKWYNYYEVSVRS | DQRYYGMDV |
| | | | SEQ ID NO:6980 | SEQ ID NO:14992 | SEQ ID NO:23004 |
| iPS:436296 | 21-225_205F5 | NA | AGATATGGCATGCAC | GTTATATGGTATGATGGAAGTAATGAGAATTATGTAGACTCCGTGAAGGGC | GATATGGGGATAGGGTATTA TGGTATGGACGTC |
| | | | SEQ ID NO:6981 | SEQ ID NO:14993 | SEQ ID NO:23005 |
| | | AA | RYGMH | VIWYDGSNENYVDSVKG | DMGIGYYGMDV |
| | | | SEQ ID NO:6982 | SEQ ID NO:14994 | SEQ ID NO:23006 |
| iPS:436302 | 21-225_205G7 | NA | GTTTATTACTGGAGC | GAAAGCAATCAGAGTGGACGCACCACCTACAACCCGTCCCTCAAGAGT | GACTACGGTGTCTTTGACTAC |
| | | | SEQ ID NO:6983 | SEQ ID NO:14995 | SEQ ID NO:23007 |
| | | AA | VYYWS | ESNQSGRTTYNPSLKS | DYGVFDY |
| | | | SEQ ID NO:6984 | SEQ ID NO:14996 | SEQ ID NO:23008 |

FIGURE 49
(Continued)

| | | | | | |
|---|---|---|---|---|---|
| iPS:436304 | 21-225_201F3 | NA | AGCTATGCCATGAGC | ACTATTAGTGGTAGTGGT GTTAGAACATACACGC AGACTCCGTGAAGGGC | GGGGGAGCTAGGAGCAGTG GCTGGTTCCACTTTGACTAC |
| | | | SEQ ID NO:6985 | SEQ ID NO:14997 | SEQ ID NO:23009 |
| | | AA | SYAMS | TISGSGVRTYYADSVKG | GGARSSGWFHFDY |
| | | | SEQ ID NO:6986 | SEQ ID NO:14998 | SEQ ID NO:23010 |
| iPS:436306 | 21-225_201H4 | NA | AGCTATGCCATGCAC | GCTATATGGTATGATGG AAGTAATAAATACAATG CAGACTCCGTGAAGGGC | GATGTGGGTACAGTGGGAGC TACCTACTTTGACTGC |
| | | | SEQ ID NO:6987 | SEQ ID NO:14999 | SEQ ID NO:23011 |
| | | AA | SYAMH | AIWYDGSNKYNADSVKG | DVGTVGATYFDC |
| | | | SEQ ID NO:6988 | SEQ ID NO:15000 | SEQ ID NO:23012 |
| iPS:436308 | 21-225_205H8 | NA | GGTTACTTCTGGAGC | GAAATCAGTCATAGTGG ACGCACCAACTACAACC CGTCCCTCAAGAGC | GACTACGGGGCGGACTAC |
| | | | SEQ ID NO:6989 | SEQ ID NO:15001 | SEQ ID NO:23013 |
| | | AA | GYFWS | EISHSGRTNYNPSLKS | DYGADY |
| | | | SEQ ID NO:6990 | SEQ ID NO:15002 | SEQ ID NO:23014 |
| iPS:436310 | 21-225_202D11 | NA | GGGTCCCTACTGGAGC | GAAATCAATCATAGTGG AAGCACCAACTACAACC CGTCCCCTCAAGAGT | GACTACGGTGTCCTTGACTA C |
| | | | SEQ ID NO:6991 | SEQ ID NO:15003 | SEQ ID NO:23015 |
| | | AA | GPYWS | EINHSGSTNYNPSLKS | DYGVLDY |
| | | | SEQ ID NO:6992 | SEQ ID NO:15004 | SEQ ID NO:23016 |
| iPS:436312 | 21-225_206A4 | NA | GGCTACTATATCCAC | TGGATCAACCCTAATAG TGGTGGCACAAACTATG CACAGAAGTTTCAGGGC | GGATACAGCTATGGTTACAA CTGGTTCGACCCC |
| | | | SEQ ID NO:6993 | SEQ ID NO:15005 | SEQ ID NO:23017 |

FIGURE 49
(Continued)

| | | AA | GYYIH | WINPNSGGTNYAQKFQG | GYSYGYNWFDP |
|---|---|---|---|---|---|
| iPS:436314 | | | SEQ ID NO:6994 | SEQ ID NO:15006 | SEQ ID NO:23018 |
| | 21-225_206G4 | NA | GGCTACTATATACAC | TGGATCAACCCTAATAGTGGTGGCACAAACTATGCACAGAAGTTTCAGGGC | GATCAAGGGTATAACTGGAACTCTTTTGACTAC |
| | | | SEQ ID NO:6995 | SEQ ID NO:15007 | SEQ ID NO:23019 |
| | | AA | GYYIH | WIDPNSGGTNYAQKFQG | DQGYNWNSFDY |
| iPS:436316 | | | SEQ ID NO:6996 | SEQ ID NO:15008 | SEQ ID NO:23020 |
| | 21-225_206A5 | NA | GGCTACTATATCCAC | TGGATCAACCCTAATAGTGGTGGCACAAACTATGCACAGAAGTTTCAGGGC | GGATACAGCTATGGTTACAACTGGTTCGACCCC |
| | | | SEQ ID NO:6997 | SEQ ID NO:15009 | SEQ ID NO:23021 |
| | | AA | GYYIH | WINPNSGGTNYAQKFQG | GYSYGYNWFDP |
| | | | SEQ ID NO:6998 | SEQ ID NO:15010 | SEQ ID NO:23022 |
| iPS:436324 | | NA | AGCTATGGCATGCAC | GTTATATGGTATGATGGAAGTAATAAAAACTATGCAGAGTCCGTGAAGGGC | GATGCGGGTATTGGATACTACGGTATAGACGTC |
| | 21-225_207G6 | | SEQ ID NO:6999 | SEQ ID NO:15011 | SEQ ID NO:23023 |
| | | AA | SYGMH | VIWYDGSNKNYAESVKG | DAGIGYYGIDV |
| | | | SEQ ID NO:7000 | SEQ ID NO:15012 | SEQ ID NO:23024 |
| iPS:436328 | | NA | AACTATGGCATGCAC | GTTATATGGTATGATAGAAATAATAAATACTATGGTGACTCCGTGAAGGGC | GAACTGGGGTTCCTCTTTGACTAC |
| | 21-225_207F12 | | SEQ ID NO:7001 | SEQ ID NO:15013 | SEQ ID NO:23025 |
| | | AA | NYGMH | VIWYDRNNKYYGDSVKG | ELGFLFDY |
| | | | SEQ ID NO:7002 | SEQ ID NO:15014 | SEQ ID NO:23026 |

FIGURE 49
(Continued)

| | | | | | |
|---|---|---|---|---|---|
| iPS:436332 | 21-225_208B2 | NA | GACTGTGTCATGCAC | GTTATATGGTATGATGGAAGTAATAAATACTATGTAGACTCCGTGAAGGGC | GAACGGTATAGCAGTGGCTTGTACGACTACGGTTTGGACGTC |
| | | | SEQ ID NO:7003 | SEQ ID NO:15015 | SEQ ID NO:23027 |
| | | AA | DCVMH | VIWYDGSNKYYVDSVKG | ERYSSGLYDYGLDV |
| | | | SEQ ID NO:7004 | SEQ ID NO:15016 | SEQ ID NO:23028 |
| iPS:436334 | 21-225_208G3 | NA | AGCTATGCCATGAGC | ACTATTAGTGGTAGTGGTGTTAGAACATACTACGCAGACTCCGTGAAGGGC | GGGGGAGCTAGGAGAGCAGTGGCTGGTTCCACTTTGACTAC |
| | | | SEQ ID NO:7005 | SEQ ID NO:15017 | SEQ ID NO:23029 |
| | | AA | SYAMS | TISGSGVRTYYADSVKG | GGARSSGWFHFDY |
| | | | SEQ ID NO:7006 | SEQ ID NO:15018 | SEQ ID NO:23030 |
| iPS:436336 | 21-225_208B5 | NA | GTTTACTACTGGACC | GAAATCAATCATAGTGGAAGCACCAACTACAACCCGTCCCTCAAGAGT | GACTATGGTGTCTTTGATTAC |
| | | | SEQ ID NO:7007 | SEQ ID NO:15019 | SEQ ID NO:23031 |
| | | AA | VYYWT | EINHSGSTNYNPSLKS | DYGVFDY |
| | | | SEQ ID NO:7008 | SEQ ID NO:15020 | SEQ ID NO:23032 |
| iPS:436338 | 21-225_208E8 | NA | GGCTACTATATCCAC | TGGATCAACCCTAATAGTGGTGGCACAAACTATGCACAGAAGTTTCAGGGC | GGATACAGCTATGGTTACAACTGGTTCGACCCC |
| | | | SEQ ID NO:7009 | SEQ ID NO:15021 | SEQ ID NO:23033 |
| | | AA | GYYIH | WINPNSGGTNYAQKFQG | GYSYGYNWFDP |
| | | | SEQ ID NO:7010 | SEQ ID NO:15022 | SEQ ID NO:23034 |
| iPS:436340 | 21-225_208A9 | NA | GTTTCCTACTGGAGC | GAAATCAATCATAGTGGACGCGCCAACTACAACCCGTCCCTCAAGAGT | GACTACGGTGTCCTTGACTAC |
| | | | SEQ ID NO:7011 | SEQ ID NO:15023 | SEQ ID NO:23035 |

FIGURE 49
(Continued)

| | | | VSYWS | | EINHSGRANYNPSLKS | | DYGVLDY |
|---|---|---|---|---|---|---|---|
| iPS:436344 | 21-225_208B11 | AA | SEQ ID NO:7012 | | SEQ ID NO:15024 | | SEQ ID NO:23036 |
| | | NA | GGCTACTATATCCAC | | TGGATCAACCCTAATAGTGGTGGCACAAACTATGCACAGAAGTTTCAGGGC | | GGATACAGCTATGGTTACAACTGGTTCGACCCC |
| | | | | | SEQ ID NO:15025 | | SEQ ID NO:23037 |
| | | AA | | GYYIH | WINPNSGTNYAQKFQG | | GYSYGYNWFDP |
| | | | | SEQ ID NO:7014 | SEQ ID NO:15026 | | SEQ ID NO:23038 |
| iPS:436350 | 21-225_210E4 | NA | AACTATGGCATGCAC | | GTTATATGGTATGATGAAATAATAAATACTATGTAGACTCCGTGAAGGGC | | GAGACGGGTTTCTTGAGCGACTAC |
| | | | SEQ ID NO:7015 | | SEQ ID NO:15027 | | SEQ ID NO:23039 |
| | | AA | | NYGMH | VIWYDENNKYYVDSVKG | | ETGFLSDY |
| | | | | SEQ ID NO:7016 | SEQ ID NO:15028 | | SEQ ID NO:23040 |
| iPS:436352 | 21-225_210G5 | NA | GACTGTGTCATGCAC | | GTTATATGGTATGATGAAGTAATAAATACTATGTAGACTCCGTGAAGGGCTC | | GAACGGTATAGCAGTGGCTTGTACGACTACGGTTGAACG |
| | | | SEQ ID NO:7017 | | SEQ ID NO:15029 | | SEQ ID NO:23041 |
| | | AA | | DCVMH | VIWYDGSNKYYVDSVKG | | ERYSSGLYDYGLDV |
| | | | | SEQ ID NO:7018 | SEQ ID NO:15030 | | SEQ ID NO:23042 |
| iPS:436354 | 21-225_210G10 | NA | AGTTACTACTGGAGC | | CGTATCTATACCAGTGGGAGCACCGACTACAACCCCTCCCTCAAGAGT | | GGGGTTCGGTGACTGGGACTAC |
| | | | SEQ ID NO:7019 | | SEQ ID NO:15031 | | SEQ ID NO:23043 |
| | | AA | | SYYWS | RIYTSGSTDYNPSLKS | | GFGDWDY |
| | | | | SEQ ID NO:7020 | SEQ ID NO:15032 | | SEQ ID NO:23044 |

FIGURE 49
(Continued)

| | | | | |
|---|---|---|---|---|
| iPS:436356 | 21-225_210H10 | NA | AGCAACAGTGCTGCTTGGAAC | AGGACATACTACAGGTCCAAGTGGTATAATTATTATCCAGTATCTGTGAAAGT | GATCAACGGTACTACGGTATGGACGTC |
| | | | SEQ ID NO:7021 | SEQ ID NO:15033 | SEQ ID NO:23045 |
| | | AA | SNSAAWN | RTYYRSKWNYYPVSVRS | DQRYYGMDV |
| | | | SEQ ID NO:7022 | SEQ ID NO:15034 | SEQ ID NO:23046 |
| iPS:436358 | 21-225_210D11 | NA | GGCTACTACTATATCCAC | TGGATCAACCCTAATAGTGGTGGCACAAACTATGCACAGAAGTTTCAGGGC | GGATACAGCTATGGTTACAACTGGTTCGACCCC |
| | | | SEQ ID NO:7023 | SEQ ID NO:15035 | SEQ ID NO:23047 |
| | | AA | GYYIH | WINPNSGGTNYAQKFQG | GYSYGYNWFDP |
| | | | SEQ ID NO:7024 | SEQ ID NO:15036 | SEQ ID NO:23048 |
| iPS:436360 | 21-225_210H11 | NA | AGCCATGGCATGCAC | GTTACATGGTATGATGGAAGTGATAAATACTATGCAGACTCCGTGAAGGGC | GACCGGCTAGTGGGAGCTACTACCGATGCTTTTGATATC |
| | | | SEQ ID NO:7025 | SEQ ID NO:15037 | SEQ ID NO:23049 |
| | | AA | SHGMH | VTWYDGSDKYYADSVKG | DRLVGATTDAFDI |
| | | | SEQ ID NO:7026 | SEQ ID NO:15038 | SEQ ID NO:23050 |
| iPS:436362 | 21-225_210C12 | NA | AACAATGGTATCAGC | TGGATCAACGCTTACAATGGTCACACAAACTATGCACAGAAGTTCCAGGGC | GATCCTACGGTGACCCACTACTATTACTACGGTATGGACGTC |
| | | | SEQ ID NO:7027 | SEQ ID NO:15039 | SEQ ID NO:23051 |
| | | AA | NNGIS | WINAYNGHTNYAQKFQG | DPTVTHYYYYGMDV |
| | | | SEQ ID NO:7028 | SEQ ID NO:15040 | SEQ ID NO:23052 |

FIGURE 49
(Continued)

| iPS:436364 | 21-225_211A11 | NA | AGCTATGGCATGCAC | GTTCTTTGGTTTGATGGAAGTAATAGAAACTATGCAGACTCCGTGAAGGGC | GATCGGGGAGTGGGCTACTACGGTACGGACGTC |
| --- | --- | --- | --- | --- | --- |
| | | | SEQ ID NO:7029 | SEQ ID NO:15041 | SEQ ID NO:23053 |
| | | AA | SYGMH | VLWFDGSNRNYADSVKG | DRGVGYYGTDV |
| | | | SEQ ID NO:7030 | SEQ ID NO:15042 | SEQ ID NO:23054 |
| iPS:436366 | 21-225_211A3 | NA | AGTTATGGCATGCAC | GTTATATGGTATGATGGAAGTAATAAAAACTATGAAGACTCCGTGAAGGGC | GATGGGAGTTATGGTTACGACGGTATGGACGTC |
| | | | SEQ ID NO:7031 | SEQ ID NO:15043 | SEQ ID NO:23055 |
| | | AA | SYGMH | VIWYDGSNKNYEDSVKG | DGSYGYDGMDV |
| | | | SEQ ID NO:7032 | SEQ ID NO:15044 | SEQ ID NO:23056 |
| iPS:436368 | 21-225_211G3 | NA | AACTATGGCATGCAC | GTTATATGGCATGATGGAAGTAATAAATACTATGCAGACTCCGTGAAGGGC | TTAGACTACAGTAACTACGGGTGGTTCGACCCC |
| | | | SEQ ID NO:7033 | SEQ ID NO:15045 | SEQ ID NO:23057 |
| | | AA | NYGMH | VIWHDGSNKYYADSVKG | LDYSNYGWFDP |
| | | | SEQ ID NO:7034 | SEQ ID NO:15046 | SEQ ID NO:23058 |
| iPS:436370 | 21-225_211A6 | NA | AGCTATGGCATGCAC | GTTATATGGTATGATGGAAGTAATAAAAACTATGCAGACTCCGTGAAGGGC | GATAGGACGGTGGGCTATGATGGTTTTGATATC |
| | | | SEQ ID NO:7035 | SEQ ID NO:15047 | SEQ ID NO:23059 |
| | | AA | SYGMH | VIWYDGSNKNYADSVKG | DRTVGYDGFDI |

FIGURE 49
(Continued)

| | | | SEQ ID NO:7036 | SEQ ID NO:15048 | SEQ ID NO:23060 |
|---|---|---|---|---|---|
| iPS:436372 | 21-225_211A8 | NA | AGCTATGGCATGCAC | GTTATATGGTATGATGG AAGTAATGAACACTATG CAGACTCCGTGAAGGGC | GACCACGGTGTCGGGTACTA CGGTATGGACGTC |
| | | | SEQ ID NO:7037 | SEQ ID NO:15049 | SEQ ID NO:23061 |
| | | AA | SYGMH | VIWYDGSNEHYADSVKG | DHGVGYYGMDV |
| | | | SEQ ID NO:7038 | SEQ ID NO:15050 | SEQ ID NO:23062 |
| iPS:436374 | 21-225_211C10 | NA | AGGCATGGTATCAGC | TGGATCAGCGCTTACAA TGGTCTCACAAACTATGC ACAGAAGTTCCAGGGC | GATCCTACGGTGACCCACTA CTACTACTACGGTATGGACG TC |
| | | | SEQ ID NO:7039 | SEQ ID NO:15051 | SEQ ID NO:23063 |
| | | AA | RHGIS | WISAYNGLTNYAQKFQG | DPTVTHYYYGMDV |
| | | | SEQ ID NO:7040 | SEQ ID NO:15052 | SEQ ID NO:23064 |
| iPS:436376 | 21-225_212E6 | NA | AGCTATGGCATGCAC | GTTATATGGTATGATGG AAGTAATAAAAACTATG TAGACTCCGTGAAGGGC | GACTACGGTGTCGGGTACTA CGGTACGGACGTC |
| | | | SEQ ID NO:7041 | SEQ ID NO:15053 | SEQ ID NO:23065 |
| | | AA | SYGMH | VIWYDGSNKNYVDSVKG | DYGVGYYGTDV |
| | | | SEQ ID NO:7042 | SEQ ID NO:15054 | SEQ ID NO:23066 |
| iPS:436378 | 21-225_212D7 | NA | AGCTATGGCATGCAC | GTTATATGGTATGATGG AAGTAATAAAAATTATG CAGACTCCGTGAAGGGC | GACTACGGTGTCGGGTACTA CGGTACGGACGTC |
| | | | SEQ ID NO:7043 | SEQ ID NO:15055 | SEQ ID NO:23067 |
| | | AA | SYGMH | VIWYDGSNKNYADSVKG | DYGVGYYGTDV |

FIGURE 49
(Continued)

| | | | | | | |
|---|---|---|---|---|---|---|
| iPS:436380 | 21-225_212H9 | NA | SEQ ID NO:7044<br>AGCTATGGCATGCAC | SEQ ID NO:15056<br>GTTATATGGTATGATGG<br>AAGTAATGAACACTATG<br>CAGACTCCGTGAAGGGC | SEQ ID NO:23068<br>GACCACGGTGTCGGGTACTA<br>CGGTATGGACGTC |
| | | AA | SEQ ID NO:7045<br>SYGMH | SEQ ID NO:15057<br>VIWYDGSNEHYADSVKG | SEQ ID NO:23069<br>DHGVGYYGMDV |
| iPS:436382 | 21-225_212C10 | NA | SEQ ID NO:7046<br>AGCTATGGCATGCAC | SEQ ID NO:15058<br>GCTATATGGTATGATGG<br>AAGTCATAAATACTATA<br>CAGATTCCGTGAAGGGC | SEQ ID NO:23070<br>GATCGGAGTATAGTGGGAGC<br>TACCTACTTTGACTAC |
| | | AA | SEQ ID NO:7047<br>SYGMH | SEQ ID NO:15059<br>AIWYDGSHKYYTDSVKG | SEQ ID NO:23071<br>DRSIVGATYFDY |
| iPS:436384 | 21-225_212F10 | NA | SEQ ID NO:7048<br>AGATATGGCATGCAC | SEQ ID NO:15060<br>GTTATATGGTATGATGG<br>AAGTAAACACTATG<br>CAGACTCCGTGAAGGGC | SEQ ID NO:23072<br>GATCGGGAGTGGGCTACAA<br>CGGTATGGACGTC |
| | | AA | SEQ ID NO:7049<br>RYGMH | SEQ ID NO:15061<br>VIWYDGSNKHYADSVKG | SEQ ID NO:23073<br>DRGVGYNGMDV |
| iPS:436386 | 21-225_212B11 | NA | SEQ ID NO:7050<br>GACTATGTCATGCAC | SEQ ID NO:15062<br>GTTATATGGTATGATGG<br>AAGTAATAAATATTATG<br>CAGACTCCGTGAAGGGC | SEQ ID NO:23074<br>GAACGTTATAGCAGTGGCTG<br>GTACGACTACGGTATGGACG<br>TC |
| | | | SEQ ID NO:7051 | SEQ ID NO:15063 | SEQ ID NO:23075 |

FIGURE 49
(Continued)

| | | AA | DYVMH | VIWYDGSNKYYADSVKG | ERYSSGWYDYGMDV |
|---|---|---|---|---|---|
| iPS:436388 | 21-225_212H11 | | SEQ ID NO:7052 | SEQ ID NO:15064 | SEQ ID NO:23076 |
| | | NA | AGTTATGGCATGCAC | GTTATATGGTATGATGG AAGTAATAAAAACTATG AAGACTCCGTGAAGGGC | GATGGGAGTTATGGTTACGA CGGTATGGACGTC |
| | | AA | SEQ ID NO:7053 | SEQ ID NO:15065 | SEQ ID NO:23077 |
| | | | SYGMH | VIWYDGSNKNYEDSVKG | DGSYGYDGMDV |
| iPS:436390 | 21-225_213D2 | NA | SEQ ID NO:7054 | SEQ ID NO:15066 | SEQ ID NO:23078 |
| | | | AGCTATGGCATGCAC | GTTATATGGTATGATGG AAGTAATAAAAATTATG CAGACTCCGTGAAGGGC | GACTACGGTGTCGGGTACTA CGGTACGGACGTC |
| | | AA | SEQ ID NO:7055 | SEQ ID NO:15067 | SEQ ID NO:23079 |
| | | | SYGMH | VIWYDGSNKNYADSVKG | DYGVGYYGTDV |
| iPS:436392 | 21-225_213B3 | NA | SEQ ID NO:7056 | SEQ ID NO:15068 | SEQ ID NO:23080 |
| | | | AGCTATGGCATGCAC | GTTATATGGTATGATGG AAGTAATAAAAACTATG CAGACTCCGTGAAGGGC | GATAGGACGGTGGGCTATGA TGGTTTTGATATC |
| | | AA | SEQ ID NO:7057 | SEQ ID NO:15069 | SEQ ID NO:23081 |
| | | | SYGMH | VIWYDGSNKNYADSVKG | DRTVGYDGFDI |
| | | NA | SEQ ID NO:7058 | SEQ ID NO:15070 | SEQ ID NO:23082 |

FIGURE 49
(Continued)

| | | | | |
|---|---|---|---|---|
| iPS:436394 | 21-225_213C4 | NA | AGCTATGGCATGCAC | GTTATATGGTATGATGG AAGTAATAAACACTATG CAGACTCCGTGAAGGGC | GACTACGGTGTCGGGTACGA CGGTATGGACGTC |
| | | | SEQ ID NO:7059 | SEQ ID NO:15071 | SEQ ID NO:23083 |
| | | AA | SYGMH | VIWYDGSNKHYADSVKG | DYGVGYDGMDV |
| | | | SEQ ID NO:7060 | SEQ ID NO:15072 | SEQ ID NO:23084 |
| iPS:436396 | 21-225_213E5 | NA | AGTTATGGCATGCAC | GTTATATGGTATGATGG AAGTAATAAAACTATG AAGACTCCGTGAAGGGC | GATGGGAGTTATGGTTACGA CGGTATGGACGTC |
| | | | SEQ ID NO:7061 | SEQ ID NO:15073 | SEQ ID NO:23085 |
| | | AA | SYGMH | VIWYDGSNKNYEDSVKG | DGSYGYDGMDV |
| | | | SEQ ID NO:7062 | SEQ ID NO:15074 | SEQ ID NO:23086 |
| iPS:436398 | 21-225_213B8 | NA | AGCTATGGCATGCAC | GTTATATGGTATGATGG AAGTAATAAACACTATG CAGACTCCGTGAAGGGC | GACTACGGTGTCGGGTACTA CGGTACGGACGTC |
| | | | SEQ ID NO:7063 | SEQ ID NO:15075 | SEQ ID NO:23087 |
| | | AA | SYGMH | VIWYDGSNKHYADSVKG | DYGVGYYGTDV |
| | | | SEQ ID NO:7064 | SEQ ID NO:15076 | SEQ ID NO:23088 |
| iPS:436400 | 21-225_213H7 | NA | GGCTACCATATGCAC | TGGATCAATCCTAAGAG TGATGGCACAAACTATG CACAGAAGTTTCAGGGC | GAAAAGCCTGGGAGCTACTA CAAATAC |
| | | | SEQ ID NO:7065 | SEQ ID NO:15077 | SEQ ID NO:23089 |
| | | AA | GYHMH | WINPKSDGTNYAQKFQG | EKPGSYYKY |
| | | | SEQ ID NO:7066 | SEQ ID NO:15078 | SEQ ID NO:23090 |

FIGURE 49
(Continued)

| | | | | | |
|---|---|---|---|---|---|
| iPS:436402 | 21-225_213H12 | NA | AGCTATGGTATCAAC | TGGATCAGCGTTCACAATGGTAACACAGACTATGCACAGAAGTTCCAGGGC | GACTACTACTACGGTATGGACGTC |
| | | | SEQ ID NO:7067 | SEQ ID NO:15079 | SEQ ID NO:23091 |
| | | AA | SYGIN | WISVHNGNTDYAQKFQG | DYYYGMDV |
| | | | SEQ ID NO:7068 | SEQ ID NO:15080 | SEQ ID NO:23092 |
| iPS:436404 | 21-225_214C3 | NA | AGCTATGGCATGCAC | GTTTATATGGTATGATGGAAGTAATAAAAACTATGGAGACTCCGTGAAGGGC | GATCGGGGAGTGGGCTACGACGGAAATGGACGTC |
| | | | SEQ ID NO:7069 | SEQ ID NO:15081 | SEQ ID NO:23093 |
| | | AA | SYGMH | VIWYDGSNKNYGDSVKG | DRGVGYDGMDV |
| | | | SEQ ID NO:7070 | SEQ ID NO:15082 | SEQ ID NO:23094 |
| iPS:436406 | 21-225_214E4 | NA | AGCTATGGCATGCAC | GTTTATATGGTATGATGGAAGTAATGAAAACTATGCAGACTCCGTGAAGGGC | GATAGGACGGTGGGCTATGATGGTTGTGATATC |
| | | | SEQ ID NO:7071 | SEQ ID NO:15083 | SEQ ID NO:23095 |
| | | AA | SYGMH | VIWYDGSNENYADSVKG | DRTVGYDGCDI |
| | | | SEQ ID NO:7072 | SEQ ID NO:15084 | SEQ ID NO:23096 |
| iPS:436408 | 21-225_214H8 | NA | GGCCACTATATACAC | TGGATCAACTCTAACAGTGGTGCACAAACTATGCACAGAAGTTTCAGGGC | GACGGGAGATACAGCTATGGTTACGACTGGTTCGACCCC |
| | | | SEQ ID NO:7073 | SEQ ID NO:15085 | SEQ ID NO:23097 |
| | | AA | GHYIH | WINSNSGGTNYAQKFQG | DGRYSYGYDWFDP |
| | | | SEQ ID NO:7074 | SEQ ID NO:15086 | SEQ ID NO:23098 |

FIGURE 49
(Continued)

| | | | | | |
|---|---|---|---|---|---|
| iPS:436410 | 21-225_212E10 | NA | AGCTATGGCATGCAC | GTTATATGGTATGATGG AAGTAATAAATACTATG CAGACTCCGTGAAGGGC | GACTACGGTGTCGGGTACTA CGGTACGACGTC |
| | | AA | SEQ ID NO:7075<br>SYGMH | SEQ ID NO:15087<br>VIWYDGSNKYYADSVKG | SEQ ID NO:23099<br>DYGVGYYGTDV |
| iPS:436412 | 21-225_214H9 | NA | SEQ ID NO:7076<br>AGCTATGTCATGCAC | SEQ ID NO:15088<br>GTTATATGGTATGATGG AAGTAATAAATACTATG CAGACTCCGTGAAGGGC | SEQ ID NO:23100<br>GAGAGGTATACCAGCAGCTG GTACGACTACGGTATGGACG TC |
| | | AA | SEQ ID NO:7077<br>SYVMH | SEQ ID NO:15089<br>VIWYDGSNKYYADSVKG | SEQ ID NO:23101<br>ERYTSSWYDYGMDV |
| iPS:436414 | 21-225_214G10 | NA | SEQ ID NO:7078<br>GACTATGTCATGCAC | SEQ ID NO:15090<br>GTTATATGGTATGATGG AAGTAATAAATATTATG CAGACTCCGTGAAGGGC | SEQ ID NO:23102<br>GAACGTTATAGCAGTGGCTG GTACGACTACGGTATGGACG TC |
| | | AA | SEQ ID NO:7079<br>DYVMH | SEQ ID NO:15091<br>VIWYDGSNKYYADSVKG | SEQ ID NO:23103<br>ERYSSGWYDYGMDV |
| iPS:436416 | 21-225_214G12 | NA | SEQ ID NO:7080<br>GACTATGTCATGCAC | SEQ ID NO:15092<br>GTTATATGGTATGATGG AAGTAATAAATATTATG CAGACTCCGTGAAGGGC | SEQ ID NO:23104<br>GAACGTTATAGCAGTGGCTG GTACGACTACGGTATGGACG TC |
| | | AA | SEQ ID NO:7081<br>DYVMH | SEQ ID NO:15093<br>VIWYDGSNKYYADSVKG | SEQ ID NO:23105<br>ERYSSGWYDYGMDV |
| | | | SEQ ID NO:7082 | SEQ ID NO:15094 | SEQ ID NO:23106 |

FIGURE 49
(Continued)

| | | | | | |
|---|---|---|---|---|---|
| iPS:436418 | 21-225_215E3 | NA | GACTATGTCATACAC<br>SEQ ID NO:7083 | GTTATATGGTATGATGG<br>AAGTAATAAATATTATG<br>CAGACTCCGTGAAGGGC<br>SEQ ID NO:15095 | GAACGTTATAGCAGTGGCTG<br>GTACGACTACGGTATGGACG<br>TC<br>SEQ ID NO:23107 |
| | | AA | DYVIH<br>SEQ ID NO:7084 | VIWYDGSNKYYADSVKG<br>SEQ ID NO:15096 | ERYSSGWYDYGMDV<br>SEQ ID NO:23108 |
| iPS:436420 | 21-225_215B5 | NA | AGCTATGGCATGCAC<br>SEQ ID NO:7085 | GTTATATGGTATGATGG<br>AAGTAATAAAAATTATG<br>CAGACTCCGTGAAGGGC<br>SEQ ID NO:15097 | GACTACGGTGTCGGGTACTA<br>CGGTACGGACGTC<br>SEQ ID NO:23109 |
| | | AA | SYGMH<br>SEQ ID NO:7086 | VIWYDGSNKNYADSVKG<br>SEQ ID NO:15098 | DYGVGYYGTDV<br>SEQ ID NO:23110 |
| iPS:436422 | 21-225_215D6 | NA | AGCTATGGCATGCAC<br>SEQ ID NO:7087 | GTTATATGGTATGAGTGG<br>AAGTAATAAAAACTATG<br>CAGATTCCGTGAAGGGC<br>SEQ ID NO:15099 | GACTGCGGTGTCGGATACTA<br>CGGTACGGACGTC<br>SEQ ID NO:23111 |
| | | AA | SYGMH<br>SEQ ID NO:7088 | VIWYDGSNKNYADSVKG<br>SEQ ID NO:15100 | DCGVGYYGTDV<br>SEQ ID NO:23112 |
| iPS:436424 | 21-225_215H6 | NA | GGCCACTATATACAC<br>SEQ ID NO:7089 | TGGATCAACTCTAACAG<br>TGGTGGCACAAATTATG<br>CAGAGAAGTTTCAGGGC<br>SEQ ID NO:15101 | GACGGGAGATACAGCTATGG<br>TCACGACTGGTTCGACCCC<br>SEQ ID NO:23113 |
| | | AA | GHYIH<br>SEQ ID NO:7090 | WINSNSGGTNYAEKFQG<br>SEQ ID NO:15102 | DGRYSYGHDWFDP<br>SEQ ID NO:23114 |

FIGURE 49
(Continued)

| | | | | | |
|---|---|---|---|---|---|
| iPS:436426 | 21-225_215C7 | NA | TACTATGGCATGCAC | GTTATATGGCATGATGG AAGTAATAAATACTATG CAGACTCCGTGAAGGGC | TTAGACTACACAGTAATTACGG GTGGTTCGACCCCC |
| | | | SEQ ID NO:7091 | SEQ ID NO:15103 | SEQ ID NO:23115 |
| | | AA | YYGMH | VIWHDGSNKYYADSVKG | LDYSNYGWFDP |
| | | | SEQ ID NO:7092 | SEQ ID NO:15104 | SEQ ID NO:23116 |
| iPS:436428 | 21-225_215E11 | NA | GACTATGTCATGCAC | GTTATATGGTATGATGG AAGTAATAAATATTATG CAGACTCCGTGAAGGGC | GAACGTTATAGCAGTGGCTG GTACGACTACGGTATGGACG TC |
| | | | SEQ ID NO:7093 | SEQ ID NO:15105 | SEQ ID NO:23117 |
| | | AA | DYVMH | VIWYDGSNKYYADSVKG | ERYSSGWYDYGMDV |
| | | | SEQ ID NO:7094 | SEQ ID NO:15106 | SEQ ID NO:23118 |
| iPS:436430 | 21-225_215A12 | NA | AGCTATGGCATGCAC | GTTATATGGTATGATGG AATGAACACTATG CAGACTCCGTGAAGGGC | GATCGGGGAGTGGGCTACTA CGGTATGGACGTC |
| | | | SEQ ID NO:7095 | SEQ ID NO:15107 | SEQ ID NO:23119 |
| | | AA | SYGMH | VIWYDGSNEHYADSVKG | DRGVGYYGMDV |
| | | | SEQ ID NO:7096 | SEQ ID NO:15108 | SEQ ID NO:23120 |
| iPS:436432 | 21-225_215H12 | NA | AACTATGGCATGCAC | GTTATATGGCATGATGG AAGTAATAAATACTATG CAGACTCCGTGAAGGGC | TTAGACTACACAGTAACTACGG GTGGTTCGACCCCC |
| | | | SEQ ID NO:7097 | SEQ ID NO:15109 | SEQ ID NO:23121 |
| | | AA | NYGMH | VIWHDGSNKYYADSVKG | LDYSNYGWFDP |

FIGURE 49
(Continued)

| | | | | | | | |
|---|---|---|---|---|---|---|---|
| iPS:436434 | 21-225_216B10 | NA | SEQ ID NO:7098 AGCTATGGCATGCAC | SEQ ID NO:15110 GCTATATGGTATGATGG AAGTAATAAATACTATG CAGACTCCGTGAAGGGC | SEQ ID NO:23122 GATCCCAACATAGTGGGAGC TACTTGGTTTGACTAC |
| | | AA | SEQ ID NO:7099 SYGMH | SEQ ID NO:15111 AIWYDGSNKYYADSVKG | SEQ ID NO:23123 DPNIVGATWFDY |
| iPS:436436 | 21-225_216F10 | NA | SEQ ID NO:7100 AGCTATAGCATGAAC | SEQ ID NO:15112 TACATTACTGGTAGTAGT AGTACCATATACTACGC AGACTCTGTGAAGGGC | SEQ ID NO:23124 TCGGGTTTAGCAGTGGAGGA CTAC |
| | | AA | SEQ ID NO:7101 SYSMN | SEQ ID NO:15113 YITGSSSTIYYADSVKG | SEQ ID NO:23125 SGLAVEDY |
| iPS:436438 | 21-225_216E8 | NA | SEQ ID NO:7102 GACTATGTCATGCAC | SEQ ID NO:15114 GTTATATGGTATGATGG AAGTAATAAATATTATG CAGACTCCGTGAAGGGC | SEQ ID NO:23126 GAACGTTATAGCAGTGGCTG GTACGACTACGGTATGGACG TC |
| | | AA | SEQ ID NO:7103 DYVMH | SEQ ID NO:15115 VIWYDGSNKYYADSVKG | SEQ ID NO:23127 ERYSSGWYDYGMDV |
| iPS:436440 | 21-225_216H12 | NA | SEQ ID NO:7104 GACTATGTCATGCAC | SEQ ID NO:15116 GTTATATGGTATGATGG AAGTAATAAATATTATG CAGACTCCGTGAAGGGC | SEQ ID NO:23128 GAACGTTATAGCAGTGGCTG GTACGACTACGGTATGGACG TC |
| | | AA | SEQ ID NO:7105 DYVMH | SEQ ID NO:15117 VIWYDGSNKYYADSVKG | SEQ ID NO:23129 ERYSSGWYDYGMDV |
| | | | SEQ ID NO:7106 | SEQ ID NO:15118 | SEQ ID NO:23130 |

FIGURE 49
(Continued)

| | | | AGCTATAATATGAAC | TACATTAGTAGTAGTCGT AATATCATATATTACGCA GACTCTGTGAAGGGC | GATGGCTCTTATAGCAGTGG CTGGTACTGGGGTTTGACT AC |
|---|---|---|---|---|---|
| iPS:436448 | 21-225_217A3 | NA | | SEQ ID NO:15119 | SEQ ID NO:23131 |
| | | AA | SYNMN | YISSSRNIIYYADSVKG | DGSYSSGWYWGFDY |
| | | | SEQ ID NO:7107 | SEQ ID NO:15120 | SEQ ID NO:23132 |
| | | | SEQ ID NO:7108 | | |
| iPS:436450 | 21-225_217E5 | NA | GACTATGTCATGCAC | GTTATATGGTATGATGG AAGTAATAAATATTATG CAGACTCCGTGAAGGGC | GAACGTTATAGCAGTGGCTG GTACGACTACGGTATGGACG TC |
| | | | SEQ ID NO:7109 | SEQ ID NO:15121 | SEQ ID NO:23133 |
| | | AA | DYVMH | VIWYDGSNKYYADSVKG | ERYSSGWYDYGMDV |
| | | | SEQ ID NO:7110 | SEQ ID NO:15122 | SEQ ID NO:23134 |
| iPS:436452 | 21-225_217G5 | NA | AGCAATGGCATGCAC | GTTATATGGTATGATGG AAGTAATAAAAACTATG CAGACTCCGTGAAGGGC | GACTACGGTGTCGGGTACTA CGGTCTCGGACGTC |
| | | | SEQ ID NO:7111 | SEQ ID NO:15123 | SEQ ID NO:23135 |
| | | AA | SNGMH | VIWYDGSNKNYADSVKG | DYGVGYYGLDV |
| | | | SEQ ID NO:7112 | SEQ ID NO:15124 | SEQ ID NO:23136 |
| iPS:436454 | 21-225_217B10 | NA | AGTTATGGCATGCAC | GTTATATGGTATGATGG AAGTAATAAAAACTATG AAGACTCCGTGAAGGGC | GATGGGAGTTATGTTACGA CGGTATGGACGTC |
| | | | SEQ ID NO:7113 | SEQ ID NO:15125 | SEQ ID NO:23137 |
| | | AA | SYGMH | VIWYDGSNKNYEDSVKG | DGSYGYDGMDV |
| | | | SEQ ID NO:7114 | SEQ ID NO:15126 | SEQ ID NO:23138 |

FIGURE 49
(Continued)

| | | | | |
|---|---|---|---|---|
| iPS:436456 | 21-225_217G10 | NA | GACTATGTCATGCAC SEQ ID NO:7115 | GTTATATGGTATGATGG AAGTAATAAATATTATG CAGACTCCGTGAAGGGC SEQ ID NO:15127 | GAACGTTATAGCAGTGGCTG GTACGACTACGGTATGGACG TC SEQ ID NO:23139 |
| | | AA | DYVMH SEQ ID NO:7116 | VIWYDGSNKYYADSVKG SEQ ID NO:15128 | ERYSSGWYDYGMDV SEQ ID NO:23140 |
| iPS:436458 | 21-225_217H12 | NA | GACTATGTCATGCAC SEQ ID NO:7117 | GTTATATGGTATGATGG AAGTAATAAATATTATG CAGACTCCGTGAAGGGC SEQ ID NO:15129 | GAACGTTATAGCAGTGGCTG GTACGACTACGGTATGGACG TC SEQ ID NO:23141 |
| | | AA | DYVMH SEQ ID NO:7118 | VIWYDGSNKYYADSVKG SEQ ID NO:15130 | ERYSSGWYDYGMDV SEQ ID NO:23142 |
| iPS:436462 | 21-225_218C4 | NA | GACTATGTCATGCAC SEQ ID NO:7119 | GTTATATGGTATGATGG AAGTAATAAATATTATG CAGACTCCGTGAAGGGC SEQ ID NO:15131 | GAACGTTATAGCAGTGGCTG GTACGACTACGGTATGGACG TC SEQ ID NO:23143 |
| | | AA | DYVMH SEQ ID NO:7120 | VIWYDGSNKYYADSVKG SEQ ID NO:15132 | ERYSSGWYDYGMDV SEQ ID NO:23144 |
| iPS:436464 | 21-225_219H1 | NA | AGATATGGCATGCAC SEQ ID NO:7121 | GTTATATGGTATGATGG AAGTAATAAACACTATG CAGACTCCGTGAAGGGC SEQ ID NO:15133 | GATCGGGGAGTGGGCTACAA CGGTATGGACGTC SEQ ID NO:23145 |
| | | AA | RYGMH SEQ ID NO:7122 | VIWYDGSNKHYADSVKG SEQ ID NO:15134 | DRGVGYNGMDV SEQ ID NO:23146 |

FIGURE 49
(Continued)

| | | | | |
|---|---|---|---|---|
| iPS:436472 | 21-225_220E1 | NA | ACTTACTACTGGAGC | TATATCTATTACAGTGGG ACCACCAACTACAACCC CTCCCTCAAGAGT | GACCAGCAGTGGCTGGTACG TGGGAGGGACAACTACTACT ACGGTATGGACGTC |
| | | AA | TYYWS SEQ ID NO:7123 | YIYYSGTTNYNPSLKS SEQ ID NO:15135 | DQQWLVRGRDNYYYGMDV SEQ ID NO:23147 |
| | | | SEQ ID NO:7124 | SEQ ID NO:15136 | SEQ ID NO:23148 |
| iPS:436480 | 21-225_220F8 | NA | GACTATGTCATGCAC | GTTATATGGTATGATGG AAGTAATAAATATTATG CAGACTCCGTGAAGGGC | GAACGTTATAGCAGTGGCTG GTACGACTACGGTATGGACG TC |
| | | AA | DYVMH SEQ ID NO:7125 | VIWYDGSNKYYADSVKG SEQ ID NO:15137 | ERYSSGWYDYGMDV SEQ ID NO:23149 |
| | | | SEQ ID NO:7126 | SEQ ID NO:15138 | SEQ ID NO:23150 |
| iPS:436488 | 21-225_221A6 | NA | GGCTACTATATGCAC | TGGATCCACCCTAACAG TGGTGGCACAAACTATG CACAGAAATTTCAGGGC | GATGGGACCAGCTCGTTTGA CTAC |
| | | AA | GYYMH SEQ ID NO:7127 | WIHPNSGGTNYAQKFQG SEQ ID NO:15139 | DGTSSFDY SEQ ID NO:23151 |
| | | | SEQ ID NO:7128 | SEQ ID NO:15140 | SEQ ID NO:23152 |
| iPS:436490 | 21-225_221F6 | NA | AGCAATGGCATGCAC | GTTATATGGTACGATGG AAGTAATGAAAACTATG CAGACTCCGTGAAGGGC | GATCGGACAGTGGGCTACAA CGGTATGGACGTC |
| | | AA | SNGMH SEQ ID NO:7129 | VIWYDGSNENYADSVKG SEQ ID NO:15141 | DRTVGYNGMDV SEQ ID NO:23153 |
| | | | SEQ ID NO:7130 | SEQ ID NO:15142 | SEQ ID NO:23154 |
| iPS:436496 | 21_225_222E1 | NA | GGCTACTATATGCAC | TGGATCCACCCTAACAG TGGTGGCACAAACTATG CACAGAAATTTCAGGGC | GATGGGACCAGCTCGTTTGA CTAC |

FIGURE 49
(Continued)

| | | | | | | |
|---|---|---|---|---|---|---|
| iPS-436500 | 21-225_222E1 | AA | SEQ ID NO:7131<br>GYYMH | SEQ ID NO:15143<br>WIHPNSGGTNYAQKFQG | SEQ ID NO:23155<br>DGTSSFDY | |
| | | NA | SEQ ID NO:7132<br>AGCTATGGTATCAAC | SEQ ID NO:15144<br>TGGATCAGCGTTTACAAT<br>GGTAACACAAACTATGC<br>ACAGAAGCTCCAGGGC | SEQ ID NO:23156<br>GACTACTACGGTTTTGA<br>CGTC | |
| iPS-436502 | 21-225_222H3 | AA | SEQ ID NO:7133<br>SYGIN | SEQ ID NO:15145<br>WISVYNGNTNYAQKLQG | SEQ ID NO:23157<br>DYYYGFDV | |
| | | NA | SEQ ID NO:7134<br>AGCTATGGCATGCAC | SEQ ID NO:15146<br>GTTATATGGTATGATGG<br>AAGTAATAAAAACTATG<br>CAGACTCCGTGAAGGGC | SEQ ID NO:23158<br>GATCGGGATGTCGGGTACAA<br>CGGTATGGACGTC | |
| iPS-436504 | 21-225_222A11 | AA | SEQ ID NO:7135<br>SYGMH | SEQ ID NO:15147<br>VIWYDGSNKNYADSVKG | SEQ ID NO:23159<br>DRDVGYNGMDV | |
| | | NA | SEQ ID NO:7136<br>AACTTTGCCATGAGT | SEQ ID NO:15148<br>AGTATTGTTGGTAGTGGT<br>GGTCGCACGTACTACGC<br>AGACTCCGTGAAGGGC | SEQ ID NO:23160<br>GACCCTTATCGTGTAGCAGT<br>GGCTGGGGCCTTTGACTAC | |
| | 21-225_222H4 | AA | SEQ ID NO:7137<br>NFAMS | SEQ ID NO:15149<br>SIVGSGGRTYYADSVKG | SEQ ID NO:23161<br>DPYRVAVAGAFDY | |
| iPS-436506 | | NA | SEQ ID NO:7138<br>GGTCGCTACTGGAGC | SEQ ID NO:15150<br>GAAATCAATCATAGTGG<br>AAGCGCCAACTACAACC<br>CGTCCCTCAAGAGT | SEQ ID NO:23162<br>GACTACGGCGCCCTTGATTT<br>C | |
| | 21-225_222C7 | AA | SEQ ID NO:7139<br>GRYWS | SEQ ID NO:15151<br>EINHSGSANYNPSLKS | SEQ ID NO:23163<br>DYGALDF | |

FIGURE 49
(Continued)

| | | | | |
|---|---|---|---|---|
| iPS-436508 | 21-225_222F7 | NA | SEQ ID NO:7140<br>GGCTACTATATGCAC | SEQ ID NO:15152<br>TGGATCCACCCTAACAG<br>TGGTGGCACAAACTATG<br>CACAGAAATTTCAGGGC | SEQ ID NO:23164<br>GATGGGACCAGCTCGTTTGA<br>CTAC |
| | | AA | SEQ ID NO:7141<br>GYYMH | SEQ ID NO:15153<br>WIHPNSGGTNYAQKFQG | SEQ ID NO:23165<br>DGTSSFDY |
| iPS-436510 | 21-225_222H8 | NA | SEQ ID NO:7142<br>AACTTTGCCATGAGT | SEQ ID NO:15154<br>AGTATTGTTGGTAGTGGT<br>GGTCGCACGTACTACGC<br>AGACTCCGTGAAGGGC | SEQ ID NO:23166<br>GACCCTTATCGTGTAGCAGT<br>GGCTGGGGCCTTTGACTAC |
| | | AA | SEQ ID NO:7143<br>NFAMS | SEQ ID NO:15155<br>SIVGSGGRTYADSVKG | SEQ ID NO:23167<br>DPYRVAVAGAFDY |
| iPS-436514 | 21-225_222D10 | NA | SEQ ID NO:7144<br>AGCTATGGCATGCAC | SEQ ID NO:15156<br>GTTATATGGTATGATGG<br>AAGTAATAAAAACTATG<br>CAGACTCCGTGAAGGGC | SEQ ID NO:23168<br>GATCGGGATGTGCGGGTACAA<br>CGGTATGGACGTC |
| | | AA | SEQ ID NO:7145<br>SYGMH | SEQ ID NO:15157<br>VIWYDGSNKNYADSVKG | SEQ ID NO:23169<br>DRDVGYNGMDV |
| iPS-436516 | 21-225_222C12 | NA | SEQ ID NO:7146<br>GGCTACTATATGCAC | SEQ ID NO:15158<br>TGGATCCACCCTAACAG<br>TGGTGGCACAAACTATG<br>CACAGAAATTTCAGGGC | SEQ ID NO:23170<br>GATGGGACCAGCTCGTTTGA<br>CTAC |
| | | AA | SEQ ID NO:7147<br>GYYMH | SEQ ID NO:15159<br>WIHPNSGGTNYAQKFQG | SEQ ID NO:23171<br>DGTSSFDY |
| | | | SEQ ID NO:7148 | SEQ ID NO:15160 | SEQ ID NO:23172 |

FIGURE 49
(Continued)

| | | | | |
|---|---|---|---|---|
| iPS:436520 | 21-225_223G10 | NA | AGCTATGGTATCAAC SEQ ID NO:7149 | TGGATCAGCGTTTACAGTGGTAACACAAACTATGCACAGAAGCTCCAGGGC SEQ ID NO:15161 | GACTACTACTACGGTATGGACGTC SEQ ID NO:23173 |
| | | AA | SYGIN SEQ ID NO:7150 | WISVYSGNTNYAQKLQG SEQ ID NO:15162 | DYYYGMDV SEQ ID NO:23174 |
| iPS:436522 | 21-225_223H10 | NA | AGCTATGGCATGCAC SEQ ID NO:7151 | GTTATATGGTATGATGGAAGTAATAAAAACTATGCAGACTCCGTGAAGGGC SEQ ID NO:15163 | GATCGGGATGTCGGGTACAACGGTATGGACGTC SEQ ID NO:23175 |
| | | AA | SYGMH SEQ ID NO:7152 | VIWYDGSNKNYADSVKG SEQ ID NO:15164 | DRDVGYNGMDV SEQ ID NO:23176 |
| iPS:436526 | 21-225_224A1 | NA | AGCTATGCCATGAGC SEQ ID NO:7153 | GCTATTAGTGGCAGAGGCGGCAGCACATACTACGCAGACGCCCGTGAAGGGC SEQ ID NO:15165 | GGCTCCTACGATAGTAGTGGTTATTACCACTACTAGACCAC SEQ ID NO:23177 |
| | | AA | SYAMS SEQ ID NO:7154 | AISGRGGSTYYADAVKG SEQ ID NO:15166 | GSYDSSGYYHYLDH SEQ ID NO:23178 |
| iPS:436528 | 21-225_224B1 | NA | AGCTATGCCATGAGC SEQ ID NO:7155 | GCTATTAGTGGTGGTAGTGGTGGTAACACATACTACGCAGACTCCGTGAAGGGC SEQ ID NO:15167 | GAGGGGGGCTACTACTATTACTACGGTGTGGACGTC SEQ ID NO:23179 |
| | | AA | SYAMS SEQ ID NO:7156 | AISGSGGNTYYADSVKG SEQ ID NO:15168 | EGGYYYYGVDV SEQ ID NO:23180 |

FIGURE 49
(Continued)

| | | | | | |
|---|---|---|---|---|---|
| iPS:436534 | 21-225_224F1 | NA | AGCTATATCATGCAC | GTTATATGGTATGATGG AAGTAATAAATACTATG CAGACTCCGTGAAGGGC | GAGAGGTATAGCAGCAACTG GTACGACTACGGTATGGACG TC |
| | | | SEQ ID NO:7157 | SEQ ID NO:15169 | SEQ ID NO:23181 |
| | | AA | SYIMH | VIWYDGSNKYYADSVKG | ERYSSNWYDYGMDV |
| | | | SEQ ID NO:7158 | SEQ ID NO:15170 | SEQ ID NO:23182 |
| iPS:436536 | 21-225_224G1 | NA | GGCTACTATATACAC | TGGATCAACCCTTACAGT GGTGACACAAACTATGC ACAGAAGTTTCAGGGC | GATTGGGGTGGCTACAGTTC TTACTACTACGGTATGGACG TC |
| | | | SEQ ID NO:7159 | SEQ ID NO:15171 | SEQ ID NO:23183 |
| | | AA | GYYIH | WINPYSGDTNYAQKFQG | DWGGYSSYYYGMDV |
| | | | SEQ ID NO:7160 | SEQ ID NO:15172 | SEQ ID NO:23184 |
| iPS:436538 | 21-225_224C3 | NA | AGAAGTAGTTACTACTGGGG C | AATATCTATTATAGTGGG AGCACTACTACAACCC GTCCCTCAAGAGT | CAGGGTCGGGACTGGGGTGT TGACTAC |
| | | | SEQ ID NO:7161 | SEQ ID NO:15173 | SEQ ID NO:23185 |
| | | AA | RSSYYWG | NIYYSGSTYYNPSLKS | QGRDWGVDY |
| | | | SEQ ID NO:7162 | SEQ ID NO:15174 | SEQ ID NO:23186 |
| iPS:436540 | 21-225_224F3 | NA | AGCTATGGCATGCAC | GTTATATGGTATGATGG AAGTAATAAATACTATG CAGACTCCGTGAAGGGC | GAGAGGTATAGCAGCAGCTG GTACGACTACGGTATGGACG TC |
| | | | SEQ ID NO:7163 | SEQ ID NO:15175 | SEQ ID NO:23187 |
| | | AA | SYGMH | VIWYDGSNKYYADSVKG | ERYSSSWYDYGMDV |
| | | | SEQ ID NO:7164 | SEQ ID NO:15176 | SEQ ID NO:23188 |

FIGURE 49
(Continued)

| | | | | | |
|---|---|---|---|---|---|
| iPS:436544 | 21-225_224H5 | NA | AATTATGATATCAAC | TGGATGAACCCTAACAGTGGTAACACAGGCTATGCACAGAAGTTCCAGGGC | TCCAGTGGCTGGAACTGGTTCGACCCC |
| | | | SEQ ID NO:7165 | SEQ ID NO:15177 | SEQ ID NO:23189 |
| | | AA | NYDIN | WMNPNSGNTGYAQKFQG | SSGWNWFDP |
| | | | SEQ ID NO:7166 | SEQ ID NO:15178 | SEQ ID NO:23190 |
| iPS:436546 | 21-225_224D6 | NA | AGCGATGCCATGAGC | GCTATTAGTGGTAGTGGTGATAACACATTCTACGCAGACTCCGTGAAGGGC | GTCTATAGTGCCTACGATTCTCACTGGTTCGACCCC |
| | | | SEQ ID NO:7167 | SEQ ID NO:15179 | SEQ ID NO:23191 |
| | | AA | SDAMS | AISGSGDNTFYADSVKG | VYSAYDSHWFDP |
| | | | SEQ ID NO:7168 | SEQ ID NO:15180 | SEQ ID NO:23192 |
| iPS:436548 | 21-225_224A7 | NA | GGCTACTATATACAC | TGGATCAACCCTTACAGTGGTGACACAAAACTATGCACAGAAGTTCAGGGC | GATTGGGGTGGCTACAGTTCTTACTACTACGGTATGGACGTC |
| | | | SEQ ID NO:7169 | SEQ ID NO:15181 | SEQ ID NO:23193 |
| | | AA | GYYIH | WINPYSGDTNYAQKFQG | DWGGYSSYYYGMDV |
| | | | SEQ ID NO:7170 | SEQ ID NO:15182 | SEQ ID NO:23194 |
| iPS:436550 | 21-225_224D8 | NA | AATTATGATATCAAC | TGGTTGTACCCTAACAGTGGTAACACAGGCTATGCACAGAAGTTCCAGGGC | AGCAGTGGCTGGTACTACTTTGACTAC |
| | | | SEQ ID NO:7171 | SEQ ID NO:15183 | SEQ ID NO:23195 |
| | | AA | NYDIN | WLYPNSGNTGYAQKFQG | SSGWYYFDY |
| | | | SEQ ID NO:7172 | SEQ ID NO:15184 | SEQ ID NO:23196 |
| iPS:436554 | 21-225_224C10 | NA | AATTATGATATCAAC | TGGATGCACCCTAACAGTGGTAACACAGGCTATGCACAGAAGTTCCAGGGC | AGCAGTGGCTGGTACAAGTTTGACTAC |
| | | | SEQ ID NO:7173 | SEQ ID NO:15185 | SEQ ID NO:23197 |

FIGURE 49
(Continued)

| | | AA | NYDIN | | WMHPNSGNTGYAQKFQG | | SSGWYKFDY | |
|---|---|---|---|---|---|---|---|---|
| iPS:436556 | | | | SEQ ID NO:7174 | | SEQ ID NO:15186 | | SEQ ID NO:23198 |
| | 21-225_224D10 | NA | AGCTATGGCATGCAC | | GTTATATGGTATGAGGG AAGTAATAAATACTATG TAGACTCCGTGAGGGGC | | GAGCTAGGCTTCCAGTCTGA CTAC | |
| | | AA | SYGMH | | VIWYEGSNKYYVDSVRG | | ELGFQSDY | |
| | | | | SEQ ID NO:7175 | | SEQ ID NO:15187 | | SEQ ID NO:23199 |
| iPS:436558 | | NA | GGCTACTATATACAC | SEQ ID NO:7176 | TGGATCAACCCTACAGT GGTGACACACAAACTATGC ACAGAAGTTTCAGGGC | SEQ ID NO:15188 | GATTGGGGTGGCTACAGTTC TTACTACTTCGGTATGGACG TC | SEQ ID NO:23200 |
| | 21-225_224C11 | AA | GYYIH | SEQ ID NO:7177 | WINPYSGDTNYAQKFQG | SEQ ID NO:15189 | DWGGYSSYYFGMDV | SEQ ID NO:23201 |
| | | | | SEQ ID NO:7178 | | SEQ ID NO:15190 | | SEQ ID NO:23202 |
| iPS:436560 | | NA | AATTATGATATCAAC | | TGGATGAACCCTAACAG TGGTAACACAGGCTATG CACAGAAGTTCCAGGGC | | AGCAGTGGCTGGTACAAGTT TGACTAC | |
| | 21-225_224F11 | AA | NYDIN | SEQ ID NO:7179 | WMNPNSGNTGYAQKFQG | SEQ ID NO:15191 | SSGWYKFDY | SEQ ID NO:23203 |
| | | | | SEQ ID NO:7180 | | SEQ ID NO:15192 | | SEQ ID NO:23204 |
| iPS:436562 | | NA | GGCTACTATATACAC | | TGGATCAACCCTACAGT GGTGACACAAAACTATGC ACAGAAGTTTCAGGGC | | GATTGGGGTGGCTACAGTTC TTACTACTACGGTATGGACG TC | |
| | 21-225_224H11 | AA | GYYIH | SEQ ID NO:7181 | WINPYSGDTNYAQKFQG | SEQ ID NO:15193 | DWGGYSSYYYGMDV | SEQ ID NO:23205 |
| | | | | SEQ ID NO:7182 | | SEQ ID NO:15194 | | SEQ ID NO:23206 |

FIGURE 49
(Continued)

| | | | | | |
|---|---|---|---|---|---|
| iPS:436564 | 21-225_225A1 | NA | GACTATGTCATCCAC | GTTATATGGTGTATGATGG AAGTAATAAATACTATG CAGACTCCGTGAAGGGC | GAGAGGTATAGCAGTGGCTG GTACGACTACGGTATGGACG TC |
| | | | SEQ ID NO:7183 | SEQ ID NO:15195 | SEQ ID NO:23207 |
| | | AA | DYVIH | VIWYDGSNKYYADSVKG | ERYSSGWYDYGMDV |
| | | | SEQ ID NO:7184 | SEQ ID NO:15196 | SEQ ID NO:23208 |
| iPS:436568 | 21-225_225B3 | NA | AGCTACTATATGCAC | ATAATCAACCCTAGTGG TGGTAGCACAAGCTACG CACAGAAGTTCCAGGGC | GATTTAGCAGCTCGTTCTTA CTACTACTACTTCGGTATGG ACGTC |
| | | | SEQ ID NO:7185 | SEQ ID NO:15197 | SEQ ID NO:23209 |
| | | AA | SYYMH | IINPSGGSTSYAQKFQG | DLAARSYYYFPGMDV |
| | | | SEQ ID NO:7186 | SEQ ID NO:15198 | SEQ ID NO:23210 |
| iPS:436570 | 21-225_225F4 | NA | AATTATGATATCAAC | TGGATGCACCCTAACAG TGGTAGCACAGGCTATG CACAGAAGTTCCAGGGC | AGCAGTGGCTGGTACTGGTT CGACCCC |
| | | | SEQ ID NO:7187 | SEQ ID NO:15199 | SEQ ID NO:23211 |
| | | AA | NYDIN | WMHPNSGSTGYAQKFQG | SSGWYWFDP |
| | | | SEQ ID NO:7188 | SEQ ID NO:15200 | SEQ ID NO:23212 |
| iPS:436572 | 21-225_225G4 | NA | GGCTACTATATACAC | TGGATCAACCCTTACAGT GGTGACACAAACTATGC ACAGAAGTTTCAGGGC | GATTGGGGTGGCTACAGTTC TTACTACTACGGTATGGACG TC |
| | | | SEQ ID NO:7189 | SEQ ID NO:15201 | SEQ ID NO:23213 |
| | | AA | GYYIH | WINPYSGDTNYAQKFQG | DWGGYSSYYYGMDV |
| | | | SEQ ID NO:7190 | SEQ ID NO:15202 | SEQ ID NO:23214 |
| iPS:436574 | | NA | AATTATGATATCAAC | TGGATGCATCTAACAG TGGTAACACAGGCTTTG CACAGAAGTTCCAGGGC | AGCAGTGGCTGGTACCGCTT TGACTAC |

FIGURE 49
(Continued)

| | | | | | | |
|---|---|---|---|---|---|---|
| | 21-225_225F5 | AA | SEQ ID NO:7191<br>NYDIN | SEQ ID NO:15203<br>WMHPNSGNTGFAQKFQG | SEQ ID NO:23215<br>SSGWYRFDY |
| iPS:436576 | | NA | SEQ ID NO:7192<br>GACTATGGCATGCAC | SEQ ID NO:15204<br>GTTATATGGTATGATGA<br>AAATAATAAATACTATG<br>CAGACTCCGTGAAGGGC | SEQ ID NO:23216<br>GAAGTGGGATTCACTGAGGA<br>CTAC |
| | 21-225_225B6 | AA | SEQ ID NO:7193<br>DYGMH | SEQ ID NO:15205<br>VIWYDENNKYYADSVKG | SEQ ID NO:23217<br>EVGFTEDY |
| iPS:436578 | | NA | SEQ ID NO:7194<br>AACTATGGCATGCAC | SEQ ID NO:15206<br>GTTATATGGTATGATGA<br>AAATAATAAATACTATG<br>CAGACTCCGTGAAGGGC | SEQ ID NO:23218<br>GAAGTGGGATTCACTGAGGA<br>CTAC |
| | 21-225_225D6 | AA | SEQ ID NO:7195<br>NYGMH | SEQ ID NO:15207<br>VIWYDENNKYYADSVKG | SEQ ID NO:23219<br>EVGFTEDY |
| iPS:436580 | | NA | SEQ ID NO:7196<br>AGTGGTCATTACTACTGGAG<br>C | SEQ ID NO:15208<br>TTCATCTATTACACTGGG<br>AGCACCTACTACAACCC<br>GTCCCTCAAGAGT | SEQ ID NO:23220<br>GAGGCCGGTGACTACGGCTA<br>CTACGGTATGGACGTC |
| | 21-225_225E7 | AA | SEQ ID NO:7197<br>SGHYYWS | SEQ ID NO:15209<br>FIYYTGSTYYNPSLKS | SEQ ID NO:23221<br>EAGDYGYYGMDV |
| iPS:436582 | 21_225_225F8 | NA | SEQ ID NO:7198<br>AGCTATGGCATGCAC | SEQ ID NO:15210<br>GTTATATGGTATGATGA<br>AAATAATAAATACTATG<br>TAGACTCCGTGAAGGGC | SEQ ID NO:23222<br>GAAGTGGGATTTACTGAGGA<br>CTAC |

FIGURE 49
(Continued)

| | | | SEQ ID NO:7199<br>SYGMH | SEQ ID NO:15211<br>VIWYDENNKYYVDSVKG | SEQ ID NO:23223<br>EVGFTEDY |
|---|---|---|---|---|---|
| iPS:436584 | 21-225_225F8 | AA | | | |
| | | NA | SEQ ID NO:7200<br>AATTATGATATCAAC | SEQ ID NO:15212<br>TGGATGCACCCTAACAG<br>TGGTAACACAGGCTATG<br>CACAGAAGTTCCGGGGC | SEQ ID NO:23224<br>AGCAGTGGCTGGACCCTTTT<br>TGACTAC |
| iPS:436586 | 21-225_225B9 | AA | SEQ ID NO:7201<br>NYDIN | SEQ ID NO:15213<br>WMHPNSGNTGYAQKFRG | SEQ ID NO:23225<br>SSGWTLFDY |
| | | NA | SEQ ID NO:7202<br>AATTATGATATCAAC | SEQ ID NO:15214<br>TGGATGCACCCTAACAG<br>TGGTAACACAGGCTATG<br>CACAGAAGTTCCAGGGC | SEQ ID NO:23226<br>AGCAGTGGCTGGTACCGCTT<br>TGACTAC |
| iPS:436588 | 21-225_225F11 | AA | SEQ ID NO:7203<br>NYDIN | SEQ ID NO:15215<br>WMHPNSGNTGYAQKFQG | SEQ ID NO:23227<br>SSGWYRFDY |
| | | NA | SEQ ID NO:7204<br>CATTATGATATCAAC | SEQ ID NO:15216<br>TGGATGCACCCAAACAG<br>TGTAACACAGGCTATG<br>CACAGAAGTTCCAGGGC | SEQ ID NO:23228<br>AGCAGTGGCTGGTACAAGTT<br>TGACTAC |
| iPS:436590 | 21-225_225F12 | AA | SEQ ID NO:7205<br>HYDIN | SEQ ID NO:15217<br>WMHPNSGNTGYAQKFQG | SEQ ID NO:23229<br>SSGWYKFDY |
| | | NA | SEQ ID NO:7206<br>AATTATGATATCAAC | SEQ ID NO:15218<br>TGGATGCACCCTAACAG<br>TGGTAACACAGGCTATG<br>CACAGAAGTTCCAGGGC | SEQ ID NO:23230<br>AGCAGTGGCTGGTACAAGTT<br>TGACTAC |
| | 21-225_225H12 | | SEQ ID NO:7207 | SEQ ID NO:15219 | SEQ ID NO:23231 |

FIGURE 49
(Continued)

| | | AA | NYDIN | | WMHPNSGNTGYAQKFQG | SSGWYKFDY |
|---|---|---|---|---|---|---|
| iPS:436592 | | | SEQ ID NO:7208 | | SEQ ID NO:15220 | SEQ ID NO:23232 |
| | 21-225_226B1 | NA | ACCTATGGCATGCAC | | ATTATATGGTATGATGG AGGTTATAAATACTATG CAGACTCCGTGAAGGGC | GATCACTACGATTTTTGGAG TGGTTATCTTACCCAC |
| | | | | | SEQ ID NO:15221 | SEQ ID NO:23233 |
| | | AA | TYGMH | | IIWYDGGYKYYADSVKG | DHYDFWSGYLTH |
| | | | SEQ ID NO:7210 | | SEQ ID NO:15222 | SEQ ID NO:23234 |
| iPS:436594 | 21-225_226A5 | NA | AACTATGGCATGCAC | | ATTATATGGTATGATGG AACTAATAAATACTATA CAGACTCCGTGAAGGGC | GAGGGTCACGATTTTTGGAG TGGCTTTTTTGTTAC |
| | | | SEQ ID NO:7211 | | SEQ ID NO:15223 | SEQ ID NO:23235 |
| | | AA | NYGMH | | IIWYDGTNKYYTDSVKG | EGHDFWSGFFCY |
| | | | SEQ ID NO:7212 | | SEQ ID NO:15224 | SEQ ID NO:23236 |
| iPS:436596 | 21-225_226C6 | NA | GACTATGGCATGCAC | | GTTATATGGTATGATGG AAGTAATAAATACTATG CAGACTCCGTGAAGGGC | GAGAGGTATAGCAGCAGCTG GTACGACTACGGTATGGACG TC |
| | | | SEQ ID NO:7213 | | SEQ ID NO:15225 | SEQ ID NO:23237 |
| | | AA | DYGMH | | VIWYDGSNKYYADSVKG | ERYSSSWYDYGMDV |
| | | | SEQ ID NO:7214 | | SEQ ID NO:15226 | SEQ ID NO:23238 |
| iPS:436598 | 21-225_226D6 | NA | AATTATGATATCAAC | | TGGATGCACCCTAACAG TGGTAACACAGGCTATG CACAGAAGTTCCAGGGC | AGCAGTGGCTGGTACAAGTT TGACTAC |
| | | | SEQ ID NO:7215 | | SEQ ID NO:15227 | SEQ ID NO:23239 |
| | | AA | NYDIN | | WMHPNSGNTGYAQKFQG | SSGWYKFDY |

FIGURE 49
(Continued)

| | | | | | | |
|---|---|---|---|---|---|---|
| iPS:436600 | 21-225_226F6 | NA | SEQ ID NO:7216<br>AATTATGATATCAAC | SEQ ID NO:15228<br>TGGATGCACCTAACAG<br>TGGTAACACAGGCTATG<br>CACAGAAGTTCCAGGGC | SEQ ID NO:23240<br>AGCAGTGGCTGGTACCGCTT<br>TGACTAC | |
| | | AA | SEQ ID NO:7217<br>NYDIN | SEQ ID NO:15229<br>WMHPNSGNTGYAQKFQG | SEQ ID NO:23241<br>SSGWYRFDY | |
| iPS:436602 | 21-225_226E7 | NA | SEQ ID NO:7218<br>ACCTATGGCATGCAC | SEQ ID NO:15230<br>ATTATATGGTATGATGG<br>AAGTAATAAATACTATG<br>CAGACTCCGTGAAGGGC | SEQ ID NO:23242<br>GAGAATTACGATTTTTGGAG<br>TGGTTATTATGGCTAC | |
| | | AA | SEQ ID NO:7219<br>TYGMH | SEQ ID NO:15231<br>IIWYDGSNKYYADSVKG | SEQ ID NO:23243<br>ENYDFWSGYYGY | |
| iPS:436604 | 21-225_226F7 | NA | SEQ ID NO:7220<br>AGCTATGGCATGCAC | SEQ ID NO:15232<br>ATTATATGGTATGATGG<br>AAGTAATAAATACTATG<br>CAGACTCCGTGAAGGGC | SEQ ID NO:23244<br>GAGAGGTATAACAGCGGCTG<br>GTACGACTACGGTTTGGACG<br>TC | |
| | | AA | SEQ ID NO:7221<br>SYGMH | SEQ ID NO:15233<br>IIWYDGSNKYYADSVKG | SEQ ID NO:23245<br>ERYNSGWYDYGLDV | |
| iPS:436606 | 21-225_226G8 | NA | SEQ ID NO:7222<br>GGCTACTATATACAC | SEQ ID NO:15234<br>TGGATCAACCCTTACAGT<br>GGTGACACAAAGTATGC<br>ACAGAAGTTCAGGGC | SEQ ID NO:23246<br>GATTGGGGTGGCTACAGTTC<br>TTACTACTACGTATGGACG<br>TC | |
| | | AA | SEQ ID NO:7223<br>GYYIH | SEQ ID NO:15235<br>WINPYSGDTKYAQKFQG | SEQ ID NO:23247<br>DWGGYSSYYYGMDV | |
| | | | SEQ ID NO:7224 | SEQ ID NO:15236 | SEQ ID NO:23248 | |

FIGURE 49
(Continued)

| | | | | |
|---|---|---|---|---|
| iPS:436608 | 21-225_226A9 | NA | AACTATGGCATGCAC | GTTATATGGTATGAGGA AAGTAATAAATACTATA CAGACTCCGTGAAGGGC | GAAGTGGGATTCACTGAGGA CTAC |
| | | | SEQ ID NO:7225 | SEQ ID NO:15237 | SEQ ID NO:23249 |
| | | AA | NYGMH | VIWYEESNKYYTDSVKG | EVGFTEDY |
| | | | SEQ ID NO:7226 | SEQ ID NO:15238 | SEQ ID NO:23250 |
| iPS:436610 | 21-225_226F9 | NA | GGCTACTATATACAC | TGGATCAACCCTTACAGT GGTGACACAAAGTATGC ACAGAAGTTTCAGGGC | GATTGGGGTGGCTACAGTTC TTACTACTACGGTATGGACG TC |
| | | | SEQ ID NO:7227 | SEQ ID NO:15239 | SEQ ID NO:23251 |
| | | AA | GYYIH | WINPYSGDTKYAQKFQG | DWGGYSSYYYGMDV |
| | | | SEQ ID NO:7228 | SEQ ID NO:15240 | SEQ ID NO:23252 |
| iPS:436612 | 21-225_226H9 | NA | GGCTACTATATACAC | TGGATCAACCCTTACAGT GGTGACACAAACTCTGC ACAGAAGTTTCAGGGC | GATTGGGGTGGCTACAGTTC TTACTACTACGGTATGGACG TC |
| | | | SEQ ID NO:7229 | SEQ ID NO:15241 | SEQ ID NO:23253 |
| | | AA | GYYIH | WINPYSGDTNSAQKFQG | DWGGYSSYYYGMDV |
| | | | SEQ ID NO:7230 | SEQ ID NO:15242 | SEQ ID NO:23254 |
| iPS:436614 | 21-225_226F10 | NA | GGCTATTATATACAC | TGGATCAACCTACACAG TGGTGACACAAACTATG CACAGAAGTTTCAGGGC | GATTGGGGTGGCTACAGTTC TTACTACTACGGTATGGACG TC |
| | | | SEQ ID NO:7231 | SEQ ID NO:15243 | SEQ ID NO:23255 |
| | | AA | GYYIH | WINPYSGDTNYAQKFQG | DWGGYSSYYYGMDV |
| | | | SEQ ID NO:7232 | SEQ ID NO:15244 | SEQ ID NO:23256 |
| iPS:436616 | 21-225_226D11 | NA | AATTATGATATCAAC | TGGATGCACCCTAACAG TGGTAACACAGGCTATG CACAGAAGTTCCAGGGC | AGCAGTGGCTGGTACTACTT TGACTAC |
| | | | SEQ ID NO:7233 | SEQ ID NO:15245 | SEQ ID NO:23257 |

FIGURE 49
(Continued)

| | | | | | |
|---|---|---|---|---|---|
| iPS:436618 | 21-225_226E11 | AA | NYDIN | | WMHPNSGNTYAQKFQG | SSGWYYFDY |
| | | | SEQ ID NO:7234 | | SEQ ID NO:15246 | SEQ ID NO:23258 |
| | | NA | GGCTACTATATACAC | | TGGATCAACCCTTACAGTGGTGACACAAACTATGCACAGAAGTTTCAGGGC | GATTGGGGTGGCTACAGTCTTACTACTACGGTATGGACGTC |
| | | | SEQ ID NO:7235 | | SEQ ID NO:15247 | SEQ ID NO:23259 |
| | | AA | GYYIH | | WINPYSGDTNYAQKFQG | DWGGYSSYYYGMDV |
| | | | SEQ ID NO:7236 | | SEQ ID NO:15248 | SEQ ID NO:23260 |
| iPS:436620 | 21-225_226H11 | NA | AACTGTGGCATGCAC | | GTTATATGGTATGATGGAAGTAATAAATACTATGCAGACTCCGTGAAGGGC | GAGCTGTATAGCAGCAGCTGGTACGACTACGGTTTGGACG |
| | | | SEQ ID NO:7237 | | SEQ ID NO:15249 | SEQ ID NO:23261 |
| | | AA | NCGMH | | VIWYDGSNKYYADSVKG | ELYSSSWYDYGLDV |
| | | | SEQ ID NO:7238 | | SEQ ID NO:15250 | SEQ ID NO:23262 |
| iPS:436622 | 21-225_226A12 | NA | AATTATGATATCAAC | | TGGATGCACCCTAACAGTGGTAACACAGGCTATGCACAGAAGTTCCAGGGC | AGCAGTGGCTGGTACTACTTTGACTAC |
| | | | SEQ ID NO:7239 | | SEQ ID NO:15251 | SEQ ID NO:23263 |
| | | AA | NYDIN | | WMHPNSGNTYAQKFQG | SSGWYYFDY |
| | | | SEQ ID NO:7240 | | SEQ ID NO:15252 | SEQ ID NO:23264 |
| iPS:436624 | 21-225_226H12 | NA | GGCTACTATATACAC | | TGGATCAACCCTTACAGTGGTGACACAAACTATGCACAGAAGTTTCAGGGC | GATTGGGGTGGCTACAGTCTTACTACTACGGTATGGACGTC |
| | | | SEQ ID NO:7241 | | SEQ ID NO:15253 | SEQ ID NO:23265 |
| | | AA | GYYIH | | WINPYSGDTNYAQKFQG | DWGGYSSYYYGMDV |
| | | | SEQ ID NO:7242 | | SEQ ID NO:15254 | SEQ ID NO:23266 |

FIGURE 49
(Continued)

| | | | | |
|---|---|---|---|---|
| iPS:436626 | 21-225_227C1 | NA | GGCTACTATACACAC | TGGATCAACCCTTACAGTGGTGGCACAAAACTATGCACAGAAGTTTCAGGGC | GATTGGGGTGGCTACAGTTCTTACTACTACGGTATGGACGTC |
| | | | SEQ ID NO:7243 | SEQ ID NO:15255 | SEQ ID NO:23267 |
| | | AA | GYYTH | WINPYSGGTNYAQKFQG | DWGGYSSYYYGMDV |
| | | | SEQ ID NO:7244 | SEQ ID NO:15256 | SEQ ID NO:23268 |
| iPS:436628 | 21-225_227F2 | NA | GGCTACTATATACAC | TGGATCAACCCTTACAGTGGTGACACAAAGTATGCACAGAAGTTTCAGGGC | GATTGGGGTGGCTACAGTTCTTACTACTACGGTATGGACGTC |
| | | | SEQ ID NO:7245 | SEQ ID NO:15257 | SEQ ID NO:23269 |
| | | AA | GYYIH | WINPYSGDTKYAQKFQG | DWGGYSSYYYGMDV |
| | | | SEQ ID NO:7246 | SEQ ID NO:15258 | SEQ ID NO:23270 |
| iPS:436630 | 21-225_227G3 | NA | AGCTATGGCATGCAC | GTTATATGGTATGTTGGAAGTAATCAATACTATGCAGACTCCGTGAAGGGC | GAAGTGGATTCACTGAGGACTAC |
| | | | SEQ ID NO:7247 | SEQ ID NO:15259 | SEQ ID NO:23271 |
| | | AA | SYGMH | VIWYVGSNQYYADSVKG | EVGFTEDY |
| | | | SEQ ID NO:7248 | SEQ ID NO:15260 | SEQ ID NO:23272 |
| iPS:436632 | 21-225_227E4 | NA | ACTTTTGCCATGACC | GTTATTAGTGGTAGAGGTGGTAGCTCATTCTACGCAGACTCCGTGAAGGGC | GATCAACTATGGTTTGACTAC |
| | | | SEQ ID NO:7249 | SEQ ID NO:15261 | SEQ ID NO:23273 |
| | | AA | TFAMT | VISGRGGSSFYADSVKG | DQLWFDY |
| | | | SEQ ID NO:7250 | SEQ ID NO:15262 | SEQ ID NO:23274 |
| iPS:436634 | 21-225_227H5 | NA | AACTATGGCATGCAC | GTTATATGGTATGAAGAAAGTAATAAATACTATGCAGACTCCGTGAAGGGC | GAAGTGGATTCACTGAGGACTAC |
| | | | SEQ ID NO:7251 | SEQ ID NO:15263 | SEQ ID NO:23275 |

FIGURE 49
(Continued)

| | | | AA | NYGMH | VIWYEESNKYYADSVKG | EVGFTEDY |
|---|---|---|---|---|---|---|
| iPS:436636 | 21-225_227E6 | | | SEQ ID NO:7252 | SEQ ID NO:15264 | SEQ ID NO:23276 |
| | | | NA | AATTATGATATCAAC | TGGATGCACCCTAACAG TGGTAACACAGGCTATG CACAGAAGTTCCAGGGC | AGCAGTGGCTGGTACAAGTT TGACTAC |
| | | | | SEQ ID NO:7253 | SEQ ID NO:15265 | SEQ ID NO:23277 |
| | | | AA | NYDIN | WMHPNSGNTGYAQKFQG | SSGWYKFDY |
| | | | | SEQ ID NO:7254 | SEQ ID NO:15266 | SEQ ID NO:23278 |
| iPS:436638 | 21-225_227C7 | | NA | AATTATGATATCAAC | TGGATGCATCCTAACAG TGGTAACACAGGCTATG CACAGAAGTTCCAGGGC | AGCAGTGGCTGGTACCGCTT TGACTAC |
| | | | | SEQ ID NO:7255 | SEQ ID NO:15267 | SEQ ID NO:23279 |
| | | | AA | NYDIN | WMHPNSGNTGYAQKFQG | SSGWYRFDY |
| | | | | SEQ ID NO:7256 | SEQ ID NO:15268 | SEQ ID NO:23280 |
| iPS:436640 | 21-225_227A8 | | NA | GGCTACTATATACAC | TGGATCAACCCTTACAGT GGTGACACAAACTATGC ACAGAAGTTCAGGGC | GATTGGGGTGGCTACAGTTC TTACTACTACGGTATGGACG TC |
| | | | | SEQ ID NO:7257 | SEQ ID NO:15269 | SEQ ID NO:23281 |
| | | | AA | GYYIH | WINPYSGDTNYAQKFQG | DWGGYSSYYYGMDV |
| | | | | SEQ ID NO:7258 | SEQ ID NO:15270 | SEQ ID NO:23282 |
| iPS:436644 | 21-225_227G9 | | NA | AATTATGATATCAAC | TGGATGTACCTAACAG TGGTAACACAGGCTATG CACAGAAGTTCCAGGGC | AGCAGTGGCTGGTACTGTT CGACCCC |
| | | | | SEQ ID NO:7259 | SEQ ID NO:15271 | SEQ ID NO:23283 |
| | | | AA | NYDIN | WMYPNSGNTGYAQKFQG | SSGWYWFDP |
| | | | | SEQ ID NO:7260 | SEQ ID NO:15272 | SEQ ID NO:23284 |

FIGURE 49
(Continued)

| | | | | | |
|---|---|---|---|---|---|
| iPS:436646 | 21-225_227D11 | NA | AATTATGATATCAAC | TGGATGCACCCTAACAGTGGTAACACAGGCTATGCACAGAAGTTCCAGGGC | AGCAGTGGCTGGTACTACTTTGACTAC |
| | | | SEQ ID NO:7261 | SEQ ID NO:15273 | SEQ ID NO:23285 |
| | | AA | NYDIN | WMHPNSGNTGYAQKFQG | SSGWYYFDY |
| | | | SEQ ID NO:7262 | SEQ ID NO:15274 | SEQ ID NO:23286 |
| iPS:436648 | 21-225_227F11 | NA | ACCTATAGCATGAAC | TCCATTAGTAGTAGTATTAATTACATGTACTACGCAGACTCAGTGAAGGGC | TTAGGGGTCTAC |
| | | | SEQ ID NO:7263 | SEQ ID NO:15275 | SEQ ID NO:23287 |
| | | AA | TYSMN | SISSSINYMYYADSVKG | LGVY |
| | | | SEQ ID NO:7264 | SEQ ID NO:15276 | SEQ ID NO:23288 |
| iPS:436650 | 21-225_227C12 | NA | AACTATGGCATGCAC | GTTATATGGTATATTGGAAGTAATCAATACTATGCGGACTCCGTGAAGGGC | GAAGTGGGATTCACTGAGGACTAC |
| | | | SEQ ID NO:7265 | SEQ ID NO:15277 | SEQ ID NO:23289 |
| | | AA | NYGMH | VIWYIGSNQYYADSVKG | EVGFTEDY |
| | | | SEQ ID NO:7266 | SEQ ID NO:15278 | SEQ ID NO:23290 |
| iPS:436652 | 21-225_146B11 | NA | AGCTATGCCATGAGC | GTTATTAGTGGTGGTGGTAGTAGCACATACTACGCAGACTCCGTGAAGGGC | TGGCGAGGTAACCCCACTGACTACGGTATGGACGTC |
| | | | SEQ ID NO:7267 | SEQ ID NO:15279 | SEQ ID NO:23291 |
| | | AA | SYAMS | VISGGGSSTYYADSVKG | WRGNPTDYGMDV |
| | | | SEQ ID NO:7268 | SEQ ID NO:15280 | SEQ ID NO:23292 |
| iPS:436654 | 21-225_146C11 | NA | AGCTATGCCATGAGC | GTTATTAGTGGTGGTGGTGTAGTAGCACATACTACGCAGACTCCGTGAAGGGC | TGGCGAGGTAACCCCACTGACTACGGTATGGACGTC |
| | | | SEQ ID NO:7269 | SEQ ID NO:15281 | SEQ ID NO:23293 |
| | | AA | SYAMS | VISGGGSSTYYADSVKG | WRGNPTDYGMDV |

FIGURE 49
(Continued)

| | | | | SEQ ID NO:7270 | SEQ ID NO:15282 | SEQ ID NO:23294 |
|---|---|---|---|---|---|---|
| iPS:436658 | 21-225_146A2 | NA | | AGCTATGCCATGAGC | GTTATTAGTGGTGGTGGT AGTAGCACATACTACGC AGACTCCGTGAAGGGC | TGGCGAGGTAACCCCACTGA CTACGGTATGGACGTC |
| | | AA | | SEQ ID NO:7271 SYAMS | SEQ ID NO:15283 VISGGGSSTYYADSVKG | SEQ ID NO:23295 WRGNPTDYGMDV |
| iPS:436660 | 21-225_146D8 | NA | | SEQ ID NO:7272 AACTATAACATGAAC | SEQ ID NO:15284 TACATTAGTAGAAGTAG TAATACCAAATACTATGT AGACTCTGTGAAGGGC | SEQ ID NO:23296 GATAGGAGTGGGAGCTACGG GTACTTCTACTACTACGGTTT GGACGTC |
| | | AA | | SEQ ID NO:7273 NYNMN | SEQ ID NO:15285 YISRSSNTKYYVDSVKG | SEQ ID NO:23297 DRSGSGYFYYYGLDV |
| iPS:436662 | 21-225_146E2 | NA | | SEQ ID NO:7274 AGTTATGATATCAAC | SEQ ID NO:15286 TGGATGAACCCTAATAG TGGTAACACAGGCTATG CACAGAAGTTCCAGGGC | SEQ ID NO:23298 GCGGATATTGTATTAGTACC AGCTGCTATCCCTTATAATT ACTACTTCGTCTATGGACGTC |
| | | AA | | SEQ ID NO:7275 SYDIN | SEQ ID NO:15287 WMNPNSGNTGYAQKFQG | SEQ ID NO:23299 ADIVLVPAAIPYNYYFAMDV |
| iPS:436664 | 21-225_147E7 | NA | | SEQ ID NO:7276 AGCTATGCCATGAGC | SEQ ID NO:15288 GTTATTAGTGGTGGTGGT AGTAGTACATACTACGC AGACTCCGTGAAGGGC | SEQ ID NO:23300 TGGCGAGGTAACCCCACTGA CTACGGTATGGACGTC |
| | | AA | | SEQ ID NO:7277 SYAMS | SEQ ID NO:15289 VISGGGSSTYYADSVKG | SEQ ID NO:23301 WRGNPTDYGMDV |
| iPS:436666 | 21-225_147B8 | NA | | SEQ ID NO:7278 GACTACTATTTGCAC | SEQ ID NO:15290 TGGATCAACCCTAACAG TGGTGACACAAACTATG CACAGAAGTTTCAGGGC | SEQ ID NO:23302 GATCGGGACTCTGGTTCGGG GAGTTACCCCTACTACTACT ACTACGGTATGGACGTC |
| | | | | SEQ ID NO:7279 | SEQ ID NO:15291 | SEQ ID NO:23303 |

FIGURE 49
(Continued)

| | | AA | DYYLH | WINPNSGDTNYAQKFQG | DRDSGSGSYPYYYYGMDV |
|---|---|---|---|---|---|
| | | | SEQ ID NO:7280 | SEQ ID NO:15292 | SEQ ID NO:23304 |
| iPS:436668 | 21-225_147B9 | NA | AGCTATGGCATGCAC | GTTATATGGTTATGATGG AAGTAATAAATACTATG CAGACTCCGTGAAGGGC | GATCGTGACTACGGTGACCC CCCTACTACTACTACTACG GTATGGACGTC |
| | | | SEQ ID NO:7281 | SEQ ID NO:15293 | SEQ ID NO:23305 |
| | | AA | SYGMH | VIWYDGSNKYYADSVKG | DRDYGDPPYYYYGMDV |
| | | | SEQ ID NO:7282 | SEQ ID NO:15294 | SEQ ID NO:23306 |
| iPS:436670 | 21-225_147D9 | NA | AGCTATGGCATGCAC | GATATATGGTTTGATGGC AGTAATAAATACTATGT AGACTCCGTGAAGGAC | GATCGGGTGGAGGGTTCGGG GACTCCCTACTACTACTACG GTATGGACGTC |
| | | | SEQ ID NO:7283 | SEQ ID NO:15295 | SEQ ID NO:23307 |
| | | AA | SYGMH | DIWFDGSNKYYVDSVKD | DRVEGSGTPYYYYGMDV |
| | | | SEQ ID NO:7284 | SEQ ID NO:15296 | SEQ ID NO:23308 |
| iPS:436672 | 21-225_147F9 | NA | ACCTATGGCATGCAC | GTTATATGGTATGGTGG AAGTGATAAAGACTATG CAGACTCCGTGAAGGGC | GATCGGGATTATTGTAGTGG TGGTACTTGTCCTTACTACTA CTACTACGGTATGGACGTC |
| | | | SEQ ID NO:7285 | SEQ ID NO:15297 | SEQ ID NO:23309 |
| | | AA | TYGMH | VIWYGGSDKDYADSVKG | DRDYCSGGTCPYYYYGMDV |
| | | | SEQ ID NO:7286 | SEQ ID NO:15298 | SEQ ID NO:23310 |
| iPS:436674 | 21-225_147G9 | NA | ACCTATGGCATGCAC | GTTATATGGTATGGTGG AAGTGATAAAGACTATG CAGACTCCGTGAAGGGC | GATCGGGATTATTGTAGTGG TGGTAGCTGCCCTTACTACT ACTACTACGGTATGGACGTC |
| | | | SEQ ID NO:7287 | SEQ ID NO:15299 | SEQ ID NO:23311 |

FIGURE 49
(Continued)

| | | AA | TYGMH | | VIWYGGSDKDYADSVKG | | DRDYCSGGSCPYYYYGMDV | |
|---|---|---|---|---|---|---|---|---|
| iPS:436676 | 21-225_147E11 | | SEQ ID NO:7288 | | SEQ ID NO:15300 | | SEQ ID NO:23312 | |
| | | NA | AACTATGTCATGAGC | | GTTATTAGTGGTGGTGGT AGTAGTACATACTACGC AGACTCCGTGAAGGGC | | TGGCGAGGTAACCCCACTGA CTACGGTATGGACGTC | |
| | | | SEQ ID NO:7289 | | SEQ ID NO:15301 | | SEQ ID NO:23313 | |
| | | AA | NYVMS | | VISGGGSSTYYADSVKG | | WRGNPTDYGMDV | |
| iPS:436678 | 21-225_147B12 | | SEQ ID NO:7290 | | SEQ ID NO:15302 | | SEQ ID NO:23314 | |
| | | NA | AGCTATGCCATGAGC | | GTTATTAGTGGTGGTGGT AGTAGCACATACTACGC AGACTCCGTGAAGGGC | | TGGCGAGGTAACCCCACTGA CTACGGTATGGACGTC | |
| | | | SEQ ID NO:7291 | | SEQ ID NO:15303 | | SEQ ID NO:23315 | |
| | | AA | SYAMS | | VISGGGSSTYYADSVKG | | WRGNPTDYGMDV | |
| iPS:436680 | 21-225_147H12 | | SEQ ID NO:7292 | | SEQ ID NO:15304 | | SEQ ID NO:23316 | |
| | | NA | AGTGGTTATTACCACTGGAG C | | TACATCTATTACAGTGGG AGCACCTACTACAACCC GTCCCTCAAGAGT | | GATTGGGGTGGCTACGATTC GAGTGGCTGGTTCGACCCC | |
| | | | SEQ ID NO:7293 | | SEQ ID NO:15305 | | SEQ ID NO:23317 | |
| | | AA | SGYYHWS | | YIYYSGSTYYNPSLKS | | DWGGYDSSGWFDP | |
| iPS:436682 | 21-225_146A8 | | SEQ ID NO:7294 | | SEQ ID NO:15306 | | SEQ ID NO:23318 | |
| | | NA | AACTATAACATGAAC | | TACATTAGTAGAAGTAG TAATACCAAATACTACG CAGACTCTGTGAGGGGC | | GATAGGAGTGGGAGCTACGG GTACTTCTACTACTACGGTTT GGACGTC | |
| | | | SEQ ID NO:7295 | | SEQ ID NO:15307 | | SEQ ID NO:23319 | |
| | | AA | NYNMN | | YISRSSNTKYYADSVRG | | DRSGSGYFYYYGLDV | |
| | | | SEQ ID NO:7296 | | SEQ ID NO:15308 | | SEQ ID NO:23320 | |

FIGURE 49
(Continued)

| | | | | |
|---|---|---|---|---|
| iPS:436684 | 21-225_146B6 | NA | AGCTATAACATGAAC | TACATTAGTAGAAGTAGTAATACCAAACACTACGCAGACTCTGTGAAGGGC | GATAGGAGTGGGAGCTACGGGTACTTCTACTACTACGGTTGGACGTC |
| | | | SEQ ID NO:7297 | SEQ ID NO:15309 | SEQ ID NO:23321 |
| | | AA | SYNMN | YISRSSNTKHYADSVKG | DRSGSYGYFYYYGLDV |
| | | | SEQ ID NO:7298 | SEQ ID NO:15310 | SEQ ID NO:23322 |
| iPS:436686 | 21-225_148G6 | NA | AGCTATGGCCATGAGC | GTTATTAGTGGTGGTGGTAGTAGCACATACTACGCAGACTCCGTGAAGGGC | TGGCGAGGTAACCCCACTGACTACGGTATGGACGTC |
| | | | SEQ ID NO:7299 | SEQ ID NO:15311 | SEQ ID NO:23323 |
| | | AA | SYAMS | VISGGGSSTYYADSVKG | WRGNPTDYGMDV |
| | | | SEQ ID NO:7300 | SEQ ID NO:15312 | SEQ ID NO:23324 |
| iPS:436688 | 21-225_148C8 | NA | AGCTATGGCCATGCAC | GTTATATGGTATGATGGAAGTAATAAATACTATGCAGACTCCGTGAAGGGC | GATCGTGACTACGGTGACCCCCCTACTACTACTACGGTATGACGTC |
| | | | SEQ ID NO:7301 | SEQ ID NO:15313 | SEQ ID NO:23325 |
| | | AA | SYGMH | VIWYDGSNKYYADSVKG | DRDYGDPPYYYYGMDV |
| | | | SEQ ID NO:7302 | SEQ ID NO:15314 | SEQ ID NO:23326 |
| iPS:436690 | 21-225_148A9 | NA | ACCTATGGCCATGCAC | GTTATATGGTATGGTGGAAGTGATAAAGACTATGCAGACTCCGTGAAGGGC | GATCGGGATTATTGTCCTTACTACTACTA CTACTACGGTATGACGTC |
| | | | SEQ ID NO:7303 | SEQ ID NO:15315 | SEQ ID NO:23327 |
| | | AA | TYGMH | VIWYGGSDKDYADSVKG | DRDYCSGGTCPYYYYGMDV |
| | | | SEQ ID NO:7304 | SEQ ID NO:15316 | SEQ ID NO:23328 |

FIGURE 49
(Continued)

| | | | | | | |
|---|---|---|---|---|---|---|
| iPS:436694 | 21-225_148G11 | NA | AGCTATCCCATGAGC SEQ ID NO:7305 | GTTATTAGTGGTGGTGGT AGTAGTGCATACTACGC AGACTCCGTGAAGGGC SEQ ID NO:15317 | TGGCGAGGTAACCCCACTGA CTACGGTATGGACGTC SEQ ID NO:23329 | |
| | | AA | SYPMS SEQ ID NO:7306 | VISGGGSSAYYADSVKG SEQ ID NO:15318 | WRGNPTDYGMDV SEQ ID NO:23330 | |
| iPS:436696 | 21-225_149A1 | NA | AGCTATAACATGAAC SEQ ID NO:7307 | TACATTAGTAGAAGTAG TAATACCAAACACTACG CAGACTCTGTGAAGGGC SEQ ID NO:15319 | GATAGGAGTGGGAGCTACGG GTACTTCTACTACTACGGTTT GGACGTC SEQ ID NO:23331 | |
| | | AA | SYNMN SEQ ID NO:7308 | YISRSSNTKHYADSVKG SEQ ID NO:15320 | DRSGSYGYFYYYGLDV SEQ ID NO:23332 | |
| iPS:436698 | 21-225_149B5 | NA | GGCTATTGGATGAAC SEQ ID NO:7309 | AACATAAAGCAAGATGG AAGTGAGAAATACTATG TGGACTCTGTGAAGGGC SEQ ID NO:15321 | GGGATGTATAGCAGTGGCTG GTACGTCTTTGACTAC SEQ ID NO:23333 | |
| | | AA | GYWMN SEQ ID NO:7310 | NIKQDGSEKYYVDSVKG SEQ ID NO:15322 | GMYSSGWYVFDY SEQ ID NO:23334 | |
| iPS:436700 | 21-225_149C7 | NA | AGCTATGCCATGAGC SEQ ID NO:7311 | GTTATTAGTGGTGGTGGT AGTAGCACATACTACGC AGACTCCGTGAAGGGC SEQ ID NO:15323 | TGGCGAGGTAACCCCACTGA CTACGGTATGGACGTC SEQ ID NO:23335 | |
| | | AA | SYAMS SEQ ID NO:7312 | VISGGGSSTYYADSVKG SEQ ID NO:15324 | WRGNPTDYGMDV SEQ ID NO:23336 | |
| iPS:436702 | 21-225_149E8 | NA | AGTTATAGCATGAAC SEQ ID NO:7313 | GCCATTAGTAGTACTGGT AGTTACATATATTACGCA GACTCAGTGAAGGC SEQ ID NO:15325 | ACGGCAGTGGCTGGTACTGG GTGGTTCGACCCC SEQ ID NO:23337 | |

FIGURE 49
(Continued)

| | | AA | SYSMN | AISSTGSYIYYADSVKG | TAVAGTGWFDP |
|---|---|---|---|---|---|
| iPS:436704 | | | SEQ ID NO:7314 | SEQ ID NO:15326 | SEQ ID NO:23338 |
| | 21-225_149C10 | NA | AGCCACGCCATGAGC | GTTATAAGTGGAGGTGG TAGTAGCACATATTACG CAGACTCCGTGAAGGGC | TGGCGAGGTAACCCCACTGA CTACGGTATGGACGTC |
| | | | SEQ ID NO:7315 | SEQ ID NO:15327 | SEQ ID NO:23339 |
| | | AA | SHAMS | VISGGGSSTYYADSVKG | WRGNPTDYGMDV |
| iPS:436706 | | | SEQ ID NO:7316 | SEQ ID NO:15328 | SEQ ID NO:23340 |
| | 21-225_149A11 | NA | AGCTATGGCATGCAC | GTTATATGGTATGATGG AAGTAATAAATACTATG CAGACTCCGTGAAGGGC | GATCGTGACTACGGTGACCC CCCTACTACTACTACTACG GTATGGACGTC |
| | | | SEQ ID NO:7317 | SEQ ID NO:15329 | SEQ ID NO:23341 |
| | | AA | SYGMH | VIWYDGSNKYYADSVKG | DRDYGDPPYYYYGMDV |
| iPS:436708 | | | SEQ ID NO:7318 | SEQ ID NO:15330 | SEQ ID NO:23342 |
| | 21-225_150D3 | NA | ACCTATGGCATGCAC | GTTATATGGTATGGTGG AAGTAATAAAGACTATG CAGACTCCGTGAAGGGC | GATCGGGATTATTGTAGTGG TGGTACCTGCCCTTACTACT ACTACTACGGTATGGACGTC |
| | | | SEQ ID NO:7319 | SEQ ID NO:15331 | SEQ ID NO:23343 |
| | | AA | TYGMH | VIWYGGSNKDYADSVKG | DRDYCSGGTCPYYYYYGMDV |
| iPS:436710 | | | SEQ ID NO:7320 | SEQ ID NO:15332 | SEQ ID NO:23344 |
| | 21-225_150F6 | NA | AGCTATGCCATGAGC | GTTATTAGTGGTGGTGGT AGTAGCACATACTACGC AGACTCCGTGAAGGGC | TGGCGAGGTAACCCCACTGA CTACGGTATGGACGTC |
| | | | SEQ ID NO:7321 | SEQ ID NO:15333 | SEQ ID NO:23345 |
| | | AA | SYAMS | VISGGGSSTYYADSVKG | WRGNPTDYGMDV |
| | | | SEQ ID NO:7322 | SEQ ID NO:15334 | SEQ ID NO:23346 |

FIGURE 49
(Continued)

| | | | | |
|---|---|---|---|---|
| iPS:436712 | 21-225_150F9 | NA | AGCTATAACATGAAC | TACATTAGTAGAAGTAG TAATACCAAACACTACG CAGACTCTGTGAAGGGC | GATAGGAGTGGGAGCTACGG GTACTTCTACTACTACGGTTT GGACGTC |
| | | | SEQ ID NO:7323 | SEQ ID NO:15335 | SEQ ID NO:23347 |
| | | AA | SYNMN | YISRSSNTKHYADSVKG | DRSGSYGYFYYYGLDV |
| | | | SEQ ID NO:7324 | SEQ ID NO:15336 | SEQ ID NO:23348 |
| iPS:436714 | 21-225_150H11 | NA | ACCTATGCCATGAGC | ATTATTAGTGGTGGTGGT AGTAGCACATACTACGC AGACTCCGTGAAGGGC | TGGCGAGGTAACCCCACTGA CTACGGTATGGACGTC |
| | | | SEQ ID NO:7325 | SEQ ID NO:15337 | SEQ ID NO:23349 |
| | | AA | TYAMS | IISGGGSSTYYADSVKG | WRGNPTDYGMDV |
| | | | SEQ ID NO:7326 | SEQ ID NO:15338 | SEQ ID NO:23350 |
| iPS:436716 | 21-225_151F3 | NA | ACCTATGGCATGCAC | GTTATATGGTATGGTGG AAGTAATACAGACTATG CAGACTCCGTGAAGGGC | GATCGGGATTATTGTAGTGG TACTAGCTGCCCTTACTACT ACTACTACGGTATGGACGTC |
| | | | SEQ ID NO:7327 | SEQ ID NO:15339 | SEQ ID NO:23351 |
| | | AA | TYGMH | VIWYGGSNTDYADSVKG | DRDYCSGTSCPYYYYYGMDV |
| | | | SEQ ID NO:7328 | SEQ ID NO:15340 | SEQ ID NO:23352 |
| iPS:436718 | 21-225_151H5 | NA | AGCTATGCCATGAGC | GTTATTAGTGGTGGTGGT AGTAGCACATACTACGC AGACTCCGTGAAGGGC | TGGCGAGGTAACCCCACTGA CTACGGTATGGACGTC |
| | | | SEQ ID NO:7329 | SEQ ID NO:15341 | SEQ ID NO:23353 |
| | | AA | SYAMS | VISGGGSSTYYADSVKG | WRGNPTDYGMDV |
| | | | SEQ ID NO:7330 | SEQ ID NO:15342 | SEQ ID NO:23354 |

FIGURE 49
(Continued)

| | | | | |
|---|---|---|---|---|
| iPS:436720 | 21-225_151H6 | NA | GACTATGGCATGCAC | CTTATATGGTATGATGGAAGTAATAAATACTATGCAGACTCCGTGAAGGGC | GATGACCGATCTTGTAGTAGAACCAGCTGCCCTTACTACTACTACGGTTTGGACGTC |
| | | | SEQ ID NO:7331 | SEQ ID NO:15343 | SEQ ID NO:23355 |
| | | AA | DYGMH | LIWYDGSNKYYADSVKG | DDRSCSRTSCPYYYYGLDV |
| | | | SEQ ID NO:7332 | SEQ ID NO:15344 | SEQ ID NO:23356 |
| iPS:436722 | 21-225_151H7 | NA | AGCTATGCCATGAGC | GTTATTAGTGGTGGTGGTAGTAGCACATACTACGCAGACTCCGTGAAGGGC | TGGCGAGGTAACCCACTGACTACGGTATGGACGTC |
| | | | SEQ ID NO:7333 | SEQ ID NO:15345 | SEQ ID NO:23357 |
| | | AA | SYAMS | VISGGGSTYYADSVKG | WRGNPTDYGMDV |
| | | | SEQ ID NO:7334 | SEQ ID NO:15346 | SEQ ID NO:23358 |
| iPS:436724 | 21-225_151B9 | NA | AGCTATGCCATGAGC | GTTATTAGTGGTGGTGGTAGTAGCACATACTACGCAGACTCCGTGAAGGGC | TGGCGAGGTAACCCACTGACTACGGTATGGACGTC |
| | | | SEQ ID NO:7335 | SEQ ID NO:15347 | SEQ ID NO:23359 |
| | | AA | SYAMS | VISGGGSTYYADSVKG | WRGNPTDYGMDV |
| | | | SEQ ID NO:7336 | SEQ ID NO:15348 | SEQ ID NO:23360 |
| iPS:436726 | 21-225_152G5 | NA | GACTATGGCATGCAC | CTTATATGGTATGATGGAAGTAATAAATACTATGCAGACTCCGTGAAGGGC | GATGACCGATCTTGTAGTAGAACCAGCTGCCCTTACTACTACTACGGTTTGGACGTC |
| | | | SEQ ID NO:7337 | SEQ ID NO:15349 | SEQ ID NO:23361 |
| | | AA | DYGMH | LIWYDGSNKYYADSVKG | DDRSCSRTSCPYYYYGLDV |
| | | | SEQ ID NO:7338 | SEQ ID NO:15350 | SEQ ID NO:23362 |

FIGURE 49
(Continued)

| | | | | |
|---|---|---|---|---|
| iPS:436728 | 21-225_152G6 | NA | AGCTATGCCATGAGC | GTTATTAGTGGTGGTGGT AGTAGCACATACTACGC AGACTCCGTGAAGGGC | TGGCGAGGTAACCCCACTGA CTACGGTATGGACGTC |
| | | | SEQ ID NO:7339 | SEQ ID NO:15351 | SEQ ID NO:23363 |
| | | AA | SYAMS | VISGGGSSTYYADSVKG | WRGNPTDYGMDV |
| | | | SEQ ID NO:7340 | SEQ ID NO:15352 | SEQ ID NO:23364 |
| iPS:436730 | 21-225_152D7 | NA | AGCTATGCCATGAGC | GTTATTAGTGGTGGTGGT AGTAGCACATACTACGC AGACTCCGTGAAGGGC | TGGCGAGGTAACCCCACTGA CTCCGGTATGGACGTC |
| | | | SEQ ID NO:7341 | SEQ ID NO:15353 | SEQ ID NO:23365 |
| | | AA | SYAMS | VISGGGSSTYYADSVKG | WRGNPTDSGMDV |
| | | | SEQ ID NO:7342 | SEQ ID NO:15354 | SEQ ID NO:23366 |
| iPS:436732 | 21-225_152B12 | NA | GACTATGGCATGCAC | GTTATATGGTATGATGG AAGTAATAAATACTATG CAGACTCCGTGAAGGGC | GATGACCGATCTTGTAGTAG TACCAGCTGCCCTTACTACT ACTACTACGGTTTGGACGTC |
| | | | SEQ ID NO:7343 | SEQ ID NO:15355 | SEQ ID NO:23367 |
| | | AA | DYGMH | VIWYDGSNKYYADSVKG | DDRSCSSTSCPYYYYGLDV |
| | | | SEQ ID NO:7344 | SEQ ID NO:15356 | SEQ ID NO:23368 |
| iPS:436734 | 21-225_153A8 | NA | GACTATGGCATGCAC | CTTATATGGTATGATGGA AGTAATAAATACTATGC AGACTCCGTGAAGGGC | GATGACCGATCTTGTAGTAG AACCAGCTGCCCTTACTACT ACTACTACGGTTGGACGTC |
| | | | SEQ ID NO:7345 | SEQ ID NO:15357 | SEQ ID NO:23369 |
| | | AA | DYGMH | LIWYDGSNKYYADSVKG | DDRSCSRTSCPYYYYGLDV |
| | | | SEQ ID NO:7346 | SEQ ID NO:15358 | SEQ ID NO:23370 |

FIGURE 49
(Continued)

| | | | | |
|---|---|---|---|---|
| iPS:436736 | 21-225_153E8 | NA | AACTATGGCATGCAC SEQ ID NO:7347 | GTTATATGGTTTGATGGC AGTAATAAATACTATGTT GACTCCGTGAAGGAC SEQ ID NO:15359 | GATCGGGTGGAGGGTTCGGG GACTCCTACTACTACTACG GTATGGACGTC SEQ ID NO:23371 |
| | | AA | NYGMH SEQ ID NO:7348 | VIWFDGSNKYYVDSVKD SEQ ID NO:15360 | DRVEGSGTPYYYYGMDV SEQ ID NO:23372 |
| iPS:436738 | 21-225_153D9 | NA | ACCTATGGCATGCAC SEQ ID NO:7349 | GTTATATGGTATGGTGG AAGTAATAAAGACTATG CAGACTCCGTGAAGGGC SEQ ID NO:15361 | GATCGGGATTATTGTAGTGG TGGTAGCTGTCCTTACTACT ACTACTACGGTATGGACGTC SEQ ID NO:23373 |
| | | AA | TYGMH SEQ ID NO:7350 | VIWYGGSNKDYADSVKG SEQ ID NO:15362 | DRDYCSGGSCPYYYYYGMDV SEQ ID NO:23374 |
| iPS:436740 | 21-225_154C3 | NA | ACCTATGGCATGCAC SEQ ID NO:7351 | GTTGTATGGTATGGTGG AAATAATAAAGACTATG CAGACTCCGTGAAGGGC SEQ ID NO:15363 | GATCGGGATTATTGTAGTGG TGGTAGCTGCCCTTACTACT ACTACTACGGTATGGACGTC SEQ ID NO:23375 |
| | | AA | TYGMH SEQ ID NO:7352 | VVWYGGNNKDYADSVK G SEQ ID NO:15364 | DRDYCSGGSCPYYYYYGMDV SEQ ID NO:23376 |
| iPS:436742 | 21-225_154C4 | NA | AGCTATGCCATGAGC SEQ ID NO:7353 | GTTATTAGTGGTGGTGGT AGTAGCACATACTACGC AGACTCCGTGAAGGGC SEQ ID NO:15365 | TGGCGAGGTAACCCCACTGA CTACGGTATGGACGTC SEQ ID NO:23377 |
| | | AA | SYAMS SEQ ID NO:7354 | VISGGGSSTYYADSVKG SEQ ID NO:15366 | WRGNPTDYGMDV SEQ ID NO:23378 |

FIGURE 49
(Continued)

| | | | | |
|---|---|---|---|---|
| iPS:436744 | 21-225_154F4 | NA | AGCTATGGCATGCAC | GTTATATGTGTATGATGG AAGTAATAAATACTATG CAGACTCCGTGAAGGGC | GAGGATTCCTATTGTAGTGG TACCAGCTGCCCTACTACT ACTACTACGGTATGGACGTC |
| | | | SEQ ID NO:7355 | SEQ ID NO:15367 | SEQ ID NO:23379 |
| | | AA | SYGMH | VIWYDGSNKYYADSVKG | EDSYCSGTSCPYYYYGMDV |
| | | | SEQ ID NO:7356 | SEQ ID NO:15368 | SEQ ID NO:23380 |
| iPS:436746 | 21-225_154E10 | NA | AGCTATGCCATGAGC | GTTATTAGTGGTGGTGGT AGTAGCACATACTACGC AGACTCCGTGAAGGGC | TGGCGAGGTAACCCCACTGA CTACGGTATGGACGTC |
| | | | SEQ ID NO:7357 | SEQ ID NO:15369 | SEQ ID NO:23381 |
| | | AA | SYAMS | VISGGGSSTYYADSVKG | WRGNPTDYGMDV |
| | | | SEQ ID NO:7358 | SEQ ID NO:15370 | SEQ ID NO:23382 |
| iPS:436748 | 21-225_154D11 | NA | ACCTATGGCATGCAC | GTTATATGTGTATGGTGG AAGTAATAAAGACTATG CAGACTCTGTGAAGGGC | GATCGGGATTATTGTAGTGG TGGTAGTTGCCCTTACTACT ACTACTACGGTATGGACGTC |
| | | | SEQ ID NO:7359 | SEQ ID NO:15371 | SEQ ID NO:23383 |
| | | AA | TYGMH | VIWYGGSNKDYADSVKG | DRDYCSGGSCPYYYYGMDV |
| | | | SEQ ID NO:7360 | SEQ ID NO:15372 | SEQ ID NO:23384 |
| iPS:436750 | 21-225_154G12 | NA | AGTGGTTATTACTACTGGAG C | TACATCTATTATAGTGGG AGCACCTACTACAACCC GTCCCTCAAGAGT | GATTGGGGTGGCTACGATTC GAGTGGCTGGTTCGACCCC |
| | | | SEQ ID NO:7361 | SEQ ID NO:15373 | SEQ ID NO:23385 |
| | | AA | SGYYWS | YIYYSGSTYYNPSLKS | DWGGYDSSGWFDP |
| | | | SEQ ID NO:7362 | SEQ ID NO:15374 | SEQ ID NO:23386 |

FIGURE 49
(Continued)

| | | | | |
|---|---|---|---|---|
| iPS:436752 | NA | AGCTACTGGATCGGC | CTCATCTATCCTGGTGCC TCTGATACCAGATACAG CCCGTCCTTCCAAGGC | CAGGCCATAGCAAGTCGAGG GAGGTACTACTACGGTA TGGACGTC |
| | | SEQ ID NO:7363 | SEQ ID NO:15375 | SEQ ID NO:23387 |
| 21-225_155H1 | AA | SYWIG | LIYPGASDTRYSPSFQG | QAIASRGRYYYYGMDV |
| | | SEQ ID NO:7364 | SEQ ID NO:15376 | SEQ ID NO:23388 |
| iPS:436754 | NA | AGCTATGGCATGCAC | GTTATATCATATGATGGA AGTAATAAATACTATGC AGACTCCGTGAAGGGC | GATACGGAGAGATGGCTACC ATACTCCTACGGTATGGACG TC |
| | | SEQ ID NO:7365 | SEQ ID NO:15377 | SEQ ID NO:23389 |
| 21-225_155G3 | AA | SYGMH | VISYDGSNKYYADSVKG | DTERWLPYSYGMDV |
| | | SEQ ID NO:7366 | SEQ ID NO:15378 | SEQ ID NO:23390 |
| iPS:436756 | NA | GGCTATGGCATGCAC | CTTATACGGTATGATGG AAGGATAAAAACTATG CAGACTCCGTGAAGGGC | GATCGGGTTTTTTGTAGTAG TACCAGCTGCCTCTCTTACTA CTACTACTACGGTATGGACG TC |
| | | SEQ ID NO:7367 | SEQ ID NO:15379 | SEQ ID NO:23391 |
| 21-225_146A10 | AA | GYGMH | LIRYDGSDKNYADSVKG | DRVFCSSTSCLSYYYYGMDV |
| | | SEQ ID NO:7368 | SEQ ID NO:15380 | SEQ ID NO:23392 |
| iPS:436758 | NA | AGCTATGCCATGAGC | GTTATTAGTGGTGGTGGT AGTAGCACATACTACGC AGACTCCGTGAAGGGC | TGGCGAGGTAACCCCACTGA CTACGGTATGGACGTC |
| | | SEQ ID NO:7369 | SEQ ID NO:15381 | SEQ ID NO:23393 |
| 21-225_155C10 | AA | SYAMS | VISGGGSSTYYADSVKG | WRGNPTDYGMDV |
| | | SEQ ID NO:7370 | SEQ ID NO:15382 | SEQ ID NO:23394 |

FIGURE 49
(Continued)

| | | | | | |
|---|---|---|---|---|---|
| iPS:436760 | 21-225_155E10 | NA | AGCTATGGCATGCAC SEQ ID NO:7371 | GTTATATGGTATGATGG AAGTAATAAATACTATG CAGACTCCGTGAAGGGC SEQ ID NO:15383 | GATCGTGACTACGGTGACCC CCCTACTACTACTACTACG GTATGGACGTC SEQ ID NO:23395 |
| | | AA | SYGMH SEQ ID NO:7372 | VIWYDGSNKYYADSVKG SEQ ID NO:15384 | DRDYGDPPYYYYGMDV SEQ ID NO:23396 |
| iPS:436762 | 21-225_156H2 | NA | AACTATAACATGAAC SEQ ID NO:7373 | TACATTAGTAGAAGTAG TAATACCAAATACTACG CAGACTCTGTGAAGGGC SEQ ID NO:15385 | GATAGGAGTGGGAGCTACGG GTACTTCTACTACTACGTA TGGACGTC SEQ ID NO:23397 |
| | | AA | NYNMN SEQ ID NO:7374 | YISRSSNTKYYADSVKG SEQ ID NO:15386 | DRSGSYGYFYYYGMDV SEQ ID NO:23398 |
| iPS:436764 | 21-225_158E9 | NA | AGCTATGGCATGCAC SEQ ID NO:7375 | GTTATATGGTATGATGG AAGTAGTAAATACTATG CAGACTCCGTGAAGGGC SEQ ID NO:15387 | GATCGGGTTTTTGTAGTGG TACCAGCTGCCCTTACTACT ACTACTACGGTATGACGTC SEQ ID NO:23399 |
| | | AA | SYGMH SEQ ID NO:7376 | VIWYDGSSKYYADSVKG SEQ ID NO:15388 | DRVFCSGTSCPYYYYGMDV SEQ ID NO:23400 |
| iPS:436766 | 21-225_158D10 | NA | AGCTATGGCATGCAC SEQ ID NO:7377 | GTTATATGGTATGATGG AAGTAATAAATACTATG CAGACTCCGTGAAGGGC SEQ ID NO:15389 | GATCGGGTTTCTTGTAGTAG TACCAGCTGCCCTTACTACT ACTACTACGGTATGGACGTC SEQ ID NO:23401 |
| | | AA | SYGMH | VIWYDGSNKYYADSVKG | DRVSCSSITSCPYYYYGMDV |

FIGURE 49
(Continued)

| | | | | | | |
|---|---|---|---|---|---|---|
| iPS:436768 | 21-225_159H8 | NA | SEQ ID NO:7378<br>ACCTATGGCATGCAC | SEQ ID NO:15390<br>GTTATATGGTATGATGG<br>AAGTAATAAATACTATG<br>CAGACTCCGTGAAGGGC | SEQ ID NO:23402<br>GATCGGGTTTCTTGTAGTAG<br>TACCAGCTGCCCTTACTACT<br>ACTACTACGGTATGGACGTC |
| | | AA | SEQ ID NO:7379<br>TYGMH | SEQ ID NO:15391<br>VIWYDGSNKYYADSVKG | SEQ ID NO:23403<br>DRVSCSSTSCPYYYYGMDV |
| iPS:436770 | 21-225_160B12 | NA | SEQ ID NO:7380<br>AGCTATGGCATGCAC | SEQ ID NO:15392<br>GTTATATGGTATGATGG<br>AAGTAATAAATACTATG<br>CAGACTCCGTGAAGGGC | SEQ ID NO:23404<br>GATCGGGTTTCTTGTAGTAG<br>TACCAGCTGCCCTTACTACT<br>ACTACTACGGTATGGACGTC |
| | | AA | SEQ ID NO:7381<br>SYGMH | SEQ ID NO:15393<br>VIWYDGSNKYYADSVKG | SEQ ID NO:23405<br>DRVSCSSTSCPYYYYGMDV |
| iPS:436772 | 21-225_161H3 | NA | SEQ ID NO:7382<br>AGCTATGGCATGCAC | SEQ ID NO:15394<br>GTTATATGGTATGATGG<br>AAGTAATAAATACTATG<br>CAGACTCCGTGAAGGGC | SEQ ID NO:23406<br>GTCGGGTATAGCGGTGGCTG<br>GTACATCTTTGACTAC |
| | | AA | SEQ ID NO:7383<br>SYGMH | SEQ ID NO:15395<br>VIWYDGSNKYYADSVKG | SEQ ID NO:23407<br>VGYSGGWYIFDY |
| iPS:436774 | 21-225_161E10 | NA | SEQ ID NO:7384<br>AGCTATGGCATGCAC | SEQ ID NO:15396<br>GTTATATGGTATGATGG<br>AAGTAATAAATACTATG<br>TAGACTCCGTGAAGGGC | SEQ ID NO:23408<br>GATCGGGTTTTTGTAGTGG<br>TACCAGCTGCCCTTACTACT<br>ACTACTACGGTATGGACGTC |
| | | | SEQ ID NO:7385 | SEQ ID NO:15397 | SEQ ID NO:23409 |

FIGURE 49
(Continued)

| | | AA | SYGMH | VIWYDGSNKYYVDSVKG | DRVFCSGTSCPYYYYGMDV |
|---|---|---|---|---|---|
| iPS:436776 | 21-225_161F12 | | SEQ ID NO:7386 | SEQ ID NO:15398 | SEQ ID NO:23410 |
| | | NA | AGTGGTGGTTACTACTGGAG C | TACATCTATTACAGTGGGAGCCCTACTACAACCCGTCCCTCAAGAGT | TCGAATTGTAGTAGTGCCAACTGCTATACGGTGGGGTTCTACTACTACGGTTGGACGTC |
| | | | SEQ ID NO:7387 | SEQ ID NO:15399 | SEQ ID NO:23411 |
| | | AA | SGGYYWS | YIYYSGSPYYNPSLKS | SNCSSANCYTVGFYYYGLDV |
| iPS:436780 | 21-225_165H3 | | SEQ ID NO:7388 | SEQ ID NO:15400 | SEQ ID NO:23412 |
| | | NA | AGTGGTGGTTACTACTGGAG C | TACATCTATTACAGTGGGAGCCCTACTACAATCCGTCCCTCAAGAGT | TCGAATTGTAGTAGTGCCAACTGCTATACGGTGGGGTTCTACTACTACGGTATGGACGTC |
| | | | SEQ ID NO:7389 | SEQ ID NO:15401 | SEQ ID NO:23413 |
| | | AA | SGGYYWS | YIYYSGSPYYNPSLKS | SNCSSANCYTVGFYYYGMDV |
| iPS:436782 | 21-225_166G11 | | SEQ ID NO:7390 | SEQ ID NO:15402 | SEQ ID NO:23414 |
| | | NA | GGCTATGGCATGCAC | GTTATATGGTATGATGGAAGTAATAAATACTATGCAGACTCCGTGAAGGGC | GATGATAGATATTGTAGTAGTCCCACCTGCCATCCTTACTACTACTACGGTCTGGACGTC |
| | | | SEQ ID NO:7391 | SEQ ID NO:15403 | SEQ ID NO:23415 |
| | | AA | GYGMH | VIWYDGSNKYYADSVKG | DDRYCSSPTCHPYYYYGLDV |
| | | | SEQ ID NO:7392 | SEQ ID NO:15404 | SEQ ID NO:23416 |

FIGURE 49
(Continued)

| | | | | | |
|---|---|---|---|---|---|
| iPS:436784 | 21-225_169C1 | NA | AGCAATGGCATGCAC | GTTATATGGTATGATGG AAGTAATAAATACTATG CAGACTCCGTGAAGGGC | GATCAGTACAACCGGAACGA CGGACCACCAGCTTACTACT ACTACTACGGTTTGGACGTC |
| | | | SEQ ID NO:7393 | SEQ ID NO:15405 | SEQ ID NO:23417 |
| | | AA | SNGMH | VIWYDGSNKYYADSVKG | DQYNRNDGPPAYYYYGLDV |
| | | | SEQ ID NO:7394 | SEQ ID NO:15406 | SEQ ID NO:23418 |
| iPS:436786 | 21-225_169A6 | NA | AGCAATGGCATGCAC | GTTATATGGTATGATGG AAGTAATAAATACTATG CAGACTCCGTGAAGGGC | GATCAGTACAACCGGAACGA CGGACCACCAGCTTACTACT ACTACTACGGTATGGACGTC |
| | | | SEQ ID NO:7395 | SEQ ID NO:15407 | SEQ ID NO:23419 |
| | | AA | SNGMH | VIWYDGSNKYYADSVKG | DQYNRNDGPPAYYYYYGMD V |
| | | | SEQ ID NO:7396 | SEQ ID NO:15408 | SEQ ID NO:23420 |
| iPS:436788 | 21-225_169B7 | NA | AGCTATAGCTTGAAC | TACATTGGTAGTAGTGG CAGTATCATATTCTACGC AGACTCTGTGAAGGGC | GGGGATACAGCTGGGGTTAC CTATTACTACGGTATGGACG TC |
| | | | SEQ ID NO:7397 | SEQ ID NO:15409 | SEQ ID NO:23421 |
| | | AA | SYSLN | YIGSSGSIIFYADSVKG | GDTAGVTYYYGMDV |
| | | | SEQ ID NO:7398 | SEQ ID NO:15410 | SEQ ID NO:23422 |
| iPS:436790 | 21-225_169G11 | NA | AGCTATGGCATGCAC | ATTATATGGTATGATGG AAGTAATAAATACTATG CAGACTCCGTGAAGGGC | GAGGGGGCTACGTATTACCA TGGTTCGGGGAGTTATTATC CGGCTACTAACTACGGTATG GACGTC |
| | | | SEQ ID NO:7399 | SEQ ID NO:15411 | SEQ ID NO:23423 |
| | | AA | SYGMH | IIWYDGSNKYYADSVKG | EGATYYHGSGSYYPATNYGM DV |
| | | | SEQ ID NO:7400 | SEQ ID NO:15412 | SEQ ID NO:23424 |

FIGURE 49
(Continued)

| | | | | | | |
|---|---|---|---|---|---|---|
| iPS:436792 | 21-225_169D12 | NA | AGCTATGGCATGCAC | | GTTATATGGTATGATGG AAGTAATAAATATTATG CAGACTCCGTGAAGGGC | | CCCCTTTACGATATGGACT CTACTACGATATGGACGTC |
| | | | SEQ ID NO:7401 | | SEQ ID NO:15413 | | SEQ ID NO:23425 |
| | | AA | SYGMH | | VIWYDGSNKYYADSVKG | | PLYDMGLYYDMDV |
| | | | SEQ ID NO:7402 | | SEQ ID NO:15414 | | SEQ ID NO:23426 |
| iPS:436794 | 21-225_170F1 | NA | GGCTATGGCATGAAC | | ATTATATGGTATGATGG AAATAAATAACTATG CAGACTCCGTGAAGGGC | | GATCGGGTTTATTGTAGTAG TACCAGCTGCCATCCCTATT ACTACTACGCTATGGAC GTC |
| | | | SEQ ID NO:7403 | | SEQ ID NO:15415 | | SEQ ID NO:23427 |
| | | AA | GYGMN | | IIWYDGNNKYYADSVKG | | DRVYCSSTSCHPYYYYYAMD V |
| | | | SEQ ID NO:7404 | | SEQ ID NO:15416 | | SEQ ID NO:23428 |
| iPS:436796 | 21-225_170A5 | NA | AACTGTGGCATGCAC | | ATTATATGGTATGATGG AAGTAATAAATACTATG CAGACTCCGTGAAGGGC | | GATCAGTACAACAGGAACGA CGGACCACCAGCTTACTACT ACTACTACGGTTTGGACGTC |
| | | | SEQ ID NO:7405 | | SEQ ID NO:15417 | | SEQ ID NO:23429 |
| | | AA | NCGMH | | IIWYDGSNKYYADSVKG | | DQYNRNDGPPAYYYYYGLDV |
| | | | SEQ ID NO:7406 | | SEQ ID NO:15418 | | SEQ ID NO:23430 |
| iPS:436798 | 21-225_171F5 | NA | AGCTATAGCTTGAAC | | TACATTGGTAGTAGTGG CAGTATCATATTCTACGC AGACTCTGTGAAGGGC | | GGGGATACAGCTGGGGTTAC CTATTACTACGGTATGGACG TC |
| | | | SEQ ID NO:7407 | | SEQ ID NO:15419 | | SEQ ID NO:23431 |
| | | AA | SYSLN | | YIGSSGSIIFYADSVKG | | GDTAGVTYYYGMDV |
| | | | SEQ ID NO:7408 | | SEQ ID NO:15420 | | SEQ ID NO:23432 |

FIGURE 49
(Continued)

| | | | | | |
|---|---|---|---|---|---|
| iPS:436800 | 21-225_171D12 | NA | AGTTACTATATGTAT<br>SEQ ID NO:7409 | ATAATCAACCCTAGTGG<br>TGGTAGCACAAACTACG<br>CACAGAAGTTCCAGGGC<br>SEQ ID NO:15421 | GGTTGGGAGTTAAACTAC<br>SEQ ID NO:23433 |
| | | AA | SYYMY<br>SEQ ID NO:7410 | IINPSGGSTNYAQKFQG<br>SEQ ID NO:15422 | GWELNY<br>SEQ ID NO:23434 |
| iPS:436802 | 21-225_171E12 | NA | AGTTATGGCATGCAC<br>SEQ ID NO:7411 | GTTATATGGAATGATGG<br>AGGTAATAAATATAATG<br>GAGACTCCGTGAAGGGC<br>SEQ ID NO:15423 | GACCGTACGTATTACTCTGG<br>TTCGGGGAGCCCCCCCTACT<br>ACTACTACGGTATGGAC<br>GTC<br>SEQ ID NO:23435 |
| | | AA | SYGMH<br>SEQ ID NO:7412 | VIWNDGGNKYNGDSVKG<br>SEQ ID NO:15424 | DRTYSGSGSPPYYYYGMD<br>V<br>SEQ ID NO:23436 |
| iPS:436804 | 21-225_172C3 | NA | AGTTACTATATGTAT<br>SEQ ID NO:7413 | ACAATCAACCCTAGTGG<br>TGGTAGCACAAACTACG<br>CACAGAAGTTCCAGGGC<br>SEQ ID NO:15425 | GGCTGGGAGTTAAACTAC<br>SEQ ID NO:23437 |
| | | AA | SYYMY<br>SEQ ID NO:7414 | TINPSGGSTNYAQKFQG<br>SEQ ID NO:15426 | GWELNY<br>SEQ ID NO:23438 |
| iPS:436806 | 21-225_172B12 | NA | AGTTACTATATGTAT<br>SEQ ID NO:7415 | ACAATCAACCCTAGTGG<br>TGGTAGCACAGACTACG<br>CACAGAAGTTCCAGGGC<br>SEQ ID NO:15427 | GGCTGGGAATTAAACTAC<br>SEQ ID NO:23439 |
| | | AA | SYYMY<br>SEQ ID NO:7416 | TINPSGGSTDYAQKFQG<br>SEQ ID NO:15428 | GWELNY<br>SEQ ID NO:23440 |
| iPS:436808 | 21-225_173F8 | NA | AGCTATGGCATGCAC<br>SEQ ID NO:7417 | GTTATATCATATGATGA<br>AGTCCTAAATACTGTGC<br>AGACTCCGTGAAGGGC<br>SEQ ID NO:15429 | GATGAAAGGCAGTGGCTGCC<br>GGCCCCCTACGGTATGGACG<br>TC<br>SEQ ID NO:23441 |

FIGURE 49
(Continued)

| | | AA | SYGMH | | VISYDGSPKYCADSVKG | DERQWLPAPYGMDV |
|---|---|---|---|---|---|---|
| iPS:436810 | | | SEQ ID NO:7418 | | SEQ ID NO:15430 | SEQ ID NO:23442 |
| | 21-225_175F4 | NA | AGCAACAGTGTGCTGCTTGGAAC | | AGGACATACTACAGGTCCAAGTGGTATAAATGCTTATCCAGTATCTATGGAAAGT | GATAAGGCAGCTGGGAGGAATGACTTCTACTACTACGGTATGGACGTC |
| | | | SEQ ID NO:7419 | | SEQ ID NO:15431 | SEQ ID NO:23443 |
| iPS:436812 | | AA | SNSAAWN | | RTYYRSKWYNAYPVSMES | DKAAGRNDFYYGMDV |
| | | | SEQ ID NO:7420 | | SEQ ID NO:15432 | SEQ ID NO:23444 |
| | 21-225_175C6 | NA | AACTGTGGCATGCAC | | ATTATATGGTATGATGGAAGTAATAAATACTATGCAGACTCCGTGAAGGGC | GATCAGTACAACAGGAACGACGGACCACCAGCTTACTACTACTACTACGGTTTGGACGTC |
| | | | SEQ ID NO:7421 | | SEQ ID NO:15433 | SEQ ID NO:23445 |
| iPS:436814 | | AA | NCGMH | | IIWYDGSNKYYADSVKG | DQYNRNDGPPAYYYYYGLDV |
| | | | SEQ ID NO:7422 | | SEQ ID NO:15434 | SEQ ID NO:23446 |
| | 21-225_178H10 | NA | AGCAACAGTGCTGCTTGGAAC | | AGGACATACTACAGGTCCAAGTGTATAGTGCTTATCCAGTATCTATGGAAATGT | GATAAGGCAGCTGGGAGGAATGACTTCTACTACTACGGTATGGACGTC |
| | | | SEQ ID NO:7423 | | SEQ ID NO:15435 | SEQ ID NO:23447 |
| iPS:436816 | | AA | SNSAAWN | | RTYYRSKWYSAYPVSMES | DKAAGRNDFYYGMDV |
| | | | SEQ ID NO:7424 | | SEQ ID NO:15436 | SEQ ID NO:23448 |
| | 21-225_179H5 | NA | AGCTATGGCATGCAC | | GTTATATGGTATGATGGAAGTAATGAATACTATGCAGACTCCGTGAAGGGC | GATATCCGGAACTACTACTACGGTTTGGACGTC |
| | | | SEQ ID NO:7425 | | SEQ ID NO:15437 | SEQ ID NO:23449 |

FIGURE 49
(Continued)

| | | | | | | |
|---|---|---|---|---|---|---|
| iPS:436818 | 21-225_179C7 | AA | SYGMH | | VIWYDGSNEYYADSVKG | DIRNYYYGLDV |
| | | | SEQ ID NO:7426 | | SEQ ID NO:15438 | SEQ ID NO:23450 |
| | | NA | AACTCTGGCATGCAC | | ATTATATATTATGATGGA AGTTATAAATACAATGC AGACTCCGTGAAGGGC | GACCGTCATTACGATTTCCA CGTTCCTACTATTACTATTA CGGTATGGACGTC |
| | | | SEQ ID NO:7427 | | SEQ ID NO:15439 | SEQ ID NO:23451 |
| iPS:436820 | 21-225_179D10 | AA | NSGMH | | IIYYDGSYKYNADSVKG | DRHYDFHVPYYYYGMDV |
| | | | SEQ ID NO:7428 | | SEQ ID NO:15440 | SEQ ID NO:23452 |
| | | NA | AGCTATAGCATGAAC | | TACATTAGTAGTAGTGG AAGTACCACATACTACG CAGACTCTGTGCAGGGC | GATAGTAGGAAGGGGTTCTA CTACGGTCTGGACGTC |
| | | | SEQ ID NO:7429 | | SEQ ID NO:15441 | SEQ ID NO:23453 |
| iPS:436822 | 21-225_180D4 | AA | SYSMN | | YISSSGSTTYYADSVQG | DSRKGFYYGLDV |
| | | | SEQ ID NO:7430 | | SEQ ID NO:15442 | SEQ ID NO:23454 |
| | | NA | AACTTTGGCATGCAC | | ATTATATGGTATGATGG AAGTGATAAATACTATG CAGACTCCGTGAAGGGC | GGGGGGCCCCGTTCTCTAC GGTGACTATGTACTTTGACT AC |
| | | | SEQ ID NO:7431 | | SEQ ID NO:15443 | SEQ ID NO:23455 |
| iPS:436824 | 21-225_180C5 | AA | NFGMH | | IIWYDGSDKYYADSVKG | GGPPFSTVTMYFDY |
| | | | SEQ ID NO:7432 | | SEQ ID NO:15444 | SEQ ID NO:23456 |
| | | NA | ACTAGTGGAGTGGGTGTGG C | | TTCATTTCTTGGAATGAT GATAAGCGCTACAGCCC ATCTCTGAAGAGC | AAAGCAGCAGCTGTTGCTTT TGATATC |
| | | | SEQ ID NO:7433 | | SEQ ID NO:15445 | SEQ ID NO:23457 |
| | | AA | TSGVGVG | | FISWNDDKRYSPSLKS | KAAAVAFDI |
| | | | SEQ ID NO:7434 | | SEQ ID NO:15446 | SEQ ID NO:23458 |

FIGURE 49
(Continued)

| | | NA | AGTTATGATATCAAC | TGGATGAACCCTAACAG TGGTAACACAGGCTATG CACAGAAGTTCCAGGGC | GGGTTTATTACTATGGTTCG GGGAGTCATGTCCCTTACCA CTACTACTACGGTTTGGACG TC |
|---|---|---|---|---|---|
| iPS:436826 | 21-225_180G5 | | SEQ ID NO:7435 | SEQ ID NO:15447 | SEQ ID NO:23459 |
| | | AA | SYDIN | WMNPNSGNTGYAQKFQG | GFYYYGSGSHVPYHYYYGLD V |
| | | | SEQ ID NO:7436 | SEQ ID NO:15448 | SEQ ID NO:23460 |
| iPS:436828 | 21-225_181H1 | NA | AACTATGGCATGCAC | ATTATATGGTATGATGG AAGTGATAAATACTATG CAGACTCCGTGAAGGGC | GGGGGCCCCGTTTCTAC GGTGACTATGTACTTCGACT AC |
| | | | SEQ ID NO:7437 | SEQ ID NO:15449 | SEQ ID NO:23461 |
| | | AA | NYGMH | IIWYDGSDKYYADSVKG | GGPPFSTVTMYFDY |
| | | | SEQ ID NO:7438 | SEQ ID NO:15450 | SEQ ID NO:23462 |
| iPS:436830 | 21-225_51F4 | NA | AGCTATGGTATCAGC | TGGATCAGCGCTTATAAT GGTAACACAAAGTATGC ACAGAAGCTCCAGGGC | CACGATTTTGGAGTGGTTA TTATAAGGGTATGGACGTC |
| | | | SEQ ID NO:7439 | SEQ ID NO:15451 | SEQ ID NO:23463 |
| | | AA | SYGIS | WISAYNGNTKYAQKLQG | HDFWSGYYKGMDV |
| | | | SEQ ID NO:7440 | SEQ ID NO:15452 | SEQ ID NO:23464 |
| iPS:436832 | 21-225_51D8 | NA | AGTAACAGTGCTGCTTGGAA C | AGGACATACTACAGGTC CAAGTGGTATAATGATT ATGCAGTATCTGTGAAA AGT | GACCGCTATAACTGGAACTA CCCCTACTGGTACTTCGATCT C |
| | | | SEQ ID NO:7441 | SEQ ID NO:15453 | SEQ ID NO:23465 |
| | | AA | SNSAAWN | RTYYRSKWYNDYAVSVK S | DRYNWNYPYWYFDL |
| | | | SEQ ID NO:7442 | SEQ ID NO:15454 | SEQ ID NO:23466 |

FIGURE 49
(Continued)

| | | | | | |
|---|---|---|---|---|---|
| iPS:436834 | 21-225_52F1 | NA | AGCTATGTGTCAGC | TGGATCAGCGCTTATAATGGTAACAGAAAGTATGCACAGAAGCTCCAGGGC | CACGATTTTTGGAGTGGTTATTATAAGGGTATGGACGTC |
| | | | SEQ ID NO:7443 | SEQ ID NO:15455 | SEQ ID NO:23467 |
| | | AA | SYGVS | WISAYNGNRKYAQKLQG | HDFWSGYYKGMDV |
| | | | SEQ ID NO:7444 | SEQ ID NO:15456 | SEQ ID NO:23468 |
| iPS:436836 | 21-225_52H1 | NA | GGCTATGGCATGCAC | GTTATATGGTATGATGGAAGTAATAAATACTATGCAGACTCCGTGAAGGGC | GATCGGGTCTATTGTAGTAGTTCCAGCTGCTCATATTACTACTACTACGGTATGGACGTC |
| | | | SEQ ID NO:7445 | SEQ ID NO:15457 | SEQ ID NO:23469 |
| | | AA | GYGMH | VIWYDGSNKYYADSVKG | DRVYCSSSSCSYYYYYGMDV |
| | | | SEQ ID NO:7446 | SEQ ID NO:15458 | SEQ ID NO:23470 |
| iPS:436838 | 21-225_52H4 | NA | CACTTTGGCATGCAC | GTTATTTGGTATGATGGAAGTAATAAATACTATGCAGACTCCGTGAAGGGC | GGGGACTGGAACTACGAGGGTTTTGACTAC |
| | | | SEQ ID NO:7447 | SEQ ID NO:15459 | SEQ ID NO:23471 |
| | | AA | HFGMH | VIWYDGSNKYYADSVKG | GDWNYEGFDY |
| | | | SEQ ID NO:7448 | SEQ ID NO:15460 | SEQ ID NO:23472 |
| iPS:436840 | 21-225_53E9 | NA | GGCTACTATATGCAC | TGGATCATCCCTAACAGTGGTGACACAAAACTATGCACAGAAGTTTCAGGGC | GATGGGTATAGCAGTGGCTGGTTCAACTGGTTCGACCCC |
| | | | SEQ ID NO:7449 | SEQ ID NO:15461 | SEQ ID NO:23473 |
| | | AA | GYYMH | WIIPNSGDTNYAQKFQG | DGYSSGWFNWFDP |
| | | | SEQ ID NO:7450 | SEQ ID NO:15462 | SEQ ID NO:23474 |

FIGURE 49
(Continued)

| | | | | | |
|---|---|---|---|---|---|
| iPS:436842 | 21-225_54E9 | NA | AGCTATGGTATCAGC | TGGATTAGTAGTGCTTATAATGGTAACACAAAGAATGCACAGAAGCTCCAGGGC | CACGATTTTTGGAGTGGTTATTATAAGGGTATGGACGTC |
| | | | SEQ ID NO:7451 | SEQ ID NO:15463 | SEQ ID NO:23475 |
| | | AA | SYGIS | WISAYNGNTKNAQKLQG | HDFWSGYYKGMDV |
| | | | SEQ ID NO:7452 | SEQ ID NO:15464 | SEQ ID NO:23476 |
| iPS:436844 | 21-225_56G1 | NA | AGCTATGGTATCAGC | TGGATCAGCGCTTATAATGGTAACACAAAGTATGCACAGAAGTTCCAGGGC | CACGATTTTTGGAGTGGTTATTATAAGGGTATGGACGTC |
| | | | SEQ ID NO:7453 | SEQ ID NO:15465 | SEQ ID NO:23477 |
| | | AA | SYGIS | WISAYNGNTKYAQKFQG | HDFWSGYYKGMDV |
| | | | SEQ ID NO:7454 | SEQ ID NO:15466 | SEQ ID NO:23478 |
| iPS:436846 | 21-225_56E3 | NA | AGCTATGGTTCAGC | TGGATCAGCGCTTATAATGGTAACACAAAGGAAGCACAGAAGTTCCAGGGC | CACGATTTTTGGAGTGGTTATTATAAGGGTATGGACGTC |
| | | | SEQ ID NO:7455 | SEQ ID NO:15467 | SEQ ID NO:23479 |
| | | AA | SYGFS | WISAYNGNTKEAQKFQG | HDFWSGYYKGMDV |
| | | | SEQ ID NO:7456 | SEQ ID NO:15468 | SEQ ID NO:23480 |
| iPS:436848 | 21-225_57F1 | NA | ACTAGTGGAGTGGGTGTGGGC | CTCATTTATTGGCATGAAGATAAGCGCTACAGCCCATCTCTGAAGAGC | GTCACAGGTATAGCAGCTCCCTAC |
| | | | SEQ ID NO:7457 | SEQ ID NO:15469 | SEQ ID NO:23481 |
| | | AA | TSGVGVG | LIYWHEDKRYSPSLKS | VTGIAAPY |
| | | | SEQ ID NO:7458 | SEQ ID NO:15470 | SEQ ID NO:23482 |

FIGURE 49
(Continued)

| | | | | | |
|---|---|---|---|---|---|
| iPS:436850 | 21-225_57D9 | NA | ACTAGTGGAGTGGGTGTGGGC | CTCATTTATTGGAATGATGATAAGGCGCTACAGTCCATCTCTGAAGAGC | GCAGTGGCGTGTCCTTTGACTAC |
| | | | SEQ ID NO:7459 | SEQ ID NO:15471 | SEQ ID NO:23483 |
| | | AA | TSGVGVG | LIYWNDDKRYSPSLKS | AVAVSFDY |
| | | | SEQ ID NO:7460 | SEQ ID NO:15472 | SEQ ID NO:23484 |
| iPS:436852 | 21-225_57H11 | NA | ACTAGTGGAGTGGGTGTGGGC | CTCATTTATTGGCATGAAGATAGGCGCTACAGCCCATCTCTGAAGAGC | GTCACAGGTATAGCAGCTCCCTAC |
| | | | SEQ ID NO:7461 | SEQ ID NO:15473 | SEQ ID NO:23485 |
| | | AA | TSGVGVG | LIYWHEDRRYSPSLKS | VTGIAAPY |
| | | | SEQ ID NO:7462 | SEQ ID NO:15474 | SEQ ID NO:23486 |
| iPS:436854 | 21-225_58C1 | NA | ACTAGTGGAGTGGGTGTGGGC | CTCATTTATTGGGATGATGATAAGCGCTACAGCCCATCTCTGAAGAGC | CTTATAGCAGTGGCCTTTGACTCC |
| | | | SEQ ID NO:7463 | SEQ ID NO:15475 | SEQ ID NO:23487 |
| | | AA | TSGVGVG | LIYWDDDKRYSPSLKS | LIAVAFDS |
| | | | SEQ ID NO:7464 | SEQ ID NO:15476 | SEQ ID NO:23488 |
| iPS:436856 | 21-225_58C5 | NA | AGCTATAGCATGAAC | TCCATTAGTAGTAGTAGTTATTACTTATACTACGCAGACTCAGTGAAGGGC | ACCTATAGTGGGAGTTTTGACTAC |
| | | | SEQ ID NO:7465 | SEQ ID NO:15477 | SEQ ID NO:23489 |
| | | AA | SYSMN | SISSSSYYLYYADSVKG | TYSGSFDY |
| | | | SEQ ID NO:7466 | SEQ ID NO:15478 | SEQ ID NO:23490 |
| iPS:436858 | 21-225_58E7 | NA | TTCTATGGCATGCAC | GTTACATCATATGATGGAAGTGATAAATACTATGCAGACTCCGTGAAGGGC | GATGACTATGGTTCGGGGAGTCCCCTATACTACGGTATGGACGTC |
| | | | SEQ ID NO:7467 | SEQ ID NO:15479 | SEQ ID NO:23491 |
| | | AA | FYGMH | VTSYDGSDKYYADSVKG | DDYGSGSPLYYGMDV |

FIGURE 49
(Continued)

| | | | | | | |
|---|---|---|---|---|---|---|
| iPS:436860 | 21-225_58F7 | NA | SEQ ID NO:7468<br>AGCTTTTGGATGAGC | SEQ ID NO:15480<br>CACATAAGCAAGATGG<br>AAGTGAGAAATACTATG<br>TGGACTCTGTGAAGGGC | SEQ ID NO:23492<br>GGGGACCTCCCATACAGCTC<br>GGGCTACTACGGTATGG<br>ACGTC |
| | | AA | SEQ ID NO:7469<br>SFWMS | SEQ ID NO:15481<br>HIKQDGSEKYYVDSVKG | SEQ ID NO:23493<br>GDLPYSSGYYYGMDV |
| iPS:436862 | 21-225_58F8 | NA | SEQ ID NO:7470<br>AGCTATGGCATGCAC | SEQ ID NO:15482<br>GTTATATCATATGATGGA<br>AGTAATAAATACTATGC<br>AGACTCCGTGAAGGGC | SEQ ID NO:23494<br>GATGAGGGACGTGGATATGG<br>TGGCTACGAGAGGGGATATT<br>ACTACTACTACGGTATG<br>GACGTC |
| | | AA | SEQ ID NO:7471<br>SYGMH | SEQ ID NO:15483<br>VISYDGSNKYYADSVKG | SEQ ID NO:23495<br>DEGRGYGGGYERGYYYYYG<br>MDV |
| iPS:436864 | 21-225_58G11 | NA | SEQ ID NO:7472<br>AGCTATAGCATGAAC | SEQ ID NO:15484<br>TACATTAGTACTAGTAGT<br>AGTACCATATTCTACGCA<br>GACTCTGTGAAGGGC | SEQ ID NO:23496<br>GGGGATACAGCTATGGTCCT<br>CTACTACTACGGTATGGACG<br>TC |
| | | AA | SEQ ID NO:7473<br>SYSMN | SEQ ID NO:15485<br>YISTSSSTFYADSVKG | SEQ ID NO:23497<br>GDTAMVLYYYGMDV |
| iPS:436866 | 21-225_59F2 | NA | SEQ ID NO:7474<br>AGCTATAGCATGAAC | SEQ ID NO:15486<br>TACATTAGTGGGAGTAG<br>TAATATCATATACTACAC<br>AGACTCTGTGAAGGGC | SEQ ID NO:23498<br>GCGGATACACCTATGGTCCT<br>TTACTTCTACGGTATGGACG<br>TC |
| | | AA | SEQ ID NO:7475<br>SYSMN | SEQ ID NO:15487<br>YISGSSNIIYTDSVKG | SEQ ID NO:23499<br>ADTPMVLYFYGMDV |
| | | | SEQ ID NO:7476 | SEQ ID NO:15488 | SEQ ID NO:23500 |

FIGURE 49
(Continued)

| | | | | | |
|---|---|---|---|---|---|
| iPS:436868 | 21-225_59B11 | NA | AGTTATGGCGTGCAC | GCTATATGGTATGATGG AAGTAATAAATACTATG CAGACTCCGTGAAGGGC | GATAGGGACTATTGTAGTAG TTCCAGCTGCCCTTACTACTA CTACTACGGTATGGACGTC |
| | | AA | SYGVH SEQ ID NO:7477 | SEQ ID NO:15489 AIWYDGSNKYYADSVKG | SEQ ID NO:23501 DRDYCSSSSCPYYYYGMDV |
| | | | SEQ ID NO:7478 | SEQ ID NO:15490 | SEQ ID NO:23502 |
| iPS:436870 | 21-225_60B1 | NA | ACTAGTGGAGTGGGTGTGGG C | CTCATTTATTGCATGAA GATAAGCGCTACAGCCC ATCTCTGAAGAGC | GTCACATATAGCAGCTCC CTAC |
| | | | SEQ ID NO:7479 | SEQ ID NO:15491 | SEQ ID NO:23503 |
| | | AA | TSGVGVG | LIYWHEDKRYSPSLKS | VTYIAAPY |
| | | | SEQ ID NO:7480 | SEQ ID NO:15492 | SEQ ID NO:23504 |
| iPS:436872 | 21-225_60D2 | NA | AGCTATAGCATGAAC | TACATTAGTGAGAGTAG TAATATCATATACTACAC AGACTCTGTGAAGGGC | GCGGATACACCTATGGTCCT TTACTTCTACGGTATGGACG TC |
| | | | SEQ ID NO:7481 | SEQ ID NO:15493 | SEQ ID NO:23505 |
| | | AA | SYSMN | YISESSNIIYTDSVKG | ADTPMVLYFYGMDV |
| | | | SEQ ID NO:7482 | SEQ ID NO:15494 | SEQ ID NO:23506 |
| iPS:436874 | 21-225_60A12 | NA | ACTAGTGGAGTGGGTGTGGG C | CTCATTTATTGGGATGAT GATAAGCGCTACAGCCC ATCTCTGAAGAGC | CTTATAGCAGTGGCCTTTGA CTCC |
| | | | SEQ ID NO:7483 | SEQ ID NO:15495 | SEQ ID NO:23507 |
| | | AA | TSGVGVG | LIYWDDDKRYSPSLKS | LIAVAFDS |
| | | | SEQ ID NO:7484 | SEQ ID NO:15496 | SEQ ID NO:23508 |
| iPS:436876 | 21-225_61F5 | NA | ACTAGTGGGTTGGGTGTGGG C | CTCATTTATTCACATGAA GATAAGCGCTACAGCCC ATCTCTGAAGAGC | GTCACAGGTATAGCAGCTCC CTAC |
| | | | SEQ ID NO:7485 | SEQ ID NO:15497 | SEQ ID NO:23509 |

FIGURE 49
(Continued)

| | | AA | TSGLGVG | LIYSHEDKRYSPSLKS | VTGIAAPY |
|---|---|---|---|---|---|
| iPS:436878 | 21-225_62E3 | | SEQ ID NO:7486 | SEQ ID NO:15498 | SEQ ID NO:23510 |
| | | NA | ACTAGTGGAGTGGGGTGTGGG C | CTCATTAATTGGAATGAT GATAAGCGCTACAGCCC ATCTCTGAAGAGC | AAAGCTACCTGGGTGGCTTT TGATATC |
| | | | SEQ ID NO:7487 | SEQ ID NO:15499 | SEQ ID NO:23511 |
| iPS:436880 | 21-225_62E8 | AA | TSGVGVG | LINWNDDKRYSPSLKS | KATWVAFDI |
| | | | SEQ ID NO:7488 | SEQ ID NO:15500 | SEQ ID NO:23512 |
| | | NA | ACTAGTGGAGTGGGGTGTGGG C | CTCATTAATTGGAATGAT GATAAGCGCTACAGCCC ATCTCTGAAGAGC | AAAGCTACCTGGGTGGCTTT TGATATC |
| | | | SEQ ID NO:7489 | SEQ ID NO:15501 | SEQ ID NO:23513 |
| iPS:436882 | 21-225_62D10 | AA | TSGVGVG | LINWNDDKRYSPSLKS | KATWVAFDI |
| | | | SEQ ID NO:7490 | SEQ ID NO:15502 | SEQ ID NO:23514 |
| | | NA | ACTAGTGGAGTGGGGTGTGGG C | CTCATTAATTGGAATGAT GATAAGCGCTACAGCCC ATCTCTGAAGAGC | AAAGCTACCTGGGTGGCTTT TGATATC |
| | | | SEQ ID NO:7491 | SEQ ID NO:15503 | SEQ ID NO:23515 |
| iPS:436884 | 21-225_62A12 | AA | TSGVGVG | LINWNDDKRYSPSLKS | KATWVAFDI |
| | | | SEQ ID NO:7492 | SEQ ID NO:15504 | SEQ ID NO:23516 |
| | | NA | ACTAGTGGAGTGGGGTGTGGG C | CTCATTAATTGGAATGAT GATAAACGCTACAGCCC ATCTCTGAAGAGC | AAAACTACCTGGGTGGCTTT TGATATC |
| | | | SEQ ID NO:7493 | SEQ ID NO:15505 | SEQ ID NO:23517 |
| iPS:436886 | 21-225_62B12 | AA | TSGVGVG | LINWNDDKRYSPSLKS | KTTWVAFDI |
| | | | SEQ ID NO:7494 | SEQ ID NO:15506 | SEQ ID NO:23518 |
| | | NA | ACTAGTGGAGTGGGGTGTGGG C | CTCATTAATTGGAATGAT GATAAGCGCTACAGCCC GTCTCTGAAGAGC | AAAGCTACCTGGGTGGCTTT TGATATC |
| | | | SEQ ID NO:7495 | SEQ ID NO:15507 | SEQ ID NO:23519 |

FIGURE 49
(Continued)

| | | AA | | | | |
|---|---|---|---|---|---|---|
| iPS:436888 | 21-225_63G7 | AA | TSGVGVG<br>SEQ ID NO:7496 | LINWNDDKRYSPSLKS<br>SEQ ID NO:15508 | KATWVAFDI<br>SEQ ID NO:23520 |
| | | NA | AGCTATAGCATGAAC<br>SEQ ID NO:7497 | TACATTAGTAGTAGTACT<br>AGTACCATATACTACGC<br>AGCCTCTGTGAAGGGC<br>SEQ ID NO:15509 | GATCACCGTTACTATGATAG<br>TAGTGGTTATTACTCTGATG<br>CTTTTGATATC<br>SEQ ID NO:23521 |
| iPS:436890 | 21-225_63A10 | AA | SYSMN<br>SEQ ID NO:7498 | YISSSTSTIYYAASVKG<br>SEQ ID NO:15510 | DHRYYDSSGYYSDAFDI<br>SEQ ID NO:23522 |
| | | NA | AGCTATAGCATGAAC<br>SEQ ID NO:7499 | TACATTAGTAGTAGTACT<br>AGTACCATATACTACGC<br>AGCCTCTGTGAAGGGC<br>SEQ ID NO:15511 | GATCACCGTTACTATGATAG<br>TAGTGGTTATTACTCTGATG<br>CTTTTGATATC<br>SEQ ID NO:23523 |
| iPS:436892 | 21-225_65E9 | AA | SYSMN<br>SEQ ID NO:7500 | YISSSTSTIYYAASVKG<br>SEQ ID NO:15512 | DHRYYDSSGYYSDAFDI<br>SEQ ID NO:23524 |
| | | NA | GGCTACTATATGCAC<br>SEQ ID NO:7501 | TGGATCAACCCTAACAG<br>TGGTGGCACAAATTATG<br>CACAGAAGTTTCAGGGC<br>SEQ ID NO:15513 | GCGTATTATATGGTTCGGG<br>GAGTTATTATAATGAATTG<br>ATATG<br>SEQ ID NO:23525 |
| iPS:436894 | 21-225_66G9 | AA | GYYMH<br>SEQ ID NO:7502 | WINPNSGGTNYAQKFQG<br>SEQ ID NO:15514 | AYYYGSGSYYNEFDM<br>SEQ ID NO:23526 |
| | | NA | ACTAGTGGAGTGGGTGTGGG<br>C<br>SEQ ID NO:7503 | CTCATTAATTGGAATGAT<br>GATAAGCGCTTCAGCC<br>ATCTCTGAAGAGC<br>SEQ ID NO:15515 | AAAGCTACCTGGGTGGCTTT<br>TGATATC<br>SEQ ID NO:23527 |
| iPS:436896 | 21-225_67F10 | AA | TSGVGVG<br>SEQ ID NO:7504 | LINWNDDKRFSPSLKS<br>SEQ ID NO:15516 | KATWVAFDI<br>SEQ ID NO:23528 |
| | | NA | GGCTACTATATGCAC<br>SEQ ID NO:7505 | TGGATCAACCCTAACAG<br>TGGTGGCACAAACTATG<br>GACAGAAGTTTCAGGGC<br>SEQ ID NO:15517 | ACGTATTTCTATGGTTCGGG<br>GAGTTATTATAACGGCTTTG<br>ACTAC<br>SEQ ID NO:23529 |

FIGURE 49
(Continued)

| | | | | | |
|---|---|---|---|---|---|
| iPS:436898 | 21-225_68D8 | AA | GYYMH<br>SEQ ID NO:7506 | WINPNSGGTNYGQKFQG<br>SEQ ID NO:15518 | TYFYGSGSYYNGFDY<br>SEQ ID NO:23530 |
| | | NA | AGCAACAGTGCTGCTTGGAAC<br>SEQ ID NO:7507 | AGGACATACTACAGGTCCGAGTGCTATAATGATTATGCAGTATCTGTGCAGAGT<br>SEQ ID NO:15519 | GATAGAGGGCATAGAGGGTTCTACGGTATGGACGTC<br>SEQ ID NO:23531 |
| iPS:436900 | 21-225_69B9 | AA | SNSAAWN<br>SEQ ID NO:7508 | RTYYRSECYNDYAVSVQS<br>SEQ ID NO:15520 | DRGHRGFYGMDV<br>SEQ ID NO:23532 |
| | | NA | GGCTACCATATGCAC<br>SEQ ID NO:7509 | TGGATCAACCCTAACAGTGGTGGCACAAATTATGCACAGAAGTTTCAGGGC<br>SEQ ID NO:15521 | GCGTATTATTATGGTTCGGGGAGTTATTATAATGAATCTGATATG<br>SEQ ID NO:23533 |
| iPS:436902 | 21-225_69B11 | AA | GYHMH<br>SEQ ID NO:7510 | WINPNSGGTNYAQKFQG<br>SEQ ID NO:15522 | AYYYGSGSYYNESDM<br>SEQ ID NO:23534 |
| | | NA | GGCTACTATATGCAC<br>SEQ ID NO:7511 | TGGATCAACCCTAACAGTGGTGGCACAAACTATGGACAGAAGTTTCAGGAC<br>SEQ ID NO:15523 | ACGTATTACTATGGGTCGGGGAGTTATTATAACGGCTTTG ACTAC<br>SEQ ID NO:23535 |
| | | AA | GYYMH<br>SEQ ID NO:7512 | WINPNSGGTNYGQKFQD<br>SEQ ID NO:15524 | TYYYGSGSYYNGFDY<br>SEQ ID NO:23536 |
| iPS:436904 | 21-225_71D4 | NA | GGCTACTGTATGCAC<br>SEQ ID NO:7513 | TGGATCAACCCTAACAGTGGTGGCACAAACTATGCACAGAAGTTTCAGGTC<br>SEQ ID NO:15525 | GCGTATTACTATGGTTCGGGGGACTTATCATAACGAATTTG ACTAC<br>SEQ ID NO:23537 |
| | | AA | GYCMH<br>SEQ ID NO:7514 | WINPNSGGTNYAQKFQV<br>SEQ ID NO:15526 | AYYYGSGTYHNEFDY<br>SEQ ID NO:23538 |

FIGURE 49
(Continued)

| | | | | GGCTACTATATGCAC | TGGATCAACCCTAACAG TGGTGGCACAAACTATG GACAGAAGTTTCAGGGC | ACGTATTACTATGGTTCGGG GAGTTATTATAACGGCTTTG ACTAC |
|---|---|---|---|---|---|---|
| iPS:436906 | 21-225_72B4 | NA | | SEQ ID NO:7515 | SEQ ID NO:15527 | SEQ ID NO:23539 |
| | | AA | GYYMH | | WINPNSGGTNYGQKFQG | TYYYGSGSYYNGFDY |
| | | | | SEQ ID NO:7516 | SEQ ID NO:15528 | SEQ ID NO:23540 |
| iPS:436908 | 21-225_72D5 | NA | | ACTAGTGGAGTGGGTGTGGG C | CTCATTAATTGGAATGAT GATAAGCGCTACAGCCC ATCTCTGAAGAGC | AAAGCTACCTGGGTGGCTTT TGATATC |
| | | | | SEQ ID NO:7517 | SEQ ID NO:15529 | SEQ ID NO:23541 |
| | | AA | TSGVGVG | | LINWNDDKRYSPSLKS | KATWVAFDI |
| | | | | SEQ ID NO:7518 | SEQ ID NO:15530 | SEQ ID NO:23542 |
| iPS:436910 | 21-225_73G1 | NA | | TACTATGGCATGCAC | GTTACAACATATGATGG AAGTAATAAATACTATG CAGACTCCGTGAAGGGC | GAGACTGGAACCTGGGCTTT TGATATC |
| | | | | SEQ ID NO:7519 | SEQ ID NO:15531 | SEQ ID NO:23543 |
| | | AA | YYGMH | | VITYDGSNKYYADSVKG | ETGTWAFDI |
| | | | | SEQ ID NO:7520 | SEQ ID NO:15532 | SEQ ID NO:23544 |
| iPS:436912 | 21-225_73C4 | NA | | ACTAGTGGAGTGGGTGTGGG C | CTCATTAATTGGAATGAT GATAAGCGCTACAGCCC ATCTCTGAAGAGC | AAAACTACCTGGGTGGCTTT TGATATC |
| | | | | SEQ ID NO:7521 | SEQ ID NO:15533 | SEQ ID NO:23545 |
| | | AA | TSGVGVG | | LINWNDDKRYSPSLKS | KTTWVAFDI |
| | | | | SEQ ID NO:7522 | SEQ ID NO:15534 | SEQ ID NO:23546 |
| iPS:436914 | 21-225_76B4 | NA | | ACTGGTGGAGTGGGTGTGGG C | CTCATTATTGGAATGAT GATAAGCGCTACAGCCC ATCTCTGAAGAGC | CTTATAGCAGTGGCCTTTGA CTAC |
| | | | | SEQ ID NO:7523 | SEQ ID NO:15535 | SEQ ID NO:23547 |

FIGURE 49
(Continued)

| | | | | | | |
|---|---|---|---|---|---|---|
| iPS:436916 | 21-225_74A9 | AA | TGGVGVG | | LIYWDDDKRYSPSLKS | LIAVAFDY |
| | | | SEQ ID NO:7524 | | SEQ ID NO:15535 | SEQ ID NO:23548 |
| | | NA | AGCTATGGCATGCAC | | GTTATATGGTATGATGGG AATAATAAATCCTATG CAGACTCCGTGAAGGGC | GATCGAGATTATTGTAGTGG TACCAGCTGCCCTTATTATTA CTACTACGGTATGGACGTC |
| | | | SEQ ID NO:7525 | | SEQ ID NO:15537 | SEQ ID NO:23549 |
| | | AA | SYGMH | | VIWYDGNNKSYADSVKG | DRDYCSGTSCPYYYYGMDV |
| | | | SEQ ID NO:7526 | | SEQ ID NO:15538 | SEQ ID NO:23550 |
| iPS:436918 | 21-225_77A2 | NA | ACTAGTGGAGTGGGTGTGGG C | | TTCATTTATTGGGATGAT GATAAGCGCTACAGCCC ATCTCTGAAGAGC | CTTATAGCAGTGGCTTTGA CTAC |
| | | | SEQ ID NO:7527 | | SEQ ID NO:15539 | SEQ ID NO:23551 |
| | | AA | TSGVGVG | | FIYWDDDKRYSPSLKS | LIAVAFDY |
| | | | SEQ ID NO:7528 | | SEQ ID NO:15540 | SEQ ID NO:23552 |
| iPS:436920 | 21-225_74E5 | NA | AGTGGTGGTTACTACTGGAG C | | TACATCTATTACAGTGGG AGCACTACTACAACCC GTCCCTCAGGAGT | GATTCACCAGTGGCTGGTAC TGACTAC |
| | | | SEQ ID NO:7529 | | SEQ ID NO:15541 | SEQ ID NO:23553 |
| | | AA | SGGYYWS | | YIYYSGSTYYNPSLRS | DSPVAGTDY |
| | | | SEQ ID NO:7530 | | SEQ ID NO:15542 | SEQ ID NO:23554 |
| iPS:436922 | 21-225_78E9 | NA | AGCTATGGCATGCAC | | GTTATATGGTATGATGGG AATAATAAATCCTATG CAGACTCCGTGAAGGGC | GATCGAGATTATTGTAGTAG TACCAGCTGCCCTTATTATTA CTACTACGGTATGGACGTC |
| | | | SEQ ID NO:7531 | | SEQ ID NO:15543 | SEQ ID NO:23555 |
| | | AA | SYGMH | | VIWYDGNNKSYADSVKG | DRDYCSSTSCPYYYYGMDV |
| | | | SEQ ID NO:7532 | | SEQ ID NO:15544 | SEQ ID NO:23556 |

FIGURE 49
(Continued)

| | | | | | |
|---|---|---|---|---|---|
| iPS:436924 | 21-225_74B3 | NA | CGATATGGCATGCAC<br><br>SEQ ID NO:7533 | GTTTTTGTTGGTATGATGGA<br>AGTAATAAAGACTATGC<br>AGACTCCGTGAAGGGC<br><br>SEQ ID NO:15545 | GATCGAGATTATTGTAGTAG<br>TACCAGCTGCCCTACTACT<br>ACTACTACGGTATGGACGTC<br><br>SEQ ID NO:23557 |
| | | AA | RYGMH<br><br>SEQ ID NO:7534 | VFWYDGSNKDYADSVKG<br><br>SEQ ID NO:15546 | DRDYCSSTSCPYYYYGMDV<br><br>SEQ ID NO:23558 |
| iPS:436926 | 21-225_78D10 | NA | AGTGGTGGTTACTACTGGAG<br>C<br><br>SEQ ID NO:7535 | TACATCTATTACACATTGGG<br>AGTGTTACTACAACCCG<br>TCCCTCAAGAGT<br><br>SEQ ID NO:15547 | GATGCCCCGACTTCGGTAT<br>GGACGTC<br><br>SEQ ID NO:23559 |
| | | AA | SGGYYWS<br><br>SEQ ID NO:7536 | YIYYIGSVYYNPSLKS<br><br>SEQ ID NO:15548 | DAPDFGMDV<br><br>SEQ ID NO:23560 |
| iPS:436928 | 21-225_79E7 | NA | AGCTATGGCATGCAC<br><br>SEQ ID NO:7537 | GTTATATGGTATGATGG<br>AAATAATAAATCCTATG<br>CAGACTCCGTGAAGGGC<br><br>SEQ ID NO:15549 | GATCGAGATTATTGTAGTAG<br>TACCAGCTGCCCTTATTATTA<br>CTACTACGGTATGGACGTC<br><br>SEQ ID NO:23561 |
| | | AA | SYGMH<br><br>SEQ ID NO:7538 | VIWYDGNNKSYADSVKG<br><br>SEQ ID NO:15550 | DRDYCSSTSCPYYYYGMDV<br><br>SEQ ID NO:23562 |
| iPS:436932 | 21-225_92A4 | NA | AGCTATGGCATGCAC<br><br>SEQ ID NO:7539 | GTTATATGGTATGATGG<br>AAATAATAAATCCTATG<br>CAGACTCCGTGAAGGGC<br><br>SEQ ID NO:15551 | GATCGAGATTATTGTAGTAG<br>TACCAGCTGCCCTTATTATTA<br>CTACTACGGTATGGACGTC<br><br>SEQ ID NO:23563 |
| | | AA | SYGMH<br><br>SEQ ID NO:7540 | VIWYDGNNKSYADSVKG<br><br>SEQ ID NO:15552 | DRDYCSSTSCPYYYYGMDV<br><br>SEQ ID NO:23564 |

FIGURE 49
(Continued)

| | | | | |
|---|---|---|---|---|
| iPS:436934 | 21-225_96B5 | NA | ACTGGTGGAGTGGGGTGTGGG C | CTCATTTATTGGGATGAT GATAAGCGCTACAGCCC ATCTCTGAAGAGC | CTTATAGCAGTGGCCTGTGA CTAC |
| | | | SEQ ID NO:7541 | SEQ ID NO:15553 | SEQ ID NO:23565 |
| | | AA | TGGVGVG | LIYWDDDKRYSPSLKS | LIAVACDY |
| | | | SEQ ID NO:7542 | SEQ ID NO:15554 | SEQ ID NO:23566 |
| iPS:436936 | 21-225_97E6 | NA | AGCTATGGCATGCAC | GTTATATGGTATGATGG AAATAATAAATCCTATG CAGACTCCGTGAAGGGC | GATCGAGATTATTGTAGTAG TACCAGCTGCCCTTATTATTA CTACTACGGTATGGACGTC |
| | | | SEQ ID NO:7543 | SEQ ID NO:15555 | SEQ ID NO:23567 |
| | | AA | SYGMH | VIWYDGNNKSYADSVKG | DRDYCSSTSCPYYYYGMDV |
| | | | SEQ ID NO:7544 | SEQ ID NO:15556 | SEQ ID NO:23568 |
| iPS:436938 | 21-225_146A3 | NA | AGCTATGCCATGAGC | GTTATTAGTGGTGGTGGT ACTACCACATACTACG AGACTCCGTGAAGGGC | TGGCGAGGTAACCCCACTGA CTACGGTATGGACGTC |
| | | | SEQ ID NO:7545 | SEQ ID NO:15557 | SEQ ID NO:23569 |
| | | AA | SYAMS | VISGGGTTTYYADSVKG | WRGNPTDYGMDV |
| | | | SEQ ID NO:7546 | SEQ ID NO:15558 | SEQ ID NO:23570 |
| iPS:436940 | 21-225_146B8 | NA | ACCTATGGCATGCAC | GTTGTATGGTATGGTGG AAATGATAAAGACTTTG CAGACTCCGTGACGGGC | GATCGGGATTATTGTAGTGG TGGTAGCTGCCCTTACTACT ACTACTACGGTATGGACGTC |
| | | | SEQ ID NO:7547 | SEQ ID NO:15559 | SEQ ID NO:23571 |
| | | AA | TYGMH | VVWYGGNDKDFADSVTG | DRDYCSGGSCPYYYYGMDV |
| | | | SEQ ID NO:7548 | SEQ ID NO:15560 | SEQ ID NO:23572 |

FIGURE 49
(Continued)

| | | | | |
|---|---|---|---|---|
| iPS:436942 | 21-225_146H8 | NA | AGTTATGATATCAAT | TGGATGAACCCTAACAG TGGTAACACAGGCTATG CACAGAAGTTCCAGGGC | GGAGATTATTACTATGATAG TAGTGGTCACCAGCCTTACT ACTACTACGGTATGGAC GTC |
| | | | SEQ ID NO:7549 | SEQ ID NO:15561 | SEQ ID NO:23573 |
| | | AA | SYDIN | WMNPNSGNTGYAQKFQG | GDYYYDSSGHQPYYYYGMD V |
| | | | SEQ ID NO:7550 | SEQ ID NO:15562 | SEQ ID NO:23574 |
| iPS:436944 | 21-225_182D12 | NA | ACTACTGGAGTGGGTGTGGG C | ATCCTTTTTGGAATGAT GATGAGCGCTACAGCCC ATCTCTGAAGAGC | AAATCGCAGCTCGTCTACTT TGACTAC |
| | | | SEQ ID NO:7551 | SEQ ID NO:15563 | SEQ ID NO:23575 |
| | | AA | TTGVGVG | ILFWNDDERYSPSLKS | KSQLVYFDY |
| | | | SEQ ID NO:7552 | SEQ ID NO:15564 | SEQ ID NO:23576 |
| iPS:436946 | 21-225_183F4 | NA | AGCTATGGCATGCAC | GTTATATGGTATGATGG AAGTAATAAATACTATG CAGACTCCGTGAAGGGC | GAAAGGACGTATTGTAGTGG TACCACCTGCCCTACTACT ACTACTACGGTCTGGGCGTC |
| | | | SEQ ID NO:7553 | SEQ ID NO:15565 | SEQ ID NO:23577 |
| | | AA | SYGMH | VIWYDGSNKYYADSVKG | ERTYCSGTTCPYYYYGLGV |
| | | | SEQ ID NO:7554 | SEQ ID NO:15566 | SEQ ID NO:23578 |
| iPS:436948 | 21-225_183F5 | NA | AGTTATGGCATGCTC | GTTATATGGTATGATGG AAGTGGTAAATACTATG CAGACTCCGTGAAGGGC | GAGAATTTTTGGAGTGGTGA CTAC |
| | | | SEQ ID NO:7555 | SEQ ID NO:15567 | SEQ ID NO:23579 |
| | | AA | SYGML | VIWYDGSGKYYADSVKG | ENFWSGDY |
| | | | SEQ ID NO:7556 | SEQ ID NO:15568 | SEQ ID NO:23580 |

FIGURE 49
(Continued)

| | | | | | |
|---|---|---|---|---|---|
| iPS:436950 | 21-225_184G4 | NA | AGCTATGGCATGCAC | ATTATATGGTATGATGG AAGTAATAAATACTATG CAGACTCCGTGAAGGGC | GGGGGGCCCCGTTCTCTAC GGTGACTATGTACTTTGACT AC |
| | | | SEQ ID NO:7557 | SEQ ID NO:15569 | SEQ ID NO:23581 |
| | | AA | SYGMH | IIWYDGSNKYYADSVKG | GGPPFSTVTMYFDY |
| | | | SEQ ID NO:7558 | SEQ ID NO:15570 | SEQ ID NO:23582 |
| iPS:436952 | 21-225_185D2 | NA | AACTATGGCATGCAC | ATTATATGGTATGATGG AAGTGATAAATACTATG CAGACTCCGTGAAGGGC | GGGGGGCCCCGTTCTCTAC GGTGACTATGTACTTTGACT AC |
| | | | SEQ ID NO:7559 | SEQ ID NO:15571 | SEQ ID NO:23583 |
| | | AA | NYGMH | IIWYDGSDKYYADSVKG | GGPPFSTVTMYFDY |
| | | | SEQ ID NO:7560 | SEQ ID NO:15572 | SEQ ID NO:23584 |
| iPS:436954 | 21-225_185G7 | NA | ACTGGTGGAGTGGGTGTGGG C | CTCATTTATTGGAATGAT GATGAGCGCTACAGCCC ATCTCTGAAGAGC | ATTATAGCAGTGGCCTTCCA GCAT |
| | | | SEQ ID NO:7561 | SEQ ID NO:15573 | SEQ ID NO:23585 |
| | | AA | TGGVGVG | LIYWNDDERYSPSLKS | IIAVAFQH |
| | | | SEQ ID NO:7562 | SEQ ID NO:15574 | SEQ ID NO:23586 |
| iPS:436956 | 21-225_186H6 | NA | ACTAGTGGAGTGGGTGTGGG C | TTCATTTCTTGGAATGAT GATAAGGCGCTACAGCCC ATCTCTGAAGAGC | AAAGCAGCAGCTGTTGCTTT TGATATC |
| | | | SEQ ID NO:7563 | SEQ ID NO:15575 | SEQ ID NO:23587 |
| | | AA | TSGVGVG | FISWNDDKRYSPSLKS | KAAAVAFDI |
| | | | SEQ ID NO:7564 | SEQ ID NO:15576 | SEQ ID NO:23588 |
| iPS:436958 | 21-225_190D1 | NA | AGTGGTGGTTACTACTGGAG C | TACATCTATTACAGTGGG AGCACCTACTACAACCC GTCCCTCAAGAGT | GATTCCCCACTACGAGGCTT TGACTAC |
| | | | SEQ ID NO:7565 | SEQ ID NO:15577 | SEQ ID NO:23589 |
| | | AA | SGGYYWS | YIYYSGSTYYNPSLKS | DSPLRGFDY |

FIGURE 49
(Continued)

| | | | | | | |
|---|---|---|---|---|---|---|
| iPS:436960 | 21-225_198D2 | NA | SEQ ID NO:7566 AGCTATGGCATGCAT | SEQ ID NO:15578 GTTATAATATGATGG AAGTTATAAGTACTATG CAGACTCCGTGAAGGGC | SEQ ID NO:23590 ACGTATAGCGGGGGTATGGA CGTC | |
| | | AA | SEQ ID NO:7567 SYGMH | SEQ ID NO:15579 VIIYDGSYKYYADSVKG | SEQ ID NO:23591 TYSGGMDV | |
| iPS:436962 | 21-225_190H1 | NA | SEQ ID NO:7568 AGGAAAAGTGCTACTTGGAAC | SEQ ID NO:15580 AAGACATACTACAGGTC CAAGTGGTATAATGATT ATGCAGTATCTGTGAAA AGT | SEQ ID NO:23592 GATCCGGGTGGCCTCTTTGA CTAC | |
| | | AA | SEQ ID NO:7569 RKSATWN | SEQ ID NO:15581 KTYYRSKWYNDYAVSVK S | SEQ ID NO:23593 DPGGLFDY | |
| iPS:436964 | 21-225_190B3 | NA | SEQ ID NO:7570 AACTATGGCATACAC | SEQ ID NO:15582 GTTATATGGTTTGATGGA GATAATAAATACTATGC AGACTCCGTGAAGGGC | SEQ ID NO:23594 GATAACTGGAACTACGGCGA TCACTACTACTACTTCGGTAT GGACGTC | |
| | | AA | SEQ ID NO:7571 NYGIH | SEQ ID NO:15583 VIWFDGDNKYYADSVKG | SEQ ID NO:23595 DNWNYGDHYYYFGMDV | |
| iPS:436966 | 21-225_190C3 | NA | SEQ ID NO:7572 AGCTATGGCATGCAC | SEQ ID NO:15584 GTTATATGGTATGATGG AAGTAATAATACTATG CAGACTCCGTGAAGGGC | SEQ ID NO:23596 TGGTACTACTACTACTACGG TATGGACGTC | |
| | | AA | SEQ ID NO:7573 SYGMH | SEQ ID NO:15585 VIWYDGSNKYYADSVKG | SEQ ID NO:23597 WYYYYGMDV | |

FIGURE 49
(Continued)

| | | | | | |
|---|---|---|---|---|---|
| iPS:436968 | 21-225_190B10 | NA | SEQ ID NO:7574 AGCTATGGCATGCAC | SEQ ID NO:15586 GTTATATGGAATGATGG AAGTAAAAATACCATG TAGACTCCGTGAAGGGC | SEQ ID NO:23598 GATCTGGATAAGAGGAACTT TCCTTATTACTACTACTACGG TATGGACGTC |
| | | AA | SEQ ID NO:7575 SYGMH | SEQ ID NO:15587 VIWNDGSKKYHVDSVKG | SEQ ID NO:23599 DLDKRNFPYYYYYGMDV |
| iPS:436970 | 21-225_190B8 | NA | SEQ ID NO:7576 AGCTATGGCATGCAC | SEQ ID NO:15588 GTTATATGGTTTGATGGA AGTAATAAATACTATAC AGACTCCGTGAAGGGC | SEQ ID NO:23600 GATAAACTGGAACTACGGCGA TTACTACTACTACGGTA TGGACGTC |
| | | AA | SEQ ID NO:7577 SYGMH | SEQ ID NO:15589 VIWFDGSNKYYTDSVKG | SEQ ID NO:23601 DNWNYGDYYYYYGMDV |
| iPS:436972 | 21-225_190C7 | NA | SEQ ID NO:7578 GGCTACTATATGCAC | SEQ ID NO:15590 TGGATCAACCCTAACAG TGGTGGCACAAACTATG CACAGAAGTTTCAGGGC | SEQ ID NO:23602 GATAGAGCAGTGGCTGGAAA CTACTTCTACTACGGTATGG ACGTC |
| | | AA | SEQ ID NO:7579 GYYMH | SEQ ID NO:15591 WINPNSGGTNYAQKFQG | SEQ ID NO:23603 DRAVAGNYFYYGMDV |
| iPS:436974 | 21-225_190H7 | NA | SEQ ID NO:7580 AGCTATGGCATGCAT | SEQ ID NO:15592 GTTATATATATGATGG AAGTTATAAGTACTACTATG CAGACTCCGTGAAGGGC | SEQ ID NO:23604 ACGTATAGCCGGGGGTATGGA CGTC |
| | | AA | SEQ ID NO:7581 SYGMH | SEQ ID NO:15593 VIIYDGSYKYYADSVKG | SEQ ID NO:23605 TYSGGMDV |
| | | | SEQ ID NO:7582 | SEQ ID NO:15594 | SEQ ID NO:23606 |

FIGURE 49
(Continued)

| | | | | | |
|---|---|---|---|---|---|
| iPS:436976 | 21-225_190D8 | NA | AGCTATGGCCTGCAC | GTTATATGGTATGATGGAAGTAATAAATACTATGCAGACTCCGTGAAGGGC | TGGTACTACTACTACTACGGTATGGACGTC |
| | | AA | SEQ ID NO:7583<br>SYGLH | SEQ ID NO:15595<br>VIWYDGSNKYYADSVKG | SEQ ID NO:23607<br>WYYYYYGMDV |
| iPS:436978 | 21-225_190G9 | NA | SEQ ID NO:7584<br>AGGAAAAGTGCTACTTGGAAC | SEQ ID NO:15596<br>AGGACATACTACAGGTCCAAGTGGTATAATGATTATGCAGTATCTGTGAAAAGT | SEQ ID NO:23608<br>GATCCGGGTGGCCTCTTTGACTAC |
| | | AA | SEQ ID NO:7585<br>RKSATWN | SEQ ID NO:15597<br>RTYYRSKWYNDYAVSVKS | SEQ ID NO:23609<br>DPGGLFDY |
| iPS:436980 | 21-225_190C10 | NA | SEQ ID NO:7586<br>AACTATGGCATGCAC | SEQ ID NO:15598<br>GTTATATGGTTTGGTGGAGATAATAAATACTATGCAGACTCCGTGAGGGGC | SEQ ID NO:23610<br>GATAACTGGAACTACGGCGATCACTACTACTATTACGGAATGGACGTC |
| | | AA | SEQ ID NO:7587<br>NYGMH | SEQ ID NO:15599<br>VIWFGGDNKYYADSVRG | SEQ ID NO:23611<br>DNWNYGDHYYYYGMDV |
| iPS:436982 | 21-225_190D10 | NA | SEQ ID NO:7588<br>AGCTATGGCATGCAT | SEQ ID NO:15600<br>GTTATATATATGATGGAAGTTATAAGTACTATGCAGACTCCGTGAAGGGC | SEQ ID NO:23612<br>ACGTATAGCGGGGGTATGGACGTC |
| | | AA | SEQ ID NO:7589<br>SYGMH | SEQ ID NO:15601<br>VIHYDGSYKYYADSVKG | SEQ ID NO:23613<br>TYSGGMDV |
| | | | SEQ ID NO:7590 | SEQ ID NO:15602 | SEQ ID NO:23614 |

FIGURE 49
(Continued)

| | | | | |
|---|---|---|---|---|
| iPS:436984 | 21-225_190F10 | NA | AGTGGTGGTGACTACTGGAGC | TACACTCTATTACAGTGGGATCACCTACTACAATCCGTCCCTCAAGAGT | GATAGCAGCTCGCGGGGTATGGACGTC |
| | | | SEQ ID NO:7591 | SEQ ID NO:15603 | SEQ ID NO:23615 |
| | | AA | SGGDYWS | YIYYSGITYYNPSLKS | DSSSRGMDV |
| | | | SEQ ID NO:7592 | SEQ ID NO:15604 | SEQ ID NO:23616 |
| iPS:436986 | 21-225_191A1 | NA | AGTTACTACTGGATC | TATATCTATTACAGTGGGAGTACTAAGTACAACCCCTCCCTCAAGAGT | AAGGGAGTGGGAACCATCCACTTTGACTAC |
| | | | SEQ ID NO:7593 | SEQ ID NO:15605 | SEQ ID NO:23617 |
| | | AA | SYYWI | YIYYSGSTKYNPSLKS | KGVGTIHFDY |
| | | | SEQ ID NO:7594 | SEQ ID NO:15606 | SEQ ID NO:23618 |
| iPS:436988 | 21-225_191A2 | NA | AGTGGTGGTGACTACTGGAGC | TACACTCTATTACAGTGGGATCACCTACTACAATCCGTCCCTCAAGAGT | GATAGCAGCTCGCGGGGTATGGACGTC |
| | | | SEQ ID NO:7595 | SEQ ID NO:15607 | SEQ ID NO:23619 |
| | | AA | SGGDYWS | YIYYSGITYYNPSLKS | DSSSRGMDV |
| | | | SEQ ID NO:7596 | SEQ ID NO:15608 | SEQ ID NO:23620 |
| iPS:436992 | 21-225_191B8 | NA | AGCTATGGCATGCAC | GTTATATGGTTTGATGGAAGTAATAAATACTATGCAGACTCCGTGAAGGGC | GATAACTGGAACTACGGCGATCACTACTACTACGGTATGGACGTC |
| | | | SEQ ID NO:7597 | SEQ ID NO:15609 | SEQ ID NO:23621 |
| | | AA | SYGMH | VIWFDGSNKYYADSVKG | DNWNYGDHYYYGMDV |
| | | | SEQ ID NO:7598 | SEQ ID NO:15610 | SEQ ID NO:23622 |
| iPS:436994 | 21-225_191A9 | NA | AATTATGGCATGCAC | GTTATATGGTTTGGTGGAGATAATAAATACTATGCAGACTCCGTGAAGGGC | GATAACTGGAACTACGGCGATCACTACTACTATTACGGTATGGACGTC |
| | | | SEQ ID NO:7599 | SEQ ID NO:15611 | SEQ ID NO:23623 |

FIGURE 49
(Continued)

| | | AA | NYGMH | | VIWFGGDNKYYADSVKG | | DNWNYGDHYYYYGMDV | |
|---|---|---|---|---|---|---|---|---|
| iPS:436996 | | | SEQ ID NO:7600 | | SEQ ID NO:15612 | | SEQ ID NO:23624 | |
| | 21-225_191B9 | NA | TTCCATGGCATGCAC | | GTTATATGGTATGATGG AAGTAAAAATACTATG CAGACTCCGTGAAGGGC | | GAAGGGTATAGCAGTGGCTT TTACAGGGGGTTTGACAAC | |
| | | | SEQ ID NO:7601 | | SEQ ID NO:15613 | | SEQ ID NO:23625 | |
| | | AA | FHGMH | | VIWYDGSKKYYADSVKG | | EGYSSGFYRGFDN | |
| iPS:437000 | | | SEQ ID NO:7602 | | SEQ ID NO:15614 | | SEQ ID NO:23626 | |
| | 21-225_191G9 | NA | ACCTATGGCATGCAC | | CTTATATGGTTTGATGGA AGTAATAAATACTATGC AGACTCCGTGAAGGGC | | GATCGGGTGGGAGGTACTAG TCCTCCTTACTACTACTACTA CGGTATGGACGTC | |
| | | | SEQ ID NO:7603 | | SEQ ID NO:15615 | | SEQ ID NO:23627 | |
| | | AA | TYGMH | | LIWFDGSNKYYADSVKG | | DRVGGTSPPYYYYGMDV | |
| iPS:437002 | | | SEQ ID NO:7604 | | SEQ ID NO:15616 | | SEQ ID NO:23628 | |
| | 21-225_191H9 | NA | GGCTACAATATGCAC | | TGGATCAACCTAATAG TGGTGGCACAAACTATG CACACAAGTTTCAGGGC | | GATTTCTATGATAGTGGTGG AGAAGGGTGGTTCGACCCC | |
| | | | SEQ ID NO:7605 | | SEQ ID NO:15617 | | SEQ ID NO:23629 | |
| | | AA | GYNMH | | WINPNSGGTNYAHKFQG | | DFYDSGGEGWFDP | |
| iPS:437006 | | | SEQ ID NO:7606 | | SEQ ID NO:15618 | | SEQ ID NO:23630 | |
| | 21-225_192G2 | NA | AGCTATGGCATGCAC | | GTTATATGGAATGATGG AAGTAATAAATACTATG CAGACTCCGTGAAGGGC | | GATCTGGATAAGAGGAACTT TCCTTATTACTACTACTACGG TATGGACGTC | |
| | | | SEQ ID NO:7607 | | SEQ ID NO:15619 | | SEQ ID NO:23631 | |

FIGURE 49
(Continued)

| | | AA | SYGMH | | VIWNDGSNKYYADSVKG | | DLDKRNFPYYYYGMDV | |
|---|---|---|---|---|---|---|---|---|
| | | | SEQ ID NO:7608 | | SEQ ID NO:15620 | | SEQ ID NO:23632 | |
| iPS:437008 | 21-225_192E3 | NA | AGTGGTGGTTACTACTGGAG C | | TACATCTATTACACTGGG AGCACCTACTACAACC GTCCCTCAAGAGT | | GACGATCCCCTCTACGGAAT GGACGTC | |
| | | | SEQ ID NO:7609 | | SEQ ID NO:15621 | | SEQ ID NO:23633 | |
| | | | SGGYYWS | | YIYYTGSTYNPSLKS | | DDPLYGMDV | |
| | | | SEQ ID NO:7610 | | SEQ ID NO:15622 | | SEQ ID NO:23634 | |
| iPS:437010 | 21-225_192G3 | AA | AATTACTACTGGAGC | | CGGATCTATTCCAGTGG GAGCACCAACTACAACC CCTCCCTCAAGAGT | | GGGTGGGAGCTAAACTAC | |
| | | | SEQ ID NO:7611 | | SEQ ID NO:15623 | | SEQ ID NO:23635 | |
| | | AA | NYYWS | | RIYSSGSTNYNPSLKS | | GWELNY | |
| | | | SEQ ID NO:7612 | | SEQ ID NO:15624 | | SEQ ID NO:23636 | |
| iPS:437012 | 21-225_192G7 | NA | AGTGGTGGTTACTACTGGAG C | | TACATCTATTACAGAGG GAGTACCTACTACAATC CGTCCCTCAAGAGT | | GACTCCCGGTGACAGGATT TGACTAT | |
| | | | SEQ ID NO:7613 | | SEQ ID NO:15625 | | SEQ ID NO:23637 | |
| | | AA | SGGYYWS | | YIYYRGSTYNPSLKS | | DSPVTGFDY | |
| | | | SEQ ID NO:7614 | | SEQ ID NO:15626 | | SEQ ID NO:23638 | |
| iPS:437014 | 21-225_192H8 | NA | AGTGGTGGTGGTGACTACTGGAG C | | TACATCTATTACAGTGGG CCCACCTACTACAACCC GTCCCTCAAGAGT | | GATAGCTCCCTCTACGGTAT GGACGTC | |
| | | | SEQ ID NO:7615 | | SEQ ID NO:15627 | | SEQ ID NO:23639 | |
| | | AA | SGGDYWS | | YIYYSGPTYYNPSLKS | | DSSLYGMDV | |
| | | | SEQ ID NO:7616 | | SEQ ID NO:15628 | | SEQ ID NO:23640 | |
| iPS:437016 | 21_225_193A6 | NA | AGTTACTACTGGAGC | | TATATCTATTACAGTGGG AGCACCAACTACAACCC CTCCCTCAAGAGT | | GGATGGGAGCTAAACTAC | |

FIGURE 49
(Continued)

| | | | | | | | |
|---|---|---|---|---|---|---|---|
| iPS:437018 | 21-225_193A6 | AA | SEQ ID NO:7617<br>SYYWS | SEQ ID NO:15629<br>YIYYSGSTNYNPSLKS | SEQ ID NO:23641<br>GWELNY |
| | | NA | SEQ ID NO:7618<br>AACGCCTACATGACC | SEQ ID NO:15630<br>CGTATTAAAAGCAAAAC<br>TGATGGTGGGACAACAG<br>ACTACGCTGCACCCGTG<br>AAAGGC | SEQ ID NO:23642<br>GATCCCGGTGGTATCTTTGA<br>CTAC |
| iPS:437020 | 21-225_193H5 | AA | SEQ ID NO:7619<br>NAYMT | SEQ ID NO:15631<br>RIKSKTDGGTTDYAAPVK<br>G | SEQ ID NO:23643<br>DPGGIFDY |
| | | NA | SEQ ID NO:7620<br>GGCTACTATATGCAC | SEQ ID NO:15632<br>TGGATCAACCCTTACAGT<br>GGTGGCACAAACTATGC<br>ACAGAAGTTTCAGGGC | SEQ ID NO:23644<br>GATAGAGCAGTGGCTGGAAA<br>CTACTTCTACTACGGTATGG<br>ACGTC |
| iPS:437022 | 21-225_193F11 | AA | SEQ ID NO:7621<br>GYYMH | SEQ ID NO:15633<br>WINPYSGGTNYAQKFQG | SEQ ID NO:23645<br>DRAVAGNYFYYGMDV |
| | | NA | SEQ ID NO:7622<br>AGTGGTGGTGACTACTGGAG<br>C | SEQ ID NO:15634<br>TACATCTATTACAGTGGG<br>AGCACTACTACAACCC<br>GTCTCTCAAGAGT | SEQ ID NO:23646<br>GATCACTCCCTCTACGGTAT<br>GGACGTC |
| iPS:437024 | 21-225_194G5 | AA | SEQ ID NO:7623<br>SGGDYWS | SEQ ID NO:15635<br>YIYYSGSTYYNPSLKS | SEQ ID NO:23647<br>DHSLYGMDV |
| | | NA | SEQ ID NO:7624<br>AGCTATGGCATGCAC | SEQ ID NO:15636<br>GTTATATGGAATGATGG<br>AAGTAAAAATACCATG<br>TAGACTCCGTGAAGGGC | SEQ ID NO:23648<br>GATCTGGATAAGAGGAACTT<br>TCCTTATTACTACTACTACGG<br>TATGGACGTC |
| | 21-225_194F11 | AA | SEQ ID NO:7625<br>SYGMH | SEQ ID NO:15637<br>VIWNDGSKYHVDSVKG | SEQ ID NO:23649<br>DLDKRNFPYYYYGMDV |

FIGURE 49
(Continued)

| | | | | | | |
|---|---|---|---|---|---|---|
| iPS:437026 | 21-225_194D12 | NA | SEQ ID NO:7626 AGTGGTGGTGACTACTGGAG C | SEQ ID NO:15638 TACATCTATTACAGTGGG AGTACCTACTACACAACCC GTCCCTCAAGAGT | SEQ ID NO:23650 GATGGGGCTCGGCACGGTAT GGACGTC |
| | | AA | SEQ ID NO:7627 SGGDYWS | SEQ ID NO:15639 YIYYSGSTYYNPSLKS | SEQ ID NO:23651 DGARHGMDV |
| iPS:437028 | 21-225_194G12 | NA | SEQ ID NO:7628 AGCTATGGCATGCAC | SEQ ID NO:15640 GTTATATGGAATGATGG AAGTAATAAATACTATG CAGACTCCGTGAAGGGC | SEQ ID NO:23652 GATCTGGATAAGAGGAACTT TCCTTATTACTACTACTACGG TATGGACGTC |
| | | AA | SEQ ID NO:7629 SYGMH | SEQ ID NO:15641 VIWNDGSNKYYADSVKG | SEQ ID NO:23653 DLDKRNFPYYYYYGMDV |
| iPS:437030 | 21-225_195E3 | NA | SEQ ID NO:7630 GACTACTACATGAGC | SEQ ID NO:15642 TATATTACTAGTAGTGGT AATACCATATACTACGC AGACTCTGTGAAGGGC | SEQ ID NO:23654 GATAGTCGATATTTGACTG GTTTGACTAC |
| | | AA | SEQ ID NO:7631 DYYMS | SEQ ID NO:15643 YITSSGNTIYYADSVKG | SEQ ID NO:23655 DSRYFDWFDY |
| iPS:437032 | 21-225_195H6 | NA | SEQ ID NO:7632 AATTACTACTGGAGC | SEQ ID NO:15644 CGTATCTATAGCAGTGG GAGCACCAACTACAACC CCTCCCTCAAGAGT | SEQ ID NO:23656 GGGTGGGAGCTAAACAAC |
| | | AA | SEQ ID NO:7633 NYYWS | SEQ ID NO:15645 RIYSSGSTNYNPSLKS | SEQ ID NO:23657 GWELNN |
| iPS:437034 | 21_225_195E9 | NA | SEQ ID NO:7634 GGCTACTATATGCAC | SEQ ID NO:15646 TGGATCAACCCTAACAG TGGTGCCACAAACTATG CACAGAGTTTCAGGGC | SEQ ID NO:23658 GCCTATTACTATGGTTCGGG GACTTATTATAACGAGTTCG ACTAC |

FIGURE 49
(Continued)

| | | | | SEQ ID NO:7635 | | SEQ ID NO:15647 | | SEQ ID NO:23659 |
|---|---|---|---|---|---|---|---|---|
| iPS:437036 | 21-225_195E9 | AA | GYYMH | | WINPNSGATNYAQKFQG | | AYYYGSGTYYNEFDY | |
| | | NA | SEQ ID NO:7636 GGCTACTATATGCAC | | SEQ ID NO:15648 TGGATCAACCCTACAGT GGTGGCACAAACTATGC ACAGAAGTTTCAGGAC | | SEQ ID NO:23660 GATAGAGCAGTGGCTGGAAA CTACTTCTACTACGGTATGG ACGTC | |
| iPS:437040 | 21-225_195H9 | AA | SEQ ID NO:7637 GYYMH | | SEQ ID NO:15649 WINPYSGGTNYAQKFQD | | SEQ ID NO:23661 DRAVAGNYFYYGMDV | |
| | | NA | SEQ ID NO:7638 GGCTACTACAATATGCAC | | SEQ ID NO:15650 TGGATCAACCCTAATAG TGGTGGCACAAACTATG CACACAAGTTTCAGGGC | | SEQ ID NO:23662 GATTACTATGATACTAGTGG AGAAGGGTGGTTCGACCCC | |
| iPS:437042 | 21-225_196E7 | AA | SEQ ID NO:7639 GYNMH | | SEQ ID NO:15651 WINPNSGGTNYAHKFQG | | SEQ ID NO:23663 DYYDTSGEGWFDP | |
| | | NA | SEQ ID NO:7640 GGCTACTATATACAC | | SEQ ID NO:15652 TGGATCAACCCTAACAG TGGTGGCACAAACTATG CACAGAGTTTCAGGGC | | SEQ ID NO:23664 GAGATAGCAGTGGCTGGAA CTACTTCTACTACGGTATGG GCGTC | |
| iPS:437044 | 21-225_197E8 | AA | SEQ ID NO:7641 GYYIH | | SEQ ID NO:15653 WINPNSGGTNYAQRFQG | | SEQ ID NO:23665 EIAVAGNYFYYGMGV | |
| | | NA | SEQ ID NO:7642 ATTTACTACTGGAGC | | SEQ ID NO:15654 TATGTCTATTACAGTGGG AGCACCACTACAACCC CTCCCTCAAGAGT | | SEQ ID NO:23666 GAAAGGGGAGTAGCCACA GATGGGGGACTACTACGGA ATGGACGTC | |
| iPS:437046 | 21-225_197F9 | AA | SEQ ID NO:7643 IYYWS | | SEQ ID NO:15655 YVYYSGSTTYNPSLKS | | SEQ ID NO:23667 ERGSSHRWGDYYGMDV | |
| iPS:437048 | 21 225 197B11 | NA | SEQ ID NO:7644 AGTGGTGGTTACTACTGGAG C | | SEQ ID NO:15656 TACATCTATTACACTGGG AGCACCTACTACAACCC GTCCCTCAAGAGT | | SEQ ID NO:23668 GACGATCCCCTCTACGGAAT GGACGTC | |

FIGURE 49
(Continued)

| | | | | | | | |
|---|---|---|---|---|---|---|---|
| iPS:437050 | 21-225_197B11 | AA | SEQ ID NO:7645<br>SGGYYWS | SEQ ID NO:15657<br>YIYYTGSTYYNPSLKS | SEQ ID NO:23669<br>DDPLYGMDV | | |
| | | NA | SEQ ID NO:7646<br>GGCTACAATATGCAC | SEQ ID NO:15658<br>TGGATCAACCCTAATAG<br>TGGTGGCACAAACTATG<br>CACACAAGTTTCAGGGC | SEQ ID NO:23670<br>GATTACTATGATAGTAGTGG<br>AGAAGGGTGGTTCGACCCC | | |
| iPS:437054 | 21-225_197C11 | AA | SEQ ID NO:7647<br>GYNMH | SEQ ID NO:15659<br>WINPNSGGTNYAHKFQG | SEQ ID NO:23671<br>DYYDSSGEGWFDP | | |
| | | NA | SEQ ID NO:7648<br>TTCCATGGCATGCAC | SEQ ID NO:15660<br>GTTATATGGTATGATGG<br>AAGTAAAAATACTATG<br>CAGACTCCGTGAAGGGC | SEQ ID NO:23672<br>GAAGGGTTTAGCAGTGGCTT<br>TTACAGGGGTTTGACAAC | | |
| iPS:437056 | 21-225_194G3 | AA | SEQ ID NO:7649<br>FHGMH | SEQ ID NO:15661<br>VIWYDGSKKYYADSVKG | SEQ ID NO:23673<br>EGFSSGFYRGFDN | | |
| | | NA | SEQ ID NO:7650<br>AGTGGTGGTGACTACTGGAG<br>C | SEQ ID NO:15662<br>TACATCTATTACAGTGGG<br>ATCACCTACTACAATCCG<br>TCCCTCAAGAGT | SEQ ID NO:23674<br>GATAGCAGCTCGCGGGGTAT<br>GGACGTC | | |
| iPS:437058 | 21-225_198B8 | AA | SEQ ID NO:7651<br>SGGDYWS | SEQ ID NO:15663<br>YIYYSGITYYNPSLKS | SEQ ID NO:23675<br>DSSSRGMDV | | |
| | | NA | SEQ ID NO:7652<br>TTCTATGGCATGCAC | SEQ ID NO:15664<br>GTTATTTGGTATGATGGA<br>AGTAGTAAATACTATGC<br>AGACTCCGTGAAGGGC | SEQ ID NO:23676<br>GAAGGGTATAGCAGTGGCTT<br>TTACAGGGGATTTGCCAAC | | |
| | 21-225_199F3 | AA | SEQ ID NO:7653<br>FYGMH | SEQ ID NO:15665<br>VIWYDGSSKYYADSVKG | SEQ ID NO:23677<br>EGYSSGFYRGFAN | | |
| | | | SEQ ID NO:7654 | SEQ ID NO:15666 | SEQ ID NO:23678 | | |

FIGURE 49
(Continued)

| iPS | | | | | |
|---|---|---|---|---|---|
| iPS:437060 | 21-225_199C3 | NA | | AITTACTACTGGAGC SEQ ID NO:7655 | TATATCTATTATACAGTGGG AGCACCACCTACAACCC CTCCCTCAAGAGT SEQ ID NO:15667 | GAAAGGGGGAGTAGCCACA GATGGGGGACTACTACGGA ATGGACGTC SEQ ID NO:23679 |
| | | AA | IYYWS SEQ ID NO:7656 | | YIYYSGSTYYNPSLKS SEQ ID NO:15668 | ERGSSHRWGDYYGMDV SEQ ID NO:23680 |
| iPS:437062 | 21-225_200H1 | NA | AGTGGTGGTGACTATTGGAGC SEQ ID NO:7657 | | TACATCTATTATAGTGGG AGCACCTACTACAACCC GTCCCTCAAGAGT SEQ ID NO:15669 | GATGGAGCAGCTCTGGGTAT GGACGTC SEQ ID NO:23681 |
| | | AA | SGGDYWS SEQ ID NO:7658 | | YIYYSGSTYYNPSLKS SEQ ID NO:15670 | DGAALGMDV SEQ ID NO:23682 |
| iPS:437064 | 21-225_200G8 | NA | AGTTACTACTGGAGC SEQ ID NO:7659 | | TATATCTATTACAGTGGG AGTACTAAGTACAACCC CTCCCTCAAGAGT SEQ ID NO:15671 | AAGGGAGTGGGAACCATCCA CTTTGACTAC SEQ ID NO:23683 |
| | | AA | SYYWS SEQ ID NO:7660 | | YIYYSGSTKYNPSLKS SEQ ID NO:15672 | KGVGTIHFDY SEQ ID NO:23684 |
| iPS:437066 | 21-225_200G9 | NA | AGTGGTGGTGACTACTGGAG C SEQ ID NO:7661 | | TACATCTATTACAGTGGG AGCACCTACTACAACCC GTCCCTCAAGAGT SEQ ID NO:15673 | GATGGAGCAGCTCTGGGTAT GGACGTC SEQ ID NO:23685 |
| | | AA | SGGDYWS SEQ ID NO:7662 | | YIYYSGSTYYNPSLKS SEQ ID NO:15674 | DGAALGMDV SEQ ID NO:23686 |
| iPS:437068 | 21-225_200A11 | NA | AGTGGTGGTGACTACTGGAG C SEQ ID NO:7663 | | TACATCTATTACAGAGG GAGCACCTACTACAACC CGTCCCTCAAGAGT SEQ ID NO:15675 | GATGCAGCAGCCCACGGCAT GGACGTC SEQ ID NO:23687 |
| | | AA | SGGDYWS SEQ ID NO:7664 | | YIYYRGSTYYNPSLKS SEQ ID NO:15676 | DAAAHGMDV SEQ ID NO:23688 |

FIGURE 49
(Continued)

| | | | | | |
|---|---|---|---|---|---|
| iPS:437070 | 21-225_201G11 | NA | CGCATCAATCCTACTTGGAA C | AGGACATACACAGGTC CAAGTGGTATCATGTTTA TGCAGTATCTGTGAAAA GT | GATCCTGGGGGGGCTCTTTGA CTAC |
| | | | SEQ ID NO:7665 | SEQ ID NO:15677 | SEQ ID NO:23689 |
| | | AA | RINPTWN | RTYYRSKWYHVYAVSVK S | DPGGLFDY |
| | | | SEQ ID NO:7666 | SEQ ID NO:15678 | SEQ ID NO:23690 |
| iPS:437074 | 21-225_203B2 | NA | AACTATGGCATGCAC | ATTATATGGTTTGATGGA AGTAATGAATACTATGC AGACTCCGTGAAGGGC | GAAAGTGGGAGCTATGCTCT TTATATC |
| | | | SEQ ID NO:7667 | SEQ ID NO:15679 | SEQ ID NO:23691 |
| | | AA | NYGMH | IIWFDGSNEYYADSVKG | ESGSYALYI |
| | | | SEQ ID NO:7668 | SEQ ID NO:15680 | SEQ ID NO:23692 |
| iPS:437076 | 21-225_203G6 | NA | CGCACCAATCCTACTTGGAA C | AGGACATACACAGGTC CAAGTGGTATCATGTTTA TGCACTATCTGTGAAAA GT | GATCCTGGGGGCCCTCTTTGA CTAC |
| | | | SEQ ID NO:7669 | SEQ ID NO:15681 | SEQ ID NO:23693 |
| | | AA | RTNPTWN | RTYYRSKWYHVYALSVK S | DPGGLFDY |
| | | | SEQ ID NO:7670 | SEQ ID NO:15682 | SEQ ID NO:23694 |
| iPS:437082 | 21-225_205E12 | NA | AACTATGGCATGCAC | ATTATATGGTTTGATGGA AGTAATGAATACTATGC AGACTCCGTGAAGGGC | GAAAGTGGGAGCTATGCTCT TTATATC |
| | | | SEQ ID NO:7671 | SEQ ID NO:15683 | SEQ ID NO:23695 |
| | | AA | NYGMH | IIWFDGSNEYYADSVKG | ESGSYALYI |
| | | | SEQ ID NO:7672 | SEQ ID NO:15684 | SEQ ID NO:23696 |

FIGURE 49
(Continued)

| | | | | |
|---|---|---|---|---|
| iPS:437084 | 21-225_206B5 | NA | AGCTATGGCATGCAC<br>SEQ ID NO:7673 | GTTATATGGTATGATGG<br>AAGTAATAAATACTATG<br>CAGACTCCGTGAAGGGC<br>SEQ ID NO:15685 | GAGGGTGGGAGCTACCACCT<br>TGACTAC<br>SEQ ID NO:23697 |
| | | AA | SYGMH<br>SEQ ID NO:7674 | VIWYDGSNKYYADSVKG<br>SEQ ID NO:15686 | EGGSYHLDY<br>SEQ ID NO:23698 |
| iPS:437086 | 21-225_209A8 | NA | AGTTATAGCATGAAC<br>SEQ ID NO:7675 | TACATTAGTAGTAGTAGT<br>AGTATCAAAAAGTACGC<br>AGACTCTGTGAAGGGC<br>SEQ ID NO:15687 | GATGATGGGAGCTACTACTT<br>TGACTAC<br>SEQ ID NO:23699 |
| | | AA | SYSMN<br>SEQ ID NO:7676 | YISSSSIKKYADSVKG<br>SEQ ID NO:15688 | DDGSYYFDY<br>SEQ ID NO:23700 |
| iPS:437088 | 21-225_209H10 | NA | AGCTATGGCATGCAC<br>SEQ ID NO:7677 | GTTATATGGTATGATGG<br>AAGTAATAAATACTATG<br>CAGACTCCGTGAAGGGC<br>SEQ ID NO:15689 | GAGGGTGGGAGCTACCACCT<br>TGACTAC<br>SEQ ID NO:23701 |
| | | AA | SYGMH<br>SEQ ID NO:7678 | VIWYDGSNKYYADSVKG<br>SEQ ID NO:15690 | EGGSYHLDY<br>SEQ ID NO:23702 |
| iPS:437090 | 21-225_210F11 | NA | AGTGGTGGTTCCTACTGGAG<br>C<br>SEQ ID NO:7679 | TACATCTATTACATTGGG<br>ACCACCTACTACAACCC<br>GTCCCTCAAGAGT<br>SEQ ID NO:15691 | GATGAGCCATTGACCGGTAT<br>GGACGTC<br>SEQ ID NO:23703 |
| | | AA | SGGSYWS<br>SEQ ID NO:7680 | YIYYIGTTYYNPSLKS<br>SEQ ID NO:15692 | DEPLTGMDV<br>SEQ ID NO:23704 |

FIGURE 49
(Continued)

| iPS:437092 | 21-225_210B12 | NA | GACTACTATATGAAC | TGGATCAACCCTAACAGTGGTTGGCACAAACTATGCACAGAAGTTTCAGGGC | GGGTATGACTCGTTCGCCCC |
|---|---|---|---|---|---|
| | | | SEQ ID NO:7681 | SEQ ID NO:15693 | SEQ ID NO:23705 |
| | | AA | DYYMN | WINPNSGGTNYAQKFQG | GYDSFAP |
| | | | SEQ ID NO:7682 | SEQ ID NO:15694 | SEQ ID NO:23706 |
| iPS:437094 | 21-225_210D12 | NA | CACTATGGCATGCAC | GTTATATGGTATGATGGAAGTAATAAATACTATGCAGACTCCGTGAAGGGC | GGGGACTGGAACCCCGAGGGTTTGGACGTC |
| | | | SEQ ID NO:7683 | SEQ ID NO:15695 | SEQ ID NO:23707 |
| | | AA | HYGMH | VIWYDGSNKYYADSVKG | GDWNPEGLDV |
| | | | SEQ ID NO:7684 | SEQ ID NO:15696 | SEQ ID NO:23708 |
| iPS:437096 | 21-225_210E12 | NA | AACTATGGCATGCAC | GTTATATGGTATGATGGAAGTAATAAATACTATGCAGACTCCGTGAAGGGC | GGGGACTGGAACCCCGAGGGTATGGACGTC |
| | | | SEQ ID NO:7685 | SEQ ID NO:15697 | SEQ ID NO:23709 |
| | | AA | NYGMH | VIWYDGSNKYYADSVKG | GDWNPEGMDV |
| | | | SEQ ID NO:7686 | SEQ ID NO:15698 | SEQ ID NO:23710 |
| iPS:437098 | 21-225_211C1 | NA | CACTATGGCATGCAC | GTTATATGGTATGATGGAAGTAATAAATACTATGCAGACTCCGTGAAGGGC | GGGGACTGGAACCCCGAGGGTTTGGACGTC |
| | | | SEQ ID NO:7687 | SEQ ID NO:15699 | SEQ ID NO:23711 |
| | | AA | HYGMH | VIWYDGSNKYYADSVKG | GDWNPEGLDV |
| | | | SEQ ID NO:7688 | SEQ ID NO:15700 | SEQ ID NO:23712 |

FIGURE 49
(Continued)

| | | | | |
|---|---|---|---|---|
| iPS:437100 | 21-225_211H2 | NA | AGCTATGCCATGCAC | GTTATATGGTATGATGG AAGTAATAAATACTATG CAGACTCCGTGAAGGGC | GATCCTGGGAGCTACGGGTT CGACCCC |
| | | | SEQ ID NO:7689 | SEQ ID NO:15701 | SEQ ID NO:23713 |
| | | AA | SYAMH | VIWYDGSNKYYADSVKG | DPGSYGFDP |
| | | | SEQ ID NO:7690 | SEQ ID NO:15702 | SEQ ID NO:23714 |
| iPS:437102 | 21-225_211E5 | NA | AACTATGGCATGCAC | ATTATATGGTTTGATGGA AGTGATCAATACTATGC AGACTCCGTGAAGGGC | GGCCTCTCTGTCTACTACTAC GGTATGGGCGTC |
| | | | SEQ ID NO:7691 | SEQ ID NO:15703 | SEQ ID NO:23715 |
| | | AA | NYGMH | IIWFDGSDQYYADSVKG | GLSVYYYGMGV |
| | | | SEQ ID NO:7692 | SEQ ID NO:15704 | SEQ ID NO:23716 |
| iPS:437104 | 21-225_211G5 | NA | CACTATGGCATGCAC | GTTATATGGTATGATGG AAGTAATAAATACTATG CAGACTCCGTGAAGGGC | GGGGACTGGAACCCCGAGGG TTTGGACGTC |
| | | | SEQ ID NO:7693 | SEQ ID NO:15705 | SEQ ID NO:23717 |
| | | AA | HYGMH | VIWYDGSNKYYADSVKG | GDWNPEGLDV |
| | | | SEQ ID NO:7694 | SEQ ID NO:15706 | SEQ ID NO:23718 |
| iPS:437106 | 21-225_211H7 | NA | AGTGGTGGTTACTACTGGAGC | TACATCTATTACGTTGGG AGCACCTACTACAACCC GTCCCTCAAGAGT | GATGGGCCATTGAGCGGTAT GGACGTC |
| | | | SEQ ID NO:7695 | SEQ ID NO:15707 | SEQ ID NO:23719 |
| | | AA | SGGYYWS | YIYYVGSTYYNPSLKS | DGPLSGMDV |
| | | | SEQ ID NO:7696 | SEQ ID NO:15708 | SEQ ID NO:23720 |

FIGURE 49
(Continued)

| | | | | |
|---|---|---|---|---|
| iPS:437108 | 21-225_211C9 | NA | AGTGGTGGTGACTACTGGAG C | TACATCTATTATAGTGGG AGCACCACTACTACAACCC GTCCCTCAAGAGT | GATTCAGCAGTGTACAATAT GGACGTC |
| | | | SEQ ID NO:7697 | SEQ ID NO:15709 | SEQ ID NO:23721 |
| | | AA | SGGDYWS | YIYYSGSTYYNPSLKS | DSAVYNMDV |
| | | | SEQ ID NO:7698 | SEQ ID NO:15710 | SEQ ID NO:23722 |
| iPS:437110 | 21-225_211E9 | NA | AGTGGTGGTGACTACTGGAG C | TACATCTATTACACTGGG AGCAACTACTACAACCC GTCCCTCAAGAGT | GATTCAGCAGTGTACGGTAT GGACGTC |
| | | | SEQ ID NO:7699 | SEQ ID NO:15711 | SEQ ID NO:23723 |
| | | AA | SGGDYWS | YIYYTGSNYYNPSLKS | DSAVYGMDV |
| | | | SEQ ID NO:7700 | SEQ ID NO:15712 | SEQ ID NO:23724 |
| iPS:437112 | 21-225_212C2 | NA | CACTATGGCATGCAC | GTTATATGGTATGATGG AAGTAATAAATACTATG CAGACTCCGTGAAGGGC | GGGGACTGGAACCCCGAGGG TATGGACGTC |
| | | | SEQ ID NO:7701 | SEQ ID NO:15713 | SEQ ID NO:23725 |
| | | AA | HYGMH | VIWYDGSNKYYADSVKG | GDWNPEGMDV |
| | | | SEQ ID NO:7702 | SEQ ID NO:15714 | SEQ ID NO:23726 |
| iPS:437114 | 21-225_212A4 | NA | AACTATGGCATGCAC | GTTATATGGTATGATGG AAGTAATAAATACTATG CAGACTCCGTGAAGGGC | GGGGACTGGAACCCCGAGGG TATGGACGTC |
| | | | SEQ ID NO:7703 | SEQ ID NO:15715 | SEQ ID NO:23727 |
| | | AA | NYGMH | VIWYDGSNKYYADSVKG | GDWNPEGMDV |
| | | | SEQ ID NO:7704 | SEQ ID NO:15716 | SEQ ID NO:23728 |

FIGURE 49
(Continued)

| | | | | |
|---|---|---|---|---|
| iPS:437116 | 21-225_212F6 | NA | CACTATGGCATGCAC | GTTATATGGTATGATGG AAGTAATAAATACTATG CGGACTCCGTGAAGGGC | GGGGACTGGAACCCCGAGGG TTTGGACGTC |
| | | | SEQ ID NO:7705 | SEQ ID NO:15717 | SEQ ID NO:23729 |
| | | AA | HYGMH | VIWYDGSNKYYADSVKG | GDWNPEGLDV |
| | | | SEQ ID NO:7706 | SEQ ID NO:15718 | SEQ ID NO:23730 |
| iPS:437118 | 21-225_212G7 | NA | CACTATGGCATGCAC | GTTATATGGTATGATGG AAGTAATAAATACTGTG CAGACTCCGTGAAGGGC | GGAGACTGGAACCCCGAGGG TTTGGACGTC |
| | | | SEQ ID NO:7707 | SEQ ID NO:15719 | SEQ ID NO:23731 |
| | | AA | HYGMH | VIWYDGSNKYCADSVKG | GDWNPEGLDV |
| | | | SEQ ID NO:7708 | SEQ ID NO:15720 | SEQ ID NO:23732 |
| iPS:437120 | 21-225_212A9 | NA | AGTGGTGGTGACTACTGGAG C | TATATGTATTACAGTGGG AGCACCTACTACAACCC GTCCCTCAAGAGT | GATTCAGCAGTGTACGGTAT GGACGTC |
| | | | SEQ ID NO:7709 | SEQ ID NO:15721 | SEQ ID NO:23733 |
| | | AA | SGGDYWS | YMYYSGSTYYNPSLKS | DSAVYGMDV |
| | | | SEQ ID NO:7710 | SEQ ID NO:15722 | SEQ ID NO:23734 |
| iPS:437124 | 21-225_212H12 | NA | AGTGGTGGTGACTACTGGAG T | TACATCTATTACAGTGGG AGCACCTACTACAACCC GTCCCTCAAGAGT | GATAGCAGCTCCTACGGTAT GGACGTC |
| | | | SEQ ID NO:7711 | SEQ ID NO:15723 | SEQ ID NO:23735 |
| | | AA | SGGDYWS | YIYYSGSTYYNPSLKS | DSSSYGMDV |
| | | | SEQ ID NO:7712 | SEQ ID NO:15724 | SEQ ID NO:23736 |

FIGURE 49
(Continued)

| | | | | |
|---|---|---|---|---|
| iPS:437128 | 21-225_213G3 | NA | CACTATGGCATGCAC | GTTATATGGTATGATGG AAGTAATAAATACTATG CAGACTCCGTGAAGGGC | GGGGACTGGAACCCCGAGGG TATGGACGTC |
| | | | SEQ ID NO:7713 | SEQ ID NO:15725 | SEQ ID NO:23737 |
| | | AA | HYGMH | VIWYDGSNKYYADSVKG | GDWNPEGMDV |
| | | | SEQ ID NO:7714 | SEQ ID NO:15726 | SEQ ID NO:23738 |
| iPS:437130 | 21-225_213D5 | NA | CACTATGGCATGCAC | GTTATATGGTATGATGG AAGTAATAAATACTATG CAGACTCCGTGAAGGGC | GGGGACTGGAACCCCGAGGG TATGGACGTC |
| | | | SEQ ID NO:7715 | SEQ ID NO:15727 | SEQ ID NO:23739 |
| | | AA | HYGMH | VIWYDGSNKYYADSVKG | GDWNPEGMDV |
| | | | SEQ ID NO:7716 | SEQ ID NO:15728 | SEQ ID NO:23740 |
| iPS:437132 | 21-225_213F5 | NA | AGTGGTGGTGACTACTGGAG C | TACATCTATTATAGTGGG AGCACCTACTACAACCC GTCCCTCAAGAGT | GATTCAGCAGTGTACAATAT GGACGTC |
| | | | SEQ ID NO:7717 | SEQ ID NO:15729 | SEQ ID NO:23741 |
| | | AA | SGGDYWS | YIYYSGSTYYNPSLKS | DSAVYNMDV |
| | | | SEQ ID NO:7718 | SEQ ID NO:15730 | SEQ ID NO:23742 |
| iPS:437134 | 21-225_213A7 | NA | GACTACTATATGAAC | TGGATCAACCCTAAGAA TGGTGGCACAAACTATG CACAGAAGTTTCAGGGC | GGGTATGATTCGTTCGCCCC C |
| | | | SEQ ID NO:7719 | SEQ ID NO:15731 | SEQ ID NO:23743 |
| | | AA | DYYMN | WINPKNGGTNYAQKFQG | GYDSFAP |
| | | | SEQ ID NO:7720 | SEQ ID NO:15732 | SEQ ID NO:23744 |

FIGURE 49
(Continued)

| | | | | |
|---|---|---|---|---|
| iPS:437136 | 21-225_214H3 | NA | AGTGGTGGTGACTGACTGGAGT<br>SEQ ID NO:7721 | TACATCTATTACAGTGGGAGCACCTACTACAACCCGTCCCTCAAGAGT<br>SEQ ID NO:15733 | GATAGCAGCTCCTACGGTATGGACGTC<br>SEQ ID NO:23745 |
| | | AA | SGGDYWS<br>SEQ ID NO:7722 | YIYYSGSTYYNPSLKS<br>SEQ ID NO:15734 | DSSSYGMDV<br>SEQ ID NO:23746 |
| iPS:437138 | 21-225_214D8 | NA | ACTGCTTTTTACTACTGGAGC<br>SEQ ID NO:7723 | TACATCTATTTCAGTGGGAGCACCTACTACAACCCGTCCCTCAAGAGT<br>SEQ ID NO:15735 | GCAAGGGATATCACTACAGTATCTTTGACTAC<br>SEQ ID NO:23747 |
| | | AA | TAFYYWS<br>SEQ ID NO:7724 | YIYFSGSTYYNPSLKS<br>SEQ ID NO:15736 | ARGYHYSIFDY<br>SEQ ID NO:23748 |
| iPS:437140 | 21-225_214E12 | NA | AGTGGTGGTGATTACTGGAGC<br>SEQ ID NO:7725 | TACATCTATTACAGTGGGCCCACCTACTACAACCCGTCCCTCAAGAGT<br>SEQ ID NO:15737 | GATGGGCTGCGGAGGGTATGGACGTC<br>SEQ ID NO:23749 |
| | | AA | SGGDYWS<br>SEQ ID NO:7726 | YIYYSGPTYYNPSLKS<br>SEQ ID NO:15738 | DGAAEGMDV<br>SEQ ID NO:23750 |
| iPS:437142 | 21-225_215A3 | NA | AGTGGTGGTGACTACTGGAGC<br>SEQ ID NO:7727 | TACATCTATTACACTGGGAGCAACTACTACAACCCGTCCCTCAAGAGT<br>SEQ ID NO:15739 | GATTCAGCAGTGTACGGTATGGACGTC<br>SEQ ID NO:23751 |
| | | AA | SGGDYWS<br>SEQ ID NO:7728 | YIYYTGSNYYNPSLKS<br>SEQ ID NO:15740 | DSAVYGMDV<br>SEQ ID NO:23752 |
| iPS:437144 | 21-225_215B3 | NA | AACGCCTGGATGCAC<br>SEQ ID NO:7729 | CGTATTAAAAGCAAAACTAATGGTGGGACAACAGACTACGCTGCACCCGTGAAAGGC<br>SEQ ID NO:15741 | GATCCGGGGGGGATCTTTGACTAC<br>SEQ ID NO:23753 |

FIGURE 49
(Continued)

| | | | | | | |
|---|---|---|---|---|---|---|
| | | AA | NAWMH | | RIKSKTNGGTTDYAAPVK G | DPGGIFDY |
| iPS:437146 | 21-225_215D3 | NA | SEQ ID NO:7730 CACTATGGCATGCAC | | SEQ ID NO:15742 GTTATATGGTATGATGG AAGTAATGAGTACTATG CAGACTCCGTGAAGGGC | SEQ ID NO:23754 GGGGACTGGAACCCCGAGGG TATGGACGTC |
| | | AA | SEQ ID NO:7731 HYGMH | | SEQ ID NO:15743 VIWYDGSNEYYADSVKG | SEQ ID NO:23755 GDWNPEGMDV |
| iPS:437148 | 21-225_215H3 | NA | SEQ ID NO:7732 AGTGGTGGTGGACTACTGGAG C | | SEQ ID NO:15744 TATATGTATTACAGTGGG AGCACCTACTACAACCC GTCCCTCAAGAGT | SEQ ID NO:23756 GATTCAGCAGTGTACGGTAT GGACGTC |
| | | AA | SEQ ID NO:7733 SGGDYWS | | SEQ ID NO:15745 YMYYSGSTYYNPSLKS | SEQ ID NO:23757 DSAVYGMDV |
| iPS:437150 | 21-225_216A3 | NA | SEQ ID NO:7734 CACTATGGCATGCAC | | SEQ ID NO:15746 GTTATATGGTATGATGG AAGTAATAAATACTATG CAGACTCCGTGAAGGGC | SEQ ID NO:23758 GGGGACTGGAACCCCGAGGG TTTGGACGTC |
| | | AA | SEQ ID NO:7735 HYGMH | | SEQ ID NO:15747 VIWYDGSNKYYADSVKG | SEQ ID NO:23759 GDWNPEGLDV |
| iPS:437154 | 21-225_216A7 | NA | SEQ ID NO:7736 AGTGGTGGTGGACTACTGGAG C | | SEQ ID NO:15748 TATATGTATTACAGTGGG AGCACCTACTACAACCC GTCCCTCAAGAGT | SEQ ID NO:23760 GATTCAGCAGTGTACGGTAT GGACGTC |
| | | AA | SEQ ID NO:7737 SGGDYWS | | SEQ ID NO:15749 YMYYSGSTYYNPSLKS | SEQ ID NO:23761 DSAVYGMDV |
| | | | SEQ ID NO:7738 | | SEQ ID NO:15750 | SEQ ID NO:23762 |

FIGURE 49
(Continued)

| | | | | | |
|---|---|---|---|---|---|
| iPS:437158 | 21-225_216H11 | NA | AGTGGTGGTGATTACTGGAG C | TACACTCTATTACAGTGGG CCCACCTACTACAACCC GTCCCTCAAGAGT | GATGGGGCTGCGGAGGGTTT GGACGTC |
| | | AA | SEQ ID NO:7739 SGGDYWS | SEQ ID NO:15751 YIYYSGPTYYNPSLKS | SEQ ID NO:23763 DGAAEGLDV |
| iPS:437160 | 21-225_216B12 | NA | SEQ ID NO:7740 AGCTATGCCATGCAC | SEQ ID NO:15752 GTTATATGGTATGATGG AAGTAATAAATACTATG CAGACTCCGTGAAGGGC | SEQ ID NO:23764 GATCTGGGACTGGGATACTT CTTTGACTAC |
| | | AA | SEQ ID NO:7741 SYAMH | SEQ ID NO:15753 VIWYDGSNKYYADSVKG | SEQ ID NO:23765 DLGLGYFFDY |
| iPS:437162 | 21-225_217B2 | NA | SEQ ID NO:7742 AACTATGGCATGCAC | SEQ ID NO:15754 GTTATATGGTATGATGG AAGTAATAAATACTATG CAGACTCCGTGAAGGGC | SEQ ID NO:23766 GGGGACTGGAACCCCGAGGG TATGGACGTC |
| | | AA | SEQ ID NO:7743 NYGMH | SEQ ID NO:15755 VIWYDGSNKYYADSVKG | SEQ ID NO:23767 GDWNPEGMDV |
| iPS:437164 | 21-225_217C6 | NA | SEQ ID NO:7744 AACTATGGCATGCAC | SEQ ID NO:15756 ATTATATGGTTTGATGGA AGTGATGAATACTATGC AGACTCCGTGAAGGGC | SEQ ID NO:23768 GGCCTATCTGTCTACTACTA CGGTATGGACGTC |
| | | AA | SEQ ID NO:7745 NYGMH | SEQ ID NO:15757 IIWFDGSDEYYADSVKG | SEQ ID NO:23769 GLSVYYYGMDV |
| | | | SEQ ID NO:7746 | SEQ ID NO:15758 | SEQ ID NO:23770 |

FIGURE 49
(Continued)

| | | | | | | |
|---|---|---|---|---|---|---|
| iPS:437166 | 21-225_217G11 | NA | AACTATGGCATGCAC | | ATTATATGGTTTGATGGAAGTGATCAGTACTATGCAGACTCCGTGAAGGGC | | GGCCTCTCTGTCTACTACTACGGTATGGACGTC |
| | | | SEQ ID NO:7747 | | SEQ ID NO:15759 | | SEQ ID NO:23771 |
| | | AA | NYGMH | | IIWFDGSDQYYADSVKG | | GLSVYYYGMDV |
| | | | SEQ ID NO:7748 | | SEQ ID NO:15760 | | SEQ ID NO:23772 |
| iPS:437168 | 21-225_218G4 | NA | AGCTATGGCTTGCAC | | GTTATATGGTATGATGGAAGTAATAAATACTATGCAGACTCCGTGAAGGGC | | TGGTACTACTATTACTACGGTATGGACGTC |
| | | | SEQ ID NO:7749 | | SEQ ID NO:15761 | | SEQ ID NO:23773 |
| | | AA | SYGLH | | VIWYDGSNKYYADSVKG | | WYYYYYGMDV |
| | | | SEQ ID NO:7750 | | SEQ ID NO:15762 | | SEQ ID NO:23774 |
| iPS:437170 | 21-225_218E5 | NA | AACTATGGCATGCAC | | ATTATATGGTTTGATGGAAGTGATGAATACTATGCAGACTCCGTGAAGGGC | | GGCCTATCTGTCTACTACTACGGTATGGACGTC |
| | | | SEQ ID NO:7751 | | SEQ ID NO:15763 | | SEQ ID NO:23775 |
| | | AA | NYGMH | | IIWFDGSDEYYADSVKG | | GLSVYYYGMDV |
| | | | SEQ ID NO:7752 | | SEQ ID NO:15764 | | SEQ ID NO:23776 |
| iPS:437172 | 21-225_219A7 | NA | CACTATGGCATGCAC | | GTCATATGGTATGATGGAAGTAATAAATACTATGCAGACTCCGTGAAGGGC | | GGGGACTGGAACCCCGAGGGTATGGACGTC |
| | | | SEQ ID NO:7753 | | SEQ ID NO:15765 | | SEQ ID NO:23777 |
| | | AA | HYGMH | | VIWYDGSNKYYADSVKG | | GDWNPEGMDV |
| | | | SEQ ID NO:7754 | | SEQ ID NO:15766 | | SEQ ID NO:23778 |

FIGURE 49
(Continued)

| | | | | | |
|---|---|---|---|---|---|
| iPS:437182 | 21-225_221H2 | NA | CACTATGGCATGCAC | GTTATATGGTATGATGG AAGTAATAAATACTATG CAGACTCCGTGAAGGGC | GGGGACTGGAACCCCGAGGG TATGGACGTC |
| | | | SEQ ID NO:7755 | SEQ ID NO:15767 | SEQ ID NO:23779 |
| | | AA | HYGMH | VIWYDGSNKYYADSVKG | GDWNPEGMDV |
| | | | SEQ ID NO:7756 | SEQ ID NO:15768 | SEQ ID NO:23780 |
| iPS:437184 | 21-225_221G4 | NA | CACTATGGCATGCAC | GTTATATGGTATGATGG AAGTAATAAATACTATG CAGACTCCGTGAAGGGC | GGGGACTGGAACCCCGAGGG TATGGACGTC |
| | | | SEQ ID NO:7757 | SEQ ID NO:15769 | SEQ ID NO:23781 |
| | | AA | HYGMH | VIWYDGSNKYYADSVKG | GDWNPEGMDV |
| | | | SEQ ID NO:7758 | SEQ ID NO:15770 | SEQ ID NO:23782 |
| iPS:437186 | 21-225_224H2 | NA | AGCAACAGTGCTGCTTGGAA C | AGGACATACTACAGGTC CAAGGTGGTATAAATGATT ATGCAGTATCTGTGAAA AGT | GAGGGGGGCCTAGGATATTG TAGTAGTACCAGCTGCTATG GAGGCTGGTTCGACCCC |
| | | | SEQ ID NO:7759 | SEQ ID NO:15771 | SEQ ID NO:23783 |
| | | AA | SNSAAWN | RTYYRSKWYNDYAVSVK S | EGGLGYCSSTSCYGGWFDP |
| | | | SEQ ID NO:7760 | SEQ ID NO:15772 | SEQ ID NO:23784 |
| iPS:437188 | 21-225_224B11 | NA | GGCTACTATATACAC | TGGATCAACCCTAAAAA TGGTGGCACAAACTATG CACAGAAGTTTCAGGGC | GGAGCGTTTGATTACTTCTA CTACTACGCTATGACGTC |
| | | | SEQ ID NO:7761 | SEQ ID NO:15773 | SEQ ID NO:23785 |

FIGURE 49
(Continued)

| | | AA | GYYIH | | WINPKNGGTNYAQKFQG | | GAFDYFYYAMDV |
|---|---|---|---|---|---|---|---|
| | | | | SEQ ID NO:7762 | | SEQ ID NO:15774 | |
| iPS:437190 | | NA | ACCTATGGCATGCAC | | GTTATATGGTATGATGG AAGTAATAAATACTATG CAGACTCCGTGAAGGGC | | GATAACCACTATTGTAGTAG TACCAGCTGCTCCCATACT ACTACTACTTCGGTATGGAC GTC |
| | 21-225_225A9 | | | SEQ ID NO:7763 | | SEQ ID NO:15775 | SEQ ID NO:23786 |
| | | AA | TYGMH | | VIWYDGSNKYYADSVKG | | DNHYCSSTSCSPYYYYFGMDV |
| | | | | SEQ ID NO:7764 | | SEQ ID NO:15776 | SEQ ID NO:23787 |
| iPS:437192 | | NA | AGCTATGGCATGCAC | | GTTATGTGGTATGATGG AGGTAATAAAGACTATG CAGACTCCGTGAAGGGC | | GATCGGGAATATTGTACTAG TACCAGCTGCCCTTACTACT ACTACTACGGTATGGACGTC |
| | 21-225_225E9 | | | SEQ ID NO:7765 | | SEQ ID NO:15777 | SEQ ID NO:23788 |
| | | AA | SYGMH | | VMWYDGGNKDYADSVK G | | DREYCTSTSCPYYYYGMDV |
| | | | | SEQ ID NO:7766 | | SEQ ID NO:15778 | SEQ ID NO:23789 |
| iPS:437194 | | NA | GGCTACTTTATGCAC | | TGGATCAACCCTAACAG TGGTCACACAAACTATG CACAGAAGTTTCAGGGC | | GGGACTTACTATGGTTCGGG GAGTTATTTTAACGAACTTG ACTCC |
| | 21-225_226B2 | | | SEQ ID NO:7767 | | SEQ ID NO:15779 | SEQ ID NO:23790 |
| | | AA | GYFMH | | WINPNSGDTNYAQKFQG | | GTYYGSGSYFNELDS |
| | | | | SEQ ID NO:7768 | | SEQ ID NO:15780 | SEQ ID NO:23791 |
| iPS:437196 | | NA | GGCTACTACTATGCAC | | TGGATCAACCCTAACAG TGGAGGCACAAACTATG CACAGAAGTTTCAGGAC | | GGATATTACTATGGTTCGGG GAGTTATTATAACTGGTTCG ACTCC |
| | 21-225_226B7 | | | SEQ ID NO:7769 | | SEQ ID NO:15781 | SEQ ID NO:23792 |
| | | AA | GYYMH | | WINPNSGGTNYAQKFQD | | GYYYGSGSYYNWFDS |
| | | | | | | | SEQ ID NO:23793 |

FIGURE 49
(Continued)

| | | | | | | |
|---|---|---|---|---|---|---|
| iPS:437198 | 21-225_226F8 | NA | SEQ ID NO:7770 GGCTACTATATACAC | SEQ ID NO:15782 TGGATCAACCCTAACAG TGGTGGCACAAACTATG CACGGAAGTTTCAGGGC | SEQ ID NO:23794 GGAGCGTTTGATTACTACTA CTACTACGCTTGGACGTC |
| | | AA | SEQ ID NO:7771 GYYIH | SEQ ID NO:15783 WINPNSGGTNYARKFQG | SEQ ID NO:23795 GAFDYYYYALDV |
| iPS:437200 | 21-225_226A10 | NA | SEQ ID NO:7772 GGCTACTTTATGCAC | SEQ ID NO:15784 TGGATCAACCCTAACAG TGGTGACACAAACTATG CACAGAAGTTTCAGGGC | SEQ ID NO:23796 GGGACTTACTATGGTTCGGG GAGTTATTTTAACGAACTTG ACTCC |
| | | AA | SEQ ID NO:7773 GYFMH | SEQ ID NO:15785 WINPNSGDTNYAQKFQG | SEQ ID NO:23797 GTYYGSGSYFNELDS |
| iPS:437202 | 21-225_227D3 | NA | SEQ ID NO:7774 GGCTACTATATGCAC | SEQ ID NO:15786 TGGATCAACCCTAAGAG TGGTGGCACAAACTTG CACAGAAGTTTCAGGGC | SEQ ID NO:23798 GGAGCGTTTGATTACTTCTA CTACTACGGTATGACGTC |
| | | AA | SEQ ID NO:7775 GYYMH | SEQ ID NO:15787 WINPKSGGTNFAQKFQG | SEQ ID NO:23799 GAFDYFYYGMDV |
| iPS:437204 | 21-225_227E5 | NA | SEQ ID NO:7776 AGCTATGCCATGAGC | SEQ ID NO:15788 GCTATTAGTGGTAGTGGT GGTAGCACATACTACGC AGACTCCGTGAAGGGC | SEQ ID NO:23800 GAATATTGTGGTGGTGACTG CTATTCCCCTTACTACTACTA CTACGGTATGGACGTC |
| | | AA | SEQ ID NO:7777 SYAMS | SEQ ID NO:15789 AISGSGGSTYYADSVKG | SEQ ID NO:23801 EYCGGDCYSPYYYYYGMDV |
| iPS:437208 | 21-225_227C10 | NA | SEQ ID NO:7778 GGCTACTATATGCAC | SEQ ID NO:15790 TGGATCAACCCTAAGAG TGGTGGCACAAACTATG CACAGAAGTTTCAGGGC | SEQ ID NO:23802 GGAGCGTTTGATTACTTCTA CTACTACGGTATGACGTC |
| | | | SEQ ID NO:7779 | SEQ ID NO:15791 | SEQ ID NO:23803 |

FIGURE 49
(Continued)

| | | AA | GYYMH | WINPKSGGTNYAQKFQG | GAFDYFYYYGMDV |
|---|---|---|---|---|---|
| iPS:437210 | 21-225_227E12 | | SEQ ID NO:7780 | SEQ ID NO:15792 | SEQ ID NO:23804 |
| | | NA | ACTAGTGGAGTGGGTGTGGG C | CTCATTTATTGGAATGATGATAAGGTCTACAGCCCATCTCTGAAGAGC | AGGGGACAGCAGCTGGCCCTCGACTAC |
| | | | SEQ ID NO:7781 | SEQ ID NO:15793 | SEQ ID NO:23805 |
| | | AA | TSGVGVG | LIYWNDDKVYSPSLKS | RGQQLALDY |
| | | | SEQ ID NO:7782 | SEQ ID NO:15794 | SEQ ID NO:23806 |
| iPS:437214 | 21-225_48B12 | NA | AGCTATGCCATGAAC | GCTATTAGTGGTCGTGGTGGTAACACATTCTACGCAGACTCCGTGAAGGGC | AGAGAGACGTATAACTGGAACTACGAAGGGTTTGACTAC |
| | | | SEQ ID NO:7783 | SEQ ID NO:15795 | SEQ ID NO:23807 |
| | | AA | SYAMN | AISGRGGNTFYADSVKG | RETYNWNYEGFDY |
| | | | SEQ ID NO:7784 | SEQ ID NO:15796 | SEQ ID NO:23808 |
| iPS:437216 | 21-225_51D5 | NA | AGCTATAGTCATGAGC | ACTATGAGTGGTAGTGGTGGTCGCACATACGCAGACTCCGTGAACGGC | GTGACTGCTTTTGACTAC |
| | | | SEQ ID NO:7785 | SEQ ID NO:15797 | SEQ ID NO:23809 |
| | | AA | SYVMS | TMSGSGGRTYYADSVNG | VTAFDY |
| | | | SEQ ID NO:7786 | SEQ ID NO:15798 | SEQ ID NO:23810 |
| iPS:437220 | 21-225_55H6 | NA | AGCTATAGAATGAAC | TCCATTAGTGGTAGTAGTACTACATATACGCAGACTCAGTGAAGGGC | ACTGGGGTCTTTGACTAC |
| | | | SEQ ID NO:7787 | SEQ ID NO:15799 | SEQ ID NO:23811 |
| | | AA | SYSMN | SISGSSTYIYYADSVKG | TGVFDY |
| | | | SEQ ID NO:7788 | SEQ ID NO:15800 | SEQ ID NO:23812 |
| iPS:437224 | 21-225_56H1 | NA | AACTATAGAATGAAC | TCCATTAGTGGTAGTAGTACTGACATATACTACGCAGACTCAGTGAAGGGC | GTGGCCTCCTTTGACTAC |
| | | | SEQ ID NO:7789 | SEQ ID NO:15801 | SEQ ID NO:23813 |

FIGURE 49
(Continued)

| | | | | | |
|---|---|---|---|---|---|
| iPS:437226 | 21-225_57C2 | AA | NYRMN | SISGSSTDIYYADSVKG | VASFDY |
| | | | SEQ ID NO:7790 | SEQ ID NO:15802 | SEQ ID NO:23814 |
| | | NA | AGCTTTGGCATGAAC | TCTATTAGTAGTAGTACTGGTTACATATACAACGCAGACTCAGTGAAGGGC | ACCTATAGTGGAGCCTGGACGTC |
| | | | SEQ ID NO:7791 | SEQ ID NO:15803 | SEQ ID NO:23815 |
| iPS:437228 | 21-225_60C11 | AA | SFGMN | SISSSTGYIYNADSVKG | TYSGSLDV |
| | | | SEQ ID NO:7792 | SEQ ID NO:15804 | SEQ ID NO:23816 |
| | | NA | AGCTATGCCATGAGC | GCTATTAGTGGTAGTGGTGGTAACACATTCTACGCAGACTCCGTGAAGGGC | TTTTTCCGTGTAGTGGGAGTCGGGTGCTTTGACTAC |
| | | | SEQ ID NO:7793 | SEQ ID NO:15805 | SEQ ID NO:23817 |
| iPS:437230 | 21-225_62H10 | AA | SYAMS | AISGSGGNTFYADSVKG | FFGVVGVGCFDY |
| | | | SEQ ID NO:7794 | SEQ ID NO:15806 | SEQ ID NO:23818 |
| | | NA | AGCTATAGCATGAAC | TCCATTAGTAGTAGTAGTAGTTACATATACTACGCAGACTCAGTGAAGGGC | GGGGGTTCGAGGGGGTTCGACCCC |
| | | | SEQ ID NO:7795 | SEQ ID NO:15807 | SEQ ID NO:23819 |
| iPS:437232 | 21-225_63E1 | AA | SYSMN | SISSSSYIYYADSVKG | GGSRGFDP |
| | | | SEQ ID NO:7796 | SEQ ID NO:15808 | SEQ ID NO:23820 |
| | | NA | ACTTCTGCCATGAGC | GCTATTAGTGGTAGTGGTGCTAACACATTCTACGCAGACTCCGTGAAGGGC | GTTATAGCAGTGGCTGGCGAGGGCACTTTTCGACCCC |
| | | | SEQ ID NO:7797 | SEQ ID NO:15809 | SEQ ID NO:23821 |
| iPS:437234 | 21_225_64E2 | AA | TSAMS | AISGSGANTFYADSVKG | VIAVAGGHFFDP |
| | | | SEQ ID NO:7798 | SEQ ID NO:15810 | SEQ ID NO:23822 |
| | | NA | GGCTACTATATGCAC | TGGATCAACCCTAACAATAATGGCACAAACTATGCACCAGAAGTTTCAGGGC | GATGGGAGCAGTGGCTTTGACTAC |

FIGURE 49
(Continued)

| | | | | | |
|---|---|---|---|---|---|
| iPS:437248 | 21-225_64E2 | AA | SEQ ID NO:7799<br>GYYMH | SEQ ID NO:15811<br>WINPNNGTNYAQKFQG | SEQ ID NO:23823<br>DGSSGFDY |
| iPS:437250 | 21-225_97H3 | NA | SEQ ID NO:7800<br>GATTACTACTGGAGC | SEQ ID NO:15812<br>GAAATCAATCATATAGTGG AGACACCAACTACAACC CGTCCCTCAAGAGT | SEQ ID NO:23824<br>GAGTTTCCATATAGTGGAAG CTACCTCTACTACTACGGTA TGGACGTC |
| | | AA | SEQ ID NO:7801<br>DYYWS | SEQ ID NO:15813<br>EINHSGDTNYNPSLKS | SEQ ID NO:23825<br>EFPYSGSYLYYYGMDV |
| iPS:437252 | 21-225_148C6 | NA | SEQ ID NO:7802<br>AGCTATGCCATGAGC | SEQ ID NO:15814<br>GTTATTAGTGGTGGTGGT AGTAGTACATACTACGC AGACTCCGTGAAGGGC | SEQ ID NO:23826<br>TGGCGAGGTAACCCCACTGA CTACGGTATGGACGTC |
| | | AA | SEQ ID NO:7803<br>SYAMS | SEQ ID NO:15815<br>VISGGGSSTYYADSVKG | SEQ ID NO:23827<br>WRGNPTDYGMDV |
| iPS:437252 | 21-225_148H11 | NA | SEQ ID NO:7804<br>AGCTATGCCATGAGC | SEQ ID NO:15816<br>GTTATTAGTGGTGGTGGT AGTAGCACATACTACGC AGACTCCGTGAAGGGC | SEQ ID NO:23828<br>TGGCGAGGTAACCCCACTGA CTACGGTATGGACGTC |
| | | AA | SEQ ID NO:7805<br>SYAMS | SEQ ID NO:15817<br>VISGGGSSTYYADSVKG | SEQ ID NO:23829<br>WRGNPTDYGMDV |
| iPS:437254 | 21-225_149F2 | NA | SEQ ID NO:7806<br>CGCTATGGCATGCAC | SEQ ID NO:15818<br>TTTATATGGTATGATGGA AGTGAGAACTACTATGC AGACTCCGTGAAGGGC | SEQ ID NO:23830<br>GATCGGGTGGAGGGTTCGGG GACTCCCTACTACTACTACG GTATGGACGTC |
| | | AA | SEQ ID NO:7807<br>RYGMH | SEQ ID NO:15819<br>FIWYDGSENYYADSVKG | SEQ ID NO:23831<br>DRVEGSGTPYYYYGMDV |
| | | | SEQ ID NO:7808 | SEQ ID NO:15820 | SEQ ID NO:23832 |

FIGURE 49
(Continued)

| iPS: | | | | | |
|---|---|---|---|---|---|
| iPS:437256 | 21-225_150F11 | NA | CGCTATGGCATGCAC | TTTATATGGTATGATGGAAGTGAGAACTACTATGCAGACTCCGTGAAGGGC | GATCGGGTGGAGGGTTCGGGGACTCCCTACTACTACGGTATGGACGTC |
| | | | SEQ ID NO:7809 | SEQ ID NO:15821 | SEQ ID NO:23833 |
| | | AA | RYGMH | FIWYDGSENYYADSVKG | DRVEGSGTPYYYGMDV |
| | | | SEQ ID NO:7810 | SEQ ID NO:15822 | SEQ ID NO:23834 |
| iPS:437258 | 21-225_153F9 | NA | ACCTATGGCATGCAC | GTTATATGGTATGGTGGAAGTGATACAGACTATGCAGACTCCGTGAGGGGC | GATCGGGATTATTGTAGTGGTGGTAACTGCCCTACTACTACTACGTATGGACGTC |
| | | | SEQ ID NO:7811 | SEQ ID NO:15823 | SEQ ID NO:23835 |
| | | AA | TYGMH | VIWYGGSDIDYADSVRG | DRDYCSGGNCPYYYYGMDV |
| | | | SEQ ID NO:7812 | SEQ ID NO:15824 | SEQ ID NO:23836 |
| iPS:437260 | 21-225_170D1 | NA | GGCTACTTTATGCAC | TGGATCAAGCCTAAAAGCGGTGGCACAAACTGTGCACAGAAGTTTCAGGGC | GGGGGGCTACGGTGACTACGTGGGGGGTCTTTGACTAC |
| | | | SEQ ID NO:7813 | SEQ ID NO:15825 | SEQ ID NO:23837 |
| | | AA | GYFMH | WIKPKSGGTNCAQKFQG | GGATVTTWGVFDY |
| | | | SEQ ID NO:7814 | SEQ ID NO:15826 | SEQ ID NO:23838 |
| iPS:437262 | 21-225_170E4 | NA | AGCTATAGCATGAAC | TACATTAGCAGTAGTGGTAGTACCAAATACTACGCAGACTCTGTGGAGGGC | GATAGTAGGAAGGGGTTCTACTACGGTCTGGACGTC |
| | | | SEQ ID NO:7815 | SEQ ID NO:15827 | SEQ ID NO:23839 |
| | | AA | SYSMN | YISSSGSTKYYADSVEG | DSRKGFYYGLDV |
| | | | SEQ ID NO:7816 | SEQ ID NO:15828 | SEQ ID NO:23840 |
| iPS:437264 | 21_225_171H12 | NA | GGCTACTTTATGCAC | TGGATCAAGCCTAAGAGTGGTGGCACAAACTCTGCACAGAGGTTTCAGGGC | GGGGGACTACGGTGGCTACGTGGGGGGTCTTTGACTAC |

FIGURE 49
(Continued)

| | | | | | | | |
|---|---|---|---|---|---|---|---|
| iPS:437266 | 21-225_171H12 | AA | SEQ ID NO:7817<br>GYFMH | SEQ ID NO:15829<br>WIKPKSGGTNSAQRFQG | SEQ ID NO:23841<br>GGTTVATWGVFDY | | |
| | | NA | SEQ ID NO:7818<br>GGCTACTTTATGCAC | SEQ ID NO:15830<br>TGGATCAAGCCTAAGAG<br>TGGTGGCACAAACTCTG<br>CACAGAGGTTTCAGGGC | SEQ ID NO:23842<br>GGGGGGACTACGGTGGCTAC<br>GTGGGGGGTCTTTGACTAC | | |
| iPS:437268 | 21-225_177A5 | AA | SEQ ID NO:7819<br>GYFMH | SEQ ID NO:15831<br>WIKPKSGGTNSAQRFQG | SEQ ID NO:23843<br>GGTTVATWGVFDY | | |
| | | NA | SEQ ID NO:7820<br>AGCTATGGCATGGAC | SEQ ID NO:15832<br>ATTATATGGTTTGATGGA<br>AGTAATAAATACTATGC<br>AGACTCCGTGAAGGGC | SEQ ID NO:23844<br>GCATATTGTGGTGGTGACTG<br>CTATTCCCCATCTCCATTA<br>CTACGGTATGGACGTC | | |
| | 21-225_177D2 | AA | SEQ ID NO:7821<br>SYGMD | SEQ ID NO:15833<br>IIWFDGSNKYYADSVKG | SEQ ID NO:23845<br>AYCGGDCYFPHLHYYGMDV | | |
| iPS:437270 | 21-225_178H4 | NA | SEQ ID NO:7822<br>GGCTACTTTATGCAC | SEQ ID NO:15834<br>TGGATCAAGCCTAAAAG<br>TGGTGGCACAAACTGTG<br>CACAGAAGTTTCAGGGC | SEQ ID NO:23846<br>GGGGGGACTACGGTGACTAC<br>GTGGGGGGTCTTTGACTAC | | |
| | | AA | SEQ ID NO:7823<br>GYFMH | SEQ ID NO:15835<br>WIKPKSGGTNCAQKFQG | SEQ ID NO:23847<br>GGTTVTTWGVFDY | | |
| iPS:437274 | 21-225_196D4 | NA | SEQ ID NO:7824<br>AGCTATGGCATGCAC | SEQ ID NO:15836<br>GTTATATGGTATGATGG<br>AAGTAATAGAAAACTATG<br>CAGACTCCGTGAAGGGC | SEQ ID NO:23848<br>GATCGGTCTAAGGGTTACGA<br>CGGTATGGACGTC | | |
| | | | SEQ ID NO:7825 | SEQ ID NO:15837 | SEQ ID NO:23849 | | |

FIGURE 49
(Continued)

| | | | SYGMH | VIWYDGSNRNYADSVKG | DRSKGYDGMDV |
|---|---|---|---|---|---|
| iPS:437280 | | AA | SEQ ID NO:7826 | SEQ ID NO:15838 | SEQ ID NO:23850 |
| | 21-225_203C10 | NA | GACTATGGCATGCAC | GTTATATGGTATGATGG AGGTAATACACATTATA CAGACTCCGTGAAGGGC | GAAGTGGGTTGGCTTGATGA CTAC |
| | | | SEQ ID NO:7827 | SEQ ID NO:15839 | SEQ ID NO:23851 |
| | | AA | DYGMH | VIWYDGGNTHYTDSVKG | EVGWLDDY |
| iPS:437282 | | | SEQ ID NO:7828 | SEQ ID NO:15840 | SEQ ID NO:23852 |
| | 21-225_207C9 | NA | AGCTATGGCCATGAGC | GCTATTAGTGGTAGTGGT GGTAGCACATACTACGC AGACTCCGTGAAGGGC | GCTGGTGGAACTACGGGAG CTACTACTACAACGGTATGG ACGTC |
| | | | SEQ ID NO:7829 | SEQ ID NO:15841 | SEQ ID NO:23853 |
| | | AA | SYAMS | AISGSGGSTYYADSVKG | AGGTTGSYYYNGMDV |
| iPS:437286 | | | SEQ ID NO:7830 | SEQ ID NO:15842 | SEQ ID NO:23854 |
| | 21-225_208F1 | NA | GACTATGTCATGCAC | GTTATATGGTATGATGG AAGTAATAAATACTATG TAGACTCCGTGAAGGGC | GAACGGTATAGCAGTGGCTT GTACGACTACGGTATGGACG TC |
| | | | SEQ ID NO:7831 | SEQ ID NO:15843 | SEQ ID NO:23855 |
| | | AA | DYVMH | VIWYDGSNKYYVDSVKG | ERYSSGLYDYGMDV |
| iPS:437290 | | | SEQ ID NO:7832 | SEQ ID NO:15844 | SEQ ID NO:23856 |
| | 21-225_210G6 | NA | GACTATGTCATGCAC | GTTATATGGTATGATGG AAGTAATAAATACTATG TAGACTCCGTGAAGGGC | GAACGGTATAGCAGTGGCTT GTACGACTACGGTATGGACG TC |
| | | | SEQ ID NO:7833 | SEQ ID NO:15845 | SEQ ID NO:23857 |

FIGURE 49
(Continued)

| | | | | VIWYDGSNKYYVDSVKG | ERYSSGLYDYGMDV |
|---|---|---|---|---|---|
| iPS:437294 | 21-225_216D5 | AA | DYYMH | | |
| | | | SEQ ID NO:7834 | SEQ ID NO:15846 | SEQ ID NO:23858 |
| | | NA | AGTGGTGGTTACTACTGGAG C | TACATCTATTACAGTGGG AGCACTACTACAACCC GTCCCTCAAGAGT | GATTCCCCTGACAGGGGGTT TGACTAC |
| | | | SEQ ID NO:7835 | SEQ ID NO:15847 | SEQ ID NO:23859 |
| | | AA | SGGYYWS | YIYYSGSTYYNPSLKS | DSPDRGFDY |
| | | | SEQ ID NO:7836 | SEQ ID NO:15848 | SEQ ID NO:23860 |
| iPS:437302 | 21-225_225B11 | NA | AGCTATGGCATGCAC | ATTATATCATATAGTGA AGTAATAAATACTATGC AGACTCCGTGAAGGGC | CGGGGATACAGCTATGGCGG GTACGGTATGGACGTC |
| | | | SEQ ID NO:7837 | SEQ ID NO:15849 | SEQ ID NO:23861 |
| | | AA | SYGMH | IISYSGSNKYYADSVKG | RGYSYGGYGMDV |
| | | | SEQ ID NO:7838 | SEQ ID NO:15850 | SEQ ID NO:23862 |
| iPS:437320 | 21-225_75A1 | NA | GATTACTACTGGAGC | GAAATCAATCATATAGTGG AGACACCAACTACAACC CGTCCCTCAAGAGT | GAGTTTCCATATAGTGGAAG CTACCTCTACTACTACGGTA TGGACGTC |
| | | | SEQ ID NO:7839 | SEQ ID NO:15851 | SEQ ID NO:23863 |
| | | AA | DYYWS | EINHSGDTNYNPSLKS | EFPYSGSYLYYYGMDV |
| | | | SEQ ID NO:7840 | SEQ ID NO:15852 | SEQ ID NO:23864 |
| iPS:437322 | 21-225_75B1 | NA | AAITATGATATCAAC | TGGATGCACCCTAACAG TGGTAAACACAGGCTATG CACAGAAGTTCCAGGGC | AGTAGTGGCTGGTACTGGTT CGACCCC |
| | | | SEQ ID NO:7841 | SEQ ID NO:15853 | SEQ ID NO:23865 |
| | | AA | NYDIN | WMHPNSGNTGYAQKFQG | SSGWYWFDP |
| | | | SEQ ID NO:7842 | SEQ ID NO:15854 | SEQ ID NO:23866 |

FIGURE 49
(Continued)

| iPS:437324 | 21-225_75C2 | NA | GGTTGCTACTGGAGC | GAAATCAATCATAGTGG AAGCACCAACTACAACC CGTCCCTCAAGAGT | GACTACGGGGGTATGGACGT C |
| --- | --- | --- | --- | --- | --- |
| | | | SEQ ID NO:7843 | SEQ ID NO:15855 | SEQ ID NO:23867 |
| | | AA | GCYWS | EINHSGSTNYNPSLKS | DYGGMDV |
| | | | SEQ ID NO:7844 | SEQ ID NO:15856 | SEQ ID NO:23868 |
| iPS:437326 | 21-225_75C10 | NA | AGTTATATGGCATGCAT | GTTATATGGTATGATGG AAGTGATAAATACTATG CAGACTCCGTGAAGGGC | GATCGGTTAGTGGGAGCTAC GGTTGATGCTTTTGATATC |
| | | | SEQ ID NO:7845 | SEQ ID NO:15857 | SEQ ID NO:23869 |
| | | AA | SYGMH | VIWYDGSDKYYADSVKG | DRLVGATVDAFDI |
| | | | SEQ ID NO:7846 | SEQ ID NO:15858 | SEQ ID NO:23870 |
| iPS:437328 | 21-225_75D3 | NA | GGTTGCTACTGGAGC | GAAATCAATCATAGTGG AAGCACCAACTACAACC CGTCCCTCAAGAGT | GACTACGGCGGTATGGACGT C |
| | | | SEQ ID NO:7847 | SEQ ID NO:15859 | SEQ ID NO:23871 |
| | | AA | GCYWS | EINHSGSTNYNPSLKS | DYGGMDV |
| | | | SEQ ID NO:7848 | SEQ ID NO:15860 | SEQ ID NO:23872 |
| iPS:437332 | 21-225_75F3 | NA | GGTTGCTACTGGAGC | GAAATCAATCATAGTGG AAGCACCAACTACAACC CGTCCCTCAAGAGT | GACTACGGCGGTATGGACGT C |
| | | | SEQ ID NO:7849 | SEQ ID NO:15861 | SEQ ID NO:23873 |
| | | AA | GCYWS | EINHSGSTNYNPSLKS | DYGGMDV |
| | | | SEQ ID NO:7850 | SEQ ID NO:15862 | SEQ ID NO:23874 |
| iPS:437334 | 21-225_75F11 | NA | ACTGGTGGAGTGGGTGTGGG C | CTCATTTATTGGGATGAT GATAAGCGCTACAGCCC ATCTCTGAAGAGC | CTTATAGCAGTGGCCTTTGA CTAC |
| | | | SEQ ID NO:7851 | SEQ ID NO:15863 | SEQ ID NO:23875 |
| | | AA | TGGVGVG | LIYWDDDKRYSPSLKS | LIAVAFDY |

FIGURE 49
(Continued)

| | | | SEQ ID NO:7852 | SEQ ID NO:15864 | SEQ ID NO:23876 |
|---|---|---|---|---|---|
| iPS:437340 | 21-225_75G9 | NA | GGTTGCTACTGGAGC | GAAATCAATCATAGTGG AAGGACCAACTACAACC CGTCCCTCAAGAGT | GACTACGGTGGGCTTGACTA C |
| | | AA | SEQ ID NO:7853 GCYWS | SEQ ID NO:15865 EINHSGRTNYNPSLKS | SEQ ID NO:23877 DYGGLDY |
| | | | SEQ ID NO:7854 | SEQ ID NO:15866 | SEQ ID NO:23878 |
| iPS:437344 | 21-225_75G12 | NA | GGTTGCTACTGGAGC | GAAATCAATCATAGTGG AAGCACCAACTACAACC CGTCCCTCAAGAGT | GACTACGGCGGGTATGGACGT C |
| | | AA | SEQ ID NO:7855 GCYWS | SEQ ID NO:15867 EINHSGSTNYNPSLKS | SEQ ID NO:23879 DYGGMDV |
| | | | SEQ ID NO:7856 | SEQ ID NO:15868 | SEQ ID NO:23880 |
| iPS:437346 | 21-225_75H7 | NA | AGGAGTAGTTACTGGGG C | AGTATCTATTATAGTGG AGCGCCTACTCCAACCC GTCCCTCAAGAGT | CTTGACTCTAACTGGGGTCT TGACTAC |
| | | AA | SEQ ID NO:7857 RSSYYWG | SEQ ID NO:15869 SIYYSGSAYSNPSLKS | SEQ ID NO:23881 LDSNWGLDY |
| | | | SEQ ID NO:7858 | SEQ ID NO:15870 | SEQ ID NO:23882 |
| iPS:437350 | 21-225_74A3 | NA | GGTTGCTACTGGAGC | GAAATCAATCATAGTGG AAGCACCAACTACAACC CGTCCCTCAAGAGT | GACTACGGCGGGTATGGACGT C |
| | | AA | SEQ ID NO:7859 GCYWS | SEQ ID NO:15871 EINHSGSTNYNPSLKS | SEQ ID NO:23883 DYGGMDV |
| | | | SEQ ID NO:7860 | SEQ ID NO:15872 | SEQ ID NO:23884 |
| iPS:437356 | 21-225_74B1 | NA | AATTATGATATCAAC | TGGATGAACCCTAACAG TGGTAACACAGGCTATG CACAGAAGTTCCAGGGC | ACCAGTGGCTGGAACTTCTT TGACTAC |
| | | | SEQ ID NO:7861 | SEQ ID NO:15873 | SEQ ID NO:23885 |

FIGURE 49
(Continued)

| | | AA | NYDIN | | WMNPNSGNTGYAQKFQG | | TSGWNFFDY | |
|---|---|---|---|---|---|---|---|---|
| iPS:437361 | 21-225_74C1 | | SEQ ID NO:7862 | | SEQ ID NO:15874 | | SEQ ID NO:23886 | |
| | | NA | AATTATGATATCAAC | | TGGATGAACCCTAACAGTGGTAACACAGGCTTTGCACAGAAGTTCCAGGC | | TCCAGTGGCTGGTACTGGTTCGACCCC | |
| | | | SEQ ID NO:7863 | | SEQ ID NO:15875 | | SEQ ID NO:23887 | |
| iPS:437363 | 21-225_74C10 | AA | NYDIN | | WMNPDSGNTGFAQKFQG | | SSGWYWFDP | |
| | | | SEQ ID NO:7864 | | SEQ ID NO:15876 | | SEQ ID NO:23888 | |
| | | NA | AATTATGATATCAAC | | TGGATGAACCCTAACAGTGGTAACATAGGCTATGCACAGAAGTTCCAGGC | | AGCAGTGGCTGGTACTGGTTCGACCCC | |
| | | | SEQ ID NO:7865 | | SEQ ID NO:15877 | | SEQ ID NO:23889 | |
| iPS:437369 | 21-225_74D6 | AA | NYDIN | | WMNPNSGNIGYAQKFQG | | SSGWYWFDP | |
| | | | SEQ ID NO:7866 | | SEQ ID NO:15878 | | SEQ ID NO:23890 | |
| | | NA | GGTTGCTACTGGAGC | | GAAATCAATCATAGTGGAAGCACCAACTACAACCCGTCCCTCAAGAGT | | GACTACGGCGGTATGGACGTC | |
| | | | SEQ ID NO:7867 | | SEQ ID NO:15879 | | SEQ ID NO:23891 | |
| | | AA | GCYWS | | EINHSGSTNYNPSLKS | | DYGGMDV | |
| | | | SEQ ID NO:7868 | | SEQ ID NO:15880 | | SEQ ID NO:23892 | |
| iPS:437371 | 21-225_74D8 | NA | AACTACGACATGCAC | | GCTATTGGTACTGCTGGTGACACATACTATCCAGGCTCCGTGAAGGGC | | GTTCTTGACTACGGTGACTCCTTGGGCTACTACTACTACGGTATGGACGTC | |
| | | | SEQ ID NO:7869 | | SEQ ID NO:15881 | | SEQ ID NO:23893 | |
| | | AA | NYDMH | | AIGTAGDTYYPGSVKG | | VLDYGDSLGYYYYGMDV | |
| | | | SEQ ID NO:7870 | | SEQ ID NO:15882 | | SEQ ID NO:23894 | |

FIGURE 49
(Continued)

| | | | | |
|---|---|---|---|---|
| iPS:437377 | 21-225_74G9 | NA | ACTGGTGGAGTGGGTGTGGGC | CTCATTTATTGGGATGATGATAAGCGCTACAGCCCATCTCTGAAGAGC | CTTATAGCAGTGGCCTTTGACTAC |
| | | | SEQ ID NO:7871 | SEQ ID NO:15883 | SEQ ID NO:23895 |
| | | AA | TGGVGVG | LIYWDDDKRYSPSLKS | LIAVAFDY |
| | | | SEQ ID NO:7872 | SEQ ID NO:15884 | SEQ ID NO:23896 |
| iPS:437379 | 21-225_74H2 | NA | AATTATGATATCAAC | TGGATGCACCCTAACAGTGGTAACACAGGCTTTGCACAGAAGTTCCAGGGC | TCCAGTGGCTGGTACTGGTTCGACCCC |
| | | | SEQ ID NO:7873 | SEQ ID NO:15885 | SEQ ID NO:23897 |
| | | AA | NYDIN | WMHPNSGNTGFAQKFQG | SSGWYWFDP |
| | | | SEQ ID NO:7874 | SEQ ID NO:15886 | SEQ ID NO:23898 |
| iPS:437383 | 21-225_74H8 | NA | AACGCCTGGATGAAC | CGTATTAAAAGCAAAACTGATGTGGGACAACAGACTACGCTGCACCCGTGAAAGGC | GTGGGAGCTACTACGGACTAC |
| | | | SEQ ID NO:7875 | SEQ ID NO:15887 | SEQ ID NO:23899 |
| | | AA | NAWMN | RIKSKTDGGTTDYAAPVKG | VGATTDY |
| | | | SEQ ID NO:7876 | SEQ ID NO:15888 | SEQ ID NO:23900 |
| iPS:438664 | 21-225_216G1 | NA | AACTATGGCATGCAC | GTTATATGGTATGATGGAAGTAATAAATACTATGCAGACTCCGTGAAGGGC | GGGGACTGGAACCCCGAGGGTATGGACGTC |
| | | | SEQ ID NO:7877 | SEQ ID NO:15889 | SEQ ID NO:23901 |
| | | AA | NYGMH | VIWYDGSNKYYADSVKG | GDWNPEGMDV |
| | | | SEQ ID NO:7878 | SEQ ID NO:15890 | SEQ ID NO:23902 |

FIGURE 49
(Continued)

| | | NA | AATTATGATATTAAT | TGGATGTACCCTAACAG TGGTAGCACAGGCTATG CACAGAAATTCCAGGGC | AGCAGTGGCTGGTACTACTT TGACTAC |
|---|---|---|---|---|---|
| iPS:441468 | 21-225_25A4.001.001 | | SEQ ID NO:7879 | SEQ ID NO:15891 | SEQ ID NO:23903 |
| | | AA | NYDIN | WMYPNSGSTGYAQKFQG | SSGWYYFDY |
| | | | SEQ ID NO:7880 | SEQ ID NO:15892 | SEQ ID NO:23904 |
| iPS:441475 | 21-225_25A4.001.002 | NA | AATTATGATATTAAT | TGGATGTACCCTAACAG TGGTAACGCAGGCTATG CACAGAAATTCCAGGGC | AGCAGTGGCTGGTACTACTT TGACTAC |
| | | | SEQ ID NO:7881 | SEQ ID NO:15893 | SEQ ID NO:23905 |
| | | AA | NYDIN | WMYPNSGNAGYAQKFQG | SSGWYYFDY |
| | | | SEQ ID NO:7882 | SEQ ID NO:15894 | SEQ ID NO:23906 |
| iPS:441482 | 21-225_25A4.001.003 | NA | AATTATGATATTAAT | TGGATGTACCCTAACAG TGGTAACGTAGGCTATG CACAGAAATTCCAGGGC | AGCAGTGGCTGGTACTACTT TGACTAC |
| | | | SEQ ID NO:7883 | SEQ ID NO:15895 | SEQ ID NO:23907 |
| | | AA | NYDIN | WMYPNSGNVGYAQKFQG | SSGWYYFDY |
| | | | SEQ ID NO:7884 | SEQ ID NO:15896 | SEQ ID NO:23908 |
| iPS:441489 | 21-225_25A4.001.004 | NA | AATTATGATATTAAT | TGGATGTACCCTAACAG TGGTCAAACAGGCTATG CACAGAAATTCCAGGGC | AGCAGTGGCTGGTACTACTT TGACTAC |
| | | | SEQ ID NO:7885 | SEQ ID NO:15897 | SEQ ID NO:23909 |

FIGURE 49
(Continued)

| | | AA | NYDIN | | WMYPNSGQTGYAQKFQG | | SSGWYYFDY | |
|---|---|---|---|---|---|---|---|---|
| | | | SEQ ID NO:7886 | | SEQ ID NO:15897 | | SEQ ID NO:23910 | |
| iPS:441496 | | NA | AATTATGATATTAAT | | TGGATGTACCCTAACAG TGGTAGCACAGGCTATG CACAGAAATTCCAGGGC | | AGCAGTGGCTGGTACTACTT TGACTAC | |
| | 21-225_25A4.001.005 | | SEQ ID NO:7887 | | SEQ ID NO:15898 | | SEQ ID NO:23911 | |
| | | AA | NYDIN | | WMYPNSGSTGYAQKFQG | | SSGWYYFDY | |
| | | | SEQ ID NO:7888 | | SEQ ID NO:15899 | | SEQ ID NO:23912 | |
| iPS:441505 | | NA | AATTATGATATTAAT | | TGGATGTACCCTAACAG TGGTAACGCAGGCTATG CACAGAAATTCCAGGGC | | AGCAGTGGCTGGTACTACTT TGACTAC | |
| | 21-225_25A4.001.006 | | SEQ ID NO:7889 | | SEQ ID NO:15900 | | SEQ ID NO:23913 | |
| | | AA | NYDIN | | WMYPNSGNAGYAQKFQG | | SSGWYYFDY | |
| | | | SEQ ID NO:7890 | | SEQ ID NO:15901 | | SEQ ID NO:23914 | |
| iPS:441512 | | NA | AATTATGATATTAAT | | TGGATGTACCCTAACAG TGGTAACGTAGGCTATG CACAGAAATTCCAGGGC | | AGCAGTGGCTGGTACTACTT TGACTAC | |
| | 21-225_25A4.001.007 | | SEQ ID NO:7891 | | SEQ ID NO:15902 | | SEQ ID NO:23915 | |
| | | AA | NYDIN | | WMYPNSGNVGYAQKFQG | | SSGWYYFDY | |
| | | | SEQ ID NO:7892 | | SEQ ID NO:15903 | | SEQ ID NO:23916 | |

FIGURE 49
(Continued)

| iPS:441519 | 21-225_25A4.001.008 | NA | AATTATGATATTAAT SEQ ID NO:7893 | TGGATGTACCCTAACAG TGGTCAAACAGGCTATG CACAGAAATTCCAGGGC SEQ ID NO:15905 | AGCAGTGGCTGGTACTACTT TGACTAC SEQ ID NO:23917 |
| --- | --- | --- | --- | --- | --- |
| | | AA | NYDIN SEQ ID NO:7894 | WMYPNSGQTGYAQKFQG SEQ ID NO:15906 | SSGWYYFDY SEQ ID NO:23918 |
| iPS:441554 | 21-225_25A4.001.013 | NA | AATTATGATATTAAT SEQ ID NO:7895 | TGGATGTACCCTAACAG TGGTAGCACAGGCTATG CACAGAAATTCCAGGGC SEQ ID NO:15907 | AGCAGTGGCTGGTACTACTT TGACTAC SEQ ID NO:23919 |
| | | AA | NYDIN SEQ ID NO:7896 | WMYPNSGSTGYAQKFQG SEQ ID NO:15908 | SSGWYYFDY SEQ ID NO:23920 |
| iPS:441595 | 21-225_25A4.001.019 | NA | AATTATGATATTAAT SEQ ID NO:7897 | TGGATGTACCCTAACAG TGGTAGCACAGGCTATG CACAGAAATTCCAGGGC SEQ ID NO:15909 | AGCAGTGGCTGGTACTACTT TGACTAC SEQ ID NO:23921 |
| | | AA | NYDIN SEQ ID NO:7898 | WMYPNSGSTGYAQKFQG SEQ ID NO:15910 | SSGWYYFDY SEQ ID NO:23922 |
| iPS:441604 | 21-225_25A4.001.020 | NA | AATTATGATATTAAT SEQ ID NO:7899 | TGGATGTACCCTAACAG TGGTCAAACAGGCTATG CACAGAAATTCCAGGGC SEQ ID NO:15911 | AGCAGTGGCTGGTACTACTT TGACTAC SEQ ID NO:23923 |

FIGURE 49
(Continued)

| | | AA | NYDIN | | WMYPNSGQTGYAQKFQG | SSGWYYFDY |
|---|---|---|---|---|---|---|
| iPS:441613 | 21-225_25A4.001.021 | | SEQ ID NO:7900 | | SEQ ID NO:15912 | SEQ ID NO:23924 |
| | | NA | AATTATGATATTAAT | | TGGATGTACCCTAACAG TGGTAACGCAGGCTATG CACAGAAATTCCAGGGC | AGCAGTGGCTGTGGTACTACTT TGACTAC |
| | | | SEQ ID NO:7901 | | SEQ ID NO:15913 | SEQ ID NO:23925 |
| iPS:441841 | 21-225_4A2.001.001 | AA | NYDIN | | WMYPNSGNAGYAQKFQG | SSGWYYFDY |
| | | | SEQ ID NO:7902 | | SEQ ID NO:15914 | SEQ ID NO:23926 |
| | | NA | AATTATGATATCAAC | | TGGATGCACCCTAACAG TGGTAACACAGGCTATG CACAGAAGTTCCAGGGC | AGCAGTGGCTGTGGTACTACTT TGACTAC |
| | | | SEQ ID NO:7903 | | SEQ ID NO:15915 | SEQ ID NO:23927 |
| iPS:441847 | 21-225_4A2.001.002 | AA | NYDIN | | WMHPNSGNTGYAQKFQG | SSGWYYFDY |
| | | | SEQ ID NO:7904 | | SEQ ID NO:15916 | SEQ ID NO:23928 |
| | | NA | AATTATGATATCAAC | | TGGATGCACCCTAACAG TGGTAACACAGGCTATG CACAGAAGTTCCAGGGC | AGCAGTGGCTGTGGTACTACTT TGACTAC |
| | | | SEQ ID NO:7905 | | SEQ ID NO:15917 | SEQ ID NO:23929 |
| iPS:441853 | 21-225_4A2.001.003 | AA | NYDIN | | WMHPNSGNTGYAQKFQG | SSGWYYFDY |
| | | | SEQ ID NO:7906 | | SEQ ID NO:15918 | SEQ ID NO:23930 |
| | | NA | AATTATGATATCAAC | | TGGATGCACCCTAACAG TGGTAACACAGGCTATG CACAGAAGTTCCAGGGC | AGCAGTGGCTGTGGTACTACTT TGACTAC |
| | | | SEQ ID NO:7907 | | SEQ ID NO:15919 | SEQ ID NO:23931 |

FIGURE 49
(Continued)

| | | AA | NYDIN | | WMHPNSGNTGYAQKFQG | SSGWYYFDY |
|---|---|---|---|---|---|---|
| iPS:441859 | | | SEQ ID NO:7908 | | SEQ ID NO:15920 | SEQ ID NO:23932 |
| | 21-225_4A2.001.004 | NA | AATTATGATATCAAC | | TGGATGCACCCTAACAG TGGTAACGCAGGCTATG CACAGAAGTTCCAGGGC | AGCAGTGGCTGGTACTACTT TGACTAC |
| | | | SEQ ID NO:7909 | | SEQ ID NO:15921 | SEQ ID NO:23933 |
| iPS:441866 | | AA | NYDIN | | WMHPNSGNAGYAQKFQG | SSGWYYFDY |
| | | | SEQ ID NO:7910 | | SEQ ID NO:15922 | SEQ ID NO:23934 |
| | 21-225_4A2.001.005 | NA | AATTATGATATCAAC | | TGGATGCACCCTAACAG TGGTAGCACAGGCTATG CACAGAAGTTCCAGGGC | AGCAGTGGCTGGTACTACTT TGACTAC |
| | | | SEQ ID NO:7911 | | SEQ ID NO:15923 | SEQ ID NO:23935 |
| iPS:441873 | | AA | NYDIN | | WMHPNSGSTGYAQKFQG | SSGWYYFDY |
| | | | SEQ ID NO:7912 | | SEQ ID NO:15924 | SEQ ID NO:23936 |
| | 21-225_4A2.001.006 | NA | AATTATGATATCAAC | | TGGATCAAACAGGCTATG CACAGAAGTTCCAGGGC | AGCAGTGGCTGGTACTACTT TGACTAC |
| | | | SEQ ID NO:7913 | | SEQ ID NO:15925 | SEQ ID NO:23937 |
| iPS:441880 | | AA | NYDIN | | WMHPNSGQTGYAQKFQG | SSGWYYFDY |
| | | | SEQ ID NO:7914 | | SEQ ID NO:15926 | SEQ ID NO:23938 |
| | 21-225_4A2.001.007 | NA | AATTATGATATCAAC | | TGGATGCACCCTAACAG TGGTCAAACAGGCTATG CACAGAAGTTCCAGGGC | AGCAGTGGCTGGTACTACTT TGACTAC |
| | | | SEQ ID NO:7915 | | SEQ ID NO:15927 | SEQ ID NO:23939 |
| | | AA | NYDIN | | WMHPNSGQTGYAQKFQG | SSGWYYFDY |

FIGURE 49
(Continued)

| | | | SEQ ID NO:7916 AATTATGATATCAAC | SEQ ID NO:15928 TGGATGCACCCTAACAG TGGTAACGCAGGCTATG CACAGAAGTTCCAGGGC | SEQ ID NO:23940 AGCAGTGGCTGGTACTACTT TGACTAC |
|---|---|---|---|---|---|
| iPS:441884 | 21-225_4A2.001.008 | NA | | | |
| | | AA | SEQ ID NO:7917 NYDIN | SEQ ID NO:15929 WMHPNSGNAGYAQKFQG | SEQ ID NO:23941 SSGWYYFDY |
| iPS:441888 | 21-225_4A2.001.009 | NA | SEQ ID NO:7918 AATTATGATATCAAC | SEQ ID NO:15930 TGGATGCACCCTAACAG TGGTCAAACAGGCTATG CACAGAAGTTCCAGGGC | SEQ ID NO:23942 AGCAGTGGCTGGTACTACTT TGACTAC |
| | | AA | SEQ ID NO:7919 NYDIN | SEQ ID NO:15931 WMHPNSGQTGYAQKFQG | SEQ ID NO:23943 SSGWYYFDY |
| iPS:441892 | 21-225_4A2.001.010 | NA | SEQ ID NO:7920 AATTATGATATCAAC | SEQ ID NO:15932 TGGATGCACCCTAACAG TGGTAACGCAGGCTATG CACAGAAGTTCCAGGGC | SEQ ID NO:23944 AGCAGTGGCTGGTACTACTT TGACTAC |
| | | AA | SEQ ID NO:7921 NYDIN | SEQ ID NO:15933 WMHPNSGNAGYAQKFQG | SEQ ID NO:23945 SSGWYYFDY |
| iPS:441896 | 21-225_4A2.001.011 | NA | SEQ ID NO:7922 AATTATGATATCAAC | SEQ ID NO:15934 TGGATGCACCCTAACAG TGGTCAAACAGGCTATG CACAGAAGTTCCAGGGC | SEQ ID NO:23946 AGCAGTGGCTGGTACTACTT TGACTAC |
| | | AA | SEQ ID NO:7923 NYDIN | SEQ ID NO:15935 WMHPNSGQTGYAQKFQG | SEQ ID NO:23947 SSGWYYFDY |
| | | | SEQ ID NO:7924 | SEQ ID NO:15936 | SEQ ID NO:23948 |

FIGURE 49
(Continued)

| | | | | |
|---|---|---|---|---|
| iPS:441900 | 21-225_4A2.001.012 | NA | AATTATGATATCAAC | TGGATGCACCCTAACAG TGGTAGCACAGGCTATG CACAGAAGTTCCAGGGC | AGCAGTGGCTGGTACTACTT TGACTAC |
| | | | SEQ ID NO:7925 | SEQ ID NO:15937 | SEQ ID NO:23949 |
| | | AA | NYDIN | WMHPNSGSTGYAQKFQG | SSGWYYFDY |
| | | | SEQ ID NO:7926 | SEQ ID NO:15938 | SEQ ID NO:23950 |
| iPS:441955 | 21-225_4A2.001.022 | NA | AATTATGATATCAAC | TGGATGCACCCTAACAG TGGTAACACAGGCTATG CACAGAAGTTCCAGGGC | AGCAGTGGCTGGTACTACTT TGACTAC |
| | | | SEQ ID NO:7927 | SEQ ID NO:15939 | SEQ ID NO:23951 |
| | | AA | NYDIN | WMHPNSGNTGYAQKFQG | SSGWYYFDY |
| | | | SEQ ID NO:7928 | SEQ ID NO:15940 | SEQ ID NO:23952 |
| iPS:441962 | 21-225_4A2.001.023 | NA | AATTATGATATCAAC | TGGATGCACCCTAACAG TGGTAACACAGGCTATG CACAGAAGTTCCAGGGC | AGCAGTGGCTGGTACTACTT TGACTAC |
| | | | SEQ ID NO:7929 | SEQ ID NO:15941 | SEQ ID NO:23953 |
| | | AA | NYDIN | WMHPNSGNTGYAQKFQG | SSGWYYFDY |
| | | | SEQ ID NO:7930 | SEQ ID NO:15942 | SEQ ID NO:23954 |
| iPS:441971 | 21-225_4A2.001.024 | NA | AATTATGATATCAAC | TGGATGCACCCTAACAG TGGTCAAACAGGCTATG CACAGAAGTTCCAGGGC | AGCAGTGGCTGGTACTACTT TGACTAC |
| | | | SEQ ID NO:7931 | SEQ ID NO:15943 | SEQ ID NO:23955 |
| | | AA | NYDIN | WMHPNSGQTGYAQKFQG | SSGWYYFDY |
| | | | SEQ ID NO:7932 | SEQ ID NO:15944 | SEQ ID NO:23956 |

FIGURE 49
(Continued)

| | | | | |
|---|---|---|---|---|
| iPS:441999 | 21-225_4A2.001.028 | NA | AATTATGATATCAAC<br>SEQ ID NO:7933 | TGGATGCACCCTAACAG<br>TGGTCAAACAGGCTATG<br>CACAGAAGTTCCAGGGC<br>SEQ ID NO:15945 | AGCAGTGGCTGGTACTACTT<br>TGACTAC<br>SEQ ID NO:23957 |
| | | AA | NYDIN<br>SEQ ID NO:7934 | WMHPNSGQTGYAQKFQG<br>SEQ ID NO:15946 | SSGWYYFDY<br>SEQ ID NO:23958 |
| iPS:442006 | 21-225_4A2.001.029 | NA | AATTATGATATCAAC<br>SEQ ID NO:7935 | TGGATGCACCCTAACAG<br>TGGTAGCACAGGCTATG<br>CACAGAAGTTCCAGGGC<br>SEQ ID NO:15947 | AGCAGTGGCTGGTACTACTT<br>TGACTAC<br>SEQ ID NO:23959 |
| | | AA | NYDIN<br>SEQ ID NO:7936 | WMHPNSGSTGYAQKFQG<br>SEQ ID NO:15948 | SSGWYYFDY<br>SEQ ID NO:23960 |
| iPS:442020 | 21-225_4A2.001.031 | NA | AATTATGATATCAAC<br>SEQ ID NO:7937 | TGGATGCACCCTAACAG<br>TGGTAACGAAGGCTATG<br>CACAGAAGTTCCAGGGC<br>SEQ ID NO:15949 | AGCAGTGGCTGGTACTACTT<br>TGACTAC<br>SEQ ID NO:23961 |
| | | AA | NYDIN<br>SEQ ID NO:7938 | WMHPNSGNEGYAQKFQG<br>SEQ ID NO:15950 | SSGWYYFDY<br>SEQ ID NO:23962 |
| iPS:442050 | 21-225_4H6.004 | NA | GACTACTATTTGCAC<br>SEQ ID NO:7939 | TGGATCCACCCTAACAG<br>TGGTGGCACAAACTATG<br>CACAGAAGTTTCAGGGC<br>SEQ ID NO:15951 | GATGGTACCAGCTCGTTTGA<br>CTAC<br>SEQ ID NO:23963 |
| | | AA | DYYLH<br>SEQ ID NO:7940 | WIHPNSGGTNYAQKFQG<br>SEQ ID NO:15952 | DGTSSFDY<br>SEQ ID NO:23964 |
| iPS:442059 | 21_225_4H6_005 | NA | GACTACTATTTGCAC | TGGATCCACCCTAACAG<br>TGGTGGCACAAACTATG<br>CACAGAAGTTTCAGGGC | GATGGTACCAGCTCGTTTGA<br>CTAC |

FIGURE 49
(Continued)

| | | | | | | |
|---|---|---|---|---|---|---|
| iPS:442065 | 21-225_4H6.005 | AA | SEQ ID NO:7941<br>DYYLH | SEQ ID NO:15953<br>WIHPNSGGTNYAQKFQG | SEQ ID NO:23965<br>DGTSSFDY | |
| | | NA | SEQ ID NO:7942<br>GACTACTATTTGCAC | SEQ ID NO:15954<br>TGGATCCACCCTAACAG<br>TGGTGGCACAAACTATG<br>CACAGAAGTTTCAGGGC | SEQ ID NO:23966<br>GATGGTACCAGCTCGTTTGA<br>CTAC | |
| iPS:442071 | 21-225_4H6.006 | AA | SEQ ID NO:7943<br>DYYLH | SEQ ID NO:15955<br>WIHPNSGGTNYAQKFQG | SEQ ID NO:23967<br>DGTSSFDY | |
| | | NA | SEQ ID NO:7944<br>GACTACTATTTGCAC | SEQ ID NO:15956<br>TGGATCCACCCTAACAG<br>TGGTGGCACAAACTATG<br>CACAGAAGTTTCAGGGC | SEQ ID NO:23968<br>GATGCTACCAGCTCGTTTGA<br>CTAC | |
| iPS:442078 | 21-225_4H6.007 | AA | SEQ ID NO:7945<br>DYYLH | SEQ ID NO:15957<br>WIHPNSGGTNYAQKFQG | SEQ ID NO:23969<br>DATSSFDY | |
| | | NA | SEQ ID NO:7946<br>GACTACTATTTGCAC | SEQ ID NO:15958<br>TGGATCCACCCTAACAG<br>TGGTGGCACAAACTATG<br>CACAGAAGTTTCAGGGC | SEQ ID NO:23970<br>AGTGGTACCAGCTCGTTTGA<br>CTAC | |
| iPS:442085 | 21-225_4H6.008 | AA | SEQ ID NO:7947<br>DYYLH | SEQ ID NO:15959<br>WIHPNSGGTNYAQKFQG | SEQ ID NO:23971<br>SGTSSFDY | |
| | | NA | SEQ ID NO:7948<br>GACTACTATTTGCAC | SEQ ID NO:15960<br>TGGATCCACCCTAACAG<br>TGGTGGCACAAACTATG<br>CACAGAAGTTTCAGGGC | SEQ ID NO:23972<br>AGTGGTACCAGCTCGTTTGA<br>CTAC | |
| iPS:442089 | 21-225_4H6.009 | AA | SEQ ID NO:7949<br>DYYLH | SEQ ID NO:15961<br>WIHPNSGGTNYAQKFQG | SEQ ID NO:23973<br>SGTSSFDY | |
| | 21-225_4H6.010 | NA | SEQ ID NO:7950<br>GACTACTATTTGCAC | SEQ ID NO:15962<br>TGGATCCACCCTAACAG<br>TGGTGGCACAAACTATG<br>CACAGAAGTTTCAGGGC | SEQ ID NO:23974<br>GATGCTACCAGCTCGTTTGA<br>CTAC | |

FIGURE 49
(Continued)

| | | | | | | | |
|---|---|---|---|---|---|---|---|
| iPS:442093 | 21-225_4H6.010 | AA | SEQ ID NO:7951 DYYLH | SEQ ID NO:7952 | SEQ ID NO:15963 WIHPNSGGTNYAQKFQG | SEQ ID NO:15964 | SEQ ID NO:23975 DATSSFDY | SEQ ID NO:23976 |
| | 21-225_4H6.011 | NA | SEQ ID NO:7953 | GACTACTATTTGCAC | SEQ ID NO:15965 | TGGATCCACCCTAACAG TGGTGCACAAACTATG CACAGAAGTTTCAGGGC | SEQ ID NO:23977 | GATGCTACCAGCTCGTTTGA CTAC |
| iPS:442115 | | AA | SEQ ID NO:7954 DYYLH | | SEQ ID NO:15966 WIHPNSGGTNYAQKFQG | | SEQ ID NO:23978 DATSSFDY | |
| | 21-225_5E5.003 | NA | SEQ ID NO:7955 | AACTATGTCATGCAC | SEQ ID NO:15967 | GTTATCTGGTATGATGCA AGTAATAAATACTATGC AGACTCCGTGAAGGGC | SEQ ID NO:23979 | GAGGTATATAGCAGTGGCTG GTACGACTACGGTATGGACG TC |
| iPS:442122 | | AA | SEQ ID NO:7956 NYVMH | | SEQ ID NO:15968 VIWYDASNKYYADSVKG | | SEQ ID NO:23980 EVYSSGWYDYGMDV | |
| | 21-225_5E5.004 | NA | SEQ ID NO:7957 | AACTATGTCATGCAC | SEQ ID NO:15969 | GTTATCTGGTATGATGGA AGTAATAAATACTATGC AGAATCCGTGAAGGGC | SEQ ID NO:23981 | GAGGTATATAGCAGTGGCTG GTACGACTACGGTATGGACG TC |
| iPS:442129 | | AA | SEQ ID NO:7958 NYVMH | | SEQ ID NO:15970 VIWYDGSNKYYAESVKG | | SEQ ID NO:23982 EVYSSGWYDYGMDV | |
| | 21-225_5E5.005 | NA | SEQ ID NO:7959 | AACTATGTCATGCAC | SEQ ID NO:15971 | GTTATCTGGTATGATGGA AGTAATAAATACTATGC AGGCTCCCGTGAAGGGC | SEQ ID NO:23983 | GAGGTATATAGCAGTGGCTG GTACGACTACGGTATGGACG TC |

FIGURE 49
(Continued)

| | | AA | NYVMH | VIWYDGSNKYYAGSVKG | EVYSSGWYDYGMDV |
|---|---|---|---|---|---|
| iPS:442136 | | | SEQ ID NO:7960 | SEQ ID NO:15972 | SEQ ID NO:23984 |
| | 21-225_5E5.006 | NA | AACTATGTCATGCAC | GTTATCTGGTATGATGGAAGTAATAAATACTATGCAGACGCCGTGAAGGGC | GAGGTATATAGCAGTGGCTGGTACGACTACGGTATGGACGTC |
| | | | SEQ ID NO:7961 | SEQ ID NO:15973 | SEQ ID NO:23985 |
| iPS:442171 | | AA | NYVMH | VIWYDGSNKYYADAVKG | EVYSSGWYDYGMDV |
| | | | SEQ ID NO:7962 | SEQ ID NO:15974 | SEQ ID NO:23986 |
| | 21-225_5E5.011 | NA | AACTATGTCATGCAC | GTTATCTGGTATGATGCAAGTAATAAATACTATGCAGAATCCGTGAAGGGC | GAGGTATATAGCAGTGGCTGGTACGACTACGGTATGGACGTC |
| | | | SEQ ID NO:7963 | SEQ ID NO:15975 | SEQ ID NO:23987 |
| iPS:442178 | | AA | NYVMH | VIWYDASNKYYAESVKG | EVYSSGWYDYGMDV |
| | | | SEQ ID NO:7964 | SEQ ID NO:15976 | SEQ ID NO:23988 |
| | 21-225_5E5.012 | NA | AACTATGTCATGCAC | GTTATCTGGTATGATGCAAGTAATAAATACTATGCAGACGCCGTGAAGGGC | GAGGTATATAGCAGTGGCTGGTACGACTACGGTATGGACGTC |
| | | | SEQ ID NO:7965 | SEQ ID NO:15977 | SEQ ID NO:23989 |
| | | AA | NYVMH | VIWYDASNKYYADAVKG | EVYSSGWYDYGMDV |
| | | | SEQ ID NO:7966 | SEQ ID NO:15978 | SEQ ID NO:23990 |

FIGURE 49
(Continued)

| | | NA | AACTATGTCATGCAC | GTTATCTGGTATGATGCA AGTAATAAATACTATGC AGACTCCGTGAAGGGC | GAGGTATATAGCAGTGGCTA TTACGACTACGGTATGGACG TC |
|---|---|---|---|---|---|
| iPS:442199 | 21-225_5E5.015 | | SEQ ID NO:7967 | SEQ ID NO:15979 | SEQ ID NO:23991 |
| | | AA | NYVMH | VIWYDASNKYYADSVKG | EVYSSGYYDYGMDV |
| | | | SEQ ID NO:7968 | SEQ ID NO:15980 | SEQ ID NO:23992 |
| | | NA | AACTATGTCATGCAC | GTTATCTGGTATGATGCA AGTAATAAATACTATGC AGACTCCGTGAAGGGC | GAGGTATATAGCAGTGGCTT CTACGACTACGGTATGGACG TC |
| iPS:442206 | 21-225_5E5.016 | | SEQ ID NO:7969 | SEQ ID NO:15981 | SEQ ID NO:23993 |
| | | AA | NYVMH | VIWYDASNKYYADSVKG | EVYSSGFYDYGMDV |
| | | | SEQ ID NO:7970 | SEQ ID NO:15982 | SEQ ID NO:23994 |
| | | NA | AACTATGTCATGCAC | GTTATCTGGTATGATGGA AGTAATAAATACTATGC AGAATCCGTGAAGGGC | GAGGTATATAGCAGTGGCTA TTACGACTACGGTATGGACG TC |
| iPS:442213 | 21-225_5E5.017 | | SEQ ID NO:7971 | SEQ ID NO:15983 | SEQ ID NO:23995 |
| | | AA | NYVMH | VIWYDGSNKYYAESVKG | EVYSSGYYDYGMDV |
| | | | SEQ ID NO:7972 | SEQ ID NO:15984 | SEQ ID NO:23996 |
| | | NA | AACTATGTCATGCAC | GTTATCTGGTATGATGGA AGTAATAAATACTATGC AGACTCCGTGAAGGGC | GAGGTATATAGCAGTGGCTA TTACGACTACGGTATGGACG TC |
| iPS:442220 | 21-225_5E5.018 | | SEQ ID NO:7973 | SEQ ID NO:15985 | SEQ ID NO:23997 |

FIGURE 49
(Continued)

| | | AA | NYVMH | | VIWYDGSNKYYADSVKG | EVYSSGYYDYGMDV |
|---|---|---|---|---|---|---|
| iPS:442227 | 21-225_5E5.019 | | SEQ ID NO:7974 | | SEQ ID NO:15986 | SEQ ID NO:23998 |
| | | NA | AACTATGTCATGCAC | | GTTATCTGGTATGATGGA AGTAATAAATACTATGC AGACTCCGTGAAGGGC | GAGGTATATAGCAGTGGCTT CTACGACTACGGTATGGACG TC |
| | | | SEQ ID NO:7975 | | SEQ ID NO:15987 | SEQ ID NO:23999 |
| | | AA | NYVMH | | VIWYDGSNKYYADSVKG | EVYSSGFYDYGMDV |
| iPS:442255 | 21-225_5E5.023 | | SEQ ID NO:7976 | | SEQ ID NO:15988 | SEQ ID NO:24000 |
| | | NA | AACTATGTCATGCAC | | GTTATCTGGTATGATGCA AGTAATAAATACTATGC AGAATCCGTGAAGGGC | GAGGTATATAGCAGTGGCTA TTACGACTACGGTATGGACG TC |
| | | | SEQ ID NO:7977 | | SEQ ID NO:15989 | SEQ ID NO:24001 |
| | | AA | NYVMH | | VIWYDASNKYYAESVKG | EVYSSGYYYDYGMDV |
| iPS:442262 | 21-225_5E5.024 | | SEQ ID NO:7978 | | SEQ ID NO:15990 | SEQ ID NO:24002 |
| | | NA | AACTATGTCATGCAC | | GTTATCTGGTATGATGCA AGTAATAAATACTATGC AGACGCCGTGAAGGGC | GAGGTATATAGCAGTGGCTA TTACGACTACGGTATGGACG TC |
| | | | SEQ ID NO:7979 | | SEQ ID NO:15991 | SEQ ID NO:24003 |
| | | AA | NYVMH | | VIWYDASNKYYADAVKG | EVYSSGYYDYGMDV |
| | | | SEQ ID NO:7980 | | SEQ ID NO:15992 | SEQ ID NO:24004 |

FIGURE 49
(Continued)

| | | | | |
|---|---|---|---|---|
| iPS:442269 | 21-225_5E5.025 | NA | AACTATGTCATGCAC | GTTATCTGGTATGATGA AGTAATAAATACTATGC AGAATCCGTGAAGGGC | GAGGTATATAGCAGTGGCTG GTACGACTACGGTATGGACG TC |
| | | | SEQ ID NO:7981 | SEQ ID NO:15993 | SEQ ID NO:24005 |
| | | AA | NYVMH | VIWYDGSNKYYAESVKG | EVYSSGWYDYGMDV |
| | | | SEQ ID NO:7982 | SEQ ID NO:15994 | SEQ ID NO:24006 |
| iPS:442311 | 21-225_7E11.001.001 | NA | AGCTTTGGCATGCAC | ATTATCTGGCATGATGG AAGTAATAAATACTATG CAGACTCCGTGAAGGGC | GATCTGAGTATGGGCGGTAT GGACGTC |
| | | | SEQ ID NO:7983 | SEQ ID NO:15995 | SEQ ID NO:24007 |
| | | AA | SFGMH | IIWHDGSNKYYADSVKG | DLSMGGMDV |
| | | | SEQ ID NO:7984 | SEQ ID NO:15996 | SEQ ID NO:24008 |
| iPS:442317 | 21-225_7E11.001.002 | NA | AGCTTTGGCATGCAC | ATTATCTGGCATGATGG AAGTAATAAATACTATG CAGACTCCGTGAAGGGC | GATCTGAGTATGGGCGGTAT GGACGTC |
| | | | SEQ ID NO:7985 | SEQ ID NO:15997 | SEQ ID NO:24009 |
| | | AA | SFGMH | IIWHDGSNKYYADSVKG | DLSMGGMDV |
| | | | SEQ ID NO:7986 | SEQ ID NO:15998 | SEQ ID NO:24010 |
| iPS:442323 | 21-225_7E11.001.003 | NA | AGCTTTGGCATGCAC | ATTATCTGGCATAGTGG AAGTAATAAATACTATG CAGACTCCGTGAAGGGC | GATCTGAGTATGGGCGGTAT GGACGTC |
| | | | SEQ ID NO:7987 | SEQ ID NO:15999 | SEQ ID NO:24011 |
| | | AA | SFGMH | IIWHSGSNKYYADSVKG | DLSMGGMDV |
| | | | SEQ ID NO:7988 | SEQ ID NO:16000 | SEQ ID NO:24012 |

FIGURE 49
(Continued)

| | | | | |
|---|---|---|---|---|
| iPS:442330 | NA | AGCTTTGGCATGCAC | ATTATCTGGCATGAAGG AAGTAATAAATACTATG CAGACTCCGTGAAGGGC | GATCTGAGTATGGGCGGTAT GGACGTC |
| | | SEQ ID NO:7989 | SEQ ID NO:16001 | SEQ ID NO:24013 |
| 21-225_7E11.001.004 | AA | SFGMH | IIWHEGSNKYYADSVKG | DLSMGGMDV |
| | | SEQ ID NO:7990 | SEQ ID NO:16002 | SEQ ID NO:24014 |
| iPS:442337 | NA | AGCTTTGGCATGCAC | ATTATCTGGCATGATGCA AGTAATAAATACTATGC AGACTCCGTGAAGGGC | GATCTGAGTATGGGCGGTAT GGACGTC |
| | | SEQ ID NO:7991 | SEQ ID NO:16003 | SEQ ID NO:24015 |
| 21-225_7E11.001.005 | AA | SFGMH | IIWHDASNKYYADSVKG | DLSMGGMDV |
| | | SEQ ID NO:7992 | SEQ ID NO:16004 | SEQ ID NO:24016 |
| iPS:442344 | NA | AGCTTTGGCATGCAC | ATTATCTGGCATGATGG AAGTAATAAATACTATG CAGAATCCGTGAAGGGC | GATCTGAGTATGGGCGGTAT GGACGTC |
| | | SEQ ID NO:7993 | SEQ ID NO:16005 | SEQ ID NO:24017 |
| 21-225_7E11.001.006 | AA | SFGMH | IIWHDGSNKYYAESVKG | DLSMGGMDV |
| | | SEQ ID NO:7994 | SEQ ID NO:16006 | SEQ ID NO:24018 |
| iPS:442351 | NA | AGCTTTGGCATGCAC | ATTATCTGGCATGATGG AAGTAATAAATACTATG CAGACGCCGTGAAGGGC | GATCTGAGTATGGGCGGTAT GGACGTC |
| | | SEQ ID NO:7995 | SEQ ID NO:16007 | SEQ ID NO:24019 |
| 21-225_7E11.001.007 | AA | SFGMH | IIWHDGSNKYYADAVKG | DLSMGGMDV |
| | | SEQ ID NO:7996 | SEQ ID NO:16008 | SEQ ID NO:24020 |

FIGURE 49
(Continued)

| | | | | |
|---|---|---|---|---|
| iPS:442358 | 21-225_7E11.001.008 | NA | AGCTTTGGCATGCAC<br><br>SEQ ID NO:7997 | ATTATCTGGCATGAAGG<br>AAGTAATAAATACTATG<br>CAGACGCCGTGAAGGGC<br><br>SEQ ID NO:16009 | GATCTGAGTATGGGCGGTAT<br>GGACGTC<br><br>SEQ ID NO:24021 |
| | | AA | SFGMH<br><br>SEQ ID NO:7998 | IIWHEGSNKYYADAVKG<br><br>SEQ ID NO:16010 | DLSMGGMDV<br><br>SEQ ID NO:24022 |
| iPS:442365 | 21-225_7E11.001.009 | NA | AGCTTTGGCATGCAC<br><br>SEQ ID NO:7999 | ATTATCTGGCATGAAGG<br>AAGTAATAAATACTATG<br>CAGAATCCGTGAAGGGC<br><br>SEQ ID NO:16011 | GATCTGAGTATGGGCGGTAT<br>GGACGTC<br><br>SEQ ID NO:24023 |
| | | AA | SFGMH<br><br>SEQ ID NO:8000 | IIWHEGSNKYYAESVKG<br><br>SEQ ID NO:16012 | DLSMGGMDV<br><br>SEQ ID NO:24024 |
| iPS:442372 | 21-225_7E11.001.010 | NA | AGCTTTGGCATGCAC<br><br>SEQ ID NO:8001 | ATTATCTGGCATAGTGG<br>AAGTAATAAATACTATG<br>CAGAATCCGTGAAGGGC<br><br>SEQ ID NO:16013 | GATCTGAGTATGGGCGGTAT<br>GGACGTC<br><br>SEQ ID NO:24025 |
| | | AA | SFGMH<br><br>SEQ ID NO:8002 | IIWHSGSNKYYAESVKG<br><br>SEQ ID NO:16014 | DLSMGGMDV<br><br>SEQ ID NO:24026 |
| iPS:442379 | 21-225_7E11.001.011 | NA | AGCTTTGGCATGCAC<br><br>SEQ ID NO:8003 | ATTATCTGGCATAGTGG<br>AAGTAATAAATACTATG<br>CAGACGCCGTGAAGGGC<br><br>SEQ ID NO:16015 | GATCTGAGTATGGGCGGTAT<br>GGACGTC<br><br>SEQ ID NO:24027 |
| | | AA | SFGMH<br><br>SEQ ID NO:8004 | IIWHSGSNKYYADAVKG<br><br>SEQ ID NO:16016 | DLSMGGMDV<br><br>SEQ ID NO:24028 |

FIGURE 49
(Continued)

| | | | | | |
|---|---|---|---|---|---|
| iPS:442386 | 21-225_7E11.001.012 | NA | AGCTTTGGCATGCAC<br>SEQ ID NO:8005 | ATTATCTGGCATAGTGG<br>AAGTAATAAATACTATG<br>CAGACTCCGTGAAGGGC<br>SEQ ID NO:16017 | GATCTGAGTATGGGCGGTAT<br>GGACGTC<br>SEQ ID NO:24029 |
| | | AA | SFGMH<br>SEQ ID NO:8006 | IIWHSGSNKYYADSVKG<br>SEQ ID NO:16018 | DLSMGGMDV<br>SEQ ID NO:24030 |
| iPS:442390 | 21-225_7E11.001.013 | NA | AGCTTTGGCATGCAC<br>SEQ ID NO:8007 | ATTATCTGGCATGATGG<br>AAGTAATAAATACTATG<br>CAGAATCCGTGAAGGGC<br>SEQ ID NO:16019 | GATCTGAGTATGGGCGGTAT<br>GGACGTC<br>SEQ ID NO:24031 |
| | | AA | SFGMH<br>SEQ ID NO:8008 | IIWHDGSNKYYAESVKG<br>SEQ ID NO:16020 | DLSMGGMDV<br>SEQ ID NO:24032 |
| iPS:442394 | 21-225_7E11.001.014 | NA | AGCTTTGGCATGCAC<br>SEQ ID NO:8009 | ATTATCTGGCATAGTGG<br>AAGTAATAAATACTATG<br>CAGACTCCGTGAAGGGC<br>SEQ ID NO:16021 | GATCTGAGTATGGGCGGTAT<br>GGACGTC<br>SEQ ID NO:24033 |
| | | AA | SFGMH<br>SEQ ID NO:8010 | IIWHSGSNKYYAESVKG<br>SEQ ID NO:16022 | DLSMGGMDV<br>SEQ ID NO:24034 |
| iPS:442398 | 21-225_7E11.001.015 | NA | AGCTTTGGCATGCAC<br>SEQ ID NO:8011 | ATTATCTGGCATAGTGG<br>AAGTAATAAATACTATG<br>CAGACTCCGTGAAGGGC<br>SEQ ID NO:16023 | GATCTGAGTATGGGCGGTAT<br>GGACGTC<br>SEQ ID NO:24035 |
| | | AA | SFGMH<br>SEQ ID NO:8012 | IIWHSGSNKYYADSVKG<br>SEQ ID NO:16024 | DLSMGGMDV<br>SEQ ID NO:24036 |

FIGURE 49
(Continued)

| | | | | |
|---|---|---|---|---|
| iPS:442402 | 21-225_7E11.001.016 | NA | AGCTTTGGCATGCAC | ATTATCTGGCATAGTGG AAGTAATAAATACTATG CAGAATCCGTGAAGGGC | GATCTGAGTATGGGCGGTAT GGACGTC |
| | | | SEQ ID NO:8013 | SEQ ID NO:16025 | SEQ ID NO:24037 |
| | | AA | SFGMH | IIWHSGSNKYYAESVKG | DLSMGGMDV |
| | | | SEQ ID NO:8014 | SEQ ID NO:16026 | SEQ ID NO:24038 |
| iPS:442406 | 21-225_7E11.001.017 | NA | AGCTTTGGCATGCAC | ATTATCTGGCATGAAGG AAGTAATAAATACTATG CAGACGCCGTGAAGGGC | GATCTGAGTATGGGCGGTAT GGACGTC |
| | | | SEQ ID NO:8015 | SEQ ID NO:16027 | SEQ ID NO:24039 |
| | | AA | SFGMH | IIWHEGSNKYYADAVKG | DLSMGGMDV |
| | | | SEQ ID NO:8016 | SEQ ID NO:16028 | SEQ ID NO:24040 |
| iPS:442410 | 21-225_7E11.001.018 | NA | AGCTTTGGCATGCAC | ATTATCTGGCATGATGCA AGTAATAAATACTATGC AGAATCCGTGAAGGGC | GATCTGAGTATGGGCGGTAT GGACGTC |
| | | | SEQ ID NO:8017 | SEQ ID NO:16029 | SEQ ID NO:24041 |
| | | AA | SFGMH | IIWHDASNKYYAESVKG | DLSMGGMDV |
| | | | SEQ ID NO:8018 | SEQ ID NO:16030 | SEQ ID NO:24042 |
| iPS:442417 | 21-225_7E11.001.019 | NA | AGCTTTGGCATGCAC | ATTATCTGGCATGATGG AAGTAATAAATACTATG CAGAATCCGTGAAGGGC | GATCTGAGTATGGGCGGTAT GGACGTC |
| | | | SEQ ID NO:8019 | SEQ ID NO:16031 | SEQ ID NO:24043 |
| | | AA | SFGMH | IIWHDGSNKYYAESVKG | DLSMGGMDV |
| | | | SEQ ID NO:8020 | SEQ ID NO:16032 | SEQ ID NO:24044 |

FIGURE 49
(Continued)

| ID | sub-ID | NA/AA | Seq 1 | Seq 2 | Seq 3 |
|---|---|---|---|---|---|
| iPS:442431 | 21-225_7E11.001.021 | NA | AGCTTTGGCATGCAC | ATTATCTGGCATAGTGG AAGTAATAAATACTATG CAGAATCCGTGAAGGGC | GATCTGAGTATGGGCGGTAT GGACGTC |
| | | | SEQ ID NO:8021 | SEQ ID NO:16033 | SEQ ID NO:24045 |
| | | AA | SFGMH | IIWHSGSNKYYAESVKG | DLSMGGMDV |
| | | | SEQ ID NO:8022 | SEQ ID NO:16034 | SEQ ID NO:24046 |
| iPS:442438 | 21-225_7E11.001.022 | NA | AGCTTTGGCATGCAC | ATTATCTGGCATGAAGG AAGTAATAAATACTATG CAGAATCCGTGAAGGGC | GATCTGAGTATGGGCGGTAT GGACGTC |
| | | | SEQ ID NO:8023 | SEQ ID NO:16035 | SEQ ID NO:24047 |
| | | AA | SFGMH | IIWHEGSNKYYAESVKG | DLSMGGMDV |
| | | | SEQ ID NO:8024 | SEQ ID NO:16036 | SEQ ID NO:24048 |
| iPS:442568 | 21-225_149D8 | NA | AACAGTGGTTACTACTGGAGC | TACAGCTATTACAGTGG GAGCACCTACTACAACC CGTCCCTCAAGAGT | GGGGGATATAACTGGAACCA TGCTTTTGATATC |
| | | | SEQ ID NO:8025 | SEQ ID NO:16037 | SEQ ID NO:24049 |
| | | AA | NSGYYWS | YSYYSGSTYYNPSLKS | GGYNWNHAFDI |
| | | | SEQ ID NO:8026 | SEQ ID NO:16038 | SEQ ID NO:24050 |
| iPS:443003 | 21-225_43F11_LC2 | NA | GGCTACTATATACAC | TGGATCAACCCTAACAG TGGTGGCACAAACTATG CACAGAAGTTTCAGGGC | GGAGGGAATTACTTCTACAA CCACGTTATGGACGTC |
| | | | SEQ ID NO:8027 | SEQ ID NO:16039 | SEQ ID NO:24051 |
| | | AA | GYYIH | WINPNSGGTNYAQKFQG | GGNYFYNHVMDV |
| | | | SEQ ID NO:8028 | SEQ ID NO:16040 | SEQ ID NO:24052 |
| iPS:443005 | 21-225_43F11_LC1 | NA | GGCTACTATATACAC | TGGATCAACCCTAACAG TGGTGGCACAAACTATG CACAGAAGTTTCAGGGC | GGAGGGAATTACTTCTACAA CCACGTTATGGACGTC |
| | | | SEQ ID NO:8029 | SEQ ID NO:16041 | SEQ ID NO:24053 |

FIGURE 49
(Continued)

| | | AA | GYYIH | | WINPNSGGTNYAQKFQG | GGNYFYNHVMDV |
|---|---|---|---|---|---|---|
| iPS:443006 | | | SEQ ID NO:8030 | | SEQ ID NO:16042 | SEQ ID NO:24054 |
| | 21-225_25A4.001.029 | NA | AATTATGATATTAAT | | TGGATGTACCCTAACAG TGGTCAAACAGGCTATG CACAGAAATTCCAGGGC | AGCAGTGGCTGGTACTACTT TGACTAC |
| | | | SEQ ID NO:8031 | | SEQ ID NO:16043 | SEQ ID NO:24055 |
| | | AA | NYDIN | | WMYPNSGQTGYAQKFQG | SSGWYYFDY |
| | | | SEQ ID NO:8032 | | SEQ ID NO:16044 | SEQ ID NO:24056 |
| iPS:443016 | 21-225_4H6.014 | NA | GACTACTATTGCAC | | TGGATCCACCCTAACAG TGGTGGCACAAACTATG CACAGAAGTTTCAGGGC | GATGCTACCAGCTCGTTTGA CTAC |
| | | | SEQ ID NO:8033 | | SEQ ID NO:16045 | SEQ ID NO:24057 |
| | | AA | DYYLH | | WIHPNSGGTNYAQKFQG | DATSSFDY |
| | | | SEQ ID NO:8034 | | SEQ ID NO:16046 | SEQ ID NO:24058 |
| iPS:443027 | 21-225_7E11.001.023 | NA | AGCTTTGGCATGCAC | | ATTATCTGGCATGATGCA AGTAATAAATACTATGC AGACGCCGTGAAGGGC | GATCTGAGTATGGGCGGTAT GGACGTC |
| | | | SEQ ID NO:8035 | | SEQ ID NO:16047 | SEQ ID NO:24059 |
| | | AA | SFGMH | | IIWHDASNKYYADAVKG | DLSMGGMDV |
| | | | SEQ ID NO:8036 | | SEQ ID NO:16048 | SEQ ID NO:24060 |
| iPS:446086 | 21-225_94D8 | NA | AATTATGATATCAAC | | TGGATGAACCCTAACAG TGGTAACACAGGCTATG CACAGAAGTTCCAGGTC | AGCAGTGGCTGGTACATCTT TGACTAC |
| | | | SEQ ID NO:8037 | | SEQ ID NO:16049 | SEQ ID NO:24061 |
| | | AA | NYDIN | | WMNPNSGNTGYAQKFQV | SSGWYIFDY |

FIGURE 49
(Continued)

| | | | SEQ ID NO:8038 AATTATGATATCAAC | SEQ ID NO:16050 TGGATGAACCCTAACAG TGGTAACACAGGCTATG CACAGAAGTTCCAGGGC | SEQ ID NO:24062 TCCAGTGGCTGGCACTGGTT CGACCCC |
|---|---|---|---|---|---|
| iPS:446094 | 21-225_77E1 | NA | | SEQ ID NO:16051 WMNPNSGNTGYAQKFQG | SEQ ID NO:24063 SSGWHWFDP |
| | | AA | SEQ ID NO:8039 NYDIN | | |
| | | NA | SEQ ID NO:8040 | SEQ ID NO:16052 | SEQ ID NO:24064 GATGCGTATAGCCACTAC |
| iPS:448904 | 21-225_65C12 | | AGCTTTAGCTTGAAC | TCCATTAGTAGTAGTAGT AGTTACATATACTACGC AGACTCAGTGAAGGGC | |
| | | AA | SEQ ID NO:8041 SFSLN | SEQ ID NO:16053 SISGSSSYIYYADSVKG | SEQ ID NO:24065 DAYSHY |
| | | NA | SEQ ID NO:8042 AGTTATAGCATGAAC | SEQ ID NO:16054 TCCATTAGTGGTAGTAGT AGTTACATATACTACGC AGACTCAGTGAAGGGC | SEQ ID NO:24066 GGGGGTTCGAGGGGGTTCGA CCCC |
| iPS:448906 | 21-225_72G9 | AA | SEQ ID NO:8043 SYSMN | SEQ ID NO:16055 SISGSSSYIYYADSVKG | SEQ ID NO:24067 GGSRGFDP |
| | | NA | SEQ ID NO:8044 AGCTATGGCATGCAC | SEQ ID NO:16056 GTTATATCACAAGATGG AATTATTAGATACTATGC AGACTCCGTGAAGGGC | SEQ ID NO:24068 GATGTGAAGCAGTGGCTGGT ACGGACCTACGGTATGGACG TC |
| iPS:448908 | 21-225_50G9 | AA | SEQ ID NO:8045 SYGMH | SEQ ID NO:16057 VISQDGIIRYYADSVKG | SEQ ID NO:24069 DVKQWLVRTYGMDV |
| iPS:451102 | 21_225_45F6 | NA | SEQ ID NO:8046 TACTATGGCTTGCAC | SEQ ID NO:16058 GTTATATCATATGATGGA AGTAATAAATATTATGC AGACTCCGTGAAGGGC | SEQ ID NO:24070 GAGGATCGATATTGTAGTGG TACCAGTGCCCCTACTACT ACTACTACGGTATGGACGTC |

FIGURE 49
(Continued)

| | | | | | | | |
|---|---|---|---|---|---|---|---|
| iPS:451104 | 21-225_45F6 | AA | SEQ ID NO:8047<br>YYGLH | SEQ ID NO:16059<br>VISYDGSNKYYADSVKG | SEQ ID NO:24071<br>EDRYCSGTSCPYYYYGMDV | | |
| | | NA | SEQ ID NO:8048<br>AGCTATGGTATCAGC | SEQ ID NO:16060<br>TGGATCAGCGCTTATAATGGTAACACAAAGTATGCACAGAAGCTCCAGGGC | SEQ ID NO:24072<br>CACGATTTTTGGAGTGGTTATTATAAGGGTATGGACGTC | | |
| iPS:451106 | 21-225_49C5 | AA | SEQ ID NO:8049<br>SYGIS | SEQ ID NO:16061<br>WISAYNGNTKYAQKLQG | SEQ ID NO:24073<br>HDFWSGYYKGMDV | | |
| | | NA | SEQ ID NO:8050<br>AGCTATGGTATCAGC | SEQ ID NO:16062<br>TGGATCAGCGCTTATAATGGTAACACAAAGAATGCACAGAAGCTCCAGGGC | SEQ ID NO:24074<br>CACGATTTTTGGAGTGGTTATTATAAGGGTATGGACGTC | | |
| | 21-225_49D10 | AA | SEQ ID NO:8051<br>SYGIS | SEQ ID NO:16063<br>WISAYNGNTKNAQKLQG | SEQ ID NO:24075<br>HDFWSGYYKGMDV | | |
| | | NA | SEQ ID NO:8052<br>AGCTATGGTATCAGC | SEQ ID NO:16064<br>TGGATCAGCGCTTATAATGGTAACACAAAGTTTGCACAGAAGCTCCAGGGC | SEQ ID NO:24076<br>CACGATTTTTGGAGTGGTTATTATAAGGGTATGGACGTC | | |
| iPS:451108 | 21-225_53E8 | AA | SEQ ID NO:8053<br>SYGIS | SEQ ID NO:16065<br>WISAYNGNTKFAQKLQG | SEQ ID NO:24077<br>HDFWSGYYKGMDV | | |
| | | | SEQ ID NO:8054 | SEQ ID NO:16066 | SEQ ID NO:24078 | | |

FIGURE 49
(Continued)

| iPS:451110 | 21-225_74C9 | NA | AGCTATGGCATGCAC SEQ ID NO:8055 | GTTATATGGTATGATGG AATAATAAATCCTATG CAGACTCCGTGAAGGGC SEQ ID NO:16067 | GATCGAGATTATTGTAGTAG TACCAGCTGCCCTTATTA CTACTACGGTATGGACGTC SEQ ID NO:24079 |
| --- | --- | --- | --- | --- | --- |
| | | AA | SYGMH SEQ ID NO:8056 | VIWYDGNNKSYADSVKG SEQ ID NO:16068 | DRDYCSSTSCPYYYYGMDV SEQ ID NO:24080 |
| iPS:451112 | 21-225_53D10 | NA | GGCTACTATATACAC SEQ ID NO:8057 | TGGATCAACCCTAACAG TGGTGGCACAAAACTATG CACAGAAGTTTCAGGGC SEQ ID NO:16069 | GAAAACGAAAGTCTAGCAAC TCGTCCTTCTACGACTACTA CGGTATGGACGTC SEQ ID NO:24081 |
| | | AA | GYYIH SEQ ID NO:8058 | WINPNSGGTNYAQKFQG SEQ ID NO:16070 | ENESLATRPFYDYYGMDV SEQ ID NO:24082 |
| iPS:451114 | 21-225_159A3 | NA | GACTATGTCATGCAG SEQ ID NO:8059 | GTTATATGGTATGATGG AAGTAATAAATACTATG CAGACTCCGTGAAGGGC SEQ ID NO:16071 | GAACCGTATAATAGTGGCTG GTACGACTACGGTATGGACG TC SEQ ID NO:24083 |
| | | AA | DYVMQ SEQ ID NO:8060 | VIWYDGSNKYYADSVKG SEQ ID NO:16072 | EPYNSGWYDYGMDV SEQ ID NO:24084 |
| iPS:451116 | 21-225_164A4 | NA | AATTATGATATCAAC SEQ ID NO:8061 | TGGATGCACCCTAACAG TGGTAACACAGGCTATG CACAGAAGTTCCAGGGC SEQ ID NO:16073 | AGCAGTGGCTGGTACTTCTT TGACTAC SEQ ID NO:24085 |
| | | AA | NYDIN SEQ ID NO:8062 | WMHPNSGNTGYAQKFQG SEQ ID NO:16074 | SSGWYFFDY SEQ ID NO:24086 |

FIGURE 49
(Continued)

| | | | | | |
|---|---|---|---|---|---|
| iPS:451118 | 21-225_191C8 | NA | AGTGGTGGTTACTACTGGAG C | TATATCTATTACAGTGGG ACCACCATTTACAACCCC TCCCTCAAGAGT | GACACGTTTGCTTTGATGG TTGTGGTTATTTCTTTGACTC C |
| | | | SEQ ID NO:8063 | SEQ ID NO:16075 | SEQ ID NO:24087 |
| | | AA | SGGGYYWS | YIYYSGTTIYNPSLKS | DTFCFDGCGYFFDS |
| | | | SEQ ID NO:8064 | SEQ ID NO:16076 | SEQ ID NO:24088 |
| iPS:451120 | 21-225_197D3 | NA | AGCCATGGCATGCAC | GTTATATGGTATGATGG AAGTAATGAACACTATG CAGACTCCGTGAAGGGC | GATCAAGGTGTGGGGTACTA CGGTATGGACGTC |
| | | | SEQ ID NO:8065 | SEQ ID NO:16077 | SEQ ID NO:24089 |
| | | AA | SHGMH | VIWYDGSNEHYADSVKG | DQGVGYYGMDV |
| | | | SEQ ID NO:8066 | SEQ ID NO:16078 | SEQ ID NO:24090 |
| iPS:451122 | 21-225_200A1 | NA | GTTTACTATTGGAGC | GAAATCAATCATAGTGG AAGCACCAACTACAACC CGTCCCTCAAGAGT | GACTACGGTGTCTTTGACTA C |
| | | | SEQ ID NO:8067 | SEQ ID NO:16079 | SEQ ID NO:24091 |
| | | AA | VYYWS | EINHSGSTNYNPSLKS | DYGVFDY |
| | | | SEQ ID NO:8068 | SEQ ID NO:16080 | SEQ ID NO:24092 |
| iPS:451124 | 21-225_74F6 | NA | AATTATGATATCAAC | TGGATGCACCCTAACAG TGGTAACACAGGCTATG CACAGAAGTTCCAGGGC | AGCAGTGGCTGGTACTTTTT TGACTAC |
| | | | SEQ ID NO:8069 | SEQ ID NO:16081 | SEQ ID NO:24093 |
| | | AA | NYDIN | WMHPNSGNTGYAQKFQG | SSGWYFFDY |
| | | | SEQ ID NO:8070 | SEQ ID NO:16082 | SEQ ID NO:24094 |
| iPS:451127 | | NA | AATTATGATGTCAAC | TGGATGCACCCTAACAG TGGTAACACAGGCTATG CACAGAAGTTCCAGGGC | AGCAGTGGCTGGTACCTCTT TGACTAC |

FIGURE 49
(Continued)

| | | | | | |
|---|---|---|---|---|---|
| iPS:451129 | 21-225_164A7 | AA | SEQ ID NO:8071<br>NYDVN | SEQ ID NO:16083<br>WMHPNSGNTGYAQKFQG | SEQ ID NO:24095<br>SSGWYLFDY |
| | | NA | SEQ ID NO:8072<br>AATTATGATATCAAC | SEQ ID NO:16084<br>TGGATGCACCCTAACAG<br>TGGTAACACAGGCTTTG<br>CACAGAAGTTCCAGGGC | SEQ ID NO:24096<br>TCCAGTGGCTGGTACTGGTT<br>CGACCCC |
| iPS:451131 | 21-225_94D2 | AA | SEQ ID NO:8073<br>NYDIN | SEQ ID NO:16085<br>WMHPNSGNTGFAQKFQG | SEQ ID NO:24097<br>SSGWYWFDP |
| | | NA | SEQ ID NO:8074<br>AATTATGATATCAAC | SEQ ID NO:16086<br>TGGATGCACCCTCACAG<br>TGGTAACACAGGCTATG<br>CACAGAAGTTCCAGGGC | SEQ ID NO:24098<br>AGCAGTGGCTGGTACTACTT<br>TGACTAC |
| iPS:451133 | 21-225_160A7 | AA | SEQ ID NO:8075<br>NYDIN | SEQ ID NO:16087<br>WMHPHSGNTGYAQKFQG | SEQ ID NO:24099<br>SSGWYYFDY |
| | | NA | SEQ ID NO:8076<br>AATTATGATATCAAC | SEQ ID NO:16088<br>TGGATGAACCCTAACAG<br>TGGTAACACAGGCTATG<br>CACAGAAGTTCCAGGGC | SEQ ID NO:24100<br>TCCAGTGGCTGGAACTGGTT<br>CGACCCC |
| iPS:451135 | 21-225_95H4 | AA | SEQ ID NO:8077<br>NYDIN | SEQ ID NO:16089<br>WMNPNSGNTGYAQKFQG | SEQ ID NO:24101<br>SSGWNWFDP |
| | | NA | SEQ ID NO:8078<br>AGTTATGATATCAAC | SEQ ID NO:16090<br>TGGCTGAACCCTCACAG<br>TGGTAACACAGGCTATG<br>CACAGAAGTTCCAGGGC | SEQ ID NO:24102<br>GGGTTTTACGATATTTTGACT<br>GGTTATTCCCCACCTACTA<br>CTACTACGATATGGACGTC |
| iPS:437240 | 21-225_84H12 | | SEQ ID NO:8079 | SEQ ID NO:16091 | SEQ ID NO:24103 |

FIGURE 49
(Continued)

| | | AA | SYDIN | WLNPHSGNTGYAQKFQG | GFYDILTGYSPTYYYDMDV |
|---|---|---|---|---|---|
| iPS:434577 | 21-225_75C11 | | SEQ ID NO:8080 | SEQ ID NO:16092 | SEQ ID NO:24104 |
| | | NA | AGTTATGATATCAAC | TGGCTGAACCCTCACAG TGGTAACACAGGCTATG CACAGAAGTTCCAGGGC | GGGTTTTACGATATTTGACT GGTTATTCCCCACCTACTA CTACTACGATATGGACGTC |
| | | | SEQ ID NO:8081 | SEQ ID NO:16093 | SEQ ID NO:24105 |
| iPS:435477 | 21-225_154E8 | AA | SYDIN | WLNPHSGNTGYAQKFQG | GFYDILTGYSPTYYYDMDV |
| | | | SEQ ID NO:8082 | SEQ ID NO:16094 | SEQ ID NO:24106 |
| | | NA | AGCTATGCCATGAGC | GCTATTAGTGGTAGTGGT GGTAACACATTCTACGC AGACTCCGTGAAGGGC | CACGGTATAGCAGTGGCTGG TACTGGGGCTCACTACTTTG ACTAC |
| | | | SEQ ID NO:8083 | SEQ ID NO:16095 | SEQ ID NO:24107 |
| iPS:434553 | 21-225_76H12 | AA | SYAMS | AISGSGGNTFYADSVKG | HGIAVAGTGAHYFDY |
| | | | SEQ ID NO:8084 | SEQ ID NO:16096 | SEQ ID NO:24108 |
| | | NA | AGTTATGATATCAAC | TGGCTGAACCCTCACAG TGGTAACACAGGCTATG CACAGAAGTTCCAGGGC | GGGTTTTACGATATTTGACT GGTTATTCCCCACCTACTA CTACTACGATATGGACGTC |
| | | | SEQ ID NO:8085 | SEQ ID NO:16097 | SEQ ID NO:24109 |
| iPS:434927 | 21-225_86E5 | AA | SYDIN | WLNPHSGNTGYAQKFQG | GFYDILTGYSPTYYYDMDV |
| | | | SEQ ID NO:8086 | SEQ ID NO:16098 | SEQ ID NO:24110 |
| | | NA | AGTTATGATATCAAC | TGGATGAACCCTAACAG TGGTAACACAGGCTATG CACAGAAGTTCCAGGGC | GGGTTTTACGATATTTGACT GGTTATTCCCCACCTACTA CTACTACGATATGGACGTC |
| | | | SEQ ID NO:8087 | SEQ ID NO:16099 | SEQ ID NO:24111 |

FIGURE 49
(Continued)

| | | AA | SYDIN | WMNPNSGNTGYAQKFQG | GFYDILTGYSPTYYYYDMDV |
|---|---|---|---|---|---|
| iPS:435385 | 21-225_149G7 | | SEQ ID NO:8088 | SEQ ID NO:16100 | SEQ ID NO:24112 |
| | | NA | AGCTATGCCATGAGC | GCTATTAGTGGTAGTGGT GGTAACACATTCTACGC AGACTCCGTGAAGGGC | CACGGTATAGCAGTGGCTGG TACTGGGGCTCACTACTTTG ACTAC |
| | | | SEQ ID NO:8089 | SEQ ID NO:16101 | SEQ ID NO:24113 |
| | | AA | SYAMS | AISGSGGNTFYADSVKG | HGIAVAGTGAHYFDY |
| | | | SEQ ID NO:8090 | SEQ ID NO:16102 | SEQ ID NO:24114 |

FIGURE 50

Table 3
Standard IgG Antibody Variable Region Sequences

| IPS# | Ab | Type | LC V-region | HC V-region |
|---|---|---|---|---|
| iPS:451135 | 21-225_64A11 | NA | GACATCCAGATGACCCAGTCTCCATTCTCCCT GTCTGCATCTGTAGGCGACAGAGTCACCATCA CTTGCCGGGCAAGTCGGAGCGTTAGCAGATAT TTAAATTGGTATCAGCAGAAACACTGGGGAAAGC CCTTAAGCTCTTGATATCTGTTGCATCCCGTTT GCAAAGTGGGGTCCCATCGAGGTTCAGTGGCA GTGGATCTGGGACAGATTTCACTCTCACCATC AGCAGTGTGCAACGTGAAGATTTTGCAACTTA CTTCTGTCAACAGAGTAGTGACAGTTTCCCTCTCAC TTTCGGCGGAGGGACCAAGGTGGAGATCAAA<br><br>SEQ ID NO: 24115 | CAGGTGCAGCTGGTGGAGTCTGGGGGAGGCGTG GTCCAGCCTGGGAGGTCCCTGAGACTCTCTGTG CAGCCTCTGGATTCACCTTCAGTAACTATGGCAT GCACTGGGTCCGCCAGGCTCCAGGCAAGGGCT GGAGTGGGTGGCAGTTATATCATATGTTGGAAGT AATAAATACTATGCAGACTCCGTGAAGGGCCGA TTCACCATCTCCAGAGACAATTCCAAGAACACGC TGTATCTGCAAATGAACACCCTGAGAGCTGAGG ACACGGCTGTGTATTACTGTGCGAGGAGGAG CAGTGGCTCCGTACTACGGTATGGACGTCTGGGG CCAAGGGACCACGGTCACCGTCTCCTCA<br><br>SEQ ID NO: 28121 |
| | | AA | DIQMTQSPFSLSASVGDRVTITCRASRSVSRYLN WYQQILGKALKLLISVASRLQSGVPSRFSGSGSG TDFTLTISSVQREDFATYFCQQSDSFPLTFGGGTK VEIK<br><br>SEQ ID NO: 24116 | QVQLVESGGGVVQPGRSLRLSCAASGFTFSNYGM HWVRQAPGKGLEWVAVISYVGSNKYYADSVKGR FTISRDNSKNTLYLQMNTLRAEDTAVYYCARRGAV APYYGMDVWGQGTTVTVSS<br><br>SEQ ID NO: 28122 |

FIGURE 50
(Continued)

| | | | |
|---|---|---|---|
| iPS:451141 | 21-225_164B11 | NA | GACATCGTGATGACCCAGTCTCCAGACTCCCT GGCTGTGTCTCTGGGCGAGAGGGCCACCATCA ACTGCAAGTCCAGCCAGAGTCTTTAAAGAGC TCCAACAATAAGCCAGGACTCTTCGTACCA GCAGAAGCCAGGACAGCCTCCTAAACTGCTCA TTTACTGGGCATCTTCCCGGGAATCCGGGGTC CCTGACCGATTCAGTGGCAGCGGGTCTGGGAC AGATTTCACTCTCACCATCAGCAGCCTGCAGG CTGAAGATGTGGCACTTTATTACTGTCAGCAA TATTATAGTATTCCTCCCACTTTCGGCCATGGG ACCAATGTGGATATCACG<br>SEQ ID NO: 24117 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGACCCTAACAGTGG TAACACAGGCTATGCACAGAAGTTCCAGGGCAG AGTCACCATGACCAGGAACACTTCCATGAGCACC GCCTACATGGAGCTGAGCAGCCTGAGATCTGAG GACTCGGCCGTGTATTACTGTGTTCCTATAGCAGTG GCTGGTACATGTTTGACTACTGGGGCCAGGGAAC CCTGGTCACCGTCTCCTCA<br>SEQ ID NO: 28123 |
| | | AA | DIVMTQSPDSLAVSLGERATINCKSSQSLLKSSN NKSYLASYQQKPGQLPKLLIYWASSRESGVPDR FSGSGSGTDFTLTISSLQAEDVALYYCQQYYSIPP TFGHGTNVDIT<br>SEQ ID NO: 24118 | QVQLVQSGAEVKKPGASVKVSCKASGYTFTNYDIN WVRQATGQGLEWMGWMTPNSGNTGYAQKFQGR VTMTRNTSMSTAYMELSSLRSEDSAVYYCVSYSSG WYMFDYWGQGTLVTVSS<br>SEQ ID NO: 28124 |
| iPS:451137 | 21-225_74A7 | NA | GACATCGTTATGACCCAGTCTCCAGACTCCCT GGCTGTGTCTCTGGGCGAGAGGGCCACCATCA ACTGCAAGTCCAGCCAGAGTGTTTATTCAGC TCCAACAATATAACTACTTAGCTTGGTACCA GCAGAAGACCAGGACAGCCTCCTAAACTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGCTGATGTGGCAGTTTATTACTGTCAGCAA TATCATAGTTCTCCTCGACGTTCGGCCAAGG GACCACGGTGCAAATCAAA<br>SEQ ID NO: 24119 | CAGGTGCAGTTGGTGCAGTCTGGGGCTGAGGTGA AGAAGCCTGGGGCCTCAGTGAAGGTCTCCTGCA AGGCTTCTGGATACACCTTCACCAATTATGATAT CAACTGGGTGCGACAGGCCACTGGACAAGGGCT TGAGTGGGTGGATGGGATGAACCCTAACAGTGG TAACACAGGCTATGCACAGAAGTTCCAGGGCAG AGCCCACATGGAGCTGAGCAGCCTGAGATCTGA GGACACGGCCGTGTATTACTGTGCGGGTCTCCAGT GGCTGGAACTGGTTCGACCCCTGGGGCCAGGGA ACCCTGGTCACCGTCTCCTCA<br>SEQ ID NO: 28125 |

FIGURE 50
(Continued)

| | | | | |
|---|---|---|---|---|
| iPS:451139 | 21-225_71A6 | AA | DIVMTQSPDSLAVSLGERATINCKSSQSVLFSSN NYNYLAWYQQRPGQPPNLLIYWASTRESGVPD RFSGSGSGTDFTLTISSLQAADVAVYYCQQYHSS PPTFGQGTTVQIK<br>SEQ ID NO: 24120 | QVQLVQSGAEVKKPGASVKVSCKASGYTFTNYDIN WVRQATGQGLEWMGWMNPNSGNTGYAQKFQGR VTMTRNTSTAHMELSSLRSEDTAVYYCAVSSGW NWFDPWGQGTLVTVSS<br>SEQ ID NO: 28126 |
| | | NA | GATATTGTGATGACCCAGACTCCACTCTCTCTC TCTGTCACACCTGGACAGCCGGCCTCCATCTC CTGCAAGTCTAGTCAGAGCCTCCTGCGTAGTG ATGGAAAGACCCATTTGTATTGGTACCTGCAG AAGCCAGGCCAGCCTCCACAGCTCTTAATCTA TGAAGTTTCCAACCGGTTCTCTGGAGTGTCAG ATAGGTTCAGTGGCAGCGGGTCAGGGACAGA TTTCACACTGAAAATCAGCGGGTGGAGGCTG AGGATGTTGGGGTTTATTACTGCATGCAAAGT AAACAGCTTCCTCTCACTTTCGGCGGAGGGAC CAAGGTGGAGTTCAAA<br>SEQ ID NO: 24121 | CAGGTGCAACTGGTGCAGTCTGGGGGAGGCGTG GTCCAGCCTGGGAGGTCCCTGAGACTCTCCTGTG CAGCCTCTGGATTCACCTTCAGTAACTATGGCAT GCACTGGGTCCGCCAGGCTCCAGGCAAGGGGCT GGAGTGGGTGGCAGTTATATCATATGATGAAGT AATGAATACTATGCAGACTCCGTGAAGGGCCGA TTCACCATCTCCAGAGACAATTCCAAGAACACGC TGTATCTGCAAATGAACAGCTGAGAGCTGAGG ACACGGCTGTGTATTACTGTGCGAGAGATCACAG ATATGGGGTTCGGGAGGCTTTGACTACTGGGGC CAGGGAACCCTGGTCACCGTCTCCTCA<br>SEQ ID NO: 28127 |
| | | AA | DIVMTQTPLSLSVTPGQPASISCKSSQSLLRSDGK THLYWYLQKPGQPPQLLIYEVSNRFSGVSDRFSG SGSGTDFTLKISRVEAEDVGVYYCMQSKQLPLT FGGGTKVEFK<br>SEQ ID NO: 24122 | QVQLVESGGGVVQPGRSLRLSCAASGFTFSNYGM HWVRQAPGKGLEWVAVISYDGSNEYYADSVKGRF TISRDNSKNTLYLQMNSLRAEDTAVYYCARDHRY GVRGGFFDYWGQGTLVTVSS<br>SEQ ID NO: 28128 |

FIGURE 50
(Continued)

| | | | |
|---|---|---|---|
| iPS:451143 | 21-225_66H11 | NA | GACATCCAGATGACCCAGTTTCCATCCTCACTGTTTGCATTTGTAGGAGACAGAGTCACCATCACTTGTCCGGCGAGTCAGGGCATTAGCAATTCATTAGCTTGGTTTCAGCAGAAACCAGGAAAGCCCCTAAGTCCCTTATTTATGGTGCATTCAATTTGCACAGTGGGGTCCATCAAAGTTCAGCGGCAGTGGGATTTGGGACAGATTTCACTCTCACCATCAACAGCCTGCAGCCTGAAGATATTGCAAATTATTACTGCCAACACTATAGTTGTTACCCATTCACTTTCGGCCATGGGACCAAAGTGGATATCAAA | CAGGTTCAGCTGGTCCAGTCTGGAGCTGAGGTGAAGAAGCCTGGGGCCTCAGTGAAGGTCTCCTGCAAGGCTTCTGGTTACACCTTTGCCACCTATGGTATCAGCTGGGTGCGACAGGCCCCTGGACAGGGCTTGAGTGGATGGATGGATCAGCGCTTACAATGGTAACACAAACTATGCACAGAAGTCCAGGGCAGAGTCACCATGACCACAGACACATCCACGAGCACAGCCTACATGGAGCTGAGGAGCCTGAGATCTGACGACACGGCCGTGTATTACTGTGCGAGAGGGAAGCAGTGGCTGTCTCGACCCCTGGGGCCAGGGAACCCTGGTCACCGTCTCCTCA |
| | | | SEQ ID NO: 28129 |
| | | SEQ ID NO: 24123 | |
| | | AA | DIQMTQFPSSLFAFVGDRVTITCPASQGISNYLAWFQQKPGKAPKSLIYGAFNLHSGVPSKFSGSGFGTDFTLTINSLQPEDFANYYCQQYSCYPFTFGHGTKVDIK | QVQLVQSGAEVKKPGASVKVSCKASGYTFATYGISWVRQAPGQGLEWMGWISAYNGNTNYAQKLQGRVTMTDTSTSTAYMELRSLRSDDTAVYYCARGEAVAVFDPWGQGTLVTVSS |
| | | | SEQ ID NO: 28130 |
| | | SEQ ID NO: 24124 | |
| iPS:453445 | 21-225_148E10 | NA | TCCTATGAGCTGACTCAGCCACCTCAGTGTCCGTGTCCCAGGACAGAGCAGCATCACCTGCTCTGGAGATAAATTGGGTAATAAATATGTTTGTTGGTATCAGCAGAAGCCAGGCCATGCTGCTGTGCTGATCATCTATCAAGATAGCAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTTCTGTCAGGCGTGGGACAGGAACACTGTATGTGGTGTTCGGCGGAGGGACCAAGCTGACCGTCCTA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGTTGATGGAAGTAATAAATACTATGTAGACTCCGTGAAGGACCGATTCACCATCTCCAGAGACAATTCCAAGAACACGCTGTATCTGCAAATGAACAGCCTGAGAGCCGAGGACACGGCTGTTTATTACTGTGCGAGAGATGGGGTGGAGGGTTCGGGGACTCCTACTACTACGGTATGGACGTCTGGGGCCAAGGGACCACGGTCACCGTCTCCTCA |
| | | | SEQ ID NO: 28131 |
| | | SEQ ID NO: 24125 | |

FIGURE 50
(Continued)

| | | AA | SYELTQPPSVSVSPGQTASITCSGDKLGNKYVCW YQQRPGHAAVLIIYQDSKRPSGIPERFSGSNSGNT ATLTISGTQAMDEADYFCQAWDRNTYVFGGG TKLTVL | QVQLVESGGGVVQPGRSLRLSCAASGFTFSSYGMH WVRQAPGKGLEWVAVIWFDGSNKYYVDSVKDRF TISRDNSKNTLYLQMNSLRAEDTAVYYCARDRVEG SGTPYYYGMDVWGQGTTVTSS |
| | | | SEQ ID NO: 24126 | SEQ ID NO: 28132 |
| | | NA | GACATCCAGATGACCCAGTCTCCATCTTCCGT GTCTGCATCTGTAGGAGACAGAGTCACCATCA CTTGTCGGGGGGTCAGGGTATTAGCACATGG TTAGCATGGTATCAGCAGAAACCAGGGAAAG CCCCTAAGCTCCTGATCTATGCTGATCCATTT TGCAAAGTGGGGTCCCATCAAGGTTCAGAGGC AGGGGATCTGGGACAGATTTCACTCTCACCAT CAGCAGCCTGCAGCTGAAGATTTTGCAACTT ATTATTGTCAACAGGGTAACATTTTCCCATTCA CTTTCGGCCGAGGGACCAAAGTGGATATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACCATA TGCACTGGGTGCGACAGGCCCCTGGACAAGGGC TTGAGTGGATGGGATGGATCAACCCTAACAATGG TGGCACAAGCTATGCACAGAAGTTTCAGGACAG GGTCAACATGACCAGGGACACGTCCATCAGCAC AGCCTACATGGAGCTGAGCAGGCTGAGATCTGA CGACACGGCCGTGTACTACTGTGCGAGAGATAGT AGGTCGTCCTGGGACTACTGGGGCCAGGGAACC CTGGTCACCGTCCTCA |
| | | | SEQ ID NO: 24127 | SEQ ID NO: 28133 |
| iPS:453447 | 21-225_65F10 | AA | DIQMTQSPSSVSASVGDRVTITCRGGQISTWLA WYQQKPGKAPKLLIYAASILQSGVPSRFRGRGS GTDFTLTISSLQPEDFATYYCQQGNIFPFTFGRGT KVDIK | QVQLVQSGAEVKKPGASVKVSCKASGYTFTGYHM HWVRQAPGQGLEWMGWINPNNGGTSYAQKFQDR VNMTRDTSISTAYMELSRLRSDDTAVYYCARDSRS SWDYWGQGTLVTVSS |
| | | | SEQ ID NO: 24128 | SEQ ID NO: 28134 |

FIGURE 50
(Continued)

| | | | | |
|---|---|---|---|---|
| iPS:453449 | 21-225_208A2 | NA | GACATCCAGATGACCCAGTCTCCATCCTCCCT GTCTGCATCTGTAGGAGACAGAGTCACCATCA CTTGCCGGACAAGTCAGGCATTAGAAATGAT TTAGGCTGGTATCAGCAGCAACCAGGGAAAA CCCCTAAGCGCCTGATCTATGCTGCATCCAGT TTGCTTAGTGGGGGTCCATCAAGGTTCAGCGG CAGTAGATCTGGGACAGATTTCACTCTCACAA TCAGCAGCCTGCAGCCTGAAGATTTTGCAACT TATTACTGTCTACAGTATAATAGTTACCCTCCC ACCTTCGGCCAAGGGACACGACTGGAGATTAA A | CAGGTGCAGCTGCAGGAGTCGGGCCCAGGACTG GTGAAGCCTTCGGAGACCCTGTCCCTCAACTGCA CTGTCTCTGGTTGGCTCCATCAGGAGTTACTACTG GAGTGGATCCGGCAGCCCGCGGAAGGGACT GGAGTGGATTGGGCGTATCTATACCAGTGGAGC ACCGACTACAACCCTCCCTCAAGAGTCGAATCA CCATGTCAGTAGACACGTCCAAGAACCAGTTCTC TTTGAAGCTGAGCTCTGTGACCGCCGCGGACACG GCCGTGTATTACTGTGCGAGAGGGTTCGGTGACT GGGACTACTGGGGCCAGGGAACCCTGGTCACCG TCTCCTCA |
| | | | SEQ ID NO: 24129 | SEQ ID NO: 28135 |
| | | AA | DIQMTQSPSSLSASVGDRVTITCRTSQGIRNDLG WYQQQPGKTPKRLIYAASSLLSGVPSRFSGSRSG TDFTLTISSLQPEDFATYYCLQYNSYPPTFGQGT RLEIK | QVQLQESGPGLVKPSETLSLNCTVSGGSIRSYYWS WIRQPAGKGLEWIGRIYTSGSTDYNPSLKSRITMSV DTSKNQFSLKLSSVTAADTAVYYCARGFGDWDYW GQGTLVTVSS |
| | | | SEQ ID NO: 24130 | SEQ ID NO: 28136 |
| iPS:453451 | 21-225_52G11 | NA | GACATCCAGATGACCCAGTCTCCATCTCCGT GTCTGCATCTGTAGGAGACAGAGTCACCATCA CTTGTCGGGCGAGTCAGGGTATTAGCAAATGG TTAGCCTGGTATCAGCAGAAACCAGGGAAAG CCCCTAAGCTCCTGATCTATGCTGCATCCAGT TGCAAAGTGGGGTCCATCAAGATTCAGCGCC AGTGGATCTGGGACAGATTTCACTCTCACCAT CAGCAGTTTGCAGCCTGAAGATTTTGCAACTT ACTATTGTCAACAGGCTAACAGTTTCCCATTC ACTTTCGGCCCTGGGACCAAAGTGGATGTCAA A | CAGGTGCAGCTGCAGGTGCAGTCTGGGGCTGAGGTG AAGAAGCCTGGGGCCTCAGTGAAGGTCTCTGC AAGGCTTCTGATACACCTTCACCGGCTACTATT TGCACTGGGTGCGACAGGCCCCTGGACAAGGGC TTGAGTGGATGGGATGGATCAACCCTAATAGAA ATGGCACAAACTATGCACCAGGACACGTCCATCAGA GGGTCACCATGACCAGGGACACGTCCATCAGCA CAGCCTTCATGGAGCTGAGCAGGCTGAGATCTGA CGACACGGCCGTGTATTACTGTGCGAGAGACGGT ACCAGCAGTTTGACTACTGGGGCCAGGGAACC CTGGTCACCGTCTCCTCA |
| | | | SEQ ID NO: 24131 | SEQ ID NO: 28137 |

FIGURE 50
(Continued)

| | | | | |
|---|---|---|---|---|
| iPS-453453 | 21-225_53F2 | AA | DIQMTQSPSSVSASVGDRVTITCRASQGISKWLA WYQQKPGKAPKLLLYAASSLQSGVPSRFSASGS GTDFTLTISSLQPEDFATYYCQQANSFPFTFGPGT KVDVK. SEQ ID NO: 24132 | QVQLVQSGAEVKKPGASVKVSCKASGYTFTGYYL HWVRQAPGQGLEWMGWINPNRNGTNYAQKFQGR VTMTRDTSISTAFMELSRLRSDDTAVYYCARDGTS SFDYWGQGTLVTVSS SEQ ID NO: 28138 |
| | | NA | GACATCCAGATGACCCAGTCTCCATCTTCCGT GTCTGCATCTGTAGGAGACAGAGTCACCATCA CTTGTCGGGCGAGTCAGGGTCATTAGCAAGTGG TTAGCCTGGTATCAGCAGAAACCAGGAAAG CCCCTAACCTCCTTCTCTATGCTGCATCCAGTT TGCAAAGTGGGGTCCCATCAAAATTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATGTCAA A SEQ ID NO: 24133 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATT TGCACTGGGTGCGACAGGCCCCTGGACAAGGGC TTGAGTGGATGGGATGGATCAACCCTAACAGAA ATGGCACAAACTATGCACCAGGACAGACATAGC GGGTCACCATGACCAGGACACGTCCATCAGCA CAGCCTACATGGAGCTGAGCAGGCTGAGATCTG ACGACACGGCCGTGTATTACTGTGCGAGAGACG GTACCAGTAGCTTTGACTACTGGGGCCAGGGAAC CCTGGTCACCGTCTCCTCA SEQ ID NO: 28139 |
| | | AA | DIQMTQSPSSVSASVGDRVTITCRASQGISKWLA WYQQKPGKAPNLLLYAASSLQSGVPSKFSGSGS GTDFTLTISSLQPEDFATYYCQQANSFPFTFGPGT KVDVK. SEQ ID NO: 24134 | QVQLVQSGAEVKKPGASVKVSCKASGYTFTGYYL HWVRQAPGQGLEWMGWINPNRNGTNYAQNFQGR VTMTRDTSISTAYMELSRLKSDDTAVYYCARDGTS SFDYWGQGTLVTVSS SEQ ID NO: 28140 |

FIGURE 50
(Continued)

| | | | | |
|---|---|---|---|---|
| iPS:468810 | 21-225_74D5 | NA | GACATCCAGATGACCCAGTCTCCAGGCACCCT GTCTTTGTCTCCAGGGGAAAGAGCCACCCTCT CCTGCAGGGCCAGTCAGAGTGTTAACAGCAAC TACTTAGCCTGGTACCGGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCATTCTCAT CATCAGCAGACTGGAGCCTGAGGATTTTGCAG TGTATTACTGTCAGCAGTATGAAAGCTCGCCG TGGACGTTCGGCCAAGGGACCAAGGTGGAAA TCAAA<br><br>SEQ ID NO: 24135 | CAGGTGCAGCTACACAACAGTGGGGCGAGGACTG TTGAAGCCTCGGAGACCCTGTCCTCACTTGCG CTGTCAATGGTGGGCCCTTCAGCGGTTGCTACTG GAGCTGGATCCGCCAGCCCCCAGGGAAGGGCT GGAGTGGATTGGGGAAATCAATTATAGTGGAAG GACCAACTTCAACCGTCCCTCAAGAGTGAGTC ACCATATCAGTTGACACGTCCAAGAACCAGTTCT CCCTGAAGCTGAGCTCTGTGACCGCCGCGGACAC GGCTGTGTATTACTGTGCGAGAGACTACGGCGGT ATGGACGTCTGGGGCCAAGGGACCACGGTCACC GTCTCCTCA<br><br>SEQ ID NO: 28141 |
| | | AA | EIVLTQSPGTLSLSPGERATLSCRASQSVNSNYLA WYRQKPGQAPRLLIYGASSRATGIPDRFSGSGSG TDFTLTISRLEPEDFAVYYCQQYESSPWTFGQGTK VEIK<br><br>SEQ ID NO: 24136 | QVQLQQWGAGLLKPSETLSLTCAVNGGPFSGCYW SWIRQPPGKGLEWIGEINYSGRTNFNPSLKSRVTISV DTSKNQFSLKLSSVTAADTAVYYCARDYGGMDV WGQGTTVTVSS<br><br>SEQ ID NO: 28142 |
| iPS:468812 | 21-225_48H4 | NA | GACATCCAGATGACCCAGTTTCCATCTCCCT GTCTGCATCTGTAGGAGACAGAGTCACCATCA CTTGCCGGGCAAGTCAGAGACATTAGAAATGAT CTTAGGCTGGTATCAGCAGAAACCAGGAAAAG CCCCTAAGGCCCTGATCTATGCTGCATCCAGT TTGCAAAGTGGGGTCCCATCAAGGTTCAGCGG CAGTGGATCTGGGACAGACTTCACTCTCACAA TCAGCAGCCTGCAGCCTGAAGATTTTGCAACT TATTACTGTCTACAACATTATAGTTACCCGCTC ACTTTCGGCGGAGGGACCAAGGTGGAGATCA AA<br><br>SEQ ID NO: 24137 | CAGGTGCAGCTGGTGGAGTCTGGGGGAGGCGTG GTCCAGCCTGGGAGGTCCCTGAGACTCTCGTG CAGCGTCTGGATTCACCTTCAGTGACTGACTCTCAT GCACTGGGTCCGCCAGGCTCCAGGCAAGGGGCT GGAGTGGGTGGCAGTTATATGTGTATGATGAAGT AATAAATACTATACAGAGACATCGTTAAGGGCCGAT TCACCATCTCCAAATGAACAGCCTGAGAGCCGAGGA GTATCTGCAAATGAACAGCCTGAGAGCCGAGGA CACGGCTGTGTATTACTGTGCGAGAGAAAACTAT AGCAGTGGCTGGTACGGGTACGTATGGACGTCT GGGGCCAAGGGACCACGGTCACCGTCTCCTCA<br><br>SEQ ID NO: 28143 |

FIGURE 50
(Continued)

| | | | | |
|---|---|---|---|---|
| iPS:468816 | 21-225_52G8 | AA | DIQMTQFPSSLSASVGDRVTITCRASRDIRNDLGWYQQKPGKAPKRLIYAASSLQSGVPSRFSGSGSGTEFTLTISSLQPEDFATYYCLQHYSYPLTFGGGTKVEIK<br>SEQ ID NO: 24138 | QVQLVESGGGVVQPGRSLRLSCAASGFTFSDSLMHWVRQAPGKGLEWVAVIWYDGSNKYTDSVKGRFTISRDNSKNTLYLQMNSLRAEDTAVYYCARENYSSGWYGYGMDVWGQGTTVTVSS<br>SEQ ID NO: 28144 |
| | | NA | GATATTGTGATGACCCAGACTCCACTCTCTCTGTCCGTCACCCCTGGACAGCCGGCCTCCATGTCCTGCAAGTCTAGTCAGAGCCTCCTGCATAGTGAAGGAAAGACCTATTTGTATTGGTACCTGCAGAAGACAGGCCAGCTCCACACCTCCTGATCTATGAAGTTTCCAAGCGGTCTCTGGCGTGCCAGATAGGTTCAGTGGCAGCGGGTCAGGGACAGATTTCACACTGAAATCAGCCGGATGAGGCTGAGGATGTTGGGGTTTATTACTGCATGCAAAGTATGCAGCTTCCGATTATCTTCGGCCAGGGGACACGACTGGAGATTAAA<br>SEQ ID NO: 24139 | CAGGTGCAGCTGGTGGAGTCTGGGGGAGGCGTGGTCCAGCCTGGGAGGTCCCTGAGACTCTCTGTGCAGCGTCTGGATTCACCTTCAGTAGTGATGGCATGCACTGGGTCCGCCAGGCTCCAGGCAAGGGGCTGGAGTGGGTGGCAGTTATATGGTATGATGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTCTGTATTACTGTGCGAGAAGGTATAGCAGCAGCTGGTGGGCGGTATGGACGTCTGGGGCCAAGGGACCACGGTCACCGTCCTCTCA<br>SEQ ID NO: 28145 |
| | | AA | DIVMTQTPLSLSVTPGQPASMSCKSSQSLLHSEGKTYLYWYLQKTGQPPHLLIYEVSKRLSGVPDRFSGSGSGTDFTLKISRMEAEDVGVYYCMQSMQLPIIFGQGTRLEIK<br>SEQ ID NO: 24140 | QVQLVESGGGVVQPGRSLRLSCAASGFTFSSYGMHWVRQAPGKGLEWVAVIWYDGSNKYYADSVKGRFTISRDNSKNTLYLQMNSLRAEDTALYYCARRYSSSWSGGMDVWGQGTTVTVSS<br>SEQ ID NO: 28146 |

FIGURE 50
(Continued)

| | | | |
|---|---|---|---|
| iPS:468814 | 21-225_223D11 | NA | GACATCCAGATGACCCAGTCTCCCTCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTATGCTGCATCCACTTT GCAAAGTGGGGTCCCATCAAAGTTCAGCGGCA GTAGATCTGGGACAGATTTTAATCTCACCATC AGCAACCTGCAGCCTGAAGATTTTGCAACTTA TTACTGCCAACAGTATAGTGGTTACCCATTCA CTTTCGGCCCTGGGACCAAAGTGGATACCAAA | CAGGTGCAGCTGGTGGTGGAGTCTGGGGAGGCGTG GTCCAGCCTGGGAGGTCCCTGAGACTCTCCTGTG CAGCGTCTGGATTCACCTTCAGTAACTATGGCAT GGACTGGGTCCGCCAGGCTCCAGGCAAGGGCT GGAGTGGGTGGCAGTTATATGGTATGGAAGT AATGACTACTATGCAGACTCCGTGAAGGGCCGAT TCACCATCTCCAGAGACAATTCCAAGAACACGCT GTTTCTGCAAATGAACAGCCTGAGAGCCGAGGA CACGGCTGTGTATTACTGTGCGAGAGATCGGGGG ATCGGGTACAACGATATGGACGTCTGGGGCCAA GGGACCACGGTCACCGTCTCCTCA |
| | | | SEQ ID NO: 24141 | SEQ ID NO: 28147 |
| | | AA | DIQMTQSPSSLSASVGDRVTITCRASQGISNYLA WFQQKPGKAPKSLIY AASTLQSGVPSKFSGSRSG TDFNLTISNLQPEDFATYYCQQYSGYPFTFGPGT KVDTK | QVQLVESGGGVVQPGRSLRLSCAASGFTFSNYGM DWVRQAPGKGLEWVAVIWYDGSNDYYADSVKGR FTISRDNSKNTLFLQMNSLRAEDTAVYYCARDRGI GYNDMDVWGQGTTVTVSS |
| | | | SEQ ID NO: 24142 | SEQ ID NO: 28148 |
| iPS:468822 | 21-225_147E10 | NA | GCTATTGTGATGACCCAGACTCCACTCTCTCTG TCCGTCACCCCTGGACAGCCGGCTCCATCTC CTGCAAGTCTAGTCAGAGCCTCCTGCATGGTG ATGGAAAGAACCTATTTGTATTGGTACCTGCAG AAGCCAGGCCAGCCTCCACACCTCCTGATCTC TGAAGTTTCCAACCGGTTCTCTGGAGTGCCAG ATAGGTTCAGTGGCAGCGGGTCAGGGACAGA TTTCACACTGAAAATCAGCGGGTGGAGGCTG AGGATGTTGGGGTTTATTACTGCATGCAAAGT ATACAGGTTCCGTGGACGTTCGGCCAAGGGAC CAAGGTGGAAATCAAA | CAGGTGCAGCTGGTGCAGTCTGGGGGAGGCGTG GTCCAGCCTGGGAAGTCCCTGAGACTCTCCTGTG CTGCGTCTGGATTCACCTTCAGTAACTATGGCTT ACACTGGGTCCGCCAGGCTCCAGGCAAGGGGCT GGAGTGGGTGGCAATTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCATTA CGATTTTTGGAGTGGTCACTTTGACTACTGGGGC CAGGGAACCCTGGTCACCGTCTCCTCA |
| | | | SEQ ID NO: 24143 | SEQ ID NO: 28149 |

FIGURE 50
(Continued)

| | | | | |
|---|---|---|---|---|
| iPS:468824 | | AA | AIVMTQTPLSLSVTPGQPASISCKSSQRLLHGDG KTYLYWYLQKPGQPPHLLISEVSNRFSGVPDRFS GSGSGTDFTLKISRVEAEDVGVYYCMQSIQVPW TFGQGTKVEIK<br>SEQ ID NO: 24144 | QVQLVESGGGVVQPGKSLRLSCAASGFTFSNYGLH WVRQAPGKGLEWVAIIWYDGSNKYYADSVKGRFT ISRDNSKNTLYLQMNSLRAEDTAVYYCARDHYDF WSGHFDYWGQGTLVTVSS<br>SEQ ID NO: 28150 |
| | 21-225_73G6 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCGTCAAGGTTCAGTGG CAGTGGATCTGGGACAGATTCACTCTCACAA TCAGCAGCCTGCAGCCTGAAGATTTTGCAACT TATTACTGTCTACAGCATATAGTTACCCGCTC ACTTTCGGCGGAGGGACCAAGGTGGAGATCA AA<br>SEQ ID NO: 24145 | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGGCAT GCACTGGGTCCGCCAGGCTCCAGGCAAGGGCT GGAGTGGGTGGCAGTTATATGGTATGATGGAAGT AATAAATACTATGGAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCCAGGGAAGTGGG GATGACTTCTGACTACTGGGGCCAGGGAACCCTG GTCACCGTCTCCTCA<br>SEQ ID NO: 28151 |
| | | AA | DIQMTQSPSSLSASVGDRVTITCRASQGIRNDLG WYQQKPGKAPKRLIY AASSLQSGVPSRFSGSGS GTEFFLTISSLQPEDFATYYCLQHNSYPLTFGGG TKVEIK<br>SEQ ID NO: 24146 | QVQLVESGGGVVQPGRSLRLSCAASGFTFSSYGMH WVRQAPGKGLEWVAVIWYDVSNKYYGDSVKGRF TISRDNSKNTLYLQMNSLRAEDTAVYYCAREVGM TSDYWGQGTLVTVSS<br>SEQ ID NO: 28152 |

FIGURE 50
(Continued)

| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGAAACT TATTACTGTCTACAGCATAATGATTACCCGTTC ACTTTCGGCGGAGGGACCAAGGTGGAGATCA AA<br>SEQ ID NO: 24147 | CAGGTGCAGCTGGTGCAGTCTGGGGCTGAGGTG AAGAAGCCTGGGGCCTCAGTGAAGGTCTCCTGC AAGGCTTCTGGATACACCTTCATCAGTTATGATA TCAACTGGGTGCGACAGGCCACTGGACAAGGGC TTGAGTGGATGGGATGGATGAACCCTAAAAGGG GTAACACAGGCTATGCACAGAAGTTCCAGGGCA GAGTCACCATGACCAGGGACACCTCCATAAGCA CAGCCTACATGGAGCTGAGCAGCCTGAGATCTG AGGACACGGCCGTTTATTACTGTGCGAGAGGAG ACCCGTATAACTGGAACTCCTACGCTATGGACGT CTGGGGCCAAGGGACCACGGTCACCGTCTCCTCA<br>SEQ ID NO: 28153 |
| iPS:468818 | 21-225_190C8 | AA | DIQMTQSPSSLSASVGDRVTITCRASQGIRNDLG WYQQKPGKAPKRLIYAASSLQSGVPSRFSGSGS GTEFTLTISSLQPEDFETYYCLQHNDYPFTFGGG TKVEIK<br>SEQ ID NO: 24148 | QVQLVQSGAEVKKPGASVKVSCKASGYTFISYDIN WVRQATGQLEWMGWMNPKRGNTGYAQKFQGR VTMTRDTSISTAYMELSSLRSEDTAVYYCARGDPY NWNSYAMDVWGQGATVTVSS<br>SEQ ID NO: 28154 |
| iPS:468826 | 21-225_201C5 | NA | GACATCCAGATGACCCAGTCTCCATCCTCCCT GTCTGCATCTGTAGGAGACAGAGTCACCATCA CTTGCCGGGCAAGTCAGGGCATTAGAGACATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTCCCCTCGG ACGTTCGGCCAAGGGACCAAGGTGGAAATCA AA<br>SEQ ID NO: 24149 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGGCAGTTATATGACTCCGTGAAGGT AATAAATACTATGCAGAGACAATTCCAGGAACACGCT GTATCTGCAAATGAACAGCCTGAGAGCCGAGGA CACGGCTGTGTATTACTGTGCGAGAGAACGTCT AGCAGTGGCTTGTACGACTACGGTATGACGTCT GGGGCCAAGGGACCACGGTCACCGTCTCCTCA<br>SEQ ID NO: 28155 |

FIGURE 50
(Continued)

| | | | | |
|---|---|---|---|---|
| iPS:468828 | 21-225_162A10 | AA | DIQMTQSPSSLSASVGDRVTITCRASQGIRHDLGWYQQKPGKAPKRLIYAASSLQSGVPSRFSGSGSGTEFTLTISSLQPEDFATYYCLQHYSFPRTFGQGTKVEIK<br>SEQ ID NO: 24150 | QVQLVESGGGVVQPGRSLRLSCAASGFTFSDYYMHWVRQAPGKGLEWVAVIWYDGSNKYYVDSVKGRFTISRDNSRNTLYLQMNSLRAEDTAVYYCARERYSSGLYDYGMDVWGQGTTVTVSS<br>SEQ ID NO: 28156 |
| | | NA | GAAATAGTGATGACGCAGTCTCCAGCCACCCTGTCTGTGTCTCCAGGGGAAAGAGCCACCCTCTCCTGCAGGGCCAGTCAGTCTGTTAACAGCAACTTAGCCTGGTACCAGCAGAAATCTGGCCAGGCTCCCAGGCTCCTCATCTTTGGTGCATCCACCAGGGCCACTGTTATCCCAGCCAGGATCAATGGCAGTGGGTCTGGGACAGAGTTCACTCTCACCATCAGCAGCCTGCGGTCTGAAGATAATGACTGGCGTGCATTTCTGTCAGCAGTATAGTTTTCCTCGGACGTTTTGGCCAGGGGACCAAGCTGGAGATCAAA<br>SEQ ID NO: 24151 | CAGGTGCAGCTGGTGGAGTCTGGGGGAGGCGTGGTCCAGCCTGGGAGGTCCCTGAGACTCTCCTGTGCAGCCGTCTGGATTCACCTTCAGTAGCTAGTGATGTAGGCATGCACTGGGTCCGCCAGGCTCCAGGCAAGGGCTGGAATGGGTGGCAGCTATATGGTATGATGGAAGCAATAAATACTATGCAGACTCCGTGAAGGGCCGATTCACCATCTCCAGAGACAATTCCAAGAACACGCTGTTTCTGCAAATGAACAGCCTGAGAGCCGAGGACACGGCTGTGTATTACTGTGCGAGAGACAAAATATAATGGGAGATACTTGGTTTGACTTCTGGGGCCAGGGAACCCTGGTCACCGTCTCCTCA<br>SEQ ID NO: 28157 |
| | | AA | EIVMTQSPATLSVSPGERATLSCRASQTVNSNLAWYQQKSGQAPRLLIFGASTRATVIPARINGSGSGTEFTLTISSLRSEDFAVYFCQQYNDWPCSFGQGTKLEIK<br>SEQ ID NO: 24152 | QVQLVESGGGVVQPGRSLRLSCAASGFTFSSCGMHWVRQAPGKGLEWVAAIWYDGSNKYYADSVKGRFTISRDNSKNTLFLQMNSLRAEDTAVYYCARDKNIMGDIWFDFWGQGTLVTVSS<br>SEQ ID NO: 28158 |

FIGURE 50
(Continued)

| | | | |
|---|---|---|---|
| iPS:468830 | 21-225_191G11 | NA | GAAATAGTGATGACGCAGTCTCCAGCCACCCTGTCTGTGTCTCCAGGGGAAAGAGCCAACCTCTCCTGCAGGACCAGTCAGAGTGTTTGGATTAGCGTAGCCTGGTACCACCAGAAACCTGGCCAGGCTCCCAGGCTCCTCATCTATGGTGCAGCCACCAGGGCCACTGGTATCCCAGCCAGGTTTAGTGGCAGTGGGTCTGGGACAGAGTTCACTCTCACCATCAGCAGCCTGCAGTCTGAAGATTTTGCAGTTTATTACTGTCAGCAGTATATTACTGGCCTCACTTTCGGCGGAGGGACCAAGGTGGAGATCAAA<br><br>SEQ ID NO: 24153 | CAGGTGCAACTGGTGCAGTCTGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAAGGACTTGAGTGGATGGGATGGATCAACCTAATAGTGGTGGCACAAACTTTGCACAGAAGTTTCAGGGCAGGGTCACCTTGACCAGGACACGTCCATCAACACAGCCTACATGGAGCTGAGCTGGCTGCGATCTGACGACACGGCCGTATATTACTGTGCGCGTGAAAGAACTATGGCTCCTACTTTGACTACTGGGGCCAGGGAACCCTGGTCACCGTCCTCG<br><br>SEQ ID NO: 28159 |
| | | AA | EIVMTQSPATLSVSPGERANLSCRTSQSVWISVAWYHQKPGQAPRLLIYGAATRATGIPARFSGSGSGTEFTLTISSLQSEDFAVYYCQQYNYWPLTFGGGTKVEIK<br><br>SEQ ID NO: 24154 | QVQLVQSGAEVKKPGASVKVSCKASGYTFTGYYMHWVRQAPGQGLEWMGWINPNSGGTNFAQKFQGRVTLTRDTSINTAYMELSWLRSDDTAVYYCARGKNYGSYFDYWGQGTLVTVSS<br><br>SEQ ID NO: 28160 |
| iPS:468832 | 21-225_76H10 | NA | GACATCCAGATGACCCAGTCTCCATCCTCCCTGTCTGCCTCTGCAGGAGACAGAGTCACCATCACTTGCCGGGCAAGTCAGGACATTAGAAATTATTTAGGCTGGTATCAGCAGAAACCAGGGAAAGCCCCTAAGCGACTGATCTATGTGCATCCAGTTTGCAAAGTGGGGTCCCATCAAGGTTCAGCGGCAGTGGATCTGGGACAGATTCACTCTCACAATCAGCAGCCTGCAGCCTGAAGATTTTGCAACTTTTTACTGTCTACAGTATAATAGTTACCATTCACTTTCGGCCCTGGGACCAAAGTGGATATCAAA<br><br>SEQ ID NO: 24155 | CAGGTGCAGCTACAACAGTGGGGCGCAGGACTGTTGAAGCCTTCGGAGACCCTGTCCCTCACTTGCGCTGTCAATGTGGGCCCTTCAGCGGTTGCTACTGGAGCTGGATCCGCCAGCCCCCAGGGAAGGGGCTGGAGTGGATTGGGAAATCAATTATATGTGGAAGGACCAACTTCAACCCGTCCCTCAAGAGTCGAGTCACCATATCAGTTGACACGTCCAAGAACCAGTTCTCCCTGAAGCTGAGCTCTGTGACCGCCGGGGACACGGCTGTGTATTACTGTGCGAGAGACTACGGCGGTATGGACGTCTGGGGCCAAGGGACCACGGTCACCGTCTCCTCA<br><br>SEQ ID NO: 28161 |

FIGURE 50
(Continued)

| | | | | |
|---|---|---|---|---|
| | | AA | DIQMTQSPSSLSASAGDRVTITCRASQDIRNYLG WYQQKPGKAPKRLIYGASSLQSGVPSRFSGSGS GTEFTLTISSLQPEDFATFYCLQYNSYPFTFGPGT KVDIK<br>SEQ ID NO: 24156 | QVQLQQWGAGLLKPSETLSLTCAVNGGPFSGCYW SWIRQPPGKGLEWIGEINYSGRTNFNPSLKSRVTISV DTSKNQFSLKLSSVTAADTAVYYCARDYGGMDV WGQGTTVTVSS<br>SEQ ID NO: 28162 |
| | | NA | GAAATTGTGTTGACGCAGTCTCCAGGCACCCT GTCTTTGTCTCCAGGGGAAGAGAGCCACCCTCT CCTGCAGGGCCAGTCAGAGTGTTAACAGCAAC TACTTAGCCTGGTACCGGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCATTCTCAT CATCAGCAGACTGGAGCCTGAGGATTTTGCAG TGTATTACTGTCAGCAGTATGAAAGCTCGCCG TGGACGTTCGGCCAAGGGACCAAGGTGGAAA TCAAA<br>SEQ ID NO: 24157 | CAGGTGCAGCTACAACAGTGGGGCGCAGGACTG TTGAAGCCTTCGGAGACCCTGTCCCTCACTTGCG CTGTCAATGGTGGGCCCTTCAGCGGTTGCTACTG GAGCTGGGATCGCCAGCCCCCAGGGAAGGGGCG GGAGTGGATTGGGGAAATCAATTATAGTGGAAG GACCAACTTCAACCGTCCCTCAAGAGTCGAGTC ACCATATCAGTTGACACGTCAAGAACCAGTTCT CCCTGAAGCTGAGCTGATTACTGTGCGAGAGACTACGGCGGT ATGGACGTCTGGGGCCAAGGGACCACGGTCACC GTCTCCTCA<br>SEQ ID NO: 28163 |
| iPS:468834 | 21-225_94G10 | AA | EIVLTQSPGTLSLSPGERATLSCRASQSVNSNYLA WYRQKPGQAPRLLIYGASSRATGIPDRFSGSGSG TDFILISRLEPEDFAVYYCQQYESSPWTFGQGTK VEIK<br>SEQ ID NO: 24158 | QVQLQQWGAGLLKPSETLSLTCAVNGGPFSGCYW SGIRQPPGKGREWIGEINYSGRTNFNPSLKSRVTISV DTSKNQFSLKLSSVTAADTAVYYCARDYGGMDV WGQGTTVTVSS<br>SEQ ID NO: 28164 |

FIGURE 50
(Continued)

| | | | |
|---|---|---|---|
| iPS-468836 | 21-225_198E3 | NA | GACATCAGAGATGACCCAGTCTCCATCCTCCCT GTCTGCATCTGTAGGAGACAGAGTCACCATCA CTTGCCGGGCAAGTCAGGGACATAAGAAAAGA TTTAGGCTGGTATCAGCAGAAACCAGGGAAA GCCCCTAAGCGCCTGATCTATGCTGCATCCAG TTTGCAAAGTGGGGTCCCATCAAGGTTCAGCG GCAGTGGATCTGGGACAGAATTCACTCTCACA ATCAGCAGCCTGCAGCCTGAAGATTTTGCAAC TTATGTCTGTCTACAACATTATCGTTACCCTTT CACTTTCGGCCCTGGGACCAAAGTGGATTTCA AA | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATCATATGATGGAGGT TATAAAAACTATGCAGACTCCGTGAAGGGCCGA TTCACCATCTCCAGAGACAATTCCAAGAACACGC TGTATCTGCAAATGAATAGCCTGAGAGCTGAGGA CACGGCTGTGTATTACTGTGCGAGAGAGGTACCAC GGGTACTACTACGGTGTGGACGTCTGGGGCCAA GGGACCACGGTCACCGTCTCCTCA |
| | | | SEQ ID NO: 24159 | SEQ ID NO: 28165 |
| | | AA | DIQMTQSPSSLSASVGDRVTITCRASQGIRKDLG WYQQKPGKAPKRLIY AASSLQSGVPSRFSGSGS GTEFTLTISSLQPEDFATYVCLQHYRYPFTFGPGT KVDFK | QVQLVESGGGVVQPGRSLRLSCAASGFTFSSYGMH WVRQAPGKGLEWVAVISYDGGYKNYADSVKGRF TISRDNSKNTLYLQMNSLRAEDTAVYYCARGTHG YYYGVDVWGQGTTVTVSS |
| | | | SEQ ID NO: 24160 | SEQ ID NO: 28166 |
| iPS-468838 | 21-225_80E12 | NA | GAAATTGTGTTGACGCAGTCTCCAGGCACCCT GTCTTTGTCTCCAGGGGAGAGAGCCACCCTCT CCTGCAGGGCCAGTCAGAGCGTTAACAGCAAC TACTTAGCCTGGTACCGGCAGAAAACCTGACCA GGCTCCCAGGCTCCTCATCTATGGTGCATCCA GCAGGGCCACTGGCATCCCAGACAGGTTCAGT GGCAGTGGGTCTGGGACAGACTTCATTCTCAT CATCAGCAGACTGGAGCCTGAAGATTTTGCAG TGTATTACTGTCAGCAGTATGAAAAGCTCGCG TGGACGTTCGGCCAAGGGACCAAGGTGGAAA TCAAA | CAGGTGCAGCTACAACAGTGGGGCGCAGGACTG TTGAAGCCTTCGGAGACCCGTCCCTCACTTGCG CTGTCAATGTGGGCCCTTCAGCGGTTGCTACTG GAGCTGGATCCGCCAGCCCAGGGAAGGGGCT GGAGTGGATTGGGAAATCAATTATATGTGAAG GACCAACTTCAACCCGTCCTCAAGAGTGAGTC ACCATATCAGTTGACAGTCAAGAACCAGTTCT CCCTGAAGCTGAGCTCTGTGACGGCCGCGGACAC GGCTGTGTATTACTGTGCGAGAGATACGCGGT ATGGACGTCTGGGGCCAAGGGACCACGGTCACC GTCTCCTCA |
| | | | SEQ ID NO: 24161 | SEQ ID NO: 28167 |

FIGURE 50
(Continued)

| | | | |
|---|---|---|---|
| iPS:468840 | 21-225_200H9 | AA | EIVLTQCPGTLSLSPGERATVSCRASQSVNSNYL AWYRQKPDQAPRLLIYGASSRATGIPDRFSGSGS GTDFILIISRLEPEDFAVYYCQQYESSPWTFGQGT KVEIK<br>SEQ ID NO: 24162 | QVQLQQWGAGLLKPSETLSLTCAVNGGPFSGCYW SWIRQPPGKGLEWIGEINYSGRTNFNPSLKSRVTISV DTSKNQFSLKLSSVTAADTAVYYCARDYGGMDV WGQGTTVTVSS<br>SEQ ID NO: 28168 |
| | | NA | GACATCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCAGT TTGCAAAGTGGGATCCATCAAGGTTCAGCGG CAGTGGATCTGGGACAGAATTCACTCTCACAA TCAGCAGCTGCAGCCTGAAGATTTTGCAACT TATTACTGTCTACAGCATATAGTTACCCCTCTC ACTTTCGGCGGAGGGACCAAGGTGGAGATCA AA<br>SEQ ID NO: 24163 | CAGGTGCAGCTGCAGGAGTCGGGCCAGGACTG GTGAAGCCTTCACAGACCCTGTCCCTCACCTGCA TTGTCTCTGGTGGCTCATGAGGAGTGGTGA CTACTGGAGCTGGATCCGCCAGCACCCAGGGAA GGGCCTGGAGTGGTTTGGGTACATCTATTACAGT GGGAGCACTTACTACAACCGTCCCTCAAGAGTC GAGTTACCTTATCAGTAGACACGTCTAAGAACCA GTTCTCCCTGAAGCTGAGCTCTGTGACTGCCGCG GACACGGCCGTGTATTACTGTGCGAGAATGGACT ACAGTAACTACTACCGGTATGGACGTCTGGGG CCAAGGGACCTCGGTCACCGTCCTCA<br>SEQ ID NO: 28169 |
| | | AA | DIQMTQSPSSLSASVGDRVTITCRASQGIRNDLG WYQQKPGKAPKRLIYAASSLQSGIPSRFSGSGSG TEFTLTISSLQPEDFATYYCLQHNSYPLTFGGGT KVEIK<br>SEQ ID NO: 24164 | QVQLQESGPGLVKPSQTLSLTCIVSGGSMRSGGDY WSWIRQHPGKGLEWFGYIYYSGSTYYNPSLKSRVT LSVDTSKNQFSLKLSSVTAADTAVYYCARMDYSN YYYGMDVWGQGTSVTVSS<br>SEQ ID NO: 28170 |

FIGURE 50
(Continued)

| | | | | |
|---|---|---|---|---|
| iPS:468820 | 21-225_76E10 | NA | GAAATTGTGTTGACGCAGTCTCCAGGCACCCT GTCTTTGTCTCCAGGGGAAAGAGCCACCCTCT CCTGCAGGGCCAGTCAGAGTGTTAACAGCAAC TACTTAGCCTGGTACCGGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGATTCATTCTCAT CATCAGCAGACTGGAGCCTGAGGATTTTGCAG TGTATTACTGTCAGCAGTATGAAAGCTCGCCG TGGACGTTCGGCCAAGGGACCAAGGTGGAAAA TCAAA SEQ ID NO: 24165 | CAGGTGCAGCTCCAACAGTGGGGGCAGGACTG TTGAAGCCTTCGGAGAGCCTGTCCTCACTTGCG CTGTCAATGTGGGCCCCTTCAGCGGTTCCTACTG GAGCTGGATCCGCCAGCCCCAGGGAAGGGCT GGAGTGGATTGGGGAAATCAATTATAGTGGAAG GACCAACTTCAACCGTCCCTCAAGAGTCGAGTC ACCATATCAGTTGACACGTCCAAGAACCAGTTCT CCCTGAAGCTGAGCTCTGTGACCGCCGGACAC GGCTGTGTATTACTGTGCGAGAGACTACGGCGGT ATGGACGTCTGGGGCCAAGGGACCACGGTCACC GTCTCCTCA SEQ ID NO: 28171 |
| | | AA | EIVLTQSPGTLSLSPGERATLSCRASQSVNSNYLA WYRQKPGQAPRLLIYGASSRATGIPDRFSGSGSG TDFILISRLEPEDFAVYYCQQYESSPWTFGQGTK VEIK SEQ ID NO: 24166 | QVQLQQWGAGLLKPSETLSLTCAVNGPFSGSYW SWIRQPPGKGLEWIGEINYSGRTNFNPSLKSRVTISV DTSKNQFSLKLSSVTAADTAVYYCARDYGGMDV WGQGTTVTVSS SEQ ID NO: 28172 |
| iPS:468842 | 21-225_50H4 | NA | GACATCCAGATGACCCAGTCTCCATCCTCCCT GTCTGCATCTGTTGGAGACAGAGTCACCATCA CTTGCCGGGCAAGTCAGGGCATTAGAAATGAT TTAGGCTGGTATCAGCAGAAACCAGGGAAGG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTACAGCCTGAAGATTTTGCAACT TATTACTGTCTACAACATTATAGTTACCCTCGG ACGTTCGGCCAAGGGACCAAGGTGGAAATCA AA SEQ ID NO: 24167 | CAGGTGCAGCTGGTGGAGTCTGGGGGAGGCGTG GTCCAGCCTGGGAGGTCCCTGAGACTCTCCTGTG CAGCGGTCTGGATTCACCTTCAGTAGCTATGTCAT GCACTGGGTCCGCCAGGCTCCAGGCAAGGGGCT GGAGTGGGTGGCAGTCTATATGTATGATGGAAG TAATAAATACTATGCAGACTCCGTGAAGGGCCG ATTCACCATCTCCAGAGACAATTCCAAGAACACG CTGGATCTGCAAATGAACAGCCTGAGAGCCGAG GACACGGCTGTGTATTACTGTGCGAGAGAGTTGT ATAGCAGCAACTGGTACGACTACGGTATGGACG TCTGGGGCCAAGGGACCACGGTCACCGTCTCCTC A SEQ ID NO: 28173 |

FIGURE 50
(Continued)

| | | | |
|---|---|---|---|
| iPS:468844 | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHYSYPRTFGQGTKVEIK<br>SEQ ID NO: 24168 | QVQLVESGGGVVQPGRSLRLSCAASGFTFSSYVMHWVRQAPGKGLEWVAAIWYDGSNKYYADSVKGRFTISRDNSKNTLDLQMNSLRAEDTAVYYCARELYSSNWYDYGMDVWGQGTTVTVSS<br>SEQ ID NO: 28174 |
| | | NA | GACATCCAGATGACCCAGTCTCCATCCTCCCTGTCTGCATCTGTAGGAGACAGAGTCACCATCACTTGCCGGGCAAGTCAGGGCATTAGAAGTGATTTAGGCTGGTATCAGCAGAAACCAGGGAAAGCCCCTAAGCGCCTGATCTATGCCGCATCCAGTTTGCAAAGTGGGGTCCCATCAAGGTTCAGCGGCAGTGGATCTGGGACAGAATTCACTCTCACAACAGCAGCCTGCAGCCTGAAGATTTTGCAACTTATTACTGTCTACAGCATATAATAGTTACCCATTCACTTTCGGCCCTGGGACCAAAGTGGATATCAAA<br>SEQ ID NO: 24169 | GAGGTGCAGCTGGTGGAGTCTGGGGGAGGCCTGGTCAAGCCTGGGGGGTCCCTGAGACTCTCCTGTGCAGCCTCTGGATTCACCTTCAGTAGCTATAACATGAACTGGGTCCGCCAGGCTCCAGGGAAGGGGCTGGAGTGGGTCTCATCCATTAGTGGTAGTAGTAGTTACATATACTACGCAGACTCAGTGAAGGGCCGATTCACCATCTCCAGAGACAACGCCAAGAACTCACTGTATCTGCAAATGAACAGCCTGAGAGCCGAGGACACGGCTGTGTATTACTGTGCGAGAAGCCTCGACCTCTGGGGCCAGGGAACCCTGGTCACCGTCTCCTCA<br>SEQ ID NO: 28175 |
| | 21-225_48E10 | AA | DIQMTQSPSSLSASVGDRVTITCRASQGIRSDLGWYQQKPGKAPKRLIYTASSLQSGVPSRFSGSGSGTEFTLTISSLQPEDFATYYCLQYNSYPFTFGPGTKVDIK<br>SEQ ID NO: 24170 | EVQLVESGGGLVKPGGSLRLSCAASGFTFSSYNMNWVRQAPGKGLEWVSSISGSSSYIYYADSVKGRFTISRDNAKNSLYLQMNSLRAEDTAVYYCARSLDLWGQGTLVTVSS<br>SEQ ID NO: 28176 |

FIGURE 50
(Continued)

| | | | |
|---|---|---|---|
| iPS:468846 | 21-225_53B10 | NA | GACATCCAGATGACCCAGTCTCCATCTCCCT GTCTGCCTCTGCAGGAGACAGAGTCACCATCA CTTGCCGGGCAAGTCAGGACATTAGAAATTAT TAGGCTGGTATCAGCAGAAACCAGGGAAAG CCCCTAAGCGACTGATCTATGGTGCATCCAGT TTGCAAAGTGGGGGTCCCATCAAGGTTCAGCGG CAGTGGATCTGGGACAGAATTCACTCTCACAA TCAGCAGCCTGCAGCCTGAAGATTTTGCAACT TTTTACTGTCTACAGTATATAATAGTTACCCATTC ACTTTCGGCCCTGGGACCAAAGTGGATATCAA A<br>SEQ ID NO: 24171 | GAGGTGCAGTTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCATTAGTGGTAGTAGCAGT TACATATACTACGTAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGTCAACTCT TTTGACTCCTGGGGCCAAGGGACCCTGGTCACCG TCTCCTCA<br>SEQ ID NO: 28177 |
| | | AA | DIQMTQSPSSLSASAGDRVTITCRASQDIRNYLG WYQQKPGKAPKRLIYGASSLQSGVPSRFSGSGS GTEFTLTISSLQPEDFATFYCLQYNSYPFTFGPGT KVDIK<br>SEQ ID NO: 24172 | EVQLVESGGGLVKPGGSLRLSCAASGFTFSSYSMN WVRQAPGKGLEWVSSISGSSSYIYYVDSVKGRFTIS RDNAKNSLYLQMNSLRAEDTAVYYCARVNSFDSW GQGTLVTVSS<br>SEQ ID NO: 28178 |
| iPS:468848 | 21-225_54B1 | NA | GACATCCAGATGACCCAGTCTCCATCTCCCT GTCTGCTTCTATTGGAGACAGAGTCACCATCA CTTGCCGGGCAAGTCAGAACATTAGCAGCTAT TTAAATTGGTATCAGCAGAAACCAGGGAAGG CCCCCAAGTTCCTGATCTATGCTGCATCCAGTT TGCATATAGTGGGGTCCCACCAAGGTTCAGTGGC AGTGGATCTGGGACAGATTTCACTCTCACCAT CAGCAGTCTGCAACCTGAAGATTTTGCAATTT ACTACTGTCAACAGAGTTACAGAACCCCCTCTG TGGACGTTCGGCCAAGGGACCAAGGTGGAAA TCAAA<br>SEQ ID NO: 24173 | GAGGTGCAGCTGTTGGAGTCTGGGGGAGGCTTG GTACAGCCTGGGGGGTCCCTGAGACTCTCCGTG CAGCCTCTGGATTCACCTTTAGCAGCTATGCCAT GAGCTGGGTCCGCCAGGCTCCAGGGAAGGGGCT GGAGTGGGTCTCAGTTCTTAGTGGTAGTGGTGGT AGCACATTCTACGCAGACTCCGTGAAGGGCCGGT TCACCATCTCCAGAGAGAATTCCAAGAACACGCT GTATCTGCAAATGAGCAGCCTGAGAGCCGAGGA CACGGCCGTATATTACTGTGCCCGAAGAGGCCGT GAATATAGTGGCTACGATTACTTTGACTACTGGG GCCAGGGAACCCTGGTCACCGTCTCCTCA<br>SEQ ID NO: 28179 |

FIGURE 50
(Continued)

| | | | | |
|---|---|---|---|---|
| iPS:468850 | 21-225_63F4 | AA | DIQMTQSPSSLSASIGDRVTITCRASQNISSYLNW YQQKPGKAPKFLIYAASSLHSGVPPRFSGSGSGT DFTLTISSLQPEDFAIYYCQQSYRTPLWTFGQGT KVEIK<br><br>SEQ ID NO: 24174 | EVQLLESGGGLVQPGGSLRLSCAASGFTFSSYAMS WVRQAPGKGLEWVSVLSGSGGSTFYADSVKGRFTI SRENSKNTLYLQMSSLRAEDTAVYYCARRGREYS GYDYFDYWGQGTLVTVSS<br><br>SEQ ID NO: 28180 |
| | | NA | GACATCGTGATGACCCAATCTCCAGACTCCCT GGCTGTGTCTCTGGGCGAGAGGGCCACCATCA ACTGCAAGTCCAGCCAGAGTGTTTTATCCAGC TCCAACAATAACAACTACTTAGCTTGGTACCA GCAGAAACCAGGACAGCCTCCTAAGCTGCTCA TTTACTGGGCATCTACCCGGGAATCCGGATC CCTGACCGATTCAGTGGCAGCGGGTCTGGGAC AGTTTCACTCTCACCATCAGCAGCCTGCAGG CTGAGGATGTGGCAGTTTATTACTGTCAGCAA TATTATACTACTCCGTGCAGTTTTGGCCAGGG GACCAAGCTGGAGATCAAT<br><br>SEQ ID NO: 24175 | CAGGTGCAGCTGGTGCAATCTGGGGCTGAGGTG AAGAAGCCTGGGGCCTCAGTGAAGGTCTCTGC AAGGCTTCTGGATACACCTTCACCAATTATGATG TCAACTGGGTGCGACAGGCCACTGGACAAGGGC TTGAGTGGATGGGATGGATGCACCTAACAGTGG TAACACAGGCTATGCACAGAAGTTCCGGGCAG AGTCACCATGACCAGGAACACCTCCTAAGCAC AGTCTACATGGAGCTGAGCAGCCTGCGATCTGAG GACACGGCCGTGTATTACTGTGCCTAGCAGTG GCTGGTACGTTTTGACTACTGGGGCCAGGGAAC CCTGGTCACCGTCTCCTCA<br><br>SEQ ID NO: 28181 |
| | | AA | DIVMTQSPDSLAVSLGERATINCKSSQSVLSSSN NNNYLAWYQQKPGQPPKLLIYWASTRESGIPDR FSGSGSGTGFTLTISSLQAEDVAVYYCQQYYTTP CSFGQGTKLEIN<br><br>SEQ ID NO: 24176 | QVQLVQSGAEVKKPGASVKVSCKASGYTFTNYDV NWVRQATGQGLEWMGWMHPNSGNTGYAQKFRG RVTMTRNTSLSTVYMELSSLRSEDTAVYYCAYSSG WYVFDYWGQGTLVTVSS<br><br>SEQ ID NO: 28182 |

FIGURE 50
(Continued)

| | | | | |
|---|---|---|---|---|
| iPS:468852 | 21-225_71F3 | NA | GACATCGTGATGACCCAATCTCCAGACTCCT GGCTGTCTGTCTCCTGGGCGCGAGGGCCACCATCA ACTGCAAGTCCAGCCAGCCAGAGTGTTTTATCCAAC TCCAACAATAACAACTACTTAGCTTGGTACCA GCAGAAACCAGGACAGCCTCCTAAGCTGCTCA TTTACTGGGCATCTACCCGGAATCCGGATC CCTGACCGATTCAGTGGCAGCGGGTCTGGGAC AGATTTCACTCTCACCATCAACAGCCTGCAGG CTGAAGATGTGGCAGTTTATTACTGTCAGCAA TATTATACTACTCCGTGCAGTTTTGACCAGGG GACCAAGCTGGAGATCAAA SEQ ID NO: 24177 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATG TCAACTGGGTGCGACAGGCCACTGGACAAGGC TCAACAGGCTATGCACAGAAGTTCCAGGGCAG TAACACAGGCTATGCACAGAAGTTCCAGGCAG AGTCACCATGACCAGGAACACCTCCATAAGCAC AGCCTACATGGAGCTGAGCAGCCTGCGATCGA GGACACGGCCGTGTATTACTGTGCCTATAGCAGT GGCTGGTACGTTTTGACTCCTGGGGCCAGGGAA CCCTGGTCACCGTCTCCTCA SEQ ID NO: 28183 |
| | | AA | DIVMTQSPDSLAVSLGARATINCKSSQSVLSNSN NNNYLAWYQQKPGQPPKLLIYWASTRESGIPDR FSGSGSGTDFTLTINSLQAEDVAVYYCQQYYTTP CSFGQGTKLEIK SEQ ID NO: 24178 | QVQLVQSGAEVKKPGASVKVSCKASGYTFTNYDV NWVRQATGQGLEWMGWMHPNSGNTGYAQKFQG RVTMTRNTSISTAYMELSSLRSEDTAVYYCAYSSG WYVFDSWGQGTLVTVSS SEQ ID NO: 28184 |
| iPS:468854 | 21-225_72C4 | NA | GATGTTGTAATGACTCAGTCTCCGCTCTCCCTG CCCGTCACCCTTGGACAGCCGGCCTCCATCTC CTGCAGGTCTGGTCAAAGCCTCGTATACAGTG ATGGAAACACCTACTTGAATTGGTTTCAGCAG AGGCCAGGCCAATCTCCAAGGCGCCTAATTTA TGAAGGTTTCTAAGTGGGACTCTGGGGTCCCAG ACAGATTCAGTGGCAGTGGGTCAGGCACTAAT TTCACACTGAAAATCAGCAGGGTGGAGGCTGA GGATGTTGGGGTCTTTTACTGCATGCAAGGTA CACACTGGCCGCTCACTTTCGGCGGAGGGACC AAGGTGGAGATCAAA SEQ ID NO: 24179 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGTCACTGGACAAGGC TTGAGTGGATGGGATGCACAGAAGTTCCAGGCAG TAACACAGGCTATGCACAGAAGTTCCAGGGCAG AGTCACCATGACCAGGAACACCTCCATAAGCAC AGCCTACATGAACTGAACAGCCTGAGATCTGA GGACACGCCGTGTATTACTGTTGCATAGCAGT GGCTGTACCTCTTTGACTACTGGGGCCAGGGAA CCCTGGTCACCGTCTCCTCA SEQ ID NO: 28185 |

FIGURE 50
(Continued)

| | | | |
|---|---|---|---|
| iPS:468856 | 21-225_77C9 | AA | DVVMTQSPLSLPVTLGQPASISCRSGQSLVYSDG NTYLNWFQQRPGQSPRRLIYEVSKWDSGVPDRF SGSGSGTNFTLKISRVEAEDVGVFYCMQGTHWP LTFGGGTKVEIK<br>SEQ ID NO: 24180 | QVQLVQSGAEVKKPGASVKVSCKASGYTFTNYDIN WVRQVTGQGLEWMGWMHPNSGNTGYAQKFQGR VTMTRNTSISTAYMELNSLRSEDTAVYYCSHSSGW YLFDYWGQGTLVTVSS<br>SEQ ID NO: 28186 |
| | | NA | GATGTTGTGATGACTCAGTCTCCACTCTCCCTG CCCGTCACCCTTGGACAGCCGGCCTCCATCTC CTGCAGGTCTAGTCAAAGCCTCGTTTACAGTG TTGGAAACACCTCCTTGAGTTGGTTTCAGCAG AGGCCAGGCCAATCTCCAAGGCGCCTAATTTA TAAGGTTTCTAACTGGGACTCTGGGGTCCCAG ACAGATTCAGCGGCAGTGGGTCAGGCACTGAT TTCACACTGAAAATCAGCAGGGTGGAGGCTGA GGATGTTGGGGTTTATTACCGCATGCAAGGTA CACACTGGCCATTCACTTTCGGCCCTGGGACC AAAGTGGATATCAAA<br>SEQ ID NO: 24181 | CAGCTGCAGCTGCAGGAGTCGGGCCAGGACTG GTGACGCCTTCGGAGACCCCTGTCCCTCACCTGCA CTGTCTCTGGCGGCTCCATCAGCAGGAGTAGTTA CTACTGGGGCTGGATCCGCCAGCCCCCAGGGAA GGGGCTGGAGTGGATTGGGAGTATCTATTATAGT GGGAGCGCCTACTCCAACCCGTCCCTCAAGAGTC GAGTCACCATATCCGTAGACACGTCCAAGAACC AGTTCTCCCTGAAGCTGAGCTCTGTGACCGCCGC GGACACGGCTCTGTTTTACTGTGCGAGACTTGAC TCTAACTGGGGTCTTGACTACTGGGGCCAGGGAA CCCTGGTCACCGTCTCCTCA<br>SEQ ID NO: 28187 |
| | | AA | DVVMTQSPLSLPVTLGQPASISCRSSQSLVYSVG NTSLSWFQQRPGQSPRRLIYKVSNWDSGVPDRF SGSGSGTDFTLKISRVEAEDVGVYYRMQGTHWP FTFGPGTKVDIK<br>SEQ ID NO: 24182 | QLQLQESGPGLVTPSETLSLTCTVSGGSISRSSYYW GWIRQPPGKGLEWIGSIYYSGSAYSNPSLKSRVTIS VDTSKNQFSLKLSSVTAADTALFYCARLDSNWGLD YWGQGTLVTVSS<br>SEQ ID NO: 28188 |

FIGURE 50
(Continued)

| | | | |
|---|---|---|---|
| iPS:468858 | 21-225_148C9 | NA | GACATCCAGATGACCCAGTCTCCATCCTCCCT GTCTGCATCTGTAGGAGACAGAGTCACCATCA CTTGCCGGGCAAGTCGGGCATTAGAGATGAT TTAGGCTGGTATCAGCAGAAACCAGGGAAAG CCCCTAAGCGCCTGATCTATGCTGCATCCAGT TTGCAGAGTGGGGTCCCATCAAGGTTCAGCGG CAGTGGATCTGGGACAGAATTCACTCTCACAA TCAGCAGCCTGCAGCTGAAGATTTTGCAACT TATTACTGTCTACAGCATTATAGTTATCCTCGG ACGTTCGGCGGAGGGACCAAGGTGGAAATCA AA<br>SEQ ID NO: 24183 | CAGGTGCAGCTGGTGGAGTCTGGGGGAGGCGTG GCCCAGCCTGGGAGGTCCCTGAGACTCTCCTGTG CAGCCGTCTGGATTCACCTTCAGTGACTATGGCAT GCACTGGGTCCGCCAGGCTCCAGGCAAGGGGCT GGAGTGGGTGGCAGTTATATGGTATGATGAAGT AATAAGTACTATGCAGACTCCGTGAAGGGCCGA CTCACCATCTCCAGAGACAATTCCAAGAACACGC TGTATCTGCAAATGAACAGCCTGAGAGCCGAGG ACACGGCTGTGTATTACTGTGCGAGAGAGGTA TAGCAGTGGCTGGTACGACTACGGTTTGGACGTC TGGGGCCAAGGGACCACGGTCACCGTCTCCTCA<br>SEQ ID NO: 28189 |
| | | AA | DIQMTQSPSSLSASVGDRVTITCRASRGIRDDLG WYQQKPGKAPKRLIYAASSLQSGVPSRFSGSGS GTEFTLTISSLQPEDFATYYCLQHYSYPRTFGQG TKVEIK<br>SEQ ID NO: 24184 | QVQLVESGGGVAQPGRSLRLSCAASGFTFSDYGM HWVRQAPGKGLEWVAVIWYDGSNKYYADSVKGR LTISRDNSKNTLYLQMNSLRAEDTAVYYCARERYS SGWYDYGLDVWGQGTTVTVSS<br>SEQ ID NO: 28190 |
| iPS:468860 | 21-225_224E7 | NA | GACATCCAGATGACCCAGTCTCCTTCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTACGCGCCTGATCTATGCTGCCAGTT TGCAAAGTGGGGTCCCATCGAGGTTCAGCGGC AGTGGATCTGGGACAGAATTCACTCTCACAAT CAGCAGCCTGCAGCTGAACATTATACCCTCGG ATTACTGTCTACAACATTATAGTTACCCTCGG ACGTTCGGCCAAGGGACCAAGGTGGAAATCA AA<br>SEQ ID NO: 24185 | CAGGTGCAGCTGGTGGAGTCTGGGGGAGGCGTG GTCCAGCCTGGGAGGTCCCTGAGCCTCTCCTGTG CAGCCGTCTGGATTCACCTTCAGTAGTATGTCAT GCACTGGGTCCGCCAGGCTCCAGGCAAGGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACAGTA TAGCAGCAGCTGGTACGACTTCGGTCTGACGTC TGGGGCCAAGGGACCACGGTCACCGTCTCCTCA<br>SEQ ID NO: 28191 |

FIGURE 50
(Continued)

| | | | |
|---|---|---|---|
| iPS:468862 | 21-225_178H8 | AA | DIQMIQSPSSLSASVGDRVTITCRASQGIKNDLG WYQQKPGKAPTRLIYAASSLQSGVPSRFSGSGSG TEFTLTISSLQPEDFATYYCLQHYSYPRTFGQGT KVEIK<br>SEQ ID NO: 24186 | QVQLVESGGGVVQPGRSLSLSCAASGFTFSSYVMH WVRQAPGKGLEWVAVIWYDGSNKYYADSVKGRF TISRDNSKNTLYLQMNSLRAEDTAVYYCAREQYSS SWYDFGLDVWGQGTTVTVSS<br>SEQ ID NO: 28192 |
| | | NA | CAGTCTGCCCTGACTCAGTCTGCCTCCGTGTCG GGGTCTCCTGGACAGTCGATCACCATCTCCTG CACTGGAACCAGCAGTGACGTTGGTGGTTATA ATTTTGTCTCTGGTACCAACAGCACCCAGGC AAAGTCCCCAAATTCATGATTTATGAGGTCAG TAATCGGCCCTCAGGGGTTCCTAATCGTTTTC TGGCTCCAAGTCTGGCAACACGGCCTCCCTGA CCATCTCTGGCCTCCAGGCTGAGGACGAGGCT GATTATTACTGCAGCTCATATACAAGCAGTA CACTTGGGTGTTCGGCGGAGGGACCAAACTGA CCGTCCTA<br>SEQ ID NO: 24187 | CAGGTGCAGCTGGTGCAGTCTGGGGCTGAGGTG AGGACGCCTGGGGCCTCAGTGAAGGTCTCCTGCA AGGCTTCTGGATACACCTTCACCGACTATTATAT GCACTGGGTGCGACAGGCCCCTGGACAAGGGCT TGAGTGGATGGGATGGATCAACCCTAACAGAGG TGGCACAAACTATGTCTCAGAAGTTTCAGGGCAG GGTCACCATGACCAGGGACACGTCCATCAGCAC AGCCTACATGGAGCTGAGCAGGCTGAGATCTGA CGACACGGCCGTGTATTACTGTGCGAGAGAGA CGATCGCAGTGGCTGGTACTACTACGGTATG GACGTCTGGGGCCAAGGGACCACGGTCACCGTC TCCTCA<br>SEQ ID NO: 28193 |
| | | AA | QSALTQSASVSGSPGQSITISCTGTSSDVGGYNFV SWYQQHPGKVPKFMIYEVSNRPSGVPNRFSGSK SGNTASLTISGLQAEDEADYYCSSYTSSYTWVFG GGTKLTVL<br>SEQ ID NO: 24188 | QVQLVQSGAEVRTPGASVKVSCKASGYTFTDYYM HWVRQAPGQGLEWMGWINPNRGGTNYAQKFQGR VTMTRDTSISTAYMELSRLRSDDTAVYYCAREEDR SGWYYYYGMDVWGQGTTVTVSS<br>SEQ ID NO: 28194 |

FIGURE 50
(Continued)

| | | | |
|---|---|---|---|
| iPS:468864 | 21-225_60D6 | NA | CAGTCTGTGTGCTGACTCAGCCACCTCAGCGTC TGGGACCCCCGGGCAGCAGTCCAACATCTCTT GTTCTGGAAGCAGCTCCAACATGGAAGTAAT ACTGTAAACTGGTACCAGCAGCTCCCAGGAAC GGCCCCCAAACTCCTCATTCATAGTAATAATC AGCGGGCCCTCAGGGGTCCCTGACGATTCTCT GGCTCCAAGTCTGGCCACCTCAGCTCTCCTGGC CATCAGTGGGCTCCAGTCTGAGGATGAGGCTG ATTATTACTGTGCAGCATGGGATGACAGCCTG AATGGTCCGGTCGGCGGAGGGACCAAGCTGA CCGTCCTA<br><br>SEQ ID NO: 24189 | CAGATCACCTTGAAGGAGTCTGGTCCTACGCTGG TGAAACCACACAGACCCTCACGTGACCTGCAC CTTCTCTGGGTTCTCACTCAGCACTAGTGGAGTG GGTGTGGGCTGGATCCGTCAGCCCCCAGGAAAG GCCCTGGAGTGGCTTGCACTCATTTATTGGAAAG ATGATGAGCGCTACAGCCCATCTGAAGAGCA GGCTCACCATCACCAAGGACACTTCCAAAACC AGTGGTCCTTACAATGACCACATGACCCTGT GGACACAGCCACATATTACTGTGCACATGCAGTG GCTGTCTCCTTGACTACTGGGGCCAGGGAACCC TGGTCACCGTCTCCTCA<br><br>SEQ ID NO: 28195 |
| | | AA | QSVLTQPPSASGTPGQRVTISCSGSSSNIGSNTVN WYQQLPGTAPKLLIYSNNQRPSGVPDRFSGSKS GTSASLAISGLQSEDEADYYCAAWDDSLNGPVG GGTKLTVL<br><br>SEQ ID NO: 24190 | QITLKESGPTLVKPTQTLTLTCTFSGFSLSTSGVGVG WIRQPPGKALEWLALIYWKDDERYSPSLKSRLTITK DTSKNQVVLTMTNMDPVDTATYYCAHAVAVSFD YWGQGTLVTVSS<br><br>SEQ ID NO: 28196 |
| iPS:468866 | 21-225_190C1 | NA | TCCTATGAGCTGACACAGCCACCCTCGGTGTC AGTGTCCCCAGGACAAACGGCCAGGATCACCT GCACTGGAGATGCAATGCCGAAAAATATGCT TATTGGGACCAGCAGAAGCCAGGCCAGCCCC TGTGCTGGTCATCTCTGAGGACAGCAAGCGAC CCTCCGGGATCCCTGAGAGATTCTCTGGCTCC AGCTCAGGGACAATGGCCCCTTGACTATCAG TGGGGCCCAGGTGGAGGATGAAACTGACTAC GACTGTAACTCAACAGACAGCAGTGGTAATCG GGTGTTCGGCGGAGGGACCAAGCTGACCGTCC TA<br><br>SEQ ID NO: 24191 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGAC TTGAGTGGATGGGATGGATCAACCCTACAGTGG TGGCACAAACTATGCACAGAAGTTCAGGGCAG GGTCACCATGACCAGGGACACGTCCATCAGCAC AGCTACATGGAACTGAGCAGGCTGAGATCTGA CGACACGGCCGTGTATTACTGTGCGAGAGATAG AGCAGTGGCTGGAAAACTACTTCTACTACGGTATG GACGTCTGGGGCCAAGGGACCACGGTCACCGTC TCCTCA<br><br>SEQ ID NO: 28197 |

FIGURE 50
(Continued)

| | | | |
|---|---|---|---|
| iPS-468868 | 21-225_74A1 | AA | SYELTQPPSVSVSPGQTARITCTGDAMPKKYAY WDQQKSGQAPVLVISEDSKRPSGIPERFSGSSSG TMAPLTISGAQVEDETDYDCNSTDSSGNRVFGG GTKLTVL<br>SEQ ID NO: 24192 | QVQLVQSGAEVKKPGASVKVSCKASGYTFTGYYM HWVRQAPGQGLEWMGWINPYSGGTNYAQKFQGR VTMTRDTSISTAYMELSRLRSDDTAVYYCARDRAV AGNYFYYGMDVWGQGTTVTVSS<br>SEQ ID NO: 28198 |
| | | NA | GACATCCAGATGACCCAGTCTCCATCCCCT GTCGGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTACGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATGATAGTTACCCTCTC ACTTTCGGCGGAGGGACCAAGGTGGAGATCA AA<br>SEQ ID NO: 24193 | CAACTGCAGCTGCAGGAGTCGGGCCCGGACTG GTGAAGCCTTCGGAGACCCTGTCCTCCACCTGCA CTGTCTCTGGTGCTCCATCAGCGGTAGTAGTTA CTACTGGGGCTGGATCCGCCAGCCCCCGGGAA GGGGCTGGAGTGGATTGGGAATATCTATTATAGT GGGAGCACCTACCACAACCCGTCCCTCAAGAGTC GAGTCACCATATCCGTGGACACGTCCAAGAACC AGTTCTCCCTGAAGCTGACCTCTGTGACCGCCGC AGACACGGCTGTGTTTACTGTGCGAGACATGAT TTACTTTGGTCCCTTGACTTCTGGGGCCAGGGAA TTCTGGTCACCGTCTCCTCA<br>SEQ ID NO: 28199 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHDSYPLTFGGG AKVEIK<br>SEQ ID NO: 24194 | QLQLQESGPGLVKPSETLSLTCTVSGGSISGSSYYW GWIRQPPGKGLEWIGNIYYSGSTYHNPSLKSRVTIS VDTSKNQFSLKLTSVTAADTAVFYCARHDLLWSLD FWGQGILVTVSS<br>SEQ ID NO: 28200 |

FIGURE 50
(Continued)

| | | | |
|---|---|---|---|
| iPS:468870 | 21-225_74A8 | NA | GACATCGTGATGACCCAGTCTCCAGACTCCCT GGCTGTGTCTCTGGGCGAGAGGGCCACCATCA ACTGCAAGTCCAGCCAGTGTTTTGTACAGC TCCAACAGTGCCACAACTACTTAGCTGTACCA GCAGAAACCAGGACAGCCTCCTAAACTGCTCA TTTACTGGGCATCTACCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCGTGCAGTTTGGCCAGGG GACCAAGCTGGAGATCAAA<br>SEQ ID NO: 24195 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCTCTGGACAAGGAC TTGAGTGGATGGATGGATGATGCACCTAACAGTGG TAACACAGGCTATGCACCAGAACACCTCCAGGGCAG AGTCACCATGACCAGGAACACCTCCATAAGCAC AGCCTACATGGAGCTGAGCAGCCTGAGATCTGA GGACTCGGCCGTATATTACTGTGCGTATAGTAGT GGCTGGTACAAATTTGACTACTGGAGCCAGGGA ACCCTGGTCACCGTCTCCTCA<br>SEQ ID NO: 28201 |
| | | AA | DIVMTQSPDSLAVSLGERATINCKSSQSVLYSSN SHNYLAWYQQKPGQPPKLLIYWASTRESGVPDR FSGSGSGTDFTLTISSLQAEDVAVYYCQQYYSTP CSFGQGTKLEIK<br>SEQ ID NO: 24196 | QVQLVQSGAEVKKPGASVKVSCKASGYTFTNYDIN WVRQASGQGLEWMGWMHPNSGNTGYAQKFQGR VTMTRNTSISTAYMELSSLRSEDSAVYYCAYSSGW YKFDYWSQGTLVTVSS<br>SEQ ID NO: 28202 |
| iPS:472730 | 21-225_14B1_LC1 | NA | GACATCCAGATGACCCAGTCTCCATCCTACCT GTCTGCATCTGTAGGAGACAGAGTCACCATCA CTTGCCGGGCAAGTCAGGACATTAGAGATAAT TTAGGCTGGTATCAGCAGAAACCAGGGAAAG CCCCTAAACGCCTGATCTATACTGCATACAGT TTGCAAAGTGGGGTCCCATCAAGGTTCAGCGG CAGTGGATCTGGGACAGAATTCACTCTCACAA TCAGCAGCCTGCAGCCTGAGGATTTTGCAACT TATTACTGTCTACAACATTATAATTACCCGCTC ACTTTCGGCGGAGGGACCAAGGTGGAGATCA AA<br>SEQ ID NO: 24197 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTAGTACCAT GAACTGGGTCCGCCAGGCTCCAGGGAAGGGCT GGAGTGGGTCTCATCCATAAGTGGTAGTAGTAGT TACTTATATACCAGATCAGTGAAGGGCCGAT TCACCATCTCCAGAGACAACGCCAAGAACTCTCT GTATCTGCAAATGAACAGCCTGAGAGCCGAGGA CACGGCTGTGTATTACTGTGCGAGAGATAGAGGC AGCAGCTGGGCCCAGGGAACCCTGGTCACCGTC TCCTCA<br>SEQ ID NO: 28203 |

FIGURE 50
(Continued)

| | | | |
|---|---|---|---|
| iPS:472731 | 21-225_14B1_LC2 | AA | DIQMTQSPSYLSASVGDRVTITCRASQDIRDNLG WYQQKPGKAPKRLIYTAYSLQSGVPSRFSGSGS GTEFTLTISSLQPEDFATYYCLQHYNYPLTFGGG TKVEIK<br>SEQ ID NO: 24198 | EVQLVESGGGLVKPGGSLRLSCAASGFTFSSYTMN WVRQAPGKGLEWVSSISGSSSYLYYPDSVKGRFTIS RDNAKNSLYLQMNSLRAEDTAVYYCARDRGSSW GQGTLVTVSS<br>SEQ ID NO: 28204 |
| | | NA | TCCTTTGAGCTGACTCAGCCACCCTCAGTGTCC GTGTCCCCAGGACAGAGCAGCCAGCATCACCTG CTCTGGAGATAAATTGGGGGATAAAATATGCTT ACTGGTATCAGCAGAAGCCAGGCCAGTCCCCT GTGTTGGTCATCTATCAAGATAGGAAGCGCCC CTCAGGGATCCCTGAGCGATTCTCTGGCTCCA ACTCTGGGAACACAGCCACTCTGACCATCAGC GGGACCCAGGCTATGGATGAGGCTGACTATTA CTGTCAGGCGTGGGACAACAGCACTGTGGTGT TCGGCGGAGGGACCAAGCTGACCGTCCTA<br>SEQ ID NO: 24199 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATACCAT GAACTGGGTCCGCCAGGCTCCAGGGAAGGGGCT GGAGTGGGTCTCATCCATAAGTGGTAGTAGTAGT TACTTATACTACCCAGACTCAGTGAAGGGCCGAT TCACCATCTCCAGAGACAACGCCAAGAACTCTCT GTATCTGCAAATGAACAGCCTGAGAGCCGAGGA CACGGCTGTGTATTACTGTGCGAGAGATAGAGGC AGCAGCTGGGGCCAGGGAACCCTGGTCACCGTC TCCTCA<br>SEQ ID NO: 28205 |
| | | AA | SFELTQPPSVSVSPGQTASITCSGDKLGDKYAYW YQQKPGQSPVLVIYQDRKRPSGIPERFSGSNSGN TATLTISGTQAMDEADYYCQAWDNSTVVFGGG TKLTVL<br>SEQ ID NO: 24200 | EVQLVESGGGLVKPGGSLRLSCAASGFTFSSYTMN WVRQAPGKGLEWVSSISGSSSYLYYPDSVKGRFTIS RDNAKNSLYLQMNSLRAEDTAVYYCARDRGSSW GQGTLVTVSS<br>SEQ ID NO: 28206 |

FIGURE 50
(Continued)

| | | | |
|---|---|---|---|
| iPS:472732 | 21-225_2B10_LC1 | NA | GATGTTGTGATGACTCAGTCTCCACTCTCCCTG CCCGTCACCCTTGGACAGCCGGCCTCCATCTC CTGCAGGTCTAGTCAAAGCCTCGTATACAGTG ATGGAAACACCTTCTTGAATTGGTTTCAGCAG AGGCCAGGCCAATCTCCAAGGCGCCTAATTTA TAAGGTTTCTAACTGGGACTCTGGGGTCCAG ACAGATTCAGCGGCAGTGGGTCAGGCACTGGT TTCACACTGAAAATCAGCAGGGTGGAGGCTGA GGATGTTGGGGTTTATTACTGCATACAAGTA CGCACTGGCCTTTCCCCTCGGCCAAGGGACA CGACTGGAGATTAAA <br><br>SEQ ID NO: 24201 | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGTCAT GCACTGGGTCCGCCAGGCTCCAGGCAAGGGGCT GGAGTGGGTGGCGGTTATATGGTATGATGGAAGT AATAAATACTATGCAGACTCCGTGAAGGTCCGAT TCACCGTCTCCAGAGACAATTCCAAGAACACGCT GTCTCTGCAAATGAACAGCCTGAGAGCCGAGGA CACGGCTGTGTATTACTGTGCGAGAGAGATAT ACCAGTGGCTATGACTACGGTATGGACGTCT GGGGCCAAGGGACCACGGTCACCGTCTCCTCA <br><br>SEQ ID NO: 28207 |
| | | AA | QVQLVESGGGVVQPGRSLRLSCAASGFTFSSYVMH WVRQAPGKGLEWVAVIWYDGSNKYYADSVKVRF TVSRDNSKNTLSLQMNSLRAEDTAVYYCARERYTS GWYDYGMDVWGQGTTVTSS <br><br>SEQ ID NO: 28208 |
| iPS:472733 | 21-225_2B10_LC2 | NA | CAGTCTGCCCTGACTCAGCCTGCCTCCGTGTCT GGGTCTCCTGGACAGTCGATCACCATCTCCTG CACTGGAACCAGCAGTGACGTTGGTGGTTATA ATTTTGTCTCTGGTACCAACAGCACCCAGAC AAAGCCCCCAAACTCATGATTTATGAGGTCAG TAATCGGCCCTCAGGGGTTTCTAATCGCTTCTC TGGCTCCAAGTCTGGCAACACGGCCTCCCTGA CCATCTCTGGGCTCCAGGCTGAGGACGAGGCT GATTATTACTGCAGCTCATATACAAGCACCGG CACTGTGTAATCGGCGGAGGGACCAAACTG ACCGTCCTA <br><br>SEQ ID NO: 24203 | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGTCAT GCACTGGGTCCGCCAGGCTCCAGGCAAGGGGCT GGAGTGGGTGGCGGTTATATGGTATGATGGAAGT AATAAATACTATGCAGACTCCGTGAAGGTCCGAT TCACCGTCTCCAGAGACAATTCCAAGAACACGCT GTCTCTGCAAATGAACAGCCTGAGAGCCGAGGA CACGGCTGTGTATTACTGTGCGAGAGAGATAT ACCAGTGGCTGTATGACTACGGTATGGACGTCT GGGGCCAAGGGACCACGGTCACCGTCTCCTCA <br><br>SEQ ID NO: 28209 |

FIGURE 50
(Continued)

| | | | | |
|---|---|---|---|---|
| | | | AA | QSALTQPASVSGSPGQSITISCTGTSSDVGGYNFV SWYQQHPDKAPKLMIYEVSNRPSGVSNRFSGSK SGNTASLTISGLQAEDEADYYCSSYTSTGTVVIG GGTKLTVL<br>SEQ ID NO: 24204 | QVQLVESGGGVVQPGRSLRLSCAASGFTFSSYVMH WVRQAPGKGLEWVAVIWYDGSNKYYADSVKVRF TVSRDNSKNTLSLQMNSLRAEDTAVYYCARERYTS GWYDYGMDVWGQGTTVTSS<br>SEQ ID NO: 28210 |
| iPS:473253 | 21-225_7C3_LC1 | | NA | GACATCCAGATGACCCAGTCTCCATCCTCCCT GTCTGCATCTGTAGGAGACAGAGTCACCATCA CTTGCCGGGCAAGTCAGGGCATTAGAAGTGAT TTAGGCTGGTATCAGCAGAAATCCAGTCAAAGC CCCTAAGCGCCTGATCTATGCTGCATCCAGTTT GCAAAGTGGGGTCCCATCGAGGTTCAGCGGCA GTGGATCTGGGACAGAATTCACTCTCACAGTC AGCAGCCTGCAGCCTGAAGATTTTGCATTTTA TTACTGTCTACAGCATAATAGTTACCTCCCCAT CACCTTCGGCCAAGGGACACGACTGGAAATTA AA<br>SEQ ID NO: 24205 | CAGGTGCAGCTGGTACAGTCTGGGGCTGAGGTG AAGAAGCCTGGGGCCTCAGTGAAGGTCCTGC AAGGCTTCTGGATACACCTTCAGCTACTATT TGCACTGGGTGCGACAGGCCCCTGGACAAGGTCT TGAGTGGATGGGATGGATCCACCTAACAGTGGT GGCACAAACTATGCACAGAAGTTTCAGGGCAGG GTCACCATGACCAGGGACACGTCCATCAGCACA GCCTACATGGAGCTGAGCAGCCTGAGATCTGAC GACACGGCCGTGTATTCTGTGCGAGAGATGGTA CCAGCTCGTTTGACTACTGGGGCCAGGGAACCCT GGTCACCGTCTCCTCA<br>SEQ ID NO: 28211 |
| | | | AA | DIQMTQSPSSLSASVGDRVTITCRASQGIRSDLG WYQQNPVKAPKRLJYAASSLQSGVPSRFSGSGS GTEFTLTVSSLQPEDFAFYYCLQHNSYLPITFGQ GTRLEIK<br>SEQ ID NO: 24206 | QVQLVQSGAEVKKPGASVKVSCKASGYTFNDYYL HWVRQAPGQGLEWMGWIHPNSGGTNYAQKFQGR VTMTRDTSISTAYMELSSLRSDDTAVYSCARDGTSS FDYWGQGTLVTVSS<br>SEQ ID NO: 28212 |

FIGURE 50
(Continued)

| | | | |
|---|---|---|---|
| iPS:473254 | 21-225_7C3_LC2 | NA | GACATCCAGATGACCCAGTCTCCATCTTCCGT GTCTGCATCTCTAGGAGACAGAGTCACCATCA CTTGTCGGGCGAGTCAGGGTATTAGCAGCTGG TTAGCCTGGTATCAGCAGAAACAAGGGAAAG CCCCTAAGCTCCTGATCTTTGCTGCATCCAGGT TGCAAAGTGGGGCCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A |
| | | | SEQ ID NO: 24207 |
| | | AA | DIQMTQSPSSVSASLGDRVTITCRASQGISSWLA WYQQKPGKAPKLLIFAASRLQSGAPSRFSGSGS GTDFTLTISSLQPEDFATYYCQQANSFPFTFGPGT KVDIK |
| | | | SEQ ID NO: 24208 |
| | | | CAGGTGCAGCTGGTACAGTCTGGGGCTGAGGTG AAGAAGCCTGGGGCCTCAGTGAAGGTCTCCTGC AAGGCTTCTGGATACACCTTCAACGACTACTATT TGCACTGGGTGCGACAGGCCCCTGGACAAGGTCT TGAGTGGATGGGATGGATCCACCCTAACAGTGGT GGCACAAACTATGCACAGAAGTTTCAGGCAGG GTCACCATGACCAGGGACACGTCCATCAGCACA GCCTACATGGAGCTGAGCAGCCTGAGATCTGAC GACACGGCCGTGTATTCCTGTGCGAGAGATGGTA CCAGCTCGTTTGACTACTGGGGCCAGGGAACCCT GGTCACCGTCTCCTCA |
| | | | SEQ ID NO: 28213 |
| iPS:473255 | 21-225_9F12_LC1 | NA | QVQLVQSGAEVKKPGASVKVSCKASGYTFNDYYL HWVRQAPGQGLEWMGWIHPNSGGTNYAQKFQGR VTMTRDTSISTAYMELSSLRSDDTAVYSCARDGTSS FDYWGQGTLVTVSS |
| | | | SEQ ID NO: 28214 |
| | | | CAGGTGCAGCTGGTACAGTCTGGGGCTGAGGTG AAGAAGCCTGGGGCCTCAGTGAAGGTCTCCTGC AAGGCTTCTGGATACACCTTCGCCGACTACTATT TGCACTGGGTGCGACAGGCCCCTGGACAAGGTCT TGAGTGGATGGGATGGATCCACAGAAGTTTCAGGCAGG GGCACAAACTTTGCACAGAAGTTTCAGGCAGG GTCACCATGACCAGGGACACGTCCATCAGCACA GCCTACTGGAACTGAGCAGTCTGAGATCTGACG ACACGGCCTTCTATTACTGTGCGAGAGATGGTAC ACACGGCTCGTTTGACTACTGGGGCCAGGGAACCCTG GTCACCGTCTCCTCA |
| | | | SEQ ID NO: 28215 |
| | | | SEQ ID NO: 24209 |

FIGURE 50
(Continued)

| | | | | |
|---|---|---|---|---|
| iPS:473256 | | AA | DIQMTQSPSSVSASVGDRVTITCRASQGISRWLAWYQQKPGKAPKLLIYAASRLQSGVPSRFSGSGSGTDFTLTISGLLPEDFAIYYCQQANSFPFTFGPGTKVDFK<br>SEQ ID NO: 24210 | QVQLVQSGAEVKKPGASVKVSCKASGYTFADYYLHWVRQAPGQGLEWMGWIHPNSGGTNFAQKFQGRVTMTRDTSISTAYLELSSLRSDDTAFYYCARDGTSSFDYWGQGTLVTVSS<br>SEQ ID NO: 28216 |
| | 21-225_9F12_LC2 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGTCAAAGCCCCTAAGCGCCTTATCTATGCTGCATCCAGTTTGCAAAGTGGGGTCCCATCAAGGTTCAGCGGCAGTGGATCTGGGACAGACTTCACTCTCACAATCAGCAGCCTGCAGCCTGAAGATATAGTTACCTCCCCATTCACTGTCTACAGCATAATAGTTACCTCCCCATCACCTTCGGCCAAGGGACACGACTGGAGATTAAA<br>SEQ ID NO: 24211 | CAGGTGCAGCTGGTACAGTCTGGGGCTGAGGTGAAGAAGCCTGGGGCCTCAGTGAAGGTCTCCTGCAAGGCTTCTGGATACACCTTCGCCGACTACTATTTGCACTGGGTGCGACAGGCCCCTGGACAAGGTCTTGAGTGGATGGGATGGATCCACCTAACAGTGGTGGCACAAACTTTGCACAGAAGTTTCAGGGCAGGGTCACCATGACCAGGGACACGTCCATCAGCACAGCCTACCTGGAACTGAGCAGTCTGAGATCTGACGACACGGCCTTCTATTACTGTGCGAGAGATGGTACCAGCTCGTTTGACTACTGGGGCCAGGGAACCCTGGTCACCGTCTCCTCA<br>SEQ ID NO: 28217 |
| | | AA | DIQMTQSPSSLSASVGDRVTITCRASQGIRNDLGWYQQKPVKAPKRLIYAASSLQSGVPSRFSGSGSGTEFTLTISSLQPEDFATYYCLQHNSYLPITFGQGTRLEIK<br>SEQ ID NO: 24212 | QVQLVQSGAEVKKPGASVKVSCKASGYTFADYYLHWVRQAPGQGLEWMGWIHPNSGGTNFAQKFQGRVTMTRDTSISTAYLELSSLRSDDTAFYYCARDGTSSFDYWGQGTLVTVSS<br>SEQ ID NO: 28218 |

FIGURE 50
(Continued)

| | | | | |
|---|---|---|---|---|
| iPS:472742 | 21-225_30D9_LC2 | NA | TCCTATGAGCTGACTCAGCCACCCTCAGTGTC CGTGTCCCCAGGACAGACAGCAGCCAGCATCACCT GCTCTGGAGATAAATTGGGGGATAAATATGTT TACTGGTTTCAGCAGAAGCCAGGCCAGTCCCC TGTGCTAGTCATCTATCAAGATAGGAAGCGGC CCTCAGGGATCCCTGAGCGATTCTCTGGCTCC AACTCTGGGAACACAGCCACTCTGACCATCAG CGGGACGCAGGCTCTGGATGAGGCTGACTATT ACTGTCAGGCGTGGGACAACAGCACTGCGGTA TTCGGCGGAGGGACCAAGCTGACCGTCCTA<br><br>SEQ ID NO: 24213 | CAGGTGAAACTGGTGCAGTCTGGGGCTGAGGTG GAGAAGCCTGGGGCCTCAGTGAAGGTCTCCTGC AAGGCTTCAGGATACACCTTCACCGGCTACTATC TGCACTGGGTGCGACAGGCCCCTGGACAAGGGC TTGAGTGGATGGGATGGATCAACCTAACAGTGG TGGCACAAACTATGCACAGAAGTTTCAGGGCAG GGTCACCATGACCAGGGACACGTCCATCAGCAC AGCCTACATGGAGCTGAGCAGGCTGAGATCTGA CGACACGGCCGTGTATTACTGTGCGAGAGTGTAT TACTATGGTTCGGGGAGTTATTATAACGAGTTTG ACAACTGGGGCCAGGGAACCCTGGTCACCGTCTC CTCA<br><br>SEQ ID NO: 28219 |
| | | AA | SYELTQPPSVSVSPGQTASITCSGDKLGDKYVY WFQQKPGQSPVLVIYQDRKRPSGIPERFSGSNSG NTATLTISGTQALDEADYYCQAWDNSTAVFGG GTKLTVL<br><br>SEQ ID NO: 24214 | QVKLVQSGAEVEKPGASVKVSCKASGYTFTGYYL HWVRQAPGQGLEWMGWINPNSGGTNYAQKFQGR VTMTRDTSISTAYMELSRLRSDDTAVYYCARVYYY GSGSYYNEFDNWGQGTLVTVSS<br><br>SEQ ID NO: 28220 |
| iPS:472741 | 21-225_30D9_LC1 | NA | GATGTCGTGATGACTCAGTCTCCACTCTCCCTG CCCGTCACCCTTGGACAGCCGGCCTCCATCTC CTGCAGGTCTAGTCAAAGCCTCGTATCCAGTG ATGGAAACACCTTCTTGAATTGGTTTCAGCAG AGGCCAGGCCAATCTCCAAGGCGCCTAATTTA TAAGGTTTCTAACTGGGACTCTGGGGTCCCAG ACAGATTCAGCGGCAGTGGGTCAGGCACTGAT TTCACACTGAAAATCAGCAGGTTGGAGGCTGA GGATGTTGGGGTTTATTACTGCTGCAAGGTA CACACTGGCCCTCACCTTCGGCCAAGGGACA CGACTGGAGATTAAA<br><br>SEQ ID NO: 24215 | CAGGTGAAACTGGTGCAGTCTGGGGCTGAGGTG GAGAAGCCTGGGGCCTCAGTGAAGGTCTCCTGC AAGGCTTCAGGATACACCTTCACCGGCTACTATC TGCACTGGGTGCGACAGGCCCCTGGACAAGGGC TTGAGTGGATGGGATGGATCAACCTAACAGTGG TGGCACAAACTATGCACAGAAGTTTCAGGGCAG GGTCACCATGACCAGGGACACGTCCATCAGCAC AGCCTACATGGAGCTGAGCAGGCTGAGATCTGA CGACACGGCCGTGTATTACTGTGCGAGAGTGTAT TACTATGGTTCGGGGAGTTATTATAACGAGTTTG ACAACTGGGGCCAGGGAACCCTGGTCACCGTCTC CTCA<br><br>SEQ ID NO: 28221 |

FIGURE 50
(Continued)

| | | | | |
|---|---|---|---|---|
| iPS:472743 | 21-225_68G6 | AA | DVVMTQSPLSLPVTLGQPASISCRSSQSLVSSDGNTFLNWFQQRPGQSPRRLIYKVSNWDSGVPDRFSGSGSGTDFTLKISRLEAEDVGVYYCLQGTHWPLTFGQGTRLEIK<br>SEQ ID NO: 24216 | QVKLVQSGAEVEKPGASVKVSCKASGYTFTGYYLHWVRQAPGQGLEWMGWINPNSGGTNYAQKFQGRVTMTRDTSISTAYMELSRLRSDDTAVYYCARVYYYGSGSYYNEFDNWGQGTLVTVSS<br>SEQ ID NO: 28222 |
| | | NA | TCCTATGAGGTGACTCAGCCACCCTCAGTGTCCGTGTCCCCAGGACAGACAGGCCAGCATCACCTGCTCTGAGATAAATTGGGGATAAATATACTTACTGGTATCAGCAGAAGCCAGGCCAGTCCCCTTTCCTGGTCATCTATCAAGATAGGAAGCGGCCCTCAGGGATCCCTGACCGATTCTCTGGCTCCAACTCTGGGAACACAGCCACTCTGGATGCGGTACGGGACCAGGCGTGGGAGGACAATAGTACTGCGGTATTCGGCGGAGGGACCAAGCTGACCGTCCTA<br>SEQ ID NO: 24217 | CAGGTGCAGTTGGTGCAGTTTGGGGGTGAGGTGAAGAAGCCTGGGTCCTCAGTGAAGGTNTCCTGCAAGGCTTCAGGATACACCTTCACCGGYTACTATATGCACTGGGTGCGACAGGCCCCTGGACAAGGGCTTGAGTGGATGGGATCGATCTACCGTAACAGTGGTGGCACAAATTATGCACAGAAGTTTCAGGGCAGGGTCACCATGACCAGGGACAAGTCCATCAGCACCGCCTACATGGAGAAGCAGGATCAGATCTGATGACACGGCCGTGTATTACTGTGCGAGAGCTTTTACTATGGTTCGGGGACTTATTATAACGAATTGACTACTGGGGCCAGGGAACCCTGGTCACCGTCTCCTCA<br>SEQ ID NO: 28223 |
| | | AA | SYEVTQPPSVSVSPGQTASITCSGDKLGDKYTYWYQQKAGQSPFLVIYQDRKRPSGIPDRFSGSNSGNTATLTISGTQAMDAADFYCQAWDNSTAVFGGGTKLTVL<br>SEQ ID NO: 24218 | QVQLVQFGGFVKKPGSSVKVSCKASGYTFTGYYMHWVRQAPGQGLEWMGSIYRNSGGTNYAQKFQGRVTMTRDKSISTAYMEKSRIRSDDTAVYYCARAFYYGSGTYYNEFDYWGQGTLVTVSS<br>SEQ ID NO: 28224 |

FIGURE 50
(Continued)

| | | | | |
|---|---|---|---|---|
| iPS:392573 | 21-225_15G2 | NA | CAGTCTGCCCTGACTCAGCCTGCCTCCGTGTCTGGGTCTCCTGGACAGTCGATCACCATCCTGCACTGGAACCAGCAGTGACGTTGGTGGTTATAACTATGTCTCCTGGTACCAACAGCACCAGGCAAAGCCCCCAAACTCATGATTTATGAGGTCAGTAATCGGCCCTCAGGGGTTTCTAATCGCTTCTCTGGCTCCAAGTCTGGCAACACGGCCTCCCTGACCATCTGGGCTCCAGGCTGAGGACGAGGCTGATTATTACTGCACCTCATATACAAGCACCAGCACTGTGGTCTTCGGCGGAGGGACCAAGCTGACCGTCCTA | CAGATCACCTTGAAGGAGTCTGGTCCTACGCTGGTGAAACCCACACAGACCCTCACGCTGACCTGCACCTTCTCTGGATTCTCACTCAGCACTAGTGGAGTGGGTGTGGGCTGGATCCGTCAGCCCCCAGGAAAGGCCCTGGAGTGGCTTGCACTCATTTATTGGAATGATGATAAGCGCTACAGCCCATCTGAAGAGCAGGCTCACCATCACCAAGGACACCTCCAAAAACCAGGTGGTCCTTACAATGACCAACATGGACCCTGTGGACACAGCCACATATTACTGTCAGACACCGGTGTCAGCTGCTATTTCACTATTGGGGCCAGGGAACCCTGGTCACCGTCCTCTCA |
| | | | SEQ ID NO: 24219 | SEQ ID NO: 28225 |
| | | AA | QSALTQPASVSGSPGQSITISCTGTSSDVGGYNYVSWYQQHPGKAPKLMIYEVSNRPSGVSNRFSGSKSGNTASLTISGLQAEDEADYYCTSYTSTSTVVFGGGTKLTVL | QITLKESGPTLVKPTQTLTLTCTFSGFSLSTSGVVGWIRQPPGKALEWLALIYWNDDKRYSPSLKSRLTITKDTSKNQVVLTMTNMDPVDTATYYCADTGVSCCYFHYWGQGTLVTVSS |
| | | | SEQ ID NO: 24220 | SEQ ID NO: 28226 |
| iPS:392583 | 21-225_10B10 | NA | TCCTATGAGCTGACTCAGCCACCCTCAGTGTCCGTGTCCCAGGACAGACAGCCAGCATCACCTGCTCTGGAGATAACATTGGGAATAAATATGCTTGGTACCAGCAGAAGCCAGGCCAGTCCCCTGTGCTGGTGATCTATCAAGATAGGAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTACTGTCAGGCGTGGGACAACAGCACTGTGGTTTTCGGCGGAGGGACCAAACTGACCGTCCTA | CAGATCACCTTGAAGGAGTCTGGTCCTACGCTGGTGAAACCCACACAGACCCTCACGCTGACCTGCACCTTCTCTGGGTTCTCACTCAGCACTGGTGGAGTGGGTGTGGGCTGGATCCGTCAGCCCCCAGGAAAGGCCCTGGAGTGGCTTGTATTCATTTATTGGAGTGATGATAAGCGCTACAGCCCATCTGAAGAGCAGGCTCCATCACCAAGGACACCTCCAAAAACCAGGTGGTCCTTACAATGACCAACATGGACCCTGTGGACACAGCCACATATTACTGTCACGTATAGCAGCAGTTGCCTTGACTACTGGGGCCAGGGAACCCTGGTCACCGTCTCCTCA |
| | | | SEQ ID NO: 24221 | SEQ ID NO: 28227 |

FIGURE 50
(Continued)

| | | | |
|---|---|---|---|
| iPS:392585 | 21-225_14H11 | AA | SYELTQPPSVSVSPGQTASITCSGDKLGNKYAW WYQQKPGQSPVLVIYQDRKRPSGIPERFSGSNSG NTATLTISGTQAMDEADYYCQAWDNSTVFGG GTKLTVL<br>SEQ ID NO: 24222 | QITLKESGPTLVKPTQTLTLTCTFSGFSLSTGGVGVG WIRQPPGKALEWLVFIYWSDDKRYSPSLKSRLSITK DTSKNQVVLTMTNMDPVDTATYYCARIAAVAPDY WGQGTLVTVSS<br>SEQ ID NO: 28228 |
| | | NA | ACCTATGAGCTGACTCAGCCATCCTCAGTGTC CGTGTCCCAGGACAGACAGCCAGCATCACCT GCTCTGGAGATAAATTGGGGGAAAAATATGTT TGCTGGTATCAGCAGAAGCCAGGCCAGTCCCC TGTGCTGGTCTATATATCCTGAGCGATTCTCTGGCTCC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAAGCTGACCGTCCTA GGCGGAGGGACCAAGCTGACCGTCCTA<br>SEQ ID NO: 24223 | CAGGTGCAGCTGGTGCAGTCTGGGGCTGAGGTG AAGAAGCCTGGGGCCTCAGTGAAGGTCTCCTGCC AGGGTTCTGGATACACCTTCACCGGCCACTATAT GTGCTGGGTGCGACAGGCCCCTGACAAGGGCT TGAGTGGATGGGATGGATCAACCCTAATAGTGGT GGCACAAACTATGCACAGAAGTTTCAGGGCAGG GTCACCATGACCAGGACACGTCCATCAGCACA GCCTACATGGAGCTGAGCAGGCTGAGATCTGAC GACACGGCCGTGTATTACTGTGCGGCTGGATATT GTAGTAGTTCCAGCTGCTATTTGCAACCGGTTA TTACGGTATGGACGTCTGGGGCCAAGGGACCAC GGTCACCGTCTCCTCA<br>SEQ ID NO: 28229 |
| | | AA | TYELTQPSSVSVSPGQTASITCSGDKLGEKYVCW YQQKPGQSPVLVIYQDTKRPSGIPERFSGSNSGN TATLTISGTQAMDEADYYCQAWDSSTIFGGGTK LTVL<br>SEQ ID NO: 24224 | QVQLVQSGAEVKKPGASVKVSCQGSGYTFTGHYM CWVRQAPGQGLEWMGWINPNSGGTNYAQKFQGR VTMTRDTSISTAYMELSRLRSDDTAVYYCAAGYCS SSSCYLQPGYYGMDVWGQGTTVTVSS<br>SEQ ID NO: 28230 |

FIGURE 50
(Continued)

| | | | |
|---|---|---|---|
| iPS:392587 | 21-225_18G5 | NA | TCCTATGAGCTGACTCAGCCACCCTCAGTGTCCGTGTCCCCAGGACAGACAGCCAGCATCACCTGCTCTGGAGAGAAATTGGGGGATAAATATGTTTGTTGGTATCAGCAGAAGCCAGGCCAGTCCCCTGTGCTGGTCATCTATCAAGATAGCAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTACTGTCAGGCGTGGAACAGCAGCAATGTGGTATTCGGCGGAGGGACCAAGCTGACCGTCCTA<br>SEQ ID NO: 24225 | CAGATCACCCTTGAAGGAGTCTGGTCCTACGCTGGTGAAACCCACAGAGACCCTCACGCTGACCTGCACCTTCTCTGGGTTCTCACTCAGCACTAGTGGAGTGGGTGTGGGCTGGATCCGTCAGCCCCCAGGAAAGGCCCTGGAGTGCCTTTCACTCATTTATTGGAATGATGATAAGGTCTACAGCCCATCTCTGAAGAGCAGGCTCACCATCACCAAGTACACCTCCAAAAACCAGGTGGTCCTTACAACTGACCAATGGACCCTGTGGACACAGCCACATATTACTGTGCACACAGGGACAGCAGCTGCCCTGACTACTGGGGCCAGGGAACCCTGGTCACCGTCTCCTCA<br>SEQ ID NO: 28231 |
| | | AA | SYELTQPPSVSVSPGQTASITCSGEKLGDKYVCWYQQKPGQSPVLVIYQDSKRPSGIPERFSGSNSGNTATLTISGTQAMDEADYYCQAWNSSNVVFGGGTKLTVL<br>SEQ ID NO: 24226 | QITLKESGPTLVKPTQTLTLTCTFSGFSLSTSGVGVGWIRQPPGKALECLSLIYWNDDKVYSPSLKSRLTITKYTSKNQVVLTMTNMDPVDTATYYCAHRGQQLALDYWGQGTLVTVSS<br>SEQ ID NO: 28232 |
| iPS:392589 | 21-225_27H2 | NA | TCCTATGAGCTGACTCAGCCACCCTCAGTGTCCGTATCCCCAGGACAGACAGCCAGCATCACCTGCTCTGGAGATAAATTGGGGGATAAATATGCTTCCTGGTATCAGCAGAAGCCAGGCCAGTCCCCTGTTTTTGGTCATCTATCAAGATGGCAAGCGGCCCTCAGGGATCCCTGAGCGATTCTCTGGCTCCAACTCTGGGAACACAGCCACTCTGACCATCAGCGGGACCCAGGCTGTGGACGAGGCTGACTATTACTGTCAGGCGTGGGACAGCAGCACTTATGTGGTATTCGGCGGAGGGACCAAGCTGACCGTCCTA | CAGGTGCAGTTGGTGGAGTCTGGGGGAGGCGTGGTCCAGCCTGGGAGGTCCCTGAGACTCTCCTGTGCAGGGTCTGGATTCACCTTCAGTGGCTATGGCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTTTCTGCAAATGAACAGCCTGAGAGCCGAGGACACGGCTGTGTATTACTGTGCGAGAGATAGGGTATATTGTAGTAGTACCAGCTGCTCCCCTTACTACTACTACTACGGTATGGACGTCTGGGGCCAAGGGACCACGGTCACCGTCTCCTCA |

FIGURE 50
(Continued)

| | | | |
|---|---|---|---|
| iPS:392593 | 21-225_3E10 | AA | SEQ ID NO: 24227<br>SYELTQPPSVSVSPGQTASITCSGDKLGDKYASWYQQKPGQSPVLVIYQDGKRPSGIPERFSGSNSGNTATLTLSGTQAMDEADYYCQAWDSSTYVFGGGTKLTVL | SEQ ID NO: 28233<br>QVQLVESGGGVVQPGRSLRLSCAASGFTFSGYGMHWVRQAPGKGLEWVAVIWYDGSNKYYADSVKGRFTISRDNSKNTLFLQMNSLRAEDTAVYYCARDRVYCSSTSCSPYYYYGMDVWGQGTTVTVSS |
| | | NA | SEQ ID NO: 24228<br>TCCTATGAGCTGACTCAGCCACCACTCAGTGTCAGTGCCACACCAGAGATGGCCAGGATCACCTGTGGGGAAACAACATTGGAAGTAAAGCTGTGCACTGGTACCAGCAAAAGCCAGGACCAGGACCCTGTGCTGGTCATCTATAGCGATAGCAACCGGCCCTCAGGGATCCCTGAGCGATTCTCTGGCTCCAACCCAGGGAACACCGCCACCTAACCATCAGCAGGATCGAGGCTGGGGATGAGGCTGACTATTACTGTCAGGTGTGGGACAGTAGTACTGATCATGTGGTATTCGGCGGAGGGACCAAGCTGACCGTCCTA | SEQ ID NO: 28234<br>CAGATCACCTTGAAGGAGTCTGGTCCTACGCTGGTGAAACCACACAGACCCTCACGCTGACCTGCACCTTCTCTGGGTTCTCACTCAATACTGGTGAGTGGGTGTGGGCTGGATCCGTCAGCCCCAGGAAAGGCCCTGGAGTGGCTTGCACTCATTTATTGGAATGATGATAAGCGCCACAGCCATCTCTGAAGACCAGGCTCACCATCACCAAAGACACCTCCAAAACCAGGTGGTCCTTACAATGACCACCATGGCCCCTGTGGACACAGCCACATATTACTGTGCACACCTTATAGAAGTGGCCTTTGACTATTGGGGCCAGGGAACCCTGGTCACCGTCTCCTCA |
| | | AA | SEQ ID NO: 24229<br>SYELTQPHSVSVATAQMARITCGGNNIGSKAVHWYQQKPGQDPVLVIYSDSNRPSGIPERFSGSNPGNTATLTISRIEAGDEADYYCQVWDSSSDHVFGGGTKLTVL | SEQ ID NO: 28235<br>QITLKESGPTLVKPTQTLTLTCTFSGFSLNTGGVGVGWIRQPPGKALEWLALIYWNDDKRHSPSLKSRLTITKDTSKNQVVLTMTHMAPVDTATYYCAHLIEVAFDYWGQGTLVTVSS |
| | | | SEQ ID NO: 24230 | SEQ ID NO: 28236 |

FIGURE 50
(Continued)

| | | | |
|---|---|---|---|
| iPS:392596 | 21-225_12D8 | NA | CTGCCTGTGCTGCTGACTCAGCCCCCGTCTGCATCT GCCTTGCTGGGAGCCTCGATCAAGCTCACCTG CACCCTAAGCAGTGAGCACAGCAGCCTACACCA TCGAATGGTATCAACAGAGACCAGGAGGTC CCCCCAGTATATAATGAAGGTTAAGAGTGATG GCAGCCACAGCAAGGGGACGGGATCCCCGA TCGCTTCATGGGCTCCAGTTCTGGGCTGACC GCTACCTCACCTTCTCCAACCTCCAGTCTGACG ATGAGGATGAGTATCACTGTGGAGAGACCA CACGATTGATGGCCAAGTCGGTTGTGATTCG GCGGAGGACCAAGCTGACCGTCCTA<br><br>SEQ ID NO: 24231 | GAGGTGCAGCTGGTTGTGGAATCTGGGGGAGGCTTGG TACAGCCTGGGGGGTCCCTGAGACTCTCCTGTGC AGCCTCTGGATTCACCTTTAGCAGCTATGTCATG AGCTGGGTCCGCCAGGCTCCAGGGAAGGGGCTG GAGTGGGTCTCAACTATTAGTGTTGGTGGTGTA GCACATACTACGCAGACTCCGTGAAGGGCCGGTT CACCATCTCCAGAGACAATTCCAAGACCACGCTG TATCTGCAAATGAACAGCCTGAGAGCCGAGGAC ACGGCCGTATATTACTGTGCGAAATGGGACGTG GATACAGCTATGAATACTACTACGGTATGGACGT CTGGGGCCAAGGGACCACGGTCACCGTCTCCTCA<br><br>SEQ ID NO: 28237 |
| | | AA | LPVLTQPPSASALLGASIKLTCTLSSEHSTYTIEW YQQRPGRSPQYIMKVKSDGSHSKGDGIPDRFMG SSSGADRYLTFSNLQSDDEYHCGESHTIDGQV GVVFGGGTKLTVL<br><br>SEQ ID NO: 24232 | EVQLLESGGGLVQPGGSLRLSCAASGFTFSSYVMS WVRQAPGKGLEWVSTISVGGGSTYYADSVKGRFTI SRDNSKTTLYLQMNSLRAEDTAVYYCAKWGRGYS YEYYYGMDVWGQGTTVTVSS<br><br>SEQ ID NO: 28238 |
| iPS:392598 | 21-225_18E10 | NA | TCCTATGAACTGACGCAGCCACCCTCAGTGTC CGTGTCCCCAGGACAGACAGCCAGCATCACCT GCTCTGGAGATAGATTGGGGATAAATATGCT TGGTGGTATCAGCAGAAGCCAGGCCAGTCCCC TGTGCTGGTCATATCAAGATGCAAGCGGC CCTCAGGGATCCCTGAGCGATTCTCTGGCTCC AATTCAGGGAACACAGCCACTCTGACCATCAG CGGGACCCAGGCTATGGATGAGGCTGACTATT ACTGTCAGGGTGGGACAGCAGCACAGTGT ATTCGGGCGGAGGGACCAAGCTGACCGTCCTA<br><br>SEQ ID NO: 24233 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGGTGGATCAACCCTAACAGTGG TGGCACAAACTATGCACAGAAGTTTCAGGGCAG GGTCACCATGACCAGGGACTCGTCCATCAACACA GCCTACATGGAGCTGAGCAGGCTGAGATCTGAC GACACGGCCGTGTATTACTGTGCGAGGTCGTACT ACTATGGTTCGGGGAGTTATTATAACGAGTTGA CTACTGGGGCCAGGGAACCCTGGTCACCGTCTCC TCA<br><br>SEQ ID NO: 28239 |

FIGURE 50
(Continued)

| | | | |
|---|---|---|---|
| iPS:392618 | | AA | SYELTQPPSVSVSPGQTASITCSGDRLGDKYAW<br>WYQQKPGQSPVLVIYQDRKRPSGIPERFSGSNSG<br>NTATLTISGTQAMDEADYCQAWDSSTVVFGG<br>GTKLTVL<br>SEQ ID NO: 24234 | QVQLVQSGAEVKKPGASVKVSCKASGYTFTGYYM<br>HWVRQAPGQGLEWMGWINPNSGGTNYAQKFQGR<br>VTMTRDSSINTAYMELSRLRSDDTAVYYCARSYYY<br>GSGSYYNEFDYWGQGTLVTSS<br>SEQ ID NO: 28240 |
| | | NA | GATATTGTGATGACCCAGACTCCACTCTCTCT<br>GTCCGTCATTCCTGGACAGCCGGCCTCCATCT<br>CCTGCAAGTCTAGTCAGAGCCTCCTGCATAGT<br>GATGGAAAGACCCATTTGAATTGGTACCTGCA<br>GAAGCCAGGCCAGCCTCCACAGCTCCTGATCT<br>ATGAAGTTTCCTACCGGTTCTCTGGAGTGCCA<br>GATAGGTTCAGTGGCAGCGGGTCAGGGACAG<br>TTTTCACACTGGAGATCAGCCGGGTGGAGGCT<br>GCGGATGTTGGGGTTTATTACTGCTTTCAAAG<br>TATACAGCTTCCGCTCACTTTCGGCGGAGGGA<br>CCAAGGTGGAGATCAAA<br>SEQ ID NO: 24235 | CAGGTGCAGCTGGTGGAGAGTCTGGGGGAGGCGTG<br>GTCCAGCCTGGGAGGTCCCTGAGACTCTCCTGTG<br>CAGCGTCTGATTCACCTTCAGTGACTGACTGGCAT<br>GCACTGGGTCCGCCAGGCTCCAGGCAAGGGCT<br>GGAGTGGGTGGCAGTCATATGGTATGATGGAAA<br>TAATAAATACTATGTAGACTCCGTGAAGGGCCGA<br>TTCACCATCTCCAGAGACAATTCCAAGAATACGC<br>TGTATCTGCAAATGAACAGCCTGAGAGCCGAGG<br>ACACGGCTGTGTATTACTGTGCGAGAGAGCTTGC<br>CTGGTACGAGGACTACTGGGGCCAGGGAACCCT<br>GGTCACCGTCTCCTCA<br>SEQ ID NO: 28241 |
| | 21-225_16F10 | AA | DIVMTQTPLSLSVIPGQPASISCKSSQSLLHSDGK<br>THLNWYLQKPGQPPQLLIYEVSYRFSGVPDRFSG<br>SGSGTVFTLEISRVEAADVGVYYCFQSIQLPLTF<br>GGGTKVEIK<br>SEQ ID NO: 24236 | QVQLVESGGGVVQPGRSLRLSCAASGFTFSDYGM<br>HWVRQAPGKGLEWVAVIWYDGNNKYYVDSVKG<br>RFTISRDNSKNTLYLQMNSLRAEDTAVYYCARELA<br>WYEDYWGQGTLVTSS<br>SEQ ID NO: 28242 |

FIGURE 50
(Continued)

| | | | |
|---|---|---|---|
| iPS:392620 | 21-225_17H5 | NA | GACATCCAGATGACCCAGTCTCCATCCTCCACT GTCTGCATCTGTAGGAGACAGAGTCACCATCA CTTGTCGGGCGAGTCAGGCATTAGCAATTAT TTAGCCTGGTTTCAGCAGAAACCAGGGAAAGC CCCTAAGTCCCTGATCTATGCTGCATCCAGTTT ACAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAGTATCATAGTTACCCATTCA CTTTCGGCCCTGGGACCAAAGTGGATATCAAA | GAGGTGCAGCTGGTGGAGTCTGGGGGAGGCCTG GTCAAGCCTGGGGGGTCCCTGAGACTCTCCTGTG CAGCCTCTGATTCACCTTCAGTAGTATAGCAT GAACTGGGTCCGCCAGGCTCCAGGGAAGGGCT GGAGTGGGTCTCATCATTAGTAGTAGTAGTACT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGTGGCTTCA TTTGACTACTGGGGCCAGGGAACCCTGGTCACCG TCTCCTCA |
| | | | SEQ ID NO: 24237 | SEQ ID NO: 28243 |
| | | AA | DIQMTQSPSSLSASVGDRVTITCRASQGISNYLA WFQQKPGKAPKSLIYAASSLQSGVPSKFSGSGSG TDFTLTISSLQPEDFATYYCQQYHSYPFTFGPGT KVDIK | EVQLVESGGGLVKPGGSLRLSCAASGFTFSSYSMN WVRQAPGKGLEWVSSISSSSTYIYYADSVKGRFTIS RDNAKNSLYLQMNSLRAEDTAVYYCARVASFDY WGQGTLVTVSS |
| | | | SEQ ID NO: 24238 | SEQ ID NO: 28244 |
| iPS:392622 | 21-225_17H8 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGGTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTACAACT TATTACTGTCTACAGCATAATAGTTACCCACTC ACTTTCGGCGGAGGGACCAAGGTGGAGATCA AA | CAGCTGCAGCTGCAGGAGTCGGGCCCAGGACTG GTGAAGCCTTCGGAGACCCTGTCCTCACCTGCA CTGTCTCTGGTGGCTCCATCAGTAGAAGTAGTTA CTACTGGGGCTGGATCCGCCAGCCCCCAGGGAG GGGCTGGAGTGGATTGGGAATATCTATTATGGT GGGAACACTACTACAACCGTCCCTCCCTCAAGAGTC GAGTCACCATATCCGTAGACACGTCCAAGAACC AGTTCTCCCTGAAGCTGAGCTCTGTGACCGCGC AGACACGGCTGTGTATTACTGTGCGAGACATGGA AAAGACTGGGGCCTTGACTACTACTGGGGCCAGGGA ACCCTGGTCACCGTCTCCTCA |
| | | | SEQ ID NO: 24239 | SEQ ID NO: 28245 |

FIGURE 50
(Continued)

| | | | | |
|---|---|---|---|---|
| | | AA | DIQMTQSPSSLSASVGDRVTITCRASQGIRNDLG WYQQKPGKAPKRLIYGASSLQSGVPSRFSGSGS GTEFTLTISSLQPEDFTTYYCLQHNSYPLTFGGGT KVEIK<br>SEQ ID NO: 24240 | QLQLQESGPGLVKPSETLSLTCTVSGGSISRSSYYW GWIRQPPGRGLEWIGNIYYGGNTYNPSLKSRVTIS VDTSKNQFSLKLSSVTAADTAVYYCARHGKDWGL DYWGQGTLVTVSS<br>SEQ ID NO: 28246 |
| iPS:392624 | 21-225_17H12 | NA | GACATCCAGATGACCCAGTCTCCATCCTCCCT GTCTGCATCTGTAGGAGACAGAGTCACCATCA CTTGCCGGGCAAGTCAGGACATTAGAAATGAT TTAGGCTGGTATCAGCAGAAAGCAGGGAAAG CCCCTAAGCGCCTGATCAATGCTGCATCCAGT TTGCAAAGTGGGGTCCCATCAAGGTTCAGCGG CATTGGCTCTGGGACAGAATTCACTCTCACAA TCACCGGCCTGCAGCCTGAAGATTTTGCAACT TATTACTGTCTACAGCATTATAGTTATATGTTC ACTTTCGGCGGAGGGACCAAGGTGGAGATCA AA<br>SEQ ID NO: 24241 | GAGGTGCAACTGGTGGAGTCTGGGGGAGGCTG GTCAAGCCTGGGGGGTCCCTGAGACTCTCTGTG CAGCCTCTGGATTCACCTTCAGTAGCTATACCAT GAACTGGGTCCGCCAGGCTCCAGGGAAGGGCT GGAGTGGGTCTCATCATTAGTGGTAGTAGTAGT TACATATACTACGCAGACTCAGTGAAGGGCCGAT TCACCATCTCCAGAGAACAACGCCAAGAACTCACT GTATTTGCAAATGAACAGCCTGAGAGCCGAGGA CACGGCTGTATATTACTGTGCAGAGATCGAGGC TCCATCTGGGCCAAGGGACCAATGGTCACCGTCT CTTCA<br>SEQ ID NO: 28247 |
| | | AA | DIQMTQSPSSLSASVGDRVTITCRASQDIRNDLG WYQQKPGKAGKAPKRLINAASSLQSGVPSRFSGIGS GTEFTLTITGLQPEDFATYYCLQHSYSYMFTFGGG TKVEIK<br>SEQ ID NO: 24242 | EVQLVESGGGLVKPGGSLRLSCAASGFTFSSYTMN WVRQAPGKGLEWVSSISGSSSYIYYADSVKGRFTIS RDNAKNSLYLQMNSLRAEDTAVYYCARDRGSIWG QGTMVTVSS<br>SEQ ID NO: 28248 |

FIGURE 50
(Continued)

| | | | |
|---|---|---|---|
| iPS:392626 | 21-225_18A5 | NA | GACATCCAGATGACCCAGTCTCCATCTCCCT GTCTGCATCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGTG GACGTTCGGCCAAGGGACCAAGGTGGAAATC AAA |
| | | | SEQ ID NO: 24243 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPWTFGQG TKVEIK |
| | | | SEQ ID NO: 24244 |
| | | | CAGGTGCAGTTGGTGGAGTCTGGGGGAGGCGTG GTCCAGCCTGGGAGGTCCCTGAGACTCTCCTATA CAGCGTCTGGATTCACCTTCAGTGACTATGGCAT GCACTGGGTCCGCCAGGCTCCAGGCAAGGGGCT GGAGTGGGTGGCAGTTATATGGTTTGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCTTGG CTGACGGAAGAGTACTGGGGCCAGGGAACCCT GGTCACCGTCTCCTCA |
| | | | SEQ ID NO: 28249 |
| | | | QVQLVESGGGVVQPGRSLRLSYTASGFTFSDYGMH WVRQAPGKGLEWVAVIWFDGSNKYYADSVKGRF TISRDNSKNTLYLQMNSLRAEDTAVYYCARDLGW TEEYWGQGTLVTVSS |
| | | | SEQ ID NO: 28250 |
| iPS:392628 | 21-225_20C2 | NA | GACATCCAGATGACCCAGTCTCCATCTCCCT GTCTGCATCTGTACAAGACAGAGTCACCATCA CTTGCCGGGCAAGTCAGGGCATTAGAAATGAT TTAGGCTGGTATCAGCAGAAACCAGGGAAAG CCCCTAAGTCCCTGATCTTTGCTGCATCCAGTT TGCAAAGTGGGGTCCCGTCAAGGTTCAGCGGC AGTGGATCTGGGACAGATTTCACTCTCACAAT CAGCAGCCTGCAGCCTGAACATGCAACTTT ATTACTGTCTCTCAACATGTAGTTACCCGCTCA CTTTCGGCGGAGGGACCAAGGTGGAGATCGA |
| | | | SEQ ID NO: 24245 |
| | | | CAGCTGCAGCTGCAGGAGTCGGGCCCAGGACTG GTGAAGCCTTCGGAGACCCTGTCCCTCACCTGCA CTGTCTCTGGTGGCTCCATCAGCAGAAGTAGTTA CTACTGGGGCTGGATCCGCCAGCCCCAGGGAA GGGGACTGGAGTGGATTGGGAATATCTATTATAGT GGGAGCTGCCACTGTAATTCGTCCCTCAAGAGTC GAGTCATTATATCCGTAGACACGTCCAAGAACCA GTTCTCCCTGAAGCTGAGCTCTGTGACCGCCACA GACACGGCTGTGTATTACTGTGCGAGACATAGTA GCAGCTGGTCCCTTGACAACTGGGGCCAGGGAA CCCTGGTCACCGTCTCCTCA |
| | | | SEQ ID NO: 28251 |

FIGURE 50
(Continued)

| | | | | |
|---|---|---|---|---|
| | | AA | DIQMTQSPSSLSASVQDRVTITCRASQGIRNDLG WYQQKPGKAPKRLIFAASSLQSGVPSRFSGSGSG TEFTLTISSLQPEDFATYYCLQHASYPLTFGGGT KVEIE<br>SEQ ID NO: 24246 | QLQLQESGPGLVKPSETLSLTCTVSGGSISRSSYYW GWIRQPPGKGLEWIGNIYYSGTAYCNSSLKSRVHS VDTSKNQFSLKLSSVTATDIAVYYCARHSSSWSLD NWGQGTLVTVSS<br>SEQ ID NO: 28252 |
| iPS:392630 | 21-225_20E5 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCTGAAGATTTTGCAACT TATTACTGTCTACAGCATAATAGTTACCCGCTC ACTTTCGGCGGAGGGACCAAGGTGGAGATCA AA<br>SEQ ID NO: 24247 | CAGGTGCAGCTGGTGGAGTCTGGGGGAGGCGTG GTCCAGCCTGGGAGGTCCCTGAGACTCTCTGTG CAGCGTCTGGATTCACCTTCAGTGACTATGGCAT GCACTGGGTCCGCCAGGCTCCAGGCAAGGGGCT GGAGTGGGTGGCAGTTATTTGGTATGAAGAAAAT AATCAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACTGGGG TTCCGGTCTGACTACTGGGGCCAGGGAACCCTGG TCACCGTCTCCTCA<br>SEQ ID NO: 28253 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br>SEQ ID NO: 24248 | QVQLVESGGGVVQPGRSLRLSCAASGFTFSDYGM HWVRQAPGKGLEWVAVIWYEENNQYYADSVKGR FTISRDNSKNTLYLQMNSLRAEDTAVYYCARELGF RSDYWGQGTLVTVSS<br>SEQ ID NO: 28254 |

FIGURE 50
(Continued)

| | | | | |
|---|---|---|---|---|
| iPS:392632 | 21-225_16A11 | NA | GACATCCAGATGACCCAGTCTCCATCTCCT GTCTGCATCTGTCGGAGACAGAGTCACCATCT CTTGCCGGGCAAGTCAGGACATTAGAAATCAT TTAGGCTGGTATCAGCGTAACCAGGGAAAGC CCCTAAGCGCCTGATCTATGCTGCATCCAGTTT GCAAAGTGGGGTCCATCAAGGTTCAGCGGCA GTGGATCTGGGACAGAATTCACTCTCACAATC AGCAGCCTGCAGCCTGAAGATTTTGCAACTTA TTACTGTCTACAGTATAATAGTTATCCATTCAC TTTCGGCCCTGGGACCAAAGTGGACATCAAA<br><br>SEQ ID NO: 24249 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTAGTGTAGTAGT CTCATATACTACGCAGACTCAGTGAAGGGCCGAT TCACCATCTGCAAATGAACAGCCTGAGAACTCACT GTATCTGCAAATGAACAGCCTGAGAGCCGAGGA CACGGCTGTGTATTACTGTGCGAGAGTAGCAGCC TTTGACTACTGGGGCCAGGGAACCCTGGTCACCG TCTCCTCA<br><br>SEQ ID NO: 28255 |
| | | AA | DIQMTQSPSSLSASVGDSVTISCRASQDIRNHLG WYQRNPGKAPKRLIYAASSLQSGVPSRFSGSGS GTEFTLTISSLQPEDFATYYCLQYNSYPFTFGPGT KVDIK<br><br>SEQ ID NO: 24250 | EVQLVESGGGLVKPGGSLRLSCAASGFTFSSYSMN WVRQAPGKGLEWVSSISGSSSLIYYADSVKGRFTIS RDNAKNSLYLQMNSLRAEDTAVYYCARVAAFDY WGQGTLVTVSS<br><br>SEQ ID NO: 28256 |
| iPS:392634 | 21-225_17H3 | NA | GACATCCAGATGACCCAGTCTCCATCTCCCT GTCTGCATCTGTAGGAGACAGAGTCACCTTCA CTTGCCGGGCAAGTCAGGGCATTAGAAGTGAT TAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCAATATAGTTACCCTCG GACGTTCGGCCAAGGGACCAAGGTGGAAATC AAA<br><br>SEQ ID NO: 24251 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTGTGTCAT GCACTGGGTCCGCCAGGCTCCAGGCAAGGGGCT GGAGTGGGTGGCAGTTATATGTATGATGGAAGT AATAAATACTATGCAGACTCCGTGAAGGGCCGA TTCACCATCTCCAGAGACAATTCCAAGAACACGC TGTATCTGCAAATGAACAGCTGAGAGCCGAGG ACACGGCTGTGTATTACTGTGCGAGAGAAAAGTA TAGCAGCAGCTGGTACGACTACGGTATGGACGTC TGGGGCCAAGGGACCACGGTCACCGTCTCCTCA<br><br>SEQ ID NO: 28257 |

FIGURE 50
(Continued)

| | | | | |
|---|---|---|---|---|
| iPS:392636 | | AA | DIQMTQSPSSLSASVGDRVTFTCRASQGIRSDLG WYQQKPGKAPKRLIYAASSLQSGVPSRFSGSGS GTEFTLTISSLQPEDFATYYCLQQYSYPRTFGQG TKVEIK<br>SEQ ID NO: 24252 | QVQLVESGGGVVQPGRSLRLSCAASGFTFSNCVMH WVRQAPGKGLEWVAVIWYDGSNKYYADSVKGRF TISRDNSKNTLYLQMNSLRAEDTAVYYCAREKYSS SWYDYGMDVWGQGTTVTVSS<br>SEQ ID NO: 28258 |
| | 21-225_17A6 | NA | GACATCCAGATGACCCAGTCTCCATCCTCCCT GTCTGCATCTGTCGGAGACAGAGTCACCATCA CTTGCCGGGCAAGTCAGAGTCAGACCATTAGCAACTAT TTAAATTGGTATCATCAGAAACCAGGGAAAGC CCCTAAGCTCCTGATCTATGCTGCTTCCAGTTT GCAAAGTGGGGTCCCATCAAGGTTCAGTGGCA GTGGATCTGGGACAGATTTCACTCTCACCATC AGCAGTCTGCAACCTGAAGATTTTGCAACTTA CTACTGTCAACACAGAGTCACACTTCCCGCTCA CTTTCGGCGGAGGGACCAAGGTGGAGATCAA A<br>SEQ ID NO: 24253 | CAGGTACAGCTGCAGCAGTCAGGTCCAGGACTG GTGAAGCCCTCGAGACCCTCCACTCACCTGTG CCATCTCCGGGACAGTGTCTCTCGCAACACTGC TGCTTGGAGCTGGATCAGGCAGTCCCATCGAGA GGCCTTGAGTGGCTGGAAGGACATACTACAGG TCCAAGTGGTATAATGATTATCAGTATCTGTGA AAAGTGAGTAACCATCAACCAGACACATCCA AGAACCAGTTCTCCCTGCAGCTGAACTCTGTGAC TCCCGAGGACACGGCTGTGTCCATCACTACTACT GTAAGCAGTGGCGTCTGGGGCCAAGGACCACGG TCACCGTCTCCTCA<br>SEQ ID NO: 28259 |
| | | AA | DIQMTQSPSSLSASVGDRVTITCRASQTISNYLN WYHQKPGKAPKLLIYAASSLQSGVPPSRFSGSGS GTDFTLTISSLQPEDFATYYCQQSHTSPLTFGGGT KVEIK<br>SEQ ID NO: 24254 | QVQLQQSGPGLVKPSQTLSLTCAISGDSVSRNTAA WSWIRQSPSRGLEWLGRTYYRSKWYNDYAVSVKS RVTINPDTSKNQFSLQLNSVTPEDTAVYYCARVSSG WSHHYYYGMDVWGQGTTVTVSS<br>SEQ ID NO: 28260 |

FIGURE 50
(Continued)

| | | | |
|---|---|---|---|
| iPS:392638 | 21-225_17F9 | NA | GACATCCAGATGACCCAGTCTCCATCCTCCT GTCTGCATCTGTAGGAGACAGAGTCACCATCA CTTGCCGGGCAAGTCAGGTCATTAGAAATGAT TTAGGCTGGTATCAGCAGAAACCAGGGAAAG CCCCTAAGCGCCTGATCTATGCTGTATCCAGTT TGCAAAGTGGGGTCCCATCAAGGTTCAGCGGC AGTGGATCTGGGACAGAATTCACTCTCACAAT CAACAGCCTGCAGCCTGAAGATTTTGCAACTT ATTACTGTCTACAACATAATACTTATCCGCTCA CTTTCGGCGGCGGGACCAAGGTGGAGTTCAAA<br>SEQ ID NO: 24255 | CAGCTGCAGCTGCAGGAGTCGGGCCCAGGACTG GTGAAGCCTTCGGCGGCTCCCTCACTCGCA CTGTCTCTGGCGGCTCCATCAGCAGAAGTAGTTA CTATTGGGGCTGGATCCGCAGCCCCCAGGGAA GGGCCTGGAGTGGATTGGGAATATCTATTATAGT GGGAGCACTACTACAATCGTCCCCTCAAGAGTC GAGTCACCATATCCGTAGACTGTCCAAGAACCA GTTCTCCCTGAACCTGAGCTGTGACCGCGCA GACACGGCTGTGTATTCCTGTGCAGACATGGAA AAGACTGGGCCTTGACTACTGGGGCCAGGGAA CCCTGGTCACCGTCTCCTCA<br>SEQ ID NO: 28261 |
| | | AA | DIQMTQSPSSLSASVGDRVTITCRASQVIRNDLG WYQQKPGKAPKRLIYAVSSLQSGVPSRFSGSGS GTEFTLTINSLQPEDFATYYCLQHNTYPLTFGGG TKVEFK<br>SEQ ID NO: 24256 | QLQLQESGPGLVKPSETLSLTCTVSGGSISRSSYYW GWIRQPPGKGLEWIGNIYYSGSTYYNPSLKSRVTIS VDSSKNQFSLNLNSVTAADTAVYSCARHGKDWGL DYWGQGTLVTVSS<br>SEQ ID NO: 28262 |
| iPS:392640 | 21-225_18A1 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTACAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA<br>SEQ ID NO: 24257 | CAGGTGCAGCTGGTGGAGTCTGGGGGAGGCGTG GTCCAGCCTGGGAGGTCCCTGAGACTCTCCTGTG CAGTGTCTGGATTCACCTTCAGTAGCTATGGCAT GCATTGGGTCCGCCAGGCTCCAGGCAAGGGGCT GGAGTGGGTGGCAGTTATATGGTATGAGGAAAA TAATAAATATTATGTAGACTCCGTGAAGGGCCGA TTCACCATCTCCAGAGACAATTCCAAGAGCACGC TGTATCTGCAAATGAACAGCCTGAGAGCCGAGG ACACGGCTGTGTATTACTGTGTGAGAGAGTAGG CTTCCAGTCTGACTACTGGGGCCAGGGAACCCCG GTCACCGTCTCCTCA<br>SEQ ID NO: 28263 |

FIGURE 50
(Continued)

| | | | | |
|---|---|---|---|---|
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGG TKVEIK<br>SEQ ID NO: 24258 | QVQLVESGGGVVQPGRSLRLSCAVSGFTFSSYGMH WVRQAPGKGLEWVAVIWYEENNKYYVDSVKGRF TISRDNSKSTLYLQMNSLRAEDTAVYYCVRELGFQ SDYWGQGTPVTVSS<br>SEQ ID NO: 28264 |
| iPS:392642 | 21-225_18C6 | NA | GACATCCAGATGACCCAGTCTCCATCCTCCCT GTCTGCATCTGTAGGAGACAGAGTCACCATCA CTTGCCGGACAAGTCAGGGCATTAGAAATGAT TTAGGCTGGTATCAGCAGAAACCGGGGAAAG CCCCTAAGCGCCTGATCTATGCTGCATCCAGT TTGCAAAGTGGGGTCCCGTCAAGGTTCAGCGG CAGTGGATCTGGGACAGAATTCACTCTCACAA TCAGCAGCCTGCAGCCTGAAGATAGTTTCTTACCCGCTC TATTACTGTCTACAGCATAGTTTCTTACCCGCTC ACTTTCGGCGGAGGGACCAAGGTGGAGATCA AA<br>SEQ ID NO: 24259 | CAGCTGCAGCTGCAGGAGTCGGGCCAGGACTG GTGAAGCCTTCGGAGACCCCTGTCCTCACCTGCA CTGTCTCTGGTGGCTCCATCAGTAGGAGTAGTTA TTACTGGGGCTGGATCCGCCAGCCCCCAGGGAA GGGGCTGGAGTGGATTGGAATATCTATTATAGT GGGTACACCTACTACAACCCGTCCCTCAAGAGTC GAGTCATCATATCCGTAGACACGTCAAGAACCA GTTCTCCCTGAAGCTGAGCTCTGTGACCGCTGCA GACACGGCTCTGTATTACTGTGCGAGACATAGTA GCAGTTGGTCCCTGACGACTGGGGCCAGGGAA CCCTGGTCACCGTCTCCTCT<br>SEQ ID NO: 28265 |
| | | AA | DIQMTQSPSSLSASVGDRVTITCRTSQGIRNDLG WYQQKPGKAPKRLIYAASSLQSGVPSRFSGSGS GTEFTLTISSLQPEDFATYYCLQHSSYPLTFGGGT KVEIK<br>SEQ ID NO: 24260 | QLQLQESGPGLVKPSETLSLTCTVSGGSISRSSYYW GWIRQPPGKGLEWIGNIYYSGYTYNPSLKSRVIIS VDTSKNQFSLKLSSVTAADTALYYCARHSSSWSLD DWGQGTLVTVSS<br>SEQ ID NO: 28266 |

FIGURE 50
(Continued)

| | | | |
|---|---|---|---|
| iPS:392644 | 21-225_19E1 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAAT TTACAAAGTGGGGTCCCATCAAGGTTCAGCGG CAGTGGATCTGGGACAGAGATTCACTCTCACAA TCAGCAGCCTGCAGCCTGAAGATTTTGCAACT TATTACTGTCTACAGCATAATAGTTTCCCGCTC ACTTTCGGCGGAGGGACCAAGGTGGAGATCA AA<br><br>SEQ ID NO: 24261 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCGGCAAGGGCT GGAGTGGGTGGCAGTTATTGTATGAAGAAAAT AATCAATACTATGCAGACTCCGTGAAGGGCCGAT TCACCATCTCCAGAGACAATTCAAGAACACGCT GTATCTGCAAATGAACAGCCTGAGAGCCGAGGA CACGGCTGTGTATTACTGTGCGAGAGAACTGGGG TTCCGGTCTGACTACTGGGGCCAGGGAACCCTGG TCACCGTCTCCTCA<br><br>SEQ ID NO: 28267 |
| | | AA | DIQMTQSPSSLSASVGDRVTITCRASQGIRNDLG WYQQKPGKAPKRLIYAASNLQSGVPSRFSGSGS GTEFTLTISSLQPEDFATYYCLQHNSFPLTFGGGT KVEIK<br><br>SEQ ID NO: 24262 | QVQLVESGGGVVQPGRSLRLSCAASGFTFSNYGM HWVRQAPGKGLEWVAVIWYEENNQYYADSVKGR FTISRDNSKNTLYLQMNSLRAEDTAVYYCARELGF RSDYWGQGTLVTVSS<br><br>SEQ ID NO: 28268 |
| iPS:392646 | 21-225_20G2 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTCCAAAGTGGGGTCCCATCAAGGTTCAGCGG CAGTGGATCTGGGACAGAGATTCACTCTCACAA TCAGCAGCCTGCAGCCTGAAGATTTTGCAAGT TATTACTGTCTACAGCATAATAGTTACCCGCTC ACTTTCGGCGGAGGGACCAAGGTGGAGATCA AA<br><br>SEQ ID NO: 24263 | CAGGTGCAGCTGGTGGAGTCTGGGGGAGGCGTG GTCCAGCCTGGGAGGTCCCTGAGACTCTCCTGTG CAGCGTCTGGATTCACCCTCAGTAGCGATGACAT GCACTGGGTCCGCCAGGAACCAGGCAAGGGGCT GGAGTGGGTGGCAGTTATATGTTTGATGGAAGT AATAAATACTATGCAGACTCCGTGAAGGGCCGA TTCATCATGTCCAAATGAACAGCCTGAGAGCCGA TGTATCTGCAAATGAACAGCCTGAGAGCCGGGG ACACGGCTGTGTATTACTGTGCGAGAGATCTGAT AGCAGCAGCTGGTACGGTTGACTACTGGGGCCA GGGAACCCTGGTCACCGTCTCCTCA<br><br>SEQ ID NO: 28269 |

FIGURE 50
(Continued)

| | | | | |
|---|---|---|---|---|
| iPS:392648 | 21-225_16D11 | AA | DIQMTQSPSSLSASVGDRVTITCRASQGIRNDLGWYQQKPGKAPKRLIYAASSFQSGVPSRFSGSGSGTEFTLTISSLQPEDFASYYCLQHNSYPLTFGGGTKVEIK<br>SEQ ID NO: 24264 | QVQLVESGGGVVQPGRSLRLSCAASGFTLSSDDMHWVRQEPGKGLEWVAVIWFDGSNKYYADSVKGRFIMSRDNSKNTLYLQMNSLRAGDTAVYYCARDLIAAAGTVDYWGQGTLVTVSS<br>SEQ ID NO: 28270 |
| | | NA | GACATCCAGATGACCCAGTCTCCATCCTCCCTGTCTGCATCTGTCGGAGACAGAGTCACCATCACTTGCCGGGCAAGTCAGAGACAGTCACCATCACTTGCCGGGCAAGTCAGAGACAGACCATTAGCAACTATTTAAATTGGTATCATCAGAAACCAGGGAAAGCCCCTAAGCTCCTGATCTATGCTGCATCCAGTTTGCAAAGTGGGGTCCCATCAAGGTTCAGTGGCAGTGGATCTGGGACAGATTTCACTCTCACCATCAGCAGTCTGCAACAGAGTCACAGTTTGCAACTTACTACTGTCAACAGAGTCACAGTCCCCGCTCACTTTCGGCGGAGGGACCAAGGTGGAGATCAAA<br>SEQ ID NO: 24265 | CAGGTACAGCTGCAGCAGTCAGGTCAGGACTGGTGAAGCCCTCGCAGACCCTCACTCTCACCTGTGCCATCTCCGGGGACAGTGTCTCTCGCAACACTGCTGCTTGGAGCTGGATCAGGCAGTCCCCATCGAGAGGCCTTGAGTGGCTGGGAAGGACATATCAGTATGCAGGTCCAAGTGGTATAATGATTATGCAGTATGTGTGAAAGTGAATAACCATCAACCAGACACATCCAAGAACCAGTTCTCCCTGCAGCTGAACTCTGTGACTCCCGAGGACACGGCTGTGTATTACTGTGCAAGAGTAAACAGTGGCTGGTCCCATCACTACTACTACTACGGTATGGACGTCTGGGGCCAAGGGACCACGGTCACCGTCTCCTCA<br>SEQ ID NO: 28271 |
| | | AA | DIQMTQSPSSLSASVGDRVTITCRASQTISNYLNWYHQKPGKAPKLLIYAASSLQSGVPSRFSGSGSGTDFTLTISSLQPEDFATYYCQQSHSSPLTFGGGTKVEIK<br>SEQ ID NO: 24266 | QVQLQQSGPGLVKPSQTLSLTCAISGDSVSRNTAAWSWIRQSPSRGLEWLGRTYYRSKWYNDYAVSVKSRITINPDTSKNQFSLQLNSVTPEDTAVYYCARVNSGWSHHYYYYGMDVWGQGTTVTVSS<br>SEQ ID NO: 28272 |

FIGURE 50
(Continued)

| | | | |
|---|---|---|---|
| iPS:392650 | 21-225_17A4 | NA | GACATCCAGATGACCCAGTCTCCATCTTCCGT GTCTGCATCTGTAGGAGACAGAGTCACCATCA CTTGTCGGGCGAGTCAGGGTATTGCAACTGG TTAGCCTGGTATCAGCAGAAACCAGGGAAAG CCCCTAAACTCCTGATCTTTGCTGCATCCAGTT TGCAAAGTGGGGTCCCATCACGGTTCAGCGGC AGTGGATCTGGGACAGATTTCACTCTCACCAT CAGCAGCCTGCAGCCTGAAGATTTTGTAACTT ACTATTGTCAACAGGCTAACAGTTCCCTCGG ACGTTCGGCCAAGGGACCAAGGTGGAAATCA AA | CAGGTGCAGCTGGTGGAGTCTGGGGAGGCTTG GTCAAGCCTGGAGGGTCCCTGAGACTCTCCTGTG CAGCCTCTGGATTCACCTTCAGTGACTACTACAT GAGCTGGATCCGCCAGGCTCCAGGGAAGGGGCT GGAGTGGGTTTCACACATTAGTAGTAGTGGTAGT ACCATATATTACGCAGACTCTGTGAAGGGCCGAT TCACCATCTCCAGGGACAACGCCAAGAACTCACT GTATCTGCAAATGAACAGCCTGAGAGCCGAGGA CACGGCCGTGTATTACTGTGCGAGATATCGGAAT AACCGGGGGATACTTCGATCTCTGGGGCCGTGGCA CCCTGGTCACTGTCTCTCA |
| | | | SEQ ID NO: 24267 | SEQ ID NO: 28273 |
| | | AA | DIQMTQSPSSVSASVGDRVTITCRASQGIGNWLA WYQQKPGKAPKLLIFAASSLQSGVPSRFSGSGSG TDFTLTISSLQPEDFVTYYCQQANSFPRTFGQGT KVEIK | QVQLVESGGGLVKPGGSLRLSCAASGFTFSDYYMS WIRQAPGKGLEWVSHISSSGSTIYYADSVKGRFTIS RDNAKNSLYLQMNSLRAEDTAVYYCARYRNNRG YFDLWGRGTLVTVSS |
| | | | SEQ ID NO: 24268 | SEQ ID NO: 28274 |
| iPS:392652 | 21-225_17C6 | NA | GACATCCAGATGACCCAGTCTCCATCCTCCCT GTCTGCATCTGTAGGAGACAGAGTCACCATCA CTTGCCGGGCAAGTCAGAGCATTAATACTTAT TTAAATTGGTATCAGCAAAAACCAGGGAAAG CCCCTAAGCTCCTGATCTATGCTGCATCCAGT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTTCTGTCAACAGAGTTACAGAACCCCCTTT TTCACTTTCGGCCCTGGGACCAAAGTGGATAT CAAA | GAGGTGCAGCTGTTGGAGTCTGGGGGAGGCTTG GTACAGCCTGGGGGGTCCCTGAGACTCTCCTGTG CAGCCTCTGAATTCACCTTTAGCAGCTATGCCAT GAACTGGGTCCGCCAGGCTCCAGGGAAGGGGCT GGAGTGGGTCTCAGTTATTAGTGGTCGTGGTGGT AACACATTCTACGCAGACTCCGTGAAGGGCCGGT TCACCATCTCCAGAGACAATTCAAGAACACGCT CTTTCTGCAAATGAACAGCCTGAGAGCCGAGGA CACGGCCGTATATTATTGTGCGTCCGTTTGGCA GTGGCTGGCTCGGAGGCTTTTGATATCTGGGGCC AAGGGACAATGGTCACCGTCTCTTCA |
| | | | SEQ ID NO: 24269 | SEQ ID NO: 28275 |

FIGURE 50
(Continued)

| | | | | |
|---|---|---|---|---|
| | | AA | DIQMTQSPSSLSASVGDRVTITCRASQSINTYLN WYQQKPGKAPKLLIYAASSLQSGVPSRFSGSGS GTDFTLTISSLQPEDFATYFCQQSYRTPFFTFGPG TKVDIK<br>SEQ ID NO: 24270 | EVQLLESGGGLVQPGGSLRLSCAASEFTPSSYAMN WVRQAPGKGLEWVSVISGRGGNTFYADSVKGRFTI SRDNSKNTLFLQMNSLRAEDTAVYYCASRLAVAG SEAFDIWGQGTMVTVSS<br>SEQ ID NO: 28276 |
| iPS:392654 | 21-225_17A10 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGGCGCTGATCTATGCTGCATCCAGT TTACAAAGTGGGGTCCCATCAAGGTTCAGCGG CAGTGGATCTGGGACAGATTCACTCTCACAA TCAGCAGCCTGCAGCTGAAGATTTTGCAACT TATTACTGTCTACAGCATAATAGTTACCCGCTC ACTTTCGGCGGAGGGACCAAGGTGGAGATCA AA<br>SEQ ID NO: 24271 | CAGGTGCAGCTGGTGGAGTCTGGGGGAGGCGTG GTCCAGCCTGGGAGGTCCCTGAGACTCTCCTGTG CAGCGTCTGATTCACCTTCAGTAACTATGGCAT GCACTGGGTCCGCCAGGCTCCAGCCAAGGGGCT GGAGTGGGTGGCAGTTATTTGGTATGAAGAAAAT AATCAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACTGGGG TTCCGGTCTGACTACTGGGGCCAGGGAACCCTGG TCACCGTCTCCTCA<br>SEQ ID NO: 28277 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br>SEQ ID NO: 24272 | QVQLVESGGGVVQPGRSLRLSCAASGFTFSNYGM HWVRQAPAKGLEWVAVIWYEENNQYYADSVKGR FTISRDNSKNTLYLQMNSLRAEDTAVYYCARELGF RSDYWGQGTLVTVSS<br>SEQ ID NO: 28278 |

FIGURE 50
(Continued)

| | | | |
|---|---|---|---|
| iPS:392656 | 21-225_1F2 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT GTGCAAAGTGGGGTCCATCAAGGTTCAGCGG CAGTGGATCTGGGACAGAATTCACTCTCACAA TCAGCAGCCTGCAGCCTGAAGATTTTGCAATT TATTACTGTCTACAGCATAATAGTTACCCGCTC ACTTTCGGCGGAGGGACCAAGGTGGAGATCA AA<br><br>SEQ ID NO: 24273 | CAGCTGCAGCTGCAGGAGAGTGGGCCAGGACTG GTGAAGCCTTCGGAGACCCTGTCCCTCACCTGCA CTGTCTCTGGTGGCTCCATCAGTAGGAGTAGTTA CTACTGGGGCTGGATCCGCCAGCCCCCAGGGAA GGGGCTGGAGTGGATTGGGAATATTTATTATAGT GGGAGCGCCTACAACAACCCGTCCCTCAAGGGT CGAGTCACCATATCCGTAGACACGTCCAAGAACC AGTTCTCCCTGAAGCTGAACTCTGTGACCGCCGC AGACACGGCTGTGTATTACTGTGGGAGACATGGA AAAGACTGGGGCCTTGACTACTGGGGCCAGGGA ACCCTGGTCACCGTCTCCTCA<br><br>SEQ ID NO: 28279 |
| | | AA | DIQMTQSPSSLSASVGDRVTITCRASQGIRNDLG WYQQKPGKAPKRLIYAASSVQSGVPSRFSGSGS GTEFTLTISSLQPEDFAIYYCLQHNSYPLTFGGGT KVEIK<br><br>SEQ ID NO: 24274 | QLQLQESGPGLVKPSETLSLTCTVSGGSISRSSYYW GWIRQPPGKGLEWIGNIYYSGSAYNNPSLKGRVTIS VDTSKNQFSLKLNSVTAADTAVYYCGRHGKDWGL DYWGQGTLVTVSS<br><br>SEQ ID NO: 28280 |
| iPS:392658 | 21-225_18E8 | NA | GACATCCAGATGACCCAGGCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCATCAAGGTTCAGCGG CAGTGGATCTGGGACAGAATTCACTCTCACAA TCAGCAGCCTGCAGCCTGAAGATTTTGCAACT TATTACTGTCTACAGCATATAAGTTACCCGCTC ACTTTCGGCGGAGGGACCAAGGTGGAGATCA AA<br><br>SEQ ID NO: 24275 | CAGGTGCAGTTGGTGGAGTCTGGGGGAGGCGTG GTCCAGCCTGGGAGGTCCCTGAGACTCTCCTGTG CAGCGTCTGGATTCACCTTCAGTAACTAACTATGGCAT GCACTGGGTCCGCCAGGCTCCAGGCAAGGGGCT GGAGTGGGTGGCAGTTATTTGGTATGAAGAAAAT AATCAATACTATGCAGACTCCGTGAAGGGCCGAT TCACCGTCTCCAGAGACAATTCAAGAACACGCT GTTTCTGCAAATGAACAGCCTGAGAGCCGAGGA CACGGCTGTGTATTACTGTGCGAGAGAACTGGGG TTCCGGTCGACTACTGGGGGCCAGGGAACCCTGG TCACCGTCTCCTCA<br><br>SEQ ID NO: 28281 |

FIGURE 50
(Continued)

| | | | | |
|---|---|---|---|---|
| iPS:392660 | | AA | DIQMTQAPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br><br>SEQ ID NO: 24276 | QVQLVESGGGVVQPGRSLRLSCAASGFTFSNYGM HWVRQAPGKGLEWVAVIWYEENNQYYADSVKGR FTVSRDNSKNTLFLQMNSLRAEDTAVYYCARELGF RSDYWGQGTLVTVSS<br><br>SEQ ID NO: 28282 |
| | | NA | GACATCCAGATGACCCAGTCTCCATCCTCCCT GTCTGCTTCTGTCGGAGACAGAGTCACCATCA CTTGCCGGGCAGGTCAGAACAGAACATTATCAACTAT TTAAATTGGTATCAGCAGAAACCAGGGAAAG CCCCTAACCTCCTGATATATGTTGCATCCAGTT TGCAAAGTGGGGTCCCATCAAGGTTCACTGGC AGTGGATCTGGGACAGATTTCACTCTCACCAT CAGCAGTCTGCAACCTGAAGATTTTGCAACTT ACTACTGTCAACAGAGTTACAGTACCCCTTTC ACTTTCGGCCCTGGGACCAAAGTGGATATCAA A<br><br>SEQ ID NO: 24277 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGACAT GCACTGGGTCCGCCAGGCTCCAGGCAAGGGCT GGAGTGGGTGGCAGTTATATGTATGACGGAAG TGATAAATACTATGCAGACTCCGTGAAGGGCCG ATTCACCATCTCCAGAGACAATTCCAAGAACACG CTCTTTCTGCAAATGAACAGCCTGAGAGCCGAGG ACACGGCTGTGTATTACTGTGCGAGAGATCGGGC CTATAGCAGCTCGTCGACTACTGGGGCCAGGGA ACCCTGGTCACCGTCTCCTCA<br><br>SEQ ID NO: 28283 |
| 21-225_19B3 | | AA | DIQMTQSPSSLSASVGDRITITCRAGQNIINYLNW YQQKPGKAPNLLIYVASSLQSGVPSRFNGSGSGT DFTLTISSLQPEDFATYYCQQSYSTPFTFGPGTKV DIK<br><br>SEQ ID NO: 24278 | QVQLVESGGGVVQPGRSLRLSCAASGFTFSSYDMH WVRQAPGKGLEWVAVIWYDGSDKYYADSVKGRF TISRDNSKNTLFLQMNSLRAEDTAVYYCARDRAYS SSSDYWGQGTLVTVSS<br><br>SEQ ID NO: 28284 |

FIGURE 50
(Continued)

| | | | | |
|---|---|---|---|---|
| iPS:392664 | 21-225_20F6 | NA | GACATCAGATGACCCAGTCTCCATCTCCCT GTCTGCATCTGTAGGAGACAGAGTCACCATCA CTTGCCGGGCAAGTCAGAGACATTATCACCTAT TTAAATTGGTATCAGCAGAAACCAGGGAAAG CCCCTAAGGTCCTGATCTATCATGCCATCCAGT TTGCAAAGTGGGGTCCCATCCAAGGTTCAGTGG CAGTGGATCTGGGACAGATTTCACTCTCACCA TCAGCAGTCTGCAACAGACTTACAGTCCCGCT TACTACTGTCAACAGACATATAGTAATGTTACCGCTC ACTTTCGGCGGAGGGACCAAGGTGGAGATC AAA<br>SEQ ID NO: 24279 | CAGGTGCAGCTGGTGGAGTCTGGGGGAGGCGTG GTCCAGCCTGGGAGGTCCCTGAGACTCTCCTGTG TAGCGTCTGGATTCACCTTCAGTGACTAGCTATGGCAT GCACTGGGTCCGCCAGGCTCCAGGCAAGGGGCT GGAGTGGGGGCAGTTATATGCATGATGAAAG TAATAAATACTATGCAGACTCCGTGAAGGGCCG ATTCACCATCTCCAGAGACAATGCCAAGAACAC GCTGTATCTGCAAATGAACAGCCTGAGAGCCGA GGACACGGCTGTGTATTACTGTGCGAGAGATCTG AGTATGGGCGGAATGGACGTCTGGGGCCAAGGG ACCACGGTCACCGTCTCCTCA<br>SEQ ID NO: 28285 |
| | | AA | DIQMTQSPSSLSASVGDRVTITCRASQSIITYLNW YQQKPGKAPKVLIHTASSLQSGVPSRFSGSGSGT DFTLTISSLQPEDFATYYCQQTYSPPLTFGGGTK VEIK<br>SEQ ID NO: 24280 | QVQLVESGGGVVQPGRSLRLSCVASGFTFSSYGMH WVRQAPGKGLEWGAVIWHDGSNKYYADSVKGRF TISRDNAKNTLYLQMNSLRAEDTAVYYCARDLSM GGMDVWGQGTTVTVSS<br>SEQ ID NO: 28286 |
| iPS:392666 | 21-225_16F11 | NA | GACATCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT GTACAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCGCTC ACTTTCGGCGGAGGGACCAAGGTGGAGATCA AA<br>SEQ ID NO: 24281 | CAGGTGCAGATGGTGGAGTCTGGGGGAGGCGTG GTCCAGCCTGGGAGGTCCCTGAGACTCTCTGTG AAGCGTCTGGATTCACCTTCAGTAGCTATGGCAT GCACTGGGTCCGCCAGGCTCCAGGCAAGGGGCT GGAGTGGGTGGCAGTTATATGACTCCGTGAAGGGCCGA TTCACCATCTCCAGAGACAATTCCAAGAGCACGC TGTATCTGCAAATGAATAGCCTGAGAGCCGAGG ACACGGCTGTGTATTACTGTGTGAGAGAACTAGG CTTCCAGTCTGACTACTGGGGCCAGGGAACCCCG GTCACCGTCTCCTCA<br>SEQ ID NO: 28287 |

FIGURE 50
(Continued)

| | | | | |
|---|---|---|---|---|
| iPS:392668 | 21-225_17B4 | AA | DIQMTQSPSSLSASVGDRVTITCRASQGIRNDLG WYQQKPGKAPKRLIYAASSVQSGVPSRFSGSGS GTEFTLTISSLQPEDFATYYCLQHNSYPLTFGGG TKVEIK<br><br>SEQ ID NO: 24282 | QVQMVESGGGVVQPGRSLRLSCEASGFTFSSYGM HWVRQAPGKGLEWVAVIWYEENNKYYVDSVKGR FTISRDNSKSTLYLQMNSLRAEDTAVYYCVRELGF QSDYWGQGTPVTVSS<br><br>SEQ ID NO: 28288 |
| | | NA | GACATCCAGATGACCCAGTCTCCATCTCCCT GTCTGCATCTGTAGGCGACAGAGTCACCATCA CTTGCCGGGCAAGTCAGAACATTAGTAGTTAT TTAAATTGGTATCAGCAGAAACCAGGAAAG CCCCTAAGCTCCTGATCTTTGGTGCATCCAGTT TGCAAACTGGGGTCCCATCAAGGTTCAGTGGC AGTGGATCTGGGACAGATTTCACTCTCACCAT CAACAGTCTGCAACCTGAAGATTTTGCAACTT ACTTCTGTCAACAGAGTTACAGAACCCCCTTT TTCACTTTCGGCCCTGGGACCAAAGTGGATAT CAAA<br><br>SEQ ID NO: 24283 | GAGGTGCAGCTGTTGGAGTCTGGGGGAGGCTTG GTACAGCCTGGGGGGTCCCTGAGACTCTCTGTG CAGCCTCTGAATTTACCTTTAGCAGCTATGCCAT GAACTGGGTCCGCCAGGCTCCAGGGAAGGGCT GGAGTGGGTCTCAGTTATTAGTGGCCGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGTCCCGTTGGCA GTGGCTGGCTCGGAGGCTTTTGATATCTGGGGCC AAGGGACAAATGGTCACCGTCTCTTCA<br><br>SEQ ID NO: 28289 |
| | | AA | DIQMTQSPSSLSASVGDRVTITCRASQNISSYLN WYQQKPGKAPKLLIFGASSLQTGVPSRFSGSGSG TDFTLTINSLQPEDFATYFCQQSYRTPFFTFGPGT KVDIK<br><br>SEQ ID NO: 24284 | EVQLLESGGGLVQPGGSLRLSCAASEFTFSSYAMN WVRQAPGKGLEWVSVISGRGGNTFYADSVKGRFTI SRDNSKNTLYLQMNSLRAEDTAVYYCASRLAVAG SEAFDIWGQGTMVTVSS<br><br>SEQ ID NO: 28290 |

FIGURE 50
(Continued)

| | | | | |
|---|---|---|---|---|
| iPS:392674 | 21-225_18C2 | NA | GACATCCAGATGACCCAGTCTCCATCTCCCT GTCTGCGTCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCTATACTGCATCCAGT TTGCAAAGTGGGGGTCCCATCAAGATTCAGCGG CAGTGGATTTGGGACAGATTCACTCTCACAA TCAGCAGCCTGCAGCCTGAAGATTTTGCAACT TATTACTGTCTACAACATAATAGTTACCCGTG GACGTTCGGCCCTGGGGACCAAGGTGGTCATCA AA SEQ ID NO: 24285 | CAGGTGCAACTGGTGGTGGAGTCTGGGGGAGGCGTG GTCCAGCCTGGGAGGTCCCTGAGACTCTCCTGTG TAGCGTCTGGATTCACCTTCAGTGACTATGGCAT GCACTGGGTCCGCCAGGCTCCAGGCAAGGGGCT GGAGTGGATGGCAGTTATATGCAGACTCCGTGAAGGGCCGA AATAAATACTATGCAGACTCCGTGAAGGGCCGA TTCACCATCTCCAGAGACAATTCCAAGAACACGC TGTATCTGCAAATGAACAGCCTGAGCGCCGAGG ACACGGCTGTTTATTACTGTGCGAGAGAGCTTGG CTGGTACGAGGACTACTGGGGCCAGGGAACCCT GGTCACCGTCTCCTCA SEQ ID NO: 28291 |
| | | AA | DIQMTQSPSSLSASVGDRVTITCRASQGIRNDLG WYQQKPGKAPKRLIYTASSLQSGVPSRFSGSGFG TEFTLTISSLQPEDFATYYCLQHNSYPWTFGLGT KVVIK SEQ ID NO: 24286 | QVQLVESGGGVVQPGRSLRLSCVASGFTFSDYGM HWVRQAPGKGLEWMAVIWYDVTNKYYADSVKG RFTISRDNSKNTLYLQMNSLSAEDTAVYYCARELG WYEDYWGQGTLVTVSS SEQ ID NO: 28292 |
| iPS:392676 | 21-225_19F3 | NA | GACATCCAGATGACCCAGTCTCCATCTCCCT GTCTGCATCTGTACGAGACAGAGTCACCATCA CTTGCCGGGCAAGTCAGGGCATAAGAAATGAT TTAGGCTGGTATCAGCAGAAACCAGGGAAAG CCCCTAAGCGCCTGATCTATGCTGTTTCCAGTT TGCAAAGTGGGGTCCCATCAAGGTTCAGCGGC AGTGGATCTGGGACAGATTCACTCTCACAAT CAGCAGCCTGCAGCCTGAAGATTTTGCAACTT ATTACTGTCTACAGCACATGCCAGTTACCCGCTC ACTTTCGGCGGAGGGACCAAGGTGGAGATCA AA SEQ ID NO: 24287 | CAGGTGCAGCTGCAGGAGTCCGGCCCAGGACTG GTGAAGCCTTCGGAGACCCTGTCCCTCACCTGCA CTGTCTCCGGTGGCGCCATCAGCGGTAGTAGTTA CTACTGGGGCTGGATCCGCCAGCCCCCAGGGAA ACAACTGGAGTGGATTGGGAATATCTATTATAGT GGGAGCACCTACTACAACCCGTCCTTCAAGAGTC GAGTTCTCCATATCCGTAGACACGTCCAAGAACC AGTTCTCCCTGAAGCTGAGCTCTGTGACCGCGA AGACACGGCTGTCTATTACTGTGCGAGACATTCC AGTAGCTGGTCCCTTGACTACTGGGGCCAGGGAA CCCTGGTCACCGTCTCCTCT SEQ ID NO: 28293 |

FIGURE 50
(Continued)

| | | | |
|---|---|---|---|
| iPS:392678 | 21-225_20F3 | AA | DIQMTQSPSSLSASVRDRVTITCRASQGIRNDLG WYQQKPGKAPKRLIYAVSSLQSGVPSRFSGSGS GTEFTLTISSLQPEDFATYCLQHASYPLTFGGG TKVEIK<br>SEQ ID NO: 24288 | QVQLQESGPGLVKPSETLSLTCTVSGGAISGSSYYW GWIRQPPGKQLEWIGNIYYSGSTYYNPSFKSRVTIS VDTSKNQFSLKLSSVTAEDTAVYYCARHSSSWSLD YWGQGTLVTVSS<br>SEQ ID NO: 28294 |
| | | NA | GACATCCAGATGACCCAGTCTCCATCCTCCCT GTCTGCATCTGTAGGAGACAGAGTCACCATCA CTTGCCGGGCAAGTCAGAGCATTAGTAGTTAT TTATATTGGTATCAGCAGAAACCAGGGAAAGC CCCTAAGCTCCTGATCTATGCTGCATCCAGTTT GCAAAGTGGGGTCCCATCAAGGTTCAGTGGCA GTGGATCTGGGACAGATTTCACTCTCACCATC AGCAGTCTGCAACCTGAAGATTTTGCAACTTA CTACTGTCAACAGAGTTACAGTGCCCCTCCAT TCACTTTCGGCCCTGGGACCAAAGTGGATATC AAA<br>SEQ ID NO: 24289 | GAGGTGCAGCTGTTGGAGTCTGGGGGAGGCTTG GTACAGCCGGGGGGGTCCCTGAGACTCTCCTGTG CAGCCTCTGGATTCACCTTTAGCAGCTATGCCAT GAACTGGGTCCGCCAGGCTCCAGGGAAGGGCT GGAGTGGGTCTCAGTTATTAGTGGTAGTGGTGGT AGCACATACTACGCAGACTCCGTGAAGGGCCGG TTCACCATCTCAGAGACAATTCCAAGAACACGC TGTATCTGCAAATGAACAGCCTGAGAGCCGAGG ACACGGCCGTATATTACTGTGCGAAAAGGATAG CAGCAGTGGTACGGAGTACTTCGATCTCTGGGG CCGTGGCACCCTGGTCACTGTCTCCTCA<br>SEQ ID NO: 28295 |
| | | AA | DIQMTQSPSSLSASVGDRVTITCRASQSISSYLYW YQQKPGKAPKLLIYAASSLQSGVPSRFSGSGSGT DFTLTISSLQPEDFATYYCQQSYSAPPFTFGPGTK VDIK<br>SEQ ID NO: 24290 | EVQLLESGGGLVQPGGSLRLSCAASGFTFSSYAMN WVRQAPGKGLEWVSVISGSGSTYYADSVKGRFTI SRDNSKNTLYLQMNSLRAEDTAVYYCAKRIAAAG TEYFDLWGRGTLVTVSS<br>SEQ ID NO: 28296 |

FIGURE 50
(Continued)

| | | | | |
|---|---|---|---|---|
| iPS:392680 | 21-225_20A7 | NA | GACATCCAGATGACCCAGTCTCCATCCCCT GTCTGCATCTGTAGGAGACAGAGTCACCATCA CTTGCCGGGCAAGTCAGGGCATTAGAAATGAT TTAGGCTGGTATCAGCAAAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA SEQ ID NO: 24291 | CAGGTGCAGCTGGTGCAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATTTGGTATGAAGAAAAT AATCAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTATTATTACTGTGCGAGAGAACTGGGG TTCCGGTCTGACTACTGGGGCCAGGGAACCCTGG TCACCGTCTCCTCA SEQ ID NO: 28297 |
| | | AA | DIQMTQSPSSLSASVGDRVTITCRASQGIRNDLG WYQQKPGKAPKRLIYAASSLQSGVPSRFSGSGS GTEFSLTISSLQPEDFATYYCLQHNSYPLTFGGGT KVEIK SEQ ID NO: 24292 | QVQLVESGGGVVQPGRSLRLSCAASGFTFSNYGM HWVRQAPGKGLEWVAVIWYEENNQYYADSVKGR FTISRDNSKNTLYLQMNSLRAEDTAIYYCARELGFR SDYWGQGTLVTVSS SEQ ID NO: 28298 |
| iPS:392682 | 21-225_16A12 | NA | GACATCCAGATGACCCAGTCTCCATCCTCACT GTCTGCATCTGTAGGAGACAGAGTCACCATCA CTTGTCGGGCGAGTCAGGCCATTAACACTTAT TTAGCCTGGTTTCAGCAGAAACCAGGGAAAGC CCCTAAGTCCCTGATTTCTGCTGCATCCAGTT GCAAAGTGGGGTCCCATCAAAGTTCACTCTCA GTGGATCTGGGACAGATTTCACTCTCACCATC AGCAGCCTGCAGCCTGAAGATTTTGCAACTTA TTACTGCCAACAGTATTATAGTTATCCGCTCAC TTTCGGCGGAGGGACCAAGGTGGAGATCAAA SEQ ID NO: 24293 | GAGGTGCAGCTGGTGGAGTCTGGGGGAGGCCTG GTCAAGCCTGGGGGGTCCCTGAGACTCTCCTGTG CAGCCTCTGGATTCACCTTCACGTAGTAGATAGAAT GAACTGGTTCCGCCAGGCTCCAGGGAAGGGGCT GGAGTGGGTCTCATCCATTAGTGGTAGTAGTACT GACATATACTACGCAGATCAGTGAAGGGCCGA TTCACCATCTCCAGAGACAACGCCGAGAACTCAC TGTATCTGCAAATGAACAGCCTGAGAGCCGAGG ACACGGCTGTGTATTACTGTGCGAGAAGGGACTT CTGGGGCCAGGGAACCCTGGTCACCGTCTCCTCA SEQ ID NO: 28299 |

FIGURE 50
(Continued)

| | | | | |
|---|---|---|---|---|
| iPS:392684 | 21-225_17F4 | AA | DIQMTQSPSSLSASVGDRVTITCRASQAINTYLAWFQQKPGKAPKSLISAASSLQSGVPSKFSGSGSGTEFTLTISSLQPEDFATYYCQQYYSYPLTFGGGTKVEIK<br>SEQ ID NO: 24294 | EVQLVESGGGLVKPGGSLRLSCAASGFTFSSYRMNWFRQAPGKGLEWVSSISGSSTDIYYADSVKGRFTISRDNAENSLYLQMNSLRAEDTAVYYCARRDFWGQGTLVTVSS<br>SEQ ID NO: 28300 |
| | | NA | GACATCCAGATGACCCAGTCTCCATCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGTCGCCTGATCTATGCTGCATCCAGTTTGCAAAGTGGGGTCCCATCAAGGTTCAGCGGCAGTGGATCTGGGACAGAATTCACTCTCACAACAGCAGCCTGCAGCCTGAAGATTTTGCAACTTATTACTGTCTACAGCATAATAGTTACCCATTCACTTTCGGCCCTGGGACCAAAGTGGATATCAAA<br>SEQ ID NO: 24295 | CAGGTGCAGCTGGTGGAGTCTGGGGGAGGCGTGGTCCAGCCTGGGAGGTCCCTGAGACTCTCCTGTCAGCGTCTGGATTCACCTTCAGTAACTATGCATGAACTGGGTCCGCCAGGCTCCAGGCAAGGGGCTGGAGTGGGTGGCAGTTATATGTATGATGGAAATAATAAACACTATGCAGACTCCGTGAAGGGCCGATTCACCATTCCAAGAGACAATTCCAAGAACACGCTGTATCTGCAAATGAACAGCCTGAGAGCCGAGGACACGGCTGTGTATTACTGTGCGAGTAGTGGGAGCTACTTCTTTGACTACTGGGGCCAGGGAACCCTGGTCACCGTCTCCTCA<br>SEQ ID NO: 28301 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGPGTKVDIK<br>SEQ ID NO: 24296 | QVQLVESGGGVVQPGRSLRLSCAASGFTFSNYGMNWVRQAPGKGLEWVAVIWYDGNNKHYADSVKGRFTISRDNSKNTLYLQMNSLRAEDTAVYYCASSGSYFFDYWGQGTLVTVSS<br>SEQ ID NO: 28302 |

FIGURE 50
(Continued)

| | | | |
|---|---|---|---|
| iPS:392686 | 21-225_17C7 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGATTCAGCGG CAGTGGATCTGGGACAGAATTCACTCTCACAA TCAGCAGCCTGCAGCCTGAAGATTTTGCAACT TATTACTGTCTACAGCATAATAGTTACCCGTG GACGTTCGGCCAAGGGACCAAGGTGGAAATC AAA SEQ ID NO: 24297 | CAGGTGCAGCTGGTGGAGTCTGGGGGAGGCGTG GTCCAGCCTGGGAAGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTTTGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG GCACGGCTGTGTATTACTGTGCGAGAGATCTTGG CTGGACGGAAGAATACTGGGGCCAGGGAACCCT GGTCACCGTCTCCTCA SEQ ID NO: 28303 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPWTFGQG TKVEIK SEQ ID NO: 24298 | QVQLVESGGGVVQPGKSLRLSCAASGFTFSDYGM HWVRQAPGKGLEWVAVIWFDGSNKYYADSVKGR FTISRDNSKNTLYLQMNSLRAEGTAVYYCARDLG WTEEYWGQGTLVTVSS SEQ ID NO: 28304 |
| iPS:392690 | 21-225_18F2 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGTG GACGTTCGGCCAAGGGACCAAGGTGGAAATC AAA SEQ ID NO: 24299 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTTTGATGGAAGT AATAAATACTATGTAGACTCCGTGAAGGGCCGAT TCACCATCTCCAGAGACAATTCCAAGAACACGCT GTATCTGCAAATGAACAGCCTGAGAGTCGAGGA CACGGCTGTGTATTACTGTGCGAGAGATCTTGGC TGGACGGAAGAGTACTGGGGCCAGGGAACCCTG GTCACCGTCTCCTCA SEQ ID NO: 28305 |

FIGURE 50
(Continued)

| | | | | |
|---|---|---|---|---|
| iPS:392692 | 21-225_18G10 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPWTFGQG TKVEIK<br><br>SEQ ID NO: 24300 | QVQLVESGGGVVQPGRSLRLSCAASGFTFSDYGM HWVRQAPGKGLEWVAVIWFDGSNKYYVDSVKGR FTISRDNSKNTLYLQMNSLRVEDTAVYYCARDLG WTEEYWGQGTLVTVSS<br><br>SEQ ID NO: 28306 |
| | | NA | GACATCCAGATGACCCAGTCTCCATCTCACT GTCTGCATCTGTAGGAGACAGAGTCACCATCA CTTGTCGGGCGAGTCAGGACATTAGTATAT TTAGCCTGGTTTCAGCAGAAACCAGGGAAAGC CCCTAAGTCCCTGATTTATGTTGCATCCAGTTT GCAAAGTGGGGTCCCATCAAAGTTCGGCGGCA GTGGATTTGGGACAGATTTCACTCTCACCATC AGCAGCCTGCAGCCTGAAGATTTTGCAACTTA TACTGCTTACAGTATAATAGTTACCCATTCAC TTTCGGCCCTGGGACCAAAGTGGATATCAAA<br><br>SEQ ID NO: 24301 | GAGGTGCAGCTGGTGGAGTCTGGGGGAGGCTTG GTACAGCCTGGGGGGTCCCTGAGACTCTCTGTG CAGCCTCTGGAATCACCTTCAGTACTACTAGCAT GAACTGGGTCCGCCAGGCTCCAGGGAAGGGGCT GGAGTGGGTTTCATACATTAGTAGGAGTAGTAGT ACCATAGACTACGCAGACTCTGTGAAGGGCCGA TTCACCATCTCCAGAGACAATGCCAAGAACTCAC TGTATCTGCAAATGAACAGCCTGAGAGACGAGG ACACGGCTGTGTATTACTGTGCGAGAGGAGGTGG GAGCCCTTTTGACTACTGGGGCCAGGGAACCCTG GTCACCGTCTCCTCA<br><br>SEQ ID NO: 28307 |
| | | AA | DIQMTQSPSSLSASVGDRVTITCRASQDISYYLA WFQQKPGKAPKSLIYVASSLQSGVPSKFGGSGF GTDFTLTISSLQPEDFATYYCLQYNSYPFTFGPGT KVDIK<br><br>SEQ ID NO: 24302 | EVQLVESGGGLVQPGGSLRLLCAASGITFSTYSMN WVRQAPGKGLEWVSYISRSSSTIDYADSVKGRFTIS RDNAKNSLYLQMNSLRDEDTAVYYCARGGGSPFD YWGQGTLVTVSS<br><br>SEQ ID NO: 28308 |

FIGURE 50
(Continued)

| | | | |
|---|---|---|---|
| iPS:392694 | 21-225_19A5 | NA | GACATCCAGATGACCCAGTCTCCATCTCCCT GTCTGCACCTGTAGGAGACAGAGTCTCCATCA CTTGCCGGGCAAGTCAGAGACATTATCAACTAT TTAAATTGGTATCAGCAGAAACCAGGGAAAG CCCCTAAGCTCCTGATAGATGTTGCATCCAAT TTACAAGGTGGGGTCCCATCAAGGTTCAGTGG CAGTGGATCTGGGACAGATTTCACTCTCACCA TCAGCAGTCTGCAACCTGCAAGATTTTGCAACT TACTACTGTCAACAGAGTTACAGTACCCCTTT CACTTTCGGCCCTGGGACCAAAGTGGATATCA AA<br><br>SEQ ID NO: 24303 | CAGGTGCAGCTGGTGGAGTCTGGGGGAGGCGTG GTCCAGCCTGGGAGGTCCCTGAGACTCTCCTGT CAGCGTCTGGATTCACCTTCAGTAGCTATGCCAT GCACTGGGTCCGCCAGGCTCCAGGCAAGGGGCT GGAGTGGGTGGCAGTTATATGTTTGATGGAAGT GATAAATACTATGCAGACTCCGTGAAGGGCCGA TTCACCATCTCCAGAGACACAATTCAAGAACACGC TGTATCTACAAATGAACAGCCTGAGAGCCGAGG ACACGGCTGTGTATTACTGTGCGAGAGATCGGGC CTATAGTAGCTCGTCTGACTACTGGGGCCAGGGA ACCCTGGTCACCGTCTCCTCA<br><br>SEQ ID NO: 28309 |
| | | AA | DIQMTQSPSSLSAPVGDRVSITCRASQNIINYLN WYQQKPGKAPKLLIDVASNLQGGVPSRFSGSGS GTDFTLTISSLQPEDFATYYCQQSYSTPFFGPGT KVDIK.<br><br>SEQ ID NO: 24304 | QVQLVESGGGVVQPGRSLRLSCAASGFTFSSYAMH WVRQAPGKGLEWVAVIWFDGSDKYYADSVKGRF TISRDNSKNTLYLQMNSLRAEDTAVYYCARDRAYS SSSDYWGQGTLVTVSS<br><br>SEQ ID NO: 28310 |
| iPS:392696 | 21-225_20A4 | NA | GACATCCAGATGACCCAGTCTCCAGCCTCCCT GTCTGCATCTGTAGGAGACAGAGTCACCATCA CTTGCCGGGCAAGTCAGAGCATTATCAACTAT TTAAATTGGTATCAGCAGAAGACCAGGGAAATC CCCTAAGCTCCTGATCTATGCTGCATCCAGTTT GCACAGTGGGGTCCCATCAAGGTTCAGTGGCA GAGGATCTGGGACAGATTTCACTCTCACCATC AGTAGTCTGCAACCTGAAGATTTTGCAACTTA CTTCTGTCAACAGAGTTACAGAACCCCCTTAT TCACTTTCGGCCCTGGGACCAAAGTAGATTTC AAA<br><br>SEQ ID NO: 24305 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GACCTGGGTCCGCCAGGTTCCAGGGATGGGGCT GGAGTGGGTCTCAGTTATAAGTGGTAGTGGTGGT TACATACAAACGCGGACTCCGTGAAGGGCCGG TTCACCATCTCCAGAGACAATTCAAGAACACGC TGTATCTGCAAATGAACAGCCTGAGAGTCGAGG ACACGGCCGTATATTACTGTGCGTCCCGTATAGC AGTGGCTGGCTCGGAGGCTTTTGATATCTGGGGC CAAGGGACAATGGTCACCGTCTCTTCA<br><br>SEQ ID NO: 28311 |

FIGURE 50
(Continued)

| | | | | |
|---|---|---|---|---|
| | | | DIQMTQSPASLSASVGDRVTITCRASQSIINYLN WYQQRPGKSPKLLIYAASSLHSGVPSRFSGRGSG TDFTLTISSLQPEDFATYFCQQSYRTPLFTFGPGT KVDFK | EVQLLESGGGLVQPGGSLRLSCAASGFTFSSYAMT WVRQGPGMGLEWVSVISGSGYTYNADSVKGRFT ISRDNSKNTLYLQMNSLRVEDTAVYYCASRIAVAG SEAFDIWGQGTMVTVSS | |
| | | AA | SEQ ID NO: 24306 | SEQ ID NO: 28312 |
| | | NA | GACATCCAGATGACCCAGTCTCCATCCCCT GTCTGCATCTGTAGGAGACAGAGTCACCATCA CTTGCCGGGCAAGTCAGGGCATTAGAAATGAT TTAGGCTGGTATCAGCAGAGACCAGGGAAAG CCCTAAGCGCCTGATCTATGCTGCATCCAGT TTACAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA | CAGGTGCAGCTGGTGGAGTCTGGGGGAGGCCTG GTCCAGCCTGGGAGGTCCCTGAGACTCTCCTGTG CAGCCGTCTGGATTCACCTTCAGTAACTATGGCAT GCACTGGGTCCGCCAGGCTCCAGGCAAGGGGCT GGAGTGGGTGGCAGTTATATGGTATGAGGGAAG TAATAAATATTATGGTAGACTCCGTGAGGGCCGA TTCACCATCTCCAGAGACAATTCCAAGAGCACGC TGTATCTGCAAATGAACAGCCTGAGAGCCGAGG ACACGGCTGTGTATTACTGTGTGAGAGAGCTAGG CTTCCAGTCTGATCACTGGGGCCAGGGAACCCCG GTCACCGTCTCCTCA | |
| | | | SEQ ID NO: 24307 | SEQ ID NO: 28313 |
| iPS:392700 | 21-225_16E12 | AA | DIQMTQSPSSLSASVGDRVTITCRASQGIRNDLG WYQQKPGKAPKRLIYAASSLQSGVPSRFSGSGS GTEFTLTISSLQPEDFATYCLQHNSYPLTFGGG TKVEIK | QVQLVESGGGLVQPGRSLRLSCAASGFTFSNYGMH WVRQAPGKGLEWVAVIWYEGSNKYYVDSVRGRF TISRDNSKSTLYLQMNSLRAEDTAVYYCVRELGFQ SDHWGQGTPVTVSS | |
| | | | SEQ ID NO: 24308 | SEQ ID NO: 28314 |

FIGURE 50
(Continued)

| | | | |
|---|---|---|---|
| iPS:392702 | 21-225_17F7 | NA | GACATCCAGATGACCCAGTCTCCATCCTCCT GTCTGCATCTGTTGGAGACAGAGTCACCATCA CTTGCCGGGCAAGTCAGACAGTCATTAGTTT TTAAATTGGTATCAGCAGAAACCAGGGAAAG CCCCTAAACTCCTGATCTATGCTGCTTCCAGTT TGCAAAGTGGGGTCCCGTCAAGGTTCAGTGGC AGTGGATCTGGGACAGATTTCACTCTCACCAT CAGCGGTCTGCAACCTGAAGATTTTGCAACTT ACTTCTGTCAACAGAGTTACAGAACCCCCTTT TTCACTTTCGGCCCTGGGACCAAAGTGGATAT CAAA<br/><br/>SEQ ID NO: 24309 | GAGGTGCAGCTGTTGGAGTCTGGGGGAGGCTTG GTACAGCCTGGGGGGTCCCTGAGACTCTCCTGTG CAGCCTCTGAATTCACCTTTAGCAGCTATGCCAT GAACTGGGTCCGCCAGGCTCCAGGGAAGGGCT GGAGTGGGTCTCAATTATTAGTGGTCGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGTCCCGTTTGGCA GTGGCTGGCTCGGAGGCTTTTGATATCTGGGGCC AAGGGACAATGGTCACCGTCTCTTCA<br/><br/>SEQ ID NO: 28315 |
| | | AA | DIQMTQSPSSLSASVGDRVTITCRASQTISSFLNW YQQKPGKAPKLLIYAASSLQSGVPSRFSGSGSGT DFTLTISGLQPEDFATYFCQQSYRTPFFTFGPGTK VDIK<br/><br/>SEQ ID NO: 24310 | EVQLLESGGGLVQPGGSLRLSCAASEFTFSSYAMN WVRQAPGKGLEWVSIISGRGGNTFYADSVKGRFTI SRDNSKNTLYLQMNSLRAEDTAVYYCASRLAVAG SEAFDIWGQGTMVTVSS<br/><br/>SEQ ID NO: 28316 |
| iPS:392704 | 21-225_17F11 | NA | GACATCCAGATGACCCAGTCTCCATCCTCCCT GTCTGCATCTATAGGAGACAGAGTCTCCATCA CTTGCCGGGCAAGTCGGACCATTAACAACTAT TTAAATTGGTATCAGCAGAAACCAGGGAAAG CCCCTAAACTCCTGATCTTTGCTACATCAGTT TACAAAGTGGGGTCCCATCAAGGTTCACTCAGTGGC AGTGGATCTGGGACAGATTTCACTCTCACCAT CAGCAGTCTGCAACCTGAAGATTTTGCAACTT ACTACTGTCAACAGACTTACAGTACCCCCTTA TTCGCTTTCGGCCCTGGGACCAAAGTGGATAT CAAA<br/><br/>SEQ ID NO: 24311 | GAGGCGCAGCTGTGTTGGAGTCTGGGGGAGGCTTG GAACAGCCTGGGGGGTCCCTGAGACTCTCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTGGTAGAGGTGGT AACACATACTCCGCAGACTCCGTGAAGGGCCGG TTCACCATCTCCAGAGACAATTCCAAGAACACGC TATATCTACAAATGAACAGCCTGAGAGCCGAGG ACACGGCCGTATATTACTGTGCGTCCCGTTTAGC AGTGGCTGGCTCGGAGGCTTTTCATATCTGGGGC CAAGGGACAATGGTCACCGTCTCTTCA<br/><br/>SEQ ID NO: 28317 |

FIGURE 50
(Continued)

| | | | | |
|---|---|---|---|---|
| iPS:392706 | 21-225_18A3 | AA | DIQMTQSPSSLSASIGDRVSITCRASRTINNYLNW YQQKPGKAPKLLIFATSSLQSGVPSRFSGSGSGT DFTLTISSLQPEDFATYYCQQTYSTPLFAFGPGTK VDIK<br>SEQ ID NO: 24312 | EAQLLESGGGLEQPGGSLRLSCAASGFTFSSYAMS WVRQAPGKGLEWVSVISGRGGNTYSADSVKGRFTI SRDNSKNTLYLQMNSLRAEDTAVYYCASRLAVAG SEAFHIWGQGTMVTVSS<br>SEQ ID NO: 28318 |
| | | NA | GACATCCAGATGACCCAGTCTCCATCCTCCCT GTCTGCATCTGTAGGAGACAGAGTCAGCATCA CTTGCCGGGCAAGTCAGGGCATTAGAAATGAT TTAGGCTGGTATCAGCAGAAACCAGGGAAAG CCCCTAAGGCCCTGATCTATGTTGCATCCAGTT TGCAAAGTGGGGTCCCATCAAGGTTCAACGGC AGTGGATCTGGGACAGATTCACTCTCACAAT CAGCAGCCTGCAGCCTGAAGATTTTGCAACTT ATTACTGTCTACAGCATAGTAGTTACCCGCTC ACTTTCGGCGGAGGGACCAAGGTGGAGATCA AA<br>SEQ ID NO: 24313 | CAGCTGCAGCTGCAGGAGTCGGCCCAGGACTG GTGAAGTTTCGGAGACCCTGTCCCTCACCTGCA CTGTCTCTGGTGGCTCCATCAGCAGAAGTAGTTA TTACTGGGGCTGGATCCGCCAGCCCCCAGGGAA GGGGCTGGAGTGGATTGGGAATATCTATTATAGT GGGTATACCTACTACAACTCCGTCCTCAAGAGTC GAGTCACCATATCCGTAGACACGTCCAAGAACC AGTTCTCCCTGAAGCTGAGCTCTGTGACCGCCGC AGACACGGCTGTGTATTACTGTGCGAGACATAGC ACCAGTGGTCCCTTGACTACTGGGGCCAGGGAA CCCTGGTCACCGTCTCCTCA<br>SEQ ID NO: 28319 |
| | | AA | DIQMTQSPSSLSASVGDRVTITCRASQGIRNDLG WYQQKPGKAPKRLIYVASSLQSGVPSRFNGSGS GTEFTLTISSLQPEDFATYCYCLQHSSYPLTFGGGT KVEIK<br>SEQ ID NO: 24314 | QLQLQESGPGLVKFSETLSLTCTVSGGSISRSSYYW GWIRQPPGKGLEWIGNIYYSGYTYTPSLKSRVTIS VDTSKNQFSLKLSSVTAADTAVYYCARHSTSWSLD YWGQGTLVTVSS<br>SEQ ID NO: 28320 |

FIGURE 50
(Continued)

| | | | |
|---|---|---|---|
| iPS:392708 | 21-225_18D11 | NA | GACATCCAGATGACCCAGTCTCCTTCCTCACT GTTTGCATTTGTAGGAGACAGAGTCACCATCA CTTGTCGGGCGAGTCAGGGCATTAGTAATTAT TTAGCCTGGTTTCAGCAGAAACCAGGGAAAGC CCCTAAGTCCCGATTTATGTTGCATCCAGTTT GCAAAGTGGGGTCCCATCAAAGTTCAGCGGCA GTGGATTTGGGACAGATTTCACTCTCACCATC AGCAGCCTGCAGCCTGAAGATTATACTTA TTACTGCCAACAGTATAATACTTACCCATTCA CTTTCGGCCCTGGGACCACAGTGGATATCAAG | GAGGTGCAGCTGGTGGAGTCTGGGGGAGGCTTG GTACAGCCTGGGGGGTCCCTGAGACTCTCCTGTG CAGCCTCTGGATTCACCTTCAGAAGCTATAGCAT GAACTGGGTCCGCCAGGCTCCAGGGAAGGGCT GGAGTGGCTTTCATACATTAGTAGTAGTAGTGGT ACCATATACTACGCAGACTCTGTGAAGGGCCGAT TCACCATCTCCAGAGACAACGCCAAGAACTCACT GAATCTGCAAATGAACAGCCTGAGAGACGAGGA CACGGCTGTGTATTACTGTGCGAGAGGAGGTGGG AGCCCTTTTGACTACTGGGGCCAGGGAATCCTGG TCACCGTCTCCTCA |
| | | | SEQ ID NO: 24315 SEQ ID NO: 28321 |
| | | AA | DIQMTQSPSSLFAFVGDRVTITCRASQGISYYLA WFQQKPGKAPKSLIYVASSLQSGVPSKFSGSGPG TDFTLTISSLQPEDFATYYCQQYNTYPFTFGPGTT VDIK | EVQLVESGGGLVQPGGSLRLSCAASGFTFRSYSMN WVRQAPGKGLEWLSYISSSSGTIYYADSVKGRFTIS RDNARNSLNLQMNSLRDEDTAVYYCARGGGSPFD YWGQGILVTVSS |
| | | | SEQ ID NO: 24316 SEQ ID NO: 28322 |
| iPS:392710 | 21-225_19A10 | NA | GACATCCAGATGACCCAGTCTCCATCTCCCT GTCTGCATCTGTAGGAGACAGAGTCACCATCA CTTGCCGGGCAAGTCAGGGCATTAGAACTGAT TTAGGCTGGTATCAGCAGAAACCAGGGAAAG CCCCTAAAGCGCCTGATCTATACTGCATCAGT TTGCAAAGTGGGGTCCCATCAAGGTTCAGCGG CAGTGGATCTGGGACAGAATTCACTCTCACAA TCAGCAGGCTGCAGCCTGAAGATTTTGCAACT TATTACTGTCTACAGCATAATAATGGTTACCGTG GACGTTCGGCCAAGGGACCAAGGTGGAAATC AAA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTATGGCAT GCATGGGTCCGCCAGGCTCCAGGCAAGGGGCT GGAGTGGGTGGCAGTTATATATGGTATGGAAAGT AATAAAATACTATGCAGAGACTCCGTGAAGGGCCGA TTCACCATCTCCAGAGACAATTCCAAGAACACGC TGTATCTGCAAATGAACAGCCTGAGAGCCGAGG ACACGGCTACGAGGACTCCTGGGGCCAGGGAGCCTTGC CTGGTACGAGGACTCCTGGGGCCAGGGAACCCT GGTCACCGTCTCCTCA |
| | | | SEQ ID NO: 24317 SEQ ID NO: 28323 |

FIGURE 50
(Continued)

| | | | | |
|---|---|---|---|---|
| iPS:392714 | | AA | DIQMTQSPSSLSASVGDRVTITCRASQGIRTDLG WYQQRPGKAPKRLLYTASSLQSGVPSRFSGSGSG TEFTLTISRLQPEDFATYYCLQHNGYPWTFGQGT KVEIK<br>SEQ ID NO: 24318 | QVQLVESGGGVVQPGRSLRLSCAASGFTFSSYGMH WVRQAPGKGLEWVAVIWYDESNKYYADSVKGRF TISRDNSKNTLYLQMNSLRAEDTAVYYCARELAW YEDSWGQGTLVTVSS<br>SEQ ID NO: 28324 |
| | 21-225_16G12 | NA | GACATCCAGATGACCCAGTCTCCATCCTCACT GTCTGCATCTGTTGGAGACAGAGTCACCATCA CTTGTCGGGCGAGTCAGAGACATTAGCAATTAT TTAGCCTGGTTTCAGCAGAAACAGGGAAAGC CCCTAAGTCCCTGATCTATGCTGCATCCAGTTT GCAAAGTGGGGTCCATCAAGGTTCAGAGGC AGTGGATCTGGGACAGATTTCACTCTCACCAT CAGCAACCTGCAGCCTGAAGATTTTGCATCTT ATTACTGCCAACAGTATCATAGTTTCCCATTCA CTTTCGGCCCTGGGACCAAAGTGGATATCAAA<br>SEQ ID NO: 24319 | GAGGTGCAACTGTTGGAGTCGGGGGGAGGCTTG GTACAGCCTGGGGGGTCCCTGAGACTCTCCTGTG CAGCCTCTGGATTCTCCTTTAGTAGCTATGCCAT GACTTGGGTCCGCCAGGCTCCAGGGAAGGGCT GGAGTGGGTCTCAACTATTAGTGGTCGTGGTGGT CACACATACTACGCAGACTCCGTGAGGGCCGG TTCGCCATCTCCAGAGACACAGTTCCAAGAACAGC TGTATCTGCAAATGAACAGCCTGAGAGCCGAGG ACACGGCCGTATATTACTGTGCGAAACAGGACTG CTGGGGCCAGGGAACCCTGGTCACCGTCTCCTCA<br>SEQ ID NO: 28325 |
| | | AA | DIQMTQSPSSLSASVGDRVTITCRASQDISNYLA WFQQKPGKAPKSLIYAASSLQSGVPSKFRGSGSG TDFTLTISNLQPEDFASYYCQQYHSFPFTFGPGTK VDIK<br>SEQ ID NO: 24320 | EVQLLESGGGLVQPGGSLRLSCAASGFSFSSYAMT WVRQAPGKGLEWVSTISGRGGHTYYADSVRGRFA ISRDSSKNTLYLQMNSLRAEDTAVYYCAKQDCWG QGTLVTVSS<br>SEQ ID NO: 28326 |

FIGURE 50
(Continued)

| | | | |
|---|---|---|---|
| iPS:392716 | 21-225_17B5 | NA | GACATCAGAGATGACCCAGTCTCCATCCTCCCT GTCTGCATCTGTAGGAGACAGAGTCACCATCA CTTGCCGGGCAAGTCAGGGCATTAGAAATGAT TTAGGCTGTATCAGCAGAAACCAGGGAAAG CCCCTAAGCGCCTGATCTATGCTGCATCCAAT TTGCAAAGTGGGGTCCCATCAAGGTTCAGCGG CAGTGGATCTGGGACAGAATTCAGTTTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA SEQ ID NO: 24321 | CAGGTGCAGTTGGTGGAGTCTGGGGGAGGCGTG GTCCAGCCTGGGAGGTCCCTGAGACTCTCCTG CAGCGTCTGGATTCACCTTCAGTGACTATGGCAT GCACTGGGTCCGCCAGGCTCCAGGCAAGGGCT GGAGTGGGTGGCAGTTATATGGTATGATGAAAGT AATAAACACTATATAGACTCCGTGAAGGGCCGA TTCACCATCTCCAGAGACAATTCCAAGAACACGC TGTATCTGCAAATGAACAGCCTGAGAGCCGAGG ACACGGCTGTGTATTATTGCGTGAGAGAACTGGG GTTCCGGTTTGACTACTGGGGCCAGGGAACCCTG GTCACCGTCTCCTCA SEQ ID NO: 28327 |
| | | AA | DIQMTQSPSSLSASVGDRVTITCRASQGIRNDLG WYQQKPGKAPKRLIYAASNLQSGVPSRFSGSGS GTEFSFTISSLQPEDFATYYCLQHNSYPLTFGGGT KVEIK SEQ ID NO: 24322 | QVQLVESGGGVVQPGRSLRLSCAASGFTFSDYGM HWVRQAPGKGLEWVAVIWYDESNKHYIDSVKGRF TISRDNSKNTLYLQMNSLRAEDTAVYYCVRELGFR FDYWGQGTLVTVSS SEQ ID NO: 28328 |
| iPS:392718 | 21-225_17B8 | NA | GATATTGTGATGACTCAGTCTCCACTCTCCCTG CCCGTCACCCCTGGAGAGCCGGCCTCCATCTC CTGTAGGTCTAGTCAGAGCCTCCTGCATAGTA ATGGGAACAACTCTTTGGATTGTACCTGCAG AAGCCAGGGCAGTCTCCACAGCTCCTGATCTA TTTGGGTTCTCATCGGGCCTCCGGGGTCCCTG ACAGGTTCAGTGACAGTGGATCAGGCACAGAT TTTACACTGAAAATCAGCAGAGTGGAGGCTGA AGCCTACTACTGCATGCAAGCTCTACAAGCT GGATGTGGGGTTTATTACTGCGGCGGAGGGACCAA AGGTGGAGATCAAA SEQ ID NO: 24323 | CAGGTGCAGCTGGTGCAGTCTGGGGCTGAGGTG AAGAAGCCTGGGGCCTCAGTGAAGGTCTCCTGC AAGGCGTCTGGATACACCTTCACCAGCTATGCTA TCAACTGGGTGCGACAGGCCACTGGACAAGGGC TTGAGTGGATGGGATGGATGAACCCTAACACTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTATATTTCTGTACGAGAAGGCT GGGTTTGACTACTGGGGCCAGGGAACCCTGGTCA CCGTCTCCTCA SEQ ID NO: 28329 |

FIGURE 50
(Continued)

| | | AA | DIVMTQSPLSLPVTPGEPASISCRSSQSLLHSNGN NSLDWYLQKPGQSPQLLIYLGSHRASGVPDRFS DSGSGTDFTLKISRVEAEDVGVYYCMQVLQTPP LTFGGGTKVEIK<br><br>SEQ ID NO: 24324 | QVQLVQSGAEVKKPGASVKVSCKASGYTFTSYAIN WVRQATGQGLEWMGWMNPNTGNTGYAQKFQGR VTMTRNTSISTAYMELSSLRSEDTAVYFCTRKAGF DYWGQGTLVTVSS<br><br>SEQ ID NO: 28330 |
|---|---|---|---|---|
| iPS:392720 | 21-225_17A12 | NA | GACATCCAGATGACCCAGTCTCCATCCTCCT GTCTGCATCTGTAGGAGACAGAGTCACCATCA CTTGCGGGCAAGTCAGAGCATTAGTAGTTAT TTAAATTGGTATCACCAGAAACCAGGGAAAGC CCCTAAGCTCCTGATCTATGCTGCATCCAGTTT GCAAAGTGGGGTCCCATCAAGGTTCAGTGGCA GTGGATCTGGGACAGATTTCACTCTCACCATC AGCAATCTGCAACCTGAAGATTTTGCAACTTA CTACTGTCAACAGAGTTACAATACCCCCTTAT TCACTTTCGGCCCTGGGACCAAAGTGGATATC AAA<br><br>SEQ ID NO: 24325 | GAGGTGCAGCTGTTGGAGTCTGGGGGAGGCTTG ATACAGCCTGGGGGGTCCCTGAGACTCTCCTGTG CAGCCTCTGGAATTCACCTTTAGCAGCTATGCCAT GAGCTGGGTCCGCCAGGATCCAGGGAAGGGGCT GGAGTGGGTCTCAATTATTAGTGGTCGTGGGGGA AACGCATTCTACGCAGACTCCGTGAAGGGCCGGT TCACCATCCAGAGACAATTCCAAGAACACGCT GTATCTGCAAATGAACAGCCTGAGAGCCGAGGA CACGGCCGTATATTACTGTGCGTCCCGTATAGCA GTGGCTGGCTCGGAGGCTTTTGATATCTGGGGCC AAGGGACAATGGTCACCGTCTCTTCA<br><br>SEQ ID NO: 28331 |
| | | AA | DIQMTQSPSSLSASVGDRVTITCRASQSISSYLNW YHQKPGKAPKLLIY AASSLQSGVPSRFSGSGSGT DFTLTISNLQPEDFATYYCQQSYNTPLFTFGPGT KVDIK<br><br>SEQ ID NO: 24326 | EVQLLESGGGLIQPGGSLRLSCAASEFTFSSYAMSW VRQDPGKGLEWVSIISGRGGNAFYADSVKGRFTISR DNSKNTLYLQMNSLRAEDTAVYYCASRIAVAGSE AFDIWGQGTMVTVSS<br><br>SEQ ID NO: 28332 |

FIGURE 50
(Continued)

| | | | |
|---|---|---|---|
| iPS:392722 | 21-225_18E12 | NA | GACATCCAGATGACCCAGTCTCCATCTCCCT GTCTGCATCTGTAGGAGACAGAGTCACCATCA CTTGCCGGGCAAGTCAGAGCATTAGTAGTTAT TTAAATTGGTATCAGCAGAAACCAGGGAAAG CCCCTACGCTCCTGATCTATGCTGCATCCAGTT TACAAAGTGGGGTCCCATCAAGGTTCAGTGGC AGTGGATCTGGGACAGATTTCACTCTCACCAT CAACAGTCTGCAACCTGAAGATTTTGCAACTT ACTTCTGTCAACAGAGTTACAGAACCCCTTT TTCACTTTCGGCCCTGGGACCAAAGTGGATAT CAAA<br><br>SEQ ID NO: 24327 | GAGGTGCAGCTGTTGGAGTCTGGGGGAGGCTTG GTACAGCCTGGGGGGTCCCTGAGACTCTCCTGTG CAGCCTCTGAATTCACCTTTAGCAGCTATGCCAT GAGCTGGGTCCGCCAGGCTCCAGGGACGGGGCT GGAGTGGGTCTCAATTATTAGTGGTCGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGTCCCGTCTGGCA GTGGCTGGCTGGGAGGCTTTTGATATCTGGGGCC AAGGGACGATGGTCACCGTCTCTTCA<br><br>SEQ ID NO: 28333 |
| | | AA | EVQLLESGGGLVQPGGSLRLSCAASEFTFSSYAMS WVRQAPGTGLEWVSIISSRGGNTFYADSVKGRFTI SRDNSKNTLYLQMNSLRAEDTAVYYCASRLAVAG SEAFDIWGQGTMVTVSS<br><br>SEQ ID NO: 28334 |
| iPS:392726 | 21-225_20B5 | NA | GACATCCAGATGACCCAGTCTCCATCTCCCT GTCTGCATCTGTAGGAGACAGAGTCACCATCA CTTGCCGGGCGAGTCAGGGCATTAACAATTAT TTAGCCTGGTATCAGCAGAAACCAGGGAAAAT TCCTAAGCTCCTGATCTATGCTGCCATCCACTTT GCAATCAGGGGTCCCCTCTCGGTTCAGTGGCA GTGGATCTGGGACAGATTTCACTCTCACCATC AGCAGCCTGCAGCCTGAAGATATAACAGTGCCCTCCGA TTGCTGTCAAAAGTATAACAGTGCCCCTCCGA TCACCTTCGGCCAAGGGACACGACTGGAGATT AAA<br><br>SEQ ID NO: 24329 | GAGGTGCAGCTGGTGGAGGCCGGGGGAGGCCTG GTCAAGCCGGGGGGGTCCCTGAGACTCTCCTGTG CAGCCTCTGATTCACCTTCACCAGCTATAGCAT GAACTGGGTCCGCCAGGCTCCAGGGAAGGGGCT GGAGTGGGTCTCATCATTAGTGGGAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGATCGTGGG AGCTACTGGGGCCAGGGTACCCTGGTCACCGTCT CCTCA<br><br>SEQ ID NO: 28335 |

FIGURE 50
(Continued)

| | | | | |
|---|---|---|---|---|
| | | AA | DIQMTQSPSSLSASVGDRVTITCRASQGINNYLA WYQQKPGKIPKLLIYAASTLQSGVPSRFSGSGSG TDFTLTISSLQPEDVATYCCQKYNSAPPITFGQGT RLEIK | EVQLVEAGGGLVKPGGSLRLSCAASGFTFTSYSMN WVRQAPGKGLEWVSSISGSSSYIYADSVKGRFTIS RDNAKNSLYLQMNSLRAEDTAVYYCARDRGSYW GQGTLVTVSS |
| | | | SEQ ID NO: 24330 | SEQ ID NO: 28336 |
| iPS:392728 | 21-225_20F7 | NA | GACATCCAGATGACCCAGTCTCCATCTTCCGT GTCTGCATCTGTAGGAGACGGAGTCACCATCA CTTGTCGGGCGAGTCAGGGTATTAGCAGTGG TTAGCCTGGTATCAGCAGAAACCAGGAAAG CCCCTAAACTCTTGATTTATGCTGCATCCAGTT TGCAAAGTGGGGTCCATCAAGGTTCAGCGGC AGTGGATCTGGGACAGATTTCACTCTCACAT CAGCAGCCTGCAGCCTGAAGATTTTGCAACTT ACTATTGTCAACAGGCTAACAGTTTCCCTCGG ACGTTCGGCCAAGGGACCAAGGTGGAAATCA AA | CAGGTGCAGCTGGTGGTGGAGTCTGGGGGAGGCTTG GTCAAGCCTGGAGGGTCCCTGAGACTCTCCTGTG CAGCCTCTGGATTCACCTTCAGTGACTATTACAT GAGCTGGATCCGCCAGGCTCCAGGAAGGGCT GGAGTGGGTTCACACATTAGTAGTAGTGGTAGT ACCATATACTACGCAGACTCTGTGAAGGGCCGAT TCACCATCTCCAGGGACAACGGCGAGAACTCACT GTATCTGCAAATGAACAGCCTGAGAGCCGAGA CACGGCCGTGTATTACTGTGCGAGATATCGGAAT AACCGGGGTACTTCGATCTCTGGGGCCGTGGCT CCCTGGTCACTGTCTCCTCA |
| | | | SEQ ID NO: 24331 | SEQ ID NO: 28337 |
| | | AA | DIQMTQSPSSVSASVGDGVTITCRASQGISSWLA WYQQKPGKAPKLLIYAASSLQSGVPSRFSGSGS GTDFTLTISSLQPEDFATYCQQANSFPRTFGQG TKVEIK | QVQLVESGGGLVKPGGSLRLSCAASGFTFSDYYMS WIRQAPGKGLEWVSHISSSGSTIYADSVKGRFTIS RDNGENSLYLQMNSLRAEDTAVYYCARYRNNRG YFDLWGRGSLVTVSS |
| | | | SEQ ID NO: 24332 | SEQ ID NO: 28338 |

FIGURE 50
(Continued)

| | | | |
|---|---|---|---|
| iPS:392730 | 21-225_17A1 | NA | GACATCCAGATGACCCAGTCTCCATCCTCCCT GTCTGCATCTGTAGGAGACAGAGTCACCATCA CCTGCCGGGCAAGTCAGAAACATTAACAATTAT TTAAATTGGTATCAGCAGAAACCAGGGAAAG GCCCTAAGGTCCTGATCTTTACTACATCTAGTT TACAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACACTACCCCCACG TGGACGTTCGGCCAAGGGACCAAGGTGGAAA TCAAA<br><br>SEQ ID NO: 24333 | GAGGTGCAACTGTTGGAGTCTGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGGAAGGGCT GGAGTGGGTCTCAGTTATTAGTGGTAGTGGTAGT AACACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCAAAAGATATAC CAGTGACTGGCATGATGCTTTTGATATCTGGGGC CAAGGGACAATGGTCACCGTCTCCTCA<br><br>SEQ ID NO: 28339 |
| | | AA | DIQMTQSPSSLSASVGDRVTITCRASQNINNYLN WYQQKPGKAPKVLIFTSSLQSGVPSRFSGSGSG TDFTLTISSLQPEDFATYYCQQSYTTPTWTFGQG TKVEIK<br><br>SEQ ID NO: 24334 | EVQLLESGGGLVQPGGSLRLSCAASGFTFSSYAMN WVRQAPGKGLEWVSVISGSGSNTYYADSVKGRFTI SRDNSKNTLYLQMNSLRAEDTAVYYCAKRYTSDW HDAFDIWGQGTMVTVSS<br><br>SEQ ID NO: 28340 |
| iPS:392732 | 21-225_17E5 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATACTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAACATAATAGTTACCCGTTG ACGTTCGGCCGCCCAGGGACCAAGGTGGTCATCAA A<br><br>SEQ ID NO: 24335 | CAGGTGCAACTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCACTTATATGGAGACTCGTGAAGGGCCGA AATAAATACTATGGAGACTCCGTGAAGGGCCGA TTCACCATCTCCAGAGACAATTCCAAGAACACGC TGTATCTGCAACTGAACAGCCTGAGAGCCGAGG ACACGGCTGTGTATTACTGTGCGAGAGAGCTTGG CTGGTACGAGGACTACTGGGGCCAGGGAACCCT GGTCACCGTCTCCTCA<br><br>SEQ ID NO: 28341 |

FIGURE 50
(Continued)

| | | | | |
|---|---|---|---|---|
| | | AA | DIQMTQSPSSLSASVGDRVTITCRASQGIRNDLG WYQQKPGKAPKRLIYTASSLQSGVPSRFSGSGSG TEFTLTISSLQPEDFATYYCLQHNSYPLTFGPGTK VVIK<br>SEQ ID NO: 24336 | QVQLVESGGGVVQPGRSLRLSCAASGFTFSDYGM HWVRQAPGKGLEWVALIWYDVTNKYYGDSVKGR FTISRDNSQNTLYLQLNSLRAEDTAVYYCARELGW YEDYWGQGTLVTVSS<br>SEQ ID NO: 28342 |
| iPS.392734 | 21-225_17D8 | NA | GAAATAGTGATGACGCAGTCTCCATCCACCCT GTCTGTGTCTCCAGGGGAAAGAGCCACCCTCT CCTGCAGGGCCAGTCAGAGTGTTAGCAGCAAC TTAGCCTGGTTCCAGCAGAAACCTGGCCAGGC TCCCAGGCTCCTCATCAATGTGCATCCACCA GGGCCAGTGGTATCCCAGCAGTTCAGTGGC AGTGGGTCTGGGACAGATTTCACTCTCACCAT CAGCAGCCTGCAGTCTGAAGATTTTGCAGTTT ATTACTGTCAGCAGTATAATAACTGGCCTCTG ACGTTCGGCCAAGGGACCAAGGTGGAAATCA AA<br>SEQ ID NO: 24337 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATGGCTT GAACTGGGTCCGCCAGGCTCCAGGGAAGGGGCT GGAGTGGGTCTCATCACGCGGACTCAGTAGTGGTAGT CACATATCCTACGCGGACTCAGTGAAGGGCCGAT TCACCATCTCCAGAGACAACAGCCTGAGAGCCGAGGA GTATCTGCAACTGAACAGCTGTGCGAGAGATCGGGGC CACGGCTGTATTACTGTGCGAGAGATCGGGGC AGTGGCTGGGCCAAGGAACCCTGGTCACCGTCT CCTCA<br>SEQ ID NO: 28343 |
| | | AA | EIVMTQSPSTLSVSPGERATLSCRASQSVSSNLA WFQQKPGQAPRLLINGASTRASGIPARFSGSGSG TEFTLTISSLQSEDFAVYYCQQYNNWPLTFGQGT KVEIK<br>SEQ ID NO: 24338 | EVQLVESGGGLVKPGGSLRLSCAASGFTFSSYGLN WVRQAPGKGLEWVSSISGSGSHISYADSVKGRFTIS RDNAKNSLYLQLNSLRAEDTAVYYCARDRGSGWG QGTLVTVSS<br>SEQ ID NO: 28344 |

FIGURE 50
(Continued)

| | | | |
|---|---|---|---|
| iPS:392736 | 21-225_17B12 | NA | GACATCCAGATGACCCAGTCTCCATCCTCCCT GTCTGCATCTGTAGGAGACAGAGTCTCCATCA CTTGCCGGGCAAGTCAGAATATTAACAACTAT TTAAATTGGTATCAGCAGAAACCAGGGAAAG GCCCTAAGGTCCTGATCCTTACTGCATCCAGT TGCAAAGTGGGGTCCCATCAAGGTTCAGTGGC AGTGGATCTGGGACAGATTCACTCTCACCAT CAGCAGTCTACAACCTGAAGATTTTGCAACTT ACTACTGTCAACAGACTTACACTACCCCCACG TGGACGTTCGGCCAAGGGACCAAGGTGGAAA TCAAA | GAGGTGCAGCTGTTGGAGTCTGGGGGAGGCTTG GTACAGCCTGGGGGGTCCCTGAGACTCTCCTGTG TAGCCTCTGGATTCACCTTTAGCAGCTATGCCAT GAACTGGGTCCGCCAGGCTCCAGGGAAGGGCT GGAGTGGGTCTCAGTTATTAGTGGTAGTGGTGGT AGCACATACTACGCAGACTCCGTGAAGGGCCGG TTCACCATCTCCAGAGACAATTCCAAGAACACGC TGTATCTGCAAATGAACACCCTGAGAGCCGAGG ACACGGCCGTATATTACTGTGCGAAAAGGTATAC CAGTGACTGGCATGATGCTTTTGATATCTGGGGC CAAGGGACAATGGTCACCGTCTCTTCA |
| | | | SEQ ID NO: 24339 SEQ ID NO: 28345 |
| | | AA | DIQMTQSPSSLSASVGDRVSITCRASQNINNYLN WYQQKPGKPVLILTASSLQSGVPSRFSGSGSG TDFTLTISSLQPEDFATYYCQQTYTTPTWTFGQG TKVEIK EVQLLESGGGLVQPGGSLRLSCVASGFTFSSYAMN WVRQAPGKGLEWVSVISGSGGSTYYADSVKGRFTI SRDNSKNTLYLQMNTLRAEDTAVYYCAKRYTSDW HDAFDIWGQGTMVTVSS |
| | | | SEQ ID NO: 24340 SEQ ID NO: 28346 |
| iPS:392738 | 21-225_18G4 | NA | GACATCCACATGACCCAGTCTCCATCCTCCCT GTCTGCATCTGTAGGAGACAGAGTCTCCATCA CTTGCCGGGCAAGTCAGAGACATTAGCAGCTAT TTAAATTGGTATCAGCAGAAACCAGGGAAAG CCCCTAAGGTCCTGATCTATACTGCATCCAGT TGCAAACTGGGGTCCCATCAGGGTTCAGTGGC AGTGGATCTGGGACAGATTTCACTCTCACCAT CAGCAGTCTGCAACCTGAAGATTTTGCAACTT ACTACTGTCAACAGACTTACAGTCCCCCGTC ACTTTCGGCGGTGGGACCAAGGTGGAGATCAA A | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGGCAT GCACTGGGTCCGCCAGGCTCCAGGCAAGGGCT GGAGTGGGTGGCAATTATATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCTGAG TATGGGCGGTATGGACGTCTGGGGCCAAGGGAC CACGGTCACCGTCTCCTCA |
| | | | SEQ ID NO: 24341 SEQ ID NO: 28347 |

FIGURE 50
(Continued)

| | | AA | DIHMTQSPSSLSASVGDRVTITCRASQSIISYLNWYQQKPGKAPKVLIYTASSLQTGVPSGFSGSGSGTDFTLTISSLQPEDFATYYCQQTYSPPLTFGGGTKVEIK | QVQLVESGGGVVQPGRSLRLSCAASGFTFSSYGMHWVRQAPGKGLEWVAIIWYDGSNKYYADSVKGRFTISRDNSKNTLYLQMNSLRAEDTAVYYCARDLSMGGMDVWGQGTTVTVSS |
| | | | SEQ ID NO: 24342 | SEQ ID NO: 28348 |
| iPS:392740 | 21-225_18H12 | NA | GACATCCAGATGACCCAGTCTCCATCCTCCCTGTCTGCGTCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATACTGCATCCAATTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAACATAATAATTACCGTGGACGTTCGGCCCTAGGGACCAAGGTGGTCATCAAAA | CAGGTGCAACTGGTGGAGTCTGGGGGAGGCGTGGTCCAGCCTGGGAGGTCCCTGAGACTCTCCTGTGCAGCGTCTGGATTCACCTTCAGTGACTATGGCATGCACTGGGTCCGCCAGGCTCCAGGCAAGGGGCTGGAGTGGGATGGCAGTTATCAGACTCCGTGAAGGGCCGAAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTTTATTACTGTGCGAGAGAGGTTGGACTGGTACGAGGACTACTGGGGCCAGGGAACCCTGGTCACCGTCTCCTCA |
| | | | SEQ ID NO: 24343 | SEQ ID NO: 28349 |
| | | AA | DIQMTQSPSSLSASVGDRVTITCRASQGIRNDLGWYQQKPGKAPKRLIYTASNLQSGVPSRFSGSGSGTEFTLTISSLQPEDFATYYCLQHNNYPWTFGLGTKVVIK | QVQLVESGGGVVQPGRSLRLSCAASGFTFSDYGMHWVRQAPGKGLEWMAVIWYDVTNKYYADSVKGRFTISRDNSKNTLYLQMNSLRAEDTAVYYCAREVGWYEDYWGQGTLVTVSS |
| | | | SEQ ID NO: 24344 | SEQ ID NO: 28350 |

FIGURE 50
(Continued)

| | | | |
|---|---|---|---|
| iPS:392742 | 21-225_20B2 | NA | GACATCCAGATGACCCAGTCTCCATCCTCCCT GTCTGCCTCTGTAGGAGACAGAGTCAATATCA CTTGCCGGGCAAGTCAGGACATTAGAAATGAT TTAGGCTGGTATCAGCAGAAACCAGGGAAAG CCCCTAAAGCGCCTGATCTATCGTGCATCCAGT TTGCAAAGTGGGGTCCCATCAAGGTTCAGCGG CAGTGGATCTGGGACAGAATTCACTCTCACGA TCAGCAGCCTGCAGCCTGAAGATTTTGCAACT TATTACTGTCTACAGCATTATAATTACCCTCGG GCGTTCGGCCAAGGGACCAAGGTGGATATCA AA | CAGGTGCAACTGGTGGAGTCTGGGGGAGGCGTG GTCCAGCCTGGGAGGTCCCTGAGACTCTCCTGTG CAGCGTCTGGATTCACCTTCAGTAATTATGTCATT CACTGGGTCCGCCAGGCTCCAGGCAAGGGACTG GAGTGGGTGGCAGTTATATGGTATGATGGAAGTA ATAAATACTATGCAGACTCCGTGAAGGGCCGCTT CACCATCTCCAGAGACAATTCCAAGAACACGCTG TATCTGCAAATGAACAGCCTGAGAGCCGAGGAC ACGGCTGTGTATTCCTGTGCGAGAGAAGTATA GCAGCAGCTGGTACGACTACGGTATGGACGTCTG GGGCCAAGGGACCACGGTCACCGTCTCCTCA |
| | | | SEQ ID NO: 24345 | SEQ ID NO: 28351 |
| | | AA | DIQMTQSPSSLSASVGDRVNITCRASQDIRNDLG WYQQKPGKAPKRLIYAASSLQSGVPSRFSGSGS GTEFTLTISSLQPEDFATYYCLQHYNYPRAFGQG TKVDIK | QVQLVESGGGVVQPGRSLRLSCAASGFTFSNYVIH WVRQAPGKGLEWVAVIWYDGSNKYYADSVKGRF TISRDNSKNTLYLQMNSLRAEDTAVYSCAREKYSS SWYDYGMDVWGQGTTVTVSS |
| | | | SEQ ID NO: 24346 | SEQ ID NO: 28352 |
| iPS:392744 | 21-225_20D5 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATAGTTACCCGTTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGGCAT GCACTGGGTCCGCCAGGCTCCAGGCAAGGGCT GGAGTGGGTGGCAGTTATTTGGTATGAAGAAAAT AATCAATAACTATGCAGAGACTCCGTGAAGGGCCGAT TCACCATCTCCAGAGACAATTCCAAGAACACGCT GTATCTGCAAATGAACAGCCTGAGAGCCGACGA CACGGCTGTGTATTACTGTGCGAGAGAACTGGGG TTCCGGTCTGACTACTGGGGCCAGGGAACCCTGG TCACCGTCTCCTCA |
| | | | SEQ ID NO: 24347 | SEQ ID NO: 28353 |

FIGURE 50
(Continued)

| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGGGTKVEIK<br><br>SEQ ID NO: 24348 | QVQLVESGGGVVQPGRSLRLSCAASGFTFSSYGMHWVRQAPGKGLEWVAVIWYEENNQYYADSVKGRFTISRDNSKNTLYLQMNSLRADDTAVYYCARELGFRSDYWGQGTLVTVSS<br><br>SEQ ID NO: 28354 |
| iPS:392746 | 21-225_20H7 | NA | GACATCCAGATGACCCAGTCTCCATCCTCACTGTCTGCATCTGTAGGAGACAGAGTCACCATCACTTGTCGGACGAGTCAGGGCATTAGACAATTATTTAGTCTGGTTTCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGCCTGCAACAGATTTCACTCTCACCATCAGCAGCCTGCAACAGTATTATAGTTACCCATTCACTTTCGGCCCTGGGACCAAAATGGATTTCAAA<br><br>SEQ ID NO: 24349 | GAGGTGCACCTGGTGGAGTCTGGGGGAGGCCTGGTCAAGCCTGGGGGGTCCCTGAGACTCTCCTGTGCAGCCTCTGGATTCACCTTCAGTAGCTATAGCATGAACTGGGTCCGCCAGGCTCCAGGGAAGGGCTGGAGTGGGTCTCATCCATTAGTGTAGGGCCGATTCATATACTACGCAGACTCAGTGAAGGGCCGATTCACCATCTCCAGAGACAACAAGCCAAGAGCCGAGGAGTAATCTGCAAATGAACAGCCTGCGAGAGAGTAGCAGCTCACGGCTGTGTATTACTGTGCGAGAACCCTGGTCACCGTCTCCTCA<br><br>SEQ ID NO: 28355 |
| | | AA | DIQMTQSPSSLSASVGDRVTITCRASQGIRNDLGWFQQKPGKAPKRLIYAASSLQSGVPSRFSGSGSGTDFTLTISSLQPEDFATYYCQQYYSYPFTFGPGTKMDFK<br><br>SEQ ID NO: 24350 | EVHLVESGGGLVKPGGSLRLSCAASGFTFSSYSMNWVRQAPGKGLEWVSSISGSSSFIYYADSVKGRFTISRDNAKNSLYLQMNSLRAEDTAVYYCARVAALDYWGQGTLVTVSS<br><br>SEQ ID NO: 28356 |

FIGURE 50
(Continued)

| | | | |
|---|---|---|---|
| iPS:392748 | 21-225_20A8 | NA | GACATCAGATGACCCAGTCTCCATCTCTACT GTCTGCATCTGTAGGAGACAGAGTCACCATCA CTTGTCGGGCGAGTCAGGGCATTAATAATTAT TTAGTCTGGTTTCAGCAGAAACCAGGGAAAGC CCCTAAGTCCCTGATCTATGCTGCATCCAGTT GCTGAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATAATAGTTACCCGATCA CCTTCGGCCAAGGGACCAAGGTGGAGATTAAA<br>SEQ ID NO: 24351 | GAGGTGCAGCTGGTGGAGTCTGGGGGAGGCCTG GTCAAGCCTGGGGGGTCCCTAAGACTCTCCTGTG CAGCCCTCTGGATTCACCTTCAGTAGTAGTAGCGT GAACTGGGTCCGCCAGGCTCCAGGGAAGGGGCT GGAGTGGGTCTCATCCATTAGTAGTAGTAGTAGT TTCCTATACTACGCAGACTCAGTGAAGGGCCGAT TCACCATCTCCAGAGACAACGCCAAGAACTCAGT GTATCTGCAAATGAACAGCCTGAGAGCCGAGGA CACGGCTGTATATTACTGTGCCAGAAACTGGAC TACTGGGGCCAGGGAACCCTGGTCACCGTCTCCT CA<br>SEQ ID NO: 28357 |
| | | AA | DIQMTQSPSSLSASVGDRVTITCRASQGINNYLV WFQQKPGKAPKSLIYAASSLLSGVPSKFSGSGSG TDFTLTISSLQPEDFATYYCQQYNSYPITFGQGTR LEIK<br>SEQ ID NO: 24352 | EVQLVESGGGLVKPGGSLRLSCAASGFTFSSYSVN WVRQAPGKGLEWVSSISSSSSFLYYADSVKGRFTIS RDNAKNSVYLQMNSLRAEDTAVYYCARNWDYW GQGTLVTVSS<br>SEQ ID NO: 28358 |
| iPS:392750 | 21-225_20A10 | NA | GACATCAGATGACCCAGTCTCCATCTCTCCT GTCTGCATCTGTAGGAGACAGAGTCACCATCA CTTGCCGGGCAAGTCAGGGCATTAGAAATGAT TTAGGCTGGTATCAGCAGAAACAAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACCA TCAGCAGCCTGCAGCCTGAAGATTTTGCAACT TATTACTGTCTACAGCATAATAGATACCCGCT CACTTTCGGCGGAGGGACCAAGGTGGAGATC AAA<br>SEQ ID NO: 24353 | CAGGTGCAGCTGGTGGAGTCTGGGGGAGGCGTG GTCCAGCCTGGAGGGTCCCTGAGACTCTCCTGTG CAGCGTCTGGATTCACCCTCAGTAGCGATGACAT GCACTGGGTCCGCCAGGCTCCAGGCAAGGGGCT GGAGTGGGTGGCAGTTATATGGTTTGATGGAAGT AATAAATACTATGCAGACTCCGTGAAGGGCCGA TTCATCATCTCCAGAGACAATTCCAAGAACACGC TGTATCTGCAAATGAACAGCCTGAGAGCCGAGG ACACGGCTATGTATTACTGTGCGAGAGATCTAAT AGCAGCAGCTGGTACGGTTGACTACTGGGGCCA GGGAACCCTGGTCACCGTCTCCTCA<br>SEQ ID NO: 28359 |

FIGURE 50
(Continued)

| | | AA | DIQMTQSPSSLSASVGDRVTITCRASQGIRNDLG WYQQKQGKAPKRLIYAASSLQSGVPSRFSGSGS GTEFTLTISSLQPEDFATYYCLQHNRYPLTFGGG TKVEIK<br><br>SEQ ID NO: 24354 | QVQLVESGGGVVQPGRSLRLSCAASGFTLSSDDMH WVRQAPGKGLEWVAVIWFDGSNKYYADSVKGRFI ISRDNSKNTLYLQMNSLRAEDTAMYYCARDLIAAA GTVDYWGQGTLVTVSS<br><br>SEQ ID NO: 28360 |
|---|---|---|---|---|
| iPS:392754 | 21-225_21D3 | NA | GACATCCAGATGACCCAGTCTCCATCTCCCT GTCTGCATCTGTAGGAGACAGAGTCACCATCA CTTGCCGGGCAAGTCAGAGCATTACTGGTTAT CAAATTGGTATCAGCAGAAAGCCAGGGAAAA CCCCTAAACTCCTGATCTTTGCTACATACAGTT TGGAAAGTGGGGTCCCATCAAGGTTCAGTGGC AGTGGATTTGGGACAAATTTCACTCTCACCAT CACCAGTCTGCAACCTGAAGATTTTGCAACTT ACTACTGTCAACAGAGTTACAGTACCTCGATC ACCTTCGGCCAAGGGACACGACTGGAGATTAA A<br><br>SEQ ID NO: 24355 | CAGGTGCAGCTGGTGGAGTCTGGGGGAGGCGTG GTCCAGCCTGGGAGGTCCCTGAGACTCTCCTGTG TTGCCTCTGGATTCACCTTCAGTAGCTATGGCAT GCACTGGGTCCGCCAGGCTCCAGGCAAGGGGCT GGAGTGGGTGACAGTTATATCATATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGCGAGAGGGTATG GTTCGGGGACCTCTGGGGCCAGGGAACCCTGGTC ACCGTCTCCTCA<br><br>SEQ ID NO: 28361 |
| | | AA | DIQMTQSPSSLSASVGDRVTITCRASQSITGYSN WYQQKPGKTPKLLIFATYSLESGVPSRFSGSGFG TNFTLTITSLQPEDFATYYCQQSYSTSITFGQGTR LEIK<br><br>SEQ ID NO: 24356 | QVQLVESGGGVVQPGRSLRLSCVASGFTFSSYGMH WVRQAPGKGLEWVTVISYDGSNKYYADSVKGRFT ISRDNSKNTLYLQMNSLRAEDTAVYYCARGVWFG DLWGQGTLVTVSS<br><br>SEQ ID NO: 28362 |

FIGURE 50
(Continued)

| | | | |
|---|---|---|---|
| iPS:392758 | 21-225_21G11 | NA | GACATCCAGATGACCCAGTCTCCATCCTCCCT GTCTGCGTCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATACTGCATCCAGT TTGCAAAGTGGGGTCCCATCAAGGTTCAGCGG CAGTGGATCTGGGACAGATTTCACTCTCACAA TCAGCAGCCTGCAGCCTGAAGATTTTGCAACT TATTACTGTCTACAACATAATAATTACCCGTG GACGTTCGGCCTAGGGACCAAGGTGGTCATCA AA<br>SEQ ID NO: 24357 | CAGGTGCAACTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGATGGCAGTTATATGGTATGATGTAACT AATGAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTTTATTACTGTGCGAGAGAGCTTGG CTGTACGAGGACTACTGGGGCCAGGGAACCCT GGTCACCGTCTCCTCA<br>SEQ ID NO: 28363 |
| | | AA | DIQMTQSPSSLSASVGDRVTITCRASQGIRNDLG WYQQKPGKAPKRLIYTASSLQSGVPSRFSGSGSG TEFTLTISSLQPEDFATYYCLQHNNYPWTFGLGT KVVIK<br>SEQ ID NO: 24358 | QVQLVESGGGVVQPGRSLRLSCAASGFTFSDYGM HWVRQAPGKGLEWMAVIWYDVTNEYYADSVKG RFTISRDNSKNTLYLQMNSLRAEDTAVYYCARELG WYEDYWGQGTLVTVSS<br>SEQ ID NO: 28364 |
| iPS:392760 | 21-225_22G3 | NA | GACATCCAGATGACCCAGTCTCCATCCTCCCT GTCTGCATCTGTAGGAGACAGAGTCACCATCA CTTGCCGGGCAAGTCAGAGCATTAGTAATTAT TTAAATTGGTATCAGCAGAAACCAGGGAAAG CCCCTAAGCTCCTGATCTTTGCTGTCTCCAGT TTGCAAAGTGGGGTCCCATCAAGGTTCAGTGGC AGTGGATCTGGGACAGATTTCACTCTCACCAT CAGCGGTCTACAACCTGAAGATTTTGCAACTT ACTTCTGTCAACAGAGTTTCAGAACCCCTTTT TCACTTTCGGCCCTGGGACCAAAGTGGATATC AAA<br>SEQ ID NO: 24359 | GAGGTGCAGCTGTTGGAGTCTGGGGGAGGCTTG GTACAGCCTGGGGGGTCCCTGAGACTCTCCTGTG CAGCCTCTGAATTCACCTTTAGCAGTCAGTGCCAT GAACCTCTGGGTCCGCCAGGCTCCAGGAAGGGCT GGAGTGGGTCTCAATTATTAGTAGTGGTGGTGGTT AACACATTCTACGCAGACTCCGTGAAGGGCCGGT TCACCATCTCCAGAGACAATTCCAAGAACACGCT GTATCTGCAAATGAACAGCTGAGAGCCGAGGA CACGGCCGTATATTACTGTGCGTCCCGTTTGGCA GTGGCTGGCTGGGAGGCTTTGATATCTGGGGCC AAGGGACAATGGTCACCGTCTCTTCA<br>SEQ ID NO: 28365 |

FIGURE 50
(Continued)

| | | | |
|---|---|---|---|
| | | AA | DIQMTQSPSSLSASVGDRVTITCRASQSISNYLN WYQQKPGKAPKLLIFAASSLQSGVPSRFSGSGSG TDFTLTISGLQPEDFATYFCQQSFRTPFFTFGPGT KVDIK<br><br>SEQ ID NO: 24360 | EVQLLESGGGLVQPGGSLRLSCAASEFTFSSYAMN WVRQAPGKGLEWSIISGRGVNTFYADSVKGRFTI SRDNSKNTLYLQMNSLRAEDTAVYYCASRLAVAG SEAFDIWGQGTMVTVSS<br><br>SEQ ID NO: 28366 |
| iPS:392762 | 21-225_22G5 | NA | GACATCCAGATGACCCAGTCTCCATCCCCT GTCTGCATCTGTAGGAGACAGAGTCACCATCA CTTGCCGGGCAAGTCAGAGTCAGAACATTAGCAGCTAT TTAAATTGGTATCTCCTGATCTATGCTGCATCCAGTT CCCCTAAGCTCCTGATCTATGCTGCATCCAGTT TGCAAAATGGGGTCCCATCAAGGTTCAGTGGC AGAGGATCTGGGACAGATTTCACTCTCACCAT CAGTAGTCTGCAACCTGAAGATTTTGCAACTT ACTACTGTCAACAGAGTTACAGAACCCCTTA TTCACTTTCGGCCCTGGGACCAAGGTTGATTTC AAA<br><br>SEQ ID NO: 24361 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGGATGGGGCT GGAGTGGGTCTCAGTTATTAGTCGTAGTGGTGGT TACACATACTACGCGGACTCCGTGAAGGGCCGGT TCACCATCTCCAGAGACAATTCCAAGAACACGCT GTATCTGCAAATGAACAGCCTGAGAGCCGAGGA CACGGCCGTCTATTACTGTGCGTCCCGTTTAGCA GTGGCTGGCTCGGAGGCTTTTGATATCTGGGGCC AAGGGACACTGGTCACCGTCTCTTCA<br><br>SEQ ID NO: 28367 |
| | | AA | DIQMTQSPSSLSASVGDRVTITCRASQNISSYLN WYQQKPGKAPKLLIYAASSLQNGVPSRFSGRGS GTDFTLTISSLQPEDFATYYCQQSYRTPLFTFGPG TKVDFK<br><br>SEQ ID NO: 24362 | EVQLLESGGGLVQPGGSLRLSCAASGFTFSSYAMN WVRQAPGMGLEWVSVISRSGGYTYYADSVKGRFT ISRDNSKNTLYLQMNSLRAEDTAVYYCASRLAVAG SEAFDIWGQGTLVTVSS<br><br>SEQ ID NO: 28368 |

FIGURE 50
(Continued)

| | | | | |
|---|---|---|---|---|
| iPS:392764 | 21-225_22G10 | NA | GACATCCAGATGACCCAGTCTCCATCCTCCCT GTCTGCATCTGTAGGAGACAGAGTCACCATCA CTTGCCGGGCAAGTCAGAGCATTTTCAGCTAT TTAAATTGGTATCAGCAGAAACCAGGGAAAG CCCCTAAACTCCTGATCTATGCTGCATCCAGTT TACAAAGTGGGGTCCATCAAGGTTCAGTGGC AGTGGATCTGGGACAGATTTCACTCTCACCAT CAGCAGTCTCAACCTGAAGATTTTGCAACTT ACTTCTGTCAACAGAGTTTCAGAACCCCTTA TTCACTTTCGGCCCTGGGACCAAGGTGGATTT CAAA<br><br>SEQ ID NO: 24363 | GAGGTGCAGCTGTTGGAGTCTGGGGGAGACTTG GTACAGCCTGGGGGGTCCCTGAGACTCTCCTGTA CAGCCTCTGATTCACCTTTAGCAGCTATGCCAT GAACTGGGTCCGCCAGGCTCCAGGGAAGGGGCT GGAGTGGGTCTCAGTTATTAGTGGTAGTGGTGGT AACACATTCTACGCAGACTCCGTGAAGGGCCGAT TCACCATCTCCAGAGACAATTCCAAGAACACGCT GTTTCTGCACATGAACAGCCTGAGAGCCGAGGA CACGGCCGTTTATTACTGTGCGTCCCGTATGGCA GTGGCTGGCTCGGAGGCTTTTGATATCTGGGGCC AAGGGACAATGGTCACCGTCTCTTCA<br><br>SEQ ID NO: 28369 |
| | | AA | DIQMTQSPSSLSASVGDRVTITCRASQSIFSYLNW YQQKPGKAPKLLIYAASSLQSGVPSRFSGSGSGT DFTLTISSLQPEDFATYFCQQSFRTPLFTFGPGTK VDFK<br><br>SEQ ID NO: 24364 | EVQLLESGGDLVQPGGSLRLSCTASGFTFSSYAMN WVRQAPGKGLEWVSVISGSGGNTFYADSVKGRFTI SRDNSKNTLFLHMNSLRAEDTAVYYCASRMAVAG SEAFDIWGQGTMVTVSS<br><br>SEQ ID NO: 28370 |
| iPS:392766 | 21-225_23H4 | NA | GACATCCAGATGACCCAGTCTCCATCCTCCCT GTCTGCATCTGTAGGAGACAGAGTCACCATCA CTTGCCGGGCAAGTCAGAGCATTAGCAGTAT TTAAATTGGTATCAGCAGAAACCAGGGAAAG CCCCTAAACTCCTGATCTGTTCTACATCCAGT TGCAAAGTGGGGTCCATCAAGGTTCAGTGGC AGTGGATCTGGGACAGATTTCACTCTCACCAT CAGCAGTCTGCAACCTGAAGATTTTGCAACTT ATTACTGTCAACAGAGTTACAGTACCCCCACG TGGACGTTCGGCCAAGGGACCAAGGTGGAAA TCAGA<br><br>SEQ ID NO: 24365 | GAGGTGCAGCTGTTGGAGTCTGGGGGAGGCTTG GTACAGCCTGGGGGGTCCCTGAGACTCTCCTGTG CAGCCTCTGATTCACCTTTAGCAGCTATGCCAT GAACTGGGTCCGCCAGGCTCCAGGGAAGGGGCT GGAGTGGGTCTCAGTTATTAGTGGTAGTGGTGGT ACCACATACTTCGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGAAAGAAATAG CAGTGGCTGGCATGATGTTTTGATATCTGGGGC CAAGGGACAAAGGTCACCGTCTCTTCA<br><br>SEQ ID NO: 28371 |

FIGURE 50
(Continued)

| | | | | |
|---|---|---|---|---|
| | | | AA | DIQMTQSPSSLSASVGDRVTITCRASQSISRYLN WYQQKPGRAPKLLICSTSSLQSGVPSRFSGSGSG TDFTLTISSLQPEDFATYYCQQSYSTPTWTFGQG TKVEIR<br>SEQ ID NO: 24366 | EVQLLESGGGLVQPGGSLRLSCAASGFTFSSYAMN WVRQAPGKGLEWVSVISGSGGTTYFADSVKGRFTI SRDNSKNTLYLQMNSLRAEDTAVYYCAKRNSSGW HDVFDIWGQGTKVTVSS<br>SEQ ID NO: 28372 |
| iPS:392768 | 21-225_20B8 | | NA | GAAATAGTGATGACGCAGTCTCCATCCACCCT GTCTGTGTCTCCAGGGGAAAGAGTCACCCTCT CTTGCAGGGCCAGTCAGAGTGTTAGCAGCAAC TTAGCCTGGTTTCAGCAGAAACCTGGCCAGGC TCCCAGGCTCCTCATCAATGGTGCATCCACCA GGGCCAGTGGTATCCCAGCCAGGTTCAGTGGC AGTGGGTCTGGGACAGAGTTCACTCTCACCAT CAGCAGCCTGCAGTCTGAAGATTTTGCAGTTT ATTACTGTCAGCAGTATAATAACTGTCCTCTG ACGTTCGGCCAAGGGACCAAGGTGGAAATCA AA<br>SEQ ID NO: 24367 | GAGGTGCAGCTGGTGGAGTCTGGGGGAGGCTG GTCAAGCCTGGGGGGTCCCTGAGACTCTCTGTG CAGCCTCTGGATTCACCTTCAGTAGTTATAGCAT GAACTGGGTCCGCCAGGCTCCAGGGAAGGGGCT GGAGTGGGTCTCATCCATCAGTGGCAGTGGTAGT CACATATACTACGGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCGAGAGATCGGGG CAGTGGCTGGGGCCAGGGAACCCTGGTCACCGT CTCCTCA<br>SEQ ID NO: 28373 |
| | | | AA | EIVMTQSPSTLSVSPGERVTLSCRASQSVSSNLA WFQQKPGQAPRLLINGASTRASGIPARFSGSGSG TEFTLTISSLQSEDFAVYYCQQYNNCPLTFGQGT KVEIK<br>SEQ ID NO: 24368 | EVQLVESGGGLVKPGGSLRLSCAASGFTFSSYSMN WVRQAPGKGLEWVSSISGSGSHIYYADSVKGRFTIS RDNAKNSLYLQMNSLRAEDTAVYYCARDRGSGW GQGTLVTVSS<br>SEQ ID NO: 28374 |

FIGURE 50
(Continued)

| | | | |
|---|---|---|---|
| iPS:392770 | 21-225_20C10 | NA | GACATCCACACATGACCCAGTCTCCATCCTCCCT GTCTGCATCTGTGGGAGACAAAGTCTCCATCA CTTGCCGGGCAAGTCACCATATTAGCAACTAT TTAAATTGGTATCAGCAGAAACCAGGGAAAG GCCCTAAGGTCCTGATCCTTACTGCATCCAGT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACACTACCCCCACG TGGACGTTCGGCCAAGGGACCAAGGTGAAA TCAAA<br><br>SEQ ID NO: 24369 | GAGGTGCAGCTGTTGGAGTCTGGGGGAGGCTTG GTACAGCCTGGGGGGTCCCTGAGACTCTCCTGTG CAGCCTCTGGATTCACTTTTAGCAGCTATGCCAT GAACTGGGTCCGCCAGGCTCCAGGGAAGGGGCT GGAGTGGGTCTCAGTTATTAGTGGTAGTGGTGGT ACCACATACTACGCAGACTCCGTGAAGGGCCGG TTCACCATCTCCAGAGACAATTCCAAGAACACGC TGTATCTGCAAATGAACACCCTGAGAGCCGAGG ACACGGCCGTATATTACTGTGCGAAAAGGTATAC CAGTGACTGGCATGATGCTTTTGATATCTGGGGC CAAGGGACAATGGTCACCGTCTCTTCA<br><br>SEQ ID NO: 28375 |
| | | AA | DIHMTQSPSSLSASVGDKVSITCRASHHISNYLN WYQQKPGKPKVLILTASSLQSGVPSRFSGSGSG TDFTLTISSLQPEDFATYYCQQSYTTPTWTFGQG TKVEIK<br><br>SEQ ID NO: 24370 | EVQLLESGGGLVQPGGSLRLSCAASGFTFSSYAMN WVRQAPGKGLEWVSVISGSGGTTYYADSVKGRFTI SRDNSKNTLYLQMNTLRAEDTAVYYCAKRYTSDW HDAFDIWGQGTMVTVSS<br><br>SEQ ID NO: 28376 |
| iPS:392772 | 21-225_20E12 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTTTGCTGCATCCAGTT TACAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAATAGTTACCCGTTC ACTTTCGGCGGAGGGACCAAGGTGGAGATCA AA<br><br>SEQ ID NO: 24371 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATGTGGTATGATGAAAGT AATAAACACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACTGGG GTTCCGGTTGACTACTGTGGGGCCAGGGAACCCTG GTCACCGTCTCCTCA<br><br>SEQ ID NO: 28377 |

FIGURE 50
(Continued)

| | | | | |
|---|---|---|---|---|
| | | AA | DIQMTQSPSSLSASVGDRVTITCRASQGIRNDLG WYQQKPGKAPKRLIFAASSLQSGVPSRFSGSGSG TEFTLTISSLQPEDFATYYCLQHNSYPFTFGGGTK VEIK | QVQLVESGGGVVQPGRSLRLSCAASGFTFSSYGMH WVRQAPGKGLEWVAVMWYDESNKHYADSVKGR FTISRDNSRNTLYLQMNSLRAEDTAVYYCARELGF RFDYWGQGTLVTVSS |
| | | | SEQ ID NO: 24372 | SEQ ID NO: 28378 |
| iPS:392774 | 21-225_21F3 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTTCATTCTCACAA TCAGCAGCCTGCAGCCTGAAGATTTTGCAACT TATTACTGTCTACAGCATAGTAGTTACCCCTC ACTTTCGGCGGAGGGACCAAGGTGAGATCA AA | CAGCTGCAGCTGCAGGAGTCGGGCCCAGGACTG GTGAAGCCTGCGGAGACCCTGTCCCTCACCTGCA CTGTCTCTGGTGGCTCCATCAGCAGAAGTAGTTA CTACTGGGGCTGGATCCGCCAGCCCCCAGGGAA GGTGCTGGAGTGGATTGGGAGCATCTATTATAGT GGGAGCACCTACTACAACCGTCCCTCAAGAGTC GAGTCACCATATCCGTGACACGTCCAAGAACCA GTTCTCCCTGAAGCTGAGCTCTGTGACCGCCGA GACACGGCTGAGTATTACTGTGCGAGCCTTAGCA GCAGCTGGGACTTCCAGCACTGGGGCCAGGGCA CCCTGGTCACCGTCTCCTCA |
| | | | SEQ ID NO: 24373 | SEQ ID NO: 28379 |
| | | AA | DIQMTQSPSSLSASVGDRVTITCRASQGIRNDLG WYQQKPGKAPKRLIYAASSLQSGVPSRFSGSGS GTDFILTISSLQPEDFATYYCLQHSSYPLTFGGGT KVEIK | QLQLQESGPGLVKPAETLSLTCTVSGGSISRSSYYW GWIRQPPGKVLEWIGSIYYSGSTYYNPSLKSRVTIS VDTSKNQFSLKLSSVTAADTAEYYCASLSSSWDFQ HWGQGTLVTVSS |
| | | | SEQ ID NO: 24374 | SEQ ID NO: 28380 |

FIGURE 50
(Continued)

| | | | | |
|---|---|---|---|---|
| iPS:392776 | 21-225_21A12 | NA | GACATCCAGATGACCCAGTCTCCATCCTCACTGTCTGCATCTGTGGGAGACAGAGTCACCATCACTTGTCGGGCGAGTCAAGGCATTAGCAGTCAAATATTTAGCCTGGTTTCAGCAGAAACCAGGGAAAGCCCCTAAGTCCCTGATCTATGCTGCATCCAGTTTGCAAAGTGGGGGTCCCATCAAGGTTCAGCGGCAGTGGATCTGGGACAGATTTCACTCTCACCATCAGCAGCCTGCCAACAGTATAATAGTTACCCGTTCATTACTGCCAAACAGTATAATAGTTACCCGTTCAGGTTTGGCCAGGGGACCAAGCTGGAGATCAAA SEQ ID NO: 24375 | GAGGTGCAGCTGGTGGAGTCTGGGGGAGGCCTGGTCAAGCCTGGGGGGTCCCTGAGACTCTCTGTGCAGCCTCTGGATTCACCTTCAATAGCTATAGCATGAACTGGGTCCGCCAGGCTCCAGGGAAGGGCTGGAGTGGGTCTCATCATTAGTGGTAGTAGTACATATACTACGCAGACTCAGTGAAGGGCCGATTCACCATCTCCAGAGACAACGCCAAGAACTCACTGTATCTGCAAATGAACAGCCTGAGAGCCGAGGACACGGCTCTGTATTACTGTGCGAGAGCCGGCTGGCTTTGACTACTGGGGCCAGGGAACCCTGGTCACCGTCTCCTCA SEQ ID NO: 28381 |
| | | AA | DIQMTQSPSSLSASVGDRVTITCRASQGISKYLAWFQQKPGKAPKSLIYAASSLQSGVPSKFSGSGSGTDFTLTISSLQPEDFATYYCQQYNSYPFRFGQGTKLEIK SEQ ID NO: 24376 | EVQLVESGGGLVKPGGSLRLSCAASGFTFNSYSMNWVRQAPGKGLEWVSSISGSSSYIYYADSVKGRFTISRDNAKNSLYLQMNSLRAEDTALYYCARAAGFDYWGQGTLVTVSS SEQ ID NO: 28382 |
| iPS:392778 | 21-225_22H3 | NA | GACATCCAGATGACCCAGTCTCCATCCTCCCTGTCTGCATCTGTAGGAGACAGAGTCACCATCACTTGCCGGGCAAGTCAGGACATTAGAAATAATTTAGGCTGGTATCAGCAGAAACCAGGGAAAGCCCCTAAGCGCCTGATCTATCCTGCATCCAGTTTGCAAACTGGGGTCCCATCAAGGTTCAGCGGCAGTGGATCTGGGACAGATTTCACTCTCACAATCAGCAGCCTGCAGCCTGAAGATTTTGCAACTTATTTCTGTCTACAGGATAATAGTTACCATTCACTTTCGGCCCTGGGACCAAAGTGGATATCAAA SEQ ID NO: 24377 | GCGGTGCAGCTGGTGGAGTCTGGGGGAGGCCTGGTCAAGCCTGGGGGGTCCCTGAGACTCTCTGTGCAGCCTCTGGATTCACCTTCAGTAGTATAGCATGAACTGGGTCCGCCAGGCTCCAGGGAAGGGGCTGGAGTGGGTCTCATCATTAGTAGTAGTAGTACATATACTACGCAGACTCAGTGAAGGGCCGATTCACCATCTCCAGAGACAACGCCAAGAACGCTGAGAGCCGAGGAGTATCTGCAAATGAACAGCCTGAGAGCCGAGGACACGGCTGTGTTTTACTGTGCGAGAGATAGGGGCAGCCTCTGGGGCCAGGGAACCCTGGTCACCGTCTCCTCT SEQ ID NO: 28383 |

FIGURE 50
(Continued)

| | | | |
|---|---|---|---|
| iPS:392780 | 21-225_22B7 | AA | DIQMTQSPSSLSASVGDRVTITCRASQDIRNNLG WYQQKPGKAPKRLIYPASSLQTGVPSRFSGSGSG TEFTLTISSLQPEDFATYFCLQDNSYPFTFGPGTK VDIK<br>SEQ ID NO: 24378 | AVQLVESGGGLVKPGGSLRLSCAASGFTFSSYSMN WVRQAPGKGLEWVSSISSSSYIYYADSVKGRFTIS RDNAKNSLYLQMNSLRAEDTAVFYCARDRGSLWG QGTLVTVSS<br>SEQ ID NO: 28384 |
| | | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAACGCCTGATCTATACTGCATCCAGT TTGCAAAGTGGGGTCCCATCAAGGTTCAGCGG CAGTGGTTCTGGGACAGATTCACTCTCACAA TCAGCAGCCTGCAGCCTGAAGATTTTGCAACT TATTACTGTCTACAGCATAATACTTACCCGCTC ACTTTCGGCGGAGGGACCAAGGTGGAGATCA AA<br>SEQ ID NO: 24379 | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGGCAT GCACTGGGTCCGCCAGGCTCCAGGCAAGGGGCT GGAGTGGGTGGCAGTTATTTGGTATGAAGAAAAT AATCAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAAGTGGGG TTCCGGTCTGACTACTGGGGCCAGGGAACCCTGG TCACCGTCTCCTCA<br>SEQ ID NO: 28385 |
| | | AA | DIQMTQSPSSLSASVGDRVTITCRASQGIRNDLG WYQQKPGKAPKRLIYTASSLQSGVPSRFSGSGSG TEFTLTISSLQPEDFATYYCLQHNTYPLTFGGGT KVEIK<br>SEQ ID NO: 24380 | QVQLVESGGGVVQPGRSLRLSCAASGFTFSSYGMH WVRQAPGKGLEWVAVIWYEENNQYYADSVKGRF TISRDNSKNTLYLQMNSLRAEDTAVYYCAREVGFR SDYWGQGTLVTVSS<br>SEQ ID NO: 28386 |

FIGURE 50
(Continued)

| | | | |
|---|---|---|---|
| iPS:392782 | 21-225_22B12 | NA | GACATCAGATGACCCAGTCTCCATCCTCACTGTCTGCGTCTGTAGGAGACAGAGTCACCATCATTTGTCCGGCGAGTCAGGACAGATTAGCACAATTATTTAGCCTGGTTTCAGGAGAAACCAGGGAAAGCCCATAAGTCCCTGATCTATGGTGCATCCAGTTTGCGGAGTGGGGTCCCATCAAAGTTCAGCGGCAGTGGATCGGGACAGATTTCAATCTCACCATCAGCAGCCTGCAGCCTGAAGATCTTGCAACTTATTACTGCCAACAGTATCATAGTTACCCATTCACTTTCGGCCCTGGGACCAAAGTGGATTTCAAA<br/>SEQ ID NO: 24381 | GAGGTGCAGCTGTGGTGGAGTCTGGGGGAGGCTTGGTCAAGCCTGGGGGGTCCCTGAGACTCTCCTGTGCAGCCTCTGGATTCACCTTCAGCAGCTATAGCATGAACTGGGTCCGCCAGGCTCCAGGGAAGGGGCTGGAGTGGGTCTCATCCATTAGTGGTAGTAGTAGTTACACATACTACGCAGACTCAGTGAAGGGCCGATTCACCATCTCCAGAGACAACGCCAAGAACTCACTGTATCTGCAAATGAACAGCCTGAGAGCCGAGGACACGGCTGTGTATTACTGTGCGAGAGTAGCAGCCCTTGACTCCTGGGGCCAGGGAACCCTGGTCACCGTCTCCTCA<br/>SEQ ID NO: 28387 |
| | | AA | DIQMTQSPSSLSASVGDRVTIICRASQDISNYLAWFQEKPGKAHKSLIYGASSLRSGVPSKFSGSGSGTDFNLTISSLQPEDLATYYCQQYHSYPFTFGPGTKVDFK<br/>SEQ ID NO: 24382 | EVQLVESGGGLVKPGGSLRLSCAASGFTFSSYSMNWVRQAPGKGLEWVSSISGSSSYTYADSVKGRFTISRDNAKNSLYLQMNSLRAEDTAVYYCARVAALDSWGQGTLVTVSS<br/>SEQ ID NO: 28388 |
| iPS:392784 | 21-225_23C7 | NA | GACATCAGATGACCCAGTCTCCATCCTCACTGTCTGCATCTGTAGGAGACAGAGTCACCATCACTTGCCGGGCGAGTCAGGGCATTAGCAATTATTTAGCCTGGTTTCAGCAGAAACCAGGGAAAGCCCCTAAGTCCCTGATCTCTGCTGCATCCAAGTTTGCAAAGTGGGGTCCCATCAAAGTTCAGCGGCAGTGGATCTGGGACAGAGTTCACTCTCACCATCAGCAGCCTGCAGCCTGAAGATTTTGCAACTATTACTGCCAACAGTATAATAGTTACCCATTCACTTTCGGCCCTGGGACCAAAGTGGATATCAAA<br/>SEQ ID NO: 24383 | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGTTATGAGCTGGGTCCGCCAGGCTCCAGGGAAGGGGCTGGAGTGGGTCTCAGCTATTAGTGGTAGTGGTGGTAGCACATATTATGTAGACTCCGTGAAGGGCCGGTTCACCATCTCCAGAGACAATTCCAAGAACACGCTGTATCTGCAAATGAACAGCCTGAGAGCCGAGGACACGGCCGTATACTATTGTGCGAACTGGGTCTTTGACTACTGGGGCCAGGGAACCCTGGTCATCGTCTCCTCA<br/>SEQ ID NO: 28389 |

FIGURE 50
(Continued)

| | | | | |
|---|---|---|---|---|
| iPS:392786 | 21-225_24E1 | AA | DIQMTQSPSSLSASVGDRVTITCRASQGIGIYLA WFQQKPGKAPKSLISAASSLQSGVPSKFSGSGSG TEFTLTISSLQPEDFATYYCQQYNSYPFTFGPGTK VDIK<br>SEQ ID NO: 24384 | EVQLLESGGGLVQPGGSLRLSCAASGFTFSSYVMS WVRQAPGKGLEWVSAMSGSGSTYYVDSVKGRF TISRDNSKNTLYLQMNSLRAEDTAVYYCARTGVFD YWGQGTLVTVSS<br>SEQ ID NO: 28390 |
| | | NA | GACATCGTGATGACCCAGTCTCCAGACTCCCT GGCTGTCTCTGGGCGAGAGGGCCACCATCA ACTGCAAGTCCAGCCAGAGTGTTTTATACACC TCCAACAATAACAACTACTTAACTTGGTACCA GCAGAAACCTGGACAGGTCCTAACCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TTTTATAGTACTCCTCCGACGTTCGGCCAAGG GACCAAGGTGAAATCAAA<br>SEQ ID NO: 24385 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAGTGG TAACACAGGCTATGCACAGAGGTTCCAGGCAG AGTCACCATGACCAGGAACACCTCCATAAGCAC AGCCTACACATGGAGCTGAGCAGCCTGAGATCTGA GGACACGGCCGTGTATTACTGTGCGACAAGCAGT GGCTGGGAGGTCTTTGACTACTGGGGCCAGGGA ACCCTGGTCACCGTCCTCTCA<br>SEQ ID NO: 28391 |
| | | AA | DIVMTQSPDSLAVSLGERATINCKSSQSVLYTSN NNNYLTWYQQKPGQRPNLLIYWASTRESGVPD RFSGSGSGTDFTLTISSLQAEDVAVYYCQQFYST PPTFGQGTKVEIK<br>SEQ ID NO: 24386 | QVQLVQSGAEVKKPGASVKVSCKASGYTFTNYDIN WVRQATGQGLEWMGWMHPNSGNTGYAQRFQGR VTMTRNTSISTAYMELSSLRSEDTAVYYCATSSGW EVFDYWGQGTLVTVSS<br>SEQ ID NO: 28392 |

FIGURE 50
(Continued)

| | | | |
|---|---|---|---|
| iPS:392788 | 21-225_20C8 | NA | GACATCCAGATGACCCAGTCTCCATCTCCCT GTCTGCATCTGTAGGAGACAGAGTCACCATCA CTTGCCGGGCAAGTCAGGGACATTAGAAATGAT TTAGGCTGGTATCAGAAGAAACCAGGGAAAG CCCCTAAGCGCCTGATCAATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATATTTGCAACT TATTACTGTCTACAAGATAATAGTTACCCGTTC ACTTTCGGCGGAGGGACCAAGGTGGAGATCA CA SEQ ID NO: 24387 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGTTCCAGGGAAGGGCCT GGAGTGGGTCTCATCCATTAGTGGCAGTAGTAGT TACATATACTACGCAGACTCAGTGAAGGCCGAT TCCACATCTCCAGAGACAACGCCAAGAACTCACT GTATCTGCAAATGAACAGCCTGAGAGCCGAGGA CACGGCTGTGTATTACTGTGCGAGAGACAGAGG CAGTCTCTGGGGCCAGGGAACCCTGGTCACCGTC TCCTCA SEQ ID NO: 28393 |
| | | AA | DIQMTQSPSSLSASVGDRVTITCRASQGIRNDLG WYQKKPGKAPKRLINAASSLQSGVPSRFSGSGS GTEFTLTISSLQPEDFATYCLQDNSYPFTFGGGT KVEIT SEQ ID NO: 24388 | EVQLVESGGGLVKPGGSLRLSCAASGFTFSSYSMN WVRQAPGKGLEWVSSISGSSSYIYYADSVKARFTIS RDNAKNSLYLQMNSLRAEDTAVYYCARDRGSLW GQGTLVTVSS SEQ ID NO: 28394 |
| iPS:392790 | 21-225_20D10 | NA | GACATCCAGATGACCCAGTCTCCATCTCCCT GTCTGCATTTGTAGGAGACAGAGTCACCATCA CTTGCCGGGCAAGTCAGGGACATTAGAAATGAT TTAGGCTGTGTATCAGCAGAAACCAGGGAAAG CCCGTAAGCGCCTGATCTATGTTGCATACAGT TTGCAAAGTGGGGTCCCATCAAGGTTCAGCGG CAGTGGATATGGGACAGAATTCACTCTCACAA TCAGCAGCTTGCAGCCTGCAGAAATAGTTACCCGTG GACGTTCGGCCAAGGGACCAAGGTGGAAATC AAA SEQ ID NO: 24389 | CAGGTGCAGCTGGTGCAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGTTTGATGGAAGT AATAAATACTATGTAGACTCCGTGAAGGGCCGAT TCACCATCTCCAGAGACGATTCCAAGAACACTCT GTATCTGCAAATGAACAGCCTGAGAGCCGAGGA CACGGCTGTGTATTACTGCGCGAGAGATCTTGGC TGGACGGAAGAGTACTGGGGCCAGGGAACCCTG GTCACCGTCTCCTCA SEQ ID NO: 28395 |

FIGURE 50
(Continued)

| | | | |
|---|---|---|---|
| iPS:392792 | 21-225_20G12 | AA | DIQMTQSPSSLSAFVGDRVTITCRASQGIRNDLG WYQQKPGKARKRLIYVAYSLQSGVPSRFSGSGY GTEFTLTISSLQPEDFATYYCIQQNSYPWTFGQG TKVEIK<br>SEQ ID NO: 24390 | QVQLVESGGGVVQPGRSLRLSCAASGFTFSDYGM HWVRQAPGKGLEWVAVIWFDGSNKYYVDSVKGR FTISRDDSKNTLYLQMNSLRAEDTAVYYCARDLG WTEEYWGQGTLVTVSS<br>SEQ ID NO: 28396 |
| | | NA | GACATCCAGATGACCCAGTCTCCATCCTCCCT GTCTGCATCTGTAGGAGACAGAGTCACCATCA CTTGCCGGGCGAGTCAGGGCATTAGACAATTAT TTAGCCTGGTATCAGCAGAAACCAGGAAAGT TCCTAAGGTCTTGATCTATACTGCATCCACTTT GCAATCAGGGGTCCCATCTCGGTTCAGTGGCA GTGGATCTGGGACAGATTTCACTCTCACCGTC AGCAGCCTGCAGCCTGAAGATGTTGCAACTTA TTACTGTCAAAAGTATAACAGTGCCCCTCCGA TCACCTTCGGCCAAGGGACACGACTGGAGATT AAA<br>SEQ ID NO: 24391 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCTACTACGCGGTAGTAGT TACATCTACTACGCAGAGACAACGCCAAGAACTCACT GTATCTGCAAATGAACAGCCTGAGAGCCGAGGA CACGGCTGTGTATTACTGTGCGAGAGATCGTGGG AGCTACTGGGGCCAAGGAACCCTGGTCACCGTCT CCTCA<br>SEQ ID NO: 28397 |
| | | AA | DIQMTQSPSSLSASVGDRVTITCRASQGISNYLA WYQQKPGKVPKVLIYTASTLQSGVPSRFSGSGS GTDFTLTVSSLQPEDVATYYCQKYNSAPPITFGQ GTRLEIK<br>SEQ ID NO: 24392 | EVQLVESGGGLVKPGGSLRLSCAASGFTFSSYSMN WVRQAPGKGLEWVSSISGSSSYIYYADSLKGRFTIS RDNAKNSLYLQMNSLRAEDTAVYYCARDRGSYW GQGTLVTVSS<br>SEQ ID NO: 28398 |

FIGURE 50
(Continued)

| | | | |
|---|---|---|---|
| iPS:392794 | 21-225_21H3 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCGTCCAGT GTGCAAACTGGGGTCCCATCAAGGTTCAGCGG CAGTGGATCTGGGACAGAATTCACTCTCACAA TCAGCAGCCTGCAGGCTGAAGATTTGGCAATT TATTACTGTCTACAGCATATAGTTATCCGCTC ACTTTCGGCGGAGGGACCAAGGTGGAGATCA AA<br><br>SEQ ID NO: 24393 | CAGCTGCAGCTGCAGGAGTCGGGCCCAGGACTG GTGAAGCCTTCGGAGACCCTGTCCCTCACCTGCA CTGTCTCTGGTGGCTCCATCAGTAGGAGTAGTTA CTACTGGGGCTGGATCCGCCAGCCCCCAGGGAA GGGGCTGGAGTGGATTGGGAATATTTATTATAGT GGGAGCACCTACGACAACCCGTCCCTCAAGAGT CGAGTCACCATATCCGTAGACACGTCCAAGAACC AGTTCTCCCTGAAGCTGAGCTCTGTGACCGCCGC GGACACGGCTGTTTATTACTGTGTGGGAGACATGGA AAAGACTGGGGCCTGACTACTGGGGCCAGGGA ACCCTGGTCACCGTCTCCTCA<br><br>SEQ ID NO: 28399 | QLQLQESGPGLVKPSETLSLTCTVSGGSISRSSYYW GWIRQPPGKGLEWIGNIYYSGSTYDNPSLKSRVTIS VDTSKNQFSLKLSSVTAADTAVYYCGRHGKDWGL DYWGQGTLVTVSS<br><br>SEQ ID NO: 28400 |
| iPS:392796 | 21-225_22A4 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGCTGCAGCCTGAAGATTTTGCAACT TCAGCAGCCTGCAGCCTGAAGATTTTGCAACT TATTACTGTCTTCAGCATATAGTTACCCGTGG ACGTTCGGCCAAGGGACCAAGGTGGAAATCA AA<br><br>SEQ ID NO: 24395 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTTGACTATGGCAT ACACTGGGTCCGCCAGGCTCCAGGCAAGGGCT GGAGTGGGTGGCAGTTATATGCAGTTTGATGGAAGT AATAAATACTATGCAGACTCCGTGAAGGGCCGA ATCACCATCTCTAGAGACAATTCCAAGAACACGC TGTATCTGCAAATGAACAGCCTGAGAGCCGAGG ACACGGCTGTGTATTACTGTGCGAGAGATCTTGG CTGGACGGAAGAGTACTGGGGCCAGGGAACCCT GGTCACCGTCTCCTCA<br><br>SEQ ID NO: 28401 |

FIGURE 50
(Continued)

| | | | |
|---|---|---|---|
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPWTFGQG TKVEIK<br>SEQ ID NO: 24396 | QVQLVESGGGVVQPGRSLRLSCAASGFTFSDYGIH WVRQAPGKGLEWVAVIWFDGSNKYYADSVKGRIT ISRDNSKNTLYLQMNSLRAEDTAVYYCARDLGWT EEYWGQGTLVTVSS<br>SEQ ID NO: 28402 |
| iPS:392798 | 21-225_22C7 | NA | GACATCCAGATGACCCAGTCTCCATCCTCCCT GTCTGCATCTGTAGGAGACAGAGTCACCATCA CTTGCCGGGCAAGTCAGAACATTATCAGCTAT TTAAATTGGTATCAGCAGAAACCAGAGAAAG CCCCTAAACTCCTGATCTCATATTGCATCCAGTT TGCAAAGTGGGGTCCCATCAAGGTTCACTCTCA AGTGGATCTGGGACAGATTTCACTCTCACCAT CAGCAGTCTGCAACCTGAAGATTTTGCAACTT ACTACTGTCAACAGACTTACAGTACCCCGCTC ACTTTCGGCGGAGGGACCAAGGTTGGAGATCA AA<br>SEQ ID NO: 24397 | CAGGTGCAGCTGGTGGAGTCTGGGGGAGGCGTG GTCCAGCCTGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGGTGGGCAGTTATATGCATGATGGAAG TAATAAATACTATGCAGACTCCGTGAAGGGCCG ATTCACCATCTCCAGAGACAATGCCAAGAACAC GCTGTATCTGCAAATGAACAGCCTGAGAGCCGA GGACACGGCTGTGTATTACTGTGCGAGAGATCTG AGTATGGGCGGTATGGACGTCTGGGGCCAAGGG ACCACGGTCACCGTCTCCTCA<br>SEQ ID NO: 28403 |
| | | AA | DIQMTQSPSSLSASVGDRVTITCRASQNISYLNW YQQKPEKAPKLLIHASSLQSGVPSRFSGSGSGTD FTLTISSLQPEDFATYYCQQTYSTPLIFGGGTKV EIK<br>SEQ ID NO: 24398 | QVQLVESGGGVVQPGRSLRLSCAASGFTFSSYGMH WVRQAPGKGLEWGAVIWHDGSNKYYADSVKGRF TISRDNAKNTLYLQMNSLRAEDTAVYYCARDLSM GGMDVWGQGTTVTVSS<br>SEQ ID NO: 28404 |

FIGURE 50
(Continued)

| | | | |
|---|---|---|---|
| iPS:392800 | 21-225_22D12 | NA | GACATCCAGATGACCCAGTCTCCATCCTCCCT GTCTGCATCTGTAGGAGACAGAGTCACCATCA CTTGTCGGGCAAGTCAGGGCATTAGAAATGAT TTAGGCTGGTATCAGCAGAAACCAGGGAAAG CCCCTAAGCGCCTGATCTATGCTGCATCCAGT TTGCAGAGTGGGGTCCATCAAGGTTCAGCGG CAGTGGATCTGGGACAGATTTCACTCTCACAA TCAGCAGCCTGCAGCCTGAAGATTTTGCAACT TATTACTGTCTACAGCATAGTACTTACCCTCTC ACTTTCGGCGGAGGGACCAAGGTGGAGATCA AA | CAGCTGCAGCTGCAGGAGTCGGGCCCAGGACTG GTGAAGCCTTCGGAGACCCTGTCCTCACCTGCA CTGTCTCTGGTGCTCATCAGCAGGAGTAGTTA CTACTGGGGCTGGATCCGCCAGCCCCAGGGAA GGGGCTGGAGTGGATTGGAAATATCTATTATAGT GGGACCACCTCTACAACCGTCCCTCAAGAGTC GAGTCACCATATCCGTTGACACGTCCAGGAACCA GTTCTCCCTGAAGCTGAGCTCTGTGACCGCGCA GACACGGCTGTGTTTTACTGTGCAGACTCAGCA GCAGCTGGTCCGTGACTACTGGGGCCAGGGAA CCCTGGTCACCGTCTCCTCA |
| | | | SEQ ID NO: 24399 | SEQ ID NO: 28405 |
| | | AA | DIQMTQSPSSLSASVGDRVTITCRASQGIRNDLG WYQQKPGKAPKRLIYAASSLQSGVPSRFSGSGS GTDFTLTISSLQPEDFATYYCLQHSTYPLTFGGG TKVEIK | QLQLQESGPGLVKPSEFILSLTCTVSGGSISRSSYYW GWIRQPPGKGLEWIGNIYYSGTTSYNPSLKSRVTIS VDTSRNQFSLKLSSVTAADTAVFYCARLSSSWSVD YWGQGTLVTVSS |
| | | | SEQ ID NO: 24400 | SEQ ID NO: 28406 |
| iPS:392802 | 21-225_23E7 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGATACCAGGGAAAGC CCCTAAGTCCCTGATCTATGTGCATCCAGTTT GCAAAGTGGGGTCCCATCAAGGTTCAGCGGCA GTGGATCTGGGACAGATTTCACTTCTCACCATC AGCAGCCTGCAGCCTGAAGATTTTGCAACTTA TTACTGCCAACAGTTTTATAGTTACCCATTCAC TTTCGGCCCTGGGACCAAAGTGGATATCAAT | GAGGTGCAGCTGTTGGAGTCTGGGGGAGGCTTG GTACAGCCTGGGGGGTCCCTGAGACTCTCCTGTA CAGCCTCTGGATTCACCTTTAGCAGCTATGCCAT GAACTGGGTCCGCCAGGCTCCAGGGAAGGGGCT GGAGTGGGTCTCAGTTATTAGTGGTAGTGGTGGT TCACATATACGACAGAGACTCCGTGAAGGGCCGGT TCACCATCTCCAGAGACAATTCCAGGAACACGCT GTATCTGCAAATGAACAGCCTGAGAGCCGAGGA CACGGCCGTATATTACTGTGCGCTACCAGTGGC TTTGACTACTGGGGCCAGGGAACCCTGGTCACCG TCTCCTCA |
| | | | SEQ ID NO: 24401 | SEQ ID NO: 28407 |

FIGURE 50
(Continued)

| | | | |
|---|---|---|---|
| iPS:392806 | 21-225_24H3 | AA | DIQMTQSPSSLSASVGDRVTITCRASQGISNYLA WFQQIPGKAPKSLIYAASSLQSGVPSKFSGSGSG TDFTLTISSLQPEDFATYYCQQFYSYPFTFGPGTK VDIN<br>SEQ ID NO: 24402 | EVQLLESGGGLVQPGGSLRLSCTASGFTFSSYAMN WVRQAPGKGLEWVSAISGSGGFTYYADSVKGRFTI SRDNSRNTLYLQMNSLRAEDTAVYYCARTSGFDY WGQGTLVTVSS<br>SEQ ID NO: 28408 |
| | | NA | GAAATAGTGATGACGCAGTCTCCAGCACCCT GTCTGTGTCTCCAGGGGAAAGAGCCACCCTCT CCTGCAGGGCCAGTCAGAGTGTTAGCAGCAAC TTAGCCTGGTACCAGCAGAAACCTGGCCAGGC TCCCAGGCTCCTCATCTATTTTGCATCCATCAG GCCACTGGTATCCCAGCCAGGTTCAGTGGCA GTGGGTCTGGGACAGAGTTCACTCTCACCATC AGCAGCCTGCAGTCTGAAGATTTTGCAGTTTA TTACTGTCAGCAGTAGTATAATAACTGGCCATGT GCAGTTTTGGCCAGGGGACCAAGCTGGAGATC AAA<br>SEQ ID NO: 24403 | CAGGTGCAGCTGGTGGAGTCTGGGGGAGGCGTG GTCCAGCCTGGGAGGTCCCTGAGACTCTCCTGTG GAGCGTCTGGATTCACCTTCAGTAGCTATGGCAT GCACTGGGTCCGCCAGGCTCCAGGCAAGGGCT GGAGTGGGTGGCAGTTATATGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGCGAGAGTAGCAGT GGCAGGCGGTATGGACGTCTGGGGCCAAGGGAC CACGGTCACCGTCTCCTCA<br>SEQ ID NO: 28409 |
| | | AA | EIVMTQSPATLSVSPGERATLSCRASQSVSSNLA WYQQKPGQAPRLLIYFASIRATGIPARFSGSGSG TEFTLTISSLQSEDFAVYYCQQYNNWPMCSFGQ GTKLEIK<br>SEQ ID NO: 24404 | QVQLVESGGGVVQPGRSLRLSCGASGFTFSSYGMH WVRQAPGKGLEWVAVIWYDGSNKYYADSVKGRF TISRDNSKNTLYLQMNSLRAEDTAVYYCARVAVA GGMDVWGQGTTVTVSS<br>SEQ ID NO: 28410 |

FIGURE 50
(Continued)

| | | | |
|---|---|---|---|
| iPS:392808 | 21-225_20F8 | NA | GACATCCAGATGACCCAGTCTCCATCCTCCCT GTCTGCATCTGTAGGAGACAGAGTCACCATCA CTTGCCGGGCAAGTCAGAGACATTAGCAGGTAT TTAAATTGGTATCAGCAGAAACCAGGGAAAG CCCCTGAGCTCCTGATCTATGCTGCTTCCAGTT TGCAAAGTGGGGTCCCATCAAGGTTCAGTGGC AGTGGATCTGGGACAGATTTCATTCTCACCAT CAGCAGTCTACAACCTGAAGATTTTGCAACTT ACTACTGTCAACAGAGTTACAATACCCCCACG TGGACGTTCGGCCAAGGGACCAAGGTGGAAA TCAAA |
| | | | GAGGTGCAGCTGTTGGAGTCTGGGGGAGGCTTG GTACAGCCTGGGGGGTCCCTGAGACTCTCCTGTG CAGCCTCTGGATTCACCTTTAGAAGCTATGCCAT GAGCTGGATCCGCCAGGCTCCAGGGAAGGGGCT GGAGTGGTCTTCAGTTATTAGTGGTAGTGGTGGT AGCACATATTACGCAGACTCCGTGAAGGGCCGG TTCACCATCTCCAGAGACAATTCCAAGAACACGC TGTATCTGCAAATGAGCAGCCTGAGAGCCGAAG ACACGGCCGTATATTACTGTGCGAAAAGGTATAA CAGTGGCTGGCATGATGTTTTTGATATCTGGGGC CAAGGGACAATGGTCACCGTCTCTTCA |
| | | | SEQ ID NO: 24405 |
| | | | SEQ ID NO: 28411 |
| | | AA | DIQMTQSPSSLSASVGDRVTITCRASQSISRYLN WYQQKPGKAPELLIYAASSLQSGVPSRFSGSGSG TDFTLTISSLQPEDFATYYCQQSYNTPTWTFGQG TKVEIK |
| | | | EVQLLESGGGLVQPGGSLRLSCAASGFTFRSYAMS WIRQAPGRGLEWSSVISGSGGSTYYADSVKGRFTIS RDNSKNTLYLQMSSLRAEDTAVYYCAKRYNSGW HDVFDIWGQGTMVTVSS |
| | | | SEQ ID NO: 24406 |
| | | | SEQ ID NO: 28412 |
| iPS:392810 | 21-225_20H12 | NA | GACATCCAGATGACCCAGTCTCCATCCTCCCT GTCTGCTTCTGTAGGAGACAGAGTCACCATCA CTTGCCGGGCAAGTCAGGGCATTAGACAGGCT TTAGACTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTAACTATGGCAT GCACTGGGTCCGCCAGGCTCCAGGCAAGGGGCT GGAGTGGTGGCAGTTATATGTAGACTCCGTGAAGGGCCGAT AATAAATACTATGCCAGAGACAACTCCAAGAACACGCT GTATCTGCAAATGAACAGCCTGAGAGCCGAGGA CACGGCTGTGTATTACTGTGCGAGAGAGTTGGGG TTCCGGTCGACTACTGGGGCCAGGGAACCCTGG TCACCGTCTCCTCA |
| | | | SEQ ID NO: 24407 |
| | | | SEQ ID NO: 28413 |

FIGURE 50
(Continued)

| | | | |
|---|---|---|---|
| iPS:392812 | 21-225_21F4 | AA | DIQMTQSPSSLSASVGDRVTITCRASQGIRNDLD WYQQKPGKAPKRLIYAASSLQSGVPSRFSGSGS GTEFTLTISSLQPEDFATYYCLQHNSYPLTFGGG TKVEIK<br>SEQ ID NO: 24408 | QVQLVESGGGVVQPGRSLRLSCAASGFTFSNYGM HWVRQAPGKGLEWVAVIWYDENNKYYVDSVKGR FTISRDNSKNTLYLQMNSLRAEDTAVYYCARELGF RSDYWGQGTLVTVSS<br>SEQ ID NO: 28414 |
| | | NA | GACATCCAGATGACCCAGTCTCCATCCTCCCT GTCTGCATCTGTAGGAGACAGAGTCACCATCA CTTGCCGGGCAAGTCAGAACATTGGTAGTTAT TTAAATTGGTATCAGCAGAAACCAGGGAAAG CCCCTAAGCTCCTGATCTTTGCTGCATCCAGT TGCAAAGTGGGGTCCCATCAAGGTTCAGTGGC AGTGGATCTGGGACAGATTTCACTCTCACCAT CAGCAGTCTGCAACCTGAAGATTTTGCAACTT TCTTCTGTCAACAGAGTTACAGAACCCCCTTT TCACTTTCGGCCCTGGGACCAAAGTGGATTTC AAA<br>SEQ ID NO: 24409 | GAGGTGCAGCTGTTGGAGTCTGGGGGAGGCTTG GTACAGCCTGGGGGGTCCCTGAGACTCTCTGTG CAGCCTCTGAATTCACCTTTAGCAGCTATGCCAT GAACTGGGTCCGCCAGGCTCCAGGGAAGGGGCT GGAGTGGGTCTCAGTTATTAGTGGTCGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGCGTCCCGTTTGGCA GTGGCTGGCTCGGAGGCTTGTGATATCTGGGGCC AAGGGACAAATGGTCACCGTCTCTTCA<br>SEQ ID NO: 28415 |
| | | AA | DIQMTQSPSSLSASVGDRVTITCRASQNIGSYLN WYQQKPGKAPKLLIFAASSLQSGVPSRFSGSGSG TDFTLTISSLQPEDFATFFCQQSYRTPFFTFGPGT KVDFK<br>SEQ ID NO: 24410 | EVQLLESGGGLVQPGGSLRLSCAASEFTFSSYAMN WVRQAPGKGLEWVSVISGRGGNTFYADSVKGRFTI SRDNSKNTLYLQMNSLRAEDTAVYYCASRLAVAG SEACDIWGQGTMVTVSS<br>SEQ ID NO: 28416 |

FIGURE 50
(Continued)

| | | | | |
|---|---|---|---|---|
| iPS:392814 | 21-225_22A1 | NA | GATATTGTGATGACCCAGACTCCACTCTCT GTCCGTCACCCCTGGACAGCCGGCCTCATCT CCTGCAAGTCTAGTCAGAGCCTCCTGCATAGT GGTGAAAGACCTATTTATATTGGTACCTGCA GAAGCCAGGCCAGCCTCCACAGCTCCTGATCT ATGAAGTTTCCAACGGTTCTCTGGACTGCCA GATAGGTTCAGTGGCAGCGGGTCAGGACAG ATTTCACACTGAAAATCAGCCGGGTGGAGGCT GCGGATGTTGGGGTTTATTACTGCATGCAAAC TTTACACCTTCCGTGACGTTCGGCCAAGGGA CCAAGGTGGAAATCAAA<br><br>SEQ ID NO: 24411 | CAGGTGCAGCTGGTGGAGTCTGGGGGAGGCGTG GTCCAGCCTGGGAGGTCCCTGAGACTCTCCTGTG CAGGGTCTGATTCACCTTCAGTAGCTATGGCAT GCACTGGGTCCGCCAGGCTCCAGGCAAGGGGCT GGAGTGGGTGGCAGTTATGTGGTATGATGGAAGT AATAAATATTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGATGGGGGA TTTTTGGAGTGGTTAGACTACTGGGGCCAGGGAA CCCTGGTCACCGTCTCCTCA<br><br>SEQ ID NO: 28417 |
| | | AA | DIVMTQTPLSLSVTPGQPASISCKSSQSLLHSGGK TYLYWYLQKPGQPPQLLIYEVSNRFSGLPDRFSG SGSGTDFTLKISRVEAADVGVYYCMQTLHLPWT FGQGTKVEIK<br><br>SEQ ID NO: 24412 | QVQLVESGGGVVQPGRSLRLSCAASGFTFSSYGMH WVRQAPGKGLEWVAVMWYDGSNKYYADSVKGR FTISRDNSKNTLYLQMNSLRAEDTAVYYCARDGGF LEWLDYWGQGTLVTVSS<br><br>SEQ ID NO: 28418 |
| iPS:392816 | 21-225_22E4 | NA | GACATCCAGATGACCCAGTCTCCATCTCCCT GTCTGCATCTGTAGGAGACAGAGTCACCATCA CTTGCCGGGCAAGTCAGAACATTAGTAGTTAT TTAAATTGGTATCAGCAGAAACCAGGGAAAG CCCCTAAGCTCCTGATCTATGCTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAATACCCCCTTA TTCACTTTCGGCCCTGGGACCAAAGTGGATAT CAAA<br><br>SEQ ID NO: 24413 | GAGGTGCAGCTGTTGGAGTCTGGGGGAGGCTTG GTGCAGCCTGGGGGGTCCCTGAGACTCTCCTGTG CAGCCTCTGAATTCACCTTTAGCAGCTATGCCAT GAGCTGGGTCCGCCAGGCTCCAGGGAAGGGGCT GGAGTGGGTCTCAATTATTAGTGGTGGTGTACT AACACATTCTACGCAGACTCCGTGAAGGGCCGGT TCACCATCTCCAGAGACAATGCAAAGAACACGCT GTATCTGCAAATGAACAGCCTGAGAGCCGAGGA CACGGCCGTATATTACTGTGCTCCCGTATAGCA GTGGCTGGCTCGGAGGCTTTGATATCTGGGGCC AAGGGACAATGGTCACCGTCTCTTCA<br><br>SEQ ID NO: 28419 |

FIGURE 50
(Continued)

| | | | | |
|---|---|---|---|---|
| iPS:392818 | | AA | DIQMTQSPSSLSASVGDRVTITCRASQNISSYLN WYQQKPGKAPKLLIYAASSLQSGVPSRFSGSGS GTDFTLTISSLQPEDFATYYCQQSYNTPLFTFGPG TKVDIK<br><br>SEQ ID NO: 24414 | EVQLLESGGGLVQPGGSLRLSCAASEFTFSSYAMS WVRQAPGKGLEWVSIISGRGTNTFYADSVKGRFTI SRVNSKNTLYLQMNSLRAEDTAVYYCASRIAVAGS EAFDIWGQGTMVTVSS<br><br>SEQ ID NO: 28420 |
| | 21-225_22D8 | NA | GACATCCAGATGACCCAGTCTCCATCTCCCT GTCTGCATCTGTAGGAGACAGAGTCACCATCA CTTGCCGGACAAGTCAGAACAGTAACAGTTAT TTAAATTGGTATCAGCAGAAACCAGGGAAAG CCCCTAAGCTCCAGATCTTTGCTGCATACAGTT TGGAAAGTGGGGTCCCATCAAGGTTCAGTGGC AATAGATCTGGGACAGAGTTCACTCTCACCAT CAGCAGTCTGCAACAGACTTACGGTACAACTT ACTACTGTCAACAGGGACACACGACTGAGATTAA ACCTTCGGCCAAGGGACACACGACTGGAGATTAA A<br><br>SEQ ID NO: 24415 | CAGGTGCAGCTGGTGGAGTCTGGGGGAGGCGTG GTCCAGCCTGGGGAGGTCCCTGAGACTCTCCTGTG TAGCCTCTGATTCACCTTCAGGAGCTATGGCAT GCACTGGGTCCGCCAGGCTCCAGGCAAGGGGCT GGAGTGGGTGACAATTATATCATATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCTGAGG ACACGGCTGTATATTTCTGTGCGAGAGGGTTTG GTTCGGGGACTTCTGGGGCCAGGGAACCCTGGTC ACCGTCTCCTCA<br><br>SEQ ID NO: 28421 |
| | | AA | DIQMTQSPSSLSASVGDRVTITCRTSQNSNSYLN WYQQKPGKAPKLQIFAAYSLESGVPSRFSGNRS GTEFTLTISSLQPEDFATYYCQQTYGTSITFGQGT RLEIK<br><br>SEQ ID NO: 24416 | QVQLVESGGGVVQPGRSLRLSCVASGFTFRSYGMH WVRQAPGKGLEWVTIISYDGSNKYYADSVKGRFTI SRDNSKNTLYLQMNSLRAEDTAVYFCARGVWFGD FWGQGTLVTVSS<br><br>SEQ ID NO: 28422 |

FIGURE 50
(Continued)

| | | | |
|---|---|---|---|
| iPS:392820 | 21-225_23D1 | NA | GACATCCAGATGACCCAGTCTCCATCCTCCCT GTCTGCATCTGTAGGAGACAGAGTCACCATCA CTTGCCGGGCAAGTCAGGGCATCAGAAATGAT TTAGGCTGTATCAGCAGAAACCAGGGAAAG CCCCTAAGCGCCTGATCTATGCTGCATCCAGT TTACAAAGTGGGGTCCCATCAAGGTTCAGTGG CAGTGGTTCTGGGACAGAATTCACTCTCACAG TCAGCAGCCTGCAGCCTGAAGATTTTGCAACT TATTACTGTCTACAGCATAGTAGTTACCCTCTC ACTTTCGGCGGAGGGACCAAGGTGGAGATCA AA | CAGTGCAGCTGCAGGAGTCGGGCCCAGGACTG GTGAAGCCTTCGGAGACCCTGTCCCTCACCTGCA CTGTCTCTGGTGGCTCCATCAGCAGAAGTAGTTA CTACTGGGGCTGGATCCGCCAGCCCCCAGGGAA GGGACTGGAGTGGATTGGGAGTATCTATTATAGT GGGAGCGCCAGTACAACCCGTCCCTCAAGAGT CGAGTCACCATATCCGTCGACACGTCCAAGAACC AGTTCTCCCTGACGCTGAGCTCTGTGACCGCCGC AGACACGGCTTTATATTACTGTGCGAGACTGAGC AGCAGCTGTCTTTTGACTACTGGGGCCAGGGAA CCCTGGTCACCGTCTCCTCA SEQ ID NO: 28423 |
| | | | QLQLQESGPGLVKPSETLSLTCTVSGGSISRSSYYW GWIRQPPGKGLEWIGSIYYSGSAQYNPSLKSRVTIS VDTSKNQFSLTLSSVTAADTALYYCARLSSSWSFD YWGQGTLVTVSS |
| | | AA | DIQMTQSPSSLSASVGDRVTITCRASQGIRNDLG WYQQKPGKAPKRLIYAASSLQSGVPSRFSGSGS GTEFTLTVSSLQPEDFATYYCLQHSSYPLTFGGG TKVEIK SEQ ID NO: 24418 | SEQ ID NO: 28424 |
| iPS:392822 | 21-225_23C8 | NA | GACATCCAGATGACCCAGTCTCCATCCTCCCG GTCTGCATCTGTAGGGGACAGAGTCACCATCA CTTGCCGGGCAAGTCAGGACATTAGAAATGAT TTAGGCTGTATCAGCAGAAACCAGGGAGAG CCCCTAAGCGCCTGATCAATGTTGCATCCAGT GTGCAAAGTGGGGTCCCATCAAGGTTCAGCGG CAGTGGATCTGGGACAGAATTCACTCTCACAA TCAGCAGCCTGCAGCCTGAAGATTTTGTAATT TATTACTGTCTACAGCATAATAGTTACCCGCTC ACTTTCGGCGGAGGGACCAAGGTGGAGATCA AA SEQ ID NO: 24419 | CAGTTGCAACTGCAGGAGTCGGGCCCAGGACTG GTGAAGCCTTCGGAGACCCTGTCCCTCACCTGCA CTGTCTCTGGTGGCTCCATCAGTAGGAGTAGTTA CTACTGGGGCTGGATCCGCCAGCCCCCAGGGAA GGGGCTGGAGTGGATTGGGAATATTATTATAGT GGGACCACTTACAACAACCCGTCCCTCAAGAGTC GAGTCACCATATCCGTAGACACGTCCAAGAACC ACTTCTCCCTGAAGCTGAGCTCTGTGACCGCCGC AGACACGGCTGTGTATTACTGTGGGGAGACATGGA AAAGACTGGGGCCTTGACTACTGGGGCCAGGGA ACCCTGGTCACCGTCTCCTCA SEQ ID NO: 28425 |

FIGURE 50
(Continued)

| | | | | |
|---|---|---|---|---|
| iPS:392824 | 21-225_24E5 | AA | DIQMTQSPSSRSASVGDRVTITCRASQDIRNDLGWYQQKPGRAPKRLINGASSVQSGVPSRFSGSGSGTEFTLTISSLQPEDFVIYYCLQHNSYPLTFGGGTKVEIK<br>SEQ ID NO: 24420 | QLQLQESGPGLVKPSETLSLTCTVSGGSISRSSYYWGWIRQPPGKGLEWIGNIYYSGTTYNNPSLKSRVTISVDTSKNHFSLKLSSVTAADTAVYYCGRHGKDWGLDYWGQGTLVTVSS<br>SEQ ID NO: 28426 |
| | | NA | GACATCCAGATGACCCAGTCTCCATCTCCCTGTCTGCATCTGTAGGAGACAGAGTCACCATCACTTGCCGGGCAAGTCAGGGCATTAGAAATGATTTAGGCTGGTATCAGCAGAAACCAGGGAAACCCCTAAGCGCCTGATCTATGCTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATAGTAATTACCCGCTCACTTTCGGCGGAGGGACCAAGGTGGAGATCAAA<br>SEQ ID NO: 24421 | CAGCTGCAGCTGCAGGAGTCGGGCCCAGGACTGGTGAAGCCCTCGGAGACCCTGTCCCTCACCTGCACTGTCTCTGGTGGCGCCATCAGCAGGAGTAGTTACTACTGGGGCTGGATCCGCCAGCCCCCAGGGAAGGGGCTGGAGTGGATTGGAGTATCTATTATAGTGGGAGCGCCAACTACAACCCGTCCCTCAAGAGTCGAGTCACCATATCCGTAGACACGTCCAAGAACCAGTTCTCCCTGAAGCTGAGCTCTGTGACCGCCGCAGACACGGCTGTGTATTACTGTGCGAGACTCAGCAGCAGCTGGTCCATTGACAACTGGGGCCAGGAACCCTGGTCACCGTCTCCTCA<br>SEQ ID NO: 28427 |
| | | AA | DIQMTQSPSLSASVGDRVTITCRASQGIRNDLGWYQQKPGKAPKRLIYAASSLQSGVPSRFSGSGSGTEFTLTISSLQPEDFATYYCLQHSNYPLTFGGGTKVEIK<br>SEQ ID NO: 24422 | QLQLQESGPGLVKPSETLSLTCTVSGGAISRSSYYWGWIRQPPGKGLEWIGSIYYSGSANYNPSLKSRVTISVDTSKNQFSLKLSSVTAADTAVYYCARLSSSWSIDNWGQGTLVTVSS<br>SEQ ID NO: 28428 |

FIGURE 50
(Continued)

| | | | |
|---|---|---|---|
| iPS:392826 | 21-225_20B9 | NA | GACATCCAGATGACCCAGTCTCCATCCTCACT GTCTGCATCTGTAGGAGACAGAGTCACCATCA CTTGTCGGGCAGTCAGGGCATTAGCAATTAT TTAGCCTGGTTTCAGCAGAAACCAGGGAAAGC CCCTAAGTCCCTGATCTATGTTGCATCCAGTT GCAAAGTGGGGTCCATCAAGTTCAGCGGCA GTGGATCTGGGACAGATTTCACTCTCACCATC AGCAGCCTGCAGCCTGAAGATTTTGCAACTTA TTACTGCCAACAGTATAATACTTATCCATTCAC TTTCGGCCCTGGGACCAAAGTGGATATCAAA<br><br>SEQ ID NO: 24423 | GAGGTGCAGCTGGTGGAGTCTGGGGGAGGCTTG GTACAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTTTCATACATTAGTAGTAGTAGTAGT ACCATATACTATGCAGACTCTGTGAAGGGCCGAT TCACCATCTCCAGAGACAATGCCAAGAACTCACT GTACCTGCAAATGAACAGCCTGAGAGACGAGGA CACGGCTGTGTATTACTGTGCGAGGTCACTATGG TCCCCCTTTGACTACTGGGGCCAGGGAACCCTGG TCACCGTCTCCTCA<br><br>SEQ ID NO: 28429 |
| | | AA | DIQMTQSPSSLSASVGDRVTITCRASQGISNYLA WFQQKPGKAPKSLIYVASSLQSGVPSKFSGSGSG TDFTLTISSLQPEDFATYYCQQYNTYPFTFGPGT KVDIK<br><br>SEQ ID NO: 24424 | EVQLVESGGGLVQPGGSLRLSCAASGFTFSSYSMN WVRQAPGKGLEWVSYISSSSSTIYYADSVKGRFTIS RDNAKNSLYLQMNSLRDEDTAVYYCARSLWSPFD YWGQGTLVTVSS<br><br>SEQ ID NO: 28430 |
| iPS:392830 | 21-225_21A5 | NA | GACATCCAGATGACCCAGTCTCCATCTCCCT GTGTGCATCTGTAGGAGACAGAGTCACCATCA CTTGCCGGGCAAGTCAGAGCATTAGCAGCCAT TTAAATTGGTATCAGCGGAAACCAGGGAAAG CCCCTAAACTCCTGATCTATGCTGCATCCAGTT TGCAAAGTGGGGTCCCATCAACGGTTCAGTGGC AGTGGATCTGGGACAGATTTCACTCTCACCAT CAGCAGTGTGCAACCTGAAGATTTTGCAACTT ATTACTGTCAACAGAGTTACATATCTCATTC ACTTTCGGCCCTGGGACCAAAGTGGATATCAA A<br><br>SEQ ID NO: 24425 | CAGGTGCAGCTGCAGGAGTCGGGCCCAGGACTG GTGAAGCCTTCGGAGACCCTGTCCCTCACCTGCA CTGTCTCTGGTGGCTCCATCAGTAGTTACTTCTGG AGCTGGATCCGGCAGCCCGCCGGGAAGGGACTG GAGTGGATTGGGCGTATCTATACCAGTGGGATCA CCAACTACAACCCCTCCCTCAAGAGTCGAGTCAC CATGTCAGTAGACACGTCCAAGAACCAGTTCTCC CTGAAACTGAGTTCTGTGACCGCCGCGGACACGG CCATATATTACTGTGCGAGAGGCCCCGACTTCGGG GTGGTTCGACCCCTGGGGCCAGGGAACCCTGGTC ACCGTCTCCTCA<br><br>SEQ ID NO: 28431 |

FIGURE 50
(Continued)

| | | | | |
|---|---|---|---|---|
| | | AA | DIQMTQSPSSLCASVGDRVTITCRASQTISSHLN WYQRKPGKAPKLLIYAASSLQSGVPSRFSGSGSG TDFTLTISSVQPEDFATYYCQQSYNISFTFGPGTK VDIK<br><br>SEQ ID NO: 24426 | QVQLQESGPGLVKPSETLSLTCTVSGGSISSYFWSW IRQPAGKGLEWIGRIYTSGITNYNPSLKSRVTMSVD TSKNQFSLKLSSVTAADTAIYYCARGPTSGWFDPW GQGTLVTVSS<br><br>SEQ ID NO: 28432 |
| iPS:392832 | 21-225_21H8 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTACAAAGTGGGGTCCCATCAAGGTTCAGAGG CAGTGGATCTGGGACAGAATTCACTCTCACAA TCAGCAGCCTGCAGCCTGAAGATATTTGCAACT TATTACTGTCTACAGCATAATAGTTACCCGTG GACGTTCGGCCAAGGGACCAAGGTGGAAATC AAA<br><br>SEQ ID NO: 24427 | CAGGTGCAGCTGGTGGAGTCTGGGGGAGGCGTG GTCCAGTCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTTTGATGGAAGT AATAAATACTATGCAGACTCCGTGAAGGGCCGA TTCACCATCTCCAGAGACAACAATTCCAAGAACACGC TGTATCTGCAAATGAACAGCCTGAGAGCCGAGG ACACGGCTGTGTATTACTGTGCGAGAGATCTTGG CTGGACGGAAGAGTACTGGGGCCAGGGAACCCT GGTCACCGTCTCCTCA<br><br>SEQ ID NO: 28433 |
| | | AA | DIQMTQSPSSLSASVGDRVTITCRASQGIRNDLG WYQQKPGKAPKRLIYAASSLQSGVPSRFRGSGS GTEFTLTISSLQPEDFATYYCLQHNSYPWTFGQG TKVEIK<br><br>SEQ ID NO: 24428 | QVQLVESGGGVVQSGRSLRLSCAASGFTFSDYGM HWVRQAPGKGLEWVAVIWFDGSNKYYADSVKGR FTISRDNSKNTLYLQMNSLRAEDTAVYYCARDLG WTEEYWGQGTLVTVSS<br><br>SEQ ID NO: 28434 |

FIGURE 50
(Continued)

| | | | |
|---|---|---|---|
| iPS:392834 | 21-225_22C1 | NA | GACATCCAGATGACCCAGTCTCCATCTCCT GTCTGCATCTGTAGGAGACAGAGTCACCATCA CTTGCCGGACAAGTCAGGGCATTAGAAATGAT TTAGGCTGGTATCAGCAGAAACCAGGGAAAG CCCCTAAGGCGCTGATCTATGCTGCATCCAGT TTGCAAAGTGGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATACTTACCCGCTC ACTTTCGGCGGAGGGACCAAGGTGGAGATCAA AA | CAACTGCAGCTGCAGGAGAGTCGGGGCCAGGACTG GTGAAGCCTTCGGAGACCCTGTCCCTCACCTGTA CTGTTTCTGGTGGCTCCATCAACAGGAGTAGTTA CTACTGGGGCTGGATCCGCCAGCCCCCAGGGAA GGGGCTGGAGTGGATTGGGAATATCTATTATAGT GGGGCCACCTATTATAATTCTCCCTCAAGAGTC GAGTCACCATCTCCGTAGACACGTCCACGAACCA GTTCTCCCTGAAGCTGAGCTCTGTGACCGCCGCA GACACGGCTGTGTATTACTGTGCGAGACATAGCG GCAGCTGGTCCCTTGACTACTGGGGCCAGGAAC CCTGGTCACCGTCTCCTCA |
| | | | SEQ ID NO: 24429 | SEQ ID NO: 28435 |
| | | AA | DIQMTQSPSSLSASVGDRVTITCRTSQGIRNDLG WYQQKPGKAPKRLIYAASSLQSGVPSRFSGSGS GTEFTLTISSLQPEDFATYYCLQHSTYPLTFGGGT KVEIK | QLQLQESGPGLVKPSETLSLTCTVSGGSINRSSYYW GWIRQPPGKGLEWIGNIYYSGATYYNSSLKSRVTIS VDTSTNQFSLKLSSVTAADTAVYYCARHSGSWSLD YWGQGTLVTVSS |
| | | | SEQ ID NO: 24430 | SEQ ID NO: 28436 |
| iPS:392836 | 21-225_22F4 | NA | GACATCCAGATGACCCAGTCTCCATCTCCCT GTCTGCTTCTGTTGGAGACAGAGTCACCATCA CTTGCCGGGCAAGTCAGGTCATTAGAGATGAT TTAGGCTGGTATCAGCAGAAACCAGGGAAAG CCCCTAAGCGCCTGATCTATGCTGCATCCAGT TTGCAAAGTGGGGTCCCATCGAGGTTCAGCGG CAGTAGATCTGGGACAGATTCACTCTCACAA TCAGCAGCCTGCAGCCTGAAGATTTTGCAACT TATTACTGTCTACACCACTACTAGTTATCCTGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGCGACTACTGGCAT GCACTGGGTCCGCCAGGCTCCAGGCAAGGGGCT GGAGTGGGTGGCAGTTATATGACTCCGTGAAGGGCCGAT AATAAATACTATGTAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAAAAGTAT AGCAGCAGCTGGTACGACTACGGTATGGACGTCT GGGGCCAAGGGACCACGGTCACCGTCTCCTCA |
| | | | SEQ ID NO: 24431 | SEQ ID NO: 28437 |

FIGURE 50
(Continued)

| | | | | |
|---|---|---|---|---|
| | | | AA | DIQMTQSPSSLSASVGDRVTITCRASQVIRDDLG WYQQKPGKAPKRLIYAASSLQSGVPSRFSGSRS GTDFTLTISSLQPEDFATYYCLHHYSYPRTFGQG TKVEIK<br><br>SEQ ID NO: 24432 | QVQLVESGGGVVQPGRSLRLSCAASGFTFSDYGM HWVRQAPGKGLEWVAVIWYDGSNKYYVDSVKGR FTISRDNSKNTLYLQMNSLRAEDTAVYYCAREKYS SSWYDYGMDVWGQGTTVTSS<br><br>SEQ ID NO: 28438 |
| iPS:392838 | 21-225_22G8 | NA | GACATCCAGATGATCCAGTCTCCATCTCCCT GTTCGCATCTGTAGGAGACAGAGTCACCATCA CTTGCCGGACAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAAATTCAGCGG CAGTGGATCTGGGACAGATTTCACTCTCTCAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA<br><br>SEQ ID NO: 24433 | CAGCTGCAGCTGCAGGAGTCGGGCCCAGGACTG GTGAAGCCTTCGGAGACCCTGTCCCTCACCTGCA CTGTCTCTGGTGGCTCCATCAACAGGAGTAGTTA CTACTGGGGCTGGATCCGCCAGCCCCCAGGGAA GGGGAGCACCTACTACAACCCGTCCGTCAAGAGTC GATTCACCATATCCGTAGACACGTCCAAGAACCA GTTCTCCCTGAAGCTGAGCTCTGTGACCGCCGCA GACACGGCTGTGTATTACTGTGCGAGACATGGAA AAGACTGGGCCTTGACTACTGGGGCCAGGGAA CCCTGGTCACCGTCTCCTCA<br><br>SEQ ID NO: 28439 |
| | | AA | DIQMIQSPSSLFASVGDRVTITCRTSQGIRNDLG WYQQKPGKAPKRLIYAASSLQSGVPSKFSGSGS GTEFTLSISSLQPEDFATYYCLQHNSYPLTFGGGT KVEIK<br><br>SEQ ID NO: 24434 | QLQLQESGPGLVKPSETLSLTCTVSGGSINRSSYYW GWIRQPPGKGLDWIGNIYYSGSTYYNPSVKSRFTIS VDTSKNQFSLKLSSVTAADTAVYYCARHGKDWGL DYWGQGTLVTVSS<br><br>SEQ ID NO: 28440 |

FIGURE 50
(Continued)

| | | | |
|---|---|---|---|
| iPS:392840 | 21-225_23G1 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTCTGCTGCATCCAGTTT ACAGAGTGGGGTCCCATCACAGTTCAGCGGCA GTGGATTTGGGACAGATTTCACTCTCACCATC AGCAGCCTGCAACAGTATAATAGTTACCCATTCA TTACTGCCAACAGTATAATAGTTACCCATTCA CTTTTCGGCCCTGGGACCAAAGTGGATATCAAA<br><br>SEQ ID NO: 24435 | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAGGGGGCT GGAGTGGGGTCTCAGTTATTAGTGGTAGTGGTGGT ACCACATATAACACAGACTCCGTGAAGGGCCGG TTCACCATCTCCAGAGACAATTCCAAGAACACGC TATATCTGCAAATGAACAGCCTGAGAGCCGAGG ACACGGCCGTATATTACTGTGCCGCAGCTCCTT GTTTGACTACTGGGGCCAGGGAACCCTGGTCACC GTCTCCTCA<br><br>SEQ ID NO: 28441 |
| | | AA | DIQMTQSPSSLSASVGDRVTITCRASQGISNYLA WFQQKPGKAPKSLISAASSLQSGVPSQFSGSGFG TDFTLTISSLQPEDFATYYCQQYNSYPFTFGPGT KVDIK<br><br>SEQ ID NO: 24436 | EVQLLESGGGLVQPGGSLRLSCAASGFTFSSYAMS WVRQAPGRGLEWVSVISGSGGTTYNIDSVKGRFTI SRDNSKNTLYLQMNSLRAEDTAVYYCARSSLFDY WGQGTLVTVSS<br><br>SEQ ID NO: 28442 |
| iPS:392842 | 21-225_23G8 | NA | GACATCCAGATGACCCAGTCTCCATCCTCACT GTCTGCATCTGTAGGAGACAGAGTCACCATCA CTTGTCGGGCGAGTCAGGGCATTAGAAATTAT TTAGCCTGGTTTCAGCAGAAACCAGGGAAAGC CCCTAAGTCCCTGATCTATGCTGCATCCAGTTT GCAAAGTGGGGTCCCATCAACTTCAGCGGCA GTGGATCTGGGACAGATTTCACTCTCACCATC AGTAGCCTGCAGCCTGAAGATTTTGCAACTTA TTACTGCCAACAGTATAATAGTTACCCTTTCAC TATCGGCCCTGGGACCAAGGTGGATATCAAA<br><br>SEQ ID NO: 24437 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTAGTGGTGGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGGTTAGCAGTGG ACGGTTCGCCTGGGGCCAGGGAACCCTGGTCACC GTCTCCTCA<br><br>SEQ ID NO: 28443 |

FIGURE 50
(Continued)

| | | | | |
|---|---|---|---|---|
| | | | DIQMTQSPSSLSASVGDRVTITCRASQGIRNYLA WFQQKPGKAPKSLIYAASSLQSGVPSNFSGSGSG TDFTLTISSLQPEDFATYYCQQYNSYPFTIGPGTK VDIK | EVQLLESGGGLVQPGGSLRLSCAASGFTFSSYAMS WVRQAPGKGLEWVSAISGSGGSTYYADSVKGRFTI SRDNSKNTLYLQMNSLRAEDTAVYYCAVSSGWFA WGQGTLVTVSS |
| | | AA | SEQ ID NO: 24438 | SEQ ID NO: 28444 |
| iPS:392844 | 21-225_23E11 | NA | GACATCCAGATGACCCAGTCTCCATCCTCCCT GTCTGCATCTGTAGGAGACAGAATCACCATCA CTTGCCGGGCAAGTCAGGGCATTAGAAATGAT TTAGGCTGGTATCAGCAGAAACCAGGGAAAG CCCCTAAAGCGCCTGATCTATCCTGCATCCAGTT TGCAAAGTGGGGTCCCATCAAGGTTCAGCGGC AGTGGATCTGGGACAGATTCACTCTCACAAT CAGCAGCCTGCAGCCTGAAGATTTTGCAACTT ATTACTGTCTACAGCATAATAGTTACCCGTGG ACGTTCGGCCAAGGGACCAAGGTGGAAATCA AA | GAGGTGCAACTGGTGGAGTCTGGGGGAGGCCTG GTCAAGCCTGGGGGGTCCCTGAGACTCTCTGTG CAGCCTCTGGATTCACCTTCAGTTCCTATACCAT GAACTGGGTCCGCCAGGCTCCAGGGAAGGGGCT GGAGTGGGTCTCATCCATTAGTGGTAGTGGTAGT TACATATGTATGTAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGATCGGGGC AGTCTCTGGGGCCAGGGAACCCTGGTCACCGTCT CCTCA |
| | | | SEQ ID NO: 24439 | SEQ ID NO: 28445 |
| | | AA | DIQMTQSPSSLSASVGDRITTTCRASQGIRNDLG WYQQKPGKAPKRLIYPASSLQSGVPSRFSGSGSG TEFTLTISSLQPEDFATYYCLQHNSYPWTFGQGT KVEIK | EVQLVESGGGLVKPGGSLRLSCAASGFTFSSYTMN WVRQAPGKGLEWVSSISGSSSYIWYDSVKGRFTI SRDNAKNSLYLQMNSLRAEDTAVYYCARDRGSLW GQGTLVTVSS |
| | | | SEQ ID NO: 24440 | SEQ ID NO: 28446 |

FIGURE 50
(Continued)

| | | | |
|---|---|---|---|
| iPS:392846 | 21-225_24B6 | NA | GACATCCAGATGACCCAGTCTCCATCTCCT GTCTGCATCTGTCGGAGACAGAGTCACCATCA CTTGCCGGGCAAGTCAGGACATTAGAAATGAT TTAGGCTGGTATCAGCAGAAGCCAGGGAAAG CCCCTAAGCGCCTGATCTATGCTGCATCCAGT TTGCACAGTGGGGTCCCATCAAGGTTCAGCGG CAGTGGATCTGGGACAGAATTCACTCTCACAA TCAGCAGCCTGCAGACTGAAGATTTTGCAACT TATTACTGTCTACAGCATTATAGTTACCCTCGG ACGTTCGGCCAAGGGACCAAGGTGGAAGTCA AG |
| | | | SEQ ID NO: 24441 |
| | | | DIQMTQSPSSLSASVGDRVTITCRASQDIRNDLG WYQQKPGKAPKRLIYAASSLHSGVPSRFSGSGS GTEFTLTISSLQTEDFATYYCLQHYSYPRTFGQG TKVEVK |
| | | AA | SEQ ID NO: 24442 |
| | | | CAGGTGCAGCTGGTGGAGTCTGGGGGAGGCGTG GTCCAGCCTGGGAGTCCCGAGACTCTCCTGTG CAGCGTCTGATTCATCTTCAGTAACTATGTCAT GCACTGGGTCCGCCAGGCTCCAGGCAAGGGCT GGAGTGGGTGGCAGTTATATGGTATGATGAAGT AATAAATACTATGCAGACTCCGTGAAGGGCCGA TTCACCATCTCCAGAGACAATTCCAAGAACAGC TGTATCTGCAAATGAACAGCCTGAGAGCCGAG ACACGGCTGTGTATTACTGTGCGAGAGAGGAATA TAGTAGTGGCTGGTACGACTACGGTATGGACGTC TGGGGCCAAGGGACCACGGTCACCGTCTCCTCA |
| | | | SEQ ID NO: 28447 |
| | | | QVQLVESGGGVVQPGRSPRLSCAASGFIFSNYVMH WVRQAPGKGLEWVAVIWYDGSNKYYADSVKGRF TISRDNSKNTLYLQMNSLRAEDTAVYYCAREEYSS GWYDYGMDVWGQGTTVTVSS |
| | | | SEQ ID NO: 28448 |
| iPS:392848 | 21-225_20F9 | NA | GACATCCAGATGACCCAGTCTCCATCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTCTGCTGCATCCAGTTT GCAAAGTGGGGTCCCTTCAAAGTTCAGCGGCA GTGGATCCGGGACAGATTTCACTCTCACCATC AGCAGCCTGCAACAGTATCATAGTTACCGTGGA TTGCTGCAACAGTATCATAGTTACCCGTGGA CGTTCGGCCAAGGGACCAAGGTGGAAATCAA A |
| | | | SEQ ID NO: 24443 |
| | | | GAAGTGCAGCTGGTGGAATCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGCT GGAGTGGGTCTCATCCATTAGTAGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTATTGTGCGAGAGATCGTGGG AGCTGCTGGGGCCAGGGAACCCTGGTCACCATCT CCTCA |
| | | | SEQ ID NO: 28449 |

FIGURE 50
(Continued)

| | | | | |
|---|---|---|---|---|
| iPS:392850 | | AA | DIQMTQSPSSLSASVGDRITITCRASQGISNYLAW FQQKPGKAPKSLISAASSLQSGVPSKFSGSGSGT DFTLTISSLQPEDFATYCCQQYHSYPWTFGQGTK VEIK<br><br>SEQ ID NO: 24444 | EVQLVESGGGLVKPGGSLRLSCAASGFTFSSYSMN WVRQAPGKGLEWVSSISSSSYIYYADSVKGRFTIS RDNAKNSLYLQMNSLRAEDTAVYYCARDRGSCW GQGTLVTISS<br><br>SEQ ID NO: 28450 |
| | 21-225_20H10 | NA | GGCATCCAGATGACCCAGTCTCCATCCTCCCT GTCTGCATCTGTAGGAGACAGAGTCACCATCA CTTGCCGGGCAAGTCAGGGCATTAAAAATAAT TTAGGCTGGTATCAGCAGAAACCAGGGAAAG GCCCTAAGTGCCTGATCTATGCTGCATCAGT TTGCAAAGTGGGGTCCCATCAAGGTTCAGCGG CAGTGGATCTGGGACAGAATTCACTCTCACAA TCAGCAGCCTGCAGCCTGAAGATATAGTTACCGCTC TATTACTGTCTACAGCATAATAGTTACCCGCTC ACTTTCGGCGGAGGGACCAAGGTGGAGATCA AA<br><br>SEQ ID NO: 24445 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGCT GGAGTGGGTCTCATCATTAGTAGTAGTAGTAGT TACATATACTACGCAGACTCAGTGAAGGGCCGAT TCACCATCTCCAGAGACAACAGCCAAGAACTCACT GTATCTGCAAATGAACAGCCTGAGAGCCGAGGA CACGGCTATTATTATTACTGTGCGAGAGATCGTGGG AGCCTCTGGGGCCAGGGAACCCTGGTCACCGTCT CCTCA<br><br>SEQ ID NO: 28451 |
| | | AA | GIQMTQSPSSLSASVGDRVTITCRASQGIKNNLG WYQQKPGKGPKCLIYAASSLQSGVPSRFSGSGS GTEFTLTISSLQPEDFATYCCLQHNSYPLTFGGG TKVEIK<br><br>SEQ ID NO: 24446 | EVQLVESGGGLVKPGGSLRLSCAASGFTFSTYSMN WVRQAPGKGLEWVSSISSSSYIYYADSVKGRFTIS RDNAKNSLYLQMNSLRAEDTAIYYCARDRGSLWG QGTLVTVSS<br><br>SEQ ID NO: 28452 |

FIGURE 50
(Continued)

| | | | |
|---|---|---|---|
| iPS:392852 | 21-225_21A2 | NA | GACATCAGATGACCCAGTCTCCATCTCCT GTCTGCATCTGTAGGAGACAGAGTCACCATCA CTTGCCGGGCAAGTCAGAGTATTAGTTAT TTAAATTGGTATCAGCAGAAACCAGGGAAAG CCCCTAAGCTCCTGATCTATGCTGCATCCAGTT TGCAAAGTGGGGTCCATCAAGGTTCAGTGGC AGTGGATCTGGGACAGATTTCACTCTCACCAT CAGTAGTCTGCAACAGAGTTACAGAAACCCTTT ACTTCTGTCAACAGAGTTACAGAAACCCCTTT TCACTTTCGGCCCTGGGACCAAAGTGGATAT CAAA SEQ ID NO: 24447 | GAGGTGCAGCTGTTGGAGTCTGGGGGAGGCTTG GTACAGCCTGGGGGGTCCCTGAGACTCTCCTGTG CAGCCTCTAAATTCACCTTTAGCAGCTATGCCAT GAACTGGGTCCGCCAGGCTCCAGGGAAGGGGCT GGAGTGGATCTCAATTATTAGTGGTCGTGGTGGT AACACATTCTACGCAGACTCCGTGAAGGGCCGGT TCACCATCTCCAGAGACAATTCAAGAACACGCT GTATCTGCAAATGAACAGCCTGAGAGCCGAGGA CACGGCCGTATATTACTGTGCGTCCCGTTTGGCA GTGGCTGCCTCGGAGGCTTTTGATATCTGGGGCC AAGGGACAATGGTCACCGTCTCTCA SEQ ID NO: 28453 |
| | | AA | DIQMTQSPSSLSASVGDRVTITCRASQSISSYLNW YQQKPGKAPKLLIYAASSLQSGVPSRFSGSGSGT DFTLTISSLQPEDFATYFCQQSYRTPFFTFGPGTK VDIK SEQ ID NO: 24448 | EVQLLESGGGLVQPGGSLRLSCAASKFTFSSYAMN WVRQAPGKGLEWISIISGRGGNTFYADSVKGRFTIS RDNSKNTLYLQMNSLRAEDTAVYYCASRLAVAGS EAFDIWGQGTMVTVSS SEQ ID NO: 28454 |
| iPS:392854 | 21-225_21E5 | NA | GACATCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTACATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAATAGTTACCCCCTC ACTTTCGGCGGAGGGACCAAGGTGGAGATCA AA SEQ ID NO: 24449 | CAGGTGCAGCTGGTGGAGTCTGGGGGAGGCGTG GTCCAGCCTGGGAGGTCCCTGAGACTCTCCTGTT CAGCGTCTGGATTCACCTTCAGTGACTATGGCAT GCACTGGGTCCGCCAGGCTCCAGGCAAGGGGCT GGAGTGGGTGGCAGTTATATGTCAGACTCCGTGAAAAGT AATAATACTACTATGCAGACAATTCCAAGAACACGC TTCACCATCTCCAAATGAACAGCCTGAGAGCCGAGG TGTATCTGCAAATGAACAGCCTGAGAGCCGAGG ACACGGCTATGTATTACTGTACGAGAGAACTGGG GTCCGGTCTGACTATTGGGGCCAGGGAACCCTG GTCACCGTCTCCTCA SEQ ID NO: 28455 |

FIGURE 50
(Continued)

| | | | | |
|---|---|---|---|---|
| iPS:392856 | | AA | DIQMTQSPSSLSASVGDRVTITCRASQGIRNDLG WYQQKPGKAPKRLIYATSSLQSGVPSRFSGSGSG TEFTLTISSLQPEDFATYYCLQHNSYPLTFGGGT KVEIK<br>SEQ ID NO: 24450 | QVQLVESGGGVVQPGRSLRLSCSASGFTFSDYGMH WVRQAPGKGLEWVAVIWYDESNKYYADSVKGRF TISRDNSKNTLYLQMNSLRAEDTAMYYCTRELGFR SDYWGQGTLVTVSS<br>SEQ ID NO: 28456 |
| | 21-225_22A2 | NA | GACATCCAGATGACCCAGTCTCCATCCTCACT GTCTGCATCTGTCGGAGACAGAGTCACCATCA CTTGTCGGGCGAGTCAGGACATTAGCAATTAT TTAGCCTGGTTCAGCAGAAACCAGGAAAG CCCCTAAGTCCCTGATCTACGCTGCATCCAGTT TGCAAAGTGGGGTCCCATCAAGTTCAGCGGC AGTGGATCTGGGACAGATTTCACTCTCACCAT CAGCAGCCTGCAGCCTGAAGATTTTGCAAGTT ATTACTGCCAACAGTATAATAGTTTCCCGCTC ACTTTCGGCGGAGGGACCAAGGTGGAGATCA AA<br>SEQ ID NO: 24451 | GAGGTGCAGCTGTTGGAGTCTGGGGGAGGCTTG GTCCAACCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGGTATTAGTGGTAGTGGAGGT AACACACCTACGCAGACTCCGTGAAGGGCCGG TTCACCATCTCCAGAGACATTTCCAAGAACACGC TGTATCTGCAAATGAACAGCCTGAGAGCCGAAG ACACGGCCGTATATTACTGTGCGAAAGTAGTGGG AGCTGTCCACTGGGGCCGGGAACCCTGGTCACC GTCTCCTCA<br>SEQ ID NO: 28457 |
| | | AA | DIQMTQSPSSLSASVGDRVTITCRASQDISNYLA WVQQKPGKAPKSLIYAASSLQSGVPSKFSGSGS GTDFTLTISSLQPEDFASYYCQQYNSFPLTFGGG TKVEIK<br>SEQ ID NO: 24452 | EVQLLESGGGLVQPGGSLRLSCAASGFTFSSYAMS WVRQAPGKGLEWVSGISGSGGNTPYADSVKGRFTI SRDISKNTLYLQMNSLRAEDTAVYYCAKVVGAVH WGRGTLVTVSS<br>SEQ ID NO: 28458 |

FIGURE 50
(Continued)

| | | | |
|---|---|---|---|
| iPS:392858 | 21-225_22H4 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT GTGCAAAGTGGGGTCCCATCAAGGTTCAGCGG CAGTGGATCTGGGACAGAATTCACTCTCACAA TCAGCAGCCTGCAGCCTGAAGATTTTGCACTT TATTACTGTCTACAGCATAATAGTTACCCGCTC ACTTTCGGCGGAGGGACCAAGGTGGAGATCA AA<br><br>SEQ ID NO: 24453 | CAGCTGCAGCTGCAGGAGTCGGGCCCAGGACTG GTGAAGCCTTCTGGTGGCTCCATCAGTAGGAGTAGTTA CTGTCTCTGGGGCTCCATCAGTAGGAGTAGTTA CTACTGGGCTGGATCCGCCAGCCCCCCAGGGAA GGGGCTGGAGTGGATTGGGAATATTTATTATAGT GGGAGCACCTACCACAACCGTCTCTCAAGAGTC GAGTCACCATATCGTAGACACGTCCATGAACCA GTTCTCCCTGAAGTTGACCTCTGTGACCGCCCA GACACGGCTGTGTATTTCTGTGCGAGACATGGAA AAGACTGGGGCCTTGACTACTGGGGCCAGGGAA CCCTGGTCACCGTCTCCTCA<br><br>SEQ ID NO: 28459 |
| | | AA | DIQMTQSPSSLSASVGDRVTITCRASQGIRNDLG WYQQKPGKAPKRLIYAASSVQSGVPSRFSGSGS GTEFTLTISSLQPEDFALYYCLQHNSYPLTFGGG TKVEIK<br><br>SEQ ID NO: 24454 | QLQLQESGPGLVKPSETLSLTCTVSGGSISRSSSYYW GWIRQPPGKGLEWIGNIYYSGSTYHNPSLKSRVTIS VDTSMNQFSLKLTSVTAADTAVYFCGRHGKDWGL DYWGQGTLVTVSS<br><br>SEQ ID NO: 28460 |
| iPS:392860 | 21-225_22H8 | NA | GATATTGTGATGACCCAGACTCCACTCTCTCT GCCCGTCACCCCTGGACAGCCGGCCTCCATCT CCTGCAAGTCTAGTCAGAGCCTCCTGCATAGT GATGGAAAGACCTTTTTGTATTGGTACCTGCA GCCAGGCCATCTCCACAGCTCCTGATCT AAGCAAGGTTTCAACCGGTTCTCTGGAGTGCCA ATGAAGTTTCAGTGGCAGCGGGTCAGGGACAG GATAAGGTTCACACTGAAAATCAGCCGGGTGGAGGCT ATTTCACACTGAAAATCAGCCGGGTGGAGGCT GAGGATGTTGGAATTTATTACTGCATGCAAAG TATACAGCTTCCGCTCTCATTCGGCGGAGGGA CCAAGGTGGAGATCAAC<br><br>SEQ ID NO: 24455 | CAGGTGCAGCTGGTGGAGTCTGGGGGAGGCGTG GTCCAGCCTGGAGGTCCCTGAGACTCTCCTGTG CAGGCGTCTGGATTCACCTTCAGTAGCTATGGCAT GCACTGGGTCCGCCAGGCTCCAGGCAAGGGGCT GGAGTGGGTGGCAGTTATCTGGTATGATGGAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGCTTGC CTGGTACGAAGACTACTGGGGCCAGGGAACCCT GGTCACCGTCTCCTCA<br><br>SEQ ID NO: 28461 |

FIGURE 50
(Continued)

| | | | | |
|---|---|---|---|---|
| | | AA | DIVMTQTPLSLSVTPGQPASISCKSSQSLLHSDGK TFLYWYLQKPGHPPQLLIYEVSNRFSGVPDRFSG SGSGTDFTLKISRVEAEDVGIYYCMQSIQLPLSFG GGTKVEIN<br>SEQ ID NO: 24456 | QVQLVESGGGVVQPGRSLRLSCAASGFTFSSYGMH WVRQAPGKGLEWVAVIWYDGNNKYYADSVKGRF TISRDNSKNTLYLQMNSLRAEDTAVYYCARELAW YEDYWGQGTLVTVSS<br>SEQ ID NO: 28462 |
| | | NA | GAAATTGTGTTGACGCAGTCTCCAGGCACCCT GTCTTTGTCTCCAGGAGAAAGAGCCACCCTCT CCTGCAGGGCCAGTCAGAATGTTTACAGCAGC TACTTAGCCTGGTACCAGCAGAAACCTGGCCA GACTCCCAGGCTCCTCATCTATGGTGCATCCA GCAGGGCCAGTGGCATCCCAGACAGGTTCAGT GGCAGTGGGTCTGGGACAGACTTCACTCTCAC CATCAGCAGACTGGAGCTGAAGATTTTGCAG TGTATTACTGTCAGCAGTATGGTCACCT CGGACGTTCGGCCAAGGGACCAAGGTGGAAA TCAAA<br>SEQ ID NO: 24457 | CAGGTGCAGCTGCAGGCGTCGGGCCAGGACTG GTGAAGCCTTCACAGACCCTGTCCCTCACCTGCA CTGTCTCTGATGGCTCCATCAGCAGTGGTTA CTACTGGAGCTGGATCCGCCAGCACCAGGGAA GGGCCTGGAGTGGATTGGGTACATCTATTACAGT GGGAGCACCTACTACAACCCGTCCCTCAAGAGTC GAGTTACCATATCAGTAGACACGTCTAAGAACCA GTTCTCCCTGAAGCTGAGTTCTGTGACTGCCGCG GACACGGCCGTATATTACTGTGCGAGAGAGGAC GGTGCTTCGGCTACTACGGTATGGACGTCTGGG GCCAAGGGACCACGGTCACCGTCTCCTCA<br>SEQ ID NO: 28463 |
| iPS:392864 | 21-225_23B9 | AA | EIVLTQSPGTLSLSPGERATLSCRASQNVYSSYLA WYQQKPGQTPRLLIYGASSRASGIPDRFSGSGSG TDFTLTISRLEPEDFAVYYCQQYGSSPRTFGQGT KVEIK<br>SEQ ID NO: 24458 | QVQLQASGPGLVKPSQTLSLTCTVSDGSISSGGYY WSWIRQHPGKGLEWIGYIYYSGSTYYNPSLKSRVTI SVDTSKNQFSLKLSSVTAADTAVYYCAREDGAFGY YGMDVWGQGTTVTVSS<br>SEQ ID NO: 28464 |

FIGURE 50
(Continued)

| | | | | |
|---|---|---|---|---|
| iPS:392866 | 21-225_23H11 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGACTGGTATCAGCAGAAACCAGGGAAAG CCCCTAAGCGCCTGATCTATGCTGCATCAGT TTGCAAAGTGGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGACATAATCGTTACCCGTC ACTTTCGGCGGAGGGACCAAGGTGGAGATCA AA<br>SEQ ID NO: 24459 | CAGGAGCAGCTGGTGGAGTCTGGGGGAGGCGTG GTCCAGCCTGGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGAAAAT AATAAATACTATGTAGACTCCGTGAAGGGCCGAT TCACCATCTCCAGAGACAACTCCAAGAACACGCT GTATCTGCAAATGAACAGCCTGAGAGCCGAGGA CACGGCTGTGTATTACTGTGCGAGAGAATTGGGG TTCCGGTCTGACTACTGGGGCCAGGGAACCCTGG TCACCGTCTCCTCA<br>SEQ ID NO: 28465 |
| | | AA | DIQMTQSPSSLSASVGDRVTITCRASQGIRNDLD WYQQKPGKAPKRLIYAASSLQSGVPSRFSGSGS GTEFTLTISSLQPEDFATYYCLQHNRYPLTFGGG TKVEIK<br>SEQ ID NO: 24460 | QEQLVESGGGVVQPGRSLRLSCAASGFTFSSYGMH WVRQAPGKGLEWVAVIWYDENNKYYVDSVKGRF TISRDNSKNTLYLQMNSLRAEDTAVYYCARELGFR SDYWGQGTLVTVSS<br>SEQ ID NO: 28466 |
| iPS:392868 | 21-225_24D6 | NA | GACATCCAGATGACCCAGTCTCCATCCTCCT GTCTGCATCTGTAGGAGACAGAGTCACCATCA CTTGCCAGGCGAGTCAGGACATTAACAACTAT TTAAATTGGTATCAGCAGAAACCAGGGAAAG CCCTTAAGCTCTTGATATACGATGCATCCAGATT TGGAAACAGGGGTCCCATCAAGGTTCAGTGGA AGTGGATCTGGGACAGATTTTACTTTCACCAT CAGCAGTCTGCAGCCTGAAGATATTGCAATAT ATTACTGTCAACAGTATGAAAATCTCCGATC ACCTTCGGCCAAGGGACACGACTGGAGATTAA A<br>SEQ ID NO: 24461 | CAGGTGCAACTGGTAGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGTTCCAGGCAAGGGGCT GGAGTGGGTGGCAATTATATCATATGCTGGAAGT AATAAATCCTATGCAGACTCCGTGAAGGGCCGAT TCACCATCTCCAGAGACAATTCCAAGAACACGCT GTATCTGCAAATGAACAGCCTGAGAGCTGAGGA CACGGCTGTGTATTACTGTGTGAGACGGGGATAC AGCTATGGCGGGTACGGTATGGACGTCTGGGGC CAAGGGGCCACGGTCACCGTCTCCTCA<br>SEQ ID NO: 28467 |

FIGURE 50
(Continued)

| | | | | |
|---|---|---|---|---|
| iPS:392870 | 21-225_20G9 | AA | DIQMTQSPSSLSASVGDRVTITCQASQDINNYLN WYQQKPGKALKLLIYDASDLETGVPSRFSGSGS GTDFTFTISSLQPEDIAIYYCQQYENLPITFGQGT RLEIK<br>SEQ ID NO: 24462 | QVQLVESGGGVVQPGRSLRLSCAASGFTFSSYGMH WVRQVPGKGLEWVAIISYAGSNKSYADSVKGRFTI SRDNSKNTLYLQMNSLRAEDTAVYYCVRRGYSYG GYGMDVWGQGATVTVSS<br>SEQ ID NO: 28468 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAGATTCACTCTCACAA TCAGCAGCCTGCAGCCTGAAGATTTTGCAACT TATTACTGTCTACAGCATAGTACTTACCCTCTC ACTTTCGGCGGAGGGACCAAGGTGGAGATCA AA<br>SEQ ID NO: 24463 | CAGGTGCAGCTGGTGCAGGAGTCGGGCCAGGACTG GTGAAGCCTTCGGAGACCCTGTCCCTCACCTGCA CTGTCTCTGGTGGCTCCATCAGCAGGAGTAGTTA CTACTGGGGCTGGATCCGCCAGCCCCCAGGGAA GGGACTGGAGTGGATTGGGAGTATCTATTATAGT GGGAGCGCCTCTTACAACCGTCCCTCAAGAGTC GAGTTCACCATATCCGTAGACACGTCCAAGAACC AGTTCTCCCTGAAGCTGAGCTGTGACCGCCGC AGACACGGCTGCTATTACTGTGCGAGACTGAGC AGCAGCTGGTCTTTTGACTACTGGGGCCAGGGAA CCCTGGTCACCGTCTCCTCA<br>SEQ ID NO: 28469 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHSTYPLTFGGGT KVEIK<br>SEQ ID NO: 24464 | QLQLQESGPGLVKPSETLSLTCTVSGGSISRSSYYW GWIRQPPGKGLEWIGSIYSGSASYNPSLKSRVTIS VDTSRNQFSLKLSSVTAADTAAYYCARLSSSWSFD YWGQGTLVTVSS<br>SEQ ID NO: 28470 |

FIGURE 50
(Continued)

| | | | |
|---|---|---|---|
| iPS:392872 | 21-225_20B11 | NA | GACATCCAGATGACCCAGTCTCCATCCTCCCT GTCTGCATCTGTAGGAGACAGAGTCACCATCA CTTGCCGGGCAAGTCAGGGCATTGGAAATGAT TTAGGCTGGTATCAGCAGAAACCAGAGAAAG CCCCTAAGCGCCTGATCTATGCTGCATCCAGT TTGCATAGTGGGGGTCCCATCCAGGTTCAGCG CAGTGGCTCTGGGACAGAATTCACTCTCACAA TCAGCAGCCTGCAGCCTGAAGATTTTGCAACT TATTACTGTCTACAGCATTATAGTTACCCTCGG ACGTTTGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGGCAAGGGGCT GGAGTGGGTGGCAGTTATATGGTATGATGGAAGT AATAAATACTATGCAGACTCCGTGAAGGTCCGAT TCACCGTCTCCAGAGACAATTCCAAGAACACGCT GTCTCTGCAAATGAACAGCCTGAGAGCCGAGGA CACGGCTGTGTATTACTGTGCGAGAGAGATAT ACCAGTGGCTGGTATGACTACGGTATGGACGTCT GGGGCCAAGGGACCACGGTCACCGTCTCCTCA |
| | | | SEQ ID NO: 24465 | SEQ ID NO: 28471 |
| | | AA | DIQMTQSPSSLSASVGDRVTITCRASQGIGNDLG WYQQKPEKAPKRLIYAASSLHSGVPSRFSGSGSG TEFTLTISSLQPEDFATYYCLQHYSYPRTFGQGT KVEIK | QVQLVESGGGVVQPGRSLRLSCAASGFTFSSYVMH WVRQAPGKGLEWVAVIWYDGSNKYYADSVKVRF TVSRDNSKNTLSLQMNSLRAEDTAVYYCARERYTS GWYDYGMDVWGQGTTVTSS |
| | | | SEQ ID NO: 24466 | SEQ ID NO: 28472 |
| iPS:392874 | 21-225_21D2 | NA | GACATCCAGATGACCCAGTCTCCATCCTCCCT GTTTGCATCTGTAGGAGACAGAGTCACCATCA CTTGCCGGGCAAGTCAGAGCATTAGCGACTAT TTAAATTGGTATCAGCAGAAACCAGGGAGAG CCCCTAAACCTCCTGATCTATGATACATCCAGTT TGCAAAGTGGGGTCCCATCAAGGTTCAGTGGC AGTGGATCTGGGACAGATTTCACTCTCACCAT CAACAGTCTGCAACTGAAGATTTTGCAACTT ACTACTGTCTCAACAGAGTTACAATATTCTTCCG GAGCGCAGTTTTGGCCGGGGGACCAAGCTGG AGATCAAA | GAGGTGAAGCTGTGTTGGAGTCTGGGGGAGGCTTG GTACAGCCGGGGGGGTCCCTGAGACTCTCCTGTG CAGCCTCTGGATTCACCTTTAACAACTATGCCAT GAGCTGGGTCCGCCAGGCTCCAGGGAAGGGGCT GGAGTGGGTCTCAGTTCTTAGTGGTAGTGGTGGT AGCACATTCTACGCAGACTCCGTGAAGGGCCGGT TCACCATCTCCAGAGACAATTCCAAGAACACGCT GTATCTGCAAATGAGCAGCCTGAGAGCCGGGGA CACGGCCGTATATTTCTGTGCCGATATTGTAGT AGTGCCAGGTGCCCTTATGATGCTTTGATATCT GGGGCCAAGGGACAATGGTCACCGTCTCCTCA |
| | | | SEQ ID NO: 24467 | SEQ ID NO: 28473 |

FIGURE 50
(Continued)

| | | | | |
|---|---|---|---|---|
| iPS:392876 | 21-225_21F7 | AA | DIQMTQSPSSLFASVGDRVTITCRASQSISDYLN WYQQKPGRAPKLLIYDTSSLQSGVPSRFSGSGSG TDFTLTINSLQPEDFATYYCQQTYNILPERSFGRG TKLEIK<br><br>SEQ ID NO: 24468 | EVKLLESGGGLVQPGGSLRLSCAASGFTFNNYAMS WVRQAPGKGLEWVSVLSGSGSTFYADSVKGRFTI SRDNSKNTLYLQMSSLRAGDTAVYFCARYCSSARC PYDAFDIWGQGTMVTVSS<br><br>SEQ ID NO: 28474 |
| | | NA | GACATCAGATGACCCAGTCTCCATCTCCCT GTCTGCATCTGTAGGAGACAGAGTCACCATCA CTTGCCGGGCAAGTCAGATTAGAAATGAT TTAGGCTGTGTATCAGCAGAAACCAGGGAAAG CCCCTAAGCGCCTGATCTATGCTGCATCCAAT TTTCAAAGTGGGGTCCCATCAAGGTTCAGCGG CAGTGGATCTGGGACAGATTCACTCTCACAA TCAGCAGCCTGCAGCCTGACATAATAATTACCCGTG TATTACTGTCTACAGCATCATAATTAATTACCCGTG GACGTTCGGCCAAGGGACCAAGGTGGAAATC AAA<br><br>SEQ ID NO: 24469 | CAGGTGCAGCTGGTGGAGTCTGGGGGAGGCGTG GTCCAGCCTGGGAGGTCCCTGAGACTCTCCTGT CAGCGTCTGGATTCACCTTCAGTGACTATGGCAT GCACTGGGTCCGCCAGGCTCCAGGCAAGGGGCT GGAGTGGGTGGCAGTTATATGAGACTCCGTGAAGGGCCGAT AATAAATACTATGTAGACTCCGTGAAGGGCCGAT TCACCATCTCCAGAGACAATTCCAAGAACACGCT GTATCTGCAAATGAACAGCCTGAGAGCTGAGGA CACGGCTGTGTATTACTGTGCGAGAGATCTGGC TGGACGGAAGAGTACTGGGGCCAGGGAACCCTG GTCACCGTCTCCTCA<br><br>SEQ ID NO: 28475 |
| | | AA | DIQMTQSPSSLSASVGDRVTITCRASQDIRNDLG WYQQKPGKAPKRLIYAASNFQSGVPSRFSGSGS GTEFTLTISSLQPEDFATYYCLQHNNYPWTFGQG TKVEIK<br><br>SEQ ID NO: 24470 | QVQLVESGGGVVQPGRSLRLSCAASGFTFSDYGM HWVRQAPGKGLEWVAVIWFDGNNKYYVDSVKGR FTISRDNSKNTLYLQMNSLRAEDTAVYYCARDLG WTEEYWGQGTLVTVSS<br><br>SEQ ID NO: 28476 |

FIGURE 50
(Continued)

| | | | | |
|---|---|---|---|---|
| iPS:392878 | 21-225_22C5 | NA | GACATCCAGATGACCCAGTCTCCAGCTCCCT GTCTGCGTCTGTTGGAGACAGAGTCACCATCA CTTGCCGGGCAAGTCAGAACATTAGCAGTTAT TTAAATTGGTATCAGCAGAAACCAGGGAAGG CCCCTAAACTCCTGATCTATGCTGCATCCGTTT TGCAACATGGGATCCCATCAAGGTTCAGTGGC AGGGGATCTGGGACAGATTTCACTCTCATCAT CAGTAGTCTGCAACCTGAAGATTTTGCAACTT ACTACTGTCAACAGAGTTACAGAACCCCTTA TTCACTTTCGGCCCTGGGACCAAAGTAGATTT CAAA | GAGGTGCAGCTGTTGGAGTCTGGGGGAGGCTTG GTACAGGTTGGGGGGTCCCTGAGACTCTCCTGTG CAGCCTCTGGATTCACTTTTAGCAGCTATGCCAT GAGCTGGGTCCGCCAGGCTCCAGGGATGGGGCT GGAGTGGGTCTCAATTATTAGTGGTAGTGGTGGT TACAACATACTACGCGACTCCGTGAAGGGCCGAT TCACCATCTGCAAATGAACAGCCTGAGAACACGCT GTATCTGCAAATGAACAGCCTGAGAGCCGAGA CACGGCCGTATATATTGTGCGTCCGTATAGCA GTGGCTGGCTCCGGAGGCTTTTGATATCTGGGGCC AAGGGACAATGGTCACCGTCTCTTCA |
| | | | SEQ ID NO: 24471 | SEQ ID NO: 28477 |
| | | AA | DIQMTQSPASLSASVGDRVTITCRASQNISSYLN WYQQKPGKAPKLLIYAASVLQHGIPSRFSGRGS GTDFTLIISSLQPEDFATYYCQQSYRTPLFTFGPG TKVDFK | EVQLLESGGGLVQVGGSLRLSCAASGFTFSSYAMS WVRQAPGMGLEWVSIISGSGGYTYYADSVKGRFTI SRDNSKNTLYLQMNSLRAEDTAVYYCASRIAVAGS EAFDIWGQGTMVTVSS |
| | | | SEQ ID NO: 24472 | SEQ ID NO: 28478 |
| iPS:392880 | 21-225_22F9 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTACAAAGTGGGGTCCCATCAAGGTTCAGTGG CAGTGGATCTGGGACAGAATTCACTCTCACAA TCAGCAGCCTGCAGCTGAAGATTTTGCAACT TATTACTGTCTACAGCATAATAGTTACCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGTAGACTCCGTG TAATAAAGACTATGTACGCCGTGAAGGGCCG ATTCACCATCTCCAGAGACAATTCCAAGAGCACG CTGTATCTGCAAATGAATAGTCTGAGAGCCGAGG ACACGGCTGTGTATTACTGTGTGAGAGAGTTAGG CTTCCAGTCTGACTACTGGGGCCAGGGAACCCCG GTCACCGTCTCCTCA |
| | | | SEQ ID NO: 24473 | SEQ ID NO: 28479 |

FIGURE 50
(Continued)

| | | | | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK | QVQMVESGGGVVQPGRSLRLSCAASGFTFSSYGM HWVRQAPGKGLEWVAVIWYEENNKDYVDSVKGR FTISRDNSKSTLYLQMNSLRAEDTAVYYCVRELGF QSDYWGQGTPVTVSS |
|---|---|---|---|---|---|
| | | | AA | SEQ ID NO: 24474 | SEQ ID NO: 28480 |
| | | 21-225_23A3 | NA | GACATCCAGATGACCCAGTCTCCATCCTCCCT GTCTGCATCTGTAGGAGACAGAGTCACCATCA CTTGCCGGGCAAGTCAGGCATTAGAAATGAT TTAGGCTGGTATCAGCAGAAACCAGGGAAAG CCCCTAAGCGCCTGATCTATGCTGCATCCAGT GTGCAAAGTGGGGTCCCATCAAGGTTCAGCGG CAGTGGATCTGGGACAGAATTCACTCTCACAA TCAGCAGCCTGCAGCCTGAAGATTTTGCAATT TATTTCTGTCTACAGCATAATAGTTACCCGCTC ACTTTCGGCGGAGGGACCAAGGTGGAGATCA AA | CAGCTGCAGCTGCAGGAGTCGGCCCAGGACTG GTGAAGCCTTCGGAGACCCTGTCCTCACCTGCA CTGTCTCTGGTGGCTCCATCAGTAGGAGTAGTTA CTACTGGGGCTGGATCCGCCAGCCCCCAGGGCA GGGGCTGGAGTGGATTGGGAATATTTATTATAGT GGGAGCACTACAACAACCGTCCCTCAAGAGT CGAGTCTCCATATCCGTTGACACGTCAAGAACC AGTTCTCCCTGAACCTGTGATTACTGTGGAGACATGA AGACACGGCTGTGTATTACTGTGGAGACATGA AAAGACTGGGCCTTGACTTCTGGGGCCAGGGA ACCCTGGTCACCGTCTCCTCA |
| iPS:392882 | | | | SEQ ID NO: 24475 | SEQ ID NO: 28481 |
| | | | AA | DIQMTQSPSSLSASVGDRVTITCRASQGIRNDLG WYQQKPGKAPKRLIYAASSVQSGVPSRFSGSGS GTEFTLTISSLQPEDFAIYFCLQHNSYPLTFGGGT KVEIK | QLQLQESGPGLVKPSETLSLTCTVSGGSISRSSYYW GWIRQPPGQGLEWIGNIYYSGSTYNNPSLKSRVSIS VDTSKNQFSLNLSSVTAADTAVYYCGRHGKDWGL DFWGQGTLVTVSS |
| | | | | SEQ ID NO: 24476 | SEQ ID NO: 28482 |

FIGURE 50
(Continued)

| | | | |
|---|---|---|---|
| iPS:392884 | 21-225_23A10 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAGAATTCACTCTCACAA TCGGGCAGCCTGCAGCCTGAAGATTTTGCAACT TATTACTGTCTGCAACATTATAGTTACCCTCGG ACGTTCGGCCTAGGGACCAAGGTGGAAATCA AA |
| | | | SEQ ID NO: 24477 |
| | | AA | DIQMTQSPSSLSASVGDRVTITCRASQGIRNDLG WYQQKPGKAPKRLIYAASSLQSGVPSRFSGSGS GTEFTLTIGSLQPEDFATYYCLQHYSYPRTFGLG TKVEIK |
| | | | SEQ ID NO: 24478 |
| | | NA | CAGGTGCAGTTGGTGGAGTCTGGGGGAGGCGTG GTCCAGCCTGGGAGGTCCCTGAGACTCTCGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGAGACTCCGTGAAGGGCCGA TTCACCATCTCCAGAGACAATTCAAGAACACGC TGTATCTGCAAATGAACAGCCTGAGAGCCGAGG ACACGGCTGTGTATTACTGTGCGAGAGAAGGTA TAGCAGTGGCTGGCACGACTACGGTATGGACGTC TGGGGCCAAGGGACCACGGTCACCGTCTCCTCA |
| | | | SEQ ID NO: 24479 |
| | | | SEQ ID NO: 28483 |
| | | AA | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARERYSS GWHDYGMDVWGQGTTVTVSS |
| | | | SEQ ID NO: 28484 |
| iPS:392886 | 21-225_23A12 | NA | CAGGTGCAGCTGGTGCAGTCTGGGGCTGAGGTG AAGAAGCCTGGGGCCTCAGTGAAGGTCTCCTGC AAGGCTTCTGGATACCCCTTCACCAATTATGATA TCAACTGGGTGCGACAGGCCACTGGACAAGGGC TTGAGTGGATGGATGGATGCACCCTAACAGTGG TAACACAGGCTATGCACAGAAGTTCCAGGGCAG AGTCACCATGACCAGGAACACCTCCATAAACAC AGCCTACATGGAACTGAGCAGCCTGAGATCTGA GGACACGGCCGTGTATTACTGTGCGGGTAGCAGT GGCTGGTACTACTTGACTACTGGGGCCAGGGAA CCCTGGTCACCGTCTCCTCA |
| | | | SEQ ID NO: 28485 |

FIGURE 50
(Continued)

| | | AA | DIVMTQSPDSLAVSLGERATINCKSSQSVLYSSN NNNYLAWYQQKPGQPPKLLIYWTSTRESGVPDR FSGSGSGTDFTLTISSLQAEDVAVYYCQQYYDTP PTFGQGTKVEIK<br>SEQ ID NO: 24480 | QVQLVQSGAEVKKPGASVKVSCKASGYPFTNYDIN WVRQATGQGLEWMGWMHPNSGNTGYAQKFQGR VTMTRNTSINTAYMELSSLRSEDTAVYYCAGSSGW YYFDYWGQGTLVTVSS<br>SEQ ID NO: 28486 |
|---|---|---|---|---|
| iPS:392888 | 21-225_25A2 | NA | GATATTGTGATGACCCAGACTCCACTCTCTCT GTCCGTCACCCCTGGACAGCCGGCCTCCATCT CCTGCAAGTCTAGTCAGAGCCTCCTACATAGT GAAGGAAAGACCTATTTGTATTGGTATCTGCA GAAGCCAGGCCAGCCTCCACAACTCCTGATCT ATGAAATTTCCAACGGTTCTCTGGAGTGCCA GCTAGGTTAAGTGGCAGCGGGTCAGGACAG ATTTCACACTGAAAATCAGCGGGTGGAGGCT GAGGATGTTGGGGTTTATTACTGCATGCAAAG TACACAGTTTCCGCTCACTTTCCGCGAGGGA CCAAGGTGGAGATCAAA<br>SEQ ID NO: 24481 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTATGGCAT GCACTGGGTCCGCCAGGCTCCAGGCAAGGGCT GGAGTGGGTGGCAGTTATATGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAAGGTATAG CAGCAGCTGGTCAGGGGGTATGGACGTCTGGGG CCAAGGGACCACGGTCACCGTCTCCTCA<br>SEQ ID NO: 28487 |
| | | AA | DIVMNQTPLSLSVTPGQPASISCKSSQSLLHSEGK TYLYWYLQKPGQPPQLLIYEISNRFSGVPARLSG SGSGTDFTLKISRVEAEDVGVYYCMQSTQFPLTF GGGTKVEIK<br>SEQ ID NO: 24482 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSSS WSGGMDVWGQGTTVTVSS<br>SEQ ID NO: 28488 |

FIGURE 50
(Continued)

| | | | | |
|---|---|---|---|---|
| iPS:392890 | 21-225_20H9 | NA | GACATCCAGATGACCCAGTCTCCATCCTCACT GTCTGCATCTGTAGGAGACAGAGTCACCATCA CTTGTCGGGCGAGTCAGGGATTAGCAATATAT TTAGCCTGGTTTCAGCAGAAACCAGGGAAAGC CCCTAAGTCCCTGATCTCTGCTGCATCCAGTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATAATAGTTACCCATTCA CTTTCGGCCCTGGGACCAAAGTGGATATCAAA<br><br>SEQ ID NO: 24483 | GAGGTGCAGCTGTTGGAGTCTGGGGGAGGCTTG GTACAGCCTGGGGGGTCCCTGAGACTCTCCTGTG CAGCCTCCGGATTCACCTTTAGCAGCTATGCCAT GAGCTGGGTCCGCCAGGCTCCAGGGAAGGGGCT GGAGTGGGTCTCAGCTATTAGTGGTAGTGGTGGT TACACATACTACGCAGACTCCGTGAAGGGCCGGT TCACCATCTCCAGAGACAATTCCGAGAACACGCT GTATCTGCAAATGAGCAGCCTGAGAGCCGAGGA CACGGCCGTTTATTACTGTGCGAAAGGGGGTCC CTCTTCTACTGGGGCCAGGGAACCCTGGTCACCG TCTCCTCA<br><br>SEQ ID NO: 28489 |
| | | AA | DIQMTQSPSSLSASVGDRVTITCRASQGISNYLA WFQQKPGKAPKSLISAASSLQSGVPSKFSGSGSG TDFTLTISSLQPEDFATYYCQQYNSYPFTFGPGT KVDIK<br><br>SEQ ID NO: 24484 | EVQLLESGGGLVQPGGSLRLSCAASGFTFSSYAMS WVRQAPGKGLEWVSAISGSGGYTYYADSVKGRFT ISRDNSENTLYLQMSSLRAEDTAVYYCAKGGSLFY WGQGTLVTVSS<br><br>SEQ ID NO: 28490 |
| iPS:392892 | 21-225_20C11 | NA | GACATCCAGATGACCCAGTCTCCATCCTCACT GTCTGCATCTGTTGGAGACAGAGTCACCATCA CTTGTCGGGCGAGTCAGGACAGATTAGCAATTAT TTAGCCTGGTTTCAGCAGAAACCAGGGAAAGC CCCTAAGTCCCTGATCTATGCTGCATCCAGTTT GCAAAGTGGGGTCCCATCAAAGTTCAGCGGC AGTGGATCTGGGACAGATTTCACTCTCACCAT CAGCAGCCTGCAGCCTGAAGATTTTGCAACTT ATTACTGCCAACAGTATCATAGTTTCCCATTCA CTTTCGGCCCTGGGACCAAAGTGGATGTCAAA<br><br>SEQ ID NO: 24485 | GAGGTGCAGCTGTTGGAGTCGGGGGGAGGCTTG GTACAGCCTGGGGGGTCCCTGAGACTCTCCTGTG CAGCCTCTGGATTCTCCTTTAGTAGCTATGCCAT GAGCTGGGTCCGCCAGGCTCCAGGGAAGGGGCT GGAGTGGGTCTCAACTATTAGTGGTCGTGGTGGT CACACATACTACGCAGACTCCGTGAAGGGCCGG TTCGCCATCTCCAGAGACAGTTCCAAGAACACGC TGTATCTGCAAATGAACAGCCTGAGAGCCGAGG ACACGGCCGTATATTACTGTGCGAAACAGGACTG CTGGGGCCAGGGAACCCTGGTCACCGTCTCCTCA<br><br>SEQ ID NO: 28491 |

FIGURE 50
(Continued)

| | | | |
|---|---|---|---|
| iPS:392894 | 21-225_21G2 | AA | DIQMTQSPSSLSASVGDRVTITCRASQDISNYLA WFQQKPGKAPKSLIYAASSLQSGVPSKFRGSGSG TDFTLTISSLQPEDFATYYCQQYHSFPFTFGPGTK VDVK<br>SEQ ID NO: 24486 | EVQLLESGGGLVQPGGSLRLSCAASGFSFSSYAMS WVRQAPGKGLEWVSTISGRGGHTYYADSVKGRFA ISRDSSKNTLYLQMNSLRAEDTAVYYCAKQDCWG QGTLVTVSS<br>SEQ ID NO: 28492 |
| | | NA | GACATCCAGATGACCCAGTCTCCATCTCCCT GTCTGCGTCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCTATACTTCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAACATAATAGTTACCCGTGG ACGTTCGGCCTAGGGACCAAGGTGGTCATCAA A<br>SEQ ID NO: 24487 | CAGGTGCAACTGGTGGAGTCTGGGGGAGGCGTG GTCCAGCCTGGGAGGTCCCTGAGACTCTCCTGTG CAGCCGTCTGGATTCACCTTCAGTGACTATGCCAT GCACTGGGTCCGCCAGGCTCCAGGCAAGGGGCT GGAGTGGATGGCAGTTATATGGTATGATGTAACT AATAAATACTATGCAGACTCCGTGAAGGGCCGA TTCACCATCTCCAGAGACACAATTCCAAGAACACGC TGTATCTGGAAATGAACAGCCTGAGAGAGCCTTGG ACACGGCTGTTTATTACTGTGCGAGAGAGCTTGG CTGGTACGAGGACTACTGGGGCCAGGGAACCCT GGTCACCGTCTCCTCA<br>SEQ ID NO: 28493 |
| | | AA | DIQMTQSPSSLSASVGDRVTITCRASQGIRNDLG WYQQKPGKAPKRLIYTSSSLQSGVPSRFSGSGSG TEFTLTISSLQPEDFATYYCLQHNSYPWTFGLGT KVVIK<br>SEQ ID NO: 24488 | QVQLVESGGGVVQPGRSLRLSCAASGFTFSDYGM HWVRQAPGKGLEWMAVIWYDVTNKYYADSVKG RFTISRDNSKNTLYLEMNSLRAEDTAVYYCARELG WYEDYWGQGTLVTVSS<br>SEQ ID NO: 28494 |

FIGURE 50
(Continued)

| | | | | |
|---|---|---|---|---|
| iPS:392896 | 21-225_21G7 | NA | GACATCCAGATGACCCAGTCTCCATCTCCCT GTCTGCATCTGTAGGAGACAGAGTCACCATCA CTTGCCGGGCAAGTCAGGGCGGTTAGAAATGAT TTAGGCTGGTATCAGCAGAAACAGGGAAAC CCCCTCAGCGCCTGATCTATGCTGCATCCAGTT TGCAAAGTGGGGTCCCATCAAGGTTCAACGGC AGTGGATCTGGGACAGAATTCACTCTCACAA CAGCAGCCTGCAGCCTGAAGATTTTGCAACTT ATTACTGTCTACAGCATAGTAGTTACCCGCTC ACTTTCGGCGGAGGGACCAAGGTGGAGATCA AA | CAGCTGCAGCTGCAGGAGTCGGGCCCAGGACTG GTGAAGTTTTCGGAGACCCTGTCCTCACCTGCA CTGTCTCTGGTGGCTCCATCAGCAGAAGTAGTTA CTACTGGGGCTGGATCCGCCAGCCCCCAGGGAA GGGGCAGGAGTGGATAGGGAATATCTATTATAG TGGGTATAGTTACTACAACCGTCCCTCAAGAGT CGAGTCACCATATCCGTAGACACGTCCAAGAACC AGTTCTCCCTGAAGCTGAGCTCTGTGACCGCCGC AGACACGGCTGTATTACTGTGCGAGACATAGC ACCAGTGGTCCCTTGACTACTGGGGCCAGGGAA CCCTGGTCACCGTCTCCTCA |
| | | | SEQ ID NO: 24489 | SEQ ID NO: 28495 |
| | | AA | DIQMTQSPSSLSASVGDRVTITCRASQGVRNDLG WYQQKPGKAPQRLIYAASSLQSGVPSRFNGSGS GTEFTLTISSLQPEDFATYYCLQHSSYPLTFGGGT KVEIK | QLQLQESGPGLVKFSETLSLTCTVSGGSISRSSYYW GWIRQPPGKGQEWIGNIYYSGYSYNPSLKSRVTIS VDTSKNQFSLKLSSVTAADTAVYYCARHSTSWSLD YWGQGTLVTVSS |
| | | | SEQ ID NO: 24490 | SEQ ID NO: 28496 |
| iPS:392898 | 21-225_21H10 | NA | GAAATTGTGTTGACGCAGTCTCCAGGCACCCT GTCTTTGTCTCCAGGGGAAAGAGCCACCCTCT CCTGCAGGGCCAGTCAGAGTTTTAGCAGCAGC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAGCTCACGC AGTTTTGGCCAGGGGACCAAGCTGGAGATCAA A | GAGGTGCAGCTGGTGGAGTCTGGGGGAGGCTTG GTAAAGCCTGGGGGGTCCCTTAGACTCTCCTGTG CAGCCTCTGGATTCACTTTCAGTAACGCCTGGAT GAACTGGGTCCGCCAGGCTCCAGGGAAGGGGCT GGAGTGGGTTGGCCGTATTAAAAGCAAAACTGA TGGTGGGACAACAGACTACGCTGCACCGTGAA AGGCAGATTCACCATCTCAAGAGATGATTCAAA AAACACGCTGTATCTGCAAATGAACAGCCTGAA AACCGAGGACACAGCCGTGTATTACTGTACCACA GAAGGCTGGAACACGGACTACTGGGGCCAGGGA ACCCTGGTCACCGTCTCCTCA |
| | | | SEQ ID NO: 24491 | SEQ ID NO: 28497 |

FIGURE 50
(Continued)

| | | | | |
|---|---|---|---|---|
| iPS:392900 | 21-225_22F2 | AA | EIVLTQSPGTLSLSPGERATLSCRASQSFSSSYLA WYQQKPGQAPRLLIYGASSRATGIPDRFSGSGSG TDFTLTISRLEPEDFAVYYCQQYGSSRSFGQGTK LEIK<br>SEQ ID NO: 24492 | EVQLVESGGGLVKPGGSLRLSCAASGFTFSNAWM NWVRQAPGKGLEWVGRIKSKTDGGTTDYAAPVK GRFTISRDDSKNTLYLQMNSLKTEDTAVYYCTTEG WNTDYWGQGTLVTVSS<br>SEQ ID NO: 28498 |
| | | NA | GACATCCAGATGACCCAGTCTCCATCTCCT GTCTGCATCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCTATGCTGCATCCAGT TTACAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA<br>SEQ ID NO: 24493 | CAGGTGCAGTTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTATGAGGGAAG TAATAAATACTATGTAGACTCCGTGAGGGCCGA TTCACCATCTCCAGAGACAATTCCAAGAGCACGC TGTATCTGCAAATGAACAGCCTGAGAGCCGAGG ACACGGCTGTTTATTACTGTGTGAGAGAGCTAGG CTTCCAGTCTGACTACTGGGGCCAGGGAACCCG GTCACCGTCTCCTCA<br>SEQ ID NO: 28499 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br>SEQ ID NO: 24494 | QVQLVESGGGVVQPGRSLRLSCAASGFTFSDYGM HWVRQAPGKGLEWVAVIWYEGSNKYYVDSVRGR FTISRDNSKSTLYLQMNSLRAEDTAVYYCVRELGF QSDYWGQGTPVTVSS<br>SEQ ID NO: 28500 |

FIGURE 50
(Continued)

| | | | | |
|---|---|---|---|---|
| iPS:392902 | 21-225_22D5 | NA | GACATCCAGATGACCCAGTCTCCATCTCCCT GTCTGCATCTGTAGGAGACAGAGTCACCATCA CTTGCCGGGCAAGTCAGAACAGAACATTTTAGTTAT TTAAATTGGTATCATCAGAAACCAGGAAAGC CCCTAAGCTCCTGATCTATGCTGCATCCAGTTT GCAAAGTGGGTCCCATCAAGGTTCAGTGGCA GTGGATCTGGGACAGATTTCACTCTCACCATC AGCAGTCTACAACCTGAAGATTTTGCAACTTA CTACTGTCAACAGAGTTACAGTACCCCCTTAT TCACTTTCGGCCCTGGGACCAAAGTGGATATC AAA<br>SEQ ID NO: 24495 | GAGGTGCAGCTGTTGGAGTCTGGGGGAGGCTTG GTACAGCCTGGGGGGTCCCTGAGACTCTCCTGTG CAGCCTCTGAATTCACCTTTAGCAGCTATGCCAT GAGCTGGGTCCGCCAGGCTCCAGGGAAGGGCT GGAGTGGGTCTCAGTTATTAGTGGTCGTGGTGGT AACACATTCTACGCAGACTCCGTGAAGGGCCGGT TCACCATCTCCAGAGACAATTCCAAGAACACGCT GTATCTGCAAATGAACAGCTGAGAGCCGAGGA CACGGCCGTATATTACTGTGCGTCCGTATAGCA GTGGCTGGCTCGGAGGCTTTTGATATCTGGGGCC AAGGGACAATGGTCACCGTCTCTTCA<br>SEQ ID NO: 28501 |
| | | AA | DIQMTQSPSSLSASVGDRVTITCRASQNIFSYLN WYHQKPGKAPKLLIYAASSLQSGVPSRFSGSGS GTDFTLTISSLQPEDFATYYCQQSYSTPLFTFGPG TKVDIK<br>SEQ ID NO: 24496 | EVQLLESGGGLVQPGGSLRLSCAASEFTFSSYAMS WVRQAPGKGLEWVSVISGRGGNTFYADSVKGRFTI SRDNSKNTLYLQMNSLRAEDTAVYYCASRIAVAGS EAFDIWGQGTMVTVSS<br>SEQ ID NO: 28502 |
| iPS:392904 | 21-225_22G9 | NA | GACATCCAGATGACCCAGTCTCCATCTCCCT GTCTGCATCTGTAGGAGACAGAGTCACCATCA CTTGCCGGGCAAGTCAGGGCATTAGCAAATGAT TTAGGCTGGTATCAGCAGAAACCAGGAAAAG CCCCTAAGCGCCTGATCTATGCTGCTTCCAGTT TGCAAAGTGGGGTCCCATCAAGGTTCAGCGGC AGTGGATCTGGGACAGAGTTCACTCTCACAAT CAGCAGCCTGCAGCCTGAAGATTTTGCAACTT ATTACTGTCTACAGCATGCCAGTTACCCGCTC ACTTTCGGCGGAGGGACCAAGGTGGAGATCA AA<br>SEQ ID NO: 24497 | CAGCTGCAGCTGCAGGAGTCGGGCCCAGGACTG GTGAAGCCTTCGGAGACCCTGTCCCTCACCTGCA CTGTCTCCGGTGGCTGGAGATCCGCCAGCCCCAGGGAA CTACTGGGGCTGGATCCGCCAGCCCCCAGGGAA GGGAGCACCTACTACAACCCGTCCCTCAAGAGT GAGTCACCATATCCGTAGACACGTCAAGAACC AGTTCTCCCTGAAGCTGAGTCTGTGACCGCCGA AGCACCGGCTGTCCTTGACTACTGGGGCCAGGGAA CCCTGGTCACCGTCTCCTCA<br>SEQ ID NO: 28503 |

FIGURE 50
(Continued)

| | | | |
|---|---|---|---|
| iPS:392908 | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHASYPLTFGGG TKVEIK<br>SEQ ID NO: 24498 | QLQLQESGPGLVKPSETLSLTCTVSGGAISGSNYYW GWIRQPPGKELEWIGNIYYSGSTYYNPSLKSRVTIS VDTSKNQFSLKLRSVTAEDTAVYYCARHSSSWSLD YWGQGTLVTVSS<br>SEQ ID NO: 28504 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGTTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAAGTT ATTACTGTCTACAGCATATAGTTACCCGTGG ACGTTCGGCCAAGGGACCAAGGTGGAAATCA AA<br>SEQ ID NO: 24499 | CAGGTGCAGCTGGTGGAGTCTGGGGGAGGCGTG GTCCAGCCTGGGAGGTCCCTGAGACTCTCCTGTG TAGCGTCTGGATTCACCTTCAGTAGCTATGGCAT GCACTGGGTCCGCCAGGCTCCAGGCAAGGGGCT GGAGTGGGTGGCAGTTATATGGTATGATGAAACT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTATTTATTACTGTGCGAGAGAGCTTGC CTGGTACGAGGACTACTGGGGCCAGGGATCCCT GGTCACCGTCTCCTCA<br>SEQ ID NO: 28505 |
| | 21-225_23F12 | AA | DIQMTQSPSSLSASVGDRVTITCRASQGIRNDLG WYQQKPGKAPKRLIYVASSLQSGVPSRFSGSGS GTEFTLTISSLQPEDFASYYCLQHNSYPWTFGQG TKVEIK<br>SEQ ID NO: 24500 | QVQLVESGGGVVQPGRSLRLSCVASGFTFSSYGMH WVRQAPGKGLEWVAVIWYDETNKYYADSVKGRF TISRDNSKNTLYLQMNSLRAEDTAIYYCARELAWY EDYWGQGSLVTVSS<br>SEQ ID NO: 28506 |

FIGURE 50
(Continued)

| | | | | |
|---|---|---|---|---|
| iPS:392912 | 21-225_25A9 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGTGG CAGTGGATCTGGGACAGAGAATTCACTCTCACAA TCAGCAGCCTGCAGCCTGAAGATTTTGCAACT TATTACTGTCTACAGCATATAGTAGTTACCCATTC ACTTTCGGCCCTGGGACCAAAGTGGATATCAA A SEQ ID NO: 24501 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGTAACT AATAAATACTATACAGGCTCCGTGAAGGGCCGA TTCACCATCTCCAGAGACAATTCCAAGAACACGC TGTATCTGCAAATGAACAGCCTGAGAGCCGAGG ACACGGCTGTATATTACTGTGCGAGAGAAATTGG CTGGTTAGATGACTACTGGGGCCAGGGAACCCTG GTCACCGTCTCCTCA SEQ ID NO: 28507 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPFTFGPGT KVDIK SEQ ID NO: 24502 | QVQLVESGGGVVQPGRSLRLSCAASGFTFSSYGMH WVRQAPGKGLEWVAVIWYDVTNKYYTGSVKGRF TISRDNSKNTLYLQMNSLRAEDTAVYYCAREIGWL DDYWGQGTLVTVSS SEQ ID NO: 28508 |
| iPS:392914 | 21-225_25D12 | NA | GACATCCAGATGACCCAGTCTCCATCCTCCCT GTCTGCATCTGTAGGAGACAGAGTCACCATCA CTTGCCGGACAAGTCAGGGCATTAGAAATGAT TTAGGCTGGTATCAGCAGAAACCAGGGAAAG CCCCTAAGCGCCTGATCTATGCTGCATCCAGT TTACAAAGTGGGGTCCCATCAAGGTTCAGCGG CAGTGGATCTGGGACAGCCTGAAGATTTTGCAACT TCAGCAGCCTGCAGCCTGAAGATTTTGCAACT TATTACTGTCTACAGCATTATAGTTTCCCTCGG ACGTTCGGCCAAGGGACCAAAGTGGAAATCA AA SEQ ID NO: 24503 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCGATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGAGTA TAGCAGCAGCTGGTACGACTACGGTATGGACGTC TGGGGCCAAGGGACCACGGTCACCGTCTCCTCA SEQ ID NO: 28509 |

FIGURE 50
(Continued)

| | | | | |
|---|---|---|---|---|
| iPS:392916 | 21-225_27C5 | AA | DIQMTQSPSSLSASVGDRVTITCRTSQGIRNDLG WYQQKPGKAPKRLIYAASSLQSGVPSRFSGSGS GTEFTLTISSLQPEDFATYYCLQHYSFPRTFGQGT KVEIK<br>SEQ ID NO: 24504 | QVQLVESGGGVVQPGRSLRLSCAASGFTFSSDGMH WVRQAPGKGLEWVAVIWYDGSNKYYADSVKGRF TISRDNSKNTLYLQMNSLRAEDTAVYYCARERYSS SWYDYGMDVWGQGTTVTVSS<br>SEQ ID NO: 28510 |
| | | NA | GACATCCAGATGACCCAGTCTCCCTCTTCCGT GTCTGCATCTGTAGGAGACAGAGTCACCATCA CTTGTCGGGCGAGTCAGGGTATTAGCAGCTGG TTAGCCTGGTATCAGCAGAAACCAGGGAAAG CCCCTAAGTTCCTGATCTATGCTGCATCCAGTT TGCAAAGTGGGGTCCCATCAAGGTTCACTCT CAGTGGATCTGGGACAGAGTTCACTCTCACCAT CAGCAGCCTGCAGCTGAACAGTATGACAGTTTTGCAACTT ACTGTTGTCAACAGCCTGAACAGTATGACAGTTTTGCAACTT ACGTTCGGCCAAGGGACCAAGGTGGAAATCA AA<br>SEQ ID NO: 24505 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGCT GGAGTGGGTCTCATCCACTAGTAGTGATAGT TATATATACTACGCAGACTCAGTGAAGGCCGAT TCACCATCTCAGAGACAACGCCAAGAACTCACT GTATCTGCAAATGAACAGCCTGAGAGCCGAGGA CACGGCTGTGTATTACTGTGCAGAGTGGCGTCC TTTGACTGCTGGGGCCAGGGAACCCTGGTCACCG TCTCCTCA<br>SEQ ID NO: 28511 |
| | | AA | DIQMTQSPSSVSASVGDRVTITCRASQGISSWLA WYQQKPGKAPKFLIYGASSLQSGVPSRFSASGSG TEFTLTISSLQPEDFATYCCQQYDSFPRTFGQGTK VEIK<br>SEQ ID NO: 24506 | EVQLVESGGGLVKPGGSLRLSCAASGFTFSSYSMN WVRQAPGKGLEWVSSTSSSDSYIYADSVKGRFTI SRDNAKNSLYLQMNSLRAEDTAVYYCARVASFDC WGQGTLVTVSS<br>SEQ ID NO: 28512 |

FIGURE 50
(Continued)

| | | | |
|---|---|---|---|
| iPS:392918 | 21-225_28F5 | NA | GACATCCAGATGACCCAGTCTCCATCCTCCCT GTCTGCATCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCTATCGTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAATACTTACCCGTG GACGTTCGGCCAAGGGACCAAGGTGGAAGTC AAA<br>SEQ ID NO: 24507 | CAGGTGCAGCTGGTGGAGTCTGGGGGAGGCGTG GTCCAGCCTGGAGGTCCCTGAGACTCTCCTGTG CAGCGTCTGGATTCACCTTCAGTAGTAGTATGGCAT GCACTGGGTCCGCCAGGCTCCAGGCAAGGGGCT GGAGTGGGTGGCAGTTATATGCAGACTCCGTGAAGGGCCGA AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAATTAGG CTGGTACGACGACTACTGGGGCCAGGGAACCCT GGTCACCGTCTCCTCA<br>SEQ ID NO: 28513 |
| | | AA | DIQMTQSPSSLSASVGDRVTITCRASQGIRNDLG WYQQKPGKAPKRLIYTASSLQSGVPSRFSGSGSG TEFTLTISSLQPEDFATYYCLQHNTYPWTFGQGT KVEVK<br>SEQ ID NO: 24508 | QVQLVESGGGVVQPGRSLRLSCAASGFTSSYGMH WVRQAPGKGLEWVAVIWYDENNKYYADSVKGRF TISRDNSKNTLYLQMNSLRAEDTAVYYCARELGW YDDYWGQGTLVTVSS<br>SEQ ID NO: 28514 |
| iPS:392920 | 21-225_29G4 | NA | GACATCCAGATGACCCAGTCTCCATCCTCCCT GTCTGCATCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA CA<br>SEQ ID NO: 24509 | CAGGTGCAGCTGGTGGAGTCTGGGGGAGGCGTG GTCCAGCCTGGAGGTCCCTGAGACTCTCACCTGTG CAGCGTCTGGATTCACCTTCAGTGACTATGGCAT ACACTGGGTCCGCCAGGCTCCAGGCAAGGGCT GGAGTGGGTGGCAGTTATATGCAGACTCCATGAAGGTGATGAAGGCCGA AATAAATACTATGCAGACTCCATGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACTGGG AATGACGGGTGACTACTGGGGCCAGGGAACCCT GGTCACCGTCTCCTCA<br>SEQ ID NO: 28515 |

FIGURE 50
(Continued)

| | | | | |
|---|---|---|---|---|
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIT<br><br>SEQ ID NO: 24510 | QVQLVESGGGVVQPGRSLRLTCAASGFTFSDYGIH WVRQAPGKGLEWVAVIWYDESNKYYADSMKGRF TISRDNSKNTLYLQMNSLRAEDTAVYYCARELGMT GDYWGQGTLVTVSS<br><br>SEQ ID NO: 28516 |
| iPS:392922 | 21-225_30G4 | NA | GACATCCAGATGACCCAGTCTCCACCCTCCCT GTCTACATCTGTAGGAGACAGAGTCACCATCA CTTGCCGGGCAACTCAGAACAGATTTTCAGCTAT TTAAATTGGCATCAGCAGAAACCAGGGAAAG CCCCTAAGCTCCTGATCCATCATGCATCCAGTT TGCAAGGTGGGGTCCCATCAAGGTTCAGTGGC AGTGGATCTGGACAGATTTCACTCTCACCAT CATCAGTAGTCAACCTGAAGATTTTTCCACTT ACTACTGTCAACTCAGTACAGTCCCCCGTAC ACTTTTGGCGGAGGGACCAAGGTGGAGATCA AA<br><br>SEQ ID NO: 24511 | CAGGTGCAGTTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCCGGGGGCT GGAATGGGTGGCAGTTATATGACTCCGTGATGAACT GATAAATACTCCAGAGACAATTCCAAGAACACGCT GTATCTGCAAATGAACAGCCTGAGAGCCGAGGA CTCGGCTGTATTACTGTGCGAGAGAAATAGC AGTCGTACTACTTTGACTACTGGGGCCAGGGAA CCCTGGTCACCGTCTCCTCA<br><br>SEQ ID NO: 28517 |
| | | AA | DIQMTQSPPSLSTSVGDRVTITCRATQNIFSYLN WHQQKPGKAPKLLIHTASSLQGGVPSRFSGSGS GTDFTLTIISMQPEDFSTYYCQLSYSPPYTFGGGT KVEIK<br><br>SEQ ID NO: 24512 | QVQLVESGGGVVQPGRSLRLSCAASGFTFSSYGMH WVRQAPGRGLEWVAVIWYDGTDKYYVDSVKGRF TISRDNSKNTLYLQMNSLRAEDSAVYYCARENSSS YYFDYWGQGTLVTVSS<br><br>SEQ ID NO: 28518 |

FIGURE 50
(Continued)

| | | | | |
|---|---|---|---|---|
| iPS:392924 | 21-225_32H2 | NA | GATATTGTGATGACCCAGACTCCACTCTCT GTCCGTCACCCCTGGACAGCCGGCCTCCATCT CCTGCAGGTCTAGTCAGAGCCTCCTCCATAGT GATGGAAGGACCTATTTGTATTGTACCTGCA GAAGCCAGGCCAGCTCCACAGCTCCTGATCT ATGAACTTTCAAACCGGTTCTCTGGAGTGCCA GATAGGTTCAGTGGCAGCGGGTCAGGGACAG ATTTCACACTGAAAATCAGCCGGGTGGAGGCT GAGGATGTTGGGATTTATTCCTGCTTGCAAAG TATACAATATCCCATCACCTTCGGCCAAGGGA CACGACTGGAGATTAAA<br><br>SEQ ID NO: 24513 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGAATCTGCAAATGAACAGCCTGAGAGCCGAGG ACACGGGTGTGTATTACTGTGCGAGAAGATATAG CAGCAGTCGGACGGGGGTATGGACGTCTGGGG CCAAGGGACCACGGTCACCGTCTCCTCA<br><br>SEQ ID NO: 28519 |
| | | AA | DIVMTQTPLSLSVTPGQPASISCRSSQSLLHSDGR TYLYWYLQKPGQPPQLLIYELSNRFSGVPDRFSG SGSGTDFTLKISRVEAEDVGIYSCLQSIQYPITFG QGTRLEIK<br><br>SEQ ID NO: 24514 | QVQLVESGGGVVQPGRSLRLSCAASGFTFSSYGMH WVRQAPGKGLEWVAVIWYDGSNKYYADSVKGRF TISRDNSKNTLNLQMNSLRAEDTGVYYCARRYSSS WTGGMDVWGQGTTVTVSS<br><br>SEQ ID NO: 28520 |
| iPS:392928 | 21-225_25A4 | NA | GACATCGTGATGACCCAGTCTCCAGACTCCCT GGCTGTGTCTCTGGGCGAGAGGGCCACCATCA AGTGTAAGTCCAGCCAGAGTGTTTTATACAGC TCCCACAATAACAACCAGGACAAACTACTTGGTACCA GCAGAAACCAGGACAGCCTCCTAAGTTGCTCC TTTACTGGGCATCTACCCGGGAATCCGGGGTC CCTGACCGATTCAGTGGCAGCGGGTCTGGGAC AGAATTCACTCTCACCATCAGCAGCCTGGAGG CTGAAGATGTGGCAGTTTATTACTGTCAGCAG CTATTATAGTACTCCTCCGACGTTCGGCCAAGG GACCAAGGTGGAAATCAAA<br><br>SEQ ID NO: 24515 | CAGGTGCTCTGGTGCAGTCTGGGGCTGAGGTGA AGAGGCCTGGGGCCTCAGTGAAGGTCTCTGCA AGGCTTCTGGATACACCTTCACCAATTATGATAT TAATTGGGTGCGACAGGCCACTGGACAAGGGCT TGAGTGGATGGGATGGATGTACCCTAACAGTGGT AACACAGGCTATGCACAGAAATTCCAGGGCAGA GTCACCATGACCAGGAACACCTCCATAAGCACA GCCTACATGGAGCTGAGCAGCCTGAGATCTGAG GACACGGCCGTCTATTACTGTGCGAGTAGCAGTG GCTGGTACTACTTTGACTACTGGGGCCAGGGAAC CCTGGTCACCGTCTCCTCA<br><br>SEQ ID NO: 28521 |

FIGURE 50
(Continued)

| | | | | |
|---|---|---|---|---|
| iPS:392930 | 21-225_25H9 | AA | DIVMTQFPDSLAVSLGERATIKCKSSQSVLYSSH NNNYLAWYQQKPGQPPKLLLYWASTRESGVPD RFSGSGSGTEFTLTISSLEAEDVAVYYCQQYYST PPTFGQGTKVEIK<br><br>SEQ ID NO: 24516 | QVLLVQSGAEVKRPGASVKVSCKASGYTFTNYDIN WVRQATGQGLEWMGWMYPNSGNTGYAQKFQGR VTMTRNTSISTAYMELSSLRSEDTAVYYCASSSGW YYFDYWGQGTLVTVSS<br><br>SEQ ID NO: 28522 |
| | | NA | GATATTGTGATGACCCAGACTCCACTCTCTCT GTCCGTCACCCCTGGACAGCCGGCCTCCATCT CCTGCAAGTCTAGTCAGAGCCTCCTGCATGT GATGAAAGACCTATTTGTTTTGGTACCTGCA GAAGCCAGGCCAGCCTCCACAGCTCCTGATCT ATGAAGTTTCCAATCGGTTCTCTGGAGTGCCA GATAGGTTCAGTGGCAGCGGGTCAGGACAG ATTTCACACTGAAAATCAGCCGGGTGGAGGCT GAGGATGTTGGGGTTTATTACTGCAAAG TATACAGCTTCCGTGGACGTTCGGCCAAGGGA CCAAGGTGGAAATCAAA<br><br>SEQ ID NO: 24517 | CAGGTGCAGCTGGTGCAGTCTGGGGGAGGCGTG GTCCAGCCTGGGAGGTCCCTGAGACTCTCCTGTG CAGCGTCTGGATTCCCCTTCAATAACTATGGCAT GCACTGGGTCCGCCAGGCTCCAGGCAAGGGCT GGAGTGGGTGTCAATTATATGGTATGATGGAAGT TATAAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAGGATAC GATTTTTGGAGTGGCTTCTTTGACTCCTGGGGCC AGGGAACCCTGGTCACCGTCTCCTCA<br><br>SEQ ID NO: 28523 |
| | | AA | DIVMTQTPLSLSVTPGQPASISCKSSQSLLHGDG KTYLFWYLQKPGQPPQLLIYEVSNRFSGVPDRFS GSGSGTDFTLKISRVEAEDVGVYYCMQSIQLPW TFGQGTKVEIK<br><br>SEQ ID NO: 24518 | QVQLVESGGGVVQPGRSLRLSCAASGFPFNNYGM HWVRQAPGKGLEWVSIIWYDGSYKYYADSVKGRF TISRDNSKNTLYLQMNSLRAEDTAVYYCAREGYDF WSGFFDSWGQGTLVTVSS<br><br>SEQ ID NO: 28524 |

FIGURE 50
(Continued)

| | | | |
|---|---|---|---|
| iPS:392934 | 21-225_27D5 | NA | GACATCCAGATGACCCAGTCTCCATCTCCT GTCTGCATCTGTAGGAGACAGAGTCACCATCA CTTGCCGGGCAAGTCAGGCATTAGAAATGAT TTAGGCTGGTATCAACAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A<br>SEQ ID NO: 24519 | CAGGTGCAACTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGAAAGT AATAAATACTATGGAGACTCCGTGAAGGGCCGA TTCACCATCTCCAGAGACAATTCCAAGAATATGC TGTATCTGCAAATGAACAGCCTGAGAGGCGAGG ACACGGCTCTGTATTACTGTGCGAGAGAACTGGG GTTCCTCTCTGACTACTGGGGCCAGGGAACCCTG GTCACCGTCTCCTCA<br>SEQ ID NO: 28525 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPFFGPGT KVDIK<br>SEQ ID NO: 24520 | QVQLVESGGGVVQPGRSLRLSCAASGFTFSSYGMH WVRQAPGKGLEWVAVIWYDESNKYYGDSVKGRF TISRDNSKNMLYLQMNSLRGEDTALYYCARELGFL SDYWGQGTLVTVSS<br>SEQ ID NO: 28526 |
| iPS:392936 | 21-225_28B6 | NA | GATGTTGTGATGACTCAGTCTCCACTCTCCCTG CCCGTCACCCTTGGACAGCCGGCTCCATCTC CTGCCGGTCTAGTCAAAGCCTCGTATATAGTG ATGGAGACACCTACTTGAATTGGTTTCAGCAG AGGCCAGGCCAATCTCCAAGGCGCCAAATTTA TAAGGTTTCTAACTGGGACTCTGGGGTCCCAG ACAGATTCAGCGGCAGTGGGTCAGGCACTGAT TTCACACTGAAACATCAGCAGGGTGGAGGCTGA GGATGTTGGGATTTATTTCTGCATGCATTGTAC ACACTGGCTCCTTTCGGCCCTGGGACCAAAG TGGATATCAAA<br>SEQ ID NO: 24521 | CAGGTGCTCCTGGTGCAGTCTGGGGCTGAGGTGA AGAAGCCTGGGGCCTCAGTGAAGGTCTCCTGCA AGGCTTCTGGATACACCTTCACCAATTATGATAT TAATTGGGTGCGACAGGCCACTGGACAAGGTCTT GAGTGGATGGATGGATCCAGAAGTTCCAGGCAGA AACACAGGCTATGCACAGAAGTTCCAGGCAGA GTCACCATGACCAGGAACACCTCCATAAGCACG GCCTACATGAGCTGAGCAGCCTGAGATCTGAG GACACGGCCGTGATTACTGTGCGAGTAGCAGTG GCTGGTACTACTTGACTACTGGGGCCAGGGAAC CCTGGTCACCGTCTCCTCA<br>SEQ ID NO: 28527 |

FIGURE 50
(Continued)

| | | | | |
|---|---|---|---|---|
| | | AA | DVVMTQSPLSLPVTLGQPASISCRSSQSLVYSDG DTYLNWFQQRPGQSPRRQIYKVSNWDSGVPDRF SGSGSGTDFTLNISRVEAEDVGIYFCMHCTHWLL FGPGTKVDIK<br>SEQ ID NO: 24522 | QVLLLVQSGAEVKRPGASVKVSCKASGYTFTNYDIN WVRQATGQGLEWMGWMHPDSGNTGYAQKFQGR VTMTRNTSISTAYMELSSLRSEDTAVYYCASSSGW YYFDYWGQGTLVTVSS<br>SEQ ID NO: 28528 |
| iPS:392938 | 21-225_29H4 | NA | GATATTGTGATGACCCAGACTCCACTCTCT GTCCGTCACCCCTGGACAGCCGGCCTCTTCT CCTGCAAGTCTAGTCAGAGCCTCCTGCATAGT GATGGAAAGACCTATTTGTATTGGTACCTGCA GAAGCCAGGCCAGTCCAGGCCTCCACAGCTCCTGATCT TTGAGGTTTCCCACCGGTTCTCTGACTGCCA GATAGGTTCAGTGGCAGCGGGTCAGGGACAG ATTTCACACTGAAAATCAGCCGGGTGGAGGCT GAGGAJGTTGGGGTTTATTACTGCATGCAAAG TATACAGCATCCGTTCACTTTCGGCGGAGGGA CCAGGGTGGAGATCAAA<br>SEQ ID NO: 24523 | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGGCAT ACACTGGGTCCGCCAGGCTCCAGGCAAGGGGCT GGAGTGGGTGGGGCAGTTATATGGTATGATGAAGT AATAAATACTATGCAGACTCCGTGAAGGGCCGA TTCACCATTCTCCAGAGACAATTCCAAGAACACGC TGTATCTGCAAATGAACAGCCTGAGAGCCGAGG ACACGGCTGTGTATTACTGTGCGAGAAGGTATAG CAGCAGCTGGTCCAGGGGGTATGACCGTCTGGGG CCAAGGGACCACGGTCACCGTCTCCTCA<br>SEQ ID NO: 28529 |
| | | AA | DIVMTQTPLSLSVTPGQPASFSCKSSQSLLHSDG KTYLYWYLQKPGQPPQLLIFEVSHRFSGLPDRFS GSGSGTDFTLKISRVEAEDVGVYYCMQSIQHPFT FGGGTRVEIK<br>SEQ ID NO: 24524 | QVQLVESGGGVVQPGRSLRLSCAASGFTFSSYGIH WVRQAPGKGLEWVAVIWYDGSNKYYADSVKGRF TISRDNSKNTLYLQMNSLRAEDTAVYYCARRYSSS WSGGMDVWGQGTTVTVSS<br>SEQ ID NO: 28530 |

FIGURE 50
(Continued)

| | | | | |
|---|---|---|---|---|
| iPS:392940 | 21-225_29D9 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTTTCAGCAGAAACCGGGAAAGC CCCTAAGCGCCTGATCTATGCTGCATCCAGTTT GCAAAGTGGGGTCCCATCAAGGTTCAGCGGCA GTGGATCTGGGACAGAATTCACTCTCACAATC AGCAGCCTGCAGCCTGAAGATTTTGCAACTTA TTACTGTCTACAGCATAATACTTACCCATTCAC TTTCGGCCCTGGGACCAAAGTGGATTTCAAA<br><br>SEQ ID NO: 24525<br><br>DIQMTQSPSSLSASVGDRVTITCRASQGIRNDLG WFQQKPGKAPKRLIYAASSLQSGVPSRFSGSGSG TEFTLTISSLQPEDFATYYCLQHNTYPFTFGPGTK VDFK<br><br>SEQ ID NO: 24526 | CAGGTGCAGCTGGTGGAGTCTGGGGGAGGCGTG GTCCAGCCTGGGAGGTCCCTGAAACTCTCCTGTT CAGCCTCTGGATTCACCTTCAGTGACTATGGCAT TCACTGGGTCCGCCAGGCTCCAGGCAAGGGGCT GGAGTGGGTGGCAGTTATATGGTATGATGAAAGT AATAACTACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTACTACTGTGCGAGAGAAATTGGC TGGTTAGATGACTACTGGGGCCAGGGAACCCAG GTCACCGTCTCCTCA<br><br>SEQ ID NO: 28531<br><br>QVQLVESGGGVVQPGRSLKLSCSASGFTFSDYGIH WVRQAPGKGLEWVAVIWYDESNNYYADSVKGRF TISRDNSKNTLYLQMNSLRAEDTAVYYCAREIGWL DDYWGQGTQVTVSS<br><br>SEQ ID NO: 28532 |
| iPS:392942 | 21-225_30E9 | NA | GACATCCAGATGACCCAGTCTCCATCTCCCT GTCTGCATCTGTAGGAGACAGAGTCACCATCA CTTGCCGGGCAAGTCAGGACAGATTAGAGATGAT TTAGGCTGGTATCAGCAGAAACCAGGGAAAG CCCCTAGGCGCCTGATCTATGGTGCATTCAGC TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATACTAGTTACCCTCCT ACTTTCGGCGGAGGGACCAAGGTGGAGATCA AA<br><br>SEQ ID NO: 24527 | GAGGTGCAGGTGTTGGAGTCTGGGGGAGGCTTG GTACAGCCTGGGGGGTCCCTGAGACTCTCCTGTG CAGCCTCTGGATTCACCTTTAGCAGCTGTGCCAT GAACTGGGTCCGCCAGGCTCCAGGGAAGGGGCT GGAGTGGGTCTCCGCTATTAGTGGTGTGTGGTGT AGCACATTCTACGCAGACAGACTCCGTGAAGGGCCGGT TCACCATCTCCAGAAATGAACAGCCTGAGACACGCT GTATCTGCAAATGAACAGCCTGAGAAGGGAGCT CACGGCCGTATATTACTGTGCGAAATGGACGTC ACTAGAGGACTACTACTACTACGGAATGGACGTC TGGGGCCAAGGGACCACGGTCACCGTCTCCTCA<br><br>SEQ ID NO: 28533 |

FIGURE 50
(Continued)

| | | | | |
|---|---|---|---|---|
| iPS:392944 | 21-225_31H5 | AA | DIQMTQSPSSLSASVGDRVTITCRASQDIRDDLGWYQQKPGKAPRRLIYGAFSLQSGVPSRFSGSGSGTEFTLTISSLQPEDFATYYCLQHTSYPPTFGGGTKVEIK<br><br>SEQ ID NO: 24528 | EVQVLESGGGLVQPGGSLRLSCAASGFTFSSCAMNWVRQAPGKGLEWVSAISGRGGSTFYADSVKGRFTISRDNSKNTLYLQMNSLRAEDTAVYYCAKGELLEDYYYYGMDVWGQGTTVTVSS<br><br>SEQ ID NO: 28534 |
| | | NA | GACATCCAGATGACCCAGTCTCCATCCTCCCTGTCTGCATCTGTAGGAGACAGAGTCACCATCTCTTTCCGGGCAAGTCAGGACATTAGAAGTGATTTAGGCTGGTATCAGCAGAAACCAGGGAAAGCCCATAAGCGCATCATCTATGCTGCATCCAGTTTGCAAAGTGGGGTCCCATCAAGGTTCAGCGTCAGTGGATCTGGGACAGATCACTTTCACAATCAGCAGCATGCAGCCTGACGATTTTTACCTCTATTACTGTATACAACATATTATTACCCTCCTACTTTCGGCGGAGGGACCAAGGTGGAGATCAAA<br><br>SEQ ID NO: 24529 | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTGTGCCATGAGCTGGGTCCGCCAGGCTCCAGGGAAGGGGCTGGAGTGGGTCTCCGCTATTAGTGGTCGTGGTGGAAGCATATTCCACGCAGACTCCGTGAAGGGCCGGTTCACCATCTCCAGAGACAATTCCAAGAACACGCTGTATCTGCAAATGAACAGCCTGAGAGCCGAGGACACGGCCGTATATTACTGTGTGAAGGGAGCTACTAGAGGACTACTACTTCTACGTATGGACGTCTGGGGCCAAGGGACCACGGTCACCGTCTCCTCA<br><br>SEQ ID NO: 28535 |
| | | AA | DIQMTQSPSSLSASVGDRFTISFRASQDIRSDLGWYQQKPGKAHKRIIYAASSLQSGVPSRFSVSGSGTEFTFTISSMQPDDFSNYYCIQHIYPPTFGGGTKVEIK<br><br>SEQ ID NO: 24530 | EVQLLESGGGLVQPGGSLRLSCAASGFTFSSYAMSWVRQAPGKGLEWVSAISGRGGSIFHADSVKGRFTISRDNSKNTLYLQMNSLRAEDTAVYYCVKGELLEDYYFYGMDVWGQGTTVTVSS<br><br>SEQ ID NO: 28536 |

FIGURE 50
(Continued)

| | | | |
|---|---|---|---|
| iPS:392948 | 21-225_25G5 | NA | GACATCCAGATGACCCAGTCTCCATCCTCACTGTCTGCATCTGTTGGAGACAGAGTCACCATCACTTGCCGGGCAAGTCAGGACATTAGCAGACAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTCTCACAGTCAGCAGCCTGCAGCCTGAAGATTTTGCAACTTATTACTGTCTACAGCATAATAGTTACCCCTCACTTTCGGCCCTGGGACCAAAGTGGATATCAAA<br>SEQ ID NO: 24531 | CAGGTGCAGCTGGTGGAGTCTGGGGGAGGCGTGGTCCAGCCTGGGAGGTCCCTGAGACTCTCCTGTGCAGCGTCTGGATTCACCTTCAGTGACTATGGCATACACTGGGTCCGCCAGGCTCCAGGCAAGGGCTGGAGTGGGTGGCAGTTATTTGGTATGATGAAATAATAAATATTATGCAGACTCCGTGAAGGGCCGATTCACCATCTCCAGAGACAATTCCAAGAACACGCTGTATCTGCAAATGAACAACCTGAGAGCCGAGGACACGGCTGTGTATTACTGTGCGAGAGAAATTGGCTGGTTAGATGACTACTGGGGCCAGGGAACCCTGGTCACCGTCTCCTCA<br>SEQ ID NO: 28537 |
| | | AA | DIQMTQSPSSLSASVGDRVTITCRASQDIRNDLGWYQQKPGKAPKRLIYAASSLQSGVPSRFSGSGSGTEFTLTVSSLQPEDFATYYCLQHNSYPFTFGPGTKVDIK<br>SEQ ID NO: 24532 | QVQLVESGGGVVQPGRSLRLSCAASGFTFSDYGIHWVRQAPGKGLEWVAVIWYDGNNKYYADSVKGRFTISRDNSKNTLYLQMNNLRAEDTAVYYCAREIGWLDDYWGQGTLVTVSS<br>SEQ ID NO: 28538 |
| iPS:392950 | 21-225_25C10 | NA | GACATCCAGATGACCCAGTCTCCATCCTCACTGTCTGCATCTGTAGGAGACAGAGTCACCATCACTTGTCGGGCGAGTCAGGGCATTAGCAATTATTTAGCCTGGTTTCAGCAGAAACCAGGGAAAGCCCCTAAGTCCCTGATCTGCTGCATCCAGTTTGCAAAGTGGGGTCCCATCAAGGTTCAGCGGCAGTGGATCTGGGACAGATTTCACTCTCACCATCAGCAGCCTGCAGCCTGAAGATTTTGCAACTTATTACTGCCAACAGTATCATAGTTACCCATTCACTTTCGGCCCTGGGACCAAAGTGGATATCAAA<br>SEQ ID NO: 24533 | GAGGTGCAGTTGGTGGAGTCTGGGGGAGGCTTGGTACAGCCTGGGGGGTCCCTGAGACTCTCCTGTGCAGCCTCTGGATTCACCTTCAGTAGCTATAGGATGAACTGGGTCCGCCAGGCTCCAGGGAAGGGGCTGGAGTGGGTTTCATCCATTAGTAGTAGTAGTAGTACCATATACTACGCAGACTCTGTGAAGGGCCGATTCACCATCTCCAAATGAACAGCCTGAGAGACGAGGAGTATCTGCAAATGAACAGCCTGAGAGACGAGGACACGGCTGTGTATTACTGTGCGAGAACGGCTGGTTTGACTACTGGGGCCAGGGAACCCTGGTCACCGTCTCCTCA<br>SEQ ID NO: 28539 |

FIGURE 50
(Continued)

| | | | | |
|---|---|---|---|---|
| iPS:392952 | 21-225_26G1 | AA | DIQMTQSPSSLSASVGDRVTITCRASQGISNYLA WFQQKPGKAPKSLIYAASSLQSGFPSKFSGSGSG TDFTLTISSLQPEDFATYYCQQYHSYPFTFGPGT KVDIK<br><br>SEQ ID NO: 24534 | EVQLVESGGGLVQPGGSLRLSCAASGFTFSSYRMN WVRQAPGKGLEWVSSISSSSSTIYYADSVKGRFTIS RDNAKNSLYLQMNSLRDEDTAVYYCARTAGFDY WGQGTLVTVSS<br><br>SEQ ID NO: 28540 |
| | | NA | GACATCCAGATGACCCAGTCTCCATCCTCACT GTCTGCATCTGTAGGAGACAGAGTCACCATCA CTTGTCGGGCGAGTCAGGACATTAGCAATTAT TTAGCCTGGTTTCAGCAGAAACCAGGGAAAGC CCCTAAGTCCCTGATCTATGCTGCATCCAGTTT GCGAAGTGGGGTCCCATCAAACTTCAGCGGCA GTGGATCTGGGACAGATTTCACTCTCACCATC AGCAGCCTGCAGCCTGAAGATTTTGCAACTTA TTACTGCCAACAGTATCATAGTTACCCATTCA CTTTCGGCCCTGGGACCAAAGTGGATATCAAA<br><br>SEQ ID NO: 24535 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATGGCAT GAACTGGGTCCGCCAGGCTCCAGGGAAGGGGCT GGAGTGGGTCTCATCCATTAGTAGTGGTAGTAGT TACATATACTACGCGGACTCAGTGAAGGGCCGAT TCACCATCTCCAGAGACAACGCCAAGAACTCACT GTATCTGCAAATGAACAGCCTGAGAGACCGAGGA CACGGCTGTGTATTACTGTGCGAGACTGACTACC TTTGACTTCTGGGGCCAGGGAACCCTGGTCACCG TCTCCTCA<br><br>SEQ ID NO: 28541 |
| | | AA | DIQMTQSPSSLSASVGDRVTITCRASQDISNYLA WFQQKPGKAPKSLIYAASSLRSGVPSNFSGSGSG TDFTLTISSLQPENFATYYCQQYHSYPFTFGPGT KVDIK<br><br>SEQ ID NO: 24536 | EVQLVESGGGLVKPGGSLRLSCAASGFTFSSYGMN WVRQAPGKGLEWVSSISGSSSYIYYADSVKGRFTIS RDNAKNSLYLQMNSLRAEDTAVYYCARLTFDFW GQGTLVTVSS<br><br>SEQ ID NO: 28542 |

FIGURE 50
(Continued)

| | | | |
|---|---|---|---|
| iPS:392954 | 21-225_26A10 | NA | GACATCCAGATGACCCAGTCTCCATCTCCCT GTCTGCATCTGTAGGAGACAGAGTCACCATCA CTTGCCGGGCAAGTCAGAGCATTAGCAGCTAT TTAAATTGGTATCAGCAGAAACCAGGGAAAG CCCCTAAGGTCCTGATCTATGCTGCATCCAGC TTGCAAAGTGGGGTCCCATCAAGATTCAGTGG CAGTGGATCTGGGACAGATTTCACTCTCACCA TCAGCAGTCTGCAACCTGAAGATTTTGCAACT TACTACTGTCAACAGAGTTACAGTACCCTAC GTGGACGTTCGGCCAAGGGACCAAGGTGGAA ATCAAA<br>SEQ ID NO: 24537 | GAGGTGCAGCTGCTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGTCT GGAGTGGGTCTCAGTTATTAGTGGTAGTGGTGTT AACACATTCTACGCAGACTCCGTGAAGGGCCGGT TCACCATCTCCAGAGACAATTCCAAGAACACGCT GTATCTGCTAATGAACAGCTGAGAGCCGAGGA CACGGCCGTATATTACTGTGCGAAAAAGATAGC AGTGGCTGGTACTCACTACTTTGACTACTGGGGC CAGGGAACCCTGGTCACCGTCTCCTCA<br>SEQ ID NO: 28543 |
| | | AA | DIQMTQSPSSLSASVGDRITITCRASQSISSYLNW YQQKPGKAPKVLIYAASSLQSGVPSRFSGSGSGT DFTLTISSLQPEDFATYYCQQSYSTPTWTFGQGT KVEIK<br>SEQ ID NO: 24538 | EVQLLESGGGLVQPGGSLRLSCAASGFTFSSYAMS WVRQAPGKGLEWVSVISGSGVNTFYADSVKGRFTI SRDNSKNTLYLLMNSLRAEDTAVYYCAKKIAVAG THYFDYWGQGTLVTVSS<br>SEQ ID NO: 28544 |
| iPS:392956 | 21-225_27A11 | NA | GACATCCAGATGACCCAGTCTCCCTCTTCCGT GTCTGCATCTGTAGGAGACAGAGTCACCATCA CTTGTCGGGCAAGTCAGGGTATTAGTAGTTGG TTAGCCTGGTATCAGCAGAAACCAGGGAAAG CCCCTAAGCTCCTGATCTATGGTGCATCCAGTT TGCAAAGTGGGGTCCCATCAAGGTTCAGCGCC AGTGGATCTGGGACAGATTTCACTCTCACCAT CAGCAGCCTGCAGCCTGAAGATTTTGCAACTT ACTGTTGTCAACAGTCTGACAGTTTCCCTCGG ACGTTCGGCCAAGGGACCAAGGTGGAAATCA AA<br>SEQ ID NO: 24539 | CAGGTGCAGCTGCAGCTGGTGCAGTCTGGGGGAGGCGTG GTCCAGCCTGGGAGGTCCCTGAGACTCTCCTGTG CAGCGTCTGGATTCACCTTCAGCAGCTATGGCAT GCACTGGGTCCGCCAGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TATATCTACAAATGAACAGCCTGAGAGCCGAGG ACACGGCTGTGTATCACTGTGCGAGAGATTCCTC CCCCTACGGTATGGACGTCTGGGGCCAAGGGAC CACGGTCACCGTCTCCTCA<br>SEQ ID NO: 28545 |

FIGURE 50
(Continued)

| | | | | |
|---|---|---|---|---|
| | | AA | DIQMTQSPSSVSASVGDRVTITCRASQGISSWLA WYQQKPGKAPKLLIYGASSLQSGVPSRFSASGS GTDFTLTISSLQPEDFATYCCQQSDSFPRTFGQGT KVEIK<br>SEQ ID NO: 24540 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYHCARDSSPY GMDVWGQGTTVTVSS<br>SEQ ID NO: 28546 |
| iPS:392958 | 21-225_28C7 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATATTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAATACTTACCCGTGG ACGTTCGGCCAAGGGACCAAGGTGAAATCA AA<br>SEQ ID NO: 24541 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGAAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAATTAGG CTGGTACGACGACTACTGGGGCCAGGGAACCCT GGTCACCGTCTCCTCT<br>SEQ ID NO: 28547 |
| | | AA | DIQMTQSPSSLSASVGDRVTITCRASQGIRNDLG WYQQKPGKAPKRLIYIASSLQSGVPSRFSGSGSG TEFTLTISSLQPEDFATYCLQHNTYPWTFGQGT KVEIK<br>SEQ ID NO: 24542 | QVQLVESGGGVVQPGRSLRLSCAASGFTFSSYGMH WVRQAPGKGLEWVAVIWYDESNKYYADSVKGRF TISRDNSKNTLYLQMNSLRAEDTAVYYCARELGW YDDYWGQGTLVTVSS<br>SEQ ID NO: 28548 |

FIGURE 50
(Continued)

| | | | |
|---|---|---|---|
| iPS:392960 | 21-225_29E6 | NA | GACATCGTGATGACCCAGTTTCCAGACTCCCT GGCTGTGTCTCTGGGCGAGAGGGCCACCATCA ACTGTAAGTCCAGCCAGAGTGTTTTATACAGC TCCCACAATAACTACTACTTAACTGGTACCA GCAGAAACCAGGACAGCCTCATAAGTTGCTC TTTACTGGGCATCTTCCGGGAATCCGGGGTC CCTGACCGATTCAGTGGCAGCGGGTCTGGGAC AGAATTCACTCTCACCATCAGCAGCCTGCAGG CTGAAGATGTGGCAGTTTATTACTGTCAGCAG TATTATAGTACTCCTCGACGTTCGGCCAAGG GACCAAGGTGGAAATCAAA

SEQ ID NO: 24543 | CAGGTGCTCCTGGTGCAGTCTGGGGCTGAGGTGA AGAGGCCTGGGGCCTCAGTGAAGGTCTCCTGCA AGGCTTCTGGATACACCTTCACCAATTATGATAT TAATTGGGTGCGACAGGCCACTGGACAAGGGCT TGAGTGGATGGGATGGATGCACCTAACAGTGGT AACACAGGCTATGCACAGAAATTCCAGGGCAGA GTCACCATGACCAGGAACACCTCCATAAGCACA GCCTACATGGAGCTGAGCAGCCTGAGATCTGAG GACACGGCCGTCTATTACTGTGCGAGTAGCAGTG GCTGGTACTACTTTGACTACTGGGGCCAGGGAAC CCTGGTCACCGTCTCCTCA

SEQ ID NO: 28549 |
| | | AA | DIVMTQFPDSLAVSLGERATINCKSSQSVLYSSH NNYYLTWYQQKPGQPHKLLLYWASSRESGVPD RFSGSGSGTEFTLTISSLQAEDVAVYYCQQYYST PPTFGQGTKVEIK

SEQ ID NO: 24544 | QVLLVQSGAEVKRPGASVKVSCKASGYTFTNYDIN WVRQATGQGLEWMGWMHPNSGNTGYAQKFQGR VTMTRNTSISTAYMELSSLRSEDTAVYYCASSSGW YYFDYWGQGTLVTVSS

SEQ ID NO: 28550 |
| iPS:392962 | 21-225_30A1 | NA | GACATCCAGATGACCCAGTCTCCATCCTCACT GTCTGCATCTGTAGGAGACAGAGTCACCATCA CTTGTCGGGCAGTCAGGGCATTAGCAATTAT TTAGCCTGGTTTCAGCAGAAACCAGGAAAGC CCCTAAGTCCCTGATCTCTGCTGCATCCAGTTT GCAAACTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATAATAGTTACCCATTCA CTTTCGGCCCTGGGACCAAAGTGGATATCAAA

SEQ ID NO: 24545 | GAGGTGCAGCTGTTGGAGTCTGGGGGAGGCCTG GTACAGCCGGGGGGGTCCCTGAGACTCTCCTGTG CAGCCTCTGGATTCACCTTTAGCAGCTATGTCAT GAACTGGGTCCGCCAGGCTCCAGGGAAGGGGCT GGAGTGGGTCTCAGCTATTAGTGGTAGTGGTGGT AGCACATACTACGCAGACTCCGTGAAGGGCCGG TTCACCATCTCCAGAAACAATTCCAAGAACACGC TGTATCTGCAAATGAACAGCCTGAGAGCCGAGG ACACGGCCGTATATTACTGTGCGCAACTGGGGT CTTTGACTACTGGGGCCAGGGAACCCTGGTCACC GTCTCCTCA

SEQ ID NO: 28551 |

FIGURE 50
(Continued)

| | | AA | DIQMTQSPSSLSASVGDRVTITCRASQGISNYLAWFQQKPGKAPKSLISAASSLQTGVPSKFSGSGSGTDFTLTISSLQPEDFATYYCQQYNSYPFTFGPGTKVDIK<br>SEQ ID NO: 24546 | EVQLLESGGGLVQPGGSLRLSCAASGFTFSSYVMNWVRQAPGKGLEWVSAISGSGGSTYYADSVKGRFTISRNNSKNTLYLQMNSLRAEDTAVYYCARTGVFDYWGQGTLVTVSS<br>SEQ ID NO: 28552 |
|---|---|---|---|---|
| iPS:392964 | 21-225_31A8 | NA | GACATCCAGATGACCCAGTCTCCATCCTCCCTGTCTGCATCTGTAGGAGACAGAGTCACCATCACTTGCCGGGCAAGTCAGGACATTAGAAGTGATTTAGGCTGGTATCAGCAGAAACCAGGGAAAGCCCCTAAGCGCCTGATCTATGCTGTATCCAGTTTGCAAAGTGGGGTCCCATCAAGGTTCAGCGGCAGTGGCTCTGGGACAGAATTCACTCTCACAATCAGCAGCCTGCAGCCTGAAGATTTTGCCACTTATTACTGTCTACAGCATACTATTTACCCTCCTACTTTCGGCGGAGGGACCAAGGTGGAGATCAAA<br>SEQ ID NO: 24547 | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGCCATGAGCTGGGTCCGCCAGGCTCCAGGGAAGGGTCTGGAGTGGGTCTCCGCTATTAGTGGTAGTGGTGGTAGCACATTCCACGCAGACTCCGTGAAGGGCCGGTTCACCATCTGCAAATGAACAGCCTGAGAGACGAGGTGTATCTGCAAATGAACAGCCTGAGAGACGAGGACACGGCCGTATATTACTGTGTGAAAGGGAGCTACTAGAGGACTACTACTTCTACGGTATGGACGTCTGGGGCCAAGGGACCACGGTCACCGTCTCCTCA<br>SEQ ID NO: 28553 |
| | | AA | DIQMTQSPSSLSASVGDRVTITCRASQDIRSDLGWYQQKPGKAPKRLIYAVSSLQSGVPSRFSGSGSGTEFTLTISSLQPEDFATYYCLQHTIYPPTFGGGTKVEIK<br>SEQ ID NO: 24548 | EVQLLESGGGLVQPGGSLRLSCAASGFTFSSYAMSWVRQAPGKGLEWVSAISGRGGSTFHADSVKGRFTISRDNSKNTLYLQMNSLRDEDTAVYYCVKGELLEDYYFYGMDVWGQGTTVTVSS<br>SEQ ID NO: 28554 |

FIGURE 50
(Continued)

| | | | |
|---|---|---|---|
| iPS:392966 | 21-225_32G3 | NA | GACATCCAGATGACCCAGTCTCCAACCTCACT<br>GTCTGCATCTGTCGGAGACAGAGTCACCATCA<br>CTTGTCGGGCGAGTCAGGCCATTAGCAATTAT<br>TTAGCCTGGTTTCAGCAGAAACCAGGGAAAGC<br>CCCTAAGTCCCTGATCTATGATGCATCCAGTTT<br>GCAAAGTGGGGTCCCATCAAAATTCAGCGGCA<br>GTGGGTCTGGGACAGATTTCACTCTCACCATC<br>AGCAGCCTACAGCCTGAAGATTTTGCAACTTA<br>TTACTGCCAACAGTATCATAGTTACCCGCTCA<br>CTTTCGGCGGAGGGACCAAGGTGGAGATCAA<br>G<br><br>SEQ ID NO: 24549 | GAGGTGCAGCTGGTGGAGTCTGGGGGAGGCCTG<br>GTCCAAGCCTGGGGGGTCCCTGAGACTCTCCTGTG<br>CAGCCTCTGGATTCACCTTCAGTAGCTATAGCAT<br>GAACTGGGTCCGCCAGGCTCCAGGGAAGGGGCT<br>GGAGTGGGTCTCATCATTAGTGGTAGTAGT<br>TACATATACTACGCAGACTCAGTGAAGGGCCGAT<br>TCACCATCTCCAGAGACAACGCCAAGAACTCACT<br>GTATCTGCAAATCAACAGCCTGAGAGCCGAGGA<br>CACGGCTGTGTATTACTGTGCGAGAGGCAATATA<br>GCAAGGGACTACTGGGGCCAGGGAACCCTGGTC<br>ACCGTCTCCTCA<br><br>SEQ ID NO: 28555 |
| | | AA | DIQMTQSPTSLSASVGDRVTITCRASQAISNYLA<br>WFQQKPGKAPKSLIYDTSSLQSGVPSKFSGSGSG<br>TDFTLTISTLQPEDFATYYCQQYHSYPLTFGGGT<br>KVEIK<br><br>SEQ ID NO: 24550 | EVQLVESGGGLVKPGGSLRLSCAASGFTFSSYSMN<br>WVRQAPGKGLEWVSSISGSSSYIYYADSVKGRFTIS<br>RDNAKNSLYLQINSLRAEDTAVYYCARGNIARDY<br>WGQGTLVTVSS<br><br>SEQ ID NO: 28556 |
| iPS:392968 | 21-225_25B6 | NA | GACATCCAGATGACCCAGTCTCCATCTCCCT<br>GTCTGCATCTGTAGGAGACAGAGTCACCATCA<br>CTTGCCGGGCAAGTCAGGGCATTAGAGAATGAT<br>TTAGGCTGGTATCAGCAGAAACCAGGAAAAG<br>CCCCTAAGCGCCTGATCTATCGTGCATCCAGT<br>TTGCAAAGTGGGGTCCCATCAAGGTTCAGCGG<br>CAGTGGATCTGGGACAGATTCACTCTCACAA<br>TCAGCAGCCTGCAGCCTGAAGATTTTGCAACT<br>TATTACTGTCTACAGCATAATAGTTACCCATTC<br>ACTTTCGGCCCTGGGACCAAAGTGGATATCAA<br>A<br><br>SEQ ID NO: 24551 | CAGGTGCAGCTGGTGGAGTCTGGGGGAGGCGTG<br>GTCCAGCCTGGGAGGTCCCTGAGAGTCTCCTGTA<br>CAGCGTCTGGATTCACCTTCACCCTCAGAAACTATGGCAT<br>GCACTGGGTCCGCCAGGCTCCAGGCAAGGGGCT<br>GGAGTGGGTGGCAGTTATATACAGAGTCGTGAGGAAAG<br>TAATAAATACTATACAGGACACAATTCAAGAACACG<br>ATTCACCATCTCCAGAGACAATGAACAGCCTGAGAGCCGAG<br>CTGTATCTGCAAATGAACAGCCTGAGAGCCGAG<br>GACACGGCTGTGTATTACTGTGCGAGAGAACTGG<br>GGTTCCTCTGACTACTGGGGCCAGGGAACCCT<br>GGTCACCGTCTCCTCA<br><br>SEQ ID NO: 28557 |

FIGURE 50
(Continued)

| | | | |
|---|---|---|---|
| iPS:392972 | 21-225_26A2 | AA | DIQMTQSPSSLSASVGDRVTITCRASQGIRNDLGWYQQKPGKAPKRLIYRASSLQSGVPSRFSGSGSGTEFTLTISSLQPEDFATYYCLQHNSYPFTFGPGTKVDIK<br>SEQ ID NO: 24552 | QVQLVESGGGVVQPGRSLRVSCTASGFTLRNYGMHWVRQAPGKGLEWVAVIWYEESNKYYTESVKGRFTISRDNSKNTLYLQMNSLRAEDTAVYYCARELGFLSDYWGQGTLVTVSS<br>SEQ ID NO: 28558 |
| | | NA | GACATCCAGATGACCCAGTCTCCATCCTCCCTGTCTGCATCTGTAGGAGACAGAGTCACCATCACTTGCCGGGCAAGTCAGGGCATTAGAAGTGATTTAGGCTGGTATCAGCAGAAACCAGGGAAAGCCCCTAAGCGCCTGATCTATACTGCATCCAGTTTGCAGAGTGGGGTCCCATCAAGATTCAGCGGCAGTGGATCTGGGACAGAATCACTCTCACATTCAGCAGCCTGCAGCCTGAAGATTTTGCAACGTATTACTGTCTACAGCATAATCGTTACCCGTGGACGTTCGGCCAAGGGACCAAGGTGGAAATCAAA<br>SEQ ID NO: 24553 | CAGGTGCAGCTGGTGGAGTCTGGGGGAGGCGTGGTCCAGCCTGGGAGGTCCCTGAGACTCTCCTGTGCAGCCGTCTGGATTCACCTTCAGTAGCTATGGCATGCACTGGGTCCGCCAGGCTCCAGGCAAGGGGCTGGAGTGGGTGGCAGTTATATGGTATGAAGGAAGTAATAAATACTATGTAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAATTAGGCTGGTACGACGACTACTGGGGCCAGGGAACCCTGGTCACCGTCTCCTCA<br>SEQ ID NO: 28559 |
| | | AA | DIQMTQSPSSLSASVGDRVTITCRASQGIRSDLGWYQQKPGKAPKRLIYTASSLQSGVPSRFSGSGSGTEFTLTFSSLQPEDFATYYCLQHNRYPWTFGQGTKVEIK<br>SEQ ID NO: 24554 | QVQLVESGGGVVQPGRSLRLSCAASGFTFSSYGMHWVRQAPGKGLEWVAVIWYEGSNKYYVDSVKGRFTISRDNSKNTLYLQMNSLRAEDTAVYYCARELGWYDDYWGQGTLVTVSS<br>SEQ ID NO: 28560 |

FIGURE 50
(Continued)

| | | | |
|---|---|---|---|
| iPS:392974 | 21-225_26A11 | NA | GACATCCAGATGACCCAGTCTCCAATTTCCT GTCTGCATCTGTAGGAGACAGAGTCACCATCA CTTGCCGGGCAAGTCAGGCCATTAGAAATGAT TTAGGCTGGTATCAGCAGAAACCAGGGAAAG CCCCTAAGCGCCTGATCTATCGTGCATCCAGT TTGCAAAGTGGGGTCCCATCAAGGTTCAGCGG CAGTGGATCTGGGACAGAATTTATTCTCACAA TCAGCAGCCTGCAGCCTGAAGATTTTGCAACT TATTACTGTCTACAGCATTATAATTACCCTCGC AGTTTTGGCCAGGGGACCAAGCTGGAGATCAG A<br><br>SEQ ID NO: 24555 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTGTGTCAT GCACTGGGTCCGCCAGGCTCCAGGCAAGGGGCT GGAGTGGGTGGCAGTTATATGTATGATGGAAGT AATAAATACTATGCAGACTCCGTGAAGGGCCGA TTCACCATCTCCAGAGACAATTCCAAGAACAGC TGTATCTGCAAATGAACAGCCTGAGAGCCGAGG ACACGGCTGTGTATTACTGTGCGAGAGAGGAGTA TAGCAGTGGCTGGTACGACTACGGTATGGACGTC TGGGGCCAAGGGACCACGGTCACCGTCTCCTCA<br><br>SEQ ID NO: 28561 |
| | | AA | DIQMTQSPISLSASVGDRVTITCRASQAIRNDLG WYQQRPGKAPKRLIYAASSLQSGVPSRFSGSGS GTEFILTISSLQPEDFATYYCLQHYNYPRSFGQGT KLEIR<br><br>SEQ ID NO: 24556 | QVQLVESGGGVVQPGRSLRLSCAASGFTFSNCVMH WVRQAPGKGLEWVAVIWYDGSNKYYADSVKGRF TISRDNSKNTLYLQMNSLRAEDTAVYYCAREEYSS GWYDYGMDVWGQGTTVTVSS<br><br>SEQ ID NO: 28562 |
| iPS:392976 | 21-225_27H12 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCAATGGTGCATCCAGT TGCAAAGTGGGGTCCCATCAAAGTTCAGCGGC AGTGGATCTGGGACAGATTTCACTCTCACCAT CAGCAGCCTGCAGCCTGAAGATTTTGCAACTT ATTACTGCCAACAGTATTATAGTTACCCATTC ACTTTCGGCCCTGGGACCAAAGTGAATATCAA T<br><br>SEQ ID NO: 24557 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCCT GAACTGGGTCCGCCAGGCTCCAGGGAAGGGGCT GGAGTGGGTCTCATCCATTAGTGGTAGTAGT AACATATACTACACAGACTCAGTGAAGGGCCGA TTCACCATCTCCAGAGACAACGCCAAGAACTCAC TGTTTCTGCAAATGAACAGCCTGAGAGCCGAGG ACACGGCTGTGTATTACTGTGCGAGAGTGGCGTC CTTTGACTACTGGGGCCAGGGAACCCTGGTCACC GTCTCCTCA<br><br>SEQ ID NO: 28563 |

FIGURE 50
(Continued)

| | | | | |
|---|---|---|---|---|
| iPS:392978 | 21-225_28B8 | AA | DIQMTQSPSSLSASVGDRVTITCRASQGISNYLA WFQQKPGKAPKSLINGASSLQSGVPSKFSGSGSG TDFTLTISSLQPEDFATYYCQQYSYPFTFGPGT KVNIN<br>SEQ ID NO: 24558 | EVQLVESGGGLVKPGGSLRLSCAASGFTFSSYSLN WVRQAPGKGLEWVSSISGSSNIYTDSVKGRFTIS RDNAKNSLFLQMNSLRAEDTAVYYCARVASFDYW GQGTLVTVSS<br>SEQ ID NO: 28564 |
| | | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCACAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATAGTTACCCATTC ACTTTCGGCCCTGGGACCAAAGTGGATATCAA T<br>SEQ ID NO: 24559 | CAGGTGCAGCTGGTGGAGTCTGGGGGAGGCGTG GTCCAGCCTGGGAGGTCCCTGAGACTCTCTGTG CAGCGTCTGGATTCACCTTCAGTGACTATGCAT GCACTGGGTCCGCCAGGCTCCAGGCAAGGGCT GGAGTGGGTGACAGTTATATGTATGATGCAAAT AATAAATACTATGCAGACTCCGTGAAGGGCCGA TTCACCATCTCCAGAGACAATTTCAAAAACACGG TGTATCTGCAAATGAACAGCCTGAGAGCCGAGG ACACGGCTGTGTATTACTGTGCGAGAGAAATTGG CTGGTTAGATGACTACTGGGGCCAGGGAACCCTG GTCACCGTCTCCTCA<br>SEQ ID NO: 28565 |
| | | AA | DIQMTQSPSSLSASVGDRVTITCRASQGIRNDLG WYQHKPGKAPKRLIYAASSLQSGVPSRFSGSGS GTEFTLTISSLQPEDFATYYCLQHNSYPFTFGPGT KVDIN<br>SEQ ID NO: 24560 | QVQLVESGGGVVQPGRSLRLSCAASGFTFSDYGM HWVRQAPGKGLEWVTVIWYDANNKYYADSVKGR FTISRDNFKNTVYLQMNSLRAEDTAVYYCAREIGW LDDYWGQGTLVTVSS<br>SEQ ID NO: 28566 |

FIGURE 50
(Continued)

| | | | |
|---|---|---|---|
| iPS:392980 | 21-225_29H6 | NA | GACATCCAGATGACCCAGTCTCCATCCTCCCT GTCTGCATCTGTAGGAGACAGAGTCACCATCA CTTGCCGGGCAAGTCAGGGACATTAGAAATGAT TTAGGCTGGTATCAGCAGAAATCAGGGAAAA CCCCTAAGCGCCTGATCTATGCTGCATCCAGT TTGCAAAGTGGGGTCCCATCAAGGTTCAGCGG CAGTGGATCTGGGACAGAGATTCACTCTCACAA TCAGCAGTCTGCAGCCTGAAGATTTTGCAACC TATTACTGTCTACAGCATAATAGTTACCCGCTC ACTTTCGGCGGAGGGACCAAGGTGGAGATCA AA SEQ ID NO: 24561 | CAGGTGCAGCTGGTGGTGAGTCTGGGGGAGGCGTG GTCCAGCCTGGGAGGTCCCTGAGACTCTCCTGTG CAGCGTCTGGATTCACCTTCAGTGACTACTGGCAT GCACTGGGTCCGCCAGGCTCCAGGCAAGGGGCT GGAGTGGGTGACAGTTATATGTATAATGAAAAT AATAAATACTATGCAGACTCCGTGAAGGGCCGA TTCACCATCTCCAGAGACAATTCCAAGAACACGC TGTATCTGCAAATGAACAGCCTGAGAGAACTGGG ACACGGCTGTGTATTACTGTGCGAGAGAACTGG GATGACGGGTGACTCCTGGGGCCAGGGAACCCT GGTCACCGTCTCCTCA SEQ ID NO: 28567 |
| | | AA | DIQMTQSPSSLSASVGDRVTITCRASQGIRNDLG WYQQKPGKTPKRLIYAASSLQSGVPSRFSGSGSG TEFTLTISSLQPEDFATYYCLQHNSYPLTFGGGT KVEIK SEQ ID NO: 24562 | QVQLVESGGGVVQPGRSLRLSCAASGFTFSDYGM HWVRQAPGKGLEWVTVIWYNENNKYYADSVKGR FTISRDNSKNTLYLQMNSLRAEDTAVYYCARELGM TGDSWGQGTLVTVSS SEQ ID NO: 28568 |
| iPS:392982 | 21-225_30D1 | NA | GACATCCAGATGACCCAGTCTCCATCCTCCCT GTCTGCATCTGTAGGAGACAGAGTCACCATCA CTTGCCGGGCAAGTCAGGGACATTAGAAGTGAT TTAGGCTGGTATCAACAGAAACCAGGGAAAG CCCCTGAGCGCCTGATCTATGCTGCATCCAGT TTGCAAAGTGGGGTCCCATCAAGGTTCAGCGG CAGTGGATCTGGGACAGAGATTCACTCTCACAA TCAGCAGCCTGCAGCCTGAAGATTTTACAACT TATTACTGTCTACAGCATACTATTTACCCTCCT ACTTTCGGCGGAGGGACCAAGGTGGAGATCA AA SEQ ID NO: 24563 | GAGGTGCAGCTGGTGTTGGAGTCTGGGGGAGGCTTG GTACAGCCTGGGGGGTCCCTGAGACTCTCCTGTG CAGCCTCTGGATTCACCTTTAGCAGTCATGCCAT GAGCTGGGTCCGCCAGGCTCCAGGGAAGGGGCT GGAGTGGGTCTCCGCTATTAGTGGTCGTGGTGGT AGCACATTCCACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGTGAAAGGGGAGCT ACTAGAGGACTACTACTTCTACGGTTTGGACGTC TGGGGCCAAGGGACCACGGTCACCGTCTCCTCA SEQ ID NO: 28569 |

FIGURE 50
(Continued)

| | | | | |
|---|---|---|---|---|
| | | AA | DIQMTQSPSSLSASVGDRVTITCRASQDIRSDLG WYQQKPGKAPERLIYAASSLQSGVPSRFSGSGSG TEFTLTISSLQPEDFTTYYCLQHTIYPPTFGGGTK VEIK<br><br>SEQ ID NO: 24564 | EVQVLESGGGLVQPGGSLRLSCAASGFTFSSYAMS WVRQAPGKGLEWVSAISGRGGSTFHADSVKGRFTI SRDNSKNTLYLQMNSLRAEDTAVYYCVKGELLED YYFYGLDVWGQGTTVTVSS<br><br>SEQ ID NO: 28570 |
| iPS:392984 | 21-225_30E11 | NA | GACATCCAGATGACCCAGTCTCCATCCTCCCT GTCTGCATCTGTAGGAGACAGAGTCACCATCA CTTGCCGGGCAAGTCAGAGCATTAGCAACTAT TTAAAATTGGTATCAACAGCAAACAGGGAAAG CCCCTAAGTTCCTGATCTATGCTGCATCCAGT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTACCCATTC ACTTTCGGCCCTGGGACCAAAGTGGATATCAA A<br><br>SEQ ID NO: 24565 | GAGGTGCAGCTGTTGGAGTCTGGGGGAGACATG GTCCAGCCTGGGGGGTCCCTGAGACTCTCCTGTG CAGCCTCCGGATTCACCTTTAGCATCTATGCCAT GAGCTGGGTCCGCCAGGCTCCAGGGAAGGGGCT GGAGTGGGTCTCAGTTATTAGTGGTAGTGGTGGT AGCTCATTCTACGCAGACTCCGTGAAGGGCCGGT TCACCATCTCCAGAGACAATTCCAAGAACACGCT GTATCTGCAAATGAACAGCCTGAGAGCTGAGGA CACGGCCGTATATTACTGTACGAAAGATCGGGTG AAAGCTCATGATGGTTTTGATATCTGGGGCCAAG GGACAATGGTCACCGTCTCTTCA<br><br>SEQ ID NO: 28571 |
| | | AA | DIQMTQSPSSLSASVGDRVTITCRASQSISNYLN WYQQQTGKAPKFLIYAASSLQSGVPSRFSGSGS GTDFTLTISSLQPEDFATYYCQQSYSTPFTFGPGT KVDIK<br><br>SEQ ID NO: 24566 | EVQLLESGGDMVQPGGSLRLSCAASGFTFSIYAMS WVRQAPGKGLEWVSVISGSGGSSFYADSVKGRFTI SRDNSKNTLYLQMNSLRAEDTAVYYCTKDRVKAH DGFDIWGQGTMVTVSS<br><br>SEQ ID NO: 28572 |

FIGURE 50
(Continued)

| | | | |
|---|---|---|---|
| iPS:392986 | 21-225_31B8 | NA | GACATCCAGATGATCCAGTCTCCATCTCCCT GTCTGCATCTGTAGGAGACAGAGTCACCATCA CTTGCCGGGCAAGTCAGGACATTAGAAGTGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATTATTTACCCTCCT ACTTTCGGCGGAGGGACCAAGGTGGAGATCA AA<br>SEQ ID NO: 24567 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGTTATGCCAT GAGCTGGGTCCGCCAGGCTCCAGGGAAGGGCT GGAGTGGGTCTCCGCTATTAGTGGTCGTGGTGGT AGCACATTCCACGCAGACTCCGTGAAGGGCCGG TTCACCATCTCCAGAGACAATTCCAAGAACACGC TGTATCTACAACTGAACAGCCTGAGAGCCGATGA CACGGCCGTATATTACTGTGTAAAGGGGAGCTA CTAGAGGACTACTACTTCTACGGTATGACGTCT GGGGCCAAGGGACCACGGTCACCGTCTCCTCA<br>SEQ ID NO: 28573 |
| | | AA | DIQMIQSPSSLSASVGDRVTITCRASQDIRSDLGW YQQKPGKAPKRLIYGASSLQSGVPSRFSGSGSGT EFTLTISSLQPEDFATYYCLQHIYPPTFGGGTKV EIK<br>SEQ ID NO: 24568 | EVQLLESGGGLVQPGGSLRLSCAASGFTFSSYAMS WVRQAPGKGLEWVSAISGRGGSTFHADSVKGRFTI SRDNSKNTLYLQLNSLRADDTAVYYCVKGELLED YYFYGMDVWGQGTTVTVSS<br>SEQ ID NO: 28574 |
| iPS:392988 | 21-225_25E6 | NA | GACATCCAGATGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCCGCGG CAGTGGATCTGGGACAGAATTCACTCTCACAA TCAACAGTCTGCAGCCTGAAGATTTTGCAACC TATTACTGTCTACAGCATAATAGTTACCCGCTC ACTTTCGGCGGAGGGACCAAGGTGGAGATCA AA<br>SEQ ID NO: 24569 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGCT GGAGTGGGTGGCAGTTATATGTATGATGAAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTCTGTATTACTGTGCACAGAACTGGG GATGACGGGTGACTCCTGGGGCCAGGGAACCCT GGTCACCGTCTCCTCA<br>SEQ ID NO: 28575 |

FIGURE 50
(Continued)

| | | | | |
|---|---|---|---|---|
| | | AA | DIQMTQSPSSLSASVGDRVTITCRASQGIRNDLG WYQRKPGKAPKRLIYAASSLQSGVPSRFRGSGS GTEFTLTINSLQPEDFATYYCLQHNSYPLTFGGG TKVEIK<br>SEQ ID NO: 24570 | QVQLVESGGGVVQPGRSLRLSCAASGFTFSDYGM HWVRQAPGKGLEWVAVIWYDENNKYYADSVKGR FTISRDNSKNTLYLQMNSLRAEDTALYYCATELGM TGDSWGQGTLVTVSS<br>SEQ ID NO: 28576 |
| iPS:392990 | 21-225_25H10 | NA | GACATCCAGATGACCCAGTCTCCATCCTCCT GTCTGCATCTGTAGGAGACAGAGTCACCATCA CTTGCCGGGCAAGTCGGGGCATTAGAAATGAT TTAGGCTGGTATCAGCAGAAACCAGGAAAG CCCCTAAGCGCCTGATCTATGCTGCATTCAGTT TGCAAAGTGGGGTCCCATCAAGGTTCAGCGGC AGTGGATCTGGGACAGATTCACTCTCACAAT CAGCAGCCTGCAGCCTGAAGATTTTGCAACTT ATTACTGTCTACAGCATAATAGTTACCCGCTC ACTTTCGGCGGAGGGACCAAGGTGGAGATCA AA<br>SEQ ID NO: 24571 | CAGGTGCAGCTGGTGGAGTCTGGGGGAGGCGTG GTCCAGCCTGGGAGGTCCCTGAGACTCTCTGTG CAGCGTCTGGATTCACCTTCAGTGACTATGGCAT GCACTGGGTCCGCCAGGCTCCAGGCAAGGGCT GGAGTGGGTGGCAGTTATATGGTATGATGAAAGT AATAAATACTATGCAGACTCCATGAAGGGCCGA TTCACCATCTCCAGAGACAACAATTCCAAGAACACGC TGTATCTGCAAATGAACAGCCTGAGAGCCGAGG ACACGGCTGTGTATTACTGTGCGAGAGAACTGGG GATGACGGGTGACTACTGGGGCCAGGAACCCT GGTCACCGTCTCCTCA<br>SEQ ID NO: 28577 |
| | | AA | DIQMTQSPSSLSASVGDRVTITCRASRGIRNDLG WYQQKPGKAPKRLIYAAFSLQSGVPSRFSGSGS GTEFTLTISSLQPEDFATYYCLQHNSYPLTFGGG TKVEIK<br>SEQ ID NO: 24572 | QVQLVESGGGVVQPGRSLRLSCAASGFTFSDYGM HWVRQAPGKGLEWVAVIWYDESNKYYADSMKGR FTISRDNSKNTLYLQMNSLRAEDTAVYYCARELGM TGDYWGQGTLVTVSS<br>SEQ ID NO: 28578 |

FIGURE 50
(Continued)

| | | | | |
|---|---|---|---|---|
| iPS:392992 | 21-225_26C4 | NA | GACATCGTGATGACCCAGTCTCCAGACTCCT GGCTGTGTCTCTGGGCGAGAGTGTCCATCA ACTGCAAGTCCAGCAGAGTGTTTATACCGC TCCAACAATTACAACTACTTAGCTTGGTACCA GCACAAACCAGGACAGCCTCCAAAGCTGCTCA TTTACTGGGCATCTACCCGGGAATCCGGGGTC CCTGACCGCTTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCCGACGTTCGGCCAAGG GACCAAGGTGGAATTCAAA SEQ ID NO: 24573 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCTCTGGACAAGGGC TTGAGTGGATGGGATGGATGAACCCTAACAGTG GTAACACAGGCTATGCACAGAGATTCCAGGCA GAGTCACCATGACCAGGAACACCTCCATAAACA CAGCCTACATGGAGCTGAGCAGCCTGAGATCTG AGGACACGGCCGTATATTACTGTGCGAGTAGCA GTGGCTGGTACTACTTTGACTACTGGGGCCAGGG AACCCTGGTCACCGTCTCCTCA SEQ ID NO: 28579 |
| | | AA | DIVMTQSPDSLAVSLGERATINCKSSQSVLYRSN NYNYLAWYQHKPGQPPKLLIYWASTRESGVPD RFSGSGSGTDFTLTISSLQAEDVAVYYCQQYYST PPTFGQGTKVEFK SEQ ID NO: 24574 | QVQLVQSGAEVKKPGASVKVSCKASGYTFTNYDIN WVRQASGQGLEWMGWMNPNSGNTGYAQRFQGR VTMTRNTSINTAYMELSSLRSEDTAVYYCASSSGW YYFDYWGQGTLVTVSS SEQ ID NO: 28580 |
| iPS:392994 | 21-225_26G11 | NA | GATATTGTGATGACCCAGACTCCACTCTCT GTCCGTCACCCTGGACAGCCGGGCTCCATCT CCTGCAAGTCTAGTCAGAGCCTCCTGCATGGT GAAGGAAAGACCTATTTGTATTGGTACCTGCA GAAGCCAGGCCAGCCTCCACACCTCCTGATCT ATGAAGTTTCCAACCGGTTCTCTGGAGTGCCA GATAGGTTCAGTGGCAGCGGGTCAGGGACAG ATTTCACACTGAAAATCAGCCGGGTGGAGGCT GAGGATGTTGGGATTTATTACTGCATGCAAAG TATAAAGTTCCGCTCACTTTCGGCGGAGGGA CCAAGGTGGAGATCAAA SEQ ID NO: 24575 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAACAGCCAAGAACACGC TGTATCTGCAAATGAACAGCCTGAGAGCCGAGG ACACGGCTGTGTATTACTGTGCGAGAAGGTATAG CAACAGCTGGTCAGGGGTATGGACGTCTGGGG CCAAGGGACCACGGTCACCGTCTCCTCA SEQ ID NO: 28581 |

FIGURE 50
(Continued)

| | | | | |
|---|---|---|---|---|
| | | AA | DIVMTQTPLSLSVTPGQPASISCKSSQTLLHGEGK TYLYWYLQKPGQPPHLLIYEVSNRFSGVPDRFSG SGSGTDFTLKISRVEAEDVGIYYCMQSIKLPLTFG GGTKVEIK<br>SEQ ID NO: 24576 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSNS WSGGMDVWGQGTTVTVSS<br>SEQ ID NO: 28582 |
| iPS:392996 | 21-225_28B1 | NA | GACATCCAGATGACCCAGTCTCCATCTTCCGT GTCTGCATCTGTAGGAGACAGAGTCACCATCA CTTGTCGGGCAGTCAGGCTATCAATGACTGG TTAGCCTGGTATCAGCAGAAACCAGGAAAG CCCCTAAGCTCCTGATCTATGCTGCATCCAGTT TCCAAAGTGGGGTCCCATCAAGGTTCAGCGGC AGTGGATCTGGGACAGATTCACTCTCACCAT CACCAGCCTGCAGCCTGAAGATTTTGCAACTT ACTATTGTCAACAGGCTAGCAGTTTCCCATTC ACTTTCGGCCCTGGGACCAAAGTGGATATCAA A<br>SEQ ID NO: 24577 | GAGGTGCAGCTGTTGGAGTCTGGGGGAGGCTTG GTACAGCCTGGGGGGTCCCTGAGATTGTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTAGTGGAGGT AACACATTCTACGCAGACTCCGTGAAGGGCCGGT TCACCATCTCCAGAGACAACAATTCCAAGAACACGCT GTATCTGCAAATGAACAGCCTGAGAGCCGAGGA CACGGCCGTATATTACTGTGCGAAATTGGGGCGT ATAGCAGTGACTGTCCTTACTTTGACTACTGGG GCCAGGGAACCCTGGTCACCGTCTCCTCA<br>SEQ ID NO: 28583 |
| | | AA | DIQMTQSPSSVSASVGDRVTITCRASQAINDWLA WYQQKPGKAPKLLIYAASSFQSGVPSRFSGSGSG TDFTLTITSLQPEDFATYYCQQASSFPFTFGPGTK VDIK<br>SEQ ID NO: 24578 | EVQLLESGGGLVQPGGSLRLSCAASGFTFSSYAMS WVRQAPGKGLEWVSAISGSGGNTFYADSVKGRFTI SRDNSKNTLYLQMNSLRAEDTAVYYCAKLGRIAV TGPYFDYWGQGTLVTVSS<br>SEQ ID NO: 28584 |

FIGURE 50
(Continued)

| | | | |
|---|---|---|---|
| iPS:392998 | 21-225_28A9 | NA | GACATCCAGATGACCCAGTCTCCATCTCCCT GTCTGCATCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCTATGCTGTTCTAGTT TGCAAAATGGAGTCCCATCAAGGTTCAGCGGC AGTGGATCTGGGACAGATTCACTCTCACAAT CAGCAGCCTGCAGCCTGAAGATTTTGCAACTT ATTACTGTCTACAGCATAATCGTTACCCATTCA CTTTCGGCCCTGGGACCAAAGTGGATATCAAA SEQ ID NO: 24579 | CAGGTGCAGCTGGTGGAGTCTGGGGGAGGCGTG GTCCAGCCTGGGAGGTCCCTGAGACTCTCTGTG CAGCGTCTGGATTCACCTTCAGTAGCTATGGCAT ACACTGGGTCCGCCAGGCTCCAGGCAAGGGGCT GGAGTGGGTGGCAGTTATATGGTTTGATGAAGT AATAAATACTATGCAGACTCCGTGAAGGGCCGA TTCACCATCTCCAGAGACAATTCCAAGAACACGC TGTTTCTGCAAATGAACAGCTGAGAGTCGAGGA CACGGCTGTGTATTACTGTGCGAGAGAAATTGGC TGGTTAGATGACTACTGGGGCCAGGGAACCCTG GTCACCGTCTCCTCA SEQ ID NO: 28585 |
| | | AA | DIQMTQSPSSLSASVGDRVTITCRASQGIRNDLG WYQQKPGKAPKRLIYAASSLQNGVPSRFSGSGS GTEFTLTISSLQPEDFATYYCLQHNRYPFTFGPGT KVDIK SEQ ID NO: 24580 | QVQLVESGGGVVQPGRSLRLSCAASGFTFSSYGIH WVRQAPGKGLEWVAVIWFDGSNKYYADSVKGRF TISRDNSKNTLFLQMNSLRVEDTAVYYCAREIGWL DDYWGQGTLVTVSS SEQ ID NO: 28586 |
| iPS:393000 | 21-225_29D7 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAACAGAAACCAGGGAAAG CCCCTAAGCTCCTGATCTATGCTGCATCCAGT TTACAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A SEQ ID NO: 24581 | CAGGTGCAACTGGTGGAGTCTGGGGGAGGCGTG GTCCAGCCTGGGAGGTCCCTGAGACTCTCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGAAGT AATAAATACTATCCAGAGACAATTCCAAGAACACGC TTCACCATCTGCAAATGAACAGCTCAAGAGACACGG TGTATCTGCAAATGAACAGCTGTGGAGAGAACTGG ACACGGCTGTCTGTATTACTGTGGAGAGAACTGGG GTCCTCTGCTGACTACTGGGGCCAGGGAACCCTG GTCACCGTCTCCTCA SEQ ID NO: 28587 |

FIGURE 50
(Continued)

| | | | | |
|---|---|---|---|---|
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGPGTKVDIK | QVQLVESGGGVVQPGRSRLRLSCAASGFTFSSYGMHWVRQAPGKGLEWVAVIWYDESNKYYGDSVKGRFTISRDNSKNTLYLQMNSLRGEDTALYYCARELGFLSDYWGQGTLVTVSS |
| | | | SEQ ID NO: 24582 | SEQ ID NO: 28588 |
| | | NA | GACATCCAGATGACCCAGTCTCCATCCTCCTGTCTGCATCTGTAGGAGACAGAGTCACCATCACTTGCCGGGCAAGTCAGAACATTTACAGCTATTTAAATTGGTATCAGCAGAAACCAGGGAAAGACCCTAAGCTCCTGATCTATGCTGCATCCAGTTTGCATAGTGGGGTCCCGTCACGGTTCAGTGGCAGTGGTTCTGGGACAGATTTCACTCTCACCATCAGCAGTCTGCAACCTGAAGATTTTGCAACTTACTACTGTCAACAGAGTTACAGTACTCCGCTCACTTTCGGCGGAGGGACCAAGGTGGAGATCAAA | CAGGTGCAGCTGGTGGAGTCTGGGGGAGGCGTGGTCCAGCCTGGGAGGTCCCTGAGACTCTCCTGTGCAGCCGTCTGGATTCACCTTCAGTTACTATGGCATGCACTGGGTCCGCCAGGCTCCAGGCAAGGGCTGGAGTGGGTGGCAGTTATATGGCATGATGAAGTAATAAATACTATGTAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAAAATAGCAGTTCGTACTACTTTGACTACTGGGGCCAGGGAACCCTGGTCACCGTCTCCTCA |
| | | | SEQ ID NO: 24583 | SEQ ID NO: 28589 |
| iPS:393002 | 21-225_30G1 | AA | DIQMTQSPSSLSASVGDRVTITCRASQNIYSYLNWYQQKPGKDPKLLIYAASSLHSGVPSRFSGSGSGTDFTLTISSLQPEDFATYYCQQSYSTPLTFGGGTKVEIK | QVQLVESGGGVVQPGRSRLRLSCAASGFTFSYYGMHWVRQAPGKGLEWVAVIWHDGSNKYYVDSVKGRFTISRDNSKNTLYLQMNSLRAEDTAVYYCARENSSSYYFDYWGQGTLVTVSS |
| | | | SEQ ID NO: 24584 | SEQ ID NO: 28590 |

FIGURE 50
(Continued)

| | | | |
|---|---|---|---|
| iPS:393004 | 21-225_30G11 | NA | GACATCCAGATGACCCAGTCTCCATCTCCCT GTCTGCATCTGTAGGAGACAGAGTCACCATCA CTTGCCGGGCAAGTCAGGACATTAGAAGTGAT TTAGGCTGGTATCAGCAGAAACCAGGAAAG CCCCTAAGCGCCTGATCTATGCTGCATCAGT TTGCAAAGTGGGGTCCCATCAAGGTTCAGCGG CAGTGGATCTGGGACAGAATTCACTCTCACAA TCGGCAGCCTGCAGCCTGAAGATTTTGCAACT TATTTCTGTCTACAGCATACTATTTACCCTCCT ACTTTCGGCGGAGGGACCAAGGTGGAGATCA AA<br>SEQ ID NO: 24585 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCCGCTATTAGTGGTGGTGGT AGCACATTCAACGCAGACTCCGTGAAGGGCCGG TTCACCATCTCCAGAGACAATTCCAAGACCACGC TGTATCTGCAAATGAACAGCCTGAGAGCCGAGG ACACGGCCGTATATTACTGTGTGAAAGGGAGCT ACTAGAGGACTACTACTTCTACGGTATGGACGTC TGGGGCCAAGGGACCACGGTCACCGTCTCCTCA<br>SEQ ID NO: 28591 | |

| | | | AA | DIQMTQSPSSLSASVGDRVTITCRASQDIRSDLG WYQQKPGKAPKRLIYAASSLQSGVPSRFSGSGS GTEFTLTIGSLQPEDFATYFCLQHTIYPPTFGGGT KVEIK<br>SEQ ID NO: 24586 | EVQLLESGGGLVQPGGSLRLSCAASGFTFSSYAMS WVRQAPGKGLEWVSAISRGGSTFNADSVKGRFTI SRDNSKTTLYLQMNSLRAEDTAVYYCVKGELLED YYFYGMDVWGQGTTVTVSS<br>SEQ ID NO: 28592 |

| iPS:393086 | 21-225_31G9 | NA | GACATCCAGATGACCCAGTCTCCATCTCCCT GTCTGCATCTATAGGAGACAGAGTCACCATCA CTTGCCGGGCAAGTCAGGGCATTAGAAATGAT TTAGGCTGTGTATCAGCAGAAACCAGGAAAG CCCCTAAGCGCCTGATCTATCTGCATCCAGTT TGCAAAGTGGGGTCCCATCAAGGTTCAGCGGC AGTGGATCTGGGACAGAGTTCACTCTCACAAT CAGCAGCCTGCAGCCTGAAGATTTTGCAACTT ATTACTGTCTACAGGATAATAGTTACCCTTTCA CTTTCGGCCCTGGGACCAAAGTGGATATCAAA<br>SEQ ID NO: 24587 | GAGGTGCAGCTGGTGGAGTCTGGGGGAGGCCTG GTCAAGCCTGGGGGGTCCCTGAGACTCTCCTGTG CAGCCTCTGGATTCACTTCAGTAGCTATAGCAT GAACTGGGTCCGCCAGGCTCCAGGGAAGGGGCT GGAGTGGGTCTCATCAATTAGTAGTAGTAGTAGT TACATATACTACGCAGACTCAGTGAAGGGCCGAT TCACCATCTCCAGAGACAACGCCAAGAACTCACT GTATCTGCAAATGAACAGCTGAGAGCCGAGGA CACGGCCGTGTATTACTGTGCGAGAGATCGAGGC AGCAGCTGGGGCCAGGGAACCCTGGTCACCGTC TCCTCA<br>SEQ ID NO: 28593 | |

FIGURE 50
(Continued)

| | | | | |
|---|---|---|---|---|
| iPS:393010 | | AA | DIQMTQSPSSLSASIGDRVTITCRASQGIRNDLG WYQQKPGKAPKRLIYPASSLQSGVPSRFSGSGSG TEFTLTISSLQPEDFATYCLQDNSYPFTFGPGTK VDIK<br>SEQ ID NO: 24588 | EVQLVESGGGLVKPGGSLRLSCAASGFTFSSYSMN WVRQAPGKGLEWVSSISSSSYIYADSVKGRFTIS RDNAKNSLYLQMNSLRAEDTAVYYCARDRGSSW GQGTLVTVSS<br>SEQ ID NO: 28594 |
| | 21-225_25E11 | NA | GACATCCAGATGACCCAGTCTCCATCTTCCGT GTCTGCATCTGTAGGAGACAGAGTCACCATCA CTTGTCGGGCGAGTCAGGGTATTAGCAACTGG TTAGCCTGGTATCAGCAGAAACCAGGGAAAG CCCCTAAGGTCCTGATCTATACTGCATCCAGTT TGCAAGGTGGGGTCCCATCAAGGTTCACTATCAGCAT AGTGGATCTGGGACAGATTTCACTATCAGCAT CAGCAGCCTGCAGCCTGAAGATTTTGCAACTT ACTATTGTCAACAGGCTAACAGTTTCCCAATC ACTTTCGGCCCTGGGACCAAAGTGGATATCAA A<br>SEQ ID NO: 24589 | GAGGTGCAGCTGTTGGAGTCTGGGGGAGGCTTG GTACAGCCTGGGGGGTCCCTGAGACTCTCCTGTG CAGCCCTCTGGATTCACCTTTAGCAGCTATGCCAT GAGCTGGGTCCGCCAGGCTCCAGGGAAGGGGCT GGAGTGGGTCTCAGTTATTAGTGGTGGTGGTGGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAACGTGGATA TAGTGGCTACGAGGACCTCCTCTACTTTGACTGC TGGGGCCAGGGAACCCTGGTCACCGTCTCCTCA<br>SEQ ID NO: 28595 |
| | | AA | DIQMTQSPSSVSASVGDRVTITCRASQGISNWLA WYQQKPGKAPKLLIYTASSLQGGVPSRFSGSGS GTDFTISISSLQPEDFATYCCQQANSFPITFGPGT KVDIK<br>SEQ ID NO: 24590 | EVQLLESGGGLVQPGGSLRLSCAASGFTFSSYAMS WVRQAPGKGLEWVSVISGGGGSTYYADSVKGRFT ISRDNSKNTLYLQMNSLRAEDTAVYYCAKRGYSG YEDLLYFDCWGQGTLVTVSS<br>SEQ ID NO: 28596 |

FIGURE 50
(Continued)

| | | | |
|---|---|---|---|
| iPS:393012 | 21-225_26G7 | NA | GATATCTTGATGACCCAGACTCCACTCTCTCTG TCCGTCACCCTGGACAGCCGGCCTCCATCTC CTGCAAGTCTAGTCAGAGCCTCCTGCATAGTG AGGGAAAGAACCTATTTGTATTGGTACCTGCAG AAGCCAGGCCAGCCTCCACAGTTCCTGATCTA TGAAGTTCCCAGACCGGCTCTGAGTGCCAG ATAGGTTCAGTGGCAGCGGGTCAGGGACAGA TTTCACACTGAAAATCAGCCGGGTTGAGGCTG AGGATGTTGGGGTTTATTACTGCATGCAAAGT ATACAGCTTCCGTCACTTTCGGCGGAGGGAC CAAGGTGGAGATCAAA<br><br>SEQ ID NO: 24591 | CAGGTGCAGCTGGTGGAGTCTGGGGGAGGCGTG GTCCAGCCTGGGAGGTCCCTGAGACTCTGTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATATTATGCAGACTCCGTGAAGGGCCGAT TCACCATCTCCAGAGACAATTCCAATAACACGCT GTATCTGCAAATGAACAGCCTGAGAGCCGAGGA CACGGCTGTGTATTACTGTGCGAGAAGGTATAGC AGCAGCTGTCAGGGGTATGACGTCTGGGGC CAAGGGACCACGGTCACCGTCTCCTCA<br><br>SEQ ID NO: 28597 |
| | | AA | DIILMTQTPLSLSVTPGQPASISCKSSQSLLHSEGK TYLYWYLQKPGQPPQFLIYEVSHRLSGVPDRFSG SGSGTDFTLKISRVEAEDVGVYYCMQSIQLPLTF GGGTKVEIK<br><br>SEQ ID NO: 24592 | QVQLVESGGGVVQPGRSLRLSCAASGFTFSSYGMH WVRQAPGKGLEWVAVIWYDGSNKYYADSVKGRF TISRDNSNTLYLQMNSLRAEDTAVYYCARRYSSS WSGGMDVWGQGTTVTVSS<br><br>SEQ ID NO: 28598 |
| iPS:393014 | 21-225_26D12 | NA | GACATCCAGATGACCCAGTCTCCATCCTCCGT GTCTGCATCTGTAGGAGACAGAGTCACCATCA CTTGTCGGGCGAGTCAGGGTATTAGTAGTTGG TTAGCCTGGTATCAGCAGAAACCAGGGAAAG CCCCTAAGCTCCTGATCTATGCTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTGTTGTCAACAGTCTGACAGTTTCCCTCGG ACGTTCGGCCAAGGGACCAAGGTGGAAATCA AA<br><br>SEQ ID NO: 24593 | CAGGTGCAGCTGGTGGAGTCTGGGGGAGGCGTG GTCCAGCCTGGGAGGTCCCTGAGACTCTCTGTG CAGCGTCTGGATTCACCTTCAGCAGTTATGGCAT GCACTGGGTCCGCCAGGCTCCAGGCAAGGGGCT GGAGTGGGTGGCAGTTATATGTATGATGGAAGT AATGAATACTATGCAGACTCCGTGAAGGGCCGA TTCACCATCTCCAGAGACAATTCCAAGAACACGC TATATCTACAAATGAACAGCCTGAGAGCCGCGG ACACGGCTGTGTATTACTGTGCGAGAGATTCCTC CCCCTACGGTATGGACGTCTGGGGCCAAGGGAC CACGGTCACCGTCTCCTCA<br><br>SEQ ID NO: 28599 |

FIGURE 50
(Continued)

| | | | |
|---|---|---|---|
| iPS:393016 | 21-225_28F11 | AA | DIQMTQSPSSVSASVGDRVTITCRASQGISSWLA WYQQKPGKAPKLLIYGASSLQSGVPSRFSASGS GTDFTLTISSLQPEDFATYCCQQSDSFPRTFGQGT KVEIK<br>SEQ ID NO: 24594 | QVQLVESGGGVVQPGRSLRLSCAASGFTFSSYGMH WVRQAPGKGLEWVAVIWYDGSNEYYADSVKGRF TISRDNSKNTLYLQMNSLRAADTAVYYCARDSSPY GMDVWGQGTTVTSS<br>SEQ ID NO: 28600 |
| | | NA | GACATCCAGATGACCCAGTCTCCATCTTCCGT GTCTGCATCTGTAGGAGACAGAGTCACCATCA CTTGTCGGGCGAGTCAGGGTATTAGCAACTGG TTAGCCTGGTATCAGCAGAAACCAGGGAAAG CCCCTAAGCTCCTGATCTCTGCATCCAATT TGCAAAGTGGGGTCCCATCAAGGTTCAGAGGC AGTGGATCTGGGACAGATTTCACTCTCACCAT CACCAGCCTGCAGCCTGAAGATTTTGCAACTT ACTGTTGTCAACAGGCTAACAGTCCCCATTC ACTTTCGGCCCTGGGACCAAAGTGGATATCAA A<br>SEQ ID NO: 24595 | GAGGTGCAGCTGTTGGAGTCTGGGGGAGGCTTG GTACAGCCGGGGGGTCCCTGAGACTCTCCTGTG CAGCCTCTGGATTCATCTTTAGCAGCTATGCCAT GAGCTGGGTCCGCCAGGCTCCAGGGAAGGGGCT GGAGTGGGTCTCAGTTACTAGTGGTAGTGGTGGT ACCACATTCTACGCAGACTCCGTGAAGGGCCGGT TCACCATCTCCAGAGACAATTCCAAGAACACGCT TTATCTGCAAATGAACAGCCTGAGAGCCGAGGA CACGGCCGTTTATTACTGTGCGAAACGGACCCAG TTTGATGATTTTGATATCTGGGGCCAAGGGACAA TGGTCACCGTCTCTTCA<br>SEQ ID NO: 28601 |
| | | AA | DIQMTQSPSSVSASVGDRVTITCRASQGISNWLA WYQQKPGKAPKLLISAASNLQSGVPSRFRGSGS GTDFTLTITSLQPEDFATYCCQQANSLPFTFGPGT KVDIK<br>SEQ ID NO: 24596 | EVQLLESGGGLVQPGGSLRLSCAASGFIFSSYAMS WVRQAPGKGLEWVSVTSGSGGTFYADSVKGRFT ISRDNSKNTLYLQMNSLRAEDTAVYYCAKRTQFDD FDIWGQGTMVTVSS<br>SEQ ID NO: 28602 |

FIGURE 50
(Continued)

| | | | |
|---|---|---|---|
| iPS:393018 | 21-225_29B8 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTAGATCTGGGACAGAATTCACTCTCACAA TCAGCAGTCTGCAGCCTGAAGATTTTGCAACC TATTACTGTCTACAGCATAATAGTTACCCGCTC ACTTTCGGCGGAGGGACCAAGGTGGAGATCA AA<br><br>SEQ ID NO: 24597 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTATGATGAAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACTGG GATGACGGGTGACTCCTGGGGCCAGGGAACCCT GGTCACCGTCTCCTCA<br><br>SEQ ID NO: 28603 |
| | | AA | DIQMTQSPSSLSASVGDRVTITCRASQGIRNDLG WYQQKPGKAPKRLIYAASSLQSGVPSRFSGSRS GTEFTLTISSLQPEDFATYYCLQHNSYPLTFGGG TKVEIK<br><br>SEQ ID NO: 24598 | QVQLVESGGGVVQPGRSLRLSCAASGFTFSDYGM HWVRQAPGKGLEWVAVIWYDENNKYYADSVKGR FTISRDNSKNTLYLQMNSLRAEDTAVYYCARELGM TGDSWGQGTLVTVSS<br><br>SEQ ID NO: 28604 |
| iPS:393020 | 21-225_30E2 | NA | GACATCCAGATGACCCAGTCTCCACATTCCCT GTCTGCATCTGTAGGAGACAGAGTCACCATCA CTTGCCAGGCGAGTCAGGACATACTTAGCAACTAT TTAAATTGGTATCAGCAGAAATCAGGAAAAGC CCCTAAGCTCCTGATCTACGATGGATCCAGT TGGAAACAGGGGTCCCATCAAGGTTCAGTGGA AGTGGATCTGGGACAGATTTTACTTTCACCAT CAGCAGCCTGCAGCCTGAAGATCTTGCAACAT ATTACTGTCAACAGTATGATAATCTCCCGATC ACCTTCGGCCAAGGGACACGACTGGAGATTAA A<br><br>SEQ ID NO: 24599 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTAGTGGCAT GCACTGGGTCCGCCAGGCTCCAGGCAAGGGGCT GGAGTGGGTGGCAGTTATATCATAGGTGGAAGT AATAAATTCTATGCAGTCTCCGTGAAGGGCCGAT TCAACATCTCCAGAGACAATTCCAAGAACACGCT GTATCTGCAAATGAACAGCCTGAGAGCTGAGGA CACGGCTGTGTATTACTGTGTGAGAAGGGGTAT AGCAGTGGAGGCTACGGTATGGACGTCTGGGGC CAAGGGACCACGGTCACCGTCTCCTCA<br><br>SEQ ID NO: 28605 |

FIGURE 50
(Continued)

| | | | | |
|---|---|---|---|---|
| iPS:393022 | 21-225_30H11 | AA | DIQMTQSPHSLSASVGDRVTITCQASQYISNYLNWYQQKSGKAPKLLIYDGSSLETGVPSRFSGSGSGTDFTFTISSLQPEDLATYYCQQYDNLPITFGQGTRLEIK<br>SEQ ID NO: 24600 | QVQLVESGGGVVQPGRSLRLSCAASGFTFSSYGMHWVRQAPGKGLEWVAVISYGGSNKFYAVSVKGRFNISRDNSKNTLYLQMNSLRAEDTAVYYCVRRGYSSGGYGMDVWGQGTTVTVSS<br>SEQ ID NO: 28606 |
| | | NA | GACATCCAGATGACCCAGTCTCCATCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGATGCATCCAGTTTGCAAAGTGGGGTCCCATCAAGGTTCAGCGGCAGTGGATCTGGGACAGAATTCACTCTCACAACTCAGCAGCCTGCAGCCTGAAGATATAGCAATTATCCACACTTCTGTCTACAGGATGAACAAGTCCTGGGACCAAAGTGGATATCCACA<br>SEQ ID NO: 24601 | GAGGTGCAGCTGGTGGAGTCTGGGGGAGGCCTGGTCAAGCCTGGGGGGTCCCTGAGACTCTCCTGTGCAGCCTCTGGATTCACCTTCAGTAGCTATAGCATGAACTGGGTCCGCCAGGCTCCAGGGAAGGGCTGGAGTGGGTCTCATCATTAGTGGTAGTAGTTACATATACTACGCAGACTCAGTGAAGGGCCGATTCACCATCTCAAGAGACAACGCCAAGAACTCACTGTATCTGCAAATGAACAGCCTGAGAGCCGAGGACACGGCTGTGTATTACTGTGCGAGATAGGGGGAGCCTCTGGGGCCAGGGAACCCTGGTCACCGTCTCCTCA<br>SEQ ID NO: 28607 |
| | | AA | DIQMTQSPSSLSASVGDRVTITCRASQGIRNDLGWYQQKPGKAPKRLVYPASSLQSGVPSRFSGSGSGTEFTLTISSLQPEDFATYYCLQDNSHPFTFGPGTKVDIT<br>SEQ ID NO: 24602 | EVQLVESGGGLVKPGGSLRLSCAASGFTFSSYSMNWVRQAPGKGLEWVSSISGSSSYIYYADSVKGRFTISRDNAKNSLYLQMNSLRAEDTAVYYCARDRGSLWGQGTLVTVSS<br>SEQ ID NO: 28608 |

FIGURE 50
(Continued)

| | | | |
|---|---|---|---|
| iPS:393024 | 21-225_31H9 | NA | GACATCCAGATGACCCAGTCTCCATCTTCCGT GTCTGCATCTGTAGGAGACAGAGTCACCATCA CTTGTCGGGCGAGTCAGGGTATTACCAGCTGG TTAACTTGGTATCAGCAGAAGCCAGGGAAAGC CCCTAAACTCCTGATCTATGATACATCCAGTT GCAAAGTGGGGTCCCATCAAGGTTCAGCGGCA GTGGATCTGGGACAGATTTCATTTTCACCATC AGCAGCCTGCAGCCTGAAGATTTTGCCACTTA TTATTGTCAACAGGGTAACAGTTTCCCATTCA CTTTCGGCCAAGGGACCAAAGTGGATATCAAA | GAGGTGCAGCTGTTGGAGTCTGGGGGAGGCTTG GTACAGCCTGGGGGCTCCCTGAGACTCTCCTGTG CAGCCTCTGGATTCACCTTTAGCAGCTGTGCCAT GAACTGGGTCCGCCAGGCTCCAGGGAAGGGGCT GGAGTGGGTCTCAGCTATTAGTGGTAGTGGTGGT AGCTCATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGAAACGGACTCCC TATGATGTCTTTGATATCTGGGGCCAAGGGACAA TGGTCACCGTCTCTCA |
| | | | SEQ ID NO: 24603 | SEQ ID NO: 28609 |
| | | AA | DIQMTQSPSSVSASVGDRVTITCRASQGITSWLT WYQQRPGKAPKLLIYDTSSLQSGVPSRFSGSGSG TDFIFTISSLQPEDFATYYCQQGNSFPFTFGQGTK VDIK | EVQLLESGGGLVQPGGSLRLSCAASGFTFSSCAMN WVRQAPGKGLEWVSAISGSGGSSFYADSVKGRFTI SRDNSKNTLYLQMNSLRAEDTAVYYCAKRTPYDV FDIWGQGTMVTVSS |
| | | | SEQ ID NO: 24604 | SEQ ID NO: 28610 |
| iPS:393026 | 21-225_32B6 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTATATTGCATCCAGTT TGCAAAGTGGGGTCCCATCAAGGTTCAGCGGC AGTGGATCTGGGACAGATTCACTCTCACAAT CAGCAGCCTGCAGCCTGAAGATTTTGCAACTT ATTACTGTCTACAGCATATAAGTTACCCGTGG ACGTTCGGCCAAGGGACCAAGGTGGAAATCA AA | CAGGTGCAGCTGTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGACAAGGGGCT GGAGTGGGTGGCAGTTATATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAGTGGGGG GACTACTGGGGCCAGGGAACCCTGGTCACCGTCT CCTCA |
| | | | SEQ ID NO: 24605 | SEQ ID NO: 28611 |

FIGURE 50
(Continued)

| | | | | |
|---|---|---|---|---|
| | | AA | DIQMTQSPSSLSASVGDRVTITCRASQGIRNDLG WYQQKPGKAPKRLIYIASSLQSGVPSRFSGSGSG TEFTLTISSLQPEDFATYYCLQHNSYPWTFGQGT KVEIK<br><br>SEQ ID NO: 24606 | QVQLVESGGGVVQPGRSLRLSCAASGFTFSDYGM HWVRQAPDKGLEWVAVIWYDENTKYYADSVKGR FTISRDNSKNTLYLQMNSLRAEDTAVYYCAREWG DYWGQGTLVTVSS<br><br>SEQ ID NO: 28612 |
| iPS:393028 | 21-225_25D7 | NA | GACATCCAGATGACCCAGTCTCCATCTTCCGT GTCTGCATCTGTAGGAGACAGAGTCACCTCA CTTGTCGGGCGAGTCAGGATATTTTCGACTGG TTAGCCTGCTGGTATCAGCAGAAACCCGGACAGC CCCTAAGCTCCTGATCTATGCTGCATCCAGTTT GCAAAGTGGGGTCCCATCAAGGTTCAGCGGCA GTGGATCTGGGACAAATTTCACTCTCACCGTC AGCGGCCTGCAGCCTGAAGATTTTGCTACTTA CTATTGTCAACAGGCTTACAGTTTCCCGTGGA CGTTCGGCCAAGGGACCAAAGTGAAATCAA A<br><br>SEQ ID NO: 24607 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGACTCCAGGGCAGGGCT GGAGTGGGTCTCAGTATTAGTGGTAGAGGTGGT ACCACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGAAAGACGGGTAC GGTGGTAACTCCTTCTTTGACTACTGGGGCCAGG GAACCCTGGTCACCGTCTCCTCA<br><br>SEQ ID NO: 28613 |
| | | AA | DIQMTQSPSSVSASVGDRVTFTCRASQDIFDWLA WYQQKPGTAPKLLIYAASSLQSGVPSRFSGSGSG TNFTLTVSGLQPEDFATYYCQQAYSFPWTFGQG TKVEIK<br><br>SEQ ID NO: 24608 | EVQLLESGGGLVQPGGSLRLSCAASGFTFSSYAMS WVRQTPGQGLEWVSAISGRGGTTFYADSVKGRFTI SRDNSKNTLYLQMNSLRAEDTAVYYCAKDGYGGN SFFDYWGQGTLVTVSS<br><br>SEQ ID NO: 28614 |

FIGURE 50
(Continued)

| | | | |
|---|---|---|---|
| iPS:393030 | 21-225_25H11 | NA | GACATCCAGATGACCCAGTCTCCATCCTCCCT GTCTGCGTCTGTAGGAGACAGAGTCACCATCA CTTGCCGGGCAAGTCAGGGCATTAGAAACTGAT TTAGGCTGGTATCAGCAGAAACCAGGGAAAG CCCCTAAGCGCCTGATCTATGCTGCATCCAGT TTACAAAGTGGGGTCCCATCAAGGTTCAGCGG CAGTGGATCTGGGACAGAATTCACTCTCACAA TCAGTAGTCTGCAGCCTGAAGATTTTGCAACC TATTACTGTCTACAGCATAATAGTTACCCGCTC ACTTTCGGCGGAGGGACCAAGGTGGAGATCA AA SEQ ID NO: 24609 | CAGGTGCAGCTGGTGGAGTCTGGGGGAGGCGTG GTCCAGCCTGGGAGGTCCCTGAGACTCTCCTGTG CAGGCGTCTGGATTCACCTTCAGTGACTATGGCAT GCACTGGGTCCGCCAGGCTCCAGGCAAGGGGCT GGAGTGGGTGGCAGTTATATGGTATGATGAAAAT AATGAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACTGGG GATGACGGGTGACTCCTGGGGCCAGGGAACCCT GGTCACCGTCTCCTCA SEQ ID NO: 28615 |
| | | AA | DIQMTQSPSSLSASVGDRVTITCRASQGIRTDLG WYQQKPGKAPKRLIYAASSLQSGVPSRFSGSGS GTEFTLTISSLQPEDFATYCLQHNSYPLTFGGG TKVEIK SEQ ID NO: 24610 | QVQLVESGGGVVQPGRSLRLSCAASGFTFSDYGM HWVRQAPGKGLEWVAVIWYDENNEYYADSVKGR FTISRDNSKNTLYLQMNSLRAEDTAVYYCARELGM TGDSWGQGTLVTVSS SEQ ID NO: 28616 |
| iPS:393032 | 21-225_26F8 | NA | GATATTGTGATGACCCAGACTCCACTCTCTCT GTCCGTCACCCCTGGACAGCCGGCCTCCATCT CCTGCAAGTCTAGTCAGAGCCTCCTGCATGGT GATGAAAGACCTATTTGTATTGGTACCTGCA GAAGCCAGGCCAGCCTCCACAGCTCCTGATCT ATGAAGTTTCCAACCGGTTCTCTGGAGTGCCA GATAGGTTCAGTGGCAGCGGGTCAGGGACAG ATTTTCACACTGAAAATCAGCCGGGTGGAGCT GAGGATGTTGGGGTTTATTACTGCATGCAAAG TATACAGCTTCCGTGGACGTTCGGCCAAGGGGA CCAAGGTGGAAATCAAA SEQ ID NO: 24611 | CAGGTGCAGCTGGTGGAGTCTGGGGGAGGCGTG GTCCAGCCTGGGAGGTCCCTGAGACTCTCCTGTG CAGGCGTCTGGATTCACCTTCAGTGGCTATGGCAT GCACTGGGTCCGCCAGGCTCCAGGCAAGGGGCT GGAGTGGGTGGCAATTATATGGTATGATGAAGT AATAAATACTATGCAGACTCCGTGAAGGGCCGA TTCACCATCTGCAAATGAACAGCCTGAGAGCCGAGG TGTATCTGCAAATGAACAGCCTGAGAGCCGAGG ACACGGCTGTGTATTACTGTGCGAGAGAGGTA CGATTTTTGGAGTGGTTGTATGACGTCTGGGGC CAAGGGACCACGGTCACCGTCTCCTCA SEQ ID NO: 28617 |

FIGURE 50
(Continued)

| | | | | |
|---|---|---|---|---|
| iPS:393034 | | AA | DIVMTQTPLSLSVTPGQPASISCKSSQSLLHGDG KTYLYWYLQKPGQPPQLLIYEVSNRFSGVPDRFS GSGSGTDFTLKISRVEAEDVGVYYCMQSIQLPW TFGQGTKVEIK<br>SEQ ID NO: 24612 | QVQLVESGGGVVQPGRSLRLSCAASGFTFSGYGM HWVRQAPGKGLEWVAIIWYDGSNKYYADSVKGR FTISRDNSKNTLYLQMNSLRAEDTAVYYCARERYD FWSGCMDVWGQGTTVTSS<br>SEQ ID NO: 28618 |
| | 21-225_27F2 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGTTGCATCCAGTT TGCAAAGTGGGGTCCCATCAAGGTTCAGCGGC AGTGGATCTGGGACAGATTCACTCTCACAACCT CAGCAGTCTGCAGCCTGAAGATTTTGCAACCT ATTACTGTCTACAGCATAATAGTTACCCGCTC ACTTTCGGCGGAGGGACCAAGGTGGAGATCA AA<br>SEQ ID NO: 24613 | CAGGAGCAGCTGGTGGAGTCTGGGGGAGGCGTG GTCCAGCCTGGGAGGTCCCTGAGACTCTCCTGTG CAGCGCTCTGGATTCATCTTCAGTGACTATGGCAT GCACTGGGTCCGCCAGGCTCCAGGCAAGGGGCT GGAGTGGGTGGCAGTTATATGTATGATGAAAAT AATAAATACTATGTAGACTCCGTGAGGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACTGGGG ATGACGGGTGACTCCTGGGGCCAGGGAACCCTG GTCACCGTCTCCTCA<br>SEQ ID NO: 28619 |
| | | AA | DIQMTQSPSSLSASVGDRVTITCRASQGIRNDLG WYQQKPGKAPKRLIYVASSLQSGVPSRFSGSGS GTEFTLTISSLQPEDFATYYCLQHNSYPLTFGGG TKVEIK<br>SEQ ID NO: 24614 | QEQLVESGGGVVQPGRSLRLSCAASGFIFSDYGMH WVRQAPGKGLEWVAVIWYDENNKYYVDSVRGRF TISRDNSKNTLYLQMNSLRAEDTAVYYCARELGMT GDSWGQGTLVTVSS<br>SEQ ID NO: 28620 |

FIGURE 50
(Continued)

| | | | |
|---|---|---|---|
| iPS:393036 | 21-225_28G3 | NA | GAAATTGTGATGACCCAGACTCCACTCTCT GTCCGTCACCCCTGGACAGCCGGCCTCCATCT CCTGCAAGTCTAGTCAGAGCCTCCTACATGGT GATGGAAAGACCTATTTGTATTGGTACCTGCA GAAGCCAGGCCAGCCTCCACAGTCCTGATCT ATGAAGTTTCCAACCGGTTCTCTGGAGTGCCA GAAAGGTTCAGTGGCAGTGGATCAGGGACAG ATTTCACACTGAAAATCAGCCGGGTGGAGGCT GAGGATGTTGGGGGTTTATTACTGTATGCAAAG TATACAGATTCCGTGGACGTTCGGCCAAGGGA CCAAGGTGGAAATCAAA<br><br>SEQ ID NO: 24615 | CAGGTGCAGCTGGTGGAGTCTGGGGGAGGCGTG GTCCAGCCTGGGAGGTCCCTGAGACTCTCCTGTG CAGCGTCTGGATTCATCTTCAGTACTTACGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCAGAGACAATTCAAGAACACGC TGTATCTGCAAATGAACAGCCTGAGAGCCGAGG ACACGGCTGTGTATTACTGTGCGAGAGATCGATA CGATTTTGGAGTGGTTATTTTGACTACTGGGGC CAGGGAACCCTGGTCACCGTCTCCTCA<br><br>SEQ ID NO: 28621 |
| | | AA | EIVMTQTPLSLSVTPGQPASISCKSSQSLLHGDGK TYLYWYLQKPGQPPQLLIYEVSNRFSGVPERFSG SGSGTDFTLKISRVEAEDVGVYYCMQSIQPWTF GQGTKVEIK<br><br>SEQ ID NO: 24616 | QVQLVESGGGVVQPGRSLRLSCAASGFIFSTYGMH WVRQAPGKGLEWVAVIWYDGSNKYYADSVKGRF TISRDNSKNTLYLQMNSLRAEDTAVYYCARDRYDF WSGYFDYWGQGTLVTVSS<br><br>SEQ ID NO: 28622 |
| iPS:393038 | 21-225_29D8 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATACTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A<br><br>SEQ ID NO: 24617 | CAGGTGCAGCTGGTGGAGTCTGGGGGAGGCGTG GTCCAGCCTGGGAGGTCCCTGAGACTCTCCTGTG CAGCGTCTGGATTCACCTTCAGGGACTATGGCAT ACACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCAGAGACAATTCAAGAACACGC TGTATCTGCAAATGAACAGCCTGAGAGCCGAAG ACACGGCTGTGTATTACTGTGGGAGAGAAATTGG CTGGTTAGATGACTACTGGGGGCCAGGGAACCCTG GTCACCGTCTCCTCA<br><br>SEQ ID NO: 28623 |

FIGURE 50
(Continued)

| | | | | |
|---|---|---|---|---|
| | | | DIQMTQSPSSLSASVGDRVTITCRASQGIRNDLG WYQQKPGKAPKRLIYTASSLQSGVPSRFSGSGSG TEFTLTISSLQPEDFATYYCLQHNSYPFTPGPGTK VDIK | QVQLVESGGGVVQPGRSLRLSCAASGFTFRDYGIH WVRQAPGKGLEWVAVIWFDGTNKYYADSVKGRF TISRDNSKNTLYLQMNSLRAEDTAVYYCGREIGWL DDYWGQGTLVTVSS | |
| | | AA | SEQ ID NO: 24618 | SEQ ID NO: 28624 |
| iPS:393040 | 21-225_30E3 | NA | GACATCCAGATGACCCAGTCTCCATCTCCCT GTCTGCATCTGTAGGAGACAGAGTCACCATCA CTTGCCGGGCAAGTCAGGACATTAGAGATGAT TTAGGCTGGTATCAGCAGAAACCAGGGAAAG CCCCTAGGCGCCCTGATCTATGCTGCATTCAGC TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATACTAGTTACCCTCCT ACTTTCGGCGGAGGGACCAAGGTGGAGATCA AA | GAGGTGCAGGTGTTGGAGTCTGGGGGAGGCTTG GTACAGCCTGGGGGGTCCCTGAGACTCTCTGTG CAGCCTCTGGATTCACCTTTAGCAGCTATGCCAT GAACTGGGTCCGCCAGGCTCCAGGGAAGGGGCT GGAGTGGGTCTCCGCTATTAGTGTCGTGGTGGT AGCACATTCTACGCAGACTCCGAGAAGGGCCGG TTCACCATCTCCAGAGACAATTCCAAGAACACGC TGTATCTGCAAATGAACAGCCTGAGAGCCGAGG ACACGGCCGTATTACTGTGCGAAAGGGGAGCT ATTAGAGGACTACTACTACTACGGAATGGACGTC TGGGGCCAAGGGACCACGGTCACCGTCTCCTCA | |
| | | | SEQ ID NO: 24619 | SEQ ID NO: 28625 |
| | | AA | DIQMTQSPSSLSASVGDRVTITCRASQDIRDDLG WYQQKPGKAPRRLIYAAFSLQSGVPSRFSGSGS GTEFTLTISSLQPEDFATYYCLQHTSYPPTFGGGT KVEIK | EVQVLESGGGLVQPGGSLRLSCAASGFTFSSYAMN WVRQAPGKGLEWVSAISGRGGSTFYADSEKGRFTI SRDNSKNTLYLQMNSLRAEDTALYYCAKGELLED YYYYGMDVWGQGTTVTVSS |
| | | | SEQ ID NO: 24620 | SEQ ID NO: 28626 |

FIGURE 50
(Continued)

| | | | |
|---|---|---|---|
| iPS:393042 | 21-225_31F1 | NA | GACATCCAGATGACCCAGTCTCCATCCTCCCT GTCTGCATCTGTAGGAGACAGAGTCACCATCA CTTGCCGGGCAAGTCAGAGGATTAGCAGCTAT TTAAATTGGTATCAGCAGAAACCAGGGAAAG CCCCTAAGCTCCTGATCTTTGCTGCATCCAGTT CGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACATTACCCCTCCG ACTTTCGGCGGAGGGACCACGGTGGAGATCA GA |
| | | | SEQ ID NO: 24621 |
| | | AA | DIQMTQSPSSLSASVGDRVTITCRASQRISSYLN WYQQKPGKAPKLLIFAASSSQSGVPSRFSGSGSG TDFTLTISSLQPEDFATYYCQQSYITPLTFGGGTT VEIR |
| | | | SEQ ID NO: 24622 |
| | | NA | CAGGTGCAGCTGGTGCAGTCTGGGGCTGAGGTG AAGAAGCCTGGGGCTCAGTGAAGGTCTCCTGC AAGGCTTCTGGATACACCTTCACCGACTACTATA TGCACTGGGTGCGACAGGCCCCTGGACAGGGC TTGAGTGGATGGGATGGATCAACCTAACAGTGG TGGCACAAACTATGCACAGAAGTTTCAGGGCAG GGTCACCATGACCAGGGACACGTCATTATGACA GCCTATATGGAGCTGAGCAGGCTGAGATCTGAC GACACGGCCGTGTATTACTGTGCGAGAGATAGTA GCAATTTCAGCAACTGGTACGATTACTACGTAT GGACGTCTGGGGCCAAGGGACCACGGTCACCGT CTCCTCA |
| | | | SEQ ID NO: 28627 |
| | | AA | QVQLVQSGAEVKKPGASVKVSCKASGYTFTDYYM HWVRQAPGQGLEWMGWINPNSGGTNYAQKFQGR VTMTRDTSIMTAYMELSRLRSDDTAVYYCARDSSN FSNWYDYYGMDVWGQGTTVTVSS |
| | | | SEQ ID NO: 28628 |
| iPS:393044 | 21-225_25B8 | NA | GAAATAGTGATGACGCAGTCTCCAGCCACCCT GTCTGTGTCTCCAGGGGAAAGAGCCACCCTCT CCTGCAGGGCCAGTCAGAGTGTTAGAAGTAAT TTAGCCTGGTACCAGCAGAAACCTGGCCAGGC TCCCAGGCTCCTCATCTATGGTGCATCCACCA GGGCCACTGGTATCCCAGCCAGGTTCAGTGGC AGTGGGTCTGGGACAGAGTTCACTCTCACCAT CAGCAGCCTGCAGTCTGAAGATTTTGCACTTT ATTACTGTCAGCAGTATAATAATTGGCCTCCG TGGCCGTTCGGCCAAGGGACCAAGGTGGAAA TCAAA |
| | | | SEQ ID NO: 24623 |
| | | NA | CAGGTTCAGTTGGTGCAGTCTGGAGCTGAGGTGA AGAAGCCTGGGGCCTCAGTGAAGGTCTCCTGCA AGGCTTCTGGTTACACCTTCACCAGCTATGGTAT CAGCTGGGTGCGACAGGCCCCTGGACAAGGGCT TGAGTGGATGGGATGGATCAGCGCTTACAATGGT AACACAACCTATGCACAGAAGTTCCGGGGCAGA GTCACCATGACCACAGACACATCCACGAGCACA GCCTACATGGATCTGAGGAGCCTGAGATCTGACG ACACGGCCGTGTATTACTGTGCGAGAACCGCTGC TGGGTATAGCAGCAGCTGTTGACTACTGGGGC CAGGGAACCCTGGTCACCGTCTCCTCA |
| | | | SEQ ID NO: 28629 |

FIGURE 50
(Continued)

| | | | |
|---|---|---|---|
| | | AA | EIVMTQSPATLSVSPGERATLSVCRASQSVRSNLA WYQQKPGQAPRLLIYGASTRATGIPARFSGSGSG TEFTLTISSLQSEDFALYYCQQYNNWPPWPFGQ GTKVEIK<br><br>SEQ ID NO: 24624 | QVQLVQSGAEVKKPGASVKVSCKASGYTFTSYGIS WVRQAPGQGLEWMGWISAYNGNTYAQKLRGRV TMTTDTSTSTAYMDLRSLRSDDTAVYYCARTAAG YSSSWFDYWGQGTLVTVSS<br><br>SEQ ID NO: 28630 |
| iPS:393046 | 21-225_25A12 | NA | GACATCCAGATGACCCAGTCTCCATCTCCCT GTCTGCATCTGTAGGAGACAGAGTCACCGTCA CTTGCCGGGCAAGTCAGGACAGCCATTAGAGATGAT TTAGGCTGGTATCAGCAGAGACCAGGGAAAG CCCCTAAGCGCCTGATCTATGCTGCATCCAGT TTGCAAAGTGGGGTCCCATCAAGGTTCAGCGG CAGTGGATCTGGGACAGAATTTATTCTCACAA TCAGCAGCCTGCAGCCTGAAGATTTTGCAACT TATTACTGTCTACAGCATTATAATTACCCTCGC AGTTTTGGCCAGGGGACCAAGCTGGAGATCAA A<br><br>SEQ ID NO: 24625 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTGTGTCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGAGTA TAGCAGTGGCTGGTACGACTACGGTATGGACGTC TGGGGCCAAGGGACCATGGTCACCGTCTCCTCA<br><br>SEQ ID NO: 28631 |
| | | AA | DIQMTQSPSSLSASVGDRVTVTCRASQAIRDDLG WYQQRPGKAPKRLIYAASSLQSGVPSRFSGSGS GTEFILTISSLQPEDFATYYCLQHYNYPRSFGQGT KLEIK<br><br>SEQ ID NO: 24626 | QVQLVESGGGVVQPGRSLRLSCAASGFTFSNCVMH WVRQAPGKGLEWVAVIWYDGSNKYYADSVKGRF TISRDNSKNTLYLQMNSLRAEDTAVYYCAREEYSS GWYDYGMDVWGQGTMVTVSS<br><br>SEQ ID NO: 28632 |

FIGURE 50
(Continued)

| | | | | |
|---|---|---|---|---|
| iPS:393048 | 21-225_27C3 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCAGT TTGCAAAGTGGGGTCCCATCAAGGTTCAGCGG CAGTGGATCTGGGACAGAATTCACTCTCACAA TCAGCAGTCTGCAGCCTGAAGATTTTGCAACC TATTACTGTCTACAGCATAATCGTTACCCGTC ACTTTCGGCGGAGGGACCAAGGTGGAGATCA AA<br><br>SEQ ID NO: 24627 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTATGATGAAAAT AATAAATCCTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACTGGGG ATGACGGGTGACTCCTGGGGCCAGGGAACCCTG GTCACCGTCTCCTCA<br><br>SEQ ID NO: 28633 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNRYPLTFGGG TKVEIK<br><br>SEQ ID NO: 24628 | QVQLVESGGGVVQPGRSLRLSCAASGFTFSDYGM HWVRQAPGKGLEWVAVIWYDENKSYADSVKGR FTISRDNSKNTLYLQMNSLRAEDTAVYYCARELGM TGDSWGQGTLVTVSS<br><br>SEQ ID NO: 28634 |
| iPS:393050 | 21-225_28C5 | NA | GAAATAGTGATGACGCAGTCTCCAGCCACCCT GTCTGTGTCTCCAGGGAAAGAGCCACCCTCT CCTGCAGGGCCAGTCAGAGTGTTAGCAGCAAC TTAGCCTGGTACCATCAGAAACCTGGCCAGGC TCCCAGGCTCCTCATCTATGGTGCATCCACCA GGGCCACTGGTATCCCAGCCAGGTTCAGTGGC AGTGGGTCTGGGACAGAGTTCACTCTCACCAT CAGCAGCCTGCAGTCTGAAGATTTTGCACTTT ATTACTGTCAGCAGTATAATAATTGGCCTCCG TGGCCGTTCGGCCAAGGGACCAAGGTGGAAA TCAAA<br><br>SEQ ID NO: 24629 | CAGGTTCAGTTGGTGCAGTCTGGAGCTGAGGTGA AGAAGCCTGGGGCTCAGTGAAGGTCTCCTGCA AGGCTTCTGATTACACCTTCACCAGCTATGTAT CAGCTGGGTGCGACAGGCCCCTGACAAGGGCT TGAGTGGATGGGATGGATCAGCGCTTACAATGGT AACACAACCTATGCACAGAAGTCCGGGCAGA GTCACCATGACCACAGACACATCCACGAGCACA GCCTACATGGATCTGGAGAGCTGAGATCTGACG ACACGGCCGTGTATTACTGTGCGAGAACCGCTGC TGGGTATAGCAGCAGCTGGTTGACTACTGGGGC CAGGGAACCCTGGTCACCGTCTCCTCA<br><br>SEQ ID NO: 28635 |

FIGURE 50
(Continued)

| | | | |
|---|---|---|---|
| iPS:393054 | | AA | EIVMTQSPATLSVSPGERATLSCRASQSVSSNLAWYHQKPGQAPRLLIYGASTRATGIPARFSGSGSGTEFTLTISSLQSEDFALYYCQQYNNWPPWPFGQGTKVEIK<br>SEQ ID NO: 24630 | QVQLVQSGAEVKKPGASVKVSCKASDYTFTSYGISWVRQAPGQGLEWMGWISAYNGNTTYAQKLRGRVTMTTDTSTSTAYMDLRSLRSDDTAVYYCARTAAGYSSSWFDYWGQGTLVTVSS<br>SEQ ID NO: 28636 |
| | 21-225_29G8 | NA | GACACTGCAGTCTGGTGGAGTCTGGGGGAGGCGTGGTCCAGCCTGGGAGGTCCCTGAGACTCTCCTGTGCAGCGTCTGGATTCACCTTCAGTGACTATGGCATGCACTGGGTCCGCCAGGCTCCAGGCAAGGGGCTGGAGTGGGTGGCAGTTATATGGTATGATGAAACTAATAAATACTATGCAGACTCCGTGAAGGGCCGATTCACCATCTCCAGAGACAATTCCAAGAACACGCTGTATCTGCAAATGAACAGCCTGAGAGCTGAGGACACGGCTGTGTATTACTGTGCGAGAGAACTGGGATGACGAGTGACTACTGGGGCCAGGAACCCTGGTCACCGTCTCCTCA<br>SEQ ID NO: 24631 | |
| | | AA | DIQMTQSPSSLSASVGDRVTITCRASQGIRNDLGWYQLKPGKAPKRLIYAASSLQSGVPSRFSGSGSGTEFTLTISSLQPEDFATYNCLQHNSYPLTFGGGTKVEIK<br>SEQ ID NO: 24632 | QVQLVESGGGVVQPGRSLRLSCAASGFTFSDYGMHWVRQAPGKGLEWVAVIWYDETNKYYADSVKGRFTISRDNSKNTLYLQMNSLRAEDTAVYYCARELGMTSDYWGQGTLVTVSS<br>SEQ ID NO: 28638 |

FIGURE 50
(Continued)

| | | | | |
|---|---|---|---|---|
| iPS:393056 | 21-225_30F3 | NA | GACATCCAGATGACCCAGTCTCCATCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATACTGCATCCAGT TTACAAAGTGGGGTCCCATCAAGGTTCAGCGG CAGTGGATCTGGGACAGATTTCACTCTCACAA TCAGCAGCCTGCAGCCTGAAGATTTTGCAAGT TATTACTGTCTACAGCATAATAGTTACCCGTTC ACTTTCGGCGGAGGGACCAAGGTGGAGATCA AA SEQ ID NO: 24633 | CAGGTGCAGCTGGTGGAATCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGTAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAAATGGG CTGGTACGATGACTACTGGGGCCAGGGAACCCT GGTCACCGTCTCCTCA SEQ ID NO: 28639 |
| | | AA | DIQMTQSPSSLSASVGDRVTITCRASQGIRNDLG WYQQKPGKAPKRLIYTASSLQSGVPSRFSGSGSG TDFTLTISSLQPEDFASYYCLQHNSYPFTFGGGT KVEIK SEQ ID NO: 24634 | QVQLVESGGGVVQPGRSLRLSCAASGFTFSSYGMH WVRQAPGKGLEWVAVIWYDVSNKYYADSVKGRF TISRDNSKNTLYLQMNSLRAEDTAVYYCAREMGW YDDYWGQGTLVTVSS SEQ ID NO: 28640 |
| iPS:393058 | 21-225_31H3 | NA | GACATCCAGATGACACAGTCTCCATCTCCCT GTCTGCATCTGTAGGAGACAGAGTCACCATCA CTTGCCGGGCAAGTCAGGACATTAGAGATGAT TTAGGCTGGTATCAGCAGAAACCAGGGAAAG CCCCTAAGCGCCTGATCTATGCTGCATCAGC TTGCAAAGTGGGGTCCCATCAAGGTTCAGCGG CAGTGGATCTGGGACAGCCTCACTCTCACAA TCAGCAGCCTGCAGCCTGAAGATTTTGCAACT TATTACTGTCTACAGCATACTAGTTACCCTCCT ACTTTCGGCGGAGGGACCAAGGTGGAGATCA AA SEQ ID NO: 24635 | GAGGTGCAGGTGTTGGAGTCTGGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGGAAGGGGCT GGAGTGGGTCTCCGCTATTAGTAGTGGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGAAAGGGGAGTTA CTAGAGGACTACTACTACGGAATGGACGTCT GGGGCCAAGGGACCACGGTCACCGTCTCCTCA SEQ ID NO: 28641 |

FIGURE 50
(Continued)

| | | | | |
|---|---|---|---|---|
| iPS:393060 | 21-225_32G12 | AA | DIQMTQSPSSLSASVGDRVTITCRASQDIRDDLG WYQQKPGKAPRRLIYAAFSLQSGVPSRFSGSGS GTEFTLTISSLQPEDFATYYCLQHTSYPPTFGGGT KVEIK<br>SEQ ID NO: 24636 | EVQVLESGGGLVQPGGSLRLSCAASGFTFSSYAMN WVRQAPGKGLEWVSAISGRGGNTFYADSVKGRFTI SRDNSKNTLYLQMNSLRAEDTAVYYCAKGELLED YYYYGMDVWGQGTTVTVSS<br>SEQ ID NO: 28642 |
| | | NA | GACATCCAGATGACCCAGTCTCCATCCTCCCT GTCTGCATCTGTAGGAGACAGAGTCACCATCA CTTGCCGGGCAAGTCAGGACATTAGAAGTGAT TTAGGCTGGTATCAGCAGAAGCCAGGAAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTACAGCCTGAAGATTTTGCAACT TATTACTGTCTGCAGCATACTATTTACCCTTCT ACTTTCGGCGGAGGGACCAAGGTGGAGATCA AA<br>SEQ ID NO: 24637 | GAGGTGCAGCTGTTGGAGTCTGGGGGAGGCTTGC TACAGCCTGGGGGGTCCCTGAGACTCTCCTGTGC AGCCTCTGGATTCACCTTTAATAGCTATGCCATG AGCTGGGTCCGCCAGGCTCCAGGGAAGGGGCTG GAGTGGGTCTCTCTATTAGTGGTGGTGGTGGTA GCACATTCCACGCAGACTCCGTGAAGGGCCGGTT CACCATCTCCAGAGACAATTCCAGAACACGCTG TATCTGCAAATGAACAGCTGAGAGCCGAGGAC ACGGCCGTATATTACTGTGTGAAAGGGAGCTAC TAGAGGACTACTACTTCTACGGTATGGACGTCTG GGGCCAAGGGACCACGGTCACCGTCTCCTCA<br>SEQ ID NO: 28643 |
| | | AA | DIQMTQSPSSLSASVGDRVTITCRASQDIRSDLG WYQQKRPGKAPKRLIYAASSLQSGVPSRFSGSGS GTEFTLTISSLQPEDFATYYCLQHTYPPTFGGGT KVEIK<br>SEQ ID NO: 24638 | EVQLLESGGGLLQPGGSLRLSCAASGFTFNSYAMS WVRQAPGKGLEWVSSISGRGGSTFHADSVKGRFTI SRDNSRNTLYLQMNSLRAEDTAVYYCVKGELLED YYFYGMDVWGQGTTVTVSS<br>SEQ ID NO: 28644 |

FIGURE 50
(Continued)

| | | | | |
|---|---|---|---|---|
| iPS:393062 | 21-225_33H3 | NA | GACATCCAGATGACCCAGTCTCCATCTCCCT GTCTGCATCTGTTGGAGACAGAGTCACCATCA CTTGCCAGGCGAGTCAGGACAGATTTCCAACTTT TTAAATTGGTTTCGGCAGAAACCAGGAAAAGC CCCTAACTCCTGATCTACGATGCATCCAATTT GGTAACAGGGGTCCCATCAAGGTTCAGTGGAC GTGGATCTGGGACAGATTTACTTTCACCATC AGCAGCCTGCAGCCTGAAGATTTTGCAACATA TTACTGTCAACAGTATGATAATCTCCCGATCA CCTTCGGCCAAGGGACACGGCTGGAGATTAAA | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCGGGCTCCAGGCAAGGGGCT GGAGTGGGTGGCAATTATATCAGACTCCGTGAAGT AATAACTTCTATGCAGACTCCGTGAAGGGCCGAT TCACCATCTCCAGAGACAATTCCAAGAACACGCT GTATCTGCAAATGAACAGCCTGAGAGCTGAGGA CACGGCTGTGTATTACTGTCGAGAAGGGGGTAT AGCAGTGGAGGCTACGGTATGGACGTCTGGGGC CAAGGGACCACGGTCACCGTCTCCTCA |
| | | AA | DIQMTQSPSSLSASVGDRVTITCQASQDISNFLN WFRQKPGKAPNSLIYDASNLVTGVPSRFSGRGS GTDFTFTISSLQPEDFATYYCQQYDNLPITFGQGT RLEIK | QVQLVESGGGVVQPGRSLRLSCAASGFTFSSYGMH WVRRAPGKGLEWVAIISYGGSNFYADSVKGRFTI SRDNSKNTLYLQMNSLRAEDTAVYYCARRGYSSG GYGMDVWGQGTTVTVSS |
| | | | SEQ ID NO: 24639 | SEQ ID NO: 28645 |
| iPS:393064 | 21-225_33A9 | NA | GACATCGCAGATGACCCAGTCTCCATCTCCCT GTCTGCATCTGTAGGAGACAGAGTCACCATCA CTTGCCGGGCAAGTCAGAGCATTAGCAGGTAT TTAAGTTGGTATCAGCAGAAACCAGGGAGAG CCCCTAAGCTCCTGATCTATGCTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAATATCCCGATC ACCTTCGGCCAAGGGACACGACTGGAGATTAA A | CAGGTGCAGCTGGTGCAGTCTGGGGCTGAGGTG AAGAAGCCTGGGGCCTCAGTGAAGGTCTCCTGTA AGGCTTCTGGATACACCTTCACCAGTTATGATAT CAACTGGGTGCGACAGGCCACTGGTCAAGGGCT TGAGTGGATGGGATGGATGCACAGAAGTTCCAACAGTGG TAACACAGGCTATGCACCAGGAACACCTCCATAAGCAC AGCCTACATGGAGCTGAGCAGCCTGGGACTCTGA GGACACGGCCGTGTATTACTGTGCGAGAAGAA GGCTAACGACTACTGGGGCCAGGGAACCCTGGT CACCGTCTCCTCA |
| | | | SEQ ID NO: 24640 | SEQ ID NO: 28646 |
| | | | SEQ ID NO: 24641 | SEQ ID NO: 28647 |

FIGURE 50
(Continued)

| | | | | |
|---|---|---|---|---|
| iPS:393066 | 21-225_34D3 | AA | DIQMTQSPSSLSASVGDRVTITCRASQSISRYLSWYQQKPGRAPNLQIYAASSLQSGVPSRFSGSGSGTDFTLTISSLQPEDFATYYCQQSYNIPITFGQGTRLEIK<br>SEQ ID NO: 24642 | QVQLVQSGAEVKKPGASVKVSCKASGYTFTSYDINWVRQATGQGLEWMGWMNPNSGNTGYAQKFQGRVTMTRNTSISTAYMELSSLGSEDTAVYYCARKKANDYWGQGTLVTVSS<br>SEQ ID NO: 28648 |
| | | NA | GACATCCAGATGACCCAGTCTCCATCTCCCTGTCTGCATCTGTTGGAGACAGAGTCACCATCACTTGCCGGGCAAGTCAGAGCATTTACAGCTATTTAAATTGGTATCAGCAGAAACCAGGGAAAGACCCTAAACTCCTGATCTATGCTGCATCCAGTTTGCATAGTGGGGTCCCGTCACGGTTCAGTGGCAGTGGTTCTGGGACAGATTTCACTCTCACCATCAGCAGTCTGCAACTGAAGATTTTGCAACTTTCTACTGTCAACAGAGTTACAGTATCCGCTCACTTTCGGCGGAGGGACCAAGGTGGAGATCAAA<br>SEQ ID NO: 24643 | CAGGTGCAGCTGGTGGAGTCTGGGGGAGGCGTGGTCCAGCCTGGGAGGTCCCTGAGACTCTCCTGTGCAGCCGTCTGGATTCACCTTCAGTTACTATGGCATGCACTGGGTCCGCCAGGCTCCAGGCAAGGGGCTGGAGTGGGTGGCAGTTATATGATGGCATGATGGAAGTAATAAATACTATGTAGACTCCGTGAAGGGCCGATTCACCATCTCCAGAGACAATTCCAAGAACACGCTGTATCTGCAAATGAACAGCCTGAGAGCCGAGGACACGGCTGTGTTATTACTGTGCGAGAGAAATAGCAGTTCGTTCTACTTTGACTACTGGGGCCAGGGAACCCTGGTCACCGTCTCCTCA<br>SEQ ID NO: 28649 |
| | | AA | DIQMTQSPSSLSASVGDRVTITCRASQNIYSYLNWYQQKPGKDPKLLIYAASSLHSGVPSRFSGSGSGTDFTLTISSLQPEDFATFYCQQSYSTPLTFGGGTKVEIK<br>SEQ ID NO: 24644 | QVQLVESGGGVVQPGRSLRLSCAASGFTFSYYGMHWVRQAPGKGLEWVAVIWHDGSNKYYVDSVKGRFTISRDNSKNTLYLQMNSLRAEDTAVYYCARENSSSFYFDYWGQGTLVTVSS<br>SEQ ID NO: 28650 |

FIGURE 50
(Continued)

| | | | |
|---|---|---|---|
| iPS:393068 | 21-225_34G9 | NA | GACATCCAGATGACCCAGTCTCCATCTCCCT GTCTGCATCTGTAGGAGACAGAGTCACCATCA CTTGCCGGGCAAGTCAGGACATTAGAAGTGAT TTAGGCTGGTATCAGCAGAAACCAGGGAAAG CCCCTAAGCGCCTGATCTATGCTGCATCCAGT TTGCAAAGTGGGGTCCCATCAAGGTTCACGG CAGTGGCTCTGGGACAGAATTCACTCTCACAA CAGCAGCCTGCAGCCTGAAGCTTTTGCAATT TATTACTGTCTCCAGCATACTATTTACCCTCCT ACTTTCGGCGGAGGGACCAAGGTGTGGATCAA A | GAGGTGCAGCTGGTGGAGTCTGGGGGAGGCTTG GTACAGCCTGGGGGGTCCCTGAGACTCTCCTGTG CAGCCTCTGGATTCACCTTTAGCAGTAGCCAT GAGCTGGGTCCGCCAGGCTCCAGGGAAGGGCT GGAGTGGGTCTCCGCTATTAGTGGTCGTGGTGGT AGCACATTCCACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGTGAAAGGGAGCT ACTAGAGGACTACTACTTCTACGGTATGGACGTC TGGGGCCAAGGGACCACGGTCACCGTCTCCTCA |
| | | | SEQ ID NO: 24645 | SEQ ID NO: 28651 |
| | | AA | DIQMTQSPSSLSASVGDRVTITCRASQDIRSDLG WYQQKPGKAPKRLIYAASSLQSGVPSRFTGSGS GTEFTLTISSLQPEAFAIYYCLQHTIYPPTFGGGT KVWIK | EVQLVESGGGLVQPGGSLRLSCAASGFTFSSYAMS WVRQAPGKGLEWVSAISGRGGSTFHADSVKGRFTI SRDNSKNTLYLQMNSLRAEDTAVYYCVKGELLED YYFYGMDVWGQGTTVTVSS |
| | | | SEQ ID NO: 24646 | SEQ ID NO: 28652 |
| iPS:393072 | 21-225_36C5 | NA | GACATCCAGATGACCCAGTCTCCATCTCCCT GTCTGCATCTGTAGGAGACAGAGTCACCATCA CTTGCCGGGCAAGTCAGGACAGATTAGAAGTGAT TTAGGCTGGTATCAGCAGAAACCAGGGAAAG CCCCTAAGCGCCTGATCTATGCTGCATCCAGT TTGCAAAGTGGGGTCCCATCAAGGTTCACGG CAGTGGATCTGGGACAGAATTCACTCTCACAA TCAGCAGCGTGCAGCCTGAAGATTTTGCAACT TATTACTGTCTCTCCATCATCCTATTTACCCTCCT ACTTTCGGCGGAGGGACCAAGGTGTGGATCAA A | GAGGTGCAGCTGGTGGAGTCTGGGGGAGGCTTG GTACAGCCTGGGGGGTCCCTGAGACTCTCCTGTG CAGCCTCTGGATTCACCTTTAGCAGTAGCCAT GAACTGGGTCCGCCAGGCTCCAGGGAAGGGCT GGAGTGGGTCTCCGCTATTAGTGGTCGTGGTGGT AGCACATTCCACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGTGAAAGGGAGCT ATTAGAGGACTACTACTTCTACGGTATGGACGTC TGGGGCCAAGGGACCACGGTCACCGTCTCCTCA |
| | | | SEQ ID NO: 24647 | SEQ ID NO: 28653 |

FIGURE 50
(Continued)

| | | | | |
|---|---|---|---|---|
| | | AA | DIQMTQSPSSLSASVGDRVTITCRASQDIRSDLG WYQQKPGKAPKRLIYAASSLQSGVPSRFTGSGS GTEFTLTISSVQPEDFATYYCLHHPIYPPTFGGGT KVWIK SEQ ID NO: 24648 | EVQLVESGGGLVQPGGSLRLSCAASGFTFSSYAMN WVRQAPGKGLEWVSAISGRGGSTFHADSVKGRFTI SRDNSKNTLYLQMNSLRAEDTAVYYCVKGELLED YYFYGMDVWGQGTTVTVSS SEQ ID NO: 28654 |
| iPS:393074 | 21-225_33B1 | NA | GACATCCAGATGACCCAGTCTCCATCCTCCCT GTCTGCATCTGTAGGAGACAGAGTCACCATCA CTTGCCGGACAAGTCAGGGCATTAGAAATGAT TTAGGCTGGTTTCAGCAGAAACCAGGGAAAGC CCCTAAGCGCCTGATCTATACTGCATCCAGTTT GCAAAGTGGGGTCCCATCAAGGTTCAGCGGCA GTGGATCTGGGACAGAATTCACTCTCACAATT AGCAGCCTGCAGCTGCAAGATAATAGTTACCC TTACTGTCTACAGCATATAGTTACCCGCTCA CTTCGGCGGAGGGACCAAGGTGGAGGTCAA A SEQ ID NO: 24649 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGCCAAGGGGCT GGAGTGGGTGGCAGTTATATGGTATGATAGAAAT AATAAATACTATGCAGACTCCGTGAAGGGCCGA TTCACCATCTCCAGAGACAATCCAAGAACACGC TGTATCTGCAAATGAACAGCCTGAGAGCCGAGG ACACGGCTGTATATTACTGTGCGAGAGAAATGGG CTGGTACGATGACTACTGGGGCCAGGGAACCCT GGTCACCGTCTCCTCA SEQ ID NO: 28655 |
| | | AA | DIQMTQSPSSLSASVGDRVTITCRTSQGIRNDLG WFQQKPGKAPKRLIYTASSLQSGVPSRFSGSGSG TEFTLTISSLQPEDFATYYCLQHNSYPLTFGGGT KVEVK SEQ ID NO: 24650 | QVQLVESGGGVVQPGRSLRLSCAASGFTFSDYGM HWVRQAPAKGLEWVAVIWYDRNNKYYADSVKG RFTISRDNSKNTLYLQMNSLRAEDTAVYYCAREMG WYDDYWGQGTLVTVSS SEQ ID NO: 28656 |

FIGURE 50
(Continued)

| | | | |
|---|---|---|---|
| iPS:393076 | 21-225_33A4 | NA | GACATCCAGATGACCCAGTCTCCATCCTCCT GTCTGCATCTGTAGGAGACAGAGTCACCATCA CTTGCCGGGCAAGTCAGGACATTAGAAATGAT GTAGGCTGGTATCAGCAGAAACCAGGGAAAG CCCCTGAGCGCCTGATCTATGCTGCATCCAGT TTGCAAACGTGGGGTCCCATCAAGGTTCAGCGG CAGTGGATCTGGGACAGAATTCACTCTCACAA TCAGCAGCCTGCAGCTGAAGATTTTGCAAGA TATTACTGTCTACAGCATTATAGTTACCCTCCT ACTTTCGGCGGAGGGACCAAGGTGGAGATCA AA<br><br>SEQ ID NO: 24651 | GAGGTGCAGTTGTTGGAGTCTGGGGGAGGCTTGG TACAGTCTGGGGGGTCCCTGAGACTCTCCTGTGA AGCCTCAGGATTCATCTTTAGCAGCTATGCCATG AACTGGGTCCGCCAGGTTCCAGGAAGGGGCTG GAGTGGGTCTCAGTATTAGTCGTCGTGGTGTA GCACATTCTACGCAGACTCCGTGAAGGGCCGGTT CACCATTTCCAGAGACAATTCCAAGAACACGCTG TATCTGCAAATGAACAGCCTGAGAGCCGAGGAC ACGGCCGTATATTTCTGTGCGAAAGGGAACTAC TAGAGGACTACTCCTACTACGGTATGCGACGTCTG GGGCCAGGGGACCACGGTCACCGTCTCCTCA<br><br>SEQ ID NO: 28657 |
| | | AA | DIQMTQSPSSLSASVGDRVTITCRASQDIRNDVG WYQQKPGKAPERLIYAASSLQRGVPSRFSGSGS GTEFTLTISSLQPEDFARYYCLQHYSYPPTFGGG TKVEIK<br><br>SEQ ID NO: 24652 | EVQLLESGGGLVQSGGSLRLSCEASGFIFSSYAMN WVRQVPGKGLEWVSAISRRGGSTFYADSVKGRFTI SRDNSKNTLYLQMNSLRAEDTAVYFCAKGELLED YSYYGIDVWGQGTTVTVSS<br><br>SEQ ID NO: 28658 |
| iPS:393078 | 21-225_33H11 | NA | GACATCCAGATGACCCAGTCTCCATCCTCACT GTCTGCATTTGTAGGAGACAGAGTCACCATCA CTTGTGGGCGAGTCAGGGCATTAACAGTTAT TTAGCCTGGTTTCAGCAGAGACCAGGGAAAGC CCATAAGTCCTGATCTATGCTGCATCCAGTTT GCAAGGTGGGGTCCCATCAAGGTTCAGCGGCA GTGGATCTGGGACAGATTTCATTCTCACCATC AGCAGCCTGCAGCCTGAAGATTTTGCAACTTA TTACTGCCAACAGTTTAATAGTTACCCTCTGAC GTTCGGCCAAGGGACCAAGGTGGAAATCAAA<br><br>SEQ ID NO: 24653 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTAGCAT GAACTGGGTCCGCCAGGCTCCAGGAAGGGCT GGAGTGGGTCTCATCCATTAGTGGTAGTAGT TACATATACTACGCAGACTCAGTGAAGGGCCGAT TCACCATCTCCAGAGACAACGCCAAGAACTCACT GTATCTGCAAATGAGCAGCCTGAGAGCCGAGGA CACGGCTGTGTATACTGTGCGAGAACAAACGGT ATGGACGTCTGGGGCCAAGGGACCACGGTTACC GTCTCCTCA<br><br>SEQ ID NO: 28659 |

FIGURE 50
(Continued)

| | | | |
|---|---|---|---|
| iPS:393080 | 21-225_34F3 | AA | DIQMTQSPSSLSAFVGDRVTITCWASQGINSYLA WFQQRPGKAHKSLIYAASSLQGGVPSKFSGSGS GTDFILTISSLQREDFATYYCQQFNSYPLTFGQGT KVEIK<br><br>SEQ ID NO: 24654 | EVQLVESGGGLVKPGGSLRLSCAASGFTFSSYSMN WVRQAPGKGLEWVSSISGSSSYIYYADSVKGRFTIS RDNAKNSLYLQMSSLRAEDTAVYYCARTNGMDV WGQGTTVTVSS<br><br>SEQ ID NO: 28660 |
| | | NA | GACATCCAGATGACCCAGTCTCCGTCTCCGT GTCTGCAACTGTAGGAGACAGAGTCACCAGCA CTTGTCGGGCGAGTCAGGGTATTAGTAAGTGG TTAGCCTGGTATCAGCAGAGAAGCCAGGGAAAG CCCCTAAACTCCTGATCTATGCTGCATCCAGTT TGCAAAGTGGGGTCCCATCAAGGTTCAGCGGC AGTGGATCTGGGACAGATTTCACTCTCACCAT CAGCAGCCTGCAGCCTGAAGACTCTGCAACTT ACTATTGTCAACAGGCTAACAGTTTCCCTTTCA CTTTCGGCCCCTGGGACCAAAGTGGATATCAAA<br><br>SEQ ID NO: 24655 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACCATA TGCACTGGGTGCGACAGGCCCCTGGACAAGGGC TTGACTGGATGGGATGGATCAACCCTAACAGTGG TGGCACAAACTATGCACAGAAGTTTCAGGGCAG GGTCACCATGACCAGGGACACGTCCATCAGCAC AGCCTATATGGAGCTGAGCAGGCTGAGATCTGA CGACACGGCCGTGTATTACTGTGCGAGAGACGGT ACCAGCTCCTTGACTACTGGGGCCAGGGAACCC TGGTCACCGTCTCCTCA<br><br>SEQ ID NO: 28661 |
| | | AA | DIQMTQSPSVSATVGDRVTSTCRASQGISKWLA WYQQKPGKAPKLLIYAASSLQSGVPSRFSGSGS GTDFTLTISSLQPEDSATYYCQQANSFPFTFGPGT KVDIK<br><br>SEQ ID NO: 24656 | QVQLVQSGAEVKKPGASVKVSCKASGYTFTGYHM HWVRQAPGQGLDWMGWINPNSGGTNYAQKFQGR VTMTRDTSISTAYMELSRLRSDDTAVYYCARDGTS SFDYWGQGTLVTVSS<br><br>SEQ ID NO: 28662 |

FIGURE 50
(Continued)

| | | | | |
|---|---|---|---|---|
| iPS:393082 | 21-225_34C11 | NA | GACATCCAGATGACCCAGTTTCCATCTTCCCT GTCTACATCTGTAGGAGACAGAGTCACCAGCA CTTGCCGGGCAAGTCAGAACATTAGGAACTTT TTAAATTGGTATCAGCAGAAACCTGAGAAAGA CCCTAAGCTCCAGATCTATGGTGCATCCACTTT GCAAAGTGGGGTCCCATCAAGGTTCAGTGGCA GTGGGATTTGGGACAGATTTCACTCTCACCATC AGTAGTCTGCAACCTAAAGATTTTGCAACTTA CTACTGTCAACAGACTTGCAGTACCCGCTCA CTTTCGGCGGAGGGACCAAGGTGGAGATCAA A<br>SEQ ID NO: 24657 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGTAGTATACCAT GAGCTGGGTCCGCCAGGCTCCAGGGAAGGGCT GGAGTGGGTCTCATCCATTAGTGGTAGTAGTAAT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGATTAACTGGT TTTGACTACTGGGGCCAGGGAACCCTGGTCACCG TCTCCTCA<br>SEQ ID NO: 28663 |
| | | AA | DIQMTQFPSSLSTSVGDRVTSTCRASQNIRNFLN WYQQKPEKDPKLQIYGASTLQSGVPSRFSGSGF GTDFTLTISSLQPKDFATYYCQQTCSTPLTFGGG TKVEIK<br>SEQ ID NO: 24658 | EVQLVESGGGLVKPGGSLRLSCAASGFTFSSYTMS WVRQAPGKGLEWVSSISGSSNYIYYADSVKGRFTIS RDNAKNSLYLQMNSLRAEDTAVYYCARLTGFDY WGQGTLVTVSS<br>SEQ ID NO: 28664 |
| iPS:393084 | 21-225_35C6 | NA | GACATCCAGATGACCCAGTCTCCATCTCCGT GTCTGCATCTGTAGGAGACAGAGTCACCATCA CTTGTCGGGCGAGTCAGGGTATTAGCAAATGG TTAGCCTGGTATCAGCAGAAACCAGGGAAAG CCCCTAAACCCTGATCTATGCTGCATCCAGTT TGCAGAGTGGGGTCCCAACAAGGTTCAGCGGC AGTGGATCTGGGACAGATTTCACTCTCACCAT CAGCAGCCTGCAGCCTGAAGATTTTGCAATTT ACTATTGTCAAACAGGCTAACAGTTCCCATTC ACTTTCGGCCCTGGGACCAAAGTGGATATCAA A<br>SEQ ID NO: 24659 | CAGGTGCAGTTGGTGCAGTCTGGGACTGAGGTGA AGAAGCCTGGGGCTGGCCTCAGTGAAGGTCTCTGCA AGGCTTCTGGATACACCTTCACCGGCGATTATAT GCACTGGGTGCGACAGGCCCCTGGACAAGGGCT TGAGTGGATGGGATGGATCAGCCTAAAAATGG TGGCACAAACTATGCACAGAAGTTTCAGGGCAG GGTCACCATGACCAGGGACACGTCCATCAGCAC AGCCTACATGGAGCTGAACAGGCTGAGATCTGA CGACACGCCGTGTATTACTGTGCGAGAGATGG AACTGGTCTTTGACTACTGGGGCCAGGGAACC CTGGTCACCGTCTCCTCA<br>SEQ ID NO: 28665 |

FIGURE 50
(Continued)

| | | | |
|---|---|---|---|
| iPS:393086 | 21-225_36H5 | AA | DIQMTQSPSSVSASVGDRVTITCRASQGISKWLA WYQQKPGKAPKPLIYAASSLQSGVPTRFSGSGS GTDFTLTISSLQPEDFAIYYCQQANSFPFTFGPGT KVDIK SEQ ID NO: 24660 | QVQLVQSGTEVKKPGASVKVSCKASGYTFTGDYM HWVRQAPGQGLEWMGWISPKNGGTNYAQKFQGR VTMTRDTSISTAYMELNRLRSDDTAVYYCARDGT GSFDYWGQGTLVTVSS SEQ ID NO: 28666 |
| | | NA | GACATCCAGATGACCCAGTCTCCATCTTCCGT GTCTGCATCTGTAGGAGACAGAGTCACCATCA CTTGTCGGGCGAGTCAGGGTATTAGCAGATGG TTAGCCTGGTATCAGCAGAAACCAGGGAAAG CCCCTGAACTCCTGATCTATGCTGCATCCCGT TGCAAAGTGGGATCCCATCCAGGTTCAGCGGC AGTGGATCTGGGACAGACTTCACTCTCACCAT CAGCAGCCTGCAGCCTGAACAGGCTAACAGTTTGCAACTT ACTATTGTCAACAGGCTAACAGTTTCCCTTTCA CTTTCGGCCCTGGGACCAAAGTGGATATCAAA SEQ ID NO: 24661 | CAGGTGCAGCTGGTGCAGTCTGGGCTGAGGTG AAGAAGCCTGGGGCCTCAATGAAGGTCTCCTGC AAGGCTTCTGGATACACCTTCACCGACTATCATA TGCACTGGGTGCGACAGGCCCCTGGACAAGGC TTGAGTGGATGGGATGGATCAACCCTAATAGGG GTGGCACAAACTATGCACAGAAGTTTCAGGACA GGGTCACCATGACCAGGGACACGTCCATCAGCA CAGCCTACATGAACTGAGCAGGCTGAGATCTG ACGACACGGCCGTGTATTCTGTGCGAGAGATGG AACTGGGTCCTTTGACTACTGGGGCCAGGGAACC CTGGTCACCGTCTCCTCA SEQ ID NO: 28667 |
| | | AA | DIQMTQSPSSVSASVGDRVTITCRASQGISRWLA WYQQKPGKAPELLIYAASRLQSGIPSRFSGSGSG TDFTLTISSLQPEDFATYYCQQANSFPFTFGPGTK VDIK SEQ ID NO: 24662 | QVQLVQSGAEVKKPGASMKVSCKASGYTFTDYHM HWVRQAPGQGLEWMGWINPNRGGTNYAQKFQDR VTMTRDTSISTAYMELSRLRSDDTAVYFCARDGTG SFDYWGQGTLVTVSS SEQ ID NO: 28668 |

FIGURE 50
(Continued)

| | | | | |
|---|---|---|---|---|
| iPS:393088 | 21-225_33D1 | NA | GACATCGTGATGACCCAGTCTCCAGACTCCCT GTCTGTGTCTTTGGGCGAGAGGGCCACCATCA ACTGCAAGTCCATCCAGAGTGTTTTATACAGA TCCAACAATAAGAACCTACTTAACTTGGTATCA GCAGAAACCAGGACAGCCTCGTAAACTGTTCA TTTATTGGGCCATCTACCCGGGAATCCGGGGTC CTTGACCGATTCAGTGGCAGCGGGTGTGGGAC AGATTTCACTCTCACCATCACAGCCTGTCAGGA CTGAAGATGTGGCACTTTATTACTGTCAGGAA TATTATAGTTCTCCGTGCAGTTTTGGCCAGGG GACCAAGCTGGAGATCAAA SEQ ID NO: 24663 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGACA TTAACTGGGTGCGACAGGCCACTGGACAAGGC TTGAGTGGATGGGATGGATGCACCCTAACAGTGG TAACACAGGCTTGCACAGAAGTTCCGGGCAG AGTCACCATGACCAGAAACACCTCATAAGCAC AGCCTACATGGAACTGAGCAGCCTGAGATCTGA GGACACGGCCGTGTATTACTGTGCGAGCAGCAGT GGCTGGTACTTTTGACTACTGGGGCCAGGGAA CCCTGGTCACCGTCTCCTCA SEQ ID NO: 28669 |
| | | AA | DIVMTQSPDSLSVSLGERATINCKSIQSVLYRSNN KNYLTWYQQKPGQPRKLFIYWASTRESGVLDRF SGSGCGTDFTLTISLQAEDVALYYCQQYYSSPC SFGQGTKLEIK SEQ ID NO: 24664 | QVQLVQSGAEVKKPGASVKVSCKASGYTFTNYDIN WVRQATGQGLEWMGWMHPNSGNTGFAQKFRGR VTMTRNTSISTAYMELSSLRSEDTAVYYCASSSGW YFFDYWGQGILVTVSS SEQ ID NO: 28670 |
| iPS:393090 | 21-225_33A5 | NA | GACATCAGATGACCCAGTCTCCATCCTCACT GTCTGCATCTGTAGGAGACAGAGTCACCATCA CTTGTCGGGCGAGTCAGGGCATTAGCAATTAC TTAGCCTGGTTTCAGCAGAAACCAGGGAAAGC CCCTAAGTCCCTGATCTCTGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATAATAGTTACCCATTCA CTTTCGGCCCTGGGACCAACGTGGATATCAAA SEQ ID NO: 24665 | GAGGTGCAGCTGTTAGAGTCTGGGGGAGGCTTG GTACAGCCTGGGGGGTCCCTGAGACTCTCCTGTG CAGCCTCTGGATTCACCTTTAGCAGCTATGTCAT AAACTGGGTCCGCCAGGCTCCAGGGAAGGGGCT GGAGTGGGTCTCAGCTATTAGTGGTAGTGGTGTT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAGAACTTCCCT CTTTGACTACTGGGGCCAGGGAACCCTGGTCACC GTCTCCTCA SEQ ID NO: 28671 |

FIGURE 50
(Continued)

| | | | | |
|---|---|---|---|---|
| | | AA | DIQMTQSPSSLSASVGDRVTITCRASQGISNYLAWFQQKPGKAPKSLISAASSLQSGVPSKFSGSGSGTDFTLTISSLQPEDFATYYCQQYNSYPFTFGPGTNVDIK<br>SEQ ID NO: 24666 | EVQLLESGGGLVQPGGSLRLSCAASGFTFSSYVINWVRQAPGKGLEWVSAISGSGVSTYYADSVKGRFTISRDNSKNTLYLQMNSLRAEDTAVYYCARTSLFDYWGQGTLVTVSS<br>SEQ ID NO: 28672 |
| iPS:393092 | 21-225_33C12 | NA | GACATCCAGATGACCCAGTCTCCATCCTCCCTGTCTACATCTGTAGGAGACAGAGTCACCATCACTTGCCGGGCAAGTCAGAGTCATTATCAGTTATTAAATTGGTATCAGCAGAAACCAGGGAAAGCCCCTAAACTCCTGATCTATGTTGCATCCAGTTTGCAAGGTGGGGTCCCATCAAGGTTCACTCTCACCATCAGCAGTCTGCAACCTGAAGATTTTGCAACTTACTACTGTCAACAGAGTTACAGTACCCCGTACACTTTCGGCGGGGGGACCAAGGTGGAGATCAAA<br>SEQ ID NO: 24667 | CAGGTGCAGTTGGTGGAATCTGGGGGAGGCGTGGTCCAGCCTGGGAGGTCCCTGAGACTCTCCTGTGCAGCGTCTGGATTCACCTTCAGTCACTATGGCATGCACTGGGTCCGCCAGGCTCCAGGCAAGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTACTACTTTGACTACTGGGGCCAGGGAACCCTGGTCACCGTCTCCTCA<br>SEQ ID NO: 28673 |
| | | AA | DIQMTQSPSSLSTSVGDRVTITCRASQSIISYLNWYQQKPGKAPKLLIYVASSLQGGVPSRFNGSGSGTDFTLTISSLQPEDFATYYCQQSYSTPYTFGGGTKVEIK<br>SEQ ID NO: 24668 | QVQLVESGGGVVQPGRSLRLSCAASGFTFSHYGMHWVRQAPGKGLEWVAVIWYDGSNKYYADSVKGRFTISRDNSKNTLYLQMNSLRAEDTAVYYCARENSSSYYFDYWGQGTLVTVSS<br>SEQ ID NO: 28674 |

FIGURE 50
(Continued)

| | | | | |
|---|---|---|---|---|
| iPS:393094 | 21-225_34C4 | NA | GACATCCAGATGACCCAGTCTCCATCCCCT GTCTGCATCTGTAGGAGACAGAGTCACCATCA CTTGCCGGGCAAGTCAGGGACATTAGAAATGAT TTAGGCTGGTATCAACAGAAACCAGGGAAAG CCCCTAAGCGCCTGATCTATACTGCATCCAAT TTGCAAAGTGGGGTCCCATCAAGGTTCAGCGG CAGTGGATCTGGGACAGCCTGAAGATTTTGCAACT TCAGCAGCCTGCAGCCTGAAGATTTTGCAACT TATTACTGTCTACAACATAGTTCTTACCCCATC ACCTTCGGCCAAGGGACACGACTGGAGATTAA A | CAGCTGCAGCTGCAGGAGTCGGGCCCAGGACTG GTGAAGCCTTCGGTGCTCCATCAGTAGAAGTAGTTA CTGTCTCTGTGGTCTCCATCAGTAGAAGTAGTTA CTACTGGGGCTGGATCCGCCAGTCCCAGGGAA GGGAGCACCGCCTACAATCCGTCCTCAAGAGTC GAGTCACCATATCCGTAGACACGTCAAGAACC AGGTCTCCCTGAAGCTGAGCTCCGTGACCGCCGC AGACACGGCTGTGTATTACTGTGCGAGACTGAGC AGCAGCTGGTCTTTTGACTACTGGGGCCAGGGAA CCCTGGTCACCGTCTCCTCA |
| | | | SEQ ID NO: 24669 | SEQ ID NO: 28675 |
| | | AA | DIQMTQSPSSLSASVGDRVTITCRASQGIRNDLG WYQQKPGKAPKRLIYTASNLQSGVPSRFSGSGS GTEFTLTISSLQPEDFATYYCLQHSSYPITFGQGT RLEIK | QLQLQESGPGLVKPSETLSLTCTVSGGSISRSSYYW GWIRQSPGKGLEWIGSIYYSGSTAYNPSLKSRVTIS VDTSKNQVSLKLSSVTAADTAVYYCARLSSSWSFD YWGQGTLVTVSS |
| | | | SEQ ID NO: 24670 | SEQ ID NO: 28676 |
| iPS:393096 | 21-225_34D11 | NA | GACATCCAGATGACCCAGTCTCCATCTCCCT GTCTGCATCTGTAGGAGACAGAGTCACCATCA CTTGCCGGGCAAGTCAGGACAGTTAGAAGTGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGCCTGAAGATTTTGCAACT TCATCAGCCTGCAGCCTGAAGATTTTGCAACT TATTACTGTCTACAGCATATCTATTACCCTCCT ACTTTCGGCGGAGGGACCAAGGTGGGGATCA AA | GAGGTGCAGCTGTCGGAGTCTGGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGGAAGGGGCT GGAGTGGGTCTCCGCTATTAGTGGTGGTGTGTGGT AGCACCATTCACGCAGACTCCGTGAAGGGCCGG TTCACCATCTCCAAATGAACAGCCTGAGAGCCGAGG TGTATCTGCAAATGAACAGCCTGAGAGCCGAGG ACACGGCCGTATATTACTGTGTGAAAGGGAGTT AGTAGAGGACTACTACTTCTACGGTATGGACGTC TGGGGCCAAGGGACCACGGTCACCGTCTCCTCA |
| | | | SEQ ID NO: 24671 | SEQ ID NO: 28677 |

FIGURE 50
(Continued)

| | | | | |
|---|---|---|---|---|
| | | AA | DIQMTQSPSSLSASVGDRVTITCRASQDIRSDLG WYQQKPGKAPKRLIYAASSLQSGVPSRFSGSGS GTEFTLTVISLQPEDFATYYCLQHTIYPPTFGGGT KVGIK<br>SEQ ID NO: 24672 | EVQLSESGGGLVQPGGSLRLSCAASGFTFSSYAMN WVRQAPGKGLEWVSAISGRGGSTFHADSVKGRFTI SRDNSKNTLYLQMNSLRAEDTAVYYCVKGELVED YYFYGMDVWGQGTTVTVSS<br>SEQ ID NO: 28678 |
| iPS:393098 | 21-225_35G6 | NA | GACATCCAGATGACCCAGTCTCCATCTTCCGT GTCTGCATCTGTAGGCGACAGACTCACCATCA CTTGTCGGGCGAGTCAGGGTATTAGCCGGTGG TTAGCCTGGTATCAGCAGAAAGTGGGAAAGT CCCAAACTCCTGATCTATGCTGCATCCAGT TGCAAAGTGGGGGTCCCATCAAGGTTCAGCGGC AGTGGATCTGGGACAGCTTTCACTCTCACCAT CGGCAGCCTGCAGCCTGAAGATTTTGCAACTT ACTATTGTCAACAGGCTAACAGTTTCCCGTTC ACTTTCGGCCCTGGGACCAAAGTGGATCTCAA A<br>SEQ ID NO: 24673 | CAGGTGCAGCTGGTGCAGTCTGGGGCTGACGTG AAGAAGCCTGGGGCCTCAGTGAAGGTCTCCTGC AAGGCTTCTGGATACACCTTCACCGACTACCATA TACACTGGGTGCGACAGGCCCCTGGACAAGGGC TTGAGTGGATGGGATGGATCAACCCTAACAATGG TGGCACACACTATGCACAGGAGTTTCAGGGCAG GGTCACCATGACCAGGGACACGTCCATCAGCAC AGCCTACATGGAGCTGAGTAGCCTGAGATCTGAC GACACGGCCGTGTATTACTGTGCGAGAGATGGA ACTGGGTCCTTTGACTACTGGGGCCAGGGAACCC TGGTCACCGTCTCCTCA<br>SEQ ID NO: 28679 |
| | | AA | DIQMTQSPSSVSASVGDRLTITCRASQGISRWLA WYQQKPGKVPKLLIYAASRLQSGVPSRFSGSGS GTAFTLTIGSLQPEDFATYYCQQANSFPFTFGPG TKVDLK<br>SEQ ID NO: 24674 | QVQLVQSGADVKKPGASVKVSCKASGYTFTDYHI HWVRQAPGQGLEWMGWINPNNGGTHYAQEFQGR VTMTRDTSISTAYMELSSLRSDDTAVYYCARDGTG SFDYWGQGTLVTVSS<br>SEQ ID NO: 28680 |

FIGURE 50
(Continued)

| | | | |
|---|---|---|---|
| iPS:393100 | 21-225_36B8 | NA | GACATCCAGATGACCCAGTCTCCATCTCCT GTCTACTTCTGTAGGAGACAGAGTCACCATCA CTTGCCGGGCAAGTCAGAGCATTTATCAGCTAT TTAAATTGGTATCAGCAGAAACCAGGAAAG CCCCTAAACTCCTGATCTATGTTGCATCCAGTT TGCAAAGTGGGGTCCCATCAAGGTTCAGTGGC AGTGGATCTGGGACAGATTTCACTCTCACCAT CAGCAGTCTGCAACCTGCAAGATTTTGCACTT ACTACTGTCAACAGAGTTACAGTACCCGTAC ACTTTCGGCGGAGGGACCAAGATGGAGATCA AA | CAGGTGCAGTTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATATGGCATGATGAAG TAATAAATACTATGGAGACTCCGTGAAGGGCG ATTCACCATCTCCAGAGACAATTCAAGAACACA CTGTATCTGCAAATGAACAGCCTGAGAGCCGAG GACACGGCTGTGTATTACTGTGCGAGAGAAATA GCAACGTCGTACTACTTTGACTACTGGGGCCAGGG AACCCTGGTCACCGTCTCCTCA SEQ ID NO: 28681 |
| | | AA | DIQMTQSPSSLSTSVGDRVTITCRASQSIISYLNW YQQKPGKAPKLLIYVASSLQSGVPSRFSGSGSGT DFTLTISSLQPEDFATYYCQQSYSTPYTFGGGTK MEIK SEQ ID NO: 24675 | QVQLVESGGGVVQPGRSLRLSCAASGFTFSNYGM HWVRQAPGKGLEWVAVIWHDGSNKYYGDSVKGR FTISRDNSKNTLYLQMNSLRAEDTAVYYCARENSS SYYFDYWGQGTLVTVSS SEQ ID NO: 28682 |
| iPS:393102 | 21-225_33F1 | NA | GACATCCAGATGACCCAGTCTCCATCCTCCCT GTCTGCATCTGTAGGAGACAGAGTCACCATCA CTTGCCGGACAAGTCAGGACATTAGAAGTGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAATT TATTACTGTCTACAGCATATTACCCTCCT ACTTTCGGCGGAGGGACCAAGGTGGAGATCA AA SEQ ID NO: 24677 | GAGGTGCAGCTGTTGGAGTCTGGGGGAGGCTTGC TACAGCCGGGGGGGTCCCTGAGACTCTCCTGTGC AGCCTCTGGATTCACCTTTAGCAGCTATGCCATG AGTTGGGTCCGCCAGGCTCCAGGGAAGGGGCTG GAGTGGGTCTCTATTAGTGGTCGTGGTGGTA GCACATTCCACGACAGACTCCGTGAAGGGCCGGTT CACCATCTCCAGAGACAATTCCAAGAACACGCTG TATCTGCAAATGAACAGCCTGAGAGCCGAGGAC ACGGCCGTATATTACTGTGTGAAGGGGAGCTAC TTGAGGACTACTACTTCTACGGTATGACGTCTG GGGCCAAGGACCACGGTCACCGTCTCCTCA SEQ ID NO: 28683 |

FIGURE 50
(Continued)

| | | | |
|---|---|---|---|
| iPS:393104 | 21-225_33A7 | AA | DIQMTQSPSSLSASVGDRVTITCRTSQDIRSDLG WYQQKPGKAPKRLIYAASSLQSGVPSRFSGSGS GTEFTLTISSLQPEDFAIYYCLQHTIYPPTFGGGT KVEIK<br>SEQ ID NO: 24678 | EVQLLESGGGLLQPGGSLRLSCAASGFTFSSYAMS WVRQAPKGLEWVSSISGRGGSTFHADSVKGRFTI SRDNSKNTLYLQMNSLRAEDTAVYYCVKGELLED YYFYGMDVWGQGTTVTVSS<br>SEQ ID NO: 28684 |
| | | NA | GACATCCAGATGACCCAGTCTCCATCCTCCCT GTCTGCATCTGTAGGAGACAGAGTCACCATCA CTTGCCGGGCAAGTCAGGACATTAGAAGTGAT TTAGGCTGGTATCAGCAGAAACCAGGGAAAG CCCCTAAGCGCCTGATCTATGTTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAGCAT ATTACTGTCTACAGCATATATCCCTCCTA CTTTCGGCGGAGGGACCAAGGTGGAGATCAA A<br>SEQ ID NO: 24679 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTGTGCCAT GAGCTGGGTCCGCCAGGCTCCAGGGAAGGGCT GGAGTGGGTCTCCGCTATTAGTGGTCGTGGTGGT AGCACATTCCACGCAGACTCCGTGAAGGGCCGG TTCACCATCTCCAGAGACAACAATTCCAAGAACACGC TGTATCTGCAAATGAACAGCCTGAGAGCCGAGG ACACGGCCGTATATTACTGTGTGAAAGGGGAACT ACTAGAGGACTACTACTTCTACGGTATGGACGTC TGGGGCCAAGGGACCACGGTCACCGTCTCCTCA<br>SEQ ID NO: 28685 |
| | | AA | DIQMTQSPSSLSASVGDRVTITCRASQDIRSDLG WYQQKPGKAPKRLIYVASSLQSGVPSRFSGSGS GTEFTLTISSLQPEDFAAYYCLQHTIYPPTFGGGT KVEIK<br>SEQ ID NO: 24680 | EVQLLESGGGLVQPGGSLRLSCAASGFTFSSCAMS WVRQAPGKGLEWVSAISRGGSTFHADSVKGRFTI SRDNSKNTLYLQMNSLRAEDTAVYYCVKGELLED YYFYGMDVWGQGTTVTVSS<br>SEQ ID NO: 28686 |

FIGURE 50
(Continued)

| | | | | |
|---|---|---|---|---|
| iPS:393106 | 21-225_34A6 | NA | GACATCCAGATGACCCAGTCTCCATCCTCCT GTCTGCATCTGTAGGAGACAGAGTCACCATCA CTTGCCGGACAAGTCAGGACATCAGAAATGAT TTAGGCTGGTATCAGCAGAAACCAGGGAAAG CCCCTAAGCGCCTGATCTTTGCTGCATCCAGTT TGCAAAGTGGGGTCCCATCAAGATTCAGCGGC AGTGGATCTGGGACAGATTCACTCTCACAGT CAGCAGCCTGCAGCCTGAAGATTTTGCAACTT ATTACTGTCTACAGCATAATAGTTACCCTCCTA CTTTCGGCGGAGGGACCAAGGTGGAGATCAA A | GAGGTGCAGCTGTTGGAGTCTGGGGGAGGCTTG GTACAGCCTGGGGGGTCCCTGAGACTCTCTGTG CAGCCTCTGGATTCACCTTTAACAACTATGCCAT GAACTGGGTCCGCCAGGCTCCAGGGAAGGGGCT GGAGTGGGTCTCAGCTATTAGTCGTCGTGGTGGT AGCACATTCTACGCAGACTCCGTGAAGGGCCGGT TCACCATCTCCAGAGACAATTCCAAGAACACTCT GTATCTCCAAATGAACAGCCTGAGAGCCGAGGA CACGGCCGTATATTACTGTGCGAAAGGGAGCT ACTAGAGGACTACTACTTCGCTATGGACGTC TGGGGCCAAGGGACCACGGTCACCGTCTCCTCA |
| | | | SEQ ID NO: 24681 | SEQ ID NO: 28687 |
| | | AA | DIQMTQSPSSLSASVGDRVTITCRTSQDIRNDLG WYQQKPGKAPKRLIFAASSLQSGVPSRFSGSGSG TEFTLTVSSLQPEDFATYYCLQHNSYPPTFGGGT KVEIK | EVQLLESGGGLVQPGGSLRLSCAASGFTFNNYAMN WVRQAPGKGLEWVSAISRRGGSTFYADSVKGRFTI SRDNSKNTLYLQMNSLRAEDTAVYYCAKGELLED YYYFAMDVWGQGTTVTVSS |
| | | | SEQ ID NO: 24682 | SEQ ID NO: 28688 |
| iPS:393108 | 21-225_34G11 | NA | GACATCCAGATGACCCAGTCTCCATCCTCCCT GTCTGCATCTGTGGGAGACAGAGTCACCATCA CTTGCCGGGCAAGTCAGAGTCATTAACAGGTAT TTAAATTGGTATCAGCAGAAACCAGGGAAAG CCCCTAAGCTCCTGATCTATGGTGCATCCAGTT TGCAAAGTGGGGTCCCATCAAGGTTCAGTGGC AGTGGATCTGGGACAGATTTCACTCTCACCAT CAGCAGCCTGCAACCTGAAGATTTTGCAACTT ACTACTGTCAACAGACTTACATTACCCCGCTC ACTTTCGGCGGAGGGACCAAGGTGGAGATCA AA | CAGGTGCAGCTGGTGCAGTCTGGGGCTGAGGTG AAGAAGCCTGGGGCCTCAGTGAAGGTCTCCTGC AAGGCTTCTGGATACACCTTCACGGCTACTATA TGCACTGGGTGCGACAGGCCCCTGGACAGGGGC TTGAGTGGATGGGATGGATCAACCTAACAGTGG TGGCACAAACTATGCACAGGGACACGTCCATCA GGTCACCATGACCAGGGACACGTCCATCAGCAC AGCCTACATGGAGCTGAGCAGGCTGAGATCTGA CGACACGGCCGTGTATTACTGTGCGAGAGATATT AGTAATTTCAGCAGCTGGTACGATTACTACGCTA TGGACGTCTGGGGCCAAGGGACCACGGTCACCG TCTCCTCA |
| | | | SEQ ID NO: 24683 | SEQ ID NO: 28689 |

FIGURE 50
(Continued)

| | | | | |
|---|---|---|---|---|
| | | AA | DIQMTQSPSSLSASVGDRVTITCRASQNINRYLN WYQQKPGKAPKLLIYGASSLQSGVPSRFSGSGS GTDFTLTISTLQPEDFATYYCQQTYITPLTFGGGT KVEIK | QVQLVQSGAEVKKPGASVKVSCKASGYTFTGYYM HWVRQAPGQGLEWMGWINPNSGGTNYAQKFQGR VTMTRDTSISTAYMELSRLRSDDTAVYYCARDISNF SSWYDYYAMDVWGQGTTVTSS |
| | | | SEQ ID NO: 24684 | SEQ ID NO: 28690 |
| iPS:393110 | 21-225_35B7 | NA | GACATCCAGATGACCCAGTCTCCATCCTCCCT GTCTGCATCTGTAGGAGACAGAGTCACCATCA CTTGCCGGGCAAGTCAGGACATTAGAAGTGAT TTAGGCTGGTATCAGCAGAAACCAGGGAAAG CCCCTGAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATATTACCCCTCCT ACTTTCGGCGGAGGGACCAAGGTGGAGATCA AA | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCCGCTATTAGTGGTCGTGGTGGT AGCACATTCCACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGTGAAAGGGAGCT ACTAGAGGACTACTACTTCTACGGTATGGACGTC TGGGGCCAAGGGGCCACGGTCACCGTCTCCTCA |
| | | | SEQ ID NO: 24685 | SEQ ID NO: 28691 |
| | | AA | DIQMTQSPSSLSASVGDRITITCRASQDIRSDLGW YQQKPGKAPERLIYAASSLQSGVPSRFSGSGSGT EFTLTISSLQPEDFATYYCLQHTIYPPTFGGGTKV EIK | EVQLLESGGGLVQPGGSLRLSCAASGFTFSSYAMS WVRQAPGKGLEWVSAISGRGGSTFHADSVKGRFTI SRDNSKNTLYLQMNSLRAEDTAVYCVKGELLED YYFYGMDVWGQGATVTVSS |
| | | | SEQ ID NO: 24686 | SEQ ID NO: 28692 |

FIGURE 50
(Continued)

| | | | |
|---|---|---|---|
| iPS:393112 | 21-225_33G1 | NA | GACATCCAGATGACCCAGTCTCCATCTCCGT GTCTGTGTCTGCGGGCGAGTCAGGGAGACAGAGTCACCATCA CTTGTCCGGGCGAGTCAGGGTATTAGCAGGTGG TTAGCCTGGTATCAGCAGAAACCTGGGAAAGC CCCAAAGCTCCTGATCTATGGTGCATACAGTC TGGCAAAGTGGGGTCCCATCAAGGTTCACTCTCACCAT CAGGAGCCTGCAGCCTGAAGATTTTGCAACTT ACTATTGTCAACAGGCTAACAGTTTCCCATTC ACTTTCGGCCCTGGGACCAAAGTGGATATCAA A<br>SEQ ID NO: 24687 | CAGGTGCAGTTGGCGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAGCCTAACAATGG TGGCACAAACTATGCACAGAAGTTCAGGGCAG GGTCACCATGACCAGGGACACGTCCATCAGCAC AGCCTACATGGAGCTGAGCAGGCTGAGATCTGA CGACACGGCCGTGTATTACTGTGCGAGAGATGG AACTGGGTCCTTTGACTACTGGGGCCAGGGAACC CTGGTCACCGTCTCTCA<br>SEQ ID NO: 28693 |
| | | AA | DIQMTQSPSSVSVSVGDRVTITCRASQGISRWLA WYQQKPGKAPKLLIYGAYSLQSGVPSRFSGSGS GTDFFLTISSLQPEDFATYYCQQANSFPFTFGPGT KVDIK<br>SEQ ID NO: 24688 | QVQLAQSGAEVKKPGASVKVSCKASGYTFTGYYM HWVRQAPGQGLEWMGWISPNNGGTNYAQKFQGR VTMTRDTSISTAYMELSRLRSDDTAVYYCARDGTG SFDYWGQGTLVTVSS<br>SEQ ID NO: 28694 |
| iPS:393114 | 21-225_33G12 | NA | GACATCCAGATGACCCAGTCTCCATCTCCCT GTCTGCATCTGTAGGAGACAGAGTCACCATCA CTTGCCGGGCAAGTCAGAGCATTAGCAACTAT TTAAATTGGTATCAACAGCAAACAGGGAAAG CCCCTAAGTTCCTGATTTATGCTGCATCCAGTT TGCAAAGTGGGGTCCCATCAAGGTTCAGTGGC AGTGGATCTGGGACAGTTCACTCTCACCATC AGCAGTCTGCAACCTGAAGATTTTGCAACTT ACTACTGTCAACAGAGTTACAGTACCCCATTC ACTTTCGGCCCTGGGACCAAAGTGGATATCAA A<br>SEQ ID NO: 24689 | GAGGTGCAGCTGTTGGAGTCTGGGGAGACATG GTCCAGCCTGGGGGTCCCTGAGACTCTCCTGTG CAGCCTCCGGATTCACCTTTAGCAGCTATGCCAT GAGCTGGGTCCGCCAGGCTCCAGGGAAGGGCT GGAGTGGGTCTCAGTTATTAGTAGTGGTAGTGGT AGTCATTCTACGCAGACTCCGTGAAGGGCCGGT TCACCATCTCCAGAGACAATTCCAAGAACACGCT GTATCTGCAAATGAACAGCCTGAGGGCCGAGGA CACGGCCGTATATTACTGTGCGAAAGATCGGGTG AGAGGTCATGATGTTTTGATATCTGGGGCCAAG GGACAATGGTCACCGTCTCTTCA<br>SEQ ID NO: 28695 |

FIGURE 50
(Continued)

| | | | | |
|---|---|---|---|---|
| | | AA | DIQMTQSPSSLSASVGDRVTITCRASQSISNYLN WYQQKPGKAPKFLIYAASSLQSGVPSRFSGSGS GTDFTLTISSLQPEDFATYYCQQSYSTPFTFGPGT KVDIK<br>SEQ ID NO: 24690 | EVQLLESGGDMVQPGGSLRLSCAASGFTFSSYAMS WVRQAPGKGLEWVSVISGSGGSSFYADSVKGRFTI SRDNSKNTLYLQMNSLRAEDTAVYYCAKDRVRAH DGFDIWGQGTMVTVSS<br>SEQ ID NO: 28696 |
| iPS:393116 | 21-225_34G7 | NA | GACATCCAGATGACCCAGTCTCCATCTTCCGT GTCTGCATCTGTAGGAGACAGAGTCACCATCA CTTGTCGGGCGAGTCAGTTATTAGCAAGTGG TTAGCCTGGTATCAGCAGAAACCAGGGAAAG CCCCTAAACTCCTGATCTATGCTGCATCCAGTT TGCAAAGTGGGGTCCCATTAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A<br>SEQ ID NO: 24691 | CAGGTGCAGCTGGTGCAGTCTGGGGCTGAGGTG AAGAAGCCTGGGGCCTCAGTGAAGGTCCTGC AGGGCTTCTGGATACAACCTTCACCGACTACCATA TTCACTGGGTGCGACAGGCCCCTGGACAAGGGCT TGAGTGGATGGGATGGATCAACCCTAACAATGGT GGCACACACTATGCACAGAAGTTTCAGGGCAGG GTCACCATGACCAGGGACACGTCCATCAGCACA GCCTACATGGAGCTGAGCAGGCTGAGATCTGAC GACACGGCCGTGTATTATTGTGCGAGAGATGGAA CTGGGTCCTTTGACTACTGGGGCCAGGGAAACCT GGTCACCGTCTCCTCA<br>SEQ ID NO: 28697 |
| | | AA | DIQMTQSPSSVSASVGDRVTITCRASQLISKWLA WYQQKPGKAPKLLIYAASSLQSGVPLRFSGSGS GTDFTLTISSLQPEDFATYYCQQANSFPFTFGPGT KVDIK<br>SEQ ID NO: 24692 | QVQLVQSGAEVKKPGASVKVSCRASGYTFTDYHIH WVRQAPGQGLEWMGWINPNNGGTHYAQKFQGRV TMTRDTSISTAYMELSRLRSDDTAVYYCARDGTGS FDYWGQGNLVTVSS<br>SEQ ID NO: 28698 |

FIGURE 50
(Continued)

| | | | |
|---|---|---|---|
| iPS:393118 | 21-225_34H11 | NA | GACATCCAGATGACCCAGTCTCCATCCTCCCT GTCTGCATCTGTCGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGCTACATCCAGT TTGCAAAGTGGGGTCCCATCAAGGTTCAGTCGG CAGTGGATCTGGGACAGATTTCACTCTCACAA TCAGCAGCCTGCAGCCTGAAGATTTTGCAACT TATTACTGTCTACAGCATAATAGTTACCCTCCT ACTTTCGGCGGAGGGACCAAGGTGGAGATCA AA<br>SEQ ID NO: 24693<br>DIQMTQSPSSLSASVGDRVTITCRASQDIRNDLG WYQQKPGKAPKRLIYATSSLQSGVPSRFSGSGSG TEFTLTISSLQPEDFATYYCLQHNSYPPTFGGGTK VEIK<br>SEQ ID NO: 24694 | GAGGTGCAGCTGTTGGAGTCTGGGGGAGGCTTG GTACAGCCTGGGGGGTCCCTGAGACTCTCCTGTG CAGCCTCTGATTCACCTTTAGCAGTTATGCCAT GAACTGGGTCCGCCAGGCTCCAGGGAGGGGCT GGAGTGGGTCTCGCTATTAGTGGTGGTGGTGGT AGCACATTCTACGCAGACTCCGTGAAGGGCCGGT TCACCATCTCCAGAGACAATTCAAGAACACGCT GTTTCTGCAAATGAACAGCCTGAGAGCCGAGA CACGGCCGTTTATTACTGTGCGAAAGGGAGCTA CTAGAGGACTACTACTACTGGTATGGACGTCT GGGGCCAAGGGACCACGGTCACCGTCTCCTCA<br>SEQ ID NO: 28699<br>EVQLLESGGGLVQPGGSLRLSCAASGFTFSSYAMN WVRQAPGEGLEWVSAISGGGSTFYADSVKGRFTI SRDNSKNTLFLQMNSLRAEDTAVYYCAKGELLED YYYYGMDVWGQGTTVTVSS<br>SEQ ID NO: 28700 |
| iPS:393120 | 21-225_35H8 | NA | GACATCCAGATGACCCAGTCTCCATCCTCACT GTCTGCATCTGTAGGAGACAGAGTCACCATCA CTTGTGGGGCAAGTCAGGCCATTAGTAATTAT TTAGCCTGGTTTCAGCAGAAACCAGGAAAGC CCCTAAGTCCCTGATCTATGGTGTCCGTCGGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATAATAGTTACCCATTCA CTTTCGGCCCTGGGACCAAAGTGGATTTCAAA<br>SEQ ID NO: 24695 | GAGGTTCAACTGGTGGAGTCTGGGGGAGGCCTG GTCAAGCCTGGGGGGTCCCTGAGACTCTCTGTG CAGCCTCTGGATTCACCTTCAGTAGTTATAGCAT GAACTGGGTCCGCCAGGCTCCAGGGAAGGGGCT GGAGTGGGTCTCGTCCATTAGTGGTACTGGTAGT TTCATATACTACGCAGACTCAGTGAAGGGCCGAT TCACCATCTCCAGAGACAACGCAAGAAATCAG TGTATCTGCAAATGAACAGCCTGAGAGCCGAGG ACACGGCTGTGTATTACTGTGCGAGAGTCTCTGG CTTTGACTACTGGGGCCAGGGAACCCTGGTCACC GTCTCCTCA<br>SEQ ID NO: 28701 |

FIGURE 50
(Continued)

| | | | | |
|---|---|---|---|---|
| | | AA | DIQMTQSPSSLSASVGDRVTITCRASQAISNYLA WFQQKPGKAPKSLIYGASGLQSGVPSKFSGSGS GTDFTLTISSLQPEDFATYYCQQYNSYPFTFGPG TKVDFK<br>SEQ ID NO: 24696 | EVQLVESGGGLVKPGGSLRLSCAASGFTFSSYSMN WVRQAPGKGLEWVSSISGTGSFIYYADSVKGRFTIS RDNAKKSVYLQMNSLRAEDTAVYYCARVSGFDY WGQGTLVTVSS<br>SEQ ID NO: 28702 |
| | | NA | GACATCAGATGACCCAGTCTCCATCTCCCT GTCTACATCTGTCGGAGACAAAGTCACCATCA CTTGCCGGGCAAGTCAGAGCATTATCAGCTAT TTAAAATTGGTATCAGCAGAAACCAGGGAAAG CCCCTAAACTCCTGATCTATGTTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTACCCGTAC ACTTTCGGCGGGGGGACTAAGGTGGAGATCA AA<br>SEQ ID NO: 24697 | CAGGTGCAGTTGGTGGAGTCTGGGGGAGGCGTG GTCCAGCCTGGGAGGTCCCTGAGACTCTCCTGTG CAGCGTCTGGATTCACCTTCAGTAGCTATAGCAT GCACTGGGTCCGCCAGGCTCCAGGCAAGGGGCT GGAGTGGGTGGCAGTTATATGCAGATGATGAAG TAATAAATACTATTCCAGAGAGAGACAATTCCAAGAACACG ATTCACCATCTCCAGAGAGACAATTCCAAGAACACG CTGTATCTGCAAATGAACAGCCTGAGAGCCGAG GACACGGCTGTGTATTACTGTGCGAGAGAAAATA GCAGCTCGTACTACTTTGACTACTGGGGCCAGGG AACCCTGGTCACCGTCTCCTCA<br>SEQ ID NO: 28703 |
| iPS:393122 | 21-225_33B2 | AA | DIQMTQSPSSLSTSVGDKVTITCRASQSIISYLNW YQQKPGKAPKLLIYVASSLQSGVPSRFSGSGSGT DFTLTISSLQPEDFATYYCQQSYSTPYTFGGGTK VEIK<br>SEQ ID NO: 24698 | QVQLVESGGGVVQPGRSLRLSCAASGFTFSNYGM HWVRQAPGKGLEWVAVIWHDGSNKYYADSVKGR FTISRDNSKNTLYLQMNSLRAEDTAVYYCARENSS SYYFDYWGQGTLVTVSS<br>SEQ ID NO: 28704 |

FIGURE 50
(Continued)

| | | | |
|---|---|---|---|
| iPS:393124 | 21-225_33G7 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACCTCACAA TCAGCAGCCTGCAGCCTGAAGATTTTGCAACA TATTACTGTCTACAGCATTATAGTTACCCTCCT ACTTTCGGCGGAGGGACCAAGGTGGAGATCA AA<br><br>SEQ ID NO: 24699 | GAGGTTCAATTGTTGGAGTCTGGGGGAGGCTTGG TACAGCCTGGGGGTCCCTGAGACTCTCCTGTGC AGCCTCTGGATTCACCTTTAGCAACTATGCCATG AGCTGGGTCCGCCAGGCTCCAGGAAGGGGCTG GAGTGGGTCTCAGTATTAGTCGTCGTGGTGGTA GCACATTCTACGCAGACTCCGTGAAGGGCAGTT CACCATTTCCAGAGACAATTCCAAGAACACGCTG TATCTGCAAATGAACAGCCTGAGAGCCGAGGAC ACGGCCGTGTATTACTGTGCGAAAGGGGAGCTA CTAGAGGACTACTCCTACTACGGTATGGACGTCT GGGGCCAGGGGACCACGGTCACCGTCTCCTCA<br><br>SEQ ID NO: 28705 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPPTFGGGT KVEIK<br><br>SEQ ID NO: 24700 | EVQLLESGGGLVQPGGSLRLSCAASGFTFSNYAMS WVRQAPGKGLEWVSAISRRGGSTFYADSVKGQFTI SRDNSKNTLYLQMNSLRAEDTAVYYCAKGELLED YSYYGMDVWGQGTTVTVSS<br><br>SEQ ID NO: 28706 |
| iPS:393126 | 21-225_35D1 | NA | GACATCCAGATGACCCAGTCTCCATCTCCCT GTCTGCATCTGTAGGAGACAGAGTCACCATCA CTTGCCGGGCAAGTCAGGACCATTAGAAGTGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATTACCCTCCC ACTTTCGGCGGGGGGACCAAGGTGGAGATCA AA<br><br>SEQ ID NO: 24701 | GAGGTGCAACTGTTGGAGTCTGGGGGAGGCTTG GTACAGCCTGGGGGGTCCCTGAGACTCTCTGTG CAGCCTCTGGATTCACCTTTAGCAGCTATGCCAT GAGCTGGGTCCGCCAGGCTCCAGGGAAGGGCT GGAGTGGGTCTCGGTCTATTAGTGGTGGTGGT AGCACATTCCACGCAGACTCCGTGAAGGGCCGG TTCACCATCTCCAGAGACAATTCCAACAACACGC TGTATCTGCAAATGAACAGCCTGAGAGCCGAGG ACACGGCCGTATATTACTGTGTGAAAGGGGAGTT ACTAGAGGACTACTACTTCTACGGTATGGACGTC TGGGGCCAAGGGCCACGGTCACCGTCTCCTCA<br><br>SEQ ID NO: 28707 |

FIGURE 50
(Continued)

| | | | |
|---|---|---|---|
| iPS:393128 | 21-225_35F11 | AA | DIQMTQSPSSLSASVGDRVTITCRASQDIRSDLG WYQQKPGKAPKRLIYAASSLQSGVPSRFSGSGS GTEFTLTISSLQPEDFATYYCLQHTYPPTFGGT KVEIK<br><br>SEQ ID NO: 24702 | EVQLLESGGGLVQPGGSLRLSCAASGFTFSSYAMS WVRQAPGKGLEWVSAISGRGGSTFHADSVKGRFTI SRDNSNNTLYLQMNSLRAEDTAVYYCVKGELLED YYFYGMDVWGQGATVTVSS<br><br>SEQ ID NO: 28708 |
| | | NA | GACATCCAGATGACCCAGTCTCCATCCTCCCT GTCTGCATCTGTAGGAGACAGAGTCACCATCA CTTGCCGGGCAAGTCAGGACATTAGAAGTGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATACTTATCCCTCCT ACTTTCGGCGGAGGGACCAAGGTGGAGATCA AA<br><br>SEQ ID NO: 24703 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCCGCTATTAGTGGTGTGTGGT AGCACATTCACGCAGACTCCATGAAGGGCCGG TTCACCATCTCCAGAGACAATTCCAAGAACACGC TGTATCTGCAAATGAACAGCCTGAGAGCCGAGG ACACGGCCGTATATTACTGTGTGAAAGGGGAGCT ACTAGAGGACTACTACTTCTACGGTATGACGTC TGGGGCCAAGGGACCACGGTCACCGTCTCCTCA<br><br>SEQ ID NO: 28709 |
| | | AA | DIQMTQSPSSLSASVGDRVTITCRASQDIRSDLG WYQQKPGKAPKRLIYAASSLQSGVPSRFSGSGS GTEFTLTISSLQPEDFATYYCLQHTVPPTFGGG TKVEIK<br><br>SEQ ID NO: 24704 | EVQLLESGGGLVQPGGSLRLSCAASGFTFSSYAMS WVRQAPGKGLEWVSAISGRGGSTFHADSMKGRFTI SRDNSKNTLYLQMNSLRAEDTAVYYCVKGELLED YYFYGMDVWGQGTTVTVSS<br><br>SEQ ID NO: 28710 |

FIGURE 50
(Continued)

| | | | | |
|---|---|---|---|---|
| iPS:393130 | 21-225_33C2 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGTGAAAGC CCCTAAGCGCCTGATCTATGCTGCACCCAGTT TGCAAAGTGGGGTCCCATCAAGGTTCAGCGGC AGTGGATCTGGGACAGAGAATTCACTCTCACAA CAGCAGCCTGCAGCCTGAACATTTTGCAACTT ATTACTGTCTACAGCATAATAGTTACCCTGTGG ACGTTCGGCCAGGGGACCAAGGTGGAAATCA AA SEQ ID NO: 24705 | GAGGTGCAACTGGTGGAGTCTGGGGGAGGCCTG GTCAAGCCGGGGGGGGTCCCTGAGACTCTCCTGTG CAGCCTCTGGATTCACCTTCAGTAGCTATACCAT GAACTGGGTCCGCCAGGCTCCAGGGAAGGGGCT GCAGTGGGTCTCATCATTAGTGGTAGTAGTAGT TACATATACTACGCGGACTCAGTGAAGGGCCGAT TCACCATCTCCAGAGACAACGCAAGAACTCACT GTTTCTGCAAATGAACAGCCTGAGAGCCGAGA CACGGCTATCTTTTACTGTGCGCGAGATCGGGGG GGGACCTGGGGCCAGGGAACCCTGGTCACCGTC TCCTCA SEQ ID NO: 28711 |
| | | AA | DIQMTQSPSSLSASVGDRVTITCRASQGIRNDLG WYQQKPVKAPKRLIYAAPSLQSGVPSRFSGSGS GTEFTLTISSLQPEHFATYYCLQHNSYPWTFGQG TKVEIK SEQ ID NO: 24706 | EVQLVESGGGLVKPGGSLRLSCAASGFTFSSYTMN WVRQAPGKGLQWVSSISGSSSYIYYADSVKGRFTIS RDNAKNSLFLQMNSLRAEDTAIFYCARDRGGTWG QGTLVTVSS SEQ ID NO: 28712 |
| iPS:393132 | 21-225_33H7 | NA | CAGGTGCAGCTGGTGCAGTCTGGGGCTGACGTG GTCTGCATCTGTAGGCGACAGAGTCACCATCA CTTGTCGGGCGAGTCAGGTATTAGCCGGTGG TTAGCCTGGTATCAGCAGAAAGTGGGGAAAGT CCCCAAACTCCTGATCTATGCTGCATCCAGT TGCAAAGTGGGGTCCCATCAAGGTTCAGCGGC AGTGGATCTGGGACAGATTTCACTCTCACCAT CGGCAGCCTGCAGCCTGAAGATTTTGCAACTT ACTATTGTCAACAGGCTAACATTTTCCCGTTCA CTTTCGGCCCTGGGACCAAAGTGGATCTCAAA SEQ ID NO: 24707 | AAGAAGCCTGGGGCCTCAGTGAAGGTCTCCGC AAGGCTTCTGGATACACCTTCACCGACTACCATA TACACTGGGTGCGACAGGCCCCTGGACAAGGGC TTGAGTGGATGGGATGGATCAACCCTAACAATGG TGGCACACACTATGCACAGGAGTTTCAGGGCAG GGTCACCATGACCAGGGACACGTCCATCAGCAC AGCCTACATGGAACTGAGTAGCCTGAGATCTGAC GACACGGCCGTGTATCACTGTGCGAGAGATGGA ACTGGGTCCTTTGACTACTGGGGCCAGGGAACCC TGGTCACCGTCTCCTCA SEQ ID NO: 28713 |

FIGURE 50
(Continued)

| | | | | |
|---|---|---|---|---|
| iPS:393134 | 21-225_34C2 | AA | DIQMTQSPSSVSASVGDRVTITCRASQGISRWLAWYQQKVGKVPKLLIYAASRLQSGVPSRFSGSGSGTDFTLTIGSLQPEDFATYYCQQANIFPFTFGPGTKVDLK<br>SEQ ID NO: 24708 | QVQLVQSGADVKKPGASVKVSCKASGYTFTDYHIHWVRQAPGQGLEWMGWINPNGGTHYAQEFQGRVTMTRDTSISTAYMELSSLRSDDTAVYHCARDGTGSFDYWGQGTLVTVSS<br>SEQ ID NO: 28714 |
| | | NA | GACATCCAGATGACCCAGTCTCCATCCTCCCTGTCTACATTTGTAGGAGACAGAGTCACCATTACTTGTCGGGCAAGTCAGAGAATTATCAGCTATTTAAATTGGTTTCAGCAGAAACCAGGGAAAGCCCCTAAACTCCTGATCTATGTTGCATCCAGTTTGCAAAGTGGGGTCCCGTCAAGGTTCAGTGGCAGTGGATCTGGGACATATTTCACTCTCACCATCAGCAGTCTGCAACAGAGTTACAGTACCCGTACACTTTCGGCGGAGGGACCAAGGTGGAGATCAAA<br>SEQ ID NO: 24709 | CAGGTGCAGTTGGTGGAGTCTGGGGGAGGCGTGGTCCAGCCTGGGAGGTCCCTGAGACTCTCCTGTGCAGCGTCTGGATTCACCTTCAGTGACTATCATGCACTGGGTCCGCCAGGCTCCAGGCAAGGGCTGGAGTGGGTGGCACTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTACTACTTTGCTGCGAGAGAAAATAGCAGCTCGTACTACTTTGACTACTGGGGCCAGGGAACCCTGGTCACCGTCTCCTCA<br>SEQ ID NO: 28715 |
| | | AA | DIQMTQSPSSLSTFVGDRVTITCRASQRIISYLNWFQQKPGKAPKLLIYVASSLQSGVPSRFSGSGSGTYFTLTISSLQPEDFATYYCQQSYSTPYTFGGGTKMEIK<br>SEQ ID NO: 24710 | QVQLVESGGGVVQPGRSLRLSCAASGFTFSNYVMHWVRQAPGKGLEWVALIWYDGSNKYYADSVKGRFTISRDNSKNTLYLQMNSLRAEDTAVYYCARENSSSYYFDYWGQGTLVTVSS<br>SEQ ID NO: 28716 |

FIGURE 50
(Continued)

| | | | | |
|---|---|---|---|---|
| iPS:393136 | 21-225_34D8 | NA | GACATCCAGATGACCCAGTCTCCATCCTCCCT GTCTACATCTGTAGGAGACAGAGTCACCATCA CTTGCCGGGCAAGTCAGATCATTATCAGCTAT TTAAATTGGTATCAGCAGAAACCAGGGAAAG CCCCTAAACTCCTGATCTTTGTTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTACCCCGTAC ACTTTCGGCGGAGGGACCAAGGTGGAGATCA AA | CAGGTGCAGCTTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATATGTATGATGGAAGT AATAAATACTATGCAGACTCCGTGAAGGGCCGA TTCACCATCTCCAGAGACAATTCAAGAACACGC TGTATCTGCAAATGAACAGCCTGAGAGCCGAGG ACACGGCTGTGTATTACTGTGCGAGAGAAAATAG CAGCTCGTACTACTTTGACTACTGGGGCCAGGGA ACCCTGGTCACCGTCCTCA |
| | | | SEQ ID NO: 24711 | SEQ ID NO: 28717 |
| | | AA | DIQMTQSPSSLSTSVGDRVTITCRASQIISYLNW YQQKPGKAPKLLIFVASSLQSGVPSRFSGSGSGT DFTLTISSLQPEDFATYYCQQSYSTPYTFGGGTK VEIK | QVQLVESGGGVVQPGRSLRLSCAASGFTFSNYGM HWVRQAPGKGLEWVAVIWYDGSNKYYADSVKGR FTISRDNSKNTLYLQMNSLRAEDTAVYYCARENSS SYYFDYWGQGTLVTVSS |
| | | | SEQ ID NO: 24712 | SEQ ID NO: 28718 |
| iPS:393138 | 21-225_35E3 | NA | GACATCCAGATGACCCAGTCTCCATCCTCCCT GTCTGCATCTGTAGGAGACAGAGTCACCATCA CTTGCCAGGCGAGTCAGGACATTTCAACTAA TTAAATTGGTATCAGCAGAAACCAGGGAAAAG CCCCTAACCTCCTGATCTACGATGCCTCCAATT TGGAAACAGGGGTCCCATCAAGGTTCAGTGGA AGTGGATCTGGGACAGATTTTACTTTCACCAT CAGCAGCCTGCAGCCTGAAGATATTGCGACAT ATTTCTGTCAACAGTATGATAATCTCCCGATC ACCTTCGGCCAAGGGACACGACTGGATATTAG A | CAGGTGCAGCTGCAGCTGGTGCAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATCATATGGTGGAAGT AATAAATACTATGCAGACTCCGTGAAGGGCCGA TTCACCATCTGCAAATGAACAGCCTGAGAGCTGAGG ACACGGCTGTGTATTACTGTGTGAGAAGGGGGTA TAGCAGTGGAGGCTACGGTATGGACGTCTGGGG CCAAGGGACCACGGTCACCGTCTCCTCA |
| | | | SEQ ID NO: 24713 | SEQ ID NO: 28719 |

FIGURE 50
(Continued)

| | | AA | DIQMTQSPSSLSASVGDRVTITCQASQDIFNYLN WYQQKPGKAPNLLIYDASNLETGVPSRFSGSGS GTDFTFTISSLQPEDIATYFCQQYDNLPITFGQGT RLDIR<br><br>SEQ ID NO: 24714 | QVQLVESGGGVVQPGRSLRLSCAASGFTFSSYGMH WVRQAPGKGLEWVAVISYGGSNKYYADSVKGRFT ISRDNSKNTLYLQMNSLRAEDTAVYYCVRRGYSSG GYGMDVWGQGTTVTVSS<br><br>SEQ ID NO: 28720 |
|---|---|---|---|---|
| iPS:393140 | 21-225_35H12 | NA | GACATCCAGATGACCCAGTCTCCATCTTCCGT GTCTGCATCTGTAGGAGACAGAGTCACCATCA CTTGTCGGGCGAGTCAGGGTATTAGCAGATGG TTAGCCTGGTATCAGCAGAAACCAGGGAAAG CCCCTGAACTCCTGATCTATGCTGCATCCCGTT TGCAAAGTGGGATCCCATCCAGTTCACTCTCA AGTGGATCTGGGACAGACTTCACTCTCAACTT CAGCAGCCTGCAGCCTGAAGATTTTGCAACTT ACTATTGTCAACAGGCTAACAGTTTCCCATTC ACTTTCGGCCCTGGGACCAAAGTGGATATCAA A<br><br>SEQ ID NO: 24715 | CAGGTGCAGCTGGTGCAGTCTGGGGCTGAGGTG AAGAAGCCTGGGGCCTCAGTGAAGGTCTCCTGC AAGGCTTCTGGATACACCTTCACCGACTACTATA TACACTGGGTGCGACAGGCCCCTGGACAAGGGC TTGAGTGGATGGGATGGATCAACCCTAATAGGG GTGGCACAAACTATGCACAGAAGTTTCAGGGCA GGGTCACCATGACCAGGGACACGTCCATCAGCA CAGCCTACATGGAACTGAGCAGGCTGAGATCTG ACGACACGGCCGTGTATTACTGTGCGAGAGATG GAACTGGGTCTTTGACTACTGGGGCCAGGGAAC CCTGGTCACCGTCTCCTCA<br><br>SEQ ID NO: 28721 |
| | | AA | DIQMTQSPSSVSASVGDRVTITCRASQGISRWLA WYQQKPGKAPELLIYAASRLQSGIPSRFSGSGSG TDFTLTISSLQPEDFATYYCQQANSFPFTFGPGTK VDIK<br><br>SEQ ID NO: 24716 | QVQLVQSGAEVKKPGASVKVSCKASGYTFTDYYIH WVRQAPGQGLEWMGWINPNRGGTNYAQKFQGRV TMTRDTSISTAYMELSRLRSDDTAVYYCARDGTGS FDYWGQGTLVTVSS<br><br>SEQ ID NO: 28722 |

FIGURE 50
(Continued)

| | | | | |
|---|---|---|---|---|
| iPS:393142 | 21-225_33A3 | NA | GACATCCAGATGACCCAGTCTCCATCCTCACT GTCTGCATCTGTAGGAGACAGAGTCACCATCA CTTGTCGGGCGAGTCAGGGCATTAACAATTAT TTAGCCTGGTTTCAACAGAAACCAGGAAAGC CCCTAAGTCCCTGATCTACGCTGCATCCAGTTT GCAAAGTGGGGTCCCATCAAAGTTCAGCGGCA GTGGATCTGGGACAGATTTCACTCTCACCATC AGCAGCCTGCAACAGTTTAATAGTTACCCTCGA TTACTGCCAACAGTTTAATAGTTACCCTCCGA CGTTCGGCCAAGGGACCAAGGTGGAAATCAA A | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATGGCAT GAACTGGGTCCGCCAGGCTCCAGGGAAGGGGCT GGAGTGGGTCTCATCCATTAGTGGTAGTAGTACT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAACAAACGGT ATGGACGTCTGGGGCCAAGGGACCACGGTCACC GTCTCCTCA |
| | | | SEQ ID NO: 24717 | SEQ ID NO: 28723 |
| | | AA | DIQMTQSPSSLSASVGDRVTITCRASQGINNYLA WFQQKPGKAPKSLIYAASSLQSGVPSKFSGSGSG TDFTLTISSLQPEDFATYYCQQFNSYPPTFGQGT KVEIK | EVQLVESGGGLVKPGGSLRLSCAASGFTFSSYGMN WVRQAPGKGLEWVSSISGSSTYIYYADSVKGRFTIS RDNAKNSLYLQMNSLRAEDTAVYYCARTNGMDV WGQGTTVTVSS |
| | | | SEQ ID NO: 24718 | SEQ ID NO: 28724 |
| iPS:393144 | 21-225_34D2 | NA | GATATTGTGATGACCCAGACTCCACTCTCTCT GTCCGTCACCCTGGACAGCCGGCCTCCATCT CCTGCAAGTCTAGTCAGAGCCTCCTGCATAGT GATGGAAAGACCTATTTGTATTGGTACCTGCA GAAGCCAGGCCAGCCTCCACAGCTCCTGATCT ATGAAGTTTCCAACCGGTTCTCTGGAGTGCCA GATAGGTTCAGTGGCAGCGGGTCAGGGACAG ATTTCACACTAAAAATCAGCCGGGTGGAGGCT GAGGATGTTGGGGTTTATTACTGCATGCAAAG TAAACAGCTTCCTCCTTTCGGCGGAGGGACCA AGGTGGAGATCAGA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGACA TTAACTGGGTGCGACAGGCCACTGGACAAGGGC TTGAGTGGATGGGATGGCTGCACCCTAACAGTGG TACCACAGGCTTTGCACAGAAGTTCCGGGGCAG AGTCACCATGACCAGAAACACCTCCATAAGCAC AGCCTACTTGGAACTGAGCAGCCTGAGATCTGAG GACACGGCCGTGTATTACTGTGCGAGCAGCAGTG GCTGGTACTTTTTGACTACTGGGGCCAGGGAAC CCTGGTCACCGTCCTCA |
| | | | SEQ ID NO: 24719 | SEQ ID NO: 28725 |

FIGURE 50
(Continued)

| | | | | |
|---|---|---|---|---|
| | | AA | DIVMTQTPLSLSVTPGQPASISCKSSQSLLHSDGK TYLYWYLQKPGQPPQLLIYEVSNRFSGVPDRFSG SGSGTDFTLKISRVEAEDVGVYYCMQSKQLPPF GGGTKVEIR<br><br>SEQ ID NO: 24720 | QVQLVQSGAEVKKPGASVKVSCKASGYTFTNYDIN WVRQATGQGLEWVGWLHPNSGTTGFAQKFRGRV TMTRNTSISTAYLELSSLRSEDTAVYYCASSSGWYF FDYWGQGTLVTVSS<br><br>SEQ ID NO: 28726 |
| iPS:393146 | 21-225_34G8 | NA | GACATCCAGATGACCCAGTCTCCATCTCCCT GTCTGCATCTGTAGGAGACAGAGTCACCATCA CTTGCCGGGCAAGTCAGGACATTAGAAGTGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATACTATTTACCCTCCT ACTTTCGGCGGAGGGACCAAGGTGGAGATCA AA<br><br>SEQ ID NO: 24721 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCCGCTATTAGTGGTCGTGGTGGT AGCACATTCCACGCAGACTCCGTGAAGGGCCGG TTCACCATCTCCAGAGACAATTCCAAGAACACGC TGTATCTGCAAATTAACAGCCTGAGAGCCGAGG ACACGGCCGTATATTACTGTGTGAAAGGGGAGCT ACTAGAGGACTACTACTTCTACGGTATGGACGTC TGGGGCCAAGGGACCACGGTCACCGTCTCCTCA<br><br>SEQ ID NO: 28727 |
| | | AA | DIQMTQSPSSLSASVGDRVTITCRASQDIRSDLG WYQQKPGKAPKRLIYAASSLQSGVPSRFSGSGS GTEFTLTISSLQPEDFATYYCLQHTIYPPTFGGGT KVEIK<br><br>SEQ ID NO: 24722 | EVQLLESGGGLVQPGGSLRLSCAASGFTFSSYAMS WVRQAPGKGLEWVSAISGRGGSTFHADSVKGRFTI SRDNSKNTLYLQINSLRAEDTAVYYCVKGELLEDY YFYGMDVWGQGTTVTVSS<br><br>SEQ ID NO: 28728 |

FIGURE 50
(Continued)

| | | | |
|---|---|---|---|
| iPS:393148 | 21-225_35E5 | NA | GACATCCAGATGATCCAGTCTCCATCTCCT GTCTGCATCTGTAGGAGACAGAGTCACCATCA CTTACCGGGCAAGTCAGAGCATTAGCAGCTAT TTAAATTGGTATCAGCAGAAACCAGGAAAGC CCCTAAGCTCCACATCTATGGTGCATCCAGTTT CCAAAGTTGGGTCCCATCAAGGTTCAGTGGCA GTGGATCTTTCGACAGATTTCACGCTCACCATC ATCAGTATGCAACCTGGAGATTATGCAACTTA CTACTGTCACCAGAGTTACAATCTCCCGATCA CCTTCGGCCAAGGGACCCGACTGGAGATTAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGC TTGAGTGGATGGATGAATGGCACAGAAGTCACAGTG GTAACACAGGCTATGCACAGAAGTTCCAGGCA GAGTCACCATGACCAGGAACACCTCCATAAGCA CAGCCTACATGGAGCTGAGCAGCCTGAGATCTG AGGACACGGCCGTGTATTACTGTGCGAGAAAGA AGTCTAACGACTACTGGGGCCAGGGAACCCTGG TCACCGTCTCCTCA |
| | | | SEQ ID NO: 24723 | SEQ ID NO: 28729 |
| | | AA | DIQMIQSPSSLSASVGDRVTITYRASQSISSYLNW YQQKPAKAPKLHIYGASSFQSWVPSRFSGSGSST DFTLTIISMQPGDYATYYCHQSYNLPITFGQGTR LEIK | QVQLVQSGAEVKKPGASVKVSCKASGYTFTSYDIN WVRQATGQGLEWMGWMNPNSGNTGYAQKFQGR VTMTRNTSISTAYMELSSLRSEDTAVYYCARKKSN DYWGQGTLVTVSS |
| | | | SEQ ID NO: 24724 | SEQ ID NO: 28730 |
| iPS:393150 | 21-225_36A5 | NA | GACATCCAGATGACCCAGTCTCCATCTCCCT GTCTGCATCTGTAGGAGACAGAGTCACCATCA CTTGCCGGACAAGTCAGGACATTAGAAATGAT TTAGGCTGGTATCAGCAGAAACCAGGAAAG CCCCTAAGCGCCTGATCTTTGCTGCATCCAGTT TGCAAAGTGGGGTCCCATCAAGATTCAGCGGC AGTGGATCTGGGACAGAATTCACTCTCACAAT CAGCAGCCTGCAGCCTGAAGATTTTGCAACTT ATTACTGTCTACACCACAATAGTTACCCTCCTA AGTTTGGCGGAGGGATCAAGGTGGAGATCAC A | GAGGTGCAGCTGTTGGAGTCTGGGGGAGGCTTG GTACAGCCTGGGGGGTCCCTGAGACTCTCCTGTG CAGCCTCTGGATTCACCTTTAACAACTATGCCAT GAACTGGGTCCGCCAGGCTCCAGGGAAGGGGCT GGAGTGGGTCTCAGCTATTAGTGGTGTGGTGGT AACACATTCTACGCAGACTCCGTGAAGGGCCGGT TCACCATCTCCAAATGAACAGCCTGAGAACACGCT GTATCTCCAAATGAACAGCCTGAGAGCCGAGA CACGGCCGTATATTACTGTGCGAAAGGGAGCT ACTAGAGGACTACTACTACTACGCTATGGACGTC TGGGGCCAAGGGACCACGGTCACCGTCTCCTCA |
| | | | SEQ ID NO: 24725 | SEQ ID NO: 28731 |

FIGURE 50
(Continued)

| | | | | |
|---|---|---|---|---|
| iPS:393152 | 21-225_25B3 | AA | DIQMTQSPSSLSASVGDRVTITCRTSQDIRNDLG WYQQKPGKAPKRLIFAASSLQSGVPSRFSGSGSG TEFTLTISSLQPEDFATYYCLHHNSYPPKFGGGIK VEIT | EVQLLESGGGLVQPGGSLRLSCAASGFTFNNYAMN WVRQAPGKGLEWVSAISRRGGNTFYADSVKGRFTI SRDNSKNTLYLQMNSLRAEDTAVYYCAKGELLED YYYYAMDVWGQGTTVTVSS |
| | | | SEQ ID NO: 24726 | SEQ ID NO: 28732 |
| | | NA | GACATCCAGATGACCCAGTCTCCCTCTTCCGT GTCTGCATCTGTAGGAGACAGAGTCACCATCA CTTGTCGGGCGAGTCAGGTATTAGCAGCTGG TTAGCCTGGTATCAGCAGAAACCAGGGAAAG CCCCTAAGCTCCTGATCTATGCTGCATCCAGTT TGCAAAGTGGGGTCCCATCAAGGTTCAGCGCC AGTGGATCTGGGACAGATTTCACTCTCACCAT CAGCAGCCTGCAGCCTGAAGATTTTGCGACTT ACTGTTGTCAACAGTCTGACAGTTCCCTCGG ACGTTCGGCCAAGGGACCAAGGTGAAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGCAGCTATGGCAT GCACTGGGTCCGCCAGGCTCCAGGCAAGGGCT GGAGTGGGTGGCAGTTATATGGTATGATGAAGT AATAAATATTATGCAGACTCCGTGAAGGGCCGAT TCACCATCTCCAGAGACAATTCCAAGAACACGCT ATATCTACAAATGAACAGCCTGAGAGCCGAGGA CACGGCTGTGTATTACTGTGCGAGAGATTCCTCC CCCTACGGTATGGACGTCTGGGGCCAAGGGACC ACGGTCACCGTCTCCTCA |
| | | | SEQ ID NO: 24727 | SEQ ID NO: 28733 |
| | | AA | DIQMTQSPSSVSASVGDRVTITCRASQGISSWLA WYQQKPGKAPKLLIYGASSLQSGVPSRFSASGS GTDFTLTISSLQPEDFATYCCQQSDSFPRTFGQGT KVEIK | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDSSPY GMDVWGQGTTVTVSS |
| | | | SEQ ID NO: 24728 | SEQ ID NO: 28734 |

FIGURE 50
(Continued)

| | | | | |
|---|---|---|---|---|
| iPS:393166 | 21-225_27G6 | NA | TCCTATGAGCTGACTCAGCCACCCTCAGTGTC CGTGTCCCAGGACAGACAGCCAGCATCACCT GCTCTGGAGATAAATTGGGGGATAAATATGCT TGCTGGTATCAGCAGAAGCCAGGCCAGTCCCC TGTGTTGGTCATCTATCAAGATAGGAAGCGGC CCTCAGGGATCCGAGCGATTCTCTGGCTCC AACTCTGGGAACAGCACTCTGACCATCAG CGGGACCCAGACTATGGATGAGGCTGACTATT ACTGTCAGGCTGGGACAGCAGTCTTATGTG GTATTCGGCGGAGGGACCAAGCTGACCGTCCT A | CAGGTGCAGCTGGTGGAGTCTGGGGGAGGCGTG GTCCAGCCTGGGAGGTCCCTGAGACTCTCCTGTG CAGCGTCTGGATTCACCTTCAGTGGCTATGGCAT GCACTGGGTCCGCCAGGCTCCAGGCAAGGGCT GGAGTGGGTGGCAATTATATGGTATGATGAAGT AAAAATACAATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATAGGGT ATATTGTAGTAGTACCAGCTGCTCCCCTTACTAC TACTACTACGGTATGGACGTCTGGGGCCAAGGG ACCACGGTCACCGTCTCCTCA |
| | | AA | SYELTQPPSVSVSPGQTASITCSGDKLGDKYACW YQQKPGQSPVLVIYQDRKRPSGIPERFSGSNSGN TATLTISGTQTMDEADYYCQAWDSSSYVFGG GTKLTVL | QVQLVESGGGVVQPGRSLRLSCAASGFTFSGYGM HWVRQAPGKGLEWVAIIWYDGSKKYNADSVKGR FTISRDNSKNTLYLQMNSLRAEDTAVYYCARDRVY CSSTSCSPYYYYYGMDVWGQGTTVTVSS |
| | | | SEQ ID NO: 24729 | SEQ ID NO: 28735 |
| | | | SEQ ID NO: 24730 | SEQ ID NO: 28736 |

FIGURE 50
(Continued)

| | | | |
|---|---|---|---|
| iPS:393168 | 21-225_32B11 | NA | TCCTATGAACTGACTCAGCCACCCTCAGTGTC CGTGTCCCCAGGACAGACAGCCAGCATCACCT GCTCTGGAGATAAATTGGGGATAAATATGCT TACTGGTATCAGCAGAAGCCAGGCCAGTCCCC TGTGTTGGTCATCTATCAAGATAGTAAGCGGT CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGGTGGGACAACAGCTACTGTGTA TTCGGCGGAGGGACCAAGCTGACCGTCCTA<br>SEQ ID NO: 24731 | CAGGTGCAGCTGGTGCAGTCTGGGGCTGAGGTG AAGAAGCCTGGGGCCTCAGTGAAGGTCCTGC AAGGCTTCTGGATACACCTTCACCGGCTACTATA TGCACTGGGTGCGACAGGCCCCTGGACAAGGGC TTGAGTGGATGGGATGGATCAACCTAACAGTGA TGGCACTAACTATGCACAGAAGTTTCAGGGCAG GGTCACCATGACCAGGGACACGTCCATCAGCAC AGCCTACATGGAGCTGAACAGGCTGAGATCGA CGACACGGCCGTGTATTACTGTGCGAGGGGGTTT TACTATGTTCGGGAGTTATTATAACGACCTCG ACCCCTGGGGCCAGGGAACCCTGGTCACCGTCTC CTCA<br>SEQ ID NO: 28737 |
| | | AA | SYELTQPPSVSVSPGQTASITCSGDKLGDKYAY WYQQKPGQSPVLVIYQDSKRSSGIPERFSGSNSG NTATLTISGTQAMDEADYYCQAWDNSTVFGG GTKLTVL<br>SEQ ID NO: 24732 | QVQLVQSGAEVKKPGASVKVSCKASGYTFTGYYM HWVRQAPGQGLEWMGWINPNSDGTNYAQKFQGR VTMTRDTSISTAYMELNRLRSDDTAVYYCARGFYY GSGSYYNDLDPWGQGTLVTVSS<br>SEQ ID NO: 28738 |
| iPS:393172 | 21-225_3B12 | NA | TCCTATGAGCTGACTCAGCCACCCTCAGTGTC CGTGTCCCCAGGACAGACAGCCAGCATCACCT GCTCTGGAGATAAATTGGGGGAAAAATATGCT TGCTGGTATCAGCAGAAGCCAGGCCAGTCCCC TGTGCTGGTCATCTATCAAGATAGGAAGCGGC CCTCAGGGATCCCTGAGCGATTCTCTGGCTCC AACTCTGGGAACAAAGCCACTCTGACCATCAG CGGGACCCAGGCTATGGATGAGGCTGACTATT ACTGTCAGGCGTGGGTCAACAACACTATGATA TTCGGCGGAGGGACCAAGCTGACCGTCCTA<br>SEQ ID NO: 24733 | CAGGTGCACCTGGTGGAGTCTGGGGGAGGCGTG GTCCAGCCTGGGAGGTCCCTGAGACTCTCCTGTG CAGCCTCTGGATTCACCTTCAGTTACTATGGCAT GCACTGGGTCCGCCAGGCTCCAGGCAAGGGGCT GGAGTGGGTGGCAGTTATATCATATGATGGAAGT AATAAATACTATGCAGACTCCGTGAAGGGCCGA TTCACCATCTCAGAGACAATTCCAAGAACACGC TGCATCTGCAAATGAACAGCCTGAGAGCTGAGG ACACGGCTGTGTATTACTGTGCGAGAGATCGGAG GGGGGGCTATGGAGTCCCGATGCTTTTGATATC TGGGGCCAAGGGACAATGGTCACCGTCTCTTCA<br>SEQ ID NO: 28739 |

FIGURE 50
(Continued)

| | | | | |
|---|---|---|---|---|
| iPS:393174 | 21-225_15D8 | | AA | SYELSQPPSVSVSPGQTASITCSGDKLGEKYACW YQQKPGQSPVLVIYQDRKRPSGIPERFSGSNSGN KATLTISGTQAMDEADYYCQAWVNNTMIFGGG TKLTVL<br>SEQ ID NO: 24734 | QVHLVESGGGVVQPGRSLRLSCAASGFTFSYYGM HWVRQAPGKGLEWVAVISYDGSNKYYADSVKGR FTISRDNSKNTLHLQMNSLRAEDTAVYYCARDRRG GYGVPDAFDIWGQGTMVTVSS<br>SEQ ID NO: 28740 |
| | | NA | CTGCCTCTGTCTGACTCAGCCCCCGTCTGCATCT GCCTTGCTGGGAGCCTCGATCAAGCTCACCTG CACCTAAGCAGTGAGCACAGCACCTACACCA TCGAATGGTATCAACAGAAGCCAGGAGGTC CCCCCAGTACTATATCAAGGTTAAGAGTGATG GCAGCCACAGCAAGGGGACGGATCCCGA TGCTTCATGGGCTCCAGTTCTGGGGCTGAC GCTACATCACCTTCTCCAACCTCCAGTCTGAC GATGAGGAGGAGTATCACTGTGAGAGAGCC ACACGATCGATGGCCAAGTCGGTGTGGTATTC GGCGGAGGGACCAAGCTGACCGTCCTA<br>SEQ ID NO: 24735 | CAGGTGCAGTTGGTGGAGTCTGGGGGAGGCGTG GTCCAGACTGGAGGTCCCTGAGACTCTCCTGTG CAGCCTCTGGATTCACCTTCAGTGCTATGCAT GCACTGGGTCCGCCAGGCTCCAGGCAAGGGCT GGAGTGGGTGTCAGTTATATCATATGATGAAGT AATAAATACTATGCAGACTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGCGAGAGATCGGGT CTATTGTAGTAGTACCAGCTGCGTCCCTTACTAC GACTACACGGTATGGAGCGTCTGGGGCCAAGGG ACCACGGTCACCGTCTCCTCA<br>SEQ ID NO: 28741 | | | |
| | | AA | LPVLTQPPSASALLGASIKLTCTLSSEHSTYTIEW YQQRPGRSPQYIMKVKSDGSHSKGDGIPDRFMG SSSGADRYITFSNLQSDDEEYHCGESHTIDGQV GVVFGGGTKLTVL<br>SEQ ID NO: 24736 | QVQLVESGGGVVQTGRSLRLSCAASGFTFSGYGM HWVRQAPGKGLEWVSVISYDGSNKYYADSVKGRF TISRDNSKNTLYLQMNSLRAEDTAVYYCARDRVY CSSTSCVPYDYYGMDVWGQGTTVTVSS<br>SEQ ID NO: 28742 | | | |

FIGURE 50
(Continued)

| | | NA | TCCTATGAGCTGACTCAGCCACCCTCAGTGTC CGTGTCCCCAGGACAGAGCCAGCATCACCT GCTCTGGAGATAAATTGGGGAAGCCAGCCTG TGCTGGTATCAGCAGAAGCCAGGCCAGTCCCC TGTGGAGGTCATCTATCAAGATAGCAAGCGC CCTTAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGTAGTACTGTGGTA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGATTC CTATTGTAGTAGTACCAGCTGCCCTTACTACTAC TACTACGGTATGGACGTCTGGGGCCAAGGGACC ACGGTCACCGTCTCCTCA |
|---|---|---|---|---|
| iPS:393176 | 21-225_27E7 | | SEQ ID NO: 24737 | SEQ ID NO: 28743 |
| | | AA | SYELTQPPSVSVSPGQTASITCSGDKLGNKYACW YQQKPGQSPVEVIYQDSKRPLGIPERFSGSNSGN TATLTISGTQAMDEADYYCQAWDSSTVFGGG TKLTVL | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCAREDSYC SSTSCPYYYYGMDVWGQGTTVTVSS |
| | | | SEQ ID NO: 24738 | SEQ ID NO: 28744 |

FIGURE 50
(Continued)

| | | | |
|---|---|---|---|
| iPS:393178 | 21-225_34D7 | NA | TCCTATGAGCTGACTCAGCCACCCTCAGTGTCCGTGTCCCCAGGACAGACAGCCAGCATCACCTGCTCTGGAGATAAATTGGGGGAGAAATATGCTTACTGGTATCAGCAGAAGCCAGGCCAGTCCCCTGTGCTGGTCCTCTATCAAGATAGCAAGCGGCCCTCAGGGATCCCTGAGCGATTCTCTGGCTCCAACTCTGGGAACACAGCCACTCTGACCATCAGCGGGACCCAGACTATGGGACAACACCACTGTGTAACTGTCAGGCGGTGGGACAACACCACTGTGTATTCGGCGGAGGGACCAAGCTGACCGTCCTA | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAAGGCCTTGAGTGGATGGGATGGATCAACCCTAACAGTGGTGGCACAAACTATGCACAGAAGTTTCAGGGCAGGGTCACCATGACCAGGGACACGTCCATCAGCACAGCCTACATGGAGCTGAGCAGGCTGAGATCTGACGACACGGCCGTGTATTACTGTGCGAGGGGGTATTACTATGGTTCGGGGAGTTATTATAACGACCTGGACCCCTGGGGTCAGGGAACCCTGGTCACCGTCTCCTCA |
| | | | SEQ ID NO: 24739 | SEQ ID NO: 28745 |
| | | AA | SYELTQPPSVSVSPGQTASITCSGDKLGEKYAYWYQQKPGQSPVLVLYQDSKRPSGIPERFSGSNSGNTATLTISGTQTMDEADFYCQAWDNTTVVFGGGTKLTVL | QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGYYYGSGSYYNDLDPWGQGTLVTVSS |
| | | | SEQ ID NO: 24740 | SEQ ID NO: 28746 |
| iPS:393180 | 21-225_4G12 | NA | CAGTCTGTGCTGACTCAGCCACCCTCAGCGTCTGGGACCCCCGGGCAGAGGGTCAACATGTCTTGTTCTGGAACCAACTCCAACATCGGAAGTTATACTGTAAACTGGTACCAGCAGCTCCCAGGAACGGCCCCCAAACTCCTCATCTATAATAATCAGCGGCCCTCAGGGGTCCCTGACCGATTCTCTGGCTCCAAGTCTGGCACCTCAGTCTGAGGATGAGGCTGCATCAGTGGGCTCCAGTTGCAGCATGGGATGACAGCCTGATTATTACTGTGCAGCATGGGATAGCAGCCTGAATGGTCATGTGGTATTCGGCGGAGGGACCAAGCTGACCGTCCTA | GAGGTGCAGCTGTTGGAGTCTGGGGGAGGCTTGGTACAGCCGGGGGGGTCCCTGAGACTCTCCTGTGCAGCCTCTGGATTCACCTTTAGCAGCTATGCCATGAGCTGGGTCCGCCAGGCTCCAGGGAAGGGGCTGGAGTGGGTCTCAACTCTTAGTGGTCGTGTGGTAGCACATACTACGCAGACTCCGTGAAGGGCCGGTTCACCATCTCCAGAGACAATTCCAAGAACACGCTGTATCTGCAAATGAGCAGCCTGAGAGCCGAGGACACGGCCGTATACAGCTATGAGTACTACTGGTATGAGTGTCGGGGGCCAAGGGACCACGGTCACCGTCTCCTCA |
| | | | SEQ ID NO: 24741 | SEQ ID NO: 28747 |

FIGURE 50
(Continued)

| | | | | |
|---|---|---|---|---|
| iPS:393182 | 21-225_4B3 | AA | QSVLTQPPSASGTPGQRVNMSCSGTNSNIGSYTV NWYQQLPGTAPKLLIYNNQRPSGVPDRFSGSKS GTSASLAISGLQSEDEADYYCAAWDDSLNGHVV FGGRTKLTVL<br>SEQ ID NO: 24742 | EVQLLESGGGLVQPGGSLRLSCAASGFTFSSYAMS WVRQAPGKGLEWVSTLSGRGGSTYYADSVKGRST ISRDNSKNTLYLQMSSLRAEDTAVYYCAKWGRGY SYEYYYGMDVWGQGTTVTVSS<br>SEQ ID NO: 28748 |
| | | NA | TCCTATGAGCTGACTCAGCCACCTCAGTGTC CGTGTCCCAAGAGACAGACAGTCAGCATCACCT GCTCTGGAGATAAATTGGGGGATAAATATGCT TGCTGGTATCAGCAGAAGCCAGGCCAGTCCCC TGTGCTGGTCATCTATCAAGATCGCAAGCGGC CCTCAGGGATCCCTGAGCGATTCTCTGGCTCC AACTCTGGAACACAGCCACTCTGACCATCAG CGGGACCCAGGCTGTGGGACAACACACTGTGATA ACTGTCAGGCGTGGGACAACACACTGTGACCGTCCTA TTCGGCGGAGGGACCAAGCTGACCGTCCTA<br>SEQ ID NO: 24743 | CAGGTGCAACTGGTGCAGTCTGGGGCTGAGGTG AAGAAGCCTGGGCCTCAGTGAAGGTCTCCTGC AAGGCTTCTGATACACCTTCACCGGCTACTATA TGCACTGGGTGCGACAGGCCCCTGGACAAGGGC TTGAGTGGATGGGATGGATCAACCTAACAGTGG TGGCACAAACTCTGCACAGAAGTTCAGGGCAG GGTCACCATGACCAGGGACACGTCCATCAGCAC AGCCTACATGGAGCTGAGCAGGCTGAGATCTGA CGACACGGCCGTATATTACTGTGCGAGTCCTAT TACTATGGTTCGGGAGTTATTATAACGAGTTTG ACTACTGGGGCCAGGGAACCCTGGTCACCGTCTC CTCA<br>SEQ ID NO: 28749 |
| | | AA | SYELTQPPSVSVSPRQTVSITCSGDKLGDKYACW YQQKPGQSPVLVIYQDRKRPSGIPERFSGSNSGN TATLTISGTQAMDEADYYCQAWDNNTVIFGGG TKLTVL<br>SEQ ID NO: 24744 | QVQLVQSGAEVKKPGASVKVSCKASGYTFTGYYM HWVRQAPGQGLEWMGWINPNSGGTNSAQKFQGR VTMTRDTSISTAYMELSRLRSDDTAVYYCARSYYY GSGSYYNEFDYWGQGTLVTVSS<br>SEQ ID NO: 28750 |

FIGURE 50
(Continued)

| | | | |
|---|---|---|---|
| iPS:393184 | 21-225_15H11 | NA | TCCTATGAGCTGACTCAGCCACCCTCAGTGTCCGTGTCCCCAGGACAGAGCAGCCAGCATCACCTGCTCTGGAGATAAATTGGGGGAGAAATATGCTTGCTGGTATCAGCAGAAGCCAGGCCAGTCCCCTGTGGTGGTCATCTATCAAGATAGGAAGCGGCCCTCAGGGATCCCTGAGCGATTCTCTGGCTCCAACTCTGGGAACACAGCCACTCTGACCATCAGCGGGACCCAGGCTATGATGAGGCTGACTATTACTGTCAGGCGTGGGACAGCACTGCGGTATTCGGCGGAGGGACCAAGTTGACCGTCCTA<br>SEQ ID NO: 24745<br>SYELTQPPSVSVSPGQTASITCSGDKLGEKYACWYQQKPGQSPVVVIYQDRKRPSGIPERFSGSNSGNTATLTISGTQAIDEADYYCQAWDSSTAVFGGGTKLTVL<br>SEQ ID NO: 24746 | CAGATCACCTTGAAGGAGTCTGGTCTTACGCTGATGAAACCACACAGACCCTCACGCTGACCTGCACCTTCTCTGGGTTCTCACTCAGCACTGGTGAGTGGTGTGGGCTGGATCGTCAGCCCCCAGGAAAGGCCCTGGAGTGGCTTGCACTCATTTATTGGCATGATGATAAGCGCTACAGTCCATCTCTGAGGAGCAGGCTCACCATCACCAAGGACACCTCAAAAACCAGGTGGTCCTTACAATGACCAACATGACCCTGTGGACAGCCACATATTACTGTGCACGTATAGTAGCAGTTGCCTTTGACTACTGGGGCCAGGGAACCCTGATCACCGTCTCCTCA<br>SEQ ID NO: 28751<br>QITLKESGLTLMKPTQTLTLTCTFSGFSLSTGGVGVGWIRQPPGKALEWLALIYWHDDKRYSPSLRSRLTITKDTSKNQVVLTMTNMDPVDTATYYCARIVAVAFDYWGQGTLITVSS<br>SEQ ID NO: 28752 |
| iPS:393186 | 21-225_27D9 | NA | TCCTATGAGCTGACTCAGCCACCCTCAATGTCCGTGTCCCCAGGACAGAGCAGCCAGCATCACCTGCTCTGGAGATATAAATTGGGGGATAAATATGCTTGCTGGTTTCAGCAGAAGCCAGGCCAGTCCCCTGTGTCTGGTCATCTATCAAGATAGCAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTCACTGTCAGGCGTGGGTCAACAACACTGTATTCGGCGGAGGGACCAAGCTGACCGTCCTA | CAGGTGCAGTTGGTGCAGTCTGGGGCTGAGGTGAAGAAGCCTGGGGCTCAGTGAAGGTCTCCTGCAAGGCTTCTGGATACACCTTCACCGGCTACTATATGCACTGGGTGCGACAGGCCCCTGGACAAGGGCTTGAGTGGATGGGGATGGATCAACCCTAACAGTGGTGGCACAAAGTATGCACAGAAGTTTCAGGGCAGGGTCACCATGACCAGGGACACGTCCATCAGCACAGCCTACATGGAGCTGAACAGGCTGAGATCTGACGACACGGCCGTGTATTACTGTGCGAGAGAGGTGTAGTACCAGTTGCTATTTAGGAATTACGGGCTACTACGGTATGGACGTCTGGGGCCAAGGGACCACGGTCACCGTCTCCTCA |

FIGURE 50
(Continued)

| | | | | |
|---|---|---|---|---|
| iPS:393188 | 21-225_34B9 | AA | SEQ ID NO: 24747<br>SYELTQPPSMSVSPGQTASITCSGYKLGDKYAC WFQQKPGQSPVLVIYQDSKRPSGIPERFSGSNSG NTATLTISGTQAMDEADYYCQAWVNNTVFGGG TKLTVL<br>SEQ ID NO: 24748 | SEQ ID NO: 28753<br>QVQLVQSGAEVKKPGASVKVSCKASGYTFTGYYM HWVRQAPGQGLEWMGWINPNSGGTKYAQKFQGR VTMTRDTSISTAYMELNRLRSDDTAVYYCARERCS TTSCYLGITGYYGMDVWGQGTTVTVSS<br>SEQ ID NO: 28754 |
| | | NA | TCCTATGAGCTGACTCAGCCACCCTCAGTGTC CGTGTCCCAGGACAGAGCCAGCATCACCT GCTCTGGAGATAAATTGGGGGAGAAATATGTT TCCTGGTATCAGGAGAAGCCAGGCCAGTCCCC TGTGCTGGTCATCTATCAAGATAAGTAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGTATTC GGCGGAGGGACCAAGCTGACCGTCCTA | CAGATCACCTTGAGGGAGTCTGGTCCTACGCTGG TGAAACCCACACAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGGCTTGCACTCATTTATTGGAATG ATGATAAGCGCTACAGCCCATCTGAAGAGCA GACTCACCATCACCAAGGACACCTCCAAAACC AGGTGTCCTTACAATGACCAACATGGACCCTGT GGACACAGCCACATATTACTGTGCACACTTAATA GCAGTGACTTTTGACTCCTGGGGCCAGGATCCC TGGTCACCGTCCTCTCA |
| | | AA | SEQ ID NO: 24749<br>SYELTQAPSVSVSPGQTASITCSGDKLGEKYVSW YQEKPGQSPVLVIYQDSKRPSGIPERFSGSNSGNT ATLTISGTQAMDEADYYCQAWDSSTVFGGGTK LTVL<br>SEQ ID NO: 24750 | SEQ ID NO: 28755<br>QITLRESGPTLVKPTQTLTLTCTFSGFSLSTSGVGVG WIRQPPGKALEWLALIYWNDDKRYSPSLKSRLTIT KDTSKNQVVLTMTNMDPVDTATYYCAHLIAVTFD SWGQGSLVTVSS<br>SEQ ID NO: 28756 |

FIGURE 50
(Continued)

| | | | |
|---|---|---|---|
| iPS:393192 | 21-225_12B1 | NA | TCCTATGAGCTGACTCAGCCACCCTCAGTGTC CGTGTCCCCAGGACAGACAGTCAGCATCACCT GCTCTGGAGATAAATTGGGGATAAATATGCT TGCTGTATCAGCAGAAGCCAGGCCAGTCCCC TGTGCTGGTCATCTATCAAGATCGCAAGCGG CCTCAGGGATCCCTGAGGGATTCTCTGGCTCC AACTCTGGGAACACAGCCACTCTGACCATCAG CGGGACCCAGGCTATGGATGAGGCTGACTATT ACTGTCAGGCGTGGGACAACACTGTGATA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGGCGTCGGATTCACCTTCAGTAGCTATGCAT GCACTGGGTCCGCCAGGCTCCAGGCAAGGGCT GGAGTGGGTGGCAGTTATATGGAATGATGAAG TAATAAATACTATGCAGACTCCGTGAAGGGCCG ATTCACCATCTCCAGAGACAATTCCAAGAACACG CTGTATCTGCAAATGAACAGCTGAGAGCCGAG GACACGGCTGTGTATTACTGTGCGAGAGATCGG TAGCAGCTGGTACCCCTACTACTACCGG TATGGACGTCTGGGGCCAAGGGACCACGGTCAC CGTCTCCTCA |
| | | | SEQ ID NO: 24751 | SEQ ID NO: 28757 |
| | | AA | SYELTQPPSVSVSPRQTVSITCSGDKLGDKYACW YQQKPGQSPVLVIYQDRKRPSGIPERFSGSNSGN TATLTISGTQAMDEADYYCQAWDNNTVIFGGG TKLTVL | QVQLVESGGGVVQPGRSLRLSCAASGFTFSSYGMH WVRQAPGKGLEWVAVIWNDGSNKYYADSVKGRF TISRDNSKNTLYLQMNSLRAEDTAVYYCARDRVA AAGTPYYYYGMDVWGQGTTVTVSS |
| | | | SEQ ID NO: 24752 | SEQ ID NO: 28758 |
| iPS:393194 | 21-225_16D2 | NA | TCCTATGAGCTGACTCAGCCACCCTCAGTGTC CGTGTCCCCAGGACAGACAGCCAGCATCACCT GCTCTGGAGATAAATTGGGGATAAATATGCT TGCTGTATCAGCAGAAGCCAGGCCAGTCCCC TGTGCTGGTCATCTATCAAGATAGCAAGCGG CCTCAGGGATCCCTGAGGGATTCTCTGGCTCC AACTCTGGGAACACAGCCACTCTGACCATCAG CGGGACCCAGGCTATGGATGAGGCTGACTATT ACTGTCAGGCGTGGGACAGCACTTATGTG GTATTCGGCGGAGGGACCAAGCTGACCGTCCT A | GAGGTGCAGCTGGTGGAGTCTGGGGGAGGCTTG GTAAAGCCTGGGGGGTCCCTTAGACTCTCCTGTG CAGCCTCTGGATTCACTTTCAGTAACGCTGGAT GAACTGGGTCCGCCAGGCTCCAGGAAGGGGCT GGAGTGGGTTGGCCGTATTAAAAGCAAACTGA TGGTGGGACAACAGACTACGCTGCACCCGTGAA AGGCAGATTCACCATCTGCAAAGATGATTCAAA AAACACGCTGTATCTGCAAATGCACAGCCTGAA AACCGAGGACACAGCCGTGTATTACTGTACCACA GATACGGGTCCTATAGCAGCTCGTCTCGCTTACT ACTACTACTACGCTATGACGTCTGGGGCCAAGG GACCACGGTCACCGTCTCCTCA |

FIGURE 50
(Continued)

| | | | SEQ ID NO: 24753 | SYELTQPPSVSVSPGQTASITCSGDKLGDKYACW YQQKPGQSPVLVIYQDSKRPSGIPERFSGSNSGN TATLTISGTQAMDEADYYCQAWDSSTYVFGG GTKLTVL | SEQ ID NO: 28759 | EVQLVESGGGLVKPGGSLRLSCAASGFTFSNAWM NWVRQAPGKGLEWVGRIKSKTDGGTTDYAAPVK GRFTISRDDSKNTLYLQMHSLKTEDTAVYYCTTDT GPIAARLAYYYYAMDVWGQGTTVTVSS |
| --- | --- | --- | --- | --- | --- | --- |
| | | AA | SEQ ID NO: 24754 | TCCTATGAGCTGAGTCAGCCACCCTCAGTGTC CGTGTCCCCAGGACAGACAGCCAGCATCACCT GCTCTGGAGATAAATTGGGGAAAAATATGCT TGCTGGTATCAGCAGAAGCCAGGCCAGTCCC TGTGTCTGGTCATCTATCAAGATAGGAAGCGC CCTCAGGGATCCCTGAGCGATTCTCTGGCTCC AACTCTGGGAACAGGCCACTCTGACCATCAG CGGGACCCAGGCTATGGATGAGGCTGACTATT ACTGTCAGGCGTGGGTCAATAACACTATGATA TTCGGCGGAGGGACCAAGCTGACCGTCCTA | SEQ ID NO: 28760 | GAGGTGCAGCTGTTGGAGTCTGGGGGAGGCTTG GTACAGCCTGAGGGGTCCCTGAGACTCTCCTGTG CAGCCTCTGGATTCACCTTTAGCAGTATGCCAT GAGCTGGGTCCGCCAGGCTCCAGGGAAGGGCT GGAGTGGGTCTCAGGTATTAGTGGTAGTGGTGGT AGCACATACTACGCAGACTCCGTGAAGGGCCGG TTCACCATCTCCAGAGACAATTCCAAGAACACGC TGTGTCTGCAACATGAACAGCCTGAGAGCCGAGG ACACGGCCGTATATTACTGTGCGAAAGAATATTG TGGTGGTGACTGCTATTCCCCTTACTACTACTACT ACGGTATGGACGTCTGGGGCCAAGGGACCACGG TCACCGTCTCCTCA |
| | 21-225_16G8 | NA | SEQ ID NO: 24755 | SYFLSQPPSVSVSPGQTASITCSGDKLGEKYACW YQQKPGQSPVLVIYQDRKRPSGIPERFSGSNSGN KATLTISGTQAMDEADYYCQAWVNNTMIFGGG TKLTVL | SEQ ID NO: 28761 | EVQLLESGGGLVQPEGSLRLSCAASGFTFSSYAMS WVRQAPGKGLEWVSGISGSGGSTYYADSVKGRFTI SRDNSKNTLCLHMNSLRAEDTAVYYCAKEYCGGD CYSPYYYYGMDVWGQGTTVTVSS |
| iPS.393196 | | AA | SEQ ID NO: 24756 | | SEQ ID NO: 28762 | |

FIGURE 50
(Continued)

| | | | |
|---|---|---|---|
| iPS:393198 | 21-225_28A11 | NA | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTGGCTATGGCCT<br>GCACTGGGTCCGCCAGGCTCCAGGCAAGGGGCT<br>GGAGTGGGTGGCACTTATATGGTATGATGGAAAT<br>AATACATATCAGAGACTCCGTGAAGGGCCGAT<br>TCACCATCTCCAGAGACAATTCCAAGAACACGCT<br>GTATCTGCAAATGAACAGCCTGAGAGCCGAAGA<br>CACGGCTGTGTATTACTGTGCGAGAGATAGGGTA<br>TATTGTAGTAGTACCAGCTGCTCCCCTTACTACT<br>ACTACGGTATGGACGTCTGGGGCCAAGGGA<br>CCACGGTCACCGTCTCCTCA |
| | | | SEQ ID NO: 28763 |
| | | AA | QVQLVESGGGVVQPGRSLRLSCAASGFTFSGYGLH<br>WVRQAPGKGLEWVALIWYDGNNTYYADSVKGRF<br>TISRDNSKNTLYLQMNSLRAEDTAVYYCARDRVY<br>CSSTSCSPYYYYGMDVWGQGTTVTVSS |
| | | | SEQ ID NO: 28764 |
| | | NA | TCCTATGAGTTGACTCAGCCACCCTCAGTGTC<br>CGTGTCCCCAGGACAGACAGCCAGCATCACCT<br>GCTCTGGAGATAAATTGGGGGATAAATATGCT<br>TGCTGGTATCAGCAGAAGCCAGGCCAGTCCCC<br>TGTGCTGGTCATCTATCAAGATAGCAAGCGGC<br>CCTCAGGGATCCCTGAGCGATTCTCTGGCTCC<br>AACTCTGGGAACACAGCCACTCTGACCATCAG<br>CGGGACCCAGGCTGTGGACGAGTAGCACTTATGTG<br>ACTGTCAGGCGTGGACAGTAGCACTTATGTG<br>GTATTCGGCGGAGGGACCAAGCTGACCGTCCT<br>A |
| | | | SEQ ID NO: 24757 |
| | | AA | SYELTQPPSVSVSPGQTASITCSGDKLGDKYACW<br>YQQKPGQSPVLVIYQDSKRPSGIPERFSGSNSGN<br>TATLTISGTQAMDEADYYCQAWDSSTYVFGG<br>GTKLTVL |
| | | | SEQ ID NO: 24758 |

FIGURE 50
(Continued)

| | | | | |
|---|---|---|---|---|
| iPS:393200 | 21-225_35E1 | NA | TCCTATGAGCTGACTCAGCCACCCTCAGTGTC CGTGTCCCAGGACAGACAGCCAGCATCACCT GCTCTGGAGATAAATTGGGGGAAAAATATGCT TACTGGTTTCAGCAGAAGCCAGGCCAGTCCCC TGTGATAGTCATCTATCAAGATAGGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGTGGGACAACAGCACTGCGGTA TTCGGCGGAGGGACCAAGCTGACCGTCCTA<br><br>SEQ ID NO: 24759 | CAGGTGAAGCTGGTGCAGTCTGGGGCTGAGGTG AAGAAGCCTGGGGCCTCAGTGAAGGTCTCCTGC AAGGCTTCAGGATACACCTTCACCGGCTACTATA TGCACTGGGTGCGACAGGCCCCTGGACAAGGGC TTGAGTGGATGGGATGGATCAACCCTAAAAGTG GTGGCACAAATTATGCACAGAGAAGTTCAGGGCA GGGTCACCATGACCAGGGACACGTCCATCAGCA CAGTCTACATGGAGCTGAGCAGGCTGAGATCTG ACGACACGGCCGTGTATTACTGTGCGAGAGTGTA TTACCATGGTTCGGGGAGTTATTATAACGAGTTT GATTATTGGGGCCAGGGAACCCTGGTCACCGTCT CCTCA<br><br>SEQ ID NO: 28765 |
| | | AA | SYELTQPPSVSVSPGQTASITCSGDKLGEKYAYW FQQKPGQSPVIVIYQDRKRPSGIPERFSGSNSGNT ATLTISGTQAMDEADYYCQAWDNSTAVFGGGT KLTVL<br><br>SEQ ID NO: 24760 | QVKLVQSGAEVKKPGASVKVSCKASGYTFTGYYM HWVRQAPGQGLEWMGWINPKSGGTNYAQKFQGR VTMTRDTSISTVYMELSRLRSDDTAVYYCARVYYH GSGSYYNEFDYWGQGTLVTVSS<br><br>SEQ ID NO: 28766 |
| iPS:393202 | 21-225_6B4 | NA | TCCTATGAGCTGACTCAGCCACCCTCAGTGTC CGTGTCCCAAGACAGACAGCCAGCATCACCT GCTCTGGAGATAAATTGGGGGATAAATATGCT TGCTGGTATCAGCAGAAGCCAGGCCAGTCCCC TGTGCTGGTCATCTATCAAGATCGCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAACACTGTGATA TTCGGCGGAGGGACCAAGCTGACCGTCCTA<br><br>SEQ ID NO: 24761 | GAGGTGCAGCTGTTGGAGTCTGGGGGAGGCTTG GTACAGCCTGAGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTAGTGGTAGT AGCACATACTACGCAGACTCCGTGAAGGGCCGG TTCACCATCTCCAGAGACAATTCCAAGAACACGC TGTGTCTGCAAATGAACAGCCTGAGAGCCGAGG ACACGGCCGTATATTACTGTGCGAAAGAATATTG TGGTGGTGACTGCTATTCCCCTTACTACTACTACT ACGGTATGGACGTCTGGGGCCAAGGGACCACGG TCACCGTCTCCTCA<br><br>SEQ ID NO: 28767 |

FIGURE 50
(Continued)

| | | | |
|---|---|---|---|
| iPS:393204 | 21-225_8C12 | AA | SYELTQPPSVSVSPRQTVSITCSGDKLGDKYACW YQQKPGQSPVLVIYQDRKRPSGIPERFSGSNSGN TATLTISGTQAMDEADYYCQAWDNNTVIFGGG TKLTVL | EVQLLESGGGLVQPEGSLRLSCAASGFTFSSYAMS WVRQAPGKGLEWVSAISGSGSSTYYADSVKGRFTI SRDNSKNTLCLQMNSLRAEDTAVYYCAKEYCGGD CYSPYYYYGMDVWGQGTTVTVSS |
| | | | SEQ ID NO: 24762 | SEQ ID NO: 28768 |
| | | NA | TCCTATGAGCTGACTCAGCCACACTCAGTGTC AGTGGCCACAGCACAGATGGCCAGATCACCT GTGGGGGAAACAACATTGGAAGTAAAGCTGT GCACTGGTACCAGCAAAAGCCAGGCCAGGAC CCTGTGCTGGTCATCTATAGCGATAGCAACCG GCCCTCAGGGATCCCTGAGCGATTCTCTGGCT CCAACCCAGGGAACACCGCCACCTAACCATC AGCAGGATCGAGGCTGGGGATGAGGCTGACT ATTACTGTCAGGTGTGGGACAGTAGTAGTGAT CATGTGGTATTCGGCGGAGGGACCAAGCTGAC CGTCCTA | CAGGTGCAGTTGGTGGAGTCTGGGGGAGGCGTG GTCCAGCCTGGGAGGTCCCTGAGACTCTCCTGTG CAGCGTCTGGATTCACCTTCGGTAGCTATGGCAT GCACTGGGTCCGCCAGGCTCCAGGCAAGGGGCT GGAGTGGGTGGCACTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCGGGT ATCTTGTAGTAGTTCCAGCTGCTATCCTTACTACT ACTACTACGGTATGGACGTCTGGGGCCAAGGGA CCACGGTCACCGTCTCCTCA |
| | | | SEQ ID NO: 24763 | SEQ ID NO: 28769 |
| | | AA | SYELTQPHSVSVATAQMARITCGGNNIGSKAVH WYQQKPGQDPVLVIYSDSNRPSGIPERFSGSNPG NTATLTISRIEAGDEADYYCQVWDSSSDHVVFG GGTKLTVL | QVQLVESGGGVVQPGRSLRLSCAASGFTFGSYGM HWVRQAPGKGLEWVALIWYDGSNKYYADSVKGR FTISRDNSKNTLYLQMNSLRAEDTAVYYCARDRVS CSSSSCYPYYYYGMDVWGQGTTVTVSS |
| | | | SEQ ID NO: 24764 | SEQ ID NO: 28770 |

FIGURE 50
(Continued)

| | | | | |
|---|---|---|---|---|
| iPS:393206 | 21-225_13F6 | NA | TCCTATGAGCTGACTCAGCCACCCTCAGTGTC CGTGTCCCAGGACAGAGACCAGGCCATCACCT GCTCTGGAGATAAATTGGGGGATAAATATGCT TGCTGGTATCAGCAGAAGCCAGGCCAGTCCCC TGTGCTGGTCATCTATCAAGATAGCAAGCGGC CCTCAGGGATCCCTGAGGATTCTCTGGCTCC AACTCTGGGAACACAGCCACTCTGACCATCAG CGGGACCCAGGCTATGATGAGGCTGACTATT ACTGTCAGGCGTGGGCAACAGCACTGCTGTG GTATTCGGCGGAGGGACCAAGCTGACCGTCCT G SEQ ID NO: 24765 | CAGGTGCAGCTGGTGCAGTCTGGGGCTGAGGTG AAGAAGCCTGGGGCCTCAGTGAAGGTCTCCTGC AAGGCTTCTGATACACCTTCACCGGCTACTATA TGCACTGGGTGCGACAGGCCCCTGACAAGGGC TTGAGTGGATGGATGGATCAACCCTAACAGTGG TGGCGCAAACTATGCACAGAAGTTTCAGGGCAG GGTCACCATGACCAGGGACACGTCCATCAGCAC AGCCTACATGGAGCTGAGCAGGCTGAGATCTGA CGACACGGCCGTGTATTTCTGTGCGAGGTCGTTT TACTATGGTTCGGGGACTTATTATAACGAGTTTG ACTACTGGGGCCAGGGAACCCTGGTCACCGTCTC CTCA SEQ ID NO: 28771 |
| | | AA | SYELTQPPSVSVSPGQTASITCSGDKLGDKYACW YQQKPGQSPVLVIYQDSKRPSGIPERFSGSNSGN TATLTISGTQAMDEADYYCQAWGNSTAVFGG GTKLTVL SEQ ID NO: 24766 | QVQLVQSGAEVKKPGASVKVSCKASGYTFTGYYM HWVRQAPGQGLEWMGWINPNSGGANYAQKFQGR VTMTRDTSISTAYMELSRLRSDDTAVYFCARSFYY GSGTYYNEFDYWGQGTLVTVSS SEQ ID NO: 28772 |
| iPS:393208 | 21-225_16F3 | NA | TCCTATGTGCTGACTCAGCCACCCTCGGTGTC AGTGGCCCAGGACAGAGACCAGGCCAGGATTACCT GTGGGGGAAACAACATTGGAAGTAAAAGTGT GCACTGGTACCAGCAGAAGCCAGGCCAGGCC CCTGTGCTGGTCGTCTATGATGATAGCGACCG GCCCTCAGGGATCCCTGAGCGATTCTCTGGCT CCAACTCTGGGAACACGGCCACCCTGACCATC AGCAGGGTCGAAGCGGGGATGAGGCCGACT ATTACTGTCAGGTGTGGGATAGTAGCAGTGAT CAGTGGTATTCGGCGGAGGGACCAAGCTGAC CGTCCTA SEQ ID NO: 24767 | CAGGTGCAGCTGGTGCAGTCTGGGGCTGAGGTG AAGAAGCCTGGGGCCTCAGTGAAGGTCTCCTGC AAGGCTTCTGATACACCTTCACCGGCACTATA TGCACTGGGTGCGACAGGCCCCTGACAAGGAC TTGAGTGGATGGATGGATCAACCCTAACAGTGG TGGCACAAACTATGCACAGAAGTTTCAGGGCAG GGTCACCATGACCAGGGACACGTCCATCAGCAC AGCCTACATGGAGCTGAGCAGGCTGAGATCTGA CGACACGGCCGTGTATTACTGTGCGAGGTCGTAT TACTATGGTTCGGGGACTTATTATAACGAGTTTG ACTACTGGGGCCAGGGAACCCTGGTCACCGTCTC CTCA SEQ ID NO: 28773 |

FIGURE 50
(Continued)

| | | | | |
|---|---|---|---|---|
| iPS:393210 | 21-225_17D3 | AA | SYVLTQPPSVSVAPGQTARITCGGNNIGSKSVHW YQQKPGQAPVLVVYDDTDRPSGIPERFSGSNSG NTATLTISRVEAGDEADYYCQVWDSSSDHVVFG GGTKLTVL<br><br>SEQ ID NO: 24768 | QVQLVQSGAEVKKPGASVKVSCKASGYTFTGHYM HWVRQAPGQGLEWMGWINPNSGGTNYAQKFQGR VTMTRDTSISTAYMELSRLRSDDTAVYYCARSYYY GSGTYYNEFDYWGQGTLVTVSS<br><br>SEQ ID NO: 28774 |
| | | NA | TCCTATGAGCTGAGCCAGTCACCCTCAGTGTC CGTGTCCCAGGACAGACAGCCAGCATCACCT GCTCTGGAGATAAAATTGGGGATAAAATATGTT TACTGGTATCAGCAGAAGCCAGGCCAGTCCCC TGTGGTGGTCATCTATCAAGATAGGAAGCGGC CCTCAGGATCCCTGAGCGATTCTCTGGCTCC AACTCTGGGAACACAGCCACTCTGACCATCAG CGGGACCCAGGCTATGATGAGGCTGACTATT ACTGTCAGGCGTGGGACAGCATCACTGCAGTA TTCGGCGGAGGGACCAAGCTGACCGTCGA<br><br>SEQ ID NO: 24769 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACCTAACAGTGG TGGCACAAACTATGCACAGAAGTTCAGGGCAG GGTCACCATGACCAGGGACACGTCCATCAGCAC AGCTTACATGGAGCTGAGCAGGCTGAGATCGGA CGACACGGCCGTGTATTACTGTGCGAGAGCGAAT TACTATGGTTCGGGGAGTTATTATAACGACTTTG ACTACTGGGGCCAGGGAACCCTGGTCACCGTCTC CTCA<br><br>SEQ ID NO: 28775 |
| | | AA | SYELTQSPSVSVSPGQTASITCSGDKLGDKYVY WYQQKPGQSPVVVIYQDRKRPSGIPERFSGSNSG NTATLTISGTQAMDEADYYCQAWDSITAVFGGG TKLTVR<br><br>SEQ ID NO: 24770 | QVQLVQSGAEVKKPGASVKVSCKASGYTFTGYYM HWVRQAPGQGLEWMGWINPNSGGTNYAQKFQGR VTMTRDTSISTAYMELSRLRSDDTAVYYCARANYY GSGSYYNDFDYWGQGTLVTVSS<br><br>SEQ ID NO: 28776 |

FIGURE 50
(Continued)

| | | | |
|---|---|---|---|
| iPS:393212 | 21-225_30H6 | NA | TCCTATGAGCTGACTCAGCCACCCTCAGTGTC CGTGTCCCCAGGACAGACAGCCAGCATCACCT GCTCTGGATATAAATTGGGTAATAAATATGCT TGCTGGTATCAGCAGAAGCCAGGCCAGTCCCC TGTGTTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGGCAGCACTGTATT ACTGTCAGGCGTGGGACAGCAAGCTGACCGTCCTA GGCGGAGGGACCAAGCTGACCGTCCTA<br>SEQ ID NO: 24771 | CAGATCACCTTGAAGGAGTCTGGTCCTACGCTGG TGAAACCACACAGACCCTCACGCTGACCTGCAC CTTCTCTGGATTCTCACTCAGCACTGGTGAGTG GGTGTGGGCTGGATCGTCAGCCCCAGGAAAG GCCCTGGAGTGGCTTGCACTCATTATTGGCATG ATGATAAGCGCTACAGTCCCTCTCTGAAGAGCAG GCTCGCCATCACCAAGGACACCTCCAAAACCA GGTGGTCCTTACAATTACCAACATGACCCTGTG GACACAGCCACATATTACTGTGCTCACTTAATAG CAGTGGCTTTTGACTATTGGGGCCAGGAACCCT GGTCACCGTCTCCTCA<br>SEQ ID NO: 28777 |
| | | AA | SYELTQPPSVSVSPGQTASITCSGDKLGNKYACW YQQKPGQSPVLVIYQDSKRPSGIPERFSGSNSGN TATLTISGTQAMDEADYYCQAWDSSTVFGGGT KLTVL<br>SEQ ID NO: 24772 | QITLKESGPTLVKPTQTLTLTCTFSGFSLSTGGVVG WIRQPPGKALEWLALIYWHDDKRYSPSLKSRLAIT KDTSKNQVLTITNMDPVDTATYYCAHLIAVAFDY WGQGTLVTVSS<br>SEQ ID NO: 28778 |
| iPS:393214 | 21-225_33A1 | NA | TCCTATGAGCTGACTCAGCCACCCTCAGTGTC CGTGTCCCCAGGACAGACAGCCAGCATCACCT GCTCTGGATATAAATTGGGGATAAATTTGTT TATTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGGCAGCACTGTATT ACTGTCAGGCGTGGGACAGCACCACCGTGGTA TTCGGCGGAGGGACCAAGCTGACCGTCCTA<br>SEQ ID NO: 24773 | CAGGTGCAGCTGGTGCAGTCTGGGGCTGAGGTG AAGAAGCCTGGGGCCTCAGTGAAGGTCTCCTGC AAGGCTTCTGGATACACCTTCAGCGGCTACTATA TGCACTGGGTGCGACAGCCCCTGACAAGGAC TTGAGTGGATGGGATGGATCAACCTAACAATGG TGGCACACACTATGCACAGAAGTTTCAGGGCAG GGTCACCATGACCAGGGACACGTCCATCCGAC AGCCTCCATGGAGCTGAGCAGGCTGAGATCTGA CGACACGGCCGTGTATTTCTGTGCGAGGGGATAT ACCCCTGGGGCCAGGGAACCCTGGTCACCGTCTC CTCA<br>SEQ ID NO: 28779 |

FIGURE 50
(Continued)

| | | | |
|---|---|---|---|
| iPS:393218 | 21-225_14G3 | AA | SYELTQPPSVSVSPGQTASITCSGDKLGDKFVYW YQQKPGQSPVLVIYQDSKRPSGIPERFSGSNSGN TATLTISGTQAMDEADYYCQAWDSTTVVFGGG TKLTVL<br><br>SEQ ID NO: 24774 | QVQLVQSGAEVKKPGASVKVSCKASGYTFSGYYM HWVRQAPGQGLEWMGWINPNNGGTHYAQKFQGR VTMTRDTSIRTASMELSRLRSDDTAVYFCARGYYY ASGSYYNDLDPWGQGTLVTVSS<br><br>SEQ ID NO: 28780 |
| | | NA | TCCTATGAGCTGACTCAGCCACCCTCAGTGTC CGTGTCCCCAGGACAGACAGCCAGCATCACCT GCTCTGGAGATAAATTGGGGGATAAATATGTT TGCTATGGTATCAGCAGAAGCCAGGCCAGTCCCC TGTGCTGGTCATCTATCAAGATCGCAAGCGGC CCTCAGGGATCCCTGAGCGATTCTCTGGCTCC AACTCTGGAACACAGCCACTCTGACCATCAG CGGGACCCAGGCTATGGATGAGGCTGATTATT ACTGTCAGGCGTGGGGACAACAGCACTGCTGTG GTATTCGGCGGAGGGACCAAGCTGACCGTCCT G<br><br>SEQ ID NO: 24775 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACCCTAACAGTGG TGGCACAAACTATGCACAGAAGTTTCAGGGCAG GGTCACCATGACCAGGGACACGTCCATCAGCAC AGCCTACATGGAGCTGAGCAGGCTGAGATCTGA CGACACGGCCGTTATTACTGTGCGAGGTCGTAT TTTTATGGTTCGGGGAGTTATTATAACGAGTTG ACTACTGGGGCCAGGGAACCCTGGTCACCGTCTC CTCA<br><br>SEQ ID NO: 28781 |
| | | AA | SYELTQPPSVSVSPGQTASITCSGDKLGDKYVCW YQQKPGQSPVLVIYQDRKRPSGIPERFSGSNSGN TATLTISGTQAMDEADYYCQAWGNSTAVVFGG GTKLTVL<br><br>SEQ ID NO: 24776 | QVQLVQSGAEVKKPGASVKVSCKASGYITFGYYM YWVRQAPGQGLEWAMGWINPNSGGTNYAQKFQGR VTMTRDTSISTAYMELSRLRSDDTAVYYCARSYFY GSGSYYNEFDYWGQGTLVTVSS<br><br>SEQ ID NO: 28782 |

FIGURE 50
(Continued)

| | | | | |
|---|---|---|---|---|
| iPS:393222 | 21-225_17F5 | NA | TCCTATGAGCTGACTCAGCCACCCTCAGTGTC CGTGTCCCAGGACAGACAGCCAGCATCACCT GCTCTGGAGATAAATTGGGGGAAAATATGCT TGCTGGTATCAGCAGAAGCCAGGCCAGTCCCC TGTGCTGGTCATCTATCAAGATAGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGTCCTA GGCGGAGGGACCAAACTGACCGTCCTA<br/><br/>SEQ ID NO: 24777 | CAGATCACCTTGAAGGAGTCTGGTCCTTCGCTGG TGAAGCCCACACAGACCCTCACGCTGACCTGCAC CTTCTCTGGATTCTCACTCAGCACTAGTGGAGTG GGTGTGGGCTGGATCCGTCAGCCCCCGAAAG GCCCTGGAGTGGCTTGCACTCATTTATTGGATG ATGATAAGCGCTACAGCCCATCTCTGAAGAGCA GGCTCACCATCACCAAGGACACCTCCAAAAACC AGGTGGTCCTGACAATGACCAACATGGACCCTGT GGACACAGCCACATATTCCTGTGCACACATTATA GCAGTGGCTTTTGACTACTGGGGCCAGGGAACCC TGGTCACCGTCTCCTCA<br/><br/>SEQ ID NO: 28783 |
| | | AA | SYELTQPPSVSVSPGQTASITCSGDKLGEKYACW YQQKPGQSPVLVIYQDRKRPSGIPERFSGSNSGN TATLTISGTQAMDEADYYCQAWDSSTVFGGGT KLTVL<br/><br/>SEQ ID NO: 24778 | QITLKESGPSLVKPTQTLTLTCTFSGFSLSTSGVG WIRQPPGKALEWLALIYWDDKRYSPSLKSRLTIT KDTSKNQVVLTMTNMDPVDTATYSCAHIIAVAFD YWGQGTLVTVSS<br/><br/>SEQ ID NO: 28784 |
| iPS:393224 | 21-225_31C2 | NA | TCCTATGAGCTGACTCAGCCACCCTCAGTGTC CGTGTCCCAGGGACAGACAGCCAGCATCACCT GCTCTGGAGATAAATTGGGGAAATAAATATGCT TGCTGGTATCAGCAGAAGCCAGGCCAGTCCCC TGTGCTGGTCGTCATCTATCAAGATTCCAAGCGC CCTCAGGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGTATTC GGCGGAGGGACCAAACTGACCGTCCTA<br/><br/>SEQ ID NO: 24779 | CAGATCACCTTGAAGGAGTCTGGTCCTACGCTGG TGAAAACCCACACAGACCCTCACGCTGACCTGCAC CTTCTCTGGTTCTCCCTCAACACTGGTGGAGTG GGTGTGGGCTGGATCCGTCAGCCCCCAGGAAAG GCCCTGGAGTGGCTTGCACTCATTTATTGGAATG ATGATGAGCGCTACAGCCCATCTCTGAAGAGCA GGCTCACCATCACCAAGGACACCTCCAAAAACC AGGTGGTCCTTACAATGACCAACATGGACCCTTT GGACACAGCCTCATATTACTGTGCACACTTAATA GCAGTTTCCTTTGACTACTGGGGCCAGGGAGCCC TGGTCACCGTCTCCTCA<br/><br/>SEQ ID NO: 28785 |

FIGURE 50
(Continued)

| | | | |
|---|---|---|---|
| iPS:393226 | 21-225_33E6 | AA | SYELTQPPSVSVSPGQTASITCSGDKLGNKYACW YQQKPGQSPVLVIYQDSKRPSGIPERFSGSNSGN TATLTISGTQAMDEADYYCQAWDSSTVFGGGT KLTVL<br>SEQ ID NO: 24780 | QITLKESGPTLVKPTQTLTLTCTFSGFSLNTGGVGV GWIRQPPGKALEWLALIYWNDDERYSPSLKSRLTIT KDTSKNQVVLTMTNMDPLDTASYYCAHLIAVSFD YWGQGALVTVSS<br>SEQ ID NO: 28786 |
| | | NA | TCCTATGAGCTGACTCAGCCACCCTCAGTGTC CGTGTCCCAGGACACAGCCAGCATCACCT GCTCTGGAGATAAATTGGGGATAAATATGCT TACTGGTTTCAGCAGAAGCCAGGCCAGTCCCC TGTGATAGTCATCTATCAAGATAGGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAACAGCACTGCGGTA TTCGGCGGAGGGACCAAGCTGACCGTCCTA<br>SEQ ID NO: 24781 | CAGGTGAAGCTGGTGCAGTCTGGGGCTGAGGTG AAGAAGCCTGGGGCCTCAGTGAAGGTCTCCTGC AAGGCTTCAGGATACACCTTCACCGGCTACTATA TGCACTGGGTGCGACAGGCCCCTGGACAAGGGC TTGAGTGGATGGGATGGATCAACCTAACAGTGG TGGCACAAACTATGACCAGGACACGTCAGGGCAG GGTCACCATGACCAGGGACACGTCCATCAGCAC AGCCTACATGGAGCTGAGCAGGCTGAGATCTGA CGACACGGCCGTGTATTACTGTGCGAGAGTGTAT TACTATGGTTCGGGGAGTTATTATAACGAGTTTG ACTACTGGGGCCAGGGAACCCTGGTCACCGTCTC CTCA<br>SEQ ID NO: 28787 |
| | | AA | SYELTQPPSVSVSPGQTASITCSGDKLGDKYAY WFQQKPGQSPVIVIYQDRKRPSGIPERFSGSNSG NTATLTISGTQAMDEADYYCQAWDNSTAVFGG GTKLTVL<br>SEQ ID NO: 24782 | QVKLVQSGAEVKKPGASVKVSCKASGYTFTGYYM HWVRQAPGQGLEWMGWINPNSGGTNYAQKFQGR VTMTRDTSISTAYMELSRLRSDDTAVYYCARVYYY GSGSYYNEFDYWGQGTLVTVSS<br>SEQ ID NO: 28788 |

FIGURE 50
(Continued)

| | | | |
|---|---|---|---|
| iPS:393230 | 21-225_9G9 | NA | CAGTCTGTGCTGACTCAGCCACCCTCAGCGTC TGGGACCCCCGGGCAGAGGGTCAACATGTCTT GTTCTGGAACCAACTCCAACATCGAAGTTAT ACTGTAAAACTGGTACCAGCAGTCCAGGAAC GGCCCCCAAACTCCTCATCTATATTAATAATC AGCGGCCCTCAGGGGTCCCTGACCGATTCTCT GGCTCCAAGTCTGGCACCTCAGCTCTCCCTGGC CATCAGTGGGCTCCAGTCTGAGGATGACAGCCTG ATTATTACTGTGCAGCATGGGATGACAGCCTG AATGGTCATGTGGTATTCGGCGGAAGGACCAA GCTGACCGTCCTA SEQ ID NO: 24783 | CAGGTGCAGCTGGTGCAGTCTGGGGCTGAGGTG AAGAAGCCTGGGGCCTCAGTGAAGGTTCCTGC AAGGCTTCTGGATACACCTTCACCGGCTACTATA TACACTGGGTGCGACAGGCCCCTGGACAAGGAC TTGAGTGGATGGGATGGATCAACCTAACAGTGG TGGCACAGACTATGCACAGAAGTTTCAGGGCAG GGTCACCATGACCAGGGACACGTCCATCAGCAC AGCCTACATGGAGCTGAGCAGGCTGAGATCTGA CGACACGGCCGTGTATTACTGTGCGAGGTCGTAT TACTATGGTTCGGGGACTTATTATAACGAGTTTG ACTACTGGGGCCAGGGAACCCTGGTCACCGTCTC CTCA SEQ ID NO: 28789 |
| | | AA | QSVLTQPPSASGTPGQRVNMSCSGTNSNIGSYTV NWYQQLPGTAPKLLIYINNQRPSGVPDRFSGSKS GTSASLAISGLQSEDEADYYCAAWDDSLNGHVV FGGRTKLTVL SEQ ID NO: 24784 | QVQLVQSGAEVKKPGASVKVSCKASGYTFTGYYIH WVRQAPGQGLEWMGWINPNSGGTDYAQKFQGRV TMTRDTSISTAYMELSRLRSDDTAVYYCARSYYYG SGTYYNEFDYWGQGTLVTVSS SEQ ID NO: 28790 |
| iPS:393232 | 21-225_17F12 | NA | CAGTCTGCCCTGACTCAGCCTGCCTCCGTGTCT GGGTCTCCTGGACAGTCGATCACCATCCTG CACTGGAGCCAGCAGTGACGTTGGTAATATA ACTCTGTCCTGGTACCAACAGCACCCAGGC AAAGCCCCCAAACTCATGATTTATGAGGTCAG TAATCGGCCCTCAGGGGTTTCTAATCGCTTCTC TGGCTCCAAGTCTGGCAACACGGCCTCCCTGA CCATCTCTGGGCTCCAGGCTGAGGACGAGGCT GATTATTACTGTGCAGCTCATATACAAGCAGCAT CACTGTGGTATTCGGCGGAGGGACCAAACTGA CCGTCCTA SEQ ID NO: 24785 | GAGGTGCAGTTGTTGGAGTCTGGGGAGGCTTGG TACAGCCTGGGGGGTCCCTGAGACTCTCCTGTGC AGCCCTCTGGATTCACCTTTAGCAGCTATGCCATG AGCTGGGTCCGCCAGGCTCCAGGGAAGGGGCTG GAGTGGGTCTCAGCTATTAGTGGTGGTGGTGTA GCACATACTACGAGACTCCGTGAAGGGCCGGG TCACCATCCAGAGACAATTCCAAGAACACGCT GTATCTGCAAATGAACAGCTGAGAGCCGAGGA CACGGCCGTATATTACTGTGCGAAATGGGGACGT GGATACAACTATGAGTACTACTACGGTATGACCG TCTGGGGCCAAGGGACCACGGTCACCGTCTCCTC A SEQ ID NO: 28791 |

FIGURE 50
(Continued)

| | | | | |
|---|---|---|---|---|
| iPS:393234 | 21-225_26C10 | AA | QSALTQPASVSGSPGQSITISCTGASSDVGDYNS VSWYQQHPGKAPKLMIYEVSNRPSGVSNRFSGS KSGNTASLTISGLQAEDEADYYCSSYTSSITVVF GGGTKLTVL<br>SEQ ID NO: 24786 | EVQLLESGGGLVQPGGSLRLSCAASGFTFSSYAMS WVRQAPGKGLEWVSAISGGGGSTYYADSVKGRVT ISRDNSKNTLYLQMNSLRAEDTAVYYCAKWGRGY NYEYYYGMDVWGQGTTVTVSS<br>SEQ ID NO: 28792 |
| | | NA | TCCTATGAAGTGACTCAGCCACCTCAATGTC CGTGTCCCCAGGACAGAGACAGCAGCATCACCT GCTCTGGAGATAAATTGGGGGATAAAATATGTT TGCTGGTTTCAGCAGAAGCCAGGCCAGTCCCC TGTGTTGGTCATCTATCAAGATAGCAAGCGGC CCTCAGGGATCCCTGAGCGATTCTCTGGCTCC AACTCTGGAACACAGCCACTCTGACCATCAG CGGGACCCAGGCTGTGGGTCAACACACTGTATTC ACTGTCAGGCGTGGGACCAAGCTGACCGTCCTA<br>SEQ ID NO: 24787 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATG TGCACTGGGTGCGACAGGCCCCTGGACAAGGGC TTGAGTGGATGGGATGGATCAACCCTAACAGTGG TGGCACAAACTATGCACAGAAGTTTCAGGGCAG GGTCACCATGACCAGGGACACGTCCATCAGCAC AGCCTACATGGAGCTGAGCAGGCTGAGATCTGA CGACACGGCCGTGTACTACCAGTGCTATTTAGGAATTACG GTGTAGTACTACGGTTGACGTTCTGGGCCAAGGG ACCACGGTCACCGTCTCCTCA<br>SEQ ID NO: 28793 |
| | | AA | SYEVTQPPSMSVSPGQTASITCSGDKLGDKYVC WFQQKPGQSPVLVIYQDSKRPSGIPERFSGSNSG NTATLTISGTQAMDEADYYCQAWVNNTVFGGG TKLTVL<br>SEQ ID NO: 24788 | QVQLVQSGAEVKKPGASVKVSCKASGYTFTGYYV HWVRQAPGQGLEWMGWINPNSGGTNYAQKFQGR VTMTRDTSISTAYMELSRLRSDDTAVYYCARERCS TTSCYLGITGYYGMDVWGQGTTVTVSS<br>SEQ ID NO: 28794 |

FIGURE 50
(Continued)

| | | | |
|---|---|---|---|
| iPS:393345 | 21-225_5G7 | NA | TCCTATGAGCTGACTCAGCCACCCTCAGTGTC CGTGTCCCAGGACAGCAGCCAGCATCACCT GCTCTGGAGATAAATTGGGAATAAATATGCT TGGTGGTATCAGCAGAAGCCAGGCCAGTCCCC TGTGCTGGTCATCTATCAAGATAGGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAACAGCACTGTGGTT TTCGGCGGAGGGACCAAACTGACCGTCCTA<br><br>SEQ ID NO: 24789 | GAGGTGCAGCTGTTGGAGTCTGGGGGAGGCTTG GTACAGCCTGAGGGGTCCCTGAGACTCTCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTAGTGGTGGT AGCACATACTACGCAGACTCCGTGAAGGGCCGG TTCACCATCTCCAGAGACAATTCAAGAACACGC TGTGTCTGCAAATGAACAGCCTGAGAGCCGAGG ACACGGCCGTATATTACTGTGCGAAAGAATATTG TGGTGGTGACTGCTATTCCCCTTACTACTACTACT ACGGTATGGACGTCTGGGGCCAAGGGACCACGG TCACCGTCTCCTCA<br><br>SEQ ID NO: 28795 |
| | | AA | SYELTQPPSVSVSPGQTASITCSGDKLGNKYAW WYQQKPGQSPVLVIYQDRKRPSGIPERFSGSNSG NTATLTISGTQAMDEADYYCQAWDNSTVFGG GTKLTVL<br><br>SEQ ID NO: 24790 | EVQLLESGGGLVQPEGGSLRLSCAASGFTFSSYAMS WVRQAPGKGLEWVSAISGSGGSTYYADSVKGRFTI SRDNSKNTLCLQMNSLRAEDTAVYYCAKEYCGGD CYSPYYYYGMDVWGQGTTVTVSS<br><br>SEQ ID NO: 28796 |
| iPS:393368 | 21-225_29H8 | NA | GACATCGTGATGACCCAGTCTCCAGACTCCCT GGCTGTGTCTCTGGGCGAGAGGGCCACCATCA ACTGCAGGTCCAGCAGTCTGTTTACACAGC TCCAACAATTACAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATTGTACTCCGACGTTCGGCCAAGG GACCAAGGTGGAAATCAAA<br><br>SEQ ID NO: 24791 | CAGGTGCAGCTGGTGCAGTCTGGGGCTGAGGTG CAGAAGCCTGGGGCCTCAGTGAAGGTCTCCTGCA AGGCTTCTGGATACACCTTCACCAATTATGATAT CAACTGGGTGCGACAGGCCACTGGACAAGGCT TGAGTGGATGGGCTGGATGAACCCTAACAGTGGT AACACAGGCTATGCACAGAGGTTCCAGGGCAGA GTCACCATGACCAGGAACACCTCCATAAGCGCA GCCTACATGGAGCTGAGCAGCCTGAGATCTGAG GACACGGCCGTATACTTTGACTACTGGGGCCAGTG GCTGGTACTACTTTGACTACTGGGGCCAGGGAAC CCTGGTCACCGTCTCCTCA<br><br>SEQ ID NO: 28797 |

FIGURE 50
(Continued)

| | | | |
|---|---|---|---|
| | | AA | DIVMTQSPDSLAVSLGERATINCRSSQTLHSSNN YNYLAWYQQKPGQPPKLLIYWASTRESGVPDRF SGSGSGTDFTLTISSLQAEDVAVYYCQQYYCTPP TFGQGTKVEIK. SEQ ID NO: 24792 | QVQLVQSGAEVQKPGASVKVSCKASGYTFTNYDIN WVRQATGQGLEWMGWMNPNSGNTGYAQRFQGR VTMTRNTSISAAYMELSSLRSEDTAVYYCASSSGW YYFDYWGQGTLVTVSS SEQ ID NO: 28798 |
| iPS:393565 | 21-225_34B11 | NA | TCCTATGAGCTGACTCAGCCACCCTCAGTGTC CGTGTCCCAGGACAGACAGCCAGCATCACCT GCTCTGGAGATAAATTGGGGGATAAATATGCT TGCTGGTATCAGCAGAAGCCAGGCCAGTCCCC TGTTGGTGGTCATCTATCAAGATATGAAGCGGC CCTCAGGGATCCCTGAGCGATTCTCTGGCTCC AACTCTGGAACACAGCCACTCTGACCATCAG CGGGACGCAGGCTATGATGAGGCTGACTATT ACTGTCAGGCGGTGGACAACAGCACTGCGGTA TTCGGCGGAGGGACCAAGCTGACCGTCCTA SEQ ID NO: 24793 | CAGGTGAAACTGGTGCAGTCTGGGCTGAGGTG AAGAAGCCTGGGGCCTCAGTGAAGGTCTCCTGC AAGGCTTCAGGATACACCTTCACCGGCTACTATA TGCACTGGGTGCGACAGGCCCCTGGACAAGGGC TTGAGTGGATGGGATGGATCAACCCTAACAGTGG TGGCACAAACTATGCACAGAAGTTTCAGGGCAG GGTCACCATGACCAGGACACGTCCATCAGCAC AGCCTACATGGAGCTGAGCAGGCTGAGATCTGA CGACACGCCGTGTTCGGGGAGTTATTATAACGAGTTG TTCTATGGTTCGGGGAGTTATTATAACGAGTTG ACTACTGGGCCAGGGAACCCTGGTCACCGTCTC CTCA SEQ ID NO: 28799 |
| | | AA | SYELTQPPSVSVSPGQTASITCSGDKLGDKYACW YQQKPGQSPVVVIYQDMKRPSGIPERFSGSNSGN TATLTISGTQAMDEADYYCQAWDNSTAVFGGG TKLTVL SEQ ID NO: 24794 | QVKLVQSGAEVKKPGASVKVSCKASGYTFTGYYM HWVRQAPGQGLEWMGWINPNSGGTNYAQKFQGR VTMTRDTSISTAYMELSRLRSDDTAVYYCARVYFY GSGSYYNEFDYWGQGTLVTVSS SEQ ID NO: 28800 |

FIGURE 50
(Continued)

| | | | |
|---|---|---|---|
| iPS:393802 | 21-225_3D12 | NA | GAAATTGTGTTGACGCAGTCTCCAGGCACCCT GTCTTTGTCTCCAGGGGAAAGAGCCACCCTCT CCTGCAGGGCCAGTCAGAGTGTTAGCAGCAGC TACTTAGCCTGGTACCAGCAGAAACCTGGCCA GGCTCCCAGGCTCCTCATCTATGGTACATCCA GCAGGGCCACTGGCATCCCAGACAGGTTCAGT GGCAGTGGGTCTGGGACAGACTTCACTCTCAC CATCAGCAGACTGGAGCCTGAAGATGTAGTTCAC TGTATTACTGTCAGCAGTATGGTAGTTCACGC AGTTTTGGCCAGGGGACCAAGCTGGAGATCAA A | GAGGTGCAGCTGGTGGAGTCTGGGGGAGGCTTG GTAAAGCCTGGGGGGTCCCTTAGACTCTCCTGTG CAGCCCTCTGGAGTCACTTTCAGTACGCCTGGAT GAACTGGGTCCGCCAGGCTCCAGGGAAGGGGCT GGAGTGGGTTGGCCGGATTAAAACAAAATTGA TGGTGGGACAACAGACTACGTTGCACCCGTGAA AGGCAGATTCACCATCTCAAGAGATGATTCAAA AAACACGCTGTATCTGCAAATGAACAGCCTGAA AACCGAGGACACAGCCGTATATTACTGTACCACA GAAGGCTGAACACGACTACTGGGGCCAGGGA ACCCTGGTCACCGTCTCCTCA |
| | | | SEQ ID NO: 24795 | SEQ ID NO: 28801 |
| | | AA | EIVLTQSPGTLSLSPGERATLSCRASQSVSSSYLA WYQQKPGQAPRLLIYGTSSRATGIPDRFSGSGSG TDFTLTISRLEPEDFAVYYCQQYGSSRSFGQGTK LEIK | EVQLVESGGGLVKPGGSLRLSCAASGVTFSTAWM NWVRQAPGKGLEWVGRIKNKIDGGTTDYVAPVKG RFTISRDDSKNTLYLQMNSLKTEDTAVYYCTTEGW NTDYWGQGTLVTVSS |
| | | | SEQ ID NO: 24796 | SEQ ID NO: 28802 |
| iPS:393804 | 21-225_5H7 | NA | GACATCCAGATGACCCAGTCTCCATCCTCCCT GTCTGCATCTGTTGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGTTACATCCAGTT TGCAAGGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAACATATAAGTTACCCGCTC ACTTTCGGCGGAGGGACCAAGGTGGAGATCA AA | CAGCTGCAGCTGCAGGAGTCGGGCCCAGGACTG GTGAAGCCTTCGGAGACCCTGTCCCTCACCTGCA CTGTCTCTGGTGGCTCCATCAACAGAAGTAGTTA TTACTGGGGCTGGATCCGCCAGCCCCCAGGGAA GGGACCACTACTACAACCGTCCCTCAAGAGTC GAGTCACCATATCCGTAGACACGTCCAAGAACC AGTTCTCCCTGAACCTGAGCTCTGTGACCGCCGC AGACACGGCTGTATATTCCTGTGCGAGACATGGA AAAGACTGGGGCTTGACTACTGGGGCCAGGGA ACCCTGGTCACCGTCTCCTCA |
| | | | SEQ ID NO: 24797 | SEQ ID NO: 28803 |

FIGURE 50
(Continued)

| | | | | |
|---|---|---|---|---|
| iPS:393806 | | AA | DIQMTQSPSSLSASVGDRVTITCRASQGIRNDLG WYQQKPGKAPKRLIYVTSSLQGGVPSRFSGSGS GTEFTLTISSLQPEDFATYYCLQHNSYPLTFGGG TKVEIK<br>SEQ ID NO: 24798 | QLQLQESGPGLVKPSETLSLTCTVSGGSINRSSYYW GWIRQPPGKGLEWIGNIYYSGTTYYNPSLKSRVTIS VDTSKNQFSLNLSSVTAADTAVYSCARHGKDWGL DYWGQGTLVTVSS<br>SEQ ID NO: 28804 |
| | 21-225_6A6 | NA | CAGCTGCAGCTGCAGGAGTCGGGCCCAGGACTG GTGAAGCCTTCGGAGACCCTGTCCTCACCTGCA CTGTCTCTGGTGGCTCCATCAGCAGAAGTAGTTA CTACTGGGGCTGGATCCGCCAGCCCCCAGGGAA GGGGCTGGAGTGGATTGGGAATATCTATTATAGT GGGATCCCTACTACAACCGTCCCCTCAAGAGTC GGGTCAACATATCGTAGACACGTCCAAGAACC AGTTCTCCCTGAAGCTGTGTATTACTGTGCGAGACACAGC AGCAGTCTGGTCTCTGACTACTGGGGGCCAGGGAA CCCTAGTCACCGTCTCCTCA<br>SEQ ID NO: 28805 | |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHSSYPLTFGGGT KVEIK<br>SEQ ID NO: 24800 | QLQLQESGPGLVKPSETLSLTCTVSGGSISRSSYYW GWIRQPPGKGLEWIGNIYYSGIPYYNPSLKSRVNIS VDTSKNQFSLKLNSVTAADTAVYYCARHSSSWSL DYWGQGTLVTVSS<br>SEQ ID NO: 28806 |

FIGURE 50
(Continued)

| | | | |
|---|---|---|---|
| iPS:393808 | 21-225_1A2 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATCGTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAATAGTCACCCTCTC ACTTTCGGCGGAGGGACCAAGGTGGAGATCA AA<br><br>SEQ ID NO: 24801 | GAGGTGCAGCTGGTGGAGTCTGGGGGAGGCTTG GTCAAGCCTGGGGGGTCCCTGAGACTCTCCTGTG CAGCCTCTGATTCACCTTCAGTAGTACCTATACCAT GAACTGGGTCCGCCAGGCTCCAGGGAAGGGGCT GGAGTGGGTCTCATCCATTAGTGGTAGTGGTAGT TACATATACTACGCAGATCAGTGAAGGCCGAT TCACCATCTCCAGAGACAACGCCAAGAACTCACT GTATCTGCAAATGAACAGCCTGAGAGCCGAGGA CACGGCTGTGTATTACTGTGCGAGAGGGAGCAG CTCGTCCGGGTTTGACTACTGGGGCCAGGGAACC CTGGTCACCGTCTCCTCA<br><br>SEQ ID NO: 28807 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSHPLTFGGG TKVEIK<br><br>SEQ ID NO: 24802 | EVQLVESGGGLVKPGGSLRLSCAASGFTFSSYTMN WVRQAPGKGLEWVSSISGSGSYIYYADSVKGRFTIS RDNAKNSLYLQMNSLRAEDTAVYYCARGSSSSGF DYWGQGTLVTVSS<br><br>SEQ ID NO: 28808 |
| iPS:393810 | 21-225_5A4 | NA | GACATCCAGATGACCCAGTCTCCATCTCCGT GTCTGCATCTGTAGGAGACAGAGTCACCATCA CTTGTCGGGCGAGTCAGGGTATTAGCAGCTGG TTAGCCTGGTATCAACAGAAACCAGGGAAAG CCCCTAAACTCCTGATCTATGATGCATCCAGTT TGCAAAGTGGGGTCCCATCAAGGTTCAGCGGC AGTGGATCTGGGACAGATTTCACTCTCACCAT CAGCAGCCTCAGCCTGAAGATTTTGCAACTT ACTATTGTCAACAGGCTAACAGTTTCCCGTGG ACGTTCGGCCAAGGGACCAAGGTGGAAATCA AA<br><br>SEQ ID NO: 24803 | GAGGTGCAGGTGTTGGAGTCTGGGGGAGGCTTG GTACAGCCGGGGGGGTCCCTGAGACTCTCTGTG CAGCCTCTGGACTCACCTTTAGCAGTCAGTCTGCCAT GAGTGGGTCCGCCAGGCTCCAGGGAAGGGGCT GGAGTGGGTCTCAGCTATTAGTGGTCGTGGTGGT AACACATTCTACACAGAGACAATTCAAGAAACACGT TCACCATTTCGAAATGAACAGCCTGAGAGCCGAGGA CACGGCCGTATATTACTGTGCGAAACTGGGAA AGAACTACTACTACGGTATGGACGTCTGGGGC CAAGGGACCACGGTCACCGTCTCCTCA<br><br>SEQ ID NO: 28809 |

FIGURE 50
(Continued)

| | | | | |
|---|---|---|---|---|
| iPS:393812 | | AA | DIQMTQSPSSVSASVGDRVTITCRASQGISTWLA WYQQKPGKAPKLLIYDASSLQSGVPSRFSGSGS GTDFTLTISSLQPEDFATYYCQQANSFPWTFGQG TKVEIK<br>SEQ ID NO: 24804 | EVQVLESGGGLVQPGGSLRLSCAASGLTFSSSAMS WVRQAPGKGLEWVSAJSGRGNTFYTDSVKGRFTI SRDNSKNTLYLQMNSLRAEDTAVYYCAKLGKDYY YYGMDVWGQGTTVTVSS<br>SEQ ID NO: 28810 |
| | 21-225_6A11 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCGTGAAGATTTTGCAACT TATTACTGTCTACAGCATAATAGTTACCCGTG GACGTTCGGCCAAGGGACCAAGGTGGAAATC AAA<br>SEQ ID NO: 24805 | CAGGTGCAGCTGGTGGAGTCTGGGGGAGGCGTG GTCCAGCCTGGGAGGTCCCTGAGACTCTCCTGTG CAGCGTCTGATTCACCTTCAGTGACTATGGCAT GCACTGGGTCCGCCAGGCTCCAGGCAAGGGGCT GGAGTGGGTGGCAGTTATATGTTTGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATGACTGTGCGAGAGATCTTGG CTGGACGGAAGAGTACTGGGGCCAGGGAACCCT GGTCACCGTCTCCTCA<br>SEQ ID NO: 28811 |
| | | AA | DIQMTQSPSSLSASVGDRVTITCRASQGIRNDLG WYQQKPGKAPKRLIYAASSLQSGVPSRFSGSGS GTEFTLTISSLQPEDFATYCLQHNSYPWTFGQG TKVEIK<br>SEQ ID NO: 24806 | QVQLVESGGGVVQPGRSLRLSCAASGFTFSDYGM HWVRQAPGKGLEWVAVIWFDGSNKYYADSVKGR FTISRDNSKNTLYLQMNSLRAEDTAVYDCARDLG WTEEYWGQGTLVTVSS<br>SEQ ID NO: 28812 |

FIGURE 50
(Continued)

| | | | |
|---|---|---|---|
| iPS:393814 | 21-225_7F4 | NA | GACATCCAGATGACCCAGTCTCCATCCTCCCT GTCTGCATCTGTAGGAGACAGAGTCACCATCA CTTGCCGGACAAGTCAGGGCATTAGAAATGAT TTAGGCTGGTATCAGCAGAAACCAGGGAAAG CCCCTAAGCGCCTGATTTATGCTGCATCCAATT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAGTGCTTACCCGCTC ACTTTCGGCGGAGGGACCAAGGTGGAGATCA AA |
| | | | SEQ ID NO: 24807 |
| | | AA | DIQMTQSPSSLSASVGDRVTITCRTSQGIRNDLG WYQQKPGKAPKRLIYAASNLQSGVPSRFSGSGS GTEFTLTISSLQPEDFATYYCLQHSAYPLTFGGG TKVEIK |
| | | | SEQ ID NO: 24808 |
| | | NA | CAACTGCAGCTGCAGGAGTCGGGCCCAGGACTG GTGAAGCCTTCGGAGACCCTGTCCCTCACCTGCA CTGTCTCTGGTGGCTCCATCAGCAGGAGTAGTTA CTACTGGGGCTGGATCCGCCAGCCCCCAGGGAA GGGGCTGGAGTGGATTGGAGAATATCTATTAGT GGGGCCACCTACTACAACCCGTCCCTCAAGAGTC GAGTCACCATCTCCGTAGACACGTCCACGAACCA GTTCTCCCTGAAGCTGAGCTCTGTGACCGCCGCA GACACGGCTGTGTATTACTGTGCGAGACATAGCG GCAGCTGGTCCCTTGACTACTGGGGCCAGGGAAC CCTGGTCACCGTCTCCTCA |
| | | | SEQ ID NO: 28813 |
| | | AA | QLQLQESGPGLVKPSETLSLTCTVSGGSISRSSYYW GWIRQPPGKGLEWIGNIYYSGATYYNPSLKSRVTIS VDTSTNQFSLKLSSVTAADTAVYYCARHSGWSLD YWGQGTLVTVSS |
| | | | SEQ ID NO: 28814 |
| iPS:393816 | 21-225_6D4 | NA | GACATCCAGATGACCCAGTCTCCATCCTCCCT GTCTGCTTCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGTT TGCAAAGTGGGGTCCCATCTATCGGTTCAGCGGC AGTGGATCTGGGACAGAATTCACTCTCACAAT CAGCAGCCTGCAGCCTGAAGATTTTGCAACTT ATTACTGTCTACAGCATAGTAGTTACCCGCTC ACTTTCGGCGGAGGGACCAAGGTGGAGATCA AA |
| | | | SEQ ID NO: 24809 |
| | | | CAGCTGCAGCTGCAGGAGTCGGGCCCAGGACTG GTGAAGCCTTCGGAGACCCTGTCCCTCACCTGCA CTGTCTCTGGTGGCTCCATCAGCAGAAGTAGTTC CTACTGGGGCTGGATCCGCCAGCCCCCAGGGAA GGGAGCGGCCTACTACAATTCCGTCCCTCAAGAGTC GAGTCACCATATCCGTAGCCACGTCCAAGAACCA GTTCTCCCTGAACCTGACCTCTGTGACCGCCGCA GACACGGCTGTGTCTTGACTACTGCGGACAGCA GCAGCTGGTCTCTTGACTGCTGCTGGGGCCAGGGAAC CCTGGTCACCGTCTCCTCA |
| | | | SEQ ID NO: 28815 |

FIGURE 50
(Continued)

| | | | | |
|---|---|---|---|---|
| iPS:393818 | 21-225_6G12 | AA | DIQMTQSPSSLSASVGDRVTITCRASQAIRNDLG WYQQKPGKAPKRLIYAASSLQSGVPSRFSGSGS GTEFTLTISSLQPEDFATYYCLQHSSYPLTFGGGT KVEIK<br>SEQ ID NO: 24810 | QLQLQESGPGLVKPSETLSLTCTVSGGSISRSSSYW GWIRQPPGKGLEWIGNIYYSGSAYYIPSLKSRVTISV ATSKNQFSLNLTSVTAADTAVYYCARHSSWSLDC WGQGTLVTVSS<br>SEQ ID NO: 28816 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCACTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAGTTACCCGCTC ACTTTCGGCGGAGGGACCAAGGTGGAGATCA AA<br>SEQ ID NO: 24811 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATTTGGTATGATAGAAGT AATAACTACTATGCAGACTCCGTGAAGGGCCGAT TCACCATCTCAGAGACAATTCCAAGAATACGCT GTATCTGCAAATGAACAGCCTGAGAGCCGAGGA CACGGCTGTGTATTACTGTGCGAGAGAACTGGGG TTCCGGTCTGACTACTGGGGCCAGGGAACCCTGG TCACCGTCTCTCA<br>SEQ ID NO: 28817 |
| | | AA | DIQMTQSPSSLSASVGDRVTITCRASQGIRNDLG WYQQKPGKAPKRLIYAASTLQSGVPSRFSGSGS GTEFTLTISSLQPEDFATYYCLQHNSYPLTFGGG TKVEIK<br>SEQ ID NO: 24812 | QVQLVESGGGVVQPGRSLRLSCAASGFTFSSYGMH WVRQAPGKGLEWVAVIWYDRSNNYYADSVKGRF TISRDNSKNTLYLQMNSLRAEDTAVYYCARELGFR SDYWGQGTLVTVSS<br>SEQ ID NO: 28818 |

FIGURE 50
(Continued)

| | | | |
|---|---|---|---|
| iPS:393820 | 21-225_8H7 | NA | GACATCCAGATGACCCAGTCTCCATCCTCCCT GTCTGCATCTGTAGGAGACAGAGTCACCATCA CTTGCCGGGCAAGTCAGGGACATTAGAAATGAT TTAGGCTGGTATCAGCAGAAAACCAGGGAAAG CCCCTAAGCGCCTGATTTATGCTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAATAGTTACCCGTTC ACTTTCGGCGGAGGGACCAAGGTGGAGATCA AA<br><br>SEQ ID NO: 24813 | CAGGTGCAGCTGGTGGAGTCTGGGGGAGGCGTG GTCCAGCCTGGGAGGTCCCTGAGACTCTCCTGTC CAGGGTCTGATTCACCTTCAGTGACTTTGGCAT GCACTGGGTCCGCCAGGCTCCAGCAAGGGCT GGAGTGGGTGGCAGTTATTTGGTATGAAGAAAT AATCAATACTATGCAGACTCCGTGAAGGGCCGAT TCACCATCTCAGAGACAATTCCAAGAACACGCT GTATCTGCAAATGAACAGCCTGAGAGCCGAGGA CACGGCTGTGTATTACTGTGCGAGAGAGCTGGGG TTCCGGTCTGACTACTGGGGCCAGGGAACCCTGG TCACCGTCTCCTCA<br><br>SEQ ID NO: 28819 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPFTFGGGT KVEIK<br><br>SEQ ID NO: 24814 | QVQLVESGGGVVQPGRSLRLSCPASGFTFSDFGMH WVRQAPGKGLEWVAVIWYEENNQYYADSVKGRF TISRDNSKNTLYLQMNSLRAEDTAVYYCARELGFR SDYWGQGTLVTVSS<br><br>SEQ ID NO: 28820 |
| iPS:393822 | 21-225_15B11 | NA | GACATCCAGATGACCCAGTCTCCATCCTCCCT GTCTGCATCTGTAGGAGACAGAGTCACCATCA CTTGCCGGGCAAGTCAGGGACATTAGAAATGAT TTAGGCTGGTATCAGCAGAAAACCAGGGAAAG CCCCTAAGCGCCTGATCTATGCTGCATCCAGT TTGCAAAGTGGGGTCCCATCAAGGTTCACTCTCACAA CAGTGGATCTGGGACAGAATTCACTCTCACAA TCAGCAGCCTGCAGCCTGAAGATTTTGCAACT TATTACTGTCTACAGCATAATAGTTACCATTC ACTTTCGGCCCTGGGACCAAAGTGGATATCAA A<br><br>SEQ ID NO: 24815 | CAGGTGCAGCTGGTGGAGTCTGGGGGAGGCGTG GTCCAGCCTGGGAGGTCCCTGAGACTCTCCTGTG CAGGGTCTGATTCACCTTCAGTAACTATGGCAT GCACTGGGTCCGCCAGGCTCCAGGCAAGGGCT GGAATGGGTGGCAGTTATATACAGACTCCGTGAAGGGCCG TAATAAATACTATACAGACTCCGTGAAGGGCCG ATTCACCATCTCCAGAGACAATTCCAAGAACACG CTGTATCTGCAAATGAACAGCTGAGACCCGAG GACACGGCTGTGTATTACTGTGCGAGAGAAGTGG GATTCACTGAGGACTACTGGGGCCAGGGAACCC TGGTCACCGTCTCCTCA<br><br>SEQ ID NO: 28821 |

FIGURE 50
(Continued)

| | | | | |
|---|---|---|---|---|
| iPS:393824 | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPFFGPGT KVDJK<br>SEQ ID NO: 24816 | QVQLVESGGGVVQPGRSLRLSCAASGFTFSNYGM HWVRQAPGKGLEWVAVIWYEESNKYYTDSVKGR FTISRDNSKNTLYLQMNSLRPEDTAVYYCAREVGF TEDYWGQGTLVTVSS<br>SEQ ID NO: 28822 |
| | 21-225_10F12 | NA | GACATCCAGATGACCCAGTCTCCATCTCCCT GTCTGCATCTGTAGGAGACAGAGTCACCATCA CTTGCCGGGCAAGTCAGAACATTAGTAGTTAT TTAAATTGGTATCAGCAGAAACCAGGGAAAG CCCCTAAACTCCTGATCTATGCTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAATACCCCCTTC TTCACTTTCGGCCCTGGGACCAAAGTGGATAT CAAA<br>SEQ ID NO: 24817 | GAGGTGCAGCTGTTGGAGTCTGGGGGAGGCTTG GTACAGCCTGGGGGGTCCCTGAGACTCTCCTGTG CAGCCTCTGAATTCACCTTTAGCAGCTATGCCAT GAGCTGGGTCCGCCAGGCTCCAGGGAAGGGGCT GGAGTGGGTCTCAATTATTAGTGGTCGTGGTGGT AACACATTCTACGCAGACTCCGTGAAGGGCCGGT TCACCATCTCCAGAGACAATTCCAAGAACACTCT GTATCTGCAAATGAACAGCCTGAGAGCCGAGGA CACGGCCGTATATTACTGTGCGTCCGTGTAGCA GTGGCTGGTCCGGAGGCTTTGCTATCTGGGGCC AAGGGACAATGGTCACCGTCTCTTCA<br>SEQ ID NO: 28823 |
| | | AA | DIQMTQSPSSLSASVGDRVTITCRASQNISSYLN WYQQKPGKAPKLLIYAASSLQSGVPSRFSGSGS GTDFTLTISSLQPEDFATYYCQQSYNTPFFTFGPG TKVDIK<br>SEQ ID NO: 24818 | EVQLLESGGGLVQPGGSLRLSCAASEFTFSSYAMS WVRQAPGKGLEWVSIISRGGNTFYADSVKGRFTI SRDNSKNTLYLQMNSLRAEDTAVYYCASRVAVAG SEAFAIWGQGTMVTVSS<br>SEQ ID NO: 28824 |

FIGURE 50
(Continued)

| | | | |
|---|---|---|---|
| iPS:393826 | 21-225_10G5 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA SEQ ID NO: 24819 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATTTGGTATGAAGAAAAT AATCAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTTTATTACTGTGTACGAGAGAACTGGGG TTCCGGTCGACTACTGGGGCCAGGGAACCCTGG TCACCGTCTCCTCA SEQ ID NO: 28825 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK SEQ ID NO: 24820 | QVQLVESGGGVVQPGRSLRLSCAASGFTFSNYGM HWVRQAPGKGLEWVAVIWYEENNQYYADSVKGR FTISRDNSKNTLYLQMNSLRAEDTAVYYCTRELGF RSDYWGQGTLVTVSS SEQ ID NO: 28826 |
| iPS:393828 | 21-225_10H12 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGGTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACACAGCATAATAGTTACCCGCTC ACTTTCGGCGGAGGGACCAAGGTGGAGATCA AA SEQ ID NO: 24821 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATTTGGTATGAAGACAAT AATCAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACTGGGG TTCCGGTCGACTACTGGGGCCAGGGAACCCTGG TCACCGTCTCCTCA SEQ ID NO: 28827 |

FIGURE 50
(Continued)

| | | | | |
|---|---|---|---|---|
| iPS:393830 | 21-225_12A1 | AA | DIQMTQSPSSLSASVGDRVTITCRASQGIRNDLG WYQQKPGKAPKRLIYGASSLQSGVPSRFSGSGS GTEFTLTISSLQPEDFATYYCLQHNSYPLTFGGG TKVEIK<br>SEQ ID NO: 24822 | QVQLVESGGGVVQPGRSLRLSCAASGFTFSDYGM HWVRQAPGKGLEWVAVIWYEDNNQYYADSVKGR FTISRDNSKNTLYLQMNSLRAEDTAVYYCARELGF RSDYWGQGTLVTVSS<br>SEQ ID NO: 28828 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGTGGC CAGTGGATCTGGGACAGATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA<br>SEQ ID NO: 24823 | CAGGTGCAGCTGGTGGAGTCTGGGGGAGGCGTG GTCCAGCCTGGGAGGTCCCTGAGACTCTCTGTG CAGGCGTCTGGATTCACCTTCAGTAGCTATGGCAT GCACTGGGTCCGCCAGGCTCCAGCAAGGGCT GGAGTGGGTGGCAGTTATTTGGTATGAAGATAAT AATCAATACTATGCAGACTCCGTGAAGGGCCGAT TCACCATCTCCAGACAAATTCCAAGAACAGCT GTATCTGCAAATGAACAGCCTGAGAGCCGAGA CACGGCTGTGTATTACTGTGCGAGAGAACTGGGG TTCCGGTCTGACTACTGGGGCCAGGGAACCCTGG TCACCGTCTCCTCA<br>SEQ ID NO: 28829 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br>SEQ ID NO: 24824 | QVQLVESGGGVVQPGRSLRLSCAASGFTFSSYGMH WVRQAPGKGLEWVAVIWYEENNQYYADSVKGRF TISRDNSKNTLYLQMNSLRAEDTAVYYCARELGFR SDYWGQGTLVTVSS<br>SEQ ID NO: 28830 |

FIGURE 50
(Continued)

| | | | |
|---|---|---|---|
| iPS:393832 | 21-225_14B2 | NA | GACATCCAGATGACCCAGTCTCCATCCTCCCT GTCTGCATCTGTTGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGTTACATCCAGTT TGCAAGGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAACATAATAGTTACCCGCTC ACTTTCGGCGGAGGGACCAAGGTGGAGATCA AA<br><br>SEQ ID NO: 24825<br><br>DIQMTQSPSSLSASVGDRVTITCRASQGIRNDLG WYQQKPGKAPKRLIYVTSSLQGGVPSRFSGSGS GTEFTLTISSLQPEDFATYYCLQHNSYPLTFGGG TKVEIK<br><br>SEQ ID NO: 24826 | CAGGTGCAGCTGCAGGAGTCGGGGCCAGGACTG GTGAAGCCTTCGGAGACCCTGTCCCTCACCTGCA CTGTCTCTGGTGGCTCCATCAACAGAGAAGTAGTTA CTACTGGGGTTGGATCCGCCAGCCCCCAGGGAAG GGGCTGGAGTGGATTGGGAATATCTATTATAGTG GGACCACCTACTACAACCCGTCCCTCAAGAGTCG AGTCACCATATCCGTAGACACGTCAAGAACCA GTCTCCCTGAACCTGAGCTCTGTGACCGCCGCA GACACGGCTGTATATTCTGTGCGAGACATGGAA AAGACTGGGGCCTTGACTACTGGGGCCAGGGAG CCCTGGTCACCGTCTCCTCA<br><br>SEQ ID NO: 28831<br><br>QLQLQESGPGLVKPSETLSLTCTVSGGSINRSSYYW GWIRQPPGKGLEWIGNIYYSGTTYYNPSLKSRVTIS VDTSKNQFSLNLSSVTAADTAVYSCARHGKDWGL DYWGQGALVTVSS<br><br>SEQ ID NO: 28832 |
| iPS:393836 | 21-225_15A2 | NA | GACATCCAGATGACCCAGTCTCCATCCTCACT GTTTGCATTTATAGGAGACAGAGTCACCATCA CTTGTCGGGCGAGTCAGGGCATTAGCAATTAT TTAGCCTGGTTTCAGCAGAAACCTGAAAAGC CCCTAAGTCCCTGATTTTTGCTGCATCCAGTTT GCAAAGTGGGGTCCCATCAAAGTTTAGCGGCA GTGGATTTGGGACAGATTTCACTTTCCCATCA GCAGCCTGCAGCCTGAAGATTATTAT TACTGCCAACAGTATTATAGTTACCATTCACT TTCGGCCCTGGGACCCAAGTGGATGTCAAA<br><br>SEQ ID NO: 24827 | GAGGTGCAGCTGGTGGAGTCTGGGGGAGGCCTG GTCAAGCCTGGGGGGTCCCTGAGACTCTCCTGTG CAGCCTCTGGATTCACCTTCACTTCAGTAGTACCAT GAACTGGGTCCGCCAGGCTCCAGGGAAGGGGCT GGAGTGGGTCTCATCATTAGTTAGTGGTAGT TACATATACTACCAGAGACTCAGTGAAGGGCCGAT TCCATCCAAGAACAACCAAGAACTCACT GTATCTGCAAATGAACGCCCTGAGAGCCGAGGA CACGGCTGTATTACTGTGCGAGAGTGGCTTCA TTTGACTACTGGGGCCAGGGAACCCTGGTCACCG TCTCCTCA<br><br>SEQ ID NO: 28833 |

FIGURE 50
(Continued)

| | | AA | DIQMTQSPSSLFAPIGDRVTITCRASQGISNYLAW FQQKPGKAPKSLIFAASSLQSGVPSKFSGSGFGT DFTFPISSLQPEDFANYYCQQYYSYPFTFGPGTQ VDVK<br>SEQ ID NO: 24828 | EVQLVESGGGLVKPGGSLRLSCAASGFTFSSYTMN WVRQAPGKGLEWVSSISGSGSYIYYADSVKGRFTIS RDNAKNSLYLQMNALRAEDTAVYYCARVASFDY WGQGTLVTVSS<br>SEQ ID NO: 28834 |
| iPS:393838 | 21-225_6G2 | NA | GACATCCAGATGACCCAGTCTCCATCCTCCCG GTCTGCATTTGTTGGAGACAGAGTCACCATCA CTTACCGGGCAAGTCAGGGCATTAGAAATGAT TTAGGCTGGTATCAGCAGAAACCAGGGAAAG CCCCTCAGCGCCTGATCTATGCTGCATCCAGT CTGCAAAGTGGGGTCCCATCAAGGTTCAGCGG CAGTGGATATGGGACTGAATTCAATATCACAA TCAGCAGCTTGCAGCCTGAAGATTTTGCAATT TATTACTGTATACAGCATATAGTTACCTGTG GACGTTCGGCCAAGGGACCAAGGTGGAAATC ACA<br>SEQ ID NO: 24829 | CTGGTGCAGCTGGTGGAGTCTGGGGGAGGCGTG GTCCAGCCTGGGAAGTCCCTGAGACTCTCCTGTG CAGCGTCTGGATTCACCTTCAGTGACTGACTGGCAT ACACTGGGTCCGCCAGGCTCCAGGCAAGGGCT GGAGTGGGTGGCAGTCATTTGGTTTGATGGAAGT AATAAATACTATGCAGACTCCGTGAAGGGCCGA TTCACCATCTCCAGCGACAATTCCAAAAACACGC TGTATCTGCAAATGAACAGCCTGAGAGCTGAGG ACACGGCTGTGTATTACTGTGCGAGAGATCTTGG CTGGACGGAAGAGTACTGGGGCCAGGGAACCCT GGTCACCGTCTCCTCA<br>SEQ ID NO: 28835 |
| | | AA | DIQMTQSPSRSAFVGDRVTITYRASQGIRNDLG WYQQKPGKAPQRLIYAASSLQSGVPSRFSGSGY GTEFNITISSLQPEDFAIYYCIQHNSYLWTFGQGT KVEIT<br>SEQ ID NO: 24830 | LVQLVESGGGVVQPGKSLRLSCAASGFTFSDYGIH WVRQAPGKGLEWVAVIWFDGSNKYYADSVKGRF TISSDNSKNTLYLQMNSLRAEDTAVYYCARDLGW TEEYWGQGTLVTVSS<br>SEQ ID NO: 28836 |

FIGURE 50
(Continued)

| | | | | |
|---|---|---|---|---|
| iPS:393840 | 21-225_3F8 | NA | GACTTCCAGATGACCCAGTCTCCATCTCCCT GTCTGCATCTGTAGGAGACAGAGTCACCATCA CTTGCCGGGCAAGTCAGAGTATTTCTCAGGTAT TTAAATTGGTATCGGCAGAAACACCAGGGAGAG CCCCTCAGGTCCTGATCTATCATACATCCAGTT TGCAAAGTGGGGTCCCATCAAGGTTCAGTGGC AGTGGATCTGGGACAGTTTTCACTCTCACCAT CAGCAGTCTGCAACCTGAAGATTTTGCAACTT ACTACTGTCAACAGAGACTTACAGTACCCGCTC ACTTTCGGCGGAGGGACCAAGGTGGAGATCA AC<br><br>SEQ ID NO: 24831 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGGGGCAGTTATATGGCATGATGGAAG TAATAAATACTATGCAGACTCCGTGAAGGGCCG ATTCACCATCTCAGAGACAATGCCAAGAACAC GCTGTATCTGCAAATGAACAGCCTGAGAGCCGA GGACACGGCTGTGTATTACTGTGCGAGAGATCTG AGTATGGGGTATGGACGTCTGGGGCCAAGGG ACCACGGTCACCGTCTCCTCA<br><br>SEQ ID NO: 28837 |
| | | AA | DFQMTQSPSSLSASVGDRVTITCRASQSILSYLN WYRQKPGRAPQVLIHTSSLQSGVPSRFSGSGSG TVFTLTISSLQPEDFATYYCQQTYSTPLTFGGGTR VEIN<br><br>SEQ ID NO: 24832 | QVQLVESGGGVVQPGRSLRLSCAASGFTFSSYGMH WVRQAPGKGLEWGAVIWHDGSNKYYADSVKGRF TISRDNAKNTLYLQMNSLRAEDTAVYYCARDLSM GGMDVWGQGTTVTVSS<br><br>SEQ ID NO: 28838 |
| iPS:393844 | 21-225_3G7 | NA | GACATCCAGATGACCCAGTCTCCATCTCCCT GTCTGCATCTGTCGGAGACAGAGTCACCATCA CTTGCCGGGCAAGTCAGAACATTTACAGGTAT TTAAATTGGTATCAGGGAGACCAGGGAGAG CCCCTAAACTCATGATCTATGCTGCATCCAGTT CGCAAAGTGGGGTCCCATCAAGATTCAGTGGC AGTGGATCTGGGACAGATTTCACTGTCACCAT CAGTAGTCTTCAACCTGAAGATTTTGCAACTT ATTACTGTCAACAGAGTTACAGTCCCCTTTC ACTTTCGGCGGAGGGACCAAGGTGGAGATCG AC<br><br>SEQ ID NO: 24833 | CAGGTGCAGCTGGTGGAGTCTGGGGGAGGCGTG GTCCAGCCTGGGAGGTCCCTGAGACTCTCCTGTG CAGCCTCTGGATTCAACTTCAGTAACTATGGCAT GCACTGGGTCCGCCAGGCTCCAGGCAAGGGCT GGAGTGGGTGGCAGTTCATATGGACTCCGTGAAGGGCCGA TTCACCATCTCCAGAGACAATTCCAAGAACACGG TGTATCTGCAAATGAACAGCTGAGAGCCGAGG ACACGGCTGTGTATTACTGTGCGAGAGATGAGAG GCTGGGGATTTTGACTACTGGGGCCAGGAACC CTGGTCACCGTCTCCTCA<br><br>SEQ ID NO: 28839 |

FIGURE 50
(Continued)

| | | AA | DIQMTQSPSSLSASVGDRVTVTCRASQNIYRYLN WYQGRPGRAPKLMIYAASSSQSGVPSRFSGSGS GTDFTVTISSLQPEDFATYYCQQSYSPPFTFGGG AKVEID<br><br>SEQ ID NO: 24834 | QVQLVESGGGVVQPGRSLRLSCAASGFNFSNYGM HWVRQAPGKGLEWVAVIWHDGSNKYYVDSVKGR FTISRDNSKNTVYLQMNSLRAEDTAVYYCARDERL GIFDYWGQGTLVTVSS<br><br>SEQ ID NO: 28840 |
|---|---|---|---|---|
| iPS:393848 | 21-225_4H2 | NA | GACATCCAGATGACCCTGTCTCCATCCTCCT GTCTGCATCTGTAGGAGACAGAGTCACCATCA CTTGCCGGGCAATTCAGAACATTAGCAGTAT TTAAATTGGTATCAGCAGAAACCAGGGAAAG CCCCTAAACTCGTGATCTATGCTGCATCCAGC TTGCAAAGTGGGGTCCCATCAAGGTTCAGTGG CAGAGGATCTGGGACAGATTTCACTCTCACCA TCGGTTGTGTGCAAACTGAAGATTTTGCAACT TACTACTGTCAACAGAGTTACAGAACCCCTT ATTCACTTTCGGCCCTGGGACCAAGGTTGATA TCAAA<br><br>SEQ ID NO: 24835 | GAGGTGCAGCTGTTGGAGTCTGGGGAGGCTTG GTACAGCCTGGGGGGTCCCTGAGACTCTCTGTG CAGCCTCTGGATTCACCTTTAGCGCTTATGCCAT GAACTGGGTCCGCCAGGCTCCAGGGATGGGGCT GGAGTGGGTCTCAGTTATTAGTGTAGTGGTGGT TACACATACTACGCGGACTCCGTGAAGGGCCGGT TCACCATCTCAGAGACAATCCAAGAAACACGCT GTATCTGCAAATGAACAGCTGAGAGCCGAGGA CACGGCCGTCTATTACTGTGCGTCCCGTTAGCA GTGGCTGGCTCGGAGGCTTTTGATATCTGGGGCC AAGGGACAAATGGTCACCGTCTCTTCA<br><br>SEQ ID NO: 28841 |
| | | AA | DIQMTLSPSSLSASVGDRVTITCRAIQNISSYLNW YQQKPGKAPKLVIYAASSLQSGVPSRFSGRGSGT DFTLTIGCVQREDFATYYCQQSYRTPLFTFGPGT KVDIK<br><br>SEQ ID NO: 24836 | EVQLLESGGGLVQPGGSLRLSCAASGFTFSGYAMN WVRQAPGMGLEWVSVISRSGGYTYYADSVKGRFT ISRDNSKNTLYLQMNSLRAEDTAVYYCASRLAVAG SEAFDIWGQGTMVTVSS<br><br>SEQ ID NO: 28842 |

FIGURE 50
(Continued)

| | | | | |
|---|---|---|---|---|
| iPS:393852 | 21-225_12A10 | NA | GACGTCCAGATGACCCAGTCTCCATCTCCCT GTCTGCATCTGCAGGAGACAGAGTCACCATCA CTTGCCGGGCAAGTCAGAGACATTTACAGCTAT TTAAATTGGTATCAGCAGAAACCAGGGAGAG CCCCTAAGGTCCTGATCCATACTGCATCCAGT TTGCAAAGTGGGGTCCCATCAAGGTTCAGTGG CAGTGGATCTGGGGCAGATTTCACTCTCACCA TCAACAGTCTGCAACCTGAAGATTTTGCAACT TACTACTGTCAGCAGAGTTACAGTCCCCCTCT CACTTTCGGCGGAGGGACCAAGGTAGAGATC AAA<br><br>SEQ ID NO: 24837 | CAGGTGCAGCTGGTGGAGTCTGGGGGAGGCGTG GTCCAGCCTGGAGGGTCCCTGAGACTCTCCTGTG CAGCGTCTGGATTCACCTTCAGTGACTATGGCAT GCACTGGGTCCGCCAGGCTCCAGGCAAGGGCT GGAGTGGGTGGCAGTTATATGCATGATGAAAG TAATAAATACTATACAGACTCCGTGAAGGGCCG ATTCACCATCTCCAGAGACAATTCCAAGAACACG CTGTATCTGCAAATGAACAGCCTGAGAGACGAG GACACGGCTGTGTATTACTGTGCGAGAGACGAG AGGCTGGGGATTTTGACTACTGGGGCCAGGGAA CCCTGGTCACCGTCCTCA<br><br>SEQ ID NO: 28843 |
| | | AA | DVQMTQSPSSLSASAGDRVTITCRASQNIYSYLN WYQQKPGRAPKVLIHTASSLQSGVPSRFSGSGSG ADFTLTINSLQPEDFATYYCQQSYSPPLTFGGGT KVEIK<br><br>SEQ ID NO: 24838 | QVQLVESGGGVVQPGRSLRLSCAASGFTFSSYGMH WVRQAPGKGLEWVAVIWHDESNKYYTDSVKGRF TISRDNSKNTLYLQMNSLRAEDTAVYYCARDERLG IFDYWGQGTLVTVSS<br><br>SEQ ID NO: 28844 |
| iPS:393854 | 21-225_7H11 | NA | GACATCCAGATGACCCAGTCTCCATCCTCCGC ATCTGCATCTGTAGGAGTCAGAGTCACCATCA TTTGCCTGGCAAGTCAGGGCATTAGAAATGAT TTAGGCTGGTATCAGCAGAAACCAGGGAAAG CCCCTAAGCGCATAATCTATGTTGCATGTAGT TTCCAAAGTGGGGTCCCATCAAGGTTCAGCGG CAGTGGATATGGGACAGCCTGAAGATTTCCAAC TCAGCATCATGCAGCCTGAAGATTTCGCAACT TATTACTGTCTACAACACATAATCTTTACCCGCTC ACTTTCGGCGGAGGGACCAAGGTGGAGATCA AA<br><br>SEQ ID NO: 24839 | CAGGTGCAGCTGGTGGAGTCTGGGGGAGGCGTG GTCCAGCCTGGAGGGTCCCTGAGACTCTCCTGTT CAGCGTCTGGATTCACCTTCAGTGACTATGGCAT GCACTGGGTCCGCCAGGCTCCAGGCAAGGGCT GGAGTGGGTGGCAGTTATATGTATGATGAAAAT AATAAATACTATGCAGAGACAATTCAAGAACACGC TGTATCTGCAAATGAACAGCCTGAGAGACGAGG ACACGGCTGTGTATTACTGTGCGAGAGAACTGGG GTTCCGGTCTGACTACTGGGGCCAGGGAACCCTG GTCACCGTCTCCTCA<br><br>SEQ ID NO: 28845 |

FIGURE 50
(Continued)

| | | | |
|---|---|---|---|
| iPS:393856 | 21-225_14C2 | AA | DIQMTQSPSSASASVGVRVTIICLASQGIRNDLG WYQQKPGKAPKRIIYVACSFQSGVPSRFSGSGY GTEFTLTISIMQPEDFATYYCLQHNLYPLTFGGG TKVEIK<br>SEQ ID NO: 24840 | QVQLVESGGGVVQPGRSLRLSCSASGFTFSDYGMH WVRQAPGKGLEWVAVIWYDENNKYYADSVKGRF TISRDNSKNTLYLQMNSLRAEDTAVYYCARELGFR SDYWGQGTLVTVSS<br>SEQ ID NO: 28846 |
| | | NA | GACATCCAGATGATCCAGTCTCCATCTCCCT GTTTGCATGTGTAGGAGACAGAGTCATCATCA CTTGCCGGGCAAGTCAGGGCATTAGAAATGAT TTAGACTGGTATCAGCAGAAACCAGGAAAG CCCCTAAGCGCCTGATCTATGCTGCATCAGT TTGCAAAGTGGGGTCCCATCAAGGTTCAGCGG CAGTGGATCTGGGACAGATTCACTCTCACAA TCAGCAGCTGCAGCGTGAAGATTTTGCAACT TATTACTGTGTACAGCATAATAGTTACCCGCT CACTTTCGGCGGAGGGACCAAGGTGGAGATC AGA<br>SEQ ID NO: 24841 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATGAAGACTCCGTGAAGGGCCG TAATAAATACTATGAAGACTCCGTGAAGGGCCG ATTCACCATCTCCAGAGACAATTCCAAGAACACG CTGTATCTGCAAATGAAAAGCCTGAGAGCCGAG GACACGGCTGTGTATTACTGTGCGAGAGAAGTG GGATTCCGGTCGACTACTGGGGCCAGGGAACCC TGGTCACCGTCTCCTCA<br>SEQ ID NO: 28847 |
| | | AA | DIQMIQSPSSLFACVGDRVHTCRASQGIRNDLDW YQQKPGKAPKRLIYAASSLQSGVPSRFSGSGSGT EFTLTISSVQREDFATYYCVQHNSYPLTFGGGTK VEIR<br>SEQ ID NO: 24842 | QVQLVESGGGVVQPGRSLRLSCAASGFTFSDYGM HWVRQAPGKGLEWVAVIWYDESNKYYEDSVKGR FTISRDNSKNTLYLQMKSLRAEDTGVYYCAREVGF RSDYWGQGTLVTVSS<br>SEQ ID NO: 28848 |

FIGURE 50
(Continued)

| | | | |
|---|---|---|---|
| iPS:393862 | 21-225_5G2 | NA | GACATCCAGATGACCCAGTCTCCATCCTCCCC<br>GTCTGCATCTGTAGGAGACAGAGTCACCATCA<br>CTTTCCGGGCAAGTCAGAACATTATTAGTTAT<br>TTAAATTGGTATCAGCAGAAACCAGGGAAAG<br>CCCGTAAGCTCGTGATCTATGGTGCATCCAGT<br>TTGCAAAGTGGGGTCCCATCAAGGTTCAGTG<br>CAGTGGATCTGGGACAGATTCACTCTCAACA<br>TCAGAAGTCTGCAACCTGAAGATTTTGCAACT<br>TACTACTGTCAACAGAGTTACAGTACTCCCTT<br>ATTCACTTTCGGCCCTGGGACCAAAGTGGATA<br>TCAAA<br>SEQ ID NO: 24843 | GAGGTGCAGCTGTTGGAGTCTGGGGGAGGCTTG<br>GTACAGCCTGGGGGGTCCCTGAGACTCTCCTGTG<br>CAGCCCTCTGAATTCACCTTTAGCAGCTATGCCAT<br>GAGCTGGGTCCGCCAGGCTCCAGGGAAGGGGCT<br>GGAGTGGGTCTCAGTTATTAGTGGTCGTGTGTT<br>AACACATTCTACGCAGACTCCGTGAAGGGCCGGT<br>TCACCATCTCCAGAGACAATTCCAAGAACACGCT<br>GTATCTGCAAATGAACAGCTGAGAGCCGAGGA<br>CACGGCCGTATATTACTGTGCGTCCCGTATAGCA<br>GTGGCTGGCTCGGAGGCTTTTGATATCTGGGGCC<br>AAGGGACAATGGTCACCGTCTCTTCA<br>SEQ ID NO: 28849 |
| | | AA | DIQMTQSPSSPSASVGDRVTITFRASQNIISYLNW<br>YQQKPGKARKLVIYGASSLQSGVPSRFSGSGSGT<br>DFTLNIRSLQPEDFATYYCQQSYSTPLFTFGPGTK<br>VDIK<br>SEQ ID NO: 24844 | EVQLLESGGGLVQPGGSLRLSCAASEFTFSSYAMS<br>WVRQAPGKGLEWVSVISGRGVNTFYADSVKGRFTI<br>SRDNSKNTLYLQMNSLRAEDTAVYYCASRIAVAGS<br>EAFDIWGQGTMVTVSS<br>SEQ ID NO: 28850 |
| iPS:393864 | 21-225_4C5 | NA | GACATCCAGATGACCCAGTCTCCATCCTCCCT<br>GTCTGCATCTGTAGGACACAGAGTCCACCTCA<br>CTTGCCGGGCAAGTCGGGGCATCAGAGGTGAT<br>TTAGGTTGGTATCGCCAGAAACCAGGGAAAGC<br>CCCTAAGCGCTTGATCTATGCTGCATCCAATTT<br>GCAAAGTGGGGTCCCATCAAGGTTCAGCGGCA<br>GTGGATATGGGACAGAATTCACTCTCACAATC<br>GGCAGCCTGCAGCCTGAAGATTATGTTACCCT<br>TTACTGTCTACAGCATTATAGTTACCCTCCGGAC<br>GTTCGGCCAAGGGACCAAGGTGGAAATCAAA<br>SEQ ID NO: 24845 | CAGGTGCAACTGGTGGAGTCTGGGGGAGGCGTG<br>GTCCAGCCTGGGAGGTCCCTGAGACTCTCCTGTG<br>CAGCGTCTGGATTCACCTTCAGTAGCTATGTCCT<br>GCACTGGGTCCGCCAGGCTCCAGGCAAGGGCT<br>GGAGTGGGTGGCAGTTATATGTATGATGGAAGT<br>AATAAATACTATGCAGACTCCGTGAAGGGCCGA<br>TTCACCATCTCCAGAGACAATTCCAAGAACACGC<br>TATATCTGCAAATGAACAGCTGAGAGCCGAGG<br>ACACGGCTGTTTATTACTGTGCGGAGAAAAGTA<br>TACCAGCAGCTGTACGACTACGGTATGGACGTC<br>TGGGGCCAAGGGACCACGGTCACCGTCTCCTCA<br>SEQ ID NO: 28851 |

FIGURE 50
(Continued)

| | | | | |
|---|---|---|---|---|
| iPS:393866 | 21-225_14E3 | AA | DIQMTQSPSSLSASVGHRVHLTCRASRGIRGDLG WYRQKPGKAPKRLIYAASNLQSGVPSRFSGSGY GTEFTLTIGSLQPEDFATYYCLQHYSYPRTFPGQG TKVEIK<br>SEQ ID NO: 24846 | QVQLVESGGGVVQPGRSLRLSCAASGFTFSSYVLH WVRQAPGKGLEWVAVIWYDGSNKYYADSVKGRF TISRDNSKNTLYLQMNSLRAEDTAVYYCAREKYTS SWYDYGMDVWGQGTTVTVSS<br>SEQ ID NO: 28852 |
| | | NA | GACATCCAGATGACCCAGTCTCCATCCTCCT GTCTGCATCTGTAGGAGACAGAGTCCACCATCA CTTGCCGGGCAAGTCAGGGCATTAGAAATGAT TTAGGCTGGTATCAACAAAAACCAGGGAAAG CCCCTAAGCGCATTATTTATTCTGCATCCAGTT TGCAAAGTGGGGTCCCATCAAGGTTCATCGGC AGTGGATGTGGGACTGAATTCACTCTCACAAT CAGCAGCCTGCAGCCTGAAGATTTTGCAGCTT ATTACAGTGTACAGCATTATAGTTACCCGTTC ACTTTCGGCGGAGGGACCAAGGTGGAGATCA AA<br>SEQ ID NO: 24847 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTTGGCAT GCACTGGGTCCGCCAGGCTCCAGGCAAGGGCT GGAGTGGGTGGCAGTTATTTGGTATGAAGGGCGAT AATCAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTTTTTATTACTGTGCGAGAGAGAGCTGGGG TTCCGGTCTGACTACTGGGGCCAGGGAACCCTGG TCACCGTCTCCTCA<br>SEQ ID NO: 28853 |
| | | AA | DIQMTQSPSSLSASVGDRVTITCRASQGIRNDLG WYQQKPGKAPKRIIYSASSLQSGVPSRFIGSGCG TEFTLTISSLQREDFAAYYSVQHYSYPFTFGGGT KVEIK<br>SEQ ID NO: 24848 | QVQLVESGGGVVQPGRSLRLSCAASGFTFSDFGMH WVRQAPGKGLEWVAVIWYEENNQYYADSVKGRF TISRDNSKNTLYLQMNSLRAEDTAFYYCARELGFR SDYWGQGTLVTVSS<br>SEQ ID NO: 28854 |

FIGURE 50
(Continued)

| | | | |
|---|---|---|---|
| iPS:393868 | 21-225_9C11 | NA | GACATCCAGATGACCCAGTCTCCATCTCCCTGTCTGCATCTGTAGGAGACAGAGTCACCATCACTTGCCGGGCAAGTCAGAACATTAGAAATTATTAAATTGGTATCAGCAGAAATCAGGGAGAGCCCCTAAGCTCCTGATCTATGTTGCATCCAGTTTGCAAAGTGGGGTCCCATCAAGGTTCAGTGGCAGTGGATCTGGGACAGAATTCACTCTCACCATCAACAGTCTGCAACCTGAAGATTTTGCAATTTATCACTGTCATCAGAGTAACAGTACTCCTCTCACGTTCGGCCAAGGGACCAAGGTGGAAATCAAA | CAGGTGCAGCTGGTGGAGTCTGGGGGAGGCGTGGTCCAGCCTGGGAGGTCCCTGAGACTCTCCTGTGCAGCGTCTCTGGATTCACCTTCAGTAGCTATGGCATGCACTGGGTCCGCCAGGCTCCAGGCAAGGGCTGGAGTGGGTGGCAGTTATATGGCATGATGAAACTAATAAATACTATGCAGATTCCGTGAAGGGCCGATTCACCATCTCCAGAGACAATTCCAAGAACACGCTGTCTCTGCAAATGAACAGCCTGAGAGCCGAGGACACGGCTGTGTATTACTGTGCGAGAGACGAGAGGCTGGGGATTTTGACTACTGGGGCCAGGGAACCCTGGTCACCGTCTCCTCA |
| | | | SEQ ID NO: 24849 | SEQ ID NO: 28855 |
| | | AA | DIQMTQSPSSLSASVGDRVTITCRASQNIRNYLNWYQQKSGRAPKLLIYVASSLQSGVPSRFSGSGSGTEFTLTINSLQPEDFAIYHCHQSNSTPLTFGQGTKVEIK | QVQLVESGGGVVQPGRSLRLSCAASGFTFSSYGMHWVRQAPGKGLEWVAVIWHDETNKYYADSVKGRFTISRDNSKNTLSLQMNSLRAEDTAVYYCARDERLGIFDYWGQGTLVTVSS |
| | | | SEQ ID NO: 24850 | SEQ ID NO: 28856 |
| iPS:393870 | 21-225_7B1 | NA | GATATCCAGATGACCCAGGCTCCATCCTCACTGTCTGCTTCTGTAGGAGACAGAGTCACCATCACTTGTCGGGCGAGTCAGGACAGATTAGCAATCATTTAGTCTGGTTTCAGCAGAAACCAGGGAAAGCCCCTAAGCTCCTGATCTTTGCTGCATCCAGTTTACAAAAGTGGGGTCCCATCACAGTTCAGCGGCAGTGGATCTGGAACAGATTTCACTCTCACCATCAGCAATCTGCAGCCTGAGGATTTTGCAACTTATTACTGCCACCAGTATAATAGTTACCCCTTCACTTTCGGCCCTGGGACCAAAGTGGATTTCAAA | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGACATGAGCTGGGTCCGCCAGGCTCCAGGAAAGGGGCTGGAGTGGGTCTCAACTATTAGTGGTAGTGGTGGTATCACATACTACGCAGACTCCGTGAAGGGCCGGTTCACCATCTCCAGAGACAATGAACAGCCTGAGAGCCGAGGACACGGCCGTATATTTCTGTGCGAGAGATCGGGGCAGCGGTCTGGGGCCAGGGAACCCTGGTCACCGTCTCCTCA |
| | | | SEQ ID NO: 24851 | SEQ ID NO: 28857 |

FIGURE 50
(Continued)

| | | | | |
|---|---|---|---|---|
| iPS:393872 | 21-225_2A11 | AA | DIQMTQAPSSLSASVGDRVTITCRASQDISNHLV WFQQKPGKAPKSLIFAASSLQSGVPSQFSGSGSG TDFTLTISILQPEDFATYYCHQYNSYPFTFGPGTK VDFK<br>SEQ ID NO: 24852 | EVQLLESGGGLVQPGGSLRLSCAASGFTFSSYDMS WVRQAPGKGLEWVSTISGSGGITYADSVKGRFTI SRDNSKKTLYLQMNSLRAEDTAVYFCARDRGSVW GQGTLVTVSS<br>SEQ ID NO: 28858 |
| | | NA | GACATCCAGATGACCCAGTCTCCATCCTCCCT GTCTCCATCTGTAGGAGACAGAGTCACCATCA CTTGCCGGGCAAGTCAGGGCATTAGAAATGAT TTAGGCTGGTATCAGCAGAAACCAGGGAAAG CCCCTCAGCGCCTGATCTCTGCTGCATCCAGTT TGCAAAGTGGGGTCCCATCAAGGTTCAGCGGC AGTGGATCTGGGACAGATTTCACTCTCACAAT CAGCAGTTTGCAGCCTGCAGCATATAGTTACC GCTC ATTACTGTCTACAGCATATAATAGTTACCGCTC ACTTTCGGCGGAGGGACCAAGATGGAGATCA AA<br>SEQ ID NO: 24853 | CAGCTGCAGCTGCAGGAGTCGGGCCCAGGACTG GTGAAGCCTTCGGAGACCCTGTCCCTCACCTGCA CTGTCTCTGGTGGCTCCATCAGTAGGAGTAGTTA CTACTGGGGCTGGATCCGGCAGCCCCCAGGGAA GGGGCTGGAGTGGATTGGGAATATCTATTATAGT GGGAGCACCTACTACAACCGTCCGTCCAAGAGTC GAGTCACCATATCGTAGACACGTCCAAGAACC AGTTCTCCCTGAAGCTGAGTACTGTGCGAGACATGA AGACACGGCTGTGTATTACTGTGCGAGACATGA AAAGACTGGGGCCTTGAAGACTGGGCCAGGGA ACCCTGGTCACCGTCTCCTCA<br>SEQ ID NO: 28859 |
| | | AA | DIQMTQSPSSLSPSVGDRVTITCRASQGIRNDLG WYQQKPGKAPQRLISAASSLQSGVPSRFSGSGSG TDFTLTISSLQPEDFATYYCLQHNSYPLTFGGGT KMEIK<br>SEQ ID NO: 24854 | QLQLQESGPGLVKPSETLSLTCTVSGGSISRSSYYW GWIRQPPGKGLEWIGNIYYSGSTYYNPSVKSRVTIS VDTSKNQFSLKLSTVTAADTAVYYCARHGKDWGL EDWGQGTLVTVSS<br>SEQ ID NO: 28860 |

FIGURE 50
(Continued)

| | | | |
|---|---|---|---|
| iPS:393874 | 21-225_4C8 | NA | GACATCCAGATGATCCAGTCTCCATCCTTCCT GTTTGCATGTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATATATGCTGCATCCAGT TTGCAAAGTGGGGTCCCATCAAGGTTCAGCGG CAGTGTATCTGGGACAGAATTCACTCTCACAA TCAGCAGCCTGCAGCCTGAAGATTTGCAACT TATTACTGTCTACAGCATAATAGTTACCCGCTC ACTTTCGGCGGAGGGACCAAGGTGGAGATCA AA<br>SEQ ID NO: 24855 | CAGGTGCAGCTGGTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATTTGGTATGAAGAAAAT AATCAATACTATGCAGACTCCGTGAAGGGCCGAT TCACCATCTCCAGAGACAATTCCAAGAACACGCT GTATCTGCAAATGAACAGCCTGACAGCCGAGGA CACGGCTGTTTATTACAGTCCGAGAGAAATGGGG TTCCTGTCGACTACTGGGGCCAGGGAACCCTGG TCACCGTCTCCTCA<br>SEQ ID NO: 28861 |
| | | AA | DIQMIQSPSFLFACVGDRVTITCRASQGIRNDLG WYQQKPGKAPKRLIYAASSLQSGVPSRFSGSVS GTEFTLTISSLQPEDFATYYCLQHNSYPLTFGGG TKVEIK<br>SEQ ID NO: 24856 | QVQLVESGGGVVQPGRSLRLSCAASGFTFSNYGM HWVRQAPGKGLEWVAVIWYEENNQYYADSVKGR FTISRDNSKNTLYLQMNSLTAEDTAVYYSPREMGF LSDYWGQGTLVTVSS<br>SEQ ID NO: 28862 |
| iPS:393876 | 21-225_9A1 | NA | GACATCCAGATGACCCAGTCTCCATCTCCCG GTCTCATTTGTTGGAGACAGAGTCACCATCA CTTGCCGGGCAAGTCAGGGACATTAGAAATGAT TTAGGGTGGTATCAGCAGAAACCAGGGAAAG CCCGTAAGCGCCTGATCTATACTGCATCCAGT TTGCAAAGTGGGGTCCCATCAAGGTTCAGCGC CAGTGGATATGGGGACTGAATTCACTATCACAA TCAGCAGCTTGCAGCCTGAAGATTTTGCAACT TATTACTGTCTATACAGCATATAGTTACCCTGTG GACGTTCGGCCAAGGGACCAAGGTGGAAATC AAA<br>SEQ ID NO: 24857 | CAGGTGCAGGTGGTGCAGGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTTTGATGGAAGT AATAAATACTATCCAGAGACAATTCCAAGAACACGC TTCACCATCTCCAAATGAACAGTCTGAGAGCCGAGG TGTATCTGCAAATGAACAGCTGTGCGAGAGATCTTGG ACACGGCTGTGTATTACTGTGCGAGAGATCTTGG CTGGACGGAAGAGTACTGGGGCCAGGGAACCCC GGTCACCGTCTCCTCA<br>SEQ ID NO: 28863 |

FIGURE 50
(Continued)

| | | | | |
|---|---|---|---|---|
| | | AA | DIQMTQSPSSLSASVGDRVTITCRASQGIRNDLG WYQQKPGKARKRLIYTASSLQSGVPSRFSGSGY GTEFTLTISSLQPEDFATYYCIQHNSYLWTFGQGT KVEIK<br>SEQ ID NO: 24858 | QVQVVESGGGVVQPGRSLRLSCAASGFTFSDYGM HWVRQAPGKGLEWVAVIWFDGSNKYYADSVKGR FTISRDNSKNTLYLQMNSLRAEDTAVYYCARDLG WTEEYWGQGTPVTVSS<br>SEQ ID NO: 28864 |
| iPS:393878 | 21-225_7G12 | NA | GACATCCAGATGACCCAGTCTCCATCCTCCCT GTCTGCATCTGTAGGAGACAGAGTCTCCATCA CTTGCCGGGCAAGTCAGATCAGAATATTAACAACTAT TTAAATTGGTATCAGCAGAAACCAGGAAAG GCCCTAAGGTCCTGATCCTTACTGCATCCAGTT TGCAAAGTGGGGTCCCATCAAGGTTCAGTGGC AGTGGATCTGGGACAGATTTCACTCTCACCAT CAACAGTCTGCAACCTGAAGATTTTGCAACTT ACTACTGTCAACAGAGTTACACTACCCCCACG TGGACGTTCGGCCAAGGGACCAAGGTGGAAA TCAAA<br>SEQ ID NO: 24859 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGGAAGGGGCT GGAGTGGGTCTCAGTTATTAGTGGTAGTGGTGGT AGCACATACTACGCAGACTCCGTGAAGGGCCGG TTCACCATCTCCAGAGACAATTCCAAGAACACGC TGTATTTGCAAATGAACACCCTGAGAGCCGAGG ACACGGCCGTATATTACTGTGCGAAAAGTATAC CAGTGACTGGCATGATGCTTTTGATATCTGGGGC CAAGGGACAATGGTCACCGTCTCTTCA<br>SEQ ID NO: 28865 |
| | | AA | DIQMTQSPSSLSASVGDRVSITCRASQNINNYLN WYQQKPGKPGKVLILTASSLQSGVPSRFSGSGSG TDFTLTINSLQPEDFATYYCQQSYTTPTWTFGQG TKVEIK<br>SEQ ID NO: 24860 | EVQLLESGGGLVQPGGSLRLSCAASGFTFSSYAMN WVRQAPGKGLEWVSVISGSGSTYYADSVKGRFTI SRDNSKNTLYLQMNTLRAEDTAVYYCAKRYTSDW HDAFDIWGQGTMVTVSS<br>SEQ ID NO: 28866 |

FIGURE 50
(Continued)

| | | | |
|---|---|---|---|
| iPS:393880 | 21-225_15A1 | NA | GACATCCAGATGACCCAGTCTCCATCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCAGT TTACAAAGTGGGGTCCCATCAAGGTTCAGCGG CAGTGGTTCTGGGACAGATTCACTCTCACAG TCAGCAGCCTGCAGCCTGAAGATTTTGCAAGT TATTACTGTCTACACAACAGTAGTTACCCTGTT AAGTTTGGGGGAGGGATAAAGGTGGAGATCA CA<br><br>SEQ ID NO: 24861 | CAGCTGCATCTGCAGGAGTCGGGCCAGGACTG GTGAAGCCTTCGGAGACCCTGTCCCTCACCTGCA CTGTCTCTGGTGGCTCCATCAGCAGAAGTAGTTA CTACTGGGGCTGGATCCGCCAGCCCCCAGGGAA GGGGCTGGAGTGGATTGGGAGTATCTATTATAGT GGGAGCGCCCAGTACAACCCGTCCTCAAGAGT CGAGTCACCATATCCGTAGACACGACCAAGAAC CAGTTCTCCCTGACGCTGAGCTCTGTGACCGCG CAGACACGGCTGTATATTACTGTGCGAGACTGAG CAGCAGCTGGTCTTTTGACTACTGGGGCCAGGGA ACCCTGGTCACCGTCCTCA<br><br>SEQ ID NO: 28867 |
| | | AA | DIQMTQSPSSLSASVGDRVTITCRASQGIRNDLG WYQQKPGKAPKRLIYAASSLQSGVPSRFSGSGS GTEFFLTVSSLQPEDFASYYCLHNSSYPVKFGGG IKVEIT<br><br>SEQ ID NO: 24862 | QLHLQESGPGLVKPSETLSLTCTVSGGSISRSSYYW GWIRQPPGKGLEWIGSIYYSGSAQYNPSLKSRVTIS VDTTKNQFSLTLSSVTAADTAVYYCARLSSSWSFD YWGQGTLVTVSS<br><br>SEQ ID NO: 28868 |
| iPS:393882 | 21-225_15E3 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCAGT TCGCAAAGTGGTGTCCCATCAAGGTTCAGCGG CAGTCGATCTGGGACAGATTCACTCTCACAA TCAGCAGCCTGCAGCCTGAAGATCTTGCAGT TATTACTGTCTACAGCATCATATTACCCGTC ACTTTCGGCGGAGGGACCGAGGTGGAGATCTA C<br><br>SEQ ID NO: 24863 | CAGGTGCAGTTGGTGGAGTCTGGGGGAACCGTG GTCCAGCCTGGGAGGTCCCTGAGACTCTCCTGTG CAGCCGTCTGGATTCACCTTCAGTAGCTATGGCAT GCACTGGGTCCGCCAGGCTCCAGGCAAGGGGCT GGAGTGGGTGGCAGTTATATGGTATGAGGAAAA TAATAAACACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGAGAGTGG GGTTCCTCTGACTACTGGGGCCAGGGAACCCT GGTCACCGTCTCCTCA<br><br>SEQ ID NO: 28869 |

FIGURE 50
(Continued)

| | | | | |
|---|---|---|---|---|
| iPS:393884 | 21-225_16F4 | AA | DIQMTQSPSSLSASVGDRVTITCRASQGIRNDLG WYQQKPGKAPKRLIYAASSSQSGVPSRFSGSRSG TEFTLTISSLQPEDLAAYYCLQHHSYPLTFGGGT EVEIY<br>SEQ ID NO: 24864 | QVQLVESGGTVVQPGRSLRLSCAASGFTFSSYGMH WVRQAPGKGLEWVAVIWYEENKHYADSVKGRF TISRDNSKNTLYLQMNSLRAEDTAVYYCARELGFL SDYWGQGTLVTVSS<br>SEQ ID NO: 28870 |
| | | NA | GACATCCAGATGATCCAGTCTCCATCCTCCC GTCTGCATCTGTAGGAGACAGAGTCACCATCA CTTGCCGGGCAAGTCAGGGCATTAGAAATGAT TTAGGCTGGTATCAGCAGAAATCAGGGAAAG CCCCTAAGCGCCTGATATATGTTGCATCCAGT TTGCAAAGTGGGGTCCCATCAAGGTTCAGCGG CAGTGGATCTGGGACAGATCGAATTCACTATCACAA TCAGCAGCGTGCAGCCTGAAGATTTTGCAACT TATTACTGTATACAGCATATAATAGTTATCCGTTC ACTTTCGGCGGAGGGACCAAGGTGGAGATCA AA<br>SEQ ID NO: 24865 | CAGGTGCAGTTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGCT GGAGTGGGTGGCAGTTATATGGTATGAAGGAAG TAATCAATACTATGGAGACTCCGTGAAGGGCCG ATTCACCATCTCCAGAGACAATCCAAGAACACG GTGTATCTGCAAATGCACAGCCTGAGAGCCGAG GACACGGCTGTGTATTACTGTGCGAGAGAGCTGG GGTTCCTCTGACTACTGGGGCCAGGGAACCCT GGTCACCGTCTCCTCA<br>SEQ ID NO: 28871 |
| | | AA | DIQMIQSPSSPSASVGDRVTITCRASQGIRNDLG WYQQKSGKAPKRLIYVASSLQSGVPSRFSGSGS GTEFTITISSVQPEDFATYYCIQHNSYPFTFGGGT KVEIK<br>SEQ ID NO: 24866 | QVQLVESGGGVVQPGRSLRLSCAASGFTFSNYGM HWVRQAPGKGLEWVAVIWYEGSNQYYGDSVKGR FTISRDNSKNTVYLQMHSLRAEDTAVYYCARELGF LSDYWGQGTLVTVSS<br>SEQ ID NO: 28872 |

FIGURE 50
(Continued)

| | | | |
|---|---|---|---|
| iPS:393886 | 21-225_2G9 | NA | GACATCCAGATGACCCAGTCTCCATCCTCCCT GTTTGCATCTGTCGGAGACAGAGTCACCATCA CTTGCCGGGCAAGTCAGGGCATTAGAAATGAT TTAGGTTGGTATCAGCAGAAACCAGGGAAAG CCCCCTAAGCGCCTGATCTATGCTGCATCCAGTT TGCAAAGTGGAGTCCCATCAAGGTTCAGCGGC AGTGGATTTGGGACAGAATTCACTCTCACAAT CAGCAGCCTGCAGCTTGAAGATTTTGCAACTT ATTACTGTTTACAGCATGATGAAAGTTACCCTCTC ACTTTCGGCGGAGGGACCAAGGTGGAAATCA AA | CAACTGCAGCTGCAGGAGTCGGGCCCAGGACTG GTGAAGCCTTCGGAGACCCTGTCCCTCACCTGCA CTGTCTCTGGTGGCTCCATCAGACCTAATTACTA CTGGGGCTGGATCCGCCAGCCCCAGGGAAGGG GCTGGAGTGGATTGGTAGTATCTATTATAGTGGA AGCACCTCCTACAACCCGTCCCTCAACAGTGAG TCACCATATCCGTGGACACGTCCAAGAACCAGTT CTCCCTGAAGCTGAACTCTGTGACCGCCGCAGAC ACGGCTGTGTATTACTGTGCGAGACTAAGCAGCA ACTGGGACTTTGACAACTGGGGCCAGGGAACCC TGGTCACCGTCTCCTCA |
| | | | SEQ ID NO: 24867 | SEQ ID NO: 28873 |
| | | AA | DIQMTQSPSSLSASVGDRVTITCRASQGIRNDLG WYQQKPGKAPQRLIYAASSLQSGVPSRFSGSGSF GTEFTLTISSLQLEDFATYYCLQHESYPLTFGGGT KVEIK | QLQLQESGPGLVKPSETLSLTCTVSGGSIRPNYYWG WIRQPPGKGLEWIGSIYYSGSTSYNPSLNSRVTISVD TSKNQFSLKLNSVTAADTAVYYCARLSSNWDFDN WGQGTLVTVSS |
| | | | SEQ ID NO: 24868 | SEQ ID NO: 28874 |
| iPS:393888 | 21-225_3E3 | NA | GACATCCAGATGACCCAGTCTCCATCCTCCCC GTCTGCATCTGTAGGAGACAGAGTCACCATCA CTTTCCGGGCAAGTCAGAGCATTAGAAGTTAT TTAAATTGGTATCAGCAGAAACCAGGGAAAG CCCATAAACTCGTGATCTATGGTACATCCAGT TTGCAAAGTGGGGTCCCATCAAGGTTCAGTGG CAGTGGATCTGGGACAGACTTCACTCTCACCA TCAGCAGTCTGCAACTGAAGATTTTGCAACT TACTACTGTCAACAGAGTTACAGTACCCCCTT GTTCACTTTCGGCCCTGGGACCAAAGTGGATA TCAAA | GAGGTGCAGCTGTTGGAGTCTGGGGGAACCTTGG TACAGCCTGGGGGGTCCCTGAGACTCTCCTGTGC AGCCTCTGAATTCACCTTTAGCAGCTATGTCATG AGCTGGGTCCGCCAGGCTCCAGGGAAGGGGCTG GAGTGGGTCTCAATTATTAGTGGTCGTGGTGTA ACACATTCTACGCAGACTCCGTGAAGGGCCGGTT CACCATCTCCAGAGACAATTCCAAGAACACGCTG TATCTGCAAATGAACAGCCTGAGAGCCGAGGAC ACGGCCTTATATTACTGTGCGTCCGTTTAGCAG TGGGCTGCGGAGGCTTTGATATCTGGGGCCA AGGGACAATGGTCACCGTCTCTTCA |
| | | | SEQ ID NO: 24869 | SEQ ID NO: 28875 |

FIGURE 50
(Continued)

| | | | | |
|---|---|---|---|---|
| iPS:393890 | 21-225_4B1 | AA | DIQMTQSPSPSASVGDRVTITFRASQSIRSYLNW YQQKPGKAHKLVIYGTSSLQSGVPSRFSGSGSGT DFTLTISSLQPEDFATYYCQQSYSTPLFTFGPGTK VDIK<br>SEQ ID NO: 24870 | EVQLLESGGTLVQPGGSLRLSCAASEFTFSSYVMS WVRQAPGKGLEWVSIISGRGGNTFYADSVKGRFTI SRDNSKNTLYLQMNSLRAEDTALYYCASRLAVAG SEAFDIWGQGTMVTVSS<br>SEQ ID NO: 28876 |
| | | NA | GACATCCAGATGACCCAGTCTCCATCTCCCT GTCTGCATCTGTAGGCGACAGAGTCACCATCA CTTGCCGGGCAAGTCATACCATTAGAACCTAT TTAAACTGGTATCAGCAGAAACCAGGGAAAG CCCCTAAGCTCCTGATCTATGCTGCATCCAGTT TGCAAAGTGGGGTCCCATCAAGGATCAATGGC AGTGGATCTGGGACAGATTTCACTCTCACCAT CACCAATCTACAGCCTGAAGATTTTGCAACTT ACTACTGTCAACAGAGTTACAATATCTCATTC ACTTTCGGCCCTGGGACCAAAGTGGATATCAA A<br>SEQ ID NO: 24871 | CAGGTGCAGCTGCAGGAGTCGGGCCCAGGACTG GTGAAGCCTTCGGAGACCCTGTCCCTCACCTGTA GTGTCTCTGGTGACTCCATCAGTAGTTACTCCTG GAGCTGGATCCGGCAGCCCGCCGGGAAGGGACT GGAATGATTGGGCGTATCTATACCAGTGGAGC ACCAACTACAACTACCCCTCCAAGAGTCGAATCA CCATGTCAGTAGACACGTCCAAGAAGCAGTTCTC CCTGAAGCTGAGCTCTGTGACCGCCGCGGACACG GCCGTGTATTACTGTGCGAGAGATTTGAAGAGCA GTGGCTGCCTTTTCTTTGACTACTGGGGCCAGGG AACCCTGGTCACCGTCTCCTCA<br>SEQ ID NO: 28877 |
| | | AA | DIQMTQSPSSLSASVGDRVTITCRASHTIRTYLN WYQQKPGKAPKLLIYAASSLQSGVPSRINGSGSG TDFTLTITNLQPEDFATYYCQQSYNISFTFGPGTK VDIK<br>SEQ ID NO: 24872 | QVQLQESGPGLVKPSETLSLTCSVSGDSISSYSWSW IRQPAGKGLEWIGRIYTSGSTNYIPSLKSRITMSVDT SKKQFSLKLSSVTAADTAVYYCARDLKSSGCLFFD YWGQGTLVTVSS<br>SEQ ID NO: 28878 |

FIGURE 50
(Continued)

| | | | |
|---|---|---|---|
| iPS:393892 | 21-225_6G7 | NA | GACATCCAGATGACCCAGTCTCCATCCTCCG GTCTGCATCTGTAGGAGACAGAGTCACCATCA CTTGCCAGGCGAGTCAGGACATTAGCAACTAT TTAAATTGGTGTCAACAGAAACCAGGGAAAG CCCTTAAGCTCTTGATATACGATGCATCCACTT TGGAAACAGGGGTCCCCTCAAGGTTCAGTGGA AGTGGATCTGGGACAGATTTTACTTTCACCAT CAGCAGCCTGCAGCCTGAAGATATTGCAACAT ATTACTGCCAACAGTATGATAATGTCCGATC ACCTTCGGCCAAGGGACACGACTGGAGATTAA A<br>SEQ ID NO: 24873 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGACTCCAGGCAAGGGCT GGAGTGGGTGGCAATTATATGCAGATCCGTGAAAG AATAAATATTATGCAGATCCGTGAAGGCCGAT TCACCATCTCCAGAGACAATTCAAGAACACGCT GTATCTGCAAATGAACAGCCTGAGAGCTGAGGA CACGGCTGTGTATTACTGTGCGAGACGGGGAAA CAGTATGCGGGTACGGTATGGACGTCTGGGG CCAAGGGACTACGGTCACCGTCCTCA<br>SEQ ID NO: 28879 |
| | | AA | DIQMTQSPSSRSASVGDRVTITCQASQDISNYLN WCQQKPGKALKLLIYDASTLETGVPSRFSGSGS GTDFFTFTISSVQPEDIATYYCQQYDNVPITFGQGT RLEIK<br>SEQ ID NO: 24874 | QVQLVESGGGVVQPGRSLRLSCAASGFTFSSYGMH WVRQTPGKGLEWVAIISYVGKNKYADSVKGRFTI SRDNSKNTLYLQMNSLRAEDTAVYYCARRGNSYG GYGMDVWGQGTTVTVSS<br>SEQ ID NO: 28880 |
| iPS:393894 | 21-225_5E11 | NA | GTCATCCAGATGACCCAGTCTCCATCCTCACT GTCTGCCTCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCAATGCTGCATCCAGTG TGCAGAGTGGGGTCCCATCAAAATTCAGCGGC AATGGATCTGGGACAGATTCACTCTCACCAT CAGCAGCCTGCAGCCTGAAGATTTTGCAACTT ATTACTGCCACCAGTATCACAGTTACCCATTC ACTTTCGGCCCTGGGACCAAAGTGGATATCAA A<br>SEQ ID NO: 24875 | GAGGTGCAGCTGGTGGAGTCTGGGGGAGGCCTG GTCAAGCCTGGGGGGTCCCTGAGACTCTCCTGTG CAGCCTCTGGATTCACCTTCACTTCAGTAGCAT GAACTGGGTCCGCCAGGCTCCAGGGAAGGGCT GGAGTGGGTCATCCATTAGTGGTAGTAGTACT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTTTTACTGTGCGAGAGTGGCTTCA TTTGACTACTGGGGCCAGGGAACCCTGGTCACCG TCTCCTCA<br>SEQ ID NO: 28881 |

FIGURE 50
(Continued)

| | | AA | VIQMTQSPSSLSASVGDRVTITCRASQGISNYLA WFQQKPGKAPKSLINAASSVQSGVPSKFSGNGS GTDFTLTISSLQPEDFATYYCHQYHSYPFTFGPG TKVDIK | EVQLVESGGGLVKPGGSLRLSCAASGFTFSSYSMN WVRQAPGKGLEWVSSISGSSTYYYADSVKGRFTIS RDNAKNSLYLQMNSLRAEDTAVFYCARVASFDYW GQGTLVTVSS |
| --- | --- | --- | --- | --- |
| | | | SEQ ID NO: 24876 | SEQ ID NO: 28882 |
| iPS:393896 | 21-225_2A4 | NA | GACATCCAGATGACCCAGTCTCCATCCTCACT GTTTGCATCTGTAGGAGACAGAGTCACCATCA CTTGTCGGGCGAGTCAGGGATCAGGCATTAGCAATTAT TTAGCCTGGTTTCAGCAGAAACCAGGAAAGC CCCTAAGCGCCTGATCTATACTGCATCCAGTTT GCAAAGTGGGGTCCCATCAAAGTTCAGCGGCA GTGGATTTGGGACAGATTTCACTCTCACCATC AGCAGCCTGCAGCTGAAGATTTTACCAACTTA TTACTGCCAACAGTATATAAGTTACCCATTCA CTTTCGGCCCTGGGACCAAAGTGGATATCAAA | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGCT GGAGTGGGTCTCATCCATTAGTGGTAGTAGTACT TACATATACTACGCAGACTCAGTGAAGGGCCGA ATCGCCATCTCCAGAGACAACGCCAAGAACTCG CTGTATCTGCAAATGAACAGCCTGAGAGCCGAG GACACGGCTGTATATTACTGTGCGAGAGTGGCTT CATTTGACTACTGGGGCCAGGGAACCCTGGTCAC CGTCTCCTCA |
| | | | SEQ ID NO: 24877 | SEQ ID NO: 28883 |
| | | AA | DIQMTQSPSSLFASVGDRVTITCRASQGISNYLA WFQQKPGKAPKRLIYTASSLQSGVPSKFSGSGFG TDFTLTISSLQPEDFATYYCQQYNSYPFTFGPGT KVDIK | EVQLVESGGGLVKPGGSLRLSCAASGFTFSSYSMN WVRQAPGKGLEWVSSISGSSTYYYADSVKGRIAIS RDNAKNSLYLQMNSLRAEDTAVYYCARVASFDY WGQGTLVTVSS |
| | | | SEQ ID NO: 24878 | SEQ ID NO: 28884 |

FIGURE 50
(Continued)

| | | | |
|---|---|---|---|
| iPS:393898 | 21-225_5F7 | NA | GACATTCAGATGACCCAGTCTCCATCCTCCCC<br>GTCTGCATCTGTAGGAGACAGAGTCACCATCA<br>CTTTGCCGGCAAGTCAGAGCATTAGTAGTTAT<br>TTAAATTGGTATCAGCAGAAACCAGGAAAG<br>CCCCTAAACTCCTGATCTCTGCTGCATCCAGTT<br>TGCAAAGTGGGGTCCCATCAAGGTTCAGTGGC<br>AGTGGATCTGGGACAGATTTCACTCTCACCAT<br>CAGCAGTCTGCAACCTGAAGATTTTGCAACTT<br>ACTACTGTCAACAGAGTTACAATACCCCCTTA<br>TTCACTTTCGGCCCTGGGACCAAAGTGGTTAT<br>CAAA<br><br>SEQ ID NO: 24879 | GAGGTGCAGTTGTTGGAGTCTGGGGGAGGCTTGG<br>TACAGCCTGGGGGTCCCTGAGACTCTCCTGTGC<br>AGCCTCTGAATTCACCTTTAGCAGTTATGCCATG<br>AGCTGGGTCCGCCAGGCTCCAGGGAAGGGCTG<br>GAGTGGGTCTCAATTATTAGTGGTGTGGTGGTA<br>ACACATTCTACGCAGACTCCGTGAAGGGCCGGTT<br>CACCATCTCCAGAGACAATTCCAAGAACACGCTG<br>TATCTGCAAATGAACAGCCTGAGAGCCGAGGAC<br>ACGGCCGTATATTACTGTGCGTCCGTATAGCAG<br>TGGCTGGCTCGGAGGCTTTTGCTATCTGGGGCCA<br>AGGGACAATGGTCACCGTCTCTTCA<br><br>SEQ ID NO: 28885 |
| | | AA | DIQMTQSPSPSASVGDRVTITFRASQTISSYLNW<br>YQQKPGKAPKLLISAASSLQSGVPSRFSGSGSGT<br>DFTLTISSLQPEDFATYYCQQSYNTPLFTFGPGTK<br>VVIK<br><br>SEQ ID NO: 24880 | EVQLLESGGGLVQPGGSLRLSCAASEFTFSSYAMS<br>WVRQAPGKGLEWVSIISGVGGNTFYADSVKGRFTI<br>SRDNSKNTLYLQMNSLRAEDTAVYYCASRIAVAGS<br>EAFAIWGQGTMVTVSS<br><br>SEQ ID NO: 28886 |
| iPS:393900 | 21-225_10E12 | NA | GACATCCAGATGACCCAGTCTCCATCCTCCT<br>GTCTGCATCTGTAGGAGACAGAGTCACCATCA<br>CTTGCCGGCAAGTCAGAGCATTACAGTTAT<br>TTAAATTGGTATCAGCAGAAACCAGGGAGAG<br>CCCCTAAAGCTCCTGATCTATGCTACATCCAGTT<br>TGCAAAGTGGGGTCCCATCAAGGTTCGGTGGC<br>AGTGGATCTGGGACAGATTTCACTCTCACCAT<br>CAGCAGTCTACAACCTGAAGATTTTGCAACTT<br>ACTACTGTCAACAGAATTACAGTCCCCCTCTC<br>ACTTTCGGCGGAGGGACCAAGGTGGAGATCG<br>AA<br><br>SEQ ID NO: 24881 | CAGGTGCAGCTGGTGGAGTCGGGGGGAGGCGTG<br>GTCCAGCCTGGGAGGTCCCTGAGACTCTCCTGTG<br>CAGCGTCTGGATTCAACTTCAGTAACTATGGCAT<br>GCACTGGGTCCGCCAGGTTCAGGCAAGGGCT<br>GGAGTGGGTGGCAGTTATATGGTATATGGCAAGGAAG<br>TAATAAATACTATGTAGACTCCGTGAAGGGCCGA<br>TTCACCATCTCCAGAGACAATTCAAGAACACGC<br>TGTCTCTGCAAATGAACAGCCTGAGAGCCGAGG<br>ACACGGCTGTGTATTGCTGTGCGAGAGATGAGAG<br>GCTGGGGATTTTTGACTACTGGGGCCAGGGAACC<br>CTGGTCACCGTCTCCTCA<br><br>SEQ ID NO: 28887 |

FIGURE 50
(Continued)

| | | | | |
|---|---|---|---|---|
| | | AA | DIQMTQSPSSLSASVGDRVTITCRASQNIYSYLNWYQEKPGRAPKLLIYATSSLQSGVPSRFGGSGSGTDFTLTISSLQPEDFATYYCQQNYSPPLTFGGGTKVEIE<br>SEQ ID NO: 24882 | QVQLVESGGGVVQPGRSLRLSCAASGFNFSNYGMHWVRQVPGKGLEWVAVIWHDGSNKYYVDSVKGRFTISRDNSKNTLSLQMNSLRAEDTAVYCCARDERLGIFDYWGQGTLVTVSS<br>SEQ ID NO: 28888 |
| iPS:393902 | 21-225_14E10 | NA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGACTATGGCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTCTATCTGCAAATGAACAGCCTGAGAGCTGAGGACACGGCTGTGTATTACTGTGCGAGAGAAGTAAGCAGCAGCTGGTACGACTACGGTATGGACGTCTGGGGCCAAGGGACCACGGTCACCGTCTCCTCA<br>SEQ ID NO: 28889 | |
| | | AA | DIQMTQSPSSLSASVGDRVTITCRTSQGIRNDLGWYQHKPGQAPKRLIYAASSLQSGVPSRFSGSGSGTEFTLTISSLQPEDFTAYYCLQHYSYPRTFGQGTKVEIK<br>SEQ ID NO: 24883 | QVQLVESGGGVVQPGRSLRLSCAASGFTFSDYGMHWVRQAPGKGLEWVAVIWYDGSNKYYADSVKGRFTISRDNSKNTLYLQMNSLRAEDTAVYYCAREKYSSSWYDYGMDVWGQGTTVTSS<br>SEQ ID NO: 28890 |
| | | | SEQ ID NO: 24884 | |

FIGURE 50
(Continued)

| | | | |
|---|---|---|---|
| iPS:393904 | 21-225_8H11 | NA | GACATCCAGATGACCCAGTCTCCATCCTCCCT GTCTGCATTTGTAGGAGACAGAGTCACCATCA CTTGCCGGGCAAGTCAGAACATTATCAGCTAT TTAAATTGGTATCAACAGAAACCAGGGAAAG CCCCTAACCTCAATGATATATGTTACATCCAGTT TGCACAGTGGGGTCCATCAAGGTTCAGTGGC AGTGGATCTGGGACAGATTTCTCTCACCAT CAGCAGTCTCCAACTGAGGATTTTGCAACTT ACTACTGTCAACAGAGTTACAGTACCCCTTC ACTTTCGGCCCTGGGACCAAAGTGGATATCAA A | CAGGTGCAGCTGGTGGAGTCTGGGGGAGGCGTG GTCCAGCCTGGGAGGTCCCTGAGACTCTCCTGTG CAGCGTCTGATTCACCTTCAGTACTACTATAACAT GCACTGGGTCCGCCAGGCTCCAGGCAAGGGGCT GGAGTGGGTGGCAGTTATATGTATGATGGAAGT GATAGATACTCCCGAGACATCCGTGAAGGGCCGAT TCACCATCTCCAGACAATTCAAGAACACGCT GTATCTGCAAATGAACAGCTGAGAGCCGAGGA CACGGCTGTGTATTACTGTGCGAGAGATCGGGCC TATAGCAGCTGTCTGACTCTGTGGGCCAGGGAA CCCTGGTCACCGTCTCCTCA |
| | | | SEQ ID NO: 24885 | SEQ ID NO: 28891 |
| | | AA | DIQMTQSPSSLSAFVGDRVTITCRASQNIISYLNW YQQKPGKAPNLMIYVTSSLHSGVPSRFSGSGSGT DFSLTISSLQPEDFATYYCQQSYSTPFTFGPGTKV DIK | QVQLVESGGGVVQPGRSLRLSCAASGFTFSTYNMH WVRQAPGKGLEWVAVIWYDGSDRYSADSVKGRF TISRDNSKNTLYLQMNSLRAEDTAVYYCARDRAYS SSSDFWGQGTLVTVSS |
| | | | SEQ ID NO: 24886 | SEQ ID NO: 28892 |
| iPS:393906 | 21-225_13D3 | NA | GAAATAGTGATGACGCAGTCTCCAGCCACCCT GTCTGTGTCTCCAGGGAAAGCGCCACCATCT CCTGCAGGGCCAGTCAGACTGTTAGCAGCAAC TTAGCCTGGTTCCAGCAGAAAGCCTGGCCAGGC TCCCAGGCTCCTCATCAATGGTGCATCCACCA GGGCCACTGGTATCCCAGCCAGGTTCAGTGGC AGTGGGTCTGGGACAGAGTTCACTCTCACCAT CAGCAGCCTGCAGTCTGAAGATTTTGCAGTT ATTTCTGTCAGCAGTATCATGACTGGCCTCCG ACGTTCGGCCAAGGGACCAAGGTGGAAATCA AA | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGTATACCAT GAACTGGGTCCGCCAGGCTCCAGGGAAGGGCT GGACTGGGTCTCATCATTAGTGGTAGTAGT TACATATACTACGGCGACTCAGTGAAGGGCCGAT TCACCATCTCCAGAGACAACGCCAAGAACTACT GTATCTGCAAATGAACAGCTGAGAGCCGAGGA CACGGCTGTGTATTACTGTGCGAGAGATCGGGGC AGTGGCTGGGCCAGGGAACCCTGGTCACCGTCT CCTCA |
| | | | SEQ ID NO: 24887 | SEQ ID NO: 28893 |

FIGURE 50
(Continued)

| | | | | |
|---|---|---|---|---|
| iPS:393908 | 21-225_10E9 | AA | EIVMTQSPATLSVSPGESATLSCRASQTVSSNLA WFQQKPGQAPRLLINGASTRATGIPARFSGSGSG TEFTLTISSLQSEDFAVYFCQQYHDWPPTFGQGT KVEIK<br>SEQ ID NO: 24888 | EVQLVESGGGLVKPGGSLRLSCAASGFTFSSYTMN WVRQAPGKGLDWVSSISGSSSYIYADSVKGRFTIS RDNAKNSLYLQMNSLRAEDTAVYYCARDRGSGW GQGTLVTVSS<br>SEQ ID NO: 28894 |
| | | NA | GACATCCAGATGACCCAGTCTCCATCCTCCT GTCTGCATCTGTAGGAGACAGAGTCACCTTCA CTTGCGGGCAAGTCAGGACATTAGAAGTGAT TTAGGCTGGTATCAGCAGAAACCAGGGAAAG CCCCTACGCGCCTGATCTTTGCTGCATCCAGTT TGCAAAGTGGGGTCCCATCAAGGTTCAGCGGC AGTGGATCTGGGACAGACAATTCACTCTCACAAT CAACAGCCTGCAGCCTGAAGATTTTGCAACTT ATTACTGTCTACAGCATTATAGTAGTTACCCTCGG ACGTTCGGCCAAGGGACCAAGGTGGAAATCA AA<br>SEQ ID NO: 24889 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT ACACTGGGTCCGCCAGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAAAAGTA TAGCAGCAGCTGGTACGACTACGGTATGGACGTC TGGGGCCAAGGGACCACGGTCACCGTCTCCTCA<br>SEQ ID NO: 28895 |
| | | AA | DIQMTQSPSSLSASVGDRVTFTCRASQDIRSDLG WYQQKPGKAPTRLIFAASSLQSGVPSRFSGSGSG TEFTLTINSLQPEDFATYYCLQHYSYPRTFGQGT KVEIK<br>SEQ ID NO: 24890 | QVQLVESGGGVVQPGRSLRLSCAASGFTFSNYVIH WVRQAPGKGLEWVAVIWYDGSNKYYADSVKGRF TISRDNSKNTLYLQMNSLRAEDTAVYYCAREKYSS SWYDYGMDVWGQGTTVTVSS<br>SEQ ID NO: 28896 |

FIGURE 50
(Continued)

| | | | |
|---|---|---|---|
| iPS:393910 | 21-225_15F10 | NA | GACATCAGAGATGACCCAGTCTCCATCTCCCT GTCTGCTTCTGTAGGAGACAGAGTCACCATCA CTTGCCAGGCGAATCAGGACATTACCAACTTT TTAAATTGGTATCAGCTGAAACCAGGAAAAGC CCCTAACCTCCTGATCTCCGATGCATCAAGTT GGAAACAGGGGTCCCATCAAGGTTCAGTGA AGTGGATCTGGGACAGATTTTACTTTCACCAT CAGCAGCCTGCAGCTGAAGATGTTGCGACAT ATTACTGTCAACAGTATGATAATCTCCCGATC ACCTTCGGCCAAGGGACACGACTGGAGATTAA A<br>SEQ ID NO: 24891 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGCT GGAGTGGGTGTCAGTTATATCATATGGTGAAGT AATAATTACTATGCAGACTCCGTGAAGGGCCGAT TCACCATCTCCAGAGACAATTCCAAGAACACGCT GTATCTGCAAATGAACAGCCTGAGAGCTGAGGA CACGGCTGTGTATTACTGTGTGAGACGGGATAC AGCTATGGCGGGTACGGTATGGACGTCTGGGGC CAAGGGACCACGGTCACCGTCTCCTCA<br>SEQ ID NO: 28897 |
| | | AA | DIQMTQSPSSLSASVGDRVTITCQANQDITNFLN WYQLKPGKAPNLLISDASNLETGVPSRFSGSGSG TDFTFTISSLQPEDVATYYCQQYDNLPITFGQGT RLEIK<br>SEQ ID NO: 24892 | QVQLVESGGGVVQPGRSLRLSCAASGFTFSSYGMH WVRQAPGKGLEWVSVISYGGSNNYYADSVKGRFT ISRDNSKNTLYLQMNSLRAEDTAVYYCVRRGYSY GGYGMDVWGQGTTVTVSS<br>SEQ ID NO: 28898 |
| iPS:393912 | 21-225_16F6 | NA | GACATCAGAGATGACCCAGTCTCCATCTCCCT GTCTGCTTCTGTAGGAGACAGAGTCACCATCA CTTGCCAGGCGAATCAGGACATTACCAACTTT TTAAATTGGTATCAGCTGAAACCAGGAAAAGC CCCTAACCTCCTGATCTCCGATGCATCAAGTT GGAAACAGGGGTCCCATCAAGGTTCAGTGA AGTGGATCTGGGACAGATTTTACTTTCACCAT CAGCAGCCTGCAGCCTGAAGATGTTGCGACAT ATTACTGTCAACAGTATGATAATCTCCCGATC ACCTTCGGCCAAGGGACACGACTGGAGATTAA A<br>SEQ ID NO: 24893 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACCGGGTCCGCCAGGCTCCAGGCAAGGGGCT GGAGTGGGTGGCAGTTATATGGTATGAGGAAG TAATCAATACTATGGAGACTCCGTGAAGGGCCG ATTCACCATCTCCAGAGACAATTCCAAGAACACG GTGTATCTGCAAATGCAAGCCTGAGAGCCGAG GACACGGCTGTGTATTACTGTGCGAGAGAGTGG GGTTCCTCTGTATTACTGGGGCCAGGGAACCCT GGTCACCGTCTCCTCA<br>SEQ ID NO: 28899 |

FIGURE 50
(Continued)

| | | | | |
|---|---|---|---|---|
| | | AA | DIQMTQSPSSLSASVGDRVTITCQANQDITNFLN WYQLKPGKAPNLLISDASNLETGVPSRFSGSGSG TDFTFTISSLQPEDVATYYCQQYDNLPITFGQGT RLEIK<br>SEQ ID NO: 24894 | QVQLVESGGGVVQPGRSLRLSCAASGFTFSNYGM HRVRQAPGKGLEWVAVIWYEGSNQYYGDSVKGR FTISRDNSKNTVYLQMHSLRAEDTAVYYCARELGF LSDYWGQGTLVTVSS<br>SEQ ID NO: 28900 |
| iPS:393914 | 21-225_16B8 | NA | GACATCCAGATGACCCAGTCTCCATCCTCACT GTCTGCCTCTGTAGGAGACAGAGTCACCATCA CTTGTCGGGCGAGTCAGGGCATTAACAATTAT TTAGCCTGGTTTCAGCAGAAACCAGGGAAAGC CCTTAAGTCCCTGATCAATGCTGCATCCAGTG TGCAGAGTGGGGTCCCATCAAGTTCAGCGGC AGTGGATCTGGGACAGACTTCACTCTCACCAT CAGCAGCCTGCAGCCTGAAGATTTTGCAACTT ATTACTGCCACCAGTATCACAGTTACCATTC ACTTTCGGCCCTGGGACCAAAGTGGATATCGT A<br>SEQ ID NO: 24895 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGATCATCATTAGTGGTAGTAGTACT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGTGGCTTCA TTCGACTACTGGGGCCAGGGAACCCTGGTCACCG TCTCCTCA<br>SEQ ID NO: 28901 |
| | | AA | DIQMTQSPSSLSASVGDRVTITCRASQGINNYLA WFQQKPGKALKSLINAASSVQSGVPSKFSGSGS GTDFTLTISSLQPEDFATYYCHQYHSYPFTFGPG TKVDIV<br>SEQ ID NO: 24896 | EVQLVESGGGLVKPGGSLRLSCAASGFTFSSYSMN WVRQAPGKGLEWISSISGSSTYIYYADSVKGRFTIS RDNAKNSLYLQMNSLRAEDTAVYYCARVASFDY WGQGTLVTVSS<br>SEQ ID NO: 28902 |

FIGURE 50
(Continued)

| | | | | |
|---|---|---|---|---|
| iPS:393916 | 21-225_2G4 | NA | GACATCCAGATGACCCAGTCTCCATCCTCCT GTCTGCTTCTGTAGGCGACAGAGTCACCATCA CTTGCCGGGCAAGTCAGGGCATTAGAAATGAT TTAGGCTGGTATCAGCAGAAACCAGGGAAAG CCCCTACGCGCCTGATCTATCTGTCATCCAGT TGCACAGTGGGGTCCCATCACGGTTCAGCGGC AGTGGATCTGGGACAGAGATCACTCTCACAAT CAGCAGCCTGCAGCCTGAAGATCTTGCAACTT ATTACTGTCTACAACATTATAGTTCCCTCGGA CGTTCGGCCGAGGGACCAAGGTGGAAATCAA A | CAGGTGCAGTTGGTGGAGTCTGGGGGAGGCGTG GTCCAGCCTGGGAGGTCCCTGAGACTCTCCTGT CAGCGTCTGGATTCACCTTCAGTAGCTATGTCAT GCACTGGGTCCGCCAGGCTCCAGGCAAGGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAAGTA TAGCAGCAGCTGGTACGACTACGGTATGGACGTC TGGGGCCACGGGACCACGGTCACCGTCTCCTCA |
| | | | SEQ ID NO: 24897 | SEQ ID NO: 28903 |
| | | AA | DIQMTQSPSSLSASVGDRVTITCRASQGIRNDLG WYQQKPGKAPTRLIYAASSLHSGVPSRFSGSGSG TEFTLTISSLQPEDLATYYCLQHYSFPRTFGRGTK VEIK | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCAREKYSS SWYDYGMDVWGHGTTVTVSS |
| | | | SEQ ID NO: 24898 | SEQ ID NO: 28904 |
| iPS:393920 | 21-225_1H12 | NA | GACATCCAGATGACCCAGTCTCCATCCTCCCT GTCTGCATCTGTTGGAGACAGAGTCACCATCA CTTGCCGGGCAAGTCAGAACATTTACAGGTAT TAAATTGGTATCAGCAGAAACCAGGGAGAG CCCCTAAGCTCCTGATCTATACTGCATCCAGT TACAAAGTGGGGTCCCATCAAGGTTCAGTGGC AGTGACTCTGGGACAGATTCACTCTCACCAT CAGCAGTCTGCAACCTGAAGATTTTGCAACTT ACTACTGTCTCAACAGAGTTACAGTCCCCTCTC ACTTTCGGCGGAGGGACCAAGGTGGAGATCA AA | CAGGTGCAGCTGGTGGAGTCTGGGGGAGGCGTG GTCCAGTCTGGGAGGTCCCTGAGACTCTCCTGTG CAGCGTCTGGATTCAACTTCAGTAGCTATGGCAT GCACTGGGTCCGCCAGGCTCCAGGCAAGGGGCT GGAGTGGGTGGCAATTATATGTAGACTCCGTGAAGGGCCGA TTCACCATCTCCAGAGACAATTCCAAGAACACGC TGTATCTGCAAATGAACAGCCTGAGAGCCGAGG ACACGGCTGTATTACTGTGCGAGAGATGAGAG GCTGGGGATTTTTGACTACTGGGGCCAGGGAACC CTGGTCACCGTCTCCTCA |
| | | | SEQ ID NO: 24899 | SEQ ID NO: 28905 |

FIGURE 50
(Continued)

| | | | | |
|---|---|---|---|---|
| iPS:393922 | 21-225_2B2 | AA | DIQMTQSPSSLSASVGDRVTITCRASQNIYRYLN WYQEKPGRAPKLLIYTASSLQSGVPSRFSGSDSG TDFTLTISSLQPEDFATYYCQQSYSPPLTFGGGTK VEIK SEQ ID NO: 24900 | QVQLVESGGGVVQSGRSLRLSCAASGFNFSSYGMH WVRQAPGKGLEWVAJIWHDGSNKYYVDSVKGRFT ISRDNSKNTLYLQMNSLRAEDTAVYYCARDERLGI FDYWGQGTLVTVSS SEQ ID NO: 28906 |
| | | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGCAAG CCCCTAAGCGCCTGATCTATGCTGCATCCAGT TTACAAAGTGGGGTCCCATCAAGGTTCAGCGG CAGTGGATCTGGGACAGAATTCACTCTCACAA TCAGCAGCCTGCAGCCTGAAGATCTTGCAACT TATCACTGTCTACAGCATATAATAGTTACCCGCT CACTTTCGGCGGAGGGACCAAGGTGGAGATC AAA SEQ ID NO: 24901 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGAGGAAAA TAATAAATACTATGTAGACTCCGTGAAGGGCCGA TTCACCATCTCCAGAGACAATTCCAAGAGCACGC TGTATCTGCAAATGAACAGCCTGAGAGCCGAGG ACACGGCTGTGTATTACTGTGTGAGAGAACTAGG CTTCCAGTCTGACTACTGGGGCCAGGAACCCCG GTCACCGTCTCCTCA SEQ ID NO: 28907 |
| | | AA | DIQMTQSPSSLSASVGDRVTITCRASQGIRNDLG WYQQKPGQAPKRLIYAASSLQSGVPSRFSGSGS GTEFTLTISSLQPEDLATYHCLQHNSYPLTFGGG TKVEIK SEQ ID NO: 24902 | QVQLVESGGGVVQPGRSLRLSCAASGFTFSSYGMH WVRQAPGKGLEWVAVIWYEENNKYYVDSVKGRF TISRDNSKSTLYLQMNSLRAEDTAVYYCVRELGFQ SDYWGQGTPVTVSS SEQ ID NO: 28908 |

FIGURE 50
(Continued)

| | | | | |
|---|---|---|---|---|
| iPS:393926 | 21-225_4G4 | NA | GACATCCAGATGACCCAGTCTCCATCTCCCT GGCTGCATCTGTAGGAGACAGAGTCACCATCA CTTGCCGGGCAAGTCAGACCATTATCAGCTAT TTAAATTGGTATCAGCAGAAACCAGGGAAAG CCCCTAAACTTCTGATCCATACTGCATCCAGTT TGCAAAGTGGGGTCCCATCAAGGTTCAGTGGC AGTGGATCTGGGACAGATTTCACTCTCCAT CAGCAGTCTGCAACCTGAAGATTTTGCAACTT ACTACTGTCAACAGAGTTACAGTACTCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCGTG CAGCGTCCGGATTCACCTTCAGTAGCTATGGCAT GCACTGGGTCCGCCAGGCTCCAGGCAAGGGGCT GGAGTGGGGGGCAGTTATATGCAGTATGGAAG TAATAAATACTATGCAGACTCCGTGAAGGGCCG ATTCACCATCTCCAGAGACAATGCCAAGAACAC GCTGTATCTGCAAATGAACAGCCTGAGAGCCGA GGACACGGCTGTGTATTACTGTGCGAGAGATCTG AGAATGGGCGGTATGGACGTCTGGGGCCAAGGG ACCACGGTCACCGTCTCCTCA |
| | | | SEQ ID NO: 24903 | SEQ ID NO: 28909 |
| | | AA | DIQMTQSPSSLAASVGDRVTITCRASQTIISYLNW YQQKPGKAPKLLIHTASSLQSGVPSRFSGSGSGT DFTLSISSLQPEDFATYYCQQTYSTPLTFGGGTK VEIK | QVQLVESGGGVVQPGRSLRLSCAASGFTFSSYGMH WVRQAPGKGLEWGAVIWHDGSNKYYADSVKGRF TISRDNAKNTLYLQMNSLRAEDTAVYYCARDLRM GGMDVWGQGTTVTVSS |
| | | | SEQ ID NO: 24904 | SEQ ID NO: 28910 |
| iPS:393928 | 21-225_4E10 | NA | GACATCCAGATGACCCAGTCTCCATCTCCCT GTTTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATTTGGGACAGAGTTCACTCTCACAA TCAGCAGCCTGCAGCCTGAAGATTTTGCAACT TATTACTGTTTACAGCATGATAATTACCCCTC ACTTTCGGCGGAGGGACCAAGGTGGAGATCA AA | CAGCTGCAGCTACAGGAGTCGGGCCCAGGACTG GTGAAGCCTTCGGAGACCCTGTCCTCACCTGCA CTGTCTCTGGTGGCTCCATCAGCCGTAGTAGTTA CTACTGGGGCTGGATCGCCCAGCCCCCAGGGAA GGGGCTGGAGTGGATTGGAGTGTCTATTATAGT GGGGCCACCTCCTACAACCCGTCCCTCAAGAGTC GAGTCACCATATCCGTAGACACGTCCAAGAACC AGTTTTCCCTGAAGCTGAACTCTGTGTGAGACTAAGC AGACACGGCTTTGTATTACTGTGCTACTGGGGA AGCAACTGGGACTTTGACTACTACTGGGGCCAGGGA ACCCTGGTCACCGTCTCCTCA |
| | | | SEQ ID NO: 24905 | SEQ ID NO: 28911 |

FIGURE 50
(Continued)

| | | | | |
|---|---|---|---|---|
| iPS:393930 | 21-225_7E11 | AA | DIQMTQSPSSLFASVGDRVTITCRASQGIRNDLG WYQQKPGKAPKRLIYAASSLQSGVPSRFSGSGF GTEFTLTISSLQLEDFATYYCLQHDNYPLTFGGG TKVEIK<br>SEQ ID NO: 24906 | QLQLQESGPGLVKPSETLSLTCTVSGGSISRSSYYW GWIRQPPGKGLEWIGSVYYSGATSYNPSLKSRVTIS VDTSKNQFSLKLNSVTAADTALYYCVRLSSNWDF DYWGQGTLFTVSS<br>SEQ ID NO: 28912 |
| | | NA | GACATCCAGATGACCCAGTCTCCATCTCCCT GTCTGCATCTGTAGGAGACAGAGTCACCATCG CTTGCCGGGCAAGTCAAAACATTATCAGCTAT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGGGGGACCAAGGTGGAGATCA AA<br>SEQ ID NO: 24907 | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATATGGCATGATGAAAG TAATAAATACTATGCAGACTCCGTGAAGGGCCG ATTCACCATCTCCAGAGACAATTCCAACAACACG CTGTATCTGCAAATGAGCAGCCTGCGAGCCGAG GACACGGCTGTGTATTACTGTGCGAGAGATCTGA GTATGGGGGTATGGACGTCTGGGGCCAAGGGA CCACGGTCACCGTCTCCTCA<br>SEQ ID NO: 28913 |
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK<br>SEQ ID NO: 24908 | QVQLVESGGGVVQPGRSLRLSCAASGFTFSSFGMH WVRQAPGKGLEWVAIIWHDGSNKYYADSVKGRFT ISRDNSNNTLYLQMSSLRAEDTAVYYCARDLSMGG MDVWGQGTTVTVSS<br>SEQ ID NO: 28914 |

FIGURE 50
(Continued)

| | | | |
|---|---|---|---|
| iPS:393932 | 21-225_10F5 | NA | GACATCCAGATGACCCAGTCTCCATCCTCCCT GTCTGCATCTGTTGGAGACAGAGTCACCATCA CTTGCCGGGCAAGTCAGAACATTTACAGGTAT TTAAATTGGTATCAGGAGAAACCAGGGAGAG CCCCTAAACTCCTGATCTATACTGCATCCAGTT TGCAAAGTGGGGGTCCCATCAAGGTTCAGTGGC AGTGACTCTGGGACAGATTTCACTCTCACCAT CAGCAGTCTGCAACCTGAAGATTTTGCAACTT ACTACTGTCAACAGAGTTACAGTCCCCCTCTC ACTTTCGGCGGAGGGACCAAGGTGGAGATCA AA SEQ ID NO: 24909 | CAGGTGCAGCTGGTGGAGTCTGGGGGAGGCGTG GTCCAGCCTGGGAGGTCCCTGAGACTCTCTGTG CAGGGTCTGATTCAACTTCAGTAGTCTATGGCAT GCACTGGGTCCGCCAGGCTCCAGGCAAGGGGCT GGAGTGGGTGTCAATTATAGACTCCGTGAAGGCATGATGGAAGT AATAAATATTATGAGACTCCGTGAAGGCCGAT TCACCATCTCCAGAGACAATTCCAAGAACACGCT GTATCTGCAAATGAACAGCTGAGAGCCGAGGA CACGGCTGTGTATTACTGTGCGAGAGATGAGAGG CTGGGGATTTTGACTACTGGGGCCAGGGAACCC TGGTCACCGTCTCCTCG SEQ ID NO: 28915 |
| | | AA | DIQMTQSPSSLSASVGDRVTITCRASQNIYRYLN WYQQKPGRAPKLLIYTASSLQSGVPSRFSGSDSG TDFTLTISSLQPEDFATYYCQQSYSPPLTFGGGTK VEIK SEQ ID NO: 24910 | QVQLVESGGGVVQPGRSLRLSCAASGFNFSSYGMH WVRQAPGKGLEWVSIIWHDGSNKYYVDSVKGRFT ISRDNSKNTLYLQMNSLRAEDTAVYYCARDERLGI FDYWGQGTLVTVSS SEQ ID NO: 28916 |
| iPS:393934 | 21-225_13E6 | NA | GACATCCAGGTGACCCAGTCTCCATCTTCCCT GTCTGCATCTGTAGGAGACAGAGTCACCATCA CTAGCCGGGCAAGTCAGGGCATTAGAAATGAT TTAGGCTGGTATCAGCAGAAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGCT CACTTTCGGCGGAGGGACCAAGGTGGCGATCA AA SEQ ID NO: 24911 | CAGGTGCAGCTGGTGGAGTCTGGGGGAGGCGTG GTCCAGCCTGGGAGGTCCCTGAGACTCTCTGTG CAGCGTCTGGATTCACCTTCAGTAACTATGGCAT GCACTGGGTCCGCCAGGCTCCAGGCAAGGGGCT GGAGTGGGTGGCAGTTATATAGACTCCGTGAAGGCCGAT TCACCATCTCCAGAGACAACTCCAAGAACACGCT GTATCTGCAAATGAACAGCCTGAGAGCCGAGGA CACGGCTGTGTATTACTGTGCGAGAGAATTGGGG TTCCGGTCTGACTACTGGGGCCAGGGAACCCTGG TCACCGTCTCCTCA SEQ ID NO: 28917 |

FIGURE 50
(Continued)

| | | | | |
|---|---|---|---|---|
| iPS:393936 | 21-225_14A11 | AA | DIQVTQSPSSLSASVGDRVTITSRASQGIRNDLG WYQQKPGKAPKRLIYAASSLQSGVPSRFSGSGS GTEFTLTISSLQPEDFATYYCVQHNSYPLTFGGG TKVAIK<br>SEQ ID NO: 24912 | QVQLVESGGGVVQPGRSLRLSCAASGFTFSNYGM HWVRQAPGKGLEWVAVIWYDENNKYIDSVKGR FTISRDNSKNTLYLQMNSLRAEDTAVYYCARELGF RSDYWGQGTLVTVSS<br>SEQ ID NO: 28918 |
| | | NA | GACATCCAGATGACCCAGTCTCCATCTCCCT GTCTGCATCTATAGGAGACAGAGTCACCATCA CTTGCCGGGCAAGTCAGAGCATTAGCAGTTAT TTAAATTGGTATCAGCAGAAACCAGGGAAAG CCCCTAAGCTCCTGATCTTTGCTGCATCCAGTT TGCAAAATGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGACTTACAGTAGCCCTCCA TTCACTTTCGCCCCTGGGACCAAAGTGGATAT CAAA<br>SEQ ID NO: 24913 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGGAAGGGGCT GGAGTGGGTCTCAGTTATTAGTGGTAGAGGTGGT AGTACATACTACGCAGACTCCGTGAAGGGCCGA TTCACCATCTCCAGAGACAATTCCAAGAACACGC TGTATCTGCAAATGAACAGCCTGAGAGCCGAGG ACACGGCCGTATATTACTGTGCGAAAAGGATAG CAGTCGGTATGGAGTACTTCGATCTCTGGGGCCG TGGCACCCTGGTCACTGTCTCCTCA<br>SEQ ID NO: 28919 |
| | | AA | DIQMTQSPSSLSASIGDRVTITCRASQSISSYLNW YQQKPGKAPKLLIFAASSLQNGVPSRFSGSGSGT DFTLTISSLQPEDFATYYCQQTYSSPPFTEAPGTK VDIK<br>SEQ ID NO: 24914 | EVQLLESGGGLVQPGGSLRLSCAASGFTFSSYAMN WVRQAPGKGLEWVSVISGRGGSTYYADSVKGRFTI SRDNSKNTLYLQMNSLRAEDTAVYYCAKRIAAGM EYFDLWGRGTLVTVSS<br>SEQ ID NO: 28920 |

FIGURE 50
(Continued)

| | | | |
|---|---|---|---|
| iPS:393940 | 21-225_16B2 | NA | GGCGTCCAGATGACCCAGTCTCCATCCTCCCT GTCTGCATCTGTAGGAGACAGAGTCACCATCA CTTGCCGGGCAAGTCAGAGCATTAGCGGCTAT TTAAATTGGTATCAGCAGAAACCAGGGAAAG CCCCTAAGCTCCTGATCTATGCTGCATCCAGT TGCAAAGTGGGGTCCATCAAGGTTCAGTGGC GGTGGATCTGGGACAGATTTCACTCTCACCAT CAGCAGTCTACAACCTGAAGATTTTGCAACTT ACTACTGTCAACAGACTTACAATACCCCTCCG GAGCGCAGTTTTGGCCAGGGGACCAAGCTGG AGATCAAA<br><br>SEQ ID NO: 24915 | GAGGTGCAGTTGTTGGAGTCTGGGGGAGGCTTGG TACAGCCGGGGGGGTCCCTGAGACTCTCCTGTGC AGCCTCTGGATTCACCTTTAGCAGCTATGCCATG ACCTGGGTCCGCCAGGCTCCAGGGAAGGGGCCG GAGTGGGTCTCAGTTATTAGTGGTAGTGGTGGTA GCACATTCTACGCAGACTCCGTGAAGGGCCGGTT CACCATCTCCAGAGACAATTCCAAGAACACGCTT TATCTGCAAATGAGCAGCCTGAGAGCCGAGGAC ACGGCCGTTTATTTCTGTGCCCGATATTGTAGTA GTACCAGTGCCCTTATGATGCCTTTGATATCTG GGGCCAAGGGACAATGGTCACCGTCTCCTCA<br><br>SEQ ID NO: 28921 |
| | | AA | GVQMTQSPSSLSASVGDRVTITCRASQSISGYYLN WYQQKPGKAPKLLIYAASSLQSGVPSRFSGGGS GTDFTLTISSLQPEDFATYYCQQTYNTPPERSFG QGTKLEIK<br><br>SEQ ID NO: 24916 | EVQLLESGGGLVQPGGSLRLSCAASGFTFSSYAMT WVRQAPGKGPEWVSVISGSGGSTFYADSVKGRFTI SRDNSKNTLYLQMSSLRAEDTAVYFCARYCSSTRC PYDAFDIWGQGTMVTVSS<br><br>SEQ ID NO: 28922 |
| iPS:393942 | 21-225_11E5 | NA | GACATCGTGATGACCCAGTCTCCAGACTCCCT GGCTGTGTCTCTGGGCGAGAGGGCCACCCTCA ACTGCAAGTCCAGCCAGAGTGTTTTATACAGC TCCAACAATAACAACTACTTAACTTGGTACCA GCAGAAACCTGGACAGGGACCTAAGTTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAAA<br><br>SEQ ID NO: 24917 | CAGGTGCAACTGGTGCAGTCTGGGCCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TGCCACCGGCTATGCACAGAGGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGACAAGCAGT GGCTGGGAGGTCTTTGACTACTGGGGCCAGGGA ACCCTGGTCACCGTCTCCTCA<br><br>SEQ ID NO: 28923 |

FIGURE 50
(Continued)

| | | | |
|---|---|---|---|
| iPS:393944 | 21-225_14D6 | AA | DIVMTQSPDSLAVSLGERATLNCKSSQSVLYSSN NNNYLTWYQQKPGQRPKLLIYWASTRESGVPD RFSGSGSGTNFTLTISSLQAEDVAVYYCQQYYST PPTFGQGTKVEIK<br>SEQ ID NO: 24918 | QVQLVQSGPEVKKPGASVKVSCKASGYTFTNYDIN WVRQATGQGLEWMGWMHPNSGATGYAQRFQGR VTMTRNTSISTAYMELSSLRSEDTAVYYCATSSGW EVFDYWGQGTLVTVSS<br>SEQ ID NO: 28924 |
| | | NA | GACATCCAAATGACCCAGTCTCCATCCTCCCT GTCTGCATCTGTCGGAGACAGTGTCACCATCA CTTGCCGGGCAAGTCAGGACATTAGAAATCAT TTAGGCTGGTATCAGCATAAACCAGGAAAGC CCCTAAGCGCCTGATCTATGCTGCATCCAGTTT GCAAAGTGGGGTCCCATCTAGGTTCAGCGGCA GTGGATCTGGGACAGAATTCACTCTCACAATC AGCAGCCTGCTACAGACTATAATAGTTACCATTCAC TTACTGTCTACAGTATAATAGTTACCATTCAC TTTCGGCCCTGGGACCAAAGTGGATATCAAC<br>SEQ ID NO: 24919 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGTTATACCAT GAACTGGGTCCGCCAGGCTCCAGGAAGGGCT GGAGTGGGTCTCATCCATTAGTGGTAGTGGTAGT TACATATACTACGCAGACTCAGTGAAGGGCCGAT TCACCATGTCCAGAGACAACGCCAAGAACTCACT GTATCTGCAAATGAACAGCCTGAGAGCAGCGAGGA CACGGCTGTGTATTACTGTGCGAGAGTAGCAGCC TTTGACTCCTGGGGCCAGGGAACCCTGGTCTCCG TCTCCTCA<br>SEQ ID NO: 28925 |
| | | AA | DIQMTQSPSSLSASVGDSVTITCRASQDIRNHLG WYQHKPGKAPKRLIYAASSLQSGVPSRFSGSGS GTEFTLTISSLQPEDFATYYCLQYNSYPFTFGPGT KVDIN<br>SEQ ID NO: 24920 | EVQLVESGGGLVKPGGSLRLSCAASGFTFSSYTMN WVRQAPGKGLEWVSSISGSGSYIYYADSVKGRFTM SRDNAKNSLYLQMNSLRAEDTAVYYCARVAAFDS WGQGTLVSVSS<br>SEQ ID NO: 28926 |

FIGURE 50
(Continued)

| | | | | |
|---|---|---|---|---|
| iPS:393946 | 21-225_16A4 | NA | GACATCCAGATGACCCAGTCTCCATCCTCACT GTCTGCATCTGTAGGAGACAGAGTCACCATCA CTTGTCGGGCGAGTCAGGACATTAGTAATTAT TTAGCCTGGTTTCAGCAGAAACCAGGGAAAGC CCCTAAGTCCCTGATCTCTGCTGCATCCAGTTT GCAAAGTGGGGTCCCATCAAAATTCAGCGGCA GTGGATCTGGGACAGATTTCACTCTCACCATC AGCAGCCTGCAGCCTGAAGATTTTGCAACTTA TTACTGCCAACAGTATCATAGTTACCCGTGGA CGTTCGGCCAAGGGACCAAGGTGGAAATCAA T <br><br> SEQ ID NO: 24921 | GAGGTGCAGCTGGTGGAGTCTGGGGGAGGCCTG GTCAAGCCTGGGGGGTCCCTGAGACTCTCCTGTG CAGCCTCTGGATTCACCTTCAGCAGCTATAGCAT GAACTGGGTCCGCCAGGCTCCAGGGAAGGGGCT GGAGTGGGTCTCATCCATTAGTGGTAGTAGTACT TACAAATACTACGCAGACTCAGTGAAGGGCCGA TTCACCATCTCCAGAGACAACGCCAAGAACTCAC TGTATCTGCAAATGAACAGCCTGAGAACCGAGG ACACGGCTGTGTATTACTGTGCGAGAGATCGTGG GAGCTACTGGGGCCAGGGAACCCAGGTCACCGT CTCCTCA <br><br> SEQ ID NO: 28927 |
| | | AA | DIQMTQSPSSLSASVGDRVTITCRASQDISNYLA WFQQKPGKAPKSLISAASSLQSGVPSKFSGSGSG TDFTLTISSLQPEDFATYYCQQYHSYPWTFGQGT KVEIN <br><br> SEQ ID NO: 24922 | EVQLVESGGGLVKPGGSLRLSCAASGFTFSSYSMN WVRQAPGKGLEWVSSISGSSTYKYYADSVKGRFTI SRDNAKNSLYLQMNSLRTEDTAVYYCARDRGSYW GQGTQVTVSS <br><br> SEQ ID NO: 28928 |
| iPS:393948 | 21-225_16A5 | NA | GACATCCAGATGACCCAGTCTCCTTCCTCCCT GTCTGCATCTGTAGGAGACAGAGTCACCATCA CTTGCCGGGCAAGTCAGGGCATTAGAAATGAT TTAGGCTGCTATCAGCAGAAACCAGGGAAAG CCCCTAAGCGCCTGATCTATGCTGCATCCAGT TTGCAAAGTGGGGTCCCATCAAGGTTCAGCGG CAATGGATATGGGACAGAATTCACTCTCACAA TCAGCAGCCTGCAGCCTGAAGATTTTGCAACT TATTACTGTCTACAGCATAATAGTTACCCGTG GACGTTCGGCCAAGGGACCAAGGTGGAAATC AAA <br><br> SEQ ID NO: 24923 | CAGGTGCAGCTGGTGGAGTCTGGGGGAGGCGTG GTCCAGCCTGGGAGGTCCCTAAGACTCTCCTGTG CAGCGTCTGGATTCACCTTCAGTGACTGACTGGCAT GCACTGGGTCCGCCAGGCTCCAGGCAAGGGGCT GGAGTGGGTGGCAGTTATATGACTTCGTGATGGAAGT AATAAATACTATGTAGAGACTCCGTGAAGGGCCGAT TCACCATCTCCAGAGACAACAATTCCAAGAACACGCT GTATCTGCAAATGAGCAGCCTGAGAGCCGAGGA CACGGCTGTGTATTACTGTGCGAGAGATCTTGGC TGGACGGAAGAGTACTGGGGCCAGGGAACCCTG GTCACCGTCTCTCA <br><br> SEQ ID NO: 28929 |

FIGURE 50
(Continued)

| | | | | |
|---|---|---|---|---|
| iPS:393950 | 21-225_3H10 | AA | DIQMTQSPSSLSASVGDRVTITCRASQGIRNDLG CYQQKPGKAPKRLIY AASSLQSGVPSRFSGNGY GTEFTLTISSLQPEDFATYYCLQHNSYPWTFGQG TKVEIK<br><br>SEQ ID NO: 24924 | QVQLVESGGGVVQPGRSLRLSCAASGFTFSDYGM HWVRQAPGKGLEWVAVIWFDGSNKYYVDSVKGR FTISRDNSKNTLYLQMSSLRAEDTAVYYCARDLGW TEEYWGQGTLVTVSS<br><br>SEQ ID NO: 28930 |
| | | NA | TCCTATGAGCTGAGTCAGCCACCCTCAGTGTC CGTGTCCCCAGGACAGAGCCAGCATCACCT GCTCTGGAGATAAATTGGGGAAAAATATGCT TGCTGGTATCAGCAGAAGCCAGGCCAGTCCCC TGTGCTGGTCATCTATCAAGATAGGAAGCGGC CCTCAGGGATCCCTGAGCGATTCTCTGGCTCC AACTCTGGGAACACAGCCACTCTGACCATCAG CGGGACCCAGGCTGTGGATGAGGCTGACTATT ACTGTCAGGCGTGGGTCAACAACACTATGATA TTCGGCGGAGGGACCAAGCTGACCGTCCTA<br><br>SEQ ID NO: 24925 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGGCAAGGGCT GGAGTGGGTGGCAGTTATATGCAGACTCCGTGAAGT AATAAATACTATGCAGACTCCGTGAAGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGATA TAGCAGTGGCTGGTATGACTACGGTTTGGACGTC TGGGGCCAAGGGACCACGGTCACCGTCTCCTCA<br><br>SEQ ID NO: 28931 |
| | | AA | SYELSQPPSVSVSPGQTASITCSGDKLGEKYACW YQQKPGQSPVLVIYQDRKRPSGIPERFSGSNSGN KATLTISGTQAMDEADYYCQAWVNNTMIFGGG TKLTVL<br><br>SEQ ID NO: 24926 | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCARERYSS GWYDYGLDVWGQGTTVTVSS<br><br>SEQ ID NO: 28932 |

FIGURE 50
(Continued)

| | | | |
|---|---|---|---|
| iPS:393952 | 21-225_1F1 | NA | GACATCCAGATGACCCAGTCTCCATCCTCACT GTCTGCATCTGTAGGAGACAGAGTCACCATCA CTTGTGGGCGAGTCAGGGCATTAACAATTAT TAGCCTGGTTTCAGCAGAAATCAGGGAAAGC CCCTAAGTCCCTGATCTCTGTTGCATCCAGTTT GCAAACTGGGGTCCCATCAAGGTTCAGCGGCA GTGGATCTGGGACAGATTTCACTCTCACCATC AGCAGCCTGCAACAGTATATAGTTACCCTCTCA TTACTGCCAACAGTATATAGTTACCCTCTCA CTTTCGGCGGAGGGACCAAGGTGGAGATCAA A | GAGGTGCAGCTGGTGGAGTCTGGGGGAGGCCTG GTCAAGCCTGGGGGTCCCTGAGACTCTCCTGTG CAGCCTCTGGATTCACCTTCAGTAGTATAACAT GAACTGGGTCCGCCAGGCTCCAGGGAAGGGCT GGAGTGGGTCTCATCCATTAGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGA CACGGCTGTGTATTACTGTGCAGAGTTAACCTC TTTGACTACTGGGGCCAGGGAACCCTGGTCACCG TCTCCTCA |
| | | | SEQ ID NO: 24927 | SEQ ID NO: 28933 |
| | | AA | DIQMTQSPSSLSASVGDRVTITCRASQGINNYLA WFQQKSGKAPKSLISVASSLQTGVPSRFSGSGSG TDFTLTISSLQPEDFATYYCQQYNSYPLTFGGGT KVEIK | EVQLVESGGGLVKPGGSLRLSCAASGFTFSSYNMN WVRQAPGKGLEWVSSISSSSYTYADSVKGRFTIS RDNAKNSLYLQMNSLRAEDTAVYYCARVNLFDY WGQGTLVTVSS |
| | | | SEQ ID NO: 24928 | SEQ ID NO: 28934 |
| iPS:393954 | 21-225_4H6 | NA | GACATCCAGATGACCCAGTCTCCATCTTCCGT GTCTGCATCTGTAGGAGACAGAGTCACCATCA CTTGTGGGCGAGTCAGGGTATTAGCAGGTGG TTAGCCTGGTATCAGCAGAAACCAGGGAAAG CCCCTAAGCTCCTGATCTATGTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAATTT ATTATTGTCAACAGGCTAACAGTTTCCCATTC ACTTTCGGCCCTGGGACCAAAGTGGATATCAA A | CAGGTGCAGCTGGTACAGTCTGGGGCTGAGGTG AAGAAGCCTGGGGCCTCAGTGAAGGTCTCCTGC AAGGCTTCTGGATACACCTTCACGACTACTATT TGCACTGGGTGCGACAGGCCCCTGGACAAGGTCT TGAGTGGATGGGATGGATCCACCCTAACAGTGGT GGCACAAACTATGACCAGGACACGTCCATCAGCACA GTCACCATGACCAGGGACACGTCCATCAGCACA GCCTACATGGGGCTGAGCAGTCTGAGATCTGACG ACACGGCCGTGTATTACTGTGCGAGAGATGGTAC CAGCCTCGTTTGACTACTGGGGCCAGGGAACCCTG GTCACCGTCTCCTCA |
| | | | SEQ ID NO: 24929 | SEQ ID NO: 28935 |

FIGURE 50
(Continued)

| | | | | |
|---|---|---|---|---|
| iPS:393956 | 21-225_4D7 | AA | DIQMTQSPSSVSASVGDRVTITCRASQGISRWLA WYQQKPGKAPKLLIYGASSLQSGVPSRFSGSGS GTDFTLTISSLQPEDFAIYYCQQANSFPFTFGPGT KVDIK<br><br>SEQ ID NO: 24930 | QVQLVQSGAEVKKPGASVKVSCKASGYTFTDYYL HWVRQAPGQGLEWMGWIHPNSGGTNYAQKFQGR VTMTRDTSISTAYMGLSSLRSDDTAVYYCARDGTS SFDYWGQGTLVTVSS<br><br>SEQ ID NO: 28936 |
| | | NA | GACATCCAGATGACCCAGTCTCCATCCTCCCT GTCTGCATCTGTAGGAGACAGAGTCACCATCA CTTGCCGGGCAAGTCAGAGCATTAGCGACTAT TTAAATTGGTATCAGCAGAAACCAGGGAAAG CCCCTAAACTCCTGATCTTTGATACAACCAGTT TGCAAAGTGGGGTCCCATCAAGGTTCAGTGGC AGTGGATCTGGGACAGAGATTTCACTCTCACCAT CAACAGTCTGCAACCTGAAGATTTTGCAACTT ACTACTGTCAACAGAGCTTACAATACCCCTCCG GAGCGCAGTTTTGGCCAGGGACCAAGCTGG AGATCAAA<br><br>SEQ ID NO: 24931 | GAGGTGAAGCTGTTGGAGTCTGGGGGAGGCTTG GTACAGCCCGGGGGGGTCCCTGAGACTCTCCTGTG CAGCCTCTGGATTCACCTTCAGCAGCTATGCCAT GAGCTGGGTCCGCCAGGCTCCAGGGAAGGGGCT GGAGTGGGTCTCAGTTCTTAGTGGTAGTGGTGGT AGCACATTCTACGCAGACTCCGTGAAGGGCCGGT TCACCATCTCCAGAGACAATTCCAAGAACACGCT GTATCTGCAAATGAGCAGCTGAGAGCCGGGA CACGGCCGTATATTTCTGTGCCGATATTGTAGT AGTGCCAGTGCCCTTATGATGCCTTTGATATCT GGGGCCAAGGGACAATGGTCACCGTCTCCTCA<br><br>SEQ ID NO: 28937 |
| | | AA | DIQMTQSPSSLSASVGDRVTITCRASQSISDYLN WYQQKPGKAPKLLIFDTSLQSGVPSRFSGSGSG TDFTLTINSLQPEDFATYYCQQTYNTPPERSFGQ GTKLEIK<br><br>SEQ ID NO: 24932 | EVKLLESGGGLVQPGGSLRLSCAASGFTFSSYAMS WVRQAPGKGLEWVSVLSGSGGSTFYADSVKGRFTI SRDNSKNTLYLQMSSLRAGDTAVYFCARYCSSARC PYDAFDIWGQGTMVTVSS<br><br>SEQ ID NO: 28938 |

FIGURE 50
(Continued)

| | | | | |
|---|---|---|---|---|
| iPS:393958 | 21-225_5H2 | NA | GACATCCAGATGACCCAGTCTCCATCCTCCT GTCTGCATCTGTAACAGAGACAGAGTCACCATCA CTTGCCGGGCAAGTCAGGCATTAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCAGTCTCACAA TCAGCAGCCTGCAGCCTGAAGATTTTGCAACT TATTACTGTCTACAGCATAATAGTTACCCTCTC ACTTTCGGCGGAGGGACCAAGGTGGAGATCA AA<br/>SEQ ID NO: 24933 | GAGGTGCAGCTGGTGGAGTCTGGGGGAGGCTG GTCAAGCCTGGGGGGTCCTTGAGACTCTCCTGTG CAGCCTCTGGATTCACATTCAGTAGTATACCAT GAACTGGGTCCGCCAGGCTCCAGGAAGGGCT GGAGTGGGTCTCATCCATTAGTGGTAGTAGTAGT TACATATACTACGCAGACTCAGTGAAGGGCCGAT TCACCATCTCCAGAGGCAACGCAAGAACTCATT GTATCTGCAAATGAACAGCCTGAGAGCCGAGGA CACGGCTGTGTATTACTGTGCGAGAGGGAGCAG CTCGTCCCGGCTTGACTACTGGGGCCAGGGAACC CTGGTCACCGTCTCCTCA<br/>SEQ ID NO: 28939 |
| | | AA | DIQMTQSPSSLSASVTDRVTITCRASQGIRNDLG WYQQKPGKAPKRLIYAASSLQSGVPSRFSGSGS GTEFSLTISSLQPEDFATYYCLQHNSYPLTFGGGT KVEIK<br/>SEQ ID NO: 24934 | EVQLVESGGGLVKPGGSLRLSCAASGFTFSSYTMN WVRQAPGKGLEWVSSISGSSSYIYYADSVKGRFTIS RANAKNSLYLQMNSLRAEDTAVYYCARGSSSSGF DYWGQGTLVTVSS<br/>SEQ ID NO: 28940 |
| iPS:393960 | 21-225_7G2 | NA | GACATCCAGATGACCCAGTCTCCATCCTCCT GTCTGCGTCTGTAGGAGACAGAGTCACCATCA CTTGCCGGGCAAGTCAGGCATTAGAAATGAT TTAGGCTGGTATCAGCAGAAACCAGGGAAAG CCCCTAAGCGCCTGATCTATACTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAACATAATAGTTACCGTG GACGTTCGGCCTAGGGACCAAGGTGGTCATCA AA<br/>SEQ ID NO: 24935 | CAGGTGCAACTGGTGGAGTCTGGGGGAGGCGTG GTCCAGCCTGGGAGGTCCCTGAGACTCTCCTGTG CAGCGTCAGGATTCACCTTCAGTGACTATGGCAT GCACTGGGTCCGCCAGGCTCCAGGCAAGGGGCT GGAGTGGATGGCAGTTATATGTATGATGTAACT AATAAATACTATGCAGACTCCGTGAAGGGCCGA TTCACCATCTCCAGAGACAATTCCAAGAACACGC TGTATCTGCAACTGAACAGCCTGAGAGCCGAGG ACACGGCTGTTATTACTGTGCGAGAGAACTTGG CTGGTACGAGGACTACTGGGGCCAGGGAACCCT GGTCACCGTCTCCTCA<br/>SEQ ID NO: 28941 |

FIGURE 50
(Continued)

| | | | | |
|---|---|---|---|---|
| iPS:393962 | 21-225_7H7 | AA | DIQMTQSPSSLSASVGDRVTITCRASQGIRNDLG WYQQKPGKAPKRLIYTASSLQSGVPSRFSGSGSG TEFTLTISSLQPEDFATYYCLQHNSYPWTFGLGT KVVIK<br>SEQ ID NO: 24936 | QVQLVESGGGVVQPGRSLRLSCAASGFTFSDYGM HWVRQAPCKGLEWMAVIWYDVTNKYYADSVKG RFTISRDNSKNTLYLQLNSLRAEDTAVYYCARELG WYEDYWGQGTLVTVSS<br>SEQ ID NO: 28942 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCACATCAAGGTTCAGCGG CAGTGGATCTGGGACAGAATTCACTCTCACAA TCAGCAGCCTGCAGCCTGAAGATTTTGCAACT TATTACTGTCTACAGCATAGTTACCCGTTC ACTTTCGTCGGAGGGACCAAAGTGGAGATCAA A<br>SEQ ID NO: 24937 | CAGCTGCAGCTGCAGGAGTCGGGCCCAGGACTG GTGAAGCCTTCGGAGACCCTGTCCTCACCTGCA CTGTCTCTGGTGGCTCCATCAGCAGAAGTAGTTA CTACTGGGGCTGGATCCGCCAGCCCCAGGGAA GGGGAGCACCTACTACCATCCCGTCCTCAAGAGTC GAGTCACCATATCCGTTGACACGTCCAAGAACCA GTTCTCCCTGAAACTGAGCTCTGTGACCGCCGCA GACACGGCTGTGTATTACTGTGCCGAGACACAGTA CCAGCTGGTCTCTTGACCACTGGGGCCAGGGAAC CCTGGTCACCGTCTCCTCA<br>SEQ ID NO: 28943 |
| | | AA | DIQMTQSPSSLSASVGDRVTITCRASQGIRNDLG WYQQKPGKAPKRLIYAASSLQSGVTSRFSGSGS GTEFTLTISSLQPEDFATYYCLQHSSYPFTFVGGT KVEIK<br>SEQ ID NO: 24938 | QLQLQESGPGLVKPSETLSLTCTVSGGSISRSSYYW GWIRQPPGKGLEWIGNIYYSGSTYYIPSLKSRVTISV DTSKNQFSLKLSSVTAADTAVYYCARHSTWSLDH WGQGTLVTVSS<br>SEQ ID NO: 28944 |

FIGURE 50
(Continued)

| | | | | |
|---|---|---|---|---|
| iPS:393964 | 21-225_6G1 | NA | GACATCCAGATGACCCAGTCTCCATCCTCCT GTCTGCATCTGTAGGAGACAGAGTCACCATCA CTTGCCGGACAAGTCAGAACATTATCAGCTAT TTAAATTGGTATCAGCAGAAACCAGGGAAAG CCCCTAAGGTCCTGATCTATACTGCATCCAATT TGCAAACTGGGGTCCCATCAGGGTTCAGTGGC AGTGGATCTGGGACAGATTTCACTCTCACCAT CAGCAGTCTGCAAACCTGCAAGATTTTGCAACTT ACTACTGTCAACAGCCTCACAGTCCCCCGCTC ACTTTCGGCGGAGGGACCAAGGTGGAGATCA AA<br>SEQ ID NO: 24939 | CAGGTGCAGCTGGTGGAGTCTGGGGGAGGCGTG GTCCAGCCTGGGAGGTCCCTGAGACTCTCCTGTG CAGCGTCTGGATTCATCTTCAGTAGCTATGGCAT GCACTGGGTCCGCCAGGCTCCAGGCAAGGGGCT GGAGTGGGTGGCAATTATATGGTATGATGGAAGT AATAAATACTATGCAGACTCCGTGAAGGGCCGA TTCACCATCTCCAGAGACAACGCCAAGAACACGC TGTATCTGCAAATGAACAGCCTGAGAGCCGAGG ACACGGCTATGTATTACTGTGCGAGAGATCTGAG TATGGGCGGTATGGACGTCTGGGGCCAAGGGAC CACGGTCACCGTCTCCTCA<br>SEQ ID NO: 28945 |
| | | AA | DIQMTQSPSSLSASVGDRVTITCRTSQNIISYLNW YQQKPGKAPKVLIYTASNLQTGVPSGFSGSGSGT DFTLTISSLQPEDFATYYCQQPHSPPLTFGGGTK VEIK<br>SEQ ID NO: 24940 | QVQLVESGGGVVQPGRSLRLSCAASGFIFSSYGMH WVRQAPGKGLEWVAIIWYDGSNKYYADSVKGRFT ISRDNSKNTLYLQMNSLRAEDTAMYYCARDLSMG GMDVWGQGTTVTVSS<br>SEQ ID NO: 28946 |
| iPS:393966 | 21-225_7F8 | NA | GACATCCAGATGACCCAGTCTCCATCCTCCT GTCTGCATCTGTGGGAGACAGAGTCACCATCA CTTGCCGGGCAAGTCAGGGCATTGGAAATGAT TTAGGCTGGTATCAGCAGAAACCAGGGAAAG CCCCTAAGCGCCTGATCTATGCTGCATCCAGT TTGCAAAGTGGGGTCCCATCACGGTTCAGCGG CAGTGTATCTGGGACAGAATTCACTCTCCAA TCAGCAGCCTGCAGCCTGAAGATTTTGCAACT TATTACTGTCTACAACATTATACTTACCCTCGG ACGTTCGGCCAAGGGACCAAGGTGGAAATCA AA<br>SEQ ID NO: 24941 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTGTGTCAT GCACTGGGTCCGCCAGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACAATTCCAATAACACGC TGTATCTGCAAATGAACAGCCTGAGAGCCGAGG ACACGGCTGTGTATTACTGTGCGAGAGAAAGTA TACCAGTGGCTGGCACGACTACGGTATGGACGTC TGGGGCCAAGGGACCACGGTCACCGTCTCCTCG<br>SEQ ID NO: 28947 |

FIGURE 50
(Continued)

| | | | | |
|---|---|---|---|---|
| iPS:393968 | | AA | DIQMTQSPSSLSASVGDRVTITCRASQGIGNDLG WYQQKPGKAPKRLIYAASSLQSGVPSRFSGSVS GTEFTLPISSLQPEDFATYYCLQHYTYPRTFGQG TKVEIK<br>SEQ ID NO: 24942 | QVQLVESGGGVVQPGRSLRLSCAASGFTFSSCVMH WVRQAPGKGLEWVAVIWYDGSNKYYADSVKGRF TISRDNSNNTLYLQMNSLRAEDTAVYYCARERYTS GWHDYGMDVWGQGTTVTVSS<br>SEQ ID NO: 28948 |
| | 21-225_5A5 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTCTGCTGCATCCAGTTT GCAAAGTGGGGTCCCATCAAGTTCAGCGGCA GTGGATCTGGGACAGATTTCACTCTCACCATC AGCAGCCTGCAACAGTATATAGTTACCCATTCA TTACTGCCAACAGTATATAGTTACCCATTCA CTTTCGGCCCTGGGACCAAAGTGGATATCAAA<br>SEQ ID NO: 24943 | GAGGTGCAGCTGTGGGAGTCTGGGGAGGCTTG GTACAGCCTGGGGGGTCCCTGAGACTCTCCTGTG CAGCCTCCGGATTCACCTTTAGCAGCTATGCCAT GAACTGGGTCCGCCAGGCTCCAGGGAAGGGCT GGAGTGGGTCTCAGTTATTAGTGGTAGTGGTGGT TACACATACTACGCAGACTCCGTGAAGGGCCGGT TCACCATCTCCCGAGACAATTCCAAGAACACGCT GTATCTGCAAATGAGCAGCCTGAGAGCCGAGGA CACGGCCGTTTATTACTGTGCGAAAGGGGGGTCC CTCTTCTACTGGGGCCAGGGAACCTTGGTCACCG TCTCTTCA<br>SEQ ID NO: 28949 |
| | | AA | DIQMTQSPSSLSASVGDRVTITCRASQGISNYLA WFQQKPGKAPKSLISAASSLQSGVPSKFSGSGSG TDFTLTISSLQPEDFATYYCQQYNSYPFTFGPGT KVDIK<br>SEQ ID NO: 24944 | EVQLWESGGGLVQPGGSLRLSCAASGFTFSSYAMN WVRQAPGKGLEWVSAISGSGYTYYADSVKGRFT ISRDNSKNTLYLQMSSLRAEDTAVYYCAKGGSLFY WGQGTLVTVSS<br>SEQ ID NO: 28950 |

FIGURE 50
(Continued)

| | | | |
|---|---|---|---|
| iPS:393972 | 21-225_7C9 | NA | GACATCCAGATGACCCAGTCTCCATCTCCT GTCTGCATCTGTAGGAGACAGAGTCACCATCA CTTGCCGGGCAAGTCAGGGACATTAGAAACGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCTTTATAGTTACCCTCGG ACGTTCGGCCAGGGGACCAAGGTGGATATCA AA SEQ ID NO: 24945 | CAGGTGCAGCTGGTGGAGTCTGGGGGAGGCGTG GTCCAGCCTGGGAGGTCCCTGAGACTCTCCTGTG CAGCGTCTGGACTCACCTTCAGTAACTATGTCAT GCACTGGGTCCGCCAGGCTCCAGGCAAGGGCT GGAGTGGGTGGCTGTTATATGGTATGATGAAGT AATAAATACTATGCAGACTCCGTGAAGGGCCGA TTCACCATCTCCAGAGACAATTCCAAGAACACGT TGTATCTGCAAATGAACAGCCTGAGAGCCGAGG ACACGGCTGTGTATTACTGTGCGAGAGAAGTA TAGCAGCAGCTGGTACGACTACGGTATGGACGTC TGGGGCCAAGGGACCACGGTCACCGTCTCCTCA SEQ ID NO: 28951 |
| | | AA | DIQMTQSPSSLSASGGDRVTITCRASQGIRNDLG WYQQKPGKAPKRLIYAASSLQSGVPSRFSGSGS GTEFTLTISSLQPEDFATYYCLQLYSYPRTFGQGT KVDIK SEQ ID NO: 24946 | QVQLVESGGGVVQPGRSLRLSCAASGLTFSNYVM HWVRQAPGKGLEWVAVIWYDGSNKYYADSVKGR FTISRDNSKNTLYLQMNSLRAEDTAVYYCAREKYS SSWYDYGMDVWGQGTTVTVSS SEQ ID NO: 28952 |
| iPS:393974 | 21-225_7C4 | NA | GACATCCAGATGACCCAGTCTCCATCCTCCCT GTTTGCATCTGTAGGAGACAGAGTCACCATCA CTTGCCGGGCAAGTCAGGGACATTAGAAATGAT TTAGGCTGGTATCAGCAGAAACCAGGGAAAG CCCATAAGCGCCTTATATATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA SEQ ID NO: 24947 | CAGGTGCAGCTGGTGGAGTCTGGGGGAGGCGTG GTCCAGCCTGGGAAGTCCCTGAGACTCTCCTGTG CAGCGTCTGGATTCACCTTCAGTAACTATGGCAT GCACTGGGTCCGCCAGGCTCCAGGCAAGGGCT GGAATGGGTGGCAGTTATTGGTATGAAGAAAAT AATCAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACTGGGG TTCCGGTCTGACTACTGGGGCCAGGGAACCCTGG TCACCGTCTCCTCA SEQ ID NO: 28953 |

FIGURE 50
(Continued)

| | | | | |
|---|---|---|---|---|
| | | | DIQMTQSPSSLFASVGDRVTITCRASQGIRNDLG WYQQKPGKAHKRLIYAASSLQSGVPSRFSGSGS GTEFTLTISSLQPEDFATYYCLQHNSYPLTFGGG TKVEIK | QVQLVESGGGVVQPGKSLRLSCAASGFTFSNYGM HWVRQAPGKGLEWVAVIWYEENNQYYADSVKGR FTISRDNSKNTLYLQMNSLRAEDTAVYYCARELGF RSDYWGQGTLVTVSS |
| | | AA | SEQ ID NO: 24948 | SEQ ID NO: 28954 |
| iPS:393976 | 21-225_7E9 | NA | GACATCCAGATGACCCAGTCTCCATCCTCCT GTTTGCATCTGTAGGAGACAGAGTCACCATCA CTTGCCGGGCAAGTCAGGGCATTAGAAATGAT TTAGGCTGGTATGAGCAGAAACCAGGGAAAG CCCCTAAGCGCCTGATCTATACTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATAATAGTTACCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGCGGTCTGGATTCACCTTCAGTGACTATGGCAT GCACTGGGTCCGCCAGGCTCCAGGCAAGGGGCT GGAGTGGGTGGCAGTTATATGGTATGAAAAT AATAAATACTATGTAGACTCCGTGAAGGGCCGAT TCACCATCTCCAGAGACAACTCCAAGAACACGCT GTATCTGCAAATGAACAGCCGAGAGCCGAGGA CACGGCTGTATATTATTGTGCAGAGAGAATTGGGG TTCCGGTCTGACTACTGGGGCCAGGGAACCCTGG TCACCGTCTCCTCA |
| | | | SEQ ID NO: 24949 | SEQ ID NO: 28955 |
| | | AA | DIQMTQSPSSLFASVGDRVTITCRASQGIRNDLG WYEQKPGKAPKRLIYTASSLQSGVPSRFSGSGSG TEFTLTISSLQPEDFATYYCLQHNSYPLTFGGGT KVEIK | QVQLVESGGGVVQPGRSLRLSCAASGFTFSDYGM HWVRQAPGKGLEWVAVIWYDENNKYYVDSVKGR FTISRDNSKNTLYLQMNSLRAEDTAVYYCARELGF RSDYWGQGTLVTVSS |
| | | | SEQ ID NO: 24950 | SEQ ID NO: 28956 |

FIGURE 50
(Continued)

| | | | |
|---|---|---|---|
| iPS:393978 | 21-225_4C12 | NA | GACATCCAGATGACCCAGTCTCCATCTCCCT GTCTGCTCTGTGTCTGTAGGCGACAGAGTCACCATCA CTTGCCGGCAAGTCAGGCGATTAGAAATGAT TTAGGCTGGTATCAGCAGAAACCAGGGAAAG CCCCTACGCGCCTGATCTATGCTGCATCCAGTT TGCACAGTGGGGTCCCATCACGGTTCAGGGC AGTGGATCTGGGACAGAATTCACTCTCACAAT CAGCAGCCTGCAGCTGAAGATCTTGCAACTT ATTACTGTCTACAAACATTATAGTTTCCCTGGA CGTTCGGCCAAGGGACCAAGGTGGAAATCAA A |
| | | | SEQ ID NO: 24951 |
| | | AA | DIQMTQSPSSLSASVGDRVTITCRASQGIRNDLG WYQQKPGKAPTRLIYAASSLHSGVPSRFSGSGSG TEFTLTISSLQPEDLATYYCLQHYSFPRTFGQGTK VEIK |
| | | | SEQ ID NO: 24952 |
| iPS:393980 | 21-225_6D3 | NA | GACATCCAGATGACCCAGTCTCCATCTCCCT GTCTGCATCTGTAGGAGACAGAGTCACCATCA CTTGCCGGACAAGTCAGAGCATTAGCACTTAT TAAATTGGTATCAGCAGAAACCAGGGAAAG CCCCTAAGCTCCTGATCTTTGCTGCATCCAGT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTTCTGTCAACAGAGTTACAGAACCCCTTT TTCACTTTCGGCCCTGGGACCAAAGTGGATAT CAAA |
| | | | SEQ ID NO: 24953 |

| | | | |
|---|---|---|---|
| | | | CAGGTGCAGTTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAAGTA TAGCAGCAGCTGGTACGACTACGGTATGGACGTC TGGGGCCACGGACCACGGTCACCGTCTCCTCA |
| | | | SEQ ID NO: 28957 |
| | | | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCAREKYSS SWYDYGMDVWGHGTTVTVSS |
| | | | SEQ ID NO: 28958 |
| | | | GAGGTGCAGCTGTTGGAGTCTGGGGGAGGCTTG GTACAGCCTGGGGGGTCCCTGAGACTCTCCTGTG CAGCCTCTGGAATTCACCTTTAGCAGCTATGCCAT GAACTGGGTCCGCCAGGCTCCAGGGAAGGGGCT GGAGTGGGTCTCAGTTATTAGTGGTGGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTCTGTGCGTCCCGTTTGGCA GTGGCTGGCTCGGAGGCTTTGATATCTGGGGCC AAGGGACAATGGTCACCGTCTCTTCA |
| | | | SEQ ID NO: 28959 |

FIGURE 50
(Continued)

| | | | |
|---|---|---|---|
| iPS:393982 | 21-225_6C12 | AA | DIQMTQSPSSLSASVGDRVTITCRTSQSISTYLNW YQQKPGKAPKLLIFAASSLQSGVPSRFSGSGSGT DFTLTISSLQPEDFATYFCQQSYRTPFFTFGPGTK VDIK<br>SEQ ID NO: 24954 | EVQLLESGGGLVQPGGSLRLSCAASEFTFSSYAMN WVRQAPGKGLEWVSVISGRGGNTFYADSVKGRFTI SRDNSKNTLYLQMNSLRAEDTAVYFCASRLAVAG SEAFDIWGQGTMVTVSS<br>SEQ ID NO: 28960 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAGTAAT TTAGGCTGGTATCAGCAGAAACCAGGGAAAG CCCCTAAGCGCCTGATCTATGCTGCATCCAGT TTGGAAAGTGGGGTCCCATCAAGGTTCAGCGG CAGTGGATCTGGGACAGAATTCACTCTCACAA TCAGCAGCCTGCAGCCTGAAGATTTTGCAACT TATTCTGTCTACAGGATAATAGTTATCCGTTC ACTTTCGGCGGAGGGACCAAGGTGGAGATCA AA<br>SEQ ID NO: 24955 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATTAGTAGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCAGAGATCGTGGG AGCCTCTGGGGCCAGGAGAACCCTGGTCACCGTCT CCTCA<br>SEQ ID NO: 28961 |
| | | AA | DIQMTQSPSSLSASVGDRGTITCRASQGIRSNLG WYQQKPGKAPKRLIYAASSLESGVPSRFSGSGSG TEFTLTISSLQPEDFATYFCLQDNSYPFTFGGGTK VEIK<br>SEQ ID NO: 24956 | EVQLVESGGGLVKPGGSLRLSCAASGFTFSSYSMN WVRQAPGKGLEWVSSISSSSYIYADSVKGRFTIS RDNAKNSLYLQMNSLRAEDTAVYYCARDRGSLW GQGTLVTVSS<br>SEQ ID NO: 28962 |

FIGURE 50
(Continued)

| | | | |
|---|---|---|---|
| iPS:393984 | 21-225_4F12 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CGGTGGATCTGGGACAATATTCACTCTCACAA TCAGCAGCCTGCAGCCTGAAGATTTTGCAACT TATTACTGTCTACAGCATAATAGTTACGCGCT CACTTTCGGCGGAGGGACCAAGGTGGAGATC AAA<br>SEQ ID NO: 24957 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGTATGATGTTACT AATAAAAAGTATGCAGACTCCGTGAAGGGCGA TTCACCATCTCCAGAGACAATTCCAAGAACACGC TGTATCTGCAAATGAACAGCCTGACACCAGAGA ACACGGGTGTATTTGACTACTGGGGCCAGGGAACCCT GGTCACCGTCTCCTCA<br>SEQ ID NO: 28963 |
| | | AA | DIQMTQSPSSLSASVGDRVTITCRASQGIRNDLG WYQQKPGKAPKRLIYAASSLQSGVPSRFSGGGS GTHFTLTISSLQPEDFATYYCLQHNSYALTFGGGT KVEIK<br>SEQ ID NO: 24958 | QVQLVESGGGVVQPGRSLRLSCAASGFTFSSYGMH WVRQAPGKGLEWVAVIWYDVTNKKYADSVKGRF TISRDNSKNTLYLQMNSLTPENTGVYFDYWGQGTLVTVSS<br>SEQ ID NO: 28964 |
| iPS:393986 | 21-225_7G4 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGCCTCACTCTCACAA TCAGCAGCCTGCAGCCTGAAGATTCTGCAACT TATTACTGTCTACATCAATATAGTTACCCTCGG ACGTTCGGCGGCCAAGGGACCAAGGTGGAAATCA AA<br>SEQ ID NO: 24959 | CAGGTGCAGCTGGTGGAGTCTGGGGGAGGCGTG GTCCAGCCTGGGAGGTCCCTGAGACTCTCTGTG CAGCGTCTGGATTCACCTTCAATAACTATGTCAT GCACTGGGTCCGCCAGGCTCCAGGCAAGGGGCT GGAGTGGGTGGCAGTTATATGTATGATGGAAGT AATAAATACTATCCAGAGACAATTCCAAGAACACGC TGTATCTGCAAATGACCAGCCTGAGAGCCGAGG ACACGGCTGTGTATTACTGTGCGAGAGAAGTA TAGCAGCAACTGGTACGACTACGGTATGACGTC TGGGGCCAAGGGACCACGGTCACCGTCTCCTCA<br>SEQ ID NO: 28965 |

FIGURE 50
(Continued)

| | | | | |
|---|---|---|---|---|
| iPS:393988 | | AA | DIQMTQSPSSLSASVGDRVTITCRASQGIRNDLGWYQQRPGKAPKRLIYAASSLQSGVPSRFSGSGSGTEFTLTISSLQPEDSATYYCLHQYSYPRTFGQGTKVEIK<br>SEQ ID NO: 24960 | QVQLVESGGGVVQPGRSLRLSCAASGFTFNNYVMHWVRQAPGKGLEWVAVIWYDGSNKYYADSVKGRFTISRDNSKNTLYLQMTSLRAEDTAVYYCAREKYSSNWYDYGMDVWGQGTTVTVSS<br>SEQ ID NO: 28966 |
| | 21-225_7F10 | NA | GACATCCAGATGACCCAGTCTCCATCCGCACTGTCTGCATCTGTAGGAGACAGAGTCACCATCACTTGTCGGGCGAGTCAGGACATTAGGAATTATCAGCCTCTGGATTCAGCAGAAACCAGGGAAAGCCCCTAAGTCCCTGATCTCTGTTGCATCCAGTTTGCAAAGTGGGGTCCCATCAAGGTTCAGCGGGAGTGGATCTGGGACAGATTTCACTCTCACCATCAGCAGCCTGCAGCCTGAAGATTTTGCAACTTATTATTGCCAACAGTATAATAGTTACCCTCTCACTTTCGGCGGAGGGACCAAGGTGGAGATCAAA<br>SEQ ID NO: 24961 | GAGGTGCAGCTGGTGGAGTCTGGGGGAGGCCTGGTCAAGCCTGGGGGGTCCCTGAGACTCTCCTGTGCAGCCTCTGGATTCACCTTCAGTAGCTATAGCATGAACTGGGTCCGCCAGGCTCCAGGGAAGGGGCTGGAGTGGGTCTCATCCATTAGTAGTAGTAGTTACATATACTACGCAGACTCAGTGAAGGGCCGATTCACCATCTCCAGAGACAACGCCAAGAACTCACTGTATCTGCAAATGAACAGCCTGAGAGAGCTGAGGACACGGCTGTGTATTACTGTGCGAGAGCTAACCTCTTTGACTACTGGGGCCAGGGAACCCTGGTCACCGTCTCCTCA<br>SEQ ID NO: 28967 |
| | | AA | DIQMTQSPSALSASVGDRVTITCRASQDIRNYLAWFQQKPGKAPKSLISVASSLQSGVPSRFSGSGSGTDFTLTISSLQPEDFATYYCQQYNSYPLTFGGGTKVEIK<br>SEQ ID NO: 24962 | EVQLVESGGGLVKPGGSLRLSCAASGFTFSSYSMNWVRQAPGKGLEWVSSISSSSYIYYADSVKGRFTISRDNAKNSLYLQMNSLRTEDTAVYYCARANLFDYWGQGTLVTVSS<br>SEQ ID NO: 28968 |

FIGURE 50
(Continued)

| | | | |
|---|---|---|---|
| iPS:393990 | 21-225_11G7 | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCATCAAGGTTCAGCGG CAGTGGATCTGGGACAGAATTCACTCTCACAA TCAGCAGCCTGCAGCCTGAAGATTTTGCAACT TATTACTGTCTACAGCATAGTAATTACCCTCTC ACTTTCGGCGGAGGGACCATGGTGGAGATCAG A | CAGTCGCAGCTGCAGGAGTCGGGCCCAGGACTG GTGAAGCCTTCGGAGACCCTGTCCTCACCTGCA CTGTCTCTGGTGCTTCATCAGCAGGAGTACTTA CTACTGGGCTGGATCCGCCAGCCCCCAGGGAA GGGGCTGGAGTGGATTGGAGTATCTATTATAGT GGGAGCACCTCTACAGCCCGTCCCTCAAGAGTC GAGTCACCATATCCGTAGACACGTCCAAAAACC AGTTCTCCCTGAAGTTGAGCTCTGTGACCGCGC AGACACGGCTGTGTATTACTGTGCGAGACTGAAC AGCAGCTGGTCTTTTGACTACTGGGGCCAGGGAA CCCTGGTCACCGTCTCCTCA |
| | | | SEQ ID NO: 24963 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHSNYPLTFGGG TMVEIR | QLQLQESGPGLVKPSETLSLTCTVSGGFISRSTYYW GWIRQPPGKGLEWIGSIYYSGSTSYSPSLKSRVTISV DTSKNQFSLKLSSVTAADTAVYYCARLNSSWSFDY WGQGTLVTVSS |
| | | | SEQ ID NO: 24964 | SEQ ID NO: 28969 |
| iPS:393992 | 21-225_14H8 | NA | GACATCCAGATGACCCAGTCTCCATCTCCACT GTCTGCATCTGTAGGAGACAGAGTCACCATCA CTTGTCGGGCGAGTCAGGGCATTAGTCTATTAT TTAGCCTGGTTTCAGCAGAAACCAGGGAAAGC CCCTAAGTCCCTGATCTATGTTGCATCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAGTATAATAGTTACCCATTCA CTTTCGGCCCTGGGACCAAAGTGGATATCAAT | GAGGTGCAGCTGGTGGAGTCTGGGGAGGCTTG GTACAGCCTGGGGGTCCCTGAGACTCTCCTGTG CAGCCTCTGGATTCACCTTCAGTAGCAATAGCAT GAACTGGGTCCGCCAGGCTCCAGGGAAGGGGCT GGAGTGGGTTTCATACATTAGTAGTAGTAGTAGT ACCATATACTACGCAGACTCTGTGAAGGGCCGAT TCACCATCTCCAGAGACAACGCCAAGAACTCACT GTATCTGCAAATGAACAGCCTGAGAGACGAGGA CAGGCTGTGTATTACTGTGCGAGAGGAGGTGGG AGCCCTTTTGACTACTGGGGCCAGGGAACCCTGG TCACCGTCTCCTCA |
| | | | SEQ ID NO: 24965 | SEQ ID NO: 28971 |

FIGURE 50
(Continued)

| | | | | |
|---|---|---|---|---|
| | | AA | DIQMTQSPSSLSASVGDRVTITCRASQGISYYLA WFQQKPGKAPKSLIYVASSLQSGVPSKFSGSGSG TDFTLTISSLQPEDFATYYCQQYNSYPFTFGPGT KVDIN<br>SEQ ID NO: 24966 | EVQLVESGGGLVQPGGSLRLSCAASGFTFSSNSMN WVRQAPGKGLEWVSYISSSSTIYYADSVKGRFTIA RDNAKNSLYLQMNSLRDEDTAVYYCARGGGSPFD YWGQGTLVTVSS<br>SEQ ID NO: 28972 |
| iPS:393994 | 21-225_8C9 | NA | GACATCCAGATGACCCAGTCTCCATCCTCCCT GTCTGCATCTATAGGAGACAGAGTCACCATCA CTTGCCGGGCAAGTCAGGCCATTAGAAATGAT TTAGACTGGTATCAGCAGAAACCAGGGAAAG CCCCTAAGCGCCTTATCTATGCTGCATCCAGTT TGCAAAGTGGGGTCCCATCAAGGTTCAGCGGC AGTGGATCTGGGACAGAATTCACTCTCACAAT CAGCAGCCTGCAGACTGAAGATTTTGCAACTT ATTACTGTCTACAGCATAATAGTTATCCGCTC ACTTTCGGCGGAGGGACCAAGGTGGAGATCA AA<br>SEQ ID NO: 24967 | CAGGTGCAGCTGGTGGAGTCTGGGGGAGGCGTG GTCCAGCCTGGGAGGTCCCTGAGACTCTCCTGTG CAGCGTCTGATTCACCTTCAGTAGTAGTAGCAT GCACTGGGTCCGCCAGGCTCCAGGCAAGGGGCT GGAGTGGGTGGCAGTTATATGTGTATGATGAAAAT AATAAATACTATGTAGACTCCGTGAAGGGCCGAT TCACCATCTCCAGAGACAACTCCAAGAACACGCT GTATCTGCAAATGAACAGCCTGAGAGCCGAGGA CACGGCTGTGTATTACTGTGCGAGAGAATTGGGG TTCCGGTCTGACTACTGGGGCCAGGGAACCCTGG TCACCGTCTCCTCA<br>SEQ ID NO: 28973 |
| | | AA | DIQMTQSPSSLSASIGDRVTITCRASQAIRNDLD WYQQKPGKAPKRLIYAASSLQSGVPSRFSGSGS GTEFTLTISSLQTEDFATYYCLQHNSYPLTFGGG TKVEIK<br>SEQ ID NO: 24968 | QVQLVESGGGVVQPGRSLRLSCAASGFTFSSYGMH WVRQAPGKGLEWVAVIWYDENNKYYVDSVKGRF TISRDNSKNTLYLQMNSLRAEDTAVYYCARELGFR SDYWGQGTLVTVSS<br>SEQ ID NO: 28974 |

FIGURE 50
(Continued)

| | | | |
|---|---|---|---|
| iPS:393996 | 21-225_15C11 | NA | GACATCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAGCCAGGGAAAG TCCCTAAGCGCCTGATCTATCGTGCATCCAGT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACTGCATTATAGTTACCCTCGGA CGTTCGGCCAGGGACCAAGGTGGAAATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGCT GGAGTGGGTGGCAGTTATATGGTATGATGGAAGT AATAAATACTATGCAGACTCCGTGAAGGGCGA TTCACCATCTCCAGAGACAATTCCAAGAACACGC TGTATCTGCAAATGAACAGCCTGAGAGCCGAAG ACACGGCTGTGTATTACTGTGCGAGAGAGAAGTA TAGCAGCAGCTGGTACGACTACGGTTGGACGTC TGGGGCCAAGGGACCACGGTCACCGTCTCCTCA |
| | | | SEQ ID NO: 24969 | SEQ ID NO: 28975 |
| | | AA | DIQMTQSPSSLSASVGDRVTITCRASQGIRNDLG WYQQKPGKVPKRLIYAASSLQSGVPSRFSGSGS GTEFTLTISSLQPEDFATYYCLLHYSYPRTFGRGT KVEIK | QVQLVESGGGVVQPGRSLRLSCAASGFTFSDYVM HWVRQAPGKGLEWVAVIWYDGSNKYYADSVKGR FTISRDNSKNTLYLQMNSLRAEDTAVYYCAREKYS SSWYDYGLDVWGQGTTVTVSS |
| | | | SEQ ID NO: 24970 | SEQ ID NO: 28976 |
| iPS:393998 | 21-225_12B12 | NA | GACATCAGATGACCCAGTCTCCATCTCCCT GTCTGCGTCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATACTGCATCCAGT TTGCAAAGTGGGGGTCCCATCAAGGTTCAGCGG CAGTGGATCTGGGACAGAATTCACTCTCACAA TCAGCAGCCTGCAGACATAGAATTTGCAACT TATTACTGTCTACAACATAGTTACCCGTG GACGTTCGGCCAGGGACCAAGGTGGTCATCA AA | CAGGTGCAACTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGCT GGAGTGGATGGCAGTTATATGGTATGATGTAACT TTCACCATCTCCAGAGACAATTCCAAGAACACGC TGTATCTGCAAATGAACAGCCTGAGAGCCGAGG ACACGGCTGTTTATTACTGTGCGAGAGAGCTTGG CTGGTACGAGGACTACTGTGGGCCAGGGAGAGCCCT GGTCACCGTCTCCTCA |
| | | | SEQ ID NO: 24971 | SEQ ID NO: 28977 |

FIGURE 50
(Continued)

| | | | |
|---|---|---|---|
| iPS:394000 | 21-225_11A2 | AA | DIQMTQSPSSLSASVGDRVTITCRASQGIRNDLG WYQQKPGKAPKRLIYTASSLQSGVPSRFSGSGSG TEFTLTISSLQPEDFATYYCLQHNSYPWTFGLGT KVVIK<br>SEQ ID NO: 24972 | QVQLVESGGGVVQPGRSLRLSCAASGFTFSDYGM HWVRQAPGKGLEWMAVIWYDVTNKYYADSVKG RFTISRDNSKNTLYLQMNSLRAEDTAVYYCARELG WYEDYWGQGTLVTVSS<br>SEQ ID NO: 28978 |
| | | NA | GACATCCAGATGACCCAGTCTCCATCCTCCCT GTCTGCATCTGTAGGAGACAGAGTCACCATCA CTTGCCAGGCGAGTCAGGACATTAGCAACTAT TTAAATTGGTATCAGCAGAAACCAGGGAAAG CCCCTAAGCTCCTGATCTACGATGCATCCAAT TTGGAAACAGGGGTCCCCTCAAGATTCAGTGG AAGTGGATCTGGGACAGATTTTACTTTCACCA TCAGCAGCCTGCAACCTGAAGATGTTGCAACA TATTACTGTCAACAGTATGATAATCTCCGAT CACCTTCGGCCAAGGGGACACGACTGGACATTA AA<br>SEQ ID NO: 24973 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATCATATGGTGGAAGT AATAAAGACTCTGCAGACTCCGTGAAGGGCCGA TTCATCATCTCCAGAGACAATTCCAAGAACACGC TGTATCTGCAAATGAACAGCCTGAGAGCTGAGG ACACGGCTGTGTATTACTGTGTGAGACGGGATA CAGCTATGGCGGGTACGGTATGGACGTCTGGGG CCAAGGGACCACGGTCACCGTCTCCTCA<br>SEQ ID NO: 28979 |
| | | AA | DIQMTQSPSSLSASVGDRVTITCQASQDISNYLN WYQQKPGKAPKLLIYDASNLETGVPSRFSGSGS GTDFTFTISSLQPEDVATYYCQQYDNLPITFGQG TRLDIK<br>SEQ ID NO: 24974 | QVQLVESGGGVVQPGRSLRLSCAASGFTFSSYGMH WVRQAPGKGLEWVAVISYGGSNKDSADSVKGRFII SRDNSKNTLYLQMNSLRAEDTAVYYCVRRGYSYG GYGMDVWGQGTTVTVSS<br>SEQ ID NO: 28980 |

FIGURE 50
(Continued)

| | | | |
|---|---|---|---|
| iPS:394002 | 21-225_15G7 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGATCCCATCAAGGTTCAGCGG CAGTGGATTTGGGACAGAATTCACTCTCACAA TCAGCAGCCTGCAGCCTGAAGATTTTGCAACT TATTACTGTCTACAGCATAGTAATTACCCTCTC ACTTTCGGCGGAGGGACCAAGGTGGAGATCA AA<br><br>SEQ ID NO: 24975 | CAGCTGCAGTCGCAGGAGTCGGGCCCAGGACTG GTGAAGCCTTCGGAGACCCTGTCCCTCACCTGCA CTGTCTCTGGTGGCTCCATCAGCAGGAGTAGTTC CTACTGGGCTGGATCCGCCAGCCCCCAGGAA GGGACTGGAGTGGATTGGGAGTATCTATTATAGT GGGTACACCTATTACACCCCGTCCCTCAAGAGTC GAGTCACCATATCCGTGGACACGTCCAAGAACC AGTTCTCCCTGAGGCTGAGCTCTGTGACCGCCGC AGACACGGCTTCGTATTACTGTGCGAGACTGAGC AGCAGTTGGTCTTTTGACTTCTGGGGCCAGGGAA CCCTGGTCACCGTCCTCA<br><br>SEQ ID NO: 28981 |
| | | AA | DIQMTQSPSSLSASVGDRVTITCRASQGIRNDLG WYQQKPGKAPKRLIYAASSLQSGIPSRFSGSGFG TEFTLTISSLQPEDFATYYCLQHSNYPLTFGGGT KVEIK<br><br>SEQ ID NO: 24976 | QLQLQESGPGLVKPSETLSLTCTVSGGSISRSSSYW GWIRQPPGKGLEWIGSIYYSGYTYTPSLKSRVTIS VDTSKNQFSLRLSSVTAADTASYYCARLSSSWSFD FWGQGTLVTVSS<br><br>SEQ ID NO: 28982 |
| iPS:394004 | 21-225_13A1 | NA | CAGGTGCAGCTGGTGGAGTCTGGGGGAGGCGTG GTCCAGCCTGGGAGGTCCCTGAGACTCTCCTGTG CAGCCTCTGGATTCACCTTCAGCAGCTATGGCAT GCACTGGGTCCGCCAGGCTCCAGGCAAGGGCT GGAGTGGGTGGCAGTTATATCATATGCGGGAACT AATCAATACTATGCAGACTCCGTGAAGGGCCGAT TCACCATTTCCAAATGAACAGCCTGAGAACACGCT CTATCTGCAAATGTTATTATTGTGTGAGACGGGATAC ACGGCTGTTATTATTGTGTGAGACGGGGATAC AGTAGCGGGTACGGTATGGACGTCTGGGGC CAAGGGACCACGGTCACCGTCTCCTCA<br><br>SEQ ID NO: 28983 |

FIGURE 50
(Continued)

| | | | | |
|---|---|---|---|---|
| | | AA | DIQMTQSPSSLSASVGDRVTITCQASQDINNYLN WYQQKLGTAPKLLIYDGSNLETGVPSRFSGSGS GTDFTFTISSLQPEDIATYYCQQYENLPITFGQGT RLEIK<br>SEQ ID NO: 24978 | QVQLVESGGGVVQPGRSLRLSCAASGFTFSSYGMH WVRQAPGKGLEWVAVISYAGTNQYYADSVKGRF TISRDNSKNTLYLQMNSLRAEDTAVYYCVRRGYSY GGYGMDVWGQGTTVTVSS<br>SEQ ID NO: 28984 |
| iPS:394006 | 21-225_15C2 | NA | GACATCCAGATGACCCAGTCTCCATCCTCCCT GTCTGCATCTGTAGGAGACAGAGTCACCATCA CTTGCCAGGCGAGTCAGGACATTAACAACTAT TTAAATTGGTATCAGCAGAAACCAGGAAAG CCCCTAACCTCCTGATCTACGATGCATCCAATT TGGAAACAGGGGTCCCATCAAGGTTCAGTGGA AGTGGATCTGGGACAGCCTGCAGATTTACTTTCACCAT CAGCAGCCTGCAGCCTGAAGATATTGCGACAT ATTACTGTCAACAGTATGATAATCTCCCGATC ACCTTCGCCCAAGGACACGACTGGAGATTAA A<br>SEQ ID NO: 24979 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGTCAATAATATCATATGGTGACGT AATAATCACTATGCAGACTCCGTGAAGGGCCGAT TCACCATCTCCAGAGACAATGAACAGCTGAAGCT GTATCTGCAAATGAACAGCCTGAGAGCTGAGGA CACGGCTGTGTATTACTGTGTGAGACGGGATAC AGTCTATGGCGGTACGGTATGGACGTCTGGGGC CAAGGGACCACGGTCACCGTCTCCTCA<br>SEQ ID NO: 28985 |
| | | AA | DIQMTQSPSSLSASVGDRVTITCQASQDITNYLN WYQQKPGKAPNLLIYDASNLETGVPSRFSGSGS GTDFTFTISSLQPEDIATYYCQQYDNLPITFAQGT RLEIK<br>SEQ ID NO: 24980 | QVQLVESGGGVVQPGRSLRLSCAASGFTFSSYGMH WVRQAPGKGLEWVSIISYGGRNNHYADSVKGRFTI SRDNSKNTLYLQMNSLRAEDTAVYYCVRRGYSYG GYGMDVWGQGTTVTVSS<br>SEQ ID NO: 28986 |

FIGURE 50
(Continued)

| | | | | |
|---|---|---|---|---|
| iPS:394008 | 21-225_15H8 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTTTGCTGCATCCAGTT TGCAAAGTGGGCGTCCCATCACGGTTCAGCGGC AGTGGATCTGGGACAGAATTCACTCTCACAAT CAGCAGCCTGCAGCCTGAAGATTTTGCAACTT ATTACTGTCTACAGCATAATAGTTACCCGCTC ACTTTCGGCGGAGGGACCAAGGTGGAGATCA GA SEQ ID NO: 24981 | GAGGTGCAGCTGGTGGAGTCTGGGGGAGGCTG GTCAAGCCTGGGGGGTCCCTGAGACTCTCCTGTG CAGCCTCTGGATTCACCTTCAGCAGCTATGTCAT GAACTGGGTCCGCCAGGCTCCAGGGAAGGGGCT GGAGTGGGTCTCATCCATTAGTGGTAGTAGTACT TACATATACTGCGCAGACTCAATCAAGGGCCGAT TCACCATCTCCCGAGACAACGCCAAGAACTCTCT GTATCTGCAAATGAACAGCCTGAGAGCCGATGA CACGGCTGTGTATTACTGTGCGAGAGATCGAGGC TCCATCTGGGGCCAAGGGACAATGGTCACCGTCT CTTCA SEQ ID NO: 28987 |
| | | AA | DIQMTQSPSSLSASVGDRVTITCRASQGIRNDLG WYQQKPGKAPKRLIFAASSLQSGVPSRFSGSGSG TEFTLTISSLQPEDFATYYCLQHNSYPLTFGGGT KVEIR SEQ ID NO: 24982 | EVQLVESGGGLVKPGGSLRLSCAASGFTFSSYVMN WVRQAPGKGLEWVSSISGSSTYIYCADSIKGRFTIS RDNAKNSLYLQMNSLRADDTAVYYCARDRGSIWG QGTMVTVSS SEQ ID NO: 28988 |
| iPS:394010 | 21-225_12G5 | NA | GACATCCAGATGACCCAGTCTCCATCTCCCT GTCTGCCTCTGTAGGAGACAGAGTCACCATCC CTTGCCGGGCGAGTCAGGACAGTCAGATTAGCAATTAT TTAGCCTGGTATCAGCAGAAACCAGGGAAAGT TCCTAAGCTCCTGATCTATGCTGCATCCAATTT GCAATCAGGGGTCCCATCTCGGTTCAGTGGCA GTGGATCTGGGACAGATTTCACTCTCACCATC AGCAGCCTGCAGCCTGAAGATATTGCAGCTIA TTACTGTCAAAAGTATGACAGTGCCCATTCA CTTTCGGCCCTGGGACCAAAGTGGATATCAAA SEQ ID NO: 24983 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAACTAATGGCAT CTACTGGGTCCGCCAGGCTCCAGGCAAGGGGCT GGAGTGGGTGGCAGTTATATCATATGATGAAGT AATAAATACTATGCAGAGACAATTCCAAGAACACGC TTCACCATCTCCAAGAGACAATTCCAAGAACACGC TGTATCTGCAAATGAACAGCCTGAGAGCTGAGG ACACGGCTGTGTATTACTGTGCGAGAGATCGGGG AGCAGTGGCTGCTACTACTACGGTATAGAC GTCTGGGGCCAAGGGACCACGGTCACCGTCTCCT CA SEQ ID NO: 28989 |

FIGURE 50
(Continued)

| | | | | |
|---|---|---|---|---|
| iPS:394012 | | AA | DIQMTQSPSSLSASVGDRVTIPCRASQDISNYLA WYQQKPGKVPKLLIYAAYILQSGVPSRFSGSGSG TDFTLTISSLQPEDVAAYYCQKYDSAPFTFGPGT KVDIK<br><br>SEQ ID NO: 24984 | QVQLVESGGGVVQPGRSLRLSCAASGFTFSNYGIY WVRQAPGKGLEWVAVISYDGSNKYYADSVKGRFT ISRDNSKNTLYLQMNSLRAEDTAVYYCARDRGAV AAYYYYGIDVWGQGTTVTVSS<br><br>SEQ ID NO: 28990 |
| | 21-225_15A3 | NA | GACATCCAGATGACCCAGTCTCCATCCTCCCT GTCTGCATCTGTAGGAGACAGAGTCACCATCA CTTGCCGGGCAAGTCAGAGCATTATCAGCTAT TTAAATTGGTATCTGCAGAAACCAGGGAAAGC CCCTAAGTTCCTGATCTATACTGCATCCAGTTT GCAAAGTGGGGTCCATCAAGGTTCAGTGGCA GTGGATCTGGGACAGATTTCACTCTCACCATC AGCAGTCTGCAACTGAAGATTTTGCAACTTA CTACTGTCAACAGACTTACAGTACCCCGCTCA CTTTCGGCGGAGGGACCAAGGTGGAGATCAA G<br><br>SEQ ID NO: 24985 | CAGGTGCAGCTGGTGGAGTCTGGGGGAGGCGTG GTCCAGCCTGGGAGGTCCCTGAGACTCTCCTGTG CAGCCGTCTGGATTCACCTTCAGTAGCTATGGCAT TCACTGGGTCCGCCAGGCTCCAGGCAAGGGCT GGAGTGGGTGGCAGTTATATGCATGATGGAAG TAATAAATACTATGCAGACTCCGTGAAGGGCCG ATTCACCATCTCCAGAGACACAATTCCAAGAACACG CTGTATCTGCAAATGAACAGCCTGAGAGCCGAG GACACGGCTGTGTATTACTGTGCGAGAGATCTGA GTATGGGCGGTATGGACGTCTGGGGCCAAGGGA CCACGGTCACCGTCTCCTCA<br><br>SEQ ID NO: 28991 |
| | | AA | DIQMTQSPSSLSASVGDRVTITCRASQSIISYLNW YLQKPGKAPKFLIYTASSLQSGVPSRFSGSGSGT DFTLTISSLQPEDFATYYCQQTYSTPLTFGGGTK VEIK<br><br>SEQ ID NO: 24986 | QVQLVESGGGVVQPGRSLRLSCAASGFTFSSYGIH WVRQAPGKGLEWVAVIWHDGSNKYYADSVKGRF TISRDNSKNTLYLQMNSLRAEDTAVYYCARDLSM GGMDVWGQGTTVTVSS<br><br>SEQ ID NO: 28992 |

FIGURE 50
(Continued)

| | | | |
|---|---|---|---|
| iPS:394014 | 21-225_8G6 | NA | GACATCCAGATGACCCAGTCTCCATCTCCCT GTCTGCATCTGTAGGAGACAGAGTCACCATCA CTTGCCGGGCAAGTCAGAGCATTAGTAGTTAT TTAAATTGGTATCAGCAGAAACCAGGGAAAG CCCCCAAGCTCCTGATCTTTGCTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTTCTGTCAACAGAGTTACAGAACCCCTTT TTCACTTTCGGCCCTGGGACCAAAGTGGATAT CAAA SEQ ID NO: 24987 | GAGGTGCAGCTGTTGGAGTCTGGGGAGGCTTG GTACAGCCTGGGGGGTCCCTGAGACTCTCCTGTG TAGCCTCTGAATTCACCTTTAGCAGCTATGTCAT GAACTGGGTCCGCCAGGCTCCAGGGAAGGGCT GGAGTGGGTCTCAGTTATTAGTGGTCGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGTCCCGTTTGGCA GTGGCTGGCTCGGAGGCTTTTGATATCTGGGGCC AAGGGACAATGGTCAGCGTCTTCA SEQ ID NO: 28993 |
| | | AA | DIQMTQSPSSLSASVGDRVTITCRASQSISSYLNW YQQKPGKAPKLLIFAASSLQSGVPSRFSGSGSGT DFTLTISSLQPEDFATYFCQQSYRTPFFTFGPGTK VDIK SEQ ID NO: 24988 | EVQLLESGGGLVQPGGSLRLSCVASEFTFSSYVMN WVRQAPGKGLEWVSVISGRGGNTFYADSVKGRFTI SRDNSKNTLYLQMNSLRAEDTAVYYCASRLAVAG SEAFDIWGQGTMVSVSS SEQ ID NO: 28994 |
| iPS:394016 | 21-225_13D4 | NA | GACCTCCAGATGACCCAGTCTCCATCCTCCCT GTCTGCATCTGTAGGAGACCGAGTCACCATCA CTTGCCGGGCAAGTCAGAGCATTTTCAGCTAC TTAAATTGGTATCAGCAGAAACCAGGGAAAG CCCCTAAGCTCCTGATCTGTACTGCATCCAGTT TGCAAAATGGGGTCCCATCAAGGTTCAGTGGC AGTGGATCTGGGACAGATTTCACTCTCACCAT CAGCAGTCTACAGCCTGAGGATTTTGCAACTT ACTACTGTCAACAGCTTACAGTCTTCCGCTC ACTTTCGGCGGAGGGACCAAGGTGGAGATCA AA SEQ ID NO: 24989 | CAGGTGCAGCTGGTGGAGTCTGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGAGATCTGA GTATGGGCGGTATGGACGTCTGGGGCCAAGGGA CCACGGTCACCGTCTCCTCA SEQ ID NO: 28995 |

FIGURE 50
(Continued)

| | | | | |
|---|---|---|---|---|
| iPS:394018 | 21-225_15B1 | AA | DLQMTQSPSSLSASVGDRVTITCRASQSIFSYLN WYQQKPGKAPKLLICTASSLQNGVPSRFSGSGS GTDFTLTISSLQPEDFATYYCQQTYSLPLTFGGG TKVEIK<br>SEQ ID NO: 24990 | QVQLVESGGGVVQPGRSLRLSCAASGFTFSSYGMH WVRQAPGKGLEWVAVIWHDGSNKYYADSVKGRF TISRDNSKNTLYLQMNSLRAEDTAVYYCARDLSM GGMDYWGQGTLVTVSS<br>SEQ ID NO: 28996 |
| | | NA | GACATCCAGATGACCCAGTCTCCATCCTCACT GTCTGCATCTGTAGGAGACAGAGTCACCATCA CTTGTCGGGCGAGTCAGGGATTCAGCAATTAT TTAGCCTGGTTTCAGCAGAAACCAGGGAAAGC CCCTAAGTCCCTAATCTCTGCTGCATCCAGTTT GCAAAGTGGGGTCCCATCAAACTTCAGCGGCA GTGGATCTGGGACAGATTTCACTCTCACCATC AGCAGCCTGCAGCCTGAAGATTTTGCAACTTA TTACTGCCAACAGTATCATAGTTACCCATTCA CTTTCGGCCCTGGGACCAAAGTGGATATCAAA<br>SEQ ID NO: 24991 | GAGGTGCAGCTGTTGGAGTCTGGGGGAGGCTTG GTACAGCCGGGGGGGTCCCTGAGACTCTCCTGTG CAACCTCAGGATTCACCTTTAGCAGCTATGTCAT GAGCTGGGTCCGCCAGGCTCCAGGGAAGGGGCT GGAGTGGGTCTCAGTATTAGTGGTAGTGGTGGT AGCACAAACAACCAGACTCCGTGAAGGGCCGG TTCACCATCTCCAGAGACAATTCCAAGAACACGC TGTATCTGCAAGTGAACAGCTGAGAGCCGAGG ACACGGCCGTATATTACTGTGCCCGCAGTCTCTT GTTTGACTACTGGGGCCAGGGAACCCTGGTCACC GTCTCCTCA<br>SEQ ID NO: 28997 |
| | | AA | DIQMTQSPSSLSASVGDRVTITCRASQGISNYLA WFQQKPGKAPKSLISAASSLQSGVPSNFSGSGSG TDFTLTISSLQPEDFATYYCQQYHSYPFTFGPGT KVDIK<br>SEQ ID NO: 24992 | EVQLLESGGGLVQPGGSLRLSCATSGFTFSSYVMS WVRQAPGKGLEWVSGISGSGGSTNNADSVKGRFTI SRDNSKNTLYLQVNSLRAEDTAVYYCARSSLFDY WGQGTLVTVSS<br>SEQ ID NO: 28998 |

FIGURE 50
(Continued)

| | | | | |
|---|---|---|---|---|
| iPS:394020 | 21-225_15H10 | NA | GACATCCAGATGACCCAGTCTCCATCCTCCT GTCTGCATCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAAGT TATTACTGTCTACAGCATAATAGTTACCCGCTC ACTTTCGGCGGAGGGACCAAGGTGGAGATCA AT SEQ ID NO: 24993 | CAGGTGCAGCTGGTGGAGTCTGGGGGAGGCGTG GTCCAGCCTGGGAGGTCCCTGAGACTCTCTGTG CAGCGTCTGGATTCACCTTCAGTAACTATGGCAT GCACTGGGTCCGCCAGGCTCCAGGCAAGGGGCT GGAGTGGGTGGCAGTTATATGGTATGATGAAAGT AATAAATACTATGAAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGTGAGGAAGTGGG GTTTCTTTCTGACTACTGGGGCCAGGAATCCTG GTCACCGTCTCCTCA SEQ ID NO: 28999 |
| | | AA | DIQMTQSPSSLSASVGDRVTITCRASQGIRNDLG WYQQKPGKAPKRLIYAASSLQSGVPSRFSGSGS GTEFTLTISSLQPEDFASYYCLQHNSYPLTFGGGT KVEIN SEQ ID NO: 24994 | QVQLVESGGGVVQPGRSLRLSCAASGFTFSNYGM HWVRQAPGKGLEWVAVIWYDESNKYYEDSVKGR FTISRDNSKNTLYLQMNSLRAEDTAVYYCVREVGF LSDYWGQGILVTVSS SEQ ID NO: 29000 |
| iPS:394022 | 21-225_16H6 | NA | GACATCCAGATGACCCAGTCTCCATCCTCCCT GTCTGCATCTGTAGGAGACAGAGTCACCATCA CTTGCCGGGCAAGTCAGAACATTAGCAGTAT TTAAATTGGTATCAGCAGAAACCAGGGAAAG CCCCTAAGCTCCTGATCTATGCTGCATCCAGT TGCAAAGTGGGGTCCATCAAGGTTCAGTGGC AGAGGATCTGGGACAGAATTCACTCTCACCAT CAGTAGTCTGCAACAGAGTTACAGAACCCCTTA ACTACTGTCAACAGAGTTACAGAACCCCTTA TTCACTTTCGGCGGAGGGACCAAGGTTGATTTC AAA SEQ ID NO: 24995 | GAGGTGCAGCTGTTGGAGTCTGGGGGAGGCTTG GTACAGCCTGGGGGGTCCCTGAGACTCTCTGTG CAGCCTCTGGATTCACCTTTAGCAGTCAGTATCCAT GAACTGGGTCCGCCAGGCTCCAGGGATGGGGCT GGAGTGGGTCTCAGTTATTAGTCGTAGTGGTGGT TACACATACTACGCGGACTCCGTGAAGGGCCGGT TCACCATCTCCAGAGACAATTCCAAGAACACGCT GTATCTGCAAATGAACAGCTGAGAGCCGAGGA CACGGCCGTCTATTACTGTGCGTCCCGTTAGCA GTGGCTGGCTCGGAGGCTTTTGATATCTGGGGCC AAGGGACAATGGTCACCGTCTCTTCA SEQ ID NO: 29001 |

FIGURE 50
(Continued)

| | | | | |
|---|---|---|---|---|
| iPS:394024 | | AA | DIQMTQSPSSLSASVGDRVTITCRASQNISSYLN WYQQKPGKAPKLLIYAASSLQSGVPSRFSGRGS GTDFTLTISSLQPEDFATYYCQQSYRTPLTFGPG TKVDFK<br><br>SEQ ID NO: 24996 | EVQLLESGGGLVQPGGSLRLSCAASGFTFSSYAMN WVRQAPGMGLEWVSVISRSGGYTYADSVKGRFT ISRDNSKNTLYLQMNSLRAEDTAVYYCASRLAVAG SEAFDIWGQGTMVTVSS<br><br>SEQ ID NO: 29002 |
| | 21-225_16B7 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAGATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGTTCAA T<br><br>SEQ ID NO: 24997 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGAAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGGGAACTGGG GTTTCTCTGACTACTGGGGCCAGGGAACCCTG GTCACCGTCTCCTCA<br><br>SEQ ID NO: 29003 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEFN<br><br>SEQ ID NO: 24998 | QVQLVESGGGVVQPGRSLRLSCAASGFTFSSYGMH WVRQAPGKGLEWVAVIWYDESNKYYADSVKGRF TISRDNSKNTLYLQMNSLRAEDTAVYYCARELGFL SDYWGQGTLVTVSS<br><br>SEQ ID NO: 29004 |

FIGURE 50
(Continued)

| | | | |
|---|---|---|---|
| iPS:394026 | 21-225_16C7 | NA | GACATCCAGATGACCCAGTCTCCATCCTCACT GTCTGCATCTGTAGGAGACAGAGTCACCATCA CTTGTCGGGCGAGTCAGGCATTAGCAATTAT TTAGCCTGGTTTCAGCAGAAACCAGGAAAGC CCCTAAGTCCCTGATCTCTGCTGCATCCAGTTT GCAAAGTGGGGTCCATCAAAGTTCAGCGGCA GTGGATCTGGGACAGATTTCACTCTCACCATC AGCAGCCTGCAACAGTCTGAAGATTTTGCAACTTA TTACTGCCAACAGTATAATAGTTACCCATTCA CTTTCGGCCCTGGGACCAAAGTGGATATCAAA | GAGGTGCAACTGTTGGAGTCTGGGGGAGGCTTG GTACAGCCTGGGGGGTCCCTGAGACTCTCCTGTG CAGCCTCTGATTCACCTTTAGCAGTATGTCAT GACCTGGGTCCGCCAGGCTCCAGGGAAGGGGCT GGAGTGGGTCTCAACTATTAGTGGTAGTGGTGGT TGGACATATTATGCAGACTCCGTGAAGGGCCGGT TCACCATTTCCAGAGACAATTCAAGAACACGCT GTATCTGCAAATGAACAGCCTGAGAGCCGAGGA CACGGCCGAATATTACTGTGCCGCAGCTCTTG TTTGACTATTGGGGCCAGGGAACCCTGGTCACCG TCTCCTCA |
| | | | SEQ ID NO: 24999 |
| | | AA | DIQMTQSPSSLSASVGDRVTITCRASQGISNYLA WFQQKPGKAPKSLISAASSLQSGVPSKFSGSGSG TDFTLTISSLQPEDFATYYCQQYNSYPFTFGPGT KVDIK | EVQLLESGGGLVQPGGSLRLSCAASGFTFSSYVMT WVRQAPGKGLEWVSTISGSGGWTYYADSVKGRFT ISRDNSKNTLYLQMNSLRAEDTAEYYCARSSLFDY WGQGTLVTVSS |
| | | | SEQ ID NO: 25000 | SEQ ID NO: 29005 |
| iPS:394029 | 21-225_1B12 | NA | GACATCCAGATGACCCAGTCTCCATCCTCCCT GTCTGCATCTGTAGGAGACAGAGTCACCATCA CTTGCCAGGCGAGTCAGGACAGATTAACAACTAT TTAAATTGGTATCAACAGAAACCAGGGAAAG CCCCTAAGCTCCTGATATCGATGCATCCAAT TTGGAAACAGGGGTCCCATCAAGGTTCAGTGG AAGTGGATCTGGGACAGATTTTACTTTCACCA TCAGCAGTCTGCAGCCTGAAGATATTACAACA TATTACTGTCAACAGTATGAAAATCTCCCGAT CACCTTCGGCCAAGGGACACGACTGGAGATTA AA | CAGGTGCAGCTGGTAGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATATCATGCTGAAGT AATAAATCCTATGGAGACTCCGTGAAGGGCCGAT TCACCATCTCCAGAGACAATTCAAGAACATGCT GTATCTGCAAATGAACAGCCTGAGAGCTGAGGA CACGGCTGTGTATTACTGTGTGAGACGGGATAC AGCTATGGCGGTACGGTATGGACGTCTGGGGC CAAGGGGCCACGGTCACCGTCTCCTCA |
| | | | SEQ ID NO: 25001 | SEQ ID NO: 29007 |

FIGURE 50
(Continued)

| | | | | |
|---|---|---|---|---|
| iPS:394033 | 21-225_5F4 | AA | DIQMTQSPSSLSASVGDRVTITCQASQDINNYLN WYQQKPGKAPKLLIYDASNLETGVPSRFSGSGS GTDFTFTISSLQPEDITTYYCQQYENLPITFGQGT RLEIK<br>SEQ ID NO: 25002 | QVQLVESGGGVVQPGRSLRLSCAASGFTFSSYGMH WVRQAPGKGLEWVAIISYAGSNKSYADSVKGRFTI SRDNSKNMLYLQMNSLRAEDTAVYYCVRRGYSY GGYGMDVWGQGATVTVSS<br>SEQ ID NO: 29008 |
| | | NA | GACATCCAGATGACCCAGTCTCCATCCTCCCT GTCTGCATCTGTAGGAGACAGAGTCACCATCA CTTGCCGGGCAAGTCAGGGCATTCGAAATCAT TTAGGCTGGTATCAGCAGAAACCAGGGAAAG CCCCTAAGCGCCTGATCTATGCTGCCTCCAGTT TGCAAAGTGGGGTCCCATCAAGGTTCAGCGGC AGTGGATCTGGGACAGATTCACTCTCACAGT CAGCAGCCTGCAGCCTGAAGATTTTGCAACTT ATTACTGTCTACAGTATGAAAATGGTTACCATTCA CTTTCGGCCCTGGGACCAAAGTGGATATCAAA<br>SEQ ID NO: 25003 | GAGGTGCAGTTGGTGGAGTCTGGGGGAGGCTG GTCAAGCCTGGGGGGTCCCTGAGACTCTCCTGTG TAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGT TACATATACTACGCAGACTCAGTGAAGGGCCGAT TCACCATCTCCAGAGACAACAGCCAAGAACTCACT GTTTCTGCAAATGAACAGCCTGAGAGCCGAGA CACGGCTGTGTATTACTGTGCGAGAGTTAACAAC TTTGACTACTGGGGCCAGGGAACCCTGGTGTCACCG TCTCCTCA<br>SEQ ID NO: 29009 |
| | | AA | DIQMTQSPSSLSASVGDRVTITCRASQGIRNHLG WYQQKPGKAPKRLIYAASSLQSGVPSRFSGSGS GTEFTLTVSSLQPEDFATYYCLQYNGYPFTFGPG TKVDIK<br>SEQ ID NO: 25004 | EVQLVESGGGLVKPGGSLRLSCVASGFTFSSYSMN WVRQAPGKGLEWVSSISGSSSYIYYADSVKGRFTIS RDNAKNSLFLQMNSLRAEDTAVYYCARVNNFDY WGQGTLVTVSS<br>SEQ ID NO: 29010 |

FIGURE 50
(Continued)

| | | | | |
|---|---|---|---|---|
| iPS:394035 | 21-225_5G9 | NA | GACATCCAGATGACCCAGTCTCCATCCTCCCT GTCTGCATCTGTAGGAGACAGAGTCACCATCA CTTGCCAGGCGAGTCAGGCATTAGCAACTCT TTAAATTGGTATCAGCAGAAACCAGGAAAAG CCCCTAAACTCCTGATCTACGATGCATCCAAT TTGGAAACAGGGGTCCCATCAAGGTTCAGTGG AAGTGGAGCTGGGACAGATTTTACTTTCACCA TCAGCAGCCTGCAGCCTGAAGATATTGCAACA TATTACTGTCAACAAATATGATAATCTCCCGCTC ACTTTCGGCGGAGGGACCAAGGTGGAGATCA AA<br><br>SEQ ID NO: 25005 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAATTATGGCAT GCACTGGGTCCGCCAGGCTCCAGGCAAGGGCT GGAGTGGGTGGCAATTATATCATATGCTGGAAGT AATAAATACTATGCAGACTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGTGAGACGTATAAC AGCTCGTCTCTACTACGGTATGGACGTCTGGGGC CAAGGGACCACGGTCACCGTCTCCTCA<br><br>SEQ ID NO: 29011 |
| | | AA | DIQMTQSPSSLSASVGDRVTITCQASQGISNSLN WYQQKPGKAPKLLIYDASNLETGVPSRFSGSGA GTDFTFTISSLQPEDIATYYCQQYDNLPLTFGGG TKVEIK<br><br>SEQ ID NO: 25006 | QVQLVESGGGVVQPGRSLRLSCAASGFTFSNYGM HWVRQAPGKGLEWVAIISYAGSNKYYADSVKGRF TISRDNSKNTLYLQMNSLRAEDTAVYYCVRRITAR LYYGMDVWGQGTTVTVSS<br><br>SEQ ID NO: 29012 |
| iPS:394037 | 21-225_4F4 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCGTCAGT GTGCAAACTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA<br><br>SEQ ID NO: 25007 | CAGCTGCAGCTGCAGGAGTCGGGCCCAGGACTG GTGAAGGCCTTCGGAGACCCTGTCCCTCACCTGCA CTGTCTCTGGTGGCTCCATCAGTAGGAGTAGTTA CTACTGGGGCTGGATCCGCCAGCCCCCAGGAAA GGGAGCACTACGACAACCCGTCCCTCAAGAGT CGAGTCACCATATCCGTAGACACGTCCAAGAACC AGTTCTCCCTGAAGCTGAGCTCTGTGACCGCCGC GGACACGGCTGTTTATTACTGTGCGAGACATGGA AAAGACTGGGGCCTTGACTACTGGGGCCAGGGA ACCCTGGTCACCGTCTCCTCA<br><br>SEQ ID NO: 29013 |

FIGURE 50
(Continued)

| | | | | |
|---|---|---|---|---|
| iPS:394041 | | AA | DIQMTQSPSSLSASVGDRVTITCRASQGIRNDLG WYQQKPGKAPKRLIYAASSVQTGVPSRFSGSGS GTEFTLTISSLQPEDFAIYYCLQHNSYPLTFGGGT KVEIK<br><br>SEQ ID NO: 25008 | QLQLQESGPGLVRPSETLSLTCTVSGGSISRSSYYW GWIRQPPGKGLEWIGNIYYSGSTYDNPSLKSRVTIS VDTSKNQFSLKLSSVTAADTAVYYCGRHGKDWGL DYWGQGTLVTVSS<br><br>SEQ ID NO: 29014 |
| | 21-225_5E5 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA<br><br>SEQ ID NO: 25009 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTACGAGAGAGGTATA TAGCAGTGGCTGGTACGACTACGGTATGGACGTC TGGGGCCAAGGGACCACGGTCACCGTCTCCTCA<br><br>SEQ ID NO: 29015 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK<br><br>SEQ ID NO: 25010 | QVQLVESGGGVVQPGRSLRLSCAASGFTFSNYVM HWVRQAPGKGLEWVAVIWYDGSNKYADSVKGR FTISRDNSKNTLYLQMNSLRAEDTAVYYCTREVYS SGWYDYGMDVWGQGTTVTVSS<br><br>SEQ ID NO: 29016 |

FIGURE 50
(Continued)

| | | | |
|---|---|---|---|
| iPS:394043 | 21-225_3B1 | NA | GACATCCAGATGACCCAGTCTCCATCCTCCCT GTCTGCATCTGTAGGAGACAGAGTCACCATCA CTTGCCGGGCAAGTCAGAGTATTAATAATTAT TTAAATTGTATCAGCAGAAACCAGGGAAAG CCCCTAAGCTCCTGATCTATGCTACATCCAGTT TGCAAAATGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTACCCCTTA TTCACTTTCGGCCCTGGGACCAAAGTGGATAT CAAT<br><br>SEQ ID NO: 25011 | 
| | | | DIQMTQSPSSLSASVGDRVTITCRASQSINNYLN WYQQKPGKAPKLLIYATSSLQNGVPSRFSGSGS GTDFTLTISSLQPEDFATYYCQQSYSTPLFTFGPG TKVDIN<br><br>SEQ ID NO: 25012 |
| | | AA | EVQLLESGGGLVQPGGSLRLSCAASEFTFSSYAMN WVRQAPGKGLEWVSVISGRGINTFYADSVKGRFTI SRDNSKNTLYLQMNSLRAEDTAVYYCASRLAVAG SEAFDIWGQGTMVTVSS<br><br>SEQ ID NO: 29017 |
| | | | GAGGTGCAGCTGTTGGAGTCTGGGGGAGGCTTG GTACAGCCTGGGGGGTCCCTGAGACTCTCCTGTG CAGCCTCTGAATTCACCTTTAGCAGCTATGCCAT GAACTGGGTCCGCCAGGCTCCAGGGAAGGGGCT GGAGTGGGTCTCAGTTATTAGTGGTCGTGGTATT AACACATTCTACGCAGACTCCGTGAAGGGCCGGT TCACCATTTCCAGAGACAATTCCAAGAACACGCT GTATCTGCAAATGAACAGCCTGAGAGCCGAGGA CACGGCCGTATATTACTGTGCGTCCCGTTTAGCA GTGGCTGGCTGGAGGCTTTGATATCTGGGGCC AAGGGACAATGGTCACCGTCTCTTCA<br><br>SEQ ID NO: 29018 |
| iPS:394045 | 21-225_4H4 | NA | CAGCTGCAGCTGCAGGAGTCGGGCCCAGGACTG GTGAAGCCTTCGGAGACCCTGTCCCTCACCTGCA CTGTCTCTGGTGGCTCCATCAGTAGGAGTAGTTA CTACTGGGGCTGGATCCGCCAGCCCCAGGGATG GGGCTGGAATGGATTGGGAATATTATTATAGTG GGAACACCTACAACAACCCGTCCCTCAAGAGTC GAGTCACCATATCGTAGACACGTCCAAGAACC AGTTCTCCCTGAAGCTGAACTCTGTGACCGCCGC AGACACGGCTGTGTATTACTGTGGGAGACATGGA AAAGACTGGGGCCTTGACTACTGGGGCCAGGGA ACCCTGGTCATCGTCCTCA<br><br>SEQ ID NO: 25013 |

FIGURE 50
(Continued)

| | | | | |
|---|---|---|---|---|
| iPS:394047 | | AA | DIQMTQSPSSLSASVGDRVTITCRASQGIRNDLGWYQQKPGKAPKRLIYAASSVQSGVPSRFSGSGSGTEFTLTISSLQPEDFAIYYCLQHNSYPLTFGGGTKVEIK<br>SEQ ID NO: 25014 | QLQLQESGPGLVKPSETLSLTCTVSGGSISRSSYYWGWIRQPPGMGLEWIGNIYYSGNTYNNPSLKSRVTISVDTSKNQFSLKLNSVTAADTAVYYCGRHGKDWGLDYWGQGTLVTVSS<br>SEQ ID NO: 29020 |
| | | NA | GACATCCAGATGACCCAGTCTCCATCCTCCCTGTCTGCATCTGTAGGAGACAGAGTCACCATCACTTGCCAGGCGAGTCAGGACATTAACAACTATTTAAATTGGTATCAACAGAAACCAGGGAAAGCCCCTAAGCTCTTGATATACGATGCATCCAATTTGGAAACAGGGGTCCCATCAAGGTTCAGTGGAAGTGGATCTGGGACAGATTTTACTTTCACCATCAGCAGCCTGCAGCCTGAAACAGTATTGCAACATATTACTGTCAACAGTATGATAATCTCCCGATCACCTTCGGCCAAGGGACACGACTGGAGATTAAA<br>SEQ ID NO: 25015 | CAGGTGCAGCTGGTGGAGTCTGGGGGAGGCGTGGTCCAGCCTGGGAGGTCCCTGAGACTCTCCTGTGCAGCCTCTGGATTCACCTTCAGTAGCTATGGCATGCACTGGGTCCGCCAGGCTCCAGGCAAGGGGCTGGAGTGGGTGGCAATTATATCAGATGGAAGTAATAAATACTATGCAGACTCCGTGAAGGGCCGATTCACCATCTCCAGAGACAATTCCAAGAACACGCTGTATCTGCAAATGAACAGCCTGAGAGTTGAGGACACGGCTGTGTATTACTGTGCGAGACGGGGATACAGCTATGGCGGGTACGGTATGGACGTCTGGGGCCAAGGGACCACGGTCACCGTCTCCTCA<br>SEQ ID NO: 29021 |
| | 21-225_5E6 | AA | DIQMTQSPSSLSASVGDRVTITCQASQDINNYLNWCQQKPGKAPKLLIYDASNLETGVPSRFSGSGSGTDFTFTISSLQPEDIATYYCQQYDNLPITFGQGTRLEIK<br>SEQ ID NO: 25016 | QVQLVESGGGVVQPGRSLRLSCAASGFTESSYGMHWVRQAPGKGLEWVAIISYVGNNKYYADSVKGRFTISRDNSKNTLYLQMNSLRVEDTAVYYCARRGYSYGGYGMDVWGQGTTVTVSS<br>SEQ ID NO: 29022 |

FIGURE 50
(Continued)

| | | | |
|---|---|---|---|
| iPS:394049 | 21-225_13H5 | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAACTGGGGTCCCATCAAGATTCAGCGG CAGTGGATCTGGGACAGATTCATTCTCACAA TCAGCAGCCTGCAGCCTGAAGATTTTGCAACT TATTACTGTCTACAGCATAATAGTTACCCTCTC ACTTTCGGCGGAGGGACCAAGGTGGAGATCA AA<br><br>SEQ ID NO: 25017 | CAGCTGCAGCTGCAGGAGTCGGGCCCAGGACTG GTGAAGCCTGCGGAGACCCTGTCCCTCACCTGCA CTGTCTCTGGTGGCTCCATCAGCAGAAGTAGTTA CTACTGGGGCTGGATCCGCCAGCCCCAGGGAA GGGGAGCACCTACTACAACCGTCCCTCAAGAGTC GAGTCACCATATCCGTGGACACGTCCAAGAACC AGTTCTCCCTGAAGCTGAGCTGTGTGACCGCCGC AGACACGGCTGTGTATTACTGTGCGAGCCTTAGC AGCAGCTGGGACTTCCAGCACTGGGGCCAGGGC ACCCTGGTCACCGTCTCCTCA<br><br>SEQ ID NO: 29023 |
| | | AA | DIQMTQSPSSLSASVGDRVTITCRASQGIRNDLG WYQQKPGKAPKRLIYAASSLQTGVPSRFSGSGS GTEFILTISSLQPEDFATYYCLQHNSYPLTFGGGT KVEIK<br><br>SEQ ID NO: 25018 | QLQLQESGPGLVKPAETLSLTCTVSGGSISRSSYYW GWIRQPPGKGLEWIGSIYYSGSTYYNPSLKSRVTIS VDTSKNQFSLKLSSVTAADTAVYYCASLSSSWDFQ HWGQGTLVTVSS<br><br>SEQ ID NO: 29024 |
| iPS:394051 | 21-225_9E5 | NA | GACATCCAGATGACCCAGTCTCAATCTCCCT GTCTGCATCTGTAGGAGACAGAGTCACCATCA CTTGCCGGGCAAGTCAGAGCATTGCCAGTTAT TTAAATTGGTATCAGCAGAAACCAGGGAAAG CCCCTAAACTCCTGATCTATGGTGCATCCAGTT TGCAAAGTGGGGTCCCATCAAGGTTCAGTGGC AGTGGATCTGGGACAGATTTCACTCTCACCAT CAGCAGTCTCCAACCTGAAGATTTTGCAACTT ACTACTGTCAACAGAGTTACAGTACCCCTTA TTCAGTTCGGCCCTGGGACCAAAGTGGATAT CAAA<br><br>SEQ ID NO: 25019 | GAGGTGCAGCTGTTGGAGTCTGGGGGAGGCTTG GTACAGCCTGGGGGGTCCCTGAGACTCTCCTGTG CAGCCTCTGGATTCACCTTTAGCAACTATGCCAT GAACTGGGTCCGCCAGGCTCCAGGGAAGGGGCT GGAGTGGGTCTCAGCTATTAGTGGTGGTGGTGGT AACAATTCTACGCAGACTCCGTGAAGGGCCGGT TCACCATCTCCAGAGACAATTCCAAGAACACGCT GTATCTGCAAATGAACGGCCTGAGAGCCGAGGA CACGGCCGTATATTACTGTGCCGTATAGCA GTGGTGGCTCGGAGGCTTTGCTATCTGGGGCC AAGGGACATTGGTCACCGTCTCTTCA<br><br>SEQ ID NO: 29025 |

FIGURE 50
(Continued)

| | | | | |
|---|---|---|---|---|
| | | AA | DIQMTQSQSSLSASVGDRVTITCRASQSIASYLN WYQQKPGKAPKLLIYGASSLQSGVPSRFSGSGS GTDFTLTISSLQPEDFATYYCQQSYSTPLFSFGPG TKVDIK<br><br>SEQ ID NO: 25020 | EVQLLESGGGLVQPGGSLRLSCAASGFTFSNYAMN WVRQAPGKGLEWVSAISGGGNTFYADSVKGRFT ISRDNSKNTLYLQMNGLRAEDTAVYYCASRIAVAG SEAFAIWGQGTLVTVSS<br><br>SEQ ID NO: 29026 |
| iPS:394053 | 21-225_11F10 | NA | CAGATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTACAAAGTGGGGTCCCATCAAGGTTCAGCGG CAGTGGTTCTGGGACAGAATTCACTCTCACAG TCAGCAGCCTGCAGCCTGAAGATTTTGCAACT TATTACTGTCTACAGCATAGTAGTTACCCTCTC ACTTTCGGCGGAGGGACCAAGGTGGAGATCA AA<br><br>SEQ ID NO: 25021 | CAGCTGCATCTGCAGGAGTCGGGCCCAGGACTG GTGAAGCCTTCGGAGACCCTGTCCTCACCTGCA CTGTCTCTGGTGCCTCCATCAGCAGAAGTAGTTA CTACTGGGGCTGGATCCGCCAGCCCCCAGGGAA GGGGAGCGCCCAGTACAACCGTCCCTCAAGAGT CGAGTCACCATATCCGTAGACACGTCCAAGAACC AGTTCTCCCTGACGCTGAGCTGTGCGAGACTGAGC AGACACGGCTGTATATTACTGTGCGAGACTGAGC AGCAGCTGGTCTTTTGACTACTGGGGCCAGGGAA CCCTGGTCACCGTCTCCTCA<br><br>SEQ ID NO: 29027 |
| | | AA | DIQMTQSPSSLSASVGDRVTITCRASQGIRNDLG WYQQKPGKAPKRLIYAASSLQSGVPSRFSGSGS GTEFTLTVSSLQPEDFATYYCLQHSSYPLTFGGG TKVEIK<br><br>SEQ ID NO: 25022 | QLHLQESGPGLVKPSETLSLTCTVSGASISRSSYYW GWIRQPPGKGLEWIGSIYYSGSAQYNPSLKSRVTIS VDTSKNQFSLTLSSVTAADTAVYYCARLSSSWSFD YWGQGTLVTVSS<br><br>SEQ ID NO: 29028 |

FIGURE 50
(Continued)

| | | | |
|---|---|---|---|
| iPS:394055 | 21-225_9C8 | NA | GACATCCAGATGACCCAGTCTCCATCCTCCACT GTCTGCATCTGTAGGAGACAGAGTCACCATCA CTTGTCGGGCGAGTCAGGGCATTAGTATTAT TAGCCTGGTTTCAGCAGAAACCAGGGAAAGC CCCTAAGTCCCTGATCTATGTTGCATCCAGTTT GCAAAGTGGGGTCCCATCAAAGTTCAGCGGCA GTGGATCTGGGACAGATTTCACTCTCACCATC AGCAGCCTGCAACAGTATGATAGTTTGCAACTTA TTACTGCCAACAGTATGATAGTTACCCATTCA CTTTCGGCCCTGGGACCAAAGTGGATATCAAA<br/><br/>SEQ ID NO: 25023 | GAGGTGCAACTGGTGGAGTCTGGGGAGGCTTG GTACAGCCTGGGGGGTCCCTGAGACTCTCTGTG TAGTCTCTGGATTCACCTTCAGTAGCCAGAGCAT GAACTGGGTCCGCCAGGCTCCAGGGAAGGGCT GGAGTGGGTCTCATACATTAGTATTAGTAGTACC ATATACTATGCAGACACTGTGAAGGGCCGATTCA CCATCTCCAGAGACAATGCCAAGAACTCACTGTA TCTGCAAATGAACAGCCTGAGAGAGGAGGACAC GGCTGTGTATTACTGTGCGAGGGGCCAGGGAAG CCCTTTTGACTCCTGGGGCCAGGGAACCCTGGTC ACCGTCTCCTCA<br/><br/>SEQ ID NO: 29029 |
| | | AA | DIQMTQSPSSLSASVGDRVTITCRASQGISYYLA WFQQKPGKAPKSLIYVASSLQSGVPSKFSGSGSG TDFTLTISSLQPEDFATYYCQQYDSYPFTFGPGT KVDIK<br/><br/>SEQ ID NO: 25024 | EVQLVESGGGLVQPGGSLRLSCVVSGFTFSSQSMN WVRQAPGKGLEWVSYISISSTIYYADSVKGRFTISR DNAKNSLYLQMNSLRDEDTAVYYCARGGGSPFDS WGQGTLVTVSS<br/><br/>SEQ ID NO: 29030 |
| iPS:394057 | 21-225_15H1 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATCTATGCCATCCAGT TTGCAAAGTGGGGTCCCATCAAGGTTCAACGG CAGTGGATCTGGGACAGAATTCACTCTCACAA TCAGCAGCCTGCAGCCTGAAGATTTTGCAACT TATTACTGTCTACAGCATAGTAGTTACCCGCTC ACTTTCGGCGGAGGGACCAAGGTGGAGATCA AA<br/><br/>SEQ ID NO: 25025 | CAGCTGCAGTTGCAGGAGTCGGGCCAGGACTG GTGAAGTTTTCGGAGACCCTGTCCCTCACCTGCA CTGTCTCTGGTGGCTCCATCAGCAGAAGTAGTA CTACTGGGGCTGGATCCGCCAGCCCCCAGGGAA GGGGCTGGAGTGGATAGGATATATCTATTATAGT GGGTATCCTACTACAATCGTCCCTCAAGAGTC AGTTCCCTGAAGTCTGAGACACGTCAAGAACC AGTTCTCCCTGAAGCTGTGTATTACTGTGCGAGACATAGC ACCAGCTGGTCCCTTGACTACTGGGGCCAGGAA CCCTGGTCACCGTCTCCTCA<br/><br/>SEQ ID NO: 29031 |

FIGURE 50
(Continued)

| | | | AA | DIQMTQSPSSLSASVGDRVTITCRASQGIRNDLG WYQQKPGKAPKRLIYTASSLQSGVPSRFNGSGS GTEFTLTISSLQPEDFATYYCLQHSSYPLTFGGGT KVEIK<br>SEQ ID NO: 25026 | QLQLQESGPGLVKFSETLSLTCTVSGGSISRSSYYW GWIRQPPGKGLEWIGNIYYSGYPYNPSLKSRVTIS VDTSKNQFSLKLSSVTAADTAVYYCARHSTSWSLD YWGQGTLVTVSS<br>SEQ ID NO: 29032 |
|---|---|---|---|---|---|
| | | | NA | GACATCCAGATGACCCAGTCTCCATCCTCCT GTTTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTTATCTATGCTGCATCCAGTT TGCAAAGTGGGGTCCCATCAAGGTTCAGCGGC AGTGGATCTGGGACAGAATTCACTCTCACAAT CAGCAGCCTGCAGCCTGAAGATATTGCAACTT ATTACTGTCTACAGCATAATAGTTACCCGCTC ACTTTCGGCGGAGGGACCAAGGTGGAGATCA AA<br>SEQ ID NO: 25027 | CAGGTGCAGCTGGTGGAGTCTGGGGGAGGCGTG GTCCAGCCTGGGAGGTCCCTGAGACTCTCTGTG AAGCGTCTGGATTCACCTTCAGTAGCTATGGCAT GCACTGGGTCCGCCAGGCTCCAGGCAAGGGCT GGAGTGGGTGGCAGTTATTTGGTATGAAGAAAAT AATCAATACTATGCAGACTCCGTGAAGGGCCGAT TCACCATCTCCAGAGACAATTCCAAGAACACGCT GTATCTACAAATGAACAGCCTGAGAGCCGAGGA CACGGCTGTGTCTGACTACTGGGGCCAGGAAACTGGGG TTCCGGTCTGACTACTGGGGCCAGGGAACCCTGG TCACCGTCTCCTCA<br>SEQ ID NO: 29033 |
| iPS:394059 | 21-225_9E8 | | AA | DIQMTQSPSSLFASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br>SEQ ID NO: 25028 | QVQLVESGGGVVQPGRSLRLSCEASGFTFSSYGMH WVRQAPGKGLEWVAVIWYEENNQYYADSVKGRF TISRDNSKNTLYLQMNSLRAEDTAVYYCARELGFR SDYWGQGTLVTVSS<br>SEQ ID NO: 29034 |

FIGURE 50
(Continued)

| | | | |
|---|---|---|---|
| iPS:394061 | 21-225_12D2 | NA | GATATTGTGATGACTCAGTCTCCACTCTCCCTG CCCGTCACCCCTGGTGAGCCGGCCTCCATCTC CTGCAGGTCTAGTCAGAGCCTCCTCCATAGTA ATGGATACAACTATTTGGATTGGTACCTGCAG AAGCCAGGGCAGTCTCCACAGTCTCCTGATCTA TTTGGGTTCTAAATCGGGCTCCGGGTCCCTG ACAGGTTCAGTGGCAGTGGATCAGGCACAGAT TTTACTCTGAAAATCAGCAGAGTGGAGGCTGA GGATGTTGGGGTTTATTACTGCATGCAAGCTC TACAAACTCCTATCACCTTCGGCCAAGGGACA CGACTGGAGATTAAAA<br>SEQ ID NO: 25029 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGCT GGAGTGGGTCATCATTAGTAGTAGTAGT TACATATACTACGCAGACTCAGTGAAGGCCGAT TCACCATCTCCAGAGACAACGCCAAGAACTCACT GTATCTGCAAATGAACAGCCTGAGAGCCGAGGA CACGGCTGTGTATTACTGTGCGAGATTAGGGAC TACTGGGGCCAGGGAACCCTGGTCGCCGTCTCCT CA<br>SEQ ID NO: 29035 |
| | | AA | DIVMTQSPLSLPVTPGEPASISCRSSQSLLHSNGY NYLDWYLQKPGQSPQVLIYLGSNRASGVPDRFS GSGSGTDFTLKISRVEAEDVGVYYCMQALQTPIT FGQGTRLEIK<br>SEQ ID NO: 25030 | EVQLVESGGGLVKPGGSLRLSCAASGFTFSSYSMN WVRQAPGKGLEWVSSISSSSYIYYADSVKGRFTIS RDNAKNSLYLQMNSLRAEDTAVYYCARLGDYWG QGTLVAVSS<br>SEQ ID NO: 29036 |
| iPS:394063 | 21-225_16A1 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCGTCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACACCATAGTAATTACCCTCTC ACTTTCGGCGGAGGGACCAAGGTGGAGATCG AA<br>SEQ ID NO: 25031 | CAGCTGCAGCTGCAGGAGTGGGCCAGGACTG GTGAAGCCTTCGGAGACCCTGTCCTCATTTGTA CTGTCTCTGGTGGCTCCATCGACAGGAGTAGTTA CTACTGGGGCTGGATCCGCCAGCCCCAGGGAA GGGGCTGGAGTGGATTGGGAGTATCTATTATAGT GGGAGCGCCTATCACAACCGTCCTCAAGAGTC GAGGCACCATATCGTAGATACGTCAAGAACC AGTTCTCCCTGAAGCTGAGCTCTGTGACGCCGC AGACACCGGCTGGTCCTTTGACTACTGTGCGAGAGC AGCAGCTGGTCCTTTGACTACTGGGGCCAGGGAA CCCTGGTCACCGTCTCCTCT<br>SEQ ID NO: 29037 |

FIGURE 50
(Continued)

| | | | | |
|---|---|---|---|---|
| iPS:3940065 | | AA | DIQMTQSPSSLSASVGDRVTITCRASQGIRNDLG WYQQKPGKAPKRLIYAASSLQSGVPSRFSGSGS GTEFTLTISSLQPEDFATYYCLHHSNYPLTFGGG TKVEIE<br>SEQ ID NO: 25032 | QLQLQESGPGLVKPSETLSLICTVSGGSIDRSSYYW GWIRQPPGKGLEWIGSIYYSGSAYHNPSLKSRGTIS VDTSKNQFSLKLSSVTAADTAAYYCARLSSSWSFD YWGQGTLVTVSS<br>SEQ ID NO: 29038 |
| | 21-225_11E2 | NA | GACATCGTGATGACCCAGTCTCCAGACTCCCT GGCTGTGTCTCTGGGCGAGAGGGCCACCATCA ACTGCAAGTCCAACAGTGATGCATTTTATCCAGC TCCAACAATCACAACTACTTAGTTGGTACCA GCAGAGACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTTAGTACTCCATTCCACTTTCGGCCCTGGG ACCAAAGTGGATATCAAA<br>SEQ ID NO: 25033 | CAGGTGCAGGTGGTGCAGTCTGGGGCTGAGGTG AAGAAGCCTGGGGCTCAGTGAAGGTCCTGC AAGGCTTCTGGATACACCTTCACCAATTATGATA TCAACTGGGTGCGACAGGCCACTGGACAAGGGC TTGAGTGGATGGGATGGATGAACACTAACAGTG GTAACACAGGCTATGCACAGAAGTTCCAGGGCA GAGTCACCATGACCAGGAACACCTCCATAAGCA CAGCCTACATGGACTCTGAGCAGCCTGAGATCTGA GGACACGGCCGTATATTACTGTGCGAGACTGAGT GGCTGGTTCTCTTTGACTACTGGGGCCAGGGAA TCCTGGTCACCGTCTCCTCA<br>SEQ ID NO: 29039 |
| | | AA | DIVMTQSPDSLAVSLGERATINCKSNQRVLSSSN NHNYLAWYQQRPGQPPKLLIYWASTRESGVPD RFSGSGSGTDFTLTISSLQAEDVAVYYCQQYFST PFTFGPGTKVDIK<br>SEQ ID NO: 25034 | QVQVVQSGAEVKKPGASVKVSCKASGYTFTNYDI NWVRQATGQGLEWMGWMNTNSGNTGYAQKFQG RVTMTRNTSISTAYMDLSSLRSEDTAVYYCAYSHG WFLFDYWGQGILVTVSS<br>SEQ ID NO: 29040 |

FIGURE 50
(Continued)

| | | | |
|---|---|---|---|
| iPS:394067 | 21-225_12F2 | NA | GACATCCAGATGACCCAGTCTCCATCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGTAACT TATTACTGTCTACAGCATAATAGTTATCCGTG GACGTTCGGCCAAGGGACCAAGGTGGAAATC AAA<br>SEQ ID NO: 25035 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGTTGATGGAAAT AATAAATACTATGTAGATTCCGTGAAGGGCCGAT TCACCATCTCCAGAGACAATTCCAAGAACACGCT GTTTCTGCAAATGAACAGCCTGAGAGCCGAGGA CACGGCTGTGTATTACTGTGTGAGAGAGCTTGCC TGGTCCGAGGACTACTGGGGCCAGGGAACCCTG GTCACCGTCTCCTCA<br>SEQ ID NO: 29041 |
| | | AA | DIQMTQSPSSLSASVGDRVTITCRASQGIRNDLG WYQQKPGKAPKRLIYAASSLQSGVPSRFSGSGS GTEFTLTISSLQPEDFVTYYCLQHNSYPWTFGQG TKVEIK<br>SEQ ID NO: 25036 | QVQLVESGGGVVQPGRSLRLSCAASGFTFSDYGM HWVRQAPGKGLEWVAVIWFDGNNKYYVDSVKGR FTISRDNSKNTLFLQMNSLRAEDTAVYYCVRELAW SEDYWGQGTLVTVSS<br>SEQ ID NO: 29042 |
| iPS:394069 | 21-225_16H1 | NA | GACATCCAGATGACCCAGTCTCCATCCCT GTCTGCATCTGTAGGAGACAGAGTCACCATCA CTTGCCGGGCAAGTCAGGGCATTAGAGATATT TTAGGCTGGTATCAGCAGAAACCAGGGAAAG CCCCTAAGCGCCTGATCTATGCTGCATCCAGT TTGCAAAATGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGTATCATAGTTACCCATTC ACTTTCGGCCCTGGGACCAAAGTGGATGTCAA A<br>SEQ ID NO: 25037 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTAGTGGTAGTACT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGTAGCAGCC TTTGACTACTGGGGCCAGGGAACCCTGGTCACCG TCTCCTCA<br>SEQ ID NO: 29043 |

FIGURE 50
(Continued)

| | | | | |
|---|---|---|---|---|
| iPS:394071 | 21-225_10C7 | AA | DIQMTQSPSSLSASVGDRVTITCRASQGIRDILG WYQQKPGKAPKRLIYAASSLQNGVPSRFSGSGS GTEFTLTISSLQPEDFATYYCLQYHSYPFTFGPGT KVDVK<br><br>SEQ ID NO: 25038 | EVQLVESGGGLVKPGGSLRLSCAASGFTFSSYSMN WVRQAPGKGLEWVSSISGSSTYIYYADSVKGRFTIS RDNAKNSLYLQMNSLRAEDTAVYYCARVAAFDY WGQGTLVTVSS<br><br>SEQ ID NO: 29044 |
| | | NA | GATATTGTGATGACTCAGTCTCCACTCTCCTG CCCGTCACCCCTGGAGAGCCGGCCTCCATCTC CTGCAGGTCTAGTCAGAGCCTCCTGCATAGTA AGGGATACAACTATTTGGATTGGTACCTGCAG AAGCCAGGGCAGTCTCCACAGGTCCTGATCTA TTTGGGTTCTAATCGGGCCTCCGGGGTCCCTG ACAGGTTCAGTGGCAGTGGATCAGGACAGAT TTTACACTGAAAATCAGAGAGTGGAGGCTGA GGATGTTGGGGTTTATTACTGCATGCAAGCTC TACAAACTCCTCACCTTCGGCCAAGGGACA CGACTGGAGATTAAA<br><br>SEQ ID NO: 25039 | GAGGTGCAGCTGGTGGAGTCTGGGGGAGGCTG GTCAAGCCGGGGGGGTCCCTGAGACTCTCCTGTG CAGCCTCTGGATTCACCTTCAGTAGCTATAGCAT GAACTGGGTCCGCCAGGCTCCAGGGAAGGGCT GGAGTGGGTCTCATCCATTAGTAGTAGTAATAAT TACATATACTACGCAGACTCAGTGAAGGGCCGAT TCACCATCTCCAGAGACAACGCCAAGAACTCACT GTATCTGCAAATGAACAGCCTGAGAGCCGAGGA CTCGGCTGTGTATTACTGTGCGAGATTAGGGGTC TACTGGGGCCAGGGAACCCTGGTCACCGTCTCCT CA<br><br>SEQ ID NO: 29045 |
| | | AA | DIVMTQSPLSLPVTPGEPASISCRSSQSLLHSKGY NYLDWYLQKPGQSPQVLIYLGSNRASGVPDRFS GSGSGTDFTLKISRVEAEDVGVYYCMQALQTPL TFGQGTRLEIK<br><br>SEQ ID NO: 25040 | EVQLVESGGGLVKPGGSLRLSCAASGFTFSSYSMN WVRQAPGKGLEWVSSISSSNNYIYYADSVKGRFTIS RDNAKNSLYLQMNSLRAEDSAVYYCARLGVYWG QGTLVTVSS<br><br>SEQ ID NO: 29046 |

FIGURE 50
(Continued)

| | | | |
|---|---|---|---|
| iPS:394073 | 21-225_15C9 | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGTATCAACACAGAAACCAGGGAAAG CCCCTAAGCGCCTGATCTATGCTGCATCAGT TTGCAAAGTGGGGTCCCATCAAGGTTCAGCGG CAGTGGATCTGGGACAGAATTCACTCTCACAG TCAGCAGCCTGCAGCCTGAAGATTTTGCTACT TATTACTGTCTACAACATACTAGTTACCCGCTC ACTTTCGGCGGAGGGACCAAGGTGGAGATCA AA SEQ ID NO: 25041 | CAGCTGCAGCTGCAGGAGTCGGGCCCAGGACTG GTGAAGCCTTCGGAGACCCTGTCCCTCACCTGCA CTGTCTCTGGTGGCTCCATCAGCAGAAGTAGTTA CTACTGGGGCTGGATCCGCCAGCCCCCAGGGAA GGGGCTGGAGTGGATTGGAATATCTATTATAGT GGGAGCACTACAACAACCCGTCCCTCAAGAGT CGAGTCACCATATCCGTAGACACGTCCAAGAACC AGTTCCCCTGAAGCTGAGCTCTGTGACCGCCGC AGACACGGCTGTGTATTACTGTGCGAGACAGGG CAGTGGCTGGGAGGTTGACTACTGGGGCCAGGG AACCCTGGTCACCGTCCTCA SEQ ID NO: 29047 |
| | | AA | DIQMTQSPSSLSASVGDRVTITCRASQGIRNDLG WYQQKPGKAPKRLIYAASSLQSGVPSRFSGSGS GTEFTLTVSSLQPEDFATYYCLQHTSYPLTFGGG TKVEIK SEQ ID NO: 25042 | QLQLQESGPGLVKPSETLSLTCTVSGGSISRSSYYW GWIRQPPGKGLEWIGNIYYSGSTYNNPSLKSRVTIS VDTSKNQFSLKLSSVTAADTAVYYCARQGSGWEV DYWGQGTLVTVSS SEQ ID NO: 29048 |
| iPS:394075 | 21-225_8D12 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGTATCAACACAGAAACCAGGGAAAG CCCCTAAGCGCCTGATCTATGCTGCATCCAGT TTGCAAAGTGGGGTCCCATCAAGGTTCAACGG CAGTGGATCTGGGACAGAATTCACTCTCACAA TCAGCAGCCTGCAGCCTGAAGATTTTGCAACT TATTACTGTCTACAGCATATAGTAGTTACCCGCTC ACTTTCGGCGGAGGGACCAAGGTGGAGATCA AA SEQ ID NO: 25043 | CAGCTGCAGTTGCAGGAGTCGGGCCCAGGACTG GTGAAGTTTTCGGAGACCCTGTCCCTCACCTGCA CTGTCTCTGGTGGCTCCATCAGCAGAAGTAGTTA CTACTGGGGCTGGATCCGCCAGCCCCCAGGGAA GGGGCTGGAGTGGATAGGAATATCTATTATAGT GGGTATCCTACTACAATCGTCCCTCAAGAGTC GAGTCACCATATCCATAGACACGTCCAAGAACC AGTTCTCCCTGAAGCTGAGTCTGTGACCGCGC AGACACGGCTGTGTATTACTGTGCGAGACATAGC ACCAGCTGGTCCCTTGACTACTGGGGCCAGGAA CCCTGGTCACCGTCCTCA SEQ ID NO: 29049 |

FIGURE 50
(Continued)

| | | | | |
|---|---|---|---|---|
| | | AA | DIQMTQSPSSLSASVGDRVTITCRASQGIRNDLG WYQQKPGKAPKRLIYAASSLQSGVPSRFNGSGS GTEFTLTISSLQPEDFATYYCLQHSSYYPLTFGGGT KVEIK<br>SEQ ID NO: 25044 | QLQLQESGPGLVKFSETLSLTCTVSGGSISRSSYYW GWIRQPPGKGLEWIGNIYYSGYPYYNPSLKSRVTISI DTSKNQFSLKLSSVTAADTAVYYCARHSTSWSLDY WGQGTLVTVSS<br>SEQ ID NO: 29050 |
| iPS:394077 | 21-225_8E12 | NA | GACATCCAGATGACCCAGTCTCCATCCTCCT GTCTGCATCTGTAGGAGACAGAGTCACCATCA CTTGCCGGGCAAGTCAGAGCATTAGTAATTAT TTAAATTGGTATCAGCAGAAACCAGGGAAAG CCCCTAAGCTCCTGATCTATGCTGCATCCAGTT TACAAAGTGGGGTCCCATCAAGGTTCAGTGGC AGTGGATCTGGGACAGATTTCACTCTCACCAT CAGCAGTCTGCAACCTGAAGATTTTGCAACTT ACTTCTGTCAACAGAGTTACAGAACCCCTTT TTCACTTTCGGCCCTGGGACCAAAGTGGATAT CAAA<br>SEQ ID NO: 25045 | GAGGTGCAGCTGTTGGAGTCTGGGGAGGCTTG GTACAGCCTGGGGGGTCCTGAGACTCTCCTGTG CAGCCTCTGAATTCACCTTTAGCAGCTATGCCAT GAGCTGGGTCCGCCAGGCTCCAGGGAAGGGCT GGAGTGGGTCTCAATTATTAGTGGTCGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGTCCGTATGGCA GTGGCTGGCTCGGAGGCTTTTGATATCTGGGGCC AAGGGACAATGGTCACCGTCTCTTCA<br>SEQ ID NO: 29051 |
| | | AA | DIQMTQSPSSLSASVGDRVTITCRASQSISNYLN WYQQKPGKAPKLLIYAASSLQSGVPSRFSGSGS GTDFTLTISSLQPEDFATYFCQQSYRTPFFTGPG TKVDIK<br>SEQ ID NO: 25046 | EVQLLESGGGLVQPGGSLRLSCAASEFTFSSYAMS WVRQAPGKGLEWVSIISGRGGNTFYADSVKGRFTI SRDNSKNTLYLQMNSLRAEDTAVYYCASRMAVAG SEAFDIWGQGTMVTVSS<br>SEQ ID NO: 29052 |

FIGURE 50
(Continued)

| | | | |
|---|---|---|---|
| iPS:394079 | 21-225_11F5 | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGTCTGATCTATGCTGCATCCAGT GTGCAAAGTGGGGTCCCATCAAGGTTCAGCGG CAGTGGATCTGGGACAGAATTCACTCTCACAA TCAGCAGCCTGCAGCCTGAAGATTTTGCAATT TATTACTGTCTACAGCATAATAGTTACCCGCTC ACTTTCGGCGGAGGGACCAAGGTGGAGATCA AA<br/>SEQ ID NO: 25047 | CAGTCTGCAGCTGCAGGAGTCGGGCCCAGGACTG GTGAAGCCTTCGGAGACCCTGTCCCTCACCTGCA CTGTCTCTGGTGGCTCCATCAGTAGGAGTAGTTA CTACTGGGGCTGGATCGCCAGCCCCAGGGAA GGGGCTGGAATGGATTGGAAATATTTATTATAGT GGGAGCACCTACACCAACCGTCCTCAAGAGTC GAGTCACCATATCCGTAGACACGTCAAGAACC ACTTCTCCCTGAAGCTGAGCTCTGTGACCGCGC AGACACGGCTGTGTATTACTGTGGAGACATGGA AAAGACTGGGGCTTGACAACTGGGGCCAGGGA ACCCTGGTCACCGTCTCCTCA<br/>SEQ ID NO: 29053 |
| | | AA | DIQMTQSPSSLSASVGDRVTITCRASQGIRNDLG WYQQKPGKAPKRLIYAASSVQSGVPSRFSGSGS GTEFTLTISSLQPEDFAIYYCLQHNSYPLTFGGGT KVEIK<br/>SEQ ID NO: 25048 | QLQLQESGPGLVKPSETLSLTCTVSGGSISRSSYYW GWIRQPPGKGLEWIGNIYYSGSTYTNPSLKSRVTIS VDTSKNHFSLKLSSVTAADTAVYYCGRHGKDWGL DNWGQGTLVTVSS<br/>SEQ ID NO: 29054 |
| iPS:394081 | 21-225_16B3 | NA | GACATCCAGATGACCCAGTCTCCATCTCCCT GTCTGCATCTGTAGGAGACAGAGTCACCATCA CTTGCCAGGCGAGTCAGGACATTAACAACTAT TTAAATTGGTATCAGCAGAAACCAGGAGAG CCCCTAAGCTCCTGATCTACGATGCATCCAAT TTGGAAACAGGGGTCCCATCAAGGTTCAGTGG AAGTGGCTCTGGGACAGATTTTACTTTCACCA TCAGCAGTCTGCAGCCTGAAGATATTGCAACA TATTACTGTCAACAGTTTGATAATCTCCCGATC ACCTTCGGCCAAGGGACACGACTGGAGATTAA A<br/>SEQ ID NO: 25049 | CAGGTGCAGCTGGTAGAGTCTGGGGAGGCGTG GTCCAGCCTGGGAGGTCCCTGAGACTCTCCTGTG TAGCCTCTGGATTCACCTTCAGTAGCTATGGCAT GCACTGGGTCCGCCAGGCTCCAGGCAAGGGCT GGAGTGGGTGGCAGTTATATCATATGCTGAATT AATAAATCCTATGCAGACTCCGTGAAGGGCCAT GTATCTGCAAATGAACAGCCTGAGAGCTGAGGA CACGGCTGTGTATTACTGTGTGAGACGGGATAC AGCTATGCGGGTATGGTATGGACGTCTGGGGCC AAGGGGCCACGGTCACCGTCTCCTCA<br/>SEQ ID NO: 29055 |

FIGURE 50
(Continued)

| | | | | |
|---|---|---|---|---|
| | | AA | DIQMTQSPSSLSASVGDRVTITCQASQDINNYLN WYQQKPGRAPKLLIYDASNLETGVPSRFSGSGS GTDFTFTISSLQPEDIATYYCQQFDNLPITFGQGT RLEIK<br>SEQ ID NO: 25050 | QVQLVESGGGVVQPGRSLRLSCVASGFTFSSYGMH WVRQAPGKGLEWVAVISYAGINKSYADSVKGRFTI SRDNSNNTLYLQMNSLRAEDTAVYYCVRRGYSYG GYGMDVWGQGATVTVSS<br>SEQ ID NO: 29056 |
| iPS:394083 | 21-225_16E6 | NA | GACATCCAGATGACCCAGTCTCCATCCTCCT GTCTGCATCTGTAGGAGACAGAGTCACCATCA CTTGCCGGGCAAGTCAGAGACATTAATCAGTAT TTAAATTGGTATCAGCAGAAACCAGGGAAAG CCCCTAAGTTCCTGATCTATACTACATCCAGTT TGCAAAGTGGGGTCCCATCAAGGTTCAGTGGC AGTGGATCTGGGACAGATTTCACTCTCACCAT CAGTAGTCTGCAACCTGAAGATTTTGCAACTT ACTACTGTCAGCAGACTTACAGTACCCGCTC ACTTTCGGCGGAGGGACCAAGGTGGAGATCA AA<br>SEQ ID NO: 25051 | CAGGTGCAGCTGGTGGAGTCTGGGGGAGGCGTG GTCCAGCCTGGGAGGTCCCTGAGACTCTCCTGTG CAGCGTCTGATTCACCTTCAGTAGCTATGGCAT GCACTGGGTCCGCCAGGCTCCAGGCAAGGGCT GGAGTGGGTGGCAGTTATATGAGTGCATGGAAAG TAATAAATACTATGTAGACTCCGTGAAGGGCCGA TTCACCATCTCCAGAGACAATTCCAAGAACACGC TGAATCTGCAAATGAACAGCTGAGAGCCGAGG ACACGGCTGTGTATTACTGTGCAGAGATCTGAG TATGGGCGGTATGGACGTCTGGGCCAAGGGAC CACGGTCACCGTCTCCTCA<br>SEQ ID NO: 29057 |
| | | AA | DIQMTQSPSSLSASVGDRVTITCRASQSIISYLNW YQQKPGKAPKFLIYTTSSLQSGVPSRFSGSGSGT DFTLTISSLQPEDFATYYCQQTYSTPLITFGGGTK VEIK<br>SEQ ID NO: 25052 | QVQLVESGGGVVQPGRSLRLSCAASGFTFSSYGMH WVRQAPGKGLEWVAVIWHDGSNKYYVDSVKGRF TISRDNSKNTLNLQMNSLRAEDTAVYYCARDLSM GGMDVWGQGTTVTVSS<br>SEQ ID NO: 29058 |

FIGURE 50
(Continued)

| | | | |
|---|---|---|---|
| iPS:394085 | 21-225_8B11 | NA | GACATCGTGATGACCCAGTCTCCAGACTCCCT GGCTGTGTCTGTGGGCGAGAGGGCCACCATCA ACTGCAAGTCCAGCCAGAATGTTTTATACAAC TCCAACAATAACAAGTACTTAGCTTGGTACCA GCAGAAACCAGGACAGCCTCCTAAGCTGCTCA TTTACTGGGCATCTACCCGGAAATCCGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATACTACTCCGTGCAGTTTGGCCAGGG GACCAAGCTGGAGATCAAA <br><br> SEQ ID NO: 25053 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCGCTGGACAAGGC TTGAGTGGATGGGATGGATGCACCCTAACAGTGG TAACACAGGCTATGCACAGAAGTTCCAGGCAG AGTCACCATGACCAGGAACACCTCCAGAAGCAC AGCCTACATGGAGCTGAGCAGCCTGAGATCTGA GGACACGGCCGTGTACTACTGTGCGTATAGCAGT GGCTGGTACTTCTTGACTACTGGGGCCAGGGAA CCCTGGTCACCGTCCTCA <br><br> SEQ ID NO: 29059 |
| | | AA | DIVMTQSPDSLAVSLGERATINCKSSQNVLYNSN NNNYLAWYQQKPGQPPKLLIYWASTRKSGVPD RFSGSGSGTDFTLTISSLQAEDVAVYYCQQYYTT PCSFGQGTKLEIK <br><br> SEQ ID NO: 25054 | QVQLVQSGAEVKKPGASVKVSCKASGYTFTNYDIN WVRQAAGQGLEWMGWMHPNSGNTGYAQKFQR VTMTRNTSRSTAYMELSSLRSEDTAVYYCAYSSG WYFFDYWGQGTLVTVSS <br><br> SEQ ID NO: 29060 |
| iPS:394087 | 21-225_11A5 | NA | GACATCCAGATGACCCAGTCTCCATCCTCCCT GTCTGCATCTGTAGGAGAGACAGAGTCACCATCA CTTGCCGGGCAAGTCAGAACATTTATAGTTAT TTAAATTGGTATCAGCAGAAACCAGGGAAAG CCCCTAAGCTCCTGATCTATGCTGCATCCAGTT TGCAAAGTGGGGTCCCATCAAGGTTCAGTGGC AGTGGATCTGGGACAGATTTCACTCTCACCAT CAGCAGTCTACAACCTGAAGATTTTGCAACTT ACTACTGTCAACAGAGTTACAATACCCCCTTA TTCACTTTCGGCCCTGGGACCAAAGTGGATAT CAAA <br><br> SEQ ID NO: 25055 | GAGGTGCAGCTGTTGGAGTCTGGGGGAGACTTG GTTCAGCCTGGGGGGTCCCTGAGACTCTCCTGTG CAGCCTCTGAATTCACCTTTAGCAGCTATGCCAT GAGCTGGGTCCGCCAGGCTCCAGGGAAGGGGCT GGAGTGGATCTCAGTTATTAGTGGTGGTGTGTT AACACATTCTACGCAGACTCCGTGAAGGGCCGGT TCACCATCTCCAGAGACAATTCCAAGAACACGCT CTATCTACAAATGAACAGCCTGAGAGCCGAGGA CACGGCCGTATATTACTGTGCGTCCGTATCGCA GTGGCTGGCTGGAGGTTTGATATCTGGGGCC AAGGGACAATGGTCACCGTCTCTTCA <br><br> SEQ ID NO: 29061 |

FIGURE 50
(Continued)

| | | | |
|---|---|---|---|
| iPS:394089 | 21-225_12E6 | AA | DIQMTQSPSSLSASVGDRVTITCRASQNIYSYLN WYQQKPGKAPKLLIYAASSLQSGVPSRFSGSGS GTDFTLTISSLQPEDFATYYCQQSYNTPLFTFGPG TKVDIK<br>SEQ ID NO: 25056 | EVQLLESGGDLVQPGGSLRLSCAASEFTFSSYAMS WVRQAPGKGLEWISVISGRGVNTFYADSVKGRFTI SRDNSKNTLYLQMNSLRAEDTAVYYCASRIAVAGS EAFDIWGQGTMVTVSS<br>SEQ ID NO: 29062 |
| | | NA | GACATCCAGATGACCCAGTCTCCATCTCCCT GTCTGCATCTGTAGGAGACAGAGTCACCATCA CTTGCCGGGCAAGTCAGGGCATTAGAAGTGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGTG GACGTTCGGCCAAGGGACCAAGGTGGAAATC AAA<br>SEQ ID NO: 25057 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTTACTTGGCAT GCACTGGGTCCGCCAGGCTCCAGGCAAGGGGCT GGAGTGGGTGACAGTTATATGGTATGATGAAAGT AATAAATACTATGCAGACTCCGTGAAGGGCCGA TTCACCATCTCCAGAGACGATTCCAAAAACACGC TGTATCTGCAAATGAACAGTCTGAGAGCCGAGG ACACGGCTGTGTATTACTGTGCGAGAGAGCTTGC CTGGTACGAGGACTACTGGGGCCAGGGAACCCT GGTCACCGTCTCCTCA<br>SEQ ID NO: 29063 |
| | | AA | DIQMTQSPSSLSASVGDRVTITCRASQGIRSDLG WYQQKPGKAPKRLIYAASSLQSGVPSRFSGSGS GTEFTLTISSLQPEDFATYYCLQHNSYPWTFGQG TKVEIK<br>SEQ ID NO: 25058 | QVQLVESGGGVVQPGRSLRLSCAASGFTFSDYGM HWVRQAPGKGLEWVTVIWYDESNKYYADSVKGR FTISRDDSKNTLYLQMNSLRAEDTAVYYCARELAW YEDYWGQGTLVTVSS<br>SEQ ID NO: 29064 |

FIGURE 50
(Continued)

| | | | |
|---|---|---|---|
| iPS:394891 | 21-225_13H3 | NA | GACATCCAGATGACCCAGTCTCCATCTCCCT GTCTGCATCTGTAGGAGACAGAGTCACCATCA CTTGCCGGGCAAGTCAGGCATTAGAAATGAT TTAGGCTGGTATCAGCAGAAACCAGGGAAAG CCCCTAAGCGCCTGATCTATGCTGCATCCAGT TTACAAAGTGGGGTCCCATCAAGGTTCAGCGG CAGTGGATCTGGGACAGAGATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA SEQ ID NO: 25059 | CAGGTGCAGCTGGTGGAGTCTGGGGGAGGCCTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATTTGGTATGAGGAAAGT AATAAATACTATGTAGACTCCGTGAGGGGCCGAT TCACCATCTCCAGAGACAATTCCAAGAGCACGCT GTATCTGCAAATGAACAGCCTGAGAGCCGAGGA CACGGCTGTGTATTACTGTGTGAGAGAACTAGGC TTCCAGTCGACTTCTGGGGCCAGGGAACCCCGG TCACCGTCTCCTCA SEQ ID NO: 29065 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK SEQ ID NO: 25060 | QVQLVESGGGLVQPGRSLRLSCAASGFTFSSYGMH WVRQAPGKGLEWVAVIWYEESNKYYVDSVRGRF TISRDNSKSTLYLQMNSLRAEDTAVYYCVRELGFQ SDFWGQGTPVTVSS SEQ ID NO: 29066 |
| iPS:394093 | 21-225_9D12 | NA | GACATCCAGATGACCCAGTCTCCATCTCCCT GTCTGCATCTGTAGGAGACAGAGTCACCATCA CTTGCCGGGCAAGTCAGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAGATTCACTCTCACAA TCAGCAGCCTGCAGCCTGAAGATTTTGCAACT TATTACTGTCTACAGCATAATAGTTACCCGTG GACGTTCGGCCAAGGGACCAAGGTGGAAATC AAA SEQ ID NO: 25061 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATGCAGACTCCGTGAAAT AATAATTACTATGCAGAGACAATTCCAAGAACACGCT GTATCTGCAAATGAACAGCCTGAGAGCCGAGGA CACGGCTGTGTATTACTGTGCGAGAGAGCTTGCC TGGTACGAGGACTTCTGGGGCCAGGGAACCCTG GTCACCGTCTCCTCA SEQ ID NO: 29067 |

FIGURE 50
(Continued)

| | | | | |
|---|---|---|---|---|
| iPS.394095 | 21-225_16H4 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPWTFGQG TKVEIK SEQ ID NO: 25062 | QVQLVESGGGVVQPGRSLRLSCAASGFTFSDYGM HWVRQAPGKGLEWVAVIWYDGNNYYADSVKG RFTISRDNSKNTLYLQMNSLRAEDTAVYYCARELA WYEDFWGQGTLVTVSS SEQ ID NO: 29068 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTTATCTATGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAATAGTTACCCGTGG ACGTTCGGCCAAGGGACCAAGGTGGAAATCA AA SEQ ID NO: 25063 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATATGGTATGATGGTAAGT AATAAATACTATGCAGACTCCGTGAAGGGCCGA TTCACCATCTCCAGAGACAATTCCAAGAACATGT TGTATCTGCAAATGAACAGCCTGAGAGCCGAGG ACACGGCTGTGTATTACTGTGCGCGAGAAATGGG CTGGACCGATGACTGCTGGGGCCAGGGAACCCT GGTCACCGTCTCCTCA SEQ ID NO: 29069 |
| | | AA | DIQMTQSPSSLSASVGDRVTITCRASQGIRNDLG WYQQKPGKAPKRLIYTASSLQSGVPSRFSGSGSG TEFTLTISSLQPEDFATYYCLQHNSYPWTFGQGT KVEIK SEQ ID NO: 25064 | QVQLVESGGGVVQPGRSLRLSCAASGFTFSNYGM HWVRQAPGKGLEWVAVIWYDVSNKYYADSVKGR FTISRDNSKNMLYLQMNSLRAEDTAVYYCAREMG WTDDCWGQGTLVTVSS SEQ ID NO: 29070 |

FIGURE 50
(Continued)

| | | | |
|---|---|---|---|
| iPS:394097 | 21-225_16G7 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCAGT TTGCAAAGTGGGGTCCCATCAAGGTTCAGTCGG CAGTGGATCTGGGACAGATTCACTCTCACAA TCAGCAGCCTGCAGCTGAAGATTTTGCAACT TATTACTGTCTACAACATAATAGTTACCGTG GACGTTCGGCCAAGGGACCAAGGTGGAAATC AAA<br><br>SEQ ID NO: 25065 | CAGGTGCAGCTGGTGGAGTCTGGGGGAGGCGTG GTCCAGCCTGGGAGGTCCCTGAGACTCTCCTGTG CAGCGTCTGGATTCACCTTCACTGACTATGGCAT GCACTGGGTCCGCCAGGCTCCAGGCAAGGGGCT GGAGTGGGTGGCAGTTATTTGGTATGATGAAAAT AATGAATACTATGCAGACTCCGTGAAGGGCCGA TTCACCATCTCCAGAGCCAATTCCAAGAACACGC TGTATCTGCAAATGAACAGCCTGAGAGCCGAGG ACACGGCTGTGTATTACTGTGCGAGAGAGCTTGC CTGGTACGAGGACTACTGGGGCCAGGGAACCCT GGTCACCGTCTCCTCA<br><br>SEQ ID NO: 29071 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPWTFGQG TKVEIK<br><br>SEQ ID NO: 25066 | QVQLVESGGGVVQPGRSLRLSCAASGFTFTDYGM HWVRQAPGKGLEWVAVIWYDENNEYYADSVKGR FTISRANSKNTLYLQMNSLRAEDTAVYYCARELAW YEDYWGQGTLVTVSS<br><br>SEQ ID NO: 29072 |
| iPS:398470 | 21-225_14B7 | NA | TCCTATGAGCTGACTCAGCCACCCTCAGTGTC CGTGTCCCCAGGACAGACAGCAGCATCACCT GCTCTGGAGATAAAATTGGGGAATAAATATGCT TACTGGTATCAGCAGAAGCCAGGCCAGTCCCC TGTGCTGGTCATCTATCAAGATAGAAAGCGGC CCTCAGGGATCCCTGAGCGATTCTCTGGCTCC AACTCTGGGAACACAGACTATGGATGAGGCTGA CATTCGGGACCCAGCTGGAACAACAGCACTGTGGTA ACTGGCGTGAGGGACCAAGCTGACCGTCCTA<br><br>SEQ ID NO: 25067 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGC TTGAGTGGATGGGATGGATCAACCCTAACAGTGG TGGCACAAACTATGTACAGAAGTTTCAGGGCAG GGTCACCATGACCAGGGACACGTCCATCAGCAC AGCCTGCATGGAGCTGAGCAGGCTGAAATCTGA CGACACGGCCGTGTATTTCTGTGCGAGGTCGTTT TTCTATGTTCGGGAGTTATTATAACGAATTTG ACTACTGGGGCCAGGGAACCCTGGTCACCGTCTC CTCA<br><br>SEQ ID NO: 29073 |

FIGURE 50
(Continued)

| | | | | |
|---|---|---|---|---|
| | | AA | SYELTQPPSVSVSPGRTASITCSGDKLGNKYAYW YQQKPGQSPVLVIYQDRKRPSGIPERFSGSNSGN TATLTISGTQTMDEADYYCQAWNNSTVVFGGG TKLTVL<br><br>SEQ ID NO: 25068 | QVQLVQSGAEVKKPGASVKVSCKASGYTFTGYYM HWVRQAPGQGLEWMGWINPNSGGTNYVQKFQGR VTMTRDTSISTACMELSRLKSDDTAVYFCARSFFY GSGSYYNEFDYWGQGTLVTVSS<br><br>SEQ ID NO: 29074 |
| iPS:398472 | 21-225_16E4 | NA | CCCTATGAGCTGACTCAGCCACCCTCAGTGTC CGTGTCCCCAGGACAGAGACAGCCAGCATCACCT GCTCTGGAGATAAATTGGGGGATAAAATATGTT TACTGGTATCAGCAGAAGTCAGGCCAGTCCCC TGTGCTGGTCATCTATCAAGATAGCAAGCGGC CCTCAGGGATCCCTGAGGGATTCTCTGGCTCC AACTCTGGAAACACAGCCGCTCTGACCATCAG CGGGACCCAAGGCTATGATGAGGCTGACTATT ACTGTCAGGCGTGGAACAGCAGCACTGTGGTT TTCGGCGGAGGGACCAAGCTGACCGTCCTA<br><br>SEQ ID NO: 25069 | GAGGTGCAGCTGTTGGAGTCTGGGGGAGGCTTG ATACAGCCTGGGGGGTCCCTGAGACTCTCCTGTG CAGCCTCTGGATTCACCTTTAGTAGCTATGTCAT GAGCTGGGTCCGCCAGGCTCCAGGGAAGGGGCT GGAGTGGGTCTCCACTATTAGTGTTGGTGGTGGT ACCACATACTACGCAGACTCCGTGAAGGGCCGG TTCACCATCTCCAGAGACACAATTCCAAGAATACGC TGTATCTGCAAATGAACAGCCTGAGAGCCGAGG ACACGGCCGTATATTACTGTGCGAAATGGGGAC GTGGCAACAGCTATGAGTACTACGGTATGGA CGTCTGGGGCCAAGGGACCACGGTCACCGTCTCC TCA<br><br>SEQ ID NO: 29075 |
| | | AA | PYELTQPPSVSVSPGQTASITCSGDKLGDKYVY WYQQKSGQSPVLVIYQDSKRPSGIPERFSGSNSG NTAALTISGTQAMDEADYYCQAWDSSTVVFGG GTKLTVL<br><br>SEQ ID NO: 25070 | EVQLLESGGGLIQPGGSLRLSCAASGFTFSSYVMSW VRQAPGKGLEWVSTISVGGGTTYYADSVKGRFTIS RDNSKNTLYLQMNSLRAEDTAVYYCAKWGRGNS YEYYYGMDVWGQGTTVTVSS<br><br>SEQ ID NO: 29076 |

FIGURE 50
(Continued)

| | | | |
|---|---|---|---|
| iPS:398474 | 21-225_17B10 | NA | GACATCCAGATGACCCAGTCTCCATCTCCCT ATCTGCATCTGTAGGAGACAGAGTCACCATCA CTTGCCGGTCAAGTCAGAGCATTAACAGCTAT TTAAATTGGTATCAGCAGAAACCTGGGAAAGC CCCTAAGCTCCTGATCTTTGCTGCATCCAGTT GCACAGTGGGGTCCCATCAAGGTTCAGTGGCA GTGGATCTGGGACGGATTTCACTCTCACCATC AGCAGTCTGCAACCTGAAGATTTTGCAACTTA CTACTGTCAAACAGGGTTACAATACCCCACGT GGACGTTCGGCCAAGGGACCAAGGTGGAAAT CAAT<br><br>SEQ ID NO: 25071 | GAGGTGCAGCTGTTGGAGTCTGGGGGAGGCTTG GTACAGCCTGGGGGGTCCCTGAGACTCTCCTGTG CAGCCTCTGGATTCACCTTTAGAAGCTATGCCAT GAGCTGGGTCCGCCAGGCTCCAGGGAAGGGCT GGAGTGGGTCTCAGTTATTAGTGGTAGTGGTGT AACACATACTTCGCAGACTCCGTGAAGGGCCGGT TCACCATCTCCAGAGACAATTCCAAGAACACGCT GTATCTGCAAATGGACAGCCTGAGAGCCGAGGA CACGGCCGTATATTACTGTGCGAAAAGGGGTATA CCAGAGGCTGATGCTTTGATATCTGGGGCCAAG GGACAATGGTCACTGTCTCTCA<br><br>SEQ ID NO: 29077 |
| | | AA | DIQMTQSPSSLSASVGDRVTITCRSSQSINSYLNW YQQKPGKAPKLLIFAASSLHSGVPSRFSGSGSGT DFTLTISSLQPEDFATYYCQQGYNTPTWTFGQGT KVEIN<br><br>SEQ ID NO: 25072 | EVQLLESGGGLVQPGGSLRLSCAASGFTFRSYAMS WVRQAPGKGLEWVSVISGSGNTYFADSVKGRFTI SRDNSKNTLYLQMDSLRAEDTAVYYCAKRGIPEAD AFDIWGQGTMVTVSS<br><br>SEQ ID NO: 29078 |
| iPS:398476 | 21-225_17C1 | NA | GACATCCAGATGACCCAGTCTCCATCTCCCT GTCTGCATCTGTAGGAGACAGAGTCACCATCA CTTGCCGGGCAAGTCAGAGTCATTAACGACTAT TTAAATTGGTATCAGCAGAAACCAGGAAAG CCCTAAGCTCCTGATCTATGCTGCATCCAATT TGCAAAGTGGGGTCCCAGCAGATTCAGTGGC AGTCGATCTGGAACAGATTTCACTCTCACCAT CAGCAGTCTGCAACCTGAAGATTTTGCAACTT ACTACTGTCAACAGAGTTACAATACCCCTCCG GAGCGCAGTTTTGGCCAGGGGACCAAGCTGG AGATCAAA<br><br>SEQ ID NO: 25073 | GAGGTGCAGCTGTTGGAGTCTGGGGGAGGCTTG GAACAGCCTGGGGGGTCCCTGAGACTCTCTGTG CAGCCTCTGGATTCACCTTTAGCAGCTATGCCAT GAGCTGGGTCCGCCAGGCTCCAGGGAAGGGCT GGAGTGGGTCTCAGTTATTAGTGGTAGTGGTGGT ACCACATTCTACGCAGACTCCGTGAAGGGCCGGT TCACCATCTCCAGAGACAATTCCAAGAACACGCT GTATCTGCAAATGAGCAGCCTGAGAGCCGAGGA CACGGCCGTATATTCTGTGCCGATATTGTAGT AGTACCAGGTGTCCTTATGATGCTTTGATATCT GGGGCCAAGGGACAATGGTCACCGTCTCCTCA<br><br>SEQ ID NO: 29079 |

FIGURE 50
(Continued)

| | | | AA | DIQMTQSPSSLSASVGDRVTITCRASQNINDYLN WYQQKPGKAPKLLIYAASNLQSGVPARFSGSRS GTDFTLTISSLQPEDFATYYCQQTYNTPPERSFG QGTKLEIK SEQ ID NO: 25074 | EVQLLESGGGLEQPGGSLRLSCAASGFTFSSYAMS WVRQAPGKGLEWVSVISGSGGTTFYADSVKGRFTI SRDNSKNTLYLQMSSLRAEDTAVYFCARYCSSTRC PYDAFDIWGQGTMVTVSS SEQ ID NO: 29080 |
|---|---|---|---|---|---|
| iPS:398478 | 21-225_17C10 | | NA | GACATCCAGATGACCCAGTCTCCATCTCCA GTCTGCATCTGTAGGAGACAGAGTCACCATCA CTTGCCGGGCGAGTCAGGGCATTAGCAATTAT TTAGCCTGGTATCAGCAGAAACCAGGGAGAGT TCCTAAGCTCCTGATCTATGCTGCATCCACTTT GCAATCAGGGGTCCCATCTCGGTTCAGTGGCA GTGGATCTGGGACAGATTTCACTCTCACCATC AGCAGCCTGCAGCCTGACGATGTTGCAACTTA TTACTGTCAAAAGTATAACAGTGCCCCTCCGC TCACCTTCGGCCAAGGGACACGACTGGAGATT AAA SEQ ID NO: 25075 | GAGGTGCAGCTGGTGGAGTCTGGGGGAGGCTG GTCAAGCCTGGGGGGTCCCTGAGACTCTCTGTG CAGCCTCTGGATTCACCTTCAGTAGCTATAGCAT GAACTGGGTCCGCCAGGCTCCAGGGAAGGGGCT GGAGTGGGTCTCATCATTAGTGGTAGTAGTAGT TACATGTACTACGCAGACTCAGTGAAGGGCCGAT TCACCATCTCCAGAGACAACGCCAAGAACTCACT GTATCTGCAAATGAACAGCCTGCAGCCGAGGA CACGGCTCTGTATTACTGTGCGAGAGATCGTGGG AGTCCTGGGGCCAGGGAACCCTGGTCACCGTCT CCTCA SEQ ID NO: 29081 |
| | | | AA | DIQMTQSPSSQSASVGDRVTITCRASQGISNYLA WYQQKPGRVPKLLIYAASTLQSGVPSRFSGSGS GTDFTLTISSLQPDDVATYYCQKYNSAPPLTFGQ GTRLEIK SEQ ID NO: 25076 | EVQLVESGGGLVKPGGSLRLSCAASGFTFSSYSMN WVRQAPGKGLEWVSSISGSSSYMYYADSVKGRFTI SRDNAKNSLYLQMNSLRAEDTALYYCARDRGSSW GQGTLVTVSS SEQ ID NO: 29082 |

FIGURE 50
(Continued)

| | | | |
|---|---|---|---|
| iPS:398480 | 21-225_17G4 | NA | GACATCAGATGACCCAGTCTCCATCTCCCT GTCTGCATCTGCAGGAGACAGAGTCACCATCA CTTGCCGGACAAGTCAGAGAATATTAGCAACTAC TTAAATTGGTATCAGCAGAAACAGGAAAAG CCCCTAAGCTCCTGATCTATGTTGCGTCCAGTT TCCCAAGTGGGGTCCCATCAAGGTTCAGTGGC AGTGGATCTGGGACAGAGTTCACTCTCACCAT CAGCAGTCTGCAACCTGAAGATTTTGCAACTT ACTACTGTCAACAGAGTAACTTTTCCGCTC ACTTTCGGCGGAGGGACCAAGGTGGAGATCAT A<br>SEQ ID NO: 25077 | CAGGTGCAGTTGGTGCAGTCTGGGCTGAGGTGA AGAAGCCTGGGGCCTCAGTGAAGGTCTCCTGCA AGACTTCTGGATACACCTTCACCGACTATTATAT GCACTGGGTGCGACAGGCCCCTGGACAAGGGCT TGAGTGGATGGGATGGATCAACAGAAGTTCAGTGGT GGCACAAACTATGAACAGAAGTTCAGGCAGG GTCACCATGACCAGGGACACGTCCATCAGCACA GCCTACATGAACTGAGTAGGCTGAGATCTGAC GACACGGCCGTGTATTACTGTGCGAGTGGATACA GCTATGGTACAACTGGTTCGACCCTGGGGCCA GGGAACCCTGGTCACCGTCTCCTCA<br>SEQ ID NO: 29083 |
| | | AA | DIQMTQSPSSLSASAGDRVTITCRTSQNISNYLN WYQQKPGKAPKLLIYVASSFPSGVPSRFSGSGSG TEFTLTISSLQPEDFATYYCQQSNFPLTFGGGTK VEII<br>SEQ ID NO: 25078 | QVQLVQSGAEVKKPGASVKVSCKTSGYTFTDYYM HWVRQAPGQGLEWMGWINPNSGGTNYEQKFQGR VTMTRDTSISTAYMELSRLRSDDTAVYYCASGYSY GYNWFDPWGQGTLVTVSS<br>SEQ ID NO: 29084 |
| iPS:398482 | 21-225_17H6 | NA | GACATCAGATGACCCAGTCTCCATCCTCACT GTCTGCATCTGTAGGAGACAGAGTCACCATCA CTTGTCGGGCGAGTGGGACATTAGCAATTAT TTAGCCTGGTTTCAGCAGAAACCAGGAAAGC CCCTAAGTCCCTGATCTCTACTGCATCCAGTT GCAAAGTGGGGTCCCATCAAAGTTCAGTGGCA GTGGATCTGGGACAGATTTCACTCTCACCATC AGCAGCCTGCAGCCTGAAGATTTTGCAATTTA TTACTGCCAACAGTATCATAGTTACCCATTCA CTTTCGGCCCTGGGACCAAAGTGGATATCCAA<br>SEQ ID NO: 25079 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAGGGGCT GGAGTGGGTCTCATCCATTAGTGGTAGTAGT TACATATACTACGCAGACTCAGTGAAGGGCCGAT TCACCATCTTCAGAGACAACGCCAAGAACTACT GTATCTGCAAATGAACAGCTGTGCGAGAGCCGAGGA CACGGCTGTGTATTACTGTGCGAGAGTGGCTTCA TTTGACTACTGGGGCCAGGGAACCCTGGTCACCG TCTCCTCA<br>SEQ ID NO: 29085 |

FIGURE 50
(Continued)

| | | | |
|---|---|---|---|
| | AA | DIQMTQSPSSLSASVGDRVTITCRASRDISNYLA WFQQKPGKAPKSLISTASSLQSGVPSKFSGSGSG TDFTLTISSLQPEDFAIYYCQQYHSYPFTFGPGTK VDIQ<br><br>SEQ ID NO: 25080 | EVQLVESGGGLVKPGGSLRLSCAASGFTFSSYSMN WVRQAPGRGLEWVSSISGSSSYIYYADSVKGRFTIF RDNAKNSLYLQMNSLRAEDTAVYYCARVASFDY WGQGTLVTVSS<br><br>SEQ ID NO: 29086 |
| iPS:398484 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGGAAAGTGGGGTCCCATCAAGGTTCAGCGG CAGTGGATCTGGGACAGAATTCACTCTCACAG TCAGCAGCCTGCAGCCTGAAGATTTTGCAACT TATTACTGTCTACATCATAATAATTACCTCCCC ATCACCTTCGGCCAAGGGACACGACTGGAGAT TAAA<br><br>SEQ ID NO: 25081 | CAGGTGCAACTGGTGCAGTCTGGGGCTGAGGTG AAGAAGCCTGGGGCCTCCGTGAAGGTCTCCTGCA AGGCTTCTGGATACACCTTCACCGGCTACTATTT AGGCTGGGTGCGACAGGCCCCTGGACAAGGGCT TGAGTGGCTGGGATGGATCAACCCTAACAGTAAT GGCACAATCTCTGCACAGAAGTTTCAGGGCAGG GTCACCATGACCAGGGACACGTCCATCAGCACA GCCTACATGGAGCTGAGCAGGCTGAGATCTGACG ACACGGCCGTATATTACTGTGCGAGAGATGGTAC CAGCTCGCTTGACTACTGGGGCCAGGGAACCCTG GTCACCGTCTCCTCA<br><br>SEQ ID NO: 29087 |
| 21-225_18D4 | AA | DIQMTQSPSSLSASVGDRVTITCRASQGIRNDLG WYQQKPGKAPKRLIYAASSLESGVPSRFSGSGSG TEFTLTVSSLQPEDFATYYCLHHNNYLPITFGQG TRLEIK<br><br>SEQ ID NO: 25082 | QVQLVQSGAEVKKPGASVKVSCKASGYTFTGYYL HWVRQAPGQGLEWLGWINPNSNGTISAQKFQGRV TMTRDTSISTAYMELSRLISDDTAVYYCARDGTSSL DYWGQGTLVTVSS<br><br>SEQ ID NO: 29088 |

FIGURE 50
(Continued)

| | | | |
|---|---|---|---|
| iPS:398486 | 21-225_19A1 | NA | GACATCCAGATGACCCAGTCTCCATCTCCCT GTCTGCATCTGTAGGAGACAGAGTCACCATCA CTTGCCGGGCAAGTCATACCATTACCAGCTAT TTAAATTGGTATCAGCAGAAACCAGGGAAAG CCCCTAAGTTCCTGATCTATGCTACATCCAATC TCCAAAGTGGGGTCCCATCAAGGTTCAGTGGC AGTGGATCTGGGACAGATTTCACTTTTACCAT CAGCAGTCTGCAACCTGAACAGATTTTGCAATTT ACTACTGTCAACAGAGTTACAACTTCCCGCTC ACTTTCGGCGGAGGGACCAAGGTGGAGATCA AA SEQ ID NO: 25083 | CAGGTGCAACTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGC TTGAGTGGATGGGATGGATCAATCCTAACAGTGG TGGCACAAACTATGCACAGGGACACGTCCATCAG GGTCACCATGACCAGGACAGTCCATCAGCAC AGCCTACATGGAGCTGAGCAGGCTGAGATCTGA CGACACAGGCCGTGTATTACTGTGCGAGTGGATAC AGCTATGGGTACAACTGGTTCGACCCCTGGGCC AGGGAACCCTGGTCACCGTCCTCA SEQ ID NO: 29089 |
| | | AA | DIQMTQSPSSLSASVGDRVTITCRASHITSYLN WYQQKPGKAPKFLIYATSNLQSGVPSRFSGSGS GTDFTFTISSLQPEDFAIYYCQQSYNFPLTFGGGT KVEIK SEQ ID NO: 25084 | QVQLVQSGAEVKKPGASVKVSCKASGYTFTGYYM HWVRQAPGQGLEWMGWINPNSGGTNYAQKFQGR VTMTRDTSISTAYMELSRLRSDDTAVYYCASGYSY GYNWFDPWGQGTLVTVSS SEQ ID NO: 29090 |
| iPS:398488 | 21-225_19F6 | NA | TCCTATGAGCTGACTCAGCCACCCTCAGTGTC CGTGTCCCCAGGACAGACAGTCAGCATCACCT GCTCTGGAGATAAATTGGGGGATAAATATGCT TGCTGGTATCAGCAGAAGCCAGGCCAGTCCCC TGTGCTGGTCATCTATCAAGATAGCAAGCGGC CCTCAGGGACCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAACACACTGTGTA TTCGGCGGAGGGACCAAGCTGACCGTCCTA | GAGGTGCAGCTGGTGGAGTCTGGGGGAGGCTTG GTGAAGCCTGGGGGGTCCCTTAGACTCTCCTGTG CAGCCTCTGGATTCACTTTCAGTAGCTAACGCCTGGAT GAACTGGGTCCGCCAGGCTCCAGGGAAGGGCT GGAGTGGGTTGGCCGTATTAAAAGCAAAACTGA TGGTGGGACAACAGATACGCTGCACCGTGAA AGGCAGATTCACCATCTCAAGAGATGATTCAAA AAACACGTGTATCTGCAAATGAACAGCCTGAA AACCGAGGACACAGCCGTGTATTACTGTGCCACA GATACGGGTCCTATAGCGTATGGACGCTCGCTTACT ACTACTATTACGCTATGGACGTCTGGGGCCACGG GACCACGGTCACCGTCTCCTCA |

FIGURE 50
(Continued)

| | | | SEQ ID NO: 25085 | SYELTQPPSVSVSPGQTVSITCSGDKLGDKYACW YQQKPGQSPVLVIYQDSKRPSGSNSGN TATLTISGTQAMDEADYYCQAWDNNTVFGGG TKLTVL | SEQ ID NO: 29091 | EVQLVESGGGLVKPGGSLRLSCAASGFTFSNAWM NWVRQAPGKGLEWVGRIKSKTDGGTTDYAAPVK GRFTISRDDSKNTLYLQMNSLKTEDTAVYYCTTDT GPIAARLAYYYYAMDVWGHGTTVTVSS |
| --- | --- | AA | SEQ ID NO: 25086 | | SEQ ID NO: 29092 | |
| iPS:398490 | 21-225_21D12 | NA | | TCCTATGAGCTGACTCAGCCACCCTCAGTGTC CGTGTCCCCAGGACAGACAGCCAGCATCACCT GCTCTGGAGATAAATTGGGAATAAATATGCT TACTGGTATCAGCAGAAGCCAGGCCAGTCCCC TGTGTTGGTCATCTATCAAGATAGAAAGAGGC CCTCAGGGGATCCCTGAGCGATTCTCTGGCTCC AACTCTGGGAACACAGCCACTCTGACCATCAG CGGGACCCAGGCTATGGATGAGGCTGACTTTT ACTGTCAGGCGTGGGACAACAGCACTGTGTA TTCGGCGGAGGGACCAAGGCTGACGTCCTA | | CAGGTGCAGCTGGTGCAGTCTGGGGCTGAGGTG AAGAAACCTGGGGCCTCAGTGAAGGTCTCCTGC AAGGCTTCTGGATACACCTTCACCGACTACTATA TTCACTGGGTGCGACAGGCCCCTGGACAAGGGCT TGAGTGGATGGGATGGATCAACCCTAACAGTGGT GGGACAAACAATGCACAGGAGACACGTCAGGAGG GTCACCATGACCAGGGACACGTCCATCAGTACA GCCTACATGGAGCTGAGCAGGCTGAGATCTGAC GATACGGCCGTGTATTCCTGTGCGAGGTCGTATT ACTATGGTTCGGGGACTTATTATAACGAATTTGA CTACTGGGGCCAGGGAACCCTGGTCACCGTCTCC TCA |
| | | | SEQ ID NO: 25087 | SYELTQPPSVSVSPGQTASITCSGDKLGNKYAY WYQQKPGQSPVLVIYQDRKRPSGIPERFSGSNSG NTATLTISGTQAMDEADFYCQAWDNSTVFGG GTRLTVL | SEQ ID NO: 29093 | QVQLVQSGAEVKKPGASVKVSCKASGYTFTDYYIH WVRQAPGQGLEWMGWINPNSGGTNNAQKFQGRV TMTRDTSISTAYMELSRLRSDDTAVYSCARSYYYG SGTYYNEFDYWGQGTLVTVSS |
| | | AA | SEQ ID NO: 25088 | | SEQ ID NO: 29094 | |

FIGURE 50
(Continued)

| | | | |
|---|---|---|---|
| iPS:398494 | 21-225_21H4 | NA | CAGTCTGCCCTGACTCAGCCTGCCTCCGTGTCT GGGTCTCCTGGACAGTCGATCACCATCTCCTG CACTGGAACCAGCAGTGACGTTGGTGTTATA ACTCTGTCTCCTGGTACCAACAGCACCCAGAC AAAGCCCCCAAACTCATGATTTATGAGGTCAG TAATCGGCCCTCAGGGGTTTCTAATCGCTCTC TGGCTCCAAGTCTGGCAACACGGCCTCCCTGA CCATCTCTGGGCTCCAGGCTGAGGACGAGGCT GATTATTACTGCAGCTCATATACAAGGAGCAG CACTGTGGTATTCGGCGGAGGGACCAAGCTGA CCGTCCTA<br><br>SEQ ID NO: 25089 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTCTTAGTGGTCGTGGTGGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGGGAC GTGGATACAGCTATGAGTACTACTACGGTATGGA CGTCTGGGGCCAAGGGACCACGGTCACCGTCTCC TCA<br><br>SEQ ID NO: 29095 |
| | | AA | QSALTQPASVSGSPGQSITISCTGTSSDVGGYNSV SWYQQHPDKAPKLMIYEVSNRPSGVSNRFSGSK SGNTASLTISGLQAEDEADYYCSSYTRSSTVVFG GGTKLTVL<br><br>SEQ ID NO: 25090 | EVQLLESGGGLVQPGGSLRLSCAASGFTFSSYAMS WVRQAPGKGLEWVSALSGRGGSTYYADSVKGRFT ISRDNSKNTLYLQMNSLRAEDTAVYYCAKWGRGY SYEYYYGMDVWGQGTTVTVSS<br><br>SEQ ID NO: 29096 |
| iPS:398496 | 21-225_22D2 | NA | GACATCGTGATGACCCAGTCTCCAGACTCCCT GGCTGTGTCTCTGGGCGAGAGGGCCACCATCA CCTGCAAGTCCAGCCAGAGTGTTTTACACAGC TCCAACAATAACAACTACTTAGTTGGTACCA GCAGAAACCAGGACAGCCTCCTAAGCTACTCA TTTACTGGGCATCTACCCGGGAAATCCGGGGTC CCTGACCGATTCAGTGGCAGCGGGTCTGGGAC AGATTTCACTCTCACCATCAGCAGCCTGCAGG CTGAAGATGTGGCAGTTTATTTCTGTCAGCAA TATTATAGTACTCCGTGCAGTTTTGGCCAGGG GACCAAGCTGGAGATCAAA<br><br>SEQ ID NO: 25091 | CAGGTGCAGCTGGTGCAGTCTGGGGCTGAGGTG AAGAAGCCTGGGGCCCTCAGTGAAGGTCTCCTGC AAGGCTTCTGGATACACCTTCATAAATTATGATA TCAACTGGGTGCGACAGGCCACTGGACAAGGC TTGAGTGGATGGGATGGATGCACCCTGACAGTGG TAACACAGGCTATGCACAGAAGTTCCAGGCAG AGTCACCATGACCAGGAACACCTCCATAAGCAC AGCCTACATGGAGCTGAGCAGTTTGAGATCTGAG GACACGGCCGTGTATTATTGTGCGTATAGTAGTG GCTGGTACTACTTTGACTACTGGGGCCAGGGAAC CCTGGTCACCGTCTCCTCA<br><br>SEQ ID NO: 29097 |

FIGURE 50
(Continued)

| | | | | |
|---|---|---|---|---|
| iPS:398498 | 21-225_22E6 | AA | DIVMTQSPDSLAVSLGERATITCKSSQSVLHSSN NNNYLAWYQQKPGQPPKLLIYWASTRKSGVPD RFSGSGSGTDFTLTISSLQAEDVAVYFCQQYYST PCSFGQGTKLEIK SEQ ID NO: 25092 | QVQLVQSGAEVKKPGASVKVSCKASGYTFINYDIN WVRQATGQGLEWMGWMHPDSGNTGYAQKFQGR VTMTRNTSISTAYMELSSLRSEDTAVYYCAYSSGW YYFDYWGQGTLVTVSS SEQ ID NO: 29098 |
| | | NA | TCCTATGAGCTGACTCAGCCACCCTCAGTGTC CGTGTCCCCAGGACAGACAGCCAGCATCACCT GCTCTGGAGATAAATTGGGGGAGAAATATGCT TGCTGGTATCAGCAGAAGCCAGGCCAGTCCC TGTGTTGGTCATCTATCAAGATAGAAAGCGGC CCTCAGGGATCCTGAGCGATACTCTGGCTCC AACACTGGAACACAGCCACTCTGACCATCAG CGGGACCCAGGCTATGATGAGGCTGACTATT ACTGTCAGGCGTGGGACAGCAGCACTGCGGTA TTCGGCGGAGGGACCAAGCTGACCGTCCTA SEQ ID NO: 25093 | CAGATCACCTTGAAGGAGTCTGGTCCTACGCTGG TGAAACCACACAGACCCTCACGCTGACCTGCAC CTTCTCTGGGTTCTCACTCAGCACTGGTGGAGTG GGTGTGGGCTGATCCGTCAGCCCCCAGGAAAG GCCCTGAGTGGCTGCACTCATTATTGGAATG ATGATAAGCGCTACAGCCCATCTCTGAAGAGCA GGCTCACCATCACCAGGGACACCTCCAAAAACC AGGTGGTCTTACAATGACCAACATGACCCTGT GGACACAGCCACTATTACTGCACTACTATA GCAGTTCGTGGCTTTGACTACTACTGGGGCCAGGGAA CCCTGGTCACCGTCTCCTCA SEQ ID NO: 29099 |
| | | AA | SYELTQPPSVSVSPGQTASITCSGDKLGEKYACW YQQKPGQSPVLVIYQDRKRPSGIPERYSGSNTGN TATLTISGTQAMDEADYYCQAWDSSTAVFGGG TKLTVL SEQ ID NO: 25094 | QITLKESGPTLVKPTQTLTLTCTFSGFSLSTGGVVG WIRQPPGKALEWLALIYWNDDKRYSPSLKSRLTIT RDTSKNQVVLTMTNMDPVDTATYYCAHTIAVRGF DYWGQGTLVTVSS SEQ ID NO: 29100 |

FIGURE 50
(Continued)

| | | | | |
|---|---|---|---|---|
| iPS:398500 | 21-225_23A11 | NA | GACATCCAGATGACCCAGTCTCCATCCTCACT GTCTACATCTGTAGGAGACAGAGTCACCATCA CTTGTCGGGCGAGTCAGGACATTAGCAATTAT TAGCCTGGTTTCAGCAGAAACCAGGGAAAGC CCCTAAGCGCCTGATCTATGCTGCATCCACTTT GCAAAGTGGGGTCCCATCAAAGTTCAGCGGCA GTGGATCTGGGACAGATTTCACTCTCACCATC AGCAGCCTGCAGCCTGAAGATTATAGTTACCA TTACTGCCAACAGTATAATAGTTACCCATTCA CTTTCGGCCCTGGGACCAAAGTGGATCTCAAG<br/>SEQ ID NO: 25095 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGTTATAGCAT GAACTGGATCCGCCAGGCTCCAGGAAGGGCT GGAGTGGGTCTCATCCATTAGTGGTAGTAGTACT TACATATACTACGCAGACTCAGTGAAGGGCCGA ATCGCCATCTCCAGAGACAACGCCAAGAACTCA CTGTATCTGCAAATGAACAGCCTGAGAGCCGAG GACACGGCTGTGTATTACTGTGCGAGAGTGGCTT CATTTGACTACTGGGGCCAGGGAACCCTGGTCAC CGTCTCCTCA<br/>SEQ ID NO: 29101 |
| | | AA | DIQMTQSPSSLSTSVGDRVTITCRASQDISNYLA WFQQKPGKAPKRLIYAASTLQSGVPSKFSGSGS GTDFTLTISSLQPEDFATYYCQQYNSYPFTFGPG TKVDLK<br/>SEQ ID NO: 25096 | EVQLVESGGGLVKPGGSLRLSCAASGFTFSSYSMN WIRQAPGKGLEWVSSISGSSTYYADSVKGRIAIS RDNAKNSLYLQMNSLRAEDTAVYYCARVASFDY WGQGTLVTVSS<br/>SEQ ID NO: 29102 |
| iPS:398502 | 21-225_23B11 | NA | GACATCCAGATGACCCAGTCTCCATCTCCGT GTCTGCATCTGTAGGAGACAGAGTCACCATCA CTTGTCGGGCGAGTCAGGGTATTAGCAAGTGG TTAGCCTGGTATCAGCAGAAAACCAGGGAAAG CCCCTAAAGTCCTGATCTATGCTGCATCCAGTT TGCAAAGTCGGGTCCCATCAAGGTTCAGCGGC AGTAGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A<br/>SEQ ID NO: 25097 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATC TGCACTGGGTGCGACAGGCCCCTGGACAAGGGC TTGAGTGGATGGGATGGATCAACCCTAACAATAA TGGCACAAACTATGCACAGAAGTTTCAGGGCAG GGTCACCATGACCAGGGACACGTCCATCAGCAC AGCCTACATGGAGCTGAGCCGGCTGAGATCTGA CGACACGGCCGTGTATTACTGTGCGAGAGATGGT ACCAGCTCGTTTGACTACTGGGGCCAGGGAACCC TGGTCACCGTCTCCTCA<br/>SEQ ID NO: 29103 |

FIGURE 50
(Continued)

| | | | |
|---|---|---|---|
| iPS:398504 | 21-225_23D7 | AA | DIQMTQSPSSVSASVGDRVTITCRASQGITKWLA WYQQKPGKAPKVLIYAASSLQSRVPSRFSGSRS GTDFTLTISSLQPEDFATYYCQQANSFPFTFGPGT KVDIK<br>SEQ ID NO: 25098 | QVQLVQSGAEVKKPGASVKVSCKASGYTFTGYYL HWVRQAPGQGLEWMGWINPNNGTNYAQKFQGR VTMTRDTSISTAYMELSRLRSDDTAVYYCARDGTS SFDYWGQGTLVTVSS<br>SEQ ID NO: 29104 |
| | | NA | TCCTATGAACTGACTCAGCCACCCTCAGTGTC CGTGTCCCCAGGACAGACAGCCAGCATCACCT GCTCTGGAGAAAATTGGGGGATAAAATATGTT TGTTGGTATCAGCAGAAGCCAGGCCAGTCCCC TGTGGTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTGATGAGGCTGACTATT ACTGTCAGGCGTGGAACAGCAGCAATGTGGTA TTCGGCGGAGGGACCAAGCTGACCGTCCTA<br>SEQ ID NO: 25099 | CAGATCACCTTGAAGGAGTCTGGTCCTACGCTGG TGAAACCCACACAGACCCTCACGCTGACCTGCAC CTTCTCTGGGTTCTCACTCAGCACTAGTGGAGTG GGTGGGCTGAATCCGTCAGCCCCAGGAAAG GCCCTGGAGTGCTTTCACTCATTATTGGAATA ATGATAAGGTCTACAGCCATCTGAAGAGCAG GCTCACCATCAGTAAGCACCTCCAAAACCAG GTGGTCCTTACAATGTCCAACATGGACCCTGTGG ACACAGCCACATATTACTGTGCACACAGGGAC AGCAGCTGGCCCTGACTACTGGGGCCAGGGAA CCCTGGTCACCGTCTCCTA<br>SEQ ID NO: 29105 |
| | | AA | SYELTQPPSVSVSPGQTASITCSGEKLGDKYVCW YQQKPGQSPVVVIYQDSKRPSGIPERFSGSNSGN TATLTISGTQAMDEADYYCQAWNSSNVVFGGG TKLTVL<br>SEQ ID NO: 25100 | QITLKESGPTLVKPTQTLTLTCTFSGFSLSTSGVGVG WIRQPPGKALECLSLIYWNDKVYSPSLKSRLTITK YTSKNQVVLTMSNMDPVDTATYYCAHRGQQLAL DYWGQGTLVTVSS<br>SEQ ID NO: 29106 |

FIGURE 50
(Continued)

| | | | |
|---|---|---|---|
| iPS:398506 | 21-225_23G12 | NA | GACATCGTGATGACCCAGTCTCCAGACTCCCT GGCTGTGTCTCTGGGCGAGAGGGCCACCATCA ACTGCAAGTCCAGCAGTGATTTTATTCAGC TCCAACAATAACAAGAGTACTTAGCTTGGTACCA GCAGAAACCAGGACAGCCTCCTAAGTTGCTCA TTTACTGGGCATCTACCCGGGAATCCGGGGTC CCTGACCGATTCAGTGGCAGCGGGTCTGGGAC AGATTCACTCTCACCATCAGCAGCCTGCAGG CTGAAGATGTGGCAGTTTATTTCTGTCAGCAA TATTCTAGTACTCCGTGACGTTCGGCCAAGG GACCAAGGTGGAAATCAAA SEQ ID NO: 25101 | CAGGTGCAGCTGCTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGTACCCTAACAGTGG TAACACGGGCTATGCACAGAAGTTCCAGGGCAG AGTCACCATGACCATGAACACCTCCATAAGCACA GCCTACATGGAGTTGAGCAGCCTGAGATCTGAG GACACGGCCGTGTATTACTGTGCGATTAGCGGTG GCTGGTACTACTTTGACTACTGGGGCCAGGGAAC CCTGGTCACCGTCTCCTCT SEQ ID NO: 29107 |
| | | AA | DIVMTQSPDSLAVSLGERATINCKSSQSILFSSNN NNYLAWYQQKPGQPPKLLIYWASTRESGVPDRF SGSGSGTDFTLTISSLQAEDVAVYFCQQYSSTPW TFGQGTKVEIK SEQ ID NO: 25102 | QVQLLQSGAEVKKPGASVKVSCKASGYTFTNYDIN WVRQATGQGLEWMGWMYPNSGNTGYAQKFQGR VTMTMNTSISTAYMELSSLRSEDTAVYYCAISGGW YYFDYWGQGTLVTVSS SEQ ID NO: 29108 |
| iPS:398508 | 21-225_24B1 | NA | GATGTTGTGATGACTCAGTCTCCACTCTCCCTG CCCGTCACCCTTGGACAGCCGGCCTCCATCTC CTGCAGGTCTAGTCAAAGCCTCGTATACAGTG ATGGAAACACCTACTTGAATTGGTTTCAGCAG AGGCCAGGCCAATCTCCAAGGCGCCTAATTTA TAAGGTTTCTAACTGGGACTCTGGGGTCCCAG ACAGATTCAGCGGCAGTGGGTCAGGCACTGAT TTCACACTGAAAATCAGCTGGGTGGAGGCTGA GGATGTTGGGGTTTGTTACTGCATGCAAGGTG CACACTGGCCTCCGATCACCTTCGGCCAAGGG ACACGACTGGAGATTAAA SEQ ID NO: 25103 | GAGGTGCAGCTGTTGGAGTCTGGGGGAGGCTTG GTACAGCCTGGGGGGTCCCTGAGACTCTCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTGGTGGTGGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGGAC GTGGATACAGTATGAGTACTACTACGTATGGA CGTCTGGGGCCAGGGACCACCGTCACCGTCTCC TCA SEQ ID NO: 29109 |

FIGURE 50
(Continued)

| | | | | |
|---|---|---|---|---|
| iPS:398510 | 21-225_25A3 | AA | DVVMTQSPLSLPVTLGQPASISCRSSQSLVYSDG NTYLNWFQQRPGQSPRRLIYKVSNWDSGVPDRF SGSGSGTDFTLKISWVEAEDVGVCYCMQGAHW PPITFGQGTRLEIK<br>SEQ ID NO: 25104 | EVQLLESGGGLVQPGGSLRLSCAASGFTFSSYAMS WVRQAPGKGLEWVSAISGRGGSTYYADSVKGRFTI SRDNSKNTLYLQMNSLRAEDTAVYYCAKWGRGY SYEYYGMDVWGQGTTVTVSS<br>SEQ ID NO: 29110 |
| | | NA | CAGGTGCAGCTGGTGCAGTCTGGGGCTGAGGTG GACTGTGTCTGGGCGAGAGGGCCACCATCA ACTGCAAGTCCAGCAGAGTGTTTATACAGC TCCAACAATAAGAACTGGACAGCCTCCAAGGC GCAGAAACCTGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAA CTGAAGATGTGGCAGTTTATTACTGTCAGCAA TATTATAGTACTCCGTGCAGTTTTGGCCAGGG GACCAGGCTGGAGATCAAA<br>SEQ ID NO: 25105 | CAGGTGCAGCTGGTGCAGTCTGGGGCTGAGGTG AAGAAGCCTGGGGCCTCAGTGAAGGTCTCCTGC AAGGCTTCTGGATACATCTTCACCAATTATGATA TCAACTGGGTGCGACAGGCCACTGGACAAGGGC TTGAGTGGATGGGATGATGCACAGAAGTTCCAGTGG TAACACAGGCTATGCACTGACACCTAACAGTGG AGTCACCATGACCTGGAACACCTCCATAAGCACA GCCAACATGGAGCTGAGCAGCCTGAGATCTGAG GACACCGCCGTGTATTACTGTGCGAGTAGCAGTG GCTGGTATTGGTTCGACCCTGGGGCCAGGGAAC CCTGGTCACCGTCTCCTCA<br>SEQ ID NO: 29111 |
| | | AA | DIVMTQSPDSLTVSLGERATINCKSSQSVLYSSN NKNYLAWYQQKPGQPPKLLIYWASTRESGVPD RFSGSGSGTDFTLTISSLQAEDVAVYYCQQYYST PCSFGQGTRLEIK<br>SEQ ID NO: 25106 | QVQLVQSGAEVKKPGASVKVSCKASGYIFTNYDIN WVRQATGQGLEWMGWMHPNSGNTGYAQKFQGR VTMTWNTSISTANMELSSLRSEDTAVYYCASSSGW YWFDPWCQGTLVTVSS<br>SEQ ID NO: 29112 |

FIGURE 50
(Continued)

| | | | |
|---|---|---|---|
| iPS:398512 | 21-225_25E12 | NA | GACATCGTGCTGACCCAGTCTCCAGACTCCT GGCTATGTCTCTGGGCGAGAGGGCCACCATCA ACTGCAAGTCCAGCCAGAGTGTTTATACCAC TCCAACAATTACAACTACTTAGCTTGGTACCA GCAGAAACCAAAACAGCCTCCTAAGCTGCTCA TTTACTGGGCATCTACCCGGGAGTCCGGGGTC CCTGACCGATTCAGTGGCAGCGGGTCTGGGAC ATATTTCACTCTCACCATCAGCAGCCTCCAGG CTGAAGATGTGGCAGTTTATTACTGTCAGCAA TATTACAGTACTCCGTGCAGTTTTGGCCAGGG GACCAACCTGGAGATCAAA <br> SEQ ID NO: 25107 | CAGGTGCAGCTGGTGCAGTCTGGGGCTGAGGTG AAGAAGCCTGGGGCCTCAGTGAAGGTCTCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACCTGGAGCTGAGCAGCCTGAGATCTGA GGACACGGCCGTGTATTACTGTGCGGGAGCAA TGGCTGGTTACTACTTTGACTACTGGGGCCAGGA ACCCTGGTCACCGTCCTCA <br> SEQ ID NO: 29113 |
| | | AA | DIVLTQSPDFLAMSLGERATINCKSSQSVLYHSN NYNYLAWYQQKPKQPPKLLIYWASTRESGVPD RFSGSGSGTYFTLTISSLQAEDVAVYYCQQYYST PCSFGQGTNLEIK <br> SEQ ID NO: 25108 | QVQLVQSGAEVKKPGASVKVSCKASGYTFTNYDIN WVRQATGQGLEWMGWMNPNSGNTGYAQKFQGR VTMTRNTSISTAYLELSSLRSEDTAVYYCAGSNGW VTMTRNTSISTAYLELSSLRSEDTAVYYCAGSNGW YYFDYWGQGTLVTVSS <br> SEQ ID NO: 29114 |
| iPS:398516 | 21-225_26A9 | NA | GACATCGTGATGACCCAGTCTCCAGACTCCCT GGCTGTGTCTCTGGGCGAGAGGGCCACCATCA ACTGCAAGTCCAGCCAGAGTGTTTATACAGC TCCAACAATAAGAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGAC AGACTTCACTCTCACTATCAGCAGCCTGCAGG CTGAAGATGTGGCAGTTTATTACTGTCAGCAA TATTATAGTAGTCCGTGCAGTTTTGGCCAGGG GACCAGGCTGGAGATCAAA <br> SEQ ID NO: 25109 | CAGGTGCAGCTGGTGCAGTCTGGGGCTGAGGTG AAGAAGCCTGGGGCCTCAGTGAAGGTCTCTGC AAGGCTTCTGGATACACCTTCACCAATTATGATA TCAACTGGGTGCGACAGGCCACTGGACAAGGC TTGAATGGATGGGATGATGCACCTAACAGTGG TAACACAGGCTGTGCACAGAAGTTCCAGGGCAG AGTCACCATGACCTGGAACATGTCCATAAGCACA GCCTACATGGAGCTGAGCAGCCTGAGATCTGAG GACACGGCCGTATTACTGTGCGAGTAGCAGTG GCTGGTACTGGTTCGACCCCTGGGGCCAGGAAC CCTGGTCACCGTCCTCA <br> SEQ ID NO: 29115 |

FIGURE 50
(Continued)

| | | | | |
|---|---|---|---|---|
| iPS:398520 | 21-225_31C4 | AA | DIVMTQSPDSLAVSLGERATINCKSSQSVLYSSN NKNYLAWYQQKPGQPPKLLIYWASTRESGVPD RFSGSGSGTDFTLTISSLQAEDVAVYYCQQYYSS PCSFGQGTRLEIK<br>SEQ ID NO: 25110 | QVQLVQSGAEVKKPGASVKVSCKASGYTFTNYDIN WVRQATGQGLEWMGWMHPNSGNTGCAQKFQGR VTMTWNMSISTAYMELSSLRSEDTAVYYCASSSG WYWFDPWGQGTLVTVSS<br>SEQ ID NO: 29116 |
| | | NA | GACATCCAGATGACCCAGTCTCCATCTTCCGT GTCTGCATCTGTAGGAGACAGAGTCACCATCA CTTGTCGGGCGAGTCAGGGTCAGAGTTATTAGCAAATGG TTAGCCTGGTATCAGCAGAAACCAGGGAAAG CCCCTAAACCCCTGATCTATGCTGCATCCAGTT TGCAGAGTGGGGTCCCAACAAGGTTCAGCGGC AGTGGATCTGGGACAGATTTCACTCTCACCAT CAGCAGCCTGCAGCCTGAAGATTTTGCAATTT ACTATTGTCAACAGGCTAACAGTTTCCCATTC ACTTTCGGCCCTGGGACCAAAGTGGATATCAA A<br>SEQ ID NO: 25111 | CAGGTGCAGTTGGTGCAGTCTGGGACTGAGGTGA AGAAGCCTGGGGCCTCAGTGAAGGTCTCCTGCA AGGCTTCTGGATACACCTTCACCGGCGATTATAT GCACTGGGTGCGACAGGCCCCTGGACAAGGGCT TGAGTGGATGGATGGATCAGCCTAAAAATGG TGGCACAAACTATGCACAGAAGTTTCAGGGCAG GGTCACCATGACCAGGACACGTCCATCAGCAC AGTCTACATGGAGCTGAACAGGCTGAGATCTGA CGACACGGCCGTGTATTACTGTGCGAGAGATGG AACTGGGGTCTTTGACTACTGGGGCCAGGGAACC CTAGTCACCGTCTCCTCA<br>SEQ ID NO: 29117 |
| | | AA | DIQMTQSPSSVSASVGDRVTITCRASQGISKWLA WYQQKPGKAPKPLIYAASSLQSGVPTRFSGSGS GTDFTLTISSLQPEDFAIYYCQQANSFPFTFGPGT KVDIK<br>SEQ ID NO: 25112 | QVQLVQSGTEVKKPGASVKVSCKASGYTFTGDYM HWVRQAPGQGLEWMGWISPKNGGTNYAQKFQGR VTMTRDTSISTVYMELNRLRSDDTAVYYCARDGT GSFDYWGQGTLVTVSS<br>SEQ ID NO: 29118 |

FIGURE 50
(Continued)

| | | | |
|---|---|---|---|
| iPS:398522 | 21-225_32A1 | NA | GACATCGTGATGACCCAGTCTCCAGACTCCCT GGCTGTGTCTCTGGGCGAGAGGGCCACCATCA ACTGCAAGTCCAGCCAGAGTGTTTATACAGC TCCAACAATTACAACTACTTAGCTTGGTACCA GCTGAAACCAGGACAGCCTCCTAAGCTGCTCA TTTACTGGGCATCTACCCGGAAATCCGGGGTC CCTGACCGATTCAGTGGCAGCGGGTCTGGGAC AGATTTCACTCTCACCATCAGCAGCCTGCAGA CTGAAGATGTGGCACTTTATTACTGTCAACAA TATTATACTTCTCCGTCAGTTTTGGCCAGGG ACCAAGCTGGAGATCAAA SEQ ID NO: 25113 | CAGGTGCAGCTGGTGCAGTCTGGGGCTGAGGTG AAGAAGCCTGGGGCCTCAGTGAAGGTCTCCTGC AAGGCTCTGGATACACCTTCACCAACTATGATA TTAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCGAGCAGCA GTGGCTGGTACTTTTTGACTACTGGGGCCAGGG AACCCTGGTCACCGTCTCCTCA SEQ ID NO: 29119 |
| | | AA | DIVMTQSPDSLAVSLGERATINCKSSQSVLYSSN NYNYLAWYQLKPGQPPKLLIYWASTRKSGVPD RFSGSGSGTDFTLTISSLQTEDVALYYCQQYYTS PCSFGQGTKLEIK SEQ ID NO: 25114 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCASSSGW YFFDYWGQGTLVTVSS SEQ ID NO: 29120 |
| iPS:398524 | 21-225_32A5 | NA | GACATCGTGATGACCCAGTCGCCAGACTCCCT GGCTGTGTCTCTGGGCGAGAGGGCCACCATCA ACTGCAAGTCCAGCCAGAGTGTTTACACAGC TCCAACAATAAGAACTACTTAGCTTGGTATCA GCAGAAACCAGGACAGCCTCCTAAGCTGCTCA TTTACTGGGCATCTACCCGGAATCCGGGGTC CCTGACCGTTCAGTGGCAGCGGGTCTGGGAC AGATTTCACTCTCGCCATCAGCAGCCTGCAGG CTGAAGATGTGGCACTTTATCACTGTCAGCAA TATTATAGTTCTCCGTCAGTTTGGCCAGGG GACCGGGCTGGAGATCAAA SEQ ID NO: 25115 | CAGGTGCAGCTGGTGCAGTCTGGGGCTGAGGTG AAGAAGCCTGGGGCCTCAGTGAAGGTCTCCTGC AAGGCTCTGGATACACCTTCACCAATTATGACA TCAACTGGGTGCGACAGGCCACTGGACAAGGGC TTGAGTGGATGGGATGGATGCACAGAAGTTCCGGGCAG TAACACAGGCTTTGCACAGAAACACCTCCATAAGCAC AGTCACCATGACCAGAAACACCTCCATAAGCAC AGCCTACATGAACTGAGCAGCCTGAGATCTGA GGACACGGCCGTACTTGTTGAGCAGCAGT GGCTGGTACTTTTTGACTACTGGGGCCAGGAA CCCTGGTCACCGTCTCCTCA SEQ ID NO: 29121 |

FIGURE 50
(Continued)

| | | | | |
|---|---|---|---|---|
| iPS.:398526 | 21-225_32B3 | AA | DIVMTQSPDSLAVSLGERATINCKSSQSVLHSSN NKNYLAWYQQKPGQPPKLLIYWASTRESGVPD RFSGSGSGTDFTLAISSLQAEDVALYHCQQYYSS PCSFGQGTGLEIK<br>SEQ ID NO: 25116 | QVQLVQSGAEVKKPGASVKVSCKASGYTFTNYDIN WVRQATGQGLEWMGWMHPNSGNTGFAQKFRGR VTMTRNTSISTAYMELSSLRSEDTAVYYCSSSSGW YFFDYWGQGTLVTSS<br>SEQ ID NO: 29122 |
| | | NA | GACATCCAGATGACCCAGTCTCCATCCTCACT GTCTGCATCTATAGGAGACAGAGTCACCATCA CTTGTCGGGCGAGTCAGGGCATTAGCAATTAT TTAGCCTGGTTTCAGCAGAAACCAGGGAAAGC CCCTAGGTCCCTGATCTATGCTGCATCCAGTTT ACAAAGTGGGGTCCCATCAACGTTCAGCGGCA GTGGATCTGGGACAGATTTCACTCTCACCATC AGCAGCCTGCAACAGTATAATAGTTATCCATTCA TTACTGCCAACAGTATAATAGTTATCCATTCA CTTTCGGCCCTGGGACCAAAGTGGATATCAAA<br>SEQ ID NO: 25117 | GAGGTGCAGCTGGTGGAGTCTGGGGGAGGCCTG GTCAAGCCTGGGGGGTCCCTGAGACTCTCCTGTG CAGCCTGCTGATTCACCTTCAGTAGCTATAGCAT GAACTGGGTCCGCCAGGCTCCAGGGAAGGGCT GGAGTGGGTCTCATCCATTAGTGGTAGTAGTACT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGTGGCTGGC TTTGACTACTGGGGCCAGGGAACCCTGGTCACCG TCTCCTCA<br>SEQ ID NO: 29123 |
| | | AA | DIQMTQSPSSLSASIGDRVTITCRASQGISNYLAW FQQKPGKAPRSLIYAASSLQSGVPSTFSGSGSGT DFTLTISSLQPEDFATYYCQQYNSYPFTFGPGTK VDIK<br>SEQ ID NO: 25118 | EVQLVESGGGLVKPGGSLRLSCAASGFTFSSYSMN WVRQAPGKGLEWVSSISGSSTYIYYADSVKGRFTIS RDNAKNSLYLQMNSLRAEDTAVYYCARVAGFDY WGQGTLVTVSS<br>SEQ ID NO: 29124 |

FIGURE 50
(Continued)

| | | | |
|---|---|---|---|
| iPS:398528 | 21-225_32G1 | NA | GACATCAGATGACCCAGTCTCCATCTCCT GTCTGCATCTGTAGGAGACAGAGTCACCATCA CTTGCCGGGCAAGTCAGACAGCATGAGAAGTGAT TTAGGCTGGTATCAGCAGAAACCAGGAAAG CCCCTAAGCGCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATACTATTTCCCCTCCT ACTTTCGGCGGAGGGACCAAGGTGGAGATCA AA |
| | | | SEQ ID NO: 25119 |
| | | AA | DIQMTQSPSSLSASVGDRVTITCRASQDMRSDLG WYQQKPGKAPKRLIYAASSLQSGVPSRFSGSGS GTEFTLTISSLQPEDFATYYCLQHTISPPTFGGGT KVEIK |
| | | | SEQ ID NO: 25120 |
| iPS:398530 | 21-225_32G4 | NA | GATGTTGTGATGACTCAGTCTCCACTCTCCCTG TCCGTCACCCTTGGACAGCCGGCCTCCATCTC CTGCAGGTCAAGTCAAAGCCTCGTATACAGTG ATGGAAAACACCTACTTGAATTGGTTTCAGCAG AGGCCAGGCCAATCTCCAAGGCGCTAATTTA TAAGGTTTCTAACTGGGACTGGGGTCCAGA ACAGATTCAGCGGCAGTGGTCAGGCACAGA TTTCACACTGAAAATCAGCAGGGTGGAGGCTG AGGATGTTGGGGTTTATTACTGCATGCAAGGT ATACACTGGCTCACTTTCGGCGGAGGGACCAA GGTGGAGATCAAA |
| | | | SEQ ID NO: 25121 |

| | | | |
|---|---|---|---|
| | | | GAGGTGCAGCTGTTGGAGTCTGGGGGAGGCTTG GCACAGCCTGGGGGGTCCCTGAGACTCTCTGTG CAGCCTCTGGATTCACCTTTAGCAGTCAGTATGCCAT GAGCTGGGTCCGCCAGGCTCCAGGGAAGGGGCT GGAGTGGGTCTCCGCTATTAGTGGTCGTGGTGGT AGCACATTCCACGCAGACTCCGTGAAGGGCCGG TTCACGATCTCCAGAGACAATTCCAAGAACACGC TGTATCTGCAAATGAACAGCCTGAGAGCCGAGG ACACGGCCGTATATTACTGTGTAAAGGGGAGCT ACTAGAGGACTACTACTTCTACGGTATGGACGTC TGGGGCCAAGGGACCACGGTCACCGTCTCCTCA |
| | | | SEQ ID NO: 29125 |
| | | | EVQLLESGGGLAQPGGSLRLSCAASGFTFSSYAMS WVRQAPGKGLEWVSAISGRGGSTFHADSVKGRFTI SRDNSKNTLYLQMNSLRAEDTAVYYCVKGELLED YYFYGMDVWGQGTTVTVSS |
| | | | SEQ ID NO: 29126 |
| | | | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACTTCCATAAGCA CAGCCTACATGGAGCTGAGCAGCCTGAGATCTG AGGACACGGCCGTGTATTACTGTGCGAAAGA AGGCTAAGGACTACTGGGGCCAGGGAACCCTGG TCACCGTCTCCTCA |
| | | | SEQ ID NO: 29127 |

FIGURE 50
(Continued)

| | | | |
|---|---|---|---|
| iPS:398532 | 21-225_33B7 | AA | DVVMTQSPLSLSVTLGQPASISCRSSQSLVYSDG NTYLNWFQQRPGQSPRRLIYKVSNWDSGVPDRF SGSGSGTDFTLKISRVEAEDVGVYYCMQGIHWL TFGGGTKVEIK<br>SEQ ID NO: 25122 | QVQLVQSGAEVKKPGASVKVSCKASGYTFTSYDIN WVRQATGQGLEWMGWMNPNSGNTGYAQKFQGR VTMTRNTSISTAYMELSSLRSEDTAVYYCARKKAN DYWGQGTLVTVSS<br>SEQ ID NO: 29128 |
| | | NA | GACATCCAGATGACCCAGTCTCCATCCTCACT GTCTGCATCTGTAGGAGACAGAGTCACCATCA CTTGTCGGGCAGTCAGGACATTAGCAATTAT TTGGCCTGGTTTCAGCAGAAACCAGGAAAGC CCCTACGTCCCTGATCTATGCTGCATCTAGTTT GCAAAGTGGGGTCCCATCAAGTTCAGCGGCA GTGGATCTGGGACAGATTTCACTCTCACCATC AGCAGCCTGCAACAGTATCATAGTTACCCGCTCA CCTTCGGCCAAGGGACCACGACTGGAAATTAAA<br>SEQ ID NO: 25123 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAACAT GAACTGGGTCCGCCAGGCTCCAGGGAAGGGCT GGAGTGGGTCTCATCCATTAGTGGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGGTTAAATGGT TTTGACTACTGGGGCCAGGGAACCCTGGTCACCG TCTCCTCA<br>SEQ ID NO: 29129 |
| | | AA | DIQMTQSPSSLSASVGDRVTITCRASQDISNYLA WFQQKPGKAPTSLIYAASSLQSGVPSKFSGSGSG TDFTLTISSLQPEDFATFYCQQYHSYPLTFGQGT RLEIK<br>SEQ ID NO: 25124 | EVQLVESGGGLVKPGGSLRLSCAASGFTFSSYNMN WVRQAPGKGLEWVSSISGSSSYIYYADSVKGRFTIS RDNAKNSLYLQMNSLRAEDTAVYYCARLNGFDY WGQGTLVTVSS<br>SEQ ID NO: 29130 |

FIGURE 50
(Continued)

| | | | |
|---|---|---|---|
| iPS:398534 | 21-225_33B8 | NA | GACATCAGATGACCCAGTCTCCATCTCCCT GTCTGCATCTGTAGGAGACAGAGTCACCATCA CTTGCCGGGCAAGTCAGGACATTAGAAGTGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTTCTGTCTACAGCATATTACCCTCCT ACTTTCGGCGGAGGGACCAAGGTGGAGATCA AA | GAGGTGCAGCTGTTGGAGTCTGGGGGAGGCTTG GTACAGCCTGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCCGCTATTAGTGGTGGTGGTGGT AGCACATTCACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGTGAAAGGGGAGCT ACTAGAGGACTACTACTTCTACGGTATGACGTC TGGGGCCAAGGGACCACGGTCACCGTCTCCTCA |
| | | | SEQ ID NO: 25125 | SEQ ID NO: 29131 |
| | | AA | DIQMTQSPSSLSASVGDRVTITCRASQDIRSDLG WYQQKPGKAPKRLIYAASSLQSGVPSRFSGSGS GTEFTLTISSLQPEDFATYFCLQHIYPPTFGGGT KVEIK | EVQLLESGGGLVQPGGSLRLSCAASGFTFSSYAMS WVRQAPGKGLEWVSAISGGGSTFHADSVKGRFTI SRDNSKNTLYLQMNSLRAEDTAVYYCVKGELLED YYFYGMDVWGQGTTVTVSS |
| | | | SEQ ID NO: 25126 | SEQ ID NO: 29132 |
| iPS:398536 | 21-225_33D12 | NA | GACGTCAGATGACCCAGTCTCCATCTCCCT GTCTGCATCTTTAGGAGACAGAGTCACCATCA CTTGCCGGGCAAGTCAGAGCATTAGAAGCTAT TTAAATTGGTATCAGCAGAAACCAGGGAAAG CCCCTAACCTCCTGATCTATAGTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAAATT ACTACTGTCAACAGAGTTACAGTATCCGATC ACCTTCGGCCAAGGGACCACGACTGGAGATTAA A | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAGCTGGGTGCGACTGGCCACTGGACAAGGGC TTGAGTGGATGGGATGGATGAACCCTAACAGTG GTAACACAGGCTATGCACCAGAAGTTCCAGGCA GAGTCACCATGACCAGGAACACCTCCATAAGCA CAGCCTACATGGAGCTGAGCAGCCTGAGATCTG AGGACACGGCCGTGTATTACTGTGCGAGAAAGA GGGCTAACGACTACTGGGGCCAGGGAACCCTGG TCACCGTCTCCTCA |
| | | | SEQ ID NO: 25127 | SEQ ID NO: 29133 |

FIGURE 50
(Continued)

| | | | |
|---|---|---|---|
| | | AA | DVQMTQSPSSLSASLGDRVTITCRASQSIRSYLN WYQQKPGKAPNLLIYSASSLQSGVPSRFSGSGSG TDFTLTISSLQPEDFANYYCQQSYSIPITFGQGTR LEIK<br>SEQ ID NO: 25128 | QVQLVQSGAEVKKPGASVKVSCKASGYTFTSYDIS WVRLATGQGLEWMGWMNPNSGNTGYAQKFQGR VTMTRNTSISTAYMELSSLRSEDTAVYYCARKRAN DYWGQGTLVTVSS<br>SEQ ID NO: 29134 |
| iPS:398538 | 21-225_34H7 | NA | GACATCGTGATGACCCAGTCTCCAGACTCCCT GGCTGTGTCTCTGGGCGAGAGGGCCACCATCA ACTGCAAGTCCAGCCAGAGTGTTTATACAGC TCCAACAATTACAACTACTTAGCTTGGTACCA GCTGAAACCAGGACAGCCTCCTAAGCTGCTCA TTTACTGGGCATCTACCCGGAAATCCGGGGTC CCTGACCGATTCAGTGGCAGCGGGTCTGGGAC AGATTTCACTCTCACCATCAGCAGCCTGCAGA CTGAAGATATTACTTCTCCGTGCAGTTTTGGCCAGGGG ACCAAGCTGGAGATCAAA<br>SEQ ID NO: 25129 | CAGGTGCAGCTGGTGCAGTCTGGGGCTGAGGTG AAGAAGCCTGGGGCCTCAGTGAAGGTCTCCTGC AAGGCTTCTGGATACACCTTCACCAACTATGATA TTAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCGAGCAGCA GTGGCTGGTACTTTTTGACTACTGGGGCCAGGG AACCCTGGTCACCGTCTCCTCA<br>SEQ ID NO: 29135 |
| | | AA | DIVMTQSPDSLAVSLGERATINCKSSQSVLYSSN NYNYLAWYQLKPGQPPKLLIYWASTRKSGVPD RFSGSGSGTDFTLTISSLQTEDVALYYCQQYYTS PCSFGQGTKLEIK<br>SEQ ID NO: 25130 | QVQLVQSGAEVKKPGASVKVSCKASGYTFTNYDIN WVRQATGQGLEWMGWMNPNSGNTGYAQKFQGR VTMTRNTSISTAYMELNSLRSEDTAVYYCASSSGW YFFDYWGQGTLVTVSS<br>SEQ ID NO: 29136 |

FIGURE 50
(Continued)

| | | | |
|---|---|---|---|
| iPS:398540 | 21-225_35A6 | NA | GACATCCAGATGACCCAGTCTCCATCCTCCCT GTCCGCATCTGTAGGAGACAGAGTCACCATCA CTTGCCGGGCAAGTCAGGACATTAGAAGTGAT TTAGGCTGGTATCAGCAGAAACCAGGAAAG CCCCTAAGCGCCTGATCTATGCTACATCCAGT TTGCAAAGTGGGGTCCCATCAAGGTTCAGGG CAGTGGATCTGGGACAGAATTCACTCTCACAA TCAGCAGCCTGCAGCCTGAAGATTTTGCAACT TATTACTGTCTACAGCATACTATTTACCCTCCT ACTTTCGGCGGAGGGACCAAGGTGGAGATCA AA<br><br>SEQ ID NO: 25131 | GAGGTGCAGCTGTTGGAGTCTGGGGGAGGCTTG GTACAGCCTGGGGGGTCCTGAGACTCTCCTGTG CAGCCTCTGGATTCACCTTTAGCAGTCTATGCCAT CAGCTGGGTCCGCCAGGCTCCAGGGAAGGGGCT GGAGTGGGTCTCCACTATTAGTGGTGGTGGTGGT AGCACATTCACGCAGACTCCGTGAAGGGCCGG TTCACCATCTCAGAGACAATTCCAAGAACACGC TGTATCTGCAAATGAACAGCCTGAGAGCCGAAG ACACGGCCGTATATTACTGTGTGAAAGGGAGCT ACTAGAGGACTACTACTTCTACGGTATGGACGTC TGGGGCCAAGGGACCACGGTCACCGTCTCCTCA<br><br>SEQ ID NO: 29137 | EVQLLESGGGLVQPGGSLRLSCAASGFTFSSYAMS WVRQAPGKGLEWVSTISGGGSTFHADSVKGRFTI SRDNSKNTLYLQMNSLRAEDTAVYYCVKGELLED YYFYGMDVWGQGTTVTVSS<br><br>SEQ ID NO: 29138 |
| iPS:398544 | 21-225_7C8 | AA | DIQMTQSPSSLSASVGDRVTITCRASQDIRSDLG WYQQKPGKAPKRLIYATSSLQSGVPSRFSGSGSG TEFTLTISSLQPEDFATYYCLQHTIYPPTFGGGTK VEIK<br><br>SEQ ID NO: 25132 | | |
| | | NA | CTGCCTGTGCTGACTCAGCCCCCGTCTGCATCT GCCTTGCTGGGAGCCTCGATCAAGTCACCTG CACCCTAAGCAGTGAGCACAGCACCTACACCA TCGAATGGTATCAACAGAGACCAGGGAGGTC CCCCAGTATATAATGAAGGTTAAGAGTGATG GCAGCCACAGCAAGGGGACGGGATCCCCGA TCGCTTCATGGGCTCCAGTTCTGGGGTGACC GCTACCTCACCTTCTCCAACCTCCAGTCTGACG ATGAGGATGAGTATCACTGTGGAGAGAGCCA CCGATTGATGGCCAAGTCGGTGTGGTATTCG GCGGAGGGACCAAGCTGACCGTCCTA | GAGGTGCAGCTGTTGGAGTCTGGGGGAGGCTTG GTAAAGCCTGGGGGGTCCCTTAGACTCTCCTGTG CAGCCTCTGGATTCACTTTCAGTAACGCCCGGAT GAACTGGGTCCGCCTGGCTCCAGGGAAGGGGCT GGAGTGGGTTGGCCGTATTAAAAGCAAAACTGA TGGTGGGACAACAGATACTACGCTACCCGTGAA AGGCAGATTCACCATCTCAAGAGATGAATCAGA AACACGCTGTATCTGCAAATGAACAGCCTGAA AACCGAGGACACAGGTGTATTACTGTTCCACA GATACGGTCCTATAGCAGCTCGTCTCGCTTACT ACTACTACTACGCTATGGACGTCTGGGGCCAAGG GACCACGGTCACCGTCTCCTCA |

FIGURE 50
(Continued)

| | | | | |
|---|---|---|---|---|
| iPS:398546 | 21-225_9H10 | AA | SEQ ID NO: 25133<br>LPVLTQPPSASALLGASIKLTCTLSSEHSTYTIEWYQQRPGRSPQYIMKVKSDGSHSKGDGIPDRFMGSSSGGDRYLTFSNLQSDDEDEYHCGESHPIDGQVGVVFGGGTKLTVL | SEQ ID NO: 29139<br>EVQLVESGGGLVKPGGSLRLSCAASGFTFSNARMNWVRLAPGKGLEWVGRIKSKTDGGTTDYAAPVKGRFTISRDESENTLYLQMNSLKTEDTGVYYCSTDTGPIAARLAYYYYAMDVWGQGTTVTVSS |
| | | NA | SEQ ID NO: 25134<br>TCCTATGAGCTGACTCAGCCACCCTCAGTGTCCGTGTCCCCAGGACAGACAGCCAGCATCACCTGCTCTGGAGATAAATTGGGGGATAAATATGCTTGCTGGTATCAGCAGAAGCCAGGCCAGTCCCCTGTGCTGGTCATCTATCAAGATAGCAAGCGGCCCTCAGGGATCCTGAGCGATTCTCTGGCTCCAACTCTGGGAACACAGCCACTCTGACCATCAGCGGGACCCAGGCTATGGATGAGGCTGACTATTACTGTCAGGCGTGGGACAGCAGCACTTATGTGGTATTCGGCGGAGGGACCAAGCTGACCGTCCTA | SEQ ID NO: 29140<br>CAGATCACCTTGAAGGAGTCTGGTCCTACGCTGGTGAAACCACACAGACCCTCACGCTGACCTGCACCTTCTCTGGGTTCTCACTCACCACTAGTGGAGTGGGTGTGGGCTGGATCCGTCAGCCCCCAGGAAAGGCCCTGGAATGGCTTGCACTCATTTATTGGAGTGATGATAAGCGCTACACCACCAAGGACACCTCCAAAAACCAGGTCACCATCACCAAGGACACCTCCAAAAACCAGGTGTCCTTACAATGACCAACATGGCCCCTGTGGACACAGCCACATATTACTGTGCACACCGGTTCTAGCTGCTGCTATTTGACTACTGGGGCCAGGGAACCCTGGTCACCGTCTCCTCA |
| | | AA | SEQ ID NO: 25135<br>SYELTQPPSVSVSPGQTASITCSGDKLGDKYACWYQQKPGQSPVLVIYQDSKRPSGIPERFSGSNSGNTATLTISGTQAMDEADYYCQAWDSSTYVFGGGTKLTVL | SEQ ID NO: 29141<br>QITLKESGPTLVKPTQTLTLTCTFSGFSLTTSGVGVGWIRQPPGKALEWLALIYWSDDKRYSPSLKSRLTITKDTSKNQVVLTMTNMAPVDTATYCAHTGSSCCYFDYWGQGTLVTVSS |
| | | | SEQ ID NO: 25136 | SEQ ID NO: 29142 |

FIGURE 50
(Continued)

| | | | |
|---|---|---|---|
| iPS:402219 | 21-225_1C12 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTTCACTCTCACAA TCAGCAGCCTGCAGCCTGAAGATTTTGCAACT TATTACTGTCTACAACATAATAGTTACCCGCTC ACTTTCGGCGGAGGGACCAAGGTGGCGATCA AA<br>SEQ ID NO: 25137 | CAGGTGCAGCTGGTGGAGTCTGGGGGAGGCGTG GTCCAGCCTGGGAGGTCCCTGAGACTCTCCTGTG CAGGGTCTGGATTCACCTTCAGTAACTATGGCAT GCACTGGGTCCGCCAGGTTCCAGGCAAGGGGCT GGAGTGGGTGGCAGTTATATGTATGATGAAAAT AATAAATACTATGTAGACTCCGTGAAGGGCCGAT TCACCATCTCCAGAGACAACTCCAAGAACACGCT GTATCTGCAAATGAACAGCCTGAGAGCCGAGGA CACGGCTGTGTATTACTGTGCGAGAGAATTGGGG TTCCGGTCTGACTACTGGGGCCAGGAACCCTGG TCACCGTCTCCTCA<br>SEQ ID NO: 29143 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVAIK<br>SEQ ID NO: 25138 | QVQLVESGGGVVQPGRSLRLSCAASGFTFSNYGM HWVRQAPGKGLEWVAVIWYDENNKYYVDSVKGR FTISRDNSKNTLYLQMNSLRAEDTAVYYCARELGF RSDYWGQGTLVTVSS<br>SEQ ID NO: 29144 |
| iPS:402221 | 21-225_2C12 | NA | GACATCCAGATGACCCAGTCTCCATCCTCACT GTCTGCATCTGTAGGAGACAGAGTCACCATCA CTTGTCGGGCGAGTCAGGGCATTAGCAATGAT TTAGCCTGGTTTCAGCAGAAATCAGGGAAAGC CCCTAAGTCTCTGATCTCTGCTGCAACCAGTTT GCAAAGTGGGGTCCCATCACGGTTCAGCGGCA GTGGATCTGGGACAGATTTCACTCTCACCATC AGCAGCCTGCAGCCTGAAGATTATTGCAACTTA TTACTGCCAACAGTATTATAGTTACCGATCA CCTTCGGCCAAGGGACACGACTGGAGATTAAA<br>SEQ ID NO: 25139 | GAGGTGCAGCTGGTGGAGTCTGGGGGAGGCCTG GTCAAGCCTGGGGGGTCCCTGAGACTCTCCTGTG CAGCCCTCTGGATTCACCTTCAGTAGCTATAGCAT GAACTGGGTCCGCCAGGCTCCAGGGAAGGGGCT GGAGTGGGTCTCATCCATTAGTGGTAGTAGT TACATGTACTACGCAGACTCAGTGAAGGGCCGAT TCACCATCTCCAGAGACAACGCCAAGGACTCACT GTATCTGCAAATGAACAGCCTGAGAGCCGAGGA CACGGCTGTGTATTACTGTGCGAGAGTGAATCTC TTTGACTACTGGGGCCAGGGAACCCTGGTCACCG TCTCCTCA<br>SEQ ID NO: 29145 |

FIGURE 50
(Continued)

| | | | | | |
|---|---|---|---|---|---|
| iPS:402223 | 21-225_30A11 | AA | DIQMTQSPSSLSASVGDRVTITCRASQGISNYLAWFQQKSGKAPKSLISAATSLQSGVPSQFSGSGSGTDFTLTISSLQPEDFATYYCQQYYSYPITFGQGTRLEIK | EVQLVESGGGLVKPGGSLRLSCAASGFTFSSYSMNWVRQAPGKGLEWVSSISGSSSYMYYADSVKGRFTISRDNAKDSLYLQMNSLRAEDTAVYYCARVNLFDYWGQGTLVTVSS | |
| | | | SEQ ID NO: 25140 | SEQ ID NO: 29146 | |
| | | NA | GACATCCAGATGACCCAGTCTCCATCTTCCGTGTCTGCATCTGTAGGAGACAGAGTCACCATCACTTGTCGGGCGAGTCAGGGTATTAGCAGATGGTTAGCCTGGTATCAGCAGAAACCAGGGAAGCCCCTGAACTCCTGATCTATGCTGCATCCGTTTGCAAAGTGGGATCCCATCCAGGTTCAGCGGCAGTGGATCTGGGACAGACTTCACTCTCACCATCAGCAGCCTGCAGCCTGAAGATTTTGCAACTTACTATTGTCAACAGGCTAACAGTTTCCCATTCACTTTCGGCCCTGGGACCAAAGTTGGATAACAAA | CAGGTGCAGCTGGTGCAGTCTGGGGCTGAGGTGAAGAAGCCTGGGGCCTCAGTGAAGGTCTCCTGCAAGGCTTCTGGATACACCTTCACCGACTATCATATGCCACTGGGTGCGACAGGCCCCTGGACAAGGGCTTGAGTGGATGGGATGGATCAACCCTAATAGGGGTGGCACAAACTATGCACAGAAGTTTCAGGACAGGGTCACCATGACCAGGGACACGTCCATCAGCAGCCTACATGGAACTGAGCAGGCTGAGATCTGACGACACGGCCGTCTATTCTGTGCGAGAGATGGAACTGGGTCCTTTGACTACTGGGGCCAGGAACCCTGGTCACCGTCTCCTCA | |
| | | | SEQ ID NO: 25141 | SEQ ID NO: 29147 | |
| | | AA | DIQMTQSPSPSVSASVGDRVTITCRASQGISRWLAWYQQKPGRAPELLIYAASRLQSGIPSRFSGSGSGTDFTLTISSLQPEDFATYYCQQANSFPFTFGPGTKVDNK | QVQLVQSGAEVKKPGASVKVSCKASGYTFTDYHMHWVRQAPGQGLEWMGWINPNRGGTNYAQKFQDRVTMTRDTSISTAYMELSRLRSDDTAVYFCARDGTGSFDYWGQGTLVTVSS | |
| | | | SEQ ID NO: 25142 | SEQ ID NO: 29148 | |

FIGURE 50
(Continued)

| | | | | |
|---|---|---|---|---|
| iPS:402225 | 21-225_2B1 | NA | TCCTATGAGCTGACTCAGCCACCCTCAGTGTC CGTGTCCCCAGGACAGACAGTCAGCATCACCT GCTCTGGAGATAAATTGGGGGATAAATATGCT TGCTGGTATCAGCAGAAGCCAGGCCAGTCCCC TGTGCTGGTCATCTATCAAGATCGCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAACAACACTGTGTA TTCGGCGGAGGGACCAAGCTGACCGTCCTA SEQ ID NO: 25143 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCATTAGTAGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGCGTCTGGGGAAC TACTGGGGCCAGGGAACCCTGGTCACCGTCTCCT CA SEQ ID NO: 29149 |
| | | AA | SYELTQPPSVSVSPGQTVSITCSGDKLGDKYACW YQQKPGQSPVLVIYQDRKRPSGIPERFSGSNSGN TATLTISGTQAMDEADYYCQAWDNNTVFGGG TKLTVL SEQ ID NO: 25144 | EVQLVESGGGLVKPGGSLRLSCAASGFTFSSYSMN WVRQAPGKGLEWVSSISSSSYIYYADSVKGRFTIS RDNAKNSLYLQMNSLRAEDTAVYYCARLGNYWG QGTLVTVSS SEQ ID NO: 29150 |
| iPS:402229 | 21-225_16H9 | NA | GACATCCAGATGACCCAGTCTCCATCTCCCT GTCTGCATCTGTAGGAGACAGAGTCACCATCA CTTGCCGGGCAAGTCAGGGCATTAGAAATTAT TTAGGCTGGTTTCAGCAGAAAACCAGGGAAAGC CCCTAAGGCCTGATCTATGGTGCATCCAGTT TGCAAAGTGGGGTCCCATCAAGGATCGCGGC AGTGGATCTGGGACAGAATTCACTCTCACAAT CAGCAGCCTGCAGCCTGAAGATTTTGCAACTT ATTACTGTCTACAGTATCATAGTTATCATTCA CTTTCGGCCCTGGGACCAAAGTGGATATCAAA SEQ ID NO: 25145 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCATTAGTGGTAGTAGTAGT TACATATACTACGCAGACTCAGTGGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGTCAACGGT ATGGACGTCTGGGGCCAAGGGACCACGGTCACC GTCTCCTCA SEQ ID NO: 29151 |

FIGURE 50
(Continued)

| | | | | |
|---|---|---|---|---|
| iPS:402231 | 21-225_6D9 | AA | DIQMTQSPSSLSASVGDRVTITCRASQGIRNYLG WFQQKPGKAPKRLIYGASSLQSGVPSRISGSGSG TEFTLTISSLQPEDFATYYCLQYHSYLFTFGPGTK VDIK<br>SEQ ID NO: 25146 | EVQLVESGGGLVKPGGSLRLSCAASGFTFSSYSMN WVRQAPCKGLEWVSSISGSSSYIYADSVKGRFTIS RDNAKNSLYLQMNSLRAEDTAVYYCARVNGMDV WGQGTTVTVSS<br>SEQ ID NO: 29152 |
| | | NA | TCCTATGAGCTGACTCAGCCACCCTCAGTGTC CGTGTCCCCAGGACAGACAGCCAGCATCACCT GCTCTGAGATAAATTGGGGAAAAATATGCT TGCTGGTATCAGCAGAAGCCAGGCCAGTCCCC TGTACTGGTCATCTATCAAGATAAGAAGCGGC CCTCAGGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGTATTC GGCGGAGGGACCAAACTGACCGTCCTA<br>SEQ ID NO: 25147 | GAGGTGCAGCTGGTGGAGTCTGGGGGAGGCTTG GTAAAGCCTGGGGGGTCCCTTAGACTCTCCTGTG CAGCCTCTGGATTCACTTTCAGTAACGCCTGGAT GAACTGGGTCCGCCTGGCTCCAGGGAAGGGGCT GGAGTGGGTTGGCCGTATTAAAAGCAAAACTGA TGGTGGACAACAGACTACGCTGCACCGTGAA AGGCAGATTCACCATCTCAAGAGATGATTCAGA AACACGTTGTATCTGCAAATGAACAGCCTGAA ACCGAGGACACAGCCGTGTATTACTGTTCCACA GATACGGGTCCTATAGCAGCTCGTCTCGCTTACT ACTACTACTACGCTATGACGTCTGGGGGCCAAGG GACCACGGTCACCGTCTCCTCA<br>SEQ ID NO: 29153 |
| | | AA | SYELTQPPSVSVSPGQTASITCSGDKLGEKYACW YQQKPGQSPVLVIYQDKKRPSGIPERFSGSNSGN TATLTISGTQAMDEADYYCQAWDSSTVFGGGT KLTVL<br>SEQ ID NO: 25148 | EVQLVESGGGLVKPGGSLRLSCAASGFTFSNAWM NWVRLAPGKGLEWVGRIKSKTDGGTTDYAAPVKG RFTISRDDSENTLYLQMNSLKTEDTAVYYCSTDTGP IAARLAYYYYAMDVWGQGTTVTVSS<br>SEQ ID NO: 29154 |

FIGURE 50
(Continued)

| | | | | |
|---|---|---|---|---|
| iPS:402233 | 21-225_16D10 | NA | GACATCCAGATGACCCAGTCTCCATCCTCACT GTCTGCATCTGTAGGAGACAGAGTCACCATCA CTTGTCGGGCGAGTCAGGACATAAGTAATTAT TTAGCCTGGTTTCAGCAGAAACCAGGAAAGC CCCTAAGTCCCTGATCTATGCTACACCAGTT GCAGAGTGGGGTCCCATCAAGGTTCAGCGGCA GTGGATCTGGGACAGAGATTTCACTCTCACCAT AGCAGCCTGCAACAGTATAATAGTTACCGCTCA TTACTGCCAACAGTATAATAGTTACCGCTCA CTTTCGGCGGAGGGACCAAGGTGGAGATCAA A SEQ ID NO: 25149 | GAGGTGCAACTGGTGGAGTCTGGGGGAGGCCTG GTCAAGCCTGGGGGGTCCCTGAGACTCTCCTGTG CAGCCTCTGGATTCACCTTCAGTACCTATAACTT GAACTGGGTCCGCCAGGCTCCAGGGAAGGGCT GGAGTGGGTCTCATCCATTAGTGGTGGTGCCGGT CACATATATTACTGACTCAGTGAAGGGCCGAT TCACCATCTCCAGAGACACCAAGAACTCACT GTATCTGCAAATGAACAGCCTGAGAGCCGAGGA CACGGCTGTGTATTACTGTGCGAGGACTAATGG TTTGACTTCTGGGGCCAGGGAACCCTGGTCACCG TCTCCTCA SEQ ID NO: 29155 |
| | | AA | DIQMTQSPSSLSASVGDRVTITCRASQDISNYLA WFQQKPGKAPKSLIYATPSLQSGVPSKFSGSGSG TEFTLTISSLQPEDFATYYCQQYNSYPLTFGGGT KVEIK SEQ ID NO: 25150 | EVQLVESGGGLVKPGGSLRLSCAASGFTFSTYNLN WVRQAPGKGLEWVSSISGGAGHIYYSDSVKGRFTI SRDNAKNSLYLQMNSLRAEDTAVYYCARTNGFDF WGQGTLVTVSS SEQ ID NO: 29156 |
| iPS:402235 | 21-225_20F10 | NA | GACATCCAGATGACCCAGTCTCCATCCTCACT GTCTGCATCTGTCGGAGACAGAGTCACCATCA CTTGTCGGGCGAGTCAGGGCATTAACAATTAT TTAGCCTGGTTTCAGCAGAAACCAGGGAAAGC CCCTAAGTCCCTGATTTATGCTGCATCCAGTT GCAAAGTGGGGTCCCATCAAGGTTCAGCGGCA GTGGATTTGGGACAGATTTCACTCTCACCAT AGCAGCCTGCAGCCTGAAGATTTTGCAACTTA TTACTGCCAGCAATATAATAGTTACCATTCA CTTTTGGCCCTGGGACCAAAGTGGATAACAAA SEQ ID NO: 25151 | GAGGTGCAGCTGGTGGAGTCTGGGGGAGGCCTG GTCAAGCCTGGGGGGTCCCTGAGACTCTCCTGTG CAGCCTCTGGATTCACCTTCAGCTATAGCAT GAACTGGGTCCGCCAGGCTCCAGGGAAGGGGCT GGAGTGGGTCTCATCCATTAGTACTAGTACTTTC ATATACTACGCAGATTCAGTGAAGGGCCGATTCA CCATCTCAAGAGACAACGCCAAGAACTCACTGT ATCTGCAAATGAACAGCCTGAGAGCCGAGGACA CGGCTGTGTATTACTGTGCGAGAAAGGCTGGCT TGATATCTGGGGCCAAGGGACCAATGGTCACCGTC TCTTCA SEQ ID NO: 29157 |

FIGURE 50
(Continued)

| | | | | |
|---|---|---|---|---|
| | | AA | DIQLTQSPSSLSASVGDRVTITCRASQGINNYLAWFQQKPGKAPKSLIYAASSLQSGVPSRFSGSGFGTDFTLTISSLQPEDFATYCQQYNSYPFTFGPGTKVDNK | EVQLVESGGGLVKPGGSLRLSCAASGFTFSSYSMNWVRQAPGKGLEWVSSISTSTFIYYADSVKGRFTISRDNAKNSLYLQMNSLRAEDTAVYYCARKAGLDIWGQGTMVTVSS |
| | | | SEQ ID NO: 25152 | SEQ ID NO: 29158 |
| iPS:402237 | 21-225_23D11 | NA | GACATCCAGATGACCCAGTCTCCATCTCACTGTCTGCATCTGTAGGGGACAGAGTCACCATCACTTGTCGGGCGAGTCAGGGCATTGCCAATTATTTAGCCTGGTTTCAGCAGAAACCAGGGAAAGCCCCTAAGTCCCTGATCTCTGCTGCATCCAGTTTGCAAAGTGGGGTCCCATCAAGGTTCAGCGGCAGTGGATCTGGGACAGACCTGAAGATTTTGCAACTTAAGCAGCCTGCAACAGTATCATAGTTACCCGCTCACTTTCGGCGGAGGGTCCAAGGTGGAGATCAAA | GAGGTGCAGCTGGTGGAGTCTGGGGGAGGCCTGGTCAAGCCTGGGGGGTCCCTGAGACTCTCCTGTGCAGCCTCTGGATTCACCTTCAGTAGCTATAACATAAACTGGGTCCGCCAGGCTCCAGGGAAGGGCTGGAGTGGGTCTCATCCATTAGTAGTGGTAATAGTGGTTACATATACTACGCAGACTCAGTGAAGGGCCGATTCACCATCTCCAGAGACAACGCCAAGAACCTCAGTATCTGCAAATGAACAGCCTGAGAGCCGAGGACACGGCTGTGTATTACTGTGCGCGAACTAACCTCTTTGACTACTGGGGCCAGGGAACCCTGGTCACCGTCTCCTCA |
| | | | SEQ ID NO: 25153 | SEQ ID NO: 29159 |
| | | AA | DIQMTQSPSSLSASVGDRVTITCRASQGIANYLAWFQQRPGKAPKSLISAASSLQSGVPSKFSGSGSGTEFTLTISSLQPEDFATYYCQQYHSYPLTFGGGSKVEIK | EVQLVESGGGLVKPGGSLRLSCAASGFTFSSYNINWVRQAPGKGLEWVSSISGNSGYIYYADSVKGRFTISRDNAKNSLYLQMNSLRAEDTAVYYCARTNLFDYWGQGTLVTVSS |
| | | | SEQ ID NO: 25154 | SEQ ID NO: 29160 |

FIGURE 50
(Continued)

| | | | |
|---|---|---|---|
| iPS:403868 | 21-225_19D11 | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTACATCCAGT TTGCAAAGTGGGGTCCCATCAAGGTTCAGCGG CAGTGGATCTGGGACAGAATTCACTCTCACAA TCAGCAGCCTGCAGCCTGAAGGATTTTGCAACT TATTACTGTCTACAGTATTATAGTTACCCGCTC ACTTTCGGCGGAGGGACCGAGGTGGAGATCA AA<br><br>SEQ ID NO: 25155 | CAGCTGCAGCTGCAGGAGTCGGGCCCAGGACTG GTGAAGCCTTCGGAGACCCTGTCCCTCACCTGCA CTGTCTCTGGTGGCTCCATCAGCAGAAGTAGTTA CTACTGGGGCTGGATCCGCCAGCCCCCGGGAAG GGGCTGGACTGGATTGGGAGTATCTATTATAGTG GGAGCGCCAACTACAACCGTCCCTCAAGAGTC AGTTCCCTGAAACTGAGTTCCGTGACCGCGC AGACGGCTGTGTATTACTGTGCGAGACTGGAC AGGGGCTGGTCCTTTGACTACTGGGGCCAGGGA ACCCTGGTCACCGTCTCCTCA<br><br>SEQ ID NO: 29161 |
| | | AA | DIQMTQSPSSLSASVGDRVTITCRASQGIRNDLG WYQQKPGKAPKRLIYATSSLQSGVPSRFSGSGSG TEFTLTISSLQPEDFATYYCLQYYSYPLTFGGGTE VEIK<br><br>SEQ ID NO: 25156 | QLQLQESGPGLVKPSETLSLTCTVSGGSISRSSYYW GWIRQPPGKGLDWIGSIYYSGSANYNPSLKSRVTIS VDTSKNQFSLKLSSVTAADAAVYYCARLDRGWSF DYWGQGTLVTVSS<br><br>SEQ ID NO: 29162 |
| iPS:403870 | 21-225_23G4 | NA | GACATCCAGATGACCCAGTCTCCATCTCCCT GTCTGCATCTGTGGGAGACAGAGTCACCATCA CTTGCCGGGCAAGTCAGAACATTTACAGCTAT TTAAATTGGTATCAGCAGAAACCTGGGAAAGC CCCTAAGCTCCTGATCTATGCTGCATCCAGTT TGCAAAGTGGGGTTCCATCAAGGTTCAGTGGCA GTGGATCTGGGACAGATTTCACTCTCACCATC AGCATTCTGCAACCTGAAGATTTTGCAACTTA CTACTGTCAACAGAGTTACAATACCCCTCCGG AGTGCAATTTTGGCCAGGGACCAAGCTGGAG ATCAAA<br><br>SEQ ID NO: 25157 | GAGGTGCAGCTGTTGGAGTCTGGGGGAGGCTTG GTACAGCCTGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTGGCGTGGTGGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAAGGGGGA TAGTGGGAGCTACGAGGCTTTGATATCTGGGG CCAAGGGACAATGGTCACCGTCTCTTCA<br><br>SEQ ID NO: 29163 |

FIGURE 50
(Continued)

| | | | | |
|---|---|---|---|---|
| | | AA | DIQMTQSPSSLSASVGDRVTITCRASQNIYSYLN WYQQKPGKAPKLLIYAASSLQSGVPSRFSGSGS GTEFTLTISILQPEDFATYYCQQSYNTPPECNFGQ GTKLEIK<br><br>SEQ ID NO: 25158 | EVQLLESGGGLVQPGGSLRLSCAASGFTFSSYAMS WVRQAPGKGLEWVSVISGRGGSTYYADSVKGRFTI SRDNSKNTLYLQMNSLRAEDTAVYYCAKRGIVGA TEAFDIWGQGTMVTVSS<br><br>SEQ ID NO: 29164 |
| iPS:403872 | 21-225_8F11 | NA | GACATCCAGATGACCCAGTCTCCATCCTCCCT GTCTGCATCTGTAGGAGACAGAGTCACCATCA CTTGCCGGGCAAGTCAGGGCATTAGGAGTGAT TTAGGCTGGTTTCAGCAGAAACCAGGGAAAGC CCCTAAGCGCCTGATCTTTGATGCATCCAGTG TGCAAAGTGGGGTCCCATCAAGGTTCAGCGGC AGTGGATCTGGGACAGAATTCACTCTCACAAT CAGCAGCCTGCAGCCTGAAGATTTTGCAATTT ATTACTGTCTACAACATTATACTTACCCGCTCA CTTTCGGCGGAGGGACCAAGGTGGAGATCAA G<br><br>SEQ ID NO: 25159 | CAGCTGCAGCTGCAGGAGTCGGGCCCAGGACTG GTGCAGCCTTCGGAGACCCTGTCCTCACCTGCA CTGTCTCTGGTGTCTCCATCAGTAGGACTAGTTA CTACTGGGGCTGGCTCCGCCAGCCCCCAGGGAA GGGGCTGGAGTGGATTGGCAATATTATTATAGT GGGAGCGCCTACAACAACCGTCCCTCAAGAGT CGAGTCACCATATCCGTTGACAGTGTCGTGACCGCGC AGTTCTCCCTGAAGCTGAGTTCTGTTACTGTGGGAGACATGGA AGACACGGCTGTGTATTACTGTGACTACTGGGGCCAGGGA CAAGACTGGGGCTTGACTACTGGGGCCAGGGA ACCCTGGTCACCGTCTCCTCA<br><br>SEQ ID NO: 29165 |
| | | AA | DIQMTQSPSSLSASVGDRVTITCRASQGIRSDLG WFQQKPGKAPKRLIEDASSVQSGVPSRFSGSGSG TEFTLTISSLQPEDFAIYYCLQHYTYPLTFGGGTK VEIK<br><br>SEQ ID NO: 25160 | QLQLQESGPGLVQPSETLSLTCTVSGVSISRTSYYW GWLRQPPGKGLEWIGNIYYSGSAYNNPSLKSRVTIS VDTSKNQFSLKLSSVTAADTAVYYCGRHGQDWGL DYWGQGTLVTVSS<br><br>SEQ ID NO: 29166 |

FIGURE 50
(Continued)

| | | | |
|---|---|---|---|
| iPS:404090 | 21-225_8D8 | NA | TCCTATGAGCTGACTCAGCCACCCTCAGTGTC CGTGTCCCAGGACAGCAGCAGCATCACCT GCTCTGGAGATAAATTGGGGAGAAATATGCT TGCTGGTATCAGCAGAAGCCAGGCCAGTCCC TGTGGTGGTCATCTATCAAGATAGGAAGCGGC CCTCAGGGATCCCTGAGCGATTCTCTGGCTCC AACTCTGGGAACACAGCCACTCTGACCATCAG CGGGACCCAGGCTATAGATGAGGCTGACTATT ACTGTCAGGCGTGGGACAGCAGCACTGCGGTA TTCGGCGGAGGGACCAAGTTGACCGTCCTA SEQ ID NO: 25161 | GAGGTGCAGCTGGTGGTGGAGTCTGGGGGAGGCCTG GTCAAGCCTGGGGGGTCCCTGAGACTCTCCTGTG CAGCCTCTGGATTCACCTTCAGTAGTAGCAT GAACTGGGTCCGCCAGGCTCCAGGGAAGGGGCT GGAGTGGGTCTCATCCATTAGTAGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGCGTCTGGGTAAC TACTGGGGCCAGGGAACCCTGGTCACCGTCTCCT CA SEQ ID NO: 29167 |
| | | AA | SYELTQPPSVSVSPGQTASITCSGDKLGEKYACW YQQKPGQSPVVVIYQDRKRPSGIPERFSGSNSGN TATLTISGTQAIDEADYYCQAWDSSTAVFGGGT KLTVL SEQ ID NO: 25162 | EVQLVESGGGLVKPGGSLRLSCAASGFTFSSYSMN WVRQAPGKGLEWVSSISSSSYIYYADSVKGRFTIS RDNAKNSLYLQMNSLRAEDTAVYYCARLGNYWG QGTLVTVSS SEQ ID NO: 29168 |
| iPS:412232 | 21-225_4A2 | NA | GACATCGTGATGACCCAGTCTCCAGACTCCCT GGCTGTCTCTCTGGGCGAGAGGGCCACCATCA ACTGCAAGTCCAGTCAGAGTATTTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAATACTCCAGTCACTTTCGGCCCTGGG ACCAAAGTGGGTATCAAA SEQ ID NO: 25163 | CAGGTGCAGCTGGTGCAGTCTGGGACTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGATGGATGCACCCTAACAGTGG TAACACAGGCTATGCACAGAAGTTCCAGGCAG AGTCACCTTGACCAGGAAACACCTCCATAAGCACA GCCTACATGGAACTGAGCAGCCTGAGATCTGAG GACACGGCCGTGTATTACTGTGCGAGTAGCAGTG GCTGTACTACTTTGACTACTGGGGCCAGGGAAC CTGGTCACCGTCTCCTCA SEQ ID NO: 29169 |

FIGURE 50
(Continued)

| | | | |
|---|---|---|---|
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYNTP VTFGPGTKVGIK<br>SEQ ID NO: 25164 | QVQLVQSGTEVKKPGASVKVSCKASGYTFTNYDIN WVRQATGQGLEWMGWMHPNSGNTGYAQKFQGR VTLTRNTSISTAYMELSSLRSEDTAVYYCASSSGWY YFDYWGQGTLVTVSS<br>SEQ ID NO: 29170 |
| iPS:422894 | 21-225_4A2.001 | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAATACTCCAGTCACTTTCGGCCCTGGG ACCAAAGTGGGTATCAAA<br>SEQ ID NO: 25165 | CAGGTGCAGCTGGTGCAGTCTGGGACTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGGCAG AGTCACCTTGACCAGGAACACCTCCATAAGCACA GCCTACATGGAACTGAGCAGCCTGAGATCTGAG GACACGGCCGTGTACTACTTTGACTACTGGGGCCAGGGAAC CCTGGTCACCGTGTCCTCA<br>SEQ ID NO: 29171 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYNTP VTFGPGTKVGIK<br>SEQ ID NO: 25166 | QVQLVQSGTEVKKPGASVKVSCKASGYTFTNYDIN WVRQATGQGLEWMGWMHPNSGNTGYAQKFQGR VTLTRDTSISTAYMELSSLRSEDTAVYYCASSSGWY YFDYWGQGTLVTVSS<br>SEQ ID NO: 29172 |

FIGURE 50
(Continued)

| | | | |
|---|---|---|---|
| iPS:423018 | 21-225_31D12_LC2 | NA | TCCTATGAGCTGACTCAGCCACCTCAGTGTCCGTGTCCCCAGGACAGACAGCCAGCATCACCTGCTCTGGAGATAAATTGGGGGATAAATATGCTTACTGGTTTCAGCAGAAGCCAGGCCAGTCCCCTGTGATAGTCATCTATCAAGATAGGAAGCGGCCCTCAGGGATCCCTGAGCGATTCTCTGGCTCCAACTCTGGGAACACAGCCACTCTGACCATCAGCGGGACGCAGGCTATGGATGAGGCTGACTATTACTGTGTCAGGCGTGGACAACAGCACTGCGGTATTCGGCGGAGGGACCAAGCTGACCGTCCTA<br>SEQ ID NO: 25167 | CAGGTGAAGCTGGTGCAGTCTGGGGCTGAGGTGAAGAAGCCTGGGGCCTCAGTGAAGGTCTCCTGCAAGGCTTCAGGATACACCTTCACCGGCTACTATATGCACTGGGTGCGACAGGCCCCTGGACAAGGGCTTGAGTGGATGGGATGGATCAACCCTAACAGTGGTGGCACAAACTATGTACAGAAGTTTCAGGGCAGGGTCACCATGACCAGGGACACGTCCATCAGCACAGCCTACATGGAGCTGAGCAGGCTGAGATCTGACGACACGGCCGTGTATTACTGTGCGAGAGTGTATTACTATGGTTCGGGGAGTTATTATAACGAGTTTGACTACTGGGGCCAGGGAACCCTGGTCACCGTCTCCTCA<br>SEQ ID NO: 29173 |
| | | AA | SYELTQPPSVSVSPGQTASITCSGDKLGDKYAYWFQQKPGQSPVIVIYQDRKRPSGIPERFSGSNSGNTATLTISGTQAMDEADYYCQAWDNSTAVFGGGTKLTVL<br>SEQ ID NO: 25168 | QVKLVQSGAEVKKPGASVKVSCKASGYTFTGYYMHWVRQAPGQGLEWMGWINPNSGGTNYVQKFQGRVTMTRDTSISTAYMELSRLRSDDTAVYYCARVYYYGSGSYYNEFDYWGQGTLVTVSS<br>SEQ ID NO: 29174 |
| iPS:423019 | 21-225_31D12_LC1 | NA | GATGTTGTGATGACTCAGTCTCCACTCTCCCTGCCCGTCACCCTTGGACAGCCGGCCTCCATCTCCTGCAGGTCTAGTCAAAGCCTCATATACAGTGATGGAAACACCTTCTTGAATTGGTTTCAGCAGAGGCCAGGCCAATCTCCAAGGCGCCTAATTTAAGGTTTCTAATTGGGACTCTGGGGTCCAGACAGATTCAGGCGACAGTGGTCAGGCACTGATTCACACTGAAAATCAGCAGTTGGAGGCTGAGGATGTTGGGGATTTATTACTGCATGCAAGTACACACTGGCCTCTCACCTTCGGCCAAGGGACACGACTGGAGATTAAA<br>SEQ ID NO: 25169 | CAGGTGAAGCTGGTGCAGTCTGGGGCTGAGGTGAAGAAGCCTGGGGCCTCAGTGAAGGTCTCCTGCAAGGCTTCAGGATACACCTTCACCGGCTACTATATGCACTGGGTGCGACAGGCCCCTGGACAAGGGCTTGAGTGGATGGGATGGATCAACCCTAACAGTGGTGGCACAAACTATGTACAGAAGTTTCAGGGCAGGGTCACCATGACCAGGGACACGTCCATCAGCACAGCCTACATGGAGCTGAGCAGGCTGAGATCTGACGACACGGCCGTGTATTACTGTGCGAGAGTGTATTACTATGGTTCGGGGAGTTATTATAACGAGTTTGACTACTGGGGCCAGGGAACCCTGGTCACCGTCTCCTCA<br>SEQ ID NO: 29175 |

FIGURE 50
(Continued)

| | | | | |
|---|---|---|---|---|
| iPS:423314 | 21-225_12F11 | AA | DVVMTQSPLSLPVTLGQPASISCRSSQSLIYSDGN TFLNWFQQRPGQSPRRLIYKVSNWDSGVPDRFS GSGSGTDFTLKISRLEAEDVGIYYCMQGTHWPL TFGQGTRLEIK<br><br>SEQ ID NO: 25170 | QVKLVQSGAEVKKPGASVKVSCKASGYTFTGYYM HWVRQAPGQGLEWMGWINPNSGGTNYVQKFQGR VTMTRDTSISTAYMELSRLRSDDTAVYYCARVYYY GSGSYYNEFDYWGQGTLVTVSS<br><br>SEQ ID NO: 29176 |
| | | NA | GACATCGTGATGACCCAGTCTCCAGACTCCCT GGCTGTGTCTCTGGGCGAGAGGGCCACCATCA ATTGCAAGTCCAGCCAGAGTGTTTACACAGC TCCAACAATTATAACTATTAGCTTGGTACCA GCAGAAACCAGGACAGCCTCCTAACCTGCTCA TTTTCTGGGCATCTACCCGGGAATCCGGGGTC CCTGACCGATTCAGTGGCAGCGGGTTTGGAC AGATTTCACTCTCAACATCAGCAGCCTGCAGG CTGAAGATGTGGCAGTTTATTACTGTCAGCAA TATTATGATACTCCATTCACTTTCGGCCCTGGG ACCAAAGTGGATATCAAA<br><br>SEQ ID NO: 25171 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC CTGAGTGGATGGGATGGATCAAAGAAGTTCCAGGCA GTAACACAGGCTATGCACCAGGAACACCTCCATAGCG GAGTCACCATGACCAGAGACACCTCCATAAGCG CAGCCTATATGGTTCTGAGCAGCTGAGATCTGA GGACACGGCCGTGTATTACTGTGCGCTTAGCAGT GGCTGGTACTACTTTGACTACTGGGGCCAGGGAA CCCTGGTCACCGTCCTCA<br><br>SEQ ID NO: 29177 |
| | | AA | DIVMTQSPDSLAVSLGERATINCKSSQSVLHSSN NYNYLAWYQQKPGQPPNLLIFWASTRESGVPDR FSGSGFGTDFTLNISSLQAEDVAVYYCQQYYDTP FTFGPGTKVDIK<br><br>SEQ ID NO: 25172 | QVQLVQSGAEVKKPGASVKVSCKASGYTFTNYDIN WVRQATGQPEWMGWMHPNSGNTGYAKKFQGR VTMTRNTSISAAYMVLSSLRSEDTAVYYCALSSGW YYFDYWGQGTLVTVSS<br><br>SEQ ID NO: 29178 |

FIGURE 50
(Continued)

| | | | |
|---|---|---|---|
| iPS:424419 | 21-225_25A4.001 | NA | GACATCGTGATGACCCAGTTTCCAGACTCCCT<br>GGCTGTGTCTCTGGGCGAGAGGGCCACCATCA<br>AGTGTAAGTCCAGCCAGAGTGTTTTATACAGC<br>TCCCACAATAACAACTACTTAGCTTGGTACCA<br>GCAGAAACCAGGACAGCCTCCTAAGTTGCTCC<br>TTTACTGGGCATCTCACCCGGGAATCCGGGGTC<br>CCTGACCGATTCAGTGGCAGCGGGTCTGGGAC<br>AGAATTCACTCTCACCATCAGCAGCCTGGAGG<br>CTGAAGATGTGGCAGTTTATTACTGTCAGCAG<br>TATTATAGTACTCCTCCGACGTTCGGCCAAGG<br>GACCAAGGTGGAAATCAAA<br>SEQ ID NO: 25173 | CAGGTGCTCCTGGTGCAGTCTGGGGCTGAGGTGA<br>AGAGGCCTGGGGCTCAGTGAAGGTCTCCTGCA<br>AGGCTTCTGGATACACCTTCACCAATTATGATAT<br>TAATTGGGTGCGACAGGCCACTGGACAAGGGCT<br>TGAGTGGATGGGATGGATGTACCCTAACAGTGGT<br>AACACAGGCTATGCACAGGACACCTCCATCAGGCAGA<br>GTCACCATGACCAGGGACAGCCTGAGATCTGAG<br>GCCTACATGGAGCTGAGCAGCCTGAGATCTGAG<br>GACACGGCCGTCTATTACTGTGCGAGTAGCAGTG<br>GCTGGTACTACTTTGACTACTGGGGCCAGGGAAC<br>CCTGGTCACCGTGTCCTCA<br>SEQ ID NO: 29179 |
| | | AA | DIVMTQFPDSLAVSLGERATIKCKSSQSVLYSSH<br>NNNYLAWYQQKPGQPPKLLLYWASTRESGVPD<br>RFSGSGSGTEFTLTISSLEAEDVAVYYCQQYYST<br>PPTFGQGTKVEIK<br>SEQ ID NO: 25174 | QVLLVQSGAEVKRPGASVKVSCKASGYTFTNYDIN<br>WVRQATGQGLEWMGWMYPNSGNTGYAQKFQGR<br>VTMTRDTSISTAYMELSSLRSEDTAVYYCASSSGW<br>YYFDYWGQGTLVTVSS<br>SEQ ID NO: 29180 |
| iPS:424460 | 21-225_7E11.001 | NA | GACATCCAGATGACCCAGTCTCCATCCTCCCT<br>GTCTGCATCTGTAGGAGACAGAGTCACCATCG<br>CTTGCCGGGCAAGTCAAAAACATTATCAGCTAT<br>TTAAATTGGTATCAACAACAGAAACCAGGGAAAG<br>CCCCTAAATTCCTGATCTATACTGCATCCAGTT<br>TGCAAAGTGGGGTCCCATCAAGGTTCAGTGGC<br>AGTGGATCTGGGACAGATTTCACTCTCACCAT<br>CAGCAGTCTGCAACCTGAAGATTTTGCAATTT<br>ACTACTGTCAACAGACTTACAGTACCCCGCTC<br>ACTTTCGGCGGCGGGACCAAGGTGGAGATCA<br>AA<br>SEQ ID NO: 25175 | CAGGTGCAGCTGGTGGAGTCTGGGGGAGGCGTG<br>GTCCAGCCTGGGAGGTCCCTGCGACTCTCCTGTG<br>CAGCGTCTGGATTCACCTTCAGTAGCTTTGGCAT<br>GCACTGGGTCCGCCAGGCTCCAGGCAAGGGGCT<br>GGAGTGGGTGGCAATTATCGAGACTCCGTGAAGT<br>AATAAATACTATGCAGAGACAATTCCAAAACACGC<br>TTCACCATCTCCAGAGACAATTCCAAAACACGC<br>TGTATCTGCAAATGAGCAGCCTGCGAGCCGAGG<br>ACACGGCTGTGTATTACTGTGCGAGAGATCTGAG<br>TATGGGCGGTATGGACGTCTGGGGCCAAGGGAC<br>CACGGTCACCGTGTCCTCA<br>SEQ ID NO: 29181 |

FIGURE 50
(Continued)

| | | | |
|---|---|---|---|
| iPS:426108 | | AA | DIQMTQSPSSLSASVGDRVTIACRASQNIISYLN WYQQKPGKAPKFLIYTASSLQSGVPSRFSGSGSG TDFTLTISSLQPEDFAIYCQQTYSTPLTFGGGTK VEIK SEQ ID NO: 25176 | QVQLVESGGGVVQPGRSLRLSCAASGFTFSSFGMH WVRQAPGKGLEWVAIIWHDGSNKYYADSVKGRFT ISRDNSKNTLYLQMSSLRAEDTAVYYCARDLSMGG MDVWGQGTTVTVSS SEQ ID NO: 29182 |
| | 21-225_10G6 | NA | GACATCCAGATGACCCAGTCTCCATCTTCCGT GTCTGCATCTGTGGGAGACAGAGTCACCATCA CTTGTCGGGCGAGTCAGGGTATTAGCAAATGG TTAGCCTGGTATCAGCAGAAACCAGGGAAAG CCCCTAAGATCCTGATATATGCTGCATATAGT TTACAAAGTGGGGTCCCAGCAAGGTTCAGCGG CAGTGGATCTGGGACAGATTTCACTCTCACCA TCAGGAGCCTGCAGCCTGAAGATTTTGCAACT TACTATTGTCAACAGGCTAACAGTTTCCCATTC ACTTTCGGCCCTGGGACCAAAGTGGATATCAA A SEQ ID NO: 25177 | CAGGTGCAGCTGGTGCAGTCTGGGGCTGAGGTG AAGAAGCCTGGGGCCTCAGTGAAGGTCTCCTGC AAGGCTTCTGGATACACCTTCACGGCTACCATA TGCACTGGGTGCGACAGGCCCCTGGACAAGGAC TTGAGTGGATGGGATGGATCAACAGAAGTTCAACCCTAACAATAA TGGCACAAACTATGCACAGAAGTTTCAGGGCAG GGTCACCATGACCAGGGACACGTCCATCAGCAC AGCCTACATGGAGCTGAGCAGGCTGAGATCTGA CGACACGGCCGTTTATTACTGTGGGAGAGATGTT ACCAGCTCGTTTGACTATTGGGGCCAGGGAACCC TGGTCACCGTCTCCTCA SEQ ID NO: 29183 |
| | | AA | DIQMTQSPSSVSASVGDRVTIITCRASQGISKWLA WYQQKPGKAPKILIYAAYSLQSGVPARFSGSGS GTDFTLTIRSLQPEDFATYYCQQANSFPFTFGPGT KVDIK SEQ ID NO: 25178 | QVQLVQSGAEVKKPGASVKVSCKASGYTFTAYHM HWVRQAPGQGLEWMGWINPNNGTNYAQKFQGR VTMTRDTSISTAYMELSRLRSDDTAVYYCGRDVTS SFDYWGQGTLVTVSS SEQ ID NO: 29184 |

FIGURE 50
(Continued)

| | | | |
|---|---|---|---|
| iPS:426110 | 21-225_12E9 | NA | GACATCAGATGACCCAGTCTCCATCTTCCGT GTCTGCATCTGTAAGAGACAGAGTCACCATCA CTTGTCGGGCGAGTCAGGGTATTAGCAGTGG TTAGCCTGGTATCAGCAGAAACCAGGGAAG CCCCTAAGCTCCTGATCTATGCTGCATCCAGG TTGCAAAGTGGGGTCCCATCAAGGTTCAGCGG CAGTGGATCTGGGACAGATTCACTCTCACCA TCAGCAGCCTGCAGCCTGAAGATTTTGCAACT TACTATTGTCAACAGGCTAACAGTTTCCCATTC ACTTTCGGCCCTGGGACCAAAGTGGATATCAA A | CAGGTGCAGCTGGTACAGTCTGGGGCTGAGGTG AAGAAGCCTGGGGCCTCAGTGAAGGTCTCCTGC AAGGCTTCTGGATACACCTTCACCGACTACTATT TGCACTGGGTGCGACAGGCCCCTGGACAAGGTCT TGAGTGGATGGGATGGTCCACCTAACAGTGGT GGCACAAACTTGCACAGAAGTTCAGGACAGG GTCACCATGACCAGGGACACGTCATCAGCACA GCCTACATGGAGCTGAGCAGCCTGAGATCGAC GACACGGCCATATATTCTGTGCGAGATGTA CCAGCTCGTTTGACTACTGGGGCCAGGGAACCCT GGTCACCGTCTCCTCA |
| | | | SEQ ID NO: 25179 | SEQ ID NO: 29185 |
| | | AA | DIQMTQSPSSVSASVRDRVTITCRASQGISSWLA WYQQKPGEAPKLLIYAASRLQSGVPSRFSGSGS GTDFTLTISSLQPEDFATYYCQQANSFPFTFGPGT KVDIK | QVQLVQSGAEVKKPGASVKVSCKASGYTFTDYYL HWVRQAPGQGLEWMGWVHPNSGGTNFAQKFQD RVTMTRDTSISTAYMELSSLRSDDTAIYSCARDGTS SFDYWGQGTLVTVSS |
| | | | SEQ ID NO: 25180 | SEQ ID NO: 29186 |
| iPS:426112 | 21-225_12F12 | NA | GACATCGTGATGACCCAGTCTCCAGACTCCT GGCTGTGTCTCTGGGCGAGAGGGCCACCATCA ACTGCAAGTCCAGCCAGACTGTTTATTCAGC TCCAACAATAACCACTACTAGCATGGTACCA GCAGAAACCAGGACAAACCTCCTAACCTCTCA TTTACTGGGCATTCAGTGGCAGCGGGTCTGGGAC CCTGACCGATTCACTCTCACCATCAGCAGCCTGCAGG AGATTTCACTCTCACCATCAGCAGCCTGCAA CTGAAGATGTGGCAGTTTATTACTGTCAGCAA TATTATAGTAGTCCGTGGACGTTCGGCCAAGG GACCAAGGTGGAAATCAAA | CAGGTGCAGCTGCTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGTACCAGAAGTTCCAGGCAG TAACACGGGCTATGCACAGAAGTTCCAGGCAG AGTCACCAGGGATCACCATGACCAGCACCATCCATAAGCACA GCCTACATGGAGTTGAGCAGCCTGAGATCGAG GACACGGCCGTGTATTACTGTGCGATGAGCAGTG GCTGGTACTACTTTGACTTCTGGGGCCAGGGAAC CCTGGTCACCGTCTCCTCA |
| | | | SEQ ID NO: 25181 | SEQ ID NO: 29187 |

FIGURE 50
(Continued)

| | | | | |
|---|---|---|---|---|
| iPS:426114 | 21-225_28H2 | AA | DIVMTQSPDSLAVSLGERATINCKSSQTVLFSSN NNHYLAWYQQKPGQPPNLLIYWASTRASGVPD RFSGSGSGTDFTLTISSLQAEDVAVYYCQQYYSS PWTFGQGTKVEIK<br>SEQ ID NO: 25182 | QVQLLQSGAEVKKPGASVKVSCKASGYTFTNYDIN WVRQATGQGLEWMGWMYPNSGNTGYAQKFQGR VTMTMNTSISTAYMELSSLRSEDTAVYYCAMSSG WYYFDFWGQGTLVTVSS<br>SEQ ID NO: 29188 |
| | | NA | GACATCCAGATGACCCAGTCTCCTTCCTCCCT GTCTGCATCTATAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATTTATGCTGCATCCAGTT TGCAAAGTGGGGTCCCATCAAGGTTCAGCGGC AGTGGATCTGGGACAGAATTCACTCTCACAA CAGCAGCCTGCAGCCTGAAGATTATAGTT ATTACTGTCTACAACATTATAGTTACCCTCGCA GTTTTGGCCAGGGGACCAAGCTGGAGATCAAA<br>SEQ ID NO: 25183 | CAGGTGCAGCTGGTGGAGTCTGGGGGAGGCGTG GTCCAGCCTGGGAGGTCCCTGAGACTCTCTGTG CAGCGTCTGGATTCACCTTCAGTAACTATGTCAT GCACTGGGTCCGCCAGGCTCCAGGCAAGGGCT GGAGTGGGTGGCAGTTATATGGTGTATGATGAAGT AATAAGTACTATGCAGACTCCGTGAAGGCCGA TTCACCATCTCCAGAGACAATTCCAAGAACACGC TGTATCTACAAATGAACAGCCTGAGAGCCGTGG ACACGGCTGTGTATTACTGTGCGAGAGAGGAGTA TAGCAGTGGCTGTACGACTACGGTATGGACGTC TGGGGCCAAGGGACCACGGTCACCGTCTCCTCA<br>SEQ ID NO: 29189 |
| | | AA | DIQMTQSPSSLSASIGDRVTITCRASQGIRNDLG WYQQKPGKAPKRLIYAASSLQSGVPSRFSGSGS GTEFTLTISSLQPEDFATYCLQHYSYPRSFGQG TKLEIK<br>SEQ ID NO: 25184 | QVQLVESGGGVVQPGRSLRLSCAASGFTFSNYVM HWVRQAPGKGLEWVAVIWYDGSNKYYADSVKGR FTISRDNSKNTLYLQMNSLRAVDTAVYYCAREEYS SGWYDYGMDVWGQGTTVTVSS<br>SEQ ID NO: 29190 |

FIGURE 50
(Continued)

| | | | |
|---|---|---|---|
| iPS:426116 | 21-225_29E2 | NA | GACATCCAGATGACCCAGTCTCCATCCTCCT<br>GTCTGCATCTGTAGGAGACAGAGTCACCATCA<br>CTTGCCGGGCAAGTCAGGCCATTAGAAATGAT<br>TTAGGCTGGTATCAGCAGAAGACCAGGGAAAG<br>CCCCTAAGCGCCTGATCTATGCTGCATCCAGT<br>TTGCAAAGTGGGGTCCCATCAAGGTTCAGCGG<br>CAGTGGATCTGGGACAGAATTTATTCTCACAA<br>TCAGCAGCCTGCAGCCTGAAGATTTTGCAACT<br>TATTACTGTTTACAGCATTATAATTACCCTCGC<br>AGTTTTGGCCAGGGGACCAAGCTGGAGATCAA<br>A<br>SEQ ID NO: 25185 | CAGGTGCAGCTGGTGGAGTCTGGGGGAGGCGTG<br>GTCCAGCCTGGGAGGTCCCTGAGACTCTCCTGTG<br>CAGCGTCTCTGGATTCACCTTCAGTAACTGTGTCAT<br>GCACTGGGTCCGCCAGGCTCCAGGCAAGGGGCT<br>GGAGTGGGTGGCAGTTATATGGTATGATGGAAGT<br>AATAAATACTATGCAGACTCCGTGAAGGGCCGA<br>ATCACCATCTCCAGAGACAATTCCAAGAACACGC<br>TGTATCTGCAAATGAACAGCCTGAGAGCCGAGG<br>ACACGGCTGTGTATTACTGTGCGAGAGGAGTA<br>TAGCAGTGGCTGGTACGACTACGGTATGGACGTC<br>TGGGGCCAAGGGACCACGGTCACCGTCTCCTCA<br>SEQ ID NO: 29191 |
| | | AA | DIQMTQSPSSLSASVGDRVTITCRASQAIRNDLG<br>WYQQRPGKAPKRLIYAASSLQSGVPSRFSGSGS<br>GTEFILTISSLQPEDFATYYCLQHYNYPRSFGQGT<br>KLEIK<br>SEQ ID NO: 25186 | QVQLVESGGGVVQPGRSLRLSCAASGFTFSNCVMH<br>WVRQAPGKGLEWVAVIWYDGSNKYYADSVKGRI<br>TISRDNSKNTLYLQMNSLRAEDTAVYYCAREEYSS<br>GWYDYGMDVWGQGTTVTVSS<br>SEQ ID NO: 29192 |
| iPS:426118 | 21-225_7A10 | NA | GACATCCAGATGACCCAGTCTCCATCCTCCCT<br>GTCTGCATCTGTAGGAGACAGAGTCACCATCA<br>CTTGCCGGGCAAGTCAGAACATTTACAGCTAT<br>TTAAATTGGTATCAGCAGAAACCAGGGAGAG<br>CCCCTAAACTCGTGATCTATTCTACATCCAGTT<br>TGCAAAGTGGGGTCCCATCAAGGTTCAGTGGC<br>AGTGGATCTGGGACAGATTTCAGTCTCACCAT<br>CAGCAATCTGCAACTGAAGATTTTTCAACTT<br>ACTACTGTCAACAGAGTTACAGTCCCCCTCTC<br>ACTTTCGGCGGAGGGACCAAGGTGGAGATCA<br>GA<br>SEQ ID NO: 25187 | CAGGTGCAGCTGGTGGAGTCTGGGGGAGGCGTG<br>GTCCAGCCTGGGAGGTCCCTGAGACTCTCCTGTG<br>CAGCGTCTGGATTCAACTTCAGTAGTAGTATGCAT<br>GCACTGGGTCCGCCAGGCTCCAGGCAAGGGGCT<br>GGAGTGGATGGCAGTTATATGCAGACTCCGTGAAGT<br>AATAAATACTATGCAGACTCCGTGAAGGGCCGA<br>TTCACCATCTCCAGAGACAATTCCAAGAACACGC<br>TGTATCTGCAAATGACAGCCTGAGAGCCGAGG<br>ACACGGCTGTGTATTACTGTGCGAGAGATGAGAG<br>GCTGGGGATTTTGACTACTGGGGCCAGGGAACC<br>CTGGTCACCGTCTCCTCA<br>SEQ ID NO: 29193 |

FIGURE 50
(Continued)

| | | | | |
|---|---|---|---|---|
| iPS-426124 | 21-225_32D6 | AA | DIQMTQSPSSLSASVGDRVTITCRASQNIYSYLNWYQQKPGRAPKLVIYSTSSLQSGVPSRFSGSGSGTDFSLTISNLQPEDFSTYYCQQSYSPPLTFGGGTKVEIR<br>SEQ ID NO: 25188 | QVQLVESGGGVVQPGRSLRLSCAASGFNFSSYGMHWVRQAPGKGLEWMAVIWYDGSNKYYADSVKGRFTISRDNSKNTLYLQMHSLRAEDTAVYYCARDERLGIFDYWGQGTLVTVSS<br>SEQ ID NO: 29194 |
| | | NA | GACATCCAGATGACCCAGTCTCCATCCTCCCTGTCTACATCTGTAGGAGACAGAGTCACCATCACTTGCCGGGCAAGTCAGAACATTATCAGTATTTAAATTGGTATCAGCAGAAACCAGGGAAAGCCCCTAAGCTCCTGATCTATGTTGCATCCCGTTTGCAAAGTGGGGTCCCATCAAGGTTCAGTGGCAGTGGATCTGGGACAGATTTCACTCTCACCATCAGCAGTCTGCAAGCTGAAGATTTTGCAACTTACTACTGTCAACAGAGTTACAGTACCCGTACACTTTCGGCGGAGGGACCAAGGTGGCGATCAAA<br>SEQ ID NO: 25189 | CAGGTGCAGTTGGTGGAGTCTGGGGGAGGCGTGGTCCAGCCTGGGAGGTCCCTGAGACTCTCCTGTGCAGGCGTCTGGATTCACCTTCAGTAGCTATGGCATGCACTGGGTCCGCCAGGCTCCAGGCAAGGGACTGGAGTGGGTGGCAGTTATATGGCATGATGGAAGTAATGCATACTATGCAGACTCCGTGAAGGGCCGATTCACCATCTCCAGAGACAACAGCCAAGAACACGCTGTATCTGCAAATGAACAGCCTGAGAGCCGAGGACACGGCTGTGTATTACTGTGCGAGAGAAAATAGCAGTCGTACTACTTTGACTACTGGGGCCAGGGAACCCTGGTCACCGTCTCCTCA<br>SEQ ID NO: 29195 |
| | | AA | DIQMTQSPSSLSTSVGDRVTITCRASQNIISYLNWYQQKPGKAPKLLMYVASRLQSGVPSRFSGSGSGTDFFLTISSLQAEDFATYYCQQSYSTPYTFGGGTKVAIK<br>SEQ ID NO: 25190 | QVQLVESGGGVVQPGRSLRLSCAASGFTFSSYGMHWVRQAPGKGLEWVTVIWHDGSNAYYADSVKGRFTISRDNSKNTLYLQMNSLRAEDTAVYYCARENSSSYYFDYWGQGTLVTVSS<br>SEQ ID NO: 29196 |

FIGURE 50
(Continued)

| | | | | |
|---|---|---|---|---|
| iPS:426126 | 21-225_6G6 | NA | GACATCGTGATGACCCAGTCTCCAGACTCCCT GGCTGTGTCTCTGGGCGAGAGGGCCACCATCA ATTGCAAGTCCAGCCAGAGTGTTTTACACAAC TCCAACAATTATAACTATTTAGCTTGGTACCA GCAGAAACCAGGACAGCCTCCTAACCTGCTCA TTTTCTGGGCATCTACCCGGGAATCCGGGGTC CCTGACCGATTCAGTGGCAGCGGGTTTGGGAC AGATTTCACTCTCAACATCAGCAGCCTGCAGG CTGAAGATGTGGCAGTTTATTACTGTCAGCAA TATTATGATACTCCATTCACTTTCGGCCATGGG ACCAAAGTGGATATCAAA<br>SEQ ID NO: 25191<br>DIVMTQSPDSLAVSLGERATINCKSSQSVLHNSN NYNYLAWYQQKPGQPPNLLIFWASTRESGVPDR FSGSGFGTDFTLNISSLQAEDVAVYYCQQYDTP FTFGHGTKVDIK<br>SEQ ID NO: 25192 | CAGGTGCAGCTGGTGCAGTCTGGGGCTGAGGTG AGGAAGCCTGGGCCTCAGTGAAGGTCCTGC AAGGCTTCTGGATACACCTTCACCAATTATGATA TCAACTGGGTGCGACAGGCCACTGGACAAGGGC CTGAGTGGATGGGATGGATGCACCCTAACAGTG GTAACACAGGCTATGCAAAGAAGTTCCAGGCA GAGTCCACCATGACCAGGAACACCTCCATAAGCG CAGCCTATATGGTTCTGAGCAGCCTGAGATCTGA GGACACGGCCGTGTATTACTGTGCGCTTAGCAGT GGCTGGTACTACTTTGACTACTGGGGCCAGGGAA CCCTGGTCACCGTCTCCTCA<br>SEQ ID NO: 29197<br>QVQLVQSGAEVRKPGASVKVSCKASGYTFTNYDIN WVRQATGQGPEWMGWMHPNSGNTGYAKKFQGR VTMTRNTSISAAYMVLSSLRSEDTAVYYCALSSGW YYFDYWGQGTLVTVSS<br>SEQ ID NO: 29198 |
| iPS:433895 | 21-225_43E1 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGAAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A<br>SEQ ID NO: 25193 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCCGCCATTAGTAGTAGTAGTACT TACATATACTACGCAGACTCGTTGAAGGGCCGAT TCACCATCTCCAGAGACAACGCCAAGAACTCACT GTTTCTGCAACTGAACAGCCTGAGAGCCGAGGA CACGGCTGTTTATTACTGTGCGAGAGATCGGGGC AGTGAATGGGGCCAGGGAACCCTGGTCACCGTC TCCTCA<br>SEQ ID NO: 29199 |

FIGURE 50
(Continued)

| | | | |
|---|---|---|---|
| | | AA | DIQMTQSPSSLSASVGDRVTITCRASQGIRNDLG WYQQKPGKAPKRLINAASSLQSGVPSRFSGSGS GTEFTLTISSLQPEDFATYYCLQHNSYPFTFGPGT KVDIK<br><br>SEQ ID NO: 25194 | EVQLVESGGGLVKPGGSLRLSCAASGFTFSSYSMN WVRQAPGKGLEWVSAISGNSTYIYYADSLKGRFTI SRDNAKNSLFLQLNSLRAEDTAVYYCARDRGSEW GQGTLVTVSS<br><br>SEQ ID NO: 29200 |
| iPS:433897 | 21-225_43C2 | NA | GACATCCAGATGACCCAGTCTCCATCTTCCGT GTCTGCATCTGTAGGAGACAGAGTCACCATCA CTTGTCGGGCGAGTCAGGGTATTAGCGACTGG TTAGCCTGGTATCAGCAGAAACCAGGGAAAG CCCCTAGGCTCCTGATCTATGCTGCATCAGTT TGCAAAGTGGGGTCCCATCAAGGTTCAGCGGC AGTGGATCTGGGACAGATTTCACTCTCACCAT CAGCAACCTGCAGCCTGAAGATTTTGCAACTT ACTATTGTCAACAGAGACTAACAGTTTCCGTGG ACGTTCGGCCAAGGGACCAAGGTGAAATCA AA<br><br>SEQ ID NO: 25195 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTCGTGTGTT AACACATTGACGCAGACTCCGTGAAGGGCCGG TTCACCATCTCCAGAGACACAATTCCAAGAACACGC TGTATCTGCAAATGAACAGCCTGAGAGCCGAGG ACACGGCCGTATATTTTGACTACTGGGGCCAGGGAAC GTGGGAGCTATTTTGACTACTGGGGCCAGGGAAC CCTGGTCACCGTCTCCTCA<br><br>SEQ ID NO: 29201 |
| | | AA | DIQMTQSPSSVSASVGDRVTITCRASQGISDWLA WYQQKPGKAPRLLIYAASSLQSGVPSRFSGSGSG TDFTLTISNLQPEDFATYYCQQTNSFPWTFGQGT KVEIK<br><br>SEQ ID NO: 25196 | EVQLLESGGGLVQPGGSLRLSCAASGFTFSSYAMS WVRQAPGKGLEWVSAISGRGVNTFDADSVKGRFTI SRDNSKNTLYLQMNSLRAEDTAVYYCAKERSGSY FDYWGQGTLVTVSS<br><br>SEQ ID NO: 29202 |

FIGURE 50
(Continued)

| | | | | |
|---|---|---|---|---|
| iPS:433899 | 21-225_43C3 | NA | GACATCCAGATGACCCAGTCTCCATCCTCCCT GTCTGCATCTGTAGGAGACAGAGTCACCATCA CTTGCCGGGCAAGTCAGGACATTAGGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATAGTTACCCTCTC ACTTTCGGCGGAGGGACCAAGGTGGGGATCA CA | CAGGTGCAGCTGGTGGAGTCTGGGGGAGGCGTG GTCCAGCCTGGGAGGTCCCTGAGACTCTCCTGTG CAGGGTCTGATTCACCTTCAGTAGCTATGGCAT ACACTGGGTCCGCCAGGCTCCAGGCAAGGGCT GGAGTGGGTGGCAGTTATATGGTATGATGAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGCTAGG ATTTTCCAATGACTACTGGGGCCAGGGAACCCTG GTCACCGTCTCCTCA |
| | | | SEQ ID NO: 25197 | SEQ ID NO: 29203 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVGIT | QVQLVESGGGVVQPGRSLRLSCAASGFTFSSYGIH WVRQAPGKGLEWVAVIWYDENNKYYADSVKGRF TISRDNSKNTLYLQMNSLRAEDTAVYYCARELGFS NDYWGQGTLVTVSS |
| | | | SEQ ID NO: 25198 | SEQ ID NO: 29204 |
| iPS:433901 | 21-225_43A4 | NA | GACATCCAGATGACCCAGTCTCCATCCTCACT GTCTGCATCTGTAGGAGACAGAGTCACCATCA CTTGTCGGGCAGTCAGGGCATTAGCAACAATTAT TTAGCCTGGTTTCAGCAGAAACCAGGGAAAGC CCCTAAGTCCCTGATCAATGCTGCATCCAGTT GCAAAGTGGGGTCCCATCAAGGTTCAGCGGCA GTGGATCTGGGACAGATTTCACTCTCGCCATC AGCAGCCTACAACAGTCTGAAGATTATTACCTTA TTACTGCCAACAGTATTATAGTTACCCATTCAC TTTCGGCGCCCTGGGACCAAAGTGGATATCAAA | GAGGTGCAGCTGGTGGAGTCTGGGGGAGGCGTG GTCAAGCCGGGGGGGTCCCTGAGACTCTCCTGTG CAGCCTCTGGATTCACCTTCAGTAGCTATACCAT GAACTGGGTCCGCCAGGTTCCAGGAAGGGGCT GGAGTGGGTCTCATTAGTAGTGGAAGTAGTACT TACATATACTACGCAGACTCAGTGAAGGGCCGAT TCACCATCTCCAGAGACAGACGCCCAGAACTCACT GTATCTGCAAATGAACAGCTGAGAGGGCAGGAGGA CACGGCTGTGTATTACTGTGCGAGGGTGACCTCT TTTGACTACTGGGGCCAGGGAGCCCTGGTCACCG TCTCCTCA |
| | | | SEQ ID NO: 25199 | SEQ ID NO: 29205 |

FIGURE 50
(Continued)

| | | | | |
|---|---|---|---|---|
| iPS-433903 | 21-225_43H4 | AA | DIQMTQSPSSLSASVGDRVTITCRASQGINNYLA WFQQKPGKAPKSLINAASSLQSGVPSRFSGSGSG TDFTLAISSLQPEDFATYYCQQYYSYPFTFGPGT KVDIK<br><br>SEQ ID NO: 25200 | EVQLVESGGGLVKPGGSLRLSCAASGFTFSSYTMN WVRQVPGKGLEWVSSISGSSTYIYYADSVKGRFTIS RDDAQNSLYLQMNSLRGEDTAVYYCARVTSFDY WGQGALVTVSS<br><br>SEQ ID NO: 29206 |
| | | NA | GAGGTGACCAGTCTCCATCTTCCGT GTCTGCATCTGTAGGAGACAGAGTCACCATCA CTTGTCGGGCGAGTCAGGGTATTATCAACTGG TTAGCCTGGTATCAACAGAAACCAGGGAAAG CCCCTAAGCTCCTGATCTATGCTGCATCCAGTT TGCAAAGTGGGGTCCCATCAAGGTTCAGCGGC AGTGGATCTGGGACAGATTTCACTCTCACCAT CAGCAACCTGCAGCTGAAGATTTTGCAACTT ACTATTGTCAACAGACTAACAGTTTCCCGTGG ACGTTCGGCCAAGGGACCAAGGTGGAAATCA AA<br><br>SEQ ID NO: 25201 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTCGTGGTATT AACACATTCGACGCAGACTCCGTGAAGGGCCGG TTCACCATCTCCAGAGACAATTCCAAGAACACGC TGTATCTGCAAATGAACAGCCTGAGAGGCGAGG ACACGGCCGTATATTACTGTGCGAAGGAAAGGA GTGGGAGCTATTTTGACTACTGGGGCCAGGGAAC CCTGGTCACCGTCTCCTCA<br><br>SEQ ID NO: 29207 |
| | | AA | DIQMTQSPSSVSASVGDRVTITCRASQGIHNWLA WYQQKPGKAPKLLIYAASSLQSGVPSRFSGSGS GTDFTLTISNLQPEDFATYYCQQTNSFPWTFGQG TKVEIK<br><br>SEQ ID NO: 25202 | EVQLLESGGGLVQPGGSLRLSCAASGFTFSSYAMS WVRQAPGKGLEWVSAISGRGINTFDADSVKGRFTI SRDNSKNTLYLQMNSLRAEDTAVYYCAKERSGSY FDYWGQGTLVTVSS<br><br>SEQ ID NO: 29208 |

FIGURE 50
(Continued)

| | | | |
|---|---|---|---|
| iPS:433905 | 21-225_43E5 | NA | GACATCGAGATGACCCAGTCTCCATCTCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGGTGCATCCAAT TTGCAAAGTGGGGTCCCATCAAGGTTCAGCGG CAGTGGATCTGGGACAGAATTCACTCTCACAG TCAGCAGCCTGCAGCCTGAAGATTTTGCAACT TATTTCTGTCTACAGCATACTAGTTTCCCATTC ACTTTCGGCCCTGGGACCAAAGTGGATATCAA A <br> SEQ ID NO: 25203 | CAGGTGCAGCTGGTGGAGTCTGGGGGAGGCTTG GTCAAGCCTGGAGGGTCCCTGAGACTCTCCTGTG CAGCCTCTGGATTCACCTTCAGTGACTACTACAT GATCTGGATCCGCCAGGCTCCAGGGAAGGGGCT GGAGTGGGTTTCATACATTAGTAGTAGTGGTATT GGCAAATACTACGCAGACTCTATGAAGGGCCGA TTCACCATCTCCAGGGACAACGCCAAGAACTCAC TGTATCTGCAAATGAACAGCCTGAGAGCCGAGG ACACGGCCGTGTATTACTGTGCGGCCGATACAAT CTACTGGGGCCAGGGAACCCTGGTCACCGTCTCC TCA <br> SEQ ID NO: 29209 |
| | | AA | DIQMTQSPSSLSASVGDRVTITCRASQGIRNDLG WYQQKPGKAPKRLIYGASNLQSGVPSRFSGSGS GTEFTLTVSSLQPEDFATYFCLQHTSFPFTFGPGT KVDIK <br> SEQ ID NO: 25204 | QVQLVESGGGLVKPGGSLRLSCAASGFTFSDYYMI WIRQAPGKGLEWVSYISSSGITKYYADSMKGRFTIS RDNAKNSLYLQMNSLRAEDTAVYYCAADTIYWGQ GTLVTVSS <br> SEQ ID NO: 29210 |
| iPS:433909 | 21-225_43D8 | NA | GACATCGTGATGACCCAGTCTCCAGACTCCCT GGCCTGTCTCTGGGCGAGAGGCCACCATCA ACTGCAAGTCCAGTCAGAGTGTTTAATGACC TCCAACGATAAGAACTACTTAACTTGGTACCA GCAGAGACCAGGACAGACCCTCCTAAGCTGCTCA TTTACTGGGCTTCTACCCGGGAATCCGGGGTC CCTGACCGATTCAGTGGCGGGGGGTCTGGGAC AGATTTCACTCTCACCATCAGCGGCCTGCAGG CTGAAGATGTGGCAGTTTATTACTGTCAGCAA TATTATAGTACTCCTCCGACGTTCGGCCAAGG GACCAAGGTGGAAATCAAG <br> SEQ ID NO: 25205 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCCTAACAGTGG TAACACAGGCTATGCACAGAAGTTCAGGGCAG AGTCACCATGACCAGGAACACCTCCATAAGCAC AGCCTACATGGAGCTGAGCAGCCTGACATCGA GGACACGGCCGTGTATTACTGTGCCCATAGCAGT GGCTGGACCCTCTTTGACTACTGGGGCCAGGGAA CCCTGGTCACCGTCTCCGCA <br> SEQ ID NO: 29211 |

FIGURE 50
(Continued)

| | | | |
|---|---|---|---|
| iPS:433911 | 21-225_43E8 | AA | DIVMTQSPDSLAVSLGERATINCKSSQSVLMTSN DKNYLTWYQQRPGQPPKLLIYWASTRESGVPDR FSGGGSGTDFTLTISGLQAEDVAVYYCQQYYST PPTFGQGTKVEIK<br>SEQ ID NO: 25206 | QVQLVQSGAEVKKPGASVKVSCKASGYTFTNYDIN WVRQATGQGLEWMGWMHPNSGNTGYAQKFQGR VTMTRNTSISTAYMELSSLTSEDTAVYYCAHSSGW TLFDYWGQGTLVTVSA<br>SEQ ID NO: 29212 |
| | | NA | GACATCCAGATGAACCAGTCTCCATCTTCCGT GTCTGCATCTGTAGGAGACAGAGTCACCATCA CTTGTCGGGCGAGTCAGGGTATTAGCAACTGG TTAGCCTGGTATCAGCAGAAACCAGGGAGAG CCCCTAAGCTCCTGATCTATGCTGCATCCAGTT TGCAAAGTGGGGTCCCTTCAAGGTTCAGCGGC AGTGGATCTGGGACAGATTTCACTCTCACCAT CAGCAACCTGCAGCCTGAAGATTTTGCAACTT ACTATTGTCAACAGACTAACAGTTCCCGTGG ACGTTCGGCCAAGGGACCAAGGTGGAAATCA AA<br>SEQ ID NO: 25207 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTCGTGGTATT AACACATTCGACGCAGACTCCGTGAAGGGCCGG TTCACCATCTCCAGAGACAATTCCAAGAACACGC TGTATCTGCAAATGAACAGCTGAGGCCGAGG ACACGGCCGTATATTACTGTGCGAAGGAAAGGA GTGGGAGCTATTTTGACTACTGGGGCCAGGGAAC CCTGGTCACCGTCTCCA<br>SEQ ID NO: 29213 |
| | | AA | DIQMNQSPSSVSASVGDRVTITCRASQGISNWLA WYQQKPGRAPKLLIYAASSLQSGVPSRFSGSGSG TDFTLTISNLQPEDFATYCQQTNSFPWTFGQGT KVEIK<br>SEQ ID NO: 25208 | EVQLLESGGGLVQPGGSLRLSCAASGFTFSSYAMS WVRQAPGKGLEWVSAISGRGINTFDADSVKGRFTI SRDNSKNTLYLQMNSLRAEDTAVYYCAKERSGSY FDYWGQGTLVTVSS<br>SEQ ID NO: 29214 |

FIGURE 50
(Continued)

| | | | | |
|---|---|---|---|---|
| iPS:433913 | 21-225_43H8 | NA | GACATCCAAATGACCCAGTCTCCATCCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGCTGCATCCAGT TTGCAAAGTGGGGTCCATCAAGGTTCAGCGG CAGTGGATCTGGGACAGATTCACTCTCTCAA TCAGCAGCCTGCAGCCTGAAGATTTTGCAACT TATTACTGTCTACAGCATAATAGTTTCCCATTC ACTTTCGGCCCTGGGACCAAAGTGGATATCAA A | CAGGTGCAGCTGGTGGAGTCTGGGGGAGGCTTG GTCAAGCCTGGAGGGTCCCTGAGACTCTCCTGTG CAGCCTCTGGAATCACCTTCAGTGACTACTACAT GAACTGGATCCGCCAGGCTCCAGGGAAGGGGCT GGAGTGGGTTTCATACATTAGTAGTAGTGGTAGA ACCATATTCTACGCAGACTCTTTGAAGGGCCGAT TCACCATCTCCAGGGACAACGCCAAGAACTCACT GTATCTGCAAATGAACAGCCTGAGAGCCGAGGA CACGGCCGTGTATTACTGTGCGCCGATACAATC TACTGGGGCCAGGGAACCCTGGTCACCGTCTCCT CA |
| | | | SEQ ID NO: 25209 | SEQ ID NO: 29215 |
| | | AA | DIQMTQSPSSLSASVGDRVTITCRASQGIRNDLG WHQQKPGKAPKRLIYAASSLQSGVPSRFSGSGS GTEFTLSISSLQPEDFATYYCLQHNSFPFTFGPGT KVDIK | QVQLVESGGGLVKPGGSLRLSCAASGITFSDYYMN WIRQAPGKGLEWVSYISSSGRTIFYADSLKGRFTISR DNAKNSLYLQMNSLRAEDTAVYYCAADTIYWGQ GTLVTVSS |
| | | | SEQ ID NO: 25210 | SEQ ID NO: 29216 |
| iPS:433915 | 21-225_43H9 | NA | GACATCCAGATGACCCAGTCTCCATCTTCCGT GTCTGCATCTGTAGGAGACAGAGTCACCATCA CTTGTCGGGCGAGTCAGGATATTAGCAGCTGG TTAGCCTGGTATCAGAAGAAACCAGGGAAAG CCCCTAAACTCCTGATCTATGATGCATCCAGTT TGCAAAGTGGGGTCCCATCAAGGTTCAGCGGC AGTGGATCTGGGACAGCTGCACAGATTTCACTCT ACTTTTGTCAACAGGCTAACAGTCTCCCATTC ACTTTCGGCCCTGGGACCAAAGTGGATATCAA A | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGTTGGGTCCGCCAGGCTCCAGGGATGGGGCT GGAGTGGGTCTCAGCTATTAGCAGACTCCGTAGT AACACATTCTACGCAGAGACTCCGTGAAGGGCCGGT TCACCATCTCCAGAGACAATTCCAAGAACACGCT GTATCTGCAAATGAACAGCCTGAGAGCCGAGGA CACTGCCGTATATTTCTGTGCGAAACGAACGCCC TCTGATGTTTTGATATCGGGGCCAAGGGACAA TGGTCACCGTCTCTTCA |
| | | | SEQ ID NO: 25211 | SEQ ID NO: 29217 |

FIGURE 50
(Continued)

| | | | |
|---|---|---|---|
| iPS:433917 | | AA | DIQMTQSPSSVSASVGDRVTITCRASQDISSWLA WYQKKPGKAPKLLIYDASSLQSGVPSRFSGSGS GTDFILTISSLQPEDFATYFCQQANSLPFTFGPGT KVDIK<br><br>SEQ ID NO: 25212 | EVQLLESGGGLVQPGGSLRLSCAASGFTFSSYAMS WVRQAPGMGLEWVSAISGSGSNTFYADSVKGRFTI SRDNSKNTLYLHMNSLRAEDTAVYFCAKRTPSDVF DIWGQGTMVTVSS<br><br>SEQ ID NO: 29218 |
| | | NA | GATATTGTGATGACCCAGACTCCACTCTCT GTCCGTCACCCCTGGACAGCCGGCCTCCATCT CCTGCAAGTCTAGTCAGAGCCTCCTGCACAGT GATGGAAGGACCTATTTGTATTGGTACCTTCA GAAGCCAGGCCAGCCTCCCGCAGCTCCTGATCT ATGAAGTTTCCAACCGGTTCTCTGGAGTGCCA GATAGGTTCAGTGGCAGCGGGTCAGGGACAG ACTTCACACTGAAAATCAGCCGGTGGAGGCT GAGGATGTTGGGGTTTATTACTGTATGCAAAG TATACAGCTTCCGTGACGTTCGGCCAAGGGA CCAAGGTGGAAATCAAA<br><br>SEQ ID NO: 25213 | CAGGTGCAGCTGGTGGAGTCTGGGGGAGGCGTG GTCCAGCCTGGGAGGTCCCTGAGACTCTCTGTG CAGCGTCTGGATTCTCCTTCAGTGACTATGGCAT GCACTGGGTCCGCCAGGCTCCAGGCAAGGGGCT GGAGTGGGTGGCAGTTATATGTATGATGGAAGT AATAAATACTATGCAGACTCCGTGAAGGGCCGA CTCACCATCTCCAGAGACAACAATTCCAAGAACGC TGTATCTGCAAATGAACAGCCTGAGAGCCGAGG ACACGGCTGTGTATTACTGTGCGAGGCGTATGT CAGAAGCTGGGTGGGAGGTATGGACGTCTGGGG CCAAGGGACCACGGTCACCGTCTCCTCA<br><br>SEQ ID NO: 29219 |
| 21-225_43E11 | | AA | DIVMTQTPLSLSVTPGQPASISCKSSQSLLHSDGR TYLYWYLQKPGQPPQLLIYEVSNRFSGVPDRFSG SGSGTDFTLKISRVEAEDVGVYYCMQSIQLPWTF GQGTKVEIK<br><br>SEQ ID NO: 25214 | QVQLVESGGGVVQPGRSLRLSCAASGFSFSDYGMH WVRQAPGKGLEWVAVIWYDGSNKYYADSVKGRL TISRDNSKNTLYLQMNSLRAEDTAVYYCARRYVRS WVGGMDVWGQGTTVTVSS<br><br>SEQ ID NO: 29220 |

FIGURE 50
(Continued)

| | | | |
|---|---|---|---|
| iPS:433919 | 21-225_44B3 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAACAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACTGCATTATAATTACCCTCGG ACGTTCGGCCAAGGGACCAAGGTGGAAATCA AG<br>SEQ ID NO: 25215 | CAGGTGCAGCTGGTGGAGTCTGGGGGAGGCGTG GTCCAGCCTGGGAGGTCCCTGAGACTCTCTGTA CAGCGTCTGGATTCACCTTCAGTGACTATGGCAT GCACTGGGTCCGCCAGGCTCCAGGCAAGGGCT GGAGTGGGTGGCAGTTATATGGTTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGAGTA TAGCAGTGGCTGGTACGACTACGGTATGGACGTC TGGGGCCAAGGGACCACGGTCACCGTCTCCTCA<br>SEQ ID NO: 29221 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLLHYNYPRTFGQG TKVEIK<br>SEQ ID NO: 25216 | QVQLVESGGGVVQPGRSLRLSCTASGFTFSDYGMH WVRQAPGKGLEWVAVIWYDGSNKYYADSVKGRF TISRDNSKNTLYLQMNSLRAEDTAVYYCARERYSS GWYDYGMDVWGQGTTVTVSS<br>SEQ ID NO: 29222 |
| iPS:433921 | 21-225_44C3 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CGGTGGATCTGGGACAGAGCCTCACTCTCACAA TCAGCAGCCTGCAGCCTGAAGATTTTGCGACT TATTACTGTCTACAGCATAGTAGTTACCCCTCTC ACTTTCGGCGGAGGGACCAAGGTGGAGATCA AG<br>SEQ ID NO: 25217 | CAGGTGCAGCTGGTGGAGTCTGGGGGAGGCGTG GTCCAGCCTGGGAGGTCCCTGAGACTCTCTGTG CAGCGTCTGGATTCACCTTCAGTAGCTATGGCAT GCACTGGGTCCGCCAGGCTCCAGGCAAGGGCT GGAGTGGGTGGCAGTTATATGGTTTGAAGGAAGT AATAAATACTATGCAGATTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGTGAGAGAACTAGGA TTTTCCACCGACTACTGGGGCCAGGGAACCCTGG TCACCGTCTCCTCA<br>SEQ ID NO: 29223 |

FIGURE 50
(Continued)

| | | | | |
|---|---|---|---|---|
| iPS:433923 | 21-225_44D3 | AA | DIQMTQSPSSLSASVGDRVTITCRASQGIRNDLG WYQQKPGKAPKRLIYAASSLQSGVPSRFSGGGS GTEFTLTISSLQPEDFATYYCLQHSSYPLTFGGGT KVEIK<br>SEQ ID NO: 25218 | QVQLVESGGGVVQPGRSLRLSCAASGFTFSSYGMH WVRQAPGKGLEWVAVIWFEGSNKYYADSVKGRF TISRDNSKNTLYLQMSSLRAEDTAVYYCVRELGFS TDYWGQGTLVTVSS<br>SEQ ID NO: 29224 |
| | | NA | GACATCCAGATGACCCAGTCTCCATCCTCCCT GTCTGCATCTGTGGGAGACAGAGTCACCTTCA CTTGCCGGGCAAGTCAGGGCATTAGAGATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTAGATCTGGGACAGAATTCACTCTCACAA TCAGCAGCCTGCAACCTGAAGATTTTGCAACT TATTACTGTCTACAGCATTATAGTTACCCTCGG ACGTTCGGCCAAGGGACCAAGGTGGAAATCA AA<br>SEQ ID NO: 25219 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGGCAAGGGGCT GGAGTGGGTGGCAGTTATATGTATGGTGATGGAAGT AATAAATACTATGCTGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAAAGGTAT AGCAGTGGCTTGTACGACTACGGTATGGACGTCT GGGGCCAAGGGACCACGGTCACCGTCTCCTCA<br>SEQ ID NO: 29225 |
| | | AA | DIQMTQSPSSLSASVGDRVTFTCRASQGIRDDLG WYQQKPGKAPKRLIYAASSLQSGVPSRFSGSRS GREFTLTISSLQPEDFATYYCLQHYSYPRTFGQG TKVEIK<br>SEQ ID NO: 25220 | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCARERYSS GLYDYGMDVWGQGTTVTVSS<br>SEQ ID NO: 29226 |

FIGURE 50
(Continued)

| | | | |
|---|---|---|---|
| iPS:433925 | 21-225_44F3 | NA | GACATCCAGATGACCCAGTCTCCATCTCCGT GTCTGCATCTGTAGGAGACAGAGTCACCATCA CTTGTCGGGCGAGTCAGGGTATTAGCGACTGG TTAGCCTGGTATCAGCAGAAACCAGGGAAAG CCCCTAAGCTCCTGATTTATGTCGCATCCAGT TACAAAGTGGAGTCCCATCAAGGTTCAGCGGC AGTGGATTTGGGACAGATTTCACTCTCACCAT CAGCAGCCTGCAGCCTGAAGATTTTGCAACTT ACTATTGTCAACAGGCTAACAGTTCCCATTC ACTTTCGGCCCTGGGACCAAGTGGATATCAA A | GAGGTGCACCTGTTGGAGTCTGGGGGAGGCTTGG TACAGCCTGGGGGGTCCCTGAGACTCTCCTGTGC AGCCTCTGGATTCACCTTTAGCAGCTATGCCATG AGCTGGGTCCGCCAGGCTCCAGGGAAGGGGCTG GAGTGGGTCTCAATTCTCAGTGGTGGTGGTAAGA CCACATACTACGCAGACTCCGTGAAGGGCCGGTT CACCATCTCCAGAGACAATTCCAAGAACACGCTG TTTCTGCAAATGAACAGCCTGAGAGCCGAGGAC ACGGCCGTATATTACTGTGCGAAACGAACGCCCT CTGATGCTTTTGATATCTGGGGCCAAGGGACAAT GGTCACCGTCTCTCA |
| | | | SEQ ID NO: 25221 | SEQ ID NO: 29227 |
| | | AA | DIQMTQSPSSVSASVGDRVTITCRASQGISDWLA WYQQKPGKAPKLLIYAASSLQSGVPSRFSGSGF GTDFTLTISSLQPEDFATYCQQANSPFTFGPGT KVDIK | EVHLLESGGGLVQPGGSLRLSCAASGFTFSSYAMS WVRQAPGKGLEWVSILSGGGKTTYYADSVKGRFTI SRDNSKNTLFLQMNSLRAEDTAVYYCAKRTPSDAF DIWGQGTMVTVSS |
| | | | SEQ ID NO: 25222 | SEQ ID NO: 29228 |
| iPS:433929 | 21-225_44D5 | NA | GACATCCAGATGACCCAGTCTCCATCTCCCT GTCTGCATCTGTAGGAGACAGAGTCACCATCA CTTGCCGGGCAAGTCAGAGCATTAGAAAAGAT TTAGGCTGGTATCAGCAGAAACCAGGGAAAG CCCCTAAGCGCCCTGATCTATGCTGCATCCACTT TGGAAAGTGGGGTCCCATCAAGGTTCAGCGGC AGTGGATCTGGGACAGCCTGCAGCCTGAAGATTTCACTCTCACAAT CAGCAGCCTGCAGCCTGAAGATTTTGCAACTT ATTACTGTCTACAGCATTATAGTTCCCGTGGA CGTTCGGCCAAGGGACCAAGGTGGAAATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGGCAAGGGGCT GGAGTGGGTGGCAGTTATATGGTATGATGGAAGT AATAAATACTATGCAGAGACTCCGTGAAGGGCCGA TTCACCATCTCCAAATGAACAGCCTGAGAACACGC TGTATCTGCAAATGAACAGCCTGAGAGCCGAGG ACACGGCCGTGTATTACTGTGCGAGAGTCCCGTA TAGCAGCAGCTGGTACGACTACGGTATGGACGTC TGGGGCCAAGGGACCACGGTCACCGTCTCCTCA |
| | | | SEQ ID NO: 25223 | SEQ ID NO: 29229 |

FIGURE 50
(Continued)

| | | | | |
|---|---|---|---|---|
| iPS:433931 | 21-225_44F6 | AA | DIQMTQSPSSLSASVGDRVTITCRASQDIRKDLG WYQQKPGKAPKRLIYAASTLESGVPSRFSGSGS GTEFTLTISSLQPEDFATYYCLQHYSFPWTFGQG TKVEIK<br><br>SEQ ID NO: 25224 | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCARVPYSS SWYDYGMDVWGQGTTVTVSS<br><br>SEQ ID NO: 29230 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTAGTGGAAGC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCTGAAGATTTTGCAG TTTATTACTGTCAGCAGTATGGTAGTTCACCGT GGACGTTCGGCCAAGGGACCAAGGTGGAAAT CAAA<br><br>SEQ ID NO: 25225 | CAGGTGCACCTGCAGGAGTCGGGCCCAGGACTG GTGAAGCCTTCCGGAGACCCGTCCCTCACCTGCA CTGTCTCTGGTGGCTCCATCAGTAGTTACTACTG GAGCTGGATCCGGCAGCCCCCAGGGAAGGGACT GGAGTGGATTGGGTATATCTATTACAGTGGAAAC ACCAACTACAACCCCTCCCTCAAGAGTCGAGTCA CCATATCAGTAGACACGTCCAAGAACCAGTTCTC CCTGAAGCTGAGCTCTGTGACCGCTGCGGACACG GCCGTGTATTACTGTGTGAGAGGGTGGCTATAA AGAACTACTGGGGCCAGGAGAATCCTGGTCACCG TCTCCTCA<br><br>SEQ ID NO: 29231 |
| | | AA | EIVLTQSPGTLSLSPGERATLSCRASQSVSGSYLA WYQQKPGQAPRLLIYGASSRATGIPDRFSGSGSG TDFTLTISRLEPEDFAVYYCQQYGSSPWTFGQGT KVEIK<br><br>SEQ ID NO: 25226 | QVHLQESGPGLVKPSETLSLTCTVSGGSISSYYWSW IRQPPGKGLEWIGYIYYSGNTNYNPSLKSRVTISVD TSKNQFSLKLSSVTAADTAVYYCVRGVAIKNYWG QGHLVTVSS<br><br>SEQ ID NO: 29232 |

FIGURE 50
(Continued)

| | | | | |
|---|---|---|---|---|
| iPS:433933 | 21-225_44C8 | NA | GACATCCAGATGACCCAGTCTCCATCCTCCCT GTCTGCATCTGTAGGAGACAGAGTCACCATCA CTTGCCGGGCAAGTCAGGGACATTAGAAATGAT TTAGGCTGGTATCAGCAGAAACCAGGAAAG CCCCTAAGCGCCTGATCTATGCTGCATCCAAT TTGCAAAGTGGGGTCCCATCAAGGTTCAGCGG CAGTAGATCTGGGACAGATTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A SEQ ID NO: 25227 | CAGGTGCAGCTGGTGGAGTCTGGGGGAGGCGTG GTCCAGCCTGGAGGTCCCTGAGACTCTCCTGTG CAGCCTCTGGATTCACCTTCAATAACTATGGCAT GCACTGGGTCCGCCAGGCTCCAGGCAAGGGCT GGAGTGGGTGGCAGTTATATGCAGACTCCGTGAAGGGCCG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGTGAGAGAACTGG GGTTCCTCTCGACTACTGGGGCCAGGGAACCCT GGTCACCGTCTCCTCA SEQ ID NO: 29233 |
| | | AA | DIQMTQSPSSLSASVGDRVTITCRASQGIRNDLG WYQQKPGKAPKRLIYAASNLQSGVPSRFSGSRS GTEFTLTISSLQPEDFATYYCLQHNSYPFTFGPGT KVDIK SEQ ID NO: 25228 | QVQLVESGGGVVQPGRSLRLSCAASGFTFNNYGM HWVRQAPGKGLEWVAVIWYEGSNKYYADSVKGR FTISRDNSKNTLYLQMNSLRAEDTAVYYCVRELGF LSDYWGQGTLVTVSS SEQ ID NO: 29234 |
| iPS:433935 | 21-225_44F9 | NA | GACGTCCAGATGACCCAGTCTCCATCCTCCCT GTCTGCATCTGTAGGAGACAGAGTCACCATCA CTTGCCGGGCAAGTCAGGGACATTAGAAATGAT TTAGGCTGGTATCAGCAGAAACCAGGAAAG CCCCTAAGCGCCTCATCTATGCTGCATCCAGTT TGCAAAGTGGGGTCCCATCAAGGTTCAGCGGC AGTGGATCTGGGACAGAATTCACTCTCACAT CAGCAGCCTGCAGCCTGAAGATTTTGCAACTT ATTACTGTCTCCACCATTATAATTACCCTCGGA CGTTCGGCCAAGGGACCAAGGTGGAAATCAC A SEQ ID NO: 25229 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGTCAT GCACTGGGTCCGCCAGGCTCCAGGCAAGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACCATA TAGCAGCAGCTGGTACGACTACGGTATGACGTC GGGGGCCAAGGGACCACGGTCACCGTCTCCTCA SEQ ID NO: 29235 |

FIGURE 50
(Continued)

| | | | | |
|---|---|---|---|---|
| iPS:433937 | 21-225_44B10 | AA | DVQMTQSPSSLSASVGDRVTITCRASQGIRNDLG WYQQKPGKAPKRLIYAASSLQSGVPSRFSGSGS GTEFTLTISSLQPEDFATYYCLHHYNYPRTFGQG TKVEIT<br><br>SEQ ID NO: 25230 | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCAREPYSS SWYDYGMDVGGQGTTVTVSS<br><br>SEQ ID NO: 29236 |
| | | NA | CATATTGTGATGACCCAGAGCTCCACTCTCTCTG TCCGTCACCCCTGGACAGCCGGCCTCCATCTC CTGCAAGTCTAGTCAGAGCCTCCTGCATAGTG AGGGAAGGACCTATTTGTATTGGTACCTGCAG AAGCCAGGCCAGCTCCACAGCTCCTGATCTA TGAAATTTCCACCGGTTCTCTGGAGTGCCAG ATAGATTCAGTGGCAGCGGGTCAGGGACAGA TTTCACACTGAAAATCAGCCGGGTGGAGGCTG AGGATGTTGGGGTTTATTACTGCTTACTACTTTCGGCGGAGGGAC CAAGGTGGAGATCAAA<br><br>SEQ ID NO: 25231 | CAGGTGCAGTTGGTGGAGTCTGGGGGAGGCGTG GTCCAGCCTGGGAGGTCCCTGAGACTCTCCTGTG TAGCGTCTGGAATTCACCTTCAGTAGCTATGGCAT GCACTGGGTCCGCCAGGCTCCAGGCAAGGGGCT GGAGTGGGTGGCAGTTATATGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTATTGTGCGAGGCGGTATAG CAGCAGCTGGGTGGGGGTATGGAGACGTCTGGGG CCAAGGGACCACGGTCACCGTCTCCTCA<br><br>SEQ ID NO: 29237 |
| | | AA | HIVMTQTPLSLSVTPGQPASISCKSSQSLLHSEGR TYLYWYLQKPGQPPQLLIYEISHRFSGVPDRFSG SGSGTDFTLKISRVEAEDVGVYYCMQSIHLPFTF GGGTKVEIK<br><br>SEQ ID NO: 25232 | QVQLVESGGGVVQPGRSLRLSCVASGFTFSSYGMH WVRQAPGKGLEWVAVIWYDGSNKYYADSVKGRF TISRDNSKNTLYLQMNSLRAEDTAVYYCARRYSSS WVGGMDVWGQGTTVTVSS<br><br>SEQ ID NO: 29238 |

FIGURE 50
(Continued)

| | | | |
|---|---|---|---|
| iPS:433939 | 21-225_44C10 | NA | GACATCCAGATGACCCAGTCTCCATCTCCCT GTCTGCATCTGTAGGAGACAGAGTCACCTTCA CTTGCCGGGCAAGTCAGGGCATTAGAGATGAT TTAGGCTGGTATCAGCAGAAACCAGGGAAAG CCCCTAAGCGCCTGATCTATYGCTACATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAATCA AA SEQ ID NO: 25233 |
| | | AA | DIQMTQSPSSLSASVGDRVTFTCRASQGIRDDLG WYQQKPGKAPKRLIYATSSLQSGVPSRFSGSGSG TEFTLTISSLQPEDFATYYCLQHYSYPRTFGQGT KVEIK SEQ ID NO: 25234 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTGTGTCAT GCACTGGGTCCGCCAGGCTCCAGGCAAGGGGCT GGAGTGGGTGGCAGTTATATGGTATGATGGAAGT AATAAATACTATGCTGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAAAGGTAT AGCAGTGGCTTGTACGACTACGGTATGGACGTCT GGGGCCAAGGGACCACGGTCACCGTCTCCTCA SEQ ID NO: 29239 |
| iPS:433941 | 21-225_44D10 | NA | GACATCCAGATGACCCAGTCTCCATCTCCCGT GTCTGCATCTGTAGGAGACAGAGTCACCATCA CTTGTCGGGCGAGTCAGGGTATTAGCAGCTGG TTAGCCTGGTATCAACAGAAACCAGGGAAAG CCCCTAAGGCTCCTGATCTATGCTGCATCCAGTT TGCAAAGTGGGGTCCCATCAAATTCAGCGGC AGTGGATCTGGGACAGATTTCACTCTCACCAT CAGCAACCTGCAGCCTGAAGATTTTGCAACTT ACTATTGTCAACAGACTAACAGTTTCCCGTGG ACGTTCGGCCAAGGGACCAAGGTGGAAATCA AA SEQ ID NO: 25235 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTAGTGGTGGTGTT AACACATTCGACGACGAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAGGAAAGGA GTGGGAGCTATTTGACTACTGGGGCCAGGGAAC CCTGGTCACCGTCTCCTCA SEQ ID NO: 29241 |
| | | AA | | QVQLVESGGGVVQPGRSLRLSCAASGFTFSDCVMH WVRQAPGKGLEWVAVIWYDGSNKYYADSVKGRF TISRDNSKNTLYLQMNSLRAEDTAVYYCARERYSS GLYDYGMDVWGQGTTVTVSS SEQ ID NO: 29240 |

FIGURE 50
(Continued)

| | | | | |
|---|---|---|---|---|
| | | AA | DIQMTQSPSSVSASVGDRVTITCRASQGISDWLA WYQQKPGKAPRLLIYAASSLQSGVPSKFSGSGS GTDFTLTISNLQPEDFATYYCQQTNSFPWTFGQG TKVEIK<br>SEQ ID NO: 25236 | EVQLLESGGGLVQPGGSLRLSCAASGFTFSSYAMS WVRQAPGKGLEWVSAISGRGVNTFDADSVKGRFTI SRDNSKNTLYLQMNSLRAEDTAVYYCAKERSGSY FDYWGQGTLVTVSS<br>SEQ ID NO: 29242 |
| iPS:433943 | 21-225_44E10 | NA | GATATTGTGATGACTCAGTCTCCACTCTCCCTG CCCGTCACCCCTGGAGAGCCGGCCTCCATCTC CTGCAGGTCTAGTCAGAGCCTCCTGCATAGTA ATGGATACAGCTATTTGGAGTGGTACCTGCAG AAGCCAGGACAGTCTCCACAACTCCTGATCTA TTTGGGTTCTAATCGGGCCTCCGGGGTCCCTG ACAGGTTCAGTGGCAGTGGATCAGGCACAGAT TTTACACTGAAAATCAGCAGTAGAGGCTGA GGATGTTGGGGTTTATTACTGCATGCAAACTC TACAAACTCCATTCACTTTCGGCCCTGGGACC AAAGTGGATATCAAA<br>SEQ ID NO: 25237 | GAGGTGCAGCTGTTGGAGTCTGGGGAGGCTTG GTACAGTCTGGAGGGTCCTGAGACTCTCCTGTG CAGCCCTCTGGATTCACCTTTAGCAGCTATGCCAT GAACTGGGTCCGCCAGGCTCCAGGGAAGGGGCT GGAGTGGGTCTCAGGTGTTGGTAGTGGTGGT AGAACATACTACGCAGACTCCGTGAAGGGCCGG TTCATCATCTCCAGAGACAATTCCAAGAACACGC TGTATCTGCAAATGAACAGCCTGAGAGCCGAGG ACACGGCCGTATATTACTGTGCGAAAGATCGGG GCCAGTGGCTCCTAGGCGTATGGACGTCTGGG GCCAAGGGACCACGGTCACCGTCTCCTCA<br>SEQ ID NO: 29243 |
| | | AA | DIVMTQSPLSLPVTPGEPASISCRSSQSLLHSNGY SYLEWYLQKPGQSPQLLIYLGSNRASGVPDRFSG SGSGTDFTLKISRVEAEDVGVYYCMQTLQTPFTF GPGTKVDIK<br>SEQ ID NO: 25238 | EVQLLESGGGLVQSGGSLRLSCAASGFTFSSYAMN WVRQAPGKGLEWVSGVVGSGGRTYADSVKGRFI ISRDNSKNTLYLQMNSLRAEDTAVYYCAKDRGQW LLGGMDVWGQGTTVTVSS<br>SEQ ID NO: 29244 |

FIGURE 50
(Continued)

| | | | |
|---|---|---|---|
| iPS:433945 | 21-225_44C12 | NA | GACATCCAGATGACCCAGTCTCCATCTTCCGT GTCTGCATCTGTAGGAGACAGAGTCACCATCA CTTGTCGGGCGAGTCAGGGTATTAGCAACTGG TTAGCCTGGTATCAGCAGAAACCAGGGAAAG CCCCTAAGCTCCTGATCTCTGCTGCATTCAGTT TGCAAAGTGGGGTCCATCAAGGTTCAGCGGC AGTGGATCTGGGACAGATTTCACTCTCAGCAT CAGCAGCCTGCAGCCTGAAGATTTTGCAACTT ACTATTGTCAACAGTCTAACAGTTTCCGTGG ACGTTCGGCCAAGGGACCAAGGTGGAAATCA AA | GAGGTGCAGCTGGTGGAGTCTGGGGGAGGCTTG GTACAGCCTGGGGGGTCCCTGAGACTCTCCTGTG CAGCCTCTGGATTCACCTTCAGTAGCTATAGCGT GAACTGGGTCCGCCAGGCTCCAGGGAAGGGCT GGAGTGGGTTTCATACATTAGTAGTAGTAGTAGT ACCATATACTACGCAGACTCTGTGAAGGGCCGAT TCACCATCTCCAGAGACAATGCCAAGAACTCACT GTATCTGCAAATGAACAGCCTGAGACGACGAGGA CACGGCTGTGTATTACTGTGCGAGAAGTGGATAC AGCTATGCTTACTACTACTACGGTATGGACG TCTGGGGCCAAGGGACCACGGTCACCGTCTCCTC A |
| | | | SEQ ID NO: 25239 | SEQ ID NO: 29245 |
| | | AA | DIQMTQSPSSVSASVGDRVTITCRASQGISNWLA WYQQKPGKAPKLLISAAFSLQSGVPSRFSGSGSG TDFTLSISSLQPEDFATYYCQQSNSFPWTFGQGT KVEIK | EVQLVESGGGLVQPGGSLRLSCAASGFTFSSYSVN WVRQAPGKGLEWVSYISSSSTYYADSVKGRFTIS RDNAKNSLYLQMNSLRDEDTAVYYCARSGYSYAY YYYYGMDVWGQGTTVTVSS |
| | | | SEQ ID NO: 25240 | SEQ ID NO: 29246 |
| iPS:433947 | 21-225_44E12 | NA | GACATCCAGATGACCCAGTCTCCATCTCCCT GTCTGCATCTGTAGGAGACAGAGTCACCATCA CTTGCCGGACAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAACATATAGTTACCCGCTC ACTTTCGGCGGAGGGACCAAGGTGGAGATCA AA | CAGGTGCACCTGGCGGAGTCTGGGGGAGGCGTG GTCCAGCCTGGGGAGGTCCCTGAGACTCTCCTGTG AAGCGTCTGGATTCACCCTCAGTAGCGATGACAC GCACTGGGTCCGCCAGCCTCCAGGCAAGGGGCT GGAGTGGGTGGCAGTTATATGCAGACTCCGTGAAGGGCCGA AATAAATACTATGCAGACTCCGTGAAGGGCCGA TTCACCATCTCCAGAGACAATTCCAAGAACACGC TGTATCTGCAAATGAACAGCCTGAGAGCCGAGG ACGGGCTGTGTATTACTGTGCGAGAGATCTAAT AGCAGCAGCTGGGACGGGAGACTACTGGGGCCA GGGAACCCTGGTCACCGTCTCCTCA |
| | | | SEQ ID NO: 25241 | SEQ ID NO: 29247 |

FIGURE 50
(Continued)

| | | | | |
|---|---|---|---|---|
| iPS:433949 | 21-225_45H2 | AA | DIQMTQSPSSLSASVGDRVTITCRTSQGIRNDLG WYQQKPGKAPKRLIYAASSLQSGVPSRFSGSGS GTEFTLTISSLQPEDFATYYCLQHNSYPLTFGGG TKVEIK<br>SEQ ID NO: 25242 | QVHLAESGGGVVQPGRSLRLSCEASGFTLSSDDTH WVRQPPGKGLEWVAVIWFDEYNKYYADSVKGRF TISRDNSKNTLYLQMNSLRAEDAAVYYCARDLIAA AGTGDYWGQGTLVTVSS<br>SEQ ID NO: 29248 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAAT TTGCAAAGTGGGGTCCCATCAAGGTTCAGCGG CAGTGGATCTGGGACAGAATTCACTCTCACAG TCAGCAGCCTGCAGCCTGAAGATTTTGCAACT TATTTCTGTCTACAGCATATCAGTTTCCCATTC ACTTTCGGCCCTGGGACCAAAGTGGATATCAA A<br>SEQ ID NO: 25243 | CAGGTGCAGCTGGTGGAGTCTGGGGGAGGCTTG GTCAAGCCTGGAGGGTCCCTGAGACTCTCCTGTG CAGCCTCTGGATTCACCTTTAGTGACTACTACAT GAACTGGATCCGCCAGGCTCCAGGGAAGGGGCT GGAGTGGGTTTCATACATTAGTAGTAGTGGTATT ACCAAATACTACGCAGACTCTGTGAAGGGCCGA TTCACCATCTCCAGGGACACAACGCCAAGAACTCAC TGTATCTGCAAATGAACAGCCTGAGAGCCGAGG ACACGGCCGTGTATTACTGTGCGCGCGATACAAT CTACTGGGGCCAGGGAACCCTGGTCACCGTCTCC TCA<br>SEQ ID NO: 29249 |
| | | AA | DIQMTQSPSSLSASVGDRVTITCRASQGIRNDLG WYQQKPGKAPKRLIYGASNLQSGVPSRFSGSGS GTEFTLTVSSLQPEDFATYFCLQHTSFPFTFGPGT KVDIK<br>SEQ ID NO: 25244 | QVQLVESGGGLVKPGGSLRLSCAASGFTFSDYYMN WIRQAPGKGLEWVSYISSSGITKYYADSVKGRFTIS RDNAKNSLYLQMNSLRAEDTAVYYCAADTIYWGQ GTLVTVSS<br>SEQ ID NO: 29250 |

FIGURE 50
(Continued)

| | | | |
|---|---|---|---|
| iPS:433951 | 21-225_45B4 | NA | GACATCCAGATGACCCAGTCTCCATCCTCCCT GTCTGCATCTGTAGGAGACAGAGTCACCTTCA CTTGCCGGGCAAGTCAGGGCATTAGAGATGAT TTAGGCTGGTATCAACAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCTGAAGATTTTGCAACT TATTACTGTCTACAGCATTATAGTTACCCTCGG ACGTTCGGCCAAGGGACCAAGGTGGAAATCA AA<br><br>SEQ ID NO: 25245 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTGTGTCAT GCACTGGGTCCGCCAGGCTCCAGGCAAGGGGCT GGAGTGGGTGGCAGTTATATGTACTCCGTGAAGGGCCGAT AATAAATACTATGTGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAAGGTAT AGCAGTGGCTTGTACGACTACGGTATGGACGTCT GGGGCCAAGGGACCACGGTCACCGTCTCCTCA<br><br>SEQ ID NO: 29251 |
| | | AA | DIQMTQSPSSLSASVGDRVTFTCRASQGIRDDLG WYQQKPGKAPKRLIYAASSLQSGVPSRFSGSGS GTEFTLTISSLQPEDFATYYCLQHYSYPRTFGQG TKVEIK<br><br>SEQ ID NO: 25246 | QVQLVESGGGVVQPGRSLRLSCAASGFTFSDCVMH WVRQAPGKGLEWVAVIWYDGSNKYYADSVKGRF TISRDNSKNTLYLQMNSLRAEDTAVYYCARERYSS GLYDYGMDVWGQGTTVTVSS<br><br>SEQ ID NO: 29252 |
| iPS:433953 | 21-225_45H4 | NA | GACATCCAGATGACCCAGTCTCCATCTTCCGT GTCTGCATCTGTAGGAGACAGAGTCACCATCA CTTGTCGGGCGAGTCAGGATATTAGCAGCTGG TTAGCCTGGTATCAGAAGAAACCAGGGAAAG CCCCTAAGTACCTGATCTATGATGCATCCAGT TTGCAAAGTGGGGTCCCATCAAGGTTCAGCGG CAGTGGATCTGGGACAGATTTCATTCTCACCA TCAGCAGCCTGCAGCCTGAAGATTTTGCAATT TACTTTTGTCAACAGGCTAACAGTCTCCCTTTC ACTTTCGGCCCTGGGACCAAAGTGGATATCAA A<br><br>SEQ ID NO: 25247 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGTTGGGTCCGCCAGGCTCCAGGGATGGGGCT GGAGTGGGTCTCAGCTATTAGTGGTAGTGGTAGT AACACATTCTACGCAGACTCCGTGAAGGGCCGGT TCACCATCTCCAGAGACAATTCCAAGAGCCGAGGA GTATCTGCACATGAACAGCCTGAGAAACGAACGCC CACTGCCGTATATTTCTGTGCGAAACGAACGCCC TCTGATGTTTTGATATCGGGGCCAAGGGACAA TGGTCACCGTCTCTTCA<br><br>SEQ ID NO: 29253 |

FIGURE 50
(Continued)

| | | | | |
|---|---|---|---|---|
| | | AA | DIQMTQSPSSVSASVGDRVTITCRASQDISSWLA WYQQKPGKAPKYLIYDASSLQSGVPSRFSGSGS GTDFILTISSLQPEDFAIYFCQQANSLPFTFGPGTK VDIK<br>SEQ ID NO: 25248 | EVQLLESGGGLVQPGGSLRLSCAASGFTFSSYAMS WVRQAPGMGLEWVSAISGSGSNTFYADSVKGRFTI SRDNSKNTLYLHMNSLRAEDTAVYFCAKRTPSDVF DIWGQGTMVTVSS<br>SEQ ID NO: 29254 |
| iPS:433955 | 21-225_45B8 | NA | GACATCCAGATGACCCAGTCTCCATCCTCCCT GTCTGCATCTGTAGGAGACAGAGTCACCTTCA CTTGCCGGGCAAGTCAGGACATTAGAGATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGCCTGAAGATTTGCAACT TCAGCAGCTGCAGCCTGAAGATTTTGCAACT TATTACTGTCTACAGCATTATAATTACCCTCGG ACGTTCGGCCAAGGGACCAAGGTGGAAATCA AA<br>SEQ ID NO: 25249 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTGTGTCAT GCACTGGGTCCGCCAGGCTCCAGGCAAGGGCT GGAGTGGGTGGCAGTTATATGGTATGATGGAAGT AATAAATACTATGCTGACTCCGTGAAGGGCGAT TCACCATCTCCAGAGACAATTCCAAGAACACGCT GTATCTGCAAATGAACAGCCTGAGAGCCGAGGA CACGGCTGTGTATTACTGTACGACTACGGTATGAT AGCAGGTGGCTTGTACGACTACGGTATGGACGTCT GGGGCCAAGGGACCACGGTCACCGTCTCCTCA<br>SEQ ID NO: 29255 |
| | | AA | DIQMTQSPSSLSASVGDRVTFTCRASQDIRDDLG WYQQKPGKAPKRLIYAASSLQSGVPSRFSGSGS GTEFTLTISSLQPEDFATYYCLQHYNYPRTFGQG TKVEIK<br>SEQ ID NO: 25250 | QVQLVESGGGVVQPGRSLRLSCAASGFTFSDCVMH WVRQAPGKGLEWVAVIWYDGSNKYYADSVKGRF TISRDNSKNTLYLQMNSLRAEDTAVYYCARERYSS GLYDYGMDVWGQGTTVTVSS<br>SEQ ID NO: 29256 |

FIGURE 50
(Continued)

| | | | | |
|---|---|---|---|---|
| iPS:433957 | 21-225_45F8 | NA | GACATCCAGATGACCCAGTCTCCATCTTCCGT GTCTGCATCTGTAGGAGACAGAGTCACCATCA CTTGTCGGGCGAGTCAGGGTATTAGCGACTGG TTAGCCTGGTATCAGCAGAAACCAGGGAAAG CCCCTAGGCTCCCTGATCTATGGTGCATCCAGTT TGCAAAGTGGGGTCCCATCAAGGTTCAGCGGC AGTGGATCTGGGACAGATTTCACTCTCACCAT CAGCAACCTGCAGCCTGAAGATTTTGCAACTT ACTATTGTCAACAGAGCTAACAGTTTCCCGTGG ACGTTCGGCCAAGGGACCAAGGTGGAAATCA AA SEQ ID NO: 25251 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGTTGGGTCCGCCAGGCTCCAGGGAAGGGGCT GGAGTGGGTCTCAGCTATTAGTGGTCGTGGTGTT AACACATTCGACGCAGACTCCGTGAAGGGCCGG TTCACCATATCCAGAGACAATTCCAAGAACACGC TGTATCTGCAAATGAACAGCCTGAGAGCCGAGG ACACGGCCGTATATTACTGTGCGAAGGAAAGGA GTGGGAGCTATTTGACTACTGGGGCCAGGGAAC CCTGGTCACCGTCTCCTCA SEQ ID NO: 29257 |
| | | AA | DIQMTQSPSSVSASVGDRVTITCRASQGISDWLA WYQQKPGKAPRLLIYGASSLQSGVPSRFSGSGSG TDFTLTISNLQPEDFATYYCQQINSFPWTFGQGT KVEIK SEQ ID NO: 25252 | EVQLLESGGGLVQPGGSLRLSCAASGFTFSSYAMS WVRQAPGKGLEWVSAISGRGVNTFDADSVKGRFTI SRDNSKNTLYLQMNSLRAEDTAVYYCAKERSGSY FDYWGQGTLVTVSS SEQ ID NO: 29258 |
| iPS:433959 | 21-225_45C9 | NA | GACATCCAGATGACCCAGTCTCCATCTTCCGT GTCTGTTTCTGGGCAGTCAGGAGTCACCATCA CTTGTCGGGCGAGTCAGGATATTAGCGACTGG TTAGCTTGGTATCAGCAGAGACCAGGGAAAGC CCCTAAGCTCCTTGATCTATGCTGCATCCAGTT GGAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A SEQ ID NO: 25253 | GAGGTGCAGCTGTTGGAGTCTGGGGGAGGCTTG GTACAGCCTGGGGGGTCCCTGAGACTCTCCTGTG CAGCCTCTGGATTCACCTTTAACAGCTATGCCAT GAGCTGGGTCCGCCAGGCTCCAGGGAAGGGGCT GGAGTGGGTCTCAGTTATTAGTGGTCGTGGTGGT ACCACATACTACGCAGACTCCGTGAAGGGCCGG TTCACCATCCGAGAGACAATTCCAAGAACACGC TGTATCTGCAAATGAACAGCCTGAGAGCCGAGG ACACGGCCGTATATTACTGTGCGAAACGAACGCC CTCTGATGCTTTTGATATCTGGGGCCAAGGACA ATGGTCACCGTCTCTTCA SEQ ID NO: 29259 |

FIGURE 50
(Continued)

| | | | | |
|---|---|---|---|---|
| iPS:433961 | 21-225_45D9 | AA | DIQMTQSPSSVSVSVGDRVTITCRASQDISDWLAWYQQRPGKAPKLLIYAASSLESGVPSRFSGSGSGTDFTLTISSLQPEDFATYYCQQANSFPFTFGPGTKVDIK<br>SEQ ID NO: 25254 | EVQLLESGGGLVQPGGSLRLSCAASGFTFNSYAMSWVRQAPGKGLEWVSVISGRGGTTYYADSVKGRFTISRDNSKNTLYLQMNSLRAEDTAVYYCAKRTPSDAFDIWGQGTMVTVSS<br>SEQ ID NO: 29260 |
| | | NA | GAGGTGCAGCTGGTGGAGTCTGGGGGAGGCCTGGTCAAGCCGGGGGGGTCCCTGAGACTCTCCTGTGCAGCCTCTGGATTCACCTTCAGTAGCTATACCATGAACTGGGTCCGCCAGGTTCCAGGGAAGGGCTGGAGTGGGTCTCATCATTAGTGGAAGTAGTACTTACATATACTACGCAGACTCAGTGAAGGGCCGATTCACCATCTCCAGAGACGACAGCCCAGAACTCACTGTATCTGCAAATGAACAGCCTGAGAGGCGAGGACACGGCTGTGTATTACTGTGCGAGGGTGACCTCTTTTGACTACTGGGGCCAGGGAGCCCTGGTCACCGTCTCCTCA<br>SEQ ID NO: 29261 | GACATCCAGATGACCCAGTCTCCATCCTCACTGTCTGCATCTGTAGGAGACAGAGTCACCATCACTTGTCGGGCGAGTCAGGGCATTAACAATTATTTAGCCTGGTTTCAGCAGAAACCAGGGAAAGCCCCTAAGTCCCTGATCAATGCTGCATCCAGTTTGCAAAGTGGGGTCCCATCAAGGTTCAGCGGCAGTGGATCTGGGACAGATTTCACTCTCGCCATCAGCAGCCTACAGCCTGAACACTATTACTGCCAACACTATTATTAGTTACCCATTCACTTTCGGCCCTGGGACCAAAGTGGATATCAAA<br>SEQ ID NO: 25255 | |
| | | AA | DIQMTQSPSSLSASVGDRVTITCRASQGINNYLAWFQQKPGKAPKSLINAASSLQSGVPSRFSGSGSGTDFTLAISSLQPEDFATYYCQHYYSYPFTFGRGTKVDIK<br>SEQ ID NO: 25256 | EVQLVESGGGLVKPGGSLRLSCAASGFTFSSYTMNWVRQVPGKGLEWVSSISGSSTYIYADSVKGRFTISRDDAQNSLYLQMNSLRGEDTAVYYCARVISFDYWGQGALVTVSS<br>SEQ ID NO: 29262 |

FIGURE 50
(Continued)

| | | | |
|---|---|---|---|
| iPS:433963 | 21-225_46B1 | NA | GACATCCAGATGACCCAGTCTCCATCCTCCT<br>GTCTGCATCTGTAGGAGACAGAGTCACCATCA<br>CTTGCCGGGCAAGTCAGGGCATTAGAAATGAT<br>TTAGGCTGGTATCAGCAGAAACCAGGGAAAG<br>CCCCTAAGCGCCTGATCTATGCTGCATCCAGT<br>TTGCAAGGTGGGGTCCCATCAAGGTTCAGCGG<br>CAGTGGATCTGGGACAGAATTCACTCTCACAA<br>TCAGCAGCCTGCAGCCTGAAGATTTTGCAACT<br>TATTACTGTCTACAGCATAATAGTTACCCGCTC<br>ACTTTCGGCGGAGGGACCAAGGTGGAGATCA<br>AA | CAGGTGCACCTGGCGGAGTCTGGGGGAGGCGTG<br>GTCCAGCCTGGGAGGTCCCTGAGACTCTCCTGTG<br>AAGCGTCTGGATTCACCCTCAGTAGCGATGACTC<br>GCACTGGGTCCGCCAGCCTCCAGGCAAGGGCT<br>GGAGTGGGTGGCAGTTATATGTTTGATGAATAT<br>ACTAAATACTATGCAGACTCCGTGAAGGGCCGAT<br>TCACCATCTCCAGAGACAATTCCAAGAACACGCT<br>GTATCTGCAAATGAACAACCTGAGAGCCGAGA<br>CGCGGCTGTGTATTACTGTGCGAGAGATCTAATA<br>GCAGCAACTGGGACGGGAGACTACTGGGGCCAG<br>GGAACCCTGGTCACCGTCTCCTCA |
| | | | SEQ ID NO: 25257 | SEQ ID NO: 29263 |
| | | AA | DIQMTQSPSSLSASVGDRVTITCRASQGIRNDLG<br>WYQQKPGKAPKRLIYAASSLQGGVPSRFSGSGS<br>GTEFTLTISSLQPEDFATYYCLQHNSYPLTFGGG<br>TKVEIK | QVHLAESGGGVVQPGRSLRLSCEASGFTLSSDDSH<br>WVRQPPGKGLEWVAVIWFDEYTKYYADSVKGRFT<br>ISRDNSKNTLYLQMNNLRAEDAAVYYCARDLIAAT<br>GTGDYWGQGTLVTVSS |
| | | | SEQ ID NO: 25258 | SEQ ID NO: 29264 |
| iPS:433965 | 21-225_46F2 | NA | GATATCGTGATGACCCAGACTCCACTCTCTCT<br>GACCGTCACCCCTGGACAGCCGGCCTCCATCT<br>CCTGCAAGTCTAGTCAGAGCCTCCTGCATGGT<br>GATGGAAAGACATATTTGTATTGGTACCTGCA<br>GAAGCCAGGCCAGTCCACAGGTCCTGATCT<br>ATGAAGTTTCCAATCGGTTCTCTGAGTGCCA<br>GATAGGTTCAGTGGCAGCGGGTCAGGGACAG<br>ATTTCACACTGAAACTCAGCGGGTCGGAGGCT<br>GAGGATGTTGGGGTTTATTACTGCATGCAAAG<br>TATACAGCTTCCGTGACGTTCGGCCAAGGGA<br>CCAAGGTGGAAATCAAA | CAGGTGCAGCTGGTGGTGAGTCTGGGGGAGGCGTG<br>GTCCAGCCTGGGAGGTCCCTGAGACTCTCCTGTG<br>CAGCGTCTGGATTCACCTTCAGTAGCAGTATGGCAT<br>GCACTGGGTCCGCCAGGCTCCAGGCAAGGGGCT<br>GGAGTGGGTGGCAATTATATGTATGATGAAGT<br>AATAAATACTATGCAGACTCCGTGAAGGGCCGAT<br>TCACCATCTCCAGAGACAATTCCAAGAACACGCT<br>GTATCTGCAAATGAACAGCCTGAGAGCCGAGGA<br>CGCGGCTGTGTATTACTGTGCGAGAGATCGATAC<br>GATTTTGGAGTGGTTACTTTGACTACTGGGGCC<br>AGGGAACCCTGGTCACCGTCTCTCA |
| | | | SEQ ID NO: 25259 | SEQ ID NO: 29265 |

FIGURE 50
(Continued)

| | | | | |
|---|---|---|---|---|
| | | AA | DIVMTQTPLSLTVTPGQPASISCKSSQSLLHGDG KTYLYWYLQKPGQPPQVLIYEVSNRFSGVPDRF SGSGSGTDFTLKLSRVEAEDVGVYYCMQSIQLP WTFGQGTKVEIK<br>SEQ ID NO: 25260 | QVQLVESGGGVVQPGRSLRLSCAASGFTFSSYGMH WVRQAPGKGLEWVAIIWYDGSNKYYVDSVKGRFT ISRDNSKNTLYLQMNSLRAEDTAVYYCARDRYDF WSGYFDYWGQGTLVTVSS<br>SEQ ID NO: 29266 |
| iPS:433967 | 21-225_46C3 | NA | GACATCCAGATGACCCAGTCTCCATCCTCCCT GTCTGCATCTGTAGGAGACAGAGTCACCTTCA CTTGCCGGGCAAGTCAGGGCATTAGAGATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTAGATCTGGGACAGAATTCACTCTCACAA TCAGCAGCCTGCAACTGAAGATTTTGCAACT TATTACTGTCTACAGCATTATAGTTACCCTCGG ACGTTCGGCCAAGGGACCAAGGTGGAAATCA AA<br>SEQ ID NO: 25261 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGGCAAGGGCT GGAGTGGGTGGCAGTTATATGGTATGATGAAGT AATAAATACTATGCTGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAAAGGTAT AGCAGTGGCTGTGACGACTACGGTATGGACGTCT GGGGCCAAGGGACCACGGTCACCGTCTCCTCA<br>SEQ ID NO: 29267 |
| | | AA | DIQMTQSPSSLSASVGDRVTFTCRASQGIRDDLG WYQQKPGKAPKRLIYAASSLQSGVPSRFSGSRS GTEFTLTISSLQPEDFATYCLQHYSYPRTFGQG TKVEIK<br>SEQ ID NO: 25262 | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCARERYSS GLYDYGMDVWGQGTTVTSS<br>SEQ ID NO: 29268 |

FIGURE 50
(Continued)

| | | | | |
|---|---|---|---|---|
| iPS:433969 | 21-225_46F3 | NA | GACATCCAGATGACCCAGTCTCCATCCTCCCT GTCTGCATCTGTAGGAGACAGAGTCACCATCA CTTGCCGGGCAAGTCAGGGACATTAGAAAAGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCAGTCTCACAA TCAGCAGCCTGCAGCCTGAAGATTTTGCAACT TATTACTGTCTACAGCATAATAGTTACCCTCTC ACTTTCGGCGGAGGGACCAAGGTGGAGATCA AG SEQ ID NO: 25263 | CAGGTGCAGCTGGTGGAGTCTGGGGGAGGCGTG GTCCAGCCTGGGAGGTCCCTGAGACTCTCCTGTG CAGGGTCTGGATTCACCTTCAGTGATTATGGCAT GCACTGGGTCCGCCAGGCTCCAGGCAAGGGCT GGAGTGGGTGGCAGTTATATGGTTTGAAGGAAGT AATAAATACTATGCAGATTCCGTGAAGGGCCGAT TCACCATCTCCAGAGACAATTCCAAGAACACGCT GTATGTGCAAATGAACAGCCTGAGAGCCGAGGA CACGGCTGTGTATTACTGTGTGAGAGAACTAGGA TTTTCCAATGACTACTGGGGCCAGGGAACCCTGG TCACCGTCTCCTCA SEQ ID NO: 29269 |
| | | AA | DIQMTQSPSSLSASVGDRVTITCRASQGIRKDLG WYQQKPGKAPKRLIYAASSLQSGVPSRFSGSGS GTEFSLTISSLQPEDFATYYCLQHNSYPLTFGGGT KVEIK SEQ ID NO: 25264 | QVQLVESGGGVVQPGRSLRLSCAASGFTFSDYGM HWVRQAPGKGLEWVAVIWFEGSNKYYADSVKGR FTISRDNSKNTLYVQMNSLRAEDTAVYYCVRELGF SNDYWGQGTLVTVSS SEQ ID NO: 29270 |
| iPS:433971 | 21-225_46D4 | NA | GACATCCAGATGACCCAGTCTCCATCCTCCCCT GTCTGCATCTGTAGGAGACAGAGTCACCATCA CTTGCCGGACAAGTCAGGACATTAGAAAAGAT TTAGGCTGGTATCAGCAGAAAGTAGGGAAAG CCCCTAAGCGCCTGATCTATGCTGCATCCAGT TTGGAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTCCCGTGG ACGTTCGGCCAAGGGACCAAGGTGGAAATCA AA SEQ ID NO: 25265 | CAGGTGCAGCTGGTGGAGTCTGGGGGAGGCGTA GTCCAGCCTGGGAGTCCCTGAGACTCTCCTGTG CAGCGTCTGGATTCACCTTCAGTAGCTATGTCAT GCACTGGGTCCGCCAGGCTCCAGGCAAGGGCT GGAGTGGGTGGCAGTTATATGGTATGATGAAGT AATAAATACTATGCAGACTCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGTCCGTA TAGCAGCAGTTGGTACGACTACGGTATGGACGTC TGGGGCCAAGGGACCACGGTCACCGTCTCCTCA SEQ ID NO: 29271 |

FIGURE 50
(Continued)

| | | | | |
|---|---|---|---|---|
| iPS:433973 | 21-225_46A6 | AA | DIQMTQSPSSLSASVGDRVTITCRTSQDIRKDLG WYQQKPGKAPKRLIYAASSLESGVPSRFSGSGS GTEFTLTISSLQPEDFATYYCLQHYSFPWTFGQG TKVEIK<br>SEQ ID NO: 25266 | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCARVPYSS SWYDYGMDVWGQGTTVTVSS<br>SEQ ID NO: 29272 |
| | | NA | GAGGTGCAGCTGTTGGAGTCTGGGGGAGGCTTG GTACAGCCTGGGGGGTCCCTGAGACTCTCCTGTG CAGCCTCTGATTCACCTTTAGCAGCTATGCCAT GAGCTGGGTCCGCCAGGCTCCAGGGAAGGGGCT GGAGTGGGTCTCAGCTATTAGTGGTCGTGGTATT AACACATTCGACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAGGAAAGGA GTGGGAGCTATTTTGACTACTGGGGCCAGGGAAC CCTGGTCACCGTCTCCTCA<br>SEQ ID NO: 29273 | |
| | | AA | DIQMNQSPSSVSASVGDRVNITCRASQGISNWLA WYQQKPGKVPKLLIYAASSLQSGVPSRFSGSGS GTDFTLTISNLQPEDFATYYCQQTNSFPWTFGQG TKVEIK<br>SEQ ID NO: 25268 | EVQLLESGGGLVQPGGSLRLSCAASGFTFSSYAMS WVRQAPGKGLEWVSAISGRGINTFDADSVKGRFTI SRDNSKNTLYLQMNSLRAEDTAVYYCAKERSGSY FDYWGQGTLVTVSS<br>SEQ ID NO: 29274 |

FIGURE 50
(Continued)

| | | | |
|---|---|---|---|
| iPS:433975 | 21-225_46C6 | NA | GACATCCAGATGACCCAGTCTCCATCCTCCT GTCTGCATCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAATAGTTACCCTCTC ACTTTCGGCGGAGGGACCAAGGTGGAGATCA CA SEQ ID NO: 25269 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT ACACTGGGTCCGCCAGGCTCCAGGCAAGGGGCT GGAGTGGGTGGCAGTTATATGGTATGATGAAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGCTAGG AITTTCCAATGACTACTGGGGCCAGGGAACCCTG GTCACCGTCTCCTCA SEQ ID NO: 29275 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIT SEQ ID NO: 25270 | QVQLVESGGGVVQPGRSLRLSCAASGFTFSSYGIH WVRQAPGKGLEWVAVIWYDENNKYYADSVKGRF TISRDNSKNTLYLQMNSLRAEDTAVYYCARELGFS NDYWGQGTLVTVSS SEQ ID NO: 29276 |
| iPS:433977 | 21-225_46D8 | NA | GACATCCAGATGACCCAGTCTCCATCCTCCT GTCTGCATCTGTAGGAGACAGAGTCACCATCA CTTGCCGGGCAAGTCAGGGACATTAGAAAGAT TTAGGCTGGTATCAGCAGAAACCAGGGAAAG CCCCTAAGCGCCTGATCTATGCTGCATCCAGT TTGCAAAGTGGGGTCCCATCAAGGTTCAGTGG CAGTGGATCTGGGACAGATTCAGTCTCACAA TCAGCAGCCTGCAGCCTGAAGATTTTGCAACT TATTACTGTCTACAGCATAATAGTTACCCTCTC ACTTTCGGCGGAGGGACCAAGGTGGAGATCA AG SEQ ID NO: 25271 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGATTATGCAT ACACTGGGTCCGCCAGGCTCCAGGCAAGGGGCT GGAGTGGGTGGCAGTTATATGGTTTGAAGGAAGT AATAAATACTATGCAGATTCCGTGAAGGGCCGAT TCACCATCTCCAGAGACAATTCCAAGAACACGCT GTATGTGCAAATGAACAGCCTGAGAGCCGAGGA CACGGCTGTGTATTACTGTGTGAGAGAACTAGGA TTTTCCAATGACTACTGGGGCCAGGGAACCCTGG TCACCGTCTCCTCA SEQ ID NO: 29277 |

FIGURE 50
(Continued)

| | | | | |
|---|---|---|---|---|
| | | AA | DIQMTQSPSSLSASVGDRVTITCRASQGIRKDLG WYQQKPGKAPKRLIYAASSLQSGVPSRFSGSGS GTEFSLTISSLQPEDFATYYCLQHNSYPLTFGGGT KVEIK<br><br>SEQ ID NO: 25272 | QVQLVESGGGVVQPGRSLRLSCAASGFTFSDYGIH WVRQAPGKGLEWVAVIWFEGSNKYYADSVKGRF TISRDNSKNTLYVQMNSLRAEDTAVYYCVRELGFS NDYWGQGTLVTVSS<br><br>SEQ ID NO: 29278 |
| iPS:433979 | 21-225_46B9 | NA | GATATTGTGATGACCCAGACTCCACTCTCT GTCCGTCACCCTGGACAGCCGGCCTCCATCT CCTGCAAGTCTAGTCAGAGCCTCCTGCATAGT GAGGGAAAGACCTATTTGTATTGGTACCTGCA GAAGCCAGGCCAGCCTCCACAGCTCCTGATCT ATGAAGTTCTTACCGGTTCTCTGGAGTGCCA GATAGGGTTCAGTGGCAGCGGGTCAGGGACAG ATTTCACACTGAAAATCAGCCGGATGAGGCT GAGGATGTTGGGGTTTATTACTGCATGCACAG TATACAGTATCCGCTCACGTTTGGCGGAGGGA CCAAGGTGGAGATCCAA<br><br>SEQ ID NO: 25273 | CAGGTGCAGCTGGTGGAGTCTGGGGGAGGCGTG GTCCAGCCTGGGAGGTCCCTGAGACTCTCCTGT CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAG AAATAAATACTATGCAGACTCCGTGAAGGGCCG AATCACCATCTCCAGAGACAATTCCAAGAACAC GCTGTATCTGCAAATGAACAGCCTGAGAGCCGA GGACACGGCTGTGTATTACTGTGCGAGGCGGTAT AGCAGCAGCTGGATGGAGGTATGACGTCTGG GGCCAAGGGACCACGGTCACCGTCTCCTCA<br><br>SEQ ID NO: 29279 |
| | | AA | DIVMTQTPLSLSVTPGQPASISCKSSQSLLHSEGK TYLYWYLQKPGQPPQLLIYEVSYRFSGVPDRFSG SGSGTDFTLKISRMEAEDVGVYYCMHSIQYPLTF GGGTKVEIQ<br><br>SEQ ID NO: 25274 | QVQLVESGGGVVQPGRSLRLSCSASGFTFSSYGMH WVRQAPGKGLEWVAVIWYDGRNKYYADSVKGRI TISRDNSKNTLYLQMNSLRAEDTAVYYCARRYSSS WMGGMDVWGQGTTVTVSS<br><br>SEQ ID NO: 29280 |

FIGURE 50
(Continued)

| | | | |
|---|---|---|---|
| iPS:433981 | 21-225_46E9 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAG TCAGCAGCCTGCAGCCTGAAGATTTTGCAACT TATTTCTGTCTTCAGCATACTAGTTCCCATTC ACTTTCGGCCCTGGGACCAAAGTGGATATCAA A SEQ ID NO: 25275 | CAGGTGCAGCTGGTGGAGTCTGGGGGAGGCTTG GTCAAGCCTGGAGGGTCCCTGAGACTCTCCTGTG CAGCCTCTGGATTCACCTTCAGTGACTACTACAT GAACTGGATCCGCCAGGCTCCAGGGAAGGGGCT GGAGTGGGTTTCATACATTAATAGTAATGGTTTT ACCATATACTACGCAGACTCTGTGAAGGGCCGAT TCACCATCTCCAGGGACAACGCCAAGAACTCACT GTATCTGCAAATGAACAGCCTGAGAGCCGAGGA CACGGCCGTGTATTACTGTGCGCCGATACAATC TACTGGGGCCAGGGAACCCTGGTCACCGTCCCT CA SEQ ID NO: 29281 |
| | | AA | DIQMTQSPSSLSASVGDRVTITCRASQGIRNDLG WYQQKPGKAPKRLIYAASSLQSGVPSRFSGSGS GTEFTLTVSSLQPEDFATYFCLQHTSPITFGPGT KVDIK SEQ ID NO: 25276 | QVQLVESGGGLVKPGGSLRLSCAASGFTFSDYYMN WIRQAPGKGLEWVSYINSNGFTIYYADSVKGRFTIS RDNAKNSLYLQMNSLRAEDTAVYYCAADTIYWGQ GTLVTVSS SEQ ID NO: 29282 |
| iPS:433983 | 21-225_47A1 | NA | GACATCCAGATGACCCAGTCTCCATCTCCCT GTCTGCATCTGTAGGAGACAGAGTCACCATCA CTTGCCGGGCAAGTCAGGACAGATTAGAAATGAT TTAGGCTGGTATCAGCAGAAACCAGGGAAAG CCCCTAAGCGCCTGATCTATGCTGCATTCAGTT TGCAAAGTGGGGTCCCATCAAGGTTCAGCGGC AGTAGATCTGGGACAGAATTTCACTCTCACAAT CAGCAGCCTGCAACATAATAGTTACCTGCAACTT ATTACTGTCTGCAACATAATAGTTACCGCTC ACTTTCGGCGGAGGGACCAAGGTGGAGATCA AA SEQ ID NO: 25277 | CAGGTGCAGCTGGTGGAGTCGGGGGGAGGCGTG GTCCAGCCTGGGAGGTCCCTGAGACTCTCCTGTG CAGCGTCTGGATTCACCTTCAGTGACTATGGCAT GCACTGGGTCCGCCAAGCTCCAGGCAAGGGGCT GGAGTGGGTGGCAGTTATATGGTATGATGACTAT AATAAAAAGTATGCAGACTCCGTGAAGGGCCGA TTCACCATCTCCAGAGACAATGCCAAGAACACGC TGTATCTGCAAGTGAACAGCCTGAGAGTCGAAG ACACGGCTGTGTATTACTGTGCGACAGAACTGGG GATGTCTTTGACTACTGGGGCCAGGGAACCCTG GTCACCGTCTCCTCA SEQ ID NO: 29283 |

FIGURE 50
(Continued)

| | | | | |
|---|---|---|---|---|
| iPS:433985 | 21-225_47C1 | AA | DIQMTQSPSSLSASVGDRVTITCRASQDIRNDLG WYQQKPGKAPKRLIYAAFSLQSGVPSRFSGSRS GTEFTLTISSLQPEDFATYYCLQHNSYPLTFGGG TKVEIK<br><br>SEQ ID NO: 25278 | QVQLVESGGGVVQPGRSLRLSCAASGFTFSDYGM HWVRQAPGKGLEWVAVIWYDDYNKKYADSVKG RFTISRDNAKNTLYLQVNSLRVEDTAVYYCATELG MLFDYWGQGTLVTVSS<br><br>SEQ ID NO: 29284 |
| | | NA | GATATTGTGATGACCCAGACTCCACTCTCT GTCCGTCACCCCTGGACAGCCGGCCTCCATCT CCTGCACGTCTAGTCAGAGCCTCCTGCATAGT GAACGAAAGACCTATTTGTATTGGTACCTCCA GAAGCCAGGCCAGCCTCCACAGCTCCTGATCT ATGAAGTTTCCAACGGTTCTGGAGTGCCA GATAGGTTCAGTGGCAGCGGGTCAGGGACAG ATTTCACACTAAAAATCAGCCGGGTGGAGGCT GAGGATGTTGGGGTTTTTCACTGTATGCAAAG TATACAGCTTCCGTGGACGTTCGGCCAAGGGA CCAAGGTGGAAATCAAA<br><br>SEQ ID NO: 25279 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTTCTGTG GCACTGGGTCCGCCAGACTCCAGGCAAGGGCT GGAGTGGGTGGCAGTTATATGTATGATGAAGT AATAAATACTATGCAGAGCTCCGTGAAGGGCGA TTCACCATCTCCAGAGACAATTCCAAGAACACGC TGTTTCTGCAAATGAACAGCTGAGGACGAGG ACACGGCTGTGTATTACTGTGCGAGACGGTATAG CCGCAGCTGGGTGGGAGGTATGACGTCTGGGG CCAAGGGACCACGGTCACCGTCTCCTCA<br><br>SEQ ID NO: 29285 |
| | | AA | DIVMTQTPLSLSVTPGQPASISCTSSQSLLHSEGK TYLYWYLQKPGQPPQLLIYEVSNRFSGVPDRFSG SGSGTDFTLKISRVEAEDVGVFYCMQSIQLPWTF GQGTKVEIK<br><br>SEQ ID NO: 25280 | QVQLVESGGGVVQPGRSLRLSCAASGFTFSDYGM HWVRQTPGKGLEWVAVIWYDGSNKYYADSVKGR FTISRDNSKNTLFLQMNSLRDEDTAVYYCARRYSR SWVGGMDVWGQGTTVTVSS<br><br>SEQ ID NO: 29286 |

FIGURE 50
(Continued)

| | | | |
|---|---|---|---|
| iPS:433987 | 21-225_47A5 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA | CAGGTGCAGCTGGTGGAGTCTGGGGGAGGCTTG GTCCAGCCTGGGAGGTCCCTGAGACTCTCCTGTG CAGCGTCTGATTCACCTTCAGTGACGATGACAC ACACTGGGTCCGCCAGGTTCCAGGCAAGGGCT GGAGTGGGTGGCAGTTATATGGTTTGATGGAAGT AATAAATACTATGCAGACTCCGTGAAGGGCCGA TTCACCATCTCCAGAGACAATTCCAAGAACACGC TGTATCTGCAAATGAACAGCCTGAGCGCCGAGG ACACGGCTGTGTATTACTGTGCGAGAGATCTTAT AGCAGCAGCTGGTACAGTTGACTACTGGGGCCA GGGAACCCTGGTCACCGTCTCCTCA |
| | | | SEQ ID NO: 25281 | SEQ ID NO: 29287 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK | QVQLVESGGGVVQPGRSLRLSCAASGFTFSDDDTH WVRQAPGKGLEWVAVIWFDGSNKYYADSVKGRF TISRDNSKNTLYLQMNSLSAEDTAVYYCARDLIAA AGTVDYWGQGTLVTVSS |
| | | | SEQ ID NO: 25282 | SEQ ID NO: 29288 |
| iPS:433989 | 21-225_47C7 | NA | GATATTGTGATGACTCAGTCTCCACTCTCCCCG CCCGTCACCCCTGGAGAGCCGGCCTCCATCTC CTGCAGGTCTAGTCAGAGCCTCCTGCATAGTA ATGGATACAACTATTTGGAATGGTACCTGCAG AAGTCAGGGCAGTCTCCACAGTTCCTGATCTA TTTGGGTTTTAATCGGGCCTCCGGGGTCCCTG ACAGGTTCACTGGCAGTGGATCAGGCACAGAT TTTACACTGAAAATCAGCAGAGTGGAGGCTGA GGATGTTGGGGTTTATTACTGCATGCAAGTTC TACAAACTCCATTCACTTTCGGCCCTGGGACC AAAGTGGATATCAAA | GAGGTGCAGCTGTTGGAGTCTGGGGGAGGCTTG GTACAGCCTGGGGGGTCCCTGAGACTCTCCTGTG CAGCCTCTGGATTCACCTTTAGTAACTATGCCAT GAGCTGGGTCCGCCAGGCTCCAGGGAAGGGGCT GGAGTGGGTCTCAGTTATTAGTGGTAGTGGTAGT CGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAAGATCGGG GGCAGTGGCTCATAGGCGGTATGGACGTCTGGG GCCAAGGGACCACGGTCACCGTCTCCTCA |
| | | | SEQ ID NO: 25283 | SEQ ID NO: 29289 |

FIGURE 50
(Continued)

| | | | | |
|---|---|---|---|---|
| | | AA | DIVMTQSPLSPPVTPGEPASISCRSSQSLLHSNGY NYLEWYLQKSGQSPQFLIYLGFNRASGVPDRFT GSGSGTDFTLKISRVEAEDVGVYYCMQVLQTPF TFGPGTKVDIK<br>SEQ ID NO: 25284 | EVQLLESGGGLVQPGGSLRLSCAASGFTFSNYAMS WVRQAPGKGLEWVSGISGSGSRTYYADSVKGRFTI SRDNSKNTLYLQMNSLRAEDTAVYYCAKDRGQW LIGGMDVWGQGTTVTVSS<br>SEQ ID NO: 29290 |
| iPS:433991 | 21-225_47E7 | NA | GATATTGTGATGACCCAAACTCCACTCTCT GTCCGTCACCCCTGGACAGCCGGGCTCCATCT CCTGCAAGTCTAGTCAGAGCCTCCTGCATAGT GATGGAAGGACCTATTTGTATTGGTACCTGCA GAAGCCAGGCCAGCCTCCACAGCTCCTGATCT ATGAAGTTTCCAGCCGGGTCTCTGGAGTGCCA GATAGGTTCAGTGGCAGCGGGTCAGGGACAG ATTTCGCACTGAAAATCAGCCGGGTGGAGGCT GAGGATGTTGGGGTTTATTACTGCATGCAAAG TACACAACTTCCGTGGACGTTCGGCCAAGGGA CCAAGGCGGAAATCAAA<br>SEQ ID NO: 25285 | CAGGTGCAGCTGGTGGAGTCTGGGGGAGGCGTG GTCCAGCCTGGAGGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTTCAAATGAACAGCCTGAGAGCCGAGG ACACGGCTGTGTATTACTGTGCGAGACGGTATAG CAGAAGCTGGGTGGAGGTATGGACGTCTGGGG CCAAGGGACCACGGTCACCGTCTCCTCA<br>SEQ ID NO: 29291 |
| | | AA | DIVMTQTPLSLSVTPGQPASISCKSSQSLLHSDGR TYLYWYLQKPGQPPQLLIYEVSSRFSGVPDRFSG SGSGTDFALKISRVEAEDVGVYYCMQSTQLPWT FGQGTKAEIK<br>SEQ ID NO: 25286 | QVQLVESGGGVVQPGRSLRLSCAASGFTFSIYGMH WVRQAPGKGLEWVAVIWYDGSNKYYADSVKGRF TISRDNSKNTLYLQMNSLRAEDTAVYYCARRYSRS WVGGMDVWGQGTTVTVSS<br>SEQ ID NO: 29292 |

FIGURE 50
(Continued)

| | | | |
|---|---|---|---|
| iPS:433993 | 21-225_47G7 | NA | GACATCCAGATGACCCAGTCTCCATCTTCCGT GTCTGCATCTGTAGGAGACAGAGTCACCATCA CTTGTCGGGCGAGTCAGGTATTAGCAGTATGG TTAGCCTGGTATCAGCAGAAACCAGGGAAAG CCCCTAAGCTCCTGATCTTTGCTGCCTCCAATT TGCAAAGTGGGGTCCCATCAAGGTTCAGCGGC AGTGGATCTGGGACAGATTTCACTCTCACCAT CAGCAGTCTGCAGCCTGCAGATTTTGCAACTT ACTGTTGTCAACAGGTTAACAGTTTCCCGTGG ACGTTCGGCCAAGGGACCAAGGTGGAAATCA AA | GAGGTGCAGTTGTTGGACTCTGGGGGAGGCTTGG TGCAGCCTGGGGGGTCCCTGAGACTCTCCTGTGC AGCCTCTGGATTCACCTTTAGCAGTATGCCCATG AGTTGGGTCCGCCAGGCTCCAGGGAAGGGGCTG GAGTGGGTCTCAGCTATTAGTGGTGGGTGTGGTA ACACATTCTACGCAGAGTCCGTGAGGGGCCGGTT CACCATCTCCAGAGACAATTCCAAGAACACGCTG TATCTGCAAATGAACAGCCTGAGAGCCGAGGAC ACGGCCGTATATTACTGTGCGAAGATTATCCGG AGCAGTGGGCCTTTGACTACTGGGGCCAGGGAA CCCTGGTCACCGTCTCCTCA |
| | | | SEQ ID NO: 25287 | SEQ ID NO: 29293 |
| | | AA | DIQMTQSPSSLSASVGDRVTITCRASQGISNWLA WYQQKPGKAPKLLIFAASNLQSGVPSRFSGSGS GTDFTLTISSLQPADFATYCCQQVNSFPWTFGQG TKVEIK | EVQLLDSGGGLVQPGGSLRLSCAASGFTFSSYAMS WVRQAPGKGLEWVSAISRGGNTFYAESVRGRFTI SRDNSKNTLYLQMNSLRAEDTAVYYCAKIIREQWA FDYWGQGTLVTVSS |
| | | | SEQ ID NO: 25288 | SEQ ID NO: 29294 |
| iPS:433995 | 21-225_47H7 | NA | GACATCCAGATGACCCAGTCTCCATCTCCCT GTCTGCATCTGTAGGAGACAGAGTCACCATCA CTTGCCGGACAAGTCAGGGCATTAGAAATGAT TTAGGCTGGTATCAGAAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATCGCTCACTCTCACAG TCAGCAGCCTGCAGCCTGAAGATTTTGCAACT TATTTCTGTCTACAACATACTAGTTTCCCCATTC ACTTTCGGCCCTGGGACCAAAGTGGATATCAA A | CAGGTGCAGCTGGTGGAGTCTGGGGGAGGCTTG GTCAAGCCTGGAGGGTCCCTGAGACTCTCCTGTG CAGCCTCTGGATTCACCTTCAGTGACTACTACAT GATCTGGATCCGCCAGGCTCCAGGGAAGGGGCT GGAGTGGGTTTCATACATTAATAGTAATGGTTTT ACCAAATACTACGCAGACTCTGTGAAGGGCCGA TTCACCATCTCCAGGGACAACGCCAAGAATTCAC TGTATCTGCAAATGAACAGTCTGCGAGAGCCGAGG ACACGGCCGTGTATTACTGTGCGGCCGATACAGT CTACTGGGGCCAGGGAACCCTGGTCACCGTCTCC TCA |
| | | | SEQ ID NO: 25289 | SEQ ID NO: 29295 |

FIGURE 50
(Continued)

| | | | | |
|---|---|---|---|---|
| | | AA | DIQMTQSPSSLSASVGDRVTITCRTSQGIRNDLG WYQKKPGKAPKRLIYAASSLQSGVPSRFSGSGS GTEFTLTVSSLQPEDFATYFCLQHTSPFTFGPGT KVDIK<br>SEQ ID NO: 25290 | QVQLVESGGGLVKPGGSLRLSCAASGFTFSDYYMI WIRQAPGKGLEWVSYINSNGFTKYYADSVKGRFTI SRDNAKNSLYLQMNSLRAEDTAVYYCAADTVYW GQGTLVTVSS<br>SEQ ID NO: 29296 |
| | | NA | GACATCCAGATGACCCAGTCTCCATCTCCCT GTCTGCATCTGTAGGAGACAGAGTCACCATCA CTTGCCGGACAAGTCAGGGCATTAGAAATGAT TTAGGCTGGTATCAGCAGAAACCAGGAAAG CCCCTAAGCGCCTGATCTATAGCAGCATCCAGT TTGCAAAGTGGGGTCCCAGCAAGGTTCAGCGG CAGTGGATCTGGGACAGAGATTCACTCTTACAA TCAGCAGCCTGCAGCCTGAAGATTTTGCAATT TATTACTGTCTACAGCATAATTTTTACCCGTGG ACGTTCGGCCAAGGGACCAAGGTGGAAATCA AA<br>SEQ ID NO: 25291 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTGTATGGTATGATGAAATT AATAAAAAGTATGCAGACTCCGTGAAGGGCCGA GTCACCATCTCCAGAGACAACAATTCCAAGAACACGC TGTATCTGCAAATGAACAGCCTGAGAGCCGAGG ACACGGCTATGTATTACTGTGCGAGAGAATTAGG GTGGGAGGCTGACTACTGGGGCCAGGGAACCCT GGTCACCGTCTCCTCA<br>SEQ ID NO: 29297 |
| iPS:433997 | 21-225_48C1 | AA | DIQMTQSPSSLSASVGDRVTITCRTSQGIRNDLG WYQQKPGKAPKRLIYRASSLQSGVPARFSGSGS GTEFTLTISSLQPEDFAIYYCLQHNFYPWTFGQG TKVEIK<br>SEQ ID NO: 25292 | QVQLVESGGGVVQPGRSLRLSCAASGFTFSSYGMH WVRQAPGKGLEWVAVVWYDEINKKYADSVKGRV TISRDNSKNTLYLQMNSLRAEDTAMYYCARELGW EADYWGQGTLVTVSS<br>SEQ ID NO: 29298 |

FIGURE 50
(Continued)

| | | | |
|---|---|---|---|
| iPS:433999 | 21-225_48D1 | NA | GACATCCAGATGACCCAGTCTCCATCTCCCT GTCTGCGTCTGTAGGAGACAGAGTCAACATCA CTTGCCGGGCAAGTCAGAGCATTAGCAGCTAT TTAATTTGGTATCAGCAGAAACCAGGGAAAGC CCCTAAGCTCCTGATCTATGCTGCATCCAGTT GCAAAGTGGGGTCCCATCAAGGTTCAGTGCCA GTGGATCTGGGACAGATTTCACTCTCACCATC AGCAGTCTGCAACCTGAAGATTTTGCAAGTTA CTACTGTCAACAGAGTAACAGTATTCCATTCA CTTTCGGCCCTGGGACCAAAGTGGATATCAAA<br>SEQ ID NO: 25293 | GAGGTGCAGCTGTTGGAGTCTGGGGAGGCTTG GTACAGCCTGGGGGGTCCCTGAGACTCTCCTGTG CAGCCTCTAGATTCACCTTTAGCAGTTATGCCAT GAGCTGGGTCCGCCAGGCTCCAGGGAAGGGGCT GGAGTGGGTCTCAGTTATTAGTGGTCGTGGTGGT AGCACATTCTACGCAGACTCCGTGAAGGGCCGT TCACCATCTCCAGAGACAATTCCAAGAACACGCT GTATCTGCAAATGAACAGCCTGAGAGCCGAGGA CACGGCCGTATATTACTGTGCGCGTCGTATAGCA GTGGCTGGGAATGAGGCTTTGATATCGGGGCC AAGGGACAATGGTCACCGTCTCTCA<br>SEQ ID NO: 29299 |
| | | AA | DIQMTQSPSSLSASVGDRVNITCRASQSISSYLIW YQQKPGKAPKLLIYAASSLQSGVPSRFSASGSGT DFTLTISSLQPEDFASYYCQQSNSIPFTFGPGTKV DIK<br>SEQ ID NO: 25294 | EVQLLESGGGLVQPGGSLRLSCAASRFTFSSYAMS WVRQAPGKGLEWVSVISGRGGSTFYADSVKGRFTI SRDNSKNTLYLQMNSLRAEDTAVYYCARRIAVAG NEAFDIWGQGTMVTVSS<br>SEQ ID NO: 29300 |
| iPS:434001 | 21-225_48F2 | NA | GACATCCAGATGACCCAGTCTCCATCTCCT GTCTGCATCTGTAGGAGACAGAGTCACCATCA CTTGCCGGGCAAGTCGGGCATTAGACATGAT TTAGGCTGGTATCAACAGAAACCAGGGAAAC CCCCTAAGCGCCTGATCTATGCTGCATCCAGT TTGCAAAGTGGGGTCCCATCAAGGTTCAACGG CAGTGGATCTGGGACAGAATTCACTCTCACAA TCAGCAGCCTGCAGTCTGAAGATCTTGCAACT TATTACTGTCTACAGCAATATAGTTATCCTCGG ACGTTCGGCCAAGGGACCAAGGTGGAAATCA AA<br>SEQ ID NO: 25295 | CAGGTGCAGCTGGTGGAGTCTGGGGGAGGCGTG GTCCAGCCTGGGAGGTCTCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATATCGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGTA TAGCAGCAGCTGGTACGACTACGGTCTGGACGTC TGGGGCCAAGGGACCACGGTCACCGTCTCCTCA<br>SEQ ID NO: 29301 |

FIGURE 50
(Continued)

| | | | | |
|---|---|---|---|---|
| iPS:434003 | 21-225_48C3 | AA | DIQMTQSPSSLSASVGDRVTITCRASRGIRDDLG WYQQKPGKPPKRLIYAASSLQSGVPSRFNGSGS GTEFTLTISSLQSEDLATYYCLQQYSYPRTFGQG TKVEIK | QVQLVESGGGVVQPGRSLRLSCAASGFTFSNYVM HWVRQAPGKGLEWVAVIWYDGSNKYYADSVKGR FTISRDNSKNTLYLQMNSLRAEDTAVYYCARERYS SSWYDYGLDVWGQGTTVTVSS |
| | | | SEQ ID NO: 25296 | SEQ ID NO: 29302 |
| | | NA | GACATCCAGATGACCCAGTCTCCATCTCCCT GTCTGCGTCTGTAGGAGACAGAGTCAACATCA CTTGCCGGGCAAGTCAGAGCATTATCAGCTAT TTAATTTGGTATCAGCAGAAACCAGGGAAAGC CCCTAGGCTCCTGATCTATGCTGCATCCAGTTT GCAAAGTGGGGTCCCATCAAGGTTCAGTGCCA GTGGATCTGGGACAGATTTCACTCTCACCATC AGCAGTCTGCAACAGACTAACAGTATTCATTCA CTTTCGGCCCTGGGACCAAAGTGGATATCAAA | GAGGTGCAGCTGTTGGAGTCTGGGGGAGGCTTG GTACAGCCTGGGGGGGTCCCTGAGACTCTCCTGTG CAGCCTCTAGATTCACCTTTAGCAGTTATGCCAT GAGCTGGGTCCGCCAGGCTCCAGGGAAGGGGCT GGAGTGGGTCTCAGTTATTAGTGGTCGTGGTGGT AGCACATTCTACGCAGACTCCGTGAAGGGCCGT TCACCATCTCCAGAGACAATTCCAAGAACACGCT GTATCTGCAAATGAACAGCCTGAGAGCCGAGGA CACGGCCGTATATTACTGTGCGCGTCGTATAGCA GTGGCTGGGAATGAGGCTTTTGATATCTGGGGCC AAGGGACAATGGTCACCGTCTCTTCA |
| | | | SEQ ID NO: 25297 | SEQ ID NO: 29303 |
| | | AA | DIQMTQSPSSLSASVGDRVNITCRASQSIISYLIW YQQKPGKAPRLLIYAASSLQSGVPSRFSASGSGT DFTLTISSLQPEDFASYYCQQTNSIPFTFGPGTKV DIK | EVQLLESGGGLVQPGGSLRLSCAASRFTFSSYAMS WVRQAPGKGLEWVSVISRGGSTFYADSVKGRFTI SRDNSKNTLYLQMNSLRAEDTAVYYCARRIAVAG NEAFDIWGQGTMVTVSS |
| | | | SEQ ID NO: 25298 | SEQ ID NO: 29304 |

FIGURE 50
(Continued)

| | | | |
|---|---|---|---|
| iPS:434007 | 21-225_48D7 | NA | GACATCCAGATGACCCAGTCTCCATCTCCGT GTCTGCATCTGTAGGAGACAGAGTCACCATCA CTTGTCGGGCGAGTCAAATATTACCAGCTGG TTAGCCTGGTATCAGCAGAAACCAGGGAAAG CCCCTAAGCTCCTGATCTATAGTGCATCCAGT TGCAAATGGGGTCCCATCAAGGTTCAGCGGC AGTGGATCTGGGACAGATTTCACTCTCACCAT CAGCAGCCTGCAGCCTGAAGATTTTGTAACTT ACTGTTGTCAACAGGCTAACAGTTTCCCGTGG ACGTTCGGCCAAGGGACCAAGGTGGAAATCA AA<br><br>SEQ ID NO: 25299 | GAGGTGCAGCTGTTGGAGTCTGGGGGAGGCTTG GTACAGCCGGGGGGGTCCCTGAGACTCTCCTGTG CAGCCTCTGGATTCACCTTTAGAAACTCTGCCAT GAACTGGGTCCGCCAGGCTCCAGGGAAGGGGCT GGAGTGGGTCTCAGCTATTAGTGGTAGTGGTGGT ACCACATTCTACGCAGACTCCGTGAAGGGCCGGT TCACCATCTCCAGAGACAATTCCAAGAACACGTT GTATCTGCAAATAAACAGCCTGAGAGCCGAGGA CACGGCCGTATATTACTGTGCGAAATGTGGCCGG GAGCAGTGGCTTGACTACTGGGGCCAGGGAACC CTGGTCACCGTCTCCTCA<br><br>SEQ ID NO: 29305 |
| | | AA | DIQMTQSPSSVSASVGDRVTITCRASQNITSWLA WYQQKPGKAPKLLIYSASSLQNGVPSRFSGSGS GTDFTLTISSLQPEDFVTYCCQQANSFPWTFGQG TKVEIK<br><br>SEQ ID NO: 25300 | EVQLLESGGGLVQPGGSLRLSCAASGFTFRNSAMN WVRQAPGKGLEWVSAISGSGGTTFYADSVKGRFTI SRDNSKNTLYLQINSLRAEDTAVYYCAKCGREQW LDYWGQGTLVTVSS<br><br>SEQ ID NO: 29306 |
| iPS:434009 | 21-225_48A9 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCATCCAGT TGCAAAGTGGGGTCCCATCAAGGTTCAGCGGC AGTGGATCTGGGACAGAATTCACTCTCACTAT CAGCGGCTTGCAGCCTGAAGATTTTGCAATTT ATTACTGTCTACAGCATAATCGTTACCCGTGG ACGTTCGGCCAAGGGACCAAGGTGGAAATCA AA<br><br>SEQ ID NO: 25301 | CAGGTGCAGCTGGTGGAGTCTGGGGGAGGCGTG GTCCAGCCTGGGGAGGTCCCTGAGACTCTCCTGTG CAGCGTCTGGATTCACCTTCAGTAGCTATGGCAT GCACTGGGTCCGCCAGGCCCCAGGCAAGGGGCT GGAGTGGGTGGCAGTTATATGGTATGAGGAAAA TAAGAAATACTATGCAGACTCCGTGAAGGGCCG ATTCACCATCTCCAGAGACAATTCCAAGAACACG CTGTTTCTGCAAATGAATAGCCTGAGAGCCGAGG ACACGGCTATGTATTTCTGTGCGAGAGAACTTGC CTGGTACGAGGACTACTGGGGCCAGGGAACCCT GGTCACCGTCTCCTCA<br><br>SEQ ID NO: 29307 |

FIGURE 50
(Continued)

| | | | | |
|---|---|---|---|---|
| iPS-434011 | 21-225_48B10 | AA | DIQMTQSPSSLSASVGDRVTITCRASQGIRNDLG WYQQKPGKAPKRLIYIASSLQSGVPSRFSGSGSG TEFTLTISGLQPEDFAIYYCLQHNRYPWTFGQGT KVEIK<br>SEQ ID NO: 25302 | QVQLVESGGGVVQPGRSLRLSCAASGFTFSSYGMH WVRQAPGKGLEWVAVIWYEENKKYYADSVKGRF TISRDNSKNTLFLQMNSLRAEDTAMYFCARELAWY EDYWGQGTLVTVSS<br>SEQ ID NO: 29308 |
| | | NA | GACATCCAGATGACCCAGTCTCCATCCTCCCT GTCTGCGTCTGTAGGAGACAGAGTCACCATCA CTTGCCGGGCAAGTCAGAGCATTAGGAAGTAT TTAAATTGGTATCAGAAGACACCAGGAAAG CCCCTAAACTCTTGATCTATGCTGCTTCCAGTT TGCAAAGTGGGGTCCCATCAAGGTTCAGTGGC AGTGGATCTGGGACAGATTTCACTCTCACCAT CAGCAGTGTGCAACCTGAAGATTTTGCAACTT ACTACTGTCAACAGACTTACAGTAACCCACTC ACTTTCGGCGGAGGGACCAAGGTGGAGTTCAC A<br>SEQ ID NO: 25303 | CAGGTGCAGCTGGTGGAGTCTGGGGAGGCTTG GTCAAGCCTGGAGGGTCCCTGAGACTCTCTGTG CAGCCTCTGGATTCACCTTCAGTGACTACTTCAT GACCTGGATCCGCCAGGCTCCAGGGCAGGGCT GGAGTGGGTTCATACATTAGTAGTGCTGGTGGT GCCATATACTACGCAGACTCTGTGAAGGGCCGAT TCACCATCTCCAGGGACACAGCCTACAAACTACT GTATCTGCAAATGAACAGCCTGAGAGCCGAGGA CACGGCCGTGTATTACTGTGCAATAGCAGTGCT GCCCCTGGTGTTTTGATATCTGGGGCCAAGGGA CAATGGTCACCGTCTCTTCA<br>SEQ ID NO: 29309 |
| | | AA | DIQMTQSPSSLSASVGDRVTITCRASQSIRKYLN WYQKTPGKAPKLLIYAASSLQSGVPSRFSGSGSG TDFTLTISSVQPEDFATYYCQQTYSNPLTFGGGT KVEFT<br>SEQ ID NO: 25304 | QVQLVESGGGLVKPGGSLRLSCAASGFTFSDYFMT WIRQAPGQGLEWVSYISSAGGAIYYADSVKGRFTIS RDNAKNSLYLQMNSLRAEDTAVYYCAIAVAAPGV FDIWGQGTMVTVSS<br>SEQ ID NO: 29310 |

FIGURE 50
(Continued)

| | | | |
|---|---|---|---|
| iPS:434013 | 21-225_48D12 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCACTT TGCAAAGTGGGGTCCCATCAAGGATCAGCGGC AGTGGATCTGGGACAGAGAATTCACTCTCACAAT CAGCAGCCTGCAGCCTGAAGATTTTGCAACTT ATTACTGTCTACAGCATAATAGTTACCCGCTC ACTTTCGGCGGAGGGACCAAGGTGGAGATCA AA<br><br>SEQ ID NO: 25305 | CAGGTGCAGCTGGTGGAGTCTGGGGGAGGCGTG GTCCAGCCTGGGAGGTCCCTGAGACTCTCCTGTG CAGCGTCTGATTCACCTTCAGTGACTATGGCAT GCACTGGGTCCGCCAGGCTCCAGGCAGGGGCT GGAGTGGGTGGCAGTTATATGTATGATGTAAGT AATAAATACTATGTAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACTGGGG ATGAGATCTGACTACTGGGGCCAGGGAACCCTG GTCACCGTCTCCTCA<br><br>SEQ ID NO: 29311 |
| | | AA | DIQMTQSPSSLSASVGDRVTITCRASQGIRNDLG WYQQKPGKAPKRLIYAASTLQSGVPSRISGSGSG TEFTLTISSLQPEDFATYYCLQHNSYPLTFGGGT KVEIK<br><br>SEQ ID NO: 25306 | QVQLVESGGGVVQPGRSLRLSCAASGFTFSDYGM HWVRQAPGRGLEWVAVIWYDVSNKYYVDSVKGR FTISRDNSKNTLYLQMNSLRAEDTAVYYCARELGM RSDYWGQGTLVTVSS<br><br>SEQ ID NO: 29312 |
| iPS:434015 | 21-225_48F12 | NA | GACATCCAGATGACCCAGTCTCCATCCTCCCT GTCTGCGTCTGTAGGAGACAGAGTCACCATCA CTTGCCGGGCAAGTCAGAGCATTAGGAAGTAT TAAATTGGTATCAGCAGAAGACACCAGGGAAAG CCCCTAAACTCTTGATCTATGCTGCTTCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAAATT ATTACTGTCAACAGACTTACAGTAACCCGCTC ACTTTCGGCGGAGGGACCGAGGTGGAGATCA CA<br><br>SEQ ID NO: 25307 | CAGGTGCAGCTGGTGGAGTCTGGGGGAGGCTTG GTCAAGCCTGGAGGGTCCCTGAGACTCTCCTGTG CAGCCTCTGGATTCACCTTCAGTGACTACTTCAT GACCTGGATCCGCCAGGCTCCAGGGCAGGGGCT GGAGTGGGTTCATACATTAGTAGTGCTGGTGGT GCCATATACTACGCAGACTCTGTGAAGGGCCGAT TCACCATCTCCAGGGACAACGCCAAGAACTCACT GTTTCTGCAAATGAACAGCCTGAGAGCCGAGGA CACGGCCGTGTATTACTGTGCTATAGCAGTGCT GCCCCTGGTGCTTTTGATATCTGGGCCAAGGGA CATTGGTCACCGTCTCTTCA<br><br>SEQ ID NO: 29313 |

FIGURE 50
(Continued)

| | | | | |
|---|---|---|---|---|
| iPS:434017 | | AA | DIQMTQSPSSLSASVGDRVTITCRASQSIRKYLNWYQKTPGKAPKLLIYAASSLQSGVPSRFSGSGSGTDFTLTISSLQPEDFANYYCQQTYSNPLTFGGGTEVEIT<br>SEQ ID NO: 25308 | QVQLVESGGGLVKPGGSLRLSCAASGFTFSDYFMTWIRQAPGQQGLEWVSYISSAGGAIYYADSVKGRFTISRDNAKNSLFLQMNSLRAEDTAVYYCAIAVAAPGAFDIWGQGTLVTVSS<br>SEQ ID NO: 29314 |
| | 21-225_48G12 | NA | GACATCCAGATGACCCAGTCTCCATCCTCCCTGTCTGCGTCTGTAGGAGACAGAGTCACCATCACTTGCCGGGCAAGTCAGAGCATTAGGAAGTATTTAAATTGGTATCAGAAGACACCAGGGAAAGCCCCTAAACTCTTGATATATGCTGCTTCCAGTTTGCAAAGTGGGGGTCCCATCAAGGTTCAGTGGCAGTGGATCTGGGACAGATTTCACTCTCACCATCAGCAGTGTGCAACCTGAAGATTTTGCAAATTATTACTGTCAACAGACTTACAGTAACCCGCTCACTTTCGGCGGAGGGACCGAGGTGGAGATCACA<br>SEQ ID NO: 25309 | CAGGTGCAGCTGGTGGAGTCTGGGGGAGGCTTGGTCAAGCCTGGAGGGTCCCTGAGACTCTCCTGTGCAGCCTCTGGATTCACCTTCAGTGACTACTTCATGACCTGGATCCGCCAGGCTCCAGGGCAGGGGCTGGAGTGGGTTTCATACATTAGTAGTGCTGGTGGTGCCATATACTACGCAGACTCTGTGAAGGGCCGATTCACCATCTCCAGGGACAACGCCAAGAACTCACTGTTTCTGCAAATGAACAGCCTGAGAGCCGAGGACACGGCCGTGTATTACTGTGCTATAGCAGTGGCTGCCCTGGTGCTTTGATATCTGGGGCCAAGGGACATTGGTCACCGTCTCTTCA<br>SEQ ID NO: 29315 |
| | | AA | DIQMTQSPSSLSASVGDRVTITCRASQSIRKYLNWYQKTPGKAPKLLIYAASSLQSGVPSRFSGSGSGTDFTLTISSVQPEDFANYYCQQTYSNPLTFGGGTEVEIT<br>SEQ ID NO: 25310 | QVQLVESGGGLVKPGGSLRLSCAASGFTFSDYFMTWIRQAPGQQGLEWVSYISSAGGAIYYADSVKGRFTISRDNAKNSLFLQMNSLRAEDTAVYYCAIAVAAPGAFDIWGQGTLVTVSS<br>SEQ ID NO: 29316 |

FIGURE 50
(Continued)

| | | | |
|---|---|---|---|
| iPS:434019 | 21-225_49A1 | NA | GACATCCAGATGACCCAGTCTCCATCTCCT<br>GTCTGCATCTGTAGGAGACAGAGTCACCATCA<br>CTTGCCGGGCAAGTCAGGGCATTAGAAATGAT<br>TTAGACTGGTATCAGCAGAAACCAGGGAAAG<br>CCCCTAAGCGCCTGATCTATGCTGCATCCAGT<br>TTGCAAAGTGGGGTCCCATCAAGGTTCAGCGG<br>CAGTGGATCTGGGACAGATTCACTCTCACAA<br>TCAGTAGCCTGCAGCCTGAAGATTTTGCAACT<br>TATTACTGTCTACAGCATAATAGTTACCCGCTC<br>ACTTTCGGCGGAGGGACCAAGGTGGAGATCA<br>AA<br>SEQ ID NO: 25311 | CAGGTGCAGCTGGTGGAGTCTGGGGGAGGCGTG<br>GTCCAGCCTGGGAGGTCCCTGAGACTCTCCTGTG<br>CAGCCGTCTGATTCACCTTCAGTGACTATGGCAT<br>GCACTGGGTCCGCCAGGCTCCAGGCAAGGGGCT<br>GGAGTGGGTGGCAGTTATATGTAGACTCCGTGAA<br>AATAAATATTATGTAGACTCCGTGAAGGGCCGAT<br>TCACCATCTCCAGAGACAATTCAAGAACACGCT<br>GTATCTGCAAATGAACAGCCTGAGAGCCGAGGA<br>CACGGCTGTGTATTACTGTGCGAGAGAACTGGGG<br>TTCCTCTGACTACTGGGGCCAGGGAACCCTGG<br>TCACCGTCTCCTCA<br>SEQ ID NO: 29317 |
| | | AA | DIQMTQSPSSLSASVGDRVTITCRASQGIRNDLD<br>WYQQKPGKAPKRLIYAASSLQSGVPSRFSGSGS<br>GTEFTLTISSLQPEDFATYYCLQHNSYPLTFGGG<br>TKVEIK<br>SEQ ID NO: 25312 | QVQLVESGGGVVQPGRSLRLSCAASGFTFSDYGM<br>HWVRQAPGKGLEWVAVIWYDEDNKYYVDSVKGR<br>FTISRDNSKNTLYLQMNSLRAEDTAVYYCAREIGF<br>LSDYWGQGTLVTVSS<br>SEQ ID NO: 29318 |
| iPS:434021 | 21-225_49C1 | NA | GATATTGTGATGACCCAGACTCCACTCTCTCT<br>GTCCGTCACCCCTGGACAGCCGGCCTCCATCT<br>CCTGCAAGTCTAGTCAGAGCCTCCTGCATAGG<br>GAAGGAAAGACCTATTTGTACTGGTACCTGCA<br>GAAGCCAGGCCAGTCCACAGTTCCTGATCT<br>TTGAAGTTTCCACCCGGTTCTCTGGCGTGCCA<br>GATAGGTTCAGTGGCAGCGGGTCAGGGACAG<br>ATTTCACACTGAAAATCAGCCGGGTGGAGGCT<br>GAGGATGTTGGGGTTTATTACTGCATGCAAAG<br>TATACAGATTCCGATCACCCTCGGCCAAGGGA<br>CACGACTGGAGATTAAA<br>SEQ ID NO: 25313 | CAGGTGCAGCTGGTGGAGTCTGGGGGAGGCGTG<br>GTCCAGCCTGGGAGGTCCCTGAGACTCTCCTGTA<br>CAGCGTCTGGATTCACCTTCAGTAGCTATGGCAT<br>GCACTGGGTCCGCCAGGCTCCAGGCAAGGGCT<br>GGAGTGGGTGGCAGTTATATGGTATGGAAGT<br>AATAAATACTATGCAGACTCCGTGAAGGGCCGA<br>TTCACCATCTCCAGAGACAATTCAAGAACACGC<br>TGTATCTGCAAATGAACAGCCTGAGAGCCGAGG<br>ACACGGCTGTGTATTACTGTGCGAGAAGGTATAG<br>CAGCAGCTGGTCGGGCGGTATGACGTCTGGGG<br>CCAAGGGACCACGGTCACCGTCTCCTCA<br>SEQ ID NO: 29319 |

FIGURE 50
(Continued)

| | | | | |
|---|---|---|---|---|
| iPS:434023 | | AA | DIVMTQTPLSLSVTPGQPASISCKSSQSLLHREGK TYLYWYLQKPGQAPQFLIFEVSHRFSGVPDRFSG SGSGTDFTLKISRVEAEDVGVYCMQSIQIPITLG QGTRLEIK SEQ ID NO: 25314 | QVQLVESGGGVVQPGRSLRLSCTASGFTFSSYGMH WVRQAPGKGLEWVAVIWYDGSNKYYADSVKGRF TISRDNSKNTLYLQMNSLRAEDTAVYYCARRYSSS WSGGMDVWGQGTTVTVSS SEQ ID NO: 29320 |
| | 21-225_49F1 | NA | GACATCCAGATGACCCAGTCTCCATCTTCCGT GTCTGCATCTGTAGGAGACAGAGTCACCATCA CTTGTCGGGCGAGTGGGATATTAACGGCTGG TTAGCCTGGTATCAGCAGAAACCAGGGAAAG CCCCTAAGCTCCTGATCTATACTGTCTCCAGTT TGCAAAGTGGGGTCCCATCAAGGTTCAGCGGC AGTGGATCTGGGACAGCTCACTCTCACCAT CAGCAGCCTGCAGCCTGAAGATTTTGCAACTT ACTATTGTCAACAGTCTAACAGTTTCCCATTCA CTTTCGGCCCTGGGACCAAAGTGGATATCAAA SEQ ID NO: 25315 | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGACTGGGTCTCAGTTATTAGTGGTAGTGGTGGT AGCACATTCTACGCAGACTCCGTGAAGGGCCGGT TCACCATCTCCAGAGACAATTCCAAGAGACACGCT GTATCTGCAAATGAACAGCCTGAGAGCCGAGGA CACGGCCGTATATTATTGTGCGAGCGCTATAGCA GCGGCTGGTGCCCACTATTTGACTACTGGGGCC AGGGAACCCTGGTCACCGTCTCCTCA SEQ ID NO: 29321 |
| | | AA | DIQMTQSPSSVSASVGDRVTITCRASRDNGWLA WYQQKPGKAPKLLIYTVSSLQSGVPSRFSGSGSG TDFTLTISSLQPEDFATYYCQQSNSFPFTFGPGTK VDIK SEQ ID NO: 25316 | EVQLLESGGGLVQPGGSLRLSCAASGFTFSSYAMS WVRQAPGKGLDWVSVISGSGSTFYADSVKGRFTI SRDNSKSTLYLQMNSLRAEDTAVYYCASAIAAAGA HYFDYWGQGTLVTVSS SEQ ID NO: 29322 |

FIGURE 50
(Continued)

| | | | |
|---|---|---|---|
| iPS:434025 | 21-225_49G3 | NA | GATATTGTGATGACCCAGACTCCACTCTCTCT GTCCGTCACCCTGGAACAGCCGGCCTCCATGT CCTGCAAGTCTAGTCAGAGCCTCTGCATAGT GAAGGAAAGACCTATTTGTATTGTACCTGCA GAAGACAGGCCAGCTCCACACCTCCTGATCT ATGAAGTTTCCAACGGCTCTGGCGTGCCA GATAGGTTCAGTGGCAGCGGGTCAGGGACAG ATTTCACACTGAAAATCAGCCGGATGGAGGCT GAGGATGTTGGGGTTTATTTCTGCATGCAAAG TATGCAGCTTCCGATCACCTTCGGCCAGGGA CACGACTGGAGATTAAA SEQ ID NO: 25317 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAAGGTATAG CAGCAGCTGGTCGGGCGGAATGACGTCTGGGG CCAAGGGACCACGGTCACCGTCTCCTCA SEQ ID NO: 29323 |
| | | AA | DIVMTQTPLSLSVTPGQPASMSCKSSQSLLHSEG KTYLYWYLQKTGQPPHLLIYEVSNRLSGVPDRF SGSGSGTDFTLKISRMEAEDVGVYFCMQSMQLP ITFGQGTRLEIK SEQ ID NO: 25318 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSSS WSGGMDVWGQGTTVTVSS SEQ ID NO: 29324 |
| iPS:434027 | 21-225_49H5 | NA | GACATCCAGATGACCCAGTCTCCATCTTCCGT GTCTGCATCTGTAGGAGACAGAGTCACCATCA CTTGTCGGGCGAGTCAGGGTTTAGCAGCTGG TTAGCCTGGTTTCAGCAGAAACCAGGGAAAGC CCCTAAGCTCCTGATCTATGCTGCATCCAGTTT GCAAGATGGGGTCCCATCAAGGTTCAGCGGCA GTGGATCTGGGACAGATTTCACTCTCACCATC AGCAGCCTGCAGCCTGAAGATTTTGCAACTTA CTATTGTCAACAGACTAACAGTTTCCCGTTCA CTTTCGGCCCTGGGACCAAAGTGGATATCAAA SEQ ID NO: 25319 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GACCTGGGTCCGCCAGACTCCAGGGAAGGGGCT GGAGTGGGTCTCAGCTATTAGTGGTAGTGGTGGT AACTCATTCTACGCAGACTCCGTGAAGGGCCGGT TCACCATCTCCAGAGACAATTCCGAGAACACGTT GTATCTGCAAATGAACAGCCTGAGAGCCGAGGA CACGGCCGTATATTACTGTGCGAAAGCAAGGGC AGTGGCTGGGTCACACTGGTTCGACCCTGGGGC CAGGGAACCCTGGTCACCGTCTCCTCA SEQ ID NO: 29325 |

FIGURE 50
(Continued)

| | | | | |
|---|---|---|---|---|
| | | AA | DIQMTQSPSSVSASVGDRVTITCRASQGFSTWLA WFQQKPGKAPKLLIYAASSLQDGVPSRFSGSGS GTDFTLTISSLQPEDFATYYCQQTNSFPPTFGPGT KVDIK<br>SEQ ID NO: 25320 | EVQLLESGGGLVQPGGSLRLSCAASGFTFSSYAMT WVRQTPGKGLEWVSAISGSGGNSFYADSVKGRFTI SRDNSENTLYLQMNSLRAEDTAVYYCAKARAVAG SHWFDPWGQGTLVTSS<br>SEQ ID NO: 29326 |
| iPS-434029 | 21-225_49C6 | NA | GACATCCAGATGACCCAGTCTCCATCCTCCT GTCTGCATCTGTCGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGTTTCCCATCAAGGTTCAGCGG CAGTGGATCTGGGACAGATTCACTCTCACAA TCAGCAGCCTGCAGCCTGAAGATTTTGCAACT TATTACTGTCTACAGCATATAAGTTACCCTCTC ACTTTCGGCGGAGGGACCAAGGTGGAGATCA AA<br>SEQ ID NO: 25321 | CAGGTGCAGTTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATATGGTTTGATGTAAGT AATAAAAAGTATGTAGACTCCGTGAAGGGCCGA TTCACCATCTCCAGAGACAATTCCAAGAACACGC TGTATCTGCAAATGAGCAGCCTGAGAGCCGAGG ACACGGCTGTGTATTATTGTGCGAGAGATCTGGG GATGATCGAGGACTACTGGGGCCAGGGAACCCT GGTCACCGTCTCCTCA<br>SEQ ID NO: 29327 |
| | | AA | DIQMTQSPSSLSASVGDRVTITCRASQGIRNDLG WYQQKPGKAPKRLIYAASSLQSGFPSRFSGSGSG TEFTLTISSLQPEDFATYYCLQHNSYPLITFGGGT KVEIK<br>SEQ ID NO: 25322 | QVQLVESGGGVVQPGRSLRLSCAASGFTFSNYGM HWVRQAPGKGLEWVAVIWFDVSNKKYVDSVKGR FTISRDNSKNTLYLQMSSLRAEDTAVYYCARDLGM IEDYWGQGTLVTSS<br>SEQ ID NO: 29328 |

FIGURE 50
(Continued)

| | | | |
|---|---|---|---|
| iPS:434031 | 21-225_49E7 | NA | GATATTGTGATGACCCAGACTCCACTCTCT GTCTGTCACCCCTGGACAGCCGGCCTTCATGT CCTGCAAGTCCAGATCTTCTTGCATAGT GAAGGAAAGACCTATTTGTATTGGTACCTGCA GAAGACAGGCCAGCCTCCACACCTCCTGATCT ATGAAGTTTCCAACGGCTCTCTGGCGTGCCA GATAGGTTCAGTGGCAGCGGGTCAGGACAG ATTTCACACTGAAAATCAGCCGGATGGAGGCT GAGGATGCGGGATTCCGATTATCTTCGGCCAGGGGA TATGCAGCTTCCGATTATCTTCGGCCAGGGGA CACGACTGGAGATTAAA SEQ ID NO: 25323 | CAGGTGCAGCTGGTGGAGTCTGGGGGAGGCGTG GTCCAGCCTGGGAGGTCCCTGAGACTCTCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAG ACACGGCTCTGTATTACTGTGCGAGAAGGTATAG CAGCAGCTGGTCGGGCGGTATGGACGTCTGGGG CCAAGGGACCACGGTCACCGTCCTCA SEQ ID NO: 29329 |
| | | AA | DIVMTQTPLSLSVTPGQPAFMSCKSSQIFLHSEG KTYLYWYLQKTGQPPHLLIYEVSKRLSGVPDRF SGSGSGTDFTLKISRMEAEDVGVYYCMQSMQLP IIFGQGTRLEIK SEQ ID NO: 25324 | QVQLVESGGGVVQPGRSLRLSCAASGFTFSSYGMH WVRQAPGKGLEWVAVIWYDGSNKYYADSVKGRF TISRDNSKNTLYLQMNSLRAEDTALYYCARRYSSS WSGGMDVWGQGTTVTVSS SEQ ID NO: 29330 |
| iPS:434033 | 21-225_49F9 | NA | GATATTGTGATGACCCAGACTCCACTCTCT GTCCGTCACCCCTGGACAGCCGGCCTCCATCT CCTGCAAGTCCAGATCAGAGCCTCGTGCATAAT GAAGGAAAGACCTATTTGTATTGGTATTTGCA GAAGCCAGGCCAGCCTCCAACGGTTCTCTGAGTCCA TTGAAGTTTCCAACCGGTTCTCTGGAGTGCCA GATAGGTTCAGTGGCAGCGGGTCAGGGACAG ATTTCACACTGAAATCAGTGGGGTGGAGGCT GAGGATGTTGGGGTTTATTACTGCATGCAAAG TATACAGTATCCGATCACCTTCGGCCAAGGGA CACGACTGGAGATTAAA SEQ ID NO: 25325 | CAGGTGCAGCTGGTGGAGTCTGGGGGAGGCGTG GTCCAGCCTGGGAGGTCCCTGAGACTCTCTGTG CAGCGTCTGGATTCACCTTCAGTAGTTATGGCAT GCACTGGGTCCGCCAGGCTCCAGGCAAGGGGCT GGAGTGGGTGGCACTTATATGGTATGATGGAAG AATAAATACTATGCAGACTCCGTGAAGGGCCG ATTCACCATCTCCAGAGACAATCCAAGAACACG CTGTATCTGCAAATGAACAGCTGAGAGCCGAG GACACGGCTGTGTATCACTGTGCGAGAAGGTATA GCAGCAGCTGGTCGGGCGGTATGGACGTCTGGG GCCAAGGGACCACGGTCACCGTCCTCCTCA SEQ ID NO: 29331 |

FIGURE 50
(Continued)

| | | | | |
|---|---|---|---|---|
| | | | AA | DIVMTQTPLSLSVTPGQPASISCKSNQSLVHNEGKTYLYWYLQKPGQPPQLLIFEVSNRFSGVPDRFSGSGSGTDFTLKISRVEAEDVGVYYCMQSIQYPITFGQGTRLEIK<br>SEQ ID NO: 25326 | QVQLVESGGGVVQPGRSLRLSCAASGFTFSSYGMHWVRQAPGKGLEWVALIWYDGRNKYYADSVKGRFTISRDNPKNTLYLQMNSLRAEDTAVYHCARRYSSSWSGGMDVWGQGTTVTVSS<br>SEQ ID NO: 29332 |
| iPS:434035 | 21-225_49F10 | NA | GACATCCAGATGACCCAGTCTCCATCTTCCGTGTCTGCATCTGTAGGAGACAGAGTCACCATCACTTGTCGGGCGAGTCAGGGTATTAGCAGGTGGTTAGCCTGGTATCAGCAGAAACCAGGGAAAGCCCCTAAGGTCCTGATCTATGCTGCATCCACTTTGCAAAGTGGGGTCCATCAAGGTTCAGCGGCAGTGGATCTGGGACAGATTTCACTCTCACCATCAGCAGCCTGCAACCTGAAGATTTTGCAACTTACTATTGTCAACAGGCTAACAGTTTCCCATTCACTTTCGGCCCTGGGACCAAAGTGGATATCAAA<br>SEQ ID NO: 25327 | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACCATATGCACTGGGTGCGACAGGCCCCTGGACAAGGGCTTGAGTGGATGGGATGGATCAACCCTAATAACAATGCCACAAACTATGCTCAGAACTTTCAGGGCAGGGTCACCCTGACCAGGGACACGTCCATCAGCACAGCCTACATGGAGCTGAGCAGGCTGAGATCTGACGACACGGCCGTGTATTACTGTGCGAGAGACGGTACCAGCAGCTTTGACTTCTGGGGCCAGGGAACCCTGGTCACCGTCTCCTCA<br>SEQ ID NO: 29333 |
| | | AA | DIQMTQSPSSVSASVGDRVTITCRASQGISRWLAWYQQKPGKAPKVLIYAASTLQSGVPSRFSGSGSGTDFTLTISSLQPEDFATYYCQQANSFPFTFGPGTKVDIK<br>SEQ ID NO: 25328 | QVQLVQSGAEVKKPGASVKVSCKASGYTFTGYHMHWVRQAPGQGLEWMGWINPNNNATNYAQNFQGRVTLTRDTSISTAYMELSRLRSDDTAVYYCARDGTSSFDFWGQGTLVTVSS<br>SEQ ID NO: 29334 |

FIGURE 50
(Continued)

| | | | | |
|---|---|---|---|---|
| iPS:434037 | 21-225_49G12 | NA | GACATCCAGATGACCCAGTCTCCATCTCCT GTCTGCGTCTGTAGGAGACAGAGTCACCATCA CTTGCCGGTCAAGTCAGAGCATTAGTAGCTAT TTAATGTGGTATCAGCAGAAACCAGGAAAG CCCCTAAGCTCCTGATCTATGCTGCATCCAGTT TGCAAATTGGGGTCCCATCAAGATTCAGTGCC AGTGGATCTGGGACAGATTTCACTCTCACCAT CAGCAGTCTGCAACCTGAAGATTTTGCAACTT ACTACTGTCAACAGAGTTACAGTATCCATTC ACTTTCGGCCCTGGGACCAAAGTGGATATCAA A SEQ ID NO: 25329 | GAGGTGCAGCTGTTGGAGTCTGGGGGAGGCTTG GTACAGCCTGGGGGGTCCCTGAGACTCTCCTGTA CAGCCTCTGGATTCACCTTTAGCAGCTATGCCAT GAGCTGGGTCCGCCAGGCTCCAGGGAAGGGGCT GGAGTGGGTCTCAGTTATTAGTGGTAGTGGTGGT ACCACATTCTACGCAGACTCCGTGAAGGGCCGG TCACCATCTCCAGAGACAATTCCAAGAACACACT GTATCTGCAAATGAACAGCCTGAGAGCCGAGGA CACGGCCGTATATTACTGTGCGCGTCGTATAGCA GTGGCTGGGAATGATGCTTTTGATATCTGGGGCC AAGGGACAATGGTCACCGTCTCTTCA SEQ ID NO: 29335 |
| | | AA | DIQMTQSPSSLSASVGDRVTITCRSSQSISTYLM WYQQKPGKAPKLLIYAASSLQIGVPSEFSASGSG TDFTLTISSLQPEDFATYYCQQSYSIPFTFGPGTK VDK SEQ ID NO: 25330 | EVQLLESGGGLVQPGGSLRLSCTASGFTFSSYAMS WVRQAPGKGLEWVSVISGSGGTTFYADSVKGRLTI SRDNSKNTLYLQMNSLRAEDTAVYYCARRIAVAG NDAFDIWGQGTMVTVSS SEQ ID NO: 29336 |
| iPS:434039 | 21-225_43B1 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAG TCAGCAGCCTGCAGCCTGAAGATTTTGCAACT TATTTCTGTCTACAGCATACTAGTTTCCCATTC ACTTTCGGCCCTGGGACCAAAGTGGATATCAA A SEQ ID NO: 25331 | CAGGTGCAGCTGGTGGAGTCTGGGGGAGGCTTG GTCAAGCCTGGAGGGTCCCTGAGACTCTCCTGTG CAGCCTCTGGATTCACCTTCAGTGACTACTACAT GAACTGGATCCGCCAGGCTCCAGGGAAGGGGCT GGAGTGGGTTTCATACATTAGTAGTAATGTTTT ACCATATACTACGCAGACTCTGTGAAGGGCCGAT TCACCATCTCCAGGGACAACGCCAAGAACTCACT GTATCTGCAAATGAACAGCCTGAGAGCCGAGGA CACGGCCGTGTATTACTGTGCGGCCGATACAATC TACTGGGGCCAGGGAACCCGGGTCACCGTCTCCT CA SEQ ID NO: 29337 |

FIGURE 50
(Continued)

| | | | | |
|---|---|---|---|---|
| iPS:434041 | 21-225_50H8 | AA | DIQMTQSPSSLSASVGDRVTITCRASQGIRNDLG WYQQKPGKAPKRLIYAASSLQSGVPSRFSGSGS GTEFTLTVSSLQPEDFATYFCLQHTSPFTFGPGT KVDIK<br>SEQ ID NO: 25332 | QVQLVESGGGLVKPGGSLRLSCAASGFTFSDYYMN WIRQAPGKGLEWVSYINSNGFTIYADSVKGRFTIS RDNAKNSLYLQMNSLRAEDTAVYYCAADTIYWGQ GTRVTVSS<br>SEQ ID NO: 29338 |
| | | NA | GACATCCAGATGACCCAGTCTCCATCCTCCCT GTCTGCGTCTGTAGGAGACAGAGTCAACATCA CTTGCCGGGCAAGTCAGAGCATTAGCAGTTAT TTAATTTGGTATCAGCAGAAACCAGGAAAGC CCCTAAGCTCCTGATCTATGCTGCATCCAGTCT GCAAAGTGGGGTCCCATCAAGGTTCAGTGCCA GTGGATCTGGGACAGATTTCACTCTCACCATC AGCAGTCTGCAACAGAGTAACAGTCTTCCATTCA CTACTGTCAACAGAGTAACAGTCTTCCATTCA CTTTCGGCCCTGGGACCAAAGTGGATATCAAA<br>SEQ ID NO: 25333 | GAGGTGCAGCTGTTGGAGTCTGGGGGAGGCTTG GTACAGCCTGGGGGGTCCCTGAGACTCTCCTGTG CAGCCTCTAGATTCACCTTTAGCAGTTATGCCAT GAGCTGGGTCCGCCAGGCTCCAGGGAAGGGGCT GGAGTGGGTCTCAGTTATTAGTGGTCGTGGTGGT ACCACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGCGTCGTATAGCA GTGGGCTGGGAATGAGGCTTTTGATATCTGGGGCC AAGGGACAATGGTCACCGTCTCCTCA<br>SEQ ID NO: 29339 |
| | | AA | DIQMTQSPSSLSASVGDRVNITCRASQSISSYLIW YQQKPGKAPKLLIYAASSLQSGVPSRFSASGSGT DFTLTISSLQPEDFASYYCQQSNSLPFTFGPGTKV DIK<br>SEQ ID NO: 25334 | EVQLLESGGGLVQPGGSLRLSCAASRFTFSSYAMS WVRQAPGKGLEWVSVISGRGTTFYADSVKGRFTI SRDNSKNTLYLQMNSLRAEDTAVYYCARRIAVAG NEAFDIWGQGTMVTVSS<br>SEQ ID NO: 29340 |

FIGURE 50
(Continued)

| | | | |
|---|---|---|---|
| iPS:434043 | 21-225_50G10 | NA | GACATCCAGATGACCCAGTCTCCATCTCCCT GTCTGCATCTGTAGGAGACAGAGTCACCATCA CTTGCCGGGCAAGTCAGGGACATTAGAAATAAT TTAGGCTGGTATCAGCAGAAACCAGGGAAAG TCCCTAAGCGCCTGATCTATGCTGCATCCAGTT TGCAAAGTGGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGTATAATAGTTACCCGTTCA CTTTCGGCGGAGGGACCAAGGTGGAGAGCAA A | GAGGTGCAGCTGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCTGGAAGGGCT GGAGTGGGTCTCATCCATTAGTGGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGTAGCAACT TTTGACTACTGGGGCCAGGGAACCCTGGTCACCG TCTCCTCA |
| | | | SEQ ID NO: 25335 | SEQ ID NO: 29341 |
| | | AA | DIQMTQSPSSLSASVGDRVTITCRASQGIRNNLG WYQQKPGKVPKRLIY AASSLQSGVPSRFSGSGS GTEFTLTISSLQPEDFATYYCLQYNSYPFTFGGGT KVESK | EVQLVESGGGLVKPGGSLRLSCAASGFTFSSYSMN WVRQAPGKGLEWVSSISGSSSYIYYADSVKGRFTIS RDNAKNSLYLQMNSLRAEDTAVYYCARVATFDY WGQGTLVTVSS |
| | | | SEQ ID NO: 25336 | SEQ ID NO: 29342 |
| iPS:434045 | 21-225_50H10 | NA | GACATCCAGATGACCCAGTCTCCATCTCCCT GTCTGCGTCTGTAGGAGACAGAGTCACCATCA CTTGCCGGGCAAGTCAGAGCATTTACACAGCTAT TTAATTTGGTATCAGCAGAAACCAGGGAAAGC CCCTAAGCTCCTGATCTATGCTGCATCCAGTTT GCAAAGTGGGGTCCCATCAAGGTTCAGTGCCA GTGGATCTGGGACAGATTTCACTCTCACAGTTA AGCAGTCTGCAACCTGAAGATTTTGCAAGTTA CTACTGTCAACAGAGTAACAGTATTCCATTCA CTTTCGGCCCTGGGACCAAAGTGGATATCAAA | GAGGGGCAGTTGTTGAGTCTGGGGGAGGCTTG GTACAGCCTGGGGGGTCCCTGAGACTCTCCTGTG CAGCCTCTAGATTCACCTTTAGCAGTTATGCCAT GAGCTGGGTCCGCCAGGCTCCAGGGAAGGGCT GGAGTGGGTCTCAGTTATTATTAGTGGTCGTGGTGT AGCACATTCTACGCAGACTCCGTGAAGGGCCGGT TCACCATCTGCAAATGAACAGCCTGAGAGCCGAGGA GTATCTGCAAATGAACAGCCTGAGAGCCGAGGA CACGGCCGTATATTACTGTGCGCGTCGTATAGCA GTGGCTGGGAATGAGGCTTTTGATATCTGGGGCC AAGGGACAATGGTCACCGTCTCTTCA |
| | | | SEQ ID NO: 25337 | SEQ ID NO: 29343 |

FIGURE 50
(Continued)

| | | | | | |
|---|---|---|---|---|---|
| | | AA | DIQMTQSPSSLSASVGDRVNITCRASQSIYSYLIW YQQKPGKAPKLLIYAASSLQSGVPSRFSASGSGT DFTLTISSLQPEDFASYYCQQSNSIPFTFGPGTKV DIK<br><br>SEQ ID NO: 25338 | EGQLLESGGGLVQPGGSLRLSCAASRFTFSSYAMS WVRQAPGKGLEWVSVISGRGGSTFYADSVKGRFTI SRDNSKNTLYLQMNSLRAEDTAVYYCARRIAVAG NEAFDIWGQGTMVTVSS<br><br>SEQ ID NO: 29344 | |
| iPS:434047 | 21-225_50A12 | NA | GACATCCAGATGACCCAGTCTCCATCCTCCT GTCTGCATCTGTAGGAGACAGAGTCACCATCA CTTGCCGGGCAAGTCAGGCATTAGAAATGAT TTAGGCTGGTATCAGCAGAAACCAGGGAAAG CCCCTAAGCGCCTGATCTATATCTGCATCCAAT TTACAAAGTGGGGTCCCATCAAGGTTCAGCGG CAGTGGATCTGGGACAGAATTCACTCTCACA TCAGCAGCCTGCAGCCTGAAGATTTTGCAACT TATTACTGTCTACAGCATAATAGTTACCCGTG GACGTTCGGCCAAGGGACCAAGGTGGAAATC AAA<br><br>SEQ ID NO: 25339 | CAGGTGCAACTGGTGCAGTCTGGGGCTGAGGTG AAGAAGCCTGGGGCCTCAGTGAAGGTCTCTGC AAGGCTTCTGATACACCTTCACCGGCCACTATA TAAACTGGGTGCGACAGGCCCCTGACAAGGGC CTGAGTGGATGGCATGGGTCAACCTAACAGTG GTGGCACAAACTCTGCACAGAAGTTCAGGGCA GGGTCACCATGACCAGGACACGTCCATCAGCA CAGTCTACATGGAGCTGAGCAGGCTGAGATCTG ACGACACGGCCGTGTATTACTGTGCGAGGGAG GGCAGCTCGGCGGGTTTAACTACTACTACTACGG TATGGACGTCTGGGGCCAAGGGACCACGGTCAC CGTCTCCTCA<br><br>SEQ ID NO: 29345 | |
| | | AA | DIQMTQSPSSLSASVGDRVTITCRASQGIRNDLG WYQQKPGKAPKRLIYTASNLQSGVPSRFSGSGS GTEFTLTISSLQPEDFATYYCLQHNSYPWTFGQG TKVEIK<br><br>SEQ ID NO: 25340 | QVQLVQSGAEVKKPGASVKVSCKASGYTFTGHYIN WVRQAPGQGPEWMAWVNPNSGGTNSAQKFQGRV TMTRDTSISTVYMELSRLRSDDTAVYYCARGGQLG GFNYYYGMDVWGQGTTVTVSS<br><br>SEQ ID NO: 29346 | |

FIGURE 50
(Continued)

| | | | |
|---|---|---|---|
| iPS:434049 | 21-225_50B12 | NA | GACATCCAGATGACCCAGTCTCCATCCTCCCT GTCTGCATCTGTGGGAGACAGAGTCACCATCA CTTGTCGGGCAAGTCAGAGCATTAGTTATTAT TTAAATTGGTATCAGCATAAACCAGGAAAGC CCCTAGGCTCCTGATCTATGCTGCATCCAGTT GCAAAGTGGGGTCCCATCAAGGTTCAGTGGCA GTGAATCTGGGACAGATTTCATTCTCACTATC AGCAGTCTGCAACCTGAAGATTTTACAACTTA TTACTGTCAACAGAGTTACATTGCCCATTCCA CTTTCGGCCCTGGGACCAAAGTGGATATCAAA<br><br>SEQ ID NO: 25341 | GAGGTGCAGCTGGTGGAGTCTGGGGGAGGCTG GTCCAAGCCTGGGGGGTCCCTGAGACTCTCCTGT GCAGCCTCTGGATTCACCTTCAGTAGCCATAGCAT GAACTGGGTCCGCCAGGCTCCAGGGAAGGGGCT GGAGTGGGTCTCATCCATCAGTAGTAGTAGTAAT TACATATACTACGCAGACTCAGTGAAGGGCCGAT TCACCATCTCCAGAGACTACGCCAAGAACTCACT TTATCTGCAAATGAACAGCCTGAGAGCCGAGGA CACGGCTGTGTATTACTGTGCGAGAGATCGGAGC ATAGTAGTGGCTGGTCCCTGGGACTACTACGGTA TGGACGTCTGGGGGCCAAGGGACCACGGTCACCG TCTCCTCA<br><br>SEQ ID NO: 29347 |
| | | AA | DIQMTQSPSSLSASVGDRVTITCRASQSISSYLNW YQHKPGKAPRLLIYAASSLQSGVPSRFSGSESGT DFILTISSLQPEDFTTYCQQSYIAPFTFGPGTKV DIK<br><br>SEQ ID NO: 25342 | EVQLVESGGGLVKPGGSLRLSCAASGFTFSSHSMN WVRQAPGKGLEWVSSISSSSNYIYYADSVKGRFTIS RDYAKNSLYLQMNSLRAEDTAVYYCARDRSIVVA GPWDYYGMDVWGQGTTVTSS<br><br>SEQ ID NO: 29348 |
| iPS:434053 | 21-225_51E1 | NA | GATAATTGTGATGACCCAGACTCCACTCTCTCT GTCCGTCACCCCTGGACAGCCGGCCTCCATCAGT CCTGCAAGTCTAGTCAGAGCCTCCTGCATAGT GAGGGAAAGACCTATTTGTATTGGTACCTGCG GAAGCCAGGCCAGCCTCCACAGTTCTGATCT TTGAAGTTTCCAACCGGTTCTCTGGAGTGCCA GATAGGTTCAGTGGCAGCGGGTCAGGGACAG AATTCACACTGAAAATCAGCCGGGTGGAGGCT GAGGATGTTGGGGTTTATTACTGCATGCAAAG TATACAGCTTCCATTCACTTCGGCCCTGGGAC CAAAGTGGATATCAAA<br><br>SEQ ID NO: 25343 | CAGGTGCAGCTGGTGGAGTCTGGGGGAGGCGTG GTCCAGCCTGGGAGGTCCCTGAGACTCTCCTGTG CAGCGTCTGATTCACCTTCAGTAGTTATGGCAT GCACTGGGTCCGCCAGGCTCCAGGCAAGGGGCT GGAGTGGGTGGCAGTTATATGGTATGATGGAAGT AGTAAATACTATGCAGACTCCGTGAAGGGCCGA TTCACCATCTCCAGAGACAACAATTCCAAGAACGC TGTATCTGCAAATGAACAGCCTGAGAGCCGAGG ACACGGCTGTGTATTACTGTGCGAGAAGGTATAG CAGCAGTTGGTCCGGCGGTATGGACGTCTGGGG CCAAGGGACCACGGTCACCGTCTCCTCA<br><br>SEQ ID NO: 29349 |

FIGURE 50
(Continued)

| | | | |
|---|---|---|---|
| iPS:434055 | 21-225_51B4 | AA | DIVMTQTPLSLSVTPGQPASMSCKSSQSLLHSEG KTYLYWYLRKPGQPPQFLIFEVSNRFSGVPDRFS GSGSGTEFTLKISRVEAEDVGVYYCMQSIQLPFT FGPGTKVDIK<br>SEQ ID NO: 25344 | QVQLVESGGGVVQPGRSLRLSCAASGFTFSSYGMH WVRQAPGKGLEWVAVIWYDGSSKYYADSVKGRF TISRDNSKNTLYLQMNSLRAEDTAVYYCARRYSSS WSGGMDVWGQGTTVTVSS<br>SEQ ID NO: 29350 |
| | | NA | GACATCCAGATGACCCAGTCTCCATCCTCCCT GTCTGCATCTGTAGGAGACAGAGTCACCATCA CTTGCCAGGCGAGTCGGGACATTACCTTCTAT TTAAATTGGTATCAGCAGAAACCAGGGAAAG CCCCTAAGCTCCTGATCTACGATGCATCCAAT TTGGAAACAGGGGTCCCATCAAGGTTCAGTGG CAGTGGATCTGGGACAGATTTTACTTTCACCA TCAGCTGCGTGCATCTGAAGATATTGCAACA TATTTATGTCAACAGTATGATAATCTTCCATTC ACTTTCGGCCCAGGGACCACAGTGGATATCAA A<br>SEQ ID NO: 25345 | GAGGTGCAGCTGTTGGAGTCTGGGGGAGGCTTG GTACAGCCTGGGGGGTCCCTGAGTCTCTCCTGTG CAGCCTCTGGATTCACCTTTAGAAGCTATGTCAT GAGCTGGGTCCGCCAGGCTCCAGGGAAGGGGCT GGAGTGGGTCTCAGTTAGTGGTCGTGGTAGT AACACATTCTACACAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGAAAGGGATAACT GGATCACACGGTGCTTTGATATCTGGGGCCAAG GGACAATGGTCACCGTCTCTTCA<br>SEQ ID NO: 25346 | SEQ ID NO: 29351 |
| | | AA | DIQMTQSPSSLSASVGDRVTITCQASRDITFYLN WYQQKPGKAPKLLIYDASNLETGVPSRFSGSGS GTDFTFTISCVHPEDIATYLCQQYDNLPFTFGPGT TVDIK<br>SEQ ID NO: 25346 | EVQLLESGGGLVQPGGGSLSLCAASGFTFRSYVMS WVRQAPGKGLEWVSAISGRGSNTFYTDSVKGRFTI SRDNSKNTLYLQMNSLRAEDTAVYYCAKGITGSH GAFDIWGQGTMVTVSS<br>SEQ ID NO: 29352 |

FIGURE 50
(Continued)

| | | | |
|---|---|---|---|
| iPS:434057 | 21-225_51E4 | NA | GACATCCAGATGACCCAGTCTCCATCCTCCCT GTCTGCATCTGTGGGAGACAGAGTCACCATCA CTTGCCGGGCAAGTCAGGGCATTAGAAATGAT TTAGGCTGGTATCAGCAGAAACCAGGGAAAG CCCCTCAGCGCCTGATCTATGCTGCATCCAGTT TGCAAAGTGGGGTCCATCAAGGTTCAGCGGC AGTGGATCTGGGACAGAATTCACTCTCACAAT CAGCAGCCTGCAGCCTGAGGATTTTGCAGTT ATTATTGTCTACAGCATAATAGTTACCCATTCA CTTTCGGCCCTGGGACCAAAGTGGATATCAAA<br><br>SEQ ID NO: 25347 | CAGGTGCAGCTGGTGGAGTCTGGGGGAGGCGTG GTCCAGCCTGGGAGGTCCCTGCGACTCTCCTGTG CAGGGTCTGATTCACCTTCAGTAGTATGGCAT GCACTGGGTCCGCCAGGCTCCAGGCAAGGGGCT GGAGTGGGTGGCAGTTATATGCAGACTCCGTGAAAGT AATAAATACTATGCAGAGACAATTCCAAGAACGC TTCACCATCTCCAGAGACAATGAACAGCCGAGG TGTATCTGCAAATGAACAGCTGTGCGAGGAACTGGG ACACGGCTGTGTATTACTGTGCGAGGAACTGGG ATTTCTCTGACTACTGGGGCCAGGGAACCCTG GTCACCGTCCCTCA<br><br>SEQ ID NO: 29353 |
| | | AA | DIQMTQSPSSLSASVGDRVTITCRASQGIRNDLG WYQQKPGKAPKRLIYAASSLQSGVPSRFSGSGS GTEFTLTISSLQPEDFAAYYCLQHNSYPFTFGPGT KVDIK<br><br>SEQ ID NO: 25348 | QVQLVESGGGVVQPGRSLRLSCAASGFTFSSYGMH WVRQAPGKGLEWVAVIWYDESNKYYADSVKGRF TISRDNSKNTLYLQMNSLRAEDTAVYYCARELGFL SDYWGQGTLVTVSS<br><br>SEQ ID NO: 29354 |
| iPS:434059 | 21-225_51C5 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAGC CCCTAAGTCCCTTATCTATGCTGCATCCAGTT TGCAAAGTGGGGTCCCATCAAGGTTCAGCGGCA GTGGATCTGGAACAGATTTCATTCTCACCATC AGCAGCCTGCAGCCTGAAGATTTTGCAACTTA TTACTGCCAAACAGTATTATAGTTACCATTCAC TTTCGGGCCCTGGGACCAAAGTGGATATCAAA<br><br>SEQ ID NO: 25349 | GAGGTGCAGTTGTTGGAGTCTGGGGGAGGCTTGG TACAGCCTGGGGGGGTCCCTGAGACTCTCCTGTGC AGCCTCTGATTCACCTTAGCAGTATGTCATG AGCTGGGTCCGCCAGACTCCAGGAAGGGCTG GAGTGGGTCTCAACTATGCAGACTCCTGAACGGCCGATT GCACATACTACGCAGACTCCGTGAACGGCCGATT CACCGTCTCCAGAGACAATTCCAAGAACACGCTG TATTTGCAAATGAGCAGCCTGAGAGCCGAGGAC ACGGCCGTATATTACTGTGCGCGGGTGACTGCTT TTGACTACTGGGGCCAGGGAACCCTGGTCACCGT CTCCTCA<br><br>SEQ ID NO: 29355 |

FIGURE 50
(Continued)

| | | | | |
|---|---|---|---|---|
| | | | AA | DIQMTQSPSSLSASVGDRVTITCRASQGISNYLA WFQQKPGEAPKSLIYAASSLRSGVPSQFSGSGSG TDFILTISSLQPEDFATYYCQQYYSYPFTFGPGTK VDIK<br>SEQ ID NO: 25350 | EVQLLESGGGLVQPGGSLRLSCAASGFTFSSYVMS WVRQTPGKGLEWVSTMSGSGGRTYYADSVNGRFT VSRDNSKNTLYLQMSSLRAEDTAVYYCARVTAFD YWGQGTLVTVSS<br>SEQ ID NO: 29356 |
| iPS:434061 | 21-225_51C7 | | NA | GACATCCAGATGACCCAGTCTCCATCTTCCGT GTCTGCATCTGTAGGAGACAGAGTCACCATCA CTTGTCGGGCGAGTCAGGATCAGATGTTAACAACTAC TTAGCCTGGTTTCAGCAGAAACCAGGGAAAGC CCCTAAGCTCCTGATCTATGCTGCATCCAGTTT GCAAAATGGGGTCCCATCAAGGTTCAGCGGCA GTGGATCTGGGACAGATTTCACTCTCACCATC AGCAGCCTGCTGAACAAACTAACAGTTTCCCATTCA CTATTGTCAACAACTAACAGTTTCCCATTCA CTTTCGGCCCTGGGACCAAAGTGGATATCAAA<br>SEQ ID NO: 25351 | GAGGTCAGCTGTGTTGGAGTCTGGGGGAGGCTTG GTGCAGCCTGGGGGGTCCCTGAGACTCTCCTGTG CAGCCTCTGGATTCACCATTAGCAACTATGCCAT GACCTGGGTCCGCCAGACTCCAGGGAAGGGGCT GGAGTGGGTCTCAGTTATTAGTGCTAGTGGTGGT AACTCATTCTACGCAGACTCCGTGAAGGGCCGT TCACCATCTCCAGAGACAATTCCGAGAACACGTT CTATCTGCAAATGAACAGCTGAGAGCCGAGGA CACGGCCGTATATTACTGTGCGAAAGCAAGGGC AGTGGCTGGGTCACACTGGTTCGACCCCTGGGGC CAGGGAACCCTGGTCACCGTCTCCTCA<br>SEQ ID NO: 29357 |
| | | | AA | DIQMTQSPSSVSASVGDRVTITCRASQDVNNYL AWFQQKPGKAPKLLIYAASSLQNGVPSRFSGSG SGTDFTLTISSLPEDFATYYCQQTNSFPFTFGPG TKVDIK<br>SEQ ID NO: 25352 | EVQLLESGGGLVQPGGSLRLSCAASGFTISNYAMT WVRQTPGKGLEWVSVISASGGNSFYADSVKGRFTI SRDNSENTFYLQMNSLRAEDTAVYYCAKARAVAG SHWFDPWGQGTLVTVSS<br>SEQ ID NO: 29358 |

FIGURE 50
(Continued)

| | | | |
|---|---|---|---|
| iPS:434063 | 21-225_51G7 | NA | GACATCCAGATGACCCAGTCTCCATCTTCCGT GTCTGCATCTGTAGGAGACAGAGTCACCATCA CTTGTCGGGCGAGTCAGGATATTAGCAGTTGG TTAGCCTGGTATCAGCAGAAACCAGGGAAAG CCCCTAAGGTCCTGATCTATGCTCCATCCAATT TGCAAAGTGCGGTCCATCAAGGTTCAGCGGC AGTGGATCTGGGACAGATTTCACTCTCACCAT CAGCAGCCTGCAGCCTGAAGATTTTGCAACTT ACTATTGTCAACAGGCTCACAGTTTCCGTGG ACGTTCGGCCAAGGGACCAAGGTGGAAATCA AA | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCATTAGTAGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGCTCGCCTT GACTACTGGGGCCAGGGAACCCTGGTCACCGTCT CCTCA |
| | | | SEQ ID NO: 25353 | SEQ ID NO: 29359 |
| | | AA | DIQMTQSPSSLSASVGDRVTITCRASQDISSWLA WYQQKPGKAPKVLIYAPSNLQSAVPSRFSGSGS GTDFTLTISSLQPEDFATYYCQQAHSFPWTFGQG TKVEIK | EVQLVESGGGLVKPGGSLRLSCAASGFTFSSYSMN WVRQAPGKGLEWVSSISSSSSYIYYADSVKGRFTIS RDNAKNSLYLQMNSLRAEDTAVYYCARARLDYW GQGTLVTVSS |
| | | | SEQ ID NO: 25354 | SEQ ID NO: 29360 |
| iPS:434065 | 21-225_50D4 | NA | GACATCCAGATGACCCAGTCTCCATCTTCCGT GTCTGCATCTGTGGGAGACAGACTCACCATCA CTTGTCGGGCGAGTCAGGTATTAGCAGGTGG TTAGCCTGGTATCAGCAGAAACCAGGGAAAG CCCCTAAGGTCCTGATCTATGCTGCATCCACTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAG A | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACCATA TGCACTGGGTGCGACAGGCCCCTGGACAAGGGC TTGAGTGGATGGGATGGATCAACCCTAATAATAA TGCCACAAACTATGCTCAGAGGTTTCAGGCAGG GTCACCCTGACCAGGGACACGTCCATCAGCACA GCCTACATGGAGCTGAGCAGGCTGAGATCTGAC GACACGGCCGTGTATTACTGTGCGAGAGACGGT ACCAGCAGCTTTGACTTCTGGGGCCAGGGAACCC TGGTCACCGTCTCCTCA |
| | | | SEQ ID NO: 25355 | SEQ ID NO: 29361 |

FIGURE 50
(Continued)

| | | | | |
|---|---|---|---|---|
| iPS:434067 | 21-225_51H8 | AA | DIQMTQSPSSVSASVGDRLTITCRASQGISRWLA WYQQKPGKAPKVLIYAASTLQSGVPSRFSGSGS GTDFTLTISSLQPEDFATYYCQQANSFPFTFGPGT KVDIR<br>SEQ ID NO: 25356 | QVQLVQSGAEVKKPGASVKVSCKASGYTFTGYHM HWVRQAPGQGLEWMGWINPNNNATNYAQSFQGR VTLTRDTSISTAYMELSRLRSDDTAVYYCARDGTSS FDFWGQGTLVTVSS<br>SEQ ID NO: 29362 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTGGGCTGTGGTATCAGCAGAAACCAGGGAAAG CCCCTAAGCGCCTGATCTATGCTGCTTCCAGTT TGCAAAGTGGGGTCCCATCAAGGTTCAGCGGC GGTGGATCTGGGACAACTTCACTCTCACAAT CAGCAGCCTGCAGCCTGAAGATTTTGCAACTT ATTACTGTCTACAGCATAATAGTTACCCGTGG ACGTTCGGCCAAGGGACCAAGGTGGAAATCA AA<br>SEQ ID NO: 25357 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCCACTATA TGAACTGGGTGCGACAGGCCCCTGGACAAGGAC TTGAGTGGATGGGATGGGTCAACCTAACAGTGG TGGCTCAAACTTGCACAGCAGTTTCAGGGCAGG GTCACCATGACCAGGGACACGTCCATCAGCACA GTCTACATGGAGCTGAGCAGGCTGAGTCTGACG ACACGGCCGTGTATTACTGTGCGAGGGAGGGC AGTCGGCGGCTTTAACTTCTACTACTACGGTAT GGACGTCTGGGGCCAAGGGACCACGGTCACCGT CTCCTCA<br>SEQ ID NO: 29363 |
| | | AA | DIQMTQSPSSLSASVGDRVTITCRASQGIRNDLG WYQQKPGKAPKRLIYAASSLQSGVPSRFSGGGS GTHFTLTISSLQPEDFATYYCLQHNSYPWTFGQG TKVEIK<br>SEQ ID NO: 25358 | QVQLVQSGAEVKKPGASVKVSCKASGYTFTGHYM NWVRQAPGQGLEWMGWVNPNSGGSNSAQQFQGR VTMTRDTSISTVYMELSRLSSDDTAVYYCARGGQL GGFNFYYGMDVWGQGTTVTVSS<br>SEQ ID NO: 29364 |

FIGURE 50
(Continued)

| | | | |
|---|---|---|---|
| iPS:434069 | 21-225_51E9 | NA | GACATCCAGATGACCCAGTCTCCATCTTCCGT GTCTGCCTCTGTAGGAGACAGAGTCACCATCA CTTGTGTCGGGCGAGTCAGGGTATTAGCAGTTGG TTAGCCTGGTATCAGCAGAAACCAGGGAAAG CCCCTAAGCTCCTGATCTATTGTGCATCCAGTT TGCAAAGTGGGGTCCCATCAAGGTTCACTCTCACCAT AGTGGATCTGGGACAGATTTCACTCTCACCAT CAGGAGCCTGCAGCCTGAAGATTTTGCAACTT ACTATTGTCAACAGGCTAAAAGTTTCCCATTC ACTTTCGGCCCTGGGACCAAAGTGGATATCAA A | CAGGTGCAGCTGGTGCAGTCTGGGGCTGAGGTG AAGAAGCCTGGGGCCTCAGTGAAGGTCTCCTGC AAGGCTTCTAGATACACCTTCACCGGCTACCATA TACACTGGGTGCGACAGGCCCCTGGACAAGGGC TTGAGTGGATGGGATGGATCAACAGAGAACCTAACACTAA TGGCACACAGTATGCACAGGAGACAGTCATCAGCAC GGTCACCATGACCAGGGACACGTCATCAGCAC AGCCTACATGGAGCTGAGCAGGCTGAGATCTGA CGAACACGGCCGTGTATTACTGTGCGAGAGATGGC ACCTCGTCCTTTGACTACTGGGGCCAGGGAACCC TGGTCACCGTCTCCTCA |
| | | | SEQ ID NO: 25359 | SEQ ID NO: 29365 |
| | | AA | DIQMTQSPSSVSASVGDRVTITCRASQGISSWLA WYQQKPGKAPKLLIYVASSLQSGVPSRFSGSGS GTDFTLTIRSLQPEDFATYYCQQAKSFPFTFGPGT KVDIK | QVQLVQSGAEVKKPGASVKVSCKASRYTFTGYHIH WVRQAPGQGLEWMGWINPNTNGTQYAQKFQGRV TMTRDTSISTAYMELSRLRSDDTAVYYCARDGTSS FDYWGQGTLVTVSS |
| | | | SEQ ID NO: 25360 | SEQ ID NO: 29366 |
| iPS:434071 | 21-225_51F9 | NA | GACATCCAGATGACCCAGTCTCCATCTCCCT GTCTGCATCTGTAGGAGACAGAGTCACCATCA CTTGCCGGGCAAGTCAGGGCATTAGGACTGAT TTAGGCTGGTATCAGCAGAAACCAAGGAAAG CCCCTAAGCGCCTGATCTATGCTGCATCCAGT TGCAACGTGGAGTCCCATCAAGATTCAGCGGC AGTGGATCTGGGACAGATTTCACTCTCACCA CAGCAGCCTGCAGCCTGACATAATAGTTACCACT ATTACTGTCTACAGCATAATAGTTACCACT ACTTTCGGCCCCTGGGACCAAAGTGGATATCAA A | CAGGTGCAGCTGGTGCAGTCTGGGGGAGGCGTG GTCCAGCCTGGGAGGTCCTGAGACTCTCCTGTG CAGCGTCTGATTCACCTTCAGTGACTATGGCAT GCACTGGGTCCGCCAGGCTCCAGGCAAGGGCT GGAGTGGGTGGCAGTTATATGCAGTTATGTATGGAAAT AATAAATACTATGCAGACTCCGTGAAGGGCCGA TTCACCATCTCCAGAGACAATGACGGCGAGG TGTATCTGCAAATGAACAGCCTGAGCGCCGAGG ACACGGCTGTGTATTACTGTGCGAGGGAGCTGGG ATTTCTCTGACTACTGGGGCCAGGGAACCCTG GTCACCGTCTCCTCA |
| | | | SEQ ID NO: 25361 | SEQ ID NO: 29367 |

FIGURE 50
(Continued)

| | | | | |
|---|---|---|---|---|
| | | AA | DIQMTQSPSSLSASVGDRVTITCRASQGIRTDLG WYQQKPRKAPQRLIYAASSLQRGVPSRFSGSGS GTDFTLTISSLQPEDFASYYCLQHNSYPFTFGPGT KVDIK<br>SEQ ID NO: 25362 | QVQLVESGGGVVQPGRSLRLSCAASGFTFSDYGM HWVRQAPGKGLEWVAVIWFDGNNKYYADSVKGR FTISRDNSKNTLYLQMNSLSAEDTAVYYCARELGF LSDYWGQGTLVTVSS<br>SEQ ID NO: 29368 |
| iPS:434073 | 21-225_51H10 | NA | GACATCCAGATGACCCAGTCTCCATCTCCCT GTCTGCCTCTGTAGGAGACAGAGTCACCATCA CTTGCCGGGCAAGTCAGAGCATTAGTACCTAT TTAATGTGGTATCAGCAGAAACCAGGGAAAG CCCCTAAGCTCTTGATATATGCTGCATCCAGTT TGCAAAGTGGGGTCCCATCAGAGTTCAGTGCC AGTGGATCTGGGACAGATTCACTCTCACCAT CAGCAGTCTGCAACAGAGTTACAGTGCAACTT ACTACTGTCAACAGAGTTACAGTATCCCATTC ACTTTCGGCCCTGGGACCAAAGTGGATATCAA A<br>SEQ ID NO: 25363 | GAGGTGCAGCTGTTGGAGTCTGGGGGAGGCTTG GTACAGCCTGGGGGGTCCCTGAGACTCTCCTGTA CAGCCTCTGGATTCACCTTTAGCAGTATGCCAT GAGCTGGGTCCGCCAGGCTCCAGGGAAGGGCT GGAGTGGGTCTCAGTTATTAGTGGTAGTGGTGGT ACCACATTCTACGCAGACTCCGTGAAGGGCCGGC TCACCATCTCCAGAGACAATTCCAAGAACACACT GTATCTGCAAATGAACAGCCTGAGAGCCGAGGA CACGGCCGTATATTACTGTGCGCGTCGTATAGCA GTGGCTGGGAATGATGCTTTTGATATCTGGGGCC AAGGGACAAATGGTCACCGTCTCTTCA<br>SEQ ID NO: 29369 |
| | | AA | DIQMTQSPSSLSASVGDRVTITCRASQSISTYLM WYQQKPGKAPKLLIYAASSLQSGVPSEFSASGSG TDFTLTISSLQPEDFATYYCQQSYSIPFTFGPGTK VDIK<br>SEQ ID NO: 25364 | EVQLLESGGGLVQPGGSLRLSCTASGFTFSSYAMS WVRQAPGKGLEWVSVISGSGGTTFYADSVKGRLTI SRDNSKNTLYLQMNSLRAEDTAVYYCARRIAVAG NDAFDIWGQGTMVTVSS<br>SEQ ID NO: 29370 |

FIGURE 50
(Continued)

| | | | | |
|---|---|---|---|---|
| iPS:434075 | 21-225_51B11 | NA | GCCATCCAGATGACCCAGTCTCCATCTCCT<br>GTCTGCATCTGTAGGAGACAGAGTCACCATCA<br>CTTGCCGGACAAGTCAGGGCATTAGAAATGAT<br>TTAGGCTGGTATCAGCAGAAACCAGGAAAAG<br>CCCCTAAAACGCCTGATCTATGCTGCATCCAGT<br>TTGCAAAGTGGGGTCCCATCAAGGTTCAGCGG<br>CAGTGGATCTGGGACAGAATTCACTCTCACAA<br>TCAGCAGCCTGCAGCCTGAAGATTTTGCAACT<br>TATTACTGTCTACAGCATATAATAGTTACCCATTC<br>ACTTTCGGCCCTGGGACCAAAGTGGATATCAA<br>A<br>SEQ ID NO: 25365 | AIQMTQSPSSLSASVGDRVTITCRTSQGIRNDLG<br>WYQQKPRKAPKRLIYAASSLQSGVPSRFSGSGS<br>GTEFTLTISSLQPEDFATYYCLQHNSYPFTFGPGT<br>KVDIK<br>SEQ ID NO: 25366 | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTGACTATGGCAT<br>GCACTGGGTCCGCCAGGCTCCAGGCAAGGGGCT<br>GGAGTGGGTGGCAGTTATATGGTTTGGTGGAAAT<br>AATAAATACTATGGAGACTCCGTGAAGGGCCGA<br>TTCACCATCTCCAGAGACAATTCCAAGAACACGC<br>TGTATCTGCAAATGAACAGCCTGAGCGCCGAGG<br>ACACGGCTGTGTATTACTGTGCGAGGGAGCTGGG<br>ATTTCTCTGACTACTGGGGCCAGGGAACCCTG<br>GTCACCGTCTCCTCA<br>SEQ ID NO: 29371 |
| | | AA | | QVQLVESGGGVVQPGRSLRLSCAASGFTFSDYGM<br>HWVRQAPGKGLEWVAVIWFGGNNKYYGDSVKGR<br>FTISRDNSKNTLYLQMNSLSAEDTAVYYCARELGF<br>LSDYWGQGTLVTVSS<br>SEQ ID NO: 29372 |
| iPS:434077 | 21-225_51F11 | NA | GACATCCAGATGACCCAGTCTCCATCGCCCT<br>GTCTGCATCTGTAGGAGACAGAGTCACCATCA<br>CTTGCCGGGCAAGTCAGGGCATTAGAAATGAT<br>TTAGGCTGGTATCAGCAGAAACCAGGAAAAG<br>CCCCTAAGCGCCTGATCTATGCTGCATCCAGT<br>TTGCAAAGTGGGGTCCCATCAAGGTTCAGCGG<br>CAGTGGATCTGGGACAGAATTCACTCTCACAA<br>TCAGCAGCCTGCAGCCTGAAGATTTTGCAACT<br>TATTACTGTCTACAGCATATAATAGTTACCCGTTC<br>ACTTTCGGCGGAGGGACCAAGGTGGAGATCA<br>AA<br>SEQ ID NO: 25367 | | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAACTTTGGCAT<br>GCACTGGGTCCGCCAGGCTCCAGGCAAGGGGCT<br>GGAGTGGGTGGCAGTTATATGGTTATGGAGAAAG<br>TAATAAATACTATGCAGACTCGTGAAGGGCCG<br>ATTCACCATCTCCAGAGACAATTCCAAGAACACG<br>CTGTATCTGCAAATGAACAGCCTGAGAGCCGAG<br>GACACGGCTGTGTATTACTGTGCGAGAGAACTGG<br>GGTTCCTCTGACTTCTGGGGCCAGGGAACCCT<br>GGTCACCGTCTCCTCA<br>SEQ ID NO: 29373 |

FIGURE 50
(Continued)

| | | | | |
|---|---|---|---|---|
| iPS:434079 | 21-225_52B1 | AA | DIQMTQSPSALSASVGDRVTITCRASQGIRNDLG WYQQKPGKAPKRLIY AASSLQSGVPSRFSGSGS GTEFTLTISSLQPEDFATYYCLQHNSYPFTFGGGT KVEIK<br><br>SEQ ID NO: 25368 | QVQLVESGGGVVQPGRSLRLSCAASGFTFSNFGMH WVRQAPGKGLEWVAVIWYEESNKYYADSVKGRF TISRDNSKNTLYLQMNSLRAEDTAVYYCARELGFL SDFWGQGTLVTVSS<br><br>SEQ ID NO: 29374 |
| | | NA | GACATCCAGATGACCCAGTCTCCATCTCCGT GTCTACATTTGTAGGAGACAGAGTCACCATCA CTTGTCGGCGAGTCAGGACATATTCGCACCTGG TTAGCCTGGTATCAGCAGAAACCTGGGAAAGC CCCTAAGCTCCTGATCTATGCTGCATCCAGTTT GCAAAATGGGGTCCCATCAAGGTTCAGCGGCA GTGGATCTGGGACAGATTTCACTCTCACCATC AGTAGCCTGCAGCCTGAAGATTTTGCAACTTA CTTTTGTCAACAGCATAATAGTTTCCCATTCAC TTTCGGCCCTGGGACCAAAGTGGATATCAAA<br><br>SEQ ID NO: 25369 | CAGGTGCAGTTGGTGCAGTCTGGGGCTGAGGTGA AGAAGCCTGGGGCCTCAGTGAAGGTCTCCTGCA AGGCTTCTGGATACACCTTCACCGGCTATCATAT GCAGTGGGTGCGACAGGCCCCTGGACAAGGGCT TGAGTGGATGGGATGGATCAACCCTAACAGTGGT GCCACAAACTATGCACAGAAGTTTCAGGGCAGG GTCACCATGACCCGGGACACGTCCATCAGCACA GCCTACCTGCAGCTGAGCAGGCTGAGATCTGACG ACACGGCCGTGTATTACTGTGCGAGAGATGGCAC CTCGTCCTTTGACTACTGGGGCCAGGGAACCCTG GTCACCGTCTCCTCA<br><br>SEQ ID NO: 29375 |
| | | AA | DIQMTQSPSSVSTFVGDRITITCRASQDIRTWLA WYQQKPGKAPKLLIYAASSLQNGVPSRFSGSGS GTDFFTLTISSLQPEDFATYFCQQAKSFPTFGPGT KVDIK<br><br>SEQ ID NO: 25370 | QVQLVQSGAEVKKPGASVKVSCKASGYTFTGYHM QWVRQAPGQGLEWMGWINPNSGATNYAQNFQGR VTMTRDTSISTAYLDLSRLRSDDTAVYYCARDGTS SFDYWGQGTLVTVSS<br><br>SEQ ID NO: 29376 |

FIGURE 50
(Continued)

| | | | |
|---|---|---|---|
| iPS:434081 | 21-225_52B2 | NA | GACATCCAGATGACCCAGTCTCCATCGTCACTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAGGCGCCTGATCTATGCTGCATCCTTTTGCAAAGTGGGGTCCCATCGACATTCAGCGGCAGTGGATCTGGGACAGATTCACTCTCACAATCAGCAGCCTGCAGCCTGAAGATTTTGCAACTTATTACTGTCTGCAGCATAATAGCTACCCTCACTTTCGGCGGAGGGACCAAGGTGGAGATCAAAA |  CAGGGTGCAGCTGGTGGAGTCTGGGGGAGGCGTGGTCCAGCCTGGGAGGTCCCTGAGACTCTCCTGTGCAGCGTCTGGATTCACCTTCAGTAACTATGGCATGCACTGGGTCCGCCAGGCTCCAGGCAAGGGGCTGGAGTGGGTGGCAGTTACATGGTTTGATGGAAGTAATCAACGTATGCAGACTCCGTGAAGGCCGATTCACCATCTCCAGAGACATTTCCAAGAACACGCTGTATCTGCAAATGAACAGCCTGAGTGCCGAGGACACGGCTGTGTATTACTGTGCGAGAGATCTGGGGATGATCGAGGACTTCTGGGGCCAGGGAACCCTGGTCACCGTCTCCTCA SEQ ID NO: 29377 |
| | | | SEQ ID NO: 25371 | |
| | | AA | DIQMTQSPSSLSASVGDRVTITCRASQGIRNDLGWYQQKPGKAPRRLIYAASFLQSGVPSTFSGSGSGTEFTLTISSLQPEDFATYYCLQHNSYPLTFGGGTKVEIK | QVQLVESGGGVVQPGRSLRLSCAASGFTFSNYGMHWVRQAPGKGLEWVAVTWFDGSNQRYADSVKGRFTISRDISKNTLYLQMNSLSAEDTAVYYCARDLGMIEDFWGQGTLVTVSS |
| | | | SEQ ID NO: 25372 | SEQ ID NO: 29378 |
| iPS:434083 | 21-225_52H2 | NA | GACATCCAGATGACCCAGTCTCCATCTTCCGTGTCTGCATCTGTAGGAGACAGAGTCACCATCACTTGTCGGGCGAGTCAGAATATTACCAACTGGTTAGCCTGGTTTCAGCAGAAACCAGGGAGAGCCCCTAAGCTCCTGATCTATCTATACTCAGTTTCAAAGTGGGGTCCCATCAAGGTTCAGCGGCAGTGGATCTGGGACAGATTTCACTCTCACCATCAGCAGCCTGCAGCCTGAAGATTTTGCAACTTACTGTTGTCAACAGACTAACAGTTTCCCGTGACGTTCGGCCATGGGACCAAGGTAGAAGTCAAA | GAGGTGCAGCTGTTGGAGTCTGGGGGAGGCTTGGTACAGCCTGGGGGGTCCCTGAGACTCTCCTGTGCAGCCTCTGGATTCACCTTTAGCAGAAATGCCATGAGCTGGGTCCGCCAGGCTCCAGGGATGGGGCTGGAGTGGGTCTCAGCTATTAGTGGTCGTGGTGGTAATACATTCTACGCAGACTCCGTGAAGGGCCGGTTCACCGTCTCCAGAGACAATTCCAAGAACACGCTGTTTCTGCAAATGAACAGCCTGAGAGCCGAGGACACGGCCGTATATTACTGTGCGAAAATGGGCGAGAGCAGTGGCTTGACTACTGGGGCCAGGGAACCCTGGTCACCGTCTCCTCA |
| | | | SEQ ID NO: 25373 | SEQ ID NO: 29379 |

FIGURE 50
(Continued)

| | | | | |
|---|---|---|---|---|
| | | AA | DIQMTQSPSSVSASVGDRVTITCRASQNITNWLA WFQQKPGRAPKLLIYTTSSLQSGVPSRFSGSGSG TDFTLTISSLQPEDFATYCCQQTNSFPWTFGHGT KVEVK SEQ ID NO: 25374 | EVQLLESGGGLVQPGGSLRLSCAASGFTFSRNAMS WVRQAPGMGLEWVSAISGRGGNTFYADSVKGRFT VSRDNSKNTLFLQMNSLRAEDTAVYYCAKNGREQ WLDYWGQGTLVTVSS SEQ ID NO: 29380 |
| iPS:434085 | 21-225_52E3 | NA | GACATCCAGATGACCCAATCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCAATGCTGCATCCAGTTT ACAAAGTGGGGTCCCATCAAAGTTCAGCGGCA GTGGATCTGGGACAGATTTCACTCTCACTATC AGCAGCCTGCAGCCTGAAGATTTTGCAACTTA TTACTGCCAACAGTATAATAGTTTCCCTTTCAC TTTCGGCCCTGGGACCAAAGTGGATATCAAA SEQ ID NO: 25375 | GAGGTGCAGCTGGTGGAGTCTGGGGGAGGCTG GTCAAGCCTGGGGGGTCCCTGAGACTCTCTGTG CAGCCTCTGGATTCACCTTCAGTAGCTATAAAAT GAACTGGGTCCGCCAGGCTCCAGGGAAGGGCT GGAGTGGGTCTCATCATTAGTAGTGGTAATAGT TCCATATACTACGCAGACTCAGTGAAGGGCCGAT TCACCATCTCCAGAGACAACGCCGAAAACTCACT GTATCTGCAAATGAACAGCCTGAGAGCCGAAGA CACGGCTGTGTATTACTGTGCGAGAGTTAGCAGT AATGACTACTGGGGCCAGGGAACCCTGGTCACC GTCTCCTCA SEQ ID NO: 29381 |
| | | AA | DIQMTQSPSSLSASVGDRVTITCRASQGISNYLA WFQQKPGKAPKSLINAASSLQSGVPSKFSGSGSG TDFTLTISSLQPEDFATYCCQQYNSFPFTFGPGTK VDIK SEQ ID NO: 25376 | EVQLVESGGGLVKPGGSLRLSCAASGFTFSSYKMN WVRQAPGKGLEWVSSISSGNSSIYYADSVKGRFTIS RDNAENSLYLQMNSLRAEDTAVYYCARVSSNDY WGQGTLVTVSS SEQ ID NO: 29382 |

FIGURE 50
(Continued)

| | | | |
|---|---|---|---|
| iPS:434087 | 21-225_52F6 | NA | GACATCCAGATGACCCAGTCTCCATCTCCCT GTCTGCATCTGTAGGAGACAGAGTCACCATCA CTTGCCAGGCGAGTCAGGACATTAGTAACTAT TTACATTGGTATCAGCAGAAACCAGGGAAAGC CCCTAAACTCCTGATCTACGATGCATCCACTTT GGGAACAGGGGTCCCATTAAGGTTCAGTGGA AGTGGATCTGGGACAGAATTTACTTTCACCAT TAACAGCCTGCAGCCTGAAGATATTGCAACAT ATTCCTGTCAACAGTGTGATAATCTCCCGCTC ACTTTCGGCGGGGGACCAAGGTGGAGATCA AA |
| | | | SEQ ID NO: 25377 |
| | | AA | DIQMTQSPSSLSASVGDRVTITCQASQDISNYLH WYQQKPGKAPKLLIYDASTLGTGVPLRFSGSGS GTEFTFTINSLQPEDIATYSCQQCDNLPLTFGGGT KVEIK |
| | | | SEQ ID NO: 25378 |
| | | | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAATTATATCATATGGAGGAAG TAATAAATACTATGCAGACTCCGTGAAGGGCCG ATTCACCATCTCCAGAGACAATTCCAAGAATACG CTGTATCTGCAAATGAACAGCCTGAGAGCTGATG ACACGGCTGTGTATTACTGTGCGAGAAGGTCAGC AGCTCGGCCGGGCTACGGTATGGACGTCTGGGG CCAGGGGACCACGGTCACCGTCCTCA |
| | | | SEQ ID NO: 29383 |
| | | | QVQLVESGGGVVQPGRSLRLSCAASGFTFSSYGMH WVRQAPGKGLEWVAIISYGGSNKYYADSVKGRFTI SRDNSKNTLYLQMNSLRADTAVYYCARRSAARP GYGMDVWGQGTTVTVSS |
| | | | SEQ ID NO: 29384 |
| iPS:434091 | 21-225_52B9 | NA | GCCATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAAGGAAAG CCCCTAAGCGCCTGATCTATGCTGCATCCAGT TTGCAAAGTGGGGTCCCATTAAGGTTCAGGGG CAGTGGATCTGGGACAGACATTCACTCTCACAA TCAGAAGCCTGCAGCCTGAAGATTTTGCAACT TATTACTGTCTACAGCATAATAGTTACCATTC ACTTTCGGCCCTGGGACCAAAGTGGATATCAA A |
| | | | SEQ ID NO: 25379 |
| | | | CAGGTGCAGCTGCAGCTGGTGGAGTCTGGGGGAGGCGTG GTCCAGCCTGGGGAGGTCCCTGAGACTCTCCTGTG CAGCGTCTGGATTCACCTTCAGTGACTATGCAT GCACTGGGTCCGCCAGGCTCCAGGCAAGGGGCT GGAGTGGGTGGCAGTTATATGGTTTGATGGAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGGAGTGGG ATTTCTCTGACTACTGGGGCCAGGGAACCCTG GTCACCGTCCTCA |
| | | | SEQ ID NO: 29385 |

FIGURE 50
(Continued)

| | | | | |
|---|---|---|---|---|
| | | AA | AIQMTQSPSSLSASVGDRVTITCRASQGIRNDLG WYQQKPKAPKRLIYAASSLQSGVPLRFSGSGS GTEFTLTIRSLQPEDFATYYCLQHNSYPFTFGPGT KVDIK<br>SEQ ID NO: 25380 | QVQLVESGGGVVQPGRSLRLSCAASGFTFSDYGM HWVRQAPGKGLEWVAVIWFDGNNKYYADSVKGR FTISRDNSKNTLYLQMNSLSAEDTAVYYCARELGF LSDYWGQGTLVTVSS<br>SEQ ID NO: 29386 |
| iPS-434093 | 21-225_52D10 | NA | GATGTTATGATGACCCAGATTCCACTCTCTCTG TCCGTCACCCCTGGACAGCCGGCCTCCATCTC CTGCAAGTCTAGTCAGAGCCTCCTGCATAGTG AAGGAAAGAACCTATTTGTATTGGTACTTGCAG AAGCCAGGCCAGCCTCCACAGCTCCTGATCTT TGAAGTTTCCAACCGGGTCTCTGGAGTGCCAG ATAGGTTCAGTGGCAGAGGGTCAGGGACAGA TTTCACACTGAAAATCAGCGGGTGGAGGCTG AGGATGTTGGGGTTTATTACTGCATGCAAAGT ATACAGTATCCGATCACCTTCGGCCAAGGGAC ACGACTGGAGATTAAA<br>SEQ ID NO: 25381 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGCT GGAGTGGGTGGCACTTATATGGTATGATGGAAGT AATAAATACCATGCAGATCCGTGAAGGCCGA TTCACCATCTCCAGAGACAATTCAAGAACACGC TGTATCTGCAAATGAACAGCCTGAGAGCCGAGG ACACGGCTGTGTATTACTGTGCGAGAAGGTATAG CAGCAGCTGGTCGGGCGGTATGGACGTCTGGGG CCAAGGGACCACGGTCACCGTCTCCTCA<br>SEQ ID NO: 29387 |
| | | AA | DVMMTQIPLSLSVTPGQPASISCKSSQSLLHSEG KTYLYWYLQKPGQPPQLLIFEVSNRVSGVPDRFS GRGSGTDFTLKISRVEAEDVGVYYCMQSIQYPIT FGQGTRLEIK<br>SEQ ID NO: 25382 | QVQLVESGGGVVQPGRSLRLSCAASGFTFSSYGMH WVRQAPGKGLEWVALIWYDGSNKYHADSVKGRF TISRDNSKNTLYLQMNSLRAEDTAVYYCARRYSSS WSGGMDVWGQGTTVTSS<br>SEQ ID NO: 29388 |

FIGURE 50
(Continued)

| | | | |
|---|---|---|---|
| iPS:434095 | 21-225_52F10 | NA | GACATCCAGATGACCCAGTCTCCATCCTCACT GTCTGTATCTGTAGGAGACAGAGTCACCATCA CTTGTCGGGCGAGTCAGGGTATTAGTAATTAT TTAGGCTGGTTTCAGCAGAAACCAGGGAAAGC CCCGAAGTCCCTGATTTATGCTGCATCTAGTTT GCAAAGTGGGGTCCCATCAAGGTTCAGCGGCA GTGGATCTGGGACAGATTTCACTCTCACCATC AGCAGCCTACAGCCTGAAGATTTTGCAACTTA TTACTGCCAACAGTATAATAGTTATCCTCCGA CGTTCGGCCAAGGGACCAAGGTGGAAATCAA A<br><br>SEQ ID NO: 25383 | CAGGTGCAGCTGGTGGAGTCTGGGGGAGGCGTG GTCCAGCCTGGGAGGTCCCTGAGACTCTCCTGTG CAGGCGTCTGGATTCACCTTCAGTTTCTATGGCAT GCACTGGGTCCGCCAGGCTCCAGGCAAGGGGCT GGAGTGGGTGGCAGTTATATGCAGACTCCGTGAAGGCCG TAATAAATACTATGCAGACTCCGTGAAGGCCG ATTCACCATCTCCAGAGACAATTCCAAGAACACG CTGTTTCTGCAAATGATGAGCCTGAGAGCCGAGG ACACGGCTGTGTATTACTGTGCGAGAGATTCT GTATAGCAGCAGCTGGTTGTTTGACTACTGGGGC CAGGGAACCCTGGTCACCGTCTCCTCA<br><br>SEQ ID NO: 29389 |
| | | AA | DIQMTQSPSSLSVSVGDRVTITCRASQGISNYLG WFQQKPGKAPKSLIYAASSLQSGVPSRFSGSGSG TDFTLTISSLQPEDFATYYCQQYNSYPPTFGQGT KVEIK<br><br>SEQ ID NO: 25384 | QVQLVESGGGVVQPGRSLRLSCAASGFTFSFYGMH WVRQAPGKGLEWVAVIWDDGSNKYYADSVKGRF TISRDNSKNTLFLQMMSLRAEDTAVYYCARDSLYS SSWLFDYWGQGTLVTVSS<br><br>SEQ ID NO: 29390 |
| iPS:434097 | 21-225_52H10 | NA | GACATCCAGATGACCCAGTCTCCATCTTCCGT GTCTGCATCTGTAGGAGACAGAGTCACCATCA CTTGTCGGGCGAGTCAGGATATTAACAGTTGG TTAGCCTGGTATCAGCAGAAACCAGGGAAAG CCCCTAAACTCCTGATCTATGTTGCATCCAGTT TGCAAAGTGGGGCCCCATCAAGGTTCAGCGGC AGTGGATCTGGGACAGATTTCACTCTCACCAT CAGGAGCCTGCAGCCTGAAGATTTTGCTACTT ACTATTGTCAACAGGCTAAAAGTTTCCCATTC ACTTTCGGCCCTGGGACCAAAGTGGATATCAA A<br><br>SEQ ID NO: 25385 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACCATA TGCAGTGGGTGCGACAGGCCCCTGGACAAGGGC TTGAGTGGATGGGATGGATCAACAGAAGTTTCAGGGCAG TGGCACACAGTATGCACAGGACACACGTCCATCAGCAC GGTCACCATGACCAGGGACACGTCCATCAGCAC AGCCTACATGGAACTGAGCAGGCTGAGATCTGA CGACACGGCCGTGTATTACTGTGCGAGAGATGGC ACCTCGTCCTTTGACTACTGGGGCCAGGGAACCC TGGTCACCGTCTCCTCG<br><br>SEQ ID NO: 29391 |

FIGURE 50
(Continued)

| | | | | |
|---|---|---|---|---|
| iPS:434101 | 21-225_52H12 | AA | DIQMTQSPSSVSASVGDRVTITCRASQDINSWLA WYQQKPGKAPKLLIYVASSLQSGAPSRFSGSGS GTDFTLTIRSLQPEDFATYYCQQAKSFPFTFGPGT KVDIK<br>SEQ ID NO: 25386 | QVQLVQSGAEVKKPGASVKVSCKASGYTFTGYHM QWVRQAPGQGLEWMGWINPNNGGTQYAQKFQGR VTMTRDTSISTAYMELSRLRSDDTAVYYCARDGTS SFDYWGQGTLVTVSS<br>SEQ ID NO: 29392 |
| | | NA | GACATCCAGATGACCCAGTCTCCATCCTCCCT GTCTGCATCTGTAGGAGACAGAGTCACCATCA CTTGCCGGGCAAGTCAGGCATAAGAAATAAT TTAGGCTGGTATCAGCAGAAACCAGGGAAAG CCCCTAAGCGCCTGATCTATGTGCATCCAGT TTGCAAAGTGGGGGTCCCATCAAGGTTCAGCGG CAGTGGATCTGGGACAGAATTCACTCTCACAA TCAGCAGCCTGCAGCTGAAGATTTTGCAACT TATTACTGTCTACAGTATATAGTTATCCATTC ACTTTCGGCCCTGGGACCAAAGTGGATATCAA A<br>SEQ ID NO: 25387 | GAGGTGCAGCTGGTGGAGTCTGGGGGAGGCCTG GTCAAGCCTGGGGGTCCCTGAGACTCTCCTGTG CAGCCTCTGGATTCACCTTCAGTAGCTATAGCAT GAACTGGGTCCGCCAGGCTCCAGGGAAGGGCT GGAGTGGGTCTCATCCATTAGTGGTAGTAGTACT TACATATACTACGCAGACTCAGTGAAGGGCCGAT TCACCGTCTCCAGAGACAACGCCAAGAACTCACT GTATCTGCAAGTGAACAGCCTGAGAGCCGAGGA CACGGCTGTGTATTACTGTGCGAGAGTCAACTCC TTTGACTACTGGGGCCAGGGAACCCTGGTCACCG TCTCCTCA<br>SEQ ID NO: 29393 |
| | | AA | DIQMTQSPSSLSASVGDRVTITCRASQGIRNNLG WYQQKPGKAPKRLIYGASSLQSGVPSRFSGSGS GTEFTLTISSLQPEDFATYYCLQYNSYPFTFGPGT KVDIK<br>SEQ ID NO: 25388 | EVQLVESGGGLVKPGGSLRLSCAASGFTFSSYSMN WVRQAPGKGLEWVSSISGSSTYIYYADSVKGRFTV SRDNAKNSLYLQVNSLRAEDTAVYYCARVNSFDY WGQGTLVTVSS<br>SEQ ID NO: 29394 |

FIGURE 50
(Continued)

| | | | |
|---|---|---|---|
| iPS:434103 | 21-225_53G1 | NA | GACATCCAGATGACCCAGTCTCCATCTCCCT GTCTGCATCTGTAGGAGACAGAGTCACCATCA CTTGCCGGGCAAGTCAGGCATTAGAAATGAT TTAGGCTGGTATCAGCAGAAACCAGGGAAAG CCCCTAAGCGCCTGATCTATCCTGCATCCAGT TACAAAGTGGGGTCCCATCAAGGTTCAGCGGC AGGGGATCTGGGACAGAATTCAGTCTCACAAT CAGCAGCCTGCAGCCTGAAGATTTTGCAACTT ATTACTGTCTACAGGATAATAGTTACCCATTC ACTTTCGGCCCTGGGACCAAAGTGGATATCAA A | GAGGTGCAGCTGGTGGAGTCTGGGGGAGGCCTG GTCAAGCCTGGGGAGTCCCTGAGACTCTCCTGTG CAGCCTCTGGATTCACCTTCAGTAGCTATAGCAT GAACTGGGTCCGCCAGGCTCCAGGGAAGGGCT GGAGTGGGTCTCATCCATTAGTGGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCAGAGATCGGGGC AGCACCTGGGGCCAGGGAACCCTGGTCACCGTCT CCTCA |
| | | | SEQ ID NO: 25389 | SEQ ID NO: 29395 |
| | | AA | DIQMTQSPSSLSASVGDRVTITCRASQGIRNDLG WYQQKPGKAPKRLIYPASSLQSGVPSRFSGSGSG TEFSLTISSLQPEDFATYYCLQDNSYPFTFGPGTK VDIK | EVQLVESGGGLVKPGESLRLSCAASGFTFSSYSMN WVRQAPGKGLEWVSSISGSSSYIYYADSVKGRFTIS RDNAKNSLYLQMNSLRAEDTAVYYCARDRGSTW GQGTLVTVSS |
| | | | SEQ ID NO: 25390 | SEQ ID NO: 29396 |
| iPS:434105 | 21-225_53D2 | NA | GACATCCAGATGACCCAGTCTCCATCTCCCT GTCTGCATCTGTAGGAGACAGAGTCACCATCA CTTGCCGGGCAAGTCAGGACAGATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAACATAATAGATACCCGCT CACTTTCGGCGGAGGGACCAAGGTGGAGATC AAA | CAGGTGCAGCTGGTGGAGTCTGGGGGAGGCGTG GTCCAGCCTGGGGAGGTCCCTGAGACTCTCCTGTG CAGCGTCTGGATTCACCTTCAGTAACTATGGCAT GCACTGGGTCCGCCAGGCTCCAGGCAAGGGGCT GGAATGGGTGACAGTTGTATGGGATGATGGAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTACGAGGGGCCTTG GCTTTACGGGAGACTACTGGGGCCAGGGAGCCC TGGTCACCGTCTCCTCA |
| | | | SEQ ID NO: 25391 | SEQ ID NO: 29397 |

FIGURE 50
(Continued)

| | | | |
|---|---|---|---|
| iPS:434107 | 21-225_53E2 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNRYPLTFGGG TKVEIK<br>SEQ ID NO: 25392 | QVQLVESGGGVVQPGRSLRLSCAASGFTFSNYGM HWVRQAPGKGLEWVTVVWDDGSNKYYADSVKG RFTISRDNSKNTLYLQMNSLRAEDTAVYYCTRGLG FTGDYWGQGALVTVSS<br>SEQ ID NO: 29398 |
| | | NA | GACATCCAGATGACCCAGTCTCCATCCCCT GTCTGCATCTGTAGGAGACAGAGTCACCATCA CTTGCCGGGCAAGTCAGAGTTTTAGCCACTAT TTAAATTGGTATCAGCAGAAACCAGGGAAAG CCCCTAAGCTCCTGATCTTTGCTGTATCCAGTT TGCAAAGTGGGGTCCCATCACGGTTCAGTGGC AGTGGATCTGGGTCAACCTGAAGATTTCAGTG CAGTAGTTTGCAACCAGAGTTCAGTACCCATC ACTTCTGTCAACAGAGATTTCAGTACCCATTC ACTTTCGGCCCTGGGACCAAAGTGGATATCAA A<br>SEQ ID NO: 25393 | GAGGTGCAGTTGTTGGAGTCTGGGGGAGGCTTGA TACAGCCTGGGGGGTCCCTGAGACTCTCCTGTGC AGCCTCTGGATTCACCTTTAGGAGCTATGCCATG AGCTGGGTCCGCCAGGCTCCAGGGAAGGGGCTG GAGTGGGTCTCAGCTATTAGTGGTAGTGGTGGTA ACACATTCTACGCAGACTCCGTGAAGGGCCGGTT CACCATCTCCAGAGACAATTCCAAGAGAGCCCTG TATTTGCAAATGAACACCCTGAGACTGCGTCGTG ACGGCCGTATATTACTGTGCGAAAAGGTCGTGG ATACACCATGGCTCTTGACTACTGGGGCCAGGG AACCCTGGTCACCGTCTCCTCA<br>SEQ ID NO: 29399 |
| | | AA | DIQMTQSPSSLSASVGDRVTITCRASQSFSHYLN WYQQKPGKAPNLLIFAVSSLQSGVPSRFSGSGSG SDFTLPISSLQPEDFAIYFCQQSFSTPFTFGPGTKV DIK<br>SEQ ID NO: 25394 | EVQLLESGGGLIQPGGSLRLSCAASGFTFRSYAMS WVRQAPGKGLEWVSAISGSGGNTFYADSVKGRFTI SRDNSKNTLYLQMNTLRADDTAVYYCAKKVVDT AMALDYWGQGTLVTVSS<br>SEQ ID NO: 29400 |

FIGURE 50
(Continued)

| | | | |
|---|---|---|---|
| iPS:434111 | 21-225_53H2 | NA | GACATCCAGATGACCCAGTCTCCATCCTCCCT GTCTGCATCTGTAGGAGACAGAGTCACCATCA CTTGCCAGGCGAGTCAGGACATTAGCAACTAT TTACATTGGTATCAGCAGAAACCAGGGAAAGC CCCTCAGCTCCTGATCTACGATGCATCCAATTT GGAAACAGGGGTCCCATCAAGGTTCACTGGA AGTGGATCTGGGACAGATTTTACTTTCACCAT CAGCAGCCTGCAGCCTGAAGATATTGCAACAT ATTACTGTCATCAGTATGATAATCTCCCGCTCA CTTTCGGCGGAGGGACCAAGGTGGAGATCAA A<br><br>SEQ ID NO: 25395 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCTG GAGTGGGTGGCAGTTATATCATATGGTGAAGT AATAAATACCATGCAGACTCCGTGAAGGGCCGA TTCACCATCTCCAGAGACAATTCCAAGAACACGC TGTATCTGCAAATGAACAGCTGAGAGCTGAGG ACACGGCTGTGTATTACTGTGCGAGGCGGGGAG CAGCTCGTCCTGCTACGGTATGGACGTCTGGGG CCAAGGGACCACGGTCACCGTCTCCTCA<br><br>SEQ ID NO: 29401 |
| | | AA | DIQMTQSPSSLSASVGDRVTITCQASQDISNYLH WYQQKPGKAPQLLIYDASNLETGVPSRFTGSGS GTDFTFTISSLQPEDIATYYCHQYDNLPLTFGGG TKVEIK<br><br>SEQ ID NO: 25396 | QVQLVESGGGVVQPGRSLRLSCAASGFTFSSYGMH WVRQAPGKGPEWVAVISYGGSNKYHADSVKGRFT ISRDNSKNTLYLQMNSLRAEDTAVYYCARRGAAR PGYGMDVWGQGTTVTVSS<br><br>SEQ ID NO: 29402 |
| iPS:434115 | 21-225_53E4 | NA | GACATCCAGATGACCCAGTCTCCATCCTCACT GTCTGCATCTGTAGGAGACAGAGTCACCATCA CTTGTCGGGCGAGTCAGGTCATTAGCAATTAT TTAGCCTGGTTTCAGCAGAAACCAGGGAAAGC CCCTAAGTCCCTGATCTCTGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA CTACTGCCAACAGTATCATAGTTACCACTCA CTTTCGGCGGAGGGACCAAGGTGGATATCAAA<br><br>SEQ ID NO: 25397 | GAGGTGCAACTGTTGGAGTCTGGGGGAGGCTTG GTACAGCCTGGGGGGTCCCTGAGACTCTCCTGTG CAGCCTCTGATTCACCTTTAGCAGCTATGTCAT GAGCTGGGTCCGCCAGGCTCCAGGGAAGGGGCT GGAGTGGGTCTCAGTTATTAGTGGTAGTGGTGGT CGCACATACTACGCAGACTCCGTGAAGGGCCGG TTCAACATTCCAGAGACAATTCCAAGAACACGC TGTATCTGCAAATGAACAGCTGAGAGCCGAGG ACACGGCCGTCTATTACTGTGCGAGGGTGGCCCT TTTTGACTACTGGGGCCAGGGAACCCTGGTCACC GTCTCCTCA<br><br>SEQ ID NO: 29403 |

FIGURE 50
(Continued)

| | | | | |
|---|---|---|---|---|
| iPS:434117 | 21-225_53C6 | AA | DIQMTQSPSSLSASVGDRVTITCRASQVISNYLAWFQQKPGKAPKSLISAASSLQSGVPSKFSGSGSGTDFTLTISSLQPEDFATYYCQQYHSYPLTFGRGTKVDIK<br>SEQ ID NO: 25398 | EVQLLESGGGLVQPGGSLRLSCAASGFTFSSYVMSWVRQAPGKGLEWVSGISGSGGRTYYADSVKGRFNISRDNSKNTLYLQMNSLRAEDTAVYYCARVALFDYWGQGTLVTVSS<br>SEQ ID NO: 29404 |
| | | NA | GACATCCAGATGACCCAGTCTCCATCCTCCCTGTCTGCATCTGTAGGAGACAGAGTCACCATCACTTGCCGGGCAAGTCAGTACAGTAGCGACTATTTAAATTGGTATCAGCAGAAACCAGGGAAAGCCCCTAAGGTCCTGATCTTTGCTGCATCCAGTTTGAAAAGTGGGGTCCCATCAAGGTTCAGTGGCAGTGGATCTGGGACAGATTTCACTCTCACCATCAGCAGTCTGGAACCTGAAGATTTTGCGACTTACTTCTGTCAACAGAGTTACAGTACCCGTTCACCTTCGGCCAAGGGACACGACTGGAGATTAAA<br>SEQ ID NO: 25399 | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGCCATGAACTGGGTCCGCCAGGCTCCAGGGAAGGGGCTGGAGTGGGTCTCAGCTATTAGTGGTAGTGGTGGTGCCACATACTACGCAGACTCCGTGAAGGGCCGGTTCACCATCTCCAGAGACAATTCCAAGAACACGCTGTATCTGCAAATGAACAGCCTGAGAGCCGAGGACACGGCCGTATATTATTGTGCGAAACTCTAGTGGGAGCCCATGATGCTTTTGAAATCTGGGGCCAAGGGACAATGGTCACCGTCTCTTCA<br>SEQ ID NO: 29405 |
| | | AA | DIQMTQSPSSLSASVGDRVTITCRASQYSSDYLNWYQQKPGKAPKVLIFAASSLKSGVPSRFSGSGSGTDFTLTISSLEPEDFATYFCQQSYSTPFTFGQGTRLEIK<br>SEQ ID NO: 25400 | EVQLLESGGGLVQPGGSLRLSCAASGFTFSSYAMNWVRQAPGKGLEWVSAISGSGGATYYADSVKGRFTISRDNSKNTLYLQMNSLRAEDTAVYYCAKPLVGAHDAFEIWGQGTMVTVSS<br>SEQ ID NO: 29406 |

FIGURE 50
(Continued)

| | | | |
|---|---|---|---|
| iPS:434119 | 21-225_53E6 | NA | GACATCCAGATGACCCAGTCTCCATCTCCCT GTCTGCCTCTGTAGGCGCCAGAGTCACCATCA CTTGCCGGGCAAGTCAGGGCATTAGAAATGAT TTAGGCTGGTATCAGCAGAAATCCGGGAAAGC CCCTAAGCGCCTGATCTATGCTGCATCCAATT GCAAAGTGGGGTCCCATCAAGGTTCAGCGGCA GTGGATCTGGGACAGAATTCACTCTCACTTA AGCAGCCTGCAGCCTGAAGATTTTGCAACTTA TTTCTGTCTACAACATAATCGTTACCCGCTCAC TTTCGGCGGAGGGACCAAGGTGGAGATCAAA<br><br>SEQ ID NO: 25401 | CAGGTCCAGCTGGTGCAGTCTGGGGGAGGCGTG GTCCAGCCTGGGAGGTCCCTGAGACTCTCCTGTA CAACGTCTGATTCACCTTCAGTGACTATGGCAT CCACTGGGTCCGCCAGGCTCCAGGCAAGGGGCT GGAGTGGGTGGCAGTTATATGGTATGATGAAAGT AATAAATACTATGGAGACTCCGTGAAGGGCCGA TTCGCCATCTCCAGAGACAATTCCAAGAACACGC TGTATCTGCAAATGAACAGCCTGAGAGCCGAGG ACACGGCTGTGTATTATTGTGTGAGAGAACTGGG GATGACGTCGACTACTGGGGCCAGGGAACCCT GGTCACCGTCTCCTCA<br><br>SEQ ID NO: 29407 |
| | | AA | DIQMTQSPSSLSASVGARVTITCRASQGIRNDLG WYQQNPGKAPKRLIYAASNLQSGVPSRFSGSGS GTEFTLTISSLQPEDFATYFCLQHNRYPLTFGGGT KVEIK<br><br>SEQ ID NO: 25402 | QVQLVESGGGVVQPGRSLRLSCTTSGFTFSDYGIH WVRQAPGKGLEWVAVIWYDESNKYYGDSVKGRF AISRDNSKNTLYLQMNSLRAEDTAVYYCVRELGM TSDYWGQGTLVTVSS<br><br>SEQ ID NO: 29408 |
| iPS:434121 | 21-225_53F6 | NA | GACATCCAGATGACCCAGTCTCCATCCTCCCT GTCTGCATCTGTAGGAGACAGAGTCACCATCA CTTGCCAGGCGAGTCAAGACATTACCAACTAT TTAGATTGGTATCAGCAGAAACCGGGAAAG CCCCTAAACTCCTGATCTACGATGCATCCAAT TTGGAACAGGGGTCCCATCAAGGTTCAGTGG AAGTGGATCTGGGACAGATTTTACTTTCACCA TCAGCAGCCTGCAGCCTGAAGATATTGCAACA TATTACTGTCAACAGTGTGATAATCTCCCGCTC ACTTTCGGCGGAGGGACCAAGGTGGAGATCA AA<br><br>SEQ ID NO: 25403 | CAGGTCCAGCTGGTGCAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATCATATGGTGAAGT AATAAATACGATGCAGACTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGCAGACGACGGGC AGTCGTCCAGGGTACGGTATGACGTCTGGGGC CAAGGGACCACGGTCACCGTCTCCTCA<br><br>SEQ ID NO: 29409 |

FIGURE 50
(Continued)

| | | | |
|---|---|---|---|
| iPS:434123 | 21-225_53F7 | AA | DIQMTQSPSSLSASVGDRVTITCQASQDITNYLD WYQQKPGKAPKLLIYDASNLGTGVPSRFSGSGS GTDFTFTISSLQPEDIATYYCQQCDNLPLTFGGGT KVEIK<br>SEQ ID NO: 25404 | QVQLVESGGGVVQPGRSLRLSCAASGFTFSSYGMH WVRQAPGKGLEWVAVISYGGSNKYDADSVKGRFT ISRDNSKNTLYLQMTSLRAEDTAVYYCARRRAARP GYGMDVWGQGTTVTVSS<br>SEQ ID NO: 29410 |
| | | NA | GACATCCAGATGTCCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAACCAGGGAAAG CCCCTAACCTCCTGATCTATGCTGCATCCAGTT TGCAAAGTGGGGTCCCATCAAGGTTCAGCGGC AGTGGCTCTGGGACAGATTTCACTCTCACCAT CAGCAGCCTGCAGCCTGAAGATTTTGCAATT ACTATTGTCAGCAGGCTAACAGTTTCCCATTC ACTTTCGGCCCTGGGACCAAAGTGGATATCAA A<br>SEQ ID NO: 25405 | CAGGTGCAGCTGGTGCAGTCTGGGGCTGAGGTG AAGAAGCCTGGGGCCTCAGTGAAGGTCTCCTGC AAGGCTTCTGATACACCTTCACCGGCTACCATA TGCACTGGGTGCGACAGGCCCCTGGACAAGGGC TTGAGTGGATGGGATGGATCAACCTAACAATAA CGGCACAAACTATGCACAGAAGTTTCAGGGCAG GGTCACCATGACCAGGGACACGTCCATCAGCAC AGCCTACATGGAGCTGAACAGGCTGACATCTGA CGACACGGCCGTGTATTACTGTGCGAGAGACGGT ACCAGCAGCTTTGACTACTGGGGCCAGGGAACC CTGGTCACCGTCTCCTCA<br>SEQ ID NO: 29411 |
| | | AA | DIQMSQSPSSVSASVGDRVTITCRASQGISRWLA WYQQKPGKAPNLLIYAASSLQSGVPSRFSGSGS GTDFTLTISSLQPEDFAIYYCQQANSFPFTFGPGT KVDIK<br>SEQ ID NO: 25406 | QVQLVQSGAEVKKPGASVKVSCKASGYTFTGYHM HWVRQAPGQGLEWMGWINPNNGTNYAQKFQGR VTMTRDTSISTAYMELNRLTSDDTAVYYCARDGTS SFDYWGQGTLVTVSS<br>SEQ ID NO: 29412 |

FIGURE 50
(Continued)

| | | | |
|---|---|---|---|
| iPS:434127 | 21-225_53H8 | NA | GAAATTGTGTTGACGCAGTCTCCAGGCACCCT GTCTTTGTCTCCAGGGGAAAGAGCCACCCTCT CCTGCAGGGCCAGTCAGAGTATTACAAGCAGC TACTTAGCCTGGTACCAGCAGAAACCTGGCCA GGCTCCCAGGCTCCTCATCTATGGTGCGTCCG GCAGGGCCACTGGCATCCCAGACAGTTCAGT GGCAGTGGGTCTGGGACAGACTTCACCCTCAC CATCAGCAGACTGGAGCCTGAAGATTTTGCAG TGTATTACTGTCAGCAGTTTGAAAGCTCACCC ATGTGCAGTTTTGGCCAGGGGACCAACCTGGA GATCAAA<br><br>SEQ ID NO: 25407 | CAGGTGCAGCTGGTGGAGTCTGGGGGAGGCGTG GTCCAGCCTGGGAGGTCCCTGAGACTCTCCTGTG CAGGGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCAAGAACACGC TGTATCTGCAAATGAACAGCCTGAGAGCCGAGG ACACGGCTGTGTATTACTGTGCGAGGGCCCGTAT TGGGTACTTTGACTCCTGGGGCCAGGGAACCCTG GTCACCGTCTCCTCA<br><br>SEQ ID NO: 29413 |
| | | AA | EIVLTQSPGTLSLSPGERATLSCRASQSITSSYLA WYQQKPGQAPRLLIYGASGRATGIPDRFSGSGS GTDFTLTISRLEPEDFAVYYCQQFESSPMCSFGQ GTNLEIK<br><br>SEQ ID NO: 25408 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARARIGY FDSWGQGTLVTVSS<br><br>SEQ ID NO: 29414 |
| iPS:434129 | 21-225_53B12 | NA | GACATCCAGATGACCCAGTCTCCATCTCCCT GTCTGCATCTGTAGGAGACAGAGTCACCATCA CTTGTCGGGCAAGTCAGGGCATTAGAAATGAT TTAGGCTGGTATCAGCAGAAACCAGGGAAAG CCCCTAAGCGCCTGATCTATGCTGCATCAGT TTGCAAAGTGGGGTCCCATCAAGGTTCAGCGG CAGTGGATCTGGGACAGAATTCACTCTCACAA TCAGCAGCCTGCAGCCTGACAGATTTTGCAACT TATTACTGTCTACAGCATAATAGTTACCCATTC ACTTTCGGCCCTGGGACCAAAGTGGATATCAA A<br><br>SEQ ID NO: 25409 | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAACTTTGGCAT GCACTGGGTCCGCCAGGCTCCAGGCAAGGGGCT GGAGTGGGTGGCAGTTGTATGGTATGATGGAAAT AATAGATACTATGCAGACTCCGTGAAGGGCCGA TTCACCATCTCCAGAGACAATTCCAAGAACACGC TCTATCTGCAAATGAACAGCCTGAGAGCCGAGG ACACGGCTGTGTATTACTGTGCGAGGGAACTGGG ATTTCTCTGACTTCTGGGGCCAGGGAACCCTG GTCACCGTCTCCTCA<br><br>SEQ ID NO: 29415 |

FIGURE 50
(Continued)

| | | | | |
|---|---|---|---|---|
| iPS:434131 | 21-225_54D3 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPFTFGPGT KVDIK<br>SEQ ID NO: 25410 | QVQLVESGGGVVQPGRSLRLSCAASGFTFSNFGMH WVRQAPGKGLEWVAVVWYDGNNRYYADSVKGR FTISRDNSKNTLYLQMHSLRAEDTAVYYCARELGF LSDFWGQGTLVTVSS<br>SEQ ID NO: 29416 |
| | | NA | GACATCCAGATGACCCAGTCTCCATCTCCCT GTCTGCATCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGATTCAGCGG CAGTGGATCTGGGACAGATTTCACTCTCACAA TCAGCAGCCTGCAGCCTGAAGATTTTGCAACT TATTACTGTCTACAACATAATAGTTACCCATTC ACTTTCGGCCCTGGGACCAAAGTGGATATCAA A<br>SEQ ID NO: 25411 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGCT GGAGTGGGTGGCAGTTACATGGTTTGATGGAAAT AATAACTACTATGCAGACTCCGTGAAGGCCGAT TCCACCATCTCCAGAGACAATGACAAGCCTGAGAGCCGAGGA GTATCTGCAAATGAACAGCCTGAGAGCCGAGGA CACGGCTGTGTATTACTGTGCGAGAGAACTGGGG TTCCTTTCTGATTATTGGGGCCAGGGAACCCTGG TCACCGTCTCCTCA<br>SEQ ID NO: 29417 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPFTFGPGT KVDIK<br>SEQ ID NO: 25412 | QVQLVESGGGVVQPGRSLRLSCAASGFTFSNYGM HWVRQAPGKGLEWVAVTWFDGNNNYYADSVKG RFTISRDNSKNTLYLQMNSLRAEDTAVYYCARELG FLSDYWGQGTLVTVSS<br>SEQ ID NO: 29418 |

FIGURE 50
(Continued)

| | | | |
|---|---|---|---|
| iPS:434133 | 21-225_54G3 | NA | GACATCCAGATGACCCAGTCTCCATCTTCCGT GTCTGCATCTGTAGGAGACAGAGTCACCATCA CTTGTCGGGCGAGTCAGGGTATTAGCAGCTGG TATGCCTGGTATCAGCAGAAACCAGGGAAAG CCCCTAAACTCCTGATCTATGATGCATCAGTT TGCAAAGTGGGGTCCCATCAAGGTTCAGCGGC AGTGGATCTGAGACAGATTTCACTCTCACCAT CAGCAGCCTGCAGCCTGAAGATTTTGCAACTT ACTATTGTCAACAGGCTAACAGTTTCCCGTGG ACGTTCGGCCAAGGGACCAAGGTGGAAATCA AA | GAGGTGCAGCTGTTGGAGTCTGGGGAGGCTTG GTACAGCCTGGGGGGTCCCTGAGACTCTCCTGTG CAGCCTCTGGATTCACCTTTAGCACCTATGCCAT GAGTTGGGTCCGCCAGGCTCCAGGGAAGGGGCT GGAGTGGGTCTCAGCTATTAGTGGTAGTGGTGTT AACACATTCTACGCAGACTCCGTGAAGGGCCGGT TCACCATCTCCAGAGACAATTCCAAGAACACGCT GTTTCTGCAAATGAACAGCCTGAGAGCCGAGGA CACGGCCGTATATTACTGTGCGAAACTGGGGAA GGACTACTACTACTACGGTATGGACGTCTGGGGC CAAGGGACCACGGTCACCGTCTCCTCA |
| | | | SEQ ID NO: 25413 | SEQ ID NO: 29419 |
| | | AA | DIQMTQSPSSVSASVGDRVTITCRASQGISSWLA WYQQKPGKAPKLLIYDASSLQSGVPSRFSGSGSE TDFTLTISSLQPEDFATYYCQQANSFPWTFGQGT KVEIK | EVQLLESGGGLVQPGGSLRLSCAASGFTFSTYAMS WVRQAPGKGLEWVSAISGSGVNTFYADSVKGRFTI SRDNSKNTLFLQMNSLRAEDTAVYYCAKLGKDYY YYGMDVWGQGTTVTVSS |
| | | | SEQ ID NO: 25414 | SEQ ID NO: 29420 |
| iPS:434135 | 21-225_54H3 | NA | GACATCCAGATGACCCAATCTCCATCTCTCCT GTCTGCATCTGTTGGAGACAGAGTCACCATCA CTTGCCGGGCAAGTCAGGACATTAGAAATATT TTAGGCTGGTATCAGCAGAAACCAGGGAAAG CCCCTAAGCTCCTGATCTATGCTGCATCCAAT TTGCAAAGTGGAGTCCCATCAAGGTTCAGCGG CAGTGGATCTGGGACAGAATTCACTCTCACAA TCAGCAGCCTGCAGCCTGAGGATTTCGCAACT TATTACTGTCTACAGTATAATAGTTACCCGTG GACGTTCGGCCAAGGGACCAAGGTGGAAATC AAA | GAGGTGCAGCTGGTGGAGTCTGGGGAGGCTG GTCAAGCCTGGGGGGTCCCTGAGACTCTCCTGTG CAGCCTCTGGATTCACCTTCAGTAGCTATAGCAT GATCTGGGTCCGCCAGGCTCCAGGGAAGGGGCT GGAGTGGGTCTCATCATTAGTGGTACTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGGGAATGACTACA GTAATTTGGGGCCAGGGAACCCTGGTCACCGTCT CCTCA |
| | | | SEQ ID NO: 25415 | SEQ ID NO: 29421 |

FIGURE 50
(Continued)

| | | | | |
|---|---|---|---|---|
| | | AA | DIQMTQSPSSLSASVGDRVTITCRASQDIRNILG WYQQKPGKAPKRLIYAASNLQSGVPSRFSGSGS GTEFTLTISSLQPEDFATYYCLQYNSYPWTFGQG TKVEIK<br><br>SEQ ID NO: 25416 | EVQLVESGGGLVKPGGSLRLSCAASGFTFSSYSMI WVRQAPGKGLEWVSSISGTSSYIYADSVKGRFTIS RDNAKNSLYLQMNSLRAEDTAVYYCAGMTTVIW GQGTLVTVSS<br><br>SEQ ID NO: 29422 |
| iPS:434137 | 21-225_54D4 | NA | GATATTGTGATGACCCAGACTCCACTCTCT GTCCGTCACCCCTGGACAGCCGGCCTCCATGT CCTGCAAGTCTAGTCAGAGCCTCCTGCATAGT GAGGGAAAGAACCTATTTGTATTGGTACCTGCG GAAGCCAGGCCAGGCCTCCACAGTTCCTGATCT TTGAAGTTTCCAACCGGTTCTCTGGAGTGCCA GATAGGTTCAGTGGCAGCGGGTCAGGGACAG AATTCACACTGAAAATCAGCCGGGTGGAGGCT GAGGATGTTGGGATTTATTACTGCATGCAAAG TATACAGTTTCCATTCACTTTCGGCCCTGGGAC CAAAGTGGATATCAAA<br><br>SEQ ID NO: 25417 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGCAT GCACTGGGTCCGCCAGGCTCCAGGCAAGGGCT GGAGTGGGTGGCAGTTATATGCAGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAAGGTATAG CAGCAGTGGTCGGGCGGTATGACGTCTGGGG CCAAGGGACCACGGTCACCGTCTCCTCA<br><br>SEQ ID NO: 29423 |
| | | AA | DIVMTQTPLSLSVTPGQPASMSCKSSQSLLHSEG KTYLYWYLRKPGQPPQFLIFEVSNRFSGVPDRFS GSGSGTEFTLKISRVEAEDVGIYYCMQSIQFPFTF GPGTKVDIK<br><br>SEQ ID NO: 25418 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSSS WSGGMDVWGQGTTVTVSS<br><br>SEQ ID NO: 29424 |

FIGURE 50
(Continued)

| | | | |
|---|---|---|---|
| iPS:434141 | 21-225_54C6 | NA | GACATCCAGATGACCCAGTCTCCATCCTCCT GTCTGCCTCTGTAGGCGCCAGAGTCACCATCA CTTGCCGGGCAAGTCAGGGCATTAGAAATGAT TTAGGCTGGTATCAGCAGAAATCCGGGAAAGC CCCTAAGCGCCTGATCTATGCTGCATCCAATTT GCAAAGTGGGGTCCCATCAAGGTTCAGCGGCA GTGGATCTGGGACAGAGAATTCACTCTCACTAT AGCAGCCTGCAGCCTGAAGATTTTGCAACTTA TTTCTGTCTACAGCATAATCGTTACCCGCTCAC TTTCGGCGGAGGGACCAAGGTGGAGATCAAA<br><br>SEQ ID NO: 25419 | CAGGTCCAGCTGGTGGTGGAGTCTGGGGGAGGCGTG GTCCAGCCTGGGAGGTCCCTGAGACTCTCCTGTA CAACGTCTGATTCACCTTCAGTGACTATGGCAT CCACTGGGTCCGCCAGGCTCCAGGCAAGGGCT GGACTGGGTGGCAGTTATATGGTATGATGAAAAT AATAAATACTATGCAGACTCCGTGAAGGGCCGA TTCGCCATCTCCAGAGACAATTCCAAGAACACGC TGTATCTGCAAATGAACAGCCTGAGAGGGCTGAGG ACACGGCTGTGTATTATTGTGTGAGAGAACTGGG GATGACGTCGACTACTGGGGCCAGGGAACCCT GGTCACCGTCTCCTCA<br><br>SEQ ID NO: 29425 |
| | | AA | DIQMTQSPSSLSASVGARVTITCRASQGIRNDLG WYQQNPGKAPKRLIYAASNLQSGVPSRFSGSGS GTEFTLTISSLQPEDFATYFCLQHNRYPLTFGGGT KVEIK<br><br>SEQ ID NO: 25420 | QVQLVESGGGVVQPGRSLRLSCTTSGFTFSDYGIH WVRQAPGKGLDWVAVIWYDENNKYYADSVKGRF AISRDNSKNTLYLQMNSLRAEDTAVYYCVRELGM TSDYWGQGTLVTVSS<br><br>SEQ ID NO: 29426 |
| iPS:434143 | 21-225_54G7 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCTAGGTTCAGCGG CAGTGGATCTGGGACAGAATTCACTCTCACAA TCAGCAGCCTGCAGCCTGAAGATTTTGCAACT TATTACTGTCTACATCATATATACTTACCCATTC ACTTTCGGCCCTGGGACCAAAGTGGATATCAA A<br><br>SEQ ID NO: 25421 | CAGGTGCAGCTGGTGGAGTCTGGGGGAGGCGTG GTCCAGCCTGGGAGGTCCCTGAGACTCTCTGTG CAGCGTCTGGATTCACCTTCAGTAACTAACTGGCAT GCACTGGGTCCGCCAGGCTCCAGGCAAGGGGCT GGAGTGGGTGGCAGTTATATGGTATGAGGAAAG TAATAAATACTATGGAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGAGAATTGG GGTTCCTCTGACTACTGGGGCCAGGGAACCCT GGTCACCGTCTCCTCA<br><br>SEQ ID NO: 29427 |

FIGURE 50
(Continued)

| | | | | |
|---|---|---|---|---|
| iPS:434145 | | AA | DIQMTQSPSSLSASVGDRVTITCRASQGIRNDLG WYQQKPGKAPKRLIYAASSLQSGVPSRFSGSGS GTEFTLTISSLQPEDFATYCLHHNTYPFTFGPGT KVDIK<br>SEQ ID NO: 25422 | QVQLVESGGGVVQPGRSLRLSCAASGFTFSNYGM HWVRQAPGKGLEWVAVIWYEESNKYYGDSVKGR FTISRDNSKNTLYLQMNSLRAEDTAVYYCARELGF LSDYWGQGTLVTVSS<br>SEQ ID NO: 29428 |
| | 21-225_55B1 | NA | GACATCCAGATGACCCAGTCTCCATCTTCCGT GTCTGCATCTGTAGGGGACAGAGTCACCATCA CTTGTCGGGCGAGTCAGGTTATTAGCCGCTGG TTAGCCTGGTATCAGCAGAAACCAGGGAAAG CCCCTAAGCGCCTGATCTATGCTGCATCCAGTT TGCAAAGTGGGGTCCCATCAAGGTTCAGCGGC AGTGGATCTGGGACAGATTTCACTCTGACCAT CAGCAGCCTGCAGCCTGAAGATTTTGCAACTT ACTATTGTCAACAGGCTAACAGTTTCCCATTC ACTTTCGGCCCTGGGACCAAAGTGATCTCAA A<br>SEQ ID NO: 25423 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACATT TCCACTGGGTGCGACAGGCCCCTGGTCAAGGGCT TGAGTGGATGGATGCACAGAAGTTTCAGGGCAGG GCCACAAACTATGCAACAGGGACACGTCCATCAC GTCACCATGACCAGGACCTGAGCAGGCTGAGACA GCCTACATGGAGCTGTATTACTGTGCGAAGGATGGC GACACGGCCGTGTCCTTTGACTACTGGGGCCAGGGAACCCC TGGTCACCGTCTCCTCA<br>SEQ ID NO: 29429 |
| | | AA | DIQMTQSPSSVSASVGDRVTITCRASQVISRWLA WYQQKPGKAPNLLIYAASSLQSGVPSRFSGSGS GTDFTLTISSLQPEDFATYCQQANSFPFTFGPGT KVDLK<br>SEQ ID NO: 25424 | QVQLVQSGAEVKKPGASVKVSCKASGYTFTGYYF HWVRQAPGQGLEWMGWIHPNNNATNYAQKFQGR VTMTRDTSISTAYMELSRLRSDDTAVYYCAKDGRS SFDYWGQGTLVTVSS<br>SEQ ID NO: 29430 |

FIGURE 50
(Continued)

| | | | | |
|---|---|---|---|---|
| iPS:434147 | 21-225_55E1 | NA | GAAATAGTGATGACGCAGTCTCCAGCCACCCT GTCTGTGTCTCCAGGGGAAAGAGCCACCCTCT CCTGCAGGGCCAGTCAGAGTGTTAGCAGCGAC TTAGCCTGGTACCAGCTGAAACCTGGCCAGGC TCCCAGGCTCCTCATCTATGATGCATCCGCCA GGGCCACTGGTATCCCAGCCAGGTTCAGTGGC AGTGGGTCTGGGACAGAGTTCACTCTCACCAT CAGCAGCCTGCAGTCTGAAGATTTTGCATTTT ATTACTGTCAGCAGTATATAACTGGCCTCC ACTTTCGGCGGAGGGACCAAGGTGGAGATCA AA
SEQ ID NO: 25425 | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GAGTGGGTCTCAGTATTAGTGGTCGTGGTAGT AGCACATTCTACGCAGACTCCGTGAAGGGCCGGT TCACCATCTCCAGAGACAATTCAAGAACACGCT GTATCTGCAAATGAACAGCCTGAGAGCCGAGA CACGGCCGTTTTTACTGTGCGAAAGATCACGGT ATAGTGGGAACTATTTACTTTGACTACTGGGCC AGGGAACCCTGGTCACCGTCTCCTCA
SEQ ID NO: 29431 |
| | | AA | EIVMTQSPATLSVSPGERATLSCRASQSVSSDLA WYQLKPGQAPRLLIYDASARATGIPARFSGSGSG TEFTLTISSLQSEDFAFYYCQQYYNWPLTFGGGT KVEIK
SEQ ID NO: 25426 | EVQLLESGGGLVQPGGSLRLSCAASGFTFSSYAMS WVRQAPGKGLEWVSAISGRGSSTFYADSVKGRFTI SRDNSKNTLYLQMNSLRAEDTAVFYCAKDHGIVG TIYFDYWGQGTLVTVSS
SEQ ID NO: 29432 |
| iPS:434149 | 21-225_55H1 | NA | GATATTGTGATGACCCAGACTCCACTCTCTCT GTCCGTCACCCCTGGACAGCCGGCCTCCATCT CCTGCAAATCTAGTCAGAGCCTCCTGCATAGT GAAGGAAAGACCTATTTGTATTGGTACCTGCA GAAGCCAGGCCAGCCTCCACAGTTCCTGATCT TTGAAGTTCCCAACCGGTTCTCTGGAGTGCCA GATAGGTTCAGTGGCAGCGGGTCAGGGACAG ATTTCACTCTGAAAATCAGCCGGGTGGAAGCT GAGGATGTTGGGGTTTATTACTGCATGCAAAG TATACAGCTTCCATTCACTTTCGGCCCTGGGAC CAAAGTGGATATCAAA
SEQ ID NO: 25427 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGTTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAAGTATAG CAGCAGCTGGTCGGGCGGTATGACGTCTGGGG CCAAGGGACCACGGTCACCGTCTCCTCA
SEQ ID NO: 29433 |

FIGURE 50
(Continued)

| | | | | |
|---|---|---|---|---|
| iPS:434151 | 21-225_55C2 | AA | DIVMTQTPLSLSVTPGQPASISCKSSQSLLHSEGK TYLYWYLQKPGQPPQFLIFEVSHRFSGVPDRFSG SGSGTDFTLKISRVEAEDVGVYYCMQSIQLPFTF GPGTKVDIK<br>SEQ ID NO: 25428 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSSS WSGGMDVWGQGTTVTVSS<br>SEQ ID NO: 29434 |
| | | NA | GATGTTATGATGACCCAGATTCCACTCTCTCTG TCCGTCACCCCTGGACAGCCGGCTCCATCTC CTGCAAGTCTAGTCAGAGCCTCGTGCATAGTG AAGGAAAGACCTATTTGTATTGGTATTTGCAG AAGCCAGGCCAGCTCCACAGCTCCTGATCTT TGAAGTTTCCAACCGGGTCTCTGGAGTGCCAG ATAGGTTCAGTGGCAGAGGGTCAGGGACAGA TTTCACACTGAAAATCAGCCGGGTGGAGGCTG AGGATGTTGGGGTTTATTACTGCATGCAAAGT ATACTGTATCCGATCACCTTCGGCCAAGGGAC ACGACTGGAGATTAAA<br>SEQ ID NO: 25429 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGGCT GGAGTGGGTGGCACTTATATGGTATGATGGAAGT AATAAATACCATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGCGCGAGAAGGTATAG CAGCAGCTGGTCGGGCGGTATGGACGTCTGGGG CCAAGGGACCACGGTCACCGTCTCCTCA<br>SEQ ID NO: 29435 |
| | | AA | DVMMTQIPLSLSVTPGQPASISCKSSQSLVHSEG KTYLYWYLQKPGQPPQLLIFEVSNRVSGVPDRFS GRGSGTDFTLKISRVEAEDVGVYYCMQSILYPIT FGQGTRLEIK<br>SEQ ID NO: 25430 | QVQLVESGGGVVQPGRSLRLSCAASGFTFSSYGMH WVRQAPGKGLEWVALIWYDGSNKYHADSVKGRF TISRDNSKNTLYLQMNSLRAEDTAVYYCARRYSSS WSGGMDVWGQGTTVTVSS<br>SEQ ID NO: 29436 |

FIGURE 50
(Continued)

| | | | |
|---|---|---|---|
| iPS:434155 | 21-225_55B3 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTAGATCTGGGACAGAATTCACTCTCACAATCAGCAGCCTGCAGCCTGAAGATTTTGCATCTTATTACTGTCTACAACATATAGTTACCCATTCACTTTCGGCCCTGGGACCAAAGTGGATATCAAA | CAGGTGCAGCTGGTGGAGTCTGGGGGAGGCGTGGTCCAGCCTGGGAGGTCCCTGAGACTCTCCTGTCAGCGTCTGGATTCACCTTCAGTAGCTATGGCATGCACTGGGTCCGCCAGGCTCCAGGCAAGGGGCTGGAGTGGGTGGCAGTTATATGATGTTGATGGAAATAATAAATACTATGAAGACTCCGTGAAGGGCCGATTCACCATCTCCAGAGACAATTCCAAGAACACGCTGTATCTGCAAATGAACAGCCTGAGAGCTGAGGACACGGCTGTGTATTACTGTGTGAGGGAACTGGGAATTTCTCTGACTACTGGGGCCAGGGAACCCTGGTCACCGTCTCCTCA |
| | | | SEQ ID NO: 25431 | SEQ ID NO: 29437 |
| | | AA | DIQMTQSPSSLSASVGDRVTITCRASQGIRNDLGWYQQKPGKAPKRLIYAASSLQSGVPSRFSGSGSGTEFTLTISSLQPEDFASYYCLQHNSYPFTFGPGTKVDIK | QVQLVESGGGVVQPGRSLRLSCAASGFTFSSYGMHWVRQAPGKGLEWVAVIWFDGNNKYYEDSVKGRFTISRDNSKNTLYLQMNSLRAEDTAVYYCVRELGFLSDYWGQGTLVTVSS |
| | | | SEQ ID NO: 25432 | SEQ ID NO: 29438 |
| iPS:434157 | 21-225_55D4 | NA | GACATCCAGATGACCCAGTCTCCATCCTCTCTGTTTGCATCTGTAGGAGACAGAGTCACCATCACTTGTGCGGGCGAGTCAGGACATTAGCAATTATTTAAATCTGGTTTCAGCAGAAACCAGGGAAAGCCCCTAAGTCCCTGATTTATACTGCATCCAGTTTGCAAAGTGGGGTCCCCTCAAAGTTCAGCGGCAGTGGATTTGGGACAGATTTCACTCTCACCATCAGCAACCTGCAGCCTGAAGATATTGCGACTTATTACTGCCAACAGAGTATCATAGTTTCCCTCACTTTCGGCGGAGGGACCAGGGTGGAGATCAGA | GAGGTGCAACTGGTGGAGTCTGGGGGAGGCCTGGTCAAGCCTGGGGGGTCCCTGAGACTCTCCTGTGCAGCCTCTGGATTCACCTTCAATAGTTATAGGATGAACTGGGTCCGCCAGGCTCCAGGGAAGGGGCTGGAGTGGGTCTCATCCATTAGTAGTAGTAATCACATAGACTACGCAGACTCAGTGAAGGGCCGATTCACCATCTCCAGAGACAACGCCAAAAACTCACTATATTTGCAAATGAACAGCCTGAGAGCCGAGGACACGGCTTTATATTACTGTGCGAGGGACTGACTACTGGGGCCAGGGAACCCTGGTCTCCGTCTCCTCA |
| | | | SEQ ID NO: 25433 | SEQ ID NO: 29439 |

FIGURE 50
(Continued)

| | | | | |
|---|---|---|---|---|
| | | AA | DIQMTQSPSSLFASVGDRVTITCRASQDISNYLIW FQQKPGKAPKSLIYTASSLQSGVPSKFSGSGFGT DFTLTISNLQPEDFATYYCQQYHSFPLTFGGGTR VEIR<br>SEQ ID NO: 25434 | EVQLVESGGGLVKPGGSLRLSCAASGFTFNSYRMN WVRQAPGKGLEWVSSISSSSNHIDYADSVKGRFTIS RDNAKNSLYLQMNSLRAEDTALYYCARGTDYWG QGTLVSVSS<br>SEQ ID NO: 29440 |
| iPS:434159 | 21-225_55B8 | NA | GACATCCAGATGACCCAGTCTCCATCTCCCT GTCTTCATCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCCATGCTGCATTCAGG TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATAGTTACCCTCTC ACTTTCGGCGGAGGGACCAAGGTGGGGATCA AA<br>SEQ ID NO: 25435 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTATGATGAAAAT AATAAATACTATGCAGACTCCGTGAAGGCCGA TTCACCATCTCCAGAGACAATTCCAAGAACAGC TGTATCTGCAAATGAACAGCTGAGAGCCGAGG ACACGGCTGTGTATTACTGTACGAGAGAATGGTT TGACTACTGGGGCCAGGGAACCCTGGTCACCGTC TCCTCA<br>SEQ ID NO: 29441 |
| | | AA | DIQMTQSPSSLSSSVGDRVTITCRASQAIRNDLG WYQQKPGKAPKRLIHAAFRLQSGVPSRFSGSGS GTEFTLTISSLQPEDFATYYCLQHNSYPLTFGGG TKVGIK<br>SEQ ID NO: 25436 | QVQLVESGGGVVQPGRSLRLSCAASGFTFSDYGM HWVRQAPGKGLEWVAVIWYDENNKYYADSVKGR FTISRDNSKNTLYLQMNSLRAEDTAVYYCTREWFD YWGQGTLVTVSS<br>SEQ ID NO: 29442 |

FIGURE 50
(Continued)

| | | | |
|---|---|---|---|
| iPS:434161 | 21-225_55F9 | NA | GATATTGTGATGACCCAGACTCCACTCTCT GTCCGTCACCCCTGGACAGTCCGGCCTCCATCT CCTGCAAGTCTAGTCAAAGCCTCCTGCATAGT GAAGGAAAGACCTATTTGTATTGGTACTTGCA GAAGCCAGGCCAGCTCCACAGCTCCTGATCT ATGAAGTTTCCAACCGGTTCTCTGGAGTGCCA GATAGGTTCAGCGGCAGCGGGTCAGGACAG ATTTTACACTGAAAATCAGCCGGGTGGAGGCT GAGGATGTTGGGGTTTATTACTGCATACAAAG TATACAACTTCCGATCACCTTCGGCCAAGGGA CACGACTGGAGATTAAA<br><br>SEQ ID NO: 25437 | CAGGTGCAGCTGGTGGAGTCTGGGGGAGGCGTG GTCCAGCCTGGGAGGTCCCTGAGACTCTCCTGTG CAGCGGTCTGGATTCACCTTCAGTAGCTATGGCAT GCACTGGGTCCGCCAGGCTCCAGGCAAGGGGCT GGAGTGGGTGGCAGTTATATGGTATGATGGAAAT GGCAAATATTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAAGGTATAG CAGCAGCTGGTCGGGCGGTATGGACGTCTGGGG CCAAGGGACCACGGTCACCGTCTCCTCA<br><br>SEQ ID NO: 29443 |
| | | AA | DIVMTQTPLSLSVTPGQSASISCKSSQSLLHSEGK TYLYWYLQKPGQPPQLLIYEVSNRFSGVPDRFSG SGSGTDFTLKISRVEAEDVGVYYCIQSIQLPITFG QGTRLEIK<br><br>SEQ ID NO: 25438 | QVQLVESGGGVVQPGRSLRLSCAASGFTFSSYGMH WVRQAPGKGLEWVAVIWYDGNGKYYADSVKGRF TISRDNSKNTLYLQMNSLRAEDTAVYYCARRYSSS WSGGMDVWGQGTTVTVSS<br><br>SEQ ID NO: 29444 |
| iPS:434163 | 21-225_50H1 | NA | GACATCCAGATGACCCAGTCTCCATCTCCCC GTCTGCTTCTGTAGGAGACAGAGTCACCATCA CTTGCCAGGCGAGTCAAGACATTAGCAACTAT TTAGATTGGTATCAGCAGAAACCAGGGAAAG CCCCTAAACTCCTGATATCGATGCATCCAAT TTGGAAACAGGGGTCCCATCAAGGTTCAGTGG AAGTGGATCTGGGACAGATTTTGCTTTCACCA TCAGCAGCCTGCAGCCTGAAGATATTGCAACA TATTACTGTCAACAGTGTGATAATCTCCCGCTC ACTTTCGGCGGAGGGACCAAGGTGGAGATCA AA<br><br>SEQ ID NO: 25439 | CAGGTGCAGTTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGTCAATTATATCATATGTGGAAGT AATAAATACGATGAGACTCCGTGAAGGGCCGA TTCACCATCTCCAGAGACAATTCCAAGAACACGC TGTATCTGCAAATGACCAGCCTGAGAGCTGAGG ACACGGCTGTGTATTACTGTGCGAGACGACGGGC AGCTCGTCCAGGGTACGGTATGGACGTCTGGGGC CAAGGGATCACGGTCACCGTCTCCTCA<br><br>SEQ ID NO: 29445 |

FIGURE 50
(Continued)

| | | | |
|---|---|---|---|
| iPS:434165 | 21-225_50F2 | AA | DIQMTQSPSSPSASVGDRVTITCQASQDISNYLDWYQQKPGKAPKLLIYDASNLETGVPSRFSGSGSGTDFAFTISSLQPEDIATYYCQQCDNLPLTFGGGTKVEIK<br>SEQ ID NO: 25440 | QVQLVESGGGVVQPGRSLRLSCAASGFTFSSYGMHWVRQAPGKGLEWVSIISYGGSNKYDADSVKGRFTISRDNSKNTLYLQMTSLRAEDTAVYYCARRRAARPGYGMDVWGQGITVTSS<br>SEQ ID NO: 29446 |
| | | NA | GACATCCAGATGACCCAGTCTCCATCCTCCCTGTCTGCATCTGTAGGAGACAGAGTCACCATCACTTGCCGGGCAAGTCAGAGCATTCTCAGCTATTTGAATTGGTATCAGCAGAAACCAGGAAAGGCCCCTAAACTCCTGATCTATGTTGCATCCAGTTTCCAAAGTGGGGTCCCATCAAGGTTCAGTGGCAGTGGATCTGGGACAGATTTCACTCTCACCATCAGCAGTCTGCAACCTGAAGATTTTGCAACTTACTACTGTCAACAGAGTTACAGTCCCCCTCTCACTTTCGGCGGAGGGACCAAGGTGGAGATCAAA<br>SEQ ID NO: 25441 | CAGGTGCAGCTGGTGGAGTCTGGGGGAGGCGTGGTCCAGCCTGGGAGGTCCCTGAGACTCTCCTGTGCAGCGTCTGCATTCACCTTCAGTAGCTATGGCATGCACTGGGTCCGCCAGACTCCAGGCAAGGGCTGGAGTGGGTGGCAGTTATATGCATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGACGAGCAGCTCGGGACCTTTGACTACTGGGGCCAGGGAACCCTGGTCACCGTCTCCTCA<br>SEQ ID NO: 29447 |
| | | AA | DIQMTQSPSSLSASVGDRITITCRASQSILSYLNWYQQKPGKAPKLLIYVASSFQSGVPSRFSGSGSGTDFTLTISSLQPDDFATYYCQQSYSPPLTFGGGTKVEIK<br>SEQ ID NO: 25442 | QVQLVESGGGVVQPGRSLRLSCAASAFTFSSYGMHWVRQTPGKGLEWVAVIWHDGSNKYADSVKGRFTISRDNSKNTLYLQMNSLRAEDTAVYYCARDEQLGTFDYWGQGTLVTVSS<br>SEQ ID NO: 29448 |

FIGURE 50
(Continued)

| | | | |
|---|---|---|---|
| iPS:434167 | 21-225_50F3 | NA | GACATCCAGATGACCCAGTCTCCATCTTCCGT GTCTGCATCTGTAGGAGACAGAGTCACCATCA CTTGTCGGGCGAGTCAGGATATTAGCAGCTGG TTGGCCTGGTTTCAGCAGAAACCAGGGAAAGC CCCTAAGCTCCTGATCTATGCTGCATCCAGTTT GCAAAATGGGGTCCCGTCAAGGTTCAGCGGCA GTGGATCTGGGACAGATTTCACTCTCACCATC AGCAGCCTGCAGCTGAACAGACTAACAGTTTCCCATTCA CTATTGCCAACAGATAACAGTTTCCCATTCA CTTTCGGCCCTGGGACCAAAGTGGATATCAAA<br><br>SEQ ID NO: 25443 | GAGGTGCAGCTGTTGGAGTCTGGGGGAGGCTTG GTACAGCCTGGGGGGTCCCTGAGACTCTCCTGTG CAGCCTCTGGATTCACCTTTAGAACCTATGCCAT GACCTGGGTCCGCCAGGCTCCAGGGAAGGGGCT GGAGTGGGTCTCAGCTATCAGTGGTAGTGGTGTT AACTCATTCTACGCAGACTCCGTGAAGGGCCGGT TCACCATCTCCAGAGACAATTCCGAGAACACGCT GTATCTGCAAATGAACAGCCTGAGAGCGAGGA CACGGCCGTATATTACTGTGCGAAAGCAAGGGC AGTGGCTAGGGTCACACTGGTTCGACCCTGGGGC CAGGGAACCCTGGTCACCGTCTCCTCA<br><br>SEQ ID NO: 29449 |
| | | AA | DIQMTQSPSSVSASVGDRVTITCRASQDISSWLA WFQQKPGKAPKLLIYAASSLQNGVPSRFSGSGS GTDFTLTISSLQPEDFATYYCQQTNSFPFTFGPGT KVDIK<br><br>SEQ ID NO: 25444 | EVQLLESGGGLVQPGGSLRLSCAASGFTFRTYAMT WVRQAPGKGLEWVSAISGSGVNSFYADSVKGRFTI SRDNSENTLYLQMNSLRAEDTAVYYCAKARAVAG SHWFDPWGQGTLVTVSS<br><br>SEQ ID NO: 29450 |
| iPS:434169 | 21-225_50C4 | NA | GACATCCAGATGACCCAGTCTCCATCTCCCT GTCTGCATCTGTAGGAGACAGAGTCACCCTCA CTTGCCGGGCAAGTCAGGGCATTAGAAATGAT TTAGGCTGGTATCAGCAGAAACCAGGGATAGC CCTAAAGCGCCTGATCTATGCTGCATCCAGTTT GCAAAGTGGGGTCCCATCAAGGTTCAGCGGCA GTGGATCTGGGACAGAATTCACTCTCACAATC AGCAGCCTGCAGCCTGAAGATTTTGCAACTTA TTACTGTCTACAGCATAATCGTTACCCATTCAC TTTCGGCCCTGGGACCAAAGTGGATATCAAA<br><br>SEQ ID NO: 25445 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTGACTGGCAT GCACTGGGTCCGCCAGGCTCCAGGCAAGGGGCT GGAGTGGGTGGCAGTTATATGCAGACTCCGTGAAGGGCCG TAATAAATACTATGCAGACTCCGTGAAGGGCCG ATTCACCATCTCCAGAGACAATTCCAAGAACACG CTGTATCTGCAAATGAACAGCCTGAGAGCGAG GACACGGCTGTATTACTGTGCGAGAGAAGTGG GGTTCCTGAATGACTACTGGGGCCAGGGAATCCT GGTCACCGTCTCCTCA<br><br>SEQ ID NO: 29451 |

FIGURE 50
(Continued)

| | | | | |
|---|---|---|---|---|
| | | AA | DIQMTQSPSSLSASVGDRVTLTCRASQGIRNDLG WYQQKPGIAPKRLIYAASSLQSGVPSRFSGSGSG TEFTLTISSLQPEDFATYYCLQHNRYPFTFGPGTK VDIK<br><br>SEQ ID NO: 25446 | QVQLVESGGGVVQPGRSLRLSCAASGFTFSDYGM HWVRQAPGKGLEWVAVIWYEETNKYYADSVKGR FTISRDNSKNTLYLQMNSLRGEDTAVYYCAREVGF LNDYWGQGILVTVSS<br><br>SEQ ID NO: 29452 |
| | | NA | CAGGTGCAGCTGGTGCAGTCTGGGGCTGAGGTG<br>AAGGAGCCTGGGGCCTCAGTGAAGGTTTCCTGCA<br>AGGCATCTGGATACACCTTCACCAGTTACTATAT<br>ACACTGGGTGCGACAGGCCCCTGGACAAGGGCT<br>TGAGTGGATGGGAGTAATCAACCTAGTAATGGT<br>AGAACAAGCTACGCACAGAAGTTCCAGGGCAGA<br>GTCACCATGACCAGGGACACGTCCACGAGCACA<br>GTCTACATGGAGCTGAGCAGCCTGAGATCTGAG<br>GACACGGCCGTGTATTACTGTGCGAGAGATCGA<br>GGAGATGGTTACTACTTCTACTACGGTATGGACG<br>TCTGGGGCCAAGGGACCACGGTCACCGTCTCCTC<br>A<br><br>SEQ ID NO: 25447 | |
| iPS:434171 | 21-225_50G4 | AA | DIQMTQSPTSLSASVGDRVTITCQASQDITNFLN<br>WYQQKPGKAPKLLIYDASNLETGVPSRFSGSGS<br>GTDFTFTISSLQPEDIATYYCQQYDNLITFGQGTR<br>LEIK<br><br>SEQ ID NO: 25448 | QVQLVQSGAEVKEPGASVKVSCKASGYTFTSYYIH WVRQAPGQGLEWMGVINPSNGRTSYAQKFQGRVT MTRDTSTSTVYMELSSLRSEDTAVYYCARDRGDG YYFYYGMDVWGQGTTVTSS<br><br>SEQ ID NO: 29454 |

FIGURE 50
(Continued)

| | | | |
|---|---|---|---|
| iPS:434175 | 21-225_55A11 | NA | GACATCGTGACCCAGTCTCCATCCTCACT<br>GTCTGCATCTGTAGGAGACAGAGTCACCATCA<br>CTTGTCGGGCGAGTCAGGACATTAACATTTAT<br>TTAGCCTGGTTTCAGCAGAAACCAGGGAAAGC<br>CCCTAAGTCCCTGATCTATGCTGCATCCAGTTT<br>GCAAAGTGGGGTCCCATCGAAGTTCAGCGGCA<br>GTGGATCTGGGACAGATTTCACTCTCACCATC<br>AGCAGTCTGCAGCCTGAAGATTTTGCAACTTA<br>TTACTGCCAACAGTATAATAGTTATCCTCTCAC<br>TTTCGGCGGAGGGACCAAGGTGGAGATCAAA<br><br>SEQ ID NO: 25449 | CAGGTGCAGCTGGTGGAGTCTGGGGGAGGCGTG<br>GTCCAGCCTGGGAGGTCCCTGAGACTCTCCTGTG<br>CAGCCTCTGGATTCACCTTCAGTAGCTATGGCAT<br>GCACTGGGTCCGCCAGACTCCAGGGAAGGGGCT<br>GGAGTGGGTGGCAGTTATATCATATGTTGGAAGT<br>ACTAAATACTATGCAGACTCCGTGAGGGGCCGAT<br>TCACCATCTCCAGAGACAATTCCAAGAACACGCT<br>GTATCTGCAAATGAACAGCCTGAGAACTGAGGA<br>CACGGCTGTGTATTACTGTGCGAGAGGGAGAGGT<br>CGATATAGTGACTACGGTCATGATGCTTTTGATA<br>TCTGGGGCCAAGGGACAATGGTCACCGTCTCTTC<br>A<br><br>SEQ ID NO: 29455 |
| | | AA | DIQMTQSPSSLSASVGDRVTITCRASQDINIYLA<br>WFQQKPGKAPKSLIYAASSLQSGVPSKFSGSGSG<br>TDFTLTISSLQPEDFATYYCQQYNSYPLTFGGGT<br>KVEIK<br><br>SEQ ID NO: 25450 | QVQLVESGGGVVQPGRSLRLSCAASGFTFSSYGMH<br>WVRQTPGKGLEWVAVISYVGSTKYYADSVRGRFT<br>ISRDNSKNTLYLQMNSLRTEDTAVYYCARGRGRYS<br>DYGHDAFDIWGQGTMVTVSS<br><br>SEQ ID NO: 29456 |
| iPS:434177 | 21-225_56A1 | NA | GACATCGTCATGACCCAGTCTCCAGACTCCCT<br>GGCTGTGTCTCTGGGCGAGAGGGCCACCATCA<br>ACTGCAAGTCCAGCCAGAGTGTTTTACATAGT<br>TCCAACAATAAGAACTACTTAGTTTGGTACCA<br>GCAGAGACCAGGACAGCCTCCTAAGCTGCTCA<br>TTTACTGGGCATCTACCCGGGAATCCGGGGTC<br>CCTGACCGATTCAGTGGCAGCGGGTCTGGGAC<br>AGATTTCACTCTCACCATCAGCAGCCTGCAGG<br>CTGAAGATGTGGCAGTTTATTACTGTCAGCAA<br>TATTATAGTACTCCTCCGACGTTCGGCCAAGG<br>GACCAAGGTGGAAATCAAA<br><br>SEQ ID NO: 25451 | CAGGTACAGCTGGTGCAGTCTGGGGCTGAGGTG<br>AAGAAGCCTGGGGCCTCAGTGAAGGTCTCCTGC<br>AAGGCTTCTGGATACACCTTCACCAATTATGATA<br>TCAACTGGGTGCGACAGGCCACTGGACAAGGGC<br>TTGAGTGGATGGGATGGATGCACCTAACAGTGG<br>TAACACAGGCTATGCACAGAAGTTCAGGGCAG<br>AGTCACCATGACCAGGAACACCTCCATAAGCAC<br>AGCCTACATGGAGCTGAGCAGCCTGAGATCTGA<br>GGACACGGCCGTATTACTGTGCATATAGCAGT<br>GGCTGGTACGTTTTGACTACTGGGGCCAGGGAA<br>CCCTGGTCACCGTCTCCTCA<br><br>SEQ ID NO: 29457 |

FIGURE 50
(Continued)

| | | | | |
|---|---|---|---|---|
| iPS:434179 | | AA | DIVMTQSPDSLAVSLGERATINCKSSQSVLHSSN NKNYLVWYQQRPGQPPNLLIYWASTRESGVPD RFSGSGSGTDFTLTISSLQAEDVAVYYCQQYYST PPTFGQGTKVEIK<br>SEQ ID NO: 25452 | QVQLVQSGAEVKKPGASVKVSCKASGYTFTNYDIN WVRQATGQGLEWLGWMHPNSGNTGYAQKFQGR VTMTRNTSISTAYMELSSLRSEDTAVYYCAYSSGW YVFDYWGQGTLVTVSS<br>SEQ ID NO: 29458 |
| | 21-225_56F1 | NA | GACATCCAGATGACCCAGTCTCCATCCTCCCT GTCTGCATCTGTAGGAGACAGAGTCACCATCA CTTGCCGGGCAAGTCAGGACATTAGAAATAAT TTAGGCTGGTATCAGCAGAAACCAGGGAAAG CCCCTAAGCGCCTGATCAATGCTGCATCCAGT TTACAAAGTGGGGTCCCATCAAGGTTCAGCGG CAGTGGATCTGGGACAGACTTCACTCTCACAA TCAGCAGCCTGCAGCCTGAAGATATAGTCAACT TATTACTGTCTACAGGATGGGACCAAGGTGAGATC CACTTTCGGCGGAGGGACCAAGGTGGAGATC AAA<br>SEQ ID NO: 25453 | GAGGTGCAGCTGGTGGAGTCTGGGGGAGGCCTG GTCAAGTTTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTAGTAGTAGTACT TACATATACTCCGAGACTCAGTGAAGGCCGA TTCACCATCTCCCAGAGACAACGCCAAGAACTCAC TATATCTGCAGATGAACAGCCTGAGAGCCGAGG ACACGGCTGTGTATTACTGTGCGAGAGATCGGGG CAGCAGCTGGGGCCAGGGAACCCTGGTCACCGT CTCCTCA<br>SEQ ID NO: 29459 |
| | | AA | DIQMTQSPSSLSASVGDRVTITCRASQDIRNNLG WYQQKPGKAPKRLINAASSLQSGVPSRFSGSGS GTEFTLTISSLQPEDFATYYCLQDNSHPFTFGGGT KVEIK<br>SEQ ID NO: 25454 | EVQLVESGGGLVKFGGSLRLSCAASGFTFSSYSMN WVRQAPGKGLEWVSSISSSSTYIYYGDSVKGRFTIS RDNAKNSLYLQMNSLRAEDTAVYYCARDRGSSW GQGTLVTVSS<br>SEQ ID NO: 29460 |

FIGURE 50
(Continued)

| | | | |
|---|---|---|---|
| iPS:434181 | 21-225_56B2 | NA | GACATCCAGATGACCCAGTCTCCATCCTCCCT GTCTGCATCTGTAGGAGACAGAGTCACCATCA CTTGCCGGGCAAGTCAGAGTTTAGCCACTAT TAAATTGGTATCAGCAGAAACCAGGGAAAG CCCCTAACCTCCTGATCTTTGCTGTATCCAGTT TGCAAAGTGGGGTCCCATCAAGGTTCAGTGGC AGTGGATCTGGGACAGATTTCACTCTCACCAT CAGTAGTCTGCAACCTGAAGATTTTGCAATT ACTTCTGTCAACAGAGTTACAGTACCCCATTC ACTTTCGGCCCTGGGACCAAAGTGGATATCAA A<br><br>SEQ ID NO: 25455 | GAGGTGCAGTTGTTGGAGTCTGGGGAGGCTTGA TACAGCCTGGGGGGTCCCTGAGACTCTCCTGTGC AGCCTCTGGATTCACCTTTAGGAGCTATGCCATG AGCTGGGTCCGCCAGGCTCCAGGGAAGGGCTG GAGTGGGTCTCAGTATTAGTGGTAGTGGTA ACACATTCTACGCAGACTCCGTGAAGGGCCGGTT CACCATCTCCAGAGACAATTCCAAGAACACGCTG TATTTGCAAATGAACACCTGAGAGCCGACGAC ACGGCCGTATATTACTGTGCAAAAAGGTCGTGG ATACAGCCATGGCTCTTGACTACTGGGGCCAGGG AACCCTGGTCACCGTCTCCTCA<br><br>SEQ ID NO: 29461 |
| | | AA | DIQMTQSPSSLSASVGDRVTITCRASQSFSHYLN WYQQKPGKAPNLLIFAVSSLQSGVPSRFSGSGSG TDFTLTISSLQPEDFAIYFCQQSYSTPFTFGPGTK VDIK<br><br>SEQ ID NO: 25456 | EVQLLESGGGLIQPGGSLRLSCAASGFTFRSYAMS WVRQAPGKGLEWVSAISGSGGNTFYADSVKGRFTI SRDNSKNTLYLQMNTLRADDTAVYYCAKKVVDT AMALDYWGQGTLVTVSS<br><br>SEQ ID NO: 29462 |
| iPS:434187 | 21-225_56A5 | NA | GACATCCAGATGACCCAGTCTCCATCCTCCCT GTCTGCATCTGTAGGAGACAGAGTCACCATCA CTTGCCGGGCAAGTCAGGACAGTTAGAAATCTT TTAGGCTGGTATCAGCAGAAACCAGGGAAAG CCCCTAAGCGCTTGATCTATGCTGCATCCAGTT TGCAAAGTGGGGTCCCATCAAGGTTCAGCGGC AGTGGATCTGGGACAGATTTCACTCTCACAAT CAGCAGCCTGCAGCCTGAAGATTTTGCAACTT ATTACTGTCTACAGTATATAGTTACCCATTCA CTTTCGGCCCTGGGACCAAAGTGGGATATCAGA<br><br>SEQ ID NO: 25457 | GAGGTGCAGCTGGTGGAGTCTGGGGGAGGCTG GTCAAGCCTGGGGGGTCCCTGAGACTCTCCTGTG CAGCCTCTGGATTCACCTTCACTAGCTATAGCAT GAACTGGGTCCGCCAGGCTCCAGGGAAGGGGCT GGAGTGGGTCTCATCCATTAGTGGTAGTAGTAGT TACATATACTACGCAGACTCAGTGAAGGGCCGAT TCACCATCTCCAGAGACAACGCCAAGAACTCACT ATATCTGCAAATGAACAGCCTGAGAGCCGAGGA CACGGCTGTGTATTACTGTGCGAGAGTGGCTACT TTTGACTACTGGGGCCAGGGAACCCTGGTCACCG TCTCCTCA<br><br>SEQ ID NO: 29463 |

FIGURE 50
(Continued)

| | | | | |
|---|---|---|---|---|
| iPS:434189 | 21-225_56E5 | AA | DIQMTQSPSSLSASVGDRVTITCRASQDIRNLLG WYQQKPGKAPKRLIYAASSLQSGVPSRFSGSGS GTEFTLTISSLQPEDFATYYCLQYNSYPFTFGPGT KVDIR<br><br>SEQ ID NO: 25458 | EVQLVESGGGLVKPGGSLRLSCAASGFTFSSYSMN WVRQAPGKGLEWVSSISGSSSYIYYADSVKGRFTIS RDNAKNSLYLQMNSLRAEDTAVYYCARVATFDY WGQGTLVTVSS<br><br>SEQ ID NO: 29464 |
| | | NA | GACATCCAGATGACCCAGTCTCCATCTTCCGT GTCTGCATCTGTAGGCGACAGAGTCACCATCA CTTGTCGGGCGAGTCAGGTATTAGGAATGTGG TTAGCCTGGTATCAGCAGAAACCAGGGAAAG CCCCTAAGCTCCTGATCTATGCTGCATCCAGTT TGCAAAGTGGGGTCCCGTCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A<br><br>SEQ ID NO: 25459 | CAGGTGCAGCTGGTGCAGTCTGGGGCTGAGGTG AAGAAGCCTGGGGCCTCAGTGAAGGTCTCCTGCC AGGCTTCTGGATACACCTTCACCGGCTACCATAT GCACTGGGTGCGACAGGCCCCTGGACAAGGGCT TGAGTGGATGGGATGGATCAACAGAAGTTTCAGGGCAGG GCCACAAACTATGCACAGAAGTTTCAGGGCAGG GTCACCATGACCAGGGACACGTCCATCAGCACA GCCTACATGGAACTGAGGAGGCTGAGATCTGAC GACACGGCCGTGTATCACTGTGCAGGAGATGGC ACCTGTCTTTGACTACTGGGGCCAGGGAACCC TGGTCACCGTCTCCTCA<br><br>SEQ ID NO: 29465 |
| | | AA | DIQMTQSPSSVSASVGDRVTITCRASQGIRKWLA WYQQKPGKAPKLLIYAASSLQSGVPSRFSGSGS GTDFTLTISSLQPEDFATYYCQQANSFPFTFGPGT KVDIK<br><br>SEQ ID NO: 25460 | QVQLVQSGAEVKKPGASVKVSCQASGYTFIGYHM HWVRQAPGQGLEWMGWINPNNNATNYAQKFQGR VTMTRDTSISTAYMELRRLRSDDTAVYHCARDGTS SFDYWGQGTLVTVSS<br><br>SEQ ID NO: 29466 |

FIGURE 50
(Continued)

| | | | |
|---|---|---|---|
| iPS:434191 | 21-225_56B6 | NA | GACATCCAGATGACCCAGTCTCCATCTCCCT GTCTGTATCTGTAGGAGACAGAGTCACCATCA CTTGCCGGGCAAGTCAGAGACATTTTCAGATAT TTAAATTGGTATCAGCAGAAACCAGGAAGAG CCCTAAGCTCCTGATCTTTGCTGCATCCAGTT TCCAAAGTGGGGTCCCATCCAAGGTTCAGTGC AGTGGATCTGGGACAGAGACTTCACTCTCACCAT CAGCAGCCTACAACCTGAAGATTTTGCAACTT ACTACTGTCAACAGACTTACAGTCCCCCTCTC ACTTTCGGCGGAGGGACCAAGGTGGAGATCA AA SEQ ID NO: 25461 | CAGGTGCAACTGGTGGAGTCTGGGGGAGGCGTG GTCCAGCCTGGGAGGTCCCTGAGACTCTCCTGTG CAGCGCTCTGGATTCACCTTCAGTAGCTATGGCAT GCACTGGGTCCGCCAGGCTCCAGGCAAGGGGCT GGAGTGGGTGGCAGTTATATGATGACTGAAGG TAATAAATATATGATCCGTGAAGGGGCCGA TTCACCATCTCCAGAGACAATTCCAAGAATACGC TGTATCTGCAAATGAACAGCCTGAGAGCCGAG GCACGGCTGTGTATTACTGTGCGAGAGACGAGC AGCTCGGGACCTTTGACTACTGGGGCCAGGGAA CCCTGGTCACCGTCTCCTCA SEQ ID NO: 29467 |
| | | AA | DIQMTQSPSSLSVSVGDRVTITCRASQSIFRYLN WYQQKPGRAPKLLIFAASSFQSGVPSRFSGSGSG TDFTLTISSLQPEDFATYYCQQTYSPPLTFGGGTK VEIK SEQ ID NO: 25462 | QVQLVESGGGVVQPGRSLRLSCAASGFTFSSYGMH WVRQAPGKGLEWVAVIWHDGSNKYYVDSVKGRF TISRDNSKNTLYLQMNSLRAEDTAVYYCARDEQLG TFDYWGQGTLVTVSS SEQ ID NO: 29468 |
| iPS:434193 | 21-225_56C6 | NA | GACATCCAGATGACCCAGTCTCCATCTTCCGT GTCTGCATCTGTGGGAGACAGAGTCACCATCA CTTGTCGGGCGAGTCAGGGTATTAGCAGCTGG TTAGCCTGGTATCAGCAGAAATCAGGGAATGC CCCTAAGCTCCTGATCTATGCTGCATCCAGATT GCAAAGTGGGGTCCCATCAAGGTTCAGCGGCA GTGGATCTGGGTACAGATATTTCACTCTCATTATCA GCAGCCTGCAGTCTGAAGATTTTGCAACTTAC TATTGTCAACAGGCTAACAGTTTCCCATTCACT TTCGGCCCTGGGACCAAAGTGGATATCAAA SEQ ID NO: 25463 | CAGGTGCAGCTGGTGCAGTCTGGGGCTGAGGTG AAGAAGCCTGGGGCCTCAGTGAAGGTCTCCTGC AAGGCTTCTGGATACACCTTCACCGACTACCATA TGCACTGGGTGCGACAGGCCCCTGGACAAGGGC TTGAGTGGATGGGATGGATCAACCTAACAGAG GTGGCACAAATTATGTACAGAAGTTCAGGGTAG GGTCGCCATGACCAATGACCACGTCCATCAGCACA GCCTATATGGAGCTGAGTGGGCTGAGATCTGACG ACACGGCCGTGTATTACTGTGCGAGAGATGGCAC CTGTCTTTGACTATTGGGGCCGGGGAACCCTG GTCACCGTCTCCTCA SEQ ID NO: 29469 |

FIGURE 50
(Continued)

| | | | | |
|---|---|---|---|---|
| iPS:434195 | 21-225_56F6 | AA | DIQMTQSPSSVSASVGDRVTITCRASQGISSWLA WYQQKSGNAPKLLIYAASRLQSGVPSRFSGSGS GTYFTLIISSLQSEDFATYYCQQANSFPFTFGPGT KVDIK<br><br>SEQ ID NO: 25464 | QVQLVQSGAEVKKPGASVKVSCKASGYTFTDYHM HWVRQAPGQGLEWMGWINPNRGGTNYVQKFQGR VAMTNDTSISTAYMELSGLRSDDTAVYYCARDGTS SFDYWGRGTLVTVSS<br><br>SEQ ID NO: 29470 |
| | | NA | GACATCCAGATGACCCAGTCTCCATCTCTGT GTGTGCATATGTAGGAGACAGAGTCACCATCA CTTGTCGGGTGAGTCAGGATATTAGCAAATGG TTAGCCTGGTTTCAGCAGAAACCAGGGAAAGC CCCTAAATTCTTGATATATGTTGCATCCGGTTT GCAAAGTGGGGTCCCATCAAGGTTCAGCGGCA GTGGATCTGGGACAGATTTCACTTTCACCATC AGCAGCCTGCAGCCTGAAGATTTTGCAACTTA CTATTGTCAACAGGCTAACAGTTTCCCATTCA CTTTCGGCCCTGGGACCAAAGTGGATATCAAA<br><br>SEQ ID NO: 25465 | CAGGTGCAGCTGGTGCAGTCTGGGGCTGAGGTG AAGAAGCCTGGGGCCTCAGTGAAGGTCTCCTGC AAGGCTTCTGGATTCACCTTCACCGACTACTATA TGCACTGGGTGCGACAGGCCCCTGGACAAGGGC TTGAGTGGATGGGATGGATCAACCCTAACAGTGG TGGCACAAACTATGCACAGAGGTTTCAGGGCAG GGTCACCATGACCAGGGACACGTCCATCAGCAC AGCCTACATGGAACTGAGCAGACTGAGATCTGA CGACACGGCCGTGTATTACTGTACGAGAGAGGG AGCAACTCGTCCGACGGGTTTTGACTACTGGGGC CAGGGAACCCTGGTCACCGTCTCCTCA<br><br>SEQ ID NO: 29471 |
| | | AA | DIQMTQSPSSVSASVGDRVTITCRVSQDISKWLA WFQQKPGKAPKFLIYVASGLQSGVPSRFSGSGSG TDFTFTISSLQPEDFATYYCQQANSFPFTFGPGTK VDIK<br><br>SEQ ID NO: 25466 | QVQLVQSGAEVKKPGASVKVSCKASGFTFTDYYM HWVRQAPGQGLEWMGWINPNSGGTNYAQRFQGR VTMTRDTSISTAYMELSRLRSDDTAVYYCTREGAT RPTGFDYWGQGTLVTVSS<br><br>SEQ ID NO: 29472 |

FIGURE 50
(Continued)

| | | | | |
|---|---|---|---|---|
| iPS:434197 | 21-225_56C7 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATACTGCATCCAAT TTACAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTATCCGTG GACGTTCGGCCAAGGGACCAAGGTGGAAATC AAA SEQ ID NO: 25467 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCCACTATA TAAACTGGGTGCGACAGGCCCCTGGACAAGGGC TTGAGTGGATGGCATGGGTCAACCCTAACAGTGG TGGCACAAACTCTGCACAGAAGTTCAGGGCAG GGTCACCATGACCAGGGACACGTCCATCAGCAC AGTCTACATGGAGCTGAGCAGGCTGAGATCTGA CGACACGGCCGTGTATTACTGTGCGAGGGGAGG GCAGCTCGGCGGGTTTAACTACTACTACTACGGT ATGGACGTCTGGGGCCAAGGGACCACGGTCACC GTCTCCTCA SEQ ID NO: 29473 |
| | | AA | DIQMTQSPSSLSASVGDRVTITCRASQGIRNDLG WYQQKPGKAPKRLIYTASNLQSGVPSRFSGSGS GTEFTLTISSLQPEDFATYYCLQHNSYPWTFGQG TKVEIK SEQ ID NO: 25468 | QVQLVQSGAEVKKPGASVKVSCKASGYTFTGHYIN WVRQAPGQGLEWMAWVNPNSGGTNSAQKFQGR VTMTRDTSISTVYMELSRLRSDDTAVYYCARGGQL GGFNYYYYGMDVWGQGTTVTVSS SEQ ID NO: 29474 |
| iPS:434199 | 21-225_59F11 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGCCTGAAGATTTTGCAACT TCAGCAGCCTGCAGCCTGAAGATTTTGCAACT TATTACTGTCTACAGCATAATCGTTACCCTTTC ACTTTCGGCCCCTGGGACCAAAGTGGATTCAA A SEQ ID NO: 25469 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATATGGTATGATGAAAGT AATAAACACTATGCAGACTCCGTGAAGGGCCGA TTCACCATCTCCAGAGACAATTCCAAGACACGC TGTATCTGCAAATGAGCAGCCTGAGAGCCGAGG ACACGGCTGTGTATTATTGTGTGAGAGAACTGGG GATGAACGGAGGACTACTGGGCGCCAGGGAACCCT GGTCACCGTCTCCTCA SEQ ID NO: 29475 |

FIGURE 50
(Continued)

| | | | | |
|---|---|---|---|---|
| iPS:434201 | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNRYPFTFGPGT KVDFK<br>SEQ ID NO: 25470 | QVQLVESGGGVVQPGRSLRLSCAASGFTFSNYGM HWVRQAPGKGLEWVAVIWYDESNKHYADSVKGR FTISRDNSKTTLYLQMSSLRAEDTAVYYCSRELGM NGDYWGQGTLVTVSS<br>SEQ ID NO: 29476 |
| | 21-225_59A12 | NA | CAGGTGCAGCTGGTGGAGTCTGGGGGAGGCGTG GTCCAGCCTGGGAGGTCCCTGAGACTCTCCTGTG CAGGGTCTGGATTCACCTTCAGTAGCTATGGCAT GCACTGGGTCCGCCAGGCTCCAGGCAAGGGGCT GGAGTGGGTGGCAGTTATATGGTATGATGAAGT AATAAATACTATGCAGAGACTCCGTGAAGGGCCGA TTCACCATCTCCAGAGACAATCCAAGAACACGC TGTATCTGCAAATGAACAGCCTGAGAGCCGAGG ACACGGCTGTGTATTACTGTGCGAGGCGTATAG CAGCAGCTGGGACGGGGTATGGACGTCTGGGG CCAAGGGACCACGGTCACCGTCTCCTCA<br>SEQ ID NO: 29477 | GATATTGTGATGACCCAGACTCCACTCTCTCT GTCCGTCACCCCTGGACAGCCGGCCTCCATCT CCTGCAAGTCTAGTCAGAGCCTCCAGCATGGT GAAGGAAAGACCTATTTGTATTGGTACGTGCA GAAGCCAGGCCAGCTCCACAGCTCCTGATCT ATGAAGTTCCTATCGGTTTTCTGGAGTGCCA GATAGGTTCAGTGGCAGTGGGTCAGGGACAG ATTTCACACTGAAAATCAGCGGGTGGAGGTT GAGGATGTTGGGGTTTATTACTGCATGCAAAG TACACAGCTTCCGCTCACCTTCGGCGGAGGGA CCAAGGTGGAGATCAAA<br>SEQ ID NO: 25471 | |
| | | AA | DIVMTQTPLSLSVTPGQPASISCKSSQSLQHGEG KTYLYWYVQKPGQPPQLLIYEVSYRFSGVPDRF SGSGSGTDFTLKISRVEVEDVGVYYCMQSTQLP LTFGGGTKVEIK<br>SEQ ID NO: 25472 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSSS WDGGMDVWGQGTTVTVSS<br>SEQ ID NO: 29478 |

FIGURE 50
(Continued)

| | | | |
|---|---|---|---|
| iPS:434203 | 21-225_60E2 | NA | GACATCCAGATGACCCAGTCTCCATCCCCT GTCTGCATCTGTAGGAGACAGAGTCACCATCA CTTGCCCGGGCAAGTCAGGGACATTAGAAAAGAT TTAGGCTGGTATCAGCAGAAACCAGGGAAAG CCCCTAAGCGCCTGATCTATGCTGCATCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGTG GACGTTCGGCCAAGGGACCAAGGTGGAAATC AAA <br><br> SEQ ID NO: 25473 | CAGGTGCAGCTGGTGGAGTCTGGGGGAGGCGTG GTCCAGCCTGGGAGGTCCCTGAGACTCTCCTGTG CAGCGTCTGGATTCACCTTCAATGACTATGGCAT GCACTGGGTCCGCCAGGCTCCAGGCAAGGGGCT GGAGTGGGTGGCAATTATATGGTATGATGAAAAT AATAAATACTATGCAGACTCCGTGAAGGGCCGA TTCACCATCTCCAGAGACAATTCCAAGAACACGC TGTATCTGCAAATGAGCAGCCTGAGAGCCGAGG ACACGGCTGTATATTACTGTGCGAGAGATGTTCT GGACCCTTTGACTACTGGGGCCAGGGAACCCTG GTCACCGTCTCCTCA <br><br> SEQ ID NO: 29479 |
| | | AA | DIQMTQSPSSLSASVGDRVTITCRASQGIRKDLG WYQQKPGKAPKRLIYAASSLQSGVPSRFSGSGS GTEFTLTISSLQPEDFATYYCLQHNSYPWTFGQG TKVEIK <br><br> SEQ ID NO: 25474 | QVQLVESGGGVVQPGRSLRLSCAASGFTFNDYGM HWVRQAPGKGLEWVAIIWYDENNKYYADSVKGR FTISRDNSKNTLYLQMSSLRAEDTAVYYCARDVLD PFDYWGQGTLVTVSS <br><br> SEQ ID NO: 29480 |
| iPS:434205 | 21-225_60G2 | NA | GATATTGTGATGACCCAGACTCCACTCTCTCT GTCCGTCACACCTGGACAGTCGGCCTCCATCT CCTGCAAGTCTAGTCAGAGCCTCCTGCATAGT GAAGGAAAGAACCTATTTGTATTGGTACCTGCA GAAGCCAGGCCAGCCTCCACAGCTCCTGATCT ATGAAGTTTCCAACCGGATCTCTGGAGTGCCA GATAGGTTCAGTGGCAGCGGGTCAGGGACAG ATTTCACACTGAAAATCAGCCGGGTGGAGGCT GAGGATGTTGGGGTTTATTACTGCATGCAAAG TATACAGCTTCCGCTCACTTTCGGCGGAGGGA CCAAGGTGGAGATCAAA <br><br> SEQ ID NO: 25475 | CAGGTGCAGCTGGTGGAGTCTGGGGGAGGCGTG GTCCAGCCTGGGAGGTCCCTGAGACTCTCCTGTG CAGCGTCTGATTCACCTTCAGTAGTTATGGCAT GCACTGGGTCCGCCAGGCTCCAGGCAAGGGGCT GGAGTGGGTGGCAGTTATATGTGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATTACTGTGCGAGAAGGTATAG CAGAAGCTGGACGGGAGGCATGGACGTCTGGGG CCAAGGGACCACGGTCACCGTCTCCTCA <br><br> SEQ ID NO: 29481 |

FIGURE 50
(Continued)

| | | | | |
|---|---|---|---|---|
| iPS:434207 | 21-225_60A3 | AA | DIVMTQTPLSLSVTPGQSASISCKSSQSLLHSEGK TYLYWYLQKPGQPPQLLIYEVSNRISGVPDRFSG SGSGTDFTLKISRVEAEDVGVYYCMQSIQLPLTF GGGTKVEIK<br>SEQ ID NO: 25476 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSRS WTGGMDVWGQGTTVTVSS<br>SEQ ID NO: 29482 |
| | | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATTTAGTT TGCAAAGTGGGGTCCCATCAAGGTTCAGCGGC AGTGGATCTGGGACAGAATTCACTCTCACAAT CAGCAGCCTGCAGCTGAAGATTTTGCAACTT ATTACTGTCTACAGCATAATAGTTACCCTTTCA CTTTCGGCCCTGGGACCAAAGTGGATATCAAA<br>SEQ ID NO: 25477 | CAGGTGCAACTGGTGGAGTCTGGGGGAGGCGTG GTCCAGCCTGGGAGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGTATGAAGAAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTATATTACTGTGCGAGAGAACTGG GGATGACCGGAGACTACTGGGGCCAGGGAACCC TGGTCACCGTCTCCTCA<br>SEQ ID NO: 29483 |
| | | AA | DIQMTQSPSSLSASVGDRVTITCRASQGIRNDLG WYQQKPGKAPKRLIYAAFSLQSGVPSRFSGSGS GTEFTLTISSLQPEDFATYYCLQHNSYPFTFGPGT KVDIK<br>SEQ ID NO: 25478 | QVQLVESGGGVVQPGRSLRLSCAASGFTFSSYGMH WVRQAPGKGLEWVAVIWYEESNKYYADSVKGRF TISRDNSKNTLYLQMNSLRAEDTAVYYCARELGMT GDYWGQGTLVTVSS<br>SEQ ID NO: 29484 |

FIGURE 50
(Continued)

| | | | |
|---|---|---|---|
| iPS:434209 | 21-225_60C3 | NA | GACATCCAGATGACCCAGTCTCCATCCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATTCTGCATCCAGTT TACAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAATAGTTACCCGTGG ACGTTCGGCCTAGGGACCAAGGTGGAAATCA AA<br><br>SEQ ID NO: 25479 | CAGGTGCAACTAGTGCAGTCTGGGGCTGAGGTG AAGAAGCCTGGGGCCTCAGTGAAGGTCTCCTGC AAGGCTTCTGGATACAGTTTCACCGGCCACTATA TACACTGGGTGCGACAGGCCCCTGGACAAGGGC TTGAGTACATGGGATGGATCAACCCTAACAGCG GTGGCACAAACTATGTACAGAAATTTCAGGGCA GGGTCACCATGACCAGGGACACGTCCATCAGCA CAGCCTACATGGAGCTGAGCAGGCTGAGATCTG ACGACACGGCCATATATTACTGTTCGAGAGGGG GCCTACTGGGAGCTACCAACTACTATTATTACGG TATGGACGTCTGGGGCCAAGGGACCACGGTCAC CGTCTCCTCA<br><br>SEQ ID NO: 29485 |
| | | AA | DIQMTQSPSSLSASVGDRVTITCRASQGIRNDLG WYQQKPGKAPKRLIYSASSLQSGVPSRFSGSGSG TEFTLTISSLQPEDFATYYCLQHNSYPWTFGLGT KVEIK<br><br>SEQ ID NO: 25480 | QVQLVQSGAEVKKPGASVKVSCKASGYSFTGHYIH WVRQAPGQGLEYMGWINPNSGTNYVQKFQGRV TMTRDTSISTAYMELSRLRSDDTAIYYCSRGGLLGA TNYYYGMDVWGQGTTVTVSS<br><br>SEQ ID NO: 29486 |
| iPS:434211 | 21-225_60F3 | NA | GACATCGTGATGACCCAGTCTCCAGACTCCCT GACTGTGTCTCTGGGCGAGAGGGCCACCATCA ACTGCAAGTCCAGCCAGAGTGTTTTATACAGC TCCAACAATAAGAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAATTTATTACTGTCAGCAA TATTATAGTACTCCGTGCAGTTTTGGCCAGGG GACCAAGCTGGAGATCAAC<br><br>SEQ ID NO: 25481 | CAGGTGCTGCTGGTGCAGTCTGGGGCTGAGGTGA AGAAGCCTGGGGCCTCAGTGAAGGTCTCCTGCA AGGCTTCTGGATACACCTTCACCAATTATGATAT CAACTGGGTGCGACAGGCCACTGGACAAGGGCT TGAGTGGATGGGATGCACCTAACAGTGGT AACACAGGCTATGCACAGAAGTTCAGGGCAGA GTCACCATGACCAGGAACACCTCCATAAGCACA GCCTACATGGAGCTGAGCAGCCTGAGATCTGAG GACACGGCCGTGTATTACTGTGCGTATAGCAGTG GCTGGTACTTCTTTGACTACTGGGGCCAGGGAAC CCTGGTCACCGTCTCCTCA<br><br>SEQ ID NO: 29487 |

FIGURE 50
(Continued)

| | | | |
|---|---|---|---|
| iPS:434213 | 21-225_60A4 | AA | DIVMTQSPDSLTVSLGERATINCKSSQSVLYSSN NKNYLAWYQQKPGQPPKLLIYWASTRESGVPD RFSGSGSGTDFTLTISSLQAEDVAIYYCQQYYSTP CSFGQGTKLEIN<br>SEQ ID NO: 25482 | QVLLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YFFDYWGQGTLVTVSS<br>SEQ ID NO: 29488 |
| | | NA | GACATCCAGATGACCCAGTCTCCATCCTCACT GTCTGCATCTGTAGGAGACAGAGTCACCATCA CATGTCGGGCGAGTCAGGGCATTAGCAATTAC TTAGCCTGGTTTCAGCAGAAACCAGGAAAGC CCCTAAGTCCCTGATCTATGCTGCATCCAGTTT GCAAAGTGGGGTCCCATCAAAGTTCAGCGGCA GTGGATCTGGGACAGATCTCACTCTCACCATC AGCAGCCTGCAGTCTGAAGATTTTGCAACGTA CTACTGCCAACAATATAAAAGTCACCCATTCA CTTTCGGCCCTGGGACCAAAGTGGATATCAAA<br>SEQ ID NO: 25483 | GAGGTGCAGCTGTTGGAGTCTGGGGAGGCTTG GTACAGCCTGGGGGGTCCCTGAGACTCTCCTGTG CAGCCTCTGGATTCACCTTTAGCAGCTATGTCAT GAGCTGGGTCCGCCAGGCTCCAGGGAAGGGGCT GGAGTGGGTCTCATCTATTAGTGGTAGTGGTGGT TGGACAAAACTACGCAGACTCCGTGAAGGGCCGA TTCACCACCTCCAGAGACAATTCCAAGAACACGC TGTATCTGCAAATGAACAGCCTGAGAGCCGAGG ACACGGCCGTTTATTACTGTGCGAGACTAACTGG ATTTGACTATTGGGGCCAGGGAACCCTGGTCACC GTCTCCTCA<br>SEQ ID NO: 29489 |
| | | AA | DIQMTQSPSSLSASVGDRVTITCRASQGISNYLA WFQQKPGKAPKSLIYAASSLQSGVPSKFSGSGSG TDFTLTISSLQSEDFATYYCCQQYKSHPFTFGPGT KVDIK<br>SEQ ID NO: 25484 | EVQLLESGGGLVQPGGSLRLSCAASGFTFSSYVMS WVRQAPGKGLEWVSSISGSGGWTNYADSVKGRFT TSRDNSKNTLYLQMNSLRAEDTAVYYCARLTGFD YWGQGTLVTVSS<br>SEQ ID NO: 29490 |

FIGURE 50
(Continued)

| | | | |
|---|---|---|---|
| iPS:434215 | 21-225_60F7 | NA | GACATCAGATGACCCAGTCTCCATCTCACT GTCTGCATCTGTAGGAGACAGAGTCACCATCT CTTGTCGGGCGAGTCAGGTCAGTTCATTAGCA GAATTAT TTAGTCTGGTTCAGCAGAAACCAGGGAAAGC CCCTAAGTCCCTGATCTATGCTGCTCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCTACAGTTTCATAGTTACCCATTCAC TTTCGGCCCTGGGACCAAAATGGATATCAAA<br><br>SEQ ID NO: 25485 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGTCAT GAGCTGGGTCCGCCAGGCTCCAGGGAAGGGGCT GGAGTGGGTCTCAGGTATTAGTGGTAGTGGTAAT AGAACATACTACGCAGACTCCGTGAAGGGCCGG TTCACCATCTCCAGAGACAATTCCAAGAATACGC TGTATCTGCAAATGAACAGCCTGAGAGCCGAGG ACTCGGCCGTTTATTACTGTGGAGTTTGGGGAT TGACTGGGGCCAGGGAACCCTGGTCACCGTCTCC TCA<br><br>SEQ ID NO: 29491 |
| | | AA | DIQMTQSPSSLSASVGDRVTIISCRASQVIKNYLV WVQQKPGKAPKSLIYAASSLQSGVPSTFSGSGSG TDFTLTISSLQPEDFATYYCLQFHSYPFTFGPGTK MDIK<br><br>SEQ ID NO: 25486 | EVQLLESGGGLVQPGGSLRLSCAASGFTFSSYVMS WVRQAPGKGLEWVSGISGSGNRTYYADSVKGRFTI SRDNSKNTLYLQMNSLRAEDSAVYYCGSLGIDWG QGTLVTVSS<br><br>SEQ ID NO: 29492 |
| iPS:434217 | 21-225_60E8 | NA | CAGGTGCAGCTGCAGGAGTCGGGCCCAGGACTG GTGAGGCCTTCGGCGACCCTGTCCCTCACCTGCA CTGTCTCTGGTGGCTCCATCAGCAGGAGTAGTTA CTACTGGGGCTGGATCCGCCAGCCCCCAGGGAA GGGACTGGAGTGGATTGGGAGTATCTATTATAGT GGGAGCGCCTCCTACAACCGTCCCTCCAAGAGTC GAGTCACCATATCGTAGACACGTCTGTGAGAACC AATTCTCCCGAGGCTGAGCTCTGTGCGAGACTGAC AGACACGGCTGTGTATTACTGTGCGAGAGTGGAC AGTGGCTGGTCGTTTGACTACTGGGGCCAGGGAA CCCTGGTCACCGTCTCCTCA<br><br>SEQ ID NO: 29493 |
| | | NA | GACATCAGATGACCCAGTCTCCATCTCCCT GTCTGCATCTGTAGGAGACAGAGTCACCTCA CTTGCCGGGCAAGTCAGGGCATTAGAAATGAT TTAGGCTGGTTTCAGCAGAAACCAGGGAAAGC CCCTAAGCGCCTGATCTATGCTGCATCCAGTTT GCAAAGTGGGGTCCCATCAAGGTTCAGCGGCA GTGGATCTGGGACAGATTCACTCTCACAATC AGCAGCCTGCAGCCTGAAGATTTTGCAACTTA TTACTGTCTACAGCATATAGTTACCCGCTCA CTTTCGGCGGAGGGACCAAGGTGGAGATCAA A<br><br>SEQ ID NO: 25487 | |

FIGURE 50
(Continued)

| | | | |
|---|---|---|---|
| iPS:434219 | 21-225_60E9 | AA | DIQMTQSPSSLSASVGDRVTFTCRASQGIRNDLG WFQQKPGKAPKRLIYAASSLQSGVPSRFSGSGSG TEFTLTISSLQPEDFATYYCLQHSSYPLTFGGGTK VEIK<br>SEQ ID NO: 25488 | QVQLQESGPGLVRPSATLSLTCTVSGGSISRSSYYW GWIRQPPGKGLEWIGSIYYSGSASYNPSLKSRVTIS VDTSENQFSLRLSSVTAADTAVYYCARLDSGWSFD YWGQGTLVTSS<br>SEQ ID NO: 29494 |
| | | NA | GAAATAGTGATGACGCAGTCTCCAGCCACCCT GTCTGTGTCTCCAGGGGAAAGAGCCACCCTCT CCTGTAGGGCCAGTCAGAGTGTTAGCAGTTC TTAGCCTGGTACCGGCAGAAACCTGGCCAGGC TCCCAGGCTCCTCATCTATGGTGCATCCACCA GGGCCACTGGTATCCCGGCCAGTTCAGTGGC AGTGGGTCTGGGACAGAGTTCACTCTCACCAT CAGCAGCCTGCAGTCTGAAGATTTTGCAGTT ATTGCTGTCAGCAGTATAATAACTGGCCATTC ACTTTCGGCCCTGGGACCAAAATAGATATCAA A<br>SEQ ID NO: 25489 | GAGGTGCAGTTGTTGGAGTCTGGGGGAGGCTTGG TACAGCCTGGGGGGTCCCTGAGACTCTCCTGTGC AGCCTCTGGATTCACCTTTAGCAGCTATGCCATG AGCTGGGTCCGCCAGGCTCCAGGGAAGGGGCTG GAGTGGGTCTCAGCTATTAGTGGTAGTGGTGTA ACACATTCTACGCAGACTCCGTGAAGGGCCGGTT CACCATCTCCAGAGACAATTCCAAGAACACGCTG TTTCTTCAAATGAACAGCCTGAGAGCCGAGGACA CGGCCGTATATTACTGTGCGAAATTTTTCGGTAT AGTGGGAGCCGGGTACTTTGACTACTGGGGCCA GGGAACCCTGGTCACCGTCCTCA<br>SEQ ID NO: 29495 |
| | | AA | EIVMTQSPATLSVSPGERATLSCRASQSVSSSLA WYRQKPGQAPRLLIYGASTRATGIPARFSGSGSG TEFTLTISSLQSEDFAVYCCQQYNNWPFTFGPGT KIDIK<br>SEQ ID NO: 25490 | EVQLLESGGGLVQPGGSLRLSCAASGFTFSSYAMS WVRQAPGKGLEWVSAISGSGGNTFYADSVKGRFTI SRDNSKNTLFLQMNSLRAEDTAVYYCAKFFGIVGA GYFDYWGQGTLVTSS<br>SEQ ID NO: 29496 |

FIGURE 50
(Continued)

| | | | |
|---|---|---|---|
| iPS:434221 | 21-225_60A11 | NA | GACATCCAGATGACCCAGTCTCCATCTTCCGT GTCTGCATCTGTAGGAGACAGAGTCACCATCA CTTGTCGGGCGAGTCAGGTTATTAGCAACTGG TTAGCCTGGTATCAGCTGAAACCAGGGAAAGC CCCTAAGCTCCTGATCTATACTGCATCCAGTTT GCAAAGTGGGGTCCCATCAAGGTTCAGCGGCA ATGAATCTGGGACAGATTTCACTCTCACCATC AGCAGCCTGCAGCCTGAAGATTTTGCAACTTA CTATTGTCAACAGGCTAACAGTTTCCCGTGGA CGTTCGGCCAAGGGACCAAGGTGGAAATCAA A SEQ ID NO: 25491 | GAGGTGCAGCTGTTGGAGTCTGGGGGAGGCTTG GTACAGCCGGGGGGGTCCCTGAGACTCTCCTGTG CAGCCTCTGGATTCACCTTTAGCAACTATGCCAT GACCTGGGTCCGCCAGGCTCCAGGGAAGGGCT GGAGTGGGTCTCAGCTATTAGTGGTAGTGGTGGT AACACATTCTACGCAGACTCCGTGACGGGCCGG GTCACCATCTCCAGAGACAATTCCAAGAACACGC TGTATCTGCAAATGAACAGTCTGAGAGCCGAGG ACACGGCGTATATTACTGTGCAAACTGGGGA AGGACTACCACTACTACGGTATGGACGTCTGGGG CCAAGGGACCACGGTCACCGTCTCCTCA SEQ ID NO: 29497 |
| | | AA | DIQMTQSPSSVSASVGDRVTITCRASQVISNWLA WYQLKPGKAPKLLIYTASSLQSGVPSRFSGNESG TDFTLTISSLQPEDFATYYCQQANSFPWTFGQGT KVEIK SEQ ID NO: 25492 | EVQLLESGGGLVQPGGSLRLSCAASGFTFSNYAMT WVRQAPGKGLEWVSAISGSGGNTFYADSVTGRVTI SRDNSKNTLYLQMNSLRAEDTAVYYCAKLGKDYH YYGMDVWGQGTTVTVSS SEQ ID NO: 29498 |
| iPS:434223 | 21-225_60C12 | NA | GACATTGTGATGACCCAGACTCCACTCTCTCT GTCCGTCACCCGTGGACAGCCGGCCTCCATCT CCTGCAAGTCTAGTCAGAGCCTCCTGCATAGT GAGGGAAAGACCTATTTGTATTGGTACCTGCA GAAGCCAGGCCAGTCCACCAGTTCCTGATCT ATGAAGTTTCCAACCGGTTCTCTGGAGTCCA GATAGGTTCAGTGGCAGCGGGTCAGGGACAG ATTTCACACTGAAAATCAGCCGGGTGGAGGCT GAGGATGTTGGGATTTATTACTGCATGCAAAG TATAAAGTATCCGCTCACTTTCGGCGGAGGGA CCAAGGTGGAGATCAAA SEQ ID NO: 25493 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGATGGAAGT AATAAATACTATGTAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAAGGTATAGC AGAAGCTGACGGGAGGTATGGACGTCTGGGGC CAGGGGACCACGGTCACCGTCTCCTCA SEQ ID NO: 29499 |

FIGURE 50
(Continued)

| | | | | |
|---|---|---|---|---|
| iPS:434225 | | AA | DIVMTQTPLSLSVTPGQPASISCKSSQSLLHSEGK TYLYWYLQKPGQPPQFLIYEVSNRFSGVPDRFSG SGSGTDFTLKISRVEAEDVGIYYCMQSIKYPLTF GGGTKVEIK<br><br>SEQ ID NO: 25494 | QVQLVESGGGVVQPGRSLRLSCAASGFTFSSYGMH WVRQAPGKGLEWVAVIWYDGSNKYYVDSVKGRF TISRDNSKNTLYLQMNSLRAEDTAVYYCARRYSRS WTGGMDVWGQGTTVTVSS<br><br>SEQ ID NO: 29500 |
| | 21-225_60E12 | NA | GACATCCAGATGACCCAGTCTCCATCTCCCT GTCTGCATCTGTAGGAGACAGAGTCACCATCA CTTGCCGGGCAAGTCAGAGCATTAGCAGCTAT TTAAATTGGTATCAGCAGAAACCAGGGAAAG CCCCTAAGCTCCTGATCTATGCTGCATCCAGTT TGCAAAGTGGGGTCCCATCAAGGTTCAGTGGC AGTGGATCTGGGACAGATTCACTCTCACCAT CAGCAGTCTGCAACCTGGGAACCTGAAGATTTTGCACCTT ACTACTGTCAACAGAGTTACAATATTTCATTC ACTTTCGGCCCTGGGACCAAAGTGGATATCAA A<br><br>SEQ ID NO: 25495 | CAGGTGCAGCTGCAGGAGTCGGGCCCAGGACTG GTGAAGCCTTCGGAGACCCTGTCCCTCACCTGCA CTGTCTCTGGTGGCTCCATCAGTAGTTACTTCTGG AGCTGGATCCGGCAGCCCGCCGGGAAGGACTG GAGTGGATTGGGCGCATCTATACCAGGGGAGC ACCAACTACAACCCTCCCTCAAGAGTCGAGTCA CCATGTCAGTAGACACGTCCAAGAACCAGTTCTC CCTGAAGCTGAGCTCTGTGACCGCCGCGGACACG GCCGTGTATTACTGTGCGAGAGAGGGAAAACT GGGGGGGTTTCTTACTTTGACTACTGGGGCCAGG GAACCCTGGTCACCGTCTCCTCA<br><br>SEQ ID NO: 29501 |
| | | AA | DIQMTQSPSSLSASVGDRVTITCRASQSISSYLNW YQQKPGKAPKLLIYAASSLQSGVPSRFSGSGSGT DFTLTISSLQPEDFAPYYCQQSYNISFTFGPGTKV DIK<br><br>SEQ ID NO: 25496 | QVQLQESGPGLVKPSETLSLTCTVSGGSISSYFWSW IRQPAGKGLEWIGRIYTRGSTNYNPSLKSRVTMSVD TSKNQFSLKLSSVTAADTAVYYCAREGKTGGVSYF DYWGQGTLVTVSS<br><br>SEQ ID NO: 29502 |

FIGURE 50
(Continued)

| | | | |
|---|---|---|---|
| iPS:434227 | 21-225_61A1 | NA | GACATCCAGATGACCCAGTCTCCATCCTCCCT GTCTGCATCTGTAGGAGACAGAGTCACCATCA CTTGCCGGGCAAGTCAGAGCATTAGCAGCTAT TTAAATTGGTATCAGCAGAAACCAGGAAAG CCCCTAAGCTCCTGATCTATGCTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCACTT ACTACTGTCAACAGAGTTACAATATTTCATTC ACTTTCGGCCCTGGGACCAAAGTGGATATCAA A SEQ ID NO: 25497 |
| | | AA | DIQMTQSPSSLSASVGDRVTITCRASQSISSYLNW YQQKPGKAPKLLIYAASSLQSGVPSRFSGSGSGT DFTLTISSLQPEDFAPYYCQQSYNISFTFGPGTKV DIK SEQ ID NO: 25498 | CAGGTGCAGCTGCAGGAGTCGGGCCAGGACTG GTGAAGCCTTCGGAGACCCTGTCCCTCACCTGCA CTGTCTCTGGTGGCTCCATCAGTAGTCACTTCTG GAGCTGGATCCGGCAGCCCCGGGAAGGACT GGAGTGGATTGGGCGCATCTATATCAGGGGAG CACCAACTACAACCCCTCCCTCAAGAGTCGAGTC ACCATGTCAGTAGACACGTCCAAGAACCAGTTCT CCCTGAAGCTGAGCTCTGTGACCGCCGCGGACAC GGCCGTGTATTACTGTGCGAGAGAGGGAAAAAC TGGGGGGTTCTTACTTGACTACTGGGGCCAG GGAACCCTGGTCACCGTCCCTCA SEQ ID NO: 29503 |
| iPS:434229 | 21-225_61H1 | NA | GACATCCAGATGACCCAGTCTCCATCCTCCCT GTCTGCATCTGTAGGAGACAGAGTCACCATCA CTTGCCGGGCAAGTCAGGGCATTAGAAACAGAT TTAGGCTGGTATCAGCAGAAACCAGGGAAAG CCCCTAAGCGCCTGATCTTTGCTGCATCCAGTT TGCAAAGTGGGGTCCCATCAAGGTTCAGCGGC AGTGGATCTGGGACAGACCTCAGCCTGCAACTT CAGCAGCCTGCAGCCTGACATATAGTTACCCGTGG ACGTTCGGCCAAGGGACCAAGGTGGAAATCA AA SEQ ID NO: 25499 | CAGGTGCAGCTGGTGGAGTCTGGGGGAGGCGTG GTCCAGCCTGGGAGGTCCCTGAGACTCTCCGTG CAGCGTCTGGATTCACCTTCAATGACTATGGCAT GCACTGGGTCCGCCAGGCTCCAGGCAAGGGGCT GGAGTGGGTGGCAATTATATGGTATGATGAAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATATTACTGTGCGAGAGATGTTCT GGACCCTTTTGACTACTGGGGCCAGGGAACCCTG GTCACCGTCCCTCA SEQ ID NO: 29505 |

FIGURE 50
(Continued)

| | | | | |
|---|---|---|---|---|
| iPS-434231 | 21-225_61F2 | AA | DIQMTQSPSSLSASVGDRVTITCRASQGIRKDLG WYQQKPGKAPKRLIFAASSLQSGVPSRFSGSGSG TEFTLTISSLQPEDFATYYCLQHNSYPWTFGQGT KVEIK<br>SEQ ID NO: 25500 | QVQLVESGGGVVQPGRSLRLSCAASGFTFNDYGM HWVRQAPGKGLEWVAIIWYDESNKYYADSVKGRF TISRDNSKNTLYLQMNSLRAEDTAVYYCARDVLDP FDYWGQGTLVTVSS<br>SEQ ID NO: 29506 |
| | | NA | GACATCCAGATGACCCAGTCTCCATCCTCCCT GTCTGCATCTGTAGGAGACAGAGTCACCATCA CTTGCCGGGCAAGTCAGGGCATTAGAGATGAT TTAGGCTGGTATCAGCAGAAACCAGGGAAAG CCCCTGAGCGCCTGATCTATGCTGCATCCAGT TTGCAAAGTGGGGTCCCATCAAGGTTCAGCGG CAGTGGATCTGGGACAGAGTTCACTCTCACAA TCAGCAGCCTGCAGCCTGAAGATTTTGCAACT TATTACTGTCTACAGCATTATAGTTACCCTGC AGTTTTGGCCAGGGGACCAAGCTGGAGATCAA A<br>SEQ ID NO: 25501 | CAGGTGCAGCTGGTGGAGTCTGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGAGTA TAGCAGTGGCTGGTACGACTACGGTATGGACGTC TGGGGCCAAGGGACCACGGTCACCGTCTCCTCA<br>SEQ ID NO: 29507 |
| | | AA | DIQMTQSPSSLSASVGDRVTVTCRASQGIRDDLG WYQQKPGKAPERLIYAASSLQSGVPSRFSGSGSG TEFTLTISSLQPEDFATYYCLQHYSYPRSFGQGT KLEIK<br>SEQ ID NO: 25502 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARERYSS GWYDYGMDVWGQGTTVTVSS<br>SEQ ID NO: 29508 |

FIGURE 50
(Continued)

| | | | |
|---|---|---|---|
| iPS:434233 | 21-225_61B3 | NA | GATATTGTGATGACCCAGACTCCACTCTCTCT GTCCGTCACCTGGACAGCCGGCCTCCATCT CCTGCAAGTCTAGTCAGAGCCTCCTGCATAGT GAAGGAAAGACCTATTTGTATTGGTACCTGCA GAAGCCAGGCCAGCCTCCACAGCTCCTGATCT ATGAAGTTTCCAACCGATCTCTGAGTGCCA GATAAGGTTCAGTGGCAGCGGGTCAGGACAG ATTTTCACACTGAAAATCAGCCGGGTGAGGCT GAGGATGTTGGGGTTTATTACTGCATGCAAAG TATACAGCTTCCGCTCACTTTCGGCGGAGGGA CCAAGGTGGAGATCAAA<br><br>SEQ ID NO: 25503 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAAGGTATAG CAGAAGCTGGGCGGGAGGCATGGACGTCTGGGG CCAAGGGACCACGGTCACCGTCTCCTCA<br><br>SEQ ID NO: 29509 |
| | | AA | DIVMTQTPLSLSVTPGQPASISCKSSQSLLHSEGK TYLYWYLQKPGQPPQLLIYEVSNRISGVPDRFSG SGSGTDFTLKISRVEAEDVGVYYCMQSIQLPLTF GGGTKVEIK<br><br>SEQ ID NO: 25504 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSRS WAGGMDVWGQGTTVTVSS<br><br>SEQ ID NO: 29510 |
| iPS:434235 | 21-225_61E3 | NA | GACATCGTGATGACCCAGTCTCCAGACTCCCT GGCTGTGTCTCTGGGCGAGAGGGCCACCATCA ACTGCAAGTCCAGCCAGAGTGTTTTACACATC TCCAACAATAACAATTACTTAGCTTGGTACCA GCAGCAACCAGGACAGCCTCCTAAACTGCTCA TTTACTGGGCATCTATCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTATTCCGTGCAGTTTTGGCCAGGG GACCAAGCTGGAGATCAAA<br><br>SEQ ID NO: 25505 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGACCCTAACAGTGG TAACACAGGCTATGCACAGAAGTTCCAGGCAG AGTCACCATGACCAGGAACACCTCCATAAGCAC AGCCTACATGGAGCTGAGCAGCCTGAAATCTGA GGACACGGCCCGTGTATTACTGTGCGTATAGCAGT GGCTGGTACCGCTTTGACTACTGGGGCCAGGGAA CCCTGGTCACCGTCTCCTCA<br><br>SEQ ID NO: 29511 |

FIGURE 50
(Continued)

| | | | |
|---|---|---|---|
| iPS:434237 | 21-225_61B5 | AA | DIVMTQSPDSLAVSLGERATINCKSSQSVLHISN NNNYLAWYQQQPGQPPKLLIYWASIRESGVPDR FSGSGSGTDFTLTISSLQAEDVAVYYCQQYYSIP CSFGQGTKLEIK<br>SEQ ID NO: 25506 | QVQLVQSGAEVKKPGASVKVSCKASGYTFTNYDIN WVRQATGQGLEWMGWMTPNSGNTYAQKFQGR VTMTRNTSISTAYMELSSLKSEDTAVYYCAYSSGW YRFDYWGQGTLVTVSS<br>SEQ ID NO: 29512 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTATACAGC TCCAACAATAACAGGACAACTCCTTAACTTGGTACCA GCTGAAACCAGGACAGCCTCCTAAGAAGTCA TTTACTGGGCATCTCACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCCGACGTTCGGCCAAGG GTCCAAGGTGGAAATCAAA<br>SEQ ID NO: 25507 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TAGCACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGTATAGCAGT GGCTGGTACTACTTTGACTACTGGGGCCAGGGAA CCCTGGTCACCGTCTCCTCA<br>SEQ ID NO: 29513 |
| | | AA | DIVMTQSPDSLAVSLGERATINCKSSQSVLYSSN NNNSLTWYQLKPGQPPKKLIYWASTRESGVPDR FSGSGSGTDFTLTISSLQAEDVAVYYCQQYYSTP PTFGQGSKVEIK<br>SEQ ID NO: 25508 | QVQLVQSGAEVKKPGASVKVSCKASGYTFTNYDIN WVRQATGQGLEWMGWMHPNSGSTGYAQKFQGR VTMTRNTSISTAYMELSSLRSEDTAVYYCAYSSGW YYFDYWGQGTLVTVSS<br>SEQ ID NO: 29514 |

FIGURE 50
(Continued)

| | | | |
|---|---|---|---|
| iPS:434239 | 21-225_58F1 | NA | GACATCCAGATGACCCAGTCTCCATCCTCCCT GTCTGCATCTGTAGGAGACAGAGTCACCATCA CTTGCCGGGCAAGTCAGAGACATTAGCAACTTT TTAAATTGGTATCAGCAGAAACCAGGGAAAG CGCCTAAAACTCCTGATCTTCGCTGCATCCAGTT TGCAAAGTGGAATCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTATCCCGTGG ACGTTCGGCCAAGGGACCAAGGTGGAAATCA AA |
| | | | SEQ ID NO: 25509 |
| | | AA | DIQMTQSPSSLSASVGDRVTITCRASQSITNFLN WYQQKPGKAPKLLIFAASSLQSGIPSRFSGSGSG TDFTLTISSLQPEDFATYYCQQSYSIPWTFGQGT KVEIK |
| | | | SEQ ID NO: 25510 |
| | | NA | GAGGTGCAGCTGTTGGAGTCTGGGGGAGGCTTG GTTCAGCCTGGGGGGTCCCTGAGACTCTCCTGTG CAGCCTCTGGATTCACCTTTAGCAGCTATGCCAT GAGTTGGGTCCGCCAGGCTCCAGGGAAGGGGCT GGAGTGGGTCTCAGCTATTAGTACTGGTGGTGGT AACACATACTACGCAGACTCCGTGAAGGGCCGG TTCACCATTTCCAGAGACAATTCCAAGAACACGC TGTATCTGCAAATGAACAGCTGAGAGCCGAGG ACACGGCCGTATATTACTGTGCGAAACGGGGGG TCTACGGTGACTTTGATGCTTTTGATATCTGGGGC CAAGGGACAATGGTCACCGTCTCTCA |
| | | | SEQ ID NO: 29515 |
| | | AA | EVQLLESGGGLVQPGGSLRLSCAASGFTFSSYAMS WVRQAPGKGLEWVSAISTGGGNTYYADSVKGRFT ISRDNSKNTLYLQMNSLRAEDTAVYYCAKRGVYG DFDAFDIWGQGTMVTVSS |
| | | | SEQ ID NO: 29516 |
| iPS:434241 | 21-225_61E6 | NA | GACATCCAGATGACCCAGTCTCCATCCTCCCT GTCTGCATCTGTAGGAGACAGAATCACCATCA CTTGCCGGGCAAGTCAGGGCATTAGCAATGAT TTAGGCTGGTATCAGCAGAAACCAGGGAAAG CCCCTGAGCGCCTGATCTATGCTGCATCCAGT TTGCAAAGTGGGGTCCCATCAAGGTTCAGCGG CAGTGGATCTGGGACAGATTTCACTCTCACAA TCAGCAGCCTGCAGCCTGAAGATTTTGCAACT TATTACTGTCTACAACATAATAGTTCCCTCCG TGGACGTTCGGCCAAGGGACCAAGGTGGAAA TCAAA |
| | | | SEQ ID NO: 25511 |
| | | NA | GAGGTGCAGCTGTTGGAGTCTGGGGGAGGCTTG GTACAGCCTGGGGGGTCCCTGAGACTCTCCTGTG CAGCCTCTGGATTCACCTTTAGAAGCTATGCCAT GAGCTGGGTCCGCCAGGCTCCAGGGAAGGGGCT GGAGTGGGTCTCAGCTACTAGTGGTAGTGGTGTT AACACATTCTACGCAGAGACTCCGTGAAGGGCCGGT TCACCATCTCCAGAGACAATTCCAAGAACACGCT GTATCTGCAAATGAACAGCTGAGAGCCGAGGA CACGGCCGTATATTACTGTGCGAAATTGGAACTG GGGATCTTTGACTACTGGGGCCAGGGAACCCTGG TCACCGTCTCCTCA |
| | | | SEQ ID NO: 29517 |

FIGURE 50
(Continued)

| | | | | |
|---|---|---|---|---|
| iPS:434243 | 21-225_62C1 | AA | DIQMTQSPSSLSASVGDRITITCRASQGIGNDLG WYQQKPGKAPERLIYAASSLQSGVPSRFSGSGSG TEFTLTISSLQPEDFATYYCLQHNSFPPWTFGQG TKVEIK<br>SEQ ID NO: 25512 | EVQLLESGGGLVQPGGSLRLSCAASGFTFRSYAMS WVRQAPGKGLEWVSATSGSGVNTFYADSVKGRFT ISRDNSKNTLYLQMNSLRAEDTAVYYCAKLELGIF DYWGQGTLVTVSS<br>SEQ ID NO: 29518 |
| | | NA | GATATTGTGATGACTCAGTCTCCACTCTCCCTG CCCGTCACCCCTGGAGAGCCGGCCTCCATCTC CTGCAGGTCTAGTCAGAGCCTCCTACACAGTA ATGGATACAACTATTTGGATTGGTACCTGCAG AAGCCAGGGCAGTCTCCACAGCTCCTGATCTA TTTGGTTTCTAATCGGCCTCCGGGGTCCCTGA CAGGTTCAGTGCAGTGGATCAGGCACAGATT TACACTGAAAATCAGCAGAGTGGGGGCTGA GGATGTTGGGGTTTATTTCTGCCTGCAAGCTCT ACAAACTCCTCTCACCTTCGGCCAAGGGACAC GACTGGAGAGATTAAA<br>SEQ ID NO: 25513 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGACT GGAGTGGGTCTCATCCATTAGTAGTAGTAGTAGT TACATATACTCCAGAGACTCAGTGAAGGGCCGAT TCACCATCTGCAAATGAACAGCTGGATTTTGGAGTG CACGGCTGTGTATTACTGTGCGATTTTGGAGTG GACTGGGGCCAGGGAACCCTGGTCACCGTCTCCT CA<br>SEQ ID NO: 29519 |
| | | AA | DIVMTQSPLSLPVTPGEPASISCRSSQSLLHSNGY NYLDWYLQKPGQSPQLLIYLVSNRASGVPDRFS GSGSGTDFTLKISRVGAEDVGVYFCLQALQTPLT FGQGTRLEIK<br>SEQ ID NO: 25514 | EVQLVESGGGLVKPGGSLRLSCAASGFTFSSYSMN WVRQAPGKGLEWVSSISSSSYIYYADSVKGRFTIS RDNAKNSLYLQMNSLRAEDTAVYYCAIFGVDWGQ GTLVTVSS<br>SEQ ID NO: 29520 |

FIGURE 50
(Continued)

| | | | |
|---|---|---|---|
| iPS:434245 | 21-225_62H1 | NA | GACATCCAGATGACCCAGTCTCCATCTCCT GTCTGCATATGTAGGAGACAGAGTCACCATCA CTTGCCGGGCAAGTCAGAGACAGAACATTTCAGCTAT TTAAATTGGTATCAGCAGAAACCAGGGAAAG CCCCTAAGGTCCTGATCTATGCTGTATTTAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTACCCATTC ACTTTCGGCCCTGGGACCAAAGTGGATATCAA A | CAGGTGCAGCTGGTGGAGTCTGGGGGAGGCGTG GTCCAGCCTGGGAGGTCCCTGAGACTCTCCTGTG CAGGCTCTGGATTCACCTTCAGTAGTAGTATGGCAT GCACTGGGTCCGCCAGGCTCCAGGCAAGGGGCT GGAGTGGATGGCAATTATATATGGTTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAG ACACGGCTGTGTATTACTGTGCGAGAGAAGACCC GCGTACCAGCTGCTGACTACTGGGGCCAGGGA ACCCTGGTCACCGTCTCCTCA |
| | | | SEQ ID NO: 25515 | DIQMTQSPSSLSAYVGDRVTITCRASQNIFSYLN WYQQKPGKAPKVLIYAVFSLQSGVPSRFSGSGS GTDFTLTISSLQPEDFATYYCQQSYSTPFTFGPGT KVDIK | QVQLVESGGGVVQPGRSLRLSCAASGFTFSSYGMH WVRQAPGQGLEWMAIIWYDGSNKYYADSVKGRF TISRDNSKNTLYLQINSLRAEDTAVYYCAREDPRTS CSDYWGQGTLVTVSS |
| | | AA | SEQ ID NO: 25516 | SEQ ID NO: 29521 |
| iPS:434247 | 21-225_62D2 | NA | GACATCCAGATGACCCAGTCTCCATCTCCCT GTCTGCATCTGTAGGAGACAGAGTCACCATCA TTTGCCGGGCAAGTCAGAGACATTATCAGTTAT TTAAATTGGTATCAGCAGAAACCAGGGAAAG CCCCTAAGCTCCTGATCTATGCTACATCCAGTT TGCAAAGTGGGGTGGTGGCAGTTATATGATGGAAGT TCAACTTGGGACAGATTTCACTCTCACCAT CAGCAGTCTGCAAATGAACAGCCTGAGAGCCGAG ACTACTGTCAACAGACTTACAGTCCCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGGCTCTGGATTCACCTTCAGTAGTAGTATGGCAT GCACTGGGTCCGCCAGGCTCCAGGCAAGGGCT GGAGTGGATGGCAGTTATATGATGGAAGT AATAAATACTCTCCAGAGACAATTCCAAGAACACGCT GGATCTGCAAATGAACAGCTGAGAGCCGAGGA CACGGCTGTGTATTACTGTGCGAGAGATAATGGT AACTGAACTACCTTGACTACTGGGGCCAGGGA ACCCTGGTCACCGTCCCTCA |
| | | | SEQ ID NO: 25517 | SEQ ID NO: 29523 |

FIGURE 50
(Continued)

| | | | | |
|---|---|---|---|---|
| iPS:434249 | 21-225_62E2 | AA | DIQMTQSPSSLSASVGDRVTIICRASQSIISYLNW YQQKPGKAPKLLIYATSSLQSGVPSRFSGSGSGT DFTLTISSLQPEDFATYYCQQTYSPPLTFGGGTK VEIK | QVYLVESGGGVVQPGRSLRLSCAASGFTFSSYGMH WVRQAPGKGLEWVAVIWYDGSNKYSADSVKGRF TISRDNSKNTLDLQMNSLRAEDTAVYYCARDNGN WNYLDYWGQGTLVTVSS |
| | | | SEQ ID NO: 25518 | SEQ ID NO: 29524 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCCGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAGTAATTACCCTCTCA CTTTCGGCGGAGGGACCAGGGTTGAGATCAAA | CAGCTGCAGCTGCAGGAGTCGGGCCCAGGACTG GTGAAGCCTTCGGAGACCCTGTCCCTCACCTGTA TTGTCTCTGGTGGCTCCATCAGCAGAAGTAGTTA CTACTGGGGCTGGATCCGCCAGCCCCCAGGGAA GGGGCTGGAGTGGATTGGGAGCATCTATTATAGT GGGATCGCCTCCTATAATCGTCCTCCTCAAGAGTC GAGTCACCATATCCGTAGACACGTCCAAGAACC AGTTCTCCCTGAAGCTGAACTCTGTGACCGCCAC AGACACGGCTGTATATTACTGTGCGAGACTGAGC AGTGGCTGGTCCTTTGACTACTGGGGCCAGGGAA CCCTGGTCACCGTCTCCTCA |
| | | | SEQ ID NO: 25519 | SEQ ID NO: 29525 |
| | | AA | DIQMTQSPSSLSASVGDRVTITCRASQGIRNDLG WYQQKPGKAPKRLIYAASRLQSGVPSRFSGSGS GTEFTLTISSLQPEDFATYYCLQHSNYPLTFGGG TRVEIK | QLQLQESGPGLVKPSETLSLTCIVSGGSISRSSYYWG WIRQPPGKGLEWIGSIYYSGIASYNPSLKSRVTISVD TSKNQFSLKLNSVTATDTAVYYCARLSSGWSFDY WGQGTLVTVSS |
| | | | SEQ ID NO: 25520 | SEQ ID NO: 29526 |

FIGURE 50
(Continued)

| | | | |
|---|---|---|---|
| iPS:434251 | 21-225_62G3 | NA | GACATCCATATGACCCAGTCTCCATCTCCCT GTCTGCATCTGTAGGAGACAGAGTCACCATCA CTTGCCGGGCAAGTCAGGACATTAGAAATAAT TTAGGCTGGTATCAGCAGAAACCAGGGAAAG CCCCTAAGCGCCTGATCTATACTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCGACT TATTACTGTCTACAGTATAATAGTTACCCATTC ACTTTCGGCCCTGGGACCAAAGTGGATATCAA A | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGCT GGAGTGGGTCTCATCCATTAGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGA CACGGCTGTATATTACTGTGCGAGGGTTAACTCT TTTGACTCCTGGGGCCAGGGAACCCTGGTCACCG TCTCCTCA |
| | | | SEQ ID NO: 25521 | SEQ ID NO: 29527 |
| | | AA | DIHMTQSPSSLSASVGDRVTITCRASQDIRNNLG WYQQKPGKAPKRLIYTASSLQSGVPSRFSGSGSG TEFTLTISSLQPEDFATYYCLQYNSYPFTFGPGTK VDIK | EVQLVESGGGLVKPGGSLRLSCAASGFTFSSYSMN WVRQAPGKGLEWVSSISSSSYIYYADSVKGRFTIS RDNAKNSLYLQMNSLRAEDTAVYYCARVNSFDSW GQGTLVTVSS |
| | | | SEQ ID NO: 25522 | SEQ ID NO: 29528 |
| iPS:434253 | 21-225_62E4 | NA | GACATCCAGATGACCCAGTCTCCATCTCCCT GTCTGCATCTGTAGGAGACAGAGTCACCATCA CTTGCGCGGGCAAGTCAGGGCATTAGAAATGAT TTAGGCTGGTATCAGCAGAAACCAGGGAAAG CCCCTAAGCGCCTAATCTATGCTGCATTCAGT TGCAAAGTGGGGTCCCATCAAGGTTCAGCGGC AGTGGATCTGGGACAGCCTGAAGATTTTGCAACTT CAGCAGCCTGCAGCCTGAAGATTTTGCAACTT ATTACTACTGTCTACAGCATATAAGTTATCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCTGTG CAGCGTCTGGATTCACCTTCAGTGACTATGCAT GCACTGGGTCCGCCAGGCTCCAGGCAAGGGCT GGAGTGGGTGGCAGTTATATCAGACTCCGTGAAGAGT AATAAATACTATGCAGACTCCGTGAAGGGCCGA TTCACCATCTCCAGAGACAATTCCAAGAACAGC TGTATCTGCAAATGAACAGCCTGAGAGCTGAGG ACACGGCTGTGTATCACTGTGCGAGAGAGCTTGG GTTCAGCAGTGACTACTGGGGCCAGGGAACCCT GGTCACCGTCTCCTCA |
| | | | SEQ ID NO: 25523 | SEQ ID NO: 29529 |

FIGURE 50
(Continued)

| | | | |
|---|---|---|---|
| iPS:434255 | 21-225_62E6 | AA | DIQMTQSPSSLSASVGDRVTITCRASQGIRNDLG WYQQKPGKAPKRLIYAAFSLQSGVPSRFSGSGS GTEFTLTISSLQPEDFATYYCLQHNSYPLTFGGG TKVEIK<br>SEQ ID NO: 25524 | QVQLVESGGGVVQPGRSLRLSCAASGFTFSDYGM HWVRQAPGKGLEWVAVIWYDRSNKYYADSVKGR FTISRDNSKNTLYLQMNSLRVEDTAVYHCARELGF SSDYWGQGTLVTVSS<br>SEQ ID NO: 29530 |
| | | NA | GAAATAGTGATGACGCAGTCTCCAGCCACCCT GTCTGTGTCTCCAGGGGAAAGAGCCACCCTCT CCTGCAGGGCCAGTCAGAGTGTTAACAGCAAC TTAGCCTGGTACCAGCAGAAACCTGGCCAGGC TCCCAGGCTCCTCATCTCTGTTGCATCCACCAG GGCCACTGGTATCCCAGCCAGGTTCAATGGCA GTGGGTCTGGGACAGAGTCACTCTCACCATC AGCAGCCTGCAGTCTGAAGATTTTGCAGTTTA TACTGTCAGCAGTATAATGACTGGCCGTGTA GTTTGGCCAGGGGACCAAGCTGGAGATCAAA<br>SEQ ID NO: 25525 | CAGGTGCAGCTGGTGGAGTCTGGGGGAGGCGTG GTCCAGCCTGGGAGGTCCCTGAGACTCTCCTGTG CAGCGTCTGGATTCACCTTCAGTTCCTATGGCAT GCACTGGGTCCGCCAGGCTCCAGGCAAGGGCT GGAGTGGGTGGCAGTATATGGTATGATGGAAG TAATAAATACTATGGAGACTCCGTGAAGGGCCG AGTCACCATCTCCAGAGACAATTCCAAGAACTCG CTGCATCTGCAAATGAACAGCTGAGAGCCGAG GACACGGCTGTGTATTATTGTGCGAGAGATCAGG GCATAGTGGGAGCTACTTGGTTTGACTACTGGGG CCAGGGAACCCTGGTCACCGTCTCCTCA<br>SEQ ID NO: 29531 |
| | | AA | EIVMTQSPATLSVSPGERATLSCRASQSVNSNLA WYQQKPGQAPRLLISVASTRATGIPARFNGSGSG TEFTLTISSLQSEDFAVYYCQQYNDWPCSFGQGT KLEIK<br>SEQ ID NO: 25526 | QVQLVESGGGVVQPGRSLRLSCAASGFTFSSYGMH WVRQAPGKGLEWVAAIWYDGSNKYYGDSVKGRV TISRDNSKNSLHLQMNSLRAEDTAVYYCARDQGIV GATWFDYWGQGTLVTVSS<br>SEQ ID NO: 29532 |

FIGURE 50
(Continued)

| | | | |
|---|---|---|---|
| iPS:434257 | 21-225_62F7 | NA | GACATCCAGATGACCCAGTCTCCATCTCCCT GTCTGCATCTGTAGGAGACAGAGTCACCATCA CTTGCCGGGCAAGTCAGGCCATTAGAAATGAT TTAGGCTGGTATCAGCAGAAACCAGGGAAAG CCCCTAAGCGCCTGATCTATCTGCATCCCGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGTATAATAGTTACCCTCCGT GGACGTTCGGCCAAGGGTCCAAGGTGGAAAT CAAA |
| | | | SEQ ID NO: 25527 |
| | | AA | DIQMTQSPSSLSASVGDRVTITCRASQAIRNDLG WYQQKPGKAPKRLIYPASRLQSGVPSRPSGSGS GTEFTLTISSLQPEDFATYYCLQYNSYPPWTFGQ GSKVEIK |
| | | | SEQ ID NO: 25528 |
| iPS:434259 | 21-225_62G7 | NA | GACATCCAGATGACCCAGTCTCCATCTCCGT GTCTGCATCTGTAGGAGACAGAGTCACCTTCA CTTGTCGGGCCAGTCAGGATATTAGCAGCTGG TTAGCCTGGTATCAGCAGAAATCCAGGGAAGGC CCCTAAACTCCTGATCTATGCTGCATCCAGTT GCAAAGTGGGGTCCCATCAAGGTTCAGCGGCA GTGGATCTGGGACAAATTCACTCTCACCATC AGCAGCCTCCAGCCTGAAGATTTTGCAACTTA CTATTGTCAACAGACTAACAGTTTCCCTCTCAC TTTCGGCGGAGGGACCAAGGTGGAGATCAAA |
| | | | SEQ ID NO: 25529 |

| |
|---|
| GAGGTGCAGCTGTTGGAGTCTGGGGGAGGCTTG GTTCAGCCTGGGGGGTCCCTGAGACTCTCCTGTG CAGCCTCTGGATTCACCTTTAGCAGCTATGTTAT GAGCTGGGTCCGCCAGGCTCCAGGGAAGGGGCT GGAGTGGGTCTCAGTTATTAGTGGTAGTGGTGCT AAACATACTATGCAGACTCCGTGAAGGGCCGA TTCACCATCTCCAGAGACAATTCCAAGAACACGC TGTATCTGCAAATGAACAGCCTGAGAGCCGAGG ACACGGCCGTATATTACTGTGCGGAACTGGGGAT AGAGTACTACTACGGTATGGACGTCTGGGGCCAA GGGACCACGGTCACCGTCTCCTCA |
| SEQ ID NO: 29533 |
| EVQLLESGGGLVQPGGSLRLSCAASGFTFSSYVMS WVRQAPGKGLEWVSGISGSGAKTYADSVKGRFT ISRDNSKNTLYLQMNSLRAEDTAVYYCAELGIDYY YGMDVWGQGTTVTSS |
| SEQ ID NO: 29534 |
| CAGGTGCAGCTGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGAC TTGAGTGGATGGGATGGATCAACCCTAACAGTGG TGGCACAAACCAAGCACAGAAGTTTCAGGGCA GGGTCACCATGACCAGGGACACGTCCATCAGCA CAGCCTACATGGAGCTGAGCAGTCTGAGATCTGA CGACACGGCCGTGTATTACTGTGCGGAGAGCTCG GGTATAGCAGCAGCTGGTACATGGTACATTTG ACTACTGGGGCCAGGGAACCCTGGTCACCGTCTC CTCA |
| SEQ ID NO: 29535 |

FIGURE 50
(Continued)

| | | | | |
|---|---|---|---|---|
| | | AA | DIQMTQSPSSVSASVGDRVTFTCRASQDISSWLA WYQQNPGKAPKLLIYAASSLQSGVPSRFSGSGS GTNFTLTISSLQPEDFATYYCQQTNSFPLTFGGGT KVEIK<br>SEQ ID NO: 25530 | QVQLVQSGAEVKKPGASVKVSCKASGYTFTGYYM HWVRQAPGQGLEWMGWIKPKSGTNQAQKFQGR VTMTRDTSISTAYMELSSLRSDDTAVYYCARAPGI AAAGTWGYFDYWGQGTLVTVSS<br>SEQ ID NO: 29536 |
| iPS-434261 | 21-225_56F7 | NA | GACATCCTGATGACCCAGTCTCCATCCTCACT GTCTGCATCTGTAGGAGACAGAGTCACCATCA CTTGTCGGGCGAGTCAGGGCATTAGCACTTAT TTAGCCTGGTTTCAGCAGAAACACCAGGACAGC CCCTAAGTCCCTGATCTATGCTGCATCCAGTTT GCAAGGTGGGGTCCCATCAAAGTTCAGCGGCA GTGGATCTGGGACAGATTTCACTCTCACCATC AGCAGCCTGCAGCCTGAAGATTTTGCAACTTA TTACTGCCATCAGTATAGTTCCCATTTAA GTTCGGGCGTGGAGACCAAAGTGGATATCACA<br>SEQ ID NO: 25531 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGTCTT AAACTGGGTCCGCCAGGCTCCAGGGAAGGGGCT GGAGTGGGTCTCAGCTATGAGTGGTAGTGGTGGT AGAACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTTCTGTGCGATGACTACGCA CTTTGACTACTGGGGCCAGGGAACCCTGGTCACC GTCTCCTCA<br>SEQ ID NO: 29537 |
| | | AA | DILMTQSPSSLSASVGDRVTITCRASQGISTYLA WFQQTPGTAPKSLIYAASSLQGGVPSKFSGSGSG TDFTLTISSLQPEDFATYYCHQYNSFPFKFGRGT KVDIT<br>SEQ ID NO: 25532 | EVQLLESGGGLVQPGGSLRLSCAASGFTFSSYVLN WVRQAPGKGLEWVSAMSGSGGRTYYADSVKGRF TISRDNSKNTLYLQMNSLRAEDTAVYFCAMTTHFD YWGQGTLVTVSS<br>SEQ ID NO: 29538 |

FIGURE 50
(Continued)

| | | | |
|---|---|---|---|
| iPS:434263 | 21-225_56H7 | NA | GACATCCAGCTGACCCAGTCTCCATCTCCCT GTCTGCATCTGTAGGAGACAGAGTCACCATCA CTTGCCGGGCAAGTCAGGACATTAGAAATGAT TTAGGCTGGTATCAGCAGAGGCCAGGGAAAG CCCCTAAGCGCCTGATCTATCCTGCATCCAGTT TGCTAAGTGGGGTCCCATCAAGGTTCAGCGGC AGTGGATCTGGGACAGAATTCACTCTCACAAT CAGCAGCCTGCAGCCTGAAGATAATAGTTACC ACTACTGTCTACAGGATATAGTTACCCATTC ACTTTCGGCCCTGGGACCAAAGTGGATATCAA A | GAGGTGCAGCTGGTGGAGTCTGGGGGAGGCTG GTCAAGCCTGGGGGGTCCCTGAGACTCTCCTGTG CAGCCTCTGGATTCTCCTTCAGTAGCTATAGCAT GAACTGGGTCCGCCAGGCTCCAGGGAAGGGGCT GGAGTGGGTCTCATCCATTAGTAGTAGTACT TACATATACTACGGAGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCGAGAGATCGGGG CAGCAGCTGGGGCCAGGGAACCCTGGTCACCGT CTCCCTCA |
| | | | SEQ ID NO: 25533 | SEQ ID NO: 29539 |
| | | AA | DIQLTQSPSSLSASVGDRVTITCRASQDIRNDLG WYQQRPGKAPKRLIYPASSLLSGVPSRFSGSGSG TEFTLTISSLQPEDFATYCLQDNSYPFTFGPGTK VDSK | EVQLVESGGGLVKPGGSLRLSCAASGFSFSSYSMN WVRQAPGKGLEWVSSISSSSTYIYYGDSVKGRFTIS RDNAKNSLYLQMNSLRAEDTAVYYCARDRGSSW GQGTLVTVSS |
| | | | SEQ ID NO: 25534 | SEQ ID NO: 29540 |
| iPS:434265 | 21-225_57B2 | NA | GACATCCAGATGACCCAGTCTCCATCTCCCT GTCTGTATCTGTAGGAGACAGAGTCACCATCA CTTGCCGGGCAAGTCAGGGCATTAGAAATGCT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTAGT TACATAAACTACACAGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCGAGAGTGGCTGG CTTTGACTACTGGGGCCAGGGAACCCTGGTCACC GTCTCCTCA |
| | | | SEQ ID NO: 25535 | SEQ ID NO: 29541 |

FIGURE 50
(Continued)

| | | | | |
|---|---|---|---|---|
| | | AA | DIQMTQSPSSLSVSVGDRVTITCRASQGIRNALG WYQQKPGKAPKRLIYAASSLQSGVPSRFSGSGS GTEFTLTISSLQPEDFATYYCLQHNSYPFTFGPGT KVDIK | EVQLVESGGGLVKPGGSLRLSCAASGFTFSSYSMN WVRQAPGKGLEWVSSISGSSSYINYTDSVKGRFTIS RDNAKNSLYLQMNSLRAEDTAVYYCARVAGFDY WGQGTLVTVSS |
| | | | SEQ ID NO: 25536 | SEQ ID NO: 29542 |
| iPS-434267 | 21-225_57F2 | NA | GACATCCAGATGACCCAGTCTCCATCTCCCT GTCTGCATCTGTAGGAGACAGAGTCACCATCA CTTGCCGGGCAAGTCAGAGCATTAGCAGCTAT TTAAATTGGTATCAGCAGAAACCAGGGAAAG CCCCTAAGCTCCTGATCTATGCTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCACTT ACTACTGTCAACAGAGTTACAATATTTCATTC ACTTTCGGCCCTGGGACCAAAGTGGATATCAA A | CAGGTTGCAGCTGCAGGAGTCGGGCCCAGGACTG GTGAAGCCTTCGGAGACCCTGTCCTCCACCTGCA CTGTCTCTGGTGGCTCCATCAGTAGTTACTACTG GAGCTGGATCCGGCAGCCCGCCGGGAAGGGACT GGAGTGGATTGGGCGCATCTATACCAGGGGAG CACCAACTACAACCCCTCCCTCAAGAGTCGAGTC ACCATGTCAATAGACACGTCCAAGAACCAGTTCT CCCTGAAGCTGAGCTCTGTGACCGCCGCGGACAC GGCCGTGTATTACTGTGCGAGAGGGAAAAAC TGGGGGGGGTTTCTTACTTGACTACTGGGGCCAG GGAACCCTGGTCACCGTCTCCTCA |
| | | | SEQ ID NO: 25537 | SEQ ID NO: 29543 |
| | | AA | DIQMTQSPSSLSASVGDRVTITCRASQSISSYLNW YQQKPGKAPKLLIYAASSLQSGVPSRFSGSGSGT DFTLTISSLQPEDFAPYYCQQSYNISFTFGPGTKV DIK | QVQLQESGPGLVKPSETLSLTCTVSGGSISSYYWSW IRQPAGKGLEWIGRIYTRGSTNYNPSLKSRVTMSID TSKNQFSLKLSSVTAADTAVYYCAREGKTGGVSYF DYWGQGTLVTVSS |
| | | | SEQ ID NO: 25538 | SEQ ID NO: 29544 |

FIGURE 50
(Continued)

| | | | |
|---|---|---|---|
| iPS:434269 | 21-225_57H3 | NA | GAAATAGTGATGACGCAGTCTCCAGCCACCCT GTCTGTGTCTCCAGGGGAAAGAGCCACCCTCT CCTGCAGGGCCAGTCAGAGTGTTAGCAGCAGC TTAGCCTGGTACCAGCAGAAACCTGGCCAGGC TCCCAGGCTCCTCATCTATGGTGCATCCACCA GGGCCACTGGTTTCCCAGCCAGGTTCAATGGC AGTGGGTCTTGGACAGAATTCACTCTCACCAT CAGCAGCCTGCAGTCTGAAGATTTTGCAATTT ATTACTGTCAGCAGTATAATGACTGGCCGTGC AGTTTTGGCCAGGGGACCAAGCTGGAGATCAA A<br>SEQ ID NO: 25539 | CAGGTGCAGTTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTATATGTATGATGGAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGAGATTATG GTATAGTGGAGCTACATATTTGACTACTGGGG CCAGGGAACCCTGGTCACCGTCTCCTCA<br>SEQ ID NO: 29545 |
| | | AA | EIVMTQSPATLSVSPGERATLSCRASQSVSSSLA WYQQKPGQAPRLLIYGASTRATGFPARFNGSGS WTEFTLTISSLQSEDFAIYYCQQYNDWPCSFGQG TKLEIK<br>SEQ ID NO: 25540 | QVQLVESGGGVVQPGRSLRLSCAASGFTFSSYGMH WVRQAPGKGLEWVAAIWYDGSNKYYADSVKGRF TISRDNSKNTLYLQMNSLRAEDTAVYYCARDYGIV GATYFDYWGQGTLVTVSS<br>SEQ ID NO: 29546 |
| iPS:434271 | 21-225_57A4 | NA | GACATCCAGATGACCCAGTCTCCATCCTCCCT GTCTGCATCTGTAGGAGACAGAGTCACCATCA CTTGCCGGGCAAGTCAGAGTCATTAGAAATGAT TTAGGCTGGTATCTGCAGAAACCAGGGAAAGC CCCTAAGCGCCTGATCTATGCTGCATCCAGTTT GCTAAGTGGGGTCCCATCAAGGTTCAGCGGCA GTGGATCTGGGACAGAATTCACTCTCACAATC AGCAGCCTGCAGCCTGAAGATTTTGCAACTTA TTACTGTCTACAGCATAATAGTTACCCATTCAC TTTCGGCCCTGGGACCAAAGTGGATATCAAA<br>SEQ ID NO: 25541 | CAGGTGCAGCTGGTGGAGTCTGGGGGAGGCGTG GTCCAGCCTGGGAGGTCCCTGAGACTCTCCTGTG TAGCGTCTGGATTCACCTTCACGTGACTATGGCAT GCACTGGGTCCGCCAGGCTCCAGGCAAGGGCT GGAGTGGGTGGCAGTTATATGTATGCTGAAGT AATAAATACTATGTAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGGGAACTGGGG ATGAGGTCTGACTACTGGGGCCAGGGAACCCTG GTCACCGTCTCCTCA<br>SEQ ID NO: 29547 |

FIGURE 50
(Continued)

| | | | | |
|---|---|---|---|---|
| iPS:434273 | 21-225_57E4 | AA | DIQMTQSPSSLSASVGDRVTITCRASQGIRNDLG WYLQKPGKAPKRLIYAASSLSGVPSRFSGSGSG TEFTLTISSLQPEDFATYYCLQHNSYPFTFGPGTK VDIK SEQ ID NO: 25542 | QVQLVESGGGVVQPGRSLRLSCVASGFTFSDYGM HWVRQAPGKGLEWVAVIWYAGSNKYYVDSVKGR FTISRDNSKNTLYLQMNSLRAEDTAVYYCARELGM RSDYWGQGTLVTVSS SEQ ID NO: 29548 |
| | | NA | GACATCCAGATGACCCAGTCTCCATCTTCCGT GTCTGCATCTGTAGGAGACAGAGTCACCATCA CTTGTCGGGCGAGTCAGGATATTAGCAACTGG TTAGCCTGGTATCAGCAGAAACCAGGGAAAG CCCCTAAGCTCCTGATCTATGCTGCATCCAGTT TGCAAAGTGGGGTCCCATCAAGGTTCAGCGGC AGTGGTTCTGGGACAGATTTCACTCTCACCAT CAGCAGCCTGCAGCCTGAAGATTTTGCAACTT ACTCTTGTCAACAGGGTAACAGTTTCCCATTC ACTTTCGGCCCTGGGACCAAAGTGGATATCAA A SEQ ID NO: 25543 | GAGGTGCAGCTGTTGGAGTCTGGGGGAGGCTTG GTACAGCCGGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTGGTGGTGGTGGT AGTACATTCTACGCAGACTCCGTGAAGGGCCGGT TCACCATCTCCAGAGACAATTCCAAGACCACGCT GTATCTGCAAATGAACAGCCTGAGAGCCGAGGA CACGGCCGTATATTACTGTGCGAAAGGGACTG GAACGACGTTTTTGACTACTGGGGCCAGGGAACC CTGGTCACCGTCTCCTCA SEQ ID NO: 29549 |
| | | AA | DIQMTQSPSSVSASVGDRVSITCRASQDISNWLA WYQQKPGKAPKLLIYAASSLQSGVPSRFSGSGS GTDFTLTISSLQPEDFATYSCQQGNSFPFTFGPGT KVDIK SEQ ID NO: 25544 | EVQLLESGGGLVQPGGSLRLSCAASGFTFSSYAMS WVRQAPGKGLEWVSVISGSGGSTFYADSVKGRFTI SRDNSKTTLYLQMNSLRAEDTAVYYCAKRDWND VFDYWGQGTLVTVSS SEQ ID NO: 29550 |

FIGURE 50
(Continued)

| | | | |
|---|---|---|---|
| iPS:434275 | 21-225_57F4 | NA | GACATCCAGATGACCCAGTCTCCATCTCCT<br>GTCTGCATCTGTAGGAGACAGAGTCACCATCA<br>CTTGCCGGGCAAGTCAGGTCATTAGAAATGAT<br>TTAGGCTGGTATCAGCAGAAGCCAGGGAAAG<br>CCCCTAAGCGCTTGATCTATGCTGCATCCAGTT<br>TGCAAAGTGGGGTCCCATCAAGGTTCAGCGGC<br>AGTGGATCTGGGACAGATTCACTCTCACAAT<br>CAGCAGCCTGCAGCCTGAAGATTTTGCAACTT<br>ATCACTGTCTACAGTATGTTAGTTTCCCATTCA<br>CTTTCGGCCCTGGGACCAAAGTGGATATCAAA<br>SEQ ID NO: 25545 | CAGGTGCAGCTGGTGGAGTCTGGGGAGGCTTG<br>GTCAAGCCTGGAGGGTCCCTGAGACTGTCCTGTG<br>CAGCCTCTGGATTCATCTTCAGTGACTACTACAT<br>GAACTGGATCCGCCAGGCTCCAGGAAGGGGCT<br>GGAGTGGGTTTCATACATTAGTAGTAGTGGTAGT<br>ACCATATACTACGCAGACTCTGTGAAGGGCCGAT<br>TCACCATCTCCAGGGACAACGCCAAGAACTCACT<br>GTATCTGCAAATGAACAGCCTGAGAGCCGAGGA<br>CACGGCCGTGTATTACTGTGCGAGAGATATGATT<br>ACGTGGGGCCAGGGAACCCTGGTCACCGTCTCCT<br>CA<br>SEQ ID NO: 29551 |
| | | AA | DIQMTQSPSSLSASVGDRVTITCRASQVIRNDLG<br>WYQQKPGKAPKRLIYAASSLQSGVPSRFSGSGS<br>GTEFTLTISSLQPEDFATYHCLQYGSFPFTFGPGT<br>KVDIK<br>SEQ ID NO: 25546 | QVQLVESGGGLVKPGGSLRLSCAASGFIFSDYYMN<br>WIRQAPGKGLEWVSYISSSGSTIYYADSVKGRFTIS<br>RDNAKNSLYLQMNSLRAEDTAVYYCARDMITWG<br>QGTLVTVSS<br>SEQ ID NO: 29552 |
| iPS:434277 | 21-225_57A7 | NA | GACATCCAGATGACCCAGTCTCCATCTCCGT<br>GTCTGCATCTGTAGGAGACAGAGTCACCATCA<br>CTTGTCGGGCGAGTCAGGGTATTAGCAGGTGG<br>TTAGCCTGGTATCAGCAGAAACCAGGGAAAG<br>CCCCTAACCTCTGATCTATGCTGCATCCAATT<br>TGCAAAGTGGGGTCCCATCAAGGTTCAGCGGC<br>AGTGGATCTGGGACAGATTTCACTCTCACCAT<br>CAGCAGCCTGCAGCCTGAAGATTTTGCAACTT<br>ACTATTGTCAACAGGCTAACAGTTTCCCATTC<br>ACTTTCGGCCCTGGGACCAAAGTAGATATCAA<br>A<br>SEQ ID NO: 25547 | CAGGTGCAACTGGTGCAGTCTGGGGCTGAGGTG<br>AAGAAGCCTGGGGCTTCAGTGAAGGTCTCCTGC<br>AAGGCTTCTGGATACACCTTCACCGGCTACCATA<br>TACACTGGGTGCGACAGGCCCCTGGACAAGATCT<br>TGAGTGGATGGGATGGATCAACAGAAGTTTCAGGCAGG<br>GTCACCATGACCAGGGACACGTCCATCAGCACA<br>GCCTACATGGAGCTGAGCAGGCTGAGATCTGAC<br>GACACGGCCGTGTATTACTGTGCGAGAGATGG<br>AGAAGTGGTTTTGACTACTGGGGCCAGGGAACC<br>CTGGTCACCGTCTCCTCA<br>SEQ ID NO: 29553 |

FIGURE 50
(Continued)

| | | | | |
|---|---|---|---|---|
| iPS:434279 | 21-225_57F7 | AA | DIQMTQSPSSVSASVGDRVTITCRASQGISRWLA WYQQKPGKAPNLLIYAASNLQSGVPSRFSGSGS GTDFTLTISSLQPEDFATYYCQQANSFPFTFGPGT KVDIK | QVQLVQSGAEVKKPGASVKVSCKASGYTFTGYHIH WVRQAPGQDLEWMGWINPNNNGTNYAQKFQGRV TMTRDTSISTAYMELSRLRSDDTAVYYCARDGRSG FDYWGQGTLVTVSS |
| | | | SEQ ID NO: 25548 | SEQ ID NO: 29554 |
| | | NA | GAAATAGTGATGACGCAGTCTCCAGCCATCCT GTCTGTGTTCCAGGGGAAAGAGCCACCCTCT CCTGCAGGGCCAGTCAGAGTGTTAGCAGCGAC TTAGCCTGGTACCAGCAGAAACCTGGCCAGGC TCCCAGGCTCCTCATCTATGGTGCATCCACCA GGGCCACTGGTATGCCAGCAGGTTCAGTGGC GGTGGGTCTGGGACAGAGTTCACTCTCACCAT CAGCAGCCTGCAGTCTGAACATTTGCAGTTT ATTACTGTCAGCAGTATAGTAACTGGCCATTC ACTTTCGGCCCTGGGACCAAAGTGGATATCAA A | GAGGTGCAGCTGTTGGAGTCTGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTAGTGGTGGT AACACATTCTACGCAGACTCCGTGAAGGGCCGGT TCACCATCTCCAGAGACAATTCCAAGAACACGCT GTATTTGCAAATGAACAGCCTGAGAGCCGAGGA CACGGCCGTATATTACTGTGCGAAATTTTTCGGT GTAGTGGGAGTCGGTGCTTTGACTACTGGGGCC AGGGAACCCTGGTCACCGTCTCCTCA |
| | | | SEQ ID NO: 25549 | SEQ ID NO: 29555 |
| | | AA | EIVMTQSPAILSVFPGERATLSCRASQSVSSDLA WYQQKPGQAPRLLIYGASTRATGMPARFSGGGS GTEFTLTISSLQSEHFAVYYCQQYSNWPFTFGPG TKVDIK | EVQLLESGGGLVQPGGSLRLSCAASGFTFSSYAMS WVRQAPGKGLEWVSAISGSGGNTFYADSVKGRFTI SRDNSKNTLYLQMNSLRAEDTAVYYCAKFFGVVG VGCFDYWGQGTLVTVSS |
| | | | SEQ ID NO: 25550 | SEQ ID NO: 29556 |

FIGURE 50
(Continued)

| | | | | |
|---|---|---|---|---|
| iPS:434281 | 21-225_57B8 | NA | GACATCCAGATGACCCAGTCTCCATCTCCCT GTCTGCATCTGTAGGAGACAGAGTCACCATCA CTTGCCGGGCAAGTCAGGGCATTGGAAATGAT TTAGGCTGGTATCAGCAGAAACCAGGGAAAG CCCCTGAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAACATAATAGTTTCCCTCCG TGGACGTTCGGCCAAGGGACCAAGGTTGAAA TCAAA<br><br>SEQ ID NO: 25551 | GAGGTGCAGCTGTTGGAGTCTGGGGGAGGCTTG GTACAGCCTGGGGGGTCCCTGAGACTCTCCTGTG CAGCCTCTGGATTCACCTTTAGAAGCTATGCCAT GAGCTGGGTCCGCCAGGCTCCAGGGAAGGGGCT GGAGTGGGTCTCAGTATTAGTGGTAGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGAAATTGGAACTG GGGATCTTTGACTACTGGGGCCAGGGAACCCTGG TCACCGTCTCCTCA<br><br>SEQ ID NO: 29557 |
| | | AA | DIQMTQSPSSLSASVGDRITITCRASQGIGNDLG WYQQKPGKAPERLIYAASSLQSGVPSRFSGSGSG TEFTLTISSLQPEDFATYYCLQHNSFPPWTFGQG TKVEIK<br><br>SEQ ID NO: 25552 | EVQLLESGGGLVQPGGSLRLSCAASGFTFRSYAMS WVRQAPGKGLEWVSAISGSGGNTFYADSVKGRFTI SRDNSKNTLYLQMNSLRAEDTAVYYCAKLELGIFD YWGQGTLVTVSS<br><br>SEQ ID NO: 29558 |
| iPS:434283 | 21-225_57F8 | NA | GACATCCAGATGACCCAGTCTCCATCTTCCGT GTCTGCATCTGTAGGAGACAGAGTCACCATCA CTTGTCGGGCGAGTCAGGGTATTAGCAACTGG TTAGCCTGGTATCAGCAGAAACCAGGGAAAG CCCCTAAGCTCCTGATCTATACTGCATCCAGTT TGCAAAGTGGGGTCCCATCAAGGTTCAGCGGC AGTGAATCTGGGACAGATTTCACTCTCACCAT CAGCAGCCTGCAGCCTGAAGATTTTGCAACTT ACTATTGTCAACAGGCTAACAGTTTCCCGTGG ACGTTCGGCCAAGGGACCAAGGTGGAAATCA AA<br><br>SEQ ID NO: 25553 | GAGGTGCAGCTGTTGGAGTCTGGGGGAGGCTTG GTACAGCCTGGGGGGTCCCTGAGACTCTCCTGTG TAGTCTCTGGATTCACCTTTAGCAACTATGCCAT GAGCTGGGTCCGCCAGGCTCCAGGGAAGGGGCT GGAGTGGGTCTCAGTAGCAGTGGTAGTGGTGGT AACACATTCTACGCAGACTCCGTGACGGGCCGG GTCACCATCTCCAGAGACAATTCCAAGAACACGC TGTATCTGCAAATGAACAGTCTGAGAGCCGAGG ACACGGCCGTATATTACTGTGCGAAACTGGGGA AGGACTACCACTACTACGGTATGGACGTCTGGGG CCAAGGGACCACGGTCACCGTCTCCTCA<br><br>SEQ ID NO: 29559 |

FIGURE 50
(Continued)

| | | | | |
|---|---|---|---|---|
| | | AA | DIQMTQSPSSVSASVGDRVTITCRASQGISNWLA WYQQKPGKAPKLLIYTASSLQSGVPSRFSGNESG TDFTLTISSLQPEDFATYYCQQANSFPWTFGQGT KVEIK<br><br>SEQ ID NO: 25554 | EVQLLESGGGLVQPGGSLRLSCVVSGFTFSNYAMS WVRQAPGKGLEWVSASSGSGGNTFYADSVTGRVT ISRDNSKNTLYLQMNSLRAEDTAVYYCAKLGKDY HYYGMDVWGQGTTVTVSS<br><br>SEQ ID NO: 29560 |
| iPS-434285 | 21-225_57A11 | NA | GACATCGTGATGACCCAGTCTCCAGACTCCCT GACTGTGTCTCTGGGCGAGAGGGCCACCATCA ACTGCAAGTCCAGCCAAAGTGTTTACACAGC TCCAACAATTATAACTACTTAGCTTGGTACCA GCAGAGACCAGGACAGCCTCCTAAGCTGGTCA TTTACTGGGCATCTACCCGGGCATCCGGGTC CCTGACCGATTCAGTGGCAGCGGGTCTGGGAC AGATTTCACTCTCACCATCAGCAGCCTGCAGG CTGAAGATATGGCAGTTTATTACTGTCAGCAA TATTATAGTACTCCGTGGACGTTCGGCCAAGG GACCAAGGTGGAATTCAAA<br><br>SEQ ID NO: 25555 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTGT TAACACAGGCTATGCACAGAAGTTCCAGGGCAG AGTCACCATGACCAGGGACACCTCCATAAGCAC AGCTACATGAGCTGAGCAGCCTGAGATCTGA GGACACGGCCGTATTACTGCGATCAGCAGT GGCTGGAACTGGTTGACCCTGGGGCCAGGA ACCCTGGTCACCGTCTCCTCA<br><br>SEQ ID NO: 29561 |
| | | AA | DIVMTQSPDSLTVSLGERATINCKSSQSVLHSSN NYNYLAWYQQRPGQPPKLVIYWASTRASGVPD RFSGSGSGTDFTLTISSLQAEDMAVYYCQQYYST PWTFGQGTKVEFK<br><br>SEQ ID NO: 25556 | QVQLVQSGAEVKKPGASVKVSCKASGYTFTNYDIN WVRQATGQGLEWMGWMNPNSVNTGYAQKFQGR VTMTRDTSISTAYMELSSLRSEDTAVYYCAISSGW NWFDPWGQGTLVTVSS<br><br>SEQ ID NO: 29562 |

FIGURE 50
(Continued)

| | | | |
|---|---|---|---|
| iPS:434287 | 21-225_57F12 | NA | GACATCGTGATGACCCAGTCTCCAGACTCCCT GGCTGTCTCTGGGCGAGAGGGCCACCATCA ACTGCAAGTCCAGCCAGCAGAGTGTTTATTCAGC TCCAACAATTACAATTACTTAGCTTGGTACCA GCAGAAAACAGGACAGCCTCCAAGCTGATC ATTTACTGGGCATCTACCCGGGAATCCGGGT CCCTGACCGATTCAGTGGCAGCGGGTCTGGA CAGATTTCACTCTCACCATCAGCAGCCTGCAG GCTGAAGATGTGGCAATTTATTACTGTCAGCA ATATTATAGTAACCGTGTAGTTTTTGGCCAGG GGACCAAGCTGGAGATCAAA |
| | | | SEQ ID NO: 25557 |
| | | AA | DIVMTQSPDSLAVSLGERATINCKSSQSVLFSSN NYNYLAWYQQKPGQPPKLIIYWASTRESGVPDR FSGSGSGTDFTLTISSLQAEDVAIYYCQQYYSNP CSFGQGTKLEIK |
| | | | SEQ ID NO: 25558 |
| | | NA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCGATAAGCA GTGGCTGGTACCGGTTGACCCCTGGGGCCAGGG AACCCTGGTCACCGTCTCCTCA |
| | | | SEQ ID NO: 29563 |
| | | AA | QVQLVQSGAEVKKPGASVKVSCKASGYTFTNYDIN WVRQATGQLEWMGWMNPNSGNTGYAQKFQGR VTMTRNTSISTAYMELSSLRSEDTAVYYCAISSGW YRFDPWGQGTLVTVSS |
| | | | SEQ ID NO: 29564 |
| iPS:434289 | 21-225_57H12 | NA | GAAATAGTGATGACGCAGTCTCCAGCCACCCT GTCTGTGTCTCCAGGGGAAAGAGCCACCCTCT CCTGCAGGGCCAGTCAGAGTGTTAGCAGCGAC TTAGCCTGGTACCAGCAGAAACCTGGCCAGGC TCCCAGGCTCCTCATCTATGCTGCATCTACCAG GGCCACTGGTATCCCAGCCAGGTTCAGTGGCA GTGGGTCTGGGACAGAGTTCACTCTCACCATC AGCAGCCTGCAGTCTGAAGATTTTGCAGTTTA TTACTGTCAGCAGTATGATAACTGGCATTCA CTTTCGGCCCTGGGACCAAAGTGGATAACAAG | GAGGTGCAGCTGTTGGAGTCTGGGGGAGGCTTG GTACAGCCGGGGGGGTCCCTGAGACTCTCCTGTG CAGCCTCTGGATTAACGTTTAGTAGCTACGCCAT GAGCTGGGTCCGCCAGGATCCAGGGAAGGGGCT GGAGTGGGTCTCAGCTATTAGTGGTAGTGGTGGT AACACATTCTACGGAGACTCCGTGAAGGGCCGG TTCACCATCTCCAGAGACAATTCCAAGAAAACGC TGTATCTGCAAATGAACAGCTGAGAGCCGAGG ACACGGCCGTATATTACTGTGCGAAATTTTCGG TATAGTGGGTGCCGGGTACTTGACTACTGGGGC CAGGGAACCCTGGTCACCGTCTCCTCA |
| | | | SEQ ID NO: 25559 | SEQ ID NO: 29565 |

FIGURE 50
(Continued)

| | | | | |
|---|---|---|---|---|
| iPS:434291 | | AA | EIVMTQSPATLSVSPGERATLSCRASQSVSSDLA WYQQKPGQAPRLLIYAASTRATGIPARFSGSGSG TEFTLTISSLQSEDFAVYYCQQYDNWPFTFGPGT KVDNK<br>SEQ ID NO: 25560 | EVQLLESGGGLVQPGGSLRLSCAASGLTFSSYAMS WVRQDPGKGLEWVSAISGSGGNTFYGDSVKGRFTI SRDNSKKTLYLQMNSLRAEDTAVYYCAKFFGIVGA GYFDYWGQGTLVTVSS<br>SEQ ID NO: 29566 |
| | 21-225_58A4 | NA | GAAATAGTGATGACGCAGTCTCCAGCCACCCT GTCTGTGTCTCCAGGGGAAAGAGCCACCCTCT CCTGCAGGGCCAGTCAGAGTGTTAGCAGCGAC TTAGCCTGGTACCAGCAGAGACCTGGCCAGGC TCCCAGGCTCCTCATCTATGCTGCATCTACCAG GGCCACTGGTATCCCAGCCAGGTTCAGTGGCA GTGGGTCTGGGACAGAGTTCACTCTCACCATC AGCAGCCTGCAGTCTGAGGATTTTGCAGTTTA TTACTGTCAGCAGTTTAATAACTGGCCATTCA CTTTCGGCCCTGGGACCAAAGTGGATATCAAA<br>SEQ ID NO: 25561 | GAGGTGCAGCTGTTGGAGTCTGGGGGAGGCTTG GTACAGCCTGGGGGGTCCCTGAGACTCTCCTGTG CAGCCTCTGGATTAACGTTTAGTAGTACGCCAT GAGCTGGGTCCGCCAGGATCCAGGGAAGGGGCT GGAGTGGGTCTCAGCTATTAGTGGTAGTGGTGGT AACACATTCTACGGAGACTCCGTGAAGGGCCGG TTCACCATCTCCAGAGACAATTCCAAGAAAACGC TGTATCTGCAAATGAACAGCCTGAGAGCCGAGG ACACGGCCGTATATTACTGTGCGAAATTTTTCGG TATAGTGGAGCCGGGTTCTTTGACTCCTGGGGC CAGGGAACCCTGGTCACCGTCTCCTCA<br>SEQ ID NO: 29567 |
| | | AA | EIVMTQSPATLSVSPGERATLSCRASQSVSSDLA WYQQRPGQAPRLLIYAASTRATGIPARFSGSGSG TEFTLTISSLQSEDFAVYYCQQFNNWPFTFGPGT KVDIK<br>SEQ ID NO: 25562 | EVQLLESGGGLVQPGGSLRLSCAASGLTFSSYAMS WVRQDPGKGLEWVSAISGSGGNTFYGDSVKGRFTI SRDNSKKTLYLQMNSLRAEDTAVYYCAKFFGIVGA GFFDSWGQGTLVTVSS<br>SEQ ID NO: 29568 |

FIGURE 50
(Continued)

| | | | |
|---|---|---|---|
| iPS:434293 | 21-225_58F5 | NA | GACATCCAGATGACCCAGTCTCCATCTCCT GTCTGCATCTGTAGGGGACAGAGTCACCATCA CTTGCCGGGCAAGTCAGGGCATTAGAAATGAT TTAGGCTGGTTTCTGCAGACACCAGGAAAGC CCCTAAGCGCCTGATCTATGCTGCATCCAGTTT GCTAAGTGGGGTCCCATCACGGTTCGGCGGCA GTGGATCTGGGACAGAATTCACTCTCACAATC AGCAGCCTGCAGCCTGAAGATTTTGCAACTTA TTACTGTCTACAGCATAATAGTTACCCATTCAC TTTCGGCCCTGGGACCAAAGTGGAGATCAAA <br><br>SEQ ID NO: 25563 |
| | | AA | DIQMTQSPSSLSASVGDRVTITCRASQGIRNDLG WFLQTPGKAPKRLIYAASSLLSGVPSRFGGSGSG TEFTLTISSLQPEDFATYYCLQHNSYPFTFGPGTK VEIK <br><br>SEQ ID NO: 25564 |
| | | NA | CAGGTGCAGCTGGTGGAGTCTGGGGGAGGCGTG GTCCAGCCTGGGAGGTCCCTGAGACTCTCCTGTG TAGCGTCTGGATTCACCTTCAGTGACTATGGCAT GCACTGGGTCCGCCAGGCTCCAGGCAAGGGGCT GGAGTGGGTGGCAGTTATATGTATGCTGGAAGT AATAAATAACCATGTAGAGACTCCGTGAAGGGCCGA TTCACCATCTCCAGAGACAATTCCAAGAACAGC TGTATCTGCAAATGAACAGCCTGAGAGCCGAGG ACACGGCTGTGTATTACTGTGCGAGGGAACTGGG GATGAGGTCTGACTACTGGGGCCAGGGAACCCT GGTCACCGTCTCCTCA <br><br>SEQ ID NO: 29569 |
| | | AA | QVQLVESGGGVVQPGRSLRLSCVASGFTFSDYGM HWVRQAPGKGLEWVAVIWYAGSNKYHVDSVKGR FTISRDNSKNTLYLQMNSLRAEDTAVYYCARELGM RSDYWGQGTLVTVSS <br><br>SEQ ID NO: 29570 |
| iPS:434295 | 21-225_58B9 | NA | GACATCGTGATGACCCAGTCTCCAGACTCCCT GGCTGTGTCTCTGGGCGAGAGGGCCACCATCA ACTGCAAGTCCGGCCAGAGTGTATTTTATACAGC TCCAACAATAACAGGACAGCCTCCTAAGCTACTTGGTACCA GCAGAAACCAGGACAGCCTCCTAAGAAACTC ATTTACTGGGCATCTACCCGGGATTCCGGGGT CCCTGCCGATTCAGTGGCAGCGGGTCTGGGA CAGATTTCACTCTCACCATCAGCAGCCTGCAG GCTGAAGATGTGGCAGTTTATTACTGTCAGCA ATATTATAGTACTCCTCCGACGTTCGGCCAAG GGTCCAAGGTGGAAATCAAA <br><br>SEQ ID NO: 25565 | CAGGTGCAGCTGGTGGCAGTCTGGGGCTGAGGTG AAGAAGCCTGGGGCCTCAGTGAAGGTCTCTGC AAGGCTTCTGGATACACCTTCACCAATTATGATA TCAACTGGGTGCGACAGGCCACTGGACAAGGGC TTGAGTGGATGGGATGGATGCACAGAAGTTCCAGGCA GTAGCACAAGCTATGCACCAGGAACACCTCCATAAGCA CAGCCTACATGGAGCTGAGCAGCCTGAGATCTG AGGACACGGCCGTGTATTACTGTGCGTATAGCAG TGGCTGGTACTACTTGACTACTGGGGCCAGGGA ACCCTGGTCACCGTCTCCTCA <br><br>SEQ ID NO: 29571 |

FIGURE 50
(Continued)

| | | | | |
|---|---|---|---|---|
| iPS:434297 | 21-225_58A10 | AA | DIVMTQSPDSLAVSLGERATINCKSGQSILYSSN NNNYLAWYQQKPGQPPKKLIYWASTRDSGVPA RFSGSGSGTDFTLTISSLQAEDVAVYYCQQYYST PPTFGQGSKVEIK<br>SEQ ID NO: 25566 | QVQLVQSGAEVKKPGASVKVSCKASGYTFTNYDIN WVRQATGQGLEWMGWMNPNSGSTGYAQKFQGR VTMTRNTSISTAYMELSSLRSEDTAVYYCAYSSGW YYFDYWGQGTLVTVSS<br>SEQ ID NO: 29572 |
| | | NA | GAAATAGTGATGACGCAGTCTCCAGCCACCCT GTCTGTGTCTGCAGGGGAAAGAGCCACCCTCT CCTGCAGGGCCAGTCAGAGTCAGAGCTCC TTAGCCTGGTACCAGCAGAAACCTGGCCAGGC TCCCAGGCTCCTCATCTATGTGCATCCACCA GGGCCACTGGTATCCCAGCCAGGTTCAGTGGC AGTGGGTCTGGGACAGAATTCACTCTCACCAT CAGCAGCCTGCAGTCTGAAGATTTTGCAGTT ATTACTGTCAGCAGTATATAACTGGCCATTC ACTTTCGGCCCTGGGACCAAAGTGGATATCAA A<br>SEQ ID NO: 25567 | GAGGTGCAGCTGTTGGAGTCTGGGGGAGGCTTG GTACAGCCTGGGGGGTCCCTGAGACTCTCCTGTG CAGCCTCTGGATTCACCTTTAGAAGCTATGCCAT GAGCTGGGTCCGCCAGGCTCCAGGGAAGGGGCT GGAGTGGGTCTCAGCTATTAGTGGTAGTGGTGGT AACACATTCTACGCAGACTCCGTGAAGGGCCGGT TCACCATCTCCAGAGACAATTCCAAGAACACGCT GTTTCTTCAAATGAACAGCCTGAGAGCCGAGGAC ACGGCCGTATATTACTGTGCGAAATTTTTCGGTA TAGTGGAGCCGGGTACTTGACTACTGGGGCCA GGGAACCCTGGTCACCGTCTCCTCA<br>SEQ ID NO: 29573 |
| | | AA | EIVMTQSPATLSVCPGERATLSCRASQSVSSSLA WYQQKPGQAPRLLIYGASTRATGIPARFSGSGSG TEFTLTISSLQSEDFAVYYCQQYNNWPFTFGPGT KVDIK<br>SEQ ID NO: 25568 | EVQLLESGGGLVQPGGSLRLSCAASGFTFRSYAMS WVRQAPGKGLEWVSAISGSGGNTFYADSVKGRFTI SRDNSKNTLFLQMNSLRAEDTAVYYCAKFFGIVGA GYFDYWGQGTLVTVSS<br>SEQ ID NO: 29574 |

FIGURE 50
(Continued)

| | | | |
|---|---|---|---|
| iPS:434299 | 21-225_58D11 | NA | GACATCCAGATGACCCAGTCTCCATCTCCT GTCTGCATCTGTAGGAGACAGAGTCACCATCA CTTGCCGGGCAAGTCAGGCATTAGAAGTGAT TTAGACTGTATCAGCAGAAACCAGGGAAAG CCCCTAAGCGCCTGATCTATGCTGCATCAGT TTGCAAAGTGGGGTCCATCAAGGTTCAGTCGG CAGTGGATCTGGGACAGAATTCACTCTCGCAA TCAGCAGCCTGCGCCTGAAGATTTTGCAACT TATTACTGTCTCCAGCATAATAATTTCCCATTC ACTTTCGGCCCTGGGACCAAGGTGGATATCAA A | CAGGTGCAGCTGGTGGAGTCTGGGGGAGGCGTG GTCCAGCCTGGGAGGTCCCTGAGACTCTCCTGTG CAGGCGTCTGATTCACCTTCAGTGACTATGACAT ACACTGGGTCCGCCAGTCTCCAGGCAAGGGCT GGAGTGGGTGGCAGTTATATGGTATGATGGAAGT AAAAAATATTATGCAGACTCCGTGAAGGGCCGA TTCACCATCTCCAGAGACAATTCCAAGAACACGT TGTATCTGCAAATGAACAGCCTGAGAGCCGAGG ACAGGCTCGTATTACTGTGCGAGAGATCGGGT CACTTTTGACTACTGGGGCCAGGGAACCCTGGTC ACCGTCTCCTCA |
| | | | SEQ ID NO: 25569 | SEQ ID NO: 29575 |
| | | AA | DIQMTQSPSSLSASVGDRVTITCRASQGIRSDLD WYQQKPGKAPKRLIYAASSLQSGVPSRFSGSGS GTEFTLAISSLRPEDFATYYCLQHNNFPFTFGPGT KVDIK | QVQLVESGGGVVQPGRSLRLSCAASGFTFSDYDIH WVRQSPGKGLEWVAVIWYDGSKKYYADSVKGRF TISRDNSKNTLYLQMNSLRAEDTALYYCARDRVTF DYWGQGTLVTVSS |
| | | | SEQ ID NO: 25570 | SEQ ID NO: 29576 |
| iPS:434301 | 21-225_58F11 | NA | GAAATAGTGATGACGCAGTCTCCAGCACCCT GTCTGTGTCTCCAGGGGAAAGAGCCACCCTCT CCTGCAGGGCCAGTCAGAGTGTTAGCAGCGAC TTAGTCTGGTACCAGCAGAAACCTGGCCAGGC TCCCAGGCTCCTCATCTATGGTGTATCCACCA GGGCCACTGGTATCCCAGCCAGGTTCAGTGGC AGTGGGTCTGGGACAGACTTCACTCTCACCAT CAGCAGCCTGCAGTCTGAAGATTTTGCAGTTT ATTACTGTCAGCAGTATAATAATTGGCCATTC ACTTTCGGCCCTGGGACCAAAGTGGATATCAA A | GAGGTGCAGTTGTTGGAGTCTGGGGGAGGCTTGG TACAGCCTGGGGGGTCCCTGAGACTCTCCTGTGC AGCCTCTGGATTCACCTTTAGCAGCTATAGCCATG AGCTGGGTCCGCCAGGCTCCAGGGAAGGGGCTG GAGTGGGTCTCAGCTATTAGTGGTAGTGGTGTA ACACATTCTACGCAGATACAATTCAAGAACACGCTG TATCTGCAAATGAACAGCCTGAGAGCCGAGGAC ACGGCCGTATATTACTGTGCGAGAGCCTTTTCGGTA TGGTGGGGAGCCGGATTCTTTGACTACTGGGGCCA GGGAACCCTGGTCACCGTCTCCTCA |
| | | | SEQ ID NO: 25571 | SEQ ID NO: 29577 |

FIGURE 50
(Continued)

| | | AA | EIVMTQSPATLSVSPGERATLSCRASQSVSSDLV WYQQKPGQAPRLLIYGVSTRATGIPARFSGSGSG TEFTLTISSLQSEDFAVYYCQQYNNWPFTFGPGT KVDIK<br>SEQ ID NO: 25572 | EVQLLESGGGLVQPGGSLRLSCAASGFTFSSYAMS WVRQAPGKGLEWVSAISGSGGNTFYADSVKGRFTI SRYNSKNTLYLQMNSLRAEDTAVYYCAKFFGMVG AGFFDYWGQGTLVTVSS<br>SEQ ID NO: 29578 |
|---|---|---|---|---|
| | | NA | GATATTGTGATGACCCAGACTCCACTCTCT GTCCGTCACCCTGGACAGCCGGCCTCCATCT CCTGCAAGTCTAGTCAGAGCTCCTGCATAGT GAGGGAAAGACCTATTTGTATTGGTACGTGCA GAAGCCAGGCCAGCCTCCACAACTCCTGATCT ATGAAGTTTCCTATCGGTTTTCTGAAGTGCCA GATAGGTTCAGTGGCAGCGGGTCAGGACAG ATTTCACACTGAAAATCAGCCGGGTGGAGGCT GAGGATGTTGGGGTTTATTACTGCATGCAAAG TATACAGCTTCCGCTCACTTTCGGCGAGGGA CCAAGGTGGAGATCAAA<br>SEQ ID NO: 25573 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGCAT GCACTGGGTCCGCCAGGCTCCAGGCAAGGGGCT GGAGTGGGTGGCAGTTATATGGTATGATGAAGT AATAAATACCATGCAGACTCCGTGAAGGGCGA TTCACCATCTCCAGAGACAATTCCAAGAACACGC TGTATCTGCAAATGAACAGCCTGAGAGCCGAG ACACGGCTGTGTATTACTGTGCGAGGCGGTATAG CAGCAGCTGGGACGGGGGGTATGGACGTCTGGGG CCAAGGGACCACGGTCACCGTCCTCCTCA<br>SEQ ID NO: 29579 |
| iPS:434303 | 21-225_58H11 | AA | DIVMTQTPLSLSVTPGQPASISCKSSQSLLHSEGK TYLYWYVQKPGQPPQLLIYEVSYRFSGVPDRFS GSGSGTDFTLKISRVEAEDVGVYYCMQSIQLPLT FGGGTKVEIK<br>SEQ ID NO: 25574 | QVQLVESGGGVVQPGRSLRLSCAASGFTFSSYGMH WVRQAPGKGLEWVAVIWYDGSNKYHADSVKGRF TISRDNSKNTLYLQMNSLRAEDTAVYYCARRYSSS WDGGMDVWGQGTTVTVSS<br>SEQ ID NO: 29580 |

FIGURE 50
(Continued)

| | | | |
|---|---|---|---|
| iPS:434305 | 21-225_59E1 | NA | GACATCGTGATGACCCAGTCTCCAGACTCCCTGGCTGTGTCTCTGGGCGAGAGGGCCACCATCAACTGCAAGTCCAGCCAGAGTGTTTTATACAGCTCCAACAATAACAACTACTTAGCTTGGTACCAGCAGAGACCAGGACAGCCTCCTAAGTTGCTCATTTACTGGTCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAATATTTTAGTATTCCGTGCAGTTTTGGCCAGGGGACCAAGCTGGAGATCAAA<br>SEQ ID NO: 25575 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATTCAACTGGGTGCGACAGGCCACTGGACAAGGCTTGAGTGGATGGGATGGATGACTCCTAACAGTGGTAACACAGGCTATGCACAGAAGTTCCAGGGCAGAGTCACCATGACCAGGACCACCTCCATAAGCACAGCCTACATGGAGCTGAGCAGCCTGAGATCTGAGGACACGGCCGTGTATTACTGTGCGTTTAGCAGTGGCTGTACTTCTTTGACTACTGGGGCCAGGGAACCCTGGTCACCGTCTCCTCA<br>SEQ ID NO: 29581 |
| | | AA | DIVMTQSPDSLAVSLGERATINCKSSQSVLYSSNNNNYLAWYQQRPGQPPKLLIYWSSTRESGVPDRFSGSGSGTDFTLTISSLQAEDVAVYYCQQYFSIPCSFGQGTKLEIK<br>SEQ ID NO: 25576 | QVQLVQSGAEVKKPGASVKVSCKASGYTFTNYDINWVRQATGQGLEWMGWMTPNSGNTGYAQKFQGRVTMTRTSISTAYMELSSLRSEDTAVYYCAFSSGWYFFDYWGQGTLVTVSS<br>SEQ ID NO: 29582 |
| iPS:434307 | 21-225_59B2 | NA | GAAATTGTGTTGACGCAGTCTCCAGGCACCCTGTCTTTGTCTCCAGGGGAAAGAGCCACCCTCTCCTGCTGGGCCAGTCAGAGTGTTTACAGCAGCTTCTTAGCCTGGTTCCAGCAGAAAATCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTTTTACTGTCAGCAATATGGTACCTCACCGTGGACGTTCGGCCAAGGGACCAAGGTGGAAATCAAA<br>SEQ ID NO: 25577 | CAGGTGCAGTTGGTGCAGTCTGGGGCTGAGGTGAAGAAGCCTGGGGCCTCAGTGAAGGTCTCCTGCAAGGCTTCTGGATACACCTTCGCCGGCTACTATATACACTGGGTGCGACAGGCCCCTGGACAAGGACTTGAGTGTTGGGTTGGATCAACCTAACAGTGGTGGCACAAACTATGCACAGAAGTTTCAGGGCAGGGTCACCATGACCAGGGACACGTCCATCAGCACAGCCTACATGGAGCTGAGCAGCCTGAGATTTGACGACACGGCCGTGTATTACTGTGCGAGAGATCCGGGCCCCTTTGACTACTGGGGCCAGGGAACCCTGGTCACCGTCTCCTCA<br>SEQ ID NO: 29583 |

FIGURE 50
(Continued)

| | | | | |
|---|---|---|---|---|
| iPS:434309 | 21-225_59B5 | AA | EIVLTQSPGTLSLSPGERATLSCWASQSVYSSFLA WFQQKSGQAPRLLIYGASSRATGIPDRFSGSGSG TDFTLTISRLEPEDFAVFYCQQYGTSPWTFGQGT KVEIK<br>SEQ ID NO: 25578 | QVQLVQSGAEVKKPGASVKVSCKASGYTFAGYYI HWVRQAPGQGLEWLGWINPNSGGTNYAQKFQGR VTMTRDTSISTAYMELSRLRFDDTAVYYCARDPGP FDYWGQGTLVTVSS<br>SEQ ID NO: 29584 |
| | | NA | GACATCCAGATGACCCAGTCTCCATCTCCCT GTCTGCATCTGTAGGAGACAGAGTCACCATCA CTTGCCGGGCAAGTCAGAGCATTATCAGCTAT TTAAATTGGTATCAGCAGAAACCAGGGAAAG CCCCTAAACTCCTGATCTATGGTGTCCAGTT TGCAGAGTGGGGTCCCATCAAGGTTCAGTGGC AGTGGATCCGGGACAGATTTTCACTCTCACCAT CAGCAGTCTGCAACCTGAAGATTTTGCAACTT ACTACTGTCAACAGAGTTACAGTACCCCTATG TTCAGTTTTGGCCAGGGGACCAAGCTGGAGAT CAAA<br>SEQ ID NO: 25579 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGGAAGGGGCT GGAGTGGGTCTCAGCTATTAGTGGTAGTGGTGGT AACACATTCTACGCAGACTCCGTGAAGGGCCGGT TCACCATTTCCAGAGACAATTCCAAGAACACGCT GTATCTGCAAATGAACAGCCTGAGAGCCGAGGA CACGGCCGTATATTACTGTGCGAAAAGGGGGGT CTACGGTGACTACGAGGCTTTTGATATCTGGGGC CAAGGGACAATGGTCACCGTCTCTTCA<br>SEQ ID NO: 29585 |
| | | AA | DIQMTQSPSSLSASVGDRVTITCRASQSIISYLNW YQQKPGKAPKLLIYGASSLQSGVPSRFSGSGSGT DFTLTISSLQPEDFATYYCQQSYSTPMFSFGQGT KLEIK<br>SEQ ID NO: 25580 | EVQLLESGGGLVQPGGSLRLSCAASGFTFSSYAMN WVRQAPGKGLEWVSAISGSGGNTFYADSVKGRFTI SRDNSKNTLYLQMNSLRAEDTAVYYCAKRGVYGD YEAFDIWGQGTMVTVSS<br>SEQ ID NO: 29586 |

FIGURE 50
(Continued)

| | | | |
|---|---|---|---|
| iPS:434311 | 21-225_59H5 | NA | GAAATTGTGTTGACGCAGTCTCCAGGCACCCT GTCTTGTCTCTGCAGGGGAAAGAGCCACCTCT CCTGCAGGGCCAGTCAGAGTGTTAGCAGCATC TACTTAGCCTGGTTCCTGCAGAAACCTGGCCA GGCTCCCAGGCTCCTCATCTATGGTGCATCCA GCAGGGCCACTGGCATCCCAGACCAGTTCAGT GGCAGTGGGTCTGGGACAGACTTCACTCTGAC CATCAGCAGACTGGAGCCTGAAGATTTTGCAG TGTATTACTGTCACCAGTATGGTAACTCACCA TTCACTTTCGGCCCTGGGACCAAAGTGGATTT CAAA<br><br>SEQ ID NO: 25581 | CAGGTACAACTGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGAGGG GTATAGCAGTGGGTACTACGGTATGGACGTCTG GGGCCAAGGGACCACGGTCACCGTCTCCTCA<br><br>SEQ ID NO: 29587 |
| | | AA | EIVLTQSPGTLSLSPGERATLSCRASQSVSSIYLA WFLQKPGQAPRLLIYGASSRATGIPDRFSGSGSG TDFTLTISRLEPEDFAVYYCHQYGNSPFTFGPGT KVDFK<br><br>SEQ ID NO: 25582 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARERGIA VGYYGMDVWGQGTTVTVSS<br><br>SEQ ID NO: 29588 |
| iPS:434313 | 21-225_59E6 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA<br><br>SEQ ID NO: 25583 | CAGCTGCAGCTGCAGGAGTCGGGCCCAGGACTG GTGAAGCCTTCGGAGACCCTGTCCCTCACCTGCA CTGTCTCTGGTGGCTCCATCAGTAGAAGTAGTTA CTACTGGGGCTGGATCCGCCAGCCCCCAGGGAA GGGGCTGGAGTGGATTGGGAATATCTATTATAGT GGGAGCACCTACTACAACCCGTCCCTCAAGAGTC GAGTCACCATATCCGTAGACACGTCCAAGAACC AGTTCTCCCTGAAGCTGAGCTCTGTGACCGCCGC AGACACGGCTGTCCTGTATTACTGTGCGAGACATAGC AGCAGCTGGTCCTGACTACTGGGGCCAGGGA ACCCTGGTCACCGTCTCCTCA<br><br>SEQ ID NO: 29589 |

FIGURE 50
(Continued)

| | | | | |
|---|---|---|---|---|
| iPS:434315 | 21-225_59G7 | AA | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTRVEIK<br>SEQ ID NO: 25584 | QLQLQESGPGLVKPSETLSLTCTVSGGSISRSSYYWGWIRQPPGKGLEWIGNIYYSGSTYYNPSLKSRVTISVDTSKNQFSLKLSSVTAADTALYYCARHSSSWSLDYWGQGTLVTVSS<br>SEQ ID NO: 29590 |
| | | NA | GACATCCAGATGACCCAGTCTCCATCCCCTGTCTGCATCTGTAGGAGACAGAGTCACCATCACTTGCCGGGCAAGTCAGGGCATTAGAAACCAGGAAATGATTTAGGCTGGTATCAGCAGAAACCAGGGAAAGCCCCTAAGCGCCTGATCTATTCTGCATCCAGTTTACAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATAATAGTTACCCGTGGACGTTCGGCCAAGGGACCAAGGTGGAAATCAAA<br>SEQ ID NO: 25585 | CAGGTGCAACTAGTGCAGTCTGGGGCTGAGGTGAAGAAGCCTGGGGCCTCAGTGAAGGTCTCCTGCAAGGCTTCTGGATACAGTTCACCGGCCACTATACACTGGGTGCGACAGGCCCCTGGACAAGGGCTTGAGTACATGGGATGGATCAACCCGAACAGTGGTGGCACAAACTATGTACAGAGGACACGTCAGGGCAGGGCTCACCATGACCAGGACACGTCCATCAGCACAGCCTACATGGAGCTGAGCAGGCTGAGATCTGACGACACGGCCATATATTACTGTTCGAGAGGGGCCTACTGGAGCTACCAACTACTACTACTACGGTATGGACGTCTGGGGCCAAGGGACCACGGTCACCGTCACCTCA<br>SEQ ID NO: 29591 |
| | | AA | DIQMTQSPSSLSASVGDRVTITCRASQGIRNDLGWYQQKPGKAPKRLIYSASSLQSGVPSRFSGSGSGTEFTLTISSLQPEDFATYYCLQHNSYPWTFGQGTKVEIK<br>SEQ ID NO: 25586 | QVQLVQSGAEVKKPGASVKVSCKASGYSFTGHYIHWVRQAPGQGLEYMGWINPNSGGTNYVQKFQGRVTMTRDTSISTAYMELSRLRSDDTAIYYCSRGGLLGATNYYYGMDVWGQGTTVTS<br>SEQ ID NO: 29592 |

FIGURE 50
(Continued)

| | | | |
|---|---|---|---|
| iPS:434317 | 21-225_59E8 | NA | GACATCCAGATGACCCAGTCTCCATCTCCCT GTCTGCATCTGTAGGAGACAGAGTCACCATCA CTTGCCGGGCAAGTCAGAGCATTAGCAGCTAT TTAAATTGGTATCAGCAGAAACCAGGGAAAG CCCCTAAGCTCCTGATCTATGCTGCATCCAGTT TGCAAAGTGGGGGTCCCATCAAGGTTCAGTGGC AGTGGATCTGGGACAGATTTCACTCTCACCAT CAGCAGTCTGCAACCTGAAGATTTTGCAACTT ACTTCTGTCAACAGAGTTTCAGTAATTCGATC ACCTTCGGCCAAGGGACACGACTGGAGATTAA A<br>SEQ ID NO: 25587 | GAGGTGCAGCTGGTGGAGTCTGGGGGAGGCTTG GTACAGCCTGGGGGGTCCCTGAGACTCTCCTGTG CAGCCTCTGGATTCACTTTCAGTAGCTATAGCAT GAATTGGGTCCGCCAGGCTCCAGGGAAGGGGCT GGGGTGGGTGTCATATACGCAGAGACTGTGAAGGGCCGAT ACCATATACTACGCAGACTCTGTGAAGGGCCGAT TCACCATCTCCAGAGACAATGCCAAGAACTCACT GTATCTGCAAATGAACAGCCTGAGAGACGAGGA CACGGCTGTATTACTGTGCAGAGAATGGGGA ATGGCAGTGCTGCCCGTTGACTACTGGGGCC AGGGAACCCTGGTCACCGTCTCCTCA<br>SEQ ID NO: 29593 |
| | | AA | DIQMTQSPSSLSASVGDRVTITCRASQSISSYLNW YQQKPGKAPKLLIYAASSLQSGVPSRFSGSGSGT DFTLTISSLQPEDFATYFCQQSFSNSITFGQGTRL EIK<br>SEQ ID NO: 25588 | EVQLVESGGGLVQPGGSLRLSCAASGFTFSSYSMN WVRQAPGKGLGWVSYISSSSGTIYYADSVKGRFTIS RDNAKNSLYLQMNSLRDEDTAVYYCAREWGMAV AGPFDYWGQGTLVTVSS<br>SEQ ID NO: 29594 |
| iPS:434319 | 21-225_59B9 | NA | GACATCCAGATGACCCAGTCTCCATCTCCCT GTCTGCATCTGTAGGAGACAGAGTCACCATCA CTTGCCGGGCAAGTCAGGACAGTTAGAAATGAT TTAGGCTGGTATCAGCAGCACCCAGGGAAAGC CCCTAAGCGCCTGATCTATGCTGCATCCAGTTT ACAAAGTGGGGTCCCATCAAGGTTCAGCGGCA CTAGATCTGGGACAGAATTCACTCTCACAATC AGCAGCCTGCAGCCTGAAGATTTTGCAACTTA TTACTGTCTACAGCATAATAGTTACCCGTGA CGTTCGGCCAAGGGACCAAGGTGGAAATCAA A<br>SEQ ID NO: 25589 | CAGGTGCAGCTGGTGCAGTCTGGGCTGAGGTG AAGAAGCCTGGGGCCTCAGTGAAGGTCTCCTGC AAGGCTTCTGGATACATCTTCACCGGCAATTATA TACACTGGGTGCGACAGGCCCCTGGACAAGGGC TTGAGTACATGGGATGGATCAACCTAACAGTGG TGGCACAAACTATGACCAGGGACACGTCCATCAGCAG GGTCACCATGACCAGGGAACTGACCAGTCGAGATCTGA CGACACGGCCGTGTATTACTGTTCGAGAGGGGGC CTACTGGGAGCTACCTACTACTACTACGGTA TGGACGTCTGGGGCCAAGGGACCACGGTCACCG TCTCCTCA<br>SEQ ID NO: 29595 |

FIGURE 50
(Continued)

| | | AA | DIQMTQSPSSLSASVGDRVTITCRASQDIRNDLG WYQQHPGKAPKRLIYAASSLQSGVPSRFSGTRS GTEFTLTISSLQPEDFATYYCLQHNSYPWTFGQG TKVEIK | QVQLVQSGPEVKKPGASVKVSCKASGYIFTGNYIH WVRQAPGQGLEYMGWINPNSGGTNYVQKFQGRV TMTRDTSISTANMELTSLRSDDTAVYYCSRGGLLG ATYYYYGMDVWGQGTTVTSS |
|---|---|---|---|---|
| | | | SEQ ID NO: 25590 | SEQ ID NO: 29596 |
| iPS:434321 | 21-225_59F10 | NA | GACATCGTGATGACCCAGTTTCCAGACTCCCT GGCTGTGTCTCTGGGCGAGAGGGCCACCATCA ACTGCAAGTCCAGCCAGACTGTTTTATACAGG TCCAACAATTACAACTACTTAGTTGGTACCA GCAGAAACCAGGACAGCCTCCTAAGCTGCTCA TTTACTGGGCATCTACCCGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTTTAGTACTCCTCCGACGTTCGGCCAAGG GACCAAGGTGGAAATCAAA | CAGGTGCAGCTGGTGCAGTCTGGGGCTGAGGTG AAGAAGCCTGGGCCTCAGTGAAGGTCTCCTGC AAGGCTTCTGGATACACCTTCACAAATTATGATA TCAACTGGGTGCGACAGGCCACTGACAAGGGC TTGAGTGGATGGGATGGATGAACCCTAACAGTG GTAACACAGGCTATGCACAGAAGTTCCAGGGCA GAGTCACCATGACCAGAGACACCTCCATAAGCA CAGCCTACATGGAGCTGAGCAGGCTGAGATCTG AGGACACGGCCGTGTACTACTTTGACTACTGGGGCCAGGG GTGGCTGGTACTACTTTGACTACTGGGGCCAGGG AACCCTGGTCACCGTCTCCTCA |
| | | | SEQ ID NO: 25591 | SEQ ID NO: 29597 |
| | | AA | DIVMTQFPDSLAVSLGERATINCKSSQTVLYRSN NYNYLAWYQQKPGQPPKLLIYWASTRESGVPD RFSGSGSGTDFTLTISSLQAEDVAVYYCQQYFST PPTFGQGTKVEIK | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYNCAVSSGW YYFDYWGQGTLVTVSS |
| | | | SEQ ID NO: 25592 | SEQ ID NO: 29598 |

FIGURE 50
(Continued)

| | | | |
|---|---|---|---|
| iPS:434323 | 21-225_62H8 | NA | GACATCCAGATGACCCAGTCTCCATCTCCCT GTCTGCATCTGTAGGAGACAGAGTCACCATCA CTTGCCGGGCAAGTCAGAGCATTTCAGCTAT TTAAATTGGTATCAGCAGAAATCCGGGAAAGC CCCTAAGCTCCTGATCTATGCGTCATCCAGTTT GCAAAGTGGGTCCCATCAAGGTTAAGTGGCA ATGGATCTGGGACAGATTTCATTCTCACCATC AGCAGTCTGCAACCTGAAGATTTTGCAACTTA CTACTGTCAACAGAGTTACAGTACCCCATTCA CTTTCGGCCCTGGGACCAGAGTGGATATCAAA<br><br>SEQ ID NO: 25593 | CAGGTGCAGCTGGTGGAATCTGGGGGAGGCGTG GTCCAGCCTGGGAGGTCCCTGAGACTCTCCTGTG CAGCGTCTGGATTCACCTTCAGCAGCTACCTATGGCAT GCACTGGGTCCGCCAGGCTCCAGGCAAGGGGCT GGAGTGGGTGGCAGTTATATGGCATGATGGAAG TGATAAATATTATGTAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAAGACCCT GGGTACCAGTCTGCTCTGACTACTGGGGCCAGGGA ACCCCTGGTCACCGTCTCCTCA<br><br>SEQ ID NO: 29599 |
| | | AA | DIQMTQSPSSLSASVGDRVTITCRASQSIFSYLNW YQQNPGKAPKLLIYASSSLQSGVPSRLSGNGSGT DFILTISSLQPEDFATYYCQQSYSTPFFGPGTRV DIK<br><br>SEQ ID NO: 25594 | QVQLVESGGGVVQPGRSLRLSCAASGFTFSTYGMH WVRQAPGKGLEWVAVIWHDGSDKYYVDSVKGRF TISRDNSKNTLYLQMNSLRAEDTAVYYCAREDPRT SCSDYWGQGTLVTVSS<br><br>SEQ ID NO: 29600 |
| iPS:434327 | 21-225_63G6 | NA | GACATCCAGATGACCCAGTCTCCATCTCCCT GTCTGCATCTGTAGGAGACAGAGTCACCATCT CTTGCCGGGCAAGTCAGAGCATTTCAGCTAT TTAAATTGGTATCAGCAGAAACCAGGGAAAGC CCCTAAGCTCCTGATCTATGATACATCCACTTT GCAAACTGGGGTCCCATCAAGGTTCAGTGGCA GTGGATCTGGGACAGATTTCACTCTCACCATC AACAGTCTGCAACCTGAAGATTTTGCAACTTA CTACTGTCAACAGAGTTACGGTATCCCCATCA CCTTCGGCCAAGGGACACGACTGGAGATTCAA<br><br>SEQ ID NO: 25595 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT AGAATGGGTGACAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATAGCCT CTCGGGTATAGCAGCAGCTTTTGACTACTGGGGC CAGGGAACCCTGGTCACCGTCTCCTCA<br><br>SEQ ID NO: 29601 |

FIGURE 50
(Continued)

| | | | |
|---|---|---|---|
| iPS:434331 | 21-225_63H8 | AA | DIQMTQSPSSLSASVGDRVIISCRASQSIFSYLNW YQVKPGKAPKLLIYDTSTLQTGVPSRFSGSGSGT DFTLTINSLQPEDFATYCQQSYGIPITFGQGTRL EIQ<br>SEQ ID NO: 25596 | QVQLVESGGGVVQPGRSLRLSCAASGFTFSSYGMH WVRQAPGKGLEWVTVIWYDGSNKYYADSVKGRF TISRDNSKNTLYLQMNSLRAEDTAVYYCARDSLSG IAAAFDYWGQGTLVTVSS<br>SEQ ID NO: 29602 |
| | | NA | GACATCCAGATGACCCAGTCTCCATCCTCACT GTCTGCATCTGTAGGAGACAGAGTCACCATCA CTTGTCGGGCGAGTCAGGGACATTAGCAATTAT TTAGCCTGGTTTCAGCAGAAACCAGGGAAAGC CCCTAAGTCCCTGATCTATGCTGCATCCAGTTT GCAAAGTGGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAATATCATAGTTACCCATTCA CTTTCGGCCCTGGGACCAAAGTGGATATCAGA<br>SEQ ID NO: 25597 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAACAT GAACTGGGTCCGCCAGGCTCCAGGGAAGGGGCT GGAGTGGGTCTCATCATTAGTGGTAGTAGCACT TACATGAACTACACAGACTCAGTGAAGGGCCGA TTCACCATCTCCAGAGACAACAGCCAAGAACTCAC TGTATCTGCAAATGAACAGCCTGCGAGACTACGTAA ACACGGCTGTGTATTACTGTGCGAGACTACGTAA TTTTGACTACTGGGGCCAGGGAACCCTGGTCACC GTCTCCTCA<br>SEQ ID NO: 29603 |
| | | AA | DIQMTQSPSSLSASVGDRVTITCRASQGISNYLA WFQQKPGKAHKSLIYAASSLQSGVPSKFSGSGS GTDFTLTISSLQPEDFATYYCQQYHSYPFTFGPG TKVDIR<br>SEQ ID NO: 25598 | EVQLVESGGGLVKPGGSLRLSCAASGFTFSSYNMN WVRQAPGKGLEWVSSISGSSTYMNYTDSVKGRFTI SRDNAKNSLYLQMNSLRAEDTAVYYCARLRNFDY WGQGTLVTVSS<br>SEQ ID NO: 29604 |

FIGURE 50
(Continued)

| | | | |
|---|---|---|---|
| iPS:434333 | 21-225_63C9 | NA | GACATCCAGATGACCCAGTCTCCATCTCCGT GTCTGCATCTGTCGGAGACAGAGTCACCATCA CTTGTCGGGCGAGTCAGGTATTAGCAGCTGG TTAGCCTGGTATCAGCAGAAACCAGGGAAAG CCCCTAACCTCCTGATCTATGCTGCATCCAGT TGCAAAGTGGGGTCCCATCAAGGTTCAGCGGC AGTGGATCTGGGACAGATTTCACGCTCACCAT CAGCGGCCTGCAGCCTGAAGATTTTGCAACTT ACTTTTGTCAACAGATTAACAGTTTCCCTCTCA CTTTCGGCGGAGGGACCAAGGTGGCGATCAA A<br><br>SEQ ID NO: 25599 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGATGGATCAACCTAACAGTGG TGGCACAAACTTTGCACAGAAGTTTCAGGGCAG GGTCACCATGACCAGGGACGCGTCCATCAACAC AGCCTACATGGAGCTGCGCAGCCTGATATCTGAC GACACGGCCGTATATTACTGTGCGAGAGCTCCGG GTGTAGCAGCAGCTGGTTCATGGGGATACTTTGA CTACTGGGGCCAGGGAACCCTGGTCACCGTCTCC TCA<br><br>SEQ ID NO: 29605 |
| | | AA | DIQMTQSPSSVSASVGDRVTITCRASQGISSWLA WYQQKPGKAPNLLIYAASSLQSGVPSRFSGSGS GTDFTLTISGLQPEDFATYFCQQINSFPLTFGGGT KVAIK<br><br>SEQ ID NO: 25600 | QVQLVQSGAEVKKPGASVKVSCKASGYTFTGYYM HWVRQAPGQGLEWMGWINPNSGGTNFAQKFQGR VTMTRDASINTAYMELRSLISDDTAVYYCARAPGV AAAGSWGYFDYWGQGTLVTVSS<br><br>SEQ ID NO: 29606 |
| iPS:434335 | 21-225_63C10 | NA | GACATCCAGATGACCCAGTCTCCGTCCTCCCT GTCTACATCTGTAGGAGACAGAGTCACCATCA CTTGCCGGGCAAGTCAGAGCATTTCAGCTCA TTACATTGGTATCAGCAGAAACCAGGGAAAGC CCCTAAGCTCCTGATCTCTGCTGCATCCAGTTT ACAAAGTGGGGTCCCATCAAGGTTCAGTGGCA GTGGATCTGGGACAGATTTCACTCTCACCATC AGTAGTCTGCAACCTGAAGATTTTGCAACTTT CTACTGTCAACAGACTTACAGTCCCCCGCTCA CTTTCGGCGGAGGGACCAAGGTGGAGATCAA A<br><br>SEQ ID NO: 25601 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTCATATGTATGATGAAGT AATAAATACTATGCAGAGACAATTCCAAGAACACGC TTCACCATCTCAAATGAACAGCCTGAGAGCCGAGG TGTATCTGCAAATGAACAGCCTGAGAGAGATCC ACAGGCTGTGTATTACTGTGCGAGAGATGATCC CAGATCCTCCGCGGGGACTACTGGGGCCAGGG AACCCTGGTCACCGTCTCCTCA<br><br>SEQ ID NO: 29607 |

FIGURE 50
(Continued)

| | | | | |
|---|---|---|---|---|
| | | AA | DIQMTQSPSSLSTSVGDRVTITCRASQSIFSYLHW YQQKPGKAPKLLISAASSLQSGVPSRFSGSGSGT DFTLTISSLQPEDFATFYCQQTYSPPLTFGGGTKV EIK<br>SEQ ID NO: 25602 | QVQLVESGGGVVQPGRSLRLSCAASGFTFSSYGMH WVRQAPGKGLDWVAVIWYDGSNKYYADSVKGRF TISRDNSKNTLYLQMNSLRAEDTAVYYCARDDPRS SAGDYWGQGTLVTVSS<br>SEQ ID NO: 29608 |
| iPS:434337 | 21-225_64E1 | NA | CAGGTGCAGCTGGTGGAGTCTGGGGGAGGCGTG GTCCAGCCTGGGAGGTCCCTGAGACTCTCCTGTG TAGCGTCTGGATTCACCTTCAGTAGCTATGGCAT GCACTGGGTCCGCCAGGCTCCAGGCAAGGGCT GGAGTGGGTGGCAGTTATATGGTTTGATGAAACT AATAAATACTATGGAGACTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGCGAGAGAGCTTGG GTTCAGCAGTGACTATTGGGGCCAGGGAACCCTG GTCACCGTCTCCTCA<br>SEQ ID NO: 25603 | GACATCCAGATGACCCAGTCTCCATCTCCCT GTCTGCATCTGTAGGAGACAGAGTCACCATCA CTTGCCGGGCAAGTCAGAGCATTAGAAATGAT TTAGGCTGGTATCAGCAGAAACCAGGGAAAG CCCCTAAGCGCCTGATCTATGCTGCATCCAGT TTGCAAAGTGGGGTCCCATCACGGTTCAGCGG CAGTGGATCTGGGACAGAATTCACTCTCACAA TCAGCAGCTTGCAGCCTGAAGATCTTGCAACT TATTACTGTCTACAGCATAATAGTTACCCGCTC ACTTTCGGCGGAGGGACCAAGGTGGAGATCA AA<br>SEQ ID NO: 25604 |
| | | AA | DIQMTQSPSSLSASVGDRVTITCRASQGIRNDLG WYQQKPGKAPKRLIYAASSLQSGVPSRFSGSKS GTEFTLTISSLQPEDLATYYCLQHNSYPLTFGGG TKVEIK<br>SEQ ID NO: 25604 | QVQLVESGGGVVQPGRSLRLSCVASGFTFSSYGMH WVRQAPGKGLEWVAVIWFDETNKYYGDSVKGRF TISRDNSKNTLYLQMNSLRAEDTAVYYCARELGFS SDYWGQGTLVTVSS<br>SEQ ID NO: 29610 |

FIGURE 50
(Continued)

| | | | |
|---|---|---|---|
| iPS:434339 | 21-225_64A4 | NA | GACATCCAGATGACCCAGTCTCCATCCTCCCT GTCTGCATCTGTAGGAGACAGAGTCACCATCA CTTGCCGGGCAAGTCAGGGACAGAGTCATTA GAAAATGAT TTAGGCTGGTATCAGCAGAAACCAGGGAAAG CCCCTAAACGCCTGATCTATGCTGCATCCAGT TTGCAAAGTGGGGTCCCATCAAGGTTCAGCGG CAGTGGATCTGGGACAGAATTCACTCTCACAA TCAGCAGCCTACAGCCTGAAGATCTTGCAACT TATTACTGTCTACAGCATTATAGTTACCCTCGG ACGTTCGGCCAAGGGACCAAGGTGGAAATCA AA SEQ ID NO: 25605 | CAGGTGCAGCTGGTGGAGTCTGGGGGAGGCGTG GTCCAGCCTGGGAGGTCCCTGAGACTCTCCTGTG CAGCGTCTGGATTCACCTTCAGCGATTATGTCAT GCACTGGGTCCGCCAGGCTCCAGGCAAGGGGCT GGAGTGGGTGGCAGTCATATGGTATGATGGAAG TAATAAATACTATGCAGACTCCGTGAAGGGCCG ATTCACCATCTCCAGAGACAATTCCCAGAACACG CTGTATCTGCAAATGAATAGCCTGAGAGCCGAG GACACGGCTGTGTATTACTGTGCGAGAGAAAGGT ATAGCAGCAGCTGGTACGACTACGGTATGGACG TCTGGGGCCAAGGGACCACGGTCACCGTCTCCTC A SEQ ID NO: 29611 |
| | | AA | DIQMTQSPSSLSASVGDRVTITCRASQGIRNDLG WYQQKPGKAPKRLIYAASSLQSGVPSRFSGSGS GTEFTLTISSLQPEDLATYYCLQHYSYPRTFGQG TKVEIK SEQ ID NO: 25606 | QVQLVESGGGVVQPGRSLRLSCAASGFTFSDYVM HWVRQAPGKGLEWVAVIWYDGSNKYYADSVKGR FTISRDNSQNTLYLQMNSLRAEDTAVYYCARERYS SSWYDYGMDVWGQGTTVTVSS SEQ ID NO: 29612 |
| iPS:434341 | 21-225_64F7 | NA | GACATCCAGATGACCCAGTCTCCATCCTCCCT GTCTGCATCTGTAGGAGACAGAGTCACCATCA CTTGCCGGGCAAGTCAGAACATTAAGAAATAT TTAAATTGGTATCAGCAGAAACCAGGGAAAG CCCCTAAGTCTCTGATCTATGGTGCATCCAGT TGCAAAGTGGGGTCCCATCAAGGTTCAGTGGC AGTGGATCTGGGACAGATTTCACTCTCACCAT CAGTAGTCTGCAACCTGAAGATTTTGCAGCTT ACTACTGTCAACAGAGTTACATATTTCGTTC ACTTTCGGCGGAGGGACCAAGGTGGAGCTCA AA SEQ ID NO: 25607 | CAGGTGCAGCTGCAGGAGTCGGGCCCAGGACTG GTGAAGCCTTCGGAGACCCTGTCCTCACCTGCA CTGTCTCTGGTGGCTCCATCAGTAGTTACTTCTGG AGCTGGATCCGGCAGCCCCCGGGAAGGGACTG GAGTGGATTGGGCGTATCTATACCAGTGGGATCT CCAACTACAATCCCTCCCTCAAGAGTCGAGTCAC CATGTCAGTTGACACGTCCAAGAACCAGTTCTCC CTGAAGCTGAGCTCTGTGACCGCCGCGGACACG GCCGTGTATTACTGTGCGAGAGTTTAGCAGTGGCT TTTTTGACTACTGGGGCCAGGGTACCCTGGTCAC CGTCTCCTCA SEQ ID NO: 29613 |

FIGURE 50
(Continued)

| | | | |
|---|---|---|---|
| | | AA | DIQMTQSPSSLSASVGDRVTITCRASQNIKKYLN WYQQKPGKAPKFLIYGASSLQSGVPSRFSGSGSG TDFTLTISSLQPEDFAAYYCQQSYNISFTFGGGTK VELK<br>SEQ ID NO: 25608 | QVQLQESGPGLVKPSETLSLTCTVSGGSISSYFWSW IRQPAGKGLEWIGRIYTSGISNYNPSLKSRVTMSVD TSKNQFSLKLSSVTAADTAVYYCARFSSGFFDYWG QGTLVTVSS<br>SEQ ID NO: 29614 |
| | | NA | GACATCCAGATGACCCAGTCTCCATCCTCCCT GTCTGCAGCTGTAGGAGACAGAGTCACCATCA CTTGCCGGGCAAGTCAGGGCATTAGAAATGAT TTAGGCTGGTATCAGCAGAAACCAGGGAAAG CCCCTAAGTGCCTGATCTATGCTGCATCCAGT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTATTGTCTACACCATTATAGTTACCCTCGGA CGTTCGGCCAAGGGGACCAAGGTGGAAATCAA A<br>SEQ ID NO: 25609 | CAGGTGCAGCTGGTGGAGTCTGGGGGAGGCGTG GTCCAGCCTGGGAGGTCCCTGAGACTCTCCTGTG CAGCGGTCTGATTCACCTTCAGTGACTATGTCAT GCACTGGGTCCGCCAGGTCCCAGGCAAGGGCT GGAGTGGGTGGCAGTTATATGGTATGATGGAAGT AATAAATACTATGCAGACTCCATGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACGGTA TAGCAGTGGCTGGTACGACTACGGTATGGACGTC TGGGGCCAAGGGACCACGGTCACCGTCTCCTCA<br>SEQ ID NO: 29615 |
| iPS:434343 | 21-225_64C8 | AA | DIQMTQSPSSLSAAVGDRVTITCRASQGIRNDLG WYQQKPGKAPKCLIYAASSLQSGVPSRFSGSGS GTEFTLTISSLQPEDFATYYCLHHYSYPRTFGQG TKVEIK<br>SEQ ID NO: 25610 | QVQLVESGGGVVQPGRSLRLSCAASGFTFSDYVM HWVRQAPGKGLEWVAVIWYDGSNKYYADSMKG RFTISRDNSKNTLYLQMNSLRAEDTAVYYCARERY SSGWYDYGMDVWGQGTTVTSS<br>SEQ ID NO: 29616 |

FIGURE 50
(Continued)

| | | | |
|---|---|---|---|
| iPS:434345 | 21-225_64H9 | NA | GAAATTGTGATGACCCAGACTCCACTCTCTCT GTCCGTCACCCCTGGACAGCCGGCCTCCATCT CCTGCAAGTCTAGTCAGAGCTCCTTCATGGT GATGGAAAGACCTATTTGTTTGGTACCTGCA GAAGCCAGGCCAGCCTCCAACCGGTTGTGTGAGGTCTGATCT ATGAAGTTTCCAACCGGTTGTGTGAGGTGCA GACAGGTTCAGTGGCAGCGGGTCAGGGACAG ATTTCTCATTGAAAATCAGCCGGGTGAGGCT GAGGACGTTGGGGTTTATTACTGCATGCAAAG TATACAGGTTCCGTGGACGTTCGGCCAAGGGA CCAAGGTGGAAATCACA<br><br>SEQ ID NO: 25611 | CAGGTGCAGCTGGTGGAGTCTGGGGGAGGCGTG GTCCAGCCTGGGAGGTCCCTGAGACTCTCCTGTG CAGCGTCTGGATTCACCTTCAGTACCTATGGCAT GCACTGGGTCCGCCAGGCTCCAGGCAAGGGGCT GGAGTGGGTGGCAATTATATGGTATGATGGAAGT AATAAATACTATGCAGACTCCGTGAAGGGCCGA TTCACCATCTCCAGAGACAATTCCAAGAACACGC TATATCTACAAATGAACAGCCTGAGAGCCGAGG ACACGGCTGTATTATTGCGAGAGATACATA CGATTTTTGGAGTGGTTATTTGGGCTACTGGGGC CAGGGAACCCTGGTCACCGTCTCCTCA<br><br>SEQ ID NO: 29617 |
| | | AA | EIVMTQTPLSLSVTPGQPASISCKSSQSLLHGDGK TYLFWYLQKPGQPPQVLIYEVSNRLCGVPDRFS GSGSGTDFSLKISRVEAEDVGVYYCMQSIQVPW TFGQGTKVEIT<br><br>SEQ ID NO: 25612 | QVQLVESGGGVVQPGRSLRLSCAASGFTFSTYGMH WVRQAPGKGLEWVAIIWYDGSNKYYADSVKGRFT ISRDNSKNTLYLQMNSLRAEDTAVYYCARDTYDF WSGYLGYWGQGTLVTVSS<br><br>SEQ ID NO: 29618 |
| iPS:434347 | 21-225_64H10 | NA | GACATCCAGATGACCCAGTCTCCATCTTCCGT GTCTGCATCTGTAGGAGACAGAGTCACCATCA CTTGTCGGGCGAGTCAGGGTATTAGCAGCTGG TTAGCCTGGTATCAGCAGAAACCAGGGAAAG CCCTTAAGCTCTTGATCTATGCTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGATTAACAGTTTCCCTCTCA CTTTCGGCGGAGGGACCAAGGTGGAGATCAA A<br><br>SEQ ID NO: 25613 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACCAAACAGTG GTGGCACAAACCAAGCACCAGGACACGTCCATCAGCA GGGTCACCATGACCAGGGACACGTCCATCAGCA CAGCCTACATGAGCTGAGCGGCGCTGAGATCTG ACGACACGGCCGTGTATTACTGTGCGAGAGCTCC GGGTACTGCAGCAACTGGTACATGGGATACTTT GACTACTGGGGCCAGGGAACCCTGGTCACCGTCT CCTCA<br><br>SEQ ID NO: 29619 |

FIGURE 50
(Continued)

| | | | | |
|---|---|---|---|---|
| | | AA | DIQMTQSPSSVSASVGDRVTITCRASQGISSWLA WYQQKPGKALKLLIYAASSLQSGVPSRFSGSGS GTDFTLTISSLQPEDFATYYCQQINSFPLTFGGGT KVEIK<br><br>SEQ ID NO: 25614 | QVQLVQSGAEVKKPGASVKVSCKASGYTFTGYYM HWVRQAPGQGLEWMGWIKPNSGGTNQAQKFQGR VTMTRDTSISTAYMELSGLRSDDTAVYYCARAPGT AATGTWGYFDYWGQGTLVTVSS<br><br>SEQ ID NO: 29620 |
| iPS:434351 | 21-225_64A12 | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTACACGCCTGATCTATGCATCCACTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAATGGTTACCCATTC ACTTTCGGCCCTGGGACCAAAGTGATATCAA A<br><br>SEQ ID NO: 25615 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGAAAGT AATAAATACTATGTAGACTCCGTGAAGGGCCGAT TCACCATCTCCAGAGACAATTCCAAGAACACGCT GTATCTGCAAATGAACAGCCTGAGAGCGAGGA CACGGCTGTGTATTACTGTGCGAGGGAACTCGGG TTCCTCTCTGACCACTGGGGCCAGGGAACCCTGG TCACCGTCTCCTCA<br><br>SEQ ID NO: 29621 |
| | | AA | DIQMTQSPSSLSASVGDRVTITCRASQGIRNDLG WYQQKPGKAPTRLIYTASTLQSGVPSRFSGSGSG TEFTLTISSLQPEDFATYYCLQHNGYPFFGPGTK VDIK<br><br>SEQ ID NO: 25616 | QVQLVESGGGVVQPGRSLRLSCAASGFTFSSYGMH WVRQAPGKGLEWVAVIWYDESNKYYVDSVKGRF TISRDNSKNTLYLQMNSLRAEDTAVYYCARELGFL SDHWGQGTLVTVSS<br><br>SEQ ID NO: 29622 |

FIGURE 50
(Continued)

| | | | |
|---|---|---|---|
| iPS:434353 | 21-225_64B12 | NA | GACATCCAGATGACCCAGTCTCCATCTCCCT GTCTGCATCTGTAGGAGACAGAGTCACCATCA CTTGCCGGGCGAGTCAGGACATTAGCAATTAT TTAAATTGGTATCAGCAGAAACCAGGGACAGC CCCTAAACCTCCTGATCTCTGATGCATCCATTTT GGAAACAGGGGTCCCATCAACGTTCAGTGGA AGTGGATCTGGGACAGATTTTACTTTCACCAT CAGCAGCCTGCAGCCTGAAGATATTGCAACAT ATTACTGTCAACAGAGTGATAATCTCCCGTGC AGTTTTGGCCAGGGACCAAGGTGGAGATCA AA<br>SEQ ID NO: 25617 | CAGCTGCAGCTGCAGGAGTCGGGCCCAGGACTG GTGAAGCCTTCGGAGACCCTGTCCCTCACCTGCA CTGTCTCTGGTGTCTCCATCAGCAGAAGTAGTTA CTACTGGGGCTGGATCCGCCAGCCCCAGGGAA GGGGCTGGAGTGGATTGGGAGTATCTATTACAGT GGGAGCACCTCTACAACCGTCCTCCCTCAAGAGTC GAGTCACCATATCGTAGACACGTCCAAGAACC AGTTCCTCCAGCTGAAGCTGAGCTCTGTGACCGCGC AGACACGGCTGTGTATTATTGTGCGAGACTGGAC AGTGGCTGGTCCTTTGACTACTGGGGCCAGGGAA CCCTGGTCACCGTCTCCTCA<br>SEQ ID NO: 29623 |
| | | AA | DIQMTQSPSSLSASVGDRVTITCRASQDISNYLN WYQQKPGTAPNLLISDASILETGVPSTFSGSGSG TDFTFTISSLQPEDIATYYCQQSDNLPCSFGQGTK VEIK<br>SEQ ID NO: 25618 | QLQLQESGPGLVKPSETLSLTCTVSGVSISRSSYYW GWIRQPPGKGLEWIGSIYYSGSTSYNPSLKSRVTISV DTSKNQFSLKLSSVTAADTAVYYCARLDSGWSFD YWGQGTLVTVSS<br>SEQ ID NO: 29624 |
| iPS:434355 | 21-225_64G12 | NA | GACATCCAGATGACCCAGTCTCCCTCTTCCGT GTCTGCATCTGTAGGAGACAGAGTCACCATCA CTTGTCGGGCGAGTCAGAATATTACCAACTGG TTAGCCTGGTATCAGCAGAAACCAGGGAAAG CCCCTAAACTCCTGATCTCTGCTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ATATTTGTCAACAGGCTAACAGTTTTCCATTCA CTTTCGGCCCTGGGACCAAACTGGATATCAAA<br>SEQ ID NO: 25619 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGTAATGCCAT GAGCTGGGTCCGCCAGGCTCCAGGGAAGGGGCT GGAGTGGGTCTCAGTTATTAGTGGTAGTGGTGGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCTTATATTACTGTGCGAAAGGAACTA CGACGATGCTTTTGATATCTGGGGCCAAGGGACA ATGGTCACCGTCTCTTCA<br>SEQ ID NO: 29625 |

FIGURE 50
(Continued)

| | | | | |
|---|---|---|---|---|
| iPS:434357 | | AA | DIQMTQSPSSVSASVGDRVTITCRASQNITTWLAWYQQKPGKAPKLLISAASSLQSGVPSRFSGSGSGTDFTLTISSLQPEDFATYICQQANSFPFTFGPGTK.LDIK<br>SEQ ID NO: 25620 | EVQLLESGGGLVQPGGSLRLSCAASGFTFSSNAMSWVRQAPGKGLEWVSVISGSGGSTYYADSVKGRFTISRDNSKNTLYLQMNSLRAEDTALYYCAKRNYDDAFDIWGQGTMVTVSS<br>SEQ ID NO: 29626 |
| | | NA | GACATCCAGTTGACCCAGTCTCCATCTCCTGTCTGCATCTGTAGGAGACAGAGTCACCATCACTTGCCGGGCGAGTCAGGTCATTAGCAGTTATTTACATTGGTATCAGCAGAAACCAGGGAAAGTTCCTAAGGTCCTGATCTATATAGTGCATCCAATTTGCAATGTGGAGTCCCATCTCGGTTCAGCGGCAGTGGATCTGGGACAGATTTCACTCTCACCTTCAGCAGCCTGCAGCCTGAAGATGTTGCAACTTATTACGGTCAACGGCCTTACAATGCCCCGCTCACTTTCGGCGGAGGGACCAAGGTTGGAGATCAAA<br>SEQ ID NO: 25621 | CAGGTGCAGCTGGTGGAGTCTGGGGGAGGCGTGGTCCAGCCTGGGAGGTCCCTGAGACTCTCCTGTCAGCGTCTGGATTCACCTTCAGTGACTATGGCATGCACTGGGTCCGCCAGGCTCCAGGCAAGGGGCTGGAGTGGGTGGCAGTGATATGGTTTGAGGGAAGTAATAAACACTATACAGACTCCGTGAAGGGCCGATTCACCATCTCCAGAGACAACAGCCAAGAACACGCTGTATCTGCAAATGAACAGCCTGAGAGCCGAGGACACGGCTGTGTATTACTGTGCGAGAGAACTTGGGTTCAGCAGTGACTACTGGGGCCAGGGAACCCTGGTCACCGTCTCCTCA<br>SEQ ID NO: 29627 |
| | 21-225_65C1 | AA | DIQLTQSPSSLSASVGDRVTITCRASQVISSYLHWYQQKPGKVPKVLIYSASNLQCGVPSRFSGSGSGTDFTLTFSSLQPEDVATYYGQRPYNAPLTFGGGTKVEIK<br>SEQ ID NO: 25622 | QVQLVESGGGVVQPGRSLRLSCAASGFTFSDYGMHWVRQAPGKGLEWVAVIWFEGSNKHYTDSVKGRFTISRDNSKNTLYLQMNSLRAEDTAVYYCARELGFSSDYWGQGTLVTVSS<br>SEQ ID NO: 29628 |

FIGURE 50
(Continued)

| | | | |
|---|---|---|---|
| iPS:434359 | 21-225_65G3 | NA | GACATCCAGATGACCCAGTCTCCATCCTCCGT GTCTGCATCTGTAGGAGACAGAGTCACCATCA CTTGTCGGGCGAGTCAGGGTATTAGCAGCTGG TTAGCCTGGTATCAGCAGAAACCAGGGAAAG CCCCTAAGCTCTTGATCTATGCTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT TCTATTGTCAACAGGTTAACAGTTTCCCTCTCA CTTTCGGCGGAGGGACCAAGGTGGAGATCAA A | CAGGTGCAACTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGGC TTGAGTGGATGGGATGGATCAACCCTAACAGTGG TGGCACAAACTCTGCACAGAAGTTTCAGGGCAG GGTCACCATGACCAGGGACACGTCCATCAGCAC AGCCTACATGGAGCTGAGCAGGCTGAGATCTGA CGACACGGCCGTATATTACTGTGCAGAGCTCCG GGTAAAGCAGCAGCTGGTACATGGGATACTTTG ACTACTGGGGCCAGGGAACCCTGGTCACCGTCTC CTCA |
| | | | SEQ ID NO: 25623 | SEQ ID NO: 29629 |
| | | AA | DIQMTQSPSSVSASVGDRVTITCRASQGISSWLA WYQQKPGKAPKLLIYAASSLQSGVPSRFSGSGS GTDFTLTISSLQPEDFATFYCQQVNSFPLTFGGGT KVEIK | QVQLVQSGAEVKKPGASVKVSCKASGYTFTGYYIH WVRQAPGQGLEWMGWINPNSGGTNSAQKFQGRV TMTRDTSISTAYMELSRLRSDDTAVYYCARAPGKA AAGTWGYFDYWGQGTLVTVSS |
| | | | SEQ ID NO: 25624 | SEQ ID NO: 29630 |
| iPS:434361 | 21-225_65D5 | NA | GACATCCAGATGACCCAGTCTCCGTCCTCACT ATCTGCATCTGTAGGAGACAGAGTCACCATCA CTTGTCGGGCGAGTCAGGACATTAACAATTAT TTAGCCTGGTTTCAGCAGAAACCAGGGAAAGC CCCTAGGTCCCTAATTTATGCTGCATCCAGTTT GCACAGTGGGGTCCCATCACAGTTCAGCGGCA GTGGTTCTGGGTCAGATTTCACTCTTACTATCA GCAGCCTGCAGCCTGAAGATTTTGCAACTTAT TACTGCCCACTGTATAAAAGTTATCCACTCAC TTTTGGCCCTGGGACCAAAGTGGATATCAAA | CAGGTTCAGCTGGTGCAGTCTGGAGCTGAGGTGA AGAAGCCTGGGGCCTCAGTGAAGGTCTCCTGCA AGGCTTCTGGTTACACCTTTCCAGTCTATGGTAT CAGTTGGGTGCGACAGGCCCCTGGACAAGGACT TGAGTGGATGGGATGGATCAGCGCTTACAGTGGT AACACAAACTATGCACAGAAGTTCAGGGCAGA GTCACCATGACCACAGACACATCCACGAGCACA GCCTACATGGAGCTGAGGAGCCTGAGATCTGAC GACACGGCCGTGTATTTCTGTGCGAGAGGGGAA GCAGTGGCTGTCTTCGACCCCTGGGGCCAGGGAA CCCTGGTCACCGTCTCCTCA |
| | | | SEQ ID NO: 25625 | SEQ ID NO: 29631 |

FIGURE 50
(Continued)

| | | | | |
|---|---|---|---|---|
| | | AA | DIQMTQSPSSLSASVGDRVTITCRASQDINNYLA WFQQKPGKAPRSLIYAASSLHSGVPSQFSASGSG SDFTLTISSLQPEDFATYYCPLYKSYPLTFGPGTK VDIK<br>SEQ ID NO: 25626 | QVQLVQSGAEVKKPGASVKVSCKASGYTFPSYGIS WVRQAPGQGLEWMGWISAYSGNTNYAQKLQGRV TMTTDTSTSTAYMELRSLRSDDTAVYFCARGEAVA VFDPWGQGTLVTVSS<br>SEQ ID NO: 29632 |
| iPS:434363 | 21-225_65A6 | NA | GAAATAGTGATGACGCAGTCTCCAGTCACCCT GTTTGTCTCCAGGGGAAAAGAGCCACCCTCT CCTGCAGGGCCAGTCAGAGTGTTAACAGCAAC TTAGCCTGGTACCAGCAGAAACCTGGCCAGGC TCCCAGGCTCCTCATCTATGGTGCATCCACCA GGGCCACTGGTATCCCAGCCAGGTTCACTGGC AGTGGGTCTGGGACAGAGTTCACTCTCACCAT CAGCAGCCTGCAGTCTGAAGATTTTGCAGTT ATTATTGTCAGCAGTATAATGACTGGCCGTGC AGTTTTGGCCTGGAGACCAAGCTGGAGATCAA A<br>SEQ ID NO: 25627 | CAGGTGCAGCTGGTGCAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATATGGTATGATGGAAGT AATAAATACTATGGAGACTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGCGAGAGATCAGGG CATAGTGGGAGCTACTTGGTTTGACTACTGGGGC CAGGGAACCCTGGTCACCGTCTCCTCA<br>SEQ ID NO: 29633 |
| | | AA | EIVMTQSPVTLFVSPGERATLSCRASQSVNSNLA WYQQKPGQAPRLLIYGASTRATGIPARFNGSGS GTEFTLTISSLQSEDFAVYYCQQYNDWPCSFGLE TKLEIK<br>SEQ ID NO: 25628 | QVQLVESGGGVVQPGRSLRLSCAASGFTFSNYGM HWVRQAPGKGLEWVAVIWYDGSNKYYGDSVKGR FTISRDNSKNTLYLQMNSLRAEDTAVYYCARDQGI VGATWFDYWGQGTLVTVSS<br>SEQ ID NO: 29634 |

FIGURE 50
(Continued)

| | | | | |
|---|---|---|---|---|
| iPS:434367 | 21-225_65H11 | NA | GACATCCAGATGACCCAGTCTCCATCCTCT GTCTGCATCTGTAGGAGACAGAGTCACCATCA CTTGTCGGGCGAGTGCAGGACATTAGCACTTAT TTAGCCTGGTTTCAGCAGAAACCAGGAAAGC CCCTAAGTCACTGATCTATGCTGCATCCAGTT GCAAAGTGGGGTCCCATCAAGTTCAGCGGCA GTGGATCTGGGACAGATTTCACTCTCACCATC AGTAGCCTGCAGCCTGAAGATTTTGCAACTTA TTACTGCCAACAGTATAATAGTTTCCCTCTCAC TTTCGGCGGAGGGACCAAGGTGGAGATCAAA  SEQ ID NO: 25629 | GAGGTGCAGCTGTGGTGGAGTCTGGGGGAGGCCTG GTCAAGCCGGGGGGGTCCCTGAGACTCTCCTGTG CAGCCTCTGGATTCACCTTCAGTAGTATAGGAT GAACTGGGTCCGCCAGGCTCCAGGGAAGGGCT GGAGTGGGTCTCATCCATTAGTAGTAGTAATAGT TCCATATACTACGAGACTCAGTGAAGGGCGAT TCACCACCTCCAGAGACAACGCCAAGAACTACT GTATCTGCAAATGAACAGCCTGAGAGCCGAGGA CACGGCTGTGTATTACTGTACGAGTACAAGTGGG AGCTGGGGCCAGGGAACCCTGGTCACCGTCTCCT CA  SEQ ID NO: 29635 |
| | | AA | DIQMTQSPSSLSASVGDRVTITCRASQDISTYLA WFQQKPGKAPKSLIYAASSLQSGVPSKFSGSGSG TDFTLTISSLQPEDFATYYCQQYNSFPLTFGGGT KVEIK  SEQ ID NO: 25630 | EVQLVESGGGLVKPGGSLRLSCAASGFTFSSYRMN WVRQAPGKGLEWVSSISSSNSSIYYADSVKGRFTS RDNAKNSLYLQMNSLRAEDTAVYYCTSTSGSWGQ GTLVTVSS  SEQ ID NO: 29636 |
| iPS:434369 | 21-225_66B1 | NA | GACATCCAGATGACCCAGTCTCCATCTCCGT GTCTGCATCTGTAGGAGACAGAGTCACCATCA CTTGTCGGGCGAGTCAGGTATTAGCAGCTGG TTAGCCTGGTATCAGCAGAAACCAGGAAAG CCCTTAAGCTCCTTGATCTATGCTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGATACTAACAGTTTCCCTCTC ACTTTCGGCGGAGGGACCAAGGTGGAGATCA AA  SEQ ID NO: 25631 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACCTAACAGTGG TGGCACAAACAATGCACAGAAGTTCAGGCAG GGTCACCATGACCAGGGCCACGTCCATCAGCAC AGCCTACATGGAACTGAGCAGGCTGAGATCTGA CGACACGGCCGTGTATTATTGTGCGAGAGTCCG GGTACAGCAGCAGCTGGTACATGGGATACTTTG ACTACTGGGGCCAGGGAACCCTGGTCACCGTCTC CTCA  SEQ ID NO: 29637 |

FIGURE 50
(Continued)

| | | | | |
|---|---|---|---|---|
| iPS:434373 | 21-225_66A7 | AA | DIQMTQSPSSVSASVGDRVTITCRASQGISSWLA WYQQKPGKALKLLIYAASSLQSGVPSRFSGSGS GTDFTLTISSLQPEDFATYYCQQTNSFPLTFGGGT KVEIK<br>SEQ ID NO: 25632 | QVQLVQSGAEVKKPGASVKVSCKASGYTFTGYYM HWVRQAPGQGLEWMGWINPNSGGTNNAQKFQGR VTMTRATSISTAYMELSRLRSDDTAVYYCARAPGT AAAGTWGYFDYWGQGTLVTVSS<br>SEQ ID NO: 29638 |
| | | NA | GACATCCAGATGACCCAGTCTCCATCTTCCGT GTCTGCATCTGTAGGGGACAGAGTCACCATCA CTTGTCGGGCGAGTCAGGGTATTAGCAGCTGG TTAGCCTGGTATCAGCAGAAACCAGGGAAAG CCCCTAAGCTCTTGATCTATGCTGCATCCAGTT TGCAAAGTGGGGTCCCTTCAAGTTCACTCTCA AGTTGGATCTGGGACAGATTTCACTCTCACCAT CAGCAGCCTGCAGCCTGAAGATTTTGCAACTT ACTATTGTCAACAGACAAATAGTTTCCCTCTCA CTTTCGGCGGAGGGACCAAGGTGGAGATCAA A<br>SEQ ID NO: 25633 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAAACAAACAGTG GTGGCACAAACCAAGCACAGAAGTTCCAGGGCA GGGTCACCATGACCAGGGACACGTCCATCAGCA CAGTTACATGGAGCTGAGCAGGCTGAGATCTG ACGACACGGCCGTGTATTACTGTGCGAGAGCTCC GGGCACAGTAGCAGCTGGTACATGGGGATACTTT GACTATTGGGGCCAGGGAACCCTGGTCACCGTCT CCTCA<br>SEQ ID NO: 29639 |
| | | AA | DIQMTQSPSSVSASVGDRVTITCRASQGISSWLA WYQQKPGKAPKLLIYAASSLQSGVPSRFSGSGS GTDFTLTISSLQPEDFATYYCQQINSFPLTFGGGT KVEIK<br>SEQ ID NO: 25634 | QVQLVQSGAEVKKPGASVKVSCKASGYTFTGYYM HWVRQAPGQGLEWMGWIKPNSGGTNQAKFQGR VTMTRDTSISTGYMELSRLRSDDTAVYYCARAPGT VAAGTWGYFDYWGQGTLVTVSS<br>SEQ ID NO: 29640 |

FIGURE 50
(Continued)

| | | | |
|---|---|---|---|
| iPS:434375 | 21-225_66C7 | NA | GACATCCAGTTGACCCAGTCTCCATCTCCCT GTCTGCATCTGTAGGAGACAGAGTCACCATCA CTCGCCGGCAGTCAGGCATTAGCAATTAT TTACATTGGTATCAGCAGAAACCAGGGAAAGC TCCTAAGCTCTTGATCTATTGTGCATCCAATTT ACAAATGTGGAGTCCCATCACGGTTCAGCGCA GTGGATCTGGGACAGATTTCACTCTCACAATC AGCAGCCTGCAGCCTGAAGATGTTGCAACTTA TTACTGTCAACAGCATATAATTCCCGCTCA CTTTCGGCGGAGGGACCAAGGTGGAGATCAA A |
| | | | CAGGTGCAGCTGGTGGAGTCTGGGGGAGGCGTG GTCCAGCCTGGGAGGTCCCTGAGACTCTCTGTG TAGCGTCTGGATTCACCTTCAGTGACTATGGCAT GCACTGGGTCCGCCAGGCTCCAGGCAAGGGGCT GGAGTGGGTGGCAGTTATATGGTTTGAGGGAAGT CATAAATACTATACAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACTTGGG TTCAGCAGTGACTACTGGGGCCAGGAACCCTG GTCACCGTCTCCTCA |
| | | | SEQ ID NO: 25635 |
| | | AA | DIQLTQSPSSLSASVGDRVTITRRASQGISNYLH WYQQKPGKAPKLLIYCASNLQCGVPSRFSGSGS GTDFTLTISSLQPEDVATYYCQQHNNSPLTFGGG TKVEIK |
| | | | QVQLVESGGGVVQPGRSLRLSCVASGFTFSDYGM HWVRQAPGKGLEWVAVIWFEGSHKYYTDSVKGR FTISRDNSKNTLYLQMNSLRAEDTAVYYCARELGF SSDYWGQGTLVTVSS |
| | | | SEQ ID NO: 29641 |
| | | | SEQ ID NO: 29642 |
| iPS:434379 | 21-225_66A9 | NA | GACATCCAGATGACCCAGTCTCCATCTCCCT GTCTGCATCTGTAGGAGACAGAGTCACCATCA CTTGCCGGGCAAGTCAGAACATTTTCAGCTAT TTAAATTGGTATCAGCAGAAACCAGGGAAAG CCCCTAAACTCCTGATCTTTGCTGCATCCAGTT TACAAAGTGGGGTCCCATCAAGGTTCAGTGGC AGTGGATCTGGGACAGATTTCACTCTCACCAT CAGCAGTCTGCAACCTGAGGACTTTGCAACTT ACTACTGTCAACAGACTTACAGTGTCCCTTTC ACTTTCGGCCCTGGGACTAAGGTGGATTCAA A |
| | | | CAGGTGCAGCTGGTGGAGTCTGGGGGAGGCGTG GTCCAGCCTGGGAGGTCCCTGAGACTCTCTGTG CAGCGTCTGGATTCACCTTCAGTAGTCTATGGCAT GCACTGGGTCCGCCAGGCTCCAGGCAAGGGGCT GGAGTGGGTGGCAGTTATATGGCATGATGGAAG TGATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGAGAAGAC CCGCGTACCAGTTGTCTGACTACTGGGGCCAGG GAACCCTGGTCACCGTCTCCTCA |
| | | | SEQ ID NO: 25636 |
| | | | SEQ ID NO: 25637 |
| | | | SEQ ID NO: 29643 |

FIGURE 50
(Continued)

| | | | | |
|---|---|---|---|---|
| | | AA | DIQMTQSPSSLSASVGDRVTITCRASQNIFSYLN WYQQKPGKAPKLLIFAASSLQSGVPSRFSGSGSG TDFTLTISSLQPEDFATYYCQQTYSVPFTFGPGTK VDFK<br>SEQ ID NO: 25638 | QVQLVESGGGVVQPGRSLRLSCAASGFTFSSYGMH WVRQAPGKGLEWVAVIWHDGSDKYYADSVKGRF TISRDNSKNTLYLQMNSLRAEDTAVYYCAREDPRT SCSDYWGQGTLVTVSS<br>SEQ ID NO: 29644 |
| iPS:434383 | 21-225_66F9 | NA | GACATCCAGATGACCCAGTCTCCATCCTCCCT GTCTGCATCTGTAGGAGACAGAGTCACCATCA CTTGCCGGGCAAGTCAGGACATTAGAAATGTT TAGGCTGGTATCAGCAGAAACCAGGGAAAG CCCCTAAGCGCCTGATCTATACTGCATCCAGT TTACAAAGTGGGGTCCCATCAGGGTTCAGCGG CAGTGGATCTGGGACAGAATTCACTCTCACAA TCAGCAGCCTGCAGCCTGAAGATTTTGCAACT TATTACTGTCTACAGTATAATAGTTACCCATTC ACTTTCGGCCCTGGGACCAAAGTGGATATCAA A<br>SEQ ID NO: 25639 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGACT GGAGTGGGTCTCATCCATTAGTGGTACTAGTAGT TACATATACTACGCAGACTCAGTGAAGGGCCGAT TCACCATCTCCAGAGACAACGCCAAGAACTCACT GTATCTGCAAATGAACGCCTGAGAGCCGAGGA CACGGCTGTGTATTCTGTGCGAGAACCAATGCT TTTGATATCTGGGGCCAGGGGACAATGGTCACCG TCTCTTCA<br>SEQ ID NO: 29645 |
| | | AA | DIQMTQSPSSLSASVGDRVTITCRASQDIRNVLG WYQQKPGKAPKRLIYTASSLQSGVPSGFSGSGS GTEFTLTISSLQPEDFATYYCLQNSYPFTFGPGT KVDIK<br>SEQ ID NO: 25640 | EVQLVESGGGLVKPGGSLRLSCAASGFTFSSYSMN WVRQAPGKGLEWVSSISGTSSYIYYADSVKGRFTIS RDNAKNSLYLQMNGLRAEDTAVYFCARTNAFDIW GQGTMVTVSS<br>SEQ ID NO: 29646 |

FIGURE 50
(Continued)

| | | | |
|---|---|---|---|
| iPS:434385 | 21-225_66C10 | NA | GACATCCAGATGACCCAGTCTCCATCTCCCT GTCTGCATCTGTAGGAGACAGAGTCACCATCA CTTGCCGGGCAAGTCAGGCCATTAGAAATGAT TTAGGCTGGTATCAGCAGAAACCAGGAAAG CCCCTAAGCGCCTGATCTATCCTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGTATAATAGTTACCCTCCGT GGACGTTCGGCCAAGGGTCCAAGGTGGAAAT CAAA |
| | | | SEQ ID NO: 25641 |
| | | AA | DIQMTQSPSSLSASVGDRVTITCRASQAIRNDLG WYQQKPGKAPKRLIYPASSLQSGVPSRFSGSGSG TEFTLTISSLQPEDFATYYCLQYNSYPPWTFGQG SKVEIK |
| | | | SEQ ID NO: 25642 |
| | | | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGTTAT GAGCTGGGTCCGCCAGGCTCCAGGGAAGGGCT GGAGTGGGTCTCAGTATTAGTGGTAGTGGTGCT AGAACATACTACGCAGACTCCGTGAAGGGCCGA TTCACCATCTCCAGAGACAATTCCAAGAACACGC TGTATCTGCAAATGAACAGCCTGAGAGCCGAGG ACACGGCCGTATATTACTGTGCGGAACTGGGGAT AGATACTACTACGGTATGGACGTCTGGGGCCAA GGGACCACGGTCACCGTCTCCTCA |
| | | | SEQ ID NO: 29647 |
| | | | EVQLLESGGGLVQPGGSLRLSCAASGFTFSSYVMS WVRQAPGKGLEWVSGISGSGARTYYADSVKGRFTI SRDNSKNTLYLQMNSLRAEDTAVYYCAELGIDYY YGMDVWGQGTTVTVSS |
| | | | SEQ ID NO: 29648 |
| iPS:434387 | 21-225_66D11 | NA | GATATCCAGATGACCCAGTTCCATCTCTCCA GTCTGCATCTGTAGGAGACAGAGTCACCATCA CTTGCCGGGCAAGTCAGGCAGTCATTAGAAATGAT TTAGGTTGGTATCAGCAGAAACCAGGAAAG CCCATAAGCGCTTGATCTATGCTGCATCAGT TGTCAAAGTGGGGTCCCATCAAGGTTCAGCGG CAGTGGATGTGGGACAGAATTCACTATCTCAA TCAGCAGCATGCAGCGTGAAGATTTTGCAACT TATTACTGTATAGTGCATAATAGTTACCCTCG GACGTTCGGCCAAGGGACCAAGGTGGAAATC AAA |
| | | | SEQ ID NO: 25643 |
| | | | CAGGTGCAGCTGGTGGAGTCTGGGGGAGGCGTG GTCCAGCCTGGGAGGTCCCTGAGACTCTCCTGTG GAGCGTCTGGATTCACCTTCAGTAGTTATGGCAT GCACTGGGTCCGCCAGGCTCCAGGCAAGGGCT GGAGTGGGTGGCAGTTATATGTATGATGGAAGT AATAAATACTATGCAGACTCCGTGAAGGGCCGA TTCACCATCTCCAGAGACAATTCCAAGAACACGC TGTCTCTGCAAATGAACAGCCTGAGAGCCGAGG ACACGGCTCTGTATTACTGTGCGAGAGATGTA TAGCAGCAACTGGTACGACTACGGTTTGGACGTC TGGGGCCAAGGGACCACGGTCACCGTCTCCTCA |
| | | | SEQ ID NO: 29649 |

FIGURE 50
(Continued)

| | | | | |
|---|---|---|---|---|
| iPS-434389 | 21-225_66F11 | AA | DIQMTQFPSSQSASVGDRVTITCRASQGIRNDLG WYQQKPGKAHKRLIYAASSCQSGVPSRFSGSGC GTEFTISISSMQREDFATYYCIVHNSYPRTFGQGT KVEIK<br>SEQ ID NO: 25644 | QVQLVESGGGVVQPGRSLRLSCGASGFTFSSYGMH WVRQAPGKGLEWVAVIWYDGSNKYYADSVKGRF TISRDNSKNTLSLQMNSLRAEDTALYYCAREMYSS NWYDYGLDVWGQGTTVTVSS<br>SEQ ID NO: 29650 |
| | | NA | GACATCCAGATGACCCAGTCTCCATCTTCCGT GTGTGCATCTGTAGGAGACAGAGTCACCATCA CTTGTGTCGGGAGAGTCAGGGTATTAGCATCTGG TTAGCCTGGTATCAGCAGAAACCAGGGAAAG CCCCTAAGCTTTTGATCTATGCTGCATCCAGTT TGCAAAGTGGGGTCCCATCAAGGTTCAGCGGC AGTGGATATGGGACAGATTTCACTCTCACCAT CAGCAGCGTGCAGCCTGAAGATTTTGCAACTT ACTATTGTCAACAGGCTAACAGTTTCCCATTC ACTTTCGGCCCTGGGACCAAAGTGGATATCAA A<br>SEQ ID NO: 25645 | CAGGTGCAGCTGGTGCAGTCTGGGGCTGAGGTG AAGAAGCCTGGGGCCTCAGTGAAGGTCTCCTGC AAGGCTTCTGATACACCTTCACCGGCTACCATA TGCACTGGGTCCGACAGGCCCCTGGACAAGGGC TTGAGTGGATGGGATGGATCAACCTAACAATGG TGGCACACACTATGCACAGAAGTTCAGGACTGG GTCACCATGACCAGGGACACAGCGTCCATCAGCACA GCCTATATGGAACTGAGCAGGCTGAGATCTGAC GACACGGCCGTGTATTACTGTGCGAGAGATAGTA GAAGTTCGTGGGACTACTGGGGCCAGGGAACCC TGGTCTCCGTCTCCTCA<br>SEQ ID NO: 29651 |
| | | AA | DIQMTQSPSSVCASVGDRVTITCRESQGISIWLA WYQQKPGKAPKLLIYAASSLQSGVPSRFSGSGY GTDFTLTISSVQPEDFATYYCQQANSFPFTFGPGT KVDIK<br>SEQ ID NO: 25646 | QVQLVQSGAEVKKPGASVKVSCKASGYTFTGYHM HWVRQAPGQGLEWMGWINPNNGGTHYAQKFQD WVTMTRDTSISTAYMELSRLRSDDTAVYYCARDS RSSWDYWGQGTLVSVSS<br>SEQ ID NO: 29652 |

FIGURE 50
(Continued)

| | | | |
|---|---|---|---|
| iPS:434393 | 21-225_67C3 | NA | GAAATAGTGATGACGCAGTCTCCAGCCACCCTGTCTGTGTCTCCAGGGGAAAGAGCCACCCTCCTGCAGGGCCAGTCAGAGTGTTAACAGCAACTTAGCCTGGTACCAGCAGAAAACCTGGCCAGGCTCCCAGGCTCCTCATCTCTATTGCATCCACCAGGGCCACTGGTATCCCAGCCAGGTTCAATGGCAGTGGGTCTGGGACAGAGTTCACTCTCACCATCAGCAGCCTGCAGTCTGAAGATTTTGCAGTTTATTACTGTCAGCAGTATAATGACTGGCCGTGTAGTTTTGGCCAGGGACCAAGCTGGAGATCAAA SEQ ID NO: 25647 | CAGGTGCAGCTGGTGGTGAGTGGGGGAGGCGTGGTCCAGCCTGGGAGGTCCCTGAGACTCTCTGTGCAGCGTCTGATTCACCTTCAGTAGTTATGGCATGCACTGGGTCGCCAGGCTCCAGGCAAGGGGCTGGAGTGGGTGGCAGTTATATGGTATGATGGAAGTAATAAATATTATGGAGACTCCGTGAAGGGCCGAGTCACCATCTCCAGAGACAATTCCAAGAACTCGCTGCATCTGCAAATGAACAGCCTGAGAGCCGAGGACACGGCTGTGTATTACTGTGCGAGAGATCAGGGACATAGTGGGAGCTACTGGTTTGACTACTGGGGCCAGGGAACCCTGGTCACCGTCTCCTCA SEQ ID NO: 29653 |
| | | AA | EIVMTQSPATLSVSPGERATLSCRASQSVNSNLAWYQQKPGQAPRLLISIASTRATGIPARFNGSGSGTEFTLTISSLQSEDFAVYYCQQYNDWPCSFGQGTKLEIK SEQ ID NO: 25648 | QVQLVESGGGVVQPGRSLRLSCAASGFTFSSYGMHWVRQAPGKGLEWVAAIWYDGSNKYYGDSVKGRVTISRDNSKNSLHLQMNSLRAEDTAVYYCARDQGIVGATWFDYWGQGTLVTVSS SEQ ID NO: 29654 |
| iPS:434397 | 21-225_67H4 | NA | GACATCCAGATGACCCAGTCTCCATCTTCCGTGTCTGCATCTGTAGGAGACAGAGTCACCATCACTTGTCGGGCGAGTCAGGGTATTAGCAGCAGCTGGTTAGCCTGGTATCAGCAGAAACCAGGGAAAGCCCCTAAGCTCCTGATCTATGCTGTCATCCAGTTTGCAAAGTGGGGTCCCATCAAGGTTCAGCGGCAGTGGATCTGGGACAGCCTGAAGATTTCACTCTCACCATCAGCAGCCTGCAGCCTGAAGATTTTGCAACTTACTATTGTCAACAGATTAACAGTTTCCCTCTCACTTTCGGCGGAGGGACCAAGGTGGAGATCAAA SEQ ID NO: 25649 | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAAGGGCTTGAGTGGATGGATGGATCAACCAGAAGTTTCAGGGAGTGGCACAAACCAAGCACAGAAGTTTCAGGGACAGGTCACCATGACCAGGGACACGTCCATCAGCACAGCCTACATGGAGCTGAGCGGGCTGAGATCTGACGACACGGCCGTGTATTACTGTGCGAGAGCTCCGGGTACTGCAGCAACTGGTACATGGGGATACTTTGACTACTGGGGCCAGGGAACCCTGGTCACCGTCTCCTCA SEQ ID NO: 29655 |

FIGURE 50
(Continued)

| | | | |
|---|---|---|---|
| iPS:434399 | 21-225_67B7 | AA | DIQMTQSPSSVSASVGDRVTITCRASQGISSWLAWYQQKPGKAPKLLIYAASSLQSGVPSRFSGSGSGTDFTLTISSLQPEDFATYYCQQINSFPLTFGGGTKVEIK<br>SEQ ID NO: 25650 | QVQLVQSGAEVKKPGASVKVSCKASGYTFTGYYMHWVRQAPGQGLEWMGWIKPNSGGTNQAQKFQGRVTMTRDTSISTAYMELSGLRSDDTAVYYCARAPGTAATGTWGYFDYWGQGTLVTVSS<br>SEQ ID NO: 29656 |
| | | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTTTCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGATTTCTCTCACAACTTAGCAGCCTGCAGCCTGAAGATTTTGCAACTTATTACTGTCAACCATAATAGTTATCCATTCAAATTTTGGCCCTGGGACCAAAGTGGATATCAAA<br>SEQ ID NO: 25651 | CAGGTGCAGCTGGTGGAGTCTGGGGGAGGCGTGGTCCAGCCTGGGAGGTCCCTGAGACTCTCCTGTGCAGCCTCTGGATTCACCTTCAGTAACTATGGCATGCACTGGGTCCGCCAGGCTCCAGGCAAGGGGCTGGAATGGGTGGCAGTTATATTATGATGGAAGTAAGAAATACTATGCAGACTCCGTGAAGGGCCGATTCACCATCTCCAGAGACAATTCAAGAACACGCTTATCTGCAAATGAACAGCCTGAGAGCTGAGGACACGGCTGTGTATTACTGTGCGAGGAGTATCCGGAATTTGACTATTGGGGCCAGGGAACCCTGGTCACCGTCTCCTCA<br>SEQ ID NO: 29657 |
| | | AA | DIQMTQSPSSLSASVGDRVTITCRASQGIRNDLGWFQQKPGKAPKRLIYAASSLQSGVPSRFSGSGSGTEFSLTISSLQPEDFATYYCLHHNSYPFKFGPGTKVDIK<br>SEQ ID NO: 25652 | QVQLVESGGGVVQPGRSLRLSCAASGFTSNYGMHWVRQAPGKGLEWVAVILYDGSKKYYADSVKGRFTISRDNSKNTLYLQMNSLRAEDTAVYYCARSIPEFDYWGQGTLVTVSS<br>SEQ ID NO: 29658 |

FIGURE 50
(Continued)

| | | | |
|---|---|---|---|
| iPS:434405 | 21-225_68E6 | NA | GACATCCAGATGACCCAGTCTCCATCCTCACT GTCTGCATCTGTAGGAGACAGAGTCACCATCA CTTGTCGGGCGAGTCAGGGCATTAGTAGTTAT TTAGCCTGGTTTCAGCAGAAACCAGGGAGAGC CCCTAAGTCCCTGATCTATGTTGCATCCAGTTT GCAAAGTGGGGTCCCATCAAGGTTCAGCGGCA GTGGATCTGGGACAGATTTCACTCTCACCATC AGCAGCCTGCAACAGTATGATAGTTACCATTT TTACTGCCAACAGTATGATAGTTACCATTCA CTTTCGGCCCTGGGACCAAAGTGGATATCAGA<br>SEQ ID NO: 25653 | GAGGTGCAGCTGGTGGTGAGTCTGGGGGAGGCCTG GTCAAGCCGGGGGGGTCCCTGAGACTCTCCTGTG CAGCCTCTGGATTCACCTTAAGTAGCTTTGGCAT GAACTGGGTCCGCCAGGCTCCAGGAAGGGCT GGAGTGGGTCTCATACATTAGTAGAAGTAGTAGT CACATATACTACGCAGACTCAGTGAAGGCCGA TTCACCATCTCCAGAGACAACGCCAAGAACTCAC TGTATCTGCAAATGAACAGCCTGAGAGCCGAGG ACACGGCTGTGTATTACTGTGCGGTCTCTAGTGG GAGCCCCTTTGACTACTGGGGCCAGGGAACCCTG GTCACCGTCTCCTCA<br>SEQ ID NO: 29659 |
| | | AA | DIQMTQSPSSLSASVGDRVTITCRASQGISYYLA WFQQKPGRAPKSLIYVASSLQSGVPSRFSGSGSG TDFTLTISSLQPEDFAIYYCQQYDSYPFTFGPGTK VDIR<br>SEQ ID NO: 25654 | EVQLVESGGGLVKPGGSLRLSCAASGFTLSSFGMN WVRQAPGKGLEWVSYISRSSSHYYADSVKGRFTIS RDNAKNSLYLQMNSLRAEDTAVYYCAVSSGSPFD YWGQGTLVTVSS<br>SEQ ID NO: 29660 |
| iPS:434407 | 21-225_68G8 | NA | GACATCCAGATGACCCAGTCTCCATCCTCCCT GTCTGCATCTGTAGGAGACAGAGTCACCATCA CTTGCCGGGCAAGTCAGGGCATTAGAAATAAT TTAGGCTGGTATCAGCAGAAGACCAGGGAAAG CCCCTAAGCGCCTGATCTATGCTGCATCAGT GTGCAAAGTGGGGTCCCATCACGGTTCAGCGG CAGTGGATCTGGGACAGAATTCACTCTCACAA TCAGCAGCCTGCAGCCTGAAGATTTTGCAACT TATTACTGTCTACAGTATATAAGTTACCCATTC ACTTTCGGCCCTGGGACCAAAGTGGATATCAA A<br>SEQ ID NO: 25655 | GAGGTGCAGTTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGCT GGAGTGGGTCTCATCCATTAGTAGTGGTAGTAGT TACATATATTACGCAGACTCAGTGATGGGCCGAT TCACCATCTCCAGAGACAACAGCCAAGAACTCTCT GTATCTGCAAATGAACAGCCTGAGAGCCGAGGA CACGGCTGTGTATTACTGTGCGAGAGTCAACAGC TTTGACTCCTGGGGCCAGGGAACCCTGGTCACCG TCTCCTCA<br>SEQ ID NO: 29661 |

FIGURE 50
(Continued)

| | | | | |
|---|---|---|---|---|
| | | | DIQMTQSPSSLSASVGDRVTITCRASQGIRNNLG WYQQRPGKAPKRLIYAASSVQSGVPSRFSGSGS GTEFTLTISSLQPEDFATYYCLQYNSYPFTFGPGT KVDIK | EVQLVESGGGLVKPGGSLRLSCAASGFTFSSYSMN WVRQAPGKGLEWVSSISGSSSYIYADSVMGRFTIS RDNAKNSLYLQMNSLRAEDTAVYYCARVNSFDSW GQGTLVTSS |
| | | AA | SEQ ID NO: 25656 | SEQ ID NO: 29662 |
| | | NA | GACATCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGCAGCCGAATTCACTCTCAA TCAGCAGCCTGCAGCCTGAAGATTTTGCAACT TATTACTGTCTACAGCATAATAGTTATCCGTTC ACTTTCGGCGGAGGGACCAAGGTGGAGATCA AA | CAGGTGCAGCTGGTGGAGTCTGGGGGAGGCGTG GTCCAGCCTGGAGGTCCCTGAGACTCTCCTGTG CAGCGTCTGGATTCACCTTCAGTGACTACTCTGT GCACTGGGTCCGCCAGGCTCCAGGCAAGGGCT GGAGTGGTGTCTGTTATATGGTATGATGTAAGT AATAAATACTATGCAGACTCCGTGAAGGGCCGA TTCACCATCTCCAGAGACAATTCCAAGAACACGC TGTATCTTCAAATGAACAGCCTGAGAGCCGAGG ACACGGCTGTGTATTACTGTGTGAGAGAACTGGG GATGACCTCTGACTGCTGGGGCCAGGGAACCCTG GTCACCGTCTCCTCA |
| | | | SEQ ID NO: 25657 | SEQ ID NO: 29663 |
| iPS:434411 | 21-225_68F11 | AA | DIQMTQSPSPSSLSASVGDRVTITCRASQGIRNDLG WYQQKPGKAPKRLIYAASSLQSGVPSRFSGSGS GPEFTLSISSLQPEDFATYYCLQHNSYPFTFGGGT KVEIK | QVQLVESGGGVVQPGRSLRLSCAASGFTFSDYGM HWVRQAPGKGLEWVAVIWYDVSNKYYADSVKGR FTISRDNSKNTLYLQMNSLRAEDTAVYYCVRELGM TSDCWGQGTLVTSS |
| | | | SEQ ID NO: 25658 | SEQ ID NO: 29664 |

FIGURE 50
(Continued)

| | | | |
|---|---|---|---|
| iPS:434413 | 21-225_68D12 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATCTGCATCCAGT TTGCAAAGTGGGGTCCCATCAAGATTCAGCGG CAGTGGATCTGGGACAGAATTCACTCTCACAA TCAGCAGCCTGCAGCCTGAAGATTTTGCAACT TATTACTGTCTACAGCATAGTACTTACCCGCTC ACTTTCGGCGGAGGGACCAAGGTGGAGATCA AA SEQ ID NO: 25659 | CAGCTGCAGCTGCAGGAGTCGGGCCCAGGACTG GTGAAGCCTTCTGGTGCTCCTCACCTGCA CTGTCTCTGGCTGTGCTCCATCAGCAGAAGTAGTTA CTACTGGGGCTGGATCGCCAGCCCCAGGGAA GGGGCTGGAGTGGATTGGAATATCTATTATAGT GGGAGCACCTATTACATCCGTCCCTCAAGAGTC GAGTCACCATATCCGTAGACACGTCCAAGAACC AGTTCTCCCTGAAGCTGACCTCTGTGACCGCCGC AGACACGGCTGTGTATTACTGTGCGAGACATAGC ACCAGCTGGTCCATTGACTACTGGGGCCAGGGA ACCCTGGTCACCGTCCCTCA SEQ ID NO: 29665 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHSTYPLTFGGGT KVEIK SEQ ID NO: 25660 | QLQLQESGPGLVKPSETLSLTCTVSGGSISRSSYYW GWIRQPPGKGLEWIGNIYYSGSTYYIPSLKSRVTISV DTSKNQFSLKLTSVTAADTAVYYCARHSTSWSIDY WGQGTLVTVSS SEQ ID NO: 29666 |
| iPS:434417 | 21-225_69C8 | NA | GACATCCAGATGACCCAGTCTCCATCCTCCCT GTCTGCATCTGTAGGAGACAGAGTCACCATCA CTTGCCGGGCAGTCAGAGTCAGACCATTTACAAATTAT TTAAATTGGTATCAGCAGAAACCAGGGAAAG CCCCTAAGCTCCTGATCTATGCTGCGTCCAGTT TGCAAAGTGGGGTCCCATCAAGGTTCAGTGGC AGTGGATCTGGGACAGATTTCACTCTCGTCAT TAGTAGTCTGCAACCTGAAGATTTTGCAACTT ACTACTGTCAACAGAGTTACAGTACCCCATTC ACTTTCGGCCCTGGGACCAAAGTGGATATCAA A SEQ ID NO: 25661 | CAGGTGCAGCTGGTGGAGTCTGGGGGAGGCGTG GTCCAGCCTGGGAGGTCCCTGAGACTCTCCTGTG CAGGGTCTGGATTCACCTTCAGTAACTATGCCAT GCACTGGGTCCGCCAGGCTCCAGGCAAGGGGCT GGAGTGGGTGGCAGTTATATGGTATGATGGAAGT GATAAATACTATGCAGACTCCGTGAAGGGCCGA TTCACCATCTCCAGAGACAATTCCAAGAACACGC TGTATCTGCAAATGATCAGCCTGAGAGCCGAGG ACACGGCTGTTTATTACTGTGCGAGAGATATCCC TAGCAACTCGGCGGGGACTACTGGGGCCAGGG AACCCTGGTCACCGTCCCTCA SEQ ID NO: 29667 |

FIGURE 50
(Continued)

| | | | | |
|---|---|---|---|---|
| iPS:434423 | 21-225_70D1 | AA | DIQMTQSPSSLSASVGDRVTFTCRAGQTIYNYLNWYQQKPGKAPKLLIHVASSLQSGVPSRFSGSGSGTDFTLVISSLQPEDFATYYCQQSYSTPFTFGPGTKVDIK<br>SEQ ID NO: 25662 | QVQLVESGGGVVQPGRSLRLSCAASGFTFSNYAMHWVRQAPGKGLEWVAVIWYDGSDKYYADSVKGRFTISRDNSKNTLYLQMISLRAEDTAVYYCARDIPSNSAGDYWGQGTLVTVSS<br>SEQ ID NO: 29668 |
| | | NA | GACATCCAGATGACCCAGTCTCCATCTTCCGTGTCTGCATCTGTAGGAGACAGAGTCACCATCACTTGTCGGGCGAGTCAGGTGTTAGCAGGTGGTTAGCCTGGTATCAGCAGAAACCAGGGAAAGCCCCTAAGCTCCTGATCTATGCTGCATCCAGTTTGCAAAGTGGGGTCCCATCAAGGTTCAGCGGCAGTGGATCTGGGACAGATTTCACTGTCACCATCAGCAGCCTGCAGCCTGAAGATTTTGCAACTTACTATTGTCAACAGGCTAACAGTTTCCCATTCACTTTCGGCCCTGGGACCAAAGTGGATATCAAA<br>SEQ ID NO: 25663 | CAGGTGCAGCTGGTGCAGTCTGGGGCTGAGGTGAAGAAGCCTGGGGCCTCAGTGAAGGTCTCCTGTAAGGCTTCTGGATACACCTTCACCGGCTACCATATGCACTGGGTGCGACAGGCCCCTGGACAAGGGCTTGAGTGGATGGGATCAACCTAACAGTAATGCCACAAACTATGCACAGAAGTTTCAGGGCAGGGTCACCATGACCAGGGACACGTCCATCAGCACAGCCTACATGGAACTGAGCAGGCTGAGATCTGACGACACGGCCGTGTATTACTGTGCGAGAGATAGCATATCGTCGTGGGACTACTGGGGCCAGGGAACCCTGGTCACCGTCTCCTCA<br>SEQ ID NO: 29669 |
| | | AA | DIQMTQSPSSVSASVGDRVTITCRASQGVSRWLAWYQQKPGKAPKLLIYAASSLQSGVPSRFSGSGSGTDFTVTISSLQPEDFATYYCQQANSFPFTFGPGTKVDIK<br>SEQ ID NO: 25664 | QVQLVQSGAEVKKPGASVKVSCKASGYTFTGYHMHWVRQAPGQGLEWMGWINPNSNATNYAQKFQGRVTMTRDTSISTAYMELSRLRSDDTAVYYCARDSISSWDYWGQGTLVTVSS<br>SEQ ID NO: 29670 |

FIGURE 50
(Continued)

| | | | |
|---|---|---|---|
| iPS:434425 | 21-225_70A5 | NA | GAAATAGTGATGACGCAGTCTCCAGCCACCCT GTCTGTGTCTCCAGGGGAAAGAGCCACCCTCT CCTGCAGGGCCAGTCAGAGTGTTAACAGCAAC TTAGCCTGGTACCAGCTGAAACCTGGCCAGGC TCCCAGGCTCCTCATCTCTATTGCATCCACCAG GGCCACTGGTATCCCACCCGGTTCAATGGCA GTGGGTCTGGGACAGAGTTCACTCTCACCATC AGCAGCCTGCAGTCTGAAGATTTTGCAGTTTA TTACTGTCAGCAGTATAATGACTGGCCGTGTA GTTTGGCCAGGGACCAAGCTGGAGATCAAA<br>SEQ ID NO: 25665<br>EIVMTQSPATLSVSPGERATLSCRASQSVNSNLA WYQLKPGQAPRLLISIASTRATGIPPRFNGSGSGT EFTLTISSLQSEDFAVYYCQQYNDWPCSFGQGT KLEIK<br>SEQ ID NO: 25666 | CAGGTTCAGCTGGTGCAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACTGC TGTATCTGCAAATGAACAGCCTGAGCGCCGAGG ACACGGCTGTTTATTACTGTGCGAGAGATCAGGG CATAGTGGGAGCTACTTGGTTTGACTACTGGGGC CAGGGAACCCTGGTCACCGTCTCCTCA<br>SEQ ID NO: 29671<br>QVQLVESGGGVVQPGRSLRLSCAASGFTFSSYGMH WVRQAPGKGLEWVAVIWYDGSNKYYADSVKGRF TISRDNSKNSLYLQMNSLSAEDTAVYYCARDQGIV GATWFDYWGQGTLVTVSS<br>SEQ ID NO: 29672 |
| iPS:434427 | 21-225_70D6 | NA | GACATCCAGATGACCCAGTCTCCATCTTCCGT GTCTGCATCTGTAGGAGACAGAGTCACCATCA CTTGTCGGGCGAGTCAGGGTATTAGCAAATGG TTAGCCTGGTATCAGCAGAAATCAGGGAAAGC CCCTTAAGCTCTTGATCTTTGCTGCATCCAGTTT GCAAAGTGGGGTCCCATCAAGGTTCAGCGGCA GTGGATCTGGGACAGATTTCACTCTCACCATC AGCAGCCTCCAGCTGAAGATTTTGCAAATTA CTATTGTCAACAGACTAACAGTTTCCCTCTCAC TTTCGGCGGAGGGACCAAGGTGGAGATCAAA<br>SEQ ID NO: 25667 | CAGGTGCAGCTGGTGCAGTCTGGGCTGAGGTG AAGAAGCCTGGGGCCTCAGTGAAGGTCTCCTGC AAGGCCTCTGGATACATCTTCACCGGCTACTATA TGCACTGGGTGCGACAGGCCCCTGGACAAGGGC TTGAGTGGATGGGATGGATCAACCCTAAGAGTG GTGGCACAAACTCTGCACAGAAGTTTCAGGGCA GGGTCTCCATGACCAGGGACACGTCCATCGGCAC AGCCTACATGGAGCTGCGCGGGCTAAGATCTGA CGACACGGCCGAGTATTACTGTGCGAGAGCTCCG GGTAAAGCAGCAGCTGGTACATGGGGATTCTTTG ACTACTGGGGCCAGGGAACCCTGGTCACCGTCTC CTCA<br>SEQ ID NO: 29673 |

FIGURE 50
(Continued)

| | | | |
|---|---|---|---|
| iPS:434429 | 21-225_70H6 | AA | DIQMTQSPSSVSASVGDRVTITCRASQGISKWLA WYQQNPGKALKLLIFAASSLQSGVPSRFSGSGSG TDFTLTISSLQPEDFANYYCQQTNSFPLTFGGGT KVEIK<br>SEQ ID NO: 25668 | QVQLVQSGAEVKKPGASVKVSCKASGYIFTGYYM HWVRQAPGQGLEWMGWINPKSGGTNSAQKFQGR VSMTRDTSIGTAYMELRGLRSDDTAEYYCARAPGK AAAGTWGFFDYWGQGTLVTVSS<br>SEQ ID NO: 29674 |
| | | NA | GACATCCAGATGACCCAGTCTCCATCTCCCT GTCTGCATCTGTAGGAGACAGAGTCACCATCA CTTGCCGGACAAGTCAGAGCATTTTCAACTAT TTAAATTGGTTTCAGCAGAAACCAGGAAAGC CCCTAAGCTCCTGATCTATACTGCATCCAGTT GCAAAGTGGGATCCCATCAAGGTTCAGTGGCA GTGGATCTGGGACAGACTTCACTCTCACCATC AGCAGTCTGCAAACCTGAAGATTCTGCAACTTA CTACTGTCAACAGAGTTACAGTATCCCGCTCA CTTTCGGCGGAGGGACCAAGGTGGAGATCAA A<br>SEQ ID NO: 25669 | CAGGTGCAGCTGGTGGAGTCTGGGGGAGGCGTG GTCCAGCCTGGGAGGTCCCTGAGACTCTCCTGTG CAGGGTCTGGATTCACCTTCAGTAGTTATGGCAT GCACTGGGTCCGCCAGACTCCAGGCAAGGGGCT GGAGTGGGTGGCAGTTATATGGCATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATGATCC CAGATCCTCCGGCCGGGACTACTGGGGCCAGGG AACCCTGGTCACCGTCTCCTCA<br>SEQ ID NO: 29675 |
| | | AA | DIQMTQSPSSLSASLGDRVTITCRTSQSIFNYLNW FQRKPGKAPKVLIYTASSLQSGIPSRFSGSGSGTD FTLTISSLQPEDSATYYCQQSYSIPLTFGGGTKVE IK<br>SEQ ID NO: 25670 | QVQLVESGGGVVQPGRSLRLSCAASGFTFSSYGMH WVRQTPGKGLDWVAVIWHDGSNKYYADSVKGRF TISRDNSKNTLYLQMNSLRAEDTAVYYCARDDPRS SAGDYWGQGTLVTVSS<br>SEQ ID NO: 29676 |

FIGURE 50
(Continued)

| | | | |
|---|---|---|---|
| iPS:434431 | 21-225_70E7 | NA | GACATCGTGATGACCCAGTCTCCAGACTCCCT GGCTGTGTCTCTGGGCGAGAGGGCCACCCTCA ACTGCAAGTCCAGCCAGAGTGTTTATACAGC TCCAACAATAACAACTACTTGGCTTGGTACCA GCAGAAACCAGGACAGCCTCCTAAACTGCTCA TTTACTGGGCATCTACCCGGAATCGGGGGTC CCTGACCGATTCAGTGGCAGCGGGTCTGGGAC AGATTTCACTCTCACTATCAGCAGCCTGCAGG CTGAAGATGTGGCAGTTTATTACTGTCAGCAA TATTATAATATTCCTCCGACGTTCGGCCAAGG GACCAAGGTGGAAATCAAA<br>SEQ ID NO: 25671 | CAGGTGCAGCTGGTGCAGTCTGGGGCTGAGGTG AAGAAGCCTGGGGCCTCAGTGAAGGTCTCTGC AAGGCTTCTGGATACACCTTCACCAATTATGATA TCAACTGGGTGCGACAGGCCACTGGACAAGGGC TTGAGTGGATGGGGTGGATGCACAGAAGTTCAGGGCAG TAACACAGGCTATGCACAGGAACACCTCCATAAGCAC AGTCACCATGACCAGGAACACCTCCATAAGCAC AGCCTACATGGAGCTGAGCAGCCTGAGATCTGA GGACACGGCCGTGTACTATTACTGTGCGTATAGCAGT GGCTGGTACGTCTTTGACTACTGGGGCCAGGGAA CCCTGGTCACCGTCTCCTCA<br>SEQ ID NO: 29677 |
| | | AA | DIVMTQSPDSLAVSLGERATLNCKSSQSVLYSSN NNNYLAWYQQKPGQPPKLLIYWASTRESGVPD RFSGSGSGTDFTLTISSLQAEDVAVYYCQQYYNI PPTFGQGTKVEIK<br>SEQ ID NO: 25672 | QVQLVQSGAEVKKPGASVKVSCKASGYTFTNYDIN WVRQATGQGLEWMGWMHPNSGNTGYAQKFQGR VTMTRNTSTSTAYMELSSLRSEDTAVYYCAYSSGW YVFDYWGQGTLVTVSS<br>SEQ ID NO: 29678 |
| iPS:434433 | 21-225_70E8 | NA | GACATCCAGATGACCCAGTCTCCATCCTCCCT GTCTACATCTGTCGGAGACAGAGTCACCATCA CTTGCCGGGCAAGTCAGGGCATTAGAAATGGAT TTAGGCTGTGTATCAGCCTGATCTATGCTGCAGT CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATCGTTACCCGCTC ACTTTCGGCGGAGGGACCAAGGTGGAGATCA AA<br>SEQ ID NO: 25673 | CAGGTGCAGCTGGTGGAGTCTGGGGGAGGCGTG GTCCAGCCTGGGAGGTCCCTGAGACTCTCGTG CAGCGTCTGGATTCACCTTCAGTAGCTATGGCAT GCTCTGGGTCCGCCAGGCTCCAGGCAAGGGTCTG GAGTGGGTGGCAATTATATGCAGACTCCGTGAAGGGCCGATT ATAAATACTATGCAGACTCCGTGAAGGGCCGATT CACCATCTCCAGAGACAATTCCAAGAACACGCTG TATCTGCAAATGAACAGCCTGAGAGCCGAGGAC ACGGCTGTGTATTACTGTGCGAGAGACCTACTGG ACCCACGGACTACTGGGGCCAGGGAACCCTGG TCACCGTCTCCTCA<br>SEQ ID NO: 29679 |

FIGURE 50
(Continued)

| | | | |
|---|---|---|---|
| iPS:434435 | 21-225_70G9 | AA | DIQMTQSPSSLSTSVGDRVTITCRASQGIRKDLG WYQQKPGKAPKRLIYAASSLQSGVPSRFSGSGS GTEFTLTISSLQPEDFATYYCLQHNRYPLTFGGG TKVEIK<br>SEQ ID NO: 25674 | QVQLVESGGGVVQPGRSLRLSCAASGFTFSSYGML WVRQAPGKGLEWVAIIWYDESNKYYADSVKGRFT ISRDNSKNTLYLQMNSLRAEDTAVYYCARDLLDPR DYWGQGTLVTVSS<br>SEQ ID NO: 29680 |
| | | NA | GACATCAAATGACCCAGTCTCCATCTTCCGT GTCTGCATCTGTAGGAGACAGAGTCACCATCA CTTGTCGGGCGAGTCAGGATATTAGCAGCTGG TTAGCCTGGTATCAGCAGAAATCCAGGGAAAGC CCCTAAACTCTTGATCTATGCTGCATCCAGTT GCAAAGTGGGTCCCATCAAGGTTCAGCGGCA GTGGATCTGGGACAGATTTCACTCTCACCATC AGCAGCCTCCAGCTGAACAGACTAACAGTTTCCCTCTCAC TTTCGGCGGAGGGACCAAGGTGGAGATCAAA<br>SEQ ID NO: 25675 | CAGGTGCAGCTGGTGCAGTCTGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGAC TGGAGTGGATGGGATGGATCAAACCTAACAGTG GTGGCACAAACCAAGCACAGAAGTTTCAGGGCA GGGTCACCATGACCAGGGACACAGTCCATCAGCA CAGCCTACATGAGCTGAGCAGTCTGAGATCTGA CGACAGGCCGTGATTACTGTGCGAGAGCTCCG GGTATAGCAGCAGTGGTACATGGGGATACTTTG ACTACTGGGGCCAGGGAACCCTGGTCACCGTCTC CTCA<br>SEQ ID NO: 29681 |
| | | AA | DIQMTQSPSPSVSASVGDRVTITCRASQDISSWLA WYQQNPGKAPKLLIYAASSLQSGVPSRFSGSGS GTDFTLTISSLQPEDFATYYCQQTNSFPLTFGGGT KVEIK<br>SEQ ID NO: 25676 | QVQLVQSGAEVKKPGASVKVSCKASGYTFTGYYM HWVRQAPGQGLEWMGWIKPNSGGTNQAQKFQGR VTMTRDTSISTAYMELSSLRSDDTAVYYCARAPGI AAAGTWGYFDYWGQGTLVTVSS<br>SEQ ID NO: 29682 |

FIGURE 50
(Continued)

| | | | |
|---|---|---|---|
| iPS:434437 | 21-225_70A12 | NA | GACATCCAGATGACCCAGTCTCCATCTTCCGT GTCTGCATCTGTAGGAGACAGAGTCACCATCA CTTGTCGGGCGAGTCAGGGTATTAGCAGCTGG TTAGCCTGGTATCAGCAGAAACCAGGGAAAG CCCCTTAAGCTCCTTGATATATGCTGCATCCAGTT TGCAAAGTGGGGTCCCATCAAGGTTCAGCGGC AGTGGATCTGGGACAGATTTCACTCTCACCAT CAGCAGCGTGCAGCCTGAAGATTTTGCAACTT ACTATTGTCAACAGATTAACAGTTTCCCTCTCA CTTTCGGCGGAGGGACCAAGGTGGAGATCAA A<br><br>SEQ ID NO: 25677 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACAGACAAACAGTG GTGGCACAAACCAAGCACAGGGACACGTCATCAGCA GGGTCACCATGACCAGGGACACGTCAGGGCA CAGCCTACATGGAGCTGAGCGGCTGAGATCTG ACGACACGGCCGTGTATTACTGTGCGAGAGCTCC GGGTACTGCAGCAACTGGTACATGGGATACTTT GACTACTGGGGCCAGGGAACCCTGGTCACCGTCT CCTCA<br><br>SEQ ID NO: 29683 |
| | | AA | DIQMTQSPSSVSASVGDRVTITCRASQGISSWLA WYQQKPGKALKLLIYAASSLQSGVPSRFSGSGS GTDFTLTISSVQPEDFATYYCQQINSFPLTFGGGT KVEIK<br><br>SEQ ID NO: 25678 | QVQLVQSGAEVKKPGASVKVSCKASGYTFTGYYM HWVRQAPGQGLEWMGWIKPNSGGTNQAQKFQGR VTMTRDTSISTAYMELSGLRSDDTAVYYCARAPGT AATGTWGYFDYWGQGTLVTVSS<br><br>SEQ ID NO: 29684 |
| iPS:434439 | 21-225_70E12 | NA | GACATCCAGATGACCCAGTCTCCATCCTCCCT ATCTGCATCTGTAGGAGACAGAGTCACCATCA CTTGCCGGGCAAGTCAGGGCATTAACAATAAT TTAAACTGGTTTCAGCAGAAACCAGGGAAAGC CCCTAAGCGCCTGATCTATGCTGCATCCAGTTT GCAAAGTGGGGTCCCATCAAGGTTCAGCGGCA GTGGATCTGGGACAGAATTCACTCTCACAATC AGCAGCCTGCAGCCTGAAGATTTTGCAACTTA TTACTGTCTACAGCATAATAGTTACCCGCTCA CTTTCGGCGGAGGGTCCAAGGTGGAGATCAAA<br><br>SEQ ID NO: 25679 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTAGCAT GAACTGGGTCCGCCAGGCTCCAGGGAAGGGGCT GGAGTGGGTCTCTTCCATTAGTGGTAATAGTACT TACATATACTACACAGACTCAGTGAAGGGCCGAT TCACCATCTCCAGAGACAACGCCAAGAACTCACT GTATCTGCAAATGACAGCCTGACAGCCGAGGA CACGGCTGTGTATTACTGTGCGAGAGTGGCCGCC TTTGACTGCTGGGGCCAGGAACCCTGGTCACCG TCTCCTCA<br><br>SEQ ID NO: 29685 |

FIGURE 50
(Continued)

| | | | | | |
|---|---|---|---|---|---|
| iPS:434441 | 21-225_71A2 | AA | DIQMTQSPSSLSASVGDRVTITCRASQGINNNLN WFQQKPGKAPKRLIYAASSLQSGVPSRFSGSGSG TEFTLTISSLQPEDFATYYCLQHNSYPLTFGGGSK VEIK<br>SEQ ID NO: 25680 | EVQLVESGGGLVKPGGSLRLSCAASGFTFSSYSMN WVRQAPGKGLEWVSSISGNSTYIYYTDSVKGRFTIS RDNAKNSLYLQMDSLTAEDTAVYYCARVAAFDC WGQGTLVTVSS<br>SEQ ID NO: 29686 | |
| | | NA | GACATCCAGATGACCCAGTCTCCATCCTCCG GTCTGCATCTGTAGGAGACAGAGTCACCATCA CTTGCCGTGCAAGTCAGGGCATTAGAAATGAT TTAGGATGGTATCAGCAGAAACCAGGAAAAG CCCCTAAGCGCCTGATCTATATTGCATTCAGA TTGCAAATTGGGGTCCCATCAAGGTTCAGCGG CAGTGGATCTGGGACAGAATTCACTCTCACAA TCAGCAGCCTGCAGCCTGAAGATTTTGCAACT TATTACTGTATACACCATAATAGTTACCCGTG GACGTTCGGCCAAGGGACCAAGGTGGAAATC AAA<br>SEQ ID NO: 25681 | CAGGTGCAGCTGGTGGAGTCTGGGGGAGGCGTG GTCCAGCCTGGGAGGTCCCTGAGACTCTCCTGTG CAACGTCTGGATTCACCTTCAGTGACTATGGCAT GCACTGGGTCCGCCAGGCTCCAGGCAAGGGGCT GGAGTGGGTGGCAGTGATATGGTATGATGAAAG TAATAAATACTATGCAGACTCCGTGAAGGGCCG ATTCACCATCTCCAGAGACAACACGAAGAACACG CTGTATCTGCAAATGAACAGCCTGAGAGCCGAG GACACGGCTGTGTATTACTGTGCGAGAGAATTGG GGTGGCAGGATGATTACTGGGGCCAGGGAACCC TGGTCACCGTCTCCTCA<br>SEQ ID NO: 29687 | |
| | | AA | DIQMTQSPSSRSASVGDRVTITCRASQGIRNDLG WYQQKPGKAPKRLIYIAFRLQIGVPSRFSGSGSG TEFTLTISSLQPEDFATYYCIHHNSYPWTFGQGT KVEIK<br>SEQ ID NO: 25682 | QVQLVESGGGVVQPGRSLRLSCATSGFTFSDYGMH WVRQAPGKGLEWVAVIWYDESNKYYADSVKGRF TISRDNSKNTLYLQMNSLRAEDTAVYYCARELGW QDDYWGQGTLVTVSS<br>SEQ ID NO: 29688 | |

FIGURE 50
(Continued)

| | | | |
|---|---|---|---|
| iPS:434443 | 21-225_71G3 | NA | GACATCGTGATGACCCAGTCTCCAGACTCCT GGCTGTGTCTCTGGGCGAGAGGGTCGCCATCA ATTGCAAGTCCAGCAGTGTTTACACAGC TCCAACAATAACAACTACTTAGATTGTATCA GCAGAAACCAGGACAGAGTTCCTAAACTGCTCA TTTTCTGGGCATCTACCGGGAATTCGGGGT CCTGACCGATTCAGTGGCAGCGGGGTTTGGGAC AGATTTCACTCTCACCATCAGCAGCCTGCAG CTGAAGATGTGGCAGATTACTACTGTCAACAA TATTATATTACTCCCGTGCAGTTTTGGCCAGG GACCAAGCTGGAGATCAAA | CAGGTGCAACTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TAGCACAGGCTATGCACAGAAGTTCCAGGGCAG AGTCACCATGACCAGGGACACCTCCGTCAGCAC AGCCTACATGGAGCTGAGCAGCCTGAGATCTGA GGACACGGCCGTCTATTACTGTGCATATAGCAGT GGCTGGTACTACTTTGACTACTGGGGCCAGGGAA CCCTGGTCACCGTCTCCTCA |
| | | | SEQ ID NO: 25683 | SEQ ID NO: 29689 |
| | | AA | DIVMTQSPDSLAVSLGERVAINCKSSQSVLHSSN NNNYLDWYQQKPGQLPKLLIFWASTREFGVPDR FSGSGFGTDFTLTISSLQAEDVADYYCQQYYITP CSFGQGTKLEIK | QVQLVQSGAEVKKPGASVKVSCKASGYTFTNYDIN WVRQATGQGLEWMGWMHPNSGSTGYAQKFQGR VTMTRDTSVSTAYMELSSLRSEDTAVYYCAYSSG WYYFDYWGQGTLVTVSS |
| | | | SEQ ID NO: 25684 | SEQ ID NO: 29690 |
| iPS:434447 | 21-225_71B6 | NA | GACATCCAGATGACCCAGTCTCCATCCTCCCC GTCTGCATCTGTAGGAGACAGAGTCACCATCA CTTGCCGGGCAAGTCAGGGCATTAGAAATGAT TTAGATTGGTATCAGCAGAAGCCAGGGAAGG CCCCTCAGCGCCTTATCTATGCTGCATCCAGT TGCAAAGTGGGGTCCCATCAAGGTTCAGCGGC AGTGGATCTGGGACAGAATTCACTCTCACAAT CAGCAGCCTGCAGCCTGACGATTTTGCAACTT ATTACTGTCTACAGCATATAGTTACCCATTC ACTTTCGGCCCTGGGACCAAAGTGGATATCAA A | CAGGTGCAACTGGTGCAGTCTGTGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCCCCAGGCAAGGGCT GGAGTGGGTGGCAGTTATTTGGTATGATAGAACA AATAAATACTATGCAGACTCCGTGAAGGGCCGA TTCACCATCTCCAGAGACAATTCCAAGAACACGC TGCATCTGCAAATGAACAGCCTGAGAGCCGAGG ACACGGCTGTGTATTACTGTGCGAGAGAACTGGG GATGTTGTCTGACTACTGGGGCCAGGGAACCCTG GTCACCGTCTCCTCA |
| | | | SEQ ID NO: 25685 | SEQ ID NO: 29691 |

FIGURE 50
(Continued)

| | | | | |
|---|---|---|---|---|
| iPS:434449 | | AA | DIQMTQSPSSPSASVGDRVTITCRASQGIRNDLD WYQQKPGKAPQRLIYAASSLQSGVPSRFSGSGS GTEFTLTISSLQPDDFATYYCLQHNSYPFTFGPGT KVDIK<br><br>SEQ ID NO: 25686 | QVQLVESGGGVVQPGRSLRLSCAASGFTFSNYGM HWVRQAPGKGLEWVAVIWYDRTNKYYADSVKGR FTISRDNSKNTLHLQMNSLRAEDTAVYYCARELGM LSDYWGQGTLVTVSS<br><br>SEQ ID NO: 29692 |
| | 21-225_71H6 | NA | GACATCCAGATGACCCAGTCTCCATCCTCCT GTCTGCATCTGTAGGAGACAGAGTCACCATCA CTTGCCGGGCAAGTCAGGGCATTAGAAATGTT TTAGGCTGGTATCAGCAGAAACCAGGGAAAG CCCCTAAGCGCCTGATCTATGCTGCATCCAGT TTACAAAGTGGGGTCCCATCAAGGTTCAGCGG CAGTGGATCTGGGACAGAATTCACTCTCACAA TCAGCAGCCTGCAGCCTGAAGATATTGCAACT TATTACTGTCTACAGTATAATAGTTACCATTC ACTTTCGGCCCTGGGACCAAAGTGGATATCAA A<br><br>SEQ ID NO: 25687 | GAGGTGCAGCTGGTGGAGTCTGGGGGAGGCTG GTCAAGCCTGGGGGGTCCCTGAGACTGTCCTGTG CAGCCTCTGGATTCACCTTCAGTAGCTATAGCAT GAACTGGGTCCGCCAGGCTCCAGGGAAGGGACT GGAGTGGGTCTCATCATTAGTGGTACTAGTAGT TACATATACTACGCAGACTCAGTGAAGGGCCGAT TCACCATCTCCAGAGACAACGCCAAGAACTCACT GTATCTGCAAATGAACGGCCTGAGAGCCGAGGA CACGGCTGTGTATTCTGTGCGAAAACCAATGCT TTGATATCTGGGGCCAGGGGACAATGGTCACCG TCTCTTCA<br><br>SEQ ID NO: 29693 |
| | | AA | DIQMTQSPSSLSASVGDRVTITCRASQGIRNVLG WYQQKPGKAPKRLIYAASSLQSGVPSRFSGSGS GTEFTLTISSLQPEDFATYYCLQYNSYPFTFGPGT KVDIK<br><br>SEQ ID NO: 25688 | EVQLVESGGGLVKPGGSLRLSCAASGFTFSSYSMN WVRQAPGKGLEWVSSISGTSSYIYYADSVKGRFTIS RDNAKNSLYLQMNGLRAEDTAVYFCAKTNAFDIW GQGTMVTVSS<br><br>SEQ ID NO: 29694 |

FIGURE 50
(Continued)

| | | | |
|---|---|---|---|
| iPS:434451 | 21-225_71B7 | NA | GACATCCAGATGACCCAGTCTCCATCTTCCGT GTCTGCATCTGTAGGAGACAGAGTCACCATCA CTTGTCGGGCGAGTCAGGGTATTAGCAGCTGG TTAGCCTGGTATCAGCAGAAATCCAGGGAAGC CCCTAAGCTCCTGATCTATGCTGCATCCAGTTT GCAAAGGTGGGGTCCCATCAAGGTTCAGCGGCA GTGGATCTGGGACAGATTTCACTCTCACCATC AGCAGCCTCCAGCTGAAGATTTTGCAAATTA CTATTGTCAACAGACTAATAGTTTCCCTCTCAC TTTCGGCGGAGGGACCAAGGTGGAGATCAAA | CAGGTGCAGCTGGTGCAGTCTGGGGCTGAGGTG AAGAAGCCTGGGGCCTCAGTGAAGGTCTCCTGC AAGGCTTCTGGATACATCTTCACCGGCTACTATA TGCACTGGGTGCGACAGGCCCCTGGACAAGGGC TTGAGTGGATGGGATGGATCAACCCTAACAGTGG TGGCACAAACTCTGCACAGAAGTTTCAGGGCAG GGTCACCATGACCAGGGACACGTCCATCGGCAC AGCCTACATGGAGCTGAGCGGGCTGAGATCTGA CGACACGGCCGTGTATTACTGTGCGAGAGCTCCG GGTAAAGCAGCAGCTGGTACATGGGGATTCTTTG ACTACTGGGGCCAGGGAACCCTGGTCACCGTCTC CTCA |
| | | | SEQ ID NO: 29695 |
| | | | QVQLVQSGAEVKKPGASVKVSCKASGYIFTGYYM HWVRQAPGQGLEWMGWINPNSGGTNSAQKFQGR VTMTRDTSIGTAYMELSGLRSDTAVYYCARAPG KAAAGTWGFFDYWGQGTLVTVSS |
| | | AA | DIQMTQSPSSVSASVGDRVTITCRASQGISSWLA WYQQNPGEAPKLLIYAASSLQGGVPSRFSGSGS GTDFTLTISSLQPEDFANYYCQQTNSFPLTFGGG TKVEIK |
| | | | SEQ ID NO: 25690 |
| | | | SEQ ID NO: 29696 |
| iPS:434453 | 21-225_71B11 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGATTGGTATCAGCAGAAACCAGGGAAAGC CCCTAAGCGCCTGATCTATGCTGCATCCAGTT GCAAAGTGGGGTCCCATCAAGGTTCAGCGGCG GTGGATCTGGGACAGATTTCACTCTCACAATC AGCAGCCTGCAGCCTGAAGATTTTACAACTTA TTACTGTCTACAGCATAATACTTACCCATTCAC TTTCGGCCCTGGGACCAAAGTGGATGTCAAA | CAGGTGCAGCTGGTGGAGTCTGGGGGAGGCGTG GTCCAGCCTGGGAGGTCCCTGAGACTCTCCTGTG CAGGCGTCTGGATTCACCTTCAGTGACTATGGCAT GCACTGGGTCCGCCAGGCTCCAGGCAAGGGGCT GGAGTGGGTGGCAGTTATATGGTATGATGGAAAT AATAAATACTATGGAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACTGGG GATGTTGTCTGACTACTGGGGCCAGGGAACCCTG GTCACCGTCTCCTCA |
| | | | SEQ ID NO: 25691 |
| | | | SEQ ID NO: 29697 |

FIGURE 50
(Continued)

| | | | | |
|---|---|---|---|---|
| | | AA | DIQMTQSPSSLSASVGDRVTITCRASQGIRNDLD WYQQTPGKAPKRLIYAASSLQSGVPSRFSGGGS GTEFSLTISSLQPEDFTTYYCLQHNTYPFTFGPGT KVDVK<br><br>SEQ ID NO: 25692 | QVQLVESGGGVVQPGRSLRLSCAASGFTFSDYGM HWVRQAPGKGLEWVAVIWYDRNNKYYGDSVKG RFTISRDNSKNTLYLQMNSLRAEDTAVYYCARELG MLSDYWGQGTLVTVSS<br><br>SEQ ID NO: 29698 |
| iPS:434455 | 21-225_72F5 | NA | GACATCCAGATGACCCAGTCTCCATCCTCCCT GTCTGCATCTGTAGGAGACAGAGTCATCATCC CTTGCCGGGCAAGTCAGAGACATTAGCAGCTAT TTAAATTGGTATCAGCAGAAACCAGGGAAAG CCCCTAAACTCCTGATCTATGCTGCATCCAGTT TGCAAAGTGGGGTCCCATCAAGGTTCAGTGGC AGTGGATCTGGGACAGATTTCACTCTGACAAT CAGCAGTCTGCAGCCTGAAGATTTTGCAACTT ACTCCTGTCAACAGAGACTTACAGTACCCCACC TTCGGCCAAGGGACACGACTGGATATTAAT<br><br>SEQ ID NO: 25693 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GATCTGGGTCCGCCAGGCTCCAGGGAAGGGCT GGAGTGGGTCTCAACTATTAGTGGTAGTGGTGGT TACACATACTCCGCAGACTCCGTGAAGGGCCGGT TCACCATCTCCAGAGACAATTCCAAGAACACGCT GTATCTTCAAATGAACAGCCTGAGAGCCGAGGA CACGGCCGTATATTACTGTGCGAGACGTATAGCA GTGACTGGGACGGAATGGTACGACCCCCTGGGGC CAGGGAACCCTGGTCACCGTCTCCTCA<br><br>SEQ ID NO: 29699 |
| | | AA | DIQMTQSPSSLSASVGDRVIIPCRASQNISSYLNW YQQKPGKAPKLLIYAASSLQSGVPSRFSGSGSGT DFTLTISSLQPEDFATYSCQQTYSTPTFGQGTRLD IN<br><br>SEQ ID NO: 25694 | EVQLLESGGGLVQPGGSLRLSCAASGFTFSSYAMI WVRQAPGKGLEWVSTISGSGGYTYSADSVKGRFTI SRDNSKNTLYLQMNSLRAEDTAVYYCARRIAVTGT EWYDPWGQGTLVTVSS<br><br>SEQ ID NO: 29700 |

FIGURE 50
(Continued)

| | | | |
|---|---|---|---|
| iPS:434457 | 21-225_72G12 | NA | GACATCCAGTTGACCCAGTCTCCATCTCCT GTCTGCATCTGTAGGAGACAGAGTCACCATCA CTTGCCGGGCGAGTCAGGGCATTAGCAGTTAT TTAAATTGGTCTCAGCAGAAACCAGGAAAGT TCCTAAGCTCCTGATCTGTGGTCTTCCAATTT GCAATCTGGAGTCCCATCTCGGTTCAGCGGCA GTGCATCTGGGACAGAATTCATTCTCACTATC AGCAGCCTGCAGCTGAAGATGTTACAACTTA TTACGGTCAACAGAATTACAATGCCCCGCTCA CTTTCGGCGGCGAGGGACCAAGGTGGAGATCAA A<br>SEQ ID NO: 25695 | CAGGTGCAGCTGGTGCAGTCTGGGGGAGGCGTG GTCCAGCCTGGGAGGTCCCTGAGACTCTCCTGTG CAGCGTCTGATTCACCTTCAGTAGTTATGGCAT GCACTGGGTCCGCCAGGCTCCAGACACGGGCT GGAGTGGGTGGCAGTTATATGTTTGATGAAAGT AATAAATACTATGCAGACTCCGTGAAGGGCCGA TTCACCATCTCCAGAGACAATTCCAAGAACACGC TGTATCTGCAAATGAACAGCTGAGAGCCGAGG ACACGGCTGTGTATTACTGTGCGAGAGAGCTTGG TTTCAGCAGTGACTACTGGGGCCAGGGAACCCTG GTCACCGTCTCCTCA<br>SEQ ID NO: 29701 |
| | | AA | DIQLTQSPSSLSASVGDRVTITCRASQGISSYLNW SQQKPGKVPKLLICGASNLQSVPSRFSGSASGT EFILTISSLQPEDVTTYYGQQNYNAPLTFGGGTK VEIK<br>SEQ ID NO: 25696 | QVQLVESGGGVVQPGRSLRLSCAASGFTFSSYGMH WVRQAPDTGLEWVAVIWFDESNKYYADSVKGRFT ISRDNSKNTLYLQMNSLRAEDTAVYYCARELGFSS DYWGQGTLVTVSS<br>SEQ ID NO: 29702 |
| iPS:434459 | 21-225_71A7 | NA | GACATCCAGATGACCCAGTCTCCATCTTCCGT GTCTGCATCTGTAGGAGACAGAGTCACCATCA CTTGTCGGGCGAGTCAGGGTATTAGCAGCTGG TTAGCCTGGTATCAGCAGAAACCTGGGAAAGC CCCTAAGCTCCTGATCTATGCTGCATCCAGTTT GCAAAGTGGGGTCCCATCAAGGTTCAGCGGCA GTGGATCTGGGACAGATTTCACTCTCACCATC AGCAGCCTGCAACAGGTTGAAGATTTTGCAACTTA CTATTGTCAACAGGTTAACAGTTTCCCTCTCAC TTTCGGCGGAGGGACCAAGGTGGAGCTCAAA<br>SEQ ID NO: 25697 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACCCTAAAAGTG GTGGCACAAATTATGTACAGAAGTTCAGGGCAG GGTCACCATGACCAGGGACACGTCCATCAGCAC AGCCTACATGGAGCTGAGCAGTCTGAGATCTGAC GACACGGCCGTGTATTACTGTGCGAGAGCTCCGG GTACAGCACCAGCTGGGTCATGGGGTATACTTTGA CTACTGGGGCCAGGGAACCCTGGTCACCGTCTCC TCA<br>SEQ ID NO: 29703 |

FIGURE 50
(Continued)

| | | | | |
|---|---|---|---|---|
| | | AA | DIQMTQSPSSVSASVGDRVTITCRASQGISSWLA WYQQKPGKAPKLLIYAASSLQSGVPSRFSGSGS GTDFTLTISSLQPEDFATYYCQQVNSFPLTFGGG TKVELK<br>SEQ ID NO: 25698 | QVQLVQSGAEVKKPGASVKVSCKASGYTFTGYYM HWVRQAPGQGLEWMGWINPKSGGTNYVQKFQGR VTMTRDTSISTAYMELSSLRSDDTAVYYCARAPGT APAGSWGYFDYWGQGTLVTVSS<br>SEQ ID NO: 29704 |
| iPS:434461 | 21-225_73A3 | NA | GACATCCAGATGACCCAGTCTCCATCTTCCGT GTCTGCATCTATAGGAGACAGAGTCACCATCA CTTGTCGGGCGAGTCAGGGTATTAGCAACTGG TTAGCCTGGTATCAGCAGAAACCAGGGAAAG CCCCTAAGCTCCTGATCTATGCTGCATCCAGTT TGCAAAGTGGGGTCCCGTCAAGGTTCAGCGGC AGTGGATCTGAGACAGATTTCACTCTCACCAT CAGCAGCCTGCAGCCTGAAGATTTTGCAACTT ACTATTGTCAACAGGTTAACAGTTTCCCTCTCA CTTTCGGCGGAGGGACCAAGGTGGAGATCAA A<br>SEQ ID NO: 25699 | CAGGTGCAACTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTACGACAGGCCCCTGGACAAGGAC TTGAGTGGATGGGATGGATCAACCCTAAAAGTGG TGGCACGAATCATGTCCAGAAGTTTCAGGGCAG GGTCGCCATGACCAGGGACACGTCCATCAGCAC AGCCTACATGGAGCTGAGCAGTCTGAGATCTGAC GACACGGCCGTGTATTACTGTGCGAGAGCTCCGG GTACAGCAGCAGCTGGGTCATGGGGATGCTTTGA CTACTCGGGGCCAGGGAACCCTGGTCACCGTCTCC TCA<br>SEQ ID NO: 29705 |
| | | AA | DIQMTQSPSSVSASIGDRVTITCRASQGISNWLA WYQQKPGKAPKLLIYAASSLQSGVPSRFSGSGSE TDFTLTISSLQPEDFATYYCQQVNSFPLTFGGGT KVEIK<br>SEQ ID NO: 25700 | QVQLVQSGAEVKKPGASVKVSCKASGYTFTGYYM HWVRQAPGQGLDWMGWINPKSGGTNHVQKFQGR VAMTRDTSISTAYMELSSLRSDDTAVYYCARAPGT AAAGSWGCFDYWGQGTLVTVSS<br>SEQ ID NO: 29706 |

FIGURE 50
(Continued)

| | | | |
|---|---|---|---|
| iPS:434463 | 21-225_73A6 | NA | GACATCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTTTCAGCAGAAACCAGGGAAAGC CCCTAAGCGCCTGATCTATGCTGCATCCAATTT GCAAAGTGGGGTCCCATCAAGGTTCAGCGGCA GTGGATCTGGGACAGATTCACTCTCACATC AGCAGCCTGCAGCCTGAAGATTTTGCAACTTA TTACTGTCTACAGCATAATAGTTACCATTCAC TTTCGGCCCTGGGACCAAAGTGGATATCAAA<br><br>SEQ ID NO: 25701 | CAGGTGCAGCTGGTGGAGTCTGGGGGAGGCGTG GTCCAGCCTGGGAGGTCCCTGAGACTCTCCTGTG CAGCCTCTGGATTCACCTTCAGTTACTATGGCAT GCACTGGGTCCGCCAGGCTCCAGGCAAGGGGCT GGAGTGGGTGGCAGTTATATTATATGATGGAAGT AAGAAATACTATGCAGCCTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGCGAGGAGTATCCC GGACTTTGACTACTGGGGCCAGGGAACCCTGGTC ACCGTCTCCTCA<br><br>SEQ ID NO: 29707 |
| | | AA | DIQMTQSPSSLSASVGDRVTITCRASQGIRNDLG WFQQKPGKAPKRLIYAASNLQSGVPSRFSGSGS GTEFTLTISSLQPEDFATYYCLQHNSYPFTFGPGT KVDIK<br><br>SEQ ID NO: 25702 | QVQLVESGGGVVQPGRSLRLSCAASGFTFSYYGM HWVRQAPGKGLEWVAVILYDGSKKYYAASVKGR FTISRDNSKNTLYLQMNSLRAEDTAVYYCARSIPDF DYWGQGTLVTVSS<br><br>SEQ ID NO: 29708 |
| iPS:434467 | 21-225_73H8 | NA | GACATCAGATGACCCAGTCTCCATCTCCCT GTATGCATCTGTAGGAGACAGAGTCACCATCA CTCGCCGGGCAAGTCAGGACATCAGAAATGAT TTAGGCTGGTATCAGCAGAAACCAGGGAAAG CCCCTTAAGCGCCTGATCTATGCTGCATCCAGT TTGCAAAGTGGGGTCCCATCAAGCTTCAGCGG CAGTGGATCTGGGACAGAATTCACTCTCACAA TCAGCAGTTGCAGCCTGAAGATTTTGCAACT TATTACGTATACAGCATAATAGTTACCCTCC GATCACCGTCGGCCAAGGGACACGACTGGAG ATTAAA<br><br>SEQ ID NO: 25703 | GAGGTGCAGTTACTGGAGTCTGGGGGAGGCTGG GTACAGTCTGGGGGGTCCCTGAGACTCTCCTGTG CAGCCTCTGGATTCACCTTTAGCAGCAATGCCAT GAGCTGGGTCCGCCAGGCTCCAGGGAAGGGGCT GGAGTGGGTCTCAGACATTAGTCGTAGTGGTGGT ACCACATTCTACGCAGACTCCGTGAAGGGCCGGT TCACCATCTGCAAATGAACAGCCTGAGAGACGCT GTATCTGCAAATGAACAGCTGTGCGAGAGCCGAGGA CACGGCCGTATATTACTGTGCGAAATGGATAGC AGCAGCTGTACGACGTGACTCCTTTGACTACT GGGGCCAGGGAACCCTGGTCACCGTCTCCTCA<br><br>SEQ ID NO: 29709 |

FIGURE 50
(Continued)

| | | | | |
|---|---|---|---|---|
| iPS:434469 | 21-225_73C9 | AA | DIQMTQSPSSLYASVGDRVTITRRASQDIRNDLGWYQQKPGKALKRVIYAASSLQSGVPSSFSGSGSGTEFTLTISSLQPEDFATYYGIQHNSYPPITVGQGTRLEIK<br>SEQ ID NO: 25704 | EVQLLESGGGWVQSGGSLRLSCAASGFTFSSNAMSWVRQAPGKGLEWVSDISRSGGTTFYADSVKGRFTISRDNSKNTLYLQMNSLRAEDTAVYYCAKWDSSSWYDVTPFDYWGQGTLVTVSS<br>SEQ ID NO: 29710 |
| | | NA | GACATCCAGATGACCCAGTCTCCATCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATTATAGTTACCCTCGGACGTTCGGCCAAGGGACCAAGGTGGAAATCAAA<br>SEQ ID NO: 25705 | CAGGTGCAGCTGGTGGAGTCTGGGGGAGGCGTGGTCCAGCCTGGGAGGTCCCTGAGACTCTCCTGTGCAGGCGTCTGGATTCACCTTCAGCAATTATGTCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTATATTACTGTGCGAGAGAAAGTAAGCAGCAGCTGTGTTCGACTACGGTATGGACGTCTGGGGCCAAGGGACCACGGTCACCGTCTCCTCA<br>SEQ ID NO: 29711 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHYSYPRTFGQGTKVEIK<br>SEQ ID NO: 25706 | QVQLVESGGGVVQPGRSLRLSCAASGFTFSNYVMHWVRQAPGKGLEWVAVIWYDGSNKYYADSVKGRFTISRDNSKNTLYLQMNSLRAEDTAVYYCARERYSSSWFDYGMDVWGQGTTVTVSS<br>SEQ ID NO: 29712 |

FIGURE 50
(Continued)

| | | | |
|---|---|---|---|
| iPS:434471 | 21-225_75G3 | NA | GAAATTGTGTTGACGCAGTCTCCAGGCACCCT GTCTTTGTCTCTGCAGGGCCGTCAGGGAGAGCCACCCTCT CCTGCAGGGCCGTCAGGGGAGAGAATGTTGACAGCAGC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGATTCACTCTCAC CATCAGCAGACTGGAGCTGAAGATTTTGCAG TGTTTACTGTCAGCAGTATGATGAACGCTCACG TGGACGTTCGGCCAAGGGACCAAGGTGGAGA TCAAA SEQ ID NO: 25707 | CAGGTGCAGCTACAGCAGTGGGGCGCAGGACTG TTGAAGCCTTCGGAGACCCTGTCCCTCACCTGCG CTGTCTATGGTGGGTCCCTCAGTGGTTCCTACTG GAGCTGGATCCGCCAGCCCCCAGGGAAGGGCT GGAGTGGATTGGGAAATCAATCTTAGTGGAAG TACCAACTACAACCCGTCCCTCAAGAGTCGAGTC ACCATATCAGTAGACACGTCCAAGAGCCAGTTCT CCCTGAGCTGCGCTCTGTGACCGCCGCGGACAC GGCTGTGTATTACTGTGCGAGAGACTACGGTGGC CTTGACTACTGGGGCCAGGGAACCCTGGTCACCG TCTCCCTCA SEQ ID NO: 29713 |
| | | AA | EIVLTQSPGTLSLSPGERATLSCRARQNVDSSYL AWYQQKPGQAPRLLIYGASSRATGIPDRFSGSGS GTDFTLTISRLEPEDFAVFYCQQYERSPWTFGQG TKVEIK SEQ ID NO: 25708 | QVQLQQWGAGLLKPSETLSLTCAVYGGSLSGSYW SWIRQPPGKGLEWIGEINLSGSTNYNPSLKSRVTISV DTSKSQFSLTLRSVTAADTAVYYCARDYGGLDYW GQGTLVTVSS SEQ ID NO: 29714 |
| iPS:434473 | 21-225_76D1 | NA | GAAATTGTGTTGACGCAGTCTCCAGGCACCCT GTCTTTGTCTCCAGGGGAAAGAGCCACCCTCT CCTGCAGGGCCAGTCAGAATATTACAGCAAC TACCTAGCCTGGTACCAGGAGAAGCCTGGCCA GGCTCCCAGACTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGTAG TGTATTACTGTCTGTCAGCAGTATGATGAAGTTCACCG TGGACGTTCGGCCAAGGGACCAAGGTGGAAA TCAAA SEQ ID NO: 25709 | CAGGTACAACTACAGCAGTGGGGCGCAGGACTG TTGAAGCCTTCGGAGACCCTGTCCCTCACCTGCG CTGTCTATAGTGGGTCCTTCAGTGGTTGCTACTG GAGCTGGATCCGCCAGCCCCAGGGAAGGGGCT GGAGTGGATTGGGAAATCAATCATAGTGGAAG AACCAACTACAACCCGTCCCTCAAGAGTCGAGTC ACCATATCAGTAGACACGTCAAGAACCAGTTCT CCCTGAAGCTGAGCTCTGTGACCGCCGCGGACAC GGCTGTGTATTACTGTGCGAGGGACTACGGCGGT ATGGACGTTCGGGGCCAGGGGACCACGGTCACC GTCTCCTCA SEQ ID NO: 29715 |

FIGURE 50
(Continued)

| | | | | |
|---|---|---|---|---|
| iPS:434475 | 21-225_74F9 | AA | EIVLTQSPGTLSLSPGERATLSCRASQNIYSNYLAWYQEKPGQAPRLLIYGASSRATGIPDRFSGSGSGTDFTLTISRLEPEDFVVYCQQYESSPWTFGQGTKVEIK | QVQLQQWGAGLLKPSETLSLTCAVYSGSFSGCYWSWIRQPPGKGLEWIGEINHSGRTNYNPSLKSRVTISVDTSKNQFSLKLSSVTAADTAVYYCARDYGGMDVWGQGTTVTVSS |
| | | | SEQ ID NO: 25710 | SEQ ID NO: 29716 |
| | | NA | GACATCGTGATGACCCAGTCTCCAGACTCCCTGGCTGTGTCTCTGGGCGAGAGGGCCACCATCAACTGCAAGTCCAGCCAGAGTGTTTTATACAGCTCCAACAATTACAACTACTTAGCTTGGTACCAGCAGAAACCAGGACAGCCTCCTAAGAAGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTCTCCGACGTTCGGCCAAGGGACCAAGGTGGAAATCAAA | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGGCTTGAGTGGATGGGATGGATGAACCCTAACAGTGGTAACACAGGCTGTGCACAGAAGTTCCAGGGCAGAGTCACCATGACCAGAACAACCTCCATAAGCACAGCCTACATGGAGCTGAGCAGCCTGAGATCTGAGGACACGGCCGTGTATTACTGTGCGAGTAGCAGTGGCTGGAACTTCTTTGACTACTGGGGCCAGGGAACCCTGGTCACCGTCTCCTCA |
| | | | SEQ ID NO: 25711 | SEQ ID NO: 29717 |
| | | AA | DIVMTQSPDSLAVSLGERATINCKSSQSVLYSSNNYNYLAWYQQKPGQPPKKLIYWASTRESGVPDRFSGSGSGTDFTLTISSLQAEDVAVYSCQQYYSSPPTFGQGTKVEIK | QVQLVQSGAEVKKPGASVKVSCKASGYTFTNYDINWVRQATGQGLEWMGWMNPNSGNTGCAQKFQGRVTMTRNTSISTAYMELSSLRSEDTAVYYCASSSGWNFFDYWGQGTLVTVSS |
| | | | SEQ ID NO: 25712 | SEQ ID NO: 29718 |

FIGURE 50
(Continued)

| | | | |
|---|---|---|---|
| iPS:434477 | 21-225_74A6 | NA | GACATCGTGATGACCCAGTCTCCAGACTCCCT GGCTGTGTCTCCGGGCGAGAGGGCCACCATCA ACTGCAAGTCCAGCCAGAGTGTTTACACAGC TCCAACAATAACAATTACTTAGCCTGTACCA GCAGAAACCAGGACAGCCTCCTGACCTGCTCA TTTACTGGGCATCAACCCGGAATCCAGGGGTC CCTGACGATTCAGTGGCAGCGGGGTCTGGGAC AGATTTCACTCTCACCATCAGCAGCCTGCAGG CTGAAGATGTGGCAGTTTATTACTGTCAGCAA TATTTTAGTACTCCGTGACGTTCGGCCAAGGG GACCCAAGGTGGAAATCAAA |
| | | | SEQ ID NO: 25713 |
| | | AA | DIVMTQSPDSLAVSPGERATINCKSSQSVLHSSN NNNYLAWYQQKPGQPPDLLIYWASTRESGVPD RFSGSGSGTDFTLTISSLQAEDVAVYYCQQYFST PWTFGQGTQVEIK |
| | | | SEQ ID NO: 25714 |
| | | NA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TAACACAGGCTATGCACAGAAGTTCCGGGCAG AGTCACCATGACCACTGGAACACCTCCATAAGCACA GCCTACATGGAGCTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTCTCCTCA |
| | | | SEQ ID NO: 29719 |
| | | | QVQLVQSGAEVKKPGASVKVSCKASGYTFTNYDIN WVRQATGQGLEWMGWMHPNSGNTGYAQKFRGR VTMTWNTSISTAYMELSSLRSEDTAVYYCASSSGW YYFDYWGQGTLVTVSS |
| | | | SEQ ID NO: 29720 |
| iPS:434479 | 21-225_76H1 | NA | GAATTTATGTTGACGCAGTCTCCAGGCACCCT GTATTGGTCTCCAGGGGAAAGAGCCACCCTCT CGTGCAGGGCCAGTCAGAGTGTTAGCAGCAGC TACTTAGTAGTCTCGGTATCAGCAGCAGAAACCTGGCCA GGCTCCCAGGCTCCTCATCTATGGTGCATCA CCAGGGCCACTGGCATCCCAGACAGGTTCAGT GGCAGTGGGTCTGGGACAGACTTCACTCTCAC CATCAGCAGACTGGAGCCTGAATATTTTGCAG TTTATTACTGTCAGCAGTATGGTTGCTCACCGC TCACTTTCGGCGGAGGGACCAAGGTGGAGATC ACA |
| | | | SEQ ID NO: 25715 |
| | | NA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCCTGGACAAGGGC TTGAGTGGATGGGATGGATGCACCCTAACAGTGG TAACACAGGCTATGCACAGAAGTTCCAGGGCAG AGTCACCATGACCAGGAACACCTCCATCAGCAC AGCCTACATGGAGCTGAGCAGCCTGAGATCTGA GGACACGGCCGTGTATTACTGTGCGATTAGTAGT GGCTGTACTGGTTCGACCCTGGGGCCAGGGA ACCCTGGTCACCGTCTCCTCA |
| | | | SEQ ID NO: 29721 |

FIGURE 50
(Continued)

| | | | | |
|---|---|---|---|---|
| iPS-434481 | 21-225_74B10 | AA | EFMLTQSPGTLYWSPGERATLSCRASQSVSSSYL VWYQQKPGQAPRLLIYGASTRATGIPDRFSGSGS GTDFTLTISRLEPEYFAVYYCQQYGCSPLTFGGG TKVEIT<br><br>SEQ ID NO: 25716 | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS<br><br>SEQ ID NO: 29722 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTACACAGC TCCAACAATAAGAACTACTTAACTTGGTACCA GCAGAAACCAGGACAGCCTCCTAAGCTGCTCA TTTACTGGGCATCTACTCGGGAATCCGGGTC CCTGACCGATTCAGTGGCAGCGGGTCTGGGAC AGATTTCAGTCTCACGATCGGCAGCCTGCAGG CTGAAGATATTGGCAGTTATTACTGTCAGCAA TATTATAGTAGTCCTCCGACGTTCGGCCAAGG GACCAAGGTGGAAATCAAA<br><br>SEQ ID NO: 25717 | CAGGTGCAGCTGGTGCAGTCTGGGGCTGAGGTG AAGAAGCCTGGGGCCTCAGTGAAGGTCTCCTGC AAGGCTTCTGGATTCACCTTCACCAATTATGATA TCAACTGGGTGCGACAGGCCACTGGACAAGGGC TTGAGTGGATGGGATGGATGCACCTAACAGTGG TAACACAGGCTTTGCACAGAAGTTCCAGGCAG AGTCACCATGACCAGGAACACCTCCATAAGCAC AGCCTACATGGAACTGAGCAGCCTGAGATCTGA GGACACGGCCGTGTATTACTGTGCGGTTTCCAGT GGCTGGTACTGGTTCGACCCCTGGGGCCAGGGA ACCCTGGTCACCGTCTCCTCA<br><br>SEQ ID NO: 29723 |
| | | AA | DIVMTQSPDSLAVSLGERATINCKSSQSVLHSSN NKNYLTWYQQKPGQPPKLLIYWASTRESGVPDR FSGSGSGTDFSLTIGSLQAEDVAVYYCQQYYSIP PTFGQGTKVEIK<br><br>SEQ ID NO: 25718 | QVQLVQSGAEVKKPGASVKVSCKASGFTFTNYDIN WVRQATGQGLEWMGWMHPNSGNTGFAQKFQGR VTMTRNTSISTAYMELSSLRSEDTAVYYCAVSSGW YWFDPWGQGTLVTVSS<br><br>SEQ ID NO: 29724 |

FIGURE 50
(Continued)

| | | | |
|---|---|---|---|
| iPS:434483 | 21-225_74C12 | NA | GACATCGTGATGACCCAGTCTCCAGACTCCCT GGCTGTGTCTCTGGGCGAGAGGGCCACCATCA ACTGCAAGTCCAGCCAGAGTGTTTATACAGC TCCAACAATGCAAACTACTTAGCTTGGTACCA GCAGAAACCAGGACAGCCTCCTAACCTGCTCA TTTACTGGGCATCTACCCGGAATCCGGGGTC CCTGACCGATTCAGTGGCAGCGGGTCTGGGAC AGATTTCACTCTCACCATCAGCAGCCTGCAGG CTGAAGATGTGGCAGTTATTACTGTCAGCAA TATTATAGTACTCCGTGCAGTTTTGGCCAGG GACCAAGCTGGAGATCAAA SEQ ID NO: 25719 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGCA GAGTCACCATGACCAGGAACACCTCCATAAGCA CAGCCTACATGGAGCTGAGCAGCCTGAGATCTG AGGACACGGCCGTGTATTACTGTGCGATTAGCAG TGGCTGGTACTGGTTCGACCCCTGGGGCCAGGGA ACCCTGGTCACCGTCTCCTCA SEQ ID NO: 29725 |
| | | AA | DIVMTQSPDSLAVSLGERATINCKSSQSVLYSSN NANYLAWYQQKPGQPPNLLIYWASTRESGVPD RFSGSGSGTDFTLTISSLQAEDVAVYYCQQYYST PCSFGQGTKLEIK SEQ ID NO: 25720 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCAISSGW YWFDPWGQGTLVTVSS SEQ ID NO: 29726 |
| iPS:434485 | 21-225_76D2 | NA | GAAATAGTGATGACGCAGTCTCCAGCCACCC GTCTGTGTCTCCAGGGGAAAGAGCCACCCTCT CCTGCAGGGCCAGTGGTGAGTGTGTCAACAGC TTAGCCTGGTACCAGCAGAAACCTGGCCAGGC TCCCAGGCTCCTCATCCATGGTGCATCCACCA GGGCCACTGGTATCCCAGCCAGGTTCAGTGGC AGTGGGTCAGCAGTGTCAGACAGATTCACTCTCACCAT CAGCAGTGTGCAGTCTGAAGATATAATGACTGGCCGTGC ATTACTGTCAGCAATATAATGACTGGCCGTGC AGTTTTGGCCAGGGGACCAAGCTGGAGATCAA A SEQ ID NO: 25721 | CAGGTGCAGCTGGTGGAGTCTGGGGGAGGCGTG GTCCAGCCTGGGAGGTCCCTGAGACTCTCCTGTG CAGCGTCTGGATTCACTTCAGTAGCTATGGCAT GCACTGGGTCCGCCAGGCTCCAGGCAAGGGGCT GGAGTGGGTGGCAGTTATTTGGTATGATGGAAGT AATAAATACTATGCAGACTCCGTGAAGGGCCGA TTCACCATCTCCAGAGACAATTCCAAGAACACGC TGTTTCTGCAAATGAACAGCCTGAGAGCCGAGG ACACGGCTGTGTATTACTGTGCGAGCGATCGCAA TATAGTGGAGCTACTTACTTTGAGTCCTGGGGC CAGGGAACCCTGGTCACCGTCTCCTCA SEQ ID NO: 29727 |

FIGURE 50
(Continued)

| | | | | |
|---|---|---|---|---|
| iPS:434487 | 21-225_76G2 | AA | EIVMTQSPATPSVSPGERATLSCRASVSVVNSLAWYQQKPGQAPRLLIHGASTRATGIPARFSGSGSGTEFTLTISSVQSEDFAIYYCQQYNDWPCSFGQGTKLEIK<br>SEQ ID NO: 25722 | QVQLVESGGGVVQPGRSLRLSCAASGFTFSSYGMHWVRQAPGKGLEWVAVIWYDGSNKYYADSVKGRFTISRDNSKNTLFLQMNSLRAEDTAVYYCASDRNIVGATYFESWGQGTLVTVSS<br>SEQ ID NO: 29728 |
| | | NA | GACATCGTGATGACCCAGTCTCCAGACTCCCTGGCTGTGTCTCTGGGCGAGAGGGCCACCATCAACTGCAAGTCCAGCCAGAGTGTTTTACACAGCTCCAACAATTACAACTACTTAGCTTGGTACCAGCAGAGACCAGGACAGCCTCCTAGGCTGCTCATTTACTGGGCATCTACCCGGGAATCCGGGGTCCCTGACCGATTCAGTGGCAGCGGTTCTGGGACAGATTTCACTCTCACCATCAGCAGCCTGCAGGTTGAAGATGTGGCAGTTTATTACTGTCAGCAATATTATAGTTCTCCTCGACGTTCGGCCAAGGGACCAAGGTGGAAATCAAA<br>SEQ ID NO: 25723 | CAGGTGCAGCTGGTGCAGTCTGGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGACTTGAGTGGATGGGATGGATGAACCCTAACAGTGGTAACACAGGCTATGCACAGAAGTTCCAGGGCAGAGTCACCATGACCAGGAACACCTCCATAAGCACAGCCTATATGGAGCTGAGCAGCCTGAGATCTGAAGACACGGCCGTGTATTACTGTGCGGGTAGCAGTGGCTGGTACATGTTTGACTACTGGGGCCAGGGAACCCTCTGGTCACCGTCTCCTCA<br>SEQ ID NO: 29729 |
| | | AA | DIVMTQSPDSLAVSLGERATINCKSSQSVLHSSNNYNYLAWYQQRPGQPPRLLIYWASTRESGVPDRFSGSGSGTDFTLTISSLQVEDVAVYYCQQYYSSPPTFGQGTKVEIK<br>SEQ ID NO: 25724 | QVQLVQSGAEVKKPGASVKVSCKASGYTFTFNYDINWVRQATGQGLEWMGWMNPNSGNTGYAQKFQGRVTMTRNTSISTAYMELSSLRSEDTAVYYCAGSSGWYMFDYWGQGTLVTVSS<br>SEQ ID NO: 29730 |

FIGURE 50
(Continued)

| | | | |
|---|---|---|---|
| iPS:434489 | 21-225_74E4 | NA | GACATCCAGATGACCCAGTCTCCATCTCCCT GTCTGCTTCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCACTT TGCAAAGTGGGGTCCATCAAGGTTCAGCGGC AGTGGATCTGGGACAGAATTCACTCTCACAAT CAGCGGCCTGCAGCCTGAAGATTTTGCAACTT ACTACTGTCTACAGCATAGTAATTACCCGCTC ACTTTCGGCGGAGGGACCAAGGTGGAGATCA AA<br><br>SEQ ID NO: 25725 | CAGGTGCAGCTGCAGGAGTCGGGCCCAGGACTG GTGAAGCCTTCGGAGACCCTGTCCCTCATCTGTA CTGTCTCTGGTGGCTCCATCAGCAGTAGTAATTA CTACTGGGGCTGGATCCGCCAGCCCCCAGGGAA GGGGCTGGAGTGGATTGGGAGTATCTATTATAGT GGATACACCTCTACAACCGTCCCTCAAGAGTC GAGTCACCATATCGGTAGACTGTCCAAGAACCA CTTCTCCCTGAGGCTGAGCTCTGTGACCGCCGA GACACGGCTGTGTATTACTGTGCGAGACTTGACT CTAACTGGGGTCTTGACTACTGGGGCCAGGGAAC CCTGGTCACCGTCTCCTCA<br><br>SEQ ID NO: 29731 |
| | | AA | DIQMTQSPSSLSASVGDRVTITCRASQGIRNDLG WYQQKPGKAPKRLIYAASTLQSGVPSRFSGSGS GTEFTLTISGLQPEDFATYYCLQHSNYPLTFGGG TKVEIK<br><br>SEQ ID NO: 25726 | QLQLQESGPGLVKPSETLSLICTVSGGSISSSNYYW GWIRQPPGKGLEWIGSIYYSGYTSYNPSLKSRVTIS VDSSKNHFSLRLSSVTAADTAVYYCARLDSNWGL DYWGQGTLVTVSS<br><br>SEQ ID NO: 29732 |
| iPS:434493 | 21-225_76F3 | NA | GACATGCGTTATGACCCAGTCTCCAGACTCCCC GGCTGTGTCTCTGGGCGAGAGGGCCACCATCA ATTGCAAGTCCAGCCAGAGTGTTTTATTCAGC TCCAACAATTATATTAACTTAGCTTGGTACCA GCAGAGACCAGGACAGCCTCATGACCTGCTCA TTTACTGGGCATCTACCCGGAATCCGGGGTC CCTGACCGATTCAGTGGCAGCGGGTCTGGGAC AGATTTCACTCTCACCATCAGCAGCCTGCAGG CTGCTGATGTGGCAGTTTATTACTGTCAGCAA TATCATAGTTCTCCTGACGTTCGGCCAAGG GACCACGGTGCAAATCAAA<br><br>SEQ ID NO: 25727 | CAGGTGCAGTTGGTGCAGTCTGGGGCTGAGGTGA AGAAGCCTGGGGCCTCAGTGAAGGTCTCCTGCA AGGCTTCTGGATACACCTTCACCAATTATGATAT CAACTGGGTGCGACAGGCCACTGGACAAGGCT TGAGTGGATGGGATGGATGAACCTAACAGTGG TAACACAGGCTATGCACAGAAGTTCCAGGGCAG AGTCACCATGACCAGGAACACCTCCACAAGCAC AGCCCACATGGAGCTGAGCAGCCTGAGATCTGA GGACACGGCCGTGTATTACTGTGCGGTCTCCAGT GGACGAACTGGTTCGACCCCTGGGGCCAGGGA ACCCTGGTCACCGTCTCCTCA<br><br>SEQ ID NO: 29733 |

FIGURE 50
(Continued)

| | | AA | DIVMTQCPDSPAVSLGERATINCKSSQSVLFSSN NYNYLAWYQQRPGQPHDLLIYWASTRESGVPD RFSGSGSGTDFTLTISSLQAADVAVYYCQQYHSS PLTFGQGTTVQIK | QVQLVQSGAEVKKPGASVKVSCKASGYTFTNYDIN WVRQATGQGLEWMGWMNPNSGNTGYAQKFQGR VTMTRNTSTSTAHMELSSLRSEDTAVYYCAVSSGW NWFDPWGQGTLVTVSS |
|---|---|---|---|---|
| | | | SEQ ID NO: 25728 | SEQ ID NO: 29734 |
| iPS:434495 | 21-225_74B2 | NA | GAACTTGTGTTGACGCAGTCTCCAGGCACCCT GTCTTTGTCTCCAGGGGAAAGAGCCACCCTCT CCTGCAGGGCCAGTCAGATATTTACAGCAGT TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGATTCACTCTCAC CATCAGCAGACTGGAGCCTGAAGATTTTGCAG TGTATTGCTGTCAGCAGTATGAAAGCTCACCG TGGACCTTCGGCCAAGGGACCAAGGTGGAAA TCAAA | CAAGTGCAGCTACAGCAGTGGGGCGCAGGACTG TTGAAGCCTTCGGAGCCCCTGTCCCTCACCTGCG CTGTCTATGGTGGGTCCTTCAGTGGTCCCTACTG GAGCTGGATCCGCCAGCCCCCAGGGAAGGGGCT GGAGTGGATTGGGAAATCAATCATAGTGGAAG CACCAACTACAACCGTCCTCCACGAGTCGAGTC ACCATATCAGTAGACACGTCCAAGAACCAGTTCT CCCTGAAACTGACCTCTGTGACCGCCGCGACTC GGCTGTGTATTACTGTGCGAGAGACTACGGGGGT TTGGACGTCTGGGGCCAAGGGACCACGGTCACC GTCTCCTCA |
| | | | SEQ ID NO: 25729 | SEQ ID NO: 29735 |
| | | AA | ELVLTQSPGTLSLSPGERATLSCRASQNIYSSYLA WYQQKPGQAPRLLIYGASSRATGIPDRFSGSGSG TDFTLTISRLEPEDFAVYCCQQYESSPWTFGQGT KVEIK | QVQLQQWGAGLLKPSEPLSLTCAVYGGSFSGPYW SWIRQPPGKGLEWIGEINHSGSTNYNPSLTSRVTISV DTSKNQFSLKLTSVTAADSAVYYCARDYGGLDVW GQGTTVTVSS |
| | | | SEQ ID NO: 25730 | SEQ ID NO: 29736 |

FIGURE 50
(Continued)

| | | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGGCCACTGGCATCCCAGACAGCTTCAGT GGCAGTGGGTCTGGGACAGACTTCGCTCTCAC CATCAGCAGACTGGAGCCTGAAGATTTTGCAG TGTATTACTGTCAGCACTCTGATAACTCACCGT GGACGTTCGGCCAAGGGACCAAGGTGGAAAT CAAA SEQ ID NO: 25731 | CAGGTGCAGCTACAGCAGTGGGGCGCAGGACTG TTGAAGCCTTCGGAGACCCTGTCCCTCACCTGCG CTGTCCATGTGGGTCCTTCAGTGTTGCTACTG GAGCTGGATCCGCCAGCCCCAGGGAAGGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGGGACAC GGCTGTGTATTACTGTGCGAGGGACTACGGCGGT ATGGACGTCTGGGGCCAAGGGACCACGGTCACC GTCTCCTCA SEQ ID NO: 29737 |
| iPS:434497 | 21-225_76A4 | AA | EIVLTQSPGTLYLSPGERATLSCRASQSVYSSYLA WYQQKPGQAPRLLIYGASSRATGIPDRFSGSGSG TDFALTISRLEPEDFAVYYCQHSDNSPWTFGQGT KVEIK SEQ ID NO: 25732 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTVTVSS SEQ ID NO: 29738 |
| iPS:434501 | 21-225_76G4 | NA | GAAATTGTGTTGACGCAGTCTCCAGGCACCCT GTCTTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGGCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGGAAAT CAAA SEQ ID NO: 25733 | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA SEQ ID NO: 29739 |

FIGURE 50
(Continued)

| | | | | |
|---|---|---|---|---|
| iPS:434503 | 21-225_74D7 | AA | EIVLTQSPGTLSLSPGERATLSCRASQSVYSSYLAWYQQKPGQAPRLLIYGASSRATGIPDRFSGSGSGTDFALTISRLEPEDCAVYYCQHSDNSPWTFGQGTKVEIK<br>SEQ ID NO: 25734 | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS<br>SEQ ID NO: 29740 |
| | | NA | GACATCCAGATGACCCAGTCTCCATCCTCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATTTGGGACAGAATTCACTCTCACCATCAGCAGCCTGCAGCCTGAAGATTTTGCAACTTATTACTGTCTTCAGCATAGTAATTACCCGCTCACTTTCGGCGGAGGGACCAAGGTGGAGATCAAA<br>SEQ ID NO: 25735 | CAACTGCAGCTGCAGGAGTGGGCCCAGGACTGGTGAAGCCTTCGGAGACCCTGTCCCTCACCTGCAGTGTCTCTGGTGGCTCCATCTTCAGAAGTAGTTACTACTGGGGCTGGATCCGCCAGCCCCCAGGGAAGGGGCTGGAGTGGATTGGGGGTATCTATTATAGTGGGAGCACCTCCTACAACCGTCCCTCAAGAGTCGAGTCACCATATCCGTAGACACGTCCGAGAACCAGTTCTCCCTGAAGCTGAGCTCTGTGACCGCCGCAGACACGGCTGTGGACTTTGACTACTGGGGCCAGGGAACCCTGGTCACCGTCTCCTCA<br>SEQ ID NO: 29741 |
| | | AA | DIQMTQSPSSLSASVGDRVTITCRASQGIRNDLGWYQQKPGKAPKRLIYAASSLQSGVPSRFSGSGFGTEFTLTISSLQPEDFATYYCLQHSNYPLTFGGGTKVEIK<br>SEQ ID NO: 25736 | QLQLQESGPGLVKPSETLSLTCSVSGGSIFRSSYYWGWIRQPPGKGLEWIGGIYYSGSTSYNPSLKSRVTISVDTSENQFSLKLSSVTAADTAVYYCARLRPNWDFDYWGQGTLVTVSS<br>SEQ ID NO: 29742 |

FIGURE 50
(Continued)

| | | | | |
|---|---|---|---|---|
| iPS:434507 | 21-225_74C5 | NA | GAAATTGTGTTGACGCAGTCTCCAGGCACCCT GTCTTTGTCTCCAGGGGAAAGAGCCACCCTCT CTTGCAGGGCCAGTCAGAGAGTGTTAACAGCAAC TACTTAGCCTGGTACCAGCAGAAACCTGGCCA GGCTCCCAGGCTCCTCATCTATGGTGCATTCA GCAGGGCCACTGGCATCCCAGACAGGGTCAGT GGCAGTGGGTCTGGGACAGATTCAATCTCAT CATCAGCAGACTGGAGCCTGAAGATTTTGCAG TGTATTACTGTCAGCAGTATGAAAGCTCACCG TGGACGTTCGGCCAAGGGACCAAGGTGGAAA TCAAA<br><br>SEQ ID NO: 25737 | CAGGTTGCAGCTACAACAGTGGGGCGCAGGACTG TTGAAGCCTTCGGAGAGCCCTGTCCTCACTTGCG CTGTCTATGTGGGTCCTTCAGTGGTTGCTACTG GAGCTGGATCCGCCAGCCCCCAGGGAAGGGCT GGAGTGGATTGGGGAAATCAATCATAGTGGATG CACCAACTTCAACCGTCCCTCAAGAGTCGAGTC ACCATATCAGTTGACAGTCCAAGAACCAGTTCT CCCTGAAGCTGAGCTCTGTGACCGCCGCGACAC GGCTGTGTATTACTGTGCGAGAGACTACGGCGGT ATGGACGTCTGGGGCCAAGGGACCACGGTCACC GTCTCCTCA<br><br>SEQ ID NO: 29743 |
| | | AA | EIVLTQSPGTLSLSPGERATLSCRASQSVNSNYLA WYQQKPGQAPRLLIYGAFSRATGIPDRVSGSGS GTDFNLIISRLEPEDFAVYYCQQYESSPWTFGQG TKVEIK<br><br>SEQ ID NO: 25738 | QVQLQQWGAGLLKPSETLSLTCAVYGGSFSGCYW SWIRQPPGKGLEWIGEINHSGCTNFNPSLKSRVTISV DTSKNQFSLKLSSVTAADTAVYYCARDYGGMDV WGQGTTVTVSS<br><br>SEQ ID NO: 29744 |
| iPS:434509 | 21-225_76F5 | NA | GTCATCGTGTTGACCCAGTCTCCAGACTCCCT GGCTGTGTCTCTGGGCGAGAGGGCCACCATCA ACTGCAAGTCCAGCCAGAGTGTATTACACAGC TCCAACAGTTACAACTTACTTAGCTTGGTACCA GCAGAAACCAGGACAGTCTCCTAAGGTGCTCA TTTACTGGACATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTAGTCCTCGACGTTCGGCCAAGG GACCAAGGTGGAAATCAAA<br><br>SEQ ID NO: 25739 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTATATGGAGCTGAGCAGCCTGAGATCTGA GGACACGGCCGTGTATTACTGTGCGAGTAGCAGT GGCTGGTACTGGTTGACCCCTGGGCCAGGGA ACCCTGGTCACCGTCTCCTCA<br><br>SEQ ID NO: 29745 |

FIGURE 50
(Continued)

| | | | | |
|---|---|---|---|---|
| iPS:434511 | 21-225_74B11 | AA | VIVLTQSPDSLAVSLGERATINCKSSQSVLHSSNS NYNLAWYQQKPGQSPKVLIYWTSTRESGVPDRF SGSGSGTDFTLTISSLQAEDVAVYYCQQYYSSPP TFGQGTKVEIK<br>SEQ ID NO: 25740 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCASSSGW YWFDPWGQGTLVTVSS<br>SEQ ID NO: 29746 |
| | | NA | GATATCGTGATGACCCAGTCTCCAGACTCCCT GACTGTGTCTCTGGGCGAGAGGGCCACCATCA ACTGCAAGTCCAGCCAGAGTATTTATACAAC TCCAACAATAACTACTTAGCTTGGTACCA GCAGAAACCAGGACAGCCTCCTAAGCTGCTCA TTTACTGGGCATCTACCCGGAATCCGGGGTC CCTGACCGATTCAGTGGCAGCGGGTCTGGGAC AGTCACCATGACCAGGAACACCTCCATAAGCAC AGCCTACATGGAGCTGAGCAGCCTGAGATCTGA CTGAAGATGTGGCAGTTTACTACTTTCGGCCAA TATTATAGCACTCCTCCTACTTTCGGCGGAGG GACCAAGGTGGAGATCAAA<br>SEQ ID NO: 25741 | CAGGTGCAGCTGGTGCAGTCTGGGGCTGAGGTG AAGAAGCCTGGGGCCTCAGTGAGGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAGTGG TAACACAGGCTATGCACAGAAGTTCAGGGCAG AGTCACCATGACCAGGAACACCTCCATAAGCAC AGCCTACATGGAGCTGAGCAGCCTGAGATCTGA GGACACGGCCGTGTATTACTGTGCGTATAGCAGT GGCTGGTACTACTTTGACTACTGGGGCCAGGGAA CCCTGGTCACCGTCTCCTCA<br>SEQ ID NO: 29747 |
| | | AA | DIVMTQSPDSLTVSLGERATINCKSSQSILYNSNN NNYLAWYQQKPGQPPKLLIYWASTRESGVPDRF SGSGSGTDFILTISSLQAEDVAVYYCQQYYSTPP TFGGGTKVEIK<br>SEQ ID NO: 25742 | QVQLVQSGAEVKKPGASVRVSCKASGYTFTNYDIN WVRQATGQGLEWMGWMHPNSGNTGYAQKFQGR VTMTRNTSISTAYMELSSLRSEDTAVYYCAYSSGW YYFDYWGQGTLVTVSS<br>SEQ ID NO: 29748 |

FIGURE 50
(Continued)

| | | | |
|---|---|---|---|
| iPS:434513 | 21-225_76A6 | NA | GAAATTGTGTTGACGCAGTCTCCAGGCACCCG GTCTTGGTCTCCAGGGGAAAGAGCCACCCTCT CGTGCAGGGCCAGTCAGAGTGTTAGCAGCAGC TACTTAGCCTGGTACCAGCAGAAACCTGGCCA GGCTCCCAGGCTCCTCATCTATGGTGCATCA CCAGGGCCACTGGCATCCAGACAGGTTCAGT GGCAGTGGGTCTGGGACAGACTTCACTCTCAC CATCAGCAGACTGGAGCCTGAATATTTTGCAG TTTATTACTGTCAGCAGTATGGTAACTCACCG CTCACTTTCGGCGGAGGGACCAAGGTGGAGAT CAAA | CAGGTGCAGCTGCAGTCGGGGCTGAGGTG AAGAAGCCTGGGGCCTCAGTGAAGGTCCTGC AAGGCTTCTGGATACACCTTCACCAATTATGATA TCAACTGGGTGCGACAGGCCACTGGACAAGGC TTGAGTGGATGGGATGGATGCACCCTAACAATGG TAACACAGGCTATGCACAGAAGTTCAGGGCAG AGTCACCATGACCAGGAACACTTCCATAAGCAC AGCCTACATGGAGCTGAACAGCCTGAGATCTGA GGACACGGCCGTGTATTACTGTGCGATTAGCAGT GGCTGGTACTGGTTCGACCCCTGGGGCCAGGGA ACCCTGGTCACCGTCCTTA |
| | | | SEQ ID NO: 25743 | SEQ ID NO: 29749 |
| | | AA | EIVLTQSPGTRSWSPGERATLSCRASQSVSSSYL AWYQQKPGQAPRLLIYGASTRATGIPDRFSGSGS GTDFTLTISRLEPEYFAVYYCQQYGNSPLTFGGG TKVEIK | QVQLVQSGAEVKKPGASVKVSCKASGYTFTNYDIN WVRQATGQGLEWMGWMHPNNGNTGYAQKFQGR VTMTRNTSISTAYMELNSLRSEDTAVYYCAISSGW YWFDPWGQGTLVTVSL |
| | | | SEQ ID NO: 25744 | SEQ ID NO: 29750 |
| iPS:434515 | 21-225_74A5 | NA | GAATTTATGTTGACGCAGTCTCCAGGCACCCT GTCTTTGTCTCCAGGGGAAAGAGCCACCCTCT CGTGCAGGGCCAGTCAGAGTGTTAGCAGCAGC TACTTAGTCTGGTATCAGCAGAAACCTGGCCA GGCTCCCAGGCTCCTCATCTATGGTGCATCA CCAGGGCCACTGGCATCCAGACAGGTTCAGT GGCAGTGGGTCTGGGACAGACTTCACTCTCAC CATCAGCAGACTGGAGCCTGAATATTTTGCAG TTTATTACTGTCAGCAGTATGGTTGCTCACCGC TCACTTTCGGCGGAGGGACCAAGGTGGAGATC ACA | CAGGTGCAGCTGCAGTCGGGGCTGAGGTG AAGAAGCCTGGGGCCTCAGTGAAGGTCCTGC AAGGCTTCTGGATACACCTTCACCAATTATGATA TCAACTGGGTGCGACAGGTCCCTGGACAAGGC TTGAGTGGATGGGATGGATGCACCCTAACAGTGG TAACACAGGCTATGCACAGAAGTTCCAGGGCAG AGTCACCATGACCAGGAACACCTCATCAGCAC AGCCTACATGGAGCTGAGCAGCCTGAGATCTGA GGACACGGCCGTGTATTACTGTGCGATTAGTAGT GGCTGGTACTGGTTCGACCCCTGGGGCCAGGGA ACCCTGGTCACCGTCCTCA |
| | | | SEQ ID NO: 25745 | SEQ ID NO: 29751 |

FIGURE 50
(Continued)

| | | | | |
|---|---|---|---|---|
| iPS:434517 | 21-225_76A7 | AA | EFMLTQSPGTLSLSPGERATLSCRASQSVSSSYL VWYQQKPGQAPRLLIYGASTRATGIPDRFSGSGS GTDFTLTISRLEPEYFAVYYCQQYGCSPLTFGGG TKVEIT<br>SEQ ID NO: 25746 | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS<br>SEQ ID NO: 29752 |
| | | NA | GAAATTGCGTTGACGCAGTCTCCAGGCACCCT GTCTTTGTCTCCAGGGGAAAGAGCCACCCTCT CCTGCAGGGCCAGTCCGAGTGTTGACAGCAGC TACTTAGCCTGGTACCAGCAGAGACCTGGCCA GGCTCCCAGGCTCCTCATCTATGGTGCATCCA GCAGGGCCCCTGGCATCCCAGACAGGTTCAGT GGCAGTGGGTCTGGGACAGATTCACTCTCAC CATCAGCAGACTGGAGCCTGAAGATTTTGCAG TGTATTACTGTCAGCAGTATGGATGCAGCCCTCTTACCG TGGACGTTCGGCCAAGGGACCAAGGTGGAAA TCAAA<br>SEQ ID NO: 25747 | CAGGTGCAGCTACAGCAGTGGGGCGCAGGACTG TTGAAGCCTTCGGAGACCCTGTCCTGTCACCTGCG CTGTCTATGGTGGGTCCTTCAGTGGTTGCTACTG GAGCTGGATCCGCCAGCCCCCAGGGAAGGGGCT GGAGTGGATTGGGGAAATCAATCATAGTGGAAG GACCAACTACAACCGTCCCTCAAGAGTCGAGTC ACCATATCAGTAGACACGTCCGAGAACCAGTTCT CCCTGAAGCTGAGCTCTGTGACCGCCGCGGACAC GGCTGTGTATTACTGTGCGAGAGATACGGTGGG CTTGACTACTGGGGCCAGGGAGCCCTGGTCACCG TCTCCTCA<br>SEQ ID NO: 29753 |
| | | AA | EIALTQSPGTLSLSPGERATLSCRASPSVDSSYLA WYQQRPGQAPRLLIYGASSRAPGIPDRFSGSGSG TDFTLTISRLEPEDFAVYYCQQYESSPWTFGQGT KVEIK<br>SEQ ID NO: 25748 | QVQLQQWGAGLLKPSETLSLTCAVYGGSFSGCYW SWIRQPPGKGLEWIGEINHSGRTNYNPSLKSRVTIS VDTSENQFSLKLSSVTAADTAVYYCARDYGGLDY WGQGALVTVSS<br>SEQ ID NO: 29754 |

FIGURE 50
(Continued)

| | | | |
|---|---|---|---|
| iPS:434519 | 21-225_74C7 | NA | GAAATTGTGTTGACGCAGTCGCCAGGCACCCT GTCTTTGTCTCCAGGGGAGAGCACCCTCT CCTGCAGGACCAGTCGAATGTTGACAGCAGC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCTGAAGATTTTGCAG TGTTTTACTGTCAGCAGTATGAACGCTCACCG TGGACGTTCGGCCAAGGGACCAAGGTGGAAA TCAAA<br><br>SEQ ID NO: 25749 | CAGGTGCAGTTACAGCAGTGGGGCGCAGGACTG TTGAAGCCTTCGGAGACCCTGTCCCTCACCTGCG CTGTCTATGGTGGGTCCTCAGTGGTTCCTACTG GAGCTGGATCCGCCAGCCCCAGGGAAGGGGCT GGAGTGGATTGGGGAAATCAATCTTAGTGGAAG CACCAACTACAACCCGTCCCTCAAGAGTCGAGTC ACCATATCAGTAGACACGTCAAGAGCCAGTTCT CCCTGACCGCTGCCTCTGTGACCGCCGCGGACAC GGCTGTGTATTACTGTGCGAGAGACTACGGTGGC CTTGACTACTGGGGCCAGGGAACCCTGGTCACCG TCTCCTCA<br><br>SEQ ID NO: 29755 |
| | | AA | EIVLTQSPGTLSLSPGERATLSCRTSPNVDSSYLA WYQQKPGQAPRLLIYGASSRATGIPDRFSGSGSG TDFTLTISRLEPEDFAVFYCQQYERSPWTFGQGT KVEIK<br><br>SEQ ID NO: 25750 | QVQLQQWGAGLLKPSETLSLTCAVYGGSLSGSYW SWIRQPPGKGLEWIGEINLSGSTNYNPSLKSRVTISV DTSKSQFSLTLRSVTAADTAVYYCARDYGGLDYW GQGTLVTVSS<br><br>SEQ ID NO: 29756 |
| iPS:434523 | 21-225_75C3 | NA | GAAATTGTGTTGACGCAGTCTCCAGGCACCCT GTCTTTGTCTCTCAAGGGAAAGAGCCACCCTCT CCTGCAGGGCCAGTCAGAGTGTTAGCAGCAGG TACTTAGCCTGGTACCAGCAGAAACCTGGCCA GGCTCCCAGAGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TATATTACTGTCAGCATTATGATAGCTCACCGT GGACGTTCGGCCAAGGGACCAAGGTGGAAAT CAAA<br><br>SEQ ID NO: 25751 | CAGGTGCAGCTACAGCAGTGGGGCGCAGGACCG TTGAAGCCTTCGGAGACCCTGTCCTCACCTGCG CTGTCTATGGTGGGTCCTTCAGTGGTTGCTACTG GAGCTGGATCCGCCAGCCCCCAGGGAAGGGGCT GGAGTGGATTGGGGAAATCAATTATATGTGGAAG AACCAACTACAACCCGTCCCTCAAGAGTCGAGTC ACCATATCAGTAGACACGTCAAGAACCAGTTCT CCCTGAAGCTGAGCTCTGTGACCGCCGCGGACAC GGCTGTGTATTACTGTGCGAGAGACTACGGCGGT ATGGACGTCTGGGGCCAAGGGACCACGGTCACC GTCTCCTCA<br><br>SEQ ID NO: 29757 |

FIGURE 50
(Continued)

| | | | | |
|---|---|---|---|---|
| iPS:434525 | 21-225_76E8 | AA | EIVLTQSPGTLSLSQGERATLSCRASQSVSSRYLAWYQQKPGQAPRLLIYGASSRATGIPDRFSGSGSGTDFTLTISRLEPEDFAVYYCQHYDSSPWTFGQGTKVEIK<br><br>SEQ ID NO: 25752 | QVQLQQGGAGPLKPSETLSLTCAVYGGSFSGCYWSWIRQPPGKGLEWIGEINYSGRTNYNPSLKSRVTISVDTSKNQFSLKLSSVTAADTAVYYCARDYGGMDVWGQGTTVTVSS<br><br>SEQ ID NO: 29758 |
| | | NA | GACATCGTGATGACCCAGTCTCCAGACTCCCTGGCTGTGTCTCTGGGCGAGAGGGCCACCATCAACTGCAAGTCCAGCCAGAGTGTTTTACACAGCTCCAACAATTATAACTACTTAGCTTGGTACCAGCAGAAGCCAGGACAGCCCCCTAAGGTGCTCATTTACTGGACATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAATATTTAGTAGTCCTCTGACGTTCGGCCAAGGGACCAAGGTGGAAATCAAA<br><br>SEQ ID NO: 25753 | CAGGTGCAGCTGGTGCAGTCTGGGGCTGAGGTGAAGAAGCCTGGGGCCTCAGTGAAGGTCTCCTGCAAGGCTTCTGATACACCTTCCCCAATTATGATATCAACTGGGTGCGACAGGCCACTGGACAAGGGCTTGAGTGGATGGGATGGATGAACCCTAACAGTGGTAACACAGGCTATGCACAGAAGTTCCAGGGCAGAGTCACCATGACCAGGAACACCTCCATAAGCACAGCCTACATGGAGCTGAGCAGCCTGAGATCTGAGGACACGGCCGTGTATTATTGTGCGGTTTCCAGTGGCTGGCACTGGTTCGACCCCTGGGGCCAGGGAACCCTGGTCACCGTCGCCTCA<br><br>SEQ ID NO: 29759 |
| | | AA | DIVMTQSPDSLAVSLGERATINCKSSQTVLHSSNNYNYLAWYQQKPGQPPKVLIYWTSTRESGVPDRFSGSGSGTDFTLTISSLQAEDVAVYYCQQYFSSPLTFGQGTKVEIK<br><br>SEQ ID NO: 25754 | QVQLVQSGAEVKKPGASVKVSCKASGYTFPNYDINWVRQATGQGLEWMGWMNPNSGNTGYAQKFQGRVTMTRNTISTAYMELSSLRSEDTAVYYCAVSSGWHWFDPWGQGTLVTVAS<br><br>SEQ ID NO: 29760 |

FIGURE 50
(Continued)

| | | | | |
|---|---|---|---|---|
| iPS:434529 | 21-225_76B9 | NA | GAATTTATGTTGACGCAGTCTCCAGGCACCCT GTCTTGGTCTCCAGGGGAAAGAGCCACCCTCT CGTGCAGGGCCAGTCAGAGTGTTAGCAGCAGC TACTTAGTCTGGTATCAGCAGAAACCTGGCCA GGCTCCCAGGCTCCTCATCTATGGTGCATCCA CCAGGGCCACTGGCATCCCAGACAGTTCAGT GGCAGTGGGTCTGGGACAGATTCACTCTCAC CATCAGCAGACTGGAGCCTGAATATTTTGCAG TTTATTACTGTCAGCAGTATATGGTTGCTCACGC TCACTTTCGGCGGAGGGACCAAGGTGGAAATCA ACA | CAGGTGCAGCTGGTGCAGTCTGGGGCTGAGGTG AAGAAGCCTGGGGCCTCAGTGAAGGTCTCCTGC AAGGCTTCTGATACACCTTCACCAATTATGATA TCAACTGGGTGCGACAGTTCCCTGGACAAGGC TTGAGTGGATGGGATGGATGCACAGAAGTTCCAGGCAG TAACACAGGCTATGCACAGAAGTTCCAGGGCAG AGTCACCATGACCAGGAACACCTCCATCAGCAC AGCCTACATGGAGCTGAGCAGCCTGAGATCGA GGACACGGCCGTGTATTACTGTGCGATTAGTAGT GGCTGGTACTGGTTCGACCCCTGGGGCCAGGGA ACCCTGGTCACCGTCTCCTCA |
| | | AA | EFMLTQSPGTLSWSPGERATLSCRASQSVSSSYL VWYQQKPGQAPRLLIYGASTRATGIPDRFSGSGS GTDFTLTISRLEPEYFAVYYCQQYGCSPLTFGGG TKVEIT | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS |
| | | | SEQ ID NO: 25755 | SEQ ID NO: 29761 |
| | | | SEQ ID NO: 25756 | SEQ ID NO: 29762 |
| iPS:434531 | 21-225_76C9 | NA | GAAATTGTGTTGACGCAGTCTCCAGGCACCCT GTCTTTGTCTCCAGGGGAAAGAGCCACCCTCT CCTGCAGGGCCAGTCAGAGTGTTAGCAGCAGT TACTTATCCTGGTACCAGCAGAAACCTGGCCA GGCTCCCAGGCTCCTCATCTATGGTGCATCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAGGTCACGG ACGTTCGGCCAAGGGACCAAGGTGGAAATCA GA | GAGGTGCAGCTGGTGGAGTCTGGGGGAGGCTTG GTAAAGCCTGGGGGGTCCTTAGACTCTCCTGTG CAGCCTCTGGATTCAGTTTCAGTAACGCCTGAT GAACTGGGTCCGCCAGGCTCCAGGGAAGGGGCT GGAGTGGGTTGGCCGTATTAAAACAAAGCTGA TGTTGGGACAACAGACTTCGCTGCACCCGTGAA AGGCAGATTCACCATCTCAAGAGATGATTCAAA ACACACGTGTATCTGCAAATGAACAGCCTGAA AACCGAGGACACAGCCGTGTATTACTGGTACCACA GTGGGACCTACTACGGACTACTGGGGCCAGGGA ACCCTGGTCACCGTCTCCTCA |
| | | | SEQ ID NO: 25757 | SEQ ID NO: 29763 |

FIGURE 50
(Continued)

| | | | | |
|---|---|---|---|---|
| iPS:434533 | 21-225_85F7 | AA | EIVLTQSPGTLSLSPGERATLSCRASQSVSSSYLS WYQQKPGQAPRLLIYGASSRATGIPDRFSGSGSG TDFTLTISRLEPEDFAVYYCQQYGRSRTFGQGTK VEIR<br>SEQ ID NO: 25758 | EVQLVESGGGLVKPGGSLRLSCAASGFSFSNAWM NWVRQAPGKGLEWVGRIKNKADGGTTDFAAPVK GRFTISRDDSKHTLYLQMNSLKTEDTAVYYCTTVG PTTDYWGQGTLVTVSS<br>SEQ ID NO: 29764 |
| | | NA | CAAGTGCAGCTACAGCAGTGGGGCGCAGGACTG TTGAAGCCTTCGGAGACCCTGTCCCTCACCTGCG CTGTCTATGGTGGGTCCTTCAGTGGTCCCTACTG GAGCTCGGATCCGCCAGCCCCCCGGGAAGGGCT GGAGTGGATTGGGAAATCAATCATAGTGGAAG CACCAACTACAACCGTCCTCAAGAGTCGAGTC ACCATATCAGTAGACAGTCCAAGAACCAGTTCT CCCTGAAACTGACCTCTGTGACCGCCGGGACAC GGCTGTGTATTACTGTGCGAGAGACTACGGGGGT TTGGACGTCTGGGGCCAAGGACCACGGTCACC GTCTCCTCA<br>SEQ ID NO: 29765 | GAACCTGTGTGACGCAGTCTCCAGGCACCCT GTCTTTGTCTCCAGGGGAAAGAGCCACCCTCT CCTGCAGGGCCAGTCAGTCAGAATATTTACAGCAAC TACTTAGCCTGGTACCAGCAGAAACCTGGCCA GGCTCCCAGGCTCCTCATCTATGGTGCATCA GCAGGGCCACTGGCATCCAGACAGGTTCAGT GGCAGTGGGTCGGACAGACTTCACTCTCAC CATCAGCAGACTGGAGCCTGAAGATTTTGCAG TGTATTGCTGTCAGCAGTATGAAAGCTCACCG TGGACCTTCGGCCAAGGGACCAAGGTGGAAA TCAAA<br>SEQ ID NO: 25759 |
| | | AA | EPVLTQSPGTLSLSPGERATLSCRASQNIYSNYLA WYQQKPGQAPRLLIYGASSRATGIPDRFSGSGSG TDFTLTISRLEPEDFAVYCCQQYESSPWTFGQGT KVEIK<br>SEQ ID NO: 25760 | QVQLQQWGAGLLKPSEPLSLTCAVYGGSFSGPYW SWIRQPPGKGLEWIGEINHSGSTNYNPSLKSRVTISV DTSKNQFSLKLTSVTAADTAVYYCARDYGGLDVW GQGTTVTVSS<br>SEQ ID NO: 29766 |

FIGURE 50
(Continued)

| | | | |
|---|---|---|---|
| iPS:434535 | 21-225_74C8 | NA | GACATCCAGATGACCCAGTCTCCATCTCCACT GTCTGCATCAGTAGGAGACAGAGTCACCATCA CTTGTCGGGCGAGTCAGGCATTGGCAAGTAT TTAGCCTGGTTTCAGCAGAAACCAGGGAAAGC CCCTAAGTCCCTGATCTATACTACATCCAATT ACAAAAGTGGGGCCCCATCAAGGTTCAGCGGC AGTGGATCTGGGACAGATTTCACTCTCACCAT CAGCAGCCTGCAGTATGAAGATTTTGCAACTT ATTACTGCCAACAGTACAGTTAATTACCCGCTC ACTTTCGGCGGAGGGACCAAGGTGGAGATCA AT | CAGGTGCAGCTGGTGCAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGTATGATGGAAGT AATAAAAAACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATGGCAG CTATGGTTATGACGGCCTTGACTACTGGGGCCAG GGAACCCTGGTCACCGTCTCCTCA |
| | | | SEQ ID NO: 25761 | SEQ ID NO: 29767 |
| | | AA | DIQMTQSPSSLSASVGDRVTITCRASQGIGKYLA WFQQKPGKAPKSLIYTSNLQSGAPSKFSGSGSG TDFTLTISSLQYEDFATYYCQQYSNYPLTFGGGT KVEIN | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDGSYG YDGLDYWGQGTLVTVSS |
| | | | SEQ ID NO: 25762 | SEQ ID NO: 29768 |
| iPS:434537 | 21-225_74E11 | NA | GAAATAGTGATGACGCAGTCTCCAGCCACCCT GTCTGTGTCTCCAGGGGAAAGAGCCACCCTCT CCTGCAGGGCCAGTCTGAGTGTTGTCAACAGC TTAGCCTGGTACCAGCAGAAACCTGGCCAGGC TCCCAGGCTCCTCATCCATGGTGCATCCACCA GGGCCACTGGTATCCCAGCCAGGTTCACTGGC AGTGGGTCTGGGACAGAGTTCACTCTCACCAT CAGCAGTCTGCAGTCTGAAGATTTTGCAACTT ATTACTGTCAGCAGTATAATGACTGGCCGTGC AGTTTTGGCCAGGGGACCAAGCTGGAGATCAA A | CAGGTGCAGCTGGTGCAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATTTGGTATGATGGAAGT AATAAATACTATGCAGACTCCGTGAAGGGCCGA TTCACCATCTCCAGAGACAATTCCAAGAACACGC TGTTTCTGCAAATGAACAGCCTGAGAGCCGAGG ACACGGCTGTGTATTACTGTGCGAGCGATCGCAA TATAGTGGGAGCTACTTACTTTGAGTCTGGGGC CAGGGAACCCTGGTCACCGTCTCCTCA |
| | | | SEQ ID NO: 25763 | SEQ ID NO: 29769 |

FIGURE 50
(Continued)

| | | | | |
|---|---|---|---|---|
| iPS:434539 | 21-225_74A2 | AA | EIVMTQSPATLSVSPGERATLSCRASLSVVNSLA WYQQKPGQAPRLLIHGASTRATGIPARFSGSGSG TEFTLTISSLQSEDFAIYYCQQYNDWPCSFGQGT KLEIK<br>SEQ ID NO: 25764 | QVQLVESGGGVVQPGRSLRLSCAASGFTFSSYGMH WVRQAPGKGLEWVAVIWYDGSNKYYADSVKGRF TISRDNSKNTLFLQMNSLRAEDTAVYYCASDRNIV GATYFESWGQGTLVTVSS<br>SEQ ID NO: 29770 |
| | | NA | GATATTGTGATGACTCAGTCTCCACTCTCCCTG CCCGTCACCCCTGGAGAGCCGGCCTCCATCTC CTGCAGGTCTAGTCAGAGCCTCGTGGTTAACAGT ATGGACACAACTATTTGGATTGGTACTACAG AAGCCAGGGCGGTCTCCACAGCTCCTGATCTA TTTGGGTTCTAATCGGGCTCCGGGGTCCCTG AGAGGTTCAGTGGCAGTGGATCAGGCACAGA TTTTACACTGAAAATCAGCAGAGTGGAGGCTG AGGATGTTGGGGTTTATTACTGCATGCAACCT CTACAAACTCCGTTCACTTTCGGCGGAGGGAC CAAGGTGGAGATCAAA<br>SEQ ID NO: 25765 | CAGGTGCAGGTACAGCAGTGGGGCGCAGGACTG TTGAAGCCTTCGGAGACCTGTCCTCACCTGCG CTGTCTATGGTGGGTCCTTCACTGATTACTACTGG AGCTGGATCCGCCAGCCCCCAGGGAAGGGCTG GAGTGGATTGGGAAATCAATCATAGTGGAGAC ACCAACTACAACCGTCCCTCAAGAGTCGAGTCA CCATATCAGTAGACACGTCCAAGAACCAGTTCTC CCTGAAGCTGAGTTCTGTGCAGAGAGTTTCCATATA GCTGTGTATTACTGCGAGAGAGTTTCCATATA GTGGAAGCTACCTCTACTACTACGGTATGGACGT CTGGGGCCAAGGGACCACGGTCACCGTCTCCTCA<br>SEQ ID NO: 29771 |
| | | AA | DIVMTQSPLSLPVTPGEPASISCRSSQSLLHSNGH NYLDWYLQKPGRSPQLLIYLGSNRASGVPERFS GSGSGTDFTLKISRVEAEDVGVYYCMQPLQTPF TFGGGTKVEIK<br>SEQ ID NO: 25766 | QVQVQQWGAGLLKPSETLSLTCAVYGGSFTDYYW SWIRQPPGKGLEWIGEINHSGDTNYNPSLKSRVTIS VDTSKNQFSLKLSSVTAADTAVYYCAREFPYSGSY LYYYGMDVWGQGTTVTVSS<br>SEQ ID NO: 29772 |

FIGURE 50
(Continued)

| | | | |
|---|---|---|---|
| iPS:434547 | 21-225_74H5 | NA | GAAATTGTGTTGACGCAGTCTCCAGGCACCCT GTCTTTGTCTCCAGGGGAGAGCCACCCTCT CCTGCAGGGCCAGTCAGAGTGTTAACAGCAAC TACTTAGCCTGGTACCGGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCATTCTCAT CATCAGCAGACTGGAGCTGAGGATTTTGCAG TGTATTACTGTCAGCAGTATGAAAGCTCGCCG TGGACGTTCGGCCAAGGGACCAAGGTGGAAA TCAAA<br><br>SEQ ID NO: 25767 | CAGGTGCAGCTACAACAGTGGGGCGCAGGACTG TTGAAGCCTTCGGAGACCCTGTCCTCACTTGCG CTGTCAATGGTGGGCCCTTCAGTGGTTGCTACTG GAGCTGGATCGCCAGCCCCCAGGGAAGGGGCT GGAGTGGATTGGGGAAATCAATCATAGTGGAAG GACCAACTTCAACCCGTCCTCAAGAGTCGAGTC ACCATATCAGTTGACACGTCCAAGAACCAGTTCT CCCTGAAGCTGAGCTCTGTGACCGCCGGACAC GGCTGTGTATTACTGTGCGAGAGACTACGGCGGT ATGGACGTCTGGGGCCAAGGGACCACGGTCACC GTCTCCTCA<br><br>SEQ ID NO: 29773 |
| | | AA | EIVLTQSPGTLSLSPGERATLSCRASQSVNSNYLA WYRQKPGQAPRLLIYGASSRATGIPDRFSGSGSG TDFTLTISRLEPEDFAVYYCQQYESSPWTFGQGTK VEIK<br><br>SEQ ID NO: 25768 | QVQLQQWGAGLLKPSETLSLTCAVNGGPFSGCYW SWIRQPPGKGLEWIGEINHSGRTNFNPSLKSRVTISV DTSKNQFSLKLSSVTAADTAVYYCARDYGGMDV WGQGTTVTVSS<br><br>SEQ ID NO: 29774 |
| iPS:434549 | 21-225_76E11 | NA | GACATCGTGATGACCCAGTCTCCAGACTCCCT GGCTGTGTCTCTGGGCGAGAGGGCCACCATCA ACTGCAAGTCCCGCCAGAGTGTTTTACAGCAA TCCAACAATTACAACTACTTAGCTTGGTACCA GCAGAAAGCAGGACAGCCTCCTAAACTGCTCA TTTACTGGGCTTCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAGA<br><br>SEQ ID NO: 25769 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTTTTACTGTGCATATAGCAG TGGCTGGTACTACTTTGACTACTGGGGCCAGGGA ACCCTGGTCACCGTCTCCTCA<br><br>SEQ ID NO: 29775 |

FIGURE 50
(Continued)

| | | | |
|---|---|---|---|
| | | AA | DIVMTQSPDSLAVSLGEGATINCKSRQSVLHSSN NYNYLAWYQQKAGQPPKLLIYWASTRESGVPD RFSGSGSGTDFTLTISSLQAEDVAVYYCQQYYST PPTFGQGTKVEIR<br>SEQ ID NO: 25770 | QVQLVQSGAEVKKPGASVKVSCKASGYTFTNYDIN WVRQATGQGLEWMGWMNPNSGNTGYAQKFQGR LTMTRNTSISTAYMELSSLRSEDTAVFYCAYSSGW YYFDYWGQGTLVTVSS<br>SEQ ID NO: 29776 |
| iPS:434551 | 21-225_75C4 | NA | GACATCGTGATGACCCAGTCTCCAGACTCCCT GGCTGTGTCTCTGGGCGAGAGGGCCACCATCA ACTGTAAGTCCAGCCAGAGTATTTTATACAGC TCCAACAATAATAACTACTTAGCTTGGTTCCA GCAGAAACCAGGACAGCCTCCTAAGCTGCTCA TTTATTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATATTACTCCTCCGACGTTCGGCCAAGG GACCAAGGTGGAAATCAAA<br>SEQ ID NO: 25771 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCATCCTAACAGTGG TAACACAGGCTATGCACAGAAGTTCCAGGCAG AGTCACCATGACCAGAACTGAGCAGCCTATAAGCAC AGCCTACATGAACTGAGCAGCCTGAGATCTGA GGACACGGCCGTGTATTACTGTGCGAGTAGCAGT GGCTGGTACTACTTTGACTACTGGGGCCAGGGAA CCCTGGTCACCGTCTCCTCA<br>SEQ ID NO: 29777 |
| | | AA | DIVMTQSPDSLAVSLGERATINCKSSQSILYSSNN NNYLAWFQQKPGQPPKLLIYWASTRESGVPDRF SGSGSGTDFTLTISSLQAEDVAVYYCQQYYITPP TFGQGTKVEIK<br>SEQ ID NO: 25772 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCASSSGW YYFDYWGQGTLVTVSS<br>SEQ ID NO: 29778 |

FIGURE 50
(Continued)

| | | | | |
|---|---|---|---|---|
| iPS:434559 | 21-225_74D11 | NA | GAAATTGTGTTGACGCAGTCTCCAGGCACCCT GTCTTTGTCTCCAGGGGAAAGAGCCACCCTCT CCTGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGCCACTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCACTATGATAACTCACCG TGGACGTTCGGCCAAGGGACCAAGGTGGAAA TCAAA SEQ ID NO: 25773 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCAGGGAAGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGACAC GGCTGTGTATTACTGTGCGAGGGACTACGGCGGT ATGGACGTCTGGGGCCAAGGGACCACGGTCACC GTCTCCTCA SEQ ID NO: 29779 |
| | | AA | EIVLTQSPGTLSLSPGERATLSCRASQSVYSSYLA WYQQKPGQAPRLLIYGASSRATGIPDRFSGSGSG TDFALTISRLEPEDFAVYYCQHYDNSPWTFGQG TKVEIK SEQ ID NO: 25774 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS SEQ ID NO: 29780 |
| iPS:434561 | 21-225_77G1 | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTATGATAACTCACCG TGGACGTTCGGCCAAGGGACCAAGGTGGAAA TCAAA SEQ ID NO: 25775 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCAGGGAAGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGACAC GGCTGTGTATTACTGTGCGAGGGACTACGGCGGT ATGGACGTCTGGGGCCAAGGGACCACGGTCACC GTCTCCTCA SEQ ID NO: 29781 |

FIGURE 50
(Continued)

| | | | | |
|---|---|---|---|---|
| iPS:434563 | 21-225_75D8 | AA | EIVLTQSPGTLYLSPGERATLSCRASQSVSSYLA WYQQKPGQAPRLLIYGASSRATGIPDRFSGSGSG TDFALTISRLEPEDCAVYYCQHYDNSPWTFGQG TKVEIK<br>SEQ ID NO: 25776 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTSS<br>SEQ ID NO: 29782 |
| | | NA | GATATTGTGATGACTCAGTCTCCACTCTCCCTG CCCGTCACCCCTGGAGAGCCGGCCTCCATCTC CTGCAGGTCTAGTCAGAGCCTCCTGCATAGTA GTGGATACAACTATTTGGATTGGTACCTGCAG AAGCCAGGGCAGTCTCCACAGCTCCTGATCTA TTTGGGTTCTAATGGGCCTCCGGGTCCCTG ACAGGTTCAGTGGCAGTGGATCAGGCTCAGAT TTTACACTGAAGATCAGCAGAGTGGAGGCTGA GGATGTTGGACTTTATTACTGCATGCAAGCTC TACACCCCTCCTCCACTTTCGGCGGAGGGACC AAGGTGGAGATCAAA<br>SEQ ID NO: 25777 | GAGGTGCAGCTGGTGGAGTCTGGGGGAGGCTTG GTACAGCCGGGGGGGTCCCTGAGACTCTCCTGTG CAGCCTCTGGATTCACCTTCAGTAGCTAACTACGACAT GCACTGGGTCCGCCAAGCTACAGGAAAGGTCT GGAGTGGGTCTCAGTTATTGGTACTGCTGGTGAC ACATACTATCAGGCTCCGTGAAGGGCCGATTCA CCATCTCCAGAGAAATGCCAAGAACTCCTGTA TCTTCAAATGAACAGCCTGAGAGCCGGGACAC GGCTGTGTATTACTGTGCAAGAGTTCTTGACTAC GGTGACTCCTTGGGCTACTACTACTACGGTATGG ACGTCTGGGGCCAAGGGACCACGGTCACCGTCTC CTCA<br>SEQ ID NO: 29783 |
| | | AA | DIVMTQSPLSLPVTPGEPASISCRSSQSLLHSSGY NYLDWYLQKPGQSPQLLIYLGSNRASGVPDRFS GSGSGSDFTLKISRVEAEDVGLYCMQALHPPL TFGGGTKVEIK<br>SEQ ID NO: 25778 | EVQLVESGGGLVQPGGSLRLSCAASGFTFSNYDMH WVRQATGKGLEWVSAIGTAGDTYYPGSVKGRFTIS RENAKNSLYLQMNSLRAGDTAVYYCARVLDYGDS LGYYYYGMDVWGQGTTVTSS<br>SEQ ID NO: 29784 |

FIGURE 50
(Continued)

| | | | |
|---|---|---|---|
| iPS:434565 | 21-225_75B10 | NA | GAAATTGTGTTGACGCAGTCTCCAGGCACCCT ATCTTTGTCTCCAGGGGAAAGAGCCACCCTCT CCTGCAGGGCCAGTCCGAGTGTTAACAGCTAC TACTTAGCCTGGTACCAGCAGAAAACCTGGCCA GGCTCCCAGGCTCCTCATCTATGGTGCAACCA GCAGGGCCACTGGCATCCCAGACAGGTTCAGT GGCAGTGGGTCTGGAACAGACTTCACTCTCAC CATCAGCAGACTGGAGCCTGAAGATTTTGCAG TTTATTTCTGTCAGCAGTATGAAGACTCACCGT GGACGTTCGGCCAAGGGACCAAGGTGGAAAT CAAA SEQ ID NO: 25779 | CAGGTGCAGCTACAGCAGTGGGGCGCAGGACTG TTGAAGCCTTCGGAGACCCTGTCCCTCAAATGCG ATGTCTATGTGGGTCCTTCAGTGGTTACTACTG GAGCTGGATCCGCCAGCCCCCAGGGAAGGGGCT GGAGTGGATTGGGGAAATCAATCACAGTGGAAG CACCAACTACAACCGTCCCTCAAGAGTCGAGTC ACCATATCAGTAGACACGTCCAAGAACCAGTTCT CCCTGAAGCTGAGCTCTGTGACCGCCGCGACAC GGCTGTGTATTACTGTGCGAGAGACTACGGTGGT TTGGACGTCTGGGGCCAAGGGACCACGGTCACC GTCTCCTCA SEQ ID NO: 29785 |
| | | AA | EIVLTQSPGTLSLSPGERATLSCRASPSVNSYYLA WYQQKPGQAPRLLIYGATSRATGIPDRFSGSGSG TDFTLTISRLEPEDFAVYFCQQYEDSPWTFGQGT KVEIK SEQ ID NO: 25780 | QVQLQQWGAGLLKPSETLSLKCDVYGGSFSGYYW SWIRQPPGKGLEWIGEINHSGSTNYNPSLKSRVTISV DTSKNQFSLKLSSVTAADTAVYYCARDYGGLDVW GQGTTVTVSS SEQ ID NO: 29786 |
| iPS:434569 | 21-225_77H5 | NA | GAAATAGTGATGACGCAGTCTCCAGTCACCCT GTCTGTCTCCAGGGGAAAGAGCCACCCTCT CCTGCAGGGCCAGTCAGAGTGTTAGCAGC CAGCGTCTGGATTCACCTTCAGTAATTATGCAT TTAGCCTGGTACCAGCAGAAACCTGGCCTGGC TCCCAGGCTCCTCATCTATGGTGCATCCACCA GGGCCACTGGTATCCCAGCCAGGTTCAGTGGC AGTGGGTCTGGGACAGAGTTCTCTTTTACCAT CAGCAGCCTGCAGTCTGAAGATTTTGCAGTTT ATTTCTGTCAGCAGTATAATGACTGGCCGTGC AGTTTTGGCCAGGGCTCCAAGCTGGAGATCCA A SEQ ID NO: 25781 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAATTATGGCAT GCACTGGGTCCGCCAGGCTCCAGGCAAGGGGCT GGAGTGGGTGGCAGTTATATGGTATGATGGAAG AATAAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTCTATATTACTGTGCGAGAGATCGGA GTATATTGGGAGCTACTTTCTTTGACTACTGGGG CCAGGGAACCCTGGTCACCGTCTCCTCA SEQ ID NO: 29787 |

FIGURE 50
(Continued)

| | | | |
|---|---|---|---|
| iPS:434571 | 21-225_74D2 | AA | EIVMTQSPVTLSVSPGERATLSCRASQSVSSSLA WYQQKPGLAPRLLIYGASTRATGIPARFSGSGSG TEFSFTISSLQSEDFAVYFCQQYNDWPCSFGQGS KLEIQ<br>SEQ ID NO: 25782 | QVQLVESGGGVVQPGRSLRLSCAASGFTFSNYGM HWVRQAPGKGLEWVAVIWYDGRNKYYADSVKG RFTISRDNSKNTLYLQMNSLRAEDTALYYCARDRSI LGATFFDYWGQGTLVTVSS<br>SEQ ID NO: 29788 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTGACAGCAAC TACTTAGCCTGGTACCAGCAGAAACCTGGCCA GGCTCCCAGGCTCCTCATCTATGGTGCATCCA GCAGGGCCCCTGGCATCCCAGACAGGTTCAGT GGCAGTGGGTCTGGGACAGACTTCACTCTCAC CATCAACAGACTGGAGCCTGAAGATTTTGCAG TGTATTTCTGTCAGCAGTATAATGAAAGCTCACCG TGGACGTTCGGCCAAGGGACCAAGGTGGAAA TCAAA<br>SEQ ID NO: 25783 | CAGGTGCAGCTACAGCAGTGGGGCGCAGGACTG TTGAAGCCTTCGGAGACCCTGTCCTCACCTGCG CTGTCTATGTGTGGGTCCTTCAGTGGTTGCTACTG GAGCTGGATCGCCAGCCCCCAGGGAAGGGGCT GGAGTGGATTGGGGAAATCAATCATAGTGGAAG GACCAACTACAACCCGTCCTCAAGAGTCGAGTC ACCATCTCAGTAGACACGTCGAGAACCAGTTCT CCCTGAAGTTGAGCTCTGTGACCGCCGCGGACAC GGCTGTGTATTACTGTGCGAGAGACTACGGTGGG CTTGACTACTGGGGCCAGGGAACCCTGGTCACCG TCTCCTCA<br>SEQ ID NO: 29789 |
| | | AA | EIVLTQSPGTLSLSPGERATLSCRASQSVDSNYLA WYQQKPGQAPRLLIYGASSRAPGIPDRFSGSGSG TDFTLTINRLEPEDFAVYFCQQYESSPWTFGQGT KVEIK<br>SEQ ID NO: 25784 | QVQLQQWGAGLLKPSETLSLTCAVYGGSFSGCYW SWIRQPPGKGLEWIGEINHSGRTNYNPSLKSRVTIS VDTSENQFSLKLSSVTAADTAVYYCARDYGGLDY WGQGTLVTVSS<br>SEQ ID NO: 29790 |

FIGURE 50
(Continued)

| | | | |
|---|---|---|---|
| iPS:434573 | 21-225_77E6 | NA | GACATCCAGATGACCCAGTCTCCATCCTCACT GTCTGCATCTGTAGGAGACAGAGTCACCATCA CTTGTCGGGCGAGTCAGGGCATTAGCAGTAT TTAGCCTGGTTTCAGCAGAAACCAGGGAAAGC CCCTAAGTCCCTGATCTATGCTGCATCCAGTTT GCAAGGTGGGGCCCCATCAAAGTTCAGCGGC AGTGGATCTGGGACAGATTTCACTCTCACCAT CAGCAGCCTGCAGCCTGAAGATTTTGCAACTT ATTACTGCCAACAGTACAGTAATTACCCGCTC ACTTTCGGCGGAGGGACCAAGGTGGAGATCA AA<br>SEQ ID NO: 25785 | CAGGTGCAGCTGGTGGAGTCTGGGGGAGGCGTG GTCCAGTCTGGGAGGTCCCTGAGACTCTCCTGTG CAGCGTCTGATTCACCTTCAGTGACTAGCTATGGCAT GCACTGGGTCCGCCAGGCTCCAGGCAAGGGCT GGAGTGGGTGGCAGTTATATGTATGATGGAAGT AATCAAAACTATGCAGACTCCGTGAAGGGCCGA TTCACCATCTCCAGAGACAATTCCAAGAACACGC TGTTTCTGCAAATGAACAGCCTGAGAGCCGAGG ACACGGCTGTGTATTACTGTGCGAGAGATGGCAG CTATGGTTACGACGGCCTTGACTACTGGGGCCAG GGAACCCTGGTCACCGTCTCCTCA<br>SEQ ID NO: 29791 |
| | | AA | DIQMTQSPSSLSASVGDRVTITCRASQGISKYLA WFQQKPGKAPKSLIYAASSLQGGAPSKFSGSGS GTDFTLTISSLQPEDFATYYCQQYSNYPLTFGGG TRVEIK<br>SEQ ID NO: 25786 | QVQLVESGGGVVQSGRSLRLSCAASGFTFSSYGMH WVRQAPGKGLEWVAVIWYDGSNQNYADSVKGRF TISRDNSKNTLFLQMNSLRAEDTAVYYCARDGSYG YDGLDYWGQGTLVTVSS<br>SEQ ID NO: 29792 |
| iPS:434575 | 21-225_77C7 | NA | GACATCGTGATGACCCAGTCTCCAGACTCCCT GGCTGTGTCTCTGGGCGAGAGGGCCACCATCA ACTGCAAGTCCAGCCAGACTGTTTTACACAGC TCCAACAATTATAACTACTTAGCTTGGTACCA GCAGAAAGCCAGGACAGCCCCCTAAGGTGCTCC TTTACTGGACATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTATTACTGTCAGCAA TATTTTAGTAGTCCTCCGACGTTCGGCCAAGG GACCAGGGTGGAAATCAAA<br>SEQ ID NO: 25787 | CAGGTGCAGCTGGTGCAGTCTGGGGCTGAGGTG AAGAAGCCTGGGGCCTCAGTGAAGGTCTCTGC AAGGCTTCTGGATACACCTTCCCCAATTATGATA TCAACTGGGTGCGACAGGCCACTGGACAAGGC TTGAGTGGATGGGATGGATGAACCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTATTGTGCGGTTTCCAG TGGCTGGCACTGGTTCGACCCCTGGGGCCAGGGA ACCCTGGTCACCGTCGCCTCA<br>SEQ ID NO: 29793 |

FIGURE 50
(Continued)

| | | | |
|---|---|---|---|
| iPS:434579 | 21-225_77F7 | AA | DIVMTQSPDSLAVSLGERATINCKSSQTVLHSSN NYNYLAWYQQKPGQPPKVLLYWTSTRESGVPD RFSGSGSGTDFTLTISSLQAEDVAVYYCQQYFSS PPTFGQGTRVEIK<br>SEQ ID NO: 25788 | QVQLVQSGAEVKKPGASVKVSCKASGYTFPNYDIN WVRQATGQGLEWMGWMNPNSGNTGYAQKFQGR VTMTRNTSISTAYMELSSLRSEDTAVYYCAVSSGW HWFDPWGQGTLVTVAS<br>SEQ ID NO: 29794 |
| | | NA | GAAATTGTGTTGACGCAGTCTCCAGGCACCCT GTATTTGTCTCCAGGGGAAAGAGCCACCCTGT CATGCAGGGCCAGTCAGAGTGTTTACAGCAGC TACTTAGCGTGGTACCAGCAGAAACCTGGCCA GGCTCCCAGGCTCTCATCATTTATGGTGCATCCA GCCGGGGCCACTGGCATCCCAGACAGGTTCAGT GGCAGTGGGTGTGGGACAGACTTCGCTCTCAC CATCAGCAGAGTGGAGCATGAAGATTGTGCA GTGTATTACTGTCAGCACTATGATAACTCACC GTGGACGTTCGGCCAAGGGACCAAGGTGGAA ATCAAA<br>SEQ ID NO: 25789 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCCAGGGAAGGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br>SEQ ID NO: 29795 |
| | | AA | EIVLTQSPGTLYLSPGERATLSCRASQSVYSSYLA WYQQKPGQAPRLIIYGASSRATGIPDRFSGSGCG TDFALTISRVEHEDCAVYYCQHYDNSPWTFGQG TKVEIK<br>SEQ ID NO: 25790 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29796 |

FIGURE 50
(Continued)

| | | | |
|---|---|---|---|
| iPS:434581 | 21-225_74B12 | NA | GAAATTGTGTTGACGCAGTCTCCAGGCACCCT GTATTGTCTCCAGGGGAAAGAGCCACCCTCT CCTGCAGGGCCAGTCAGAGTGTTACAGCAGC TACTTAGCCTGGTACCAGCAGAAACCTGGCCA GGCTCCCAGGCTCCTCATTTATGGTGCATCCA GCCGGTCCACTGGCATCCCAGACACAGTTCAGT GGCAGTGGGTCTGGGACAGACTTCACTCTCAC CATCAGCAGACTGGAGCTGAAGATTTTGCAG TGTATTACTGTCAGCACTATGATAACTCACCG TGGACGTTCGGCCAAGGGACCAAGGTGGAAA TCAAA <br> SEQ ID NO: 25791 | CAGGTGCAGCTACAGCAGTGGGGCGCAGGACTG TTGAAGCCTTCGGAGACCGTCCTCCTCACCTGCG CTGTCCATGTGGGTCCTTCAGTGGTTGCTACTG GAGCTGGATCCGCCAGCCCCAGGGAAGGGCT GGAGTGGATTGGGGAAATCAATCATAGTGGAAG CACCAACTACACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA <br> SEQ ID NO: 29797 |
| | | AA | EIVLTQSPGTLYLSPGERATLSCRASQSVYSSYLA WYQQKPGQAPRLLIYGASSRSTGIPDRFSGSGSG TDFALTISRLEPEDFAVYYCQHYDNSPWTFGQG TKVEIK <br> SEQ ID NO: 25792 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS <br> SEQ ID NO: 29798 |
| iPS:434583 | 21-225_74B6 | NA | GAAATTGTGTTGACGCAGTCTCCAGGCACCCT GTCTTTGTCTCCAGGGGAAAGAGCCACCCTCT CCTGCAGGGCCAGTCAGAGTGTTAGCAGCAGC TACTTAGCCTGGTACCAGCAGAAACCTGGCCA GGCTCCCAGGCTCCTCATCTATGGTGCATCCA CCAGGGCCACTGGCATCCCAGACAGGTTCAGT GGCAGTGGGTCTGGGACAGACTTCACTCTCAC CATCAGCAGACTGGAGCCTGAATATTTTGCAG TTTATTACTGTCAGCAGTATGGTAACTCACCG CTCACTTTCGGCGGAGGGACCAAGGTGGAGAT CAAA <br> SEQ ID NO: 25793 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAACAATGG TAACACAGGCTATGCACAGAAGTTCCAGGCAG AGTCACCATGACCAGGAACACCTCCATAAGCAC AGCCTACATGGAGCTGAACAGCCTGAGATCTGA GGACACGGCCGTGTATTACTGTGCGATTAGCAGT GGCTGGTACTGGTTCGACCCCTGGGGCCAGGGA ACCCTGGTCACCGTCTCCTTA <br> SEQ ID NO: 29799 |

FIGURE 50
(Continued)

| | | | |
|---|---|---|---|
| iPS:434585 | 21-225_75A12 | AA | EIVLTQSPGTLSLSPGERATLSCRASQSVSSSYLA WYQQKPGQAPRLLIYGASTRATGIPDRFSGSGSG TDFTLTISRLEPEYFAVYYCQQYGNSPLTFGGGT KVEIK<br>SEQ ID NO: 25794 | QVQLVQSGAEVKKPGASVKVSCKASGYTFTNYDIN WVRQATGQGLEWMGWMHPNNGNTGYAQKFQGR VTMTRNTSISTAYMELNSLRSEDTAVYYCAISSGW YWFDPWGQGTLVTVSL<br>SEQ ID NO: 29800 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTAGCAGCAGG TACTTAGCCTGGTACCAGCAGAAACCTGGCCA GGCTCCCAGACTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGCAGATTTTGCAG TATATTACTGTCAGCAGTATGGTAGTCCACCGT GGACGTTCGGCCAAGGGACCAAGGTGGAAAT CAAA<br>SEQ ID NO: 25795 | CAGGTGCAGCTACAGCAGGGGGCGCAGGACCG TTGAAGCCTTCGGAGACCCTGTCCTCACTGCG CTGTCTATGTGGGTCTTCAGTGGTTGCTACTG GAGCTGGATCGCCAGCCCCCAGGGAAGGGGCT GGAGTGGATTGGGAAATCAATTATAGTGGAAG AACCAACTACAACCGTCTCCAAGAGTCGAGTC ACCATATCAGTAGACACGTCCAAGAACCAGTTCT CCCTGAAGCTGAGCTCTGTGACCGCCGGACAC GGCTGTGTATTACTGTGCGAGAGACTACGGCGGT ATGGACGTCTGGGGCCAAGGGACCACGGTCACC GTCTCCTCA<br>SEQ ID NO: 29801 |
| | | AA | EIVLTQSPGTLSLSPGERATLSCRASSQVSSRYLA WYQQKPGQAPRLLIYGASSRATGIPDRFSGSGSG TDFTLTISRLEPADFAVYYCQHYDSSPWTFGQGT KVEIK<br>SEQ ID NO: 25796 | QVQLQQGGAGPLKPSETLSLTCAVYGGSFSGCYWS WIRQPPGKGLEWIGEINYSGRTNYNPSLKSRVTISV DTSKNQFSLKLSSVTAADTAVYYCARDYGGMDV WGQGTTVTVSS<br>SEQ ID NO: 29802 |

FIGURE 50
(Continued)

| | | | |
|---|---|---|---|
| iPS:434587 | 21-225_74G3 | NA | GAATTTATGTTGACGCAGTCTCCAGGCACCCT GTGTTGGTCTCCAGGGGAAAGAGCCACCCTCT CGTGCAGGGCCAGTCAGAGTGTTAGCAGCAGC TACTTAGTCTGGTATCAGCAGAAACCTGGCCA GGCTCCCAGGCTCCTCATCTATGGTGCATCCA CCAGGGCCACTGGCATCCCAGACACTTCAGT GGCAGTGGGTCTGGGACAGATTCACTCTCAC CATCAGCAGACTGGAGCTGAAGATGCTGCAG TTTATTACTGTCAGCAGTATGGTTGCTCACCGC TCACTTTCGGCGGAGGGACCAAGGTGGAGATC ACA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGTCCTGGACAAGGGC TTGAGTGGATGGGATGGATGCACCTAACAGTGG TAACACAGGCTATGCACAGAAGTTCCAGGGCAG AGTCACCATGACCAGGAACACCTCCATCAGCAC AGCCTACATGGAGCTGAGCAGCCTGAGATCTGA GGACACGGCCGTGTATTACTGTGCGATTAGTAGT GGCTGGTACTGGTTCGACCCCTGGGGCCAGGGA ACCCTGGTCACCGTCTCCTCA |
| | | | SEQ ID NO: 25797 | SEQ ID NO: 29803 |
| | | AA | EFMLTQSPGTLCWSPGERATLSCRASQSVSSSYL VWYQQKPGQAPRLLIYGASTRATGIPDRFSGSGS GTDFTLTISRLEPEYFAVYYCQQYGCSPLTFGGG TKVEIT | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS |
| | | | SEQ ID NO: 25798 | SEQ ID NO: 29804 |
| iPS:434595 | 21-225_77A10 | NA | GAAATTGTGTTGACGCAGTCTCCAGGCACCCT GTCTTTGTCTCCAGGGGAGAGAGCCACCCTCT CCTGCAGGGCCAGTCAGAGTGTTACAGCAGG TACTTAGCCTGGTACCAGCAGAAACCTGGCCA GGCTCCCAAACTCCTCATCTTTGGTGCATCCA GCAGGGCCACTGGCATCCCAGACAGGTTCAGT GGCAGTGGGTCTGGGACGGACTTCACTCTCAC CATCAGCAGACTGGAGCCTGAAGATTTTGCAG TATTACTGTCAGCAGTATTATGATAGCTCACCGT GGACGTTCGGCCAAGGGACCAAGGTGGAAAT CAAA | CAGGTGCAGCTACAACAGGGGGGCGCAGGACCG TTGAAGCCTTCGGAGACCCTGTCCCTCACCTGCG CTGTCTATGGTGGGTCCTTCAGTGGTTGCTACTG GAGCTGGATCCGCCAGCCCCCAGGGAAGGGGCT GGAGTGGATTGGGGAAATCAATTATAGTGGAAAG AACCAACTACAACCGTCCCTCAAGAGTCGAGTC ACCATATCAGTAGACACGTCCAAGAACCAGTTCT CCCTGAAGCTGAGCTCTGTGACCGCCGCGGACAC GGCTGTGTATTACTGTGCGAGAGACTACGCGGTT ATGGACGTCTGGGGCCAAGGGACCACGGTCACC GTCTCCTCA |
| | | | SEQ ID NO: 25799 | SEQ ID NO: 29805 |

FIGURE 50
(Continued)

| | | | | |
|---|---|---|---|---|
| iPS:434597 | 21-225_77C10 | AA | EIVLTQSPGTLSLSPGERATLSCRASQSVHSRYLA WYQQKPGQAPKLLIFGASSRATGIPDRFSGSGSG TDFTLTISRLEPEDFAVYYCQHYDSSPWTFGQGT KVEIK<br><br>SEQ ID NO: 25800 | QVQLVQQGAGPLKPSETLSLTCAVYGGSFSGCYWS WIRQPPGKGLEWIGEINYSGRTNYNPSLKSRVTISV DTSKNQFSLKLSSVTAADTAVYYCARDYGGMDV WGQGTTVTVSS<br><br>SEQ ID NO: 29806 |
| | | NA | GACATCGTGATGACCCAGTCTCCAGATTGCT GGCTGTGTCTCTGGGCGAGAGGGCCACCATCA ACTGCAAGTCCAGCAGTGATGTTTATACACC TCCAACAATAACAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTTGCAGTTTATTATTGTCAGCACT ATTATAATACTCCGTGAAGTTTGTCCAAGGG ACCAAGGTGGAAATCACA<br><br>SEQ ID NO: 25801 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGGTTCGACCCCTGGGGCCAGGA ACCCTGGTCACCGTCCCTCA<br><br>SEQ ID NO: 29807 |
| | | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQHYYNT PWKFVQGTKVEIT<br><br>SEQ ID NO: 25802 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS<br><br>SEQ ID NO: 29808 |

FIGURE 50
(Continued)

| | | | |
|---|---|---|---|
| iPS:434603 | 21-225_77D11 | NA | GAATTTATGTTGACGCAGTCTCCAGGCACCCT GTATTGGTCTCCAGGGGAAAGAGCCACCATCT CGTGCAGGGCCAGTCAGAGTGTTAGCAGCAGC TACTTAGTTGGTATCAGCAGAAACCTGGCCA GGCTCCCAGGCTCCTCATCTATGGTGCATCCA CCAGGGCCACTGGCATCCCAGACAGGTTCAGT GGCAGTGGGTCTGGGACAGATCCACTCTCAC CATCAGCAGACTGGAGCCTGAATATTTTGCAG TTTATTACTGTCAGCAGTATGGTTGCTCACCGC TCACTTTCGGCGGAGGGACCAAGGTGGAGATC ACA<br>SEQ ID NO: 25803 | CAGGTGCAGCTGGTGCAGTCTGGGGCTGAGGTG AAGAAGCCTGGGGCCTCAGTGAAGGTCCTGC AAGGCTTCTGGATACACCTTCACCAATTATGATA TCAACTGGGTGCGACAGGTCCCTGGACAAGGGC TTGAGTGGATGGGATGGATGCACCTAACAGTGG TAACACAGGCTATGCACAGAAGTTCCAGGGCAG AGTCACCATGACCAGAAACACCTCCATCAGCAC AGCCTACATGGAGCTGAGCAGCCTGAGATCTGA GGACACGGCCGTGTATTACTGTGCGATTAGTAGT GGCTGGTACTGGTTCGACCCCTGGGGCCAGGGA ACCCTGGTCACCGTCCTCCA<br>SEQ ID NO: 29809 |
| | | AA | EFMLTQSPGTLYWSPGERATISCRASQSVSSSYL VWYQQKPGQAPRLLIYGASTRATGIPDRFSGSGS GTDFTLTISRLEPEYFAVYYCQQYGCSPLTFGGG TKVEIT<br>SEQ ID NO: 25804 | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS<br>SEQ ID NO: 29810 |
| iPS:434611 | 21-225_77C12 | NA | GAAATTGTGTTGACGCAGTCTCCAGGCACCCT GTCTTTGTCTCCAGGGGAAAGAGCCACCCTCT CCTGCAGGGCCAGCAGAGTGTTGACAGCAGT TATTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGGCTGGAACCTGAAGATTTTGCAG TATTATTACTGTCAGCAGTATGAAAGCTCACCG TGGACGTTCGGCCAAGGGACCAAGGTGGAAA TCAAA<br>SEQ ID NO: 25805 | CAGGTGCAGCTACAGCAGTGGGGCGCAGGACTG TTGAAGCCTTCGGAGACCCTGTCCCTCACCTGCG CTGTCTATGGTGGGGCCTTCAGTGGTTCCTACTG GAGCTGGATCCGCCAGTCCCCAGGGAAGGGCT GGAGTGGATTGGGGAAATCAATTATAGGGGAAG CACCAACTACAACCCGTCCCTCAAGAGTCGAGTC ACCATATCAGTAGACACGTCCAAGAACCAGTTCT CCCTGAACCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br>SEQ ID NO: 29811 |

FIGURE 50
(Continued)

| | | | | |
|---|---|---|---|---|
| iPS:434613 | 21-225_77D12 | AA | EIVLTQSPGTLSLSPGERATLSCRARQSVDSSYLA WYQQKRGQAPRLLIYGASSRATGIPDRFSGSGSG TDFTLTISRLEPEDFAVYYCQQYESSPWTFGQGT KVEIK<br>SEQ ID NO: 25806 | QVQLQQWGAGLLKPSETLSLTCAVYGGAFSGSYW SWIRQSPGKGLEWIGEINYRGSTNYNPSLKSRVTIS VDTSKNQFSLNLSSVTAADTAVYYCARDYGGMDV WGQGTTVTVSS<br>SEQ ID NO: 29812 |
| | | NA | GACATCGTGATGACCCAGTCTCCAGACTCCCT GGCTGTGTCTCTGGGCGCGAGAGTGTTTATACAGC ATTGCAGGTCCAGCCAGAGTGTTTATACAGC TCCAACAATTATAACTACTTAGCTTGGTACCA GCAGAAACCAGGACAGCCTCCTAAGCTGCTCA TTTATGGGCATCTACCCGGATTCCGGGGTC CCTGACCGATTCAGTGGCAGCGGGTCTGGGAC AGATTTCACTCTCACCATCAGCAGCCTGCAGG CTGAAGATGTGGCCGTTTATTACTGTCAGCAA TATTATACTACTCCGTGCAGTTTTGGCCAGGG GACCAAGCTGGAGATCAAG<br>SEQ ID NO: 25807 | CAGGTGCAGCTGGTGCAGTCTGGGGCTGAGGTG AAGAAGCCTGGGGCCTCAGTGAAGGTCTCTGC AAGGCTTCTGGATACACCTTCACCAATTATGATA TCAACTGGGTGCGACAGGCCACTGGACAAGGC TTGAGTGGATGGGATGGATGAACCCTAACAGTG GTAACACAGGCTATGCACAGAAGTTCCAGGGCA GAGTCACCATGACCAGGAACACCTCCATAAACA CAGCCTACATGGAGCTGAGCAGCCTGAGATCTG AGGACACGGCCGTGTATTACTGTGCGATTAGCAG TGGCTGGTACTGGTTCGACCCCTGGGGCCAGGGA ACCCTGGTCACCGTCTCCTCA<br>SEQ ID NO: 29813 |
| | | AA | DIVMTQSPDSLAVSLGARATINCRSSQSVLYSSN NYNYLAWYQQKPGQPPKLLIYWASTRDSGVPD RFSGSGSGTDFTLTISSLQAEDVAVYYCQQYYTT PCSFGQGTKLEIK<br>SEQ ID NO: 25808 | QVQLVQSGAEVKKPGASVKVSCKASGYTFTNYDIN WVRQATGQGLEWMGWMNPNSGNTGYAQKFQGR VTMTRNTSINTAYMELSSLRSEDTAVYYCAISSGW YWFDPWGQGTLVTVSS<br>SEQ ID NO: 29814 |

FIGURE 50
(Continued)

| | | | |
|---|---|---|---|
| iPS:434615 | 21-225_76C5 | NA | GACATCCAGATGACCCAGTCTCCATCCTCACT GTCTGCATCTCTAGGAGACAGAGTCACCATCA CTTGTCGGGCGAGTCAGGTCATTAGCAAGTAT TTAGCCTGGTTTCAGCAGAAACCAGGGAAAGC CCCTAAGTCCCTGATCTATGCTGCATCCAGTT TGCAAAGTGGGGCCCCATCAAGGTTCAGCGGC AGTGGATCTGGGACAGATTTCACTCTCACCAT CAGCAGCCTGCAGCCTGAAGATTTTGCAACTT ATTACTGCCAACAGTACAGTAATTACCCGCTC ACTTTCGGCGGAGGGACCAAGGTGGAGATCA AA <br>SEQ ID NO: 25809 | CAGGTGCAGCTGGTGGAGTCTGGGGGAGGCGTG GTCCAGCCTGGGAGGTCCCTGAGACTCTCCTGTG CAGGGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAAAACTATGCAGACTCCGTGAAGGGCCGA TTCACCATCTCCAGAGACAATTCAAGAACACGC TGTATCTGCAAATGAACAGCCTGAGAGCCGAGG ACACGGCTGTGTATTACTGTGCGAGAGATGGCAG CTATGGTTACGACGGCCTTGACTACTGGGGCCAG GGAACCCTGGTCACCGTCTCCTCA<br>SEQ ID NO: 29815 |
| | | AA | DIQMTQSPSSLSASVGDRVTITCRASQVISKYLA WFQQKPGKAPKSLIYAASSLQSGAPSKFSGSGSG TDFTLTISSLQPEDFATYYCQQYSNYPLTFGGGT KVEIK<br>SEQ ID NO: 25810 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDGSYG YDGLDYWGQGTLVTVSS<br>SEQ ID NO: 29816 |
| iPS:434617 | 21-225_74B8 | NA | GACAGCGTGATGACCCAGTCTCCAGACTCCCT GGCTGTGTCTCTGGGCGAGAGGGCCACCATCA ACTGCAAGTCCAGCCAGAGTGTTTTATACAGC TCTAATAAAAAGAACTACTTAGCTTGGTACCA GCAGAAACCAGGACAGCCTCCTAAGCTGCTCA TTTACTGGGCATCTACCCGGGAATCCGGGGTC CCTGACCGATTCACTCTCACCATCAGCAGTCTGCAGG CTGAAGATGTGGCAGTTTATTACTGTCAGCAA TATTATAGGACTCCGTGACGTTCGGCCAAGG GACCAAGGTGAAATCAAA<br>SEQ ID NO: 25811 | CAGGTGCAGCTGCAGGAGTCGGGCCCAGGACTG GTGAAGCCTTCGGAGACCCTGTCCCTCACCTGC ACTGTCTCTGGTGGCTCCATCAGTAGTTACTAC TGGAGCTGGATCCGGCAGCCCCCAGGGAAGGGA CTGGAGTGGATTGGGCGTATCTATACCAGTGGG AGCACCAACTACAACCCCTCCCTCAAGAGTCGA GTCACCATATCAGTAGACACGTCCAAGAACCAG TTCTCCCTGAAGCTGAGCTCTGTGACCGCTGCG GACACGGCCGTGTATTACTGTGCGGTTTCCAGT GGCTGGTACTGGTTCGACCCCTGGGGCCAGGGA ACCCTGGTCACCGTCTCCTCA<br>SEQ ID NO: 29817 |

FIGURE 50
(Continued)

| | | | | |
|---|---|---|---|---|
| iPS:434619 | 21-225_78C1 | AA | DSVMTQSPDSLAVSLGERATINCKSSQSVLHSSN KKNYLAWYQQKPGQPPKLLIYWASTRESGVPD RFSGSGSGTDFTLTISSLQAEDVAVYYCQQYYRT PWTFGQGTKVEIK<br>SEQ ID NO: 25812 | QVQLVQSGAEVKKPGASVKVSCKASGYTFTNYDIN WVRQATGQGLEWMGWMHPNSGNTGYAQKFQGR VTLTRNTSISTAYMELSSLRSEDTAVYYCAVSSGW YWFDPWGQGTLVTVSS<br>SEQ ID NO: 29818 |
| | | NA | GACATCTGTGATGACCCAGTCTCCAGATTGCCT GGCTGTGTCTCTGGGCGAGAGGGCCACCATCA ACTGCAAGTCCAGCAGTGTTTTATACACC TCCAACAATAACAAGAACTACTTAGCTTGGTACCA GCAGAAACCAGGACAGCCTCCTAAGCTGCTCA TTTACTGGGCATCTACCCGGGAATCCGGGTC CCTGACCGATTCAGTGGCAGCGGGTCTGGGAC AGATTTCACTCTCACCATCAGCAGCCTGCAGG CTGAAGATGTTGCAGTTTATTATTGTCAGCACT ATTATAATACTCCGTGGAAGTTTGTCCAAGGG ACCAAGGTGGAAATCAAA<br>SEQ ID NO: 25813 | CAGGTCCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TAACACAGGCTATGCACAGAAGTTCCAGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGGTTCGACCCCTGGGGCCAGGGA ACCCTGGTCACCGTCTCCTCA<br>SEQ ID NO: 29819 |
| | | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQHYYNT PWKFVQGTKVEIK<br>SEQ ID NO: 25814 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS<br>SEQ ID NO: 29820 |

FIGURE 50
(Continued)

| | | | |
|---|---|---|---|
| iPS:434621 | 21-225_74D1 | NA | GAAATAGTGATGACGCAGTCTCCAGCCACCCT GTCTGTGTCTCCAGGGGAAAGAGCCACCCTCT CCTGCAGGGCCAGTCAGAGTGTTAGCAGAAAT TTAGCCTGGTTCCAGCAGAAACCTGGCCAGGC TCCCAGGCTCCTCATCTATGGTGCATCCATCA GGGCCACTGGTATCCCAGCCAGGTTCAGTGGC AGTGGGTCTGGGACAGAGTTCACTCTCACCAT CTACAGCCTGCAGTCTGAAGATTTTGCAGTTT ATTACTGTCAGCAGTATAATAACTGGCCTCCG CTCACTTTCGGCGGAGGGACCAAGGTGGAGAT CAAA | CAGGTGCAGCTGGTGGAGTCTGGGGGAGGCGTG GTCCAGCCTGGGAGGTCCCTGAGACTCTCCTGTG CAGCGCTGTGATTCACCTTCAGTGAGCTATGGCAT GCACTGGGTCCGCCAGGCTCCAGGCAAGGGGCT GGAGTGGGTGGCAGTTATATGGTATGATGGAAGT AATAAATACCATGCAGACTCCGTGAAGGGCCGA TTCACCATCTCCAGAGACAATTCCAAGAACACGC TGTATCTGCAAATGAACAGCTGAGAGCGAGG ACACGGCTATGTATTACTGTGCGAGAGATGAGGG GTTCGGGGAGTTCGACTACTACAACTACGGTATG GACGTCTGGGGCCAAGGGACCACGGTCACCGTC TCCTCA |
| | | | SEQ ID NO: 25815 | SEQ ID NO: 29821 |
| | | AA | EIVMTQSPATLSVSPGERATLSCRASQSVSRNLA WFQQKPGQAPRLLIYGASIRATGIPARFSGSGSG TEFTLTIYSLQSEDFAVYYCQQYNNWPPLTFGG GTKVEIK | QVQLVESGGGVVQPGRSLRLSCAASGFTFSSYGMH WVRQAPGKGLEWVAVIWYDGSNKYHADSVKGRF TISRDNSKNTLYLQMNSLRAEDTAMYYCARDEGF GEFDYYNYGMDVWGQGTTVTVSS |
| | | | SEQ ID NO: 25816 | SEQ ID NO: 29822 |
| iPS:434629 | 21-225_74C3 | NA | GAAATAGTGATGACGCAGTCTCCAGCCACCCT GTCTGTGTCTCCAGGGGAAAGAGCCACCCTCT CCTGCAGGGCCAGTCAGAGTGTTGCCAGCAGC TTAGCCTGGTACCAGCAGAAACCTGGCCAGGC TCCCAGGCTCCTCATCTTTGGTACATCCACCAG GGCCACTGGTATCCCAGCCAGGTTCAGTGGCA GTGGGTCTGGGACAGAGTTCACTCTCATAATC AGCAGCCTGCAGTCTGAAGATTTTGCAGTTTA TTACTGTCAGCAGTATAATGACTGGCCTGCA GTTTTGGCCTGGGGACCAAGCTGGAGATCAAA | CAGGTGCAGCTGGTGGTGGAGTCTGGGGGAGGCGTG GTCCAGCCTGGGAGGTCCCTGAGACTCTCCTGTG CAGCGTCTGGATTCACCTTCAGTAGCTTTGGCAT GCACTGGGCCCGCCAGGCTCCAGGCAAGGGCT GGAATGGGTGGCAGTCTATTTGGTATGATGGAAGT AATAAATACTGTGCAGACTCCGTGAAGGGCCGA TTCACCATCTCCAGAGACAATTCCAAGAACACAC TGTCTCTGCAAATGAACAGCTGAGAGCCGAGG ACTCGGCTGTGTATTACTGTGCGAGAGATCGGAG TATACTGGGAGCTGCTTTCTTTGACTACTGGGGC CAGGGAACCCTGGTCACCGTCTCCTCA |
| | | | SEQ ID NO: 25817 | SEQ ID NO: 29823 |

FIGURE 50
(Continued)

| | | | | |
|---|---|---|---|---|
| | | AA | EIVMTQSPATLSVSPGERATLSCRASQSVASSLA WYQQKPGQAPRLLIFGTSTRATGIPARFSGSGSG TEFTLIISSLQSEDFAVYYCQQYNDWPCSFGLGT KLEIK<br><br>SEQ ID NO: 25818 | QVQLVESGGGVVQPGRSLRLSCAASGFTFSSFGMH WARQAPGKGLEWVAAIWYDGSNKYCADSVKGRF TISRDNSKNTLSLQMNSLRAEDSAVYYCARDRSILG AAFFDYWGQGTLVTVSS<br><br>SEQ ID NO: 29824 |
| iPS:434633 | 21-225_74G8 | NA | GAAATTGTGTTGACGCAGTCTCCAGGCACCCT GTCTTTGTCTCCAGGGGAAAGAGCCACCCTCT CCTGCAGGGCCAGTCAGAGTTTTAGCAGCGCC TACTTAGCCTGGTACCAGCAGAAACCTGGCCA GGCTCCCAGGCTCCTCATCTATGGTACTTCCA GCAGGGCCACTGGCATCCCAGACAGGTTCAGT GGCAGTGGGTCTGGGACAGCTGAAGATTTCAC CATCGGCAGACTGGAGCCTGAAGATTTTGCAG TGTATTACTGTCAACAGTATGGTAACTCAAGG ACGTTCGGCCAAGGGACCAAGGTGGAAATCA AA<br><br>SEQ ID NO: 25819 | GAGGTGCAGCTGGTGGAGTCTGGGGGAGGCTTG GTAAAGCCTGGGGGGTCCCTTAGACTCTCCTGTG CAGCCTCTGGATTCACTTTCAGTAACGCTGGAT GAACTGGGTCCGCCAGGCTCCAGGGAAGGGGCT GGAGTGGGTTGGCCGTATTAAAAACAAAGCTGA TGGTGGGACAACAGATTACGCTGCACCCGTGAA AGGCAGATTCACCATCTCAAGAGATGAATTCAAA AACACGCTGTATCTGCAAATGAACAGCCTGAA AACCGAGGAGCTACTACGGACTACTGTATTACTGTACCACA GTGGGAGCTACTACGGACTACTGGGGCCAGGGA ACCCTGGTCACCGTCTCCTCA<br><br>SEQ ID NO: 29825 |
| | | AA | EIVLTQSPGTLSLSPGERATLSCRASQSFSSAYLA WYQQKPGQAPRLLIYGTSSRATGIPDRFSGSGSG TDFTLTIGRLEPEDFAVYYCQQYGNSRTFGQGT KVEIK<br><br>SEQ ID NO: 25820 | EVQLVESGGGLVKPGGSLRLSCAASGFTFSNAWM NWVRQAPGKGLEWVGRIKNKADGGTTDYAAPVK GRFTISRDDSKNTLYLQMNSLKTEDTAVYYCTTVG ATTDYWGQGTLVTVSS<br><br>SEQ ID NO: 29826 |

FIGURE 50
(Continued)

| | | | |
|---|---|---|---|
| iPS:434635 | 21-225_78E6 | NA | GACATCGTGATGACCCAGTCTCCAGACTCCCTGGCTGTGTCTCTGGGCGAGAGGGCCACCATCAACTGCAAGTCCAGCCAGAGTGTTTTGTACAGCTCCAACAGTCACAACTAGCTTGTACCAGCAGAAACCAGGACAGCCTCCTAAACTGCTCATTTACTGGGCATCTATCCGGGAATCCGGGGTCCCTGACCGATTCAGTGGCAGCGGGTCTGGGACAGATTTCACTCTCCATCAGCAGCCTGCAGGCTGAAGATGTGGCAGTTTATTACTGTCAGCAATATTATAGTACTCCGTGCAGTTTTGGCCAGGGGACCAAGCTGGAGATCAAA | CAGGTGCAGCTGGTGCAGTCTGGGGCTGAGGTGAAGAAGCCTGGGGCCTCAGTGAAGGTCCTGCAAGGCTTCTGGATACACCTTCACCAATTATGATATCAACTGGGTGCGACAGGCCTCTGGACAAGGACTTGAGTGGATGGGATGGATGCACCCTAACAGTGGTAACACAGGCTATGCACAGAAGTTCCAGGCAGAGTCACCATGACCAGGAACACCTCCATAAGCACAGCCTACATGGAGCTGAGCAGCCTGAGATCTGAGGACTCGGCCGTATATTACTGTGCGTATAGTAGTGGCTGGTACAAATTTGACTACTGGAGCCAGGGAACCCTGGTCACCGTCTCCTCA |
| | | | SEQ ID NO: 25821 | SEQ ID NO: 29827 |
| | | AA | DIVMTQSPDSLAVSLGERATINCKSSQSVLYSSNSHNYLAWYQQKPGQPPKLLIYWASIRESGVPDRFSGSGSGTDFTLSISSLQAEDVAVYYCQQYYSTPCSFGQGTKLEIK | QVQLVQSGAEVKKPGASVKVSCKASGYTFTNYDINWVRQASGQGLEWMGWMHPNSGNTGYAQKFQGRVTMTRNTSISTAYMELSSLRSEDSAVYYCAYSSGWYKFDYWSQGTLVTVSS |
| | | | SEQ ID NO: 25822 | SEQ ID NO: 29828 |
| iPS:434637 | 21-225_78E7 | NA | GAAATTGTGTTGACGCAGTCGCCAGGCACCCTGTCTTTGTCTCCAGGGGAGAGAGCCACCCTCTCCTGCAGGGCCAGTCAGAATGTTGACAGCAACTACTTAGCCTGGTACCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTTTTACTGTCAGCAGTATGAACGCTCACCGTGGACGTTCGGCCAAGGGACCAAGGTGGAAATCAAA | CAGGTGCAGCTACAGCAGTGGGGCGCAGGACTGTTGAAGCCTTCGGAGACCCTGTCCCTCACCTGCGCTGTCTATGGTGGGTCCCTCAGTGGTTCCTACTGGAGCTGGATCCGCCAGCCCCCAGGGAAGGGGCTGGAGTGGATTGGGAAATCAATCTTAGTGGAAGCACCAACTACAACCCGTCCCTCAAGAGTCGAGTCACCATATCAGTAGACACGTCCAAGAGCCAGTTCTCCCTGACGCTGCGCTCTGTGACCGCCGCGGACACGGCTGTGTATTACTGTGCGAGAGATACGGTTGGCCTTGACTACTGGGGCCAGGGAACCCTGGTCACCGTCTCCTCA |
| | | | SEQ ID NO: 25823 | SEQ ID NO: 29829 |

FIGURE 50
(Continued)

| | | | |
|---|---|---|---|
| iPS:434639 | 21-225_74B7 | AA | EIVLTQSPGTLSLSPGERATLSCRASQNVDSNYL AWYQQKPGQAPRLLIYGASSRATGIPDRFSGSGS GTDFTLTISRLEPEDFAVFYCQQYERSPWTFGQG TKVEIK<br><br>SEQ ID NO: 25824 | QVQLQQWGAGLLKPSETLSLTCAVYGGSLSGSYW SWIRQPPGKGLEWIGEINLSGSTNYNPSLKSRVTISV DTSKSQFSLTLRSVTAADTAVYYCARDYGGLDYW GQGTLVTVSS<br><br>SEQ ID NO: 29830 |
| | | NA | GACATCGTGATGACCCAGTCTCCAGACTCCCT GGCTGTGTCTCTGGGCGAGAGGGCCACCATCA ACTGCAAGTCCAGCCAGACTGTTTTACACAGC TCCAACAATTATAACTACTTAGTTGGTACCA GCAAGAAGCCAGGACAGGACCCCCTAAGGTGCTC ATTTACTGGACATCTACCCGGGAATCCGGGGT CCCTGACCGATTCAGTGGCAGCGGGTCTGGGA CAGATTTCACTCTCACCATCAGCAGCCTGCAG GCTGAAGATGTGGCAGTTTATTACTGTCAGCA ATATTTTAGTAGTCCTCCGACGTTCGGCCAAG GGACCAAGGTGGAAATCAAA<br><br>SEQ ID NO: 25825 | CAGGTGCAGCTGGTGCAGTCTGGGGCTGAGGTG AAGAAGCCTGGGGCCTCAGTGAAGGTCTCCTGC AAGGCTTCTGGATACACCTTCCCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACTCCATAAGCA CAGCCTACATGGAGCTGAGCAGCCTGAGATCTG AGGACACGGCCGTGTATTATTGTGCGGTTCCAG TGGCTGGCACTGGTTCGACCCCTGGGGCCAGGGA ACCCTGGTCACCGTCGCCTCA<br><br>SEQ ID NO: 29831 |
| | | AA | DIVMTQSPDSLAVSLGERATINCKSSQTVLHSSN NYNYLAWYQQKPGQPPKVLIYWTSTRESGVPD RFSGSGSGTDFTLTISSLQAEDVAVYYCQQYFSS PPITGQGTKVEIK<br><br>SEQ ID NO: 25826 | QVQLVQSGAEVKKPGASVKVSCKASGYTFPNYDIN WVRQATGQGLEWMGWMNPNSGNTGYAQKFQGR VTMTRNTSISTAYMELSSLRSEDTAVYYCAVSSGW HWFDPWGQGTLVTVAS<br><br>SEQ ID NO: 29832 |

FIGURE 50
(Continued)

| | | | |
|---|---|---|---|
| iPS:434649 | 21-225_78E11 | NA | GACATCGTGATGACCCAGTCTCCAGACTCCCT GGCTGTGTCTCTGGGCGAGAGGGCCACCATCA ACTGCAAGTCCAGCCAGAGTGTTTATACAGC TTCAACAATTACAACTACTTAGCTTGGTACCA GCAGAAACCAGGACAGCCTCCTAAGAAGCTC ATTTACTGGGCATCTACCCGGAATCCGGGGT CCCTGACCGATTCAGTGGCAGCGGGTCTGGGA CAGATTCACTCTCACCATCAGCAGCCTGCAG GCTGAAGATGTGGCAGTTTATTCCTGTCAGCA ATATTATAGTAGTCCTCCGACGTTCGGCCAAG GGACCAAGGTGGAAATCAAA SEQ ID NO: 25827 DIVMTQSPDSLAVSLGERATINCKSSQSVLYSFN NYNYLAWYQQKPGQPPKKLIYWASTRESGVPD RFSGSGSGTDFTLTISSLQAEDVAVYSCQQYYSS PPTFGQGTKVEIK SEQ ID NO: 25828 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTAACACAGGCTGTGCACAGAAGTTCCAGGCA GAGTCACCATGACCAGGAACACCTCCATAAGCA CAGCCTACATGGAGCTGAGCAGCCTGAGATCTG AGGACACGGCCGTGTATTACTGTGCGAGTAGCA GTGGCTGGAACTTCTTTGACTACTGGGGCCAGG AACCCTGGTCACCGTCCTCA SEQ ID NO: 29833 QVQLVQSGAEVKKPGASVKVSCKASGYTFTNYDIN WVRQATGQGLEWMGWMNPNSGNTGCAQKFQGR VTMTRNTSISTAYMELSSLRSEDTAVYYCASSSGW NFFDYWGQGTLVTVSS SEQ ID NO: 29834 |
| iPS:434653 | 21-225_74B5 | NA | GACATCGTTATGACCCAGTCTCCAGACTCCT GGCTGTGTCTCTGGGCGAGAGGGCCACCATCA ACTGCAAGTCCAGCCAGAGTGTTTTATTCAGC TCCAACAATTATAACTACTTAGCTTGGTACCA GCAGAGACCAGGACAGCCTCCTAAACTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGCTGATGTGGCAGTTTATTACTGTCAGCAA TATTATAGTTCTCCTCCGACGTTCGGCCAAGG GACCACGGTGCAAATCAAA SEQ ID NO: 25829 | CAGGTGCAGTTGGTGCAGTCTGGGGCTGAGGTGA AGAAGCCTGGGGCCTCAGTGAAGGTCTCCTGCA AGGCTTCTGGATACACCTTCACCAATTATGATAT CAACTGGGTGCGACAGGCCACTGGACAAGGGCT TGAGTGGATGGGATGGATGAACCCTAACAGTGG TAACACAGGCTATGCACAGAAGTTCCAGGGCAG AGTCACCATGACCAGGAACACCTCCACAAGCAC AGCCCACATGGAGCTGAGCAGCCTGAGATCTGA GGACACGGCCGTGTATTACTGTGCGGTCTCCAGT GGCTGGAACTGGTTCGACCCCTGGGGCCAGGGA ACCCTGGTCACCGTCCTCA SEQ ID NO: 29835 |

FIGURE 50
(Continued)

| | | | | |
|---|---|---|---|---|
| iPS:434655 | 21-225_78H12 | AA | DIVMTQSPDSLAVSLGERATINCKSSQSVLFSSN NYNYLAWYQQRPGQPPNLLIYWASTRESGVPD RFSGSGSGTDFTLTISSLQAADVAVYYCQQYYSS PPTFGQGTTVQIK<br><br>SEQ ID NO: 25830 | QVQLVQSGAEVKKPGASVKVSCKASGYTFTNYDIN WVRQATGQGLEWMGWMNPNSGNTGYAQKFQGR VTMTRNTSTAHMELSSLRSEDTAVYYCAVSSGW NWFDPWGQGTLVTVSS<br><br>SEQ ID NO: 29836 |
| | | NA | GACATCGTGATGACCCAGTCTCCAGACTCCCT GGCTGTGTCTCTGGGCGAGAGAGACTCACCATCA ACTGCAAGTCCAGCCAGAGACTGTTTTACACAGC TTCAACAATTATAACTACTTAGCTTGGTACCA GCAGAAGCCAGGACAGCCCCCTAAGGTGCTC ATTTACTGGACATCTACCCGGGAATCCGGGGT CCCTGACCGATTCAGTGGCAGCGGGTCTGGGA CAGATTTCACTCTCACCATCAGCAGCCTGCAG GCTGAAGATGTGGCAGTTTATTACTGTCAGCA ATATTTTAGTAGTCCTCCGACGTTCGGCCAAG GGACCAAGGTGGAAATCAAA<br><br>SEQ ID NO: 25831 | CAGGTGCAGCTGGTGCAGTCTGGGCTGAGGTG AAGAAGCCTGGGGCCTCAGTGAAGGTCTCCTGC AAGGCTTCTGGATACACCTTCCCAATTATGATA TCAACTGGGTGCGACAGGCCACTGGACAAGGC TTGAGTGGATGGGATGGATGAACCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTATTGTGCGGTTTCCAG TGGCTGGCACTGGTTCGACCCTGGGGCCAGGGA ACCCTGGTCACCGTCGCCTCA<br><br>SEQ ID NO: 29837 |
| | | AA | DIVMTQSPDSLAVSLGERATINCKSSQTVLHSFN NYNYLAWYQQKPGQPPKVLIYWTSTRESGVPD RFSGSGSGTDFTLTISSLQAEDVAVYYCQQYFSS PPTFGQGTKVEIK<br><br>SEQ ID NO: 25832 | QVQLVQSGAEVKKPGASVKVSCKASGYTFPNYDIN WVRQATGQGLEWMGWMNPNSGNTGYAQKFQGR VTMTRNTSISTAYMELSSLRSEDTAVYYCAVSSGW HWFDPWGQGTLVTVAS<br><br>SEQ ID NO: 29838 |

FIGURE 50
(Continued)

| | | | |
|---|---|---|---|
| iPS:434657 | 21-225_79G1 | NA | GAAATTGTGTTGACGCAGTCTCCAGGCACCCT GTATTTGTCTTCAGGGGAAAGAGCCACCCTCT CCTGCAGGGCCAGTCAGAGTGTTTACAGCAGC TACTTAGCCTGGTACCAGCAGAAACCTGCCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCACTATGATAACTCACCG TGGACGTTCGGCCAAGGGACCAAGGTGGAAA TCAAA<br>SEQ ID NO: 25833 | CAGGTGCAGCTACAGCAGTGGGGCGCAGGACTG TTGAAGCCTTCGGAGACCGTCCCTCACCTGCG CTGTCCATGTGGGTCCTTCAGTGGTTGCTACTG GAGCTGGATCCGCCAGCCCCCAGGGAAGGGCT GGAGTGGATTGGGGAAATCAATCATAGTGGAAG CACCAACTACAACCCGTCCTCCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br>SEQ ID NO: 29839 |
| | | AA | EIVLTQSPGTLYLSSGERATLSCRASQSVYSSYLA WYQQKPAQAPRLLIYGASSRSTGIPDRFSGSGSG TDFALTISRLEPEDFAVYYCQHYDNSPWTFGQG TKVEIK<br>SEQ ID NO: 25834 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29840 |
| iPS:434663 | 21-225_79F3 | NA | GAAATTGTGTTGACGCAGTCTCCAGGCACCCT GTATTTGTCTCCAGGGGAAAGAGCCACCCTCT CCTGCAGGGCCAGTCAGAGTGTTTACAGCAGC TACTTAGCCTGGTACCAGCAGAAACCTGCCCA GGCTCCCAGGCTCCTCATCTATGGTGCATCCA GCCGGTCCACTGGCATCCCAGACAGGTTCAGT GGCAGTGGGTCTGGGACAGGAGCTGAAGATTTTGCAG CATCAGCAGACTGGAGCCTGAAGATTTTGCAG TGTATTACTGTCAGCACTATGATAACTCACCG TGGACGTTCGGCCAAGGGACCAAGGTGGAAA TCAAA<br>SEQ ID NO: 25835 | CAGGTGCAGCTACAGCAGTGGGGCGCAGGACTG TTGAAGCCTTCGGAGACCCTGTCCTCACCTGCG CTGTCCATGTGGGTCCTTCAGTGGTTGCTACTG GAGCTGGATCCGCCAGCCCCCAGGGAAGGGCT GGAGTGGATTGGGGAAATCAATCATAGTGGAAG CACCAACTACAACCCGTCCCTCCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGACCACCGGTCACC GTCTCCTCA<br>SEQ ID NO: 29841 |

FIGURE 50
(Continued)

| | | | |
|---|---|---|---|
| iPS:434665 | | AA | EIVLTQSPGTLYLSPGERATLSCRASQSVYSSYLA WYQQKPAQAPRLLIYGASSRSTGIPDRFSGSGSG TDFALTISRLEPEDFAVYYCQHYDNSPWTFGQG TKVEIK<br>SEQ ID NO: 25836 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29842 |
| | 21-225_74G4 | NA | GACATCGTGATGACCCAGTCTCCAGACTCCCT GGCTGTGTCTCTGGGCGAGAGGGCCACCATCA ACTGCAAGTCCAGCCAGAGTGTTTTATACAGT TCCAACAATAATAACTACTTAGCTTGGTACCA GCAGAAGCCAGGACAGCCTCCTAAGCTGCTCA TTTACTGGGCATCTACCCGGACAGTCCGGGTC CCTGACCGATTCAGTGGCAGCGGGTCTGGGAC AGATTTCACTCTCACCATCAGCAGCCTGCAGG CGGAAGATGTGGCAGTTTATTACTGTCAGCAA TATTATAGTATTCCTCCGACGTTCGGCCAAGG GACCAAGGTGGAAATCAAA<br>SEQ ID NO: 25837 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATG TCAACTGGGTGCGACAGGCCACTGGACAAGGC TTGAATGGATGGGATGGATGCACCCTAACAGTGG TAACACAGGCTATGCACAGAAGTTCCAGGCAG AGTCACCATGACCAGGAACACCTCCATACGCAC AGCCTACATGGAGCTGAGCAGCCTGAGATCTGA GGACACGGCCGTGTATTACTGTGCGAGTAGCAGT GGCTGGTACCATTTTGACTACTGGGGCCAGGGAA CCCTGGTCACCGTCTCCTCA<br>SEQ ID NO: 29843 |
| | | AA | DIVMTQSPDSLAVSLGERATINCKSSQSVLYSSN NNNYLAWYQQKAGQPPKLLIYWASTRESGVPD RFSGSGSGTDFTLTISSLQAEDVAVYYCQQYYSI PPTFGQGTKVEIK<br>SEQ ID NO: 25838 | QVQLVQSGAEVKKPGASVKVSCKASGYTFTNYDV NWVRQATGQGLEWMGWMHPNSGNTGYAQKFQG RVTMTRNTSIRTAYMELSSLRSEDTAVYYCASSSG WYHFDYWGQGTLVTVSS<br>SEQ ID NO: 29844 |

FIGURE 50
(Continued)

| | | | |
|---|---|---|---|
| iPS:434669 | 21-225_79F4 | NA | GACATCCAGATGACCCAGTCTCCATCCTCACTGTCTGCATCTGTAGGAGACAGAGTCACCATCACTTGTCGGGCGAGTCAGGGCATTAGCAAGTATTTAGCCTGGTTTCAGCAGAAACCAGGGAAAGCCCCTAAGTCCCTGATCTATGCTGCATCCAGTTTGCAAGGTGGGGTCCCATCTAAGTTCAGCGGCAGTGGATCTGGGACAGATTTCACTCTCACCATCAGCAGCCTGCAGCCTGAAGATTTTGCAACTTATTACTGCCAACAGTACAGTAATTACCCACTCACTTTCGGCGGAGGGACCAAGGTGGAGATCAAA | CAGGTGCAGTTGGTGGAGTCTGGGGGAGGCGTGGTCCAGTCTGGGAGGTCCCTGAGACTCTCCTGTGCAGCGTCTGGATTCACCTTCAGTAACTATGGCATGCACTGGGTCCGCCAGGCTCCAGGCAAGGGGCTGGAGTGGGTGGCAGTTATATGGTATGATGGAAGTAATCAAAACTATGCAGACTCCGTGAAGGGCCGATTCACCATCTCCAGAGACAATTCCAAGAACACGCTGTTTCTGCAAATGAACAGCCTGAGAGCCGAGGACACGGCTGTGTATTACTGTGCGAGAGATGGCAACACGGCTATGGTTATGACGGCCTTGACTACTGGGGCCAGGGAACCCTGGTCACCGTCTCCTCA |
| | | | SEQ ID NO: 25839 | SEQ ID NO: 29845 |
| | | AA | DIQMTQSPSSLSASVGDRVTITCRASQGISKYLAWFQQKPGKAPKSLIYAASSLQGGAPSKFSGSGSGTDFTLTISSLQPEDFATYYCQQYSNYPLTFGGGTRVEIK | QVQLVESGGGVVQSGRSLRLSCAASGFTFSNYGMHWVRQAPGKGLEWVAVIWYDGSNQNYADSVKGRFTISRDNSKNTLFLQMNSLRAEDTAVYYCARDGSYGYDGLDYWGQGTLVTVSS |
| | | | SEQ ID NO: 25840 | SEQ ID NO: 29846 |
| iPS:434671 | 21-225_74F4 | NA | GAAATTGTGTTGACGCAGTCTCCAGGCACCCTGTCTTTGTCTCCAGGGGAAAGAGCCACCCTCTCCTGCAGGGCCAGTCAGATTTTTAGCAGCTACTTAGCCTGGTACCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATTACTGTCAGCAGTATGGTAGCTCACGGACGTTCGGCCAAGGGACCAAGGTGGAAATCAAA | GAGGTGCAGCTGGTGGAGTCTGGGGGAGGCTTGGTAAAGCCTGGGGGGTCCCTTAGACTCTCCTGTGCAGCCTCTGGATTCACTTTCAGTAACGCCTGGATGAACTGGGTCCGCCAGGCTCCAGGGAAGGGGCTGGAGTGGGTTGGCCGAATTAAAACAAAATTGAAGGCAGATTCACCATCTCAAGAGATGATTCAAAAACACGCTGTATCTGCAAATGAACAGCCTGAAAACCGAGGACACAGCCGTGTATTACTGTACCACAGTGGGAGCTACTACGGACTACTGGGGCCAGGGAACCCTGGTCACCGTCTCCTCA |
| | | | SEQ ID NO: 25841 | SEQ ID NO: 29847 |

FIGURE 50
(Continued)

| | | | |
|---|---|---|---|
| iPS:434673 | 21-225_74E3 | AA | EIVLTQSPGTLSLSPGERATLSCRASQIFSSSYLAWYQQKPGQSPRLLIYGASSRATGIPDRFSGSGSGTDFTLTISRLEPEDFAVYYCQQYGSSRTFGQGTKVEIK<br>SEQ ID NO: 25842 | EVQLVESGGGLVKPGGSLRLSCAASGFTFSNAWMNWVRQAPGKGLEWVGRIKNKIDGGTTDYAAPVKGRFTISRDDSKNTLYLQMNSLKTEDTAVYYCTTVGATTDYWGQGTLVTVSS<br>SEQ ID NO: 29848 |
| | | NA | GAAATAGTGATGACGCAGTCTCCAGCCACCCTGTCTCTGTCTCCAGGGGAAAGAGCCACCCTCTCCTGCAGGGCCAGTCTGAGTGTTGTCAACAGCTTAGCCTGGTACCAGCAGAAACCTGGCCAGGCTCCCAGGCTCCTCATCTATGGTGCATCCACCAGGGCCACTGGTATCCCAGCCAGGTTCAGTGGCAGTGGGTCTGGGACAGAGTTCACTCTCACCATCAGCAGCCTGCAGTCTGAAGATTTTGCAGTGCATTACTGTCAGCAGTATGGTAGTAGCCTCGTGCAGTTTTGGCCAGGGGGACCAAGCTGGAGATCAAA<br>SEQ ID NO: 25843 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATTTGTATGATGGAAGTAATAAATACTATGCAGACTCCGTGAAGGGCCGATTCACCATCTCCAGAGACAATTCCAAGAACACGCTGTTTCTGCAAATGAACAGCCTGAGAGCCGAGGACACGGCTGTGTATTACTGTGCGAGCGATCGCAACATAGTGGGAGCTACTACTTTGACTTTGAGTCCTGGGGCCAGGGAACCCTGGTCACCGTCTCCTCA<br>SEQ ID NO: 29849 |
| | | AA | EIVMTQSPATLSLSPGERATLSCRASLSVVNSLAWYQQKPGQAPRLLIYGASTRATGIPARFSGSGSGTEFTLTISSLQSEDFAIYYCQQYNDWPCSFGQGTKLEIK<br>SEQ ID NO: 25844 | QVQLVESGGGVVQPGRSLRLSCTASGFTFSSYGMHWVRQAPGKGLEWVAVIWYDGSNKYYADSVKGRFTISRDNSKNTLFLQMNSLRAEDTAVYYCASDRNIVGATYFESWGQGTLVTVSS<br>SEQ ID NO: 29850 |

FIGURE 50
(Continued)

| | | | |
|---|---|---|---|
| iPS:434675 | 21-225_79G6 | NA | GACATCGTGATGACCCAGTCTCCAGACTGCCT GGCTGTGTCTCTGGGCGAGAGGGCCACCATCA GCTGCATGTCCAGCCAGAGTGTTTTACACAGC TTCAACAATAAGAACTACTTAACTTGGTACCA GCAGAAACCAGGACAGCCTCCTAAGCTGCTCA TTTACTGGGCATCTACTTGGGAATCCGGGGTC CCTGACCGATTCAGTGGCAGCGGGTCTGGGAC AGATTTCAGTCTCCGATCGGCAGCCTGCAGG CTGAAGATGTGGCAGTTTATTACTGTCAGCAA TATTATAGTATTCCTCGACGTTCGGCCAAGG GACCAAGGTGGAAATCAAA |
| | | | SEQ ID NO: 25845 |
| | | AA | DIVMTQSPDCLAVSLGERATISCMSSQSVLHSFN NKNYLTWYQQKPGQPPKLLIYWASTWESGVPD RFSGSGSGTDFSLPIGSLQAEDVAVYYCQQYYSI PPTFGQGTKVEIK |
| | | | SEQ ID NO: 25846 |
| | | | CAGGTGCAGCTGGTGCAGTCTGGGGCTGAGGTG AAGAAGCCTGGGGCCTCAGTGAAGGTCTCCTGC AAGGCTTCTGGATTCACCTTCACCAATTATGATA TCAACTGGGTGCGACAGGCCACTGGACAAGGC TTGAGTGGATGGGATGGATGCACCTAACAGTGG TAACACAGGCTTTGCACAGAAGTTCCAGGCAG AGTCACCATGACCAGGAACACCTCCATAAGCAC AGCCTACATGGAACTGAGCAGCCTGAGATCTGA GGACACGGCCGTGTATTACTGTGCGGTTTCCAGT GGCTGGTACTGGTTCGACCCCTGGGGCCAGGGA ACCCTGGTCACCGTCTCCTCA |
| | | | SEQ ID NO: 29851 |
| | | | QVQLVQSGAEVKKPGASVKVSCKASGFTFTNYDIN WVRQATGQGLEWMGWMHPNSGNTGFAQKFQGR VTMTRNTSISTAYMELSSLRSEDTAVYYCAVSSGW YWFDPWGQGTLVTVSS |
| | | | SEQ ID NO: 29852 |
| iPS:434679 | 21-225_79G7 | NA | GACATCGTGATGACCCAGTCTCCAGACTCCCT GGCTGTGTCTCTGGGCGAGAGGGCCACCATCA ACTGCAAGTCCAGCCAGAGTGTTTTGTACAGC TCCAACAGTCACAACTACTTAGCTTGGTACCA GCAGAAACCAGGACAGCCTCCTAAACTGCTCA TTTTCTGGGCATCTATCCGGGAGTCCGGGGTC CCTGACCGATTCAGTGGCAGCGGGTCTGGGAC AGATTTCACTCTCTCCATCAGCAGCATGTCAGG CTGAAGATGTGGCAGTTTATTACTGTCAGCAA CTGAAGATGTGGCAGTTTATTACTGTCAGCAA TATTATAGTACTCCGTGCAGTTTTGGCCAGGG GACCAAGCTGGAGATCAAA |
| | | | SEQ ID NO: 25847 |
| | | | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCCTGGACAAGGAC TTGAGTGGATGGGATGGATGCACCTAACAGTGG TAACACAGGCTATGCACAGAAGTTCCAGGCAG AGTCACCATGACCAGGAACACCTCCATAAGCAC AGCCTACATGGAGCTGAGCAGCCTGAGATCTGA GGACTCCGCCGTATATTACTGTGCGTATAGTAGT GGCTGGTACAAATTGACTACTGGAGCCAGGGA ACCCTGGTCACCGTCTCCTCA |
| | | | SEQ ID NO: 29853 |

FIGURE 50
(Continued)

| | | | | |
|---|---|---|---|---|
| iPS:434685 | | AA | DIVMTQSPDSLAVSLGERATINCKSSQSVLYSSN SHNYLAWYQQKPGQPPKLLIFWASIRESGVPDR FSGSGSGTDFTLSISSMQAEDVAVYYCQQYYSTP CSFGQGTKLEIK<br>SEQ ID NO: 25848 | QVQLVQSGAEVKKPGASVKVSCKASGYTFTNYDIN WVRQASGQGLEWMGWMHPNSGNTGYAQKFQGR VTMTRNTSISTAYMELSSLRSEDSAVYYCAYSSGW YKFDYWSQGTLVTVSS<br>SEQ ID NO: 29854 |
| | 21-225_79E9 | NA | GACATCGTGATGACCCAGTCTCCAGACTCCCT GGCTGTGTCTCTGGGCGAGAGGGCCACCATCA ACTGTAAGTCCAGCCAGAGTGTATTTTATACAGC TCCAACAATAATAACTACTTAGCTTGGTTCCA GCAGAAACCAGGACAGCCTCCTAAGCTGCTCA TTTATTGGGCATCTACCCGGGAATCCGGGGTC CCTGACCGATTCAGTGGCAGCGGGTGTGGGAC AGATTTCACTCTCACCATCAGCAGCCTGCAGG CTGAAGATGTGGCAGTTTATTACTGTCAGCAA TATTATATTACTCCTCCGACGTTCGGCCAAGG GACCAAGGTGGAAATCAAA<br>SEQ ID NO: 25849 | CAGGTGCAGCTGGTGCAGTCTGGGGCTGAGGTG AAGAAGCCTGGGGCCTCAGTGAAGGTCTCCTGC AAGGCTTCTGATACACCTTCACCAATTATGATA TCAACTGGGTGCGACAGGCCACTGGACAAGGC TTGAGTGGATGGGATGGATGCATCCTAACAGTGG TAACACAGGCTATGCACAGAAGTTCCAGGGCAG AGTCACCATGACCAGGAACACCTCCATAAGCAC AGCCTACATGGAACTGAGCAGCCTGAGATCTGA GGACACGGCCGTGTATTACTGTGCGAGTAGCAGT GGCTGGTACTACTTTGACTACTGGGGCCAGGGAA CCCTGGTCACCGTCTCCTCA<br>SEQ ID NO: 29855 | 
| | | AA | DIVMTQSPDSLAVSLGERATINCKSSQSILYSSNN NNYLAWFQQKPGQPPKLLIYWASTRESGVPDRF SGSGCGTDFTLTISSLQAEDVAVYYCQQYYITPP TFGQGTKVEIK<br>SEQ ID NO: 25850 | QVQLVQSGAEVKKPGASVKVSCKASGYTFTNYDIN WVRQATGGGLEWMGWMHPNSGNTGYAQKFQGR VTMTRNTSISTAYMELSSLRSEDTAVYYCASSSGW YYFDYWGQGTLVTVSS<br>SEQ ID NO: 29856 |

FIGURE 50
(Continued)

| | | | | |
|---|---|---|---|---|
| iPS:434687 | 21-225_75A5 | NA | GACATCGTTATGACCCAGTCTCCAGACTCCCT GTATTTGTCTCCAGGGGAAAGAGCCACCCTCT CATGCAGGGCCAGTCAGAGTGTTTACAGCAGC TACTTAGCCTGGTACCAGCAGAAAACCTGGCCA GGCTCCCAGGCTCCTCATTTATGTGCATCCA GCCGGGCCACTGGCATCCCAGACAGGTTCAGT GGCAGTGGGTCTGGGACAGATTCGCTCTCAC CATCAGCAGACTGGAGCCTGAAGATTTTGCAG TGTATTACTGTCAGCACTATGATAACTCACCG TGGACGTTCGGCCAAGGGACCAAGGTGGAAA TCAAA<br>SEQ ID NO: 25851 | CAGGTGCAGCTACAGCAGTGGGGCGCAGGACTG TTGAAGCCTTCGGAGACCCTGTCCCTCACCTGCG CTGTCCATGTGGGTCTTCAGTGGTTGCTACTG GAGCTGGATCCGCCAGCCCCCAGGGAAGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGACAC GGCTGTGTATTACTGTGCGAGGGACTACGGCGGT ATGGACGTCTGGGGCCAAGGGACCACGGTCACC GTCTCCTCA<br>SEQ ID NO: 29857 |
| | | AA | EIVLTQSPGTLYLSPGERATLSCRASQSVYSSYLA WYQQKPGQAPRLLIYGASSRATGIPDRFSGSGSG TDFALTISRLEPEDFAVYYCQHYDNSPWTFGQG TKVEIK<br>SEQ ID NO: 25852 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29858 |
| iPS:434689 | 21-225_79G10 | NA | CAGGTGCAGTTGGTGCAGTCTGGGGCTGAGGTGA AGAAGCCTGGGGCCTCAGTGAAGGTCTCCTGCA AGGCTTCTGGATACACCTTCACCAATTATGATAT CAACTGGGTGCGACAGGCCACTGGACAAGGCT TGAGTGGATGGGATGGATGAACCCTAACAGTGG TAACACAGGCTATGCACAGAAGTTCCAGGGCAG AGTCACCATGACCAGGAACACCTCCACAAGCAC AGCCCACATGGAGCTGAGCAGCCTGAGATCTGA GGACACGGCCGTGTATTACTGTGCGGTCTCCAGT GGCTGGAACTGGTTCGACCCCTGGGGCCAGGA ACCCTGGTCACCGTCTCCTCA<br>SEQ ID NO: 29859 |
| | | | CCTGCTGATTGGGCAGTTTATTACTGTCAGCAA TATCATAGTTCTCCTGACGTTCGGCCAAGG<br>SEQ ID NO: 25853 | |

FIGURE 50
(Continued)

| | | | | |
|---|---|---|---|---|
| | | AA | DIVMTQSPDSLAVSLGERATINCKSSQSVLFSSN NYNYLAWYQQRPGQPHNLLIYWASTRESGVPD RFSGSGSGTDFTLTISSLQAADVAVYYCQQYHSS PLTFGQGTTVQIK<br>SEQ ID NO: 25854 | QVQLVQSGAEVKKPGASVKVSCKASGYTFTNYDIN WVRQATGQGLEWMGWMNPNSGNTGYAQKFQGR VTMTRNTSTSTAHMELSSLRSEDTAVYYCAVSSGW NWFDPWGQGTLVTVSS<br>SEQ ID NO: 29860 |
| iPS:434691 | 21-225_75G7 | NA | CAGGATGCAGCTACAGCAGTGGGGCGCAGGACTG<br>TTGAAGCCTTCGGAGACCCTGTCCTCACCTGCA<br>CTGTCTATGTGGGGCCTTCAGTGGTTCCTACTG<br>GAGCTGGATCCGCCAGTCCCCAGGGAAGGGCT<br>GGAGTGGATTGGGGAAATCAATTATAGGGGAAG<br>CACCAACTACACAACCGTCCCTCAAGAGTCGAGTC<br>ACCATATCAGTAGACACGTCCAAGAACCAGTTCT<br>CCCTGAACCTGAGCTCTGTGACCGCCGCGGACAC<br>GGCTGTGTATTACTGTGCGAGGGACTACGGCGGT<br>ATGGACGTCTGGGGCCAAGGGACCACGGTCACC<br>GTCTCCTCA<br>SEQ ID NO: 29861 | |
| | | AA | EIVLTQSPGTLSLSPGERATLSCRARQSVDSSYLA WYQQKRGQAPRLLIYGASSRATGIPDRFSGSGSG TDFTLTISRLEPEDFAVYYCQQYESSPWTFGQGT KVEIK<br>SEQ ID NO: 25856 | QVQLQQWGAGLLKPSETLSLTCTVYGGAFSGSYW SWIRQSPGKGLEWIGEINYRGSTNYNPSLKSRVTIS VDTSKNQFSLNLSSVTAADTAVYYCARDYGGMDV WGQGTTVTVSS<br>SEQ ID NO: 29862 |

FIGURE 50
(Continued)

| | | | |
|---|---|---|---|
| iPS:434693 | 21-225_79F11 | NA | GAAATTGTGTTGACGCAGTCTCCAGGCACCCT GTCTTTGTCTCCAGGGGAAAGAGCCACCCTCT CATGCAGGGCCAGTCAGTCAGAGTGTTTACAGCAGC TACTTAGCCTGGTACCAGCAGAAACCTGGCCA GGCTCCCAGGTCCTCATTTATGGTGCATCCA GCCGGGCCACTGGCATCCCAGACAGGTTCAGT GGCAGTGGGTCTGGGACAGACTTCGCTCAC CATCAGCAGACTGGAGCTGAAGATTTTGCAG TGTATTACTGTCAGCACTCTGATAACTCACCGT GGACGTTCGGCCAAGGGACCAAGGTGGAAAT CAAA<br>SEQ ID NO: 25857 | CAGGTGCAGCTGCAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCCAGGGAAGGGCT GGAGTGGATTGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGACACG GCTGTGTATTACTGTGCGAGGGACTACGGCGGT ATGGACGTCTGGGGCCAAGGGACCACGGTCACC GTCTCCTCA<br>SEQ ID NO: 29863 |
| | | AA | EIVLTQSPGTLSLSPGERATLSCRASQSVYSSYLA WYQQKPGQAPRLLIYGASSRATGIPDRFSGSGSG TDFALTISRLEPEDFAVYYCQHSDNSPWTFGQGT KVEIK<br>SEQ ID NO: 25858 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29864 |
| iPS:434697 | 21-225_79F12 | NA | GACATCGTGATGACCCAGTCTCCAGACTCCCT GGCTGTGTCTCTGGGCGAGAGGGCCACCATCA ACTGCAAGTCCAGCCAGAGTATTTTATACAGC TCCAACAATAACAATTACACTTAGCTTGTACCA GCAGAAACCAGGACAGCCTCCTAAGTTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCGTGACGTTCGGCCAAGG GACCAAGGTGGAAATCAAA<br>SEQ ID NO: 25859 | CAGGTGCAGCTGGTGCAGTCTGGGGCTGAGGTG AAGAAGCCTGGGGCCTCTGTGAAGGTCTCCTGCA AGGCTTCTGGATACACCTTCACCAATTATGATAT CAACTGGGTGCGACAGGCCACTGGACAAGGGCT TGAGTGGATGGGATGGATGAACCTAACAGTGG TAACACAGGCTATGCACCAGAAACACCTCCATAAGCAC AGTCACCATGACCAGAGAGATCCAGGCAG AGCCTACATGGAGCTGAGCAGCCTGAGATCTGA GGACACGGCCGTATATTACTGTGCGAGTAGCAGT GGCTGGTACTTCTTTGACTACTGGGCCAGGGAA CCCTGGTCACCGTCTCCTCA<br>SEQ ID NO: 29865 |

FIGURE 50
(Continued)

| | | | | |
|---|---|---|---|---|
| iPS:434699 | 21-225_79G12 | AA | DIVMTQSPDSLAVSLGERATINCKSSQSILYSSNNYNYLAWYQQKPGQPPKLLIYWASTRESGVPDRFSGSGSGTDFTLTISSLQAEDVAVYYCQQYYSTPWTFGQGTKVEIK<br>SEQ ID NO: 25860 | QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCASSSGWYFFDYWGQGTLVTLSS<br>SEQ ID NO: 29866 |
| | | NA | GAAATTGTGTTGACGCAGTCTCCAGGCACCCTGTATTTGTCTCCAGGGGAAAGAGCCACCCTCTCATGCAGGGCCAGTCAGAGTGTTTACAGCAGCTACTTAGCCTGGTACCAGCAGAAACCTGGCCAGGCTCCCAGGCTCCTCATTTATGGTGCATCCAGCCGGTCCACTGGCATCCCAGACAGGTTCAGTGGCAGTGGGTCTGGGACAGACTTCGCTCTCACCATCAGCAGACTGGAGCTGAAGATTGTGCAGTGTATTACTGTCAGCACTCTGATAACTCACCGTGGACGTTCGGCCAAGGGACCAAGGTGGAAATCAAA<br>SEQ ID NO: 25861 | CAGGTGCAGCTACAGCAGTGGGGCGCAGGACTGTTGAAGCCTTCGGAGACCCTGTCCCTCACCTGCGCTGTCCATGTGGTCCTTCAGTGGTTGCTACTGGAGCTGGATCCGCCAGCCCCAGGGAAGGGGCTGGAGTGGATTGGGAAATCAATCATAGTGGAAGCACCAACTACAACCCGTCCCTCAAGAGTCGAGTCACCATTTCAGTAGACACGTCCAAGAACCAGTTCTCCCTGAAGCTGAGCTCTGTGACCGCCGGGACACGGCTGTGTATTACTGTGCGAGGGACTACGGCGGTATGGACGTCTGGGGCCAAGGGACCACGGTCACCGTCTCCTCA<br>SEQ ID NO: 29867 |
| | | AA | EIVLTQSPGTLYLSPGERATLSCRASQSVYSSYLAWYQQKPGQAPRLLIYGASSRSTGIPDRFSGSGSGTDFALTISRLEPEDCAVYYCQHSDNSPWTFGQGTKVEIK<br>SEQ ID NO: 25862 | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS<br>SEQ ID NO: 29868 |

FIGURE 50
(Continued)

| | | | |
|---|---|---|---|
| iPS:434701 | 21-225_80A1 | NA | GAAATTGTGTTGACGCAGTCTCCAGGCACCCG GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTGTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGGAAAT CAAA<br>SEQ ID NO: 25863 | CAGGTGCAGCTACAGCAGTGGGGCGCAGGACTG TTGAAGCCTTCGGAGACCCTGTCCCTCACCTGC CTGTCCATGTGGGTCTTCAGTGGTTGCTACTG GAGCTGGATCCGCCAGCCCCCAGGGAAGGGCT GGAGTGGATTGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGCGACAC GGCTGTGTATTACTGTGCGAGGGACTACGGCGGT ATGGACGTCTGGGGCCAAGGGACCACGGTCACC GTCTCCTCA<br>SEQ ID NO: 29869 |
| | | AA | EIVLTQSPGTRYLSPGERATLSCRASQSVYSSYL AWYQQKPGQAPRLLIYGASSRSTGIPDRFSGSGC GTDFALTISRVEPEDCAVYYCQHSDNSPWTFGQ GTKVEIK<br>SEQ ID NO: 25864 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29870 |
| iPS:434703 | 21-225_80C1 | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGCCTGAAGATTGTGCAG TGTATTACTGTCAGCACTCTGATAACTCACCGT GGACGTTCGGCCAAGGGACCAAGGTGGAAAT CAAA<br>SEQ ID NO: 25865 | CAGGTGCAGCTACAGCAGTGGGGCGCAGGACTG TTGAAGCCTTCGGAGACCCTGTCCCTCACCTGCG CTGTCCATGTGGGTCTTCAGTGGTTGCTACTG GAGCTGGATCCGCCAGCCCCCAGGGAAGGGCT GGAGTGGATTGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGCGACAC GGCTGTGTATTACTGTGCGAGGGACTACGGCGGT ATGGACGTCTGGGGCCAAGGGACCACGGTCACC GTCTCCTCA<br>SEQ ID NO: 29871 |

FIGURE 50
(Continued)

| | | | |
|---|---|---|---|
| iPS-434705 | 21-225_80A2 | AA | EIVLTQSPGTLYLSPGERATLSCRASQSVYSSYLAWYQQKPGQAPRLLIYGASSRSTGIPDRFSGSGSGTDFALTISRVEPEDCAVYYCQHSDNSPWTFGQGTKVEIK<br>SEQ ID NO: 25866 | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS<br>SEQ ID NO: 29872 |
| | | NA | GAATTTATGTTGACGCAGTCTCCAGGCACCCTGTATTTGTCTCCAGGGGAAAGAGCCACCCTCTCGTGCAGGGCCAGTCAGAGTGTTAGCAGCAGCTACTTAGTCTGGTATCAGCAGAAACCTGGCCAGGCTCCCAGGCTCCTCATCTATGGTGCATCCACCAGGGCCACTGGCATCCCAGACAGGTTCAGTGGCAGTGGGTCTGGGACAGACTTCACTCTCACCATCAGCAGACTGGAGCCTGAATATTTTGCAGTTTATTACTGTCAGCAGTATGGTTGCTCACCGCTCACTTTCGGCGGAGGGACCAAGGTGGAGATCACA<br>SEQ ID NO: 25867 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGTCCCTGGACAAGGCTTGAGTGGATGGGATGGATGCACCCTAACAGTGGTAACACAGGCTATGCACAGAAGTTCCAGGGCAGAGTCACCATGACCAGGAACACCTCCATCAGCACAGCCTACATGGAGCTGAGCAGCCTGAGATCTGAGGACACGGCCGTGTATTACTGTGCGATTAGTAGTGGCTGGTACTGGTTCGACCCTGGGGCCAGGGAACCCTGGTCACCGTCTCCTCA<br>SEQ ID NO: 29873 |
| | | AA | EFMLTQSPGTLYLSPGERATLSCRASQSVSSSYLVWYQQKPGQAPRLLIYGASTRATGIPDRFSGSGSGTDFTLTISRLEPEYFAVYYCQQYGCSPLTFGGGTKVEIT<br>SEQ ID NO: 25868 | QVQLVQSGAEVKKPGASVKVSCKASGYTFTNYDINWVRQVPGQGLEWMGWMHPNSGNTGYAQKFQGRVTMTRNTSISTAYMELSSLRSEDTAVYYCAISSGWYWFDPWGQGTLVTVSS<br>SEQ ID NO: 29874 |

FIGURE 50
(Continued)

| | | | |
|---|---|---|---|
| iPS:434707 | 21-225_80D3 | NA | GACATCGTGATGACCCAGTCTCCAGATTGCCT GGCTGTGTCTCTGGGCGACCAGAGGGCCACCATCA ACTGCAAGTCCAGCCAGAGTGTTTTATACACC TCCAACAATAACAACTACTTAGCTTGGTACCA GCAGAAACCAGGACAGCCTCCTAAGCTGCTCA TTTACTGGGCATTCACCCGGGAATCCGGGGTC CCTGACCGATTCAGTGGCAGCGGGTCTGGAC AGATTTCACTCTCACCATCAGCAGCCTGCAGG CTGAAGATGTTGCAGTTTATTATTGTCAGCACT ACAATGAAACTCCAGGAAGTTTGTCCAAGTG ACCAAGGTGGAAATCACA<br><br>SEQ ID NO: 25869 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TAACACAGGCTATGCACAGAAGTTCCAGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGGTTCGACCCCTGGGGCCAGGGA ACCCTGGTCACCGTCCTCA<br><br>SEQ ID NO: 29875 |
| | | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQHYNET PGKFVQVTKVEIT<br><br>SEQ ID NO: 25870 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS<br><br>SEQ ID NO: 29876 |
| iPS:434709 | 21-225_80E3 | NA | GAAATTGTTGTTGACGCAGTCTCCAGGCACCCT GTATTTGTCTTCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTGTGGGACAGACTTCGCTCTCAC CATCAGCAGAGTGGAGCTGAAGATTTTGCAG TGTATTACTGTCAGCATTCTGATAACTCACCGT GGACGTTCGGCCAAGGGACCAAGGTGGAAAT CAAA<br><br>SEQ ID NO: 25871 | CAGGTGCAGCTACAGCAGTGGGGCGCAGGACTG TTGAAGCCTTCCGGAGACCCCTGTCCCTCACCTGCG CTGTCCATGTGGGTCCTTCAGTGGTTGCTACTG GAGTGGATCCGCCAGCCCCCAGGGAAGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 29877 |

FIGURE 50
(Continued)

| | | | |
|---|---|---|---|
| iPS:434711 | 21-225_80H3 | AA | EIVLTQSPGTLYLSSGERATLSCRASQSVYSSYLAWYQQKPGQAPRLLIYGASSRSTGIPDRFSGSGCGTDFALTISRVEPEDFAVYYCQHSDNSPWTFGQGTKVEIK<br>SEQ ID NO: 25872 | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS<br>SEQ ID NO: 29878 |
| | | NA | GACATCGTGATGACCCAGTCTCCAGACTCCCTGGCTGTGTCTCTGGGCGAGAGGGCCACCACCAATTGTAAGTCCAGCCAGAGTGTTTACACAGGTCCAACAATTACAACCAGGACAGCCTCCTAAGCTGGTGTACCAGCAGAAACCAGGACAGCCTCCTAAGCTGCTCATTTACTGGGCATCTACCCGGGAATCCGGGGTCCCTGACCGATTCAGTGGCAGCGGGTCTGGGACAGATTTCACTCTCACCATCAGCAGCCTGTCAGGACTGAAGATGTGACTACTCCCGACGTTCGGCCAAGGGACCAAGGTGGAAATCAAA<br>SEQ ID NO: 25873 | CAGGTGCAGCTGGTGCAGTCTGGGGCTGAGGTGAAGAAGCCTGGGGCCTCAGTGAAGGTCTCCTGCAAGGCTTCTGGATACACCTTGACCAATTATGATATCAACTGGGTGCGACAGGCCACTGGACAAGGCTTGAGTGGATGGGATGGATGAACCCTAACAGTGGTAACACAGGCTATGACCAGGAACACCTCCAGGCAGAGTCACCATGACCAGGACACTGAGACCCTGTGATTACTGTGCTGGGAGTACCAAGGACACGGCCGTGTATTACTGTACTACTGGGGCCAGGGTGGCTGGAACTTCTTTGACTACTGGGGCCAGGGAACCCTGGTCACCGTCTCCTCA<br>SEQ ID NO: 29879 |
| | | AA | DIVMTQSPDSLAVSLGERATTNCKSSSQSVLHRSNNYNYLAWYQQKPGQPPKLLIYWASTRESGVPDRFSGSGSGTDFTLTISSLQAEDVAVYYCQQYYSTPPTFGQGTKVEIK<br>SEQ ID NO: 25874 | QVQLVQSGAEVKKPGASVKVSCKASGYTLTNYDINWVRQATGQGLEWMGWMNPNSGNTGYAQKFQGRVTMTRNTSISTAYMELSSLRSEDTAVYYCGSTSGWNFFDYWGQGTLVTVSS<br>SEQ ID NO: 29880 |

FIGURE 50
(Continued)

| | | | |
|---|---|---|---|
| iPS:434715 | 21-225_80D5 | NA | GAACTTGTGTTGACGCAGTCTCCAGGCACCCT GTCTTTGTCTCCAGGGAAAAGAGTCACCCTCT CCTGCAGGGCCAGTCAGAATATTTACAGCAGC TACTTAGCCTGGTACCAGCAGAAACCTGGCCA GGCTCCCAGACTCCTCATCTATGGTGCATCCA GCAGGGCCACTGGCATCCCAGACTTCAGT GGCAGTGGGTCTGGGACAGACTTCACTCTCAC CATCACCAGACTGGAGCCTGAAGATTTTGCAG TGTATTGCTGTCAGCAGTATGAAAGCTCACCG TGGACCTTCGGCCAAGGGACCAAGGTGGAAA TCAAA<br>SEQ ID NO: 25875 | CAAGTGCAGCTACAGCAGTGGGGCGCAGGACTG TTGAAGCCTTCGGAGCCCTGTCCCTCACCTGCG CTGTCTATGGTGGGTCTTCAGTGGTCCCTACTG GAGCTGGATCGCCAGCCCCCGGAAGGGCT GGAGTGGATTGGGAAATCAATCATAGTGGAAG CACCAACTACAACCGTCCCTCAAGAGTCGAGTC ACCATATCAGTAGACACGTCCAAGAACCAGTTCT CCCTGAAACTGACCTCTGTGACCGCCGCGGACACAT GGCTGTGTATTACTGTGCGAGAGATACGGGGGT TTGACAGTCTGGGGCCAAGGACCACGGTCACC GTCTCCTCA<br>SEQ ID NO: 29881 |
| | | AA | ELVLTQSPGTLSLSPGKRVTLSCRASQNIYSSYLA WYQQKPGQAPRLLIYGASSRATGIPDRFSGSGSG TDFTLTITRLEPEDFAVYCCQQYESSPWTFGQGT KVEIK<br>SEQ ID NO: 25876 | QVQLQQWGAGLLKPSEPLSLTCAVYGGSFSGPYW SWIRQPPGKGLEWIGEINHSGSTNYNPSLKSRVTISV DTSKNQFSLKLTSVTAADMAVYYCARDYGGLDV WGQGTTVTVSS<br>SEQ ID NO: 29882 |
| iPS:434717 | 21-225_80A6 | NA | GAAATTGTGTTGACGCAGTCTCCAGGCACCCT GTCTTTGTCTCCAGGGGAAATACCACCCTCT CCTGCAGGGCCAGTCAGAGTGTTGACAGCGGC TACTTAGCCTGGTACCAGCAGAAACCTGGCCA GGCTCCCAGGCTCCTCATCTATGGTGCATCCA GCAGGGCCCCTGGCATCCCAGACAGGTTCAGT GGCAGTGGGTCTGGGACAGACTTCACTCTCAC CATCAGCAGACTGGAACCTGAAGATTTTGCAG TGTATTACTGTCAGCAGTATGAAAGCTCACCG TGGACGTTCGGCCAAGGGACCAAGGTGGAAA TCAAA<br>SEQ ID NO: 25877 | CAGGTGCAGCTACAGCAGTGGGGCGCAGGACTG TTGAAGCCTTCGGAGACCCTGTCCCTCACCTGCG CTGTCTATGGTGGGTCTTCAGTGGTTGCTACTG GAGCTGGATCGCCAGCCCCCAGGAAAGGGCT GGAGTGGATTGGGAAATCAATCATAGTGGAAG GACCAACTACAACCGTCCCTCAAGAGTCGAGTC ACCATATCAGTAGACACGTCCGAGAAGCAGTTCT CCCTGAAGCTGAGCTCTGTGACCGCCGCGGACAC GGCTGTGTATTACTGGGGCCAGGAGACTACGGTGGG CTTGACTACTGGGGCCAGGGAACCCTGGTCACCG TCTCCTCA<br>SEQ ID NO: 29883 |

FIGURE 50
(Continued)

| | | | |
|---|---|---|---|
| | | AA | EIVLTQSPGTLSLSPGTLSLSPGEIPTLSLCRASQSVDSGYLA WYQQKPGQAPRLLIYGASSRAPGIPDRFSGSGSG TDFTLTISRLEPEDFAVYYCQQYESSPWTFGQGT KVEIK<br>SEQ ID NO: 25878 | QVQLQQWGAGLLKPSETLSLTCAVYGGSFSGCYW SWIRQPPGKGLEWIGEINHSGRTNYNPSLKSRVTIS VDTSEKQFSLKLSSVTAADTAVYYCARDYGGLDY WGQGTLVTVSS<br>SEQ ID NO: 29884 |
| iPS:434725 | 21-225_80H7 | NA | GAAATTGTGTTGACGCAGTCTCCAGGCACCCT GTCTTTGTCTCCAGGGGAAAGAGCCACCCTCT CCTGCAGGGCCAGTCAGTATTAACAGCAAC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTTTTACTGTCAGCAGTATGAGAGCTCACCG TGGACGTTCGGCCAAGGGACCAAGGTGGAAA TCAAA<br>SEQ ID NO: 25879 | CAGGTGCAGCTACAGCAGTGGGGCGCAGGACTG TTGAAGCCTTCGGAGACCCTGTCCCTCACCTGCG CTGTCTATGTTGGGTCCTTCAGTGGTTCCTACTGG AGCTGGATCCGCCAGCCCCCAGGGAAGGGGCTA GAGTGGATTGGGGAAATCAATCAAAGTGGACGC ACCAACTACAACCCGTCCCTCAAGAGTCGAGTCA CCATATCAGTAGACACGTCCAAGAACCAGTTCTC CCTGAAGCTGAGCTCTGTGACCGCCGCGGACACG GCTGTGTATTACTGTGCGAGAGACTACGGGGGTA TAGACGTCTGGGGCCAAGGGACCACGGTCACCG TCTCCTCA<br>SEQ ID NO: 29885 |
| | | AA | EIVLTQSPGTLSLSPGERATLSCRASQSINSNYLA WYQQKPGQAPRLLIYGASSRATGIPDRFSGSGSG TDFTLTISRLEPEDFAVFYCQQYESSPWTFGQGT KVEIK<br>SEQ ID NO: 25880 | QVQLQQWGAGLLKPSETLSLTCAVYVGSFSGSYW SWIRQPPGKGLEWIGEINQSGRTNYNPSLKSRVTIS VDTSKNQFSLKLSSVTAADTAVYYCARDYGGIDV WGQGTTVTVSS<br>SEQ ID NO: 29886 |

FIGURE 50
(Continued)

| | | | |
|---|---|---|---|
| iPS:434729 | 21-225_80B12 | NA | GACATCGTTGACCAGTCCCAGACTCCT<br>GGCTGTGTCTCTGGGCGAGAGGGCCACCATCA<br>ACTGCAAGTCCAGACAGAGTGTTTATACAGC<br>TCCAACAATTACAACTACTTAACTTGGTACCA<br>GCAGAAACCAGGACAGCCTCCTAAGCTGCTCA<br>TTTACTGGGCATCTACCCGGGAATCCGGGGTC<br>CCTGACCGATTCAGTGGCAGCGGGTCTGGGAC<br>AGATTTCACTCTCACCATCAGCAGCCTGCAGG<br>CTGAAGACGTGGCAGTTTATTACTGTCAGCAA<br>TATTATAGTTCTCCTCCTACTTTCGGCGGAGGG<br>ACCAAGGTGGAGATCAAA<br>SEQ ID NO: 25881 | CAGGTGCAGCTGGTGCAGTCTGGGGCTGAGGTG<br>AAGAAGCCTGGGGCCTCAGTGAAGGTCTCCTGC<br>AAGACTTCTGGATACACCTTCACCAATTATGATA<br>TCAACTGGGTGCGACAGGCCACTGGACAAGGGC<br>TTGAGTGGATGGGATGGATGAACCCTAACAGTG<br>GTAACACAGGCTATGCACAGAAGTTCCAGGTCA<br>GAGTCACCATGACCAGGAACACCTCCATAAGCA<br>CAGCCTACATGGAGCTGAGCAGCCTGAGATCTG<br>AGGACACGGCCGTCTATTACTGTGCGTATAGCAG<br>TGGCTGGTACATCTTGACTACTGGGGCCAGGGA<br>ACCCTGGTCACCGTCTCCTCA<br>SEQ ID NO: 29887 |
| | | AA | DIVLTQSPDSLAVSLGERATINCKSRQSVLYSSN<br>NYNYLTWYQQKPGQPPKLLIYWASTRESGVPDR<br>FSGSGSGTDFTLTISSLQAEDVAVYYCQQYYSSP<br>PTFGGGTKVEIK<br>SEQ ID NO: 25882 | QVQLVQSGAEVKKPGASVKVSCKTSGYTFTNYDIN<br>WVRQATGQGLEWMGWMNPNSGNTGYAQKFQVR<br>VTMTRNTSISTAYMELSSLRSEDTAVYYCAYSSGW<br>YIFDYWGQGTLVTVSS<br>SEQ ID NO: 29888 |
| iPS:434731 | 21-225_80E9 | NA | GACATCGTGATGACCCAGTCTCCAGATTGCCT<br>GGCTGTGTCTCTGGGCGAGAGGGCCACCATCA<br>ACTGCAAGTCCAGCCAGAGTGTTTATACACC<br>TCCAACAATAACAACTACTTAGCTTGGTACCA<br>GCAGAAACCAGGACAGCCTCCTAAGCTGCTCA<br>TTTACTGGGCATCTACCCGGGAATCCGGGGTC<br>CCTGACCGATTCAGTGGCAGCGGGTCTGGGAC<br>AGATTTCACTCTCACCATCAGCAGCCTGCAGG<br>CTGAAGATGTTGCAGTTTATTATTGTCAGCAA<br>TATTATAATACTCCGTGACGTTCGTCCAAGG<br>GACCAAGGTGGAAATCAAA<br>SEQ ID NO: 25883 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCAATTATGATA<br>TCAACTGGGTGCGACAGGCCACTGGACAAGGGC<br>TTGAGTGGATGGGATGGATGCACCCTAACAGTGG<br>TAACACAGGCTATGCACAGAAGTTCCAGGGCAG<br>AGTCACCATGACCAGGAACACCTCCATAAGCAC<br>AGCCTACATGGAGCTGAGCAGCCTGAGATCTGA<br>GGACACGGCCGTGTATTACTGTGCGATTAGCAGT<br>GGCTACGGTTGGTTCGACCCCTGGGGCCAGGGA<br>ACCCTGGTCACCGTCTCCTCA<br>SEQ ID NO: 29889 |

FIGURE 50
(Continued)

| | | | | |
|---|---|---|---|---|
| iPS:434735 | 21-225_80B10 | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQQYYNT PWTFVQGTKVEIK<br>SEQ ID NO: 25884 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS<br>SEQ ID NO: 29890 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTGACAGCAGC TACTTAGCCTGGTACCAGCAGAAACCTGGCCA GGCTCCCAGGCTCCTCATCTATGGTGCATCCA GCAGGGCCCCTGGCATCCCAGACAGGTTCAGT GGCAGTGGGTCTGGGACAGATCCTCACTCTCAC CATCAGCAGACTGGAGCCTGAAGATTTTGCAG TGTATTACTGTCAGCAGTATGAAAGCTCACCG TGGACGTTCGGCCAAGGGACCAAGGTCGAAA TCAAA<br>SEQ ID NO: 25885 | CAGGTGCAGCTACAGCAGTGGGGCGCAGGACTG TTGAAGCCTTCGGAGACCCTGTCCTCACCTGCG CTGTCTATGTGGTCCTTCAGTGGTTGCTACTG GAGCTGGATCGCCAGCCCCAGGGAAGGGGCT GGAGTGGATTGGGAAATCAATCATAGTGGAAG CACCAACTACAACCGTCCCTCAAGAGTCGAGTC ACCATATCAGTAGACACGTCCAAGAACCAGTTCT CCCTGAAGCTGAGCTCTGTGACGGCCGCGGACAC GGCTGTGTATTACTGTGCGAGAGACTACGGTGGG CTTGACTACTGGGGCCAGGGAACCCTGGTCACCG TCTCCTCA<br>SEQ ID NO: 29891 |
| | | AA | EIVLTQSPGTLSLSPGERATLSCRASQSVDSSYLA WYQQKPGQAPRLLIYGASSRAPGIPDRFSGSGSG TDFTLTISRLEPEDFAVYYCQQYESSPWTFGQGT KVEIK<br>SEQ ID NO: 25886 | QVQLQQWGAGLLKPSETLSLTCAVYGGSFSGCYW SWIRQPPGKGLEWIGEINHSGSTNYNPSLKSRVTISV DTSKNQFSLKLSSVTAADTAVYYCARDYGGLDYW GQGTLVTVSS<br>SEQ ID NO: 29892 |

FIGURE 50
(Continued)

| | | | |
|---|---|---|---|
| iPS:434737 | 21-225_74G6 | NA | GACATCCAGATGACCCAGTCTCCATCCTCACT GTCTGCATCAGTAGGAGACAGAGTCACCATCA CTTGTCGGGCGAGTGCAGGTCAGGGCATTGGCAAGTAT TTAGCCTGGTTTCAGCAGAAACCAGGAAAGC CCCTAAGTCCCTGATCTATACTCATCCAGTTT GCAAAGTGGGGCCCATCAAGTTCAGCGGC AGTGGATCTGGGACAGATTTCACTCTCACCAT CAGCAGCCTGCAGTATGAAGATTTTGCAACTT ATTACTGCCAACAGTACAGTAATTACCCGCTC ACTTTCGGCGGAGGGACCAAGGTGGAGATCA AT | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGGCT GGAGTGGGTGGCAGTTATATGGTATGATGGAAGT AATAAAAACTATGCAGACTCCGTGAAGGGCGA TTCACCATCTCCAGAGACAATTCCAAGAACACGC TGTATCTGCAAATGAACAGCCTGAGAGCCGAGG ACACGGCTGTGTATTACTGTGCGAGAGATGGCAG CTATGGTTATGACGGCCTTGACTACTGGGGCCAG GGAACCCTGGTCACCGTCTCCTCA |
| | | | SEQ ID NO: 25887 | SEQ ID NO: 29893 |
| | | AA | DIQMTQSPSSLSASVGDRVTITCRASQGIGKYLA WFQQKPGKAPKSLIYTTSSLQSGAPSKFSGSGSG TDFTLTISSLQYEDFATYYCQQYSNYPLTFGGGT KVEIN | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDGSYG YDGLDYWGQGTLVTVSS |
| | | | SEQ ID NO: 25888 | SEQ ID NO: 29894 |
| iPS:434741 | 21-225_80C11 | NA | GACATCCAGATGACCCAGTCTCCATCCTCACT GTCTGCTTCTGTAGGGGACAGAGTCACCATCA CTTGTCGGGCGAGTGCAGGTCAGGGCATTGGCAAGTAT TTAGCCTGGTTTCAGCAGAAACCAGGAGAGC CCCTAAGTCCCTGATCTATACTGCATCCAGTTT GCAAAGTGGGGCCCATCAAGTTCAGCGGC AGTGGATCTGGGACAGATTTCACTCTCACCAT CAGCAGCCTGCAGCCTGAAGATTTTGCAACTT ATTACTGCCAACAGTACAGTAATTACCCGCTC ACTTTCGGCGGAGGGACCAAAGTGGAGATCA AT | CAGGTGCAGCTGGTGGAGTCTGGGGGAGGCGTG GTCCAGCCTGGGAGGTCCCTGAGACTCTCCTGTG CAGCGTCTGGATTCACCTTCAGCAGCTATGGCAT GCACTGGGTCCGCCAGGCTCCAGGCAAGGGGCT GGAGTGGGTGGCAGTTATATGGTATGATGGAAGT AATAAAAACTATGCAGACTCCGTGAAGGGCCGA TTCACCATCTCCAGAGACAATTCCAAGAACACGC TGTCTCTGCAAATGAACAGCCTGAGAGCCGAGG ACACGGCTGTGTATTACTGTGCGAGAGATGGCAG CTATGGGTATGACGGCCTTGACTACTGGGGCCAG GGAACCCTGGTCACCGTCTCCTCA |
| | | | SEQ ID NO: 25889 | SEQ ID NO: 29895 |

FIGURE 50
(Continued)

| | | | |
|---|---|---|---|
| iPS:434743 | | AA | DIQMTQSPSSLSASVGDRVTITCRASQGIGRYLA WFQQKPGRAPKSLIYTASSLQSGAPSKFSGSGSG TDFTLTISSLQPEDFATYYCQQYSNYPLTFGGGT KVEIN<br>SEQ ID NO: 25890 | QVQLVESGGGVVQPGRSLRLSCAASGFTFSSYGMH WVRQAPGKGLEWVAVIWYDGSNKNYADSVKGRF TISRDNSKNTLSLQMNSLRAEDTAVYYCARDGSYG YDGLDYWGQGTLVTVSS<br>SEQ ID NO: 29896 |
| | 21-225_74A4 | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTGTGGGACAGACTTCGCTCTCAC CATCAGCAGACTGGAGCCTGAAGATTGTGCAG TGTATTACTGTCAGCACTGTGATAACTCACCGT GGACGTTCGGCCAAGGGACCAAGGTGAAAT CAAA<br>SEQ ID NO: 25891 | CAGGTGCAGCTACAGCAGTGGGGCGCAGGACTG TTGAAGCCTTCGGAGACCCTGTCCCTCACCTGCG CTGTCCATGTGGGTCTTCAGTGGTTGCTACTG GAGCTGGATCCGCCAGCCCCAGGGAAGGGCT GGAGTGGATTGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br>SEQ ID NO: 29897 |
| | | AA | EIVLTQSPGTLYLSPGERATLSCRASQSVYSSYLA WYQQKPGQAPRLLIYGASSRSTGIPDRFSGSGCG TDFALTISRLEPEDCAVYYCQHSDNSPWTFGQG TKVEIK<br>SEQ ID NO: 25892 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29898 |

FIGURE 50
(Continued)

| | | | |
|---|---|---|---|
| iPS:434747 | 21-225_80C12 | NA | GAAATTGTTGTTGACGCAGTCTCCAGGCACCCT GTATTTGTCTCCAGGGGAAAGAGCCACCCTCT CGTGCAGGGCCAGTCAGAGTGTTAGCAGCAGC TACTTAGCCTGGTACCAGCAGAAACCTGGCCA GGCTCCCAGGCTCCTCATCTATGGTGCATCCA CCAGGGCCACTGGCATCCCAGACAGTTCAGT GGCAGTGGGTCTGGGACAGACTTCACTCTCAC CATCAGCAGACTGGAGCTGAAGATTTTGCAG TTTATTACTGTCAGCAGTATGGTAACTCACCG CTCACTTTCGGCGGAGGGACCAAGGTGGAGAT CAAA<br><br>SEQ ID NO: 25893 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAATGG TAACACAGGCTATGCACAGAAGTTCAGGGCAG AGTCACCATGACCAGGAACACCTCCATAAGCAC AGCCTACATGGAGCTGAACAGCCTGAGATCTGA GGACACGGCCGTGTATTACTGTGCGATTAGCAGT GGCTGGTACTGGTTCGACCCCTGGGGCCAGGGA ACCCTGGTCACCGTCTCCTTA<br><br>SEQ ID NO: 29899 |
| | | AA | EIVLTQSPGTLYLSPGERATLSCRASQSVSSSYLA WYQQKPGQAPRLLIYGASTRATGIPDRFSGSGSG TDFTLTISRLEPEYFAVYYCQQYGNSPLTFGGGT KVEIK<br><br>SEQ ID NO: 25894 | QVQLVQSGAEVKKPGASVKVSCKASGYTFTNYDIN WVRQATGQGLEWMGWMHPNNGNTGYAQKFQGR VTMTRNTSISTAYMELNSLRSEDTAVYYCAISSGW YWFDPWGQGTLVTVSL<br><br>SEQ ID NO: 29900 |
| iPS:434751 | 21-225_80H12 | NA | GAAATTGTTGTTGACGCAGTCTCCAGGCACCCT GTCTTTGTCTCCAGGGGAAAGAGCCACCCTCT CATGCAGGGCCAGTCAGAGTGTTACAGCAGC TACTTAGCCTGGTACCAGCAGAAACCTGGCCA GGCTCCCAGGCTCCTCATTTATGGTGCATCCA GCCGGTCCACTGGCATCCCAGACAGTTCAGT GGCAGTGGGTCTGGGACAGACTTCGCTCTCAC CATCAGCAGACTGGAGCTGAAGATTTTGCAG TGTATTACTGTCAGCAGCACTCTGATAACTCACCGT GGACGTTCGGCCAAGGGACCAAGGTGGAAAT CAAA<br><br>SEQ ID NO: 25895 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCCAGGGAAGGGGCT GGAGTGGATTGGGAAATCAATCATAGTGGAAG CACCAACTACAACCCGTCCCTCAAGAGTGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 29901 |

FIGURE 50
(Continued)

| | | | | |
|---|---|---|---|---|
| | | | AA | EIVLTQSPGTLSLSPGERATLSCRASQSVYSSYLA WYQQKPGQAPRLLIYGASSRSTGIPDRFSGSGSG TDFALTISRLEPEDFAVYYCQHSDNSPWTFGQGT KVEIK<br><br>SEQ ID NO: 25896 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 29902 |
| iPS:434759 | 21-225_81C5 | NA | GAAATTGTGTTGACGCAGTCTCCAGGCACCCT GTATTTGTCTTCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGTCATCCA GCCGGTTCACTGGCATCCCAGACAGGTTCAGT GGCAGTGGGTGTGGGACAGACTTCGCTCTCAC CATCAGCAGAGTGGAGCCTGAAGATTGTGCAG TGTATTACTGTCAGCATTCTGATAACTCACCGT GGACGTTCGGCCAAGGGACCAAGGTGGAAAT CAAA<br><br>SEQ ID NO: 25897 | CAGGTGCAGCTACAGCAGTGGGGCGCAGGACTG TTGAAGCCTTCGGAGACCCTGTCCCTCACCTGCG CTGTCCATGTGGTCCTTCAGTGGTTGCTACTG GAGCTGGATCCGCCAGCCCCAGGAAGGGCT GGAGTGGATTGGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 29903 |
| | | AA | EIVLTQSPGTLYLSSGERATLSCRASQSVYSSYLA WYQQKPGQAPRLLIYGASSRSTGIPDRFSGSGCG TDFALTISRVEPEDCAVYYCQHSDNSPWTFGQG TKVEIK<br><br>SEQ ID NO: 25898 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 29904 |

FIGURE 50
(Continued)

| | | | | |
|---|---|---|---|---|
| iPS:434761 | 21-225_81E5 | NA | GACATCGTTATGACCCAGTCTCCAGATTGCCT GGCTGTGTCTCTGGGCGAGAGGGCCACCATCA ATTGCAAGTCCAGCCAGAGTGTTTATTCAGC TCCAACAATTATAATTACTTAGTTGGTACCA GCAGAGACCAGGACAGCCTCCTAACCTGCTCA TTTACTGGGCATCTACCCGGAATCCGGGGTC CCTGACCGATTCAGTGGCAGCGGGTCTGGGAC AGATTTCACTCTCACCATCAGCAGCCTGCAGG CTGCTGATGTGGCAGTTTATTACTGTCAGCAA TATTATAGTTCTCCTGACGTTCGGCCAAGG GACCACGGTGCAAATCAAA | CAGGTGCAGTTGGTGCAGTCTGGGGCTGAGGTGA AGAAGCCTGGGGCCTCAGTGAAGGTCTCCTGCA AGGCTTCTGGATACACCTTCACCAATTATGATAT CAACTGGGTGCGACAGGCCACTGGACAAGGCT TGAGTGGATGGGATGGATGAACCCTAACAGTGG TAACACAGGCTATGCACAGAAGTTCCAGGGCAG AGTCACCATGACCAGGAACACTTCCACAAGCAC AGCCCACATGGAGCTGAGCAGCCTGAGATCTGA GGACACGGCCGTGTATTACTGTGCGGTCTCCAGT GGCTGGAACTGGTTCGACCCCTGGGGCCAGGGA ACCCTGGTCACCGTCTCCTCA |
| | | | SEQ ID NO: 25899 | SEQ ID NO: 29905 |
| | | AA | DIVMTQSPDSLAVSLGERATINCKSSQSVLFSSN NYNYLAWYQQRPGQPPNLLIYWASTRESGVPD RFSGSGSGTDFTLTISSLQAADVAVYYCQQYYSS PLTFGQGTTVQIK | QVQLVQSGAEVKKPGASVKVSCKASGYTFTNYDIN WVRQATGQGLEWMGWMNPNSGNTGYAQKFQGR VTMTRNTSTSTAHMELSSLRSEDTAVYYCAVSSGW NWFDPWGQGTLVTVSS |
| | | | SEQ ID NO: 25900 | SEQ ID NO: 29906 |
| iPS:434771 | 21-225_81F9 | NA | GACATCGTGATGACCCAGTCTCCAGATTGCCT GGCTGTGTCTCTGGGCGAGAGGGCCACCATCA ACTGCAAGTCCAGCCAGAGTGTTTTATAGCTTGGTACCA TCCAACAATAACAACTACTTGGTACCA GCAGAAACCAGGACAGCCTCCTAAGCTGCTCA TTTACTGGGCATCTACCCGGAATCCGGGGTC CCTGACCGATTCAGTGGCAGCGGGTCTGGGAC AGATTTCACTCTCACCATCAGCAGCCTGCAGG CTGAAGATGTTGCAGTTTATTATCGTCAGCAA TACAATGATACTCCAGGAAGTTTGTCCAAGG CATCATGGGAAATCACA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGGTTCGACCCCTGGGGCCAGGGA ACCCTGGTCACCGTCTCCTCA |
| | | | SEQ ID NO: 25901 | SEQ ID NO: 29907 |

FIGURE 50
(Continued)

| | | | | |
|---|---|---|---|---|
| iPS:434773 | | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYRQHYNDT PGKFVQGIMVEIT<br>SEQ ID NO: 25902 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS<br>SEQ ID NO: 29908 |
| | | NA | GAAATTGTTGACGCAGTCTCCAGGCACCCT GTCTTTGTCTCCAGGGGAAAGAGCCACCCTCT CCTGCAGGGCCAGTCAGTGTTAGCAGCAGC TACTTAGCCTGGTACCAGCAGAAACGTGGCCA GGCTCCCAGGCTCCTCATCTATGGTGCATCCA GCAGGGCCACTGGCATTCCAGACAGTTCAGT GGCAGTGGGTCTGGGACAGATTCACTCTCAC CATCAGCAGACTGGAGCTGAAGATTTTGCAG TGTATTACTGTCAGCAGTATTATGAAAGCTCACG TGGACGTTCGGCCAAGGGACCAAGGTGGAAA TCAAA<br>SEQ ID NO: 25903 | CAGGTGCAGCTACAGCAGTGGGGCGCAGGACTG TTGAAGCCTTCGGAGACCCTGTCCCTCACCTGCG CTGTCTATGGTGGTCCTTCAGTGGTCCCTACTG GAGCTGGATCGCCAGCCCCAGGGAAGGGCT GGAGTGGATTGGGAAATCAATTATAGGGAAG CACCAACTACAACCGTCCTCAAGAGTCGAGTC ACCATTTCAGTAGACACGTCCAAGAACCAGTTCT CCCTGAACCTGAGCTCTGTGACCGCCGCCGACAC GGCTGTGTATTACTGTGCGAGGGACTACGGCGGT ATGGACGTCTGGGGCCAAGGGACCACGGTCACC GTCTCCTCA<br>SEQ ID NO: 29909 |
| 21-225_75D9 | | AA | EIVLTQSPGTLSLSPGERATLSCRASQSVSSSYLA WYQQKRGQAPRLLIYGASSRATGIPDRFSGSGSG TDFTLTISRLEPEDFAVYYCQQYESSPWTFGQGT KVEIK<br>SEQ ID NO: 25904 | QVQLQQWGAGLLKPSETLSLTCAVYGGSFSGPYW SWIRQPPGKGLEWIGEINYRGSTNYNPSLKSRVTIS VDTSKNQFSLNLSSVTAADTAVYYCARDYGGMDV WGQGTTVTVSS<br>SEQ ID NO: 29910 |

FIGURE 50
(Continued)

| | | | | |
|---|---|---|---|---|
| iPS:434777 | 21-225_81C11 | NA | GAAATTGTGTTGACGCAGTCTCCAGGCACCCTG GTATTTGTCTCCAGGGGAAAGAGCCACCCTCT CATGCAGGGCCAGTCAGAGTGTTTACAGCAGC TACTTAGCCTGGTACCAGCAGAAACTGGCCA GGCTCCCAGGCTCCTCATTTATGTGCATCCA GCGGTCCACTGGCCTCCCAGACAGGTTCAGT GGCAGTGGGTGTGGGACAGACTTCGCTCTCAC CATCAGCAGACTGGAGCCTGAAGATTGTGCAG TGTATTACTGTCAGCATTCTGATAACTCACCGT GGACGTTCGGCCAAGGGACCAAGGTGGAAAT CAAA | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCGCCAGCCCCCAGGGAAGGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA |
| | | | SEQ ID NO: 25905 | SEQ ID NO: 29911 |
| | | AA | EIVLTQSPGTRYLSPGERATLSCRASQSVYSSYL AWYQQKPGQAPRLLIYGASSRSTGLPDRFSGSG CGTDFALTISRVEPEDCAVYYCQHSDNSPWTFG QGTKVEIK | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS |
| | | | SEQ ID NO: 25906 | SEQ ID NO: 29912 |
| iPS:434793 | 21-225_82A5 | NA | GAAATTGTGTTGACGCAGTCTCCAGGCACCCT GTCTTGGTCTCCAGGGGAAAGAGCCACCCTCT CGTGCAGGGCCAGTCAGAGTGTTAGCAGCAGC TACTTAGCCTGGTACCAGCAGAAACTGGCCA GGCTCCCAGGCTCCTCATCTATGGTGCATCCA CCAGGGCCACTGGCATCCCAGACAGGTTCAGT GGCAGTGGGTCTGGGACAGACTTCACTCTCAC CATCAGCAGACTGGAGCCTGAATATTTTGCAG TTTATTACTGTCAGCAGTATGGTAACTCACCG CTCACTTTCGGCGGAGGGACCAAGGTGGAGAT CAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAACAATGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGTTCGACCCCTGGGGCCAGGGA ACCCTGGTCACCGTCTCCTTA |
| | | | SEQ ID NO: 25907 | SEQ ID NO: 29913 |

FIGURE 50
(Continued)

| | | | | |
|---|---|---|---|---|
| iPS:434797 | 21-225_82G5 | AA | EIVLTQSPGTLSWSPGERATLSCRASQSVSSSYLAWYQQKPGQAPRLLIYGASTRATGIPDRFSGSGSGTDFTLTISRLEPEYFAVYYCQQYGNSPLITFGGGTKVEIK<br>SEQ ID NO: 25908 | QVQLVQSGAEVKKPGASVKVSCKASGYTFTNYDINWVRQATGQGLEWMGWMHPNNGNTGYAQKFQGRVTMTRNTSISTAYMELNSLRSEDTAVYYCAISSGWYWFDPWGQGTLVTVSL<br>SEQ ID NO: 29914 |
| | | NA | GAATTTATGTTGACGCAGTCTCCAGGCACCCTGTATTGGTCTCCAGGGGAAAGAGCCACCCTCTGAGCAGGGCCAGTGAGAGTGTTAGCAGCAGCTACTTAGTCTGGTATCAGCAGAAACCTGGCCAGGCTCCCAGGCTCCTCATCTATGGTGCATCCACCAGGGCCACTGGCATCCCAGACAGGTTCAGTGGCAGTGGGTCTGGGACAGAGCTCACTCTCACCATCAGCAGACTGGAGCCTGAATATTTGCAGTTTATTACTGTCAGCAGTATGGTTGCTCACCGCTCACTTTCGGCGGAGGGACCAAGGTGGAGATCACA<br>SEQ ID NO: 25909 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGTCCCTGGACAAGGGCTTGAGTGGATGGGATGGATGCACAGAACAGTGGTAACACAGGCTATGCACAGAAGTTCCAGGGCAGAGTCACCATGACCAGGAACACCTCCATCAGCACAGCCTACATGGAGCTGAGCAGCCTGAGATCTGAGGACACGGCCGTGTATTACTGTGCGATTAGTAGTGGCTGGTACTGGTTCGACCCCTGGGGCCAGGGAACCCTGGTCACCGTCTCCTCA<br>SEQ ID NO: 29915 |
| | | AA | EFMLTQSPGTLYWSPGERATLSSRASESVSSSYLVWYQQKPGQAPRLLIYGASTRATGIPDRFSGSGSGTDFFLTISRLEPEYFAVYYCQQYCGCSPLITFGGGTKVEIT<br>SEQ ID NO: 25910 | QVQLVQSGAEVKKPGASVKVSCKASGYTFTNYDINWVRQVPGQGLEWMGWMHPNSGNTGYAQKFQGRVTMTRNTSISTAYMELSSLRSEDTAVYYCAISSGWYWFDPWGQGTLVTVSS<br>SEQ ID NO: 29916 |

FIGURE 50
(Continued)

| | | | |
|---|---|---|---|
| iPS:434805 | 21-225_82D9 | NA | GAATTTATGTTGACGCAGTCTCCAGGCACCCT GTCTGTCTCCAGGGGAAAGAGCCACCCTCT CGTGCAGGGCCAGTGAGAGTGTTAGCAGCAG CTACTTAGTCTGGTATCAGCAGAAACCTGGCC AGGCTCCCAGGCTCCTCATCTATGGTGCATCC ACCAGGGCCACTGGCATCCCAGACAGGTTCAG TGGCAGTGGGTCTGGGACAGACTTCACTCTCA CCATCAGCAGACTGGAGCTGAATATTTTGCA GTTTATTACTGTCAGCAGTATGGTTGCTCACCG CTCACTTTCGGCGGAGGGACCAAGGTGGAGAT CACA<br><br>SEQ ID NO: 25911 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGTCCTGACAAGGGC TTGAGTGGATGGGATGGATGCACAGAAGTTCCAGGCAG TAACACAGGCTATGCACCAGGAACACTCCATCACAGT AGTCACCATGACCAGGAACACTCCATCACAGCAC AGCCTACATGGAGCTGAGCAGCCTGAGATCTGA GGACACGGCCGTGTATTACTGTGCGATTAGTAGT GGCTGGTACTGGTTCGACCCCTGGGGCCAGGGA ACCCTGGTCACCGTCCTCA<br><br>SEQ ID NO: 29917 |
| | | AA | EFMLTQSPGTLSWSPGERATLSCRASESVSSSYL VWYQQKPGQAPRLLIYGASTRATGIPDRFSGSGS GTDFTLTISRLEPEYFAVYYCQQYGCSPLTFGGG TKVEIT<br><br>SEQ ID NO: 25912 | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS<br><br>SEQ ID NO: 29918 |
| iPS:434809 | 21-225_74F5 | NA | GAAATTGTTGTTGACGCAGTCTCCAGGCACCCT GTATTTGTCTCCAGGGGAAAGAGCCACCCTCT CATGCAGGGCCAGTCAGAGTGTTACAGCAGC TACTTAGCCTGGTACCAGCAGAAACCTGGCCA GGCTCCCAGGCTCCACTGGCATCCCAGACAGGTTCAGT GCCGGTCCACTGGCATCCCAGACAGGTTCAGT GGCAGTGGGTCTGGGACAGACTTCGCTCTCAC CATCAGCAGACTGGAGCTGAAGATTTTGCAG TGTATTACTGTCAGCAGCACTCTGATAACTCACCGT GGACGTTCGGCCAAGGGACCAAGGTGGAAAT CAAA<br><br>SEQ ID NO: 25913 | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGCT GGAGTGGATTGGGAAATCAATCATAGTGGAAG CACCAACTACAACCGTCCCTCAAGAGTCGAGTC ACCATTTCAGTAGACAGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 29919 |

FIGURE 50
(Continued)

| | | | | |
|---|---|---|---|---|
| iPS:434813 | | AA | EIVLTQSPGTLYLSPGERATLSCRASQSVYSSYLA WYQQKPGQAPRLLIYGASSRTGIPDRFSGSGSG TDFALTISRLEPEDFAVYYCQHSDNSPWTFGQGT KVEIK SEQ ID NO: 25914 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS SEQ ID NO: 29920 |
| | 21-225_82C12 | NA | GAAATTGTGTTGACGCAGTCTCCAGGCACCCT GTCTTGGTCTCCAGGGGAAAGAGCCACCCTCT CGTGCAGGGCCAGTCAGAGTGTTAGCAGCAGC TACTTAGCCTGGTACCAGCAGAAACCTGGCCA GGCTCCCAGGCTCCTCATCTATGGTGCATCCA CCAGGGCCCTCTGGCATCCCAGACAGGTTCAGT GGCAGTGGGTCTGGGACAGACTGGAGCCTGAGC AGCCTGCGAGCAGGAGATGGAGCTGAGCCTGAAGATTTTGCAG TTTATTACTGTCAGCAGTATGGTAACTCACCG CTCACTTTCGGCGGAGGGACCAAGGTGGAGAT CAAA SEQ ID NO: 25915 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAACAATGG TAACACAGGCTATGCACAGAAGTTCCAGGGCAG AGTCACCATGACCAGGAACACTTCCATAAGCAC AGCCTACATGGAGCTGAGCTCTGTGCGATTAGCAGT GGACACGGCCGTGTATTACTGTGCGATTAGCAGT GGCTGGTACTGGTTCGACCCCTGGGGCCAGGGA ACCCTGGTCACCGTCTCCTTA SEQ ID NO: 29921 |
| | | AA | EIVLTQSPGTLSWSPGERATLSCRASQSVSSSYLA WYQQKPGQAPRLLIYGASTRASGIPDRFSGSGSG TDFFLTISRLEPEYFAVYYCQQYGNSPLTFGGGT KVEIK SEQ ID NO: 25916 | QVQLVQSGAEVKKPGASVKVSCKASGYTFTNYDIN WVRQATGQLEWMGWMHPNGNTGYAQKFQGR VTMTRNTSISTAYMELNSLRSEDTAVYYCAISSGW YWFDPWGQGTLVTVSL SEQ ID NO: 29922 |

FIGURE 50
(Continued)

| | | | |
|---|---|---|---|
| iPS:434815 | 21-225_74A11 | NA | GACATCAGATGACCCAGTCTCCATCCTCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTGTCTGCATCCAGT TTGCAAAGTGGGGTCCCATCAAGGTTCAGCGG CAGTGGATCTGGGACCGAGTTCACTCTCACA TCAGCAGCCTGCAGCCTGAGGATTTTGCAACT TATTTCTGTCTACACGCATAATGATTACCCATTC ACTTTCGGCCCTGGGACCAAAGTGGATATCAA A SEQ ID NO: 25917 | CAGGTGCAGCTGGTGCAGTCTGGGGCTGAGGTG AAGAAGCCTGGGGCCTCAGTGAAGGTCTCTGTA AGGCTTCTGGATACACCTTCACCAGTTATGATAT CAACTGGGTGCGACAGGCCACTGGACAAGGGCT TGAGTGGATGGGATGGATGAACCCTAACAGTGG TAACACAGGCTATGCACAGAAGTTCCAGGCAG AGTCACCATGACCTGAACACCTCCAAAAGCAC AGCCTACATGGAGCTGAGCAGCCTGAGATCTGA GGAACACGGCCGTGTATTACTGTGCGAGAGGCTTT TACGATACTTTGACTGGTTCCGGCTACTACG TTATGGACGTCTGGGGCCAAGGGACCACGGTCA CCGTCTCCTCA SEQ ID NO: 29923 |
| | | AA | DIQMTQSPSSLSASVGDRVTITCRASQDIRNDLG WYQQKPGKAPKRLICAASSLQSGVPSRFSGSGS GTEFTLTISSLQPEDFATYFCLQHNDYPFTFGPGT KVDIK SEQ ID NO: 25918 | QVQLVQSGAEVKKPGASVKVSCKASGYTFTSYDIN WVRQATGQGLEWMGWMNPNSGNTGYAQKFQGR VTMTWNTSKSTAYMELSSLRSEDTAVYYCARGFY DTLTGSGYYYVMDVWGQGTTVTVSS SEQ ID NO: 29924 |
| iPS:434821 | 21-225_83G1 | NA | GAAATTGTGTTGACGCAGTCTCCAGGCACCCTG GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCAGGTCCACGGTCCCCAGACAGGTTCAGT GGCAGTGGGTCTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGGAAAT CAAA SEQ ID NO: 25919 | CAGGTGCAGCTGCAGCTACAGCAGTGGGGCGCAGGACTG TTGAAGCCTTTGGAGGGCTCCCTCACCTGCG CTGTCCATGTGGTCCTTCAGTGGTTGCTACTG GAGTGGATCCGCCAGCCCCCAGGGAAGGGCT GGAGTGGATTGGGAAATCAATCATCATAGTGGAAG ACCAACTACAACCGTCCCTCCAAGAGTCGAGTC ACCATTTCAGTAGACACGTCCAAGAACCAGTTCT CCCTGAAGTGAGCTCTGTGACCGCGCGGACAC GGCTGTGTATTACTGTGCGAGGGACTACGGCGGT ATGGACGTCTGGGGCCAAGGGACCACGGTCACC GTCTCCTCA SEQ ID NO: 29925 |

FIGURE 50
(Continued)

| | | | | |
|---|---|---|---|---|
| iPS:434825 | 21-225_83C2 | AA | EIVLTQSPGTRYLSPGERATLSCRASQSVYSSYL AWYQQKPGQAPRLLIYGASSRSTVLPDRFSGSGS GTDFALTISRVEPEDCAVYYCQHSDNSPWTFGQ GTKVEIK<br>SEQ ID NO: 25920 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29926 |
| | | NA | GAATTTATGTTGACGCAGTCTCCAGGCACCCT GTGTTTGTCTCCAGGGGAAAGAGCCACCCTCT CGTGCAGGGCCAGTCAGAGTGTTAGCAGCAGC TACTTAGTCTGGTATCAGCAGAAACCTGGCCA GGCTCCCAGGCTCCTCATCTATGGTGCATCCA CCAGGGCCACTGGCATCCCAGACAGGTTCAGT GGCAGTGGGTCTGGGACAGACTTCACTCTCAC CATCAGCAGACTGGAGCCTGAATATTTTGCAG TTTATTACTGTCAGCAGTATGTTGCTCACCGC TCACTTTCGGCGGAGGGACCAAGGTGGAGATC ACA<br>SEQ ID NO: 25921 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGTCCCTGACAAGGGC TTGAGTGGATGGGATGGATGCACCCTAACAGTGG TAACACAGGCTATGCACAGAAGTTCCAGGCAG AGTCACCATGACCAGGAACACCTCCATCAGCAC AGCCTACATGAGCTGAGCAGCCTGAGATCTGA GGACACGGCCGTGTATTACTGTGCGATTAGTAGT GGCTGGTACTGGTTCGACCCTGGGGCCAGGGA ACCCTGGTCACCGTCTCCTCA<br>SEQ ID NO: 29927 |
| | | AA | EFMLTQSPGTLCLSPGERATLSCRASQSVSSSYL VWYQQKPGQAPRLLIYGASTRATGIPDRFSGSGS GTDFTLTISRLEPEYFAVYYCQQYGCSPLTFGGG TKVEIT<br>SEQ ID NO: 25922 | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS<br>SEQ ID NO: 29928 |

FIGURE 50
(Continued)

| | | | |
|---|---|---|---|
| iPS:434827 | 21-225_83F3 | NA | GACATCGTGATGACCCAGTCTCCAGATTGCCT GGCTGTGTCTCTGGGCGAGAGGGCCACCATCA ACTGCAAGTCCAGCCAGAGTGTTTATACACC TCCAACAATAACAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTTGCAGTTTATTATTGTCAGCACT ATAATGATATACTCCATGGAAGTTTGTCCAAGGG ATCAAGGTGGAAATCAAA SEQ ID NO: 25923 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGGTTCGACCCCTGGGGCCAGGGA ACCCTGGTCACCGTCTCCTCA SEQ ID NO: 29929 |
| iPS:434829 | 21-225_83G3 | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQHYNDT PWKFVQGIKVEIK SEQ ID NO: 25924 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS SEQ ID NO: 29930 |
| | | NA | GACATCGTGATGACCCAGTCTCCAGATTGCCT GGCTGTGTCTCTGGGCGAGAGGGCCACCATCA ACTGCAAGTCCAGCCAGAGTGTTTATACACC TCCAACAATAACAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTTGCAGTTTATTATTGTCAGCACT ATTATAATACTCCGTGGACGTTTGTCCAAGGG ACCAAGGTGGAAATCAAA SEQ ID NO: 25925 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGGTTCGACCCCTGGGGGCCAGGGA ACCCTGGTCACCGTCTCCTCA SEQ ID NO: 29931 |

FIGURE 50
(Continued)

| | | | | |
|---|---|---|---|---|
| | | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQHYYNT PWTFVQGTKVEIK<br>SEQ ID NO: 25926 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS<br>SEQ ID NO: 29932 |
| iPS:434833 | 21-225_83C5 | NA | GAATTTATGTTGACGCAGTCTCCAGGCACCCT GTGTTGGTCTCCAGGGGAAAGAGCCACCCTCT CGTGCAGGGCCAGTGAGAGTGTTAGCAGCAG CTACTTAGTCTGGTATCAGCAGAAACCTGGCC AGGCTCCCAGGCTCCTCATCTATGGTGCATCC ACCAGGGCCACTGGCATCCCAGACAGGTTCAG TGGCAGTGGGTCTGGGACAGACTTCACTCTCA CCATCAGCAGACTGGAGCTGAATATTTTGCA GTTTATTACTGTCAGCAGTATGGTTGCTCACCG CTCACTTTCGGCGGAGGGACCAAGGTGGAGAT CACA<br>SEQ ID NO: 25927 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCTCCTGGACAAGGGC TTGAGTGGATGGGATGGATGCACAGAAGTTCCAGGGCAG TAACACAGGCTATGCACCAGAACACTCCATCAGCAC AGTCACCATGACCAGAGCAGCCTGAGATCTGA AGCCTACATGGAGCTGAGCAGCCTGAGATCTGA GGACACGGCCGTGTATTACTGTGCGATTAGTAGT GGCTGGTACTGGTTCGACCCTGGGGCCAGGGA ACCCTGGTCACCGTCTCCTCA<br>SEQ ID NO: 29933 |
| | | AA | EFMLTQSPGTLCWSPGERATLSCRASESVSSSYL VWYQQKPGQAPRLLIYGASTRATGIPDRFSGSGS GTDFTLTISRLEPEYFAVYYCQQYGCSPLTFGGG TKVEIT<br>SEQ ID NO: 25928 | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS<br>SEQ ID NO: 29934 |

FIGURE 50
(Continued)

| | | | |
|---|---|---|---|
| iPS:434835 | 21-225_83B6 | NA | GAAATTGTGTTGACGCAGTCTCCAGGCACTTT GTCTTTGTCTCCAGGGGAAAGAGCCACCCTCT CCTGCAGGGCCAGTCAGAGTGTTGACAGCGC TACTTAGCCTGGTACCAGCAGAAACCTGGCCA GGCTCCCAGGTCCTCATCTATGGTGCATCCA GCAGGACCCCTGGCATCCAGACAGTTCAGT GGCAGTGGGTCTGGGACAGACTTCACTCTCAC CATCAGCAGACTGGAGCCTGAAGATTTTGCAG TGTATTACTGTCAGCAGTATGAAAGCTCACCG TGGACGTTCGGCCAAGGGACCAAGGTGGAAA TCAAA<br><br>SEQ ID NO: 25929 | CAGGTGCAGCTACAGCAGTGGGGCGCAGGACTG TTGAAGCCTTCGGAGACCCTGTCCCTCACCTGCG CTGTCTATGGTGGGTCTTCAGTGGTTGTTACTGG AGCTGGATCCGCCAGCCCCCAGGGAAGGGCTG GAGTGGATTGGGAAATCAATACATAGTGAAGG ACCAACTACAACCCTCCCTCAAGAGTCGAGTCA CCATATCAGTAGACACGTCCGAGAACCAGTTCTC CCTGAAGCTGAGCTCTGTGACCGCCGCGACACG GCTGTGTATTACTGTGCGAGAGACTACGGTGGC TTGACTACTGGGGCCAGGGAACCCTGGTCACCGT CTCCTCA<br><br>SEQ ID NO: 29935 |
| | | AA | EIVLTQSPGTLSLSPGERATLSCRASQSVDSGYLA WYQQKPGQAPRLLIYGASSRTPGIPDRFSGSGSG TDFTLTISRLEPEDFAVYYCQQYESSPWTFGQGT KVEIK<br><br>SEQ ID NO: 25930 | QVQLQQWGAGLLKPSETLSLTCAVYGGSFSGCYW SWIRQPPGKGLEWIGEINHSGRTNYNPSLKSRVTIS VDTSENQFSLKLSSVTAADTAVYYCARDYGGLDY WGQGTLVTVSS<br><br>SEQ ID NO: 29936 |
| iPS:434839 | 21-225_83B7 | NA | GAAATTGTGTTGACGCAGTCTCCAGGCACCCG GTATTTGTCTTCAGTGGAAAGAGCCACCCTCT CATGCAGGGCCAGTCAGAGTGTTTACAGCAGC TACTTAGCGTGGTACCAGCAGAAACCTGGCCA GGCTCCCAGGCTCCTCATTTATGGTGCATCCA GCCGGTCCACTGGCATCCAGACAGTTCAGT GGCAGTGGGTCTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGAAAT CAAA<br><br>SEQ ID NO: 25931 | CAGGTGCAGCTACAGCAGTGGGGCGCAGGACTG TTGAAGCCTTCGGAGACCCTGTCCCTCACCTGCG CTGTCTATGGTGGGTCTTCAGTGGTTGCTACTG GAGCTGGATCCGCCAGCCCCCAGGGAAGGGGCT GGAGTGGATTGGGAAATCAATCATAGTGAAAG CACCAACTACAACCCGTCCCTCAAGAGTCGAGTC ACCATTTCAGTAGACACGTCTGTGACGGCCGCGGACAC CCCTGAAGCTGAGCTCTGTGCGAGGGACTACGGCGGT ATGGACGTCTGGGGCCAAGGGACCACGGTCACC GTCTCCTCA<br><br>SEQ ID NO: 29937 |

FIGURE 50
(Continued)

| | | | | |
|---|---|---|---|---|
| iPS:434841 | 21-225_83G7 | AA | EIVLTQSPGTRYLSSVERATLSLTCRASQSVYSSYL AWYQQKPGQAPRLLIYGASSRSTGIPDRFSGSGS GTDFALTISRLEPEDCAVYYCQHSDNSPWTFGQ GTKVEIK<br><br>SEQ ID NO: 25932 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTSS<br><br>SEQ ID NO: 29938 |
| | | NA | GACATCGTGATGACCCAGTCTCCAGACTCCCT GGCTGTGTCTCTGGGCGAGAGGGCCACCATCA TCTGCAAGTCCAGCCAGAGACTGTTTACACAGC TCCAACAATTATATAACTACTTAGCTGGTACCA GCAGAAGCCAGGACAGCCCCCTAAGGTGCTC ATTTACTGGACATCTACCCGGGAATCCGGGGT CCCTGACCGATTCAGTGGCAGCGGGTCTGGGA CAGATTTCACTCTCACCATCAGCAGCCTGCAG GCTGAAGATGTGGCAGTTTATTACTGTCAGCA ATATTTTAGTAGTCCTCGACGTTCGGCCAAG GGACCAAGGTGGAAATCAAA<br><br>SEQ ID NO: 25933 | CAGGTGCAGCTGGTGCAGTCTGGGGCTGAGGTG AAGAAGCCTGGGGCCTCAGTGAAGGTCTCCTGC AAGGCTTCTGGATACACCTTCCCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTATTGTGCGGTTTCCAG TGGCTGCACTGGTTCGACCCCTGGGGCCAGGGA ACCCTGGTCACCGTCGCCTCA<br><br>SEQ ID NO: 29939 |
| | | AA | DIVMTQSPDSLAVSLGERATIICKSSQTVLHSSNN YNYLAWYQQKPGQPPKVLIYWTSTRESGVPDRF SGSGSGTDFLTISSLQAEDVAVYYCQQYFSSPL TFGQGTKVEIK<br><br>SEQ ID NO: 25934 | QVQLVQSGAEVKKPGASVKVSCKASGYTFPNYDIN WVRQATGQGLEWMGWMNPNSGNTGYAQKFQGR VTMTRNTSISTAYMELSSLRSEDTAVYYCAVSSGW HWFDPWGQGTLVTVAS<br><br>SEQ ID NO: 29940 |

FIGURE 50
(Continued)

| | | | |
|---|---|---|---|
| iPS:434849 | 21-225_83C10 | NA | GAAATTGTGTTGACGCAGTCTCCAGGCACCCT GTCTTTGTCTCCAGGGGAAAGAGCCACCCTCT CCTGCAGGGCCAGTCCGAGTGTTCACAGCAAC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCATTCTCAC CATCAGCAGACTGGAGCCTGAAGATTTTGCAG TGTATTACTGTCAGCAGTATGAAAGTTCACCG TGGACGTTCGGCCAAGGGACCAAGGTGGAAA TCAAA<br>SEQ ID NO: 25935 | CAGGTGCAGCTACAGCAGTGGGGCGCAGGACTG TTGAAGCCTTCGGAGACCTGTCCCTCACCTGCA CTGTCTATGTGGGTCTTCAGTGGTTACTACTG GAGCTGGATCCGCCAGCCCCCAGGGAAGGGGCT GGAATGGATTGGGGAAATCAATCATAGTGGAAG CACCAACTTCAACCCGTCCTCAAGAGTCGAGTC ACCATATCAGTAGACACGTCCAAGAACCAGTTCT CCCTGAAGCTGAGCTCTGTGACCGCCGCGACAC GGCTGTGTTTACTGTGCAGAGACTACGGTGGG CTTGACTACTGGGGCCAGGGAACCCTGGTCACCG TCTCCCTCA<br>SEQ ID NO: 29941 |
| | | AA | EIVLTQSPGTLSLSPGERATLSCRASPSVHSNYLA WYQQKPGQAPRLLIYGASSRATGIPDRFSGSGSG TDFILTISRLEPEDFAVYYCQQYESSPWTFGQGT KVEIK<br>SEQ ID NO: 25936 | QVQLQQWGAGLLKPSETLSLICTVYGGSFSGYYW SWIRQPPGKGLEWIGEINHSGSTNFNPSLKSRVTISV DTSKNQFSLKLSSVTAADTAVFYCARDYGGLDYW GQGTLVTVSS<br>SEQ ID NO: 29942 |
| iPS:434851 | 21-225_75A6 | NA | GACATCGTGATGACCCAGTCGCCAGACTCCT GGCTGTGTCTCTGGGCGAGAGGGCCACCATCA ACTGCAAGTCCAGACAGAGTGTTTTACACAGC AAGGCTTCTGGATACACCTTCACCAATTATGATA TCAACAATTACAACTACTTAGCTTGGTACCA GCAGAAACCAGGACAGGCCTCCTGAACTACTCA TTTACTGGGCATCTACCCGGGAATCGGGGTC CCTGACCGATTCAGTGGCAGCGGGTCTGGGAC AGATTTCACTCTCACCATCAGCAGCCTGCAGG CTGAGGATGTGGCAGTTTATTACTGTCAGCAA TATTATAGTACTCCTCCTACTTTCGGCGGAGG GACCAAGGTGGAGATCAAA<br>SEQ ID NO: 25937 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGATGGGATGGATGCACAGAAGTTCCAGGCA GTAACACAGGCTATGCACCAGGAACACCTCATAAGCA GAGTCACCATGACCAGGAGCTGAGCAGCCTGAGATCTG AGGACACGGCCGTGTATTACTGTGCGATAGCAG TGGCTGGTACATCTTGACTACTGGGGCCAGGGA ACCCTGGTCACCGTCCGTCCTCA<br>SEQ ID NO: 29943 |

FIGURE 50
(Continued)

| | | AA | DIVMTQSPDSLAVSLGERATINCKSRQSVLHSSN NYNYLAWYQQKPGQPPELLIYWASTRESGVPDR FSGSGSGTDFTLTISSLQAEDVAVYYCQQYSTP PTFGGGTKVEIK<br><br>SEQ ID NO: 25938 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCAYSSGW YIFDYWGQGTLVTVSS<br><br>SEQ ID NO: 29944 |
|---|---|---|---|---|
| iPS:434863 | 21-225_84G7 | NA | GACATCGTGATGACCCAGTCTCCAGACTCCCC GGCTGTGTCTCTGGGCGAGAGGGCCACCATCA TCTGCAAGTCCAGCCAGTCTGTTTACACAGC TCCAACAATTATAACTACTTAGCTTGGTACCA GCAGAAGCCAGGACAGCCCCCTAAGGTGCTC ATTTACTGGACATCTACCCGGGAATCCGGGGT CCCTGACCGATTCAGTGGCAGCGGGTCTGGGA CAGATTTCACTCTCACCATCAGCAGCCTGCAG GCTGAAGATGTGGCAGTTTATTACTGTCAGCA ATATTTTAGTAGTCCTCCGACGTTCGGCCAAG GGACCAAGGTGGAAATCAAA<br><br>SEQ ID NO: 25939 | CAGGTGCAGCTGGTGCAGTCTGGGGCTGAGGTG AAGAAGCCTGGGGCCTCAGTGAAGGTCTCCTGC AAGGCTTCTGGATACACCTTCCCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGACA GAGTCACCATGACCAGGAACACCTCCATAAGCA CAGCCTACATGGAGCTGAGCAGCCTGAGATCTG AGGACACGGCCGTGTATTATTGTGCGGTTCCAG TGGCTGGCACTGGTTGCACCCCTGGGGCCAGGGA ACCCTGGTCACCGTGCCCTCA<br><br>SEQ ID NO: 29945 |
| | | AA | DIVMTQSPDSPAVSLGERATIICKSSQTVLHSSNN YNYLAWYQQKPGQPPKVLIYWTSTRESGVPDRF SGSGSGTDFTLTISSLQAEDVAVYYCQQYFSSPP TFGQGTKVEIK<br><br>SEQ ID NO: 25940 | QVQLVQSGAEVKKPGASVKVSCKASGYTFPNYDIN WVRQATGQGLEWMGWMNPNSGNTGYAQKFQDR VTMTRNTSISTAYMELSSLRSEDTAVYYCAVSSGW HWFDPWGQGTLVTVAS<br><br>SEQ ID NO: 29946 |

FIGURE 50
(Continued)

| | | | |
|---|---|---|---|
| iPS:434867 | 21-225_79A12 | NA | GACATCCAGATGACCCAGTCTCCATCCTCACT GTCTGCATCTGTAGGAGACAGAGTCACCATCA CTTGTCGGGCGAGTCAGGTCATTAGCAAGTAT TTAGCCTGGTTTCAGCAGAAACCAGGAAAGC CCCTAAGTCCCTGATCTATGCTGCATCAGTTT GCAAAGTGGGGCCCCATCAAGGTTCAGCGGC AGTGGATCTGGGACAGATTTCACTCTCACCAT CAGCAGCCTGCAGCCTGAAGATTTTGCAACTT ATTACTGCCAACAGTACAGTAATTACCCGCTC ACTTTCGGCGGAGGGACCAAGGTGGAGATCA AA<br><br>SEQ ID NO: 25941<br><br>DIQMTQSPSSLSASVGDRVTITCRASQVISKYLA WFQQKPGKAPKSLIYAASSLQSGAPSKFSGSGSG TDFTLTISSLQPEDFATYYCQQYSNYPLTFGGGT KVEIK<br><br>SEQ ID NO: 25942 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAAACTATGCAGACTCCGTGAAGGGCCGA TTCACCATCTCCAGAGACAACAGCAAGAACACGC TGTATCTGCAAATGAACAGCCTGAGAGCCGAGG ACACGGCTGTGTATTACTGTGCGAGAGATGGCAG CTATGGTTACGACGGCCTTGACTACTGGGGCCAG GGAACCCTGGTCGCCGTCTCCTCA<br><br>SEQ ID NO: 29947<br><br>QVQLVESGGGVVQPGRSLRLSCAASGFTFSSYGMH WVRQAPGKGLEWVAVIWYDGSNKNYAEDTAVYYCARDGSYG TISRDNSKNTLYLQMNSLRAEDTAVYYCARDGSYG YDGLDYWGQGTLVAVSS<br><br>SEQ ID NO: 29948 |
| iPS:434869 | 21-225_84E12 | NA | GAAATTGTGTTGACGCAGTCTCCAGGCACCCT GTCTTTGTCTCCAGGGGAAAGAGCCACCCTCT CCTGCAGGGCCAGTCAGAGTATTAACAGCAAC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGACGATTTTGCAG TGTTTTACTGTCAGCAGTATGAGAGCTCACCG TGGACGTTCGGCCAAGGGACCAAGGTGGAAA TCAAA<br><br>SEQ ID NO: 25943 | CAGGTGCAGCTACAGCAGTGGGGCGCAGGACTG TTGAAGCCTTCGGAGACCCTGTCCCTCACCTGCG CTGTCTATGGTGGGTCCTTCAGTGGTTCTACTGG AGTGGATCCGCCAGCCCCCAGGGAAGGGGCTA GAGTGGATTGGGAAATCAATCAAAGTGGACGC ACCAACTACAACCGTCCCTCAAGAGTCGAGTCA CCATATCAGTAGACACGTCCAAGAACCAGTTCTC CCTGAAGCTGAGCTCTGTGACCGCCGCGGACACG GCTGTGTATTACTGTGCGAGAGACTACGGGGTA TAGACGTCTGGGGCCAAGGGACCACGGTCACCG TCTCCTCA<br><br>SEQ ID NO: 29949 |

FIGURE 50
(Continued)

| | | | | |
|---|---|---|---|---|
| iPS:434871 | 21-225_85H1 | AA | EIVLTQSPGTLSLSPGERATLSCRASQSINSNYLA WYQQKPGQAPRLLIYGASSRATGIPDRFSGSGSG TDFTLTISRLEPDDFAVFYCQQYESSPWTFGQGT KVEIK<br>SEQ ID NO: 25944 | QVQLQQWGAGLLKPSETLSLTCAVYGGSFSGSYW SWIRQPPGKGLEWIGEINQSGRTNYNPSLKSRVTIS VDTSKNQFSLKLSSVTAADTAVYYCARDYGGIDV WGQGTTVTVSS<br>SEQ ID NO: 29950 |
| | | NA | GAGATAGTGATGACGCAGTCTCCAGCCACCCT GTCTGTGTCTCCAGGGGAAAGAGCCACCCTCT CCTGCAGGGCCAGTCAGTCAGGATGTTATCACCTAC TTAGCCTGGTACCAGCAGAAACCTGGCCAGGC TCCCAGGCTCCTCATCTATGGTGCATCCACCA GGGCCACTGGTGTCCAGCCAGGTTCAGTGGC AGTGGGTCTGGGACAGAGATTTCACTCTCACCAT CAGCAGCCTGCAGTCTGAAGATTTTGCACTTT ATTACTGTCAGGAGTATGAATGACTGGCCGTGC AGTTTTGGCCAGGGGACCAAGGTGGAGATCA AA<br>SEQ ID NO: 25945 | CAGGTGCAGCTGCTGGTGGAGTCTGGGGGAGGCGTG GTCCAGCCTGGAGGTCCCTGAGACTCTCCTGTG CAGCGTCTGATTCACCTTCAGTAGCTATGGCAT ACACTGGGTCCGCCAGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCCCTT TATAGTGGGAGCTACTTACTTTGACTACTGGGGC CAGGGAACCCTGGTCACCGTCTCCTCA<br>SEQ ID NO: 29951 |
| | | AA | EIVMTQSPATLSVSPGERATLSCRASQDVITYLA WYQQKPGQAPRLLIYGASTRATGVPARPSGSGS GTEFTLTISSLQSEDFALYYCQEYNDWPCSFGQG TKVEIK<br>SEQ ID NO: 25946 | QVQLVESGGGVVQPGRSLRLSCAASGFTFSSYGIH WVRQAPGKGLEWVAVIWYDGSNKYYADSVKGRF TISRDNSKNTLYLQMNSLRAEDTAVYYCARDPFIV GATYFDYWGQGTLVTVSS<br>SEQ ID NO: 29952 |

FIGURE 50
(Continued)

| | | | |
|---|---|---|---|
| iPS:434877 | 21-225_85H2 | NA | GACAGCATGATGACCCAGTCTCCAGACTCCCT GGCTGTGTCTCTGGGCGAGAGGGCCACCATCA ACTGCAAGTCCAGCCAGAGTGTTTACACAGC TCTAATAAAAGAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGTCTGCAGG CTGAAGATGTGGCAGTTTATTACTGTCAGCAA TATTATAGGACTCCGTGACGTTCGGCCAAGG GACCAAGGTGGAAATCAAA<br>SEQ ID NO: 25947 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAATAGTGG TAACACAGGCTATGCACAGAAGTTCCAGGGCAG AGTCACCCTGACCAGGAACACCTCCATAAGCAC AGCCTACATGGAGCTGAGCAGCCTGAGATCTGA GGACACGGCCGTGTATTACTGTGCGGTTTCCAGT GGCTGGTACTGGTTCGACCCCTGGGGCCAGGGA ACCCTGGTCACCGTCTCCTCA<br>SEQ ID NO: 29953 |
| | | AA | DSMMTQSPDSLAVSLGERATINCKSSQSVLHSSN KKNYLAWYQQKPGQPPKLLIYWASTRESGVPD RFSGSGSGTDFTLTISSLQAEDVAVYYCQQYYRT PWTFGQGTKVEIK<br>SEQ ID NO: 25948 | QVQLVQSGAEVKKPGASVKVSCKASGYTFTNYDIN WVRQATGQGLEWMGWMHPNSGNTGYAQKFQGR VTLTRNTSISTAYMELSSLRSEDTAVYYCAVSSGW YWFDPWGQGTLVTVSS<br>SEQ ID NO: 29954 |
| iPS:434879 | 21-225_85A3 | NA | GAAATTGTGTTGACGCAGTCTCCAGGCACCCT GTTTTTGTCTCCAGGGGAAAAGAGCCACCCTCT CCTGCAGGGCCAGTCAGAGTGTTTACAGCAGC TACTTAGCCTGGTACCAGCAGAAACCTGCCCA GGCTCCCAGGCTCCTCATCTATGGTGCATCCA GCCGGGCCAGTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCACTATGATAACTCACCG TGGACGTTCGGCCAAGGGACCAAGGTGGAAA TCAAA<br>SEQ ID NO: 25949 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCCAGGGAAGGGGCT GGAGTGGATTGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCCGT ATGACGTCTGGGGCCAAGGGACCACGGTCACC GTCTCCTCA<br>SEQ ID NO: 29955 |

FIGURE 50
(Continued)

| | | | | |
|---|---|---|---|---|
| iPS:434881 | 21-225_85B4 | AA | EIVLTQSPGTLFLSPGERATLSCRASQSVYSSYLA WYQQKPAQAPRLLIYGASSRASGIPDRFSGSGSG TDFALTISRLEPEDFAVYYCQHYDNSPWTFGQG TKVEIK SEQ ID NO: 25950 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS SEQ ID NO: 29956 |
| | | NA | GAAATTGTGTTGACGCAGTCTCCAGGCACCCT GTTTTTGTCTCTCCAGGGGAAAGAGCCACCCTCT CCTGCAGGGCCAGTCAGAGTGTTTACAGCAGC TACTTAGCCTGGTACCAGCAGAAACCTGGCCA GGCTCCCAGGCTCCTCATCTATGGTGCATCCA GCCGGGCCACTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCACTATGATAACTCACCG TGGACGTTCGGCCAAGGGACCAAGGTGGAAA TCAAA SEQ ID NO: 25951 | CAGGTGCAGCTACAGCAGTGGGGCGCAGGACTG TTGAAGCCTTCGGAGACCCTGTCCTCCACCTGCG CTGTCCATGTGGGTCCTCAGTGGTTGCTACTG GAGCTGGATCCGCCAGCCCCAGGGAAGGGGCT GGAGTGGATTGGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA SEQ ID NO: 29957 |
| | | AA | EIVLTQSPGTLFLSPGERATLSCRASQSVYSSYLA WYQQKPGQAPRLLIYGASSRATGIPDRFSGSGSG TDFALTISRLEPEDFAVYYCQHYDNSPWTFGQG TKVEIK SEQ ID NO: 25952 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS SEQ ID NO: 29958 |

FIGURE 50
(Continued)

| | | | |
|---|---|---|---|
| iPS:434883 | 21-225_85B5 | NA | GAATTTATGTTGACGCAGTCTCCAGGCACCCT GTCTTTGTCTCAGGGGAAAGAGCCACCCTCT CGTGCAGGTCCAGTCAGAGTGTTAGCAGCAGC TACTTAGTCTGGTATCAGCAGAAACCTGGCCA GGCTCCCAGGCTCCTCATCTATGGTGCATCCA CCAGGGCCACTGGCATCCCAGACAGGTTCAGT GGCAGTGGGTCTGGGACAGACTTCACTCTCAC CATCAGCAGACTGGAGCTGAATATTTTGCAG TTTATTACTGTCAGCAGTATGGTTGCTCACCGC TCACTTTCGGCGGAGGGACCAAGGTGGAGATC ACA<br><br>SEQ ID NO: 25953 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGTCCCTGGACAAGGGC TTGAGTGGATGGGATGGATGCACCTAACAGTGG TAACACAGGCTATGCACAGAAGTTCCAGGGCAG AGTCACCATGACCAGGAACACCTCCATCAGCAC AGCCTACATGGAGCTGAGCAGCCTGAGATCTGA GGACACGGCCGTGTATTACTGTGCGATTAGTAGT GGCTGGTACTGGTTCGACCCCTGGGGCCAGGGA ACCCTGGTCACCGTCTCCTCA<br><br>SEQ ID NO: 29959 |
| | | AA | EFMLTQSPGTLSLSPGERATLSCRSSQSVSSSYLV WYQQKPGQAPRLLIYGASTRATGIPDRFSGSGSG TDFTLTISRLEPEYFAVYYCQQYGCSPLTFGGGT KVEIT<br><br>SEQ ID NO: 25954 | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS<br><br>SEQ ID NO: 29960 |
| iPS:434887 | 21-225_85D6 | NA | GAAATTGTGTTGACGCAGTCTCCAGGCACCCT GTTTTTGTCTCAAGGGCCAGTCTCAGCACCTCT CCTGCAGGGCCAGTCAGAGTGTTAGCAGCAGG TACTTAGCCTGGTACCAGCAGAAACTGGCCA GGCTCCCCAGACTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TATATTACTGTCAGCATTATGATAGCTCACCGT GGACGTTCGGCCAAGGGACCAAGGTGGAAAT CAAA<br><br>SEQ ID NO: 25955 | CAGGTGCAGCTACAGCAGTGGGGCGCAGGACCG TTGAAGCCTTCGGAGACCCTGTCCCTCACCTGCG CTGTCTATGGTGGGTCCTTCAGTGGTTGCTACTG GAGCTGGATCCGCCAGCCCCCAGGGAAGGGGCT GGAGTGGATTGGGGAAATCAATTATAGTGGAAG AACCAACTACACCCGTCCCTCAAGAGTCGAGTC ACCATATCAGTAGACACGTCCAAGAACCAGTTCT CCCTGAAGCTGAGCTCTGTGACCGCCGCGGACAC GGCTGTGTATTACTGTGCGAGAGACTACGGCGGT ATGGACGTCTGGGGCCAAGGGACCACGGTCACC GTCTCCTCA<br><br>SEQ ID NO: 29961 |

FIGURE 50
(Continued)

| | | | | |
|---|---|---|---|---|
| iPS:434891 | 21-225_85G6 | AA | EIVLTQSPGTLFLSQGERATLSCRASQSVSSRYLAWYQQKPGQAPRLLIYGASSRATGIPDRFSGSGSGTDFTLTISRLEPEDFAVYYCQHYDSSPWTFGQGTKVEIK<br>SEQ ID NO: 25956 | QVQLQQGGAGPLKPSETLSLTCAVYGGSFSGCYWSWIRQPPGKGLEWIGEINYSGRTNYNPSLKSRVTISVDTSKNQFSLKLSSVTAADTAVYYCARDYGGMDVWGQGTTVTVSS<br>SEQ ID NO: 29962 |
| | | NA | GAAATTGCGTTGACGCAGTCTCCAGGCACCCTGTCTTTGTCTCCAGGGGAAAGAGCCACCCTCTCCTGCAGGGCCAGTCCGAGTGTTGACAGCAGCTACTTAGCCTGGTACCAGCAGAAACCTGGCCAGGCTCCCAGGCTCCTCATCTATGGTGCAGCCAGCAGGGGCCCCTGCATCCAGACAGGTTCAGTGGCAGTGGGTCTGGGACAGACTTCACTCTCACCATCAGCAGACTGGAGCCTGAAGACTTTGTAGTGTATTACTGTCAGCAGTATGATAGTTCACCGTGGACGTTCGGCCAAGGGACCAAGGTGGAAATCAAA<br>SEQ ID NO: 25957 | CAGGTGCAGCTACAGCAGTGGGGCGCAGGACTGTTGAAGCCTTCGGAGACCCTGTCCTCACCTGCGCTGTCTATGGTGGGTCCTTCAGTGGTTGTACTGGAGCTGGATCCGCAGCCCCAGGGAAGGGGCTGGAGTGGATTGGGGAAATCAATATAGTGGAAGGACCAACTACAACCGTCCCTCAAGAGTCGAGTCACCATATCAGTAGACACGTCCGAGAACCAGTTCTCCCTGAAGCTGAGCTCTGTGACCGCCGCGGACACGGCTGTGTATTACTGTGCGAGAGACTACGGTGGGCTTGACTACTGGGGCCAGGGAACCCTGGTCACCGTCTCCTCA<br>SEQ ID NO: 29963 |
| | | AA | EIALTQSPGTLSLSPGERATLSCRASPSVDSSYLAWYQQKPGQAPRLLIYGAASRAPGIPDRFSGSGSGTDFTLTISRLEPEDFVVYYCQQYESSPWTFGQGTKVEIK<br>SEQ ID NO: 25958 | QVQLQQWGAGLLKPSETLSLTCAVYGGSFSDCYWSWIRQPPGKGLEWIGEINHSGRTNYNPSLKSRVTISVDTSENQFSLKLSSVTAADTAVYYCARDYGGLDYWGQGTLVTVSS<br>SEQ ID NO: 29964 |

FIGURE 50
(Continued)

| | | | |
|---|---|---|---|
| iPS:434895 | 21-225_74H7 | NA | GAACTTGTGTTGACGCAGTCTCCAGGCACCCT GTCTTTGTCTCCAGGGGAAAGAGCCACCCTCT CCTGCAGGGCCAGTCAGATATTTACAGCAGC TACTTAGCCTGGTACCAACAGAAACCTGGCCA GGCTCCCAGGCTCCTCATCTATGGTGCATCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTGCTGTCAGCAGTATGAAAGCTCACCG TGGACCTTCGGCCAAGGGACCAAGGTGAAA TCAAA<br>SEQ ID NO: 25959 | CAAGTGCAGCTACAACAGTGGGGCGCAGGACTG TTGAAGCCTTCGGAGCCCCTGTCCTCACCTGCG CTGTCTATGGTGGGTCCTTCAGTGGTCCTACTG GAGCTGGATCCGCCAGCCCCGGGAAGGGGCT GGAGTGGATTGGGGAAATCAATCATAGTGGAAG CACCAACTACAACCGTCCCTCAAGAGTCGAGTC ACCATATCAGTAGACACGTCCAAGAACCAGTCT CCCTGAAACTGACCTCTGTGACCGCCGCGGACAC GGCTGTGTATTACTGTGCGAGAGACTACGGGGT TGGACGTCTGGGGCCAAGGGACCACGGTCACC GTCTCCTCA<br>SEQ ID NO: 29965 |
| | | AA | ELVLTQSPGTLSLSPGERATLSCRASQNIYSSYLA WYQQKPGQAPRLLIYGASSRATGIPDRFSGSGSG TDFTLTISRLEPEDFAVYCCQQYESSPWTFGQGT KVEIK<br>SEQ ID NO: 25960 | QVQLQQWGAGLLKPSEPLSLTCAVYGGSFSGPYW SWIRQPPGKGLEWIGEINHSGSTNYNPSLKSRVTISV DTSKNQFSLKLTSVTAADTAVYYCARDYGGLDVW GQGTTVTVSS<br>SEQ ID NO: 29966 |
| iPS:434899 | 21-225_85B9 | NA | GAAATTGTGTTGACGCAGTCTCCAGGCACCCT GTTTTTGTCTCCAGGGGAGAGAGCCACCCTCT CCTGCAGGGCCAGTCAGAGTGTTAACAGCAAC TACTTAGCCTGGTACCGGCAGAAACCTGGCCA GGCTCCCAGGCTCCTCATCTATGGTGCATCA GCAGGGCCACTGGCATCCCAGACAGGTTCAGT GGCAGTGGGTCTGGGACAGACTTCATTCTCAT CATCAGCAGACTGGAGCCTGAGGATTTTGCAG TGTATTACTGTCAGCAGTATGAAAGCTCGCCG TGGACGTTCGGCCAAGGGACCAAGGTGAAAA TCAAA<br>SEQ ID NO: 25961 | CAGGTGCAGCTACAACAGTGGGGCGCAGGACTG TTGAAGCCTTCGGAGACCCTGTCCTCACTTGCG CTGTCAATGGTGGGTCCCTTCAGTGGTTGCTACTG GAGCTGGATCCGCCAGCCCCGCAGGGAAGGGGCT GGAGTGGATTGGGGAAATCAATCATAGTGGAAG GACCAACTTCAACCGTCCCTCAAGAGTCGAGTC ACCATATCAGTTGACACGTCCAAGAACCAGTTCT CCCTGAAGCTGAGCTCTGTGACCGCCGCGGACAC GGCTGTGTATTACTGTGCGAGAGACTACGCGGT ATGGACGTCTGGGGCCAAGGGACCACGGTCACC GTCTCCTCA<br>SEQ ID NO: 29967 |

FIGURE 50
(Continued)

| | | | |
|---|---|---|---|
| iPS:434901 | 21-225_85H9 | AA | EIVLTQSPGTLFLSPGERATLSCRASQSVNSNYLA WYRQKPGQAPRLLIYGASSRATGIPDRFSGSGSG TDFILIISRLEPEDFAVYYCQQYESSPWTFGQGTK VEIK<br>SEQ ID NO: 25962 | QVQLQQWGAGLLKPSETLSLTCAVNGGPFSGCYW SWIRQPPGKGLEWIGEINHSGRTNFNPSLKSRVTISV DTSKNQFSLKLSSVTAADTAVYYCARDYGGMDV WGQGTTVTVSS<br>SEQ ID NO: 29968 |
| | | NA | GACATCGTGATGACCCAGTCTCCAGACTCCCT GGCTGTGTCTCTGGGCGAGAGGGCCACCACCA ATTGTAAGTCCAGCCAGAGTGTTTACACAGG TCCAACAATTACAACTACTTAGCGTGGTACCA GCAGAAACCAGGACAGCCTCCTAAGCTGCTCA TTTACTGGGCATCTACCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCGACGTTCGGCCAAGG GACCAAGGTGGAAATCAAA<br>SEQ ID NO: 25963 | CAGGTGCAGCTGGTGCAGTCTGGGCTGAGGTG AAGAAGCCTGGGGCCTCAGTGAAGGTCTCCTGC AAGGCTTCTGGATACACCTTGACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAACTGAGCAGCCTGAGATCTG AGGACACGGCCGTGTATTACTGTGGGAGTACCA GTGGCTGAACTTCTTTGACTACTGGGGCCAGGG AACCCTGGTCACCGTCTCCTCA<br>SEQ ID NO: 29969 |
| | | AA | DIVMTQSPDSLAVSLGERATTNCKSSQSVLHRSN NYNYLAWYQQKPGQPPKLLIYWASTRESGVPD RFSGSGSGTDFTLTISSLQAEDVAVYYCQQYYST PPTFGQGTKVEIK<br>SEQ ID NO: 25964 | QVQLVQSGAEVKKPGASVKVSCKASGYTLTNYDI NWVRQATGQGLEWMGWMNPNSGNTGYAQKFQG RVTMTRNTSISTAYMELSSLRSEDTAVYYRGSTSG WNFFDYWGQGTLVTVSS<br>SEQ ID NO: 29970 |

FIGURE 50
(Continued)

| | | | |
|---|---|---|---|
| iPS:434907 | 21-225_85G10 | NA | GAAATTGTGTTGACGCAGTCTCCAGGCTCCCT GTCTTTGTCTCAGGGGAAAGAGCCACCCTCT CCTGCAGGGCCAGTCAGAGTGTTTGGAGCGGC TACTTAGCCTGGTACCAGCAGAAAACCTGGCCA GGCTCCCAGGCTCCTCATCTATGGTGCATCTA GCAGGGCCACTGGCATCCCAGACAGACTTCAGT GGCAGTGGGTCTGGGACAGACTTCACTCTCAC CATCAGCAGACTGGAGCCTGAAGATTTTGCAG TGTATTTCTGTCAGCAGTATGAGAGTTCACCG TGGACGTTCGGCCAAGGGACCAAGGTGGAAA TCAAA<br><br>SEQ ID NO: 25965 | CAGGTACAGCTACAGCAGCGGGGCGCAGGACTG TTGAAGCCTTGGAGACAGCCCTGCCCCTCACCTGCG CTGTCTATGTGGGTCCTTCAGTGTTGTTACTGG AGCTGGATCGCCAGCCCCCGGAAGGGGCTG GAGTGGATTGGGAAATCAATCATAGTGGAATC ACCAACTACAACCCGTCCTCAAGATCGAGTCA CCATATCAGTAGACACGTCCAAGAACCAGTTCTC CCTGAAGCTGACCTCTGTGACCGCCGCGGACACG GCTGTGTATTACTGTGCGAGAGACTACGGTGGTT TGGACGTCTGGGGCCAAGGGACCACGGTCACCG TCTCCTCA<br><br>SEQ ID NO: 29971 |
| | | AA | EIVLTQSPGSLSLSPGERATLSCRASQSVWSGYL AWYQQKPGQAPRLLIYGASSRATGIPDRFSGSGS GTDFTLTISRLEPEDFAVYFCQQYESSPWTFGQG TKVEIK<br><br>SEQ ID NO: 25966 | QVQLQQRGAGLLKPSETLSLTCAVYGGSFSGCYWS WIRQPPGKGLEWIGEINHSGITNYNPSLKSRVTISVD TSKNQFSLKLTSVTAADTAVYYCARDYGGLDVWG QGTTVTVSS<br><br>SEQ ID NO: 29972 |
| iPS:434909 | 21-225_85C11 | NA | GACATCGTGATGACCCAGTCTCCAGACTCCCT GGCTGTGTCTCTGGGCGAGAGGGCCACCATCA ACTGCAAGTCCAGCCAGAGTGTTTTGTACAGC TCCAACAGTCACAACTTCTTAGCTTGGTACCA GCAGAAACCAGGACAGCCTCCTAAACTGCTCA TTTTCTGGGCATTATCCGGGAATCCGGGGTC CCTGAAGGATTCAGTGGCAGCGGGTCTGGGC AGATTTCACTCTCTCCATCAGCGGCCTACAGG CAGAAGATGTGGCAGTTTATTACTGTCAGCAA TATTATAGTACTCCGTGCAGTTTTGGCCAGGG GACCAAGCTGGAGATCAAA<br><br>SEQ ID NO: 25967 | CAGGTGCAGCTGGTGCAGTCTGGGGCTGAGGTG AAGAAGCCTGGGGCCTCAGTGAAGGTCTCTGC AAGGCTTCTGGATACACCTTCACCAATTATGATA TCAACTGGGTGCGACAGGCCTCTGGACAAGGAC TTGAGTGGATGGGATGGATGAACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACTCGGCCGTATATTACTGTGCGTATAGTAGT GGCTGGTACAAATTTGACTACTGGAGCCAGGGA ACCCTGGTCACCGTCCTCA<br><br>SEQ ID NO: 29973 |

FIGURE 50
(Continued)

|  |  |  |  |  |
|---|---|---|---|---|
|  |  | AA | DIVMTQSPDSLAVSLGERATINCKSSQSVLYSSN SHNFLAWYQQNPGQPPKLLIFWAFIRESGVPEGF SGSGSGADFTLSISGLQAEDVAVYYCQQYYSTP CSFGQGTKLEIK<br>SEQ ID NO: 25968 | QVQLVQSGAEVKKPGASVKVSCKASGYTFTNYDIN WVRQASGQGLEWMGWMHPNSGNTGYAQKFQGR VTMTRNTSISTAYMELSSLRSEDSAVYYCAYSSGW YKFDYWSQGTLVTVSS<br>SEQ ID NO: 29974 |
|  |  | NA | GAATTTATGTTGACGCAGTCTCCAGGCACCCT GTCTTTGTCTACAGGGGAAAGAGCCACCTCT CGTGCAGGTCCAGTCAGAGTGTTAGCAGCAGC TACTTAGTCTGTATCAGCAGAAACCTGGCCA GGCTCCCAGGCTCCTCATCTATGTGCATCCA CCAGGGCCACTGGCATCCCAGACAGGTTCAGT GGCAGTGGGTCTGGGACAGATTCACTCTCAC CATCAGCAGACTGGAGCCTGAATATTTTGCAG TTTATTACTGTCAGCAGTATGTTGCTCACCGC TCACTTTCGGCGGAGGGACCAAGGTGGAGATC ACA<br>SEQ ID NO: 25969 | CAGGTGCAGTCTGGTGCAGTCTGGGGCTGAGGTG AAGAAGCCTGGGGCCTCAGTGAAGGTCTCCTGC AAGGCTTCTGATACACCTTCACCAATTATGATA TCAACTGGGTGCGACAGGTCCCTGGACAAGGGC TTGAGTGGATGGGATGGATGCACCTAACAGTGG TAACACAGGCTATGCACAGAAGTTCAGGGCAG AGTCACCATGACCAGGAACACCTCCATCAGCAC AGCCTACATGGAGCTGAGCAGCCTGAGATCTGA GGACACGGCCGTGTATTACTGTGCGATTAGTAGT GGCTGGTACTGGTTCGACCCTGGGGCCAGGGA ACCCTGGTCACCGTCTCCTCA<br>SEQ ID NO: 29975 |
| iPS:434911 | 21-225_85D11 | AA | EFMLTQSPGTLSLSTGERATLSCRSSQSVSSSYLV WYQQKPGQAPRLLIYGASTRATGIPDRFSGSGSG TDFTLTISRLEPEYFAVYYCQQYGCSPLTFGGGT KVEIT<br>SEQ ID NO: 25970 | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS<br>SEQ ID NO: 29976 |

FIGURE 50
(Continued)

| | | | | |
|---|---|---|---|---|
| iPS:434913 | 21-225_86C1 | NA | GAAATTGTGTTGACGCAGTCTCCAGGCACCCT GTATTTGTCTCCAGGGGAAAGAGCCACCCTCT CCTGCAGGGCCAGTCAGAGTGTTTACAGCAGC TACTTAGCCTGGTACCAGCAGAAACCTGCCCA GGCTCCCAGGCTCCTCATCTATGGTGCATCCA GCCGGGCCACTGGCATCCCAGACAGGTTCAGT GGCAGTGGGTCTGGGACAGATTCGCTCTCAC CATCAGCAGACTGGAGCCTGAAGATTGTGCAG TGTATTACTGTCAGCACTATGATAACTCACCG TGGACGTTCGGCCAAGGGACCAAGGTGGAAA TCAAA SEQ ID NO: 25971 | CAGGTGCAGCTACAGCAGTGGGGCGCAGGACTG TTGAAGCCTTCGGAGACCCTGTCCCTCACCTGCG CTGTCCATGTGGGTCTTCAGTGGTTGCTACTG GAGCTGGATCCGCCAGCCCCCAGGGAAGGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA SEQ ID NO: 29977 |
| | | AA | EIVLTQSPGTLYLSPGERATLSCRASQSVYSSYLA WYQQKPAQAPRLLIYGASSRATGIPDRFSGSGSG TDFALTISRLEPEDCAVYYCQHYDNSPWTFGQG TKVEIK SEQ ID NO: 25972 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS SEQ ID NO: 29978 |
| iPS:434921 | 21-225_86E4 | NA | GAAATTGTGTTGACGCAGTCTCCAGGCACCCG GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTGTGATAACTCACCGT GGACGTTCGGCCAAGGGACCAAGGTGGAAAT CAAA SEQ ID NO: 25973 | CAGGTGCAGCTACAGCAGTGGGGCGCAGGACTG TTGAAGCCTTCGGAGACCCTGTCCCTCACCTGCG CTGTCCATGTGGGTCTTCAGTGGTTGCTACTG GAGCTGGATCCGCCAGCCCCCAGGGAAGGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA SEQ ID NO: 29979 |

FIGURE 50
(Continued)

| | | | | |
|---|---|---|---|---|
| | | AA | EIVLTQSPGTRYLSPGERATLSCRASQSVYSSYL AWYQQKPGQAPRLLIYGASSRSTGIPDRFSGSGS GTDFALTISRLEPEDCAVYYCQHSDNSPWTFGQ GTKVEIK<br><br>SEQ ID NO: 25974 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 29980 |
| iPS:434935 | 21-225_86E9 | NA | GACATCGTGATGACCCAGTCTCCAGACTCCCC GGCTGTGTCTCTGGGCGAGAGGGCCACCATCA ATTGCAAGTCCAGCAGAGTGTTTGCACAGA TCCAACAATTATAATTACTTAGCTTGGTACCA GCAGAAACCAGGACAGCCTCCTAACCTGCTCA TTTACTGGGCATCTACCGGGAATCGGGGTC CCTGACCGATTCAGTGGCAGCGGGTCTGGGAC AGATTTCACTCTCACCATCAGCAGCCTGCAGG CTGCTGATGTGGCAGTTTATTACTGTCAGCAA TATCATAGTAGTCCACTGACGTTCGGCCAAGG GACCACGGTGGAAATCAAA<br><br>SEQ ID NO: 25975 | CAGGTGCAGCTGGTGCAGTCTGGGCTGAGGTG AAGAAGCCTGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGAACCCTAACAGTG GTAACACAGGCTATGCACAGAAGTTCCAGGGCA GAGTCACCATGACCAGAGCACCTCCACAAGCA CAGCCCACATGAGCTGAGCAGCCTGAGATCTG AGGACACGGCCGTGTATTACTGTGCGGTTCCAG TGGCTGGTCCTGGTTCGACCCTGGGGCCAGGGA ACCCTGGTCACCGTCCTCTCA<br><br>SEQ ID NO: 29981 |
| | | AA | DIVMTQCPDSPAVSLGERATINCKSSQSVLHRSN NYNYLAWYQQKPGQPPNLLIYWASTRESGVPD RFSGSGSGTDFTLTISSLQAADVAVYYCQQYHSS PLTFGQGTTVEIK<br><br>SEQ ID NO: 25976 | QVQLVQSGAEVKKPGASVKVSCKASGYTFTNYDIN WVRQATGQGLEWMGWMNPNSGNTGYAQKFQGR VTMTRSTSTAHMELSSLRSEDTAVYYCAVSSGW SWFDPWGQGTLVTVSS<br><br>SEQ ID NO: 29982 |

FIGURE 50
(Continued)

| | | | | |
|---|---|---|---|---|
| iPS:434939 | 21-225_86C11 | NA | GAAATTGTGTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCCTCCCAGACAGGTTCAGT GGCAGTGGGTCTGGGACAGATCCGCTCTCAC CATCAGCAGACTGGAGCTGAAGATTGTGCAG TGTATTACTGTCAGCACTCTGATAACTCACCGT GGACGTTCGGCCAAGGGACCAAGGTGGAAAT CAAA<br>SEQ ID NO: 25977 | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br>SEQ ID NO: 29983 |
| | | AA | EIVLTQSPGTLYLSPGERATLSCRASQSVYSSYLA WYQQKPGQAPRLLIYGASSRSTGLPDRFSGSGSG TDFALTISRLEPEDCAVYYCQHSDNSPWTFGQG TKVEIK<br>SEQ ID NO: 25978 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29984 |
| iPS:434943 | 21-225_87H1 | NA | GAAATTGTGTGACGCAGTCTCCAGGCACCCT GTCTTTGTCTCCAGGGGAAAGAGCCACCCTCT CCTGCAGGGCCAGTCAGAGTGTTGACAGCAAC TACTTAGCCTGGTACCAGCAGAAACCTGGCCA GGCTCCCAGGCTCCTCATCTATGGTGCATCCA CCAGGACCACTGGCATCCCAGACAGGTTCAGT GGCAGTGGGTCTGGGACATGGAGCCTCACTCTCAC CATCAGCAGACTGGAGCTGAAGATTTTGCAG TGTATTCCTGTCAGCAGTATGAAAGCTCACCG TGGACGTTCGGCCAAGGGACCAAGGTGGAAA TCAAA<br>SEQ ID NO: 25979 | CAGGTGCAGCTGCAGCCTGGGGCGCAGGACTG TTGAAGCCTTCGGAGACCCTGTCCCTCACCTGCG CTGTCTATGGTGGGTCCTTCAGTGGTTACTACTG GAGCTGGATCCGCCAGCCCCCAGGGAAGGGGCT GGAGTGGATTGGGGAAATCAATCATAGTGGACG CACCAACTACAACCCGTCCCTCAAGAGTCGAGTC ACCATATCAGTAGACACGTCCAAGGACCAGTTCT CCCTGAAGCTGAGCTCTGTGACCGCCGCGGACAC GGCTGTGTATTACTGTGCGAGAGACTACGGTGGT TTGGACGTCTGGGGCCAAGGGACCACGGTCACC GTCTCCTCA<br>SEQ ID NO: 29985 |

FIGURE 50
(Continued)

| | | | | |
|---|---|---|---|---|
| iPS:434945 | | AA | EIVLTQSPGTLSLSPGERATLSCRASQSVDSNYLAWYQQKPGQAPRLLIYGASARTTGIPDRFSGSGSGTDFTLTISRLEPEDFAVYSCQQYESSPWTFGQGTKVEIK<br>SEQ ID NO: 25980 | QVQLQPWGAGLLKPSETLSLTCAVYGGSFSGYYWSWIRQPPGKGLEWIGEINHSGRTNYNPSLKSRVTISVDTSKDQFSLKLSSVTAADTAVYYCARDYGGLDVWGQGTTVTVSS<br>SEQ ID NO: 29986 |
| | 21-225_87E5 | NA | GAATTGTGTTGACGCAGTCTCCAGGCACCCTGTATTTGTCTCCAGGGGAAAGAGCCACCCTCTCATGCAGGGCCAGTCAGAGTGTTTACAGCAGCTACTTAGCCTGGTACCAGCAGAAACCTGGCCAGGCTCCCAGGCTCCTCATTTATGGTGCATCCAGCCGGTCCACTGGCATCCCAGACAGGTTCAGTGGCAGTGGGTCTGGGACAGATTCGCTCTCACCATCAGCAGACTGGAGCCTGAAGATTGTGCAGTGTATTACTGTCAGCATTCTGATAACTCACCGTGGACGTTCGGCCAAGGGACCAAGGTGGAAATCAAA<br>SEQ ID NO: 25981 | CAGGTGCAGCTACAGCAGTGGGGCGCAGGACTGTTGAAGCCTTCGAGACCCTGTCCCTCACCTGCGCTGTCCATGTGGGTCCTTCAGTGGTTGCTACTGGAGCTGGATCCGCCAGCCCCCAGGGAAGGGCTGGAGTGGATTGGGGAAATCAATCATAGTGGAAGCACCAACTACAACCCGTCCCTCAAGAGTCGAGTCACCATTTCAGTAGACACGTCCAAGAACCAGTTCTCCCTGAAGCTGAGCTCTGTGACCGCCGCGGACACGGCTGTGTATTACTGTGCGAGGGACTACGGCGGTATGGACGTCTGGGGCCAAGGGACCACGGTCACCGTCTCCTCA<br>SEQ ID NO: 29987 |
| | | AA | EFVLTQSPGTLYLSPGERATLSCRASQSVYSSYLAWYQQKPGQAPRLLIYGASSRSTGIPDRFSGSGSGTDFALTISRVEPEDCAVYYCQHSDNSPWTFGQGTKVEIK<br>SEQ ID NO: 25982 | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS<br>SEQ ID NO: 29988 |

FIGURE 50
(Continued)

| | | | |
|---|---|---|---|
| iPS:434947 | 21-225_87B7 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTATGCTGCATCCAGTT GCACAGTGGGGTCCCATCAAAGTTCAGCGGCA GTGGATCTGGGACAGATTTCACTCTCACCATC AGCAGCCTGCAGCCTGAAGATTCTGCAACTTA TTTCTGCCTACTCTATCTTACTTACCCGCTCAC CTTCGGCCAAGGGACACGACTGGAGATTAAA SEQ ID NO: 25983 | CAGGTGCAGCTGGTGGAGTCTGGGGGAGGCGTG GTCCAGCCTGGGAGGTCCCTGAGACTCTCCTGTG CAGGGTCTGGATTCACCTTCAGTAGCTATGGCAT GCACTGGGTCCGCCAGGCTCCAGGCAAGGGGCT GGAGTGGGTGGCAGTTATATCGAGACTCCGTGAAGGGCCGA AATAAAAACTATGCAGAGACAATTCCAAGAACACGC TTCACCATCTCAAATGAACAGCCTGAGAGCCGAGG TGTATCTGCAAATGAACAGCCTGAGAGCCGAGG ACACGGCTGTGTATTACTGTGCGAGAGATTTTGG AGTGGGCTACTACGGTATGGACGTCTGGGGCCA AGGGACCACGGTCACCGTCTCCTCA SEQ ID NO: 29989 |
| | | AA | DIQMTQSPSSLSASVGDRVTITCRASQGISNYLA WFQQKPGKAPKSLIYAASSLHSGVPSKFSGSGSG TDFTLTISSLQPEDSATYFCLLYLTYPLTFGQGTR LEIK SEQ ID NO: 25984 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDFGVG YYGMDVWGQGTTVTVSS SEQ ID NO: 29990 |
| iPS:434955 | 21-225_87C9 | NA | GAAATTGTGTTGACGCAGTCTCCAGGCACCCT GTATTTGTCTCCAGTGGAAAGAGCCACCCTCT CATGCAGGGCCAGTCAGAGTGTTTACAGCAGC TACTTAGCCTGGTACCAGCAGAAAACCTGGCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCATTCTGATAACTCACCGT GGACGTTCGGCCAAGGGACCAAGGTGAAAT CAAA SEQ ID NO: 25985 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCGGCCAGCCCCCAGGGAAGGGGCT GGAGTGGATTGGGGAAATCAATCATAGTGGAAG CACCAACTACAACCCGTCCCTCAAGAGTCGAGTC ACCATTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA SEQ ID NO: 29991 |

FIGURE 50
(Continued)

| | | AA | EIVLTQSPGTLYLSPVERATLSCRASQSVSSYLA WYQQKPGQAPRLLIYGASSRTGIPDRFSGSGSG TDFALTISRLEPEDCAVYYCQHSDNSPWTFGQG TKVEIK<br><br>SEQ ID NO: 25986 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 29992 |
|---|---|---|---|---|
| iPS:434957 | 21-225_87A10 | NA | GAATTTGTGTTGACGCAGTCTCCAGGCACCCT GTATTTGTCTCCAGGGGAAAGAGCCACCCTCT CGTGCAGGGCCAGTGCAGTGTTAGCAGCAGC TACTTAGCCTGGTACCAGCAGAAACCTGGCCA GGCTCCCAGGCCTCCTCATCTATGGTGCATCA CCAGGGCCTCTGGCATCCCAGACACTTCAGT GGCAGTGGGTCTGGGACAGGTTCACTCTCAC CATCAGCAGACTGGAGCCTGAATATTTTGCAG TTTATTACTGTCAGTCAGGAGGGACCAAGGTGGAGAT CTCACTTTCGGCGGAGGGACCAAGGTGGAGAT CAAA<br><br>SEQ ID NO: 25987 | CAGGTGCAGCTGGTGCAGTCTGGGGCTGAGGTG AAGAAGCCTGGGGCCTCAGTGAAGGTCCTGC AAGGCTTCTGGATACACCTTCACCAATTATGATA TCAACTGGGTGCGACAGGCCACTGGACAAGGGC TTGAGTGGATGGATGGATGCACCTAACAATGG TAACACAGGCTATGCACAGAAGTTCAGGGCAG AGTCACCATGACCAGGAACACTCCATAAGCAC AGCCTACATGGAGCTGAACAGCCTGAGATCTGA GGACACGGCCGTGTATTACTGTGCGATTAGCAGT GGCTGGTACTGGTTCGACCCCTGGGGCCAGGA ACCCTGGTCACCGTCTCCTTA<br><br>SEQ ID NO: 29993 |
| | | AA | EFVLTQSPGTLYLSPGERATLSCRASQSVSSSYL AWYQQKPGQAPRLLIYGASTRASGIPDRFSGSGS GTDFTLTISRLEPEYFAVYYCQQYGNSPLTFGGG TKVEIK<br><br>SEQ ID NO: 25988 | QVQLVQSGAEVKKPGASVKVSCKASGYTFTNYDIN WVRQATGQGLEWMGWMHPNGNTGYAQKFQGR VTMTRNTSISTAYMELNSLRSEDTAVYYCAISSGW YWFDPWGQGTLVTVSL<br><br>SEQ ID NO: 29994 |

FIGURE 50
(Continued)

| | | | |
|---|---|---|---|
| iPS:434959 | 21-225_87E10 | NA | GACATCGTGATGACCCAGTCTCCAGACTCCCT GGCTGTGTCTCTGGGCGAGAGGGCCACCATCA AGTGCAAGTCCAGCAGTCAGAGTGTTTACACAG TCCAACAATATGAACTACTTAGCTTGGTACCA GCAGAAACCTGGACAGCCTCCTAAACTGCTCA TTTACTGGGCATCTACCCGGAAATCCGGGTC CCTGACCGATTCAGTGGCACCGGGTCTGGGAC AGATTTCACTCTCACCATCAGCAGCCTGCAGG CTGAAGATGTGGCAGTTTATTACTGTCAGCAA TATTATAGTAGTCCGTGCAGTTTTGGCCAGGG GACCAAGCTGAAGATCAAA SEQ ID NO: 25989 |
| | | | CAGGTGCAGCTGGTGCAGTCTGGGGCTGAGGTG AAGAAGCCTGGGCCTCAGTGAAGGTCCTGC AAGGCTTCTGGATACACCTTCACCAATTATGATA TCAACTGGGTGCGACAGGCCACTGGACAAGGC TTGAGTGGATGGGATGAACCTAACAGTG GTAACACAGGCTATGCACAGAAGTTCCAGGCA GAGTCACCATGACCAGGAACACCTCCATAAGCA CAGCCTACATGGAGCTGAGCAGCCTGAGATCTG AGGACACGGCCGTGTATTACTGTGCCTATAGCAG TGGCTGGTACTTCTTTGACTACTGGGGCCAGGGA ACCCTGGTCACCGTCTCCTCA SEQ ID NO: 29995 |
| | | AA | DIVMTQSPDSLAVSLGERATIKCKSSQSVLHSSN NMNYLAWYQQKPGQPPKLLIYWASTRKSGVPD RFSGTGSGTDFTLTISSLQAEDVAVYYCQQYYSS PCSFGQGTKLKIK SEQ ID NO: 25990 |
| | | | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYCAYSSGW YFFDYWGQGTLVTVSS SEQ ID NO: 29996 |
| iPS:434961 | 21-225_87A12 | NA | GAAATTGTGTTGACGCAGTCTCCAGGCACCCG GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGTCATCCAGACAGTTCAGT GGCAGTGGGTGTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGGAAAT CAAA SEQ ID NO: 25991 |
| | | | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCCAGGGAAGGGGCT GGAGTGGATTGGGGAAATCAATCATAGTGGAAG CACCAACTACAACCCGTCCCTCAAGAGTCGAGTC ACCATATTCAGTACAGATACGTCCAAGAACCAGTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA SEQ ID NO: 29997 |

FIGURE 50
(Continued)

| | | | |
|---|---|---|---|
| iPS:434965 | 21-225_88A1 | AA | EIVLTQSPGTIRYLSPGERATLSCRASQSVYSSYL AWYQQKPGQAPRLLIYGASSRSTVIPDRFSGSGC GTDFALTISRVEPEDCAVYYCQHSDNSPWTFGQ GTKVEIK<br>SEQ ID NO: 25992 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29998 |
| | | NA | AATATGTGATGACCCAGTCTCCAGACTCCCT GGCTGTGTCTCTGGGCGCGAGGGCCACCATCA ACTGCAAGTCCAGCAGAGTGTTTACACAGC TCCAACAATTACAACTACTTAACTTGGTACCA GCAGAAACCAGGACAGCCTCCTAAGCTGCTCC TTTACTGGGCATCTCACCGGAAATCCGGGGTC CCTGACCGATTCAGTGGCAGCGGGTCTGGGAC AGATTTCACTCTCACCATCAGCAGCCTGTCAGCAA CTGAAGATGTGGCAGTTATTTCTGTGCGTATAGCAG TATTATAGTTCTCCTCCGACGTTCGGCCAAGG GACCAAGGTGGAAATCAAA<br>SEQ ID NO: 25993 | CAGGTGCAGCTGGTGCAGTCTGGGCTGAGGTG AAGAAGCCTGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCTAACAGTG GTAACACAGGCTATGCACAGAAGTTCCAGGCA GAGTCACCATGACCAGGAACACCTCCATAAGCA CAGCCTACATGGAGCTGAGCAGCCTGAGATCTG AGGACACGGCCGTGTATTACTGTGCGTATAGCAG TGGCTGGTACTACTTGACTACTGGGGCCAGGGA ACCCTGGTCACCGTCTCCTCA<br>SEQ ID NO: 29999 |
| | | AA | NIVMTQSPDSLAVSLGARATINCKSSQSVLHSSN NYNYLTWYQQKPGQPPKLLLYWASTRKSGVPD RFSGSGSGTDFTLTISSLQAEDVAVYFCQQYYSS PPTFGQGTKVEIK<br>SEQ ID NO: 25994 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCAYSSGW YYFDYWGQGTLVTVSS<br>SEQ ID NO: 30000 |

FIGURE 50
(Continued)

| | | | |
|---|---|---|---|
| iPS:434969 | 21-225_88H1 | NA | GAAATTGTGTTGACGCAGTCTCCAGGCACCCT GTATTTGTCTCCAGGGGAAAGAGCCACCCTGT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACGGTCATCCCAGACACAGTTCAGT GGCAGTGGGTGTGGGACAGACTTCGCTCTCAC CATCAGCAGACTGGAGCCTGAAGATTGTGCAG TGTATTACTGTCAGCATTCTGATAACTCACCGT GGACGTTCGGCCAAGGGACCAAGGTGGAAAT CAAA<br><br>SEQ ID NO: 25995 | CAGGTGCAGCTACAGCAGTGGGGCGCAGGACTG TTGAAGCCTTCGGAGACCCTGTCCCTCACCTGC CTGTCCATGTGGGTCTTCAGTGGTTGCTACTG GAGCTGGATCCGCCAGCCCCAGGGAAGGGCT GGAGTGGATTGGGGAAATCAATCATAGTGAAG CACCAAACTACAACCCGTCCCTCAAGAGTCGAGTC ACCATTTCAGTAGACACGTCCAAGAACCAGTTCT CCCTGAAGCTGAGCTCTGTGACCGCCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30001 |
| | | AA | EIVLTQSPGTLYLSPGERATLSCRASQSVYSSYLA WYQQKPGQAPRLLIYGASSRSTVIPDRFSGSGCG TDFALTISRVEPEDCAVYYCQHSDNSPWTFGQG TKVEIK<br><br>SEQ ID NO: 25996 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 30002 |
| iPS:434971 | 21-225_88G2 | NA | GACATCGTGATGACCCAGTCTCCAGATTGCCT GGCTGTGTCTCTGGGCGAGAGGGCCACCATCA ACTGCAAGTCCAGCCAGAGTGTTTTATACACC TCCAACAATAACAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGGGGTCTGGGAC AGATTTCACTCTCACCATCAGCAGCCTGCAGG CTGAAGATGTGCAGTTTATTATTGTCAGCAA TATTATAATACTCCGTGGACGTTTGTCCAAGG GACCAAGGTGGAAATCAAA<br><br>SEQ ID NO: 25997 | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGGCAG AGTCACCATGACCAGGAACACCTCATAAGCAC AGCCTACATGGAGCTGAGCAGCCTGAGATCGA GGACACGGCCGTGTATTACTGTGCGATTAGCAGT GGCTGGTACTGGTTCGACCCCTGGGCCAGGGA ACCCTGGTCACGGTCTCCTCA<br><br>SEQ ID NO: 30003 |

FIGURE 50
(Continued)

| | | | |
|---|---|---|---|
| | | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQQYYNT PWTFVQGTKVEIK<br>SEQ ID NO: 25998 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS<br>SEQ ID NO: 30004 |
| iPS:434973 | 21-225_88B4 | NA | GACATCGTGATGACCCAGTCTCCAGACTCCCT GGCTGTGTCTCTGGGCGAGAGGGCCACCATCA ACTGCAAGTCCAGCAGTGTTTTATACATC TCCAACAATAATAATTACTTAGCTTGGTACCA GCAGAAACCAGGACAGCCTCCTAAACTGCTCA TTTACTGGGCATCTACCCGGGAATCCGGGGTC CCTGCCCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAAA<br>SEQ ID NO: 25999 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTGACACAGGCTATGCACAGAAGTTCCAGGGCA GTGTCACCATGACCAGGAACACCTCCATAACCAC AGCCTACATGGAGCTGAGCAGCCTGAGATCTGA GGACACGGCCGTGTATTACTGTTCGTATAGCAGT GGCTGGTACTACTTTGACTACTGGGGCCAGGGAA CCCTGGTCACCGTCTCCTCA<br>SEQ ID NO: 30005 | |
| | | AA | DIVMTQSPDSLAVSLGERATINCKSSQSVLYISN NNNYLAWYQQKPGQPPKLLIYWASTRESGVPA RFSGSGSGTDFTLTISSLQAEDVAVYYCQQYYST PPTFGQGTKVEIK<br>SEQ ID NO: 26000 | QVQLVQSGAEVKKPGASVKVSCKASGYTFTNYDIN WVRQATGQGLEWMGWMNPNSGDTGYAQKFQGS VTMTRNTSITTAYMELSSLRSEDTAVYYCSYSSGW YYFDYWGQGTLVTVSS<br>SEQ ID NO: 30006 |

FIGURE 50
(Continued)

| | | | |
|---|---|---|---|
| iPS:434977 | 21-225_88A5 | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATGATTACCCATTC ACTTTCGGCCCTGGGACCAAAGTGGAAATCAA A |
| | | | SEQ ID NO: 26001 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNDYPFTFGPGT KVEIK |
| | | | SEQ ID NO: 26002 |
| | | | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGGC TTGAGTGGATGGGATGGATGAACCCTAACAGTG GTAACACAGGCTATGCACAGAAGTTCCAGGCA GAGTCACCATGACCTGGAACACCTCCATACGCAC TGCCTACATGGAGCTGAGCAGCCTGAGATCTGAG GACACGGCCGTGTATTACTGTGCGCGAGGGTTT ACGATTTTTGACTGGTTATTCCCCACTACTAC TACTACGATATGGACGTTCTGGGGCCAAGGGACC ACGGTCACCGTCTCCTCA |
| | | | SEQ ID NO: 30007 |
| iPS:434981 | 21-225_88E7 | NA | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCGCCAGCCCCCAGGGAAGGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA |
| | | | SEQ ID NO: 30008 |

FIGURE 50
(Continued)

| | | | SEQ ID NO: 26003 | EIVLTQSPGTLSLSPGERATLSCRASQSVYSSYLA WYQQKPGQAPRLLIYGASSRSTGIPDRFSGSGSG TDFALTISRVEPEDCAVYYCQHSDNSPWTFGQG TKVEIK | SEQ ID NO: 30009 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS |
|---|---|---|---|---|---|---|
| | | AA | SEQ ID NO: 26004 | GAAATTGTGTTGACGCAGTCTCCAGGCACCCT GTCTTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGAAAT CAAA | SEQ ID NO: 30010 | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGGGACAC GGCTGTGTATTACTGTGCGAGGGACTACGGCGGT ATGGACGTCTGGGGCCAAGGGACCACGGTCACC GTCTCCTCA |
| iPS:434983 | 21-225_88F7 | AA | SEQ ID NO: 26005 | EIVLTQSPGTLSLSPGERATLSCRASQSVYSSYLA WYQQKPGQAPRLLIYGASSRSTGIPDRFSGSGSG TDFALTISRLEPEDCAVYYCQHSDNSPWTFGQG TKVEIK | SEQ ID NO: 30011 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS |
| | | | SEQ ID NO: 26006 | | SEQ ID NO: 30012 | |

FIGURE 50
(Continued)

| | | | |
|---|---|---|---|
| iPS:434995 | 21-225_88G9 | NA | GAAATTGTGTTGACGCAGTCTCCAGGCACCCG GTATTTGTCTCCAGGGGAAAGAGCCACCCTCT CCTGCAGGGCCAGTCAGAGTGTTTACAGCAGC TACTTAGCCTGGTACCAGCAGAAACCTGGCCA GGCTCCCAGGCTCCTCATTTATGGTGCATCA GCCGGTCCACTGGCATCCCAGAGACTTCAGT GGCAGTGGGTCTGGGACAGATTCGCTCTCAC CATCAGCAGAGTGGAGCCTGAAGATTGTGCAG TGTATTACTGTCAGCACTCTGATAACTCACCGT GGACGTTCGGCCAAGGGACCAAGGTGGAAAT CAAA<br><br>SEQ ID NO: 26007 | CAGGTGCAGCTACAGCAGTGGGGCGCAGGACTG TTGAAGCCTTCGGAGACCCTGTCCCTCACCTGCG CTGTCCATGTGGTGGGTCCTTCAGTGGTTGCTACTG GAGCTGGATCGCCAGCCCCAGGGAAGGGGCT GGAGTGGATTGGGGAAATCAATCATAGTGGAAG CACCAACTACAACCCGTCCTCAAGAGTCGAGTC ACCATTTCAGTAGACACGTCAAGAACCAGTTCT CCCTGAAGCTGAGCTCTGTGACCGCCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30013 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 30014 |
| | | AA | EIVLTQSPGTRYLSPGERATLSCRASQSVYSSYL AWYQQKPGQAPRLLIYGASSRSTGIPDRFSGSGS GTDFALTISRVEPEDCAVYYCQHSDNSPWTFGQ GTKVEIK<br><br>SEQ ID NO: 26008 | | |
| iPS:434997 | 21-225_88C10 | NA | GACATCGTGATGACCCAGTCTCCAGACTCCCT GGCTGTGTCTCTGGGCGAGAGGGCCACCATCA ACTGCAAGTCCAGCCAGAGTGTTTTACACAGC TCCAACAATTGGAATTTGGAATTACTTAGCTTGGCACCA TCCAACAATTGGAATTACTTAGCTTGGCACCA GCAGAAACCAGGACAGCCTCCTAAGTTGCTCA TTCACTGGGCATTTACTCGGAAATCCGGGGTC CCTGACCGATTCAGTGGCGGCGGGTCTGGGAC AAATTTCACTCTCACCATCAGCAGCCTGCAGG CTGAAGATGTGGCAGTTTATTACTGTCAGCAA TATTATAGAGCTCCTCCGACGTTCGGCCAAGG GACCAAGGTGGAAATCAAA<br><br>SEQ ID NO: 26009 | CAGGTGCAGCTGGTGCAGTCTGGGGCTGAGGTG AAGAAGCCTGGGGCCTCAGTGAAGGGTCTCCTGC AAGGCTTCTGGATACACCTTCAGCAATTATGATA TCAACTGGGTGCGACAGGCCACTGGACAAGGGC TTGAGTGGATGGGATGCAGAAGTTCCAGGGCAG TAACACAGGCTATGCACAGGAACACCTCCATAAGCAC AGCTACATGGAGCTGAGCAGCCTGAGATCTGA GGACACGGCCGTGTATTACTGTGCGAGTAGCAGT GGCTGGTTACTACTTTGACTCCTGGGGCCAGGAA CCCTGGTCACCGTCTCCTTA<br><br>SEQ ID NO: 30015 | |

FIGURE 50
(Continued)

| | | | | |
|---|---|---|---|---|
| | | AA | DIVMTQSPDSLAVSLGERATINCKSSQSVLHSSN NWNYLAWHQQKPGQPPKLLIHWAFTRKSGVPD RFSGGGSGTNFTLTISSLQAEDVAVYYCQQYYR APPTFGQGTKVEIK SEQ ID NO: 26010 | QVQLVQSGAEVKKPGASVRVSCKASGYTFSNYDIN WVRQATGQGLEWMGWMTPNSGNTGYAQKFQGR VTMTRNTSISTAYMELSSLRSEDTAVYYCASSSGW YYFDSWGQGTLVTVSL SEQ ID NO: 30016 |
| iPS:434999 | 21-225_75A8 | NA | GAAATTGTGTTGACGCAGTCTCCAGGCACCCT GTATTTGTCTCCAGGGGAAAGAGCCACCCTCT CATGCAGGGCCAGTCAGTCAGATGTTTACAGCAGC TACTTAGCCTGGTACCAGCAGAAACCTGGCCA GGCTCCCAGGCTCCTCATTTATGTGCATCCA GCCGGGCCACTGGCATCCCAGACAGTTCAGT GGCAGTGGGTCTGGGACAGATTCGCTCTCAC CATCAGCAGAGTGGAGCTGAAGATTGTGCAG TGTATTACTGTCAGCACTCTGATAACTCACCGT GGACGTTCGGCCAAGGGACCAAGGTGAAAT CAAA SEQ ID NO: 26011 | CAGGTGCAGCTACAGCAGTGGGGCGCAGGACTG TTGAAGCCTTCGGAGACCCTGTCCTCCACCTGCG CTGTCCATGTGGGTCTTCAGTGGTTGCTACTG GAGCTGGATCCGCCAGCCCCAGGGAAGGGCT GGAGTGGATTGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGCGGT ATGGACGTCTGGGGCCAAGGGACCACGGTCACC GTCTCCTCA SEQ ID NO: 30017 |
| | | AA | EIVLTQSPGTLYLSPGERATLSCRASQSVYSSYLA WYQQKPGQAPRLLIYGASSRATGIPDRFSGSGSG TDFALTISRVEPEDCAVYYCQHSDNSPWTFGQG TKVEIK SEQ ID NO: 26012 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS SEQ ID NO: 30018 |

FIGURE 50
(Continued)

| | | | |
|---|---|---|---|
| iPS:435009 | 21-225_89G4 | NA | GATATTGTGATGACTCAGTCTCCACTCTCCCTG CCCGTCACCCCTGGAGAGCCGGCCTCCATCTC CTGCAGGTCTAGTCAGAGCCTCCTGCATAGTA GTGATACAAACTATTTGGATTGGTACCTGCAG AAGCCAGGGCAGTCTCCACAGCTCCTGATCTA TTTGGGTTCTAATCGGGCCTCCGGGGTCCCTG ACAGGTTCAGTGGCAGTGGTTCAGGCACAGAT TTTACACTGAAAATCAGCAGAGTGGAGGCTGA GGATATTGGGGTTTATTACTGCATGCAAGCTC TACATATTCCCTCTCACTTTCGGCGGAGGGACC AAGGTGGAGATCAAA<br><br>SEQ ID NO: 26013 | GAGGTGCAGCTGGTGGAGTCTGGGGGAGGCTTG GTACAGCCGGGGGGGTCCCTGAGACTCTCCTG CAGCCTCTGGGATTCACCTTCAGTAGCTACGACAT GCACTGGGTCCGCCAAGCTACAGGAAGCTCT GGAGTGGGTCTCAGCTATTGGTACTGCTGGTGAC ACATACTATCCAGGCTCCGTGAAGGGCCGATTCA CCATCTCCAGAGAAAATGCCAAGAACTCCTTGTA TCTTCAAATGAACAGCCTGAGAGCCGGGGACAC GGCTGTGTATTTCTGTGCAAGAGCTCTTGACTAC GGTGACTCCTTGGGCTACTACTACTACGGTATGG ACGTCTGGGGCCAAGGGACCACGGTCACCGTCTC CTCA<br><br>SEQ ID NO: 30019 |
| | | AA | DIVMTQSPLSLPVTPGEPASISCRSSQSLLHSSGY NYLDWYLQKPGQSPQLLIYLGSNRASGVPDRFS GSGSGTDFTLKISRVEAEDIGVYYCMQALHIPLT FGGGTKVEIK<br><br>SEQ ID NO: 26014 | EVQLVESGGGLVQPGGSLRLSCAASGFTFSSYDMH WVRQATGKGLEWVSAIGTAGDTYYPGSVKGRFTIS RENAKNSLYLQMNSLRAGDTAVYFCARALDYGDS LGYYYYGMDVWGQGTTVTVSS<br><br>SEQ ID NO: 30020 |
| iPS:435013 | 21-225_89D5 | NA | GAAATTGTGTTGACGCAGTCTCCAGGCACCCT GTATTTGTCTTCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCACTATGATAACTCACCG TGGACGTTCGGCCAAGGGACCAAGGTGGAAA TCAAA<br><br>SEQ ID NO: 26015 | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGGCT GGAGTGGATTGGGAAATCAATCATATGGTGAAG CACCAACTACAACCCGTCCCTCCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGGAGGGACTACGGCGGT ATGGACGTTCTGGGGCCAAGGGACCACGGTCACC GTCTCCTCA<br><br>SEQ ID NO: 30021 |

FIGURE 50
(Continued)

| | | | | |
|---|---|---|---|---|
| iPS:435015 | 21-225_89H5 | AA | EIVLTQSPGTLYLSSGERATLSCRASQSVYSSYLA WYQQKPGQAPRLLIYGASSRSTGIPDRFSGSGSG TDFALTISRLEPEDFAVYYCQHYDNSPWTFGQG TKVEIK<br>SEQ ID NO: 26016 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30022 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTAACAGCAAC TACTTAGCCTGGTACCAGCAGAAACCTGGCCA GGCTCCCAGGCTCCTCATCTATGGTGCATTCA GCAGGGCCACTGGCATCCCAGACAGGGTCAGT GGCAGTGGGTCTGGGACAGACTTCAATCTCAT CATCAGCAGACTGGAGCCTGAAGATTTTGCAG TGTATTACTGTCAGCAGTATGAAAGCTCAGTG TGGACGTTCGGCCAAGGGACCAAGGTGGAAA TCAAA<br>SEQ ID NO: 26017 | CAGGTGCAGCTACAACAGTGGGGCGCAGGACTG TTGAAGCCTTCGGAGACCCTGTCCCTCACTTGCG CTGTCTATGGTGGGTCCTTCAGTGGTTGCTACTG GAGCTGGATCCGCCAGCCCCCAGGGAAGGGGCT GGAGTGGATTGGGGAAATCAATTATAGTGGAAG CACCAACTTCAACCGTCCCTCAAGAGTCGAGTC ACCATATCAGTGACACGTCCAAGAACCAGTTCT CCCTGAAGCTGAGCTCTGTGACCGCCGGGACAC GGCTGTGTATTACTGTGCGAGAGACTACGGCGGT ATGGACGTCTGGGGCCAAGGGACCACGGTCACC GTCTCCTCA<br>SEQ ID NO: 30023 |
| | | AA | EIVLTQSPGTLSLSPGERATLSCRASQSVNSNYLA WYQQKPGQAPRLLIYGAFSRATGIPDRVSGSGS GTDFNLISRLEPEDFAVYYCQQYESSVWTFGQG TKVEIK<br>SEQ ID NO: 26018 | QVQLQQWGAGLLKPSETLSLTCAVYGGSFSGCYW SWIRQPPGKGLEWIGEINYSGSTNFNPSLKSRVTISA DTSKNQFSLKLSSVTAADTAVYYCARDYGGMDV WGQGTTVTVSS<br>SEQ ID NO: 30024 |

FIGURE 50
(Continued)

| | | | | |
|---|---|---|---|---|
| iPS-435025 | 21-225_89E10 | NA | GAAATTGTGTTGACGCAGTCTCCAGGCACCCT<br>GTATTTGTCTTCAGGGGAAAGAGCCACCCTCT<br>CCTGCAGGGCCAGTCAGAGTGTTTACAGCAGC<br>TACTTAGCCTGGTACCAGCAGAAACCTGGCCA<br>GGCTCCCAGGCTCCTCATTTATGGTGCATCCA<br>GCCGGTCACTGTCATCCCAGACAGGTTCAGT<br>GGCAGTGGGTCTGGGACAGACTTCGCTCTCAC<br>CATCAGCAGAGTGGAGCCTGAAGATTTTGCAG<br>TGTATTACTGTCAGCATTCTGATAACTCTCCGT<br>GGACGTTCGGCCAAGGGACCAAGGTGGAAAT<br>CAAA<br>SEQ ID NO: 26019 | CAGGTGCAGCTACAGCAGTGGGGCGCAGGACTG<br>TTGAAGCCTTCGGAGACCCTGTCCCTCACCTGCG<br>CTGTCCATGTGGTCCTTCAGTGGTTGCTACTG<br>GAGCTGGATCCGCCAGCCCCAGGGAAGGGCT<br>GGAGTGGATTGGGGAAATCAATCATAGTGGAAG<br>CACCAACTACAACCCGTCCTCAAGAGTCGAGTC<br>ACCATTTCAGTAGACACGTCCAAGAACCAGTTCT<br>CCCTGAAGCTGAGCTCTGTGACCGCCGCGGACAC<br>GGCTGTGTATTACTGTGCGAGGACTACGGCGGT<br>ATGGACGTCTGGGGCCAAGGGACCACGGTCACC<br>GTCTCCTCA<br>SEQ ID NO: 30025 |
| | | AA | EIVLTQSPGTLYLSSGERATLSCRASQSVYSSYLA<br>WYQQKPGQAPRLLIYGASSRSTVIPDRFSGSGSG<br>TDFALTISRVEPEDFAVYYCQHSDNSPWTFGQG<br>TKVEIK<br>SEQ ID NO: 26020 | QVQLQQWGAGLLKPSETLSLTCAVHGGSFSGCYW<br>SWIRQPPGKGLEWIGEINHSGSTNYNPSLKSRVTISV<br>DTSKNQFSLKLSSVTAADTAVYYCARDYGGMDV<br>WGQGTTVTVSS<br>SEQ ID NO: 30026 |
| iPS-435029 | 21-225_89A11 | NA | GAAATTGTGTTGACGCAGTCTCCAGGCACCCT<br>GTCTTTGTCTCCAGGGGAAAGAGCCACCCTCT<br>CCTGCAGGGCCAGTCAGAGTGTTGACAGCAAC<br>TTCTTAGCCTGGTACCAGCAGAAACCTGGCCA<br>GGCTCCCAGGCTCCTCATCTATGGTGCATCTG<br>CCAGGACCACTGGCATCCCAGACAGGTTCAGT<br>GGCAGTGGGTCTGGGACAGACTTCACTCTCAC<br>CATCAGCAGACTGGAGCCTGAAGATTTTGCAG<br>TGTATTCCTGTCAGCAGTATGAAATCTCACCG<br>TGGACGTTCGGCCAAGGGACCAAGGTGGAAA<br>TCAAA<br>SEQ ID NO: 26021 | CAGGTGCAGCTGCAGCCGTGGGGCGCAGGACTG<br>TTGAAGCCTTCGGAGACCCTGTCCCTCACCTGCG<br>CTGTCTATGGTGGGTCCTTCAGTGGTTACTACTG<br>GAGCTGGATCCGCCAGCCCCCAGGGAAGGGCT<br>GGAGTGGATTGGGGAAATCAATCATAGTGGACG<br>CACCAGCTACAACCCGTCCTCAAGAGTCGAGTC<br>ACCATATCAGTAGACACGTCCAAGAACCAGTTCT<br>CCCTGAAGCTGAGCTCTGTGACCGCCGGACAC<br>GGCTGTGTATTACTGTGCGAGAGACTACGGTGGT<br>TTGGACGTCTGGGGCCAAGGGACCACGGTCACC<br>GTCTCCTCA<br>SEQ ID NO: 30027 |

FIGURE 50
(Continued)

| | | | | |
|---|---|---|---|---|
| iPS:435039 | | AA | EIVLTQSPGTLSLSPGERATLSCRASQSVDSNFLA WYQQKPGQAPRLLIYGASARTTGIPDRFSGSGSG TDFTLTISRLEPEDFAVYSCQQYEISPWTFGQGT KVEIK | QVQLQPWGAGLLKPSETLSLTCAVYGGSFSGYYW SWIRQPPGKGLEWIGEINHSGRTSYNPSLKSRVTISV DTSKNQFSLKLSSVTAADTAVYYCARDYGGLDVW GQGTTVTVSS |
| | | | SEQ ID NO: 26022 | SEQ ID NO: 30028 |
| | 21-225_90G4 | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGTCATCCCAGACAGGTTCAGT GGCAGTGGGTCTGGGACAGACTTCGCTCTCAC CATCAGCAGACAGAGTGGAGCTGAAGATTGTGCAG TGTATTACTGTCAGCACTCTGATAACTCACCGT GGACGTTCGGCCAAGGGACCAAGGTGGAAAT CAAA | CAGGTGCAGCTACAGCAGTGGGGCGCAGGACTG TTGAAGCCTTCGGAGACCCTGTCCTCACCTGCG CTGTCCATGTGGGTCCTTCAGTGGTTGCTACTG GAGCTGGATCCGCAGCCCCAGGGAAGGGGCT GGAGTGGATTGGGAAATCAATCATAGTGGAAG CACCAACTACAAACCGTCCTCAAGAGTCGAGTC ACCATTTCAGTAGACACGTCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA |
| | | | SEQ ID NO: 26023 | SEQ ID NO: 30029 |
| | | AA | EIVLTQSPGTLYLSPGERATLSCRASQSVYSSYLA WYQQKPGQAPRLLIYGASSRSTVIPDRFSGSGSG TDFALTISRVEPEDCAVYYCQHSDNSPWTFGQG TKVEIK | QVQLQQWGAGLLKPSETLSLTCAVHGGSFSGCYW SWIRQPPGKGLEWIGEINHSGSTYNPSLKSRVTISV DTSKNQFSLKLSSVTAADTAVYYCARDYGGMDV WGQGTTVTVSS |
| | | | SEQ ID NO: 26024 | SEQ ID NO: 30030 |

FIGURE 50
(Continued)

| | | | | |
|---|---|---|---|---|
| iPS:435041 | 21-225_90A5 | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAAACCTGGCCA GGCTCCCAGGCTCCTCATTTATGGTGCATCCA GCCGGGCCACTGGCATCCCAGACAGGTTCAGT GGCAGTGGGTCTGGGACAGACTTCGCTCTCAC CATCAGCAGAGTGGAGCATGAAGATTTTGCAG TGTATTACTGTCAGCACTATGATAACTCACCG TGGACGTTCGGCCAAGGGACCAAGGTGGAAA TCAAA SEQ ID NO: 26025 | CAGGTGCAGCTACAGCAGTGGGGCGCAGGACTG TTGAAGCCTTCGGAGACCCTGTCCCTCACCTGCG CTGTCCATGTGGTGTCCTTCAGTGGTTGCTACTG GAGCTGGATCCGCCAGCCCCCAGGGAAGGGGCT GGAGTGGATTGGGAGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA SEQ ID NO: 30031 |
| | | AA | EIVLTQSPGTLYLSPGERATLSCRASQSVYSSYLA WYQQKPGQAPRLLIYGASSRATGIPDRFSGSGSG TDFALTISRVEHEDFAVYYCQHYDNSPWTFGQG TKVEIK SEQ ID NO: 26026 | QVQLQQWGAGLLKPSETLSLTCAVHGGSFSGCYW SWIRQPPGKGLEWIGENHSGSTNYNPSLKSRVTISV DTSKNQFSLKLSSVTAADTAVYYCARDYGGMDV WGQGTTVTVSS SEQ ID NO: 30032 |
| iPS:435043 | 21-225_90G5 | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAAACCTGGCCA GGCTCCCAGGCTCCTCATCATTTATGGTGCATCCA GCCGGGCCACTGGCATCCCAGACAGGTTCAGT GGCAGTGGGTCTGGGACAGACTTCGCTCTCAC CATCAGCAGAGTGGAGCATGAAGATTTTGCAG TGTATTACTGTCAGCACTATGATAACTCACCG TGGACGTTCGGCCAAGGGACCAAGGTGGAAA TCAAA SEQ ID NO: 26027 | CAGGTGCAGCTACAGCAGTGGGGCGCAGGACTG TTGAAGCCTTCGGAGACCCTGTCCCTCACCTGCG CTGTCCATGTGGTGTCCTTCAGTGGTTGCTACTG GAGCTGGATCCGCCAGCCCCCAGGGAAGGGGCT GGAGTGGATTGGGAGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA SEQ ID NO: 30033 |

FIGURE 50
(Continued)

| | | | | |
|---|---|---|---|---|
| hPS:435045 | 21-225_90H5 | AA | EIVLTQSPGTLYLSPGERATLSCRASQSVYSSYLAWYQQKPGQAPRLIIYGASSRATGIPDRFSGSGSGTDFALTISRVEHEDFAVYYCQHYDNSPWTFGQGTKVEIK | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS |
| | | | SEQ ID NO: 26028 | SEQ ID NO: 30034 |
| | | NA | GACATCCAGATGACCCAGTCTCCATCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATATTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATATAGTTACCCGATCACCTTCGGCCAAGGGACCACGACTGGAGATTAAA | CAGGTGCAGCTGGTGGAGTCTGGGGGAGGCGTGGTCCAGCCTGGGAGGTCCCTGAGACTCTCCTGTCAGCGTCTGGATTCACCTTCAGTGACTATGGCATGCACTGGGTCCGCCAGTCTCCAGGCAAGGGCTGGAGTGGGTGGCAGTTATATGGTATGAAGGAAGTAATACATATGCAGACTCCGTGAAGGGCCGATTCACCATCTCCAGAGACAATTCCAAGAACACGCTGTATCTGCAAATGAACAGCCTGAGAGCCGAGGACACGGCTGTATATTACTGTGTGAGAGATGGGGTGGTTAGAATGACTACTGGGGCCAGGGAACCCTGGTCACCGTCTCCTCA |
| | | | SEQ ID NO: 26029 | SEQ ID NO: 30035 |
| | | AA | DIQMTQSPSSLSASVGDRVTITCRASQGIRNDLGWYQQKPGKAPKRLIYIASSLQSGVPSRFSGSGSGTEFTLTISSLQPEDFATYYCLQHNSYPITFGQGTRLEIK | QVQLVESGGGVVQPGRSLRLSCAASGFTFSDYGMHWVRQSPGKGLEWVAVIWYEGSNTYADSVKGRFTISRDNSKNTLYLQMNSLRAEDTAVYYCVREMGWLDDYWGQGTLVTVSS |
| | | | SEQ ID NO: 26030 | SEQ ID NO: 30036 |

FIGURE 50
(Continued)

| | | | | |
|---|---|---|---|---|
| iPS:435051 | 21-225_90D9 | NA | GACATCGTGATGACCCAGTCTCCAGACTCCCT GGCTGTGTCTCTGGGCGAGAGGGCCACCATCA CTGCAAGTCCAGCCAGCAGACTGTTTTACACAGC TCCAACAATTATAACTACTTAGCTTGGTACCA GCAGAAGCCAGGACAGCCCCCTAAGGTGCTC ATTTACTGGACATCTACCCGGGAATCCGGGGT CCCTGACCGATTCAGTGGCAGCGGGTCTGGGA CAGATTTCACTCTCACCATCAGCAGCCTGCAG GCTGAAGATGTGGCAGTTTATTACTGTCAGCA ATATCTTAGTAGTCCTCTGACGTTCGGCCAAG GGACCAAGGTGGAAATCAAA SEQ ID NO: 26031 | CAGGTGCAGCTGGTGCAGTCTGGGGCTGAGGTG AAGAAGCCTGGGGCCTCAGTGAAGGTCTCCTGC AAGGCTTCTGGATACACCTTCCCAATTATGATA TCAACTGGGTGCGACAGGCCACTGGACAAGGGC TTGAGTGGATGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTATTGTGCGGTTCCAG TGGCTGGCACTGGTTCGACCCGTGGGCCAGGGA ACCCTGGTCACCGTCGCCTCA SEQ ID NO: 30037 |
| | | AA | DIVMTQSPDSLAVSLGERATICKSSQTVLHSSNN YNYLAWYQQKPGQPPKVLIYWTSTRESGVPDRF SGSGSGTDFTLTISSLQAEDVAVYYCQQYLSSPL TFGQGTKVEIK SEQ ID NO: 26032 | QVQLVQSGAEVKKPGASVKVSCKASGYTFPNYDIN WVRQATGQGLEWMGWMNPNSGNTGYAQKFQGR VTMTRNTSISTAYMELSSLRSEDTAVYYCAVSSGW HWFDPWGQGTLVTVAS SEQ ID NO: 30038 |
| iPS:435053 | 21-225_75F9 | NA | GACATCGTGATGACCCAGTCTCCAGACTCCCT GCCTGTGTCTCTGGGCGAGAGGGCCACCGTCA ACTGCAAGTCCAGCCAGAGTGTTTTACACAGC TCCAACAATAATAACTACTTGGCTTGGTACCA GCAGAAAACCAGGACAGCCTCCTAAGCTGCTCA TTTACTGGGCATCTACGCGGGAGTCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAACAA TATTATAGTAGTCCTCTGACGTTCGGCCAAGG GACCAAGGTGGAAATCAAA SEQ ID NO: 26033 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGATCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCCTATAGCAGT GGCTGGTACATCTTTGACTACTGGGGCCAGGAA CCCTGGTCACCGTCTCCTCA SEQ ID NO: 30039 |

FIGURE 50
(Continued)

| | | | |
|---|---|---|---|
| iPS:435055 | 21-225_90F10 | AA | DIVMTQSPDSLPVSLGERATVNCKSSQSVLHNSN NNNYLAWYQQKPGQPPKLLIYWASTRESGVPD RFSGSGSGTDFTLTISSLQAEDVAVYYCQQYYSS PPTFGQGTKVEIK<br>SEQ ID NO: 26034 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YIFDYWGQGTLVTVSS<br>SEQ ID NO: 30040 |
| | | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTATGATAACTCACCG TGGACGTTCGGCCAAGGGACCAAGGTGGAAA TCAAA<br>SEQ ID NO: 26035 | CAGGTGCAGCTACAGCAGTGGGGCGCAGGACTG TTGAAGCCTTCGGAGACCCTGTCCTCACCTGCG CTGTCCATGTGGTCCTTCAGTGGTTGCTACTG GAGCTGGATCGGCCAGCCCCAGGGAAGGGCT GGAGTGGATTGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br>SEQ ID NO: 30041 |
| | | AA | EIVLTQSPGTLYLSPGERATLSCRASQSVYSSYLA WYQQKPGQAPRLLIYGASSRSTGIPDRFSGSGSG TDFALTISRLEPEDCAVYYCQHYDNSPWTFGQG TKVEIK<br>SEQ ID NO: 26036 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30042 |

FIGURE 50
(Continued)

| | | | |
|---|---|---|---|
| iPS:435059 | 21-225_90C11 | NA | GATATTGTGATGACTCAGTCTCCACTCTCCTG CCCGTCACCCCTGGAGAGCCGGCCTCCATCTC ATGCAGGTATAGTCAGAGCCTCGTGCATAGTA GTTGGATACAACTATTTGGATTGGTACCTGCAG AAGCCAGGGCAGTCTCCACAGCTCGTTATCTA TTTGGGTTCTAATCGGGCCTCCGGGGTCCCTG ACAGGTTCAGTGGCAGTGGATCAGGTTCAGAT TTTACACTGAAGATCAGCAGAGTGGAGGCTGA GGATGTTGGACTTTATTACTGCATGCAAGCTC TACACCCTCCTCACTTTCGGCGGAGGGACC AAGGTGGAGATCAAA<br><br>SEQ ID NO: 26037 |
| | | AA | DIVMTQSPLSLPVTPGEPASISCRYSQSLVHSSGY NYLDWYLQKPGQSPQLVIYLGSNRASGVPDRFS GSGSGSDFTLKISRVEAEDVGLYYCMQALHPPL TFGGGTKVEIK<br><br>SEQ ID NO: 26038 | GAGGTGCAGCTGGTGGAGTCTGGGGGAGGCTTG GTACAGCCTGGGGGGTCCCTGAGACTCTCCTGTG CAGCCTCTGGATTCACCTTCAGTAACTACGACAT GCACTGGGTCCGCCAAGCTACAGGAAAAGGTCT GGAGTGGGTCTCAGCTATTGGTACTGCTGGTGAC ACATACTATCCAGGCTCCGTGAAGGGCCGATTCA CCATCTCCAGAGACAACGCCAAGAACTCCTTGTA TCTTCAAATGAACAGCCTGAGAGCCGGGACAC GGCTGTGTATTACTGTGCAAGAGTTCTTGACTAC GGTGACTCCTTGGGCTACTACTACTACGGTATGG ACGTCTGGGGCCAAGGGACCACGGTCACCGTCTC CTCA<br><br>SEQ ID NO: 30043 |
| iPS:435071 | 21-225_91F1 | NA | GACATCGTGATGACCCAGTCTCCAGATTGCCT GGCTGTGTCTCTGGGCGAGAGGGCCACCATCA ACTGCAAGTCCAGCCAGAGTGTTTTATACACC TCCAACAATAACAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTTGCAGTTTATTATTGTCAGCACT ATTATAATACTCCGTGAAGTTTGTCCAAGGG ACCAAGGTGGAAATCAAA<br><br>SEQ ID NO: 26039 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGGTTCGACCCCTGGGGCCAGGGA ACCCTGGTCACCGTCTCCTCA<br><br>SEQ ID NO: 30045 |

FIGURE 50
(Continued)

| | | | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQHYYNT PWKFVQGTKVEIK SEQ ID NO: 26040 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTSS SEQ ID NO: 30046 |
|---|---|---|---|---|---|
| | | | NA | GAAATTGTGTTGACGCAGTCTCCAGGCACCCT GTATTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGAGTGGAGCCTGAAGATTGTGCAG TGTATTACTGTCAGCACTATTATGATAACTCACCG TGGACGTTCGGCCAAGGGACCAAGGTGGAAA TCAAA SEQ ID NO: 26041 | CAGGTGCAGTCACAGCAGTGGGGCGCAGGACTG TTGAAGCCTTCGGAGACCCTGTCCCTCACCTGCG CTGTCCATGTGGTCCTTCAGTGGTTGCTACTG GAGCTGGATCGCCAGCCCCAGGGAAGGGCT GGAGTGGATTGGGAAATCAATCATATAGTGGAAG CACCAACTACAACCGTCCTCAAGAGTCGAGTC ACCATTTCAGTAGACACGTCAAGAACCAGTCT CCCTGAAGTCGAGCTCTGTGACCGCCGGACAC GGCTGTGTATTACTGTGCCGAGGGACTACGGCGGT ATGGACGTTCTGGGGCCAAGGGACCACGGTCACC GTCTCCTCA SEQ ID NO: 30047 |
| iPS:435073 | 21-225_91B2 | | AA | EIVLTQSPGTLYLSPGERATLSCRASQSVYSSYLA WYQQKPGQAPRLLIYGASSRSTGIPDRFSGSGSG TDFALTISRVEPEDCAVYYCQHYDNSPWTFGQG TKVEIK SEQ ID NO: 26042 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS SEQ ID NO: 30048 |

FIGURE 50
(Continued)

| | | | |
|---|---|---|---|
| iPS:435075 | 21-225_91B3 | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAAACCTGGCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGACTGGAGCATGAAGATTGTGCA GTGTATTACTGTCAGCACTATGATAACTCACC GTGGACGTTCGGCCAAGGGACCAAGGTGGAA ATCAAA  SEQ ID NO: 26043 | CAGGTGCAGCTACAGCAGTGGGGCGCAGGACTG TTGAAGCCTTCGGAGACCCTGTCCCTCACCTGCG CTGTCCATGTGGGTCTTCAGTGGTTGCTACTG GAGCTGGATCGCCAGCCCCAGGGAAGGGCT GGAGTGGATTGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA  SEQ ID NO: 30049 |
| | | AA | EIVLTQSPGTLYLSPGERATLSCRASQSVYSSYLA WYQQKPGQAPRLLIYGASSRSTGIPDRFSGSGSG TDFALTISRVEHEDCAVYYCQHYDNSPWTFGQG TKVEIK  SEQ ID NO: 26044 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS  SEQ ID NO: 30050 |
| iPS:435077 | 21-225_91F3 | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAAACCTGGCCA GGCTCCCAGGCTCCTCATTTATGGTGCATCCCA GCCGGTCCACTGGCATCCCAGACAGGTTCAGT GGCAGTGGGTCTGGGACAGACTTCGCTCTCAC CATCAGCAGACTGGAGAGCCTGAAGATTCTGCAG TGTATTACTGTCAGCATTCTGATAACTCACCGT GGACGTTCGGCCAAGGGACCAAGGTGGAAAT CAAA  SEQ ID NO: 26045 | CAGGTGCAGCTACAGCAGTGGGGCGCAGGACTG TTGAAGCCTTCGGAGACCCTGTCCCTCACCTGCG CTGTCCATGTGGGTCTTCAGTGGTTGCTACTG GAGCTGGATCGCCAGCCCCAGGGAAGGGGCT GGAGTGGATTGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA  SEQ ID NO: 30051 |

FIGURE 50
(Continued)

| | | | | |
|---|---|---|---|---|
| iPS:435079 | 21-225_91B4 | AA | EIVLTQSPGTLYLSPGERATLSCRASQSVYSSYLA WYQQKPAQAPRLLIYGASSRSTGIPDRFSGSGSG TDFALTISRVEPEDCAVYYCQHSDNSPWTFGQG TKVEIK<br>SEQ ID NO: 26046 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30052 |
| | | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGATTCGCTCTCAC CATCAGCAGACTGGAGCCTGAAGATTGTGCAG TGTATTACTGTCAGCACTATGATAACTCACCG TGGACGTTCGGCCAAGGGACCAAGGTGGAAA TCAAA<br>SEQ ID NO: 26047 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCCAGGGAAGGGGCT GGAGTGGATTGGGGAAATCAATCATAGTGGAAG CACCAACTACAACCGTCCTCAAGAGTCGAGTC ACCATTTCAGTAGACACGTCCAAGAACCAGTTCT CCCTGAAGCTGAGCTCTGTGACCGCCGCGACAC GGCTGTGTATTACTGTGCGAGGGACTACGGCGGT ATGGACGTCTGGGGCCAAGGGACCACGGTCACC GTCTCCTCA<br>SEQ ID NO: 30053 |
| | | AA | EIVLTQSPGTLYLSPGERATLSCRASQSVYSSYLA WYQQKPGQAPRLIIYGASSRSTGIPDRFSGSGSG TDFALTISRVEPEDCAVYYCQHYDNSPWTFGQG TKVEIK<br>SEQ ID NO: 26048 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30054 |

FIGURE 50
(Continued)

| | | | |
|---|---|---|---|
| iPS:435087 | 21-225_91G8 | NA | GACATCGTGATGACCCAGTCTCCAGATTGCCT GGCTGTGTCTCTGGGCGAGAGGGCCACCATCA ACTGCAAGTCCAGCCAGAGTGTTTTATACACC TCCAACAATAACAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTTGCAGTTTATTATTGTCAGCAA TATTATACTACTCCGTGACGTTCGGCCAAGG GACCAAGGTGGAAATCAAA<br><br>SEQ ID NO: 26049 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGGTTCGACCCCTGGGGCCAGGGA ACCCTGGTCACCGTCTCCTCA<br><br>SEQ ID NO: 30055 |
| | | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQQYYTT PWTFGQGTKVEIK<br><br>SEQ ID NO: 26050 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS<br><br>SEQ ID NO: 30056 |
| iPS:435089 | 21-225_91E9 | NA | GAAATTGTGTTGACGCAGTCTCCAGGCACCCT GTATTTGTCTCCAGGGGAAAGAGCCACCCTGT CATGCAGGGCCAGTCAGAGTGTTACAGCAGC TACTTAGCGTGGTACCAGCAGAAACCTGGCCA GGCTCCCAGGCTCCTCATTTATGGTGCATCCA GCCGGGCCACGGCCATCCCAGACAGGTTCAGT GGCAGTGGGTGTGGGACAGACTTCGCTCTCAC CATCAGCAGACAGAGTGGAGCATGAAGATTGTGCA GTGTATTACTGTCAGCACTCTGATAACTCACC GTGGACGTTCGGCCAAGGGACCAAGGTGGAA ATCAAA<br><br>SEQ ID NO: 26051 | CAGGTGCAGCTACAGCAGTGGGGCGCAGACTG TTGAAGCCTTGGAGACCCTGTCCCTCACCTGCG CTGTCCATGTGGGTCCTTCAGTGGTTGCTACTG GAGCTGGATCCGCCAGCCCCCAGGGAAGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30057 |

FIGURE 50
(Continued)

| | | | | |
|---|---|---|---|---|
| | | AA | EIVLTQSPGTLYLSPGERATLSCRASQSVYSSYLA WYQQKPGQAPRLLIYGASSRATGIPDRFSGSGCG TDFALTISRVEHEDCAVYYCQHSDNSPWTFGQG TKVEIK<br>SEQ ID NO: 26052 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30058 |
| iPS:435897 | 21-225_92B1 | NA | GAAATTGTGTTGACGCAGTCTCCAGGCACCCT GTCTTTGTCTCCAGGGGAAAGAGCCACCCTCT CCTGCAGGGCCAGTCAGAGTGTTGGCAGCAAC TACTTAGCCTGGTACCAGCAGAAACGTGGCCA GGCTCCCAGGCTCCTCATCTATGGTGCATCCA GCAGGGCCACTGACATCCCAGACAGGTTCAGT GGCAGTGGGTCTGGGACAGATTCACTCTCAC CATCAGCAGACTGGAGCCTGAAGATTTTGCAG TGTATTACTGTCAGCAGTATGATGACCAAGGTGAAA TGGACGTTCGGCCAAGGGACCAAGGTGGAA TCAAA<br>SEQ ID NO: 26053 | CAGGTGCAGCTACAGCAGTGGGGCGCAGGACTG TTGAAGCCTTCGGAGACCCTGTCCCTCACCTGCG CTGTCTATGGTGGGTCCTTCAGTGGTTCCTACTGG AGCTGGATCCGCCAGCCCCAGGGAAGGGCTG GAGTGGATTGGGGAAATCAATTATAGGGGAAGC ACCAACTACAACCGTCCCTCAAGAGTCGAGTCG CCATATCAGTAGACACGTCCAAGAACCAGTTCTC CCTGAACCTGACCTCTGTGACCGCCGCGACACG GCTGTGTATTACTGTGCGAGGGACTACGGCGGTT TGGACGTCTGGGGCCAAGGGACCACGGTCACCG TCTCCTCA<br>SEQ ID NO: 30059 |
| | | AA | EIVLTQSPGTLSLSPGERATLSCRASQSVGSNYLA WYQQKRGQAPRLLIYGASSRATDIPDRFSGSGSG TDFTLTISRLEPEDFAVYYCQQYESSPWTFGQGT KVEIK<br>SEQ ID NO: 26054 | QVQLQQWGAGLLKPSETLSLTCAVYGGSFSGSYW SWIRQPPGKGLEWIGEINYRGSTNYNPSLKSRVAIS VDTSKNQFSLNLTSVTAADTAVYYCARDYGGLDV WGQGTTVTVSS<br>SEQ ID NO: 30060 |

FIGURE 50
(Continued)

| | | | |
|---|---|---|---|
| iPS:435103 | 21-225_92B2 | NA | GATATTGTGATGACTCAGTCTCCACTCTCCCTC<br>CCTGTCACCCCTGGAGAGCCGGCCTCCATCTC<br>ATGCAGGTCTAGTCAGAGCCTCGTGCATAGTA<br>GTGGATACAACTATTTGGATTGGTACCTGCAG<br>AAGCCAGGGCAGTCTCCACAACTCGTGATCTA<br>TTTGGGTTCTAATCGGGCCTCCGGGGTCCCTG<br>ACAGGTTCAGTGGCAGTGGTTCAGTCACAGAT<br>TTTACACTGAGAATCAGCAGAGTGGAGGCTGA<br>GGATATTGGGATTTATTATTGCATGCAAGCTC<br>TACATATTCCTCCACTTTCGGCGGAGGGACC<br>AAGGTGGAGATCAAA<br><br>SEQ ID NO: 26055 | GAGGTGCAGCTGGTGGAGTCTGGGGGAGGCTTG<br>GTACAGCCGGGGGGGTCCCTGAGACTCTCCTG<br>CAGCCCTGAGTTCACCTTCAGTAACTACGACAT<br>GCACTGGGTCCGCCAAGCTACAGGAAAAGGTCT<br>GGAGTGGGTCTCAGTTATTGGTACTGCTGGTGAC<br>ACATACTATCCAGGTCCGTGAAGGGCCGATTCA<br>CCATCTCCAGAGAAAATGCCAAGAACTCCTTGTA<br>TCTTCAAATGAACAGCCTGAGAGCCGGGACAC<br>GGCTGTGTATTTCTGTGCAAGAGCTCTTGACTAC<br>GGTGACTCCTTGGGCTACTACTACTACGGTATGG<br>ACGTCTGGGGCCAAGGGACCACGGTCACCGTCTC<br>CTCA<br><br>SEQ ID NO: 30061 |
| | | AA | DIVMTQSPLSLPVTPGEPASISCRSSQSLVHSSGY<br>NYLDWYLQKPGQSPQLVIYLGSNRASGVPDRFS<br>GSGSVTDFTLRISRVEAEDIGIYYCMQALHPLTF<br>GGGTKVEIK<br><br>SEQ ID NO: 26056 | EVQLVESGGGLVQPGGSLRLSCAASGFTFSNYDMH<br>WVRQATGKGLEWVSAIGTAGDTYYPGSVKGRFTIS<br>RENAKNSLYLQMNSLRAGDTAVYFCARALDYGDS<br>LGYYYYGMDVWGQGTTVTVSS<br><br>SEQ ID NO: 30062 |
| iPS:435109 | 21-225_92H5 | NA | GAAATAGTGATGACGCAGTCTCCAGCCACCCT<br>GTCTGTGTCTCCAGGGGAAAGAGCCACCCTCT<br>CCTGCCGGCCAGTCAGGATGTTATCACCTAC<br>TTAGCCTGGTACCAGCAGAAACCTGGCCAGGC<br>TCCCAGGCTCCTCATCTATGGTGCATCCACCA<br>GGGCCACTGGTGTCCCAGCCAGGTTCAGTGGC<br>AGTGGGTCTGGGACAGAGTTCACTCTCACCAT<br>CACCAGCCTGCAGTCTGAAGATATAATGACTG<br>ATTACTGTCAGGAGTATAATGACTGGCCGTGC<br>AGTTTTGGCCAGGGGACCAAGCTGGAGATCAA<br>A<br><br>SEQ ID NO: 26057 | CAGGTGCAGCTGGTGGAGTCTGGGGGAGGCGTG<br>GTCCAGCCTGGGAGGTCCCTGAGACTCTCCTGTG<br>CAGCGGTCTGGATTCACCTTCAGTAGCTATGGCAT<br>GCACTGGGTCCGCCAGGCTCCAGGCAAGGGGCT<br>GGAGTGGGTGGCAGTTATATGGTATGATGGAAGT<br>AATAAATACTATGCAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGCTGTGTATTACTGTGCGAGAGATCCCTT<br>TATAGTGGGAGCTACTACTTTGACTACTGGGGC<br>CAGGGAACCCTGGTCACCGTCTCCTCA<br><br>SEQ ID NO: 30063 |

FIGURE 50
(Continued)

| | | AA | EIVMTQSPATLSVSPGERATLSCRASQDVITYLA WYQQKPGQAPRLLIYGASTRATGVPARFSGSGS GTEFTLTITSLQSEDFALYYCQEYNDWPCSFGQG TKLEIK<br><br>SEQ ID NO: 26058 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDPFIV GATYFDYWGQGTLVTVSS<br><br>SEQ ID NO: 30064 |
| iPS:435111 | 21-225_92D6 | NA | GAAATTGTGTTGACGCAGTCTCCAGGCACCCT GTATTTGTCTCCAGGGGAAAGAGCCACCCTCT CATGCAGGGCCAGTCAGAGTGTTACAGCAGC TACTTAGCCTGGTACCAGCAGAAACCTGGCCA GGCTCCCAGGCTCCTCATTTATGGTGCATCCA GCCGGTCCACTGTCATCCAGACAGGTTCAGT GGCAGTGGGTGTGGGACAGACTTCGCTCTCAC CATCAGCAGACTGGAGCCTGAAGATTGTGCAG TGTATTACTGTCAGCATTATGATAACTCTCCGT GGACGTTCGGCCAAGGGACCAAGGTGGAAAT CAAA<br><br>SEQ ID NO: 26059 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCCAGGGAAGGGCT GGAGTGGATTGGGGAAATCAATCATAGTGGAAG CACCAACTACAACCGTCCTCAAGAGTCGAGTC ACCATTTCAGTAGACACGTCCAAGAACCAGTTCT CCCTGAAGCTGAGCTCTGTGACCGCCGCGACAC GGCTGTGTATTACTGTGCGAGGGACTACGGCGGT ATGGACGTCTGGGGCCAAGGGACCACGGTCACC GTCTCCTCA<br><br>SEQ ID NO: 30065 |
| | | AA | EIVLTQSPGTLYLSPGERATLSCRASQSVYSSYLA WYQQKPGQAPRLLIYGASSRSTVIPDRFSGSGCG TDFALTISRLEPEDCAVYYCQHYDNSPWTFGQG TKVEIK<br><br>SEQ ID NO: 26060 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 30066 |

FIGURE 50
(Continued)

| | | | |
|---|---|---|---|
| iPS:435113 | 21-225_92E6 | NA | GACATCGTGATGACCCAGTCTCCAGACTCCT GGCTGCGTCTCGGGCGAGAGGGCCACCATCA ACTGCAAGTCCAGTCAGAATATTTTATCCAGC TCCAACAATAAGAACTACTTAACTTGGTACCA GCAGAAACCAGGACAGCCTCCTAAAATACTCA TTTACTGGACATCTACCCGGAATCCGGGGTC CCTGACCGATTCAGTGGCAGCGGGTTTGGGAC AGTCACCTCACCATCAGCAGCCTGCAGG CTGAAGATGTGGCTGTTTATTACTGTCAGCAA TATTTAGTGTTCCTCCGACGTTCGGCCAAGG GACCAAGGTGGAAATCAAA<br>SEQ ID NO: 26061 | CAGGTGCAGCTGGTGCAGTCTGGGGCTGAGGTG AAGAAACCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TAACACAGGCTATGCACAGAAGTTCCAGGGCAG AGTCACCATGACCAGGAACACCTCCATGAGCAC AGCCTACATGGAGCTGAGCAGCCTGAGATCTGA GGACACGGCCGTGTATTACTGTGCCCATAGCAGT GGCTGGTACTTTTTGACTACTGGGGCCAGGGAA CCCTGGTCACCGTCCTCA<br>SEQ ID NO: 30067 |
| | | AA | DIVMTQSPDSLAASLGERATINCKSSQNILSSSNN KNYLTWYQQKPGQPPKILIYWTSTRESGVPDRFS GSGFGTDFTLTISSLQAEDVAVYYCQQYFSVPPT FGQGTKVEIK<br>SEQ ID NO: 26062 | QVQLVQSGAEVKKPGASVRVSCKASGYTFTNYDIN WVRQATGQGLEWMGWMHPNSGNTGYAQKFQGR VTMTRNTSMSTAYMELSSLRSEDTAVYYCAHSSG WYFFDYWGQGTLVTVSS<br>SEQ ID NO: 30068 |
| iPS:435115 | 21-225_77C5 | NA | GAAATTGTGTTGACGCAGTCTCCAGGCACCCT GTCTTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCACTATAACTCACCG TGGACGTTCGGCCAAGGGACCAAGGTGGAAA TCAAA<br>SEQ ID NO: 26063 | CAGGTGCAGCTACAGCAGTGGGGCGCAGGACTG TTGAAGCCTTCGGAGACCCTGTCCTCACCTGCG CTGTCCATGTGGGTCCTTCAGTGGTTGCTACTG GAGCTGGATCCGCCAGCCCCAGGGAAGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGGACAC GGCTGTGTATTACTGTGCGAGGGACTACGGCGGT ATGGACGTCTGGGGCCAAGGGACCACGGTCACC GTCTCCTCA<br>SEQ ID NO: 30069 |

FIGURE 50
(Continued)

| | | AA | EIVLTQSPGTLSLSPGERATLSCRASQSVYSSYLA WYQQKPGQAPRLLIYGASSRSTGIPDRFSGSGSG TDFALTISRLEPEDFAVYYCQHYDNSPWTFGQG TKVEIK<br>SEQ ID NO: 26064 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30070 |
|---|---|---|---|---|
| iPS:435167 | 21-225_92F12 | NA | GACATCGTGATGACCCAGTCTCCAGACTCCCT GGCTGTGTCTCTGGGCGAGAGGGCCACCACCA ATTGTAAGTCCAGCCAGAGTGTTTTACACAGG TCCAACAATTACAACTACTTAGCGTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAAA<br>SEQ ID NO: 26065 | CAGGTGCAGCTGGTGCAGTCTGGGCTGAGGTG AAGAAGCCTGGGGCCTCAGTGAAGGTCTCCTGC AAGGCTTCTGATACACCTTGACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGCA GAGTCACCATGACCAGAAACACCTCCATAAGCA CAGCCTACATGGAACTGAGCAGCCTGAGATCTG AGGACACCGCCGTGTATTACCGTGGGAGTACCA GTGGCGGGAAGTTCTTCGACTACTGGGGCCAGG GAACCCTGGTCACCGTCTCCTCA<br>SEQ ID NO: 30071 |
| | | AA | DIVMTQSPDSLAVSLGERATTNCKSSQSVLHRSN NYNYLAWYQQKPGQPPKLLIYWASTRESGVPD RFSGSGSGTDFTLTISSLQAEDVAVYYCQQYYST PPTFGQGTKVEIK<br>SEQ ID NO: 26066 | QVQLVQSGAEVKKPGASVKVSCKASGYTLTNYDI NWVRQATGQGLEWMGWMNPNSGNTGYAQKFQG RVTMTRNTSISTAYMELSSLRSEDTAVYYRGSTSG GKFFDYWGQGTLVTVSS<br>SEQ ID NO: 30072 |

FIGURE 50
(Continued)

| | | | |
|---|---|---|---|
| iPS:435171 | 21-225_93C2 | NA | GAAATTGTGTTGACGCAGTCTCCAGGCACCCT GTATTTGTCTCCAGGGGAAAGAGCCACCCTCT CCTGCAGGGCCAGTCAGAGTGTTTACAGCAGC TACTTAGCCTGGTACCAGCAGAAACCTGGCCA GGCTCCCAGGCTCCTCATCTATGGTGCATCCA GCCGGGCCACTGGCATACCAGACAGTTCAGT GGCAGTGGGTCTGGGACAGACTTCGCTCTCAC CATCAGCAGACTGGAGCATGAAGATTGTGCAG TGTATTACTGTCAGCACTATGATAACTCACCG TGGACGTTCGGCCAAGGGACCAAGGTGGAAA TCAAA<br><br>SEQ ID NO: 26067 | CAGGTGCAGCTACAGCAGTGGGGCGCAGGACTG TTGAAGCCTTCGGAGACCCTGTCCCTCACCTGCG CTGTCCATGTGGGGTCTTCAGTGTTGCTACTG GAGCTGGATCCGCCAGCCCCCAGGGAAGGGGCT GGAGTGGATTGGGGAAATCAATCATAGTGGAAG CACCAACTACAACCGTCCCTCAAGAGTCGAGTC ACCATTTCAGTAGACACGTCAAGAACCAGTTCT CCCTGAAGCTGAGCTCTGTGACCGCCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30073 |
| | | AA | EIVLTQSPGTLYLSPGERATLSCRASQSVYSSYLA WYQQKPGQAPRLLIYGASSRATGIPDRFSGSGSG TDFALTISRLEHEDCAVYYCQHYDNSPWTFGQG TKVEIK<br><br>SEQ ID NO: 26068 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 30074 |
| iPS:435177 | 21-225_93E4 | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGTTCAGT GGCAGTGGGTGTGGGACAGACTTCGCTCTCAC CATCAGCAGACTGGAGCTGAAGATTTTGCAG TGTATTACTGTCAGCACTCTGATAACTCACCGT GGACGTTCGGCCAAGGGACCAAGGTGGAAAT CAAA<br><br>SEQ ID NO: 26069 | CAGGTGCAGCTACAGCAGTGGGGCGCAGGACTG TTGAAGCCTTCGGAGACCCTGTCCCTCACCTGCG CTGTCCATGTGGGTCTTCAGTGGTTGCTACTG GAGCTGGATCCGCCAGCCCCCAGGGAAGGGGCT GGAGTGGATTGGGGAAATCAATCATAGTGGAAG CACCAACTACAACCGTCCCTCAAGAGTCGAGTC ACCATTTCAGTAGACACGTCAAGAACCAGTTCT CCCTGAAGCTGAGCTCTGTGACCGCCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30075 |

FIGURE 50
(Continued)

| | | | | |
|---|---|---|---|---|
| iPS:435183 | 21-225_93E9 | AA | EIVLTQSPGTLYLSPGERATLSCRASQSVYSSYLA WYQQKPGQAPRLLIYGASSRSTGIPDRFSGSGCG TDFALTISRVEPEDFAVYYCQHSDNSPWTFGQG TKVEIK SEQ ID NO: 26070 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS SEQ ID NO: 30076 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTGACAGCAGC TACCTAGCCTGGTACCAGCAGAAAACTGGCCA GGCTCCCAGGCTCCTCATCTATGGTGCATCCA GCAGGGCCCCTGGCATCCCAGACAGGTTCAGT GGCAGTGGGTCTGGGACAGACTTCACTCTCAC CATCAGCAGAGTGGAGCCTGAAGATTTTGCAG TGTATTACTGTCAGCAGTATGATAAAGCTCACCG TGGACGTTCGGCCAAGGGACCAAGGTGGAAA TCAAA SEQ ID NO: 26071 | CAGGTGCAGCTACAGCAGTGGGGCGCAGGACTG TTGAAGCCTTCGGAGACCCTGTCCCTCACCTGCG CTGTCTATGGTGGGTCCTTCAGTGGTTGCTACTG GAGCTGGATCCGCCAGCCCCAGGGAAGGGCT GGAGTGGATTGGGAAATCAATCATAGTGGAAG GACCAACTACAACCGTCCCTCAAGAGTCGAGTC ACCATATCAGTAGACACGTCCGAGAACAAGTTCT CCCTGAAGCTGAGCTCTGTGACCGCCGCGGACAC GGCTGTGTATTACTGTGCGAGAGACTACGGTGGG CTTGACTACTGGGGCCAGGGAACCCTGGTCACCG TCTCCTCA SEQ ID NO: 30077 |
| | | AA | EIVLTQSPGTLSLSPGERATLSCRASQSVDSSYLA WYQQKPGTGQAPRLLIYGASSRAPGIPDRFSGSGSG TDFTLTISRLEPEDFAVYYCQQYESSPWTFGQGT KVEIK SEQ ID NO: 26072 | QVQLQQWGAGLLKPSETLSLTCAVYGGSFSGCYW SWIRQPPGKGLEWIGEINHSGRTNYNPSLKSRVTIS VDTSENKFSLKLSSVTAADTAVYYCARDYGGLDY WGQGTLVTVSS SEQ ID NO: 30078 |

FIGURE 50
(Continued)

| | | | |
|---|---|---|---|
| iPS:435195 | 21-225_94D3 | NA | GAAATTGTGTTGACGCAGTCTCCAGGCACCCT GTCTTTGTCTCAAGGGGAAAGAGCCACCCTCT CCTGCAGGGCCAGTCAGAGTGTTAGCAGCAGG TACTTAGCCTGGTACCAGCAGAAACCTGGCCA GGCTCCCAGACTCCTCATCTATGGTGCATCCA GCAGGGCCACTGGCATCCAGACAGGTTCAGT GGCAGTGGGTCTGGGACAGACTTCACTCTCAC CATCAGCAGACTGGAGCCTGAAGATTTTGCAG TATATTACTGTCAGCATTATGATAGCTCACCGT GGACGTTCGGCCAAGGGACCAAGGTGGAAATC ACA<br><br>SEQ ID NO: 26073 | CAGGTGCAGCTACAGCAGGGGGCGCAGGACCG TTGAAGCCTTCGGAGACCCTGTCCCTCACCTGC GCTGTCTATGTGGGTCCTTCAGTGGTTGCTACTG GAGCTGGATCCGCCAGCCCCCAGGGAAGGGCT GGAGTGGATTGGGGAAATCAATTATAGTGGAAG AACCAACTACAACCCGTCCCTCAAGAGTCGAGTC ACCATATCAGTAGACACGTCCAAGAACCAGTTCT CCCTGAAGCTGAGTCTGTGACCGCCGCGGACAC GGCTGTGTATTACTGTGCGAGAGACTACGGCGGT ATGGACGTCTGGGGCCAAGGGACCACGGTCACC GTCTCCTCA<br><br>SEQ ID NO: 30079 |
| | | AA | EIVLTQSPGTLSLSQGERATLSCRASQSVSSRYLA WYQQKPGQAPRLLIYGASSRATGIPDRFSGSGSG TDFTLTISRLEPEDFAVYYCQHYDSSPWTFGQGT KVENQ<br><br>SEQ ID NO: 26074 | QVQLQQGGAGPLKPSETLSLTCAVYGGSFSGCYWS WIRQPPGKGLEWIGEINYSGRTNYNPSLKSRVTISV DTSKNQFSLKLSSVTAADTAVYYCARDYGGMDV WGQGTTVTVSS<br><br>SEQ ID NO: 30080 |
| iPS:435197 | 21-225_94F3 | NA | GACATCCAGATGACCCAGTCTCCATCCTCCCT GTCTGCATCTGTAGGAGACAGAGTCACCATCA CTTGCCGGGCAAGTCAGGCCATTAGAGATGAT TTAGGCTGGTATCAGCAGAAACCAGGGAAAG CCCCTCAGCGCCTGATCTTTGCTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTCCAGCATTATAGTTACCCTCGGA CGTTCGGCCGAGGGACCAAGGTGGCAATCAA A<br><br>SEQ ID NO: 26075 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACGATATCAT GCACTGGGTCCGCCAGGCTCCAGGCAAGGGCT GGAGTGGTGGCAGTTATATGAGACTCCGTGAAGGCCGA AATAAATACTATGCAGACTCCGTGAAGGGCCGA TTCACCATCCACAGAGACAATTCCAAGAACACGC TGTATCTGCAAATTAACAGCCTGAGAGCCGAGG ACACGGCTGTGTATTTCTGTGCGAGAGAAAAATA TAGCAGTGGCTGGTACGACTACGGTATGGACGTC TGGGGCCAAGGGACCACGGTCACCGTCTCCTCA<br><br>SEQ ID NO: 30081 |

FIGURE 50
(Continued)

| | | | |
|---|---|---|---|
| iPS:435203 | 21-225_75A7 | AA | DIQMTQSPSSLSASVGDRVTITCRASQAIRDDLG WYQQKPGKAPQRLIFAASSLQSGVPSRFSGSGSG TEFTLTISSLQPEDFATYYCLQHYSYPRTFGRGT KVAIK<br>SEQ ID NO: 26076 | QVQLVESGGGVVQPGRSLRLSCAASGFTFSNDIMH WVRQAPGKGLEWVAVIWYDGSNKYYADSVKGRF TISRDNSKNTLYLQINSLRAEDTAVYFCAREKYSSG WYDYGMDVWGQGTTVTVSS<br>SEQ ID NO: 30082 |
| | | NA | GACATGTGATGACCCAGTCTCCAGACTCCCT GGCTGTGTCTCTGGGCGAGAGGGCCACCATCA ACTGCAAGTCCAGCAGACTGTTTACACAGC TCCAACAATTATAACTACTTAGCTTGGTACCA GCAGAAGCCAGGACAGCCCCCTAAGGTGCTC ATTTACTGGACATCTACCCGGGAATCCGGGGT CCCTGACCGATTCAGTGGCAGCGGGTCTGGGA CAGATTTCACTCTCACCATCAGCAGCCTGCAG GCTGAAGATGTGGCAGTTTATTACTGTCAGCA ATATTTTAGTAGTCCTCCGACGTTCGGCCAAG GGACCAAGGTTGGAAATCAAA<br>SEQ ID NO: 26077 | CAGGTGCAGCTGGTGCAGTCTGGGGCTGAGGTG AAGAAGCCTGGGGCCTCAGTGAAGGTCTCCTGC AAGGCTTCTGGATACACCTTCCCAATTATGATA TCAACTGGGTGCGACAGGCCACTGGACAAGGGC TTGAGTGGATGGGATGGATGAACCCTAACAGTG GTAACACAGGCTATGCACAGAAGTTCAGGACA GAGTCACCATGACCAGGAACACCTCCATAAGCA CAGCCTACATGGAGCTGAGCAGCCTGAGATCTG AGGACACGGCCGTGTATTATTGTGCGGTTCCAG TGGCTGGCACTGGTTGACCCCTGGGGCCAGGGA ACCCTGGTCACCGTCGCCTCA<br>SEQ ID NO: 30083 |
| | | AA | DIVMTQSPDSLAVSLGERATINCKSSQTVLHSSN NYNYLAWYQQKPGQPPKVLIYWTSTRESGVPD RFSGSGSGTDFTLTISSLQAEDVAVYYCQQYFSS PPTFGQGTKVEIK<br>SEQ ID NO: 26078 | QVQLVQSGAEVKKPGASVKVSCKASGYTFPNYDIN WVRQATGQGLEWMGWMNPNSGNTGYAQKFQDR VTMTRNTSISTAYMELSSLRSEDTAVYYCAVSSGW HWFDPWGQGTLVTVAS<br>SEQ ID NO: 30084 |

FIGURE 50
(Continued)

| | | | |
|---|---|---|---|
| iPS:435209 | 21-225_75A10 | NA | AATATCGTTATGACCCAGTCTCCAGACTCCCT GGCTGTGTCTCTGGGCGAGAGGGCCACCATCA ACTGCAAGTCCAGCCAGAGTGTTTTACACAAC TCCAACAATTACAACTACTTAACTTGGTACCA GCAGAAACCAGGACAGCCTCCTAAGCTGCTCC TTTACTGGGCATCTACCCGGAAATCCGGGGTC CCTGACCGATTCAGTGGCAGCGGGTCTGGGAC AGATTTCACTCTCACCATCAGCAGCCTGCAGG CTGAAGATGTGGCAGTTTATTCTGTCAGCAA TATTATAGTTCTCCTCGACGTTCGGCCAAGG GACCAAGGTGGAAATCAAA<br>SEQ ID NO: 26079 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCGTATAGCAG TGGCTGGTACTACTTTGACTACTGGGGCCAGGGA ACCCTGGTCACCGTCCTCA<br>SEQ ID NO: 30085 |
| | | AA | NIVMTQSPDSLAVSLGARATINCKSSQSVLHNSN NYNYLTWYQQKPGQPPKLLLYWASTRKSGVPD RFSGSGSGTDFTLTISSLQAEDVAVYFCQQYYSS PPTFGQGTKVEIK<br>SEQ ID NO: 26080 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCAYSSGW YYFDYWGQGTLVTVSS<br>SEQ ID NO: 30086 |
| iPS:435211 | 21-225_94E11 | NA | GACATCGTTATGACCCAGTCTCCAGACTCCCT GGCTGTGTCTCTGGGCGAGAGGGCCACCATCA ATTGCAAGTCCAGCCAGAGTGTTTTATTCAGC TCCAACAATTATAATTACTTGGTACCA GCAGAAACCAGGACAGCCTCCTAACCTGCTCA TTTACTGGGCATCTACCCGGGAAATCCGGGGTC CCTGACCGATTCAGTGGCAGCGGGTCTGGGAC AGATTTCACTCTCACCATCAGCAGCCTGCAGG CTGCTGATGTGGCAGTTTATTACTGTCAGCAA TATCATAGTTCTCTCTGACGTTCGGCCAAGG GACCACGGTCAAATCAAA<br>SEQ ID NO: 26081 | CAGGTGCAGTTGGTGCAGTCTCGGGCTGAGGTGA AGAAGCCTGGGGCCTCAGTGAAGGTCTCCTGCA AGGCTTCTGGATACACCTTCACCAATTATGATAT CAACTGGGTGCGACAGGCCACTGGACAAGGCT TGAGTGGATGGGATGGATGAACCCTAACAGTGG TAACACAGGCTATGCACAGAAGTTCCAGGGCAG AGTCACCATGACCAGGAACACCTCCACAAGCAC AGCCCACATGGAGCTGAGCAGCCTGAGATCTGA GGACACGGCCGTGTATTACTGTGCGGTCTCCAGT GGCTGGAAGTTGGTTGACCCTGGGGCCAGGGA ACCCTGGTCACCGTCCTCA<br>SEQ ID NO: 30087 |

FIGURE 50
(Continued)

| | | | | |
|---|---|---|---|---|
| iPS:435215 | 21-225_94E12 | AA | DIVMTQSPDSLAVSLGERATINCKSSQSVLFSSN NYNYLAWYQQRPGQPPNLLIYWASTRESGVPD RFSGSGSGTDFTLTISSLQAADVAVYYCQQYHSS PLTFGQGTTVQIK<br>SEQ ID NO: 26082 | QVQLVQSGAEVKKPGASVKVSCKASGYTFTNYDIN WVRQATGQGLEWMGWMNPSNGTGYAQKFQGR VTMTRNTSTSTAHMELSSLRSEDTAVYYCAVSSGW KWFDPWGQGTLVTVSS<br>SEQ ID NO: 30088 |
| | | NA | GACATCGTGATGACCCAGTCTCCAGACTCCCT GGCTGTGTCTCTGGGCGAGAGGGCCACCACCA ATTGTAAGTCCAGCCAGAGTGTTTTACACAGG TCCAACAATTACAACTACTTAGCGTGGTACCA GCAGAAACCAGGACAGCCTCCTAAGCTGCTCA TTTACTGGGCATCTACCCGGAATCCAGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAAA<br>SEQ ID NO: 26083 | CAGGTGCAGCTGGTGCAGTCTGGGGCTGAGGTG AAGAAGCCTGGGGCCTCAGTGAAGGTCTCCTGC AAGGCTTCTGGATACACCTTGACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGAACTGAGCAGCCTGAGATCTG AGGACACGGCCGTGTATTACCGTGGGAGTACCA GTGGCTGGAAGTTCTTTGACTACTGGGGCCAGGG AACCCTGGTCACCGTCTCCTCA<br>SEQ ID NO: 30089 |
| | | AA | DIVMTQSPDSLAVSLGERATTNCKSSQSVLHRSN NYNYLAWYQQKPGQPPKLLIYWASTRESGVPD RFSGSGSGTDFTLTISSLQAEDVAVYYCQQYYST PPTFGQGTKVEIK<br>SEQ ID NO: 26084 | QVQLVQSGAEVKKPGASVKVSCKASGYTLTNYDI NWVRQATGQGLEWMGWMPNSGNTGYAQKFQG RVTMTRNTSISTAYMELSSLRSEDTAVYYRGSTSG WKFFDYWGQGTLVTVSS<br>SEQ ID NO: 30090 |

FIGURE 50
(Continued)

| | | | |
|---|---|---|---|
| iPS:435217 | 21-225_94F12 | NA | GAAATTGTGTTGACGCAGTCTCCAGGCACCCT GTATTTGTCTCCAGGGGAAAGAGCCACCTTCT CATGCAGGGCCAGTCAGTCAGAGTGTTTACAGCAGC TACTTAGCGTGGTACCAGCAGAAACCTGGCCA GGCTCCCAGGCTCCTCATTTATGGTGTCATCCA GCCGGTCCACTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCATTATGATAACTCACCGT GGACGTTCGGCCAAGGGACCAAGGTGGAAAT CAAA<br>SEQ ID NO: 26085 | CAGGTGCAGCTACAGCAGTGGGGCGCAGGACTG TTGAAGCCTTCGGAGACCGTCCCTCAGTGGTTGCTACTG CTGTTCCATGTGGGTCTTCAGTGGTTGCTACTG GAGCTGGATCCGCCAGCCCCAGGGAAGGGCT GGAGTGGATTGGGGAAATCAATCATAGTGGAAG ACCAACTACAACCCGTCCCTCAAGAGTCGAGTC ACCATTCAGTAGACACGTCCAAGAACCAGTCT CCCTGAAGCTGAGCTCTGTGACCGCCGGACAC GGCTGTGTATTACTGTGCGAGGACTACGGCGGT ATGGACGTCTGGGGCCAAGGGACCACGGTCACC GTCTCCTCA<br>SEQ ID NO: 30091 |
| | | AA | EIVLTQSPGTLYLSPGERATFSCRASQSVYSSYLA WYQQKPGQAPRLLIYGASSRSTGIPDRFSGSGSG TDFALTISRLEPEDFAVYYCQHYDNSPWTFGQG TKVEIK<br>SEQ ID NO: 26086 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30092 |
| iPS:435219 | 21-225_95D2 | NA | GAAATTGTGTTGACGCAGTCTCCAGGCACCCT GTCTTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATCTATGGTGCATCCA GCCGGGCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTATGATAACTCACCG TGGACGTTCGGCCAAGGGACCAAGGTGGAAA TCAAA<br>SEQ ID NO: 26087 | CAGGTGCAGCTACAGCAGTGGGGCGCAGGACTG TTGAAGCCTTCGGAGACCGTCCCTCACCTGCG CTGTCCATGTGGGTCCTTCAGTGGTTGCTACTG GAGCTGGATCGCCAGCCCCCAGGGAAGGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGGGACAC GGCTGTGTATTACTGTGCGAGGACTACGGCGGT ATGGACGTCTGGGGCCAAGGGACCACGGTCACC GTCTCCTCA<br>SEQ ID NO: 30093 |

FIGURE 50
(Continued)

| | | | | |
|---|---|---|---|---|
| iPS:435221 | | AA | EIVLTQSPGTLSLSPGERATLSCRASQSVYSSYLA WYQQKPGQAPRLLIYGASSRATGIPDRFSGSGSG TDFALTISRLEPEDCAVYYCQHYDNSPWTFGQG TKVEIK<br>SEQ ID NO: 26088 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30094 |
| | 21-225_95G2 | NA | CAGGTGCAGCTGCAGTGGTGGAGTCTGGGGGAGGCGTG GTCCAGCCTGGGAGGTCCCTGAGACTCTCCTGTA CAGCGTCTGGATTCACCTTCAGTAGCTATGGCAT GCACTGGGTCCGCCAGGCTCCAGGCAAGGGGCT TTAGCCTGGTACCAGCAGAAACCTGGCCAGGC GGAGTGGGTGGCAGTTATTTGGTATGATGGAAGT TCCCAGGCTCCTCATCTATGTGCATCCACCA AATAAATACTATGCAGAGACTCCGTGAAGGGCGA GGGCCACTGGTATCCCAGCAGTTCAGTGGC TTCACCATCTCCAGAGACAATTCCAAGAACAGC AGTGGGTCTGGGACAGAGTTCACTCTCACCAT TGTTTCTGCAAATGAACAGCTGAGAGCCGAGG CAGCAGCCTGCAGTCAGTATAATGACTGGCCGT ACACGGCTGTGTATTACTGTGCGAGCGATGCAA ATTACTGTCAGCAGCAGTCAGTATAATGACTGGCCGT TATAGTGGGAGCTACTTACTTTGAGTCCTGGGGC AGTTTTGGCCAGGGGACCAAGCTGGAGATCAA CAGGGAACCCTGGTCACCGTCTCCTCA A<br>SEQ ID NO: 26089 | SEQ ID NO: 30095 |
| | | AA | EIVMTQSPATLSLSPGERATLSCRASMSVVNSLA WYQQKPGQAPRLLIYGASTRATGIPARFSGSGSG TEFTLTISSLQSEDFAIYYCQQYNDWPCSFGQGT KLEIK<br>SEQ ID NO: 26090 | QVQLVESGGGVVQPGRSLRLSCTASGFTFSSYGMH WVRQAPGKGLEWVAVIWYDGSNKYYADSVKGRF TISRDNSKNTLFLQMNSLRAEDTAVYYCASDRNIV GATYFESWGQGTLVTVSS<br>SEQ ID NO: 30096 |

FIGURE 50
(Continued)

| | | | | |
|---|---|---|---|---|
| iPS:435227 | 21-225_95G4 | NA | GACATCGTTATGACCCAGTCTCCAGACTCCCT<br>GGCTGTGTCTCTGGGGGAGAGGGCCACCATCA<br>ATTGCAAGTCCAGCCAGAGTGTTTATTCAGA<br>TCCAACAATTATAATTACTTAGCTTGGTACCA<br>GCAGAGACCAGGACAGCCTCCTATAACCTGCTCA<br>TTTACTGGGCATCTACCCGGGAATCCGGGGTC<br>CCTGACCGATTCAGTGGCAGCGGGTATGGGAC<br>AGATTTCACTCTCACCATCAGCAGCGTGCAGG<br>CTGCTGATGTGGCAGTTTATTACTGTCAGCAA<br>TATCATAGTTCCTCTGACGTTCGGCCAAGG<br>GACCACGGTGCAAATCAAA<br>SEQ ID NO: 26091 | CAGGTGCAGTTGGTGCAGTCTGGGGCTGAGGTGA<br>AGAAGCCTGGGGCCTCAGTGAAGGTCTCCTGCA<br>AGGCTTCTGGATACACCTTCACCAATTATGATAT<br>CAACTGGGTGCGACAGGCCACTGGACAAGGGCT<br>TGAGTGGATGGATGGATGCACAGAAGTTCAGGGCAG<br>TAACACAGGCTATGCACAGAAGTTCCAGGCAG<br>AGTCACCATGACCAGGAACACCTCCACAAGCAC<br>AGCCCACATGGAGCTGAGCAGCCTGAGATCTGA<br>GGACACGGCCGTGTATTACTGTGCGGTCTCCAGT<br>GGCTGGAACTGGTTCGACCCTGGGGCCAGGGA<br>ACCCTGGTCACCGTCTCCTCA<br>SEQ ID NO: 30097 |
| | | AA | DIVMTQCPDSLAVSLGERATINCKSSQSVLFRSN<br>NYNYLAWYQQRPGQPHNLLIYWASTRESGVPD<br>RFSGSGYGTDFTLTISSVQAADVAVYYCQQYHS<br>SPLTFGQGTTVQIK<br>SEQ ID NO: 26092 | QVQLVQSGAEVKKPGASVKVSCKASGYTFTNYDIN<br>WVRQATGQGLEWMGWMNPNSGNTGYAQKFQGR<br>VTMTRNTSTSTAHMELSSLRSEDTAVYYCAVSSGW<br>NWFDPWGQGTLVTVSS<br>SEQ ID NO: 30098 |
| iPS:435235 | 21-225_95F9 | NA | GAAATTGTGTTGACGCAGTCTCCAGGCACCCT<br>GTATTTGTCTCAGGGGAAAAGAGCCACCCTCT<br>CCTGCAGGGCCAGTCAGAGTGTTACAGCAGC<br>TACTTAGCCTGGTACCAGCAGAAACCTGGCCA<br>GGCTCCCAGGCTCCTCATTTATGGTGCATCCA<br>GCCGGTCCACTGGCATCCCAGACAGGTTCAGT<br>GGCAGTGGGTGTGGGACAGACTTCCGTCTCAC<br>CATCAGCAGACTGGAGCCTGAAGATTTTGCAG<br>TGTATTACTGTCAGCACTATGATAACTCACCG<br>TGGACGTTCGGCCAAGGGACCAAGGTGGAAA<br>TCAAA<br>SEQ ID NO: 26093 | CAGGTGCAGTCAGTACAGCAGTGGGGCGCAGGACTG<br>TTGAAGCCTTCGGAGACCCTGTCCCTCACCTGCG<br>CTGTCCATGTTGGGTCCTTCAGTGGTTGCTACTG<br>GAGCTGGATCCGCCAGCCCCCAGGGAAGGGCT<br>GGAGTGGATTGGGAAATCAATCATAGTGGAAG<br>CACCAACTACACAACCCGTCCCTCAAGAGTCGAGTC<br>ACCATTTCAGTAGACACGTCAAGAACCAGTTCT<br>CCCTGAAGCTGAGCTCTGTGACCGCCGCGGACAC<br>GGCTGTGTATTACTGTGCGAGGGACTACGGCGGT<br>ATGGACGTCTGGGGCCAAGGGACCACGGTCACC<br>GTCTCCTCA<br>SEQ ID NO: 30099 |

FIGURE 50
(Continued)

| | | | | |
|---|---|---|---|---|
| iPS:435237 | 21-225_95G9 | AA | EIVLTQSPGTLYLSPGERATLSCRASQSVYSSYLA WYQQKPGQAPRLLIYGASSRSTGIPDRFSGSGCG TDFALTISRLEPEDFAVYYCQHYDNSPWTFGQG TKVEIK<br><br>SEQ ID NO: 26094 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 30100 |
| | | NA | GAAATTGTGTTGACGCAGTCTCCAGGCACCCT GTATTTGTCTCAGGGGAAAGAGCCACCCTCT CATGCAGGGCCAGTCAGTGTTTACAGCAGC TACTTAGCGTGGTACCAGCAGAAACCTGGCCA GGCTCCCAGGCTCCTCATTTATGGTGCATCCA GCCGGTCCACTGGCATCCCAGACAGTTCAGT GGCAGTGGGTCTGGGACAGCATTCGCTCTCAC CATCAGCAGAGTGGAGCATGAAGATTGTGCA GTGTATTACTGTCAGCACTATGATAACTCACC GTGGACGTTCGGCCAAGGGACCAAGGTGGAA ATCAAA<br><br>SEQ ID NO: 26095 | CAGGTGCAGCTACAGCAGTGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCCAGGGAAGGGCT GGAGTGGATTGGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30101 |
| | | AA | EIVLTQSPGTLYLSSGERATLSCRASQSVYSSYLA WYQQKPGQAPRLLIYGASSRSTGIPDRFSGSGSG TDFALTISRVEHEDCAVYYCQHYDNSPWTFGQG TKVEIK<br><br>SEQ ID NO: 26096 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 30102 |

FIGURE 50
(Continued)

| | | | |
|---|---|---|---|
| iPS:435239 | 21-225_95H10 | NA | GAAATTGTGTTGTCGCAGTCTCCAGGCATCT GTATTTGTCTTCAGGGGAAAGAGCCACCCTCT CCTGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGCCACTGGCATCCCAGACAGTTCAGT GGCAGTGGGTCTGGGACAGACTTCGCTCAC CATCAGCAGACTGGAGCTGAAGATTTTGCAG TGTATTACTGTCAGCACTATGATAACTCCCGT GGACGTTCGGCCAAGGGACCAAGGTGGAAAT CAAA SEQ ID NO: 26097 | CAGGTGCAGCTACAGCAGTGGGGCGCAGGACTG TTGAAGCCTTCGGAGACCCTGTCCTCACCTGCG CTGTCCATGTGGGTCCTTCAGTGGTTGCTACTG GAGCTGGATCCGCCAGCCCCAGGGAAGGGGCT GGAGTGGATTGGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGCGACAC GGCTGTGTATTACTGTGCGAGGGACTACGGCGGT ATGGACGTCTGGGGCCAAGGGACCACGGTCACC GTCTCCTCA SEQ ID NO: 30103 |
| | | AA | EIVLSQSPGILYLSSGERATLSCRASQSVYSSYLA WYQQKPGQAPRLLIYGASSRATGIPDRFSGSGSG TDFALTISRLEPEDFAVYYCQHYDNSPWTFGQG TKVEIK SEQ ID NO: 26098 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS SEQ ID NO: 30104 |
| iPS:435245 | 21-225_95E12 | NA | GACATCGTGATGACCCAGTCTCCAGACTCCCT GGCTGTGTCTCTGGGCGAGAGGGCCACCATCA ACTGCAAGTCCAGCCAGAGTGTTTTATACAGC TCCAACAATGCGAACTACTTAGCTTGGTACCA GCAGAAACCAGGACAGCCTCCTAACCTGTTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCGTGCAGTTTGGCCAGGG GACCAAGGTGGAGATCAAA SEQ ID NO: 26099 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGAACCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCGATTAGCAG TGGCTGGTACTGGTTCGACCCCTGGGGCCAGGGA ACCCTGGTCACCGTCTCCTCA SEQ ID NO: 30105 |

FIGURE 50
(Continued)

| | | | |
|---|---|---|---|
| | AA | DIVMTQSPDSLAVSLGERATINCKSSQSVLYSSN NANYLAWYQQKPGQPPNLFIYWASTRESGVPD RFSGSGSGTDFTLTISSLQAEDVAVYYCQQYYST PCSFGQGTKVEIK<br><br>SEQ ID NO: 26100 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCAISSGW YWFDPWGQGTLVTVSS<br><br>SEQ ID NO: 30106 |
| iPS:435247 | NA | GAAATTGTGTTGACGCAGTCTCCAGGCACCCT GTCTTTGTCTACAGGGGAAAGAGCCACCCTCT CGTGCAGGGCCAGTCAGAGCGTTAGCAGCAG CTACTTAGCTTGGTACCAGCAGAAACCTGGCC AGCCTCCCAGGCTCCTCATTTATGGTGCATCA ACCAGGGCCTCTGGCATCCCAGACAGGTTCAG TGGCAGTGGGTCTGGGACAGACTTCACTCTCA CCATCAGCAGACTGGAGCCTGAATATTTTGCA GTTTATTACTGTCAGCAGTATTACTCACCATC GCTCACTTTCGGCGGAGGGACCAAGGTTGGAG ATCAAA<br><br>SEQ ID NO: 26101 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAATGG TAACACAGGCTATGCACAGAAGTTCCAGGGCAG AGTCACCATGACCAGGAACACCTCCATAAGCAC AGCTACATGGAGCTGAACAGCCTGAGATCTGA GGACACGGCCGTGTATTACTGTGCGATTAGCAGT GGCTGGTACTGGTTCGACCCCTGGGGCCAGGGA ACCCTGGTCACCGTCTCCTTA<br><br>SEQ ID NO: 30107 |
| | AA | EIVLTQSPGTLSLSTGERATLSCRASQSVSSSYLA WYQQKPGQPPRLLIYGASTRASGIPDRFSGSGSG TDFTLTISRLEPEYFAVYYCQQYYGNSPLTFGGGT KVEIK<br><br>SEQ ID NO: 26102 | QVQLVQSGAEVKKPGASVKVSCKASGYTFTNYDIN WVRQATGQGLEWMGWMHPNNGNTGYAQKFQGR VTMTRNTSISTAYMELNSLRSEDTAVYYCAISSGW YWFDPWGQGTLVTVSL<br><br>SEQ ID NO: 30108 |

FIGURE 50
(Continued)

| | | | |
|---|---|---|---|
| iPS:435249 | 21-225_96E2 | NA | GACAGCGTGATGACCCAGTCTCCAGACTCCCT GGCTGTGTCTCTGGGCGAGAGGGCCACCATCA ACTGCAAGTCCAGCCAGAGTGTTTTACACAGC TCTAATAAAAAGAACTACTTAGCTTGGTACCA GCAGAAACCAGGACAGCCTCCTAAGCTGCTCA TTTACTGGGCATCTACCTGGGAATCCGGGGTC CCTGACCGATTCAGTGGCAGCGGGTCTGGGAC AGATTCACTCTCACCATCAGCAGTCTGCAGG CTGAAGATGTGGCAGTTTATTACTGTCAGCAA TATTATAGGACTCCGTGACGTTCGGCCAAGG GACCAAGGTGGAAATCAAA<br><br>SEQ ID NO: 26103 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAATAGTGG TAACACAGGCTATGCACAGAAGTTCCAGGCAG AGTCACCCTGACCAGAGAACACCTCCATAAGCAC AGCCTACATGGAGCTGAGCAGCCTGAGATCTGA GGACACGGCCGTGTATTACTGTGCGGTTCCAGT GGCTGGTACTGGTTCGACCCCTGGGGCCAGGGA ACCCTGGTCACCGTCTCCTCA<br><br>SEQ ID NO: 30109 |
| | | AA | DSVMTQSPDSLAVSLGERATINCKSSQSVLHSSN KKNYLAWYQQKPGQPPKLLIYWASTWESGVPD RFSGSGSGTDFTLTISSLQAEDVAVYYCQQYYRT PWTFGQGTKVEIK<br><br>SEQ ID NO: 26104 | QVQLVQSGAEVKKPGASVKVSCKASGYTFTNYDIN WVRQATGQGLEWMGWMHPNSGNTGYAQKFQGR VTLTRNTSISTAYMELSSLRSEDTAVYYCAVSSGW YWFDPWGQGTLVTVSS<br><br>SEQ ID NO: 30110 |
| iPS:435251 | 21-225_96A3 | NA | GACATCCAGATGACCCAGTCTCCATCCTCCCT GTCTGCTTCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCACTT TGCAAAGTGGGGTCCCATCAAGGTTCAGCGGC AGTGGATCTGGGACAGAATTCACTCTCACAAT CAGCGGCCTGCAGCGTGAAGATTTTGCAACTT ATCACTGTCTACAGCATATAATTACCCGCTC ACTTTCGGCGGAGGGACCAAGGTGGAGATCA AA<br><br>SEQ ID NO: 26105 | CAGCTGCAGCTGCAGGAGTCGGGCCCAGGACTG GTGAAGCCTTCGGAGACCCTGTCCCTCATCTGTA CTGTCTCTGGTGGCTCCATCAGCAGTAGTAATTA CTACTGGGGCTGGATCCGCCAGCCCCCAGGGAA GGGGCTGGAGTGGATTGGGAGTATCTATTATAGT GGATACACCTCTACAACCGTCCTCAAGAGTC GAGTCACCATATCCGTAGACTGTCCAAGAACCA CTTCTCCCTGAGGCTGAGCTCTGTGACCGCCGCA GACACGGCTGTGTATTACTGTGCGAGACTTGACT CTAACTGGGGTCTTGACTACTGGGGCCAGGGAAC CCTGGTCACCGTCTCCTCA<br><br>SEQ ID NO: 30111 |

FIGURE 50
(Continued)

| | | | | |
|---|---|---|---|---|
| | | AA | DIQMTQSPSSLSASVGDRVTITCRASQGIRNDLG WYQQKPGKAPKRLIYAASTLQSGVPSRFSGSGS GTEFTLTISGLQREDFATYHCLQHSNYPLTFGGG TKVEIK<br>SEQ ID NO: 26106 | QLQLQESGPGLVKPSETLSLICTVSGGSISSSNYYW GWIRQPPGKGLEWIGSIYYSGYTSYNPSLKSRVTIS VDSSKNHFSLRLSSVTAADTAVYYCARLDSNWGL DYWGQGTLVTVSS<br>SEQ ID NO: 30112 |
| iPS:435253 | 21-225_96A4 | NA | GACATCCAGATGACCCAGTCTCCATCCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGTGTATCCAGT TTGCAAAGTGGGGTCCCATCAAGGTTCAGCGG CAGTGGATCTGGGACCGAATTCACTCTCACAA TCAGCAGCCTGCAGCCTGAAGATTTTGCAACT TATTACTGTCTACAGCATAATGATTACCCATTC ACTTTCGGCCGTGGGACCAAAGTGGATATCAA A<br>SEQ ID NO: 26107 | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACACGGGC TTGAGTGGATGGGATGGATGAACCTAACAGTG GTAACACAGGCTATGCACAGAAGTTCCAGGGCA GAGTCACCATGACCTGGAACACCTCCAAAGCA CAGCCTACATGGAGCTGAGTAGCCTGAGATCTGA GGACACGGCCGTGTATTACTGTGCGAGAGGCTTT TACGATACTTTGACTGGTTCCGGCTACTACG TTATGGACGTCTGGGGCCAAGGGACCACGGTCA CCGTCTCCTCA<br>SEQ ID NO: 30113 |
| | | AA | DIQMTQSPSSLSASVGDRVTITCRASQDIRNDLG WYQQKPGKAPKRLIYGVSSLQSGVPSRFSGSGS GTEFTLTISSLQREDFATYYCLQHNDYPFTFGRG TKVDIK<br>SEQ ID NO: 26108 | QVQLVQSGAEVKKPGASVKVSCKASGYTFTSYDIN WVRQATGHGLEWMGWMNPNSGNTGYAQKFQGR VTMTWNTSKSTAYMELSSLRSEDTAVYYCARGFY DTLTGSGYYYVMDVWGQGTTVTVSS<br>SEQ ID NO: 30114 |

FIGURE 50
(Continued)

| | | | |
|---|---|---|---|
| iPS:435255 | 21-225_96D5 | NA | GACATCGTGATGACCCAGTCTCCAGACTCCCT GGCTGTGTCTCTGGGCGAGAGGGCCACCATCA ACTGCAAGTCCAGCCAGAGTGTTTGCACAGC TCCAACAATTATAATTACTTAGCTGGTACCA GCAGAAACCAGGACAGCCTCCTAAACTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGCTGATGTGGCAGTTTATTACTGTCAGCAA TATTATAGTAGTCCACCGACGTTCGGCCAAGG GACCACGGTGGAAATCAAA SEQ ID NO: 26109 | CAGGTGCAGCTGGTGCAGTCTGGGGCTGAGGTG AAGAAGCCTGGGGCCTCAGTGAAGGTCTCCTGC AAGGCTTCTGATACACCTTCACCAATTATGATA TCAACTGGGTGCGACAGGCCACTGGACAAGGC TTGAGTGGATGGGATGGAACCTAACAGTG GTAACACAGGCTATGCACAGAAGTTCCAGGCA GAGTCACCATGACCAGGAGCACCTCACAAGCA CAGCCCACATGGAGCTGAGCAGCTGAGATCTG AGGACACGGCCGTGTATTACTGTGCGGTTCCAG TGGCTGGTCCTGGTTCGACCCTGGGGCCAGGGA ACCCTGGTCACCGTCTCCTCA SEQ ID NO: 30115 |
| | | AA | DIVMTQSPDSLAVSLGERATINCKSSQSVLHSSN NYNYLAWYQQKPGQPPNLLIYWASTRESGVPD RFSGSGSGTDFTLTISSLQAEDVAVYYCQQYYSS PPTFGQGTTVEIK SEQ ID NO: 26110 | QVQLVQSGAEVKKPGASVKVSCKASGYTFTNYDIN WVRQATGQGLEWMGWMNPNSGNTGYAQKFQGR VTMTRSTSTAHMELSSLRSEDTAVYYCAVSSGW SWFDPWGQGTLVTVSS SEQ ID NO: 30116 |
| iPS:435257 | 21-225_96H5 | NA | GACATCGTGATGACCCAGTCTCCAGACTCCCT GGCTGTGTCTCTGGGCGAGAGGGCCACCATCA ACTGCAAGTCCAGCCAGAGTGTTTGTACAGC TCCAACAGTCCACAACTACTTAGCTTGGTACCA GCAGAAACCAGGACAGCCTCCTAAACTGCTCA TTTACTGGGCATCTATCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA CTGTATACTCCGTGCAGTTTTGGCCAGGG GACCAAGGTGGAGATCAAA SEQ ID NO: 26111 | CAGGTGCAGCTGGTGCAGTCTGGGGCTGAGGTG AAGAAGCCTGGGGCCTCAGTGAAGGTCTCCTGC AAGGCTTCTGATACACCTTCACCAATTATGATA TCAACTGGGTGCGACAGGCCTCTGGACAAGGAC TTGAGTGGATGGGATGGCACCCTAACAGTGG TAACACAGGCTATGCACAGAAGTTCCAGGGCAG AGTCACCATGACCAGGAACACCTCCATAAGCAC AGCTACATGGAGCTGAGCAGCCTGAGATCTGA GGACTCGGCCGTATATTACTGTGCGTATAGTAGT GGCTGGTACAAATTTGACTACTGGGGCCAGGGA ACCCTGGTCACCGTCTCCTCA SEQ ID NO: 30117 |

FIGURE 50
(Continued)

| | | | | |
|---|---|---|---|---|
| | | AA | DIVMTQSPDSLAVSLGERATINCKSSQSVLYSSN SHNYLAWYQQKPGQPPKLLIYWASIRESGVPDR FSGSGSGTDFTLSISSMQAEDVAVYYCQQYYSTP CSFGQGTKVEIK<br><br>SEQ ID NO: 26112 | QVQLVQSGAEVKKPGASVKVSCKASGYTFTNYDIN WVRQASGQGLEWMGWMHPNSGNTGYAQKFQGR VTMTRNTSISTAYMELSSLRSEDSAVYYCAYSSGW YKFDYWSQGTLVTVSS<br><br>SEQ ID NO: 30118 |
| iPS:435259 | 21-225_96C6 | NA | GACATCCAGATGACCCAGTCTCCATCCTCACT GTCTGCATCTGTAGGAGACAGAGTCACCATCA CTTGTGGGCGAGTCAGGGCATTAGCAATTAT TTAGCCTGGTTTCAGCAGAAACCAGGGAAAGC CCCTAAGTCCCTGATCTATGCTGCTTCCAGTT GCAAAGTGGGTCCCCTCAAAGTTCAGCGGCA GTGGATCTGGGACAGATTTCACTCTCACCATC AACAGCCTGCAGCCTGAAGATTTTGCAACTTA TTACTGCCACCAGTAATGATTACCATTCA CTTTCGGCCCTGGGACCAAAGTGGATATCAAA<br><br>SEQ ID NO: 26113 | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGTCAGGCCACTGGACAAGGGC TTGAGTGGATGGATGGATGAACCTAACAGTCG TAACACAGGCTATGCACAGAAGTTCCAGGGCAG AGTCACCATGACCTGAACACCTCCATAAGCACA GCCTACATGGAGCTGAGCAGCCTGAGATCTGAG GACAGCCGTGTATTACTGTGCGAGAGGGGGCT ACGATGTTTGCCTGGGAATAACTACTACTACGA TATGACGTCTGGGGCCAAGGGACCACGGTCAC CGTCTCCTCA<br><br>SEQ ID NO: 30119 |
| | | AA | DIQMTQSPSSLSASVGDRVTITCRASQGISNYLA WFQQKPGKAPKSLIYAASSLQSGVPSKFSGSGSG TDFTLTINSLQPEDFATYYCHQYNDYPFTFGPGT KVDIK<br><br>SEQ ID NO: 26114 | QVQLVQSGAEVKKPGASVKVSCKASGYTFTSYDIN WVRQATGQGLEWMGWMNPNSRNTGYAQKFQGR VTMTWNTSISTAYMELSSLRSEDTAVYYCARGGY DVLPGNNYYYDMDVWGQGTTVTVSS<br><br>SEQ ID NO: 30120 |

FIGURE 50
(Continued)

| | | | |
|---|---|---|---|
| iPS:435267 | 21-225_96D10 | NA | GACATCGTGATGACCCAGTCTCCAGACTCCCT GGCTGTGTCTCTGGGCGAGAGGGCCACCATCA ATTGCAAGTCCAGTCAGAATACTTAACTTATCCAGC TCCAACAATAAGAACTACTTAACTTGGTACCA GCAGAAACCAGGACAGCCTCCTAAAATACTCA TTTACTGGACATCTACCCGGGAATCCGGGGTC CCTGACCGATTCAGTGGCAGCGGGTTTGGGAC AGATTCACTCTCACCATCAGCAGCCTGCAGG CTGAAGATGTGGCTGTTTATTACTGTCAGCAA TATTTTAGTGTTCCTCCGACGTTCGGCCAAGG GACCAAGGTGGAAATCAAA<br>SEQ ID NO: 26115 | CAGGTGCAGCTGGTGCAGTCTGGGGCTGAGGTG AAGAAACCTGGGCCTCAGTGAGGGTCTCCTGC AAGGCTTCTGATACACCTTCACCAATTATGATA TCAACTGGGTGCGACAGGCCACTGGACAAGGC TTGAGTGGATGGGATGGATGCACCCTAACAGTGG TAACACAGGCTATGCACAGAAGTTCAGGGCAG AGTCACCATGACCAGGAACACTCCATGAGCAC AGCCTACATGGAGCTGAGCAGCCTGAGATCTGA GGACACGGCCGTGTATTACTGTGCCATAGCAGT GGCTGGTACTTTTTGACTACTGGGGCCAGGGAA CCCTGGTCACCGTCCTCA<br>SEQ ID NO: 30121 |
| | | AA | DIVMTQSPDSLAVSLGERATINCKSSQNILSSSNN KNYLTWYQQKPGQPPKILYWTSTRESGVPDRFS GSGFGTDFTLTISSLQAEDVAVYYCQQYFSVPPT FGQGTKVEIK<br>SEQ ID NO: 26116 | QVQLVQSGAEVKKPGASVRVSCKASGYTFTNYDIN WVRQATGQGLEWMGWMHPNSGNTGYAQKFQGR VTMTRNTSMSTAYMELSSLRSEDTAVYYCAHSSG WYFFDYWGQGTLVTVSS<br>SEQ ID NO: 30122 |
| iPS:435273 | 21-225_97A2 | NA | GAAATTGTGTTGACGCAGTCTCCAGGCACCCT GTATTTGTCTTCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGTATCCCAGACAGGTTCAGT GGCAGTGGGTGTGGGACAGACTTCGCTCTCAC CATCAGCAGACTGGAGCCTGAAGATTGTGCAG TGTATTACTGTCAGCATTCTGATAACTCACCGT GGACGTTCGGCCAAGGGACCAAGGTGGAAAT CAAA<br>SEQ ID NO: 26117 | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCCGT ATGGACGTCTGGGGCCAAGGGACCACGGTCACC GTCTCCTCA<br>SEQ ID NO: 30123 |

FIGURE 50
(Continued)

| | | | |
|---|---|---|---|
| iPS:435279 | 21-225_97H4 | AA | EIVLTQSPGTLYLSSGERATLSCRASQSVYSSYLA WYQQKPGQAPRLLIYGASSRSTGIPDRFSGSGCG TDFALTISRLEPEDCAVYYCQHSDNSPWTFGQG TKVEIK<br>SEQ ID NO: 26118 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30124 |
| | | NA | GACATCGTGATGACCCAGTCTCCAGATTGCCT GGCTGTGTCTCTGGGCGAGAGGGCCACCATCA ACTGCAAGTCCAGCCAGAGTGTTTATACACC TCCAACAATAACAACTACTTAGCTTGGTACCA GCAGAAACCAGGACAGCCTCCTAAGCTGCTCA TTTACTGGGCATCTACCCGGGAATCCGGGTC CCTGACCGATTCAGTGGCAGCGGGTCTGGGAC AGATTTCACTCTCACCATCAGCAGCCTGCAGG CTGAAGATGTTGCAGTTTATTATTGTCAGCACT ACAATGATACTCCATGGAAGTTTGTCCAAGGG ACCAAGGTGGAAATCACA<br>SEQ ID NO: 26119 | CAGGTGCAGCTGGTGCAGTCTGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCCTAACAGTGG TAACACAGGCTATGACCAGGAACACCTCCATAAGCAC AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGGTTCGACCCCTGGGGCCAGGGA ACCCTGGTCACCGTCCTCTCA<br>SEQ ID NO: 30125 |
| | | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQHYNDT PWKFVQGTKVEIT<br>SEQ ID NO: 26120 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS<br>SEQ ID NO: 30126 |

FIGURE 50
(Continued)

| | | | | |
|---|---|---|---|---|
| iPS:435281 | 21-225_97E5 | NA | GACATCAAGATGACCCAGTCTCCAGGCACCCT GTCTTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGCCACTGGCATCCCAGACAGGTTCAGT GGCAGTGGGTGTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGGAAAT CAAA<br><br>SEQ ID NO: 26121 | CAGGTGCAGCTACAGCAGTGGGGCGCAGGACTG TTGAAGCCTTCGGAGACCCTGTCCCTCACCTGCG CTGTCCATGTGGGGTCCTTCAGTGGTTGCTACTG GAGCTGGATCCGCCAGCCCCCAGGGAAGGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30127 |
| | | AA | EIVLTQSPGTLSLSPGERATLSCRASQSVYSSYLA WYQQKPGQAPRLLIYGASSRATGIPDRFSGSGCG TDFALTISRVEPEDCAVYYCQHSDNSPWTFGQG TKVEIK<br><br>SEQ ID NO: 26122 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 30128 |
| iPS:435291 | 21-225_146E1 | NA | GACATCAAGATGACCCAGTCTCCATCTTCCGT GTCTGCATCTGTAGGAGACAGAGTCACCATCA CTTGTCGGGCGAGTCAGGGTATTAACAACTGG TTAGTCTGGTATCAGCAGAAACCAGGGAAAGC CCCTAAGCTCCTGATCTATGCTGCATCCAGTTT GCAAAGTGGGGTCCCATCAAGGTTCCGCGGCA GTGGATCTGGGACAGATTTCACTCTCACCATC AGCAGCCTGCAGCCTGAAGATTTTGCAACTTA CTATTGTCAACAGGCTAACAGTTTCCCATTCA CTTTCGGCCCTGGGACCAAAGTGGATATCAAA<br><br>SEQ ID NO: 26123 | CAGGTGCAGCTGGTGGAGTCTGGGGGAGGCGTG GTCCAGCCTGGGAGGTCCCTGAGACTCTCCTGTG AAGCGTCTGGAAATCACCTTCAGTAGCTATGGCAT GCACTGGGTCCGCCAGGCTCCAGGCAAGGGGCT GGAGTGGGTGGCAATTATATGGTATGATGGAAGT AATAAATACTATGCAGACTCCGTGAAGGGCCGA TTCACCATCTCCAGAGACAATTCCAAGAACACGC TGTTTCTGCAAATGAACAGCCTGAGAGCCGAGG ACACGGCTGTGTATTACTGTGCGAGAGATCGTTT AGTGGGAGCTACCGCTGATGCTTTTGATATCTGG GGCCAAGGGACAATGGTCACCGTCTCTTCA<br><br>SEQ ID NO: 30129 |

FIGURE 50
(Continued)

| | | | | |
|---|---|---|---|---|
| iPS:435293 | 21-225_146F1 | AA | DIKMTQSPSSVSASVGDRVTITCRASQGINNWLVWYQQKPGKAPKLLIYAASSLQSGVPSRFRGSGSGTDFTLTISSLQPEDFATYYCQQANSFPFTFGPGTKVDIK<br>SEQ ID NO: 26124 | QVQLVESGGGVVQPGRSLRLSCEASGITFSSYGMHWVRQAPGKGLEWVAIIWYDGSNKYYADSVKGRFTISRDNSKNTLFLQMNSLRAEDTAVYYCARDRLVGATADAFDIWGQGTMVTVSS<br>SEQ ID NO: 30130 |
| | | NA | GACATCCAGATGACCCAGTCTCCATCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAAGCTCCTGATCTATGCTGCATCCAGTTTGCAAAGTGGGGTCCCATCAAGGTTCAGCGGCGGTGGATCTGGGACAGAATTCACTCTCACAATCAGCAGCCTGCAGCCTGAAGATTTTGCAACTTATTACTGTCTTCAGCATGATACTTACCCGCTCACTTTCGGCGGAGGGACCAAGGTGGAGATCAAA<br>SEQ ID NO: 26125 | CAGCTGCAGCTGCAGGAGTCGGGCCCAGGACTGGTGAAGCCTTGGAGACCCTGTCCTCACCTGCACTGTCTCTGGTGGCTCATCAGCAGAAGTAGTTACTACTGGGGCTGATCCGCCAGCCCCAGGGAAGGGACTGGAGTGGATTGGGAGTATATTATAGTGGGAGTACCTCTACAACCGTCCCTCAAGAGTCGAGTCACCATATCCGTCGACACGTCCAAGAACCAGTTCTCCCTGAAGCTGAGCTCTGTGACCGCCGCAGACACGGCTGTTTATTACTGTGCGAGACTTGATCTCCTGTGAGTTTTGACTACTGGGGCCAGGGAACCCTGGTCACCGTCTCCTCA<br>SEQ ID NO: 30131 |
| | | AA | DIQMTQSPSSLSASVGDRVTITCRASQGIRNDLGWYQQKPGKAPKRLIYAASSLQSGVPSRFSGGGSGTEFTLTISSLQPEDFATYYCLQHSTYPLTFGGGTKVEIK<br>SEQ ID NO: 26126 | QLQLQESGPGLVKPSETLSLTCTVSGGSISRSSYYWGWIRQPPGKGLEWIGSIYYSGSTSYNPSLKSRVTISVDTSKNQFSLKLSSVTAADTAVYYCARLDLLWSFDYWGQGTLVTVSS<br>SEQ ID NO: 30132 |

FIGURE 50
(Continued)

| | | | |
|---|---|---|---|
| iPS:435295 | 21-225_146H1 | NA | GACATCCAGATGACCCAGTCTCCATCCCCT GTCTGCATCTGTAGGAGACAGAGTCACCATCA CTTGCCGGGCAAGTCAGAGCATTAGCGACTAT TTAAATTGGTATCAGCAAAAACCAGGGAAAG CCCCTAAGGTCCTGATCTATACTATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTACCCCCACT TTCGGCGGAGGGACCAAGGTGGAGATCAAA |
| | | | SEQ ID NO: 26127 |
| | | AA | DIQMTQSPSSLSASVGDRVTITCRASQSISDYLN WYQQKPGKAPKVLIYTTSSLQSGVPSRFSGSGSG TDFTLTISSLQPEDFATYYCQQSYSTPTFGGGTK VEIK |
| | | | SEQ ID NO: 26128 |
| | | | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGCTATTAGTGGTCGTGGTGT AACACATTCTACGCAGACTCCGTGAAGGGCCGT TCACCATCTCCAGAGACAATTCCAAGAACACACT ATATCTGCAAATGAACAGCCTGAGAGCCGAGGA CACGGCCGTATATTACTGTGCGAAACGGGTGACG GACTACGGTGTAACGACTGGTTCGACCCTGGG GCCAGGGAACCCTGGTCACCGTCCTCA |
| | | | SEQ ID NO: 30133 |
| | | | EVQLLESGGGLVQPGGSLRLSCAASGFTFSSYAMS WVRQAPGKGLEWVSAISGRGGNTFYADSVKGRFTI SRDNSKNTLYLQMNSLRAEDTAVYYCAKRVTDYG GNDWFDPWGQGTLVTVSS |
| | | | SEQ ID NO: 30134 |
| iPS:435297 | 21-225_146B3 | NA | GATATTGTGATGACCCAGACTCCACTCTCTCT GTCCGTCACCCCTGGACAGCCGGCCTCCATCT CCTGCAAGTCTAGTCAGAGCCTCCTGCATGGT GATGGAAAGACCTATTTGTATTGGTACCTGCA GAAGCCAGGCCAGTCTCCACAGCTCCTGATCT ATGAAGTTTCCAACCGGTTCTCTGGAGTGCCA GATAGGTTCAGTGGCAGCGGGTCAGGGACAG ATTTCACACTGAAAATCAGCCGGGTGGAAGCT GAGGATGTTGGGCTTTATCACTGCATGCAAAG TATACAGCTTCCGTGACGTTCGGCCAAGGGA CCAAGGTGGAAATCAAA |
| | | | SEQ ID NO: 26129 |
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGAAGT TATAAATACTATGCAGAGACAATCCGTGAAGGGCCGAT TCACCATCTCCAGAGACAATTCCAAGAACACGCT GGATCTGCAAATGAACAGCCTGAGAGCCGAGGA CACGGCTGTGTATTACTGTGTGAAAATGGTATA GAAGTGGCTGTGGACTACTACGGTATGACG TCTGGGGCCAAGGGACCACGGTCACCGTCCTC A |
| | | | SEQ ID NO: 30135 |

FIGURE 50
(Continued)

| | | | | |
|---|---|---|---|---|
| | | AA | DIVMTQTPLSLSVTPGQPASISCKSSQSLLHGDG KTYLYWYLQKPGQPPQLLIYEVSNRFSGVPDRFS GSGSGTDFTLKISRVEAEDVGLYHCMQSIQLPW TFGQGTKVEIK<br>SEQ ID NO: 26130 | QVQLVESGGGVVQPGRSLRLSCAASGFTFSSYGMH WVRQAPGKGLEWVAVIWYDGSYKYYADSVKGRF TISRDNSKNTLDLQMNSLRAEDTAVYYCVKMGIEV AVDYYYGMDVWGQGTTVTVSS<br>SEQ ID NO: 30136 |
| iPS-435299 | 21-225_146D4 | NA | GACATCGTGATGACCCAGTCTCCAGACTCCCT GGCTGTGTCTCTGGGCGAGAGGGCCACCATCA ACTGCAAGTCCAGCCAGAGTGTTTTATACAGC TCCAACAATAACAACTACTTAGCTTGGTACCA GCAGAAACCAGGACAGCCTCCTAAGCTGGTCA TTTACTGGGCATCTACCCGGGAATCCGGGGTC CCTGACCGATTCAGTGGCAGCGGGTCTGGGAC AGATTTCACTCTCACCATCAGCAGCCTGTCAGCAA CTGAAGATGTGGCAGTTTATTACTGTCAGCAA TATTATAGTACTCCGTGCAGTTTTGGCCAGGG GACCAAGCTGGAGATCAAA<br>SEQ ID NO: 26131 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGGTGCACCTAACAGTGG TAACACAGGCTATGCACCAGAAGTTCAGGGCAG AGTCACCATGACCAGGAACACCTCCATAAGCAC AGCCTACATGGAGCTGAGCAGCCTGAGATCTGA GGACACGGCCGTGTATTACTGTGCGGGAGCAG TGGCTGGTACTACTTTGACTACTGGGGCCAGGGA ACCCTGGTCACCGTCTCCTCA<br>SEQ ID NO: 30137 |
| | | AA | DIVMTQSPDSLAVSLGERATINCKSSQSVLYSSN NNNYLAWYQQKPGQPPKLVIYWASTRESGVPD RFSGSGSGTDFTLTISSLQAEDVAVYYCQQYYST PCSFGQGTKLEIK<br>SEQ ID NO: 26132 | QVQLVQSGAEVKKPGASVKVSCKASGYTFTNYDIN WVRQATGQGLEWMGWVHPNSGNTGYAQKFQGR VTMTRNTSISTAYMELSSLRSEDTAVYYCAGSSGW YYFDYWGQGTLVTVSS<br>SEQ ID NO: 30138 |

FIGURE 50
(Continued)

| | | | | |
|---|---|---|---|---|
| iPS:435301 | 21-225_146G4 | NA | GAAATTGTATTGACGCAGTCTCCAGGCACCCT GTCTTTATTTCCAGGGGAAAGAGCCACCCTCT CCTGCAGGGCCAGTCAGAATATTATCAGCAGC TATTTAGCCTGGTACCAGCAGAAACCTGGCCA GGCTCCCAGGCTCCTCATCTTTGGTGTATCTAG TCGGGCCACTGGCATCCCAGACAGGTTCAGTG GCAGTGGGTCTGGGACAGATCCACTCACC ATCAGCAGACTGGAGCCTGAAGATTTTGCAGT GTATTACTGTCAACAATATGGTAGGTCACCAT TCAATTTCGGCCCTGGGACCAAAGTGGATATC AAC<br>SEQ ID NO: 26133 | CAGGTGCAGCTGCAGGAGTCGGGCCCAGGACTG GTGAAGCCTTCACAGACCCTGTCCCTCAATTGCA CTGTCTCTGGTGCTCCATCAGCAACAGTGGTTA CTACTGGAGCTGGATCCGCCAGCACCCAGGGAA GGGAGCACCTACTACAACCCGTCCCTCAAGAGTC GAATTACCATATCAGTAGACACGTCTAACAACCA GTTCTCCCTGAAGCTGACCTCTGTGACTGCCGG GACACGGCCGTGTATTACTGTGCGAGAGGAAA TATAACTGGAACCATGCTTTTGATATCTGGGGCC AAGGGACAATGGTCACCGTCTCTTCA<br>SEQ ID NO: 30139 |
| | | AA | EIVLTQSPGTLSLFPGERATLSCRASQNIISSYLA WYQQKPGQAPRLLIFGVSSRATGIPDRFSGSGSG TDFTLTISRLEPEDFAVYYCQQYGRSPFNFGPGT KVDIN<br>SEQ ID NO: 26134 | QVQLQESGPGLVKPSQTLSLNCTVSGGSISNSGYY WSWIRQHPGKGLEWIGYSYYSGSTYYNPSLKSRITI SVDTSNNQFSLKLTSVTAADTAVYYCARGKYNWN HAFDIWGQGTMVTVSS<br>SEQ ID NO: 30140 |
| iPS:435303 | 21-225_146A6 | NA | GACATCCAGATGACCCAGTCTCCAGCTTCCGT GTCTGCATCTGTGGGAGACAGAGTCACCATAA CTTGTGTCGGGCGAGTCAGGGTATTAGCAGCTGG TTAGCCTGGTATCAGCAGAAACCAGGGAAAG CCCCTAAACTCCTGATCTATGCTGCATCCAGTT TGCAAGGTGGGGTCCCATCAAGGTTCAGCGGC AGTGGATCTGGGACAGCTGCCTCTCAT CAGCAGCCTGCAGCCTGAAGATTTTGCAACTT ACTATTGTCAACAGACTGACAGTTTCCCATTC ACTTTCGGCCCTGGGACCAAAGTGGATATCAA A<br>SEQ ID NO: 26135 | GAGGTGCAGCTGTTGGAGTCTGGGGGAGGCTTG GTACAGCCTGGGGGGTCCCTGAGACTCTCCTGTG CAGCCTCTGGATTCACCTTTAACAGCTATGCCAT GAACTGGGTCCGCCAGGCTCCAGGGAAGGGGCT GGAGTGGGTCTCAGCTATTAGTGGTAGTGGTGGT AACACATTCTACGCAGACTCCGTGAAGGGCCGCT TCACCATCTCCAGAGACAATTCCAAGAACACACT GTATCTGCAAATGAACAGCCTGAGAGCCGAGGA CACGGCCGTATATTACTGTGCGAAAAGGATAAT GATTACGTTTGGGGGAGTCCTTACTTTGACTACT GGGGCCAGGGAACCCTGGTCACCGTCTCCTCA<br>SEQ ID NO: 30141 |

FIGURE 50
(Continued)

| | | | | |
|---|---|---|---|---|
| iPS:435305 | 21-225_146C9 | AA | DIQMTQSPASVSASVGDRVTITCRASQGISNWLAWYQQKPGKAPKLLIYAASSLQGGVPSRFSGSGSGTDFTLSISSLQPEDFATYYCQQTDSFPFTFGPGTKVDIK<br>SEQ ID NO: 26136 | EVQLLESGGGLVQPGGSLRLSCAASGFTFNSYAMNWVRQAPGKGLEWVSAISGSGGNTFYADSVKGRFTISRDNSKNTLYLQMNSLRAEDTAVYYCAKKDNDYVWGSPYFDYWGQGTLVTVSS<br>SEQ ID NO: 30142 |
| | | NA | GACATCGTGATGACCCAGTCTCCAGACTCCCTGGCTGTGTCTCTGGGCGAGAGGGCCACCATCAACTGCAAGTCCAGCCAGAGTGTTTTACACAGCTCCAACAATTATAATTACTTAGCTTGGTACCAGCAGAAACCAGGACAGCCTCCTAAGGTGCTCATTTACTGGGCATCTACCCGGGAAATCCGGGTCCCTGACCGATTCAGTGGCAGCGGGTCTGGGACAGATTTCACTCTCACCATCAGCAGCCTGCAGGCTGAAGATGTGGCAGTTTATTATTGTCAGCAATATTATAGTACTCCGTGCAGTTTTGGCCAGGGGACCAAGCTGGAGATCAAA<br>SEQ ID NO: 26137 | CAGGTGCAGCTGGTGCAGTCTGGGGCTGAGGTGAAGAAGCCTGGGCCTCAGTGAAGGTCTCCTGCAAGGCTTCTGGATACACCTTCACCAATTATGATATCAACTGGGTGCGACAGGCCACTGGACAAGGGCTTGAGTGGATGGGATGGATGCACCCTAACAGTGGTAACACAGGCTATGCACAGAAGTTCCAGGGCAGAGTCACCATGACCTGGAACACCTCCATAAGCACAGCCTACATGGCCCTGAGCAGCCTGAGATCTGAGGACACGGCCGTGTATTACTGTGCGTACTACTGGGGCCAGGGAACCCTGGTCACCGTCTCCTCA<br>SEQ ID NO: 30143 |
| | | AA | DIVMTQSPDSLAVSLGERATINCKSSQSVLHSSNNYNYLAWYQQKPGQPPKVLIYWASTRKSGVPDRFSGSGSGTDFTLTISSLQAEDVAVYYCQQYYSTPCSFGQGTKLEIK<br>SEQ ID NO: 26138 | QVQLVQSGAEVKKPGASVKVSCKASGYTFTNYDINWVRQATGQGLEWMGWMHPNSGNTGYAQKFQGRVTMTWNTSISTAYMALSSLRSEDTAVYYCAYSSGWYSFDYWGQGTLVTVSS<br>SEQ ID NO: 30144 |

FIGURE 50
(Continued)

| | | | |
|---|---|---|---|
| iPS-435307 | 21-225_146E9 | NA | GACATCCAGATGACCCAGTCTCCATCCTCCCT GTCTGCATCTGTAGGAGACAGAGTCACCATCA CTTGCCGGGCAAGTCAGAGCATTAGCGACTAT TTAAATTGGTATCAGCTGAAACCAGGGAAAGC CCCTAAGGTCCTGATCTATACTATCATCCAGTTT GCAAAGTGGGGTCCCATCAAGGTTCAGTGGCA GTGGATCTGGGACAGATTTCACTCTCACCATC AGCAGTCTGCAACCTGAAGATTTTGCAACTTA CTTCTGTCAACAGAGTTACAGTACCCCACTTT CGGCGGAGGGACCAAGGTGGAGATCAAA SEQ ID NO: 26139 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTCGTGGTGGT AACACATTCTACGCAGACTCGTGAAGGCCCGGT TCACCATCTCCAGAGACAATTCCAAGAAAACACT ATATCTGCAAATGAACAGCTGAGAGCCGAGGA CACGGCCGTATATTACTGTGCAAACGGTGACG GACTACGGTGGTAACGACTGGTTCGACCCTCGG GCCAGGGAACCCTGGTCACCGTCCTCTCA SEQ ID NO: 30145 |
| | | AA | DIQMTQSPSSLSASVGDRVTITCRASQSISDYLN WYQLKPGKAPKVLIYTSSLQSGVPSRFSGSGSG TDFTLTISSLQPEDFATYFCQQSYSTPTFGGGTKV EIK SEQ ID NO: 26140 | EVQLLESGGGLVQPGGSLRLSCAASGFTFSSYAMS WVRQAPGKGLEWVSAISGRGGNTFYADSVKGRFTI SRDNSKKTLYLQMNSLRAEDTAVYYCAKRVTDYG GNDWFDPWGQGTLVTVSS SEQ ID NO: 30146 |
| iPS-435309 | 21-225_146F9 | NA | GACATCGTGATGACCCAGTCTCCAGACTCCT GGCTGTGTCTCTGGGCGAGAGGGCCACCATCA ACTGCAAGTCCAGCCAGAATATTTACAGCAGC TCCAACAATAACAACTACTTAGCTTGGTACCA GCAGAAACCAGGACAGCCTCCTTACCTGCTCA TTTACTGGGCATCTACCCGGGAATCCGGGGTC CCTGACCGATTCAGTGGCAGCGGGTCTGGGAC AGATTTCACTCTCACCATCACCAGCCTGCAGG CTGAAGATGTGGCAGTTTATTACTGTCAGCAA TATTATACTACTCCCGTGCAGTTTTGGCCAGGG GACCAAGCTGGAGATCACT SEQ ID NO: 26141 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGAGTAGCAGT GGCTGGTACTTTTTGACTACTGGGGCCAGGGAA CCCTGGTCACCGTCCTCTCA SEQ ID NO: 30147 |

FIGURE 50
(Continued)

| | | AA | DIVMTQSPDSLAVSLGERATINCKSSQNILHSSN NNNYLAWYQQKPGQPPYLLIYWASTRESGVPD RFSGSGSGTDFTLTISLQAEDVAVYYCQQYYT PCSFGQGTKLEIT<br>SEQ ID NO: 26142 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCASSSGW YFFDYWGQGTLVTVSS<br>SEQ ID NO: 30148 |
|---|---|---|---|---|
| iPS:435311 | 21-225_146H9 | NA | GACATCCAGATGACCCAGTCTCCATCCTCCCT GTCTGCATCTGTAGGAGACAGAGTCACCATCA CTTGCCGGGCAAGTCAGGGATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATAATAGTTACCCGCTC ACTTTCGGCGGAGGGACCAAGGTGGAGATCA AA<br>SEQ ID NO: 26143 | CAGGTGCAGCTGGTGGAGTCTGGGGGAGGCGTG GTCCAGCCTGGGAGGTCCCTGAGACTCTCCTGTG CAGCGTCTGGATTCAGCTTCAGTAGCTATGGCAT GCACTGGGTCCGCCAGGCTCCAGGCAAGGGGCT GGAGTGGGTGGCAGTGATATGGTTTGATGAAAGT AATAAACACTATGGAGACTCCGTGAAGGGCCGA TTCACCATCTCCAGGGACAATTCCAAGAACACGC TGTATCTGCAAATGAACAGCCTGAGAGCCGAGG ACACGGCTGTGTATTACTGTGCGAGAGAATTGGG ATTTCTCTGACTATTGGGGCCAGGGAACCCTG GTCACCGTCTCCTCA<br>SEQ ID NO: 30149 |
| | | AA | DIQMTQSPSSLSASVGDRVTITCRASQGIRNDLG WYQQKPGKAPKRLIYAASSLQSGVPSRFSGSGS GTEFTLTISSLQPEDFATYCLQHNSYPLFGGG TKVEIK<br>SEQ ID NO: 26144 | QVQLVESGGGVVQPGRSLRLSCAASGFSFSSYGMH WVRQAPGKGLEWVAVIWFDESNKHYGDSVKGRF TISRDNSKNTLYLQMNSLRAEDTAVYYCARELGFL SDYWGQGTLVTVSS<br>SEQ ID NO: 30150 |

FIGURE 50
(Continued)

| | | | |
|---|---|---|---|
| iPS:435313 | 21-225_146G11 | NA | GACATCCAGATGACCCAGTCTCCATCTCCT GTCTGCATCTGTAGGAGACAGAGTCACCATCA CTTGCCGGGCAAGTCAGACAGTCATTAGAAATAAT TTTGGCTATCAGCAGAAACCAGGGAAAGC CCCTAAGCGCCTGATCTATGCTGCATCCAGTTT GCAAAGTGGGGTCCCATTAAGGTTCAGGGCA GTGGATCTGGGACAGAATTCACTCTCACAATC AGCAGCCTGCAGCCTGAAGATTTTGCAACTTA TTACTGTCTCCAACATGATAGTTACCCGCTCAC TTTCGGCGGAGGGACCAAGGTGGAGATCAAA<br><br>SEQ ID NO: 26145 | GAGGTGCAGCTGGTGGAGTCTGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTGGTAGC TACACATACTACGCAGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCGAGAGGTAGCAG CTCGTCCGGGTTTGACTACTGGGGCCAGGGAACC CTGGTCACCGTCTCCTCA<br><br>SEQ ID NO: 30151 |
| | | AA | DIQMTQSPSSLSASVGDRVTITCRASQDIRNNFG WYQQKPGKAPKRLIYAASSLQSGVPLRFSGSGS GTEFTLTISSLQPEDFATYYCLQHDSYPLTFGGG TKVEIK<br><br>SEQ ID NO: 26146 | EVQLVESGGGLVKPGGSLRLSCAASGFTFSSYSMN WVRQAPGKGLEWVSSISGSGSYTYYADSVKGRFTI SRDNAKNSLYLQMNSLRAEDTAVYYCARGSSSSGF DYWGQGTLVTVSS<br><br>SEQ ID NO: 30152 |
| iPS:435315 | 21-225_147B2 | NA | GATATTGTGATGACCCAGACTCCCCTCTCTG TCCGTCACGCCTGGACAGCCGGCTCCCATCTC CTGCAAGTCTAGTCAGAGCCTCCTGCATAGTG ATGGAAAGAACCTATTTGTATTGGTACCTGCAG AAGCCAGGCCAGCCTCCACAGCTCCTGATCTA TGAAGTTTCCCACCGGTCTCTGAGTGCCAG ATAGGTTCAGTGCAGCGGGTCAGGGACAGA TTTCACAGTGAAAATCAGCGGGGTGGAGGCTG AGGATGTTGGGGTTTATTACTGCATGCAAAGT ACACAGTTTCCTCCCACTTTCGGCCCCTGGGAC CAAAGTTGGATATCAAA<br><br>SEQ ID NO: 26147 | CAGGTGCAGCTGGTGGAGTCTGGGGAGGCTG GTCCAGCCTGGGAGGTCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGGAGGTATAG CAGCAGCTGGTCGGGGGTATGGACGTCTGGGG CCAAGGGACCACGGTCACCGTCTCCTCA<br><br>SEQ ID NO: 30153 |

FIGURE 50
(Continued)

| | | | |
|---|---|---|---|
| iPS:435317 | 21-225_147D2 | AA | DIVMTQTPLSLSVTPGQPASISCKSSQSLLHSEGK TYLYWYLQKPGQPPQLLIYEVSHRVSGVPDRFS GSGSGTDFTVKISRVEAEDVGVYYCMQSTQFPP TFGPGTKVDIK<br>SEQ ID NO: 26148 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSSS WSGGMDVWGQGTTVTVSS<br>SEQ ID NO: 30154 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTGGCAGCAGC TACTTAGCCTGGTACCAGCAGAAACCTGGCCA GGCTCCCAGGCTCCTCATCTATGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAGCTTATTCA CTTTCGGCCCTGGGACCAAAGTGGATATCAAA<br>SEQ ID NO: 26149 | CAGGTGCTACTGCAGGAGTCGGGCCCAGGACTG GTGAAGCCTTCACAGACCCTGTCCTCACCTGCG CTGTCTCTGTGCCCATCAGCAGTGGTGATTA CTACTGGAACTGGATCCGCCAGCCCCAGGAA GGGCCTGGAGTGGATTGGGTTCATCTATTACACT GGGAGCACCTACTACAACCGTCCTCAAGAGTC GAGTTTCCATATCGGAAGACACGTCTGAGAACCA GTTCTCCCTGAACCTGAGTTCTGTGACTGCCGC GACACGGCCGTGTATTACTGTGCGAGAGGGGA GCTTACTACCTACTACGGTATGGACGTCTGGG GCCAAGGGACCACGGTCACCGTCTCCTCA<br>SEQ ID NO: 30155 |
| | | AA | EIVLTQSPGTLSLSPGERATLSCRASQSVGSSYLA WYQQKPGQAPRLLIYGASSRATGIPDRPSGSGSG TDFTLTISRLEPEDFAVYYCQQYGSLFTFGPGTK VDIK<br>SEQ ID NO: 26150 | QVLLQESGPGLVKPSQTLSLTCAVSGGPISSGDYYW NWIRQRPGKGLEWIGFIYTGSTYYNPSLKSRVSIS EDTSENQFSLNLSSVTAADTAVYYCARGGAYYSYY GMDVWGQGTTVTVSS<br>SEQ ID NO: 30156 |

FIGURE 50
(Continued)

| | | | |
|---|---|---|---|
| iPS:435319 | 21-225_147E3 | NA | GAAATTGTGTTGACGCAGTCTCCAGGCACCCT GTCTTTGTCTCAGGGGAAAAGAGCCACCCTCT CCTGCAGGGCCAGTCAGAGTGTTATCAGTAGC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAACAATATGGTAGGTCACCA TTCAATTTCGGCCCTGGGACCAAAGTGGATAT CAAA <br/><br/>SEQ ID NO: 26151 | CAGGTGCAGCTGCAGGAGTCGGGCCCAGGACTG GTGAAGCCTTCACAGACCCTGTCCCTCACCTGCA CTGTCTCTGGTGGCTCCATCACCAATAGTGGTTA CTACTATAGCTGGATCCGGCAGCACCCAGGGAA GGGGCTGGAATGATTGGGTACATCTATTACAGT GGGGCCACCTACTACAACCCGTCCCTCAAGAGTC GAATTACCATATCAGTGGACACGTCTAACAACCA GTTCTCCCTGAAGCTGAGCTCTGTGACTGCCGCG GACACGGCCGTGTATTACTGTGCGAGAGGGGA TATAACTGGAACCATGCTTTTGATTTCTGGGCC AAGGGACAATGGTCACCGTCTCTCA <br/><br/>SEQ ID NO: 30157 |
| | | AA | EIVLTQSPGTLSLSPGERATLSCRASQSVISSYLA WYQQKPGQAPRLLIYGASSRATAIPDRFSGSGSG TDFTLTISRLEPEDFAVYYCQQYGRSPFNFGPGT KVDIK <br/><br/>SEQ ID NO: 26152 | QVQLQESGPGLVKPSQTLSLTCTVSGGSITNSGYYY SWIRQHPGKGLEWIGYIYYSGGTYYNPSLKSRITISV DTSNNQFSLKLSSVTAADTAVYYCARGYNWNHA FDFWGQGTMVTVSS <br/><br/>SEQ ID NO: 30158 |
| iPS:435321 | 21-225_147E4 | NA | GACATCGTGATGACCCAGTCTCCAGACTCCT GGCTGTCTGTCTGGCGAGAGGGCCACCATCA ACTGCAAGTCCAGCCAGAGTGTTTTACACAG TCCAACAATTACAACCAAGACAGCCTCTACAGC GCTGAAAACCAAGACAGCCTCTACAGCTGCTCA TTTACTGGGCATCTACCCGGGAATCCGGGGTC CCTGACCGATTCAGTGGCCGCGGGTCGGGGAC AGACTTCACTCTCACCATCAGCAGCCTGCAGG CTGAAGATGTGGCAATTTATTACTGTCAGCAA TATTATAGTACTCCATCCACTTTCGGCCCTGGG ACCAAAGTGGAGATCAAA <br/><br/>SEQ ID NO: 26153 | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGCA GAGTCACCATGACCAGGAACACCTCCATAAGCA CAGCCTACATGGAGCTGAGCAGCCTGAGATCTG AGGACACGGCCGTGTATTACTGTGCGAGTAGCA GTGGCTGTACTTTTTGACTACTGGGGCCAGGG AACCCTGGTCACCGTCTCCTCA <br/><br/>SEQ ID NO: 30159 |

FIGURE 50
(Continued)

| | | | | |
|---|---|---|---|---|
| iPS-435323 | | AA | DIVMTQSPDSLAVSLGERATINCKSSQSVLHSSN NYNYLAWYQLKPRQPPKLLIYWASTRESGVPDR FSGRGSGTDFTLTISSLQAEDVAIYYCQQYYSTPS TFGPGTKVEIK<br>SEQ ID NO: 26154 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCASSSGW YFFDYWGQGTLVTVSS<br>SEQ ID NO: 30160 |
| | 21-225_147D5 | NA | CAGGTGCAGCTGGTGCAGTCTGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGGTGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGG GGACACGCCGTGTATTACTGTGCGGGGAGCAG TGGCTGGTACTACTTTGACTACTGGGGCCAGGGC ACCCTGGTCACCGTCTCCTCA<br>SEQ ID NO: 30161 | |
| | | AA | DIVMTQSPDSLAVSLGERATINCKSSQSVLYSSN NNNYLAWYQQKPGQPPKLLIYWASTRESGVPD RFSGSGSGTDFTLSISSLQAEDVAVYYCHQYYST PCSFGQGTKLEIK<br>SEQ ID NO: 26156 | QVQLVQSGAEVKKPGASVKVSCKASGYTFTNYDIN WVRQATGQGLEWMGWVHPNSGNTGYAQKFQGR VTMTRNTSISTAYMELSSLRSGDTAVYYCAGSSGW YYFDYWGQGTLVTVSS<br>SEQ ID NO: 30162 |

FIGURE 50
(Continued)

| | | | |
|---|---|---|---|
| iPS:435325 | 21-225_147H5 | NA | GACATCGTGATGACCCAGTCTCCATCCCT GTCTGCATCTGTAGGAGACAGAGTCACCATCA CTTGCCGGGCAAGTCGGGCATTAGAGATGAT TTAGGCTGGTATCAGCAGAAACCAGGGAAAG CCCCTAAGCGCCTGATCTATGCTGCATCCAGT TTGCAGAGTGGGGTCCCATCAAGGTTCAGTGG CAGTGGATCTGGGACAGAATTCACTCTCACAA TCAGCAGCCTGCAGCCTGAAGATTTTGCAACT TATTACTGTCTACAGCATTATAGTTATCCTCGG ACGTTCGGCCAAGGGACCAAGGTGGAAATCA AA<br><br>SEQ ID NO: 26157 | CAGGTGCAGCTGGTGGAGTCTGGGGGAGGCGTG GCCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTATGATGGAAGT AATAAGTACTATGCAGACTCCGTGAAGGGCCGA CTCACCATCTCCAGAGACAATTCCAAGAACACGT TGTATCTGCAAATGAACAGCCTGAGCGCCGAGG ACACGGCTGTGTATTACTGTGCGAGAGAGGTA TAGCAGTGGCTGGTACGACTACGGTTTGACGTC TGGGGCCAAGGGACCACGGTCACCGTCTCCTCA<br><br>SEQ ID NO: 30163 |
| | | AA | DIQMTQSPSSLSASVGDRVTITCRASRGIRDDLG WYQQKPGKAPKRLIYAASSLQSGVPSRFSGSGS GTEFTLTISSLQPEDFATYYCLQHYSYPRTFGQG TKVEIK<br><br>SEQ ID NO: 26158 | QVQLVESGGGVAQPGRSLRLSCAASGFTFSDYGM HWVRQAPGKGLEWVAVIWYDGSNKYYADSVKGR LTISRDNSKNTLYLQMNSLSAEDTAVYYCARERYS SGWYDYGLDVWGQGTTVTVSS<br><br>SEQ ID NO: 30164 |
| iPS:435327 | 21-225_147G6 | NA | GACATCGTGATGACCCAGTCTCCATCCCT GGCTGTGTCTCTGGGCGAGAGGGCCACCATCA ACTGCAAGTCCAGCCAGAGTGTTTTATACAGC TCCAACAGTAACAACTACTTAGCTTGGTACCA GCAGAAACCAGGACAGCCTCCTAAGCTGCTCA TTTACTGGGCATCTGCCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATACTACTCCTCCCCACTTTCGGCCCTGGG ACCAAAGTGGATATCAAA<br><br>SEQ ID NO: 26159 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGTTGGATGCACCCCAACAGTGG TAACACAGGCTATGCACAGAAGTTCAGGGCAG AGTCACCATGACCAGGAACACCTCCATAAGCAC AGCTACATGGAGCTGAGCAGCCTGAGATCTGA GGACACGGCCGTGTATTACTGTGCGTATAGCAGT GGCTGGTACTGGTTCGACCCCTGGGGCCAGGGA ACCCTGGTCACCGTCTCCTCA<br><br>SEQ ID NO: 30165 |

FIGURE 50
(Continued)

| | | | | |
|---|---|---|---|---|
| iPS-435329 | 21-225_147A8 | AA | DIVMTQSPDSLAVSLGERATINCKSSQSVLYSSN SNNYLAWYQQKPGQPPKLLIYWASARESGVPD RFSGSGSGTDFTLTISSLQAEDVAVYYCQQYYTT PPTFGPGTKVDIK<br>SEQ ID NO: 26160 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YWFDPWGQGTLVTVSS<br>SEQ ID NO: 30166 |
| | | NA | GATATTGTGATGACCCAGAGTCCACTCTCTCT GTCCGTCACCCCTGGACAGCCGGCCTCCATCT CCTGCAAGACTAGTCAGAGCCTCCTGCATAGT GAAGGAAAGACCTATTTGTATTGGTACCTGCA GAAGCCAGGCCAGCCTCCACAGCTCCTGATCT ATGAAGTTTCCAACCGGTTCTCTGGAGTGCCA GATAGGTTCAGTGGCAGCGGGTCAGGACAG ATTTCACACTGAAAATCAGCGGGTGCATGCAAAG GAGGATGTTGGGGTTTATTACTGCCAAAGGCT TATACAGCTAATCACCTTCGGCCAAGGGACAC GACTGGAGATTAAA<br>SEQ ID NO: 26161 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAAGGTATAG CAGCAGCTGGACGGGGGGTATGGACGTCTGGGG CCAAGGGACCACGGTCACCGTCTCCTCA<br>SEQ ID NO: 30167 |
| | | AA | DIVMTQTPLSLSVTPGQPASISCKTSQSLLHSEGK TYLYWYLQKPGQPPQLLIYEVSNRFSGVPDRFSG SGSGTDFTLKISRVEAEDVGVYYCMQSIQLITFG QGTRLEIK<br>SEQ ID NO: 26162 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSSS WTGGMDVWGQGTTVTVSS<br>SEQ ID NO: 30168 |

FIGURE 50
(Continued)

| | | | | |
|---|---|---|---|---|
| iPS:435331 | 21-225_147G8 | NA | CAAATTGTGTTGACGCAGTCTCCAGGCACCCT GTCTTTGTCTCCAGGGGAAAGAGCCACCCTCT CCTGCAGGGCCAGTCAGAGAATTTTCAGCAAC TACTTAGCCTGGTACCAGCAGAAGCCTGGCCA GGCTCCCAGGATCCTCATCTATGGTGCATCCA GCAGGGCCACTGGCATCCCAGACAGGATCAGT GGCAGTGGGTCTGGGACAGACTTCACTCTCAC CATCACCAGACTGGAGCTGAAGATTTTGCAG TGTATTACTGTCAGCAGTATGATAGCTCACCG TGGACGTTCGGCCAAGGGACCAAGGTGGAAA TCAAC | CAGGTGCAGCTACAGCAGTGGGGCGCAGGACTG TTGAAGCCTTCGGAGACCCTGTCCCTCACCTGCG GTGTCTATGGTGGGTCCTTCAGTGCTTACTACTG GAGCTGGATCCGCCAGCCCCCAGGGAAGGGGCT GGAGTGGATTGGGGAAATCAATCATAGTGGAAG TACCAACTACAAACCGTCCTCAAGAGTCGAGTC ACCATATCAGTAGACACGTCCAAGAACCAGTCT CCCTGAAGCTGAGCTCTGTGACCGCCGCGGACAC GGCTGTGTATTACTGTGCGAGAGACTACGGTGTT TTTGACTACTGGGGCCAGGGAACCCTGGTCACCG TCTCCTCA |
| | | | SEQ ID NO: 26163 | SEQ ID NO: 30169 |
| | | AA | QIVLTQSPGTLSLSPGERATLSCRASQRIFSNYLA WYQQKPGQAPRILIYGASSRATGIPDRISGSGSGT DFTLTITRLEPEDFAVYYCQQYDSSPWTFGQGTK VEIN | QVQLQQWGAGLLKPSETLSLTCGVYGGSFSAYYW SWIRQPPGKGLEWIGEINHSGSTNYKPSLKSRVTISV DTSKNQFSLKLSSVTAADTAVYYCARDYGVFDYW GQGTLVTVSS |
| | | | SEQ ID NO: 26164 | SEQ ID NO: 30170 |
| iPS:435333 | 21-225_147E9 | NA | GACATCCAGATGACCCAGTCTCCATCCTCACT GTCTGCATCTGTAGGAGACAGAGTCACCATCA CTTGTCGGGCGAGTCAGGACATTAACAATTAT TTAGCCTGGTTTCAGCAGAAACCAGGGAAAGC CCCTAAGTCCCTGATCGTTGCTGCATCCAGTTT GCAAAGTGGGGTCCCATCAAAGTTCACTCTCAC AGCAGCCTGCAGCCTGAAGATTTTGCAACTTA TTACTGCCAACAGTATAATAGTTACCCTCTCA CTTTCGGCGGAGGGACCAAGGTGGAGATCAA A | GAGGTGCAGCTGGTGGAGTCTGGGGGAGGCTTG GTACAGCCTGGGGGGTCCTGAGACTCTCCTGTG CAGCCTCTGGATTCACCTTCAGTAGCTATAGCAT GAACTGGGTCCGCCAGGCTCCAGGGAAGGGGCT GGAGTGGGTTTCATCCATTAGTAGTAGCAGCAGA ACTATACTATGCAGACTCTGTGAAGGGCCGAT TCACCATCTCCAGAGACAATGCCAAGAACTCACT GTATCTGCAAATGAACAGCCTGAGAGACGAGGA CACGGCTGTTTATTACTGTTCGAGAGATCGGGGC AGTTGCTGGGGCCAGGGAACCCTGGTCACCGTCT CCTCA |
| | | | SEQ ID NO: 26165 | SEQ ID NO: 30171 |

FIGURE 50
(Continued)

| | | | | |
|---|---|---|---|---|
| | | AA | DIQMTQSPSSLSASVGDRVTITCRASQDINNYLAWFQQKPGKAPKSLIVAASSLQSGVPSKFSGSGSGTDFTLTISSLQPEDFATYYCQQYNSYPLTFGGGTKVEIK<br>SEQ ID NO: 26166 | EVQLVESGGGLVQPGGSLRLSCAASGFTFSSYSMNWVRQAPGKGLEWVSSISGRNTTIYYADSVKGRFTISRDNAKNSLYLQMNSLRDEDTAVYYCSRDRGSCWGQGTLVTVSS<br>SEQ ID NO: 30172 |
| iPS:435335 | 21-225_147D10 | NA | GACATCCAGATGACCCAGTCTCCAGCTCCCGTGTCTGCATCTGTAGGAGACAGAGTCACCATAACTTGTCGGGCGAGTCAGATCAGTAGCAACTGGTTAACCTGGTATCAGCAGAAACCAGGGAAAGCCCCTAAGCTCCTGATCTATGCTGCATCCAGTTTGCAAAGTGGGGTCCCATCAAGGTTCAGCGGCAGTGGATCTGGGACAGATTTCACTCTCCATCAGCAGCCTGCAGCTGAAGATTTTGCAACTTACTATTGTCAACAGACTGACAGTTTCCCATTCACTTTCGGCCCTGGGACCAAAGTGGATGTCAAA<br>SEQ ID NO: 26167 | GAGGTGCAGCTGTTGGAGTCTGGGGGAGGCTTGGTACAGCCTGGGGGGTCCCTGAGACTCTCCTGTGCAGCCTCTGGATTCACCTTCAGCAGCTATAGCCATGAGCTGGGTCCGCCAGGCTCCAGGGAAGGGGCTGGAGTGGGTCTCAGCTATTAGTGGTCGTGGTGGTAACACATTCTACGCAGACTCCGTGAAGGGCCGCTTCACCATCTCCAGAGACAATGAACAGCCTGAGAGCCGAGGACCGGCCGTATATTACTGTGCGAAAAAGGATTATGATTACGTTTGGGGAGTCCTTACTTTGACTACTGGGGCCAGGGAACCCTGGTCACCGTCTCCTCA<br>SEQ ID NO: 30173 |
| | | AA | DIQMTQSPASVSASVGDRVTITCRASQNISNWLTWYQQKPGKAPKLLIYAASSLQSGVPSRFSGSGSGTDFTLSISSLQPEDFATYYCQQTDSFPFTFGPGTKVDVK<br>SEQ ID NO: 26168 | EVQLLESGGGLVQPGGSLRLSCAASGFTFSSYAMSWVRQAPGKGLEWVSAISGRGGNTFYADSVKGRFTISRDNSKNTLYLQMNSLRAEDTAVYYCAKKDYDYVWGSPYFDYWGQGTLVTVSS<br>SEQ ID NO: 30174 |

FIGURE 50
(Continued)

| | | | |
|---|---|---|---|
| iPS:435339 | 21-225_147D12 | NA | GACATCCAGATGACCCAGTCTCCAGTTCCGT GTCTGCATCTGTAGGAGACAGAGTCACCATAA CTTGTCGGGCGAGTCAGGGTATTAGCAACTGG TTAGCCTGGTATCAGGAGAAACCAGGAAAAG CCCCTAAACTCCTGATCTATGCTGCATCCAGTT TGCAAAGTGGGGTCCCATCAAGGTTCAGCGGC AGTGGATCCGGGACAGATTTCACTCTCCAT CAGCAGCCTGCAGCCTGAAGATTTTGCAACTT ACTATTGTCAACAGACTGACAGTTTCCCATTC ACTTTCGGCCCTGGGACCAAAGTGGATGTCAA A <br> SEQ ID NO: 26169 | GAGGTGCAGCTGTTGGAGTCTGGGGAGGCTTG GTACAGTCTGGGGGGTCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGCTATTAGTGGTCGTGGTGGT AACACATTCTACGCAGACTCCGTGAAGGGCCGCT TCACCATCTCCAGAGACAATTCCAAGAACACGCT CTATCTGCAAATGAACAGCCTGAGAGCCGAGGA CACGGCCGTATATTACTGTGCGAAAAGGATTAT GATTACGTTTGGGGGAGTCCTTACTTTGACTACT GGGGCCAGGGAACCCTGGTCACCGTCTCCTCA <br> SEQ ID NO: 30175 |
| | | AA | DIQMTQSPASVSASVGDRVTITCRASQGISNWLA WYQEKPGKAPKLLIYAASSLQSGVPSRFSGSGSG TDFTLSISSLQPEDFATYYCQQTDSFPFTFGPGTK VDVK <br> SEQ ID NO: 26170 | EVQLLESGGGLVQSGGSLRLSCAASGFTFSSYAMS WVRQAPGKGLEWVSAISGRGGNTFYADSVKGRFTI SRDNSKNTLYLQMNSLRAEDTAVYYCAKKDYDYV WGSPYFDYWGQGTLVTVSS <br> SEQ ID NO: 30176 |
| iPS:435341 | 21-225_148B2 | NA | GCTATTGTGATGACCCAGACTCCACTCTCTCTG TCCGTCACCCCTGGACAGCCGGCCTCCATCTC CTGCAAGTCTAGTCAGAGCCTCCTGCATGGTG ATGGAAAGACCTATTTTTATTGGTACCTGCAG AAGCCAGGCCAGCCTCCACAGCTCCTGATCTA TGAAGTTTCCACCGGTTCTCTGAGTGCCAG ATAGGTTCAGTGGCAGCGGGTCAGGACAGA TTTCACACTGAAAATCAGCCGGGTGGAGGCTG AGGATGTTGGGGTTTATTACTGCATGCAAAGT ATACAGATTCCGTGGACGTTCGGCCAAGGGAC CAAGGTGGAAATCAAA <br> SEQ ID NO: 26171 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAATTATCTGTATGATGAAGT TATAAATACTATGCAGACTCCGTGAAGGGCCGAT TCACCATCTCCAGAGACAATGAACAGCCTGAGTGCCGAGGA GTATCTGCAAATGAACAGCCTGAGAGCCGAGGA CACGGCTGTGTATTACTGTGCGAGAGATCATTC GATTTTGGAGTGGTCACTTTGACTACTGGGGCC AGGGAACCCTGGTCACCGTCTCCTCA <br> SEQ ID NO: 30177 |

FIGURE 50
(Continued)

| | | | |
|---|---|---|---|
| iPS:435343 | 21-225_148E2 | AA | AIVMTQTPLSLSVTPGQPASISCKSSQSLLHGDG KTYFYWYLQKPGQPPQLLIYEVSHRFSGVPDRFS GSGSGTDFTLKISRVEAEDVGVYYCMQSIQIPWT FGQGTKVEIK<br>SEQ ID NO: 26172 | QVQLVESGGGVVQPGRSLRLSCAASGFTFSSYGMH WVRQAPGKGLEWVAIIWYDGSYKYYADSVKGRFT ISRDNSKNTLYLQMNSLSAEDTAVYYCARDHFDF WSGHFDYWGQGTLVTVSS<br>SEQ ID NO: 30178 |
| | | NA | GACATCCAGATGACCCAGTCTCCAGCTTCCGT GTCTGCATCTGTAGGAGACAGAGTCACCATAA CTTGTCGGGCGAGTCAGGGTATTAGCAACTGG TTAGCCTGGTATCAGCAGAAACCAGGAAAG CCCCTAAGCTCCTGATCTATGCTGCATCCAGTT TGCAAAGTGGGGTCCCATCAAGGTTCAGCGGC AATGAATCTGGGACAGATTTCACTCTCTCCAT CAGCAGCCTGCAGCCTGAAGATTTTGCAACTT ACTATTGTCAACAGACTGACAGTTTCCCATTC ACTTTCGGCCCTGGACCAAAGTGGATGTCAA A<br>SEQ ID NO: 26173 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGCTATTAGTGGTCGTGGTGGT AACACATTCTACGCAGACTCCGTGAAGGGCCGCT TCACCATCTCCAGAGACAATTCCAAGAACACGCT CTATCTGCAAATGAACAGCCTGAGAGCCGAGGA CACGGCCGTATATTACTGTGCGAAAAAGGATTAT GATTACGTTTGGGGGAGTCCTTACTTTGACTACT GGGGCCAGGGAACCCTGGTCACCGTCTCCTCA<br>SEQ ID NO: 30179 |
| | | AA | DIQMTQSPASVSASVGDRVTITCRASQGISNWLA WYQQKPGKAPKLLIYAASSLQSGVPSRFSGNES GTDFTLSISSLQPEDFATYYCQQTDSFPFTFGPGT KVDVK<br>SEQ ID NO: 26174 | EVQLLESGGGLVQPGGSLRLSCAASGFTFSSYAMS WVRQAPGKGLEWVSAISGRGGNTFYADSVKGRFTI SRDNSKNTLYLQMNSLRAEDTAVYYCAKKDYDYV WGSPYFDYWGQGTLVTVSS<br>SEQ ID NO: 30180 |

FIGURE 50
(Continued)

| | | | |
|---|---|---|---|
| iPS:435345 | 21-225_148G3 | NA | GACATCGTGATGACCCAGTCTCCAGACTCCT GGCTGTGTCTCTGGGCGAGAGGGCCACCATCC ACTGCAAGTCCAGCCAACGTGTTTTACACAGC TCCAACAATTATAACTACTTAGCTTGGTACCA GCAGAAACCAGGACAGCCTCCTAAGCTGCTCA TTTACTGGGCATCTACCGGGATTCCGGGGTC CCTGACCGATTCAGTGGCAGCGGGTCTGGGC CGATTCACTCTCACCATCAGCAGCCTGCAGG CTGAAGATGGCACTTTATTACTGTCAGCAA TATTATAGTACTCCATTCACTTTCGGCCCTGGG ACCAAAGTGGATATCAAA |  | CAGGTGCAGCTGGTGCAGTCTGGGGCTGAGGTG AAGAAGCCTGGGGCCTCAGTGAAGGTCCTGC AAGGCTTCTGGATACACCTTCACCAATTATGATA TCAACTGGGTGCGACAGGCCTCTGGACAAGGGC TTGAGTGGATGGGATGGATGCACCCTAACAGTGG TAACACAGGCTATGCACAGAACACCTCCAGGCAG AGTCACCATGACCAGGGACGAGCAGCCTGAGATCTGA AGCCTACATGGAGCTGAGCAGCCTGAGATCTGA GGACACGCCCGTGTATTACTGTGCGAGTAGCAGT GGCTGGTACTTTTGACTACTGGGGCCAGGGAA CCCTGGTCACCGTCTCCTCA |
| | | | SEQ ID NO: 26175 | | SEQ ID NO: 30181 |
| | | AA | DIVMTQSPDSLAVSLGERATIHCKSSQRVLHSSN NYNYLAWYQQKPGQPPKLLIYWASTRDSGVPD RFSGSGSGADFTLTISSLQAEDVALYYCQQYYST PFTFGPGTKVDIK |  | QVQLVQSGAEVKKPGASVKVSCKASGYTFTNYDIN WVRQASGQGLEWMGWMHPNSGNTGYAQNFQGR VTMTRNTSISTAYMELSSLRSEDTAVYYCASSSGW YFFDYWGQGTLVTVSS |
| | | | SEQ ID NO: 26176 | | SEQ ID NO: 30182 |
| iPS:435347 | 21-225_148C4 | NA | GACATCCAGATGACCCAGTCTCCATCCTCCCT GTCTGCATCTGTAGGAGACAGAGTCACCATCA CTTGCCGGGCAAGTCAGAGCATTATCAACTAT TTAAATTGGTATCAGCAGAAACCAGGGAAAG CCCCTAAGGTCCTGATCTATCTGCATCCAGTT TACAGAGTGGGGTCCCATCAAGGTTCAGTGGC AGTGGATCGGGACAGATTTCACTCTCACCAT CAGCAGTCTGCAACTGGAAGATTTTACAACTT ACTACTGTCAACAGAGTTACAGTACCCCACT TTCGGCGGAGGGACCAAGGTGGAGATCGAA |  | GAGGTGCAGCTCTTGGAGTCTGGGGGAGGCTGG TACAGCCTGGGGGGTCCCTGAGACTCTCCTGTGC AGCCTCTGGATTCACCTTTAGCAGCTATGCCATG AGCTGGGTCCGCCAGGCTCCAGGGAAGGGGCTG GAGTGGGTCTCAGCTATTAGTAGTGGTAGTGGTA ACACATTCTACGCAGACTCCGTGAAGGGCCGGTT CACCATCTCCAGAGACAATTCCAAGAACACGCTG TATCTGCAAATGAACAGCCTGAGAGCCGAGGAC ACGGCCGTATATTACTGTGCGAAACGGGTGACG GACTACGGTGTAACGACTGGTTCGACCCTGGG GCCAGGGAACCCTGGTCACCGTCTCCTCA |
| | | | SEQ ID NO: 26177 | | SEQ ID NO: 30183 |

FIGURE 50
(Continued)

| | | | |
|---|---|---|---|
| iPS:435349 | 21-225_148F5 | AA | DIQMTQSPSSLSASVGDRVTITCRASQSIINYLNWYQQKPGKAPKVLIYTASSLQSGVPSRFSGSGSGTDFTLTISSLQPEDFTYYCQQSYSTPTFGGGTKVEIE<br>SEQ ID NO: 26178 | EVQLLESGGGLVQPGGSLRLSCAASGFTFSSYAMNWVRQAPGKGLEWVSAISGSGGNTFYADSVKGRFTISRDNSKNTLYLQMNSLRAEDTAVYYCAKRVTDYGGNDWFDPWGQGTLVTVSS<br>SEQ ID NO: 30184 |
| | | NA | GATATTGTGATGACCCAGACTCCACTCTCTCTGTCCGTCACCCCTGGACAGCCGGCCTCCATCTCCTGTAAGTCTAGTCAGAGCCTCCTGCATAGTGAAGGAAAGAACCTATTTGTATTGGTACCTGCAGAAGCCAGGCCAGCCTCCACAGCTCCTGATCTATGAAGTTTCCTACCGGGTCTCTGGAGTGCCAGATAGATTCAGTGGCAGCGGGTCAGGGACAGATTTCACACTGAAAATCAGCCGGGTGGAGGCAGAGGATGTTGGGGTCTATTTCTGCATGCAAAGTATACAGCTTCCGCTCACTTTCGGCGGAGGGACCAAGGTGGAGATCAAA<br>SEQ ID NO: 26179 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGCATGCACTGGGTCCGCCAGGCTCCAGGCAAGGGCTGAGTGGGTGGCAGTTATATGGTATGATGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGGAGTATAGCAGCAGCTGGTCGGGGGGTATGGACGTCTGGGGCCAAGGGACCACGGTCACCGTCTCCTCA<br>SEQ ID NO: 30185 |
| | | AA | DIVMTQTPLSLSVTPGQPASISCKSSQSLLHSEGKTYLYWYLQKPGQPPQLLIYEVSYRVSGVPDRFSGSGSGTDFTLKISRVEAEDVGVYFCMQSIQLPLTFGGGTKVEIK<br>SEQ ID NO: 26180 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARRYSSSWSGGMDVWGQGTTVTVSS<br>SEQ ID NO: 30186 |

FIGURE 50
(Continued)

| | | | |
|---|---|---|---|
| iPS:435351 | 21-225_148B6 | NA | GACATCGTGATGACCCAGTCTCCATCCTCACT GTCTGCATCTGTAGGAGACAGAGTCAGCATCA CTTGTCGGGCGAGTCAGGGCATTAGCAAATAT TTAGCCTGGTTTCAGCAGAAACCAGGGAAAGC CCCTAAGTCCCTGATCTTTGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATAATAGTTTCCCATTCAC TTTCGGCCCTGGGACCAAAGTGGATATCAAA<br><br>SEQ ID NO: 26181 | CAGGTGCAGCTGGTGCAGTCTGGGGCTGAGGTG AAGAAGCCTGGGGCCTCAGTGAAGGTCTCCTGC AAGGCTTCTGGATACACCTTCACGGCTACTATA TGCACTGGGTGCGACAGGCCCCTGGACAAGGTCT TGAGTGGATGGGTTGGATCACCCTAACAATGGT GGCACAAACTATGCACAGGGACACGTCCATCAGG GTCACCATGACCAGGGACACGTCCATCAGCACA GTCTACATGGAGCTGAGCAGGCTGAGATCGAC GACACGGCCGTGTATTACTGTGCGAGAGATCCTG TAGTAGTACCAGCTGCCCCCTTTGACTACTGGGG CCAGGGAACCCTGGTCACCGTCTCCTCA<br><br>SEQ ID NO: 30187 |
| | | AA | DIQMTQSPSSLSASVGDRVSITCRASQGISKYLA WFQQKPGKAPKSLIFAASSLQSGVPSKFSGSGSG TDFTLTISSLQPEDFATYYCQQYNSFPFTFGPGTK VDIK<br><br>SEQ ID NO: 26182 | QVQLVQSGAEVKKPGASVKVSCKASGYTFTGYYM HWVRQAPGQGLEWMGWIHPNNGGTNYAQTFQGR VTMTRDTSISTVYMELSRLRSDDTAVYYCARDPVV VPAAPFDYWGQGTLVTVSS<br><br>SEQ ID NO: 30188 |
| iPS:435353 | 21-225_148F8 | NA | GACATCGTGATGACCCAGTCTCTAGACTCCCT GGCTGTGTCTCTGGGCGAGAGGGCCACCATCA ACTGCAAGTCCAGCCAGAGTGTTCTTTACACAGC TCCAACAATTACAACTGGTTGGTACCA GCAGAAACCAGGACAGCCTCCTAAACTGCTCA TTTACTGGGCATCTACCCGGAAATCGGGGTC CCTGACCGATTCAGTGGCAGCGGGTCTGGGAC AGATTTCACTCTCACCATCAGCAGCCTGCAGG CTGAAGATGTGGCAGTTTATTACTGTGTCAGCAA TATTATAGTATTCCTCGACGTTCGGCCAAGG GACCAAGGTGGAAATCAAA<br><br>SEQ ID NO: 26183 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGCCAGGCCACTGGACAAGGC TTGAGTGGATGGGATGGATGAACCCTAACAGTG GTAACACAGGCTATGCACAGAACACCTCCAGGCA GAGTCACCATGACCAGGAACACCTCCATAAGCA CAGCCTACATGGAGCTGAGCAGCCTGAGATCTG AGGACACGGCCGTGTATTACTTTGACTACTGGG CCAGGGTGGCTGGTACTTTTGACTACTGGGGCCAGGG AACCCTGGTCACCGTCTCCTCA<br><br>SEQ ID NO: 30189 |

FIGURE 50
(Continued)

| | | | |
|---|---|---|---|
| iPS:435355 | 21-225_148H9 | AA | DIVMTQSLDSLAVSLGERATINCKSSQSALHSSN NYNYLAWYQQKPGQPPKLLIYWASTRKSGVPD RFSGSGSGTDFTLTISSLQAEDVAVYYCQQYYSI PPTFGQGTKVEIK<br>SEQ ID NO: 26184 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCASSSGW YYFDYWGQGTLVTVSS<br>SEQ ID NO: 30190 |
| | | NA | GACATCCAGATGACCCAGTCTCCATCCTCCCT GTCTGCATCTGTAGGAGACAGAGTCACCATCA CTTGCCGGGCAAGTCAGAGCATTAGTAACTAT TTAAATTGGTATCAGCAGAAACCAGGGAAAG CCCCTAAGGTCCTGATCTATATTGCATCCAGTT TGCAAAGTGGGGTCCCATCTAGGTTCAGTGGC AGTGGATCTGGGACAGATTTCACTCTCACCAT CAGCAGTCTGCAACCTGAAGATTTTGCAACTT ACTACTGTCAACAGAGTTACAGTACCCCCACT TTCGGCGGAGGGACCAAGGTGGAGATCAAA<br>SEQ ID NO: 26185 | GAGGTGCAGCTGTTGGAGTCTGGGGGAGGCTTG GTACAGCCCGGGGGGTCCCTGAGACTCTCCTGTG CAGCCTCTGGATTCACCTTTAGCAGCTATGCCAT GAGCCTGGGTCCGCCAGGCTCCAGGGAAGGGCT GGAGTGGGTCTCAGCTATTAGTGGTCGTGGTGGT AACACATTCTACGCAGACTCCGTGAAGGGCCGGT TCACCATCTCCAGAGACAATTCAAGAACACACT ATATTTGCAAATGAACAGCTGAGAGCCGAGGA CAGGCCGTATATTACTGTGCGAAACGGGTGACG GACTACGGTGGTAACGACTGGTTCGACCCCTGGG GCCAGGGAACCCTGGTCACCGTCTCCTCA<br>SEQ ID NO: 30191 |
| | | AA | DIQMTQSPSSLSASVGDRVTITCRASQSISNYLN WYQQKPGKAPKVLIYIASSLQSGVPSRFSGSGSG TDFTLTISSLQPEDFATYYCQQSYSTPTFGGGTK VEIK<br>SEQ ID NO: 26186 | EVQLLESGGGLVQPGGSLRLSCAASGFTFSSYAMS WVRQAPGKGLEWVSAISGRGGNTFYADSVKGRFTI SRDNSKNTLYLQMNSLRAEDTAVYYCAKRVTDYG GNDWFDPWGQGTLVTVSS<br>SEQ ID NO: 30192 |

FIGURE 50
(Continued)

| | | | |
|---|---|---|---|
| iPS-435357 | 21-225_148G10 | NA | GATATTGTGATGACCCAGACTCCACTCTCT<br>GTCCGTCACCCCTGGACAGCCGGCCTCCATCT<br>CCTGCAAGTCTAGTCAGAGCCTCCTGCATGGT<br>GATGGAAAGACCTATTTGTATTGGTACCTGCA<br>GAGGCCAGGCCAGCTCCACAGCTCCTGATCT<br>ATGAAGTTTCCAACCGGTTCTCTGGAGTGCCA<br>GATAGGTTCAGTGGCAGCGGGTCAGGGACAG<br>ATTTCACACTGAAAATCAGCCGGGTGGAGGCT<br>GAGGATGTTGGGGTTTATTACTGCATGCAAAG<br>TATACAGCTTCCGTGGACGTTCGGCCAAGGGA<br>CCAAGGTGGAAATCAAA<br>SEQ ID NO: 26187 | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAGCTATGGCAT<br>GCACTGGGTCCGCCAGGCTCCAGGCAAGGGGCT<br>GGAGTGGGTGGCAATTATATGGTATGATGAAGT<br>AATAAATACTATGCAGACTCCGTGAAGGGCCGA<br>TTCACCATCTCCAGAGACAATTCCAAGAACACGC<br>TGTATCTGCAAATGAACAGCCTGAGAGCCGAAG<br>ACACGGCTGTGTATTACTGTGCGAGAGATCGTTA<br>CGATTTTTGGAGTGGTCACTTGACTACTGGGGC<br>CAGGGAACCCTGGTCACCGTCTCCTCA<br>SEQ ID NO: 30193 |
| | | AA | DIVMTQTPLSLSVTPGQPASISCKSSQSLLHGDG<br>KTYLYWYLQRPGQPPQLLIYEVSNRFSGVPDRFS<br>GSGSGTDFTLKISRVEAEDVGVYYCMQSIQLPW<br>TFGQGTKVEIK<br>SEQ ID NO: 26188 | QVQLVESGGGVVQPGRSLRLSCAASGFTFSSYGMH<br>WVRQAPGKGLEWVAIIWYDGSNKYYADSVKGRFT<br>ISRDNSKNTLYLQMNSLRAEDTAVYYCARDRYDF<br>WSGHFDYWGQGTLVTVSS<br>SEQ ID NO: 30194 |
| iPS-435359 | 21-225_148H10 | NA | GATATTGTGATGACCCAGACTCCACTCTCT<br>GTCCGTCACTCCTGGACAGCCGGCCTCCATCT<br>CCTGCAAGTCTAGTCAGAGCCTCCTGCATAGT<br>GAGGGAAAGACCTATTTGTATTGGTACCTGCA<br>GAAGCCAGGCCAGCCTCCACAGCTCCTGATCT<br>ATGAAGTTTCCTACCGGGTCTCTGGAGTGCCA<br>GATAGGTTCAGTGGCAGCGGGTCAGGGACAG<br>ATTTCACACTGAAAATCAGCCGGGTGGAGGCA<br>GAGGATGTTGGGGTCTATTACTGCATGCAAG<br>TATACAGCTTCCGCTCACTTTCGGCGGAGGGA<br>CCAAGGTGGAGATCAAA<br>SEQ ID NO: 26189 | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAGCTATGGCAT<br>GCACTGGGTCCGCCAGGCTCCAGGCAAGGGGCT<br>GGAGTGGGTGGCAGTTATATGGTATGATGAAGT<br>AATAAATACTATGGAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGCTGTGTATTATTGTGCGAGGAGTATAG<br>CAGCAGCTGGTCGGGGGTATGGACGTCTGGGG<br>CCAAGGGACCACGGTCACCGTCTCCTCA<br>SEQ ID NO: 30195 |

FIGURE 50
(Continued)

| | | | | |
|---|---|---|---|---|
| | | AA | DIVMTQTPLSLSVTPGQPASISCKSSQSLLHSEGK TYLYWYLQKPGQPPQLLIYEVSYRVSGVPDRFS GSGSGTDFTLKISRVEAEDVGVYYCMQSIQLPLT FGGGTKVEIK SEQ ID NO: 26190 | QVQLVESGGGVVQPGRSLRLSCAASGFTFSSYGMH WVRQAPGKGLEWVAVIWYDGSNKYYGDSVKGRF TISRDNSKNTLYLQMNSLRAEDTAVYYCARRYSSS WSGGMDVWGQGTTVTVSS SEQ ID NO: 30196 |
| iPS:435361 | 21-225_148E11 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTCTGCTGCATCCAGTT TGCAAAGTGGGGTCCATCAAGGTTCACGGC AGTGGATCTGGGACAGATTTCACTTTCACAAT CAGCAGCGTGCAGCTGAGGATGTTTGCAACTT ATTACTGTCTACAGCATCGTAATTACCCGCTC ACTTTCGGCGGAGGGACCAAGGTGGAGATCA AA SEQ ID NO: 26191 | CAGCTGCAGCTGCAGGAGTCGGGCCCAGGACTG GTGAAGCCTTCGGAGACCCTGTCCCTCACCTGCA CTGTCTCTGGTGTCTCCATCAGCAGAAGTAGTTA CTACTGGGGCTGGATCCGCCAGCCCCCAGGGAA GGGGCTGGAGTGGATTGGGAGTATCTATTATAGT GGGAGCACCTCTACAACCGTCTCCTCAAGAGTC GAGTCACCATATCCGAAGCTGAGCTCTGTGACCGCGC AGTTCTCCCTGAAGCTGTGTTTACTGTGCGAGACTTGAT AGACACCGGCTGTGGAGTTTGACTACTGGGGCCAGGAA CCCCAGTGGAGTTTGACTACTGGGGCCAGGAA TCCTGGTCACCGTCTCCTCA SEQ ID NO: 30197 |
| | | AA | DIQMTQSPSSLSASVGDRVTITCRASQGIRNDLG WYQQKPGKAPKRLISAASSLQSGVPSRFTGSGSG TEFTFTISSVQPEDFATYYCLQHRNYPLTFGGGT KVEIK SEQ ID NO: 26192 | QLQLQESGPGLVKPSETLSLTCTVSGVSISRSSYYW GWIRQPPGKGLEWIGSIYYSGSTSYNPSLKSRVTISV DTSKNQFSLKLSSVTAADTAVFYCARLDPQWSFDY WGQGILVTVSS SEQ ID NO: 30198 |

FIGURE 50
(Continued)

| | | | |
|---|---|---|---|
| iPS:435363 | 21-225_148F12 | NA | GACATCCAGATGACCCAGTCTCCTTCCTCCCT GTCTGCATCTGTAGGAGACAGAGTCACCATCA CTTGCCGGGCAAGTCAGGGCATTAGAAATGCC TTAGGCTGGTATCAGCAGAAACCAGGGAAAG CCCCTAAGCGCCTGATCTATGCTGCATCCAGT TTGCAAAGTGGGGTCCATCAAGGTTCAGCGG CAGTGGATCTGGGACAGATTCACTCTCACAA TCAGCAGCCTGCAGCCTGAAGATTTTGCAACT TATTTCTGTCTACAGCATAATAGTTACCCTCTC ATTTTCGGCGGAGGGACCAAGGTGGAGATCA AA | CAGGTGCAGCTGCAGGAGTCGGGCCAGGACTG GTGAAGCCTTCGGAGACCCTGTCCCTCACCTGCA CTGTCTCTGGTGGCTCCATCAGCAGTGGTTA CTACTGGAACTGGATCCGCCAGCACCCAGGGAA GGGCCTGGAGTGGATTGGGTACATCTATTACAGT GGGAGCACCTACTACAACCGTCCCTCAAGAGTC AAATTACCATATCAGTGGACACGTCTAAGGACCA GTTCTCCCTGAGCTGAGCTCTGTGACTGCCGCG GACACGGCCGTGTATTACTGTGCGAGGTACAGTA CCTACGACTACTACGGTATGGACGTCGGGG CCAAGGGACCACGGTCACCGTCTCCTCA |
| | | | SEQ ID NO: 30199 |
| | | AA | DIQMTQSPSSLSASVGDRVTITCRASQGIRNALG WYQQKPGKAPKRLIYAASSLQSGVPSRFSGSGS GTEFTLTISSLQPEDFATYFCLQHNSYPLIFGGGT KVEIK | QVQLQESGPGLVKPSQTLSLTCTVSGGSISNGGYY WNWIRQHPGKGLEWIGYIYYSGSTYYNPSLKSQITI SVDTSKDQFSLRLSSVTAADTAVYYCARYSTYDYY YGMDVWGQGTTVTSS |
| | | | SEQ ID NO: 26194 | SEQ ID NO: 30200 |
| iPS:435365 | 21-225_149F1 | NA | GATATTGTGATGACCCAGTCTCCACTCTCTCTG TTCGTCACTCTGGACAGCCGGCTCCATCTCC TACAAGTCTAGTCAGAGCCTCCTGCATGGTGA TGGAAAGACCTATTTTTATTGGTACCTGCAGA AGCCAGGCCAGCCTCCACAGCTCTGATTTAT GAAGTTTCCAACCGGTTCTCTGGAGTGCCAGA TAGGTTCAGTGGCAGCGGGTCAGGGACAGATT TCACACTGAAAATCAGCGGGTGGAGGCTGA GGATGTTGGGGTTTATTACTGCATGCAAAGTA CACAGATTCCGTGGACGTTCGGCCAAGGGACC AAGGTGGAAATCAAA | CAGGTGCAGCTGGTGGAGTCTGGGGGAGGCGTG GTCCAGCCTGGGAGGTCCCTGAGACTCTCTGTG CAGCGTCTGGATTCACCTTCAGTAGCTATGGCAT GCACTGGGTCCGCCAGGCTCCAGGCAAGGGCT GGAGTGGGTGGCAATTATCTGGTATGATGGAAGT TATAAATACTATGCAGACTCCGTGAAGGGCCGAT TCACCATCTCCAGAGACAACGCTGAAGAACACGCT GTATCTGCAAATGAACAGCCTGAGTGCCGAGGA CACGGCTGTGTATTACTGTGCGAGAGATCATTTC GATTTTTGGAGTGGTCACTTTGACTACTGGGCC AGGGAACCCTGGTCACCGTCTCCTCA |
| | | | SEQ ID NO: 26195 | SEQ ID NO: 30201 |

FIGURE 50
(Continued)

| | | | | |
|---|---|---|---|---|
| | | AA | DIVMTQSPLSLFVTPGQPASISYKSSQSLLHGDG KTYFYWYLQKPGQPPQLLIYEVSHRFSGVPDRFS GSGSGTDFTLKISRVEAEDVGVYYCMQSIQIPWT FGQGTKVEIK<br>SEQ ID NO: 26196 | QVQLVESGGGVVQPGRSLRLSCAASGFTFSSYGMH WVRQAPGKGLEWVAIIWYDGSYKYYADSVKGRFT ISRDNSKNTLYLQMNSLSAEDTAVYYCARDHFDF WSGHFDYWGQGTLVTVSS<br>SEQ ID NO: 30202 |
| iPS:435367 | 21-225_149G1 | NA | GACATCCAGATGACCCAGTCTCCATCCTCCCT GTCTGCATCTGTAGGAGCCAGAGTCACCATCA CTTGCCGGGCAAGTCAGGGCATTAGAAATGAT TTAGGCTGGTATCAGCAGAAACCAGGAAAG CCCCTAAGGCGCCTGATCTATGCTGCATCCAAT TTGCAAAGTGGGGTCCCATCAAGGTTCAGTGG CAGTGGATCTGGGACAGAATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA<br>SEQ ID NO: 26197 | CAGGTGCAGTTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGCT GGAGTGGGTGGCAGTTATATGGTATGGAAGGAAG TAATAAATACTATGCAGACTCCGTGAAGGGCCG ATTCACCATCTCCAGAGACAATTCCAAGAACATG TTGTATCTGCAAATGAACAGCCTGAGAGCCGAG GACACGGCTGTGTATTACTGTGCGAGAGAAATAG GATTCAGTGAGGACTACTGGGGCCAGGGAACCC TGGTCACCGTCTCCTCA<br>SEQ ID NO: 30203 |
| | | AA | DIQMTQSPSSLSASVGARVTITCRASQGIRNDLG WYQQKPGKAPKRLIYAASNLQSGVPSRFSGSGS GTEFTLTISSLQPEDFATYYCLQHNSYPLTFGGG TKVEIK<br>SEQ ID NO: 26198 | QVQLVESGGGVVQPGRSLRLSCAASGFTFSDYGM HWVRQAPGKGLEWVAVIWYEGSNKYYADSVKGR FTISRDNSKNMLYLQMNSLRAEDTAVYYCAREIGF SEDYWGQGTLVTVSS<br>SEQ ID NO: 30204 |

FIGURE 50
(Continued)

| | | | |
|---|---|---|---|
| iPS:435369 | 21-225_149A2 | NA | GACATCGTGATGACCCAGTCTCCAGACTCCT GGCTGTGTCTCTGGGCGAGAGGGCCACCATCA ACTGCAAGTCCAGCCAGAGTGTTTTATACAGT CCCAACAATAACAACTACTTAGCTTGGTACCA GCAGAAACCAGGACAGCCCCTAAGCTGCTCA TTTACTGGGCATCTACCCGGGAATCCGGGGTC CCTGACCGATTCAGTGGCAGCGGGTCTGGGAC AGATTCACTCTCACCATCAGCAGCCTGCAGG CTGAAGATGTGGCAGTTTATTACTGTCAGCAA TATTTATAGTACTCCGTGCAGTTTTGGCCAGG GACCAAGGTGGAGATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGGTGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGGGGAGCAG TGGCTGGTACTACTTTGACTACTGGGGCCAGGGA ACCCTGGTCACCGTCTCCTCA |
| | | | SEQ ID NO: 26199 |
| | | AA | DIVMTQSPDSLAVSLGERATINCKSSQSVLYSPN NNNYLAWYQQKPGQPPKLLIYWASTRESGVPD RFSGSGSGTDFTLTISSLQAEDVAVYYCQQYYST PCSFGQGTKVEIK | QVQLVQSGAEVKKPGASVKVSCKASGYTFTNYDIN WVRQATGQGLEWMGWVHPNSGNTGYAQKFQGR VTMTRNTSISTAYMELSSLRSEDTAVYYCAGSSGW YYFDYWGQGTLVTVSS |
| | | | SEQ ID NO: 26200 | SEQ ID NO: 30205 |
| iPS:435371 | 21-225_149A3 | NA | GACATCCAGATGACCCAGTCTCCATCCTCCCT GTCTGCATCTGTAGGAGACAGAGTCACCATCA CTTGCCGGGCAAGTCAGAGCATTAGCAGTTAT TTAAATTGGTATCAGCAGAAACCAGGGAAAG CCCCTAAGGTCTCATGATCTATGCTGCATCCAGT TTGCAAAGTGGGGTCCCATCAAGGTTCAGTGG CAGTGGATCTGGGACAGATTTCACTCTCACCA TCAACAGTCTGCAACTGAAGATTTTGCAACT TACTACTGTCAACAGAGTTACAGTATCCCCAC TTTCGGCGGAGGGACCAAGGTGGAGATCAAA | GAGGTGCAGCTGTTGGAGTCTGGGGGAGGCTTG GTACAGCCTGGGGGGTCCCTGAGACTCTCCTGTG CAGCCTCTGGATTCACCTTTAGCAACTATGCCAT GACCTGGGTCCGCCAGGCTCCAGGGAAGGGGCT GGAGTGGGTCTCAGCTATTAGTAGTGGTCGTGGT AACACATTCTACGAGACTCCGTGAAGGGCCGGT TCACCATCTCCAGAGACAATTCCAAGAACACGCT GTATCTGCAAATGAACAGCCTGAGAGCCGAGA CAGGCCGTATATTACTGTACGAAACGGGTGACG GACTACGGTGGTAACGACTGGTTCGACCCCTGGG GCCAGGGAACCCTGGTCACCGTCTCCTCA |
| | | | SEQ ID NO: 26201 | SEQ ID NO: 30207 |

FIGURE 50
(Continued)

| | | | |
|---|---|---|---|
| | | AA | DIQMTQSPSSLSASVGDRVTITCRASQSISSYLNW YQQKPGKAPKVMIYTASSLQSGVPSRFSGSGSGT DFTLTINSLQPEDFATYYCQQSYSIPTFGGGTKVE IK<br>SEQ ID NO: 26202 | EVQLLESGGGLVQPGGSLRLSCAASGFTFSNYAMT WVRQAPGKGLEWVSAISGRGGNTFYADSVKGRFTI SRDNSKNTLYLQMNSLRAEDTAVYYCTKRVTDYG GNDWFDPWGQGTLVTVSS<br>SEQ ID NO: 30208 |
| iPS:435373 | 21-225_149E3 | NA | GACATCGTGATGACCCAGTCTCCAGACTCCCT GGCTGTGTCTCTGGGCGAGAGGGCCACCATCA GCTGCAAGTCCAGCCAGACTGTTTACACAAC TCCAATAATCACAATTACTTTGCTTGGTACCA GCAGAAACCAGAACAGCCTCCTAAGCTGCTCA TTTACTGGGCATCTACCCTGACCGGGGTC CCTGACCGATTCAGTGGCAGCGGGTCTGGGAC AGATTTCACTCTCACCATCAGCAGCCTGCAGG CTGAAGATGTGCAGTTTATTACTGTCAGCAA TATTATAGTACTCCTCGACGTTCGGCCAAGG GACCAAGGTGGAAATCAAA<br>SEQ ID NO: 26203 | CAGGTGCAGTCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCCTAACAGTGG TAACACAGGCTATGCACAGAAGTTCCAGGCAG AGTCACCATGACCAGGAACACCTCCATAAGCAC AGCCTACATGGAGCTGAGCAGCCTGACATCTGA GGACACGGCCGTGTATTACTGTGCATATAGCAGT GGCTGGTACTGGTTTGACTACTGGGGCCAGGAA CCCTGGTCACCGTCTCCTCA<br>SEQ ID NO: 30209 |
| | | AA | DIVMTQSPDSLAVSLGERATISCKSSQTVLHNSN NHNYFAWYQQKPGQPPKLLIYWASTLRSGVPD RFSGSGSGTDFTLTISSLQAEDVAVYYCQQYYST PPTFGQGTKVEIK<br>SEQ ID NO: 26204 | QVQLVQSGAEVKKPGASVKVSCKASGYTFTNYDIN WVRQATGQGLEWMGWMHPNSGNTGYAQKFQGR VTMTRNTSISTAYMELSSLTSEDTAVYYCAYSSGW YWFDYWGQGTLVTVSS<br>SEQ ID NO: 30210 |

FIGURE 50
(Continued)

| | | | |
|---|---|---|---|
| iPS-435375 | 21-225_149H4 | NA | GACATCGTGATGACCCAGTCTCCAGACTCCCTGGCTGTATCTCTGGGCGAGAGGGCCACCATCAACTGCAAGTCCAGCCAGAGTGTTTTATCCAGCTCCAACGATAACAACTAGCTTGGTACCAACAGAAACCAGGACAGCCTCCTAAGCTGCTCAATTTACTGGTCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAATATTATAGTTATCCCGACGTTCGGCCAAGGGACCAAGGTGGAAATCAAA<br><br>SEQ ID NO: 26205<br><br>DIVMTQSPDSLAVSLGERATINCKSSQSVLSSSNDNNYLAWYQQKPGQPPKLLIYWSSTRESGVPDRFSGSGSGTDFTLTISSLQAEDVAVYYCQQYYSYPPTFGQGTKVEIK<br><br>SEQ ID NO: 26206 | CAGGTGCAGCTGGTGCAGTCTGGGGCTGAGGTGAAGAAGCCTGGGGCCTCAGTGAAGGTCCTGCAAGGCTTCTGGATACACCTTCACCAATTATGATATCAACTGGGTGCGACAGGCCACTGGACAAGGCTTGAGTGGATGGGATGGATGCACCCTAACAGTGGTAACACAGACTATGCACAGAAGTTCCAGGCAGAGTCACCATGACCAGGAACACCTCCATAACCACAGTTTACATGGAGCTGAGCAGCCTGAGATCTGAGGACACGGCCGTGTATTATTGTGCACGTTAGCAGTGGCTGTACTACTTGACTACTGGGGCCAGGGAACCCTGGTCACCGTCTCCTCA<br><br>SEQ ID NO: 30211<br><br>QVQLVQSGAEVKKPGASVKVSCKASGYTFTNYDINWVRQATGQGLEWMGWMHPNSGNTDYAQKFQGRVTMTRNTSITTVYMELSSLRSEDTAVYYCTFSSGWYYFDYWGQGTLVTVSS<br><br>SEQ ID NO: 30212 |
| iPS-435377 | 21-225_149G5 | NA | GACATCCAGATGACCCAGTCTCCTTCCTCCCTGTCTGCATCTGTAGGAGACAGAGTCACCATCACTTGCCGGGCAAGTCAGGGCATTAGCAGCATGCCTTAGGCTGGTTTCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATAATAGTTACCCTCTCACTTTCGGCGGAGGGACCAAGGTGGAGATCAAA<br><br>SEQ ID NO: 26207 | CAGGTGCAGCTGCAGGAGTCGGGCCCAGGACTGGTGAAGCCTTCACAGACCCTGTCCCTCACCTGCACTGTCTCTGGTGGCTCCATCAGCAATGGTGGTTACTACTGGAACTGGATCCGCCAGCACCCAGGGAAGGGCCTGGAGTGGATTGGGTACATCTATTACAGTGGGAGCACCTACTACAACCCGTCCCTCAAGAGTCGAGTTACCATATCAGTAGACACGTCTAAGGACCAGTTCTCCCTGAGGCTGAGCTCTGTGACTGCCGCGGACACGGCCGTGTATTACTGTGCGAGGTACAGTACCTAGACTACTACGGTATGGACGTCTGGGGCCAAGGGACCACGGTCACCGTCTCCTCA<br><br>SEQ ID NO: 30213 |

FIGURE 50
(Continued)

| | | | | |
|---|---|---|---|---|
| iPS:435379 | 21-225_149B6 | AA | DIQMTQSPSSLSASVGDRVTITCRASQGIRNALG WFQQKPGKAPKRLIYAASSLQSGVPSRFSGSGSG TEFTLTISSLQPEDFATYYCLQHNSYPLTFGGGT KVEIK<br>SEQ ID NO: 26208 | QVQLQESGPGLVKPSQTLSLTCTVSGGSISNGYY WNWIRQHPGKGLEWIGYIYYSGSTYYNPSLKSRVT ISVDTSKDQFSLRLSSVTAADTAVYYCARYSTYDY YYGMDVWGQGTTVTVSS<br>SEQ ID NO: 30214 |
| | | NA | GACATCCAGATGACCCAGTCTCCATCTTCCGT GTCGGCATCTGTAGGAGACAGAGTCACCATCA CTTGTCGGGCGAGTCAGGGTATTAGCAGGAAAAG TTAGCCTGGTATCAGCAGAAACCAGGAAAAG CCCCTAAGCTCCTGATCTATGCTGCATCCAGTT TGCAAAGTGGGGTCCCATCAAGGTTCAGCGGC AGTGGATCTGGGACAGATTTCACTCTCACCAT CAGCAGCCTGCAACAGGGTAACAGTTTCCCATTC ACTATTGTCAACAGGGTAACAGTTTCCCATTC ACTTTCGGCCCTGGGACCAAAGTGGATATCAA A<br>SEQ ID NO: 26209 | GAGGTGCAGCTGTTGGAGTCTGGGGGAGGCTTG GTACAGCCTGGGGGGTCCCTGAGACTCTCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTGGTAGTGGTGGT AGCACATTCTACGCAGACTCCGTGAAGGGCCGGT TCACCATCTCCAGAGACAATTCCAAGAACACGCT GTTTCTGCAAATGAACAGCCTGAGAGCCGAGGA CACGGCCGTATATTACTGTGCGAAACGAACTCCG GAAGATGTTTTGATATCTGGGGCCAAGGGACAA TGGTCACCGTCTCTTCA<br>SEQ ID NO: 30215 |
| | | AA | DIQMTQSPSSVSASVGDRVTITCRASQGIISWLA WYQQKPGKAPKLLIYAASSLQSGVPSRFSGSGS GTDFTLTISSLQPEDFATYYCQQGNSFPFTFGPGT KVDIK<br>SEQ ID NO: 26210 | EVQLLESGGGLVQPGGSLRLSCAASGFTFSSYAMS WVRQAPGKGLEWVSVISGSGGSTFYADSVKGRFTI SRDNSKNTLFLQMNSLRAEDTAVYYCAKRTPEDVF DIWGQGTMVTVSS<br>SEQ ID NO: 30216 |

FIGURE 50
(Continued)

| | | | |
|---|---|---|---|
| iPS:435381 | 21-225_149C6 | NA | GACATCCAGATGACCCAGTCTCCAGCTTCCGT GTCTGCATCTGTAGGAGACAGAGTCACCATAA CTTGTCGGGCGAGTCAGGGTATTAGCAACTGG TTAGCCTGGTATCAGCAGAAACCAGGGAGAG CCCCTAAGCTCCTGATCTATCTGCATCCAGTT TGCAAGGTGGGGTCCCATCAAGGTTCAGCGGC AGTGGATCTGGGACAGATTACACTCTCTCAT CAGCAGCCTGCAGCCTGAAGATTTTGCAACTT ACTATTGTCAACAGACTGACAGTTTCCCCATTC ACTTTCGGCCCTGGGACCAAAGTGGATATCAA A | GAGGTGCAGCTGTTGGAGTCTGGGGGAGGCTTA GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTAGTGGTGGT AACACATTCTACGCAGACTCCGTGAAGGGCCGCT TCACCATCTCCAGAGACAATTCCAAGAACACGCT GTATCTGCACATGAACAGCCTGAGAGCCGAGGA CACGGCCGTTTATTACTGTGCGAAAAAGGATTAT GATTACGTTTGGGGGAGTCCTTACTTTGACTACT GGGGCCAGGGAACCCTGGTCACCGTCTCATCA |
| | | | SEQ ID NO: 26211 | SEQ ID NO: 30217 |
| | | AA | DIQMTQSPASVSASVGDRVTITCRASQGISNWLA WYQQKPGRAPKLLIYLQGVPSRFSGSGS GTDYTLSISSLQPEDFATYYCQQTDSFPFTFGPGT KVDIK | EVQLLESGGGLVQPGGSLRLSCAASGFTFSSYAMS WVRQAPGKGLEWVSAISGSGGNTFYADSVKGRFTI SRDNSKNTLYLHMNSLRAEDTAVYYCAKKDYDYV WGSPYFDYWGQGTLVTVSS |
| | | | SEQ ID NO: 26212 | SEQ ID NO: 30218 |
| iPS:435383 | 21-225_149D7 | NA | GAAATTGTGTTGACGCAGTCTCCAGGCACCCT GTCTTTGTTTCCAGGGGAAAGAGTCACCCTCT CCTGCAGGGCCAGTCAGAGTATTATCAGCAAC TACTTAGCCTGGTACCAGCAGAAACCTGGCCA GGCTCCCAGGCTCCTCATCTTTGGTGTATCTAG TAGGGCCACTGGCATCCCAGACAGGTTCAGTG GCAGTGGGTCTGGGACAGACTTCACTCTCACC ATCAGCAGACTGGAGCCTGAAGATTTTGCAGT GTATTACTGTCAACAATATGGTCGGTCACCAT TCAATTTCGGCCCTGGGACCAAAGTGGATATC AAA | CAGGTGCAGCTGCAGGAGTCGGGCCCAGGACTG GTGAAGCCTTCACAGACCCTGTCCCTCAATTGCA CTGTCTCTGGTGGCTCCATCAGCAGCAGTGGTTA CTACTGGAGCTGGATCCGCCAGCACCCAGGGAA GGGCCTGGAATGGATTGGGTACAGCTATTACAGT GGGAGCACCTACTACAACCCGTCCCTCAAGAGTC GAATTACCATATCAGTAGACACGTCTAACAACCA GTTCTCCCTGAAGCTGAGCTCTGTGACTGCCGCG GACACGGCCGTGTATTACTGTGCGAGAGGGGA TATAACTGAACCATGCTTTGATATCTGGGGCC AAGGGACAATGGTCATCGTCTCTTCA |
| | | | SEQ ID NO: 26213 | SEQ ID NO: 30219 |

FIGURE 50
(Continued)

| | | | | |
|---|---|---|---|---|
| | | AA | EIVLTQSPGTLSLFPGERVTLSCRASQSIISNYLA WYQQKPGQAPRLLIFGVSSRATGIPDRFSGSGSG TDFTLTISRLEPEDFAVYYCQQYGRSPFNFGPGT KVDIK<br>SEQ ID NO: 26214 | QVQLQESGPGLVKPSQTLSLNCTVSGGSISNSGYY WSWIRQHPGKGLEWIGYSYYSGSTYYNPSLKSRITI SVDTSNNQFSLKLSSVTAADTAVYYCARGGYNWN HAFDIWGQGTMVTVSS<br>SEQ ID NO: 30220 |
| iPS:435391 | 21-225_149F8 | NA | GACATCCAGATGACCCAGTCTCCAGTCTCCGT GTCTGCATCTGTAGGAGACAGAGTCACCATAA CTTGTCGGGCGAGTCAGGTATTAGCAACTGG TTAGCCTGGTATCAGCAGAAACCAGGGAAAG CCCCTAAGCTCCTGATCTATGCTGCATCCAGTT TGCAAAGTGGGGTCCCATCAAGGTTCAGCGGC AATGAATCTGGGACAGATTTCACTCTCCAT CAGCAGCCTGCAGCCTGAAGATTTGCAATTT ACTATTGTCAACAGACTGACAGTTTCCCATTC ACTTTCGGCCCTGGGACCAAAGTGGATGTCAA A<br>SEQ ID NO: 26215 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTCGTGGTGGT AACACATTCTACGCAGACTCCGTGAAGGGCCGCT TCACCATCTCCAGAGACAACAGCCAAGAACACGCT CTATCTGCAAATGAACAGCTGAGAGCCGAGGA CACGGCCGTATATTACTGTGCGAAAAGGATTAT GATTACGTTTGGGGAGTCCTTACTTTGACTACT GGGGCCAGGGAACCCTGGTCACCGTCTCCTCA<br>SEQ ID NO: 30221 |
| | | AA | DIQMTQSPASVSASVGDRVTITCRASQGISNWLA WYQQKPGKAPKLLIYAASSLQSGVPSRFSGNES GTDFTLSISSLQPEDFAIYYCQQTDSFPFTFGPGT KVDVK<br>SEQ ID NO: 26216 | EVQLLESGGGLVQPGGSLRLSCAASGFTFSSYAMS WVRQAPGKGLEWVSAISGRGGNTFYADSVKGRFTI SRDNSKNTLYLQMNSLRAEDTAVYYCAKKDYDYV WGSPYFDYWGQGTLVTVSS<br>SEQ ID NO: 30222 |

FIGURE 50
(Continued)

| | | | |
|---|---|---|---|
| iPS:435393 | 21-225_149D10 | NA | CAGGTGCAGCTGGTGGAGTCTGGGGGAGGCGTG<br>GCCCAGCCTGGGAGGTCCCTGAGACTCTCCTGTG<br>CAGCGTCTGGATTCACCTTCAGTGACTATGGCAT<br>GCACTGGGTCCGCCAGGCTCCAGGCAAGGGGCT<br>GGAGTGGGTGGCAGTTATATGGTATGATGGAAGT<br>AATAAGTACTATGCAGACTCCGTGAAGGGCCGA<br>CTCACCATCTCCAGAGACAATTCAAGAACACGC<br>TGTATCTGCAAATGAACAGCCTGAGAGCCGAGG<br>ACACGGCTGTGTATTACTGTGCGAGAGAGAGTA<br>TAGCAGTGGCTGGTACGACTACGGTATGGACGTC<br>TGGGGCCAAGGGACCACGGTCACCGTCTCCTCA |
| | | | SEQ ID NO: 30223 |
| | | AA | DIQMTQSPSSLSASVGDRVTITCRASRGIRNDLG<br>WYQQKPGKAPKRLIYAASSLQSGVPSRFSGSGS<br>GTEFTLTISSLQPEDFATYCLQHYSYPRTFGQG<br>TKVEIK |
| | | | QVQLVESGGGVAQPGRSLRLSCAASGFTFSDYGM<br>HWVRQAPGKGLEWVAVIWYDGSNKYYADSVKGR<br>LTISRDNSKNTLYLQMNSLRAEDTAVYYCARERYS<br>SGWYDYGMDVWGQGTTVTVSS |
| | | | SEQ ID NO: 30224 |
| | | | SEQ ID NO: 26218 |
| iPS:435395 | 21-225_149D11 | NA | GACATCCAGATGACCCAGTCTCCAGCTTCCGT<br>GTCTGCATCTGTAGGAGACAGAGTCACCATAA<br>CTTGTCGGGCGAGTCAGATATTAGCAACTGG<br>TTAACCTGGTATCAGCAGAAACCAGGGAAAG<br>CCCCTAAGCTCCTGATCTATGCTGCATCCAGT<br>TGCAAAGTGGGGTCCATCAAGGTTCAGCGGC<br>AGTGGATCTGGGACAGATTTCACTCTCTCCAT<br>CAGCAGCCTGCAGCTGAAGATTTTGCAACTT<br>ACTATTGTCAACAGACTGACAGTTTCCCATTC<br>ACTTTCGGCCCTGGGACCAAAGTGGATGTCAA<br>A | GAGGTGCAGCTGTTGGAGTCTGGGGGAGGCTTG<br>GTACAGCCTGGGGGGTCCTGAGACTCTCTGTG<br>CAGCCTCTGGATTCACCTTTAGCAGTCAGCTATGCCAT<br>GAGCTGGGTCCGCCAGGCTCCAGGGAAGGGGCT<br>GGAGTGGGTCTCAGCTATTAGTGGTCGTGGTGGT<br>AACACATTCTACGCAGACTCCGTGAAGGGCCGCT<br>TCACCATCTCCAGAGACAATGAACAGCCTGAGAGCCGAGGA<br>CACGGCCGTATATTACTGTGCGAAAAGGATTAT<br>GATTACGTTTGGGGGAGTCCTTACTTTGACTACT<br>GGGGCCAGGGAACCCTGGTCACCGTCTCCTCA |
| | | | SEQ ID NO: 30225 |
| | | | SEQ ID NO: 26219 |

FIGURE 50
(Continued)

| | | | |
|---|---|---|---|
| iPS:435397 | 21-225_149F12 | AA | DIQMTQSPASVSASVGDRVTITCRASQNISNWLT WYQQKPGKAPKLLIYAASSLQSGVPSRFSGSGS GTDFTLSISSLQPEDFATYYCQQTDSFPFTFGPGT KVDVK<br>SEQ ID NO: 26220 | EVQLLESGGGLVQPGGSLRLSCAASGFTFSSYAMS WVRQAPGKGLEWVSAISGRGGNTFYADSVKGRFTI SRDNSKNTLYRQMNSLRAEDTAVYYCAKKDYDY VWGSPYFDYWGQGTLVTVSS<br>SEQ ID NO: 30226 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAAT TTGCAAAGTGGGGTCCCATCAAGGTTCAGCGG CAGTGGATCTGGGACAGAGAATTCACTCTCACAA TCAGCAGCCTGCAGCCTGAAGATTTTGCAATT TATTACTGTCTACAGCATAATAGTTACCCGCTC ACTTTCGGCGGAGGGACCAAGGTGGAGATCA AA<br>SEQ ID NO: 26221 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGCAGACTCCGTGAAGGGCCG ATTCACCATCTCCAGAGACAATTCCAAGAACACG CTGTTTCTGCAAATGAACAGCCTGAGAGCCGAGG ACACGGCTGTGTATTACTGTGCGAGAGAAATAGG GTTCAGTGAGGACTACTGGGGCCAGGGAACCCT GGTCACCGTCTCCTCA<br>SEQ ID NO: 30227 |
| | | AA | DIQMTQSPSSLSASVGDRVTITCRASQGIRNDLG WYQQKPGKAPKRLIYAASNLQSGVPSRFSGSGS GTEFTLTISSLQPEDFAIYYCLQHNSYPLTFGGGT KVEIK<br>SEQ ID NO: 26222 | QVQLVESGGGVVQPGRSLRLSCAASGFTFSDYGM HWVRQAPGKGLEWVAVIWYEENNKYYADSVKGR FTISRDNSKNTLFLQMNSLRAEDTAVYYCAREIGFS EDYWGQGTLVTVSS<br>SEQ ID NO: 30228 |

FIGURE 50
(Continued)

| | | | |
|---|---|---|---|
| iPS:435399 | 21-225_150D2 | NA | GACATCGTGATGACCCAGTCTCCAGACTCCCT GGCTGTGTCTCTGGGCGAGAGGGCCACCATCA AGTGCAAGTCCAGCCAGAGTGTTTTATACAGA TCCAACAGTAAGAAATACTTAACTTGGTACCA GCAGAAACCAGGACAGCCTCCTAAGCTGTTCA TTTATTGGGCATCTACCCGGAAATCCGGGGTC CCTGACCGATTCAGTGGCAGCGGGTCTGGGAC AGATTTCACTCTCACCATCAGCAACCTGCAGG CTGAAGATGTGGCAGTTTATTTCTGTCAGCAA TATTTTAGTACTCCGTACAATTTTGGCCAGGG GACCAAGAGGGAGATCAAA SEQ ID NO: 26223 | CAGGTGCAGCTGGTGCAATCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGCAG AGTCACCATGACCAGGAACACTCCATAAGCAC AGCCTACATGGAGCTGAGCAGCCTGAGATCTGA GGACACGGCCGTGTATTACTTGTCTTATAGCAGT GGCTGGTACTACTTTGACTACTGGGGCCAGGGAA CCCTGGTCACCGTCCTCA SEQ ID NO: 30229 |
| | | AA | DIVMTQSPDSLAVSLGERATIKCKSSQSVLYRSN SKKYLTWYQQKPGQPPKLFIYWASTRKSGVPDR FSGSGSGTDFTLTISNLQAEDVAVYFCQQYFSTP YNFGQGTKREIK SEQ ID NO: 26224 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YYFDYWGQGTLVTVSS SEQ ID NO: 30230 |
| iPS:435401 | 21-225_150E2 | NA | GACATCCAGATGACCCAGTCTCCATCCTCCCT GTCTGCATCTGTGGGAGACAGAGTCACCATCT CTTGCCGGGCAAGTCAGGGCATTGGAAATGAT TTAGGCTGGTATCAGCAGAAACCAGGGAAAG CCCCTACGCGCCTGATCTATGCTGCATCCAGTT TGCAAAGTGGGGTCCCATCAAGGTTCAGCGGC AGTGGATCTGGGACAGAATTCACTCTCACTAT CAGCAGCCTGCAGCCTGCAGATTTTGCAACTT ATTACTGTCTACAACATTATAGTTTCCCGTACA GTTTTGGCCAGGGGACCAAGCTGGAGATCAAA SEQ ID NO: 26225 | CAGGTGCAGCTGGTGCAGTCTGGGGAGGCGTG GTCCAGCCTGGGAGGTCCCTGAGACTCTCCTGTG CAGGGTCTCGGATTCACCTTCAGTAGCTATGTCAT GCACTGGGTCCGCCAGGCTCCAGGCAAGGGCT GGAGTGGGTGGCAGTTATATGCAGACTCCGTGAAGGT AATAAATACTATCCAGAGACAATTCCAAGAACACGC TTCACCATCCAGAGATGAAATGAACAGCCTGAGAGCCGAGG TGTATCTGCAAATGAACAGCCTGAGAGCCGAGG ACACGGCTGTGTATTACTGTGCGAGAGAGGAGTA TAGCAGCAGCTGGTACGGTACGGTATGGACGT CTGGGGCCAAGGGACCACGGTCACCGTCTCCTCA SEQ ID NO: 30231 |

FIGURE 50
(Continued)

| | | | | |
|---|---|---|---|---|
| iPS:435403 | 21-225_150C5 | AA | DIQMTQSPSSLSASVGDRVTISCRASQGIGNDLG WYQQKPGKAPTRLIYAASSLQSGVPSRFSGSGSG TEFTLTISSLQPADFATYYCLQHYSFPYSFGQGT KLEIK<br>SEQ ID NO: 26226 | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCAREEYSS SWYGYGMDVWGQGTTVTVSS<br>SEQ ID NO: 30232 |
| | | NA | GACATCCAGATGACCCAGTCTCCAGTTCCGT GTCTGCATCTGTAGGAGACAGAGTCACCATAA CTTGTCGGGCGAGTCAGGTATTAACAACTGG TTAGCCTGGTATCAGCAGAAACCAGGGAAAG CCCCTAAGCTCCTGATCTATGCTGCATCCAGTT TGCAAGGTGGGGTCCCATCAAGGTTCAGCGGC AGTGGATCTGGGACAGATTTCACTCTCCAT CAGCAGCCTGCAACAGACTGACAGTTTGCAAC ACTATTGTCAACAGCATTACTGTGCGAAAAGGATTAT ACTTTCGGCCCTGGGACCAAAGTGGATATCAA A<br>SEQ ID NO: 26227 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGCTATTAGTGGTAGTGGTGGT AACACATTCTACGCAGACTCCGTGAAGGGCCGCT TCACCATCTCCAGAGACAATTCCAAGAACACGCT GTATCTGCAAATGAACAGCCTGAGAGCCGAGGA CACGGCCGTATATTACTGTGCGAAAAAGGATTAT GATTACGTTTGGGGGAGTCCTTACTTTGACTACT GGGGCCAGGGAACCCTGGTCACCGTCTCCTCA<br>SEQ ID NO: 30233 |
| | | AA | DIQMTQSPGSVSASVGDRVTITCRASQGINNWL AWYQQKPGKAPKLLIYAASSLQGVPSRFSGSG SGTDFTLSISSLQPEDFATYYCQQTDSPFTFGPG TKVDIK<br>SEQ ID NO: 26228 | EVQLLESGGGLVQPGGSLRLSCAASGFTFSSYAMS WVRQAPGKGLEWVSAISGSGGNTFYADSVKGRFTI SRDNSKNTLYLQMNSLRAEDTAVYYCAKKDYDYV WGSPYFDYWGQGTLVTVSS<br>SEQ ID NO: 30234 |

FIGURE 50
(Continued)

| | | | |
|---|---|---|---|
| iPS:435405 | 21-225_150B7 | NA | GACATCGTGATGACCCAGTCTCCAGACTCCCT GGCTGTGTCTCTGGGCGAGAGGGCCACCATCA ACTGCAAGTCCAGCAGTGTTTTATACAGC TCCCACAATAACAACTACTTAGCTTGGTACCA GCAGAAACCAGGGCAGCCTCCTAAACTACTCA TTTACTGGGCATCTACCCGGAAATCCGGGGTC CCTGACCGATTCAGTGGCAGCGGGTCTGGGAC AGATTTCACTCTCACCATCACCAGCCTGCAGG CTGAAGATGTGGCAGTTTATTACTGTCAGCAA TATTATAGTACTCCATTCACTTTCGGCCCTGGG ACCAAAGTGGATATCAAA<br><br>SEQ ID NO: 26229 | CAGGTGCAGCTGGTGCAGTCTGGGGCTGAGGTA AAGAAGCCTGGGGCCTCAGTGACGGTCCTGCA AGGCTTCTGGATTCCCCTTCACCAATTATGATAT CAACTGGGTGCGACAGGCCACTGGACAAGGCT TGAGTGGATGGGATGGATGCACAGAAGTTCCAGGCAGA AACACAGGCTATGCACAGAACACTCCATAAGCACA GCCTACTTGGAGCTGAGCAGCCTGAGATCTGAGG ACACGGCCGTGTATTACTGTGCGAGTAGCAGTGG CTGGTACTTTTTGACTACTACTGGGGCCAGGGAACC CTGGTCACCGTCTCCTCA<br><br>SEQ ID NO: 30235 |
| | | AA | DIVMTQSPDSLAVSLGERATINCKSSQNVLYSSH NNNYLAWYQQKPGQPPKLLIYWASTRKSGVPD RFSGSGSGTDFTLTITSLQAEDVAVYYCQQYYST PFTFGPGTKVDIK<br><br>SEQ ID NO: 26230 | QVQLVQSGAEVKKPGASVTVSCKASGFPFTNYDIN WVRQATGQGLEWMGWMHPNSGNTGYAQKFQGR VTMTRNTSISTAYLELSSLRSEDTAVYYCASSSGWY FFDYWGQGTLVTVSS<br><br>SEQ ID NO: 30236 |
| iPS:435407 | 21-225_150E7 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG GCCCTAAGCGCCTGATCTATGCTGCATCCAAT TTGCAAAGTGGGGTCCCATTAAGGTTCAGCGG CAGTGGATCTGGGACAGATCTCACTCTCACAA TCAGCAGCCTGCAGCCTGAAGATTTTGCAGCT TATTACTGTCTACAGCATAATAGTTACCCGCTC ACTTTCGGCGGAGGGACCAAGGTGGAGATCA AA<br><br>SEQ ID NO: 26231 | CAGGTGCAGCTGGTGGAGTCTGGGGGAGGCGTG GTCCAGCCTGGGGGAGGAGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATATGGTATGAAGAAAA TAATAAATACTATGCAGACTCCGTGAAGGGCCG ATTCACCATCTCCAGAGACAATTCCAAGAACACG CTGTTTCTGCAAATGAACAGCCTGAGAGCCGAGG ACACGGCTGTGTATTACTGTGCGAGAGAAATAGG GTTCAGTGAGGACTACTGGGGCCAGGGAACCCT GGTCACCGTCTCCTCA<br><br>SEQ ID NO: 30237 |

FIGURE 50
(Continued)

| | | | |
|---|---|---|---|
| iPS:435409 | | AA | DIQMTQSPSSLSASVGDRVTITCRASQGIRNDLG WYQQKPGKAPKRLIYAASNLQSGVPLRFSGSGS GTDFTLTISSLQPEDFAAYYCLQHNSYPLTFGGG TKVEIK<br>SEQ ID NO: 26232 | QVQLVESGGGVVQPGRSLRLSCAASGFTFSDYGM HWVRQAPGKGLEWVAVIWYEENNKYYADSVKGR FTISRDNSKNTLFLQMNSLRAEDTAVYYCAREIGFS EDYWGQGTLVTVSS<br>SEQ ID NO: 30238 |
| | 21-225_150G8 | NA | GAGGTGCAGCTGGTGGAGTCTGGGGGAGGCTTG GTGCAGCCTGGGGGGTCCCTGAGACTCTCCTGTG CAGCCTCGGGATTCACTTTCAGTACTACCTATAGCAT GACTTGGGTCCGCCAGGCTCCAGGGAAGGGGCT GGACTGGGTTTCATCATTAGTAGGAGTAGTAGT ACCATATACTACGCAGACTCTGTGAAGGGCCGAT TCTCCATCTCCAGAGACAATGCCAAGAACTCACT GTATCTGCAAATGAACAGCCTGAGAGACGAGGA CACGGCTCTGTATTACTGTGCGAGATCGGCATTT AGCCCTTTGATTACTGGGGCCAGGGAACCCTGG TCACCGTCTCCTCA<br>SEQ ID NO: 30239 | GACATCCAGATGACCCAGTCTCCATCCTCACT GTCTGCATCTGTAGGAGACAGAGTCACCATCA CTTGTCGGGCGAGTCAGGGCATTAGCCATTAT TTAGCCTGGTTTCAGCAGAAACCAGGGAAAGC CCCTAAGTCCCTGATCTATGTTGCATCCAGTTT GCAAAATGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAGTATAATAATTACCCGCTCA CTTTCGGCGGAGGGACCAAGGTGGAGATCAA A<br>SEQ ID NO: 26233 |
| | | AA | DIQMTQSPSSLSASVGDRVTITCRASQGISHYLA WFQQKPGKAPKSLIYVASSLQNGVPSRFSGSGSG TDFTLTISSLQPEDFATYYCQQYNNYPLTFGGGT KVEIK<br>SEQ ID NO: 26234 | EVQLVESGGGLVQPGGSLRLSCAASGFTFSTYSMT WVRQAPGKGLDWVSYISRSSSTIYYADSVKGRFSIS RDNAKNSLYLQMNSLRDEDTALYYCARSAFSPFD YWGQGTLVTVSS<br>SEQ ID NO: 30240 |

FIGURE 50
(Continued)

| | | | |
|---|---|---|---|
| iPS:435413 | 21-225_150B11 | NA | GATATTGTGATGACCCAGACTCCACTCTCTCT<br>GTCCGTCACCCCTGGACAGCCGGCCTCCATCT<br>CCTGCAAGTCTAGTCAGAGCCTCGTGCATGGT<br>GATGGAAAGACCTATTTGTATTGGTACCTGCA<br>GAGGCCAGGCCAGCTCCACAGCTCCTGATCT<br>ATGAAGTTCCAACCGGTTCTGGAGTGCCA<br>GATAGGTTCAGTGCAGCGGGTCAGGACAG<br>ATTTCACATTGAAAATCAGCCGGGTGGAGGCT<br>GAGGATGTTGGGGTTTATTACTGCATGCAAAG<br>TATACAGCTTCCGTGACGTTCGGCCAAGGGA<br>CCAAGGTGGAAATCAAA<br>SEQ ID NO: 26235 | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAGTTATGGCAT<br>GCACTGGGTCCGCCAGGCTCCAGGCAAGGGCT<br>GGAGTGGGTGGCAATTATATGGTATGATGGAAGT<br>AATAAATACTATGCAGACTCCGTGAAGGGCCGA<br>TTCACCATCTCCAGAGACAATTCCAAGAACACGC<br>TGTATCTGCAAATGAACAGCCTGAGAGCCGAAG<br>ACACGGCTGTGTATTACTGTGCGAGAGATCGTTA<br>CGATTTTGGAGTGGTCACTTGACTACTGGGGC<br>CAGGGAACCCTGGTCACCGTCTCCTCA<br>SEQ ID NO: 30241 |
| | | AA | DIVMTQTPLSLSVTPGQPASISCKSSQSLVHGDG<br>KTYLYWYLQRPGQPPQLLIYEVSNRFSGVPDRFS<br>GSGSGTDFTLKISRVEAEDVGVYYCMQSIQLPW<br>TFGQGTKVEIK<br>SEQ ID NO: 26236 | QVQLVESGGGVVQPGRSLRLSCAASGFTFSSYGMH<br>WVRQAPGKGLEWVAIIWYDGSNKYYADSVKGRFT<br>ISRDNSKNTLYLQMNSLRAEDTAVYYCARDRYDF<br>WSGHFDYWGQGTLVTVSS<br>SEQ ID NO: 30242 |
| iPS:435415 | 21-225_150C11 | NA | GACATCCAGATGACCCAGTCTCCATCCTCCCT<br>GTCTGCATCTGTAGGAGACAGAGTCACCATCA<br>CTTGCCGGGCAAGTCAGAGCATTAGCAGCTAT<br>TTAAATTGGTATCAGCAGAAACCAGGGAAAG<br>CCCCTAAACTCCTGATCTATACTGCATCCAGTT<br>TGCAAAGTGGGGTCCCATCAAGGTTCAGTGGC<br>AGTGGATCTGGGACAGATTTCACTCTCACCAT<br>CAGCAGTCTGCAACCTGAAGATTTTGCAACTT<br>ACTACTGTCAACAGAGTTACAGTATTTACACT<br>TTCGGCGGAGGGTCCAAGGTGGAGATCAAA<br>SEQ ID NO: 26237 | GAGGTGCAGCTGTTGGAGTCTGGGGGAGGCTTG<br>GTACAGCCTGGGGGGTCCCTGAGACTCTCCTGTG<br>CAGCCTCTGGATTCACCTTTAGCAGCTATGCCAT<br>GAACTGGGTCCGCCAGGCTCCAGGGAAGGGGCT<br>GGAGTGGGTCTCAGCTATTAGTAGTGGTAGTGGT<br>AACACATTCTACGCAGACTCCGTGAAGGGCCGGT<br>TCACCATCTCCAGAGACAATTCCAAGAACACGCT<br>GAATCTGCAAATGAGCAGCCTGAGAGCCGAGGA<br>CACGGCCGTATATTACTGCGCGAAACGGGTGAC<br>GGACTACGGTGGTAACGACTGGTTCGACCCCTGG<br>GGCCAGGGAACCCTGGTCACCGTCTCCTCA<br>SEQ ID NO: 30243 |

FIGURE 50
(Continued)

| | | | | |
|---|---|---|---|---|
| | | AA | DIQMTQSPSSLSASVGDRVTITCRASQSISSYLNW YQQKPGKAPKLLIYTASSLQSGVPSRFSGSGSGT DFTLTISSLQPEDFATYYCQQSYSIYTFGGGSKVE IK<br>SEQ ID NO: 26238 | EVQLLESGGGLVQPGGSLRLSCAASGFTFSSYAMN WVRQAPGKGLEWVSAISGSGGNTFYADSVKGRFTI SRDNSKNTLNLQMSSLRAEDTAVYYCAKRVTDYG GNDWFDPWGQGTLVTVSS<br>SEQ ID NO: 30244 |
| iPS:435417 | 21-225_150D11 | NA | GATATTGTGATGACCCAGACTCCACTCTCT GTCCGTCACTCCTGACAGCCGGCCTCCATCT CCTGCAAGTCTAGTCAGAGCCTCCTGCATAGT GAGGGAAAGAACCTATTTGTATTGGTACCTGCA GAAGCCAGGCCAGCCTCCACAGCTCCTGATCT ATGAAGTTTCTACCGGTTCTCTGGAGTGCCA GATAGGTTCAGTGGCAGCGGGTCAGGGACAG ATTTCACACTGAAAATCAGCCGGTGCATGGAGGCT GAGGATGTTGGGGTTTATTACTGCATGCAAGG TATACAGTCTTCCGCTCACTTTCGGCGGAGGGA CCAAGGTGGAGATCAAA<br>SEQ ID NO: 26239 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGCAT GCACTGGGTCCGCCAGGCTCCAGGCAAGGGCT GGAGTGGGTGGCAGTTATATTCTATGATGGAAGT AATAAACACTATGCAGACTCCGTGAAGGGCCGA TTCACCATCTCCAGAGACAATTCCAAGAACACGC TGTATCTGCAAATGAACAGCCTGAGAGCCGAGG ACTCGGCTGTGTATTACTGTACGAGGAGGTTTAG CAGCAGCTGGTCGGGGTATGGACGTCTGGGG CCAAGGGACCACGGTCACCGTCTCCTCA<br>SEQ ID NO: 30245 | |
| | | AA | DIVMTQTPLSLSVTPGQPASISCKSSQSLLHSEGK TYLYWYLQKPGQPPQLLIYEVSYRFSGVPDRFSG SGSGTDFTLKISRVEAEDVGVYYCMQGIQLPLTF GGGTKVEIK<br>SEQ ID NO: 26240 | QVQLVESGGGVVQPGRSLRLSCAASGFTFSSYGMH WVRQAPGKGLEWVAVIFYDGSNKHYADSVKGRFT ISRDNSKNTLYLQMNSLRAEDSAVYYCTRRFSSSW SGGMDVWGQGTTVTVSS<br>SEQ ID NO: 30246 |

FIGURE 50
(Continued)

| | | | |
|---|---|---|---|
| iPS:435419 | 21-225_150C12 | NA | GACATCCAGATGACCCAGTCTCCATCTCCT GTCTGCATCTGTAGGAGACAGAGTCACCATCA CTTGCCGGGCAAGTCAGAGCATTAGCGACTAT TTAAATTGGTATCAGCAGAAACCAGGGAAAG CCCCTAAGGTCCTGATCTATACTACATCAGTT TGCAAAGTGGGGTCCCATCAAGGTTCAGTGGC AGTGGATCTGGGACAGATTTCACTCTCACCAT CAGCAGTCTGCAGCCTGAAGATTTTGCAACTT ACTACTGTCAACAGAGTTTCAGTACCCCCACT TTCGGCGGAGGGACCAAGGTGGAGATCAAA GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGCTATTAGTGGTGGTGGTGGT AACACATTCTACGCAGACTCCGTGAAGGGCCGT TCACCATCTCCAGAGACAATTCCAAGAACACTA TATCTGCAAATGAACAGCCTGAGAGCCGAGA CACGGCCGTATATTACTGTGCGAAACGGGTGACG GACTACGGTGGTAACGACTGGTTCGACCCCTGGG GCCAGGGAACCCTGGTCACCGTCTCCTCA |
| | | AA | DIQMTQSPSSLSASVGDRVTITCRASQSISDYLN WYQQKPGKAPKVLIYTSSLQSGVPSRFSGSGSG TDFTLTISSLQPEDFATYYCQQSFSTPTFGGGTKV EIK | EVQLLESGGGLVQPGGSLRLSCAASGFTFSSYAMS WVRQAPGKGLEWVSAISGGNTFYADSVKGRFTI SRDNSKNTLYLQMNSLRAEDTAVYYCAKRVTDYG GNDWFDPWGQGTLVTVSS |
| | | | SEQ ID NO: 26241 | SEQ ID NO: 30247 |
| iPS:435421 | 21-225_151F1 | NA | GAAATGGTGATGACGCAGTCTCCAGCCACCCT GTCTGTGTCTCCAGGGGAAAGAGTCACCCTCT CCTGCAGGGCCAGTCAGAGTATTAACATCAAT CAGCCTGGTACCAGCAGAAACCTGGCCAGGC ATAGCCTGGTACCAGCAGAAACCTGGCCAGGC TCCCAGGCTCCTCATCTATGGTGCATCCACCA GGGCCACTGGTATCCCAGCCAGGTTCAGTGGC AGTGGGTCTGGGACAGAGTTCACTCTCACCAT CAGCAGCCTGCAGTCTGAAGATTTTGCAGTTT ATTACTGTCAGCAGTATAATGACTGGCCTCCG TGGACGTTCGGCCAAGGGACCAAGGTGGAAA TCAAA | GAGGTGCAGCTGTTGGAGTCTGGGGGAGGCCTG GTCAAGCCTGGGGGGTCCTGAGACTCTCCTGTG CAGCCTCTGGATACACCTTCAGGAGCTTTAGCAT GAACTGGGTCCGCCAGGCTCCAGGGAAGGGCT GGAGTGGGTCTCATCATTAGTAGTAGTAGTTAT TACATATACTACGCAGACTCAGTGAAGGGCCGAT TCACCATCTCCAGAGACAACGCCAAGAACTACT GTATCTGCAAATGAACAGCCTGAGAGCCGAAGA CACGGCTGTGTATTACTGTGCGAGAGATACACCA CTGGTTTACTGGGGCCAGGGAACCCTGGTCACCG TCTCCTCA |
| | | | SEQ ID NO: 26242 | SEQ ID NO: 30248 |
| | | | SEQ ID NO: 26243 | SEQ ID NO: 30249 |

FIGURE 50
(Continued)

| | | | |
|---|---|---|---|
| iPS:435423 | 21-225_151G5 | AA | EMVMTQSPATLSVSPGERVTLSCRASQSININIA WYQQKPGQAPRLLIYGASTRATGIPARFSGSGSG TEFTLTISSLQSEDFAVYYCQQYNDWPPWTFGQ GTKVEIK<br>SEQ ID NO: 26244 | EVQLVESGGGLVKPGGSLRLSCAASGYTFRSFSMN WVRQAPGKGLEWVSSISSSSYIYYADSVKGRFTIS RDNAKNSLYLQMNSLRAEDTAVYYCARDTPLVY WGQGTLVTVSS<br>SEQ ID NO: 30250 |
| | | NA | GATATTGTGATGACCCAGACTCCACTCTCTCT GTCCGTCACCCCTGGACAGCCGGCCTCCATCT CCTGCAAGTCTAGTCAGCGCCTCCTGCATGGT GATGAAAGACCTATTTGTATTGGTACCTGCA GAAGCCAGGCCAGCCTCCACAGTCTCCTGCTCT ATGAAGTTCCAACCGGTTCTCTGGAGTGCCA GATAGGTTCAGTGGCAGCGGGTCAGGGACAGG ATTTCACACTGAAATCAGCCGGGTGGAGGCT GAGGATGTTGGGGTTTATTACTGCAAGCAAAG TATACAGGTTCCGTGGACGTTCGGCCAAGGGA CCAAGGTGAAATCAAA<br>SEQ ID NO: 26245 | CAGGTGCAGCTGATGGAGTCTGGGGGAGGCGTG GTCCAGCCTGGGAGGTCCCTGAGACTCTCCTGTG CAGCGTCTGATTCATCTTCAGTAGCTATGGCAT GCACTGGGTCCGCCAGGCTCCAGGCAAGGGGCT GGAGTGGGTGGCAATTATATGGTATGATGAAGT AATAAATACTATGCAGACTCCGTGAAGGGCCGA TTCACCATCTCCAGAGACAATTCCAAGAACACGC TGTATCTGCAAATGAACAGCTGAGAGCCGAGG ACACGGCTGTGTATTACTGTGCGAGAGATCGATA CGATTTTTGGAGTGGTCACTTTGACTACTGGGGC CAGGGAACCCTGGTCACCGTCTCCTCA<br>SEQ ID NO: 30251 |
| | | AA | DIVMTQTPLSLSVTPGQPASISCKSSQRLLHGDG KTYLYWYLQKPGQPPQLLLYEVSNRFSGVPDRF SGSGSGTDFTLKISRVEAEDVGVYYCMQSIQVP WTFGQGTKVEIK<br>SEQ ID NO: 26246 | QVQLMESGGGVVQPGRSLRLSCAASGFIFSSYGMH WVRQAPGKGLEWVAIIWYDGSNKYYADSVKGRFT ISRDNSKNTLYLQMNSLRAEDTAVYYCARDRYDF WSGHFDYWGQGTLVTVSS<br>SEQ ID NO: 30252 |

FIGURE 50
(Continued)

| | | | |
|---|---|---|---|
| iPS:435425 | 21-225_151B12 | NA | GACATACAGATGACCCAGTCTCCATCTCCCT GTCTGCGTCTGTAGGAGACAGAGCATTAGCAACTCAT CTTGCCGGGCAAGTCAGAGCATTAGCAACTTT TTAAATTGGTATCAGCAGAAACCAGGAAAG CCCCTAAGGTCCTGATCTATACTGCATCCAGTT TGGAAAGTGGGGTCCCATCAAGGTTCAGTGGC AGTGAATCTGGGACAGATTTCACTCTCACCAT CAGCAGTCTGCAACCTGAAGATTTTGCAACTT ACTACTGTCAACAGAGTTACAGTACCCCACT TTCGGCGGAGGGACCAGGGTGGAGATCAAA<br><br>SEQ ID NO: 26247 | GAGGTGCAGCTGTTGGAGTCTGGGGGAGGCTTG GTACAGCCTGGGGGGTCCCTGAGACTCTCCTGTG CAGCCCTCTGATTCACCTTAGCAGTCATGCCAT GAACTGGGTCCGCCACGTCCAGGGAAGGGGCT GGAGTGGGTCTCAGCTATTAGTGGTAGTGGTAAA AACACATTCTACGCAGACTCCGTGAAGGGCCGGT TCACCATCTCCAGAGACAATTCAAGAACACGCT GTATCTGCAAATGAACAGCCTGAGAGCCGAGGA CACGGCCGTATATTACTGTGCGAAACGGGTGACG GACTACGGTGGTAACGACTGGTTCGACCCTGGG GCCAGGGAACCCTGGTCACCGTCTCCTCA<br><br>SEQ ID NO: 30253 |
| | | AA | DIQMTQSPSSLSASVGDRVTITCRASQSISNFLNW YQQKPGKAPKVLIYTASSLESGVPSRFSGSESGT DFTLTISSLQPEDFATYYCQQSYSTPFGGGTRV EIK<br><br>SEQ ID NO: 26248 | EVQLLESGGGLVQPGGSLRLSCAASGFTFSSYAMN WVRHAPGKGLEWVSAISGSGKNTFYADSVKGRFTI SRDNSKNTLYLQMNSLRAEDTAVYYCAKRVTDYG GNDWFDPWGQGTLVTVSS<br><br>SEQ ID NO: 30254 |
| iPS:435427 | 21-225_151C9 | NA | GACATCCAGATGACCCAGTCTCCATCCTCACT GTCTGCTTCTGTGGGAGACAGAGTCACCATCA CTTGTCGGGCGAGTCAGGGCATTAGCAAGTAT TTAGCCTGGTTTCAGCAGAAACCAGGAAAGC CCCTAAGTCTCTGATCTATGATGCATCCAGTT TGCAAAGTGGGGTCCCATCAAAGTTCAGCGGCA GTGGATCTGGGACAGATTTCACTCTCACCATC AGCAGCCTGCAGCCAGAAGATTTTGCAAGTTA TTACTGCCATCAGTAGTATAAACATTACCCGATCA CCTTCGGCCAAGGGACCACGACTGGAGATTAAA<br><br>SEQ ID NO: 26249 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTAGTATGGCAT GCACTGGGTCCGCCAGGCTCCAGGCAAGGGGCT GGAGTGGGTGGCAGTTATATCATATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGGGGTATT ACTATGGTTCGGGGAGCTAGAAGATGACTGGTTC GACCCTGGGGCCAGGGAACCCTGGTCACCGTCT CCTCA<br><br>SEQ ID NO: 30255 |

FIGURE 50
(Continued)

| | | | |
|---|---|---|---|
| iPS-435429 | 21-225_151A10 | AA | DIQMTQSPSSLSASVGDRVTITCRASQGISKYLA WFQQKPGKAPKSLIYDASRLQSGVPSKFSGSGSG TDFTLTISSLQPEDFASYYCHQYKHYPITFGQGT RLEIK<br>SEQ ID NO: 26250 | QVQLVESGGGVVQPGRSLRLSCAASGFTFSSYGMH WVRQAPGKGLEWVAVISYDGSNKYYADSVKGRFT ISRDNSKNTLYLQMNSLRAEDTAVYYCARGVLLW FGELEDDWFDPWGQGTLVTVSS<br>SEQ ID NO: 30256 |
| | | NA | GATATTGTGATGACCCAGACTCCACTCTCTCT GTCCGTCACCCCTGGACAGCCGGCCTCCATCT CCTGCAAGTCTAGTCAGAGCCTCTGATGGT GATGGAAAGACCTATTTGTATTGGTACCTACA GAAGCCAGGCCAGCCTCCACAGCTCCTGATCT ATGAAGTTTCCCACCGGTTCTCTGGAGTGCCA GATAGGTTCAGTGGCAGCGGGTCAGGGACAG ATTTCACACTGAAAATCAGCCGGGTGGAGGCT GAGGATGTTGGGGTTTATTACTGCATGCAAAG TATACAGATTCCGTGGACGTTCGGCCAAGGGA CCAAGGTGGAAATCAAA<br>SEQ ID NO: 26251 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGTTGGCAATTATATGGTATGATGGAAGT AATAAATACTATGCAGACTCCGTGAAGGGCCGA TTCACCATCTCCAGAGACAATTCCAAGAACACGC TGTATCTACAAATGAACAGCCTGAGAGCCGAGG ACACGGCTGTGTATTACTGTGCGAGAGATCATTA CGATTTTTGGAGTGGTCACTTTGACTACTGGGGC CAGGGAACCCTGGTCACCGTCTCCTCA<br>SEQ ID NO: 30257 |
| | | AA | DIVMTQTPLSLSVTPGQPASISCKSSQSLLHGDG KTYLYWYLQKPGQPPQLLIYEVSHRFSGVPDRFS GSGSGTDFTLKISRVEAEDVGVYYCMQSIQPWT FGQGTKVEIK<br>SEQ ID NO: 26252 | QVQLVESGGGVVQPGRSLRLSCAASGFTFSNYGM HWVRQAPGKGLEWLAHWYDGSNKYYADSVKGRF TISRDNSKNTLYLQMNSLRAEDTAVYYCARDHYDF WSGHFDYWGQGTLVTVSS<br>SEQ ID NO: 30258 |

FIGURE 50
(Continued)

| | | | |
|---|---|---|---|
| iPS:435431 | 21-225_152D2 | NA | GACATCCAGATGACCCTGTCTCCATCCTCCT GTCTGCATCTGTAGGAGACAGAGTCACCATCA CTTGCCGGGCAAGTCAGAGCATTAGCGACTAT TTAAATTGGTATCAGCTGAAACCAGGAAAGC CCCTAAGGCTCTGATCTATACTACATCCAGTTT GCAAAGTGGGGTCCCATCAAGGTTCAGTGGCA GTGGATCTGGGACAGATTTCACTCTCACCATC AGCAGTCTGCAACCTGAAGAGTTACAGTACCCCCACTTT CGGCGGAGGGACCAAGGTGGAGATCAAA SEQ ID NO: 26253 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGCTATTAGTGGTCGTGGTGGT AACACATTCTACGCAGACTCCGTGAAGGGCCGGT TCACCATCTCCAGAGACAATTCCAAGAAAACACT ATATCTGCAAATGAACAGCCTGAGAGCCGAGGA CACGGCCGTATATTACTGTGCAAACGGGTGACG GACTACGGTGGTAACGACTGGTTCGACCCTGGG GCCAGGGAACCCTGGTCACCGTCTCCTCA SEQ ID NO: 30259 |
| | | AA | DIQMTLSPSSLSASVGDRVTITCRASQSISDYLN WYQLKPGKAPKVLIYTTSSLQSGVPSRFSGSGSG TDFTLTISSLQPEDFATYFCQQSYSTPTFGGGTKV EIK SEQ ID NO: 26254 | EVQLLESGGGLVQPGGSLRLSCAASGFTFSSYAMS WVRQAPGKGLEWVSAISGRGGNTFYADSVKGRFTI SRDNSKKTLYLQMNSLRAEDTAVYYCAKRVTDYG GNDWFDPWGQGTLVTVSS SEQ ID NO: 30260 |
| iPS:435433 | 21-225_152E3 | NA | GACATCGTGATGACCCAGTCTCCAGACTCCCT GGCTGTCTCTCTGGGCGAGAGGGCCACCATCA ACTGCAAGTCCAGCCAGAGTGTTTTACACAGC TCCAACAATTACAACTACTTAGTTTGGTACCA GCAGAAACCAGGACAGTCTCCTAAGCGGCTCA TTTACTGGGCATCTACCCGGGAATCCGGGGTC CCTGACCGATTCAGTGGCAGCGGGTCTGGGAC AGATTTCTCTCACCATCAGCAGCCTGCAGG CTGAAGATGTGGCAGTTTATTACTGTCAGCAA TATTACAGTACTCCATTCACTTTCGGCCCTGGG ACCAAAGTGGATATCAAA SEQ ID NO: 26255 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTATTACTGTGCGAGTAGCAGT GGCTGGTACTTTTTGACTACTGGGGCCAGGGAA CCCTGGTCACCGTCTCCTCA SEQ ID NO: 30261 |

FIGURE 50
(Continued)

| | | | |
|---|---|---|---|
| | | AA | DIVMTQSPDSLAVSLGERATINCKSSQSVLHSSN NYNYLVWYQQKPGQSPKRLIYWASTRESGVPD RFSGSGSGTDFSLTISSLQAEDVAVYYCQQYYST PFTFGPGTKVDIK<br>SEQ ID NO: 26256 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCASSSGW YFFDYWGQGTLVTVSS<br>SEQ ID NO: 30262 |
| iPS:435435 | 21-225_152H3 | NA | CAGGTGCAGCTGGTGCAGTCTGGGGCTGAGGTG AAGAAGCCTGGGGCCTCAGTGAAGGTCTCCTGC AAGGCTTCTGGATACACCTTCCCAATTATGATA TCAACTGGGTGCGACAGGCCACTGGACAAGGCC TTGAGTGGATGGGATGGATGCACCCTAACAGTGG TAACACAGGCTATGCACAGAAGTTCCAGGGCAG AGTCACCATGACCAGGAACACCTCCATAAGCAC AGCCTACATGAGCTGAGCAGCCTGAGATCTGA GGACACGGCCGTGTATTACTGTGCATATAGCAGT GGCTGGTACTGGTTTGACTACTGGGGCCAGGGAA CCCTGGTCACCGTCTCCTCA<br>SEQ ID NO: 30263 | GACATCGTGATGACCCAGTCTCCAGACTCCCT GGCTGTGTCTCTGGGCGAGAGAGGCCACCATCA ACTGCAAGTCCAGCCAGAGTGTTTTGCACAGC TCCAACAATTACAACTACTTAACTGGTACCA GCAGAAACCAGGACAGCCTCCTAAACTGCTCA TTTACTGGGCATCTACCCGGAATCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCGTGCAGTTTTGGCCAGGG GACCAAGCTGGAGATCAAA<br>SEQ ID NO: 26257 |
| | | AA | DIVMTQSPDSLAVSLGEKATINCKSSQSVLHSSN NYNYLTWYQQKPGQPPKLLIYWASTRKSGVPD RFSGSGSGTDFTLTISSLQAEDVAVYYCQQYYST PCSFGQGTKLEIK<br>SEQ ID NO: 26258 | QVQLVQSGAEVKKPGASVKVSCKASGYTFPNYDIN WVRQATGQGLEWMGWMHPNSGNTGYAQKFQGR VTMTRNTSISTAYMELSSLRSEDTAVYYCAYSSGW YWFDYWGQGTLVTVSS<br>SEQ ID NO: 30264 |

FIGURE 50
(Continued)

| | | | | |
|---|---|---|---|---|
| iPS:435437 | 21-225_152F4 | NA | GACATCGTGATGACCCAGTCTCCAGACTCCCT GGCTGTGTCTCTGGGCGAGAGGGCCACCATCA ACTGCAAGTCCAGCCAGAGTGTTTTATACAGC TCCAACAATTACAACTACTTAGCTTGGTACCA GCAGAAACCAGGGCAGCCTCCTAAACTGCTCA TTTACTGGGCATCTACCCGAAATCCGGGGTC CCTGACCGATTCAGTGGCAGCGGGTCTGGGAC AGATTTCACTCTCACCGTCAGCAGCCTGCAGG CTGAAGATGTGGCAGTTTATTACTGTCAGCAA TATTTTAATACTCCTCCCACTTTCGGCCCTGGG ACCAAAGTGGATATCAAA SEQ ID NO: 26259 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAGTGG TAACACAGGCTATGCACAGAAGTTCCAGGCAG AGTCACCATGACCAGGAACACCTCATAAGCAC AGCCTACATGGAGCTGAGCAGCCTGAGATCTGA CGACACGGCCGTGTATTACTGTGCGTATAGCAGT GGCTGGTACTGGTTCGACCCCTGGGGCCAGGGA ACCCTGGTCACCGTCTCCTCA SEQ ID NO: 30265 |
| | | AA | DIVMTQSPDSLAVSLGERATINCKSSQSVLYSSN NYNYLAWYQQKPGQPPKLLIYWASTRKSGVPD RFSGSGSGTDFTLTVSSLQAEDVAVYYCQQYFN TPPTFGPGTKVDIK SEQ ID NO: 26260 | QVQLVQSGAEVKKPGASVKVSCKASGYTFTNYDIN WVRQATGQGLEWMGWMHPNSGNTGYAQKFQGR VTMTRNTSISTAYMELSSLRSDDTAVYYCAYSSGW YWFDPWGQGTLVTVSS SEQ ID NO: 30266 |
| iPS:435439 | 21-225_152G4 | NA | GACATCCAGATGACCCAGTCTCCATCCTCCCT GTCTGCATCTGTAGGAGACAGAGTCACCATCA CTTGCCGGGCAAGTCAGAGCATTAGCAGCTAT TTAAATTGGTATCAGCAAAAACCAGGGAAAG CCCCTAAGGTCCTGATCTATACATCCAGTT TGCAAAGTGGGGTCCATCAAGGTTCAGTGGC AGTGGATCTGGGACAGATTTCACTCTCACCAT CAGCAGTCTGCAACCTGAAGATTTTGCAACTT ACTTCTGTCAACAGAGTTACAGTACCCCCACT TTCGGCGGAGGGACCAAGGTGGAGATCAAA SEQ ID NO: 26261 | GAGGTGCAGCTGTTGGAGTCTGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTGTGGTGGT AACACATTCTACGCAGACTCCGTGAAGGGCCGGT TCACCATCTCCAGAGACAATTCCAAGAACACACT ATATCTGCAAATGAACAGCCTGAGAGCCGAGGA CACGGCCGTATATTACTGTGCGAAACGGGTGACG GACTACGGTGGTAACGACTGGTTCGACCCCTGGG GCCAGGGAACCCTGGTCACCGTCTCCTCA SEQ ID NO: 30267 |

FIGURE 50
(Continued)

| | | | | |
|---|---|---|---|---|
| | | AA | DIQMTQSPSSLSASVGDRVTITCRASQSISDYLN WYQQKPGKAPKVLIYTTSSLQSGVPSRFSGSGSG TDFTLTISSLQPEDFATYFCQQSYSTPFGGGTKV EIK<br><br>SEQ ID NO: 26262 | EVQLLESGGGLVQPGGSLRLSCAASGFTFSSYAMS WVRQAPGKGLEWVSAISGRGGNTFYADSVKGRFTI SRDNSKNTLYLQMNSLRAEDTAVYYCAKRVTDYG GNDWFDPWGQGTLVTVSS<br><br>SEQ ID NO: 30268 |
| iPS:435441 | 21-225_152F6 | NA | GATATTGTGATGACCCAGACTCCACTCTCT GTCCGTCACCCCTGGACAGCCGGCCTCCATCT CCTGCAAGTCTAGTCAGAGCCTCCGGCATGGT GATGGAAAGACCTATTTGACTTGGTACCTACA GAGGCCAGGCCAGCCTCCACAGTCCTGATCC ATGAAATTTCCAAGCGGTTCACTGGAGTGCCA GATAGGTTCAGTGGCAGCGGGTCAGGGACAG ATTTCACACTGAACATCAGCCGGGTGGAGGCT GAGGATGTTGGCTTTTATTACTGCATGCAAAG TATACAGGTTCCGTGGACGTTCGGCCAAGGGA CCAAGGTGGAAATCAAA<br><br>SEQ ID NO: 26263 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGCCAT GCACTGGGTCCGCCAGGCTCCAGGCAAGGGGCT GGAGTGGGTGGCAATTATATGGTATGATGGAAGT TATAAATACTATGCAGACTCCGTGAAGGGCCGAT TCACCATCTCCAGAGACAATTCCAAGAATACGCT GTATCTGCAAATGAACAGCCTGAGAGCCGAGGA CACGGCTGTGTATTACTGTGCGAGAGAGGGTAC GATTTTTGAGTGGTTACCTTGGCTACTGGGGCC AGGGAACCCTGGTCACCGTCTCCTCA<br><br>SEQ ID NO: 30269 |
| | | AA | DIVMTQTPLSLSVTPGQPASISCKSSQSLRHGDG KTYLTWYLQRPGQPPQVLIHEISKRFTGVPDRFS GSGSGTDFTLNISRVEAEDVGFYYCMQSIQVPW TFGQGTKVEIK<br><br>SEQ ID NO: 26264 | QVQLVESGGGVVQPGRSLRLSCAASGFTFSSYGMH WVRQAPGKGLEWVAIIWYDGSYKYYADSVKGRFTI ISRDNSKNTLYLQMNSLRAEDTAVYYCAREGYDF WSGYLGYWGQGTLVTVSS<br><br>SEQ ID NO: 30270 |

FIGURE 50
(Continued)

| | | | | |
|---|---|---|---|---|
| iPS:435443 | 21-225_152E7 | NA | GAAATTGTGTTGACGCAGTCTCCAGGCACCCT GTCTTTGTTTCCAGGGGAAAGAGCCACCCTCT CCTGCAGGGCCAGTCAGTGTTATCAGCAGC TACTTAGCTGGTACCAGCAGAAACCTGGCCA GGCTCCCAGGCTCCTCATCTTTGGTGTATCTAG TAGGGCCACTGGCATCCCAGACAGTTCAGTG GCAGTGGGTCTGGGACAGACTTCACTCTCACC ATCAGCAGACTGGAGCCTGAAGATTTTGCAGT GTATTACTGTCAACAATATGGTAGGTCACCAT TCAATTTCGGCCCTGGGACCAAAGTGGATATC AAA<br><br>SEQ ID NO: 26265 | CAGGTGCAGCTGCAGGAGTCGGGCCCAGGACTG GTGAAGCCTTCACAGACCCTGTCCCTCAATTGCA CTGTCTCTGGTGGCTCCATCAGCAACAGTGTTA CTACTGGAGCTGGATCCGCCAGCACCCAGGCAA GGGCCTGGAATGGATTGGGTACAGTTATTACAGT GGGAGCACCTACTACAACCCGTCCCTCAAGAGTC GAATTACCATATCAGTAGACACGTCTAACAACCA GTTCTCCCTGAACCTGAGCTCTGTGACTGCCGCG GACACGGCCGTGTATTACTGTGCGAGAGGGGGA TATAACTGAACCATGCTTTTGATATCTGGGGCC AAGGGACAATGGTCACGTCTCTTCA<br><br>SEQ ID NO: 30271 |
| | | AA | EIVLTQSPGTLSLFPGERATLSCRASQSVISSYLA WYQQKPGQAPRLLIFGVSSRATGIPDRFSGSGSG TDFTLTISRLEPEDFAVYYCQQYGRSPFNFGPGT KVDIK<br><br>SEQ ID NO: 26266 | QVQLQESGPGLVKPSQTLSLNCTVSGGSISNSGYY WSWIRQHPGKGLEWIGYSYYSGSTYYNPSLKSRITI SVDTSNNQFSLNLSSVTAADTAVYYCARGGYNWN HAFDIWGQGTMVTVSS<br><br>SEQ ID NO: 30272 |
| iPS:435445 | 21-225_152F7 | NA | GACATCCAGATGACCCAGTCTCCATCCTCCT GTCTGCATCTGTTGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTACATCCAGT TTGCAAAGTGGGGTCCCATCAAGGTTCAGCGG CAGTGGATCTGGGACAGCCTGAAGATTTGCAACT TCAGCAGCCTACAGCCTGAAGATTTTGCAACT TATTACTGTCTACAGCATTATAATTTCCCGTAC AGTTTTGGCCAGGGGACCAAGCTGGAGATCAA A<br><br>SEQ ID NO: 26267 | CAGGTGCAGCTGGTGGAGTCTGGGGGAGGCGTG GTCCAGCCTGGGAGGTCCCTGAGACTCTCTGTG CAGCGTCTGGATTCACCTTCAGTAGCTATATCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGTA TAGCAGCAGCTGGACTGGGTACGGTATGACGT CTGGGGCCAAGGGACCACGTCACCGTCTCCTCA<br><br>SEQ ID NO: 30273 |

FIGURE 50
(Continued)

| | | | | |
|---|---|---|---|---|
| iPS:435447 | 21-225_152H7 | AA | DIQMTQSPSSLSASVGDRVTITCRASQGIRNDLG WYQQKPGKAPKRLIYATSSLQSGVPSRFSGSGSG TEFTLTISSLQPEDFATYYCLQHYNFPYSPGQGT KLEIK<br>SEQ ID NO: 26268 | QVQLVESGGGVVQPGRSLRLSCAASGFTFSSYIMH WVRQAPGKGLEWVAVIWYDGSNKYYADSVKGRF TISRDNSKNTLYLQMNSLRAEDTAVYYCAREEYSS SWYGYGMDVWGQGTTVTVSS<br>SEQ ID NO: 30274 |
| | | NA | GACATCCAGATGACCCAGTCTCCAGCTTCCGT GTCTGCATCTGTGGGAGACAGAGTCACCATAA CTTGTCGGGCGAGTCAGGATATTAGCAACTGG TTAGCCTGGTATCAGCAGAAACCAGGAAAAG CCCCTAAACTCCTGATCTATGCTGCATCCAGTT TGCAAGGTGGGGTCCCATCAAGGTTCAGCGGC AGTGGATCTGGGACAGATTTCACTCTCACC CAGCACCCTGCAGCCTGAAGATTTTGCAACTT ACTATTGTCAACAGACTGACAGTTTCCCATTC ACTTTCGGCCCTGGGACCAAAGTGGATATCAA A<br>SEQ ID NO: 26269 | GAGGTGCAGCTGTTGGAGTCTGGGGGAGGCTTG GTACAGCCTGGGGGGTCCCTGAGACTCTCCTGTG CAGCCTCTGGATTCACCTTTAACAGCTATGCCAT GAACTGGGTCCGCCAGGCTCCAGGGAAGGGGCT GGAGTGGGTCTCAGCTATTAGTGGTAGTGGTGGT AACACATTCTACGCAGACTCCGTGAAGGGCCGCT TCACCATCTCCAGAGACAATTCCAAGAACACACT GTATCTGCAAATGAACAGCCTGAGAGCCGAGGA CACGGCCGTATATTACTGTGCGAAAAAGGATAAT GATTACGTTTGGGGAGTCCTTACTTTGACTACT GGGGCCAGGGAACCCTGGTCACCGTCTCCTCA<br>SEQ ID NO: 30275 |
| | | AA | DIQMTQSPASVSASVGDRVTITCRASQDISNWLA WYQQKPGKAPKLLIYAASSLQGGVPSRFSGSGS GTDFTLSISTLQPEDFATYYCQQTDSPPTFGPGT KVDIK<br>SEQ ID NO: 26270 | EVQLLESGGGLVQPGGSLRLSCAASGFTFNSYAMN WVRQAPGKGLEWVSAISGSGGNTFYADSVKGRFTI SRDNSKNTLYLQMNSLRAEDTAVYYCAKKDNDYV WGSPYFDYWGQGTLVTVSS<br>SEQ ID NO: 30276 |

FIGURE 50
(Continued)

| | | | |
|---|---|---|---|
| iPS:435449 | 21-225_152H9 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCACCGG CAGTGGATCTGGGACAGAATTCACTTTCACAA TCAGCAGCCTGCAGCCTGAAGATTTTGCAACT TATTACTGTCTACAGCATGATAGTAATTACCCGCTC ACTTTCGGCGGAGGGACCAAGGTGGAGATCA AA SEQ ID NO: 26271 |
| | | | CAGCTGCAGCTGCAGGAGTCGGGCCCAGGACTG GTGAAGCCTTCGGAGACCCTGTCCCTCACCTGCA CTGTCTCTGGTGGCTCCATCAGCAGAAGTAGTTA CTACTGGGGCTGGATCCGCCAGCCCCCAGGGAA GGGGCTGGAGTGGATTGGGAGTATCTATTATAGT GGGAGCGCCTCCTACAACCCGTCCCTCAAGAGTC GAGTCACCATATCGTAGACACGTCAAGAACC AGTTCTCCCTGAAGCTGAGCTCTGTGACCGCCGC AGACACGGCTGTGTATTACTGTGCGAGACTGAT CTCCAGTGGAGTTTGACTTCTGGGGCCAGGGAA CCCTGGTCACCGTCTCCTCA SEQ ID NO: 30277 |
| | | AA | DIQMTQSPSSLSASVGDRVTITCRASQGIRNDLG WYQQKPGKAPKRLIYAASSLQSGVPSRFTGSGS GTEFTFTISSLQPEDFATYYCLQHSNYPLTFGGGT KVEIK SEQ ID NO: 26272 | QLQLQESGPGLVKPSETLSLTCTVSGGSISRSSYYW GWIRQPPGKGLEWIGSIYYSGSASYNPSLKSRVTIS VDTSKNQFSLKLSSVTAADTAVFYCARLDIQWSFD FWGQGTLVTVSS SEQ ID NO: 30278 |
| iPS:435451 | 21-225_152D10 | NA | GGCATCCTGTGATGACCCAGTCTCCAGACTCCT GGCTGTCTGTGGGCGCGAGGGCCACCATCG ACTGCAAGTCCAGCCAGAGTGTTTTATACAGC TCCAACAATAAGAACTACTTAGCTTGGTACCA GCAGAAACCAGGACAGCCTCCTAAGTTGCTCA TTTACTGGGCATCTACCCGGGAATCCGGGGTC CCTGACCGATTCAGTGGCAGCGGATCTGGGAC AGATTTCACTCTCACCATCTACAGCCTGCAGG CTGAAGATGTGGCAGTTTATTACTGTCAGCAA TATTATCGTAGTCCTAGTTTTGGCCAGGGGAC CAAGCTGGAGATCAAA SEQ ID NO: 26273 | CAGGTGCAGCTGCAGGAGTCGGGCCCAGGACTG GTGAAGCCTTCGGAGACCCTGTCCCTCACCTGCA CTGTCTCTGGTGGCTCCATCAGTAATTACTACTG GAGCTGGATCCGGCAGCCCGCCGGGAAGGGACT GGAGTGGATTGGGCGTATCGATCCAGTGGATC ACCAACTACAACCCCTCAAGAGTCGAGTCA CCATGTCAGTGACAGTCGACAGTTCT CCTGAAGCTGACCTCTGTGACCGCCGCGACACG GCCGTGTATTACTGTGCGAGAGAGGGGATTG GGAGCTACCTTCTTTGACTACTGGGGCCAGGGAA CCCTGGTCACCGTCTCCTCA SEQ ID NO: 30279 |

FIGURE 50
(Continued)

| | | | |
|---|---|---|---|
| | | AA | GIVMTQSPDSLAVSLGARATIDCKSSQSVLYSSN NKNYLAWYQQKPGQPPKLLIYWASTRESGVPD RFSGSGSGTDFTLTIYSLQAEDVAVYYCQQYYR SPSFGQGTKLEIK<br>SEQ ID NO: 26274 | QVQLQESGPGLVKPSETLSLTCTVSGGSISNYYWS WIRQPAGKGLEWIGRIDTSGITNYNPSLKSRVTMSV DTSKNQFSLKLTSVTAADTAVYYCAREGGLGATFF DYWGQGTLVTVSS<br>SEQ ID NO: 30280 |
| iPS:435453 | 21-225_152G10 | NA | GACATCCAGATGACCCAGTCTCCAGCTTCCGT GTCTGCATCTGTAGGAGACAGAGTCACCATAA CTTGTCGGGCGAGTCAGGGTATTAGCAACTGG TTAGCCTGGTATCAGCAGAAACCAGGGAAAG CCCCTAAGCTCCTGATCTCTGCTGCATCCAGTT TGCAAAGTGGGGTCCCATCAAGGTTCAGCGGC AATGAATCTGGGACAGATTTCACTCTCCAT CAGCAGCCTGCAGCCTGAAGATTTTGCAACTT ACTATTGTCAACAGACTGACAGTTCCCATTC ACTTTCGGCCCTGGGACCAAAGTGGATGTCAA A<br>SEQ ID NO: 26275 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTGGTGGTGT AACACATTCTACGCAGACTCCGTGAAGGGCCGCT TCACCATCTCCAGAGACAATTCCAAGAACACGCT CTATCTGCAAATGAACAGCTGAGAGCCGAAGA CACGGCCGTATACTGTGGGGGAGTCCTTACTTTGACTACT GATTACGTTTGGGGACAAGGGAACCCTGGTCACCGTCTCCTCA<br>SEQ ID NO: 30281 |
| | | AA | DIQMTQSPASVSASVGDRVTITCRASQGISNWLA WYQQKPGKAPKLLISAASSLQSGVPSRFSGNESG TDFTLSISSLQPEDFATYYCQQTDSFPFTFGPGTK VDVK<br>SEQ ID NO: 26276 | EVQLLESGGGLVQPGGSLRLSCAASGFTFSSYAMS WVRQAPGKGLEWVSAISGRGGNTFYADSVKGRFTI SRDNSKNTLYLQMNSLRAEDTAVYYCAKKDYDYV WGSPYFDYWGQGTLVTVSS<br>SEQ ID NO: 30282 |

FIGURE 50
(Continued)

| | | | | |
|---|---|---|---|---|
| iPS:435455 | 21-225_152B11 | NA | GACATCCAGATGACCCAGTCTCCATCTCCT GTCTCATCTGTAGGAGACAGAGTCACCATCA CTTGCCGGGCAAGTCAGAGCATTAGCGACTAT TTAAATTGGTATCAGCAGAAACCAGGGAAAG CCCCTAAGGTCCTGATCTATACTACATCCAGTT TGCAAAGTGGGGTCCCATCACAAGGTTCAGTGGC AGTGGATCTGGGACAGATTTCACTCTCACCAT CAGCAGTCTGCAACAGAGTTACAGTACCCCACT ACTTCTGTCAACAGAGTTACAGTACCCCACT TTCGGCGGAGGGACCAAGGTGGAGATCAAA SEQ ID NO: 26277 DIQMTQSPSSLSASVGDRVTITCRASQSISDYLN WYQQKPGKAPKVLIYTTSSLQSGVPSRFSGSGSG TDFTLTISSLQPEDFATYFCQQSYSTPTFGGGTKV EIK SEQ ID NO: 26278 | GAGGTGCAGCTGGTTGAGTCTGGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGGAAGGGGCT GGAGTGGGTCTCAGCTATTAGTGGTCGTGGTGGT AACACATTCTACGCAGACTCCGTGAAGGGCCGGT TCACCATCTCCAGAGACAATTCCAAGAACACACT ATATCTGCAAATGAACAGCCTGAGAGCCGAGGA CACGGCCGTATATTACTGTGCGAAACGGGTGACG GACTACGGTGGTAACGACTGGTTCGACCCTGGG GCCAGGGAACCCTGGTCACCGTCTCCTCA SEQ ID NO: 30283 EVQLLESGGGLVQPGGSLRLSCAASGFTFSSYAMN WVRQAPGKGLEWVSAISGRGGNTFYADSVKGRFTI SRDNSKNTLYLQMNSLRAEDTAVYYCAKRVTDYG GNDWFDPWGQGTLVTVSS SEQ ID NO: 30284 |
| iPS:435457 | 21-225_152C11 | NA | GATATTGTGATGACCCAGGCTCCACTCTCT GTCCGTCACCCTGGACAGCCGGCCTCCATCT CCTGCAAGTCTAGTCAGAGCCTCCTGCATGGT GATGGAAAGAGACCTATTTATATGTACCTGCA GAAGCCAGGCCAGTCCTCACAGATCCTGATCT ATGAAGTTTCCAACCGGTTCTCTGGAGTGCCA GATAGGTTCAGTGGCAGCGGGTCAGGGACAG ATTTCACACTGAAACATCAGCCGGGTGAGGCT GAGGATTTTGGGTTTTATTACTGCATGCAAAG TATACAGATTCCGTGACGTTCGGCCAAGGGA CCAAGGTGGACATCAAA SEQ ID NO: 26279 | CAGGTACAACTGGTGGAGTCTGGGGGAGGCGTG GTCCAGCCTGGGAGGTCCCTGAGACTCTCCTGTG CAGCGTCTGGATTCACCTTCCGTAACTATGGCAT GCACTGGGTCCGCCAGGCTCCAGGCAAGGGGCT GGAGTGGGTGGCAATTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGCTTA CGATTTTTGGAGTGGTTATTTGACTACTGGGGC CAGGGAATTCTGGTCACCGTCTCCTCA SEQ ID NO: 30285 |

FIGURE 50
(Continued)

| | | | |
|---|---|---|---|
| iPS:435459 | 21-225_152E12 | AA | DIVMTQAPLSLSVTPGQPASISCKSSQSLLHGDG KTYLYWYLQKPGQPPQILIYEVSNRFSGVPDRFS GSGSGTDFTLNISRVEAEDFGFYYCMQSIQIPWT FGQGTKVDIK<br>SEQ ID NO: 26280 | QVQLVESGGGVVQPGRSLRLSCAASGFTFRNYGM HWVRQAPGKGLEWVAIIWYDGSNKYYADSVKGR FTISRDNSKNTLYLQMNSLRAEDTAVYYCAREAYD FWSGYFDYWGQGILVTVSS<br>SEQ ID NO: 30286 |
| | | NA | GCCGTCGTGATGACCCAGTCTCCAGACTCCCT GGCTGTGTCTCTGGGCGAGAGGGCCACCATCA ACTGCAAGTCCAGCCAGAGTATTTTACACAGC TCCAATAATTACAACTACTTAGCTTGGTACCA GCAGAAACCAGGACAGCCTCCTAAATTGCTCA TTTACTGGGCATCTACCCGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAACAA TATTATAGTGGTCCGTGCAGTTTTGGCCAGGG GACCAAGCTGGAGATCAAA<br>SEQ ID NO: 26281 | CAGGTGCAGCTGGTGCAGTCTGGGGCTGAGGTG AAGAAGCCTGGGGCCTCAGTGAAGGTCCTGC AAGGCTTCTGGATACACCTTCACCAATTATGATA TCAACTGGGTGCGACAGGCCACTGGACAAGGGC TTGAGTGGATGGATGGATGAACCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCTTATAGCAG TGGCTGGTACTACTTTGACTACTGGGGCCAGGGA ACCCTGTCACCGTCTCCTCA<br>SEQ ID NO: 30287 |
| | | AA | AVVMTQSPDSLAVSLGERATINCTSSQSILHSSN NYNYLAWYQQKPGQPPKLLIYWASTRESGVPD RFSGSGSGTDFTLTISSLQAEDVAVYYCQQYYSG PCSFGQGTKLEIK<br>SEQ ID NO: 26282 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCAYSSGW YYFDYWGQGTLVTVSS<br>SEQ ID NO: 30288 |

FIGURE 50
(Continued)

| | | | |
|---|---|---|---|
| iPS:435461 | 21-225_153A1 | NA | GACATCCAGATGACCCAGTCTCCATCCTCACTGTCTGCATCTGTAGGAGACAGAGTCACCATCACTTGTCGGGCGAGTCAGGTCATTAGCAGTAATTATTTAGCCTGGTTTCAGCAGAAACCAGGGAAAGCCCCTAAGTCCCTGATCTCTGCTGCATCCAGTTTGCGAAGTGGGGTCCCATCAAACTTCAGCGGCAGTGGATCTGGGACAGATTTCACTCTCACCATCAGCAGCCTGCAAGATATCATAGTTACCATTCATTACTGCCAACAGTATCATAGTTACCATTCACTTTCGGCCCTGGGACCAAAGTGGATTTCAAASEQ ID NO: 26283 | GAGGTGCAGCTGTTGGAGTCTGGGGGAGGCCTGGTACAGCCTGGGGGGTCCCTGAGACTCTCCTGTGCAGCCCTCTGATTCAGCTTTAGCAGTCATGAGTTGGGTCCGCCAGGTCCCCAGGGAAGGGCTGGAGTGGGGTCTCAGCTATTAGTGGAAGTGGTGATAGAACATACTACGCAGACTCCGTGAAGGGCCGGTTCACCATCTCCAGAGACAATTCCAAGAACACGCTGTACTGCAAATGAACAGCCTGAGAGCCGAGGACACGGCCGTATATTACTGTGCGCGTACGGCGACTAAGGACTACTGGGGCCAGGGAACCCTGGTCACCGTCTCCTCASEQ ID NO: 30289 |
| | | AA | DIQMTQSPSSLSASVGDRVTITCRASQVISNYLAWFQQKPGKAPKSLISAASSLRSGVPSNFSGSGSGTDFTLTISSLQPEDFATYYCQQYHSYPFTFGPGTKVDFKSEQ ID NO: 26284 | EVQLLESGGGLVQPGGSLRLSCAASGFSFSSYVMSWVRQGPGKGLEWVSAISGSGDRTYYADSVKGRFTISRDNSKNTLYLQMNSLRAEDTAVYYCARTATKDYWGQGTLVTVSSSEQ ID NO: 30290 |
| iPS:435463 | 21-225_153D2 | NA | GATATTGTGATGACCCAGACTCCACTCTCTCTGTCCGTCACCCCTGGACAGCCGGCCTCCATCTCCTGCAAGTCTAGTCAGAGCCTCCTGCATGGTGATGGAAAGACCTATTTGACTTGGTACCTACAGAGGCCAGGCCAGCCTCCACAGGTCCTGATCCATGAAGTTTCCAACTCCAAGCGGTTCTACTGGAGTGCCAGATAGGTTCAGTGGCAGCGGGTCAGGGACAGATTTCACACTGGAAACATCAGCCGGGTGGAGGCTGAGGATGTTGGGGTTTTATTACTGCATGCAAAGTATACAAGGTTCCGTGGACGTTCGGCCAAGGGACCAAGGTGGAAATCAAASEQ ID NO: 26285 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATCAGCTGGGTCCGCCAGGCTCCAGGCAAGGGGCTGGAGTGGGTGGCAATTATATATGTATGATGGAAGTTATAAATACTATGCAGACTCCGTGAAGGGCCGATTCACCATCTCCAGAGACAATTCCAAGAACACGGTGTATCTGCAAATGAACAGCCTGAGAGCCGAGGACACGGCTGTATATTACTGTGCGAGAGAGGGTACGATTTTTGGAGTGGTTACCTGGCTACTGGGGCCAGGGAACCCTGGTCACCGTCTCCTCASEQ ID NO: 30291 |

FIGURE 50
(Continued)

| | | | | |
|---|---|---|---|---|
| iPS:435465 | 21-225_153A6 | AA | DIVMTQTPLSLSVTPGQPASISCKSSQSLRHGDG KTYLTWYLQRPGQPPQVLIHEVSKRFTGVPDRFS GSGSGTDFTLNISRVEAEDVGFYYCMQSIQVPW TPGQGTKVEIK<br>SEQ ID NO: 26286 | QVQLVESGGGVVQPGRSLRLSCAASGFTFSSYGMH WVRQAPGKGLEWVAIIWYDGSYKYYADSVKGRFT ISRDNSKNTVYLQMNSLRAEDTAVYYCAREGYDF WSGYLGYWGQGTLVTVSS<br>SEQ ID NO: 30292 |
| | | NA | GAAATTGTGTTGACGCAGTCTCCAGGCACCCT GTCTTTGTTTCCAGGGGAAAGAGCCCCCCTCT CCTGCAGGGCCAGTCAGAGTGTTATCAGCAGC TACTTAGCCTGGTACCAGCAGAAACCTGGCCA GGCTCCCAGGCTCCTCATCTTTGTGTATCTAG TAGGGCCACTGGCATCCCAGACAGGTTCAGTG GCAGTGGGTCTGGGACAGACTTCACTCTCACC ATCAGCAGACTGGAGCCTGAAGATTTTGCAGT GTATTACTGTCAACAATATGGTAGGTCACCAT TCAATTTCGGCCCTGGGACCAAAGTGGATATC AAA<br>SEQ ID NO: 26287 | CAGGTGCAGCTGCAGGAGTCGGGCCCAGGACTG GTGAAGCCTTCACAGACCCTGTCCCTCACTTGCA CTGTCTCTGGTGCCTCCATCAGCAGCAGTGGTTA CTACTGGAGCTGGATCCGCCAGCACCCAGGCAA GGGCCTGGAATGGATTGGGTACAGCTATTACAGT GGGAGCACCTACTACAACCGTCCCTCAAGAGTC GAATTACCATATCAGTAGACACGTCTAACAACCA GTTCTCCCTGAACCTGAGCTCTGTGACTGCCGCG GACACGGCCGTGTATTACTGTGCGAGAGGGGA TATAACTGGAACCATGCTTTTGATATCTGGGGCC AAGGGACAATGGTCACCGTCTCTTCA<br>SEQ ID NO: 30293 |
| | | AA | EIVLTQSPGTLSLFPGERAPLSCRASQSVISSYLA WYQQKPGQAPRLLIFGVSSRATGIPDRFSGSGSG TDFTLTISRLEPEDFAVYYCQQYGRSPFNFGPGT KVDIK<br>SEQ ID NO: 26288 | QVQLQESGPGLVKPSQTLSLNCTVSGGSISNSGYY WSWIRQHPGKGLEWIGYSYYSGSTYYNPSLKSRITI SVDTSNNQFSLNLSSVTAADTAVYYCARGGYNWN HAFDIWGQGTMVTVSS<br>SEQ ID NO: 30294 |

FIGURE 50
(Continued)

| | | | |
|---|---|---|---|
| iPS:435467 | 21-225_153B9 | NA | GGCATCGTGATGACCCAGTTTCCAGATTCCCT GGCTGTGTCTCTGGGCGAGAGGGCCACCATCA ACTGCAAGTCCAGCCAGAGTGTTTATACAGC TCCAACAATAAGAACTACTTAGCTGGTACCA GCAGAAACCAGGACAGCCTCATAAGTTGCTCA TTTACTGGGCATCTACCCGGGAATTTGGGGTC CCTGACCGATTCAGTGGCAGCGGGTGTGGAC AGATTTCACTCTCACCATCTACAGCGTGCAGG CTGAAGATGTGGCAGTTTATTACTGTGTCAGCA TATAATCGTAGTCTTAGTTTTGGCCAGGGGAC CAAGCTGGAGATCAAA<br><br>SEQ ID NO: 26289<br><br>GIVMTQFPDSLAVSLGERATINCKSSQSVLYSSN NKNYLAWYQQKPGQPHKLLIYWASTREFGVPD RFSGSGCGTDFTLTIYSVQAEDVAVYYCQQYNR SLSFGQGTKLEIK<br><br>SEQ ID NO: 26290 | CAGGTGCAGCTGCAGGAGTCGGGCCCAGGACTG GTGAAGCCTTGGAGACCCTGTCCTCACCTGCA CTGTCTCTGGTGGCTCCATCAGTAGTTACTACTG GAGCTGGATCCGGCAGCCCGCCGGGAAGGACT GAGTGGATTGGGCGTATCGATACCAGTGGGATC ACCAACTACAACCCCTCCCTCAAGAGTCGAGTCA CCATGTCAGTGGACACGTCCAAGAACCAGTTCTC CCTGAAGCTGACCTCTGTGACCGCCGCGGACACG GCCGTGTATTACTGTGCGAGAGAGGGGGAGTG GGACGTACGTACTTTGACTACTGGGGCCAGGGA ACCCTGGTCACCGTCCTCA<br><br>SEQ ID NO: 30295<br><br>QVQLQESGPGLVKPSETLSLTCTVSGGSISSYYWSW IRQPAGKGLEWIGRIDTSGITNYNPSLKSRVTMSVD TSKNQFSLKLTSVTAADTAVYYCAREGGVGATYF DYWGQGTLVTVSS<br><br>SEQ ID NO: 30296 |
| iPS:435469 | 21-225_153G9 | NA | GATATTGTGATGACCCAGACTCCCTCTCTCTG TCCGTCACCCCTGGACAGCCGGCCTCCATCTC CTGCAAGTCTAGTCAGAGCCTCCTGCATATG ATGCAAGTCTATTTGTATTGGTACCTGCAG AAGCCAGGCCAGTCTCCACAGTTCCTGATCTA TGAAGTTTCCAACCGGTTCTCTGGAGTGCCAG ATAGGTTCAGTGGCAGCGGGTCAGGACAGA TTTCACACTGAAAATCAGCCGGGTGGAGGCTG ACGATGTTGGGGTTTATTACTGCACGCATGCAAAAT ATAAAGTATCCGCTCACTTTCGGCGGAGGGAC CAAGGTGGAGATCAAA<br><br>SEQ ID NO: 26291 | CAGGTGCAGCTGGTGGTGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCACTTATATTCTATGATGGAAGT AATAAATACTATGCAGACTCCGTGAAGGGCCGA TTCACCATCTCCAGAGACAATTCCAAGAACACGC TGTATCTGCAAATAAACAGCCTGAGAGCCGAGG ACACGGCTGTGTATTTCTGTGCGCGACGCTATAG CCGCAGCTGGGCCGGGGTATGGACGTCTGGGG CCAAGGGACCGCGGTCACCGTCTCCTCA<br><br>SEQ ID NO: 30297 |

FIGURE 50
(Continued)

| | | | |
|---|---|---|---|
| iPS:435471 | 21-225_153F11 | AA | DIVMTQTPFSLSVTPGQPASISCKSSQSLLHSDGK TYLYWYLQKPGQPPQFLIYEVSNRFSGVPDRFSG SGSGTDFTLKISRVEADDVGVYYCMQNIKYPLT FGGGTKVEIK<br>SEQ ID NO: 26292 | QVQLVESGGGVVQPGRSLRLSCAASGFTFSSYGMH WVRQAPGKGLEWVALIFYDGSNKYYADSVKGRFT ISRDNSKNTLYLQINSLRAEDTAVYFCARRYSRSW AGGMDVWGQGTAVTVSS<br>SEQ ID NO: 30298 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTATACAGC TCCAACAATTACAAGTACTTAGCTTGGTACCA GCAGAAACCAGGACAGCCTCCTAACCTGCTCA TTTACTGGGCATCTACCCGGAAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTATGCAA AATTATAAGTACTCCGTCAGTTTTGGCCAGGG GACCAAGCTGGAGATCAAA<br>SEQ ID NO: 26293 | CAGGTGCAGCTGGTGCAGTCTGGGGCTGAGGTG AAGGAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGACCAGAAGTTCCAGGGCAG AGTCACCATGACCAGGAATACCTCCATAAACAC AGCCTACATGGAGCTGAGCAGCCTGAGATCTGA GGACACGGCCGTGTATTACTGTGCGTATAGCAGT GGCTGGTACTTCTTTGACAACTGGGGCCAGGGAA CCCTGGTCACCGTCTCCTCA<br>SEQ ID NO: 30299 |
| | | AA | DIVMTQSPDSLAVSLGERATINCKSSQSVLYSSN NYKYLAWYQQKPGQPPNLLIYWASTRKSGVPD RFSGSGSGTDFTLTISSLQAEDVAVYYCQQYYST PCSFGQGTKLEIK<br>SEQ ID NO: 26294 | QVQLVQSGAEVKKPGASVKVSCKASGYTFTNYDIN WVRQATGQGLEWMGWMHPNSGNTGYAQKFQGR VTMTRNTSINTAYMELSSLRSEDTAVYYCAYSSGW YFFDNWGQGTLVTVSS<br>SEQ ID NO: 30300 |

FIGURE 50
(Continued)

| | | | |
|---|---|---|---|
| iPS:435475 | 21-225_154H6 | NA | GACATCGTGATGACCCAGTCTCCAGACTCCCT GGCTGTCTCTGGGCGAGAGGGCCACCATCA ACTGCAAGTCCAGCCAGAGTGTTTACACAGT TCCAACAATTACAACTATTTAGCTTGGTACCA GCAGAAACCAGGACAGCCTCCTAAGCTGCTCA TTTACTGGACATCTACCCGGAAATCCGGGGTC CCTGACCGATTCAGTGGCAGCGGGTCTGGGAC ACATTTCACTCTCTCATCAGCAGCCTGCAGG CTGAAGATGTGGCAGTTTATTACTGTCAGCAT TATTATAGTACTCCGTGCAGTTTTGGCCAGGG GACCAAGCTGGAGATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGCA GAGTCACCATGACCAGGAACACCTCCATAAGCA CAGCCTACATGGAGCTGAGCAGCCTGAGATCTG AGGACACGGCCGTGTATTACTGTGCGTATAGCAG TGGCTGGTACATCTTTGACTACTGGGGCCAGGGA ACCCTGGTCACCGTCTCCTCA |
| | | | SEQ ID NO: 26295 | SEQ ID NO: 30301 |
| | | AA | DIVMTQSPDSLAVSLGERATINCKSSQSVLHSSN NYNYLAWYQQKPGQPPKLLIYWTSTRKSGVPD RFSGSGSGTHFTLSISSLQAEDVAVYYCQHYYST PCSFGQGTKLEIK | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCAYSSGW YIFDYWGQGTLVTVSS |
| | | | SEQ ID NO: 26296 | SEQ ID NO: 30302 |
| iPS:435479 | 21-225_154E9 | NA | GACATTCAGATGACCCTGTCTCCATCCTCCGT GTATGCATCTGTGGAGACAGAGTCACCATCA CTTGTCGGGCGAGTCAGGATATTAGCAACTGG TTAGCCTGGTATCAGCAGAGACCAGGGAAAG CCCCTAAGGTCCTTATCTATGCTGCATCCAGTT TGCAAAGTGGGGTCCCATCAAGATTCAGCGGC AGTGGATCTGGGACAGATTTCACTCTCACCAT CAGCAGCGTGCAGCCTGAAGATTTTGCAACTT ACTATTGTCAACAGGGTAACAGTTTCCCGCTC ACTTTCGGCGGAGGGACCAAGGTGGACATCA AA | GAGGTGAAGTTGTTGGAGTCTGGGGGAGGCTTG GTACAGCCGGGGGGGTCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTATTAGTGGTGGTGGTGGT AACAATTCTACGCAGACTCCGTGAAGGGCCGGT TCACCATCTCCAGAGACAATTCCAAGAACACGCT GTTTCTGCAAATGAACAGCCTGAGAGCCGAGGA CAGCGCGTATATTACTGTGCGAAAAGGGGATTT CGATTTTTGGAGTGGTTGGGGGCTTTGACTACT GGGGCCAGGGAACCCTGGTCACCGTCTCCTCA |
| | | | SEQ ID NO: 26297 | SEQ ID NO: 30303 |

FIGURE 50
(Continued)

| | | AA | DIQMTLSPSSVYASVGDRVTITCRASQDISNWLAWYQQRPGKAPKVLIYAASSLQSGVPSRFSGSGSGTDFTLTISSVQPEDFATYYCQQGNSFPLTFGGGTKVDIK<br>SEQ ID NO: 26298 | EVKLLESGGGLVQPGGSLRLSCAASGFTFSSYAMSWVRQAPGKGLEWVSAISGRGGNTFYADSVKGRFTISRDNSKNTLFLQMNSLRAEDTAVYYCAKRGFRFLEWLGGFDYWGQGTLVTVSS<br>SEQ ID NO: 30304 |
|---|---|---|---|---|
| iPS:435481 | 21-225_154A11 | NA | CAGGTGCAGCTGGTGCAGTCTGGGGCTGAGGTGGACATCGTGATGACCCAGTCTCCAGACTCCCTGGCTGTGTCTCTGGGCGAGAGGGCCACCATCAACTGCAGGTCAAGCCAGAGTGTTTTACACAGCTCCAACAATTATAACTACTTAGTTTGGTACCAGCAGAAACCAGGACAGCCTCCTAAGCTGCTCATTTACTGGGCATCTAAACGGGATTCCGGGTCCCTGACCGATTCAGTGGCAGCGGGTCTGGGACAGATTTCACTCTCACCATCAGCAGCCTGCAGCCTGAGGATGTGGCAGTTTATTACTGTCAGCAATATTTTAGTTCTCCTGGACGTTCGGCCAAGGGACCAAGGTGGAAATCAAG<br>SEQ ID NO: 26299 | AAGAAGCTGGGGCTCAGTGAAGGTCTCCTGCAAGGCTTCTGGATACACCTTCACCAATTATGATATCAACTGGGTGCGACAGGCCACTGGACAGGGCTTGAGTGGATGGGATGGATGAACCCTAACAGTGGTAACACAGGCTATGCACAGAAGTTCCAGGGCAGAGTCACCATGACCAGAAACACCTCCATAAGCACAGCCTACATGGAGCTGAGCAGCCTGAGATCTGAGGACACGGCCGTGTATTACTGTGCGAGTAGCAGTGGCTGGTACTACTTCGACTACTGGGGCCAGGGAACCCTGGTCACCGTCTCCTCA<br>SEQ ID NO: 30305 |
| | | AA | DIVMTQSPDSLAVSLGERATINCRSSQSVLHSSNNYNYLAWYQQKPGQPPKLLIYWASKRDSGVPDRFSGSGSGTDFTLTISSLQAEDVAVYYCQQYFSSPRTFGQGTKVEIK<br>SEQ ID NO: 26300 | QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCASSSGWYYFDYWGQGTLVTVSS<br>SEQ ID NO: 30306 |

FIGURE 50
(Continued)

| | | | |
|---|---|---|---|
| iPS-435483 | 21-225_155A4 | NA | GACATCCAGATGACCCAGTCTCCAGCTTCCGT GTCTGCATCTGTAGGAGACAGAGTCACCATAA CTTGTCGGGCGAGTCAGGGTATTAGCAACTGG TTAGCCTGGTATCACCAGAAACCAGGGAAAGC CCCTAAGCTCCTGATCTATGCTGCATCCAGTTT GCAAGGTGGGGTCCCATCAAGGTTCAGCGGCA GTGGATCTGGGACAGATTTCACTCTCCATC AGCAGCCTGCAGCTGAAGACTGACAGTTTCCATTCAC CTATTGTCACCAGACTGACAGTTTCCAATTCAC TTTCGGCCCTGGGACCAAAGTGGATATCAAA SEQ ID NO: 26301 | GAGGTGCAGCTGTTGGAGTCTGGGGAGGCTTG GTACAGCCTGGGGGGTCCCTGAGACTCTCTTGTG CAGCCTCTGGATTCACCTTTAACAGCTATGCCAT GAGCTGGGTCCGCCAGGCTCCAGGGAAGGGCT GGAGTGGGTCTCAGTTATTAGTGGTAGTGGTGT AACACATTCTACGCAGACTCCGTGAAGGGCCGT TCACCATCTCCAGAGACAATTCCAAGAACACGCT GTATCTGCAAATGAACAGCCTGAGAGCCGAGGA CACGGCCGTATATTACTGTGCGAAAAGGATTAT GATTACGTTTGGGGAGTCCTTACTTTGACTACT GGGGCCAGGGAACCCTGGTCACCGTCTCCTCA SEQ ID NO: 30307 |
| | | AA | DIQMTQSPASVSASVGDRVTITCRASQGISNWLA WYHQKPGKAPKLLIYAASSLQGGVPSRFSGSGS GTDFTLSISSLQPEDFATYYCHQTDSFPFTFGPGT KVDIK SEQ ID NO: 26302 | EVQLLESGGGLVQPGGSLRLSCAASGFTFNSYAMS WVRQAPGKGLEWVSAISGSGNTFYADSVKGRFTI SRDNSKNTLYLQMNSLRAEDTAVYYCAKKDYDYV WGSPYFDYWGQGTLVTVSS SEQ ID NO: 30308 |
| iPS-435485 | 21-225_155B4 | NA | GACATCCAGATGACCCAGTCTCCAGCTTCCGT GTCTGCATCTGTAGGAGACAGAGTCACCATAA CTTGTCGGGCGAGTCAGGATATTAGCAACTGG TTAGCCTGGTATCAGCAGAAACCAGGGAAAG CCCCTAAGCTCCTGATCTATGCTGCATCCAGTT TGCAAGGTGGGGTCCCATCAAGGTTCAACGGC AGTGGATCTGGGACAGATTTCACTCTCCAT CAGCAGCCTGCAGCCTGAAGACTTTGCAACTT ACTATTGTCACCAGACTGACAGTTTCCATTC ACTTTCGGCCCTGGGACCAAAGTGGATATCAA A SEQ ID NO: 26303 | GAGGTGCAGCTGTTGGAGTCTGGGGAGGCTTG GTACAGCCTGGGGGGTCCCTGAGACTCTCTGTG CAGCCTCTGGATTCACCTTTAGCAGCTATGCCAT GAGCTGGGTCCGCCAGGCTCCAGGGAAGGGCT GGAGTGGGTCTCAGTTATTAGTGGTAGTGGTGT AACACATTCTACGCAGACTCCGTGAAGGGCCGCT TCACCATCTCCAGAGACAATTCCAAGAACACGCT GTATCTGCAAATGAACAGCCTGAGAGCCGAGGA CACGGCCGTATATTACTGTGCGAAAAGGATTAT GATTACGTTTGGGGAGTCCTTACTTTGACTACT GGGGCCAGGGAACCCTGGTCACCGTCTCCTCA SEQ ID NO: 30309 |

FIGURE 50
(Continued)

| | | AA | DIQMTQSPASVSASVGDRVTITCRASQDISNWLA WYQQKPGKAPKLLIYAASSLQGGVPSRFNGSGS GTDFTLSISSLQPEDFATYYCHQTDSFPFTFGPGT KVDIK | EVQLLESGGGLVQPGGSLRLSCAASGFTFSSYAMS WVRQAPGKGLEWVSAISGSGGNTFYADSVKGRFTI SRDNSKNTLYLQMNSLRAEDTAVYYCAKKDYDYV WGSPYFDYWGQGTLVTVSS |
|---|---|---|---|---|
| | | | SEQ ID NO: 26304 | SEQ ID NO: 30310 |
| iPS:435487 | 21-225_155C4 | NA | GACATCCAGATGACCCAGTCTCCATCTCCCT GTCTGCATCTGTAGGAGACAGAGTCACCATCA CTTGCCGGGCAAGTCAGAGCATTAGCAGCTAT TTAAATTGGTATCAGCAGAAACCAGGGAAAG CCCCTAAGGTCCTGATCTTTACTGCATCCAGTT TGCAAAGTGGGGTCCCATCAAGATTCAGTGGC AGTGGATCTGGGACAGATTTCACTCTCACCAT CAGCAGTCTGCAACCTGAAGATTTTGCAACTT ACTACTGTCAACAGAGTTACAGTACCCCCACT TTCGGCGGAGGGACCAGGGTGGAGATCAAA | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTCGTGGTGGT AACACATTCTACGCAGACTCCGTGAAGGGCCGT TCACCATCTCCAGAGACAACAGTCAAGAACACGCT GTATCTGCAAATGAACAGTCTGAGAGCCGAGGA CACGGCCGTATATTACTGTGCGAAACGGGTGACG GACTACGGTGGTAACGACTGGTTCGACCCTGGG GCCAGGGAACCCTGGTCACCGTCTCCTCA |
| | | | SEQ ID NO: 26305 | SEQ ID NO: 30311 |
| | | AA | DIQMTQSPSSLSASVGDRVTITCRASQSISSYLNW YQQKPGKAPKVLIFTASSLQSGVPSRFSGSGSGT DFTLTISSLQPEDFATYYCQQSYSTPTFGGGTRV EIK | EVQLLESGGGLVQPGGSLRLSCAASGFTFSSYAMS WVRQAPGKGLEWVSAISGRGGNTFYADSVKGRFTI SRDNSKNTLYLQMNSLRAEDTAVYYCAKRVTDYG GNDWFDPWGQGTLVTVSS |
| | | | SEQ ID NO: 26306 | SEQ ID NO: 30312 |

FIGURE 50
(Continued)

| | | | | |
|---|---|---|---|---|
| iPS:435489 | 21-225_155A5 | NA | GATATTGTGATGACCCAGACTCCACTCTCTCT GTCCGTCACCCCTGGACAGCCGGCTCCATCT CCTGCAAGTCTAGTCAGAGCCTCTGCATGGT GATGAAAGACCTATTTGTATTGGTACTGCA GAAGCCAGGCCAGCCTCCACAGTCCTGATTT ATGAAGTTTCCAATCGGTTCTCTGGAGTGCCA GATAGGTTCAGTGGCAGCGGTTCAGGACAG ATTTCACACTGAAAATCAGCCGGTGGAGGCT GAGGATGTTGGAGATTTATTACTGCATGCAAAG TATACAGGTTCCGTGGACGTTCGGCCAAGGGA CCAAGGTGGAAATCAAA | DIVMTQTPLSLSVTPGQPASISCKSSQSLLHGDG KTYLYWYLQKPGQPPQLLIYEVSNRFSGVPDRFS GSGSGTDFTLKISRVEAEDVGFYCMQSIQVPW TFGQGTKVEIK |
| | | | SEQ ID NO: 26307 | SEQ ID NO: 30313 |
| | | AA | | QVQLVESGGDVVQPGRSLRLSCAASGFTFSSYGMH WVRQAPGKGLEWVAIIWYDGSSKYYADSVKGRFT ISRDNSKNTLYLHMNSLRAEDTAVYYCARDRYDF WSGHFDYWGQGTLVTVSS |
| | | | | SEQ ID NO: 30314 |
| iPS:435491 | 21-225_155E5 | NA | CAGGTGCAGCTGGTGCAGTCTGGGGCTGAGGTG AAGAAGCCTGGGGCCTCAGTGAAGGTCTCTGC AAGGCTCTGATACACCTTCACCAATTATGATA TCAACTGGGTGCGACAGGCCACTGGACAAGGGC TTGAGTGGATGGGATGCACCCTAACAGTGG TAGTACAGGCTATGCACCAGAGGTTCCAGGCAG AGTCACCATGACCAGGAACACCTCCATAAGCAC AGCCTACATGGAGCTGAGCAGCCTGAGATCGA GGACACGGCCGTGTATTACTGTGCGTTTAGCAGT GGCTGGTACTATTTTGACTACTGGGGCCAGGGAA CCCTGGTCACCGTCTCCTCA | |
| | | | SEQ ID NO: 26309 | SEQ ID NO: 30315 |

FIGURE 50
(Continued)

| | | | | |
|---|---|---|---|---|
| iPS:435495 | 21-225_155B6 | AA | DIVMTQSPDSLAVSLGERATINCKSSQSVLSSSN NNNYLAWYQQKPGQPPKLLIYWASTRKSGVPD RFSGSGSGTDFTLTISSLQAEDVAVYYCQQYYST PCSFGQGTKLEIK<br><br>SEQ ID NO: 26310 | QVQLVQSGAEVKKPGASVKVSCKASGYTFTNYDIN WVRQATGQGLEWMGWMHPNSGSTGYAQRFQGR VTMTRNTSISTAYMELSSLRSEDTAVYYCAFSSGW YYFDYWGQGTLVTVSS<br><br>SEQ ID NO: 30316 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTACACAGC TCCAATAATTACAACCAGGACAGCCCCTAAACTTGGTACCA GCAGAAACCAGGACAGCCCCTAAACTGCTCA TTTACTGGACATCTACCCGGGAATCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAACAA TATTATAGTACTCCGTGCAGTTTTGGCCAGGG GACCAAGTTGGAGATCAAA<br><br>SEQ ID NO: 26311 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCTTATAGCAG TGGCTGGTACTACTTTGACTACTGGGGCCAGGGA ACCCTGGTCACCGTCTCCTCA<br><br>SEQ ID NO: 30317 |
| | | AA | DIVMTQSPDSLAVSLGERATINCKSSQSVLHSSN NYNYLAWYQQKPGQPPKLLIYWTSTRESGVPDR FSGSGSGTDFTLTISSLQAEDVAVYYCQQYYSTP CSFGQGTKLEIK<br><br>SEQ ID NO: 26312 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCAYSSGW YYFDYWGQGTLVTVSS<br><br>SEQ ID NO: 30318 |

FIGURE 50
(Continued)

| | | | |
|---|---|---|---|
| iPS:435497 | 21-225_155H9 | NA | GAAATAGTGATGACGCAGTCTCCAGCCACCCT GTCTGTGTCTCCAGGGGAAAGAGCCACCCTCT CCTGCAGGGCCAGTCAGAGTGTTAGTAACTTAGCCTGGTACCAGCAGAAACCTGGCCAGGCTCCCAGACTCCTCATCTATGGTGCATCCACCAGGGCCACTGGTATCCCAGCCAGGTTCAGTGGCAGTGGGTCTGGGACAGAGTTCACTCTCACCATCAGCAGCCTGCAGTCTGAAGATTTTGCAGTTTATTACTGTCAGCAGTATGATGACTGGCCTCCGTGGACGTTCGGCCAAGGGACCAAGGTGGAAATCAAA | GAGGTGCAACTATTGGAGTCTGGGGGAGGCTTGGTTCAGCCTGGGGGGTCCCTGAGACTCTCCTGTGCAGCCTCTGGATTCACCTTTAGCAGCTATGCCATGAACTGGGTCCGCCAGGCTCCAGGGAAGGGGCTGGAATGGGTCTCAACTATTAGTGGTAGAGGTCTTGGCACATACTACGCAGACTCCGTGAAGGGCCGGTTCACCATCTCCAGAGACAATTCCAAGAACACGCTGTATCTGCAACTGAACAGCCTGAGAGCCGAGGACACGGCCGTATATTACTGTGCGAAAGACCATGACTACGGTGACTACATATCTACTTTGACTACTGGGGCCAGGGAACCCTGGTCACCGTCCTCA |
| | | | SEQ ID NO: 26313 | SEQ ID NO: 30319 |
| | | AA | EIVMTQSPATLSVSPGERATLSCRASQSVSSNLA WYQQKPGQAPRLLIYGASTRATGIPARFSGSGSG TEFTLTISSLQSEDFAVYYCQQYDDWPPWTFGQ GTKVEIK | EVQLLESGGGLVQPGGSLRLSCAASGFTFSSYAMN WVRQAPGKGLEWVSTISGRGLGTYYADSVKGRFTI SRDNSKNTLYLQLNSLRAEDTAVYYCAKDHDYGD YNIYFDYWGQGTLVTVSS |
| | | | SEQ ID NO: 26314 | SEQ ID NO: 30320 |
| iPS:435499 | 21-225_156G1 | NA | GACATCCAGATGACCCAGTCTCCATCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTTTCACAACAGCAGCCTGCAGCCTGAAGATATTGCAACTTATTACTGTCTACAGCATAGTAGTTACCCGCTCACTTTCGGCGGAGGGACCAAGGTGGAGATCAAA | CAGCTGCAGCTGCAGGAGTCGGGCCCAGGACTGGTGAAGCCTTCGGAGACCCTGTCCCTCACCTGCACTGTCTCTGGTGGCTCCATCAGCAGAAGTAGTTACTACTGGGGCTGGATCCGCCAGCCCCCAGGGAAGGGGCTGGAGTGGATTGGGAGTATCTATTATAGTGGGAGCGCCCTACAACCCGTCCCTCAAGAGTCGAGTCACCATATCCGTAGACACGTCCAAGAACCAGTTCTCCCTGAAGCTGAGCTGTGTGACCGCCGCAGACACGGCTGTGTTTTACTGTGCGAGACTTGATCTCCAGTGGAGTTTGACTTTCTGTGGGGCCAGGGAACCCTGGTCACCGTCCTCA |
| | | | SEQ ID NO: 26315 | SEQ ID NO: 30321 |

FIGURE 50
(Continued)

| | | | |
|---|---|---|---|
| | | AA | DIQMTQSPSSLSASVGDRVTITCRASQGIRNDLG WYQQKPGKAPKRLIYAASSLQSGVPSRFSGSGS GTEFTFTISSLQPEDFATYYCLQHSNYPLTFGGGT KVEIK<br><br>SEQ ID NO: 26316 | QLQLQESGPGLVKPSETLSLTCTVSGGSISRSSYYW GWIRQPPGKGLEWIGSIYYSGSASYNPSLKSRVTIS VDTSKNQFSLKLSSVTAADTAVFYCARLDLQWSFD FWGQGTLVTVSS<br><br>SEQ ID NO: 30322 |
| iPS-435501 | 21-225_156H1 | NA | GACATCGTGATGACCCAGTCTCCAGACTCCT GGCTGTGTCTCTGGGCGAGAGGGCCACCATCA ACTGCAAGTCCAGCCAGAGTGTTTTATACAGC TCCAACAATAACAACTACTTAGCTTGGTACCA GCAGAAACCAGGACAGCCTCCTAAGCTGCTCA TTTACTGGGCATCTACCCGGGAATCCGGGGTC CCTGCCCGATTCAGTGGCAGCGGGTCTGGGAC AGATTTCACTCTCACCATCAGCAGCCTGCAGG CTGAAGATGTGGCAGTTTATTACTGTCACCAA TATTATAGTACTCCGTGCAGTTTTGGCCAGGG GACCAAGCTGGAGATCAAA<br><br>SEQ ID NO: 26317 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGGTGCACCCTAACAGTGG TAACACAGGCTATGACCAGGAAGTTCCAGGCAG AGTCACCATGACCAGGAACACCTCCATAAGCAC AGCCTACACGGCCGTGTATTACTGTGCGGGGAGCAG GGACACGGCCGTGTATTACTTTGACTACTGGGGCCAGGGA TGGCTGGTACTACTTTGACTACTGGGGCCAGGGA ACCCTGGTCACCGTCTCCTCA<br><br>SEQ ID NO: 30323 |
| | | AA | DIVMTQSPDSLAVSLGERATINCKSSQSVLYSSN NNNYLAWYQQKPGQPPKLLIYWASTRESGVPA RFSGSGSGTDFTLTISSLQAEDVAVYYCHQYYST PCSFGQGTKLEIK<br><br>SEQ ID NO: 26318 | QVQLVQSGAEVKKPGASVKVSCKASGYTFTNYDIN WVRQATGQGLEWMGWVHPNSGNTGYAQKFQGR VTMTRNTSISTAYMELSSLRSEDTAVYYCAGSSGW YYFDYWGQGTLVTVSS<br><br>SEQ ID NO: 30324 |

FIGURE 50
(Continued)

| | | | |
|---|---|---|---|
| iPS:435503 | 21-225_156E4 | NA | GACATCCAGATGACCCAGTCTCCATCCTCCT GTCTGCATCTGTAGGAGACAGAGTCACCATCA CTTGCCGGGCAAGTCAGAGCATTAGCAGCTAT TTAAATTGGTATCAGCAGAAACCAGGGAAAG CCCCTAAGGTCCTGATCTATACTGCATCCAGT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTGCCCCCACT TTCGGCGGAGGGACCAAGGTGGAGATCAAA<br>SEQ ID NO: 26319 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTCGTGGTGGT AACACATTCTACGCAGACTCCGTGAAGGGCCGGT TCACCATCTCCAGAGACAATTCCAAGAACACACT ATATCTGCAAATGAACAGCCTGAGAGCCGAGGA CACGGCCGTATATTACTGTGCGAAACGGGTGACG GACTACGGTGTAACGACTGGTTCGACCCTGGG GCCAGGGAACCCTGGTCACCGTCTCCTCA<br>SEQ ID NO: 30325 |
| | | AA | DIQMTQSPSSLSASVGDRVTITCRASQSISSYLNW YQQKPGKAPKVLIYTASSLQSGVPSRFSGSGSGT DFTLTISSLQPEDFATYYCQQSYSAPTFGGGTKV EIK<br>SEQ ID NO: 26320 | EVQLLESGGGLVQPGGSLRLSCAASGFTFSSYAMS WVRQAPGKGLEWVSAISGRGGNTFYADSVKGRFTI SRDNSKNFLYLQMNSLRAEDTAVYYCAKRVTDYG GNDWFDPWGQGTLVTVSS<br>SEQ ID NO: 30326 |
| iPS:435505 | 21-225_157C1 | NA | GACATCCAGATGACCCAGTCTCCATCCTCACT GTCTGCATCTATAGGAGACAGAGTCACCCTCA CTTGTCGGGCGAGTCAGGGCATTAGCAATTAT TTAGCCTGGTTTCAGCAGAGACCAGGGAAAGC CCCTAAGTCCCTGATCTATGCTGCATCCAGTT GCTAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATAATAGTTTTCCATTCAC TTTCGGCGGAGGGACCAAGGTGGAGCTCAAA<br>SEQ ID NO: 26321 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGAAT GAACTGGGTCCGCCAGGCTCCAGGGAAGGGGCT GGAGTGGGTCTCATCCATGAGTAATAGTAGTAGT TCCATATACTACGCAGATCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGACAGGCAGCC CAGGACTACTGGGGCCAGGGAACCCTGGTCACC GTCTCCTCA<br>SEQ ID NO: 30327 |

FIGURE 50
(Continued)

| | | | | |
|---|---|---|---|---|
| | | AA | DIQMTQSPSSLSASIGDRITLTCRASQGISNYLAW FQQRPGKAPKSLIYAASSLLSGVPSKFSGSGSGT DFTLTISSLQPEDFATYYCQQYNSFPFTFGGGTK VELK<br>SEQ ID NO: 26322 | EVQLVESGGGLVKPGGSLRLSCAASGFTFSSYRMN WVRQAPGKGLEWVSSMSNSSSSIYYADSVKGRFTI SRDNAKNSLYLQMNSLRAEDTAVYYCARQAAQD YWGQGTLVTVSS<br>SEQ ID NO: 30328 |
| | 21-225_157H1 | NA | GACATCCAGATGACCCAGTCTCCATCCTCACT GTCTGCATCTGTAGGAGACAGAGTCACCATCA CTTGTCGGGCAGTCAGGACATTAGCAATTAT TTAGTCTGGTTTCAGCAGAGACCAGGGAAAGC CCCTAGGTCCCTGATCTATGCTGCATCCAGTTT GCAAAGTGGGGTCCCATCAAGTTCAGCGGCA GTGGATCTGGGACAGATTTCACTCTCACCATC AGCAGCCTGCAACAATATCATAGTTACCAATCC TTACTGCCAACAATATCATAGTTACCATTCA CTTTCGGCCCTGGGACCAAAGTGGATATCAAA<br>SEQ ID NO: 26323 | GAGGTGCAGCTGTTGGAGTCTGGGGGAGGGTTG GTACAGCCTGGGGGTCCCTGAGACTCTCCTGTG CAGCCTCTGGATTCACCTTTAGCAGTTATGCCAT GAGGTGGATCCGCCAGGCTCCAGGGAAGGGCT GCAGTGGGTCTCAGATATTAGTGGTAGTGGTGGT ACCACATACTACGCAGACTCCGTGAAGGGCCG TTCACCATCTCCAGAGACAATTCCAAGAACACGC TGTATCTGCAAATGAACAGCCTGAGAGCCGAGG ACACGGCCGTATATTACTGTGCGAAGACTACCT CTGGGGCCAGGGAACCCTGGTCACCGTCTCCTCA<br>SEQ ID NO: 30329 |
| iPS:435509 | | AA | DIQMTQSPSSLSASVGDRVTITCRASQDISNYLV WFQQRPGKAPRSLIYAASSLQSGVPSKFSGSGSG TDFTLTISSLQPEDFATYYCQQYHSYPFTFGPGT KVDIK<br>SEQ ID NO: 26324 | EVQLLESGGGLVQPGGSLRLSCAASGFTFSSYAMR WIRQAPGKGLQWVSDISGSGGTTYYADSVKGRFTI SRDNSKNTLYLQMNSLRAEDTAVYYCAKTYLWGQ GTLVTVSS<br>SEQ ID NO: 30330 |

FIGURE 50
(Continued)

| | | | | |
|---|---|---|---|---|
| iPS:435511 | 21-225_157C3 | | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTCATCTATGCTGCATCCAGTT TGCAAAGTGGGGGTCCCATCAAGGTTCAGCGGC AGTGGATCTGGGACAGACTTCACTCTCACAAT CAGCAGCCTGCAGCCTGATGACTTTGCAACTT ATTACTGTCTACAGCATAATAGTTACCCATC ACTTTCGGCCCTGGGACCAAAGTGGATATCAA A SEQ ID NO: 26325 | CAGGTGCAGCTGGTGGAGTCTGGGGGAGGCGTG GTCCAGCCTGGGAGGTCCCTGAGACTCTCCTGTG CAGCGTCTGGATTCACCTTCAGTACTACCTATGGCAT GCACTGGGTCCGCCAGGCTCCAGGCAAGGGGCT GGAGTGGGTGGCTGTTATATGGTATGATGTAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGCTGGG GTTCCTCTCTGACTATTGGGGCCAGGGAACCCTG GTCACCGTCTCCTCA SEQ ID NO: 30331 |
| | | DIQMTQSPSSLSASVGDRVTITCRASQGIRNDLG WYQQKPGKAPKRLIYAASSLQSGVPSRFSGSGS GTDFTLTISSLQPDDFATYYCLQHNSYPFTFGPG TKVDIK SEQ ID NO: 26326 | AA | QVQLVESGGGVVQPGRSLRLSCAASGFTFSTYGMH WVRQAPGKGLEWVAVIWYDVNKYYADSVKGRF TISRDNSKNTLYLQMNSLRAEDTAVYYCARELGFL SDYWGQGTLVTVSS SEQ ID NO: 30332 |
| iPS:435513 | 21-225_157F3 | | NA | GACATCCAGATGACCCAGTCTCCATCTCCCT GTCTGCATCTGTAGGAGACAGAGTCACCATCA CTTGCCGGGCAAGTCAGAACATTAGCAGTTAT TTAAATTGGTATCAGCAGAAACCAGGGAAAGC CCCTAAACTCCTGATCTATACTGCATCCAGTTT GCAAAGTGGGGTCCCATCAAGGTTCAGTGGCA GTGGATCTGGGACAGATTTCACTCTCACCATC AGCAGTCTGCAACAGAGTTACAATACCCCACGT CTACTGTCAACAGAGTTACAATACCCCCACGT GGACGTTCGGCCAAGGGACCAAGGTGGAAAT CAAA SEQ ID NO: 26327 | GAGGTGCAACTGTTGGAGTCTGGGGGAGGCTTG GTACAGCCTGGGGGGTCCCTGAGACTCTCCTGTG CAGCCTCTGAATTCACCTTTAGCACCTATGCCAT GAGCTGGGTCCGCCAGGCTCCAGGGAAGGGGCT GGAGTGGGTCTCAGTTATTAGTGGTAGTGGTGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAAAGAGCA GTGGCTGGTACGAGGATGCTCTTGATATCTGGGG CCAAGGGACAATGGTCACCGTCTCTTCA SEQ ID NO: 30333 |

FIGURE 50
(Continued)

| | | | | |
|---|---|---|---|---|
| iPS:435515 | 21-225_157E4 | AA | DIQMTQSPSSLSASVGDRVTITCRASQNISSYLN WYQLKPGKAPKLLIYTASSLQSGVPSRFSGSGSG TDFTLTISSLQPEDFATYYCQQSYNTPTWTFGQG TKVEIK SEQ ID NO: 26328 | EVQLLESGGGLVQPGGSLRLSCAASEFTFSTYAMS WVRQAPGKGLEWVSVISGSGGSTYYADSVKGRFTI SRDNSKNTLYLQMNSLRAEDTAVYYCAKRSSGWY EDALDIWGQGTMVTVSS SEQ ID NO: 30334 |
| | | NA | GACATCCAGATGACCCAGTCTCCATCCTCACT GTCTGCATCTGTAGGAGACAGAGTCACCTTCA CTTGTCGGGCGAGTCAGGGCATTAGCAATTAT TTAGCCTGGTTTCAGCAGAAACCAGGGAGAGC CCCTAAGTCCCTGATCTATGCTGCATCCAGTT GCGAAGTGGGGTCCCATCACAGTTCAGCGGCA GTGGATCTGGGACAGATTTCACTCTCACCATC AACAGCCTGCAACAGTATCATAGTTATCATTCAC TTACTGCCAACAGTATCATAGTTATCATTCAC TTTCGGCCCTGGGACCAAAGTGGATATCAAA SEQ ID NO: 26329 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATACCAT GAACTGGGTCCGCCAGGCTCCAGGGAAGGGGCT GGAGTGGGTCTCATCCATTAGTGGTAGTAGTAGT TACATATACTACGCAGACTCAGTGAAGGGCCGAT TCACCATCTCCAGAGACAACGCCAAGAACTCACT GTATCTGCAAATGAACAGCCTGAAAGCCGAGGA CACGGCTGTGTATTACTGTGCGAGAGTAGCTACC TTTGACTACTGGGGCCAGGGAACCCTGGTCACCG TCTCCTCA SEQ ID NO: 30335 |
| | | AA | DIQMTQSPSSLSASVGDRVTITCRASQGISNYLA WFQQKPGRAPKSLIYAASSLRSGVPSQFSGSGSG TDFTLTINSLQPEDFATYYCQQYHSYPFTFGPGT KVDIK SEQ ID NO: 26330 | EVQLVESGGGLVKPGGSLRLSCAASGFTFSSYTMN WVRQAPGKGLEWVSSISGSSSYIYYADSVKGRFTIS RDNAKNSLYLQMNSLKAEDTAVYYCARVATFDY WGQGTLVTVSS SEQ ID NO: 30336 |

FIGURE 50
(Continued)

| | | | |
|---|---|---|---|
| iPS:435521 | 21-225_157H4 | NA | GACATCCAGATGACCCAGTCTCCATCCTCCCT GTCTGCATCTGTAGGAGACAGAGTCACCATCA CTTGCCGGGCAAGTCAGGGACATTAGAAATGAT TTAGGCTGGTATCAGCAGAAACCAGGGAAAG CCCCTAAAGCGCCTGATCTATCCTGCATCCAGTT TACAAACTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGGATATAGTTACCCATTC ACTTTCGGCCCTGGGACCAAAGTGGATATCAA A<br>SEQ ID NO: 26331 | GAGGTGCAGCTGGTGGAGTCTGGGGGAGGCTG GTCAAGCCTGGGGGGTCCCTGAGACTCTCCTGTG CAGCCCTCTGGATTCACCTTCAGTAGTTATAGCAT GAACTGGGTCCGCCAGGCTCCAGGGAAGGGGCT GGAGTGGGTCTCATCCATTAGTAGTAGTAGTACT TACATATACTAGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGATAGAGGG TCCATCTGGGGCCAGGGAACCCTGGTCACCGTCT CCTCA<br>SEQ ID NO: 30337 |
| | | AA | DIQMTQSPSSLSASVGDRVTITCRASQGIRNDLG WYQQKPGKAPKRLIYPASSLQTGVPSRFSGSGSG TEFTLTISSLQPEDFATYYCLQDNSYPFTFGPGTK VDIK<br>SEQ ID NO: 26332 | EVQLVESGGGLVKPGGSLRLSCAASGFTFSSYSMN WVRQAPGKGLEWVSSISSSSTYIYYADSVKGRFTIS RDNAKNSLYLQMNSLRAEDTAVYYCARDRGSIWG QGTLVTVSS<br>SEQ ID NO: 30338 |
| iPS:435523 | 21-225_157G5 | NA | GACATCCAGATGACCCAGTCTCCATCCTCACT GTCTGCATCTGTAGGGACAGAGTCACCATCA CTTGTCGGGCGAGTCAGGGACATTAACAATTAT TTAGCCTGGTTTCAGCAGAAACCAGGGAAAGC CCCTGAGTCCCTGATCTATGCTGCATCCAGTTT ACAAAGTGGGGTCCCATCACAGTTCAGCGGCA GTGGATCTGGGACAGATTTCACTCTCACCATC AGCAGCCTGCAGCCTGAAGATTTTGCAACTTA TACTGCCAACAGTATATAGTTATCCATTCA CTTTCGGCCCTGGGACCAAAGTGGATATCAAA<br>SEQ ID NO: 26333 | GAGGTGCAGCTGTTGGAGTCTGGGGGAGGCTTG GTACAGCCGGGGGGTCCCTGAGACTCTCCTGTG CAGCCTCTGGATTCACCTTTAGTAGTATGTCAT GAGCTGGGTCCGCCAGGCTCCAGGGAAGGGACT GGAGTGGGTCTCAGCTATGAGTGGTAGTGGTGGT AGAACATACTACGCAGACTCCGTGAAGGGCCGG TTCACCATCTCCAGAGACAATTCAAGAACACGC TGTATCTGCAAATGAACAGCCTGAGAGCCGAGG ACACGGCCGTGTATTACTGTGCGAAGTATACCTG GAACGGCTACTGGGGCCAGGGAACCCTGGTCAC CGTCTCCTCA<br>SEQ ID NO: 30339 |

FIGURE 50
(Continued)

| | | | | |
|---|---|---|---|---|
| | | AA | DIQMTQSPSSLSASVGDRVTITCRASQGINNYLA WFQQKPGKAPESLIY AASSLQSGVPSQFSGSGSG TDFTLTISSLQPEDFATYYCQQYNSYPFTFGPGT KVDIK SEQ ID NO: 26334 | EVQLLESGGGLVQPGGSLRLSCAASGFTFSSYVMS WVRQAPGKGLDWVSAMSGSGGRTYYADSVKGRF TISRDNSKNTLYLQMNSLRAEDTAVYYCAKYTWN GYWGQGTLVTVSS SEQ ID NO: 30340 |
| iPS:435525 | 21-225_157E7 | NA | GACATCCAGATGACCCAGTCTCCATCCTCCCT GTCTGCATCTGTAGGAGACAGAGTCACCATCA CTTGCCGGGCAAGTCAGAGCTTTAGCAGCTAT TTAAATTGGTATCAGCAGAAACCAGGGATAGC CCCTAAACTCCTGATCTATGCTGCATCCAGTTT GCAAAGTGGGGTCCCATCAAGGTTCAGTGGCA GTGGATCTGGGACAGATTTCACTCTCACCATC AGCAGTCTGCAACCTGAAGAGTTATCCGCTTCG CCTTCGGCCAAGGGACACGACTGGAGATTAAA SEQ ID NO: 26335 | CAGTCTGCACCTGCAGGAGTCGGGCCCAGGACTG GTGAAGCCTTCGGAGACCCCTGTCCCTCACCTGCA CTGTCTCTGGTGGCTCCATCAGCAGTGGTAGTTA CTACTGGGGCTGGATCCGCCAGCCCCCAGGGAA GGGACTGGAGTGGATTGGGAGTATCTACTATAGT GGGAGCACCTACTACAATCGTCCCTCAAGAGTC GAGTCACCATATCCGTAGACACGTCCAAGAACC AGTTCTCCCTGAACCTGAGCTCTGTGACCGCCGC AGACACGGCTGTCTATTACTGTGCGAGACATAAA GTGGCTGGTCCCTTTGACTACTGGGGCCAGGGAA CCCTGGTCACCGTCTCCTCA SEQ ID NO: 30341 |
| | | AA | DIQMTQSPSSLSASVGDRVTITCRASQSFSSYLN WYQQKPGIAPKLLIY AASSLQSGVPSRFSGSGSG TDFTLTISSLQPEDFATYYCQESYSIRFAFGQGTR LEIK SEQ ID NO: 26336 | QLHLQESGPGLVKPSETLSLTCTVSGGSISSGSYYW GWIRQPPGKGLEWIGSIYYSGSTYYNPSLKSRVTIS VDTSKNQFSLNLSSVTAADTAVYYCARHKVAGPF DYWGQGTLVTVSS SEQ ID NO: 30342 |

FIGURE 50
(Continued)

| | | | |
|---|---|---|---|
| iPS:435527 | 21-225_157G7 | NA | GACATTCAGATGACTCAGTCTCCATCTCCCT GTGTGCATCAGTAGGAGACAGAGTCACCATCA CTTGCCGGGCAAGTCAGGGCATTAGAAATGAT TTAGGCTGGTATCAGCAGAAACCAGGGAAAG CCCCTAAGCGCTTGATCAATGTTGCATCCAGT TTGCAAAGTGGGGTCCCATCAAGGTTCAGTCGGG CAGTGGATCTGGGACAGATTCACTCTCACAA TCAGCAGCGTGCAGCGTGAAGATTTTGCAACT TATTACTGTATACAGGATATAGTCACCCATT CACTTTCGGCCCTGGGACCAAAGTGGAAATCA AA | GAGGTGCAACTGGTGGAGTCTGGGGGAGGCCTG GTCAAGCCTGGGGGGTCCCTGAGATTCTCCTGTG CAGCCTCTGGATTCACCTTCAGTAGTTATAGCAT GAACTGGGTCCGCCAGGCTCCAGGGAAGGGCT GGAGTGGGTCTCATCCATTAGTGGTAGTAGTACG TACATATACTACGCAGACTCAGTGAAGGGCCGAT TCACCATCTCCAGAGACAAGCCAAGAACTCACT GTATCTGCAAATGAACAGCCTGAGAGCCGAAGA CACGGCTGTGTATTACTGTGCGAGAGATCGGGGC AGCAGCTGGGGCCAGGGAACCCTGGTCACCGTC TCCTCA |
| | | | SEQ ID NO: 26337 | SEQ ID NO: 30343 |
| | | AA | DIQMTQSPSSLSASVGDRVTITCRASQGIRNDLG WYQQKPGKAPKRLINVASSLQSGVPSRFSGSGS GTEFTLTISSVQREDFATYYCIQDNSHPFTFGPGT KVEIK | EVQLVESGGGLVKPGGSLRFSCAASGFTFSSYSMN WVRQAPGKGLEWVSSISGSSTYYYADSVKGRFTIS RDNAKNSLYLQMNSLRAEDTAVYYCARDRGSSW GQGTLVTVSS |
| | | | SEQ ID NO: 26338 | SEQ ID NO: 30344 |
| iPS:435529 | 21-225_157H7 | NA | GACATCCAGATGACCCAGTCTCCATCCTCACT GTCTGCATCTGTAGGAGACAGAGTCACCATCA CTTGTCGGGCGAGTCAGGACATTAGCAATTTT TTAGCCTGGTTTCAGCAGAAACCAGGGAAAGC CCCTAAGTCCCTGATCTCTACTGCATCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAGTATCATAGTTACCCGATCA CCTTCGGCCAAGGGACACGACTGGAGATTAAA | GAGGTGCAGCTGGTGGAGTCTGGGGGAGGCCTG GTCAAGCCTGGGGGGTCCCTGAGACTCTCCTGTG CAGCCTCTGGATTCACATTCAGTAGCTATAGCAT GAACTGGGTCCGCCAGGCTCCAGGGAAGGGCT AGAGTGGGTCTCATGCATTAGTGGTAGTAGTAGT TACATATATTACGCAGACTCAGTGAAGGGCCGAT TCACCATGTCCAGAGACAACGCCAAGAACTCACT GTATCTGCAAATGAACAGCCTGAGAGCCGAGGA CACGGCTGTGTATTACTGTGTGAGAGATCGAGGG GGCTATTGGGGCCAGGGAACCCTGGTCACCGTCT CCTCA |
| | | | SEQ ID NO: 26339 | SEQ ID NO: 30345 |

FIGURE 50
(Continued)

| | | | |
|---|---|---|---|
| iPS:435531 | 21-225_157G8 | AA | DIQMTQSPSSLSASVGDRVTITCRASQDISNFLAWFQQKPGKAPKSLVSTASSLQSGVPSKFSGSGSGTDFTLTISSLQPEDFATYYCQQYHSYPITFGQGTRLEIK<br>SEQ ID NO: 26340 | EVQLVESGGGLVKPGGSLRLSCAASGFTFSSYSMNWVRQAPGKGLEWVSCISGSSSYIYYADSVKGRFTMSRDNAKNSLYLQMNSLRAEDTAVYYCVRDRGGYWGQGTLVTVSS<br>SEQ ID NO: 30346 |
| | | NA | GATATTGTGATGACCCAGACTCCACTCTCTCTGTCCGTCACCCCTGGACAGCCGGCCTCCATCTCCTGCAAGTCTAGTCAGAGCCTCCTGCATGGTGATGGAAAGACCTATTTATATTGGTACCTGCAGAAGCCAGGCCAGTCTCCACAACTCCTGATCTATGAAAATTTCCAAGCGGTTCTCTGGAGTGCCAGATAGGTTCAGTGGCAGCGGGTCAGGGACAGATTTCACACTGAAAATCAGCCGGGTGGAGGCTGAGGATGTTGGGGTTTACTACTGCATGCAAAGTATACAGGTTCCGTGGACGTTCGGCCAAGGGACCAAGGTGAAAATCAAA<br>SEQ ID NO: 26341 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAATTATGGCATGCACTGGGTCCGCCAGGCTCCAGGCAAGGGGCTGGAGTGGGTGGCAATTATATGGTATGATGGAAGTATAAATACTATGCAGACTCCGTGAAGGGCCGATTCACCGTCTCCAGAGACAATTCCAAGAACACGCTGTATCTGCAAATGAACAGCCTGAGAGCCGAGGACACGGCTGTGTATTACTGTGCGAGAGATACGATTTTTGGAGTGGTTTCTTGACTCTGGGCCACAGGGAACCCTGGTCACCGTCTCCTCA<br>SEQ ID NO: 30347 |
| | | AA | DIVMTQTPLSLSVTPGQPASISCKSSQSLLHGDGKTYLYWYLQKPGQSPQLLIYEISKRFSGVPDRFSGSGSGTDFTLKISRVEAEDVGVYYCMQSIQVPWTFGQGTKVEIK<br>SEQ ID NO: 26342 | QVQLVESGGGVVQPGRSLRLSCAASGFTFSNYGMHWVRQAPGKGLEWVAIIWYDGSYKYYADSVKGRFTVSRDNSKNTLYLQMNSLRAEDTAVYYCAREGYDFWSGFFDSWGQGTLVTVSS<br>SEQ ID NO: 30348 |

FIGURE 50
(Continued)

| | | | |
|---|---|---|---|
| iPS:435533 | 21-225_157H8 | NA | GACATCCAGATGACCCAGTCTCCATCCTCCCT GTCTGCATCTGTAGGAGACAGAGTCACCATCA CTTGCCGGGCAAGTCAGGCATTAGAAATGAT TAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGACTTCACTCTCACAA TCAGCAGCCTGCAGCCTGATGACTTTGCAACT TATTACTGTCTACAGCATAATAGTTACCCATTC ACTTTCGGCCCTGGGACCAAAGTGGATATCAA A SEQ ID NO: 26343 | CAGGTGCAGCTGGTGGAGTCTGGGGGAGGCGTG GTCCAGCCTGGGGAGGTCCCTGAGACTCTCCTGTG CAGGCGTCTGGATTCACCTTCAGTAGCTATGGCAT GCACTGGGTCCGCCAGGCTCCAGGCAAGGGGCT GGAGTGGGTGGCTGTGTATATGGTATGATGTAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGCTGGG GTTCCTCTGACTACTGGGGCCAGGGAACCCTG GTCACCGTCTCCTCA SEQ ID NO: 30349 |
| | | AA | DIQMTQSPSSLSASVGDRVTITCRASQGIRNDLG WYQQKPGKAPKRLIYAASSLQSGVPSRFSGSGS GTDFTLTISSLQPDDFATYYCLQHNSYPFTFGPG TKVDIK SEQ ID NO: 26344 | QVQLVESGGGVVQPGRSLRLSCAASGFTFSSYGMH WVRQAPGKGLEWVAVIWYDVNKYYADSVKGRF TISRDNSKNTLYLQMNSLRAEDTAVYYCARELGFL SDYWGQGTLVTVSS SEQ ID NO: 30350 |
| iPS:435535 | 21-225_157H10 | NA | GACATCCAGATGACCCAGTCTCCATCCTCACT GTCTGCATCTGTAGGAGACAGAGTCACCATCA CTTGTCGGGCGAGTCAGGGCATTAGGCATTCA TTAGCCTGGTTTCAGCAGAAACCAGGGAAAGC CCCTAAGTCCCTGATCTATACTGCATCCAATTT GCAAAGTGGGGTCCCATCAAAGTTCAGCGGCA GTGGATCTGGGACAGATTTCACTCTCACCATC AGCAGCCTGCAGCCTGAACAGTATCATAGTTA TTACTGCCAACAGTATCATAGTTACCCATTCA CTTTCGGCCCTGGGACCAAAGTGGATATCAAA SEQ ID NO: 26345 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATACCAT GAACTGGGTCCGCCAGGCTCCAGGGAAGGGGCT GGAGTGGGTCTCATCATTAGTAGTGGTAGCAGTAGT TACATAAACTACGCAGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCGAGAGTGGCTCA CTTTGACTACTGGGGCCAGGGAACCCTGGTCACC GTCTCCTCA SEQ ID NO: 30351 |

FIGURE 50
(Continued)

| | | | | |
|---|---|---|---|---|
| | | | AA | DIQMTQSPSSLSASVGDRVTITCRASQGITNYLA WFQQKPGKAPKSLIYTASNLQSGVPSKFSGSGSG TDFTLTISSLQPEDFATYYCQQYHSYPFTFGPGT KVDIK<br>SEQ ID NO: 26346 | EVQLVESGGGLVKPGGSLRLSCAASGFTFSSYTMN WVRQAPGKGLEWVSSISGSSSYINYADSVKGRFTIS RDNAKNSLYLQMNSLRAEDTAVYYCARVAHFDY WGQGTLVTVSS<br>SEQ ID NO: 30352 |
| iPS:435537 | 21-225_157H12 | | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTTGGCTGTATCAGCAGAAGCCAGGAAAGC CCCTAAGTCCCTGATTCATGCTGCATCCAGTTT ACAGAGTGGGGTCCCATCAAGGTTCAGCGGCA GTGGATCTGGGACAGAATTCACTCTCACAATC AGCAGCCTGCAGCCTGAAGATTTTGCAACTTA TTACTGTCTACAGCATTATAGTTACCCATTCAC TTTCGGCCCTGGGACCAAAGTGGATATCAAA<br>SEQ ID NO: 26347 | GAGGTGCAGTGGGTGGAGTCTGGGGGAGGCCTG GTCAAGCCTGGGGGGTCCCTGAGACTCTCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTGGTAGT TACATAAACTACGCAGACTCAGTGAAGGGCCGG TTCACCATCTCAGAGACAACGCCAAGACCTCAC TGTATCTGCAAGTGAACGGCCTGAGAGCGAGG ACACGGCTGTGTATTACTGTGCGAGATCCAAGTT TGACTCCTGGGGCCAGGGAACCCTGGTCACCGTC TCCTCA<br>SEQ ID NO: 30353 |
| | | | AA | DIQMTQSPSSLSASVGDRVTITCRASQGIRNDFG WYQQRPGKAPKCLIHAASSLQSGVPSRFSGSGS GTEFTLTISSLQPEDFATYYCLQHYSYPFTFGPGT KVDIK<br>SEQ ID NO: 26348 | EVQWVESGGGLVKPGGSLRLSCAASGFTFSSYSMN WVRQAPGKGLEWVSSISGSGSYINYADSVKGRFTIS RDNAKTSLYLQVNGLRAEDTAVYYCARSKFDSWG QGTLVTVSS<br>SEQ ID NO: 30354 |

FIGURE 50
(Continued)

| | | | |
|---|---|---|---|
| iPS:435539 | 21-225_158G1 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATACTGCATCCAAT TTGCAAAGTGGGGTCCCATCAAGGTTCAGGG CAGTGGATGTGGGACAGAATTCACTCTCACAG TCAGCAGCCTGCAGCTGAAGATTTTGCAACT TATTACTGTCTACAGCATAATAGTTACCCGTG GACGTTCGGCCAAGGGACCAAGGTGGAAATC AAA GAGGTGCAGCTGGTGGTGGAATCTGGGGGAGGCCTG GTCAAGCCTGGGGGGTCCCTGAGACTCTCCTGTG CAGCCTCTGGATTCACCTTCAGTAGTTATGGCAT GAACTGGGTCCGCCAGGCTCCAGGGAAGGGCT GGAGTGGATCTCATCCATTAGTAGTGGTAGTGGT TACATATACTACGCAGACTCAGTGAAGGGCCGAT TCACCATTTCCAGAGACAACGCCAAGAACTCACT GTATCTGCAAATGAACAGCCTGAGAGCCGAGGA CACGGCTGTGTATTACTGTGCGATTAGCAGTGGC TGGTCTTGGGGCCAGGGAACCCTGGTCACCGTCT CCTCA |
| | | | SEQ ID NO: 26349 | SEQ ID NO: 30355 |
| | | AA | DIQMTQSPSSLSASVGDRVTITCRASQGIRNDLG WYQQKPGKAPKRLIYTASNLQSGVPSRFSGSGC GTEFTLTVSSLQPEDFATYYCLQHNSYPWTFGQ GTKVEIK | EVQLVESGGGLVKPGGSLRLSCAASGFTFSSYGMN WVRQAPGKGLEWISSISGSGSYIYYADSVKGRFTIS RDNAKNSLYLQMNSLRAEDTAVYYCAISSGWSWG QGTLVTVSS |
| | | | SEQ ID NO: 26350 | SEQ ID NO: 30356 |
| iPS:435543 | 21-225_158D4 | NA | GACATCCAGATGACCCAGTCTCCATCTCCCCT GTCTGCATCTGTAGGAGACAGAGTCACCATCA CTTGCCGGGCAAGTCAGGACATTAGAAAGGAT TTAGGCTGGTATCAGCAGAAACCAGGGAAAG CCCCTAAGCGCCTGATCTATGCTGCATCCAGT TTGCAAAGTGGGGTGTCAGTTATATGGTCAGGGG CAGTGGATCTGGGACAGAATTCACTCTCACAT TCAGCAGCCTGCAGCCTGAAGATTTTGCAACT TATTACTGTCTACAGCATTATAGTTACCCCTGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCCGTCTGGATTCACCTTCAGTGACTATGTCAT GCACTGGGTCCGCCAGGCTCCAGGCAAGGGGCT GGAGTGGGTGTCAGTTATATGTCAGACAGACTCCGTGAAGGGCCGA AATAAATACTATGCAGACTCCGTGAAGGGCCGA TTCACCATCTCCAGAGACAATTCCAAGAACACAC TGTATCTGCAAATGAACAGCCTGAGAGCCGAGG ACACGGCTGTGTATTACTGTGCGAGAGAACCGTA TACTAGTGGCTGGTACGACTACGGTATGGACGTC TGGGGCCAAGGGACCACGGTCACCGTCTCCTCA |
| | | | SEQ ID NO: 26351 | SEQ ID NO: 30357 |

FIGURE 50
(Continued)

| | | | | |
|---|---|---|---|---|
| iPS-435545 | 21-225_158F4 | AA | DIQMTQSPSSLSASVGDRVTITCRASQDIRKDLG WYQQKPGKAPKRLIYAASSLQSGVPSRFSGSGS GTEFTLTFSSLQPEDFATYYCLQHYSYPRTFGQG TKVEIK<br>SEQ ID NO: 26352 | QVQLVESGGGVVQPGRSLRLSCAASGFTFSDYM HWVRQAPGKGLEWVSVIWYDGSNKYYADSVKGR FTISRDNSKNTLYLQMNSLRAEDTAVYYCAREPYT SGWYDYGMDVWGQGTTVTVSS<br>SEQ ID NO: 30358 |
| | | NA | GACATCCAGATGACCCAGTCTCCATCCTCCCT GCCTGCATCTGTAGGAGACAGAGTCACCATCA CTTGCCGGGCAAGTCAGAGACATTAGAAAGTAT TTACATTGGTATCAGTTCTTACCAGGAAAGC CCCTAAGCTCCTGATCTATACTGCATCCACTTT ACAAAGTGGGGTCCATCAAGGTTCAGTGGCA GCGGATCTGGGACAGATTTCACTCTCACCATC AGCAGTCTGCAACAGAGTTACAATTTCATTCA CTACTGTCAACAGAGTTACAATATTTCATTCA CTTTCGGCCCTGGGACCAAAGTGGATATCAAA<br>SEQ ID NO: 26353 | CAGGTGCAGCTGCAGGAGTCGGGCCCAGGACTG GTGAAGCCTTCGGAGACCCTGTCCTCCACCTGCA CTGTCTCTGGTGGCTCCATCAGTAGTACTCTG GAGCTGGATCCGGCAGCCCGCCGGGAAGGGACT GGAGTGGATTGGCCGTATCTATACCAGTGGGACC ACCAACTACACCCCCTCCCTCAAGAGTCGAGTCA CCATGTCAGTAGACACGTCCAAGAACCAGTTCTC CCTGAAGCTGAGCTCTGTGACCGCCGCGACACG GCCGTGTATTACTGTGCGAGATTGAGCAGTGGCT GGTTTGACTACTGGGGCCAGGGAACCCTGGTCAC CGTCTCCTCA<br>SEQ ID NO: 30359 |
| | | AA | DIQMTQSPSSLPASVGDRVTITCRASQNIRKYLH WYQFLPGKAPKLLIYTASTLQSGVPSRFSGSGSG TDFTLTISSLQPEDFATYYCQQSYNISFTFGPGTK VDIK<br>SEQ ID NO: 26354 | QVQLQESGPGLVKPSETLSLTCTVSGGSISSHFWSW IRQPAGKGLEWIGRIYTSGTTNYTPSLKSRVTMSVD TSKNQFSLKLSSVTAADTAVYYCARLSSGWPDYW GQGTLVTVSS<br>SEQ ID NO: 30360 |

FIGURE 50
(Continued)

| | | | |
|---|---|---|---|
| iPS:435547 | 21-225_158F5 | NA | GACATTCAGATGACCCAGTCTCCATCCTCCCT GTCTGCATCTGTAGGAGACAGAGTCACCATCA CTTGCCGGGCAAGTCAGGACATTAGAAATGAT TTAGGCTGGTATCAGCAGAAACCAGGAAAAG CCCCTAAGCGCCTGATCAATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGGATAATAGTCACCCATT CACTTTCGGCCCTGGGACCAAAGTGGAAATCA AA<br>SEQ ID NO: 26355 | GAGGTGCAACTGGTGGAGTCTGGGGGAGGCCTG GTCAAGCCTGGGGGGTCCCTGAGATTCTCCTGTG CAGCCTCTGGATTCACCTTCAGTAGTTATAGCAT GAACTGGGTCCGCCAGGCTCCAGGGAAGGGGCT GGAGTGGGTCTCATCCATTAGTGGTAGTAGTACG TACATATACTACGCAGAGTCAGTGAAGGGCCGAT TCACCATCTCCAGAGACAACGCCAAGAACTCACT GTATCTGCAAATGAACAGCCTGAGAGCCGAAGA CACGGCTGTGTATTACTGTGCGAGAGATCGGGGC AGCAGCTGGGCCAGGGAACCCTGGTCACCGTC TCCTCA<br>SEQ ID NO: 30361 |
| | | AA | DIQMTQSPSSLSASVGDRVTITCRASQGIRNDLG WYQQKPGKAPKRLINAASSLQSGVPSRFSGSGS GTEFTLTISSLQPEDFATYYCLQDNSHPFTFGPGT KVEIK<br>SEQ ID NO: 26356 | EVQLVESGGGLVKPGGSLRFSCAASGFTFSSYSMN WVRQAPGKGLEWVSSISGSSTYYYADSVKGRFTIS RDNAKNSLYLQMNSLRAEDTAVYYCARDRGSSW GQGTLVTVSS<br>SEQ ID NO: 30362 |
| iPS:435549 | 21-225_158H5 | NA | GACATCCAGATGATCCAGTCTCCATCCTTCCT GTTTGCATCTGTAGGAGACAGAGTTACCATCA CTTGCCGGGCAAGTCAGGGCATGAGAATTGAT TTAGGGTGGTATCAGCAGAAACCAGGGAAAAG CCCCTAAGCGCCTGATTTATCGTGCATCCAGT TGCAAAGTGGGGTCCATCAAGGTTCAGCGGC AGTGGATGTGGGACAGAATTCACTCTCACAAT CAGCAGCGTGCAGCGTGAAGATTTTGCAAGTT ATTACTGTCTGTACAGCATAATAGTTACCCTCTC ACTTTCGCGGAGGGACCAAGGTGGAGATCA AA<br>SEQ ID NO: 26357 | GAGGTGCAACTGGTGGAGTCTGGGGGAGGCCTG GTCAAGCCTCTGGGTTCACCTTCAGTAGCTATAGCAT GAACTGGGTCCGCCAGGCTCCAGGGAAGGGGCT GGAGTGGGTCTCATCCATCAGTGGTAGTAGTACT TACATATACTACGCAGAGACAACGCCAAGAACTCACT GCATCTGCAAATGAACAGCCTGAGAGCCGAGGA CACGGCTGTGTATTACTGTGCGAGAGATCGGGGC AGCAGCTGGGGCCAGGGAACCCTGGTCACCGTC TCCTCA<br>SEQ ID NO: 30363 |

FIGURE 50
(Continued)

| | | | | |
|---|---|---|---|---|
| iPS-435551 | 21-225_158H6 | AA | DIQMIQSPSFLFASVGDRVTITCRASQGMRIDLG WYQQKPGKAPKRLIYRASSLQSGVPSRFSGSGC GTEFTLTISSVQREDFASYYCVQHNSYPLTFGGG TKVEIK<br><br>SEQ ID NO: 26358 | EVQLVESGGGLVKPGGSLRLSCAASGFTFSSYSMN WVRQAPGKGLEWVSSISGSSTYYYADSVKGRFTIS RDNAKNSLHLQMNSLRAEDTAVYYCARDRGSSW GQGTLVTVSS<br><br>SEQ ID NO: 30364 |
| | | NA | GACATCCAGATGACCCAGTCTCCATCCCT GTCTGCATCTGTAGGAGACAGAGTCACCATCA CTTGCCGGGCAAGTCAGGGCATTAGAAGTGAT TTAGGCTGGTATCAGCAGAAACCAGGGAAAG CCCCTAAGCGCCTGATCTATACTGCATCCAGT TTGCAAAGTGGGGTCCCATCAAGGTTCAGCGG CAGTGGATCTGGGACAGAATTCACTCTCACAA TCAGCAGCCTGCAGCTGAAGATTTTGCAACT TATTACTGTGTCTACAGCATAATAGTTACCCATTC ACTTTCGGCCCTGGGACCAAAGTGGACATCAA A<br><br>SEQ ID NO: 26359 | CAGGTGCAGCTGGTGGAGTCTGGGGGAGGCGTG GTCCAGCCTGGGGAGGTCCCTGAGACTCTCCTGTG CAGTGTCTGTGATTCACCTTCAGTAGCTATGCAT GCACTGGGTCCGCCAGGCTCCAGGCAAGGGGCT GGAGTGGGTGGCAGTTATATGTGATGGTAACT AATAAATACTATGCAGACTCCGTGAAGGGCCGA TTCACCATCTCCAGAGACAATTCCAAGAACACGC TGTATCTGCAAATGAACAGCCTGAGAGACGAGG ACACGGCTGTGTATTATTGTGTAGAGAACTGGG ATGGGCGGAGGACTACTGGGGCCAGGGAACCCT GGTCACCGTCTCCTCA<br><br>SEQ ID NO: 30365 |
| | | AA | DIQMTQSPSSLSASVGDRVTITCRASQGIRSDLG WYQQKPGKAPKRLIYTASSLQSGVPSRFSGSGSG TEFTLTISSLQPEDFATYYCLQHNSYPFTFGPGTK VDIK<br><br>SEQ ID NO: 26360 | QVQLVESGGGVVQPGRSLRLSCAVSGFTFSSYGMH WVRQAPGKGLEWVAVIWYDVTNKYYADSVKGRF TISRDNSKNTLYLQMNSLRDEDTAVYYCVRELGW AEDYWGQGTLVTVSS<br><br>SEQ ID NO: 30366 |

FIGURE 50
(Continued)

| | | | |
|---|---|---|---|
| iPS:435553 | 21-225_158G8 | NA | GACATCGTGATGACCCAGTCTCCATCCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATGTATACTGCATCCAGT TTGCAAAGTGGGGTCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A<br><br>SEQ ID NO: 26361 | GAGGTGCAGCTGGTGGAGTCTGGGGGAGGCTG GTCACGCCTGGGGGGTCCCTGAGACTCTCCTGTG CAGCCTCTGGATTCACCTTCAGTAGCTATACCAT GAACTGGGTCCGCCAGGCTCCAGGGAAGGGCT GGAGTGGGTCTCATTGATTAGTGGCAGTAGTGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGATCGAGGC AGCCTCTGGGGCCAGGGAACCCTGGTCACCGTCT CCTCA<br><br>SEQ ID NO: 30367 |
| | | AA | DIQMTQSPSSLSASVGDRVTITCRASQDIRNDLG WYQQKPGKAPKRLMYTASSLQSGVPSRFSGSGS GTEFTLTISSLQPEDFATYYCLQHNSYPFTFGPGT KVDIK<br><br>SEQ ID NO: 26362 | EVQLVESGGGLVTPGGSLRLSCAASGFTFSSYTMN WVRQAPGKGLEWVSLISGSSSYIYYADSVKGRFTIS RDNAKNSLYLQMNSLRAEDTAVYYCARDRGSLW GQGTLVTVSS<br><br>SEQ ID NO: 30368 |
| iPS:435557 | 21-225_158B12 | NA | GACATCGTGATGACCCAGTCTCCAGACTCCCC GGCTGTGTCTCTGGGCGAGAGGGCCACCATCA ACTGCAAGTCCAGCCAGAATGTTTTACACAGC TCCAACAATAACAATACTTAACTTGGTACCA GCAGAGACCAGGACAGCCTCCTAAGTTGCTCA TTTACTGGGCATCTACCCGGGAATCCGGGGTC CCTGACCGATTCAGTGGCAGCGGGTCTGGGAC AGAATTCACTCTCACCATCAGCAGCCTGCAGG CTGAAGATGTGGCAGTTTATTACTGTCAGCAA TATTATAGTACTCCTCCCGACGTTCGGCCAAGG GACCAAGGTGGAAATCAAA<br><br>SEQ ID NO: 26363 | CAGGTGCAGCTGGTGCAGTCTGGGGCTGAGGTG AGGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGCACCCTAACAGTGG TAACACAGGCTATGCACAGAAGTTCCAGGGCAG ATTCACCATGACCAGGAACACCTCCATAAGCACA GCCTACATGGAGCTGAGCAGCCTGAGATCTGAG GACACGGCCGTGTATTACTGTGCCTATAGCAGTG GCTGGTACCGCTTTGACTACTGGGGCCAGGGAAC CCTGGTCACCGTCTCCTCA<br><br>SEQ ID NO: 30369 |

FIGURE 50
(Continued)

| | | | | |
|---|---|---|---|---|
| iPS:435559 | 21-225_158H12 | AA | DIVMTQSPDSPAVSLGERATINCKSSQNVLHSSN NNNYLTWYQQRPGQPPKLLIYWASTRESGVPDR FSGSGSGTEFTLTISSLQAEDVAVYYCQQYYSTP PTFGQGTKVEIK SEQ ID NO: 26364 | QVQLVQSGAEVRKPGASVKVSCKASGYTFTNYDIN WVRQATGQGLEWMGWMHPNSGNTGYAQKFQGR FTMTRNTSISTAYMELSSLRSEDTAVYYCAYSSGW YRFDYWGQGTLVTVSS SEQ ID NO: 30370 |
| | | NA | GACATCCAGATGACCCAGTCTCCATCCTCACT GTCTGCATCTGTAGGAGACAGAGTCACCATCA CTTGTCGGGCGAGTCAGGGCATTAACAATTAT TTAGCCTGGTTTCAGCAGAAACCAGGAAAGC CCCTAAGTCCCTGATCTCTGTCGCATCCAGTTT ACAAAGTGGGGTCCCATCAAAGTTCAGCGGCA GTGGATCTGGGACAGATTTCACTCTCAGTATC AGCAGCCTACAGCCTGAAGATTTTGCAACTTA TTACTGTCAACAGTATCATAGTTACCCATTCAC TTTCGGCCCTGGGACCAAGGTGGATATCAAA SEQ ID NO: 26365 | GAGGTGCAGCTGGTGGAGTCTGGGGGAGGCTTG GTACAGCCTGGGGGGTCCCTGAGACTCTCCTGTG CAGCCTCTGGATTCACCTTTAGCAGCTATGTCAT GAGCTGGGTCCGCCAGGCTCCAGGGAAGGGCT GGAGTGGGTCTCAGTATTAGTGGTAGTGGTGGT AGGACAGACTACGCAGACTCCGTAAAGGGCCGG TTCACCATCTCCAGAGACAATTCCAAGAACACGC TGTATCTGCAAATGAACAGCCTGAGAGCCGAGG ACACGGCCGTATATTACTGTGCGAAAGGGGGCT GGAACACGACTGGGGCCAAGGGACCACGGTCA CCGTCTCCTCA SEQ ID NO: 30371 |
| | | AA | DIQMTQSPSSLSASVGDRVTITCRASQGINNYLA WFQQKPGKAPKSLISAASSLQSGVPSKFSGSGSG TDFTLTISSLQPEDFATYYCQQYHSYPFTFGPGTK VDIK SEQ ID NO: 26366 | EVQLVESGGGLVQPGGSLRLSCAASGFTFSSYVMS WVRQAPGKGLEWVSAISGSGGRTDYADSVKGRFTI SRDNSKNTLYLQMNSLRAEDTAVYYCAKGGWNH DWGQGTTVTVSS SEQ ID NO: 30372 |

FIGURE 50
(Continued)

| | | | |
|---|---|---|---|
| iPS:435561 | 21-225_159F1 | NA | GACATCCAGATGACCCAGTCTCCATCTCCT GTCTGCATCGGTAGGAGACAGAGTCACCATCA CTTGCCGGGCAAGTCAGCGCGTCAGAAATGAT TTAGGCTGGTATCAGCAGAAACCAGGGAAAG CCCCTAAGGCGCATCATTTTCGATGCATCCAAT TGCAAAGTGGGGTCCCATCAAGGTTCAGCGGC AGTGGATCTGGACAGAATTCACTCTCACAAT CAGCAGCCTGCAGCCTGAAGATTTTGCAACTT ATTACTGTCTACAGCATCATAGTTTCCGATCA CCTTCGGCCAAGGGACCCGACTGGAGATTAAA<br><br>SEQ ID NO: 26367 | GAGGTGCAGCTGGTGGAGTCTGGGGGAGGCTG GTCAAGCCGGGGGGGTCCCTGAGACTCTCCTGTG CAGCCTCTGGATTCACCTTCAGTAGCTATAGAAT GAACTGGGTCCGCCAGGCTCCAGGGAAGGGCT GGAGTGGGTCTCATCATAAGTGGTAGTGGTAAT TACATAGACTACGCAGACTCAGTGAAGGGCCGA TTCACCATCTCAAATGAACAGCCAAGAACTCAC TGTATCTGCAAATGAACAGCCTGAGAGCCGAGG ACACGGCTGTGTATTACTGTGCGAGAGGTTGGGA CGTCTGGGGCCAAGGGACCACGGTCACCGTCTCC TCA<br><br>SEQ ID NO: 30373 |
| | | AA | DIQMTQSPSSLSASVGDRVTITCRASQRVRNDLG WYQQKPAKAPKRIIFDASNLQSGVPSRFSGSGSG TEFTLTISSLQPEDFATYYCLQHHSFPITFGQGTR LEIK<br><br>SEQ ID NO: 26368 | EVQLVESGGGLVKPGGSLRLSCAASGFTFSSYRMN WVRQAPGKGLEWVSSISGSGNYIDYADSVKGRFTI SRDNAKNSLYLQMNSLRAEDTAVYYCARGWDVW GQGTTVTVSS<br><br>SEQ ID NO: 30374 |
| iPS:435563 | 21-225_159H2 | NA | GACATCCAGTTGACCCAGTCTCCATCTCCCT GTCTGCATCTGTAGGAGACAGAGTCACCATCA CTTGCCGGGCAAGTCAGAGAGCATTAGCAAATAT TTAAATTGGTATCAGCAGAAACCAGGGAAAG CCCCTGAACTCCTGATCTATGCTACATCCAATT TGCAAAGTGGGGTCCCATCAAGGTTCAGTGGC AGTGGATCTGGGACAGATTTCACTCTCACCAT CAGCACTCTGCAACCTGAAGATTTTGTAACTT ACTACTGTCAACAGAGTTACAGTCTCCCGGTC ACTTTCGGCGGAGGGACCAAGGTAGAGATCA AA<br><br>SEQ ID NO: 26369 | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGGC TTGAGTGGATGGGATGGATGAACCCTAACAGTG GTAACACAGGCTATGTACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCGAGAAAGA AAACTGGGGACTACTGGGGCCAGGGAACCCTGG TCACCGTCTCCTCA<br><br>SEQ ID NO: 30375 |

FIGURE 50
(Continued)

| | | | |
|---|---|---|---|
| iPS-435565 | 21-225_159C4 | AA | DIQLTQSPSSLSASVGDRVTITCRASQSISKYLNW YQQKPGKAPELLIYATSNLQSGVPSRFSGSGSGT DFTLTISTLQPEDFVTYYCQQSYSLPVTFGGGTK VEIK<br><br>SEQ ID NO: 26370 | QVQLVQSGAEVKKPGASVKVSCKASGYTFTSYDIN WVRQATGQGLEWMGWMNPNSGNTGYVQKFQGR VTMTRNTSISTAYMELSSLRSEDTAVYYCARKKTG DYWGQGTLVTVSS<br><br>SEQ ID NO: 30376 |
| | | NA | GACATCCAGATGACCCAGTCTCCATCTCCCT GTCTGCATCTGTAGGAGACAGAGTCACCATCA CTTGCCAGGCGAGTCAGGACATTAGCGACTAT TTAAATTGGTATCAACAGAAACCAGGGAAAG CCCCTAAACTCCTGATCTACGATGCCTCCACTT TGGAAACAGGGGTCCCATCAAGGTTCAGTGGA AGTGGATCTGGGACAGATTTTACTTTCACCAT CAGCAGCCTGCAGCCTGAAGATATTGCAACAT ATTTCTGTCAACAATATGATAATCTCCCGATC ACCTTCGGCCAAGGGACACGACTGGAGATTAA A<br><br>SEQ ID NO: 26371 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATCGAGACTCCGTGAAAC AATAAATACTATGCAGAGACAATTCAAGAACACGC TTCACCATCTCCAGAGACAATTCAAGAACACGC TGTATCTGCAGTTGAACAGCCTGAGAGCTGAGGA CATGGCTGTGTATTACTGTGCGAGACGGTATGGAC TCGTGGGGGCTACGGTATGGACGTCTGGGGC CACGGGACCACGGTCACCGTCTCCTCA<br><br>SEQ ID NO: 30377 |
| | | AA | DIQMTQSPSSLSASVGDRVTITCQASQDISDYLN WYQQKPGKAPKLLIYDASTLETGVPSRFSGSGS GTDFFTFTISSLQPEDIATYFCQQYDNLPITFGQGT RLEIK<br><br>SEQ ID NO: 26372 | QVQLVESGGGVVQPGRSLRLSCAASGFTFSNYGM HWVRQAPGKGLEWVAVISYSGNNKYYADSVKGR FTISRDNSKNTLYLQLNSLRAEDMAVYYCARRSSS WGGYGMDVWGHGTTVTVSS<br><br>SEQ ID NO: 30378 |

FIGURE 50
(Continued)

| | | | | |
|---|---|---|---|---|
| iPS:435569 | 21-225_159C5 | NA | GACATCCAGATGACCCAGTCTCCATCCTCCCT GTCTGCATCTGTAGGAGACAGAGTCACCATCA CTTGCCGGACAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGACTTCACTCTCACAA TCATCAGCCTGCAGCCTGATGACTTTGCAACT TATTACTGTCTACAGCATAATAGTTATCCATTC ACTTTCGGCGGCCCTGGGACCAAAGTGGATATCAA A<br><br>SEQ ID NO: 26373 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT ACACTGGGTCCGCCAGGCTCCAGCAAGGGGCT GGAGTGGGTGGCTGTTGTATGGTATGATGTAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGCTGGG GTTCCTCTCTGACTACTGGGGCCAGGGAACCCTG GTCACCGTCTCCTCA<br><br>SEQ ID NO: 30379 |
| | | AA | DIQMTQSPSSLSASVGDRVTITCRTSQGIRNDLG WYQQKPGKAPKRLIYAASSLQSGVPSRFSGSGS GTDFTLTIISLQPDDFATYYCLQHNSYPFTFGPGT KVDIK<br><br>SEQ ID NO: 26374 | QVQLVESGGGVVQPGRSLRLSCAASGFTFSSYGIH WVRQAPGKGLEWVAVVWYDVNKYADSVKGR FTISRDNSKNTLYLQMNSLRAEDTAVYYCARELGF LSDYWGQGTLVTVSS<br><br>SEQ ID NO: 30380 |
| iPS:435571 | 21-225_159C8 | NA | GACATCCAGATGACCCAGTCTCCATCCTCCCT GTCTGCATCTGTAGGAGACAGAGTCACCATCA CTTGCCGGGCAAGTCAGGACATTAGGAAAGGAT CAGCGGTTGGTATCAGCAGAAACCAGGGAAAG CCCCTAACCTGCTGATCTATGCTGCATCCAGTT TGCAAAGTGGGGTCCCATCAAGGTTCAGCGGC AGTGGATCTGGGACAGAATTCACTCTCACATT CAGCAGCCTGCAGCCTGAAGATTTTGCAACTT ATTACTGTCTACAGCATCATAGTTATCCTCCGG ACGTTCGGCCAAGGGACCAAGGTGGAAATCA AA<br><br>SEQ ID NO: 26375 | CAGGTGCAACTGGTGGAGTCTGGGGGAGGCGTG GTCCAGCCTGGGAGGTCCCTGAGACTCTCCTGTG CAGCGTCTGGATTCACCTTTAGTGACTATGTCAT GCAGTGGGTCCGCCAGGCTCCAGGCAAGGGGCT GGAGTGGGTGGCAGTTATATCGAGACTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACCGTA TAATAGTGGCTGGTACGACTACGGTATGGACGTC TGGGGCCAAGGGACCACGGTCACCGTCTCCTCA<br><br>SEQ ID NO: 30381 |

FIGURE 50
(Continued)

| | | | | |
|---|---|---|---|---|
| | | AA | DIQMTQSPSSLSASVGDRVTITCRASQDIRKDLG WYQQKPGKAPNRLIYAASSLQSGVPSRFSGSGS GTEFTLTFSSLQPEDFATYYCLQHHSYPRTFGQG TKVEIK SEQ ID NO: 26376 | QVQLVESGGGVVQPGRSLRLSCAASGFTFSDYVM QWVRQAPGKGLEWVAVIWYDGSNKYYADSVKGR FTISRDNSKNTLYLQMNSLRAEDTAVYYCAREPYN SGWYDYGMDVWGQGTTVTVSS SEQ ID NO: 30382 |
| iPS:435573 | 21-225_159D8 | NA | GACATCCAGATGACCCAGTCTCCATCCTCCCT GTCTGCATCTGTTGGAGACAGAGTCACCATCA CTTGCCGGGCAAGTCGGGACATTGGAAATGAT TTAGGCTGGTATCAGCAGAAACCAGGGAAAG CCCCTAAGCGCCTGATCTCTGCTGCATCCAGTT TGCAAAGTGGGGTCCCATCAAGGTTCAGCGGC AGTGGATCTGGGACAGAATTCACTCTCACATT CAGCAGCCTGCAGCCTGAAGATTTTGCAACTT ATTACTGTCTACAGCATTATAGTTACCCTCGG ACGTTCGGCCAAGGGACCAAGGTGGAAATCA AA SEQ ID NO: 26377 | CAGGTGCAGCTGGTGGAGTCTGGGGGAGGCGTG GTCCAGCCTGGGAGGTCCCTGAGACTCTCCTGCG CAGCCGTCTGGATTCACCTTCAGTAACTATGTCAT GCACTGTGTCCGCCAGGCTCCAGGCAAGGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACCGTA TAGTAGTGGCTGGTACGACTACGGTATGGACGTC TGGGGCCAAGGGACCACGGTCACCGTCTCCTCA SEQ ID NO: 30383 |
| | | AA | DIQMTQSPSSLSASVGDRVTITCRASRDIGNDLG WYQQKPGKAPKRLISAASSLQSGVPSRFSGSGSG TEFTLTFSSLQPEDFATYYCLQHYSYPRTFGQGT KVEIK SEQ ID NO: 26378 | QVQLVESGGGVVQPGRSLRLSCAASGFTFSNYVM HCVRQAPGKGLEWVAVIWYDGSNKYYADSVKGR FTISRDNSKNTLYLQMNSLRAEDTAVYYCAREPYS SGWYDYGMDVWGQGTTVTVSS SEQ ID NO: 30384 |

FIGURE 50
(Continued)

| | | | |
|---|---|---|---|
| iPS:435575 | 21-225_159H11 | NA | GACATCCAGATGACCCAGTCTCCATCCTCACT GTCTGCATCTGTAGGAGACAGAGTCACCATCA CTTGTGTGGGGCGAGTCAGGGCATTAGCAAATAT TTAGTCTGGTTTCAGCAGAAACCAGGGAAAGC CCCTAAGTCCCTGATCTATGCTGCATCCAGTCT GCAAAGTGGGGTCCCATCAAAGTTCAGCGGCA GTGGATCTGGGACAGATTTCACTCTCACCATC AGCAACCTGCAGCCTGAAGATTTTGCAACTTA TTACTGCCAACAGTATATAGTTACCCATTCA CTTTCGGCCCTGGGACCAAAGTGGATATCAAA <br> SEQ ID NO: 26379 | GAGGTGCAGCTGGTGGAGTCTGGGGGAGGCTG GTCAAGCCTGGGGGGTCCCTAAGACTCTCCTGTG CAGCCTCTGGATTCACCTTCAGTAGCTATACCAT GAACTGGGTCCGCCAGGCTCCAGGGAAGGGGCT GGAGTGGGTCTCATCATTAGTGGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CGGGCTGTATATTACTGTGCGCAGTGAGCTGG GCTGACTGCTGGGGCCAGGGAACCCTGGTCACC GTCTCCTCA <br> SEQ ID NO: 30385 |
| | | AA | DIQMTQSPSSLSASVGDRVTITCRASQGISKYLV WFQQKPGKAPKSLIYAASSLQSGVPSKFSGSGSG TDFTLTISNLQPEDFATYYCQQYYSYPFTFGPGT KVDIK <br> SEQ ID NO: 26380 | EVQLVESGGGLVKPGGSLRLSCAASGFTFSSYTMN WVRQAPGKGLEWVSSISGSSSYIYYADSVKGRFTIS RDNAKNSLYLQMNSLRAEDTAVYYCARVSWADC WGQGTLVTVSS <br> SEQ ID NO: 30386 |
| iPS:435577 | 21-225_160B1 | NA | GATATTGTGATGACCCAGACTCCACTCTCTCT GTCCGTCACCCCTGGACAGCCGGCCTCCATCT CCTGCAAGTCTAGTCAGAGCCTCCTGCATGGT GATGGGAAGACCTATTTCTATTGGTACCTGCA GAAGCCAGGCCAGCCTCCACAGGTCCTGATCT ATGAAGTATCCAAGCGGTTCTCTGGAGTGTCA GAAAGGTTCAGTGGCAGCGGGTCAGGGACAG ATTTCACACTGAAAATCAGCCGGGTGGAGGCT GAGGATGTTGGGGTTTATTACTGCATGCAAAG TATACAGATTCCGTGACGTTCGGCCAAGGGA CCAAGGTGGAAATCAAA <br> SEQ ID NO: 26381 | CAGGTGCAGCTGGTGGAGTCTGGGGGAGGCGTG GTCCAGCCTGGGAGGTCCCTGAGACTCTCCTGTG CAGCGGTCTGGATTCACCTTCAGTAGCTATGGCAT GCACTGGGTCCGCCAGGCTCCAGGCAAGGGGCT GGAGTGGGTGGCAGTTATATCGATGGTGGAAGT TATAAATACTATGCAGACTCCGTGAAGGGCCGAT TCACCATCTCCAGAGACAATTCCAAGAACACGCT GTATCTTCAAATGAACAGCCTGAGAGCCGAGGA CACGGCTGTGTATTACTGTGCGAGAGAGGCCTAC GATTTTTGGAGTGGTTATTATGACTACTGGGGCC AGGGAACCCTGGTCACCGTCTCCTCA <br> SEQ ID NO: 30387 |

FIGURE 50
(Continued)

| | | | |
|---|---|---|---|
| | | AA | DIVMTQTPLSLSVTPGQPASISCKSSQSLLHGDG KTYFYWYLQKPGQPPQVLIYEVSKRFSGVSERFS GSGSGTDFTLKISRVEAEDVGVYYCMQSIQIPWT FGQGTKVEIK<br>SEQ ID NO: 26382 | QVQLVESGGGVVQPGRSLRLSCAASGFTFSSYGMH WVRQAPGKGLEWVAVIWYDGSYKYYADSVKGRF TISRDNSKNTLYLQMNSLRAEDTAVYYCAREAYDF WSGYYDYWGQGTLVTVSS<br>SEQ ID NO: 30388 |
| iPS:435579 | 21-225_160G1 | NA | GACATCCAGATGACCCAGTCTCCATCTCGCT GTCTGCCTCTGTAGGAGACAGAGTCACCATCA CTTGTCGGGCGAGTCAGGACATTAACAATTAT TTAGCCTGGTTTCAGCAGAAACCAGGAAAAGC CCCTACGTCCCTGATCTATGCTTCATCCAGTTT GCAAAGTGGGGTCCCATCAAGGTTCAGCGGCA GTGGATCTGGGACAGATTTCACTCTCACCATC AGCAGCCTGCAGCCTGAAGATATAGTTACCTA TTACTGCCAACAATATCATAGTTACCCATTCA CTTTCGGCCCTGGGACCAAAGTGGATATCAGA<br>SEQ ID NO: 26383 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGTCAT GAGCTGGGTCCGCCAGGCTCCAGGGAAGGGGCT GGAGTGGGTCTCAGTATGAGTGGTAGTGGTGGT CACACATACTACGCAGACTCCGTGAAGGGCCGG TTCACCATCTCCAGAGACAATTCCAAGAACACGG TGTATCTGCAAATGAACAGCCTGAGAGCCGAGG ACACGGCCGTATATTACTGTGTGAAACATGGATA CAGCTGGGGCCAGGGAACCCTGGTCACCGTCTCC TCA<br>SEQ ID NO: 30389 |
| | | AA | DIQMTQSPSSLSASVGDRVTITCRASQDINNYLA WFQQKPGKAPTSLIYASSSLQSGVPSKFSGSGSG TDFTLTISSLQPEDFATYYCQQYHSYPFTFGPGT KVDIR<br>SEQ ID NO: 26384 | EVQLLESGGGLVQPGGSLRLSCAASGFTFSSYVMS WVRQAPGKGLEWVSAMSGSGGHTYYADSVKGRF TISRDNSKNTVYLQMNSLRAEDTAVYYCVKHGYS WGQGTLVTVSS<br>SEQ ID NO: 30390 |

FIGURE 50
(Continued)

| | | | |
|---|---|---|---|
| iPS:435581 | 21-225_160H1 | NA | GACATCCAGATGACCCAGTCTCCATCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGCTGCATCCAGT TTGCAGAATGGGGTCCCATCAAGGTTCAGTG CAGTGGATCTGGGACAGATTCACTCTCACAA TCAGCAGCCTGCAGCCTGAAGATTTTACAACT TATTACTGTCTACAGCATAATAGTTTCCCGTGG ACGTTCGGCCAAGGGACCAAGGTGGAAATCA AA SEQ ID NO: 26385 | GAGGTGCAGCTGGTGGAGTCTGGGGGAGGCCTG GTCAAGCCTGGGGGGTCCCTGAGACTCTCCTGTG CAGCCCTCTGATTCACCTTCAGTAGTACTATGCAT GAACTGGGTCCGCCAGGCTCCAGGGAAGGGGCT GGAGTGGGTCTCATCATTAGTAGTAGTACTGGT TACATGTACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTTCTGTGCGAGAGATAAAGAT TACTGGGGCCAGGGAACCCTGGTCACCGTCTCCT CA SEQ ID NO: 30391 |
| | | AA | DIQMTQSPSSLSASVGDRVTITCRASQDIRNDLG WYQQKPGKAPKRLIYAASSLQNGVPSRFSGSGS GTEFTLTISSLQPEDFTTYYCLQHNSFPWTFGQG TKVEIK SEQ ID NO: 26386 | EVQLVESGGGLVKPGGSLRLSCAASGFTFSSYRMN WVRQAPGKGLEWVSSISSSTGYMYYADSVKGRFTI SRDNAKNSLYLQMNSLRAEDTAVYFCARDKDYW GQGTLVTVSS SEQ ID NO: 30392 |
| iPS:435583 | 21-225_160F2 | NA | GACATCCAGATGACCCAGTCTCCATCTCCCT GTCTGCATCTGTAGGAGACAGAGTCACCATCA CTTGCCGGGCAAGTCAGGCATTAGAAATGAT TTAGGCTGGTATCAGCAGAAACCAGGGAAAG CCCCTAAGCGCCTGATCTATACTGCATCCAAT TTGCAAAGTGGGGTCCCATCAAGGTTCAGCG CAGTGGATCTGGGACAGATTCACTCTCACAG TCAGCAGCCTGCAGCCTGAAGATTTTGCAACT TATTACTGTCTACAGCATAATAGTTACCCGTG GACGTTCGGCCAAGGGACCAAGGTGGAAATC AAA SEQ ID NO: 26387 | GAGGTGCAGCTGGTGGAATCTGGGGGAGGCCTG GTCAAGCCTGGGGGGTCCCTGAGACTCTCCTGTG CAGCCTCTGGATTCACCTTCAGTAGTTATGGCAT GAACTGGGTCCGCCAGGCTCCAGGGAAGGGGCT GGAGTGGATCTCATCATTAGTAGTGGTAGTGGTAGT TACATATACTACGCAGACTCAGTGAAGGGCCGAT TCACCATTTCCAGAGACAACGCCAAGAACTCACT GTATCTGCAAATGAACAGCCTGAGAGCCGAGGA CACGGCGTGTGTATTACTGTGCGATTAGCAGTGGC TGGTCTTGGGGCCAGGGAACCCTGGTCACCGTCT CCTCA SEQ ID NO: 30393 |

FIGURE 50
(Continued)

| | | | | |
|---|---|---|---|---|
| iPS:435585 | | AA | DIQMTQSPSSLSASVGDRVTITCRASQGIRNDLG WYQQKPGKAPKRLIYTASNLQSGVPSRFSGSGS GTEFTLTVSSLQPEDFATYYCLQHNSYPWTFGQ GTKVEIK<br>SEQ ID NO: 26388 | EVQLVESGGGLVKPGGSLRLSCAASGFTFSSYGMN WVRQAPGKGLEWISSISGSGSYIYYADSVKGRFTIS RDNAKNSLYLQMNSLRAEDTAVYYCAISSGWSWG QGTLVTVSS<br>SEQ ID NO: 30394 |
| | 21-225_160G3 | NA | GACATCCAGATGACCCAGTCTCCATCCTCGCT GTCTGCCTCTGTAGGAGACAGAGTCACCATCA CTTGTCGGGCGAGTCAGGACATTAACAATTAT TTAGCCTGGTTTCAGCAGAAGACCAGGGAAAGC CCCTACGTCCCTGATCTATGCTTCATCCAGTTT GCAAAGTGGGGTCCCATCAAAGTTCAGCGGCA GTGGATCTGGGACAGATTTCACTCTCACCATC AGCAGCCTGCAGCCTGAACAATATCATAGTTA TTACTGCCAACAATATCATAGTTACCCATTCA CTTTCGGCCCTGGGACCAAAGTGGATATCAAA<br>SEQ ID NO: 26389 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGTCAT GAGCTGGGTCCGCCAGACTCCAGGGAAGGGACT GGAGTGGGTCTCAGCTATGAGTGGTAGTGGTGGT CACACATACTACCGAGACTCCGTGAAGGGCCGG TTCACCATCTCCAGAGACAATTCCAAGAACACGC TGTATCTGCAAATGAACAGCCTGAGAGCCGAGG ACACGGCCATATATTACTGTGTGAAACATGGATA CAGCTGGGGCCAGGGAACCCTGGTCACCGTCTCC TCA<br>SEQ ID NO: 30395 |
| | | AA | DIQMTQSPSSLSASVGDRVTITCRASQDINNYLA WFQQRPGKAPTSLIYASSSLQSGVPSKFSGSGSG TDFTLTISSLQPEDFATYYCQQYHSYPFTFGPGT KVDIK<br>SEQ ID NO: 26390 | EVQLLESGGGLVQPGGSLRLSCAASGFTFSSYVMS WVRQTPGKGLEWVSAMSGSGGHTYYADSVKGRF TISRDNSKNTLYLQMNSLRAEDTAIYYCVKHGYSW GQGTLVTVSS<br>SEQ ID NO: 30396 |

FIGURE 50
(Continued)

| | | | |
|---|---|---|---|
| iPS:435587 | 21-225_160H3 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATTTATGCTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATATGTCCGCTC ACTTTCGGCGGAGGGACCAAGGTGGAGAGCA AA<br>SEQ ID NO: 26391<br>DIQMTQSPSSLSASVGDRVTITCRASQGIRNDLG WYQQKPGKAPKRLIYAASSLQSGVPSRFSGSGS GTEFTLTISSLQPEDFATYCLQHSNYPLTFGGG TQVESK<br>SEQ ID NO: 26392 | CAGGTGCAGCTGCAGGAGTCGGGCCCAGGACTG GTGAAGCCTTCGGAGACCCTGTCCCTCACCTGCA CCGTCTCTGGTGGCTCCATCAGCAGAAGTAGTTA CTACTGGGGCTGGATCCGCCAGCCCCCAGGGAA GGGACTGGAGTGGATTGGGAGTATCATTATAGT GGGAGTACCTCCTACAACCCGTCTCTCGAGATC GAGTTACCATATCGTAGACACGTCAAGAACCA GTTCTCCCTGAAGCTGAGCTCTGTGACCGCCGCC GACACGGCTGTGTTTACTGTGCGAGACTCTC AACGGTGGGACTTTGACTACTGGGGCCAGGGAA CCCTGGTCACCGTCTCCTCA<br>SEQ ID NO: 30397<br>QLQLQESGPGLVKPSETLSLTCTVSGGSISRSSYYW GWIRQPPGKGLEWIGSIYYSGSTSYNPSLESRVTISV DTSKNQFSLKLSSVTAADTAVFYCARLSQRWDFDY WGQGTLVTVSS<br>SEQ ID NO: 30398 |
| iPS:435589 | 21-225_160A4 | NA | GACATCGTGATGACCCAGTCTCCAGACTCCCT GGCTGTGTCTCTGGGCGAGAGGGCCACCATCA ACTGCAAGTCCAGCCAGAGTGTTTTACACGAA TCCAACAATAATAACTACTTAGCTTGGTACCA GCAGAAACCAGGACAGCCTCCTAAGCTACTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAATAGTCCGTCGACGTTTTGGCCAGGG GACCAAGCTGGAGATCAAA<br>SEQ ID NO: 26393 | CAGGTGCAGCTGGTGCAGTCTGGGACTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGAC CTGAGTGGATGGGATGGATGCACCCTAACAGTG GTAACACAGGCTATCCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCGTATAGCAG CGGCTGGTACATTTTGACTACTGGGGCCAGGGA ACCCTGGTCACCGTCTCCTCA<br>SEQ ID NO: 30399 |

FIGURE 50
(Continued)

| | | | |
|---|---|---|---|
| | | AA | DIVMTQSPDSLAVSLGERATINCKSSQSVLHSSN NNNYLAWYQQKPGQPPKLLIYWASTRESGVPD RFSGSGSGTDFTLTISSLQAEDVAVYYCQQYYNS PCSFGQGTKLEIK<br>SEQ ID NO: 26394 | QVQLVQSGTEVKKPGASVKVSCKASGYTFTNYDIN WVRQATGQPEWMGWMHPNSGNTGYPQKFQGR VTMTRNTSISTAYMELSSLRSEDTAVYYCAYSSGW YIFDYWGQGTLVTVSS<br>SEQ ID NO: 30400 |
| iPS:435591 | 21-225_160C4 | NA | GACATCCAGATGACCCAGTCTCCATCCTCCCT GTCTGCATCTGTAGGAGACAGAGTCACCATCA CTTGCCGGGCAAGTCAGGACATTAGAAAGGAT TTAGGGTGGTATCAGCAGAAACCAGGGAAAG CCCCTAAGCGCCTGATCTATGCTGCATCCAGTT TGCAAAGTGGGGTCCCATCAAGGTTCAGCGGC AGTGGATCTGGGACAGAATTCACTCTCACATT CAGCAGCCTGCAGCCTGAAGATTTTGCAACTT ATTACTGTCTACAGCATTATAGTTATCTCCGA CGTTCGGCCAAGGGACCAAGGTGGAAATCAA A<br>SEQ ID NO: 26395 | CAGGTGCAACTGGTGCAGTCTGGGGGAGGCGTG GTCCAGCCTGGGAGGTCCCTGAGACTCTCCTGTG CAGCGTCTGGATTCACCTTTAGTGACTATGTCAT GCAGTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACCGTA TAATAGTGGCTGGTACGACTACGGTATGGACGTC TGGGGCCAAGGGACCACGGTCACCGTCTCCTCA<br>SEQ ID NO: 30401 |
| | | AA | DIQMTQSPSSLSASVGDRVTITCRASQDIRKDLG WYQQKPGKAPNRLIYAASSLQSGVPSRFSGSGS GTEFTLTFSSLQPEDFATYYCLQHYSYPRTFGQG TKVEIK<br>SEQ ID NO: 26396 | QVQLVESGGGVVQPGRSLRLSCAASGFTFSDYVM QWVRQAPGKGLEWVAVIWYDGSNKYYADSVKGR FTISRDNSKNTLYLQMNSLRAEDTAVYYCAREPYN SGWYDYGMDVWGQGTTVTVSS<br>SEQ ID NO: 30402 |

FIGURE 50
(Continued)

| | | | |
|---|---|---|---|
| iPS:435593 | 21-225_160F4 | NA | GACATTCAGATGACCCAGTCTCCATCTCCCC GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCTTGATCAATGTTGCATCCAGT TTGCAAAGTGGGGTCCCATCAAGGTTCAGCGG CAGTGGATCTGGGACAGCCTGAAATTCACTCTTACAA TCAGCAGCGTGCAGCCTGAAGATTTTGCAACT TATTACTGTATACAGGATATAATAGTCACCCATT CACTTTCGGCCCTGGGACCAAAGTGGAAATCA AA<br><br>SEQ ID NO: 26397 | GAGGTGCAACTGGTGGAGTCTGGGGGAGGCCTG GTCAAGCCTGGGGGGTCCCTGAGATTCTCCTGTG CAGCCTCTGGATTCACCTTCAGTAGTTATAGCAT GAACTGGGTCCGCCAGGCTCCAGGGAAGGGGCT GGAGTGGGTCTCATCCATTAGTGGTAGTAGTACG TACATATACTACGCAGACTCAGTGAAGGGCCGAT TCACCATCTCCAGAGACAACGCCAAGAACTCACT GTATCTGCAAATGAACAGCCTGAGAGCCGAAGA CACGGCTGTGTATTACTGTGCGAGAGATCGGGGC AGCAGCTGGGGCCAGGGAACCCTGGTCACCGTC TCCTCA<br><br>SEQ ID NO: 30403 |
| | | AA | DIQMTQSPSSSPSASVGDRVTITCRASQGIRNDLG WYQQKPGKAPKRLINVASSLQSGVPSRFSGSGS GTEFTLTISSVQPEDFATYYCIQDNSHPFTFGPGT KVEIK<br><br>SEQ ID NO: 26398 | EVQLVESGGGLVKPGGSLRFSCAASGFTFSSYSMN WVRQAPGKGLEWVSSISGSSTYIYYADSVKGRFTIS RDNAKNSLYLQMNSLRAEDTAVYYCARDRGSSW GQGTLVTVSS<br><br>SEQ ID NO: 30404 |
| iPS:435595 | 21-225_160H4 | NA | GACATCCAGATGACCCAGTCTCCATCCTCACT GTCTGCATCTGTAGGAGACAGAGTCACCATCA CTTGTCGGGCGAGTCAGGACATTAGTAATTAT TTAGTCTGGTTTCAGCAGAAATTAGGGAAAGC CCCTAAGTCCCTGATCTATGTTGCATCCAGTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAGAGTATATAATAGTTACCCTCTCA CTTTCGGCGGAGGGACCAAAGTAGAGATCAA A<br><br>SEQ ID NO: 26399 | GAGGTGCAGCTGGTGGAGTCTGGGGGAGGCCTG GTCAAGTCTGGGGGGTCCCTGAGACTCTCCTGTG CAGCCTCTGGATTCACCTTCAGTAGCTATAGGAT GAACTGGGTCCGCCAGGCTCCAGGGAAGGGGCT GGAGTGGGTCTCATCCATTAGTAGTGGTAGTAGT ACATAGACTACGCAGACTCAGTGAAGGGCCGA TTCACCATCCAGAGACAACGCCAAGAACTCAC TGTATCTGCAAATGAACAGCCTGAGAGCCGAGG ACACGGCTGTATTACTGTGCGAGAAAGAGTTG GTTTGACTACTGGGGCCAGGGAACCCTGGTCACC GTCTCCTCA<br><br>SEQ ID NO: 30405 |

FIGURE 50
(Continued)

| | | AA | DIQMTQSPSSLSASVGDRVTITCRASQDISNYLVWFQQKLGKAPKSLIYVASSLQSGVPSRFSGSGSGTDFTLTISSLQPEDFATYYCQQYNSYPLTFGGGTKVEIK | EVQLVESGGGLVKSGGSLRLSCAASGFTFSSYRMNWVRQAPGKGLEWVSSISGSSSYIDYADSVKGRFTISRDNAKNSLYLQMNSLRAEDTAVYYCARKSWFDYWGQGTLVTVSS |
| | | | SEQ ID NO: 26400 | SEQ ID NO: 30406 |
| iPS:435599 | 21-225_160B10 | NA | GACATCCAGATGACCCAGTCTCCATCCTCCCCGTCTGCATCTGTAGGAGACAGAGTCACCATCACTTGCCGGGCAAGTCAGGGCATTAGAAATGATTTAGGCTGGTATCAGCAGAAACCAGGACAGCCCCTAAGCGCCTTATCTATGCTGCATCCAGTTTGCAAAGTGGGGTCCCATCAAGGTTCAGCGGCAGTGGATCTGGGACAGAATTCACTCTCACAATCAGCAACCTGCAGCCTGAAGATAGTTGCAACTTATTACTGTCTACAGCATAGTAGTTACCCGCTCACTTTCGGCGGCGGGACCAAGGTGGAGATCAAA | CAGCTGCAGCTGCAGGAGTCGGGCCAGGACTGGTGAAGCCTTCGGAGACCCTGTCCTCACCTGCACTGTCTCTGGTGGCTCCATCAGTAGAAGTAGCTACTACTGGGGCTGATCCGCCAGTACCCAGGGAAGGGCTGGAGTGGATTGGGAATATCTATTATAGTGGGAGCGCCTACCACCATTCGTCCCTCAAGAGTCGAGTCACCATATCCGTAGACACGTCCAAGAACCAGTTCTCCCTGAAGTTGAACTCTGTGTGTGAGACGCCGCAGACACGGCTGTGTATTACTGTGTGAGACATGACCCAAACTGGGGAGTTGACTACTGGGGCCAGGAAACCCTGGTCACCGTCTCCTCA |
| | | | SEQ ID NO: 26401 | SEQ ID NO: 30407 |
| | | AA | DIQMTQSPSSPSASVGDRVTITCRASQGIRNDLGWYQQKPGTAPKRLIYAASSLQSGVPSRFSGSGSGTEFTLTISNLQPEDFATYYCLQHSSYPLTFGGGTKVEIK | QLQLQESGPGLVKPSETLSLTCTVSGGSISRSSYYWGWIRQYPGKGLEWIGNIYYSGSAYHIPSLKSRVTISVDTSKNQFSLKLNSVTAADTAVYYCVRHDPNWGVDYWGQGTLVTVSS |
| | | | SEQ ID NO: 26402 | SEQ ID NO: 30408 |

FIGURE 50
(Continued)

| | | | |
|---|---|---|---|
| iPS:435601 | 21-225_160G10 | NA | GCTATTGTGATGACCCAGACTCCACTCTCTG TCCGTCACCCTGGACAGCAGGCCTCCATCTC CTGCAAGTCTAGTCAGAGCCTCCTGCACGTG ATGGAAAGACCTATTTGTATTGGTACCTGCAG AAGCCAGGCCAGCCTCCACACCTCCTGATCTA TGAAGTTTCAAACGGTTCTCTGGAGTGCCAG ATAGGTTCAGTGGCAGCGGGTCAGGGACAGA TTTCACACTGAAAATCAGCGGGTGGAGGCTG AGGATGTTGGGCTTTATTACTGCATGCAAAGT ATACAGCTTCCGTGACGTTGTCAAGGGAC CAAGGTGGAAATCACA<br>SEQ ID NO: 26403 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTTTGGCAT GCACTGGGTCCGCCAGGCTCCAGGCAAGGGCCT GGAGTGGGTGGCAGTCATATGGTATGATGGAAG TTATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGTTGGTAT AGAAGTGGCTGGTGACTACTACTTCGGTATGGAA GTCTGGGGCCAAGGGACCACGGTCACCGTCTCCT CA<br>SEQ ID NO: 30409 |
| | | AA | AIVMTQTPLSLSVTPGQPASISCKSSQSLLHGDG KTYLYWYLQKPGQPPHLLIYEVSKRFSGVPDRFS GSGSGTDFTLKISRVEAEDVGLYYCMQSIQLPW TFVQGTKVEIT<br>SEQ ID NO: 26404 | QVQLVESGGGVVQPGRSLRLSCAASGFTFSSFGMH WVRQAPGKGLEWVAVIWYDGSYKYYADSVKGRF TISRDNSKNTLYLQMNSLRAEDTAVYYCARVGIEV AGDYYFGMEVWGQGTTVTVSS<br>SEQ ID NO: 30410 |
| iPS:435605 | 21-225_161A4 | NA | GAAATAGTGATGACGCAGTCTCCAGCCACCCT GTCTGTGTCTCCAGGGGAAAGAGCCTCCCTCT CCTGCAGGTCCAGTCAGAGTGTTAACAGCAAC TTAGCCTGGTACCAGCAGAAGCCTGGCCAGGC TCTCAGGCTCCTCATCTATGGTGCATCCATCAG GGCCACTGGTATCCCAGCCAGGTTCAGTGGCA GTGGGTCTGGGACAGAGTTCACTCTCACCATC AGCAGCCTGCAGTCTGAAGATTTTGCAGTTTA TTTCTGTCAGCAGTATAATAACTGGTGACGT TCGGCCAAGGGACCAAGGTGGAAATCAAA<br>SEQ ID NO: 26405 | GAGGTGCAGCTGGTGGAGTCTGGAGGAGGCTTG ATCCAGCCTGGGGGGTCCCTGAGACTCTCCTGTG CAGCCTCTGGGTTCACCGTCAGTAGCAACTACAT GAGCTGGGTCCGCCAGGCTCCAGGGAAGGGGCT GGAGTGGGTCTCAGTTATTATACCGGTGGTAGC ACATACAACGACAGACTCCGTGAAGGGCCGATTC ACCATCTCCAAATGAACAGCTGAGAGCCGAGGACA ATCTTCAAATGAACAGCTGAGAGCCGAGGACA CGGCCGTGTATTACTGTGCGAGAAATTGGGAAT GGCTGGCCCCTTTGACTACTGGGGCCAGGGAACC CTGGTCACCGTCTCCTCA<br>SEQ ID NO: 30411 |

FIGURE 50
(Continued)

| | | | | |
|---|---|---|---|---|
| iPS:435607 | 21-225_161G4 | AA | EIVMTQSPATLSVSPGERASLSCRSSQSVNSNLA WYQQRPGQALRLLIYGASIRATDIPARFNGSGSG TEFTLTISSLQSEDFAVYFCQQYNNWWTFGQGT TVEIK<br><br>SEQ ID NO: 26406 | EVQLVESGGGLIQPGGSLRLSCAASGFTVSSNYMS WVRQAPGKGLEWVSVIYTGGSTYNADSVKGRFTIS RDNSKNTLYLQMNSLRAEDTAVYYCARNWGMAG PFDYWGQGTLVTVSS<br><br>SEQ ID NO: 30412 |
| | | NA | GACATCCAGATGACCCAGTCTCCATCCTCCCT GTCTGCATCTGTAGGAGACAGAGTCACCATCA CTTGCCAGGCGAGTCAGGACATTTACAATTAT TTAAATTGGTATCAGCAGAAACCAGGGAAAG CCCCTAAGCTCCTGATCTACGATGCATCCAAT TTGGAAACAGGGGTCCCATCAAGGTTCAGTGG AAGTGGATCTGGGACAGATTTTACTTTCGCCA TCAGCAGCCTGCAGCCTGAAGATATTGCAACA TATTACTGTCAACAGTATGATATTCTCCCGATC ACCTTCGGCCAAGGGACACGACTGGAGATTAA A<br><br>SEQ ID NO: 26407 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATCATATGGTGGAAGT AATAAATACCATGCAGACTCCGTGAAGGGCCGA TTCACCATCTCCAGAGACACAATTCCAAGAACGC TGTATCTGCAAATGAACAGCCTGAGAGCTGAGG ACACGGCTGTGTATTACTGTGTGAGACGGAGCAG CTCGTCTGGGGGCTACGGTATGGACGTCTGGGGC CAAGGGACCACGGTCACCGTCTCCTCA<br><br>SEQ ID NO: 30413 |
| | | AA | DIQMTQSPSSLSASVGDRVTITCQASQDIYNYLN WYQQKPGKAPKLLIYDASNLETGVPSRFSGSGS GTDFTFAISSLQPEDIATYYCQQYDILPITFGQGT RLEIK<br><br>SEQ ID NO: 26408 | QVQLVESGGGVVQPGRSLRLSCAASGFTFSSYGMH WVRQAPGKGLEWVAVISYGGSNKYHADSVKGRFT ISRDNSKNTLYLQMNSLRAEDTAVYYCVRRSSSSG GYGMDVWGQGTTVTVSS<br><br>SEQ ID NO: 30414 |

FIGURE 50
(Continued)

| | | | |
|---|---|---|---|
| iPS:435609 | 21-225_161F7 | NA | GACATCCAGATGACCCAGTCTCCATCCTCCT GTCTGCATCTGTAGGCGACAGAGTCACCATCA CTTGCCGGGCAAGTCAGGCGATTAGAAATGAT TTGGGCTGGTATCAGCAGAAACCAGGAGAAG CCCCTAAGCGCCTGATCTATGCTGCATCCACTT TGCAAAGTGGGGTCCCATGCGGTTCAGCGGC AGTGGATCTGGGGCAGAATTCACTGTCACAAT CGGCAGCGTGCAGCGTGAAGATTTTGCAACTT ATTACGGTCTACTATATTCGTTACCCATTCA CTTTTGGCCGTGGGACCAAAGTGGATATCAAA<br><br>SEQ ID NO: 26409 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTTTGGCT GCACTGGGTCCGCCAGGCTCCAGGCCAGGACT GGAGTGGGTGGCAGTTATATGGTTTGATGGAAGT AATAAATACTATGCAGACTCCGTGAAGGGCCGA TTCACCATTTCAGAGACAATTCCAAGAACACGC TGTATCTGCAAATGAACAGCTGAGAGCCGAGG ACACGGCTGTGTATTACTGTGCGAGAGAGATTGG CTGGCTCTCTGACTACTGGGGCCAGGGAACCCTG GTCACCGTCTCCTCA<br><br>SEQ ID NO: 30415 |
| | | AA | DIQMTQSPSSLSASVGDRVTITCRASQGIRNDLG WYQQKPGEAPKRLIYAASTLQSGVPSRFSGSGS GAEFTVTIGSVQREDFATYYGLLYIRYPFTFGRG TKVDIK<br><br>SEQ ID NO: 26410 | QVQLVESGGGVVQPGRSLRLSCAASGFTFSDFGLH WVRQAPGQGLEWVAVIWFDGSNKYYADSVKGRF TIFRDNSKNTLYLQMNSLRAEDTAVYYCAREIGWL SDYWGQGTLVTVSS<br><br>SEQ ID NO: 30416 |
| iPS:435611 | 21-225_161F10 | NA | GACATCCAGATGACCCAGTCTCCATCCTCCT GTCTGCATCTGTAGGAGACAGAGTCACCATCA CTTGCCAGGCGAGTCAGGACGTCATTACAACCAT TTAAGTTGGTATCAGCAGAAACCAGGGAAAG CCCCTAAGCTCCTGATCTACGATGCATCCAAT TGGGAAACAGGGGTCCCATCCAGGTTCAGTGG AGGTGGATCTGGGACAGATTTTACTTTCACCA TCAGCAGCCTGCAGCCTGAAGATTTTGCAACA TATTACTGTCAACAGTATGAAAATCTCCCGCT CACCTTCGGCGGAGGGACCAAGGTGGAGATC AAA<br><br>SEQ ID NO: 26411 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAATGGGTGGCAATTATATCAGACTCCGTGAAGA AATGATTCTATGCAGACTCCGTGAAGGGCCGAT TCACCATCTCCAGAGACAATTCCAAGAACACGCT GTATCTGCAAATGAACAGCTGAGAGCGTGAGA CACGGCTGTGTATTACTGTGCGAGACGTATAGCA GCAGCTGGTCACTACGGTATGGACGTCTGGGGCC AAGGGACCACGGTCACCGTCTCCTCA<br><br>SEQ ID NO: 30417 |

FIGURE 50
(Continued)

| | | | | |
|---|---|---|---|---|
| iPS:435613 | 21-225_161D11 | AA | DIQMTQSPSSLSASVGDRVTITCQASQDIYNHLS WYQQKPGKAPKLLIYDASNWETGVPSRFSGGGS GTDFTFTISSLQPEDFATYYCQQYENLPLTFGGG TKVEIK<br>SEQ ID NO: 26412 | QVQLVESGGGVVQPGRSLRLSCAASGFTFSSYGMH WVRQAPGKGLEWVAIISYSGRNDFYADSVKGRFTI SRDNSKNTLYLQMNSLRAEDTAVYYCARRIAAAG HYGMDVWGQGTTVTVSS<br>SEQ ID NO: 30418 |
| | | NA | GACATCCAGATGACCCAGTCTCCATCCTCCCT GTCTGCATCTGTAGGCGACAGAGTCACCATCA CTTGCCGGGCAAGTCAGGGACATTAGAAATGAT TTGGGCTGGTATCAGCAGAAACCAGGAAAG CCCCTAAGCGCCTGATCTATGCTGCATCCACTT TGCAAAGTGGGGTCCCATCGCGGTTCAGCGGC AGTGGATCTGGGACAGAATTCACTCTCACAAT CGGCAGCGTGCAGCGTGAAGATTTTGCAACTT ATTACGGTCTACAATATAATCGTTACCCATTC ACTTTTGGCCCTGGGACCAAAGTGGATATCAA A<br>SEQ ID NO: 26413 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCATG CACTGGGTCCGCCAGGCTCCAGGCAGGGACT GGAGTGGGTGGCAGTTATATGTTTGATGAAGT AATAAATACTATGCAGACTCCGTGAAGGGCCGA TTCACCATTTCAGAGACAATTCCAAGAACACGC TGTATCTGCAAATGAACAGCCTGAGAGCCGAGG ACACGGCTGTGTATTACTGTGCGAGAGAGATTGG CTGGCTCTCTGACTACTGGGGCCAGGGAACCCTG GTCACCGTCTCCTCA<br>SEQ ID NO: 30419 |
| | | AA | DIQMTQSPSSLSASVGDRVTITCRASQGIRNDLG WYQQKPGEAPKRLIYAASTLQSGVPSRFSGSGS GAEFTLTIGSVQREDFATYYGLQYNRYPFTFGRG TKVDIK<br>SEQ ID NO: 26414 | QVQLVESGGGVVQPGRSLRLSCAASGFTFSDFGLH WVRQAPGQGLEWVAVIWFDGSNKYYADSVKGRF TIFRDNSKNTLYLQMNSLRAEDTAVYYCAREIGWL SDYWGQGTLVTVSS<br>SEQ ID NO: 30420 |

FIGURE 50
(Continued)

| | | | |
|---|---|---|---|
| iPS:435615 | 21-225_161G12 | NA | GACATCCAGATGACCCAGTCTCCATCTCCCG<br>GTCTGCATCTGTAGGAGACAGAGTCACCATCA<br>CTTGCCGGGCAAGTCAGGACATTAGAAAGGAT<br>TTAGGGTGGTATCAGCAGAAACCAGGGAAAG<br>CCCCTAACCGCTGATCTATGCTGCATCCAGTT<br>TGCAAAGTGGGGTCCCATCAAGGTTCAGCGGC<br>AGTGGATCTGGGACAGAATTCACTCTCACATT<br>CAGCAGCCTGCAGCCTGAAGATTTTGCAACTT<br>ATTACTGTCTACAGCATCATAGTTATCCTCGG<br>ACGTTCGGCCAAGGGACCAAGGTGGAAATCA<br>AA<br><br>SEQ ID NO: 26415 | CAGGTGCAGCTGGTGGAGTCTGGGGGAGGCGTG<br>GTCCAGCCTGGGGAGGTCCCTGAGACTCTCCTGTG<br>CAGCGTCTGATTCACCTTAGTGACTATGTCAT<br>GCAGTGGGTCCGCCAGGCTCCAGGCAAGGGGCT<br>GGAGTGGGTGGCAGTTATATGGTATGATGGAAGT<br>AATAAATACTATGCAGACTCCGTGAAGGGCCGA<br>TTCACCATCTCAGAGACAATTCCAAGAACACGC<br>TGTATCTGCAAATGAACAGCCTGAGAGCCGAGG<br>ACACGGCTGTGTATTACTGTGCGAGAGAACGTA<br>TAATAGTGGCTGGTACGACTACGGTATGGACGTC<br>TGGGGCCAAGGGACCACGGTCACCGTCTCCTCA<br><br>SEQ ID NO: 30421 |
| | | AA | DIQMTQSPSSRSASVGDRVTITCRASQDIRKDLG<br>WYQQKPGKAPNRLIYAASSLQSGVPSRFSGSGS<br>GTEFTLTFSSLQPEDFATYYCLQHSYPRTFGQG<br>TKVEIK<br><br>SEQ ID NO: 26416 | QVQLVESGGGVVQPGRSLRLSCAASGFTFSDYVM<br>QWVRQAPGKGLEWVAVIWYDGSNKYYADSVKGR<br>FTISRDNSKNTLYLQMNSLRAEDTAVYYCAREPYN<br>SGWYDYGMDVWGQGTTVTVSS<br><br>SEQ ID NO: 30422 |
| iPS:435617 | 21-225_162F2 | NA | GACATTCAGATGACCCAGTCTCCATCTCCCT<br>GTGTGCATCTGTAGGAGACAGAGTCACCATCA<br>CTTGCCGGGCAAGTCAGGGCATTAGAAATGAT<br>TTAGGCTGGTATCAGCAGAAACCAGGGAAAG<br>CCCCTAAGCGCTTGATCAATGCTGCATCCAGT<br>TTGCAAAGTGGGGTCCCATCAAGGTTCAGCGG<br>CAGTGGATCTGGGACAGAATTCACTCTCACAA<br>TCAGCAGCGTGCAGCCTGAAGATTTTGCAACT<br>TATTACTGTGTATACAGGATAATAGTCACCCATT<br>CACTTTCGGCCCTGGGACCAAAGTGGAAATCA<br>AA<br><br>SEQ ID NO: 26417 | GAGGTGCAACTGGTGGAGTCTGGGGGAGGCTG<br>GTCAAGCCTGGGGGGTCCCTGAGATTCTCCTGTG<br>CAGCCTCTGATTCACCTTCAGTAGTTATATAGCAT<br>GAACTGGGTCCGCCAGGCTCCAGGGAAGGGGCT<br>GGAGTGGGTCTCATCATTAGTGGTAGTAGTACG<br>TACATATACTACGCAGACTCAGTGAAGGGCCGAT<br>TCACCATCTCCAGAGACAACGCCAAGAACTCACT<br>GTATCTGCAAATGAACAGCCTGAGAGCCGAAGA<br>CACGGCTGTGTATTACTGCGCGAGAGATCGGGGC<br>AGCAGCTGGGGCCAGGGAACCCTGGTCACCGTC<br>TCCTCA<br><br>SEQ ID NO: 30423 |

FIGURE 50
(Continued)

| | | | | |
|---|---|---|---|---|
| iPS:435621 | 21-225_162H3 | AA | DIQMTQSPSSLCASVGDRVTITCRASQGIRNDLG WYQQKPGKAPKRLINAASSLQSGVPSRFSGSGS GTEFTLTISSVQPEDFATYYCIQDNSHPFTFGPGT KVEIK<br>SEQ ID NO: 26418 | EVQLVESGGGLVKPGGSLRFSCAASGFTFSSYSMN WVRQAPGKGLEWVSSISGSSTYIYYADSVKGRFTIS RDNAKNSLYLQMNSLRAEDTAVYYCARDRGSSW GQGTLVTVSS<br>SEQ ID NO: 30423 |
| | | NA | GACATTCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCTTGATCAATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATATAGTCAACT TATTACTGTCTACAGGATAATAGTCACCCATT CACTTTCGGCCCTGGGACCAAAGTGGAAATCA AA<br>SEQ ID NO: 26419 | GAGGTGCAACTGGTGGAGTCTGGGGGAGGCTG GTCAAGCCTGGGGGGTCCTTGAGATTCTCCTGTG CAGCCTCTGGATTCACCTTCAGTAGTTATAGCAT GAACCGGGTCCGCCAGGCTCCAGGGAAGGGCT GGAGTGGGTCTCATCCATTAGTGGTAGTAGTACG TACATATACTACGCAGACTCAGTGAAGGGCCGAT TCACCATCTCCAGAGACAACGCCAAGAACTCACT GTATCTGCAAATGAACAGCCTGAGAGCCGAAGA CACGGCTGTGTATTACTGCGCGAGAGATCGGGGC AGCAGCTGGGGCCAGGGAACCCTGGTCACCGTC TCCTCA<br>SEQ ID NO: 30424 |
| | | AA | DIQMTQSPSSLSASVGDRVTITCRASQGIRNDLG WYQQKPGKAPKRLINAASSLQSGVPSRFSGSGS GTEFTLTISSLQPEDFATYYCLQDNSHPFTFGPGT KVEIK<br>SEQ ID NO: 26420 | EVQLVESGGGLVKPGGSLRFSCAASGFTFSSYSMN RVRQAPGKGLEWVSSISGSSTYIYYADSVKGRFTIS RDNAKNSLYLQMNSLRAEDTAVYYCARDRGSSW GQGTLVTVSS<br>SEQ ID NO: 30426 |

FIGURE 50
(Continued)

| | | | |
|---|---|---|---|
| iPS:435623 | 21-225_162D5 | NA | GACATTGTGATGACCCAGTCTCCAGACTTCCG TAATGTGTCTATGGGCAGAGGGCCATCATCA ACTTCAAGTCCAACCATAGTGTTTATACAGG TCCAACAATAATCAATACTTAGCTTGGTACCA GCGGAAACCAGGACAGCCTCCTAAGTTGCTCA TTTACCGACATCTATCCGGAAATCCGGGGTC CCTGACCGATTCAGTGGCAGCGGGTGTGGAC AGATTCACTCTCACCATCGACAGCCTGCAGG CTGAAGATGTGGCAGTTTATTACTGTCAGCAA TATTATAGTACTCCTCCCACTTTCGGCGGAGG GACCAAGGTGGAGATCAAA<br>SEQ ID NO: 26421 | CAGGTGCAGCTGGTGCAGTCTGGGTCTGAGGTGA AGAAGCCTGGGGCCTCAGTGAAGGTCTCTGCA AGGCTTCTGGATACACCTTCACCAATTATGATAT CAACTGGGTGCGACAGGCCACTGGACAAGGGCT TGAGTGGATGGGATGGATGCACCTAACAGTGGT AACACAGGCTATGCACAGAAGTTCCAGGGCAGA GTCACCATGACCAGGAACACCTCATAGACACA GCCTACATGGAACTGAGCAGCCTGAGTTCTGAGG ACACGGCCGTGTATTTCTGTGCGTTTAGCAGTGG CTGGTACTTCTTTGACTACTGGGGCCAGGGAACC CTGGTCACCGTCTCCTCA<br>SEQ ID NO: 30427 |
| | | AA | DIVMTQSPDFRNVSMGERAIINFKSNHSVLYRSN NNQYLAWYQRKPGQPPKLLIYRTSIRKSGVPDR FSGSGCGTDFTLTIDSLQAEDVAVYYCQQYYSTP PTFGGGTKVEIK<br>SEQ ID NO: 26422 | QVQLVQSGSEVKKPGASVKVSCKASGYTFTNYDIN WVRQATGQGLEWMGWMHPNSGNTGYAQKFQGR VTMTRNTSIDTAYMELSSLSSEDTAVYFCAFSSGW YFFDYWGQGTLVTVSS<br>SEQ ID NO: 30428 |
| iPS:435627 | 21-225_162F6 | NA | CAGGTGCAGCTGATGACCCAGTCTCCAGACTCCT GGCTGTGTCTCTGGGCGAGAGGGCCACCATCA ACTGCAAGTCCAGCCAGAATGTTTACAACTGGTACCA TCCAACAATAACAACTACTTAACTGGTACCA GCAGAAACCAGGACAGCCTCCTAAGTTGCTCA TTTACTGGGCATCTACCCGGGAATCCGGGGTC CCTGACCGATTCAGTGGCAGCGGGTCTGGGAC AGAATTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAAA<br>SEQ ID NO: 26423 | CAGGTGCAGCTGGTGCAGTCTGGGGCTGAGGTG AGGAAGCCTGGGGCCTCAGTGAAGGTCTCTGC AAGGCTTCTGGATACACCTTCACCAATTATGATA TCAACTGGGTGCGACAGGCCACTGGACAAGGGC TTGAGTGGATGGGATGATGCACAGAAGTTCCAGGGCAG ATTCACCATGACCAGGAACACCTCCATAAGCACA GCCTACATGGAGCTGAGCAGCCTGAGATCTGAG GACACGGCCGTGTATTACTGTGCCTATAGCAGTG GCTGGTACCGCTTTGACTACTGGGGCCAGGGAAC CCTGGTCACCGTCTCCTCA<br>SEQ ID NO: 30429 |

FIGURE 50
(Continued)

| | | | |
|---|---|---|---|
| iPS-435629 | 21-225_162H6 | AA | DIVMTQSPDSLAVSLGERATINCKSSQNVLHSSN NNNYLTWYQQRPGQPPKLLIYWASTRESGVPDR FSGSGSGTEFTLTISSLQAEDVAVYYCQQYYSTP PTFGQGTKVEIK<br>SEQ ID NO: 26424 | QVQLVQSGAEVRKPGASVKVSCKASGYTFTNYDIN WVRQATGQGLEWMGWMHPNSGNTGYAQKFQGR FTMTRNTSISTAYMELSSLRSEDTAVYYCAYSSGW YRFDYWGQGTLVTVSS<br>SEQ ID NO: 30430 |
| | | NA | GATATTGTGATGACCCAGACTCCACTCTCTCT GTCCGTCACCCCTGGACAGCCGGCCTCCATCT CCTGCAAGTCTACTCAGAGCCTCCTGCATGGT GATGGAAAGACCTATTTGTATTGGTACCTGCA GAAGCCAGGCCAGCCTCCACAACTCCTGATCT ATGAAGGTTCCAAGCGGTTCTCTGGAGTGCCA GAAAGGTTCAGTGGCAGCGGGTCAGGGACAG ATTTCACACTGAAAATCAGCCGGGTGGAGGCT GAGGATGTTGGGGTTTATTACTGCAAGCAAAG TATACAGCTTCCGTGGACGTTCGGCCAAGGGA CCAAGGTGGAAATCAAA<br>SEQ ID NO: 26425 | CAGGTGCAGCTGGTGGAGTCTGGGGGAGGCGTG GTCCAGCCTGGAGGTCCCTGAGACTCTCCTGTG CAGGCGTCTGGATTCACCTTCAATAACTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAAAAGGTAT AGCAGCAGTTGGAGACTACTACTACGGTATGGA CGTCTGGGGCCAAGGGACCACGGTCACCGTCTCC TCA<br>SEQ ID NO: 30431 |
| | | AA | DIVMTQTPLSLSVTPGQPASISCKSTQSLLHGDG KTYLYWYLQKPGQPPQLLIYEVSKRFSGVPERFS GSGSGTDFTLKISRVEAEDVGVYYCKQSIQLPWT FGQGTKVEIK<br>SEQ ID NO: 26426 | QVQLVESGGGVVQPGRSLRLSCAASGFTFNNYGM HWVRQAPGKGLEWVAVIWYDGSNKYYADSVKGR FTISRDNSKNTLYLQMNSLRAEDTAVYYCARKGIA AVGDYYYGMDVWGQGTTVTVSS<br>SEQ ID NO: 30432 |

FIGURE 50
(Continued)

| | | | |
|---|---|---|---|
| iPS-435635 | 21-225_163F1 | NA | GACATCCAGATGACCCAGTCTCCATCCTCACT GTCTGCATCTGTAGGAGACAGAGTCACCATCA CTTGTCGGGCGAGTCAGGACATTAGCAATTAT TTAGCCTGGTTTCAGCAGAAACCAGGGAAAGC CCCTAAGTCCCTGATCTATCGTGCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAGCTTA TTACTGCCAACAGTATAATAGTTACCCATTCA CTTTCGGCCCTGGGACCAAGTGGATGCCCAA<br><br>SEQ ID NO: 26427 | GAGGTGCAGCTGGTGGACTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTGGTAGT TACATATACTACGCAGACTCAGTGAAGGGCCGAT TCACCACCTCCAGAGACAACGCCAAGAACTCACT GTATCTGCAAATGAACAGCCTGAGCGCCGACGA CACGGCTGTTTATTACTGTACGCTCTATAGCAGC TGGCACTATTGGGGCCAGGGAACCCTGGTCACCG TCTCCTCA<br><br>SEQ ID NO: 30433 |
| | | AA | DIQMTQSPSSLSASVGDRVTITCRASQDISNYLA WFQQKPGKAPKSLIYAASSLQSGVPSKFSGSGSG TDFTLTISSLQPEDFAAYYCQQYNSYPFTFGPGT QVDAQ<br><br>SEQ ID NO: 26428 | EVQLVDSGGGLVKPGGSLRLSCAASGFTFSSYSMN WVRQAPGKGLEWVSSISGSGSYIYYADSVKGRFTT SRDNAKNSLYLQMNSLSADDTAVYYCTLYSSHY WGQGTLVTVSS<br><br>SEQ ID NO: 30434 |
| iPS-435637 | 21-225_163E2 | NA | GACATCCAGATGACCCAGTCTCCATCCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTACGCGCCTGATCTATCTCTGCATCCAGTT TGCAAAGTGGGGTCCCATCAAGGTTCAGCGGC AGTGGATCTGGGACAGAATTCACTCTCACTTAT CAGTAGCCTGCAGCCTGAAGATTTTTGCAACTT ATTACTGTCTACAGCATATAGTCACCCATTC ACTTTCGGCCCTGGGACCAAAGTGGATATCAA A<br><br>SEQ ID NO: 26429 | GAGGTGCAACTGGTGGAGTCTGGGGGAGGCCTG GTCCAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTGGGTCTCTCCACTAGTGGGAGTTCTACT TACATATACTACGCAGACTCAGTGAAGGGCCGAT TCACCATCTCCAGAGACAACGCCAAGAACTTAGT GTATCTGCAAATGAACAGCCTGAGACCCGAGGA CACGGCTGTGTATTACTGTGTGGAGAGATCGAGGC AGCCTCTGGGGCCAGGGAACCCTGGTCACCGTCT CCTCA<br><br>SEQ ID NO: 30435 |

FIGURE 50
(Continued)

| | | | | |
|---|---|---|---|---|
| iPS:435639 | 21-225_163G6 | AA | DIQMTQSPSSLSASVGDRVTITCRASQDIRNDLGWYQQKPGKAPTRLIYPASSLQSGVPSRFSGSGSGTEFTLSISSLQPEDFATYYCLQHNSHPFTFGPGTKVDIK<br>SEQ ID NO: 26430 | EVQLVESGGGLVQPGGSLRLSCAASGFTFSSYSMNWVRQAPGKGLEWVSSTSGSSTYIYYADSVKGRFTISRDNAKNLVYLQMNSLRPEDTAVYYCARDRGSLWGQGTLVTVSS<br>SEQ ID NO: 30436 |
| | | NA | GACATCCAGATGACCCAGTCTCCATCCTCACTGTCTGCATCTGTAGGAGACAGAGTCACCATCACTTGTCGGGCGAGTCAGGACATTAGCAATGATTTAGTCTGGTTTCAGCAGAAACCAGGGAAAGCCCCTAAGTCCCTGATCTATGCTGCATCCAGTTTGCTAAGTGGGGTCCCTTCAAAGTTCAGCGGCAGTGGATCTGGGACAGATTTCACTCTCACCATCAGCAGCCTGCAACAGTATCATAGTTACCGCTCACTTTCGGCGGAGGGACCAAGGTGGCGATCAAA<br>SEQ ID NO: 26431 | GAGGTGCAGCTGGTGGAGTCTGGGGGAGGCCTGGTCAAGCCTGGGGGGTCCCTGAGACTCTCCTGTGCAGCCTCTGGATTCACCTTCAGTAGTTATAGCATGAGCTGGGTCCGCCAGGCTCCAGGGAAGGGGCTGGAGTGGGTCTCATCCATTAGTGGTAGTAGTGCTTACATATACTACGCAGACTCAGTGAAGGGCCGATTCACCATCTCCAGAGACAACGCCAAGAACTCACTGTATCTGCAAATGAACAGCCTGAGAGCCGAGGACACGGCTGTGTATTACTGTGCGAGATTGAGCGGTATGGACGTCTGGGGCCAAGGGACCACGGTCACCGTCTCCTCA<br>SEQ ID NO: 30437 |
| | | AA | DIQMTQSPSSLSASVGDRVTITCRASQDISNYLVWFQQKPGKAPKSLIYAASSLLSGVPSKFSGSGSGTDFTLTISSLQPEDFATYYCQQYHSYPLTFGGGTKVAIK<br>SEQ ID NO: 26432 | EVQLVESGGGLVKPGGSLRLSCAASGFTFSSYSMSWVRQAPGKGLEWVSSISGSSAYIYYADSVKGRFTISRDNAKNSLYLQMNSLRAEDTAVYYCARLSGMDVWGQGTTVTVSS<br>SEQ ID NO: 30438 |

FIGURE 50
(Continued)

| | | | |
|---|---|---|---|
| iPS:435641 | 21-225_163F9 | NA | GACATCCAGATGACCCAGTCTCCATCTCCT GTCTGCATCTGTAGGAGACAGAGTCACCATCA CTTGCCGGGCAAGTCAGGACATTAGAGATGAT TTAGGCTGGTATCAGCAGAAACCAGGGAAAG CCCCTAAGCGCCTGATCTATCCTGCATCCAGTT TGCAAAGTGGGGTCCATCAAGGTTCAGCGGC AGTGGATCTGGGACAGAATTCACTCTCACAAT CAGCAGCCTGCAGCCTGAAGATTTTGCAGCTT ATTACTGTCTACAGGATAATAGTTACCCATTC ACTTTCGGCCCTGGGACCAAAGTGGATATCAA A<br><br>SEQ ID NO: 26433 | GAGGTGCAGCTGGTGGAGTCTGGGGGAGGCCTG GTCCAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTACT TACATATACTACGCAGACTCAGTGAAGGGCCGAT TCCACCATCTCCAGAGACAACGCCAAGAACTCACT GTATCTGCAAATGAACAGCCTGAGAGCCGAGGA CACGGCTGTGTATTACTGTGCGAGAGATCGAGGC AGCCTCTGGGGCCAGGGAACCCTGGTCACCGTCT CCTCA<br><br>SEQ ID NO: 30439 |
| | | AA | DIQMTQSPSSLSASVGDRVTITCRASQDIRDDLG WYQQKPGKAPKRLIYPASSLQSGVPSRFSGSGSG TEFTLTISSLQPEDFAAYYCLQDNSYPFTFGPGTK VDIK<br><br>SEQ ID NO: 26434 | EVQLVESGGGLVQPGGSLRLSCAASGFTFSSYSMN WVRQAPGKGLEWVSSISGSSTYYYADSVKGRFTIS RDNAKNSLYLQMNSLRAEDTAVYYCARDRGSLW GQGTLVTVSS<br><br>SEQ ID NO: 30440 |
| iPS:435643 | 21-225_163G10 | NA | GACATCCAGATGACCCAGTCTCCATCTCCCT GTCTGCATCTGTAGGAGACAGAGTCACCATCA CTTGCCGGGCAAGTCAGGACAGTCAGGACATTAGAAATAAT TTAGGCTGGTATCAGCAGAAACCAGGGAAAG CCCCTAAGCGCCTGATCTATCCTGCATCCAGTT TGCAAAGTGGGGTCCATCAAGGTTCAGCGGC AGTGGATCTGGGACAGAATTCACTCTCACAAT CAGCAGCCTGCAGCCTGAAGATTTTGCAACTT ATTACTGTCTACAGGATTATAGTTACCATTCA CTTTCGGCCCTGGGACCAAAGTGGATATCAAA<br><br>SEQ ID NO: 26435 | GAGGTGCAGTTGGTGGAGTCTGGGGGAGGCCTG GTCAAGCCTGGGGGGTCCCTGAGACTCTCCGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTACT TACATATACTACGCAGACTCAGTGAAGGGCCGAT TCCACCATCTCCAGAGACAACGCCAAGAACTCACT GTATCTGCAAATGAACAGCCTGAGAGCCGAGGA CACGGCTGTGTATTACTGTGCGAGAGCCCGTATG GACGTCTGGGGCCAAGGGACCACGGTCACCGTC TCCTCA<br><br>SEQ ID NO: 30441 |

FIGURE 50
(Continued)

| | | | | |
|---|---|---|---|---|
| iPS-435649 | 21-225_165H2 | AA | DIQMTQSPSSLSASVGDRVTITCRASQDIRNNLG WYQQKPGKAPKRLIYPASSLQSGVPSRFSGSGSG TEFTLTISSLQPEDFATYYCLQDYSYPFTFGPGTK VDIK<br>SEQ ID NO: 26436 | EVQLVESGGGLVKPGGSLRLSCAASGFTFSSYSMN WVRQAPGKGLEWVSSISGSSTYIYYADSVKGRFTIS RDNAKNSLYLQMNSLRAEDTAVYYCARARMDVW GQGTTVTVSS<br>SEQ ID NO: 30442 |
| | | NA | GACATCGTGATGACCCAGTCTCCAGACTCCCT GACTGTGTCTGCCGGGCGAGAGAGTGTTTACACAGC ACTGCAAGTCCAGCCAGAACTACTTAACTTGGTACCA TCCAACAATAAGAACCAGGACAGCCTCCTAAACTGCTCA GCAGAAACCAGGACAGCAGCCTCCTAAACTGCTCA TTTACTGGGCATCTACCCGAGAATCCGGGGTC CCTGTCCGATTCAGTGGCAGCGGGTCGGGGAC AGATTCACTGTCCCCATCAGCAGCATGCAGG ATGATGATGTGGCAGTTTATTACCGTCAGCAA TCTTATAGTAGTATTCCTCCCACTTTCGGCCCCGGG ACCAACGTGGATATCAAA<br>SEQ ID NO: 26437 | CAGGTGCAGCTGGTGCAGTCTGGGGCTGAGGTG AAGAAGCCTGGGGCCTCAGTGAAGGTCTCCTGC AAGGCTTCTGGATACACCTTCACCCATTATGATA TCAACTGGGTGCGACAGGCCACTGGACAAGGGC TTGAGTGGATGGGATGGATCAGAAGTTCCAGGCAG TAAGACAGGCTATGCACAGAAGTTCCAGGCAG AGTCACCATGACCAGGAACACTCCAACGCAC AGCCTACATGACCAGCCTGAGATCTGAG GACACGGCCGTGTATTACTGTGCTTATAGCAGTG GCTGGTACATGTTTGACTACTGGGGCCAGGGAAC CCTGGTCACCGTCTCCTCA<br>SEQ ID NO: 30443 |
| | | AA | DIVMTQSPDSLTVSPGERATINCKSSQSVLHSSN NKNYLTWYQQKPGQPPKLLIYWASTRESGVPVR FSGSGSGTDFTVPISSMQDDDVAVYYRQQSYSIP PTFGPGTNVDIK<br>SEQ ID NO: 26438 | QVQLVQSGAEVKKPGASVKVSCKASGYTFTHYDIN WVRQATGQGLEWVGWMHPNSHKTGYAQKFQGR VTMTRNTSNSTAYMDLSSLRSEDTAVYYCAYSSG WYMFDYWGQGTLVTVSS<br>SEQ ID NO: 30444 |

FIGURE 50
(Continued)

| | | | | |
|---|---|---|---|---|
| iPS:435653 | 21-225_166H12 | NA | GACATCCAGATGACCCAGTCTCCATCCTCACT GTCTACATCTGTAGGAGACAGAGTCACCATCA CTTGTCGGGCGAGTCAGGACATTAGCCATTAT TTAGCCTGGTTTCAGCAGAAACCAGGGAAAGC CCCTAAGTCCCTGATCTATGCTGCATCCAGTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATAATAGTTTCCCGCTCA CTTTCGGCGGAGGGACCAAGGTGGAGATCAAC A | GAGGTGCAGCTGGTGGAGTCTGGGGGAGCCTG GTCAAGCCTGGGGGGTCCCTGAGACTCTCCTGTG CAGCCTCTGGATTCACCTTCAGTAGCTATAGCAT GAGCTGGGTCCGCCAGGCTCCAGGGAAGGGGCT GGGGGTGGGTCTCATCATTAGTGGGAGTAGTAGT TACAGTTACTACGCAGACTCAGTGAAGGGCCGAT TCACCATCTCCAGAGACAATGCCAAGAACTCACT GTATCTGCAAATGAACAGCCTGAGAGCCGAGGA CACGGCTGTGTATTACTGTGCGAGACTAACTGGC TTTGACTACTGGGGCCAGGGAACCCTGGTCACCG TCTCCTCA |
| | | | SEQ ID NO: 26439 | SEQ ID NO: 30445 |
| | | AA | DIQMTQSPSSLSTSVGDRVTITCRASQDISHYLA WFQQKPGKAPKSLIYAASSLQSGVPSKFSGSGSG TDFTLTISSLQPEDFATYYCQQYNSFPLTFGGGT KVEIT | EVQLVESGGALVKPGGSLRLSCAASGFTFSSYSMS WVRQAPGKGLGWVSSISGSSSYSYYADSVKGRFTI SRDNAKNSLYLQMNSLRAEDTAVYYCARLTGFDY WGQGTLVTVSS |
| | | | SEQ ID NO: 26440 | SEQ ID NO: 30446 |
| iPS:435655 | 21-225_167E2 | NA | GATATTGTGATGACCCAGACTCCACTCTCTCT GTCCGTCACCCCTGGACAGCCGGCCTCCATCT CCTGTAAGTCTAGTCAGAGCCTCCTGCACGGT GATGGGAAGACCTATTTGTATTGGTACCTGCA GAAGCCAGGCCAGTCTCCACACTCCTGATCT ATGAAGTTTCCAAACGGTTCTCTGGAGTGCCA GATAGGTTCAGTGGCAGCGGGTCAGGACAG AATTTCACACTGAAGATCAGCCGGGTGGAGGCT GAGGATGTTGGCTTTATCACTGACTGCAAAG CATACAGCTTCCGTGACGTTCGGCCAAGGGA CCAAGGTGGAAATCAAA | CAGGTGCAGCTGGTGGAGTCTGGGGGAGGCGTG GTCCAGCCTGGGAGGTCCCTGAGACTCTCCTGTG CAGCGTCTGGATTCACCTTAGTAGCTTTGGCAT GCACTGGGTCCGCCAGGCTCCAGGCAAGGGCCT GGAGTGGGTGGCAGTCATATGGTATGATGGAACT TATAAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGTTGGTATT GAAGTGGCTGGTGACTACTACTACGGTATGGAAG TCTGGGGCCAAGGGACCACGGTCACCGTCTCCTC A |
| | | | SEQ ID NO: 26441 | SEQ ID NO: 30447 |

FIGURE 50
(Continued)

| | | | | |
|---|---|---|---|---|
| iPS:435657 | 21-225_167H10 | AA | DIVMTQTPLSLSVTPGQPASISCKSSQSLLHGDG KTYLYWYLQKPGQPPHLLIYEVSKRFSGVPDRFS GSGSGTDFTLKISRVEAEDVGLYHCMQSIQLPW TFGQGTKVEIK<br>SEQ ID NO: 26442 | QVQLVESGGGVVQPGRSLRLSCAASGFTFSSFGMH WVRQAPGKGLEWVAVIWYDGTYKYYADSVKGRF TISRDNSKNTLYLQMNSLRAEDTAVYYCARVGIEV AGDYYYGMEVWGQGTTVTVSS<br>SEQ ID NO: 30448 |
| | | NA | GATATTGTGATGACCCAGACTCCACTCTCTCT GTCCGTCACCCCTGGACAGCCGGCCTCCATCT CCTGCAAGTCTAGTCAGAGCCTCCTGCACGGT GATGGAAAGACCTATTTGTATTGGTACCTGCA GAAGCCAGGCCAGCCTCCACACTCCTGATCT ATGAAGTTTCAAACGGTTCTCTGGAGTGCCA GATAGGTTCAGTGGCAGCGGGTCAGGGACAG ATTTCACACTGAAAATCAGCCGGGTGGAGGCT GAGGATGTTGGGCTTTATCACTGCATGCAAAG CATACAGCTTCCGTGGACGTTCGGCCAAGGGA CCAAGGTGGAAATCAAA<br>SEQ ID NO: 26443 | CAGGTGCAGTTGGTGGAGTCTGGGGGAGGCGTG GTCCAGCCTGGGAGGTCCCAGAGACTCTCCTGTG CAGCCTCTGGATTCACCTTTAGTAGCTTTGGCAT GCACTGGGTCCGCCAGGCTCCAGGCAAGGGCCT GGAGTGGGTGGCAGTCATATGGTATGATGGAAG TTATAAGTACCATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGTTGGTAT AGAAGTGGCTGGTGACTACTACGGTATGGAA GTCTGGGGCCAAGGGACCACGGTCACCGTCTCCT CA<br>SEQ ID NO: 30449 |
| | | AA | DIVMTQTPLSLSVTPGQPASISCKSSQSLLHGDG KTYLYWYLQKPGQPPHLLIYEVSKRFSGVPDRFS GSGSGTDFTLKISRVEAEDVGLYHCMQSIQLPW TFGQGTKVEIK<br>SEQ ID NO: 26444 | QVQLVESGGGVVQPGRSQRLSCAASGFTFSSFGMH WVRQAPGKGLEWVAVIWYDGSYKYHADSVKGRF TISRDNSKNTLYLQMNSLRAEDTAVYYCARVGIEV AGDYYYGMEVWGQGTTVTVSS<br>SEQ ID NO: 30450 |

FIGURE 50
(Continued)

| | | | |
|---|---|---|---|
| iPS:435659 | 21-225_167D12 | NA | GACATCCAGATGACCCAGTCTCCATCCTCACT GTCTGCATCTGTAGGGGACAGAGTCACCATCA CTTGTCGGGCGAGTCAGGGCATTAACAATTAT TTAGCCTGGTTTCAGCAGAAACCAGGGAAAGC CCCTGAGTCCCTGATCTATGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTTCTGCCAACAGTATAATAGTTATCCATTCAC TTTCGGCCCTGGGACCAAAGTGGATATCAAA<br><br>SEQ ID NO: 26445 | GAGGTGCAGCTGTTGGAGTCTGGGGGAGGCTTG GTACAGCCGGGGGGGTCCCTGAGACTCTCCTGTG CAGCCTCTGGATTCACCTTTAGTAGCTATGTCAT GAGCTGGGTCCGCCAGGCTCCAGGGAAGGGGCT GGAGTGGGTGGTCTCAGTATGAGTGGTAGTGGTGGT AGAACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTGTATTACTGTGCGAAGTATACCTG GAACGGCTACTGGGGCCAGGGAACCCTGGTCAC CGTCTCCTCA<br><br>SEQ ID NO: 30451 |
| | | AA | DIQMTQSPSSLSASVGDRVTITCRASQGINNYLA WFQQKPGKAPESLIYAASSLQSGVPSKFSGSGSG TDFTLTISSLQPEDFATYFCQQYNSYPFTFGPGTK VDIK<br><br>SEQ ID NO: 26446 | EVQLLESGGGLVQPGGSLRLSCAASGFTPSSYVMS WVRQAPGKGLEWVSAMSGSGGRTYYADSVKGRF TISRDNSKNTLYLQMNSLRAEDTAVYYCAKYTWN GYWGQGTLVTVSS<br><br>SEQ ID NO: 30452 |
| iPS:435663 | 21-225_169B1 | NA | GACATCCAGATGACCCAATCTCCATCCTCCCT GTCTGCATCTGTAGGAGACAGAGTCACCATCA CTTGCCGGGCTAGTCAGGGCATTAGAAATGAT TTAGGCTGGTATCAGCAGAAACCAGGGAAAG CCCCTAAGCGCCTGATCGGTGCTGAATCCAGT TTGCAAAGTGGGGTCCCATCAAGGTTCAGCGG CAGTGGATCTGGGACAGAATTCACTCTCACAA TCAGCGGCCTGCAGCCTGAAGATTTTGCAACT TATTACTGTCTACAGCATTATAGTTACCCGCTC ACTTTCGGCGGAGGGACCAAAGTGGAGATCA AA<br><br>SEQ ID NO: 26447 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAGGGGCCGA TTCACCATCTCCAGAGACAATTCCAAGAACACGC TGTATCTGCAAATGAACAGCTGAGAGCCGAAG ACACGGCTGTGTATTACTGTGCGAGAGATCCTT ACGTGGATACAATGACCCGGTTATGGACTACTGG GGCCAGGGAACCCTGGTCACCGTCTCCTCA<br><br>SEQ ID NO: 30453 |

FIGURE 50
(Continued)

| | | | | |
|---|---|---|---|---|
| iPS:435665 | | AA | DIQMTQSPSSLSASVGDRVTITCRASQGIRNDLGWYQQKPGKAPKRLIGAESSLQSGVPSRFSGSGSGTEFTLTISGLQPEDFATYYCLQHYSYPLTFGGGTKVEIK<br>SEQ ID NO: 26448 | QVQLVESGGGVVQPGRSLRLSCAASGFTFSSYGMHWVRQAPGKGLEWVAVIWYDGSNKYYADSVRGRFTISRDNSKNTLYLQMNSLRAEDTAVYYCARDPLRGYNDPVMDYWGQGTLVTVSS<br>SEQ ID NO: 30454 |
| | | NA | GACATCGTGATGACCCAGTCTCCAGACTCCCTGGCTGTGTCTCTGGGCGAGAGGGCCACCATCAACTGCAAGTCCAGCCAGAGTGTTTATACATCTCCAACAATAAAAACTACTTAGCTTGGTACCAGCAGAAACCAGGACAGCCTCCTAAACTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAATATTATCGTGCTCCCACCTTCGGCCAAGGGACACGACTGGAGATTAAA<br>SEQ ID NO: 26449 | CAGGTGCAGCTGCAGGAGTCGGGCCCAGGACTGGTGAAGCCTTCGGAGACCCCTGTCCTCACCTGCACTGTCTCTGGTGGCTCCATCAGTAGTTACTACTGGAGTTGGATCCGGCAGCCCGCCGGGAAGGGACTGGAGTGGATTGGGCGTATCGATACCAGTGGGATCACCAACTACAACCCCTCCCTCAAGAGTGAGTCACCATGTCAATAGACACGTCCAAGAGCCAGATCTCCCTGAAGCTGAGCTCTGTGACCGCCGCGGACACGGCCGTGTATTACTGTGCGAGAGAGGGAGGAGTGGAGCTACCTACTTGACTACTGGGGCCAGGGAACCCTGGTCACCGTCTCCTCA<br>SEQ ID NO: 30455 |
| 21-225_169F2 | | AA | DIVMTQSPDSLAVSLGERATINCKSSQSVLYISNNKNYLAWYQQKPGQPPKLLIYWASTRESGVPDRFSGSGSGTDFTLTISSLQAEDVAVYYCQQYYRAPTFGQGTRLEIK<br>SEQ ID NO: 26450 | QVQLQESGPGLVKPSETLSLTCTVSGGSISSYYWSWIRQPAGKGLEWIGRIDTSGITNYNPSLKSRVTMSIDTSKSQISLKLSSVTAADTAVYYCAREGGVGATYFDYWGQGTLVTVSS<br>SEQ ID NO: 30456 |

FIGURE 50
(Continued)

| | | | |
|---|---|---|---|
| iPS:435667 | 21-225_169E3 | NA | GACATTGTGATGACTCAGTCTCCACTCTCCCTG CCCGTCACCCCTGGAGAGCCGGCCTCCATCTC CTGCAGGTCTAGTCAGAGCCTCCTGCATAATA ATGGATACAAGTATTTGGATTGTACCTGCAG AAGCCAGGGCAGTCTCCACAGCTCCTGATCTA TTTGGGGTTCTAAATCGGGCCTCCGGGGTCCCTG ACAGGTTCAGTGCCAGTGGATCAGGCACAGAT TTTACACTGAAAATCAGCAGAGTGGAGGCTGA GGATGTTGGGGTTTATTACTGACGTTCATGCAAGTTC TACAAACTCCGTGACGTTCGGCCAAGGGACC AAGGTGGAAATCAAA SEQ ID NO: 26451 | GAGGTGCAACTGGTGGAGTCTGGGGGAGGCTTG GTACAGCCGGGGGGGGTCCCTGAGACTCTCCTGTG CAGCCTCAGATTCACCTTCAGTGGCCATAGCAT GAACTGGGTCCGCCAGGCTCCAGGGAAGGGCT GGAGTGGGTTGCATACATTAGCCTTAGTGTAGT ACCATAAAGTACGCAGACTCTGTGAAGGGCCGA TTCACCATCTCCAGAGACAATGCCAGGGACTCAC TGTATCTGCAAATGAACAGCCTGAGAGACGAGG ACACGGCTGTGTATTACTGTGCGAGAAGGGGAT TACTGGTTCGAATGAGGACGGTTTGACGTC TGGGGCCAAGGGACCACGGTCACCGTCCTCA SEQ ID NO: 30457 |
| | | AA | DIVMTQSPLSLPVTPGEPASISCRSSQSLLHNNGY KYLDWYLQKPGQSPQLLIYLGSNRASGVPDRFS ASGSGTDFTLKISRVEAEDVGVYYCMQVLQTPW TFGQGTKVEIK SEQ ID NO: 26452 | EVQLVESGGGLVQPGGSLRLSCAASGFTFSGHSMN WVRQAPGKGLEWVAYISLSGSTIKYADSVKGRFTI SRDNARDSLYLQMNSLRDEDTAVYYCARRGITVV RNEDGLDVWGQGTTVTVSS SEQ ID NO: 30458 |
| iPS:435669 | 21-225_169F9 | NA | GACATCCAGATGACCCAGTCTCCATCCTCCCT GTCTGCATCTGTAGGAGACAGAGTCACCATCA CTTGCCCGGCAAGTCAGGGCATTAGAAATGAT TTAGGCTGGTATCAGCAGAAACCAGGGAAAG CCCCTAAGCGCCTGATCTTTGCTGCATCCAGTT TGCAAAGTGGGGTCCCATCAAGGTTCAGCGGC AGTGGATCTGGGACAGATTCACTCTCACAAT CAGCAGCCTGCAGCCTGAAGATTTTGCAACTT ATTACTGTCTACAGCATTATAGTTACCCGCTCA CTTTCGGCGGAGGGACCAAGGTGGAGATCAA A SEQ ID NO: 26453 | CAGGTGCAGCTGGTGGAGTCTGGGGGAGGCGTG GTCCAGCCTGGGAGGTCCCTGAGACTCTCCTGTG CAGCGGTCTGGATTCACCTTCAGTAGTACCTATGGCAT GCACTGGGTCCGCCAGGCTCCAGGCAAGGGGCT GGAGTGGGTGGTCAATTATATGGTATGATGGAACT AATAAATACTATGCAGACTCCGTGAAGGGCCGA TTCACCATCTCCAGAGACAATTCCAAGAACACGC TGTATCTGCAACTGAACAGCCTGAGAGCCGAGG ACACGGCTGTGTATTACTGTGCGCGAGATCCTT ACGGTGATACAATGACCCGGTTATGACTACTGG GGCCAGGGAACCCTGGTCACCGTCTCCTCA SEQ ID NO: 30459 |

FIGURE 50
(Continued)

| | | | |
|---|---|---|---|
| | AA | DIQMTQSPSSLSASVGDRVTITCRASQGIRNDLG WYQQKPGKAPKRLIFAASSLQSGVPSRFSGSGSG TEFTLTISSLQPEDFATYYCLQHYSYPLTFGGGT KVEIK<br><br>SEQ ID NO: 26454 | QVQLVESGGGVVQPGRSLRLSCAASGFTFSTYGMH WVRQAPGKGLEWVSIIWYDGTNKYYADSVKGRFT ISRDNSKNTLYLQLNSLRAEDTAVYYCARDPLRGY NDPVMDYWGQGTLVTVSS<br><br>SEQ ID NO: 30460 |
| iPS:435671<br>21-225_169H5 | NA | GACATCGTGATGACCCAGTCTCCAGACTCCCT GGCTGTGTCTCTGGGCGAGAGGGCCACCATCA ACTGCAAGTCCAGCCAGAGTGTTTATACATC TCCAACAATAAAAACTACTTAGCTTGGTACCA GCAGAAACCAGGACAGCCTCCTAAACTGCTCA TTTACTGGGCATCTACCCGGGAATCCGGGTC CCTGACCGATTCAGTGGCAGCGGGTCTGGGAC AGATTTCACTCTCACCATCAGCAGCCTGTCAGG CTGAAGATGTGGCAGTTTATTACTGTCAGCAA TATTATCGTGCTCCCACCTTCGGCCAAGGGAC ACGACTGGAGATTAAA<br><br>SEQ ID NO: 26455 | CAGGTGCAGCTGCAGGAGTCGGGCCCAGGACTG GTGAAGCCTTCGGAGACCCTGTCCCTCACCTGCA CTGTCTCTGGTGGCTCCATCAGTAGTTACTACTG GAGTTGGATCCGGCAGCCCGCCGGGAAGGACT GGAGTGGATTGGGCGTATCGATACCAGTGGATC ACCAACTACAACCCCTCCCTCAAGAGTCGAGTCA CCATGTCAGTAGACACGTCCAAGAGCCAGATCTC CCTGAAGCTGAGCTCTGTGACCGCCGCGGACACG GCCGTGTATTACTGTGCGAGAGAGGGAGGAGTG GGAGCTACCTACTTTGACTACTGTGGGCCAGGGAA CCCTGGTCACCGTCTCCTCA<br><br>SEQ ID NO: 30461 |
| | AA | DIVMTQSPDSLAVSLGERATINCKSSQSVLYISN NKNYLAWYQQKPGQPPKLLIYWASTRESGVPD RFSGSGSGTDFTLTISSLQAEDVAVYYCQQYYR APTFGQGTRLEIK<br><br>SEQ ID NO: 26456 | QVQLQESGPGLVKPSETLSLTCTVSGGSISSYYWSW IRQPAGKGLEWIGRIDTSGITNYNPSLKSRVTMSVD TSKSQISLKLSSVTAADTAVYYCAREGGVGATYFD YWGQGTLVTVSS<br><br>SEQ ID NO: 30462 |

FIGURE 50
(Continued)

| | | | | |
|---|---|---|---|---|
| iPS:435673 | 21-225_169E6 | NA | GACATTGTGATGACTCAGTCTCCACTCTCCCTG CCCGTCACCCCTGGAGAGCGGCCTCCATCTC CTGCAGGTCAGTCAGAGCCTCCTGCATAATA ATGGATACAAGTATTTGGATTGTACCTGCAG AAGCCAGGGACAGTCTCCACAGCTCCTGATCTA TTTGGGTTCTAATCGGGCCTCCGGGGTCCCTG ACAGGTTCAGTGCCAGTGGATCAGGCACAGAT TTTACACTGAAAATCAGCAGAGTGGAGGCTGA GGATGTTGGGGTTTATTACTGCATGCAAGTTC TACAAACTCCGTGACGTTCGGCCAAGGGACC AAGGTGGAAATCAAA<br><br>SEQ ID NO: 26457 | GAGGTGCAACTGGTGGAGTCTGGGGGAGGCTTG GTACAGCCTGGGGGGTCCCTGAGACTCTCCTGTG CAGCCTCAGGATTCACCTTCAGTGCCATAGCAT GAACTGGGTCCGCCAGGCTCCAGGGAAGGGGCT GGAGTGGGTTGCATACATTAGCATTAGTAGTAGT ACCATAAAGTACGCAGACTCTGTGAAGGGCCGA TTCACCATCTCCAGAGACAATGCCAGGACTCAC TGTATCTGCAAATGAACAGCCTGAGAGACGAGG ACACGGCTGTGTATTACTGTGCGAGAAGGGGAT TACTGTGGTTCGGAATGAGGACGGTTTGACGTC TGGGGCCAAGGGACCACGGTCACCGTCTCCTCA<br><br>SEQ ID NO: 30463 |
| | | AA | DIVMTQSPLSLPVTPGEPASISCRSSQSLLHNNGY KYLDWYLQKPGQSPQLLIYLGSNRASGVPDRFS ASGSGTDFTLKISRVEAEDVGVYYCMQVLQTPW TFGQGTKVEIK<br><br>SEQ ID NO: 26458 | EVQLVESGGGLVQPGGSLRLSCAASGFTFSGHSMN WVRQAPGKGLEWVAYISISSTIKYADSVKGRFTIS RDNARDSLYLQMNSLRDEDTAVYYCARRGITVR NEDGLDVWGQGTTVTVSS<br><br>SEQ ID NO: 30464 |
| iPS:435675 | 21-225_169D7 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATCATAGTTGCCCGTG GACGTTCGGCCAAGGGACCAAGGTGGAAATC AAA<br><br>SEQ ID NO: 26459 | CAGGTGCAGCTGCAGGAGTCGGCCCAGGACTG GTGAAGCCTTCGGAGACCCTGTCCCTCACCTGCA CTGTCTCTGGTGGCTCCATCAGTAGTTACTACTG GAGCTGGATCCGGCAGCCCGCGGGAAGGGACT GGAGTGGATTGGGCGTATCTATACCAGTGGGAGC ACCAACTACAACCCCTCCCTCAAGAGTCGAGTCA CCATGTCAGTAGACACGTCCAAGAACCAGTTCTC CCTGAAGCTGAGCTCTGTGACCGCCGCGGACACG GCCGTGTATTCTGTGCGAAAGTCGGGAGGTACT ACTACGGTATGGACGTCTGGGGCCAAGGGACCA CGGTCACCGTCTCCTCA<br><br>SEQ ID NO: 30465 |

FIGURE 50
(Continued)

| | | | |
|---|---|---|---|
| iPS:435677 | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHHSCPWTFGQGTKVEIK<br>SEQ ID NO: 26460 | QVQLQESGPGLVKPSETLSLTCTVSGGSISSYYWTWIRQPAGKGLEWIGRIYTSGSTNYNPSLKSRVTMSVDTSKNQFSLKLSSVTAADTAVYFCAKVGRYYYGMDVWGQGTTVTVSS<br>SEQ ID NO: 30466 |
| | 21-225_169C10 | NA | GACATCCAGATGACCCAGTCTCCATCCTCACTGTCTGCATCTGTAGGAGACAGAGTCACCATCACTTGTCGGGCGAGTCAGGACAGACATTAGCAATTATTTAGCCTGGTTTCAGCAGAAACCAGGGAAAGCCCCTAAGTCCCTAATCTTTTCTGCATCCAGTTTGCAAAGTGGGGTCCCATCAAAATTCAGCGGCAGTGGATCTGGGACAGATTTCAATCTCACCATCAGCAGCCTGCAGCCTGAAGATCTGATAGTTACCCTCTCACTTTCGGCGGAGGGACCAAGGTGGAGATCAAA<br>SEQ ID NO: 26461 | CAGGTGCAGCTGGTGCAGTCTGGGGCTGAGGTGAAGAAGCCTGGGGCCTCAGTGAGGGTCTCCTGCAAGGCTTCTGGATACACCTTCACCGGCTACTTATGCACTGGGTGCGACAGGCCCCTGGACAAGGGCTTGAGTGGATGGGATCAAGCCTAAGAGTGGTGGCACAAACTCTGCACAGAGGTTCAGGGCAGGGTCACCATGACCAGGGACACGTCCATCAACACAGCCTACATGGAGCTGAACAGGCTGAGATCTGACGACACGGCCGTGTATTACTGTGCGAGAGGGGGACTACGGTGGCTACGTGGGGGGTCTTTGACTACTGGGGCCAGGGAACCCTGGTCACCGTCTCCTCA<br>SEQ ID NO: 30467 |
| | | AA | DIQMTQSPSSLSASVGDRVTITCRASQDISNYLAWFQQKPGKAPKSLIFSASSLQSGVPSKFSGSGSGTDFNLTISSLQPEDFATYYCQQSDSYPLTFGGGTKVEIK<br>SEQ ID NO: 26462 | QVQLVQSGAEVKKPGASVRVSCKASGYTFTGYFMHWVRQAPGQGLEWMGWIKPKSGGTNSAQRFQGRVTMTRDTSINTAYMELNRLRSDDTAVYYCARGGTTVATWGWFDYWGQGTLVTVSS<br>SEQ ID NO: 30468 |

FIGURE 50
(Continued)

| | | | |
|---|---|---|---|
| iPS:435679 | 21-225_169D10 | NA | GACATCCAGATGACCCAGTCTCCATCTTCACT GTCTGCATCTGTAGGAGACAGAGTCACCATCA CTTGTCGGGCGAGTCAGGACATTAGCAATTAT TTAGCCTGGTTTCAGCAGAAACCAGGGAAAGC CCCTAAGTCCCTGATCTATGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATATCATAGTTAC CCATTCATTACTGCCAACAGTATCATAGTTACCATTCA CTTTCGGCCCTGGGACCAAAGTGGATATCAAA | GAGGTGCAGTTGTTGGAGTCTGGGGGAGGCTTGG TGCAGTCTGGGGGGTCCCTGAGACTCTCCTGTGC AGCCTCTGGATTCACCTTTAGCAGCTATGTCATG AGTTGGGTCCGCCAGGCTCCAGGGAAGGGGCTG GAGTGGGTCTCAGCTATTAGTGGTAGTGGTAGTA GAATATACTACGGGACTCCGTGAAGGGCCGGTT CACCATCTCCAGAGACAATTCCAAGAACACGCTG TATCTGCAAATGAACAGCCTGAGAGCCGAGGAC ACGGCCTTATATTACTGTGCAGGGGCTTTCT TTGACTATTGGGGCCAGGGAACCCTGGTCACCGT CTCCTCA |
| | | | SEQ ID NO: 26463 | SEQ ID NO: 30469 |
| | | AA | DIQMTQSPSSLSASVGDRVTITCRASQDISNYLA WFQQKPGKAPKSLIYAASSLQSGVPSKFSGSGSG TDFTLTISSLQPEDFATYYCQQYHSYPFTFGPGT KVDIK | EVQLLESGGGLVQSGGSLRLSCAASGFTFSSYVMS WVRQAPGKGLEWVSAISGSGSRIYYADSVKGRFTI SRDNSKNTLYLQMNSLRAEDTALYYCARVAFFDY WGQGTLVTVSS |
| | | | SEQ ID NO: 26464 | SEQ ID NO: 30470 |
| iPS:435681 | 21-225_169D11 | NA | GACATCCAGATGACCCAGTCTCCATCCTCCCT GTCTGCATCTGTAGGAGACAGAGTCACCATCA CTTGCCGGGCAAGTCAGGGCATTAGAGATGAT TTAGGCTGGTATCAACAGAAACCAGGGAAAG TCCCTAAGCGCCTGATATATGCTGCATCCAGT TTGCAAAGTGGGGTCCCATCAAGGTTCAGCGG CAGTGGATCTGGGACAGATTTCACTCTCACAA TCAGCAGCCTACAGCCTGAAGATTTTGCAACT TATTACTGTCTTCAGCATTATAGTTACCCTCGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTGCAATTGAACAGCCTGAGAGCCGAGG ACACGGCTGTGTATTACTGTGCGAGAGAAAGTA TAGCAGTGGCTGGTACGACTACGGTATGGACGTC TGGGGCCAAGGGACCACGGTCACCGTCTCCTCA |
| | | | SEQ ID NO: 26465 | SEQ ID NO: 30471 |

FIGURE 50
(Continued)

| | | AA | DIQMTQSPSSLSASVGDRVTITCRASQGIRDDLGWYQQKPGKVPKRLIYAASSLQSGVPSRFSGSGSGTEFTLTISSLQPEDFATYYCLQHYSYPRTFGQGTKVEIK<br>SEQ ID NO: 26466 | QVQLVESGGGVVQPGRSLRLSCAASGFTFSDYVMHWVRQAPGKGLEWVAVIWYDGSNKYYADSVKGRFTISRDNSKNTLYLQLNSLRAEDTAVYYCARERYSSGWYDYGMDVWGQGTTVTVSS<br>SEQ ID NO: 30472 |
|---|---|---|---|---|
| iPS:435683 | 21-225_170A1 | NA | GAGATTGTGATGACCCAGACTCCACTCTTCCTGTCCGTCACCCCTGGACAGCCGGCTCCATCTCCTGCAAGTCTAGTCAGAGCCTCCTGCATGGTGATGAAGAAGACCTATTTGTTTGGTACCTGCAGAAGCCAGGCCAGCCTCCACAGGTCCTGAGTGCAATGAAGTTCCAACCGGTTCTCTGGAGTGCCAGATAGGTTCAGTGGCAGCGGGTCAGGGACAGATTTCACACTGAAAATCAGCCGGGTGGAGGCTGAGGATGTTGGGGTTTATTACTGTCTGCAAAGTATTCAGCTTCCGTGGACGTTCGGCCAAGGGACCAAGGTGGAAATCAAA<br>SEQ ID NO: 26467 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAATTATATGGTATGATGGAAGTAATAAATACTATGCAGATTCCGTGAAGGGCCGATTCACCATCTCCAGAGACAATTCCAAGAACACACTGTATCTGCAAATGAACAGCCTGAGAGCCGAGGACACGGCTGTGTATTACTGTGCGAGAGATGCCACGATTTTTGGAGTGGTTACTTTGACTCCTGGGGCCAGGGAACCCTGGTCACCGTCTCCTCA<br>SEQ ID NO: 30473 |
| | | AA | EIVMTQTPLFLSVTPGQPASISCKSSQSLLHGDGKTYLFWYLQKPGQPPQVLIYEVSNRFSGVPDRFSGSGSGTDFTLKISRVEAEDVGVYYCMQSIQLPWTFGQGTKVEIK<br>SEQ ID NO: 26468 | QVQLVESGGGVVQPGRSLRLSCAASGFTFSSYGMHWVRQAPGKGLEWVAIIWYDGSYKYYADSVKGRFTISRDNSKNTLYLQMNSLRAEDTAVYYCARDAHDFWSGYFDSWGQGTLVTVSS<br>SEQ ID NO: 30474 |

FIGURE 50
(Continued)

| | | | |
|---|---|---|---|
| iPS:435685 | 21-225_170E1 | NA | GACATCCAGATGACCCAGTCTCCATCCTCACT GTCTGCATCTGAAGGAGACAGAGTCACCATCA CTTGTGGGCGAGTCAGGGCATTAGCAATTAT TTAGCCTGGTTTCAGCAGAAACCAGGAAAGC CCCTAAGTCCCTGATCTATGCTGCATCCAGTTT GCAAAGTGGGGTCCCATCAAAGTTCAGCGGCA GTGGATCTGGGACAGATTTCACTCTCACCATC AGCAGCCTGCAACAGTATCATAGTTACCCTTA TTACTGCCAACAAGTATCATAGTTACCCTTA CTTTCGGCCCTGGGACCAAAGTGGATATCAAA SEQ ID NO: 26469 | GAGGTGCAGTTGTTGGAGTCTGGGGGAGGCTTGG TACAGCCTGGGGGGTCCCTGAGACTCTCCTGTGC AGCCTCTGGATTCACCTTTAGCAGCTATGTCATG AGTTGGGTCCGCCAGGCTCCAGGGAAGGGGCTG GAGTGGGTCTCAGCTATTAGTGGTAGTGGTAATA GAATATACTACGCAGAGACTCCGTGAAGGGCCGGTT CACCATCTCCAGAGACAATTCCAAGAACACGCTG TATCTGCAAATGAACAGCCTGAGAGTCGAGGAC ACGGCCTTATATTACTGTGCGAGAGTGGCTTTCT TTGACTATTGGGGCCAGGGAACCCTGGTCACCGT CTCCTCA SEQ ID NO: 30475 |
| | | AA | DIQMTQSPSSLSASEGDRVTITCRASQGISNYLA WFQQKPGKAPKSLIYAASSLQSGVPSKFSGSGSG TDFTLTISSLQPEDFATYYCQQYHSYPFTFGPGT KVDIK SEQ ID NO: 26470 | EVQLLESGGGLVQPGGSLRLSCAASGFTFSSYVMS WVRQAPGKGLEWVSAISGSGNRIYYADSVKGRFTI SRDNSKNTLYLQMNSLRAEDTALYYCARVAFFDY WGQGTLVTVSS SEQ ID NO: 30476 |
| iPS:435687 | 21-225_170H1 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTACATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTATTGTCTACAGGATATAGTAACCCGTG GACGTTCGGCCAAGGGACCAAGGTGGAAAGC AAA SEQ ID NO: 26471 | CAGGTGCAGCTGCAGGAGTCGGGCCCAGGACTG GTGAAGCCTTCGGAGACCCTGTCCCTCACCTGCA CTGTCTCTGGTGGCTCCATCAGTAGTTATTACTGG AGCTGGATCCGGCAGCCCGCCGGGAAGGGACTG GAGTGGATTGGGCGTATCTATACCAGTGGGAGCA CCAACTACAACCCCTCCCTCAAGAGTCGAGTCAC CATGTCAGTAGACACGTCCAAGAACCAGTTCTCC CTGAAGCTGAGCTCTGTGACCGCCGCGGACACG GCCGTGTATTACTGTGCGAGAGTCGGGAGGTACT ACTATGGTATGGACGTCTGGGGCCAAGGGACCA CGGTCACCGTCTCCTCA SEQ ID NO: 30477 |

FIGURE 50
(Continued)

| | | | |
|---|---|---|---|
| iPS:435689 | 21-225_170F3 | AA | DIQMTQSPSSLSASVGDRVTITCRASQGIRNDLG WYQQKPGKAPKRLIYATSSLQSGVPSRFSGSGSG TEFTLTISSLQPEDFATYYCLQHSSNPWTFGQGT KVESK<br>SEQ ID NO: 26472 | QVQLQESGPGLVKPSETLSLTCTVSGGSISSYYWSW IRQPAGKGLEWIGRIYTSGSTNYNPSLKSRVTMSVD TSKNQFSLKLSSVTAADTAVYYCARVGRYYYGMD VWGQGTTVTVSS<br>SEQ ID NO: 30478 |
| | | NA | GACATCCAGATGACCCAGTCTCCATCCCCT GTCTGCTTCTGTACAAGACAGAGTCACCATCA CTTGCCGGGCAAGTCGGGGATTAGAAACAGGGCATTAGAAATGAT TTAGGCTGTGTATCAGCAGAAACCAGGGAAAG CCCCTAAGCGCCTGATCTATGCTGCATCCAGT TTGCAAAGTGGGGTCCCATCCAAGGTTCAGCGG CAGTGGATCTGGGACAGAATTCACTCTCACAA TCAACAGCCTGCAGCCTGAAGATTTTGCAACT TATTACTGTCTACAGCATTATAGTTACCCTCGG ACGTTCGGCCAAGGGACCAAGGTGGAAATCA AA<br>SEQ ID NO: 26473 | CAGGTGCAGCTGGTGGAATCTGGGGGAGGCGTG GTCCAGCCTGGGAGGTCCCTGAGACTCTCCTGTG CAGCGTCTGGATTCTCCTTCAGTGACTATGTCAT GCACTGGGTCCGCCAGGCTCCAGGCAAGGGCT GGAGTGGGTGGCAGTTATATGGTATGATGGAAGT AATAAATACTATGAAGACTCCGTGAAGGGCCGA TTCACCATCTCCAGAGACAATTCCAAGAACACGC TGTATCTGCAAATGAACAGCTGAGAGCCGAGG ACACGGCTGTGTATTACTGTGCGAGAGAGACGTA TAGCAGCAGCTGGTACGACTACGGTATGGACGTC TGGGGCCAAGGGACCACGGTCACCGTCTCCTCA<br>SEQ ID NO: 30479 |
| | | AA | DIQMTQSPSSLSASVGDRVTITCRASRGIRNDLG WYQQKPGKAPKRLIYAASSLQSGVPSRFSGSGS GTEFTLTINSLQPEDFATYYCLQHYSYPRTFGQG TKVEIK<br>SEQ ID NO: 26474 | QVQLVESGGGVVQPGRSLRLSCAASGFSFSDYVMH WVRQAPGKGLEWVAVIWYDGSNKYYEDSVKGRF TISRDNSKNTLYLQMNSLRAEDTAVYYCARETYSS SWYDYGMDVWGQGTTVTVSS<br>SEQ ID NO: 30480 |

FIGURE 50
(Continued)

| | | | |
|---|---|---|---|
| iPS:435693 | 21-225_170G4 | NA | GACATCCAGATGACCCAGTCTCCATCTCCCT GTCTGCATCTGTAGGAGACAGAGTCACCATCA CTTGCCGGGCAAGTCAGGGACATTAGAAATGAT TTAGGCTGGTATCACCAGAAACCGGGAAAG CCCCTAAGCGCCTGATCTATGCTGCATCCACTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATTATAGTTACCCGCTCA CTTTCGGCGGAGGGACCAAGGTGGAGATCAA A<br>SEQ ID NO: 26475 | CAGGTGCAGCTGGTGGAGTCTGGGGGAGGCGTG GTCCAGCCTGGGAGGTCCCTGAGACTCTCCTGTA CAGCGTCTGGATTCACCTTCAGTACTATGGCAT GCACTGGGTCCGCCAGGCTCCAGGCAAGGGGCT GGAGTGGGTGTCAATTATATGGTATGATGGAACT AATAAATACTATGCAGACTCCGTGAAGGGCCGA TTCACCATCTCCAGAGACAATTCCAAGAACACGC TGTTTCTGCAACTGAACAGCCTGAGAGCCGAGGA CACGGCTATGTATTACTGTGCGCGAGATCCCTTA CGTGGATACAATGACCCGGTTACTGACTACTGGG GCCAGGGAACCCTGGTCACCGTCCTCA<br>SEQ ID NO: 30481 |
| | | AA | DIQMTQSPSSLSASVGDRVTITCRASQGIRNDLG WYHQKPGKAPKRLIYAASTLQSGVPSRFSGSGS GTEFTLTISSLQPEDFATYYCLQHYSYPLTFGGG TKVEIK<br>SEQ ID NO: 26476 | QVQLVESGGGVVQPGRSLRLSCTASGFTFSTYGMH WVRQAPGKGLEWVSIIWYDGTNKYYADSVKGRFT ISRDNSKNTLFLQLNSLRAEDTAMYYCARDPLRGY NDPVMDYWGQGTLVTVSS<br>SEQ ID NO: 30482 |
| iPS:435695 | 21-225_170D5 | NA | GACATCCAGATGACCCAGTCTCCATCTCCCT GTCTGCATCTGTCGGAGACAGAGTCACCATCA CTTGCCGGGCAAGTCAGGGACATTAGAAATGAT TTAGGCTGGTATCAGCAGAAACCAGGGAAAG CCCCTAAACACCTGATCTATGCTGCATCCAGT TTGCAAAATGGGGTCCCATCAAGGTTCAGCGGC CAGTGGATCTGGGACAGAGTTCACTCTCACAA TCAGCAGCCTGCAGCCTGAAGATTTTGCAACT TATTACTGTCTACAGCATTATAGTTTCCCGCTC ACTTTCGGCGGAGGGACCAAGGTGGAGATCA AA<br>SEQ ID NO: 26477 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAATTATATGTATGATGGAACT AATAAATACTATGCAGACAATTCCAAGAACACGC TGTATCTGCAACTGAACAGCCTGAGAGCCGAGG ACACGGCTGTGTATTACTGTGCGCGAGATCCCTT ACGTGGATACAATGACCCGGTTATGACTACTGG GGCCAGGGAACCCTGGTCACCGTCTCCTCA<br>SEQ ID NO: 30483 |

FIGURE 50
(Continued)

| | | | | |
|---|---|---|---|---|
| iPS:435697 | 21-225_170G5 | AA | DIQMTQSPSSLSASVGDRVTITCRASQGIRNDLG WYQEKPGKAPKHLIYAASSLQNGVPSRFSGSGS GTEFTLTISSLQPEDFATYYCLQHYSFPLTFGGGT KVEIK<br>SEQ ID NO: 26478 | QVQLVESGGGVVQPGRSLRLSCAASGFTFSSYGMH WVRQAPGKGLEWVAHWYDGTNKYYADSVKGRF TISRDNSKNTLYLQLNSLRAEDTAVYYCARDPLRG YNDPVMDYWGQGTLVTVSS<br>SEQ ID NO: 30484 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAACTGAT TTAGGCTGGTTTCAGCAGAAAACCAGGGAAAGC CCCTAAGCGCCTGATCTATACTGCATCCAGTT GCAAAGTGGGGTCCCATCAAGGTTCAGCGGCA GTGGATCTGGGACAGAATTCACTCTCACGATC AGCAGCCTGCAGCCTGAAGATTTTGCAACTTA TTACTGTCTACAGCATTATAGTTACCCGCTCAC TTTCGGCGGAGGGACCAAGGTGGAGATCAAA<br>SEQ ID NO: 26479 | CAGGTGCAGCTGGTGGAGTCTGGGGGAGGCGTG GTCCAGCCTGGGGGGTCCCTGAGACTCTCTGTG CAGCGTCTGGCTTCACCTTCAGTAGCTATGGCAT GCACTGGGTCCGCCAGGCTCCAGGCAAGGGGCT GGAGTGGGTGACAATTATATGGTATGATGGGACT AATAAATACTATGCAGACTCCGTGAAGGGCCGA TTCACCATCTCCAGAGACAATTCCAAGAGCACGC TGTATCTGCAAATGAACAGCCTGAGAGCCGAGG ACACGGCTGTGTATTTCTGTGCGAGAGATCCTT ACGTGGATACAAATGACCCGGTTATGGACTACTGG GGCCAGGGAACCCTGGTCACCGTCTCCTCA<br>SEQ ID NO: 30485 |
| | | AA | DIQMTQSPSSLSASVGDRVTITCRASQGIRTDLG WFQQKPGKAPKRLIYTASSLQSGVPSRFSGSGSG TEFTLTISSLQPEDFATYYCLQHYSYPLTFGGGT KVEIK<br>SEQ ID NO: 26480 | QVQLVESGGGVVQPGGSLRLSCAASGFTFSTYGMH WVRQAPGKGLEWVTHWYDGTNKYYADSVKGRFT ISRDNSKSTLYLQMNSLRAEDTAVYFCARDPLRGY NDPVMDYWGQGTLVTVSS<br>SEQ ID NO: 30486 |

FIGURE 50
(Continued)

| | | | |
|---|---|---|---|
| iPS:435699 | 21-225_170D6 | NA | GACATCCAGATGACCCAGTCTCCATCTCT GTCTGCATCTGTAGGAGACAGAGTCGCCATCA CTTGTCGGGCGAGTCAGGACATTGGCAATGT TTAGCCTGGTTTCAGCAGAAACCAGGGAAAGC CCCTAAGTCCCTGATCTATTCTGCGTCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAATCTGATAGTTACCCTCTCAC TTTCGCGGACCAAGGTGGAGATCAAA<br><br>SEQ ID NO: 26481<br>DIQMTQSPSSLSASVGDRVAITCRASQDIGNCLA WFQQKPGKAPKSLIYSASSLQSGVPSKFSGSGSG TDFTLTISSLQPEDFATYYCQQSDSYPLTFGGGT KVEIK<br>SEQ ID NO: 26482 | CAGGTGCAGCTGGTGCAGTCTGGGGCTGAGGTG AAGAAGCCTGGGGCCTCAGTGAAGGGTCCTGC AAGGCTTCTGGATACACCTTCACCGGCTACTTTA TACACTGGGTGCGACAGGCCCCTGGACAAGGGC TTGAGTGGATGGGATGGATCAAGCTAACAGTG GTGGCACAAACTCTGCACAGAGGTTTCAGGGCA GGGTCACCATGACCAGGGACACGTCATCAACA CAGCCTACATGGAGCTGAACAGGCTGAGATCTG ACGACAGGCCGTGTATTACTGTGCGAGAGGGG GGATACGGTGGCTACGTGGGGGGTCTTTGACTA CTGGGGCCAGGGAACCCTGGTCACCGTCTCCTCA<br><br>SEQ ID NO: 30487<br>QVQLVQSGAEVKKPGASVRVSCKASGYTFTGYFIH WVRQAPGQGLEWMGWIKPNSGGTNSAQRFQGRV TMTRDTSINTAYMELNRLRSDDTAVYYCARGGTT VATWGVFDYWGQGTLVTVSS<br>SEQ ID NO: 30488 |
| iPS:435701 | 21-225_170F6 | NA | GACATCGTGATGACCCAGTCTCCAGACTCCCT GGCTGTGTCTCTGGGCGCGAGGGCCACCATCA ACTGCAAGTCCAGCCAGAGTGTTTTACACAGG TCCAACAATTACAACTACTTAGCTTGGTACCA GCAGAGACCAGGACAGCCTCCTAAAGTGCTCA TTCACTGGGCATCTACCCGGAAATCGGGGTC CCTGACCGATTCAGTGGCAGCGTGTCTGGGAC AGATTTCACTCTCACCATCAACAGCCTGCAGG CTGAAGATGTGGCAGTTTATTACTGTCAGCAA TATTATAGTACTCCGTGGACGTTCGGCCAAGG GACCAAGGTGGAAATCAAA<br><br>SEQ ID NO: 26483 | CAGGTGCAGCTGGTGCAGTCTGGGGCTGAGGTG AAGAAGCCTGGGGCCTCAGTGAAGGTCCTGC AAGGCTTCTGGATACACCTTCACCAATTATGATA TCAACTGGGTGCGACAGGCCACTGGACAAGGC TTGAGTGGATGGGATGGATGAACCTAACAGTG GTAACACAGGCTATGCACAGAAGTTCCAGGACA GAGTCACCATGACCAGGGACACGTCCATAAGCA CAGCCTACATGGAGCTGAGCAGCCTGAGATCTG AGGACACGGCCGTGTATTACTGTGCGATTAGCAG TGGCTGGTACTGGTTCGACCCCTGGGGCCAGGGA ACCCTGGTCACCGTCTCCTCA<br><br>SEQ ID NO: 30489 |

FIGURE 50
(Continued)

| | | | | |
|---|---|---|---|---|
| | | AA | DIVMTQSPDSLAVSLGARATINCKSSQSVLHSSN NYNYLAWYQQRPGQPPKVLIHWASTRKSGVPD RFSGSVSGTDFTLTINSLQAEDVAVYYCQQYYST PWTFGQGTKVEIK<br>SEQ ID NO: 26484 | QVQLVQSGAEVKKPGASVKVSCKASGYTFTNYDIN WVRQATGQGLEWMGWMNPNSGNTGYAQKFQDR VTMTRHTSISTAYMELSSLRSEDTAVYYCAISSGW YWFDPWGQGTLVTVSS<br>SEQ ID NO: 30490 |
| iPS:435703 | 21-225_170D11 | NA | GACATCCAGATGACCCAGTCTCCATCCTCCCT GTCTGCATCTGTCGGAGACAGAGTCACCATCA CTTGCCGGGCAAGTCAGGGCATTAGAAATGAT TTAGGCTGGTATCAGCAGAAACCAGGGAAAG CCCCTAAACACCTGATCTATGCTGCATCCAGT TTGCAAAATGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATTATAGTTTCCCGCTC ACTTTCGGCGGAGGGACCAAGGTGGAGATCA GA<br>SEQ ID NO: 26485 | CAGGTGCAGCTGGTGCAGAGTCTGGGGGAGGCGTG GTCCAGCCTGGGAGGTCCCTGAGACTCTCCTGTG TAGCGTCTGGATTCACCTTCAGTAGCTATGGCAT GCACTGGGTCCGCCAGGCTCCAGGCAAGGGGCT GGAGTGGGTGGCAATTATATGGTATGATGGAACT AATAAATACTATGCAGACTCCGTGAAGGGCCGA TTCACCATCTCCAGAGACAATTCCAAGAACACGC TGTATCTGCAACTGAACAGCCTGAGAGCCGAGG ACACGGCTGTGTATTACTGTGCGGAGATCCTT ACGTGGATACAATGACCCGGTTATGGACTACTGG GGCCAGGGAACCCTGGTCACCGTCTCCTCA<br>SEQ ID NO: 30491 |
| | | AA | DIQMTQSPSSLSASVGDRVTITCRASQGIRNDLG WYQQKPGKAPKHLIYAASSLQNGVPSRFSGSGS GTEFTLTISSLQPEDFATYYCLQHYSFPLIFGGGT KVEIR<br>SEQ ID NO: 26486 | QVQLVESGGGVVQPGRSLRLSCVASGFTFSSYGMH WVRQAPGKGLEWVAIIWYDGTNKYYADSVKGRF TISRDNSKNTLYLQLNSLRAEDTAVYYCARDPLRG YNDPVMDYWGQGTLVTVSS<br>SEQ ID NO: 30492 |

FIGURE 50
(Continued)

| | | | |
|---|---|---|---|
| iPS:435705 | 21-225_171C3 | NA | GACATCCAGATGACCCAGTCTCCATCTCCT GTCTGCATCTGTAGGAGACAGAGTCACCATCA CTTGCCGGGCAAGTCAGGGACATTAGAACTGAT TTAGGCTGGTTTCAGCAGAAACCAGGGAAAGC CCCTAAGCGCCTGATCTATACTGCATCCAGTTT GCAAAGTGGGGTCCCATCAAGGTTCAGCGGCA GTGGATCTGGGACAGAATTCACTCTCACGATC AGCAGCCTGCAGCCTGAAGATTTTGCAACTTA TTACTGTCTACAGCATTATAGTTACCCGCTCAC TTTCGGCGGAGGGACCAAGGTGGAGATCAAA |
| | | | SEQ ID NO: 26487 |
| | | AA | DIQMTQSPSSLSASVGDRVTITCRASQGIRTDLG WFQQKPGKAPKRLIYTASSLQSGVPSRFSGSGSG TEFTLTISSLQPEDFATYYCLQHYSYPLTFGGGT KVEIK |
| | | | SEQ ID NO: 26488 |
| iPS:435709 | 21-225_171A4 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATACTGCATCCAGT TTGCAAAGTGGGGTCCCATCAAGGTTCAGCGG CAGTGGATCTGGGACAGAATTCACTCTCACGA TCAGCAGCCTGCAGCCTGAAGATTTTGCAACT TATTACTGTCTACAGCATTATAGTTACCCGCTC ACTTTCGGCGGAGGGACCAAGGTGGAGATCA AA |
| | | | SEQ ID NO: 26489 |

| | | | CAGGTGCAGCTGGTGGAGTCTGGGGGAGGCGTG GTCCAGCCTGGGGGGTCCCTGAGACTCTCCTGTG CAGGCTCTGGCTTCACCTTCAGTACTTATGGCAT GCACTGGGTCCGCCAGGCTCCAGGCAAGGGCT GGAGTGGGTGACAATTATATGGTATGATGGACT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCCCTT ACGTGGATACAATGACCCGGTTATGGACTACTGG GGCCAGGGAACCCTGGTCACCGTCTCCTCA |
|---|---|---|---|
| | | | SEQ ID NO: 30493 |
| | | | QVQLVESGGGVVQPGGSLRLSCAASGFTFSTYGMH WVRQAPGKGLEWVTIIWYDGTNKYYADSVKGRFT ISRDNSKNTLYLQMNSLRAEDTAVYYCARDPLRGY NDPVMDYWGQGTLVTVSS |
| | | | SEQ ID NO: 30494 |
| | | | CAGGTGCAACTGGTGGGGTCTGGGGGAGGCGTG GTCCAGCCTGGGGGGTCCCTGAGACTCTCCTGTG CAGGCTCTGGCTTCACCTTCAGTACTTATGGCAT GCACTGGGTCCGCCAGGCTCCAGGCAAGGGGCT GGAGTGGGTGGCAATTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGTGTGCGAGATCCCTT ACACGGCTGTGTATTACTGTGCGAGAGATCCCTT ACGTGGATACAATGACCCGGTTATGGACTACTGG GGCCAGGGAACCCTGGTCACCGTCTCCTCA |
| | | | SEQ ID NO: 30495 |

FIGURE 50
(Continued)

| | | | | |
|---|---|---|---|---|
| | | AA | DIQMTQSPSSLSASVGDRVTITCRASQGIRNDLGWYQQKPGKAPKRLIYTASSLQSGVPSRFSGSGSGTEFTLTISSLQPEDFATYYCLQHYSYPLTFGGGTKVEIK | QVQLVESGGGVVQPGGSLRLSCAASGFTFSTYGMHWVRQAPGKGLEWVAIIWYDGSNKYYADSVKGRFTISRDNSKNTLYLQMNSLRAEDTAVYYCARDPLRGYNDPVMDYWGQGTLVTVSS |
| | | | SEQ ID NO: 26490 | SEQ ID NO: 30496 |
| iPS:435711 | 21-225_171G4 | NA | GACATCCAGATGACCCAGTCTCCATCTTCCGTGTCTGCATCTGTAGGAGACAGAGTCACCATCACTTGTCGGGCGAGTCAGGGTGTTAACGACTGGTTAGCCTGGTATCAGCAGAAACCAGGGAGAGCCCCTAAGCTCCTGATCTATGATGCATCAAGTTTGCAAAGTGGGGTCCCATCAAGGTTCACTCTCACCAGTGGATCTGGGACAGATTTCACTCTCACCATCAGCAGCCTGCAGCCTGAAGATTTTGCAACTTACTATTGTCAACAGGCTAACAGTTTCCCGTGGACGTTCGGCCAAGGGACCAAGGTGGAAATCAAA | GAGGTGCAGCTGTTGGAGTCTGGGGGAGACTTAGTACAGCCTGGGGGGTCCCTGAGACTCTCCTGTGCAGCCTCTGGATTCACCTTTAGCAGCTGTGCCATGACCTGGGTCCGCCAGGCTCCAGGGAAGGGGCTGGAGTGGGTCTCAGCTATTAGTGGTGGTGGTACCAGTTCTACGCAGACTCCGTGAAGGGCCGGTTCACCATCTCAAGAGACAATTCCAAGAACACGCTGTTTCTGCAAATGAACAGCCTGAGAGCCGAGGACACGGCCGTATATTACTGTGCGAAAGATCTTATTGGGGAGCTACTTACTTGACTACTGGGGCCAGGGAACCCTGGTCACCGTCTCCTCA |
| | | | SEQ ID NO: 26491 | SEQ ID NO: 30497 |
| | | AA | DIQMTQSPSSVSASVGDRVTITCRASQGVNDWLAWYQQKPGRAPKLLIYDASSLQSGVPSRFSGSGSGTDFTLTISSLQPEDFATYYCQQANSFPWTFGQGTKVEIK | EVQLLESGGDLVQPGGSLRLSCAASGFTFSSCAMTWVRQAPGKGLEWVSAISGRGGTTFYADSVRGRFTISRDNSKNTLFLQMNSLRAEDTAVYYCAKDLIGGATYFDYWGQGTLVTVSS |
| | | | SEQ ID NO: 26492 | SEQ ID NO: 30498 |

FIGURE 50
(Continued)

| | | | |
|---|---|---|---|
| iPS:435713 | 21-225_171D7 | NA | GATATTGTGATGACTCAGTCTCCACTCTCCCTG CCCGTCACCCCTGGAGAGCCGGCCTCCATCTC CTGCAGGTCTAGTCAGAGCCTCCTGTATCATA ATGGATACAACTATTTGGATTGGTACCTGCAG AAGACAGGGCAGTCTCCACAGTCTCTGATCTA TGTGGGGTTCTAATCGGGCCTCCGGGGTCCCTG ACAGGTTCAGTGGCAGTGGATCAGGCACAGAT TTTACACTGAAAATCAGCAGAGTGGAGGCTGA GGATGTTGGGGTTTATTACTGCATGCAAACTC TACAAACTCCGCTCACTTTCGGCGGAGGGACC AAGGTGGAGATCAAA SEQ ID NO: 26493 | CAGGTGCAGCTGGTGGAGTCTAGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATCATATGACGGAAA CAATAGACACTATGCAGACTCCGTGCAGGGCCG ATTCACCATTTCCAGAGACAATTCCAAGAACACG CTGTCTCTGCAAATGAACAGCCTGGGAGCTGAGG ACACGGCTGTGTATTACTGTGCGAGAGATCGTCA CCGTTTGGACTACTACGCTTTGACGTTCTGGGGC CAAGGGACCACGGTCACCGTCTCCTCA SEQ ID NO: 30499 |
| | | AA | DIVMTQSPLSLPVTPGEPASISCRSSQSLLYHNGY NYLDWYLQKTGQSPQLLIYVGSNRASGVPDRFS GSGSGTDFTLKISRVEAEDVGVYYCMQTLQTPL TFGGGTKVEIK SEQ ID NO: 26494 | QVQLVESRGGVVQPGRSLRLSCAASGFTFSSYGMH WVRQAPGKGLEWVAVISYDGNNRHYADSVQGRF TISRDNSKNTLSLQMNSLGAEDTAVYYCARDRHRL DYYALDVWGQGTTVTVSS SEQ ID NO: 30500 |
| iPS:435715 | 21-225_171A8 | NA | GCCATCCAGATGACCCAGTCTCCATCTTCCGT GTCTGCATCTGTAGGAGACAGAGTCACCATCA CTTGTCGGGCGAGTCAGGTATTAGCAACTGG TTAGCCTGGTATCAGCAGAAACCAGGGAAAG CCCCTAAACCTCATGATCCATGCTGCATTCAGTT TGCAAGGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGAGACTAACAGTTTCCCGTGG ACGTTCGGCCAAGGGACCAAGGTGGAAATCA AA SEQ ID NO: 26495 | GAGGTGCAGTTGTTGGAGTCTGGGGGAGGCTTGG TACAGCCTGGGGGGTCCCTGAGACTCTCCTGTGC AGCCTCTGGATTCACCTTTAGGAGCTCTGCCATG AGCTGGGTCCGCCAGGCTCCAGGGAAGGGGCTG GAGTGGGTCTCAGTTATTAGTGGTAGTGGTGTA GCACATTCTACACAGACTCCGTGAAGGGCCGGTT CACCATCTCCAGAGACAATTCCAAGAACACGCTG TATCTGCAAATGAACAGCCTGAGAGCCGAGGAC ACGGCCGTATATTACTGTGCGAAATCGAATAGCA GTGGCTGGTTTGACTACTGGGGCCAGGGAACCCT GGTCACCGTCTCCTCA SEQ ID NO: 30501 |

FIGURE 50
(Continued)

| | | | |
|---|---|---|---|
| | | AA | AIQMTQSPSSVSASVGDRVTITCRASQGISNWLA WYQQKPGKAPNLMIHAAFSLQGGVPSRFSGSGS GTDFTLTISSLQPEDFATYYCQQTNSFPWTFGQG TKVEIK<br>SEQ ID NO: 26496 | EVQLLESGGGLVQPGGSLRLSCAASGFTFRSSAMS WVRQAPGKGLEWVSVISGSGGSTFYTDSVKGRFTI SRDNSKNTLYLQMNSLRAEDTAVYYCAKSNSSGW FDYWGQGTLVTVSS<br>SEQ ID NO: 30502 |
| iPS:435717 | 21-225_171A9 | NA | GACATCCAGATGACCCAGTCTCCATCTCCGT GTCTGCATCTGTAGGAGACAGAGTCACCATCA CTTGTCGGGCGAGTCAGAGATATTACCACCTGG TTAGCCTGGTATCAGCAGAAACCAGGGAAAG CCCCTAAGCTCCTGATCTATGATGCATCAGTT TGCAAAGTGCGGTCCCATCAAGGTTCAGCGGC AGTGGATCTGGGACAGATTTCACTCTCACCAT CAGCAGTTTGCAGCTGAAGATTTTGCAACTT ACTATTGTCTACAGACTAACAGTTTCCCGTGG ACGTTCGGCCAAGGGACCAAGGTGGAGATCA AG<br>SEQ ID NO: 26497 | GAGGTGCAGTTGTTGGAGTCTGGGGGAGGCTTGG CACAGCCTGGGGGGTCCCTGAGACTCTCCTGTGC AGCCTCTGGATTCACCTTTAGCAGCTATGCCATG AGTTGGGTCCGCCAGGCTCCAGGGAAGGGGCTG GAGTGGGTCTCAGCTATTAGTGGTAGTGGTGGTA ACACATTCAACGCAGACTCCGTGAAGGGCCGGTT CACCATCTCCAGAGACAATGAACAGCCTGAGAAC TATCTGCAAATGAACAGCCTGAGAGCCGAGGAC ACGGCCGTATATTACTGTGCAAAGCTGGGATCG ACTACTACTACGGTATGGACGTCTGGGGCCA AGGGACCACGGTCACCGTCTCCTCA<br>SEQ ID NO: 30503 |
| | | AA | DIQMTQSPSSVSASVGDRVTITCRASQDITTWLA WYQQKPGKAPKLLIYDASSLQSAVPSRFSGSGS GTDFTLTVSSLQPEDFATYYCLQTNSFPWTFGQG TKVEIK<br>SEQ ID NO: 26498 | EVQLLESGGGLAQPGGSLRLSCAASGFTFSSYAMT WVRQAPGKGLEWVSAISGSGGNTFNADSVKGRFTI SRDNSKNTLYLQMNSLRAEDTAVYYCAKLGIDYY YYGMDVWGQGTTVTVSS<br>SEQ ID NO: 30504 |

FIGURE 50
(Continued)

| | | | |
|---|---|---|---|
| iPS:435719 | 21-225_171A11 | NA | GACATCCAGATGACCCAGTCTCCATCTCCCTGTCTGCATCTGTAGGAGACAGAGTCACCATCACTTGCCGGGCAAGTCAGGGCATTAGAAATAATTTAGGCTGGTATCAGCAGAAACCAGGGAAAGCCCCTAAGCGCCTGATCTATCCTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGGATCATAGTTACCCATTCACTTTCGGCCCTGGGACCAAAGTGGATATCAAA<br>SEQ ID NO: 26499 | GAGGTGCAGCTGGTGGAGTCTGGGGGAGGCCTGGTCAAGCCTGGGGGGTCCCTGAGACTCTCCTGTGCAGCCTCTGGATTCACCTTCAGTAGCTATAGCATGAACTGGGTCCGCCAGGCTCCAGGGAAGGGCTGGAGTGGGTCTCATCCATTAGTGGTAGTAGTTACATATACTACGCAGACTCAGTGAAGGGCCGATTCACCATCTCCAGAGACAAACGCAAGAACTCACTGTATCTGCAAATGAACAGCCTGAGAGCCGAGGACACGGCTGTGTATTACTGTGCGAGAGATAGGGGCAGCTCCTGGGCCAGGGAATCCTGGTCACCGTCTCCTCA<br>SEQ ID NO: 30505 |
| | | AA | DIQMTQSPSSLSASVGDRVTITCRASQGIRNNLGWYQQKPGKAPKRLIYPASSLQSGVPSRFSGSGSGTEFTLTISSLQPEDFATYYCLQDHSYPFTFGPGTKVDIK<br>SEQ ID NO: 26500 | EVQLVESGGGLVKPGGSLRLSCAASGFTFSSYSMNWVRQAPGKGLEWVSSISGSSSYIYYADSVKGRFTISRDNAKNSLYLQMNSLRAEDTAVYYCARDRGSSWGQGILVTVSS<br>SEQ ID NO: 30506 |
| iPS:435721 | 21-225_172B3 | NA | GACATCCAGATGACCCAATCTCCATCTCCCTGTCTGCATCTGTAGGAGACAGAGTCACCATCACTTGCCGGGCTAGTCAGGGCATTAGAAATGATTTAGGCTGGTATCAGCAGAAACCAGGGAAAGCCCCTAAGCGCCTGATCGGTGCTGCTAAGGTTCAGTTTGCAAAGTGGGGTCCCATCAAGTTCACTCTCACAACAGTGGATCTGGACAGAATTCACTCTCACAATCAGCAGCCTGCAGCCTGAAGATTTTGCAACTTATTACTGTCTACAGCATTATAGTTACCCGCTCACTTTCGGCGGAGGGACCAAAGTGGAGATCAA<br>SEQ ID NO: 26501 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTACCTATGCATGCACTGGGTCCGCCAGGCTCCAGGCAAGGGGCTGGAGTGGGTGGCAGTTATATCAGACTCCGTGAAGGGCCGAAATAAATACTATGCAGACGAATTCCAAGAACACGCTTGTATCTGCAAATGAACAGCCTGAGAGCCGAGGACACGGCTGTGTATTACTGTGCGAGAGATCCCTTACACGGCATACAATGACCCGGTTATGGACTACTGGGGCCAGGGAACCCTGGTCACCGTCTCCTCA<br>SEQ ID NO: 30507 |

FIGURE 50
(Continued)

| | | | | |
|---|---|---|---|---|
| iPS:435723 | | AA | DIQMTQSPSSLSASVGDRVTITCRASQGIRNDLG WYQQKPGKAPKRLIGAESSLQSGVPSRFSGSGSG TEFTLTISGLQPEDFATYYCLQHYSYPLTFGGGT KVEIK | QVQLVESGGGVVQPGRPLRLSCAASGFTFSTYGMH WVRQAPGKGLEWVAVIWYDGSNKYYADSVKGRF TISRDNSKNTLYLQMNSLRAEDTAVYYCARDPLRG YNDPVMDYWGQGTLVTVSS |
| | | | SEQ ID NO: 26502 | SEQ ID NO: 30508 |
| | 21-225_172B7 | NA | GATATTGTGATGACCCAGACTCCACTCTCTCT GTCCGTCACCCCTGGACAGCCGGCCTCCATCT CCTGCAAGTCTAGTCAGAGCCTCCTGCATGGT GATGGAAAGACCTATTTCTATTGGTACCTGCA GAAGCCAGGCCAGGCCTCCACAGGTCCTGTTAT TTGAAGTTTCCCACCGGTTCTCTGGAGTGCCA GATAGGTTCAGTGGCGGCGGGTCAGGGACAG ATTTCACACTGAAGATCAGCCGGGTGGAGGCT GAGGATGTTGGGGTTTACTATTGCATGCAAAG TATACAGTTTCCGTGACGTTCCGGCCAAGGGA CCAGGGTGGACATCAAA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT AGAGTGGGTGGCAATTATATGGTATGATGGAAGT AATAAATACTATGTAGACTCCGTGAAGGGCCGAT TCACCATCTCCAGAGACAATTCCAAGAACACGCT GTATCTCCAAATGAACAGCCTGAGAGCCGAAGA CACGGCTGTGTACTATTGTGCGAGAGAGGCGTAC GATTTTTGAGGTGGTTATTGGGGACTACTGGGGCC AGGGAACCCTGGTCACCGTCTCCTCA |
| | | | SEQ ID NO: 26503 | SEQ ID NO: 30509 |
| | | AA | DIVMTQTPLSLSVTPGQPASISCKSSQSLLHGDG KTYFYWYLQKPGQPPQVLLFEVSHRFSGVPDRF SGGGSGTDFTLKISRVEAEDVGVYYCMQSIQFP WTFGQGTRVDIK | QVQLVESGGGVVQPGRSLRLSCAASGFTFSNYGM HWVRQAPGKGLEWVAHWYDGSNKYYVDSVKGR FTISRDNSKNTLYLQMNSLRAEDTAVYYCAREAYD FWSGYWDYWGQGTLVTVSS |
| | | | SEQ ID NO: 26504 | SEQ ID NO: 30510 |

FIGURE 50
(Continued)

| | | | |
|---|---|---|---|
| iPS:435725 | 21-225_172G8 | NA | GACATCCAGATGACCCAGTCTCCATCCTCCCT GTCTGCATCTGTCGGAGACAGAGTCACCATCA CTTGCCGGGCAAGTCAGGGCGTTAGAAATGAT TTAGGCTGGTATCAGCAGAAACCAGGGAAAG CCCCTAAAACACCTGATCTATGCTGCATCCAGT TTGCAAAATGGGGTCCCATCAAGGTTCAGCGG CAGTGGCTCTGGGACAGAATTCACTCTCACAA TCAGCAGCCTGCAGCCTGAAGATTTTGCCACT TATTACTGTCTACACCATTATAGTTTCCCGCTC ACTTTCGGCGGAGGGACCAAGGTGGAGATCA AA |  CAGGTGCAGATGGTGGAGTCTGGGGGAGGCGTG GTCCAGCCTGGGAGGTCCCTGAGACTCTCCTGTG CAGCGTCTGGATTCACCTTCAGTACCTATGGCAT GCACGTGGGTCCGCCAGGCTCCAGGCAAGGGCT GGAATGGATGGCAATTATATGGTATGATGGAACT AATAAATACTATGCAGACTCCGTGAAGGGCCGA TTCACCATCTCCAGAGACAATTCCAAGAACACGC TGTATCTGCAACTGAACAGCCTGAGAGCCGAGG ACACGGCTGTGTATTACTGTGCGCGAGATCCCT ACGTGGATACAAATGACCGGTTATGGACTACTGG GGCCAGGGAACCCTGGTCACCGTCTCCTCA |
| | | | SEQ ID NO: 26505 | SEQ ID NO: 30511 |
| | | AA | DIQMTQSPSSLSASVGDRVTITCRASQGVRNDLG WYQQKPGKAPKHLIYAASSLQNGVPSRFSGSGS GTEFTLTISSLQPEDFATYYCLHHYSFPLTFGGGT KVEIK | QVQMVESGGGVVQPGRSLRLSCAASGFTFSTYGM HWVRQAPGKGLEWMAIIWYDGTNKYYADSVKGR FTISRDNSKNTLYLQLNSLRAEDTAVYYCARDPLR GYNDPVMDYWGQGTLVTVSS |
| | | | SEQ ID NO: 26506 | SEQ ID NO: 30512 |
| iPS:435727 | 21-225_172E11 | NA | GACATGTGCAGTCTGGATGACCCAGTCTCCAGACTCCT GGCGGGTGTCTGCGGAGAGGGCCACCATCA ACTGCAAGTCCAGCCAGAGTGTTTTACACAGC TCCAACAATAACAACTACTTAGCTTGGTACCA GCAGAAACCAGGACAGCCTCCTAAGCTGCTCA TTTACTGGGCATCTACTCGGGAATCCGGGGTC CCTGACCGATTCAGTGGCAGCGGGTCTGGGAC AGATTTCATTCTCACCATCAGCGGCCTGCAGG CTGAAGATGTGGCAGTTTATTACTGTCAGCAA TATTTTACTACTCCGTGCAGTTTTGGCCAGGGG ACCAAGCTGGAGATCAAA | CAGGTGCAGCTGGTGCAGTCTGGGGCTGAGGTG AAGAAGCCTGGGGCCTCAGTGATGGTCTCCTGCA AGGCTTCTGGATACACCTTCACCAATTATGATAT CAACTGGGTGCGACAGGCCACTGGACAAGGGCT TGAGTGGATGGGATGGATGCACAGAAGTTCCAGGCAGA AACACAAGGCTATGCACAGGAACACTCCATAAGCACA GCCTACATGGAGCTGAGCAGCCTGAGATCTGAG GACACGGCCGTGTACCGGTTGTCACTGTGCGTATAGCAGTG GCTGGTACCGGTTTGACTACTGGGGCCAGGGAAC CCTGGTCACCGTCTCCTCA |
| | | | SEQ ID NO: 26507 | SEQ ID NO: 30513 |

FIGURE 50
(Continued)

| | | | | |
|---|---|---|---|---|
| iPS:435729 | 21-225_173E7 | AA | DIVMTQSPDSLAVSLGERATINCKSSQSVLHSSN NNNYLAWYQQKPGQPPKLLIYWASTRESGVPD RFSGSGSGTDFILTISGLQAEDVAVYYCQQYFTT PCSFGQGTKLEIK<br>SEQ ID NO: 26508 | QVQLVQSGAEVKKPGASVMVSCKASGYTFTNYDI NWVRQATGQGLEWMGWMHPNSGNTGYAQKFQG RVTMTRNTSISTAYMELSSLRSEDTAVYYCAYSSG WYRFDYWGQGTLVTVSS<br>SEQ ID NO: 30514 |
| | | NA | GACATCCAGATGACCCAGTCTCCATCCTCCG GTCTGCATGTATAGGAGACAGAGCCACCATCA CTTACCGTGCAAGTCAGACCATTAGCAACTAT TTAAAATTGGTATCAGCAGAAACCAGGAAAG CCCCTAAACTCCTTATCTATGCTGCATCCAGTT TGCAAATTGGGGTCCCATCAAGGTTCAGTGGC AGTGGATCTGGGACAGATTCACTCTCACCAT CAGCAGTGTGCAACTGAAGATTTTGCAACTT ACTTCTGTCAACAGAGTTACAGAACCCCTCAG TGGACGTTCGGCCAAGGGACCAAGGTGGAAA TCAAA<br>SEQ ID NO: 26509 | GAGGTGCAGTTGTTGGAGTCTGGGGGAGGCTCG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCATTTATTAGTGGTAGTGGTGGT AACACATTCTACGCAGACTCCGTGAAGGGCCGGT TCACCATCTCCAGAGACAATTCCAAGAACACGCT GTATCTGCAAATGAACAGCCTGCAAGCCGAGGA CACGGCCGTATATTACTGTACGAAAAGGATACC TACAACGGTTGGGATGCTTTTGATATCTGGGGCC AAGGGACAATGGTCACCGTCTCTTCA<br>SEQ ID NO: 30515 |
| | | AA | DIQMTQSPSSRSACIGDRATITYRASQTISNYLN WYQQKPGKAPKLLIYAASSLQIGVPSRFSGSGSG TDFFLTISSVQPEDFATYFCQQSYRTPQWTFGQG TKVEIK<br>SEQ ID NO: 26510 | EVQLLESGGGSVQPGGSLRLSCAASGFTFSSYAMS WVRQAPGKGLEWVSFISGSGGNTFYADSVKGRFTI SRDNSKNTLYLQMNSLQAEDTAVYYCTKRDTYNG WDAFDIWGQGTMVTVSS<br>SEQ ID NO: 30516 |

FIGURE 50
(Continued)

| | | | | |
|---|---|---|---|---|
| iPS:435731 | 21-225_173A11 | NA | GATATTGTGATGACCCAGACTCCACTCTCTCT GTCCGTCACCCCTGGACAGCCGGCCTCCATCT CCTGCAAGTCTAGTCAGAGCCTCCTGCATGGT GATGGAAAGACCTATTTGTATTGGTACCTGCA GAAGCCAGGCCAGCCTCCACAGCTCCTGATCT ATGAAGTTTCCAACCGGTTCTCTGGCGTGCCA GATAGGTTCAGTGGCAGCGGGTCAGGGACAG ATTTCACACTGAAAATCAGCCGGGTGGAGGCT GAGGATGTTGGGGTTTTTTCTGCATGCAAAG TATACAGGTTCCGTGGACGTTCGGCCAAGGGA CCAAGGTGGAAATCAAA | CAGGTGCAGCTGGTGGTGGAGTCTGGGGAGGCGTG GTCCAGCCTGGGGAGGTCCCTGAGACTCTCCTGTG CAGGCTCTGGATTCACCTTCAGTAGCTATGGCAT GCACTGGGTCCGCCAGGCTCCAGGCAAGGGGCT GGAGTGGGTGGCAATTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGCCTA CGATTTTTGGAGTGGTTCTTTGACTCCTGGGGCC AGGGAACCCTGGTCACCGTCCTCTCA |
| | | | SEQ ID NO: 26511 | SEQ ID NO: 30517 |
| | | AA | DIVMTQTPLSLSVTPGQPASISCKSSQSLLHGDG KTYLYWYLQKPGQPPQLLIYEVSNRFSGVPDRFS GSGSGTDFTLKISRVEAEDVGVFFCMQSIQVPWT FGQGTKVEIK | QVQLVESGGGVVQPGRSLRLSCAASGFTFSSYGMH WVRQAPGKGLEWVAIIWYDGSNKYYADSVKGRFT ISRDNSKNTLYLQMNSLRAEDTAVYYCAREAYDF WSGFFDSWGQGTLVTVSS |
| | | | SEQ ID NO: 26512 | SEQ ID NO: 30518 |
| iPS:435733 | 21-225_173C11 | NA | GATATTGTGATGACCCAGACTCCACTCTCTCT GTCCGTCACCCCTGGACAGCCGGCCTCCATCT CCTGCAAGTCTAGTCAGAGCCTCCTGCATAGT GAGGAAAGACCTACTTGTATTGGTACCTGCA GAAGCCAGGCCAGCCTCCACAGCTCCTGATCT ATGAAGTTTCCCACCGGTTCTCTGGAGTGCCA GATAGGTTCAGTGGCAGCGGGTCAGGGACAG ATTTCACACTGAAAATCAGCCGGGTGGAGGCT GAGGATGTGGGGTTTATTACTGCATGCAAAG TATACAGCTTCTCACTTTCGGCGGAGGGACCA AGGTGGAGATCAAA | CAGGTGCAGCTGGTGGTGGAGTCTGGGGGAGGCGTG GTCCAGCCTGGGGAGGTCCCTGAGACTCTCCTGTG CAGGCTCTGGATTCACCTTCAGTAGCTATGGCAT ACACTGGGTCCGCCAGGCTCCAGGCAAGGGACT GGAGTGGGTGGCACTTATATTTATGATGGAAGT AATAAATACTATGCAGACTCCGTGAAGGGCCGA TTCACCATCTCCAGAGACAATTCCAAGAACACGC TGTATCTGCATATGAGCAGCCTGAGAGCCGAGG ACACGGCTGTGTATTACTGTGCGAGACGGTATAG CAGCAGCTGTCCGGTGTATGGACGTCTGGGGC CAAGGGACCACGGTCACCGTCTCCTCA |
| | | | SEQ ID NO: 26513 | SEQ ID NO: 30519 |

FIGURE 50
(Continued)

| | | | |
|---|---|---|---|
| iPS:435735 | 21-225_173H12 | AA | DIVMTQTPLSLSVTPGQPASISCKSSQSLLHSEGK TYLYWYLQKPGQPPQLLIYEVSHRFSGVPDRFSG SGSGTDFTLKISRVEAEDVGVYYCMQSIQLLTFG GGTKVEIK<br>SEQ ID NO: 26514 | QVQLVESGGGVVQPGRSLRLSCAASGFTFSSYGIH WVRQAPGKGLEWVALIFYDGSNKYYADSVKGRFT ISRDNSKNTLYLHMSSLRAEDTAVYYCARRYSSSW SGGMDVWGQGTTVTVSS<br>SEQ ID NO: 30520 |
| | | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATACTACATCCAGT TTGCAAAGTGGGGTCCCATCAAGGTTCAGGTGG CAGTGGATCTGGGACAGAATTCACTCTCACAA TCAGCAGCCTGCAGCCTGAAGATTTTGCAAGT TATTACTGTCTACAGCATTATAGTTTCCCGAAC ACTTTCGGCGGAGGGACCAAGGTGGAGATCA AA<br>SEQ ID NO: 26515 | CAGGTGCAGCTGGTGGAGTCTGGGGGAGGCGTG GTCCAGCCTGGAGGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAATTATATGGTATGATGAACT AACAAATACTATGCAGACTCCGTGAAGGCCGA TTCACCATCTCCAGAGACAATTCCAAGAACACGC TGTATCTGCAACTGAACAGCCTGAGAGCCGAGG ACACGGCTGTGTATTACTGTGCGCGAGATCCCTT ACGTGGATACAATGACCGGTTATGGACTACTGG GGCCAGGGAACCCTGGTCACCGTCTCCTCA<br>SEQ ID NO: 30521 |
| | | AA | DIQMTQSPSSLSASVGDRVTITCRASQGIRNDLG WYQQKPGKAPKRLIYTTSSLQSGVPSRFSGSGSG TEFTLTISSLQPEDFASYYCLQHYSFPNTFGGGTK VEIK<br>SEQ ID NO: 26516 | QVQLVESGGGVVQPGRSLRLSCAASGFTFSSYGMH WVRQAPGKGLEWVAIIWYDGTNKYYADSVKGRF TISRDNSKNTLYLQLNSLRAEDTAVYYCARDPLRG YNDPVMDYWGQGTLVTVSS<br>SEQ ID NO: 30522 |

FIGURE 50
(Continued)

| | | | |
|---|---|---|---|
| iPS:435737 | 21-225_174G5 | NA | GACATCGTGATGACCCAGTCTCCAGATTCCCT GGCTGTGTCTCTGGGCGCAGAGGGCCACCATCA ATTGCAAGTCCAGCAGTGTATTACACAGC TCCAACAATTACAACTACTTAACTTGGTACCA GCAGAAATCAGGACAGCCTCCTAAGCTGCTCA TTTACTGGGCATCTACCCGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATCGTACTCCGTGGACGTTCGGCCAAGG GACCAAGGTGGAAATCAAA SEQ ID NO: 26517 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGGTTAGCAGT GGCTGGTACTGGTTCGACCCCTGGGGCCAGGA ACCCTGGTCACCGTCTCCTCA SEQ ID NO: 30523 |
| | | AA | DIVMTQSPDSLAVSLGARATINCKSSQSVLHSSN NYNYLTWYQQKSGQPPKLLIYWASTRESGVPDR FSGSGSGTDFTLTISSLQAEDVAVYYCQQYYRTP WTFGQGTKVEIK SEQ ID NO: 26518 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAVSSGW YWFDPWGQGTLVTVSS SEQ ID NO: 30524 |
| iPS:435739 | 21-225_174G7 | NA | GCCATCCAGATGACCCAGTCTCCATCTTCCGT GTCTGCATCTGTAGGAGACAGAGTCACCATCA CTTGTCGGGCAGTCAGGGTATTAGCAACTGG TTAGCCTGGTATCAGCAGAAACCAGGGAAAG CCCCTAAACCTCCTGATCCATGCTGCATCAGTT TGCAAGGTCGGGTTCCCATCAAGGTTCAGCGGC AGTGGATCTGGGACAGATTTCACTCTCACCAT CAGCAGCCTGCAGCCTGAAGATTTTGCAACTT ACTATTGTCAACAGACTAACAGTTTCCCGTGG ACGTTCGGCCAAGGGACCAAGGTGGAAATCA AA SEQ ID NO: 26519 | GAGGTGCAGTTGTTGGAGTCTGGGGGAGGCTTGG TACAGCCTGGGGGGTCCCTGAGACTCTCCTGTGC AGCCTCTGGATTCACCTTTAGGAGTCTGCCATG AGCTGGGTCCGCCAGGCTCCAGGGAAGGGGCTG GAGTGGGTCTCAGTTATTAGTGGTAGTGGTGGTA GCACATTCTACACAGACTCCGTGAAGGGCCGGTT CACCATCTCCAGAGACAATTCCAAGAACACGCTG TATCTGCAAATGAACAGCCTGAGAGCCGAGGAC ACGGCCGTATATTACTGTGCGAAATGAATAGCA GTGGCTGGTTTGACTACTGGGGCCAGGGAACCCT GGTCACCGTCTCCTCA SEQ ID NO: 30525 |

FIGURE 50
(Continued)

| | | | | |
|---|---|---|---|---|
| iPS:435741 | | AA | AIQMTQSPSSVSASVGDRVTITCRASQGISNWLA WYQQKPGKAPNLLIHAAFSLQGGVPSRFSGSGS GTDFFLTISSLQPEDFATYYCQQTNSFPWTFGQG TKVEIK<br>SEQ ID NO: 26520 | EVQLLESGGGLVQPGGSLRLSCAASGFTFRSSAMS WVRQAPGKGLEWVSVISGSGSTFYTDSVKGRFTI SRDNSKNTLYLQMNSLRAEDTAVYYCAKSNSSGW FDYWGQGTLVTVSS<br>SEQ ID NO: 30526 |
| | 21-225_174G10 | NA | GACATCCAGATGACCCAGTCTCCATCCTCCCT GTCTGCATCTGTAGGAGACAGAGTCACCATCA CTTGCCGGGCAAGTCAGGGCATTAGAGATGAT TTAGGCTGGTATCAACAGAAACCAGGGAAAG TCCCTAAGCGCCTGATATATGCTGCATCCAGT TTGCAAAGTGGGGTCCCATCAAGGTTCAGCGG CAGTGGATCTGGGACAGAATTCACTCTCACAA TCAGCAGCCTACAGCCTGAAGATTTTGCAACT TATTACTGTCTTCAGCATCATAGTTTACCCTCGG ACGTTCGGCCAAGGGACCAAGGTGGAAATCA AA<br>SEQ ID NO: 26521 | CAGGTGCAGCTGGTGGAGTCTGGGGGAGGCGTG GTCCAGCCTGGGAGGTCCCTGAGACTCTCCTGTG CAGCCGTCTGGATTCACCTTCAGTGACTATGTCAT GCACTGGGTCCGCCAGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAATTGAACAGCTGAAGAGCCGAGG ACACGGCTGTGTATTACTGTGCAGAGAGAAGGTA TAGCAGTGGCTGGTACGACTACGGTATGACGTC TGGGGCCAAGGGACCACGGTCACCGTCTCCTCA<br>SEQ ID NO: 30527 |
| | | AA | DIQMTQSPSSLSASVGDRVTITCRASQGIRDDLG WYQQKPGKVPKLIYAASSLQSGVPSRFSGSGS GTEFTLTISSLQPEDFATYYCLQHHSYPRTFGQG TKVEIK<br>SEQ ID NO: 26522 | QVQLVESGGGVVQPGRSLRLSCAASGFTFSDYVM HWVRQAPGKGLEWVAVIWYDGSNKYYADSVKGR FTISRDNSKNTLYLQLNSLRAEDTAVYYCARERYSS GWYDYGMDVWGQGTTVTVSS<br>SEQ ID NO: 30528 |

FIGURE 50
(Continued)

| | | | | |
|---|---|---|---|---|
| iPS:435743 | 21-225_175G1 | NA | GACATCCAGATGACCCAGTCTCCATCTCCT<br>GTCTGCATCTGTAGGAGACAGAGTCACCATCA<br>CTTGCCGGGCAAGTCAGGGCATTAGAACTGAT<br>TTAGGCTGGTATCAGCAGAAACCAGGGAAAG<br>CCCCTAAGCGCCTGATCTATACTGCATCCAGT<br>TTGCAAAGTGGGGTCCCATCAAGGTTCAGTCGG<br>CAGTGGATCTGGGACAGATTCACTCTCACGA<br>TCAGCAGCCTGCAGCCTGAAGATTTTGCAACT<br>TATTACTGTCTACACAGCATTATAGTTACCCGCTC<br>ACTTTCGGCGGAGGGACCAAGGTGGAGATCA<br>AG<br>SEQ ID NO: 26523 | CAGGTGCAACTGGTGGAGTCTGGGGGAGGCGTG<br>GTCCAGCCTGGGGGGGTCCCTGAGACTCTCCTGTG<br>CAGCGTCTGGCTTCACCTTCAGTACTACTATGGCAT<br>GCACTGGGTCCGCCAGGCTCCAGGCAAGGGGCT<br>GGAGTGGGTGGCAGTTATATGTATGATGGAAGT<br>AATAAATACTATGCAGACTCCGTGAAGGGCCGA<br>TTCACCATATCCAGAGACAATTCCAAGAACACGC<br>TGTATCTGCAAATGAACAGCCTGAGAGCCGAGG<br>ACACGGCTGTGTATTACTGTGCGAGAGATCCTT<br>ACGTGGATACAATGACCCGGTTATGGACTACTGG<br>GGCCAGGGAACCCTGGTCACCGTCTCCTCA<br>SEQ ID NO: 30529 |
| | | AA | DIQMTQSPSSLSASVGDRVTITCRASQGIRTDLG<br>WYQQKPGKAPKRLIYTASSLQSGVPSRFSGSGSG<br>TEFTLTISSLQPEDFATYYCLQHYSYPLTFGGGT<br>KVEIK<br>SEQ ID NO: 26524 | QVQLVESGGGVVQPGGSLRLSCAASGFTFSTYGMH<br>WVRQAPGKGLEWVAVIWYDGSNKYYADSVKGRF<br>TISRDNSKNTLYVQMNSLRAEDTAVYYCARDPLRG<br>YNDPVMDYWGQGTLVTVSS<br>SEQ ID NO: 30530 |
| iPS:435745 | 21-225_175G3 | NA | GACATCCAGATGACCCAGTCTCCATCCTCACT<br>GTCTGCATCTGTAGGAGACAGAGTCACCATCA<br>CTTGTCGGGCGAGTCAGGACATTAGCAAGGAT<br>TTAGCCTGGTTTCAGCAGAAACCAGGGAAAGC<br>CCCTAAGTCCCTGATCTTTTCTGCATCCAGTTT<br>GCAAAGTGGGGTCCCATCAAAGTTCAGCGGCA<br>GTGGATCTGGGACAGATTTCACTCTCACCATC<br>AGCAGCCTGCAGCCTGAAGATTTTGCAACTTA<br>TTACTGCCAACAATCTGATAGTTACCCTCTCAC<br>TTTCGGCGGAGGGACCAAGGTTGAGATCAAA<br>SEQ ID NO: 26525 | CAGGTACAGGTGGTGCAGTCTGGGGCTGAGGTG<br>AAGAAGCCTGGGGCCTCAGTGAAGGTCTCCTGC<br>AAGGCTTCTGGATACACCTTCACCGGCTACTTTA<br>TGCACTGGGTGCGACAGGCCCCTGGACAAGGGC<br>TTGAATGGATGGGATGGATCAAGCCTAACAGAGGC<br>GTGGCACAAACTGTGCACAGAGGTTTCAGGGCA<br>GGGTCACCATGACCAGGGACACGTCCATCACCA<br>CAGCCTACATGGAACTGAGCAGGCTGCGATCTG<br>ACGACGGCCGTGTATTATTGTGTGAGAGGGGG<br>GACTACGGTGACTACGGTGGGGGGTCTTTGACTAC<br>TGGGGCCAGGGAACCATGGTCACCGTCTCCTCA<br>SEQ ID NO: 30531 |

FIGURE 50
(Continued)

| | | | | |
|---|---|---|---|---|
| | | AA | DIQMTQSPSSLSASVGDRVTITCRASQDISNDLAWFQQKPGKAPKSLIFSASSLQSGVPSKFSGSGSGTDFTLTISSLQPEDFATYYCQQSDSYPLTFGGGTKVEIK<br><br>SEQ ID NO: 26526 | QVQVVQSGAEVKKPGASVKVSCKASGYTFTGYFMHWVRQAPGQGLEWMGWIKPKSGGTNCAQRFQGRVTMTRDTSITTAYMELSRLRSDDTAVYYCVRGGTTVTTWGVFDYWGQGTMVTVSS<br><br>SEQ ID NO: 30532 |
| iPS:435747 | 21-225_175C4 | NA | GACATCCAGATGACCCAGTCTCCATCCTCACTGTCTGCATCTGTAGGAGACAGAGTCACCATCACTTGTCGGGCGAGTCAGGGCATTGGGAATTATTTAGCCTGGTTTCAGCAGAAACCAGGGAAAGCCCCTAAGTCCCTGATCTATGCTGCATCCGGTTTGCAAAGTGGGTTCCCATCAAAATTCAGCGGCAGTGGATCTGGGACAGCCTTCACTCTCACCATCAGCAGCCTACAGCCTGAAGATTTTGCAACTTATTACTGCCAACAGTATTATAGTTACCATTCACTTTCGGCCCTGGGACCAAAGTGGATATCAAA<br><br>SEQ ID NO: 26527 | GAGGTGCAGCTGTTGGAGTCTGGGGGAGGCTTGGTGCAGCCTGGGGGGTCCCTGAGACTCTCCTGTGCAGCCTCTGCATTCACCTTTAGCAGCTATGTCATGAGCTGGGTCCGCCAGGCTCCAGGGAAGGGGCTGGAGTGGGTCTCTGCTATTAGTGGTAGTGGTGATAGAACATACTACGCAGACTCCGTGAAGGGCCGGTTCACCATCTCCAGAGACGATTCAATACCACGCTGTATCTGCAAATGAACAGCCTGAGAGCCGAGGACACGGCCGTATATTACTGTGCGAGAACAGCGGGCTTTGACTACTGGGGCCAGGGAACCCTGGTCACCGTCTCCTCA<br><br>SEQ ID NO: 30533 |
| | | AA | DIQMTQSPSSLSASVGDRVTITCRASQGIGNYLAWFQQKPGKAPKSLIYAASGLQSGFPSKFSGSGSGTDFTLTISSLQPEDFATYYCQQYYSYPFTFGPGTKVDIK<br><br>SEQ ID NO: 26528 | EVQLLESGGGLVQPGGSLRLSCAASAFTFSSYVMSWVRQAPGKGLEWVSAISGSGDRTYYADSVKGRFTISRDDSNTTLYLQMNSLRAEDTAVYYCARTAGFDYWGQGTLVTVSS<br><br>SEQ ID NO: 30534 |

FIGURE 50
(Continued)

| | | | |
|---|---|---|---|
| iPS:435749 | 21-225_175C10 | NA | GACATCCAGATGACCCAGTCTCCATCTTCCGT GTCTGCATCTGTAGGAGACAGAGTCACCATCA CTTGTCGGGCGAGTCAGGGTATTACCGACTGG TTAGCCTGGTATCAGCAGAAACCAGGGAAAG CCCCTAAGCTCCTGATCTATGCTGCATCCAGTT TGCAAAGTGGGGTCCCATCAAGGTTCAGCGGC AGTGGATCTGGGACAGATTTCACTCTCACCTT CAGCAGCCTGCAGCCTGACGATTTTGCAACTT ACTATTGTCAACAGACTAACAGTTTCCCGTGG ACGTTCGGCCAAGGGACCAAGGTGGAAATCA AA

SEQ ID NO: 26529 | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCGTCTATTAGTGGTGTGGTGGT AGCACGTTCTACGCAGACTCCGTGAAGGGCCGGT TCACCGTCTCCAGAGACAATTCCAAGAACACGCT GTATCTGCAAATGAACAGCCTGAGAGCCGAGGA AGGCCCGTATATTACTGTGCGAAATCGAATAGC AGTGGCTGGTTTGACTACTGGGGCCAGGGAACCC TGGTCACCGTCTCCTCA

SEQ ID NO: 30535 |
| | | AA | DIQMTQSPSSVSASVGDRVTITCRASQGITDWLA WYQQKPGKAPKLLIYAASSLQSGVPSRFSGSGS GTDFTLTFSSLQPDDFATYYCQQTNSFPWTFGQ GTKVEIK

SEQ ID NO: 26530 | EVQLLESGGGLVQPGGSLRLSCAASGFTFSSYAMS WVRQAPGKGLEWVSSISGRGGSTFYADSVKGRFT VSRDNSKNTLYLQMNSLRAEDTAVYYCAKSNSSG WFDYWGQGTLVTVSS

SEQ ID NO: 30536 |
| iPS:435751 | 21-225_175D10 | NA | GACATCGTGATGACCCAGTCTCCAGACTCCCT GGCTGTCTCTGGCGAGAGGGCCACCATCA ACTGCAAGTCCAGCCAGAGTGTTTTATACAGC TCCAACAATAACAACTACTTAGCTTGGTACCA GCAGAAACCAGGACAGCCTCCTAACCTGCTCA TTTACTGGACATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAAA

SEQ ID NO: 26531 | CAGGTGCAGCTGGTGCAGTCTGGGGCTGAGGTG AAGAAGCCTGGGGCCTCAGTGAAGGTCTCCTGC AAGGCTTCTGGTTACACCTTCACCAATTATGATC TCAACTGGGTGCGACAGGCCACTGGACAAGGGC TTGAGTGGATGGGATGGATGCACAGAAGTTCACAGTGG TAACACAGGCTATGCACCAGGAACACCTCCATAAGCAC AGTCCACCATGACCAGGAACACCTCCATAAGCAC AGTTTACATGGAGCTGAGCAGCCTGAGATCTGAG GACACGGCCGTGTATTACTGTGCGTATAGCAGTG GCTGGTACTACTTTGACTACTGGGGCCAGGGAAC CCTGGTCACCGTCTCCTCA

SEQ ID NO: 30537 |

FIGURE 50
(Continued)

| | | | |
|---|---|---|---|
| iPS:435753 | 21-225_175G10 | AA | DIVMTQSPDSLAVSLGERATINCKSSQSVLYSSN NNNYLAWYQQKPGQPPNLLIYWTSTRESGVPDR FSGSGSGTNFTLTISSLQAEDVAVYYCQQYYSTP PTFGQGTKVEIK<br>SEQ ID NO: 26532 | QVQLVQSGAEVKKPGASVKVSCKASGYTFTNYDL NWVRQATGQGLEWMGWMHPNSGNTGYAQKFQG RVTMTRNTSISTVYMELSSLRSEDTAVYYCAYSSG WYYFDYWGQGTLVTVSS<br>SEQ ID NO: 30538 |
| | | NA | GACATCCAGATGACCCAGTCTCCATCCTCCCT GTCTGCATCTGTAGGAGACAGAGTCATCATCA CTTGCCGGGCAAGTCAGAGACCATTGGCAACTAT TTAAATTGGTATCAGCAGAAACCAGGGAGAG CCCCTAAGCTCCTGATCTATGCTGCATCCAGTT TGCACAGTGGGGTCCCATCAAGGTTCAGTGGC AGTGGATCTGGGACAGATTTCACTCTCACCAT CAGCAGTCTGCAACACAGAGTTACAGAACCCTCAG ACTTCTGTCAACAGAGTTACAGAACCCTCAG TGGACGTTCGGCCAAGGGACCAAGGTGGAAA TCAAA<br>SEQ ID NO: 26533 | GAGGTGCAGTTGTTGGAGTCTGGGGGAGGCTTGG TACAGCCTGGGGGGTCCCTGAGACTCTCCTGTGC AGCCTCTGGATTCACCTTTAGCAGCTATGCCATG AGCTGGGTCCGCCAGACTCCAGGGAAGGGGCTG GAGTGGGTCTCAATTATTAGTGGTAGTGGTGGTA ACACATACTACGCAGACTCCGTGAAGGGCCGGTT CACCATCTCCAGAGACAATTCCAAGAACACGCTG TATCTGCAAATGAACAGCCTGAGAGCCGAGGAC ACGGCCGTATATTACTGTGCGAAAAGGGATACCT GAACGGTTGGGATGCTTTTGATATCTGGGGCCA AGGGACAATGGTCACCGTCTCTTTA<br>SEQ ID NO: 30539 | EVQLLESGGGLVQPGGSLRLSCAASGFTFSSYAMS WVRQTPGKGLEWVSIISGSGGNTYYADSVKGRFTI SRDNSKNTLYLQMNSLRAEDTAVYYCAKRDTWN GWDAFDIWGQGTMVTVSL<br>SEQ ID NO: 30540 |

| | | | | |
|---|---|---|---|---|
| iPS:435753 | 21-225_175G10 | AA | DIVMTQSPDSLAVSLGERATINCKSSQSVLYSSNNNNYLAWYQQKPGQPPNLLIYWTSTRESGVPDRFSGSGSGTNFTLTISSLQAEDVAVYYCQQYYSTPPTFGQGTKVEIK<br>SEQ ID NO: 26532 | QVQLVQSGAEVKKPGASVKVSCKASGYTFTNYDLNWVRQATGQGLEWMGWMHPNSGNTGYAQKFQGRVTMTRNTSISTVYMELSSLRSEDTAVYYCAYSSGWYYFDYWGQGTLVTVSS<br>SEQ ID NO: 30538 |
| | | NA | GACATCCAGATGACCCAGTCTCCATCCTCCCTGTCTGCATCTGTAGGAGACAGAGTCATCATCACTTGCCGGGCAAGTCAGAGACCATTGGCAACTATTTAAATTGGTATCAGCAGAAACCAGGGAGAGCCCCTAAGCTCCTGATCTATGCTGCATCCAGTTTGCACAGTGGGGTCCCATCAAGGTTCAGTGGCAGTGGATCTGGGACAGATTTCACTCTCACCATCAGCAGTCTGCAACAGAGTTACAGAACCCTCAGACTTCTGTCAACAGAGTTACAGAACCCTCAGTGGACGTTCGGCCAAGGGACCAAGGTGGAAATCAAA<br>SEQ ID NO: 26533 | GAGGTGCAGTTGTTGGAGTCTGGGGGAGGCTTGGTACAGCCTGGGGGGTCCCTGAGACTCTCCTGTGCAGCCTCTGGATTCACCTTTAGCAGCTATGCCATGAGCTGGGTCCGCCAGACTCCAGGGAAGGGGCTGGAGTGGGTCTCAATTATTAGTGGTAGTGGTGGTAACACATACTACGCAGACTCCGTGAAGGGCCGGTTCACCATCTCCAGAGACAATTCCAAGAACACGCTGTATCTGCAAATGAACAGCCTGAGAGCCGAGGACACGGCCGTATATTACTGTGCGAAAAGGGATACCTGAACGGTTGGGATGCTTTTGATATCTGGGGCCAAGGGACAATGGTCACCGTCTCTTTA<br>SEQ ID NO: 30539 |
| | | AA | DIQMTQSPSSLSASVGDRVIITCRASQTIGNYLNWYQQKPGRAPKLLIYAASSLHSGVPSGFSGSGSGTDFTLTISSLQPEDFATYFCQQSYRTPQWTFGQGTKVEIK<br>SEQ ID NO: 26534 | EVQLLESGGGLVQPGGSLRLSCAASGFTFSSYAMSWVRQTPGKGLEWVSIISGSGGNTYYADSVKGRFTISRDNSKNTLYLQMNSLRAEDTAVYYCAKRDTWNGWDAFDIWGQGTMVTVSL<br>SEQ ID NO: 30540 |

FIGURE 50
(Continued)

| | | | |
|---|---|---|---|
| iPS:435755 | 21-225_176H4 | NA | GATATTGTGATGACCCAGACTCCACTCTCTCT GTCCGTCACCCCTGGACAGCCGGCCTCCATCT CCTGCAAGTCTAGTCAGAGCCTCCTGCATGGT GATGGAAAGACCTATTTGTATTGGTACCTGCA GAAGCCAGGCCAGGCTCCACAGCTCCTGATCT ATGAAGTTTCCAACCGGTTCTCTGGAGTGCCA GATAGGTTCAGTGGCAGCGGGTCAGGGACAG ATTTCACACTGAAAATCAGCCGGTGGAGGCT GAGGATGTTGGGATTTATTACTGCATGCAAAG TATACAGATTCCGTGACGTTCGGCCAAGGGA CCAGGGTGGAAATCAAA SEQ ID NO: 26535 | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGGCAT GCACTGGGTCCGCCAGGCTCCAGGCAAGGGGCT GGAGTGGGTGGCAATTATATGGTATGATGGAAGT TATAAATACTATGCAGACTCCGTGAAGGGCCGAT TCACCATCTCCAGAGACAATTCCAAGAACACGCT GTATCTGCAAATGAGCAGCCTGAGAGCCGAGGA CACGGCTGTGTATTACTGTGCGAGAGATGCCAC GATTTTGGAGTGGTTACTTTGCCTACTGGGGCC AGGGAGCCCTGGTCACCGTCTCCTCA SEQ ID NO: 30541 |
| | | AA | DIVMTQTPLSLSVTPGQPASISCKSSQSLLHGDG KTYLYWYLQKPGQPPQLLIYEVSNRFSGVPDRFS GSGSGTDFTLKISRVEAEDVGIYYCMQSIQIPWT FGQGTRVEIK SEQ ID NO: 26536 | QVQLVESGGGVVQPGRSLRLSCAASGFTFSSYGMH WVRQAPGKGLEWVAIIWYDGSYKYYADSVKGRFT ISRDNSKNTLYLQMSSLRAEDTAVYYCARDAHDF WSGYFAYWGQGALVTVSS SEQ ID NO: 30542 |
| iPS:435759 | 21-225_176E6 | NA | GACATTGTGATGACTCAGTCTCCACTCTCCCTG CCCGTCACCCCTGGAGAGCCGGCCTCCATCTC CTGCAGGTCTAGTCAGAGCCTCCTGCATAATA ATGGATACAAGTATTTGGATTGGTACCTGCAG AAGCCAGGGCAGTCTCCACAGCTCCTGATCTA TTTGGGTTCTAATCGGGCCTCCGGGGTCCCTG ACAGGTTCAGTGGCAGTGGATCAGGCACAGAT TTTACACTGAAAATCAGCGAGTGGAGGCTGA GGATGTTGGGGTTTATTACTGCATGCAAGTC TACAAACTCCGTGACGTTCGGCCAAGGGACC AAGGTGGAAATCAAA SEQ ID NO: 26537 | GAGGTGCAACTGGTGGAGTCTGGGGGAGGCTTG GTACAGCCTGGGGGGTCCCTGAGACTCTCCTGTG CAGCCTCAGGATTCACCTTCAGTGGCCATAGTAT GAACTGGGTCCGCCAGGCTCCAGGGAAGGGGCT GGAGTGGGTTGCATACATTAGCATTAGTGGTAGT ACCATAAAGTACGCAGACTCTGTGAAGGGCCGA TTCATCATCTCCAGAGACAATGCCAGGGATTCAC TGTATCTGCAAATGAACAGCCTGAGAGACGAGG ACACGGCTGTGTTATTACTGTGCGAGAAGGGGAT TACTGTGGTTCGGAATGAGGACGGTTTGGACGTC TGGGGCCAAGGGACCACGGTCACCGTCTCCTCA SEQ ID NO: 30543 |

FIGURE 50
(Continued)

| | | | | |
|---|---|---|---|---|
| iPS:435761 | | AA | DIVMTQSPLSLPVTPGEPASISCRSSQSLLHNNGY KYLDWYLQKPGQSPQLLIYLGSNRASGVPDRFS ASGSGTDFTLKISRVEAEDVGVYYCMQVLQTPW TFGQGTKVEIK<br>SEQ ID NO: 26538 | EVQLVESGGGLVQPGGSLRLSCAASGFTFSGHSMN WVRQAPGKGLEWVAYISISGSTIKYADSVKGRFIIS RDNARDSLYLQMNSLRDEDTAVYYCARRGITVVR NEDGLDVWGQGTTVTVSS<br>SEQ ID NO: 30544 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTTTCAGCAGAAACCAGGGAAAGC CCCTAAGCGCCTGATCTATGCTGCATCCAGTTT GCAAAGTGGGGTCCATCAAGGTTCAGCGGCA GTGGATCTGGGACAGATTCACTCTCACACTC AGCAGCCTGCAGCTGACATTATAGTTGCAACTTA TTATTGTCTACAGCATTATAGTTACCCGCTCAC TTTCGGCGGAGGGACCAAGGTGGAGATCAAA<br>SEQ ID NO: 26539 | CAGGTGCAGCTGGTGGAGTCTGGGGGAGGCGTG GTCCAGCCTGGGAGGTCCCTGAGACTCTCCTGTG CAGCGTCTGGATTCACCTTCAGTACCTATGGCAT GCACTGGGTCCGCCAGGCTCCAGGCAAGGGCCT GGAGTGGGTGTCAATTATATGGTATGATGGAACT AATAAATACTATGCAGACTCCGTGAAGGGCCGA TTCACCATCTCCAGAGACAATTCCAAGAACACGC TGTTTCTGCAACTGAACAGCCTGAGAGCCGAGGA CACGGCTGTCTATTACTGTGCGCGAGATCCCTTA CGTGGATACAATGACCCGGTTTTGGACTACTGGG GCCAGGGAACCCTGGTCACCGTCTCCTCA<br>SEQ ID NO: 30545 |
| 21-225_176B11 | | AA | DIQMTQSPSSLSASVGDRVTITCRASQGIRNDLG WFQQKPGKAPKRLIYAASSLQSGVPSRFSGSGSG TEFTLTLSSLQPEDFATYYCLQHYSYPLTFGGGT KVEIK<br>SEQ ID NO: 26540 | QVQLVESGGGVVQPGRSLRLSCAASGFTFSTYGMH WVRQAPGKGLEWVSIIWYDGTNKYYADSVKGRFT ISRDNSKNTLFLQLNSLRAEDTAVYYCARDPLRGY NDPVLDYWGQGTLVTVSS<br>SEQ ID NO: 30546 |

FIGURE 50
(Continued)

| | | | |
|---|---|---|---|
| iPS:435763 | 21-225_176H12 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAACCGCCTGATCTATGCTGCATCCAGTT TGCAAAGTGGGGTCCATCACGGTTCAGCGGC AGTGGATCTGGGACAGAATTCACTCTCACAAT CAGCAGCCTGCAGCCTGAAGATTTTGCAACTT ATTACGGTCTACAGCATAATAGTTACCCTCGC AGTTTTGGCCAGGGGACCAAGCTGGAGATCAA A<br>SEQ ID NO: 26541 | CAGGTGCAGCTGGTGGAGTCTGGGGGAGGCGTG GTCCAGCCTGGGGAGGTCCCTGAGACTCTCCTGTG CAGCGTCTGGATTCACCTTCAGTGACTATGTCAT GCACTGGGTCCGCCAGGCTCCAGGCAAGGGCT GGAGTGGGTGGCAGTTATATGGTATGATGAAGT AATAAATACTATGCCGACTCCGTGAAGGGCCGAT TCACCATCTCCAGAGACAATTCCAAGAACACGCT GTATCTGCAAATGAACAGCTGAGAGCCGAGGA CACGGCTGTATATTACTGTGCGAGAGAAAAGTAT AGCAGCAACTGGTACGACTACGGTATGGACGTCT GGGGCCAAGGGACCACGGTCACCGTCTCCTCA<br>SEQ ID NO: 30547 |
| | | AA | DIQMTQSPSSLSASVGDRVTITCRASQGIRNDLG WYQQKPGKAPNRLIYAASSLQSGVPSRFSGSGS GTEFTLTISSLQREDFATYYGLQHNSYPRSFGQG TKLEIK<br>SEQ ID NO: 26542 | QVQLVESGGGVVQPGRSLRLSCAASGFTFSDYVM HWVRQAPGKGLEWVAVIWYDGSNKYYADSVKGR FTISRDNSKNTLYLQMNSLRAEDTAVYYCAREKYS SNWYDYGMDVWGQGTTVTVSS<br>SEQ ID NO: 30548 |
| iPS:435765 | 21-225_177D3 | NA | GACATCCAGATGTCCCAGTCTCCATCTCCACT GTCTGCTTCTGTAGGAGACAGAGTCACCATCA CTTGTCGGGCGAGTCAGGGCATTACCAATTAT TTAGCCTGGTTTCAGCAGAAACCAGGGAAAGC CCCTAAGTCCCTGATCTATGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATAATAGTTACCATTCA CTTTCGGCCCTGGGACCAAAGTGGATATCAAA<br>SEQ ID NO: 26543 | GAGGTGCAGTTGTTGGAGTCTGGGGGAGGCTTGG TACAGCCTGGGGGGTCCCTGAGACTCTCCTGTGC AGCCTCTGGATTCACCTTTAGCAGCTATGTCATG AACTGGGTCCGCCAGGCTCCAGGGAAGGGGCTG GAGTGGGTCTCAGTTATGAGCGGTAGTGGTGGTA GAACATACTACGCAGACTCCGTGAAGGACCGGT TCACCATCTCCAGAGACAATTCCAAGAACACGCT GTCTCTGCAAATGAACAGCTGAGGGCCGAGGA CACGGCCGTATATTACTGTGCGAGAGTGACTTTC TTTGACTATTGGGGCCAGGGAACCCTGGTCACCG TCTCCTCA<br>SEQ ID NO: 30549 |

FIGURE 50
(Continued)

| | | | | |
|---|---|---|---|---|
| iPS:-435767 | 21-225_177B4 | AA | DIQMSQSPSSLSASVGDRVTITCRASQGITNYLAWFQQKPGKAPKSLIYAASSLQSGVPSKFSGSGSGTDFTLTISSLQPEDFATYYCQQYNSYPFTFGPGTKVDIK<br>SEQ ID NO: 26544 | EVQLLESGGGLVQPGGSLRLSCAASGFTFSSYVMNWVRQAPGKGLEWVSGMSGSGGRTYYADSVKDRFTISRDNSKNTLSLQMNSLRAEDTAVYYCARVTFFDYWGQGTLVTVSS<br>SEQ ID NO: 30550 |
| | | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCTCCTGATCTATGCTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGGGGACCAAGCTGGAGATCAAAGTTTTGGCCAGGGGACCAAGCTGGAGATCAAA<br>SEQ ID NO: 26545 | CAGGTGCAGCTGGTGGAGTCTGGGGGAGGCGTGGTCCAGCCTGGGAGGTCCCTGAGACTCTCCTGTGCAGCGTCTGGATTCACCTTCAGTGATTATGTCATGCACTGGGTCCGCCAGGCTCCAGGCAAGGGGCTGGAGTGGGTGGCAGTTATATGGTATATGATGAAGTAATAAATACTATGCAGACTCCGTGAAGGGCCGATTCATAGTCTCCAGAGACAATTCCAAGAACACGCTGTATCTGCAAATGAACAGCCTGAGAGCCGAGGACACGGCTGTGTATTACTGTGCGAGAGAAAGTATAGCAGCAGCTGGTACGACTACGGTTTGACGTCTGGGGCCAAGGGACCACGGTCACCGTCTCCTCA<br>SEQ ID NO: 30551 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHYSFPRSFGQGTKLEIK<br>SEQ ID NO: 26546 | QVQLVESGGGVVQPGRSLRLSCAASGFTFSDYVMHWVRQAPGKGLEWVAVIWYDGSNKYYADSVKGRFIVSRDNSKNTLYLQMNSLRAEDTAVYYCAREKYSSSWYDYGLDVWGQGTTVTVSS<br>SEQ ID NO: 30552 |

FIGURE 50
(Continued)

| | | | |
|---|---|---|---|
| iPS:435769 | 21-225_177B6 | NA | GACATCCAGATGACCCAGTCTCCATCCTCCCT GTCTGCATCTGTAGGAGACAGAGTCACCATCA CTTGCCGGGCAAGTCAGGACATTAGCAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGTGG CAGTGGTTCTGGGACAGATTCACTCTCACAA TCAACAGCCTGCAGCCTGAAGATTTTGCAACT TATTACTGTCTACAGCTTAATAGTTACCCATTC ACTTTCGGCCCTGGGACCAAAGTGGATATCAA A | GAGGTGCAGCTGTTGGAGTCTGGGGGAGGCTTG GTACAGCCGGGGGGGTCCCGAGACTCTCCTGTG AAGCCTCTGGATTCACCTTTAGCAGTTATGCCAT GAGCTGGGTCCGCCAGGCTCCAGGGAAGGGGCT GGAGTGGGTCTCAGTTATTAGTGGTAGTGGTAGT AACACATACTACGTAGACTCCGTGAAGGGCGG TTCACCATCTCCAGAGACAATTCCAAGAACACGC TGAATCTGCAAATGAACAGCCTGAGAGCCGAGG ACTCGGCCGTATATTACTGTACGAAAGGTTACTA TGATAGTAGTGGTTATTACTACCCTTTGACTTCT GGGGCCAGGGAACCCTGGTCACCGTCTCCTCA |
| | | | SEQ ID NO: 26547 | SEQ ID NO: 30553 |
| | | AA | DIQMTQSPSSLSASVGDRVTITCRASQDISNDLG WYQQKPGKAPKRLIYAASSLQSGVPSRFSGSGS GTEFTLTINSLQPEDFATYYCLQLNSYPFTFGPGT KVDIK | EVQLLESGGGLVQPGGSRRLSCEASGFTFSSYAMS WVRQAPGKGLEWVSVISGSGSNTYYVDSVKGRFTI SRDNSKNTLNLQMNSLRAEDSAVYYCTKGYYDSS GYYYPFDFWGQGTLVTVSS |
| | | | SEQ ID NO: 26548 | SEQ ID NO: 30554 |
| iPS:435771 | 21-225_177B11 | NA | GATATTGTGATGACCCAGACTCCACTCTCTCT GTCCGTCACTCCTGGACAGCCGGCCTCCATCT CCTGCAAGTCTAGTCAGCGCCTCCTGCATGGT GATGAAAGACTCTATTTGTATTGGTACCTGCA GAAGCCAGGCCAGTCCTCCACAGACTCCTGATCT ATGAAGTTCCAACCGGTTCTCTGGAGTGCCA GATAGGTTCAGTGGCAGCGGGTCAGGGACAG AGTTCACACTTAAAATCAGCCGGGTGGAGGCT GAGGATGTTGGGGTTTATTACTGCATGCAAAG TATACAGATTCCGTGGACGTTCGGCCAAGGGA CCAAGGTGGAAATCAAA | CAGGTGCAACTGGTGGAGTCTGGGGGAGGCGTG GTCCAGCCTGGGAGGTCCCTGAGACTCACCTGTG CAGCGTCTGGATTCACCTTCAGTAGTAGTATGGCAT GCACTGGGTCCGCCAGGCTCCAGGCAAGGGGCT GGAGTGGGTGGCAATTATATAGATATGATGGAAGT TATAAATACTATACAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGACTTAC GATTTTTGGAGTGGTTATTTGTCTTCTGGGGCCA GGGAACCCTGGTCACCGTCTCCTCA |
| | | | SEQ ID NO: 26549 | SEQ ID NO: 30555 |

FIGURE 50
(Continued)

| | | | | |
|---|---|---|---|---|
| iPS:435773 | | AA | DIVMTQTPLSLSVTPGQPASISCKSSQRLLHGDG KTYLYWYLQKPGQPPQILYEVSNRFSGVPDRFS GSGSGTEFTLKISRVEAEDVGVYYCMQSIQIPWT FGQGTKVEIK<br><br>SEQ ID NO: 26550 | QVQLVESGGGVVQPGRSLRLTCAASGFTFSSYGMH WVRQAPGKGLEWVAIIWYDGSKYYTDSVKGRFT ISRDNSKNTLYLQMNSLRAEDTAVYYCARETYDF WSGYFVFWGQGTLVTVSS<br><br>SEQ ID NO: 30556 |
| | 21-225_177B12 | NA | GACATCGTGATGACCCAGTCTCCAGACTCCCT GGCTGTGTCTCTGGGCGAGAGGGCTACCGTCA ACTGCAAGTCCAGCCAGAGTGTTTTACACAGC TCCAACAATAACAACTACTTAACTTGGTACCA GCAGAAACCAGGACAGCCTCCTAAGCTGCTCA TTTACTGGGCATCTACCCGGAGAATCCGGGGTC CCTGACCGATTCAGTGGCAGCGGTCTGGGAC AGATTTCACTCTCACCATCAGCAGCCTGTCAGCA CTGAAGATGTGGCAGTTTATTACTGTCAGCAA TATTATAGTAGTCCTCCGACGTTCGGCCAAGG GACCAAGGTGGAAATCAAA<br><br>SEQ ID NO: 26551 | CAGGTGCAGCTGGTGCAGTCTGGGGCTGAGGTG AAGAAGCCTGGGGCCTCAGTGAAGGTCTCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTACTACTGTGCGTATAGCAGT GGCTGGTACTACTTTGACTTCTGGGGCCAGGGAA CCCTGGTCACCGTCTCCTCA<br><br>SEQ ID NO: 30557 |
| | | AA | DIVMTQSPDSLAVSLGERATVNCKSSQSVLHSSN NNNYLIWYQQKPGQPPKLLIYWASTRESGVPDR FSGSGSGTDFTLTISSLQAEDVAVYYCQQYYSSP PTFGQGTKVEIK<br><br>SEQ ID NO: 26552 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YYFDFWGQGTLVTVSS<br><br>SEQ ID NO: 30558 |

FIGURE 50
(Continued)

| | | | |
|---|---|---|---|
| iPS:435775 | 21-225_178A5 | NA | GACATCCAGATGACCCAGTCTCCATCTTCCGT GTCTGCATCTGTAGGAGACAGAGTCACCATCA CTTGTCGGGCGAGTCAGGTATTAGCAACTGG TTAGCCTGGTATCAGCAGAAACCAGGGAAAG CCCCTAAGCTCCTGATCTATGCTGCTTCCAGT TGCAAAGTGGGGTCCCATCAAGGTTCAACGGC AGTGGATCTGGGACAGATTTCACTCTCACCAT CAGCAGCCTGCAGCCTGAAGATTTTGCAACTT ACTGTTGTCAACAGGCTAACAGTTTACCGTGG ACGTTCGGCCAAGGGACCAAGGTGGAAATCA AA SEQ ID NO: 26553 | GAGGTGCACCTGTTGGAGTCTGGGGGAGGCTTGG TACAGACTGGGGGGTCCCTGAGACTCTCCTGTGC AGCCTCTGGATTCACCTTTAGCAGCTATGCCATG ACCTGGGTCCGCCAGGCTCCAGGGAAGGGGCTG GAGTGGGTCTCAGTTATTAGTGGTAGTGGTGTA ATACATTCTACGCAGACTCCGTGAAGGGCCGGTT CACCATCTCCAGAGACAATTCCAAGAATACGCTG TATCTGCAAATGAACAGCCTGAGAGCCGAGGAC ACGGCCGTATATTACTGTGCGCGCCGGACGGTG ACTACTTTGACTACTGGGGCCAGGGAACCCTGGT CACCGTCTCCTCA SEQ ID NO: 30559 |
| | | AA | DIQMTQSPSSVSASVGDRVTITCRASQGISNWLA WYQQKPGKAPKLLIYAASSLQSGVPSRFNGSGS GTDFTLTISSLQPEDFATYCCQQANSLPWTFGQG TKVEIK SEQ ID NO: 26554 | EVHLLESGGGLVQTGGSLRLSCAASGFTFSSYAMT WVRQAPGKGLEWVSVISGSGNTFYADSVKGRFTI SRDNSKNTLYLQMNSLRAEDTAVYYCARRDGDYF DYWGQGTLVTVSS SEQ ID NO: 30560 |
| iPS:435777 | 21-225_178F7 | NA | GACATCCAGATGACCCAGTCTCCATCTTCCGT GTCTGCATCTGTAGGAGACAGAGTCACCATCA CTTGTCGGGCGAGTCAGGATATTACTGACTGG TTAGCCTGGTATCAGCAGAAACCAGGGAAAG CCCCTAAACTCCTGATCTCTGCTGCATCCAGT TGCAGAGTGGGGTCCCATCAAGGTTCAGCGGC AGTGGATCTGGGACAGATTTCACTCTCGCCAT CAGCAGCCTGCAGCCTGAAGATTTTGCAACTT ACTATTGTCAACAGGCTAACAGTTTACCGTGG ACGTTCGGCCAAGGGACCAAGGTGGAAATCA AA SEQ ID NO: 26555 | GAGGTGCACCTGTTGGAGTCTGGGGGAGGCTTGG TACAGACTGGGGGGTCCCTGAGACTCTCCTGTGC AGCCTCTGGATTCACCTTTAGCAGCTATGCCATG ACCTGGGTCCGCCAGGCTCCAGGGAAGGGGCTG GAGTGGGTCTCAGTTATTAGTGGTAGTGGTGTA ACACATTCTACGCAGACTCCGTGAAGGGCCGGTT CACCATCTCCAGAGACAATTCCAAGAACACGCTG TATCTGCAAATGAACAGCCTGAGAGCCGAGGAC ACGGCCGTATATTACTGTGCGCCGCCGGTACGGTG ACTACTTTGACTACTGGGGCCAGGGAACCCTGGT CACCGTCTCCTCA SEQ ID NO: 30561 |

FIGURE 50
(Continued)

| | | | | |
|---|---|---|---|---|
| | | AA | DIQMTQSPSSVSASVGDRVTITCRASQDITDWLA WYQQKPGKAPKLLISAASSLQSGVPSRFSGSGSG TDFTLAISSLQPEDFATYYCQQANSLPWTFGQGT KVEIK<br>SEQ ID NO: 26556 | EVHLLESGGGLVQTGGSLRLSCAASGFTFSSYAMT WVRQAPGKGLEWVSVISGSGNTFYADSVKGRFTI SRDNSKNTLYLQMNSLRAEDTAVYYCARRYGDYF DYWGQGTLVTVSS<br>SEQ ID NO: 30562 |
| iPS:435779 | 21-225_178B10 | NA | GACATCCAGATGACCCAGTCTCCATCCTCCCT GTCTGCATCTGTCGGAGACAGAGTCACCATCA CTTGCCGGGCAAGTCAGGGCATTAGAAATGAT TAGGCTGGTTATCAGCAGAAACCAGGGAAAG CCCCTAAACACCTGATCTATGCTGCATCCAGT TTGCAAAATGGGGTCCCATCAAGGTTCAGCGG CAGTGGCTCTGGGACAGACCTCACTCTCACAA TCAGCAGCCTGCAGCCTGAAGATTTTGCCACT TATTACTGTCTACACCATTATAGTTTCCCGCTC ACTTTCGGCGGAGGGACCAAGGTGGAGATCA AA<br>SEQ ID NO: 26557 | CAGGTGCAGCTGGTGGAGTCGGGGGGAGGCGTG GTCCAGCCTGGGAGGTCCCTGAGACTCTCCTGTG TAGCGTCTGATTCACCTCCAGTACCTATGCAT GCACTGGGTCCGCCAGGCTCCAGGCAAGGGCT GGAATGGATGGCAATTATATGGTATGATGGAACT AATAAATACTATGCAGACTCCGTGAAGGGCCGA TTCACCATCTCAAGAGACAATTCCAAGAACACGC TGTATCTGCAACTGAACAGCCTGAGAGCCGAGG ACACGGCTGTGTATTACTGTGCGGAGATCCCTT ACGTGGATACAATGACCCGGTTATGACTACTGG GGCCAGGGAACCCTGGTCACCGTCTCCTCA<br>SEQ ID NO: 30563 |
| | | AA | DIQMTQSPSSLSASVGDRVTITCRASQGIRNDLG WYQQKPGKAPKHLIYAASSLQNGVPSRFSGSGS GTEFTLTISSLQPEDFATYYCLHHYSFPLTFGGGT KVEIK<br>SEQ ID NO: 26558 | QVQLVESGGGVVQPGRSLRLSCVASGFTSSTYGMH WVRQAPGKGLEWMAIIWYDGTNKYYADSVKGRF TISRDNSKNTLYLQLNSLRAEDTAVYYCARDPLRG YNDPVMDYWGQGTLVTVSS<br>SEQ ID NO: 30564 |

FIGURE 50
(Continued)

| | | | |
|---|---|---|---|
| iPS:435781 | 21-225_178G10 | NA | CATATTGTTGATGACCCAGACTCCACTCTCTG TCCGTCACCCCTGGACAGCCGGCCTCCATCTC CTGCAAGTCAGTCAGAGACCTCCTGCATGGTG ATGGAAAGACCTATTTGTATTGGTACCTGCAG AAGCCAGGCCAGCCTCCACAGCTCCTGATCTA TGAAGTTTCCAACCGGTTTTCTGGAGTGCCAG ACAGACTCAGTGGCGGCGGGTCAGGGACAGA TTTCACACTGAAAATCAGCGGGTGGAGGCTG AGGATGTTGGCATTTATTACTGCATGCAAAGT ATACAGGTTCCGTGGACGTTCGGCCAAGGGAC CAAGGTGGAAATCAAA<br><br>SEQ ID NO: 26559 | CAGGTGCAGCTGGTGGAGTCTGGGGGAGGCGTG GTCCAGCCTGGGAGGTCCCTGAGACTCTCTGTG CAGCGTCTGGATTCACCTTCAGTACCTATGGCAT GCACTGGGTCCGCCAGGCTCCAGGCAAGGGCT GGAGTGGGTGGCAGTTATATGGTATGATGAAGT AATAAATACTACGCAGACTCCGTGAAGGGCCGA TTCACCATCTCCAGAGACAATTTCAAGAACACGC TGTATCTGCAAATGAACAGCCTGAGAGCCGAGG ACACGGCTGTTTATTACTGTGCGAGAGAACGGTA CGATTTTTGGAGTGGTCATTTGACTACTGGGGC CAGGGAACCCTGGTCACCGTCTCCTCA<br><br>SEQ ID NO: 30565 |
| | | AA | HIVMTQTPLSLSVTPGQPASISCKSSQSLLHGDG KTYLYWYLQKPGQPPQLLIYEVSNRFSGVPDRL SGGGSGTDFTLKISRVEAEDVGIYYCMQSIQVPW TFGQGTKVEIK<br><br>SEQ ID NO: 26560 | QVQLVESGGGVVQPGRSLRLSCAASGFTFSTYGMH WVRQAPGKGLEWVAVIWYDGSNKYYADSVKGRF TISRDNFKNTLYLQMNSLRAEDTAVYYCARERYDF WSGHFDYWGQGTLVTVSS<br><br>SEQ ID NO: 30566 |
| iPS:435783 | 21-225_179G1 | NA | GACATCCAGATGACCCAGTCTCCATCTTCCGT GTCTGCATCTGTAGGAGACAGAGTCACCATCA CTTGTCGGGCGAGTCAGGATATTAGCAGCTGG TTAGCCTGGTATCAGCAAAAATCAGGGAAAGC CCCTAAACTCCTGATCTCTGCTGCATCCAGTTT GCAAAGTGGGGTCCCATCAAGGTTCGGCGGCA GTGGATCTGGGACAGATTTCACTCTCACCATC AGCAGCCTGCAGCCTGAAGATTTTGCAACTTA CTATTGTCAACAGGCTAACAGTTTACCGTGGA CGTTCGGCCAAGGGACCAAGGTGGAAATCAA A<br><br>SEQ ID NO: 26561 | GAGGTGCACCTGTTGGAGTCGGGGGAGGCTTG GTACAGACTGGGGGGTCCCTGAGACTCTCTGTG CAGCCTCTGGATTCACCTTTAGCAGCTATGCCAT GACCTGGGTCCGCCAGGCTCCAGGGAAGGGCT GGAGTGGGTCTCAGTTATTAGTGGTTTTGGTGGT AACACATTCTACGCAGACTCCGTGAAGGGCCGGT TCACCATCTCCAGAGACAATTCAAGAACACGCT GTATCTGCAAATGAACAGCCTGAGAGCCGAGGA CACGGCCGTATATTACTGTGCGCGCCGGTACGGT GACTACTTTGACTACTGGGGCCAGGGAACCCTGG TCACCGTCTCCTCA<br><br>SEQ ID NO: 30567 |

FIGURE 50
(Continued)

| | | AA | DIQMTQSPSSVSASVGDRVTITCRASQDISDWLAWYQQKSGKAPKLLISAASSLQSGVPSRFGGSGSGTDFTLTISSLQPEDFATYYCQQANSLPWTFGQGTKVEIK<br>SEQ ID NO: 26562 | EVHLLESGGGLVQTGGSLRLSCAASGFTFSSYAMTWVRQAPGKGLEWVSVISGFGGNTFYADSVKGRFTISRDNSKNTLYLQMNSLRAEDTAVYYCARRYGDYFDYWGQGTLVTVSS<br>SEQ ID NO: 30568 |
| iPS:435785 | 21-225_179C2 | NA | GATATTGTGATGACCCAGACTCCACTCTCTCTGTCCGTCACCCCTGGACAGCCGGCTCCATCTCCTGCAAATCTAGTCAGAGCCTCCTGCATAGTGAGGGAAAGAACCTACTTGTATTGGTACCTGCAGAAGCCAGGCCAGTCCACAGCTCCTGATCTATGAGGTTTCCCACCGGTTCTCTGGAGTGCCAGATAGGTTCAGTGGCAGCGGGTCAGGGACAGATTTCACACTGAAAATCAGCCGGGTGGAGGCTGAGGATGTTGGGGTTTATTACTGCAAAGTATACAGGTTCTCACTTTCGGCGGAGGGACCAAGGTGGAGATCAAA<br>SEQ ID NO: 26563 | CAGGTGCAGCTGGTGGAGTCGGGGGGAGGCGTGGTCCAGCCTGGGAGGTCCCTGAGACTCTCCTGTCAGGGTCTGGATTCACCTTCAGTAGCTATGGCATGCACTGGGTCCGCCAGGCTCCAGGCAAGGGGCTGGAGTGGGTGGCACTTATATTTATGATGGAAGTAATAAATACTATGCAGACTCCGTGAAGGGCCGATTCACCATCTCCAGAGACAATTCCAAGAACACGCTGTTTCTGCAAATGAACAGCCTGAGAGCCGAGGACACGGCTGTGTATTACTGTGCGAGACGGTATAGCGGCAGCTGGTCCGTGGTATGGACGTCTGGGGCCAAGGGACCACGGTCACCGTCTCCTCA<br>SEQ ID NO: 30569 |
| | | AA | DIVMTQTPLSLSVTPGQPASISCKSSQSLLHSEGKTYLYWYLQKPGQPPQLLIYEVSHRFSGVPDRFSGSGSGTDFTLKISRVEAEDVGVYYCMQSIQVLTFGGGTKVEIK<br>SEQ ID NO: 26564 | QVQLVESGGGVVQPGRSLRLSCAASGFTFSSYGMHWVRQAPGKGLEWVALIFYDGSNKYYADSVKGRFTISRDNSKNTLFLQMNSLRAEDTAVYYCARRYSGSWSGGMDVWGQGTTVTVSS<br>SEQ ID NO: 30570 |

FIGURE 50
(Continued)

| | | | |
|---|---|---|---|
| iPS:435787 | 21-225_180A3 | NA | GACATCCAGATGACCCAGTCTCCATCTTCCGT GTCTGCATCTGTAGGAGACAGAGTCACCATCA CTTGTCGGGCGAGTCAGGATATTACCAGCTGG TTAGCCTGGTATCAGCAGAAACCAGGGAAAG CCCCTAAGCTCCTGATCTATGCTGCATCCAGTT TGCAAAGTGGGGTCCATCAAGGTTCAGCGGC AGTGGATCTGGGACAGATTTCATTCTCACCAT CAGCAGCCTGCAGCCTGAAGATTTTGCATTTT ACCATTGTCAACAGGCTAACAGTATCCCATTC ACTTTCGGCCCTGGGACCAAAGTGGACATCAA C<br>SEQ ID NO: 26565 | GAGGTGCAGCTGTTGGAGTCTGGGGGAGGCTTG GAACAGCCTGGGGGGTCCCTGAGACTCTCCTGTG CAGCCCTCTGATTCACCTTTAGCAGCTTTGCCAT GAACTGGGTCCGCCAGGCTCCAGGGAAGGGGCT GGAGTGGGTCTCAGTTATTAGCGGTCGCGGTGGT AACACATTCTACGCAGACTCCGTGAAGGGCCGGT TCACCATCTCCAGAGACAATTCCAAGAACACGCT GTTTCTGCAAATGAACAGCCTGAGAGGCCGAGGA CACGGCCGTATATTTCTGTGCGAAACGGACTGGG GATGATGTTTTGATGTCTGGGGCCAAGGGACAA TGGTCACCGTCTCTCA<br>SEQ ID NO: 30571 |
| | | AA | DIQMTQSPSSVSASVGDRVTITCRASQDITSWLA WYQQKPGKAPKLLIYAASSLQSGVPSRFSGSGS GTDFILTISSLQPEDFAFYHCQQANSIPFTFGPGT KVDIN<br>SEQ ID NO: 26566 | EVQLLESGGGLEQPGGSLRLSCAASGFTFSSFAMN WVRQAPGKGLEWVSVISGRGGNTFYADSVKGRFTI SRDNSKNTLFLQMNSLRAEDTAVYFCAKRTGDDV FDVWGQGTMVTVSS<br>SEQ ID NO: 30572 |
| iPS:435789 | 21-225_180C4 | NA | GATATTGTGATGACCCAGACTCCACTCTCTCT GTCCGTCACCCCTGGACAGCCGGCTTCCATCT CCTGCAAGTCTAGTCAGAGCCTCCTGCATGGT GATGGAAAGACCTATTTGTATTGGTACCTGCA GAAGCCAGGCCAGTCTCCACAGCTCCTGATCT ATGCAACTTCCAACCGGTTCCCTGGAGTGTCA GATAGGTTCAGTGGCAGCGGGTCAGGTACAG ACTTCACACTGAAAATCAGCCGGGTGGAGGCT GAGGATGTTGGGGTTTATTACTGCATGCAAAG TATACAGGTTCCGTGGACGTTCGGCCAAGGGA CCAAGGTGGAAATCAAA<br>SEQ ID NO: 26567 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGCCTATGGCAT GCACTGGGTCCGCCAGGCTCCAGGCAAGGGCT GGAGTGGGTGGCAGTTATATTTGGTATGATGGAAGT TATAAATACTATGCAGACTCCGTGAAGGGCCGAT TCGCCATCTCCAGAGACAATTCCAAGAATACGCT GTATCTGCAAATGAACAGCCTGAGAGCCGAGGA CACGGCTGTATTACTGTGCGAGAACCGGTGTG GATCCCTGGGACTACTACAACGAATGACGTCT GGGGCCAAGGGACCACGGTCACCGTCTCCTCA<br>SEQ ID NO: 30573 |

FIGURE 50
(Continued)

| | | AA | DIVMTQTPLSLSVTPGQPASISCKSSQSLLHGDG KTYLYWYLQKPGQPPQLLIYATSNRFPGVSDRFS GSGSGTDFTLKISRVEAEDVGVYYCMQSIQVPW TFGQGTKVEIK SEQ ID NO: 26568 | QVQLVESGGGVVQPGRSLRLSCAASGFTFSAYGM HWVRQAPGKGLEWVTIIWYDGSYKYYADSVKGRF AISRDNSKNTLYLQMNSLRAEDTAVYYCARTGVDP WDYYNGMDVWGQGTTVTVSS SEQ ID NO: 30574 |
|---|---|---|---|---|
| iPS:435791 | 21-225_180H7 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATACTGCATCAGT TTGCAAAGTGGGGTCCCATCAAGGTTCAGCGG CAGTGGATCTGGGACAGAATTCACTCTCACAA TCAGCAGCCTGCAGCCTGAAGATTTTGCATCT TATTACTGTCTACAGCATAATAGTTACCCATTC ACTTTCGGCCCTGGGACCAAAGTGGATTTCAA A SEQ ID NO: 26569 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGACT GGAGTGGGTGGCAGTTATATGGTATGATGAAAAT AATAAACACTATGCAGACTCCGGAAGGGCGA TTCACCATCTCCAGAGACAATTCCAAGAACACGC TGTATCTGCAAATGAACAGCCTGAGAGTCGAAG ACACGGCTGTGTATTACTGTGCGAGAGAGGTTGG CTGGTCCGATGACTACTGGGGCCAGGGAACCCTG GTCACCGTCTCCTCA SEQ ID NO: 30575 |
| | | AA | DIQMTQSPSSLSASVGDRVTITCRASQGIRNDLG WYQQKPGKAPKRLIYTASSLQSGVPSRFSGSGSG TEFTLTISSLQPEDFASYYCLQHNSYPFTFGPGTK VDFK SEQ ID NO: 26570 | QVQLVESGGGVVQPGRSLRLSCAASGFTFSDYGM HWVRQAPGKGLEWVAVIWYDENNKHYADSAKGR FTISRDNSKNTLYLQMNSLRVEDTAVYYCAREVG WSDDYWGQGTLVTVSS SEQ ID NO: 30576 |

FIGURE 50
(Continued)

| | | | |
|---|---|---|---|
| iPS:435793 | 21-225_180F8 | NA | GACATCCAGATGACCCAGTCTCCATCTCCCT GTCTGCATCTGTAGGAGACGAGTCACCATCA CTTGCCGGGCAAGTCAGACCATTCTCAGTTAT TTAAATTGGTATCAGCAGAAACCAGGGAAAG CCCCTAAACTCCTGATCTATGGTGTATCCAGTT TACAAAGTGGGGTCCCATCAAGGTTCAGTGGC AGTGGATCTGGGACAGATTTCTCTCACCAT CAGCAGTCTGCAACCTGAAGATTTTGCAACTT ACTACTGTCAGCAGAGTTACAGTACCCATTC ACTTTCGGCCCTGGGACCAAAGTGGATATCAA A<br><br>SEQ ID NO: 26571 | CAGGTGCAGCTGGTGCAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGTCAGTTATATGGTATGATGGAAGT GATAAATACTATGAAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCATCC CCGGTGGAGCTACGGAGACTACTGGGGCCAGGG AACCCTGGTCACCGTGTCCTCA<br><br>SEQ ID NO: 30577 |
| | | AA | DIQMTQSPSSLSASVGDGVTITCRASQTILSYLN WYQQKPGKAPKLLIYGVSSLQSGVPSRFSGSGS GTDFSLTISSLQPEDFATYYCQQSYSTPFFGPGT KVDIK<br><br>SEQ ID NO: 26572 | QVQLVESGGGVVQPGRSLRLSCAASGFTFSSYGMH WVRQAPGKGLEWVSVIWYDGSDKYYEDSVKGRF TISRDNSKNTLYLQMNSLRAEDTAVYYCARDHPR WSYGDYWGQGTLVTVSS<br><br>SEQ ID NO: 30578 |
| iPS:435795 | 21-225_181C2 | NA | GAAATTGTGATGACCCAGTCTCCACTCTCTCT GTCCGTCACCCCTGGACAGCCGGCTCCATCT CCTGCAAGTCTAGTCAGAGCCTCCTGCATGGT GATGGAAAGACCTATTTGTATTGGTACCTGCA GAAGCCAGGCCAGTCTCCACAGCTCCTGATCC ATGAAGTTTCCAACCGGTTCTCTGGAGTGCCA GATAGGTTCAGTGGCAGCGGGTCAGGGACAG ATTTCACACTGAAAATCAGCGGGTGGAGGCT GAGGATGTTGGGGTTTATTACTGCATGCAAAG TATACAGGTTCCCTGGACGTTCGGCCAAGGGA CCAAGGTGGAAATCAAA<br><br>SEQ ID NO: 26573 | CAGGTGCAGCTGGTGGAGTCTGGGGGAGGCGTG GTCCAGCCTGGGAGGTCCCTGAGACTCTCCTGTG TAGCGTCTGGATTCACCTTCAGTAGCTATGGCAT GCACTGGGTCCGCCAGGCTCCAGGCAAGGGGCT GGAATGGGTGGACAATTATATGTATGATGGAAGT TATAAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGATCATTAC GATTTTTGGAGTGGGCACTTTGACTTCTGGGGCC AGGGAACCCTGGTCACCGTCTCCTCA<br><br>SEQ ID NO: 30579 |

FIGURE 50
(Continued)

| | | | |
|---|---|---|---|
| iPS:435797 | 21-225_181G2 | AA | EIVMTQTPLSLSVTPGQPASISCKSSQSLLHGDGK TYLYWYLQKPGQPPQLLIHEVSNRFSGVPDRFSG SGSGTDFTLKISRVEAEDVGVYYCMQSIQVPWT FGQGTKVEIK<br>SEQ ID NO: 26574 | QVQLVESGGGVVQPGRSLRLSCVASGFTFSSYGMH WVRQAPGKGLEWVTIIWYDGSYKYYADSVKGRFT ISRDNSKNTLYLQMNSLRAEDTAVYYCARDHYDF WSGHFDFWGQGTLVTVSS<br>SEQ ID NO: 30580 |
| | | NA | GACATCAGATGACCCAGTCTCCATCTCACT GTCTGCATCTATAGGAGAGAGTCACCATCA CTTGTCGGGCGAGTCAGGGCATTAGCAATTAT TTAGCCTGGATTCAGCAGAAACCAGGGACAGC CCCTAAGTCCCTGATCTATGCTGCATCCAGTTT GCAAAGTGGGGTCTCATCAAGGTTCAGGGACA GTGGATTTGGGACAGATTTCACTCTCACCATC AGTAGTCTGCAGCCTGAAGATTTTGCAACTTA TTACTGCCAACAGTATATAATGGTTACCCATTCA CTTTCGGCCCTGGGACCAAAGTGGATATCAAA<br>SEQ ID NO: 26575 | CAGGTGCAGCTGGTGCAGTCTGGGGCTGAAGTG AAGACGCCTGGGGCCTCAGTGAAGGTCTCCTGCA GGGCTTCTGGATACACCTTCACCAGCTACAATAT GCACTGGGTGCGACAGGTCCCTGGACAAGGGCT TGAGTGGATGGGATGGATCAACCCTAACAATGGT GGCTCAAACATGACCAGGACACGTCCATCAGCACA GTCACCATGACCAGGGACACGTCCATCAGCACA GCCTACACTGGAGCTGAGCAGGCTGAGATCTGAC GACACGGCCGTGTATTACTGTGCGAGAAAGTTTG GGGACTGGGGCCAGGGAACCCTGGTCACCGTCT CCTCA<br>SEQ ID NO: 30581 |
| | | AA | DIQMTQSPSSLSASIGERVTITCRASQGISNYLAW IQQKPGTAPKSLIYAASSLQSGVSSRFSGSGFGTD FTLTISSLQPEDFATYYCQQYNGYPFTFGPGTKV DIK<br>SEQ ID NO: 26576 | QVQLVQSGAEVKTPGASVKVSCRASGYTFTSYNM HWVRQVPGQGLEWMGWINPNNGGSNYTQKFQGR VTMTRDTSISTAYMELSRLRSDDTAVYYCARKFGD WGQGTLVTVSS<br>SEQ ID NO: 30582 |

FIGURE 50
(Continued)

| | | NA | GACATCCAGATGACCCAGTCTCCATCCTCCT GTCTGCATCTGTAGGAGACAGAGTCAACATCA CTTGCCGGGCAAGTCACAGCATTAGCAACTAT TTAAATTGGTATCAGCAGAAAGCAGGAAAG CCCCTAACCTCTTGATCTATACTACATTGAATT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTTCTCCTCCG TGGACGTTCGGCCAAGGGACCAAGGTGGAAA TCAAA | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGTTGGGTCCGCCAGGCTCCAGGGAAGGGCT TGGAGTGGGTCTCAGTTATTAGTGGTAGTGGTGGT AACACATTCTACGGAGACTCCGTGAAGGGCCGG TTCACCATCTCCAGAGACAATTCAAGAACACGC TGTATCTGCAAATGAACAGCCTGAGAGCCGAGG ACACGGCCATATATTACTGTGCAAACGGGAGA CCTACGACTGGGGATCCGATGCTTTTGATATCTG GGGCCAAGGGACAATGGTCACCGTCTCTTCA |
| iPS:435799 | 21-225_181G3 | | SEQ ID NO: 26577 | SEQ ID NO: 30583 |
| | | AA | DIQMTQSPSSLSASVGDRVNITCRASHSISNYLN WYQQKAPNLLIYTTLNLQSGVPSRFSGSGS GTDFTLTISSLQPEDFATYYCQQSYSSPPWTFGQ GTKVEIK | EVQLLESGGGLVQPGGSLRLSCAASGFTFSSYAMS WVRQAPGKGLEWVSVISGSGGNTFYGDSVKGRFTI SRDNSKNTLYLQMNSLRAEDTAIYYCAKRETYDW GSDAFDIWGQGTMVTVSS |
| | | | SEQ ID NO: 26578 | SEQ ID NO: 30584 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTACACAGC TCCAACAATTACAACTACTTAACTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCATCAG GATTTTAGTGGAGGTGTATTAACAAGCGCCAGAGG TATTTTATTACTCCGTGACGTTCGGCCAAGG GACCAAGGTGGAAATCAAA | CAGGTGCAGCTGGTGCAGTCTGGGCTGAGGTG AAGAAGCCTGGGCCTCAGTGAAGGTCTCCTGC AAGGCTTCTGATACACCTTCACCAATTATGATA TCAACTGGGTGCGACAGGCCACTGGACAAGGC TTGAGTGGATGGGATGGATGAACCTAACAGTG GTAACACAGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCGAGTAGTAG TGGCTGGTACATCTTTGACTACTACTGGGGCCAGGGA ACCCTGGTCACCGTCTCCTCA |
| iPS:435801 | 21-225_181E5 | | SEQ ID NO: 26579 | SEQ ID NO: 30585 |

FIGURE 50
(Continued)

| | | | | |
|---|---|---|---|---|
| iPS:435805 | 21-225_181A8 | AA | DIVMTQSPDSLAVSLGERATINCKSSQSVLHSSN NYNYLTWYQQKPGQPPKLLIYWASTRESGVPDR FSGSGSGTDFTLTISSLQAEDVAVYYCHQYFITP WTFGQGTKVEIK<br>SEQ ID NO: 26580 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCASSSGW YIFDYWGQGTLVTVSS<br>SEQ ID NO: 30586 |
| | | NA | GACATCCAGATGACCCAGTCTCCATCCTCCCT GTCTGCATCTGTAGGAGACAGAGTCACCATCA CTTGCCCGGGCAAGTCAGGGCATTAGAAATGAT TTAGGCTGGTATCAGCAGAAACCAGGAAAAG CCCCTAAGCGCCTGATCTATACTGCATCCAGT TTGCAAAGTGGGGTCCCATCAAGGTTCAGCGG CAGTGGATCTGGGACAGATTTCACTCTCACAA TCAGCAGCCTGCAGCCTGAAGATTTTGCATCT TATTACTGTCTACAGCATATAAGTTACCCATTC ACTTTCGGCCCTGGGACCAAAGTGGATTTCAA A<br>SEQ ID NO: 26581 | CAGGTGCAGCTGGTGGAGTCTGGGGGAGGCGTG GTCCAGCCTGGGAGGTCCCTGAGACTCTCCTGTG CAGCCGTCTGGATTCACCTTCAGTGACTATGGCAT GCACTGGGTCCGCCAGGCTCCAGGCAAGGGACT GGAGTGGGTGGCAGTTATATGGTATGATGAAAAT AATAAACACTATGCAGACTCCGCGAAGGGCCGA TTCACCATCTCCAGAGACAACAATTCCAAGAACACGC TGTATCTGCAAATGAACAGCTGAGAGCCGAAG CTGGTCCGATGACTACTGGGGCCAGGGAACCCTG GTCATCGTCTCCTCA<br>SEQ ID NO: 30587 |
| | | AA | DIQMTQSPSSLSASVGDRVTITCRASQGIRNDLG WYQQKPGKAPKRLIYTASSLQSGVPSRFSGSGSG TDFTLTISSLQPEDFASYYCLQHNSYPFTFGPGTK VDFK<br>SEQ ID NO: 26582 | QVQLVESGGGVVQPGRSLRLSCAASGFTFSDYGM HWVRQAPGKGLEWVAVIWYDENNKHYADSAKGR FTISRDNSKNTLYLQMNSLRAEDTAVYYCAREVG WSDDYWGQGTLVIVSS<br>SEQ ID NO: 30588 |

FIGURE 50
(Continued)

| | | | |
|---|---|---|---|
| iPS:435807 | 21-225_181C10 | NA | GATATTGTGATGACCCAGACTCCACTCTCT GTCCGTCACCCCTGGACAGCCGGCTCCATCT CCTGCAAGTCTAGTCAGAGCCTCCTGCATGG GATGGAAAGACCTATTTGTATTGGTACCTGCA GAAGCCAGGCCAGCTCCACAGCTCCTGATCT ATGAAGTTTCCAATCGGTTCTCTGGAGTGCCA GATAGGTTCAGTGGCAGCGGGTCAGGGACAG ATTTCACACTTAAAATCAGCCGGGTGGAGGCT GAGGATGTTGGGGTTTATCACTGCATGCAAAG TATACAGATTCCCTGACGTTCGGCCAAGGGA CCAAGGTGGAAATCAAA SEQ ID NO: 26583 | CAGGTGCAACTGGTGGAGTCTGGGGGAGGCGTG GTCCAGCCTGGGAGGTCCCTGAGACTCTCCTG CAGGTCTGGATTCACCTTCAGTAGCTATGGCAT GCACTGGGTCCGCCAGGCTCCAGGCAAGGGCT GGAGTGGATGGCAATTATATGGTATGATGGAAGT TATAAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGATCATTAC GATTTTTGGAGTGGGCACTTGACTACTGGGGCC AGGGAACCCTGGTCACCGTCTCCTCA SEQ ID NO: 30589 |
| | | AA | DIVMTQTPLSLSVTPGQPASISCKSSQSLLHGDG KTYLYWYLQKPGQPPQLLIYEVSNRFSGVPDRFS GSGSGTDFTLKISRVEAEDVGVYHCMQSIQPWT FGQGTKVEIK SEQ ID NO: 26584 | QVQLVESGGGVVQPGRSLRLSCAASGFTFSSYGMH WVRQAPGKGLEWMAIIWYDGSYKYYADSVKGRF TISRDNSKNTLYLQMNSLRAEDTAVYYCARDHYDF WSGHFDYWGQGTLVTVSS SEQ ID NO: 30590 |
| iPS:435809 | 21-225_182H5 | NA | GACATCCAGATGACCCAGTCTCCATCTTCCGT GTATGCATCTGTTGGAGACAGAGTCACCATCA CTTGTCGGGCGAGTCAGGATATTACCAGCTGG TTAGCCTGGTATCAGCAGAAACCAGGGAAAG CCCCTAAACTCCTGATCTATGCTGCATCCAGTT TACAAAGTGGGGTCCCATCAAGGTTCAGCGGC AGTGGATCTGGGACAGATTTCATTCTCACCAT CACCAGCTGCAGCCTGATGATTTTGCAACTT ACTATTGTCAACAGGTTAACAGTTTCCCATTC ACTTTCGGCCACGGGACCAAAGTGGATATCAA A SEQ ID NO: 26585 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGTTGGGTCCGCCAGGCTCCAGGGAAGGGGCT GGAGTGGGTCTCAGTTATTAGTGGTAGAGGTGGT ACCACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGAAACGGACTGGG GATGATGTTTTTGATATCTGGGGCCAAGGGACAA TGGTCACCGTCTCTTCA SEQ ID NO: 30591 |

FIGURE 50
(Continued)

| | | | |
|---|---|---|---|
| iPS-435811 | | AA | DIQMTQSPSSVYASVGDRVTITCRASQDITSWLA WYQQKPGKAPKLLIYAASSLQSGVPSRFSGSGS GTDFILTITSVQPDDFATYYCQQVNSFPFTFGHG TKVDIK<br>SEQ ID NO: 26586 | EVQLLESGGGLVQPGGSLRLSCAASGFTFSSYAMS WVRQAPGKGLEWVSVISGRGGTTFYADSVKGRFTI SRDNSKNTLYLQMNSLRAEDTAVYYCAKRTGDDV FDIWGQGTMVTVSS<br>SEQ ID NO: 30592 |
| | 21-225_183H6 | NA | GACATCCAGATGACCCAGTCTCCATCCTCCCT GTCTGCATCTGTAGGAGACAGAGTCACCATCG CTTGCCAGGCGAGTCAGGACATTAGCAACTAT TTAAATTGGTATCAGCAGAAACCAGGAAAGC CCCTAAGGTCCTGATCTACGATGCATCCAATT TGGAAACAGGGGTCCCAGCAAGGTTCAGTGG AAGTGGATCTGGGACAGATTTTACTTTCACCA TCAGCAGCCTGCAGCCTGAAGATATTGCAACA TATTACTGTCAACAGTATGATAATCTCCCTCTC ACTTTCGGCGGAGGGACCAAGGTGGACATCA AA<br>SEQ ID NO: 26587 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGCT GGAGTGGGTGGCAATTATATCAGACTCGTGAAGT ACTAAATTCTATGCAGACTCCGTGAAGGGCCGAT TCACCATCTCCAGAGACAATTCCAAGAACACGCT GTATCTGCAAATGAACAGCCTGAGAGCTGAGGA CACGGCTGTGTATTACTGTGTGAGAAGGCCCCG CAGTGGCTGGTAGAGGGCTACGGTATGGACGTCT GGGGCCAAGGGACCACGGTCACCGTCTCCTCA<br>SEQ ID NO: 30593 |
| | | AA | DIQMTQSPSSLSASVGDRVTIACQASQDISNYLN WYQQTPGKAPKVLIYDASNLETGVPARFSGSGS GTDFTFTISSLQPEDIATYYCQQYDNLPLTFGGG TKVDIK<br>SEQ ID NO: 26588 | QVQLVESGGGVVQPGRSLRLSCAASGFTFSSYGMH WVRQAPGKGLEWVAIISYAGSTKFYADSVKGRFTI SRDNSKNTLYLQMNSLRAEDTAVYYCVRRPPQWL VEGYGMDVWGQGTTVTVSS<br>SEQ ID NO: 30594 |

FIGURE 50
(Continued)

| | | | | |
|---|---|---|---|---|
| iPS:435813 | 21-225_183A12 | NA | GACATCCAGATGACCCAGTCTCCATCCCCT GTGTGCCTCTGTAGGAGACAGAGTCACCATCA CTTGCCGGGCAAGTCGGAACATCAGCAACTAT TTAAATTGGTATCAGCAGAAACCAGGGAAAG CCCCTAAGCTCCTGATCTATGTTGTATCAGTT TGCAAAGTGGGGTCCCATCAAGGTTCAGTGGC AGTGGATCTGGGACAGATTTCACTCTCACCAT CAGCAGTCTACAACCTGAAGATTTTGCAACTT ACTACTGTCAACAGAGTTACAGTTCCCCTCCG TGGACGTTCGGCCAAGGGACCAAGGTGGATAT CAGA<br>SEQ ID NO: 26589 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATCATCTGCTGAAGT AATAAATACTATGCAGACTCCGTGAAGGGCCGA TTCACCATCTCCAGAGACAATTCCAAGAACACGC TGTATCTGCAAATGAACAGCCTGAGAGCTGAGG ACACGGCTGTGTATTATTGTGCGAGAAGGTATAG CAGTGGGCTGGGACTGGTTCGACCCCTGGGGCCAG GGAACCCTGGTCACCGTCCTCA<br>SEQ ID NO: 30595 |
| | | AA | DIQMTQSPSSLCASVGDRVTITCRASRNISNYLN WYQQKPGKAPKLLIYVSSLQSGVPSRFSGSGS GTDFTLTISSLQPEDFATYYCQQSYSSPPWTFGQ GTKVDIR<br>SEQ ID NO: 26590 | QVQLVESGGGVVQPGRSLRLSCAASGFTFSSYGMH WVRQAPGKGLEWVAVISSAGSNKYYADSVKGRFT ISRDNSKNTLYLQMNSLRAEDTAVYYCARRYSSG WDWFDPWGQGTLVTVSS<br>SEQ ID NO: 30596 |
| iPS:435815 | 21-225_190G10 | NA | GAAATTGTGTTGACGCAGTCTCCAGGCACCCT GTCTTTGTCTCCAGGGGAAAGAGCCACCCTCT CCTGCAGGGCCAGTCCGAGTGTTAGCAGCAGA TTCTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTGGCACTCTCAC CAACAGCAGACTGGAGCCTGAAGATTTTGCAG TGTATCTGCAAATGAACAGCCTGAGAGCCGAGG CCGTGGACGTTCGGCCAAGGGACCAAGGTAG AAATCAAA<br>SEQ ID NO: 26591 | GAGGTGCAGCTGGTGGAGTCTGGGGGAGGCCTG GTCAAGCCTGGGGGGTCCCTGAGACTCTCCTGTG CAGCCTCTGGATTCACCTTCAGGGACTACTAGCAT GAACTGGGTCCGCCAGGCTCCAGGGAAGGGGCT GGAGTGGGTCTCATCTATTAGTAGTGGTAGTGGT TACATACACTACGCAGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCCGAGCAACTAT GGCCCTTGACTACTGGGGCCAGGGAACCCTGGTC ACCGTCTCCTCA<br>SEQ ID NO: 30597 |

FIGURE 50
(Continued)

| | | | |
|---|---|---|---|
| iPS:435817 | | AA | EIVLTQSPGTLSLSPGERATLSCRASPSVSSRFLA WYQQKPGQAPRLLIYGASSRATGIPDRFSGSGSG TDFTLTNSRLEPEDFAVYYCQQYGSSPPWTFGQ GTKVEIK<br>SEQ ID NO: 26592 | EVQLVESGGGLVKPGGSLRLSCAASGFTFRDYSMN WVRQAPGKGLEWVSSISSGSGYIHYADSVKGRFTIS RDNAKNSLYLQMNSLRAEDTAVYYCARATMALD YWGQGTLVTVSS<br>SEQ ID NO: 30598 |
| | | NA | GAAATTGTGCTGACTCAGTCTCCAGACTTTCA GTCTGTGGCTCCAAAGGAGAAAGTCACCATCA CCTGCCGGGCCAGTCAGAGTATTGGTAGTAAC TTACACTGGTACCAGCAGAAACCAGATCAGTC TCCGAAACTCCTCATCAAGTCTGCTTCCCAGTC CTTCTCAGGGGTCCCCTCGAGTTCAGTGGCA GTGGATCTGGGACAGATTTCACCCTCACCATC AATAGCCTGGAAACTGAAGATGCTGCAACGTA TTACTGTCAGCAGCAGAGTAGTTTACCGTGGA CGTTCGGCCAAGGGACCAAGGTGGAAATCAA A<br>SEQ ID NO: 26593 | CAGGTGCAGCTGCAGGAGTCGGGCCCAGGACTG GTGAAGCCTTCGGAGACCCTGTCCTCACCTGCA CTGTCTCTGGTGGCTCCATCAATAATTACTACTG GAGCTGGATCCGGCAGCCCGCGGAAGGGACT GGAGTGGATTGGGCGTATCTATACCAGTGGAGC ACCAACTACAACCCTCCCTCAAGAGTCGAGTCA CCATGTCAGTAGACACGTCAAGAACCAGTTCTC CCTGAAGCTGAGTCTGTGACCGCCGCGACACG GCCGTGCATTACTACGGTATGGACGTCTGGGGCCAAG GGACCACGGTCACCGTCTCCTCA<br>SEQ ID NO: 30599 |
| 21-225_190B11 | | AA | EIVLTQSPDFQSVAPKEKVTITCRASQSIGSNLHW YQQKPDQSPKLLIKSASQSFSGVPSRFSGSGSGT DFTLTINSLETEDAATYYCQQSSSLPWTFGQGTK VEIK<br>SEQ ID NO: 26594 | QVQLQESGPGLVKPSETLSLTCTVSGGSINNYYWS WIRQPAGKGLEWIGRIYTSGSTNYNPSLKSRVTMS VDTSKNQFSLKLSSVTAADTAVHYCARDRGYYGY YGMDVWGQGTTVTVSS<br>SEQ ID NO: 30600 |

FIGURE 50
(Continued)

| | | | |
|---|---|---|---|
| iPS:435819 | 21-225_190C11 | NA | GACATCCAGATGACCCAGTCTCCTTCCTCACT GTCTGCATCTGTAGGAGACAGAGTCACCATCA CTTGTCGGACGAGTCAGGGCATTGGCAATTAT TTAGCCTGGTTTCAGCAGAAACCAGGGAAAGC CCCTAAGTCCCTGCTCTATAAACATCCAGTTT ACAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATATGACTTACCCGCTCA CTTTCGGCGGAGGGACCAAGGTGGAGATCAA A | CAGGTGCAGCTGGTGGAGTCTGGGGAGGCGTG GTCCAGCCTGGGAGGTCCCTGAGACTCTCCTGTG CAGGCGTCTGGATTCACCTTCAGTAGTAGCAT GCACTGGGTCCGCCAGGCTCCAGGCAAGGGGCT GGAGTGGGTGGCAGTTATATGGTATGATGAAGT AATAAAACTATGCAGACTCCGTGAAGGGCCGA TTCACCATCTCAGAGACAATTCCAAGAACACGC TGTATCTGCAAATGAACAGCCTGAGAGCCGAGG ACACGGCTGTGTATTACTGTGCGAGAGATCAGGG CGTGGGCTACGACGGTTTGGACGTCTGGGGCCAA GGGACCACGGTCACCGTCTCCTCA |
| | | | SEQ ID NO: 26595 | SEQ ID NO: 30601 |
| | | AA | DIQMTQSPSSLSASVGDRVTITCRTSQGIGNYLA WFQQKPGKAPKSLLYKTSSLQSGVPSKFSGSGS GTDFTLTISSLQPEDFATYYCQQYMTYPLTFGGG TKVEIK | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDQGV GYDGLDVWGQGTTVTVSS |
| | | | SEQ ID NO: 26596 | SEQ ID NO: 30602 |
| iPS:435821 | 21-225_190E11 | NA | GAAATAGTGATGACGCAGTCTCCAGCCACCCT GTCTGTGTCTCCAGGGGAAAGAGCCACCCTCT CCTGCAGGGCCAGTCAGAGTTTTCGCATCAAC TTAGCCTGGTACCACCAGAGACCTGGCCAGGC TCCCAGGCTCCTCATCTATGGTGCATCCACCA GGGCCACTGGTATCCCAGCCAGGTTCAGTGGC AGTGGGTCTGGGACAGAGTTCACTCTCACCAT CAGCAGCCTGCAGTCTGAAGATTTTGCAGTTT ATTACTGTCAGCAGCAGTATAATAACTGGCCGCTC ACTTTCGGCGGAGGGACCAAGGTGGAGATCA AA | CAGGTGCAGCTGGTGGAGTCTGGGGAGGCGTG GTCCAGCCTGGGAGGTCCCTGAGACTCTCTGTA CAGGCGTCTGGATTCACCTTCAGTAACTATGGCAT GCACTGGGTCCGCCAGGCTCCAGGCAAGGGGCT GGAGTGGGTGGCAATTATATGGTTTGATGAAGT AATAAATACTATGCAGAGACAATTCCAATAACACGC TTCACCATCTCAGAGACAATTCCAATAACACGC TGTATCTGCAAATGAACAGCCTGCGAGCCGAGG ACACGGCTGTGTATTACGTTATGGACGTCTGGGGCCAGG GGTCTACTACTGGTCACCGTCTCCTCA |
| | | | SEQ ID NO: 26597 | SEQ ID NO: 30603 |

FIGURE 50
(Continued)

| | | | |
|---|---|---|---|
| iPS:435823 | 21-225_190F11 | AA | EIVMTQSPATLSVSPGERATLSCRASQSFRINLA WYQQRPGQAPRLLIYGASTRATGIPARFSGSGSG TEFTLTISSLQSEDFAVYYCQQYNNWPLTFGGGT KVEIK<br>SEQ ID NO: 26598 | QVQLVESGGGVVQPGRSLRLSCTASGFTFSNYGMH WVRQAPGKGLEWVAIIWFDGSNKYYADSVKGRFTI SRDNSNNTLYLQMNSLRAEDTAVYYCAKAQGVY YYVMDVWGQGTTVTVSS<br>SEQ ID NO: 30604 |
| | | NA | GAAATTGTGCTGACTCAGTTTCCAGACTCTCA GTCTGTGACTCCAAAGGAGAAAGTCACCATCA CCTGCCGGGCCAGTCAGAGCAGAAACATTTTTAGC TTACACTGGTACCAGCAGAAACCAGAACAGTC TCCAAAGGTCCTCATCAAGTATGCTTCCCAGT CCCTCTCAGGGGTCCCCTGAGGTTCAGTGGC AGTGGATCTGGGACAGATTTCACCTCACGT CAATAGCCTGGAAGCTGAAGATGCTGCAACGT ATTACTGTCATCAGAGTAGTAGTTTCCCTCGG ACGTTCGGCCAAGGGACCAAGGTGGAAATCA AA<br>SEQ ID NO: 26599 | GAGGTGCAGCTGTTGGACTCTGGGGGAGGCTTGG GACAGCCTGGGGGGTCCCTGAGACTCTCCTGTGC AGCCTCTGGATTCACCTTTGACAGCTATGCCATG AACTGGGTCCGCCAGGCTCCAGGGAAGGGGCTG GAGTGGGTCTCAACTATTAGTGGTACTGGTCGTA GGACATACTACGCAGACTCCGTGAAGGGCCGGT TCACCATCTCAGAGACAATTCCAAGAACACGCT GTATCTGCAAATGAATAGCCTGAGAGCCGAGGA CACGGCCGTATATTACTGTGCGAAAGAGGAGGA TTACTATGATAGTAGTGGCCGGGGTTCGACCCC TGGGGCCAGGGAACCCTGGTCACCGTCTCCTCA<br>SEQ ID NO: 30605 |
| | | AA | EIVLTQFPDSQSVTPKEKVTITCRASQNIGSSLHW YQQKPEQSPKVLIKYASQFSGVPSRFSGSGSGT DFTLTINSLEAEDAATYYCHQSSSFPRTFGQGTK VEIK<br>SEQ ID NO: 26600 | EVQLLDSGGGLGQPGGSLRLSCAASGFTFDSYAMN WVRQAPGKGLEWVSTISGTGRRTYYADSVKGRFTI SRDNSKNTLYLQMNSLRAEDTAVYYCAKEEDYYD SSGPGFDPWGQGTLVTVSS<br>SEQ ID NO: 30606 |

FIGURE 50
(Continued)

| | | | |
|---|---|---|---|
| iPS:435825 | 21-225_190G11 | NA | GACATCCAGATGACCCAGTCTCCTTCCTCACT GTCTGCATCTGTAGGAGACAGAGTCACCATCA CTTGTCGGACGAGTCAGGGCATTGGCAATTAT TTAGCCTGGTTTCAGCAGAAACCAGGGAAAGC CCCTAAGTCCCTGCTCTATAAAGCATCCAGTTT GCAAAGTGGGGTCCCATCAAAGTTCAGCGGCA GTGGATCTGGGACAGATTTCACTCTCACCATC AGCAGCCTGCAGCCTGAAGATATGACTTACCGCTCA CTTTCGGCGGAGGGACCAAGGTGGAGATCAA A | CAGGTGCAGCTGCAGGAGTCTGGGGGAGGCGTG GTCCAGCCTGGGATTCCCTGAGACTCTCCTGTG CAGCGTCTGGATTCACCTTCACCTATTTATGGCAT GCACTGGGTCCGCCAGGCTCCAGGCAAGGGGCT GGAGTGGGTGGCAGTTATATGGTATGATGAAGT AATAAAAACTATGCAGACTCCGTGAAGGGCCGA TTCACCATCTCCAAGAGACAATTCCAAGAACACGC TGTATCTGCAAATGAACAGCCTGAGAGCCGAGG ACACGGCTGTGTATTACTGTGCGAGAGATCAGGG CGTGGGCTACGACGGTTTGGACGTCTGGGGCCAA GGGACCACGGTCACCGTCTCCTCA |
| | | | SEQ ID NO: 26601 | SEQ ID NO: 30607 |
| | | AA | DIQMTQSPSSLSASVGDRVTITCRTSQGIGNYLA WFQQKPGKAPKSLLIYASSLQSGVPSKFSGSGS GTDFTLTISSLQPEDFATYYCQQYMTYPLTFGGG TKVEIK | QVQLVESGGGVVQPGRSLRLSCAASGFTFSIYGMH WVRQAPGKGLEWVAVIWYDGSNKNYADSVKGRF TISRDNSKNTLYLQMNSLRAEDTAVYYCARDQGV GYDGLDVWGQGTTVTVSS |
| | | | SEQ ID NO: 26602 | SEQ ID NO: 30608 |
| iPS:435827 | 21-225_190H11 | NA | GATATTGTGATGACCCAGACTCCACTCTCTCT GTCCGTCACCCCTGGACAGCCGGCCTCCATCT CCTGCAAGTCTAGTCAGAGCCTCCTGCATAGT GATGGAAGGAACCTATTTGTATTGGTACCTGCA GAAGCCAGGCCAGCCTCCACAGCTCCTGATCT GTGAGGTTTCCAACCGGTTCTCTGGAGTGACA GATAGGTTCAGTGGCAGCGGGTCAGGGACAG ATTTCACACTGAAAATCAGCCGGGTGGAGGCT GGGGATGTTGGGGTTTATTACTGCATGCAAAG TATACAGTTTCCCTGGACGTTCGGCCAAGGGA CCAAGGTGGAAATCAAA | CAGCTGCAGCTGCAGGAGTCGGGCCCAGGACTG GTGAAGCCTTCGGAGACCCTGTCCTCCACCTGCA CTGTCTCTGGTGGCTCCATCAGAAGCTACCACTG GAGCTGGATCCGGCAGCCCGCCGGGAAGGGACT GGAGTGGAGTGGATTGGGCTTATCTATACCAGTAGGAGC ACCATTTACAACCCCTCCCTCAAGAGTCGAGTCA CCCTGTCAGTAGACACGTCCAAGAACCAGTTCTC CCTGAAGCTGAGCTCTGTGACCGCCGCGGACACG GCCGTGTATTACTGTGCGAGACTCCGGTATAACT GGAACTTCCCTTACTTTGACTACTGGGGCCAGGG AACCCTGGTCACCGTCTCCTCA |
| | | | SEQ ID NO: 26603 | SEQ ID NO: 30609 |

FIGURE 50
(Continued)

| | | | |
|---|---|---|---|
| iPS:435829 | | AA | DIVMTQTPLSLSVTPGQPASISCKSSQSLLHSDGR TYLYWYLQKPGQPPQLLICEVSNRFAGVTDRFS GSGSGTDFTLKISRVEAGDVGVYYCMQSIQFPW TFGQGTKVEIK SEQ ID NO: 26604 | QLQLQESGPGLVKPSETLSLTCTVSGGSIRSYHWSW IRQPAGKGLEWIGLIYTSRSTIYNPSLKSRVTLSVDT SKNQFSLKLSSVTAADTAVYYCARLRYNWNFPYF DYWGQGTLVTVSS SEQ ID NO: 30610 |
| | | NA | GAAATTGTGCTGACTCAGTCTCCAGACTTTCA GTCTGTGACTCCAAAGGAGAAAGTCACCATCA CCTGCCGGGCCAGTCAGAGTATTGGTAGTAGC TTACACTGGTACCAGCAGAAACCAGATCAGTC TCCAAAGCTCCTCATCAAGTATGCTTCCCAGT CCTTCTCAGGGGACCCCTCGAGTTCAGTGGC AGTGGATCTGGGACAGATTTCACCCTCACCAT CAATAGCCTGGAAGCTGAAGATGCTGCAACGT ATTACTGTCATCAGACTAGAAGTTTACCTCTC ACTTTCGGCGGAGGGACCAAGGTGGAGATCA AA SEQ ID NO: 26605 | CAGGTGCAGCTGCAGGAGTCGGGCCCAGGACTG GTGAAGCCTTCACAGACCCTGTCCTCACCTGCA CTGTCTCTGGTGGCTCCATCAGCAGTGGTGTTA CTACTGGAACTGGATCCGCCAGCACCCAGGGAA GGGCCTGGAGTGGATTGGGTATATCTATTACAGT GGGAGCACCTACTACAACCCGTCCTCAAGAGTC GAGTTACCATATCAGTAGACAGTCTAAGAACCA GTTTTTTCTGAAGCTGAACTCTGTGACTGCCGCG GACACGGCCGTGTATTACTGTGCGAGATCGGGT ATAATTGGGACGCCGGGGTCGACCCTGGGGCC GGGGAACCCTGGTCACCGTCTCCTCA SEQ ID NO: 30611 |
| | 21-225_190B12 | AA | EIVLTQSPDFQSVTPKEKVTITCRASQSIGSSLHW YQQKPDQSPKLLIKYASQSFSGDPSRFSGSGSGT DFTLTINSLEAEDAATYYCHQTRSLPLTFGGGTK VEIK SEQ ID NO: 26606 | QVQLQESGPGLVKPSQTLSLTCTVSGGSISSGGYYW NWIRQHPGKGLEWIGYIYYSGSTYNPSLKSRVTIS VDTSKNQFFLKLNSVTAADTAVYYCARSGYNWDA GVDPWGRGTLVTVSS SEQ ID NO: 30612 |

FIGURE 50
(Continued)

| | | | |
|---|---|---|---|
| iPS-435831 | 21-225_190C12 | NA | GACATCCAGATGACCCAGTCTCCATCCTCCT GTCTGCATCTGTAGGAGACAGAGTCACCATCA CTTGCCGGGCAAGTCAGGCATTAGAAAAGAT TTAGGCTGGTATCAGCAGAAACCAGGGAAAG CCCCTAAGCGCCTGATCTATGCTGCATCCAGT TTGCAAAGTGGGGTCCCATTAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGTG GACGTTCGGCCAAGGGACCAAGGTGGAAATC AAA<br><br>SEQ ID NO: 26607 | CAGGTGCAGCTGGTGGAGTCTGGGGGAGCCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGCT GGAGTGGGTGGCAGTTATATCATATGATGGAAGT TATAAAACTATGTAGACTCCGTGAAGGGCCGAT TCACCATCTCCAGAGACAATTCCAAGAACACGCT GTATCTGCAAATGAATAGCTGAGAGCTGAAGA CACGGCTGTGTATTACTGTGCGAGAGGTACCCAC GGGTACTACTACGGTGTGTGGACGTCTGGGGCCAA GGGACCACGGTCACCGTCCTCA<br><br>SEQ ID NO: 30613 |
| | | AA | DIQMTQSPSSLSASVGDRVTITCRASQGIRKDLG WYQQKPGKAPKRLIHTASSLQSGVPLRFSGSGS GTEFTLTISSLQPEDFATYYCLQHNSYPWTFGQG TKVEIK<br><br>SEQ ID NO: 26608 | QVQLVESGGAVVQPGRSLRLSCAASGFTFSSYGMH WVRQAPGKGLEWVAVISYDGGYKNYVDSVKGRF TISRDNSKNTLYLQMNSLRAEDTAVYYCARGTHG YYYGVDVWGQGTTVTVSS<br><br>SEQ ID NO: 30614 |
| iPS-435833 | 21-225_190D12 | NA | GACATTCAGATGACCCAGTCTCCATCCTCCCT GTCTGCATCTGTAGGAGACAGAGTCACCATCA CTTGCCGGGCGAGTCAGGCATTAGCAATTAT TTAGCCTGGTATCAGCAGAAACCAGGGAAAGT CCCTAAACTCCTGATCTATGTTGCATCCACTTT GCAATCAGGGGTCCCATCTCGGTTCAGTGGCA GTGGATCTGGGACAGATTTCACTCTCACCATC AGCAGCCTGCAGCCTGAAGATGTTGCAACTTA TTACTGTCAAAAGTATAACAGTGCCCCATTCA CTTTCGGCCCTGGGACCAAAGTGGATATCAAA<br><br>SEQ ID NO: 26609 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGACTCAGCTATTATTGGTAATGGTGGT AGGACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAAGATATGGG TAGATACAGCTATGGTTCTTTGACTACTGGGGC CAGGGAACCCTGGTCACCGTCTCCTCA<br><br>SEQ ID NO: 30615 |

FIGURE 50
(Continued)

| | | | |
|---|---|---|---|
| iPS:435835 | 21-225_190F12 | AA | DIQMTQSPSSLSASVGDRVTITCRASQGISNYLA WYQQKPGKVPKLLIYVASTLQSGVPSRFSGSGS GTDFTLTISSLQPEDVATYYCQKYNSAPFTFGPG TKVDIK SEQ ID NO: 26610 | EVQLLESGGGLVQPGGSLRLSCAASGFTFSSYAMS WVRQAPGKGLEWDSAIIGNGGRTYYADSVKGRFTI SRDNSKNTLYLQMNSLRAEDTAVYYCAKDMGRYS YGFFDYWGQGTLVTVSS SEQ ID NO: 30616 |
| | | NA | GACATCCAGATGACCCAGTCTCCATCCTCACT GTCTGCATCTGTGGGAGACAGAGTCACCATCA CTTGTCGGGCGAGTCAGGGCATTGGCAAGTAT TTAGCCTGGTTTCAGCAGAAACCAGGGAAAGC CCCTAAGTCACTGATCTATGCTGCATCCAGTTT GCAAAGTGGGGTCCCATCAAAATTCAGCGGCA GTGGATCTGGGACAGATTTCACTCTCACCATC AGCAGCCTGCAGCCTGACGATATGATACTTCA TTACTGCCAACGATATGATACTTACCCATTCA CTTTCGGCCCTGGGACCAAAGTGGATATCAAA SEQ ID NO: 26611 | CAGGTGCAGCTGGTGGAGTCTGGGGGAGGCGTG GTCCAGCCTGGGAGGTCCCTGAGACTCTCCTGTG CAGCGTCTGGATTCACCTTCAGGAACTATGGCAT GCACTGGGTCCGCCAGGCTCCAGGCAAGGGCT GGAGTGGGATGGCAGTTATATGGTTTGATGGAAGT AATGACTACTATGCAGACTCCGTGAAGGGCCGAT TCACCATCTCCAGAGACAATTCCAAGAACACGCT GTCACTGCAAATGAACAGCCTGAGAGCCGAGGA CACGGCTGTGTATTACTGTGCGAGAGATAGAAGC GTCGGCTACGACGGTTTAGATGTCTGGGGCCAAG GGACCACGGTCACCGTCTCCTCA SEQ ID NO: 30617 |
| | | AA | DIQMTQSPSSLSASVGDRVTITCRASQGIGKYLA WFQQKPGKAPKSLIYAASSLQSGVPSKFSGSGSG TDFFLTISSLQPDDFATYYCQRYDTYPFTFGPGT KVDIK SEQ ID NO: 26612 | QVQLVESGGGVVQPGRSLRLSCAASGFTFRNYGM HWVRQAPGKGLEWVAVIWFDGSNDYYADSVKGR FTISRDNSKNTLSLQMNSLRAEDTAVYYCARDRSV GYDGLDVWGQGTTVTVSS SEQ ID NO: 30618 |

FIGURE 50
(Continued)

| | | | |
|---|---|---|---|
| iPS:435837 | 21-225_198G3 | NA | GACATCCAGATGGCCCAGTCTCCTTCCTCACT GTCTGCATCTGTAGGAGACAGAGTCACCATCA CTTGTCGGACGAGTCAGGGCATTGGCAAGTAT TTAGCCTGGTTTCAGCAGAAGCCAGGGAAAGC CCCTAAGTCCCTGCTCTATAAAGCATCCAGTTT GCAAGGTGGGGTCCCATCAAGTTCAGCGGCA GTGGATCTGGGACAGATTTCACTCTCACCATC AGCAGCCTGCAGCCTGAAGATTTTGCAACTTA TTACTGCCAACAGTATATGACTTACCCGCTCA CTTTCGGCGGAGGGACCAAGGTGGAGATCAA A<br><br>SEQ ID NO: 26613 | CAGGTGCAGCTGGTGGAGTCTGGGGGAGGCGTG GTCCAGCCTGGGAGGTCCCTGAAACTCTCCTGTG CAGCGTCTGGATTCACCTTCAGTACCTATGGCAT GCACTGGGTCCGCCAGGCTCCAGGCAAGGGACT GGAGTGGGTGGCAGTTATATGGTATGATGAACT AATAAAAACTATGCAGACTCCGTGAAGGGCCGA TTCACCATCTCCAGAGACAATTCCAAGAACACGC TGTGTCTGCAAATGAACAGCCTGAGAGCCGAGG ACACGGCTGTGTATTACTGTGCGAGAGATCAGGG CGTGGGCTACGACGGTTTGGACGTCTGGGGCCAA GGGACCACGGTCACCGTCTCCTCA<br><br>SEQ ID NO: 30619 |
| | | AA | DIQMAQSPSSLSASVGDRVTITCRTSQGIGKYLA WFQQKPGKAPKSLLYKASSLQGGVPSKFSGSGS GTDFTLTISSLQPEDFATYYCQQYMTYPLTFGGG TKVEIK<br><br>SEQ ID NO: 26614 | QVQLVESGGGVVQPGRSLKLSCAASGFTFSTYGMH WVRQAPGKGLEWVAVIWYDGTNKNYADSVKGRF TISRDNSKNTLCLQMNSLRAEDTAVYYCARDQGV GYDGLDVWGQGTTVTVSS<br><br>SEQ ID NO: 30620 |
| iPS:435839 | 21-225_191B1 | NA | GACATTGTGATGACCCAGACTCCACTCTCT GTCCGTCACCCTGGACAGCCGGCCTCCATCT CCTGTAGGTCTAGTCAGAGCCTCCTGCATAGT GATGGAAAAGACCTATTTGTTTGGTACCTGCA GAAGCCAGGCCAGCCTCCACAGGTCCTGATCT ATGAAACTTTCCAACCGGTTCTCTGGAGTGCCA GATAGGTTCAGTGGCAGCGGGTCAGGGACAG ATTTCACACTGAAAATCAGCCGGGTGGAGGCT GAGGATGTTGGGGTTTATTACTGCATGCAAAG TTTCCAGCTTCCCTGGACGTTCGGTCAAGGGA CCAAGGTGGAAATCAAT<br><br>SEQ ID NO: 26615 | CAGGTGCAGCTGCAGGAGTCGGGCCCAGGACTG GTGAAGCCTTCGGAGACCCTGTCCCTCACCTGCA CTGTCTCTGGTGGCTCCATCAGTAGTTATCACTG GAGCTGGATCCGGCAGCCCGCGGGAAGGGACT GGAGTGGATTGGGCGTATCTATACCAGTGGGAGC ACCAACTACAACCCCTCCCTCAAGAGTCGAGTCA CCATGTCAGTAGACACGTCTGTGACCGCGGACACG GCCGTGTATTACTGTGCGAGACTCCGGTATAACT GGAACTTCCCTTCTTTGACTATTGGGGCCAGGG AACCCTGGTCACCGTCTCCTCA<br><br>SEQ ID NO: 30621 |

FIGURE 50
(Continued)

| | | | | |
|---|---|---|---|---|
| iPS-435841 | 21-225_191D8 | AA | DIVMTQTPLSLSVTPGQPASISCRSSQSLLHSDGK TYLFWYLQKPGQPPQVLIYELSNRFSGVPDRFSG SGSGTDFTLKISRVEAEDVGVYYCMQSFQLPWT FGQGTKVEIN<br>SEQ ID NO: 26616 | QVQLQESGPGLVKPSETLSLTCTVSGGSISSYHWSW IRQPAGKGLEWIGHIYTSGSTKYNPSLKSRVTMSVD TSKNQFSLKLSSVTAADTAVYYCARLRYNWNFPFF DYWGQGTLVTVSS<br>SEQ ID NO: 30622 |
| | | NA | GACATCATGATGACCCAGTCTCCAGACTCCCT GGCTGTGTCTCTGGGCGAGAGGGCCATCATCA GCTGCAGGTCCAGCCAGAGTGTTTACACAGC TCCAACAATTACAACTACTTAGCTTGGTACCA GCAGAAACCAGGACAGCATCCTCCTAAACTGCTCA TTTACTGGGCATCTACCCGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAACAA TATTATAGTACTCCTCGACGTTCGGCCTAGG GACCAAGGTGGAAATCAAA<br>SEQ ID NO: 26617 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACAGAAGTTCCAGGCAG TAACACAGGCTATGCACAGAAGTTCCAGGCAG AGTCACCATGACCAGGAACACCTCCATAAGCAC AGCCTACATGGAGCTGAGCAGCCTGAGATCTGA GGACACGGCCGTGTATTACTGTGCCATAGCAGT GGCTGGTACTACTTTGACTACTGGGGCCAGGGAA CCCTGGTCACCGTCTCCTCA<br>SEQ ID NO: 30623 |
| | | AA | DIMMTQSPDSLAVSLGERAIISCRSSQSVLHSSNN YNYLAWYQQKPGHPPKLLIYWASTRESGVPDRF SGSGSGTDFTLTISSLQAEDVAVYYCQQYYSTPP TFGLGTKVEIK<br>SEQ ID NO: 26618 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAHSSGW YYFDYWGQGTLVTVSS<br>SEQ ID NO: 30624 |

FIGURE 50
(Continued)

| | | | | |
|---|---|---|---|---|
| iPS:435843 | 21-225_191F1 | NA | GAAATTGTGTTGACGCAGTCTCCAGGCACCCT GTCTTTGTCTCCAGGGGAAAGAGCCGCCTCT CCTGCAGGGCCAGTCAGAGTATTAGCCTCAAC TTCTTAGCCTGGTACCAGCAGAAACCTGGCCA GGCTCCCAGGCTCCTCATCTATGGTGCATCCA GCAGGGCCACTGGCATCCCAGACAGTTCAGT GGCAGTGGGTCTGGGACAGACTTCACTCTCAC CATCAATAGACTGGAGCCTGAAGATTTTGCAG TGTATTACTGTCAGCAGTATGGTAGTCACCG TGGACGTTCGGCCAAGGGACCAAGGTGGAAG TCAAA | CAGGTGCAGCTGCAGGAGTCGGGCCCAGGACTG GTGAAGCCTTCACAGACCCTGTCCCTCACCTGCA CTGTTTCTGGTGCTCCATCAACAGTGGTGGTTA CTACTGGAACTGGATCCGCCAGCACCCAGGGAA GGGCCTGGAGTGGATTGGGTACATCTTTACAGT GGGAGCACCTACTACAACCGTCCCTCAAGAGTC GAGTCACCATATCAGTAGACACGTCTAAGAACC AGTTCTCCCTGAACGTGAGCTCTGTGACTGCCGC GGACACGGCCGTGTATTACTGTGCGAGAGGGA TTACGATGGTTCGGGAGTTATCACTACTATTAC GGTATGGACGTCTGGGGCCAAGGGACCACGGTC ACCGTCTCCTCA |
| | | | SEQ ID NO: 26619 | SEQ ID NO: 30625 |
| | | AA | EIVLTQSPGTLSLSPGERAALSCRASQSISLNFLA WYQQKPGQAPRLLIYGASSRATGIPDRPSGSGSG TDFTLTINRLEPEDFAVYYCQQYGRSPWTFGQG TKVEVK | QVQLQESGPGLVKPSQTLSLTCTVSGGSINSGGYY WNWIRQHPGKGLEWIGYIFYSGSTYYNPSLKSRVTI SVDTSKNQFSLKLSSVTAADTAVYYCARGDYDGS GSYHYYGMDVWGQGTTVTVSS |
| | | | SEQ ID NO: 26620 | SEQ ID NO: 30626 |
| iPS:435845 | 21-225_191G1 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAAACCAGGGAAAGC CCCTAAGTCCCTGATCTATGCTGCATCCAGTTT GCAAAGTGGGGTCCCATCAAGGTTCAGCGGCA GTGGATCTGGGAACAGATTTCACTCTCACCATC AGCAGCCTGCAGCCTGAAGATTTTGCAACTTA TTACTGCCAACATTATTCTTACCCTCTCCAC TTTCGGCGGAGGGACCAAGGTGGAGATCAAA | CAGGTGCAGCTGGTGGAGTCTGGGGGAGGCGTG GTCCAGCCTGGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATGAACACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATAGGGG GGTGGGTTACTACGGTTTGGACGTCTGGGGCCAA GGGACCACGGTCACCGTCTCCTCA |
| | | | SEQ ID NO: 26621 | SEQ ID NO: 30627 |

FIGURE 50
(Continued)

| | | | | |
|---|---|---|---|---|
| iPS:435847 | 21-225_191A3 | AA | DIQMTQSPSSLSASVGDRVTITCRASQGISNYLA WFQQKPGKAPKSLIYAASSLQSGVPSKFSGSGSG TDFTLTISSLQPEDFATYYCQHYLTYPLTFGGGT KVEIK<br>SEQ ID NO: 26622 | QVQLVESGGGVVQPGRSLRLSCAASGFTFSSYGMH WVRQAPGKGLEWVAVIWYDGSNEHYADSVKGRF TISRDNSKNTLYLQMNSLRAEDTAVYYCARDRGV GYYGLDVWGQGTTVTVSS<br>SEQ ID NO: 30628 |
| | | NA | GAAATTGTGTTGACGCAGTCTCCAGGCACCCT GTCTTTGTCTCCAGGGGAAAGAGCCACCCTCT CCTGCAGGGCCAGTCAGAGTATTCGCAGCAGC TTCTTAGCCTGGTACCAGCAGAAACCTGGCCA GGCTCCCAGGCTCCTCATCTATGCTGCATCCA GCAGGGCCACTGGCATCCCAGACAGACTTCAGT GGCAGTGGGTCTGGGACAGACTTCACTCTCAC CATCAGCAGACTGGAGCCTGAAGATTTTGCAG TGTATTACTGTCAGCAATATGGTAACTCACCG TGGGCGTTCGGCCAAGGGACCAAGGTGGAAG TCAAA<br>SEQ ID NO: 26623 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGATCGCCAGCACCCAGGGAA GGGCCTGGAGTGGATTGGGTACATCTTTTACAGT GGGAGCACCTACTACAACCCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGGGATT ACGATGGTTCGGGGAGTTATCACTACTACTACGG TATGGACGTCTGGGGCCAAGGGACCACGGTCAC CGTCTCCTCA<br>SEQ ID NO: 30629 |
| | | AA | EIVLTQSPGTLSLSPGERATLSCRASQSIRSSFLA WYQQKPGQAPRLLIYGASSRATGIPDRFSGSGSG TDFTLTISRLEPEDFAVYYCQQYGNSPWAFGQG TKVEVK<br>SEQ ID NO: 26624 | QVQLQESGPGLVKPSQTLSLTCTVSGGSISSGDYYW NWIRQHPGKGLEWIGYIFYSGSTYYNPSLKSRVTIS VDTSKNQFSLKLSSVTAADTAVYYCARGDYDGSG SYHYYGMDVWGQGTTVTVSS<br>SEQ ID NO: 30630 |

FIGURE 50
(Continued)

| | | | | |
|---|---|---|---|---|
| iPS:435849 | 21-225_191C3 | NA | GAAATTGTGTTGACGCAGTCTCCAGGCACCCT GTCTTTGTCTCCAGGGGAAAGAGCCACCCTCT CCTGCAGGGCCAGTCAGAGTATTCGCAGCAGC TTCTTAGCCTGGTATCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAACTCACCG TGGGCGTTCGGCCAAGGGACCAAGGTGGAAA TCAAA<br><br>SEQ ID NO: 26625 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGGATCGCCAGTCCCAGGAA GGGCTGGAGTGGATTGGGTACATCTTTTACAGT GGGAGCACCTACTACAACCCGTCCCTCAAGAGTC GACTTACCATATCAGTGGACACGTCTAAGAACCA GTTCTCCCTGAAACTGAACTCTGTGACTGCCGCG GACACGGCCGTGTATTACTGTGCGAGAGGGGATT ACGATGGTTCGGGGAGTTATCACTTCTACTACGG TATGGACGTCTGGGGCCAAGGGACCACGGTCAC CGTCTCCTCA<br><br>SEQ ID NO: 30631 |
| | | AA | EIVLTQSPGTLSLSPGERATLSCRASQSIRSSFLA WYQQKPGQAPRLLIYGASSRATGIPDRFSGSGSG TDFTLTISRLEPEDFAVYYCQQYGNSPWAFGQG TKVEIK<br><br>SEQ ID NO: 26626 | QVQLQESGPGLVKPSQTLSLTCTVSGGSISSGDYYW NWIRQLPGKGLEWIGYIFYSGSTYYNPSLKSRLTISV DTSKNQFSLKLNSVTAADTAVYYCARGDYDGSGS YHFYYGMDVWGQGTTVTVSS<br><br>SEQ ID NO: 30632 |
| iPS:435851 | 21-225_191D3 | NA | GAAATTGTGTTGACGCAGTCTCCAGGCACCCT GTCTTTGTCTCCAGGGGAAAGAGCCACCCTCT CCTGCAGGGCCGGTCAAAGTATTAGAACCAAC TTCTTAGCCTGGTACCAGCAGCAGCCTGGCCA GGCTCCCAGGCTCCTCATCTATGGTGCATCA GCAGGGCCACTGGCATCCCAGACAGGTTCAGT GGCAGTGGGTCTGGGACAGACTTCACTCTCAC CATCAACAGACTGGAGCCTGAAGATTTTGCAG TGTATTACTGTCAGCAGTATGGTAGCTCACCG TGGACGTTCGGCCAAGGGACCAAGGTGGAAA TCAAA<br><br>SEQ ID NO: 26627 | CAGGTGCAACTGAAGGAGTCGGGCCCAGGACTG GTGAAGCCTTCACAGACCCTGTCCCTCACCTGCA CTGTCTCTGGTGGCTCCATCAACAGTGGTGATTA CTACTGGAACTGGATCGCCAGCACCCAGGAA GGGCCTGGACTGGATTGGGTACATCTTTTACAGT GGGAGCACCTACTACAACCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGGGGATT ACGATGGTTCGGGGAGTTATCACTACTATTACGG TATGGACGTCTGGGGCCAAGGGACCACGGTCAC CGTCTCCTCA<br><br>SEQ ID NO: 30633 |

FIGURE 50
(Continued)

| | | | | |
|---|---|---|---|---|
| iPS:435853 | 21-225_191E3 | AA | EIVLTQSPGTLSLSPGESATLSCRAGQSIRTNFLA WYQQKPGQAPRLLIYGASSRATGIPDRFSGSGSG TDFTLTINRLEPEDFAVYYCQQYGSSPWTFGQGT KVEIK. SEQ ID NO: 26628 | QVQLKESGPGLVKPSQTLSLTCTVSGGSINSGDYY WNWIRQHPGKGLDWIGYIFYSGSTYYNPSLKSRVT ISVDTSKNQFSLKLSSVTAADTAVYYCARGDYDGS GSYHYYYGMDVWGQGTTVTSS SEQ ID NO: 30634 |
| | | NA | GATATTGTAATGACCCAGACTCCACTCTCT GTCCGTCACCCCTGGACAGCCGGCCTCCATCT CCTGCAAGTCTAGTCAGAGCCTCCTCACATAGT GATGAAGGACCTATTTGTATTGGTACCTGCA GAAGCCAGGCCAGCCTCCACAGCTCCTGATCT GTGAGGTTTCCAACCGGTTCGCTGGAGTGACA GATAGGTTCAGTGGCAGCGGGTCAGGGACAG ATTTCACACTGAAAATCAGCCGGTGGAGGCT GGGGATGTTGGGGTTTATTACTGCATGCAAAG TATACAACTTCCCTGGACGTTCGGCCAAGGGA CCAAGGTGGAAATCAAA SEQ ID NO: 26629 | CAGCTGCAGCTGCAGGAGTCGGGCCCAGGACTG GTGAAGCCTTCGGAGACCCTGTCCTCACCTGCA CTGTCTCTGGTGGCTCCATCAGAAGCTACCACTG GAGCTGGATCCGGCAGCCCGCGGAAGGGACT GGAGTGGATTGGACTTATCTATACCAGTAGGAGC ACCAATTACAACCCCTCCCTCAAGAGTCGAGTCA CCATGTCAGTTGACAGTCCAAGAACCAGTTCTC CCTGAAGCTGAACTCTGTGCGAGACCGCGGACACG GCCGTGTATTACTGTGCGAGACTCCGGTATAACT GGAACTTCCCTTACTTTGACTACTGGGGCCAGGG AACCCTGGTCACCGTCTCCTCA SEQ ID NO: 30635 |
| | | AA | DIVMTQTPLSLSVTPGQPASISCKSSQSLLHSDGR TYLYWYLQKPGQPPQLLICEVSNRFAGVTDRFS GSGSGTDFTLKISRVEAGDVGVYYCMQSIQLPW TFGQGTKVEIK SEQ ID NO: 26630 | QLQLQESGPGLVKPSETLSLTCTVSGGSIRSYHWSW IRQPAGKGLEWIGLIYTSRSTNYNPSLKSRVTMSVD TSKNQFSLKLNSVTAADTAVYYCARLRYNWNFPY FDYWGQGTLVTVSS SEQ ID NO: 30636 |

FIGURE 50
(Continued)

| | | | |
|---|---|---|---|
| iPS:435855 | 21-225_191G3 | NA | GACATCGTGATGACCCAGTCTCCAGACTCCCT GGCTGTGTCTCTGGGCGAGAGGGCCACCATCG ACTGTAAGTCCAGCCAGAGTGTTTTACACAGC TCCAACAGTTACAACTACTTAGCTTGGTACCA GCAGAAATTAGGACAGCCTCCTAAACTGCTCA TTTACTGGGCATCTACCCGAAAATCCGGGGTC CCTGACCGATTCAGTGGCAGCGGGTCTGGGAC AGATTTCACTCTCACCATCAGCAGCCTGCAGG CTGAAGATGTGGCATTTTATTACTGTCAGCAA TATTATAGTAGTCCTCCCACTTTCGGCCCTGGG ACCAAAATGGATATCAAA<br>SEQ ID NO: 26631 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGACGGATGAACCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCCATAGCAG TGGCTGGTACATCTTTGACTACTGGGGCCAGGGA ACCCTGGTCACCGTCTCCTCA<br>SEQ ID NO: 30637 |
| | | AA | DIVMTQSPDSLAVSLGERATIDCKSSQSVLHSSN SYNYLAWYQQKLGQPPKLLIYWASTRKSGVPD RFSGSGSGTDFTLTISSLQAEDVAFYYCQQYYSS PPTFGPGTKMDIK<br>SEQ ID NO: 26632 | QVQLVQSGAEVKKPGASVKVSCKASGYTFTNYDIN WVRQATGQGLEWMGRMNPNSGNTGYAQKFQGR VTMTRNTSISTAYMELSSLRSEDTAVYYCAHSSGW YIFDYWGQGTLVTVSS<br>SEQ ID NO: 30638 |
| iPS:435857 | 21-225_191A4 | NA | GACATCCAGATGACCCAGTCTCCATCTCCCT GTCTGCATCTGTAGGAGACAGAGTCACCATCA CTTGCCGGGCAAGTCAGGGCATTAGAAAAGAT TTAGGCTGGTATCAGCAGAAACCAGGGAAAG CCCCTAAGCGCCTGATCTATACTGCATCCAGT TTGCAAAATGGGGTCCCATTAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGTG GACGTTCGGCCAAGGGACCAAGGTGGAAATC AAA<br>SEQ ID NO: 26633 | CAGGTGCAGCTGGTGGAGTCTGGGGGAGGCGTG GTCCAGCCTGGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATCATATGATGGAGGT TATAAAAACTATGCAGACTCCGTGAAGGGCCGA TTCACCATCTCCAGAGACAATTCCAAGAACACGC TGTATCTGCAAATGAATAGCCTGAGAGCTGAGGA CACGGCTGTGTATTACTGTGCGAGAGAGGTACCAC GGGTACTACTACGGTGTGGACGTCTGGGGCCAA GGGACCACGGTCACCGTCTCCTCA<br>SEQ ID NO: 30639 |

FIGURE 50
(Continued)

| | | | | |
|---|---|---|---|---|
| iPS-435859 | 21-225_190E6 | AA | DIQMTQSPSSLSASVGDRVTITCRASQGIRKDLG WYQQKPGKAPKRLIHTASSLQNGVPLRFSGSGS GTEFTLTISSLQPEDFATYYCLQHNSYPWTFGQG TKVEIK<br>SEQ ID NO: 26634 | QVQLVESGGGVVQPGRSLRLSCAASGFTFSSYGMH WVRQAPGKGLEWVAVISYDGGYKNYADSVKGRF TISRDNSKNTLYLQMNSLRAEDTAVYYCARGTHG YYYGVDVWGQGTTVTVSS<br>SEQ ID NO: 30640 |
| | | NA | GACATCAGATGACCCAGTCTCCTCCTCACT GTCTGCATCTGTAGGAGACAGAGTCACCATCA CTTGTCGGACGAGTCAGGGCATTCGGCAATTAT TTAGCCTGGTTTCAGCAGAAACCAGGGAAAGC CCCTAAGCTCCTGATCCTCTATATAAAGCATCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAGTATATGACTTACCCGCTCA CTTTCGGCGGAGGGACCAAGGTGGAGATCAA A<br>SEQ ID NO: 26635 | CAGGTGCAGCTGGTGGAGTCTGGGGGAGGCGTG GTCCAGCCTGGGAGGTCCCTGAGACTCTCCTGTG CAGCGGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAAAACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCAGGG CGTGGGCTACGACGGTTTGGACGTCTGGGGCCAA GGGACCACGGTCACCGTCTCCTCA<br>SEQ ID NO: 30641 |
| | | AA | DIQMTQSPSSLSASVGDRVTITCRTSQGIGNYLA WFQQKPGKAPKSLLYKASSLQSGVPSKFSGSGS GTDFTLTISSLQPEDFATYYCQQYMTYPLTFGGG TKVEIK<br>SEQ ID NO: 26636 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDQGV GYDGLDVWGQGTTVTVSS<br>SEQ ID NO: 30642 |

FIGURE 50
(Continued)

| | | | |
|---|---|---|---|
| iPS:435861 | 21-225_190A5 | NA | CAGGTGCAGTTGGTGGAGTCTGGGGGAGGCGTG GGCCAGCCTGGGAGGTCCCTGAGACTCTCCTGTG CAGCGTCTGATTCACCTTCAGTAGTAGTATGGCAT GCACTGGGTCCGCCAGGCTCCAGGCAAGGGGCT GGAGTGGGTGGCAGTTATATGGTATGATGGAAGT AATAAAAACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATTTCTC TGTAGGGTACGACGGTATGGACGTCTGGGGCCA AGGGACCACGGTCACCGTCCTCA |
| | | | GACATCCAGATGACCCAGTCTCCATCCTCACT GTCTGCATCTGTAGGAGACAGAGTCACCATCA CTTGTCGGGCAGTCAGGGATTGGCAATCAT TTAGCCTGGTTTCAGCAGAAACCAGGAAAGC CCCTAAGTCCCTGATCCATGCTGCATCCAGTT GCAAAGTGGGGTCCCATCAAGTTCAGCGGCA GTGGATCTGGGACAGATTTCACTCTCACCATC AGCAGCCTGCAGCCTGAAGATTTTGCAACTTA TTACTGCCAACAGTATAGTAATTACCCAGTCA CTTTCGGCCCTGGGACCAAAGTGGATATCAAA |
| | | | SEQ ID NO: 30643 |
| | | AA | DIQMTQSPSSLSASVGDRVTITCRASQGIGNHLA WFQQKPGKAPKSLIHAASSLQSGVPSKFSGSGSG TDFTLTISSLQPEDFATYYCQQYSNYPVTFGPGT KVDIK |
| | | | QVQLVESGGGVGQPGRSLRLSCAASGFTFSSYGMH WVRQAPGKGLEWVAVIWYDGSNKNYADSVKGRF TISRDNSKNTLYLQMNSLRAEDTAVYYCARDFSVG YDGMDVWGQGTTVTVSS |
| | | | SEQ ID NO: 26637 |
| | | | SEQ ID NO: 30644 |
| iPS:435863 | 21-225_191H4 | NA | GAAATTGTGCTGACTCAGTCTCCAGACTTTCA GTCTGTGACTCCAAAGGAGAAAGTCACCATCA CCTGCCGGGCCAATCAGAGCATTGGTAGTAGC TTACACTGGTACCAGCAGAAACCAGATCAGTC CCTAAAGCTCCTCATCAAGTATGCTTCCCAGT CCCTCTCAGGGGTCCCCTCGAGGTTCAGTGC AGTGGATCTGGGACAGATTTCACCCTCACCAT CAATAGCCTGGATGCTGAAGATGCTGCAACGT ATTACTGTCATCAGACTGGTAGGTTACCTCTC ACTTTCGGCGGAGGGACCAAGGTGGAGATCA AA | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGGTTA CTACTGGAACTGGATCCGCCAGCACCCAGGGAA GGGCCTGGAGTGGATTGGGTACATCTTTTACAGT GGGAGCACCTACTACAACCCGTCCCTCAAGAGTC GACTTACCATATCAATAGACACGTCTAAGAACCA GTTCTCCCTGAAGCTGACCTCTGTGACTGCCGCG GACACGGCGTATATTACTGTGGGAGATCCGGGT ATAACTGGACAACGGGGTGCACCCTGGGGCC AGGGAACCCTGGTCACCGTCCTCA |
| | | | SEQ ID NO: 26638 |
| | | | SEQ ID NO: 26639 |
| | | | SEQ ID NO: 30645 |

FIGURE 50
(Continued)

| | | | |
|---|---|---|---|
| iPS:435865 | 21-225_191A5 | AA | EIVLTQSPDFQSVTPKEKVTITCRANQSIGSSLHW YQQKPDQSPKLLIKYASQSLSGVPSRFSASGSGT DFTLTINSLDAEDAATYYCHQTGRLPLTFGGGT KVEIK<br>SEQ ID NO: 26640 | QVQLQESGPGLVKPSQTLSLTCTVSGGSISSGGYYW NWIRQHPGKGLEWIGYIFYSGSTYNPSLRSRLTISI DTSKNQFSLKLTSVTAADTAVYYCGRSGYNWDNG VDPWGQGTLVTVSS<br>SEQ ID NO: 30646 |
| | | NA | GAAATTGTGTTGACGCAGTCTCCAGGCACCCT GTCTTTGTCTCCAGGGGAAAGAGCCACCCTCT CCTGCAGGGCCAGTGTTAGCAGCAGG CAGCCTCTGGATTCACCTTCAGAGACTTAGCAT TTCTTAGCCTGGTACCAGCAGAAACCTGGCCA GGCTCCCAGGCTCCTCATCTATGGTGCTTCCA ACAGGGCCACTGGCATCCCCGACAGTTCAGT GGCAGTGGGTCTGGGACAGATTCACTCTCAC CATCAGCAGACTGGAGCCTGAAGATTTTGCAG TGTATTACTGTCAGCAGTATGGTAGTTCACCTC CGTTGGACGTTCGTCCAAGGGACCAAGGTGGA AATCAAA<br>SEQ ID NO: 26641 | GAGATACAGGTGGTGGAGTCTGGGGGAGGCCTG GTCAAGCCTGGGGGGTCCCTGAGACTCTCCTGTG CAGCCTCTGGATTCACCTTCAGAGACTATAGCAT GAACTGGGTCCGCCAGCTCCAGGGAAGGGCT GGAGTGGGTCTCATCATTAGTAGTGGTAGTGGT TACATATATTATGCAGACTCAGTGAAGGGCCGAT TCACCATCTCCAGAGACAAGCCAAGAACTCACT GTATCTGCAAATGAACAGCCTGAGAGCCGAGA CAGGCTGTGTATTACTGTGCGAGAGCTACTATG GCCCTTGACTACTGGGGCCAGGGAGCCCTGGTCA CCGTCTCCTCA<br>SEQ ID NO: 30647 |
| | | AA | EIVLTQSPGTLSLSPGERATLSCRASQSVSSRFLA WYQQKPGQAPRLLIYGASNRATGIPDRFSGSGS GTDFTLTISRLEPEDFAVYYCQQYGGSPPWTFVQ GTKVEIK<br>SEQ ID NO: 26642 | EIQVVESGGGLVKPGGSLRLSCAASGFTFRDYSMN WVRQAPGKGLEWVSSISSGSGYIYYADSVKGRFTIS RDNAKNSLYLQMNSLRAEDTAVYYCARATMALD YWGQGALVTVSS<br>SEQ ID NO: 30648 |

FIGURE 50
(Continued)

| | | | |
|---|---|---|---|
| iPS:435867 | 21-225_191E5 | NA | GAAATTGTGCTGACTCAGTTTCCAGACTCTCA GTCTGTGACTCCAAAGGAGAAAGTCACCATCA CCTGCCGGGCCAGTCAGAGCATTGGTAGTAGC TTACACTGGTACCAGCAGAAACCAGATCAGTC TCCAAAGCTCCTCATCAAGTATGCTTCCCAGT CCTTCTCAGGGGTCCCCTGAGGTTCAGTGGC AGTGGATCTGGGACAGATTTCACCCTCACCAT CAATAGTCTGGAGGCTGAAGATGCTGCAACGT ATTACTGTCATCAGAGTAGTAGTTTCCCTCGG ACGTTCGGCCAAGGGACCAAGGTGGAAATCA AA<br><br>SEQ ID NO: 26643 | GAGGTGCAGCTGTTGTGACTCTGGGGGAGGCTTGG GACAGCCTGGGGGGTCCCTGAGACTCTCCTGTGC AGCCTCTGGATTCACCTTTGACAGTGCCTATGCCATG AACTGGGTCCGCCAGGCTCCAGGGAAGGGGCTG GAGTGGGTCTCAACTATTAGTGGTACTGGTGTA GGACATACTACGCAGACTCCGTGAAGGGCCGGT TCACCATCTCCAGAGACAATTCCAAGAACACGT GTATCTGCAAATGAATAGCCTGAGAGCCGAGGA CACGGCCGTATATATTACTGTGCGAAAGAGGAGA TTACTATGATAGTAGTAGGCCCGGGTTCGACCCC TGGGGCCAGGGAACCCTGGTCACCGTCTCCTCA<br><br>SEQ ID NO: 30649 |
| | | AA | EIVLTQFPDSQSVTPKEKVTITCRASQSIGSSLHW YQQKPDQSPKLLIKYASQSFSGVPSRFSGSGSGT DFTLTINSLEAEDAATYYCHQSSSFPRTFGQGTK VEIK<br><br>SEQ ID NO: 26644 | EVQLLDSGGGLGQPGGSLRLSCAASGFTFDSYAMN WVRQAPGKGLEWVSTISGTGRRTYYADSVKGRFTI SRDNSKNTLYLQMNSLRAEDTAVYYCAKEEDYYD SSGPGFDPWGQGTLVTVSS<br><br>SEQ ID NO: 30650 |
| iPS:435869 | 21-225_190B1 | NA | GACATCCAGATGACCCAGTCTCCATCCTCACT GTCTGCATCTGTTGGAGACAGAGTCACCATCA CTTGTCGGGCGAGTCAGGGCATTAGAAATTAT TTAGCCTGGTTTCAGCAGAAACCAGGGAAAGC CCCTAAGTCCCTGATCTATGTTGCATCCAGTTT GGAAAGTGGGGTCCCATCAAAGTTCAGTGGCA GTGGATCTGGGACAGATTTCACTCTCACCATC AGCAGCCTGCAACCTGAAGATTTTGAACTTA TTACTGCCAACAGTATCTTAATTACCCAGTCA CTTTCGGCCCTGGGACCAAAGTGGATATCAGA<br><br>SEQ ID NO: 26645 | CAGGTGCAGCTGGTGAGTCTGGGGGAGGCGTG GTCCAGCCTGGGAGGTCCCTGAGACTCTCCTGTG CAACGTCTGATTCACCTTCACTAGCTATGGCAT GCACTGGGTCCGCCAGGCTCCAGGCAAGGGGCT GGAGTGGGTGGCAGTTATATGGTATGATGGAAGT AATAAACATTATGCAGACTCCGTGAAGGGCCGA TTCACCATCTCCAGAGACAATTCCAAGAACACAC TATATCTGCAAATGAACAGCCTGAGAGCCGAGG ACACGGCTGTTTATTACTGTGCGAGAGATAGAAC AGTGGGATACTCCGTATGGACGTCTGGGGCCA AGGGACCACGGTCACCGTCTCCTCA<br><br>SEQ ID NO: 30651 |

FIGURE 50
(Continued)

| | | | |
|---|---|---|---|
| | | AA | DIQMTQSPSSLSASVGDRVTITCRASQGIRNYLA WFQQKPGKAPKSLIYVASSLESGVPSKFSGSGSG TEFTLTISSLQPEDFGTYYCQQYLNYPVTFGPGT KVDIR<br>SEQ ID NO: 26646 | QVQLVESGGGVVQPGRSLRLSCATSGFTSSYGMH WVRQAPGKGLEWVAVIWYDGSNKHYADSVKGRF TISRDNSKNTLYLQMNSLRAEDTAVYYCARDRTVG YSGMDVWGQGTTVTVSS<br>SEQ ID NO: 30652 |
| iPS:435871 | 21-225_191E6 | NA | GATATTGTGATGACCCAGACTCCACTCTCT GTCCGTCACCCCTGGACAGCCGGCCTCCATCT CCTGCAAGTCTAGTCAGAGCCTCCTCCATAGT GATGGAAGGACCTATTTGTATTGGTACCTGCA GAAGCCAGGCCAGCCTCCACAGCTCCTGATCT GTGAGGTTTCCAACCGGTTCGCTGCAGGTGACA GATAGGTTCAGTGGCAGCGGGTCAGGGACAG ATTTCACACTGAAAATCAGCCGGGTGGAGGCT GGGGATGTTGGGATTTATTACTGCATGCAAAG TATACAITTTCCCTGGACGTTCGGCCAAGGGA CCAAGGTGGAAATCAAA<br>SEQ ID NO: 26647 | CAGCTGCAGCTGCAGGAGTCGGGCCAGGACTG GTGAAGCCTTCGGAGACCCTGTCCCTCACCTGCA CTGTCTCTGGTGGCTCCATCAGAAGCTACCACTG GAGCTGGATCCGGCAGCCCCCGGGAAGGGACT GGAGTGGATTGGCTTATCTATACCAGTAGGAGC ACCAATTACAACCCCTCCCTCAAGAGTCGAGTCA CCATGTCAGTAGACACGTCAAGAACCAGTTCTC CCTGAAGCTGAGCTCTGTGACCGCCGCGGACACG GCCGTGTATTACTGTGCGAGACTCCGGTATAACT GGAACTTCCCTACTTTGACTTCTGGGGCCAGGG AACCCTGGTCACCGTCTCCTCA<br>SEQ ID NO: 30653 |
| | | AA | DIVMTQTPLSLSVTPGQPASISCKSSQSLLHSDGR TYLYWYLQKPGQPPQLLICEVSNRFAGVTDRFS GSGSGTDFTLKISRVEAGDVGIYYCMQSIHFPWT FGQGTKVEIK<br>SEQ ID NO: 26648 | QLQLQESGPGLVKPSETLSLTCTVSGGSIRSYHWSW IRQPAGKGLEWIGLIYTSRSTNYNPSLKSRVTMSVD TSKNQFSLKLSSVTAADTAVYYCARLRYNWNFPYF DFWGQGTLVTSS<br>SEQ ID NO: 30654 |

FIGURE 50
(Continued)

| | | | |
|---|---|---|---|
| iPS:435873 | 21-225_190G4 | NA | GACATCCAGATGACCCAGTCTCCATCCTCACT GTCTGCATCTGTAGGAGACAGAGTCACCATCA CTTGTCGGGCGAGTCAGGACATTGGCAGATAT TTAGCCTGGTTTCAGCAGAAGCCAGGGAAAGC CCCTAAGTCCCTGATCTATCTGCATCCAGTTT GCAAAGTGGGGTCCCATCAAAGTTCAGCGGCA GTGGATCTGGGACAGATTTCACTCTCACCATC AGCAGCCTGCAGCCTGAAGATATTGCAACTTA TTACTGCCAACAATATAGTACTTACCCGCTCA CTTTCGGCGGAGGGACCAAGGTGGAGATCAA A |
| | | | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAAACTACGCAGACTCCGTGAAGGGCCGA TTCACCATCTCCAGAGACAATTCCAAGAACACGC TGTATCTGCAAATGAACAGCCTGAGAGCCGAGG ACACGGCTATGTATTACTGTGCGAGAGATCAGGG CGTGGGCTACGACGGTTTGGACGTCTGGGGCCAA GGGACCCTCGGTCACCGTCTCCTCA |
| | | | SEQ ID NO: 26649 | SEQ ID NO: 30655 |
| | | AA | DIQMTQSPSSLSASVGDRVTITCRASQDIGRYLA WFQQKPGKAPKSLIYLHPSGVPSKFSGSGSG TDFTLTISSLQPEDIATYYCQQYSTYPLTFGGGT KVEIK | QVQLVESGGGVVQPGRSLRLSCAASGFTFSSYGMH WVRQAPGKGLEWVAVIWYDGSNKNYADSVKGRF TISRDNSKNTLYLQMNSLRAEDTAMYYCARDQGV GYDGLDVWGQGTSVTVSS |
| | | | SEQ ID NO: 26650 | SEQ ID NO: 30656 |
| iPS:435875 | 21-225_190B9 | NA | GACATCCAGATGACCCAGTCTCCATCTCCGT GTCTGCATCTGTAGGAGACAGAGTCACCATCA CTTGTCGGGCGAGTCAGGGTATTAACAACTGG TTAGCCTGGTATCAGCAGAAACCAGGGAAAG CCCCTAAGCTCCTGATCTATGGTGTTCCAGTT TGCAGAGTGGGGTCCCATCAAGGTTCAGCGGC AGTGGATCTGGGACAGATTTCACTCTCACCAT CAGCAGCCTGCAGCCTGAAGATTTTGCAACTT ACTCTTGTCAACAGGCTAACAGTTTCCCGTGG ACGTTCGGCCAAGGGACCAAGGTGGAAATCA GA | GAGGTGCAGCTGTTGGAGTCTGGGGGAGGCTTG GTACAGCCTGGGGGGTCCCTGAGACTCTCCTGTG CAGCCTCTGGATTCACCTTTAGCACCTATGCCAT GAGTTGGGTCCGCCAGGCTCCAGGGAAGGGGCT GGAGTGGGTCTCAGCTATTAGTAGTGGTGGTGGT AACACACTACGCAGACTCCGTGAAGGGCCGG TTCACCATCTCCAGAGACAATTCCAAGAATACGC TGTATCTGCAAATGAACAGCCTGAGAGCCGAGG ACACGGCCGTATATTCCTGTGCGAAAGATGGATT CGGTGGGAGCTCCTACTTTGACTACTGGGGCCAG GGAACCCTGGTCACCGTCTCCTCA |
| | | | SEQ ID NO: 26651 | SEQ ID NO: 30657 |

FIGURE 50
(Continued)

| | | | | |
|---|---|---|---|---|
| | | AA | DIQMTQSPSSVSASVGDRVTITCRASQGINNWLA WYQQKPGKAPKLLIYGVSSLQSGVPSRFSGSGS GTDFTLTISSLQPEDFATYSCQQANSFPWTFGQG TKVEIR<br><br>SEQ ID NO: 26652 | EVQLLESGGGLVQPGGSLRLSCAASGFTFSTYAMS WVRQAPGKGLEWVSAISRSGGNTHYADSVKGRFTI SRDNSKNTLYLQMNSLRAEDTAVYSCAKDGFGGS SYPDYWGQGTLVTVSS<br><br>SEQ ID NO: 30658 |
| iPS:435877 | 21-225_184E7 | NA | GACATCCAGATGACCCAGTCTCCATCCTCACG GTCTGCATCTATAGGAGAGAGTCACCATCA CTTGTCGGGCGAGTCAGGGCATTAGCAATTAT TTAGCCTGGATTCAGCAGAAACCAGGGACAGC CCCTAAGTCCCTTATTTATGTCATCCAGTTT GCAAAGTGGGGTTTCATCAAGGTTTAGCGGCA GTGGATTTGGGACAGATTTCACTATCACCATC AGTAGTGTGCAGCGTGAAGATTTTGCAACTTA TTACTGCCAACAGTATATAATGTTACCCATTCA CTTTCGGCCATGGGACCAAAGTGGATATCAAA<br><br>SEQ ID NO: 26653 | CAGGTGCAGCTGGTGCAGTCTGGGCTGAAGTG AAGACGCCTGGGCCTCAGTGAAGGTCTCCTGCA GGGCTTCTGGATACACCTTCACCAGTACAATAT GCACTGGGTGCGACAGGTCCCTGGACAAGGGCT TGAGTGGATGGGATGGATCAACCCTAACAATGGT GGCTCAAACTATACACAGAAGTTTCAGGGCAGG GTCACCATGACCAGGGACACGTCCATCAGCACA GCCTACATGGAGCTGAGCAGGCTGAGATCTGAC GACACGGCCGTGTATTACTGTGCGAGAAAGTTTG GGGACTGGGGCCAGGGAACCCTGGTCACCGTCT CCTCA<br><br>SEQ ID NO: 30659 |
| | | AA | DIQMTQSPSSRSASIGERVTITCRASQGISNYLAW IQQKPGTAPKSLIYAASSLQSGVSSRFSGSGFGTD FTITISSVQREDFATYYCQQYNGYPFTFGHGTKV DIK<br><br>SEQ ID NO: 26654 | QVQLVQSGAEVKTPGASVKVSCRASGYTFTSYNM HWVRQVPGQGLEWMGWINPNNGGSNYTQKFQGR VTMTRDTSISTAYMELSRLRSDDTAVYYCARKFGD WGQGTLVTVSS<br><br>SEQ ID NO: 30660 |

FIGURE 50
(Continued)

| | | | | |
|---|---|---|---|---|
| iPS:435879 | 21-225_184H10 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATATTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAATAGTTACCCATTC ACTTTCGGCCCTGGGACCAAAGTGGATATCAA A | CAGGTGCAGCTGGTGGAGTCTGGGGGAGGCGTG GTCCAGCCTGGGAGGTCCCTGAGACTCTCCTGTG TAGCGTCTGGATTCACCTTCAGTGACTATGGCAT GCACTGGGTCCGCCAGGCTCCAGGCAAGGGCT GGAGTGGGTGGCAGTTATTTGGTATGATGAAACT AATAAACACTATGGAGACTCCGTGAAGGGCCGA TTCACCATCTCCAGAGACAATTCCAAGGACACGC TGTATCTGCAAATGAACAGCCTGAGAGCCGAGG ACACGGCTGTGTATTACTGTGCGAGAGAGGTTGG CTGGCACGATGACTATTGGGGCCAGGGAACCCT GGTCACCGTCTCCTCA |
| | | | SEQ ID NO: 26655 | SEQ ID NO: 30661 |
| | | AA | DIQMTQSPSSLSASVGDRVTITCRASQGIRNDLG WYQQKPGKAPKRLIYIASSLQSGVPSRFSGSGSG TEFTLTISSLQPEDFATYYCLQHNSYPFTFGPGTK VDIK | QVQLVESGGGVVQPGRSLRLSCVASGFTFSDYGM HWVRQAPGKGLEWVAVIWYDETNKHYGDSVKGR FTISRDNSKDTLYLQMNSLRAEDTAVYYCAREVG WHDDYWGQGTLVTVSS |
| | | | SEQ ID NO: 26656 | SEQ ID NO: 30662 |
| iPS:435881 | 21-225_184D11 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATATTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAATAGTTACCCATTC ACTTTCGGCCCTGGGACCAAAGTGGATATCAA A | CAGGTGCAGCTGGTGGAGTCTGGGGGAGGCGTG GTCCAGCCTGGGAGGTCCCTGAGACTCTCCTGTG CAGCGTCTGATTCACCTTCAGTGACTATGGCAT GCACTGGGTCCGCCAGGCTCCAGGCAAGGGCT GGAGTGGGTGGCAGTTATTTGGTATGATGAAACT AATAAACACTATGGAGACTCCGTGAAGGGCCGA TTCACCATCTCCAGAGACAATTCCAAGGACACGC TGTATCTGCAAATGAACAGCCTGAGAGCCGAGG ACACGGCTGTGTATTACTGTGCGAGAGAGGTTGG CTGGCACGATGACTATTGGGGCCAGGGAACCCT GGTCACCGTCTCCTCA |
| | | | SEQ ID NO: 26657 | SEQ ID NO: 30663 |

FIGURE 50
(Continued)

| | | | | |
|---|---|---|---|---|
| | | AA | DIQMTQSPSSLSASVGDRVTITCRASQGIRNDLG WYQQKPGKAPKRLIYIASSLQSGVPSRFSGSGSG TEFTLTISSLQPEDFATYYCLQHNSYPFTFGPGTK VDIK<br>SEQ ID NO: 26658 | QVQLVESGGGVVQPGRSLRLSCAASGFTFSDYGM HWVRQAPGKGLEWVAVIWYDETNKHYGDSVKGR FTISRDNSKDTLYLQMNSLRAEDTAVYYCAREVG WHDDYWGQGTLVTVSS<br>SEQ ID NO: 30664 |
| iPS:435883 | 21-225_185.A1 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACACCAGGGAAAGC CCCTAAGTCCCTGATCTCTGTTGCATCCAGTTT GCAAAGTGGGGTCCCATCAAGATTCAGCGCCA GTGGATCTGGGACAGATTTCACTCTCACCATC AGCAGCCTGCAGCCTGAACATATCATAGTTACCATTCA CTTTCGCCCCTGGGACCAAAGTGGATATCAAA<br>SEQ ID NO: 26659 | GAGGTGCAGCTGGTGGTGGAGTCTGGGGGAGGCCTG GTCAAGCCTGGGGGGTCCCTGAGACTCTCCTGTG CAGCCTCTGGATTCACCTTCAATAGCTATAGCAT GAACTGGGTCCGCCAGGCTCCAGGGAAGGGCT GGAGTGGGTCTCATCCATTAGCAGTAGTGGTAGT TACATATATTACGCAGACTCAGTGAAGGGCCGAT TCACCATCTCCAGAGACAAACGCCAAGAACTCACT GTATCTGCAAATGCACAGCTGAGAGCCGAGGA CAGGGCTGTGTATACTGTGCGAGAAGCAACCTT TTTGACTGCTGGGGCCAGGGAACCCCGGTCACCG TCTCCTCA<br>SEQ ID NO: 30665 |
| | | AA | DIQMTQSPSSLSASVGDRVTITCRASQGISNYLA WFQQTPGKAPKSLISVASSLQSGVPSRFSASGSG TDFTLTISSLQPEDFATYYCRQYHSYPFTFGPGTK VDIK<br>SEQ ID NO: 26660 | EVQLVESGGGLVKPGGSLRLSCAASGFTFNSYSMN WVRQAPGKGLEWVSSISSSGSYIYYADSVKGRFTIS RDNAKNSLYLQMHSLRAEDTAVYYCARSNLFDCW GQGTPVTVSS<br>SEQ ID NO: 30666 |

FIGURE 50
(Continued)

| | | | |
|---|---|---|---|
| iPS:435885 | 21-225_185E10 | NA | GACATCCAGATGACCCAGTCTCCATCCTCACG GTCTGCATCTATAGGAGAGAGAGTCACCATCA CTTGTCGGGCGAGTCAGGCATTAGCAATATAT TTAGCCTGGATTCAGCAGAAACCAGGACAGC CCCTAAGTCCCTTATCTATGCTGCATCCAGTTT GCAAAGTGGGGTTTCATCAAGGTTTAGCGGCA GTGGATTTGGGACAGATTTCACTCTCACCATC AGTAGTCTGCAGCCTGAAGATTTTGCAACTTA TTACTGCCAACAGTATAATGGTTACCCATTCA CTTTCGGCCCTGGGACCAAAGTGGATATCAAA<br><br>SEQ ID NO: 26661 | CAGGTGCAGCTGGTGCAGTCTGGGGCTGAAGTG AAGACGCCTGGGGCCTCAGTGAAGGTCTCCTGCA GGGCTTCTGATACACCTTCACCAGCTACAATAT GCACTGGGTGCGACAGGTCCCTGGACAAGGGCT TGAGTGGATGGGATGGATCAACCTAACAATGGT GGCTCAAACTATACACAGAAGTTTCAGGGCAGG GTCACCATGACCAGGGACACGTCCATCAGCACA GCCTACATGGAGCTGAGCAGGCTGAGATCTGAC GACACGGCCGTGTATTACTGTGCGAGAAAGTTTG GGGACTGGGGCCAGGGAACCCTGGTCACCGTCT CCTCA<br><br>SEQ ID NO: 30667 |
| | | AA | DIQMTQSPSSRSASIGERVTITCRASQGISNYLAW IQQKPGTAPKSLIYAASSLQSGVSSRFSGSGFGTD FTLTISSLQPEDFATYYCQQYNGYPFTFGPGTKV DIK<br><br>SEQ ID NO: 26662 | QVQLVQSGAEVKTPGASVKVSCRASGYTFTSYNM HWVRQVPGQGLEWMGWINPNNGGSNYTQKFQGR VTMTRDTSISTAYMELSRLRSDDTAVYYCARKFGD WGQGTLVTVSS<br><br>SEQ ID NO: 30668 |
| iPS:435887 | 21-225_186F7 | NA | GATGTTGTGATGGCCCAGACTCCACTCTCTCT GTCCGTCACCCCTGGACAGCCGGCCTCCATCT CCTGCAAGTCTAGTCAGAGCCTCCTGCATGGT GATGGAAAGACCTATTTGTGTTGGTACCTCCA GAAGCCAGGCCAGCTCCACAGTCTCCTGATCT ATGAAGTTTCCAAGCGGTTCTCTGGAGTGCCA GATAGGTTCAGTGGCAGCGGGTCAGGGACAG ATTTCACACTGAAAATCAGCCGGGTGGAGGCT GAGGATGTTGGGGTCTATTACTGCATGCAAAG TATACAGGTTCCCTGACGTTCGGCCAAGGGA CCAAGGTGGAAATCAAA<br><br>SEQ ID NO: 26663 | CAGGTGCAGCTGGTGGAGTCTGGGGGAGGCGTG GTCCAGCCTGGGAGGTCCCTGAGACTCTCCTGTG CAGCGTCTGGATTCACCTTCAGTACTTACTATGGCAT GCACTGGGTCCGCCAGGCTCCAGGCAAGGGGCT GGAGTGGGTGGCAATTATATGGTATGATGGAAGT TATAAATATTATGCAGACTCCGTGAAGGGCCGAT TCACCATCTCCAGAGACAATTCCAAGAACACGCT GTATCTGCAAATGAACAGCTGAGAGCCGAGGA CACGGCTGTGTATTACTGTGCGAGAGATCATTAC GATTTTTGGAGTGGCACTTTGACTACTGGGGCC AGGGAACCCTGGTCACCGTCTCCTCA<br><br>SEQ ID NO: 30669 |

FIGURE 50
(Continued)

| | | | | |
|---|---|---|---|---|
| iPS:435889 | 21-225_186A11 | AA | DVVMAQTPLSLSVTPGQPASISCKSSQSLLHGDG KTYLCWYLQKPGQPPQLLIYEVSKRFSGVPDRFS GSGSGTDFTLKISRVEAEDVGVYYCMQSIQVPW TFGQGTKVEIK<br>SEQ ID NO: 26664 | QVQLVESGGGVVQPGRSLRLSCAASGFTFSTYGMH WVRQAPGKGLEWVAIIWYDGSYKYYADSVKGRFT ISRDNSKNTLYLQMNSLRAEDTAVYYCARDHYDF WSGHFDYWGQGTLVTVSS<br>SEQ ID NO: 30670 |
| | | NA | GACATCCAGATGACCCAGTCTCCATCTTCCGT GTCTGCATCTGTTGGAGACAGAGTCACCATCA CTTGTCGGGCGAGTCAGGATCAGGATATTACCAGCTGG TTAGCCTGGTATCAGCAGAAACCAGGGAAAG CCCCTAAACTCCTGATCTATGCTGCATCAGTT TACAAAGTGGGGTCCCATCAAGGTTCAGCGGC AGTGGATCTGGGACAGATTTCATTCTCACCAT CACCAGCGTGCAGCCTGAGTTAACAGTTTGCCAATT ACTATTGTCAACACAGTTTCCCATTC ACTTTCGGCCATGGGACCAAAGTGGATATCAA A<br>SEQ ID NO: 26665 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGTTGGGTCCGCCAGGCTCCAGGGAAGGGGCT GGAGTGGGTCTCAGTTATTAGTGGTAGAGGTGGT ACCACATTCTACGCAGACTCCGTGAAGGGCCGT TCACCATCTCCAGAGACAATTCCAAGAACACGCT GTATCTGCAAATGAACAGCCTGAGAGCCGAGGA CACGGCCGTATATTACTGTGCGAAACGGACTGGG GATGATGTTTTTGATATCTGGGGCCAAGGGACAA TGGTCACCGTCTCTTCA<br>SEQ ID NO: 30671 |
| | | AA | DIQMTQSPSSVSASVGDRVTITCRASQDITSWLA WYQQKPGKAPKLLIYAASSLQSGVPSRFSGSGS GTDFILTITSVQPDDFATYYCQQVNSFPFTFGHG TKVDIK<br>SEQ ID NO: 26666 | EVQLLESGGGLVQPGGSLRLSCAASGFTFSSYAMS WVRQAPGKGLEWVSVISRGGTTFYADSVKGRFTI SRDNSKNTLYLQMNSLRAEDTAVYYCAKRTGDDV FDIWGQGTMVTVSS<br>SEQ ID NO: 30672 |

FIGURE 50
(Continued)

| | | | |
|---|---|---|---|
| iPS:435891 | 21-225_188H5 | NA | GACATCCAGATGACCCAGTCTCCATCCTCACT GTCTGCATCTATAGGAGAGAGTCACCATCA CTTGTCGGGCGAGTCAGGCATTAGACAATTAT TTAGCCTGGCTTCAGCAGAAACCAGGGACAGC CCCTAAGTCCCTGATCTATGCTGCTTCCAGTTT GCAAAGTGGGGTCTCATCAAGGTTCAGCGGCA GTGGATTTGGGACAGATTTCACTCTCACCATC AGTAGTCTGCAGCCTGAAGATATAGTTATCAT TA TTACTGCCAACAGTATAATAGTTATCCATTCA CTTTCGGCCCTGGGACCAAAGTGGATATCAAA<br><br>SEQ ID NO: 26667 | CAGGTGCAGCTGGTGCAGTCTGGGGCTGAGGTG AAGAAGCCTGGGGCCTCAGTGAAGGTCTCCTGCA AGGCTTCTGGATACACCTTCACCAGCTACAATAT GCACTGGGTACGACAGGTCCCTGACAAGGGCT TGAGTGGATGGGATGGATCAACCTAACAGTGGT GGCTCAAACTATACACAGAAGTTTCAGGGCAGG ATCACCATGACCAGGGACACGTCCATCAGCACA GCCTACATGGAGCTGAGCAGGCTGAGATCTGAC GACACGGCCGTATATTACTGTGCGAGAAAGTTTG GGGACTGGGGCCAGGGAACCCTGGTCACCGTCT CCTCA<br><br>SEQ ID NO: 30673 |
| | | AA | DIQMTQSPSSLSASIGERVTITCRASQGISNYLAW LQQKPGTAPKSLIYAASSLQSGVSSRFSGSGFGT DFTLTISSLQPEDFATYYCQQYNSYPFTFGPGTK VDIK<br><br>SEQ ID NO: 26668 | QVQLVQSGAEVKKTPGASVKVSCRASGYTFTSYNM HWVRQVPGQGLEWMGWINPNSGGSNYTQKFQGRI TMTRDTSISTAYMELSRLRSDDTAVYYCARKFGD WGQGTLVTVSS<br><br>SEQ ID NO: 30674 |
| iPS:435895 | 21-225_188E8 | NA | GACATCCAGATGACCCAGTCTCCATCTTCCGT GTCTGCATCTGTAGGAGACAGAGTCACCATCA CTGTCGGGCGAATCAGGATATTCAGCTGG TTAGCCTGGTATCAGCAGAAACCAGGGAAAG CCCCTAAGCTCCTGATCTATGCTGCATCCAATT TGCAAAGTGGGGTCCCATCAGGTTCAGCGGC AGTGGATCTGGGACAGATTTCACTCTCACCAT CAGCAGCCTGCAGCCTGAAGATTTTGCAACTT ACTATTGTCAGCAGGCTAACAGTTTCCCGTGG ACGTTCGGCCAAGGGACCAAGGTGGAAATCA AG<br><br>SEQ ID NO: 26669 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTCTGCCAT GAACTGGGTCCGCCAGGCTCCAGGGAAGGGGCT GGAGTGGGTCTCAGTTATTAGTGGTAGTGGTGGT TACACATACTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTTCTGTGCGAAAAGGAACACC GATGATGCTTTTGATATCTGGGGCCAAGGGACAA TGGTCACCGTCTCTTCA<br><br>SEQ ID NO: 30675 |

FIGURE 50
(Continued)

| | | | | |
|---|---|---|---|---|
| iPS:435897 | | AA | DIQMTQSPSSVSASVGDRVTITCRANQDISSWLA WYQQKPGKAPKLLIYAASNLQSGVPSGFSGSGS GTDFTLTISSLQPEDFATYYCQQANSFPWTFGQG TKVEIK<br>SEQ ID NO: 26670 | EVQLLESGGGLVQPGGSLRLSCAASGFTFSSSAMN WVRQAPGKGLEWVSVISGSGYTYYADSVKGRFT ISRDNSKNTLYLQMNSLRAEDTAVYFCAKRNTDDA FDIWGQGTMVTVSS<br>SEQ ID NO: 30676 |
| | 21-225_188B9 | NA | GACATCCAGATGACCCAGTCTCCATCCTCACT GTCTGCATCTATAGGAGAGAGACACCATCA CTTGTCGGGCGAGTCAGGGCATTAGCAATTAT TTAGCCTGGCTTCAGCAGAAACCAGGGACAGC CCCTAAGTCCCTGATCTATGCTGCATCCAGTTT GCAAAGTGGGGTCTCATCAAGGTTCAGCGGCA GTGGATTTGGGACAGATTTCACTCTCACCATC AGTAGTCTGCAGCCTGAAGATATAGTTACCAA TTACTGCCAACAGTATAATAGTTACCCATTCA CTTTCGGCCCTGGGACCAAAGTGGATATCAAA<br>SEQ ID NO: 26671 | CAGGTGCAGCTGGTGCAGTCTGGGGCTGAGGTG AAGACGCCTGGGGCCTCAGTGAAGGTCTCCTGCA GGGCTTCTGGATACACCTTCACCAGCTACAATAT GCACTGGGTGCGACAGGTCCCTGGACAAGGGCT TGAGTGGATGGGATGGATCAACCCTAACAGTGGT GGCTCAAACTATACACAGAAGTTTCAGGGCAGG GTCACCATGACCAGGGACACGTCCATCAGCACA GCCTACATGGAGCTGAGCAGGCTGAGATCTGAC GACACGGCCGTGTATTACTGTGCGAGAAAGTTTG GGGACTGGGGCCAGGGAACCCTGGTCACCGTCT CCTCA<br>SEQ ID NO: 30677 |
| | | AA | DIQMTQSPSSLSASIGERVTITCRASQGISNYLAW LQQKPGTAPKSLIYAASSLQSGVSSRFSGSGFGT DFTLTISSLQPEDFATYYCQQYNSYPFTFGPGTK VDIK<br>SEQ ID NO: 26672 | QVQLVQSGAEVKTPGASVKVSCRASGYTFTSYNM HWVRQVPGQGLEWMGWINPNSGGSNYTQKFQGR VTMTRDTSISTAYMELSRLRSDDTAVYYCARKFGD WGQGTLVTVSS<br>SEQ ID NO: 30678 |

FIGURE 50
(Continued)

| | | | |
|---|---|---|---|
| iPS:435899 | 21-225_188G11 | NA | GATATTGTGATGACCCAGACTCCACTCTCTCT GTCCGTCACCCCTGGACAGCCGGCCTCCATCT CCTGCATGTCAGTCAGAGCCTCCTGCATGGT GATGGAAAGACCTATTTATATTGGTACCTGCA GAAGCCCGGCCAGCCTCCACAGCTCCTGATCT ATGAAGTTTCCAACCGGTTCTCTGGAGTGCCA GATACGTTCAGTGGCAGCGGGTCAGGACAG ATTTCACACTGAAAATCAGCCGGGTGGAGGCT GAGGATGTGGGGGTTTATTACTGCATGCAAAG TATACAGATTCCTTGGACGTTCGGCCAAGGGA CCAAGGTGGAAATCAAA<br><br>SEQ ID NO: 26673 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGGCT GGAGTGGGTGACAATTATATGTATGATGGAAGT TATAAATACTATGCAGACTCCGTGAAGGGCCGAT TCACCATCTCCAGAGACAATTCAAGAACACGCT GTTTCTGCAAATGAACAGCCTGAGAGCCGAAGA CACGGCTGTGTATTACTGTGCGAGAGAGATAC GATTTTTGGAGTGGTCATTTGACTACTGGGGCC AGGGAACCCTGGTCACCGTCTCCTCA<br><br>SEQ ID NO: 30679 |
| | | AA | DIVMTQTPLSLSVTPGQPASISCMSSQSLLHGDG KTYLYWYLQKPGQPPQLLIYEVSNRFSGVPDTFS GSGSGTDFTLKISRVEAEDVGVYYCMQSIQIPWT FGQGTKVEIK<br><br>SEQ ID NO: 26674 | QVQLVESGGGVVQPGRSLRLSCAASGFTFSSYGMH WVRQAPGKGLEWVTIIWYDGSYKYYADSVKGRFT ISRDNSKNTLFLQMNSLRAEDTAVYYCARERYDF WSGHFDYWGQGTLVTVSS<br><br>SEQ ID NO: 30680 |
| iPS:435901 | 21-225_189G2 | NA | GATATTGTGATGACCCAGACTCCACTCTCTCT GTCCGTCACCCCTGGACAGCCGGCCTCCATCT CCTGCAAGTCTAGTCAGAGCCTCCTGCATGGT GATGGAAAGACCTATTTGTTTTGGTACCTGCA GAAGCCAGGCCAGCCTCCACAACTCCTGATCT ATGAAGTTTCCAACCGGTTCTCTGGAGTGTCA GATAGGTTCAGTGGCAGCGGGTCAGGAACAG ATTTTCACACTGAAAATCAGCCGGGTGGAGGCT GAGGATGTTGGGGTTTACTACTGCATGCAAAG TATCTGCAAATGAACAGCCTGAGAGCCGAGGA CACGGCTGTGTATTATTGTGCGAGAGATCGATTC GATTTTTGGAGTGGTTATTCCGACTACTGGGGCC AGGGAACCCTGGTCACCGTCTCCTCA<br><br>SEQ ID NO: 30681 |
| | | | TATAAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTATTGTGCGAGAGATCGATTC GATTTTTGGAGTGGTTATTCCGACTACTGGGGCC AGGGAACCCTGGTCACCGTCTCCTCA |
| | | | GAGGATGTTGGGGTTTACTACTGCATGCAAAG TATCTGCAAATGAACAGCCTGAGAGCCGAGGA CACGGCTGTGTATTATTGTGCGAGAGATCGATTC GATTTTTGGAGTGGTTATTCCGACTACTGGGGCC AGGGAACCCTGGTCACCGTCTCCTCA<br><br>SEQ ID NO: 26675 |

FIGURE 50
(Continued)

| | | | |
|---|---|---|---|
| iPS-435903 | 21-225_190E2 | AA | DIVMTQTPLSLSVTPGQPASISCKSSQSLLHGDG KTYLFWYLQKPGQPPQLLIYEVSNRFSGVSDRFS GSGSGTDFTLKISRVEAEDVGVYYCMQSIQIPWT FGQGTKVEIK<br>SEQ ID NO: 26676 | QVQLVESGGGVVQPGRSLRLSCAASGFTFSNYGM HWVRQAPGKGLEWVAIIWYDGSYKYYADSVKGR FTISRDNSKNTLYLQMNSLRAEDTAVYYCARDRFD FWSGYSDYWGQGTLVTVSS<br>SEQ ID NO: 30682 |
| | | NA | GACATCGTGATGACCCAGTCTCCAGACTCCCT GGCTGTCTCTGGGCGAGAGGGCCACCATCA ACTGCAAGTCCAGCCAGAGTGTTTATTCAAC TCCAACAATAAGAACTACTTAGCTTGGTACCA GCAGAAACCAGGTCAGCCTCCTAACCTGCTCA TTTACTGGGCATCTACCCGGGAATCCGGGGTC CCTGACCGATTCAGTGGCAGCGGGTCTGGGAC AGATTTCACTCTCACCATCAGCAGCATGCAGG CTGAAGATGTGGCAGTTTATTACTGTCAGCAA TATTGTAGTCTTCCATTCACTTTCGGCCCTGGG ACCAAAGTGGATATCAGA<br>SEQ ID NO: 26677 | CAGGTGCAACTGGTGGAGTCTGGGGGAGGCTTG GTCAAGCCTGGAGGGTCCCTGAGACTCTCCTGTG CAGCCTCTGGATTCACCTTCAGTGACTTCTACAT GAGCTGGATCCGCCAGGCTCCAGGGAAGGGGCT GGAGTGGCTTTCATACATTAGTAGTGGTGGTACT ACCGTATTCTACGCAGACTCTGTGAAGGGCCGA TCACCATCTCCAGGGACAACGCCAAGAACTCACT GTATCTGCAAATGAACAGCCTGAGAGCCGAGGA CACGGCCGTGTATTACTGTGCGAGAGAATGGGTG GGAGCCGACTACTGGGGCCAGGGAACCCTGGTC ACCGTCTCCTCA<br>SEQ ID NO: 30683 |
| | | AA | DIVMTQSPDSLAVSLGERATINCKSSQSVLFNSN NKNYLAWYQQKPGQPPNLLIYWASTRESGVPD RFSGSGSGTDFTLTISSMQAEDVAVYYCQQYCS LPFTFGPGTKVDIR<br>SEQ ID NO: 26678 | QVQLVESGGGLVKPGGSLRLSCAASGFTFSDYYMS WIRQAPGKGLEWLSYISSSGTTVFYADSVKGRFTIS RDNAKNSLYLQMNSLRAEDTAVYYCAREWVGAD YWGQGTLVTVSS<br>SEQ ID NO: 30684 |

FIGURE 50
(Continued)

| | | | |
|---|---|---|---|
| iPS:435905 | 21-225_190A3 | NA | GAAATTATGTTGACGCAGTCTCCAGGCACCCT GTCTTTGTCTCAGGGGAAAGAGCCACCCTCT CCTGCAGGGCCAGTCAGAATATAAGGAGCAA CTTCTTAGCCTGGTACCAGCAGAAACCTGGCC AGGCTCCCAGGCTCCTCATCTATGGTGCATCA AGCAGGGCCACTGGCATCCCAGACAGATTCAG TGGCAGTGTGTCTGGGACAGACTTCACTCTCA CCATCAACAGACTGGAGCCTGAAGATTTTGCG GTGTATTACTGTCAGCAGTATGGTAACTCACC GTGGACGTTCGGCCAAGGGACCAAGGTGGAA ATCAAA<br><br>SEQ ID NO: 26679 | CAGGTGCAGCTGCAGGAGTCGGGCCCAGGACTG GTGAAGCCTTCACAGACCCTGTCCCTCACCTGCA CTGTCTCTGGTGTCTCCATCAACAGTGGTGTTA CTACTGAACTGGATCCGCCAGCACCCAGGGAA GGGCCTGGAGTGGATTGGGTTCATCTTTTATAGT GGGAGCACCTACTACAACCCGTCCTCAAGAGTC GAGTTACCATATCAGTAGACACGTCTAAGAACCA GTTCTCCCTGAAGCTGAACTCTGTGACTGCCGCG GACACGGCCGTGTATTACTGTGCGAGAGGGATT ACGACGGTTCGGGGAGTTATCACTACTATTACGG TATGGACGTCTGGGGCCAAGGGACCACGGTCAC CGTCTCCTCA<br><br>SEQ ID NO: 30685 |
| | | AA | EIMLTQSPGTLSLSPGERATLSCRASQNIRSNFLA WYQQKPGQAPRLLIYGASSRATGIPDRFSGSVSG TDFTLTINRLEPEDFAVYYCQQYGNSPWTFGQG TKVEIK<br><br>SEQ ID NO: 26680 | QVQLQESGPGLVKPSQTLSLTCTVSGGSINSGVT WNWIRQHPGKGLEWIGFIFYSGSTYYNPSLKSRVTI SVDTSKNQFSLKLNSVTAADTAVYYCARGDYDGS GSYHYYGMDVWGQGTTVTVSS<br><br>SEQ ID NO: 30686 |
| iPS:435907 | 21-225_190G3 | NA | GACATCCAGATGACCCAGTCTCCATCCTCCCT GTCTGCATCTGTAAGAGACAGAGTCACCATCA CTTGCCGGGCAAGTCAGGGCATTAGAAAAGAT TTAGGCTGGTATCAGCAGAAACCAGGGAAAG CCCCTAAGCGCCTGATCCATACTGCATCCAGT TTGCAAAGTGGGGTCCCATTAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGTG GACGTTCGGCCAAGGGACCAAGGTGGAAATC AAA<br><br>SEQ ID NO: 26681 | CAGGTGCAGCTGGTGGAGTCTGGGGGAGGCGTG GTCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATCGATGATGGAAGT TATAAAACTATGTAGACTCCGTGAAGGGCCGAT TCACCATCTCCAGAGACAATTCCAAGAACACGCT GTATCTGCAAATGAATAGCCTGAGAGCTGAAGA CACGGCTGTATACTACGGTGTGCGAGAGGTACCCAC GGGTACTACTACGGTGTGACGTCTGGGGCCAA GGGACCACGGTCACCGTCTCCTCA<br><br>SEQ ID NO: 30687 |

FIGURE 50
(Continued)

| | | | |
|---|---|---|---|
| | | AA | DIQMTQSPSSLSASVRDRVTITCRASQGIRKDLG WYQQKPGKAPKRLIHTASSLQSGVPLRFSGSGS GTEFTLTISSLQPEDFATYYCLQHNSYPWTFGQG TKVEIK<br><br>SEQ ID NO: 26682 | QVQLVESGGGVVQPGRSLRLSCAASGFTFSSYGMH WVRQAPGKGLEWVAVISYDGGYKNYVDSVKGRF TISRDNSKNTLYLQMNSLRAEDTAVYYCARGTHG YYYGVDVWGQGTTVTVSS<br><br>SEQ ID NO: 30688 |
| iPS:435909 | 21-225_190H3 | NA | GACATCCAGATGACCCAGTCTCCATCTTCCGT GTCTGCATCTGTAGGAGACAGAGTCACCATCA CTTGTCGGGCGAGTCAGGGTCTTAACAACTGG TTAGCCTGGTATCAGCTGAAACCAGGAAAGC CCCTAAGCTCCTGATCTATGCTGTGTCCAGTTT GCAAAGTGGGGTCCCATCAAGGTTCAGCGGCA GTGGATCTGGGTCAGAGTTCACTCTCACCATC AGCAGCCTGCAGCCTGAAGATTTTGCAACTTA CCATTGTCAACAGGCTAACAGTCTCCCGTGGA CGTTCGGCCAAGGGACCAAGGTGGAAATCAA A<br><br>SEQ ID NO: 26683 | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTCGTGGTGGT AACACATACTACGCAGACTCCGTGAAGGGCCGG TTCACCATCTCCAGAGACAATTCCAAGAACACGC TGTATCTGCAAATGAACAGTTTGAGAGCCGAGGA CACGGCCGTATATTACTGTGCGAAAGATGGATTC GGTGGGAGCTCCTATTTTGACTACTGGGGCCAGG GAACCCTGGTCACCGTCTCCTCA<br><br>SEQ ID NO: 30689 |
| | | AA | DIQMTQSPSSVSASVGDRVTITCRASQGLNNWL AWYQLKPGKAPKLLIYAVSSLQSGVPSRFSGSGS GSEFTLTISSLQPEDFATYHCQQANSLPWTFGQG TKVEIK<br><br>SEQ ID NO: 26684 | EVQLLESGGGLVQPGGSLRLSCAASGFTFSSYAMS WVRQAPGKGLEWVSAISGRGGNTYYADSVKGRFT ISRDNSKNTLYLQMNSLRAEDTAVYYCAKDFGGSS SYFDYWGQGTLVTVSS<br><br>SEQ ID NO: 30690 |

FIGURE 50
(Continued)

| | | | | |
|---|---|---|---|---|
| iPS:435911 | 21-225_190B4 | NA | GAAATTGTGTTGACGCAGTCTCCAGGCACCCT GTCTTTGTCTCCAGGGGAAAGAGCCACCCTCT CCTGCAGGGCCAGTCAGTATTCGCAGAGC TTCTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAACTCACG TGGGCGTTCGGCCAAGGGACCAAGGTGGAAA TCAAA<br>SEQ ID NO: 26685 | CAGGTGCAGCTGCAGGAGTCGGGCCCAGGACTG GTGAAGCCTTCACAGACCCTGTCCTCACCTGCA CTGTCTCTGGTGGCTCCATCAGCAGTGGTGATTA CTACTGGAACTGGATCCGCCAGCACCCAGGGAA GGGCCTGGAGTGGATTGGGTACATCTTTACAGT GGGAGCACCTACTACAACCGTCCCTCAAGAGTC GAGTTACCATATCAGTAGACACGTCTAAGAACCA GTTCTCCCTGAAGCTGAGCTCTGTGACTGCCGCG GACACGGCCGTATATTACTGTGCGAGAGGGGATT ACGATGGTTCGGGGAGTTATCACTACTACTACGG TATGGACGTCTGGGGCCAAGGGACCACGGTCAC CGTCTCCTCA<br>SEQ ID NO: 30691 |
| | 21-225_190B4 | AA | EIVLTQSPGTLSLSPGERATLSCRASQSIRSSFLA WYQQKPGQAPRLLIYGASSRATGIPDRFSGSGSG TDFTLTISRLEPEDFAVYYCQQYGNSPWAFGQG TKVEIK<br>SEQ ID NO: 26686 | QVQLQESGPGLVKPSQTLSLTCTVSGGSISSGDYYW NWIRQHPGKGLEWIGYIFYSGSTYYNPSLKSRVTIS VDTSKNQFSLKLSSVTAADTAVYYCARGDYDGSG SYHYYYGMDVWGQGTTVTVSS<br>SEQ ID NO: 30692 |
| iPS:435913 | 21-225_190A7 | NA | GAAATTGTGTTGACGCAGTCTCCAGGCACCCT GTCTTTGTCTCCAGGGGAAAGAGCCACCCTCT CCTGCAGGGCCAGTCACCAGCAGTGTTAGAAGCAAC TTCTTAGCCTGGTACCAGCAGAAACCTGGCCA GGCTCCCAGGCTCCTCATCTATGGTGCATACC GCAGGGCCACTGGCATCCCAGACAGGTTCAGT GGCAGTGGGTCTGGGACAGACTTCACTCTCAC CATCAACAGACTGGAGCCTGAAGATTTTGCAG TGTATTACTGTCAGCAGTATGGTAACTCACCG TGGACGTTCGGCCAAGGGACCAAGGTGGAAA TCAAA<br>SEQ ID NO: 26687 | CAGGTGCAGCTGCAGGAGTCGGGCCCAGGACTG GTGAAACCCTTCTGGTGGCTCCACAGACCCTGTCCTCACCTGCA CTGTCTCTGGTGGCTCCATCAGCAGTGGTGTTTA CTACTGGAGCTGGATCCGCCAGCACCCAGGGAA GGGCCTGGAGTGGATTGGGAACATCTATTACAGT GGGAGCACCTACAACAACCGTCCCTCAAGAGT CGAATTATCATATCAGTAGACACGTCTAAGAACC AGTTCTCCCTGAAGCTGAGCTCTGTGACTGCCGC GGACACGGCCGTGTATTACTGTGCGAGAGGGGA TTACGATGGTTCGGGGAGTTATCACTACTACTAC GGTTTGGACGTCTGGGGCCAAGGGACCACGGTC ACCGTCTCCTCA<br>SEQ ID NO: 30693 |

FIGURE 50
(Continued)

| | | | | |
|---|---|---|---|---|
| | | AA | EIVLTQSPGTLSLSPGERATLSCRASQSVRSNFLA WHQQKPGQAPRLLIYGAYRRATGIPDRFSGSGS GTDFTLTINRLEPEDFAVYYCQQYGNSPWTFGQ GTKVEIK<br>SEQ ID NO: 26688 | QVQLQESGPGLVNPSQTLSLTCTVSGGSISSGVYYW SWIRQHPGKGLEWIGNIYYSGSTYNNPSLKSRIIISV DTSKNQFSLKLSSVTAADTAVYYCARGDYDGSGS YHYYYGLDVWGQGTTVTVSS<br>SEQ ID NO: 30694 |
| iPS:435915 | 21-225_190H4 | NA | GCCAACGTGATGACCCAGTCTCCAGACTCCCT GGCTGTGTCTCTGGGCGAGAGGACCACCATCA ACTGCAAGTCCAGCCAGAGTGTTTTACACAGC TCCAACAATTACAACTACTTAGCTTGGTACCG GCAGAAACCAGGACAGCCTCCTAAGCTGCTCA TTTACTGGGCATCTACCCGGAATCCGGGGTC CCTGACCGATTCAGTGGCAGCGGGTCTGGTAC AGATTTCACTCTCACCATCAGCAGCCTGCAGG CTGAAGATGTGGCAGTTTATTACTGTCAGCAA TATTATAAGTAGTACTCCTCCCACTTTCGGCCCTGGG ACCAAAGTGGATATCAAA<br>SEQ ID NO: 26689 | CAGGTGCAGCTGGTGCAGTCTGGGGCTGAGGTG AAGAAGCCTGGGGCCTCAGTGAAGGTCTCCTGC AAGGCTTCTGGAAACACCTTCACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTACTATTGTGCCCATAGCAG TGGCTGGTACATCTTTGACTACTGGGGCCAGGA ACCCTGGTCACCGTCTCCTCA<br>SEQ ID NO: 30695 |
| | | AA | ANVMTQSPDSLAVSLGERTTINCKSSQSVLHSSN NYNYLAWYRQKPGQPPKLLIYWASTRESGVPD RFSGSGSGTDFTLTISSLQAEDVAVYYCQQYYSI PPTFGPGTKVDIK<br>SEQ ID NO: 26690 | QVQLVQSGAEVKKPGASVKVSCKASGNTFTNYDIN WVRQATGQGLEWMGWMNPNSGNTGYAQKFQGR VTMTRNTSISTAYMELSSLRSEDTAVYYCAHSSGW YIFDYWGQGTLVTVSS<br>SEQ ID NO: 30696 |

FIGURE 50
(Continued)

| | | | |
|---|---|---|---|
| iPS:435917 | 21-225_190D5 | NA | GAAATTGTGCTGACTCAGTCTCCAGACTTTCA GTCTGTGGCTCCAAAGGAGAAAGTCACCATCA CCTGCCGGGCCAGTCAGAGTATTGGTAGTAAC CTTACACTGGTACCAGCAGAAACCTGATCAGTC TCCAAAGCTCCTCATCAAGTCTGCTTCCCAGTC TCCTCAGGGGTCCCCTGAGGTTCAGTGGCA GTGGATCTGGGACAGATTTCACCCTCACCATC AATAGCCTGGAAACTGAAGATGCTGCAACGTA TTACTGTCAGCAGAGTAGTAGTTTACCGTGGA CGTTCGGCCAAGGGACCAAGGTGGAAATCAA A <br><br>SEQ ID NO: 26691 | CAGGTGCAGCTGCAGGAGTCGGGCCCAGGACTG GTGAAGCCTTCGGAGACCCTGTCCCTCACTGCA CTGTCTCTGGTGCTCCATCAATAATTACTACTG GAGCTGGATCCGGCAGCCCGGGAAGGGACT GGAGTGGATTGGGCGTATCTATGCCAGTGGGAGC ACCAACTACAACCCCTCCCTCAAGAGTCGAGTCA CCATGTCAATAGACACGTCCAAGAACCAGTTCTC CCTGAAGCTGAGCTCTGTGACCGCCGCGGACACG GCCGTGTATTACTGTGCGAGAGATCGGGATACT ATGGCTACTACGGTATGGACGTCTGGGGCCAAG GGACCACGGTCACCATCCTCA <br><br>SEQ ID NO: 30697 |
| | | AA | EIVLTQSPDFQSVAPKEKVTITCRASQSIGSNLHW YQQKPDQSPKLLIKSASQSFSGVPSRFSGSGSGT DFTLTINSLETEDAATYYCQQSSSLPWTFGQGTK VEIK <br><br>SEQ ID NO: 26692 | QVQLQESGPGLVKPSETLSLTCTVSGGSINNYYWS WIRQPAGKGLEWIGRIYASGSTNYNPSLKSRVTMSI DTSKNQFSLKLSSVTAADTAVYYCARDRGYYGYY GMDVWGQGTTVTISS <br><br>SEQ ID NO: 30698 |
| iPS:435919 | 21-225_190H5 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATTAAGGTTCAGCGG CAGTGGATCTGGGACAGAATTCACTCTCACAA TCAGCAGCCTGCAGCCTGAAGATTTTGCAACT TATTACTGTCTACAGCATAATAATTACCCGTG GACGTTCGGCCAAGGGACCAAGGTGGAAATC AAA <br><br>SEQ ID NO: 26693 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTAGTATGGCAT GCACTGGGTCCGCCAGGCTCCAGGCAAGGGGCT GGAGTGGGTGGCAGTTATATCAGACTCCGTGAAGGGCCGA TATAAAAACTATGCAGAGACTCCGTGAAGGGCCGA TTCACCATCTCCAGAGACAATTCCAAGAACACGC TGTATCTGCAAATGAATAGCCTGAGAGCTGAGGA CACGGCTGTGTATTACTGTGCGAGAGGTACCCAC GGGTACTACTACGGTGTGGACGTCTGGGGCCAA GGGACCACGGTCACCGTCCTCA <br><br>SEQ ID NO: 30699 |

FIGURE 50
(Continued)

| | | | | |
|---|---|---|---|---|
| | | AA | DIQMTQSPSSLSASVGDRVTITCRASQGIRKDLG WYQQKPGKAPKRLIHTASSLQSGVPLRFSGSGS GTEFTLTISSLQPEDFATYYCLQHNNYPWTFGQG TKVEIK<br><br>SEQ ID NO: 26694 | QVQLVESGGGVVQPGRSLRLSCAASGFTFSSYGMH WVRQAPGKGLEWVAVISYDGGYKNYADSVKGRF TISRDNSKNTLYLQMNSLRAEDTAVYYCARGTHG YYYGVDVWGQGTTVTVSS<br><br>SEQ ID NO: 30700 |
| iPS:435921 | 21-225_190D6 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCTGAAACCAGGGAAAGC CCCTAAGCGCCTGATTTATGCTGCATCCAGTTT GCAAAGTGGGGTCCCATCAAGGTTCAGCGGCA GTGGATCTGGGCCAGCCTGAAGATTTCACTCTCACAATC AGCAGCCTGCAGCCTGAAGATTTTGCAACTTA TTACTGTCTACAGCATTATAGTTTCCCATTCAC TTTCGGCCCTGGGACCAAAGTGGATATCAAA<br><br>SEQ ID NO: 26695 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTTTATCAT GCACTGGGTCCGCCAGGCTCCAGGCAGGGGCT GGAGTGGGTGGCAGTTATATGTATGATGGAAGT AATAAATACTATGCAGACTCCGTGAAGGGCCGA TTCACCATCTCCAGAGACAATTCCAAGAACACGC TGTATCTGCAAATGAACAGCTGAGAGCCGAGG ACACGGCTGTGTATTACTGTGCGAGAGAGGAGTA TAGCAGTGGCTGGTTCGGGTACGGTATGGACGTC TGGGGCCAAGGGACCACGGTCACCGTCTCCTCA<br><br>SEQ ID NO: 30701 |
| | | AA | DIQMTQSPSSLSASVGDRVTITCRASQGIRNDLG WYQLKPGKAPKRLIYAASSLQSGVPSRFSGSGSG PEFTLTISSLQPEDFATYYCLQHYSFPFTFGPGTK VDIK<br><br>SEQ ID NO: 26696 | QVQLVESGGGVVQPGRSLRLSCAASGFTFSSFIMH WVRQAPGRGLEWVAVIWYDGSNKYYADSVKGRF TISRDNSKNTLYLQMNSLRAEDTAVYYCAREEYSS GWFGYGMDVWGQGTTVTVSS<br><br>SEQ ID NO: 30702 |

FIGURE 50
(Continued)

| | | | |
|---|---|---|---|
| iPS:435923 | 21-225_190H6 | NA | GACATCGTGATGACCCAGTCTCCAGACTCCCT GGCTGTGTCTCTGGGCGAGAGGGCCACCATCA ACTGCAAGTCCAGCCAGAGTGTTTTATTCAAC TCCAACAATAAGAACTACTTAGCTGGTACCA GCAGAAACCAGGTCAGCCTCCTAACCTGCTCA TTTACTGGGCATCTACCCGGGAATCCGGGTC CCTGACCGATTCAGTGGCAGCGGGTGTGGAC AGATTTCACTCTCACCATCAGCAGCCTGCAGG CTGAAGATGTGGCAGTTTATTACTGTCAGCAA TATTGTAGTCTTCCATTCACTTTCGGCCCTGGG ACCAAAGTGGATATCAGA<br><br>SEQ ID NO: 26697 | CAGGTGCAACTGGTGGAGTCTGGGGGAGGCTTG GTCAAGCCTGGAGGGTCCCTGAGACTCTCCTGTG CAGCCTCTGGATTCACCTTCAGTGACTACTACAT GAGCTGGATCCGCCAGGCTCCAGGGAAGGGCT GGAGTGGCTTTCATACATTAGTAGTAGTGGTACT ACCGTATTCTACGCAGACTCTGTGAAGGGCCGAT TCACCATCTCCAGGGACAACGCCAAGAACTCACT GTATCTGCAAATGAACAGCCTGAGAGCCGAGGA CACGGCCGTGTATTACTGTGCGAGAGAATGGGTG GGAGCCGACTACTGGGGCCAGGGAACCCTGGTC ACCGTCTCCTCA<br><br>SEQ ID NO: 30703 |
| | | AA | DIVMTQSPDSLAVSLGERATINCKSSQSVLFNSN NKNYLAWYQQKPGQPPNLLIYWASTRESGVPD RFSGSGCGTDFTLTISSLQAEDVAVYYCQQYCSL PFTFGPGTKVDIR<br><br>SEQ ID NO: 26698 | QVQLVESGGGLVKPGGSLRLSCAASGFTFSDYYMS WIRQAPGKGLEWLSYISSSGTTVFYADSVKGRFTIS RDNAKNSLYLQMNSLRAEDTAVYYCAREWVGAD YWGQGTLVTVSS<br><br>SEQ ID NO: 30704 |
| iPS:435925 | 21-225_190D7 | NA | GACATCGTGATGACCCAGTCTCCAGACTCCCT GGCTGTGTCTCTGGGCGAGAGGGCCACCATCA ACTGCAAGTCCAGCCAGAGTGTTTTATTCAGC TCCAACAATTACAACTATTTAGTTGGTATCA GCAGAAACCAGGACAGCCTCCTAAGCTGCTCA TTTACTGGGCATCTACCCGGGAAATCCGGGTC CCTGACCGATTCAGTGGCAGCGGGTCTGGGAC AGATTTTACTCTCACCATCAGCAGCCTGCAGG CTGATGACGTGGCAGTTTATTACTGTCAAGCA TATTATCGTACTCCGTGGACGTTCGGCCAAGG GACCAAGGTGGAGATCAAA<br><br>SEQ ID NO: 26699 | CAGGTGCAGCTGGTGCAGTCTGGGGCTGAGGTG AAGAAGCCTGGGGCCTCAGTGAAGGTCTCCTGC AAGGCTCTGGATACACCTTCACCAATTATGATA TCAACTGGGTGCGACAGGCCACTGGACAAGGGC TTGAGTGGATGGGATGGATGAACAGAAGTTCCAGGCAG TAATACAGGCTATGCACAGAAGTTCCAGGCAG AGTCACCATGACCAGGAATACCTCCATAAGCAC AGCCTACATGGAGCTGAGCAGCCTGAGATCTGA GGACACGGCCGTGTATTACTGTGCGAGTAGCAGT GGCTGGTACTTCTTTGACTACTGGGGCCAGGGAA CCCTGGTCACCGTCTCCTCA<br><br>SEQ ID NO: 30705 |

FIGURE 50
(Continued)

| | | | |
|---|---|---|---|
| | | AA | DIVMTQSPDSLAVSLGERATINCKSSQSVLSSSNNYNYLVWYQQKPGQPPKLLIYWASTRKSGVPDRFSGSGSGTDFTLTISSLQADDVAVYYCQQYYRTPWTFGQGTKVEIK<br>SEQ ID NO: 26700 | QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCASSSGWYPFFDYWGQGTLVTVSS<br>SEQ ID NO: 30706 |
| iPS:435927 | 21-225_190E7 | NA | GATATTGTTGTTGACCCAGTCTCCACTCTCTGTCCGTCACCCCTGGACAGCCGGCCTCCATCTCCTGCAAGTCTAGTCAGAGCCTCCTCCATAGTGATGGAAGGACCTATTTGTATTGGTACCTGCAGAAACCAGGCCAGCTCCACAGGTCCTGATCTGTGAGGTTTCCAACCGGTTCTCTGGAGTGCCAGATAGGTTCAGTGGCAGCGGGTCAGGGACAGATTTCACACTGAAAATCAGCGGGTGGAGGCTGGAGATGTGGGGTTTATTACTGCATGCAAAGTATACAGCTTCCCTGGACGTTCGGCCAAGGGACCAAGGTGGAAATCAAA<br>SEQ ID NO: 26701 | CAGGTGCAGCTGCAGGAGTCGGGCCCAGGACTGGTGAAGCCTTCGGAGACCCTGTCCCTCACCTGCACTGTCTCTGGTGGCTCCATCAGAAGTTACCACTGGAGTTGGATCCGGCAGCCCGCCGGGAAGGACTGGAGTGGATTGGGCATATCTATACCAGTAGGAGCACCAACTACAACCCCTCCCTCAAGAGTCGAGTCACCATTTCAGTAGACACGTCCAAGAACCAGTTCTCCCTGAAGCTGAGCTCTGTGACCGCCACGGACACGGCCGTGTATTACTGTGCGAGACTCCGTATAACTGAACTTCCCTTACTTTGACTACTGGGGCCAGGGAACCCTGGTCACCGTCTCCTCA<br>SEQ ID NO: 30707 |
| | | AA | DIVLTQTPLSLSVTPGQPASISCKSSQSLLHSDGRTYLYWYLQKPGQPPQVLICEVSNRFSGVPDRFSGSGSGTDFTLKISRVEAGDVGVYYCMQSIQLPWTFGQGTKVEIK<br>SEQ ID NO: 26702 | QLQLQESGPGLVKPSETLSLTCTVSGGSIRSYHWSWIRQPAGKGLEWIGHIYTSRSTNYNPSLKSRVTISVDTSKNQFSLKLSSVTATDTAVYYCARLRYNWNPYFDYWGQGTLVTVSS<br>SEQ ID NO: 30708 |

FIGURE 50
(Continued)

| | | | | |
|---|---|---|---|---|
| iPS:435929 | 21-225_190D9 | NA | GAAATTGTGCTGACTCAGTTTCCAGACTCTCA GTCTGTGACTCCAAAGGAGAAAGTCACCATCA CCTGCCGGGCCAGTCAGAGCATTGGTAGTAGC TTACACTGGTACCAGCAGAAACCAGATCAGTC TCCAAAGCTCCTCATCAAGTATGCTTCCCAGT CCTTCTCAGGGGTCCCCTCGAGGTTCAGTGGC AGTGGATCTGGGACAGATTCACCCTCACCAT CAATAGCCTGAAGCTGAAGATGCTGAAGATGCTGCAACCAT ATTACTGTCATCAGAGTAGTTTCCCTCGG ACGTTCGGCCAAGGGACCAAGGTGGAAATCA AA | GAGGTGCAGCTGTTGGAGTCTGGGGGAGGCTTGG GACAGCCTGGGGGGTCCCTGAGACTCTCCTGTGC AGCCTCTGGATTCACCTTTGACAGCTATGCCATG AGTTGGGTCCGCCAGGCTCCAGGGAAGGGGCTG GAGTGGGTCTCAACTATTAGTGGTACTGGTCGTA GGACATACTACGCAGACTCCGTGAAGGGCCGGT TCACCATCTCCAGAGACACAATTCCAAGAACACGCT GTATCTGCAAATGAATAGCCTGAGAGCCGAGGA CACGGCCGTATATTACTGTGCGAAGAGAGGA TTACTATGATAGTAGTGGCCGGGGTTCGACCCC TGGGGCCAGGGAACCCTGGTCACCGTCTCCTCA |
| | | | SEQ ID NO: 26703 | SEQ ID NO: 30709 |
| | | AA | EIVLTQFPDSQSVTPKEKVTITCRASQSIGSSLHW YQQKPDQSPKLLIKYASQSFSGVPSRFSGSGSGT DFTLTINSLEAEDAATYYCHQSSSFPRTFGQGTK VEIK | EVQLLDSGGGLGQPGGSLRLSCAASGFTFDSYAMS WVRQAPGKGLEWVSTISGTGRRTYYADSVKGRFTI SRDNSKNTLYLQMNSLRAEDTAVYYCAKEEDYYD SSGPGFDPWGQGTLVTVSS |
| | | | SEQ ID NO: 26704 | SEQ ID NO: 30710 |
| iPS:435933 | 21-225_190F8 | NA | GACATCCAGATGACCCAGTCTCCTTCCTCACT GTCTGCATCTGTAGGAGACAGAGTCACCATCA CTTGTCGGACGAGTCAGGGCATTGGCAATTAT TTAGCCTGGTTTCAGCAGAAACCAGGGAAAGC CCCTAAGTCCCTGATCTATAAAGCATCCAGTTT ACAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAACAGTATGACTTACCCACTCA CTTTCGGCGGAGGGACCAAGGTGGAGATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTACTTATGGCAT GCACTGGGTCCGCCAGGCTCCAGGCAAGGGGCT GGAGTGGGTGGCAGTTATATGTGATGGAAGT AATAAAAACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCAGGG CGTGGGCTACGACGTTTGGACGCTGTGGGCCAA GGGACCACGGTCACCGTCTCCTCA |
| | | | SEQ ID NO: 26705 | SEQ ID NO: 30711 |

FIGURE 50
(Continued)

| | | | | |
|---|---|---|---|---|
| iPS:435935 | 21-225_190H8 | AA | DIQMTQSPSSLSASVGDRVTITCRTSQGIGNYLA WFQQKPGKAPKSLLYKASSLQSGVPSKFSGSGS GTDFTLTISSLQPEDFATYYCQQYMTYPLTFGGG TKVEIK<br>SEQ ID NO: 26706 | QVQLVESGGGVVQPGRSLRLSCAASGFTFSTYGMH WVRQAPGKGLEWVAVIWYDGSNKNYADSVKGRF TISRDNSKNTLYLQMNSLRAEDTAVYYCARDQGV GYDGLDVWGQGTTVTVSS<br>SEQ ID NO: 30712 |
| | | NA | GAAATTGTGCTGACTCAGTTTCCAGACTCTCA GTCTGTGACTCCAAAGGAGAAAGTCACCATCA CCTGCCGGGCCAGTCAGAGTCATTGGTAGTAGC TTACACTGGTACCAGCAGAAACCAGATCAGTC TCCAAAGCTCCTCATCAAGTATGCTTCCCAGT CCCTTCTCAGGGGTCCCCTGAGGTTCAGTGGC AGTGGATCTGGGACAGATTTCACCCTCACCAT CAATAGCCTGGAAGCTGAAGATGCTGCAACGT ATTACTGTCATCAGAGATAGTAGTTTCCCTCGG ACGTTCGGCCAAGGGACCAAGGTGGAAATCA AA<br>SEQ ID NO: 26707 | GGGGTACAACTGTTGGAGACTCTGGGGGAGGCTTGG GACAGCCTGGGGGGTCCCTGAGACTCTCCTGTGC AGCCTCTGGATTCACCTTTGACAGCTATGCCATG AGCTGGGTCCGCCAGGCTCCAGGGAAGGGGCTG GAGTGGGTCTCAACTATTAGTGGTACTGGTGTA GGACATATTACGCAGACTCCGTGAAGGGCCGGTT CACCATCTCCAGAGACAATTCCAAGAACACACTG TATCTGCAGATGAATAGCCTGAGAGCCGAGGAC ACGGCCGTATATTACTGTGCGAAAGAGGAGATT ACTATGATAGTAGTGGCCCGGGGTTCGACCCTG GGGCCAGGGAACCCTGGTCACCGTCTCCTCA<br>SEQ ID NO: 30713 |
| | | AA | EIVLTQFPDSQSVTPKEKVTITCRASQSIGSSLHW YQQKPDQSPKLLIKYASQFSGVPSRFSGSGSGT DFTLTINSLEAEDAATYYCHQSSSFPRTFGQGTK VEIK<br>SEQ ID NO: 26708 | GVQLLDSGGGLGQPGGSLRLSCAASGFTFDSYAMS WVRQAPGKGLEWVSTISGTGRRTYYADSVKGRFTI SRDNSKNTLYLQMNSLRAEDTAVYYCAKEEDYYD SSGPGFDPWGQGTLVTVSS<br>SEQ ID NO: 30714 |

FIGURE 50
(Continued)

| | | | |
|---|---|---|---|
| iPS:435937 | 21-225_190H9 | NA | GACATCCAGATGACCCAGTCTCCATCTCTACT GTCTGCATCTGTGGGAGACAGAGTCACCATCA CTTGTCGGGCGAGTCAGGGCATTGGCAAGTAT TTAGCCTGGTTTCAGCAGAAACCAGGGAAAGC CCTTAAGTCACTGATCTATGCTGCATCCAGTTT GCAAAGTGGGGTCCCATCAAAATTCAGCGGCA GTGGATCTGGGACAGATTTCACTCTCACCATC AGCAGCCTGCAGCCTGACGATTTTGCAACTTA TTACTGCCAACGATATATGATACTTACCCATTCA CTTTCGGCCCTGGGACCAAAGTGGATATCAAA<br><br>SEQ ID NO: 26709 | CAGGTGCAGCTGGTGGAGTCTGGGGGAGGCGTG GTCCAGCCTGGGAGGTCCCTGAGACTCTCCTGTG CAGCGTCTGGATTCACCTTCAGGAACTATGCAT GCACTGGGTCCGCCAGGCTCCAGGCAAGGGCT GGAGTGGGTGGCAGTTATATGGTTTGATGAAGT AATGACTACTATGCAGACTCCGTGAAGGGCCGAT TCACCATCTCCAGAGACAATTCCAAGAACACGCT GTCACTGCAAATGAACAGCCTGAGAGCCGAGGA CACGGCTGTGTATTACTGTGCGAGAGATAGAAGC GTCGGCTACGACGGTTTAGATGTCTGGGGCCAAG GGACCACGGTCACCGTCTCCTCA<br><br>SEQ ID NO: 30715 |
| | | AA | DIQMTQSPSSLSASVGDRVTITCRASQGIGKYLA WFQQKPGKAPKSLIYAASSLQSGVPSKFSGSGSG TDFTLTISSLQPDDFATYYCQRYDTYPFTFGPGT KVDIK<br><br>SEQ ID NO: 26710 | QVQLVESGGGVVQPGRSLRLSCAASGFTFRNYGM HWVRQAPGKGLEWVAVIWFDGSNDYYADSVKGR FTISRDNSKNTLSLQMNSLRAEDTAVYYCARDRSV GYDGLDVWGQGTTVTVSS<br><br>SEQ ID NO: 30716 |
| iPS:435939 | 21-225_191H7 | NA | GAAATTGTGTTGACGCAGTCTCCAGGCACCCT GTCTTTGTCTCCAGGGGAAAGCGCCACCCTCT CCTGCAGGGCCGGTCAAAGTATTAGAACCGAC TTCTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAACAGACTGGAGCCTGAAGATTTTGCAG TGTATTTCTGTCAGCAGTATAGCTCACCGT GGACGTTCGGCCAAGGGACCAAGGTGGAAAT CAAT<br><br>SEQ ID NO: 26711 | CAGGTGCAACTGCAGGAGTCGGGCCCAGGACTG GTGAAGCCTTCACAGACCCTGTCCCTCACCTGCA CTGTCTCTGGTGGCTCCATCAACAGTGGTGATTA CTACTGGAACTGAATCGCCAGCACCCAGGGAA GGGCTGGAGTGGATTGGGTACATCTTTTACAGT GGGAGCACCTACTACAACCCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGGGATT ACGATGGTTCGGGGAGTTATCACTACTATTACGG TATGGACGTCTGGGGCCAAGGGACCACGGTCAC CGTCTCCTCA<br><br>SEQ ID NO: 30717 |

FIGURE 50
(Continued)

| | | | | |
|---|---|---|---|---|
| iPS:435941 | 21-225_191E8 | AA | EIVLTQSPGTLSLSPGESATLSCRAGQSIRTDFLA WYQQKPGQAPRLLIYGPSSRATGIPDRFSGSGSG TDFTLTINRLEPEDFAVYFCQQYGSSPWTFGQGT KVEIN<br><br>SEQ ID NO: 26712 | QVQLQESGPGLVKPSQTLSLTCTVSGGSINSGDYY WNWIRQHPGKGLEWIGYIFYSGSTYYNPSLKSRVTI SVDTSKNQFSLKLSSVTAADTAVYYCARGDYDGS GSYHYYGMDVWGQGTTVTVSS<br><br>SEQ ID NO: 30718 |
| | | NA | GAAATAGTTGATGACGCAGTCTCCAGCACCCT GTCTGTGTCTCCAGGGGAAAGAGCCACCCTCT CCTGCAGGCCCAGTCAGAGTTTTAGCAGAAAC TTAGCCTGGTACCAGCAGAAACCTGGCCAGGC TCCCAGGCTCCTCATCTATGGTGCATCCACTA GGGCCACTGGTATCCCATCCAGGTTCAGTGGC AGTGGGTCTGGGACAGAGTCACTCTCACCAT CAGCAGCCTGGAGCCTGAAGATTTTGCAGTT ACTACTGTCAGCAGTATAATAACTGGCCGCTC ACTTTCGGCGGAGGGATCAAGGTGGAGATCA AA<br><br>SEQ ID NO: 26713 | CAGGTGCAGCTGGTGGAGTCTGGGGGAGGCGTG GTCCAGCCTGGGAGGTCCCTGAGACTCTCCTGTG CAGCCGTCTGGATTCACCTTCAGTAACTATGGCAT GCACTGGGTCCGCCAGGCTCCAGGCAAGGGCT GGAGTGGGTGGCAATTATATGTTTGATGAAGT AATCAATACTATGCCGACTCCGTGAAGGGCCGAT TCACCATCTCCAGAGACAATTCCAAGAACACGCT GTATCTGCAATTGAACAGCCTGAGAGCCGAGGA CACGGCTGTCTATTACTGTGCGAGAGAGCCACGG GTCTACTACTACGCTATGGACGTCTGGGGCCAAG GGACCACGGTCACCGTCTCCTCA<br><br>SEQ ID NO: 30719 |
| | | AA | EJVMTQSPATLSVSPGERATLSCRPSQSFSRNLA WYQQKPGQAPRLLIYGASTRATGIPSRFSGSGSG TEFTLTISSLESEDFAVYYCQQYNNWPLTFGGGI KVEIK<br><br>SEQ ID NO: 26714 | QVQLVESGGGVVQPGRSLRLSCAASGFTFSNYGM HWVRQAPGKGLEWVAIIWFDGSNQYYADSVKGRF TISRDNSKNTLYLQLNSLRAEDTAVYYCARAHGVY YYAMDVWGQGTTVTVSS<br><br>SEQ ID NO: 30720 |

FIGURE 50
(Continued)

| | | | |
|---|---|---|---|
| iPS:435943 | 21-225_191C9 | NA | GAAATTGTGCTGACTCAGTCTCCAGACTTTCA GTCTGTGACTCCAAAGGAGAAAGTCACCATCA CCTGCCGGGCCAGTCAGAGTATTGGTAGTAGT TTACACTGGTACCAGCAGAAACCAGATCAGTC TCCAAAGCTCCTCATCAAGTATGCTTCCCAGT CCTTCTCAGGGGACCCTGAGATTCAGTGGC AGTGGATCTGGGACAGATTTCACCCTCACCAT CAATAGCCTGGAAGCTGAAGATGTGCAACGT ATTACTGTCATCAGACTAGAAGTTTACCTCTC ACTTTCGGCGGAGGGACCAAGGTGGAGATCA AA<br>SEQ ID NO: 26715 | CAGGTGCAGCTGCAGGAGTCGGGCCCAGGACTG GTGAAGCCTTCACAGACCCTGTCCTCACCTGCA CTGTCTCTGGTGGCTCCATCAGCAGTGGTGGTTA CTACTGAACTGGATCGGCAGCACCCAGGGAA GGGCCTGGATTGGATTGGATATATCTATTACAGT GGGAGCACCTACTACAACCCGTCCTCAAGAGTC GAGTTACCATATCAGTAGACACGTCTAAGAACCA GTTCTCCCTGAAGCTGAACTCTGTGACTGCCGCG GACACGGCCGTGTATTACTGTGCGAGATCCGGGT ATAATTGGGACGCCGGGGTCGACCCTGGGGCC AGGGAACCCTGGTCACCGTCCTCA<br>SEQ ID NO: 30721 |
| | | AA | EIVLTQSPDFQSVTPKEKVTITCRASQSIGSSLHW YQQKPDQSPKLLIKYASQSFSGDPSRFSGSGSGT DFTLTINSLEAEDAATYYCHQTRSLPLTFGGGTK VEIK<br>SEQ ID NO: 26716 | QVQLQESGPGLVKPSQTLSLTCTVSGGSISSGGYYW NWIRQHPGKGLDWIGYIYYSGSTYYNPSLKSRVTIS VDTSKNQFSLKLNSVTAADTAVYYCARSGYNWDA GVDPWGQGTLVTVSS<br>SEQ ID NO: 30722 |
| iPS:435945 | 21-225_191A10 | NA | GACATCCAGATGACCCAGTCTCCATCCTCACT GTCTGCATCTGTAGGAGACAGAGTCACCATCA CTTGTCGGGCAGTCAGGGCATTAGCAATGTAT TTAGCCTGGTTTCAGCAGAAACCAGGGAAAGC CCCTAAGTCCCTGATCTATGCTGCATCCAGTTT GCAAAGTGGGGTCCCATCAAGGTTCAGCGGCA GTGGATATGGGACAGATTTCACTCTCACCATC AGCAGCCTGCAACAGTATACTACTACCCGCTCA TTACTGCCAACAGTATATAGTACTTACCCGCTCA CTTTCGGCGGAGGGACCAAGGTGGAGATCAA A<br>SEQ ID NO: 26717 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAAAACTACGCAGACTCCGTGAAGGGCCGA TTCACCATCTCCAGAGACAATTCCAAGAACACGC TGTATCTGCAAATGAACAGCCTGAGAGCCGAGG ACACGGCTATGTATTACTGTGCGAGAGATCAGGG CGTGGGGTACGACGGTTTGACGTCTGGGGCCAA GGGACCTCGGTCACCGTCCTCA<br>SEQ ID NO: 30723 |

FIGURE 50
(Continued)

| | | | | |
|---|---|---|---|---|
| iPS-435947 | 21-225_191E10 | AA | DIQMTQSPSSLSASVGDRVTITCRASQGIGKYLA WFQQKPGKAPKSLIYAASSLQSGVPSKFSGSGY GTDFTLTISSLQPENFAIYYCQQYSTYPLTFGGGT KVEIK<br>SEQ ID NO: 26718 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAMYYCARDQGV GYDGLDVWGQGTSVTVSS<br>SEQ ID NO: 30724 |
| | | NA | GACATCCAGATGACCCAGTCTCCATCCTCACT GTCTGCATCTGTAGGAGACAGAGTCACCATCA CTTGTCGGGCGAGTCAGGGCATTGGCAAGTAT TTAGCCTGGTTTCAGCAGAAACCAGGGAAAGC CCCTAAGTCCCTGATCTATGCTGCATCCAGTTT GCAAAGTGGGGTCCCATCAAAGTTCAGCGGCA GTGGATCTGGGACAGATTTCACTCTCACCATC AGCAGCCTGCAACAGCCTGAAAATTTTGCAACTA TTACTGCCAACAGTATAGTACTTACCCGCTCA CTTTCGGCGGAGGGACCAAGGTGGAGATCAA A<br>SEQ ID NO: 26719 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGTATGATGGAAGT AATAAAACTACGCAGACTCCGTGAAGGGCCGA TTCACCATCTCCAGAGACAATTCCAAGAACACGC TGTATCTGCAAATGAACAGCCTGAGAGCCGAGG ACACGGCTATGTATTACTGTGCGAGAGATCAGG CGTGGGCTACGACGGTTTGGACGTCTGGGGCCAA GGGACCTCGGTCACCGTCTCCTCA<br>SEQ ID NO: 30725 |
| | | AA | DIQMTQSPSSLSASVGDRVTITCRASQGIGKYLA WFQQKPGKAPKSLIYAASSLQSGVPSKFSGSGSG TDFTLTISSLQPENFATYYCQQYSTYPLTFGGGT KVEIK<br>SEQ ID NO: 26720 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAMYYCARDQGV GYDGLDVWGQGTSVTVSS<br>SEQ ID NO: 30726 |

FIGURE 50
(Continued)

| | | | |
|---|---|---|---|
| iPS:435953 | 21-225_191B12 | NA | GACATCGTGATGACCCAGTCTCCAGACTCCCT GGCTGTGTCTCTGGGCGAGAGAGTCCTCACTC ACTGCAAGTCCAGCCAGAGTGTTTATTCAAC TCCAACAATAAGAACTACTTAGCTTGGTACCA GCAGAAACCAGGTCAGCCTCCTAAACTGCTCA TTTACTGGGCCTCTACCCGGAATCCGGGGTC CCTGACCGATTCAGTGGCAGCGGGTCTGGGAC AGATTTCACTCTCACCATCAGCAGTCTGCAAG CTGAAGATGTGGCAATTTATTACTGTCAGCAA TATTCTAGTCTTCCATTCACTTTCGGCCCTGGG ACCAAAGTGGATATCAAA SEQ ID NO: 26721 | CAGGTGCAGCTGGTGGAGTCTGGGGGAGGCTTG GTCAAGCCTGGAGGGTCCCTGAGACTCTCCTGT CAGCCTCTGGATTCACCTTCAGTGACTACTACAT GAGCTGGATCCGCCAGGCTCCAGGGAAGGGGCT GGAGTGGGTTTCATACATTAGTAGTAGTGGTACT ACCGTATTCTACGCAGACTCTGTGAAGGGCCGAT TCACCATCTCCAGGGACAACGCCAAGAACTCACT GTATCTGCAAATGAACAGCTGAGAGCCGAGGA CACGGCCGTGTATTACTGTGCGAGAGAATGGGTG GGAGGCGACTACTGGGGCCAGGGAACCCTGGTC ACCGTCTCCTCA SEQ ID NO: 30727 |
| | | AA | DIVMTQSPDSLAVSLGERATINCKSSQSVLFNSN NKNYLAWYQQKPGQPPKLLIYWASTRESGVPD RFSGSGSGTDFTLTISNLQAEDVAIYYCQQYSSLP FTFGPGTKVDIK SEQ ID NO: 26722 | QVQLVESGGGLVKPGGSLRLSCAASGFTFSDYYMS WIRQAPGKGLEWVSYISSSGTTVFYADSVKGRFTIS RDNAKNSLYLQMNSLRAEDTAVYYCAREWVGAD YWGQGTLVTVSS SEQ ID NO: 30728 |
| iPS:435957 | 21-225_191G12 | NA | GACATCCAGATGACCCAGTCTCCTTCCTCACT GTCTGCATCTGTAGGAGACAGAGTCACCATCA CTTGTCGGACGAGTCAGGGCATTAGCAATTAT TTAGCCTGGTTTCAGCAGAAACCAGGGAAAGC CCCTAAGTCCCTGATCTATAAAGCATCCAGTTT GCAAAGTGGGGTCCCATCAAGGTTCAGCGGCA GTGGATCTGGGACAGATTTCACTCTCACCATC AGCAGCCTGCAGCCTGAAGATATTGCAACTTA TTACTGCCAACAGTATTATACTTACCCGCTCA CTTTCGGCGGAGGGTCCAAGGTGGAGATCAAA SEQ ID NO: 26723 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATATGGTATGATGAAGT AATAAAAACTATGCAGAGACATCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCAGGG CGTGGGCTACGACGGTTTGGACGTCTGGGGCCAA GGGACCACGGTCACCGTCTCCTCA SEQ ID NO: 30729 |

FIGURE 50
(Continued)

| | | | |
|---|---|---|---|
| iPS:435961 | 21-225_192A2 | AA | DIQMTQSPSSLSASVGDRVTITCRTSQGIGNYLA WFQQKPGKAPKSLLYKASSLQSGVPSKFSGSGS GTDFTLTISSLQPEDFATYYCQQYITYPLTFGGGS KVEIK<br>SEQ ID NO: 26724 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDQGV GYDGLDVWGQGTTVTVSS<br>SEQ ID NO: 30730 |
| | | NA | GACATCCAGATGACCCAGTCTCCATCCTCACT GTCTGCATCTGTAGGAGACAGAGTCACCATCA CTTGTGGGCGAATCAGGGCATTAACAATTAT TTAGCCTGGTTTCAGCAGAAACCAGGAAAGC CCCTAAGTCCCTGATCTATGCTGCATCCAGTTT GCAAAGTGGGGTCCCATCAAAGTTCAGCGGCA GTGGATCTGGGACAGATTTCACTCTCACCATC AGCAGCCTGCCAACAGTATGAAGATTTGCAAAT TTACTGCCAACAGTATATTACTTACCCATTCA CTTTCGGCCCTGGGACCAAAGTGGATATCAAA<br>SEQ ID NO: 26725 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGCTGGCAGTTATATGGTATGATGGAAGT TATAAATACTATGCAGACTCCGTGAAGGGCCGAT TCACCATCTCCAGAGACAATTCCAAGAACACGCT GTATCTGCAAATGAACAGCTGAGAGCTGAGGA CACGGCTGTGTATTACTGTGCGAGAGAGATTCC CCTTATAGTGGCTACGCCTTGGACTACTTCTACG GTATGGACGTCTGGGGCCAAGGGACCACGGTCA CCGTCTCCTCA<br>SEQ ID NO: 30731 |
| | | AA | DIQMTQSPSSLSASVGDRVTITCRANQGINNYLA WFQQKPGKAPKSLIYAASSLQSGVPSKFSGSGSG TDFTLTISSLQPEDFATYYCQQYNSYPFTFGPGT KVDIK<br>SEQ ID NO: 26726 | QVQLVESGGGVVQPGRSLRLSCAASGFTFSSYGMH WVRQAPGKGLEWLAVIWYDGSYKYYADSVKGRF TISRDNSKNTLYLQMNSLRAEDTAVYYCAREDSPY SGYALDYFYGMDVWGQGTTVTVSS<br>SEQ ID NO: 30732 |

FIGURE 50
(Continued)

| | | | |
|---|---|---|---|
| iPS:435963 | 21-225_192D2 | NA | GACATCCAGATGATTCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGAAAGC CCCTAAGTCCCTGATCTATGCTGCATCCAGTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACATTATGTTACTTACCGAACA CTTTCGGCGGAGGGACCAAGGTGGAGATCAA A | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGGCAT GCACTGGGTCCGCCAGGCTCCAGGCAAGGGCT GGAGTGGGTGGCAGTTATATGGTATGATGGAAGT AATAAAACTATGCAGACTCCGTGAAGGGCCGA TTCCACCATCTCCAGAGACAATTCCAAGAACATGT TGTATCTGCAAATGAACAGCCTGAGAGCCGAGG AAACGGCTGTGTTATTACTGTGCGAGAGATCGTGG GGTTGGCTACTACGGTATGGACGTCTGGGGCCAA GGGACCACGGTCACCGTCTCCTCA |
| | | | SEQ ID NO: 26727 | SEQ ID NO: 30733 |
| | | AA | DIQMIQSPSPSSLSASVGDRVTITCRASQGISNYLA WFQQKPGKAPKSLIYAASSLQSGVPSKFSGSGSG TDFTLTISSLQPEDFATYYCQHYVTYPNTFGGGT KVEIK | QVQLVESGGGVVQPGRSLRLSCAASGFTFSSYGMH WVRQAPGKGLEWVAVIWYDGSNKNYADSVKGRF TISRDNSKNMLYLQMNSLRAEETAVYYCARDRGV GYYGMDVWGQGTTVTVSS |
| | | | SEQ ID NO: 26728 | SEQ ID NO: 30734 |
| iPS:435965 | 21-225_192H2 | NA | GACATCCAGATGACCCAGTCTCCATCTCCGT GTCTGCATCTGTAGGAGACAGAGTCACCATCA CTTGTCGGGCGAGTCAGGGTATCAGGTATGTTGG ATAGCCTGGTATCAGCAGAAACCAGGGAAAG CCCCTAAGCTCCTGATCTATGGTGCATCCAGTT TGCAAAGTGGGGTCCCATCTAGGTTCAGCGGC AGTGGATCTGGGACAGATTTCACTCTCACCAT CAGCAGCCTGCAGCCTGAAGATTTTGCAACTT ACTATTGTCAACAGTCTAACAGTTTCCCATTCA CTTTCGGCCCTGGGACCAAAGTGGATGTCAAA | GAGGTGCAGCTGTTGGAATCTGGGGGAGACTTA ATACAGCCTGGGGGGTCCCTGAGACTCTCCTGTG CAGCCTCTGGATTCACCTTTAGCAGCAGCTCTGCCAT GAGCTGGGTCCGCCAGGCTCCAGGGAAGGGGCT GGAGTGGGTCTCAGCTATTAGTGGTAGTGGTGGT AACAGCATTCTACGCAGACTCCGTGAAGGGCCGGT TCACCATCTCCAGAGACAATTCCAAGAACACGCT GTATCTGCAAATGAACAGCCTGAGAGCCGAAGA CACGGCCGTTTATTACTGTGCGAAACTCATAGCA GTAGTTGGGTCCCACTACTTTGACTACTGGGGCC AGGGAACCCTGGTCACCGTCTCCTCA |
| | | | SEQ ID NO: 26729 | SEQ ID NO: 30735 |

FIGURE 50
(Continued)

| | | | | |
|---|---|---|---|---|
| iPS-435967 | 21-225_192B3 | AA | DIQMTQSPSSVSASVGDRVTITCRASQGISSWIA WYQQKPGKAPKLLIYGASSLQSGVPSRFSGSGS GTDFTLTISSLQPEDFATYYCQQSNSFPFTFGPGT KVDVK SEQ ID NO: 26730 | EVQLLESGGDLIQPGGSLRLSCAASGFTFSSSAMSW VRQAPGKGLEWVSAISGSGGNTFYADSVKGRFTIS RDNSKNTLYLQMNSLRAEDTAVYYCAKLIAVVGS HYFDYWGQGTLVTVSS SEQ ID NO: 30736 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTCGCAGCAGC TTCCTTGCCTGGTACCAGCAGAAACCTGGCCA GGCTCCCAGGCTCCTCATCTATGGTGCATCTA GCAGGGCCACTGGCATCCCAGACAGTTCAGT GGCAGTGGGTCTGGGACAGACTTCACTCTCAC CATCAGCAGACTGGAGCCTGAAGATTTTGCTG TGTATTACTGTCAGCAGTATGGTAACTCACCG TGGGCGTTCGGCCAAGGGACCAAGGTGGAAA TCAAA SEQ ID NO: 26731 | CAGGTGCAGCTGCAGGAGTCGGGCCCAGGACTG GTGAAGCCTTCACAGACCCTGTCCCTCACCTGCA CTGTCTCTGGTGCTCCATCAGCAGTGGTGATTA CTACTGGAACTGGATCCGCCAGCACCCAGGGAA GGGCCTGGAATGGATTGGGTTCATCTTTTACAGT GGGAGCACCTACTACAACCGTCCCTCAAGAGTC GAGTTACCATATCAGTAGACACGTCTAAGAACCA GTTCTCCTGAAGCTGAGCTCTGTGACTGTCGCG GACACGGCCGTGTATTACTGTGCGAGAGGGATT ACGATGGTTCGGGGAGTTATCACCACTACTACGG TATGGACGTCTGGGGCCAAGGGACCACGGTCAC CGTCTCCTCA SEQ ID NO: 30737 |
| | | AA | EIVLTQSPGTLSLSPGERATLSCRASQSVRSSFLA WYQQKPGQAPRLLIYGASSRATGIPDRFSGSGSG TDFTLTISRLEPEDFAVYYCQQYGNSPWAFGQG TKVEIK SEQ ID NO: 26732 | QVQLQESGPGLVKPSQTLSLTCTVSGGSISSGDYYW NWIRQHPGKGLEWIGFIFYSGSTYYNPSLKSRVTIS VDTSKNQFSLKLSSVTVADTAVYYCARGDYDGSG SYHHYYGMDVWGQGTTVTVSS SEQ ID NO: 30738 |

FIGURE 50
(Continued)

| | | | |
|---|---|---|---|
| iPS:435971 | 21-225_192D3 | NA | GACATCGAGATGACCCAGTCTCCATCCTCACTGTCTGCATCTGTAGGAGACAGAGTCACCATCACTTGTCGGGCGAGTCAGGGCATTAGCAATTATCTTAGCCTGGTTTCAGCAGAAACCAGGGAAAGCCCCTAAGTCCCTGATCTATGCTGCATCCAGTTTGCAAAGTGGGGTCCCATCAAGTTCAGCGGCAGTGGATCTGGAACAGATTCACTCTCACCATCAGCAGCCTGCAGCCTGAAGATTTTGCAACTTATTACTGCCTACAATATCTTACTTACCCCTCTCACTTTCGGCGGAGGGACCAAGGTGGAGATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGGTATGATGGAAGTAATGAACACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGGGGGGTGGGTTACTACGGTTTGGACGTCTGGGGCCAAGGGACCACGGTCACCGTCTCCTCA |
| | | | SEQ ID NO: 26733 | SEQ ID NO: 30739 |
| | | AA | DIQMTQSPSSLSASVGDRVTITCRASQGISNYLAWFQQKPGKAPKSLIYAASSLQSGVPSKFSGSGSGTDFTLTISSLQPEDFATYYCLHYLTYPLTFGGGTKVEIK | QVQLVESGGGVVQPGRSLRLSCAASGFTFSSYGMHWVRQAPGKGLEWVAVIWYDGSNEHYADSVKGRFTISRDNSKNTLYLQMNSLRAEDTAVYYCARDRGVGYYGLDVWGQGTTVTVSS |
| | | | SEQ ID NO: 26734 | SEQ ID NO: 30740 |
| iPS:435973 | 21-225_192H3 | NA | GAAATTGTGTTGACGCAGTCTCCAGGCACCCTGTCTTTGTCTCCAGGGGAAAGAGCCACCCTCTCCTGCAGGGCCAGTCAGAGTGTTAGCAGCAACTTCTTAGCCTGGTACCAGCAGAAACCTGGCCAGGCTCCCAGGCTCCTCATCTTTGGTGCATCCAGCAGGGCCACTGGCATCCCAGACAGGTTCAGTGGCAGTGGGTCTGGGACAGACTTCACTCTCACCATCAACAGACTGGAGCCTGAAGATTTTGCAGTGTATTACTGTCAGCAATATGGTATCTCACCGTGGACGTTCGGCCAAGGGACCAAGGTGGAAATCAAA | CAGGTGCAGCTGCAGGAGTCGGGCCCAGGACTGGTGAAGCCTTCACAGACCCTGTCCCTCACCTGCACTGTCTCTGGTGGCTCCATCAGCAGTGTTAGTTACTACTGGAGCTGGATCCGCCAGCCCCCAGGGAAGGGCCTGGAGTGGATTGGGAACCTCTATTACAGTGGGAGCACCTACTACAACCCGTCCCTCAGGAGTCGAGTACCATATCAGTAGACACGTCTAAGAACCAGTTCTCCCTGAAGCTGAGTTCTGTGACTGCCGCGGACACGGCCGTGTATTACTGTGTACGAGAGGGGATTACGATGGTTCGGGGAGTTATCACTACTACCACGGTATGGACGTCTGGGGCCAAGGGACCACGGTCACCGTCTCCTCA |
| | | | SEQ ID NO: 26735 | SEQ ID NO: 30741 |

FIGURE 50
(Continued)

| | | | |
|---|---|---|---|
| iPS:435977 | 21-225_192E4 | AA | EIVLTQSPGTLSLSPGERATLSCRASQSVSSNFLAWYQQKPGQAPRLLIFGASSRATGIPDRFSGSGSGTDFTLTINRLEPEDFAVYYCQQYGISPWTFGQGTKVEIK<br>SEQ ID NO: 26736 | QVQLQESGPGLVKPSQTLSLTCTVSGGSISSVSYYWSWIRQRPGKGLEWIGNLYYSGSTYNPSLRSRATISVDTSKNQFSLKLSSVTAADTAVYYCTRGDYDGSGSYHYYHGMDVWGQGTTVTVSS<br>SEQ ID NO: 30742 |
| | | NA | GACATCCAGATGACCCAGTCTCCATCCTCACTGTCTGCATCTGTAGGAGACAGAGTCACCATCACTTGTCGGGCGAGTCAGGGCATTGGCAATTATTTAGCCTGGTTTCAGCAGAAACCAGGGAAAGCCCCTAAGTCCCTGATCTATGTTGTATCCAGTTTACAAAGTGGGGTCCCATCAAGGTTCAGCGGCAGTGGATCTGGGACAGATTTCACTCTCACCATCAGCAGCCTGCAGCCTGAAGATTTTGCAGTTATTACTGCCAACGGTATGATACTTACCATTCACTTTCGGCCCTGGGACCAAAGTGGATATCAAA<br>SEQ ID NO: 26737 | CAGGTGCAGCTGGTGGAGTCTGGGGGAGGCGTGGTCCAGCCTGGGAGGTCCCTGAGACTCTCCTGTGCAGCCGTCTGGATTCACCTTCAGTAGTTATGGCATGCACTGGGTCCGCCAGGCTCCAGGCAAGGGGCTGGAGTGGGTGGCAGTTATATGGTATGATGGAAGTAACAAAAACTATGTAGACTCCGTGAAGGGCCGATTCACCATCTCCAGAGACAACTCCAAGAACACGCTGTATCTGCAAATGAACAGCCTGAGAGCCGAGGACACGGCTGTGTATTATTGTGCGAGAGATAGAAGCGTGGGCTACGACGGTATGGACGTCTGGGGCCAAGGGACCACGGTCACCGTCTCCTCA<br>SEQ ID NO: 30743 |
| | | AA | DIQMTQSPSSLSASVGDRVTITCRASQGIGNYLAWFQQKPGKAPKSLIYVVSSLQSGVPSRFSGSGSGTDFTLTISSLQPEDFATYYCQRYDYPFTFGPGTKVDIK<br>SEQ ID NO: 26738 | QVQLVESGGGVVQPGRSLRLSCAASGFTFSSYGMHWVRQAPGKGLEWVAVIWYDGSNKNYVDSVRGRFTISRDNSKNTLYLQMNSLRAEDTAVYYCARDRSVGYDGMDVWGQGTTVTVSS<br>SEQ ID NO: 30744 |

FIGURE 50
(Continued)

| | | | |
|---|---|---|---|
| iPS:435979 | 21-225_192H4 | NA | GACATCCAGATGACCCAGTCTCCATCCTCACT GTCTGCATCTGTAGGAGACAGAGTCACCATCA CTTGTCGGGCGAGTCAGGACATTAGCAATTAT TTAGCCTGGTTTCAGCAGAAACCAGGGAAAGC CCCTAAGTCCCTGATCTCTGCTGCATCCAGTTT GCAAAGTGGGGTCCCATCAAAGTTCAGCGGCA GTAGATCTGGGACAGATTTCACTCTCACCATC AGCAGCCTGCAGCCTGAAGATTTTGCAACTTA TTACGGCCTACATTATCTCAATTACCCGCTCAC TTTCGGCGGAGGGACCAGGGTGGAGATCAGA<br><br>SEQ ID NO: 26739<br><br>DIQMTQSPSSLSASVGDRVTITCRASQDISNYLA WFQQKPGKAPKSLISAASSLQSGVPSKFSGSRSG TDFTLTISSLQPEDFATYYGLHYLNYPLTFGGGT RVEIR<br><br>SEQ ID NO: 26740 | CAGGTGCAGTTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAG CAATAAAAACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGAGATCAAG GTGTGGGGTACTACGGTATGGACGTCTGGGGCCA AGGGACCACGGTCACCGTCTCCTCA<br><br>SEQ ID NO: 30745<br><br>QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDQGV GYYGMDVWGQGTTVTVSS<br><br>SEQ ID NO: 30746 |
| iPS:435983 | 21-225_192E5 | NA | GAAATTGTTCTGACTCAGTCTCCAGATTTTCAG TCTGTGACTCCAAAGGAGAAAGTCACCATCAC CTGCCGGGCCAGTCAGAGCATTGGTAGGAGTT TACACTGGTACCAGCAGAAACCAGATCAGTCT CCAAAGCTCCTCATCAAGTATGCTTCCCAGTC ATTCTCAGGGGTCCCCTGAGGTTCAGTGGCA GTGGATCGGGACAGATTTCACCCTCACCATC AATAGCCTGGAGGCTGAAGATGCTGCAACGTA TTACTGTCATCAGAGTAGTCGTTTACCGCTCAC TTTCGGCGGAGGGACCAAGGTGGAGATCAAA<br><br>SEQ ID NO: 26741 | CAGGTGCAGCTGCAGGAGTCGGGCCCAGGACTG GTGAAGCCTTCACAGACCCTGTCCCTCACCTGCA CTGTCTCTGGTGACTCCATCAATAATGGTGGATA CTACTGGAGCTGGATCCGCCAGCACCCAGGGAA GGGCCTGGAGTGGATTGGATACATCTTTTACAGC GGGAGCACCTACTACAACCCGTCCCTCAAGAGTC GAGTTACCATATCAGTTGACACGTCTAAGAATCA GTTCTCCCTGAAACTGAACTCTGTGACTGCCGCG GACACGGCCGTGTATTTTTGTGCGAGAGCGGGAT ATAACTGGGACAACGGGTTTGACTACTGGGGCC AGGGAACCCTGGTCACCGTCACCTCCTCA<br><br>SEQ ID NO: 30747 |

FIGURE 50
(Continued)

| | | | |
|---|---|---|---|
| iPS-435985 | 21-225_192F6 | AA | EIVLTQSPDFQSVTPKEKVTITCRASQSIGRSLHW YQQKPDQSPKLLIKYASQSFSGVPSRFSGSGSGT DFTLTINSLEAEDAATYYCHQSSRLPLTFGGGTK VEIK<br><br>SEQ ID NO: 26742 | QVQLQESGPGLVKPSQTLSLTCTVSGDSINNGGYY WSWIRQHPGKGLEWIGYIFYSGSTYYNPSLKSRVTI SVDTSKNQFSLKLNSVTAADTAVYFCARAGYNWD NGFDYWGQGTLVTVSS<br><br>SEQ ID NO: 30748 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCTGAAACCAGGGAAAGC CCCTAAGCGCCTGATCTATGCTGCATCCAGTTT GCAAAGTGGGGTCCCATCAAGGTTCAGCGGCA GTGGATCTGGGCCAGAATTCACTCTCACAATC AGCAGCCTGCAGACCTGAAGATTTTGCAACTTA TTACTGTCTACAGCATTATAGTTTCCATTCAC TTTCGGCCCTGGGACCAAAGTGGATATCAAA<br><br>SEQ ID NO: 26743 | CAGGTGCAGCTGGTGGAGTCTGGGGGAGGCGTG GTCCAGCCTGGGAGGTCCCTGAGACTCTCCTGTG CAGGGTCTGGATTCACCTTCAGTAGCTTTATCAT GCACTGGGTCCGCCAGGCTCCAGGCAGGGGCT GGAGTGGGTGGCAGTTATATGACTCCGTGAAGT AATAAATACTATGTAGACTCCGTGAAGGGCCGAT TCACCATCTCCAGAGACAATTCCAAGAACACGCT GTATCTGCAAATGAACAGCCTGAGAGCCGAGGA CACGGCTGTGTACTACTGTGCGAGAGAGGAGTAT AGTAGCGGCTGGTTCGGGTACGGTATGGACGTCT GGGGCCAAGGGACCACGGTCACCGTCTCCTCA<br><br>SEQ ID NO: 30749 |
| | | AA | DIQMTQSPSSLSASVGDRVTITCRASQGIRNDLG WYQLKPGKAPKRLIYAASSLQSGVPSRFSGSGSG PEFTLTISSLQPEDFATYYCLQHYSFPFTFGPGTK VDIK<br><br>SEQ ID NO: 26744 | QVQLVESGGGVVQPGRSLRLSCAASGFTFSSFIMH WVRQAPGRGLEWVAVIWYDGSNKYYVDSVKGRF TISRDNSKNTLYLQMNSLRAEDTAVYYCAREEYSS GWFGYGMDVWGQGTTVTSS<br><br>SEQ ID NO: 30750 |

FIGURE 50
(Continued)

| | | | |
|---|---|---|---|
| iPS:435987 | 21-225_192G6 | NA | GACATCAAGATGACCCAGTCTCCTTCCTCACT GTCTGCATCTGTAGGAGACAGAGTCACCATCA CTTGTCGGACGAGTCAGGCATTGGCAATTAT TTAGCCTGGTTTCAGCAGAAACCAGGAAAGC CCCTAAGTCCCTGCTCTATAAAGCATCCAGTTT GCAAAGTGGGGTCCCATCAAAGTTCAGCGGCA GTGGATCTGGGACAGATTCACTCTCACCATC AGCAGCCTGCAGCCTGAAGATTTTGCAACTTA TTACTGCCAAACAGTATATGACTTACCCGCTCA CTTTCGGCGGGGGGACCAAGGTGGAGATCAA A SEQ ID NO: 26745 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTTATGGTATGATGGAACT AATAAAAACTATGCAGACTCCGTGAAGGGCCGA TTCACCATCTCCAGAGACAATTCCAAGAACGC TGTATCTGCAAATGAACAGCCTGAGAGCCGAGG ACACGGCTGTGTATTACTGTGCGAGAGATCAGG CGTGGGCTACGACGGTTTGGACGTCTGGGGCCAA GGGACCACGGTCACCGTCCTCA SEQ ID NO: 30751 |
| | | AA | DIKMTQSPSSLSASVGDRVTITCRTSQGIGNYLA WFQQKPGKAPKSLLYKASSLQSGVPSKFSGSGS GTDFTLTISSLQPEDFATYYCQQYMTYPLTFGGG TKVEIK SEQ ID NO: 26746 | QVQLVESGGGVVQPGRSLRLSCAASGFTFSSYGMH WVRQAPGKGLEWVAVLWYDGTNKNYADSVKGR FTISRDNSKNTLYLQMNSLRAEDTAVYYCARDQGV GYDGLDVWGQGTTVTVSS SEQ ID NO: 30752 |
| iPS:435989 | 21-225_192F7 | NA | GACATCCAGATGACCCAGTCTCCATCCTCCCT GTCTGCGTCTGTAGGAGACAGAGTCACCATCA CTTGCCGGGCAAGTCAGGGCATTAGAAAAGAT TTAGGCTGGTATCAACAGAAACCAGGGAAAG CCCCTAAGCGCCTAATCCATACTGCATCCAGT TTGCAAAGTGGGGTCCCATTAAGGTTCAGCGG CAGTGGATCTGGGACAGAATTCACTCTCACAA TCAGCAGCCTGCAGCCTGAAGATTTTGCAACT TATTACTGTCTACAGCATACTAGTTACCCGTG GACGTTCGGCCAAGGGACCAAGGTGGAAATC TAC SEQ ID NO: 26747 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGCT GGAGTGGGTGACAGTTATATCATGATGGAGGT TATAAAAACTATGCAGACTCCGTGAAGGGCCGA TTCACCATCTCCAAATGAATAGCCTGAGAGCTGAGGA TGTATCTGCAAATGAACAGCCTGAGAGCTGAGGA CACGGCTGTGTATTACTGTGCGAGAGAGGTACCCAC GGGTACTACTACGGTGTGGACGTCTGGGGCCAA GGGACCACGGTCACCGTCTCCTCA SEQ ID NO: 30753 |

FIGURE 50
(Continued)

| | | | |
|---|---|---|---|
| iPS-435993 | 21-225_192C8 | AA | DIQMTQSPSSLSASVGDRVTITCRASQGIRKDLG WYQQKPGKAPKRLIHTASSLQSGVPLRFSGSGS GTEFTLTISSLQPEDFATYYCLQHTSYPWTFGQG TKVEIY<br>SEQ ID NO: 26748 | QVQLVESGGGVVQPGRSLRLSCAASGFTFSSYGMH WVRQAPGKGLEWVTVISYDGGYKNYADSVKGRF TISRDNSKNTLYLQMNSLRAEDTAVYYCARGTHG YYYGVDVWGQGTTVTVSS<br>SEQ ID NO: 30754 |
| | | NA | GACATCCAGATGACCCAGTCTCCATCCTCACT GTCTGCATCTGTAGGAGACAGAGTCACCATCA CTTGTCGGGCGAGTCAGGGCATTAGACAATTAT TAGCCTGGTTTCAGCAGAAACCAGGAAAGC CCCTAAGTCCCGATCTATGTGCATCCAGTTT GCAAAGTGGGGTCCCATCAAAGTTCAGCGGCA GTGGATCTGGAACAGATTTCACTCTCACCATC AGCAGCCTGCAGCCTGAGGATTTTGCTACTTA TTACTGCCAACATTATCTTACTTACCCCTCAC TTCGGCGGAGGGACCAAGGTGGAGATCAAA<br>SEQ ID NO: 26749 | CAGGTGCAGCTGGTGGAGTCTGGGGGAGGCGTG GTCCAGCCTGGGAGGTCCCTGAGACTCTCCTGT CAGCGTCTGGATTCACCTTCAGTAGCTATGGCAT GCACTGGGTCCGCCAGGCTCCAGGCAAGGGGCT GGAGTGGGTGGCAGTTATATCGTATGATGGAAGT AATGAACACTATGCAGACTCCGTGAAGGGCCGA TTCATGATCTCCAGAGACAATTCCAAGAACACGC TGTATCTGCAAATGAACAGCCTGAGAGCCGAGG ACACGGCTGTGTATTACTGTGCGAGAGATAGGGG AGTGGGTTACTACGGTATGGACGTCTGGGGCCAA GGGACCACGGTCACCGTCTCCTCA<br>SEQ ID NO: 30755 |
| | | AA | DIQMTQSPSSLSASVGDRVTITCRASQGISNYLA WFQQKPGKAPKSLIYAASSLQSGVPSKFSGSGSG TDFTLTISSLQPEDFATYYCQHYLTYPLTFGGGT KVEIK<br>SEQ ID NO: 26750 | QVQLVESGGGVVQPGRSLRLSCAASGFTFSSYGMH WVRQAPGKGLEWVAVIWYDGSNEHYADSVKGRF MISRDNSKNTLYLQMNSLRAEDTAVYYCARDRGV GYYGMDVWGQGTTVTVSS<br>SEQ ID NO: 30756 |

FIGURE 50
(Continued)

| | | | | |
|---|---|---|---|---|
| iPS:435995 | 21-225_192F8 | NA | GAAATTGTGTTGACGCAGTCTCCAGGCACCCT GTCTTTGTCTCAGGGGAAAGAGCCACCCTCT CCTGCAGGGCCAGTCAGTATTAGCAGCAGC TACTTAGCCTGGTACCAGCAGAAACCTGGCCA GGCTCCCCGGCTCCTCATCTATGGTGCATCCA GCAGGGCCACTGGCATCCCAGCCAGGTTCAGT GGCAGTGGGTCTGGGACAGACTTCACTCTCAC CATCAGCAGACTGGAGCCTGAAGATTTTGCAG TGTATTACTGTCAGCAGTATGAGAGTTCACCG TGGACGTTCGGCCAAGGGACCAAGGTGGAAA TCAAA SEQ ID NO: 26751 | CAGGTGCAGCTACAGCAGTGGGGCGCAGGACTG TTGAAGCCTTCGGAGACCCTGTCCCTCACCTGCG CTGTCTATGGTGGGTCCTTCAGTGGTTGCTACTG GAGCTGGATCCGCCAGCCCCAGGGAAGGGCT GGAGTGGATTGGGAAATCAATCAAAGTGGAAG GTCCAACTACAACCGTCCTCAAGAGTCGAGTC ACCATTTCAGTAGACACGTCCACGAACCAGTCT CCCTGAAGCTGAGTCTGTGACCGCCGCGGACAC GGCTGTGTATTACTGTGCGAGAGACTACGGTGTC TTTGACTACTGGGGCCAGGGCACCCTGGTCACCG TCTCCTCA SEQ ID NO: 30757 |
| | | AA | EIVLTQSPGTLSLSPGERATLSCRASQSISSSYLA WYQQKPGQAPRLLIYGASSRATGIPARFSGSGSG TDFTLTISRLEPEDFAVYYCQQYESSPWTFGQGT KVEIK SEQ ID NO: 26752 | QVQLQQWGAGLLKPSETLSLTCAVYGGSFSGCYW SWIRQPPGKGLEWIGEINQSGRSNYNPSLKSRVTIS VDTSTNQFSLKLRSVTAADTAVYYCARDYGVFDY WGQGTLVTVSS SEQ ID NO: 30758 |
| iPS:435997 | 21-225_192G8 | NA | GACATCCAGATGACCCAGTCTCCTTCCTCACT GTCTGCATCTGTAGGAGACAGAGTCACCATCA CTTGTCGGACGAGTCAGGGCATTGGCAATTAT TTAGCCTGGTTTCAGCAGAAACCAGGGAAAGC CCCTAAGTCCCTGTCTATAAAGCATCCAGTTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATATCACTTACCCGCTCA CTTTCGGCGGAGGGACCAAGGTGGAGATCAA A SEQ ID NO: 26753 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGCAGTATGATGGAAGT AATAAAACTATGCAGAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCAGGG CGTGGGCTACGACGGTTTGGACGTCTGGGGCCAA GGGACCACGGTCACCGTCTCCTCA SEQ ID NO: 30759 |

FIGURE 50
(Continued)

| | | AA | DIQMTQSPSSLSASVGDRVTITCRTSQGIGNYLA WFQQKPGKAPKSLLYKASSLQSGVPSKFSGSGS GTDFTLTISSLQPEDFATYYCQQYITYPLTFGGGT KVEIK SEQ ID NO: 26754 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDQGV GYDGLDVWGQGTTVTVSS SEQ ID NO: 30760 |
|---|---|---|---|---|
| iPS:435999 | 21-225_192F9 | NA | GATATTGTAATGACCCAGACTCCACTCTCTCT GTCCGTCACCCTGGACAGCCGGCCTCCATCT CCTGCAAGTCTAGTCAGAGCCTCCTCCATAGT GATGGAAGGACCTATTTGTATTGGTACCTGCA GAGGCCAGGCCAGCCTCCACAGTCCTGATCT GTGAGGTTTCCAACCGGTTCGCTGGAGTGACA GATAGGTTCAGTGGCAGCGGGTCAGGGACAG ATTTCACACTGAAAATCAGCCGGGTGGAGGCT GGGGATGTTGGGGTTTATTACTGCATGCAAAG TATACAGCTTCCCTGGACGTTCGGCCAAGGGA CCAAGGTGGAAATCAAA SEQ ID NO: 26755 | CAGCTGCAGCTGCAGGAGTCGGGCCCAGGACTG GTGAAGCCTTCGGAGACCCTGTCCCTCACCTGCA CTGTCTCTGGTGGCTCCATCAGAAGTCACCACTG GAGCTGGATCGGCAGCCCGCGGGAAGGGACT GGAGTGGATTGGCTTATCTATACCAGTAGGAGC ACCAATTACAACCCCTCCCTCAAGAGTCGAGTCA CCATGTCAGTTGACACGTCCAAGAACCAGTTCTC CCTGAAGCTGAACTCTGTGCAGACCGCCGACACG GCCGTGTATTACTGTGCGAGACTCCGGTATAACT GGAACTTCCCTTACTTTGACTACTGGGGCCAGGG AACCCTGGTCACCGTCTCCTCA SEQ ID NO: 30761 |
| | | AA | DIVMTQTPLSLSVTPGQPASISCKSSQSLLHSDGR TYLYWYLQRPGQPPQLLICEVSNRFAGVTDRFS GSGSGTDFTLKISRVEAGDVGVYYCMQSIQLPW TFGQGTKVEIK SEQ ID NO: 26756 | QLQLQESGPGLVKPSETLSLTCTVSGGSIRSYHWSW IRQPAGKGLEWIGLIYTSRSTNYNPSLKSRVTMSVD TSKNQFSLKLNSVTAADTAVYYCARLRYNWNFPY FDYWGQGTLVTVSS SEQ ID NO: 30762 |

FIGURE 50
(Continued)

| | | NA | GACATCCAGATGACCCAGTCTCCATCCTCACT GTCTGCATCTGTGGGAGACAGAGTCACCATCA CTTGTCGGGCGAGTCAGGGCATTGGCAAGTAT TTAGCCTGGTTTCAGCAGAAACCAGGGAAAGC CCCTAAGTCACTGATCTATGCTGCATCCAGTT GCAAAGTGGGGTCCCATCAAGTTCAGCGGCA GTGGGTCTGGGACAGATTTCACTCTCACCATC AGCAGCCTGCAGCCTGACGATTTTGCAACTTA TTACTGCCAACGATATGATACTTACCCATTCA CTTTCGGCCCTGGGACCAAAGTGGATTTCAAA<br><br>SEQ ID NO: 26757 | CAGGTGCAGCTGGTGGAGTCTGGGGGAGGCGTG GTCCAGCCTGGGAGGTCCCTGAGACTCTCCTGTG CATCGTCTGGATTCACCTTCAGGAACTATGGCAT GCACTGGGTCCGCCAGGCTCCAGGCAAGGGGCT GAAATGGGTGGCAGTTATATGGTTTGATGGAAGT AATGACTACTATGCAGACTCCGTGAAGGGCCGAT TCACCATCTCCAGAGACAATTCCAAGAACACGCT GTCACTGCAAATGAACAGCCTGAGAGCCGAGGA CACGGCTGTGTATTACTGTGCGAGAGATAGAAGC GTCGGGTACGACGGTTAGATGTCTGGGGCCAAG GGACCACGGTCACCGTCTCCTCA<br><br>SEQ ID NO: 30763 |
|---|---|---|---|---|
| iPS:436001 | 21-225_192C10 | AA | DIQMTQSPSSLSASVGDRVTITCRASQGIGKYLA WFQQKPGKAPKSLIYAASSLQSGVPSKFSGSGSG TDFTLTISSLQPDDFATYYCQRYDTYPFTFGPGT KVDFK<br><br>SEQ ID NO: 26758 | QVQLVESGGGVVQPGRSLRLSCASSGFTFRNYGMH WVRQAPGKGLKWVAVIWFDGSNDYYADSVKGRF TISRDNSKNTLSLQMNSLRAEDTAVYYCARDRSVG YDGLDVWGQGTTVTVSS<br><br>SEQ ID NO: 30764 |
| iPS:436003 | 21-225_192G10 | NA | GACATCCAGATGACCCAGTCTCCATCCTCCCT GTCTGCATCTGTAGGAGACAGAGTCACCATCA CTTGCCGGGCAAGTCAGAGCATTAGCAACTAT TTAAATTGGTATCAGCAGAGACACCAGGAAAGC CCCTAAGCTCCTGATCTATGCTGAATCCAGTTT ACAAAGTGGGGTCCCATCAAGGTTCAGTGGCA GTGGATCTGGGACAGATTTCACTCTCACCATC AGCAGTCTGCAACCTGAAGATTTTGCAACTTA CTCCTGTCAACAGAGTTACAGTTCCCCTCCGT GGACGTTCGGCCAAGGGACCAAGGTGGAAAT CAAA<br><br>SEQ ID NO: 26759 | GAGGTGCAGCTGTTGGAGTCTGGGGGAGGCTTG GTACAGCCTGGGGGGTCCCTGAGACTCTCCTGTT CAGCCTCTGGATTCACCTTTAGCAGCTATGCCAT GAGCTGGGTCCGCCAGGCTCCAGGGAAGGGGCT GGAGTGGGTCTCAGCTATTAGTAGTGGTAGTGGT AGTACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTCTATTACTGTGCGCGACGTTTAGCA CTGGATGGCTATGATGCTTTTGATATCTGGGGCC AAGGGACAATGGTCACCGTCTCTTCA<br><br>SEQ ID NO: 30765 |

FIGURE 50
(Continued)

| | | | | |
|---|---|---|---|---|
| | | AA | DIQMTQSPSSLSASVGDRVTITCRASQSISNYLN WYQQTPGKAPKLLIYAESSLQSGVPSRFSGSGSG TDFTLTISSLQPEDFATYSCQQSYSSPPWTFGQGT KVEIK<br>SEQ ID NO: 26760 | EVQLLESGGGLVQPGGSLRLSCSASGFTFSSYAMS WVRQAPGKGLEWVSAISGRGGSTFYADSVKGRFTI SRDNSKNTLYLQMNSLRAEDTAVYYCARRLALDG YDAFDIWGQGTMVTVSS<br>SEQ ID NO: 30766 |
| iPS-436005 | 21-225_192H10 | NA | GACATCCAGATGACCCAGTCTCCATCCTCACT GTCTGCATCTGTAGGAGACAGAGTCACCATCA CTTGTCGGGCGAGTCAGGGCATTGGCAAGTAT TTAGCCTGGTTTCAGCAGAAACCAGGGAAAGC CCCTAAGTCCCTGATCTATGCTGCATCCAGTTT GCAAAGTGGGGTCCCATCAAGTTCACTCTCACT GTGGATATGGACAGCCTGCAACAGTATCTACTTGCAACTTA TTACTGCCAACAGTATAGTACTTACCCGCTCA CTTTCGGCGGAGGGACCAAGGTGGAGATCAA G<br>SEQ ID NO: 26761 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGCAT GCACTGGGTCCGCCAGGCTCCAGGCAAGGGCT GGAGTGGGTGGCAGTTATATGGTATGATGGAAGT AATAAAAACTACGACAGACTCCGTGAAGGGCCGAA TTCACCATCTCCAGAGACAATTCCAAGAACACGC TGTATCTGCAAATGAACAGCCTGAGAGCCGAGG ACACGGCTACGACGGTTTGACGTCTGGGCCAA CGTGGGCTACGACGGTTTGACGTCTGGGCCAA GGGACCTCGGTCACCGTCTCCTCA<br>SEQ ID NO: 30767 |
| | | AA | DIQMTQSPSSLSASVGDRVTITCRASQGIGKYLA WFQQKPGKAPKSLIYAASSLQSGVPSKFSGSGY GTDFTLTISSLQPENFATYYCQQYSTYPLTFGGG TKVEIK<br>SEQ ID NO: 26762 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAMYYCARDQGV GYDGLDVWGQGTSVTVSS<br>SEQ ID NO: 30768 |

FIGURE 50
(Continued)

| | | | | |
|---|---|---|---|---|
| iPS:436007 | 21-225_192G12 | NA | GAAATTGTGTTGACGCAGTCTCCAGGCACCCT GTCTTTGTCTCCAGGGGAAAGAGCCACCCTCT CCTGCAGGGCCAGTCAGAGTGTTAGAAGCGA CTTCTTAGCCTGGCTCCAGCAGAAACCTGGCC AGGCTCCCAGGCTCCTCATCTATGTGTATCC CGCAGGGCCACTGGCATCCCAGACAGGTTCAG TGGCAGTGGGTCTGGGACAGATTCACTCTCA CCATCAACAGACTGGAGCTGAAGATTTTGCA GTGTATTACTGTCAGCAGTATGGTAACTCACC GTGGACGTTCGGCCAAGGGACCAAGGTGGAA ATCAAA<br><br>SEQ ID NO: 26763 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGTTTA CCACTGGAGCTGGATCCGCCAGCACCCAGGGAA GGGGCTGGAGTGGATTGGGAACATCCATTACAG CGGGAGCACCTACAACAACCGTCCCTCAAGAG TCGAGTTACCATATCAGTAGACACGTCTAAGAAC CAGTTCTCCCTGAAGCTGAGCTCTGTGACTGCCG CGGACACGGCCGTGTATTACTGTGCGAGAGGG ATTACGATGGTTCGGGGAGTTATCACTACTACTA CGGTATGGACGTCTGGGGCCAAGGGACCACGGT CACCGTCTCCTCA<br><br>SEQ ID NO: 30769 |
| | | AA | EIVLTQSPGTLSLSPGERATLSCRASQSVRSDFLA WLQQKPGQAPRLLIYGVSRRATGIPDRFSGSGSG TDFTLTINRLEPEDFAVYYCQQYGNSPWTFGQG TKVEIK<br><br>SEQ ID NO: 26764 | QVQLQESGPGLVKPSQTLSLTCTVSGGSISSGVYHW SWIRQHPGKGLEWIGNIHYSGSTYNNPSLKSRVTIS VDTSKNQFSLKLSSVTAADTAVYYCARGDYDGSG SYHYYYGMDVWGQGTTVTVSS<br><br>SEQ ID NO: 30770 |
| iPS:436009 | 21-225_193A1 | NA | GAAATTGTGTTGACGCAGTCTCCAGGCACCCT GTCTTTGTCTCCAGGGGAAAGAGCCACCCTCT CTTGTAGGGCCAGTCAGAGTGTTAGAAGCAAC TTCTTAGCCTGGCTACCAGCAGAAACCTGGCCA GGCTCCCAGGCTCCTTCATCTATGGTGCATCC GCAGGGCCACTGGCATCCCAGACAGGTTCAGT GGCAGTGGGTCTGGGACAGACTTCACTCTCAC CATCAACAGACTGGAGCTGAAGATTTTGCAG TGTATTACTGTCAGCAGTATGTGAACTCACCG TGGACGTTCGGCCAAGGGACCAAGGTGGAAA TCAAA<br><br>SEQ ID NO: 26765 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGTTTA CTACTGGAGCTGGATCCGCCAGCACCCAGGGAA GGGGCTGGAGTGGATTGGGAACATCTATTACAGT GGGAGCACCTACAACAACCGTCCCTCAAGAGT CGACTTACCATATCAGCAGACACGTCTAAGAACC AGTTCTCCCTGAAGCTGAGCTCTGTGACTGCCGC GGACACGGCCGTGTATTACTGTGCGAGAGGGA TTACGATGGTTCGGGGAGTTATCACTACTACTAC GGTATGGACGTCTGGGGCCAAGGGACCACGGTC ACCGTCTCCTCA<br><br>SEQ ID NO: 30771 |

FIGURE 50
(Continued)

| | | | | |
|---|---|---|---|---|
| | | AA | EIVLTQSPGTLSLSPGERATLSCRASQSVRSNFLAWHQQKPGQAPRLFIYGASRRATGIPDRFSGSGSGTDFTLTINRLEPEDFAVYYCQQYGNSPWTFGQGTKVEIK<br>SEQ ID NO: 26766 | QVQLQESGPGLVKPSQTLSLTCTVSGGSISSGVYYWSWIRQHPGKGLEWIGNIYYSGSTYNNPSLKSRLTISADTSKNQFSLKLSSVTAADTAVYYCARGDYDGSGSYHYYGMDVWGQGTTVTVSS<br>SEQ ID NO: 30772 |
| iPS:436011 | 21-225_193B1 | NA | GAAATTGTGTTGACGCAGTCTCCAGGCACCCTGTCTTTGTCTCCAGGGGACAGAGCCACCCTCTCTTGCAGGGCCAGTCAGAGTGTTAGAAGCAACTTCTTAGCCTGGCACCAGCAGAAACCTGGCCAGGCTCCCAGGCTCCTCATCTATGGTGCATCCGCAGGGCCACTGGCATCCAGACAGGTTCAGTGGCAGTGGGTCTGGGACAGACTTCACTCTCACCATCAACAGACTGGAACCTGAAGATTTTGCAGTGTATTTCTGTCAGCAGTATGGTAACTCACCGTGGACGTTCGGCCAAGGGACCAAGGTGGAAATCAAA<br>SEQ ID NO: 26767 | CAGGTGCAGCTGCAGGAGTCGGGCCCAGGACTGGTGAAGCCTTCACAGACCCTGTCCCTCACCTGCACTGTCTCTGGTGGCTCCATCAGCAGTGGTGTTTACTACTGGAGCTGGATCCGCCAGCACCCAGGGAAGGGCCTGGAGTGGATTGGGAACATCTATTACAGTGGGAGCACCTACAACAACCCGTCCCTCAAGAGTCGAGTTACCATATCAGTAGACACGTCTAAGAACCAGTTCTCCCTGAAGCTGAGCTCTGTGACTGCCGCGGACACGGCCGTGTATTACTGTGCGAGGGGATTACGATGGTTCGGGGAGTTATCACTACTACTACGTATGACGTTCGGGGCCAAGGGACCACGGTCACCGTCTCCTCA<br>SEQ ID NO: 30773 |
| | | AA | EIVLTQSPGTLSLSPGDRATLSCRASQSVRSNFLAWHQQKPGQAPRLLIYGASRRATGIPDRFSGSGSGTDFTLTINRLEPEDFAVYFCQQYGNSPWTFGQGTKVEIK<br>SEQ ID NO: 26768 | QVQLQESGPGLVKPSQTLSLTCTVSGGSISSGVYYWSWIRQHPGKGLEWIGNIYYSGSTYNNPSLKSRVTISVDTSKNQFSLKLSSVTAADTAVYYCARGDYDGSGSYHYYGMDVWGQGTTVTVSS<br>SEQ ID NO: 30774 |

FIGURE 50
(Continued)

| | | | |
|---|---|---|---|
| iPS:436013 | 21-225_193F2 | NA | GACATCCAGATGACCCAGTCTCCATCTTCCGT GTCTGCATCTGTAGGAGACAGAGTCACCATCA CTTGTCGGGCGAGTCAGGGTATTAACAACTGG TTAGCCTGGTATCAGCAGAAACCAGGGAAAG CCCCTAAGCTCCTGATCTATGGTGTTTCCAGTT TGCAAAGTGGGGTCCATCAAGGTTCAGCGGC AGTGGATCTGGGACAGATTTCACTCTCACCAT CAGCAGCCTGCAGCCTGAAGATTTTGCAACTT ACTCTTGTCAACAGGCTAACAGTTTCCCGTGG ACGTTCGGCCAAGGGACCAAGGTGGAAATCA GA<br>SEQ ID NO: 26769 | GAGGTGCAGCTGGTTGGAGTCTGGGGGAGGCTTG GTACAGCCTGGGGGGTCCCTGAGACTCTCCTGTG CAGCCTCTGGATTCACCTTTAGCACCTTTGCCAT GAGTTGGGTCCGCCAGGCTCCAGGGAAGGGGCT GGAGTGGGTCTCAGCTATTAGTCGTAGTGGTGGT AACACACTACGCAGACTCCGTGAAGGGCCGG TTCACCATCTCCAGAGACAATTCCAAGAATACGC TGTATCTGCAAATGAACAGCCTGAGAGCCGAGG ACACGGCCGTATATTCCTGTGCGAAAGATGATT CGGTGGGAGCTCCTACTTTGACTACTGGGGCCAG GGAACCCTGGTCACCGTCTCCTCA<br>SEQ ID NO: 30775 |
| | | AA | DIQMTQSPSSVSASVGDRVTITCRASQGINNWLA WYQQKPGKAPKLLIYGVSSLQSGVPSRFSGSGS GTDFTLTISSLQPEDFATYSCQQANSFPWTFGQG TKVEIR<br>SEQ ID NO: 26770 | EVQLLESGGGLVQPGGSLRLSCAASGFTFSTFAMS WVRQAPGKGLEWVSAISRSGGNTHYADSVKGRFTI SRDNSKNTLYLQMNSLRAEDTAVYSCAKDGFGGS SYFDYWGQGTLVTVSS<br>SEQ ID NO: 30776 |
| iPS:436015 | 21-225_193D3 | NA | GAAATTGTGTTGACGCAGTCTCCAGGCACCCT GTCTTTGTCTCCAGGGGAAAGAGCCACCCTCT CCTGCAGGGCCAGTCAGAGTATTCGCAGCAGC TTCTTAGCCTGGTATCAGCAGAAACCTGGCCA GGCTCCCAGGCTCCTCATCTATGGTGCATCCA ACAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAACTCACCG TGGGCGTTCGGCCAAGGGACCAAGGTGGAAA TCAAA<br>SEQ ID NO: 26771 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGGATCCGCCAGTCCCCAGGGAA GGGCCTGGAGTGGATTGGGTACATCTTTTACAGT GGGAGCACCTACTACAACCCGTCCCTCAAGAGTC GACTTACCATATCAGTGGACACGTCTAAGAACCA GTTCTCCCTGAAGCTGAGCTCTGTGACTGCCGCG GACACGGCCGTGTATTACTGTACAAGGGGGATT ACGATGGTTCGGGAGTTATCACTTCTACTACGG TATGACGTCTGGGGCCAAGGGACCACGGTCAC CGTCTCCTCA<br>SEQ ID NO: 30777 |

FIGURE 50
(Continued)

| | | | | |
|---|---|---|---|---|
| iPS:436017 | 21-225_193F3 | AA | EIVLTQSPGTLSLSPGERATLSCRASQSIRSSFLA WYQQKPGQAPRLLIYGASNRATGIPDRFSGSGS GTDFTLTISRLEPEDFAVYYCQQYGNSPWAFGQ GTKVEIK<br><br>SEQ ID NO: 26772 | QVQLQESGPGLVKPSQTLSLTCTVSGGSISSGDYYW NWIRQLPGKGLEWIGYIFYSGSTYYNPSLKSRLTISV DTSKNQFSLKLSSVTAADTAVYYCTRGDYDGSGSY HFYYGMDVWGQGTTVTVSS<br><br>SEQ ID NO: 30778 |
| | | NA | GAAATTGTGTTGACGCAGTCTCCAGGCACCCT GTCTTTGTCTCCAGGGGAAAGCGCCACCCTCT CCTGCAGGGCCGGTCAAAGTATTAGAACCGAC TTCTTAGTCTGGTACCAGCAGCAACCTGGCCA GGCTCCCAGGCTCCTCATCTATGGTGCATCCA GCAGGGCCACTGGCTCCCAGAGAGGTTCAGT GGCAGTGGGTCTGGGACAGACTTCACTCTCAC CATCAACAGACTGGAGCCTGAAGATTTTGCAG TGTATTACTGTCAGCAGTATGGAAGCTCACCG TGGACGTTCGGCCAAGGGACCAAGGTGGAAA TCAAT<br><br>SEQ ID NO: 26773 | CAGGTGCAACTGCAGGAGTCGGGCCAGGACTG GTGAAGCCTTCACAGACCCTGTCCCTCACCTGCA CTGTCTCTGGTGTGGCTCCATCAACAGTGGTGATTA CTACTGGAACTGATCGCCAGCACCCAGGGAA GGGCCTGGAGTGGATTGGGTACATCTTTTACAGT GGGAGCACCTACTACAACCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGGGGATT ACGATGGTTCGGGGAGTTATCACTACTATTACGG TATGGACGTCTGGGGCCAAGGGACCACGGTCAC CGTCTCCTCA<br><br>SEQ ID NO: 30779 |
| | | AA | EIVLTQSPGTLSLSPGESATLSCRAGQSIRTDFLV WYQQQPGQAPRLLIYGASSRATGFPERFSGSGSG TDFTLTNRLEPEDFAVYYCQQYGSSPWTFGQGT KVEIN<br><br>SEQ ID NO: 26774 | QVQLQESGPGLVKPSQTLSLTCTVSGGSINSGDYY WNWIRQHPGKGLEWIGYIFYSGSTYYNPSLKSRVTI SVDTSKNQFSLKLSSVTAADTAVYYCARGDYDGS GSYHYYGMDVWGQGTTVTVSS<br><br>SEQ ID NO: 30780 |

FIGURE 50
(Continued)

| | | | |
|---|---|---|---|
| iPS:436019 | 21-225_193C4 | NA | GACATCGAGATGACCCAGTCTCCATCTCCCT GTCTGCATCTGTTGGAGACAGAGTCACCATCA CTTGCCGGCCGAGTCAGGGCATTAGCATTTAT TTAGCCTGGTATCAGCAGAAACCAGGGAATGT TCCTAAGCTCCTGATCTATGCTGCATCCACTTT ACAATCAGGGGTCCCATCTCGGTTCAGTGGCA GTGGATCTGGGACAGATTTCACTCTCACCATC AGCAGCCTGCAGCCTGAAGATGTTGCAACTTA TTACTGTCAAAAGTATAACAGTGCCCCATTCA CTTTCGGCCCTGGGACCAAAGTGGATATCAAA<br><br>SEQ ID NO: 26775 |
| | | AA | DIQMTQSPSSLSASVGDRVTITCRPSQGISIYLAW YQQKPGNVPKLLIYAASTLQSGVPSRFSGSGSGT DFTLTISSLQPEDVATYYCQKYNSAPFTFGPGTK VDIK<br><br>SEQ ID NO: 26776 | GAGGTGCAGCTGTTGGAGTCTGGGGGAGGCTTG GCACAGCCTGGGGGGTCCCTGAGACTCTCCTGTG CAGCCTCTGGATTCACCTTTAGCAGCTATGCCAT GAACTGGGTCCGCCAGGCTCCAGGGAAGGGGCT GGAGTGGGTCTCAGCTATTATTGGTAATGGTGGT AGAACATACTACGCAGACTCCGTGAAGGGCCGG TTCTCCATCTGCAAATGAACAGCCTGAGAACACGC TGTTTCTGCAAATGAACAGCCTGAGAGCCGAGG ACACGGCCGTATATTACTGTGCGAAAGATCTGG TAGATACAGCTATGGTTCTTTGACTACTGGGGC CAGGGAACCCTGGTCACCGTCTCCTCA<br><br>SEQ ID NO: 30781 |
| | | | EVQLLESGGGLAQPGGSLRLSCAASGFTFSSYAMN WVRQAPGKGLEWVSAIIGNGGRTYYADSVKGRFSI SRDNSKNTLFLQMNSLRAEDTAVYYCAKDLGRYS YGFFDYWGQGTLVTVSS<br><br>SEQ ID NO: 30782 |
| iPS:436021 | 21-225_193G4 | NA | GACATCGTGATGACCCAGTCTCCAGACTCCCT GGCTGTGTCTCTGGGCGAGAGGGCCACCATCA ACTGCAAGTCCAGCCAGAGTGTTTTATACAGC TCCAACAATTATAAACTACTTGACTTGGTACCA GCAGAAACCAGGACAGCCTCCTAAGCTGCTCA TTTACTGGGCATCTACCCGAGAAATCCGGGGTC CCTGACCGATTCAGTGGCAGCGGGTCTGGGAC AGATTTCACTCTCACCATCAGCAGCCTGCAGG CTGAGGATGTGGCAGTTTATTACTGTCAGCAA TATTATATTACTCCGTGACGTTCGGCCAAGG GACCAAGGTGGACATCAAA<br><br>SEQ ID NO: 26777 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCATAAGAA CAGCCTACATGGAGCTGAACAGCTGAGATCTG GTGGCTGGTACTTCTTTGACTACTGCGAGTAGCA GTCCCTGGTCACCGTCTCCTCA<br><br>SEQ ID NO: 30783 |

FIGURE 50
(Continued)

| | | | | |
|---|---|---|---|---|
| | | AA | DIVMTQSPDSLAVSLGERATINCKSSQSVLYSSN NYNYLTWYQQKPGQPPKLLIYWASTRKSGVPD RFSGSGSGTDFTLTISSLQADDVAVYYCQQYYIT PWTFGQGTKVDIK<br><br>SEQ ID NO: 26778 | QVQLVQSGAEVKKPGASVKVSCKASGYTFTNYDIN WVRQATGQGLEWMGWMNPNSGNTGYAQKFQGR VTMTRNTSIRTAYMELNSLRSEDTAVYYCASSSGW YFFDYWGQGTLVTVSS<br><br>SEQ ID NO: 30784 |
| iPS:436023 | 21-225_193A5 | NA | GACATCCAGATGACCCAGTCTCCATCCTCCCT GTTTGCATCTGTAGGAGACAGAGTCATCATCT CTTGCCCGGGCAAGTCAGGGCATTAGAAATGAT TTAGGGTGGTATCAGCAGTATCCAGGGAAAGC CCCTAAGCGCGTGATTTATGCTGCATCCAGTT GCAAAGTGGGGTCCCATCAAGGTTCAGCGGCA GTGGATTTGGGACAGAATTCACTATCACAATC AGCAGGCGTGCAGCTGACATAATGATTTCCCGTTCAC TTACTGTCTACAGCATAATGATTTCCCGTTCAC TTTCGGCGGAGGGACCAAGGTGGAGATCAAA<br><br>SEQ ID NO: 26779 | CAGGTGCAGCTGGTGCAGTCTGGGGCTGAGGTG AAGAAGCCTGGGGCCTCAGTGAAGGTCTCCTGC AAGGCTTCTGGATACACCTTCATCAGTTATGATA TCAACTGGGTGCGACAGGCCACTGGACAAGGGC TTGAGTGGATGGGATGGATGAACCCTAAAAGGG GTAACACAGGCTATGCACAGAAGTTCCAGGGCA GAGTCACCATGACCAGGGACACACCTCCATAAGCA CAGCCTACATGGAGCTGAGCAGCCTGAGATCTG AGGACACGGCCGTTTATTACTGTGCGAGAGGAG ACCCGTATAACTGGAACTCCTACGTATGGACGT CTGGGGCCAAGGGGCCACGGTCACCGTCCTCA<br><br>SEQ ID NO: 30785 |
| | | AA | DIQMTQSPSSLFASVGDRVIISCRASQGIRNDLG WYQQYPGKAPKRVIYAASSLQSGVPSRFSGSGF GTEFTITISSVQPEDFETYCYCLQHNDFPFTFGGGT KVEIK<br><br>SEQ ID NO: 26780 | QVQLVQSGAEVKKPGASVKVSCKASGYTFISYDIN WVRQATGQGLEWMGWMNPKRGNTGYAQKFQGR VTMTRDTSISTAYMELSSLRSEDTAVYYCARGDPY NWNSYAMDVWGQGATVTVSS<br><br>SEQ ID NO: 30786 |

FIGURE 50
(Continued)

| | | | | |
|---|---|---|---|---|
| iPS:436025 | 21-225_193B5 | NA | GAAATTGTGCTGACTCAGTCTCCAGACTTTCA GTCTGTGACTCCAAAGGAGAAAGTCACCATCA CCTGCCGGGCCAGTCAGAGCATTGGTAGTAGC TTACACTGGTACCAGCAGAAACCAGATCAGTC TCCAAAGCTCCTCATCAAGTATGCTTCCCAGT CCTTCTCAGGGGTCCCCTCGAGGTTCAGTGGC AGTGGATCTGGGACAGATTTCACCCTCACCAT CAATAGCCTGGAAGCTGAAGATGCTGCAACGT ATTACTGTCATCAGAGTAGTCGTTTACCATTCA CTTTCGGCCCTGGGACCAAAGTGGATATCAAA

SEQ ID NO: 26781 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGTA CTACTGGAGCTGGATCCGCCAGCACCCAGGGAA GGGCCTGGAGTGGATTGGGTACATCTATTACAGT GGGAGCACCTACTACAACCCGTCCCTCAAGAGTC GAGTTACCATATCAGTAGACACGTCTAAGAACCA GTTCTCCCTGAAGCTGAGCTCTGTGGCTGCCGCG GACACGGCCGTGTATTATTGTGCGAGAGGAGAGT ATAACTGGAACCACGGTATGGACGTCTGGGGCC AAGGGACCACGGTCACCGTCTCCTCA

SEQ ID NO: 30787 |
| | | AA | EIVLTQSPDFQSVTPKEKVTITCRASQSIGSSLHW YQQKPDQSPKLLIKYASQSFSGVPSRFSGSGSGT DFTLTINSLEAEDAATYYCHQSSRLPFTFGPGTK VDIK

SEQ ID NO: 26782 | QVQLQESGPGLVKPSQTLSLTCTVSGGSISSGGYYW SWIRQHPGKGLEWIGYIYYSGSTYYNPSLKSRVTIS VDTSKNQFSLKLSSVAADTAVYYCARGEYNWNH GMDVWGQGTTVTVSS

SEQ ID NO: 30788 |
| iPS:436027 | 21-225_193E6 | NA | GAAATTGTGTTGACGCAGTCTCCAGGCACCCT GTCTTTGTCTCCAGGGGAAAGAGCCACCCTCT CCTGCAGGGCCAGTCAGAGTGTTAGGAGCGGT TACTTAGCCTGGTACCAGCAGAAACCTGGCCA GGCTCCCAGGCTCCTCATCTATGGTGCATCCA GCAGGGCCACTGGCATCCCAGACAGGTTCGGT GGCAGTGGGTCTGGGACAGACTTCACTCTCAC CATCAGCAGACTGGAGCCTGAAGATTTTGCAG TGTATTACTGTCAGCAGTATGAGAGTTCACCG TGGACGTTCGGCCAAGGGACCAAGGTGGAAA TCAAA

SEQ ID NO: 26783 | CAGGTGCAGCTACAGCAGTGGGGCGCAGGACTG TTGAAGCCTTCGGAGACCCTGTCCCTCACCTGCG CTGTCTTTGGTGGGTCCTTCAGTGGTCCCTACTGG AGTTGGATCCGCCAGCCCCAGGGAAGGGGCTG GAGTGGATTGGGGAATCCAATCATATAGTGGACGC ACCAACTACAACCCGTCCCTCAAGAGTCGAGTCA CCATATCAGTGGACACGTCCAAGAACCAGTTCTC CCTGAGGCTGAGCTCTGTGACCGCCGCGGACACG GCTGTGTATTACTGTGCGAGAGACTACGTGGTT TGGACTACTGGGGCCAGGGAACCCTGGTCACCGT CTCCTCA

SEQ ID NO: 30789 |

FIGURE 50
(Continued)

| | | | | |
|---|---|---|---|---|
| iPS-436029 | 21-225_193H6 | AA | EIVLAQSPGTLSLSPGERATLSCRASQSVRSGYLAWYQQKPGQAPRLLIYGASSRATGIPDRFGGSGSGTDFTLTISRLEPEDFAVYYCQQYESSPWTFGQGTKVEIK<br>SEQ ID NO: 26784 | QVQLQQWGAGLLKPSETLSLTCAVFGGSFSGPYWSWIRQPPGKGLEWIGESNHSGRTNYNPSLKSRVTISVDTSKNQFSLRLSSVTAADTAVYYCARDYGGLDYWGQGTLVTVSS<br>SEQ ID NO: 30790 |
| | | NA | GAAATTGTGTTGACGCAGTCTCCAGGCACCCTGTCTTTGTCTCCAGGGGAAAGCGCCACCCTCTCCTGCAGGGCCGGTCAAAGTATTAGAACCAACTTCTTAGCCTGGTACCAGCAGCAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAACAGACTGGAGCCTGAAGATTTTGCAGTGTATTTCTGTCAGCAGTATGGTAGCTCACCGTGGACGTTCGGCCAAGGGACCAAGGTGGAAATCAAT<br>SEQ ID NO: 26785 | CAGGTGCAACTGCAGGAGTCGGGCCCAGGACTGGTGAAGCCTTCACAGACCCTGTCCTCACCTGCACTGTCTCTGGTGGCTCCATCAACAGTGGTGATTACTACTGGAACTGGATCCGCCAGCACCAGGAAGGGCCTGGAGTGGATTGGGTACATCTTTTACAGTGGGAGCACCTACTACAACCGTCCCTCAAGAGTCGAGTTACCATATCAGTAGACACGTCTAAGAACCAGTTCTCCCTGAAGTCGAGCTCTGTGACTGCCGCGGACACGGCCGTGTATTACTGTGCGAGAGGGATTACGATGGTTCGGGGAGTTATCACTACTATTACGGTATGGACGTCTGGGGCCAAGGGACCACGGTCACCGTCTCCTCA<br>SEQ ID NO: 30791 |
| | | AA | EIVLTQSPGTLSLSPGESATLSCRAGQSIRTNFLAWYQQQPGQAPRLLIYGASSRATGIPDRFSGSGSGTDFTLTINRLEPEDFAVYFCQQYGSSPWTFGQGTKVEIN<br>SEQ ID NO: 26786 | QVQLQESGPGLVKPSQTLSLTCTVSGGSINSGDYYWNWIRQHPGKGLEWIGYIFYSGSTYYNPSLKSRVTISVDTSKNQFSLKLSSVTAADTAVYYCARGDYDGSGSYHYYYGMDVWGQGTTVTVSS<br>SEQ ID NO: 30792 |

FIGURE 50
(Continued)

| | | | | |
|---|---|---|---|---|
| iPS:436031 | 21-225_193C7 | NA | GACATCCAGATGACCCAGTCTCCATCCTCACTGTCTGCATCTGTAGGAGACAGAGTCACCATCACTTGTCGGGCGAGTCAGGGCATTGGCAAGTATTTAGCCTGGTTTCAGCAGAAACCAGGGAAAGCCCCTAAGTCCCTGATCTATGCTGCATCCAGTTTGCAAAGTGGGGTCCCATCAAGGTTCAGCGGCAGTGGATCTGGGACAGATTTCACTCTCACCATCAGCAGCCTGCAGCCTGAAGATTTTGCAACTTATTACTGCCAACAGTATTACTACCGCTCACTTTCGGCGGAGGGACCAAGGTGGAGATCAAA<br>SEQ ID NO: 26787 | CAGGTGCAGCTGGTGGAGTCTGGGGGAGGCGTGGTCCAGCCTGGGAGGTCCCTGAGACTCTCCTGTGCAGCCTCTGGATTCACCTTCAGTAGCTATGGCATGCACTGGGTCCGCCAGGCTCCAGGCAAGGGGCTGGAGTGGGTGGCAGTTATATGGTATGATGGAAGTAATAAAAACTACGAGACTCCGTGAAGGGCCGATTCACCATCTCCAGAGACAATTCCAAGAACACGCTGTATCTGCAAATGAACAGCCTGAGAGCCGAGGACACGGCTATGTATTACTGTGCGAGAGATCAGGGCGTGGGCTACGACGGCTTGGACGTCTGGGGCCAAGGGACCCTGGTCACCGTCTCCTCA<br>SEQ ID NO: 30793 |
| | | AA | DIQMTQSPSSLSASVGDRVTITCRASQGIGKYLAWFQQKPGKAPKSLIYAASSLQSGVPSKFSGSGSGTDFTLTISSLQPEDFATYYCQQYYYRSLFGGGTKVEIK<br>SEQ ID NO: 26788 | QVQLVESGGGVVQPGRSLRLSCAASGFTFSSYGMHWVRQAPGKGLEWVAVIWYDGSNKNYADSVKGRFTISRDNSKNTLYLQMNSLRAEDTAMYYCARDQGVGYDGLDVWGQGTLVTVSS<br>SEQ ID NO: 30794 |
| iPS:436033 | 21-225_193E7 | NA | GACATCCAGATGACCCAGTCTCCATCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTAATCTATTCTGCATCCAGTTTGCAAAGGGGGGTCCCATCAAGATTCAGCGGCAGTGGATCTGGGACAGAATTCACTCTCACAATCAGCAGCCTGCAGCCTGAAGATATAAAAGTACCCGCTCATTACTGTCTACAGCATAATAGTACCCCGCTCACTTTCGGCGGAGGGACCAAGGTGGAGATCAAA<br>SEQ ID NO: 26789 | CAGGTGCAGCTACAGCAGTGGGGCGCAGGACTGTTGAAGCCTTCGGAGACCCTGTCCCTCACCTGCGCTGTCTATGGTGGGTCCTTCAGTGGTTACTTCTGGAGCTGGATCCGCCAGCCCCCAGGGAAGGGGCTGGAGTGGATTGGGGAAATCAATCATAGTGGAAGCACCAACTACAACCCGTCCCTCAAGAGTCGCGTCACCATATCAGTAGACACGTCCAAGAACCAGTTCTCCCTGAAGCTGAGCTCTGTGACCGCCGCGGACACGGCTGTGTATTACTGTGCGAGAGACTACGGTGCTGACTACTGGGGCCAGGGAACCCTGGTCGCCGTCTCCGCA<br>SEQ ID NO: 30795 |

FIGURE 50
(Continued)

| | | | | |
|---|---|---|---|---|
| iPS:436035 | | AA | DIQMTQSPSSLSASVGDRVTITCRASQGIRNDLG WYQQKPGKAPKRLIYSASSLQRGVPSRFSGSGS GTEFTLTISSLQPEDFATYYCLQHKRYPLTFGGG TKVEIK<br>SEQ ID NO: 26790 | QVQLQQWGAGLLKPSETLSLTCAVYGGSFSGYFW TWIRQPPGKGLEWIGEINHSGSTNYNPSLKSRVTISV DTSKNQFSLKLSSVTAADTAVYYCARDYGADYWG QGTLVAVSA<br>SEQ ID NO: 30796 |
| | 21-225_193C8 | NA | GAAATTGTGTTGACGCAGTCTCCAGGCACCCT GTTTTTGTCTCCAGGGGAAAGAGCCACCCTCT CCTGCAGGGCCAGTCAGAGTATTCGCAGCAGC TTCTTAGCCTGGTACCAGCAGAAACCTGGCCA GGCTCCCAGGCTCCTCATCTATGGTGCATCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAATATGGTAACTCACCG TGGGCGTTCGGCCAAGGGATCAAGGTGGAAG TCAAA<br>SEQ ID NO: 26791 | CAGGTGCAGCTGCAGGAGTCGGGCCAGGACTG GTGAAGCCTTCACAGACCCTGTCCCTCACCTGCA CTGTCTCTGGTGGCTCCATCAGCAGTGGTGATTA CTACTGGAACTGGATCCGCCAGCACCCAGGGAA GGGCCTGGAGTGGATTGGGTACATCTTTTACAGT GGGAGCACCTACTACAACCGTCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGGGGATT ACGATGGTTCGGGGAGTTATCACTACTACTACGG TATGGACGTCTGGGGCCAAGGGACCACGGTCAC CGTCTCCTCA<br>SEQ ID NO: 30797 |
| | | AA | EIVLTQSPGTLFLSPGERATLSCRASQSIRSSFLA WYQQKPGQAPRLLIYGASSRATGIPDRFSGSGSG TDFTLTISRLEPEDFAVYYCQQYGNSPWAFGQGI KVEVK<br>SEQ ID NO: 26792 | QVQLQESGPGLVKPSQTLSLTCTVSGGSISSGDYYW NWIRQHPGKGLEWIGYIFYSGSTYYNPSLKSRVTIS VDTSKNQFSLKLSSVTAADTAVYYCARGDYDGSG SYHYYGMDVWGQGTTVTVSS<br>SEQ ID NO: 30798 |

FIGURE 50
(Continued)

| | | | |
|---|---|---|---|
| iPS:436037 | 21-225_193D8 | NA | GAAATTGTGTTGTTGAAGCAGTCTCCAGGCACCCT GTTTTTGTCTCCAGGGGAGAGAGCCACCTCT CCTGCAGGGCCAGTCAGAGTATAAGAGACCAA CTTCTTAGCCTGGTACCAGCAGAAACCTGGCC AGGCTCCCAGGCTCCTCATCTATGGTGCATC CAGGCTCCACTGGCATCCCAGACAGTTCAG TGGCAGTGGGTCTGGGACAGACTTCACTCTCA CCATCAACAGACTGGAGCCTGAAGATTTTGCA GTGTATTACTGTCAGCAGTATGTAACTCACC GTGGACGTTCGGCCAAGGGACCAAGGTGGAA ATCAAA<br>SEQ ID NO: 26793 | CAGGTGCAGCTGCAGGAGTCGGGCCCAGGACTG GTGAAGCCTTCACAGACCCTGTCCCTCACTGCA CTGTCTCTGGTGGCTCCATCAACAGTGGTGTTA CTACTGGAACTGGATCCGCCAGCACCCAGGGAA GGGCCTGGAGTGGATTGGGTTCATCTTTTACAGT GGGAGCACCTACTACAACCCGTCCCTCAAGAGTC GAGTTTCCATATCAGTAGACACGTCTAAGAACCA GTTCTCCCTGAAGCTGAGCTCTGTGACTGCCGCG GACACGGCCGTGTATTACTGTGCGAGAGGGATT ACGATGGTTCGGGAGTTATCACTACTATTACGG TATGGACGTCTGGGGCCAGGGGACCACGGTCAC CGTCTCCTCA<br>SEQ ID NO: 30799 |
| | | AA | EIVLKQSPGTLFLSPGERATLSCRASQSIRTNFLA WYQQKPGQAPRLLIYGASSRATGIPDRFSGSGSG TDFTLTINRLEPEDFAVYYCQQYGNSPWTFGQG TKVEIK<br>SEQ ID NO: 26794 | QVQLQESGPGLVKPSQTLSLTCTVSGGSINSGGYY WNWIRQHPGKGLEWIGFIFYSGSTYYNPSLKSRVSI SVDTSKNQFSLKLSSVTAADTAVYYCARGDYDGS GSYHYYYGMDVWGQGTTVTVSS<br>SEQ ID NO: 30800 |
| iPS:436039 | 21-225_193F8 | NA | GACATCCAGATGATCCAGTCTCCATCCTCACT GTCTGCATCTGTAGGAGACAGAGTCACCATCA CTTGTCGGGCCAGTCAGGGCGTTAGCAATCAT TTAGCCTGGTTTCAGCAGAAACCAGGGAGAGC CCCTAAGTCCCTGATCTATGCTGCATCCAGTTT GCAAAGTGGGGTCCCATCAAGGTTCAGGGCA GTGGATCTGGGACAGATTTCACTCTCACCATC AGCAGCCTGCAGCCTGAAGATATAGTTACCTA TTACTGCCAACAGTATAATAGTTACCCATTCA CTTTCGGCCCTGGGACCAAAGTGGATATCAAA<br>SEQ ID NO: 26795 | CAGGTGCAGCTGGTTGGAGTCTGGGGAGGCGTG GTCCAGCCTGGGGAGGTCCCTGAGACTCTCCTGTG CAGCGTCTGGATTCACCTTCAGTATCTATGGCAT GGACTGGGTCCGCCAGGCTCCAGGCAAGGGGCT GGAGTGGGTGGCAGTTATATGGTATGATGGAAGT TATAAATACTATGCAGAGACTCCGTGAAGGGCCGAT TCACCATCTCCAGAGACAATTCCAAGAACACGCT GTATCTGCAAATGAACAGCCTGAGAGCCGAGGA CACGGCCGTGTATTATTGTGTGAGAGAGGATTCC CCTTATAGTGGCTACGGCTTGGACTACTACTACG GTATGGACGTCTGGGGCCAAGGGACCACGGTCA CCGTCTCCTCA<br>SEQ ID NO: 30801 |

FIGURE 50
(Continued)

| | | | |
|---|---|---|---|
| | | AA | DIQMIQSPSSLSASVGDRVTITCRASQGVSNHLA WFQQKPGRAPKSLIYAASSLQSGVPSKFSGSGSG ADFTLTISSLQPEDFATYYCQQYNSYPFTFGPGT KVDIK<br><br>SEQ ID NO: 26796 | QVQLVESGGGVVQPGRSLRLSCAASGFTFSIYGMD WVRQAPGKGLEWVAVIWYDGSYKYYADSVKGRF TISRDNSKNTLYLQMNSLRAEDTAVYYCVREDSPY SGYGLDYYYGMDVWGQGITVTVSS<br><br>SEQ ID NO: 30802 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTAGAACCAAC TTCTTAGCCTGGCACCAGCAGAAAACCTGGCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAACAGACTGGAGCCTGAAGATTTTGCAC TGTATTACTGTCAGCAGTATGGTAACTCACCG TGGACGTTCGGCCAAGGGACCAAGGTGGAAA TCAAA<br><br>SEQ ID NO: 26797 | CAGGTGCAGCTGCAGGAGAAAGGCCAGGACTG GTGAAGCCTTCACAGACCCTGTCCCTCACCTGCA CTGTCTCTGGTGGCTCCGTCAGCAGTGGTGTTTA CTACTGGAGCTGGATCCGCCAGCACCAGGGAA GGGCCTGGAGTGGATTGGGAACATCTATTACAGT GGGAGCACCTACAACAACCCGTCCCTCAAGAGT CGAGTTACCATATCAGTAGACACGTCTAAGAACC AGTTCTCCCTGAAGCTGAACTCTGTGACTGCCGC GGACACGGCCGTCTATTACTGTGCGCGAGGGGAT TACGATGGTTCGGGGAGTTATCACTTCTACTACG GTTTGGACGTCTGGGGCCATGGGACCACGGTCAC CGTCTCCTCA<br><br>SEQ ID NO: 30803 |
| iPS:436041 | 21-225_193G8 | AA | EIVLTQSPGTLSLSPGERATLSCRASQSVRTNFLA WHQQKPGQAPRLLIYGASRRATGIPDRFSGSGSG TDFTLTINRLEPEDFALYCQQYGNSPWTFGQG TKVEIK<br><br>SEQ ID NO: 26798 | QVQLQEKGPGLVKPSQTLSLTCTVSGGSVSSGVYY WSWIRQHPGKGLEWIGNIYYSGSTYNNPSLKSRVTI SVDTSKNQFSLKLNSVTAADTAVYYCARGDYDGS GSYHFYYGLDVWGHGTTVTVSS<br><br>SEQ ID NO: 30804 |

FIGURE 50
(Continued)

| | | | |
|---|---|---|---|
| iPS:436043 | 21-225_193G9 | NA | GAAATTGTACTGACTCAGTCTCCAGATTTTCA GTCTGTGACTCCAAAGGAGAAAGTCACCATCA CCTGCCGGGCCAGTCAGAGCATTGGTAGGAGT TTACACTGGTACCAGCAGAGACCAGATCAGTC TCTAAAGCTCCTCATCAAGTATGCTTCCCAGTC ATTCTCAGGGGTCCCCTCGAGTTCAGTGGCA GTGGATCTGGGACAGATTCACCCTCACCATC AATAGCCTGGAGGCTGAAGATGCTGCAACGTA TTTCTGTCATCAGAGTAGTCGTTTACCGCTCAC TTTCGGCGGAGGGACCAAGGTGGAGATCAAA | CAGGTGCAGCTGCAGGAGTCGGGCCCAGGACTG GTGAAGCCTTCACAGACCCTGTCCCTCACCTGCA CTGTCTCTGGTGACTCCATCAATAATGGTGGATA CTACTGGAGCTGGATCCGCCAGCACCCAGGGAA GGGCCTGGAGTGGATTGGGTACATCTTTTACAGC GGGAGCACCTACTACAACCCGTCCCTCAAGAGTC GAGTTACCATATCAGTTGACACGTCTAAGAATCA GTTCTCCCTGAAGCTGAACTCTGTGACTGCCGCG GACACGGCCGTGTATTTTTGTGCGAGAGCGGGAT ATAACTGGGACAACGGTTTGACTACTGGGGCC AGGGAACCCTGGTCACCGTCCTCA |
| | | | SEQ ID NO: 26799 | SEQ ID NO: 30805 |
| | | AA | EIVLTQSPDFQSVTPKEKVTITCRASQSIGRSLHW YQQRPDQSLKLLIKYASQSFSGVPSRFSGSGSGT DFTLTINSLEAEDAATYFCHQSSRLPLTFGGGTK VEIK | QVQLQESGPGLVKPSQTLSLTCTVSGDSINNGGYY WSWIRQHPGKGLEWIGYIFYSGSTYYNPSLKSRVTI SVDTSKNQFSLKLNSVTAADTAVYFCARAGYNWD NGFDYWGQGTLVTVSS |
| | | | SEQ ID NO: 26800 | SEQ ID NO: 30806 |
| iPS:436045 | 21-225_193A10 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTATGCTGCATCCAGTTT GCAAAGTGGGGTCCCATCAAGGTTCAGCGGCA GTGGATCTGGAACAGCTGAAACAGCCTGAGG AGCAGCCTGCCAACATTATCTTACTCTCTCAC TTTCGGCGGAGGGACCAAGGTGGAGATCAAA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGAAGT AATGAACACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATAGGGG GGTGGGTTACTACGGTTTGGACGTCTGGGGCCAA GGGACCACGGTCACCGTCTCCTCA |
| | | | SEQ ID NO: 26801 | SEQ ID NO: 30807 |

FIGURE 50
(Continued)

| | | AA | DIQMTQSPSSLSASVGDRVTITCRASQGISNYLA WFQQKPGKAPKSLIYAASSLQSGVPSKFSGSGSG TDFTLTISSLQPEDFATYFCQHYLTYPLTFGGGT KVEIK<br><br>SEQ ID NO: 26802 | QVQLVESGGGVVQPGRSLRLSCAASGFTFSSYGMH WVRQAPGKGLEWVAVIWYDGSNEHYADSVKGRF TISRDNSKNTLYLQMNSLRAEDTAVYYCARDRGV GYYGLDVWGQGTTVTSS<br><br>SEQ ID NO: 30808 |
|---|---|---|---|---|
| iPS-436047 | 21-225_193B10 | NA | GAAATTGTGTTGACGCAGTCTCCAGGCACCCT GTCTTTGTCTCCAGGGGAAAGAGCCACCCTCT CCTGCAGGGCCAGTCCAGTGTTAGCAGCAGC TACTTAGCCTGGTACCAGCAAAAACCTGGCCA GGCTCCCAGGCTCGTCATCTATGGTGCATCCA GGAGGGCCACTGGCATCCCAGACAGGTTCAG AGGCAGTGGGTCTGGGACAGATTCACTCTCA CCATCAGTAGACTGGAGCCTGAAGATTTTGCA GTGTATTACTGTCAGCAGTATGGTAGCTCACC TCCGTGGACGTTCGGCCAAGGGACCAAGGTGG AAATCAAA<br><br>SEQ ID NO: 26803 | GAGGTGCAGTTGGTGGAGTCTGGGGGAGGCTG GTCAAGCCTGGGGGGTCCCTGAGACTCTCCTGTG CAGCCTCTGGATTCACCTTCAGGGACTATAGCAT GAACTGGGTCCGCCAGGCTCCAGGGAAGGGGCT GGAGTGGGTCTCATCCATTAGTAGTGCTGGTGGT TACATATACTACGCAGACTCACTGAAGGGCCGAT TCACCATCTCCAGAGACAACGCCAAAAACTCACT GTATCTGCAAATGAACAGCCTGAGAGCCGAGGA CACGGCTGTGTATTACTGTGCGAGAGCAACTATG GCCCTTGACTACTGGGGCCAGGGAACCCTGGTCA CCGTCTCCTCA<br><br>SEQ ID NO: 30809 |
| | | AA | EIVLTQSPGTLSLSPGERATLSCRASPSVSSSYLA WYQQKPGQAPRLVIYGASRRATGIPDRFRGSGS GTDFTLTISRLEPEDFAVYYCQQYGSSPPWTFGQ GTKVEIK<br><br>SEQ ID NO: 26804 | EVQLVESGGGLVKPGGSLRLSCAASGFTFRDYSMN WVRQAPGKGLEWVSSISSAGGYIYYADSLKGRFTI SRDNAKNSLYLQMNSLRAEDTAVYYCARATMALD YWGQGTLVTVSS<br><br>SEQ ID NO: 30810 |

FIGURE 50
(Continued)

| | | | |
|---|---|---|---|
| iPS:436049 | 21-225_193B12 | NA | GAAATTGTTGACGCAGTCTCCAGGCACCCT GTCTTTGTCTCCAGGGGAAAGAGCCACCCTCT CCTGCAGGGCCAGTCAGTATTCGCAGCAGC TTCTTAGCCTGGTATCAGCAGAAACCTGGCCA GGCTCCCAGGCTCCTCATCTATGATGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAACTCACCG TGGGGCGTTCGGCCAAGGGACCAAGGTGGAAA TCAAA<br><br>SEQ ID NO: 26805 | CAGGTGCAGCTGCAGGAGTCGGGCCCAGGACTG GTGAAGCCTTCACAGACCCTGTCCCTCACCTGCA CTGTCTCTGGTGCTCCATCAGCAGTGCTGATTA CTACTGGAACTGGATCCGCCAGTCCCAGGGAA GGGCCTGGAGTGGATTGGGTACATCTTTACAGT GGGAGCACCTACTACAACCCGTCCTCAAGAGTC GACTTACCATATCAGTGGACACGTCTAAGAACCA GTTCTCCCTGAAGCTGAGCTCTGTGACTGCCGCG GACACGGCCGTGTATTACTGTGCGAGAGGGGATT ACGATGGTTCGGGGAGTTATCACTTCTACTACGG TATGGACGTCTGGGGCCAAGGGACCACGGTCAC CGTCTCCTCA<br><br>SEQ ID NO: 30811 |
| | | AA | EIVLTQSPGTLSLSPGERATLSCRASQSIRSSFLA WYQQKPGQAPRLLIYDASSRATGIPDRFSGSGSG TDFTLTISRLEPEDFAVYYCQQYGNSPWAFGQG TKVEIK<br><br>SEQ ID NO: 26806 | QVQLQESGPGLVKPSQTLSLTCTVSGGSISSADYYW NWIRQLPGKGLEWIGYIFYSGSTYYNPSLKSRLTISV DTSKNQFSLKLSSVTAADTAVYYCARGDYDGSGS YHFYYGMDVWGQGTTVTVSS<br><br>SEQ ID NO: 30812 |
| iPS:436051 | 21-225_193G12 | NA | GAAATAGTGATGACGCAGTCTCCAGCCACCCT GTCTGTGTCTCCAGGGGAAAGAGCCACCCTCT CCTGCAGGGCCAGTCAGAGTGTTAGCAGCAGC TTAGCCTGGTATCAGCAGAAACCTGGCCAGGC TCCCAGGATCCTCATCTCTGGTGCATCCACCA GGGCCACTGGTATCCCAGCCAGGTTCAGTGGC AGTGGGTCTGGGACAGAGTTCACTCTCACCAT CAGCAGCCTGCAGTCTGCAGATATTAACTGGCCTGC ATTACTGCCAGCAGTATAATAACTGGCCGTGC AGTTTTGGCCAGGGGACCAAGCTGGAGATCAA A<br><br>SEQ ID NO: 26807 | CAGGTGCAGCTGGTGGAGTCTGGGGGAGGCGTG GTCCAGCCTGGGAGGTCCCTGAGACTCTCCTGTG GAGCGTCTGGATTCACCTTCAGTAGCTATGCCAT GCACTGGGTCCGCCAGGCTCCAGGCAAGGGGCT GGAGTGGGTGGCAGTTATATGGAGACTCCGTGAAGGGCCGA AATAATACTATGGAGACTCCGTGAAGGGCCGA TTCACCATCTCCAGAGACAATTCCAAGAACACGC TGAATCTGCAAATGAACAGCCTGAGAGCCGAGG ACACGGCTGTCTATTACTGTGCGAGAGATTTCAC TATAACTGAGCTACATATTTGACTACTGGGGC CAGGGAACCCTGGTCACCGTCTCCTCA<br><br>SEQ ID NO: 30813 |

FIGURE 50
(Continued)

| | | | | |
|---|---|---|---|---|
| iPS:436054 | | AA | EIVMTQSPATLSVSPGERATLSCRASQSVSSSLA WYQQKPGQAPRILISGASTRATGIPARFSGSGSG TEFTLTISSLQSADFAVYYCQQYNNWPCSFGQG TKLEIK<br>SEQ ID NO: 26808 | QVQLVESGGGVVQPGRSLRLSCGASGFTFSSYAMH WVRQAPGKGLEWVAVIWYDGTNKYYGDSVKGRF TISRDNSKNTLNLQMNSLRAEDTAVYYCARDFTIT GATYFDYWGQGTLVTVSS<br>SEQ ID NO: 30814 |
| | 21-225_194C1 | NA | GACATCCAGATGACCCAGTCTCCATCCTCACT GTCTGCATCTGTAGGAGACAGAGTCACCATCA CTTGTGGGCGAGTCAGGCATTAGCAATTAT TTAGCCTGGTTTCAGCAGAAACCAGGAAAGC CCCTAAGTCCCTGATCTATGCTGCATCCAGTTT GCAAAGTGGGGTCCCATCAAAGTTCAGCGGCA GTGGATCTGGAACAGATTTCACTCTCACCATC AGCAGCCTGCAGCCTGAAGATTTTGCAACTTA TTACTGCCTACATTATCTTACTTACCCTCTCAC TTTCGGCGGAGGGACCAAGGTGGAGATCAAA<br>SEQ ID NO: 26809 | CAGGTGCAGCTGGTGGAGTCTGGGGGAGGCGTG GTCCAGCCTGGGAGGTCCCTGAGACTCTCTGTG CAGCGTCTGATTCACCTTCAGTAGCTATGCAT GCACTGGGTCCGCCAGGCTCCAGGCAAGGGCT GGAGTGGGTGGCAGTTATATGGTATGATGAAGT AATGAACACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAAATAGGGG GGTGGGTTACTACGGTTTGGACGTCTGGGGCCAA GGGACCACGGTCACCGTCTCCTCA<br>SEQ ID NO: 30815 |
| | | AA | DIQMTQSPSSLSASVGDRVTITCRASQGISNYLA WFQQKPGKAPKSLIYAASSLQSGVPSKFSGSGSG TDFTLTISSLQPEDFATYYCLHYLTYPLTFGGGT KVEIK<br>SEQ ID NO: 26810 | QVQLVESGGGVVQPGRSLRLSCAASGFTFSSYGMH WVRQAPGKGLEWVAVIWYDGSNEHYADSVKGRF TISRDNSKNTLYLQMNSLRAEDTAVYYCARNRGV GYYGLDVWGQGTTVTVSS<br>SEQ ID NO: 30816 |

FIGURE 50
(Continued)

| | | | |
|---|---|---|---|
| iPS:436056 | 21-225_194C3 | NA | GAAATTGTGCTGACTCAGTCTCCAGACTTCA GTCTGTGGCTCCAAAGGAGAAAGTCACCATCA CCTGCCGGGCCAGTCAGAGTATTGGTAGTAAC TTACACTGGTACCAGCAGAAACCTGATCAGTC TCCAAAGCTCCTCATCAAGTCTGCTTCCCAGTC CTTCTCAGGGGTCCCCTCGAGGTTCAGTGGCA GTGGATCTGGGACAGATTTCACCCTCACCATC AATAGCCTGGAAACTGAAGATGCTGCAACGTA TTACTGTCAGCAGAGTAGTTTACCGTGGA CGTTCGGCCAAGGGACCAAGGTGGAAATCAA A |
| | | | SEQ ID NO: 26811 |
| | | AA | EIVLTQSPDFQSVAPKEKVTITCRASQSIGSNLHW YQQKPDQSPKLLIKSASQSFSGVPSRFSGSGSGT DFTLTINSLETEDAATYYCQQSSSLPWTFGQGTK VEIK |
| | | | SEQ ID NO: 26812 |
| iPS:436058 | 21-225_194A4 | NA | GAAATTGTGTTGACGCAGTCTCCAGGCACCCT GTCTTTGTCTCCAGGGGAAAGAGCCACCCTCT CCTGCAGGGCCAGTCGGGTGTTAGCAACATC TACTTAGCCTGGTACCAACAGAAACCTGGCCA GGCTCCCAGGCTCCTCATCTATGGTGCTTCCA ACAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCACAATGATTACTCAATG TTCACTTTCGGCCCTGGGACCAAAGTGGATAT CAAA |
| | | | SEQ ID NO: 26813 |
| | | | CAGGTGCAGTTGGTGCAATCTGGGACTGAGGTGA AGAAGCCTGGGCCTCTTTGAAGGTCTCCTGCAA GGCTTCTGATACACCTTCACCGTCTACTATTTG AACTGGGTGCGACAGGCCCCTGGACAAGGGCTT GAGTGGATGGGATGGATCAACCCTAACAGTGGT GGCACAAACTATGCACAGAAGTTTCAGGGCAGG GTCACCATGACCAGGGACACGTCCATCAGCACA GCCTACATGGAACTGAGCAGGCTGAGATCTGAC GACACGGCCGTGTATTACTGTGCGAGAGGCTACG ATATTTGACTGGTTGGGGCCAGGGAACCCTGGT CACCGTCTCCTCA |
| | | | SEQ ID NO: 30819 |
| | | | CAGGTGCAGTGTGCAGGAGTCGGGCCCAGGACTG GTGAAGCCTTCGGAGACCCTGTCCCTCACCTGCA CTGTCTCTGGTGGCTCCATCAATAATTACTACTG GAGCTGGATCCGGCAGCCCGCCGGGAAGGGACT GGAGTGGATTGGGCGTATCTATGCCAGTGGGAGC ACCAACTACAACCCCTCCCTCAAGAGTCGAGTCA CCATGTCAATAGACACGTCCAAGAACCAGTTCTC CCTGAAGCTGAGCTCTGTGACCGCCGCGGACACG GCCGTGCATTACTGTGCGAGAGATCGGGGATACT ATGGTACTACGGTATGGACGTCTGGGGCCAAG GGACCACGGTCACCATCTCCTCA |
| | | | SEQ ID NO: 30817 |
| | | | QVQLQESGPGLVKPSETLSLTCTVSGGSINNYYWS WIRQPAGKGLEWIGRIYASGSTNYNPSLKSRVTMSI DTSKNQFSLKLSSVTAADTAVHYCARDRGYYGYY GMDVWGQGTTVTISS |
| | | | SEQ ID NO: 30818 |

FIGURE 50
(Continued)

| | | | |
|---|---|---|---|
| iPS:436060 | 21-225_194F4 | AA | EIVLTQSPGTLSLSPGERATLSCRASRGVSNIYLA WYQQKPGQAPRLLIYGASNRATGIPDRFSGSGS GTDFTLTISRLEPEDFAVYYCQHNDYSMFTFGPG TKVDIK<br>SEQ ID NO: 26814 | QVQLVQSGTEVKKPGASLKVSCKASGYTFTVYYL NWVRQAPGQGLEWMGWINPNSGGTNYAQKFQGR VTMTRDTSISTAYMELSRLRSDDTAVYYCARGYDI LTGWGQGTLVTVSS<br>SEQ ID NO: 30820 |
| | | NA | GATATTGTGATGACCCAGACTCCACTCTCTCT GTCCGTCACCCCTGGACAGCCGGCCTCCATCT CCTGCAAGTCTAGTCAGAGCCTCCTCCATAGT GATGGAAAGGACCTATTTGTATTGGTACCTGCA GAAGCCAGGCCAGCCTCCACAGCTCCTGATCT GTGAGGTTCCAACCGGTTCTCTGGAGTGCCA GATAGGTTCAGTGGCAGCGGGTCAGGGACAG ATTTCACACTGAAAATCAGCCGGGTGGAGGCT GGGGATGTTGGGGTTTATTACTGCATGCAAAG TATACAGCTTCCCTGGACGTTCGGCCAAGGGA CCAAGGTGGAAATCAAA<br>SEQ ID NO: 26815 | CAGCTGCAGCTGCAGGAGTCGGGCCCAGGACTG GTGAAGCCTTCGGAGACCCTGTCCCTCACCTGCA CTGTCTCTGGTGGCTCCATCAGTAGTTACCACTG GAGCTGGATCCGGCAGCCCGCCGGGAAGGACT GGAGTGGATTGGACTTATCTATACCAGTAGGAGC ACCAACTACAACCCCTCCCTCAAGAGTCGAGTCA CCATGTCAGTAGACACGGTCCAAGAGCCAGTTCTC CCTGAAGCTGAGCTCTGTGACCGCCGCGGACACG GCCGTGTATTACTGTGCGAGACTCCGGTATAACT GGAACTTCCCTTACTTTGACTACTGGGGCCAGGG AACCCTGGTCACCGTCTCCTCA<br>SEQ ID NO: 30821 |
| | | AA | DIVMTQTPLSLSVTPGQPASISCKSSQSLLHSDGR TYLYWYLQKPGQPPQLLICEVSNRFSGVPDRFSG SGSGTDFTLKISRVEAGDVGVYYCMQSIQLPWT FGQGTKVEIK<br>SEQ ID NO: 26816 | QLQLQESGPGLVKPSETLSLTCTVSGGSISSYHWSW IRQPAGKGLEWIGLIYTSRSTNYNPSLKSRVTMSVD RSKSQFSLKLSSVTAADTAVYYCARLRYNWNFPYF DYWGQGTLVTVSS<br>SEQ ID NO: 30822 |

FIGURE 50
(Continued)

| | | | |
|---|---|---|---|
| iPS:436062 | 21-225_194E5 | NA | GAAATTGTGTTGACGCAGTCTCCAGGCACCCT GTCTTTGTCTCCAGGGGAAAGCGCCACCCTCT CCTGCAGGGCCGGTCAGTCAAAGTATTAGAACCAAC TTCTTAGCCTGGTACCAGCAGAAACCTGGCCA GGCTCCCAGGCTCCTCATCTATGGTGCATCA GCAGGGCCACTGGCATCCCAGACAGGTTCAGT GGCAGTGGGTCTGGGACAGACTTCACTCTCAC CATCAACAGACTGGAGCCTGAAGATTTTGCAG TGTATTACTGTCAGCAGTATGGTAGTTCACCG TGGACGTTCGGCCAAGGGACCAAGGTGGAAA TCAAA<br><br>SEQ ID NO: 26817 | CAGGTGCAACTGCAGGAGTCGGGCCCAGGACTG GTGAAGCCTTCGGTCTCCCTGTCCCTCACCTGCA CTGTCTCTGGTGGCTCCATCAACAGTGGTGATTA CTACTGGAACTGGATCCGCCAGCACCCAGGGAA GGGCCTGGAGTGGATTGGGTACATCTTTTACAGT GGGAGCACCTACTACAACCCGTCCCTCAAGAGTC GAGTTACCATATCAGTAGACACGTCTAAGAACCA GTTCTCCCTGAAGCTGAGCTCTGTGACTGCCGCG GACACGGCCGTATATTACTGTGCGAGAGGGATT ACGATGGTTCGGGGAGTTATCACTACTATTACGG TATGGACGTCTGGGGCCAAGGGACCACGGTCAC CGTCTCCTCA<br><br>SEQ ID NO: 30823 |
| | | AA | EIVLTQSPGTLSLSPGESATLSCRAGQSIRTNFLA WYQQKPGQAPRLLIYGASSRATGIPDRFSGSGSG TDFTLTINRLEPKDFAVYYCQQYGSSPWTFGQG TKVEIK<br><br>SEQ ID NO: 26818 | QVQLQESGPGLVKPSQTLSLTCTVSGGSINSGDYY WNWIRHHPGKGLEWIGYIFYSGSTYYNPSLKSRVTI SVDTSKNQFSLKLSSVTAADTAVYYCARGDYDGS GSYHYYGMDVWGQGTTVTVSS<br><br>SEQ ID NO: 30824 |
| iPS:436064 | 21-225_194E6 | NA | GAAATTGTGTTGACGCAGTCTCCAGGCACCCT GTCTTTGTCTCCAGGGGAAAGAGCCACCCTCT CCTGCAGGGCCAGTCAGAGTATTAGAAGCAAC TTCTTAGCCTGGTATCAGCAGAAACCTGGCCA GGCTCCCAGGCTCCTCATCTATGGTGCATCA GCAGGGCCACTGGCATCCCAGACAGGTTCAGT GGCAGTGTGTCTGGGACAGACTTCACTCTCAC CATCAACAGACTGGAGCCTGAAGATTTTGCAG TGTATTACTGTCAGCAGTATGGTAGTTCACTCCG TGGACGTTCGGCCAAGGGACCAAGGTGGAAA TCAAA<br><br>SEQ ID NO: 26819 | CAGGTGCAGCTGCAGGAGTCGGGCCCAGGACTG GTGAAGCCTTCACAGACCCTGTCCCTCACCTGCA CTGTCTCTGGTGACTCCATCAACAGTGGTGATTA CTACTGGAACTGGATCCGCCAGCACCCAGGGAA GGGCCTGGAGTGGATTGGATTCATCTTTTACAGT GGGAGCACCTACTACAACCCGTCCCTCAAGAGTC GAGTTACCATATCAATAGACACGTCTAAGAACCA GTTCTCCCTGAAGCTGAGCTCTGTGAATGTCGCG GACACGGCCGTGTATTACTGTGCGAGAGGGATT ACGATGGTTCGGGGAGTTATCACTACTATTACGG TATGGACGTCTGGGGCCAAGGGACCACGGTCAC CGTCTCCTCA<br><br>SEQ ID NO: 30825 |

FIGURE 50
(Continued)

| | | | | |
|---|---|---|---|---|
| | | AA | EIVLTQSPGTLSLSPGERATLSCRASQSIRSNFLA WYQQKPGQAPRLLIYGASSRATGIPDRFSGSVSG TDFTLTINRLEPEDFAVYYCQQYGSSPWTFGQGT KVEIK<br><br>SEQ ID NO: 26820 | QVQLQESGPGLVKPSQTLSLTCTVSGDSINSGDYY WNWIRQHPGKGLEWIGFIFYSGSTYYNPSLKSRVTI SIDTSKNQFSLKLSSVNVADTAVYYCARGDYDGSG SYHYYYGMDVWGQGTTVTVSS<br><br>SEQ ID NO: 30826 |
| iPS:436066 | 21-225_194B7 | NA | GACATCCAGATGACCCAGTCTCCATCCTCACT GTCTGCATCTGTAGGAGACAGAGTCACCATCA CTTGTCGGGCGAGTCAGGGCATTAGCAAATAT TTAGCCTGGTTTCAGCAGAAACCAGGGAAAGC CCCTAAGTCCCTGATCTATGGTGCATCCAGGT TGCAAAGTGGGGTCCCATCAAGTTCAGCGGC AGTGGATCTGGGACAGATTTCACTCTCACCAT CAGCAGCCTGCAACATTATCTTAATTACCCTCA ATTACTGCCAACATTATCTTAATTACCCTCTCA CCTTCGGCCAAGGGACCACGACTGGAGATTAAA<br><br>SEQ ID NO: 26821 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGAAGT AATAAAACTATGCAGACTCCGTGAAGGGCCGA TTCACCATCTCCAGAGACACAATTCCAAGAACACGC TGTATCTGCAAATGAACAGCCTGAGAGCCGAGG ACACGGCTGTGTATTATTGTGCGAGAGATCGGTC TAAGGGTTACGACGGTATGGACGTCTGGGGCCA AGGGACCACGGTCACCGTCCTCCTCA<br><br>SEQ ID NO: 30827 |
| | | AA | DIQMTQSPSSLSASVGDRVTITCRASQGISKYLA WFQQKPGKAPKSLIYGASRLQSGVPSKFSGSGSG TDFTLTISSLQPEDFATYYCQHYLNYPLTFGQGT RLEIK<br><br>SEQ ID NO: 26822 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDRSKG YDGMDVWGQGTTVTVSS<br><br>SEQ ID NO: 30828 |

FIGURE 50
(Continued)

| | | | |
|---|---|---|---|
| iPS:436068 | 21-225_194F7 | NA | GACATCCAGATGACCCAGTCTCCATCTTCCGT GTCTGCATCTGTAGGAGACAGAGTCACCATCA CTTGTCGGGCGAGTCAGGTATTAGCAGGTGG TTAGCCTGGTTTCAGCAGAAACCAGGGAAAGC CCCTAAGATCCTGATCTATGCTGCATCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA CTATTGTCAACAGGCTAACAGTTTCCCGTGGA CGTTCGGCCAAGGGACCAAGGTGGAAATCAA A <br> SEQ ID NO: 26823 | CAGGTGCAGCTGGTGCAGTCTGGGGCTGAGGTG AAGAAGCCTGGGGCCTCAGTGAAGGTCTCCTGC AAGGCTTCTGGATACACCTTCACCGACTACTA CACACTGGGTGCGACAGGCCCCTGGACAAGGGC TTGAGTGGATGGGATGGATCAACCCTAACAATGG TGGCACAAACTATGCACAGAAATTTCAGGGCAG GGTCACCATGACCAGGGACACGTCCATCAGCAC AGCCTACATGGAGCTGAGCAGGCTGAGATCTGA CGACACGGCCGTGTATTACTGTGCGAGAGAACCC CTTGGTTACTATGGTTCGGGGAGTTATGGGCCT ACGGTATGGACGTCTGGGGCCAAGGGACCACGG TCACCGTCTCCTCA <br> SEQ ID NO: 30829 |
| | | AA | DIQMTQSPSSVSASVGDRVTITCRASQGISRWLA WFQQKPGKAPKILIYAASSLQSGVPSRFSGSGSG TDFTLTISSLQPEDFATYYCQQANSFPWTFGQGT KVEIK <br> SEQ ID NO: 26824 | QVQLVQSGAEVKKPGASVKVSCKASGYTFTDYYIH WVRQAPGQGLEWMGWINPNNGGTNYAQKFQGRV TMTRDTSISTAYMELSRLRSDDTAVYYCAREPLGY YGSGSYGAYGMDVWGQGTTVTVSS <br> SEQ ID NO: 30830 |
| iPS:436072 | 21-225_194C10 | NA | GAAATTGTGTTGACGCAGTCTCCAGGCACCCT GTCTTTGTCTCCAGGGGAAAGAGCCACCCTCT CCTGCAGGGCCAGTCCAGTGTTAACAGCGGC TACTTAGCCTGGTACCAGCAGAAAGCCTGGCCA GACTCCCAGGCTCCTCATCTTTGGTGCATCCA GCAGGGCCACTGGCATCCCCGACAGGTTCAGT GCCAGTGGGTCTGGGACAGCCTCACTCTCAC CATCAGTAGACTGGAGCCTGAAGATTTTGCAG TGTATTTCTGTCAGCAGTATGAAAGCTCACCG TGGACGTTCGGCCAAGGGACCAAGGTGGAAA TCAAA <br> SEQ ID NO: 26825 | CAGGTGCAGCTACAGCAGTGGGGCGCAGGACTG TTGAAGCCTTCGGAGACCCTGTCCCTCACCTGCG CTGTCTCTGGTGGGTCCTTCAGATATTACTACTGG AGCTGGATCCGCCAGCCCCCGGGAAGGGGCTG GAGTGGATTGGGGAAATCAATCATAGTGGAAGC ACCAACTACAACCCGTCCCTCAAGAGTCGAGTCA CCATATCAATAGACACGTCCAAGAACCAGTTCTC CCTGAAGCTGAGTCTGTGACCGCCGCGGACAC GGCTGTGTATTACTGTGCGAGAGACTACGGTGCT TTTGATATCTGGGGCCAAGGGACAATGTCACCG TCTCTTCA <br> SEQ ID NO: 30831 |

FIGURE 50
(Continued)

| | | | |
|---|---|---|---|
| iPS:436074 | 21-225_194F10 | AA | EIVLTQSPGTLSLSPGERATLSCRASPSVNSGYLA WYQQKPGQTPRLLIFGASSRATGIPDRFSASGSG ADFTLTISRLEPEDFAVYFCQQYESSPWTFGQGT KVEIK | QVQLQQWGAGLLKPSETLSLTCAVSGGSFRYYYW SWIRQPPGKGLEWFGEINHSGSTNYNPSLKSRVTISI DTSKNQFSLKLRSVTAADTAVYYCARDYGAFDIW GQGTMVTVSS |
| | | | SEQ ID NO: 26826 | SEQ ID NO: 30832 |
| | | NA | GACATCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCTGAAACCAGGAAAGC CCCTAAGCGCCTGATCTATGCTGCATCCAGTTT ACAAAGTGGGGTCCCATCAAGGTTCAGCGGCA GTGGATCTGGGCCAGCCTGCAGCCTCACACTTA AGCAGCCTGCAGCCTGACATTATCAGTTTTCCAC TTACTGTCTACAGCATTATAGTTTCCCATTCAC TTTCGGCCCTGGGACCAAAGTGGATATCAAA | CAGGTGCAGCTGGTGGAGTCGGGGGGAGGCGTG GTCCAGCCTGGGAGGTCCCTGAGACTCTCCTGTG CAGGGTCTGGATTCACCTTCAGTAGCTTTATCAT GCACTGGGTCCGCCAGGCTCCAGGCAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGTCGAGG ACACGGCTGTGTATTACTGTGCGAGAGAGGAGTA TAGCAGTGGCTGGTTCGGGTACGGTATGGACGTC TGGGGCCAAGGGACCACGGTCACCGTCTCCTCA |
| | | | SEQ ID NO: 26827 | SEQ ID NO: 30833 |
| | | AA | DIQMTQSPSSLSASVGDRVTITCRASQGIRNDLG WYQLKPGKAPKRLIYAASSLQSGVPSRFSGSGSG PEFTLTISSLQPEDFATYYCLQHYSFPFTFGPGTK VDIK | QVQLVESGGGVVQPGRSLRLSCAASGFTPSSFIMH WVRQAPGRGLEWVAVIWYDGSNKYYADSVKGRF TISRDNSKNTLYLEMNSLRVEDTAVYYCAREEYSS GWFGYGMDVWGQGTTVTVSS |
| | | | SEQ ID NO: 26828 | SEQ ID NO: 30834 |

FIGURE 50
(Continued)

| | | | |
|---|---|---|---|
| iPS:436076 | 21-225_194H11 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTATGCTGCATCCAGTTT ACAAAGTGGGGTCCCATCAAAGTTCAGCGGCA GTGGATCTGGAACAGATTTCACTCTCACCATC AGCAGCCTGCAGCCTGAAGATTTTGCAACTTA TTACTGCCAACATTATCTTACTTACCCTCTCAC TTTCGGCGGAGGGACCAAGGTGGAGATCAAA<br><br>SEQ ID NO: 26829 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGAAGT AATGAACACTATGCAGACTCCGTGAAGGGCCGA TTCACCATCTCCAGAGACAATTCCAAGAACACGC TGTCTCTGCAAATGAACAGCCTGAGAGCCGAGG ACACGGCTGTATTACTGTGCGAGAGATAGGGG GGTGGGTTATTACGGTTTGACGTCTGGGGCCAA GGGACCACGGTCACCGTCTCCTCA<br><br>SEQ ID NO: 30835 |
| | | AA | DIQMTQSPSSLSASVGDRVTITCRASQGISNYLA WFQQKPGKAPKSLIYAASSLQSGVPSKFSGSGSG TDFTLTISSLQPEDFATYYCQHYLTYPLTFGGGT KVEIK<br><br>SEQ ID NO: 26830 | QVQLVESGGGVVQPGRSLRLSCAASGFTFSSYGMH WVRQAPGKGLEWVAVIWYDGSNEHYADSVKGRF TISRDNSKNTLSLQMNSLRAEDTAVYYCARDRGVG YYGLDVWGQGTTVTVSS<br><br>SEQ ID NO: 30836 |
| iPS:436078 | 21-225_194H12 | NA | GACATCCAGATGACCCAGTCTCCATCCTCACT GTCTGCATCTGTGGGAGACAGAGTCACCATCA CTCGTCGGGCGAGTCAGGGCATTGGCAAGTAT TTAGCATGGTTTCAGCAGAAACCAGGGAAAGC CCTTAAGTCACTGATATATGCTGCATCCAGTTT GCAAAGTGGGGTCCCATCAAAATTCAGCGGCA GTGGATCTGGGACAGATTTCACTCTCACCATC AGCAGCCTGCAGCCTGACGATTTTGCAACTTA TTACTGCCAACGATATGATACTTACCCATTCA CTTTCGGCCCTGGGACCAAAGTGGATATCAAA<br><br>SEQ ID NO: 26831 | CAGGTGCAGCTGGTGGAGTCTGGGGGAGGCGTG GTCCAGCCTGGGAGGTCCCTGAGACTCTCCTGTG CAGCGTCTGATTCACCTTCAGGAACTACATGGCAT GCACTGGGTCCGCCAGGCTCCAGGCAAGGGGCT GGAGTGGGTGGCAGTTATATGGTTTGATGAAGT AATGACTACTATGCAGACTCCGTGAAGGGCCGAT TCACCATCTCCAGAGACAATTCCAAGAACACGCT GTCACTGCAAATGAACAGCCTGAGAGCCGAGGA CACGGCTGTGTATTACTGTGCGAGAGATAGAAGC GTCGGCTACGACGGTTTAGATGTCTGGGGCCAAG GGACCACGGTCACCGTCTCCTCA<br><br>SEQ ID NO: 30837 |

FIGURE 50
(Continued)

| | | | | |
|---|---|---|---|---|
| | | AA | DIQMTQSPSSLSASVGDRVTITRRASQGIGKYLA WFQQKPGKALKSLIYAASSLQSGVPSKFSGSGSG TDFTLTISSLQPDDFATYYCQRYDTYPFTFGPGT KVDIK<br>SEQ ID NO: 26832 | QVQLVESGGGVVQPGRSLRLSCAASGFTFRNYGM HWVRQAPGKGLEWVAVIWFDGSNDYYADSVKGR FTISRDNSKNTLSLQMNSLRAEDTAVYYCARDRSV GYDGLDVWGQGTTVTVSS<br>SEQ ID NO: 30838 |
| iPS:436080 | 21-225_195B1 | NA | GAAATTGTGTTGACGCAGTCTCCAGGCACCCT GTCTTGTCTTCAGGGGAAAGAGCCACCCTCT CCTGCAGGGCCAGTCCGAGTGTTAACAGTAAC TACTTAGCCTGGTATCAGCAGAAACCTGGCCA GACTCCCAGGCTCCTCATCTATGGTGCATCA ACAGGGCCACTGGCGTCCCAGACAGGTTCAGT GCCAGTGGGTCTGGGACAGATTCACTCTCAC CATCAGAAGACTGGAGCTGAAGATTTTGCAG TGTATTTCTGTCAGCAGTATGAAAGCTCACG TGGACGTTCGGCCAAGGGACCAAGGTGGAAA TCAAA<br>SEQ ID NO: 26833 | CAGGTGCAGTTACAGCAGTGGGGCGCAGGACTG TTGAAGCCTTCCGAGACCCTGTCCCTCACCTGCG CTGTCTCTGGTGGGTCCTTCAGTATTACTTCTGG AGCTGGATCGCCAGTCCCCCGGGAAGGGGCTG GAGTGGATTTGGGAAATCAATCATATGGACGC ACCAACTACAACCGTCCCTCAAGAGTCGAGTCA CCATATCAGTAGACACGTCCAAGAACCAGTTCTC CCTGAAGCTGAGTTCTGTGACCGCCGCGGACAC GGCTGTGTATTACTGTGCGAGAGACTACGGTGCT TTTGATATCTGGGGCCAAGGCACATTGGTCACCG TCTCTTCA<br>SEQ ID NO: 30839 |
| | | AA | EIVLTQSPGTLSLSSGERATLSCRASPSVNSNYLA WYQQKPGQTPRLLIYGASNRATGVPDRFSASGS GTDFTLTIRRLEPEDFAVYFCQQYESSPWTFGQG TKVEIK<br>SEQ ID NO: 26834 | QVQLQQWGAGLLKPSETLSLTCAVSGGSFRYYFW SWIRQSPGKGLEWFGEINHSGRTNYNPSLKSRVTIS VDTSKNQFSLKLRSVTAADTAVYYCARDYGAFDI WGQGTLVTVSS<br>SEQ ID NO: 30840 |

FIGURE 50
(Continued)

| | | | | |
|---|---|---|---|---|
| iPS:436082 | 21-225_195D9 | NA | GACATCCAGATGACCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAACCAGGAAAG CCCCTAAGCTCCTGATCTATGCTGCATCCAGTT TGCTAGGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACGGGCTAACAGTTTCCCGTGC AGTTTTGGCCAGGGGACCAAGCTGGAGATCAA A<br><br>SEQ ID NO: 26835 | CAGGTGCAGCTGGTGGAGTCTGGGGGAGGCGTG GTCCAGCCTGGGAGGTCCCTGAGACTCTCCTGTG CAGCGTCTGGATTCACCTTCAGTCACTATGTCAT GCACTGGGTCCGCCAGGCTCCAGGCAAGGGGCT GGAGTGGGTGGCAGTTATTGGTATGATGGAACT AATAAATACTATGCAGACTCCGTGAAGGGCGA TTCACCATCTCCAGAGACAATTCCAAGAACACGC TGTATCTGCAAATGAACAGCCTGAGAGCCGAGG ACACGGCTGTGTATTACTGTGCGAGAGATTGGTT CGGGGAGGGGAACTACTACGGTATGGACGTCTG GGGCCAAGGGACCACGGTCACCGTCTCCTCA<br><br>SEQ ID NO: 30841 |
| | | AA | DIQMTQSPSSVSASVGDRVTITCRASQGISRWLA WYQQKPGKAPKLLIYAASSLLGGVPSRFSGSGS GTDFTLTISSLQPEDFATYYCQRANSFPCSFGQG TKLEIK<br><br>SEQ ID NO: 26836 | QVQLVESGGGVVQPGRSLRLSCAASGFTFSHYVM HWVRQAPGKGLEWVAVIWYDGTNKYYADSVKGR FTISRDNSKNTLYLQMNSLRAEDTAVYYCARDWF GEGNYYGMDVWGQGTTVTVSS<br><br>SEQ ID NO: 30842 |
| iPS:436084 | 21-225_195F2 | NA | GAAATTGTGCTGACTCAGTCTCCAGACTTTCA GTCTGTGACTCCAAAGGAGAAAGTCACCATCA CCTGCCGGGCCAGTCAGAGCATTGGTAGTAGC TTACACTGGTACCAGCAGAAACCAGATCAGTC TCCAAAGCTCCTCATCAAGTATGCTTCCCAGT CCTTCTCAGGGGTCCCCTCGAGGTTCAGTGGC AGTGGATCTGGGACAGATTTCGCCCTCACCAT CAGTAGCCTGGAAGCTGAAGATGCTGCAACGT ATTACTGTCATCAGAGTAGAACTTTACCGCTC ACTTTCGGCGGAGGGACCAAGGTGGAGATCA AA<br><br>SEQ ID NO: 26837 | CAGGTGCAGCTGCAGGAGTCGGGCCCAGGACTG GTGAAGCCTTCACAGACCCTGTCCCTCACCTGCA CTGTCTCTGGTGACTCCATCAGCAGCGGTGTTA CTACTGGAGCTGGATCCGCCAGCAGCCAGGGAA GGGCCTGGAGTGGATTGGGTACAGTATTACAGT GGGAGCACCAACTACTAACCCGTCCCTCAAGAGTC GAGTTACCATATCAGTAGACACGTCTAAGAACCA GTTCTCCCTGAAGCTGAGCTCTGTGACTGACCG GACACGGCCGTGTATTATTGTGCGAGAGGGGGT ATAACTGGAACAACGGGTTTGACTACTGGGGCC AGGGAGCCCTGGTCACCGTCTCCTCA<br><br>SEQ ID NO: 30843 |

FIGURE 50
(Continued)

| | | | |
|---|---|---|---|
| iPS-436086 | | AA | EIVLTQSPDFQSVTPKEKVTITCRASQSIGSSLHW YQQKPDQSPKLLIKYASQSFSGVPSRFSGSGSGT DFALTISSLEAEDAATYYCHQSRTLPLTFGGGTK VEIK<br>SEQ ID NO: 26838 | QVQLQESGPGLVKPSQTLSLTCTVSGDSISSGGYYW SWIRQHPGKGLEWIGYSYYSGSTNYNPSLKSRVTIS VDMSKNQFSLKLSSVTDADTAVYYCARGGYNWN NGFDYWGQGALVTVSS<br>SEQ ID NO: 30844 |
| | | NA | GACATCCAGATGACCCAGTCTCCTTCCTCACT GTCTGCATCTGTAGGAGACAGAGTCACCATCA CTTGTCGGACGAGTCAGGGCATTGGCAAGTAT TTAGCCTGGTTTCAGCAGAAACCAGGGAAAGC CCCTAAGTCCCTGCTCTATAAAGTATCCAGTTT GCAAAGTGGGGTCCCATCAAAGTTCAGTGGCA GTGGATCTGGGACAGATTTCACTCTCACCATC AGCAGCCTGCAACAGCCTGAAGATTTTGCAACTTA TTACTGCCAACAGTATATGACTTACCGCTCA CTTTCGGCGGAGGGACCAAGGTGGAGATCAA A<br>SEQ ID NO: 26839 | CAGGTGCAGCTGGTGGAGTCTGGGGGAGGCGTG GTCCAGCCTGGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAAACTATGCAGACTCCGTGAAGGGCCGA TTCACCATCTCAAGAGACAATTCCAAGAACACGC TGTATCTGCAAATGAACAGCCTGAGAGCCGAGG ACACGGCTGTGTATTACTGTGCGAGAGATCAGGG CGTGGGCTACGACGGTTTGGACGTCTGGGGCCAA GGGACCACGGTCACCGTCTCCTCA<br>SEQ ID NO: 30845 |
| 21-225_191G10 | | AA | DIQMTQSPSSLSASVGDRVTITCRTSQGIGKYLA WFQQKPGKAPKSLLYKVSSLQSGVPSKFSGSGS GTDFTLTISSLQPEDFATYCCQQYMTYPLTFGGG TKVEIK<br>SEQ ID NO: 26840 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDQGV GYDGLDVWGQGTTVTVSS<br>SEQ ID NO: 30846 |

FIGURE 50
(Continued)

| | | | |
|---|---|---|---|
| iPS:436088 | 21-225_195C8 | NA | GAAATTGTGTTGACGCAGTCTCCAGGCACCCT GTCTTTGTCTCCAGGGGAAAGAGCCACCCTCT CCTGCAGGGCCAGTCAGAGTATTCGCAGCAGC TTCTTAGCCTGGTACCAACAGAAACAGGGCCA GGCTCCCAGGCTCCTCATCTATGGTGCATTTA GTAGGGCCACTGGCATCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAACTCACCG TGGGCGTTCGGCCAAGGGACCAAGGTGGAAA TCAAA<br><br>SEQ ID NO: 26841 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGGATCCGCCAGTCCCCAGGGAA GGGGCTGGAGTGGATTGGGTACATCTTTTACAGT GGGAGCACCTACTACAACCCGTCCCTCAAGAGTC GACTTACCATATCAGTGGACACGTCTAAGAACCA GTTCTCCCTGAAGCTGAGCTCTGTGACTGCCGCG GACACGGCCGTGTATTACTGTGCGAGAGGGGATT ACGATGGTTCGGGGAGTTATCACTTCTACTACGG TATGGACGTCTGGGGCCAAGGGACCACGGTCAC CGTCTCCTCA<br><br>SEQ ID NO: 30847 |
| | | AA | EIVLTQSPGTLSLSPGERATLSCRASQSIRSSFLA WYQQKPGQAPRLLIYGAFSRATGIPDRFSGSGSG TDFTLTISRLEPEDFAVYYCQQYGNSPWAFGQG TKVEIK<br><br>SEQ ID NO: 26842 | QVQLQESGPGLVKPSQTLSLTCTVSGGSISSGDYYW NWIRQSPGKGLEWIGYIFYSGSTYYNPSLKSRLTISV DTSKNQFSLKLSSVTAADTAVYYCARGDYDGSGS YHFYYGMDVWGQGTTVTVSS<br><br>SEQ ID NO: 30848 |
| iPS:436090 | 21-225_195A9 | NA | GACATCCAGATGACCCAGTCTCCATCCTCACT GTCTGCATCTGTAGGAGACAGAGTCACCATCA CTTGTCGGGCAGTCAGGGCATTAGCAATTAT TTAGCCTGGTTTCAGCAGAAACCAGGGAAAGC CCCTAAGTCCCTGATCTATGCTGCATCCAGTTT GCAAAGTGGGGTCCCATCAAGGTTCAGCGGCA GTGGATCTGGAACAGATTTCACTCTCACCATC AGCAGCCTGCAGCCTGAAGATTTTGCAACTTA TTACTGCCAACATTATCTTACTCCCTCAC TTTCGGCGGAGGGACCAAGGTGGAGATCAAA<br><br>SEQ ID NO: 26843 | CAGGTGCAGCTGGTGGTGGAGTCTGGGGGAGGCGTG GTCCAGCCTGGGAGGTCCCTGAGACTCTCCTGTG CAGGGTCTGATTCACCTTCAGTAGCTAGCTATGGCAT GCACTGGGTCCGCCAGGCTCCAGGCAAGGGGCT GCAGTGGGTGGCAGTTATATGTATGATGGAAGT AATGAACACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATAGGGGG GGTGGGTTACTACGGTTTGGACGTCTGGGGCCAA GGGACCACGGTCACCGTCTCCTCA<br><br>SEQ ID NO: 30849 |

FIGURE 50
(Continued)

| | | | | |
|---|---|---|---|---|
| iPS-436092 | 21-225_195B9 | AA | DIQMTQSPSSLSASVGDRVTITCRASQGISNYLAWFQQKPGKAPKSLIYAASSLQSGVPSKFSGSGSGTDFTLTISSLQPEDFATYYCQHYLTYPLTFGGGTKVEIK<br>SEQ ID NO: 26844 | QVQLVESGGGVVQPGRSLRLSCAASGFTFSSYGMHWVRQAPGKGLQWVAVIWYDGSNEHYADSVKGRFTISRDNSKNTLYLQMNSLRAEDTAVYYCARDRGVGYYGLDVWGQGTTVTVSS<br>SEQ ID NO: 30850 |
| | | NA | GACATCCAGATGACCCAGTCTCCATCCTCCCTGTCTGCATCTGTAGGAGACAGAGTCACCATCACTTGCCGGGCAAGTCAGGGCATAAGAAAGATTTAGGCTGGTATCAGCAGAAACCAGGGAAAGCCCCTAAGCGCCTGATCTATGCTGCATCCGATTTGCAAAGTGGGGTCCCATCAAGGTTCAGCGGCAGTGGATCTGGGACAGATTCACTCTCACAATCAGCAGCCTGCAGCCTGAAGATTTTGCAACTTATTGCTGTCTACAGCATTATCGTTACCCATTCACTTTCGGCCCTGGGACCAAAGTGGATTTCAAA<br>SEQ ID NO: 26845 | CAGGTGCAACTGGTGGAGTCTGGGGGAGGCGTGGTCCAGCCTGGGAGGTCCCTGAGACTCTCCTGTGCAGCCGTCTGGATTCACCTTCAGTAGCTATGGCATGCACTGGGTCCGCCAGGCTCCAGGCAAGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAATGGCTACAATTCAGGTACTACTACGGTATGGACGTCTGGGGCCAAGGGACCACGGTCACCGTCTCCTCA<br>SEQ ID NO: 30851 |
| | | AA | DIQMTQSPSSLSASVGDRVTITCRASQGIRKDLGWYQQKPGKAPKRLIYAASDLQSGVPSRFSGSGSGTEFTLTISSLQPEDFATYCCLQHYRYPFTFGPGTKVDFK<br>SEQ ID NO: 26846 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREWLQFRYYYGMDVWGQGTTVTVSS<br>SEQ ID NO: 30852 |

FIGURE 50
(Continued)

| | | | |
|---|---|---|---|
| iPS:436094 | 21-225_195B10 | NA | GAAATTGTGCTGACTCAGTCTCCAGACTTTCA GTCTGTGACTCCAAAGGAGAAAGTCACCATCA CCTGCCGGGCCAGTCAGAGCATTGGTAGTAGC TTACACTGGTACCAGCAGAAACCAGATCAGTC TCCAAAGCTCCTCATCAAGTATGCTTCCCAGT CCTTCTCAGGGGTCCCCTGAGGTTCAGTGGC AGTGGATCTGGGACAGATTTCACCCTCACCAT CAATAGCCTGGAAGCTGAAGATGCTGCAACGT ATTACTGTCATCAGAGTAGTCGTTTACCCTC ACTTTCGGCGAGGGACCAAGGTGGAGATCA AA

SEQ ID NO: 26847 | CAGGTGCAGCTGCAGGAGTCGGGCCCAGGACTG GTGAAGCCTTCACAGACCCTGTCCCTCACCTGCA CTGTCTCTGGTGGCTCCATCAGCAATAGTGGTTA CTACTGGAGCTGGATCCGCCAGCACCCAGGGAA GGGAGCACCTACTACAACCGTCCCTCAAGAGTC GGGTTATACCATATCTGTAGACACGTCTAAGAACCA GTTTTATCTGAAGCTGAGCGCTGTGACTGCCGCG TATAACTGAACAATGGGTTTGACTGTTGGGGCC AGGGAACCCTGGTCACCGTCTCCTCA

SEQ ID NO: 30853 |
| | | AA | EIVLTQSPDFQSVTPKEKVTITCRASQSIGSSLHW YQQKPDQSPKLLIKYASQSFSGVPSRFSGSGSGT DFTLTINSLEAEDAATYYCHQSSRLPLTFGGGTK VEIK

SEQ ID NO: 26848 | QVQLQESGPGLVKPSQTLSLTCTVSGGSISNSGYYW SWIRQHPGKGLEWIGYMYYSGSTYYNPSLKSRVTI SVDTSKNQFYLKLSAVTAADTAVYYCAKGGYNW NNGFDCWGQGTLVTVSS

SEQ ID NO: 30854 |
| iPS:436096 | 21-225_195E10 | NA | GAAATTGTGCTGACTCAGTCTCCAGACTTTCA GTCTGTGACTCCAAAGGAGAAAGTCACCATCA CCTGCCGGGCCAGTCAGAGCATTGGTAGTAGC TTACACTGGTACCAGCAGAAACCAGATCAGTC TCCAAAGCTCCTCATCAAGTATGCTTCCCAGT CCTTCTCAGGGGTCCCCTGAGGTTCAGTGGC AGTGGATCTGGGACAGATTTCACCCTCACCAT CAATAGCCTGGAAGCTGAAGATGCTGCAACGT ATTACTGTCATCAGAGTAGTCGTTTACCATTCA CTTTCGGCCCTGGGACCAAAGTGGATATCAAA

SEQ ID NO: 26849 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGTTA CTACTGGAGCTGGATCCGCCAGCACCCAGGGAA GGGCCTGGAGTGGATTGGGTACATCTATTACAGT GGGAGCACCTACTACAACCGTCCCTCAAGAGTC GAGTTACCATATCAGTAGACACGTCTAAGAACCA GTTCTCCCTGAAGCTGAGCTCTGTGACTGCCGCG GACACGGCCGTGTATTATTGTGCGAGAGGGGGT ATAACTGAACCACGTATGGACGTCTGGGGCC AAGGGACCACGGTCACCGTCTCCTCA

SEQ ID NO: 30855 |

FIGURE 50
(Continued)

| | | | |
|---|---|---|---|
| | | AA | EIVLTQSPDFQSVTPKEKVTITCRASQSIGSSLHW YQQKPDQSPKLLIKYASQSFSGVPSRFSGSGSGT DFTLTINSLEAEDAATYCHQSSRLPFTFGPGTK VDIK<br>SEQ ID NO: 26850 | QVQLQESGPGLVKPSQTLSLTCTVSGGSISSGGYYW SWIRQHPGKGLEWIGYIYYSGSTYYNPSLKSRVTIS VDTSKNQFSLKLSSVAAADTAVYYCARGYNWN HGMDVWGQGTTVTVSS<br>SEQ ID NO: 30856 |
| iPS:436098 | 21-225_195G11 | NA | GACATCGTGATGACCCAGTCTCCAGACTCCCT GGCTGTGTCTCTGGGCGAGAGGGCCACCATCA ACTGCAAGTCCAGCCAGAGTGTTTATTCAAC TCCAACAATAAGAACTACTTAGCTTGGTACCA GCAGAAACCCGGTCAGCCTCCTAACCTGCTCA TTTACTGGGCATCTACCCTGGAATCTGGGGTC CCTGACCGATTCAGTGGCAGCGGGTGGGAC AGATTTCACTCTCACCATCAGCAGCATGTCAGG CTGAAGATGTGGCAGTTTATTACTGTCAGCAA TATTGTAGTTTCCATTCACTTTCGGCCCTGGG ACCAAAGTGGATATCAGA<br>SEQ ID NO: 26851 | CAGGTGCAACTGGTGGAGTCTGGGGAGGCTTG GTCAAGCCTGGAGGGTCCCTGAGACTCTCCTGTG CAGCCTCTGGATTCACCTTCAGTGACTACTACAT GAGCTGGATCCGCCAGGCTCCAGGGAAGGGCT GGAGTGGCTTTCATACGCAGACTCTGTGAAGGGCCGAT TCACCATCTCCAGGGACAACGCCAAGAACTCACT GTATCTGCAAATGAACAGCCTGAGAGCCGAGA CACGGCCGTGTATTACTGTGCGAGAGAATGGGTG GGAGCCGACTACTGGGGCCAGGGAACCCTGGTC ACCGTCTCCTCA<br>SEQ ID NO: 30857 |
| | | AA | DIVMTQSPDSLAVSLGERATINCKSSQSVLFNSN NKNYLAWYQQKPGQPPNLLIYWASTLESGVPD RFSGSGCGTDFTLTISSMQAEDVAVYCQQYCS FPFTFGPGTKVDIR<br>SEQ ID NO: 26852 | QVQLVESGGGLVKPGGSLRLSCAASGFTFSDYYMS WIRQAPGKGLEWLSYISSSGTTVFYADSVKGRFTIS RDNAKNSLYLQMNSLRAEDTAVYYCAREWVGAD YWGQGTLVTVSS<br>SEQ ID NO: 30858 |

FIGURE 50
(Continued)

| | | | |
|---|---|---|---|
| iPS:436100 | 21-225_195G12 | NA | GACATCCAGATGACCCAGTCTCCATCTTCCGT GTCTGCATCTGTAGGAGACAGAGTCACCATCA CTTGTCGGCGAGTCAGGGTATTAACAACTGG TTAGCCTGGTATCAGCAGAAACCAGGGAAAG CCCCTAAGCTCCTGATCTATGGTGTTTCCAGTT TGCAGAGTGGGGTCCCATCAAGGTTCAGCGGC AGTGGATCTGGGACAGATTTCACTCTCACCAT CAGCAGCCTGCAGCCTGAAGATGAACAGCCT ACTCTTGTCAACAGGCTAACAGTTCCCGTGG ACGTTCGGCCGAGGGACCAAGGTGGAAAATC AG<br><br>SEQ ID NO: 26853 | GAGGTGCAGCTGTTGGAGTCTGGGGAGGCTTG GTACAGCCTGGGGGGTCCCTGAGACTCTCCTGTG CAGCCTCTGGATTCACCTTTAGCACCTATGCCAT GAGTTGGGTCCGCCAGGCTCCAGGGAAGGGGCT GGAGTGGGTCTCAGCTATTAGTCGTAGTGGTGGT AACACACTACGCAGATCCGTGAAGGGCCGG TTCACCATCTCCAGAGACAATTCCAAGAATACGC TGTATCTGCAAATGAACAGCCTGAGAGCCGAGG ACACGGCCGTATATTCCTGTGCGAAAGATGGATT CGGTGGGAGCTCCTACTTTGACTACTGGGGCCAG GGAACCCTGGTCACCGTCTCCTCA<br><br>SEQ ID NO: 30859 |
| | | AA | DIQMTQSPSSVSASVGDRVTITCRASQGINNWLA WYQQKPGKAPKLLIYGVSSLQSGVPSRFSGSGS GTDFTLTISSLQPEDFATYSCQQANSFPWTFGRG TKVENQ<br><br>SEQ ID NO: 26854 | EVQLLESGGGLVQPGGSLRLSCAASGFTFSTYAMS WVRQAPGKGLEWVSAISRSGGNTHYADSVKGRFTI SRDNSKNTLYLQMNSLRAEDTAVYSCAKDGFGGS SYFDYWGQGTLVTVSS<br><br>SEQ ID NO: 30860 |
| iPS:436102 | 21-225_196B1 | NA | GACATCGTGATGACCCAGTCTCCAGACTCCCT GGCTGTGTTCTGGGCGAGAGGGCCACCATCA ACTGCAAGTCCAGCCAGAGTATTTTATTCAGC TCCAACAATAAGAACCTACTTAGCTTGGTATCA GCAGAAACCAGGACAGCCTCCTAAGCTGCTCA TTTACTGGGCATCTATCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTCTAGTCTTCCATTCACTTTCGGCCCTGGG ACCAAAGTGGATATCAAA<br><br>SEQ ID NO: 26855 | CAGGTGCAGCTGGTGGAGTCTGGGGGAGGCTTG GTCAAGCCTGGAGGGTCCTGAGACTCTCCTGTG CAGCCTCTGGATTCACCTTCAGTGACTACTACAT GAGCTGGATCCGCCAGCCTCCAGGGAAGGGGCT GGAGTGGATTTCATACATTAGTAGTAGTGGTATT ACCATGTACTACGCAGACTCTGTGAAGGGCCGAT TCACCATCTCCAGGGACAACGCCAAGAACTCACT GTATCTGCAAATGAACAGCCTGAGAGCCGAGGA CACGGCCGTGTATTACTGTGCGAGAGAATGGGTG GGAGCCGACTACTGGGGCCAGGGAACCCTGGTC ACCGTCTCCTCA<br><br>SEQ ID NO: 30861 |

FIGURE 50
(Continued)

| | | | |
|---|---|---|---|
| iPS:436104 | 21-225_196C1 | AA | DIVMTQSPDSLAVFLGERATINCKSSQSILFSSNN KRYLAWYQQKPGQPPKLLIYWASIRESGVPDRF SGSGSGTDFTLTISSLQAEDVAVYYCQQYSSLPF TFGPGTKVDIK<br>SEQ ID NO: 26856 | QVQLVESGGGLVKPGGSLRLSCAASGFTFSDYYMS WIRQAPGKGLEWISYISSSGITMYYADSVKGRFTIS RDNAKNSLYLQMNSLRAEDTAVYYCAREWVGAD YWGQGTLVTVSS<br>SEQ ID NO: 30862 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTATTCAAC TCCAACAATAAGAACTACTTAGCTTGGTACCA GCAGAAACCCGGTCAGCTTCCTAACCTGCTCA TTTACTGGGCATCTACCCTGGAAATCTGGGGTC CCTGACCGATTCAGTGGCAGCGGCTGTGGAC AGATTTCACTCTCACCATCAGCAGCATGTCAGCAGG CTGAAGATGTGGCAGTTTATTACTTCACTTTCGGCCCTGGG ACCAAAGTGGATATCAGA<br>SEQ ID NO: 26857 | CAGGTGCAACTGGTGGAGTCTGGGGGAGGCTTG GTCAAGCCTGGAGGGTCCCTGAGACTCTCCTGTG CAGCCTCTGGATTCACCTTCAGTGACTACTACAT GAGCTGGATCCGCCAGGCTCCAGGGAAGGGGCT GGAGTGGCTTTCATACAGCAGACTCTGTGAAGGGCCGAT TCACCATCTCCAGGGACAACGCCAAGAACTCACT GTATCTGCAAATGAACAGCCTGAGAGCCGAGGA CACGGCCGTGTATTACTGTGCGAGAGAATGGGTG GGAGCCGACTACTGGGGCCAGGGAACCCTGGTC ACCGTCTCCTCA<br>SEQ ID NO: 30863 |
| | | AA | DIVMTQSPDSLAVSLGERATINCKSSQSVLFNSN NKNYLAWYQQKPGQLPNLLIYWASTLESGVPD RFSGSGCGTDFTLTISSMQAEDVAVYYCQQYCS FPFTFGPGTKVDIR<br>SEQ ID NO: 26858 | QVQLVESGGGLVKPGGSLRLSCAASGFTFSDYYMS WIRQAPGKGLEWLSYISSSGTTVFYADSVKGRFTIS RDNAKNSLYLQMNSLRAEDTAVYYCAREWVGAD YWGQGTLVTVSS<br>SEQ ID NO: 30864 |

FIGURE 50
(Continued)

| | | | |
|---|---|---|---|
| iPS:436106 | 21-225_196F2 | NA | GACATCGAGATGACCCAGTCTCCATCTTCCGTGTCTGCATCTGTAGGAGACAGAGTCACCATCACTTGTCGGGCGAGTCAGGGTATTAGCAGCTGGTTAGCCTGGTATCAGCAGAAACCAGGGAAAGCCCCTAAACTCCTGATCTATGCTGCATCCAGTTTGCAAAGTGGGGTCCCATCAAGGTTCAGCGGCAGTGGATCTGGGACAGATTTCACTCTCACCATCAGCAGCCTGCAGCCTGAAGATTTTGCAACTTACTATTGTCAACAGACTAACAGTGTCCCATTCACTTTCGGCCCTGGGACCAAAGTAGATATCAAA |  | CAGGTGCAGCTGGTGGAGTCTGGGGGAGGCGTGGTCCAGCCTGGGAGGTCCCTGAGACTCTCCTGTGCAGCCTCTGGATTCACCTTCAGTAGCTTTGGCATGCACTGGGTCCGCCAGGCTCCAGGCAAGGGGCTGGAGTGGGTGGCAGTTATATTAATGATGGAAGTAATAAAAAGTGTGCAGACTCCGTGAAGGGCCGATGCACCATTTCCAGAGACAACTCCAAGAACACGCTGTATCTGCAAATGAACAGCCTGAGAGCTGAGGACACGGCTGTTTATTACTGTGCGAGAGGACAGCAGTGGCTGGTAAACGGTGTGGACGTCTGGGGCCAGGGGACCACGGTCACCGTCTCCTCA |
| | | | SEQ ID NO: 26859 | | SEQ ID NO: 30865 |
| | | AA | DIQMTQSPSSVSASVGDRVTITCRASQGISSWLAWYQQKPGKAPKLLIYAASSLQSGVPSRFSGSGSGTDFTLTISSLQPEDFATYYCQQTNSVPFTFGPGTKVDIK |  | QVQLVESGGGVVQPGRSLRLSCAASGFTFSSFGMHWVRQAPGKGLEWVAVILNDGSNKKCADSVKGRCTISRDNSKNTLYLQMNSLRAEDTAVYYCARGQQWLVNGVDVWGQGTTVTVSS |
| | | | SEQ ID NO: 26860 | | SEQ ID NO: 30866 |
| iPS:436110 | 21-225_196F4 | NA | GACTTTCAGATGATCCAGTCTCCATCCTCCCTGTCTGCATCTGTAGGCGACAGAGTCACCATCACTTGCCGGGCAAGTCAGGCATTCACAGTCTATTTAAATTGGTATCAGCAGAAACCAGGGAAAGCTCCTAAGCTCCTGATCTATACTGCATCCAGTTTGCAAGGTGGGGTCCCATCAAGGTTCAGTGGCAGTGGATCTGGGACAGATTTCACTCTCACCATCAGCAGTCTGCAGCCTGAAGATTTTGCAACTTACTACTGTCAACAGAGCTACGGTTCCCCTCTCACTTTCGGCGGAGGGACCAAGGTGGAGATCAAA |  | GAGGTGCAGCTGTTGGAGTCTGGGGGAGGCTTGGTACAGCCTGGGGGGTCCCTGAGATTCTCCTGTGCAGCCCTCTGGATTCACCTTTAGCAGCTGTGCCATGACCTGGGTCCGCCAGGCTCCAGGGAAGGGGCTGGAGTGGGTCTCAGCTATTAGTGGTAGTGGTGGTAGCACATACTACGCAGACTCCGTGAAGGGCCGGTTCACCATTTCCAGAGACAATGAACAGCTGAGCCGAGGTGTATCTGCAAATGAACAGCCGTATATTACTGTGCGAAAGTGGGGACACGCCGTATATTACTGTGCGAAGTGGGGACGTTTGACTGGCTCCTACTACTACTACGGTATGGACGTCTGGGGCCAAGGGACCACGGTCACCGTCTCCTCA |
| | | | SEQ ID NO: 26861 | | SEQ ID NO: 30867 |

FIGURE 50
(Continued)

| | | | | |
|---|---|---|---|---|
| iPS:436112 | 21-225_196C7 | AA | DFQMIQSPSSLSASVGDRVTITCRASQRIHSYLN WYQQKPGKAPKLLIYTASSLQGGVPSRFSGSGS GTDFTLTISSLQPEDFATYYCQQSYGSPLTFGGG TKVEIK<br>SEQ ID NO: 26862 | EVQLLESGGGLVQPGGSLRFSCAASGFTFSSCAMT WVRQAPGKGLEWVSAISGSGGSTYYADSVKGRFTI SRDNSKNTLYLQMNSLRAEDTAVYYCAKVGGLTG SYYYYGMDVWGQGTTVTVSS<br>SEQ ID NO: 30868 |
| | | NA | GACATCCAGATGACCCAGTCTCCATCCTCACT GTCTGCATCTGTAGGAGACAGAGTCACCATCA CTTGTCGGGCAATCAGGCCATTAGCAATTAT TTAGCCTGGTTTCAGCAGAAACCAGGAAAGC CCCTAAGTCCCTGATCTATGCTGCATCCAGTTT GCAAAGTGGGGTCCCATCAAAGTTCAGCGGCA GTGGATCTGGAACAGATTTCACTCTCACCATC AGCAGCCTGCAGCCTGAAGATTTTGCAACTTA TTACTGCCAACATTATCTCACTTACCCTCTCAC TTTCGGCGGAGGGACCAAGGTGGAGATCAAA<br>SEQ ID NO: 26863 | CAGGTGCAGCTGGTGGAGTCTGGGGGAGGCGTG GTCCAGCCTGGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGAAGT AATGAACACTATGCAGACTCCGTGAAGGGCCGA TTCACCATTCCAAGAGACAATTCCAAGAACACGC TGTATCTGCAAATGAACAGCCTGAGAGCCGAGG ACACGGCTGTGTATTACTGTGCGAGAGATAGGGG GGTGGGTTACTACGGTTTGGACGTCTGGGGCCAA GGGACCACGGTCACCGTCTCCTCA<br>SEQ ID NO: 30869 |
| | | AA | DIQMTQSPSSLSASVGDRVTITCRANQAISNYLA WFQQKPGKAPKSLIYAASSLQSGVPSKFSGSGSG TDFTLTISSLQPEDFATYYCQHYLTYPLTFGGGT KVEIK<br>SEQ ID NO: 26864 | QVQLVESGGGVVQPGRSLRLSCAASGFTFSSYGMH WVRQAPGKGLEWVAVIWYDGSNEHYADSVKGRF TISRDNSKNTLYLQMNSLRAEDTAVYYCARDRGV GYYGLDVWGQGTTVTVSS<br>SEQ ID NO: 30870 |

FIGURE 50
(Continued)

| | | | |
|---|---|---|---|
| iPS:436114 | 21-225_196G8 | NA | GACATCGTGATGACCCAGTCTCCAGACTCCCT GACTGTCTCTGGGCGAGAGGGCCACCGTCA ACTGCAAGTCCAGCCAGAGTGTTTACACAGC TCCAACAATAACAACTACTTAGCTTGGTACCA GCAGAAACCAGGACAGCCTCCTAAGCTGCTCA TTTACTGGGCATCTACCCGGAATCCGAGTC CCTGACCGATTCAGTGGCAGCGGGTCTGGGAC AGATTTCACTCTCGCCATCAGCAGCCTGCAGG CTGAAGATGTGGCGGTTTATTACTGTCAGCAA TATTATAATACTCCTCCGACATTCGGCCAAGG GACCAAGGTGGAAATCAAA SEQ ID NO: 26865 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGATGCGGCAGGCCACTGGTCAAGGC TTGAGTGGATGGGATGGATGCACCTTAACAGTGG TAACACAGGCTATGCACCAGGACACCTCATAAGCAC AGTCACCATGACCAGGGACACGTCTATAGCAGC AGCCTTCATGGAGCTGAGCAGCCTGAGATCTGAG GACACGGCCGTGTATTACTGTGCCTATAGCGGTG GCTGGTACGTGTTCGACCCTGGGGCCAGGGAAC CCTGGTCACCGTCCTCA SEQ ID NO: 30871 |
| | | AA | DIVMTQSPDSLTVSLGERATVNCKSSQSVLHSSN NNNYLAWYQQKPGQPPKLLIYWASTRESGVPD RFSGSGSGTDFTLAISSLQAEDVAVYYCQQYYN TPPTFGQGTKVEIK SEQ ID NO: 26866 | QVQLVQSGAEVKKPGASVKVSCKASGYTFTNYDIN WMRQATGQGLEWMGWMHLNSGNTGYAPKFQGR VTMTRDTSISTAFMELSSLRSEDTAVYYCAYSGGW YVFDPWGQGTLVTVSS SEQ ID NO: 30872 |
| iPS:436116 | 21-225_196B9 | NA | GACATCCAGATGACCCAGTCTCCATCTTCCGT GTCTGCATCTGTAGGAGACAGAGTCACCATCA CTTGTCGGGCGAGTCAGGGTATTAGCAACTGC TTAGCCTGGTATCAGCAGAAACCAGGGAAAG CCCCTAAGTTCCTGATCTGTGCTGCATCCAGTT TGCAAAGTGCGGTCCCATCAAGGTTCAGCGGC AGTGGATCTGGGACAGATTTCACTCTCACCAT CAGCAGCCTGCAGCCTGAAGATTTTGCATCTT ACTATTGTCAACAGGGTGACAGTTTCCCTCCG ACGTTCGGCCAAGGGACCAAGGTGGAATTCA GA SEQ ID NO: 26867 | CAGGTGCAGCTGGTGCAGTCTGGGGCTGAGGTG AAGAAGCCTGGGGCCTCAATGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACCCTAACAGTGG TGGCACAAACTTTGCACAGAAGTTTCGGGCAG GGTCACCAGACCAGGGACACGTCATCAGCAC AGCCTACATGGAGCTGAGCAGCCTGAGCTCTGA CGACACGGCCGTGTATTACTGTGCGAGAGGGGG GGTTCGGGGAGTTCCAACTACTACTAGTTATG GACGTCTGGGGCCAAGGGACCACGGTCACCGTC TCCTCA SEQ ID NO: 30873 |

FIGURE 50
(Continued)

| | | | | |
|---|---|---|---|---|
| iPS:436118 | | AA | DIQMTQSPSSVSASVGDRVTITCRASQGISNCLAWYQQKPGKAPKFLICAASSLQSAVPSRFSGSGSGTDFTLTISSLQPEDFASYYCQQGDSFPPTFGQGTKVEFR<br>SEQ ID NO: 26868 | QVQLVQSGAEVKKPGASMKVSCKASGYTFTGYYMHWVRQAPGQGLEWMGWINPNSGGTNFAQKFRGRVTMTRDTSISTAYMELSRLSSDDTAVYYCARGGVRGVPNYYVMDVWGQGTTVTVSS<br>SEQ ID NO: 30874 |
| | 21-225_196A10 | NA | GACATCCAGATGACCCAGTATCCATCTTACGTGTCTGCATCTGTAGGAGACAGAGTCAGCATCACTTGTCGGGCGAGTCAGGGTATTAGCAGCAGGTGGTTAGCCTGGTATCAGCAGAAGCCAGGGAAAGCCGCCAAGTTCCTGATCTATGCTGCATCCAGTTTGCTAGGTGGGGTCTCATCAAGGTTCACTCTCACCATCAGCAGCCTGCAGAATTTCAACGGATATAACAGTTTACCGTGCACTATTGTCAACGGGATAACAGTTTACCGTGCAGTTTTGGCCAGGGGACCAAGCTGGAGATCAAA<br>SEQ ID NO: 26869 | CAGGTGCAGCTGGTGCAGTCTGGGGAGGCGTGGTCCAGCCTGGGAGGTCCCTGAGACTCTCCTGTGCAGCGTCTGGATTCACCTTCAGTCACTATGTCATGCACTGGGTCCGCCAGGCTCCAGGCAAGGGCTGGAGTGGGTGGCAGTTATTTGGTATGATGGAACTAATAAATACTATGCAGACTCCGTGAAGGGCCGATTCACCATCTCCAGAGACAATTCCAAGAACACGCTGTATCTGCAAATGAACAGCCTGAGAGCTGAGGACACGGCTGTGTATTACTGTGCGAGAGATTGGTTCGGGGAGGGAACTACTACGGTATGGACGTCTGGGGCCAAGGGACCACGGTCACCGTCTCCTCA<br>SEQ ID NO: 30875 |
| | | AA | DIQMTQYPSYVSASVGDRVSITCRASQGISRWLAWYQQKPGKAAKFLIYAASSLLGGVSSRFSGSGSGTDFTLTISSLQPEDFAIYYCQRDNSLPCSFGQGTKLEIK<br>SEQ ID NO: 26870 | QVQLVESGGGVVQPGRSLRLSCAASGFTSFSHYVMHWVRQAPGKGLEWVAVIWYDGTNKYYADSVKGRFTISRDNSKNTLYLQMNSLRAEDTAVYYCARDWFGEGNYYGMDVWGQGTTVTVSS<br>SEQ ID NO: 30876 |

FIGURE 50
(Continued)

| | | | |
|---|---|---|---|
| iPS:436120 | 21-225_196C10 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGTTCTGGGACAGAATTCACTCTCACAA TCAGCAGCCTGCAGCCTGAAGATTTTGCAACT TATTACTGTCTACAAATATAATAGTTACCCTCT ACTTTCGGCGGAGGGACCAAGGTGGAGATCA AA<br><br>SEQ ID NO: 26871 | CAGGTGCAGCTGCAGGAGTCGGGCCCAGGACTG GTGAAGCCTTCACAGACCCTGTCCCTCACCTGCA CTGTCTCTGGTGGCTCCATGAGGAGTGGTGGTGA CTACTGGAGCTGGATCCGCCAGCACCCAGGGAA GGGAGCACCTACTACAATCGTCCCTCAAGAGTC GAGTTACCTTATCAGTAGACACGTCTAAGAACCA GTTCTCCCTGAAGCTGAGCTCTGTGACTGCCGCG GACACGGCCGTGTATTACTGTGCGAGAATGGACT ACAGTAACTACTACGGTATGGACGTCTGGGG CCAAGGGACCACGGTCACCGTCTCCTCA<br><br>SEQ ID NO: 30877 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQYNSYPLLFGGG TKVEIK<br><br>SEQ ID NO: 26872 | QVQLQESGPGLVKPSQTLSLTCTVSGGSMRSGGDY WSWIRQHPGKGLEWFGFIYYSGSTYYNPSLKSRVT LSVDTSKNQFSLKLSSVTAADTAVYYCARMDYSN YYYGMDVWGQGTTVTVSS<br><br>SEQ ID NO: 30878 |
| iPS:436122 | 21-225_196G10 | NA | GAAATTGTGTTGACGCAGTCTCCAGGCACCCT GTTATTGTCTCCCGGGGAAAGAGCCACCCTCT CCTGCAGGGCCAGTCCGAGTGTTAGCAACAGC TTCTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CAACAGACTGGAGCCTGAAGATTTTGCAG TGTATCGCAAATGAACAGCCTGCGCGAGCAACTAT CCGTTGGACGTTCGGCCAAGGGACCAAGGTAG AACTCAAA<br><br>SEQ ID NO: 26873 | GAGGTGCAGCTGGTGGTGAGTCTGGGGAGGCCTG GTCAAGCCTGGGGGGTCCCTGAGACTCTCCTGTG CAGCCTCTGGATTCACCTTCAGGGACTATAGCAT GAACTGGGTCCGCCAGGCTCCAGGGAAGGGGCT GGAGTGGGTCTCATCTATTAGTAGTAGTAGTGGT TACATACACTACGCAGACTCAGTGAAGGGCCGA TTCACCATCTCCAGAGACAACGCCAAGAACTCAC ACACGGCTGTGTATTACTGTGCGCGAGCAACTAT GCCCCTTGACTACTGGGGCCAGGGAACCCTGGTC ACCGTCTCCTCA<br><br>SEQ ID NO: 30879 |

FIGURE 50
(Continued)

| | | | |
|---|---|---|---|
| iPS:436132 | 21-225_196C12 | AA | EIVLTQSPGTLLLSPGERATLSCRASPSVSNSFLA WYQQKPGQAPRLLIYGASSRATGIPDRFSGSGSG TDFTLTNSRLEPEDFAVYYCQQYGSSPPWTFGQ GTKVELK<br>SEQ ID NO: 26874 | EVQLVESGGGLVKPGGSLRLSCAASGFTFRDYSMN WVRQAPGKGLEWVSSISSGSGYIHYADSVKGRFTIS RDNAKNSLYLQMNSLRAEDTAVYYCARATMALD YWGQGTLVTVSS<br>SEQ ID NO: 30880 |
| | | NA | GACATCCAGATGACCCTGTCTCCATCGTCCCT GTTTGCATGTGTAGGAGACAGAGTCATCATCA CTTGCCGGGCAAGTCAGGGCATTAGAAATGAT CTAGGCTGGTCTCAGCAGAAATCCAGGGAAAGC CCCTAAGCGCCTGATCTATGCTGCATCCAGTTT GCAAAGTGGGGTCCCATCAAGGTTCAGCGGCA GTGGATCTGGGACAGAATTCACTATCACAATC AGCAGCCTGCAGCCTGAAGATAATGATTTTGA AAACTTA TTACTGTCTACAGCATATACGAAGTGGTTTCCCGTTCAC TTTCGGCCGAGGGACCAAGGTGGAGATCAAA | CAGGTGCAGCTGGTGCAGTCTGGGGCTGAAGTG AAGAAGCCTGGGGCCTCAGTGAAGGTCCTGC AAGGCTTCTGGATACACCTTCATCAGTTATGATA TCAACTGGGTGCGACAGGCCACTGGACAAGGGC TTGAGTGGATGGGATGGATGCACAGAAGTTCCAGGGCA GTAACACAGGCTATGCACCAGGGACACCTCCATAAGCA GAGTCACCATGACCAGGGACACTCCATAAGCA CAGCCTACATGGAGCTGAGCAGCCTGAGATCTG AGGACACGGCCGTTTATTACTGTGCGAGAGGAG ACCCGTATAACTGGAACTCCTACGCTATGGACGT CTGGGGCCAAGGGGCCACGGTCACCGTCTCCTCA |
| | | | SEQ ID NO: 26875 | SEQ ID NO: 30881 |
| | | AA | DIQMTLSPSSLFACVGDRVIITCRASQGIRNDLG WSQQNPGKAPKRLIYAASSLQSGVPSRFSGSGSG TEFTITISSLQPEDFETYYCLQHNDPFTFGRGTK VEIK<br>SEQ ID NO: 26876 | QVQLVQSGAEVKKPGASVKVSCKASGYTFISYDIN WVRQATGQGLEWMGWMNPKRGNTGYAQKFQGR VTMTRDTSISTAYMELSSLRSEDTAVYYCARGDPY NWNSYAMDVWGQGATVTVSS<br>SEQ ID NO: 30882 |

FIGURE 50
(Continued)

| | | | |
|---|---|---|---|
| iPS:436134 | 21-225_196H12 | NA | GAAATTGTGTTGACGCAGTCTCCAGGCACCCT GTTTTTGTCTCCAGGGGAAAGAGCCACCCTCT CCTGCAGGGCCAGTCAGTCAGAGTGTTAGAAGCAAC TTCTTAGCCTGGCCACCAGCAGAAACCTGGCCA GGCTCCCAGGCTCCTCATCTATGGTGCATACC GCAGGGCCACTGGCATCCCAGACAGACTTCAGT GGCAGTGGGTCTGGGACAGACTTCACTCTCAC CATCAACAGACTGGAGCTGAAGATTTTGCAG TGTATTACTGTCAGCAGTATATGGTAACTCACCG TGGACGTTCGGCCAAGGGACCAAGGTGGAAA TCAAA<br><br>SEQ ID NO: 26877 | CAGGTGCAGCTGCAGGAGTCGGGCCCAGGACTG GTGAACCCTTCACAGACCCTGTCCCTCACCTGCA CTGTCTCTGGTGGCTCCATCAGCAGTGGTGTTTA CTACTGGAGCTGGATCCGCCAGCACCCAGGGAA GGGCCTGGAGTGGATTGGGAACATCTATTACAGT GGGAGCACCTACAACACCGTCCCTCAAGAGT CGAATTATCATATCAGTAGACACGTCTAAGAACC AGTTCTCCCTGAAGCTGAGCTCTGTGACTGCCGC GGACACGGCCGTGTATTACTGTGCGAGAGGGA TTACGATGGTTCGGGGAGTTATCACTACTACTAC GGTTTGGACGTCTGGGGCCAAGGGACCACGGTC ACCGTCTCCTCA<br><br>SEQ ID NO: 30883 |
| | | AA | EIVLTQSPGTLFLSPGERATLSCRASQSVRSNFLA WHQQKPGQAPRLLIYGAYRRATGIPDRFSGSGS GTDFTLTINRLEPEDFAVYYCQQYGNSPWTFGQ GTKVEIK<br><br>SEQ ID NO: 26878 | QVQLQESGPGLVNPSQTLSLTCTVSGGSISSGVYYW SWIRQHPGKGLEWIGNIYYSGSTYNNPSLKSRIIISV DTSKNQFSLKLSSVTAADTAVYYCARGDYDGSGS YHYYYGLDVWGQGTTVTVSS<br><br>SEQ ID NO: 30884 |
| iPS:436138 | 21-225_197F2 | NA | GACATCCAGATGATCCAGTCTCCTTCCTCACT GTCTGCATCTGTAGGAGACAGAGTCACCATCA CTTGTCGGACGAGTCAGGGCATTGGCAATTAT TTAGCCTGGTTTCAGCAGAAACCAGGGAAAGC CCCTAAGTCCCTGCTCTATAAAACATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTTCCAACAATATCACTTACCCGCTCAC TTTCGGCGGAGGGACCAAGGTGGAGATCAAA<br><br>SEQ ID NO: 26879 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGACT GGAGTGGGTGGCAGTTATATGTTATGATGGAAGT AATAAAACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCAGGG CGTGGGCTACGACGGTTTGGACGTCTGGGGCCAA GGGACCACGGTCACCGTCTCCTCA<br><br>SEQ ID NO: 30885 |

FIGURE 50
(Continued)

| | | | | |
|---|---|---|---|---|
| | | AA | DIQMIQSPSSLSASVGDRVTITCRTSQGIGNYLA WFQQKPGKAPKSLLYKTSSLQSGVPSKFSGSGS GTDFTLTISSLQPEDFATYYFQQYITYPLTFGGGT KVEIK<br>SEQ ID NO: 26880 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDQGV GYDGLDVWGQGTTVTVSS<br>SEQ ID NO: 30886 |
| iPS:436140 | 21-225_197G3 | NA | GACATCCAGATGACCCAGTCTCCGTCCTCACT GTCTGCATCTGTAGGAGACAGAGTCACCATCA CTTGTCGGGCGAGTCAGGGCATTGGCAATCAT TTAGCCTGGTTTCAGCAGAAACCAGGGAAAGC CCCTAAGTCCCTGATCTATGCTGCATCCAGTTT GCAAAGTGGGGTCCCATCAAAGTTCAGCGGCA GTAGATCTGGGACAGATTTCTCTCTCACCATC AGCAGCCTGCAGCCTGAAGATTTTGCAACTTA TTACTGCCAACAGTATATTACTTACCCGGTCA CTTTCGGCCCTGGGACCAAAGTGGATATCAAG<br>SEQ ID NO: 26881 | CAGGTGCAACTGGTGGAGTCTGGGGGAGGCGTG GTCCAGCCTGGGAGGTCCCTGAGACTCTCCTGTG TAGCGTCTGGGTTCACCTTCAGTAGCTACGGCAT GCACTGGGTCCGCCAGGCTCCAGGCAAGGGGCT GGAGTGGGTGGCAGTTATATGACTCCGTGAAAGT AATAAAAACTATGCAGACTCCGTGAAGGGCCGA TTCACCATCTCCAGAGACAATTCCAAGAACACGC TGTATCTGCAAATGAACAGCTGAGAGCCGAGG ACACGGCTGTGTATTACTGTGCAGAGATCCCTC TGTAGGGTACGACGTATGACGTCTGGGGCCA AGGGACCACGGTCACCGTCCTCA<br>SEQ ID NO: 30887 |
| | | AA | DIQMTQSPSSLSASVGDRVTITCRASQGIGNHLA WFQQKPGKAPKSLIYAASSLQSGVPSKFSGSRSG TDFSLTISSLQPEDFATYYCQQYSNYPVTFGPGT KVDIK<br>SEQ ID NO: 26882 | QVQLVESGGGVVQPGRSLRLSCVASGFTFSSHGMH WVRQAPGKGLEWVAVIWYDGSNKNYADSVKGRF TISRDNSKNTLYLQMNSLRAEDTAVYYCARDPSVG YDGMDVWGQGTTVTVSS<br>SEQ ID NO: 30888 |

FIGURE 50
(Continued)

| | | | |
|---|---|---|---|
| iPS:436146 | 21-225_197F4 | NA | GAAATTGTTGAGCGAGTCTCCAGGCACCCT GTCTTTGTCTCCAGGGGAAGGAGCCACCCTCT CCTGCAGGGCCAGTCAGAGTATTGCAGAGC TTCTTAGCCTGGTACCTGCAGAAGCCTGGCCA GGCTCCCAGGCTCCTCATCTATGGTGCATCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGAAACTCACCG TGGGCGTTCGGCCAAGGGACCAAGGTGGAAA TCAAA<br><br>SEQ ID NO: 26883 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGGATCCGCCAGCACCCAGGGAA GGGCCTGGAGTGGATTGGGTACATCTTTTACAGT GGGAGCACCTACTACAACCCGTCCCTCAAGAGTC GAATTACCATATCAGTAGACACGTCTAAGAACCA GTTCTCCCTGAAGCTGAGCTCTGTGACTGCCGCG GACACGGCCGTGTATTACTGTGCGAGAGGGGATT ACGATGGTTCGGGGAGTTATCACTACTACTACGG TTTGGACGTCTGGGGCCAAGGGACCACGGTCACC GTCTCCTCA<br><br>SEQ ID NO: 30889 |
| | | AA | EIVLTQSPGTLSLSPGEGATLSCRASQSIRSSFLA WYLQKPGQAPRLLIYGASSRATGIPDRFSGSGSG TDFTLTISRLEPEDFAVYYCQQYGNSPWAFGQG TKVEIK<br><br>SEQ ID NO: 26884 | QVQLQESGPGLVKPSQTLSLTCTVSGGSISSGDYYW NWIRQHPGKGLEWIGYIFYSGSTYYNPSLKSRITISV DTSKNQFSLKLSSVTAADTAVYYCARGDYDGSGS YHYYYGLDVWGQGTTVTVSS<br><br>SEQ ID NO: 30890 |
| iPS:436150 | 21-225_197H4 | NA | GACATCATGATGACCCAGTCTTCAGACTCCCT GACTGTGTCTGTGGGCGAGAGGGCCATCATCA GCTGCAGGTCCAGCCAGAGTGTTTTACACAGC TCAACAATTACAACTACTTAGCTTGGTACCA GCAGAAAGCAGGACAGTCCTCCTAACCTGCTCA TTTACTGGGCATCTACCCGGGAATCCGGGGTC CCTGACCGATTCAGTGGCAGCGGGTCTGGGAC AGATTTCACTCTCCCCATCAGCAGCCTGCAGG CTGAAGATGTGGCAGTTTATTACTGTCAACAA TATTATAGTACTCCTCCGACGTTCGGCCTAGG GACCAAGGTGGAAATCAAA<br><br>SEQ ID NO: 26885 | CAGGTGCAGCTGGTGCAGTCTGGGGCTGAGGTG AAGAAGCCTGGGGCCTCAGTGAAGGTCTCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TAACACAGGCTATGCACCAGAACACTCCAGGCAG AGTCACCATGACCAGGAACACCTCCATAAGCAC AGCCTACATGGAGCTGAGCAGCCTGAGATCTGA GGACACGGCCGTGTATTACTGTGCCCATAGCAGT GGCTGGTACTACTTTGACTACTGGGGCCAGGGAA CCCTGGTCACCGTCTCCTCA<br><br>SEQ ID NO: 30891 |

FIGURE 50
(Continued)

| | | AA | DIMMTQSSDSLTVSLGERAIISCRSSQSVLHSFNN YNYLAWYQQKAGHPPNLLIYWASTRESGVPDR FSGSGSGTDFTLPISSLQAEDVAVYYCQQYYSTP PTFGLGTKVEIK<br>SEQ ID NO: 26886 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAHSSGW YYFDYWGQGTLVTVSS<br>SEQ ID NO: 30892 |
|---|---|---|---|---|
| iPS:436152 | 21-225_197B6 | NA | GACATCCAGATGACCCAGTCTCCATCCTCACT GTCTGCATCTGTAGGAGACAGAGTCACCATCA CTTGTGTGGCGAGTCAGGGCATTGGCAAATAT TTAGCCTGGTTTCAGCAGAAACCAGGGAAAGC CCCTAAGTCCCTGATCTATGGTGCATCCAGTTT GCAAAGTGGGGTCCCATCAAAGTTCACTCTCA GCAAAGTGGGATCTGGGACAGATTTCACTCTCACCATC AGCAGCCTGCAACAATATAGTACTTACCCGCTCA TTACTGCCAACAATATAGTACTTACCCGCTCA CTTTCGGCGGAGGGACCAAGGTGGAGATCAA A<br>SEQ ID NO: 26887 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGTATGGAAGT AATAAAACTACGCAGACTCCGTGAAGGGCCGA TTCACCATCTCCAGAGACAATTCCAAGAACATGT TGTATCTGCAAATGAACAGCCTGAGAGCCGAGG ACACGGCTATGTATTACTGTGCGACGTTTGGAC GTGGGCTACGACGGTTTGGACGTCTGGGGCCAA GGGACCCTGGTCACCGTCTCCTCA<br>SEQ ID NO: 30893 |
| | | AA | DIQMTQSPSSLSASVGDRVTITCRASQGIGKYLA WFQQKPGKAPKSLIYGASSLQSGVPSKFSGSGSG TDFTLTISSLQPENFATYYCQQYSTYPLTFGGGT KVEIK<br>SEQ ID NO: 26888 | QVQLVESGGGVVQPGRSLRLSCAASGFTFSSYGMH WVRQAPGKGLEWVAVIWYDGSNKNYADSVKGRF TISRDNSKNMLYLQMNSLRAEDTAMYYCARDQGV GYDGLDVWGQGTSVTVSS<br>SEQ ID NO: 30894 |

FIGURE 50
(Continued)

| | | | |
|---|---|---|---|
| iPS:436154 | 21-225_197C6 | NA | GACATCATGATGACCCAGTCTCCAGACTCCCT GGCTGTGTCTCTGGGCGAGAGGGCCATCATCA GCTGCAGGTCCAGCCAGAGTACTTACACAGC TCCAACAATTACAACTGGTATCAGCAGAAACCAGGACAATCCTCCTAACCTGCTCA GCAGAAACCAGGACAATCCTCCTAACCTGCTCA TTTACTGGGCATCTACCCGGGAATCCGGGGTC CCTGACCGATTCAGTGGCAGCGGGTCTGGGAC AGATTCACTCTCACCATCAGCAGCCTGCAGG CTGAAGATGTGGCAGTTTATTACTGTCAACAA TATTATAGTACTCCTCCGACGTTCGGCCTAGG GACCAAGGTGGAAATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCCCATAGCAGT GGCTGGTACTACTTTGACTACTGGGGCCAGGGAA CCCTGGTCACCGTCTCCTCA |
| | | | SEQ ID NO: 26889 | SEQ ID NO: 30895 |
| | | AA | DIMMTQSPDSLAVSLGERATISCRSSQSVLHSSNN YNYLAWYQQKPGQHPPNLLIYWASTRESGVPDRF SGSGSGTDFTLTISSLQAEDVAVYYCQQYYSTPP TFGLGTKVEIK | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAHSSGW YYFDYWGQGTLVTVSS |
| | | | SEQ ID NO: 26890 | SEQ ID NO: 30896 |
| iPS:436156 | 21-225_197C8 | NA | GACATCGTGATGACCCGGTCTCCAGACTCCCT GGCTGTGTCTCTGGGCGAGAGGGCCACCATCA ACTGCAAGTCCAGCCAGAGTGTTTTACACAGT TCCAACAATAAGAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCAGCATCAGCAGCCTGCAGG CTGAAGATGTGGCAATGTATTATACTGTCAGCAG TCTTATACTATTCCATTCACTTTCGGCCCTGGG ACCAAAGTGGATAACAAA | GAGGTGCAACTATTGGAGTCTGGGGGAGGCTTG GTGCAGCCTGGGGGGTCCCTGAGACTCTCCTGTG CAGCCTCTGGATTCACCTTTAGCAGCTGTGCCAT GACCTGGGTCCGCCAGGCTCCAGGGAAGGGACT GGAGTGGGTCTCAGCTATCATTGGTAATGGTGT AGAGCATACTACGCAGACTCCGTGAAGGGCCGG TTCACCATCTCCAGAGACAATTCCAAGAACACGC TGTATCTGCAAATGAACAGCCTGAGAACCGAGG ACACGGCCGTATATTACTGTGCGAAAGATCGGG GATATAGCAGGATAGCAGTGGCTGGTACCTTTGA CTACTGGGGCCAGGGAACCCTGGTCACCGTCTCC TCA |
| | | | SEQ ID NO: 26891 | SEQ ID NO: 30897 |

FIGURE 50
(Continued)

| | | | AA | DIVMTPSPDSLAVSLGERATINCKSSQSVLHSSN NKNYLAWYQQKPGQPPKLLIYWASTRESGVPD RFSGSGSGTDFTLSISSLQAEDVAVYYCQQSYTIP FTFGPGTKVDNK<br>SEQ ID NO: 26892 | EVQLLESGGGLVQPGGSLRLSCAASGFTFSSSAMT WVRQAPGKGLEWVSAIIGNGGRAYYADSVKGRFT ISRDNSKNTLYLQMNSLRTEDTAVYYCAKDRGYSR IAVAGTFDYWGQGTLVTVSS<br>SEQ ID NO: 30898 |
|---|---|---|---|---|---|
| iPS:436158 | 21-225_197G8 | | NA | GAGATTGTGATGACCCAGACTCCACTTCTCT GTCCGTCATCCTGGACAGCCGGCTCCATCT CCTGCAAGTCTAGTCAGAACCTCCTGCATAGT GATGGAAAGACCTATTTGTATTGGTACCTGCA GAAGCCAGGCCAGCCTCCACAGGTCCTGATCT ATGAAGTTTCCAACCGGTTCTCTGGGGTGCCA GATAGGTTCAGTGGCAGCGGGTCAGGGACAG ATTTCACACTGAAAATTAGCCGGGTGGAGGCT GAGGATGTTGGGGTTTATTCCTGCATGCAAAG TATACAGCTTCCCTGGACGTTCGCCCAAGGGT CCAAGGTGGAAATCAAA<br>SEQ ID NO: 26893 | CAGGTGCATCTGCAGGAGTCGGGCCCAGGACTG GTGAAGCCTTCGGAGACCCTGTCCCTCACCTGCA CTGTCTCTGGTGGCTCCATCAGTGCTTACTCCTGG AGCTGGATCCGGCAGCCCGCCGGGAAGGGACTG GAGTGGATTGGGCGTCTCTCCTGGTGGGAGCA CCAACTTCAACCCCTCCCTCAAGAGTCGAGTCAC CATGTCAGTAGACACGTCCAAGAACCAGTTCTCC CTGAGGCTGAGCTCTGTGACCGCCGCGGACACG GCCGTTTATTACTGTGCGAGACTCCGGTATAACT GGAACTTCCCTTACTTTGACTACTGGGGCCAGGG AGCCCTGGTCACCGTCTCCTCA<br>SEQ ID NO: 30899 |
| | | | AA | EIVMTQTPLSLSVIPGQPASISCKSSQNLLHSDGK TYLYWYLQKPGQPPQVLIYEVSNRFSGVPDRFS GSGSGTDFTLKISRVEAEDVGVYSCMQSIQLPWT FAQGSKVEIK<br>SEQ ID NO: 26894 | QVHLQESGPGLVKPSETLSLTCTVSGGSISAYSWSW IRQPAGKGLEWIGRLSPGGSTNFNPSLKSRVTMSVD TSKNQFSLRLSSVTAADTAVYYCARLRYNWNFPYF DYWGQGALVTVSS<br>SEQ ID NO: 30900 |

FIGURE 50
(Continued)

| | | NA | GACATCAGATGACCCAGTCTCCATCTTCCGT GTCTGCATCTGTAGGAGACAGAGTCACCATCA CTTGTCGGGCGAGTCAGGGTATTAGCAACTGG TTAGCCTGGTTTCAGCAGAAACCAGGGAAAGC CCCTCAGCTCCTGATCTATGCTGCATCCAGTTT GCAAAGTGGGGTCCATCAAGGTTCAGCGGCA GTGGATCTGGGACAGACTTCAGTCTCACCATC AGCAGCCTGCAGCCTGAAGATTTTGCAACTTA CTATTGTCAACAGGCTAACAGTTTCCCGTGGA CGTTCGGGCAAGGGACCAAGGTGGAAATCAA A<br><br>SEQ ID NO: 26895<br><br>DIQMTQSPSSLSASVGDRVTITCRASQGISNWLA WFQQKPGKAPQLLIYAASSLQSGVPSRFSGSGSG TDFSLTISSLQPEDFATYYCQQANSFPWTFGQGT KVEIK<br><br>SEQ ID NO: 26896 | GAGGTGCAGCTGTTGGAGTCTGGGGGAGGCTTG GCACAGCCGGGGGGTCCCTGAGACTCTCCTGTG CAGCCTCTGGATTCACCTTTAGGAGCTATGCCAT GAGCTGGGTCCGCCAGGCTCCAGGGAAGGGGCT GGAGTGGGTCTCAGTTATTAGTGGTAGAGGTGGT AACACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAAGGCATAGC AGTGGCTGGCTCGCACTACTTTGACTACTGGGGC CAGGGAACCCTGGTCACCGTCTCCTCA<br><br>SEQ ID NO: 30901<br><br>EVQLLESGGGLAQPGGSLRLSCAASGFTFRSYAMS WVRQAPGKGLEWVSVISGRGGNTYYADSVKGRFT ISRDNSKNTLYLQMNSLRAEDTAVYYCAKGIAVAG SHYFDYWGQGTLVTVSS<br><br>SEQ ID NO: 30902 |
|---|---|---|---|---|
| iPS:436160 | 21-225_197C9 | | | |
| iPS:436164 | 21-225_197G10 | NA | GACATCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGTGCATCCAGT TTACAAAGTGGGGTCCATCGAGGTTCAGCGG TCAGCAGCCTGCAGCCTGAAGATTTTGCAACT TATTACTGTCTACAGCATTATAGGTACCCATTC ACTTTCGGCCCTGGAACCAAAGTGGATATCAA A<br><br>SEQ ID NO: 26897 | CAGGTGCAGCTGGTGGAGTCTGGGGGAGGCGTG GTCCAGCCTGGGAGGTCCCTGAGACTCTCCTGTG TAGCGTCTGGATTCACCTTCAGTAGCTATGGCAT GCACTGGGTCCGCCAGGCTCCAGGCAAGGGGCT GGAGTGGGTGGCAGTTACATGGTATGATGGAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGAGAATGGC TACAATTTAGTTACTACTACGGTATAGACGTCTG GGGCCAAGGGACCACGGTCACCGTCTCCTCA<br><br>SEQ ID NO: 30903 |

FIGURE 50
(Continued)

| | | AA | DIQMTQSPSSLSASVGDRVTITCRASQGIRNDLG WYQQKPGKAPKRLIYGASSLQSGVPSRFSGSGS GTEFTLTISSLQPEDFATYYCLQHYRYPFTFGPGT KVDIK<br><br>SEQ ID NO: 26898 | QVQLVESGGGVVQPGRSLRLSCVASGFTFSSYGMH WVRQAPGKGLEWVAVTWYDGSNKYYADSVKGR FTISRDNSKNTLYLQMNSLRAEDTAVYYCAREWLQ FRYYYGIDVWGQGTTVTVSS<br><br>SEQ ID NO: 30904 |
|---|---|---|---|---|
| | | NA | GACATCCAGATGACCCAGTCTCCATCCTCGCT GTCTGCATCTGTGGGAGACAGAGTCACCATCA CTTGTCGGGCGAGTCAGGGCATTAACAAGTAT TTATCCTGGTTTCAGCAGAAACCAGGAAAGC CCCTAAGTCATTGATCTATGCTGCATCCAGTGT GCAAAGTGGGGTCCCATCAAAATTCAGCGGCA GTGGATCTGGGACAGATTTCACTCTCACCATC AGCCGCCTGCAGCCTGACGATATGACACTTA TTACGGCCAACGATATGACACTTACCCATTCA CTTTCGGCCCTGGGACCAAAGTGGATATCAAA<br><br>SEQ ID NO: 26899 | CAGGTGCAGCTGGTGGAGTCTGGGGGAGGCGTG GTCCAGCCTGGGAGGTCCCTGAGACTCTCCTGTG CAGCGTCTGGATTCACCTTCAGGAACTATGGCAT GCACTGGGTCCGCCAGGCTCCAGGCAAGGGGCT GGAGTGGGTGGCAGTTATATGGTTTGATGGAAGT AATGACTACTATGCAGACTCCGTGAAGGGCCGAT TCACCATCTCCAGAGACAATTCCAAGAACACGCT GTCACTGCAAATGAACAGCCTGAGAGCCGAGGA CACGGCTGTGTATTACTGTGCGAGAGATAGAAGC GTCGGCTACGACGGTTTAGATGTCTGGGGCCAAG GGACCACGGTCACCGTCTCCTCA<br><br>SEQ ID NO: 30905 |
| iPS:436167 | 21-225_197E11 | AA | DIQMTQSPSSLSASVGDRVTITCRASQGINKYLS WFQQKPGKAPKSLIYAASSVQSGVPSKFSGSGSG TDFTLTISRLQPDDFATYYGQRYDTYPFTFGPGT KVDIK<br><br>SEQ ID NO: 26900 | QVQLVESGGGVVQPGRSLRLSCAASGFTFRNYGM HWVRQAPGKGLEWVAVIWFDGSNDYYADSVKGR FTISRDNSKNTLSLQMNSLRAEDTAVYYCARDRSV GYDGLDVWGQGTTVTVSS<br><br>SEQ ID NO: 30906 |

FIGURE 50
(Continued)

| | | | |
|---|---|---|---|
| iPS:436173 | 21-225_197G12 | NA | GACATCCAGATGATCCAGTCTCCTCCTCACT GTCTGCATCTGTAGGAGACAGAGTCACCATCA CTTGTCGACGAGTCAGGGCATTGGCAATTAT TTAGCCTGGTTTCAGCAGAAACCAGGAAAGC CCCTAAGTCCCTGCTCTATAAACATCCAGTTT GCAAAGTGGGTTCCCATCAAAGTTCAGGGCA GTGGATCTGGGACAGATTTCACTCTCACCATC AGCAGCCTGCAGCTGAAGATTTTGCAACTTA TTACTTCCAACAATATGACTTACCCGCTCAC TTTCGGCGGAGGGACCAAGGTGGAGATCAAA<br><br>SEQ ID NO: 26901 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGACT GGAGTGGGTGGCAGTTATATGGTATGATGGAAGT AATAAAAACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCAGGG CGTGGGCTACGACGGTTTGACGTCTGGGGCCAA GGGACCACGGTCACCGTCTCCTCA<br><br>SEQ ID NO: 30907 |
| | | AA | DIQMIQSPSSLSASVGDRVTITCRTSQGIGNYLA WFQQKPGKAPKSLLYKTSSLQSGFPSKFSGSGSG TDFTLTISSLQPEDFATYYFQQYMTYPLTFGGGT KVEIK<br><br>SEQ ID NO: 26902 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDQGV GYDGLDVWGQGTTVTVSS<br><br>SEQ ID NO: 30908 |
| iPS:436177 | 21-225_198B1 | NA | GAAATTGTGTTGACGCAGTCTCCAGGCACCCT GTCTTTGTCTCCAGGGGAAAGCGCCACCCTCT CCTGCAGGGCCGGTCAAAGTATTAGAACCAAC TTCTTAGCCTGGTACCAGCAGCAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAACAGACTGGAGCCTGAAGATTTTGCAG TGTATTACTGTCAGCAGTATGGTAGTCACCG TGGACGTTCGGCCAAGGGACCAAGGTGGAAA TCAAA<br><br>SEQ ID NO: 26903 | CAGGTGCAACTGAAGGAGTCGGGCCCAGGACTG GTGAAGCCTTCACAGACCCTGTCCCTCACCTGCA CTGTCTCTGGTGCTCCATCAACAGTGGTGATTA CTACTGGAACTGGTTCCGCCAGCACCAGGGAA GGGCCTGGAGTGGATTGGGTACATCTTCCACAGT GGGAGCACCTACTACAACCCGTCCCTCAAGAGTC GAGTAAACGTATCAGTAGACACGTCTAAGAACC AGTTCTCCCTGAAGCTGAGTTCTGTGACTGCCGC GGACACGGCCGTGTATTACTGTGCGAGAGGGGA TTACGATGGTTCGGGGAGTTATCACTACTATTAC GGTATGGACGTCTGGGGCCGAGGGACCACGGTC ACCGTCTCCTCA<br><br>SEQ ID NO: 30909 |

FIGURE 50
(Continued)

| | | | | |
|---|---|---|---|---|
| iPS:436179 | | AA | EIVLTQSPGTLSLSPGESATLSCRAGQSIRTNFLAWYQQQPGQAPRLLIYGASSRATGIPDRFSGSGSGTDFTLTINRLEPEDFAVYYCQQYGSSPWTFGQGTKVEIK<br>SEQ ID NO: 26904 | QVQLKESGPGLVKPSQTLSLTCTVSGGSINSGDYYWNWFRQHPGKGLEWIGYIFHSGSTYYNPSLKSRVTVSVDTSKNQFSLKLSSVTAADTAVYYCARGDYDGSGSYHYYGMDVWGRGTTVTVSS<br>SEQ ID NO: 30910 |
| | 21-225_198E1 | NA | GAAATTGTGTTGACGCAGTCTCCAGGCACCCTGTCTTTGTCTCCAGGGGAAAGAGCCACCCTCTCCTGCAGGGCCAGTCAGTCAGAGTATAAGGAGCAACTACTGGAACTGGTACCAGCAGAAACCTGGCCCTTCTTAGCCTGATCTATGGTGCATTCAGGGCTCCCAGGGCCACTGGCATCCCAGACAGGTTCAGTGGCAGTGGGTCTGGGACAGACTTCACTCTCACCATCAACAGACTGGAGCCTGAAGATTTTGCAGTGTATTACTGTCAGCAGTATGGTAGTAGTCCGTGGACGTTCGGCCAAGGGACCAAGGTGGAAATCAAA<br>SEQ ID NO: 26905 | CAGGTGCAGCTGCAGGAGTCGGGCCCAGGACTGGTGAAGCCTTCACAGACCCTGTCCTCACCTGCACTGTCTCTGGTGGCTCCATCAACAGTGGTGATTACTACTGGAACTGGTTCCGCCAGCACCCAGGGAAGGGCCTGGAGTGGATTGGGTATCATCTTTACAGTGGGAGCACCTACTACAACCCGTCCCTCAAGAGTCGACTTTCCATATCAGTAGACACGTCTAAGAACCAGTTCTCCCTGAAGCTGAGCTCTGTGACTGCCGCGGACACGGCCGTGTATTACTGTGCGAGAGGGGATTACGATGGTTCGGGGAGTTATCACTACTATTACGGTATGGACGTTCGGGGCCAAGGGACCACGGTCACCGTCTCCTCA<br>SEQ ID NO: 30911 |
| | | AA | EIVLTQSPGTLSLSPGERATLSCRASQSIRSNFLAWYQQKPGQAPRLLIYGAFSRATGIPDRFSGSGSGTDFTLTINRLEPEDFAVYYCQQYGNSPWTFGQGTKVEIK<br>SEQ ID NO: 26906 | QVQLQESGPGLVKPSQTLSLTCTVSGGSINSGGYYWNWIRQHPGKGLEWIGFIFYSGSTYYNPSLKSRLSISVDTSKNQFSLKLSSVTAADTAVYYCARGDYDGSGSYHYYGMDVWGQGTTVTVSS<br>SEQ ID NO: 30912 |

FIGURE 50
(Continued)

| | | | |
|---|---|---|---|
| iPS:436181 | 21-225_198C2 | NA | GAAATTGTGGTGACGCAGTCTCCAGGCACCCT GTTATTGTATTCCGAGGAGAGAGTCACCCTCT CCTGCAGGGCCAGTCAGTCAGATGTTAGAAGCAGC TACTTAGCCTGGTACCAGCAGAAACCTGGCCA GGCTCCCAGGCTCCTCATCTGTGTGGTCATTCA GCAGGGCCAGTGCATCCCAGACAGGTTCAGT GGCAGTGGGTCTGGGACAGATTCACTCTCAC CATCAGCAGACTGGAGCCTGAAAGATTTCGCAG TGTACTACTGTCAGCAGTATGGTAACTCACCG TGGACGTTCGGCCAAGGGACCAAGGTGGAAA TCAAA<br><br>SEQ ID NO: 26907 | CAGGTGCAGCTGCAGGAGTCGGGCCCAGGACTG GTGAAGCCCTCGTGGCTCCATCAGCAGTGGTGTTA CTGTCTCTGTGGCTCCATCAGCAGTGGTGTTA CTACTGGAGCTGGATCGCCAGCACCCAGGGAA GGGCCTGGAGTGGATTGGGAACATCTATTACAGT GGGAGCACCTACTACAACCCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGGGATT ACTATGGTTCGGGAGTTATCACAACTACTACGG TTTGGACGTCTGGGGCCAAGGGACCACGGTCACC GTCTCCTCA<br><br>SEQ ID NO: 30913 |
| | | AA | EIVVTQSPGTLLLYSEERSTLSCRASQSVRSSYLA WYQQKPGQAPRLLICGAFSRASGIPDRFSGSGSG TDFTLTISRLEPEDFAVYYCQQYGNSPWTLGHA TKVEIK<br><br>SEQ ID NO: 26908 | QVQLQESGPGLVKPSQTLSLTCTVSGGSISSGGYYW SWIRQHPGKGLEWIGNIYYSGSTYYNPSLKSRVTIS VDTSKNQFSLKLSSVTAADTAVYYCARGDYYGSG SYHNYYGLDVWGQGTTVTVSS<br><br>SEQ ID NO: 30914 |
| iPS:436189 | 21-225_198B6 | NA | GACATCCAGATGACCCAGTCTCCATCCTCACT GTCTGCATCTGTAGGAGACAGAGTCACCATCA CTTGTCGGGCAGTCAGGCATTGGCAATTAT TTAGCCTGGTTTCAGCAGAAACCAGGGAAAGC CCCTAAGTCCCTGATCTATGCTGCATCCAGTTT GCAAAGTGGGGTCCCATCAAGGTTCAGCGGCA ATAGATCTGGGACAGATTTCACTCTCACCATC AGCAGCCTGCAGCCTGAAGATTTTGCAACTTA TTACTGCCAACAATATACTTACCCGCTCA CTTTCGGCGGAGGGACCAAGGTGGAGATCAA A<br><br>SEQ ID NO: 26909 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAACACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCAGGG CGTGGGCTACTACGGTATGGACGTCTGGGGCCAA GGGACCACGGTCACCGTCTCCTCA<br><br>SEQ ID NO: 30915 |

FIGURE 50
(Continued)

| | | | |
|---|---|---|---|
| iPS:436191 | | AA | DIQMTQSPSSLSASVGDRVTITCRASQGIGNYLA WFQQKPGKAPKSLIYAASSLQSGVPSKFSGNRSG TDFTLTISSLQPEDFATYYCQQYSTYPLTFGGGT KVEIK<br>SEQ ID NO: 26910 | QVQLVESGGGVVQPGRSLRLSCAASGFTFSSYGMH WVRQAPGKGLEWVAVIWYDGSNKHYADSVKGRF TISRDNSKNTLYLQMNSLRAEDTAVYYCARDQGV GYYGMDVWGQGTTVTVSS<br>SEQ ID NO: 30916 |
| 21-225_198B9 | | NA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAATTATATGGTTTGATGAAGT AATAAATACTATGTAGACTCCGTGAAGGGCCGAT TCACCATCTCCAGAGACAATTCCAAGAACACGCT GTTTCTGCAAATGAGCAGCTGAGAGCCGAGGA CACGGCTGTGTATTATTGCGCGAGAGAATGGCTA CAATTCAGGTACTACTACGGTATGGACGTCTGGG GCCAAGGGACCACGGTCACCGTCTCCTCA<br>SEQ ID NO: 30917 | |
| | | AA | DIQMTQSPSSLSASVGDRVTITCRASQGIRKDLG WYQQKPGKAPKRLIYAASSLQSGVPSRFSGSGS GTEFTLTISSLQPEDFATYVCLQHYRYPFTFGPGT KVDFK<br>SEQ ID NO: 26912 | QVQLVESGGGVVQPGRSLRLSCAASGFTFSNYGM HWVRQAPGKGLEWVAIIWFDGSNKYYVDSVKGRF TISRDNSKNTLFLQMSSLRAEDTAVYYCAREWLQF RYYYGMDVWGQGTTVTVSS<br>SEQ ID NO: 30918 |

FIGURE 50
(Continued)

| | | | |
|---|---|---|---|
| iPS:436193 | 21-225_198A10 | NA | GATATTGTGTTGACCCAGACTCCACTCTCTG<br>TCCGTCACCCCTGGACAGCCGGCCTCCATATC<br>GTGCAAGTCTAGTCAGAGCCTTCCTCTATAGTG<br>ATGAAGGACCTATTTGTATTGGTACCTGCAG<br>AAACCAGGCCAGTCTCCACAGGTCCTGATCTG<br>TGAGGTTTCCAACCGGTTCTCTGGAGTGCCAG<br>ATAGGTTCAGTGGCAGCGGGTCAGGACAGA<br>TTTCACACTGAAAATCAGCCGGGTGGAGGCAG<br>GAGATGTTGGGGTTTATTACTGCATGCAAAGT<br>ATACAGCTTCCCTGGACGTTCGGCCAAGGGAC<br>CAAGGTGGAAATCAAA<br><br>SEQ ID NO: 26913 | CAGGTGCAGCTGCAGGAGTCGGGCCCAGGACTG<br>GTGAAGCCTTCGGAGACCCTGTCCCTCACCTGCA<br>CTGTCTCTGGTGGCTCCATCAGAAGTTACCACTG<br>GAGTTGGATCCGGCAGCCGCCGGGAAGGGACT<br>GGAGTGGATTGGGACATATCTATACCAGTAGGAGC<br>ACCAACTACAACCCTCCCTCAAGAGTCGAGTCA<br>CCATTTCAGTAGACACGTCCAAGAACCAGTTCTC<br>CCTGAAGCTGAGCTCTGTGACCGCCACGACACG<br>GCCGTGTATTACTGTGCGAGACTCCGGTATAACT<br>GGAACTTCCCTTACTTTGACTACTGGGGCCAGGG<br>AACCCTGGTCACCGTCTCCTCA<br><br>SEQ ID NO: 30919 |
| | | AA | DIVLTQTPLSLSVTPGQPASISCKSSQSLLYSDGR<br>TYLYWYLQKPGQPPQVLICEVSNRFSGVPDRFS<br>GSGSGTDFTLKISRVEAGDVGVYYCMQSIQLPW<br>TFGQGTKVEIK<br><br>SEQ ID NO: 26914 | QLQLQESGPGLVKPSETLSLTCTVSGGSIRSYHWSW<br>IRQPAGKGLEWIGHIYTSRSTNYNPSLKSRVTISVDT<br>SKNQFSLKLSSVTATDTAVYYCARLRYNWNFPYFD<br>YWGQGTLVTVSS<br><br>SEQ ID NO: 30920 |
| iPS:436195 | 21-225_198G10 | NA | GAAATTGTGTTGACGCAGTCTCCAGGCACCCT<br>GTCTTTGTCTCCAGGGGAAAGAGCCACCCTCT<br>CCTGCAGGGCCAGTCAGAGTATTCGCAGCAGC<br>TTCTTAGCCTGGTACCAGCAGAAACCTGGCCA<br>GGCTCCCAGGCTCCTCATCTATGGTGCATCCA<br>GCAGGGCCACTGGCATCCCAGACAGGTTCAGT<br>GGCAGTGGGTCTGGGACAGACTTCACTCTCAC<br>CATCAGCAGACTGGAGCTGAAGATTTTGCAG<br>TGTATTACTGTCAGCAGTATGGTAACTCACCG<br>TGGGCGTTCGGCCAAGGGACCAAGGTGGAAA<br>TCAAA<br><br>SEQ ID NO: 26915 | CAGGTGCAGCTGCAGGAGTCGGGCCCAGGACTG<br>GTGAAGCCTTCACAGACCCTGTCCCTCACCTGCA<br>CTGTCTCTGGTGGCTCCATCAGCAGTGGTGATTA<br>CTACTGGAACTGGATCCGCCAGCTCCCAGGGAA<br>GGGCCTGGAGTGGATTGGATTGGTACATCTTTTACAGT<br>GGGAGCACCTACTACAACCCGTCCCTCAAGAGTC<br>GACTTACCATATCAGTGGACACGTCTAAGAACCA<br>GTTCTCCCTGAAGCTGAGTTCTGTGACTGCCGCG<br>GACACGGCCGTGTATTACTGTGCGAGAGGGGATT<br>ACGATGGTTCGGGGAGTTATCACTTCTACTACGG<br>TATGGACGTCTGGGGCCAAGGGACCACGGTCAC<br>CGTCTCCTCA<br><br>SEQ ID NO: 30921 |

FIGURE 50
(Continued)

| | | | | |
|---|---|---|---|---|
| | | AA | EIVLTQSPGTLSLSPGERATLSCRASQSIRSSFLA WYQQKPGQAPRLLIYGASSRATGIPDRFSGSGSG TDFTLTISRLEPEDFAVYYCQQYGNSPWAFGQG TKVEIK<br><br>SEQ ID NO: 26916 | QVQLQESGPGLVKPSQTLSLTCTVSGGSISSGDYYW NWIRQLPGKGLEWIGYIFYSGSTYYNPSLKSRLTISV DTSKNQFSLKLSSVTAADTAVYYCARGDYDGSGS YHFYYGMDVWGQGTTVTVSS<br><br>SEQ ID NO: 30922 |
| iPS:436197 | 21-225_199C2 | NA | GAAATTGTGTTGACGCAGTCTCCAGGCACCCT GTCTTTGTCTCCAGGGGAAAGAGCCACCCTCT CCTGCAGGGCCAGTCAGAGTATTCGCAGCAGC TTCTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAACAGACTGGAGCCTGAAGATTTTGCAG TGTATTACTGTCAGCAGTATGGTAACTCACCG TGGGCGTTCGGCCAAGGGACCAAGGTGGAAA TCAAA<br><br>SEQ ID NO: 26917 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGGCTCCGCCAGCACCCAGAGAA GGGCCTGGAGTGGATTGGGTACATCTTTACAGT GGGAGCACCTACTACAACCGTCCCTCAAGAGTC GAGTTACCATATCAGTGGACACGTCTATGACCA GTCTCCCTGAAGCTGACCTCTGTGACTGCCGCG GACACGGCCGTGTATTACTGTGCGAGAGGGGATT ACGATGGTTCGGGGAGTTATCACTACTACTACGG TATGGACGTCTGGGGCCAAGGGACCACGGTCAC CGTCTCCTCA<br><br>SEQ ID NO: 30923 |
| | | AA | EIVLTQSPGTLSLSPGERATLSCRASQSIRSSFLA WYQQKPGQAPRLLIYGASSRATGIPDRFSGSGSG TDFTLTINRLEPEDFAVYYCQQYGNSPWAFGQG TKVEIK<br><br>SEQ ID NO: 26918 | QVQLQESGPGLVKPSQTLSLTCTVSGGSISSGDYYW NWLRQHPEKGLEWIGYIFYSGSTYYNPSLKSRVTIS VDTSMTQFSLKLTSVTAADTAVYYCARGDYDGSG SYHYYYGMDVWGQGTTVTVSS<br><br>SEQ ID NO: 30924 |

FIGURE 50
(Continued)

| | | | |
|---|---|---|---|
| iPS:436199 | 21-225_199E3 | NA | GACATCCAGATGACCCAGTCTCCATCCTCCT GTCTGCATCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATTTCTCTGCATCCAGTT TGCAAAGGGGGTCCCATCAAGATTCAGCGGC AGTGGATCTGGGACAGAATTCACTCTCACAAT CAGCAGCCTGCAGCCTGAAGATTTTGCAACTT ATTACTGTCTACAGCATAAAAGGTACCCGCTC ACTTTCGGCGGAGGGACCAAGGTGGAGATCA AA SEQ ID NO: 26919 | CAGGTGCAGCTACAGCAGTGGGGCGCAGGACTG TTGAAGCCTTCGGAGACCGTCCCTCACCTGCG CTGTCTATGGTGGGTCCTTCAGTGGTTACTTCTGG ACCTGGATCCGCCAGCCCCCAGGGAAGGGCTG GAGTGGATTGGGGAAATCAATCATAGTGGAAGC ACCAACTACAACCGTCCCTCAAGAGTCGCGTCA CCATATCAGTAGACACGTCCAAGAACCAGTTCTC CCTGAAGCTGAGCTCTGTGACCGCCGCGGACACG GCTGTGTATTACTGTGCGAGAGACTACGGTGCTG ACTACTGGGGCCAGGGAACCCTGGTCGCCGTCTC CGCA SEQ ID NO: 30925 |
| | | AA | DIQMTQSPSSLSASVGDRVTITCRASQGIRNDLG WYQQKPGKAPKRLISSASSLQRGVPSRFSGSGSG TEFTLTISSLQPEDFATYYCLQHKRYPLTFGGGT KVEIK SEQ ID NO: 26920 | QVQLQQWGAGLLKPSETLSLTCAVYGGSFSGYFW TWIRQPPGKGLEWIGEINHSGSTNYNPSLKSRVTISV DTSKNQFSLKLSSVTAADTAVYYCARDYGADYWG QGTLVAVSA SEQ ID NO: 30926 |
| iPS:436201 | 21-225_199C5 | NA | GACATCCAGATGACACAGTCTCCATCCTCACT GTCTGCATCTGTAGGAGACAGAGTCACCATCA CTTGTCGGGCGAGTCAGGGACATTAGCAAGTAT TTAGCCTGGTTTCAGCAGAAACCAGGGAAAGC CCCTAAGTCCCTGATCTATGCTGCATCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAGCTTA TTACTGCCAACAGTATCTTACTTACCCGCTCAC TTTCGGCGGAGGGACCAAGGTGGAGATCAAA SEQ ID NO: 26921 | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAAAACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCAGGG CGTGGCTACTACGGTATGGACGTCTGGGGCCAA GGGACCACGGTCACCGTCTCCTCA SEQ ID NO: 30927 |

FIGURE 50
(Continued)

| | | | | |
|---|---|---|---|---|
| iPS:436203 | 21-225_199A6 | AA | DIQMTQSPSSLSASVGDRVTITCRASQGISKYLA WFQQKPGKAPKSLIYAASSLQSGVPSKFSGSGSG TDFTLTISSLQPEDFAAYYCQQYLTYPLTFGGGT KVEIK<br>SEQ ID NO: 26922 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDQGV GYYGMDVWGQGTTVTSS<br>SEQ ID NO: 30928 |
| | | NA | GACATAGTGATGACGCAGTCTCCAGCCACCCT GTCTGTGTCTCCAGGGGATAGAGCCACCCTCT CCTGCAGGCCCAGTCAGAGTTTTAGCAGAAAC TTAGCCTGGTACCAGCAGAAACCTGGCCAGGC TCCCAGGCTCCTCATCTATGGTGCATCCACTA GGGCCACTGGTATCCCAGCCAGGTTCAGTGGC AGTGGGTCTGGGACAGAGTTCACTCTCACCAT CAGCAGCCTGGAGTGTGAAGATTTTGCAGTTT ACTACTGTCAGCAGTATAATAACTGGCCGCTC ACTTTCGGCGGAGGGACCAAGGTGGAGATCA AA<br>SEQ ID NO: 26923 | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGGCAT GCACTGGGTCCGCCAGGCTCCAGGCAAGGGGCT GGAGTGGGTGGCAGTTATATGGTTTGATGGAAGT AATCAATACTATGCCGACTCCGTGAAGGGCCGAT TCACCATCTCCAGAGACAATTCCAAGAACACGCT GTATCTGCAATTGAACAGCCTGAGAGCCGAGGA CACGGCTGTCTATTACTGTGCGAGAGATCCCACGGG GTCTACTACGCTATGGACGTCTGGGGCCAAG GGACCACGGTCACCGTCTCCTCA<br>SEQ ID NO: 30929 |
| | | AA | DIVMTQSPATLSVSPGDRATLSCRPSQSFSRNLA WYQQKPGQAPRLLIYGASTRATGIPARFSGSGSG TEFTLTISSLECEDFAVYYCQQYNNWPLTFGGGT KVEIK<br>SEQ ID NO: 26924 | QVQLVESGGGVVQPGRSLRLSCAASGFTFSNYGM HWVRQAPGKGLEWVAIIWFDGSNQYYADSVKGRF TISRDNSKNTLYLQLNSLRAEDTAVYYCARAHGVY YYAMDVWGQGTTVTSS<br>SEQ ID NO: 30930 |

FIGURE 50
(Continued)

| | | | | |
|---|---|---|---|---|
| iPS:436205 | 21-225_199A7 | NA | GACATCCAGATGACCCAGTCTCCATCCTCCT GTCTGCATCTGTAGGAGACAGAGTCACCATCA CTTGCCGGGCAAGTCAGGGCATAAGAAAGA TTTAGGCTGGTATCAGCAGAAACCAGGGAAA GCCCCTAAGCGCCTGATCTATGCTGCATCCAG TTTGCAAAGTGGGGTCCATCAAGGTTCAGCG GCAGTGGATCTGGGACAGAATTCACTCTCACA ATCAGCAGCCTGCAGCCTGAAGATTTTGCAAC TTATGTCTGTCTACAACATTATGTTACCCTTT CACTTTCGGCCCTGGGACCAAAGTGGATTTCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGCT GGAGTGGGTGGCAATTATATGGTTTGATGGAAGT AATAAATACTATGCAGACTCCGTGAAGGGCCGA TTCACCATCTCCAGAGACAATTCCAAGAACACGC TGTTTCTGCAAATGAGCAGCCTGAGAGCCGAGG ACACGGCTGTGTATTACTGTGCGAGAGAATGGCT ACAATTCAGGTACTACTACGGTATGGACGTCTGG GGCCAAGGGACCACGGTCACCGTCTCCTCA |
| | | | SEQ ID NO: 26925 | SEQ ID NO: 30931 |
| | | AA | DIQMTQSPSSLSASVGDRVTITCRASQGIRKDLG WYQQKPGKAPKRLIYAASSLQSGVPSRFSGSGS GTEFTLTISSLQPEDFATYVCLQHYRYPFTFGPGT KVDFK | QVQLVESGGGVVQPGRSLRLSCAASGFTFSNYGM HWVRQAPGKGLEWVAIIWFDGSNKYYADSVKGRF TISRDNSKNTLFLQMSSLRAEDTAVYYCAREWLQF RYYYGMDVWGQGTTVTVSS |
| | | | SEQ ID NO: 26926 | SEQ ID NO: 30932 |
| iPS:436207 | 21-225_199C7 | NA | GAAATTGTGTTGACGCAGTCTCCAGGCACCCT GTCTTTGTCTCCAGGGGAAAGAGCCACCCTCT CCTGCAGGGCCAGTCAGAGTATAAGGACCAA CTTCTTAGCCTGGTACCAGCAGAAACCTGGCC AGGCTCCCAGGCTCCTCATCTATGGTGCATCC AGCAGGGCCACTGGCATCCCAGACAGGTTCAG TGGCAGTGGGTCTGGGACAGACTTCACTCTCA CCATCAACAGACTGGAGCCTGAAGATTTTGCA GTGTATTACTGTCAGCAGTATGGTAACTCACC GTGGACGTTCGGCCAAGGGACCAAGGTGGAA ATCAAA | CAGGTGCAGCTGCAGGAGTCGGGCCCAGGACTG GTGAAGCCTTCACAGACCCTGTCCCTCACCTGCA CTGTCTCTGGTGGCTCCATCAACAGTGGTGGTTA CTACTGGAACTGGATCCGCCAGCACCCAGGGAA GGGCCTGGAGTGGATTGGGTTCATCTTTACAGT GGGAGCACCTACTACAACCGTCCCTCAAGAGTC GAGTTTCCATATCAGTAGACACGTCTAAGAACCA GTTCTCCCTGAAGCTGAGCTCTGTGACTGCCGCG GACACGGCCGTGTATTACTGTGCGAGAGGGGATT ACGATGGTTCGGGGAGTTATCACTACTATTACGG TATGGACGTCTGGGGCCAGGGGACCACGGTCAC CGTCTCCTCA |
| | | | SEQ ID NO: 26927 | SEQ ID NO: 30933 |

FIGURE 50
(Continued)

| | | | | |
|---|---|---|---|---|
| | | AA | EIVLTQSPGTLSLSPGERATLSCRASQSIRTNFLA WYQQKPGQAPRLLIYGASSRATGIPDRFSGSGSG TDFTLTINRLEPEDFAVYYCQQYGNSPWTFGQG TKVEIK<br><br>SEQ ID NO: 26928 | QVQLQESGPGLVKPSQTLSLTCTVSGGSINSGYY WNWIRQHPGKGLEWIGFIFYSGSTYYNPSLKSRVSI SVDTSKNQFSLKLSSVTAADTAVYYCARGDYDGS GSYHYYGMDVWGQGTTVTVSS<br><br>SEQ ID NO: 30934 |
| | | NA | GAAATTGTGCTGACGCAGTCTCCAGGCACCCT GTCTTTGTCTCCAGGGGAAAGAGCCACCCTCT CCTGCAGGGCCAGTCAGAGTGTTAGAAGCAGC TACTTAGCCTGGTACCAGCAGAAACCTGGCCA GGCTCCCAGGCTCCTCATCTATGGTGCATTCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTACTACTGTCAGCAGTATGGTAACTCACCG TGGACGTTCGGCCACGGGACCAAGGTGGAAA TCAAA<br><br>SEQ ID NO: 26929 | CAGGTGCAGCTGCAGGAGTCGGGCCAGGACTG GTGAAGCCCTCACAGACCCTATCCCTCACCTGCA CTGTCTCTGGTGGCTCCATCAGCAGTGGTTA CTACTGGAGCTGGATCCGCCAGCACCCAGGAA GGGCCTGGAGTGGATTGGAACATCTATTACAGT GGGAGCACCTACTACAACCCGTCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGGGGATT ACTATGGTTCGGGGAGTTATCACAACTACTACGG TTTGGACGTCTGGGGCCAAGGGACCACGGTCACC GTCTCCTCA<br><br>SEQ ID NO: 30935 |
| iPS:436210 | 21-225_199G11 | AA | EIVVTQSPGTLSLSPGERATLSCRASQSVRSSYLA WYQQKPGQAPRLLIYGAFSRATGIPDRFSGSGSG TDFTLTISRLEPEDFAVYYCQQYGNSPWTFGHGT KVEIK<br><br>SEQ ID NO: 26930 | QVQLQESGPGLVKPSQTLSLTCTVSGGSISSGGYYW SWIRQHPGKGLEWIGNIYYSGSTYYNPSLKSRVTIS VDTSKNQFSLKLSSVTAADTAVYYCARGDYYGSG SYHNYYGLDVWGQGTTVTVSS<br><br>SEQ ID NO: 30936 |

FIGURE 50
(Continued)

| | | | | |
|---|---|---|---|---|
| iPS:436212 | 21-225_200G1 | NA | GACATCCAGATGACCCAGTCTCCATCCTCCCT GTCTGCATCTGTAGGAGACAGAGTCACCATCA CTTGCCGGGCAAGTCAGAGAGTTAGCAGTCAT TTAAATTGGTTTCAGCAGAAACCAGGGAAAGC CCCTAAGCTCCTGATCTATGCTGAGTCCAGTTT ACAAAGTGGGGTCCCATCAAGGTTCAGTGGCA GTGGATCTGGGACAGATTCACTCTCACCATC AGCAGTCTGCAACCTGAAGATTTTGCAACTTA TTCCTGTCAACAGAGTTACAGTTCCCCTCCGTG GACGTTCGGCCAAGGGACCAAGGTGGAGTTC AAA | GAGGTGCAACCTGTTGGAGTCTGGGGGAGGCTTG GTGCAGCCTGGGGGGTCCCTGAGACTCTCCTGTG CAGCCTCTGGATTCACCTTTAGCAGCTATGCCAT GAGCCTGGTCCGCCAGGCTCCAGGGAAGGGGCT GGAGTGGGTCTCAGTTATTAGTGGTAGAGGCGGT AATACATTCTACGCAGACTCCGTGAGGGGCCGT TCACCATCTCCAGAGACAATTCCAAGAACACGCT GTATCTGCAAATGAACAGCCTGAGAGCCGAGGA CACGGCCGTATATTACTGTGCGCGACGTATAGCA GTGGATGGCTATGATGCTTTTGATGTCTGGGGCC AAGGGACAATGGTCACCGTCTCTCA |
| | | | SEQ ID NO: 26931 | SEQ ID NO: 30937 |
| | | AA | DIQMTQSPSSLSASVGDRVTITCRASQSISSYLNW FQQKPGKAPKLLIYAESSLQSGVPSRFSGSGSGT DFTLTISSLQPEDFATYSCQQSYSSPPWTFGQGT KVEFK | EVQLLESGGGLVQPGGSLRLSCAASGFTFSSYAMS WVRQAPGKGLEWVSAISGRGGNTFYADSVRGRFTI SRDNSKNTLYLQMNSLRAEDTAVYYCARRIAVDG YDAFDVWGQGTMVTVSS |
| | | | SEQ ID NO: 26932 | SEQ ID NO: 30938 |
| iPS:436214 | 21-225_200F6 | NA | GACATCCAGATGACCCAGTCTCCATCCTCCCT GTCTGCATCTGTAGGAGACAGAGTCACCATCA CTTGCCGGGCAAGTCAGGACAGTTAGAGATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATCACTGTCTACAGCATTATCGTTACCCATTC ACTTTCGGCCCTGGGACCAAAGTGGATATCAA A | CAGGTGCAGCTGGTGCAGTCTGGGGGAGGCGTG GTCCAGCCTGGGAAGGTCCCTGAGACTCTCCTGTG CAGCGTCTGGATTCACCTTCAGTAGTTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTACGAGAGAATGGCT ACAATTAGTATTACTACGGTATGGACGTCTGG GGCCAAGGGACCACGGTCACCGTCTCCTCA |
| | | | SEQ ID NO: 26933 | SEQ ID NO: 30939 |

FIGURE 50
(Continued)

| | | | | |
|---|---|---|---|---|
| | | AA | DIQMTQSPSSLSASVGDRVTITCRASQDIRNDLG WYQQKPGKAPKRLIYAASSLQSGVPSRFSGSGS GTEFTLTISSLQPEDFATYHCLQHYRYPFTFGPGT KVDIK<br><br>SEQ ID NO: 26934 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCTREWLQF RYYYGMDVWGQGTTVTVSS<br><br>SEQ ID NO: 30940 |
| iPS:436216 | 21-225_200B7 | NA | GAAATTGTGCTGACTCAGTCTCCAGACTTTCA GTCTGTGACTCCAAAGGAGAAAGTCACCATCA CCTGCCGGGCCAGTCAGAACATTGGTAATACC TTGCACTGGTACCAGCAGAAACCAGATCAGTC TCCTAAGCTCCTCATCAAGTATGCTTCCCAGTC CTTCTCAGGGGTCCCCTCGAGGTTCAGTGGCA GTGGGTCTGGGACAGATTTCATCTCACCATC AATAGCCTGGAAGCTGAAGATGCTGCAACGTA TTACTGTCATCAGAGTGGTAGTTTACCTCAGA CGTTCGGCCAAGGGACCAAGGTGGAAATCAA A<br><br>SEQ ID NO: 26935 | CAGGTGCAGCTGCAGGAGTCGGGCCCAGGACTG GTGAAGCCTTCACAGACCCTGTCCTCACCTGCA CTGTCTCTGGTGGCTCCATCAGCAGTGGTTA CTACTGGAGCTGATCCGCCAGCACCCAGGAA GGGCCTGGAGTGGATTGGGTACATCTTTTACAGT GGGAGCACCAACTACAACCGTCCCTCAGGAGT CGAGTTACCATATCAGTAGACACGTCTAAGAACC AGTTCTCCCTGAAACTGAGTTCTGTGACTGCCGC GGACACCGCCGTGTATTACTGTGCGAGAGCGG GTATAACTGGAACAACGGTATGGACGTCTGGGG CCAAGGGACCACGGTCACCGTCTCCTCA<br><br>SEQ ID NO: 30941 |
| | | AA | EIVLTQSPDFQSVTPKEKVTITCRASQNIGNTLH WYQQKPDQSPKLLIKYASQSFSGVPSRFSGSGSG TDFILTINSLEAEDAATYYCHQSGSLPQTFGQGT KVEIK<br><br>SEQ ID NO: 26936 | QVQLQESGPGLVKPSQTLSLTCTVSGGSISSGGYYW SWIRQHPGKGLEWIGYIFYSGSTNYNPSLRSRVTIS VDTSKNQFSLKLSSVTAADTAVYYCARAGYNWNN GMDVWGQGTTVTVSS<br><br>SEQ ID NO: 30942 |

FIGURE 50
(Continued)

| | | | |
|---|---|---|---|
| iPS:436218 | 21-225_200G7 | NA | GACATCGTGATGACCCAGTCTCCAGACTCCCCGACTGCGTCTGGGCCGAGAGGGCCACCGTCAATGCAAGTCCAGCCAGAGAGTGTTTACACAGCTCCAACAATAACAACTACTTAGCTTGGTACCAGCAGAAACCAGGACAGCCTCCTAAGCTGCTCATTTACTGGGCATCTACCCGGAATCCGAGTCCCTGACCGATTCAGTGGCAGCGGGTCTGGGACAGATTTCACTCTCGCCATCAGCAGCTGCAGCTGAAGATGTGGCGGTTTATTACTGTCAGCAATATTATAATACTCCTCCGACATTCGGCCAAGGGACCAAGGTGGAAATCAAA |
| | | | SEQ ID NO: 26937 |
| | | AA | DIVMTQSPDSPTASLGERATVKCKSSQSVLHSSNNNNYLAWYQQKPGQPPKLLIYWASTRESGVPDRFSGSGSGTDFTLAISSLQAEDVAVYYCQQYYNTPPTFGQGTKVEIK |
| | | | SEQ ID NO: 26938 |
| | | | CAGGTGCAGCTGGTGCAGTCTGGGGCTGAGGTGAAGAAGCCTGGGGCCTCAGTGAAGGTCCTGCAAGGCTTCTGGATACACCTTCACCAATTATGATATCAACTGGATGCGGCAGGCCACTGGTCAAGGCTTGAGTGGATGGGATGCACCTTAACAGTGGTAACACAGGCTATGCACCGAAGTTCCAGGCAGAGTCACCATGAGCCAGGAGACACCTCCATAAGCACAGCCTTCATGGAGCTGAGCAGCCTGAGATCTGAGGACACGGCCGTGTATTACTGTGCCTATAGCGGTGGCTGGTACGTGTTCGACCCCTGGGGCCAGGGAACCCTGGTCACCGTCTCCTCA |
| | | | SEQ ID NO: 30943 |
| iPS:436220 | 21-225_200F8 | NA | GAAATTGTGCTGACTCAGTCTCCAGACTTTCAGTCTGTGGCTCCAAAGGAGAGAAAGTCACCATCACCTGCCGGGCCAGTCAGATTCAGAGTATTGGTAGTAACTTACACTGGTACCAGCAGAAACCAGATCAGTCTCCGAAACTCCTCATCAAGCTCTGCTTCCCAGTCCTTCTCAGGGGTCCCCTCGAGGTTCAGTGGCAGTGGGATCTGGGACAGATTTCACCCTCACCATCAATAGCCTGGAAACTGAAGATGCTGCAACGTATTACTGTCAGCAGAGTAGTAGTTTACCGTGGACGTTCGGCCAAGGGACCAAGGTGGAAATCAAA |
| | | | SEQ ID NO: 26939 |
| | | AA | QVQLVQSGAEVKKPGASVKVSCKASGYTFTNYDINWMRQATGQGLEWMGWMHLNSGNTGYAPKFQGRVTMTRDTSISTAFMELSSLRSEDTAVYYCAYSGGWYVFDPWGQGTLVTVSS |
| | | | SEQ ID NO: 30944 |
| | | | CAGGTGCAGCTGCAGGAGAGTCGGCCCAGGACTGGTGAAGCCTTCGGAGACCCTGTCCCTCACCTGCACTGTCTCTGGTGCTCATCAATAATTACTACTGGAGCTGGATCCGGCAGCCGCCGGAAGGGACTGGAGTGGATTGGGCGTATCTATACCAGTGGGAGCACCAACTACAACCCCTCCCTCAAGAGTCGAGTCAACCATCAGTAGACACGTCCAAGAACCAGTTCTCCCTGAAGCTGAGTCTGTGACCGCCGGACACGGCCGTGTATTACTGTGCGAGAGATCGGGGATACTATGGCTACTACGGTATGGACGTCTGGGGCCAAGGGACCACGGTCACCGTCTCCTCA |
| | | | SEQ ID NO: 30945 |

FIGURE 50
(Continued)

| | | | | |
|---|---|---|---|---|
| iPS:436222 | 21-225_200C9 | AA | EIVLTQSPDFQSVAPKEKVTITCRASQSIGSNLHW YQQKPDQSPKLLIKSASQSFSGVPSRFSGSGSGT DFTLTINSLETEDAATYYCQQSSSLPWTFGQGTK VEIK<br><br>SEQ ID NO: 26940 | QVQLQESGPGLVKPSETLSLTCTVSGGSINNYYWS WIRQPAGKGLEWIGRIYTSGSTNYNPSLKSRVTMS VDTSKNQFSLKLSSVTAADTAVYYCARDRGYYGY YGMDVWGQGTTVTVSS<br><br>SEQ ID NO: 30946 |
| | | NA | GACATCCAGATGACCCAGTCTCCATCCTCCCT GTCTGCATCTGTTGGAGACAGAGTCACCATCA CTTGCCGGGCAACTCAGGGCATTAGAAAAGAT TTAGGCTGTATCAGCAGAAACCAGGAAAG CCCCTAAGCGCCTGATCCATACTGCATCCAGT TTGCAAAGTGGGGTCCCATTAAGGTTCAGCGG CAGTGGATCTGGGACAGAATTCACTCTCACAA TCAGCAGCCTGCAGCTACAGCATAATAGTTACCGTG GACGTTCGGCCAAGGGACCAAGGTGGAAATC AAA<br><br>SEQ ID NO: 26941 | CAGGTGCAGCTGCAGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGCT GGAGTGGGTGGCAGTTATATCATATGATGGAAGT TATAAAAACTATATAGACTCCGTGAAGGGCCGAT TCACCATCTCCAGAGACACAATTCCAAGAACACGCT GTATCTGCAAATGAACAGCCTGAGAGCTGAGGA CACGGCTGTGTTTACTGTGCGAGAGGTACCCAC GGGTACTACTACGGTGTGGACGTCTGGGGCCAA GGGACCACGGTCACCGTCTCCTCA<br><br>SEQ ID NO: 30947 |
| | | AA | DIQMTQSPSSLSASVGDRVTITCRATQGIRKDLG WYQQKPGKAPKRLIHTASSLQSGVPLRFSGSGS GTEFTLTISSLQPEDFATYYCLQHNSYPWTFGQG TKVEIK<br><br>SEQ ID NO: 26942 | QVQLVESGGGVVQPGRSLRLSCAASGFTFSSYGMH WVRQAPGKGLEWVAVISYDGGYKNYIDSVKGRFT ISRDNSKNTLYLQMNSLRAEDTAVFYCARGTHGYY YGVDVWGQGTTVTVSS<br><br>SEQ ID NO: 30948 |

FIGURE 50
(Continued)

| | | | |
|---|---|---|---|
| iPS:436226 | 21-225_200F10 | NA | GAAATTGTTGTTGACGCAGTCTCCAGGCACCCT GTCTTTGTCTCCAGGGGAAAGAGCCACCCTCT CCTGCAGGGCCAGTCAGTCAGAATATTCGCAGCAGC TTCTTAGCCTGGTACCAACAGAAACCTGGCCA GGCTCCCAGGCTCCTCATCTATGGTGCATCCA GCAGGGCCACTGGCATCCCAGACAGTTCAGT GGCAGTGGGTCTGGGACAGACTTCACTCTCAC CATCAACAGACTGGAGCCTGAAGATTTTGCAG TGTATTACTGTCAGCAGTATGGTAACTCACCG TGGGCGTTCGGCCAAGGGACCAAGGTGGAAA TCAAA SEQ ID NO: 26943 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGGCTCCGCCAGCACCCAGAGAA GGGCCTGGAGTGGATTGGGTACATCTTTTACAGT GGGAGCACCTACTACAACCCGTCCCTCAAGAGTC GAATTACCATATCAGTGACACGTCTATGACCCA GTTCTCCCTGAAGCTGACCTCTGTGACTGCCGCG GACACGGCCGTGTATTACTGTGCGAGAGGGATT ACGATGGTTCGGGAGTTATCACTACTACGG TATGGACGTCTGGGGCCAAGGGACCACGGTCAC CGTCTCCTCA SEQ ID NO: 30949 |
| | | AA | EIVLTQSPGTLSLSPGERATLSCRASQNIRSSFLA WYQQKPGQAPRLLIYGASSRATGIPDRFSGSGSG TDFTLTINRLEPEDFAVYYCQQYGNSPWAFGQG TKVEIK SEQ ID NO: 26944 | QVQLQESGPGLVKPSQTLSLTCTVSGGSISSGDYYW NWLRQHPEKGLEWIGYIFYSGSTYYNPSLKSRITISV DTSMTQFSLKLTSVTAADTAVYYCARGDYDGSGS YHYYYGMDVWGQGTTVTVSS SEQ ID NO: 30950 |
| iPS:436228 | 21-225_200F12 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGAGAG CCCCTAAGCGCCTGATCTATTCTGCATCCAGTT TGCATACTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAAGAGTTACCCGCTC ACTTTCGGCGGAGGGACCAAGGTGGAGATCA AA SEQ ID NO: 26945 | CAGGTGCAGCTGCAGCAGTGGGGCGCAGGACTG TTGAAGCCTTCGGAGACCCTGTCCCTCACCTGCG CTGTCTATGGTGGGTCCTTCAGTGGTTACTTCTGG ACCTGGATACGCCAGCCCCCAGGGAAGGGACTG GAGTGGATTGGGAAATCAGTCATAGTGGAAGC ACCAACTACAACCCGTCCCTCAAGAGTCGAGTCA CCATATCAGTAGACACGTCCAAGAACCAGTTCTC CCTGAAGTGAGCTGTGACCGCCGGACAC GGCTGTGTATTACTGTGCGAGGGACTACGGGCG GACTACTGGGGCCAGGGAACCCTGGTCACCGTCT CCTCA SEQ ID NO: 30951 |

FIGURE 50
(Continued)

| | | | | |
|---|---|---|---|---|
| | | AA | DIQMTQSPSSLSASVGDRVTITCRASQGIRNDLGWYQQKPGRAPKRLIYSASSLHTGVPSRFSGSGSGTEFTLTISSLQPEDFATYYCLQHKSYPLTFGGGTKVEIK | QVQLQQWGAGLLKPSETLSLTCAVYGGSFSGYFWTWIRQPPGKGLEWIGEISHSGSTNYNPSLKSRVTISVDTSKNQFSLKVSSVTAADTAVYYCARDYGADYWGQGTLVTVSS |
| | | | SEQ ID NO: 26946 | SEQ ID NO: 30952 |
| | | NA | GACATCCAGATGACCCAGTCTCCATCCTCCCTGTCTGCATCTGTAGGAGACAGAGTCACCATCACTTGCCGGGCAAGTCAGGGCATTAGGAATGATTTAGGCTGGTATCAGCAGAAACCAGGGAAAGCCCCTAAGCGCCTGATCTATTCTGCATCCATTTTACAAAGGGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATAAAAGTTACCCTCTCACTTTCGGCGGAGGGACCAAGGTGGAGGTCAAA | CAGGTGCAGCTACAGCAGTGGGGCGCAGGACTGTTGAAACCTTCGGAGACCCTGTCCCTCACCTGCGCTGTCACTGGTGGTCCTTCAGTGGTTACTTCTGGACCTGATCCGCCAGCCCCAGGGAAGGGGCTGGAGTGGATTGGGGAAATCAGTCATAGTGGACGCACCAACTACAACCCGTCCCTCAAGAGTCGAGTCACCATATCAGGAGACACGTCCAAGAACCAGTTCTCCCTGAAGCTGAGCTCTGTGACCGCCGCGGACACGGCTGTGTATTACTGTGCGAGGGACTACGGGGCGGACTACTGGGGCCAGGGAACCCTGGTCACCGTCTCCTCA |
| | | | SEQ ID NO: 26947 | SEQ ID NO: 30953 |
| iPS:436230 | 21-225_201A1 | AA | DIQMTQSPSSLSASVGDRVTITCRASQGIRNDLGWYQQKPGKAPKRLIYSASILQRGVPSRFSGSGSGTEFTLTISSLQPEDFATYYCLQHKSYPLTFGGGTKVEVK | QVQLQQWGAGLLKPSETLSLTCAVTGGSFSGYFWTWIRQPPGKGLEWIGEISHSGRTNYNPSLKSRVTISGDTSKNQFSLKLSSVTAADTAVYYCARDYGADYWGQGTLVTVSS |
| | | | SEQ ID NO: 26948 | SEQ ID NO: 30954 |

FIGURE 50
(Continued)

| | | | | |
|---|---|---|---|---|
| iPS:436232 | 21-225_201E1 | NA | GAAATTGTGTTGACGCAGTCTCCAGACACCCT GTCTTTGTCTCCAGGGGAAAGAGCCACCCTCT CCTGCAGGGCCAGTCCGAGTATTAACAGCGGC TTCTTAGCCTGGTACCAGCAGAAACCTGGCCA AGCTCCCAGGCTCCTCATCTATGGTGCATCCA GCAGGGCCACTGGCATCCAGACAGGTTCAGT GGCAGTGGGTCTGGGACAGACTTCACTCTCAC CATCAGCAGACTGGAGCCTGAAGATTTTGCAA TGTTTCACTGTCACCAGTATGAGACCTCACCG TGGACGTTCGGCCAAGGGACCAAGGTGGAGA TCAAA<br><br>SEQ ID NO: 26949 | CAGGTGCAGTCTACAGCAGTGGGGCGCAGGACTG TTGAAGCCTTCGGAGACCTGTCCCTCACCTGCG CTGTCTTTGATGGGTCCTTCAGTCCTTACTACTGG AGCTGGATCCGCCAGCCCCAGGGAAGGGCTG GAGTGGATTGGGGAAGTCAATCATAGTGGAAGC ACCAACTACAACCGTCCTCAAGAGTCGAGTCA CCATATCAGTAGACACGTCCAAGAACCAGTTCTC CCTGAAGCTGAGCTCTGTGACCGCCGCGGACACG GCTGTGTATTACTGTGCGAGAGACTACGGGGGTT TAGACTACTGGGGCCAGGGAGCCCTGGTCACCGT CTCCTCA<br><br>SEQ ID NO: 30955 |
| | | AA | EIVLTQSPDTLSLSPGERATLSCRASPSINSGFLA WYQQKPGQAPRLLIYGASSRATGIPDRFSGSGSG TDFTLTISRLEPEDFAMFHCHQYETSPWTFGQGT KVEIK<br><br>SEQ ID NO: 26950 | QVQLQQWGAGLLKPSETLSLTCAVFDGSFSPYYWS WIRQPPGKGLEWIGEVNHSGSTNYNRPQESRVTISV DTSKNQFSLKLSSVTAADTAVYYCARDYGGLDYW GQGALVTVSS<br><br>SEQ ID NO: 30956 |
| iPS:436234 | 21-225_51E3 | NA | CAGTCTGTGCTGACTCAGCCACCCTCAGCGTC TGGGACCCCCGGGCAGAGGGTCACCATCTCTT GTTCTGGAAGCAACTCCAACATCGGAAGTAAT ATTGTAAACTGGTACCAGCAGCTCCCAGGAAAC GGCCCCCAAACTCCTCATCTATAGTAATGATC AGCGGCCCTCAGGGGTCCCTGACCGATTCTCT GGCTCCAAGTCTGGCACCTCAGCCTCCCTGGCC CATCAGTGGGCTCCAGTGAGGATGAGGCTG ATTATTACTGTACAGGATGGATGACAGCCTG AATGGTTGGGTGTTCGGCGGAGGGACCAAGCT GACCGTCCTA<br><br>SEQ ID NO: 26951 | CAGGTTCAGCTGGTGCAGTCTGGAGCTGAGGTGA AGAAGCCTGGGGCCTCAGTGAAGGTCTCCTGCA AGGCTTCAGGTTACACCTTTAACAGCTATGTGAT CAGCTGGGTGCGACTGGCCCCTGGACAAGGGCTT GAGTGGATGGGATGGATCAGCGCTTATATGGTA ACACAAAGAATGCACAGAGATTCCAGGCAGAG TCACCATGACCACAGACACATCCACGAGCACGG CCTACATGGAGCTGAGGAGCCTGAGATCTGACG ACACGGCCGTTTATTACTGTGGAGACACGATTT TGGAGTGGTTATTATAAGGGTATGGACGTCTGG GGCCAAGGGACCACGGTCACCGTCTCCTCA<br><br>SEQ ID NO: 30957 |

FIGURE 50
(Continued)

| | | | | |
|---|---|---|---|---|
| iPS-436236 | | AA | QSVLTQPPSASGTPGQRVTISCSGSGSNSNIGSNIVT WYQQLPGTAPKLLIYSNDQRPSGVPDRFSGSKS GTSASLAISGLQSEDEADYYCTAWDDSLNGWVF GGGTTLTVL<br>SEQ ID NO: 26952 | QVQLVQSGAEVKKPGASVKVSCKASGYTFNSYGIS WVRLAPGQGLEWMGWISAYNGNTKNAQRFQGRV TMTTDTSTSTAYMELRSLRSDDTAVYYCARHDFW SGYYKGMDVWGQGTTVTVSS<br>SEQ ID NO: 30958 |
| | 21-225_201F7 | NA | GAAATAGTGATGACGCAGTCTCCAGCCACCCT GTCTGTGTCTCCAGGGGAAAGAGCCACCCTCT CCTGCAGGGCCAGTCAGAATATTAAAACAAC TTAGCCTGGTACCAGCAGAAACCTGGCCAGGC TCCCAGGCTCCTCATCTTTGGTGCATCCACCAG GGCCACTGGTATCCCAGCCAGGTTCAGTGGCA GTGGGTCTGGGACAGTCTGAAGATTTTGCAGTTTA TTACTGTCAGCAGTTTTATAACTGGCTGTGCA GTTTTGGCCAGGGGACCAAGCTGGAGCTCAAA<br>SEQ ID NO: 26953 | CAGGTACAGCTGCAGCAGTCAGGTCAGGACTG GTGAAGCCCTGCAGACCCTCTCACTCACCTGTG CCATCTCCGGGGACAGTGTCTAGCAACAGTGC TGCTTGGAACTGGATCAGGCAGTCCCATCGAGA GGCCTTGAGTGGCTGGGAAGGACATACTACAGG TCCAAGTGGTATAATTATGAAGTATCTGTGA GAAGTCGAATAACCATCAACCAGACACATCCA AGAACCAGTTCTCCCTGCAGCTGAACTCTGTGAC TCCCGAGGACACGGCTGTATATTTCTGTGCGAGA GATCAACGGTACTACGGTATGGACGTCTGGGGCC AAGGGACCACGGTCACCGTCTCCTCA<br>SEQ ID NO: 30959 |
| | | AA | EIVMTQSPATLSVSPGERATLSCRASQNIKNNLA WYQQKPGQAPRLLIFGASTRATGIPARFSGSGSG TEFTLTISSLQSEDFAVYYCQQFYNWLCSFGQGT KLELK<br>SEQ ID NO: 26954 | QVQLQQSGPGLVKPSQTLSLTCAISGDSVSSNSAA WNWIRQSPSRGLEWLGRTYYRSKWYNYEVSVRS RITNPDTSKNQFSLQLNSVTPEDTAVYFCARDQRY YGMDVWGQGTTVTVSS<br>SEQ ID NO: 30960 |

FIGURE 50
(Continued)

| | | | |
|---|---|---|---|
| iPS:436238 | 21-225_201B2 | NA | GAAATTGTTTTGACGCAGTCTCCAGGCACCCT GTCTTTGTCTCCAGGGGAAAGAGCCACCCTCT CCTGCAGGGCCAGTCAGAGTGTTAGCAGCAAC TACTTAGCCTGGTATCAGCAGAGACCTGGCCA GGCTCCCAGACTCCTCATCTATGGTGCATCCA GCAGGGCCACTGGCATCCCAGACAGATTCAGT GGCAGTGGGTCTGGGACAGACTTCACTCTCAC CATCAGCAGACTGGAGCCTGAAGATTTTGCAG TGTATTTCTGTCAGCAGTATGAAAACTCACCG TGGACGTTCGGCCAAGGGACCAAGGTGGAAA TCAAA<br>SEQ ID NO: 26955 | CAGGTGCAGCTACAGCAGTGGGGCGCAGGACTG TTGAAGCCTTCGGAGACCGTCCTCCTCACCTGC CTGTCTTTGGTGGTCCATCAGTGTTTACTACTGG ACCTGGATCCGCCAGCCCCCAGGGAAGGGGCTG GAGTGGATTGGGGAAATCAATCATAGTGGAAGC ACCAACTACAACCGTCCCTCAAGAGTCGAGTCA CCATATCAGTAGACACGTCCAAGAACCAGTTCTC CCTGAAGCTGAGCTCTGTGACCGCCGCGACACG GCTGTGTATTACTGTGCGAGGGACTATGGTGTCT TTGATTACTGGGGCCAGGGAACCCTGGTCACCGT CTCCTCA<br>SEQ ID NO: 30961 |
| | | AA | EIVLTQSPGTLSLSPGERATLSCRASQSVSSNYLA WYQQRPGQAPRLLIYGASSRATGIPDRFSGSGSG TDFTLTISRLEPEDFAVYFCQQYENSPWTFGQGT KVEIK<br>SEQ ID NO: 26956 | QVQLQQWGAGLLKPSETLSLTCAVFGGSISVYYWT WIRQPPGKGLEWIGEINHSGSTNYNRPSLKSRVTISV DTSKNQFSLKLSSVTAADTAVYYCARDYGVFDYW GQGTLVTVSS<br>SEQ ID NO: 30962 |
| iPS:436240 | 21-225_201E8 | NA | GAAATTGTGCTGACTCAGTCTCCAGCCTTTCA GTCTGTGACTCCAAAGGAGAAAGTCACCATCA CCTGCCGGGCCAGTCAGAGCATTGGTAGT TTACACTGGTACCAGCAGAAACCAGATCAGTC TCCAAAACTCCTCATCAAGTATGCTTCCCAGT CCTTCTCAGGGGTCCCCTCGAGGTTCAGTGGC AGTGGATCTGGGACAAATTTCACCCTCACCAT CAATAGCCTGGAAGCTGAAGATGCTGTAACGT ATTACTGTCATCAGAGTCGAAGTTTACCGCTC ACTTTCGGCGGAGGGACCAAGGTAGAGATCA GA<br>SEQ ID NO: 26957 | CAGGTGCAGCTGGTACAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCGACCCTAACAGTGG TGGCACAAACTATCCACAGAAGTTTCAGGGCAG GGTCACCATGACCAGGGACACGTCCATCAGCAC AGCCTACATGGAACTGAGCAGGCTGAGATCTGA CGACACGGCCGTGTTTACTGTGCGAAAGATCAA GGGTATAACTGGAACTCTTTTGACTACTGGGGCC AGGGAACCCTGGTCACCGTCTCCTCA<br>SEQ ID NO: 30963 |

FIGURE 50
(Continued)

| | | | | |
|---|---|---|---|---|
| | | AA | EIVLTQSPAFQSVTPKEKVTITCRASQNIGRSLHW YQQKPDQSPKLLIKYASQSFSGVPSRFSGSGSGT NFTLTINSLEAEDAVTYYCHQSRSLPLTFGGGTK VEIR<br>SEQ ID NO: 26958 | QVQLVQSGAEVKKPGASVKVSCKASGYTFTGYYM HWVRQAPGQGLEWMGWIDPNSGGTNYPQKFQGR VTMTRDTSISTAYMELSRLRSDDTAVFYCAKDQGY NWNSFDYWGQGTLVTVSS<br>SEQ ID NO: 30964 |
| iPS:436242 | 21-225_201A10 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAGAG CCCCTAAGCGCCTGATCTATTCTACATCCAGTT TGCATTCTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATATAGTTACCCGCTC ACTTTCGGCGGAGGGACCAAGGTGGAGATCA AA<br>SEQ ID NO: 26959 | CAGGTGCAGCTACAGCAGTGGGGCGCAGGACTG TTGAAGCCTTCGGAGACCCTGTCCCTCACCTGCG CTGTCTCTATGTGGGTCCTTCAGTGTTACTTCTGG ACCTGGATACGCCAGCCCCCAGGGAAGGGACTG GAGTGGATTGGGAAATCAGTCATAGTGGAAGC ACCAACTACAACCGTCCCTCAAGAGTCGAGTCA CCATATCAGTAGACACGTCCAAGAACCAGTTCTC CCTGAAGGTGAACTCTGTGCGAGGGACTACGGGGCG GGCTGTGTATTACTGTGCGAGGGACTACGGGGCG GACTACTGGGGCCAGGGAACCCTGGTCACCGTCT CCTCA<br>SEQ ID NO: 30965 |
| | | AA | DIQMTQSPSSLSASVGDRVTITCRASQGIRNDLG WYQQKPGRAPKRLIYSTSSLHSGVPSRFSGSGSG TEFTLTISSLQPEDFATYYCLQHNSYPLIFGGGT KVEIK<br>SEQ ID NO: 26960 | QVQLQQWGAGLLKPSETLSLTCAVYGGSFSGYFW TWIRQPPGKGLEWIGEISHSGSTNYNPSLKSRVTISV DTSKNQFSLKVNSVTAADTAVYYCARDYGADYW GQGTLVTVSS<br>SEQ ID NO: 30966 |

FIGURE 50
(Continued)

| | | | |
|---|---|---|---|
| iPS:436244 | 21-225_201H10 | NA | GACATCCAGATGACCCAGTCTCCATCTCCCTGTCTGCATCTGTTGGAGACAGAGTCACCATCACTTGCCGGGCAAGTCACACAGGATCAACAGCTATTTAAATTGGTATCAGCAGAAATCAGGAAAGCCCCTAAACTCCTAATCTATGCTGCATCCAGTTTGCAAAGTGGGGTCCCGTCAAGGTTCAGTGGCAGTGGATCTGGGACAGATTTCACTCTCACCTTCAGTAGTCTACAACCTGAAGATTTTGCAACTTACTACTGTCAACAGAGTTACAGTTTCCCGCTCACTTTCGGCGGAGGGACCAAGGTGGAGATGAAGG | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTATATCCACTGGGTGCGACAGGCCCCTGGACAAGGCTTGAGTGGATGGCATGGATCAACCCTAATAGTGGTGGCACAAACTATGCACAGAAGTTTCAGGCAGGTCACCATGACCAGGGACACGTCCATCACCACAACCTACATGGAGCTGAGCAGGCTGAGATCTGACGACACGGCCGTGTATTACTGTGCGAGAGGATACAGCTATGGTTACAACTGGTTCGACCCCTGGGGCCAGGGAACCCTGGTCACCGTCTCCTCA |
| | | | SEQ ID NO: 26961 | SEQ ID NO: 30967 |
| | | AA | DIQMTQSPSSLSASVGDRVTITCRASHNINSYLNWYQQKSGKAPKLLIYAASSLQSGVPSRFSGSGSGTDFTLTFSSLQPEDFATYYCQQSYSFPLTFGGGTKVEMR | QVQLVQSGAEVKKPGASVKVSCKASGYTFTGYYIHWVRQAPGQGLEWMAWINPNSGGTNYAQKFQGRVTMTRDTSITTYMELSRLRSDDTAVYYCARGYSYGYNWFDPWGQGTLVTVSS |
| | | | SEQ ID NO: 26962 | SEQ ID NO: 30968 |
| iPS:436246 | 21-225_201G6 | NA | GATATTGTGATGACTCAGTCTCCACTCTCCCTGCCCGTCACCCCTGGAGAGCCGGCCTCCATCTCCTGCAGGTCTAGTCAGAGCCTCCTCCATATAATAGATACAACCATTTGGATTGTGCAGAAGCCAGGACAGTCTCCACAGTCCTGATCTATTTGGGTTCTAATCGGGCCTCCGGGGTCCCTGACAGGTTCAGTGGCAGTGGATCAGGCACAGATTTTACACTGAAAATCAGCAGAGTGGAGGCTGAGGATGTTGGGGTTTATTACTGCATGCAAGCTACAAACTCCCACTTTCGGCGGAGGGACCAAGGTGGAGATCAAA | GAGGTGCAGCTGTTGGAGTCTGGGGGAGGCTTGGTACAGCCTGGGGGGTCCCTGAGACTCTCCTGTGTAGCCTCTGGATTCACCTTTAGCAGCTATGCCATGAGCTGGGTCCGCCAGGCTCCAGGGAAGGGGCTGGAGTGGGTCTCAACTATTAGTGGTAGTGGTGTTAGAACATACTACGCAGACTCCGTGAAGGGCCGGTTCACCATCTCCAGAGACAATTCCAAGAACACGCTGTTTCTGCAAATGAACAGCCTGAGAGCCGAGGACACGGCCAGTCAGTGGCTGTTCCACTTTGACTACTGGGGCCAGGGAACCCTGGTCACCGTCTCCTCA |
| | | | SEQ ID NO: 26963 | SEQ ID NO: 30969 |

FIGURE 50
(Continued)

| | | | | |
|---|---|---|---|---|
| | | | DIVMTQSPLSLPVTPGEPASISCRSSQSLLHNNRY NHLDWYLQKPGQSPQLLIYLGSNRASGVPDRFS GSGSGTDFTLKISRVEAEDVGVYYCMQALQTPT FGGGTKVEIK<br>SEQ ID NO: 26964 | EVQLLESGGGLVQPGGSLRLSCVASGFTFSSYAMS WVRQAPGKGLEWVSTISGSGVRTYYADSVKGRFTI SRDNSKNTLFLQMNSLRAEDTAVYYCAKGGARSS GWFHFDYWGQGTLVTVSS<br>SEQ ID NO: 30970 |
| iPS-436248 | 21-225_202A3 | NA | GACATCCAGATGTCCCAATCTCCATCTCCCT GTCTGCATCTGTTGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTGTGCTGCATCCAGG TTGCAAAGTGGGGTCCCATCAAGGTTCAGCGG CAGTGGATCTGGAACAGAATTCACTCTCACAA TCAGCAGCCTGCAGCCTGAAGATTTTGCAATT TATTACTGTCTACAGCATCATGACTACCCATTC ACTTTCGGCCCTGGGACCAAAGTGGATATCAA A<br>SEQ ID NO: 26965 | CAGGTGCAGCTGGAGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACAGGACAAGGGC TTGAGTGGCTGGGATGGATGAACCCTAAGAGAG GTAACACAGGCTATGCACCAGAAGTTCCAGGCA GAGTCACCATGACCAGGAATACCTCCATAAGCA CAGCCCACATGGAGCTGAGCAGCCTGAGATCTG AGGACACGGCCGTGTATTACTGTGCGAGGAA GGTATAGCAGGGAGGATTACTACTACTATTATGA TATGGACGTCTGGGGCCAAGGGACCACGGTCAC CGTCTCCTCA<br>SEQ ID NO: 30971 |
| | | AA | DIQMSQSPSSLSASVGDRVTITCRASQGIRNDLG WYQQKPGKAPKRLICAASRLQSGVPSRFSGSGS GTEFTLTISSLQPEDFAIYYCLQHHDYPFTFGPGT KVDIK<br>SEQ ID NO: 26966 | QVQLEQSGAEVKKPGASVKVSCKASGYTFTSYDIN WVRRQATGQGLEWLGWMNPKRGNTGYAQKFQGR VTMTRNTSISTAHMELSSLRSEDTAVYYCARGRYS REDYYYYDMDVWGQGTTVTVSS<br>SEQ ID NO: 30972 |

FIGURE 50
(Continued)

| | | | |
|---|---|---|---|
| iPS:436250 | 21-225_201A4 | NA | GAAATAGTGATGACGCAGTCTCCAGCCACCCT GTCTGTGTCTCCAGGGAAAGTGCCACCCTCT CCTGCAGGTCCAGTCAGATATTAAAAGCAAC TTAGCCTGGTACCAGCAGAAACCTGGCCAGGC TCCCAGGCTCCTCATCTTTGGTGCATCCACCAG GGCCACTGGTATCCCAGCCAGGTTCAGTGGCA GTGGGTCTGGGACAGAGTTCACTCTCACCATC AGCAGCCTGCAGTCTGAAGATTTTGCAGTTTA TTACTGTCAGCAGTTTATAAACTGGCTGTGCA GTTTTGGCCAGGGGACCAAGCTGGAGATCAAA |
| | | | CAGGTACAGCTGCAGCAGTCAGGTCCAGGACTG GTGAAGCCCTGCAGACCCTCTCACTCACCTGTG CCATCTCCGGGACAGTGTCTAGCAACAGTGC TGCTTGGAACTGGATCAGGCAGTCCCATCGAGA GGCCTTGAGTGGCTGGGAAGGACATACTACAGG TCCAAGTGGTATAATTATTATGAAGTATCTGTGA AAAGTCGAATAACCATCAACCCAGACACATCCA AGAACCAGTTCTCCCTGCAGTGAACTCTGTGAC TCCCGAGGACACGGCTGTATATTCTGTGCGAGA TCAACGGTACTACGGTATGGACGTCTGGGGCC AAGGGACCACGGTCACCGTCTCCTCA |
| | | | SEQ ID NO: 30973 |
| | | AA | EIVMTQSPATLSVSPGESATLSCRSSQNIKSNLA WYQQKPGQAPRLLIFGASTRATGIPARFSGSGSG TEFTLTISSLQSEDFAVYYCQQFYNWLCSFGQGT KLELK |
| | | | QVQLQQSGPGLVKPSQTLSLTCAISGDSVSSNSAA WNWIRQSPSRGLEWLGRTYYRSKWYNYEVSVKS RITINPDTSKNQFSLQLNSVTPEDTAVYFCARDQRY YGMDVWGQGTTVTVSS |
| | | | SEQ ID NO: 26968 | SEQ ID NO: 30974 |
| iPS:436252 | 21-225_202A8 | NA | GAAATAGTGATGACGCAGTCACCAGCCACCCT GTCTGTGTCTCCAGGGAAAGAGCCACCCTCT CCTGCAGGGCCAGTCAGTCAGAATTAACAACAA CTTAGCCTGTACCAGCAGCAGAAACCTGGCCAGG CTCCCAGGCTCCTCATTTATGGTGCATCCACCA GGGCCACTGGTGTCCCGGCCAGGTTCAGTGGC AGTGGGTCTGGGACAGAGTTCACTCTCACCAT CAGCAGCCTGCAGTCTGAAGACTTTACAGTTT ATTACTGTCAGCAGTAGTATTAATAACTGGCTGTGC AGTTTTGGCCAGGGGACCAAGCTGGAGATCAG A |
| | | | CAGGTACAGCTGCAGCAGTCAGGTCCAGGACTG GTGAAGCCCTGCAGACCCTCTCACTCACCTGTG CCATCTCCGGGACAGTGTCTAGCAACAGTGC TGCTTGGAACTGGATCAGGCAGTCCCATCGAGA GGCCTTGAGTGGCTGGGAAGGACATACTACAGG TCCAAGTGGTATAATGAGTATGCAGTATCTGTGA GAAGTCGAATAACCATCAACCCAGACACATCCA AGAACCAGTTCTCCCTGCAGTGAACTCTGTGAC TCCCGAGGACACGGCTCTGTATTACTGTACAAGA GATCAACGGTACTACGGTATGGACGTCTGGGGCC AAGGGACCCCGGTCACCGTCTCCTCA |
| | | | SEQ ID NO: 26969 | SEQ ID NO: 30975 |

FIGURE 50
(Continued)

| | | | |
|---|---|---|---|
| iPS:436254 | 21-225_202C12 | AA | EIVMTQSPATLSVSPGERATLSCRASQRINNNLA WYQQNPGQAPRLLIYGASTRATGVPARFSGSGS GTEFTLTISSLQSEDFTVYYCQQYYNWLCSFGQG TKLEIR<br>SEQ ID NO: 26970 | QVQLQQSGPGLVKPSQTLSLTCAISGDSVSSNSAA WNWIRQSPSRGLEWLGRTYYRSKWYNEYAVSVRS RITINPDTSKNQFSLQLNSVTPEDTALYYCTRDQRY YGMDVWGQGTPVTVSS<br>SEQ ID NO: 30976 |
| | | NA | GATATTGTGCTGACTCAGTCTCCACTCTCCCTG CCCGTCACCCCTGGAGAGCCGGCCTCCATCTC CTGCAGGTCTAGTCAGAGCCTCCTGCATAATA ATAAATACAACCATTTGGATTGGTACCTGCAG AAGCCAGGGCAGTCTCCACAGCTCCTGATCTA TTTGGGTTCTAATCGGCCTCCGGGGTCCCTG ACAGGTTCAGTGCAGTGGATCAGGCACAGAT TTTACACTGAAAATCAGCAGAGTGGAGGCTGA GGATGTTGGGGTTTATTACTGCATGCAAGCTC TACAAACTCCCACTTTCGGCGGAGGGACCAAG GTGGAGATCAAA<br>SEQ ID NO: 26971 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAACTATTAGTGGTAGTGGTGTT AGAACATACTACGCAGACTCCGTGAAGGGCCGG TCCACCATCTCCAGAGACAATTCCAAGAATACGC TGTTTCTGCAAATGAACAGCCTGAGAGCCGAGG ACACGGCCGTATATTACTGTGCGAAAGGGGAG CTAGGAGCAGTGGCTGGTTCCACTTTGACTACTG GGGCCAGGGAACCCTGGTCACCGTCTCCTCA<br>SEQ ID NO: 30977 |
| | | AA | DIVLTQSPLSLPVTPGEPASISCRSSQSLLHNNKY NHLDWYLQKPGQSPQLLIYLGSNRASGVPDRFS GSGSGTDFTLKISRVEAEDVGVYYCMQALQTPT FGGGTKVEIK<br>SEQ ID NO: 26972 | EVQLLESGGGLVQPGGSLRLSCAASGFTFSSYAMS WVRQAPGKGLEWVSTISGSGVRTYYADSVKGRSTI SRDNSKNTLFLQMNSLRAEDTAVYYCAKGGARSS GWFHFDYWGQGTLVTVSS<br>SEQ ID NO: 30978 |

FIGURE 50
(Continued)

| | | | | |
|---|---|---|---|---|
| iPS:436256 | 21-225_202D9 | NA | GAAATTGTGTTGACGCAGTCTCCAGACACCCT GTCTTTGTCTCCAGGGGAAAGAGCCACCCTCT CCTGCAGGGCCAGTCAGAGTGTTAACAGGGC TACTTAGCCTGGTACCAGCAGAAACCTGGCCA GTCTCCCAGGCTCCTCATCTATGGTGCATCCA GCAGGGCCACTGGCATCCAGACAGTTCAGT GGCAGTGGGTCTGGGACAGACTTCACTCTCAC CATCAGCAGACTGGAGCCTGAAGATTTTGCAG TGCATTACTGTCAACAATATGAGACCTCACCG TGGACGTTCGGCCAAGGGACCAAGGTGGAAA TCAAA<br><br>SEQ ID NO: 26973 | CAGGTGCAGCTACAGCAGTGGGGCGCAGGACTG TTGAAGCCTTCGGAGACCCTGTCCTCCACCTGCG CTGTCTATGATGGTCCCAGTCCTTACTACTGG AGCTGGATCGCCAGCCGCCAGGGAAGGGCTG GAGTGGATTGGGGAAATCAATCATAGTGGAAGC ACCAACTACAATCGTCCCTCAAGAGTCGAGTCA CCATATCAGTAGACACGTCCAAGAACCAGTTCTC CCTGAAGCTGAGCTCTGTGACCGCCGCGGACACG GCTGTATATTACTGTGCGAGAGATACGGGGTT TAGACTACTGGGGCCAGGGAACCCTGGTCACCGT CTCCTCA<br><br>SEQ ID NO: 30979 |
| | | AA | EIVLTQSPDTLSLSPGERATLSCRASQSVNSGYLA WYQQKPGQSPRLLIYGASSRATGIPDRFSGSGSG TDFTLTISRLEPEDFAVHYCQQYETSPWTFGQGT KVEIK<br><br>SEQ ID NO: 26974 | QVQLQQWGAGLLKPSETLSLTCAVYDGSFSPYYW SWIRQPPGKGLEWIGEINHSGSTNYNPSLKSRVTISV DTSKNQFSLKLSSVTAADTAVYYCARDYGGLDYW GQGTLVTVSS<br><br>SEQ ID NO: 30980 |
| iPS:436258 | 21-225_202F12 | NA | GAAATAGTGATGACGCAGTCTCCAGCCACCCT GTCTGTGTCTCCAGGGGAAAGAGCCACCCTCT CCTGCAGGGCCAGTCAGAGTGTTCTGAACAAC TTAGCCTGGTACCAGCAGAGACCTGGCCAGGC TCCCAGGCTCCTCATCTATGGTGCATCCACTA GGGCCACTGGTATCCCAGCCAGGTTCAGTGGC AGTGGGTCTGGGACAGGCTGAAGATTTGCAGTT ATTACTGTCAGCAGTATGATAACTGGCCTCCG TGCAGTTTTGGCCAGGGACCAAGCTGGAGAT CAAA<br><br>SEQ ID NO: 26975 | CAGGTGCAGCTGGTGGAGTCTGGGGGAGGCGTG GTCCAGCCTGGAGGTCCCTGAGACTCTCCTGTG AGCCGTCTGGATTCACCTTCAGTTACTATGGCAT GCACTGGGTCCGCCAGGCTCCAGGCAAGGGACT GGAGTGGGTGGCAATTATATGTGTGATGGAAGT AATAAATTCTATGCAGACTCCGTGAAGGGCCGAT TCACCATCTCCAGAGACAGTTCCAAGAACACGCT GTATCTGCAAATGAACAGCCTGAGAGCCGAGGA CACGGCTGTGTATTACTGTGCGAGTAATATAGCA GCAGCTGCCCTTACTTTGACTACTGGGGCCAGG GAACCCTGGTCACCGTCTCCTCA<br><br>SEQ ID NO: 30981 |

FIGURE 50
(Continued)

| | | | | |
|---|---|---|---|---|
| iPS:436260 | 21-225_203H1 | AA | EIVMTQSPATLSVSPGERATLSCRASQSVLNNLA WYQQRPGQAPRLLIYGASTRATGIPARFSGSGSG TEFTLTISSLQSEDFAVYYCQQYDNWPPCSFGQG TKLEIK<br><br>SEQ ID NO: 26976 | QVQLVESGGGVVQPGRSLRLSCEASGFTFSYYGMH WVRQAPGKGLEWVAIIWYDGSNKFYADSVKGRFT ISRDSSKNTLYLQMNSLRAEDTAVYYCASNIAAAA PYFDYWGQGTLVTVSS<br><br>SEQ ID NO: 30982 |
| | | NA | GACATCCAGATGACCCAGTCTCCATCCTCACT GTCTGCATCTGTCGGAGACAGAGTCACCATCA CTTGTCGGGCGAGTCAGGGCATTGGCAATTAT TTAGCCTGGTTTCAGCAGAAACCAGGGAAAGC CCCTAAGTCCCTGATCTATGTTGCATCCAGTT GCAAAGTGGGGTCCCATCAAAGTTCAGCGGCA CTGGATCTGGGTCAGCCTGACAGATTTCACTCTCACCATC AGCAGCCTGCAGCCTGACGATTTTGCGACTTA TTACTGCCAACGGTATCATACTTACCCGCTCA CTTTCGGCGGAGGGACCAAGGTGGAGATCAA A<br><br>SEQ ID NO: 26977 | CAGGTGCAGCTGGTGGAGTCTGGGGGAGGCGTG GTCCAGCCTGGGAGGTCCCTGAGACTCTCCTGTG CAGCGTCTGATTCACCTTCAGTAGCTATGGCAT GCACTGGGTCCGCCAGGCTCCAGGCAAGGGCT GGAGTGGGTGGCAGTTATATGGTATGATGGAAGT AATAAAAACTATGCAGACTCCGTGAAGGGCCGA TTCACCATCTCCAGAGACAATTCCAAGAACACGC TGTATCTGCAAATGAACAGCCTGAGAGAGAAC ACACGGCTGTGTATTACTGTGCGAGAGATAGAAC AGTTGGCTACAACGGTATGGACGTCTGGGGCCA AGGGACCACGGTCACCGTCTCCTCA<br><br>SEQ ID NO: 30983 |
| | | AA | DIQMTQSPSSLSASVGDRVTITCRASQGIGNYLA WFQQKPGKAPKSLIYVASRLQSGVPSKFSGTGS GSDFTLTISSLQPDDFATYYCQRYHTYPLTFGGG TKVEIK<br><br>SEQ ID NO: 26978 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDRTVG YNGMDVWGQGTTVTVSS<br><br>SEQ ID NO: 30984 |

FIGURE 50
(Continued)

| | | | | |
|---|---|---|---|---|
| iPS:436262 | 21-225_203E3 | NA | GACATCCAGATGACCCAGTCTCCATCTCCCC GTCTGCATCTGTGGAGACAGAGTCACCATCA CTCGCCGGGCAAGTCACAACATTAACAGCTAT TTAAATTGGTATCAGCAGAAATCAGGGAAAGC CCCTAAACTCCTTATCTATGCTGCATCCAGTTT GCAAAGTGGGGTCCCGTCAAGGTTCAGTGGCA GTGGATCTGGGACAGATTTCACTCTCACTTTC AGTAGTCTACAACCTGAAGATTTTGCAACTTA CTACTGTCAACAGAGTTACAGTTTCCCGCTCA CTTTCGGCGGAGGGACCAAGGTGGAGATGAG G<br><br>SEQ ID NO: 26979 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TCCACTGGGTGCGACAGGCCCCTGGACAAGGGC TTGAGTGGATGGCATGGATCAACCCTAATAGTGG TGGCACAAACTATGCACAGAAGTTTCAGGGCAG GGTCACCATGACCAGGGACACGTCCATCACCAC AGCCTACATGGAGCTGAGCAGGCTGAGATCTGA CGACACGGCCGTGTACAACTGTGCGAGAGATAC AGCTATGGTTACAACTGGTTCGACCCCTGGGGCC AGGGAACCCTGGTCACCGTCTCCTCA<br><br>SEQ ID NO: 30985 |
| | | AA | DIQMTQSPSSPSASVGDRVTITRASHNINSYLN WYQQKSGKAPKLLIYAASSLQSGVPSRFSGSGS GTDFTLTFSSLQPEDFATYYCQQSYSFPLTFGGG TKVEMR<br><br>SEQ ID NO: 26980 | QVQLVQSGAEVKKPGASVKVSCKASGYTFTGYYIH WVRQAPGQGLEWMAWINPNSGGTNYAQKFQGRV TMTRDTSITTAYMELSRLRSDDTAVYYCARGYSYG YNWFDPWGQGTLVTVSS<br><br>SEQ ID NO: 30986 |
| iPS:436264 | 21-225_203F7 | NA | GACATCCAGATGACCCAGTCTCCATCTCCCG TTTTGCATCTGTAGGAGACAGAGTCACCATCA CTTGCCGGGCAAGTCAGGGCATTAGACATGAT TTAGGCTGGTATCAGCAGAAACCAGGGAAAG CCCTTAAGCGCTTGATATATGCTGCATCCAGTT TGCAAAGTGGGGTCCCATCAAGGTTCAGCGGC AGTGGATGTGGGACAGAATTCACTCTCACAAT CAGCAGCGTGCAGCCTGAAGATTTTGCAAATT ATTACTGTCTACAGCATTATAGTTTCCCTCGGA CGTTCGGCCAAGGGACCAAGGTGGAAATCAA A<br><br>SEQ ID NO: 26981 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGGCAGTTATATAGACTCCGTGAAGT AATAAATACTATGTAGAGACAATTCCAGGAACACGCT TCACCATCTCCAGAGACAATGAACAGCCTGAGAG GTATCTGCAAATGAACAGCCTGAGAGCCGAGGA CACGGCTGTGTATTACTGTGCGAGAGAACGGTAT AGCAGTGGCTTGTACGACTACGGTATGGACGTCT GGGGCCAAGGGACCACGGTCACCGTCTCCTCA<br><br>SEQ ID NO: 30987 |

FIGURE 50
(Continued)

| | | | |
|---|---|---|---|
| | | AA | DIQMTQSPSSRFASVGDRVTITCRASQGIRHDLG WYQQKPGKALKRLIYAASSLQSGVPSRFSGSGC GTEFTLTISSVQPEDFANYYCLQHYSFPRTFGQG TKVEIK<br>SEQ ID NO: 26982 | QVQLVESGGGVVQPGRSLRLSCAASGFTFSDYVM HWVRQAPCKGLEWVAVIWYDGSNKYYVDSVKGR FTISRDNSRNTLYLQMNSLRAEDTAVYYCARERYS SGLYDYGMDVWGQGTTVTVSS<br>SEQ ID NO: 30988 |
| iPS:436268 | 21-225_203B9 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATCACTGTCTACAGCATAATAGTTACCCATTC ACTTTCGGCCCTGGGACCAAAGTGGATATCAA A<br>SEQ ID NO: 26983 | CAGGTGCAGCTGGTGGAGTCTGGGGGAGGCGTG GTCCAGCCTGGGAGGTCCCTGAGACTCTCCTGT CAGGCGTCAGGATTCACCTTCAGTAGTTTTGGCAT GCACTGGGTCCGCCAGGCTCCAGGCAAGGGCT GGAGTGGGTGGCAGTTATATGGTATGATGGTAAAT AATAAATACTATGCAGACTCCGTGAAGGGCCGA TTCACAATCTCCAGAGACAATTCCAAGAACACGC TGTATCTCCAAATGAACAGCTGAGACCCGAGG ACACGGCTGTGTATTACTGTGCCAGAGAACTGGG GTTCCTCTCTGACTACTGGGGCCAGGGAATCCTG GTCACCGTCTCCTCA<br>SEQ ID NO: 30989 |
| | | AA | DIQMTQSPSSLSASVGDRVTITCRASQGIRNDLG WYQQKPGKAPKRLIYRASSVQNGVPSRFSGSGS GTEFTLTISSLQPEDFATYHCLQHNSYPFTFGPGT KVDIK<br>SEQ ID NO: 26984 | QVQLVESGGGVVQPGRSLRLSCAASGFTLSSFGMH WVRQAPGKGLEWVAVIWYDVNNKYADSVKGRF TISRDNSKNTLYLQMNSLRPEDTAVYYCARELGFL SDYWGQGILVTVSS<br>SEQ ID NO: 30990 |

FIGURE 50
(Continued)

| | | | |
|---|---|---|---|
| iPS:436270 | 21-225_203F10 | NA | GACATCGTGATGACCCAGTCTCCAGACTCCCT GGCTGTGTCTCTGGGCGAGAGGGCCACCATCA ACTGCAAGTCCAGCCAGAGTGTTTTTCCACT CGAACAATAAGAACTACTTAGCTTGGTACCAG CAGAAACCAGGACAGCCTCCTAAGTTGCTCAT TTACTGGGCATCTACCCGGAATCCGGGGTCC CTGACCGATTCAGTGGCAGCGGGTCTGGGACA GATTTCACTCTCACCATCAGCAGCCTGCAGGC TGAAGATGTGACAGTTTATTACTGTCAACAAT ATTTAGTCTTCCATTCACTTTCGGCCCTGGGA CCAAAGTGGATATCACA<br><br>SEQ ID NO: 26985 | CAGGTGCAACTGGTGGAGTCTGGGGGAGGCTTG GTCAAGCCTGGAGGGTCCCTGAGACTCTCCTGTG CAGCCTCTGGATTCACCTTCAGTGACTACTACAT GAGCTGGATCCGCCAGGCTCCAGGGAAGGGGCT GGAGTGGGTTTATACATTAGTGGTAGTGGTACT ACCACATACTACGCAGACTCTGTGAAGGGCCGAT TCACCATCTCCAGGGACAACGCCAAGAACTCACT GTATCTGCAAATGAACAGCCTGAGAGCCGAGGA CACGGCCGTGTATTACTGTGCGAGAGATAGGGG GGGTTGGACGTCTGGGGCCAAGGGACCACGGT CACCGTCTCCTCA<br><br>SEQ ID NO: 30991 |
| | | AA | DIVMTQSPDSLAVSLGERATINCKSSQSVFFHSN NKNYLAWYQQKPGQPPKLLIYWASTRESGVPD RFSGSGSGTDFTLTISSLQAEDVTVYYCQQYFSL PFTFGPGTKVDIT<br><br>SEQ ID NO: 26986 | QVQLVESGGGLVKPGGSLRLSCAASGFTFSDYYMS WIRQAPGKGLEWVLYISGSGTTYYADSVKGRFTIS RDNAKNSLYLQMNSLRAEDTAVYYCARDRGGLD VWGQGTTVTVSS<br><br>SEQ ID NO: 30992 |
| iPS:436272 | 21-225_201F5 | NA | CAGGTGCAGCTGGTGCAGTCTGGGGCTGCGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCAGAAGTTCCAGTGG TAACACAGGTATGCACCAGGAACACCTCCATAAGCAC AGTCACCATGACCAGGAGCTGAGCAGCTGAGATCTGA AGCCACATGAGGCCGTGTATTACTGTGCTATAGCAGT GGCTGGTACTACTTTGACTACTGGGGCCAGGGAA CCCTGGTCACCGTCTCCTCA<br><br>SEQ ID NO: 30993 |
| | | NA | GACATCGTGATGACCCAGTCTCCAGAGTCCCT GGCTGTGTCTCTGGGCGAGAGGGCCACCATCA ACTGCAAGTCCAGCCAGAGTGTTTTATACAGT TCCAACAATAAGAACTACTTAGTTTGGTACCA GCAGAAACCAGGACAGCCTCCTAAACTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAAA<br><br>SEQ ID NO: 26987 | |

FIGURE 50
(Continued)

| | | | | |
|---|---|---|---|---|
| | | | AA | DIVMTQSPESLAVSLGERATINCKSSQSVLYSSN NKNYLVWYQQKPGQPPKLLIYWASTRESGVPD RFSGSGSGTDFTLTISSLQAEDVAVYYCQQYST PPTFGQGTKVEIK<br>SEQ ID NO: 26988 | QVQLVQSGAAVKKPGASVKVSCKASGYTFTNYDI NWVRQATGQGLEWMGWMHPNSGNTGYAQKFQG RVTMTRNTSISTAYMELSSLRSEDTAVYYCAYSSG WYYFDYWGQGTLVTVSS<br>SEQ ID NO: 30994 |
| iPS:436274 | 21-225_204H3 | | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTGAACTCCTGATCTATGCTGCAGCAGT TTGCAAGGTGGGGTCCCATCAGAATTCACTCTCACAA CAGTGGATCTGGGACAGATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAACTCC AA<br>SEQ ID NO: 26989 | CAGGTGCAGCTGGTGCAGTCTGGGGGAGGCGTG GGCCAGCCTGGGAGGTCCCTGAGACTCTCCTGTA CAGCGTCTGATTCACCTTCAGTAGCTATGTCAT GCACTGGGTCCGCCAGGCTCCAGGCAAGGGGCT GGAGTGGGTGGCAGTTATATGCAGACTCGTGAAGGGCCGA AATAAATATAATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACCGTA TAGCAGCAGCTGGTACGACTACGGTATGGACGTC TCGGGGCCAAGGGACCACGGTCACCGTCTCCTCA<br>SEQ ID NO: 30995 |
| | | | AA | DIQMTQSPSSLSASVGDRVTITCRASQGIRNDLG WYQQKPGKAPELLIYAAASLQGGVPSRFSGSGS GTEFTLTISSLQPEDFATYYCLQHYSYPRTFGQG TKVELQ<br>SEQ ID NO: 26990 | QVQLVESGGGVGQPGRSLRLSCTASGFTFSSYVMH WVRQAPGKGLEWVAVIWYDGSNKYNADSVKGRF TISRDNSKNTLYLQMNSLRAEDTAVYYCAREPYSS SWYDYGMDVSGQGTTVTVSS<br>SEQ ID NO: 30996 |

FIGURE 50
(Continued)

| | | | | |
|---|---|---|---|---|
| iPS:436276 | 21-225_204H4 | NA | GACATCCAGATGACCCTGTCTCCATCTCCCC GTCTGCATTTGTTGGAGACAGAGTCACCATCA CTCGCCGGGCAAGTCACACAGAGTCAACATTAACAGCTAT TAAATTGGTATCAGCAGAAATCAGGAAAGC CCCTAAACTCCTTATCTATGCTGCATCCAGTT GCAAAGTGGGGTCCCGTCAAGGTTCAGTGGCA GTGGATCTGGGACAGATTTCACTCTCACTTA CTACTGTCAACAGAGTTACAGTTTCCCGCTCA CTTTCGGCGGAGGGACCAAGGTGGAGATGAG G<br><br>SEQ ID NO: 26991 | CAGGTGCAGCTGGTGCAGTCTGGGGCTGAGGTG AAGAAGCCTGGGGCCTCAGTGAAGGTCTCTGC AAGGCTTCTGGATACACCTTCACCGGCTACTATA TCCACTGGGTGCGACAGGCCCTGACAAGGGC TTGAGTGGATGGCATGGATCAACCTAATAGTGG TGGCACAAACTATGCACAGAAGTTCAGGGCAG GGTCACCATGACCAGGGACACGTCCATCACCAC AGCCTACATGGAGCTGAGCAGGCTGAGATCTGA CGACACGGCCGTGTATTACTGTGCGAGAGGATAC AGCTATGGTTACAACTGGTTCGACCCTGGGGCC AGGGAACCCTGGTCACCGTCCTCA<br><br>SEQ ID NO: 30997 |
| | | AA | DIQMTLSPSSPSAFVGDRVTITRRASHNINSYLN WYQQKSGKAPKLLIYAASSLQSGVPSRFSGSGS GTDFTLTFSSLQPEDFATYYCQQSYSFPLTFGGG TKVEMR<br><br>SEQ ID NO: 26992 | QVQLVQSGAEVKKPGASVKVSCKASGYTFTGYYIH WVRQAPGQGLEWMAWINPNSGGTNYAQKFQGRV TMTRDTSITTAYMELSRLRSDDTAVYYCARGYSYG YNWFDPWGQGTLVTVSS<br><br>SEQ ID NO: 30998 |
| iPS:436278 | 21-225_201F2 | NA | GAGATAGTGATGACGCAGTCTCCAGCCACCCT GTCTGTGTCTCCAGGGGAAAGAGCCACCCTCT CCTGCAGGGCCAGTCAGAGAATATTAAAAGCAAC TTAGCCTGGTACCAGCAGAAACCTGGCCAGGC TCCCAGGCTCCTCATCTTTGGTGCATCCAGCAG GGCCACTGGTATCCCAGCCAGGTTCAGTGGCA GTGGGTCTGGTACAGAGTTTCACTCTCACCATC AGCAGCCTGCAGTCTGAAGATTTTGCAGTGTA TTACTGTCAGCAGTTTTATAACTGGCTGTGCA GTTTTGGCCAGGGGACCAAGCTGGAGCTCAAG<br><br>SEQ ID NO: 26993 | CAGGTACAGCTGCAGCAGTCAGGTCCAGGACTG GTGAAGCCCTCGCAGACCCTCTCACTCACCTGTG CCATCTCCGGGACAGTGTCTCTAGCAACAGTGC TGCTTGGAACTGGATCAGGCAGTCCCCATCGAGA GGCCTTGAGTGGCTGGGAAGGACATACTACAGG TCCAAGTGGTATAATTATTATGAAGTATCTGTGA GAAGTCGAGTAACCATCAACCCAGACACATCCA AGAACCAGTTCTCCCTGCAACTGAACTCTGTGAC TCCCGAGGACACGGCTGTGTATTCTGTGCGAGA GATCAACGGTACTACGGTATGGACGTCTGGGGCC AAGGGACCACGGTCACCGTCTCCTCA<br><br>SEQ ID NO: 30999 |

FIGURE 50
(Continued)

| | | | | |
|---|---|---|---|---|
| iPS-436280 | 21-225_204D6 | AA | EIVMTQSPATLSVSPGERATLSCRASQNIKSNLA WYQQKPGQAPRLLIFGASTRATGIPARFSGSGSG TEFTLTISSLQSEDFAVYYCQQFYNWLCSFGQGT KLELK SEQ ID NO: 26994 | QVQLQQSGPGLVKPSQTLSLTCAISGDSVSSNSAA WNWIRQSPSRGLEWLGRTYYRSKWYNYEVSVRS RVTINPDTSKNQFSLQLNSVTPEDTAVYFCARDQR YYGMDVWGQGTTVTVSS SEQ ID NO: 31000 |
| | | NA | GACAGCCAGATGACCCAGTCTCCATCCTCCCT GTCTGCATCTGTAGGAGACAGAGTCACCATCA CTTGCCGGGCAAGTCGGAGCGTTCACACCTAT TTAAATTGGTATCAACAGAAGCCAGGAAAG CCCCTAAGGTCCTGATCTATGGTGCATCCAGT TTGCAACGTGGGGTCCCATCAAGGTTCAGTGG CAGTGGATCTGGGACAGATTTCACTCTCACCA TCAGCAGTCTGCAACCTGAAGATGTTGCAACT TACTACTGTCAACAGAGTTACAGTTCCCCGCT CACTTTCGGCGGGGGACCAAGGTGGAGATCC AA SEQ ID NO: 26995 | GAGGTGCAGGTGTTGGAGTCTGGGGGAGGCTTG GTGCAGCCTGGGGGGTCCCTGCGACTCTCCTGTG CAGCCTCTGGATTCACCTTTAGCACCTATGCCAT GAGCCTGGGTCCGCCAGGCTCCAGGGAAGGGGCT GGAGTGGGTCTCAGCTATTAGTGGTAGTGGTGGT AGCACATATTACGCAGACTCCGTGAAGGGCCGG TTCACCATCTCCAGAGACAATTCCAAGAACACGC TGTATCTGCAAATGGACAGCCTGAGAGCCGAGG ACACGGCCGTATATTACTGTGCGAAAGGGATAA GTGGAACCGGCTCCTACTACTACTACGGTGTGGA CGTCTGGGGCCAAGGGACCACGGTCACCGTCTCC TCA SEQ ID NO: 31001 |
| | | AA | DSQMTQSPSSLSASVGDRVTITCRASRSVHTYLN WYQQKPGKAPKVLIYGASSLQRGVPSRFSGSGS GTDFTLTISSLQPEDVATYYCQQSYSSPLTFGGG TKVEIQ SEQ ID NO: 26996 | EVQVLESGGGLVQPGGSLRLSCAASGFTFSTYAMS WVRQAPGKGLEWVSAISGSGSTYYADSVKGRFTI SRDNSKNTLYLQMDSLRAEDTAVYYCAKGISGTGS YYYYGVDVWGQGTTVTVSS SEQ ID NO: 31002 |

FIGURE 50
(Continued)

| | | | |
|---|---|---|---|
| iPS:436282 | 21-225_204G6 | NA | GACATCCGGATGACCCAGTCTCCATCTCTCACT GTCTGCATCTGTAGGAGACAGAGTCACCATCA CTTGTCGGACGAGTCAGGGCATTGGCAATTAT TTAGCCTGGTTTCAGCAGAAACCAGGGAAAGC CCCTAAGTCCCTGATCTATGCTGCATCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACACTATCTTAGTTACCCTCTCAC TTTCGGCGGAGGGACCAAGGTGGAGATCAAA | CAGGTGCAGCTGGTGGAGTCTGGGGGAGGCGTG GTCCAGCCTGGGAGGTCCCTGAGACTCTCCTGTA CAGGCGTCTGGATTCACCTTCAGTAGCTATGGCAT GCACTGGGTCCGCCAGGCTCCAGGCAAGGGGCT GGAGTGGGTGGCAGTTATATGGTATGGAAGT AATAAAAACTATGCAGACTCCGTGAAGGGCCGA TTCACCATCTCCAGAGACAATTCCAAGAACACGC TGTATCTGCAAATGAACAGCTGAGAGCCGAGG ACACGGCTGTGTATTACTGTGCGAGAGATCGAGG TGTGGGCTACGACGGTATGGACGTCTGGGGCCAA GGGACCACGGTCACCGTCTCCTCA |
| | | | SEQ ID NO: 31003 |
| | | AA | DIRMTQSPSSLSASVGDRITITCRTSQGIGNYLAW FQQKPGKAPKSLIYAASSLQSGVPSRFSGSGSGT DFTLTISSLQPEDFATYYCQHYLSYPLTPGGGTK VEIK | QVQLVESGGGVVQPGRSLRLSCTASGFTFSSYGMH WVRQAPGKGLEWVAVIWYDGSNKNY ADSVKGRF TISRDNSKNTLYLQMNSLRAEDTAVYYCARDRGV GYDGMDVWGQGTTVTVSS |
| | | | SEQ ID NO: 26997 | SEQ ID NO: 31004 |
| iPS:436284 | 21-225_204G8 | NA | GACATCCAGATGACCCAGTCTCCATCCTCACT GTCTGCATCTGTAGGAGACAGAGTCACCATCA CTTGTCGGGCGAGTCAGGGCATAAGTAATCAT TTAGCCTGGTTTCAGCAGAAACCAGGGAAAGC CCCTAAGTCCCTGATCTTTGCTGCATCCAGTTT GCAAAGTGGGGTCCCATCACAGTTCAGCGGCA GTGGATCTGGGACCGAATTCACTCTCACCATC AGCAGCCTGCAGCCTGAAGATTTTGCAACTTA TTACTGCCAACACTATAGTAATTACCCGTCA CTTTCGGGCGGAGGGACCAAGGTGGAGATCAA A | CAGGTGCAGCTGGTGGAGTCTGGGGGAGACGTG GTCCAGCCTGGGAGGTCCCTGAGACTCTCATGTG CAGGCGTCTGATTCACCTTCAGTAGCTATGGCAT GCACTGGGTCCGCCAGGCTCCAGGCAAGGGCT GGAGTGGGTGGCAGTTATATGGTATGGTAGC AATGAAAATTATGTAGCCTCCGTGAAGGGCCGAT TCACCATCTTCAGAGACAATTCCAAGAACACGCT GTATCTGCAAATGAACAGCTGAGAGCCGAGGA CACGGCTGTGTATTACGGTATGGACGTCTGGG ATAGGGTATTACGGTATGGACGTCTGGGGCCAAG GGACCACGGTCACCGTCCTCA |
| | | | SEQ ID NO: 26999 | SEQ ID NO: 31005 |

FIGURE 50
(Continued)

| | | | | |
|---|---|---|---|---|
| iPS:436286 | 21-225_204H8 | AA | DIQMTQSPSSLSASVGDRVTITCRASQGISNHLA WFQQKPGKAPKSLIFAASSLQSGVPSQFSGSGSG TEFTLTISSLQPEDFATYYCQQYSNYPVTFGGGT KVEIK<br>SEQ ID NO: 27000 | QVQLVESGGDVVQPGRSLRLSCAASGFTFSSYGMH WGRQAPGKGLEWVAVIWYDGSNENYVASVKGRF TIFRDNSKNTLYLQMNSLRAEDTAVYYCARDLGIG YYGMDVWGQGTTVTVSS<br>SEQ ID NO: 31006 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCTAAGCGCCTGATCTATTCTGCATCCAGTT TGCAAAGTGGGGTCCCATCAAGGTTCAGCGGC AGTGGATCTGGGACAGAATTCACTCTCACAGT CAGCAGCCTGCAGCCTGAAGATTTTGCAACTT ATTACTGTCTACAACATAATAGTTACCCTCTCA CTTTCGGCGGAGGGACCAAGGTGGAGATCAA A<br>SEQ ID NO: 27001 | CAGGTGCAGCTACACAGCAGTGGGGCGCAGGACTG TTGAAGCCTTCGGAGACCTGTTCCTCACCTGCG CTGTCTATGGTGGTCCTTCAGTGGTTACTTCTGG ACCTGGGTCCGCCAGCCCCAGGGAAGGACTG GAGTGGATTGGGAAATCAGTCATAGTGAAGC ACCAGTTACAACCGTCCCTCAAGAGTCGAGTCA CCATATCAGTAGACAAGTCCAAGAACCAGTCTC CCTGAAGCTGAGCTCTGTGACCGCCGCGACACG GCTGTGTATTACTGTGCGAGGGACTACGGGGCG ACTACTGGGGCCAGGGAACCCTGGTCACCGTCTC CTCA<br>SEQ ID NO: 31007 |
| | | AA | DIQMTQSPSSLSASVGDRVTITCRASQGIRNDLG WYQQKPGKAPKRLIYSASSLQSGVPSRFSGRGS GTEFTLTVSSLQPEDFATYYCLQHNSYPLTFGGG TKVEIK<br>SEQ ID NO: 27002 | QVQLQQWGAGLLKPSETLFLTCAVYGGSFSGYFW TWVRQPPGKGLEWIGEISHSGSTSYNPSLKSRVTIS VDKSKNQFSLKLSSVTAADTAVYYCARDYGADY WGQGTLVTVSS<br>SEQ ID NO: 31008 |

FIGURE 50
(Continued)

| | | | |
|---|---|---|---|
| iPS:436290 | 21-225_205G3 | NA | GAAATCGTGTTGACGCAGTCTCCAGGCACCCT GTCTTTGTCTCCAGGGGAAAGAGCCACCCTCT CCTGCAGGGCCAGTCAGAATGTTAGTTACAGC TACTTAGCCTGGTACCAGCAGAAACCTGGCCA GGCTCCCAGGCTCCTCATCTATGGTGCATCCA GGAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAGCTCACCG TGCAGTTTTGGCCAGGGGACCAAGCTGGAGAT CAAA SEQ ID NO: 27003 | CAGGTGCAGCTACAGCAGTGGGGCGCAGGACTG TTGAAGCCTTCGGAGACCCTGTCCCTCACCTGCG CTGTCTTTGGTGGGTCCTTCAGTGGTCACTACTGG AGCTGGATCCGCCAGCCCCCAGGGAAGGGGCTG GAGTGGATTGGGGAAATGTATCATTTTGGAAACA CCAACTACAACCCGTCCCTCAAGAGTCGAGTCAC CATGTCAGTAGACACGTCCAAGAAACAGTTCTCC CTGAAGCTGAGCTCTGTGACCGCCGCGGACACG GCTGTGTATTACTGTGCGAGAGTGGGGCAGTGGC TGGCTTTTGATATCTGGGGCCAAGGGACAATGGT CACCGTCTCTTCA SEQ ID NO: 31009 |
| | | AA | EIVLTQSPGTLSLSPGERATLSCRASQNVSYSYLA WYQQKPGQAPRLLIYGASRRATGIPDRFSGSGSG TDFTLTISRLEPEDFAVYYCQQYGSSPCSFGQGT KLEIK SEQ ID NO: 27004 | QVQLQQWGAGLLKPSETLSLTCAVFGGSFSGHYW SWIRQPPGKGLEWIGEMYHFGNTNYNPSLKSRVTM SVDTSKKQFSLKLSSVTAADTAVYYCARVGQWLA FDIWGQGTMVTVSS SEQ ID NO: 31010 |
| iPS:436292 | 21-225_205H3 | NA | GACATCCCGATGACCCAGTCTCCATCCTCACT GTCTGCATCTGTAGGAGACAGAGTCACCATCA CTTGTCGGGCGAGTCAGGCCATTAGTAATCAT TTAGCCTGGTTTCAGCTGAAACCAGGGAAAGC CCCTAAGTCCCTGATCTATGCTGCATCCAGTT TGCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAATATAGTAATTACCCACTCA CTTTCGGCGGAGGGACCAAGGTGGAGATCAA A SEQ ID NO: 27005 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATATTACTGTGCGAGAGATAGATC AGTTGGCTACGACGGTACGGACGTCTGGGGCCA AGGGACCACGGTCACCGTCTCCTCA SEQ ID NO: 31011 |

FIGURE 50
(Continued)

| | | | | |
|---|---|---|---|---|
| iPS:436294 | 21-225_205G4 | AA | DIPMTQSPSSLSASVGDRVTITCRASQAISNHLA WFQLKPGKAPKSLIY AASSLQSGVPSKFSGSGSG SDFTLTISSLQPEDFATYYCQQYSNYPLTFGGGT KVEIK<br><br>SEQ ID NO: 27006 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDRSVG YDGTDVWGQGTTVTVSS<br><br>SEQ ID NO: 31012 |
| | | NA | GAAATAGTGATGACGCAGTCTCCAGCCACCCT GTCTGTGTCTCCAGGGGAAAGAGCCACCCTCT CCTGCAGGGCCAGTCAGTCAGAATATTAAAGCAAC TTAGCCTGGTACCAGCAGAAACCTGGCCAGGC TCCCAGGCTCCTCATCTTTGGTGCATCCACCAG GGCCACTGGTATCCCAGCCAGGTTCAGTGCA GTGGGTCTGGGACAGAGTTCACTCTCACCATC AGCAGCCTGCAGTCTGAAGATTTTGCAGTTTA TTACTGTCAGCAGTTTTATAACTGGCTGTGCA GTTTTGGCCAGGGGACCAAGCTGGAGCTCAAA<br><br>SEQ ID NO: 27007 | CAGGTACAGCTGCAGCAGTCAGGTCAGGACTG GTGAAGCCCTGCAGACCCTCACTCACCTGTG CCATCTCCGGGACAGTGTCTCTAGCAACAGTGC TGCTTGGAACTGGATCAGGCAGTCCCATCGAGA GGCCTTGAGTGGCTGGAAGGACATATTACAGGT CCAAGTGGTATAATTATTATGAAGTATCTGTGAG AAGTCGAATAACCATCAACCAGACACATCCAA GAACCAGTTCTCCCTGCAGTGTGAATTCTGTGACT CCCGAGGACACGGCTGTGTATTCTGTGCGAGAG ATCAACGGTACTACGGTATGGACGTCTGGGGCCA AGGGACCACGGTCACCGTCTCCTCA<br><br>SEQ ID NO: 31013 |
| | | AA | EIVMTQSPATLSVSPGERATLSCRASQNIKSNLA WYQQKPGQAPRLLIFGASTRATGIPARFSGSGSG TEFTLTISSLQSEDFAVYYCQQFYNWLCSFGQGT KLELK<br><br>SEQ ID NO: 27008 | QVQLQQSGPGLVKPSQTLSLTCAISGDSVSSNSAA WNWIRQSPSRGLEWLGRTYYRSKWYNYYEVSVRS RITINPDTSKNQFSLQLNSVTPEDTAVYFCARDQRY YGMDVWGQGTTVTVSS<br><br>SEQ ID NO: 31014 |

FIGURE 50
(Continued)

| | | | |
|---|---|---|---|
| iPS:436296 | 21-225_205F5 | NA | GACATCCAGATGACCCAGTCTCCATCCTCACTGTCTGCATCTGTAGGAGACAGAGTCACCATCACTTGTCGGGCGAGTCAGGGCATTGGCAATTATTTAGCCTGGTTTCAGCAGAAACCAGGGAAAGCCCCTAAGTCCCTGATCTATGGTGTCTCCAGTTTGCAAAGTGGGGTCCCATCAAAGTTCAGCGGCAGTGGATCTGGGACAGATTTCACTCTCACCATCAGCAGCCTGCAGCCTGAAGATTTTGCAACTTATACTTGCCAACAATATAGTAATTACCCTCTCACTTTCGGCGGAGGGACCAAGGTGGACATCAGA |
| | | | SEQ ID NO: 27009 |
| | | AA | DIQMTQSPSSLSASVGDRVTITCRASQGIGNYLAWFQQKPGKAPKSLIYGVSSLQSGVPSKFSGSGSGTDFTLTISSLQPEDFATYTCQQYSNYPLTFGGGTKVDIR |
| | | | SEQ ID NO: 27010 |
| iPS:436302 | 21-225_205G7 | NA | GAAATTGTGTTGACGCAGTCTCCAGGCACCCTGTCTTTGTCTCCAGGGGAAAGAGCCACCCTCTCCTGCAGGGCCAGTCAGAGTGTTTTCAGCAACTACTTAGCCTGGTACCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATTACTGTCAGCAGTATGAAAGTTCACCGTGGACGTTCGGCCAAGGGACCAAGGTGGAAATCAAA |
| | | | SEQ ID NO: 27011 |
| | | | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGATATGGCATGCACTGGGTCCGCCAGGCTCCAGGCAAGGGACTGGAGTGGGTGGCAGTTATATGGTATGATGGAAGTAATGAGAATTATGTAGACTCCGTGAAGGGCCGATTCACCATCTCCAGAGACAATTCCAAGAACACGCTGTATCTGCAAATGAACAGCCTGAGAGAAACCGATGACACGGCTGTGTATTACTGTGCGAGAGATATGGGGATAGGGTATTATGGTATGGACGTCTGGGGCCAAGGGACCACGGTCACCGTCTCCTCA |
| | | | SEQ ID NO: 31015 |
| | | | QVQLVESGGGVVQPGRSLRLSCAASGFTFSRYGMHWVRQAPGKGLEWVAVIWYDGSNENYVDSVKGRFTISRDNSKNTLYLQMNSLRAEDTAVYYCARDMGIGYYGMDVWGQGTTVTVSS |

The AA sequence shows: QVQLVESGGGVVQPGRSLRLSCAASGFTFSRYGMHWVRQAPGKGLEWVAVIWYDGSNENYVDSVKGRFTISRDTSKKMLFLQMNSLRTDDTAVYYCARDMGIGYYGMDVWGQGTTVTVSS

| | | | |
|---|---|---|---|
| | | | SEQ ID NO: 31016 |
| | | | CAGGTGCAGCTACAGCAGTGGGGCGCAGGACTGTTGAAGCCTTCGGAGACCCTGTCCCTCACCTGCGCTGTCTATGGTGGGTCCTTCAGTGTTTATTACTGGAGCTGGATCCGCCAGCCCCAGGGAAGGGGCTGGAGTGGATTGGGGAAATCAATCAGAGTGGACGCACCAACTACAACCCGTCCCTCAAGAGTCGAGTCACCATATCAGTAGACACGTCCAAGAACCAGTTCTCCCTGAATCTGATCTCTGTGACCGCCGCGGACACGGCTGTATTACTGTGCGAGGGACTACGGTGTCTTGACTACTGGGGCCAGGGAACCCTGGTCACCGTCTCCTCA |
| | | | SEQ ID NO: 31017 |

FIGURE 50
(Continued)

| | | | |
|---|---|---|---|
| | | AA | EIVLTQSPGTLSLSPGERATLSCRASQSVFSNYLA WYQQKPGQAPRLLIYGASSRAAGIPDRFSGSGSG TDFTLTISRLEPENFAVYYCQQYESSPWTFGQGT KVEIK<br>SEQ ID NO: 27012 | QVQLQQWGAGLLKPSETLSLTCAVYGGSFSVYYW SWIRQPPGKGLEWIGESNQSGRTTYNPSLKSRVTIS VDTSKNQFSLNLISVTAADTAVYYCARDYGVFDY WGQGTLVTVSS<br>SEQ ID NO: 31018 |
| iPS:436304 | 21-225_201F3 | NA | GATATTGTGATGACTCAGTCTCCACTCTCCCTG CCCGTCACCCCTGGAGAGCCGGCCTCCATCTC CTGCAGGTCTAGTCAGAGCTCCTGCATAATA ATAGATACAACCATTTGGATTGGTACCTGCAG AAGCCAGGGCAGTCTCCACAGCTCCTGATCTA TTTGGGTTCTAATCGGGCCTCCGGGGTCCCTG ACAGGTTCAGTGGCAGTGGATCAGGCACAGAT TTTACACTGAAAATCAGCAGAGTGGAGGCTGA GGATGTTGGGGTTTATTACTGCATGCAAGCTC TACAAACTCCCACTTTCGGCGGAGGGACCAAG GTGGAGATCAAA<br>SEQ ID NO: 27013 | GAGGTGCAACTGTTGGAGTCTGGGGGAGGCTTG GTACAGCCTGGGGGGTCCCAGAGACTCCTCTGTG CAGCCTCTGGATTCACCTTTAGCAGCTATGCCAT GAGCTGGGTCCGCCAGGCTCCAGGGAAGGGGCT GGAGTGGGTCTCAACTATTAGTGGTAGTGGTGTT AGAACATACTACGCAGACTCCGTGAAGGGCCGG TTCACCATCTCCAGAGACAATTCCAATAACACGC TGTTTCTGCAAATGAACAGCCTGAGAGCCGAGG ACACGGCCGTATATTACTGTGCGAAAGGGGGAG CTAGGAGCAGTGGTGTTCCACTTTGACTACTG GGGCCAGGGAACCCTGGTCACCGTCTCCTCA<br>SEQ ID NO: 31019 |
| | | AA | DIVMTQSPLSLPVTPGEPASISCRSSQSLLHNNRY NHLDWYLQKPGQSPQLLIYLGSNRASGVPDRFS GSGSGTDFTLKISRVEAEDVGVYYCMQALQTPT FGGGTKVEIK<br>SEQ ID NO: 27014 | EVQLLESGGGLVQPGGSQRLSCAASGFTFSSYAMS WVRQAPGKGLEWVSTISGSGVRTYYADSVKGRFTI SRDNSNNTLFLQMNSLRAEDTAVYYCAKGGARSS GWFHFDYWGQGTLVTVSS<br>SEQ ID NO: 31020 |

FIGURE 50
(Continued)

| | | | |
|---|---|---|---|
| iPS:436306 | 21-225_201H4 | NA | GAAATAGTGATGACGCAGTCTCCAGCCACCCT GTCTGTGTCTCCAGGGGAAAGAGCCACCTCT CCTGCAGGGCCAGTCAGAGTGTTAATAGCTAC TTAGCCTGGTACCAGCAGAAACCTGGCCAGGC TCCCAGGCTCCTCATCTATGGTGCATCCACCA GGGCCACTGGTATCCCAGCCAGGTTCAGTGGC AGTGGGTCTGGGACAGAATTCACTCTCACCAT CAGCAGCCTGCAGTCTGAAGATTATGACTGGT ATTACTGTCAAGAGTATAATGACTGGCCCGTGC AGTTTTGGCCAGGGGACCAACCTGGAGATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGCCAT GCACTGGGTCCGCCAGGCTCCAGGCAAGGGGCT GGAGTGGGTGGCAGTATATGGTATGATGGAAG TAATAAATACAATGCAGACTCCGTGAAGGGCCG ATTCACCATCTCCAGAGACAATTCCAAGAACACG CTGTATATGCAAATGAACAGCCTGAGAGCCGAG GACACGGCTGTATACTACTGTGCGAGAGATGTGG GTACAGTGGGAGCTACCTACTTTGACTGCTGGGG CCCGGGAACCCTGGTCACGTCTCCTCA |
| | | AA | EIVMTQSPATLSVSPGERATLSCRASQSVNSYLA WYQQKPGQAPRLLIYGASTRATGIPARFSGSGSG TEFTLTISSLQSEDFAVYYCQEYNDWPCSFGQGT NLEIK | QVQLVESGGGVVQPGRSLRLSCAASGFTFSSYAMH WVRQAPGKGLEWVAAIWYDGSNKYNADSVKGRF TISRDNSKNTLYMQMNSLRAEDTAVYYCARDVGT VGATYFDCWGPGTLVTVSS |
| | | | SEQ ID NO: 27015 | SEQ ID NO: 31021 |
| | | | SEQ ID NO: 27016 | SEQ ID NO: 31022 |
| iPS:436308 | 21-225_205H8 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACAAGGGAAAG CCCCTAAGCTCCTGATCTATTCTGCATCCTTTT TGCAAAGAGGGGTCCCATCAAGATTCAGCGGC AGTGGATCTGGGACAGAATTCACTCTCACAAT CAGCAGCCTGCAGCCTGAAGATTCTGCAGTT ATTACTGTCTACAGCATAATAGTTACCCGCTC ACTTTCGGCGGAGGGACCAAGGTGGAGATCA AA | CAGGTGCAGCTACAGCAGTGGGGCGCAGGACTG TTGAAGCCTTCGGAGACCCTGTCCCTCACCTGCG CTGTCTATGGTGGGTCCTTCAGTGGTTACTTCTGG AGCTGGATCCGCCAGCCCCCAGGGAAGGGGCTG GAGTGGATTGGGAAATCAGTCATAGTGGACGC ACCAATACAACCCGTCCCTCAAGAGCCGAGTCA CCATATCAGTAGACACGTCCAAGAACCAGTTCTC CCTGAAGGTGAGCTCTGTGACCGCCGCGGACAC GGCTGTGTATTACTGTGCGAGGGACTACGGGCG GACTACTGGGGCCAGGGAACCCTGGTCACCGTCT CCTCA |
| | | | SEQ ID NO: 27017 | SEQ ID NO: 31023 |

FIGURE 50
(Continued)

| | | | | |
|---|---|---|---|---|
| iPS:436310 | 21-225_202D11 | AA | DIQMTQSPSSLSASVGDRVTITCRASQGIRNDLG WYQQKQGKAPKLLIYSASFLQRGVPSRFSGSGS GTEFTLTISSLQPEDSAAYYCLQHNSYPLTFGGG ITVKIK SEQ ID NO: 27018 | QVQLQQWGAGLLKPSETLSLTCAVYGGSFSGYFW SWIRQPPGKGLEWIGEISHSGRTNYNPSLKSRVTISV DTSKNQFSLKVSSVTAADTAVYYCARDYGADYW GQGTLVTVSS SEQ ID NO: 31024 |
| | | NA | GAAATTGTGTTGACGCAGTCTCCAGGCACCCT GTCTTTGTCTCCAGGGGAAAAGAGCCACCCTCT CCTGCAGGGCCAGTCAGTATTAACAGCAAC TACTTAGCCTGGTACCAGCGGAAGCCTGGCCA GGCTCCCAGGGTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTTTTACTGTCAGCAGTATGAAAACTCACCG TGGACGTTCGGCCAAGGGACCAAGGTGGAAA TCAAA SEQ ID NO: 27019 | CAGGTGCAGCTACAGCAGTGGGGCGCAGGACTG TTGAAGCCTTCGGAGACCCTGTCCCTCACCTGCG CTGCCTATGGTGGGTCCTTCAGTGGCTACTG GAGCTGGATCCGCCAGCCCCCAGGGAAGGGCCT GGAGTGGATTGGGGAAATCAATCATAGTGGAAG CACCAACTACAACCGTCCCTCAAGAGTCGAGTC ACCATATCAGTAGACACGTCCAAGAACCAGTTCT CCCTGAAGCTGAGCTCTGTGACCGCCGCGGACAC GGCTGTTTACTACTGTGCGAGGGACTACGGTGTC CTTGACTACTGGGGCCAGGGAACCCTGGTCACCG TCTCCTCA SEQ ID NO: 31025 |
| | | AA | EIVLTQSPGTLSLSPGERATLSCRASQSINSNYLA WYQRKPGQAPRVLIYGASSRATGIPDRFSGSGSG TDFTLTISRLEPEDFAVFYCQQYENSPWTFGQGT KVEIK SEQ ID NO: 27020 | QVQLQQRGAGLLKPSETLSLTCAAYGGSFSGPYWS WIRQPPGKGLEWIGEINHSGSTNYNPSLKSRVTISV DTSKNQFSLKLSSVTAADTAVYYCARDYGVLDYW GQGTLVTVSS SEQ ID NO: 31026 |

FIGURE 50
(Continued)

| | | | |
|---|---|---|---|
| iPS:436312 | 21-225_206A4 | NA | GACATCCAGATGACCCTGTCTCCATCCTCCC GTCTGCATTTGTTGGAGACAGAGTCACCATCA CTCGCCGGGCAAGTCACAACATTAACAGCTAT TTAAATTGGTATCAGCAGAAATCAGGGAAAGC CCCTAAACTCCTTATCTGTCTGCATCCAGTTT GCAAAGTGGGGTCCCGTCAAGGTTCAGTGGCA GTGGATCTGGACAGATTTCACTCACTTTC AGTAGTCTACAACCTGAAGATTTTGCAACTTA CTACTGTCAACAGAGTTACAGTTTCCCGCTCA CTTTCGGCGGAGGGACCAAGGTGGAGATGAG G<br><br>SEQ ID NO: 27021 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TCCACTGGGTGCGACAGGCCCCTGGACAAGGGC TTGAGTGGATGGCATGGATCAACCCTAATAGTGG TGGCACAAACTATGCACAGAAGTTTCAGGGCAG GGTCACCATGACCAGGGACACGTCCATCACCAC AGCCTACATGGAGCTGAGCAGGCTGAGATCTGA CGACACGGCCGTGTATTACTGTGCGAGAGGATAC AGCTATGGTTACAACTGGTTCGACCCCTGGGGCC AGGGAACCCTGGTCACCGTCTCCTCA<br><br>SEQ ID NO: 31027 |
| | | AA | DIQMTLSPSSPSSAFVGDRVTITRRASHNINSYLN WYQQKSGKAPKLLICAASSLQSGVPSRFSGSGSG TDFTLTFSSLQPEDFATYYCQQSYSFPLTFGGGT KVEMR<br><br>SEQ ID NO: 27022 | QVQLVQSGAEVKKPGASVKVSCKASGYTFTGYYIH WVRQAPGQGLEWMAWINPNSGGTNYAQKFQGRV TMTRDTSITTAYMELSRLRSDDTAVYYCARGYSYG YNWFDPWGQGTLVTVSS<br><br>SEQ ID NO: 31028 |
| iPS:436314 | 21-225_206G4 | NA | GAAATTGTGCTGACTCAGTCTCCAGACTTTCA GTCTGTGACTCCAAAGGAGAAAGTCACCATCA CCTGCCGGGCCAGTCAGAGCATTGGTCGTAGC TTACACTGGTACCAGCAGAAACCAGATCAGTC TCCAAAACTCCTCATCAAGTATGCTCCAGT CCTTCTCAGGGATCCCCTCGAGGTTCAGTGGC AGTGGATCTGGGACAGATTTCACCCTCACCAT CAATAGCCTGGAAGCTGAAGATGCTGAACGT ATTACTGTCATCAGATAGAAGTTTACCGCTC ACTTTCGGCGGAGGGACCAAGGTGGAGATCA AA<br><br>SEQ ID NO: 27023 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGGC TTGAGTGGATGGATGGATCGACCAGAAGTTTCAGGGCAG TGGCACAAACTATGCACAGGACACGTCCATCAGTAC AATCACCATGGAACTGAGCAGGCTGAGATCTGA AGCCTACATGGAACTGAGCAGGCTGAGATCTGA CGACACGGCCGTGTTTACTGTGCGAAAGATCAA GGGTATAACTGAACTCTTTTGACTACTGGGGCC AGGGAACCCTGGTCACCGTCTCCTCA<br><br>SEQ ID NO: 31029 |

FIGURE 50
(Continued)

| | | | |
|---|---|---|---|
| iPS:436316 | 21-225_206A5 | AA | EIVLTQSPDFQSVTPKEKVTITCRASQSIGRSLHW YQQKPDQSPKLLIKYASQSFSGVPSRFSGSGSGT DFTLTINSLEAEDAATYYCHQSRSLPLTFGGGTK VEIK<br>SEQ ID NO: 27024 | QVQLVQSGAEVKKPGASVKVSCKASGYTFTGYYIH WVRQAPGQGLEWMGWIDPNSGGTNYAQKFQGRI TMTRDTSISTAYMELSRLRSDDTAVFYCAKDQGYN WNSFDYWGQGTLVTSS<br>SEQ ID NO: 31030 |
| | | NA | GACATCCAGATGACCCAGTCTCCATCCTCCCC GTCTGCATCTGTTGGACAGAGTCACCATCA CTCGCCGGGCAAGTCACAACATTAACAGCTAT TTAAAATTGGTATCAGCAGAAATCAGGGAAAGC CCCTAAACTCCTATCTGTCTGCATCCAGTTT GCAAAGTGGGGTCCCGTCAAGGTTCAGTGGCA GTGGATCTGGGACAGATTTCACTCTCACTTTC AGTAGTCTACAACAGAGTTACAGTTTCCCGCTCA CTACTGTCAACAGAGTCTGAAGATTTTGCAACTTA CTTTCGGCGGAGGGACCAAGGTGGAGATGAG G<br>SEQ ID NO: 27025 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TCCACTGGGTGCGACAGGCCCCTGGACAAGGGC TTGAGTGGATGGCATGGATCAACCCTAATAGTGG TGGCACAAACTATGCACAGAAGTTCAGGCAG GGTCACCATGACCAGGGACACGTCCATCACCAC AGCCTACATGGAGCTGAGCAGGCTGAGATCTGA CGACACGGCCGTGTATTACTGTGCGAGAGGATAC AGCTATGGTTACAACTGGTTCGACCCCTGGGGCC AGGGAACCCTGGTCACCGTCTCCTCA<br>SEQ ID NO: 31031 |
| | | AA | DIQMTQSPSSPSASVGDRVTITRRASHNINSYLN WYQQKSGKAPKLLICAASSLQSGVPSRFSGSGSG TDFTLTFSSLQPEDFATYYCQQSYSFPLTFGGGT KVEMR<br>SEQ ID NO: 27026 | QVQLVQSGAEVKKPGASVKVSCKASGYTFTGYYIH WVRQAPGQGLEWMAWINPNSGGTNYAQKFQGRV TMTRDTSITTAYMELSRLRSDDTAVYYCARGYSYG YNWFDPWGQGTLVTSS<br>SEQ ID NO: 31032 |

FIGURE 50
(Continued)

| | | | |
|---|---|---|---|
| iPS:436324 | 21-225_207G6 | NA | GATATCCAGATGACCCAGTCTCCATCCTCACTGTCTGCATCTGTAGGAGACAGAGTCACCATCACTTGTCGGGCAGTCAGGGCATTAGAAAATTATTTAGCCTGGCTTCAGCAGAAACCAGGGAAGGCCCCTAAGTCCCTGATCCATGCTGCATCCAGTTTGCAAAGTGGGGTCCCATCAAGTTCAGCGGCAATAGATCTGGGACAGATTTCACTCTCACCATCAGCAGCCTGCAGCCTGAAGATTTTGCAACTTATTACTGCCAACAGTACAGTAATTACCCTCTCACTTTCGGCGGAGGGACCAAGGTGGAGATCAAA<br>SEQ ID NO: 27027<br>DIQMTQSPSSLSASVGDRVTITCRASQGIRNYLAWLQQKPGKAPKSLIHAASSLQSGVPSKFSGNRSGTDFTLTISSLQPEDFATYYCQQYSNYPLTFGGGTKVEIK<br>SEQ ID NO: 27028 | CAGGTGCAGCTGGTGGAGTCTGGGGGAGGCGTGGTCCAGCCTGGGAGGTCCCTGAGACTCTCCTGTGCAGCCGTCTGGATTCACCTTCAGTAGCTATGGCATGCACTGGGTCCGCCAGGCTCCAGGCAAGGGGCTGGAGTGGGTGGCAGTTATATGGTATGATGGAAGTAATAAAAACTATGCAGAGTCCGTGAAGGGCCGATTCACCATCTCCAGAGACAATTCCAAGAACACGCTGTATCTGCAAATGAACAGCCTGAGAGCCGAGGACACGGCTGTGTATTATTGTGCGAGAGATGCGGGTATTGGATACTACGGTATAGACGTCTGGGGCCAAGGGACCACGGTCACCGTCTCCTCA<br>SEQ ID NO: 31033<br>QVQLVESGGGVVQPGRSLRLSCAASGFTFSSYGMHWVRQAPGKGLEWVAVIWYDGSNKNYAESVKGRFTISRDNSKNTLYLQMNSLRAEDTAVYYCARDAGIGYYGIDVWGQGTTVTVSS<br>SEQ ID NO: 31034 |
| iPS:436328 | 21-225_207F12 | NA | GACATCCAGATGACCCAGTCTCCATCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTTCTGTCTACAGCATAATAGTTACCCTCTCACCTTCGGCCAAGGGACCACGACTGGAAATTAAA<br>SEQ ID NO: 27029 | CAGGTGCAGCTGGTGGAGTCTGGGGGAGGCGTGGTCCAGCCTGGGAGGTCCCTGAGACTCTCCTGTCAGCCGTCTGGATTCACCTTCAGTAACTAATGGCATGCACTGGGTCCGCCAGGCTCCAGGCAAGGGGCTGGAGTGGGTGGCAGTTATATGGTATCCGTGAAGGGCCGATAATAAATACTATGGTGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAACTGGGGTTCCTCTTTGACTACTGGGGCCAGGGAACCCTGGTCACCGTCTCCTCA<br>SEQ ID NO: 31035 |

FIGURE 50
(Continued)

| | | | |
|---|---|---|---|
| iPS:436332 | 21-225_208B2 | AA | DIQMTQSPSSLSASVGDRVTITCRASQGIRNDLG WYQQKPGKAPKRLIYAASSLQSGVPSRFSGSGS GTEFTLTISSLQPEDFATYFCLQHNSYPLTFGQGT RLEIK<br><br>SEQ ID NO: 27030 | QVQLVESGGGVVQPGRSLRLSCAASGFTFSNYGM HWVRQAPGKGLEWVAVIWYDRNNKYYGDSVKG RFTISRDNSKNTLYLQMNSLRAEDTAVYYCARELG FLFDYWGQGTLVTVSS<br><br>SEQ ID NO: 31036 |
| | | NA | GACATCCAGATGACCCAGTCTCCATCCTCCCT GTCTGCATCTGTAGGAGACAGAGTCACCATCA CTTGCCGGGCAAGTCAGGGCATTAGAGACATGAT TTAGGCTGGTATCAACAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCCG ACGTTCGGCCAAGGGACCAAGGTGGAAATCA AA<br><br>SEQ ID NO: 27031 | CAGGTGCAGCTGGTGGAGTCTGGGGGAGGCGTG GTCCAGCCTGGGAGGTCCCTGAGACTCTCTGTG CAGCGTCTGGATTCACCTTCAGTGACTGTGTCAT GCACTGGGTCCGCCAGGCTCCAGGCAAGGGGCT GGAGTGGGTGGCAGTTATATGTAGACTCGTGAAGT AATAAATACTATCCAGAGACAATTCAGAGAACACGCT GTATCTGCAAATGAACAGCCTGAGAGCCGAGGA CACGGCTGTGTATTACTGTGCGAGAGAACGGTAT AGCAGTGGCTTGTACGACTACGGTTTGGACGTCT GGGGCCAAGGGACCACGGTCACCGTCTCCTCA<br><br>SEQ ID NO: 31037 |
| | | AA | DIQMTQSPSSLSASVGDRVTITCRASQGIRHDLG WYQQKPGKAPKRLIYAASSLQSGVPSGFSGSGS GTEFTLTISSLQPEDFATYYCLQHYSYPRTFGQG TKVEIK<br><br>SEQ ID NO: 27032 | QVQLVESGGGVVQPGRSLRLSCAASGFTFSDCVMH WVRQAPGKGLEWVAVIWYDGSNKYYVDSVKGRF TISRDNSRNTLYLQMNSLRAEDTAVYYCARERYSS GLYDYGLDVWGQGTTVTVSS<br><br>SEQ ID NO: 31038 |

FIGURE 50
(Continued)

| | | | |
|---|---|---|---|
| iPS:436334 | 21-225_208G3 | NA | GATATTGTGCTGACTCAGTCTCCACTCTCCCTG CCCGTCACCCCTGGAGAGCCGGCCTCCATCTC CTGCAGGTCTAGTCAGAGCCTCCTGCATAATA ATAAATACAACCATTTGGATTGTACTGCAG AAGCCAGGGCAGTCTCCACAGCTCCTGATCTA TTTGGGTTCTAATCGGGCCTCCGGGGTCCCTG ACAGGTTCAGTGGCAGTGGATCAGGCACAGAT TTTACACTGAAAATCAGCAGAGTGGAGGCTGA GGATGTTGGGGTTTATTACTGCATGCAAGCT TACAAACTCCCACTTTCGGCGGAGGGACCAAG GTGGAGATCAAA<br><br>SEQ ID NO: 27033 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAACTATTAGTGGTAGTGGTGTT AGAACATACTACGCAGACTCCGTGAAGGGCCGG TCCACCATCTCCAGAGACAATTCCAAGAATACGC TGTTTCTGCAAATGAACAGCCTGAGAGCCGAGG ACAAGGCCGTATATTACTGTGCAAAGGGGAG CTAGGAGCAGTGGCTGGTTCCACTTTGACTACTG GGGCCAGGGAACCCTGGTCACCGTCCTCA<br><br>SEQ ID NO: 31039 |
| | | AA | DIVLTQSPLSLPVTPGEPASISCRSSQSLLHNNKY NHLDWYLQKPGQSPQLLIYLGSNRASGVPDRFS GSGSGTDFTLKISRVEAEDVGVYYCMQALQTPT FGGGTKVEIK<br><br>SEQ ID NO: 27034 | EVQLLESGGGLVQPGGSLRLSCAASGFTFSSYAMS WVRQAPGKGLEWVSTISGSGVRTYYADSVKGRSTI SRDNSKNTLFLQMNSLRAEDKAVYYCAKGGARSS GWFHFDYWGQGTLVTVSS<br><br>SEQ ID NO: 31040 |
| iPS:436336 | 21-225_208B5 | NA | GAAATTGTTTTGACGCAGTCTCCAGGCACCCT GTCTTTGTCTCCAGGGGAAAGAGCCACCCTCT CCTGCAGGGCCAGTCAGAGTGTTAGCAGCAAC TACTTAGCCTGGTATCAGCAGAAACCTGGCCA GGCTCCCAGACTCCTCATCTATGGTGCATCCA GCAGGGCCACTGGCATCCAGACAGATTCAGT GGCAGTGGGTCTGGGACAGACTTCACTCTCAC CATCAGCAGACTGGAGCCTGAAGATTTTGCAG TGTATTTCTGTCAGCACTACGAAAACTCACCG TGGACGTTCGGCCAAGGGACCAAGGTGGAAA TCAAA<br><br>SEQ ID NO: 27035 | CAGGTGCAGCTACAGCAGTGGGGCGCAGGACTG TTGAAGCCTTCGGAGACCCTGTCCCTCACCTGCG CTGTCTTTGGTGGGTCCATCAGTGTTTACTACTGG ACCTGGATCGCCAGCCCAGGGAAGGGGCTG GAGTGGATTGGGGAAATCAATCATAGTGGAAGC ACCAACTACAACCCGTCCCTCAAGAGTCGAGTCA CCATATCAGTAGACACGTCCAAGAACCAGTTCTC CCTGAAGCTGAGCTCTGTGACCGCCGCGGACACG GCTGTGTATTACTGGGCCAGGGACTATGGTGTCT TTGATTACTGGGGCCAGGGAACCCTGGTCACCGT CTCCTCA<br><br>SEQ ID NO: 31041 |

FIGURE 50
(Continued)

| | | | | |
|---|---|---|---|---|
| iPS:436338 | 21-225_208E8 | AA | EIVLTQSPGTLSLSPGERATLSCRASQSVSSNYLAWYQQRPGQAPRLLIYGASSRATGIPDRFSGSGSGTDFTLTISRLEPEDFAVYFCQHYENSPWTFGQGTKVEIK<br>SEQ ID NO: 27036 | QVQLQQWGAGLLKPSETLSLTCAVFGGSISVYYWTWIRQPPGKGLEWIGEINHSGSTNYNPSLKSRVTISVDTSKNQFSLKLSSVTAADTAVYYCARDYGVFDYWGQGTLVTVSS<br>SEQ ID NO: 31042 |
| | | NA | GACATCCAGATGACCCAGTCTCCATCCTCCCCGTCTGCATTTGTTGGAGACAGAGTCACCATCACTCGCCGGGCAAGTCACAACATTAACAGCTATTAAATTGGTATCAGCAGAAATCAGGGAAAGCCCCTAAACTCCTTATCTATGCTGCATCCAGTTTGCAAAGTGGGGTCCCGTCAAGGTTCAGTGGCAGTGGATCTGGGACAGATTTCACTCTCACTTCAGTAGTCTACAACAGAGTTGCAACTTACTACTGTCAACAGAGTTACAGTTTCCCGTCACTTTCGGCGGAGGGACCAAGGTGGAGATGAGG<br>SEQ ID NO: 27037 | CAGGTGCAGCTGGTGCAGTCTGGGGCTGAGGTGAAGAAGCCTGGGGCCTCAGTGAAGGTCTCCTGCAAGGCTTCTGGATACACCTTCACGGCTACTATATCCACTGGGTGCGACAGGCCCCTGGACAAGGCTTGAGTGGATGGCATGGATCAACCCTAATAGTGGTGGCACAAACTATGCACAGAAGTTCAGGCAGGTCACCATGACCAGGGACACGTCCATCACCAGCCTACATGGAGCTGAGCAGGCTGAGATCTGACGACGGCCGTGTATTACTGTGCGAGAGGATACAGTATGGTTACAACTGGTTCGACCCTGGGCCAGGGAACCCTGGTCACCGTCTCCTCA<br>SEQ ID NO: 31043 |
| | | AA | DIQMTQSPSSPSSAFVGDRVTITRRASHNINSYLNWYQQKSGKAPKLLIYAASSLQSGVPSRFSGSGSGTDFTLTFSSLQPEDFATYYCQQSYSFPLTFGGGTKVEMR<br>SEQ ID NO: 27038 | QVQLVQSGAEVKKPGASVKVSCKASGYTFTGYYIHWVRQAPGQGLEWMAWINPNSGGTNYAQKFQGRVTMTRDTSITTAYMELSRLRSDDTAVYYCARGYSYGYNWFDPWGQGTLVTVSS<br>SEQ ID NO: 31044 |

FIGURE 50
(Continued)

| | | | |
|---|---|---|---|
| iPS:436340 | 21-225_208A9 | NA | GAAATTGTGTTGACGCAGTCTCCAGGCACCCT GTCTTTGTCTCCAGGGGAAAGAGCCACCCTCT CCTGCAGGGCCAGTCAGAGTGTTAGCAACAAC TACTTAGCCTGGTACCAGCAGAAACCTGGCCA GGCTCCCAGGGTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCACTATCATAGCTCACCGT GGACGTTCGGCCAAGGGACCAAGGTGGAAAT CAAA<br><br>SEQ ID NO: 27039 | CAGGTGCAGCTACAGCAGTGGGGCGCAGGACTG TTGAAGCCTTCGGAGCCCTGTCCTCACCTGCG CTGTCTATGGTGGGTCCTTCAGTGTTCTACTGG AGCTGGATCCGCCAGCCCCCAGGGAAGGGCTG GAGTGGATTGGGGAAATCAATCATAGTGGACGC GCCAACTACAACCGTCCCTCAAGAGTCGAGTCA CCATATCAATAGACACGTCAAGAACCAGTTCTC CCTGAAGCTGAGCTCTGTGACCGCCGCGGACACG GCTGTGTATTACTGTGCGAGGGACTACGGTGTCC TTGACTACTGGGGCCAGGGAACCCTGGTCACCGT CTCCTCA<br><br>SEQ ID NO: 31045 |
| | | AA | EIVLTQSPGTLSLSPGERATLSCRASQSVSNNYLA WYQQKPGQAPRVLIYGASSRATGIPDRFSGSGSG TDFTLTISRLEPEDFAVYYCQHYHSSPWTFGQGT KVEIK<br><br>SEQ ID NO: 27040 | QVQLQQWGAGLLKPSEPLSLTCAVYGGSFSVSYW SWIRQPPGKGLEWIGEINHSGRANYNPSLKSRVTISI DTSKNQFSLKLSSVTAADTAVYYCARDYGVLDYW GQGTLVTVSS<br><br>SEQ ID NO: 31046 |
| iPS:436344 | 21-225_208B11 | NA | GACATCCAGATGACCCAGTCTCCATCTCCCC GTCTGCATCTGTTGGAGACAGAGTCACCATCA CTTGCCGGGCAAGTCACAACATTAACAGCTAT TTAAATTGGTATCAGCAGAAATCAGGAAAGC CCCTAAACTCCTTATCTATGCTGCATCCAGTTT GCAAAGTGGGGTCCCGTCAAGGTTCAGTGGCA GTGGATCTGGGACAGATTTCACTCTCACTTA CTACTGTCAACAGAGTTACAGTTTCCCGTCA CTTTCGGCGGAGGGACCAAGGTGGAGATGAG G<br><br>SEQ ID NO: 27041 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TCCACTGGGTGCGACAGGCCCCTGGACAAGGC TTGAGTGGATGGCATGGATCAACCCTAATAGTGG TGGCACAAACTATGCACAGAAGTTTCAGGGCAG GGTCACCATGACCAGGGACACGTCCATCACCAC AGCCTACATGGAGCTGAGCAGGCTGAGATCTGA CGACACGGCCGTGTATTACTGTGCGAGAGGATAC AGCTATGGTTACAACTGGTTGACCCCTGGGGCC AGGGAACCCTGGTCACCGTCTCCTCA<br><br>SEQ ID NO: 31047 |

FIGURE 50
(Continued)

| | | | |
|---|---|---|---|
| iPS:436350 | 21-225_210E4 | AA | DIQMTQSPSPSASVGDRVTITCRASHNINSYLN WYQQKSGKAPKLLIYAASSLQSGVPSRFSGSGS GTDFTLTFSSLQPEDFATYYCQQSYSFPLIFGGG TKVEMR SEQ ID NO: 27042 | QVQLVQSGAEVKKPGASVKVSCKASGYTFTGYYIH WVRQAPGQGLEWMAWINPNSGGTNYAQKFQGRV TMTRDTSITTAYMELSRLRSDDTAVYYCARGYSYG YNWFDPWGQGTLVTVSS SEQ ID NO: 31048 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA CAGCAGCCTGCAGCTGAAGATTTTGCAACT TATTACTGTCTACAGCATAATAGTTACCCATTC ACTTTCGGCCCTGGGACCAAAGTGGATATCAA A SEQ ID NO: 27043 | CAGGTGCAGCTGGTGGAGTCTGGGGAGGCGTG GTCCAGCCTGGGAGGTCCCTGAGACTCTCCTGTG CAGCGTCTGGATTCACCTTCACTATGGCAT GCACTGGGTCCGCCAGGCTCCAGGCAAGGGCT GGAGTGGGTGGCAGTTATATGTATGATGAAAAT AATAAATACTATGTAGACTCCGTGAAGGGCCGAT TCACCATCTCCAGAGACAGCATTCCAAGAACAGCT GTATCTGCAAATGAACAGCCTGAGAGCCGAGGA CTCGGCTGTGTATTACTGTGCGAGAGAGACGGGT TTCTTGAGCGACTACTGGGGCCAGGGAACCCTGG TCACCGTCTCCTCA SEQ ID NO: 31049 |
| | | AA | DIQMTQSPSSLSASVGDRVTITCRASQGIRNDLG WYQQKPGKAPKRLIYAASSLQSGVPSRFSGSGS GTEFTLTISSLQPEDFATYCLQHNSYPFTFGPGT KVDIK SEQ ID NO: 27044 | QVQLVESGGGVVQPGRSLRLSCAASGFTLINYGMH WVRQAPGKGLEWVAVIWYDENNKYYVDSVKGRF TISRDDSKNTLYLQMNSLRAEDSAVYYCARETGFL SDYWGQGTLVTVSS SEQ ID NO: 31050 |

FIGURE 50
(Continued)

| | | | |
|---|---|---|---|
| iPS:436352 | 21-225_210G5 | NA | GACATCCAGATGACCCAGTCTCCATCTCCCT GTCTGCATCTGTAGGAGACAGAGTCACCATCA CTTGCCGGGCAAGTCAGGGACATTAGACATGAT TTAGGCTGGTATCAACAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACACCATTATAGTTACCCTCGG ACGTTCGGCCAAGGGACCAAGGTGGAAATCA AA SEQ ID NO: 27045 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTGTGTCAT GCACTGGGTCCGCCAGGCTCCAGGCAAGGGGCT GGAGTGGGTGGCAGTTATATGACTCCGTGAAGGGCCGAT AATAAATACTATGTAGACTCCGTGAAGGGCCGAT TCACCATCTCCAGAGACAATTCCAGGAACACGCT GTATCTGCAAATGAACAGCCTGAGAGCCGAGGA CACGGCTGTGTATTACTGTGCGAGAGAACGGTAT AGCAGTGGCTTGTACGACTACGGTTTGACGTCT GGGGCCAAGGGACCACGGTCACCGTCTCCTCA SEQ ID NO: 31051 |
| | | AA | DIQMTQSPSSLSASVGDRVTITCRASQGIRHDLG WYQQKPGKAPKRLIYAASSLQSGVPSGFSGSGS GTEFTLTISSLQPEDFATYYCLHHYSYPRTFGQG TKVEIK SEQ ID NO: 27046 | QVQLVESGGGVVQPGRSLRLSCAASGFTFSDCVMH WVRQAPGKGLEWVAVIWYDGSNKYYVDSVKGRF TISRDNSRNTLYLQMNSLRAEDTAVYYCARERYSS GLYDYGLDVWGQGTTVTVSS SEQ ID NO: 31052 |
| iPS:436354 | 21-225_210G10 | NA | GACATCCAGATGACCCAGTCTCCATCTCCCT GTCTGCATCTGTAGGAGACAGAGTCACCATCA CTTTCCGGACAAGTCAGGGCATTAGAAATGAT TTAGGCTGGTATCAGCAGAAACCAGGGAAAA CCCCTAAGCGCCTGATTTATGCTGCAACCAGT TTGTTTAGTGGGGTCCCATCAAGGTTCAGCGG CAGTAGATCTGGGACAGATTTCACTCTCACAA TCAGCAGCCTGCAGCCTGAAGATTTTGCAACT TATTACTGTCTACAGTATAATAGTTACCCTCCC ACCTTCGGCCAAGGGACGACTGGAGATTAA A SEQ ID NO: 27047 | CAGGTGCAGCTGCAGGAGTCGGGCCCAGGACTG GTGAAGCCTTCGGAGACCCTGTCCCTCAACTGCA CTGTCTCTGGTGGCTCCATCAGAGTTACTACTG GAGCTGGATCCGGCAGCCCGCCGGGAAGGACT GGAGTGGATTGGGCGTATCTATACCAGTGGGAGC ACCGACTACAACCCCTCCCTCAAGAGTCGAATCA CCATGTCAGTAGACACGTCCAAGAACCAGTTCTC TTTGAAGCTGAGCTCTGTGACCGCCGCGGACACG GCCGTGTATTACTGTGCGAGAGAGGGTTCGGTGACT GGGACTACTGGGGCCAGGGAACCCTGGTCACCG TCTCCTCA SEQ ID NO: 31053 |

FIGURE 50
(Continued)

| | | | AA | DIQMTQSPSSLSASVGDRVTITFRTSQIRNDLG WYQQKPGKTPKRMIYAASSLFSGVPSRFSGSRS GTDFTLTISSLQPEDFATYYCLQYNSYPPTFGQG TRLEIK | QVQLQESGPGLVKPSETLSLNCTVSGGSIRSYYWS WIRQPAGKGLEWIGRIYTSGSTDYNPSLKSRITMSV DTSKNQFSLKLSSVTAADTAVYYCARGFGDWDYW GQGTLVTVSS |
|---|---|---|---|---|---|
| | | | | SEQ ID NO: 27048 | SEQ ID NO: 31054 |
| iPS:436356 | 21-225_210H10 | | NA | GAAATAGTGATGACGCAGTCTCCAGCCACCCT GTCTGTCTCCAGGGGAAAGAGCCACCCTCT CCTGCAGGGCCAGTCAGAGTGTTAAAAGCAAC TTAGCCTGGTACCAGCAGAAACCTGGCCAGGC TGCTCCAGGCTCCTCATCTATGGTGCATCCACA GGGCCACTGGTATCCCAGCCAGGTTCAGTGGC AGTGGGTCTGGGACAGAGTTCACTCTCACCAT CAGCAGCCTGCAGTCTGAAGATTTTGCAGTTT ATTCCTGTCAGCAGTATTATAACTGGCTGTGC AGTTTTGGCCAGGGGACCAAGCTGGAGATCAA A | CAGGTACAGCTGCAGCAGTCAGGTCCAGGACTG GTGAAGCCCTCGCAGACCCTCTCACTCACCTGTG CCATCTCCGGGACCAGTGTCTAGCAACAGTGC TGCTTGGAACTGGATCAGGCAGTCCCCATCGAGA GGCCTTGAGTGGCTGGGAAGGACATACTACAGG TCCAAGTGGTATAATTATTATCCAGTATCTGTGA GAAGTCGAATAACCATCAACCAGACACATCCA AGAACCAGTTCTCCCTGCTGTGAACTCTGTGAC TCCGAGGACACGGCTGTGTATTACTGTGCAAGA GATCAACGGTACTACGGTATGGACGTCTGGGGCC AAGGGACCACGGTCACCGTCTCCTCA |
| | | | | SEQ ID NO: 27049 | SEQ ID NO: 31055 |
| | | | AA | EIVMTQSPATLSVSPGERATLSCRASQSVKSNLA WYQQKPGQAPRLLIYGASTRATGIPARFSGSGSG TEFTLTISSLQSEDFAVYSCQQYYNWLCSFGQGT KLEIK | QVQLQQSGPGLVKPSQTLSLTCAISGDSVSSNSAA WNWIRQSPSRGLEWLGRTYYRSKWYNYYPPVSVRS RITINPDTSKNQFSLLNSVTPEDTAVYYCARDQRY YGMDVWGQGTTVTVSS |
| | | | | SEQ ID NO: 27050 | SEQ ID NO: 31056 |

FIGURE 50
(Continued)

| | | | |
|---|---|---|---|
| iPS:436358 | 21-225_210D11 | NA | GACATCCAGATGACCCAGTCTCCATCTCCT GTCTGCATCTGTTGGAGACAGAGTCACCATCA CTTGCCGGGCAAGTCACAACATTAACAGCTAT TTAAATTGGTATCAGCAGAAATCAGGGAAAGC CCCTAAACTCCTAATCTATGCTGCATCCAGTTT GCAAAGTGGGGTCCCGTCAAGGTTCAGTGGCA GTGGATCTGGGACAGATTTCACTCTCACCTTC AGTAGTCTACAACTGAAGATTTTGCAACTTA CTACTGTCAACAGAGTTACAGTTTCCCGCTCA CTTTCGGCGGAGGGACCAAGGTGGAGATGAG G<br>SEQ ID NO: 27051 | CAGGTGCAGCTGGTGCAGTCTGGGGCTGAGGTG AAGAAGCCTGGGGCCTCAGTGAAGGTCCTGC AAGGCTTCTGGATACACCTTCACCGGCTACTATA TCCACTGGGTGCGACAGGCCCCTGGACAAGGGC TTGAGTGGATGGCATGGATCAACCCTAATAGTGG TGGCACAAACTATGCACAGAAGTTCAGGGCAG GGTCACCATGACCAGGGACACGTCATCACCAC AGCCTACATGGAGCTGAGCAGGCTGAGATCTGA CGACACGGCCGTGTATTACTGTGCGAGAGGATAC AGCTATGGTTACAACTGGTTCGACCCCTGGGGCC AGGGAACCCTGGTCACCGTCTCCTCA<br>SEQ ID NO: 31057 |
| | | AA | DIQMTQSPSSLSASVGDRVTITCRASHNINSYLN WYQQKSGKAPKLLIYAASSLQSGVPSRFSGSGS GTDFTLTFSSLQPEDFATYYCQQSYSFPLTFGGG TKVEMR<br>SEQ ID NO: 27052 | QVQLVQSGAEVKKPGASVKVSCKASGYTFTGYYIH WVRQAPGQGLEWMAWINPNSGGTNYAQKFQGRV TMTRDTSITTAYMELSRLRSDDTAVYYCARGYSYG YNWFDPWGQGTLVTVSS<br>SEQ ID NO: 31058 |
| iPS:436360 | 21-225_210H11 | NA | GACATCCAGATGACCCAGTCTCCATCTTCCGT GTCTGCTTCTGGGGAGACAGAGTCACCATCA CTTGTCGGGCGAGTCAGGTATTAGCAGCTGG TTAGCCTGGTATCAGCAGAAACCAGGGAAAG CCCCTAAGCTCCTGATCTATGCTGCATCCAGTT TGCAAAGTGGAGTCCCATCAAGGTTCAGTGGC AGAGGATCTGGGACAGATTTCACTCTCACCAT CAGCAGCCTGCAGCCTGAAGATTTTGCAACTT ACTATTGTCAACAGGCTAAAAGTTTCCCATTC ACTTTCGGCCCTGGGACCAAAGTGGATATCAA A<br>SEQ ID NO: 27053 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCCATGCAT GCACTGGGTCCGCCAGGCTCCAGGCAAGGGGCT GGAGTGGGTGGCAGTTACATGGTATGATGGAAG TGATAAATACTATGCAGACTCCGTGAAGGGCCG ATTCACCATCTCCAGAGACAATTCCAAGAACACG CTGTATCTGCAAATGAACAGCTGTGCGCGAGACCGAG GACACGGCTGTATATTACTGTGCGCGAGACCGGC TAGTGGGAGCTACTACCGATGCTTTTGATATCTG GGGCCAAGGGACAATGGTCACCGTCTCTTCA<br>SEQ ID NO: 31059 |

FIGURE 50
(Continued)

| | | AA/NA | Sequence | |
|---|---|---|---|---|
| iPS-436362 | 21-225_210C12 | AA | DIQMTQSPSSVSASVGDRVTITCRASQGISIWLAWYQQKPGKAPNLLIYAASSLQSGVPSRFSGRGSGTDFTLTISSLQPEDFATYYCQQAKSFPFTFGPGTKVDIK<br>SEQ ID NO: 27054 | QVQLVESGGGVVQPGRSLRLSCAASGFTFSSHGMHWVRQAPGKGLEWVAVTWYDGSDKYYADSVKGRFTISRDNSKNTLYLQMNSLRAEDTAVYYCARDRLVGATTDAFDIWGQGTMVTVSS<br>SEQ ID NO: 31060 |
| | | NA | GATATTGTGATGACTCAGTCTCCACTCTCCCTGCCCGTCACCCCTGGAGAGCCGGCCTCCATCTCCTGCAGGTCTAGTCAGAGCCTCCTGCATTATATATGGACACAACTTTTTGGATTGGTACCTGCAGAAGCCAGGGCAGTCTCCACAGCTCCTGATCTATTTGGTTTCTAATCGGGCCTCCGGGGTCCCTGACAGGTTCAGTGGCAGTGGATCAGGCACAGATTTTACACTGAAAATCAGCAGTGGAGGCTGAGGATGTTGGGGTTTATTACTGCATGCAAGCTCTACAAACTCCCATGTGCAGTTTTGGCCAGGGGACCAAGGTTGGAGATCAAA<br>SEQ ID NO: 27055 | CAGGTTCAGTCTGGTGCAGTCTGGAGCTGAGGTGACGAAGCCTGGGGCCTCAGTGAAGGTCTCCTGCAAGGCTTCTGGTTACACCTTTACCAACAATGTATCAGCTGGGTGCGACAGGCCCCTGGACAAGGGCTTGAGTGGATGGGATGGATCAACGCTTACAATGGTCACACAAACTATGCACAGACACATCCACGAGCACAGTCCACTATGGAGCTGTATTACTGTGCGAGATCTGACGACACGGCCGTGTATTACTACTGGGACCACTACTATTACTACGGTATGGACGTCTGGGGCCAAGGGACCACGGTCACCGTCTCCTCA<br>SEQ ID NO: 31061 |
| | | AA | DIVMTQSPLSLPVTPGEPASISCRSSQSLLHYNGHNFLDWYLQKPGQSPQLLIYLVSNRASGVPDRFSGSGSGTDFTLKISRVEAEDVGVYYCMQALQTPMCSFGQGTKLEIK<br>SEQ ID NO: 27056 | QVQLVQSGAEVTKPGASVKVSCKASGYTFTNNGISWVRQAPGQGLEWMGWINAYNGHTNYAQKFQGRVTMTTDTSTSTAYMELRSLRSDDTAVYYCARDPTVTHYYYGMDVWGQGTTVTVSS<br>SEQ ID NO: 31062 |

FIGURE 50
(Continued)

| | | NA | GACATCCGATGACCCAGTCTCCATCCTCACT GTCTGCATCTGTAGGAGACAGAGTCACCATCA CTTGTCGGGCGAGTCAGGGCATTGGCAATTAT TTAGCCTGGTTTCAGCAGAAACCAGGGAAAGC CCCTAAGTCCTGATCTATGATGCATCCAGTTT GGAAAGTGGGGTCCATCAAAGTTCAGCGGC AGTAGGTCTGGGACAGATTTCACTCTCACCAT CGGCAGCCTGCAGCCTGAAGATTTTGCAACTT ATTACTGCCAACACTATATGACTTACCCGCTC ACTTTCGGCGGAGGGACCAAGGTGGAGATCA AA | CAGGTGCAGCTGGTGGGGTCTGGGGGAGGCGTG GTCCAGCCTGGGAGGTCCCTGAGACTCTCCTGTG CAGCGTCTGAATTCACCTTCAGTAGCTATGGCAT GCACTGGGTCGCCAGGCTCCAGGCAAGGGCT GGAATGGGTGGCAGTTCTTTGGTTTGATGAAGT AATAGAAACTATGCAGACTCCGTGAAGGGCCGA TTCACCATCTCCAGAGACAATTCCAAGAACACGC TGTATCTGCAAATGAACAGCTGAGAGCCGAGG ACACGGCTGTGTATTACTGTGCGAGAGATCGGGG AGTGGGCTACTACGGTACGGACGTCTGGGGCCA AGGGACCACGGTCACCGTCTCCTCA |
| iPS:436364 | 21-225_211A11 | | SEQ ID NO: 27057 | SEQ ID NO: 31063 |
| | | AA | DIQMTQSPSSLSASVGDRVTITCRASQGIGNYLA WFQQKPGKAPRSLIYDASSLESGVPSKFSGSRSG TDFTLTIGSLQPEDFATYYCQHYMTYPLTFGAGT KVEIK | QVQLVGSGGGVVQPGRSLRLSCAASGFTFSSYGMH WVRQAPGKGLEWVAVLWFDGSNRNYADSVKGRF TISRDNSKNTLYLQMNSLRAEDTAVYYCARDRGV GYYGTDVWGQGTTVTVSS |
| | | | SEQ ID NO: 27058 | SEQ ID NO: 31064 |
| | | NA | GACATCCGATGACCCAGTCTCCATCCTCACT GTCTGCATCTGTAGGAGACAGAGTCACCATCA CTTGTCGGGCGAGTCAGGCCATTGGCAAACAT CAGTGTCTGGAATCACCTTCAGTAGTTATGGCAT GCACTGGGCCCGCCAGGCTCCAGGCAAGGGCT GGAGTGGGTGGCAGTTATATGAAGATGGAAGT AATAAAAACTATGAAGACTCCGTGAAGGGCCGA TTCACCATCTCCAGAGACAACTCCAAGAACACGC TGTATCTGCAAATGAACAGCTGAGAGCCGAGG ACACGGCTGTGTATTACTGTGCGAGAGATGGAG TTAIGGTTACGACGGTATGGACGTCTGGGGCCAA GGGACCACGGTCACCGTCTCCTCA | CAGGTGCAGCTGGTGGAGTCTGGGGGAGGCGTG GTCCAGCCTGGGAGGTCCCTGAGACTCTCCTGTG CAGTGTCTGGAATCACCTTCAGTAGTTATGGCAT GCACTGGGCCCGCCAGGCTCCAGGCAAGGGCT GGAGTGGGTGGCAGTTATATGAAGATGGAAGT AATAAAAACTATGAAGACTCCGTGAAGGGCCGA TTCACCATCTCCAGAGACAACTCCAAGAACACGC TGTATCTGCAAATGAACAGCTGAGAGCCGAGG ACACGGCTGTGTATTACTGTGCGAGAGATGGAG TTAIGGTTACGACGGTATGGACGTCTGGGGCCAA GGGACCACGGTCACCGTCTCCTCA |
| iPS:436366 | 21-225_211A3 | | SEQ ID NO: 27059 | SEQ ID NO: 31065 |

FIGURE 50
(Continued)

| | | | | |
|---|---|---|---|---|
| iPS-436368 | 21-225_211G3 | AA | DIRMTQSPSSLSASVGDRVTITCRASQAIGKHLA WFQQRPGKAPKSLIYAASRLQSGVPSKFSGSGSG TDFTLTISSLQPEDLATYYCQQYSNYPLTFGGGT KVEIK<br>SEQ ID NO: 27060 | QVQLVESGGGVVQPGRSLRLSCAVSGITFSSYGMH WARQAPGKGLEWVAVIWYDGSNKNYEDSVKGRF TISRDNSKNTLYLQMNSLRAEDTAVYYCARDGSYG YDGMDVWGQGTTVTVSS<br>SEQ ID NO: 31066 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTAGCAGCAGC TTCTTAGCCTGGTACCAGCAGAAACCTGGCCA GGCTCCCAGGCTCCTCATCTATGGTGCATCCA GCAGGGCCACTGGCATCCCAGACAGTTCAGT GGCAGTGGGTCTGGGACAGACTTCACTCTCAC CATCAGCAGACTGGAGCCTGAAGATTTTGCAG TGTATTACTGTCAGCAGTATTAGCTCACCG CTCACTTTCGGCGGAGGGACCAAGGTGGAGAT CAAA<br>SEQ ID NO: 27061 | CAGGTGCAGCTGGTGGAGTCTGGGGGAGGCGTG GTCCAGCCTGGGAGGTCCCTGAGACTCTCTGTG CAGCGTCTGGATTCACCTTCAGTAACTATGGCAT GCACTGGGTCCGCCAGGCTCCAGGCAAGGGCT GGAGTGGGTGGCAGTTATATGGCATGATGGAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGGTTAGACT ACAGTAACTACGGTGGTTCGACCCCTGGGGCCA GGGAACCCTGGTCACCGTCTCCTCA<br>SEQ ID NO: 31067 |
| | | AA | EIVLTQSPGTLSLSPGERATLSCRASQSVSSSFLA WYQQKPGQAPRLLIYGASSRATGIPDRFSGSGSG TDFTLTISRLEPEDFAVYYCQQYVSSPLTFGGGT KVEIK<br>SEQ ID NO: 27062 | QVQLVESGGGVVQPGRSLRLSCAASGFTFSNYGM HWVRQAPGKGLEWVAVIWHDGSNKYYADSVKGR FTISRDNSKNTLYLQMNSLRAEDTAVYYCARLDYS NYGWFDPWGQGTLVTVSS<br>SEQ ID NO: 31068 |

FIGURE 50
(Continued)

| | | | |
|---|---|---|---|
| iPS:436370 | 21-225_211.A6 | NA | GACATCGAGATGACCCAGTCTCCATCCTCACT GTCTGCATCTGTAGGAGACAGGGTCACCATCA CTTGTCGGGCGAGTCAGGGCATTGGCAAGTAT TTAGCCTGGTTTCAGCAGAAACCAGGGAAAGC CCCTAAGTCCCTGATCTATGCTGCATCCAGTTT GCTAAGTGGGGTCCCATCAAGGTTCAGCGGCA GTGGATCTGGGACAGATTTCACTCTCACCATC AGCAGCCTTCAGCCTGAAGATTTTGCCACTTA TTACTGCCAAAAGTATGATACTTACCCATTCA CTTTCGGCCCTGGGACCAAAGTGGATATCAAA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAAAACTATGCAGACTCCGTGAAGGGCCGA TTCACCATTCCAGAGACAACTCCAAGAACACGC TGTATCTGCAAATGAACAGCCTGAGAGCCGAGG ACACGGCTGTGTTTACTGTGCGAGAGATAGGAC GGTGGGCTATGATGGTTTTGATATCTGGGGCCAA GGGACAATGGTCACCGTCTCTTCA |
| | | | SEQ ID NO: 27063 | SEQ ID NO: 31069 |
| | | AA | DIQMTQSPSSLSASVGDSVTITCRASQGIGKYLA WFQQKPGKAPKSLIYAASSLLSGVPSKFSGSGSG TDFTLTISSLQPEDFATYYCQKYDTYPFTFGPGT KVDIK | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVFYCARDRTVG YDGFDIWGQGTMVTVSS |
| | | | SEQ ID NO: 27064 | SEQ ID NO: 31070 |
| iPS:436372 | 21-225_211.A8 | NA | GACATCGAGATGACCCAGTCTCCACCCTCACT GTCTGCATTTGTAGGAGACAGAGTCACCATCA CTTGTCGGGCGAGTCAGGGCATTAGCAGATAT TTAGCCTGGTTTCAGCAGAAACCAGGGAAAG CCCCTAAGTCCCTGATCTATGCTGCATCCAGTT TGCAAAGTGGGGTCTCATCAAGGTTCAGCGGC AGTGGATCTGGGACAGATTTCACTCTCACCAT CAGCAGCCTGCAGCCTGAAGATTTCGCAACTT ATTACTGCCTACGGTATGATACTTACCCTCTCA TTTTCGGCGGAGGGACCAAGGTGGAGATCAA G | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATGAACACTATGCAGACTCCGTGAAGGGCCGA TTCACCATTCCAGAGACAATTCCAAGAAAACGC TGTATCTGCAAATGAACAGCCTGAGAGCCGAGG ACACGGCTGTGTATTACTGTGCGAGAGACCACGG TGTCGGGTACTACGGTATGGACGTCTGGGGCCAA GGGACCACGGTCACCGTCTCCTCA |
| | | | SEQ ID NO: 27065 | SEQ ID NO: 31071 |

FIGURE 50
(Continued)

| | | | | |
|---|---|---|---|---|
| | | AA | DIEMTQSPPSLSAFVGDRVTITCRASQGISRYLA WVQQKPGKAPKSLIYAASSLQSGVSSRFSGSGSG TDFTLTISSLQPEDFATYYCLRYDTYPLIFGGGTK VEIK<br>SEQ ID NO: 27066 | QVQLVESGGGVVQPGRSLRLSCAASGFTFSSYGMH WVRQAPGKGLEWVAVIWYDGSNEHYADSVKGRF TISRDNSKKTLYLQMNSLRAEDTAVYYCARDHGV GYYGMDVWGQGTTVTVSS<br>SEQ ID NO: 31072 |
| iPS:436374 | 21-225_211C10 | NA | GATATTGTGATGACTCAGTCTCCACTCTCCCTG CCCGTCACCCCTGGAGAGCCGGCTCCATCTC CTGCAGGTCTAGTCAGAGCCTCCTCCATAGTA ATGGATACAACTATTTGGATTGGTACCTGCTG AAGCCAGGGCAGTCTCCACAGCTCCTGATCTA TTTGGGTTCTAATCGGCCTCCGGGGTCCCTG ACAGGTTCAGTGGCAGTGGATCAGGCACAGAT TTTACACTGAAAATCAGCAGAATGGAGGCTGA GGATGTTGGGATTTATTACTGCATGCAAGCTC TACTAACTCCCGTGTGCAGTTTTGGCCAGGGG ACCAAGCTGGAGATCAAA<br>SEQ ID NO: 27067 | CAGGTTCAGCTGGTGCAGTCTGGAGCTGAGGTGA AGAAGCCTGGGGCCTCAGTGAAGGTCTCCTGCA AGGCTTCTGGTTACACCTTTACCAGGCATGGTAT CAGCTGGGTGCGACTGGCCCTGGACAAGGGCTT GAGTGGATGGGATGGATCAGCGCTTACAATGGTC TCACAAACTATGCACCAGACCACATCCACGAGCAGAG TCCACCATGACCAGAGCTGCGGAGCCTGAGATCTGACG ACACGGCCGTGTATTACTGTGCGAGAGATCCTAC GGTGACCCACTACTACTACTACGGTATGGACGTC TGGGGCCAAGGGACCACGGTCACCGTCTCCTCA<br>SEQ ID NO: 31073 |
| | | AA | DIVMTQSPLSLPVTPGEPASISCRSSQSSLLHSNGY NYLDWYLLKPGQSPQLLIYLGSNRASGVPDRFS GSGSGTDFTLKISRMEAEDVGIYYCMQALLTPV CSFGQGTKLEIK<br>SEQ ID NO: 27068 | QVQLVQSGAEVKKPGASVKVSCKASGYTFTFRHGIS WVRLAPGQGLEWMGWISAVNGLTNYAQKFQGRV TMTDTSTSTGYMELRSLRSDDTAVYYCARDPTVT HYYYYGMDVWGQGTTVTVSS<br>SEQ ID NO: 31074 |

FIGURE 50
(Continued)

| | | | |
|---|---|---|---|
| iPS:436376 | 21-225_212E6 | NA | GACATCCAGATGACCCAGTCTCCATCCTCACTGTCTGCATCTGTAGGAGACAGAGTCACCATCACTTGTCGGGCGAGTCAGGGCATTAGCAATCATTAGCCTGGTTTCAGCAGAAACCAGGGCAAGCCCCTAAGTCCCTGATCTATGCTGCATCCAGTTTGCAAAGTGGGGTCCCATCAAAGTTCAGCGGCAGTAGATCTGGGACAGATTTCACTCTCACCATCAGCAGCCTGCAGCCTGAAGATTTTGCAACTTATTACTGCCAACAGTATGTTACCTACCCTCTCACTTTCGGCGGAGGGACCAAGGTGGAGATCAAA SEQ ID NO: 27069 | CAGGTGCAGCTGGTGGAGTCTGGGGGAGGCGTGGTCCAGCCTGGGAGGTCCCTGAGACTCTCCTGTGCAGCCGTCTGGATTCACCTTCAGTAGCTATGGCATGCACTGGGTCCGCCAGGCTCCAGGCAAGGGGCTGGAGTGGGTGGCAGTTATATGGTATGATGGAAGTAATAAAAACTATGTAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGACTACGGTGTCGGGTACTACGGACGTCTGGGGCCAAGGGACCACGGTCACCGTCTCCTCA SEQ ID NO: 31075 |
| | | AA | DIQMTQSPSSLSASVGDRVTITCRASQGISNHLAWFQQKPGQAPKSLIYAASSLQSGVPSKFSGSRSGTDFTLTISSLQPEDFATYYCQQYVTYPLTFGGGTKVEIK SEQ ID NO: 27070 | QVQLVESGGGVVQPGRSLRLSCAASGFTFSSYGMHWVRQAPGKGLEWVAVIWYDGSNKNYVDSVKGRFTISRDNSKNTLYLQMNSLRAEDTAVYYCARDYGVGYYGTDVWGQGTTVTVSS SEQ ID NO: 31076 |
| iPS:436378 | 21-225_212D7 | NA | GACATCCAGATGACCCAGTCTCCATCCTCACTGTCTGCATCTGTAGGAGACAGAGTCACCATCACTTGTCGGGCGAGTCAGGGCATTAGCAATTCATTAGCCTGGTTTCAGCAGAAACCAGGGAAAGCCCCTAAGTCCCTGATCTATGCTGCATCCAGTTTGCAAAGTGGGGTCCCATCAAAAATTCAGCGGCAGCAAATAGATCTGGGACAGCCTGAAGATTTTGTAACTTAAACAACCTGCAGCCTGAAGATTTTGTAACTTATTACTGCCAGCAGTATAGTAATTACCCTCTCACTTTTCGGCGGAGGGACCAAGGTGGAGATCAA SEQ ID NO: 27071 | CAGGTGCAGCTGGTGGAGTCTGGGGGAGGCGTGGTCCAGCCTGGGAGGTCCCTGAGACTCTCCTGTGCAGCCGTCTGGATTCACCTTCAGTAGCTATGGCATGCACTGGGTCCGCCAGGCTCCAGGCAAGGGGCTGGAGTGGGTGGCAGTTATATGGTATGATGGAAGTAATAAAAATTATGCAGACTCCGTGAAGGGCCGATTCACCATCTCCAGAGACAATTCCAAGAACACGCTGTCTCTGCAAATGAACAGCCTGAGAGCCGAGGACACGGCTGTGTATTACTGTGCGAGAGACTACGGTGTCGGGTACTACGGACGTCTGGGGCCAAGGGACCACGGTCACCGTCTCCTCA SEQ ID NO: 31077 |

FIGURE 50
(Continued)

| | | | | |
|---|---|---|---|---|
| iPS:436380 | | AA | DIQMTQSPSSLSASVGDRVTITCRASQGISNHLA WFQQKPGKAPKSLIHAASSLQSGVPSKFSGNRSG TDFTLTINNLQPEDFVTYYCQQYSNYPLTFGGGT KVEIK<br>SEQ ID NO: 27072 | QVQLVESGGGVVQPGRSLRLSCAASGFTFSSYGMH WVRQAPGKGLEWVAVIWYDGSNKNYADSVKGRF TISRDNSKNTLSLQMNSLRAEDTAVYYCARDYGVG YYGTDVWGQGTTVTVSS<br>SEQ ID NO: 31078 |
| | 21-225_212H9 | NA | GACATCGAGATGACCCAGTCTCCATCCTCACT GTCTGCATCTGTAGGAGACAGAGTCACCATCA CTTGTCGGGCGAGTCAGGGCATTAGCAGTTAT TTAGCCTGGCTTCAGCAGAAACCAGGGAAAGC CCCTAAGTCCCTGATCTATGCTGCATCCAGTT GCAAAGTGGGGTCCATCAAGGTTCAGCGGCA GTGGATCTGGGACAGATTTCACTCTCACCATC AGCAGCCTGCAGCCTGAAGATTTCGCAACTTA TTATTGCCTACGGTATGATACTTACCCTCTCAC TTTCGGCGGAGGGACCAAGGTGGAGATCAAG<br>SEQ ID NO: 27073 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATGAACACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGACCACGG TGTCGGGTACTACGGTATGGACGTCTGGGGCCAA GGGACCACGGTCACCGTCTCCTCA<br>SEQ ID NO: 31079 |
| | | AA | DIEMTQSPSSLSASVGDRVTITCRASQGISSSYLA WLQQKPGKAPKSLIYAASSLQSGVPSRFSGSGSG TDFTLTISSLQPEDFATYYCLRYDTYPLTFGGGT KVEIK<br>SEQ ID NO: 27074 | QVQLVESGGGVVQPGRSLRLSCAASGFTFSSYGMH WVRQAPGKGLEWVAVIWYDGSNEHYADSVKGRF TISRDNSKKTLYLQMNSLRAEDTAVYYCARDHGV GYYGMDVWGQGTTVTVSS<br>SEQ ID NO: 31080 |

FIGURE 50
(Continued)

| | | | |
|---|---|---|---|
| iPS-436382 | 21-225_212C10 | NA | GAAATAGTGATGACGCAGTCTCCAGCCACCCT GTCTGTCTCCAGGGGCCAGTCAGAGTCCACCTCT CCTGCAGGGCCAGTCAGAGTGTTGCCAGCAGC TTAGCCTGGTACCAGCAGAGAAGCCTGGCCAGGC TCCCAGGCTCCTCATCCATGTACATCCACCA GGGCCACTGATGTCCCAGCCAGGTTCAGTGGC TTTGGGTCTGGGTCGGACTTCACTCTCACCATC AGCAGCCTGCAGTCTGAAGATTTTGCAGTTTA TTCCTGTCAGCAGTATAATGACTGGCCGTGCA GTTTGGCCAGGGGACCAAGCTGGAGATCAAA |
| | | | SEQ ID NO: 27075 |
| | | AA | EIVMTQSPATLSVSPGERATLSCRASQSVASSLA WYQQKPGQAPRLLIHGTSTRATDVPARFSGFGS GSDFTLTISSLQSEDFAVYSCQQYNDWPCSFGQG TKLEIK |
| | | | SEQ ID NO: 27076 |
| | | NA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAATGGGTGACAGCTATACAGATTCCGTGAAGGCCGA TCATAAATACTATACAGATTCCGTGAAGGGCCGA TTCCACCATCTCCAGAGACAATTCCAAGAACACGC TGTATCTGCAAATGAACAGCCTGAGAGCCGAGG ACACGGCTGTGTATTACTGTGCGAGAGATCGGAG TATAGTGGGAGTACCTACTTTGACTACTGGGGC CAGGGAACCCTGGTCACCGTCTCCTCA |
| iPS-436384 | 21-225_212F10 | | SEQ ID NO: 31081 |
| | | AA | QVQLVESGGGVVQPGRSLRLSCAASGFTFSSYGMH WVRQAPGKGLEWVTAIWYDGSHKYYTDSVKGRF TISRDNSKNTLYLQMNSLRAEDTAVYYCARDRSIV GATYFDYWGQGTLVTVSS |
| | | | SEQ ID NO: 31082 |
| | | NA | GACATCCAGATGACCCAGTCTCCATCCTCACT GTCTGCATCTGTAGGAGACAGAGTCACCATCA CTTGTCGGGCCAGTCAGGCATTAGCAATTAT TTAGACTGGTTTCAGCAGAAACCAGGGAAAGC CCCTAAGTCCCTGATCTATTCTGCATCCAATTT GCAAAGTGGGGTCCCATCAAGGTTCAGCGGCA GTAGATCTGGGACAGATTTCACTCTCACCATC AGCAGCCTGCAGCCTGAAGATGTTGCAACTTA TTACTGCCAACACTATAGTAATTACCCGCTCA CTTTCGGCGGAGGGACCAAGGTGGAGATCAA A |
| | | | SEQ ID NO: 27077 |
| | | | CAGGTGCAGCTGCAGTGGTGGAGTCTGGGGGAGGCGTG GTCCAGCCTGGGAGGTCCCTGAGACTCTCCTGTG CAGCGTCTGGATTCACCTTCAGTAGATATGGCAT GCACTGGGTCCGCCAGGCTCCAGGCAAGGGGCT GGAGTGGGTGGCAGTTATATAGTGATGAAGT AATAAACACTATGCAGACTCCGTGAAGGGCCGA TTCACCATCTCCAGAGACAATTCCAAGAATACGT TGTATCTGCAAATGAACAGTCTGAGAGCCGAGG ACACGGCTGTGTATTACTGTGCGAGAGATCGGGG AGTGGGGTACAACGGTATGGACGTCTGGGCCA AGGGACCACGGTCACCGTCTCCTCA |
| | | | SEQ ID NO: 31083 |

FIGURE 50
(Continued)

| | | | | |
|---|---|---|---|---|
| iPS:436386 | 21-225_212B11 | AA | DIQMTQSPSSLSASVGDRVTITCRASQGISNYLD WFQQKPGKAPKSLIYSASNLQSGVPSKFSGSRSG TDFTLTISSLQPEDFATYYCQHYSNYPLTFGGGT KVEIK<br><br>SEQ ID NO: 27078 | QVQLVESGGGVVQPGRSLRLSCAASGFTFSRYGMH WVRQAPGKGLEWVAVIWYDGSNKHYADSVKGRF TISRDNSKNTLYLQMNSLRGEDTAVYYCARDRGV GYNGMDVWGQGTTVTVSS<br><br>SEQ ID NO: 31084 |
| | | NA | GACATCCAGATGACCCAGTCTCCATCTTCCCT GCCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGAATTCATTCTCACAA TCAGCAGCCTGCAGCCTGAAGATTTTGCAACT TATTACTGTCTACTGCATTATAGTTACCCTCGG ACGTTCGGCCAAGGGACCAAGGTGGAAATCA AA<br><br>SEQ ID NO: 27079 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGACAGTTATATGGTATGATGGAAGT AATAAATATTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGACTACGGTATGAGACGTCT AGCAGTGGCTGGTACGACTACGGTATGGACGTCT GGGGCCAAGGGACCACGGTCACCGTCTCCTCA<br><br>SEQ ID NO: 31085 |
| | | AA | DIQMTQSPSSLPASVGDRVTITCRASQGIRNDLG WYQQKPGKAPKRLIYAASSLQSGVPSRFSGSGS GTEFILTISSLQPEDFATYYCLLHYSYPRTFGQGT KVEIK<br><br>SEQ ID NO: 27080 | QVQLVESGGGVVQPGRSLRLSCAASGFTFSDYVM HWVRQAPGKGLEWVTVIWYDGSNKYYADSVKGR FTISRDNSKNTLYLQMNSLRAEDTAVYYCARERYS SGWYDYGMDVWGQGTTVTVSS<br><br>SEQ ID NO: 31086 |

FIGURE 50
(Continued)

| | | | |
|---|---|---|---|
| iPS:436388 | 21-225_212H11 | NA | GACATCCGGATGACCCAGTCTCCATCCTCACT<br>GTCTGCATCTGTAGGAGACAGAGTCACCATCA<br>CTTGTCGGGCGAGTCAGGCCATTGGGAAACAT<br>TTAGCCTGGTTTCAGCAGAGGCCTGGGAAAGC<br>CCCTAAGTCCCTGATCTATGCTGCATCCAGATT<br>GCAAAGTGGGGTCCCATCAAAGTTCAGCGGCA<br>GTGGATCTGGGACAGATTTCACTCTCACCATC<br>AGCAGCCTGCAGCCTGAAGATCTTGCAACTTA<br>TTACTGTCAACAACTACTATAGTAATTATCCGCTCAC<br>TTTTGTCGGAGGGACCAAGGTGGAGATCACA<br><br>SEQ ID NO: 27081 | CAGGTGCAGCTGGTGGAGTCTGGGGGAGGCGTG<br>GTCCAGCCTGGGAGGTCCCTGAGACTCTCCTGTG<br>CAGTGTCTGGAATCACCTTCAGTAGTTATGGCAT<br>GCACTGGGTCCGCCAGGCTCCAGGCAAGGGGCT<br>GGAGTGGGTGGCAGTTATATGTATGATGGAAGT<br>AATAAAAACTATGAAGACTCCGTGAAGGGCCGA<br>TTCACCATCTCCAGAGACAACTCCAAGAACACGC<br>TGTATCTGCAAATGAACAGCCTGAGAGCCGAGG<br>ACACGGCTGTGTTACGACGGTATGGACGTCTGGGGCCAA<br>GGGACCACGGTCACCGTCCTCA<br><br>SEQ ID NO: 31087 |
| | | AA | DIRMTQSPSSLSASVGDRVTITCRASQAIGKHLA<br>WFQQRPGKAPKSLIYAASRLQSGVPSKFSGSGSG<br>TDFTLTISSLQPEDLATYYCQHYSNYPLTFVGGT<br>KVEIT<br><br>SEQ ID NO: 27082 | QVQLVESGGGVVQPGRSLRLSCAVSGITFSSYGMH<br>WARQAPGKGLEWVAVIWYDGSNKNYEDSVKGRF<br>TISRDNSKNTLYLQMNSLRAEDTAVYYCARDGSYG<br>YDGMDVWGQGTTVTVSS<br><br>SEQ ID NO: 31088 |
| iPS:436390 | 21-225_213D2 | NA | GACATCCAGATGACCCAGTCTCCATCCTCACT<br>GTCTGCATCTGTAGGAGACAGAGTCACCATCA<br>CTTGTCGGGCGAGTCAGGGCATTAGCAATCAT<br>TTAGCCTGGTTTCAGCAGAAACCAGGGAAAGC<br>CCCTAAGTCCCTGATCTATGCTGCATCCAGTTT<br>GCAAAGTGGGGTCCCATCAAAATTCAGCGGCA<br>ATAGATCTGGGACAGATTTCACTCTCACCATC<br>AACAACCTGCAGCCTGAAGATTTTGTAACTTA<br>TTACTGCCACCAGTATAGTAATTACCCTCTCAC<br>TTTCGGCGGAGGGACCAAGGTGGAGATCAAA<br><br>SEQ ID NO: 27083 | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAGCTATGGCAT<br>GCACTGGGTCCGCCAGGCTCCAGGCAAGGGGCT<br>GGAGTGGGTGGCAGTTATATGTATGATGGAAGT<br>AATAAAAATTATGCAGACTCCGTGAAGGGCCGA<br>TTCACCATCTCCAGAGACAATTCCAAGAACACGC<br>TGTCTCTGCAAATGAACAGCCTGAGAGCCGAGG<br>ACACGGCTGTGTATTACTGTGCGAGAGACTACGG<br>TGTCGGGTACTACGGTACGGACGTCTGGGGCCAA<br>GGGACCACGGTCACCGTCCTCA<br><br>SEQ ID NO: 31089 |

FIGURE 50
(Continued)

| | | | | |
|---|---|---|---|---|
| | | AA | DIQMTQSPSSLSASVGDRVTITCRASQGISNHLA WFQQKPGKAPKSLIHAASSLQSGVPSKFSGNRSG TDFTLTINNLQPEDFVTYYCHQYSNYPLTFGGGT KVEIK | QVQLVESGGGVVQPGRSLRLSCAASGFTFSSYGMH WVRQAPGKGLEWVAVIWYDGSNKNYADSVKGRF TISRDNSKNTLSLQMNSLRAEDTAVYYCARDYGVG YYGTDVWGQGTTVTVSS |
| | | | SEQ ID NO: 27084 | SEQ ID NO: 31090 |
| iPS:436392 | 21-225_213B3 | NA | GACATCAGAGATGACCCAGTCTCCATCCTCACT GTCTGCATCTGTAGGAGACAGAGTCACCATCA CTTGTCGGGCGAGTCAGGGCATTGGCAAGTAT TTAGCCTGGTTTCAGCAGAAACCAGGAAAGC CCCTAAGTCCCTGATCTCTGCTGCATCCAGTGT GCTAAGTGGGGTCCCATCAAAGTTCAGCGGCA GTGGATCTGGGACAGATTTCACTCTCACCATC AGCAGCCTTCAGCTGCAAGATTTTGCCACTTA TTACTGCCAAAAGTATGATACTTACCCATTCA CTTTCGGCCCTGGGACCAAAGTGGATATCAAA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGAAGT AATAAAAACTATGCAGACTCCGTGAAGGGCCGA TTCACCATCTCCAGAGACAACTCCAAGAACACGC TGTATCTGCAAATGAACAGCCTGAGAGCCGAGG ACACGGCTGTGTATTACTGTGCGAGAGATAGGAC GGTGGGCTATGATGGTTTTGATATCTGGGGCCAA GGGACAATGGTCACCGTCTCCTCA |
| | | | SEQ ID NO: 27085 | SEQ ID NO: 31091 |
| | | AA | DIQMTQSPSSLSASVGDRVTITCRASQGIGKYLA WFQQKPGKAPKSLISAASSVLSGVPSKFSGSGSG TDFTLTISSLQPEDFATYYCQKYDTYPFTFGPGT KVDIK | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDRTVG YDGFDIWGQGTMVTVSS |
| | | | SEQ ID NO: 27086 | SEQ ID NO: 31092 |

FIGURE 50
(Continued)

| | | | |
|---|---|---|---|
| iPS:436394 | 21-225_213C4 | NA | GACATCCATATGACCCAGTCTCCATCCTCACT GTCTGCATCTGTAGGAGACAGAGTCACCATCA CTTGTCGGGCGAGTCAGGCCATTAGGAATTAT TTAGCCTGGTGTCAGCAGAAACCAGGGAAAG CCCCTAAGACCCTGATCTATGCTGCATCCAGT TTGCAAAGTGGGGTCCCATCAAAGTTCAGCGG CAGTGGATCTGGGACAGATTTCACTCTCACCA TCAGCAGCCTGCAGCCTGAAGATTTTGCAACT TATTACTGCCAACAGTATAGTAATTACCCTCTC ACTTTCGGCGGAGGGACCAAGGTGGAGATCA AA<br><br>SEQ ID NO: 27087<br><br>DIHMTQSPSSLSASVGDRVTITCRASQAIRNYLA WCQQKPGKAPKTLIYAASSLQSGVPSKFSGSGS GTDFTLTISSLQPEDFATYYCQQYSNYPLTFGG TKVEIK<br><br>SEQ ID NO: 27088 | CAGGTGCAGTTGGTGGAGTCTGGGGGAGGCGTG GTCCAGCCTGGGAGGTCCCTGAGACTCTCCTGTG CAAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAACACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGACTACGG TGTCGGGTACGACGGTATGGACGTCTGGGGCCA AGGGACCACGGTCACCGTCTCCTCA<br><br>SEQ ID NO: 31093 |
| | | AA | QVQLVESGGGVVQPGRSLRLSCATSGFTFSSYGMH WVRQAPGKGLEWVAVIWYDGSNKHYADSVKGRF TISRDNSKNTLYLQMNSLRAEDTAVYYCARDYGV GYDGMDVWGQGTTVTVSS<br><br>SEQ ID NO: 31094 | |
| iPS:436396 | 21-225_213E5 | NA | GACATCCGGATGACCCAGTCTCCATCCTCACT GTCTGCATCTGTAGGAGACAGAGTCACCATCA CTTGTCGGGCGAGTCAGGCCATTGGGAAACAT TTAGCCTGGTTTCAGCAGAGACCCAGGGAAAGC CCCTAAGTCCCTGATCTATCTGCATCCAGATT GCAAAGTGGGGTCCCATCAAAGTTCAGCGGCA GTGGATCTGGGACAGATTTCACTCTCACCATC AGCAGCCTGCAGCCTGAAGATCTTGCAACTTA TTACTGTCAACACTATAGTAATTATCCGCTCAC TTTCGGCGGAGGGACCAAGGTGGAGATCAAA<br><br>SEQ ID NO: 27089 | CAGGTGCAGCTGGTGGAGTCTGGGGGAGGCGTG GTCCAGCCTGGGAGGTCCCTGAGACTCTCCTGTG CAGTGTCTGGAATCACCTTCAGTAGTTATGGCAT GCACTGGGTCCGCCAGGCTCCAGGCAAGGGCT GGAGTGGGTGGCAGTTATATGGTATGATGGAAGT AATAAAACTATGAAGACTCCGTGAAGGGCCGA TTCACCATCTCCAGAGACAACTCCAAGAACACGC TGTATCTGCAAATGAACAGCCTGAGAGCCGAGG ACACGGCTGTGTATTACTGTGCGAGAGATGGGAG ACACGGCTGTGTATTACTGTGCGAGAGATGGGAG TATGTTACGACGGTATGGACGTCTGGGGCCAA GGGACCACGGTCACCGTCTCCTCA<br><br>SEQ ID NO: 31095 |

FIGURE 50
(Continued)

| | | | | |
|---|---|---|---|---|
| iPS:436398 | 21-225_213B8 | AA | DIRMTQSPSSLSASVGDRVTITCRASQAIGKHLA WFQQRPGKAPKSLIYAASRLQSGVPSKFSGSGSG TDFTLTISSLQPEDLATYYCQHYSNYPLTFGGGT KVEIK<br>SEQ ID NO: 27090 | QVQLVESGGGVVQPGRSLRLSCAVSGITFSSYGMH WARQAPGKGLEWVAVIWYDGSNKNYEDSVKGRF TISRDNSKNTLYLQMNSLRAEDTAVYYCARDGSYG YDGMDVWGQGTTVTVSS<br>SEQ ID NO: 31096 |
| | | NA | GACATCCAGATGACCCAGTCTCCATCCTCACT GTCTGCATCTGTAGGAGACAGAGTCACCATCA CTTGTCGGGCGAGTCAGGGCATTAGCAATCAT TTAGCCTGGTTTCAGCAGAAACCAGGGAAAGC CCCTAAGTCCCTGATCTATGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATTATTACCCTCA TTACTGCCAACAGTATAGTAATTACCCTCTCA CTTTCGGCGGAGGGACCAAGGTGGAGATCAA A<br>SEQ ID NO: 27091 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAACACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGACTACGG TGTCGGGTACTACGGTACGGACGTCTGGGGCCAA GGGACCACGGTCACCGTCTCCTCA<br>SEQ ID NO: 31097 |
| | | AA | DIQMTQSPSSLSASVGDRVTITCRASQGISNHLA WFQQKPGKAPKSLIYAASSLQSGVPSKFSGSGSG TDFTLTISSLQPEDFATYYCQQYSNYPLTFGGGT KVEIK<br>SEQ ID NO: 27092 | QVQLVESGGGVVQPGRSLRLSCAASGFTFSSYGMH WVRQAPGKGLEWVAVIWYDGSNKHYADSVKGRF TISRDNSKNTLYLQMNSLRAEDTAVYYCARDYGV GYYGTDVWGQGTTVTVSS<br>SEQ ID NO: 31098 |

FIGURE 50
(Continued)

| | | | |
|---|---|---|---|
| iPS:436400 | 21-225_213H7 | NA | GACATCGTGATGACCCAGTCTCCAGACTCCCT GGCTGTGTCTCTGGGCGAGAGGGCCACCATCA ACTGCAAGTCCAGCCAGAATGTTTTAGACATC TCCAACAATAAGAATTCCTTAGGTTGGTTCCA GCAGAAACCAGGTCAGCTCCCAAGCTGCTCA TTAACTGGGCATCTACCCGGGAATCCGGGGTC CCTGACCGCTTCAGTGGCAGCGGGTCTGGGAC AGATTTCACTCTCACCATCAGCAGCCTGCAGA CTGAAGATGTGGCAGTTTATCACTGTCAGCAA TATTATAACATTCCTCGACGTTCGGCCGAGG GACCAAGGTGGAAATCAAA<br><br>SEQ ID NO: 27093 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACCATA TGCACTGGGTGCGACAGGCCCCTGGACAAGGGC TTGAGTGGATGGGATGGATCAATCCTAAGAGTGA TGGCACAAACTATGCACAGAAGTTTCAGGGCAG GGTCACCATGACCAGGGACACGTCCATCAGCAC AGCCTACATGGAGCTGAGCAGGCTGAGATCTGA CGACACGGCCGTGTATTACTGTGCGAGAGAAAA GCCTGGGAGCTACTACAAATACTGGGGCCAGGG AACCCTGGTCACCGTCTCCTCA<br><br>SEQ ID NO: 31099 |
| | | AA | DIVMTQSPDSLAVSLGERATINCKSSQNVLDISN NKNSLGWFQQKPGQPPKLLINWASTRESGVPDR FSGSGSGTDFTLTISSLQTEDVAVYHCQQYYNIP PTFGRGTKVEIK<br><br>SEQ ID NO: 27094 | QVQLVQSGAEVKKPGASVKVSCKASGYTFTGYHM HWVRQAPGQGLEWMGWINPKSDGTNYAQKFQGR VTMTRDTSISTAYMELSRLRSDDTAVYYCAREKPG SYYKYWGQGTLVTVSS<br><br>SEQ ID NO: 31100 |
| iPS:436402 | 21-225_213H12 | NA | GACATCGTGATGACCCAGTCTCCAGACTCCCT GGCTGTGTCTCTGGGCGAGAGGGCCACCATCA CCTGCAAGTCCAGCCAGAATGTTTTAAAGACC TCCAACAATAGGAACTACTTAGCTTGGTACCA GCAGAAACCAGGACAGCCTCCTAAGGTGCTCA TTTACTGGGCATCTACCCGGGAATCCGGGGTC CCTGACCGATTCAGTGGCAGCGGGTCTGGGAC AGATTTCACTCTCATCATCAGCAGCCTGCAGG CTGAAGATGTGGCAGTTTATTACTGTCACCAA TATTATAGTATTCCGTGGACCTTCGGCCAAGG GACCAAGGTGGAAATCAAG<br><br>SEQ ID NO: 27095 | CAGGTTCAGCTGGTGCAGTCTGGAGCTGAGGTGA AGAAGCCTGGGGCCTCAGTGAAGGTCTCCTGCA AGGCTTCTGGTTTCACCTTTACCAGTATGTGTATC AACTGGGTGCGACAGCCCCTGGACAAGGGCTT GAGTGGATGGGATGGATCAGCGTTCACAATGGT AACACAGACTATGCACACAGAAGTTCCAGGGCAGA GTCACCATGACCACAGACACATCCACGAGCACA GCCTACATGGAACTGAGGAGCCTGAGATCTGAC GACACGGCCGTGTATTACTGTGCGAGAGACTACT ACTACGGTATGGACGTCTGGGGCCAAGGGACCA AGGTCACCGTCTCCTCA<br><br>SEQ ID NO: 31101 |

FIGURE 50
(Continued)

| | | | | |
|---|---|---|---|---|
| iPS:436404 | 21-225_214C3 | AA | DIVMTQSPDSLAVSLGERATITCKSSQNVLKTSN NRNYLAWYQQKPGQPPKVLIYWASTRESGVPD RFSGSGSGTDFTLTISSLQAEDVAVYYCHQYYSIP WTFGQGTKVEIK<br>SEQ ID NO: 27096 | QVQLVQSGAEVKKPGASVKVSCKASGFTFTSYGIN WVRQAPGQGLEWMGWISVHNGNTDYAQKFQGRV TMTDTSTSTAYMELRSLRSDDTAVYYCARDYYY GMDVWGQGTKVTVSS<br>SEQ ID NO: 31102 |
| | | NA | GACATCCAGATGACCCAGTCTCCATCCTCACT GTCTGCATCTGTTGGAGACAGAGTCACCATCA CTTGTCGGGCGAGTCAGGGTCATTGGCAATTAT TTAGCCTGGTTTCAGCAGAAACCAGGTAAAGT CCCTAAGTCCCTGATCTATGCTGCATCCAGTTT GCAAAGTGGGGTCCCATCAAGTTCAGCGGCA GTGGATCTGGGACAGATTTCACTCTCACCATC AGCAGCCTGCAGCCTGAAGATTTTACAACTTA TTACTGCCAACAATATGACTTACCCAATCA CTTTCGGCCCTGGGACCAAAGTGGATATCAAA<br>SEQ ID NO: 27097 | CAGGTGCAGCTGGTGGAGTCTGGGGGAGGCGTG GTCCAGCCTGGGAGGTCCCTGAGACTCTCCTGTG AAGCGTCTGATTCACCTTCAGTAGTCTATGCAT GCACTGGGTCCGCCAGGCTCCAGGCAAGGGGCT GGAGTGGGTGGCAGTTATATGGTATGATGGAAGT AATAAAAACTATGGAGACTCCGTGAAGGGCGA TTCACCATCTCCAGAGACAATTCCAAGAATACGC TGTATCTGCAAATGAACAGCCTGAGAGCCGAGG ACACGGCTGTGTATTACTGTGCGAGAGATCGGGG AGTGGGTACGACGGAATGGACGTCTGGGGCCA AGGGACCACGGTCACCGTCTCCTCA<br>SEQ ID NO: 31103 |
| | | AA | DIQMTQSPSSLSASVGDRVTITCRASQGIGNYLA WFQQKPGKVPKSLIYAASSLQSGVPSKFSGSGSG TDFTLTISSLQPEDFTTYYCQQYMTYPITFGPGTK VDIK<br>SEQ ID NO: 27098 | QVQLVESGGGVVQPGRSLRLSCEASGFTPSSYGMH WVRQAPGKGLEWVAVIWYDGSNKNYGDSVKGRF TISRDNSKNTLYLQMNSLRAEDTAVYYCARDRGV GYDGMDVWGQGTTVTVSS<br>SEQ ID NO: 31104 |

FIGURE 50
(Continued)

| | | | |
|---|---|---|---|
| iPS:436406 | 21-225_214E4 | NA | GACATCCAGATGACCCAGTCTCCATCCTCACTGTCTGCATCTGTAGGAGACAGAGTCACCATCACTTGTCGGGCGAGTCAGGGCATTAGCAATTATTTAGCCTGGTTTCAGCAGAAACCAGGGAAAGCCCCTAAGTCCCTGATCTATGCTGCATCCAGTTTGCAAAGTGGGGTCCCATCAAGGTTCAGCGGCAGTGGATCTGGGACAGATTTCACTCTCACCATCAGCAGCCTGCAGCCTGAAGATTTTGCAACTTATTACTGCCAACAGTATCTTACTTACCATTCACTTTCGGCCCTGGGACCAAAGTGGATATCAAA |
| | | | SEQ ID NO: 27099 |
| | | AA | DIQMTQSPSSLSASVGDRVTITCRASQGISNYLAWFQQKPGKAPKSLIYAASSLQSGVPSKFSGSGSGTDFTLTISSLQPEDFAITYCQQYLTYPFTFGPGTKVDIK |
| | | | SEQ ID NO: 27100 |
| | | | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGGTATGATGGAAGTAATGAAAACTATGCAGACTCCGTGAAGGGCCGAATCACCATCTCAGAGACAATTCCAAGAACACGCTGTATCTGCAAATGAACAGCCTGAGAGCCGAGGACACGGCTGTGTATTACTGTGCGAGAGATAGGACGGTGGGCTATGATGGTTGTGATATCTGGGGCCAAGGGGCAATGGTCACCGTCTCTTCA |
| | | | SEQ ID NO: 31105 |
| | | | QVQLVESGGGVVQPGRSLRLSCAASGFTFSSYGMHWVRQAPGKGLEWVAVIWYDGSNENYADSVKGRITISRDNSKNTLYLQMNSLRAEDTAVYYCARDRTVGYDGCDIWGQGAMVTVSS |
| | | | SEQ ID NO: 31106 |
| iPS:436408 | 21-225_214H8 | NA | GAAATTGTGCTGACTCAGTCTCCAGACTTTCAGTCTGTGACTCCAAAGGAGAAAGTCACCATCACCTGCCGGGCCAGTCAGAGCATTGGTTAGCTTACACTGTACCAGCAGAAACCAGATCAGTCTCCACAACTCCTCATCAAGTATGCTTCCCAGTCCTTCTCAGGGGTCCCCTCGAGGTTCAGTGGCAGTGGGATCTGGGACAGATTTCACCCTCACCATCAATAGCCTGGAAGCTGAAGATGCTGAAGATGCTGCAACGTATTACTGTCATCAGAGTCGTAGTTTACCATTCACTTTCGGCCCTGGGTCCAAATGGATATCAAA |
| | | | SEQ ID NO: 27101 |
| | | | CAGGTCCAGCTGGTGCAGTCTGGGGCTGAGGTGAAGAAGCCTGGGGCCTCAGTGAAGGTCTCCTGCAAGGCTTCTGGATACACCTTCACCGGCCACTATATACACTGGGTGCGACAGGCCCCTGGACAAGGCCTTGAGTGGATGGAATGGATCAACTCTAACAGTGGTGGCACAAACTATGCACAGAAGTTTCAGGGCAGGGTCACCATGACCAGGGACACGTCCATCAGCACAGCCTACATGGAGCTGAGCAGGCTGAGATCTGAAGATACAGCCGTATATTACTGTGCGAAAGACGGGAGATACAGCTATGGTTACGACTGGTTCGACCCCTGGGGCCAGGGAACCCTGGTCACCGTCTCCCTCA |
| | | | SEQ ID NO: 31107 |

FIGURE 50
(Continued)

| | | | |
|---|---|---|---|
| iPS:436410 | 21-225_212E10 | AA | EIVLTQSPDFQSVTPKEKVTITCRASQSIGVSLHW YQQKPDQSPQLLIKYASQSFSGVPSRFSGSGSGT DFTLTINSLEAEDAATYYCHQSRSLPFTFGPGSK VDIK<br>SEQ ID NO: 27102 | QVQLVQSGAEVKKPGASVKVSCKASGYTFTGHYIH WVRQAPGQGLEWMGWINSNSGGTNYAQKFQGRV TMTRDTSISTAYMELSRLRSDDTAVYYCAKDGRYS YGYDWFDPWGQGTLVTVSS<br>SEQ ID NO: 31108 |
| | | NA | GACATCCAGATGACCCAGTCTCCATCCTCACT GTCTGCATCTGTAGGAGACAGAGTCACCATCA CTTGTCGGGCGAGTCAGGGCATTAGCAATCAT TTAGCCTGGTTTCAGCAGAAACCAGGGAAAGC CCCTAAGTCCCTGATCTATGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATAGTAATTACCCTCTCA CTTTCGGCGGAGGGACCAAGGTGGAGATCAA A<br>SEQ ID NO: 27103 | CAGGTGCAGTTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTCTCTGCAAATGAACAGCCTGAGAGCCGAGG ACACGGCTGTGTATTACTGTGCGAGAGACTACGG TGTCGGGTACTACGGTACGGACGTCTGGGGCCAA GGGACCACGGTCACCGTCTCCTCA<br>SEQ ID NO: 31109 |
| | | AA | DIQMTQSPSSLSASVGDRVTITCRASQGISNHLA WFQQKPGKAPKSLIYAASSLQSGVPSKFSGSGSG TDFTLTISSLQPEDFATYYCQQYSNYPLTFGGGT KVEIK<br>SEQ ID NO: 27104 | QVQLVESGGGVVQPGRSLRLSCAASGFTFSSYGMH WVRQAPGKGLEWVAVIWYDGSNKYYADSVKGRF TISRDNSKNTLSLQMNSLRAEDTAVYYCARDYGVG YYGTDVWGQGTTVTVSS<br>SEQ ID NO: 31110 |

FIGURE 50
(Continued)

| | | | |
|---|---|---|---|
| iPS:436412 | 21-225_214H9 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAATCA AA<br><br>SEQ ID NO: 27105<br><br>DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEIK<br><br>SEQ ID NO: 27106 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATTTACTGTGCGAGAGAGTA TACCAGCAGCTGGTACGACTACGGTATGGACGTC TGGGGCCAAGGGACCACGGTCACCGTCTCCTCA<br><br>SEQ ID NO: 31111<br><br>QVQLVESGGGVVQPGRSLRLSCAASGFTFSSYVMH WVRQAPGKGLEWVAVIWYDGSNKYYADSVKGRF TISRDNSKNTLYLQMNSLRAEDTAVFYCARERYTS SWYDYGMDVWGQGTTVTVSS<br><br>SEQ ID NO: 31112 |
| iPS:436414 | 21-225_214G10 | NA | GACATCCAGATGACCCTGTCTCCATCTTCCCC GCCTGCATCTGTTGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGCTTCATTCTCACAA TCAGCAGCCTGCAGCCTGAAGATTTTGCAACT TATTACTGTCTACTGCATAATAGTTACCCTCGG ACGTTCGGCCAAGGGACCAAGGTGGAAATCA AA<br><br>SEQ ID NO: 27107 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGACAGTTATATGGTATGATGGAAGT AATAAATATTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTTATTACTGTGCGAGAGAACGTTAT AGCAGTGGCTGGTACGACTACGGTATGGACGTCT GGGGCCAAGGGACCACGGTCACCGTCTCCTCA<br><br>SEQ ID NO: 31113 |

FIGURE 50
(Continued)

| | | | | |
|---|---|---|---|---|
| iPS:436416 | 21-225_214G12 | AA | DIQMTLCPSSPPASVGDRVTITCRASQGIRNDLG WYQQKPGKAPKRLIYAASSLQSGVPSRFSGSGS GTEFILTISSLQPEDFATYYCLLHNSYPRTFGQGT KVEIK<br>SEQ ID NO: 27108 | QVQLVESGGGVVQPGRSLRLSCAASGFTFSDYVM HWVRQAPGKGLEWVTVIWYDGSNKYYADSVKGR FTISRDNSKNTLYLQMNSLRAEDTAVYYCARERYS SGWYDYGMDVWGQGTTVTVSS<br>SEQ ID NO: 31114 |
| | | NA | GACATCCAGATGACCCAGTCTCCATCTCCCC GCCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTTATCTATGCTGCATCCAGTT TGCAAAGTGGGGTCCCATCAAGGTTCAGCGGC AGTGGATCTGGGACAGAATTCATTCTCACAAT CAGCAGCCTGCAGCCTGAAGATTTTGCAACTT ATTACTGTGTAATGCATTAGTACCTCGG ACGTTCGGCCAAGGGACCAAGGTGGAAATCA AA<br>SEQ ID NO: 27109 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGACAGTTATATGGTATGATGGAAGT AATAAATATTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACGTTAT AGCAGTGGCTGGTACGACTACGGTATGGACGTCT GGGGCCAAGGGACCACGGTCACCGTCTCCTCA<br>SEQ ID NO: 31115 |
| | | AA | DIQMTQSPSSPPASVGDRVTITCRASQGIRNDLG WYQQKPGKAPKRLIYAASSLQSGVPSRFSGSGS GTEFILTISSLQPEDFATYYCVMHYSPRTFGQG TKVEIK<br>SEQ ID NO: 27110 | QVQLVESGGGVVQPGRSLRLSCAASGFTFSDYVM HWVRQAPGKGLEWVTVIWYDGSNKYYADSVKGR FTISRDNSKNTLYLQMNSLRAEDTAVYYCARERYS SGWYDYGMDVWGQGTTVTVSS<br>SEQ ID NO: 31116 |

FIGURE 50
(Continued)

| | | | |
|---|---|---|---|
| iPS:436418 | 21-225_215E3 | NA | GACATCCAGATGACCCAGTCTCCATCTCCC<br>GCCTGCATCTGTAGGAGACAGAGTCACCATCA<br>CTTGCCGGGCAAGTCAGGCATTAGAAATGAT<br>TTAGGCTGGTATCAGCAGAAACCAGGGAAAG<br>CCCCTAAGCGCCTATCTATGCTGCATCCAGTT<br>TGCAAAGTGGGGTCCATCAAGGTTCAGCGGC<br>AGTGGATCTGGGACAGAATTCACTCTCACAAT<br>CAGCAGCCTGCAGCCTGAAGATTTTGCAACTT<br>ATTACTGTGTAATGCATAATAGTTACCCTCGG<br>ACGTTCGGCCAAGGGACCAAGGTGGAAATCA<br>AA<br><br>SEQ ID NO: 27111 | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTGACTATGTCAT<br>ACACTGGGTCCGCCAGGCTCCAGGCAAGGGCT<br>GGAGTGGGTGACAGTTATATGTATGATGGAAGT<br>AATAAATATTACAGACTCCGTGAAGGGCCGAT<br>TCACCATCTCCAGAGACAATTCCAAGAACACGCT<br>GTATCTGCAAATGAACAGTGTGAGAGCCGAGGA<br>CACGGCTGTGTATTACTGTGCGAGAGAACGTTAT<br>AGCAGTGGCTGGTACGACTACGGTATGGACGTCT<br>GGGGCCAAGGGACCACGGTCACCGTCTCCTCA<br><br>SEQ ID NO: 31117 |
| | | AA | DIQMTQSPSSPPASVGDRVTITCRASQGIRNDLG<br>WYQQKPGKAPKRLIYAASSLQSGVPSRFSGSGS<br>GTEFTLTISSLQPEDFATYYCVMHNSYPRTFGQG<br>TKVEIK<br><br>SEQ ID NO: 27112 | QVQLVESGGGVVQPGRSLRLSCAASGFTFSDYVH<br>WVRQAPGKGLEWVTVIWYDGSNKYYADSVKGRF<br>TISRDNSKNTLYLQMNSVRAEDTAVYYCARERYSS<br>GWYDYGMDVWGQGTTVTVSS<br><br>SEQ ID NO: 31118 |
| iPS:436420 | 21-225_215B5 | NA | GACATCCAGATGACCCAGTCTCCATCCTCACT<br>GTCTGCATCTGTAGGAGACAGAGTCACCATCA<br>CTTGTCGGGCGAGTCAGGGACATTAGCAATCAT<br>TTAGCCTGGTTTCAGCAGAAACCAGGGAAAGC<br>CCCTAAGTCCCTGATCCATGCTGCATCCAGTTT<br>GCAAAGTGGGGTCCCATCAAAATTCAGCGGCA<br>ATAGATCTGGGACAGATTTCACTCTCACCATC<br>AACAACCTGCAGCCTGAAGATTTTGTAACTTA<br>TTACTGCCAGCAGTATTATTAATTACCCTCTCAC<br>TTTCGGCGGAGGGACCAAGGTGGAGATCAAA<br><br>SEQ ID NO: 27113 | CAGGTGCAGCTGCAGTGGAGTCTGGGGGAGGCGTG<br>GTCCAGCCTGGGAGGTCCCTGAGACTCTCGTG<br>CAGCGTCTGGATTCACCTTCAGTAGCTATGGCAT<br>GCACTGGGTCCGCCAGGCTCCAGGCAAGGGCT<br>GGAGTGGGTGGCAGTTATATGTATGATGGAAGT<br>AATAAAAATTATGCAGACTCCGTGAAGGGCCGA<br>TTCACCATCTCCAGAGACAATTCCAAGAACACGC<br>TGTCTCTGCAAATGAACAGCCTGAGAGCCGAGG<br>ACACGGCTGTGTATTACTGTGCGAGAGATACGG<br>TGTGGGTACTACGGTACGGACGTCTGGGGCCAA<br>GGGACCACGGTCACCGTCCTCA<br><br>SEQ ID NO: 31119 |

FIGURE 50
(Continued)

| | | AA | DIQMTQSPSSLSASVGDRVTITCRASQGISNHLA WFQQKPGKAPKSLIHAASSLQSGVPSKFSGNRSG TDFTLTINNLQPEDFVTYCQQYINYPLTFGGGT KVEIK<br>SEQ ID NO: 27114 | QVQLVESGGGVVQPGRSLRLSCAASGFTFSSYGMH WVRQAPGKGLEWVAVIWYDGSNKNYADSVKGRF TISRDNSKNTLSLQMNSLRAEDTAVYYCARDYGVG YYGTDVWGQGTTVTVSS<br>SEQ ID NO: 31120 |
|---|---|---|---|---|
| iPS:436422 | 21-225_215D6 | NA | GACATCCAGATGACCCAGTCTCCATCCTCACT GTCTGCATCTGTAGGAGACAGAGTCACCATCA CTTGTCGGGCGAGTCAGGGCATTAGCAATCAT TTAGCCTGGTTTCAGCAGAAACCAGGGAAAGC CCCTAAGTCCCGATCTATGTCGATCCAGTTT GCATAGTGGGGTCCCATCAAAGTTCAGCGGCA GTAGATCTGGGACAGATTTCACTCTCACCATC AGCAGCCTGCAGCTGAAGATTTTGCAACTTA TTACTGCCAACAGTATGTTACTTACCCTCTCAC TTTCGGCGGAGGGACCAAGGTGGAGATCAAA<br>SEQ ID NO: 27115 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAAAACTATGCAGATTCCGTGAAGGGCCGA TTCACCATCTCCAGAGACAATTCCAAGAACACAC TGTATCTGCAAATGAACAGCCTGAGAGACTGCGG ACACGGCTGTGTATTACTGTGCGAGAGACTGCGG TGTCGGATACTACGGTACGGACGTCTGGGGCCAA GGGACCACGGTCACCGTCTCCTCA<br>SEQ ID NO: 31121 |
| | | AA | DIQMTQSPSSLSASVGDRVTITCRASQGISNHLA WFQQKPGKAPKSLIYAASSLHSGVPSKFSGSRSG TDFTLTISSLQPEDFATYYCQQYVTYPLTFGGGT KVEIK<br>SEQ ID NO: 27116 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDCGV GYYGTDVWGQGTTVTVSS<br>SEQ ID NO: 31122 |

FIGURE 50
(Continued)

| | | | |
|---|---|---|---|
| iPS:436424 | 21-225_215H6 | NA | GAAATTGTGCTGACTCAGTCTCCAGACTTTCA GTCTGTGACTCCAAAGGAGAAAGTCACCATCA CCTGCCGGGCCAGTCAGAGTCATCGGTGTTAGC TTACACTGGTACCAGCAGAAACCAGATCAGTC TCCACAGGTCCTCATCAAGTATGCTTCCCAGTC CCCTCTCAGGGGTCCCCTCGAGGTTCAGTGGCA GTGGATCTGGGACAGATTTCACCCTCACCATC AATAGCCTGGAAGCTGAAGATGCTGCAACGTA TTACTGTCATCAGAGTCGCAGTTTACCATTCAC TTTCGGCCCTGGGTCCAAAGTGGATATCAAA<br><br>SEQ ID NO: 27117<br><br>EIVLTQSPDFQSVTPKEKVTITCRASQSIGVSLHW YQQKPDQSPQLLIKYASQSLSGVPSRFSGSGSGT DFTLTINSLEAEDAATYYCHQSRSLPFTFGPGSK VDIK<br><br>SEQ ID NO: 27118 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCCACTATA TACACTGGGTGCGACAGGCCCCTGGACAAGGGC TTGAGTGGATGGGATGGATCAACTCTAACAGTGG TGGCACAAATTATGCAGAGAAGTTTCAGGGCAG GGTCACCATGACCAGGGACACGTCATCAGCAC AGCCTACATGGAGCTGAGCAGGCTGAGATCTGA CGAACGGCCGTGTATTACTGTGCGAAAGACGG GAGATACAGCTATGGTCACGACTGGTTCGACCCC TGGGGCCAGGGAACCCTGGTCACCGTCTCCTCA<br><br>SEQ ID NO: 31123<br><br>QVQLVQSGAEVKKPGASVKVSCKASGYTFTGHYIH WVRQAPGQGLEWMGWINSNSGTNYAEKFQGRV TMTRDTSISTAYMELSRLRSDDTAVYYCAKDGRYS YGHDWFDPWGQGTLVTVSS<br><br>SEQ ID NO: 31124 |
| iPS:436426 | 21-225_215C7 | NA | GAAATTGTGTTGACGCAGTCTCCAGGCACCCT GTCTTTGTCTCCAGGGGAAAGAGTCACCCTCT CCTGCAGGGCCAGTCAGAGTCAGAGGATTACCAACAAC TTCTTAGCTTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGTCTGAAGATTTTGCAG TTTATTACTGTCAGCAGTATGTTAGTTCATTGC TCACTTTCGGCGGAGGGACCAAGGTGGAGATC AAA<br><br>SEQ ID NO: 27119 | CAGGTGCAGCTGGTGGAGTCTGGGGGAGGCGTG GTCCAGCCTGGGAGGTCCCTGAGACTCTCCTGTG CAGCGTCTGGATTCACCTTCAGTTACTATGGCAT GCACTGGGTCCGCCAGGCTCCAGGCAAGGGCT GGAGTGGGTGGCAGTTATATGCATGATGAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGGTTAGACT ACAGTAATTACGGGTGGTTCGACCCCTGGGGCCA GGGAACCCTGGTCACCGTCTCCTCA<br><br>SEQ ID NO: 31125 |

FIGURE 50
(Continued)

| | | | | |
|---|---|---|---|---|
| iPS:436428 | 21-225_215E11 | AA | EIVLTQSPGTLSLSPGERVTLSCRASQRITTNFLA WYQQKPGQAPRLLIYGASSRATGIPDRFSGSGSG TDFTLTISRLESEDFAVYYCQQYVSSLLTFGGGT KVEIK<br>SEQ ID NO: 27120 | QVQLVESGGGVVQPGRSLRLSCAASGFTFSYYGM HWVRQAPGKGLEWVAVIWHDGSNKYYADSVKGR FTISRDNSKNTLYLQMNSLRAEDTAVYYCARLDYS NYGWFDPWGQGTLVTVSS<br>SEQ ID NO: 31126 |
| | | NA | GACATCCAGATGACCCAGTGTCCATCTTCCCC GCCTGCATCTGTAGGAGACAGAGTCACCATCA CTTGCCGGGCAAGTCAGGCATTAGAAATGAT TTAGGCTGGTATCAGCAGAAACCAGGAAAG CCCCTAAGCGCCTTATCTATGCTGCATCCAGTT TGCAAAGTGGGGTCCCATCAAGGTTCAGCGGC AGTGGATCTGGGACAGATTCATTCTCACAAT CAGCAGCGTGCAGCGTGAAGATTTTGCAACTT ATTACTGTGTAATGCATTATAGTTACCCTCGG ACGTTCGGCCAAGGGACCAAGGTGGAAATCA AA<br>SEQ ID NO: 27121 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGGCAAGGGCT GGAGTGGGTGACAGTTATATGGTATGATGGAAGT AATAAATATTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACGTTAT AGCAGTGGCTGGTACGACTACGGTATGGACGTCT GGGGCCAAGGGACCACGGTCACCGTCTCCTCA<br>SEQ ID NO: 31127 |
| | | AA | DIQMTQCPSSPPASVGDRVTITCRASQGIRNDLG WYQQKPGKAPKRLIYAASSLQSGVPSRFSGSGS GTEFILTISSVQREDFATYYCVMHYSYPRTFGQG TKVEIK<br>SEQ ID NO: 27122 | QVQLVESGGGVVQPGRSLRLSCAASGFTFSDYVM HWVRQAPGKGLEWVTVIWYDGSNKYYADSVKGR FTISRDNSKNTLYLQMNSLRAEDTAVYYCARERYS SGWYDYGMDVWGQGTTVTVSS<br>SEQ ID NO: 31128 |

FIGURE 50
(Continued)

| | | | |
|---|---|---|---|
| iPS:436430 | 21-225_215A12 | NA | GACATCCAGATGACCCAGTCTCCATCCTCACT GTCTGCATCTGTAGGAGACAGAGTCACCATCA CTTGTCGGACAGTCAGGACATTGGCAATTAT TTAGCCTGGTTTCAGCAGAAACCAGGGAAAGC CCCTAAGTCCCTGATCTATGCTGCATCCAGTTT ACAGAGTGGGGTCCCATCAAAGTTCAGCGGCA GTAGATCTGGGACAGATTTCACTCTCACCATC AGCAGCCTGCAGTCTGAAGATTTTGCAACTTA TTACTGCCAACAGTATGTTACTTACCCGCTCAC TTTCGGCGGAGGGACCAAGGTGGAGATCAAA | CAGGTGCAACTGGTGGAGTCTGGGGGAGGCGTG GTCCAGCCTGGGAGGTCCCTGAGACTCTCCTGTG CAGCGTCTGGACTCACCTTCAGTAGCTATGGCAT GCACTGGGTCCGCCAGGCTCCAGGCAAGGGGCT GGAGTGGGTGGCAGTTATATGGTATGATGGAAGT AATGAAACACTATGCAGACTCCGTGAAGGGCCGA TTCACCATCTCCAGAGACAATTCCAAGAACACGC TGTATCTGCAAATGAACAGCTGAGAGCCGAGG ACACGGCTGTATTACTGTGCGAGAGATCGGGG AGTGGGTACTACGGTATGGACGTCTGGGGCCA AGGGACCACGGTCACCGTCTCCTCA |
| | | | SEQ ID NO: 27123 | SEQ ID NO: 31129 |
| | | AA | DIQMTQSPSSLSASVGDRITITCRTSQDIGNYLAW FQQKPGKAPKSLIYAASSLQSGVPSKFSGSRSGT DFTLTISSLQSEDFATYYCQQYVTYPLTFGGGTK VEIK | QVQLVESGGGVVQPGRSLRLSCAASGLTFSSYGMH WVRQAPGKGLEWVAVIWYDGSNEHYADSVKGRF TISRDNSKNTLYLQMNSLRAEDTAVYYCARDRGV GYYGMDVWGQGTTVTVSS |
| | | | SEQ ID NO: 27124 | SEQ ID NO: 31130 |
| iPS:436432 | 21-225_215H12 | NA | GAAATTGTGTTGACGCAGTCTCCAGGCACCCT GTCTTTGTCTCCAGGGGAAAGAGCCACCCTCT CCTGCAGGGCCAGTCAGAGTGTTAGCAGCAGC TTCTTAGCTTGGTACCAGCAGAAACCTGGCCA GGCTCCCAGGCTCCTCATGTATGGTGCATCCA GCAGGGCCATTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGTTAGCTCACCG CTCACTTTCGGCGGAGGGACCAAGGTGGAGAT CAAA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATATGGTACATGATGAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGGTTAGACT ACAGTAACTACGGGTGGTTCGACCCCTGGGGCCA GGGAACCCTGGTCACCGTCTCCTCA |
| | | | SEQ ID NO: 27125 | SEQ ID NO: 31131 |

FIGURE 50
(Continued)

| | | | |
|---|---|---|---|
| iPS:436434 | 21-225_216B10 | AA | EIVLTQSPGTLSLSPGERATLSCRASQSVSSSFLAWYQQKPGQAPRLLMYGASSRAIGIPDRFSGSGSGTDFTLTISRLEEPEDFAVYYCQQYVSSPLTFGGGTKVEIK<br>SEQ ID NO: 27126 | QVQLVESGGGVVQPGRSLRLSCAASGFTFSNYGMHWVRQAPGKGLEWVAVIWHDGSNKYYADSVKGRFTISRDNSKNTLYLQMNSLRAEDTAVYYCARLDYSNYGWFDPWGQGTLVTVSS<br>SEQ ID NO: 31132 |
| | | NA | GAAATAGTGATGACGGAGTCTCCAGCCACCCTGTCTGTGTCTCCAGGGGAAAGAGCCACCCTCTCCTGCAGGGCCAGTCAGAGTGTTAACAACAACCAGGGTCTGGTACCGGCAGAAACCTGGCCAGGCTTAGCCTGGTATCTCATCTATGGTGCATCCACCATCCCAGGCTCCTCATCTATGGTGCATCCACCAGGGCCACTGGTATCCCACCAGGTTCAGTGGCAGTGGGTCTGGGACAGAGTTCACTCTCTCCATCAGCAGCCTGCAGTCTGAAGATATAATGACTGGCCGTGCATTACTGTCAGCAGTATATAATGACTGGCCGTGCAGTTTTGGCCAGGGACCAAACTGGAGATCAGA<br>SEQ ID NO: 27127 | CAGGTGCAGCTGGTGGAGTCGGGGGGAGGCGTGGTCCAGCCTGGGAGGTCCCTGAGACTCTCCTGTGCAGGGTCTGGATTCACCTTCAGTAGCTATGGCATGCACTGGGTCCGCCAGGCTCCAGGCAAGGGGCTGGAGTGGGTGGCAGCTATATGGTATGATGGAAGTAATAAATACTACTCCAGAGACAATTCCAAGCACGCTGTATCTGCAGATGAACAGCCTGAGAGCCGAGGACACGGCTGTGTATTACTGTGCGAGAGATCCCAACATAGTGGAGCTACTTGGTTTGACTACTGGGGCCAGGGAACCCTGGTCACCGTCTCCTCA<br>SEQ ID NO: 31133 |
| | | AA | EIVMTESPATLSVSPGERATLSCRASQSVNNNLAWYRQKPGQAPRLLIYGASTRATGIPPRFSGSGSGTEFTLSISSLQSEDFAVYYCQQYNDWPCSFGQGTKLEIR<br>SEQ ID NO: 27128 | QVQLVESGGGVVQPGRSLRLSCAASGFTFSSYGMHWVRQAPGKGLEWVAAIWYDGSNKYYADSVKGRFTISRDNSKRTLYLQMNSLRAEDTAVYYCARDPNIVGATWFDYWGQGTLVTVSS<br>SEQ ID NO: 31134 |

FIGURE 50
(Continued)

| | | | |
|---|---|---|---|
| iPS:436436 | 21-225_216F10 | NA | GAAGTTGTGTTGACGCAGTCTCCAGGCACCCT GTCTTTGTCTCCAGGGGAAAGAGCCACCCTCT CCTGCAGGGCCAGTCAGTCAGAGTGTTAGCAGCAGC TTCTTAGCCTGGTACCAGCAGAAACCTGGCCA GGCTCCCAGGCTCCTCATCTATGGTACATCCA CCAGGGCCACTGGCATCCCTGACAGGTTCAGT GGCAGTGGGTCTGGGACAGACTTCATTCTCAC CATCAGCAGACTGGAGCCTGAAGATTTTGCAG TATATTACTGTCAACAGTATGATAGGTACCA TTCACTTTCGGCCCTGGGACCAAAGTGGATAT CAAA SEQ ID NO: 27129 | GAGGTACAGCTGGTGGAGTCTGGGGGAGGCTTG GTACAGCCTGGGGGGTCCCTGAGACTCTCCTGTG CAGCCTCTGGATTCTCCTTCAGAAGCTATAGCAT GAACTGGGTCCGCCAGGCTCCAGGGAAGGGCT GGAGTGGGTTTCATACATTACTGGTAGTAGTAGT ACCATATACTACGCAGACTCTGTGAAGGGCCGAT TCACCATCTCCAGAGACAATGCCAAGAACTCACT GTATCTGCAAATGAACAGCCTGAGAGACGAGGA CACGGCTGTGTATTACTGTGCAGATCGGGTTTA GCAGTGGAGGACTACTGGGGCCAGGGAACCCTG GTCACCGTCTCCTCA SEQ ID NO: 31135 |
| | | AA | EVVLTQSPGTLSLSPGERATLSCRASQSVSSSFLA WYQQKPGQAPRLLIYGTSTRATGIPDRFSGSGSG TDFTLTISRLEPEDFAVYYCQQYDRSPFTFGPGTK VDIK SEQ ID NO: 27130 | EVQLVESGGGLVQPGGSLRLSCAASGFSFRSYSMN WVRQAPGKGLEWVSYITGSSSTIYYADSVKGRFTIS RDNAKNSLYLQMNSLRDEDTAVYYCARSGLAVED YWGQGTLVTVSS SEQ ID NO: 31136 |
| iPS:436438 | 21-225_216E8 | NA | GACATCCAGATGACCCAGTCTCCATCTTCCCT GCCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTTATCTATGCTGCATCCAGTT TGCAAAGTGGGGTCCCATCAAGGTTCAGCGGC AGTGGATCTGGGACAGAATTCATTCTCACAAT CAGCAGCCTGCAGCCTGAAGATTTTGCAACTT ATTACTGTCTAATGCATTATAGTTACCCTCGGA CGTTCGGCCAAGGGACCAAGGTGGAAATCAA A SEQ ID NO: 27131 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGACAGTTATATGTGGTATGGAAGT AATAAATATTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACGTTAT AGCAGTGGCTGGTACGACTACGGTATGGACGTCT GGGGCCAAGGGACCACGGTCACCGTCTCCTCA SEQ ID NO: 31137 |

FIGURE 50
(Continued)

| | | AA | DIQMTQSPSSLPASVGDRVTITCRASQGIRNDLG WYQQKPGKAPKRLIYAASSLQSGVPSRFSGSGS GTEFILTISSLQPEDFATYYCLMHYSYPRTFGQGT KVEIK<br>SEQ ID NO: 27132 | QVQLVESGGGVVQPGRSLRLSCAASGFTFSDYVM HWVRQAPGKGLEWVTVIWYDGSNKYYADSVKGR FTISRDNSKNTLYLQMNSLRAEDTAVYYCARERYS SGWYDYGMDVWGQGTTVTVSS<br>SEQ ID NO: 31138 |
|---|---|---|---|---|
| iPS:436440 | 21-225_216H12 | NA | GACATCCAGATGACCCTGTCTCCATCTTCCCTG CCTGCATCTGTAGGAGACAGAGTCACCATCAC TTGCCGGGCAAGTCAGGGCATTAGAAATGATT TAGGCTGGTATCAGCAGAAACCAGGGAAAGC CCCTAAGCGCCTTATCTATGCTGCATCCAGTTT GCAAAGTGGGGTCCCATCAAGGTTCAGCGGCA GTGGATCTGGGACAGCCTGAAGATTTTGCAACTTA TTACTGTGTAATGCATAATAGTTACCCTCGGA CGTTCGGCCAAGGGACCAAGGTGGAAATCAA A<br>SEQ ID NO: 27133 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGCT GGAGTGGGTGACAGTTATATGGTATGATGGAAGT AATAAATATTATGCAGACTCCGTGAAGGGCCGAT TCACCATCTCCAGAGACAATTCCAAGAACACGCT GTATCTGCAAATGAACAGCCTGAGAGAACGTTAT CACGGCTGTGTATTACTGTGCGAGACTGGTATGGACGTCT AGCAGTGGCTGGTACGACTACGGTATGGACGTCT GGGGCCAAGGGACCACGGTCACCGTCTCCTCA<br>SEQ ID NO: 31139 |
| | | AA | DIQMTLSPSSLPASVGDRVTITCRASQGIRNDLG WYQQKPGKAPKRLIYGASSLQSGVPSRFSGSGS GTEFILTISSLQPEDFATYYCVMHNSYPRTFGQG TKVEIK<br>SEQ ID NO: 27134 | QVQLVESGGGVVQPGRSLRLSCAASGFTFSDYVM HWVRQAPGKGLEWVTVIWYDGSNKYYADSVKGR FTISRDNSKNTLYLQMNSLRAEDTAVYYCARERYS SGWYDYGMDVWGQGTTVTVSS<br>SEQ ID NO: 31140 |

FIGURE 50
(Continued)

| | | | |
|---|---|---|---|
| iPS:436448 | 21-225_217A3 | NA | GAAATTGTGCTGACTCAGTCTCCAGACTTTAAGTCTGTGACTCCAAAGGAGAAAGTCACCATCACCTGCCGGGCCAGTCAGAGCATTGGTAGTAGCTTACACTGGTACCAGCAGAAACCAGATCAGTCTCCAAAGCTCCTCGTCAAGTATGCTTCCCAGTCCTTCTCAGGGGTCCCCTCGAGGTTCAGTGGCAGTGGATCTGGGACAGAGATTTCACCCTCACCATCAACAGCCTGGAGGCTGAAGATGGTGCAAACGTATTACTGTGTCATCAGAGTAGAAGTTTACGTGGACGTTCGGCCAAGGGACCAAGGTGGAAATCAAA |
| | | | SEQ ID NO: 27135 |
| | | AA | EIVLTQSPDFKSVTPKEKVTITCRASQSIGSSLHWYQQKPDQSPKLLVKYASQSFSGVPSRFSGSGSGTDFTLTINSLEAEDGATYYCHQSRSLPWTFGQGTKVEIK |
| | | | SEQ ID NO: 27136 |
| | | | CAGGTGCAGCTGGTGGAGTCTGGGGGAGGCGTGGTCCAGCCTGGGAGGTCCCTGAGACTCTCTGTGCAGCCTCTGGATTCACCTTCAGTGACTATAATATGAACTGGGTCCGCCAGGCTCCAGGGAAGGGCTGGAGTGGGTTCATACATTAGTAGTAGTCGTAATATCATATATTACGCAGAGAAAATGCCAAGAACTCACTGTCTCTGCAAATGGACAGCCTGAGAGACGAGGACACGGCTGTGTATTACTGTGCGAGATGGTTTGACTACTGGGGCCAGGGCACCCTGGTCACCGTCTCCTCA |
| | | | SEQ ID NO: 31141 |
| | | | EVQLVESGGGLVQPGGSLRLSCAASGFTFSSYNMNWVRQAPGKGLEWVSYISSSRNIYYADSVKGRFTISRENAKNSLSLQMDSLRDEDTAVYYCARDGSYSSGWYWGFDYWGQGTLVTVSS |
| | | | SEQ ID NO: 31142 |
| iPS:436450 | 21-225_217E5 | NA | GACATCCAGATGACCCAGTCTCCATCTTCCCCGCCTCAATTTGTAGGAGACAGAGTCACCATCACTTGCCGGGCAAGTCAGGGCATTAGAAATGATCTTGCCTGGTATCAGCAGAAACCAGGGAAAGTTAGGCTCGGTATCAGCGCCTTATCTGTGTCATCCAGTTCCCCTAAGCGCCTTATCTGTGTCATCCAGTTTGCAAAGTGGGGTCCCATCAAGGTTCAGCGGCAGTGGATCTGGGACAGATTTCATTCTCACAATCAGCAGCCTGCAGCCTGAAGATTTTGCAACTTATTACTGTGTAATGCATAATAGTTACCCTCGGACGTTCGGCCAAGGGACCAAGGTGGAAATCAAA |
| | | | SEQ ID NO: 27137 |
| | | | CAGGTGCAGCTGGTGGAGTCTGGGGGAGGCGTGGTCCAGCCTGGGAGGTCCCTGAGACTCTCTGTGCAGCGTCTGGATTCACCTTCAGTGACTATGTCATGCACTGGGTCCGCCAGGCTCCAGGCAAGGGCTGGAGTGGGTGACAGTTATATGGTATGGATGGAAGTAATAAATATTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAACGTTATAGCAGTGGCTGGTACGACTACGGTATGGACGTCTGGGGCCAAGGGACCACGGTCACCGTCTCCTCA |
| | | | SEQ ID NO: 31143 |

FIGURE 50
(Continued)

| | | | | |
|---|---|---|---|---|
| iPS:436452 | | AA | DIQMTQCPSSPPAFVGDRVTITCRASQGIRNDLG WYQQKPGKAPKRLICAASSLQSGVPSRFSGSGS GTEFILTISSLQPEDFATYYCVMHNSYPRTFGQG TKVEIK<br><br>SEQ ID NO: 27138 | QVQLVESGGGVVQPGRSLRLSCAASGFTFSDYVM HWVRQAPGKGLEWVTVIWYDGSNKYYADSVKGR FTISRDNSKNTLYLQMNSLRAEDTAVYYCARERYS SGWYDYGMDVWGQGTTVTVSS<br><br>SEQ ID NO: 31144 |
| | 21-225_217G5 | NA | GACATCCTGATGACCCAGTCTCCATCCTCACT GTCTGCATCTGTAGGAGACAGAGTCACCATCA CTTGTCGGGCGAGTCAGGGCATTGGCAATTAT TTAGCCTGGTTTCAGCAGAAACCAGGGAAAGC CCCTAAGTCCCTGATCTATGCTGCATCCAGTTT GCAAAGTGGGGTCCCATCAAAGTTCAGCGGCA CTCGATCTGGGACAGATTTCACTCTCACCATC AGCAGCCTGCAGCCTGACGATGTTAATTACCCTCAC TTTTCGCGGGAGGGACCAAGGTGGAGATCAAC<br><br>SEQ ID NO: 27139 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCAATGGCAT GCACTGGGTCCGCCAGGCTCCAGGCAAGGGCT GGAGTGGGTGGCAGTTATATGGTATGGAAGT AATAAAACTATGCAGACTCCGTGAAGGGCCGA TTCACCATCTCCAGAGACAATTCCAAGAACAGC TGTATCTGCAAATGAACAGCCTGAGAGCCGAGG ACACGGCTGTGTATTACTGTGCGAGAGACTACGG TGTCGGGTACTACGGTCTGGACGTCTGGGGCCAA GGGACCACGGTCACCGTCTCCTCA<br><br>SEQ ID NO: 31145 |
| | | AA | DILMTQSPSSLSASVGDRVTITCRASQGIGNYLA WFQQRPGKAPKSLIYAASSLQSGVPSKFSGTRSG TDFTLTISSLQPDDFATYYCQQYVNYPLTFGGGT KVEIN<br><br>SEQ ID NO: 27140 | QVQLVESGGGVVQPGRSLRLSCAASGFTFSSNGMH WVRQAPGKGLEWVAVIWYDGSNKNYADSVKGRF TISRDNSKNTLYLQMNSLRAEDTAVYYCARDYGV GYYGLDVWGQGTTVTVSS<br><br>SEQ ID NO: 31146 |

FIGURE 50
(Continued)

| | | | |
|---|---|---|---|
| iPS:436454 | 21-225_217B10 | NA | GACATCCGGATGACCCAGTCTCCATCCTCACTGTCTGCATCTGTAGGAGACAGAGTCACCATCACTTGTCGGGCGAGTCAGGCCATTGGGAAACATCTTAGCCTGGTTTCAGCAGAGGCCTGGGAAAGCCCCTAAGTCCCCTGATCTATGCTGCATCCAGATTGCAAAGTGGGGTCCCATCAAAGTTCAGCGGCAGTGGATCTGGGACAGATTTCACTCTCACCATCAGCAGCCTGCAGCCTGAAGATCTTGCAACTTATTACCGTCAACACACCAGTAAATCTCCAGTGCAGCTTGTCGGAGGCACCAAGGTGGAGATCAAAA SEQ ID NO: 27141 | CAGGTGCAGCTGGTGGAGTCTGGGGGAGGCGTGGTCCAGCCTGGGAGGTCCCTGAGACTCTCCTGTCAGTGTCTGGAATCACCTTCAGTAGTTATGGCATGCACTGGGTCCGCCAGGCTCCAGGCAAGGGGCTGGAGTGGGTGGCAGTTATATGGTATGATGGAAGTAATAAAACTATGAAGACTCCGTGAAGGGCCGATTCACCATCTCCAGAGACAACGCCAAGAACACGCTGTATCTGCAAATGAACAGCCTGAGAGCTGAGGACACGGCTGTATTACTGTGCGAGAGATGGGAGTTATGGTTACGACGGTATGGACGTTGGGGCCAAGGGACCACGGTCACCGTCTCCTCA SEQ ID NO: 31147 |
| | | AA | DIRMTQSPSSLSASVGDRVTITCRASQAIGKHLAWFQQRPGKAPKSLIYAASRLQSGVPSKFSGSGSGTDFTLTISSVQPEDLATYYRQHTSKSPVQLVGGTKVEIT SEQ ID NO: 27142 | QVQLVESGGGVVQPGRSLRLSCAVSGITFSSYGMHWARQAPGKGLEWVAVIWYDGSNKNYEDSVKGRFTISRDNSKNTLYLQMNSLRAEDTAVYYCARDGSYGYDGMDVWGQGTTVTVSS SEQ ID NO: 31148 |
| iPS:436456 | 21-225_217G10 | NA | GACATCCAGATGACCCAGTCTCCATCTTCCCGCCTGCATCTGTAGGAGACAGAGTCACCATCACTTGCCGGGCAAGTCAGGGCATTAGAAATGATTAGGCTGGTATCAGCAGAAACCAGGGAAAGCCCCTAAGCGCCTTATCTATGCTGCATCCAGTTTGCAAAGTGGGGTCCCATCAAGGTTCAGCGGCAGTGGATCTGGGACAGAATTCATTCTCACTATCAGCAGCCTGCAGCCTGAAGATTTTGCAACTTATTACTGTGTAATGCATAATAGTTACCCTCGGACGTTCGGCCAAGGGACCAAGGTGGAAATCAAA SEQ ID NO: 27143 | CAGGTGCAGCTGGTGGAGTCTGGGGGAGGCGTGGTCCAGCCTGGGAGGTCCCTGAGACTCTCCTGTCAGGCGTCTGGATTCACCTTCAGTGACTATGTCATGCACTGGGTCCGCCAGGCTCCAGGCAAGGGGCTGGAGTGGGTGGCAGTTATATGGTATGATGGAAGTAATAAATATTATGCAGAGACAATTCCAAGAACACGCTGTATCTGCAAATGAACAGCCTGAGAGAGCGAGGACACGGCTGTGTTATTACTGTGCGAGAGAACGTTATAGCAGTGGCTGGTACGACTACGGTATGGACGTCTGGGGCCAAGGGACCACGGTCACCGTCTCCTCA SEQ ID NO: 31149 |

FIGURE 50
(Continued)

| | | | |
|---|---|---|---|
| iPS-436458 | | AA | DIQMTQSPSPPASVGDRVTITCRASQGIRNDLGWYQQKPGKAPKRLIYAASSLQSGVPSRFSGSGSGTEFILTISSLQPEDFATYYCVMHNSYPRTFGQGTKVEIK<br>SEQ ID NO: 27144 | QVQLVESGGGVVQPGRSLRLSCAASGFTFSDYVMHWVRQAPGKGLEWVTVIWYDGSNKYYADSVKGRFTISRDNSKNTLYLQMNSLRAEDTAVYYCARERYSSGWYDYGMDVWGQGTTVTVSS<br>SEQ ID NO: 31150 |
| | 21-225_217H12 | NA | GACATCCAGATGACCCAGTCTCCATCTCCCCGCCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTTATCTATGCTGCATCCAGTTTGCAAAGTGGGGTCCCATCAAGGTTCAGCGGCAGTGGATCTGGGACAGAATTCATTCTCACAATCAGCAGCCTGCAGCCTGAAGATTTTGCAACTTATTACTGTGTCTAATGCATTATAGTTACCCTCGGACGTTCGGCCAAGGGACCAAGGTGGAAATCAAA<br>SEQ ID NO: 27145 | CAGGTGCAGCTGGTGGAGTCTGGGGGAGGCGTGGTCCAGCCTGGGAGGTCCCTGAGACTCTCCTGTGCAGCGTCTGGATTCACCTTCAGTGACTATGTCATGCACTGGGTCCGCCAGGCTCCAGGCAAGGGCTGGAGTGGGTGACAGTTATATGGTATGATGAAGTAATAAATATTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAACGTTATAGCAGTGGCTGGTACGACTACGGTATGGACGTCTGGGGCCAAGGGACCACGGTCACCGTCTCCTCA<br>SEQ ID NO: 31151 |
| | | AA | DIQMTQSPSPPASVGDRVTITCRASQGIRNDLGWYQQKPGKAPKRLIYAASSLQSGVPSRFSGSGSGTEFILTISSLQPEDFATYYCLMHYSYPRTFGQGTKVEIK<br>SEQ ID NO: 27146 | QVQLVESGGGVVQPGRSLRLSCAASGFTFSDYVMHWVRQAPGKGLEWVTVIWYDGSNKYYADSVKGRFTISRDNSKNTLYLQMNSLRAEDTAVYYCARERYSSGWYDYGMDVWGQGTTVTVSS<br>SEQ ID NO: 31152 |

FIGURE 50
(Continued)

| | | | |
|---|---|---|---|
| iPS:436462 | 21-225_218C4 | NA | GACATCCAGATGACCCAGTCTCCATCTTCCCC GCCTGCATTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTTATCTATGCTGCATCCAGT TGCAAAGTGGGGTCCCATCAAGGTTCAGCGGC AGTGGATCTGGGACAGATTTCATTCTCACAAT CAGCAGCGTGCAGCGTGAAGATTTTGCAACTT ATTACTGTGTAATGCATTATAGTTACCCTCGG ACGTTCGGCCAAGGGACCAAGGTGGAAATCA AA |  CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGACAGTTATATGCAGACTCCGTGA AGTGATGGAAGTAATAAATATTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACGTTAT AGCAGTGGCTGGTACGACTACGGTATGGACGTCT GGGGCCAAGGGACCACGGTCACCGTCCTCA |
| | | AA | SEQ ID NO: 27147 | SEQ ID NO: 31153 |
| | | | DIQMTQSPSSPPAFVGDRVTITCRASQGIRNDLG WYQQKPGKAPKRLIYAASSLQSGVPSRFSGSGS GTEFILTISSVQREDFATYYCVMHYSYPRTFGQG TKVEIK | QVQLVESGGGVVQPGRSLRLSCAASGFTFSDYVM HWVRQAPGKGLEWVTVIWYDGSNKYYADSVKGR FTISRDNSKNTLYLQMNSLRAEDTAVYYCARERYS SGWYDYGMDVWGQGTTVTVSS |
| | | | SEQ ID NO: 27148 | SEQ ID NO: 31154 |
| iPS:436464 | 21-225_219H1 | NA | GACATCCAGATGACCCAGTCTCCATCCTCACA GTCTGCATCTGTAGGAGACAGAGTCACCATCA CTTGTCGGGCGAGTCAGGGCATTAGCAATTAT TTAGACTGGTTTCAGCAGAAACCAGGGAAAGC CCCTAAGTCCCTGATCTATTCTGCATCCAATT GCAAAGTGGGGTCCCATCAAAGTTCAGCGGCA GTAGATCTGGGACAGATTTCACTCTCACCATC AGCAGCCTGCAGCCTGAAGATTTTGCAACTTA TTACTGCCAAACACTACTAGTAATTACCCGCTCA CTTTCGGCGGAGGGACCAAGGTGGAGATCAA A | CAGGTGCAGCTGGTGGAGTCTGGGGGAGGCGTG GTCCAGCCTGGGAGGTCCCTGAGACTCTCCTGTG CAGCGTCTGGATTCAGTCACCTTCAGTAGATATGGCAT GCACTGGGTCCGCCAGGCTCCAGGCAAGGGGCT GGAGTGGGTGGCAGTTATATGGTATGATGGAAGT AATAAACACTATGCAGACTCCGTGAAGGGCCGA TTCACCATCTCCAGAGACAATTCCAAGAATACGT TGTATCTGCAAATGAACAGTCTGAGAGCCGAGG ACACGGCTGTGTATTACTGTGCGAGAGATCGGGG AGTGGCTACAACGGTATGGACGTCTGGGGCCA AGGGACCACGGTCACCGTCCTCA |
| | | | SEQ ID NO: 27149 | SEQ ID NO: 31155 |

FIGURE 50
(Continued)

| | | | | |
|---|---|---|---|---|
| iPS:436472 | 21-225_220E1 | AA | DIQMTQSPSSQSASVGDRVTITCRASQGISNYLD WFQQKPGKAPKSLIYSASNLQSGVPSKFSGSRSG TDFTLTISSLQPEDFATYYCQHYSNYPLTFGGGT KVEIK<br><br>SEQ ID NO: 27150 | QVQLVESGGGVVQPGRSLRLSCAASGFTFSRYGMH WVRQAPGKGLEWVAVIWYDGSNKHYADSVKGRF TISRDNSKNTLYLQMNSLRGEDTAVYYCARDRGV GYNGMDVWGQGTTVTSS<br><br>SEQ ID NO: 31156 |
| | | NA | GAAATTGTGTTGACGCAGTCTCCAGGCACCCT GTCTTTGTCTCCAGGGGAAAGAGCCACCCTCT CCTGCAGGGCCAGTCAGTCAGAGTATTAGCCGCAGC CACTTAGTCTGGTACCAGCAGAAAACCTAACCA GGCTCCCAGGCTCCTCTCTATGTTACATCCAG CAGGGCCACTGGCATCCCAGACAGGTTAGTG GCAGTGGGTCTGGGACAGACTTCACTCTCACC ATCAGAAGTCTGGAGCCTGAAGATTTTGCAAT GTATTACTGTCAGCAGTATGGTAGCTCACCGT GGACGTTCGGCCAAGGGACCAAGGTGGAAAT CAAA<br><br>SEQ ID NO: 27151 | CAGGTGCAGCTGCAGGAGTCGGGCCCAGGACTG GTGAAGCCTTCGGAGACCCTGTCCCTCACCTGCA CTGTCTCTGGTGGCTCCATCAGTACTTACTACTG GAGCTGGATCGGCCAGCCCCCAGGGAAGGGACT GGAGTGGATTGGGTATATCTATTACAGTGGGACC ACCAACTACAACCCCTCCCTCAAGAGTCGAGTCA CCATATCAGTAGACACGTCCAAGAACCAGTTCTC CCTGAAGCTGAGCTCTGTGACCGCTGCGACACG GCCGTGTATTACTGTGCGGAGAGACAACTACTACTACGGTAT TGGTACGTGGGGGACAACTACTACTACGTGGC GGACGTCTGGGCCAAGGGACCACGGTCACCGT CTCCTCA<br><br>SEQ ID NO: 31157 |
| | | AA | EIVLTQSPGTLSLSPGERATLSCRASQSISRSHLV WYQQKPNQAPRLLLYVTSSRATGIPDRFSGSGS GTDFTLTIRSLEPEDFAMYYCQQYGSSPWTFGQ GTKVEIK<br><br>SEQ ID NO: 27152 | QVQLQESGPGLVKPSETLSLTCTVSGGSISTYYWSW IRQPPGKGLEWIGYIYYSGTTNYNPSLKSRVTISVDT SKNQFSLKLSSVTAADTAVYYCARDQQWLVRGRD NYYYGMDVWGQGTTVTSS<br><br>SEQ ID NO: 31158 |

FIGURE 50
(Continued)

| | | | |
|---|---|---|---|
| iPS-436480 | 21-225_220F8 | NA | GACATCCAGATGACCCTGTCTCCATCTCCCC<br>GCCTGCATTTGTAGGAGACAGAGTCACCATCA<br>CTCGCCGGGCAAGTCAGGGCATTAGAAATGAT<br>TTAGGCTGGTATCAGCAGAAACCAGGAAAG<br>CCCCTAAGCGCCTTATATGTGGTCATCCAGT<br>TTGCAAAGTGGGGTCCCATCAAGGTTCAGCGG<br>CAGTGGATCTGGGACAGAATTCATTCTCACAA<br>TCAGCAGCCTGCAGCGTGAAGATTTTGCAACT<br>TATTACTGTGTAATGCATAATAGTTACCCTCG<br>GACGTTCGGCCAAGGGACCAAGGTGGAAATC<br>AAA<br><br>SEQ ID NO: 27153 | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTGACTATGTCAT<br>GCACTGGGTCCGCCAGGCTCCAGGCAAGGGGCT<br>GGAGTGGGTGACAGTTATATGGTATGATGGAAGT<br>AATAAATATTATGCAGACTCCGTGAAGGGCCGAT<br>TCACCATCTCCAGAGACAATTCCAAGAACACGCT<br>GTATCTGCAAATGAACAGCCTGAGAGCCGAGGA<br>CACGGCTGTGTATTACTGTGCGAGAGAACGTTAT<br>AGCAGTGGCTGGTACGACTACGGTATGGACGTCT<br>GGGGCCAAGGGACCACGGTCACCGTCTCCTCA<br><br>SEQ ID NO: 31159 |
| | | AA | DIQMTLSPSSPPAFVGDRVTITRRASQGIRNDLG<br>WYQQKPGKAPKRLICGASSLQSGVPSRFSGSGS<br>GTEFILTISSLQREDFATYYCVMHNSYPRTFGQG<br>TKVEIK<br><br>SEQ ID NO: 27154 | QVQLVESGGGVVQPGRSLRLSCAASGFTFSDYVM<br>HWVRQAPGKGLEWVTVIWYDGSNKYYADSVKGR<br>FTISRDNSKNTLYLQMNSLRAEDTAVYYCARERYS<br>SGWYDYGMDVWGQGTTVTVSS<br><br>SEQ ID NO: 31160 |
| iPS-436488 | 21-225_221A6 | NA | GACATCCAGATGACCCAGTCTCCATCTCCGT<br>GTCTGCATCTGTAGGAGACAGAGTCACCATCA<br>CTTGTCGGGCGAGTCAGGGTATTAGCAGCTGG<br>TTAGCCTGGTATCAGCAGAAACCAGGGAAAG<br>CCCCTAAGCTCCTGATCTATACTGCATCCATT<br>TGCAAAGTGGGGTCCCATCAAGGTTCAGCGGC<br>AGTGGATCTGGGACAGATTTCACTCTCACCAT<br>CAGCAGCCTGCAGCCTGAAGATTTTGCAACTT<br>ACTATTGTCAACAGGCTAACAGTTTCCCATTC<br>ACTTTCGGCCCTGGGACCAAAGTGGATATCAA<br>A<br><br>SEQ ID NO: 27155 | CAGGTGCAGCTGGTGCAGTCTGGGCTGAGGTG<br>AAGAAGCCTGGGCCTCAGTGAAGGTCTCTGC<br>AAGACTTCTGGATACACCTTCACCGGCTACTATA<br>TGCACTGGGTGCGACAGGCCCCTGGACAAGGGC<br>TTGAGTGGATGGATGATCCACCTAACAGTGG<br>TGGCACAAACTATGCACAGAAATTTCAGGGCAG<br>GGTCACCCTGACCAGGGACACGTCCATCAGCAC<br>AGCCTACATGGACCTGAGCAGGCTGAGATCTGA<br>CGACACGGCCGTGTATTACTGTGCGAGAGATGG<br>GACCAGCTCGTTTGACTACTGGGGCCAGGGAACC<br>CTGGTCACCGTCTCCTCA<br><br>SEQ ID NO: 31161 |

FIGURE 50
(Continued)

| | | | |
|---|---|---|---|
| iPS:436490 | | AA | DIQMTQSPSSVSASVGDRVTITCRASQGISSWLA WYQQKPGKAPKLLIYTASNLQSGVPSRFSGSGS GTDFTLTISSLQPEDFATYYCQQANSFPFTFGPGT KVDIK<br>SEQ ID NO: 27156 | QVQLVQSGAEVKKPGASVKVSCKTSGYTFTGYYM HWVRQAPGQGLEWMGWIHPNSGGTNYAQKFQGR VTLTRDTSISTAYMDLSRLRSDDTAVYYCARDGTS SFDYWGQGTLVTVSS<br>SEQ ID NO: 31162 |
| | 21-225_221F6 | NA | GACATCCAGATGACCCAGTCTCCATCTCACT GTCTGGATCTGTAGGAGACAGAGTCACCATCA CTTGTCGGGCGAGTCAGGGCATTAGCAATTAT TTAGCCTGGTTTCAGCAGAAACCAGGGAAAGC CCCTAAAATCCCTGATCTATGCTGCATCCAATTT ACAAAGTGGGGTCCCATCAAAGTTCAGCGGCA GTAGATCTGGGACAGATTTCACTCTCACCATC AGCAGCCTGCAACAGTATATGACTTACCGCTCA TTACTGCCAACAGTATATGACTTACCGCTCA CTTTCGGCGGAGGGACCAGGGTGGAGATCAA A<br>SEQ ID NO: 27157 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCAATGGCAT GCACTGGGTCCGCCAGGCTCCAGGCAAGGGGCT GGAGTGGGTGGCAGTTATATGCAGACTCCGTGAAGGGCCG TAATGAAAACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGAGATCGGA CAGTGGGCTACAACGGTATGGACGTCTGGGGCC AAGGGACCACGGTCACCGTCTCCTCA<br>SEQ ID NO: 31163 |
| | | AA | DIQMTQSPSSLSGSVGDRVTITCRASQGISNYLA WFQQKPGKAPKSLIYAASNLQSGVPSKFSGSRSG TDFTLTISSLQPEDFATYYCQQYMTYPLTFGGGT RVEIK<br>SEQ ID NO: 27158 | QVQLVESGGGVVQPGRSLRLSCAASGFTFSSNGMH WVRQAPGKGLEWVAVIWYDGSNENYADSVKGRF TISRDNSKNTLYLQMNSLRAEDTAVYYCARDRTVG YNGMDVWGQGTTVTVSS<br>SEQ ID NO: 31164 |

FIGURE 50
(Continued)

| | | | |
|---|---|---|---|
| iPS:436494 | 21-225_221F12 | NA | GACATCCAGATGACCCAGTCTCCATCTTCCGT GTCTGCATCTGTAGGAGACAGAGTCACCATCA CTTGTCGGGCGAGTCAGGGTATTAGCAGCTGG TTAGCCTGGTATCAGCAGAAACCAGGGAAAG CCCCTAAGCTCCTGATCTATACTGCATCCAATT TGCAAAGTGGGGGTCCCATCAAGGTTCAGCGGC AGTGGATCTGGGACAGATTTCACTCTCACCAT CAGCAGCCTGCAGCGTGAAGATTTTGCAACTT ACTATTGTCAACAGGCTAACAGTTTCCCATTC ACTTTCGGCCCTGGGACCAAAGTGGATATCAA A | CAGGTGCAGCTGGTGCAGTCTGGGGCTGAGGTG AAGAAGCCTGGGGCCTCAGTGAAGGTCTCCTGC AAGACTTCTGGATACACCTTCACCGGCTACTATA TGCACTGGGTGCGACAGGCCCCTGGACAAGGGC TTGAGTGGATGGGATGGATCCACCCTAACAGTGG TGGCACAAACTATGCACAGGGACACGTCAGCAG GGTCACCCTGACCAGGGACACGTCATCAGCAC AGCCTACATGGACCTGAGCAGGCTGAGATCTGA CGACACGGCCGTGTATTACTGTGCGAGAGATGG GACCAGTCTGTTTGACTACTGGGGCCAGGGAACC CTGGTCACCGTCTCCTCA |
| | | | SEQ ID NO: 27159 | SEQ ID NO: 31165 |
| | | AA | DIQMTQSPSSVSASVGDRVTITCRASQGISSWLA WYQQKPGKAPKLLIYTASNLQSGVPSRFSGSGS GTDFTLTISSLQREDFATYYCQQANSFPFTFGPGT KVDIK | QVQLVQSGAEVKKPGASVKVSCKTSGYTFTGYYM HWVRQAPGQGLEWMGWIHPNSGGTNYAQKFQGR VTLTRDTSISTAYMDLSRLRSDDTAVYYCARDGTS SFDYWGQGTLVTVSS |
| | | | SEQ ID NO: 27160 | SEQ ID NO: 31166 |
| iPS:436496 | 21-225_222E1 | NA | GACATCCAGATGACCCAGTCTCCATCTTCCGT GTCTGCATCTGTAGGAGACAGAGTCACCATCA CTTGTCGGGCGAGTCAGGGTATTAGCAGCTGG TTAGCCTGGTATCAGCAGAAACCAGGGAAAG CCCCTAAGCTCCTGATCTATACTGCATCCAATT TGCAAAGTGGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCGTGGGACCAAAGTGGATATCAA A | CAGGTGCAGCTGGTGCAGTCTGGGGCTGAGGTG AAGAAGCCTGGGGCCTCAGTGAAGGTCTCCTGC AAGACTTCTGGATACACCTTCACCGGCTACTATA TGCACTGGGTGCGACAGGCCCCTGGACAAGGGC TTGAGTGGATGGGATGGATCCACCCTAACAGTGG TGGCACAAACTATGCACAGGGACACGTCAGCAG GGTCACCCTGACCAGGGACACGTCATCAGCAC AGCCTACATGGACCTGAGCAGGCTGAGATCTGA CGACACGGCCGTGTATTACTGTGCGAGAGATGG GACCAGTCTGTTTGACTACTGGGGCCAGGGAACC CTGGTCACCGTCTCCTCA |
| | | | SEQ ID NO: 27161 | SEQ ID NO: 31167 |

FIGURE 50
(Continued)

| | | AA | DIQMTQSPSSVSASVGDRVTITCRASQGISSWLA WYQQKPGKAPKLLIYTASNLQSGVPSRFSGSGS GTDFTLTISSLQPEDFATYYCQQANSFPFTFGRGT KVDIK SEQ ID NO: 27162 | QVQLVQSGAEVKKPGASVKVSCKTSGYTFTGYYM HWVRQAPGQGLEWMGWIHPNSGGTNYAQKFQGR VTLTRDTSISTAYMDLSRLRSDDTAVYYCARDGTS SFDYWGQGTLVTVSS SEQ ID NO: 31168 |
|---|---|---|---|---|
| iPS:436500 | 21-225_222H3 | NA | GACATCGTGATGACCCAGTCTCCAGACTCCCT GGCTGTGTCTCTGGGCGAGAGGGCCACCATCA ACTGCAAGTCCAGCCAGAGTGTTTTGAAAAGT TCCAACCATAGGAACTACTTAGCTTGGTACCA ACAGAAACCAGGGCAGCCTCCTCAGCTTCTCA TTTACTGGGCATCTACCCGGGAAACCGGGGTC CCTGACCGATTCAGTGGCAGCGGGTCTGGGAC AGATTTCACTCTCACCATCAGCAGCCTCAGG CTGAAGATGTGTCAGTTTATTCTGTGACGTTCGGCCAAGG GACCAAGGTGGAAATCAAT SEQ ID NO: 27163 | CAGGTTCAGCTGGTGCAGTCTGGAGCTGAGGTGA AGAAGCCTGGGGCCTCAGTGAAGGTCTCCTGCA AGGCTTCTGGTTTCACCTTTACCAGCTATGGTATC AACTGGGTGCGACAGGCCCCTGGACAAGGCTT GAGTGGATGGGATGGATCAGCGTTTACAATGGTA ACACAAACTATGCACAGAAGTCCAGGGCAGAG TCACCATGACCACAGACACATCCACGAGCACAG CCTACATGGAGCTGAGAGCCTGAGATCTGACG ACACGGCCGTGTATTACTGTGCGAGAGACTACTA CTACGGTTTGACGTCTGGGGCCAAGGGACCACG GTCACCGTCTCCTCA SEQ ID NO: 31169 |
| | | AA | DIVMTQSPDSLAVSLGERATINCKSSQSVLKSSN HRNYLAWYQQKPGQPPQLLIYWASTRETGVPD RFSGSGSGTDFTLTISSLQAEDVSVSCQQYSSIP WTFGQGTKVEIN SEQ ID NO: 27164 | QVQLVQSGAEVKKPGASVKVSCKASGFTFTSYGIN WVRQAPGQGLEWMGWISVYNGNTNYAQKLQGR VTMTDTSTSTAYMELRSLRSDDTAVYYCARDYY YGFDVWGQGTTVTVSS SEQ ID NO: 31170 |

FIGURE 50
(Continued)

| | | | |
|---|---|---|---|
| iPS:436502 | 21-225_222A11 | NA | GACATCCAGATGACCCAGTCTCCATCTCCACT GTCTGCATCTGTAGGAGACAGAGTCACCATCA CTTGTCGGGCGAGTCAGGGCATTAGCAATTAT TTGGCCTGGTTTCAGCAGAAACCAGGGAAAGC CCCTAAGTCCCTGATCTACGCTGCATCCAGTTT GCAAAGTGGGGTCCCATCAAAGTTCAGCGGCA GTGGATCTGGGACAGATTTCACTCTCACCATC AGTAGCCTGCAGCCTGAAGATTTTGCAACTTA TTACTGCCTATATATTATCTTAATTATCCGCTCAC TTTCGGCGGAGGGACCAAGGTGGAGATCAAA<br><br>SEQ ID NO: 27165 | CAGGTGCAGCTGGTGGAGTCTGGGGGAGGCGTG GTCCAGCCTGGGAGGTCCCTGAGACTCTCCTGTG CAGGGCTCTGGATTCACCTTCAGTAGCTATGGCAT GCACTGGGTCCGCCAGGCTCCAGGCAAGGGGCT GGAATGGGTGGCAGTTATATGGTATGATGGAAGT AATAAAAACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATATTACTGTGCGAGAGATCGGGA TGTCGGGTACAACGGTATGGACGTCTGGGGCCA AGGGACCACGGTCACCGTCTCCTCA<br><br>SEQ ID NO: 31171 |
| | | AA | DIQMTQSPSSLSASVGDRVTITCRASQGISNYLA WFQQKPGKAPKSLIYAASSLQSGVPSKFSGSGSG TDFTLTISSLQPEDFATYYCLYYLNYPLTFGGGT KVEIK<br><br>SEQ ID NO: 27166 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDRDV GYNGMDVWGQGTTVTVSS<br><br>SEQ ID NO: 31172 |
| iPS:436504 | 21-225_222H4 | NA | GACATCCAGATGACCCATTCTCCATCCTCCT GTCTGCATCTGTAGGAGACAGAGTCACCATCA CTTGCCGGGCAAGTCAGAACATTAGTAATTAT GTTAATTGGTATCAGCAGAAACCAGGGAAAG CCCCTAAGTTCCTGATCTATACTGCATCGAGTT TGCAAAGTGGGGTCTCGTCAGGGTTCAGTGGC AGTGGATCTGGGACAGATTTCACTCTCACCAT CAGCAGTCTGCACCGTGACGATTTTGCAACTTT ACTATTGTCAGCAGTATTACTTTACCCCATTCA CTTTCGGCCGGGGGACCAAAGTGGATATCAAA<br><br>SEQ ID NO: 27167 | GAGGTGCAGCTATTGGAGTCTGGGGGAGGCTTG GTACAGCCTGGGGGGTCCCTGAGACTCTCCTGTG CAGCCTCTGGCTTCACCTTTAGCAACTTTGCCAT GAGTTGGGTCCGCCAGGCTCCAGGAAGGACT GGAGTGGGTCTCAAGTATTGTTGGTAGTGGTGGT CGCACGTACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTATTGTGCGAAAGACCCTTA TCGTGTAGCAGTGGCTGGGGCCTTTGACTACTGG GGCCAGGGAACCCTGATCACCGTCTCCTCA<br><br>SEQ ID NO: 31173 |

FIGURE 50
(Continued)

| | | | |
|---|---|---|---|
| iPS:436506 | 21-225_222C7 | AA | DIQMTHSPSSLSASVGDRVTITCRASQNISNYVN WYQQKPGKAPKFLIYTASSLQSGVSSRFSGSGSG TDFTLTISSVHRDDFAIYYCQQYFTPFTFGRGT KVDIK<br>SEQ ID NO: 27168 | EVQLLESGGGLVQPGGSLRLSCAASGFTFSNFAMS WVRQAPGKGLEWVSSIVGSGGRTYYADSVKGRFTI SRDNSKNTLYLQMNSLRAEDTAVYYCAKDPYRVA VAGAFDYWGQGTLITVSS<br>SEQ ID NO: 31174 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTTACAGCAAC TACTTAGCCTGGTACCAGCAGAAACCTGGCCA GGCTCCCAGGCTCCTCATCTATGGTGCATCAA GCAGGGCCACTGGCATCCCAGACAGGTTCGGT GGCAGTGGGTCTGGGACAGACTTCACTCTGC CATAAGCAGACTGGAGCTGAAGATGAAGATGCT TATATTACTGTCAGCAGTATGAAGACTCACCG TGGACGTTCGGCCAAGGGACCAAGGTGGAAA TCAAA<br>SEQ ID NO: 27169 | CAGGTGCAGCTACAGCAGTGGGGCGCAGGACTG TTGAAGCCTTCGGAGACCCTGTCCCTCACCTGCG CTGTCTATGGTGGGTCCTTCAGTGGTGCTACTG GAGCTGGATCCGCCAGCCCCCAGGGAAGGGGCT GGAGTGGATTGGGGAAATCAATCATAGTGGAAG CGCCAACTACAACCGTCCCTCAAGAGTCGAGTC ACCATATCAGTAGACACGTCCAAGAACCAGTTCT CCCTGAAGCTGAGTTCTGTGACCGCCGCGGACAC GGCTGTATATTACTGTGCGAGAGATACGGCGCC CTTGATTTCTGGGGCCAAGGGACAATGGTCACCG TCTCTTCA<br>SEQ ID NO: 31175 |
| | | AA | EIVLTQSPGTLSLSPGERATLSCRASQSVYSNYLA WYQQKPGQAPRLLIYGASSRATGIPDRFGSGS GTDFTLAISRLEPEDFTIYYCQQYEDSPWTFGQG TKVEIK<br>SEQ ID NO: 27170 | QVQLQQWGAGLLKPSETLSLTCAVYGGSFSGRYW SWIRQPPGKGLEWIGEINHSGSANYNPSLKSRVTIS VDTSKNQFSLKLSSVTAADTAVYYCARDYGALDF WGQGTMVTVSS<br>SEQ ID NO: 31176 |

FIGURE 50
(Continued)

| | | | |
|---|---|---|---|
| iPS:436508 | 21-225_222F7 | NA | GACATCAGATGACCCAGTCTCCATCTTCCGT GTCTGCATCTGTAGGAGACAGAGTCACCATCA CTTGTCGGGCGAGTCAGGGTATTAGCAGCTGG TTAGCCTGGTATCAGCAGAAACCAGGGAAAG CCCCTAAGCTCCTGATCTATTACTGCATCCAATT TGCAAAGTGGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A | CAGGTGCAGCTGGTGCAGTCTGGGGCTGAGGTG AAGAAGCCTGGGGCCTCAGTGAAGGTCTCCTGC AAGACTTCTGGATACACCTTCACCGGCTACTATA TGCACTGGGTGCGACAGGCCCCTGACAAGGGC TTGAGTGGATGGGATGGATCCACCTAACAGTGG TGGCACAAACTATGCACAGAAATTTCAGGGCAG GGTCACCCTGACCAGGGACACGTCATCAGCAC AGCCTACATGGACCTGAGCAGGCTGAGATCTGA CGACAGGCCGTGTATTACTGTGCGAGAGATGG GACCAGCTCGTTTGACTACTGGGGCCAGGGAACC CTGGTCACCGTCCTCA |
| | | | SEQ ID NO: 27171 | SEQ ID NO: 31177 |
| | | AA | DIQMTQSPSSVSASVGDRVTITCRASQGISSWLA WYQQKPGKAPKLLIYTASNLQSGVPSRFSGSGS GTDFTLTISSVQPEDFATYYCQQANSFPFTFGPGT KVDIK | QVQLVQSGAEVKKPGASVKVSCKTSGYTFTGYYM HWVRQAPGQGLEWMGWIHPNSGGTNYAQKFQGR VTLTRDTSISTAYMDLSRLRSDDTAVYYCARDGTS SFDYWGQGTLVTVSS |
| | | | SEQ ID NO: 27172 | SEQ ID NO: 31178 |
| iPS:436510 | 21-225_222H8 | NA | GACATCAGATGACCCAGTCTCCATCTTCCCTG TCTGCATCTGTAGGAGACAGAGTCACCATCAC TTGCCGGGCAAGTCAGAGCATTAGTAATTATG TTAATTGGTATCAGCAGAAACCAGGGAAAGCC CCTAAGTTCCTGATCTATATTGCATCGAGTTTG CAAAGTGGGGTCTCGGTCTCGTCAGGTTCAGTGGCAG TGGATCTGGGACAGATTTCACTCTCACCATCA GCAGTGTGCACCGTGACGATTTTGCAATTTAC TACTGTCAGCAGTATTACTTTACCCCATTCACT TTCGGCCGTGGGACCAAAGTGGATATCAAA | GAGGTGCAGCTATTGGAGTCTGGGGGAGGCTTG GTACAGCCTGGGGGGTCCCTGAGACTCTCCTGTG CAGCCTCTGGCTTCACCTTTAGCAACTTTGCCAT GAGTTGGGTCCGCCAGGCTCCAGGGAAGGGACT GGAGTGGGTCTCAAGTATTGTTGGTAGTGGTGGT CGCACGTACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTATTGTGCGAAAGACCCTTA TCGTGTAGCAGTGGCTGGGGCCTTTGACTACTGG GGCCAGGGAACCCTGATCACCGTCTCCTCA |
| | | | SEQ ID NO: 27173 | SEQ ID NO: 31179 |

FIGURE 50
(Continued)

| | | | | |
|---|---|---|---|---|
| | | AA | DIQMTHSPSSLSASVGDRVTITCRASQNISNYVN WYQQKPGKAPKFLIYIASSLQSGVSSRFSGSGSG TDFTLTISSVHRDDFAIYYCQQYFTPFTFGRGT KVDIK<br><br>SEQ ID NO: 27174 | EVQLLESGGGLVQPGGSLRLSCAASGFTFSNFAMS WVRQAPGKGLEWVSSIVGSGGRTYYADSVKGRFTI SRDNSKNTLYLQMNSLRAEDTAVYYCAKDPYRVA VAGAFDYWGQGTLITVSS<br><br>SEQ ID NO: 31180 |
| iPS:436514 | 21-225_222D10 | NA | GACATCCAGATGACCCAGTCTCCATCCTCACT GTCTGCATCTGTAGGAGACAGAGTCACCATCA CTTGTCGGGCAGTCAGGACATTAGCAATTAT TTGGCCTGGTTTCAGCAGAAACCAGGGAAAGC CCCTAAGTCCCTGATCTACGCTGCATCCAGTTT GCAAAGTGGGGTCCCATCAAAGTTCAGCGGCA GTGGATCTGGGACAGATTTCACTCTCACCATC AGCAGCCTGAGCAGATTATCTTAATTACCGCTCAC TTACTGCCTACATTATCTTAATTACCGCTCAC TTTCGGCGGAGGGACCAAGGTGGAGATCAAA<br><br>SEQ ID NO: 27175 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGAAGT AATAAAAACTATGCAGACTCCGTGAAGGGCCGA TTCACCATCTCCAGAGACACAATTCCAAGAACACGC TGTATCTGCAAATGAACAGCCTGAGAGCGAGG ACACGGCTGTGTATTACTGTGCGAGAGATGGGA TGTCGGGTACAACGGTATGACGTCTGGGGCCA AGGGACCACGGTCACCGTCTCCTCA<br><br>SEQ ID NO: 31181 |
| | | AA | DIQMTQSPSSLSASVGDRVTITCRASQGISNYLA WFQQKPGKAPKSLIYAASSLQSGVPSKFSGSGSG TDFTLTISSLQPEDFATYYCLHYLNYPLTFGGGT RVEIK<br><br>SEQ ID NO: 27176 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDRDV GYNGMDVWGQGTTVTVSS<br><br>SEQ ID NO: 31182 |

FIGURE 50
(Continued)

| | | | | |
|---|---|---|---|---|
| iPS:436516 | 21-225_222C12 | NA | GACATCCAGATGACTCAGTCTCCATCTTCCGT GTCTGCATCTGTAGGAGACAGAGTCACCATCA CTTGTCGGGTGAGTCAGGTATTAGCAGCTGG TTAGCCTGGTATCAGCAGAAACCAGGGAAAG CCCTTAAGCTCGTGATCTATACTGCATCCAATT TGCAAAGTGGGGTCCCATCAAGGTTCAGCGGC AGTGGATCTGGGACAGATTCACTCTCACCAT CAGCAGCGTGCAGCGTGAAGATAACAGTTTGCAACTT ACTATTGTCAACAGATAACAGTTTCCCATTC ACTTTCGGCCGAGGGACCAAAGTGGATATCAA A | CAGGTGCAGCTGGTGCAGTCTGGGGCTGAGGTG AAGAAGCCTGGGGCCTCAGTGAAGGTCTCCTGC AAGACTTCTGGATACACCTTCACCGGCTACTATA TGCACTGGGTGCGACAGGCCCCTGGACAAGGGC TTGAGTGGATGGGATGGATCCACCTAACAGTGG TGGCACAAACTATGCACAGAAATTTCAGGGCAG GGTCACCTGACCAGGGACACGTCCATCAGCAC AGCCTACATGGACCTGAGCAGGCTGAGATCTGA CGACACGGCCGTGTATTACTGTGCGAGAGATGG GACCAGCTCGTTGACTACTGGGGCCAGGGAACC CTGGTCACCGTCTCCTCA |
| | | | SEQ ID NO: 27177 | SEQ ID NO: 31183 |
| | | AA | DIQMTQCPSSVSASVGDRVTITCRVSQGISSWLA WYQQKPGKALKLVIYTASNLQSGVPSRFSGSGS GTDFTLTISSVQREDFATYYCQQDNSFPFTFGRG TKVDIK | QVQLVQSGAEVKKPGASVKVSCKTSGYTFTGYYM HWVRQAPGQGLEWMGWIHPNSGGTNYAQKFQGR VTLTRDTSISTAYMDLSRLRSDDTAVYYCARDGTS SFDYWGQGTLVTVSS |
| | | | SEQ ID NO: 27178 | SEQ ID NO: 31184 |
| iPS:436520 | 21-225_223G10 | NA | GACATCGTGATGACCCAGTCTCCAGACTCCCT GGCTGTGTCTCTGGGCGAGAGGGCCACCATCA ACTGCAAGTCCAGCCAGAGTATTTACTGGCAGC TCCAACAATAAGAACCTACTTAGCTTGGCACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCTGCAA TATTTTAGTACTCCGTGACGTTCGGCCAAGG GACCAAGGTGGAAATCAAA | CAGGTTCAGCTGGTGCAGTCTGGAGCTGAGGTGA AGAAGCCTGGGGCCTCAGTGAAGGTCTCCTGCA AGGCTTCTGGTTTCACCTTTACCAGCTATGTATC AACTGGGTGCGACAGGCCCCTGGACAAGGACTT GAGTGGATGGGATGGATCAGCGTTTACAGTGTA ACACAAAACTATGACCACAGATACATCCAGGGCAGAG TCACCATGACCACAGATACATCCACGAGCACAG CCTACATGGAGCTGAGGAGCCTGAGATCTGACG ACACGGCCGTGTATGACGTCTGTGCGAGAGACTACTA CTACGGTATGGACGTCTGGGGCCAAGGGACCAC GGTCACCGTCTCCTCA |
| | | | SEQ ID NO: 27179 | SEQ ID NO: 31185 |

FIGURE 50
(Continued)

| | | | | |
|---|---|---|---|---|
| | | AA | DIVMTQSPDSLAVSLGERATINCKSSQSILLSSNN KNYLAWHQQKPGQPPKLLIYWASTRESGVPDRF SGSGSGTDFTLTISSLQAEDVAVYYCLQYFSTPW TFGQGTKVEIK SEQ ID NO: 27180 | QVQLVQSGAEVKKPGASVKVSCKASGFTFTSYGIN WVRQAPGQGLEWMGWISVYSGNTNYAQKLQGRV TMTTDTSTSTAYMELRSLRSDDTAVYYCARDYYY GMDVWGQGTTVTVSS SEQ ID NO: 31186 |
| iPS:436522 | 21-225_223H10 | NA | GACATCCAGATGACCCAGTCTCCATCCTCACT GTCTGCATCTGTAGGAGACAGAGTCACCATCA CTTGTCGGGCGAGTCAGGGCATTAGTAATTAT TTGGCCTGGTTTCAGCAGAAACCAGGAAAGC CCCTAAGTCCCTGATCTACGCTGCATCCAATTT GCAAAGTGGGGTCCCATCAAAGTTCAGCGGCA GTGGGTCTGGGACAGATTTTCACTCTCACCATC AGCAGCCTGCAGCCTGAAGATTTTGCAACTTA TTACTGCCTACATTATCTTAATTACCCACTCAC TTTCGGCGGAGGGACCAAGGTGGAGATCAAA SEQ ID NO: 27181 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAAAACTATGCAGACTCCGTGAAGGGCCGA TTCACCATCTCCAGAGACACCATTCCAAGAACACGC TGTATCTGCAAATGAACAGCCTGAGAGCCGAGG ACACGGCTGTGTATTACTGTGCGAGAGATCGGGA TGTCGGGTACAACGGTATGGACGTCTGGGGCCA AGGGACCACGGTCACCGTCTCCTCA SEQ ID NO: 31187 |
| | | AA | DIQMTQSPSSLSASVGDRVTITCRASQGISNYLA WFQQKPGKAPKSLIYAASNLQSGVPSKFSGSGS GTDFTLTISSLQPEDFATYYCLHYLNYPLTFGGG TKVEIK SEQ ID NO: 27182 | QVQLVESGGGVVQPGRSLRLSCAASGFTFSSYGMH WVRQAPGKGLEWVAVIWYDGSNKNYADSVKGRF TISRDHSKNTLYLQMNSLRAEDTAVYYCARDRDV GYNGMDVWGQGTTVTVSS SEQ ID NO: 31188 |

FIGURE 50
(Continued)

| | | | | |
|---|---|---|---|---|
| iPS:436526 | 21-225_224A1 | NA | GACATCCAGATGACCCAGTCTCCATCCTCCT GTCTGCATCTGTAGGAGACAGAGTCACCATCA CTTGCCGGGCAAGTCAGGGACATTGAAAATGAT TTAGGCTGGTATCAGCAGAAGCCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCTGACATAATAGTTACCCGCTC ACTTTCGGCGGTGGGACCAAGGTGGAGATCAA A | GAGGTGCAGGTGTTGGAGTCTGGGGGAGGCTTG GTACAGCCTGGGGGGTCCCTGAGACTCTCCTGT CAGCCTCTGGATTCACCTTTAGCAGCTATGCCAT GAGCTGGGTCCGCCAGGCTCCAGGGAAGGGCT GGAGTGGGTCTCAGCTATTAGTGGCAGAGGCCG CAGCACATACTACGCAGACGCCGTGAAGGGCCG GTTCACCATCTCCAGAGACAATTCCAAGAACACG CTGTATCTGCAAATGAACAGCCTGAGAGCCGAG GACACGGCCGTATATTACTGCGCAAAGGCTCCT ACGATAGTAGTGGTTATTACCACTACTAGACCA CTGGGGCCAGGGAACCCTGGTCACCGTCTCCTCA |
| | | | SEQ ID NO: 27183 | SEQ ID NO: 31189 |
| | | AA | DIQMTQSPSSLSASVGDRVTITCRASQGIENDLG WYQQKPGKAPKRLIYAASSLQSGVPSRFSGSGS GTEFTLTISSLQPEDFATYYCLQHNSYPLTFGGG TKVEIK | EVQVLESGGGLVQPGGSLRLSCAASGFTFSSYAMS WVRQAPGKGLEWVSAISGRGGSTYYADAVKGRFT ISRDNSKNTLYLQMNSLRAEDTAVYYCAKGSYDSS GYYHYLDHWGQGTLVTVSS |
| | | | SEQ ID NO: 27184 | SEQ ID NO: 31190 |
| iPS:436528 | 21-225_224B1 | NA | GACATCCAGATGACCCAGTCTCCATCCTCCCT GTCTGCATCTGTGGGAGACAGAGTCACCATCA CTTGCCGGGCAAGTCAGGGACATTAGTAATGAT TTAGGCTGGTATCAGCAGAAGCCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGTACAGCATAATAGTTATCCTCCT TATCACTGTCTACAGCATAATAGTTATCCTCCT ACTTTCGGCGGAGGGACCAAGGTGGAGATCA AA | GAGGTGCAGGTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTAGTGGTGGT AACACATACTACGCAGACTCCGTGAAGGGCCGG TTCACCATCTCCAGAGACAATTCAAGAACACGC TGTATCTGCACATGAACAGCTGAGAGCCGAGG ACACGGCCGTATATTACTACGGTGTGACGTCTGGGG GCTACTACTAGTTACTACGGTGTGACGTCTGGGG CCAAGGGACCACGGTCACCGTCTCCTCA |
| | | | SEQ ID NO: 27185 | SEQ ID NO: 31191 |

FIGURE 50
(Continued)

| | | | | |
|---|---|---|---|---|
| iPS:436534 | | AA | DIQMTQSPSSLSASVGDRVTITCRASQGISNDLG WYQQKPGKAPKRLIYAASSLQSGVPSRFSGSGS GTEFTLTISSLQPEDFATYHCLQHNSYPPTFGGGT KVEIK<br><br>SEQ ID NO: 27186 | EVQVLESGGGLVQPGGSLRLSCAASGFTFSSYAMS WVRQAPGKGLEWVSAISGSGGNTYYADSVKGRFT ISRDNSKNTLYLHMNSLRAEDTAVYYCAGEGGYY YYYGVDVWGQGTTVTVSS<br><br>SEQ ID NO: 31192 |
| | 21-225_224F1 | NA | GCCATCCAGATGACCCAGTCTCCATCCTCCCT GTCTGCATCTGTAGGAGACAGAGTCACCATCA CTTGCCGGGCAAGTCAGGGCATTAGAGATGAT TTAGGCTGGTATCAGCAGAAACCAGGGAAAG CCCCTAAGCGCCTGATCTATGCTGCATCCAGT TTGCAAAGTGGGGTCCCGTCAAGGATCAGCGG CAGTGGATCTGGGACAGAATTCACTCTCACAA TCAGCAGCCTGCAGCCTGAAGATTTTGCAATT TATTACTGTCTACAGCATTATAGTTACCCTCGG ACGTTCGGCCAAGGGACCAAGGTGGAAATCA AA<br><br>SEQ ID NO: 27187 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATATCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGTA TAGCAGCAACTGGTACGACTACGGTATGGACGTC TGGGGCCAAGGGACCACGGTCACCGTCTCCTCA<br><br>SEQ ID NO: 31193 |
| | | AA | AIQMTQSPSSLSASVGDRVTITCRASQGIRDDLG WYQQKPGKAPKRLIYAASSLQSGVPSRISGSGSG TEFTLTISSLQPEDFAIYYCLQHYSYPRTFGQGTK VEIK<br><br>SEQ ID NO: 27188 | QVQLVESGGGVVQPGRSLRLSCAASGFTFSSYIMH WVRQAPGKGLEWVAVIWYDGSNKYYADSVKGRF TISRDNSKNTLYLQMNSLRAEDTAVYYCARERYSS NWYDYGMDVWGQGTTVTVSS<br><br>SEQ ID NO: 31194 |

FIGURE 50
(Continued)

| | | | |
|---|---|---|---|
| iPS:436536 | 21-225_224G1 | NA | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGGC TTGAGTGGATGGGATGGATCAACCCTTACAGTGG TGACACAAACTATGCACAGGACACGTCCATCAGTGCAG AGTCACCATGACCAGGGACACGTCCATCAGCAC AGCCTACATGAACTGAGCAGGCTGAGATTTGA CGACACGGCCGTGTTTACTGTGCGAGAGATTGG GGTGGCTACAGTTCTTACTACTGGTATGGACG TCTGGGGCCAAGGGACCACGGTCACCGTCTCTC A |
| | | | GATATTGTGATGACCCAGACTCCACTCTCT GTCCGTCACCCCTGGACAGCCGGCCTCCATCT CCTGCAAGTCTGGTCAGAGCCTCCTGCATAGT GATGGAAAGAACCTTTGTCTTGGTACCTGCA GAAGCCAGGCCAGCCTCCACAGCTCCTGATCT ATGAAATTTCCAACCGGTTCTCTGAGTGCCA GATAGGTTCAGTGGCAGCGGGTCAGGGACAG ATTTCACACTGAAATCAGCCGGTGGGGAGGCT GAGGATGTTGGGATTTTTACTGCATGCAAAG TACACAGTCTCCTCGACGTTCGGCCAAGGGA CCAAGGTGGAAATCAAA | SEQ ID NO: 31195 |
| | | | DIVMTQTPLSLSVTPGQPASISCKSGQSLLHSDG KTFLSWYLQKPGQPPQLLIYEISNRFSGVPDRFSG SGSGTDFTLKISRVEAEDVGIFYCMQSTQLPRTF GQGTKVEIK |
| | | | SEQ ID NO: 27189 | QVQLVQSGAEVKKPGASVKVSCKASGYTFTGYYIH WVRQAPGQGLEWMGWINPYSGDTNYAQKFQGRV TMTRDTSISTAYMELSRLREDDTAVFYCARDWGG YSSYYYGMDVWGQGTTVTVSS |
| | | AA | SEQ ID NO: 27190 | SEQ ID NO: 31196 |
| iPS:436538 | 21-225_224C3 | NA | GACATCCAGATGACCCAGTCCATCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGCTACATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA | CAGCTGCAGCTGCAGGAGTCGGGCCCAGGACTG GTGAAGTCTTCGGAGACCCTGTCCCTCACCTGCA CTGTCTCTGGCGGCTCCATCAGCAGAAGTAGTTA CTACTGGGGCTGGATCCGCCAGCCCCCAGGGAA GGGGCTGGAGTGGATTGGGAATATCTATTATAGT GGGAGCACCTACTACAACCCGTCCCTCAAGAGTC GAGTCACCATATCCGTAGACACGTCCAAGAACC AGTTCTCCCTGAAGCTGAGCTCTGTGACCGCCGC AGACACGGCTGTGTATTACTGTGCGAGACAGGGT CGGGACTGGGGTGTTGACTACGGGGGCCAGGGA ACCCTAGTCACCGTCTCTCA |
| | | | SEQ ID NO: 27191 | SEQ ID NO: 31197 |

FIGURE 50
(Continued)

| | | | |
|---|---|---|---|
| iPS:436540 | 21-225_224F3 | AA | DIQMTQSPSSLSASVGDRVTITCRASQDIRNDLG WYQQKPGKAPKRLIYATSSLQSGVPSRFSGSGSG TEFTLTISSLQPEDFATYYCLQHNSYPLTFGGGT KVEIK<br>SEQ ID NO: 27192 | QLQLQESGPGLVKSSETLSLTCTVSGGSISRSSYYW GWIRQPPGKGLEWIGNIYYSGSTYNPSLKSRVTIS VDTSKNQFSLKLSSVTAADTAVYYCARQGRDWGV DYGGQGTLVTVSS<br>SEQ ID NO: 31198 |
| | | NA | GACATCCAGATGACCCAGTCTCCATCCTCCCT GTCTGCATCTGTAGGAGACAGAGTCACCATCA CTTGCCGGGCAAGTCAGGGACATTAGAAATGAT TTAGGCTGGTATCAACAGAAACCAGGGAAAG CCCCTGAGCGCCTGATCTATGCTGCATCCAGT TTGCAAAGTGGGGTCCCATCCAAGGTTCAGCGG CAGTGGATCTGGGACAGAATTCACTCTCACAA TCAGCAGCCTGCAGCCTGAAGATTTTGCAACT TATTACTGTCTCTTCAGCATTATAATTACCTCGG GCGTTCGGCCAAGGGACCAAGGTGGAAATCA AA<br>SEQ ID NO: 27193 | CAGGTGCAGCTGCTGGTGGAGTCTGGGGGAGGCGTG GTCCAGCCTGGGAGGTCCCTGAGACTCTCCTGTG CAGCGTCTGGATTCAGCTTCAGTAGCTATGGCAT GCACTGGGTCCGCCAGGCTCCAGGCAAGGGCT GGAGTGGGTGGCAGTTATATGCAGACTCCGTGAAGT AATAAATACTATGCAGAGACAATTCAAGAACACGC TTCACCATCTCCAGAGACAATTCAAGAACACGC TGTATCTGCAAATGAACAGCTGAGAGCCGAGG ACACGGCTGTGTATTACTGTGCGAGAGAGGTA TAGCAGCAGCTGTACGACTACGGTATGACGTC TGGGGCCAAGGGACCACGGTCACCGTCTCCTCA<br>SEQ ID NO: 31199 |
| | | AA | DIQMTQSPSSLSASVGDRVTITCRASQGIRNDLG WYQQKPGKAPERLIYAASSLQSGVPSRFSGSGSG TEFTLTISSLQPEDFATYYCLQHYNYPRAFGQGT KVEIK<br>SEQ ID NO: 27194 | QVQLVESGGGVVQPGRSLRLSCAASGFSFSSYGMH WVRQAPGKGLEWVAVIWYDGSNKYYADSVKGRF TISRDNSKNTLYLQMNSLRAEDTAVYYCARERYSS SWYDYGMDVWGQGTTVTVSS<br>SEQ ID NO: 31200 |

FIGURE 50
(Continued)

| | | | | |
|---|---|---|---|---|
| iPS:436544 | 21-225_224H5 | NA | GACATCGTGATGACCCAGTCTCCAGACTCCCT GGCTGTGTCTCTGGGCGAGAGGGCCACCATCA ACTGCAAGTCCAGCCAGAGTGTTTTATACAGC TCCAACAATTCAACTACTTAACTTGGTATCA GCAGAAACCAGGACAGCCTCCTAAGTTGCTCA TTTACTGGGCATCTACCCGGAATCCGGGGTC CCTGACCGATTCAGTGGCAGCGGGTCTGGGAC AGATTTCACTCTCACCATCAACAGCCTGCAGG CTGAAGATGTGGCAGTTTATTACTGTCAGCAA TATTATAGTACTCCTCCGACGTTCGGCCAAGG GACCAAGGTGGAAATCAAA<br><br>SEQ ID NO: 27195<br><br>DIVMTQSPDSLAVSLGERATINCKSSQSVLYSSN NFNYLTWYQQKPGQPPKLLIYWASTRESGVPDR FSGSGSGTDFTLTINSLQAEDVAVYYCQQYYSTP PTFGQGTKVEIK<br><br>SEQ ID NO: 27196 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCGAGTTCCAG TGGCTGGAACTGGTTCGACCCCTGGGGCCAGGG AACCCTGGTCACCGTCTCCTCA<br><br>SEQ ID NO: 31201<br><br>QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCASSSGW NWFDPWGQGTLVTVSS<br><br>SEQ ID NO: 31202 |
| iPS:436546 | 21-225_224D6 | NA | GACATCCAGATGACCCAGTCTCCATCTTCCGT GTCTGCATCTGTAGGAGACAGAGTCACCATCA CTTGTCGGGCGAGTCAGGGTATTAGCAGCTGG TTAGCCTGGTATCAGCAGAAACCAGGGAAAG CCCCTAAGCTCCTGATCTATGCTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCGTGG ACGTTCGGCCCCAGGGACCAAGGTGGAAATCA AA<br><br>SEQ ID NO: 27197 | GAGGTGCAGGTGTTGGAGTCTGGGGGAGGCTTG GTACAGCCTGGGGGGTCCCTGAGACTCTCCTGTG CAGCCTCTGGAATCCACCTTTAGCAGGATGCCAT GAGCTGGGTCCGCCAGGCTCCAGGGAAGGGGCT GGAGTGGGTCTCAGCTATTAGTGGTAGTGGTGAT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGAAAGTCTATAGT GCCTACGATTCTCACTGGTTCGACCCTGGGGCC AGGGAACCCTGGTCACCGTCTCCTCA<br><br>SEQ ID NO: 31203 |

FIGURE 50
(Continued)

| | | | | |
|---|---|---|---|---|
| | | | AA | DIQMTQSPSSVSASVGDRVTITCRASQGISSWLAWYQQKPGKAPKLLIYAASSLQSGVPSRFSGSGSGTDFTLTISSLQPEDFATYYCQQANSFPWTFGPGTKVEIK<br>SEQ ID NO: 27198 | EVQVLESGGGLVQPGGSLRLSCAASGSTFSSDAMSWVRQAPGKGLEWVSAISGSGDNTFYADSVKGRFTISRDNSKNTLYLQMNSLRAEDTAVYYCAKVYSAYDSHWFDPWGQGTLVTVSS<br>SEQ ID NO: 31204 |
| iPS:436548 | 21-225_224A7 | | NA | GATATTGTGATGACCCAGACTCCACTCTCTCTGTCCGTCACCCCTGGACAGCCGGCCTCCATCTCCTGCAAGTCTAGTCAGAGCCTCCTGCATAGTGATGGAAAGACCTTTTTGTATTGGTTCCTGCAGAAGCCAGGCCAGCTCCACAGCTCCTGATCTATGAAATTTCCAACCGGTTCTCTGGAGTGCCAGATAGGTTCAGTGGCAGCGGGTCAGGGACAGATTTCACACTGAAAATCAGCCGGATGGAGGCTGAGGATGTTGGGATTTATTACTGCATGCAAAGTACACAGCTTCCTCCGGACGTTCGGCCAAGGGACCAAGGTGGAAATCAAA<br>SEQ ID NO: 27199 | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTATATACACTGGGTGCGACAGGCCCCTGGACAAGGGCTTGAGTGGATGGGATGGATCAACCCTTACAGTGGTGACACAAACTATGCACCAGGGACAGTCCATCACCACGGTCACCATGACCAGGAACTGAGCAGGCTGAGATTTGAAGCCTACATGGAACTGAGCAGGCTGAGATTTGACGACACGGCCGTGTTTTACTGTGCGAGAGATTGGGGTGGCTACAGTTCTTACTACTACGGTATGGACGTCTGGGGCCAAGGGACCACGGTCACCGTCTCTTCA<br>SEQ ID NO: 31205 |
| | | | AA | DIVMTQTPLSLSVTPGQPASISCKSSQSLLHSDGKTFLYWFLQKPGQPPQLLIYEISNRFSGVPDRFSGSGSGTDFTLKISRVEAEDVGIYYCMQSTQLPRTFGQGTKVEIK<br>SEQ ID NO: 27200 | QVQLVQSGAEVKKPGASVKVSCKASGYTFTGYYIHWVRQAPGQGLEWMGWINPYSGDTNYAQKFQGRVTMTRDTSITTAYMELSRLRFDDTAVFYCARDWGGYSSYYYGMDVWGQGTTVTVSS<br>SEQ ID NO: 31206 |

FIGURE 50
(Continued)

| | | | | |
|---|---|---|---|---|
| iPS:436550 | 21-225_224D8 | NA | GACATCGTGATGACCCAGTCTCCAGACTCCCT GGCTGTTTCTCTGGGCGAGAGGGCCGCCATCA ACTGCAAGTCCAGCCAGAGTGTTTTATACAGC TCCAACAATAAGAACTACTTAGCTTGGTACCA GCAGAAACCAGGACAGCCTCCTAAGCTGCTCA TTTATTGGTCGTCTACCCGGAAATCCGGGTC CCTGACGGATTCAGTGGCAGCGGGTCTGGGAC AGATTTCACTCTCACCATCAGCAGCCTGCAGG CTGAAGATGTGGCAGTTTATTACTGTCAGCAA TATTTTAGTACTCCTCCGACGTTCGGCCAAGG GACCAAGGTGGAAATCAAA SEQ ID NO: 27201 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGTTGTACCTAACAGTGG TAACACAGGCTATGCACAGAAGTTCCAGGCAG AGTCACCATGACCAGGAACACCTCCATAAGCAC AGCCTACATGGAGCTGAGCAGCCTGAGATCTGA GGACACGGCCGTGTATTACTGTGCTTATAGCAGT GGCTGGTACTACTTTGACTACTGGGGCCAGGGAA CCCTGGTCATCGTCCTCA SEQ ID NO: 31207 |
| | | AA | DIVMTQSPDSLAVSLGERAAINCKSSQSVLYSSN NKNYLAWYQQKPGQPPKLLIYWSSTRKSGVPD RFSGSGSGTDFTLTISSLQAEDVAVYYCQQYFST PPTFGQGTKVEIK SEQ ID NO: 27202 | QVQLVQSGAEVKKPGASVKVSCKASGYTFTNYDIN WVRQATGQGLEWMGWLYPNSGNTGYAQKFQGR VTMTRNTSISTAYMELSSLRSEDTAVYYCAYSSGW YYFDYWGQGTLVISS SEQ ID NO: 31208 |
| iPS:436554 | 21-225_224C10 | NA | GACATCGTGATGACCCAGTCTCCAGACTCCCT GGCTGCGTCTCTGGGCGAGAGGGCCACCATCA CCTGCAAGTCCAGCCAGAGTGTTTTATACAAT TCCAACAATAAGAACTACTTAGCTTGGTACCA GCAGAAACCAGGACAGCCTCCTAAGCTGCTCA TTTACTGGGCATCTACCCGGGAGTCCGGGGTC CCTGACGGATTCAGTGGCAGCGGGTCTGGGAC AGTCACCATGACCATCAGCAGCCTGCAGG CTGAAGATGTGGCAATTTATTACTGTCAACAA TATTATATTAATCCGTGCAGTTTTGGCCAAGG GACCAGGCTGGAGATCAAA SEQ ID NO: 27203 | CAGGTGCAGCTGGTGCAGTCTGGGGCTGAGGTG AAGAAGCCTGGGGCCTCAGTGAAGGTCTCCTGC AAGGCTTCTGGATCCACCTTCACCAATTATGATA TCAACTGGGTGCGACAGGCCACTGGACAAGGC TTGAGTGGATGGGATGCACAGAAGTTCCAGGCAG AGTCACCATGACCAGGAACACCTCCATAAGCAC AGCCTACATGGAGCTGAGCAGCCTGAGATCTGA GGACACGGCCGTGTATTACTGTGCCTATAGCAGT GGCTGGTACAAGTTTGACTACTGGGGCCAGGGA ACCCTGGTCACCGTCCTCA SEQ ID NO: 31209 |

FIGURE 50
(Continued)

| | | | | |
|---|---|---|---|---|
| | | | AA | DIVMTQSPDSLAASLGERATITCKSSQSVLYNSN NKNYLAWYQQKPGQPPKLLIYWASTRESGVPD RFSGSGSGTDFTLTISSLQAEDVAIYYCQQYYINP CSFGQGTRLEIK<br>SEQ ID NO: 27204 | QVQLVQSGAEVKKPGASVKVSCKASGSTFTNYDIN WVRQATGQGLEWMGWMHPNSGNTGYAQKFQGR VTMTRNTSISTAYMELSSLRSEDTAVYYCAYSSGW YKFDYWGQGTLVTVSS<br>SEQ ID NO: 31210 |
| iPS:436556 | 21-225_224D10 | | NA | GACATCCTGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTACAAAGTGGGGTCCCATGCGGTTCAGCGG CAGTGGATCTGGGACAGAATTCACTCTCACAA TCAGCAGCCTGCAGCCTGAAGATTTTGCAACT TATTACTGTCTACAACATAATAGTTACCCGTC ACTTTTGGCGGAGGGACCAAGGTGGAGATCA AA<br>SEQ ID NO: 27205 | CAGGTGCAGCTGGTGGAGTCTGGGGGAGGCCTG GTCCAGCCTGGGAAAGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGAGGGAAG TAATAAATACTATGTAGACTCCGTGAGGGCCGA TTCACCATCTCCAGAGACAATTCCAAGAGTACGC TGTATCTGCAAATGAACAGCCTGCGAGCCGAGG ACACGGCTGTGTATTACTGTGTGAGAGAGCTAGG CTTCCAGTCTGACTACTGGGGCCAGGGAACCCCG GTCACCGTCTCCTCA<br>SEQ ID NO: 31211 |
| | | | AA | DILMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br>SEQ ID NO: 27206 | QVQLVESGGGLVQPGKSLRLSCAASGFTPSSYGMH WVRQAPCKGLEWVAVIWYEGSNKYYVDSVRGRF TISRDNSKSTLYLQMNSLRAEDTAVYYCVRELGFQ SDYWGQGTPVTVSS<br>SEQ ID NO: 31212 |

FIGURE 50
(Continued)

| | | | |
|---|---|---|---|
| iPS:436558 | 21-225_224C11 | NA | GATTTTGTGATGACCCAGACTCCACTCTCTG TCCGTCACCCCTGGACAGCCGGCCTCCATCTC CTGCAAGTCTAGTCAGAGCTCCTGCATAGTG ATGGAAAGACCTTTTGTATTGGTACTGCAG AAGCCAGGCCAGCCTCCACAGCTCCTGATCTA TGAAATTTCCAACGGTTCTCTGGAGTGCCAG ATAGGTTCAGTGGCAGCGGGTCAGGACAGA TTTCACACTGAAAATCAGCCGGGTGGAGGCTG AGGATGTTGGGATTTATTACTGCATGCAAAGT ACACAGTCTCCTCGGACGTTCGGCCAAGGGAC CAAGGTGGAAATCAAA<br><br>SEQ ID NO: 27207 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGGC TTGAGTGGATGGGATGGATCAACCCTTACAGTGG TGACACAAACTATGCACAGGGACACGTCATCAGCAC GGTCACCATGACCAGGGACACGTCATCAGCAC AGCCTACATGAACTGAGCAGCCTGAGATTTGA CGACACGGCCGTGTTTTACTGTGCGAGAGATTGG GGTGGCTACAGTTCTTACTACTTCGGTATGGACG TCTGGGGCCAAGGGACCACGGTCACCGTCTCTC A<br><br>SEQ ID NO: 31213 |
| | | AA | DFVMTQTPLSLSVTPGQPASISCKSSQSLLHSDG KTFLYWYLQKPGQPPQLLIYEISNRFSGVPDRFS GSGSGTDFTLKISRVEAEDVGIYYCMQSTQLPRT FGQGTKVEIK<br><br>SEQ ID NO: 27208 | QVQLVQSGAEVKKPGASVKVSCKASGYTFTGYYIH WVRQAPGQGLEWMGWINPYSGDTNYAQKFQGRV TMTRDTSISTAYMELRRLRFDDTAVFYCARDWGG YSSYYFGMDVWGQGTTVTVSS<br><br>SEQ ID NO: 31214 |
| iPS:436560 | 21-225_224F11 | NA | AACATCGTGATGACCCAGACTCCACTCTCCT GGCTGTGTCTCTGGACGAGAGGGCCACCATCA ACTGCAAGTCCAGCCAGAGTGTTTTATCCAGC TCCAACAATCACAACTACTTAGCTTGGTACCA GCAGAAACCAGGACAGCCTCCTAAGATGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATACTACTCCGTGCAGTTTTGGCCAGGG GACCAAGCTGGAGATCAAA<br><br>SEQ ID NO: 27209 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTACAAGTTGACTACTGTGCCTATAGCAG TGGCTGGTACAAGTTGACTACTGGGGCCAGGGA ACCCTGGTCACCGTCTCCTCA<br><br>SEQ ID NO: 31215 |

FIGURE 50
(Continued)

| | | AA | NIVMTQSPDSLAVSLDERATINCKSSQSVLSSSN NHNYLAWYQQKPGQPPKMLIYWASTRESGVPD RFSGSGSGTDFTLTISSLQAEDVAVYYCQQYYTT PCSFGQGTKLEIK<br>SEQ ID NO: 27210 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCAYSSGW YKFDYWGQGTLVTVSS<br>SEQ ID NO: 31216 |
|---|---|---|---|---|
| iPS:436562 | 21-225_224H11 | NA | GATATTGTGATGACCCAGACTCCACTCTCTCT GTCCGTCACCCCTGGACAGCCGGCCTCCATCT CCTGCAAGTCTAGTCAGAGCCTCCTGCATAGT GATGGAAAGAACCTTTTGTATTGGTACCTGCA GAAGCCAGGCCAGCTCCAACCGGTTCTCTGGAGTCCCA ATGAAATTCCAACCGGTTCTCTGGAGTGCCA GATAGGTTCAGTGGCAGCGGGTCAGGGACAG ATTTCACACTGAAATCAGCCGGGTGGAGGCT GAGGATGTTGGGATTTATTACTGCATGCAAAG TACACAGCTTCCTGGACGTTCGGCCAAGGGA CCAAGGTGGAAATCAAA<br>SEQ ID NO: 27211 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGGC TTGAGTGGATGGGATGGATCAACCTTACAGTGG TGACACAAACTATGCACAGAAGTTCAGGGCAG GGTCACCATGACCAGGAACACGTCCATCAGCAC AGCCTACATGGAACTGCGCAGGCTGAGATTTGAC GACACGGCCGTCTTTTACTGTGCGGAGAGATTGGG GTGGCTACAGTTCTTACTACTACGGTATGGACGT CTGGGGCCAAGGGACCACGGTCACCGTCTCTTCA<br>SEQ ID NO: 31217 |
| | | AA | DIVMTQTPLSLSVTPGQPASISCKSSQSLLHSDGK TFLYWYLQKPGQPPQLLIYEISNRFSGVPDRFSGS GSGTDFTLKISRVEAEDVGIYYCMQSTQLPRTFG QGTKVEIK<br>SEQ ID NO: 27212 | QVQLVQSGAEVKKPGASVKVSCKASGYTFTGYYIH WVRQTPGQGLEWMGWINPYSGDTNYAQKFQGRV TMTRDTSISTAYMELRLRFDDTAVFYCARDWGG YSSYYYGMDVWGQGTTVTVSS<br>SEQ ID NO: 31218 |

FIGURE 50
(Continued)

| | | | |
|---|---|---|---|
| iPS:436564 | 21-225_225A1 | NA | GACATCAGATGACCCAGTCTCCATCCTCCCT GTCTGCATCTGTAGGAGACAGAGTCACCATCA CTTGCCGGGCAAGTCAGGGCATTAGAGATGAT TTAGGCTGGTATCAGCAGATACCAGGGAAAGC CCCTAAGCGCCTGATCTATGCTGCATCCAGTTT GCAAAGTGGGGTCCATCAAGGTTCAGCGGCA GTGGATCTGGGACAGAATTCACTCTCACAATC AGCAGCCTGCAGCCTGAAGATTTTGCAACTTA TTACTGTCTGCAGCATTATAGTTACCCTCGGAC GTTCGGCCAAGGGACCAAGGTGGAAATCAAA<br>SEQ ID NO: 27213 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT CCACTGGGTCCGCCAGGCTCCAGGCAAGGGGCT GGAGTGGGTGGCAGTTATATGGTATGGAAGT AATAAATACTATGCAGACTCCGTGAAGGGCCGA TTCACCATCTCCAGAGACAATTCAAGAACACGC TGTATCTGCAAATGAACAGCCTGAGAGCCGAGG ACACGGCTGTGTATTACTGTGCGAGAGAGAGTA TAGCAGTGGCTGGTACGACTACGGTATGGACGTC TGGGGCCAAGGGACCACGGTCACCGTCTCCTCA<br>SEQ ID NO: 31219 |
| | | AA | DIQMTQSPSSLSASVGDRVTITCRASQGIRDDLG WYQQKPGKAPKRLIYAASSLQSGVPSRFSGSGSG TEFTLTISSLQPEDFATYYCLQHYSYPRTFGQGT KVEIK<br>SEQ ID NO: 27214 | QVQLVESGGGVVQPGRSLRLSCAASGFTFSDYVIH WVRQAPGKGLEWVAVIWYDGSNKYYADSVKGRF TISRDNSKNTLYLQMNSLRAEDTAVYYCARERYSS GWYDYGMDVWGQGTTVTVSS<br>SEQ ID NO: 31220 |
| iPS:436568 | 21-225_225B3 | NA | GAAATTGTGCTGACGCAGTCTCCAGGCACCCT GTCTTTGTCTCCAGGGGAAAGAGCCACCCTCT CCTGCAGGGCCAGTCAGAATCTTAGCAGCAGC TACTTAGGCTGGTACCAGCAGAAACCTGGCCA GGCTCCCAGACTCCTCATCTATGATACATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGGAGTATGGTAGCTCACTC ATGTGCAGTTTTGGCCAGGGGACCAAGCTGGA GATCAAA<br>SEQ ID NO: 27215 | CAGGTGCAACTGGTGCAGTCTGGGGCTGAGGTG AAGAAGCCTGGGGCCTCAGTGAAGGTTCCTGCA AGGCATCTGGATACACCTTCACCAGCTACTATAT GCACTGGGTGCGACAGGCCCCTGGACAAGGGCT TGAGTGGATGGGAATAATCAACCCTAGTGGTGGT AGCACAAGCTACGCACAGAAGTTCCAGGGCAGA GTCACCATGACCAGGGACACGTCCACGAGCACA ACACGGCCGTGTATTACTGTGCGAGGATTTAGC AGCTCGTTCGTTCTTACTACTACTACTACTTCGGTATGAC GTCTGGGGCCAAGGGGCCACGGTCACCGTCTCCT CA<br>SEQ ID NO: 31221 |

FIGURE 50
(Continued)

| | | | | |
|---|---|---|---|---|
| | | AA | EIVLTQSPGTLSLSPGERATLSCRASQNLSSSYLG WYQQKPGQAPRLLIYDTSSRATGIPDRFSGSGSG TDFTLTISRLEPEDFAVYYCQEYGSSLMCSFGQG TKLEIK<br>SEQ ID NO: 27216 | QVQLVQSGAEVKKPGASVKVSCKASGYTFTSYYM HWVRQAPGQGLEWMGIINPSGGSTSYAQKFQGRV TMTRDTSTSTVYMELSSLRSADTAVYYCARDLAAR SYYYFGMDVWGQGATVTVSS<br>SEQ ID NO: 31222 |
| iPS:436570 | 21-225_225F4 | NA | GACATCGTGATGACCCAGTCTCCAGACTCCCT GGCTGTGTCTCTGGGCGAGAGGGCCACCATCA ACTGCAAGTCCAGCCAGAGTGTTTATATAGC TCCAACAATAAGAACTACTTAGCTTGGTACCA GCAGAAACCAGGACAGCCTCCTAAACTACTCA TTTACTGGGCATCTACCCGGGAATCCGGGGTC CCTGACCGATTCACTGGCAGCGGGGTCTGGGAC AGATTTCACTCTCACCATCAGCTGCGTGCAGC CGGAAGATGTGGCAGTTTATTACTGTCACCAA TATCATATTCTCCTCCCACTTTCGGCCACGGG ACCGAAGTGGATATCAAA<br>SEQ ID NO: 27217 | CAGGTGCAGCTGGTGCAGTCTGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TAGCACAGGCTATGCACAGAAGTTCCAGGGCAG ACTCACCATGACCAGAAACACCTCCATAAGCAC AGTCTACATGGAACTGAACAGCCTGAGATCTGA GGACACGGCCGTGTATTATTGTGCGAGTAGCAGT GGCTGGTACTGGTTCGACCCCTGGGGCCAGGA ACCCTGGTCACCGTCTCCTCA<br>SEQ ID NO: 31223 | |
| | | AA | DIVMTQSPDSLAVSLGERATINCKSSQSVLYSSN NKNYLAWYQQKPGQPPKLLIYWASTRESGVPD RFTGSGSGTDFTLTISCVQPEDVAVYYCHQYHN SPPTFGHGTEVDIK<br>SEQ ID NO: 27218 | QVQLVQSGAEVKKPGASVKVSCKASGYTFTNYDIN WVRQATGQGLEWMGWMHPNSGSTGYAQKFQGR LTMTRNTSISTVYMELNSLRSEDTAVYYCASSSGW YWFDPWGQGTLVTVSS<br>SEQ ID NO: 31224 |

FIGURE 50
(Continued)

| | | | | |
|---|---|---|---|---|
| iPS:436572 | 21-225_225G4 | NA | GATATTGTGATGACCCAGACTCCACTCTCT GTCCGTCACCCCTGGACAGCCGGCCTCCATCT CCTGCAAGTCTAGTCAGAGCCTCCTGCATAGT GATGGAAAGACCTTTTTGTATTGGTACCTGCA GAAGCCAGGCCAGTCTCCACAGCTCCTGATCT ATGAAATTTCAACCGGTTCTCTGGAGTGCCA GATAGGTTCAGTGGCAGCGGGTCAGGGACAG ATTTCACACTGAAAATCAAGAGCCGGTGGAGGCT GAGGATGTTGGGATTTATTACTGCATGCAAAG TACACAGTTCCTCCGACGTTCGGCCAAGGA CCAAGGTGGAAATCAAA SEQ ID NO: 27219 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGGC TTGAGTGGATGGGATGGATCAACCCTTACAGTGG TGACACAAACTATGCACAGAAGTTTCAGGGCAG GGTCACCATGACCAGGGACACGTCATCAGCAC AGCCTACATGGAACTGCGCAGGCTGAGATTTGAC GACACGGCCGTCTTTACTGTGCGAGAGATTGG GTGGCTACAGTTCTTACTACTACGGTATGGACGT CTGGGGCCAAGGGACCACGGTCACCGTCTCTCA SEQ ID NO: 31225 |
| | | AA | DIVMTQTPLSLSVTPGQPASISCKSSQSLLHSDGK TFLYWYLQKPGQPPQLLIYEISNRFSGVPDRFSGS GSGTDFTLKISRVEAEDVGIYYCMQSTQLPRTFG QGTKVEIK SEQ ID NO: 27220 | QVQLVQSGAEVKKPGASVKVSCKASGYTFTGYYIH WVRQAPGQGLEWMGWINPYSGDTNYAQKFQGRV TMTRDTSISTAYMELRRLRFDDTAVFYCARDWGG YSSYYYGMDVWGQGTTVTVSS SEQ ID NO: 31226 |
| iPS:436574 | 21-225_225F5 | NA | GACATCGTGATGACCCAGTCTCCAGACTCCCT GGCTGTGTCTCTGGGCGAGAGGGCCACCATCA ACTGCAAGTCCAGCCAGAGAATGTTTTATACAAC TCCAACAATAACAACTACTTAGCTTGGTACCA GCAGAAACCAGGACAGCCTCCTAACCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTTCTGTCAGCAA TATTATAGTTCTCCTCCGACGTTCGGCCAAGG GACCAAGGTGGAAATCAAC SEQ ID NO: 27221 | CAGGTGCAGCTGGTGCAGTCTGGGGCTGAGGTG AAGAAGCCTAGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCATCCTAACAGTGG TAACACAGGCTTTGCACAGAAGTTCCAGGGCAG AGTCACCATGACCAGGGAACACCTCATAAGCAC AGCCTACATGGAGCTGAGCAGCCTGAGATCTGA GGACACGGCCGTGTATTACTGTGCATATAGCAGT GGCTGGTACCGCTTTGACTACTGGGGCCAGGGAA CCCTGGTCACCGTCTCCTCA SEQ ID NO: 31227 |

FIGURE 50
(Continued)

| | | | |
|---|---|---|---|
| | | AA | DIVMTQSPDSLAVSLGERATINCKSSQNVLYNSN NNNYLAWYQQKPGQPPNLLIYWASTRESGVPD RFSGSGSGTDFTLTISSLQAEDVAVYFCQQYSSS PPTFGQGTKVEIN<br>SEQ ID NO: 27222 | QVQLVQSGAEVKKPRASVKVSCKASGHTFTNYDIN WVRQATGQGLEWMGWMHPNSGNTGFAQKFQGR VTMTRNTSISTAYMELSSLRSEDTAVYYCAYSSGW YRFDYWGQGTLVTVSS<br>SEQ ID NO: 31228 |
| iPS:436576 | 21-225_225B6 | NA | GACATCCAGATGACCCAGTCTCCATCTCCCT GTCTGCATCTGTAGGAGACAGAGTCATCATCA CTTGCCGGGCAAGTCAGGGCATGAGAAAAGA TTTAGGCTGGTATCAGCAGAAACCAGGGAAA GCCCCTAAGCGCCTGATCTATGCTGCAACCAG TTTGCAAAGTGGGGTCCCATCAAGGTTCAGCG GCAGTGGATCTGGGACAGAATTCACTCTCACA ATCAGCAGCCTGCAGCCTGAAGATTTTGCAAC TTATTACTGTCTACAGCATAATAGTTATCCATT CACTTTCGGCCCTGGGACCAAAGTGGATATCA AA<br>SEQ ID NO: 27223 | CAGGTGCGGCTGGTGGAGTCTGGGGAGGCGTG GTCCAGCCTGGGAGGTCCCTGAGACTCTCTGTG CAGCGTCTGGATTCACCTTCAGTGACTATGCAT GCACTGGGTCCGCCAGGCTCCAGGCAAGGGCT GGAGTGGGTGGCAGTTATATGGTATGAAGAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAAGTGGG ATTCACTGAGGACTACTGGGGCCAGGAACCCT GGTCACCGTCTCTCA<br>SEQ ID NO: 31229 |
| | | AA | DIQMTQSPSSLSASVGDRVIITCRASQGMRKDLG WYQQKPGKAPKRLIYAATSLQSGVPSRFSGSGS GTEFTLTISSLQPEDFATYYCLQHNSYPFTFGPGT KVDIK<br>SEQ ID NO: 27224 | QVRLVESGGGVVQPGRSLRLSCAASGFTFSDYGMH WVRQAPGKGLEWVAVIWYDENNKYYADSVKGRF TISRDNSKNTLYLQMNSLRAEDTAVYYCAREVGFT EDYWGQGTLVTVSS<br>SEQ ID NO: 31230 |

FIGURE 50
(Continued)

| | | | | |
|---|---|---|---|---|
| iPS:436578 | 21-225_225D6 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTACAAAGTGGGGTCCCATCAAGGTTCAGCGG CAGTGGATCTGGGACAGAATTCACTCTCACAA TCAGCAGCCTGCAGCCTGAAGATTTTGCAACT TATTGCTGTCTTCAGCATAATACTTACCCATTC ACTTTCGGCCCTGGGACCAAAGTGGATATCAA A | CAGGTGCAGCTGGTGGAGTCTGGGGGAGGCGTG GTCCAGCCTGGGAGGTCCCTGAGACTCTCCTGTG CAGCGGTCTGGATTCACCTTCAGTAACTATGGCAT GCACTGGGTCCGCCAGGCTCCAGGCAAGGGCT GGAGTGGGTGGCAGTTATATGCAGATCCGTGATGAAAAT AATAAATACTATGCAGATCCGTGAAGGCCGA TTCACCATCTCCAGAGACAATTCCCAGAACACGC TGTATCTGCAAATGACCAGCCTGAGAGCCGAGG ACACGGCTGTGTATTACTGTGCGAGAGAAGTGGG ATTCACTGAGGACTACTGGGGCCAGGGAACCCT GGTCACCGTCTCCTCA |
| | | AA | DIQMTQSPSSLSASVGDRVTITCRASQGIRNDLG WYQQKPGKAPKRLIYAASSLQSGVPSRFSGSGS GTEFTLTISSLQPEDFATYCCLQHNTYPFFGPGT KVDIK | QVQLVESGGGVVQPGRSLRLSCAASGFTFSNYGM HWVRQAPKGLEWVAVIWYDENNKYYADSVKGR FTISRDNSQNTLYLQMTSLRAEDTAVYYCAREVGF TEDYWGQGTLVTVSS |
| | | | SEQ ID NO: 27225 | SEQ ID NO: 31231 |
| iPS:436580 | 21-225_225E7 | NA | GAAATTGTGTTGACGCAGTCTCCAGGCACCCT GTCTTTGTCTCCAGGGGAAAGAGCCACCCTCT CCTGCAGGGCCAGTCAGTCTTTACAGCAGC TACTTAGCCTGGTACCAGCAGAAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TATATTACTGTCAGCAGTATGGTACCTCACCTC GGACGTTCGGCCAAGGGACCAAGGTGGAAAT CAAA | CAGGTGCAGCTGCAGGAGTCGGGCCCAGGACTG GTGAAGCCTTCACAGACCCTGTCCCTCACCTGCA CTGTCTCTGGTAACTCCATCAGCAGTGGTCATTA CTACTGGAGCTGGATCCGCCAGCACCCAGGGAA GGGCCTGGAGTGGATTGGGTTCATCTATTACACT GGGAGCACCTACTACAACCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGAGGCC GGTGACTACGGCTACTACGGTATGGACGTCTGGG GCCAAGGGACCACGGTCACCGTCTCCTCA |
| | | | SEQ ID NO: 27227 | SEQ ID NO: 31233 |

FIGURE 50
(Continued)

| | | AA | EIVLTQSPGTLSLSPGERATLSCRASQSVYSSYLA WYQQKPGQAPRLLIYGASSRATGIPDRFSGSGSG TDFTLTISRLEPEDFAVYYCQQYGTSPRTFGQGT KVEIK | QVQLQESGPGLVKPSQTLSLTCTVSGNSISSGHYYW SWIRQHPGKGLEWIGFIYYTGSTYYNPSLKSRVTIS VDTSKNQFSLKLSSVTAADTAVYYCAREAGDYGY YGMDVWGQGTTVTVSS |
|---|---|---|---|---|
| | | | SEQ ID NO: 27228 | SEQ ID NO: 31234 |
| iPS:436582 | 21-225_225F8 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATATATGCTGCATCCAGT TTGCTAGGTGGTCCCATCAAGATTCAGGGG CAGTGGATCTGGGACAGATTCACTCTCACAA TCAGCAGCCTGCAGCCTGAAGATTTTGCAACT TATTACTGTCTACAACATAATAGTTACCCATTC ACTTTCGGCCCTGGGACCAAGGTGGATATCAA A | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATGTATGAAAAT AATAAATACTATGTAGACTCCGTGAAGGGCCGAT TCACCATCTCCAGAGACAACGCTCCAAGAACACGCT GTATCTGCAAATGAACAGCCTGAGAGCCGAGGA CACGGCTGTGTATTACTGTGCGAGAGAAGTGGGA TTTACTGAGGACTACTGGGGCCAGGGAACCCTGG TCACCGTCTCCTCA |
| | | | SEQ ID NO: 27229 | SEQ ID NO: 31235 |
| | | AA | DIQMTQSPSSLSASVGDRVTITCRASQGIRNDLG WYQQKPGKAPKRLIYAASSLLGGVPSRFSGSGS GTEFTLTISSLQPEDFATYYCLQHNSYPFTFGPGT KVDIK | QVQLVESGGGVVQPGRSLRLSCAASGFTFSSYGMH WVRQAPGKGLEWVAVIWYDENNKYYVDSVKGRF TISRDNSKNTLYLQMNSLRAEDTAVYYCAREVGFT EDYWGQGTLVTVSS |
| | | | SEQ ID NO: 27230 | SEQ ID NO: 31236 |

FIGURE 50
(Continued)

| | | | |
|---|---|---|---|
| iPS:436584 | 21-225_225B9 | NA | GACATCGTGATGACCCAGTCTCCAGATTCCT<br>GGCTGTGTCTCTGGGCGAGAGGGCCACCATCA<br>ACTGCAAGTCCAGCCAGAGTGTTTATACAGC<br>TCCAACAATAACAACTACTTAGCTTGGTACCA<br>ACAAAAACCAGGACAGCCTCCTAAGCTGCTCA<br>TTTTCTGGGCATCTACCCGGAATCCGGGGTC<br>CCTGACCGATTCAGTGGCAGCGGGTCTGGGAC<br>AGATTTCACTCTCACCATCAGCAGCCTGCAGG<br>CTGAAGATGTGGCAGTTTATTACTGTCAACAC<br>TCCAAGAGTATTCCTGGTAAGTTGGGCAGGG<br>GATCAAACTGGAGATCCAA<br>SEQ ID NO: 27231 | CAGGTGCAGCTGGTGCAGTCTGGGACTGAGGTG<br>AGGAAGCCTGGGGCCTCAGTGAAGGTCTCCTGC<br>AAGGCTTCTGGATACACCTTCACCAATTATGATA<br>TCAACTGGGTACGACAGGCCACTGGACAAGGC<br>TTGAGTGGATGGGATGGATGCACCTAACAGTGG<br>TAACACAGGCTATGCACAGAAGTTCCGGGCAG<br>AGTCACCATGACCAGGAACACCTCCATAAACAC<br>AGCCTACATGGAGCTGAACAGCCTGAGATCTGA<br>GGACACGGCCGTATATTATTGTGCATACTGCAGT<br>GGCTGGACCCTTTTTGACTACTGGGGCCAGGGA<br>CCCTGGTCACCGTCCTCA<br>SEQ ID NO: 31237 |
| | | AA | DIVMTQSPDSLAVSLGERATINCKSSQSVLYSSN<br>NNNYLAWYQQKPGQPPKLLIFWASTRESGVPDR<br>FSGSGSGTDFTLTISSLQAEDVAVYYCQHSKSIPG<br>KFGQGIKLEIQ<br>SEQ ID NO: 27232 | QVQLVQSGTEVRKPGASVKVSCKASGYTFTNYDIN<br>WVRQATGQRLEWMGWMHPNSGNTGYAQKFRGR<br>VTMTRNTSINTAYMELNSLRSEDTAVYYCAYSSG<br>WTLFDYWGQGTLVTVSS<br>SEQ ID NO: 31238 |
| iPS:436586 | 21-225_225F11 | NA | GACATCGTGATGACCCAGTCTCCAGACTCCCT<br>GGCTGTGTCTCTGGGCGAGAGGGCCACCATCA<br>ACTGCAAGTCCAGCCAGAGTGTTTATACAGC<br>TCCAACAATTACAACTACTTAGCTTGGTACCA<br>GCAGAGACCAGGACAGCCTCCTAAGCTGCTCA<br>TTTACTGGGCTTCTACCCGGAGCCGGGGTC<br>CCTGACCGATTCAGTGGCAGCGGGTCTGGGCC<br>AGATTTCACTCTCACCATCAGCAGCCTGCAGG<br>CTGAAGATGTGGCAGTTTATTACTGTCAGCAA<br>TATTATACTACTCCTCCGACGTTCGGCCAAGG<br>GACCAAGGTGGAAATCAAA<br>SEQ ID NO: 27233 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCAATTATGATA<br>TCAACTGGGTGCGACAGGCCACTGGACAAGGC<br>TTGAGTGGATGGGATGGATGCACCTAACAGTGG<br>TAACACAGGCTATGCACAGAAGTTCCAGGGCAG<br>AGTCACCATGACCAGGAACACCTCCATAAACAC<br>AGCCTACATGGAGCTGAGCAGCCTGAGATCTGA<br>GGACACGGCCGTGTATTACTGTGCGTATAGCAGT<br>GGCTGGTACCGCTTTGACTACTGGGGCCAGGGAA<br>CCCTGGTCACCGTCCTCA<br>SEQ ID NO: 31239 |

FIGURE 50
(Continued)

| | | | | |
|---|---|---|---|---|
| iPS:436588 | 21-225_225F12 | AA | DIVMTQSPDSLAVSLGERATINCKSSQSVLYSSN NYNYLAWYQQRPGQPPKLLIYWASTRESGVPD RFSGSGSGPDFTLTISSLQAEDVAVYCQQYYT PPTFGQGTKVEIK<br>SEQ ID NO: 27234 | QVQLVQSGAEVKKPGASVKVSCKASGYTFTNYDIN WVRQATGQGLEWMGWMHPNSGNTGYAQKFQGR VTMTRNTSINTAYMELSSLRSEDTAVYYCAYSSGW YRFDYWGQGTLVTVSS<br>SEQ ID NO: 31240 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTATACAGC TCCAACAATCAGAACTACTTAGCTTGGTACCA GCAGAAACCAGGACAGCCTCCTAGGCTGCTCA TTTACTGGACATCTACCGGGAATCCGGGGTC CCTGACCGATTCAGTGGCAGCGGGTCTGGGAC AGATTTCACTCTCACCATCAGCAACCTGCAGG CTGAAGATGTGGCTGTTTATTACTGTCAGCAA TATTATATTACTCCCGTGCAGTTTTGGCCAGGG GACCAAACTGGAGATCAAA<br>SEQ ID NO: 27235 | CAGGTGCAGCTGGTGCAGTCTGGGGCTGAGGTG AAGAAGCCTGGGGCCTCAGTGAAGGTCTCCTGC AAGGCTTCTGGATACACCTTCACCATTATGATA TCAACTGGGTGCGACAGGCCACTGGACAAGGGC TTGAGTGGATGGGATGGATGCACCCAAACAGTG GTAACACAGGCTATGCCAAGAAGTTCCAGGGCA GAGTCACCATGGCCAGGAACACCTCCATAAGCA CAGCCTACATGGAGCTGAGCAGCCTGAGATCTG AGGACACGGCCGTGTATTACTGTGCCTATAGCAG TGGCTGGTACAAGTTTGACTACTGGGGCCAGGGA ACCCTGGTCACCGTCTCCTCA<br>SEQ ID NO: 31241 |
| | | AA | DIVMTQSPDSLAVSLGERATINCKSSQSVLYSSN NQNYLAWYQQKPGQPPRLLIYWTSTRESGVPDR FSGSGSGTDFTLTISNLQAEDVAVYCQQYYITP CSFGQGTKLEIK<br>SEQ ID NO: 27236 | QVQLVQSGAEVKKPGASVKVSCKASGYTFTHYDIN WVRQATGQGLEWMGWMHPNSGNTGYAQKFQGR VTMARNTSISTAYMELSSLRSEDTAVYYCAYSSGW YKFDYWGQGTLVTVSS<br>SEQ ID NO: 31242 |

FIGURE 50
(Continued)

| | | | |
|---|---|---|---|
| iPS:436590 | 21-225_225H12 | NA | GACATCGTGATGACCCAGTCTCCAGACTCCCT GGCTGTGTCTCTGGGCGAGAGGGCCACCATCA ACTGCAAGTCCAGCCAGAGTGTTTATACAAC TCCAACAATAACAACTACTTAGCTTGGTACCA GCAGAAACCAGGACAGCCTCCTAACCTGCTCA TTTACTGGGCATCTACCCGGGAATCCGGGGTC CCTGACCGATTCAGTGGCAGGGGGTCTGGGAC AGATTTCACTCTCACCATCAGCAGCCTGCAGA CTGAAGATGTGGCAGTTTATTACTGTCAGCAA TATTATTATTACTCCGTGCAGTTTTGGCCAGGG GACCAAGCTGGAGATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCCTATAGCAGT GGCTGGTACAAGTTTGACTACTGGGGCCAGGGA ACCCTGGTCACCGTCTCCTCA |
| | | | SEQ ID NO: 27237 | SEQ ID NO: 31243 |
| | | AA | DIVMTQSPDSLAVSLGERATINCKSSQSVLYNSN NNNYLAWYQQKPGQPPNLLIYWASTRESGVPD RFSGSGSGTDFTLTISSLQTEDVAVYYCQQYYIT PCSFGQGTKLEIK | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YKFDYWGQGTLVTVSS |
| | | | SEQ ID NO: 27238 | SEQ ID NO: 31244 |
| iPS:436592 | 21-225_226B1 | NA | GATATTGTGATGACCCAGACTCCACTCTCT GTCCGTCACCCCTGGACAGCCGGCCTCCATCT CCTGCAAGTCTAGTCAGAGCCTCCTGCATGGT GATGGAAAGACCTATTTGTATTGGTACCTGCA GAGGCCAGGCCAGCTCCATCGGGTCTCTGATCA ATGAAGTTTCCATCCGGTTCTCTGGAGTGCCA GATAGGTTCAGTGGCAGCGGGTCAGGGACAG ATTTCACACTGAAAATCAGCCGGGTGGAGGCT GAGGATGTTGGGGTTTACTACTGCATGCAAAG TATACAGATTCCGTGCAGCGTTCGGCCAGGGGA CCAAGGTGGACATCAAA | CAGGTGCAGCTGGTGGAGTCTGGGGAGGCGTG GTCCAGCCTGGGAGGTCCCTGAGACTCTCCTGTG CAGCGTCTGGATTCACCTTCAGTACCTATGGCAT GCACTGGGTCCGCCAGGCTCCAGGCAAGGGGCT GGAGTGGGTGGCAATTATATATGGTATGATGAGGT TATAAATACTATGCAGACTCCGTGAAGGGCCGAT TCACCATCTCCAGAGACAATTCCAAGAACACGCT GTTTCTGCAAATGAACAGCCTGAGAGCCGAGGA CACGGCCGTGTATTACTGTGCGAGAGATCACTAC GATTTTTGGAGTGGTTATCTTACCCACTGGGGCC AGGGAACCCTGGTCACCGTCTCCTCA |
| | | | SEQ ID NO: 27239 | SEQ ID NO: 31245 |

FIGURE 50
(Continued)

| | | | |
|---|---|---|---|
| | | AA | DIVMTQTPLSLSVTPGQPASISCKSSQSLLHGDG KTYLYWYLQRPGQPPQLLINEVSIRFSGVPDRFS GSGSGTDFTLKISRVEAEDVGVYYCMQSIQIPWT FGQGTKVDIK<br>SEQ ID NO: 27240 | QVQLVESGGGVVQPGRSLRLSCAASGFTFSTYGMH WVRQAPGKGLEWVAIIWYDGGYKYYADSVKGRF TISRDNSKNTLFLQMNSLRAEDTAVYYCARDHYDF WSGYLTHWGQGTLVTVSS<br>SEQ ID NO: 31246 |
| iPS:436594 | 21-225_226A5 | NA | GATATTGTGATGACCCAGACTCCACTCTCTCT GTCCGTCACCCCTGGACAGCCGGCCTCCATCT CCTGCAAGTCTAGTCAGAGCCTCCTACATGGT GATGGAAAGACCTATTTGTATTGGTACCTGCA GAAGCCAGGCCAGCTCCACAGCTCCTGATCT ATGAAGTTTCCAACCGGTTCTCTGGAGTGCCA GATAGGTTCAGTGGCAGCGGGTCAGGGACAG ATTTCACACTGAAAATCAGCGGGTGGAGGCT GAGGATGTTGGGGTTTATTACTGCATGCAAAG TATACAGATTCCGTGGACGTTCGGCCAAGGGA CCAAGGTGGAGATCAAA<br>SEQ ID NO: 27241 | CAGGTGCAGCTGGTGGAGTCTGGGGGAGGCGTG GTCCAGCCTGGGAGGTCCCTGAGACTCTCCTGTG CAGCGTCTGGATTCACCTTCAGTACTTATGGCAT GCACTGGGTCCGCCAGGCTCCAGGCAAGGGCT GGAGTGGGTGGCAATTATATAGGTATGATGGAACT AATAAATACTATACAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGGTCA CGATTTTTGGAGTGGCTTTTTTGTTACTGGGGCC AGGGAACCCTGGTCACCGTCTCCTCA<br>SEQ ID NO: 31247 |
| | | AA | DIVMTQTPLSLSVTPGQPASISCKSSQSLLHGDG KTYLYWYLQKPGQPPQLLIYEVSNRFSGVPDRFS GSGSGTDFTLKISRVEAEDVGVYYCMQSIQIPWT FGQGTKVEIK<br>SEQ ID NO: 27242 | QVQLVESGGGVVQPGRSLRLSCAASGFTFSNYGM HWVRQAPGKGLEWVAIIWYDGTNKYYTDSVKGR FTISRDNSKNTLYLQMNSLRAEDTAVYYCAREGHD FWSGFFCYWGQGTLVTVSS<br>SEQ ID NO: 31248 |

FIGURE 50
(Continued)

| | | | |
|---|---|---|---|
| iPS:436596 | 21-225_226C6 | NA | GACATCCAGATGACCCAGTCTCCATCCCCT GTCTGCATCTATAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGCTCCCATCAAGGTTCAGCGG CAGTGGATCTGGGACAGAATTCACTCTCACAA TCAGCAACCTGCAGCCTGAAGATTTTGCAACT TATTACTGTCTACAGCATTATAATTACCCTCGG GCGTTCGGCCAAGGGACCAAGGTGGAAATCC AA | CAGGTGCAGCTGGTGCAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGTA TAGCAGCAGCTGTACGACTACGTATGGACGTC TGGGGCCAAGGGACCACGGTCACCGTCTCCTCA |
| | | | SEQ ID NO: 27243 | SEQ ID NO: 31249 |
| | | AA | DIQMTQSPSSLSASIGDRVTITCRASQGIRNDLG WYQQKPGKAPKRLIYAASSLQSGLPSRFSGSGSG TEFTLTISNLQPEDFATYYCLQHYNYPRAFGQGT KVEIQ | QVQLVESGGGVVQPGRSLRLSCAASGFTFSDYGM HWVRQAPGKGLEWVAVIWYDGSNKYYADSVKGR FTISRDNSKNTLYLQTNSLRAEDTAVYYCARERYSS SWYDYGMDVWGQGTTVTVSS |
| | | | SEQ ID NO: 27244 | SEQ ID NO: 31250 |
| iPS:436598 | 21-225_226D6 | NA | GACATCGTGATGACCCAGTCTCCAGACTCCCT GGCTGTGTCTCTGGGCGAGAGGGCCACCATCA ACTGCAGGTCCAGCAGTGATATTTTATACATC TCCAACAATAAGAACTACTTAGCTTGGTACCA GCAGAAACCAGGACAGCCTCCTAAGATGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTTGCAGTTTATTACTGTCAGCAA TATTATAGTTCTCCGTGACGTTTTGGCCAGGG GACCAAGCTGGAGATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAGTGG TAACACAGGCTATGCACAGAAGTTCCAGGGCAG AGTCACCATGACCAGGAACACTTCCATAAGCAC AGCCTACATGGAGCTGAGCAGCCTGAGATCTGA GGACACGGCCGTGTATTACTGTGCCTATAGCAGT GGCTGGTACAAGTTTGACTACTGGGGCCAGGGA ACCCTGGTCACCGTCTCCTCA |
| | | | SEQ ID NO: 27245 | SEQ ID NO: 31251 |

FIGURE 50
(Continued)

| | | | | |
|---|---|---|---|---|
| iPS:436600 | 21-225_226F6 | AA | DIVMTQSPDSLAVSLGERATINCRSSQSILYISNN KNYLAWYQQKPGQPPKMLIYWASTRESGVPDR FSGSGSGTDFTLTISSLQAEDVAVYYCQQYYSSP CSFGQGTKLEIK<br>SEQ ID NO: 27246 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YKFDYWGQGTLVTVSS<br>SEQ ID NO: 31252 |
| | | NA | GACATCGTGATGACCCAGTCTCCAGACTCCT GGCTGTGTCTCTGGGCGAGAGGGCCACCATCA ACTGCAAGTCCAGCCAGAGTATTTTATACAGC TCCAACAATTACAAACTACTAGCTTGGTACCA GCAGAAGCCAGGACAGCCTCCTAAGCTGCTCA TTTACTGGGCTTCTACCCGGGAATCCGGGGTC CCTGACCGATTCAGTGGCAGCGGGTCTGGGCC AGATTTCACTCTCACCATCAGCAGCCTGCAGG CTGAAGATGTGGCAGTTTATTACTGTCAGCAA TATTATACTACTCCTCCGACGTTCGGCCAAGG GACCAAGGTGGAAATCAAA<br>SEQ ID NO: 27247 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCCTAACAGTGG TAACACAGGCTATGCACAGAAGTTCCAGGGCAG AGTCACCATGACCAGGAACACCTCCATAAACAC AGCCTACATGGAGCTGAGCAGCCTGAGATCTGA GGACACGGCCGTGTATTACTGTGCGTATAGCAGT GGCTGGTACCGCTTTGACTACTGGGGCCAGGGAA CCCTGGTCACCGTCTCCTCA<br>SEQ ID NO: 31253 |
| | | AA | DIVMTQSPDSLAVSLGERATINCKSSQSILYSSNN YNYLAWYQQKPGQPPKLLIYWASTRESGVPDRF SGSGSGPDFTLTISSLQAEDVAVYYCQQYYTTPP TFGQGTKVEIK<br>SEQ ID NO: 27248 | QVQLVQSGAEVKKPGASVKVSCKASGYTFTNYDIN WVRQATGQGLEWMGWMHPNSGNTGYAQKFQGR VTMTRNTSINTAYMELSSLRSEDTAVYYCAYSSGW YRFDYWGQGTLVTVSS<br>SEQ ID NO: 31254 |

FIGURE 50
(Continued)

| | | | |
|---|---|---|---|
| iPS:436602 | 21-225_226E7 | NA | GATATTGTGATGACCCAGACTCCACTCTCT<br>GTCCGTCACCCCTGGACAGCCGGCCTCCATCT<br>CCTGCAAGTCTAGTGACAGCCTCCTGCATGGT<br>GATGGAAAGACCTATTTGTATTGGTACCAGCA<br>GAAGCCAGGCCAGTCTCCACAGATCCTGATCT<br>ATGAAGTTTCCAACGGGTTCTCTGGAGTGCCA<br>GATAGGTTCAGTGGCAGCGGGTCAGGGACAG<br>ACTTCACACTGAAAATCAGCCGGGTGGAGGCT<br>GAGGATGTTGGGGTTTATTACTGCATGCAAAG<br>TATACAGGTTCCGTGACGTTCGGCCAAGGGA<br>CCAAGGTGGAGATCAAA<br><br>SEQ ID NO: 27249<br><br>DIVMTQTPLSLSVTPGQPASISCKSSQSLLHGDG<br>KTYLYWYQQKPGQPPQILYEVSNRFSGVPDRFS<br>GSGSGTDFTLKISRVEAEDVGVYYCMQSIQVPW<br>TFGQGTKVEIK<br><br>SEQ ID NO: 27250 | CAGGTGCAGCTGGTGGAGTCTGGGGGAGGCGTG<br>GTCCAGCCTGGGAGGTCCCTGAGACTCTCCTGTG<br>CAGCCGTCTGGATTCACCTTCAGTACCTATGGCAT<br>GCACTGGGTCCGCCAGGCTCCAGGCAAGGGGCT<br>GGAATGGGTGGCAATTATATGGTATGATGGAAGT<br>AATAAATACTATGCAGACTCCGTGAAGGGCCGA<br>TTCACCATCTCCAGAGACAATTTCAAGAACACGC<br>TGTATCTGCAAATGCACAGCCTGAGAGCCGACG<br>ACACGGCTGTGTATTACTGTGCGAGAGAATTA<br>CGATTTTTGGAGTGGTTATTATGGCTACTGGGGC<br>CAGGGAACCCTGGTCACCGTCTCCTCA<br><br>SEQ ID NO: 31255<br><br>QVQLVESGGGVVQPGRSLRLSCAASGFTFSTYGMH<br>WVRQAPGKGLEWVAIIWYDGSNKYYADSVKGRFT<br>ISRDNFKNTLYLQMHSLRADDTAVYYCARENYDF<br>WSGYYGYWGQGTLVTVSS<br><br>SEQ ID NO: 31256 |
| iPS:436604 | 21-225_226F7 | NA | GACATCCAGATGACCCAGTCTCCATCCTCCCT<br>GTCTGCATCTGTTGGAGACAGAGTCACCATCA<br>CTTGCCGGGCAAGTCAGGGCATTGGGAATGAT<br>TTAGGCTGGTATCAGCAGAAACCAGGGAAAG<br>CCCCTAAGCGCCTGATCTATGCTGCCTCCAGTT<br>TGCAAAGTGGGGTCCCATCAAGGTTCAGCGGC<br>AGTGGATCTGGGACAGAATTCATTCTCACAAT<br>CAGCAGCCTGCAGCCTGAAGATTTTGCAACTT<br>ATTACTGTCTACATCATTATAGTTACCCTCGGA<br>CGTTCGGCCAAGGGGACCAAGGTGGAAATCAA<br>A<br><br>SEQ ID NO: 27251 | CAGGTGCAGCTGGTGGAGTCTGGGGGAGGCGTG<br>GTCCAGCCTGGGAGGTCCCTGAGACTCTCCTGTG<br>CAGCCGTCTGGATTCACCTTCAGTAGCTATGGCAT<br>GCACTGGGTCCGCCAGGCTCCAGGCAAGGGGCT<br>GGAGTGGGTGGCAATTATATGGTATGATGGAAGT<br>AATAAATACTATGCAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGCTGTGTATTACTGTGCGAGAGAGGTA<br>TAACAGCGGCTGGTACGACTACGGTTTGGACGTC<br>TGGGGCCAAGGGACCACGGTCACCGTCTCCTCA<br><br>SEQ ID NO: 31257 |

FIGURE 50
(Continued)

| | | | | | |
|---|---|---|---|---|---|
| | | AA | DIQMTQSPSSLSASVGDRVTITCRASQGIGNDLG WYQQKPGKAPKRLIYAASSLQSGVPSRFSGSVS GTEFILTISSLQPEDFATYYCLHHYSYPRTFGQGT KVEIK | QVQLVESGGGVVQPGRSLRLSCAASGFTFSSYGMH WVRQAPGKGLEWVAIIWYDGSNKYYADSVKGRFT ISRDNSKNTLYLQMNSLRAEDTAVYYCARERYNSG WYDYGLDVWGQGTTVTVSS | |
| | | | SEQ ID NO: 27252 | SEQ ID NO: 31258 | |
| iPS-436606 | 21-225_226G8 | NA | GATATTGTGATGACCCAGACTCCACTCTCTCT GTCCGTCACCCTGGACAGCCGGCCTCCATCT CCTGCAAGTCTAGTCAGAGCCTCCTGCATAGT GATGGAAAGACCTTTTTGTATTGGTACCTGCA GAAGCCAGGCCAGTCTCCACAGCTCCTGATCT ATGAAATTTCAACCGGTTCTCTGGAGTGCCA GATAGGTTCAGTGGCAGCGGGTCAGGGACAG ATTTCACACTGAAAATCAGCCGGGTGGAGGCT GAGGATGTTGGGATTTATTACTGCATGCAAAG TACACAGCTTCCTCGGACGTTCGGCCAAGGGA CCAAGGTGGAAATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGGC TTGAGTGGATGGGATGGATCAACCCTTACAGTGG TGACACAAAGTATGCACAGAAGTTTCAGGGCAG GGTCACCATGACCAGGGACACGTCATCAGCAC AGCCTACATGGAACTGAGCAGGCTGAGATTTGA CGACACGGCCGTGTTTTACTGTGCGAGAGATTGG GGTGGCTACAGTTCTTACTACTACGGTATGACG TCTGGGGCCAAGGGACCACGGTCACCGTCTCTC A | |
| | | | SEQ ID NO: 27253 | SEQ ID NO: 31259 | |
| | | AA | DIVMTQTPLSLSVTPGQPASISCKSSQSLLHSDGK TFLYWYLQKPGQPPQLLIYEISNRFSGVPDRFSGS GSGTDFTLKISRVEAEDVGIYYCMQSTQLPRTFG QGTKVEIK | QVQLVQSGAEVKKPGASVKVSCKASGYTFTGYYIH WVRQAPGQGLEWMGWINPYSGDTKYAQKFQGRV TMTRDTSISTAYMELSRLRFDDTAVFYCARDWGG YSSYYYGMDVWGQGTTVTVSS | |
| | | | SEQ ID NO: 27254 | SEQ ID NO: 31260 | |

FIGURE 50
(Continued)

| | | | |
|---|---|---|---|
| iPS:436608 | 21-225_226A9 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCTGAAGATTTTGCAACT TATTACTGTCTACAGCATAATAGTTACCCATTC ACTTTCGGCCCTGGGACCAAAGTGGATATCAA A<br>SEQ ID NO: 27255 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGCT GGAGTGGGTGGCAGTTATATCGACTCCGTGAAG GGCCG TAATAAATACTATACAGACTCCGTGAAGGGCCG ATTCACCATCTCCAGAGACAATTCCAAGAACACG CTGTTTCTGCAAATGAACAGCCTGAGAGCCGAGG ACACGGCTGTGTATTACTGTGCGAGAGAAGTGGG ATTCACTGAGGACTACTGGGGCCAGGGAACCCT GGTCACCGTCTCCTCA<br>SEQ ID NO: 31261 |
| | | AA | DIQMTQSPSSLSASVGDRVTITCRASQGIRNDLG WYQQKPGKAPKRLIYAASSLQSGVPSRFSGSGS GTEFTLTISSLQPEDFATYCLQHNSYPFTFGPGT KVDIK<br>SEQ ID NO: 27256 | QVQLVESGGGVVQPGRSLRLSCAASGFTFSNYGM HWVRQAPGKGLEWVAVIWYEESNKYYTDSVKGR FTISRDNSKNTLFLQMNSLRAEDTAVYYCAREVGF TEDYWGQGTLVTVSS<br>SEQ ID NO: 31262 |
| iPS:436610 | 21-225_226F9 | NA | GATATTGTGATGACCCAGACTCCACTCTCTCT GTCCGTCACCCTGGACAGCCGGCTCCATCT CCTGCAAGTCTAGTCAGAGCCTCCTGCATAGT GATGGAAAGACCTTTTGTATTGTACCTGCA GAAGCCAGGCCAGCTCCACAGCTCCTGATCT ATGAAATTTCCAACCGGTTCTCTGGAGTGCCA GATAGGTTCAGTGGCAGCGGGTCAGGGACAG ATTTCACACTGAAATCAGCGGGTGGAGGCT GAGGATGTTGGGATTTATTACTGTCATGCAAAG TACACAGCTTCCTCGACGTTCGGCCAAGGGA CCAAGGTGGAAATCAAA<br>SEQ ID NO: 27257 | CAGGTGCAGCTGGTGCAGTCTGGGGCTGAGGTG AAGAAGCCTGGGGCCTCAGTGAAGGTCTCTGC AAGGCTTCTGGATACACCTTCACCGGCTACTATA TACACTGGGTGCGACAGGCCCCTGGACAAGGGC TTGAGTGGATGGATGGATCAACAGAGAAGTTTCAGGCAG TGACACAAAGTATGCACAGGGCCACGTCCATCAGCAC GGTCACCATGACCAGGGACACGTCCATCAGCAC AGCCTACATGGAACTGAGCAGGCTGAGATTTGA CGACACGGCCGTGTTTACTGTGCGAGAGATTGG GGTGGCTACAGTTCTTACTACTACGGTATGGACG TCTGGGGCCAAGGGACCACGGTCACCGTCTCTTC A<br>SEQ ID NO: 31263 |

FIGURE 50
(Continued)

| | | | | |
|---|---|---|---|---|
| iPS:436612 | 21-225_226H9 | AA | DIVMTQTPLSLSVTPGQPASISCKSSQSLLHSDGK TFLYWYLQKPGQPPQLLIYEISNRFSGVPDRFSGS GSGTDFTLKISRVEAEDVGIYYCMQSTQLPRTFG QGTKVEIK<br>SEQ ID NO: 27258 | QVQLVQSGAEVKKPGASVKVSCKASGYTFTGYYIH WVRQAPGQGLEWMGWINPYSGDTKYAQKFQGRV TMTRATSISTAYMELSRLRFDDTAVFYCARDWGG YSSYYYGMDVWGQGTTVTVSS<br>SEQ ID NO: 31264 |
| | | NA | GATATTGTGATGACCCAGACTCCACTCTCTCT GTCCGTCATCCTGGACAGCCGGCCTCCATCT CCTGCAAGTCTAGTCAGAGCCTCCTGCATAGT GATGGAAAGACCTTTTTGTATTGGTACCTGCA GAGGCCAGGCCAGCTCCACAGCTCCTGATCT ATGAAGTTTCCAACCGTTCTCTGGAGTGCCA GATAGGTTCAGTGGCAGCGGGTCAGGACAG ATTTCACACTGTGGGATTTATTACTGCATGCAAAG TACACAGCTTCCTCGACGTTCGGCCAAGGGA CCAAGGTGGAAATCAAA<br>SEQ ID NO: 27259 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGGC TTGAGTGGATGGGATGGATCAACCCTTACAGTGG TGACACAAACTCTGCACAGAAGTTTCAGGGCCG GGTCACCATGACCAGGGACACGTCCATCAGCAC AGCCTACATGAACTGAGCAGGCTGAGATTTGA CGACACGGCCGTGTTTACTGTGCGAGAGATTGG GGTGGCTACAGTTCTTACTACTACGGTATGGACG TCTGGGGCCAAGGGACCACGGTCACCGTCTCTTC A<br>SEQ ID NO: 31265 |
| | | AA | DIVMTQTPLSLSVIPGQPASISCKSSQSLLHSDGK TFLYWYLQRPGQPPQLLIYEVSNRFSGVPDRFSG SGSGTDFTLKISRVEAEDVGIYYCMQSTQLPRTF GQGTKVEIK<br>SEQ ID NO: 27260 | QVQLVQSGAEVKKPGASVKVSCKASGYTFTGYYIH WVRQAPGQGLEWMGWINPYSGDTNSAQKFQGRV TMTRDTSISTAYMELSRLRFDDTAVFYCARDWGG YSSYYYGMDVWGQGTTVTVSS<br>SEQ ID NO: 31266 |

FIGURE 50
(Continued)

| | | | |
|---|---|---|---|
| iPS:436614 | 21-225_226F10 | NA | GATATTGTGATGACCCAGACTCCACTCTCTCT GTCCGTCACCCCTGGACAGCCGGCCTCCATCT CCTGCAAGTCTAGTCAGAGCCTCCTGCATAGT GATGGAAAGAACCTTTTGTATTGGTACCTGCA GAAGCCAGGCCAGCTCCACAGTCCTGATCT ATGAAATTTCCAACCGGTTCTCTGGGGTGCCA GATAGGTTCAGTGGCAGCGGGTCAGGGACAG ATTTCACACTGAAAATCAGCCAGTGGAGCT GAGGATGTTGGGATTTATTACTGCATGCAAAG TACACAGCTTCCTCCGGACGTTCGGCCAAGGGA CCAAGGTGGAAATCAAA<br><br>SEQ ID NO: 27261 | CAGGTGCAGCTGGTGCAGTCTGGGGGTGAGGTG AAGAAGCTGAGGGCCTCAGTGAAGGTCTCCTGC AAGGCTTCTGGATACACCTTCACCGGCTATTATA TACACTGGGTGCGACAGGCCCCTGGACAAGGGC TTGAGTGGATGGATGGATCAACCATACAGTGG TGACACAAACTATGCACAGAAGTTTCAGGCAG GGTCACCATGACCAGGGACACGTCCGTCAGCAC AGCCTACATGAAACTGAGCAGGTTGAGATTGA CGACACGGCCGTGTTTACTGTGCGAGAGATTGG GGTGGCTACAGTTCTTACTACTGTATGGACG TCTGGGGCCAAGGGACCCGGTCACCGTCTCTTC A<br><br>SEQ ID NO: 31267 |
| | | AA | DIVMTQTPLSLSVTPGQPASISCKSSQSLLHSDGK TFLYWYLQKPGQPPQLLIYEISNRFSGVPDRFSGS GSGTDFTLKISRVEAEDVGIYYCMQSTQLPRTFG QGTKVEIK<br><br>SEQ ID NO: 27262 | QVQLVQSGGEVKKLRASVKVSCKASGYTFTGYYIH WVRQAPGQGLEWMGWINPYSGDTNYAQKFQGRV TMTRDTSVSTAYMELSRLRLDDTAVFYCARDWGG YSSYYYGMDVWGQGTPVTVSS<br><br>SEQ ID NO: 31268 |
| iPS:436616 | 21-225_226D11 | NA | GACATCGTGATGACCCAGTCTCCAGACTCCCT GGCTGTGTCTCTGGGCGAGAGGGCCACCATCA ACTGCAAGTCCAGCCAGAATGTTTACACAGC AGTCTTCTGGATACACCTTCACCAATTATGATA TCAACAGTAATAACTACTTAGTTTGGTACCA GCAGAAACCAGGACAGCCTCCTAAACTGCTCA TTTACTGGGCATCTACCCGGGAATCCGGGGTC CCTGACCGATTCAGAGGCAGCGGGTCTGGGAC AGTCCACCATGACCAGGAACACCTCCATAAGCAC AGATTTCACTCTCACCATCAGCAGCCTGCAGG CTGAAGATGTGGCAGTTTATTACTGTGTCAGCAA TATTATAAAACTCCGTGGACGTTCGGCCAAGG GACCAAGGTGGAAATCAAA<br><br>SEQ ID NO: 27263 | CAGGTGCAGCTGGTGCAGTCTGGGGCTGAGGTG AAGAAGCCTGGGGCCTCAGTGAAGGTCTCCTGC AGGTCTTCTGGATACACCTTCACCAATTATGATA TCAACTGGGTGCGACAGGCCACTGGACAAGGGC TTGAGTGGATGGGATGGATGCACCCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCCTATAGCAGT GGCTGGTACTACTTTGACTACTGGGGCCAGGGAA CCCTGGTCACCGTCTCCTCA<br><br>SEQ ID NO: 31269 |

FIGURE 50
(Continued)

| | | | |
|---|---|---|---|
| iPS:436618 | 21-225_226E11 | AA | DIVMTQSPDSLAVSLGERATINCKSSQNVLHSSN SNNYLVWYQQKPGQPPKLLIYWASTRESGVPDR FRGSGSGTDFTLTISSLQAEDVAVYYCQQYYKTP WTFGQGTKVEIK<br>SEQ ID NO: 27264 | QVQLVQSGAEVKKPGASVKVSCRSSGYTFTNYDIN WVRQATGQGLEWMGWMHPNSGNTGYAQKFQGR VTMTRNTSISTAYMELSSLRSEDTAVYYCAYSSGW YYFDYWGQGTLVTVSS<br>SEQ ID NO: 31270 |
| | | NA | GATATTGTGATGACCCAGACTCCACTCTCTCT GTCCGTCACCCCTGGACAGCCGGCCTCCATCT CCTGCAAGTCTAGTCAGAGCCTTCTGCATAGT GATGGAAAGACCTTTTTGTATTGGTACCTGCA CAAGCCAGGCCAGCCTCCACACTCCTGATCT ATGAAAATTTCCAACCGGTTCTCTGGAGTGCCA GATAGGTTCAGTGGCAGCGGGTCAGGGACAG ATTTCACACTGAAAATCAGCCGGGTGGAGGCT GAGGATGTTGGGATTTATTACTGCATGCAAAG TACACAGCTTCCTCCGGACGTTCGGCCAAGGGA CCAAGGTGAAATCAAA<br>SEQ ID NO: 27265 | CAGGTGCAGCTGGTGCAGTCTGGGGCTGAGGTG AAGAAGCCTGGGGCTTCAGTGAAGGTCTCCTGC AAGGCTTCTGGATACACCTTCACCGGCTACTATA TACACTGGGTGCGACAGGCCCCTGGACAAGGGC TTGAGTGGATGGGATGGATGCACAGAAGTTTCAGGCAG TGACACAAACTATGCACAGAAGTTTCAGGGCAG GGTCACCATGACCAGGAACACGTCCATCAGCAC AGCCTACATGGAACTGAGCAGCTGAGATTTGA CGACACGGCCGTGTTTACTGTGCGAGAGATTGG GGTGGCTACAGTTCTTACTACGGTATGGACG TCTGGGGCCAAGGGACCACGGTCACCGTCTCTTC A<br>SEQ ID NO: 31271 |
| | | AA | DIVMTQTPLSLSVTPGQPASISCKSSQSLLHSDGK TFLYWYLHKPGQPPHLLIYEISNRFSGVPDRFSGS GSGTDFTLKISRVEAEDVGIYYCMQSTQLPRTFG QGTKVEIK<br>SEQ ID NO: 27266 | QVQLVQSGAEVKKPGASVKVSCKASGYTFTGYYIH WVRQAPGQGLEWMGWINPYSGDTNYAQKFQGRV TMTRDTSISTAYMELSRLRFDDTAVFYCARDWGG YSSYYYGMDVWGQGTTVTVSS<br>SEQ ID NO: 31272 |

FIGURE 50
(Continued)

| | | | |
|---|---|---|---|
| iPS:436620 | 21-225_226H11 | NA | GACATCCAGATGACCCAGTCTCCATCTCCCT GTCTGCATCTGTAGGAGACAGAGTCACCATCA CTTGCCGGACAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGTGG CAGTGGATCTGGGACAGATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAATCA AA SEQ ID NO: 27267 | CAGGTGCAGTTGGTGGAGTCTGGGGGAGGCGTG GTCCAGCCTGGGAGGTCCCTGAGACTCTCCTGTG CAGGCGTCTGAGATTCACCTTCAGTAACTGTGGCAT GCACTGGGTCCGCCAGGCTCCAGGCAAGGGGCT GGAGTGGGTGACAGTTATATGGTATGATGGAAGT AATAAATACTATGCAGACTCCGTGAAGGGCCGA TTCACCATCTCAAGAGACAATTCCAAGAACACGC TGTATCTGCAAATGAACAGCCTGAGAGCCGAGG ACACGGCTGTGTATTACTGTGCGAGAGAGCTGTA TAGCAGCAGCTGGTACGACTACGGTTTGGACGTC TGGGGCCAAGGGACCACGGTCACCGTCTCCTCA SEQ ID NO: 31273 |
| | | AA | DIQMTQSPSSLSASVGDRVTITCRTSQGIRNDLG WYQQKPGKAPKRLIYAASSLQSGVPSRFSGSGS GTDFTLTISSLQPEDFATYYCLQHYSYPRTFGQG TKVEIK SEQ ID NO: 27268 | QVQLVESGGGVVQPGRSLRLSCAASGFTFSNCGMH WVRQAPGKGLEWVTVIWYDGSNKYYADSVKGRF TISRDNSKNTLYLQMNSLRAEDTAVYYCARELYSS SWYDYGLDVWGQGTTVTVSS SEQ ID NO: 31274 |
| iPS:436622 | 21-225_226A12 | NA | GACATCGTGATGACCCAGTCTCCAGACTCCCT GGCTGTGTCTCTGGGCGAGAGGGCCACCATCA ACTGCAAGTCCAGTCAGAGTGTTTTATACAGT TCCAACAATAACAAACTACTTAGCTTGGTACCA GCAGAACACCTGGACAGCCTCCAAGCTGCTCT TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTAGTCCGACGTTCGGCCAAGG GACCAAGGTGGAAATCAAA SEQ ID NO: 27269 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGCAG AGTCACCATGACCAGGAACACCTCCATAAGCAC AGCCTACATGGAGCTGAGCAGCCTGAGATCGA GGACACGCCGTGTATTACTGTGCTTATAGCAGT GGCTGGTACTACTTTGACTACTGGGGCCAGGAA CCCTGGTCACCGTCTCCTCA SEQ ID NO: 31275 |

FIGURE 50
(Continued)

| | | | | |
|---|---|---|---|---|
| iPS:436624 | | | AA | DIVMTQSPDSLAVSLGERATINCKSSQNVLYSSN NNNYLAWYQQTPGQPPKLLFYWASTRKSGVPD RFSGSGSGTDFTLTISSLQAEDVAVYYCQQYYSS PPTFGQGTKVEIK<br>SEQ ID NO: 27270 | QVQLVQSGAEVKKPGASVKVSCKASGYTFTNYDIN WVRQATGQGLEWMGWMHPNSGNTGYAQKFQGR VTMTRNTSISTAYMELSSLRSEDIAVYYCAYSSGW YYFDYWGQGTLVTVSS<br>SEQ ID NO: 31276 |
| | 21-225_226H12 | | NA | GATATTGTGATGACCCAGACTCCACTCTCT GTCCGTCACCCCTGGAGAGCGGGCCTCCATCT CCTGCAAGTCTAGTAAGAACCCTCCTGCATAGT GATGGAAAGAACCTTTTTGTATTGGTACCTGCA GAAGCCAGGCCAGCTCCACAGCCCCTGATCT ATGAAATTTCCAACCGGTTCTCTGGAGTGCCA GATAGGTTCAGTGGCAGCGGGTCAGGGACAG ATTTCACACTGAAAATCAGCCGGGTGGAGGCT GAGGATGTTGGGATTTATTACTGCATGCAAAG TACACAGCTTCCTCGGACGTTCGGCCAAGGGA CCAAGGTGGAAATCAAA<br>SEQ ID NO: 27271 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGGC TTGAGTGGATGGGATGGATCAACCCTTACAGTGG TGACACAAACTATGCACAGAAGTTCAGGGCAG GGTCACCATGACCAGGACACGTCCATCAGCAC AGCCTACATGGAACTGAGGAGGCTGAGATTTGA CGACACGGCCGTGTTTTACTGTGCGAGAGATTGG GGTGGCTACAGTTCTTACTACTACGGTATGGACG TCTGGGGCCAAGGGACCACGGTCACCGTCTCTC A<br>SEQ ID NO: 31277 |
| | | | AA | DIVMTQTPLSLSVTPGQPASISCKSSKTLLHSDGK TFLYWYLQKPGQPPQPLIYEISNRFSGVPDRFSGS GSGTDFTLKISRVEAEDVGIYYCMQSTQLPRTFG QGTKVEIK<br>SEQ ID NO: 27272 | QVQLVQSGAEVKKPGASVKVSCKASGYTFTGYYIH WVRQAPGQGLEWMGWINPYSGDTNYAQKFQGRV TMTRDTSISTAYMELRRLRFDDTAVFYCARDWGG YSSYYYGMDVWGQGTTVTSS<br>SEQ ID NO: 31278 |

FIGURE 50
(Continued)

| | | | |
|---|---|---|---|
| iPS:436626 | 21-225_227C1 | NA | GATATTGTGATGACCCAGACTCCACTCTCTCT GTCCGTCACCCCTGGACAGCCGGCCTCCATCT CCTGCAAGTCTAGTCAGAGCCTCCTGCATAGT GATGGAAAGACCTTTTTGTATTGGTACCTGCA GAAGCCAGGCCAGCCTCCACAGCTCCTGATCT ATGAAATTTCCAACCGGTTCTCTGGAGTGCCA GATAGGTTCAGTGGCAGCGGGTCAGGGACAG ATTTCACACTGAAAATCAGCCGGGTGGAGGCT GAGGATGTTGGGATTTATTACTGCATGCAAAG TACACAGCTTCCTCGGACGTTCGGCCAAGGGA CCAAGGTGGAAATCAAA<br><br>SEQ ID NO: 27273 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA CACACTGGGTGCGACAGGCCCCTGGACAAGGGC TTGAGTGGATGGGATGGATCAACAGAGTTACAGTGG TGGCACAAACTATGCACAGGGACACGTTCAGGGCAG GGTCACCATGACCAGGGACACGTCCATCAGCAC AGCCTACATGGAACTGAGCAGGCTGAGATTTGA CGACACGGCCGTGTATTACTGTGCGAGAGATTGG GGTGGCTACAGTTCTTACTACTACGGTATGGACG TCTGGGGCCAAGGGACCACGGTCACCGTCTCTTC A<br><br>SEQ ID NO: 31279 |
| | | AA | DIVMTQTPLSLSVTPGQPASISCKSSQSLLHSDGK TFLYWYLQKPGQPPQLLIYEISNRFSGVPDRFSGS GSGTDFTLKISRVEAEDVGIYYCMQSTQLPRTFG QGTKVEIK<br><br>SEQ ID NO: 27274 | QVQLVQSGAEVKKPGASVKVSCKASGYTFTGYYT HWVRQAPGQGLEWMGWINPYSGGTNYAQKFQGR VTMTRDTSISTAYMELSRLRFDDTAVYYCARDWG GYSSYYYGMDVWGQGTTVTVSS<br><br>SEQ ID NO: 31280 |
| iPS:436628 | 21-225_227F2 | NA | GATATTGTGATGACCCAGACTCCACTCTCTCT GTCCGTCACCCCTGGACAGCCGGCCTCCATCT CCTGCAAGTCTAGTCAGAGCCTCCTGCATAGT GATGGAAAGACCTTTTTGTATTGGTACCTGCA GAAGCCAGGCCAGCCTCCACAGCTCCTGATCT ATGAAATTTCCAACCGGTTCTCTGGAGTGCCA GATAGGTTCAGTGGCAGCGGGTCAGGGACAG ATTTCACACTGAAAATCAGCCGGGTGGAGGCT GAGGATGTTGGGATTTATTACTGCATGCAAAG TACACAGCTTCCTCGGACGTTCGGCCAAGGGA CCAAGGTGGAAATCAAA<br><br>SEQ ID NO: 27275 | CAGGTGCACCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGGC TTGAGTGGATGGGATGGATCAACAGAAGTTACAGTGG TGACACAAAGTATGCACAGGGACACGTTCAGGGCAG GGTCACCATGACCAGGGACACGTCCATCAGCAC AGCCTACATGGAACTGAGCAGGCTGAGATTTGA CGACACGGCCGTGTTTTACTGTGCGAGAGATTGG GGTGGCTACAGTTCTTACTACTACGGTATGGACG TCTGGGGCCAAGGGACCACGGTCACCGTCTCTTC A<br><br>SEQ ID NO: 31281 |

FIGURE 50
(Continued)

| | | | |
|---|---|---|---|
| iPS-436630 | 21-225_227G3 | AA | DIVMTQTPLSLSVTPGQPASISCKSSQSLLHSDGK TFLYWYLQKPGQPPQLLIYEISNRFSGVPDRFSGS GSGTDFTLKISRVEAEDVGIYYCMQSTQLPRTFG QGTKVEIK<br>SEQ ID NO: 27276 | QVHLVQSGAEVKKPGASVKVSCKASGYTFTGYYIH WVRQAPGQGLEWMGWINPYSGDTKYAQKFQGRV TMTRDTSISTAYMELSRLRFDDTAVFYCARDWGG YSSYYYGMDVWGQGTTVTVSS<br>SEQ ID NO: 31282 |
| | | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGACGATTTTGCAACT TATTACTGTCTACACCATAATAGTTACCCATTC ACTTTCGGCCCTGGGACCAAAGTGGATATCAA A<br>SEQ ID NO: 27277 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGTATGTTGGAAGT AATCAATACTATGCAGACTCCGTGAAGGGCCGAT TCACCATCTCCAGAGACAATTCCAAGAACACGCT GTATCTGCAAATGAGCAGCCTGAGAGCCGAGGA CACGGCTGTGTATTACTGTGCGAGAGAAGTGGGA ITCACTGAGGACTACTGGGGCCAGGGAACCCTG GTCACCGTCTCCTCC<br>SEQ ID NO: 31283 |
| | | AA | DIQMTQSPSSLSASVGDRVTITCRASQGIRNDLG WYQQKPGKAPKRLIYAASSLQSGVPSRFSGSGS GTEFTLTISSLQPADFATYYCLHHNSYPFTFGPGT KVDIK<br>SEQ ID NO: 27278 | QVQLVESGGGVVQPGRSLRLSCAASGFTFSSYGMH WVRQAPGKGLEWVAVIWYVGSNQYYADSVKGRF TISRDNSKNTLYLQMSSLRAEDTAVYYCAREVGFT EDYWGQGTLVTVSS<br>SEQ ID NO: 31284 |

FIGURE 50
(Continued)

| | | NA | GACATCCTGATGACCCAGTCTCCATCTTCCGT GTCTGCATCTGTAGGAGACAGAGTCACCATCA CTTGTCGGGCGAGTCAGGTATTATCAACTGG TTAGCCTGGTATCAGCAGAAACCAGGGAAAG CCCCTAAGCTCCTGATCTATGCTGCATCCAGTT TGCAAAGTGGGGTCCATCAAGGTTCAGCGGC AGTGGATCTGGGACAGATTTCACTCTCACCAT CAGCAGCCTGCAGCCTGAAGATTTTGCAATTT ACTATTGTCAACAGGCTAACAGTTTCCCGTGG ACGTTCGGCCAAGGGACCAAGGTGGAAATCA AA | GAGGGGCAGCTATTGGAGTCTGGGGGAGGCTTG GTACAGCCTGGGGGGTCACTGAGACTCTCCTGTA CAGCCTCTGGATTCACCTTTAGCACTTTTGCCATG ACCTGGGTCCGCCAGGCTCCAGGGAAGGGGCTG GAGTGGGTCTCAGTTATTAGTGGTAGAGGTGGTA GCTCATTCTACGCAGACTCCGTGAAGGGCCGGTT CACCATCTCCAGAGACAATTCCAAGAACACGCT GTATCTGCAAATGAACAGCCTGAGAGCCGAGGA CACGGCCGTATATTACTGTGCGAAAGATCAACTA TGGTTTGACTACTGGGGCCAGGGAACCCTGGTCA CCGTCTCCTCA |
|---|---|---|---|---|
| iPS:436632 | 21-225_227E4 | | SEQ ID NO: 27279 | SEQ ID NO: 31285 |
| | | AA | DILMTQSPSSVSASVGDRVTITCRASQGIINWLA WYQQKPGKAPKLLIYAASSLQSGVPSRFSGSGS GTDFTLTISSLQPEDFAIYYCQQANSFPWTFGQG TKVEIK | EGQLLESGGGLVQPGGSLRLSCTASGFTFSTFAMT WVRQAPGRGLEWVSVISGRGGSSFYADSVKGRFTI SRDNTKNTLYLQMNSLRAEDTAVYYCAKDQLWFD YWGQGTLVTVSS |
| | | | SEQ ID NO: 27280 | SEQ ID NO: 31286 |
| | | NA | GACATCCAGATGACCCAGTCTCCATCCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCATTC ACTTTCGGCCCTGGGACCAAAGTGGATATCAA A | CAGGTCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATATGGTATGATGGAAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTATGTATTACTGTGCGAGAGAAGTGG GATTCACTGAGGACTACTGGGGCCAGGGAACCC TGGTCACCGTCTCCTCA |
| iPS:436634 | 21-225_227H5 | | SEQ ID NO: 27281 | SEQ ID NO: 31287 |

FIGURE 50
(Continued)

| | | | | |
|---|---|---|---|---|
| iPS:436636 | 21-225_227E6 | AA | DIQMTQSPSSLSASVGDRVTITCRASQDIRNDLG WYQQKPGKAPKRLIYAASSLQSGVPSRFSGSGS GTEFTLTISSLQPEDFATYYCLQHNSYPFTFGPGT KVDIK<br>SEQ ID NO: 27282 | QVQLVESGGGVVQPGRSLRLSCAASGFTFSNYGM HWVRQAPGKGLDWVAVIWYEESNKYYADSVKGR FTISRDNSKNTLYLQMNSLRAEDTAMYYCAREVGF TEDYWGQGTLVTVSS<br>SEQ ID NO: 31288 |
| | | NA | GACATCGTGATGACCCAGTCTCCAGACTCCCT GACTGTGTCTCTGGGCGAGAGGGCCACCATCA ACTGCAAGTCCAGCAGTGTTTATACAGC TCCAACGATAAGAACTACTTAGCTTGGTACCA GCAGAAACCAGGACAGCCTCCTAAGATGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATATTACTCCGTCCAGTTTTGGCCAGGG GACCAAGCTGGAGATCAAA<br>SEQ ID NO: 27283 | CAGGTGCAGCTGGTGCAGTCTGGGGCTGAGGTG AAGAAGCCTGGGGCCTCAGTGAAGGTCTCCTGC AAGGCTCTGGATACACCTTCACCAATTATGATA TCAACTGGGTGCGACAGGCCACTGGACAAGGGC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCCTATAGCAGT GGCTGGTACAAGTTTGACTACTGGGGCCAGGGA ACCCTGGTCACCGTCTCCTCA<br>SEQ ID NO: 31289 |
| | | AA | DIVMTQSPDSLTVSLGERATINCKSSQSVLYSSN DKNYLAWYQQKPGQPPKMLIYWASTRESGVPD RFSGSGSGTDFTLTISSLQAEDVAVYYCQQYYIT PCSFGQGTKLEIK<br>SEQ ID NO: 27284 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YKFDYWGQGTLVTVSS<br>SEQ ID NO: 31290 |

FIGURE 50
(Continued)

| | | | |
|---|---|---|---|
| iPS:436638 | 21-225_227C7 | NA | GACATCGTGATGACCCAGTCTCCAGACTCCCTGGCTGTGTCTCTGGGCGAGAGGGCCACCATCAACTGCAGGTCCAGCCAGATTGTTTATCCGACTCCAACAATAACTACTTAGCTTGGTACCAGCAGAAACCAGGACAGCCTCCTAAGCTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTTCTGTCAGCAATATTATAGTTCTCCGACGTTCGGCCAAGGGACCAAGGTGGAAATCAAA<br><br>SEQ ID NO: 27285 | CAGGTGCAGCTGGTGCAGTCTGGGGCTGAGGTGAAGAAGCCTAGGGCCTCAGTGAAGGTCTCCTGCAAGGCTTCTGGACACACCTTCACCAATTATGATATCAACTGGGTGCGACAGGCCACTGGACAAGGGCTTGAGTGGATGGGATGGATGCATCTAACAGTGGTAACACAGGCTATGACCAGGAACACCTCCATAAGCACAGTCACCATGAGCAGCTGAGCAGCCTGAGATCTGACGCCTACATGGAGCTGTGTTCTGTGCATATAGCAGTGGACACGGGCCGTGTATACTGGTTGACTACTGGGGCCAGGGAACCCTGGTCACCGTCTCCTCA<br><br>SEQ ID NO: 31291 |
| | | AA | DIVMTQSPDSLAVSLGERATINCRSSQIVLSDSNNNNYLAWYQQKPGQPPNLLIYWASTRESGVPDRFSGSGSGTDFTLTISSLQAEDVAVYFCQQYYSSPPTFGQGTKVEIK<br><br>SEQ ID NO: 27286 | QVQLVQSGAEVKKPRASVKVSCKASGHTFTNYDINWVRQATGQGLEWMGWMHPNSGNTGYAQKFQGRVTMTRNTSISTAYMELSSLRSEDTAVYYCAYSSGWYRFDYWGQGTLVTVSS<br><br>SEQ ID NO: 31292 |
| iPS:436640 | 21-225_227A8 | NA | GATATTGTGATGACCCAGACTCCACTCTCTGTCCGTCACCCTGGACAGCCGGCCTCCATCTCCTGCAAGTCTAGTCAGAGCCTCCTGCATAGTGATGGAAAAGACCTTTTGTATTGGTATCTGCAGAAGCCAGGCCAGCCTCCACAGCTCCTGATCTATGAAATTTCCAACCGGTTCTCTGGGGTGCCAGATAGGTTCAGTGGCAGCGGGTCAGGGACAGATTTCACACTGAAAATCAGTCGAGTGGAGGCTGAGGATGTGGGAGATTTATTACTGCATGCAAAGTACACAGCTTCCTCGGACGTTCGGCCAAGGGACCAAGGTGGAAATCAAA<br><br>SEQ ID NO: 27287 | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTATATACACTGGGTGCGACAGGCCCCTGGACAAGGGCTTGAGTGGATGGGATGGATCAACCCTTACAGTGGTGACACAAACTATGCACAGGACACGTTCCAGGGCAGGGTCACCATGACCAGGGACACGAGCACTACAGCCTACATGGAACTGAGCAGCCTGAGATTTGACGAGCACGGCCGTGTTTACTGTGCGAGAGATTGGGGTGGCTACAGTTCTTACTACTACGGTATGGACGTCTGGGGCCAAGGGACCACGGTCACCGTCTCTTCA<br><br>SEQ ID NO: 31293 |

FIGURE 50
(Continued)

| | | | | |
|---|---|---|---|---|
| | | AA | DIVMTQTPLSLSVTPGQPASISCKSSQSLLHSDGK TFLYWYLQKPGQPPQLLIYEISNRFSGVPDRFSGS GSGTDFTLKISRVEAEDVGIYYCMQSTQLPRTFG QGTRVEIK<br>SEQ ID NO: 27288 | QVQLVQSGAEVKKPGASVKVSCKASGYTFTGYYIH WVRQAPGQGLEWMGWINPYSGDTNYAQKFQGRV TMTRDTSVSTAYMELSRLRFDDTAVFYCARDWGG YSSYYYGMDVWGQGTTVTVSS<br>SEQ ID NO: 31294 |
| iPS-436644 | 21-225_227G9 | NA | GACATCGTGATGACCCAGTCTCCAGACTCCCT GGCTGTGTCTCTGGGCGAGAGGGCCACCATCA ACTGCAAGTCCAGCAGTGTTTACACAGC TCCAACAATAACAACTACTTAGCTTGGTATCA GCAGAAACCAGGACAGCCTCCTAAGCTGCTCA TTTACTGGGATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTGCTCCGTACAGTTTTGGCCAGGG GACCAAGTTGGAGATCAAA<br>SEQ ID NO: 27289 | CAGGTGCAGCTGGTGCAGTCTGGGGCTGAGGTG AAGAAGCCTGGGGCCTCAGTGAAGGTCTCCTGC AGGGCTTCTGGATACACCTTCACCAATTATGATA TCAACTGGGTGCGACAGGCCACTGGACGAGGGC TTGAGTGGATGGGATGTACCTAACAGTGG TAACACAGGCTATGCACAGAAGTTCCAGGCAG AGTCACCATGACCAGGAACACCTCCATAAGCAC AGCCTACATGGAGCTGAGCAGCTGAGATCTGA GGACACGGCCGTGTATTACTGTGCGTTAGCAGT GGCTGGTACTGGTTCGACCCCTGGGGCCAGGGA ACCCTGGTCACCGTCTCCTCA<br>SEQ ID NO: 31295 |
| | | AA | DIVMTQSPDSLAVSLGERATINCKSSQSVLHSSN NNNYLAWYQQKPGQPPKLLIYWGSTRESGVPD RFSGSGSGTDFTLTISSLQAEDVAVYYCQQYYSA PYSFGQGTKLEIK<br>SEQ ID NO: 27290 | QVQLVQSGAEVKKPGASVKVSCRASGYTFTFNYDIN WVRQAATGRGLEWMGWMYPNSGNTGYAQKFQGR VTMTRNTSISTAYMELSSLRSEDTAVYYCALSSGW YWFDPWGQGTLVTVSS<br>SEQ ID NO: 31296 |

FIGURE 50
(Continued)

| | | | |
|---|---|---|---|
| iPS:436646 | 21-225_227D11 | NA | GACATCGTGATGACCCAGTCTCCAGACTCCCTGGCTGTGTCTCTGGACGAGAGGGCCACCATCAACTGCAAGTCCAGCCAGAGTGTTTTACACAGTTCCAACAATAATAACTACTTAGCTTGGTACCAGCAGAAGCCAGGACAGCCTCCTAAGCTGCTCATTTACTGGGCATCTACCCGGGAATCCGGGATCCCTGACCGATTCAGTGGCAGCGGGTCTGGGACAGATTTCACTCTCACCATCAGCAGCCTGCAGGCTGAGGATGTGGCAGTTTATTACTGTCAGCAATATTATAATACTCCGTGCAGTTTTGGCCAGGGACCAAGCTGGAGATCAAA<br>SEQ ID NO: 27291 | CAGGTGCAGCTGGTGCAGTCTGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGGCTTGAGTGGATGGGATGGATGCACAGAAGTTCCAGGGCCGTAACACAGGCTATGCACAGAAGTTCCAGGGCCGAGTCACCATGACCAGGAACACCTCCATAAGCACAGCCTACATGGAACTGAGCAGCCTGAGATCTGAGGACACGGCCGTGTATTACTGTGCGTATAGCAGTGGCTGGTACTACTTTGACTACTGGGGCCAGGGAACCCTGGTCACCGTCTCCTCA<br>SEQ ID NO: 31297 |
| | | AA | DIVMTQSPDSLAVSLDERATINCKSSQSVLHSSNNNNYLAWYQQKPGQPPKLLIYWASTRESGIPDRFSGSGSGTDFTLTISSLQAEDVAVYYCQQYYNTPCSFGQGTKLEIK<br>SEQ ID NO: 27292 | QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCAYSSGWYYFDYWGQGTLVTVSS<br>SEQ ID NO: 31298 |
| iPS:436648 | 21-225_227F11 | NA | GATGTTGTGATGACTCAGTCTCCACTCTCCCTGCCCGTCACCCCTGGAGAGCCGGCCTCCATCTCCTGCTGGTCTAGTCAGAGCCTCCTGCATAGTAATGGATACAACTATTTGGATTGGTACCTGCAGAAGCCAGGGACAGTCTCCACAGGTCCTGATCTATTTGGGTTCTAATCGGGCCTCCGGGGTCCCTGACAGGTTCAGTGGCAGTGGATCAGGCACAGATTTTACACTGAAAATCAGCAGTGGAGGCTGAGGATGTTGGGGTTTATTACTGCATGCAAGCTCTACAAACTCCTCTCACCTTCGGCCAAGGGACACGACTGGAGATTAAA<br>SEQ ID NO: 27293 | GAGGTGCAGCTGGTGGAGTCTGGGGGAGGCTGGTCAAGCCTGGGGGGTCCCTGAGACTCTCCTGTGCAGTCTCTGGATTCACCTTCAGTACCTATAGCATGAACTGGGTCCGCCAGGCTCCAGGGAAGGGCTGGAGTGGGTCTCATCCATTAGTAGTAGTATTAATTACATGTACTACGCAGACTCAGTGAAGGGCCGATTCACCATCTCCAGAGACAACGCCAAGAACTCACTGTATCTGCAAATGAACAGCCTGAGAGCCGAGGACCTCGGCTGTGTATTACTGTGCGAGATTAGGGGTCTACTGGGGCCAGGAACCCTGGTCACCGTCTCCTCA<br>SEQ ID NO: 31299 |

FIGURE 50
(Continued)

| | | | | |
|---|---|---|---|---|
| | | | AA | DVVMTQSPLSLPVTPGEPASISCWSSQSLLHSNG YNYLDWYLQKPGQSPQVLIYLGSNRASGVPDRF SGSGSGTDFTLKISRVEAEDVGVYYCMQALQTP LTFGQGTRLEIK<br>SEQ ID NO: 27294 | EVQLVESGGGLVKPGGSLRLSCAVSGFTFSTYSMN WVRQAPGKGLEWVSSISSSINYMYYADSVKGRFTI SRDNAKNSLYLQMNSLRAEDSAVYYCARLGVYW GQGTLVTVSS<br>SEQ ID NO: 31300 |
| iPS:436650 | 21-225_227C12 | | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGCTTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A<br>SEQ ID NO: 27295 | CAGGTGCAGCTGGTGGAGTCTGGGGGAGGCGTG GTCCAGCCTGGGAAGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATATGTATATTGGAAGT AATCAATACTATGCGGACTCCGTGAAGGGCCGAT TCACCATCTCCAGAGACAATTCCAAGAACACGCT GTATCTGCAAATGAGCAGCTGACAGAGCCGAGGA CACGGCTGTGTATTACTGTGCAGAGAAGTGGGA TTCACTGAGGACTACTGGGGCCAGGGAACCCTG GTCACCGTCTCCTCC<br>SEQ ID NO: 31301 |
| | | | AA | DIQMTQSPSSLSASVGDRVTITCRASQGIRNDLG WYQQKPGKAPKRLIYAASSLQSGVPSRFSGSGS GTEFLTISSLQPEDFATYYCLQHNSYPFTFGPGT KVDIK<br>SEQ ID NO: 27296 | QVQLVESGGGVVQPGKSLRLSCAASGFTFSNYGM HWVRQAPGKGLEWVAVIWYIGSNQYYADSVKGR FTISRDNSKNTLYLQMSSLRAEDTAVYYCAREVGF TEDYWGQGTLVTVSS<br>SEQ ID NO: 31302 |

FIGURE 50
(Continued)

| | | | |
|---|---|---|---|
| iPS:436652 | 21-225_146B11 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TCCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGGACAGCAGCACTGTGGTA TTCGGCGGAGGGACCAAGCTGACCGTCCTA SEQ ID NO: 27297 SYELTQPPSVSVSPGQTASITCSGDKLGDKYASW YQQKPGQSPVLVIYQDSKRPSGIPERFSGSNSGN TATLTISGIQAMDEADYYCQAWDSSTVVFGGGT KLTVL SEQ ID NO: 27298 | GAGGTGCAACTGTTGGAGTCTGGGGGAGGCTTG GTACAGCCTGGGGGGTCCCTGAGACTCTCCTGTG CAGCTTCTGGATTCACCTTTAGCAGCTATGCCAT GAGTTGGGTCCGCCAGGCTCCAGGGAAGGGGCT GGAGTGGGTCTCAGTTATTAGTGGTGGTAGT AGCACATATACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGGTATGGACGTCTGGGG CCAAGGGACCACGGTCACCGTCTCCTCA SEQ ID NO: 31303 EVQLLESGGGLVQPGGSLRLSCAASGFTFSSYAMS WVRQAPGKGLEWVSVISGGGSSTYYADSVKGRFTI SRDNSKNTLYLQMNSLRAEDTAVYYCAKWRGNPT DYGMDVWGQGTTVTVSS SEQ ID NO: 31304 |
| iPS:436654 | 21-225_146C11 | NA | TCCTATGAACTGACTCAGCCACCCTCAGTGTC CGTGTCCCCAGGACAGACAGCCAGCATCACCT GCTCTGGAGATAAATTGGGGGATAAATATGCT TCCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGGACAGCAGCACTGTGGTA TTCGGCGGAGGGACCAAGCTGACCGTCCTA SEQ ID NO: 27299 | GAGGTGCAACTGTTGGAGTCTGGGGGAGGCTTG GTACAGCCTGGGGGGTCCCTGAGACTCTCCTGTG CAGCCTCTGGAATCACCTTTAGCAGCTATGCCAT GAGCTGGGTCCGCCAGGCTCCAGGGAAGGGGCT GGAGTGGGTCTCAGTTATTAGTGGTGGTAGT AGCACATATACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGGTATGGACGTCTGGGG CCAAGGGACCACGGTCACCGTCTCCTCA SEQ ID NO: 31305 |

FIGURE 50
(Continued)

| | | | | |
|---|---|---|---|---|
| iPS:436658 | 21-225_146A2 | AA | SYELTQPPSVSVSPGQTASITCSGDKLGDKYASWYQQKPGQSPVLVIYQDSKRPSGIPERFSGSNSGNTATLTISGTQAMDEADYYCQAWDSSTVVFGGGTKLTVL<br>SEQ ID NO: 27300 | EVQLLESGGGLVQPGGSLRLSCAASGFTFSSYAMSWVRQAPGKGLEWVSVISGGSSTYYADSVKGRFTISRDNSKNTLYLQMNSLRAEDTAVYYCAKWRGNPTDYGMDVWGQGTTVTVSS<br>SEQ ID NO: 31306 |
| | | NA | TCCTATGAGCTGACTCAGCCACCCTCAGTGTCCGTGTCCCCAGGACAGAGCCAGCATCACCTGCTCTGGAGATAAATTGGGGGATAAATATGCTTCCTGGTATCAGCAGAAGCCAGGCCAGTCCCCTGTGCTGGTCATCTATCAAGATAGCAAGCGGCCCTCAGGGATCCCTGAGCGATTCTCTGGCTCCAACTCTGGGAACACAGCCACTCTGACCATCAGCGGGATCCAGGCGTGGACAGCAGCACTGTGGTATTCGGCGGAGGGACCAAGCTGACCGTCCTA<br>SEQ ID NO: 27301 | GAGGTGCAACTGTTGGAGTCTGGGGGAGGCCTGGTACAGCCTGGGGGGTCCCTGAGACTCTCCTGTGCAGCCTCTGGATTCACCTTTAGCAGCTATGCCATGAGCTGGGTCCGCCAGGCTCCAGGGAAGGGGCTGGAGTGGGTCTCAGTTATTAGTGGTGGTAGTAGCACATACTACGCAGACTCCGTGAAGGGCCGGTTCACCATCTCCAGAGACAATTCCAAGAACACGCTGTACCTGCAAATGAACAGCCTGAGAGCCGAGGACACGGCCGTATATTACTGTGCGAAATGGCGAGGTAACCCCACTGACTACGGTATGGACGTCTGGGGCCAAGGGACCACGGTCACCGTCTCCTCA<br>SEQ ID NO: 31307 |
| | | AA | SYELTQPPSVSVSPGQTASITCSGDKLGDKYASWYQQKPGQSPVLVIYQDSKRPSGIPERFSGSNSGNTATLTISGTQAMDEADYYCQAWDSSTVVFGGGTKLTVL<br>SEQ ID NO: 27302 | EVQLLESGGGLVQPGGSLRLSCAASGFTFSSYAMSWVRQAPGKGLEWVSVISGGSSTYYADSVKGRFTISRDNSKNTLHLQMNSLRAEDTAVYYCAKWRGNPTDYGMDVWGQGTTVTVSS<br>SEQ ID NO: 31308 |

FIGURE 50
(Continued)

| | | | | |
|---|---|---|---|---|
| iPS:436660 | 21-225_146D8 | NA | CAGTCTGTACTGACTCAGCCACCTCAACGTC TGGGACCCCCGGGCAGAGGGTCACCATCTCT GTTCTGGAAGCAGCTCCTACATCGAAGTAAT ACTGTAGAACTGGTACCAGCAGCTCCCAGGAAC GGCCCCAAACTCCTCATCTATAGTAATAATC AGCGGCCCTCAGGGGTCCCTGACGATTCTCT GGCTCCAAGTCTGGCACCTCAGCTCCCTGGC CATCAGTGGGCTCCAGTCTGAGGATGACAGCCTG ATTATTACTGTCAGCATGGGATGACAGCCTT AATGGCGTGGTATTCGGCGGAGGGACCAAACT GACCGTCCTA | GAGGTGCAGCTGGTGGTGAGTCTGGGGAGGCTTG GTACAGCCTGGGGGGGTCCCTGAGACTCTCCTGTG CAGCCTCTGGATTCACCTTCAGTAACTATAACAT GAACTGGGTCCGCCAGGCTCCAGGAAGGGGCT GGAGTGGGTTCATACATTAGTAGAAGTAGTAAT ACCAAATACTATGTAGACTCTGTGAAGGGCCGAT TCACCATCTCCAGAGACAATGCCAAGAACTCATT GTATCTGCAAATGAACAGCCTGAGAGACGAGGA CACGGCTGTGTATTACTGTGCGAGAGATAGGAGT GGGAGCTACGGGTACTTCTACTACTACGGTTTGG ACGTCTGGGGCCAAGGGACCACGGTCACCGTCTC CTCA |
| | | | SEQ ID NO: 27303 | SEQ ID NO: 31309 |
| | | AA | QSVLTQPPSTSGTPGQRVTISCSGSSSYIGSNTVD WYQQLPGTAPKLLIYSNNQRPSGVPDRFSGSKS GTSASLAISGLQSEDEADYYCAAWDDSLNGVVF GGGTKLTVL | EVQLVESGGGLVQPGGSLRLSCAASGFTFSNYNMN WVRQAPGKGLEWVSYISRSSNTKYYVDSVKGRFTI SRDNAKNSLYLQMNSLRDEDTAVYYCARDRSGSY GYFYYGLDVWGQGTTVTVSS |
| | | | SEQ ID NO: 27304 | SEQ ID NO: 31310 |
| iPS:436662 | 21-225_147D7 | NA | TCCTATGAGTTGACTCAGCCACCCTCAGTGTC CGTGTCCCCAGGACAGACAGCCAGCATCACCT GCTCTGGAGATAAATTGGGGGATAAATTTGCT TGCTGGTATCAGCAGAAACCAGGCCAGTCCCC TGTACTGGTCATCTATCAAGATAGGAAGCGGC CCCTCAGGGATCCTGGAACACAGCCACTCTGACCATCAG AACTCTGGGAACACAGCCACTCTGACCATCAG CGGACCCAGGCTATGGATGAGGCTGACTATT ACTGTCAGGCGTGGGACAGGAACACCGCGTC TTCGGAACTGGGACCAAGGTCACCGTCCTA | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGGC TTGAGTGGATGGGATGGATGAACCTAATAGTGG TAACACAGGCTATGCAGCAGAACACTCCATAAGCAC AGTCACCATGACCAGGGACACCTCCATAAGCAC AGCTATATGGAGCTGAGAAGCCTGAGATCTGA GGACACGGCCGTGTATTACTGTGCGAGAGCGGA TATTGTATTATTACCAGCTGCTATCCCTTATAATT ACTACTTCGCTATGGACGTCTGGGGCCAAGGGAC CACGGTCACCGTCCTCA |

FIGURE 50
(Continued)

| | | | | |
|---|---|---|---|---|
| iPS:436664 | 21-225_147E7 | AA | SEQ ID NO: 27305 | SEQ ID NO: 31311 |
| | | | SYELTQPPSVSVSPGQTASITCSGDKLGDKFACW YQQKPGQSPVLVIYQDRKRPSGIPERFSGSNSGN TATLTISGTQAMDEADYYCQAWDRNTAVFGTG TKVTVL | QVQLVQSGAEVKKPGASVKVSCKASGYTFTSYDIN WVRQATGQGLEWMGWMNPNSGNTGYAQKFQGR VTMTRNTSISTAYMELRSLRSEDTAVYYCARADIV LVPAAIPYNYYFAMDVWGQGTTVTVSS |
| | | | SEQ ID NO: 27306 | SEQ ID NO: 31312 |
| | | NA | TCCTATGAGCTGACTCAGCCACCCTCAGTGTC CGTGTCCCCAGGACAGACAGCCAGCATCACCT GCTCTGGAGATAAATTGGGGGATAAAATATGCT TCCTGGTATCAGCAGAAGCCAGGCCAGTCCCC TGTGCTGGTCATCTATCAAGATAGCAAGCGCC CCTCAGGGATCCCTGAGCGATTCTCTGGCTCC AACTCTGGGAACACAGCCACTCTGACCATCAG CGGGATCCAGGTATGGATGAGGCTGACTATT ACTGTCAGGCGTGGGACAGCAGCACTGTGTA TTCGGCGGAGGGACCAAGCTGACCGTCCTA | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTGGTGGTGGTAGT AGTACATACTACGCAGACTCCGTGAAGGGCCGG TTCACCCTCTCCAGAGACAATTCCAAGAACACGC TGTATCTGCAAATGAACAGCCTGAGAGCCGAGG ACACGGCCGTTTTTACTGTGCAAATGGCGAGG TAACCCACTGACTACGGTATGGACGTCTGGGGC CAAGGGACCACGGTCACCGTCTCCTCA |
| | | | SEQ ID NO: 27307 | SEQ ID NO: 31313 |
| | | AA | SYELTQPPSVSVSPGQTASITCSGDKLGDKYASW YQQKPGQSPVLVIYQDSKRPSGIPERFSGSNSGN TATLTISGIQAMDEADYYCQAWDSSTVVFGGGT KLTVL | EVQLLESGGGLVQPGGSLRLSCAASGFTFSSYAMS WVRQAPGKGLEWVSVISGGGSSTYYADSVKGRFT LSRDNSKNTLYLQMNSLRAEDTAVFYCAKWRGNP TDYGMDVWGQGTTVTVSS |
| | | | SEQ ID NO: 27308 | SEQ ID NO: 31314 |

FIGURE 50
(Continued)

| | | | |
|---|---|---|---|
| iPS:436666 | 21-225_147B8 | NA | TCCTATGAACTGACTCAGCCACCCTCAGTGTCCGTGTCCCAGGACAGACAGCCAGTATCACCTGCTCTGGAGATAAATTGGGGGATAAATATGTTGCTCTGGTATCAGCAGAAGCCAGGCCAGTCCCCTGAGCTGGTCATCTATCAAGATAGGAAGCGGCCCCTCAGGGATCCCTGAGCGATTCTCTGGCTCCAACTCTGGGAACACAGCCACTCTGACCATCAGCGGGACCCAGGCTATGGATGAGGCTGACTATTACTGTCAGGCGTGGGGACAGTAACACTGCTGTGGTATTCGGCGGAGGGACCAAGCTGACCGTCCTA |
| | | | SEQ ID NO: 27309 |
| | | AA | SYELTQPPSVSVSPGQTASITCSGDKLGDKYVCWYQQKPGQSPELVIYQDRKRPSGIPERFSGSNSGNTATLTISGTQAMDEADYYCQAWGSNTAVVFGGGTKLTVL |
| | | | SEQ ID NO: 27310 |
| iPS:436668 | 21-225_147B9 | NA | TCCTATGAGCTGACTCAGCCCCCTCAGTGTCCGTGTCCCAGGACAGACAGCCAGCATCACCTGCTCTGGAGATAAATTGGGGGATAAATATGTTTCCTGGTATCAGCAGAAGCCAGGCCAGTCCCCTGTGCTGGTCATCTATCAAGATAGGAAGCGGCCCCTCAGGGATCCCTGAGCGATTCTCTGGCTCCAACTCTGGGAACACAGCCACTCTGACCATCAGCGGGACCCTGGCTGTGGACAGCAGCTGACTATTACTGTCAGGCGTGGGATGAGGCAGCACTTTGTGGTATTCGGCGGAGGGACCAAGTTGACCGTCCTA |
| | | | SEQ ID NO: 31315 |
| | | AA | QVQLVQSGAEVKKPGASVKVSCKASGYTFTDYYLHWVRQAPGQGLEWMGWINPNSGDTNYAQKFQGRVTMTRDTSISTAYMELSRLRSDDTAVYYCARDRDSGSGSYPYYYYGMDVWGQGTTVTVSS |
| | | | SEQ ID NO: 31316 |
| | | | CAGGTGCAGTTGGTGGAGTCTGGGGGAGGCGTGGTCCAGCCTGGGAGGTCCCTGAGACTCTCCTGTGCAGCGTCTGGATTCACCTTCAGTGACTATCAGGCTCACTGGGTCCGCCAGGCTCCAGGCAAGGGGCTGGAGTGGGTGGCAGTTATATCGAGCTCGTGAAGGGCCGAATAAATACTATGCAGAGACTCCAGAGACAATTCAAGAACACGCTGTATCTGCAAATGAACAGCCTGAGAGCCGAGGACACGGCTGTGTATTACTGTGCGAGAGATCGTGACTCACGGTGTGACCCCCCTACTACTACTACTACGGTATGGACGTCTGGGGCCAAGGGACCACGGTCACCGTCTCCTCA |

FIGURE 50
(Continued)

| | | | SEQ ID NO: 27311 | SEQ ID NO: 31317 |
|---|---|---|---|---|
| iPS-436670 | 21-225_147D9 | AA | SYELTQPPSVSVSPGQTASITCSGDKLGDKYVSW YQQRPGQSPVLVIYQDRKRPSGIPERFSGSNSGN TATLTISGTLAVDEADYYCLAWDSSTFVVFGGG TKLTVL | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDRDY GDPPYYYYGMDVWGQGTTVTVSS |
| | | | SEQ ID NO: 27312 | SEQ ID NO: 31318 |
| | | NA | TCCTATGAGCTGACTCAGCCACCCTCAGTGTC CGTGTCCCCAGGACAGACAGCCAGCATCACCT CCTCTGGAGATAAATTGGGTAATAAATATGTT TGCTGGTATCAGCAGAGGCCAGGCCAGTCCCC TGTGCTGTCTATCAAGATAGCAAGCGGC CCTCAGGGATCCCTGAGCGATTCTCTGGCTCC AACTCCGGGAACACAGCCACTCTGACCATCAG CGGGACCCAGGCTGTGGACGAGGAACACTTAGTG ACTGTCAGGCGGTGGGACAGGACCAAGCTGACCTCCT GTGTTCGGCGGAGGGACCAAGCTGACCGTCCT A | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGGCAT GCACTGGGTCCGCCAGGCTCCAGGCAAGGGCT GGAGTGGGTGGCAGATATATGGTTTGATGGCAGT AATAAATACTATGCAGACTCCGTGAAGGACCGAT TCACCATCTCCAGAGACAATTCCAAGAACACGCT GTATCTGCAAATGAACAGCCTGAGAGCCGAGGA CACGGCTGTTATTACTGTGCGAGAGATCGGGTG GAGGGTTCGGGGACTCCCTACTACTACTACGGTA TGGACGTCTGGGGCCAAGGGACCACGGTCACCG TCTCCTCA |
| | | | SEQ ID NO: 27313 | SEQ ID NO: 31319 |
| | | AA | SYELTQPPSVSVSPGQTASITSSGDKLGNKYVCW YQQRPGQSPVLVIYQDSKRPSGIPERFSGSNSGN TATLTISGTQAMDEADYYCQAWDRNTYVFGG GTKLTVL | QVQLVESGGGVVQPGRSLRLSCAASGFTFSSYGMH WVRQAPGKGLEWVADIWFDGSNKYYVDSVKDRF TISRDNSKNTLYLQMNSLRAEDTAVYYCARDRVEG SGTPYYYYGMDVWGQGTTVTVSS |
| | | | SEQ ID NO: 27314 | SEQ ID NO: 31320 |

FIGURE 50
(Continued)

| | | | |
|---|---|---|---|
| iPS:436672 | 21-225_147F9 | NA | TCCTATGAGCTGACTCAGCCACCCTCAGTGTC CGTGTCCCAGGACAGCAGCCAGCATCACCT GTTCTGGAGATGAATTGGGGAATAAATATGCT TGCTGGTATCAGCAGAAGCCAGGCCAGTCCC TGTGCTGGTCATCTATCAAGATAGCAAGCGGC CCTCAGGGATCCCTGAGGGATTCTCTGGCTCC AACTCTGGGAACACAGCCACTCTGACCATCAG CGGGACCCAGGCTATGGATGAGGCTGACTATT ACTGTCAGGCCTGGCACAGCAGCACTGTGTA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCTGTG CAGCGTCTGGATTCACCTTCAGTACCTATGGCAT GCACTGGGTCCGCCAGGCTCCAGGCAAGGGGCT GGAGTGGGTGGCAGTTATATGGTATGGTGAAGT GATAAAGACTATGCAGACTCCGTGAAGGGCCGA TTCACCATCTCCAAATGAACAGCTGAGAGCCGAGG TGTATCTGCAAATGAACAGCCTGAGAGCCGAGG ACACGGCTGTGTATTACTGTGCGAGAGATCGGGA TTATTGTAGTGGTGGTACTTGTCCTTACTACTACT ACTACGGTATGGACGTCTGGGGCCAAGGGACCA CGGTCACCGTCTCCTCA |
| | | | SEQ ID NO: 27315 | SEQ ID NO: 31321 |
| | | AA | SYELTQPPSVSVSPGQTASITCSGDELGNKYACW YQQKPGQSPVLVIYQDSKRPSGIPERFSGSNSGN TATLTISGTQAMDEADYYCQAWHSSTVFGGG TKLTVL | QVQLVESGGGVVQPGRSLRLSCAASGFTFSTYGMH WVRQAPGKGLEWVAVIWYGGSDKDYADSVKGRF TISRDISKNTLYLQMNSLRAEDTAVYYCARDRDYC SGGTCPYYYYYGMDVWGQGTTVTVSS |
| | | | SEQ ID NO: 27316 | SEQ ID NO: 31322 |

FIGURE 50
(Continued)

| | | | |
|---|---|---|---|
| iPS:436674 | 21-225_147G9 | NA | TCCTATGAGCTGACTCAGCCACCTCAGTGTC CGTGTCCCCAGGACAGACAGCCAGCATCACCT GCTCTGGAGATAAATTGGGGGATAAATATGCT TGCTGGTATCAGCAGAAGCCAGGCCAGTCCCC TGTGCTGGTCATCTATCAAGATAGGAAGCGGC CCTCAGGGATCCCTGAGCGATTCTCTGGCTCC AACTCTGGGAACACAGCCACTCTGACCATTAG CGGAACCCAGGCTATGGATGAGGCTGACTATT ACTGTCAGGCGTGGCACAGCAGTACTGTGGTA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGCCGTCTGGATTCACCTTCAGTACCTATGGCAT GCACTGGGTCCGCCAGGCTCCAGGCAAGGGCT GGAGTGGGTGGCAGTTATATGGTATGGGAAGT GATAAAGACTATGCAGACTCCGTGAAGGGCCGA TTCACCATCTCCAGAGACATTTCCAAGAACACGC TGTATCTGCAAATGAACAGCCTGAGAGCCGAGG ACACGGCTGTGTATTACTGTGCGAGAGATCGGGA TTATTGTAGTGGTGGTAGCTGCCCTTACTACTACT ACTACGGTATGGACGTCTGGGGCCAAGGGACCA CGGTCACCGTCTCCTCA |
| | | | SEQ ID NO: 27317 | SEQ ID NO: 31323 |
| | | AA | SYELTQPPSVSVSPGQTASITCSGDKLGDKYACW YQQKPGQSPVLVIYQDRKRPSGIPERFSGSNSGN TATLTISGTQAMDEADYYCQAWHSSTVVFGGG TKLTVL | QVQLVESGGGVVQPGRSLRLSCAASGFTFSTYGMH WVRQAPGKGLEWVAVIWYGGSDKDYADSVKGRF TISRDISKNTLYLQMNSLRAEDTAVYYCARDRDYC SGGSCPYYYYGMDVWGQGTTVTVSS |
| | | | SEQ ID NO: 27318 | SEQ ID NO: 31324 |

FIGURE 50
(Continued)

| | | | |
|---|---|---|---|
| iPS:436676 | 21-225_147E11 | NA | TCCTATGAGCTGACTCAGCCACCCTCAGTGTC<br>CGTGTCCCCAGGACAGACAGCCAGCATCACCT<br>GCTCTGGAGATAAATTGGGGGATAAATATGCT<br>TCCTGGTATCAGCAGAAGCCAGGCCAGTCCCC<br>TGTGTTGGTCATCTATCAAGATAGCAAGCGGC<br>CCTCAGGGGATCCCTGAGCGATTCTCTGGCTCC<br>AACTCTGGGAACACAGCCACTCTGACCATCAG<br>CGGGATCCAGGCTATGATGAGGCTGACTATT<br>ACTGTCAGGCGTGGGACAGCAGCACTGTGGTA<br>TTCGGCGGAGGGACCAAGCTGACCGTCCTA<br><br>SEQ ID NO: 27319<br><br>SYELTQPPSVSVSPGQTASITCSGDKLGDKYASW<br>YQQKPGQSPVLVIYQDSKRPSGIPERFSGSNSGN<br>TATLTISGIQAMDEADYYCQAWDSSTVVFGGGT<br>KLTVL<br><br>SEQ ID NO: 27320 | GAGGTGCAACTGTTGGAGTCTGGGGGAGGCTTG<br>GTACAGCCTGGGGGGTCCCTGAGACTCTCCTGTG<br>CAGCCTCTGGATTCACCTTTAGCAACTATGTCAT<br>GAGCTGGGTCCGCCAGGCTCCAGGGAAGGGGCT<br>GGAGTGGGTCTCAGTTATTAGTGGTGGTAGT<br>AGTACATACTACGCAGACTCCGTGAAGGGCCGG<br>TTCACCATCTCCAGAGACAATTCCAAGAACACGC<br>TGTATCTGCAAATGAACAGCCTGAGAGCCGAGG<br>ACACGGCCGTATATTACTGTGCGAAATGGCGAG<br>GTAACCCCACTGACTACGGTATGGACGTCTGGGG<br>CCAAGGGACCACGGTCACCGTCTCCTCA<br><br>SEQ ID NO: 31325<br><br>EVQLLESGGGLVQPGGSLRLSCAASGFTFSNYVMS<br>WVRQAPGKGLEWVSVISGGGSSTYYADSVKGRFTI<br>SRDNSKNTLYLQMNSLRAEDTAVYYCAKWRGNPT<br>DYGMDVWGQGTTVTVSS<br><br>SEQ ID NO: 31326 |
| iPS:436678 | 21-225_147B12 | NA | TCCTATGAGCTGACTCAGCCACCCTCAGTGTC<br>CGTGTCCCCAGGACAGACAGCCAGCATCACCT<br>GCTCTGGAGATAAATTGGGGGATAAATATGCT<br>TCCTGGTATCAGCAGAAGCCAGGCCAGTCCCC<br>TGTGCTGGTCATCATCAAGATAGCAAGCGGC<br>CCTCAGGGGATCCCTGAGCGATTCTCTGGCTCC<br>AACTCTGGGAACACAGCCACTCTGACCATCAG<br>CGGGATCCAGGCTATGATGACAGCTGACTATT<br>ACTGTCAGGCGTGGACAGCAGCACTGTGGTA<br>TTCGGCGGAGGGACCAAGCTGACCGTCCTA<br><br>SEQ ID NO: 27321 | GAGGTGCAACTGTTGGAGTCTGGGGGAGGCTTG<br>GTACAGCCTGGGGGGTCCCTGAGACTCTCCTGTG<br>CAGCCTCTGGATTCACCTTTAGCAGCTATGCCAT<br>GAGCTGGGTCCGCCAGGCTCCAGGGAAGGGGCT<br>GGAGTGGGTCTCAGTTATTAGTGGTGGTAGT<br>AGCACATACTACGCAGACTCCGTGAAGGGCCGG<br>TTCACCATCTCCAGAGACAATTCCAAGAACACGC<br>TGTATCTGCAAATGAACAGCCTGAGAGCCGAGG<br>ACACGGCCGTATATTACTGTGCGAAATGGCGAG<br>GTAACCCCACTGACTACGGTATGGACGTCTGGGG<br>CCAAGGGACCACGGTCACCGTCTCCTCA<br><br>SEQ ID NO: 31327 |

FIGURE 50
(Continued)

| | | | | |
|---|---|---|---|---|
| iPS:436680 | 21-225_147H12 | AA | SYELTQPPSVSVSPGQTASITCSGDKLGDKYASWYQQKPGQSPVLVIYQDSKRPSGIPERFSGSNSGNAATLTISGIQAMDEADYYCQAWDSSTVVPGGGTKLTVL<br>SEQ ID NO: 27322 | EVQLLESGGGLVQPGGSLRLSCAASGFTFSSYAMSWVRQAPGKGLEWVSVISGGGSSTYYADSVKGRFTISRDNSKNTLYLQMNSLRAEDTAVYYCAKWRGNPTDYGMDVWGQGTTVTVSS<br>SEQ ID NO: 31328 |
| | | NA | CAGTCTGTGTTGACTCAGCCACCCTCAGCGTCTGGGACCCCCGGGCAGAGGTCACCATCTCTTGTTCTGGAAGCAGCTCCAACATCGGAAGTTATGCTGTAAACTGGTATCAGCAGCTCCCAGGAACGGCCCCCAAACTCCTCATTTATAGTAATAATCACCGGCCCTCAGGGGTCCCTGACCGATTCTCTGGCTCCAAGTCTGGCACCTCAGCTCCTGGCCATCAGTGGGCTCCAGTCTGAAGATGGATGACAGCCTGATTATTACTGTGAAGCAGTATGATAGCAGCTAATGGTCCGGTATTCGGCGGAGGGACCAAGCTGACCGTCCTA<br>SEQ ID NO: 27323 | CAGGTCCAGCTGCAGGAGTCGGGCCCAGGACTGGTGAATCCTTCACAGACCCTGTCCCTCACCTGCGCTGTCTCTGGTGGCTCCATCAGCAGTGGTTATTACCACTGGAGCTGGATCCGCCAGCACCCAGGGAAGGGCCTGGAGTGGATTGGGTACATCTATTACAGTGGGAGCACCTACTACAACCGTCCCTCAAGAGTCGAGTTACCATATCAGTTGACACGTCTAAGAACCAGTTCTCCCTGAAGCTGACCTCTGTGACTGCCGCGGACACGGCCGTGTATTACTGTGCGAGAGATTGGGGTGGCTACGATTCGAGTGGCTGGTTCGACCCTGGGGCCAGGGAACCCTGGTCACCGTCTCCTCA<br>SEQ ID NO: 31329 |
| | | AA | QSVLTQPPSASGTPGQRVTISCSGSSNIGSYAVNWYQQLPGTAPKLLIYSNNHRPSGVPDRFSGSKSGTSASLAISGLQSEDEADYYCEAWDDSLNGPVFGGGTKLTVL<br>SEQ ID NO: 27324 | QVQLQESGPGLVNPSQTLSLTCAVSGGSISSGYYHWSWIRQHPGKGLEWIGYIYYSGSTYYNPSLKSRVTISVDTSKNQFSLKLTSVTAADTAVYYCARDWGGYDSSGWFDPWGQGTLVTVSS<br>SEQ ID NO: 31330 |

FIGURE 50
(Continued)

| | | | | |
|---|---|---|---|---|
| iPS:436682 | 21-225_146A8 | NA | CAGTCTGTGCTGACTCAGCCACCTCAGCGTC TGGGACCCCCGGGCAGAGGGTCACCATCTCT TGTTCTGGAAGCAGCTCCAACATCGGAAGTAAT TCTATAAACTGGTACCAGCAACTCCAAGAAC GGCCCCAAACTCCTCATCTATAGTAATGATC AGCGGCCCTCAGGGGTCCCTGACCGATTCTCT GGCTCCAAGTCTGGCACCTCAGCCTCCCTGGC CATCAGTGGGCTCCAGTCTGAGGATGACAGCTG ATTATTACTGTGCAGCATGGGATGACAGCCTG AACGGCGTGGTATTCGGCGGAGGGACCAAGC TGACCGTCCTA<br><br>SEQ ID NO: 27325 | GAGGTGAAGCTGGTGGAGTCTGGGGGAGGCTTG GTACAGCCTGGGGAGTCCCTGAGACTCTCCTGTG TAGCCTCTGATTCACCTTCAGTAACTAACAT GAACTGGGTCCGCCAGGCTCCAGGGAAGGGACT GGAGTGGGTTCATACATTAGTAGAAGTAGTAAT ACCAAATACTACGCAGACTCTGTGAGGGCCGA TTCACCATCTCCAGAGACAATGCCAAGAATTCAC TATATCTGCAAATGAACAGCCTGAGAGACGAGG ACACGGCTGTGTATTACTGTGCGAGAGATAGGAG TGGGAGCTACGGTACTTCTACTACGGTTTG GACGTCTGGGGCCAAGGGACCACGGTCACCGTC TCCTCA<br><br>SEQ ID NO: 31331 |
| | | AA | QSVLTQPPSASGTPGQRVTISCSGSSNIGSNSIN WYQQLPRTAPKLLIYSNDQRPSGVPDRFSGSKSG TSASLAISGLQSEDEADYYCAAWDDSLNGVVFG GGTKLTVL<br><br>SEQ ID NO: 27326 | EVKLVESGGGLVQPGESLRLSCVASGFTFSNYMN WVRQAPGKGLEWVSYISRSSNTKYYADSVRGRFTI SRDNAKNSLYLQMNSLRDEDTAVYYCARDRSGSY GYFYYYGLDVWGQGTTVTVSS<br><br>SEQ ID NO: 31332 |
| iPS:436684 | 21-225_146B6 | NA | CAGTCTGTGCTGACTCAGCCACCTCAGCGTC TGGGACCCCCGGGCAGAGGGTCACCATCTCT TGTTCTGGAAGCAGCTCCAACATCGGAAGTAAT GCTGTAAACTGGTACCAGCAGCTCCCAGGAAC GGCCCCCAAACTCCTCATCTATAGTAATAATC AGCGGCCCTCAGGGGTCCCTGACCGGTTCTCT GGCTCCAAGTCTGGCACCTCAGCCTCCCTGGC CATCAGTGGGCTCCAGTCTGAGGATGACAGCTG ATTATTACTGTGCAGCATGGGATGACAGCCTG AATGGCGTGGTATTCGGCGGAGGGACCAAGCT GACCGTCCTA<br><br>SEQ ID NO: 27327 | GAGGTGCAGCTGGTGGAGTCTGGGGGAGGCTTG GTACAGCCTGGGGGGTCCCTGAGACTCTCCTGTG CAGCCTCTGATTCACCTTCAGTAGTAACAT GAACTGGGTCCGCCAGGCTCCAGGGAAGGGGCT GGAGTGGGTTCATACATTAGTAGAAGTAGTAAT ACCAAAACTACTACGCAGACTCTGTGAAGGGCCGA TTCACCATCTCCAGAGACAATGCCAAGAACTCAC TGTATCTGCAAATGACAGCTGAGAGACGAGG ACACGGCTGTGTATTACTGTGCGAGAGATAGGAG TGGGAGCTACGGTACTTCTACTACGGTTTG GACGTCTGGGGCCAAGGGACCACGGTCACCGTC TCCTCA<br><br>SEQ ID NO: 31333 |

FIGURE 50
(Continued)

| | | | | |
|---|---|---|---|---|
| iPS-436686 | 21-225_148G6 | AA | QSVLTQPPSASGTPGQRVTISCSGSSSNIGSNAVN WYQQLPGTAPKLLIYSNNQRPSGVPDRFSGSKS GTSASLAISGLQSEDEADYYCAAWDDSLNGVVF GGGTKLTVL<br>SEQ ID NO: 27328 | EVQLVESGGGLVQPGGSLRLSCAASGFTFSSYNMN WVRQAPGKGLEWVSYISRSSNTKHYADSVKGRFTI SRDNAKNSLYLQMDSLRDEDTAVYYCARDRSGSY GYFYYYGLDVWGQGTTVTVSS<br>SEQ ID NO: 31334 |
| | | NA | TCCTATGAGCTGACTCAGCCACCCTCAGTGTC CGTGTCCCCAGGACAGACAGCCAGCATCACCT GCTCTGGAGATAAATTGGGGGATAAATATGCT TCCTGGTATCAGCAGAAGCCAGGCCAGTCCCC TGTGCTGGTCATCTATCAAGATAGCAAGCGGC CCCTCAGGGATCCCTGAGCGATTCTCTGGCTCC AACTCTGGGAACACAGCCACTCTGACCATCAG CGGGATCCAGGTCGTGGGACAGCAGCACTGTGGTA ACTGTCAGGCGTGGGACAGCAGCACTGTGGTA TTCGGCGGAGGGACCAAGCTGACCGTCCTA<br>SEQ ID NO: 27329 | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGTTATTAGTGGTGTTGTAGT AGCACATACTAGCAGACTCCGTGAAGGGCCGG TTCACCATCTCCAGAGACAATTCCAAGAACATGC TGCATCTGCAAATGAACAGCCTGAGAGCCGAGG ACACGGCCGTATATTACTGTGCGAAATGGCGAG GTAACCCCACTGACTACGGTATGGACGTCTGGGG CCAAGGGACCACGGTCACCGTCTCCTCA<br>SEQ ID NO: 31335 | |
| | | AA | SYELTQPPSVSVSPGQTASITCSGDKLGDKYASW YQQKPGQSPVLVIYQDSKRPSGIPERFSGSNSGN TATLTISGIQAMDEADYYCQAWDSSTVVFGGGT KLTVL<br>SEQ ID NO: 27330 | EVQLLESGGGLVQPGGSLRLSCAASGFTFSSYAMS WVRQAPGKGLEWVSVISGGGSSTYYADSVKGRFTI SRDNSKNMLHLQMNSLRAEDTAVYYCAKWRGNP TDYGMDVWGQGTTVTVSS<br>SEQ ID NO: 31336 |

FIGURE 50
(Continued)

| | | | |
|---|---|---|---|
| iPS:436688 | 21-225_148C8 | NA | TCCTATGAGCTGACTCAGCCACCCTCAGTGTC CGTGTCCCCAGGACAGACAGCCAGCATCACCT GCTCTGGAGATAAATTGGGGGATAAATATGTT TCCTGGTATCAGCAGAAGCCAGGCCAGTCCCC TATACTGGTCATCTATCAAGATAGGAAGCGGC CCTCAGGGACCCCTGAGCGATTCTCTGGCTCC AACTCTGGGAACACAGCCACTCTGACCATCAG CGGGACCCAGGCTATGGATGAGGCTGATTATT ACTGTCTGGCGTGGGACAGCAGCACTTTGTG GTATTCGGCGGAGGGACCAAGTTGACCGTCCT A | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCGTGA CTACGGTGACCCCCCTACTACTACTACGGT ATGGACGTCTGGGGCCAAGGGACCACGGTCACC GTCTCCTCA |
| | | | SEQ ID NO: 27331 | SEQ ID NO: 31337 |
| | | AA | SYELTQPPSVSVSPGQTASITCSGDKLGDKYVSW YQQKPGQSPILVIYQDRKRPSGTPERFSGSNSGN TATLTISGTQAMDEADYYCLAWDSSTFVVFGGG TKLTVL | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDRDY GDPPYYYYGMDVWGQGTTVTVSS |
| | | | SEQ ID NO: 27332 | SEQ ID NO: 31338 |
| iPS:436690 | 21-225_148A9 | NA | TCCTATGAGCTGACTCAGCCACCCTCAGTGTC CGTGTCCCCAGGACAGACAGCCAGCATCACCT GTTCTGGAGATAAATTGGGGAATAAATATGTT TGCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTGTGGATGAGGCTGACTATT ACTGTCAGGGGTGGACAGCAGCACTGTGGTA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGGCGTCTGGATTCACCTTCAGTACCTATGGCAT GCACTGGGTCCGCCAGGCTCCAGGCAAGGGGCT GGAGTGGGTGGCAGTTATATGGTATGGTGAAGT GATAAAGACTATGCAGACTCCGTGAAGGGCCGA TTCACCATCTCCAGAGACATTTCCAAGAACACGC TGTATCTGCAAATGAACAGCCTGAGAGCCGAGG ACACGGCTGTGTATTACTGTGCGAGAGATCGGGA TTATTGTAGTGGTGGTACTTGTCCTTACTACTACT ACTACGGTATGGACGTCTGGGGCCAAGGGACCA CGGTCACCGTCTCCTCA |
| | | | SEQ ID NO: 27333 | SEQ ID NO: 31339 |

FIGURE 50
(Continued)

| | | | | |
|---|---|---|---|---|
| iPS:436694 | | AA | SYELTQPPSVSVSPGQTASITCSGDKLGNKYVCW YQQKPGQSPVLVIYQDSKRPSGIPERFSGSNSGN TATLTISGTQAMDEADYYCQAWHSSTVVFGGG TKLTVL | QVQLVESGGGVVQPGRSLRLSCAASGFTFSTYGMH WVRQAPGKGLEWVAVIWYGGSDKDYADSVKGRF TISRDISKNTLYLQMNSLRAEDTAVYYCARDRDYC SGGTCPYYYYYGMDVWGQGTTVTVSS |
| | | | SEQ ID NO: 27334 | SEQ ID NO: 31340 |
| | 21-225_148G11 | NA | TCCTATGAGCTGACTCAGCCACCCTCAGTGTC CGTGTCCCCAGGACAGACAGCCAGCATCACCT GCTCTGGAGATAAATTGGGGATAAATTTGCT TCCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGACAGCAGCACTGTGGTA TTCGGCGGAGGGACCAAGCTGACCGTCCTA | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATCCCAT GAGCTGGGTCCGCCAGGCTCCCGGGAAGGGGCT GGAGTGGGTCTCAGTTATTAGTGGTGGTGGTAGT AGTGCATACTACGCAGACTCCGTGAAGGGCCGG TTCACCATCTCCAGAGACAATTCCAAGAACACGC TGTATCTGCAAATGAACAGCTGAGAGCCGAGG ACACGGCCGTATATTACTGTGCAAATGGCGAG GTAACCCACTGACTACGGTATGGACGTCTGGGG CCAAGGGACCACGGTCACCGTCTCCTCA |
| | | | SEQ ID NO: 27335 | SEQ ID NO: 31341 |
| | | AA | SYELTQPPSVSVSPGQTASITCSGDKLGDKFASW YQQKPGQSPVLVIYQDSKRPSGIPERFSGSNSGN TATLTISGIQAMDEADYYCQAWDSSTVVFGGGT KLTVL | EVQLLESGGGLVQPGGSLRLSCAASGFTFSSYPMS WVRQAPGKGLEWVSVSGGGSSAYYADSVKGRFTI SRDNSKNTLYLQMNSLRAEDTAVYYCAKWRGNPT DYGMDVWGQGTTVTVSS |
| | | | SEQ ID NO: 27336 | SEQ ID NO: 31342 |

FIGURE 50
(Continued)

| | | | |
|---|---|---|---|
| iPS:436696 | 21-225_149A1 | NA | CAGTCTGTGCTGACTCAGCCACCCTCAGCGTC<br>TGGGACCCCCGGGCAGAGGGTCACCATCTCTT<br>GTTCTGGAAGCAGCTCCAACATCGGAAGTAAT<br>GCTGTAAACTGGTACCAGCAGCTCCCAGGAAC<br>GGCCCCAAACTCCTCATCTATAGTAATAATC<br>AGCGGCCCTCAGGGGTCCCTGACCGTTCTCT<br>GGCTCCAAGTCTGGCACCTCAGCTCCCTGGC<br>CATCAGTGGGCTCCAGTCTGAGGATGAGGCTG<br>ATTATTACTGTGCAGCATGGGATGACAGCCTG<br>AATGGCGTGGTATTCGGCGGAGGGACCAAGCT<br>GACCGTCCTA<br>SEQ ID NO: 27337 | GAGGTGCAGCTGGTGGAGTCTGGGGGAGGCTTG<br>GTACAGCCTGGGGGGTCCCTGAGACTCTCCTGTG<br>CAGCCTCTGGATTCACCTTCAGTAGCTATAACAT<br>GAACTGGGTCCGCCAGGCTCCAGGGAAGGGGCT<br>GGAGTGGGTTTCATACATTAGTAGAAGTAGTAAT<br>ACCAAACACTACGCAGACTCTGTGAAGGGCGA<br>TTCACCATCTCCAGAGACAATGCCAAGAACTCAC<br>TGTATCTGCAAATGAACAGCCTGAGAGACGAGG<br>ACACGGCTGTGTATTACTGTGCGAGAGATAGGAG<br>TGGGAGTACGGTACTTCTACTACTACGGTTTG<br>GACGTCTGGGGCCAAGGGACCACGGTCACCGTC<br>TCCTCA<br>SEQ ID NO: 31343 |
| | | AA | QSVLTQPPSASGTPGQRVTISCSGSSSNIGSNAVN<br>WYQQLPGTAPKLLIYSNNQRPSGVPDRFSGSKS<br>GTSASLAISGLQSEDEADYYCAAWDDSLNGVVF<br>GGGTKLTVL<br>SEQ ID NO: 27338 | EVQLVESGGGLVQPGGSLRLSCAASGFTFSSYNMN<br>WVRQAPGKGLEWVSYISRSSNTKHYADSVKGRFTI<br>SRDNAKNSLYLQMNSLRDEDTAVYYCARDRSGSY<br>GYFYYYGLDVWGQGTTVTVSS<br>SEQ ID NO: 31344 |
| iPS:436698 | 21-225_149B5 | NA | TCCTATGAACTGACTCAGCCACCCTCAGTGTC<br>CGTGTCCCCAGGACAGACAGCCAGCATCACCT<br>GCTCTGGATATAAATTGGGGTATAAATATGTT<br>TGCTGGTATCAGCAGAAGCCAGGCCAGTCCCC<br>TGTACTGGTCATCTTTCAAAATAACCAGCGGC<br>CCTCAGGGATCCGAGCGATTCTCTGGCTCC<br>AACTCTGGGAACACAGCCTCTGACCATCAG<br>CGGGACCCAGGCTATGATGAGGCTGACTATT<br>ACTGTCAGGGCGTGGGACAGCAGCACTGTGGTA<br>TTCGGCGGAGGGACCAAGCTGACCGTCCTA<br>SEQ ID NO: 27339 | GAGGTGCAGCTGGTGGAGTCTGGGGGAGGCTTG<br>GTCCAGCCTGGGGGGTCCCTGAGACTCTCCTGTG<br>CAGCCTCTGGATTCACCTTTAGTAGCTATTGGAT<br>GAACTGGGTCCGCCAGGCTCCAGGGAAGGGGCT<br>GGAGTGGGTTGGCCAACATAAAGCAAGATGAAG<br>TGAGAAATACTATGTGGACTCTGTGAAGGGCCGA<br>TTCACCATCTCCAGAGACAACGCCAAGAATTCAC<br>TGTATCTGCAAATGAACAGCCTGAGAGCCGAGG<br>ACACGGCTGTGTATTACTGTGCGAGAGGATGTA<br>TAGCAGTGGCTGGTACGTCTTTGACTACTGGGGC<br>CAGGGAACCCTGGTCACCGTCTCCTCA<br>SEQ ID NO: 31345 |

FIGURE 50
(Continued)

| | | | |
|---|---|---|---|
| iPS:436700 | | AA | SYELTQPPSVSVSPGQTASITCSGYKLGYKYVCW YQQKPGQSPVLVIFQNNQRPSGIPERFSGSNSGN TASLTISGTQAMDEADYYCQAWDSSTVVFGGG TKLTVL<br>SEQ ID NO: 27340 | EVQLVESGGGLVQPGGSLRLSCAASGFTFSGYWM NWVRQAPGKGLEWVANIKQDGSEKYYVDSVKGR FTISRDNAKNSLYLQMNSLRAEDTAVYYCARGMY SSGWYVFDYWGQGTLVTVSS<br>SEQ ID NO: 31346 |
| | 21-225_149C7 | NA | TCCTATGAGCTGACTCAGCCACCTCAGTGTC CGTGTCCCCAGGACAGACAGCCAGCATCACCT GCTCTGGAAATAAATTGGGGATAAATATGCT TCCTGGTATCAGCAGAAGCCAGGCCAGTCCC TGTGCTGGTCATCTATCAAGATAGCAAGCGGC CCTCAGGGATCCCTGAGCGATTCTCTGGCTCC AAGTCTGGGAACACAGCCACTCTGACCATCAG CGGGATCCAGGCTATGGAGGACAGCAGCACTGTGGTA ACTGTCAGGCGTGGGACCAAGCTGACCGTCCA<br>SEQ ID NO: 27341 | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGTTATTAGTGGTGGTGGTAGT AGCACATACTACGCAGACTCCGTGAAGGGCCGG TTCACCATCTCCAGAGACAATTCCAAGAACACGC TGTATCTGCAAATGAACAGCTGAGAGCCGAGG ACACGGCCGTATATTACTGTGCGAAATGGCGAG GTAACCCACTGACTACGGTATGGACGTCTGGGG CCAAGGGACCACGGTCACCGTCTCCTCA<br>SEQ ID NO: 31347 |
| | | AA | SYELTQPPSVSVSPGQTASITCSGNKLGDKYASW YQQKPGQSPVLVIYQDSKRPSGIPERFSGSKSGN TATLTISGIQAMDEADYYCQAWDSSTVVFGGGT KLTVP<br>SEQ ID NO: 27342 | EVQLLESGGGLVQPGGSLRLSCAASGFTFSSYAMS WVRQAPGKGLEWVSVISGGGSSTYYADSVKGRFTI SRDNSKNTLYLQMNSLRAEDTAVYYCAKWRGNPT DYGMDVWGQGTTVTVSS<br>SEQ ID NO: 31348 |

FIGURE 50
(Continued)

| | | | |
|---|---|---|---|
| iPS:436702 | 21-225_149E8 | NA | CAGGCTGTGTCGACTCAGCCGCTTCCCTCTCT GCATCTCCTGGAGCATCCAGCCAGTCTCACCTG CACCTTACGCAGTGGCATCTACTGTTACTACCT ATAGGATATACTGGTACCAGCAGAAGCCAGG GAGTCCTCCCCAGTTTCTCCTGCGGTACACATC AGACTCAGATAAACACCAGGGCTCTGGAGTCC CCAGCCGCTTCTCTGGATCCAAAGATGCTTCG GCCAATGCAGGGATTTTATTCATCTCTGGGCT CCAGTCTGAGGATGAGGCTGACTATTACTGTA TGATTTGGCACAGCAGCGCTTGGGTGTTCGGC GGAGGGACCAAGCTGACCGTCCTA<br><br>SEQ ID NO: 27343 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGTTATAGCAT GAACTGGGTCCGCCAGGCTCCAGGGAAGGGGCT GGAGTGGGTCTCAGCCATTAGTAGTACTGGTAGT TACATATATTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGGACGGCAGTG GCTGTACTGGGTGGTTCGACCCCTGGGGCCAGG GAACCCTGGTCACCGTCCTCA<br><br>SEQ ID NO: 31349 |
| | | AA | QAVSTQPSSLSASPGASASLTCTLRSGITVTTYRI YWYQQKPGSPPQFLLRYTSDSDKHQGSVPSRF SGSKDASANAGILFISGLQSEDEADYYCMIWHSS AWVFGGGTKLTVL<br><br>SEQ ID NO: 27344 | EVQLVESGGGLVKPGGSLRLSCAASGFTFSSYSMN WVRRAPGKGLEWVSAISSTGSYIYYADSVKGRFTIS RDNAKNSLYLQMNSLRAEDTAVYYCARTAVAGTG WFDPWGQGTLVTVSS<br><br>SEQ ID NO: 31350 |
| iPS:436704 | 21-225_149C10 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TCCTGGTATCAGCAGAAGCCAGGCCAGTCCCC TGTGCTGGTCATCTATCAAGATAACAAGCGGC CCTCAGGGATCCCTGAGCGATTCTCTGGCTCC AACTCTGGGAACACAGCCACTCTGACCATCGG CGGGATCCAGGCTATGATGAGGCTGACTATT ACTGTCAGGCGTGGGACAGCAGCACTGTGGTA TTCGGCGGAGGGACCAAGCTGACCGTCCTA<br><br>SEQ ID NO: 27345 | GAGGTGCAACTGTTGGAGTCTGGGGGAGGCTTG GTACAGCCTGGGGGGTCCCTGAGATTCTCCTGTG CAGCCTCTGGATTCACCTTTAGCAGCTACGCCAT GAGCTGGGTCCGCCAGGCTCCAGGGAAGGGGCT GGAGTGGGTCTCAGTTATAAGTGGAGGTGGTAGT AGCACATATTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGGTATGACGTCTGGGG CCAAGGGACCACGGTCACCGTCTCCTCA<br><br>SEQ ID NO: 31351 |

FIGURE 50
(Continued)

| | | | | |
|---|---|---|---|---|
| iPS:436706 | 21-225_149A11 | AA | SYELTQPPSVSVSPGQTASITCSGDKLGDKYASWYQQKPGQSPVLVIYQDNKRPSGIPERFSGSNSGNTATLTIGGIQAMDEADYYCQAWDSSTVVFGGGTKLTVL<br>SEQ ID NO: 27346 | EVQLLESGGGLVQPGGSLRFSCAASGFTFSSHAMSWVRQAPGKGLEWVSVISGGGSSTYYADSVKGRFTISRDNSKNTLYLQMNSLRAEDTAVYYCAKWRGNPTDYGMDVWGQGTTVTVSS<br>SEQ ID NO: 31352 |
| | | NA | TCCTATGAACTGACTCAGCCGCCCTCAGTGTCCGTGTCCCCAGGACAGACAGCCAGCATCACCTGCTCTGGAGATAAATTGGGAATAAATATGTTTCCTGGTATCAGCAGAAGCCAGGCCAGTCCCCTGTGCTGGTCATCTATCAAGATAGCAGGCGGCCCTCAGGGATCCTGAGCGATTCTCTGGCTCCAACTCTGGGAACACAGCCACTCTGACCATCAGCGGGACCCAGGCTATGGATGAGGCTGACTATTACTGTCTGGCGTGGGACAGCAGCACTGTGACCGTCCTGTCTTCGGCGGAGGGACCAAGTTGACCGTCCTA<br>SEQ ID NO: 27347 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGCTGGAGTGGGTGGCAGTTATATGGTATGATGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCGTGACTACGGTGACCCCCCTACTACTACTACTACGGTATGGACGTCTGGGGCCAAGGGACCACGGTCACCGTCTCCTCA<br>SEQ ID NO: 31353 |
| | | AA | SYELTQPPSVSVSPGQTASITCSGDKLGNKYVSWYQQKPGQSPVLVIYQDSRRPSGIPERFSGSNSGNTATLTISGTQAMDEADYYCLAWDSSTFVVFGGGTKLTVL<br>SEQ ID NO: 27348 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDRDYGDPPYYYYGMDVWGQGTTVTVSS<br>SEQ ID NO: 31354 |

FIGURE 50
(Continued)

| | | | | |
|---|---|---|---|---|
| iPS:436708 | 21-225_150D3 | NA | TCCTATGAGCTGACTCAGCCACCCTCAGTGTC CGTGTCCCCAGGACAGACAGCCAGCATCACCT GCTCTGGAGATGAATTGGGGAATAAATATGCT TGCTGGTATCAGCAGAAGCCAGGCCAGTCCCC TGTGCTGGTCATCTATCAAGATAACAAGCGGC CCTCAGGGATCCCTGAGCGATTCTCTGGCTCC AGCTCTGGGAACACAGCCACTCTGACCATCAG CGGGACCCAGGCTATGGATGAGGCTGACTATT ACTGTCAGGCGTGGCACAGCAGCACTGTGGTA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTACTTACTGGCAT GCACTGGGTCCGCCAGGCTCCAGGCAAGGGGCT GGAGTGGGTGGCAGTTATATGGTATGGTGAAGT AATAAAGACTATGCAGAGACTCCGTGAAGGGCCGA TTCACCATCTCCAGAGACAATTCCAAGAACACGC TGTATCTGCAAATGAACAGTTTGAGAGCCAGGA CACGGCTGTGTATTACTGTGCGAGAGATCGGGAT TATTGTAGTGGTGGTACCTGCCCTTACTACTACTA CTACGGTATGGACGTCTGGGGCCAAGGGACCAC GGTCACCGTCTCCTCA |
| | | | SEQ ID NO: 27349 | SEQ ID NO: 31355 |
| | | AA | SYELTQPPSVSVSPGQTASITCSGDELGNKYACW YQQKPGQSPVLVIYQDNKRPSGIPERFSGSSSGN TATLTISGTQAMDEADYYCQAWHSSTVVFGGG TKLTVL | QVQLVESGGGVVQPGRSLRLSCAASGFTFSTYGMH WVRQAPGKGLEWVAVIWYGGSNKDYADSVKGRF TISRDNSKNTLYLQMNSLRAEDTAVYYCARDRDY CSGGTCPYYYYGMDVWGQGTTVTVSS |
| | | | SEQ ID NO: 27350 | SEQ ID NO: 31356 |

FIGURE 50
(Continued)

| | | | |
|---|---|---|---|
| iPS:436710 | 21-225_150F6 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TCCTGGTATCAGCAGAAGCCAGGCCAGTCCCC TGTGCTGGTCATCTGTCAAGATAGCAAGCGGC CCTCAGGGATCCCTGAGGGATTCTCTGGCTCC AACTCTGGGAACACAGCCACTCTGACCATCAG CGGGATCCAGGCTATGGATGAGGCTGACTATT GCTGTCAGGCGTGGACAGCAGCACTGTGGTA TTCGGCGGAGGGACCAAGCTGACCGTCCTA<br><br>SEQ ID NO: 27351<br><br>SYELTQPPSVSVSPGQTASITCSGDKLGDKYASW YQQKPGQSPVLVICQDSKRPSGIPERFSGSNSGN TATLTISGIQAMDEADYCCQAWDSSTVVFGGGT KLTVL<br><br>SEQ ID NO: 27352 | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTTCAGTTATTAGTGGTGGTGGTAGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCACTGACTACGGTATGGACGTCTGGGG CCAAGGGACCACGGTCACCGTCCTCCTCA<br><br>SEQ ID NO: 31357<br><br>EVQLLESGGGLVQPGGSLRLSCAASGFTFSSYAMS WVRQAPGKGLEWVSVISGGGSSTYYADSVKGRFTI SRDNSKNTLYLQMNSLRAEDTAVYYCAKWRGNPT DYGMDVWGQGTTVTVSS<br><br>SEQ ID NO: 31358 |
| iPS:436712 | 21-225_150F9 | NA | CAGTCTGTGCTGACTCAGCCACCCTCAGCGTC TGGGACCCCCGGGCAGAGGGTCACCATCTCTT GTTCTGGAAGCAGCTCCAACATCGGAAGTAAT GCTGTAAACTGGTACCAGCAGCTCCCAGGAAC GGCCCCCAAACTCCTCATCTATAGTAATAGTC AGCGGCCCTCAGGGGTCCCTGACCGTTCTCT GGCTCCAAGTCTGGCACCTCAGCCTCCCTGGC CATCAGTGGGCTCCAGTCTGAGGATGAGGCTG ATTATTTCTGTGCAGCATGGGATGACAGCCTG AATGGCGTGGTATTCGGCGGAGGGACCAAGCT GACCGTCCTA<br><br>SEQ ID NO: 27353 | GAGATGCAGCTGGTGGAGTCTGGGGGAGGCTTG GTACAGCCTGGGGGGTCCCTGAGACTCTCTGTG CAGCCTCTGGATTCACCTTCAGTAGCTATAACAT GAACTGGGTCCGCCAGGTTCCAGGGAAGGGCT GGAGTGGGTTTCATACATTAGTAGAAGTAGTAAT ACCAAACACTACGCAGACTCTGTGAAGGGCCGA TTCACCATCTCCAGAGACAATGCCAAGAACTCAC TGTATCTGCAAATGAACAGCTGAGAGACGAGG ACACGGCTGTGTATTACTGTGCGAGAGATAGGAG TGGGAGCTACGGGTACTTCTACTACTACGGTTTG GACGTCTGGGGCCAAGGGACCACGGTCACCGTC TCCTCA<br><br>SEQ ID NO: 31359 |

FIGURE 50
(Continued)

| | | | |
|---|---|---|---|
| iPS:436714 | 21-225_150H11 | AA | QSVLTQPPSASGTPGQRVTISCSGSSSNIGSNAVN WYQQLPGTAPKLLIYSNSQRPSGVPDRFSGSKSG TSASLAISGLQSEDEADYFCAAWDDSLNGVVFG GGTKLTVL<br>SEQ ID NO: 27354 | EMQLVESGGGLVQPGGSLRLSCAASGFTFSSYNMN WVRQVPGKGLEWVSYISRSSNTKHYADSVKGRFTI SRDNAKNSLYLQMNSLRDEDTAVYYCARDRSGSY GYFYYYGLDVWGQGTTVTVSS<br>SEQ ID NO: 31360 |
| | | NA | TCCTATGAGCTGACTCAGCCACCCTCAGTGTC CGTGTCCCAGGACACAGCCAGCATCACCT GCTCTGGAGATAAATTGGGGATAAGCATATGCT TCCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGAACACAGCCACTCTGACCATCAG CGGGATCCAGGCTATGGATGAGGCTGACTTT ACTGTCAGGCGTGGGACCAAGCTGACCGTCCTA<br>SEQ ID NO: 27355 | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAATTATTAGTGGTGGTGTAGT AGCACATACTACGCAGACTCCGTGAAGGGCCGG TTCACCATCTCCAGAGACAATCCAAGAACACGC TGTATCTGCAAATGAACAGCCTGAGAGCCGAGG ACACGGCCGTATATTACTGTGCGAAATGGCGAG GTAACCCACTGACTACGGTATGACGTCTGGGG CCAAGGGACCACGGTCACCGTCTCCTCA<br>SEQ ID NO: 31361 |
| | | AA | SYELTQPPSVSVSPGQTASITCSGDKLGDKVASW YQQKPGQSPVLVIYQDSKRPSGIPERFSGSNSGN TATLTISGIQAMDEADFYCQAWDSSTVVFGGGT KLTVL<br>SEQ ID NO: 27356 | EVQLLESGGGLVQPGGSLRLSCAASGFTFSTYAMS WVRQAPGKGLEWVSIISGGGSSTYADSVKGRFTI SRDNSKNTLYLQMNSLRAEDTAVYYCAKWRGNPT DYGMDVWGQGTTVTVSS<br>SEQ ID NO: 31362 |

FIGURE 50
(Continued)

| | | | |
|---|---|---|---|
| iPS:436716 | 21-225_151F3 | NA | TCTTATGAGCTGACTCAGCCACCCTCAGTGTC CGTGTCCCCAGGACAGACAGCCAGCATCACCT GCTCTGGAGATAAATTGGGGATAAATATGTT TGCTGGTATCAGCAGAAGCCAGGCCAGTCCCC TGTGCTGGTCATCTATCAAGATCGCAAGCGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCCGTGGCACAGCAGCACTGTGGTA TTCGGCGGAGGGACCAAGCTGACCGTCCTA <br><br> SEQ ID NO: 27357 | CAGGTGCAGCTGGTGGAGTCTGGGGGAGGCGTG GTCCAGCCTGGGAGGTCCCTGAGACTCTCCTGTG CAGCGTCTGGATTCACCTTCAGTACCTATGGCAT GCACTGGGTCCGCCAGGCTCCAGGCAAGGGGCT GGAGTGGGTGGCAGTTATATGGTATGGTGAAGT AATACAGACTATGCAGACTCCGTGAAGGGCGA TTCACCATCTCCAGAGACATTTCCAAGAACACGC TGTATCTGCAAATGAACAGCCTGAGAGCCGAGG ACACGGCTGTGTATTACTGTGCGAGAGATCGGGA TTATTGTAGTGGTACTAGCTGCCCTTACTACTACT ACTACGGTATGACGTCTGGGGCCAAGGGACCA CGGTCACCGTCTCCTCA <br><br> SEQ ID NO: 31363 |
| | | AA | SYELTQPPSVSVSPGQTASITCSGDKLGDKYVCW YQQKPGQSPVLVIYQDRKRPSGIPERFSGSNSGN TATLTISGTQAMDEADYYCQAWHSSTVVFGGG TKLTVL <br><br> SEQ ID NO: 27358 | QVQLVESGGGVVQPGRSLRLSCAASGFTFSTYGMH WVRQAPGKGLEWVAVIWYGGSNTDYADSVKGRF TISRDISKNTLYLQMNSLRAEDTAVYYCARDRDYC SGTSCPYYYYYGMDVWGQGTTVTVSS <br><br> SEQ ID NO: 31364 |

FIGURE 50
(Continued)

| | | | |
|---|---|---|---|
| iPS:436718 | 21-225_151H5 | NA | TCCTATGAGCTGACTCAGCCACCCTCAGTGTC CGTGTCCCCAGGACAGACAGCCAGCATGCCT GCTCTGGAGATAAATTGGGGGATAAATATGCT TCCTGGTATCAACAGAAGCCAGGCCAGTCCC TGTGTGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGGACAGCAGCACTGTGGTA TTCGGCGGAGGGACCAAGTCACCGTCCTA<br>SEQ ID NO: 27359 | GAGGTGCAACTGTTGGAGTCTGGGGGAGGCTTG GTACAGCCTGGGGGTCCCTGAGACTCTCCTGTG CAGCCTCTGGATTCACCTTCAGCAGCTATGCCAT GAGCTGGGTCCGCCAGGCTCCAGGGAAGGGCT GGAGTGGGTCTCAGTTATTAGTGGTGGTGGTAGT AGCACATACTACGCAGACTCCGTGAAGGGCCGG TTCACCATCTCCAGAGACAATTCCAAGAACACGC TGTATCTGCAAATGAACAGCTGAGAGCCGAGG ACACGGCCGTATATTACTGTGCGAAATGGCGAG GTAACCCACTGACTACGGTATGGACGTCTGGGG CCAAGGGACCACGGTCACCGTCTCCTCA<br>SEQ ID NO: 31365 |
| | | AA | SYELTQPPSVSVSPGQTASIACSGDKLGDKYASW YQQKPGQSPVL VIYQDSKRPSGIPERFSGSNSGN TATLTISGIQAMDEADYYCQAWDSSTVVFGGGT KLTVL<br>SEQ ID NO: 27360 | EVQLLESGGGLVQPGGSLRLSCAASGFTFSSYAMS WVRQAPGKGLEWVSVISGGGSSTYYADSVKGRFTI SRDNSKNTLYLQMNSLRAEDTAVYYCAKWRGNPT DYGMDVWGQGTTVTVSS<br>SEQ ID NO: 31366 |
| iPS:436720 | 21-225_151H6 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TGCTGGTATCAGCAGAAGCCAGGCCAGTCCCC TGTGCTGGTCATCTATCAAGATCGAAGCAAGCGGC CCTCAGGGATCCCTGAGCGATTCTCTGGCTCC AACTCTGGGAACACAGCCACTCTGACCATCAG CGGGACCCAGGCTGTGGATGAGCAGCACTATT ACTGTCAGGCGTGGGACCAAGTCACCGTCCTA<br>SEQ ID NO: 27361 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGCT GGAGTGGGTGGCACTTATATGTGATGGAAGT AATAAATACTATGCAGACTCCGTGAAGGGCCGA TTCACCATCTCCAGAGACAATTCCAAGAACACGC TGTATCTACAAATGAACAGCTGAGAGCCGAGG ACACGGCTGTGTATTACTGTGCGAGAGATGACCG ATCTTGTAGTAGAACCAGCTGCCTTACTACTAC TACTACGGTTTGGACGTCTGGGGCCAAGGGACCA CGGTCATCGTCTCCTCA<br>SEQ ID NO: 31367 |

FIGURE 50
(Continued)

| | | | |
|---|---|---|---|
| iPS-436722 | 21-225_151H7 | AA | SYELTQPPSVSVSPGQTASITCSGDKLGDKYACW YQQKPGQSPVLVIYQDTKRPSGIPERFSGSNSGN TATLTISGTQAMDEADYYCQAWDSSTYVFGTGT KVTVL | QVQLVESGGGVVQPGRSLRLSCAASGFTFSDYGM HWVRQAPGKGLEWVALIWYDGSNKYYADSVKGR FTISRDNSKNTLYLQMNSLRAEDTAVYYCARDDRS CSRTSCPYYYYGLDVWGQGTTVTVSS |
| | | | SEQ ID NO: 27362 | SEQ ID NO: 31368 |
| | | NA | TCCTATGACCTGACTCAGCCACCCTCAGTGTC CGTGTCCCCAGGACAGACAGCCAGCATCACCT GCTCTGGAGATAAATTGGGGGATAAATATGCT TCCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGGACAGCAGCACTGTGTA TTCGGCGGAGGGACCAAGCTGACCGTCCTA | GAGGTGCAACTGTTGGAGTCTGGGGGAGGCTTG GTACAGCCTGGGGGGTCCCTGAGACTCTCCTGTG CAGCCTCTGGATTCACCTTTAGCGACTATGCCAT GAGCTGGGTCCGCCAGGCTCCAGGGAAGGGGCT GGAGTGGGTCTCAGTTATTAGTGGTGGTGTAGT AGCACATACTACGCAGACTCCGTGAAGGGCCG TTCACCATCTCCAGAGACAATTCCAAGAACACGC TGTATCTGCAAATGAACAGCCTGAGAGCCGAGG ACACGGCCGTATATTACTGTGCAAATGGCGAG GTAACCCCACTGACTACGGTATGGACGTCTGGGG CCAAGGGACCACGGTCACCGTCCTCCTCA |
| | | | SEQ ID NO: 27363 | SEQ ID NO: 31369 |
| | | AA | SYDLTQPPSVSVSPGQTASITCSGDKLGDKYASW YQQKPGQSPVLVIYQDSKRPSGIPERFSGSNSGN TATLTISGIQAMDEADYYCQAWDSSTVVFGGGT KLTVL | EVQLLESGGGLVQPGGSLRLSCAASGFTFSSYAMS WVRQAPGKGLEWVSVISGGGSSTYYADSVKGRFTI SRDNSKNTLYLQMNSLRAEDTAVYYCAKWRGNPT DYGMDVWGQGTTVTVSS |
| | | | SEQ ID NO: 27364 | SEQ ID NO: 31370 |

FIGURE 50
(Continued)

| | | | |
|---|---|---|---|
| iPS:436724 | 21-225_151B9 | NA | TCCTATGAGCTGACTCAGCCACCCTCAGTGTC CGTGTCCCCAGGACAGACAGCCAGCATCGCCT GCTCTGGAGATAATTGGGGATAAATATGCT TCCTGGTATCAACAGAAGCCAGGCCAGTCCCC TGTGCTGGTCATCTATCAAGATAGCAAGCGGC CCCTCAGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGGACAGCAGCACTGTGGTA TTCGGGGAGGGACCAAGCTGACCGTCCTA | GAGGTGCAACTGTTGGAGTCTGGGGGAGGCTTG GTACAGCCTGGGGGGTCCCTGAGACTCTCCTGTG CAGCCTCTGGATTCACCTTCAGCAGCTATGCCAT GAGCTGGGTCCGCCAGGCTCCAGGGAAGGGGCT GGAGTGGGTCTCAGTTATTAGTGGTGGTGTAGT AGCACATACTACGCAGACTCCGTGAAGGGCCGG TTCACCATCTCCAGAGACAATTCCAAGAACACGC TGTATCTGCAAATGAACAGCTGAGAGCCGAGG ACACGGCCGTATATTACTGTGCGAAATGGCGAG GTAACCCCACTGACTACGGTATGGACGTCTGGGG CCAAGGGACCACGGTCACCGTCTCCTCA |
| | | | SEQ ID NO: 27365 | SEQ ID NO: 31371 |
| | | AA | SYELTQPPSVSVSPGQTASIACSGDNLGDKYASW YQQKPGQSPVLVIYQDSKRPSGIPERFSGSNSGN TATLTISGIQAMDEADYYCQAWDSSTVVFGGGT KLTVL | EVQLLESGGGLVQPGGSLRLSCAASGFTFSSYAMS WVRQAPGKGLEWVSVISGGGSTYYADSVKGRFTI SRDNSKNTLYLQMNSLRAEDTAVYYCAKWRGNPT DYGMDVWGQGTTVTVSS |
| | | | SEQ ID NO: 27366 | SEQ ID NO: 31372 |
| iPS:436726 | 21-225_152G5 | NA | TCCTATGAGATGACTCAGCCACCCTCAGTGTC CGTGTCCCCAGGACAGACAGCCAGCATCATCACCT GCTCTGGAGATAAATTGGGGATAAATATGCT TGCTGGTATCAACAGAAGCCAGGCCAGTCCCC TGTGCTGGTCATCTATCAAGATTCCAAGCGGC CCCTCAGGGATCCCTGAGCGATTCTCTGGCTCC AACTCTGGGAACACAGCCACTCTGACCATCAG CGGGACCCAGGCTGTGGGACAGCAGCACTTATGTC ACTGTCAGGCGTGGGACCAAGGTCACCGTCCTA TTCGGAACTGGGACCAAGGTCACCGTCCTA | CAGGTGCAGCTGGTGGAGTCTGGGGGAGGCGTG GTCCAGCCTGGGAGGGTCCCTGAGACTCTCCTGTG CAGGCGTCTGGATTCACCTTCAGTGACTGATGGCAT GCAACTGGGTCCGCCAGGCTCCAGGCAAGGGGCT GGAGTGGGTGGCACTTATATGGTATGATGAAGT AATAAATACTATGCAGACTCCGTGAAGGGCCGA TTCACCATCTCCAGAGACAATTCCAAGAACACGC TGTATCTACAAATGAACAGCTGAGAGCCGAGG ACACGGCTGTGTATTACTGTGCGAGAGATGACCG ATCTTGTAGTAGAACCAGCTGCCTTACTACTAC TACTACGGTTTTGACGTCTGGGGCCAAGGGACCA CGGTCATCGTCTCCTCA |
| | | | SEQ ID NO: 27367 | SEQ ID NO: 31373 |

FIGURE 50
(Continued)

| | | | | |
|---|---|---|---|---|
| | | AA | SYEMTQPPSVSVSPGQTAIITCSGDKLGDKYAC WYQQKPGQSPVLVIYQDSKRPSGIPERFSGSNSG NTATLTISGTQAMDEADYYCQAWDSSTYVFGT GTKVTVL<br><br>SEQ ID NO: 27368 | QVQLVESGGGVVQPGRSLRLSCAASGFTFSDYGM HWVRQAPGKGLEWVALIWYDGSNKYYADSVKGR FTISRDNSKNTLYLQMNSLRAEDTAVYYCARDDRS CSRTSCPYYYYGLDVWGQGTTVTVSS<br><br>SEQ ID NO: 31374 |
| iPS:436728 | 21-225_152G6 | NA | TCCTATGAGCTGACTCAGCCACCCTCAGTGTC CGTGTCCCCAGGACAGACAGCCAGCATCACCT GCTCTGGAGATAAATTGGGGATAAAATATGCT TCCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTGTGGACGAACAGCACTGTGGTA ACTGTCAGGCTGACAACAGCACTGTGGTA TTCGGCCGAGGGACCAAGCTGACCGTCCTA<br><br>SEQ ID NO: 27369 | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGTTATTAGTGGTGGTAGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGGTATGGACGTCTGGGG CCAAGGGACCACGGTCACCGTCTCCTCA<br><br>SEQ ID NO: 31375 |
| | | AA | SYELTQPPSVSVSPGQTASITCSGDKLGDKYASW YQQKPGQSPVLVIYQDSKRPSGIPERFSGSNSGN TATLTISGIQALDEADYYCQAWDNSTVVFGGGT KLTVL<br><br>SEQ ID NO: 27370 | EVQLLESGGGLVQPGGSLRLSCAASGFTFSSYAMS WVRQAPGKGLEWVSVISGGSSTYYADSVKGRFTI SRDNSKNTLYLQMNSLRAEDTAVYYCAKWRGNPT DYGMDVWGQGTTVTVSS<br><br>SEQ ID NO: 31376 |

FIGURE 50
(Continued)

| | | | |
|---|---|---|---|
| iPS:436730 | 21-225_152D7 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TCCTGGTATCAGCAGAAGCCAGGCCAGTCCCC TGTGCTGGTCATCTATCAAGATAGCAAGCGGC CCCTCAGGGATCCCTGAGCGATTCTCTGGCTCC AACTCTGGGAACACAGCCACTCTGACCATCAG CGGGATCCAGGCTATGGATGAGCAGGACACTGTGTA ACTGTCAGGCGTGGGACAGCAGCACTGTGTA TTCGGCGGAGGGACCAAGGTCACCGTCCTA<br><br>SEQ ID NO: 27371 | GAGGTGCAACTGTTGGAGTCTGGGGGAGGCTTG GTACAGCCTGGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGTTATTAGTGGTGGTAGT AGCACATACTACGCAGACTCCGTGAAGGGCGG TTCACCATCTCCAGAGACAATTCCAAGAACACGC TGTATCTGCAAATGAACAGCCTGAGAGCCGAGG ACACGGCCGTATATTACTGTGCAAATGGCGAG GTAACCCACTGACTCCGTATGGACGTCTGGGG CCAAGGGACCACGGTCACCGTCTCCTCA<br><br>SEQ ID NO: 31377 |
| | | AA | SYELTQPPSVSVSPGQTASITCSGDKLGDKYASW YQQKPGQSPVLVIYQDSKRPSGIPERFSGSNSGN TATLTISGIQAMDEADYYCQAWDSSTVFGGGT KLTVL<br><br>SEQ ID NO: 27372 | EVQLLESGGGLVQPGGSLRLSCAASGFTFSSYAMS WVRQAPGKGLEWVSVISGGGSSTYYADSVKGRFTI SRDNSKNTLYLQMNSLRAEDTAVYYCAKWRGNPT DSGMDVWGQGTTVTVSS<br><br>SEQ ID NO: 31378 |
| iPS:436732 | 21-225_152B12 | NA | TCCTATGAGCTGACTCAGCCACCCTCAGTGTC CGTGTCCCCAGGACAGACAGCCAGCATCACCT GCTCTGGCGATAAATTGGGAAATATATGCT TGCTGGTATCAGCAGAAGCCAGGCCAGTCCCC TGTGCTGGTCGTCTATCAAGATACCAAGCGGC CCCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTTATGTC TTCGGAACTGGGACCAAGGTCACCGTCCTA<br><br>SEQ ID NO: 27373 | CAGGTGCAGGTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTACAAATGAACAGCCTGAGAGCCGAGG ACACGGCTGTGTATTACTGTGCGAGAGATGACCG ATCTTGTAGTAGTACCAGCTGCCCTTACTACTAC TACTACGGTTTGGACGTCTGGGGCCAAGGGACCA CGGTCACCGTCCTCA<br><br>SEQ ID NO: 31379 |

FIGURE 50
(Continued)

| | | | |
|---|---|---|---|
| iPS:436734 | 21-225_153A8 | AA | SYELTQPPSVSVSPGQTASITCSGDKLGNKYACW YQQKPGQSPVLVIYQDTKRPSGIPERFSGSNSGN TATLTISGTQAMDEADYYCQAWDSSTYVFGTGT KVTVL<br><br>SEQ ID NO: 27374 | QVQVVESGGGVVQPGRSLRLSCAASGFTFSDYGM HWVRQAPGKGLEWVAVIWYDGSNKYYADSVKGR FTISRDNSKNTLYLQMNSLRAEDTAVYYCARDDRS CSSTSCPYYYYGLDVWGQGTTVTVSS<br><br>SEQ ID NO: 31380 |
| | | NA | TCCTATGAGCTGACTCAGCCACCCTCAGTGTC CGTGTCCCAGGGCAGACAGCCAGCATCACCT GCTCTGGAGATAAATTGGGGATAAATATGCT TGCTGGTATCAGCAGAAGCCAGGCCAGTCCCC TGTGCTGGTCATCTATCAAGATACCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTTATGTC TTCGGAACTGGGACCAAGGTCACCGTCCTA<br><br>SEQ ID NO: 27375 | CAGGTGCAGCTGGTGGAGTCTGGGGGAGGCGTG GTCCAGCCTGGAGGGTCCCTGAGACTCTCTGTG CAGGTCTGGATTCACCTTCAGTGACTTGACTATGGCAT GCACTGGGTCCGCCAGGCTCCAGGCAAGGGGCT GGAGTGGGTGGCACTTATATGTATGGAAGT AATAAATACTATGCAGACTCCGTGAAGGGCCGA TTCACCATCTCCAGAGACAATTCCAAGAACACGC TTTATCTACAAATGAACAGCTGAGAGCCGAGG ACACGGCTGTGTATTACTGTGCGAGAGATGACCG ATCTTGTAGTAGAACCAGCTGCCTTACTACTAC TACTACGGTTTGGACGTCTGGGGCCAAGGGACCA CGGTCATCGTCTCCTCA<br><br>SEQ ID NO: 31381 |
| | | AA | SYELTQPPSVSVSPGQTASITCSGDKLGDKYACW YQQKPGQSPVLVIYQDTKRPSGIPERFSGSNSGN TATLTISGTQAMDEADYYCQAWDSSTYVFGTGT KVTVL<br><br>SEQ ID NO: 27376 | QVQLMESGGGVVQPGRSLRLSCAASGFTFSDYGM HWVRQAPGKGLEWVALIWYDGSNKYYADSVKGR FTISRDNSKNTLYLQMNSLRAEDTAVYYCARDDRS CSRTSCPYYYYGLDVWGQGTTVIVSS<br><br>SEQ ID NO: 31382 |

FIGURE 50
(Continued)

| | | | |
|---|---|---|---|
| iPS:436736 | 21-225_153E8 | NA | TCCTATGAGCTGACTCAGCCACCCTCAGTGTC CGTGTCCCCAGGACAGACAGCCAGCATCACCT GCTCTGGAAGTAAATTGGGTAATAAATATGTT TGCTGGTATCAGCAGAGGCCAGGCCAGTCCCC TGTACTGGTCATCTATCAAGATAACAAGCGGC CCTCAGGGATCCTGAGCGATTCTCTGGCTCC AACTCCGGAAACACAGCCACTCTGACCATCAG CGGGACCCAGGCTATGGATGAGGCTGGCTATT ACTGTCAGGCGGTGGACACAGCACTTATGTG ATATTCGGCGGAGGGACCAAGCTGACCGTCCT A<br>SEQ ID NO: 27377 | CAGGTGCAGCTGGTGGAGTCTGGGGGAGGCGTG GTCCAGCCTGGGAGGTCCCTGAGACTCTCCTGTG CAGGCGTCTGGATTCACCCTCAGTAACTATGGCAT GCACTGGGTCCGCCAGGCTCCAGGCAAGGGGCT GGAGTGGGTGGCAGTTATATGGTTTGATGGCAGT AATAAATACTATGTTGACTCCGTGAAGGACCGAT TCACCATCTCCAGAGACAATTCCAAGAACACGCT ATATCTGCAAATGAACAGCCTGAGAGCCGAAGA CACGGCTGTGTATTACTGTGCGAGAGATCGGGTG GAGGGTTCGGGGACTCCTACTACTACTACGGTA TGGACGTCTGGGGCCAAGGGACCACGGTCACCG TCTCCTCA<br>SEQ ID NO: 31383 |
| | | AA | SYELTQPPSVSVSPGQTASITCSGSKLGNKYVCW YQQRPGQSPVLVIYQDNKRPSGIPERFSGSNSGN TATLTISGTQAMDEAGYYCQAWDSSTYVIFGGG TKLTVL<br>SEQ ID NO: 27378 | QVQLVESGGGVVQPGRSLRLSCAASGFTLSNYGM HWVRQAPGKGLEWVAVIWFDGSNKYYVDSVKDR FTISRDNSKNTLYLQMNSLRAEDTAVYYCARDRVE GSGTPYYYGMDVWGQGTTVTVSS<br>SEQ ID NO: 31384 |
| iPS:436738 | 21-225_153D9 | NA | TCCTATGAGCTGACTCAGCCACCCTCAGTGTC CGTGTCCCCAGGACAGACAGCCAGCATCACCT GCTCTGGAGATAAATTGGGGATAAATATGCT TGCTGGTATCAGCAGAAGCCAGGCCAGTCCCC TGTACTGGTCATCTATCAAGATAGGAAGCGGC CCTCAGGGATCCTGAGCGATTCTCTGGCTCC AACTCTGGGAACACAGCCACTCTGACCATCAG CGGGACCCAGGCTATGGATGAGGCTGACTATT ACTGTCAGGCGGTGCACAGCAGTACTGTGTA TTCGGCGGAGGGACCAAGCTGACCGTCCTA | CAGGTGCAGTTGGTGGAGTCTGGGGGAGGCGTG GTCCAGCCTGGGAGGTCCCTGAGACTCCTGTGTG CAGGCGTCTGGATTCACCGTCAGTACCTATGGCAT GCACTGGGTCCGCCAGGCTCCAGGCAAGGGGCT GGAGTGGGTGGCAGTTATATGGTATGGTGAAGT AATAAAGACTATGCAGACTCCGTGAAGGGCCGA TTCACCATCTCCAGAGACATTTCCAAGAACACGC TGTATCTGCAAATGAACAGCCTGAGAGCCGAGG ACACGGCTGTATTACTGTGCGAGAGATCGGGA TTATTGTAGTGGTAGCTGTCCTTACTACTACT ACTACGGTATGGACGTCTGGGGCCAAGGACCA CGGTCACCGTCTCCTCA |

FIGURE 50
(Continued)

| | | | AA | SEQ ID NO: 27379 SYELTQPPSVSVSPGQTASITCSGDKLGDKYACW YQQKPGQSPVLVIYQDRKRPSGIPERFSGSNSGN TATLTISGTQAMDEADYYCQAWHSSTVVFGGG TKVTVL | SEQ ID NO: 31385 QVQLVESGGGVVQPGRSLRLSCAASGFTVSTYGM HWVRQAPGKGLEWVAVIWYGGSNKDYADSVKGR FTISRDISKNTLYLQMNSLRAEDTAVYYCARDRDY CSGGSCPYYYYGMDVWGQGTTVTVSS |
| iPS:436740 | 21-225_154C3 | | NA | SEQ ID NO: 27380 TCCTATGAGCTGACTCAGCCACCCTCAGTGTC CGTGTCCCCAGGACAGACAGCCAGCATCACCT GCTCTGGAGATAAATTGGGGATAAATATGTT TGCTGGTATCAGCAGAAGCCAGGCCAGTCCC TGTGTTGGTCATCTATCAAGATAGGAAGCGGC CCTCAGGGATCCCTGAGCGATTCTCTGGCTCC AACTCTGGGAACACAGCCACTCTGACCATCAC CGGGACCCAGGCTATGGATGAGGCTGACTATT ACTGTCAGGCCTGGCACAGCAGCACTGTGGTA TTCGGCGGAGGGACCAAGCTGACCGTCCTA | SEQ ID NO: 31386 CAGGTGCAGCTGGTGGAGTCTGGGGGAGGCGTG GTCCAGCCTGGGAGGTCCCTGAGACTCTCTGTA CAGCGTCTGGATTCACCTTCAGTACCTATGGCAT GCACTGGGTCCGCCAGGCTCCAGGCAAGGGCT GGAGTGGGTGGCAGTTGTATGGTATGGTGAAAT AATAAAGACTATGCAGACTCCGTGAAGGGCCGA TTCACCATCTCCAGAGACATTTCCAAGAACACAC TGTATCTGCAAATGAACAGCCTGAGAGCCGAGG ACACGGCTGTGTATTACTGTGCGAGAGATCGGA TTATTGTAGTGGTGGTAGCTGCCCTTACTACTACT ACTACGGTATGACGTCTGGGGCCAAGGGACCA CGGTCACCGTCTCCTCA |
| | | | AA | SEQ ID NO: 27381 SYELTQPPSVSVSPGQTASITCSGDKLGDKYVCW YQQKPGQSPVLVIYQDRKRPSGIPERFSGSNSGN TATLTITGTQAMDEADYYCQAWHSSTVVFGGG TKLTVL | SEQ ID NO: 31387 QVQLVESGGGVVQPGRSLRLSCTASGFTFSTYGMH WVRQAPGKGLEWVAVVWYGGNNKDYADSVKGR FTISRDISKNTLYLQMNSLRAEDTAVYYCARDRDY CSGGSCPYYYYGMDVWGQGTTVTVSS |
| | | | | SEQ ID NO: 27382 | SEQ ID NO: 31388 |

FIGURE 50
(Continued)

| | | | | |
|---|---|---|---|---|
| iPS:436742 | 21-225_154C4 | NA | TCCTATGAGCTGACTCAGCCACCTCAGTGTC CGTGTCCCCAGGACAGACAGCCAGAATCACCT GCTCTGGAGATAAATTGGGGGATAAATATGCT TCCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTATGATGAGGCTGACTATT ACTGTCAGGCGTGGGACAGCAGCACTGTGGTA TTCGGCGGAGGGACCAAGCTGACCGTCCTA SEQ ID NO: 27383 | GAGGTGCAACTGTTGGAGTCTGGGGAGGCTTG ATACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTGGTGGTGGTAGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCACTGACTACGGTATGGACGTCTGGGG CCAAGGGACCACGGTCACCGTCCTCA SEQ ID NO: 31389 |
| | | AA | SYELTQPPSVSVSPGQTARITCSGDKLGDKYASW YQQKPGQSPVLVIYQDSKRPSGIPERFSGSNSGN TATLTISGIQAMDEADYYCQAWDSSTVVFGGGT KLTVL SEQ ID NO: 27384 | EVQLLESGGGLIQPGGSLRLSCAASGFTFSSYAMSW VRQAPGKGLEWVSVISGGGSSTYADSVKGRFTIS RDNSKNTLYLQMNSLRAEDTAVYYCAKWRGNPT DYGMDVWGQGTTVSS SEQ ID NO: 31390 |
| iPS:436744 | 21-225_154F4 | NA | TCCTATGAGCTGACTCAGCCACCTCAGTGTC CGTGTCCCCAGGACAGACAGCCAGCATCACCT GCTCTGGAGATAAATTGGGGGGATAAATATGTT TGTTGGTATCAGCAGAAGCCAGGCCAGTCCCC TGTGGAAGTCATCTATAAAGATAGTAAGCGGC CCTCAGGGATCCCTGAGCGATTCTCTGGCTCC AATTCTGGGAACACACAGGCCACTCTGACCATCAG CGGGACCCAGGCTATGGATGAGGCTGACTATT ACTGTCAGGCGTGGGACAGCAGTACTTTAGTA TTCGGCGGAGGGACCAAGCTGACCGTCCTA | CAGGTGCAGCTGGTGGAGTCTGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTGCAAATGAACAGCCTGAGAGCCGAGG TGTATCTGCAAATGAACAGCCTGAGAGCCGAGG ACACGGCTGTGTATTACTGTGCGAGAGAGGATTC CTATTGTAGTGGTACCAGCTGCCCCTACTACTAC TACTACGGTATGGACGTCTGGGGCCAAGGGACC ACGGTCACCGTCCTCA |

FIGURE 50
(Continued)

| | | | SEQ ID NO: 27385 | SEQ ID NO: 31391 |
|---|---|---|---|---|
| iPS:436746 | 21-225_154E10 | AA | SYELTQPPSVSVSPGQTASITCSGDKLGNKYVCW YQQKPGQSPVEVIYKDSKRPSGIPERFSGSNSGN TGTLTISGTQAMDEADYYCQAWDNSTLVFGGG TKLTVL | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCAREDSYC SGTSCPYYYYGMDVWGQGTTVTVSS |
| | | | SEQ ID NO: 27386 | SEQ ID NO: 31392 |
| | | NA | TCCTATGAGCTGACTCAGCCACCCTCAGTGTC CGTGTCCCCAGGACAGACAGCCAGCATCACCT GCTCTGGAGATAAAATTGGGGATAAATATGCT TCCTGGTATCAGCAGAAGCCAGGTCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTGTATGGATGAGGCTGACTATT ACTGTCAGGCGTGGGACAACAGCACTGTGGTA TTCGGCGGAGGGACCAAGCTGACCGTCCTA | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGTTATTAGTGGTGGTGGTAGT AGCACATACTACGCAGACTCCGTGAAGGGCCGG TTCACCATCTCCAGAGACAATTCCAAGAACACGC TGTATCTGCAAATGAACAGCCTGAGAGCCGAG ACACGGCCGTATATTACTGTGCGAAATGGCGAG GTAACCCACTGACTACGGTATGGACGTCTGGGG CCAAGGGACCACGGTCACCGTCTCCTCA |
| | | | SEQ ID NO: 27387 | SEQ ID NO: 31393 |
| | | AA | SYELTQPPSVSVSPGQTASITCSGDKLGDKYASW YQQKPGQSPVLVIYQDSKRPSGIPERFSGSNSGN TATLTISGIQAMDEADYYCQAWDNSTVVFGGGT KLTVL | EVQLLESGGGLVQPGGSLRLSCAASGFTFSSYAMS WVRQAPGKGLEWVSVISGGGSSTYYADSVKGRFTI SRDNSKNTLYLQMNSLRAEDTAVYYCAKWRGNPT DYGMDVWGQGTTVTVSS |
| | | | SEQ ID NO: 27388 | SEQ ID NO: 31394 |

FIGURE 50
(Continued)

| | | | | |
|---|---|---|---|---|
| iPS:436748 | 21-225_154D11 | NA | TCCTATGAGCTGACTCAGCCACCTCAGTGTC CGTGTCCCCAGGACAGACAGCCAGCATCACCT GCTCTGGATATCAGCAGATAAATTGGGGATCT TGCTGGTATCAGCAGAAGCCAGGCCAGTCCCC TGTGCTGGTCATCTATCAAGATAAGAAGCGGC CCTCAGGGATCCCTGAGCGATTCTCTGGCTCC AACTCTGGGAACATAGCCACTCTGACCATCAG CGGGACCCAGGCTATGGATGAGGCTGACTATT ACTGTCAGGCGTGGCACAGCAGTATTGTGGTA TTCGGCGGAGGGACCAAGCTGACCGTCCTA | CAGGTGCAGCTGGTGGAGTCTGGGGAGGGTG GTCCAGCCTGGGAGGTCCCTGAGACTCTCCTGTG CAGGCGTCTGGATTCAACGTCAGTACCTATGGCAT GCACTGGGTCCGCCAGGCTCCAGGCAAGGGGCT GGAGTGGGTGGCAGTTATATGGTATGGTGGAAGT AATAAAGACTATGCAGACTCTGTGAAGGGCCGA TTCACCATCTCCAGAGACACAGTTCCAAGAACACGC TGTATCTGCAAATGAACAGCCTGAGAGCCGAGG ACACGGCTGTGTATTACTGTGCGAGAGATCGGGA TTATTGTAGTGGTGGTAGTTGCCCTTACTACTACT ACTACGGTATGGACGTCTGGGGCCAAGGGACCA CGGTCACCGTCTCCTCA |
| | | | SEQ ID NO: 27389 | SEQ ID NO: 31395 |
| | | AA | SYELTQPPSVSVSPGQTASITCSGDKLGDKYACW YQQKPGQSPVLVIYQDKKRPSGIPERFSGSNSGNI ATLTISGTQAMDEADYYCQAWHSSIVVFGGGTK LTVL | QVQLVESGGGVVQPGRSLRLSCAASGFNVSTYGM HWVRQAPGKGLEWVAVIWYGGSNKDYADSVKGR FTISRDSSKNTLYLQMNSLRAEDTAVYYCARDRDY CSGGSCPYYYYGMDVWGQGTTVTVSS |
| | | | SEQ ID NO: 27390 | SEQ ID NO: 31396 |

FIGURE 50
(Continued)

| | | | |
|---|---|---|---|
| iPS:436750 | 21-225_154G12 | NA | CAGTCTGTACTGACTCAGCCACCCTCAGCGTC TGGGACCCCCGGGCAGAGGGTCACCATCTCTT GTTCTGGAAGCAGCTCCAACATCGGAAATAAT GCTGTAAGCTGGTATCAGCAGCTCCCAGGAAC GGCCCCCAAACTCCTCATCTATAGTAATGATC ACCGGCCCCTCAGGGGTCTCCTGACCGATTCTCT GGCTCCAAGTCTGGCACCTCAGCTCCCTGGC CATCAGTGGGCTCCAGTCTGAGGATGAGGCTG ATTATTACTGTCAGCATGGGATGACAGCCTG AAGGGTCCGGTATTCGGCGGAGGGACCAAGC TGACCGTCCTA<br><br>SEQ ID NO: 27391 | CAGGTGCAGCTGCAGGAGTCGGGCCCAGGACTG GTGAATCCTTCACAGACCCTGTCCCTCACCTGC GTGTCTCTGGTGGCTCCATCAGCAGTGGTTATTA CTACTGGAGCTGGATCCGCCAGCACCCAGGGAA GGGCCTGGAGTGGATTGGGTACATCTATTATAGT GGGAGCACCTACTACAACCGTGTCCCTCAAGAGTC GAGTTTCCATATCATTAGAACACGCTAAGAACCA GTTCTCCCTGAAGCTGACCTCTGTGACTGCCGCG GACACGGCCGTGTATTACTGTGCGAGAGATTGGG GTGGCTACGATTCGAGTGGCTGGTTCGACCCTG GGGCCAGGGAACCCTGGTCACCGTCTCCTCA<br><br>SEQ ID NO: 31397 |
| | | AA | QSVLTQPPSASGTPGQRVTISCSGSSSNIGNNAVS WYQQLPGTAPKLLIYSNDHRPSGVPDRFSGSKS GTSASLAISGLQSEDEADYYCAAWDDSLKGPVF GGGTKLTVL<br><br>SEQ ID NO: 27392 | QVQLQESGPGLVNPSQTLSLTCGVSGGSISSGYYY WSWIRQHPGKGLEWIGYIYYSGSTYYNPSLKSRVSI SLDTPKNQFSLKLTSVTAADTAVYYCARDWGGYD SSGWFDPWGQGTLVTVSS<br><br>SEQ ID NO: 31398 |
| iPS:436752 | 21-225_155H1 | NA | CAGTCTGTGCTGACGCAGCCGCCCTCAGTGTC TGGGGCCCCAGGGCAGAGGGTCACCATCTCCT GCACTGGGAGCAGCTCCAATATCGGGGCAGGT TATGATGTACACTGGTACCAGCAGCTTCCAGG AACAGCCCCCAAACTCCTCATCTATGGTAACA GCAATCGGCCCTCAGGGGTCCCTGACCGATTC TCTGGCTCCAAGTCTGGCACCTCAGCCTCCCT GGCCATCACTGGCCTCCAGGCTGAGGATGAGG CTGATTATTACTGCAGTCCTATGACAGCAGC CTGAGTGGTCCTGTGATATTCGGCGGAGGGAC CAAGCTGACCGTCCTA<br><br>SEQ ID NO: 27393 | GAGGTGCAGCTAGTGCAGTCTGGAGCAGAGGTG AAAAAGCCCGGGGAGTCTCTGAAGATCTCCTGTA AGGGTTCTGGATACAGCTTTACCAGCTACTGGAT CGGCTGCGTGCGCCAGATGCCCGGGAAAGGCCT GGAGTGGATGGGGCTCATCTATCCTGGTGCCTCT GATACCAGATACAGCCCGTCTTCCAAGGCAGG TCACCATCTCAGCCGACAAGTCCATCAGCACCGC CTACCTGCAGTGGAGCAGCCTGAAGGCCTGGA CACCGCCATGTATTACTGTGCGAGACAGGCCATA GCAAGTCGAGGGAGGTACTACTACTACGGTATG GACGTCTGGGGCCAAGGGACCACGGTCACCGTC TCCTCA<br><br>SEQ ID NO: 31399 |

FIGURE 50
(Continued)

| | | | | |
|---|---|---|---|---|
| | | AA | QSVLTQPPSVSGAPGQRVTISCTGSSSNIGAGYD VHWYQQLPGTAPKLLIYGNSNRPSGVPDRFSGS KSGTSASLAITGLQAEDEADYHCQSYDSSLSGPV IFGGGTKLTVL<br>SEQ ID NO: 27394 | EVQLVQSGAEVKKPGESLKISCKGSGYSFTSYWIG WVRQMPGKGLEWMGLIYPGASDTRYSPSFQGQVT ISADKSISTAYLQWSSLKASDTAMYYCARQAIASR GRYYYYGMDVWGQGTTVTVSS<br>SEQ ID NO: 31400 |
| iPS:436754 | 21-225_155G3 | NA | TCCTATGAGCTGACTCAGCCACCCTCAGTGTC CGTGTCCCAGGACAGACAGCAGCATCACCT GCTCTGGAGATAAGTTGGGGATAAATATGTT TGCTGGTATCAGCAGAAGCCAGGCCAGTCCCC TATGTTGGTCATCTATCAAGATAGTAAGCGGC CCTCAGGGATCCCTGAGCGATTCTCTGGCTCC AACTCTGGGAACACAGCCACTCTGACCATCAG CGGGACCCAGGCCGTGGACAATAGTATTTATGTC ACTGTCAGGCGTGGGACCAAGGTCACCGTCCTA<br>SEQ ID NO: 27395 | CAGGTGCAGCTGGTGGAGTCTGGGGGAGGCGTG GTCCAGCCTGGGAGGTCCCTGAGACTCTCCTGTA CAGCCTCTGGATTCACCTTCAGTAGCTATGGCAT GCACTGGGTCCGCCAGGCTCCAGGCAAGGGCT GGAGTGGGTGGCAGTTATATCATATGATGAAGT AATAAATACTATGCAGAGACTCCGTGAAGGGCGA TTCACCATCTCCAGAGACAATTCCAAGAACACGC TGTATCTGCAAATGAACAGCTGAGAGCTGAGG ACACGGCTGTGTATTACTGTGCGAGAGATACGGA GAGATGGCTACCATACTCCTACGGTATGGACGTC TGGGGCCAAGGGACCACGGTCACCGTCTCCTCA<br>SEQ ID NO: 31401 |
| | | AA | SYELTQPPSVSVSPGQTASITCSGDKLGDKYVCW YQQKPGQSPMLVIYQDSKRPSGIPERFSGSNSGN TATLTISGTQAMDEADYYCQAWDNSIYVFGTGT KVTVL<br>SEQ ID NO: 27396 | QVQLVESGGGVVQPGRSLRLSCTASGFTFSSYGMH WVRQAPGKGLEWVAVISYDGSNKYYADSVKGRFT ISRDNSKNTLYLQMNSLRAEDTAVYYCARDTERW LPYSYGMDVWGQGTTVTVSS<br>SEQ ID NO: 31402 |

FIGURE 50
(Continued)

| | | | |
|---|---|---|---|
| iPS:436756 | 21-225_146A10 | NA | TCCTATGAGCTGACTCAGCCACCCTCAGTGTC CGTGTCCCCAGGACAGACAGCCAGCATCACCT GCTCTGGAGATAAATTGGGGATAAATATGTT TGCTGGTATCAGCAGAAGCCAGGCCAGTCCCC TGTGCTGGTCATCTTTCAAGATAGAAAGCGGC CCTCAGGGATCCCTGAGCGATTCTCTGGCTCC AACTCTGGGAACACAGCCACTCTGACCATCAG CGGGACCCAGGCTATGGAGGCTGACTATT ACTGTCAGGCGTGGGACAGCAGCACTGTGGTG TTCGGCGGAGGGACCAAAGTTACCGTCCTA CAGGTGCAGCTGGAGGAGTCTGGGGGAGGCGTG GTCCAGCCTGGGAGGTCCCTGAGACTCTCCTGTG CAGCGTCTGGATTCACCTTCAGTGGCTATGGCAT GCACTGGGTCCGCCAGGCTCCAGGCAAGGGCT GGAGTGGATGACACTTATACGGTATGATGGAAG CGATAAAAACTATGCAGACTCCGTGAAGGGCCG ATTCACCATCTCCAGAGACAACTCCAAGAACACG CTGTATCTGCAAATGAACAGCCTGAGAGCCGAG GACACGGCTGTGTATTACTGTGCGAGAGATCGGG TTTTTTGTAGTAGTACCAGCTGCCTCTCTTACTAC TACTACTACGGTATGGACGTCTGGGGCCAAGGG ACCACGGTCACCGTCTCCTCA |
| | | | SEQ ID NO: 27397 SEQ ID NO: 31403 |
| | | AA | SYELTQPPSVSVSPGQTASITCSGDKLGDKYVCW YQQKPGQSPVLVIFQDRKRPSGIPERFSGSNSGN TATLTISGTQAMDEADYYCQAWDSSTVFGGG TKVTVL QVQLEESGGGVVQPGRSLRLSCAASGFTFSGYGMH WVRQAPGKGLEWMTLIRYDGSDKNYADSVKGRF TISRDNSKNTLYLQMNSLRAEDTAVYYCARDRVFC SSTSCLSYYYYGMDVWGQGTTVTVSS |
| | | | SEQ ID NO: 27398 SEQ ID NO: 31404 |

FIGURE 50
(Continued)

| | | | | |
|---|---|---|---|---|
| iPS:436758 | 21-225_155C10 | NA | TCCTATGAGCTGACTCAGCCACCCTCAGTGTC CGTGTCCCAGGACAGACAGTCAGCATCACCT GCTCTGGAGATAAATTGGGGGATAAATATGTT TCCTGGTATCAGCAGAAGCCAGGCCAGTCCCC TGTGCTGGTCATCTATCAAGATAGCAAGCGG CCTCAGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGGACAGCAGCACTGTGGTA TTCGGCGGAGGGACCAAGCTGACCGTCCTA<br><br>SEQ ID NO: 27399<br><br>SYELTQPPSVSVSPGQTVSITCSGDKLGDKYVSW YQQKPGQSPVLVIYQDSKRPSGIPERFSGSNSGN TATLTISGIQAMDEADYYCQAWDSSTVFGGGT KLTVL<br><br>SEQ ID NO: 27400 | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTGGTGGTGTAGT AGCACATACTACGCAGACTCCGTGAAGGGCCGG TTCACCATCTCCAGAGACAATTCCAAGAACACGC TGTATCTGCAAATGAACAGCCTGAGAGCCGAG GACGCCGTATATTACTGTGCGAAATGGCGAG GTAACCCCACTGACTACGGTATGGACGTCTGGGG CCAAGGGACCACGGTCACCGTCTCCTCA<br><br>SEQ ID NO: 31405<br><br>EVQLLESGGGLVQPGGSLRLSCAASGFTFSSYAMS WVRQAPGKGLEWVSVISGGGSSTYYADSVKGRFTI SRDNSKNTLYLQMNSLRAEDTAVYYCAKWRGNPT DYGMDVWGQGTTVTVSS<br><br>SEQ ID NO: 31406 |
| iPS:436760 | 21-225_155E10 | NA | TCCTATGAGCTGACTCAGCCGCCCTCAGTGTC CGTGTCCCAGGACAGACAGCCAGCATCACCT GCTCTGGAGATAAATTGGGGGATAAATATGTT TCCTGGTATCAGCAGAAGCCAGGCCAGTCCCC TGTGCTGGTCATCTATCAAGATAGGAAGCGGC CCTCAGGGACCCCTGAGCGATTCTCTGGCTCC AACTCTGGGAACACAGCCACTCTGACCATCAG CGGGACCCAGGCTATGGATGAGGCTGACTATT ACTGTCTGGCGTGGGACAGCAGCACTTTTGTG GTATTCGGCGGAGGGACCAAGTTGACCGTCCT A<br><br>SEQ ID NO: 27401 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCGTGA CTACGGTGACCCCCCTACTACTACTACTACGGT ATGGACGTCTGGGGCCAAGGGACCACGGTCACC GTCTCCTCA<br><br>SEQ ID NO: 31407 |

FIGURE 50
(Continued)

| | | | | |
|---|---|---|---|---|
| iPS:436762 | 21-225_156H2 | AA | SYELTQPPSVSVSPGQTASITCSGDKLGDKYVSW YQQKPGQSPVLVIYQDRKRPSGTPERFSGSNSGN TATLTISGTQAMDEADYYCLAWDSSTFVFGGG TKLTVL<br><br>SEQ ID NO: 27402 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDRDY GDPPYYYYGMDVWGQGTTVTVSS<br><br>SEQ ID NO: 31408 |
| | | NA | CAGTCTGTGGTGACTCAGCCACCCTCAGCGTC TGGGACCCCCGGGCAGAGGGTCACCATCTCTT GTTCTGGAAGCAGCTCCAACATCGGAAGTAAT ACTGTAAATTGGTACCAGCAGCTCCCAGGAAC GGCCCCCAAACTCCTCATCTATAGTAATC AGCGGCCCTCAGGGGTCCCTGACCGATTGTCT GGCTCCAAGTCTGGCACCTCAGCCTCCCTGGC CATCAGTGGGCTCCAGTCTGAGGATGACAGCCTG ATTATTACTGTGCAGCATGGGACGGCGGAGGAGG AATGGCGTGGTATTCGGCGGAGGGACCAAGG TGACCGTCCTA<br><br>SEQ ID NO: 27403 | GAGGTGCAGCTGGTGGAGTCTGGGGGAGGCTTG ATACAGCCTGGGGGGTCCCTGAGACTCTCCTGTG CAGCCTCTGGATTCACCTTCAGTAACTATAACAT GAACTGGGTCCGCCAGGCTCCAGGGAAGGGCT GGAGTGGGTTTCATACATTAGTAGAAGTAGTAAT ACCAAATACTACGCAGACTCTGTGAAGGGCCGA TTCACCATCTCCAAAATGAACAGCCTGAGAGACGAGG TGTATCTGCAAAATGAACAGCCTGAGAGAGACGAGG ACACGGCTGTGTATTACTGTGCGAGAGATAGGAGG TGGGAGCTACGGGTACTTCTACTACTACGGTATG GACGTCTGGGGCCAAGGGACCACGGTCACCGTC TCCTCA<br><br>SEQ ID NO: 31409 |
| | | AA | QSVVTQPPSASGTPGQRVTISCSGSSSNIGSNTVN WYQQLPGTAPKLLIYSSNQRPSGVPDRLSGSKSG TSASLAISGLQSEDEADYYCAAWDDSLNGVVFG GGTKVTVL<br><br>SEQ ID NO: 27404 | EVQLVESGGGLIQPGGSLRLSCAASGFTFSNYNMN WVRQAPGKGLEWVSYISRSSNTKYYADSVKGRFTI SRDNAKNSLYLQMNSLRDEDTAVYYCARDRSGSY GYFYYYGMDVWGQGTTVTVSS<br><br>SEQ ID NO: 31410 |

FIGURE 50
(Continued)

| | | NA | TCCTATGACCTGACTCAGCCACCCTCAGTGTC CGTGTCCCCAGGACAGACAGCCAGCATCACC TGCTCTGGAGATAAATTGGGGATAAATATGTT TGCTGGTATCAGCAGAAGCCAGGCCAGTCCCC TGTGCTGGTCATCTATCAAGATAGTAAGCGGC CCTCAGGGATCCCTGAGCGATTCTCTGGCTCC AACTCTGGGAACACAGCCACTCTGACCATCAC CGGGACCCAGGCTATGGGACAACAGCAGCTAATT ACTGTCAGGCGTGGGAGGGACCAAGCTGACCGTCCT CTATTCGGCGGAGGGACCAAGCTGACCGTCCT A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGGAAGT AGTAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCGGGT TTTTTGTAGTGGTACCAGCTGCCCTTACTACTACT ACTACGGTATGGACGTCTGGGGCCAAGGGACCA CGGTCACCGTCTCCTCA |
|---|---|---|---|---|
| iPS:436764 | 21-225_158E9 | | SEQ ID NO: 27405 | SEQ ID NO: 31411 |
| | | AA | SYDLTQPPSVSVSPGQTASITCSGDKLGDKYVC WYQQKPGQSPVLVIYQDSKRPSGIPERFSGSNSG NTATLTITGTQAMDEANYYCQAWDNSSFVLFG GGTKLTVL | QVQLVESGGGVVQPGRSLRLSCAASGFTFSSYGMH WVRQAPGKGLEWVAVIWYDGSSKYYADSVKGRF TISRDNSKNTLYLQMNSLRAEDTAVYYCARDRVFC SGTSCPYYYYGMDVWGQGTTVTVSS |
| | | | SEQ ID NO: 27406 | SEQ ID NO: 31412 |

FIGURE 50
(Continued)

| iPS:436766 | 21-225_158D10 | NA | TCCTATGAGCTGACTCAGCCACCCTCAGTGAC CGTGTCCCCAGGACAGACAGCCAGCATCACCT GCTCTGGAGATAAATTGGGGATAAATATGTT TGCTGGTATCAGCAGAAGCCAGGCCAGTCCCC TGTGCTGGTCATCTATCAAGATCGCAAGCGGC CCTCAGGGATCCTGAGCGATTGTCTGGCTCC AACTCTGGGAACACAGCCACTCTGACCATCAG CGGGACCCAGGCTCTGGATGAGGCTGACTATT ACTGTCAGGCGTGGGACAACAGCAGCTTTGTG GTATTCGGCGGAGGGACCAAGCTGACCGTCCT A | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCGGGT TTCTTGTAGTAGTACCAGCTGCCCTTACTACTACT ACTACGGTATGGACGTCTGGGGCCAAGGGACCA CGGTCACCGTCTCCTCA |
|---|---|---|---|---|
| | | | SEQ ID NO: 27407 | SEQ ID NO: 31413 |
| | | AA | SYELTQPPSVTVSPGQTASITCSGDKLGDKYVC WYQQKPGQSPVLVIYQDRKRPSGIPERLSGSNSG NTATLTISGTQALDEADYYCQAWGNSSFVVFGG GTKLTVL | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDRVSC SSTSCPYYYYGMDVWGQGTTVTVSS |
| | | | SEQ ID NO: 27408 | SEQ ID NO: 31414 |

FIGURE 50
(Continued)

| | | | |
|---|---|---|---|
| iPS:436768 | 21-225_159H8 | NA | TCCTATGAGCTGACTCAGCCACCCTCAGTGTCCGTGTCCCCAGGACAGACAGCCAGCATCACCTGCTCTGGAGATAAAATTGGGGATAAATATGTTGCTCTGGTATCAGCAGAAGCCAGGCCAGTCCCCTGTGTTGGTCATCTATCAAGATAGGAAGCGGCCCTCAGGGATCCCTGAGCGATTCTCTGGCTCCAACTCTGGGAACACAGCCACTCTGACCATCAGCGGGACCCAGGCTCTGGATGAGGCTGACTATTACTGTCAGGCGTGGGACAGCAGCTTTGTGGTATTCGGCGGAGGGACCAAGCTGACCGTCCTA<br>SEQ ID NO: 27409 | CAGGTGCAGCTGGTGGAGTCTGGGGGAGGCGTGGTCCAGCCTGGGAGGTCCCTGAGACTCTCCTGTGCAGCGTCTGGATTCACCTTCAGTACCTATGGCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCGGGTTCTTGTAGTAGTACCAGCTGCCCTTACTACTACTACTACGGTATGGACGTCTGGGGCCAAGGGACCACGGTCACCGTCTCCTCA<br>SEQ ID NO: 31415 |
| | | AA | SYELTQPPSVSVSPGQTASITCSGDKLGDKYVCWYQQKPGQSPVLVIYQDRKRPSGIPERFSGSNSGNTATLTISGTQALDEADYYCQAWDSSFVFGGGTKLTVL<br>SEQ ID NO: 27410 | QVQLVESGGGVVQPGRSLRLSCAASGFTFSTYGMHWVRQAPGKGLEWVAVIWYDGSNKYYADSVKGRFTISRDNSKNTLYLQMNSLRAEDTAVYYCARDRVSCSSTSCPYYYYYGMDVWGQGTTVTVSS<br>SEQ ID NO: 31416 |

FIGURE 50
(Continued)

| iPS:436770 | 21-225_160B12 | NA | TCCGATGAGCTGACTCAGTCACCCTCAGTGTC CGTGTCCCCAGGACAGACAGCCAGCATCACCT GCTCTGGAGATAAATTGGGGGATAAATATGTT TGCTGGTATCAGCAGAAGCCAGGCCAGTCCCC TGTGTTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTCTGGATGAGGCTGACTATT ACTGTCAGGCGTGGGGACCAAGCAGCTTTGTG GTATTCGGCGGAGGGACCAAGCTGACCGTCCT A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGTATGGAAGT AATAAATACTATGCAGACTCCGTGAAGGGCCGA TTCACCATCTCCAGAGACAATTCCAAGAACACGC TGTATCTGCAAATGAACAGCTGAGAGCCGAGG ACACGGCTGTGTATTACTGTGCGAGAGATCGGGT TTCTTGTAGTAGTAGTACCAGCTGCCCTTACTACT ACTACGGTATGGACGTCTGGGGCCAAGGGACCA CGGTCACCGTCTCCTCA |
| | | | SEQ ID NO: 27411 | SEQ ID NO: 31417 |
| | | AA | SDELTQSPSVSVSPGQTASITCSGDKLGDKYVCW YQQKPGQSPVLVIYQDSKRPSGIPERFSGSNSGN TATLTISGTQALDEADYYCQAWGNSSFVVFGGG TKLTVL | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDRVSC SSTSCPYYYYYGMDVWGQGTTVTVSS |
| | | | SEQ ID NO: 27412 | SEQ ID NO: 31418 |

FIGURE 50
(Continued)

| | | | | |
|---|---|---|---|---|
| iPS:436772 | 21-225_161H3 | NA | TCCTTATGAGCTGACTCAGCCACCCTCAGTGTC CGTGTCCCAGGACAGAGCCAGCATCACCT GCTCTGGAGATAGATTGGGGGATAAATATGTT TGCTGGTATCAGCAGAAGCCAGGCCAGTCCCC TGTACTGGTCATCTTTCAAGATAACAAGCGGC CCTCAGGGATCCCTGAGCGATTCTCTGGCTCC AACTCTGGGAACACAGCCACTCTGACCATCAG CGGGACCCAGGCTCTGGATGAGGCTGACTATT ACTGTCAGGCGTGGGTCAACAACACTGCAGTG GTTTTCGGCGGAGGGACCAAGCTGACCGTCCT A SEQ ID NO: 27413 | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGAGGACACGG ACACGGCTGTGTATTACTGTGCGAGAGTCGGGTA TAGCGGTGGTGGCTGGTACATCTTTGACTACTGGGGC CAGGGAACCCTGGTCACCGTCTCCTCA SEQ ID NO: 31419 |
| | | AA | SYELTQPPSVSVSPGQTASITCSGDRLGDKYYCW YQQKPGQSPVLVIFQDNKRPSGIPERFSGSNSGN TATLTISGTQALDEADYYCQAWVNNTAVVFGG GTKLTVL SEQ ID NO: 27414 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARVGYSG GWYIFDYWGQGTLVTVSS SEQ ID NO: 31420 |
| iPS:436774 | 21-225_161E10 | NA | TCCTTTGACCTGACTCAGCCACCCTCAGTGTCC GTGTCCCAGGACAGAGCCAGCCAGCATCACCTG CTCTGGAGATAAATTGGGGGATAAATATGTTT GCTGGTATCAGCAGAAGCCAGGCCAGTCCCCT GGTCTGGTCATCTATCAAGATAGCAAGCGGCC CTCAGGGATCCCTGAGCGAATCTCTGGCTCCA ACTCTGGGAACACAGCCACTCTGACCATCAGC GGGACCCAGGCTATGGATGAGGCTGACTATTA CTGTCAGACGTGGGACAACAGTAGTTTTGCGC TTTTCGGCGGAGGGACCAAGCTGACCGTCCTA SEQ ID NO: 27415 | CAGGTGCAGCTGGTGGAGTCTGGGGGAGGCGTG GTCCAGCCTGGGAGGTCCCTGAGACTCTCCTGTG CAGGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACACAATTCCAAGAACACGCT TCACCATCTCCAGAGACAATTCCAAGAACACGCT GTATCTGCAAATGAACAGCCTGAGAGCCGAGGA CACGGCTGTGTATTACTGTGCGAGAGATGGGGTT TTTTGTAGTGGTACCAGCTGCCCTTACTACTACTA CTACGGTATGGACGTCTGGGGCCAAGGGACCAC GGTCACCGTCTCCTCA SEQ ID NO: 31421 |

FIGURE 50
(Continued)

| | | | |
|---|---|---|---|
| | | AA | SFDLTQPPSVSVSPGQTASITCSGDKLGDKYVVCW YQQKPGQSPVLVIYQDSKRPSGIPERISGSNSGNT ATLTISGTQAMDEADYYCQTWDNSSFALFGGGT KLTVL<br><br>SEQ ID NO: 27416 | QVQLVESGGGVVQPGRSLRLSCAASGFTFSSYGMH WVRQAPGKGLEWVAVIWYDGSNKYYVDSVKGRF TISRDNSKNTLYLQMNSLRAEDTAVYYCARDRVFC SGTSCPYYYYGMDVWGQGTTVTVSS<br><br>SEQ ID NO: 31422 |
| iPS:436776 | 21-225_161F12 | NA | TCCTATGAGCTGACTCAGCCACCCTCAGTGTC CGTGTCCCCAGGACAGACAGCCAGCATCACCT GCTCTGGAGATAAAATTGGGTGATAAATATGCT TGCTGGTATCAGCAGAAGCCAGGCCAGTCCCC TGTGCTGGTCATCTATCAAGATACCAAGGCGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCCTGGGACAGCAGCAAGCTGTGTT TTCGGCGGAGGGACCAAGCTGACCGTCCTA<br><br>SEQ ID NO: 27417 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGGTTA CTACTGGAGCTGGATCCGCCAGCACCCAGGGAA GGGAGCTGGAGTGGATTGGGTACATCTATTACAGT GGGAGCCCCTACTACAACCCGTCCCTCAAGAGTC GAATTACCATATCAATAGACACGTCTAAGAACCA GTTCTCCCTGAAGCTGAACTCTGTGACTGCCGCG GACACGGCCGTGTATTACTGTGCGAGATCGAATT GTAGTAGTGCCAACTGCTATACGGTGGGGTTCTA CTACTACGGTTTGGACGTCTGGGGCCAGGGACC ACGGTCACCGTCTCCTCA<br><br>SEQ ID NO: 31423 |
| | | AA | SYELTQPPSVSVSPGQTASITCSGDKLGDKYACW YQQKPGQSPVLVIYQDTKRPSGIPERFSGSNSGN TATLTISGTQAMDEADYYCQAWDSTTLVFGGG TKLTVL<br><br>SEQ ID NO: 27418 | QVQLQESGPGLVKPSQTLSLTCTVSGGSISSGGYYW SWIRQHPGKGLEWIGYIYYSGSPYYNPSLKSRITISI DTSKNQFSLKLNSVTAADTAVYYCARSNCSSANCY TVGFYYYGLDVWGRGTTVTVSS<br><br>SEQ ID NO: 31424 |

FIGURE 50
(Continued)

| | | | |
|---|---|---|---|
| iPS:436780 | 21-225_165H3 | NA | TCCTATGAGCTGACTCAGCCACCCTCAGTGTC CGTGTCCCCAGGACAGACAGCCAGCATCACCT GCTCTGGAGATAAATTGGGTGATAAATATGCT TGCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCACCACTCTGGTT TTCGGGGGAGGGACCAAGCTGACCGTCCTA | CAGGTGCAGCTGCAGGAGTCGGGCCCAGGACTG GTGAAGCCTTCACAGACCCTGTCCCTCACCTGCA CTGTCTCTGGTGCCTCCATCAGCAGTGGTTA CTACTGGAGCTGGATCCGCCAGCACCCAGGAA GGGCCTGGAGTGGATTGGGTACATCTATTACAGT GGGAGCCCCTACTACAATCGTCCCTCAAGAGTC GAATTACCATATCAATAGACACGTCTAAGAACCA GTTCTCCCTGAAGCTGAACTCTGTGACTGCCGCG GACACGGCCGTGTATTACTGTGCGAGATCGAATT GTAGTAGTGCCAACTGCTATACGGTGGGGTTCTA CTACTACGGTATGGACGTCTGGGGCCAAGGGAC CACGGTCACCGTCTCCTCA |
| | | | SEQ ID NO: 31425 |
| | | AA | SYELTQPPSVSVSPGQTASITCSGDKLGDKYACW YQQKPGQSPVLVIYQDSKRPSGIPERFSGSNSGN TATLTISGTQAMDEADYYCQAWDSTLVFGGG TKLTVL | QVQLQESGPGLVKPSQTLSLTCTVSGGSISSGGYYW SWIRQHPGKGLEWIGYIYYSGSPYYNRSLKSRITISI DTSKNQFSLKLNSVTAADTAVYYCARSNCSSANCY TVGFYYYGMDVWGQGTTVTVSS |
| | | | SEQ ID NO: 27420 | SEQ ID NO: 31426 |

FIGURE 50
(Continued)

| iPS:436782 | 21-225_166G11 | NA | TCCTATGAGCTGAGTCAGCCACCCTCAGTGTC CGTGTCCCAGGACAGCAGCCAGCATCACCT GCTCTGGAGATAAATTGGGGGATAAATATGTT CACTGGTATCAGCAGAAGCCAGGCCAGTCCCC TGTGTTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGGCTGATTATT ACTGTCAGGCGTGGGACAACAGCACTGCGGTA TTCGGCGGAGGGACCAAGTTGACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAATGGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACACTTCCAAGAACACGC TGTTTCTGCAAATGAACAGCCTGACAGCCGAGGA CACGGCTGTGTATTACTGTGCGAGAGATGATAGA TATTGTAGTAGTCCCACCTGCCATCCTTACTACTA CTACTACGGTCTGGACGTCTGGGGCCAAGGGACC ACGGTCACCGTCTCCTCA |
| | | | SEQ ID NO: 27421 | SEQ ID NO: 31427 |
| | | AA | SYELSQPPSVSVSPGQTASITCSGDKLGDKYVHW YQQKPGQSPVLVIYQDSKRPSGIPERFSGSNSGN TATLTISGTQAMDEADYYCQAWDNSTAVFGGG TKLTVL | QVQLVESGGGVVQPGRSLRLSCAASGFTFNGYGM HWVRQAPGKGLEWVAVIWYDGSNKYYADSVKGR FTISRDTSKNTLFLQMNSLTAEDTAVYYCARDDRY CSSPTCHPYYYYGLDVWGQGTTVTVSS |
| | | | SEQ ID NO: 27422 | SEQ ID NO: 31428 |

FIGURE 50
(Continued)

| | | | |
|---|---|---|---|
| iPS:436784 | 21-225_169C1 | NA | TCCTATGAGCTGACTCAGGACCACCCTCAGTGTC CGTGTCCCCAGGACAGCAGCCAGCATCACCT GCTCTGGAGATAAATTGGGGATAAATATGTT TGTTGGTATCAGCAGAAGCCAGGCCAGTCCCC TTTGCTGGTCATCTATAAAGATATCAAGCGGC CCTCAGGGATCCCTGAGCGATTCTCTGGCTCC AACTCTGGTAACACAGCCACTCTGACCATCAG CGGGACCCAGGCTATGGATGAGGCTGACTATT ACTGTCAGGCGTGGGACACCAACACTGTCCTA TTCGGGGAGGGACCAAGCTGACCGTCCTA | CAGGTGCAGTTGGTGGAGTCTGGGGGAGGCGTG GTCCAGCCTGGGAGGTCCCTGAGACTCTCCTGTG CAGCGTCTGGATTCACTTTGAGTAGCAATGGCAT GCACTGGGTCCGCCAGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACACTTCCAAGAACACGC TGTATCTGCAAATGAACAGCCTGAGAGCCGAGG ACACGGCTGTGTATTACTGTGCGAGAGATCAGTA CAACCGGAACGACGACCACCAGCTTACTACTA CTACTACGGTTTGACGTCTGGGGCCAAGGGACC ACGGTCACCGTCTCCTCA |
| | | | SEQ ID NO: 27423 | SEQ ID NO: 31429 |
| | | AA | SYELTQPPSVSVSPGQTASITCSGDKLGDKYVCW YQQKPGQSPLLVIYKDIKRPSGIPERFSGSNSGNT ATLTISGTQAMDEADYYCQAWDTNTVIFGGGT KLTVL | QVQLVESGGGVVQPGRSLRLSCAASGFTLSSNGMH WVRQAPGKGLEWVAVIWYDGSNKYYADSVKGRF TISRDTSKNTLYLQMNSLRAEDTAVYYCARDQYNR NDGPPAYYYYGLDVWGQGTTVTVSS |
| | | | SEQ ID NO: 27424 | SEQ ID NO: 31430 |

FIGURE 50
(Continued)

| iPS:436786 | 21-225_169A6 | NA | TCCTATGAGCTGACTCAGCCACCCTCAGTGTC CGTGTCCCAGGACAGACAGCCAGCATCACCT GCTCTGGAGATAAATTGGGGGATAAATATGTT TGTTGGTATCAGCGGAAGCCAGGCCAGTCCCC TGTTCTGGTCATCTATCAGGATTACAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCTGTGGGACACCAACTGTCCTG TTCGGCGGAGGGACCAAGCTGACCGTCCTG | CAGGTGCAGCTGGTGGAGTCTGGGGGAGGCGTG GTCCAGCCTGGGAGGTCCCTGAGACTCTCCTGT CAGGGTCTGGATTCACTTTGAGCAGCAATGCAT GCACTGGGTCCGCCAGGCTCCAGGCAAGGGCT GGAGTGGGTGGCAGTTATATGTATGATGAAGT AATAAATACTATGCAGAGACTCCGTGAAGGGCCGA TTCACCATCTCCAGAGACAATTCCAAGAACACGC TGTCTCTGCAAATGAACAGCTGAGAGCCGAGG ACACGGCTGTGTATTACTGTGCGAGAGATCAGTA CAACCGGAACGACGACCACCAGCTTACTACTA CTACTACGGTATGGACGTCTGGGGCCAAGGGAC CACGGTCACCGTCTCCTCA |
| | | | SEQ ID NO: 27425 | SEQ ID NO: 31431 |
| | | AA | SYELTQPPSVSVSPGQTASITCSGDKLGDKYVCW YQRKPGQSPVLVIYQDYKRPSGIPERFSGSNSGN TATLTISGTQAMDEADYYCQAWDTNTVLFGGG TKLTVL | QVQLVESGGGVVQPGRSLRLSCAASGFTLSSNGMH WVRQAPGKGLEWVAVIWYDGSNKYYADSVKGRF TISRDNSKNTLSLQMNSLRAEDTAVYYCARDQYNR NDGPPAYYYYYGMDVWGQGTTVTVSS |
| | | | SEQ ID NO: 27426 | SEQ ID NO: 31432 |

FIGURE 50
(Continued)

| | | | |
|---|---|---|---|
| iPS-436788 | 21-225_169B7 | NA | GCCTATGACCTGACTCAGCCACCCTCAGTGTC CGTGTCCCCAGGACAGACAGCCAGAATCACCT GCTCTGGATATAAATTGGGGGACAAATATGCT TCCTGGTATCAACAGAAGCCAGGCCAGTCCCC TGTGCTGGTCATCTATCAAGATAGGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAAGAACACTGTGGTA TTCGGCGGAGGGACCAAGCTGACCGTCCTA SEQ ID NO: 27427 | GAGGTGCAGCTGGTGGAGTCTGGGGGAGGCTTG GTACAGCCTGGGGGGTCCCTGAGACTCTCCTGTG CAGCCTCTGGATTCACCTTCAGTAGCTATAGCTT GAACTGGGTCCGCCAGGCTCCAGGGAAGGGGCT GGAGTGGGTTTCATACATTGGTAGTAGTGGCAGT ATCATATTCTACGCAGACTCTGTGAAGGGCCGAT TCACCATCTCCAGAGACAATGCCAAGAACTCACT GTATCTGCAAATGAACAGCCTGAGAGACGAGGA CACGGCTGTGTATTACTGTGCGAGAGGGATACA GCTGGGTTACCTATTACTACGGTATGGACGTCT GGGGCCAAGGGACCACGGTCACCGTCTCCTCA SEQ ID NO: 31433 |
| | | AA | AYDLTQPPSVSVSPGQTARITCSGDKLGGKYAS WYQQKPGQSPVLVIYQDRKRPSGIPERFSGSNSG NTATLTISGTQAMDEADYYCQAWDKNTVVFGG GTKLTVL SEQ ID NO: 27428 | EVQLVESGGGLVQPGGSLRLSCAASGFTFSSYSLN WRQAPCKGLEWVSYIGSSGSHFYADSVKGRFTIS RDNAKNSLYLQMNSLRDEDTAVYYCARGDTAGVT YYYGMDVWGQGTTVTVSS SEQ ID NO: 31434 |
| iPS-436790 | 21-225_169G11 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TGCTGGTATCAGCAGAAGCCAGGCCAGTCCCC TGTGCTGGTCATCTATCAAGATAGTAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAACAGCACTGCGGTA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAATTATATGGTATGATGGAAGT AATAAATACTATGCAGACTCCGTGAAGGGCCGA TTCACCATCTCCAGAGACAATTCCAAGAACACGC TGTATCTGCAAATGAACAGCTGAGAGCCGAGG ACACGGGTGTATTACTGTGCGAGAGAGGGGG CTACGTATTACCATGGTTCGGGGAGTTATTATCC GGGTACTAACTACGGTATGACGTCTGGGGCCAA GGGACCACGGTCACCGTCTCCTCA |

FIGURE 50
(Continued)

| | | | | SEQ ID NO: 27429 | | SEQ ID NO: 31435 | |
|---|---|---|---|---|---|---|---|
| iPS:436792 | 21-225_169D12 | | AA | SYELTQPPSVSVSPGQTASITCSGDKLGDKYACW YQQKPGQSPVLVIYQDSKRPSGIPERFSGSNSGN TATLTISGTQAMDEADYYCQAWDNSTAVFGGG TKLTVL | | QVQLVESGGGVVQPGRSLRLSCAASGFTFSSYGMH WVRQAPGKGLEWVAHWYDGSNKYYADSVKGRFT ISRDNSKNTLYLQMNSLRAEDTGVYYCAREGATY YHGSGSYYPATNYGMDVWGQGTTVTVSS | |
| | | | | SEQ ID NO: 27430 | | SEQ ID NO: 31436 | |
| | | | NA | AATTTTATGCTGACTCAGCCCCACTCTGTGTCG GAGTCTCCGGGGAAGACGGTAACCATCTCCTG CACCCGCAGCAGTGGCAGCATTACGGCAACT ATGTGCAGTGGCACCAGCAGCGCCCGGCAAT TCCCCCACCACTCTGGGGTCCCTGATCGGTTCTG AAGACCCTCTGACAGCTCCTCCAACTCTGCCTC CTCACCATCTCTGGACTGAAGACTGAGGACGA GGCTGACTATTACTGTCAGTCTTATTATAGCG GCAATTGGGTGTTCGGCGGAGGGACCAAGCTG ACCGTCCTG | | CAGGTGCAGCTGGTGGAGTCTGGGGAGGCGTG GTCCAGCCTGGGAGGTCCCTGAGACTCTCTGTG CAGCGTCTGATTCACCTTCAGTAGCTATGGCAT GCACTGGGTCCGCCAGGCTCCAGGCAAGGGCT GGAGTGGGTGGCAGTTATATGTATGATGGAAGT AATAAATATTATGCAGACTCCGTGAAGGGCCGAT TCACCATCTCCAGAGACAATTCCAAGAACACGCT GTATCTGCAAATGAACAGCTGAGAGCCGAGGA CACGGCTGTGTATTACTGTGCAGAGTCCCCTTTAC GATATGGGACTCTACTACGATATGGACGTCTGGG GCCAAGGGACCACGGTCACCGTCTCCTCA | |
| | | | | SEQ ID NO: 27431 | | SEQ ID NO: 31437 | |
| | | | AA | NFMLTQPHSVSESPGKTVTISCTRSSGSITGNYVQ WHQQRPGNSPTTLYEDKKRPSGVPDRFSGSIDS SSNSASLTISGLKTEDEADYYCQSYYSGNWFG GGTKLTVL | | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCASPLYDM GLYYDMDVWGQGTTVTVSS | |
| | | | | SEQ ID NO: 27432 | | SEQ ID NO: 31438 | |

FIGURE 50
(Continued)

| iPS:436794 | 21-225_170F1 | NA | TCCTATGAGTTGAGTCAGCCACCCTCAGTGTC CGTGTCCCCAGGACAGAGCCAGCAGCATCACCT GCTCTGGAGATAAATTGGGGGATAAATATTCT TGCTGGTATCAGCAGAAGCCAGGCCAGTCCCC TGTGCTGGTCATCTATCAAGATAGTAAGCGGC CCTCAGGGATCCCTGCACGATTCTCTGGCTCC AACTCTGGGAACACAGCCACTCTGACCATCAG CGGGACCCAGGCTATGGATGAGGCTGATTATT ACTGTCAGGCGTGGGACAGCAACACTGACCGTA TTCGGCGGAGGGACCAAACTGACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGGCTATGGCAT GAACTGGGTCCGCCAGGCTCCAGGCAAGGGGCT GGAGTGGGTGGCAATTATATGGTATGATGGAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCGGGT TTATTGTAGTAGTACCAGCTGCCATCCTATTACT ACTACTACGCTATGGACGTCTGGGGCCAAGGGA CCACGGTCACCGTCCTCCTCA |
| | | | SEQ ID NO: 27433 | SEQ ID NO: 31439 |
| | | AA | SYELSQPPSVSVSPGQTASITCSGDKLGDKYSCW YQQKPGQSPVLVIYQDSKRPSGIPARFSGSNSGN TATLTISGTQAMDEADYYCQAWDSNTAVFGGG TKLTVL | QVQLVESGGGVVQPGRSLRLSCAASGFTFSGYGM NWVRQAPGKGLEWVAIIWYDGNNKYYADSVKGR FTISRDNSKNTLYLQMNSLRAEDTAVYYCARDRVY CSSTSCHPYYYYYAMDVWGQGTTVTVSS |
| | | | SEQ ID NO: 27434 | SEQ ID NO: 31440 |

FIGURE 50
(Continued)

| | | | |
|---|---|---|---|
| iPS:436796 | 21-225_170A5 | NA | TCCTATGACCTGACTCAGCCACCCTCAGTGTC CGTGTCCCCAGGACAGACAGCCAGCATCACCT GCTCTGGAGATAAATTGGGGGATAAATATGCT TGTTGGTATCAGCAGAAGCCAGGCCAGTCCCC TATACTGGTCATCTATCAAGATTACAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ATTGTCAGGCGTGGGACAACAGCACTATGGTA TTCGGCGGAGGGACCAAGGCTGACCGTCCTA | CAGGTGCAGCTGGTGGAGTCTGGGGGAGGCGTG GTCCAGCCTGGGAGGTCCCTGAGACTCTCTGTG CAGCGTCTGACTCACCTTCAGTAACTGTGGCAT GCACTGGGTCCGCCAGGCTCCAGGCAAGGGGCT GGAGTGGGTGGCAATTATATGGTATGATGGAAGT AATAAATACTATGCAGACTCCGTGAAGGGCCGA TTCACCATCTCCAGAGACAATTCCAAGAACACGC TGGATCTGCAAATGAACAGCCTGAGAGCCGAGG ACACGGCTGTGTATTACTGTGCGAGAGATCAGTA CAACAGGAACGACGACCACCAGCTTACTACTA CTACTACGGTTTGGACGTCTGGGGCCAAGGACC ACGGTCACCGTCTCCTCA |
| | | | SEQ ID NO: 31441 |
| | | SEQ ID NO: 27435 | |
| | | AA | SYDLTQPPSVSVSPGQTASITCSGDKLGDKYAC WYQQKPGQSPILVIYQDYKRPSGIPERFSGSNSG NTATLTISGTQAMDEADYYCQAWDNSTMVFGG GTRLTVL | QVQLVESGGGVVQPGRSLRLSCAASGLTFSNCGM HWVRQAPGKGLEWVAHWYDGSNKYYADSVKGR FTISRDNSKNTLDLQMNSLRAEDTAVYYCARDQYN RNDGPPAYYYYGLDVWGQGTTVTSS |
| | | | SEQ ID NO: 31442 |
| | | SEQ ID NO: 27436 | |

FIGURE 50
(Continued)

| | | |
|---|---|---|
| iPS:436798 | NA | GCCTATGACCTGACTCAGCCACCCTCAGTGTC CGTGTCCCCAGGACAGACAGCCAGCATCACCT GCTCTGGAGATAAACAGGGGGGAAAATATGCT TCCTGGTATCAACAGAAGCCAGGCCAGTCCCC TGTGCTGGTCATCTATCAAGATAGGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCCGTGGACAAGAACACTGTGGTA TTCGGCGGAGGGACCAAGCTGACCGTCCTA | GAGGTGCAGCTGGTGGAGTCTGGGGGAGGCTTG GTACAGCCTGGGGGGTCCCTGAGACTCTCCTGTG CAGCCTCTGGATTCACCTTCAGTAGCTATAGCTT GAACTGGGTCCGCCAGGCTCCAGGGAAGGGGCT GGAGTGGGTTTCATACATTGGTAGTAGTGGCAGT ATCATATTCTACGCAGACTCTGTGAAGGGCCGAT TCACCATCTCCAGAGACAATGCCAAGAACTCACT GTATCTGCAAATGAACAGCCTGAGAGACGAGGA CACGGCTGTGTATTACTGTGCGAGAGGGATACA GCTGGGGTACCTATTACTACGGTATGGACGTCT GGGGCCAAGGGACCACGGTCACCGTCTCCTCA |
| | | SEQ ID NO: 31443 |
| | AA | AYDLTQPPSVSVSPGQTASITCSGDKLGKYAS WYQQKPGQSPVLVIYQDRKRPSGIPERFSGSNSG NTATLTISGTQAMDEADYYCQAWDKNTVFGG GTKLTVL | EVQLVESGGGLVQPGGSLRLSCAASGFTFSSYSLN WVRQAPGKGLEWVSYIGSSGSIIFYADSVKGRFTIS RDNAKNSLYLQMNSLRDEDTAVYYCARGDTAGVT YYYGMDVWGQGTTVTVSS |
| | | SEQ ID NO: 27437 | SEQ ID NO: 31444 |
| iPS:436800 | NA | TCTTCTGAGCTGACTCAGGACCCTGCTGTCT GTGGCCTTGGGACAGACAGTCAGGATCACATG CCAAGGAGACAGCCTCAGAAGCTATTATGCAA GCTGGTACCAGCAGAAGCCAGGACAGGCCCC TATACTTGTCATCTATGCTAAAAACAACCGGC CCTCAGGGATCCCAGACCGATTCTCTGGCTCC AACTCAGGAAACACAGCTTCCTTGACCATCAC TGGGGCTCAGGCGGAAGATGAGGCTGACTATT ACTGTAACTCCCGGGACAGCAGTGGCAGCCAT GTGGTATTCGGCGGAGGGACCAAACTGACCGT CCTA | CAGGTGCAGCTGGTGCAGTCTGGGGCTGAGGTG AAGAAGCCTGGGGCTCAGTGAAGGTTTCCTGCA AGGCATCTGGATACACCTTCAACAGTTACTATAT GTATTGGGTGCGACAGGCCCCTGGACAAGGGCTT GAGTGGATGGGAATAATCAACCCTAGTGGTGGT AGCACAAACTACGCACAGAAGTTCCAGGGCAGA GTCACCATGACCAGGGACACGTCCACGAGCACA CTCTACATGGAGCTGAACAGCCTGAGATCTGAGG ACACGGCCGTGTATTACTGTGCGAGTGGTTGGGA GTTAAACTACTGGGGCCAGGGAACCCTGGTCACC GTCTCCTCA |
| | | SEQ ID NO: 27438 | SEQ ID NO: 31445 |
| | | SEQ ID NO: 27439 | |

FIGURE 50
(Continued)

| | | | | |
|---|---|---|---|---|
| iPS:436802 | 21-225_171E12 | AA | SSELTQDPAVSVALGQTVRITCQGDSLRSYYAS WYQQKPGQAPILVIYAKNNRPSGIPDRFSGSNSG NTASLTITGAQAEDEADYYCNSRDSSGSHVVFG GGTKLTVL<br>SEQ ID NO: 27440 | QVQLVQSGAEVKKPGASVKVSCKASGYTFNSYYM YWVRQAPGQGLEWMGIINPSGGSTNYAQKFQGRV TMTRDTSTSTLYMELNSLRSEDTAVYYCASGWELN YWGQGTLVTVSS<br>SEQ ID NO: 31446 |
| | | NA | TCCTATGAGCTGACTCAGCCACCCTCAGTGTC CGTGTCCCAGGACAGCAGCCAGCATCACCT GCTCTGGAGATAAATTGGGGATAAATATGCT TGCTGGTATCAGCAGAAGCCAGGCCAGTCCCC TGTGCTGGTCATCTATCAAGATCGCAAGCGGC CCTCAGGGATCCCTGAGCGATTCTCTGGCTCC AACTCTGGGAACACAGCCACCCTGACCATCAG CGGGACCCAGGCTATGGATGAGGCTGACTATT ACTGTCAGGCGTGGGACATCAGCACTTATGTG GTATTCGGCGGAGGGACCAAACTGACCGTCCT A<br>SEQ ID NO: 27441 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGGCT GGAGTGGGTGGCAGTTATATGGAATGATGGAGG TAATAAATATAATGGAGACTCCGTGAAGGGCCG ATTCACCATCTCCAGAGACAATTCCAAGAACACG CTGTATCTGCAAATGAACAGTCTGAGAGCCGAG GACACGGCTGTGTATTACTGTGCGAGAGACCGTA CGTATTACTCTGGTTCGGGGAGCCCCCCTACTA CTACTACTACGGTATGGACGTCTGGGGCCAAGGG ACCACGGTCACCGTCTCCTCA<br>SEQ ID NO: 31447 |
| | | AA | SYELTQPPSVSVSPGQTASITCSGDKLGDKYACW YQQKPGQSPVLVIYQDRKRPSGIPERFSGSNSGN TATLTISGTQAMDEADYYCQAWDISTYVVFGGG TKLTVL<br>SEQ ID NO: 27442 | QVQLVESGGGVVQPGRSLRLSCAASGFTFSSYGMH WVRQAPGKGLEWVAVIWNDGGNKYNGDSVKGRF TISRDNSKNTLYLQMNSLRAEDTAVYYCARDRTYY SGSGSPPYYYYGMDVWGQGTTVTVSS<br>SEQ ID NO: 31448 |

FIGURE 50
(Continued)

| | | | | |
|---|---|---|---|---|
| iPS:436804 | 21-225_172C3 | NA | TCTTCTGAGCTGACTCAGGACCCTGCTGTGTCT GTGGCCTTGGGACAGAGACAGTCAGGATCACATG CCAAGGAGACAGCCTCAGAAACTATTATGTAA GCTGGTACCACGCAGAAGCCAGGACAGGCCCC TATACTTGTCATCTATACTAAAAACAGCCGGC CCTCAGGGATCCCAGACCGATTCTCTTGACCTCC ACCTCAGGAAACACAGCTTCCTTGACCATCAC TGGGACTCAGGCGGAAGATGAGGCTGACTATT ACTGTAACTCCCGGGACAGCAGTGGCAACCAT GTGGTATTCGGCGGAGGGACCAAGCTGACCGT CCTA SEQ ID NO: 27443 | CAGGTGCAGCTGGTGCAGTCTGGGGCTGAGGTG AAGAAGCCTGGGGCCTCAGTGAAGGTTTCCTGCA AGGCATCTGGATACACCTTCAGAAGTTACTATAT GTATTGGGTGCGACAGGCCCCTGGACAAGGGCTT GAGTGGGTGGGAACAATCAACCCTAGTGGTGT AGCACAAACTACGCACAGAAGTTCCAGGCAGA GTCACCATGACCAGGGACACGTCCACGAGCACA CTCTACATGGAGCTGAACAGCCTGAGATCTGAGG ACACGGCCGTGTATTACTGTGCAGGTGGCTGGGA GTTAAACTACTGGGGCCAGGGAACCCTGGTCACC GTCTCCTCA SEQ ID NO: 31449 |
| | | AA | SSELTQDPAVSVALGQTVRITCQGDSLRNYYVS WYQQKPGQAPILVIYTKNSRPSGIPDRFSGSTSG NTASLTITGTQAEDEADYCNSRDSSGNHVVFG GGTKLTVL SEQ ID NO: 27444 | QVQLVQSGAEVKKPGASVKVSCKASGYTFRSYYM YWVRQAPGQGLEWVGTINPSGGSTNYAQKFQGRV TMTRDTSTSTLYMELNSLRSEDTAVYYCASGWELN YWGQGTLVTVSS SEQ ID NO: 31450 |
| iPS:436806 | 21-225_172B12 | NA | TCTTCTGAGCTGACTCAGGACCCTGCTGTGTCT GTGGCCTTGGGACAGAGACAGTCAGGATCACATG CCAAGGAGACAGCCTCAGAAACTATTATGCAA GCTGGTACCACGCAGAAGCCAGGACAGGCCCC TATACTTGTCATCTATACTAAAAACAGCCGGC CCTCAGGGATCCCAGACCGATTCTCTTGACCTCC ACCTCAGGAAACACAGCTTCCTTGACCATCAC TGGGGCTCAGGCGGAAGATGAGGCTGACTATT ACTGTAACTCCCGGGACAGCAGTGGCAACCAT GTGGTATTCGGCGGAGGGACCAAGCTGACCGT CCTA SEQ ID NO: 27445 | CAGGTGCAGCTGGTGCAGTCTGGGGCTGAGGTG AAGAAGCCTGGGGCCTCAGTGACGGTTTCCTGCA AGGCATCTGGATACACCTTCAGAAGTTACTATAT GTATTGGGTGCGACAGGCCCCTGGACAAGGGCTT GAGTGGGTGGGAACAATCAACCCTAGTGGTGT AGCACAGACTACGCACAGAAGTTCCAGGGCAGA GTCACCATGACCAGGGACACGTCCACGAGCACA CTCTACATGGAGCTGAACAGCCTGAGATCTGAGG ACACGGCCGTGTATTACTGTGCGAGTGGCTGGGA ATTAAACTACTGGGGCCAGGGAACCCTGGTCACC GTCTCCTCA SEQ ID NO: 31451 |

FIGURE 50
(Continued)

| | | | | |
|---|---|---|---|---|
| | | AA | SSELTQDPAVSVALGQTVRITCQGDSLRNYYAS WYQQKPGQAPILVIYTKNSRPSGIPDRFSGSTSG NTASLTITGAQAEDEADYCNSRDSSGNHVVFG GGTKLTVL<br>SEQ ID NO: 27446 | QVQLVQSGAEVKKPGASVTVSCKASGYTFRSYYM YWVRQAPGQGLEWVGTINPSGGSTDYAQKFQGRV TMTRDTSTSTLYMELNSLRSEDTAVYYCASGWELN YWGQGTLVTVSS<br>SEQ ID NO: 31452 |
| iPS-436808 | 21-225_173F8 | NA | TCCTATGAGCTGACTCAGCACCCTCAGTGTC CGTGTCCCCAGGACAGACAGCCAGCATCACCT GCTCTGGAATAAATTGGGGAATAAATATGTT TGCTGGTATCAGCAGAGGCCAGGCCAGTCCCC TGTGCTGGTCATCTCAAGATAGCAGGGGGC CCTCAGGGATCCCTGAGGATTCTCTGGCTCC AACTCTGGGAACACAGCCACTCTGACCATCAG CGGGACCCAGGCTGTGGACAGCTTCACTGTGGTA ACTCTCAGGCGTGGGACAAGCTGACCGTCCTA TTCGGCGGAGGGACCAAGCTGACCGTCCTA<br>SEQ ID NO: 27447 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAATGGGTGGCAGTTATATCATATGATGAAGT CCTAAATACTGTGCAGACTCCGTGAAGGGCCGAT TCACCATCTCCAGAGACAATTCCAAGAACACGCT GTTTCTCCAAATGAACAGCTGAGAGCTGAGGAC ACGGCTGTGTATTATTGTGCGAGAGATGAAAGGC AGTGGCTGCCGGCCCCCTACGGTATGGACGTCTG GGGCCAAGGGACCACGGTCACCGTCTCCTCA<br>SEQ ID NO: 31453 |
| | | AA | SYELTQPPSVSVSPGQTASITCSGNKLGNKYVCW YQQRPGQSPVLVISQDSRRPSGIPERFSGSNSGNT ATLTISGTQAMDEADYYCQAWDSFTVVFGGGT KLTVL<br>SEQ ID NO: 27448 | QVQLVESGGGVVQPGRSLRLSCAASGFTFSSYGMH WVRQAPGKGLEWVAVISYDGSPKYCADSVKGRFT ISRDNSKNTLFLQMNSLRAEDTAVYYCARDERQW LPAPYGMDVWGQGTTVTVSS<br>SEQ ID NO: 31454 |

FIGURE 50
(Continued)

| | | | |
|---|---|---|---|
| iPS:436810 | 21-225_175F4 | NA | CAGTCTGCCCTGACTCAGCCTGCCTCCGTGTCTGGGTCTCCTGGACAGTCGATCACCATCTCCTGCACTGGAACCAGCAGTGATGTTGGACGTTTTAACCTTGTCTCCTGGTACCAACAGCACCCAGGCTACGCCCCCAAACTCATGATTTATGAGGTCAGTAAGCGGCCCTCAAGTCTGCAACACGGCCTCCTGCTGGCTCCAAGTCTGGGCTCCAGGCTGAGGACGAGGCACAATCTCTGGGCTCTGCTGCTCATATGCAGGTAGTAGCACCTATGTGGTATTCGGCGGAGGGACCAAGCTGACCGTCCTG<br/>SEQ ID NO: 27449 | CAGGTACAGCTGCAGCAGTCAGGTCCAGGACTGGTGAAGCCCTCGCAGACCCTCACTCTGTGCCATCTCCGGGACAGTGTCTCTAGCAACAGTGCTGCCTTGGAACTGGATCAGGCAGTCCCCATGAGAGGCCTTGAGTGGCTGGGAAGGACATACTACAGGTCCAAGTGGTATAATGCTTATCAGTATCTATGGAAAGTCGAATATCCATCAACCAGACACATCCAAGAAACCAGTTCTCCTGCAGCTGAACTCTGTGACTCCCGAGGACACGGCTGTTTATTACTGTGCAAGAGATAAGGCAGCTGGGAGGAATGACTTCTACTACTACGGTATGGACGTCTGGGGCCAAGGGACCACGGTCACCGTCTCCTCA<br/>SEQ ID NO: 31455 |
| | | AA | QSALTQPASVSGSPGQSITISCTGTSSDVGRFNLVSWYQQHPGYAPKLMIYEVSKRPSGVSNRFSGSKSGNTASLTISGLQAEDEADYYCCSYAGSSTYVVFGGGTKLTVL<br/>SEQ ID NO: 27450 | QVQLQQSGPGLVKPSQTLSLTCAISGDSVSSNSAAWNWIRQSPSRGLEWLGRTYYRSKWYNAYQYSMESRISINPDTSKNQFSLQLNSVTPEDTAVYYCARDKAAGRNDFYYYGMDVWGQGTTVTVSS<br/>SEQ ID NO: 31456 |
| iPS:436812 | 21-225_175C6 | NA | TCCTATGACCTGACTCAGCCACCCTCAGTGTCCGTGTCCCCAGGACAGACAGCCAGCATCACCTGCTCTGGAGATAAATTGGGGGATAAATATGCTGTTGGTATCAGCAGAAGCCAGGCCAGTCCCCTATACTGGTCATCTATCAAGATTACAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTATTGTCAGGCGTGGGACAGCAGCACTATGTATTCGGCGGAGGGACCAAGGCTGACCGTCCTA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAACTGTGCATGCACTGGGTCCGCCAGGCTCCAGGCAAGGGGCTGGAGTGGGTGGCAATTATATGTCAGACTCCGTGAAGGGCCGAATAAATACTATGCAGAGACAATTCCAAGAACACGCTTCACCGTCTCAAATGAACAGCCTGAGAGCCGAGGTGGATCTGCAAATGAACAGCCTGAGAGCCGAGGACACGGCTGTGTATTACTGTGCGAGAGATCAGTACAACAGGAACGACGACCACCAGCTTACTACTACTACTACGGTTTGACGTCTGGGGCCAAGGGACCACGGTCACCGTCTCCTCA |

FIGURE 50
(Continued)

| | | SEQ ID NO: 27451 | SYDLTQPPSVSVSPGQTASITCSGDKLGDKYAC WYQQKPGQSPILVIYQDYKRPSGIPERFSGSNSG NTATLTISGTQAMDEADYYCQAWDNSTMVFGG GTRLTVL | SEQ ID NO: 31457 | QVQLVESGGGVVQPGRSLRLSCAASGLTFSNCGM HWVRQAPGKGLEWVAIIWYDGSNKYYADSVKGR FTVSRDNSKNTLDLQMNSLRAEDTAVYYCARDQY NRNDGPPAYYYYGLDVWGQGTTVTVSS |
|---|---|---|---|---|---|
| iPS:436814 | 21-225_178H10 | AA | | | |
| | | SEQ ID NO: 27452 | CAGTCTGCCCTGACTCAGCCTGCCTCCGTGTCT GGGTCTCCTGGACAGTCGATCACCATCTCCTG CACTGGAACCAGCAGTGATGTTGGACGTTTTA ACCTTGTCTCCTGGTACCAACAACACCCAGGC AACGCCCCCAAACTCATGATTTATGAAGTCAG TAAGCGGCCCTCAGGGGTTTCTAATCGTTCT CTGGCTCCAAGTCTGGCAACACGGCCTCCTG ACAATCTGGGCTCCAGGCTGAGGACGAGGC TGATTATTACTGTGCTCATATGCAGGTAGTA GCACCTTTGTAGTATTCGGCGGAGGGACCAAG CTGACCGTCCTA | SEQ ID NO: 31458 | CAGGTACAGCTGCAGCAGTCAGGTCCAGGACTG GTGAAGCCCTCGCAGACCCTCTCACTCACCTGTG CCATCTCCGGGGACAGTGTCTCTAGCAACAGTGC TGCTTGGAACTGGATCAGGCAGTCCCCATCGAGA GGCCTTGAGTGGCTGGGAAGGACATACTACAGG TCCAAGTGGTATAGTGCTTATCCAGTATCTATGG AAAGTCGAGTATCCATCAACCAGACACATCCA AGAACCAGTTCTCCCTGCAGCTGAACTCTGTGAC TCCCGAGGACAGGCTGTTTATTACTGTGCAAGA GATAAGGCAGCTGGGAGGAATGACTTCTACTACT ACGGTATGGACGTCTGGGGCCAAGGGACCACGG TCACCGTCTCCTCA |
| | | SEQ ID NO: 27453 | QSALTQPASVSGSPGQSITISCTGTSSDVGRFNLV SWYQHHPGNAPKLMIYEVSKRPSGVSNRFSGSK SGNTASLTISGLQAEDEADYYCCSYAGSSTFVVF GGGTKLTVL | SEQ ID NO: 31459 | QVQLQQSGPGLVKPSQTLSLTCAISGDSVSSNSAA WNWIRQSPSRGLEWLGRTYYRSKWYSAYPVSMES RVSINPDTSKNQFSLQLNSVTPEDTAVYYCARDKA AGRNDFYYGMDVWGQGTTVTVSS |
| | | SEQ ID NO: 27454 | | SEQ ID NO: 31460 | |

FIGURE 50
(Continued)

| | | | |
|---|---|---|---|
| iPS:436816 | 21-225_179H5 | NA | TCTTCTGAGCTGACTCAGGACCCTGCTGTGTCT GTGGCCCTTGGGACAGACAGTCAGGATCACATG CCAAGGAGACAGTTCAGAAACTATTATGCAA GCTGGTACCAGCAGAAGCCAGGACAGGCCCC TGTATTTGTCATCTATGGTAAAAACAACCGC CCTCAGGGATCCCAGACCGATTCTCTGGCTCC AGGTCAGGAACACACAGTTCCTTGACCATCAC TGGGGCTCAGGCGAAGATGAGGCTGAATTAT ACTGTAACTCCCGGGACAGCAGTGGTAACCAT TGGGTGTTCGGCGGAGGGACCAAACTGACCGT CCTA<br><br>SEQ ID NO: 27455 | CAGGTGCAGTTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATGAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATATCCG GAACTACTACGGTTTGACGTCTGGGGCCAA GGGACCACGGTCACCGTCTCCTCA<br><br>SEQ ID NO: 31461 |
| | | AA | SSELTQDPAVSVALGQTVRITCQGDSLRNYYAS WYQQKPGQAPVFVIYGKNNRPSGIPDRFSGSRS GNTASLTITGAQAEDEADYYCNSRDSSGNHWVF GGGTKLTVL<br><br>SEQ ID NO: 27456 | QVQLVESGGGVVQPGRSLRLSCAASGFTFSSYGMH WVRQAPGKGLEWVAVIWYDGSNEYYADSVKGRF TISRDNSKNTLYLQMNSLRAEDTAVYYCARDIRNY YYGLDVWGQGTTVTVSS<br><br>SEQ ID NO: 31462 |
| iPS:436818 | 21-225_179C7 | NA | TCCTATGAGCTGACTCAGCCACCCTCAGTGTC CGTGTCCCCAGGACAGACAGCCAGTATCACCT GCTCTGGAGATATAAATTGGGGATAAATATGTT TGCTGGTATCAACAGAAGCCGGGCCAGTCCCC TGTGCTGGTCATCTATCAGGATAGTAAGCGGC CCTCAGGGATCCCTGAGCGATTCTCTGGCTCC AACTCTGGGAACACAGCCACTCTGACCATCCG CGGGACCCAGGCTATGATGAGGCTGACTATT ACTGTCAGGCGTGGGACAGCAACACTGCAGTG GTATTCGGCGGAGGGACCAAGCTGACCGTCCT A<br><br>SEQ ID NO: 27457 | CAGGGCAGCTGGTGGAGTCTGGGGGAGGCGTG GTCCAGCCTGGGAGGTCCCTGAGACTCTCCTGTG CAGCGTCTGGATTCACCTTCAGTAACTCTGCAT GCACTGGGTCCGCCAGGCTCCAGGCAAGGGGCT GGAGTGGGTGGCAGATTATATTATGAGTGGAAGT TATAAATACAATGCAGACTCCGTGAAGGGCCGA TTCACCATCTCCAGAGACAATTCCAAGAACACGC TGTATCTGCAAATGAACAGCCTGAGAGCCGAGG ACACGGCTGTATATTACTGTGCGAGAGACCGTCA TACGATTTCCACGTTCCTACTACTATTACTACG GTATGGACGTCTGGGGCCAAGGGACCACGGTCA CCGTCTCCTCA<br><br>SEQ ID NO: 31463 |

FIGURE 50
(Continued)

| | | | | |
|---|---|---|---|---|
| iPS-436820 | 21-225_179D10 | AA | SYELTQPPSVSVSPGQTASITCSGDKLGDKYVCW YQQRPGQSPVLVIYQDSKRPSGIPERFSGSNSGN TATLTIRGTQAMDEADYYCQAWDSNTAVVFGG GTKLTVL<br>SEQ ID NO: 27458 | QAQLVESGGGVVQPGRSLRLSCAASGFTFSNSGMH WVRQPGKGLEWVAIIYDGSYKYNADSVKGRFT ISRDNSKNTLYLQMNSLRAEDTAVYYCARDRHYD FHVPYYYYGMDVWGQGTTVTVSS<br>SEQ ID NO: 31464 |
| | | NA | CAGTCTGTGTTGACGCAGCCGCCCTCAGTGTC TGGGGCCCCAGGGCAGAGGGTCACCATCTCCT GCACTGGGAGCAGCTCCAACTTCGGGACAGAT TATGATGTATACACTGGTACCAGCAATTCCAGG AACAGCCCCCAAACTCCTCATCTATGGTCACA GCAACCGCCCTCCAAGTCTGGGGTCCCTGACCGATTT TCTGGCTCCAAGTCTGGCACCTCAGCTCTCT GGCCATCACTGGGCTCCAGGTCAGGATGAGG CTGAATATTACTGCCAGTCCTATGATAGAAGC CTGAATGTGGTCTTCGGCGGAGGGACCAAGCT GACCGTCCTA<br>SEQ ID NO: 27459 | GAGGTGCAGCTGGTGGAGTCTGGGGGAGGCTTG GTACAGCCTGGGGGGTCCCTGAGATTCTCCTGTG CAGCCTCTGGATTCACCTTCAGTAGCTATAGCAT GAACTGGGTCCGCCAGGCTCCAGGGAAGGGGCT GGAGTGGGTTGCATACATTAGTAGTAGTGGAAGT ACCACATACTACGCAGACTCTGTGCAGGGCCGAT TCACCATCTCCAGAGACAATGCCAAGAACTCACT GTATCTGCAAATGAACAGCCTGAGAGACGAGGA CACGGCTGTGTATCGTGTGCGAGAGATAGTAGG AAGGGGTTCTACTACGGTCTGGACGTCTGGGGCC AAGGGATCACGGTCACCGTCTCCTCA<br>SEQ ID NO: 31465 |
| | | AA | QSVLTQPPSVSGAPGQRVTISCTGSSSNFGTDYD VHWYQQFPGTAPKLLIYGHSNRPSGVPDRFSGS KSGTSASLAITGLQAEDEADYYCQSYDRSLNVV FGGGTKLTVL<br>SEQ ID NO: 27460 | EVQLVESGGGLVQPGGSLRFSCAASGFTFSSYSMN WVRQAPGKGLEWVAYISSSGSTTYADSVQGRFTI SRDNAKNSLYLQMNSLRDEDTAVYRCARDSRKGF YYGLDVWGQGITVTVSS<br>SEQ ID NO: 31466 |

FIGURE 50
(Continued)

| | | | |
|---|---|---|---|
| iPS:436822 | 21-225_180D4 | NA | TCCTATGAGCTGACTCAGGACACCCTCAGTGTC CGTGTCCCCAGGACAGACAGCCAGCATCACCT GCTCTGGAGATAGATTGGGGATAAATATGCT TGCTGGTATCAGCAGAAGCCAGGCCAGTCCCC TGTGCTGGTCATCTATGAAGATAGGAAGCGGC CCTCAGGGATCCCTGAGCGATTCTCTGGCTCC AACTCTGGGAACACAGCCACTCTGACCATCAG CGGGACCCAGGCTATGGACAGTAGGAAAGTGGT ACTGTCAGGCGTGGACAGTAGGAAAGTGGT ATTCGGCGGAGGGACCAAGCTGACCGTCCTA<br><br>SEQ ID NO: 27461 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAACTTTGGCAT GCACTGGGTCCGCCAGGCTCCAGGCAAGGGGCT GGAGTGGGTGGCAATTATATGGTATGATGGAAGT GATAAATACTATGCAGACTCCGTGAAGGGCCGA TTCACCATCTCCAGAGACAATTCCAAGAACACGC TGTATCTGCAAATGAACACCCTGAGAGCGAAG ACACGGCTGTGTATTTCTGTGCGAGAGGGGGCC CCGGTTCCTACGGTGACTATGTACTTTGACTACT GGGGCCAGGGAACCCTGGTCACCGTCTCCTCA<br><br>SEQ ID NO: 31467 |
| | | AA | SYELTQTPSVSVSPGQTASITCSGDRLGDKYACW YQQKPGQSPVLVIYEDRKRPSGIPERFSGSNSGN TATLTISGTQAMDEGDYYCQAWDSRKVVFGGG TKLTVL<br><br>SEQ ID NO: 27462 | QVQLVESGGGVVQPGRSLRLSCAASGFTFSNFGMH WVRQAPGKGLEWVAIIWYDGSDKYYADSVKGRFT ISRDNSKNTLYLQMNTLRAEDTAVYFCARGGPPFS TVTMYFDYWGQGTLVTVSS<br><br>SEQ ID NO: 31468 |
| iPS:436824 | 21-225_180C5 | NA | TCCTATGAACTGACTCAGCCACCCTCAGTGTC CGTGTCCCCAGGACAGACAGCCAGCATCACCT GCTCTGGAGATAAATTGGGGACAAGCTGACTATGCT TGCTGGTATCAGCAGAAGCCAGGCCAGTCCCC TGTACTGGTCATCTATCAAGATAGAAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGCCGTA TTCGGCGGAGGGACCAAGCTGACCGTCCTA<br><br>SEQ ID NO: 27463 | CAGATCACCTTGAAGGAGTCTGGTCCTACGCTGG TGAAACCCACACAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGGCTTGGATTCATTTCTTGGAATG ATGATAAAGCGCTACAGCCCATCTCTGAAGAGCA GCCTCACCATCACCAAGGACACCTCAAAAACC AGGTGGTTCTTATAATGACCAACATGACCCTGT GGACACAGCCACATATTACTGTGCACACAAAGC AGCAGCTGTTGCTTTTGATATCTGGGGCCAAGGG ACAATGGTCACCGTCTCTCA<br><br>SEQ ID NO: 31469 |

FIGURE 50
(Continued)

| | | | | |
|---|---|---|---|---|
| iPS:436826 | 21-225_180G5 | AA | SYELTQPPSVSVSPGQTASITCSGDKLGEKYACW YQQKPGQSPVLVIYQDRKRPSGIPERFSGSNSGN TATLTISGTQAMDEADYYCQAWDSSTAVFGGG TKLTVL | QITLKESGPTLVKPTQTLTLTCTFSGFSLSTSGVGVG WIRQPPGKALEWLGFISWNDDKRYSPSLKSSLTTTK DTSKNQVVLTMTNMDPVDTATYYCAHKAAAVAFD IWGQGTMVTVSS |
| | | | SEQ ID NO: 27464 | SEQ ID NO: 31470 |
| | | NA | TCCTATGAGCTGACTCAGCCACCCTCAGTGTC CGTGTACCCAGGACAGACAGCCAGCATCACCT GCTCTGGAGATAAATTGGGGGATAAATATGTT AGCTGGTATCAACAGAAGCCAGGCCAGTCCCC TGTTCTGGTCATCTATCAAGATAGCAAGCGGC CCTCAGGGATCCCTGAGCGATTCTCTGGCTCC AACTCTGGGAACACCAGCCTCTCTGACCATCAG CGGGACCCAGGCTATGGACATCACCACTGCGTA ACTGTCAGGCGTGGGACCAAGCTGACCGTCCTA TTCGGCGGAGGGACCAAGCTGACCGTCCTA | CAGGTGCAGTCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGGC TTGAGTGGATGGGATGGATGAACCCTAACAGTG GTAACACAGGCTATGCACAGAAGTTCCAGGCA GAGTCACCATGACCAGGAACACTCCATAAGCA CAGCCTACATGAGCTGAGCAGCCTGAGATCTG AGGACACGGCCGTGTATTACTGTGCGAGAGGGTT TTATTACTACTGGTTCGGGGAGTCATGTCCCTTACC ACTACTACTACGGTTTGGACGTCTGGGGCCAAGG GACCACGGTCACCGTCTCCTCA |
| | | | SEQ ID NO: 27465 | SEQ ID NO: 31471 |
| | | AA | SYELTQPPSVSVYPGQTASITCSGDKLGDKYVS WYQQKPGQSPVLVTYQDSKRPSGIPERFSGSNSG NPASLTISGTQAMDEADYYCQAWDITTAVFGGG TKLTVL | QVQLVQSGAEVKKPGASVKVSCKASGYTFTSYDIN WVRQATGQGLEWMGWMNPNSGNTGYAQKFQGR VTMTRNTSISTAYMELSSLRSEDTAVYYCARGFYY YGSGSHVPYHYYGLDVWGQGTTVTVSS |
| | | | SEQ ID NO: 27466 | SEQ ID NO: 31472 |

FIGURE 50
(Continued)

| | | | |
|---|---|---|---|
| iPS:436828 | 21-225_181H1 | NA | TCCTATGAGCTGACTCAGACACCCTCAGTGTC CGTGTCCCAGGACAGACAGCCAGCATCACCT GCTCTGGAGATAAATTGGGGATAAATATGCT TGCTGGTATCAGCAGAAGCCAGGCCAGTCCCC TGTGCTGGTCATCTATGAAGATAGGAAGCGGC CCCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGGAGGAAAGTGGT ATTCGGCGGAGGGACCAAGCTGACCGTCCTA | CAGGTGCAGCTGGTGGAGTCTGGGGGAGGCGTG GTCCAGCCTGGGAGGTCCCTGAGACTCTCTGTG CAGCGTCTGGATTCACCTTCAGTAACTATGGCAT GCACTGGGTCCGCCAGGCTCAGGCAAGGGGCT GGAGTGGGTGGCAATTATATGGTATGATGAAGT GATAAATACTATGCAGACTCCGTGAAGGGCCGA ATCACCATCTCCAGAGACAATTCCAAGAACACGC TGTATCTGCAAATGAACACCCTGAGAGAGCCGAAG ACACGGCTGTGTATTTCTGTGCGAGAGGGGGCC CCCGTTTTCTACGGTGACTATGTACTTCGACTACT GGGGCCAGGGAACCCTGGTCACCGTCTCCTCA |
| | | | SEQ ID NO: 27467 | SEQ ID NO: 31473 |
| | | AA | SYELTQTPSVSPGQTASITCSGDKLGDKYAC WYQQKPGQSPVLVIYEDRKRPSGIPERFSGSNSG NTATLTISGTQAMDEADYYCQAWDSRKVVFGG GTKLTVL | QVQLVESGGGVVQPGRSLRLSCAASGFTFSNYGM HWVRQAPGKGLEWVAIIWYDGSDKYYADSVKGRI TISRDNSKNTLYLQMNTLRAEDTAVYFCARGGPPF STVTMYFDYWGQGTLVTVSS |
| | | | SEQ ID NO: 27468 | SEQ ID NO: 31474 |
| iPS:436830 | 21-225_51F4 | NA | CAGTCTGTGCTGACTCAGCCACCCTCAGCGTC TGGGACCCCCGGGCAGAGGGTCACCATCTCTT GTTCTGGAAGCAGCTCCAACATGGAAGTAAT ATTGTGACCTGGTACCAGCAGCTCCCAGGAAC GGCCCCAAACTCCTCATCTATAGTAATGATC AGCGGCCCTCAGGGGTCCCTGACCGATTCTCT GGCTCCAAGTCTGGCACCTCAGCCTCCCTGGC CATCAGTGGGCTCCAGTCTGAGGATGAGACTG ATTATTACTGTACAGCATGGGATGGACAGCCTG AATGGTTGGGTGTTCGGCGGAGGGACCAAGCT GACCGTCCTA | CAGGTTCAGCTGGTGCAGTCTGGAGCTGAGGTGA AGAAGCCTGGGGCCTCAGTGAAGGTCTCCTGCA AGGCTTCTGGTTACACCTTTAACAGTATGGTAT CAGCTGGGTGCGACAGGCCCCTGACAAGGGCT TGAGTGGATGGGATGGATCAGCGCTTATAATGGT AACACAAAGTATGCACAGAAGCTCCAGGGCAGA GTCACCATGACCACAGACACATCCACGAGCACA GCCTACATGGAGCTGAGGAGCCTGAGATCTGAC GACACGGCCGTGTATTACTGTGCGAGACACGATT TTTGGAGTGGTTATTATAAGGTATGGACGTCTG GGGCCAAGGGACCACGGTCACCGTCTCCTCA |
| | | | SEQ ID NO: 27469 | SEQ ID NO: 31475 |

FIGURE 50
(Continued)

| | | | | |
|---|---|---|---|---|
| | | AA | QSVLTQPPSASGTPGQRVTISCSGSSSNIGSNIVT WYQQLPGTAPKLLIYSNDQRPSGVPDRFSGSKS GTSASLAISGLQSEDETDYCTAWDDSLNGWVF GGGTTLTVL<br><br>SEQ ID NO: 27470 | QVQLVQSGAEVKKPGASVKVSCKASGYTFNSYGIS WVRQAPGQGLEWMGWISAYNGNTKYAQKLQGR VTMTDTSTSTAYMELRSLRSDDTAVYYCARHDF WSGYYKGMDVWGQGTTVTVSS<br><br>SEQ ID NO: 31476 |
| iPS:436832 | 21-225_51D8 | NA | CAGTCTGTGCTGACGCAGCCGCCCTCAGTGTC TGGGGCCCCAGGGCAGAGGGTCACCATCTCCT GCACTGGGAGCAGCTCCAACATCGGGGCAGG TTTTGAAGTACACTGGTACCAGCAGCTTCCAG GAACAGCCCCCAAACTCCTCATCTATGGTAAC AGCAATCGGCCCTCAGGGGTCCCTGACCGATT CTCTGGCTCCAAGTCTGGCACCTCAGCTCCCT GGCCATCACTGGGCTCCAGGTGGAGGATGAGG CTGATTATTACTGCCAGTCCTATGACAGCAGC CTGAGTGGTTATGTCTTCGGAACTGGGACCAA GGTCACCGTCCTA<br><br>SEQ ID NO: 27471 | CAGGTACAGCTGCAGCAGTCAGGTCAGGACTG GTGAAGCCCTCGCAGACCCCTCACTCACCTGTG CCATCTCCGGGACAGTGTCTAGTAACAGTGC TGCTTGGAACTGGATCAGGCAGTCCCCATCGAGA GGCCTTGAGTGGCTGGGAAGGACATACTACAGG TCCAAGTGGTATAATGATTATGCAGTATCTGTGA AAAGTCGAATAACCTTCAACCGGACACATCCA AGAACCAGTTCTCCCTGCGGCTGAACTCTGTGAC TCCCGAGGACACGGCTGTGTATTACTGTGCAAGA GACCGCTATAACTGGAACTACCCCTACTGGTACT TCGATCTCTGGGGCCGTGGCACCCTGGTCACTGT CTCCTCA<br><br>SEQ ID NO: 31477 |
| | | AA | QSVLTQPPSVSGAPGQRVTISCTGSSSNIGAGFEV HWYQQLPGTAPKLLIYGNSNRPSGVPDRFSGSK SGTSASLAITGLQAEDEADYYCQSYDSSLSGYVF GTGTKVTVL<br><br>SEQ ID NO: 27472 | QVQLQQSGPGLVKPSQTLSLTCAISGDSVSSNSAA WNWIRQSPSRGLEWLGRTYYRSKWYNDYAVSVK SRITFNPDTSKNQFSLRLNSVTPEDTAVYYCARDRY NWNYPYWYFDLWGRGTLVTVSS<br><br>SEQ ID NO: 31478 |

FIGURE 50
(Continued)

| | | | | |
|---|---|---|---|---|
| iPS:436834 | 21-225_52F1 | NA | CAGTCTGTGCTGACTCAGCCACCCTCAGCGTC TGGGACCCCCGGGCAGCAGTCACCATCTCTT GTTCTGGAAGCAGCTCCAACATCGGAAGTAAT ATTGTGACCTGGTACCAGCAGCTCCCAGGAAC GGCCCCCAAACTCCTCATCTATAGTAATGATC AGCGGCCCTCAGGGGTCCCTGACCGATTCTCT AGCTCCAAGTCTGGCACCTCAGCTCCCTGGC CATCAGTGGGCTCCAGTCTGAGGATGACAGCC ATTATTACTGTGCAGCATGGGATGACAGCCTG AATGGTTGGGTGTTCGGCGGAGGGACCAAGCT GACCGTCCTA | CAGGTTCAGCTGCTGTCGAGCTGAGGTGA AGAAGCCTGGGGCCTCAGTGAAGGTCTCTGCA AGGCTTCTGGTTACACCTTTAACAGCTATGGTGT CAGTGGGTGCGACAGGCCCCTGGACAAGGCT TGAGTGGATGGGATGGATCAGCGCTTATAATGGT AACAGAAAGTATGCACAGAAGCTCCAGGCAGA GTCTCCATGACCACAGACACATCCACGAGCACA GCCTACATGGAGCTGAGGAGCTGAGATCTGAC GACACGGCCGTGTATTACTGTGCGAGACACGATT TTTGGAGTGGTTATTATAAGGGTATGGACGTCTG GGGCCAAGGGACCACGGTCACCGTCTCCTCA |
| | | | SEQ ID NO: 27473 | SEQ ID NO: 31479 |
| | | AA | QSVLTQPPSASGTPGQRVTISCSGSSSNIGSNIVT WYQQLPGTAPKLLIYSNDQRPSGVPDRFSGSKS GTSASLAISGLQSEDEADYYCAAWDDSLNGWV FGGGTTLTVL | QVQLVQSGAEVKKPGASVKVSCKASGYTFNSYGV SWVRQAPGQGLEWMGWISAYNGNRKYAQKLQGR VSMTTDTSTSTAYMELRSLRSDDTAVYYCARHDF WSGYYKGMDVWGQGTTVTVSS |
| | | | SEQ ID NO: 27474 | SEQ ID NO: 31480 |
| iPS:436836 | 21-225_52H1 | NA | TCCTATGAGCTGACTCAGCCACCCTCAGTGTT CGTGTCCCCAGGACAGACAGCCAGCATCACCT CCTCTGGAGATAAATTGGGGATAAATATGTT TCCTGGTATCAGCAGAAGCCAGGCCAGTCCCC TGTGCTGGTCATCTATCAAGATAGAAAGCGGC CCTCAGGGATCCCTGAGCGATTCTCTGGCTCC AATTCTGGGAATACAGCCACTCTGACCATCAG CGGACCCAGCTATGGAGTGATGAGGCTGACTAT ATTGTCAGGCGTGGGACAACAGCACTGTGGTA TTCGGCCGAGGGACCAAGCTGACCGTCCTA | CAGGTGCAGCTGGTGGAGTCTGGGGGAGGCGTG GTCCAGCCCGGGAGGTCCCTGAGACTCTCCTGTG CAGCGGTCGATTCACCTTCAGTGGCTATGGCAT GCACTGGGTCCGCCAGGCTCCAGGCAAGGGCT GGAGTGGGTGGCAGTTATATGGTATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTTATTACTGTGCGAGAGATCGGGT CTATTGTAGTAGTTCCAGCTGCTCATATTACTACT ACTACTACGGTATGGACGTCTGGGGCCAAGGGA CCACGGTCACCGTCTCCTCA |

FIGURE 50
(Continued)

| | | | | |
|---|---|---|---|---|
| | | | SEQ ID NO: 27475 | SEQ ID NO: 31481 |
| | | AA | SYELTQPPSVSVSPGQTASITSSGDKLGDKYVSW YQQKPGQSPVLVIYQDRKRPSGIPERFSGSNSGN TATLTISGTQAMDEADYYCQAWDNSTVVFGGG TKLTVL | QVQLVESGGGVVQPGRSLRLSCAASGFTFSGYGM HWVRQAPGKGLEWVAVIWYDGSNKYYADSVKGR FTISRDNSKNTLYLQMNSLRAEDTAVYYCARDRVY CSSSSCSYYYYYGMDVWGQGTTVTVSS |
| | | | SEQ ID NO: 27476 | SEQ ID NO: 31482 |
| iPS:436838 | 21-225_52H4 | NA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGGCTACGGCAT GCACTGGGTCCGCCAGGCTCCAGGCAAGGGGCT GAAATGGGTGGCAGTTATTTGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGGGACTG GAACTACGAGGGTTTTGACTACTGGGGCCAGGG AACCCTGGTCACCGTCTCCTCA | |
| | | | SEQ ID NO: 27477 | SEQ ID NO: 31483 |
| | | AA | QSALTQPASVSGSPGQSITISCTGTSSDVGGYNY VSWYQQHPGKAPKLMIYEVSNRPSGVSNRFSGS KSGNTASLTISGLQAEDEADYYCNSYTSNITWVF GGGTKLTVL | QVQLVESGGGVVQPGRSLRLSCAASGFTFSHFGMH WVRQAPGKGLKWVAVIWYDGSNKYYADSVKGRF TISRDNSKNTLYLQMNSLRAEDTAVYYCARGDWN YEGFDYWGQGTLVTVSS |
| | | | SEQ ID NO: 27478 | SEQ ID NO: 31484 |

FIGURE 50
(Continued)

| | | | |
|---|---|---|---|
| iPS:436840 | 21-225_53E9 | NA | TCCTATGAGCTGACTCAGCCACCTCAGTGTC<br>CGTGTCCCCAGGACAGAGACCAGCATCACCT<br>GCTCTGGAACTAAATTGGGGATAAATATGTT<br>TGCTCTGGTATCAACAGAAGCCAGGCCAGTCCC<br>TGTGTTGGTCATCAATCAAGATACAATGCGGC<br>CCTCAGGGATCCCTGAGCGATTCTCTGGCTCC<br>AACTCTGGGAACACAGACCACTCTGACCATCAG<br>CGGGACCCAGGCTATGATGAGGCTGACTATT<br>ACTGTCAGACAGTGGACAGCAGCACTGCGGTT<br>TTCGGCGGAGGGACCACGCTGACCGTCCTA<br><br>SEQ ID NO: 27479 | CAGGTGCAGCTGGTGCAGTCTGGGGCTGAGGTG<br>AAGAAGCCTGGGGCCTCAGTGAAGGTCTCCTGC<br>AAGGCTTCTGGAAACACCTTCACCGGCTACTATA<br>TGCACTGGGTGCGACAGGCCCCTGGACAAGGGC<br>TTGAGTGGATGGGATGGATCATCCTAACAGTGG<br>TGACACAAACTATGCACAGGACAGTTCAGGGCAG<br>GGTCACCATGACCAGGGACACGTCCATCAGCAC<br>AGCCTACATGGAGCTGAGCAGGCTGAGATCTGA<br>CGACACGGCCGTCTATTACTGTGCGAGAGATGGG<br>TATAGCAGTGGCTGGTTCAACTGGTTCGACCCT<br>GGGGCCAGGGAACCCTGGTCACCGTCTCCTCA<br><br>SEQ ID NO: 31485 |
| | | AA | SYELTQPPSVSVSPGQTASITCSGTKLGDKYVCW<br>YQQKPGQSPVLVINQDTMRPSGIPERFSGSNSGN<br>TATLTISGTQAMDEADYYCQTWDSSTAVFGGGT<br>TLTVL<br><br>SEQ ID NO: 27480 | QVQLVQSGAEVKKPGASVKVSCKASGNTFTGYYM<br>HWVRQAPGQGLEWMGWIIPNSGDTNYAQKFQGR<br>VTMTRDTSISTAYMELSRLRSDDTAVYYCARDGYS<br>SGWFNWFDPWGQGTLVTVSS<br><br>SEQ ID NO: 31486 |
| iPS:436842 | 21-225_54E9 | NA | CAGTCTGTGCTGACTCAGCCACCCTCAGTGTC<br>TGGGACCCCCGGGCAGAGGGTCACCATCTCTT<br>GTTCTGGAAGCAACTCCAACATCGGAAATAAT<br>ATTGTCACCTGGTACCAGCAGCTCCCAGGAAC<br>GGCCCCCAAACTCCTCATCTATGTTAATGATC<br>AGCGGCCCTCAGGGGTCCCTGACCGATTCTCT<br>GGCTCCAAGTCTGGCACCTCTGCCTCCCTGGC<br>CATCAGTGGGCTCCAGTCTGAGGATGAGGCTG<br>ATTATTACTGTGCAGCATGGGATGACAGCCTG<br>AATGGTTGGGTGTTCGGCGGAGGGACCAAGCT<br>GACCGTCCTA<br><br>SEQ ID NO: 27481 | CAGGTTCAGCTGGTGCAGTCTGAGCTGAGGTGA<br>AGAAGCCTGGGGCCTCAGTGAAGGTCTCCTGCA<br>AGGCTTCTGGTTACACCTTTAACAGTCATGGTAT<br>CAGCTGGGTGCGACTGGCCCCTGGACAAGGGCTT<br>GAGTGGATGGGATGGATTAGTGCTTATAATGGTA<br>ACACAAAGAATGCACAGAAGTCCAGGCAGACAG<br>TCACCATGACCACAGACACATCCACGAGCACAG<br>CCTACATGGAGCTGAGGAGCCTGAGATCTGACG<br>ACACGGCCGTTTATTACTGTGCGAGACACGATTT<br>TGGAGTGGTTATTATAAGGGTATGACGTCTGG<br>GGCCAAGGGACCACGGTCACCGTCTCCTCA<br><br>SEQ ID NO: 31487 |

FIGURE 50
(Continued)

| | | | |
|---|---|---|---|
| | | AA | QSVLTQPPSASGTPGQRVTISCSGSNSNIGNNIVT WYQQLPGTAPKLLIYVNDQRPSGVPDRFSGSKS GTSASLAISGLQSEDEADYYCAAWDDSLNGWV FGGGTTLTVL<br>SEQ ID NO: 27482 | QVQLVQSGAEVKKPGASVKVSCKASGYTFNSYGIS WVRLAPGQGLEWMGWISAYNGNTKNAQKLQGRV TMTTDTSTSTAYMELRSLRSDDTAVYYCARHDFW SGYYKGMDVWGQGTTVTVSS<br>SEQ ID NO: 31488 |
| iPS-436844 | 21-225_56G1 | NA | CAGTCTGTGCTGACTCAGCCACCCTCAGCGTC TGGGACCCCCGGGCAGAGCTCACCATCTCTT GTTCTGGAAGCAGCTCCAACATGGAAGTCAT ATTGTTACCTGGTACCAGCAGCTCCCAGGAAC GGCCCCCAAACTCCTACTCTACAGTAATGATC AGCGCCCTCAGGGGTCCCTGACCGATTCTCT GGCTCCAAGTCTGGCACCTCAGCTCCCTGGC CATCAGTGGGCTCCAGTCTGAGGATGAGGCTG ATTATTACTGTGCAGTATGGGATGACAGCCTG ATTGGTTGGGTGTTCGGCGGAGGGACCACGCT GACCGTCCTA<br>SEQ ID NO: 27483 | CAGGTTCAGCTGGTGCAGTCTGGAGCTGAGGTGA AGAAGCCTGGGGCCTCAGTGAAGGTCTCCTGCA AGGCTTCTGGCTACACCTTTAACAGTATGGTAT CAGCTGGTGCGACAGGCCCCTGGACAAGGGCT CAGTGGATGGGATGGATCAGCGCTTATAATGGT AACACAAAGTATGCACAGAAGTTCCAGGGCAGA GTCACCATGACCACAGACACATCCACGAGCACA GCCTACATGGAGCTGAGGAGCCTGAGATCTGAC GACACGGCCGTGTATTACTGTGCGAGACACGATT TTTGGAGTGGTTATTATAAGGGTATGGACGTCTG GGGCCAAGGGACCACGGTCACCGTCTCCTCA<br>SEQ ID NO: 31489 |
| | | AA | QSVLTQPPSASGTPGQRVTISCSGSSSNIGSHIVT WYQQLPGTAPKLLIYSNDQRPSGVPDRFSGSKS GTSASLAISGLQSEDEADYYCAVWDDSLIGWVF GGGTTLTVL<br>SEQ ID NO: 27484 | QVQLVQSGAEVKKPGASVKVSCKASGYTFNSYGIS WVRQAPGQGLEWMGWISAYNGNTKYAQKFQGRV TMTTDTSTSTAYMELRSLRSDDTAVYYCARHDFW SGYYKGMDVWGQGTTVTVSS<br>SEQ ID NO: 31490 |

FIGURE 50
(Continued)

| | | | |
|---|---|---|---|
| iPS:436846 | 21-225_56E3 | NA | CAGTCTGTGCTGACTCAGCCACCCTCAGCGTC TGGGACCCCGGGCAGAGGTCACCATCTCT GTTCTGGAAGCAGCTCCAACATCGGAAGTAAT ATTGTTACCTGGTACCAGCAGCTCCCAGGAAC GGCCCCCAAACTCCTCATCTATAGTAATAATC AGCGGCCCTCAGGGGTCCCTGACCGATTCTCT GGCTCCAAGTCTGGCACCTCAGCCTCCCTGGC CATCAGTGGACTCCAGTCTGAGGATGACAGCCTG ATTATTGCTGTGCAGCATGGGATGACAGCCTG AATGGTTGGGTGTTCGGCGGAGGGACCACGCT GACCGTCCTA<br><br>SEQ ID NO: 27485 | CAGGTTCAACTGGTGCAGTCTGGAGCTGAGGTGA AGAAGCCTGGGGCCTCAGTGAAGGTCTCCTGCA AGGCTTCTGGTTACACCTTTAACAGCTATGGTTC AGCTGGGTGCGACAGGCCCCTGGACAAGGGCTT GAGTGGATGGGATGGATCAGCGTTATAATGGTA ACACAAAGGAAGCACAGAAGTTCCAGGGCAGAG TCACCATGACCACAGACACATCCACGAGCACAG CCTACATGGAGCTGAGGAGCCTGAGAGCTGACG ACACGGCCGTGTATTACTGTGCGAGACACGATTT TTGGAGTGGTTATTATAAGGGTATGGACGTCTGG GGCCAAGGGACCACGGTCACCGTCCTCA<br><br>SEQ ID NO: 31491 |
| | | AA | QSVLTQPPSASGTPGQRVTISCSGSSSNIGSNIVT WYQQLPGTAPKLLIYSNNQRPSGVPDRFSGSKS GTSASLAISGLQSEDEADYCAAWDDSLNGWVF GGGTTLTVL<br><br>SEQ ID NO: 27486 | QVQLVQSGAEVKKPGASVKVSCKASGYTFNSYGF SWVRQAPGQGLEWMGWISAYNGNTKEAQKFQGR VTMTTDTSTSTAYMELRSLRADDTAVYYCARHDF WSGYYKGMDVWGQGTTVTVSS<br><br>SEQ ID NO: 31492 |
| iPS:436848 | 21-225_57F1 | NA | TCCTATGAGCTGACTCAGCCACCCTCAGCGTC CGTGTCCCCAGGACAGACAGCCAGCATCACCT GCTCTGGAGATAAACTGGGGGAAAAATATGCT TGCTGGTATCAGCAGAAGCCAGGCCAGTCCCC TGTGTTGGTCATCTATCAAGATAGGAAGCGGC CCTCAGGGATCCCTGAGCGATTCTCTGGCTCC AATTCTGGGAACACAGCCACTCTGACCATCAG CGGGACCCAGGCTATGGATGAGGCTGACTATT ACTGTCAGGCGTGGGACAGCAGCACTGTGGTA TTCGGCGGAGGGACCAAACTGACCGTCCTA<br><br>SEQ ID NO: 27487 | CAGATCACCTTGAAGGAGTCTGGTCCTACGCTGG TGAAACCCACACAGACCCTCACGCTGACCTGCAC CTTCTCTGGGTTCTCACTCAGTACTAGTGGAGTG GGTGTGGGCTGGATCCGTCAGCCCCCAGGAAAG GCCCTGGAGTGGCTTGCACTCATTATTGGCATG AAGATAAGCGCTACAGCCCATCTCTGAAGAGCA GGCTCACCATCACTGAGGACACCTCCAAAAACC AGGTGGACCTTACAATGACCAACATGGCCCCTGT GGACACAGCCACATATTACTGTGCACACGTCACA GGTATAGCAGCTCCCTACTGGGGCCAGGGAACC CTGGGTCACCGTCTCCTCA<br><br>SEQ ID NO: 31493 |

FIGURE 50
(Continued)

| | | | | |
|---|---|---|---|---|
| iPS-436850 | 21-225_57D9 | AA | SYELTQPPSASVSPGQTASITCSGDKLGEKYACW YQQKPGQSPVLVIYQDRKRPSGIPERFSGSNSGN TATLTISGTQAMDEADYYCQAWDSSTVFGGG TKLTVL<br>SEQ ID NO: 27488 | QITLKESGPTLVKPTQTLTLTCTFSGFSLSTSGVGVG WIRQPPGKALEWLALIYWHEDKRYSPSLKSRLTITE DTSKNQVDLTMTNMAPVDTATYYCAHVTGIAAPY WGQGTLVTVSS<br>SEQ ID NO: 31494 |
| | | NA | TCCTATGAGCTGACTCAGCCACCTCAGTGTC CGTGTCCCCAGGACAGACAGCCAGCATCACCT GCTCTGGAGAGAAATTGGGGACAAAAATTTGCT TGCTGGTCTCAGCAGAAGCCAGGCCAGTCCCC TGTGTTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGTGTA TTCGGCGGAGGGACCAAGCTGACCGTCCTA<br>SEQ ID NO: 27489 | CAGATCACCTTGAAGGAGTCTGGTCCTATGCTGG TGAAACCACACAGACCCTCACGTGACCTGCAC CTTCTCTGGGTTCTCACTCAGCACTAGTGGAGTG GGTGTGGGCTGGATCCGTCAGCCCCCAGGAAAG GCCCTGGAGTGGCTTGCACTCATTTATTGGAATG ATGATAAGCGCTACAGTCCATCTCTGAAGAGCAG GCTCACCATCACCGAGGACACCTCAAAACCA GGTGGTCCTTACAATGACCAACATGACCCTGTG GACACAGCCACATATTACTGTGCACATGCAGTGG CTGTCTCCTTTGACTACTGGGGCCAGGGAACCCT GGTCACCGTCTCCTCA<br>SEQ ID NO: 31495 |
| | | AA | SYELTQPPSVSVSPGQTASITCSGEKLGEKFACW SQQKPGQSPVLVIYQDSKRPSGIPERFSGSNSGNT ATLTISGTQAMDEADYYCQAWDSSTVFGGGT KLTVL<br>SEQ ID NO: 27490 | QITLKESGPMLVKPTQTLTLTCTFSGFSLSTSGVGV GWIRQPPGKALEWLALIYWNDDKRYSPSLKSRLTI TEDTSKNQVVLTMTNMDPVDTATYYCAHAVAVSF DYWGQGTLVTVSS<br>SEQ ID NO: 31496 |

FIGURE 50
(Continued)

| | | | |
|---|---|---|---|
| iPS:436852 | 21-225_57H11 | NA | TCCTATGCGCTGACTCAGCCACCTCAGCGTC CGTGTCCCCAGGACAGAGCAGCCAGCATCACCT GCTCTGGAGATAAACTGGGGGAATAAATATGCT TGCTGGTATCAGCAGAAGCCAGGCCAGTCCCC TGTGTTGGTCATCTATCAAGATAGGAAGCGGC CCTCAGGGATCCCTGAGCGATTCTCTGGCTCC AATTCTGGGAACACAGCCACTCTGACCATCAG CGGGACCCAGGCTATGGATGAGGCTGACTATT ACTGTCAGGCGGTGGACAGCAGCACTGTGGTA TTCGGCGGAGGGACCAAACTGACCGTCCTA<br><br>SEQ ID NO: 27491 | CAGATCACCTTGAAGGAGTCTGGTCCTACGCTGG TGAAACCCACACAGACCCTCACGCTGACCTGCAC CTTCTCTGGGTTCTCACTCACTAGTGGAGTG GGTGTGGGCTGATCCGTCAGCCCCAGGAAAG GCCCTGGAGTGGCTTGCACTCATTATTGGCATG AAGATAGGCGCTACAGCCATCTCTGAAGAGCA GGCTCACCATCACTGAGGACACCTCAAAAACC AGGTGGACCTTACAATGACCAACATGGCCCCTGT GGACACAGCCACATATTACTGTGCACACGTCACA GGTATAGCAGCTCCCTACTGGGGCCAGGGAACC CTGGTCACCGTCCTCA<br><br>SEQ ID NO: 31497 |
| | | AA | SYALTQPPSASVSPGQTASITCSGDKLGEKYACW YQQKPGQSPVLVIYQDRKRPSGSNSGN TATLTISGTQAMDEADYYCQAWDSSTVVFGGG TKLTVL<br><br>SEQ ID NO: 27492 | QITLKESGPTLVKPTQTLTLTCTFSGFSLTTSGVGVG WIRQPPGKALEWLALIIYWHEDRRYSPSLKSRLTITE DTSKNQVDLTMTNMAPVDTATYYCAHVTGIAAPY WGQGTLVTVSS<br><br>SEQ ID NO: 31498 |
| iPS:436854 | 21-225_58C1 | NA | TCCTATGAGCTGACTCAGCCACCTCAGTGTC CGTGTCCCCAGGACAGAGCAGCCAGCATCACCT GCTCTGGAGATAAATTGGGGAATAAATATGCT TGCTGGTATCAGCAGAAGCCAGGCCAGTCCCC TGTATTGGTCATCTATCAAGATAGGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGACAGCAGCACTGCATTC GGCGGAGGGACCAAGCTGACCGTCCTC<br><br>SEQ ID NO: 27493 | CAGATCACCTTGAAGGAGTCTGGTCCTACGCTGG TGAAACCCACACAGACCCTCACGCTGACCTGCAC CTTCTCTGGGTTCTCACTCAGCACTAGTGGAGTG GGTGTGGGCTGATCCGTCAGCCCCAGGAAAG GCCCTGGAGTGGCTTGCACTCATTATTGGGATG ATGATAAGGCGCTACAGCCATCTCTGAAGAGCA GGCTCACCATCACCGAGGACACCTCAAAAACC AGGTGGTCCTTACAATGACCAACATGGACCCTGT GGACACAGCCACATATTACTGTGCACACCTTATA GCAGTGGCCTTTGACTCCTGGGGCCAGGGAACCC TGGTCACCGTCCTCA<br><br>SEQ ID NO: 31499 |

FIGURE 50
(Continued)

| | | | AA | SYELTQPPSVSVSPGQTANITCSGDKLGNKYAC WYQQKPGQSPVLVIYQDRKRPSGIPERFSGSNSG NTATLTISGTQAMDEADYYCQAWDSSTAFGGG TKLTVL<br>SEQ ID NO: 27494 | QITLKESGPTLVKPTQTLTLTCTFSGFSLSTSGVGVG WIRQPPGKALEWLALIYWDDDKRYSPSLKSRLTITE DTSKNQVVLTMTNMDPVDTATYYCAHLIAVAFDS WGQGTLVTVSS<br>SEQ ID NO: 31500 |
|---|---|---|---|---|---|
| iPS:436856 | 21-225_58C5 | | NA | CAGTCTGTGTTGACCCAGCCGCCCTCAGTGTC TGCGGCCCCAGGACAGAAGGTCACCATCTCCT GCTCTGGAAGCAGTCTCAACATTGGGAATAAT TATGTATCCTGGTACCAGCAGCTCCCAGGAAC AGCCCCAAACTCCTCATTTATGACAATAATA AGCGACCCTCAGGGATTCCTGACCGATTTTCT GGCTCCAAGTCTGGCACGTCAGCCACCCTGGG CATCACCGGACTCCAGAACATGGGATATCAGTCT GATTATTACTGCGAACATGGGGCTCGGCTGCGGCATGGGAGGGGACCAAG GAGTGTTGGGGTATTCGGCGGAGGGACCAAG CTGACCGTCCTA<br>SEQ ID NO: 27495 | GAGGTGCAGTTGGTGGAGTCTGGGGGAGGCCTG GTCAAGCCTGGGGGGGTCCCTGAGACTCTCCTGTG CAGCCTCTGGATTCACCTTCAATAGCTATAGCAT GAACTGGGTCCGCCAGGCTCCAGGGAAGGGCT GGAGTGGATCTCATCCATTAGTAGTAGTAGTTAT TACTTATACTACGCAGACTCAGTGAAGGGCCGAT TCACCATCTCCAGAGACAACAGCGCCAAGAATTCACT GTATCTGCAAATGAACAGCCTGAGAGCCGAGGA CACGGCTGTATATTACTGTGCGAGACTATAGT GGGAGTTTTGACTACTGGGGCCAGGGAACCCTG GTCACCGTCTCCTCA<br>SEQ ID NO: 31501 |
| | | | AA | QSVLTQPPSVSAAPGQKVTISCSGSSSNIGNNYVS WYQQLPGTAPKLLIYDNNKRPSGIPDRFSGSKSG TSATLGITGLQTGDEADYYCGTWDISLSVGVFG GGTKLTVL<br>SEQ ID NO: 27496 | EVQLVESGGGLVKPGGSLRLSCAASGFTFNSYSMN WVRQAPGKGLEWISSISSSSYYLYADSVKGRFTIS RDSAKNSLYLQMNSLRAEDTAVYYCARTYSGSFD YWGQGTLVTVSS<br>SEQ ID NO: 31502 |

FIGURE 50
(Continued)

| | | | |
|---|---|---|---|
| iPS-436858 | 21-225_58E7 | NA | TCCTATGAACTGACTCAGTCACCCTCGGTGTC CGTGTCCCAGGACACAGACAGCCAGCATCACCT GTTCTGGAGATATCAGAGAAGCCAGCATCACCT TGCTGGTATCAGAAGAAGCCAGCCAGTCCCC TGTGCTGGTCATCTATCAAGATAACAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT TCTGTCAGGCGTGGAACAACTACACTGTGGTA TTCGGCGGAGGGACCAAGCTGACCGTCCTA<br><br>SEQ ID NO: 27497 | CAGGTGCAGTTGGTGGAGTCTGGGGGAGGCGTG GTCCAGCCTGGGAGGTCCCTGAGACTCTCCTGTG CAGCCTCTGGATTCACCTTCAGTTTCTATGGCAT GCACTGGGTCCGCCAGGCTCCAGGCAAGGGGCT GGAGTGGGTGGCAGTTACATCATATGATGGAAGT GATAAATACTATGCAGACTCCGTGAAGGGCCGA TTCTCCATCTGCAAATGAGCAGCCTGAGAGCTGAGG TGTATCTGCAAATGAGCAGCCTGAGAGCTGAGG ACACGGCTATGTATTACTGTGCGAGAGATGACTA TGGTTCGGGGAGTCCCTATACTACGGTATGGAC GTCTGGGGCCAAGGGACCACGGTCACCGTCTCCT CA<br><br>SEQ ID NO: 31503 |
| | | AA | SYELTQSPSVSVSPGQTASITCSGDKLGDKYTCW YQKKPGQSPVLVIYQDNKRPSGIPERFSGSNSGN TATLTISGTQAMDEADYFCQAWNNYTVVFGGG TKLTAL<br><br>SEQ ID NO: 27498 | QVQLVESGGGVVQPGRSLRLSCAASGFTFSFYGMH WVRQAPGKGLEWVAVTSYDGSDKYYADSVKGRF SISRDNSKNTLYLQMSSLRAEDTAMYYCARDDYGS GSPLYYGMDVWGQGTTVTVSS<br><br>SEQ ID NO: 31504 |
| iPS-436860 | 21-225_58F7 | NA | TCCTATGAGCTGACTCAGCCACCCTCAGTGTC CGTGTCCCCAGGACACAGACAGCCAGCATCACCT GCTCTGGAGATATCAGCAGAAGCCAGCCAGTCCCC TGTGCTGGTATCATCAAGATATAGGAAGCGGC CCTCAGGGATCCCTGAGGGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGTGGTA TTCGGCGGAGGGACCAAGCTGACCGTCCTA<br><br>SEQ ID NO: 27499 | GAGGTGCAGCTGGTGGAGTCTGGGGGAGGCTTG GTCCAGCCTGGGGGGGTCCCTGAGACTCTCTGTG CAGCCTCTGGATTCACCTTTAGTAGCTTTGGATG AGCTGGGTCCGCCAGGCTCCAGGAAGGGGCTG GAGTGGGTGGCCCACATAAAGCAAGATGGAAGT GAGAAATACTATGTGGACTCTGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGAGGGACCTC CCATACAGCTCGGGCTACTACTACGTATGACG TCTGGGGCCAAGGGACCACGGTCACCGTCTCCTC A<br><br>SEQ ID NO: 31505 |

FIGURE 50
(Continued)

| | | | | |
|---|---|---|---|---|
| iPS:436862 | 21-225_58F8 | AA | SYELTQPPSVSVSPGQTASITCSGDKLGDKYACW YQQKPGQSPVLVIYQDRKRPSGSNSGN TATLTISGTQAMDEADYYCQAWDSSTVVFGGG TKLTVL<br>SEQ ID NO: 27500 | EVQLVESGGGLVQPGGSLRLSCAASGFTFSSFWMS WVRQAPGKGLEWVAHIKQDGSEKYYVDSVKGRF TISRDNAKNSLYLQMNSLRAEDTAVYYCARGDLPY SSGYYYGMDVWGQGTTVTVSS<br>SEQ ID NO: 31506 |
| | | NA | TCCTATGAGCTGACTCAGCCACCCTCAGTGTC CGTGTCCCCAGGACAGACAGCCAGCATCACCT GCTCTGGAGATAAAATTGGGAAATAAATATGCT TGCTGGTATCAGCAGAAGCCAGGCCAGTCCCC TGTACTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTGTGGACAGCAGCACTGTGTA ACTGTCAGGCGTGGGAGGGACCAAACTGACCGTCCTA TTCGGCGGAGGGACCAAGCTGACCGTCCTA<br>SEQ ID NO: 27501 | CAGGTGCAACTGGTGGAGTCTGGGGGAGGCGTG GTCCAGCCTGGGAGGTCCCTGAGACTCTCCTGTG CAGCCTCTGGATTCACCTTCAGTAGCTTCTGGCAT GCACTGGGTCCGCCAGGCTCCAGGCAAGGGGCT GGAGTGGGTGGCACAGTTATATCATCAGATGGAAGT AATAAATACTATGCAGACTCCGTGAAGGGCCGA TTCACCATCTCCAGAGACAATTCCAAGAACACGT TGTATCTGCAAATGAACAGCTGAGAGCTGAGG ACACGGCTGTGTATTACTGTGCGAGAGATGAGGG ACGTGGATATGGTGGCTACGACGTCTGGGGCCAA CTACTACTACTGGTATGGACGTCTGGGGCCAA GGGACCACCGTCACCGTCTCCTCA<br>SEQ ID NO: 31507 |
| | | AA | SYELTQPPSVSVSPGQTASITCSGDKLGNKYACW YQQKPGQSPVLVIYQDSKRPSGSNSGN TATLTISGTQAMDEADYYCQAWDSSTVVFGGG TKLTVL<br>SEQ ID NO: 27502 | QVQLVESGGGVVQPGRSLRLSCAASGFTFSSYGMH WVRQAPGKGLEWVAVISYDGSNKYYADSVKGRFT ISRDNSKNTLYLQMNSLRAEDTAVYYCARDEGRG YGGYERGYYYYYGMDVWGQGTTVTVSS<br>SEQ ID NO: 31508 |

FIGURE 50
(Continued)

| | | | |
|---|---|---|---|
| iPS:436864 | 21-225_58G11 | NA | TCCTATGAGCTGACTCAGCCACCCTCAGTGTC CGTGTCCCCAGGACAGAGCCAGCATCACCT GCTCTGGAGATAAATTGGGGATAAATATGCT TCCTGGTATCAGCAGAAGCCAGGCCAGTCCC TGTGCTGGTCATCTATCAAGATAACAAGCGGC CCTCAGGGATCCCTGAGCGTTCTCTGGCTCC AACTCTGGGAACACAGCCACTCTGACCATCAG CGGGACCCAGGCTATGGATGAGGCTGACTATT ACTGTCAGGCGTGGAACAACAACACTGTAATG TTCGGCGGAGGGACCAAGCTGACCGTCCTA |
| | | | GAGGTGCAGCTGGTGGAATCTGGGGGAGGCTTG GTACAGCCTGGGGGGTCCCTGAGACTCTCCTGTG CAGCCCTGGATTCACCTTCAGTAGCTATAGCAT GAACTGGGTCCGCCAGGCTCCAGGAAGGGCT GGAGTGGATTTCATACATTAGTACTAGTAGT ACCATATTCTACGCAGACTCTGTGAAGGGCCGAT TCACCATCTCCAGAGACAGTGCCAAGAACTCACT GTATCTGCAAATGAACAGCCTGAGAGACGAGGA CACGGCTGTGTATTACTGTGCGAGGGGGATACA GCTATGGTCCTCTACTACTGGTATGGACGTCT GGGGCCAAGGGACCACGGTCACCGTCTCCTCA |
| | | | SEQ ID NO: 27503 |
| | | | SEQ ID NO: 31509 |
| | | AA | SYELTQPPSVSVSPGQTASITCSGDKLGDKYASW YQQKPGQSPVLVIYQDNKRPSGIPERFSGSNSGN TATLTISGTQAMDEADYYCQAWNNNTVMFGGG TKLTVL |
| | | | EVQLVESGGGLVQPGGSLRLSCAASGFTFSSYSMN WVRQAPGKGLEWISYISTSSSTIFYADSVKGRFTISR DSAKNSLYLQMNSLRDEDTAVYYCARGDTAMVL YYYGMDVWGQGTTVTVSS |
| | | | SEQ ID NO: 27504 |
| | | | SEQ ID NO: 31510 |
| iPS:436866 | 21-225_59F2 | NA | TCCTATGAACTGACTCAGCCACCCTCAGTGTC CGTGTCCCCAGGACAGAGCCAGCATCACCT GCTCTGGAGATAAATTGGGGATAAATATGCT TCTTGGTATCAGCAGAAGCCAGGCCAGTCCC TGTGTTGGTCATCTATCAAGATAACAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAACAACACTGTGGTC TTCGGCGGAGGGACCAAGCTGACCGTCCTA |
| | | | GAGGTGCAGCTGGTGGAGTCTGGGGGAGGCTTG GTACAGCCTGGGGGGTCCCTGAGACTCTCCTGTG GAGCCCTGGATTCACCTTCAGTAGCTATAGCAT GAACTGGGTCCGCCAGGCTCCAGGAAGGGACT GGAGTGGGTTTCATACATTAGTGGGAGTAGTAAT ATCATATACTACACAGACTCTGTGAAGGGCCGAT TCACCATCTCCAGAGACAATGCCAAGAACTCACT GTATCTGCAAATGAACAGCCTGAGAGACGAGGA CACGGCTGTGTATTACTGTGCGAGAGCGGATACA CCTATGGTCCTTTACTTCTACGGTATGGACGTCTG GGGCCAAGGGACCACGGTCACCGTCTCCTCA |
| | | | SEQ ID NO: 27505 |
| | | | SEQ ID NO: 31511 |

FIGURE 50
(Continued)

| | | | | |
|---|---|---|---|---|
| iPS:436868 | 21-225_59B11 | AA | SYELTQPPSVSVSPGQTASITCSGDKLGDKYASWYQQRPGQSPVLVIYQDNKRPSGIPERFSGSNSGNTATLTISGTQAMDEADYYCQAWDNNTVFGGGTKLTVL<br>SEQ ID NO: 27506 | EVQLVESGGGLVQPGGSLRLSCGASGFTFSSYSMNWVRQAPGKGLEWVSYISGSSNIYYTDSVKGRFTISRDNAKNSLYLQMNSLRDEDTAVYYCARADTPMVLYFYGMDVWGQGTTVTVSS<br>SEQ ID NO: 31512 |
| | | NA | TCCTATGAGCTGACTCAGCCACCCTCAGTGTCCGTGTCCCCAGGACAGACAGCCAGCATCACCTGCTCTGGAGATAAATTGGGGGATAAATATGCTGCTGGTATCAGCAGAAGCCAGGCCAGTCCCCTGTGCTGGTCATCTATCAAGATAGCAAGCGGCCCTCAGGGATCCTTGAGCGATTCTCTGGCTCCAATTCTGGGAACACAGCCACTCTGACCATCAGCGGAACCCAGGCTATGGATGAGGCTGACTATTACTGTCAGGCGTGGGACAGCAGCACTTATGTGGTATTCGGCGGAGGGACCAAGCTGACCGTCCTA<br>SEQ ID NO: 27507 | CAGGTGCAGCTGGTGGAGTCTGGGGGAGGCGTGGTCCAGCCTGGGAGGTCCCTGAGACTCTCCTGTGCAGCCGTCTGGATTCACCTTCAGTAGTTATGGCGTGCACTGGGTCCGCCAGGCTCCAGGCAAGGGGCTGGAGTGGGTGGCAGCTATATGGTATGATGGAAGTAATAAATACTATGCAGACTCCGTGAAGGGCCGATTCACCATCTCCAGAGACAATTCCAAGAACACGCTGTATCTGCTAATGAACAGCCTGAGAGCCGAGGACACGGCTGTGTATTACTGTGCCAGCTGCCCTTACTACTACTACGGTATGGACGTCTGGGGCCAAGGGACCACGGTCACCGTCTCCTCA<br>SEQ ID NO: 31513 |
| | | AA | SYELTQPPSVSVSPGQTASITCSGDKLGDKYACWYQQKPGQSPVLVIYQDSKRPSGILERFSGSNSGNTATLTISGTQAMDEADYYCQAWDSSTYVFGGGTKLTVL<br>SEQ ID NO: 27508 | QVQLVESGGGVVQPGRSLRLSCAASGFTPSSYGVHWVRQAPCKGLEWVAAIWYDGSNKYYADSVKGRFTISRDNSKNTLYLLMNSLRAEDTAVYYCARDRDYCSSSSCPYYYYGMDVWGQGTTVTVSS<br>SEQ ID NO: 31514 |

FIGURE 50
(Continued)

| | | | |
|---|---|---|---|
| iPS:436870 | 21-225_60B1 | NA | TCCTATGAGCTGACTCAGCCACCCTCAGCGTC<br>CGTGTCCCCAGGACAGACAGCCAGCATCACCT<br>GCTCTGGAGATAAACTGGGGGAAAAATATGCT<br>TGCTGGTATCAGCAGAAGCCAGGCCAGTCCCC<br>TGTGTTGGTCATCTATCAAGATAGGAAGCGGC<br>CCTCAGGGATCCCTGAGCGATTCTCTGGCTCC<br>AATTCTGGGAACACAGCCACTCTGACCATCAG<br>CGGGACCCAGGCTGTGGACAGCAGCACTGTGGTA<br>ACTGTCAGGGCGGTGGGACAGCAGCACTGTGGTA<br>TTCGGCGGAGGGACCAAACTGACCGTCCTA<br><br>SEQ ID NO: 27509<br><br>SYELTQPPSASVSPGQTASITCSGDKLGEKYACW<br>YQQKPGQSPVLVIYQDRKRPSGIPERFSGSNSGN<br>TATLTISGTQAMDEADYYCQAWDSSTVVFGGG<br>TKLTVL<br><br>SEQ ID NO: 27510 | CAGATCACCTTGAAGGAGTCTGGTCCTACGCTGG<br>TGAAACCCACACAGACCCTCACGCTGACCTGCAC<br>CTTCTCTGGGTTCTCACTCAGTACTAGTGGAGTG<br>GGTGTGGGCTGATCGTCAGCCCCAGGAAAG<br>GCCCTGGAGTGGCTTGCACTCATTATTGGCATG<br>AAGATAAGCGCTACAGCCATCTGAAGAGCA<br>GGCTCACCATCACTGAGGACACCTCAAAAACC<br>AGGTGGACCTTACAGCCAACATGGCCCCCTGT<br>GGACACAGCCACATATACTGCACACGTCACA<br>TATATAGCTCCTACTGGGGCCAGGGAACCC<br>TGGTCACCGTCTCCTCA<br><br>SEQ ID NO: 31515<br><br>QITLKESGPTLVKPTQTLTLTCTFSGFSLSTSGVGVG<br>WIRQPPGKALEWLALIYWHEDKRYSPSLKSRLTITE<br>DTSKNQVDLTMTNMAPVDTATYYCAHVTYIAAPY<br>WGQGTLVTVSS<br><br>SEQ ID NO: 31516 |
| iPS:436872 | 21-225_60D2 | NA | TCCTATGAACTGACTCAGCCACCCTCAGTGTC<br>CGTGTCCCCAGGACAGACAGCCAGCATCACCT<br>GCTCTGGAAATAAATTGGGGGATAAATATGCT<br>TCTTGGTATCAGCAGAGGCCAGGCCAGTCCCC<br>TGTATTAGTCATCTATCAAGATAACAAGCGGC<br>CCTCAGGGATCCCTGAGCGATTCTCTGGCTCC<br>AACTCTGAAACACAGCCACTCTGACCATCAG<br>CGGGACCCAGGCTATGGAGGCTGACTATT<br>ACTGTCAGGGCGTGGGACAACAACACTGGTC<br>TTCGGCGGAGGGACCAAGCTGACCGTCCTA<br><br>SEQ ID NO: 27511 | GAGGTGCAGCTGGTGGAGTCTGGGGGAGGCTTG<br>GTACAGCCTGGGGGGTCCCTGAGACTCTCCTGTG<br>GAGCCTCTGGATTCACCTTCAGTAGCTATAGCAT<br>GAACTGGGTCCGCCAGGCTCCAGGAAGGACT<br>GGAGTGGGTTTCATACATTAGTGAGAGTAGTAAT<br>ATCATATACTACACAGACTCTGTGAAGGGCCGAT<br>TCACCATCTCCAGAGACAATGCCATGAACTCACT<br>GTATCTGCAAATGAACAGCTGAGAGACGAGGA<br>CACGGCGTGTATTACTGTGCGAGAGCGGATACA<br>CCTATGGTCCTTTACTTCTACGGTATGGACGTCTG<br>GGGCCAAGGGACCACGGTCACCGTCTCCTCA<br><br>SEQ ID NO: 31517 |

FIGURE 50
(Continued)

| | | | | |
|---|---|---|---|---|
| iPS:436874 | 21-225_60A12 | AA | SYELTQPPSVSVSPGQTASITCSGNKLGDKYASW YQQRPGQSPVLVIYQDNKRPSGIPERFSGSNSGN TATLTISGTQTMDEADYYCQAWDNNTVVFGGG TKLTVL<br>SEQ ID NO: 27512 | EVQLVESGGGLVQPGGSLRLSCGASGFTFSSYSMN WVRQAPGKGLEWVSYISESSNIIYYTDSVKGRFTIS RDNAMNSLYLQMNSLRDEDTAVYYCARADTPMV LYFYGMDVWGQGTTVTVSS<br>SEQ ID NO: 31518 |
| | | NA | TCCTATGAGCTGACTCAGCCACCCTCAGTGTC CGTGTCCCCAGGACAGACAGCCAGCATCACCT GCTCTGGAGATAAAATTGGGAATAAATATGCT TGCTGGTATCAGCAGAGACCCAGGCCAGTCCCC TGTATTGGTCATTTATCAAGATAAGGAAGCGGC CCTCAGGGATCCCTGAGCGATTCTCTGGCTCC AACTCTGGGAACACAGCTATGGATGAGGCTGACTATT CGGGACCCAGGCTATGGGACAGCAGCACTGTTC ACTGTCAGGCGTGGGACCAAGCTGACCGTCCTC GGCGGAGGGACCAAGCTGACCGTCCTC<br>SEQ ID NO: 27513 | CAGATCACCTTGAAGGAGTCTGGTCCTACGCTGG TGAAACCCACAGAACCCTCACGTCACGCTGCAC CTTCTCTGGGTTCTCACTCAGCACTACTAGTGGAGTG GGTGTGGGCTGGATCCGTCAGCCCCCAGGAAAG GCCCTGGAGTGGCTTGCACTCATTTATTGGGATG ATGATAAGCGCTACAGCCCATCTCTGAAGAGCA GGCTCACCATCACCGAGGACACCTCCAAAAACC AGGTGGTCCTTACAATGACCAACATGGACCCTGT GGACACAGCCACATATTACTGTGCACACCTTATA GCAGTGGCCTTTGACTCCTGGGGCCAGGGAACCC TGGTCACCGTCTCCTCA<br>SEQ ID NO: 31519 |
| | | AA | SYELTQPPSVSVSPGQTASITCSGNKLGDKYAC WYQQKPGQSPVLVIYQDRKRPSGIPERFSGSNSG NTAILTISGTQAMDEADYYCQAWDSSTAFGGGT KLTVL<br>SEQ ID NO: 27514 | QITLKESGPTLVKPTQTLTLTCTFSGFSLSTSGVGVG WIRQPPGKALEWLALIYWDDDKRYSPSLKSRLTITE DTSKNQVLTMTNMDPVDTATYYCAHLIAVAFDS WGQGTLVTVSS<br>SEQ ID NO: 31520 |

FIGURE 50
(Continued)

| | | | |
|---|---|---|---|
| iPS:436876 | 21-225_61F5 | NA | TCCTATGAGCTGACTCAGCCACCCTCAGTGTC CGTGTCCCCAGGACAGACAGCCAGCATCACCT GCTCTGGAGATAAATTGGGGGAAAAATATGCT TGCTGGTATCAGCAGAAGCCAGGCCAGTCCCC TGTGTTGGTCATCTATCAAGATAGCAAGCGGC CCTCAGGGATCCCTGAGCGATTCTCTGGCTCC AATTCTGGGAACACAGCCACTCTGACCATCAG CGGGACCCAGGCTATGGATGAGGCTGACTATT ACTGTCAGGCGTGGGACAGCAGCACTGTGGTT TTCGGCGGAGGGACCAAACTGACCGTCCTA<br><br>SEQ ID NO: 27515 | CAGATCACCTTGAAGGAGTCTGGTCCTACGCTGG TGAAACCCACACAGACCCTCACGCTGACCTGCAC CTTCTCTGGGTTCTCACTCAGTACTAGTGGGTTGG GTGTGGGCTGGATCCGTCAGCCCCCAGGAAAGG CCCTGAGTGGCTTGCACTCATTTATTCACATGA AGATAAGGCTACAGCCCATCTGAAGAGCAG GCTCACCATCACTGAGGACACCTCCAAAAACCA GGTGGACCTTACAATGACCAATGCCCCTGTG GACACAGCCACATATTACTGTGCACACGTCACAG GTATAGCAGCTCCTACTGGGGCCAGGGAACCCT GGTCACCGTCTCCTCA<br><br>SEQ ID NO: 31521 |
| | | AA | SYELTQPPSVSVSPGQTASITCSGDKLGEKYACW YQQKPGQSPVLVIYQDSKRPSGIPERFSGSNSGN TATLTISGTQAMDEADYYCQAWDSSTVFGGG TKLTVL<br><br>SEQ ID NO: 27516 | QITLKESGPTLVKPTQTLTLTCTFSGFSLSTSGLGVG WIRQPPGKALEWLALIYSHEDKRYSPSLKSRLTITE DTSKNQVDLTMTNMAPVDTATYYCAHVTGIAAPY WGQGTLVTVSS<br><br>SEQ ID NO: 31522 |
| iPS:436878 | 21-225_62E3 | NA | TCCTATGACCTGACTCAGCCACCCTCAGTGTC CGTGTCCCCAGGACAGACAGCCAGCATCACCT GCTCTGGAGATAAATTGGGGAATAAATATGCT TGCTGGTATCAGCAGAAGCCAGGCCAGTCCCC TGTGGTGGTCATCTATCAAGATAGGAAGCGGC CCTCAGGGATCCCTGAGCGATTCTCTGGCTCC AATTCTGGGAACACAGCCACTCTGACCATCAG CGGGACCCAGGCTATGGATGAGGCTGACTATT ACTGTCAGGCGTGGGACAGCAGCACTGCGGTA TTCGGCGGAGGGACCAAGCTGACCGTCCTA<br><br>SEQ ID NO: 27517 | CAGATCACCTTGAAGGAGTCTGGTCCTACGCTGG TGAAACCCACACAGACCCTCACGCTGACCTGCAC CTTCTCTGGGTTCTCGCTCAGCACTAGTGGAGTG GGTGTGGGCTGGATCCGTCAGCCCCCAGGAAAG GCCCTGAGTGGCTTGCACTCATTAATTGGAATG ATGATAAGGCTACAGCCCATCTGAAGAGCA GGTTCACCATCACCAGGGACACCTCCAAAGACC AGGTGGTCCTTACAATGACCAACATGGACCCGTGT GGACACAGCCACATATTACTGTGCACATAAAGCT ACCTGGGTGGCTTTGATATCTGGGGCCAAGATAAGGA CAATGGTCACCGTCTCTTCA<br><br>SEQ ID NO: 31523 |

FIGURE 50
(Continued)

| | | | | |
|---|---|---|---|---|
| iPS:436880 | 21-225_62E8 | AA | SYDLTQPPSVSVSPGQTASITCSGDKLGNKYAC WYQQKPGQSPVVVIYQDRKRPSGIPERFSGSNSG NTATLTISGTQAMDEADYYCQAWDSSTAVFGG GTKLTVL<br>SEQ ID NO: 27518 | QITLKESGPTLVKPTQTLTLTCTFSGFSLSTSGVGVG WIRQPPGKALEWLALINWNDDKRYSPSLKSRFTITR DTSKDQVVLTMTNMDPVDTATYYCAHKATWVAF DIWGQGTMVTVSS<br>SEQ ID NO: 31524 |
| | | NA | TCCTATGACCTGACTCAGCCACCCTCAGTGTC CGTGTCCCCAGGACAGACAGCCAGCATCACCT GCTCTGGAGATAGATTGGGGAATAAATATGCT TCCTGGTATCAGCAGAAGCCAGGCCAGTCCCC TGTGGTGGTCATCTATCAGGATAGGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCCTGGGACAGCAGCACTGCGGTA TTCGGCGGAGGGACCAAGCTGACCGTCCTA<br>SEQ ID NO: 27519 | CAGATCACCTTGAAGGAGTCTGGTCCTACGCTGG TGAAACCACACAGACCCTCACGCTGACCTGTAC CTTCTCTGGTTCTCACTCAGCACTAGTGGAGTG GGTTGGGCTGGATCCGTCAGCCCCAGGAAAG GCCCTGAGTGGCTGCACTCATTAATTGGAATG ATGATAAGCGCTACAGCCCATCTGAAGAGCA GGTTCACCATCACCAGGGACACCTCCAAGACC AGTGGTCCTTACAATACTGTGCACATAAAGCT ACCTGGGTGGCTTTTGATATCTGGGGCCAAGGGA CAATGGTCACCGTCTCTTCA<br>SEQ ID NO: 31525 |
| | | AA | SYDLTQPPSVSVSPGQTASITCSGDRLGNKYASW YQQKPGQSPVVVIYQDRKRPSGIPERFSGSNSGN TATLTISGTQAMDEADYYCQAWDSSTAVFGGG TKLTVL<br>SEQ ID NO: 27520 | QITLKESGPTLVKPTQTLTLTCTFSGFSLSTSGVGVG WIRQPPGKALEWLALINWNDDKRYSPSLKSRFTITR DTSKDQVVLTMTNMDPVDTATYYCAHKATWVAF DIWGQGTMVTVSS<br>SEQ ID NO: 31526 |

FIGURE 50
(Continued)

| | | | |
|---|---|---|---|
| iPS:436882 | 21-225_62D10 | NA | TCCTATGACCTGACTCAGCCACCCTCAGTGTC CGTGTCCCCAGGACAGACAGCCAGCATCACCT GCTCTGGAGATAAATTGGGAATAAATATGCT TGCTGGTATCAGCAGAAGCCAGGCCAGTCCC TGTGGTGGTCATCTATCAAGATAGGAAGCGGC CCTCAGGGATCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGCGGTA TTCGGGCGGAGGGACCAAGTCTGACCGTCCTA<br><br>SEQ ID NO: 27521 | CAGATCACCTTGAAGGAGTCTGGTCCTACGCTGG TGAAATCCACAGAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGGCTTGCACTCATTAATTGGAATG ATGATAAGCGCTACAGCCCATCTCTGAAGAGCA GGTTCACCATCACCAGGGACACCTCAAAGACC AGGGTGTCTTACAATGACCAACATGGACCCTGT GGACACAGCCACATATTACTGTGCACATAAAGCT ACCTGGGTGGCTTTTGATATCTGGGGCCAAGGGA CAATGGTCACCGTCTCTTCA<br><br>SEQ ID NO: 31527 |
| | | AA | SYDLTQPPSVSVSPGQTASITCSGDKLGNKYAC WYQQKPGQSPVVVIYQDRKRPSGIPERFSGSNSG NTATLTISGTQAMDEADYYCQAWDSSTAVFGG GTKLTVL<br><br>SEQ ID NO: 27522 | QITLKESGPTLVKSTQTLTLTCTFSGFSLSTSGVGVG WIRQPPGKALEWLALINWNDDKRYSPSLKSRFTITR DTSKDQVLTMTNMDPVDTATYYCAHKATWVAF DIWGQGTMVTVSS<br><br>SEQ ID NO: 31528 |
| iPS:436884 | 21-225_62A12 | NA | TCCTATGACCTGACTCAGCCACCCTCAGTGTC CGTGTCCCCAGGACAGACAGCCAGCATCACCT GCTCTGGAGATAAATTGGGAATAAATATGCT TGCTGGTATCAGCAGAAGCCAGGCCAGTCCC TGTGGTGGTCATCTATCAAGATAGGAAGCGGC CCTCAGGGATCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGCGGTA TTCGGGCGGAGGGACCAAGTCTGACCGTCCTA<br><br>SEQ ID NO: 27523 | CAGATCACCTTGAAGGAGTCTGGTCCTACGCTGG TGAAACCACAGAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGGCTTGCACTCATTAATTGGAATG ATGATAAACGCTACAGCCCATCTCTGAAGAGCA GGTTCACCATCACCAGGGACACCTCAAAGACC AGGGTGTCTTACAATGACCAACATGGACCCTCT GGACACAGCCACATATTACTGTGCACATAAAACT ACCTGGGTGGCTTTTGATATCTGGGGCCAAGGGA CAATGGTCACCGTCTCTTCA<br><br>SEQ ID NO: 31529 |

FIGURE 50
(Continued)

| | | | | |
|---|---|---|---|---|
| iPS:436886 | 21-225_62B12 | AA | SYDLTQPPSVSVSPGQTASITCSGDKLGNKYAC WYQQKPGQSPVVVIYQDRKRPSGIPERFSGSNSG NTATLTISGTQAMDEADYYCQAWDSSTAVFGG GTKLTVL | QITLKESGPTLVKPTQTLTLTCTFSGFSLSTSGVGVG WIRQPPGKALEWLALINWNDDKRYSPSLKSRFTITR DTSKDQVVLTMTNMDPLDTATYYCAHKTTWVAF DIWGQGTMVTVSS |
| | | | SEQ ID NO: 27524 | SEQ ID NO: 31530 |
| | | NA | TCCTATGACCTGACTCAGCCACCCTCAGTGTC CGTGTCCCCAGGACAGACAGCCAGCATCACCT GCTCTGGAGATAAATTGGGGAATAAATATACT TGCTGGTATCAGCAGAAGCCAGGCCAGTCCCC TGTGGTGGTCATCTATCAAGATAGGAAGCGGC CCTCAGGGATCCTGAGCGATTCTCTGGCTCC AATTCTGGGAACACAGCCACTCTGACTATCAG CGGGACCCAGGCTATGGGACAGCAGCACTGCGGTA ACTGTCAGGCGTGGGACCAAGCTGACCGTCCTA TTCGGCGGAGGGACCAAGCTGACCGTCCTA | CAGATCACCTTGAAGGAGTCTGGTCCTACGCTGG TGAAACCCACACAGACCCTCACGCTGACCTGCAC CTTCTCTGGGTTCTCACTCAACACTAGTGGAGTG GGTGTGGGCTGGATCCGTCAGCCCCCAGGAAAG GCCCTGGAGTGGCTTGCACTCATTAATTGGAATG ATGATAAGCGCTACAGCCCGTCTCTGAAGAGCA GGTTCACCATCACCAGGGACACCTCCAAAGACC AGGTGGTCCTTACAATGACCAATGGACCCTGT GGACACAGCCACATATTACTGTGCACATAAAGCT ACCTGGGTGGCTTTTGATATCTGGGGCCAAGGGA CAATGGTCACCGTCTCTTCA |
| | | | SEQ ID NO: 27525 | SEQ ID NO: 31531 |
| | | AA | SYDLTQPPSVSVSPGQTASITCSGDKLGNKYTCW YQQKPGQSPVVVIYQDRKRPSGIPERFSGSNSGN TATLTISGTQAMDEADYYCQAWDSSTAVFGGG TKLTVL | QITLKESGPTLVKPTQTLTLTCTFSGFSLNTSGVGVG WIRQPPGKALEWLALINWNDDKRYSPSLKSRFTITR DTSKDQVVLTMTNMDPVDTATYYCAHKATWVAF DIWGQGTMVTVSS |
| | | | SEQ ID NO: 27526 | SEQ ID NO: 31532 |

FIGURE 50
(Continued)

| | | | |
|---|---|---|---|
| iPS-436888 | 21-225_63G7 | NA | AATTTTATGCTGACTCAGCCCCACTCTGTGTCG GAGTCTCCGGGGAAGACGGTAACCATCTCCTG CACCCGCAGCAGTGGCAGCATTGTCAGCAACT ATGTGCAGTGGTACCAGCAGCGCCCGGGCAGT TCCCCACCACTATGATCTATGAGGATAGCCG TCCTCATCGACAGCTCTCCAACTCGTCCTCC GCTCCATCGACAGCTCTGGACTGAAGACTGAGGACGA GGCTGACTACTCCTGTCAGTCTTATGATGGCA TCAATGTGGTATTCGGCGGAGGGACCAAGCTG ACCGTCCTA SEQ ID NO: 27527 | GAGGTGCAGCTGGTGGAGTCTGGGGGAGGCTTG GTACAGCCTGGGGGGTCCCTGAGACTCTCCTGTG CAGCCTCTGGATTCACCTTCAGTAGCTATAGCAT GAACTGGGTCCGCCAGGCTCCGGGAAGGGCT GGAGTGGGTTTCATACATTAGTAGTAGTACTAGT ACCATATACTACGCAGCCTCTGTGAAGGGCCGAT TCACCATCTCCAGAGACAATGCCAAGAACTCACT GTATCTGCAAATGAACAGCCTGAGAGACGAGGA CACGGCTGTGTATTACTGTGCGAGAGATCACCGT TACTATGATAGTAGTGGTTATTACTCTGATGCTTT TGATATCTGGGGCCAAGGGACAATGGTCACCGTC TCTTCA SEQ ID NO: 31533 |
| | | AA | NFMLTQPHSVSESPGKTVTISCTRSNGSIVSNYV QWYQQRPGSSPTTMIYEDSRRPSGVPDRFSGSID SSSNSASLTISGLKTEDEADYSCQSYDGINVVFG GGTKLTVL SEQ ID NO: 27528 | EVQLVESGGGLVQPGGSLRLSCAASGFTFSSYSMN WVRQAPGKGLEWVSYISSSTSTIYYAASVKGRFTIS RDNAKNSLYLQMNSLRDEDTAVYYCARDHRYYD SSGYYSDAFDIWGQGTMVTVSS SEQ ID NO: 31534 |
| iPS-436890 | 21-225_63A10 | NA | AATTTTATGCTGACTCAGCCCCACTCTGTGTCG GAGTCTCCGGGGAAGACGGTAACCATCTCCTG CACCCGCAGCAGTGGCAGCATTGTCAGCAACT ATGTGCAGTGGTACCAGCAGCGCCCGGGCAGT TCCCCACCACTGTATCTATGAGGATAAAAG AAGACCCTCAGGGGTCCCTGATCGGTTCTCTG GCTCCATCGACAGCTCTCCAACTCGTCCTCC CTCACCATCTCTGGACTGAAGACTGAGGACGA GGCTGACTACTCCTGTCAGTCTTATGATAGCA TCAATGTGGTATTCGGCGGAGGGACCAAGCTG ACCGTCCTA SEQ ID NO: 27529 | GAGGTGCAGCTGGTGGAGTCTGGGGGAGGCTTG GTACAGCCTGGGGGGTCCCTGAGACTCTCCTGTG CAGCCTCTGATTCACCTTCAGTAGCTATAGCAT GAACTGGGTCCGCCAGGCTCCGGGAAGGGCT GGAGTGGGTTTCATACATTAGTAGTAGTACTAGT ACCATATACTACGCAGCCTCTGTGAAGGGCCGAT TCACCATCTCCAGAGACAATGCCAAGAATTCACT GTATCTGCAAATGAACAGCCTGAGAGACGAGGA CACGGCTGTGTATTACTGTGCGAGAGATCACCGT TACTATGATAGTAGTGGTTATTACTCTGATGCTTT TGATATCTGGGGCCAAGGGACAATGGTCACCGTC TCTTCA SEQ ID NO: 31535 |

FIGURE 50
(Continued)

| | | | |
|---|---|---|---|
| iPS:436892 | 21-225_65E9 | AA | NFMLTQPHSVSESPGKTVTISCTRSNGSIVSNYV QWYQQRPGSSPTTVIYEDKRRPSGVPDRFSGSID SSSNSASLTISGLKTEDEADYYCQSYDSINVVFG GGTKLTVL SEQ ID NO: 27530 | EVQLVESGGGLVQPGGSLRLSCAASGFTFSSYSMN WVRQAPGKGLEWVSYISSSTSTIYYAASVKGRFTIS RDNAKNSLYLQMNSLRDEDTAVYYCARDHRYYD SSGYYSDAFDIWGQGTMVTVSS SEQ ID NO: 31536 |
| | | NA | TCCTATGAGCTGACTCAGCCACCCTCAGTGTC CGTGTCCCCAGGACAGACAGCCAGCATCACCT GCTCTGGAGATAAATTGGGGATAAATATGAT TACTGGTATCAGCAGAAGCCAGGCCAGTCCCC TGTGCTGGTCATCTATCAAGATAGAAAGCGGC CCTCAGGGATCCTGAGCGATTCTCTGGCTCC AACTCTGGAACACAGCCACCCTGACCATCAG CGGGACCCAGGCTATGGATGAGGCTGACTATT ACTGTCAGGCGTGGGACAACAGCACTGTGGTA TTCGGCGGAGGGACCAAACTGACCGTCCTA SEQ ID NO: 27531 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACCCTAACAGTGG TGGCACAAATTATGCACAGAAGTTCAGGCAG GGTCACCATGACCAGGGACACGTCCATCAGCAC AGCTACATGGAGCTGAGCAGGCTGAGATCTGA CGACACGGCCGTGTATTACTGTGCGAGAGCGTAT TATTATGGTTCGGGGAGTTATTATAATGAATTTG ATATGTGGGGCCAAGGGACAATGGTCACCGTCTC TTCA SEQ ID NO: 31537 |
| | | AA | SYELTQPPSVSVSPGQTASITCSGDKLGNKYDY WYQQKPGQSPVLVIYQDRKRPSGIPERFSGSNSG NTATLTISGTQAMDEADYYCQAWDNSTVVFGG GTKLTVL SEQ ID NO: 27532 | QVQLVQSGAEVKKPGASVKVSCKASGYTFTGYYM HWVRQAPGQGLEWMGWINPNSGGTNYAQKFQGR VTMTRDTSISTAYMELSRLRSDDTAVYYCARAYYY GSGSYYNEFDMWGQGTMVTVSS SEQ ID NO: 31538 |

FIGURE 50
(Continued)

| | | | |
|---|---|---|---|
| iPS:436894 | 21-225_66G9 | NA | TCCTATGAACTGACTCAGCCACCCTCAGTGAC<br>CGTGTCCCCAGGACAGACAGCCAGCATCACCT<br>GCTCTGGAGATAAATTGGGAATAAATATGCT<br>TGCTGGTATCAGCAGAAGCCAGGCCAGTCCCC<br>TGTGTGGTGTCATCTATCAAGATAGGAAGCGGC<br>CCTCAGGGATCCCTGAGCGATTCTCTGGCTCC<br>AACTCTGGGAACACAGCCACTCTGACCATCAG<br>CGGGACCCAGGCTATGGATGAGGCTGACTATT<br>ACTGTCAGGCGTGGGACATCAACACTGCGGTA<br>TTCGGCGGAGGGACCAAGCTGACCGTCCTA | CAGATCACCTTGAAGGAGTCGTCCTACGCTGG<br>TGAAACCCACACAGACCCTCACGCTGACTGCAC<br>CTTCTCTGGTTCTCACTCAGCACTAGTGAGTG<br>GGTGTGGCTGGATCCGTCAGCCCCCAGGAAAG<br>GCCCTGAGTGGCTTGCACTCATTAATTGGAATG<br>ATGATAAGCGCTTCAGCCATCTGAAGAGCAG<br>GTTCACCATCACCAGGGACACCTCAAAGACCA<br>GGTGGTCCTTACAATGACCAACATGGACCCTGTG<br>GACACAGCCACATATTACTGTGCACATAAAGCTA<br>CCTGGGTGGCTTTTGATATCTGGGGCCAAGGGAC<br>AATGGTCACCGTCTCTCA |
| | | | SEQ ID NO: 27533 | SEQ ID NO: 31539 |
| | | AA | SYDLTQPPSVTVSPGQTASITCSGDKLGNKYAC<br>WYQQKPGQSPVVVIYQDRKRPSGIPERFSGSNSG<br>NTATLTISGTQAMDEADYYCQAWDINTAVFGG<br>GTKLTVL | QIITLKESGPTLVKPTQTLTLTCTFSGFSLSTSGVGVG<br>WIRQPPGKALEWLALINWNDDKRFSPSLKSRFTITR<br>DTSKDQVVLTMTNMDPVDTATYYCAHKATWVAF<br>DIWGQGTMVTVSS |
| | | | SEQ ID NO: 27534 | SEQ ID NO: 31540 |
| iPS:436896 | 21-225_67F10 | NA | TCCTATGAACTGACTCAGCCACCCTCAGTTTCC<br>GTGTCCCCAGGACAGACAGCCAGCATCACCTG<br>CTCTGGAGATAAATTGGGGTATAAATATGCTT<br>GGTGGTATCAGCAGAAGCCAGGCCAGTCCCCT<br>GTGCTGTCATCTTTGAAGATAGGAAGCGGCC<br>CTCAGGGATCCCTGAGCGATTCTCTGGCTCCA<br>ACTCTGGGAACACAGCCACTCTGACCATCAGC<br>GGGACCCAGGCTATGGATGAGGCTGACTATTA<br>CTGTCAGGCGTGGGACAACAGCACTGTGGTAT<br>TCGGCGGAGGGACCAAGGCTGACCGTCCTA | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTATA<br>TGCACTGGGTGCGACAGGCCCCTGGACAAGGC<br>TTGAGTGGATGGGATGGATCAACCTAACAGTGG<br>TGGCACAAACTATGGACAGAAGTTTCAGGGCAG<br>GGTCACCATGACCAGGGACACGTCCATCAGCAC<br>AGCCTACATGGAGCTGAGCAGGCTGAGATCTGA<br>CGACACGGCCGTATATTACTGTGCGAGAACGTAT<br>TTCTATGGTTCGGGGAGTTATTATAACGGTTTG<br>ACTACTGGGGCCAGGGAACCCTGGTCACCGTCTC<br>CTCA |
| | | | SEQ ID NO: 27535 | SEQ ID NO: 31541 |

FIGURE 50
(Continued)

| | | | | |
|---|---|---|---|---|
| iPS:436898 | 21-225_68D8 | AA | SYELTQPPSVSVSPGQTASITCSGDKLGYKYAW WYQQKPGQSPVLVIFEDRKRPSGIPERFSGSNSG NTATLTISGTQAMDEADYYCQAWDNSTVVFGG GTRLTVL<br><br>SEQ ID NO: 27536 | QVQLVQSGAEVKKPGASVKVSCKASGYTFTGYYM HWVRQAPGQGLEWMGWINPNSGGTNYGQKFQGR VTMTRDTSISTAYMELSRLRSDDTAVYYCARTYFY GSGSYYNGFDYWGQGTLVTVSS<br><br>SEQ ID NO: 31542 |
| | | NA | TCCTATGAGCTGACTCAGCCACCCTCAGTGTC CGTGTCCCCAGGACAGACAGCCAGCATCACCT GCTCTGGAGATAAATTGGGGGATAAATATGCT TGCTGGTATCAGCAGAAGCCAGGCCAGTCCCC TGTGTTGGTCATCTATCAAGATAGCAAGCGGC CCCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAACAGCACTGTGGTA TTCGGCGGAGGGACCAAGCTGACCGTCCTA<br><br>SEQ ID NO: 27537 | CAGGTACAGCTGCAGCAGTCAGGTCCAGGACTG GTGAAGCCCTCGCAGACCCTCACTCAGGTCTGTG CCATCTCCGGGGACAGTGTCTCTAGCAACAGTGC TGCTTGGAACTGGATCAGGCAGTCCCCATCGAGA GGCCTTGAGTGGCTGGGAAGGACATACTACAGG TCCGAGTGCTATAATGATTATGCAGTATCTGTGC AGAGTGCGAATAACCATCAACCAGACACATCCA AGAACCAGTTCTCCCTGCACCTGAACTCTGTGAC TCCCGAGGACACGGCTGTGTATTTCTGTGCAAGA GATAGAGGGCATAGAGGGTTCTACGGTATGGAC GTCTGGGGCCAAGGGACCACGGTCACCGTCTCCT CA<br><br>SEQ ID NO: 31543 |
| | | AA | SYELTQPPSVSVSPGQTASITCSGDKLGDKYACW YQQKPGQSPVLVIYQDSKRPSGIPERFSGSNSGN TATLTISGTQAMDEADYYCQAWDNSTVVFGGG TKLTVL<br><br>SEQ ID NO: 27538 | QVQLQQSGPGLVKPSQTLSLTCAISGDSVSSNSAA WNWIRQSPSRGLEWLGRTYYRSECYNDYAVSVQS RITINPDTSKNQFSLHLNSVTPEDTAVYFCARDRGH RGFYGMDVWGQGTTVTVSS<br><br>SEQ ID NO: 31544 |

FIGURE 50
(Continued)

| | | | | |
|---|---|---|---|---|
| iPS:436900 | 21-225_69B9 | NA | TCCTATGAGCTGACTCAGCCACCCTCAGTGTC CGTGTCCCCAGGACAGACAGCCAGCATCACCT GCTCTGGAGATAAATTGGGGATAAATATGAT TACTGGTATCAGCAGAAGCCAGGCCAGTCCCC TGTGCTGGTCATCTATCAAGATAGAAAGCGGC CCTCAGGGATCCCTGAGCGATTCTCTGGCTCC AACTCTGGGAACACAGCCACCCTGACCATCAG CGGGACCCAGGCTATGGATGAGGCTGACTATT ACTGTCAGGCGTGGGACAACAGCACTGTGGTA TTCGGCGGAGGGACCAAACTGACCGTCCTA<br><br>SEQ ID NO: 27539 | CAGGTGCAGATGGTGCAGTCTGGGATGAGGTG AAGAAGCCTGGGGCCTCAGTGAAGGTCTCGTGC AAGGCTTCGGATACACCTTCACCGGCTACCATA TGCACTGGGTGCGACAGGCCCCTGGACAAGGGC TTGAGTGGATGGGATGGATCAACCTAACAGTGG TGGCACAAATTATGCACAGAAGTTTCAGGGCAG GGTCACCATGACCAGGGACACGTCCATCAGCAC AGCCTACATGGAGCTGAGCAGGATGAGATCTGA CGACACGGCCGTGTATTACTGTGCGAGAGCGTAT TATTATGGTTCGGGGAGTTATTATAATGAATCTG ATATGTGGGGCCAAGGGACAATGGTCACCGTCTC TTCA<br><br>SEQ ID NO: 31545 |
| | | AA | SYELTQPPSVSVSPGQTASITCSGDKLGNKYDY WYQQKPGQSPVLVIYQDRKRPSGIPERFSGSNSG NTATLTISGTQAMDEADYYCQAWDNSTVVFGG GTKLTVL<br><br>SEQ ID NO: 27540 | QVQMVQSGDEVKKPGASVKVSCKASGYTFTGYH MHWVRQAPGQGLEWMGWINPNSGGTNYAQKFQ GRVTMTRDTSISTAYMELSRMRSDDTAVYYCARA YYYGSGSYYNESDMWGQGTMVTVSS<br><br>SEQ ID NO: 31546 |
| iPS:436902 | 21-225_69B11 | NA | TCCTATGAGCTGACTCAGCCACCCTCAGTGTC CGTGTCCCCAGGACAGACAGCCAGCATCACCT GCTCTGGAGATAAATTGGGGATAAATATGCT TGGTGGTATCAGCAGAAGCCAGGCCAGTCCCC TGTGCTGGTCATCTATGAAGATAGGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAACAGCACTGTGGTA TTCGGCGGAGGGACCAAGCTGACCGTCCTA<br><br>SEQ ID NO: 27541 | CAGGTGCAGCTGGTGCAGTCCGGGCTGAGGTG AAGAAGCCTGGGGCCTCAGTGAGGGTCTCCTGC AAGGCTTCTGGATACACCTTCACCGGCTACTATA TGCACTGGGTGCGACAGGCCCCTGGACAAGGGC TTGAGTGGATGGGATGGATCAACCTAACAGTGG TGGCACAAACTATGACACAGGACACGTCATCAGC GGTCACCATGACCAGGGACACGTCCATCAGCAC AGCCTTCATGGAGCTGAGCAGGCTGAGATCTGAC GACACGGCCGCATATTACTGTGCGAGAACGTATT ACTATGGTCGGGGAGTTATTATAACGGCTTTGA CTACTGGGGCCAGGGAACCCTGGTCACCGTCTCC TCA<br><br>SEQ ID NO: 31547 |

FIGURE 50
(Continued)

| | | | | |
|---|---|---|---|---|
| iPS:436904 | 21-225_71D4 | AA | SYELTQPPSVSVSPGQAASITCSGDKLGDKYAW WYQQKPGQSPVLVIYEDRKRPSGIPERFSGSNSG NTATLTISGTQAMDEADYYCQAWDNSTVFGG GTKLTVL | QVQLVQSGAEVKKPGASVRVSCKASGYTFTGYYM HWVRQAPCQGLEWMGWINPNSGGTNYGQKFQDR VTMTRDTSISTAFMELSRLRSDDTAAYYCARTYYY GSGSYYNGFDYWGQGTLVTVSS |
| | | | SEQ ID NO: 27542 | SEQ ID NO: 31548 |
| | | NA | TCCTATGAGCTGACTCAGCCACCCTCAGTGTC CGTGTCTCCAGGACAGAGCCAGCATCACCT GCTCTGGAGATAAATTGGGGGATAAATATGCT TACTGGTATCAGCAGAAACCAGGCCAGTCCCC TGTGGTGGTCATCTATCAAGATAGGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGGTGGGTCAACAGCACTGTGGTA TTCGGCGGAGGGACCAAGCTGACCGTCCTA | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTGTA TGCACTGGGTGCGACAGGCCCCTGGACAAGGGC TTGAGTGGATGGGATGGATCAACCCTAACAGTGG TGGCACAAACTATGCACAGAAGTTTCAGGTCAG GGTCACCATGACCAGGGACACGTCCGTCAGCAC AGTCTACATGGACCTGAGCAGGCTGAGATCTGAC GACACGGCCGTGTATTACTGTGCGAGAGCGTATT ACTATGGTTCGGGACTTATCATAACGAATTTGA CTACTGGGGCCAGGGAAGTTGGTCACCGTCTCC TCA |
| | | | SEQ ID NO: 27543 | SEQ ID NO: 31549 |
| | | AA | SYELTQPPSVSVSPGQTASITCSGDKLGDKYAY WYQQKPGQSPVVVIYQDRKRPSGIPERFSGSNSG NTATLTISGTQAMDEADYYCQAWVNSTVFGG GTKLTVL | QVQLVQSGAEVKKPGASVKVSCKASGYTFTGYCM HWVRQAPCQGLEWMGWINPNSGGTNYAQKFQVR VTMTRDTSVSTVYMDLSRLRSDDTAVYYCARAYY YGSGTYHNEFDYWGQGSLVTVSS |
| | | | SEQ ID NO: 27544 | SEQ ID NO: 31550 |

FIGURE 50
(Continued)

| | | | |
|---|---|---|---|
| iPS:436906 | 21-225_72B4 | NA | TCCTATGAGCTGACTCAGCCACCCTCAGTGTC CGTGTCCCCAGGACAGACAGCCAGCATCACCT GCTCTGGAGATAAATTGGGGATAAATATGCT TGGTGGTATCAGCAGAGGCCAGGCCAGTCCCC TGTGCTGGTCATCTATGAAGATAGGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAACAGCACTGTGGTA TTCGGCGGAGGGACCAAGCTGACCGTCCTA<br><br>SEQ ID NO: 27545 |
| | | AA | SYELTQPPSVSVSPGQTASITCSGDKLGDKYAW WYQQRPGQSPVLVIYEDRKRPSGIPERFSGSNSG NTATLTISGTQAMDEADYYCQAWDNSTVFGG GTKLTVL<br><br>SEQ ID NO: 27546 | CAGGTGCAGCTGGTGCAGTCTGGGGCTGAGGTG AAGAAGCCTGGGGCCTCAGTGAAGGTCCTGC AAGGCTTCTGGATACACCTTCACCGGCTACTATA TGCACTGGGTGCGACAGGCCCCTGGACAAGGGC TTGAGTGGATGGGATGGATCAACCCTAACAGTGG TGGCACAAACTATGCACAGAAGTTTCAGGGCAG GGTCACCATGACCAGGGACACGTCCATCAGCAC AGCCTACATGGAGCTGAGCAGGCTGAGATCTGA CGACACGGCCGTATATTACTGTGCGAGAACGTAT TACTATGGTTCGGGGAGTTATTATAACGGCTTTG ACTACTGGGGCCAGGGAACCCTGGTCACCGTCTC CTCA<br><br>SEQ ID NO: 31551 |
| | | | QVQLVQSGAEVKKPGASVKVSCKASGYTFTGYYM HWVRQAPGQGLEWMGWINPNSGGTNYGQKFQGR VTMTRDTSISTAYMELSRLRSDDTAVYYCARTYY GSGSYYNGFDYWGQGTLVTVSS<br><br>SEQ ID NO: 31552 |
| iPS:436908 | 21-225_72D5 | NA | TCCTATGACCTGACTCAGCCACCCTCAGTGTC CGTGTCCCCAGGACAGACAGCCAGCATCACCT GCTCTGGAGATAAATTGGGGATAAATATGCT TGCTGGTATCAGCAGAAGCCAGGCCAGTCCCC TGTGGTGGTCATCTATCAAGATAGGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGCGGTA TTCGGCGGAGGGACCAAGCTGACCGTCCTA<br><br>SEQ ID NO: 27547 | CAGATCACCTTGAAGGAGTCTGGTCCTACGCTGG TGAAACCCACACAGACCCTCACGCTGACCTGCAC CTTCTCTGGGTTCTCACTCAGCACTAGTGGAGTG GGTGTGGGCTGGATCCGTCAGCCCCAGGAAAG GCCCTGGAGTGCTTGCACTCATTAATTGGAATG ATGATAAGCGCTACAGCCCATCTGAAGAGCA GGTTCACCATCACCAGGGACACCTCCAAAGACC AGGTGGTCTTTACAATGACCAACATGGACCCTGT GGACACAGGCACATATTACTGTGCACATAAAGCT ACCTGGGTGGCTTTTGATATCTGGGGCCAAGGGA CAATGGTCACCGTCTCTTCA<br><br>SEQ ID NO: 31553 |

FIGURE 50
(Continued)

| | | AA | SYDLTQPPSVSVSPGQTASITCSGDKLGNKYAC WYQQKPGQSPVVVIYQDRKRPSGIPERFSGSNSG NTATLTISGTQAMDEADYCQAWDSSTAVFGG GTKLTVL<br><br>SEQ ID NO: 27548 | QITLKESGPTLVKPTQTLTLTCTFSGFSLSTSGVVG WIRQPPGKALEWLALINWNDDKRYSPSLKSRFTITR DTSKDQVVFTMTNMDPVDTGTYYCAHKATWVAF DIWGQGTMVTVSS<br><br>SEQ ID NO: 31554 |
|---|---|---|---|---|
| iPS:436910 | 21-225_73G1 | NA | CAGACTGTGGTGACCCAGGAGCCATCGTTCTC AGTGTCCCCTGGAGGGACAGTCACACTCACTT GTGGCTTGAGCTCTGGCTCAGTCTCTACTAGTT ACTACCCCAGGTGTACCAGCAGACCCAGGC CAGGCTCCACGCACGCTCATCTACAACACAAA CACTCGCTCTTCTGGGGTCCCTGATCGTTCTC TGGCTCCATCCTTGGGAACAAAGCTGCCCTCA CCATCACGGGGCCCAGGCAGATGATGGGTAGCC GATTATTACTGTGTTCTATATATGGGTAGTGCC ATTTGGGTGTTCGGCGGAGGGACCAAGTTGAC CGTCCTA<br><br>SEQ ID NO: 27549 | CAGGTGCAGCTGGTGGAGTCTGGGGGAGGCGTG GTCCAGCCTGGGAGGTCCCTGAGACTCTCCTGTG CAGGCACTGGATTCACCTTCAGTTACTATGGCAT GCACTGGGTCCGCCAGGCTCCAGGCAAGGGGCT GGAGTGGGTGGCAGTTACAACATATGATGAAG TAATAAATACTATGCAGACTCCGTGAAGGGCCG ATTCACCAGCTCCAGAGACAATTCCAAGAACAC GCTGTATCTGCAAATGAATAGCCTGAGAGCTGAG GACACGGCTGTGTATCACTGTGCGAGAGAGACT GGAACTGGGCTTTTGATATCTGGGGCCAAGGGA CAATGGTCACCGTCTCTTTA<br><br>SEQ ID NO: 31555 |
| | | AA | QTVVTQEPSFSVSPGGTVTLTCGLSSGSVSTSYY PSWYQQTPGQAPRTLIYNTNTRSSGVPDRFSGSI LGNKAALTITGAQADDESDYYCVLYMGSAIWV FGGGTKLTVL<br><br>SEQ ID NO: 27550 | QVQLVESGGGVVQPGRSLRLSCAGTGFTFSYYGM HWVRQAPGKGLEWVAVTTYDGSNKYYADSVKGR FTSSRDNSKNTLYLQMNSLRAEDTAVYHCARETGT WAFDIWGQGTMVTVSL<br><br>SEQ ID NO: 31556 |

FIGURE 50
(Continued)

| | | | |
|---|---|---|---|
| iPS-436912 | 21-225_73C4 | NA | TCCTATGAGCTGACTCAGCCACCCTCAGTGTC CGTGTCCCCAGGACAGACAGCCAGCATCACCT GCTCTGGAGATAAAATTGGGGAATAAATATGCT TGCTGGTATCAGCAGAAGCCAGGCCAGTCCCC TGTGGTGGTCATCTATCAAGATATGAAGCGGC CCTCAGGGATCCCTGAGCGATTCTCTGGCTCC AACTCTGGGAACACAGCCACTCTGACCATCAG CGGGACCCAGGCTATGGATGAGCAGCTGACT ACTGTCAGGCGTGGACAGCAGCACTGCGGTA TTCGGCGGAGGGACCAAGCTGACCGTCCTA<br><br>SEQ ID NO: 27551 | CAGATCACCTTGAAGGAGTCTGGTCCTACGCTGG TGAAACCCACACAGAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGGCTTGCACTCATTAATTGGAATG ATGATAAGCGCTACAGCCCATCTCTGAAGAGCA GGTTCACCATCACCAGGGACACTCCAAAGACC AGGTGGTCCTTACAATGACCAACATGACCCTGT GGACACAGCCACATATTACTGTGCACATAAAACT ACCTGGGTGGCTTTTGATATCTGGGGCCAAGGGA CAATGGTCACCGTCTCTTCA<br><br>SEQ ID NO: 31557 |
| | | AA | SYDLTQPPSVSVSPGQTASITCSGDKLGNKYAC WYQQKPGQSPVVVIYQDMKRPSGIPERFSGSNS GNTATLTISGTQAMDEADYYCQAWDSSTAVFG GGTKLTVL<br><br>SEQ ID NO: 27552 | QITLKESGPTLVKPTQTLTLTCTFSGFSLSTSGVGVG WIRQPPGKALEWLALINWNDDKRYSPSLKSRFTITR DTSKDQVVLTMTNMDPVDTATYYCAHKTTWVAF DIWGQGTMVTVSS<br><br>SEQ ID NO: 31558 |
| iPS-436914 | 21-225_76B4 | NA | CCCTATGAGCTGAATCAGACACCCTCAGTGTC CGTGTCCCCAGGACAGACAGCCAGCATCACCT GCTCTGGAGATAGATTGGGGACTAAATTTGCT TGCTGGTATCAGCAGAAGCCAGGCCAGTCCCC TGTGCTGGTCGGTCATTTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGCAGCTGACTATT ACTGTCAGGCGTGGGACAGCAGCACTGTATTC GGCGGAGGGACCAAGCTGACCGTCCTA<br><br>SEQ ID NO: 27553 | CAGATCACCTTGAAGGAGTCTGGTCCTACGCTGG TGAAACCCACACAGAGACCCTCACGCTGACCTGCAC CTTCTCTGGGTTCTCACTCAGCACTGGTGGAGTG GGTGTGGGCTGGATCCGTCAGCCCCCAGGAAAG GCCCTGGAGTGGCTTGCACTCATTATTGGGATG ATGATAAGCGCTACAGCCCATCTCTGAAGAGCA GGCTCACCATCACCAAGGACACCCCAAAAACC AGGTGGTCCTTACAATGACCAACATGACCCTGT GGACACAGCCACATATTACTGTGCACACCTTATA GCAGTGGCCTTTGACTACTGGGGCCAGGGAACCC TGGTCACCGTCTCCTCA<br><br>SEQ ID NO: 31559 |

FIGURE 50
(Continued)

| | | | | |
|---|---|---|---|---|
| iPS:436916 | 21-225_74A9 | AA | PYELNQTPSVSVSPGQTASITCSGDRLGTKFACW YQQKPGQSPVLVIYQDSKRPSGIPERFSGSNSGN TATLTISGTQAMDEADYYCQAWDSSTVFGGGT KLTVL<br><br>SEQ ID NO: 27554 | QITLKESGPTLVKPTQTLTLTCTFSGFSLSTGGVGVG WIRQPPGKALEWLALIYWDDDKRYSPSLKSRLTIT KDTPKNQVVLTMTNMDPVDTATYYCAHLIAVAFD YWGQGTLVTVSS<br><br>SEQ ID NO: 31560 |
| | | NA | TCCTATGAGCTGACTCAGCCACCCTCAGTGTC CGTGTCCCCAGGACAGCAGCCAGCATCACCT GCTCTGGAGATAAATTGGGTAATAAATATGTT TGTTGGTATCAGCAGAAGCCAGGCCAGTCCCC TGTGCTGGTCATCTATCAAGATAACAGGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGTCTGTGATA TTCGGCGGAGGGACCAAACTGACCGTCCTA<br><br>SEQ ID NO: 27555 | CAGGTGCAACTGGTGGAGTCTGGGGGAGGCGTG GTCCAGCCTGGGAGGTCCCTGAGACTCTCTGTG CAGCGTCTGGATTCACCTTCAGTAGCTATGCAT GCACTGGGTCCGCCAGGCTCCAGGCAAGGGCT GGAGTGGGTGGCAGTTATATGGTATGATGGAAAT AATAAATCCTATGCAGACTCCGTGAAGGGCCGAT TCACCATCTCCAGAGACAATTCCAAGAACACGCT GTTTCTGCAAATGAACAGCCTGAGAGCCGATGAC ACGGCTGTGTATTACTGTGCGAGAGATCGAGATT ATTGTAGTGGTACCAGCTGCCCTTATTATTACTAC TACGGTATGGACGTCTGGGGCCAAGGGACCACG GTCACCGTCTCCTCA<br><br>SEQ ID NO: 31561 |
| | | AA | SYELTQPPSVSVSPGQTASITCSGDKLGNKYVCW YQQKPGQSPVLVIYQDNRRPSGIPERFSGSNSGN TATLTISGTQAMDEADYYCQAWDSSPVIFGGGT KLTVL<br><br>SEQ ID NO: 27556 | QVQLVESGGGVVQPGRSLRLSCAASGFTFSSYGMH WVRQAPGKGLEWVAVIWYDGNNKSYADSVKGRF TISRDISKNTLFLQMNSLRADDTAVYYCARDRDYC SGTSCPYYYYGMDVWGQGTTVTVSS<br><br>SEQ ID NO: 31562 |

FIGURE 50
(Continued)

| | | | |
|---|---|---|---|
| iPS:436918 | 21-225_77A2 | NA | TCCTATGAGCTGACTCAGCCACCCTCAGTGTCCGTGTCCCCAGGACAGACAGCCAGCATCACCTGCTCTGGAGATAGATTGGGGATAAATATGCTTGCTGGTATCAGCAGAAGCCAGGCCAGTCCCCTGTACTGGTCATCTATCAAGATAGGAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTACTGTCAGGCGTGGGACAGCAGTACTGCGGTATTCGGCGGAGGGACCAAGCTGACCGTCCTA SEQ ID NO: 27557 | CAGATCACCTTGAAGGAGTCTGGTCCTTCGCTGGTGAAACCCACACAGACCCTCACGCTGACCTGCACCTTCTCTGGGTTCTCACTCAGCACTAGTGGAGTGGGTGTGGGCTGGATCCGTCAGCCCCCAGGAAAGGCCCTGGAGTGGCTTGTATTCATTTATTGGGATGATGATAAGCGCTACAGCCCATCTGAAGAGCAGGCTCACCATCAAGGACACCTCCAAAAACCAGGTGGTCTTACAATGACAACATGGACCCTGTGGACACAGCCACATATTACTGTGCACACTTATAGCAGTGGCCTTTGACTGGGGCCAGGGAACCCTGGTCACCGTCTCCTCA SEQ ID NO: 31563 |
| | | AA | SYELTQPPSVSVSPGQTASITCSGDRLGDKYACWYQQKPGQSPVLVIYQDRKRPSGIPERFSGSNSGNTATLTISGTQAMDEADYYCQAWDSSTAVFGGGTKLTVL SEQ ID NO: 27558 | QITLKESGPSLVKPTQTLTLTCTFSGFSLSTSGVGVGWIRQPPGKALEWLVFIYWDDDKRYSPSLKSRLTITKDTSKNQVVLTMTNMDPVDTATYYCAHLIAVAFDYWGQGTLVTVSS SEQ ID NO: 31564 |
| iPS:436920 | 21-225_74E5 | NA | CAGACTGTGGTGACTCAGGAGCCCTCACTGACTGTGTCCCCAGGAGGGACAGTCACTCACCTGTGCTTCCAGCACTGAAACAGTCACCAGTGGTTCTTATCCGAACTGGTTCCAGCAGAAACCTGGACAAGCACCCAGGGCACTGATTTATAGTACAACGCAACAAACACTCCTGGACCCTGCCCGGTTCTCAGGCTCCCTCCTTGGGGGCAAAGTGCCCTGACACTGTCAGATGTGCAGCCTGAGGACGAGGCTGAGTATTACTGCCTGCTCTACTATGGTGGTGCTCAACTGGTATTCGGCGGAGGGACCAAGCTGACCGTCCTA SEQ ID NO: 27559 | CAGGTGCAGCTGCAGGAGTCGGGCCCAGGACTGGTGAAGCCTTCACAGACCCTGTCCTCACCTGCACTGTCTCTGGTGGCTCCATCAGAAGTGGTTACCTACTGAGCTGGATCCGCCAGCACCCAGGGAAGGGCCTGGAGTGGATTGGATATATCTATTACAGTGGGAGCACCTACTACAACCCGTCCCTCAGGAGTCGAGTTCCATATCAGTAGACACGTCTAAGAACCAGTTCTCCCTGAAGCTGAGCTCTGTGACTGCCGCGGACACGGCCGTGTATTACTGTGCGAGAGATTCACCAGTGGCTGGTACTGACTACTGGGGCCAGGGAACCCTGGTCACCGTCTCCTCA SEQ ID NO: 31565 |

FIGURE 50
(Continued)

| | | | | |
|---|---|---|---|---|
| iPS:436922 | 21-225_78E9 | AA | QTVVTQEPSLTVSPGGTVTLTCASSTETVTSGSYPNWFQQKPGQAPRALIYSTSNKHSWTPARFSGSLLGGKAALTLSDVQPEDEAEYYCLLYYGGAQLVFGGGTKLTVL<br>SEQ ID NO: 27560 | QVQLQESGPGLVKPSQTLSLTCTVSGGSIRSGGYYWSWIRQHPGKGLEWIGYIYYSGSTYYNPSLRSRASISVDTSKNQFSLKLSSVTAADTAVYYCARDSPVAGTDYWGQGTLVTVSS<br>SEQ ID NO: 31566 |
| | | NA | TCTTATGAGTTGACTCAGCCACCCTCAGAGTCTGTGTCCCCAGGACAGACAGCCAGCATCACGTGCTCAGGAGATAAATTGGGGATAAATATGTTTCCTGGTATCAGCAGAAGCCAGGCCAGTCCCCTGTGCTGGTCATCTATGCAAGATAACAGGCGGCCGTCAGGGATCCCTGAGCGATTTTCTGGCTCCAACTCTGGGAGCACAGCCACTTGGATGAGGCTGACTATTACTGTGTCAGGGCGTGGGACAGCAGCCCTGTGATAACTGTCAGGCGTGGGACCAAGCTGACCGTCCTA<br>SEQ ID NO: 27561 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGGTATGATGGAAATAATAAATCCTATGCAGACTCCGTGAAGGGCCGATTCACCATCTCCAGAGACAACAGCCTGAGAGCCGAGGATACTGCAAATGAACAGCCTGAGAGAGGGATCGAGATCACGGCTGTGTATTACTGTGCGAGGGATCGAGATTATTGTAGTAGTACCAGCTGCCCTTATTATTACTACTACGGTATGGACGTCTGGGGCCAAGGGACCACGGTCACCGTCTCCTCA<br>SEQ ID NO: 31567 |
| | | AA | SYELTQPPSESVSPGQTASITCSGDKLGNKYVSWYQQKPGQSPVLVIYQDNRPSGIPERFSGSNSGSTATLTISGTQAMDEADYYCQAWDSSPVIFGGGTKLTVL<br>SEQ ID NO: 27562 | QVQLVESGGGVVQPGRSLRLSCAASGFTFSSYGMHWVRQAPGKGLEWVAVIWYDGNNKSYADSVKGRFTISRDISKNTLYLQMNSLRAEDTAVYYCARDRDYCSSTSCPYYYYGMDVWGQGTTVTVSS<br>SEQ ID NO: 31568 |

FIGURE 50
(Continued)

| | | | |
|---|---|---|---|
| iPS:436924 | 21-225_74B3 | NA | TCCTATGAGCTGACTCAGCCACCCTCAGTGTC CGTGTCCCCAGGACAGAGACAGCAGCATCACCT GCTCTGGAGATAAATTGGGGATAAATATGCT TGCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCACCAAGTGACCGTCCTA TTCGGCGGAGGGACCAAGCTGACCGTCCTA CAGGTGCAGCTGGTGGAGTCTGGGGGAGGCGTG GTCCAGCCTGGGAGGTCCCTGAGACTCTCCTGTG CAGCGTCGGGATTCACCTTCAGTCAGTCGATATGGCAT GCACTGGGTCCGCCAGGCTCCAGGCAAGGGCT GGAGTGGGTGGCAGTTTTTGGTATGATGGAAGT AATAAAGACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCAGAGATCGAGA TTATTGTAGTAGTACCAGCTGCCCTTACTACTACT ACTACGGTATGGACGTCTGGGGCCAAGGGACCA CGGTCACCGTCTCCTCA |
| | | | SEQ ID NO: 31569 |
| | | SEQ ID NO: 27563 | |
| | | AA | SYELTQPPSVSVSPGQTASITCSGDKLGDKYACW YQQKPGQSPVLVIYQDSKRPSGIPERFSGSNSGN TATLTISGTQAMDEADYYCQAWDSTTVFGGG TKLTVL | QVQLVESGGGVVQPGRSLRLSCAASGFTFSRYGMH WVRQAPGKGLEWVAVFWYDGSNKDYADSVKGRF TISRDNSKNTLYLQMNSLRAEDTAVYYCARDRDY CSSTSCPYYYYGMDVWGQGTTVTVSS |
| | | | SEQ ID NO: 31570 |
| | | SEQ ID NO: 27564 | |

FIGURE 50
(Continued)

| | | | |
|---|---|---|---|
| iPS:436926 | 21-225_78D10 | NA | CAGACTGTGGTGACTCAGGAGCCCTCACTGAC TGTGTCCCCAGGAGGGACAGTCACTCTCACCT GTGCTTCCAGCACTGGAGCAGTCACCAGTGGT TACTTTCCAAACTGGTTCCAGCAGAAACCTGG ACAAGCACCCAGGGCACTGATTTATAGTACAG ACAACAAACACTCCTGGACCCCTGCCCGGTTC TCAGGCTCCCTCCTTGGGGCAAAGCTGCCT GACACTGTCAGGTGTGCAGCTGAGGACGAG GCTGAGTATTACTGCCTCTCTACTATGGTGGT GCTCAGCTGATGTTCGGCGGAGGGACCAAGCT GACCGTCCTA<br><br>SEQ ID NO: 27565 | CAGGTGCAGCTGCAGGAGTCGGGCCCAGGACTG GTGAAGCCTTCACAGACCCTGTCCCTCACTGCA CTGTCTGTGGCTCATCAGCAGTGTGGTTA CTACTGGAGCTGGATCCGCCAGCACCCAGGGAA GGGCCTGGAGTGGATTGGGTACATCTATTACATT ACAACCCGTCCCTCAAGAGTC GAGTTACCATATCAGTAGACACGTCTAAGAACCA GTTCTCCCTGAAGCTGAGCTCTGTGACTGCCGCG GACACGGCCGTGTACTACTGTGCGAGAGATGCCC CCGACTTCGGTATGGACGTCTGGGGCCAAGGGA CCACGGTCACCGTCTCCTCA<br><br>SEQ ID NO: 31571 |
| | | AA | QTVVTQEPSLTVSPGGTVTLTCASSTGAVTSGYF PNWFQQKPGQAPRALIYSTDNKHSWTPARFSGS LLGGKAALTLSGVQPEDEAEYYCLLYYGGAQL MFGGGTKLTVL<br><br>SEQ ID NO: 27566 | QVQLQESGPGLVKPSQTLSLTCTVSGGSISSGYYW SWIRQHPGKGLEWIGYIYYIGSVYYNPSLKSRVTIS VDTSKNQFSLKLSSVTAADTAVYYCARDAPDFGM DVWGQGTTVTVSS<br><br>SEQ ID NO: 31572 |
| iPS:436928 | 21-225_79E7 | NA | TCCTATGAGCTGACTCAGCCACCCTCAGTGTC CGTGTCCCCAGGACAGAGCCAGCCATCACCT GCTCAGGAGATAAATTGGGGAATAAATATGTT TCCTGGTATCAGCAGAAGCCAGGCCAGTCCCC TGTGCTGGTCATCTATCAAGATAACAGGCGGC CCCTCAGGGATCCCTGAGCGATTCTCTGGCTCC AACTCTGGGAACACAGCCACTCTGACCATCAG CGGACCCAGGCGTGGGACAGCAGCCCTGACTATT ACTGTCAGGCGGAGGGACCAAGCTGACCGTCCTA TTCGGCGGAGGGACCAAGCTGACCGTCCTA<br><br>SEQ ID NO: 27567 | CAGGTGCAGCTGGTGGAGTCTGGGGGAGGCGTG GTCCAGCCTGGGAGGTCCCTGAGACTCTCTGTG CAGGGTCTGGATTCACCTTCAGTAGCTATGGCAT GCACTGGGTCCGCCAGGCTCCAGGCAAGGGGCT GGAGTGGGTGGCAGTTATATGGTATGATGGAAAT AATAAATCTATGCAGACTCCGTGAAGGGCCGAT TCACCATCTCCAGAGACAATTCAAAAACACGCT GTATCTGCAAATGAACAGCCTGAGAGCCGAGGA CAGGGCTGTGTATTACTGTGCGAGGGATGCGAT TATTGTAGTAGTACCAGCTGCCTTATTATTACTA CTACGGTATGGACGTCTGGGGCCAAGGGACCAC GGTCACCGTCTCCTCA<br><br>SEQ ID NO: 31573 |

FIGURE 50
(Continued)

| | | AA | SYELTQPPSVSVSPGQTASITCSGDKLGNKYVSW YQQKPGQSPVLVIYQDNRRPSGIPERFSGSNSGS TATLTISGTQAMDEADYYCQAWDSSPVIFGGGT KLTVL | QVQLVESGGGVVQPGRSLRLSCAASGFTFSSYGMH WVRQAPGKGLEWVAVIWYDGNNKSYADSVKGRF TISRDISKNTLYLQMNSLRAEDTAVYYCARDRDYC SSTSCPYYYYGMDVWGQGTTVTVSS |
| | | | SEQ ID NO: 27568 | SEQ ID NO: 31574 |
| iPS:436932 | 21-225_92A4 | NA | TCCTATGAGCTGACTCAGCCACCCTCAGTGTC CGTGTCCCCAGGACAGACAGCCAACATCACCT GCTCTGGAGATAAATTGGGAATAAATATGTT TGCTGGTATCAACAGAAGCCAGGCCAGTCCCC TGTGTTGGTCATCTATCAAGATAACAGGCGGC CCTCAGGGATCCCTGAGCGATTCTCTGGCTCC AACTCTGGGAACACAGCCACTCTGACCATCAG CGGGACCCAGGCTGTGGACAGCAGCCCTGTGATA ACTGTCAGGCGTGGGACCAAGCTGACCGTCCTA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGGAAAT AATAAAATCTATACAGACTCCGTGAAGGGCCGAT TCACCATCTACAGAGACATTCCAAGAACACGCT GTATCTGCAAATGAACAGCCTGAGAGCCGAGGA CACGGCTGTGTATTACTGTGCGAGAGATCGAGAT TATTGTAGTAGTACCAGCTGCCCTTATTATTACTA CTACGGTATGGACGTCTGGGGCCAAGGGACCAC GGTCACCGTCTCCTCA |
| | | | SEQ ID NO: 27569 | SEQ ID NO: 31575 |
| | | AA | SYELTQPPSVSVSPGQTANITCSGDKLGNKYVC WYQQKPGQSPVLVIYQDNRRPSGSNSG NTATLTISGTQAMDEADYYCQAWDSSPVIFGGG TKLTVL | QVQLVESGGGVVQPGRSLRLSCAASGFTFSSYGMH WVRQAPGKGLEWVAVIWYDGNNKSYADSVKGRF TIYRDISKNTLYLQMNSLRAEDTAVYYCARDRDYC SSTSCPYYYYGMDVWGQGTTVTVSS |
| | | | SEQ ID NO: 27570 | SEQ ID NO: 31576 |

FIGURE 50
(Continued)

| | | | |
|---|---|---|---|
| iPS:436934 | 21-225_96B5 | NA | CCCTATGAGCTGAATCAGACACCCTCAGTGTC CGTGTCCCAGGACAGAGCCAGCATCACCT GCTCTGGAGATAGCAGCAGGACTAAATTTGCT TGCTGGTATCAGCAGAAGCCAGGCCAGTCCCC TGTGCTGGTCATTTATCAAGATAGCAAGCGGC CCTCAGGGATCCCTGAGGGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGTATTC GGCGGAGGGACCAAGCTGACCGTCCTA SEQ ID NO: 27571 | CAGATCACCTTGAAGGAGAGTCTGGTCCTACGCTGG TGAAACCCACACAGACCCTCACGCTGACCTGCAC CTTCTCTGGTTCTCACTCAGCACTGTGGAGTG GGTGTGGGCTGGATCCGTCAGCCCCCAGGAAAG GCCCTGGAGTGGCTTGCACTCATTTATTGGATG ATGATAAGCGCTACAGCCCATCTCTGAAGAGCA GGCTCACCATCACCAAGGACACCCCCAAAAACC AGGTGTCCTTACAATGACCAACATGGACCCTGT GGACACAGCCACATATTACTGTGCACACCTTATA GCAGTGGCCTGTGACTACTGGGGCCAGGGAACC CTGGTCACCGTCTCCTCA SEQ ID NO: 31577 |
| | | AA | PYELNQTPSVSVSPGQTASITCSGDRLGTKFACW YQQKPGQSPVLVIYQDSKRPSGIPERFSGSNSGN TATLTISGTQAMDEADYYCQAWDSSTVFGGGT KLTVL SEQ ID NO: 27572 | QITLKESGPTLVKPTQTLTLTCTFSGFSLSTGGVGVG WIRQPPGKALEWLALIYWDDDKRYSPSLKSRLTIT KDTPKNQVVLTMTNMDPVDTATYYCAHLIAVACD YWGQGTLVTVSS SEQ ID NO: 31578 |
| iPS:436936 | 21-225_97E6 | NA | TCCTATGAGCTGACTCAGCCACCCTCAGTGTC TGTGTCCCAGGACAGACAGTCAGCATCACCT GCTCTGGAGATAAATTGGGGATAAATATGTT TCCTGGTATCAGCAGAAGCCAGGCCAGTCCCC TGTGCTGGTCATCTATCAAGATAACAGGCGGC CGTCAGGGATCCCTGAGCGATTCTCTGGCTCC AACTCTGGGACACAGCCACTCTGACCATCAG CGGGACCCAGGCTGTGGACAGCACCCCTGTATA ACTGTCAGGCGTGGGACCGAGGACACCTGACGCCCTGTGATA TTCGGCGGAGGGACCAAGCTGACCGTCCTA SEQ ID NO: 27573 | CAGGTGCAGCTGGTGCAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGAAAT AATAAATCTATGCAGAGACATTTCAAAAACACGCT GTATCTGCAAATGAACAGCCTGAGAGCCGAGGA CACGGCTGTGTATTACTGTGCGAGGGATGAGAT TATTGTAGTAGTACCAGCTGCCCTTATTATTACTA CTACGGTATGGACGTCTGGGGCCAAGGGACCAC GGTCACCGTCTCCTCA SEQ ID NO: 31579 |

FIGURE 50
(Continued)

| | | | |
|---|---|---|---|
| iPS:436938 | 21-225_146A3 | AA | SYELTQPPSVSVSPGQTVSITCSGDKLGNKYVSW YQQKPGQSPVLVIYQDNRRPSGIPERFSGSNSGS TATLTISGTQAMDEADYYCQAWDSTPVIFGGGT KLTVL<br>SEQ ID NO: 27574 | QVQLVESGGGVVQPGRSLRLSCAASGFTFSSYGMH WVRQAPGKGLEWVAVIWYDGNNKSYADSVKGRF TISRDISKNTLYLQMNSLRAEDTAVYYCARDRDYC SSTSCPYYYYGMDVWGQGTTVTVSS<br>SEQ ID NO: 31580 |
| | | NA | TCCTATGCGATGACTCAGCCACCCTCAATGTC CGTGTCCCCAGGACAGACAGCCAGCATCACCT GCTCTGGAAATAAAATTGGGAATAGATATGCT TGCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACATAGCCACTCTGACCATCAG CGGGACCCAGGCTATGGAGGCTGAGGCTGATATT ACTGTCAGGCGTGGGACAGCAGCACTGTGGTA TTCGGCGGAGGGACCAAGCTGACCGTCCTA<br>SEQ ID NO: 27575 | GAGGTGCAGCTGTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTGGTGGTGGTACT ACCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCACTGACTACGGTATGGACGTCTGGGG CCAAGGGACCACGGTCACCGTCCTCA<br>SEQ ID NO: 31581 |
| | | AA | SYAMTQPPSMSVSPGQTASITCSGNKLGNRYAC WYQQKPGQSPVLVIYQDSKRPSGIPERFSGSNSG NIATLTISGTQAMDEADYYCQAWDSSTVVFGGG TKLTVL<br>SEQ ID NO: 27576 | EVQLLESGGGLVQPGGSLRLSCAASGFTFSSYAMS WVRQAPGKGLEWVSVISGGGTTTYADSVKGRFTI SRDNSKNTLYLQMNSLRAEDTAVYYCAKWRGNPT DYGMDVWGQGTTVTVSS<br>SEQ ID NO: 31582 |

FIGURE 50
(Continued)

| | | NA | TCCTATGAGCTGACTCAGCCACCCTCAGTGTC CGTGTCCCCAGGACAGCAGCAGCATCACCT GCTCTGGAGATAAATTGGGGGATAAATATGTT TGCTGGTATCAGCAGAAGCCAGGCCAGTCCCC TGTGTTGGTCATCTATCAAGATAGGAAGCGGC CCTCAGGGATCCCTGAGCGATTCTCTGGCTCC AACTCTGGGAACACAGCCACTCTGACCATCAG CGGGACCCAGGCTGTGGCACAGCAGCACTGTGGTA ACTGTCAGGCGTGGCACAGCAGCACTGTGGTA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGGCGTCTGGATTCACCTTCAGTACCTATGGCAT GCACTGGGTCCGCCAGGCTCCAGGCAAGGGGCT GGAGTGGGTGGCAGTTGTATGGTATGGTGGAAAT GATAAAGACTTTGCAGACTCCGTGACGGCCGAT TCACCATCTCCAGAGACATTTCCAAGAACACACT GTATCTGCAAATGAACAGCCTGAGAGCCGAGGA CACGGCTGTGTATTACTGTGCGAGAGATCGGGAT TATTGTAGTGGTGGTAGCTGCCCTTACTACTACT ACTACGGTATGGACGTCTGGGGCCAAGGGACCA CGGTCACCGTCTCCTCA |
|---|---|---|---|---|
| iPS:436940 | 21-225_146B8 | | SEQ ID NO: 27577 | SEQ ID NO: 31583 |
| | | AA | SYELTQPPSVSVSPGQTASITCSGDKLGDKYVCW YQQKPGQSPVLVIYQDRKRPSGIPERFSGSNSGN TATLTISGTQAMDEADYYCQAWHSSTVVFGGG TKLTVL | QVQLVESGGGVVQPGRSLRLSCAASGFTFSTYGMH WVRQAPGKGLEWVAVVWYGGNDKDFADSVTGR FTISRDISKNTLYLQMNSLRAEDTAVYYCARDRDY CSGGSCPYYYYGMDVWGQGTTVTVSS |
| | | | SEQ ID NO: 27578 | SEQ ID NO: 31584 |

FIGURE 50
(Continued)

| | | | |
|---|---|---|---|
| iPS:436942 | 21-225_146H8 | NA | CAGGTGCAGCTGGTGCAGTCTGGGGCTGAGGTG |
| | | | AAGAAGCCTGGGGCCTCAGTGAAGGTCTCCTGC |
| | | | AAGGCTTCTGGATACACCTTCATCAGTTATGATA |
| | | | TCAATTGGGTGCGACAGGCCACTGGACAAGGGC |
| | | | TTGAGTGGATGGGATGGATGAACCCTAACAGTG |
| | | | GTAACACAGGCTATGCACAGAAGTTCCAGGGCA |
| | | | GAGTCACCATGACCAGGAACACCTCCAAAAGCA |
| | | | CAGCCTACATGGAGCTGAGCAGCCTGAGATCTG |
| | | | AGGACACGGCCGTGTATTACTGTGCGAGAGGAG |
| | | | ATTATTACTATGATAGTAGTGGTCACCAGCCTTA |
| | | | CTACTACTACTACGGTATGGACGTCTGGGGCCAA |
| | | | GGGACCACGGTCACCGTCTCCTCA |
| | | | SEQ ID NO: 31585 |
| | | AA | QVQLVQSGAEVKKPGASVKVSCKASGYTFISYDIN |
| | | | WVRQATGQGLEWMGWMNPNSGNTGYAQKFQGR |
| | | | VTMTRNTSKSTAYMELSSLRSEDTAVYYCARGDY |
| | | | YDSSGHQPYYYYYGMDVWGQGTTVTVSS |
| | | | SEQ ID NO: 31586 |

| | | | |
|---|---|---|---|
| | | | TCCTATGAGCTGACTCAGCCACCCTCAGTGTC |
| | | | CGTGTCCCAGGACAGCAGCAGCATCACCT |
| | | | GCTCTGGAGATAAAATTGGGGGATAAGGCCACCT |
| | | | TGCTGGTATCAGCAGAAGCCAGGCCAGTCCCC |
| | | | TGTGCTGGTCATCTATCAAGATAAGAAGCGGC |
| | | | CCTCAGGGATCCCTGAGCGATTCTCTGGCTCC |
| | | | AACTCTGGGAACACAGCCACTCTGACCATCAG |
| | | | CGGGACCCAGGTTATGGATGAGGCTGACTATT |
| | | | ACTGTCAGGCGTGGGACATCAGAACTGTGGTA |
| | | | TTCGGCGGAGGGACCAAGCTGACCGTCCTA |
| | | | SEQ ID NO: 27579 |
| | | | SYELTQPPSVSVSPGQTASITCSGDKLGDKYACW |
| | | | YQQKPGQSPVLVIYQDKKRPSGIPERFSGSNSGN |
| | | | TATLTISGTQVMDEADYYCQAWDIRTVFGGGT |
| | | | KLTVL |
| | | | SEQ ID NO: 27580 |

FIGURE 50
(Continued)

| | | | |
|---|---|---|---|
| iPS:436944 | 21-225_182D12 | NA | TCCTATGAGCTGACTCAGCCACCCTCAGTGTC CGTGTCCCAGGACAGCAGCCAGCATCACCT GCTCTGGAGATAAATTGGGGGAGAAATATGCT TGCTGGTATCAGCAGAAGTCAGGCCAGTCCCC TGTGTTGGTCATCTATCAAGATAGAAAGCGGC CCCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGGTGGGACAGTAGAACTGCGGTA TTCGGCGGAGGGACCAAGCTGACCGTCCTA | CAGATCACCTTGAAGGAGTCTGGTCCTACGCTGG TGAAACCCACACAGCCCCTCACGCTGACCTGTAC CTTCTCTGGGTTCTCACTCAGCACTACTGGAGTG GGTGTGGGCTGATCCGTCAGCCCCCAGGAAAG GCCCTGGAGTGGCTTGGAATCCTTTTTGGAATG ATGATGAGGCTACAGCCACCATCTGAAGAGCA GGCTCACCATCACCAAGGACACCTCCAAAAAC AGTGGTCCTTACAATGACCAACATGACCCTGT GGACACAGCCACATATTACTTTGACTACTGGGGCCAGGGAA CAGCTCGTCTACTTTGACTACTGGGGCCAGGGAA CCCTGGTCACCGTCCTCA |
| | | | SEQ ID NO: 27581 | SEQ ID NO: 31587 |
| | | AA | SYELTQPPSVSVSPGQTASITCSGDKLGEKYACW YQQKSGQSPVLVIYQDRKRPSGIPERFSGSNSGN TATLTISGTQAMDEADYYCQAWDSRTAVFGGG TKLTVL | QITLKESGPTLVKPTQPLTLTCTFSGFSLSTTGVGVG WIRQPPGKALEWLGILFWNDDERYSPSLKSRLTITK DTSKNQVVLTMTNMDPVDTATYYCAHKSQLVYFD YWGQGTLVTVSS |
| | | | SEQ ID NO: 27582 | SEQ ID NO: 31588 |
| iPS:436946 | 21-225_183F4 | NA | TCCTATGAGCTGACTCAGCCACCCTCAGTGTC CGTGTCCCAGGACAGCAGCCAGCATCACCT GCTCTGGAGATAAATTGGGGGATAAATATGCT TGTTGGTATCAGCAGAAGCCAGGCCAGTCCCC TGTGTTGGTCATCTATCAAGATAAGAAACGGC CCTCAGGGATCCCTGAGCGATTCTCTGGCTCC AACTCTGGAAACACAGCCACTCTGACCATCAG CGGGACCCAGGCTATGGATGAGGCTGACTATT ACTGTCAGGCGTGGGACAACAGCACTGCTGTG GTATTCGGCGGAGGGACCAAACTGACCGTCCT A | CAGGTGCAGCTGGTGGAGTCTGGGGGAGGCGTG GTCCAGCCTGGGGAGGTCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGTGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAAGGA CGTATTGTAGTGGTACCACCTGCCCTACTACTA CTACTACGGTCTGGGCGTCTGGGCGTGGGCCAAGGGACC ACGGTCACCGTCTCCTCA |
| | | | SEQ ID NO: 27583 | SEQ ID NO: 31589 |

FIGURE 50
(Continued)

| | | | |
|---|---|---|---|
| | | AA | SYELTQPPSVSVSPGQTASITCSGDKLGDKYACW YQQKPGQSPVLVIYQDKKRPSGIPERFSGSNSGN TATLTISGTQAMDEADYYCQAWDNSTAVVFGG GTKLTVL<br><br>SEQ ID NO: 27584 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARERTYC SGTTCPYYYYGLGVWGQGTTVTVSS<br><br>SEQ ID NO: 31590 |
| iPS-436948 | 21-225_183F5 | NA | CAGACTGTGGTGACCCAGGAGCCATCGTTCTC AGTGTCCCCTGGAGGGACAGTCACACTCACTT GTGGCTTGAGCTCTGGCTCCAGTCTCTACTACTT TCTACCCCAGTCGTACCAGCAGCAGACCCCAGGC CAGGCTCCACGCACGCTCATCTACAACACAAA CACTCGCTCTTCTGGGGTCCCTGATCGCTTCTC TGGCTCCATCCTTGGGAACACAGCTGCCCTCA CCATCACGGGGGCCCAGGCAGATGAATGGGC GATTATTACTGTGTGCTTTATATGGGTAGTGGC ATTTGGGTGTTCGGCGGAGGGACCAAGCTGAC CGTCCTA<br><br>SEQ ID NO: 27585 | CAGGTACAGCTGGTGGAGTCTGGGGGAGGCGTG GTCCAGCCTGGAGGTCCCTGAGACTCTCCTGTG CAGCGTCTGGATTCACCTTCAGTAGTTATGGCAT GCTCTGGGTCCGCCAGGCTCCAGGCAAGGGGCT GGAGTGGGTGACAGTTATATGTATGATGGAAGT GGTAAATACTATGCAGACTCCGTGAAGGGCCGA TTCACCATCTCCAGAGACAATGAACAGCCTGAGAGAG TGTATCTGCAAATGAACAGCCTGAGAGAGAATTT ACACGGCTGTTTATTACTGTGCGAGAGAGAATTT TGGAGTGGTGACTACTGGGGCCAGGGAACCCT GGTCACCGTCTCCTCA<br><br>SEQ ID NO: 31591 |
| | | AA | QTVVTQEPSFSVSPGGTVTLTCGLSSGSVSTFYP SWYQQTPGQAPRTLIYNTNTRSSGVPDRFSGSIL GNKAALTITGAQADDESDYYCVLYMGSGIWVF GGGTKLTVL<br><br>SEQ ID NO: 27586 | QVQLVESGGGVVQPGRSLRLSCAASGFTFSSYGML WVRQAPGKGLEWVTVIWYDGSGKYYADSVKGRF TISRDNSKNTLYLQMNSLRAEDTAVYYCARENFWS GDYWGQGTLVTVSS<br><br>SEQ ID NO: 31592 |

FIGURE 50
(Continued)

| | | | |
|---|---|---|---|
| iPS:436950 | 21-225_184G4 | NA | TCCTATGAGCTGACTCAGCCACCCTCAGTGTC CGTGTCCCCAGGACAGACAGCCAGCATCACCT GCTCTGGAGATAAATTGGGGGATAAATTTGCT TGCTGGTATCAGCAGAAGCCAGGCCAGTCCCC TGTGCTGGTCATCTATGAAGATAGGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCCGCACTGTGGTA TTCGGCGGAGGGACCCAGCTGACCGTCCTA | CAGGTGCAGCTGGTGGAGTCTGGGGGAGGCGTG GTCCAGCCTGGGAGGTCCCTGAGACTCTCCTGTG CAGTGTCTGGATTCACCTTTAGTAGCTATGGCAT GCACTGGGTCCGCCAGGCTCCAGGCAAGGGGCT GGAGTGGGTGGCAATTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATTACTGTGCGAGAGGGGGC CCCGTTCTCTACGGTGACTATGTACTTTGACTAC TGGGGCCAGGGAACCCTGGTCACCGTCTCCTCA |
| | | | SEQ ID NO: 27587 | SEQ ID NO: 31593 |
| | | AA | SYELTQPPSVSVSPGQTASITCSGDKLGDKFACW YQQKPGQSPVLVIYEDRKRPSGIPERFSGSNSGN TATLTISGTQAMDEADYYCQAWDSRTVFGGG TQLTVL | QVQLVESGGGVVQPGRSLRLSCAVSGFTFSSYGMH WVRQAPGKGLEWVAIIWYDGSNKYYADSVKGRFT ISRDNSKNTLYLQMNSLRAEDTAVYYCARGGPPFS TVTMYFDYWGQGTLVTVSS |
| | | | SEQ ID NO: 27588 | SEQ ID NO: 31594 |
| iPS:436952 | 21-225_185D2 | NA | TCCTATGAGCTGACTCAGACACCCTCAGTGTC CGTGTCCCCAGGACAGACAGCCAGCATCACCT GCTCTGGAGATAAATTGGGGGATAAATATGCT TGCTGGTATCAGCAGAAGCCAGGCCAGTCCCC TGTGCTGGTCATCTATGAAGATAGGAAGCGGC CCTCAGGGATCCCTGACCGATTCTCTGGCTCC AACTCTGGGAACACAGCCACTCTGACCATCAG CGGGACCCAGGCTATGGATGAGGCTGACTATT ACTGTCAGGCGTGGGACAGCAGGAAAGTGGT ATTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGCT GGAGTGGGTGGCAATTATATGGTATGATGAAGT GATAAATACTATGCAGACTCCGTGAAGGGCCGA TTCACCATCTCCAGAGACAATTCCAAGAACACGC TGTATCTGCAAATGAACACCCTGAGAGCCGAAG ACACGGCTGTATTTCTGTGCGAGAGGGGGGCC CCCGTTCTCTACGGTGACTATGTACTTTGACTACT GGGGCCAGGGAACCCTGGTCACCGTCTCCTCA |
| | | | SEQ ID NO: 27589 | SEQ ID NO: 31595 |

FIGURE 50
(Continued)

| | | | |
|---|---|---|---|
| iPS:436954 | 21-225_185G7 | AA | SYELTQTPSVSVSPGQTASITCSGDKLGDKYAC WYQQKPGQSPVLVIYEDRKRPSGIPDRFSGSNSG NTATLTISGTQAMDEADYYCQAWDSRKVVFGG GTKLTVL<br>SEQ ID NO: 27590 | QVQLVESGGGVVQPGRSLRLSCAASGFTFSNYGM HWVRQAPGKGLEWVAIIWYDGSDKYYADSVKGR FTISRDNSKNTLYLQMNTLRAEDTAVYFCARGPP FSTVTMYFDYWGQGTLVTVSS<br>SEQ ID NO: 31596 |
| | | NA | TCCTATGAGCTGACTCAGCCACCCTCAGTGTC CGTGTCCCCAGGACACAGACAGCCAGCATCACCT GCTCTGGAGATAAAATTGGGCATAAATTTGTT TGCTGGTATCAGCAGAAGCCAGGCCAGTCCCC TGTGTTGGTCATCTATCAAGATCGCAAGCGGC CCTCAGGGATCCCTGAGCGATTCTCTGGCTCC AACTCTGGGAACACAGCCACTCTGACCATCAG CGGGACCCAGGCTATGGACGAAGCTGACTATT ACTGTCAGGCGTGGGACAGCAGCACGGTATTC GGCGGAGGGACCAAGCTGACCGTCCTA<br>SEQ ID NO: 27591 | CAGATCACCCTGAAGGAGTCTGGTCCTACGCTGG TGAAACCACACAGACCCTCACGTTGACCTGCAC CTTCTCTGGGTTCTCACTCACCACTGGTGGAGTG GGTGTGGGCTGGATCCGTCAGCCCCCAGGAAAG GCCCTGGAGTGGCTTGCACTCATTTATTGGAATG ATGAGAGCGCTACAGCCCATCTGAAGAGCA GGCTCACCATCACCAAGGACACCTCCAAAAACC AGGTGGTCCTTACAATGGACACAATGGACCCTGT GGACACAGCCACATATTACTGTGCACACATATA GCAGTGGCCTTCCAGCATTGGGGCCAGGGCACCC TGGTCACCGTCTCCTCA<br>SEQ ID NO: 31597 |
| | | AA | SYELTQPPSVSVSPGQTASITCSGDKLGHKFVCW YQQKPGQSPVLVIYQDRKRPSGIPERFSGSNSGN TATLTISGTQAMDEADYYCQAWDSSTVFGGGT KLTVL<br>SEQ ID NO: 27592 | QITLKESGPTLVKPTQTLTLTCTFSGFSLTTGGVGV GWIRQPPGKALEWLALIYWNDERYSPSLKSRLTIT KDTSKNQVVLTMTNMDPVDTATYYCAHHAVAFQ HWGQGTLVTVSS<br>SEQ ID NO: 31598 |

FIGURE 50
(Continued)

| | | | |
|---|---|---|---|
| iPS:436956 | 21-225_186H6 | NA | TCCTATGAGCTGACTCAGCCACCCTCAGTGTC CGTGTCCCAGGAGACAGACAGCCAGCATCACCT GCTCTGGAGATAAAATGGGGGAAAAATATGC TTGCTGGTATCAGCAGAAGCCAGGCCAGTCCC CTGTGCTGGTCATTTATCAAGATAGAAAGCGG CCCTCAGGGATCCCTGAGCGATTCTCTGGCTC CAACTCTGGGAACACAGCCACTCTGACCATCA GCGGGACCCAGGCTATGGATGAGCTGACTAT TACTGTCAGGCGTGTGGGACAGCAGCACTGCGGT ATTCGGCGGAGGGACCAAGCTGACCGTCCTA SEQ ID NO: 27593 | CAGATCACCTTGAAGGAGTCTGGTCCTACGCTGG TGAAACCCACACAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGGCTTGGATTCATTTCTTGGAATG ATGATAAGCGCTACAGCCCATCTCTGAAGAGCA GCCTCACCATCACCAAGGACACCTCCAAAAACC AGGTGTCCTTACAATGACCAACATGACCCTGT GGACACAGCCACATATTACTGTGCACACAAAGC AGCAGTGTTGCTTTGATATCTGGGGCCAAGGG ACAATGGTCACCGTCTCTTCA SEQ ID NO: 31599 |
| | | AA | SYELTQPPSVSVSPGQTASITCSGDKMGEKYAC WYQQKPGQSPVLVIYQDRKRPSGIPERFSGSNSG NTATLTISGTQAMDEADYYCQAWDSSTAVFGG GTKLTVL SEQ ID NO: 27594 | QITLKESGPTLVKPTQTLTLTCTFSGFSLSTSGVVG WIRQPPGKALEWLGFISWNDDKRYSPSLKSSLTITK DTSKNQVVLTMTNMDPVDTATYYCAHKAAVAF DIWGQGTMVTVSS SEQ ID NO: 31600 |
| iPS:436958 | 21-225_190D1 | NA | CAGACTGTGGTGACTCAGGAGCCCTCACTGAC TGTGTCCCAGGAGGACAGTCACTCTCACCT GTGCTTCCAGCACTGGAGCAGTCAGCAGCCCT TCCTATCCAAACTGGTTCCAGCAGAAACCTGG ACAAGCACCCAGGGACACTGGTTACAGTACAA GTAACAAACACTCCTGGACCCCTGCCGGTTC TCAGGCTCCCTCCTTGGGGGCAAAGCTGCCCT GACACTGTCAGGTGTGCAGCCTGAGGACGAG GACTATTACTGCCTGCTCTACTATGGTGGT GCTCAGGTGGCATTCGGCGGAGGGACCAAGTT GACCGTCCTA SEQ ID NO: 27595 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGGTTA CTACTGGAGCTGGATCCGCCAGCACCCAGGGAA GGGCCTGGAGTGGATTGGATACATCTATTACAGT GGGAGCACCTACTACAACCGTCCCTCAAGAGTC GAGTCACCATATCAGTAGACACGTCTAAGAACC AGTTCTCCCTGAAGCTGAGCTCGTGACTGCCGC GGACACGGCCGTTTATTACTGTGCGAGAGATTCC CCACTACGAGGCTTGACTACTGGGGCCAGGGA ACCCTGGTCACCGTCTCCTCA SEQ ID NO: 31601 |

FIGURE 50
(Continued)

| | | | | |
|---|---|---|---|---|
| | | AA | QTVVTQEPSLTVSPGGTVTLTCASSTGAVTSGSY PNWFQQKPGQAPRALIYSTSNKHSWTPARFSGS LLGGKAALTLSGVQPEDEADYYCLLYYGGAQV AFGGGTKLTVL<br>SEQ ID NO: 27596 | QVQLQESGPGLVKPSQTLSLTCTVSGGSISSGGYYW SWIRQHPGKGLEWIGYIYYSGSTYYNPSLKSRVTIS VDTSKNQFSLKLSSVTAADTAVYYCARDSPLRGFD YWGQGTLVTVSS<br>SEQ ID NO: 31602 |
| iPS:436960 | 21-225_198D2 | NA | CAGTCTGTGTTGACGCAGCCGCCCTCAGTGTC TGCGGCCCCAGGACAGAAGGTCACCATCTCCT GCTCTGGAAGCAGTCCAACATTGGGAGTAAT TATGTTTCCTGGTACCAACAGCTCCCAGGAAC AGCCCCCAAAGTCCTCATTTATGACAATAATA AGCGACCCCTCAAGTCTGGCACGTCAGCCACCCTGGG CATCACCGGACTCCAGACTGGGACGAGGCC GATTATTACTGCGGAACATGGGATAGCAGACT GAATGTTGGGGTATTCGGCGGAGGGACCAAG CTGACCGTCCTA<br>SEQ ID NO: 27597 | CAGGTGCAGCTGGTGGAGTCTGGGGGAGGCGTG GTCCAGCCTGGGAGGTCCCTGAGACTCTCCTGTG CAGCCTCTGGATTCACCTTCAGAAGCTATGGCAT GCATTGGGTCCGCCAGGCTCCAGGCAAGGGGCT GGAGTGGGTGGCAGTTATAATATGATGGAAGT TATAAGTACTATGCAGACTCCGTGAAGGGCCGAT TCACCATCTCCAAGAGACAATTCCAAGAACACGCT GTATCTGCAAATGAACAGCCTGAGAGCTGAGGA CACGGCTGTGTATTACTGTGCGAGAACGTATAGC GGGGTATGGACGTCTGGGGCCAAGGGACCACG GTCACCGTCTCCTCA<br>SEQ ID NO: 31603 |
| | | AA | QSVLTQPPSVSAAPGQKVTISCSGSSSNIGSNYVS WYQQLPGTAPKVLIYDNNKRPSGIPDRFSGSKSG TSATLGITGLQTGDEADYYCGTWDSRLNVGVFG GGTKLTVL<br>SEQ ID NO: 27598 | QVQLVESGGGVVQPGRSLRLSCAASGFTFRSYGMH WVRQAPGKGLEWVAVIIYDGSYKYYADSVKGRFT ISRDNSKNTLYLQMNSLRAEDTAVYYCARTYSGG MDVWGQGTTVTVSS<br>SEQ ID NO: 31604 |

FIGURE 50
(Continued)

| | | | |
|---|---|---|---|
| iPS:436962 | 21-225_190H1 | NA | TCCTATGAGTTGACTCAGCCACCCTCAGTGTC CGTGTCCCCAGGACAGACAGCCAGCATCACCT GCTCTGGAGATAAATTGGGGATAGATTTGCT TACTGTATCAGCAGAAGCCAGGCCAGTCCCC TGTACTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTAAGGCGTGGGACAGCAGCACTGTGTA TTCGGCGGAGGGACCAAGCTGACCGTCCTA |
| | | | CAGGTACAGCTGCAGCAGTCAGGTCCAGGACTG GTGAAGCCCTCGCAGACCCTCTCACTCACCTGTG ACATCTCCGGGGACAGTGTCTAGGAAAAGTGC TACTTGGAACTGGATCAGGACAGTCCCATGAGA GGCCTTGAGTGGCTGGGAAAGACATACTACAGG TCCAAGTGGTATAATGATTATGCAGTATCTGTGA AAGGTCGAATAACCATCAATCCAGACACATCCA AGAACCAGTTCTCCCTGCAATTGAACTCTGTGAC TCCCGAGGACACGGCTGTGTATTACTGTGCAAGA GATCCGGGTGGCTCTTTGACTACTGGGGCCAGG GAACCCTGGTCACCGTCTCCTCA |
| | | | SEQ ID NO: 27599 |
| | | AA | SYELTQPPSVSVSPGQTASITCSGDKLGDRFAYW YQQKPGQSPVLVIYQDSKRPSGIPERFSGSNSGN TATLTISGTQAMDEADYYCKAWDSSTVFGGG TKLTVL |
| | | | QVQLQQSGPGLVKPSQTLSLTCDISGDSVSRKSAT WNWIRQSPSRGLEWLGKTYYRSKWYNDYAVSVK SRITINPDTSKNQFSLQLNSVTPEDTAVYYCARDPG GLFDYWGQGTLVTVSS |
| | | | SEQ ID NO: 27600 |
| | | | SEQ ID NO: 31606 |
| iPS:436964 | 21-225_190B3 | NA | TCTTCTGAGCTGACTCAGGACCCTGCTGTGTCT GTGGCCTTGGGACAGACAGTCAGGATCACATG CCAAGGAGACAAACTCAGAACCTATTATGCAA GCTGGTACCAGCAGAAGCCAGGACAGGCCCC TGTACTTGTCGTCTATGGAAAAAACAACGGC CCTCAGGGATCCCAGACCGATTCTCTGGCTCC AGCTCAGGAAACACAGCTTCCTTGACCATCAC TGGGGCTCAGGCGGAAGATGAGGCTGACTATT ACTGTAACTCCCGGGACAGCAGCAGTGGTAACCAT CTTGTACTATTCGGCGGAGGGACCAAGCTGAC CGTCCTA |
| | | | CAGGTGCAGCTGGTGGAATCTGGGGGAGGCGTG GTCCAGCCTGGGGAGTCCCTGAGACTCTCCTGTG CAGCCGTCTGGATTCACCTTCAATAACTATGGCAT ACACTGGGTCCGCCAGGCTCCAGGCAAGGGGCT GGAGTGGGTGGCAGTTATATGGTTTGATGGAGAT AATAAATACTATGCAGACTCCGTGAAGGGCCGA TTCACCATCTCCAGAGACAATTCCAAGAACACGC TGTATCTGCAAATGAACAGCCTGAGAGCCGAAG ACACGGCTGTGTATTACTGTGCGAGAGATAACTG GAACTACGGCGATCACTACTACTTCGGTATG GACGTCTGGGGCCAAGGGACCACGGTCACCGTC TCCTCA |
| | | | SEQ ID NO: 27601 |
| | | | SEQ ID NO: 31607 |

FIGURE 50
(Continued)

| | | | |
|---|---|---|---|
| | | AA | SSELTQDPAVSVALGQTVRITCQGDKLRTYYAS WYQQKPGQAPVLVVYGKNNRPSGIPDRFSGSSS GNTASLTITGAQAEDEADYYCNSRDSSGNHLVL FGGGTKLTVL<br>SEQ ID NO: 27602 | QVQLVESGGGVVQPGRSLRLSCAASGFTFNNYGIH WVRQAPGKGLEWVAVIWFDGDNKYYADSVKGRF TISRDNSKNTLYLQMNSLRAEDTAVYYCARDNWN YGDHYYYFGMDVWGQGTTVTVSS<br>SEQ ID NO: 31608 |
| iPS:436966 | 21-225_190C3 | NA | CAGTCTGTGTTGACGCAGCCGCCCTCAGTGTC TGCGGCCCCAGGACAGAGAAGGTCACCATCTCCT GCTCTGGAAGCAGCTCCAACATTGGAAATAAT TATGTATCCTGGTACCAGCAGCTCCCAGGAAC AGCCCCCAAACTCCTCCTTTATGACAGTAATA AGCGACCCTCAGGGATTCCTGGCCGATTCTCT GGCTCCAAGTCTGCACGTCAGCCACCCTGGG CATCACCGGCCTCCAGACATGGGAGCAGCCTG ATTATTACTGCGCAACATGGGATAGCAGCAAGCT AGTACTGTGTATTCGGCGGAGGGACCAAGCT GACCGTCCTA<br>SEQ ID NO: 27603 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAACTGGTACTA CTACTACTACGGTATGGACGTCTGGGGCCAAGGG ACCACGGTCACCGTCTCCTCA<br>SEQ ID NO: 31609 |
| | | AA | QSVLTQPPSVSAAPGQKVTISCSGSSSNIGNNYVS WYQQLPGTAPKLLLYDSNKRPSGIPGRFSGSKSG TSATLGITGLQTGDEADYYCGTWDSSLSTVVFG GGTKLTVL<br>SEQ ID NO: 27604 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCANWYYY YYGMDVWGQGTTVTVSS<br>SEQ ID NO: 31610 |

FIGURE 50
(Continued)

| | | | |
|---|---|---|---|
| iPS:436968 | 21-225_190B10 | NA | CAGTCTGTGTTGACGCAGCCGCCCTCAGTGTC TGCGGCCCCAGGACAGAAGGTCACCATCCCT GCTCTGGAAGCAGCTCCAACATTGGGAATAAT TATGTATCCTGGTACCAGCAGCTCCCAGGAAC AGCCCCCAAACTCCTCATTTATGACAATAATA AGCGACCCTCAGGGATTCCTGACCGATTCTCT GGCTCCAAGTCTGGCACGTCAGCCACCCTGGG CATCACCGGACTCCAGACTGGGGACGAGGC GATTATTACTGCGGAACATGGGATAGCAGCCT GAGTGCTGGGGTTTTCGGCGGAGGGACCAAGC TGACCGTCCTA<br><br>SEQ ID NO: 27605 | CAGGTGCAGCTGGTGGAGTCTGGGGGAGGCGTG GTCCAGCCTGGGAGGTCCCTGAGACTCTCCTGTG TAGCGTCTGGATTCACCTTCAGTAGCTATGGCAT GCACTGGGTCCGCCAGGCTCCAGGCAAGGGCT GGAGTGGGTGGCAGTTATATGAACTGATGGAAG TAAAAATACCATGTAGACTCCGTGAAGGGCCGA ATTTACCATCTCCAGAGACAATTCCAAGAACACG CTGTATCTGCAAATGAACAGCTGAGAGCCGAG GACACGGCTCTGTATTACTGTGCGAGAGATCTGG ATAAGAGGAACTTTCCTTATTACTACTACTACGG TATGGACGTCTGGGGCCAAGGGACCACGGTCAC CGTCTCCTCA<br><br>SEQ ID NO: 31611 |
| | | AA | QSVLTQPPSVSAAPGQKVTISCSGSSNIGNNYVS WYQHLPGTAPKLLIYDNNKRPSGIPDRFSGSKSG TSATLGITGLQTGDEADYYCGTWDSSLSAGVFG GGTKLTVL<br><br>SEQ ID NO: 27606 | QVQLVESGGGVVQPGRSLRLSCVASGFTFSSYGMH WVRQAPGKGLEWVAVIWNDGSKKYHVDSVKGRF TISRDNSKNTLYLQMNSLRAEDTALYYCARDLDKR NFPYYYYYGMDVWGQGTTVTVSS<br><br>SEQ ID NO: 31612 |
| iPS:436970 | 21-225_190B8 | NA | TCTTCTGAGCTGACTCAGGACCCTGCTGTCT GTGGCCTTGGGACAGACAGTCAGGATCACATG CCAAGGAGACACCCTCAGACCCTATTATGTAA GCTGGTACCAGCAGAAGCCAGGACAGGCCCC TGTACTTGTCATCTATGGTAAAAACAACGGC CCTCAGGGATCCCAGACCGATTCTCTGGCTCC AGCTCAGGAAACACAGCTTCCTTGACCATCAC TGGGGCTCAGGCGGAAGATGAGGCTGACTATT ACTGTAACTCCCGGGACAGCAGCAGTGGTAACCAT CTGTGTGTTATTCGGCGGAGGGACCAAGCTGAC CGTCCTA<br><br>SEQ ID NO: 27607 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGTGATGGAAGT AATAAATACTATACAGACTCCGTGAAGGGCCGA TTCACCATCTCCAGAGACAATTCCAAGAACACGC TGTATCTGCAAATGAACAGCTGAGAGCCGAGG ACACGGCTCTGTATTATTGTGCGAGAGATAACTG GAACTACGGCGATTACTACTACTACGGTATG GACGTCTGGGGCCAAGGGACCACGGTCACCGTC TCCTCA<br><br>SEQ ID NO: 31613 |

FIGURE 50
(Continued)

| | | | | |
|---|---|---|---|---|
| | | AA | SSELTQDPAVSVALGQTVRITCQGDTLRPYYVS WYQQKPGQAPVLVIYGKNNRPSGIPDRFSGSSSG NTASLTITGAQAEDEADYYCNSRDSSGNHLVVF GGGTKLTVL<br>SEQ ID NO: 27608 | QVQLVESGGGVVQPGRSLRLSCAASGFTFSSYGMH WVRQAPGKGLEWVAVIWFDGSNKYYTDSVKGRF TISRDNSKNTLYLQMNSLRAEDTAVYYCARDNWN YGDYYYYGMDVWGQGTTVTVSS<br>SEQ ID NO: 31614 |
| iPS:436972 | 21-225_190C7 | NA | CAGTCTGTGTTGACGCAGCCGCCCTCAGTGTC TGCGGCCCCAGGACAGAAGGTCACCATCTCCT GCTCTGGAGGCAGCTCCAACATTGGGAATAAT TATGTATCCTGGTTTCAGCAGTTCCCAGGAAC AGCCCCCAAATTCCTCATTTATGACAATAATA AGCGACCCTCAGGGATTCCTGACCGATTCTCT GGCTCCAAGTCTGGCACGTCAGCACCCTGGG CATCACCGGACTCCAGAACATGGGATCGCACCCTG ATTATTACTGCGGAACATGGGATGCGCACCCTG AGTGATTGGGTATTCGGCGGAGGGACCAAGCT GACCGTCCTA<br>SEQ ID NO: 27609 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGATGGATCAACCCTAACAGTGG TGGCACAAACTATGCACAGAAGTTTCAGGGCAG GGTCACCATGACCAGGGACACGTCCATCAGCAC AGCCTACATGAACTGAGCAGGCTGAGATCTGA CGACACGGCCGTGTATTACTGTGCGAGAGATAG AGCAGTGGCTGGAAACTACTTCTACTACGGTATG GACGTCTGGGGCCAAGGGACCACGGTCACCGTC TCCTCA<br>SEQ ID NO: 31615 |
| | | AA | QSVLTQPPSVSAAPGQKVTISCSGGSSNIGNNYV SWFQQFPGTAPKFLIYDNNKRPSGIPDRFSGSKS GTSATLGITGLQTGDEADYYCGTWDRTLSDWV FGGGTKLTVL<br>SEQ ID NO: 27610 | QVQLVQSGAEVKKPGASVKVSCKASGYTFTGYYM HWVRQAPGQGLEWMGWINPNSGGTNYAQKFQGR VTMTRDTSISTAYMELSRLRSDDTAVYYCARDRAV AGNYFYYGMDVWGQGTTVTVSS<br>SEQ ID NO: 31616 |

FIGURE 50
(Continued)

| | | | | |
|---|---|---|---|---|
| iPS:436974 | 21-225_190H7 | NA | CAGTCTGTGTTGACGCAGCCGCCCTCAGTGTC<br>TGCGGCCCAGGACAGAAGGTCACCATCTCCT<br>GCTCTGGAAGCAGCTCCAACAGTCCCAGGAAT<br>TATGTTTCCTGGTACCAGCAGCTCCCAGGAAC<br>AGCCCCCAAAGTCCTCATTTATGACAATAATA<br>AGCGACCCTCAGGGATTCCTGACCGATTCTCT<br>GGCTCCAAGTCTGGCACGTCAGCCACCCTGGG<br>CATCACCGGACTCCAGACTGGGGACGAGGCC<br>GATTATTACTGCGGAACATGGGATGGCAGACT<br>GAATGTGGGGTATTCGGCGGAGGGACCAAG<br>CTGACCGTCCTA<br>SEQ ID NO: 27611 | CAGGTGCAGCTGGTGGAGTCTGGGGGAGGCGTG<br>GTCCAGCCTGGGAGGTCCCTGAGACTCTCCTGTG<br>CAGCCCTGTGATTCAACTTCAGAAGCTATGGCAT<br>GCATTGGGTCCGCCAGGCTCCAGGCAAGGGGCT<br>GGAGTGGGTGGCAGTTATAATATGATGAAGT<br>TATAAGTACTATGCAGACTCCGTGAAGGGCCGAT<br>TCACCATCTCCAGAGACAATTCCAAGAACACGCT<br>GTATCTGCAAATGAACAGCCTGAGAGCTGAGGA<br>CACGGCTGTGTATTACTGTGCGAGAACGTATAGC<br>GGGGGTATGGACGTCTGGGGCCAAGGGACCACG<br>GTCACCGTCTCCTCA<br>SEQ ID NO: 31617 |
| | | AA | QSVLTQPPSVSAAPGQKVTISCSGSSSNIGSNYVS<br>WYQQLPGTAPKVLIYDNNKRPSGIPDRFSGSKSG<br>TSATLGITGLQTGDEADYYCGTWDGRLNVGVF<br>GGGTKLTVL<br>SEQ ID NO: 27612 | QVQLVESGGGVVQPGRSLRLSCAASGFNFRSYGM<br>HWVRQAPGKGLEWVAVIIYDGSYKYYADSVKGRF<br>TISRDNSKNTLYLQMNSLRAEDTAVYYCARTYSGG<br>MDVWGQGTTVTVSS<br>SEQ ID NO: 31618 |
| iPS:436976 | 21-225_190D8 | NA | CAGTCTGTGTTGACGCAGCCGCCCTCAGTGTC<br>TGCGGCCCAGGACAGAAGGTCACCATCTCCT<br>GCTCTGGAAGCAGCTCCAACATTGGGAATCAT<br>TATGTCTCCTGGTACCAGCAGCTTCCAGGAAC<br>AGCCCCCAAACTCCTCATTTATGACAGTAGTA<br>AGCGACCCTCAGAGATTCCTGACCGATTCTCT<br>GGCTCCAAGTCTGGCACGTCCGCCACCCTGGG<br>CATCACCGGACTCCAGACTGGGGACGAGGCC<br>GATTATTACTGCGGAACATGGGATAGTAGTCT<br>GAGTACTGTGGTATTCGGCGGAGGGACCAAGC<br>TGACCGTCCTA<br>SEQ ID NO: 27613 | CAGGTGCAGCTGGTGGAGTCTGGGGGAGACCTTG<br>GTCCAGCCTGGAGAGGTCCCTGAGACTCTCTGTG<br>AAGCGTCTGGATTCACCTTCAGTAGCTATGGCCT<br>GCACTGGGTCCGCCAGGCTCCGGCAAGGGACT<br>GGAGTGGGTGGCAGTTATATGGTATGATGAAGT<br>AATAAATACTATGCAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGGCTGTGTATTACTGTGCGAACTGGTACTA<br>CTACTACTACGGTATGGACGTCTGGGGCCAAGGG<br>ACCACGGTCACCGTCTCCTCA<br>SEQ ID NO: 31619 |

FIGURE 50
(Continued)

| | | | |
|---|---|---|---|
| iPS-436978 | 21-225_190G9 | AA | QSVLTQPPSVSAAPGQKVTISCSGSSSNIGNHYVSWYQQLPGTAPKLLIYDSSKRPSEIPDRFSGSKSGTSATLGITGLQTGDEADYYCGTWDSSLSTVFGGGTKLTVL<br>SEQ ID NO: 27614 | QVQLVESGGDVVQPGRSLRLSCEASGFTFSSYGLHWVRQAPGKGLEWVAVIWYDGSNKYYADSVKGRFTISRDNSKNTLYLQMNSLRAEDTAVYYCANWYYYYYGMDVWGQGTTVTVSS<br>SEQ ID NO: 31620 |
| | | NA | TCCTATGAGCTGACTCAGCCACCTCAGTGTCCGTGTCCCCAGGACAGAGCCAGCATCACCTGCTCTGGAGATAAATTGGGGGATAGATTTGCTTACTGGTATCAGCAGAAGCCAGGCCAGTCCCCTGTGCTGGTCATCTATCAAGATAACAAGCGGCCCTCAAGGGATCCCTGAGCGATTCTCTGGCTCCAACTCTGGGAACACAGCCTCTCTGACCATCAGCGGGACCCAGGCTATGGATGAGGCTGACTATTACTGTCAGGCGTGGACACAGCAGCACTGTGTATTCGGCGGAGGGACCAGGCTGACCGTCCTA<br>SEQ ID NO: 27615 | CAGGTACAGTTGCAGCAGTCAGGTCCAGGACTGGTGAAGCCCTCGCAGACCCTCACTCTCACCTGTGCCATCTCCGGGACAGTGTCTCTAGGAAAGTGCTACTTGGAACTGATCAGGCAGTCCCCATCGAGAGGCCTTGAGTGGCTGGGAAGGACATACTACAGGTCCAAGTGGTATAATGATTATCAGTATCTGTGAAAAGTCGAATAATCATCCAGCTGAACTCTGTGACAGAACCAGTTCTCCTGCAGCTGTGTATTACTGTGCAAGATCCGGTGGCCTCTTTGACTACTGGGGCCAGGGAACCCTGGTCACCGTCTCCTCA<br>SEQ ID NO: 31621 |
| | | AA | SYELTQPPSVSVSPGQTASITCSGDKLGDRFAYWYQQKPGQSPVLVIYQDNKRPSGIPERFSGSNSGNTASLTISGTQAMDEADYYCQAWDSSTVFGGGTRLTVL<br>SEQ ID NO: 27616 | QVQLQQSGPGLVKPSQTLSLTCAISGDSVSRKSATWNWIRQSPSRGLEWLGRTYYRSKWYNDYAVSVKSRIINPDTSKNQFSLQLNSVTPEDTAVYYCARDPGGLFDYWGQGTLVTVSS<br>SEQ ID NO: 31622 |

FIGURE 50
(Continued)

| | | | |
|---|---|---|---|
| iPS:436980 | 21-225_190C10 | NA | TCTTCTGAGCTGACTCAGGACCCTGCTGTGTCT GTGGCCTTGGGACAGACAGTCAGGATCACATG CCAAGGAGACAGCCTCAGACCCTATTATGCAA GCTGGTACCAGCAGAAGCCAGGACAGGCCCC TGTACTTGTCATCTATGGTAAAAACAACCGC CCTCAGGGATCCCAGACCGATTCTCTGGCTCC AGTTCAGGGCTCAGGAACACAGCTTCCTTGACCATCAC TGAGGCTCAGGCGGAAGATGAGGCTGACTATT ACTGTAACTCCCGGGACAGCAGTGGTAACTAT CTTGTGTGGGTATTCGGCGGAGGGACCAAGCTGAC CGTCCTA<br><br>SEQ ID NO: 27617 | CAGGTGCAGCTGGTGGAGTCTGGGGGAGGCGTG GTCCAGCCTGGGAGGTCCCTGAGACTCTCCTGTG CAGCGTCTGGATTCACCCTCAGTAACTATGGCAT GCACTGGGTCCGCCAGGCTCCAGGCAAGGGGCT GGAGTGGGTGGCAGTTATATGGTTTGGTGGAGAT AATAAATACTATGCAGACTCCGTGAGGGCCGA TTCACCATCTCCAGAGACAATTCCAAGAACACGC TGTATCTGCAAATGAACAGCCTGAGAGCCGAGG ACACGGCTGTGTTTTACTGTGCAGAGATAACTG AACTAGGGCGATCACTACTACTATTACGAATG GACGTCTGGGGCCAAGGGACCACGGTCACCGTC TCCTCA<br><br>SEQ ID NO: 31623 |
| | | AA | SSELTQDPAVSVALGQTVRITCQGDSLRPYYAS WYQQKPGQAPVLVIYGKNNRPSGIPDRFSGSSSG NTASLTITEAQAEDEADYYCNSRDSSGNHLVVF GGGTKLTVL<br><br>SEQ ID NO: 27618 | QVQLVESGGGVVQPGRSLRLSCAASGFTLSNYGM HWVRQAPGKGLEWVAVIWFGGDNKYYADSVRGR FTISRDNSKNTLYLQMNSLRAEDTAVFYCARDNW NYGDHYYYGMDVWGQGTTVTVSS<br><br>SEQ ID NO: 31624 |
| iPS:436982 | 21-225_190D10 | NA | CAGTCTGTGTTGACGCAGCCGCCCTCAGTGTC TGCGGCCCCAGGACAGAAGGTCACCATCTCCT GCTCTGGAAGCAGCTCCAACATTGGGAGTAAT TATGTTTCCTGGTACCAACAGCTCCCAGGAAC AGTCCCCAAAGTCCTCATTTATGACAATAATA AGCGACCCTCAGGGATTCCTGACCGATTCTCT GGCTCCAAGTCTGGCACGTCAGCCACCCTGGG CATCACCGGACTCCAGACTGGGGACGAGGCC GATTATTACTGCGGAACATGGGATATAGCAGACT GAATGTTGGGGTATTCGGCGGAGGGACCAAG CTGACCGTCCTA<br><br>SEQ ID NO: 27619 | CAGGTGCAGCTGGTGGAGTCTGGGGGAGGCGTG GTCCAGCCTGGGAGGTCCCTGAGACTCTCCTGTG CAGCCTCTGGGATTCAACCTTCAGAAGCTATGGCAT GCATTGGGTCCGCCAGGCTCCAGGCAAGGGGCT GGAGTGGGTGGCAGTTATAATATGATGGAAGT TATAAGTACTATGCAGACTCCGTGAAGGGCCGAT TCACCATCTCCAGAGACAATTCCAAGAACACGCT GTATCTGCAAATGAACAGCCTGAGAGCTGAGGA CACGGCTGTGTATTACTGTGCGAGAACGTATAGC GGGGTATGGACGTCTGGGGCCAAGGGACCACG GTCACCGTCTCCTCA<br><br>SEQ ID NO: 31625 |

FIGURE 50
(Continued)

| | | | |
|---|---|---|---|
| iPS:436984 | | AA | QSVLTQPPSVSAAPGQKVTISCSGSSSNIGSNYVS WYQQLPGTVPKVLIYDNNKRPSGIPDRFSGSKSG TSATLGITGLQTGDEADYYCGTWDSRLNVGVFG GGTKLTVL SEQ ID NO: 27620 | QVQLVESGGGVVQPGRSLRLSCAASGFTFRSYGMH WVRQAPGKGLEWVAVIIYDGSYKYYADSVKGRFT ISRDNSKNTLYLQMNSLRAEDTAVYYCARTYSGG MDVWGQGTTVTVSS SEQ ID NO: 31626 |
| | | NA | CAGACTGTGGTGACTCAGGAGCCCTCACTGAC TGTGTCCCCAGGAGGGACAGTCACTCTCACTT GTGTTTTTAGCACTGGAGCAGTCACCAGTGGT TCCTTTCCAAACTGGTTCCAGCAGAAACCTGG ACAAGCACCCAGGGCACTGATTTATAGTACAA GCAACAAACACTCCTGGACCCCTGCCCGGTTC TCAGGCTCCCTCCTTGGGGGCAAAGCTGCCT GACACTGTCAGGTGTGCAGCCTGAGGACGAG GCTGACTATTACTGCCTGTCTCTACTGTGGTGT GCTCAGCTGTGTTCGGCGGAGGGACCAAGCT GACCGTCCTA SEQ ID NO: 27621 | CAGGTGCAGCTGCAGGAGTCGGGCCCAGGACTG GTGAAGCCTTCACAGACCCTGTCCTCCACCTGCA CTGTCTCTGGTGGCTCCATCAGAAGTGGTGTGA CTACTGAGCTGGATCCGCCAGCACCCAGGGA GGGCCTGGAGTGGATTGGGTACATCTATTACAGT GGGATCACCTACTACAATCCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGATAGC AGCTCGCGGGGTATGGACGTCTGGGGCCAAGGG ACCACGGTCACCGTCTCCTCA SEQ ID NO: 31627 |
| | 21-225_190F10 | AA | QTVVTQEPSLTVSPGGTVTLTCVFSTGAVTSGSF PNWFQQKPGQAPRALIYSTSNKHSWTPARFSGS LLGGKAALTLSGVQPEDEADYYCLLYCGGAQL VFGGGTKLTVL SEQ ID NO: 27622 | QVQLQESGPGLVKPSQTLSLTCTVSGGSIRSGGDY WSWIRQHPGEGLEWIGYIYYSGITYYNPSLKSRVTI SVDTSKNQFSLKLSSVTAADTAVYYCARDSSSRGM DVWGQGTTVTVSS SEQ ID NO: 31628 |

FIGURE 50
(Continued)

| | | | |
|---|---|---|---|
| iPS:436986 | 21-225_191A1 | NA | CAGTCTGTGTTGACGCAGCCGCCCTCAGTGTC TGCGGCCCCAGGACAGAGGGTCACCATCTCCT GCTCTGGAAGCAGCTCCAACCTTGGAAATAAT TTTGTATCCTGGTACCAGCAGTTCCAGGAAC AGCCCCAAACTCCTCATTTATGACAATTATA AGGGACCCTCAGGGATTCCTGACGATTCTCT GTCTCCAAGTCTGGCACGTCAGCCACCCTGGG CATCACCGGACTCCAGACTGGGGACGAGGC GATTATTACTGCGAACATGGGATAGCAGCCT GAATACTGGGTATTCGGCGGAGGGACCAAG CTGACCGTCCTA | CAGGTCAGCTGCAGGAGTCGGGCCCAGGACTG GTGAAGCCTTCGGAGACCCTGTCCCTCACTGCA CTGTCTCTGGTGGCTCATCAGAAGTTACTACTG GATCTGGATCCGGCAGCCCCAGGAAGGGACT GGAGTGGATTGGGTATATCTATTACAGTGGGAGT ACTAAGTACAACCCTCCCTCAAGAGTCGAGTCA CCATATCAGTAGACACGTCCAAGAACCAGTTCTC CCTGAAACTGAGCTCTGTGACGGCTGCGGACACG GCCGTGTATTACTGTGCGAGAAAGGGAGTGGGA ACCATCCACTTGACTACTGGGGCCAGGGAACCC TGGTCACCGTCTCCTCA |
| | | | SEQ ID NO: 27623 | SEQ ID NO: 31629 |
| | | AA | QSVLTQPPSVSAAPGQRVTISCSGSSSNLGNNFV SWYQQFPGTAPKLLIYDNYKRPSGIPDRFSVSKS GTSATLGITGLQTGDEADYYCGTWDSSLNTGVF GGGTKLTVL | QVQLQESGPGLVKPSETLSLTCTVSGGSIRSYYWIW IRQPPGKGLEWIGYIYYSGSTKYNPSLKSRVTISVDT SKNQFSLKLSSVTAADTAVYYCARKGVGTIHFDY WGQGTLVTVSS |
| | | | SEQ ID NO: 27624 | SEQ ID NO: 31630 |
| iPS:436988 | 21-225_191A2 | NA | CAGACTGTGGTGACTCAGGAGCCCTCACTGAC TGTGTCCCCAGGAGGGACAGTCACTCACTT GTGTTCTTAGCACTGGAGCAGTCAGCAGTTGGT TCCTTTCCAAACTGGTTCCAGCAGAAACCTGG ACAAGCACCCAGGGCACTGGTTATAGTACAA GCAACAAACACTCCTGGGGTGCAAAGCTGCCCT TCAGGCTCCCTCTGGGGTGCAGCTGAGGACGAG GACACTGTCAGGTGTGCAGCTGAGGACGAG GCTGACTATTACTGCATGCTCTACTGTGGTGGT GCTCAGCTGGTGTTCGGCGGAGGGACCAAGCT GACCGTCCTA | CAGGTGCAGCTGCAGGAGTCGGGCCCAGGACTG GTGAAGCCTTCACAGACCCTGTCCCTCACCTGCA CTGTCTCTGGTGGCTCCATCAGAAGTGGTGGTGA CTACTGGAGCTGGATCCGCCAGCACCCAGGGGA GGGCCTGGAGTGGATTGGGTACATCTATTACAGT GGGATCACCTACTACAATCCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGATAGC AGCTCGGGGGTATGGACGTCTGGGGCCAAGGG ACCACGGTCACCGTCTCCTCA |
| | | | SEQ ID NO: 27625 | SEQ ID NO: 31631 |

FIGURE 50
(Continued)

| | | | | |
|---|---|---|---|---|
| iPS:436992 | 21-225_191B8 | AA | QTVVTQEPSLTVSPGGTVTLTCVLSTGAVTSGSFPNWFQQKPGQAPRALIYSTSNKHSWTPARFSGSLLGGKAALTLSGVQPEDEADYYCMLYCGGAQLVFGGGTKLTVL<br>SEQ ID NO: 27626 | QVQLQESGPGLVKPSQTLSLTCTVSGGSIRSGGDYWSWIRQHPGEGLEWIGYIYYSGITYNPSLKSRVTISVDTSKNQFSLKLSSVTAADTAVYYCARDSSSRGMDVWGQGTTVTVSS<br>SEQ ID NO: 31632 |
| | | NA | TCTTCTGAGCTGACTCAGGACCCTGCTGTGTCTGTGGCCTGGGACAGACAGTCAGGATCACATGCCAAGGAGACACCCTCAGACCCTCTATTGCAAGTTGGTACCAGCAGAAGCCAGGACAGGCCCCTGTACTTGTCATCTATGGTAAAAACAACCGGCCCTCAGGGATCTCAGACCGATTCTCTGGCTCCAGCTCAGGAAACACAGCTTCCTTGACCATCACTGGGGCTCAGGCGGAAGATGAGGCTGACTATTACTGTAACTCCCGGGACAGCAGTAGTGGTAACCATCTTGTGTATTGGCGGAGGGACCAAGCTGACCGTCCTA<br>SEQ ID NO: 27627 | CAGGTGCAGCTGGTGGAGTCTGGGGGAGGCGTGGTCCAGCCTGGGAGGTCCCTGAGACTCTCCTGTGCAGCGTCTGGATTCACCCTCAGTAGCTATGGCATGCACTGGGTCCGCCAGGCTCCAGGCAAGGGGCTGGAGTGGGTGGCAGTTATATGGTTTGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAACTGGAACTACGGCGATCACTACTACTACGGTATGGACGTCTGGGGCCAAGGGACCACGGTCACCGTCTCCTCA<br>SEQ ID NO: 31633 |
| | | AA | SSELTQDPAVSVALGQTVRITCQGDTLRPYYASWYQQKPGQAPVLVIYGKNNRPSGISDRFSGSSSGNTASLTITGAQAEDEADYYCNSRDSSSGNHLVFGGGTKLTVL<br>SEQ ID NO: 27628 | QVQLVESGGGVVQPGRSLRLSCAASGFTLSSYGMHWVRQAPGKGLEWVAVIWFDGSNKYYADSVKGRFTISRDNSKNTLYLQMNSLRAEDTAVYYCARDNWNYGDHYYYGMDVWGQGTTVTVSS<br>SEQ ID NO: 31634 |

FIGURE 50
(Continued)

| | | | |
|---|---|---|---|
| iPS:436994 | 21-225_191A9 | NA | TCTTCTGAGCTGACTCAGGACCCTGCTGTGTCT GTGGCCTTGGGACAGAGACAGTCAGGATCACATG CCAAGGAGACAGCTCAGACCCTATTATGCAA GCTGGTACCAGCAGAAGCCAGGACAGGCCCC TGTACTTGTCATCTATGGTAAAAACAACGGC CCTCAGGGATCCCAGACCGATTCTCTGGCTCC AGCTCAGGAAACACAGCTTCCTTGACCATCAC TGAGGCTCAGGCGGAAGATGAGGCTGACTATT ACTGTAACTCCCGGACAGCTGTGTAACCAT CTTGTGGTATTCGGCGGAGGGACCAAGCTGAC CGTCCTA |
| | | | SEQ ID NO: 27629 |
| | | AA | SSELTQDPAVSVALGQTVRITCQGDSLRPYYAS WYQQKPGQAPVLVIYGKNNRPSGIPDRFSGSSSG NTASLTITEAQAEDEADYYCNSRDSCGNHLVVF GGGTKLTVL |
| | | | SEQ ID NO: 27630 |
| | | | CAGGTGCAGCTGGTGGAGTCTGGGGGAGGCGTG GTCCAGCCTGGGAGGTCCCTGAGACTCTCCTGTG CAGGCGTCTGGATTCACCCTCAGTAATTATGGCAT GCACTGGGTCCGCCAGGCTCCAGGCAAGGGGCT GGAGTGGGTGGCAGTTATATGGTTTGGTGGAGAT AATAAATACTATGCAGACTCCGTGAAGGGCCGA TTCACCATCTCCAGAGACAATTCCAAGAACACGC TGTATCTGCAAATGAACAGCTGAGAGCCGAGG ACACGGCTGTGTTTTACTGTGCGAGAGATAACTG GAACTACGACGATCACTACTACTATTACGGTATG GACGTCTGGGGCCAAGGGACCACGGTCACCGTC TCCTCA |
| | | | SEQ ID NO: 31635 |
| | | | QVQLVESGGGVVQPGRSLRLSCAASGFTLSNYGM HWVRQAPGKGLEWVAVIWFGGDNKYYADSVKGR FTISRDNSKNTLYLQMNSLRAEDTAVFYCARDNW NYGDHYYYYGMDVWGQGTTVTVSS |
| | | | SEQ ID NO: 31636 |
| iPS:436996 | 21-225_191B9 | NA | CAGTCTGTGTTGACGCAGCCGCCCTCAGTGTC TGCGGCCCCAGGACAGAAGGTCACCATCTCCT GCTCTGGAAGCAGCTCCAACATCGGGAATAAT TATGTATCCTGGTACCAGCAGCTCCAGGAAC AGCCCCCAAACTCCTCATTTATGACAATAAAA AGCGACCCTCAGGGATTCCTGACCGATTCTCT GGCTCCAAGTCTGGCACGTCAGCTCCACCCTGGG CATCACCGGACTCCAGACTGGGGGACGAGGCC GATTATTACTGCGGAACATGGGATAGCAGCCT GAGTGTTTGTGTCTTCGGAACTGGGACCAAGG TCACCGTCCTA |
| | | | SEQ ID NO: 27631 |
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTTTCCATGGCAT GCACTGGGTCCGCCAGGCTCCAGGCAAGGGGCT GGAGTGGGTGGCAGTTATATGGTATGATGGAAGT AAAAATACTATGCAGAGACAATTCCAAGAACACGC TTCACCATCTGCAAATGAACAGTCTGAGAGCCGAGG TGCATCTGCAAATGAACAGTCTGAGAGCCGAGG ACACGGCTGTGTATTACTGTGCGAAAGAAGGGTA TAGCAGTGGCTTTTACAGGGGGGTTTGACAACTGG GGCCAGGGAACCCTGGTCACCGTCTCCTCA |
| | | | SEQ ID NO: 31637 |

FIGURE 50
(Continued)

| | | | |
|---|---|---|---|
| | | AA | QSVLTQPPSVSAAPGQKVTISCSGSSSNIGNNYVS WYQQLPGTAPKLLIYDNKKRPSGIPDRFSGSKSG TSATLGITGLQTGDEADYYCGTWDSSLSVCVFG TGTKVTVL<br>SEQ ID NO: 27632 | QVQLVESGGGVVQPGRSLRLSCAASGFTFSFHGMH WVRQAPGKGLEWVAVIWYDGSKKYYADSVKGRF TISRDNSKNTLHLQMNSLRAEDTAVYYCAKEGYSS GFYRGFDNWGQGTLVTVSS<br>SEQ ID NO: 31638 |
| | | NA | CAGGCTGTGTCGACTCGGCCGTCTCCCTCTCT GCATCTCCTGGAGCATCAGCCAGTCTCACCTG CACCTTACGCAGTGGCATCAATGTTGGTACCT ACAGGATATACTGGTACCAGCAGAAGCCAGG GAGTCCTCCCAGTATCTCTGAGGTACAAAT CAGACTCAGATAAGCAGCAGGGCTCTGGAGTC CCCAGCCGCTTCTCTGGATCCAAAGATGCTTC GGCCAATGCAGGGATTTACTCATCTCTGGGC TCCAGTCTGAGGATGAGGCTGACTATTACTGT ATGATTTGGCACAGCAGCGCTGTGTATTCGG CGGAGGGACCAAGCTGACCGTCCTA<br>SEQ ID NO: 27633 | CAGGTGCAGCTGGTGGAGTCTGGGGGAGGCGTG GTCCAGCCTGGGAGGTCCCTGAGACTCTCCTGTG CAGCGCTCTGGATTCACCTTCAGTAGTTCATGGCAT GCACTGGGTCCGCCAGGCTCCAGGCAAGGGCT GGAGTGGGTGACACTTATATGGTTTGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCGGGT GGGAGGTACTAGTCCTCCTTACTACTACTACTAC GGTATGGACGTCTGGGGCCAAGGGACCACGGTC ACCGTCTCCTCA<br>SEQ ID NO: 31639 |
| iPS:437l00 | 21-225_191G9 | AA | QAVSTRPSSLSASPGASASLTCTLRSGINVGTYRI YWYQQKPGSPPQYLLRYKSDSDKQQGSGVPSRF SGSKDASANAGILLISGLQSEDEADYYCMIWHSS AVVFGGGTKLTVL<br>SEQ ID NO: 27634 | QVQLVESGGGVVQPGRSLRLSCAASGFTFSTYGMH WVRQAPGKGLEWVTLIWPDGSNKYYADSVKGRFT ISRDNSKNTLYLQMNSLRAEDTAVYYCARDRVGG TSPPYYYYGMDVWGQGTTVTVSS<br>SEQ ID NO: 31640 |

FIGURE 50
(Continued)

| | | | |
|---|---|---|---|
| iPS:437002 | 21-225_191H9 | NA | CAGACTGTGGTGACTCAGGAGCCCTCACTGAC<br>TGTGTCCCAGGAGGGACAGTCACTCTCACCT<br>GTGCTTCCAGCACTGGAGCAGTCACCAGTGCT<br>TACTATCCAAACTGGTTGCAGCAGAAACCTGG<br>ACAAGCACCCAGGACACTGATTTATAGTACAA<br>ACAACAAACACTCCTGAGCCCCTGCCCGGTTC<br>TCAGGCTCCCTCCTTGGGGCAAAGCTGCCCT<br>GACACTGTTCAGATGTGCAGCTGCAGGACGAG<br>GCTGAGTATTACTGCCTGATCTTCTATGGTGGT<br>GTACATGTGATATTTGGCGAGGGACCAAGCT<br>GACCGTCCTA<br>SEQ ID NO: 27635 | CAGGTGCAGCTGGTGCAGTCTGGGGCTGAGGTG<br>AAGAAGCCTGGGGCCTCAGTGAAGGTCTCCTGTA<br>AGGTTTCTGGATATACCTTCACCGGCTACAATAT<br>GCACTGGGTGCGACAGGCCCCTGGACAAGGGCT<br>TGAGTGGATGGGATGGATCAACCTAATAGTGGT<br>GGCACAAACTATGCACACAAGTTCAGGCAGG<br>GTCACCATGACCAGGACACGTCATCAGCACA<br>GCCTACATGGAGCTGAGCAGGCTGAGATCTGAC<br>GACACGGCCGTGTATTACTGTGCGAGAGATTTCT<br>ATGATAGTTGGTGGAGAAGGTGTTCGACCCTG<br>GGGCCAGGGAACCCTGGTCACCGTCCTCA<br>SEQ ID NO: 31641 |
| | | AA | QTVVTQEPSLTVSPGGTVTLTCASSTGAVTSAYY<br>PNWLQQKPGQAPRTLIYSTNNKHSWTPARFSGS<br>LLGGKAALTLSDVQPEDEAEYYCLIFYGGVHVIF<br>GGGTKLTVL<br>SEQ ID NO: 27636 | QVQLVQSGAEVKKPGASVKVSCKVSGYTFTGYNM<br>HWVRQAPGQGLEWMGWINPNSGGTNYAHKFQGR<br>VTMTRDTSISTAYMELSRLRSDDTAVYYCARDFYD<br>SGGEGWFDPWGQGTLVTVSS<br>SEQ ID NO: 31642 |
| iPS:437006 | 21-225_192G2 | NA | CAGTCTGTGTTGACGCAGCCGCCCTCAGTGTC<br>TGCGGCCCCAGGACAGAAGGTCACCATCTCCT<br>GCTCTGGAAGCAGCTCCAACATTGGGAATAAT<br>TATGTATCCTGGTACCAGCAGCTCCCAGGAAC<br>AGCCCCCAAACTCCTCATTTATGACAATAATA<br>AGCGACCCTCAAGGATTCCTGACCGATTCTCT<br>GGCTCCAAGTCTGGCACGTCAGCCACCCTGGG<br>CATCACCGGACTCCAGACTGGGGACGAGGCC<br>GATTATTACTGCGGAACATGGGATAGCAGCCT<br>GAGTGCTGGGGTATTCGGCGGAGGGACCAAG<br>CTGACCGTCCTA<br>SEQ ID NO: 27637 | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAGCTATGGCAT<br>GCACTGGGTCCGCCAGGCTCCAGGCAAGGGGCT<br>GGAGTGGGTGACAGTTATATGGAATGATGGAAG<br>TAATAAATACTATGCAGAGACAATTCCAAGAACACG<br>ATTTACCATCTCCAGAAATGAACAGCCTGAGAGCCGAG<br>CTGTATCTGCAAATGAACAGCCTGAGAGCCGAG<br>GACACGGCTCTGTATTACTGTGCGAGAGATCTGG<br>ATAAGAGGAACTTTCCTTATTACTACTACTACGG<br>TATGGACGTCTGGGGCCAAGGGACCACGGTCAC<br>CGTCTCCTCA<br>SEQ ID NO: 31643 |

FIGURE 50
(Continued)

| | | | |
|---|---|---|---|
| | | AA | QSVLTQPPSVSAAPGQKVTISCSGSSSNIGNNYVS WYQQLPGTAPKLLIYDNNKRPSRIPDRFSGSKSG TSATLGITGLQTGDEADYYCGTWDSSLSAGVFG GGTKLTVL<br>SEQ ID NO: 27638 | QVQLVESGGGVVQPGRSLRLSCAASGFTFSSYGMH WVRQAPGKGLEWVTVIWNDGSNKYYADSVKGRF TISRDNSKNTLYLQMNSLRAEDTALYYCARDLDKR NFPYYYYGMDVWGQGTTVTVSS<br>SEQ ID NO: 31644 |
| iPS:437008 | 21-225_192E3 | NA | CAGACTGTGGTGACTCAGGAGCCCTCACTGAC TGTGTCCCAGGAGGGACAGTCAGTCACTCTCACCT GTGCTTTCAGCACTGATCAGTCAGTCACCAGTGGT TCCTATCCAAACTGGTTCCAGCAGAAACCTGG ACAAGCACCCAGGGCACTGATTTATAGTACAA ACAACAAAACACTCCTGACCCCTGCCCGGTTC TCAGGCTCCCTCCTTGGGGCAAAGCTGCCCT GACACTGTCAGGTGTGCAGCGTGAGGACGAG GCTGAGTATTACTGCCTGCTATACTATGGTGG TGCTCAGCTGGTGTTCGGCGGAGGGACCAAGC TGACCGTCCTA<br>SEQ ID NO: 27639 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGTTA CTACTGGAGCTGGATCCGCCAGCCCCCAGGGAA GGGCCTGGAGTGGATTGGGTACATCTATTACACT GGGAGCACCTACTACAACCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGACGATC CCCTCTACGGAATGGACGTCTGGGGCCAAGGGA CCACGGTCACCGTCCTCCTCA<br>SEQ ID NO: 31645 |
| | | AA | QTVVTQEPSLTVSPGGTVTLTCAFSTGSVTSGSY PNWFQQKPGQAPRALIYSTNNKHSWTPARFSGS LLGGKAALTLSGVQREDEAEYYCLLYYGGAQL VFGGGTKLTVL<br>SEQ ID NO: 27640 | QVQLQESGPGLVKPSQTLSLTCTVSGGSISSGGYYW SWIRQPPGKGLEWIGYIYYTGSTYYNPSLKSRVTIS VDTSKNQFSLKLSSVTAADTAVYYCARDDPLYGM DVWGQGTTVTVSS<br>SEQ ID NO: 31646 |

FIGURE 50
(Continued)

| | | | |
|---|---|---|---|
| iPS:437010 | 21-225_192G3 | NA | CAGGTCTGTGCTGACTCAGCCACCTCAGCGTC TGGGACCCCCGGACAGAGGGTCACCATGTCTT GTTCTGGAAGCAGCTCCAACATGGAAGTAAT ACTGTAAACTGGTACCAACAATTCCAGGAAC GGCCCCAAACTCCTCATCTATGGTAATAAGC AGCGGCCCTCAAGGTCTGGCACCTCAGCTCCTGGC GGCTCCAAGTCTGGCACCTCAGCTCCCTGGC CATCAGTGGGCTCCAGTCTGAGGATGACAGCTGG ATTATTACTGTGCAGCGTGGGAGGAGGACCAAGCT AATGGTTGGGGTGTTCGGCGGAGGGACCAAGCT GACCGTCCTA<br>SEQ ID NO: 27641<br>QSVLTQPPSASGTPGQRVTMSCSGSSSNIGSNTV NWYQQFPGTAPKLLIYGNKQRPSRVPDRFSGSK SGTSASLAISGLQSEDETDYYCAAWDDSLNGWV FGGGTKLTVL<br>SEQ ID NO: 27642 | CAGGTGCAGCTGCAGGAGTCGGGCCCAGGACTG GTGAAGCCGTCGGAGACCCTGTCCCTCACCTGCA CTGTCTCTGGTGGCTCCATCAGTAATTACTACTG GAGCTGGATCCGGCAGCCCCCGGGAAGGGACT GGAGTGGATTGGGCGGATCTATTCCAGTGGGAGC ACCAACTACAACCCCTCCCTCAAGAGTCGAGTCA CCATGTCAGTAGACACGTCCAAGAACCAGTTCTC CCTGAAGCTGAACTCTGTGACCGCCGCGGACACG GCCGTGTATTACTGTGCGAAAGGTGGGAGCTAA ACTACTGGGCCAGGGAACCCTGGTCACCGTCTC CTCA<br>SEQ ID NO: 31647<br>QVQLQESGPGLVKPSETLSLTCTVSGGSISNYYWS WIRQPAGKGLEWIGRIYSSGSTNYNPSLKSRVTMS VDTSKNQFSLKLNSVTAADTAVYYCAKGWELNY WGQGTLVTVSS<br>SEQ ID NO: 31648 |
| iPS:437012 | 21-225_192G7 | NA | CAGACTGTGGTGACTCAGGAGCCCTCACTGAC TGTGTCCCCAGGAGAACAGTCAGTCACTCTCACCT GTGCTTCCAGCACTGGAGCAGTCAGCAGTGGT AACTATCCACAGTGGTTCCAGCAGAAACCTGG ACAAGCACCCAGGCACTGATTTACAGTACAA CCAACAGAACATTCCTGGGGGCAAGCTGCCCT TCAGGCTCCCTCCCTCGGGTGTGCAGCCTGAGGACGAG GACACTGTCAGGTGTGCAGCCTGAGGACGAG GCTGAGTATTACTGCCTGTTCTACTATGGTGGT GCTCAGGTGATATTCGGCGGAGGGACCAAGCT GACCGTCCTA<br>SEQ ID NO: 27643 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTTA CTACTGGAGCTGGATCCGCCAGCACCCAGGGAA GGGCCTGGAGTGGATTGGGTACATCTATTACAGA GGGAGTACCTACTACAATCGTCCCTCAAGAGTC GAGTTACCACATATCAGTGGACACGTCTAAGAACCA GTTCTCCCTGAAACTGAACTCTGTGACTGCCGCG GACACGGCCGTGTATTACTGTGCGAGAGACTCCC CGGTGACAGGATTTGACTATTGGGGCCAGGGAAT CCTGGTCACCGTCTCCTCA<br>SEQ ID NO: 31649 |

FIGURE 50
(Continued)

| | | | | AA | QTVVTQEPSLTVSPGGTVTLTCASSTGAVTSGNYPQWFQQKPGQAPRALIYSTTNRHSWTPARFSGSLLGGKAALTLSGVQPEDEAEYYCLFYYGGAQVIFGGGTKLTVL<br>SEQ ID NO: 27644 | QVQLQESGPGLVKPSQTLSLTCTVSGGSISSGGYYWSWIRQHPGKGLEWIGYIYYRGSTYYNPSLKSRVTISVDTSKNQFSLKLNSVTAADTAVYYCARDSPVTGFDYWGQGILVTVSS<br>SEQ ID NO: 31650 |
|---|---|---|---|---|---|---|
| iPS:437014 | 21-225_192H8 | | | NA | CAGACTGTGGTGACTCAGGAACCCTCACTGACTGTGTCCCCAGGAGGACAGTCACTCTCACCTGTGCTTTCAGCACTGGAACAGTCACCAGTGGTTTCTATCCAAACTGGTTCCAGCAGAAACCTGGACAAGCACCCAGGCATTGATTTATATACAAGCAACAGACACTCCTGGACCCCTGCCCGGTTCTCAGGCTCCCTCCTTGGGGCAGGCTGCCCTGACACTGTCAGGTGTGCAGCTGAGGACGAGGCTGATTATTACTGCCTGTTCTATATGGTGGTGCTCAGCTGATGTTCGGCGGAGGGACCAAGCTGACCGTCCTA<br>SEQ ID NO: 27645 | CAGGTGCAGCTGCAGGAGTCGGGCCCAGGAGTGGTGAAGCCTTCACAGACCCTGTCCCTCACCTGCACTGTCTCTGGTGGCTCCATCAGCAGCAGTGGTGATCACTGATCCGCAGCACCCAGGGAAGGGCCTGGAGTGGATTGGGTACATCTATTACAGTGGGCCCACCTACTACAACCCGTCCCTCAAGAGTCGACTTACCATGTCAGCAGACACGTCTAAGAACCAGTTCTCCCTGAAGCTGAGCTCTGTGACTGCCGCGGACACGGCCGTGTATTACTGTGCGAGAGATAGCTCCCTCTACGGTATGGACGTCTGGGGCCAAGGGACAACGGTCACCGTCTCCTCA<br>SEQ ID NO: 31651 |
| | | | | AA | QTVVTQEPSLTVSPGGTVTLTCAFSTGTVTSGFYPNWFQQKPGQAPRALIYNTSNRHSWTPARFSGSLLGGMAALTLSGVQPEDEADYYCLLYYGGAQLMFGGGTKLTVL<br>SEQ ID NO: 27646 | QVQLQESGPGVVKPSQTLSLTCTVSGGSISSGGDYWSWIRQHPGKGLEWIGYIYYSGPTYYNPSLKSRLTMSADTSKNQFSLKLSSVTAADTAVYYCARDSSLYGMDVWGQGTTVTVSS<br>SEQ ID NO: 31652 |

FIGURE 50
(Continued)

| | | | | |
|---|---|---|---|---|
| iPS:437016 | 21-225_193A6 | NA | TCTTCTGAGCTGACTCAGGACCCTGCTGTGTCT GTGGCCTTGGGACAGACAGTCAGGATCACATG CCAAGGAGACAGCCTCAGAAGCTCAGCAGCCCC ACTGGTACCAGCAGAAGCCAGGACAGCAGGCCCC TGTACTTTTCATCTATGCTAAGAACAACCGGC CCTCAGGGATCCCAGACCGATTCTCTTGACTCC AACTCAGGAAACACAGCTTCCTTGACCATCAC TGGGGCTCAGGCGGAAGATGAGGCTGACTATT ACTGTAATTCCCGGGACAGCAGTGGTAACCAT CTGGTATTCGGCGGAGGGACCAAGCTGACCGT CCTA | CAGGTGCAGCTGACTCAGGAGGTCGGGCCAGGACTG GTGAAGCCTTCGGAGACCCTGTCCCTCACCTGCA CTGTCTCTGGTGGCTCCATCAGTAGTTACTACTG GAGCTGGATCGGCAGCCCCAGGAAGGGACT GGAGTGGATTGGGTATATCTATTACAGTGGGAGC ACCAACTACAACCCCTCCCTCAAGAGTCGAGTCA CCATATCAGTAGACACGTCAAGAACCAGTTCTC CCTGAAGCTGAGCTCTGTGACCGCTGCGGACACG GCCGTGTATTACTGTGCGGAGGATGGGAGCTAA ACTACTGGGGCCAGGGAACCCTGGTCACCGTCTC CTCA |
| | | | SEQ ID NO: 27647 | SEQ ID NO: 31653 |
| | | AA | SSELTQDPAVSVALGQTVRITCQGDSLRSYYAN WYQQKPGQAPVLFIYAKNNRPSGIPDRFSGSNSG NTASLTITGAQAEDEADYYCNSRDSSGNHLVFG GGTKLTVL | QVQLQESGPGLVKPSETLSLTCTVSGGSISSYYWSW IRQPPGKGLEWIGYIYYSGSTNYNPSLKSRVTISVDT SKNQFSLKLSSVTAADTAVYYCAGGWELNYWGQ GTLVTVSS |
| | | | SEQ ID NO: 27648 | SEQ ID NO: 31654 |
| iPS:437018 | 21-225_193H5 | NA | TCCTATGAACTGACTCAGCCACATCCTCAGTGTC CGTGTCCCCAGGACAGACAGCCAGCATCACCT GCTCTGGAGATAAATTGGGGGATAGATTTGCT TGCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACACAGCCACTCTGACCATCAG CGGGACCCAGGCTATGATGGGACAGCAGCACTCAG ACTGTCAGGCGTGGGACAGCAGCACTGCGGTA TTCGGCGGAGGGACCAAGCTGACCGTCCTA | GAGGTGCAGCTGGTGGAGTCTGGGGGAGGCTTG GTAATGCCTGGGGGGTCCCTTAGCCTCTCCTGTG CAGCCTCTGGATTCACTTTCAGTAACGCCTACAT GACCTGGGTCCGCCAGGCTCCAGGGAAGGGCT GGAGTGGGTTGGCCGTATTAAAAGCAAAACTGA TGGTGGGAACAAGACTACGCTGCACCGTGAA AGCCAGATTCACCATCTCAAGAGATGATTCAAA AAACACGCTGTATCTGCAAATGAACAGCTGAA AACCGAGGACACAGCCGTGTATTACTGTACCACA GATCCCCGGTGGTATCTTTGACTACTGGGGCCAGG GAACCCTGGTCACCGTCTCCTCA |
| | | | SEQ ID NO: 27649 | SEQ ID NO: 31655 |

FIGURE 50
(Continued)

| | | | |
|---|---|---|---|
| iPS:437020 | | AA | SYELTQPPSVSVSPGQTASITCSGDKLGDRFACW YQQKPGQSPVLVIYQDSKRPSGIPERFSGSNSGN TAITLTISGTQAMDEADYYCQAWDSSTAVFGGG TKLTVL<br><br>SEQ ID NO: 27650 | EVQLVESGGGLVMPGGSLSLSCAASGFTFSNAYMT WVRQAPGKGLEWVGRIKSKTDGGTTDYAAPVKG RFTISRDDSKNTLYLQMNSLKTEDTAVYYCTIDPG GIFDYWGQGTLVTVSS<br><br>SEQ ID NO: 31656 |
| | 21-225_193F11 | NA | CAGTATGTGTTGACGCAGCCGCCATCAGTGTC TGCGGCCCCAGGACAGAAGGTCACCATCTCCT GCTTCGGAGGCAGTCCAACATTGGGAATAAT TATGTATCCTGGTTCCAGCAGTTCCCAGGAAC AGCCCCAAATTCCTCATTTATGACAATAATA AGGGACCCTCAAGGGATTCTTGACCGATTATCT GGCTCCAAGTCTGGCACGTCAGCCACCCTGGA CATCACCGGACTCCAGAATGGGGACGAGGCC GATTATTACTGCGGAACATGGGATCGCACCAT GAGTGATTGGGTATTCGGCGGAGGGACCAAG CTGACCGTCCTA<br><br>SEQ ID NO: 27651 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGAC TTGAGTGGATGGGATGGATCAACCCTTACAGTGG TGGCACAAACTATGCACAGAAGTTTCAGGGCAG GGTCACCATGACCAGGGACACGTCCATCAGCAC AGCCTACATGGAACTGAGCAGGCTGAGATCTGA CGACACGGCCGTGTATTACTGTGCAGAGATAG AGCAGTGGCTGGAAACTACTTCTACTACGGTATG GACGTCTGGGGCCAAGGGACCACGGTCACCGTC TCCTCA<br><br>SEQ ID NO: 31657 |
| | | AA | QYVLTQPPSVSAAPGQKVTISCFGGSNIGNNYV SWFQQFPGTAPKFLIYDNNKRPSGILDRLSGSKS GTSATLDITGLQNGDEADYYCGTWDRTMSDWV FGGGTKLTVL<br><br>SEQ ID NO: 27652 | QVQLVQSGAEVKKPGASVKVSCKASGYTFTGYYM HWVRQAPGQGLEWMGWINPYSGGTNYAQKFQGR VTMTRDTSISTAYMELSRLRSDDTAVYYCARDRAV AGNYFYYGMDVWGQGTTVTSS<br><br>SEQ ID NO: 31658 |

FIGURE 50
(Continued)

| | | | |
|---|---|---|---|
| iPS:437022 | 21-225_194G5 | NA | CAGACTGTGGTTGACGCAGCCCTCACTGAC TGTGTCCCAGGAGGACAGTCACTCTCACCT GTGCTTCCAGCACTGGAGCAGTCACCAGTGGT AACTATCCAAACTGGTTCCAGAGAAACCTGG ACAAACACCCAGGCACTGATTTATAGTACAA GCACAAAACACTCCTGGACCCTGCCCGGTTC TCAGGCTCCCTCCTTGGGGCAAAGGTGCCT GACACTGTCAGGTGTGCAGCCTGAGGACGAG GCTGAGTATTACTGCCTGATCTACTATGGTGG TGCTCAGCTGATGTTCGGCGGAGGGACCAAGC TGACCGTCCTA<br>SEQ ID NO: 27653 | CAGGTGCAGTGCAGGAGTCGGGCCCAGGACTG GTGAAGCCTTCACAGACCCTGTCCCTCATCTGCA CTGTCTCTGGTGGCTCCATCAGAAGTGGTGGTGA CTACTGGAGCTGGATCCGCCAGCACCCAGGGAA GGGCCTGGAGTGGATTGGGTACATCTATTACAGT GGGAGCACTTACTACAACCGTCTCTCAAGAGTC GAGTTACCATATCAGTAGACACGTCTAAGAACCA GTTCTCCCTGAAGCTGAGCTCTGTGACTGCCGCG GACACGGCCGTTTATTACTGTGCGAGAGATCACT CCCTCTACGGTATGGACGTCTGGGGCCAAGGGAC CACGGTCACCGTCTCCTCA<br>SEQ ID NO: 31659 |
| | | AA | QTVVTQEPSLTVSPGGTVTLTCASSTGAVTSGNY PNWFQQKPGQTPRALIYSTSNKHSWTPARFSGSL LGGKGALTLSGVQPEDEAEYYCLIYYGGAQLMF GGGTKLTVL<br>SEQ ID NO: 27654 | QVQLQESGPGLVKPSQTLSLICTVSGGSIRSGGDYW SWIRQHPGKGLEWIGYIYYSGSTYYNPSLKSRVTIS VDTSKNQFSLKLSSVTAADTAVYYCARDHSLYGM DVWGQGTTVTVSS<br>SEQ ID NO: 31660 |
| iPS:437024 | 21-225_194F11 | NA | CAGTCTGTGTTGACGCAGCCGCCCTCAGTGTC TGCGGCCCCAGGACAGAAGGTCACCATCTCCT GCTCTGGAAGCAGTCCAACATTGGGAATAAT TATGTATCCTGGTACCAGCAGCTCCCAGGAAC AGCCCCCAAACTCCTCATTTATGACAATAATA AGCGACCCTCAGGGATTCCTGACCGATTCTCT GGCTCCAAGTCTGGCACGTCAGCCACCCTGGG CATCACCGGACTCCAGACTGGGGACGAGGCC GATTATTACTGCGGAACATGGGATAGCAGCCT GAGTGCTGGGGTTTTCGGCGGAGGGACCAAGC TGACCGTCCTA<br>SEQ ID NO: 27655 | CAGGTGCAGCTGGTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGACTCCGTGAAGGGCCG TAAAAATACCATGTAGACTCCGTGAAGGGCCG ATTTACCATCTCCAGAGACAATTCCAAGAACACG CTGTATCTGCAAATGAACAGCCTGAGAGCCGAG GACACGGCTCGTGTATTACTGTGCGAGAGATCTGG ATAAGAGGAACTTCCTTATTACTACTACTACGG TATGACGTCTGGGGGCCAAGGGACCACGGTCAC CGTCTCCTCA<br>SEQ ID NO: 31661 |

FIGURE 50
(Continued)

| | | | |
|---|---|---|---|
| | | AA | QSVLTQPPSVSAAPGQKVTISCSGSSSNIGNNYVS WYQQLPGTAPKLLIYDNNKRPSGIPDRFSGSKSG TSATLGITGLQTGDEADYYCGTWDSSLSAGVFG GGTKLTVL<br>SEQ ID NO: 27656 | QVQLVESGGGVVQPGRSLRLSCAASGFTFSSYGMH WVRQAPGKGLEWVAVIWNDGSKKYHVDSVKGRF TISRDNSKNTLYLQMNSLRAEDTALYYCARDLDKR NFPYYYYGMDVWGQGTTVTVSS<br>SEQ ID NO: 31662 |
| iPS:437026 | 21-225_194D12 | NA | CAGACTGTGTGACTCAGGAGCCCTCACTGAC TGTGTCCCAGGAGGACAGTCACTCACCT GTGCTTCCAGCACTGGAGCAGTCACCAGTGGT TCCTTCCAAGCTGGTTCCAGCAGAAACCTGG ACAAGCACCCAGGACACTGATTTATAGTACAA GCAACAGACACTCTCGACCCCTGCCCGGTTC TCAGGCTCCCTCCTTGGGGCAAAGCAGCCT GACACTGTCAGGTGTGCAGCCTGAGGACGAG GCTGACTATTACTGCCTGATCTACTATGTGGT GCTCAGCTGGCATTCGGCGGAGGGACCAAGCT GACCGTCCTA<br>SEQ ID NO: 27657 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGTGA CTACTGGAGCTGGATCCGCCAGCACCCAGGGAA GGGCCTGAGTGGATTGGGTACATCTATTACAGT GGGAGTACCTACTACAACCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGATGG GCTCGGCACGGTATGGACGTCTGGGGCCAAGGG ACCACGGTCACCGTCTCCTCA<br>SEQ ID NO: 31663 |
| | | AA | QTVVTQEPSLTVSPGGTVTLTCASSTGAVTSGSF PSWFQQKPGQAPRALIYSTSNRHSSTPARFSGSL LGGKAALTLSGVQPEDEADYCLIYYGGAQLAF GGGTKLTVL<br>SEQ ID NO: 27658 | QVQLQESGPGLVKPSQTLSLTCTVSGGSISSGGDYW SWIRQHPGKGLEWIGYIYYSGSTYNPSLKSRVTIS VDTSKNQFSLKLSSVTAADTAVYYCARDGARHGM DVWGQGTTVTVSS<br>SEQ ID NO: 31664 |

FIGURE 50
(Continued)

| | | | |
|---|---|---|---|
| iPS:437028 | 21-225_194G12 | NA | CAGTCTGTGTTGACGCAGCCGCCCTCAGTGTC TGCGGCCCCAGGACAGAAGGTCACCATCTCCT GCTCTGGAAGCAGCTCCAACATTGGGAATAAT TATGTATCCTGGTACCAGCAGCTCCCAGGAAC AGCCCCCAAACTCCTCATTTATGACAATAATA AGCGACCCTCAAGGATTCCTGACCGATTCTCT GGCTCCAAGTCTGGCACGTCAGCACCCTGGG CATCACCGGACTCCAGACTGGGGAGGAGGCC GATTATTACTGCGAACATGGGATAGCAGCCT GAGTGTTGGGGTATTCGGCGGAGGGACCAAG CTGACCGTCTTA<br><br>SEQ ID NO: 27659 | QSVLTQPPSVSAAPGQKVTISCSGSSSNIGNNYVS WYQQLPGTAPKLLIYDNNKRPSRIPDRFSGSKSG TSATLGITGLQTGEEADYYCGTWDSSLSVGVFG GGTKLTVL<br><br>SEQ ID NO: 27660 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGACAGTTATATGGAATGATGAAG TAATAAATACTATGCAGAGACAATTCCAAGAACACG ATTTACCATCTCCAGAGACAATTCCAAGAACACG CTGTATCTGCAAATGAACAGCCTGAGAGCCGAG GACACGGCTCTGTATTACTGTGCGAGAGATCTGG ATAAGAGGAACTTCCTTATTACTACTACTACGG TATGGACGTCTGGGGCCAAGGGACCACGGTCAC CGTCTCCTCA<br><br>SEQ ID NO: 31665 |
| iPS:437030 | 21-225_195E3 | AA | QVQLVESGGGVVQPGRSLRLSCAASGFTFSSYGMH WVRQAPGKGLEWVTVIWNDGSNKYYADSVKGRF TISRDNSKNTLYLQMNSLRAEDTALYYCARDLDKR NFPYYYYGMDVWGQGTTVTVSS<br><br>SEQ ID NO: 31666 | | |
| | | NA | TCCTATGAGCTGACTCAGCCACCCTCAGTGTC CGTGTCCCCAGGACAGACAGCCAGCATCACCT GCTCTGGAGATAAATTGGGGTATAGATCTGTT GAGCTGGATCCGCCAGGCTCCAGGAAGGGGCT TGCTGGTATCAGCAGAAGCCAGGCCAGTCCCC GGAGTGGGGTTTCATATATACTACTAGTAGTAAT TGTGCTGGTCATCTATGAAGATAGCAAGCGAC ACCATATACTACGCAGGACTCTGTGAAGGCCGAT CCCTCAGGGATCCCTGAGCGATTCTCTGGCTCC TCACCACTCTCCAGGACAACGCCAAGAACTCACT AACTCTGGGAACACAGCCACTCTGACCATCAG GTATCTGCAAATGAACAGCCTGAGAGAGCCGAGA CGGGACCCAGGCTGGGACTATGGATGAGGCTGACTATT CACGGCCGTATATTACTGTGCGAGAGATAGTCGA ACTGTCAGGCGTGGGACAGTGTCACTGTGGTA TATTTTGACTGGTTTGACTACTGGGGCCAGGGAA TTCGGCGGAGGGACCAAGCTGATCGTCCTA CCCTGGTCACCGTCTCTTCA<br><br>SEQ ID NO: 27661 | | SEQ ID NO: 31667 |

FIGURE 50
(Continued)

| | | | | |
|---|---|---|---|---|
| | | | SYELTQPPSVSVSPGQTASITCSGDKLGYRSVCW YQQKPGQSPVLVIYEDSKRPSGIPERFSGSNSGNT ATLTISGTQAMDEADYYCQAWDSVTVVFGGGT KLIVL SEQ ID NO: 27662 | QVQLVESGGGLVKPGGSLRLSCAASGFTFSDYYMS WIRQAPGKGLEWVSYITSSGNTIYYADSVKGRFTIS RDNAKNSLYLQMNSLRAEDTAVYYCARDSRYFD WPDYWGQGTLVTVSS SEQ ID NO: 31668 |
| iPS:437032 | 21-225_195H6 | AA | | |
| | | NA | CAGTCTGTGCTGACTCAGCCACCCTCAGCGTC TGGGACCCCCGGGCAGAGGGTCACCATCTCTT GTTCTGGAAGCAGCTCCAACATCGGAAGTCAT ACTGTAAACTGGTACCAGCAACTCCCAGAAC GGCCCCCAAACTCCTCATCTATGAGGACAGC AAGCGGCCCTCAGGGGTCCCTGACCGATTCTCT GGCTCCAAGTCTGGCACCTCAGCCTCCCTGAC CATCAGTGGGCTCCAGTCTGAGGATGAAGGCTG ATTATTACTGTGCAACATGGGATGACAGCGTG AGTGTTTGGGTGTTCCGCGGAGGGACCAAGGT GACCGTCCTA SEQ ID NO: 27663 | CAGGTGCAGCTGCAGGAGTCGGGCCCAGGACTG GTGAAGCCTTCGGAGACCCTGTCCCTCACCTGCA CTGTCTCTGGTGGCTCCATCAGGAATTACTACTG GAGCTGGATCCGGCAGCCCGCCGGGAAGGGACT GGAGTGGATTGGGCGTATCTATAGCAGTGGGAG CACCAACTACAACCCCTCCCTCAAGAGTCGAGTC TCCATGTCAGTAGACACGTCCAAGAACCAGTTCT CCCTGAAGCTGAGTTCTGTGACCGCCGCGGACAC GGCCGTGTATTACTGTACGAGAGAGGTGGGAGCTA AACAACTGGGGCCAGGGAACCCTGGTCACCGTC TCCTCA SEQ ID NO: 31669 |
| | | AA | QSVLTQPPSASGTPGQRVTISCSGSSSNIGSHTVN WYQQLPGTAPKLLIYNNYQRPSGVPDRFSGSKS GTSASLTISGLQSEDEADYYCATWDDSLSVVVF GGGTKVTVL SEQ ID NO: 27664 | QVQLQESGPGLVKPSETLSLTCTVSGGSIRNYYWS WIRQPAGKGLEWIGRIYSSGSTNYNPSLKSRVSMSV DTSKNQFSLKLSSVTAADTAVYYCTRGWELNNWG QGTLVTVSS SEQ ID NO: 31670 |

FIGURE 50
(Continued)

| | | | | |
|---|---|---|---|---|
| iPS:437034 | 21-225_195E9 | NA | TCCTATGAGCTGACTCAGCCACCCTCAGTGTCCGTGTCCCCAGGACAGAGACAGCCAGCATCACCTGCTCAGGAGATAAATTGGGGAATAAATATGCTTACTGGTATCAGCAGAAGCCAGGCCAGTCCCCTGTGCTGGTCATCTATCAAGATAGGAAGCGGCCCTCAGGGATCCCTGAGCGATTCTCTGGCTCCAATTCTGGGAACACAGGGTATGATGAGGCTGACTATTACTGTCAGGCGTGGGACAGAGGAATTGTGGTATTCGGCGGAGGGACCAAGCTGACCGTCCTA<br><br>SEQ ID NO: 27665 | CAGGTGCAGGTGGTGCAGTCTGGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAAGGCTTGAGTGGATGGATCAACCCTAACAGTGGTGCCACAAACTATGCACAGAAGTTTCAGGGCAGGGTCACCATGACCAGGGACACGTCCATCAGCACAGCCTACATGGAGCTGAACAGGCTGAGATCTGAGACGGCCGTGTATTACTGTGCGAGAGCCTATTACTATGGTTCGGGGACTTATTATAACGAGTTCGACTACTGGGGCCAGGGAACCCTGGTCACCGTCTCCTCA<br><br>SEQ ID NO: 31671 |
| | | AA | SYELTQPPSVSVSPGQTASITCSGDKLGNKYAYWYQQKPGQSPVLVIYQDRKRPSGIPERFSGSNSGNTGTLTISGTQGMDEADYYCQAWDRGIVVFGGGTKLTVL<br><br>SEQ ID NO: 27666 | QVQVVQSGAEVKKPGASVKVSCKASGYTFTGYYMHWVRQAPGQGLEWMGWINPNSGATNYAQKFQGRVTMTRDTSISTAYMELNRLRSDDTAVYYCARAYYYGSGTYYNEFDYWGQGTLVTVSS<br><br>SEQ ID NO: 31672 |
| iPS:437036 | 21-225_195H9 | NA | CAGGTGCAGCTGGTGGACGCGCCCCTCAGTGTCTGCGGCCCCAGGACAGAGAGGGTCACCATCTCCTGTTCTGGAAGCAGCTCCAACATTGGGAATAATTATGTATCCTGGTTCCAGCAGTTCCCAGGAACAGCCCCCAAATTCCTCATTTATGACAATAATAGCGACCCCTCAAGTCTGGCACGTCAGCCACCCTGGGCATCACCGGACTCCAGACTGGGGACGAGGCCGATTATTACTGCGGAACATGGGATCGCACCATGAGTGATTGGGTATTCGGCGGAGGGACCAAGTTGACCGTCCTA<br><br>SEQ ID NO: 27667 | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAAGGCTTGAGTGGATGGATCAACCCTTACAACGGTGGCACAAACTATGCACAGAAGTTCAGGACAGGGTCACCATGACCAGGGACACGTCCATCAGCACAGCCTACATGGAACTGAGCAGGCTGAGATCTGACGACGGCCGTGTATTACTGTGTGAGAGATAGAGCAGTGGCTGGAAACTACTTCTACTACGGTATGGACGTCTGGGGCCAGGGGACCACGGTCACCGTCTCCTCA<br><br>SEQ ID NO: 31673 |

FIGURE 50
(Continued)

| | | | |
|---|---|---|---|
| iPS:437040 | 21-225_196E7 | AA | QYVLTQPPSVSAAPGQKVTISCSGGSSNIGNNYV SWFQQFPGTAPKFLIYDNNKRPSGILDRFSGSKS GTSATLGITGLQTGDEADYYCGTWDRTMSDWV FGGGTKLTVL<br>SEQ ID NO: 27668 | QVQLVQSGAEVKKPGASVKVSCKASGYTFTGYYM HWVRQAPGQGLEWMGWINPYSGGTNYAQKFQDR VTMTRDTSITTAYMELSRLRSDDTAVYYCARDRAV AGNYFYYGMDVWGQGTTVTVSS<br>SEQ ID NO: 31674 |
| | | NA | CAGACTGTGGTGACTCAGGAGCCCTCACTGAC TGTGTCCCCAGGAGGACAGTCACTCTCACCT GTGCTTCCAGCACTGGAGCAGTCACCAGTGCT TACTATCCAAACTGGTTGCAGCAGAAACCTGG ACAAGCACCCAGGACACTGATTTATAGTACAA ACAACACAAACACTCTGGACCCTGCCGGTTC TCAGGCTCCCTCCTTGGGGCAAAGCTGCCCT GACACTGTCAGATGTGCAGCCTGAGGACGAG GCTGAGTATTACTGCCTGATTTCTATGGTGGT GTACATGTGATATTTGGCGGAGGGACCAAGCT GACCGTCCTA<br>SEQ ID NO: 27669 | CAGGTGCAGCTGGTGCAGTCTGGGGCTGAGGTG AAGAAGCCTGGGGCCTCAGTGAAGGTCTCCTGTA AGGTTTCTGATATACCTTCACCGGCTACAATAT GCACTGGGTGCGACAGGCCCCTGGACAAGGGCT TGAGTGGATGGGATGGATCAACCTAATAGTGGT GGCACAAACTATGCACACAAGTTCAGGACAGG GTCACCATGACCAGGGACACGTCCATCAGCACA GCCTACATGGAACTGAGCAGGCTGAGATCCGAC GACACGGCCGTGATTACTGTGCGAGAGATTACT ATGATACTAGTGGAGAAGGGTTGGTTCGACCCTG GGGCCAGGGAACCCTGGTCACCGTCTCCTCA<br>SEQ ID NO: 31675 |
| | | AA | QTVVTQEPSLTVSPGGTVTLTCASSTGAVTSAYY PNWLQQKPGQAPRTLIYSTNNKHSWTPARFSGS LLGGKAALTLSDVQPEDEAEYYCLIFYGGVHVIF GGGTKLTVL<br>SEQ ID NO: 27670 | QVQLVQSGAEVKKPGASVKVSCKVSGYTFTGYNM HWVRQAPGQGLEWMGWINPNSGGTNYAHKFQGR VTMTRDTSISTAYMELSRLRSDDTAVYYCARDYYD TSGEGWFDPWGQGTLVTVSS<br>SEQ ID NO: 31676 |

FIGURE 50
(Continued)

| | | | |
|---|---|---|---|
| iPS:437042 | 21-225_197E8 | NA | CAGTCTGTGTTGACGCAGCCGCCCTCAGTGTC TGCGGGCCCAGACAGAGAAGGTCACCATCTCCT GCTCTGGAAGCAGCTCCAACATTGGGAATAAA TATGTATCCTGGTACCAGCAGTTCCCAGGAAC AGCCCCCAAACTCCTCATTTATGACAATAATA AGCGACCCTCAAAGATTCTGACCGATTCTCT GGCTCCAAATCTGGCACGTCAGCCACCCTGGG CATCACCGGACTCCTGACTGGGGACGAGGCCG ATTATTACTGCGGAATATGGGATCGCAGTCTG AGTGTTATGGTGTTCGGCGGAGGGACCAAGCT GACCGTCCTA SEQ ID NO: 27671 | CAGGTGCAGCTGCTGCAGTCTGGGGCTGAGGTG AGGAAGCCTGGGGCCTCAGTGAGGGTCTCTGC AAGGCTTCTGATACACCTTCACCGGCTACTATA TACACTGGGTGCGACAGGCCCCTGGACAAGGGC TTGAGTGGATGGGATGGATCAACCCTAACAGTGG TGGCACAAACTATGCACAGAGGTTCAGGCAG GGTCACCATGACCAGGGACACGTCCATCAGCAC AGCCTACATGGAGCTGAGCAGGCTGAGATCTGA CGACACGGCCGTGTATTACTGTGCGAGAGAGAT AGCAGTGGCTGGGAACTACTTCTACTACGGTATG GGCGTCTGGGGCCAAGGGACCACGGTCGCCGTC TCCTCA SEQ ID NO: 31677 |
| | | AA | QSVLTQPPSVSAAPGQKVTISCSGSSSNIGNKYVS WYQQFPGTAPKLLIYDNNKRPSKIPDRFSGSKSG TSATLGITGLLTGDEADYYCGIWDRSLSVMVFG GGTKLTVL SEQ ID NO: 27672 | QVQLLQSGAEVRKPGASVRVSCKASGYTFTGYYIH WVRQAPGQGLEWMGWINPNSGGTNYAQRFQGRV TMTRDTSISTAYMELSRLRSDDTAVYYCAREIAVA GNYFYYGMGVWGQGTTVAVSS SEQ ID NO: 31678 |
| iPS:437044 | 21-225_197F9 | NA | CAGTCTGTGTTGACTCAGCCACCCTCAGCGTC TGGGACCCCCGGGCAGAGGGTCACCATCTCTT GTTCTGGAAGCAGTCCAACATCGGAAGTAAT ACTGTAAACTGGTACCAGCAACTCCCAGGAAC GGCCCCCAAACTCCTCATTTATAGTAATAATC AGCGGCCCTCAGGGGTCCCTGACCGATTCTCT GGCTCCAAGTCTGGCACCTCAGCTCCCTGGC CATCAGTGGGCTCCAGTCTGAGGATGACAGTG ATTATTACTGTGCAGCATGGGATGACAGTCTG AATGGTCCGGTGTTCGGCGGAGGGACCAAGCT GACCGTCCTA SEQ ID NO: 27673 | CAGGTGCAGCTGCAGGAGTCGGGCCCAGGACTG GTGAAGCCTTCGGAGACCCTGTCCCTCACCTGCA CTGTCTCTGGTGGCTCCATCAGAATTTACTACTG GAGCTGGATCCGGCAGCCCCAGGGAAGGACT GGAGTGGATTGGGTATGTCTATTACAGTGGGAGC ACCACCTACAACCCCTCCCTCAAGAGTCGAGTCA CCATATCAGTAGACACGTCCAAGAACCAGTTCTC CCTGAAGCTGAACTCTGTGACCGCTGCGGACACG GCCGTGTATTACTGTGTGAGAGAAAGGGGAGT AGCCACAGATGGGGGACTACTACGGAATGGAC GTCGGGGCCGAGGGACCACGGTCACCGTCTCCT CA SEQ ID NO: 31679 |

FIGURE 50
(Continued)

| | | | | |
|---|---|---|---|---|
| | | AA | QSVLTQPPSASGTPGQRVTISCSGSSNIGSNTVN WYQQLPGTAPKLLIYSNNQRPSGVPDRFSGSKS GTSASLAISGLQSEDEADYYCAAWDDSMNGPVF GGGTKLTVL<br>SEQ ID NO: 27674 | QVQLQESGPGLVKPSETLSLTCTVSGGSIRIYYWSW IRQPPGKGLEWIGYVYYSGSTTYNPSLKSRVTISVD TSKNQFSLKLNSVTAADTAVYYCVRERGSSHRWG DYYGMDVWGRGTTVTVSS<br>SEQ ID NO: 31680 |
| iPS-437048 | 21-225_197B11 | NA | CAGACTGTGGTGACTCAGGAGCCCTCACTGAC TGTGTCCCCAGGAGGGACAGTCACTCTCACCT GTGCTTTCAGCACTGGATCAGTCACCAGTGGT TCCTATCCAAACTGGTTCCAGCAGAAACCTGG ACAAGCACCCAGGGCACTGATTTATAGTACAA ACAACAAACACTCCTGGACCCCTGCCGGTTC TCAGGCTCCCTCCTTGGGGGCAAAGCTGCCCT GACACTGTCAGGTGTGCAGCCTGAGGACGAG GCTGAGTATTACTGCCTGCTCTACTATGGTGGT GCTCAGCTGGTGTTCGGCGGAGGGACCAAGCT GACCGTCCTA<br>SEQ ID NO: 27675 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGTTA CTACTGGAGCTGGATCCGCCAGCCCCCAGGGAA GGGCCTGGAGTGGATTGGGTACATCTATTACACT GGGAGCACCTACTACAACCCGTCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGACGATC CCCTCTACGAATGGACGTCTGGGGCCAAGGGA CCACGGTCACCGTCCTCA<br>SEQ ID NO: 31681 |
| | | AA | QTVVTQEPSLTVSPGGTVTLTCAFSTGSVTSGSY PNWFQQKPGQAPRALIYSTNNKHSWTPARFSGS LLGGKAALTLSGVQPEDEAEYYCLLYYGGAQL VFGGGTKLTVL<br>SEQ ID NO: 27676 | QVQLQESGPGLVKPSQTLSLTCTVSGGSISSGYYW SWIRQPPGKGLEWIGYIYYTGSTYYNPSLKSRVTIS VDTSKNQFSLKLSSVTAADTAVYYCARDDPLYGM DVWGQGTTVTVSS<br>SEQ ID NO: 31682 |

FIGURE 50
(Continued)

| | | | |
|---|---|---|---|
| iPS-437050 | 21-225_197C11 | NA | CAGACTGTGGTGACTCAGGAGCCCTCACTGAC TGTGTCCCCAGGACAGTCACTCACCT GTGCTTCCAGCACTGGAGCAGTCACCAGTGCT TACTATCCAAACTGGTTGCAGCAGAAACCTGG ACAAGCACCCAGGACAACCTGATTATAGTACAA GCAACAAACACTCCTGACCCTCGCCCGGTC TCAGGCTCCCTCCTTGGGGCAAAGCTGCCCT GACACTGTCAGATGTGCAGCCTGAGGACGAG GCTGAGTATTACTGCCTGATCTTCTATGGTGGT GTACATGTGATATTTGGCGGAGGGACCAAGCT GACCGTCCTA<br><br>SEQ ID NO: 27677 | CAGGTGCAGCTGGTGGTGCAGTCTGGGGCTGAGGTG AAGAAGCCTGGGGCCTCAGTGAAGGTCTCCTGTA AGGTTTCTGGATATACCTTCACCGGCTACAATAT GCACTGGGTGCGACAGGCCCCTGGACAAGGGCT TGAGTGGATGGGATGGATCAACCTAATAGTGGT GGCACAAACTATGCACACAAGTTTCAGGGCAGG GTCACCATGACCAGGGACACGTCCATCAGCACA GCCTACATGGAGCTGAGCAGGCTGAGATCTGAC GACACGGCCGTGTATTACTGTGCCAGAGATTACT ATGATAGTAGTGGAGAAGGTGGTTCGACCCTG GGGCCAGGGAACCCTGGTCACCGTCCTCCTCA<br><br>SEQ ID NO: 31683 |
| | | AA | QTVVTQEPSLTVSPGGTVTLTCASSTGAVTSAYY PNWLQQKPGQAPRTLIYSTSNKHSWTPARFSGS LLGGKAALTLSDVQPEDEAEYYCLIFYGGVHVIF GGGTKLTVL<br><br>SEQ ID NO: 27678 | QVQLVQSGAEVKKPGASVKVSCKVSGYTFTGYNM HWVRQAPGQGLEWMGWINPNSGGTNYAHKFQGR VTMTRDTSISTAYMELSRLRSDDTAVYYCARDYYD SSGEGWFDPWGQGTLVTVSS<br><br>SEQ ID NO: 31684 |
| iPS-437054 | 21-225_194G3 | NA | CAGTCTGTGTTGACGCAGCCGCCCTCAGTGTC TGCGCCCCAGGACAGAAGGTCACCATCTCCT GCTCTGGAAGCAGCTCCAACATCGGGAATAAT TATATATCCTGGTACCAGCAGCTCCCAGGAAC AGCCCCCAAACTCCTCATTTATGACAATAAAA AGCGACCCTCAGGGATTCCTGACCGATTCTCT GGCTCCAAGTCTGGCACGTCAGCCACCCTGGG CATCACCGGACTCCAGACTGGGGACGAGGCC GATTATTACTGCGGAACATGGGATAGCAGCCT GAGTGTTTGTGTCTTCGGAACTGGGACCAAGG TCACCGTCCTA<br><br>SEQ ID NO: 27679 | CAGGTGCAGCTGGTGGTGAGTCTGGGGAGGCGTG GTCCAGCCTGGGAGGTCCCTGAGACTCTCCTGTG CAGCGTCTGGATTCACCTTTAGTTTCCATGGCAT GCACTGGGTCCGCCAGGCTCCAGGCAAGGGGCT GGAGTGGGTGGCAGTTATATGCAGACTCCGTGAAGT AAAAAATACTATGCAGACTCCGTGAAGGGCCGA TTCACCATCTCCAGAGACAATTCCAAGAACACGC TGCATCTGCAAATGAACAGTCTGAGAGCCGAGG ACACGGCTGTGTATTACTGTGCGAAAGAAGGGTT TAGCAGTGGCTTTTACAGGGGGTTTGACAACTGG GGCCAGGGAACCCTGGTCACCGTCCTCA<br><br>SEQ ID NO: 31685 |

FIGURE 50
(Continued)

| | | | |
|---|---|---|---|
| iPS-4370S6 | 21-225_198B8 | AA | QSVLTQPPSVSAAPGQKVTISCSGSSSNIGNNYIS WYQQLPGTAPKLLIYDNKKRPSGIPDRFSGSKSG TSATLGITGLQTGDEADYYCGTWDSSLSVCVFG TGTKVTVL<br>SEQ ID NO: 27680 | QVQLVESGGGVVQPGRSLRLSCAASGFTFSFHGMH WVRQAPGKGLEWVAVIWYDGSKKYYADSVKGRF TISRDNSKNTLHLQMNSLRAEDTAVYYCAKEGFSS GFYRGFDNWGQGTLVTVSS<br>SEQ ID NO: 31686 |
| | | NA | CAGACCCTGGTGACTCAGGAGTCCTCACTGAC TGTGTCCCCAGGAGGACAGTCACTCTCACTT GTGTTCTTAGCACTGGAGCAGTCACCAGTGGT TCCTTCCAAACTGGTTCCAGCAGAAACCTGG ACAAGCACCCAGGGCTCTGATTTATAGTACAA GCAACAAACATTCTGACCCCTGCCCGGTTT TCAGGCTCCCTCCTTGGGGACCCTGAGGACGAGG GACATTGTCAGGTGTGCAGCTGAGGACGAGG CTGATTATTACTTCAGCTTTACAGTGGTGGAG CTCAGATGTGTTCGGCGGAGGGACCAAGCTG ACCGTCCTA<br>SEQ ID NO: 27681 | CAGGTGCAGTGCAGGAGTCGGGCCCAGGACTG GTGAAGCCTTCACAGACCCTGTCCCTCACCTGCA CTGTCTCTGGTGGCTCCATCAGAAGTGGTGGTGA CTACTGAGCTGGATCCGCCAGCACCCAGGGA GGGATCACCTACTACAATCGTCCCTCAAGAGTC GAGTTACCATATCAGTAGACACGTCTAAGAACCA GTTCTCCCTGAAGCTGAGCTCTGTGACTGCCGG GACACGGCCGTGTATTACTGTGCGAGAGATAGC AGCTCGCGGGTATGGACGTCTGGGGCCAAGGG ACCACGGTCACCGTCTCCTCA<br>SEQ ID NO: 31687 |
| | | AA | QTVVTQESSLTVSPGGTVTLTCVLSTGAVTSGSF PNWFQQKPGQAPRALIYSTSNKHSWTPARFSGS LLGGKAALTLSGVQPEDEADYFMLYSGGAQM VFGGGTKLTVL<br>SEQ ID NO: 27682 | QVQLQESGPGLVKPSQTLSLTCTVSGGSIRSGGDY WSWIRQHPGEGLEWIGYIYYSGITYYNPSLKSRVTI SVDTSKNQFSLKLSSVTAADTAVYYCARDSSSRGM DVWGQGTTVTVSS<br>SEQ ID NO: 31688 |

FIGURE 50
(Continued)

| | | | |
|---|---|---|---|
| iPS:437058 | 21-225_199F3 | NA | CAGTCTGTGTTGACGCAGCCGCCCTCAGTGTC TGCGGCCCCAGGACAGGAAGGTCACCATCTCT GCTCTGGAAGCAGCTCCAACATTGGGAATAAT TATGTATCCTGGTACCAGCAACTCCCAGAAC AGCCCCCAAACTCCTCATTTATGACAATAATA AGCGCCCCTCAGGGATTCCTGACCGATTCTCT GGCTCCAAGTCTGGCACGTCAGCCACCCTGGG CATCACCGGCCTCCAGACTGGGGACGAGGCG ATTATTACTTGCGGAACATGGGATAGCAGCCTG AGTGCTTGTGTCTTCGGAACTGGGACCAAGGT CACCGTCCTA<br>SEQ ID NO: 27683 | CAGGTGCAGCTGGTGGAGTCTGGGGGAGGCGTG GTCCAGCCTGGGAGGTCCCTGAGACTCTCCTGTG CAGCGTCTGGATTCACCTTCAGTTTCTATGGCAT GCACTGGGTCCGCCAGGCTCCAGGCAAGGGGCT GGAGTGGGTGGCAGTTATTTGGTATGATGGAAGT AGTAAATACTATGCAGACTCCGTGAAGGGCCGA TTCACCGTCTCCAGAGACAATTCCAAGAACACGC TGTATCTGCAAATGAACAGCCTGAGAGCCGAGG ACACGGCTGTGTATTATTGTGCGAAAGAAGGTA TAGCAGTGGCTTTTACAGGGGATTGCCAACTGG GGCCAGGGAACCCTGGTCACCGTCTCCTCA<br>SEQ ID NO: 31689 |
| | | AA | QSVLTQPPSVSAAPGQKVTISCSGSSSNIGNNYVS WYQQLPGTAPKLLIYDNNKRPSGIPDRFSGSKSG TSATLGITGLQTGDEADYYCGTWDSSLSACVFG TGTKVTVL<br>SEQ ID NO: 27684 | QVQLVESGGGVVQPGRSLRLSCAASGFTFSFYGMH WVRQAPGKGLEWVAVIWYDGSSKYYADSVKGRF TVSRDNSKNTLYLQMNSLRAEDTAVYYCAKEGYS SGFYRGFANWGQGTLVTVSS<br>SEQ ID NO: 31690 |
| iPS:437060 | 21-225_199C3 | NA | CAGTCTGTGTTGACTCAGCCACCCTCAGCGTC TGGGACCCCCGGGCAGAGGGTCACCATCTCTT GTTCTGGAAGCAGCTCCAACATCGGAAGTAAT ACTGTAAACTGGTACCAGCAGCTCCCAGGAAC GGCCCCCAAACTCCTCATTTATAGTAATAATC AGCGGCCCTCAGGGGTCCCTGACCGATTCTCT GGCTCCAAGTCTGGCACCTCAGCTCCCTGGC CATCAGTGGGCTCCAGTCTGAGGATGGAGGCTG ATTATTACTTGTGCAGCATGGATGACAGCCTG AATGGTCCGGTGTTCGGCGGAGGGACCAAGCT GACCGTCCTA<br>SEQ ID NO: 27685 | CAGGTGCAGCTGCAGGAGTCGGGCCCAGGACTG GTGAAGCCTTCGGAGACCCTGTCCCTCACCTGCA CTGTCTCTGGTGGCTCCATCAGAATTTACTACTG GAGCTGGATCCGGCAGCCCCCAGGGAAGGGACT GGAGTGGATTGGATATATCTATTACAGTGGGAGC ACCAACTACAACCCCTCCCTCAAGAGTCGAGTCA CCATATCAGTAGACACGTCCAAGAACCAGTTCTC CCTGAAGCTGAACTCTGTGACCGCTGCGGACACG GCCGTGTATTACTGTGTGAGAGAAGGGGAGT AGCCACAGATGGGGGACTACTACGGAATGGAC GTCTGGGGCCAGGGGACCACGGTCACCGTCTCCT CA<br>SEQ ID NO: 31691 |

FIGURE 50
(Continued)

| | | | | |
|---|---|---|---|---|
| | | AA | QSVLTQPPSASGTPGQRVTISCSGSSSNIGSNTVN WYQQLPGTAPKLLIYSNNQRPSGVPDRPSGSKS GTSASLAISGLQSEDEADYYCAAWDDSLNGPVF GGGTKLTVL<br>SEQ ID NO: 27686 | QVQLQESGPGLVKPSETLSLTCTVSGGSIRIYYWSW IRQTPGKGLEWIGYIYYSGSTTYNPSLKSRVTISVDT SKNQFSLKLNSVTAADTAVYYCVRERGSSHRWGD YYGMDVWGRGTTVTVSS<br>SEQ ID NO: 31692 |
| iPS:437062 | 21-225_200H1 | NA | CAGACTGTGGTGACTCAGGAGCCCTCACTGAC TGTGTCCCAGGAGGGACAGTCACTCTCACCT GTGCTTCCAACACTGGAGCAGTCACCAGTGGT TCCTATCCAAACTGGTTCCAGCAGAAACCTGG ACAGGCACCCAGGGCACTGATTTATCATACAA ACAACAAACACTCTCGACCCTGCCCGGTTC TCAGGCTCCTCCTCAGGTGCAGCCTGAGGACGAG GCTGAATATTACTGTCTGATCTACTATGGTGTT GCTCAGTGGTGTTCGGCGGAGGGACCAAGCT GACCGTCCTA<br>SEQ ID NO: 27687 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGTGA CTATTGGAGCTGGATCCGCCAGCACCCAGGGAA GGGCCTGGAGTGGATTGGGTACATCTATTATAGT GGGAGCACCTACTACAACCGTCCCTCAAGAGTC GAGTTACCATATCAGTAGACACGTCTAAGAACCA GTTCTCCCTGAAGCTGAACTGTGTGACTGCCGCG GACACGGCCGTGTATTACTGTGCGAGAGATGGA GCAGCTCTGGTATGGACGTCTGGGGCCAAGGG ACCACGGTCACCGTCTCCTCA<br>SEQ ID NO: 31693 |
| | | AA | QTVVTQEPSLTVSPGGTVTLTCASNTGAVTSGSY PNWFQQKPGQAPRALIYHTNNKHSWTPARFSGS LLGGKAALTLSGVQPEDEAEYYCLIYYGGAQLV FGGGTKLTVL<br>SEQ ID NO: 27688 | QVQLQESGPGLVKPSQTLSLTCTVSGGSISSGGDYW SWIRQHPGKGLEWIGYIYYSGSTYYNPSLKSRVTIS VDTSKNQFSLKLNSVTAADTAVYYCARDGAALGM DVWGQGTTVTVSS<br>SEQ ID NO: 31694 |

FIGURE 50
(Continued)

| | | | |
|---|---|---|---|
| iPS:437064 | 21-225_200G8 | NA | CAGTCTGTGTTGACGCAGCCGCCCTCAGTGTCTGCGGCCCCAGGACAGAGGGTCACCATCTCCTGCTCTGGAAGCAGCTCCAACCTTGGAAATAATTTTGTATCCTGGTACCAGCAGTTCCCAGGAACAGCCCCAAACTCTCATTTATGACAATTATAAGCGACCCTCAGGGATTCCTGACCGATTCTCTGTCTCCAAGTCTGGCACGTCAGCCACCCTGGGCATCACCGGACTCCAGACTGGGGACGAGGCCGATTATTACTGCGAACTTGGGATAGCAGCCTGAATACTGGGGTATTCGGCGGAGGGACCAAGCTGACCGTCCTA CAGGTGCAGCTGCAGGAGTCGGGCCCAGGACTGGTGAAGCCTTCGGAGACCCTGTCCCTCACCTGCACTGTCTCTGGTGGCTCCATCAGAAGTTACTACTGGAGCTGGATCCGGCAGCCCCCAGGGAAGGGACTGGAGTGGATTGGGTATATCTATTACAGTGGGAGTACTAAGTACAACCCCTCCCTCAAGAGTCGAGTCACCATATCAGTAGACACGTCCAAGAACCAGTTCTCCCTGAAACTGAGCTCTGTGACCGCTGCGGACACGGCCGTGTACTACTGTGCGAGAAAGGGAGTGGGAACCATCACCACTTTGACTACTGGGGCCAGGGAACCCTGGTCACCGTCTCCTCA |
| | | | SEQ ID NO: 27689 | SEQ ID NO: 31695 |
| | | AA | QSVLTQPPSVSAAPGQRVTISCSGSSSNLGNNFVSWYQQFPGTAPKLLIYDNYKRPSGIPDRFSVSKSGTSATLGITGLQTGDEADYYCGTWDSSLNTGVFGGGTKLTVL | QVQLQESGPGLVKPSETLSLTCTVSGGSIRSYYWSWIRQPPGKGLEWIGYIYYSGSTKYNPSLKSRVTISVDTSKNQFSLKLSSVTAADTAVYYCARKGVGTIHFDYWGQGTLVTVSS |
| | | | SEQ ID NO: 27690 | SEQ ID NO: 31696 |
| iPS:437066 | 21-225_200G9 | NA | CAGACTGTGGTGACTCAGGAGCCCTCACTGACTGTGTCCCCAGGAGGACAGTCAGTCACTCTCACCTGTGCTTCCAACACTGGAGCAGTCAGTCACCAGTGGTTCCTATCCAAATTGGTTACAGCAGAAACCTGGACAAGCACCCAGGACACTGATTTATCATACAGACAAACAACACTCTGAAGTCCTGGGGTCCCTGAGGACGACGAGTCAGGCTGGTGCGCAGCCTGAGGACGAGGCTGACTACTACTGTGCTGAATATTACTGTGTCGATCTACTATGGTGGTGCTCAGCTGGTGTTCGGCGGAGGGACCAAGCTGACCGTCCTA | CAGGTGCAGCTGCAGGAGTCGGGCCCAGGACTGGTGAAGCCTTCACAGACCCTGTCCTCACCTGCACTGTCTCTGGTGGCTCCATCAGCAGTAGTGGTGGTGACTACTGGAGCTGGATCCGCCAGCACCCAGGGAAGGGCCTGGAGTGGATTGGGTACATCTATTACAGTGGGAGCACCTACTACAACCCGTCCCTCAAGAGTCGAGTTACCATATCAGTAGACACGTCTAAGAACCAGTTCTCCCTGAAGCTGAACTCTGTGACTGCCGCGGACACGGCCGTGTATTACTGTGCGAGAGATGGAGCAGCTCTGGGTTCGGACGCTGTGGGGCCAAGGGACCACGGTCACCGTCTCCTCA |
| | | | SEQ ID NO: 27691 | SEQ ID NO: 31697 |

FIGURE 50
(Continued)

| | | | |
|---|---|---|---|
| iPS:437068 | 21-225_200A11 | AA | QTVVTQEPSLTVSPGGTVTLTCASNTGAVTSGSYPNWLQQKPGQAPRALIYHTDNKHSWTPARFSGSLLGGKAALTLSGAQPEDEAEYYCLIYYGGAQLVFGGGTKLTVL<br>SEQ ID NO: 27692 | QVQLQESGPGLVKPSQTLSLTCTVSGGSISSGGDYWSWIRQHPGKGLEWIGYIYYSGSTYYNPSLKSRVTISVDTSKNQFSLKLNSVTAADTAVYYCARDGAALGMDVWGQGTTVTVSS<br>SEQ ID NO: 31698 |
| | | NA | CAGACTGTGGTGACTCAGGAGCCCTCACTGACTGTGTCCCCAGGAGGGACAGTCACTCTCACCTGTGCTTCCAGCACTGGAGCAGTCACCAGTGGTTACTATCCAAACTGGTTCCAGCAGAAACTGGACAAGTACCCAGGGCACTGATTTATAGTACAAACAACAAACACTCCTGGACCCCTGCCCGGTCTCAGGCTCCCTCCTTGGGGGCAAAGCTGCCTGACACTGTCAGGTGTGCAGCCTGAGGACGAGGCTGACTATTACTGCCTGCTCTATTATGGTGGTGCTCACCTGGCATTCGGCGGAGGGACCAAGCTGACCGTCCTG<br>SEQ ID NO: 27693 | CAGGTGCAGCTGCAGGAGTCGGGCCCAGGACTGGTGAAGCCTTCACAGACCCTGTCCCTCACCTGCACTGTCTCTGGTGGCTCCATCAGCAGTGGTGGTGACTACTGGAGCTGGATCCGCCAGCACCCAGGGAAGGGCCTGGAGTGGATTGGGTACATCTATTACAGAACAACAGCACCTACAACAACCGTCCCTCAAGAGTCGAGTTACCATATCAGTAGACACGTCTAAGAACCAGTTCTCCCTGAAGCTGAGCTCTGTGACTGCCGCGGACACGGCCGTGTATTACTGTGCGAGAGATGCAGCAGCCACGGCACTGACGTCTGGGGCCAAGGGACCACGGTCACCGTCTCCTCA<br>SEQ ID NO: 31699 |
| | | AA | QTVVTQEPSLTVSPGGTVTLTCASSTGAVTSGYYPNWFQQKPGQVPRALIYSTNNKHSWTPARFSGSLLGGKAALTLSGVQPEDEADYYCLLYYGGAHLAFGGGTKLTVL<br>SEQ ID NO: 27694 | QVQLQESGPGLVKPSQTLSLTCTVSGGSISSGGDYWSWIRQHPGKGLEWIGYIYYRGSTYYNPSLKSRVTISVDTSKNQFSLKLSSVTAADTAVYYCARDAAAHGMDVWGQGTTVTVSS<br>SEQ ID NO: 31700 |

FIGURE 50
(Continued)

| | | | |
|---|---|---|---|
| iPS:437070 | 21-225_201G11 | NA | TCCTATGAGCTGACTCAGCCACCCTCAGTGTC CGTGTCCCCAGGACAGACAGCCAGCATCACCT GTTCTGGAGATAAATTGGGGGATAGATTTGCT TGCTGGTATCAACAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGTGGTA TTCGGCGGAGGGACCAAGCTGACCGTCCTA |
| | | | CAGGTACAGCTGCAGCAGTCAGGTCAGGACTG GTGAAGCCTCGCAGACCCTCACTCACTGTG CCATCTCCGGGACAGTGTCTCTGCATCAATCC TACTTGGAACTGGATCAGGCAGTCCCATGAGA GGCCTTGAGTGGCTGGAAGGACATACTACAGG TCCAAGTGGTATCATGTTTATGCAGTATCTGTA AAAGTCGAATAACCATCAACCAGACACATCCA AGAACCAGTTCTCCCTGCAGTGTATTCTGTGAC TCCCGAGGACACGGCAGTGTATTACTGTGCAAGA GATCCTGGGGGGCTCTTTGACTACTGGGGCCAGG GAACCCTGGTCACCGTCTCCTCA |
| | | | SEQ ID NO: 27695 |
| | | | SEQ ID NO: 31701 |
| | | AA | SYELTQPPSVSVSPGQTASITCSGDKLGDRFACW YQQKPGQSPVLVIYQDSKRPSGIPERFSGSNSGN TATLTISGTQAMDEADYYCQAWDSSTVVFGGG TKLTVL | QVQLQQSGPGLVKPSQTLSLTCAISGDSVSRINPTW NWIRQSPSRGLEWLGRTYYRSKWYHYYAVSVKSR ITINPDTSKNQFSLQLNSVTPEDTAVYYCARDPGGL FDYWGQGTLVTVSS |
| | | | SEQ ID NO: 27696 | SEQ ID NO: 31702 |
| iPS:437074 | 21-225_203B2 | NA | CAGGTGCAGCTGGTGGAGTCTGGGGGAGGCGTG GTCCAGCCGGGGAGGTCCCTGAGACTCTCCTGTG CAGGGTCTGATTCACCTTCAGTAACTAACTATGGCAT GCACTGGGTCCGCCAGGCTCCAGGCAAGGGGCT GGAGTGGGTGGCAATTATATGGTTTGATGGAAGT AATGAATACTATGCAGACTCCGTGAAGGGCCGA TTCACCATCTCAGAGACAATTCCATGAGCACGC TGTATCTGCAAATGAACAGCCTGAGAGCCGAGG ACACGGCTGTGTATTACTGTGCGAGAGAAGTGG GAGCTATGCTCTTTATATCGGGGCCAAGGACA ATGGTCACCGTCTCTCA |
| | | | TCCTATGAGCTGACTCAGCCACTCTCAGTGTC AGTGGCCCTGGGACAGACAGCCAGGATTACCT GTGGGGGAAACAACATTGGAAGAAAAATGT GCACTGGTACCAGCAGAAGCCAGGCCAGTCCC CTGTGTTGATCATCTATAGGGATAGCGACCGG CCCTCTGGGATCCCTGAGCGATTCTCTGGCTCC AACTCGGGGAACACGGCCACCCTGACCATCAG CAGAGCCCAAGCCCGGGGATGAGGCTGACTATT ACTGTCAGGTGTGGGACAGCGGCACTGCGGTA TTCGGCGGAGGGACCAAGCTGCCCGTCCTA |
| | | | SEQ ID NO: 27697 | SEQ ID NO: 31703 |

FIGURE 50
(Continued)

| | | | | |
|---|---|---|---|---|
| iPS:437076 | 21-225_203G6 | AA | SYELTQPLSVSVALGQTARITCGGNNIGRKNVH WYQQKPGQSPVLIIHRDSDRPSGIPERFSGSNSGN TATLTISRAQAGDEADYYCQVWDSGTAVFGGG TKLPVL<br>SEQ ID NO: 27698 | QVQLVESGGGVVQPGRSLRLSCAASGFTFSNYGM HWVRQAPGKGLEWVAIIWFDGSNEYYADSVKGRF TISRDNSMSTLYLQMNSLRAEDTAVYYCARESGSY ALYIWGQGTMVTVSS<br>SEQ ID NO: 31704 |
| | | NA | TCCTATGAACTGACTCAGCCACCCTCAGTGTC CGTGTCCCAGGACAGCAGCATCACCT GTTCTGGAGATAAAATTGGGGATAGATTTGCT TGCTGGTATCAACAGAAGCCAGGCCAGTCCCC TGTACTGGTCATCTATCAAGATAACAAGCGGC CCTCAGGGATCCCTGAGCGATTCTCTGGCTCC AACTCTGGGAACACAGCCACTCTGACCATCAG CGGGACCCAGTCTATGGAGGCTGACTATT ACTGTCAGGCGTGGGACAGCAGCACTGTGTA TTCGGCGGAGGGACCAAGCTGACCGTCCTG<br>SEQ ID NO: 27699 | CAGGTTCAGCTGCAGCAGTCAGGTCCAGGACTG GTGAAGCCCTCGCAGACCCTCTCACTCACCTGTG CCATCTCCGGGGACAGTGTCTCTGCACCAATCC TACTTGGAACTGGATCAGGCAGTCCCCATGAGA GGCCTTGAGTGGCTGGGAAGGACATATACAGG TCCAAGTGGTATCATGTTTATGCACTATCTGTGA AAGTCGAATAACCATCACCCAGACACATCCA AGAACCAGTTCTCCCTGCAGCTGAACTCTGTGAC TCCGAGGACACGGCTGTGTATTACTGTGCAAGA GATCCTGGGGGCCTCTTTGACTACTGGGGCCAGG GAACCCTGGTCACCGTCTCCTCA<br>SEQ ID NO: 31705 |
| | | AA | SYELTQPPSVSVSPGQTASITCSGDKLGDRFACW YQQKPGQSPVLVIYQDNKRPSGIPERFSGSNSGN TATLTISGTQSMDEADYYCQAWDSSTVFGGGT KLTVL<br>SEQ ID NO: 27700 | QVQLQQSGPGLVKPSQTLSLTCAISGDSVSRTNPTW NWIRQSPSRGLEWLGRTYYRSKWYHVYALSVKSRI TITPDTSKNQFSLQLNSVTPEDTAVYYCARDPGGLF DYWGQGTLVTVSS<br>SEQ ID NO: 31706 |

FIGURE 50
(Continued)

| | | | |
|---|---|---|---|
| iPS:437082 | 21-225_205E12 | NA | TCCTATGAGCTGACTCAGCCACTCTCAGTGTC AGCGCCCTGGGACAGACGGCCAGGATTACCT GTGGGGGAAACAACATTGGAAGAAAAAATGT GCACTGGTACCAGCAGAAGCCAGGCCAGTCCC CTGTGTTGATCATCATAGGGATAGCGACCGG CCCTCTGGGATCCTGGACGATTCTCTGGCTCC AACTCGGGAACACGGCCACCCTGACCATCAG CAGAGCCCAAGCGTGGACAGCGGCACTGTAT ACTGTCAGGTGTGGGACAGCGGCACTGTGGTA TTCGGCGGAGGGACCAAGCTGCCCGTCCTA SEQ ID NO: 27701 | CAGGTGCAGCTGGTGGAGTCTGGGGGAGGCGTG GTCCAGCCGGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAATTATATGGTTTGATGAAGT AATGAATACTATGCAGACTCCGTGAAGGGCCGA TTCACCATCTCCAGAGACAATTCCATGAGCACGC TGTATCTGCAAATGAACAGCCTGAGAGCCGAGG ACACGGCTGTGTATTACTGTGCGAGAGAAAGTGG GAGCTATGCTCTTTATATCTGGGGCCAAGGGACA ATGGTCACCGTCTCTCA SEQ ID NO: 31707 |
| | | AA | SYELTQPLSVSAALGQTARITCGGNNIGRKNVH WYQQKPGQSPVLIIHRDSDRPSGIPERFSGSNSGN TATLTISRAQAGDEADYYCQVWDSGTAVFGGG TKLPVL SEQ ID NO: 27702 | QVQLVESGGGVVQPGRSLRLSCAASGFTFSNYGM HWVRQAPGKGLEWVAIIWFDGSNEYYADSVKGRF TISRDNSMSTLYLQMNSLRAEDTAVYYCARESGSY ALYIWGQGTMVTVSS SEQ ID NO: 31708 |
| iPS:437084 | 21-225_206B5 | NA | TCCTATGAATTGACTCAGCCACTCTCAGTGTC AGTGGCCCTGGGACAGACGGCCAGGATTGCCT GTGGGGGAAACAACATTGGAAGAAAAAATGT GCACTGGTACCAGCAGAAGCCAGGCCTGGCCC CTGTGCCGGTCATCCNTAGGGATAGCTACCGA TCTTCTGGGATCCCTGACAGATTCTCTGGCTCC AACTCGCGGAACACGGCCACCCTGACCATCA GCAGAGCCCAAGCGCGGGACGGAGGCAGAGTA TTATTGTCAGGATTGGGACAGCAGCACTGTGG TGTTCGGCGGAGGGACCAAACTGACCGTCCTA SEQ ID NO: 27703 | CAGGTGCAGCTGGTGGAGTCCGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATAACTGTGCGAGAGAGGGTG GAGCTACCACCTTGACTACTGGGGCCAGGGAA TCCTGGTCACCGTCCTCA SEQ ID NO: 31709 |

FIGURE 50
(Continued)

| | | | | |
|---|---|---|---|---|
| | | AA | SYELTQPLSVSVALGQTARIACGGNNIGRKNVH WYQQKPGLAPVPVIXRDSYRSSGIPDRFSGSNCG NTTTVTISRAQAGEEAEYYCQDWDSSTVVFGGG TKLTVL<br>SEQ ID NO: 27704 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYNCAREGGSY HLDYWGQGILVTVSS<br>SEQ ID NO: 31710 |
| | | NA | CAGTCTGTGTTGACGCAGCCGCCCTCAGTGTC TGCGGCCCCAGGACAGAAGGTCACCATCTCCT GCTCTGGAAGCAGCTCCAACATTGGGAGTAAT TTTTTATCCTGGTACCAGCAGCTCCCAGAAC AGCCCCAAACTCCTCATTTATGACAATAATA AGCGACCCTCAGGGATTCCTGACCGATTCTCT GGCTCCAAGTCTGGCACGTCAGCCACCCTGGG CATCACCGGACTCCAGACTGGGGACGAGGCC GATTATTACTGCGGAACATGGGATAGCAGCCT GAGTGCTGGGGTATTCGGCGGAGGGACCAAG CTGACCGTCCTA<br>SEQ ID NO: 27705 | GAGGTGCAGCTGGTGGAGTCTGGGGGAGGCTTG GTACAGCCTGGGGGGTCCCTGAGACTCTCCTGTG CAGCCTCTGGATTCACTTTTAGAAGTTATAGCAT GAACTGGGTCGCCAGCTCCAGGGAAGGGCT GGAGTGGGTTTTATACATTAGTAGTAGTAGTAGT ATCAAAAAGTACGCAGACTCTGTGAAGGGCCGA TTCACCATCTCCAGAGACAATGAACAGCCTGAGAGAGAGG TGTATCTGCAAATGAACAGCCTGAGAGACGAGG ACACGGCTGTGTATTACTGTGTGAGAGATGATGG GAGTACTACTTTGACTACTGGGGCCAGGGAACC CTGGTCACCGTCTCCTCA<br>SEQ ID NO: 31711 |
| iPS:437086 | 21-225_209A8 | AA | QSVLTQPPSVSAAPGQKVTISCSGSSSNIGSNFLS WYQQLPGTAPKLLIYDNNKRPSGIPDRFSGSKSG TSATLGITGLQTGDEADYYCGTWDSSLSAGVFG GGTKLTVL<br>SEQ ID NO: 27706 | EVQLVESGGGLVQPGGSLRLSCAASGFTFRSYSMN WVRQAPGKGLEWVLYISSSSIKKYADSVKGRFTIS RDNAKNSLYLQMNSLRDEDTAVYYCVRDDGSYYF DYWGQGTLVTVSS<br>SEQ ID NO: 31712 |

FIGURE 50
(Continued)

| | | | | |
|---|---|---|---|---|
| iPS:437088 | 21-225_209H10 | NA | TCCTATGAATTGACTCAGCCACTCTCAGTGTC AGTGGCCCTGGGACACAGACGGCCAGGATTGCCT GTGGGGGAAACAACATTGGAAGAAAAAATGT GCACTGTGCCGCAGCAGAAGCCAGGCTGGCCC CTGTGCCGGTCATCTTAGGGATAGCTACCGG TCTTCTGGGATCCCTGACAGATTCTCTGGCTCC AACTGGGGGAACACGGCCACCGTGACCATCA GCAGAGCCCAAGCTGGGACAGCAGCACTGTGG TTATTGTCAGGATTGGGACAGCAGCACTGTGG TGTTCGGCGGAGGGACCAAACTGACCGTCCTA SEQ ID NO: 27707 | CAGGTGCAGCTGGTGGAGTCCGGGGAGGCGTG GTCCAGCCTGGGAGGTCCCTGAGACTCTCCTGTG CAGGCGTCTGATTCACCTTCAGTAGCTATGGCAT GCACTGGGTCCGCCAGGCTCCAGCAGGGGCT GGAGTGGGTGGCAGTTATATGGTATGATGGAAGT AATAAATACTATGCAGAGACTCCGTGAAGGGCCGA TTCACCATCTCCAGAGACAATTCCAAGAACACGC TGTATCTGCAAATGAACAGCCTGAGAGCCGAGG ACACGGCTGTGTATAACTGTGCGAGAGAGGGTG GGAGCTACCACCTTGACTACTGGGGCCAGGGAA TCCTGGTCACCGTCTCCTCA SEQ ID NO: 31713 |
| | | AA | SYELTQPLSVSVALGQTARIACGGNNIGRKNVH WYQQKPGLAPVPVILRDSYRSSGIPDRFSGSNW GNTATVTISRAQAGEEAEYYCQDWDSSTVFGG GTKLTVL SEQ ID NO: 27708 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYNCAREGGSY HLDYWGQGILVTVSS SEQ ID NO: 31714 |
| iPS:437090 | 21-225_210F11 | NA | CAGACTGTGGTGACTCAGGAGCCCTCACTGAC TGTGTCCCCAGGAGGGACAGTCACTCTCACCT GTGCCTTTCAGCACTGGAGCAGTCACCAGTGT AATTATCCAAACTGGTTCCAGCAGAAACCTGG ACAAGCACCCAGGGCACTGATTTACACAGTACAA GCAACAAACACTCCTGGACCCCTGACCCGGTTC TCAGGCTCCCTCCTTGGGGGCAAAGCTGCCCT GACACTGTCAGGTGTGCAGCCTGAGGACGAG GCTGAATATTACTGCCTCTACTATGGTGGT GCTCAGCTGGTGTTCGGCGGAGGGACCAAGCT GACCGTCCTA SEQ ID NO: 27709 | CAGGTGCAGCTGCAGGAGTCGGGCCCAGGACTG GTGAAGCCGTCACAGACCCTGTCCCTCACCTGCA CTGTCTCTGGTGGCTCCATCAGCAGTGGTGGTTC CTACTGGAGCTGGATCCGCCAGCACCCAGGGAA GGGGCTGGAGTGGATTGGGTACATCTATTACATT GGGACCACCTACTACAACCCGTCCCTCAAGAGTC GAGTTACCATATCAGTAGACACGTCTACGAACCA CTTCTCCCTGAAACTGAGCTGTGACTGCCGCG GACACGGCCGTGTATTACTGTGCGAGAGATGAG CCATTGACCGGTATGGACGTCTGGGGCCAAGGG ACCACGGTCACCGTCTCCTCA SEQ ID NO: 31715 |

FIGURE 50
(Continued)

| | | | | |
|---|---|---|---|---|
| | | AA | QTVVTQEPSLTVSPGGTVTLTCAFSTGAVTSGNYPNWFQQKPGQAPRALIYSTSNKHSWTPARFSGSLLGGKAALTLSGVQPEDEAEYYCLLYYGAQLVFGGGTKLTVL<br>SEQ ID NO: 27710 | QVQLQESGPGLVKPSQTLSLTCTVSGGSISSGGSYWSWIRQHPGKGLEWIGYIYYIGTTYYNPSLKSRVTISVDTSTNHFSLKLSSVTAADTAVYYCARDEPLTGMDVWGQGTTVTVSS<br>SEQ ID NO: 31716 |
| iPS:437092 | 21-225_210B12 | NA | CAGTCTGCCCTGACTCAGCCTGCCTCCGTGTCTGGGTCTCTGGACAGTCGATCACCATCTCCTGCACTGGAACCAGCAGTGACGTTGGTGGTTATAACTATGTCTCTGGTACCAACAACACCAGGCAAAGCCCCAAATTCATGATTTATGAGGTCAGGAATCGGCCCTCAAGTGTTCTAATGCTCTCTGGCTCCAAGTCTGGCAACACGGCCTCCCTGACCATCTCTGGGCTCCAGGTCAGGAGACGAGGCTGATTATTACTGCAGCTCATATACCAGCAGCCGCACTCTGGTATTCGGCGGAGGGACCAAGTTGACCGTCCTA<br>SEQ ID NO: 27711 | CAGGTGCAGCTGGTGCAGTCTGGGGCTGAGGTGAAGAAGCCTGGGGCTCAGTGAAGATCTCCTGCAAGGCTTCTGGATTCACCTTCACGACTACTATATGAACTGGGTGCGACAGGCCCCTGGACAAGGCTTGAGTGGATGGATGGATCAACAGGAGGGCAGTGGCACAAACTATGCACAGAAGTTTCAGGGCAGGGTCACCATGACCAGGGACACGTCCATCAGCACAGCCTACATGGAGCTGAGTAGGCTGAGATCTGACGACACGGCCGTGTATTACTGTGCGAGAGAGGTATGACTCGTTCGCCCCCTGGGGCCAGGGAACCCTGGTCACCGTCCTCCTCA<br>SEQ ID NO: 31717 |
| | | AA | QSALTQPASVSGSPGQSITISCTGTSSDVGGYNYVSWYQQHPGKAPKFMIYEVRNRPSGVSNRFSGSKSGNTASLTISGLQAEDEADYYCSSYTSSRTLVFGGGTKLTVL<br>SEQ ID NO: 27712 | QVQLVQSGAEVKKPGASVKISCKASGFTFTDYYMNWVRQAPGQGLEWMGWINPNSGGTNYAQKFQGRVTMTRDTSISTAYMELSRLRSDDTAVYYCARGYDSFAPWGQGTLVTVSS<br>SEQ ID NO: 31718 |

FIGURE 50
(Continued)

| | | | |
|---|---|---|---|
| iPS:437094 | 21-225_210D12 | NA | CAGTCTGCCCTGACTCAGCCTGCCTCCGTGTCTGGGTCTCCTGGACAGTCGATCACCATCTCTGCACTGGAACCAGCAGTGACGTTGGTGGTTATAATTATGTCTCCTGGTACCAACAACACCAGTCAAAGCCCCCAAACTCTGAGGGTTTCTAATCGCTCTCTCTAATCGGCCCTCAAGTCTGGCAACACGGCCTCCCTGATGGCTCCAAGTCTGGCAACACGGCCTCCCTGACCATCTCTGGGCTCCAGGCTGAGGACGAGGCTGATTATTACTGCAACTCATATACAAGCAGCATCACTTGGGTGTTCGGCGGAGGGACCAAGCTGACCGTCCTA<br/>SEQ ID NO: 27713 | CAGGTGCAGTTGGTGGAGTCTGGGGGAGGCGTGGTCCAGCCTGGGAGGTCCCTGAGACTCTCCTGTGCAGCGTCTGGATTCACCTTCAGTCACTATGGCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCTGAGGACACGGCTGTGTATTACTGTGCGAGGGGGACTGGAACCCCGAGGGTTTGGACGTCTGGGGCCAAGGGACCACGGTCACCGTCTCCTCA<br/>SEQ ID NO: 31719 |
| | | AA | QSALTQPASVSGSPGQSITISCTGTSSDVGGYNYVSWYQQHPVKAPKLLIYEVSNRPSGVSNRFSGSKSGNTASLTISGLQAEDEADYYCNSYTSSITWVFGGGTKLTVL<br/>SEQ ID NO: 27714 | QVQLVESGGGVVQPGRSLRLSCAASGFTFSHYGMHWVRQAPGKGLEWVAVIWYDGSNKYYADSVKGRFTISRDNSKNTLYLQMNSLRAEDTAVYYCARGDWNPEGLDVWGQGTTVTVSS<br/>SEQ ID NO: 31720 |
| iPS:437096 | 21-225_210E12 | NA | CAGTCTGCCCTGACTCAGCCTGCCTCCGTGTCTGGGTCTCCTGGACAGTCGATCACCATCTCTGCACTGGAACCAGCAGTGACGTTGGTGGTTATAACTATGTCTCCTGGTACCAACAACACCAGGCAAAGCCCCCAAACTCATGATTTATGAGGTCAGTAATCGGCCCTCAGGGGTTTCTAATCGCTTCTCTGGCTCCAAGTCTGGCAACACGGCCTCCCTGACCATCTCTGGGCTCCAGGCTGAGGACGAGGCTGATTATTACTGCGGCTCATATGTAAAAGGCATCACTTGGGTGTTCGGCGGAGGGACCAGTCTAACCGTCCTC<br/>SEQ ID NO: 27715 | CAGGTGCACCTGGTGGAGTCTGGGGGAGGCGTGGTCCAGCCTGGGAGGTCCCTGAGACTCTCCTGTGCAGCGTCTGGATTCACCTTCAGTAACTAATGGCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCCACCATCTCCAAATGAACAGCCTGAGAGCGGAGGACACGGCTGTGTATTACTGTGCGAGGGGGACTGGAACCCCGAGGGTATGGACGTCTGGGGCCAAGGGACCACGGTCATCGTCTCCTCA<br/>SEQ ID NO: 31721 |

FIGURE 50
(Continued)

| | | | |
|---|---|---|---|
| iPS:437098 | 21-225_211C1 | AA | QSALTQPASVSGSPGQSITISCTGTSSDVGGYNY VSWYQQHPGKAPKLMIYEVSNRFSGS KSGNTASLTISGLQAEDEADYYCGSYVKGITWV FGGGTSLTVL<br>SEQ ID NO: 27716 | QVHLVESGGGVVQPGRSLRLSCAASGFTFSNYGM HWVRQAPGKGLEWVAVIWYDGSNKYYADSVKGR FTISRDNSKNTLYLQMNSLRAEDTAVYYCARGDW NPEGMDVWGQGTTVTVSS<br>SEQ ID NO: 31722 |
| | | NA | CAGTCTGCCCTGACTCAGCCTGCCTCCGTGTCT GGGTCTCCTGGACAGTCGATCACCATCTCCTG CACTGGAACCAGTAGTGACGTTGGTAGTTATA ACTATGTCTCCTGGTACCAACAGTACCCAGGC AAAGCCCCCAAACTCATGATTTATGAGGTCAG TAATCGGCCCTCAGGGGTTTCTAATCGCTTCTC TGGCTCCAAGTCTGGCAACACGGCCTCCCTGA CCATCTCTGGGCTCCAGGCTGAGGACGAGGCT GATTATTACTGCAACTGCAATATACAAGCAGCAT CACTTGGGTGTTCGGCGGAGGGACCAAGCTGA CCGTCCTA<br>SEQ ID NO: 27717 | CAGGTGCAGCTGGTGGAGTCTGGGGGAGGCGTG GTCCAGCCTGGGAGGTCCCTGAGACTCTCTGTG CAGCGTCTGGATTCACCTTCAGTCAGTCACTATGCAT GCACTGGGTCCGCCAGGCTCCAGGCAAGGGGCT GGAGTGGGTGGCAGTTATATGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTATCTATTACTGTGCGAGGGGGACTG GAACCCCGAGGGTTTGGACGTCTGGGGCCAAGG GACCACGGTCACCGTCTCCTCA<br>SEQ ID NO: 31723 |
| | | AA | QSALTQPASVSGSPGQSITISCTGTSSDVGSYNYV SWYQQYPGKAPKLMIYEVSNRPSGVSNRFSGSK SGNTASLTISGLQAEDEADYYCNSYTSSITWVFG GGTKLTVL<br>SEQ ID NO: 27718 | QVQLVESGGGVVQPGRSLRLSCAASGFTFSHYGM HWVRQAPGKGLEWVAVIWYDGSNKYYADSVKGR FTISRDNSKNTLYLQMNTLRAEDTAIYYCARGDWN PEGLDVWGQGTTVTVSS<br>SEQ ID NO: 31724 |

FIGURE 50
(Continued)

| | | | |
|---|---|---|---|
| iPS:437100 | 21-225_211H2 | NA | TCCTATGAACTGACTCAGCCACTCTCAGTGTCAGTGGCCCTGGGACAGACGGCCAGGATTACCTGTGGGGGAAACAACAATTGACGTAGAAATGTGCACTGGTACCAACAGAAGCCAGGCCAGGCCCCTATACTGGTCATCTATAGAGATCGCGACCGGCCCTCTGGGATCCCTGAGCGATTCTCTGGCTCCAACTCGGGAACACGGCCACCCTGACCATCAGCAGAGCCCAAGCCGGGATGAGGCTGACTATTTCTGTCAGGTGTGGGACAGCAGTACTGCGGTGTTCGGCGGAGGGACCAAACTGACCGTCCTA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGCCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCGCCAGAGACAATTCCAAGAACACGCTGTATCTGCAAATGAACAGCTGAGAGCCGAGGACACGGCTGTGTATTACTGTGCGAGAGATCCTGGAGCTACGGGTTCGACCCCTGGGGCCAGGGAACCCTGGTCACCGTCTCCTCA |
| | | | SEQ ID NO: 27719 | SEQ ID NO: 31725 |
| | | AA | SYELTQPLSVSVALGQTARITCGGNNIGRRNVHWYQQKPGQAPILVIYRDRDRPSGIPERFSGSNSGNTATLTISRAQAGDEADYFCQVWDSSTAVFGGGTKLTVL | QVQLVESGGGVVQPGRSLRLSCAASGFTFSSYAMHWVRQAPGKGLEWVAVIWYDGSNKYYADSVKGRFTIARDNSKNTLYLQMNSLRAEDTAVYYCARDPGSYGFDPWGQGTLVTVSS |
| | | | SEQ ID NO: 27720 | SEQ ID NO: 31726 |
| iPS:437102 | 21-225_211E5 | NA | TCCTATGAGCTGACACAGCCACCCTCGGTGTCAGTGTCCCCAGGACAGACGGCCAGGATCACCTGTTCTGGAGATGCATTGCCAAAGCAATATGCTTATTGGTACCAGCAGAAGCCAGGCCAGGCCCCAGTGCTGGTGATATATAAAGACAGTGCGAGGCCCTCAGGGATCCCTGAGCGATTCTCTGGCTCCCGCTCAGGGACAACAGTCACGTTGACCGTCAGTGGAGTCCAGGCAGAAGACGAGGCTGACTATTACTGTCAATTAGTGTACAGCAGTGATACTTATGTCTTCGGAACTGGGACCATGCTCACCGTCCTA | CAGGTGCAGCTGGTGGAGTCTGGGGGAGGCGTGGTCCAGCCTGGGAGGTCCCTGAGACTCTCCTGTGCAGCGTCTGGATTCACCTTCAGGAACTATGGCATGCACTGGGTCCGCCAGGCTCCAGGCAAGGGGCTGGAGTGGGTGGTCAATTATATGGTTTGATGGAAGTGATCAATACTATGCAGACTCCGTGAAGGGCCGATTCACCATCTCCAGAGACAACTCCAAGAACACGCTGTACCTGCAAATGAACAGCCTGAGAGCCGAGGACACGGCTGTTTATTACTGTGCGAGAGGCCTCTGTCTACTACTACGGTATGGGGTCTGGGGCCAAGGGACCACGGTCACCGTCTCCTCA |
| | | | SEQ ID NO: 27721 | SEQ ID NO: 31727 |

FIGURE 50
(Continued)

| | | | |
|---|---|---|---|
| iPS:437104 | 21-225_211G5 | AA | SYELTQPPSVSVSPGQTARITCSGDALPKQYAYW YQQKPGQAPVLVIYKDSARPSGIPERFSGSRSGT TVTLTVSGVQAEDEADYYCQLVYSSDTYVFGTG TMLTVL<br>SEQ ID NO: 27722 | QVQLVESGGGVVQPGRSLRLSCAASGFTFRNYGM HWVRQAPGKGLEWVSIIWFDGSDQYYADSVKGRF TISRDNSKNTLYLQMNSLRAEDTAVYYCARGLSVY YYGMGVWGQGTTVTVSS<br>SEQ ID NO: 31728 |
| | | NA | CAGTCTGCCCTGACTCAGCCTGCCTCCGTGTCT GGGTCTCCTGGACAGTCGATAACCATCTCCTG CACTGGAACCAGCAGTGACGTTGGTGGTTATA ACTATGTCTCCTGGTACCAACAGCACCCAGGC AAAGCCCCCAAACTCATGATTTATGAGGTCAG TAATCGGCCCTCAGGGGTTTCTAATGCTTCTC TGGCTCCAAGTCTGGCAACACGGCCTCCTGA CCATCTCTGGGCTCCAGGCTGAGGACGAGGCT GATTATTACTGCAACTCATATACAAGAAGCAT CACTGGGTGTTCGGCGGAGGGACCAAGCTGA CCGTCCTA<br>SEQ ID NO: 27723 | CAGGTGCAGCTGGTGGAGTCTGGGGGAGGCGTG GTCCAGCCTGGGAGGTCCCTGAGACTCTCCTGTG CAGCGTCTGGATTCACCTTCAGTCAGTCACTATGGCAT GCACTGGGTCCGCCAGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTACAAATGAACAGCCTGAGAGCCGAGG ACACGGCTGTGTATTACTGTGCGAGGGGGACTG GAACCCCGAGGTTTGGACGTCTGGGGCCAAGG GACCACGGTCACCGTCTCCTCA<br>SEQ ID NO: 31729 |
| | | AA | QSALTQPASVSGSPGQSITISCTGTSSDVGGYNY VSWYQQHPGKAPKLMIYEVSNRPSGVSNRFSGS KSGNTASLTISGLQAEDEADYYCNSYTRSITWVF GGGTKLTVL<br>SEQ ID NO: 27724 | QVQLVESGGGVVQPGRSLRLSCAASGFTFSHYGM HWVRQAPGKGLEWVAVIWYDGSNKYYADSVKGR FTISRDNSKNTLYLQMNSLRAEDTAVYYCARGDW NPEGLDVWGQGTTVTVSS<br>SEQ ID NO: 31730 |

FIGURE 50
(Continued)

| | | | |
|---|---|---|---|
| iPS:437106 | 21-225_211H7 | NA | CAGACTGTGGTGACTCAGGAGCCCTCACTGAC TGTGTCCCAGGAGGGACAGTCACTCTCACCT GTGCTTTCAGCACTGGAGCAGTCAGTCACCAGTGGT AACTATCAAGTTGGTTCCAGCAGAAACCTGG ACAAGTTCCCAGGGCACTGATTTATAGTACAA GCAACAGACACTCCTGGACCCCTGCCCGGTTT TCTGGCTCCCTCCTTGGGGGCAAAGCTGCCCT GACACTGTCAGGTGTGCAGCTGAGGACGAG GCTGAATATTACTGCCTGCTCTACTATGGTGGT GCTCAGGTGGTGTTCGGCGGAGGGACCAAGCT GACCGTCCTA<br><br>SEQ ID NO: 27725 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGTTA CTACTGGAGCTGGATCCGCCAGCACCCAGGGAA GGGCCTGGAGTGGATTGGGTACATCTATTACGTT GGGAGCACTACTACAACCGTCCCTCAAGAGTC GAGTTACCATATCAGTAGACACGTCTAAGAACCA GTTCTCCCTGAAGCTGAGTTCTGTGACTGCCGCG GACACGGCCGTGTATTACTGTGCGAGAGATGG CCATTGAGGGGTATGGACGTCTGGGGCCAAGGG ACCACGGTCACCGTCTCCTCA<br><br>SEQ ID NO: 31731 |
| | | AA | QTVVTQEPSLTVSPGGTVILTCAFSTGAVTSGNY PSWFQQKPGQVPRALIYSTSNRHSWTPARFSGSL LGGKAALTLSGVQPEDEAEYYCLLYYGGAQLV FGGGTKLTVL<br><br>SEQ ID NO: 27726 | QVQLQESGPGLVKPSQTLSLTCTVSGGSISSGGYYW SWTRQHPGKGLEWIGYIYYVGSTYNPSLKSRVTIS VDTSKNQFSLKLSSVTAADTAVYYCARDGPLSGM DVWGQGTTVTVSS<br><br>SEQ ID NO: 31732 |
| iPS:437108 | 21-225_211C9 | NA | CAGACTGTGGTGACTCAGGAGCCCTCACTGAC TGTGTCCCAGGAGGGACAGTCACTCTCACCT GTGGTTCCAGCACTGATCAGTCACCAGTGGT TACTTTCCAAACTGGTTCCAGCAGAAACCTGG ACAAGCACCCAGGGCACTGATTTATAGTACAA ACAACAAGCACTCCTGGACCCCTGCCCGGTTC TCAGGCTCCCTCCTTGGGGCAAAGCTGCCCT GACACTGTCAGATGTGCAGCCTGAGGACGAG GCTGACTATTACTGCCTGCTCTACTATGGTGGT GCTCAGTCGTGGCATTCGGCGGAGGGACCAAACT GACCGTCCTA<br><br>SEQ ID NO: 27727 | CAGGTGCAGCTGCAGGAGTCGGGCCCAGGACTG GTGAAGCCTTCACAGACCCTGTCCCTCACCTGCA CTGTCTCTGGTGGCTCCATCAGAAGTGGTGGTGA CTACTGGAGCTGGATCCGCCAGCACCCAGGGAA GGGCCTGGAGTGGATTGGATACATCTATTATAGT GGGAGCACTACTACAACCGTCCCTCAAGAGTC GAGTTACCATATTACTAGACACGTCTAAGAACCA GTTCTCCCTGAAGCTGAGCTGTGACTGTGCG GACACGGCCGTGTATTACTGTGCGAGAGATTCAG CAGTGTACAATATGGACGTCTGGGGGCCAAGGGA CCACGGTCACCGTCTCCTCA<br><br>SEQ ID NO: 31733 |

FIGURE 50
(Continued)

| | | | |
|---|---|---|---|
| iPS:437110 | 21-225_211E9 | AA | QTVVTQEPSLTVSPGGTVTLTCGSSTGSVTSGYF PNWFQQKPGQAPRPLIYSTNNKHSWTPARFSGS LLGGKAALTLSDVQPEDEADYYCLLYYGGAQL AFGGGTKLTVL<br>SEQ ID NO: 27728 | QVQLQESGPGLVKPSQTLSLTCTVSGGSIRSGGDY WSWIRQHPGKGLEWIGYIYYSGSTYYNPSLKSRVTI LLDTSKNQFSLKLSSVTVADTAVYYCARDSAVYN MDVWGQGTTVTVSS<br>SEQ ID NO: 31734 |
| | | NA | CAGACTGTGGTGACTCAGGAGCCCTCACTGAC TGTGTCCCAGGAGGGACAGTCACTCTCACCT GTGCTTCCAGCACTGGAGCAGTCACCAGTGGT AACTATCCAAACTGGTTCCAGCAGAAACCTGG ACAAGCACCCAGGGCACTGATTTATAGTACAA TCAACAAACACTCCGGGACCCCTGCCCGGTTT ACAGGCTTCCTCCTTGGGGGCAAAGCTGCCCT GACACTGTCAGGTGTACAGCCTGAGGACGAG GCTGAGTATTACTGCCTGCTCTACTATGGTGGT GCTCAGCTGGCATTCGGCGGAGGGACCAAGCT GACCGTCCTA<br>SEQ ID NO: 27729 | CAGGTGCAGCTGCAGGAGTCGGGCCAGGACTG GTGAAGCCTTCACAGACCCTGTCCCTCACCTGCA CTGTCTCTGGTGGCTCCATCAGCAGTGGTGGTGA CTACTGGAGCTGGATCCGCCAGCACCCAGGGAA GGGCCTGGAGTGGATTGGGTACATCTATTACACT GGGAGCAACTACTACAACCGTCCCTCAAGAGTC GAGTTACCATATCAGTAGACACGTCTAAGAATCA GTTCTCCCTGAAGCTGATCTCTGTGACTGCCGCG GACACGGCCGTGTATTACTGTGCGAGAGATTCAG CAGTGTACGGTATGGACGTCTGGGGCCAAGGGA CCACGGTCACCGTCTCCTCA<br>SEQ ID NO: 31735 |
| | | AA | QTVVTQEPSLTVSPGGTVTLTCASSTGAVTSGNY PNWFQQKPGQAPRALIYSTNKHSGTPARFTGFL LGGKAALTLSGVQPEDEAEYYCLLYYGGAQLA FGGGTKLTVL<br>SEQ ID NO: 27730 | QVQLQESGPGLVKPSQTLSLTCTVSGGSISSGGDYW SWIRQHPGKGLEWIGYIYTGSNYNPSLKSRVTIS VDTSKNQFSLNLISVTAADTAVYYCARDSAVYGM DVWGQGTTVTVSS<br>SEQ ID NO: 31736 |

FIGURE 50
(Continued)

| | | | |
|---|---|---|---|
| iPS:437112 | 21-225_212C2 | NA | CAGTCTGCCCTGACTCAGCCTGCCTCCGTGTCT GGGTCTCCTGGACAGTCGATCACCATCTCTG CACTGGAACCAGCAGTGACGTTGGTGGTTATA ACTATGTCTCCTGGTACCAACAACACCCAGGC AAAGCCCCCAAACTCATGATTTATGAGGTCAG AAATCGGCCCTCAGGAGTTTCTAATCGCTTCT CTGGCTCCAAGTCTGGCAACACGGCCTCCCTG ACCATCTCTGGGCTCCAGGCTGAGGACGAGGC TGATTATTACTGCAGCTCATATACACGGCAGCA TCACTTGGGTGTTCGGCGGAGGGACCAAGCTG ACCGTCCTA | CAGGTGCAACTGGTGGAGTCTGGGGGAGGCGTG GTCCAGCCTGGGAGGTCCCTGAGACTCTCCTGTG CAGCGTCTGATTCACCTTCAGTCACTTACTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGGGGGGACTG GAACCCCGAGGGTATGACGTCTGGGGCCAAGG GACCTCGGTCACCGTCTCCTCA |
| | | | SEQ ID NO: 31737 |
| | | AA | QSALTQPASVSGSPGQSITISCTGTSSDVGGYNY VSWYQQHPGKAPKLMIYEVRNRPSGVSNRFSGS KSGNTASLTISGLQAEDEADYYCSSYTRSITWVF GGGTKLTVL | QVQLVESGGGVVQPGRSLRLSCAASGFTFSHYGM HWVRQAPGKGLEWVAVIWYDGSNKYYADSVKGR FTISRDNSKNTLYLQMNSLRAEDTAVYYCARGDW NPEGMDVWGQGTSVTVSS |
| | | | SEQ ID NO: 27732 | SEQ ID NO: 31738 |
| iPS:437114 | 21-225_212A4 | NA | CAGTCTGCCCTGACTCAGCCTGCCTCCGTGTCT GGGTCTCCTGGACAGTCGATCACCATCTCTG CACTGGAACCAGCAGTGACGTTGGTGGTTATA ACTATGTCTCCTGGTACCAACAACACCCAGGC AAAGCCCCCAAACTCATGATTTATGAGGTCAG TAATCGGCCCTCAGGGGTTTCTAATCGCTTCTC TGGCTCCAAGTCTGGCAACACGGCCTCCCTGA CCATCTCTGGGCTCCAGGCTGAGGACGAGGCT GATTATTACTGCGGCTCATATGTAAAGGCAT CACTTGGGTGTTCGGCGGAGGGACCAGTCTAA CCGTCCTC | CAGGTGCACCTGGTGGAGTCTGGGGGAGGCGTG GTCCAGGCTGGGAGGTCCCTGAGACTCTCCTGTG CAGCGTCTGATTCACCTTCAGTCAACTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGGGGGGACTG GAACCCCGAGGGTATGACGTCTGGGGCCAAGG GACCACGGTCATCGTCTCCTCA |
| | | | SEQ ID NO: 27733 | SEQ ID NO: 31739 |

FIGURE 50
(Continued)

| | | | | |
|---|---|---|---|---|
| iPS:437116 | 21-225_212F6 | AA | QSALTQPASVSGSPGQSITISCTGTSSDVGGYNYVSWYQQHPGKAPKLMIYEVSNRPSGVSNRFSGSKSGNTASLTISGLQAEDEADYYCGSYVKGITWVFGGGTSLTVL<br>SEQ ID NO: 27734 | QVHLVESGGGVVQAGRSLRLSCAASGFTFSNYGMHWVRQAPGKGLEWVAVIWYDGSNKYYADSVKGRFTISRDNSKNTLYLQMNSLRAEDTAVYYCARGDWNPEGMDVWGQGTTVIVSS<br>SEQ ID NO: 31740 |
| | | NA | CAGTCTGCCCTGACTCAGCCTGCCTCCGTGTCTGGGTCTCCTGGACAGTCGATCACCATCTCCTGCACTGGAACCAGTAGTGACGTTGGTGGTTATAACTATGTCTCCTGGTACCAACAGTACCCAGGCAAAGCCCCCAAACTCATGATTTATGAGGTCAGTAATCGGCCCTCAGGGGTTTCTAATCGCTTCTCTGGCTCCAAGTCTGGCAACACGGCCTCCCTGACCATCTCTGGGCTCCAGGCTGAGGACGAGGCTGATTATTACTGCAACTCATATACAAGCAGCATCACTTGGGTGTTCGGCGGAGGGACCAAGCTGACCGTCCTA<br>SEQ ID NO: 27735 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAACTACTATGGCATGCACTGGGTCCGCCAGGCTCCAGGCAAGGGGCTGGAGTGGGTGGCAGTTATATGGTATGATGGAAGTAATAAATACTATGCGGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGGGGGGACTGGAACCCCGAGGGTTTGGACGTCTGGGGCCAAGGGACCACGGTCACCGTCTCCTCA<br>SEQ ID NO: 31741 |
| | | AA | QSALTQPASVSGSPGQSITISCTGTSSDVGGYNYVSWYQQYPGKAPKLMIYEVSNRPSGVSNRFSGSKSGNTASLTISGLQAEDEADYYCNSYTSSITWVFGGGTKLTVL<br>SEQ ID NO: 27736 | QVQLVESGGGVVQPGRSLRLSCAASGFTFSHYGMHWVRQAPGKGLEWVAVIWYDGSNKYYADSVKGRFTISRDNSKNTLYLQMNSLRAEDTAVYYCARGDWNPEGLDVWGQGTTVTVSS<br>SEQ ID NO: 31742 |

FIGURE 50
(Continued)

| | | | |
|---|---|---|---|
| iPS:437118 | 21-225_212G7 | NA | CAGTCTGCCCTGACTCAGCCTGCCTCCGTGTCT GGGTCTCCTGGACAGTCGATCACCATCTCTG CACTGGAACCAGCAGTGACGTTGGTGTGTTATA ATTATGTCCTGTACCAACAGCACCCAGGC AAAACCCCCAAACTCATGATTTATGAGGTCAG TAATCGGCCCTCAGGGGTTTCTAATCGCTTCTC TGGCTCAAGTCTGGCAACACGGCTCCCTGA CCATCTCTGGGCTCCAGGCTGAGGACGAGGCT GATTATTACTGCAACTCATATACAAGCAGCAT CACTTGGGTGTTCGGCGGAGGGACCAAGCTGA CCGTCCTA<br>SEQ ID NO: 27737 | CAGGTGCAGTTGGTGGAGTCTGGGGGAGGCGTG GTCCAGCCTGGGAGGTCCCTGAGACTCTCTGTG CAGGGTCTGGATTCACCTTCAGTCACTATGGCAT GCACTGGGTCCGCCAGGCTCCAGGCAAGGGCT GGAGTGGGTGGCAGTTATATGTATGATGGAAGT AATAAATACTGTGCAGACTCCGTGAAGGGCCGA TTCACCATCTCCAGAGACAATTCCACGAACACGC TGTATCTGCAAATGAACAGCCTGAGAGCCGAGG ACACGGCTGTGTATTACTGTGCGAGGGGAGACTG GAACCCCGAGGGTTTGGACGTCTGGGGCCAAGG GACCACGGTCACCGTCTCCTCA<br>SEQ ID NO: 31743 |
| | | AA | QSALTQPASVSGSPGQSITISCTGTSSDVGGYNY VSWYQQHPGKTPKLMIYEVSNRPSGVSNRFSGS KSGNTASLTISGLQAEDEADYCNSYTSSITWVF GGGTKLTVL<br>SEQ ID NO: 27738 | QVQLVESGGGVVQPGRSLRLSCAASGFTFSHYGM HWVRQAPGKGLEWVAVIWYDGSNKYCADSVKGR FTISRDNSTNTLYLQMNSLRAEDTAVYYCARGDW NPEGLDVWGQGTTVTVSS<br>SEQ ID NO: 31744 |
| iPS:437120 | 21-225_212A9 | NA | CAGACTGTGTGACTCAGGAGCCCTCACTGAC TGTGTCCCCAGGAGGGACAGTCACTCTCACCT GTGCTTCCAGCACTGGAGCAGTCACCAGTGGT TACTATCCAAACTGGTTCCAGCAGAAACCTGG ACAAGCACCCAGGGCACTGATTATATAGTACAA ACAACAAAACACTCCTGACCCCTGCCGGTTC TCAGGCTCCCTCCTTGGGGGCAAAGTGCCCT GACACTGTCAGGTGTACAGCCTGACGACGAGG CTGACTATTACTGCCTGCTCTACTATGTGGTG CTCAGGTGGGATTCGGCGGAGGGACCAAGCT GACCGTCCTA<br>SEQ ID NO: 27739 | CAGGTGCAGCTGCAGGAGTCGGGCCCAGGACTG GTGAAGCCTTCACAGACCCTGTCCCTCACCTGCA GTGTCTCTGGTGGCTCCATCAGAAGTGGTGGTGA CTACTGGAGCTGGATCCGCCAGCACCCAGGGAA GGGCCTGGAGTGGATTGGGTATATGTATTACAGT GGGAGCACCTACTACAACCCGTCCCTCAAGAGTC GAGTTACCATATCAGTAGACACGTCTAAGAACCA GTTCTCCCTGAAGCTGAGTTCTGTGACTGTCGCG GACACGGCCGTGTATTACTGTGCGAGATTCAG CAGTGTACGGTATGGACGTCTGGGGCCAAGGGA CCACGGTCACCGTCTCCTCA<br>SEQ ID NO: 31745 |

FIGURE 50
(Continued)

| | | | |
|---|---|---|---|
| iPS:437124 | 21-225_212H12 | AA | QTVVTQEPSLTVSPGGTVTLTCASSTGAVTSGYY PNWFQQKPGQAPRALIYSTNKHSWTPARFSGS LLGGKAALTLSGVQPDDEADYYCLLYYGGAQV GFGGGTKLTVL<br>SEQ ID NO: 27740 | QVQLQESGPGLVKPSQTLSLTCSVSGGSIRSGGDY WSWIRQHPGKGLEWIGYMYYSGSTYYNPSLKSRV TISVDTSKNQFSLKLSSVTVADTAVYYCARDSAVY GMDVWGQGTTVTVSS<br>SEQ ID NO: 31746 |
| | | NA | CAGACTGTGGTGACTCAGGAGCCCTCACTGAC TGTGTCCCCAGGAGGGACAGTCACTCTCACCT GTGCTTCCAGCACTGGAGCAGTCACCAGTGGT TACTATCCAAACTGGTTCCAGCAGAAACCTGG ACAAGCACCAGGGCACTGATTTATAGTACAA GCAACAAACACTCCTGACCCCTGCCGGTTC TCAGGCTCCCTCCTTGGGGGCAAAGCTGCCCT GACACTGTCAGGTGTGCAGCCTGAGGACGAG GCTGAGTATTACTGCCTGCTCTACTATGGTGGT GCTCATGTGGTATTCGGCGGAGGGACCAAGCT GACCGTCCTA<br>SEQ ID NO: 27741 | CAGGTGCAGCTGCAGGAGTCGGGCCCAGGACTG GTGAAGCCTTCACAGACCCTGTCCCTCACCTGCA CTGTCTCTGGTGGCTCCATCAGAAGTGGTGGTGA CTACTGGAGTTGGATCCGCCAGCCACCAGGGAA GGGCCTGGAGTGGATTGGGTACATCTATTACAGT GGGAGCACCTACTACAACCCGTCCCTCAAGAGTC GAGTTACCATATCAGGAGACACGTCTAAGAACC AGTTCTCCCTGAAGCTGAGCTCTGTGACTGCCGC GGACACGGCCGTGTATTACTGTGCGAGGGATAG CAGCTCCTACGGTATGGACGTCTGGGGCCAAGG GACCACGGTCACCGTCTCCTCA<br>SEQ ID NO: 31747 |
| | | AA | QTVVTQEPSLTVSPGGTVTLTCASSTGAVTSGYY PNWFQQKPGQAPRALIYSTNKHSWTPARFSGS LLGGKAALTLSGVQPEDEAEYYCLLYYGGAHV VFGGGTKLTVL<br>SEQ ID NO: 27742 | QVQLQESGPGLVKPSQTLSLTCTVSGGSIRSGGDY WSWIRQHPGKGLEWIGYIYYSGSTYYNPSLKSRVTI SGDTSKNQFSLKLSSVTAADTAVYYCARDSSSYGM DVWGQGTTVTVSS<br>SEQ ID NO: 31748 |

FIGURE 50
(Continued)

| | | | |
|---|---|---|---|
| iPS:437128 | 21-225_213G3 | NA | CTGTCTGCCCTGACTCAGCCTGCCTCCGTGTCT GGGTCTCCTGGACAGTCGATCACCATCTCCTG CACTGGAACCAGCAGTGACGTTGGTGGTTATA ACTATGTCTCCTGGTACCAACAACACCCAGGC AAAGCCCCCAAACTCATGATTTCTGAGGTCAG GAATCGGCCCTCAGGGGTTTCTAATCGCTTCT CTGGCTCCAAGTCTGGCAACACGGCCTCCCTG ACCATCTCTGGGCTCCAGGCTGAGGACGAGGC TGATTATTACTGCAACTCATATACACGCAGCA TCACTTGGGTGTTCGGCGGAGGGACCAAGCTG ACCGTCCTA

SEQ ID NO: 27743 | CAGGTGCAGCTGGTGGAGTCTGGGGAGGCGTG GTCCAGCCTGGGAGGTCCCTGAGACTCTCCTGTG CAGCGTCTGGATTCACCTTCAGTCACTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGCATCTGCAAATGAACAGCCTGAGAGCCGAGG ACACGGCTGTGTATTACTGTGCGAGGGGGGACTG GAACCCCGAGGGTATGGACGTCTGGGGCCAAGG GACCTCGGTCACCGTCCTCCTCA

SEQ ID NO: 31749 |
| | | AA | LSALTQPASVSGSPGQSITISCTGTSSDVGGYNYV SWYQQHPGKAPKLMISEVRNRPSGVSNRFSGSK SGNTASLTISGLQAEDEADYYCNSYTRSITWVFG GGTKLTVL

SEQ ID NO: 27744 | QVQLVESGGGVVQPGRSLRLSCAASGFTFSHYGM HWVRQAPGKGLEWVAVIWYDGSNKYYADSVKGR FTISRDNSKNTLHLQMNSLRAEDTAVYYCARGDW NPEGMDVWGQGTSVTVSS

SEQ ID NO: 31750 |
| iPS:437130 | 21-225_213D5 | NA | CAGTCTGCCCTGACTCAGCCTGCCTCCGTGTCT GGGTCTCCTGGACAGTCGATCACCATCTCCTG CACTGGAACCAGCAGTGACGTTGGTGGTTATA ACTATGTCTCCTGGTACCAACAACACCCAGGC AAAGCCCCCAAACTCGTGATTTATGAGGTCCG TAATCGGCCCTCAGGGGTTTCTACTCGCTTCTC TGGCTCCAAGTCTGGCAACAAGGCCTCCCTGA CCATCTCTGGGCTCCAGGCTGAGGACGAGGCT GATTATTACTGCTGCTCATATACAAGAAGAAT CACTTGGGTGTTCGGCGGAGGGACCAAGCTGA CCGTCCTG

SEQ ID NO: 27745 | CAGGTGCAGCTGGTGGAATCTGGGGGAGGCGTG GTCCAGCCTGGGAGGTCCCTGAGACTCTCCTGTG CAGCGTCTGGATTCACCTTCAGTCACTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTTTCTGCAAATGAACAGCCTGAGAGTCGAGGA CACGGCTGTGTATTATTGTGCGAGGGGGGACTGG AACCCCGAGGGTATGGACGTCTGGGGCCAAGGGG ACCACGGTCACCGTCTCCTCA

SEQ ID NO: 31751 |

FIGURE 50
(Continued)

| | | | | |
|---|---|---|---|---|
| iPS:437132 | 21-225_213F5 | AA | QSALTQPASVSGSPGQSITISCTGTSSDVGGYNY VSWYQQHPGKAPKLVIYEVRNRPSGVSTRFSGS KSGNKASLTISGLQAEDEADYCCSYTRRITWV FGGGTKLTVL<br>SEQ ID NO: 27746 | QVQLVESGGGVVQPGRSLRLSCAASGFTFSHYGM HWVRQAPGKGLEWVAVIWYDGSNKYYADSVKGR FTISRDNSKNTLFLQMNSLRVEDTAVYYCARGDW NPEGMDVWGQGTTVTVSS<br>SEQ ID NO: 31752 |
| | | NA | CAGACTGTGTGACTCAGGAGCCCTCACTGAC TGTGTCCCAGGAGGACAGTCAGTCACCTCACCT GTGGTTCCAGCACTGGATCAGTCAGTCACCAGTGGT TACTTTCCAAACTGGTTCCAGCAGAAACCTGG ACAAACACCCAGGCACTGATTTATAGTACAA ACAACAAGCACTCCTGGACCCCTGCCCGGTTC TCAGGCTCCCTCCTTGGGGGCAAAACTGCCCT GACACTGTCAGATGTGCAGCCTGAGGACGAG GCTGACTATTACTGCCTGCTCTACTTTGGTGGT GCTCAGCTGGCATTCGGCGGAGGGACCAAACT GACCGTCCTA<br>SEQ ID NO: 27747 | CAGGTGCAGCTGCAGGAGTCGGGCCCAGGACTG GTGAAGCCTTCACAGACCCTGTCCCTCACCTGCA CTGTCTCTGGTGGCTCCATCAGAAGTGGTGGTGA CTACTGGAGCTGGATCCGCCAGCACCCAGGGAA GGGCCTGGAGTGGATTGGGTACATCTATTATAGT GGGAGCACCTACTACAACCCGTCCCTCAAGAGTC GAGTTACCATATCACTAGACACGTCTAAGAACCA GTTCTCCCTGAAGCTGAGCTCTGTGACTGTCGCG GACACGGCCGTGTATTACTGTGCGAGAGATTCAG CAGTGTACAATATGGACGTCTGGGGCCAAGGGA CCACGGTCACCGTCTCCTCA<br>SEQ ID NO: 31753 |
| | | AA | QTVVTQEPSLTVSPGGTVTLTCGSSTGSVTSGYF PNWFQQKPGQTPRPLIYSTNKHSWTPARFSGSL LGGKTALTLSDVQPEDEADYYCLLYFGGAQLAF GGGTKLTVL<br>SEQ ID NO: 27748 | QVQLQESGPGLVKPSQTLSLTCTVSGGSIRSGGDY WSWIRQHPGKGLEWIGYIYYSGSTYYNPSLKSRVTI SLDTSKNQFSLKLSSVTVADTAVYYCARDSAVYN MDVWGQGTTVTVSS<br>SEQ ID NO: 31754 |

FIGURE 50
(Continued)

| | | | |
|---|---|---|---|
| iPS:437134 | 21-225_213A7 | NA | CAGTCTGCCCTGACTCAGCCTGCCTCCGTGTCT GGGTCTCCTGGACAGTCGATCACCATCTCCTG CACTGGAACCAGCAGTGACGTTGGTGGTTATA ACTATGTCTCCTGGTACCAACAGCACCCAGGC AAAGCCCCCAAATTCATGATTTATGAGGTCAG GAATCGGCCCTCAAGTCTGGGGTTTCTAATCGCTTCT CTGGCTCCAAGTCTGGCAACACGGCCTCCCTG ACCATCTCTGGGCTCCAGGCTCATATACCAGGCC TGATTATTACTGCAGTCATATGCAAGGACCAGCC GCACTCTGGTATTCGGCGGAGGGACCAAGTTG ACCGTCCTA<br><br>SEQ ID NO: 27749<br><br>QSALTQPASVSGSPGQSITISCTGTSSDVGGYNY VSWYQQHPGKAPKFMIYEVRNRPSGVSNRFSGS KSGNTASLTISGLQAEDEADYYCSSYTSSRTLVF GGGTKLTVL<br><br>SEQ ID NO: 27750 | CAGGTGCAGCTGGTGCAGTCTGGGGCTGAGGTG AAGAAGCCTGGGGCCTCCGTGAAGATCTCCTGCA GGGCTTCTGGATTCACCTTCACGACTACTATGCA GAACTGGGTGCGACAGGCCCCTGGACAAGGGCT TGAGTGGATGGGATGGATCAACCCTAAGAATGG TGGCACAAACTATGCACAGAAGTTTCAGGGCAG GGTCACCATGACCAGGGACACGTCCTCAGCAG AGCCTACATGAGCTGAGTAGGCTGAGATCTGA CGAACGGCCGTGTATTACTGTGCGAAAGGGTAT GATTCGTTCGCCCCCTGGGGCCAGGGAACCCTGG TCACCGTCTCCTCA<br><br>SEQ ID NO: 31755<br><br>QVQLVQSGAEVKKPGASVKISCRASGFTFTDYYMN WVRQAPGQGLEWMGWINPKNGGTNYAQKFQGRV TMTRDTSLSRAYMELSRLRSDDTAVYYCAKGYDS FAPWGQGTLVTVSS<br><br>SEQ ID NO: 31756 |
| iPS:437136 | 21-225_214H3 | NA | CAGACTGTGGTGACTCAGGAGCCCTCACTGAC TGTGTCCCCAGGAGGGACAGTCACTCTCACCT GTGCTTCCAGCACTGGAGCAGTCACCAGTGGT TACTATCCAAACTGGTTCCAGCAGAAAACTGG ACAAGCACCCAGGGCACTGATTTATAGTACAA GCAACAAACACTCCTGTACCCTGCCCGGTTC TCAGGCTCCCTCTTGGGGGCAAAGCTGCCCT GACACCGTCAGGTGTGCAGCCTGAGGACGAG GCTGAGTATTACTGCTGCTCTACTATGGTGGT GCTCATGTGGTATTCGGCGGAGGGACCAAGCT GACCGTCCTA<br><br>SEQ ID NO: 27751 | CAGGTGCAGCTGCAGGAGTCGGGCCCAGGACTG GTGAAGCCTTCACAGACCCTGTCCTCACCTGCA CTGTCTCTGGTGGCTCCATCAGAAGTGGTGTGA CTACTGGAGTTGGATCCGCCAGCACCCAGGGAA GGGCCTGGAGTGGATTGGGTACATCTATTACAGT GGGAGCACCTACTACAACCCGTCCCTCAAGAGTC AGTTCTCCCTGAAGCTGAGCTCTGTGACTGCCGC GGACACGGCCGTGTATTACTGTGCGAGGGATAG CAGCTCCTACGGTATGGACGTCTGGGGCCAAGG GACCACGGTCACCGTCTCCTCA<br><br>SEQ ID NO: 31757 |

FIGURE 50
(Continued)

| | | AA | QTVVTQEPSLTVSPGGTVTLTCASSTGAVTSGYY PNWFQQKPGQAPRALIYSTSNKHSCTPARFSGSL LGGKAALTLSGVQPEDEAEYYCLLYYGGAHVV FGGGTKLTVL<br>SEQ ID NO: 27752 | QVQLQESGPGLVKPSQTLSLTCTVSGGSIRSGGDY WSWIRQHPGKGLEWIGYIYYSGSTYYNPSLKSRVTI SGDTSKNQFSLKLSSVTAADTAVYYCARDSSSYGM DVWGQGTTVTVSS<br>SEQ ID NO: 31758 |
|---|---|---|---|---|
| iPS:437138 | 21-225_214D8 | NA | CAGTCTGTGTTGACGCAGCCGCCCTCAGTGTC TGCGGCCCCAGGACAGAAGGTCACCATCTCCT GCTCTGGAAGCAGTCCAACATTGGGAATAAT TATGTATCCTGGTACCAGCAGTTCCCAGGAAC AGCCCCCAAACTCCTCATTCATGACAATAATA AGCGACCCTCAGGGATTCCTGACCGATTCTCT GGCTCCAAGTCTGGCACGTCAGCCACCCTGGG CATCACCGGACTCCAGACTGGGGACGAGCCT GATTATTACTGCGGAGCATGGGATAGCAGCCT GAGTGCTGTGATAATCGGCGAGGGAGCAAG CTGACCGGTCCTA<br>SEQ ID NO: 27753 | CAGGTGCAGCTGCAGGAGTCGGGCCCAGGACTG GTGAAGCCTTCACAGACCCTGTCCCTCACCTGCA CTGTCTCTGGTGGCTCCATCAGTACTGCTTTTTAC TACTGGAGCTGGATCCGCCAGCACCCAGGGAAG GGCCTGGAGTGGATTGGGTACATCTATTTCAGTG GGAGCACCTACTACAACCCGTCCCTCAAGAGTCG AGTTACCATATCAGTAGACACGTCTAAGAACCAG TTCTCCCTGAACCTGAGCTCTGTGACTGCCGCGG ACACGGCCGTGTATTACTGTGCGAGAGCAAGGG GATATCACTACAGTATCTTTGACTACTGGGGCCA GGGAACCCTGGTCACCGTCTCCTCA<br>SEQ ID NO: 31759 |
| | | AA | QSVLTQPPSVSAAPGQKVTISCSGSSSNIGNNYVS WYQQFPGTAPKLLIHDNNKRPSGIPDRFSGSKSG TSATLGITGLQTGDEADYYCGAWDSSLSAVVIG GGSKLTVL<br>SEQ ID NO: 27754 | QVQLQESGPGLVKPSQTLSLTCTVSGGSISTAFYYW SWIRQHPGKGLEWIGYIYFSGSTYYNPSLKSRVTIS VDTSKNQFSLNLSSVTAADTAVYYCARARGYHYSI FDYWGQGTLVTVSS<br>SEQ ID NO: 31760 |

FIGURE 50
(Continued)

| | | | |
|---|---|---|---|
| iPS:437140 | 21-225_214E12 | NA | CAGACTGTGGTGACTCAGGAGCCCTCACTGAC TGTGTCCCCAGGAGGGACAGTCACTCTCACCT GTGCTTCCAGCACTGGAGCAGTCACCAGTGGC TACTATCCAAACTGGTTCCAACAGAAACCTGG ACAAGCACCCCAGGGCACTGATTTATAGTACAA GCAATAAACACCTCTGGAACCCCTGCCGGTTC TCAGGCTCCCTCCTTGGGGGCAAAGCTGCCCT GACACGTCAGATGTGCAGCCTGAGGACGAG GCTGAGTATTACTGCCTGCTCTACTGTGATGGT GCCCAGCTGGTGTTCGGCGGAGGGACCAAACT GACCGTCCTA<br><br>SEQ ID NO: 27755<br><br>QTVVTQEPSLTVSPGGTVTLTCASSTGAVTSGYY PNWFQQKPGQAPRALIYSTSNKHSWTPARFSGS LLGGKAALTLSDVQPEDEAEYYCLLYCDGAQL VFGGGTKLTVL<br><br>SEQ ID NO: 27756 | CAGGTGCAGCTGACTCGGGCCCAGGACTG GTGAAGCCTTCACAGACCCTGTCCCTCACCTGCA CTGTCTCTGGTGGCTCCATCAGCAGTGGTGTGA TTACTGGAGCTGGATCCGCCAGCACCCAGGGAA GGGCCTGGAGTGGATTGGGTACATCTATTACAGT GGGAGCACCTACTACAACCGTCCTCAAGAGTC GAGTTACCATATCAGTAGACACGTCTAAGAACCA GTTCTCCCTGAAGCTGAGCTGTGTGACTGCCGCG GACACGGCCGTGATTATTGTGCGAGAGATGGGG CTGCGGAGGGTATGGACGTCTGGGGCCAAGGGA CCACGGTCACCGTCCTCTCA<br><br>SEQ ID NO: 31761<br><br>QVQLQESGPGLVKPSQTLSLTCTVSGGSISSGGDYW SWIRQHPGKGLEWIGYIYYSGPTYYNPSLKSRVTIS VDTSKNQFSLKLSSVTAADTAVYYCARDGAAEGM DVWGQGTTVTVSS<br><br>SEQ ID NO: 31762 |
| iPS:437142 | 21-225_215A3 | NA | CAGACTGTGGTGACTCAGGAGCCCTCACTGAC GGTGTCCCAGGAGGGACAGTCACTCTCACCT GTGCTTCCAGCACTGAAGCCGTCACCAGTGGT AACTATCCAAGTCAAGCCCAGGGCACTGATTTATAGTACAA ACAAGCACCCCAGGGCACTGATTTATAGTACAA GCAACAAACACTCCGGTACCCGTGCCGGTTT ACAGGCTCCCTCCTTGGGGCAAAGCTGCCT GACACGTCAGGTGTACAGCCTGAGGACGAG GCTGAGTATTACTGCCTGCTCTACTATGGTGG CGCTCAGCTGCATTCGGCGGAGGGACCAAGC TGGCCGTCCTA<br><br>SEQ ID NO: 27757 | CAGGTGCAGTTGCAGGAGTCGGGCCCAGGACTG GTGAAGCCTTCACAGACCCTGTCCCTCACCTGCA CTGTCTCTGGTGGCTCCATCAGCAGTGGTGTGA CTACTGGAGCTGGATCCGCCAGCACCCAGGGAA GGGCCTGGAGTGGATTGGGTACATCTATTACACT GGGAGCAACTACTACAACCGTCCTCAAGAGTC GAGTTACCATATCAGTAGACACGTCTAAGAATCA GTTCTCCCTGAAGGTGATCTCTGTGACTGCCGCG GACACGGCCGTGTATTACTGTGCGAGAGATTCAG CAGTGTACGGTATGGACGTCTGGGGCCAAGGGA CCACGGTCACCGTCTCCTCA<br><br>SEQ ID NO: 31763 |

FIGURE 50
(Continued)

| | | | |
|---|---|---|---|
| iPS:437144 | 21-225_215B3 | AA | QTVVTQEPSLTVSPGGTVTLTCASSTEAVTSGNY PSWFQQKPGQAPRALIYSTSNKHSGTPARFTGSL LGGKAALTLSGVQPEDEAEYYCLLYYGGAQLA FGGGTKLAVL<br>SEQ ID NO: 27758 | QVQLQESGPGLVKPSQTLSLTCTVSGGSISSGGDYW SWIRQHPGKGLEWIGYIYYTGSNYYNPSLKSRVTIS VDTSKNQFSLKVISVTAADTAVYYCARDSAVYGM DVWGQGTTVTVSS<br>SEQ ID NO: 31764 |
| | | NA | TCCTATGAGCTGACTCAGCCACCCTCAGTGTC CGTGTCCCAGGACAGAGCCAGCATCACCT GCTCTGGAGATAAATTGGGGGATAAAATTTGCT TGCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGGCGTGGGACAGCAGCACTGTGGTA TTCGGCGGAGGGACCAAGCTGACCGTCCTA<br>SEQ ID NO: 27759 | GAGGTGCAGCTGGTGGAGTCTGGGGGAGGCTTG GTAAAGCCTGGGGGGTCCCTTAGACTCTCCTGTG CAGCCTCTGGATTCACTTTCAGTAACGCTGGAT GCACTGGGTCCGCCAGCCTCCAGGAAGGGCT GGAGTGGGTTGGCCGTATTAAAGCAAAACTAA TGGTGGGACAACAGACTACGCTGCACCGTGAA AGGCAGATTCACCATTTCAAGAGATGATTCAAAA AACACGCTGTATCTGCAAATGAACAGCCTGAAA ACCGAGGACACAGCCGTGTATTACTGTACCACAG ATCCGGGGGGATCTTTGACTACTGGGGCCAGG GAACCCTGGTCACCGTCCTCCTCA<br>SEQ ID NO: 31765 |
| | | AA | SYELTQPPSVSVSPGQTASITCSGDKLGDKFACW YQQKPGQSPVLVIYQDSKRPSGIPERFSGSNSGN TATLTISGTQAMDEADYYCQAWDSSTVVFGGG TKLTVL<br>SEQ ID NO: 27760 | EVQLVESGGGLVKPGGSLRLSCAASGFTFSNAWM HWVRQAPGKGLEWVGRIKSKTNGGTTDYAAPVK GRFTISRDDSKNTLYLQMNSLKTEDTAVYYCTTDP GGIFDYWGQGTLVTVSS<br>SEQ ID NO: 31766 |

FIGURE 50
(Continued)

| | | | |
|---|---|---|---|
| iPS:437146 | 21-225_215D3 | NA | CAGTCTGCCCTGACTCAGCCTGCCTCCGTGTCT GGGTCTCCTGGACAGTCGATCACCATCCCTG CACTGGAACCAGCAGTGACATTGGTGTTATA ACTATGTCTCCTGGTACCAACAACACCAGGC AAAGCCCCCACACTCATGATTTATGAGGTCAG TAATCGGCCCTCAGGGGTTTCTAATCGCTTCTC TGGCTCCAAGTCTGGCAACACGGCCTCCCTGA CCATCTCTGGGCTCCAGGCTGAGGACGAGGCT GATTATTACTGCAACTCATATAAAAGGGGCAG CACTTGGGTGTTCGGCGGAGGGACCAAGGTGA CCGTCCTA<br><br>SEQ ID NO: 27761 | CAGACGCAGCTGGTGGAGTCTGGGGGAGGCGTG GTCCAGCCTGGGAGGTCCCTGAGACTCTCCTGT CAGCCGTCTGGATTCACCTTCAGTCACTATGGCAT GCACTGGGTCCGCCAGGCTCCAGGCAAGGGGCT GGAATGGGTGGCAGTTATATGGTATGATGAAGT AATGAGTACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGGGGGACTG GAACCCCGAGGTATGACGTCTGGGGCCAAGG GACCACGGTCACCGTCTCCTCA<br><br>SEQ ID NO: 31767 |
| | | AA | QSALTQPASVSGSPGQSITISCTGTSSDIGGYNYV SWYQQHPGKAPTLMIYEVSNRPSGVSNRFSGSK SGNTASLTISGLQAEDEADYYCNSYKRGSTWVF GGGTKVTVL<br><br>SEQ ID NO: 27762 | QTQLVESGGGVVQPGRSLRLSCAASGFTFSHYGMH WVRQAPGKGLEWVAVIWYDGSNEYYADSVKGRF TISRDNSKNTLYLQMNSLRAEDTAVYYCARGDWN PEGMDVWGQGTTVTVSS<br><br>SEQ ID NO: 31768 |
| iPS:437148 | 21-225_215H3 | NA | CAGACTGTGGTGACTCAGGAGCCCTCACTGAC TGTGTCCCCAGGAGGGACAGTCACTCACCT GTGCTTCCAGCCACTGGAGCAGTCACCAGTGGT TACTATCCAAACTGGTTCCAGCAGAAACCTGG ACAAGCACCCAGGGCACTGATTTATAGTACAA ACAACAAAACACTCCTGTTGGGACCTGCCCT TCAGGCTCCCTCCTTGGGGCAAAGCTGCCGT GACACTGTCAGGTGTACAGCCTGACGACGAGG CTGACTATTACTGCTGCTCTACTATGGTGTG CTCAGGTGGGATTCGGCGGAGGGACCAAGCT GACCGTCCTA<br><br>SEQ ID NO: 27763 | CAGGTGCAGCTGCAGGAGTCGGGCCCAGGACTG GTGAAGCCTTCACAGACCCTGTCCCTCACCTGCA GTGTCTCTGGTGCTCCATCAGAAGTGGTGGTGA CTACTGGAGCTGGATCCGCCAGCACCCAGGGAA GGGCCTGGAGTGGATTGGGTATATCTATTACAGT GGGAGCACCTACTACAACCCGTCCCTCAAGAGTC GAGTTACCATATCAGTAGACACGTCTAAGAACCA GTTCTCCCTGAAGCTGAGTTCTGTGACTGTCGCG GACACGGCCGTGTACTGTGCGAGATTCAG CAGTGTACGGTATGGACGTCTGGGGCCAAGGGA CCACGGTCACCGTCTCCTCA<br><br>SEQ ID NO: 31769 |

FIGURE 50
(Continued)

| | | AA | QTVTVTQEPSLTVSPGGTVTLTCASSTGAVTSGYY PNWFQQKPGQAPRALIYSTNNKHSCGPARFSGS LLGGKAALTLSGVQPDDEADYYCLLYYGGAQV GFGGGTKLTVL<br>SEQ ID NO: 27764 | QVQLQESGPGLVKPSQTLSLTCSVSGGSIRSGGDY WSWIRQHPGKGLEWIGYMYYSGSTYYNPSLKSRV TISVDTSKNQFSLKLSSVTVADTAVYYCARDSAVY GMDVWGQGTTVTVSS<br>SEQ ID NO: 31770 |
|---|---|---|---|---|
| iPS:437150 | 21-225_216A3 | NA | CAGTCTGCCCTGACTCAGCCTCCCTGTCT GGGTCTCCTGGACAGTCAGTCGATCACCATCTCCTG CACTGGAACCAGCAGTTGACGTTGGTTATA ATTATGTCTCCTGGTACCAACAACACCCAGGC AAAGCCCCCAAACTCATGATTTATGAGGTCAG TAATCGGCCCTCAGGGGTTTCTAATCGCTCTC TGGCTCCAAGTCTGGCAACACGACCCTCCCTGA CCATCTCTGGGCTCCAGGCTGAGGACGAGGCT GATTATTACTGCAACTCATATACAAGCAGCAT CACTTGGGTGTTCGGCGGAGGGACCAAGCTGA CCGTCCTA<br>SEQ ID NO: 27765 | CAGGTGCAGCTGGTGGAGTCTGGGGGAGGCGTG GTCCAGCCTGGGAGGTCCCTGAGACTCTCCTGTG CAGCGGCTCTGGATTCACCTTCAGTCACTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGGGGGACTG GAACCCGAGGGTTTGGACGTCTGGGGCCAAGG GACCACGGTCACCGTCTCCTCA<br>SEQ ID NO: 31771 |
| | | AA | QSALTQPASVSGSPGQSITISCTGTSSDVGGYNY VSWYQQHPGKAPKLMIYEVSNRPSGVSNRFSGS KSGNTASLTISGLQAEDEADYYCNSYTSSSITWVF GGGTKLTVL<br>SEQ ID NO: 27766 | QVQLVESGGGVVQPGRSLRLSCAASGFTFSHYGM HWVRQAPGKGLEWVAVIWYDGSNKYYADSVKGR FTISRDNSKNTLYLQMNSLRAEDTAVYYCARGDW NPEGLDVWGQGTTVTVSS<br>SEQ ID NO: 31772 |

FIGURE 50
(Continued)

| | | | |
|---|---|---|---|
| iPS:437154 | 21-225_216A7 | NA | CAGACTGTGGTGACTCAGGAGCCCTCACTGAC TGTGTCCCCAGGAGGGACAGTCACTCTCACCT GTGCTTCCAGCACTGGAGCAGTCACCAGTGGT TACTATCCAAACTGGTTCCAGCAGAAACCTGG ACAAGCACCCAGGCACTGGTTCTGATTTATAGTACAA ACAACAAACACTCCTGTACCCTGCCGGTTC TCAGGCTCCCTCCTTGGGGCAAAGCTGCCT GACACTGTCAGGTGTACAGCCTGACGACGAGG CTGACTATTACTGCCTGCTCTACTATGGTGGTG CTCAGGTGGGATTCGGCGGAGGGACCAAGCT GACCGTCCTA<br><br>SEQ ID NO: 27767 | CAGGTGCAGCTGCAGGAGTCGGGCCCAGGACTG GTGAAGCCTTCACAGACCCTGTCCCTCACCTGCA GTGTCTCTGGTGCCTCCATCAGAAGTGGTGTGA CTACTGGAGCTGGATCCGCCAGCACCCAGGAA GGGCCTGGAGTGGATTGGGTATATGTATTACAGT GGGAGCACCTACTACAACCGTCCTCAAGAGTC GAGTTACCATATCAGTAGACACGTCTAAGAACCA GTTCTCCCTGAAGCTGAGTTCTGTGCCGAGATTCAG GACACGGCCGTGTATTACTGTGCCGAGATTCAG CAGTGTACGGTATGGACGTCTGGGGCCAAGGGA CCACGGTCACCGTCTCCTCA<br><br>SEQ ID NO: 31773 |
| | | AA | QTVVTQEPSLTVSPGGTVTLTCASSTGAVTSGYY PNWFQQKPGQAPRALIYSTNNKHSCTPARFSGSL LGGKAALTLSGVQPDDEADYYCLLYYGGAQVG FGGGTKLTVL<br><br>SEQ ID NO: 27768 | QVQLQESGPGLVKPSQTLSLTCSVSGGSIRSGDY WSWIRQHPGKGLEWIGYMYYSGSTYYNPSLKSRV TISVDTSKNQFSLKLSSVTVADTAVYYCARDSAVY GMDVWGQGTTVTVSS<br><br>SEQ ID NO: 31774 |
| iPS:437158 | 21-225_216H11 | NA | CAGACTGTGGTGACTCAGGAGCCCTCACTGAC TGTGTCCCCAGGAGGGACAGTCACTCTCACCT GTGCTTCAGCACTGGAGCAGTCACCAGTGGC TGTCTATCCAAACTGGTTCCAACAGAAACCTGG ACAAGCACCCAGGCACTGATTTATAGTACAA GCAATAAACACTCCTGGACCCTGCCGGTTC TCAGGCTCCCTCCTTGGGGCAAAGCTGCCT GACACTGTCAGATGTGCAGCCTGAGGACGAG GCTGAGTATTACTGCCTGCTCTACTGTGATGGT GCTCAGGTGGTGTTCGGCGGAGGGACCAAACT GACCGTCCTA<br><br>SEQ ID NO: 27769 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGTGA TTACTGGAGCTGGATCCGCCAGCACCCAGGAA GGGCCTGGAGTGGATTGGTACATCTATTACAGT GGGCCCACTACTACAACCGTCCTCAAGAGTC GAGTTACCATATCAGTAGACACGTCTAAGAACCA GTTCTCCCTGAAGCTGAGCTCTGTGACTGCCGCG GACACGGCCGTGTATTATTGTGCGAGAGATGGGG CTGCGGAGGGTTTGACGTCTGGGGCCAAGGGA CCACGGTCACCGTCTCCTCA<br><br>SEQ ID NO: 31775 |

FIGURE 50
(Continued)

| | | | | |
|---|---|---|---|---|
| iPS:437160 | 21-225_216B12 | AA | QTVVTQEPSLTVSPGGTVTLTCASSTGAVTSGYYPNWFQQKPGQAPRALIYSTSNKHSWTPARFSGSLLGGKAALTLSDVQPEDEAEYYCLLYCDGAQLVFGGGTKLTVL<br>SEQ ID NO: 27770 | QVQLQESGPGLVKPSQTLSLTCTVSGGSISSGGDYWSWIRQHPGKGLEWIGYIYYSGPTYYNPSLKSRVTISVDTSKNQFSLKLSSVTAADTAVYYCARDGAAEGLDVWGQGTTVTVSS<br>SEQ ID NO: 31776 |
| | | NA | TCCTATGAGCTGACTCAGCCACTCTCAGTGTCAGTGGCCCTGGGACAGACGGCCAGGATTACCTGTGGGGGAGACAACATTAGAAGAAGAAATGTGCACTGGTACCAGCAGAAGCCAGGCCAGGCCCCTGTGCTGGTCATCTATAGGGATAGCAACCGGCCCTCTGGGATCCCTGAGCGATTCTCTGGCTCCAACTCGGGGAACACGGCCACCCTGACCATCAGCAGAGCCCAAGCCGGGATGAGGCTGACTATTACTGTCAGTGTGGGACAGCAGCACTGGGGTGTTCGGCGGAGGGACCAAGCTGACCGTCCTA<br>SEQ ID NO: 27771 | CAGGTGCAGCTGGTGGAGTCTGGGGGAGGCGTGGTCCAGCCTGGGAGGTCCCTGAGACTCTCCTGTGCAGCGGTCTGGATTCACCTTCAGTAGCTATGCCATGCACTGGGTCCGCCAGGCTCCAGGCAAGGGGCTGGAGTGGGTGGCAGTTATATGGTATGATGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCTGGGACTGGGATACTTCTTTGACTACTGGGGCCAGGGAACCCTAGTCACCGTCTCCTCA<br>SEQ ID NO: 31777 |
| | | AA | SYELTQPLSVSVALGQTARITCGGDNIRRRNVHWYQQKPGQAPVLVIYRDSNRPSGSNSGNTATLTISRAQAGDEADYCQVWDSSTGVFGGGTKLTVL<br>SEQ ID NO: 27772 | QVQLVESGGGVVQPGRSLRLSCAASGFTFSSYAMHWVRQAPGKGLEWVAVIWYDGSNKYYADSVKGRFTISRDNSKNTLYLQMNSLRAEDTAVYYCARDLGLGYFFDYWGQGTLVTVSS<br>SEQ ID NO: 31778 |

FIGURE 50
(Continued)

| | | | |
|---|---|---|---|
| iPS:437162 | 21-225_217B2 | NA | CAGTCTGCCCTGACTCAGCCTCGCTCCGTGTCT GGGTCTCCTGGACAGTCGATCACCATCTCCTG CACTGGAACCAGCAGTGACGTTGGTGGTTATA ACTATGTCCTGGTACCAACAACACCCAGGC AAAGCCCCAAACTCTTGATTTATGAGTCAG TAATCGGCCCTCAGGGGTTTATAATCGCTTCTC TGGCTCCAAGTCTGGCAACACGGCCTCCCTGA CCATCTCTGGGCTCCAGGCTGAGGACGAGGCT GATTATTACTGCGGCTCATATGTAAAAGGCAT CACTGGGTGTTCGGCGGAGGGACCAGTCTGA CCGTCCTC<br><br>SEQ ID NO: 27773 | CAGGTGCACCTGGTGGAGTCTGGGGGAGGCGTG GTCCAGCCTGGGAGGTCCCTGAGACTCTCCTGTG CAGCCGTCTGGATTCACCTTCAGTAACTATGGCAT GCACTGGGTCCGCCAGGCTCCAGGCAAGGGGCT GGAGTGGGTGGCAGTTATATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTATTGTGCGAGGGGACTG GAACCCCGAGGGTATGGACGTCTGGGGCCAAGG GACCACGGTCATCGTCTCCTCA<br><br>SEQ ID NO: 31779 |
| | | AA | QSALTQPASVSGSPGQSITISCTGTSSDVGGYNY VSWYQQHPGKAPKLLIYEVSNRPSGVYNRFSGS KSGNTASLTISGLQAEDEADYYCGSYVKGITWV FGGGTSLTVL<br><br>SEQ ID NO: 27774 | QVHLVESGGGVVQPGRSLRLSCAASGFTFSNYGM HWVRQAPGKGLEWVAVIWYDGSNKYYADSVKGR FTISRDNSKNTLYLQMNSLRAEDTAVYYCARGDW NPEGMDVWGQGTTVIVSS<br><br>SEQ ID NO: 31780 |
| iPS:437164 | 21-225_217C6 | NA | TCCTATGAGCTGACACAGCCACCCTCGGTGTC AGTGTCCCCAGGACAGAGCGACGGCCAGGATCACCT GCTCTGGAGATGCATTGCCAAAGCAATATGCT TATTGGTACCAGCAGAAGCCAGGCCAGGCCCC TATTGTGCTGGTGATATATAAAGACAGTGAGAGG AGTGCTGGGATTCCTGAGCGATTCTCTGGCTC CCGCTCAGGGACAACAGTCACGTTGACCATCA GAGGAGTCCAGGCAGAAGACGAGGCTGACTA TTACTGTCAATTAATAGTCAGCAGTGATACTT ATGTCTTCGGAACTGGGACCAAGGTCACCGTC CTA<br><br>SEQ ID NO: 27775 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATATGGTATGATGGAAGT GATGAATAATACTATGCAGACTCCGTGAAGGGCCGA TTCACCATCTCCAGAGACAATTCCAAGAACACGA TGTATCTGCAAATGAACAGCCTGAGAGCCGAAG ACACGGCTGTGTATTACTGTGCGAGAGAGGCCTATC TGTCTACTACTACGGTATGACGTCTGGGGCCAA GGGACCACGGTCACCGTCTCCTCA<br><br>SEQ ID NO: 31781 |

FIGURE 50
(Continued)

| | | | AA | SYELTQPPSVSVSPGQTARITCSGDALPKQYAYW YQQKPGQAPVLVIYKDSERPSGSIPERFSGSRSGTT VTLTIRGVQAEDEADYYCQLIVSSDTYVFGTGT KVTVL<br>SEQ ID NO: 27776 | QVQLVESGGGVVQPGRSLRLSCAASGFTFSNYGM HWVRQAPGKGLEWMAIIWFDGSDEYYADSVKGRF TISRDNSKNTMYLQMNSLRAEDTAVYYCARGLSV YYYGMDVWGQGTTVTVSS<br>SEQ ID NO: 31782 |
|---|---|---|---|---|---|
| iPS:437166 | 21-225_217G11 | | NA | TCCTATGAGCTGACACAGCCACCCTCGGTGTC AGTGTCCCCAGGACAGACGGCCAGGATCACCT GCTCTGGAGATGCATTGCCAAAACAATATGCT TATTGGTACCAGCAGAAGCCAGGCCAGGCCCC AGTACTGGTGATATATAAAGACAGTGAGAGG CCCTCAGGGATCCCTGAGCGATTCTCTGGCTC CCGCTCAGGGACAACAGTCACGTTGACCGTCA GTGGAGTCCAGGCAGAAGACGAGGCTGACTA TTACTGTCAATTAGTGTACAGCAGTGATACTT ATGTCTTCGGAACTGGGACCAAGGTCACCGTC CTA<br>SEQ ID NO: 27777 | CAGGTGCAGTTGGTGGAGTCTGGGGGAGGCGTG GTCCAGCCTGGGAGGTCCCTGAGACTCTCCTGTG CAGCGTCTGGATTCACCTTCAGGAACTATGGCAT GCACTGGGTCCGCCAGGCTCCAGGCAAGGGGCT GGAGTGGGTGTCAATTATATGGTTTGATGGAAGT GATCAGTAGTACTATGCAGACTCCGTGAAGGGCCGAT TCACCATCTCCAGAGACAATCAAGAACACGCT GTATCTGCAAATGAACAGCTGAGAGCCGAGGA CACGGCTGTATATTACTGTGCGAGAGGCCTCTCT GTCTACTACTACGGTATGGACGTCTGGGGCCAAG GGACCACGGTCACCGTCTCCTCA<br>SEQ ID NO: 31783 |
| | | | AA | SYELTQPPSVSVSPGQTARITCSGDALPKQYAYW YQQKPGQAPVLVIYKDSERPSGIPERFSGSRSGTT VTLTVSGVQAEDEADYYCQLVYSSDTYVFGTGT KVTVL<br>SEQ ID NO: 27778 | QVQLVESGGGVVQPGRSLRLSCAASGFTFRNYGM HWVRQAPGKGLEWVSIIWFDGSDQYYADSVKGRF TISRDNSKNTLYLQMNSLRAEDTAVYYCARGLSVY YYGMDVWGQGTTVTVSS<br>SEQ ID NO: 31784 |

FIGURE 50
(Continued)

| | | | |
|---|---|---|---|---|
| iPS:437168 | 21-225_218G4 | NA | CAGTCTGTGTTGACGCAGCCGCCCTCAGTGTCTGCGGCCCCAGGACAGAAGGTCACCATCCCTGCTCTGGAAGCAGTCCAACATTGGGAATAATTATGTATCCTGGTACCAGCAGCTCCCAGGAACAGCCCCCAAACTCCTCTTATGACAGTAATAAGCGACCCTCAGGGATTCCTGCCGATTCTCTAGGCTCCAAGTCTGCACGTCAGCCACCCTGGGCATCACCGGACTCCAGACTGGGACGAGGCCGATTATTACTGCGGAACATGGGATAGCAGCCTGAATACTGTGTTATTCGGCGGAGGGACCAAGCTGACCGTCCTA<br><br>SEQ ID NO: 27779<br><br>QSVLTQPPSVSAAPGQKVTISCSGSSSNIGNNYVSWYQQLPGTAPKLLLYDSNKRPSGIPARFSGSKSGTSATLGITGLQTGDEADYYCGTWDSSLNTVFGGGTKLTVL<br><br>SEQ ID NO: 27780 | CAGGTGCAGCTGGTGGAGTCTGGGGGAGGCGTAGTCCAGCCTGGGAGGTCCCTGAGACTCTCCTGTGCAGGGTCTGGATTCACCTTCAGTAGCTATGGCTTGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGTCGAGGACACGGCTGTGTACTACTGTGCGAACTGGTACTACTATTACTACGGTATGGACGTCTGGGGCCAAGGGACCACGGTCACCGTCTCCTCA<br><br>SEQ ID NO: 31785<br><br>QVQLVESGGGVVQPGRSLRLSCAASGFTFSSYGLHWVRQAPGKGLEWVAVIWYDGSNKYYADSVKGRFTISRDNSKNTLYLQMNSLRAEDTAVYYCANWYYYYYGMDVWGQGTTVTVSS<br><br>SEQ ID NO: 31786 |
| iPS:437170 | 21-225_218E5 | NA | TCCTATGAGCTGACACAGCCACCCTCGGTGTCAGTGTCCCAGGACAGACAGGCCAGGATCACCTGCTCTAGAGATGTATTGCGAAGCAATATGCTTATTGGTACCAGCAGAAGCCAGGCCAGGCCCCAGTACTGGTGATATATAAAGACAGTGAGAGGCCCTCAGGGATCCCTGAGCGATTCTCTGGCTCCGGCTCAGGGACAACAGTCACGTTGACCATCAGAGGAGTCCAGGCAGAAGAGGCTGACTATTACTGTCAATTAGTTGTCAGCAGTGATACTTAGTCTTCGGAACTGGGACCAAGGTCACCGTCCTA<br><br>SEQ ID NO: 27781 | CAGGTGCAGTTGGTGGAGTCTGGGGGAGGCGTGGTCCAGCCTGGGGAGGTCCCTGAGACTCTCCTGTGCAGCGTCTGGATTCACCTTCAGTAACTATGGCATGCACTGGGTCCGCCAGGCTCCAGGCAAGGGGCTGGAGTGGGTGGCAGTTATATGGTTTGATGGAAGTGATGAATACTATGCAGACTCCGTGAAGGGCCGATTCACCATCTCCAGAGACAATGAACAGCCTGAGAGCCGAGGTGTATCTGCAAATGAACAGCCTGAGAGCCGAGGACACGGCTGTATATTACTGTGCGAGAGCCTATCTGTCTACTACTACGGTATGGACGTCTGGGGCCAAGGGACCACGGTCACCGTCTCCTCA<br><br>SEQ ID NO: 31787 |

FIGURE 50
(Continued)

| | | | | |
|---|---|---|---|---|
| iPS:437172 | 21-225_219A7 | AA | SYELTQPPSVSVSPGQTARITCSRDVLPKQYAYW YQQKPGQAPVLVIYKDSERPSGIPERFSGSRSGTT VTLTIRGVQAEDEADYYCQLVSSDTYVFGTGT KVTVL<br>SEQ ID NO: 27782 | QVQLVESGGGVVQPGRSLRLSCAASGFTFSNYGM HWVRQAPGKGLEWMAIIWFDGSDEYYADSVKGRF TISRDNSKNTLYLQMNSLRAEDTAVYYCARGLSVY YYGMDVWGQGTTVTVSS<br>SEQ ID NO: 31788 |
| | | NA | CAGTCTGCCCTGACTCAGCCTGCCTCCGTGTCT GGGTCTCCTGGACAGTCGATCACCATCTCCTG CACTGGAACCAGCAGTGACGTTGGTGGTTATA ATTATGTCTCCTGGTACCAACAGCACCCAGGC AAAGCCCCCAAACTCATGATTTATGAGGTCAG AAATCGGCCCTCAGGGGTTTCTAACCGCTTCT CTGGCTCCAAGTCTGGCAACACGGCCTCCCTG ACCATCTCTGGGCTCCAGGCTGAGGACGAGGC TGATTATTACTGCTGCTCATATACAAGGAGCA TCACTTGGGGTGTTCGGCGGAGGGACCAAGTTG ACCGTCCTA<br>SEQ ID NO: 27783 | CAGGTGCAGCTGGTGGAGTCTGGGGGAGGCGTG GTCCAGCCTGGGAGGTCCCTGAGACTCTCCTGTC CAGCGTCTGGATTCACCTTCAGTCACTATGGCAT GCACTGGGTCCGCCAGGCTCCAGGCAAGGGGCT GGAGTGGGTGGCAGTCATATGGTATGATGGAAG TAATAAATACTATGCAGACTCCGTGAAGGGCCG ATTCACCATCTCCAGAGACAATTCCAAGAATATG CTGTATCTGCAAATGAACAGCCTGAGAGCTGAG GACACGGCTGTGTATTACTGTGCGAGGGGGACT GGAACCCCGAGGGTATGGACGTCTGGGGCCAAG GGACCACGGTCACCGTCTCCTCA<br>SEQ ID NO: 31789 |
| | | AA | QSALTQPASVSGSPGQSITSCTGTSSDVGGYNY VSWYQQHPGKAPKLMIYEVRNRPSGVSNRFSGS KSGNTASLTISGLQAEDEADYCCSYTRSITWVF GGGTKLTVL<br>SEQ ID NO: 27784 | QVQLVESGGGVVQPGRSLRLSCPASGFTFSHYGMH WVRQAPGKGLEWVAVIWYDGSNKYYADSVKGRF TISRDNSKNMLYLQMNSLRAEDTAVYYCARGDWN PEGMDVWGQGTTVTVSS<br>SEQ ID NO: 31790 |

FIGURE 50
(Continued)

| | | | | |
|---|---|---|---|---|
| iPS:437182 | 21-225_221H2 | NA | CTGTCTGCCCTGACTCAGCCTGCCTCCGTGTCT GGGTCCTGGACAGTCGATCACCATCTCCTG CACTGGAACCAGCAGTGACGTTGGTGGTTATA ACTATGTCTCCTGGTACCAACAACACCAGGC AAAGCCCCCAAACTCATGATTTCTGAGGTCAG GAATCGGCCCTCAAGTCTGGCAACACGGCCTCCCTG CTGGCTCCAAGTCTGGCAACACGGCCTCCCTG ACCATCTCTGGGCTCCAGGCTGAGGACGAGGC TGATTATTACTGCAACTCATATACACGCAGCA TCACTTGGGTGTTCGGCGGAGGGACCAAGCTG ACCGTCCTA<br><br>SEQ ID NO: 27785 | CAGGTGCAGCTGGTGGAGTCTGGGGGAGGCGTG GTCCAGCCTGGGAGGTCCCTGAGACTCTCCTGTG CAGCGTCTGGATTCACCTTCAGTCACTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGCATCTGCAAATGAACAGCCTGAGAGCCGAGG ACACGGCTGTGTATTACTGTGCGAGGGGGACTG GAACCCGAGGGTATGGACGTCTGGGGCCAAGG GACCACGGTCACCGTCTCCTCA<br><br>SEQ ID NO: 31791 |
| | | AA | LSALTQPASVSGSPGQSITISCTGTSSDVGGYNYV SWYQQHPGKAPKLMISEVRNRPSGVSNRFSGSK SGNTASLTISGLQAEDEADYYCNSYTRSITWVFG GGTKLTVL<br><br>SEQ ID NO: 27786 | QVQLVESGGGVVQPGRSLRLSCAASGFTFSHYGM HWVRQAPGKGLEWVAVIWYDGSNKYYADSVKGR FTISRDNSKNTLHLQMNSLRAEDTAVYYCARGDW NPEGMDVWGQGTTVTVSS<br><br>SEQ ID NO: 31792 |
| iPS:437184 | 21-225_221G4 | NA | CAGTCTGCCCTGACTCAGCCTGCCTCCGTGTCT GGGTCCTGGACAGTCGATCACCATCTCCTG CACTGGAACCAGCAGTGACGTTGGTGGTTATA ACTATGTCTCCTGGTACCAACAACACCAGGC AAAGCCCCCAAACTCATGATTTATGAGGTCAG GAATCGGCCCTCAAGGGTTTCTAATCGCTTCT CTGGCTCCAAGTCTGGCAACACGGCCTCCCTG ACCATCTCTGGGCTCTGAGGACGAGGC TGATTATTACTGCAACTCATATACACGCAGCA TCACTTGGGTGTTCGGCGGAGGGACCAAGCTG ACCGTCCTA<br><br>SEQ ID NO: 27787 | CAGGTGCAGCTGGTGGAGTCTGGGGGAGGCGTG GTCCAGCCTGGGAGGTCCCTGAGACTCTCCTGTG CAGCGTCTGGATTCACCTTCAGTCACTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTGCAAATGAACAGCCTGAGAGCCGAG ACACGGCTGTGTATTACTGTGCGAGGGGGGACTG GAACCCGAGGGTATGGACGTCTGGGGCCAAGG GACCTCGGTCACCGTCTCCTCA<br><br>SEQ ID NO: 31793 |

FIGURE 50
(Continued)

| | | AA | QSALTQPASVSGSPGQSITISCTGTSSDVGYNYVSWYQQHPGKAPKLMIYEVRNRPSGVSNRFSGSKSGNTASLTISGLQAEDEADYYCNSYTRSITWVFGGGTKLTVL<br>SEQ ID NO: 27788 | QVQLVESGGGVVQPGRSLRLSCAASGFTFSHYGMHWVRQAPGKGLEWVAVIWYDGSNKYYADSVKGRFTISRDNSKNTLHLQMNSLRAEDTAVYYCARGDWNPEGMDVWGQGTSVTVSS<br>SEQ ID NO: 31794 |
|---|---|---|---|---|
| iPS:437186 | 21-225_224H2 | NA | TCCTATGAGCTGACTCAGCCAGACTCCTCAGTGTCCGTGTCCCCAGGACAGACAGCAGCCAGCATCACCTGCTCTGGAGATAATTTGGGGGTAAATATACTTACTGGTATCAGCAGAAGCCAGGCCAGTCCCCTGTGCTAGTCGTCTATCAAGATAGCAAGCGGCCCTCAGGGATCCGAGCGATTCTCTGGCTCCAACTCTGGGAACACAGCCACTCTGACCATCAGCGGGACCCAGGCTATGGATGAGGCTGACTATTACTGTCAGGCGTGGGACAGCAGCACTGTGGTATTCGGCGGAGGGACCAAGCTGACCGTCCTA<br>SEQ ID NO: 27789 | CAGGTACAGCTGCAGCAGTCAGGTCCAGGACTGGTGAAGCCCTCGCAGACCCTCACTCACCTGTGACATCTCCGGGACAGTGTCTCTAGCAACAGTGCTGCTTGGAACTGGATCAGGCAGTCCCCATGCGAGGCCTTGAGTGGCTGGGAAGGACATACTACAGGTCCAAGTGGTATAATGATTCAGTATCTGTGAAAGTCGAGTAACCATCAACCAGACACATCCAAGAACCAGTTCTCCTGCAGTGAACTCTGTGACTCCGAGGACACGGCTGTGTATTACTGTGCAAGAGAGGGGCCTAGGATATTGTAGTAGTACCAGCTGCTATGGAGGCTGGTTCGACCCCTGGGGCCAGGGAACCCTGGTCACCGTCTCCTCA<br>SEQ ID NO: 31795 |
| | | AA | SYELTQPSSVSVSPGQTASITCSGDNLGVKYTYWYQQKPGQSPVLVVYQDSKRPSGIPERFSGSNSGNTATLTISGTQAMDEADYYCQAWDSSTVFGGGTKLTVL<br>SEQ ID NO: 27790 | QVQLQQSGPGLVKPSQTLSLTCDISGDSVSSNSAAWNWIRQSPSRGLEWLGRTYYRSKWYNDYAVSVKSRVTINPDTSKNQFSLQLNSVTPEDIAVYYCAREGGLGYCSSTSCYGGWFDPWGQGTLVTVSS<br>SEQ ID NO: 31796 |

FIGURE 50
(Continued)

| | | NA | CAGTCTGTGCTGACGCAGCCGCCCTCAGTGTC TGGGGCCCCAGGGCAGAGGGTCACCATCTCCT GCACTGGGAGCAGCTCCAACATCGGGGCAGG TTATGATGTACACTGGTACCAGCAGCTTCCAG GAACAGCCCCAAACTCCTCATCTTTGGTAAC AGCAATCGGCCCTCCAGGGGTCCCTGACCGATT CTCTGGCTCCAAGTCTGGCACCTCAGCTCCCT GGCCATCACTGGGCTCCAGGCTGAGGATGAGG CTGATTATTACTGCCAGTCCTATGACAACAGC CTGAGTGGTGTGTTCGGCGGAGGGACCAAGCT GACCGTCCTA | CAGGTACACCTGGTGCAGTCTGGGGCTGAGGTG AAGAAGCCTGGGGCCTCAGTGAAGGTCTCTGC AAGGCTTCTGGATACACCTTCACCGGCTACTATA TACACTGGGTGCGACAGGCCCTGACAAGGGC TTGAGTGGATGGGATGGATCAACCCTAAAAATG GTGGCACAAACTATGCACAGGAGCGTCAGGGCA GGGTCACCATGACCAGGGACGACGTCCATCAGCA CAACCTACATGGAGCTGAGCAGGCTGAGATCTG ACGACACGGCCGTGTATTACTGTGCGAGAGAG CGTTTGATTACTTCTACTACTACGCTATGACGTC TGGGGCCAAGGGACCACGGTCACCGTCTCCTCA |
| iPS:437188 | 21-225_224B11 | | SEQ ID NO: 27791 | SEQ ID NO: 31797 |
| | | AA | QSVLTQPPSVSGAPGQRVTISCTGSSSNIGAGYD VHWYQQLPGTAPKLLIFGNSNRPSGVPDRFSGS KSGTSASLAITGLQAEDEADYHCQSYDNSLSGV FGGGTKLTVL | QVHLVQSGAEVKKPGASVKVSCKASGYTFTGYYIH WVRQAPGQGLEWMGWINPKNGGTNYAQKFQGRV TMTRDASISTTYMELSRLRSDDTAVYYCARGAFDY FYYYAMDVWGHGTTVTVSS |
| | | | SEQ ID NO: 27792 | SEQ ID NO: 31798 |
| iPS:437190 | 21-225_225A9 | NA | TCCTATGAGCTGACTCAGCCACCCTCAGTGTC CGTGTCCCCAGGACAGACAGCCAGCATCACCT GCTCTGGAGATAAATTGGGAATAAATATGCT TGCTGGTATCAGCAGAAGCCAGGCCAGTCCCC TGTGTTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCAACACTGCATGT GTCTTCGGAACTGGGACCAAGGTCACCGTCCT A | CAGGTGCAGCTGGTGGAGTCTGGGGGAGGCGTG GTCCAGCCTGGGGGGTCCCTGAGACTCTCCTGTG CAGGGTCTGGATTCACCTTCAGTAGCTACCATGCAT GCACTGGGTCCGCCTGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACATTTCCCAGAACACGC TGTATCTGCAAATGAACAGCCTGAGAGCCGAGG ACACGGCTGTGTATTACTGTGCGAGAGATAACCA CTATTGTAGTAGTACCAGCTGCTCCCCATACTAC TACTACTTCGGTATGGACGTCTGGGGCCAAGGGA CCACGGTCACCGTCCTCA |

FIGURE 50
(Continued)

| | | | | |
|---|---|---|---|---|
| | | AA | SEQ ID NO: 27793<br>SYELTQPPSVSVSPGQTASITCSGDKLGNKYACW<br>YQQKPGQSPVLVIYQDSKRPSGIPERFSGSNSGN<br>TATLTISGTQAMDEADYYCQAWDSNTACVFGT<br>GTKVTVL | SEQ ID NO: 31799<br>QVQLVESGGGVVQPGGSLRLSCAASGFTFSTYGMH<br>WVRLAPGKGLEWVAVIWYDGSNKYYADSVKGRF<br>TISRDISQNTLYLQMNSLRAEDTAVYYCARDNHYC<br>SSTSCSPYYYFGMDVWGQGTTVTVSS |
| | | | SEQ ID NO: 27794 | SEQ ID NO: 31800 |
| iPS-437192 | 21-225_225E9 | NA | TCCTATGACCTGACTCAGCCACCCTCAGTGTC<br>CGTGTCCCCAGGACAGACAGCCAGCATCACCT<br>GCTCTGGAGATAATTTGGGAATAGATATGCT<br>TGCTGGTATCAGCAGAAGCCAGGCCAGTCCCC<br>TGTACTGGTCATGTATCAAGATCGCAAGCGGC<br>CCTCAGGGATCCCTGAGCGATTCTCTGGCTCC<br>AACTCTGGGAACACAGCCACTCTGACCATCAG<br>CGGGACCCAGGCTATGGATGAGGCTGACTATT<br>ACTGTCAGGCGTGGGACAGCAGAACTGCTGTG<br>GTATTCGGCGGAGGGACCAAGCTGACCGTCCT<br>A | CAGGTGCAGTTGGTGGAGTCTGGGGGAGGCGTG<br>GTCCAGCCTGGGAGGTCCTGAGACTCTCCTGTG<br>AAGCGTCTGGATTCATCTTCAGTAGCTATGGCAT<br>GCACTGGGTCCGCCAGGCTCCAGGCAAGGGCT<br>GGAGTGGGTGGCAGTTATGTGGTATGATGGAGGT<br>AATAAAGACTATGCAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGCTGTGTATTACTGTGCGAGAGATCGGA<br>ATATTGTACTAGTACCAGCTGCCCTTACTACTAC<br>TACTACGGTATGACGTCTGGGGCCAAGGGACC<br>ACGGTCACCGTCTCCTCA |
| | | AA | SEQ ID NO: 27795<br>SYDLTQPPSVSVSPGQTASITCSGDNLGNRYAC<br>WYQQKPGQSPVLVMYQDRKRPSGIPERFSGSNS<br>GNTATLTISGTQAMDEADYYCQAWDSRTAVVF<br>GGGTKLTVL | SEQ ID NO: 31801<br>QVQLVESGGGVVQPGRSLRLSCEASGFIFSSYGMH<br>WVRQAPGKGLEWVAVMWYDGGNKDYADSVKGR<br>FTISRDNSKNTLYLQMNSLRAEDTAVYYCARDREY<br>CTSTSCPYYYYGMDVWGQGTTVTVSS |
| | | | SEQ ID NO: 27796 | SEQ ID NO: 31802 |

FIGURE 50
(Continued)

| | | | |
|---|---|---|---|
| iPS:437194 | 21-225_226B2 | NA | TCCTATGAGCTGACTCAGCCACCCTCAGTGTC CGTGTCCCAGGACAGCAGCCAGCATCACCT GCTCTGGAGATACATTGGGGGTAAATATGCT TGGTGGTATCAGCAGAGGCCAGGCCAGTCCC TGTGCTGGTCATCTATCAAGATCGCAAGCGG CCTCAGGGATCCCTGAGCGATTCTCTGGCTCC AGCTCTGGGAACACAGCCACTCTGACCATCAG CGGGACCCAGGCTATGGATGAGGCTGACTATT ACTGTCAGGCGTGGGACAACGGCGCTGCGGTT TTCGGCGGAGGGACCAAGCTGACCGTCCTA<br><br>SEQ ID NO: 27797 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTTTA TGCACTGGGTGCGACAGGCCCCTGGACAAGGGC TTGAGTGGATGGGATGGATCAACCCTAACAGTGG TGACACAAACTATGCACAGAAGTTTCAGGGCAG GGTCACCATGACCAGGGACACGTCCTCAACAC AGCCTACATGGAGCTGAGCAGGCTGAGATCTGA CGACACGGCCATTTATTACTGTGCGAGAGGACT TACTATGGTTCGGGGAGTTATTTTAACGAACTTG ACTCCTGGGGCCAGGGAACCCTGGTCACCGTCTC CTCA<br><br>SEQ ID NO: 31803 |
| | | AA | SYELTQPPSVSVSPGQTASITCSGDTLGKYAW WYQQRPGQSPVLVIYQDRKRPSGIPERFSGSSSG NTATLTISGTQAMDEADYYCQAWDNGAAVFGG GTKLTVL<br><br>SEQ ID NO: 27798 | QVQLVQSGAEVKKPGASVKVSCKASGYTFTGYFM HWVRQAPGQGLEWMGWINPNSGDTNYAQKFQGR VTMTRDTSLNTAYMELSRLRSDDTAIYYCARGYTYY GSGSYFNELDSWGQGTLVTVSS<br><br>SEQ ID NO: 31804 |
| iPS:437196 | 21-225_226B7 | NA | TCCTTTGAGCTGACACAGCCACCTCGGTGTC AGTGTCCCAGGACAGCAGCCAGGATCACCT GCTCTGGAGATGCATTGCCAAGGCATTATGTT TATTGGTACCAGCAGAAGCCAGGCCAGGCCCC TGTGCTGGTGATATATAAAGACAGTGAGAGGC CCTCAGGGATCCCTGAGCGATTCTCTGGCTCC AGCTCAGGGACAACAGTCACGTTGACCATCAG TGGAGTCCAGGCAGAAGACGAGGCTGACTATT ACTGTCAATCAGCAGACAGCAGTGGTACTTAT GTCTTCGGAACTGGGACCAAGGTCACCGTCCT A<br><br>SEQ ID NO: 27799 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTTTA TGCACTGGGTGCGACAGGCCCCTGGACAAGGAC TTGAGTGGATGGGATGGATCAACCCTAACAGTGG AGGCACAAACTATGCACAGAAGTTTCAGGACAG GGTCACCATGACCAGGGACACGTCATCAGCAC AGCCCACATGGAGCTGAGCAGGCTGAGATCTGA CGACACGGCCGTGTATTATTGTGCGAGAGATAT TACTATGGTTCGGGGAGTTATTATAACTGGTTCG ACTCCTGGGGCCAGGGAACCCTGGTCACCGTCTC CTCA<br><br>SEQ ID NO: 31805 |

FIGURE 50
(Continued)

| | | | | |
|---|---|---|---|---|
| | | AA | SFELTQPPSVSVSPGQTARITCSGDALPRHYVYW YQQNPGQAPVLVIYKDSERPSGIPERFSGSSSGTT VTLTISGVQAEDEADYYCQSADSSGTYVFGTGT KVTVL<br>SEQ ID NO: 27800 | QVQLVQSGAEVKKPGASVKVSCKASGYTFTGYYM HWVRQAPGQGLEWMGWINPNSGGTNYAQKFQDR VTMTRDTSISTAHMELSRLRSDDTAVYYCARGYYY GSGSYYNWFDSWGQGTLVTVSS<br>SEQ ID NO: 31806 |
| iPS:437198 | 21-225_226F8 | NA | CAGTCTGTGCTGACGCAGCCGCCCTCAGTGTC TGGGGCCCCAGGGCAGAGGGTCACCATCTCCT GCACTGGGAGCAGCTCCAACATCGGGGCAGG TTATGATGTACACTGGTACCAGCAGCTTCCAG GAACAGCCCCCAAACTCCTCATCTATGGTAAC AGCAATCGGCCCTCAGGGGTCCCTGACCGATT CTCTGGCTCCAAGTCTGACACCTCAGCTCCCT GGCCATCACTGGGCTCCAGGCTGAGGATGAGG CTGATTATTACTGCCAGTCCTATGACAACAGC CTGAGTGGTGTGTTCGGCGGAGGGACCAAGCT GACCGTCCTA<br>SEQ ID NO: 27801 | CAGGTGCAACTGGTGCAGTCTGGGGCTGAGGTG AAGAAGCCTGGGGCCTCAGTGAAAGTCTCCTGC AAGGCTTCTGGATACACCTTCACCGGCTACTATA TACACTGGGTGCGACAGGCCCCTGGACAAGGGC TTGAGTGGATGGGATGGATCAACCCTAACAGTGG TGGCACAAACTATGCACAGGGACACGTTCAGGGCAG GGTCACCATGACCAGGGACACGTCCATCAGCAC AGCCTACATGGAGCTGAGCAGACTGAGATCTGA CGACACGGCCGTGTATTACTACTGCGAGGAGC GTTTGATTATTACTACTACGCTTTGGACGTCT GGGGCCAAGGGACCACGGTCACCGTCTCCTCA<br>SEQ ID NO: 31807 |
| | | AA | QSVLTQPPSVSGAPGQRVTISCTGSSNIGAGYD VHWYQQLPGTAPKLLIYGNSNRPSGVPDRFSGS KSDTSASLAITGLQAEDEADYYCQSYDNSLSGV FGGGTKLTVL<br>SEQ ID NO: 27802 | QVQLVQSGAEVKKPGASVKVSCKASGYTFTGYYIH WVRQAPGQGLEWMGWINPNSGGTNYARKFQGRV TMTRDTSISTAYMELSRLRSDDTAVYYCARGAFDY YYYYALDVWGQGTTVTVSS<br>SEQ ID NO: 31808 |

FIGURE 50
(Continued)

| | | | |
|---|---|---|---|
| iPS:437200 | 21-225_226A10 | NA | TCCTATGAGCTGACTCAGCCACCCTCAGTGTC CGTGTCCCAGGAGACAGCAGCCAGGATCACCT GCTCTGGAGATACATTGGGGGGTAAATATGCT TGGTGGTATCAGAGAAGCCAGGCCAGTCCCC TGTGCTGGTCATCTATCAAGATGCGAAGCGGC CCTCAGGGATCCCTGAGCGATTCTCTGGCTCC AGCTCTGGGAACACAGCCACTCTGACCATCAG AGGGACCCAGGCTATGGATGAGGCTGACTATT ACTGTCAGGCGTGGGACAACGGCGCTGCGGTT TTCGGCGGAGGGACCAAGCTGACCGTCCTA | CAGGTGCAACTGGTGCAGTCTGGGGCTGAGGTG AAGAAGCCTGGGGCCTCAGTGAAGGTCCTGC AAGGCTTCTGGATACACCTTCACCGGCTACTTTA TGCACTGGGTGCGACAGGCCCCTGGACAAGGGC TTGAGTGGATGGGTTGGATCAACCCTAACAGTGG TGACACAAACTATGCACAGAAGTTCAGGGCAG TGACCATGACCAGGGACACGTCCTAGCAC GGTCACCATGGAGCTGAGCAGGCTGAGATCGA AGCTACATGGAGCTGAGCAGGCTGAGATCTGA CGACACGGCCATTTATTACTGTGCGAGAGGACT TACTATGGTTCGGGGAGTTATTTAACGAACTTG ACTCCTGGGGCCAGGGAACCCTGGTCACCGTCTC CTCA |
| | | | SEQ ID NO: 31809 |
| | | AA | SYELTQPPSVSVSPGQTASITCSGDTLGGKYAW WYQQKPGQSPVLVIYQDRKRPSGIPERFSGSSSG NTATLTISGTQAMDEADYYCQAWDNGAAVFGG GTKLTVL | QVQLVQSGAEVKKPGASVKVSCKASGYTFTGYFM HWVRQAPGQGLEWMGWINPNSGDTNYAQKFQGR VTMTRDTSLSTAYMELSRLRSDDTAIYYCARGTYY GSGSYFNELDSWGQGTLVTVSS |
| | | SEQ ID NO: 27804 | SEQ ID NO: 31810 |
| iPS:437202 | 21-225_227D3 | NA | CAGTCTGTGCTGACGCAGCCGCCCTCAGTGTC TGGGGCCCCAGGGCAGAGGGTCACCATCTCCT GCACTGGGAGCAGCTCCAACATCGGGGCAGG GCACTGGGTACACTGGTACCAGCAGCTTCCAG GAACAGCCCCCAAACTCCTCATCTATGGTAAC AGCAATCGGCCCTCAGGGGTCCCTGACCGATT CTCTGGCTCCAAGTCTGACACCTCAGCCTCCT GGCCATCACTGGCTCCAGGCTGAGGATGAGG CTGATTATTACTGCGCAGCTCCTATGACAACAGC CTGAGTGGTGTGTTCGGCGGAGGGACCAAGCT GACCGTCCTA | CAGGTGCAATTGGTGCAGTCTGGGGCTGAGGTGA AGAAGCCTGGGGCCTCAGTGAAGGTCTCTGCA AGGCTTCTGGATACACCTTCACCGGCTACTATAT GCACTGGGTGCGACAGGCCCCTGGACAAGGCT TGAGCGGATGGGATGGATCAACCTAAGAGTGG TGGCACAAACTTTGCACAGAAGTTCAGGGCAG GGTCACCATGACCAGGGACACGTCCATCAGCAC AGCTACATGAACTGAGCAGGCTGAGATCTGA CGACACGGCCGTGTATTACTGCGCGAGAGGAGC GTTTGATTACTTCTACTACTACGGTATGGACGTCT GGGGCCAAGGGACCACGGTCACCGTCTCCTCA |
| | | | SEQ ID NO: 31811 |
| | | SEQ ID NO: 27805 | |

FIGURE 50
(Continued)

| | | | | |
|---|---|---|---|---|
| | | AA | QSVLTQPPSVSGAPGQRVTISCTGSSSNIGAGYD VHWYQQLPGTAPKLLIYGNSNRPSGVPDRFSGS KSDTSASLAITGLQAEDEADYYCQSYDNSLSGV FGGGTKLTVL | QVQLVQSGAEVKKPGASVKVSCKASGYTFTGYYM HWVRQAPGQGLERMGWINPKSGGTNFAQKFQGR VTMTRDTSISTAYMELSRLRSDDTAVYYCARGAFD YFYYGMDVWGQGTTVTSS |
| | | | SEQ ID NO: 27806 | SEQ ID NO: 31812 |
| iPS:437204 | 21-225_227E5 | NA | TCCTATGAGCTGAGTCAGCCACCCTCAGTGTC CGTGTCCCAGGACAGAGCCAGCATCACCT GCTCTGGAGATAAATTGGGGGAAAAATATGCT TGCTGGTATCAGCAGAAGCCAGGCCAGTCCCC TGTGCTGGTCATCTATCAAGATAGGAAGCGGC CCTCAGGGATCCCTGAGGATTCTCTGGCTCC AACTCTGGGAACAAAGCCACTCTGACCATCAG CGGGACCCAGGCTATGGATGAGGCTGACTATT ACTGTCAGGGGACCAAGCTGACCGTCCTA | GAGGTGCAGCTGTTGGAGTCTGGGGGAGGCTTG GTACAGCCTGAGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTAGTGGTGGT AGCACATACTACGCAGACTCCGTGAAGGGCCGG TTCACCATCTCCAGAGACAATTCCAAGAACACGC TGTGTCTGCAAATGAACAGCCTGAGAGCCGAGG ACACGGCCGTATATTACTGTGCGAAAGAATATTG TGGTGGTGACTGCTATTCCCCTTACTACTACTACT ACGTATGGACGTCTGGGGCCAAGGGACCACGG TCACCGTCCTCA |
| | | | SEQ ID NO: 27807 | SEQ ID NO: 31813 |
| | | AA | SYELSQPPSVSVSPGQTASITCSGDKLGEKYACW YQQKPGQSPVLVIYQDRKRPSGIPERFSGSNSGN KATLTISGTQAMDEADYYCQAWVNNTMIFGGG TKLTVL | EVQLLESGGGLVQPEGSLRLSCAASGFTFSSYAMS WVRQAPGKGLEWVSAISGSGGSTYYADSVKGRFTI SRDNSKNTLCLQMNSLRAEDTAVYYCAKEYCGGD CYSPYYYYYYGMDVWGQGTTVTVSS |
| | | | SEQ ID NO: 27808 | SEQ ID NO: 31814 |

FIGURE 50
(Continued)

| | | | |
|---|---|---|---|
| iPS:437208 | 21-225_227C10 | NA | CAGTCTGTGTCTGACGCAGCCGCCCTCAGTGTCTGGGGCCCCAGGACAGAGGGTCACCATCCTCTGCACTGGGAGCAGCTCCAACATCGGGGCAGGTTATGATGTACACTGGTACCAGCAGCTTCCAGAACAGCCCCAAACTCCTCATCTATGGTAACAGCAATCGGCCCTCAGGGGTCCCTGACCGATTCTCTGGCTCCAAGTCTGACACCTCAGCCTCCCTGGCCATCACTGGGCTCCAGTCTGAGGATGAGGCTGATTATTACTGCCAGTCCTATGACAACAACTGAGTGGTGGTGTTCGGCGGAGGGACCAAGCTGACCGTCCTA<br>SEQ ID NO: 27809 | CAGGTGCAATTGGTGCAGTCTGGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAAGGGCTTGAGCGGATGGGATGGATCAACCCTAACAGTGGTGGCACAAACTATGCACAGAAGTTTCAGGGCAGGGTCACCATGACCAGGGACACGTCCATCAGCACAGCCTACATGGAGCTGAGCAGGCTGAGATCTGACGACACGGCCGTGTATTACTGTGCGAGAGAGCGTTTGATTACTTCTACTACTACGGTATGGACGTCTGGGGCCAAGGGACCACGGTCACCGTCTCCTCA<br>SEQ ID NO: 31815 |
| | | AA | QSVLTQPPSVSGAPGQRVTISCTGSSSNIGAGYDVHWYQQLPGTAPKLLIYGNSNRPSGVPDRFSGSKSDTSASLAITGLQAEDEADYYCQSYDNNLSGVFGGGTKLTVL<br>SEQ ID NO: 27810 | QVQLVQSGAEVKKPGASVKVSCKASGYTFTGYYMHWVRQAPGQGLERMGWINPKSGGTNYAQKFQGRVTMTRDTSISTAYMELSRLRSDDTAVYYCARGAFDYFYYYGMDVWGQGTTVTVSS<br>SEQ ID NO: 31816 |
| iPS:437210 | 21-225_227E12 | NA | TCCTATGAACTGACTCAGCCACCCTCAGTGTCCGTGTCCCAGGACAGAGCCAGCATCACCTGCTCTGGAGATAAATTGGGGGATAAATATGTTTGTTGGTATCAGCAGAAGCCAGGCCAGTCCCCTGTGCTGGTCATCTATCAAGATAGCAAGCGGCCCTCAGGGATCCCTGAGCGATTCTCTGGCTCCAACTCTGGGAACACAGCTATGGATGAACAGCAGCAATCAGCGGGACCCAGGCTATGGAGGCTGACTATTACTGTCAGGCGTGGAACAGCAGCAATGTGGTATTCGGCGGAGGGACCAAGCTGACCGTCCTA<br>SEQ ID NO: 27811 | CAGATCACCTTGAAGGAGTCTGGTCCTACGCTGGTGAAACCCACAGAGACCCTCACGCTGACCTGCACCCTCTCTGGGTTCTCACTCAGCACTAGTGGAGTGGGTGTGGGCTGGATCCGTCAGCCCCCAGGAAAGGCCCTGGAGTGGCTTGCACTCATTTACTGGAATGATGATAAGGTCTACAGCCCATCTCTGAAGAGCAGGCTCACCATCACCAAGGTACACCTCCAAAACCAGGTGGTCCTTACAATGACCAACATGGACCCTGTGGACACAGCCACATATTACTGTGCACACAGGGACAGCAGCTGCCCTCGACTACTGGGGCCAGGGAACCCTGGTCACCGTCTCCTCA<br>SEQ ID NO: 31817 |

FIGURE 50
(Continued)

| | | | |
|---|---|---|---|
| iPS:437214 | 21-225_48B12 | AA | SYELTQPPSVSVSPGQTASITCSGDKLGDKYVCW YQQKPGQSPVLVIYQDSKRPSGIPERFSGSNSGN TATLTISGTQAMDEADYYCQAWNSSNVVFGGG TKLTVL<br>SEQ ID NO: 27812 | QITLKESGPTLVKPTQTLTLTCTFSGFSLSTSGVVG WIRQPPGKALECLSLIYWNDDKVYSPSLKSRLTITK YTSKNQVVLTMTNMDPVDTATYYCAHRGQQLAL DYWGQGTLVTVSS<br>SEQ ID NO: 31818 |
| | | NA | TCCTATGAGCTGACACAGCCACCCTCGGTGTC AGTGTCCCAGGACAAACGCCAGGATCACCT GCTCTGGAGATGCAATGCCAAAAAAATATGCT CAGCCTCTGGATTCAACCTTTAGCAGCTATGCCAT TATTGGTACCAGCAGAAGTCAGGCAGCCCC GAACTGGGTCCGCCAGGTCCAGGGAAGGGCT TGTGCTGGTCATCTATGAGGACAGCAAACGAC GGAGTGGGTCTCAGTCTATTAGTGGTCGTGGTGGT CCTCCCGGGATCCCTGAGAGATTCTCTGGCTCC AACACATTCTACGCAGACTCCGTGAAGGGCCGGT AGCTCAGGGACAATGGCCACCTTGACTATCAG TCACCATCTCCAGAGACAATTCCAAGAACACGCT TGGGGCCCAGGTGGAGGATGAAGCTGACTACT GTATCTGCAAATGAACAGCCTGAGAGCCGAGGA ACTGTAACTCAACAGACAGCAGTGGTAATCAT CACGGCCGTATATTACTGTGCGAAAAGAGAGAC GTGGTATTCGGCGGAGGGACCAAGCTGACCGT GTATAACTGAACTACGAAGGGTTTGACTACTGG CCTA GGCCAGGGAACCCTGGTCACCGTCTCCTCA<br>SEQ ID NO: 27813 | SEQ ID NO: 31819 |
| | | AA | SYELTQPPSVSVSPGQTARITCSGDALPKKYAYW EVQLLESGGGLVQPGGSLRLSCAASGFTFSSYAMN YQQKSGQAPVLVIYEDSKRPSGIPERFSGSSSGT WVRQAPGKGLEWVSAISGRGGNTFYADSVKGRFTI MATLTISGAQVEDEADYYCNSTDSSGNHVFGG SRDNSKNTLYLQMNSLRAEDTAVYYCAKRETYNW GTKLTVL NYEGFDYWGQGTLVTVSS<br>SEQ ID NO: 27814 | SEQ ID NO: 31820 |

FIGURE 50
(Continued)

| | | | |
|---|---|---|---|
| iPS:437216 | 21-225_51D5 | NA | GACATCCAGATGACCCAGTCTCCATCCTCGCT GTCTGCATCTGTAGGAGACAGAGTCACCATCA CTTGTCGGGCGAGTCAGGGCATTAACAATTAT TTAGCCTGGTTTCAGCAGAAACCAGGGAAGC CCCTAAGTCCCTGATCTATGCTGCATCCAGTTT GCGAAGTGGGGTCCCATCACAGTTCAGCGGCA GTGGATCTGGAACAGATTTCATTCTCACCATC AGCAGCCTGCAGCCTGAAGATTTTGCAACTTA TTACTGCCAACAGTATTATAGTTACCCATTCAC TTTCGGCCCTGGGACCAAAGTGGATATCAAA SEQ ID NO: 27815 | GAGGTGCAGTTGTTGGAGTCTGGGGGAGGCTTGG TACAGCCTGGGGGGTCCCTGAGACTCTCCTGTGC AGCCTCTGGATTCACCTTTAGCAGTTATGTCATG AGCTGGGTCCGCCAGACTCCAGGGAAGGGGCTG GAGTGGGTCTCAACTATGAGTGGTAGTGGTGGTC GCACATACTACGCAGATCCGTGAACGGCCGATT CACCGTCTCCAGAGACAATTCCAAGAACACGCTG TATTTGCAAATGAGCAGCCTGAGAGCCGAGGAC ACGGCCGTATATTACTGTGCGCGGGTGACTGCTT TGACTACTGGGGCCAGGGAACCCTGGTCACCGT CTCCTCA SEQ ID NO: 31821 |
| | | AA | DIQMTQSPSSLSASVGDRVTITCRASQGINNYLA WFQQKPGEAPKSLIYAASSLRSGVPSQFSGSGSG TDFILTISSLQPEDFATYYCQQYYSYPFTFGPGTK VDIK SEQ ID NO: 27816 | EVQLLESGGGLVQPGGSLRLSCAASGFTFSSYVMS WVRQTPGKGLEWVSTMSGSGGRTYYADSVNGRFT VSRDNSKNTLYLQMSSLRAEDTAVYYCARVTAFD YWGQGTLVTVSS SEQ ID NO: 31822 |
| iPS:437220 | 21-225_55H6 | NA | GACATCCAGATGACCCAGTCTCCATCTCCCT GTCTGCATCTGTAGGAGACAGAGTCACCATCA CTTGCCGGGCAAGTCAGGGCATTAGAAACGAT TTAGGCTGGTATCAGCAGAAACCAGGGAAAG CCCCTAAGCGCCTGATCTATGTGCATCCAGT TTGCAAAGTGGGGTCCATCAAGATTCAGCGG CAGTGGATCTGGGACAGAATTCACTCTCACAA TCAGCAGCCTGCAGCCTGAAGATTTTGCAGCT TATTACTGTCTACAGCGTGATAGTTACCCGTTC ACTTTCGGCGGAGGGACCAAGGTGGAGATCA AA SEQ ID NO: 27817 | GAGGTGCACCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCATTAGTGGTAGTAGTACT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAACCTGGGGTC TTTGACTACTGGGGCCAGGGAACCCTGGTCACCG TCTCCTCA SEQ ID NO: 31823 |

FIGURE 50
(Continued)

| | | | |
|---|---|---|---|
| iPS:437224 | 21-225_56H1 | AA | DIQMTQSPSSLSASVGDRVTITCRASQGIRNDLG WYQQKPGKAPKIRLIYGASSLQSGVPSRFSGSGS GTEFTLTISSLQPEDFAAYYCLQRDSYPFTFGGG TKVEIK<br>SEQ ID NO: 27818 | EVHLVESGGGLVKPGGSLRLSCAASGFTFSSYSMN WVRQAPGKGLEWVSSISGSSTYYYADSVKGRFTIS RDNAKNSLYLQMNSLRAEDTAVYYCARTGVFDY WGQGTLVTVSS<br>SEQ ID NO: 31824 |
| | | NA | GACATCCAGATGACCCAGTCTCCATCCTCACT GTCTGCATCTGTAGGAGACAGAGTCACCATCA CTTGTCGGGCGAGTCAGGGCATTAGGCATTAT TTAGCCTGGTTTCAGCAGAAACCAGGAAAGC CCCTCAGTCCCTGATGTCTCTGCATCCGGTT GCAAAGTGGGGTCCCTTCAAAGTTCAGCGGCA GTGGATCTGGGACAGATTTCACTCTCACCATC AGCAGCCTGCAGCCTGAAGATTTTGCAACTTA CTACTGTCAACAATATCAGAATTACCCCTTCA CTTTCGGCCCTGGGACCAAAGTGGATATCAAA<br>SEQ ID NO: 27819 | GAGGTGCAGCTGGTGGAATCTGGGGGAGGCCTG GTCAAGCCGGGGGGGTCCCTGAGACTCTCCTGTG CAGCCTCTGGATTCACCTTCAGTAACTATAGAAT GAACTGGGTCCGCCAGGTCAGGGAAGGGGCT GGAGTGGATCTCATCCATTAGTGGTAGTAGTACT GACATATACTACGCAGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCGAGAGTGGCCTC ACTTGACTACTGGGGCCAGGGAACCCTGGTCACC GTCTCCTCA<br>SEQ ID NO: 31825 |
| | | AA | DIQMTQSPSSLSASVGDRVTITCRASQGISHYLA WFQQKPGKAPQSLMSAASGLQSGVPSKFSGSGS GTDFTLTISSLQPEDFATYYCQQYQNYPFTFGPG TKVDIK<br>SEQ ID NO: 27820 | EVQLVESGGGLVKPGGSLRLSCAASGFTFSNYRMN WVRQGPGKGLEWISSISGSSTDIYYADSVKGRFTIS RDNAKNSLYLQMNSLRAEDTAVYYCARVASFDY WGQGTLVTVSS<br>SEQ ID NO: 31826 |

FIGURE 50
(Continued)

| | | | |
|---|---|---|---|
| iPS:437226 | 21-225_57C2 | NA | GATGTTGTGATGACTCAGTCTCCACTCTCCCTG CCCGTCACCCTTGGACAGCCGGCTCCATCTC CTGCAGGTCTAGTCAAAGCCTCGTATACAGTG ATGGAAACACCTACTTGAATTGGTTTCAGCAG AGGCCAGGCCAATCTCCAAGGCGCCTAATTTA TGAGGTTTCTAACTGGGACTCTGGGGTCCCAA ACAGATTCAGCGGCAGTGGGTCAGGCACTGAT TTCACACTGAAAATCAGTGCGGTGGAGGCTGA GGATGTGGGGTTTATTACTGCGTGCAAGGTA CACACTGGCCTCCGACGTTCGGCCAAGGGACC AAGGTTGAAATCAAA SEQ ID NO: 27821 | GAGGTGCAGCTGGTGGAGTCTGGGGGAGGCTG GTCAAGCCTGGGGGGTCCCTGAGACTCTCCTG TGCAGCCTCTGGATTCACCTTCAGTAGCTTTGGCAT GAACTGGGTCCGCCAGGCTCCAGGGAAGGGGCT GGAGTGGGTCTCATCTATTAGTAGTAGTACTGGT TACATATACAACGCAGACTCAGTGAAGGGCCGA TTCACCATCTCCAGAGACAACGCCAAGAACTCAC TGTATCTGCAAATGAACAGCCTGAGAGCCGAAG ACACGGCTGTGTATTACTGTGCGAGAACCTATAG TGGGAGCCTGGACGTCGGGGCCAAGGGACCAC GGTCACCGTCTCCTCA SEQ ID NO: 31827 |
| | | AA | DVVMTQSPLSLPVTLGQPASISCRSSQSLVYSDG NTYLNWFQQRPGQSPRRLIYEVSNWDSGVPNRF SGSGSGTDFTLKISAVEAEDVGVYYCVQGTHWP RTFGQGTKVEIK SEQ ID NO: 27822 | EVQLVESGGGLVKPGGSLRLSCAASGFTFSSFGMN WVRQAPGKGLEWVSSISSSTGYIYNADSVKGRFTIS RDNAKNSLYLQMNSLRAEDTAVYYCARTYSGSLD VWGQGTTVTVSS SEQ ID NO: 31828 |
| iPS:437228 | 21-225_60C11 | NA | GAAATAGTGATGACGCAGTCTCCAGCCACCCT GTCTGTGTCTCCAGGGGAAAGAGCCACCCTCT CCTGCAGGGCCAGTCAGAGTGTTAGCAACGAC TTAGCCTGGTACCAGCAGAAAACCTGGCCAGGC TCCCAGGCTCCTCATCTATGGTGCATCCACCA GGGCCACTGGTATCCCAGCCAGGTTCACTGGC AGTGGGTCTGGGACAGAGTTCACTCTCACCAT CAGCGCCCTGCAGTCTGAACATTTTGCAGTTT ATTACTGTCAGCAGTATATAGTAACTGGCCATTC ACTTTCGGCCCTGGGACCAAAGTGGATATCAA A SEQ ID NO: 27823 | GAGGTGCAGCTGTTGGAGTCTGGGGGAGGCTTG GTACAGCCTGGGGGGTCCCTGAGACTCTCCTGTG CAGCCTCTGGATTCCCCTTTAGCAGCAGTATGCCAT GAGCTGGGTCCGCCAGGCTCCAGGGAAGGGGCT GGAGTGGGTCTCAGCTATTAGTAGTAGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGAAATTTTTCGGT GTAGTGGGAGTGCGGGTGCTTTGACTACTGGGGCC AGGGAACCCTGGTCACCGTCTCCTCA SEQ ID NO: 31829 |

FIGURE 50
(Continued)

| | | | | |
|---|---|---|---|---|
| iPS:437230 | 21-225_62H10 | AA | EIVMTQSPATLSVSPGERATLSCRASQSVSNDLA WYQQKPGQAPRLLIYGASTRATGIPARFSGGGS GTEFTLTISALQSEHFAVYYCQQYSNWPFTFGPG TKVDIK<br><br>SEQ ID NO: 27824 | EVQLLESGGGLVQPGGSLRLSCAASGFPFSSYAMS WVRQAPGKGLEWVSAISGSGGNTFYADSVKGRFTI SRDNSKNTLYLQMNSLRAEDTAVYYCAKFFGVVG VGCFDYWGQGTLVTVSS<br><br>SEQ ID NO: 31830 |
| | | NA | GACATCCAGATGACCCAGTCTCCATCTCCCT GTCTGCATCTGTAGGAGACAGAGTCACCATCA CTTGCCGGGCAAGTCAGAGCATTACCAGCTAT TTAAATTGGTATCAGCAGAAACCAGGACAAGCT CCCTAAGCTCCTGATCTCTACTGCATCCAGTTT GCAAAGTGGGGTCCCATCAAGGTTCAGTGGCA GTGGATCGGGACAGATTTCACTCTCACCATC AGCAGTCTGCAACCTGAAGATTTTGCAACTTA CTACTGTCAACAGAGTCACAGTTTCCCATTCA CTTTCGGCCCTGGGACCAATGTGGATTTCAAA<br><br>SEQ ID NO: 27825 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTAGTAGTAGTAGT TACATATACTACCAGAGACAACGCCAAGAACTACT GTATCTGCAAATGAACAGCCTGAGAGCCGAGGA CACGGCTGTGTATTACTGTGCGAGAGGGGTTCG AGGGGTTCGACCCCTGGGGCCAGGGAACCCTG GTCACCGTCTCCTCA<br><br>SEQ ID NO: 31831 |
| | | AA | DIQMTQSPSSLSASVGDRVTITCRASQSITSYLN WYQQKPGKVPKLLISTASSLQSGVPSRFSGSGSG TDFTLTISSLQPEDFATYYCQQSHSFPFTFGPGTN VDFK<br><br>SEQ ID NO: 27826 | EVQLVESGGGLVKPGGSLRLSCAASGFTFSSYSMN WVRQAPGKGLEWVSSISSSSSYIYYADSVKGRFTIS RDNAKNSLYLQMNSLRAEDTAVYYCARGGSRGFD PWGQGTLVTVSS<br><br>SEQ ID NO: 31832 |

FIGURE 50
(Continued)

| | | | |
|---|---|---|---|
| iPS:437232 | 21-225_63E1 | NA | GACATTCAGATGACCCAGTCTCCATCTTCCGT GTATGCATCTGTAGGAGACAGAGTCACCATCA CTTGTCGTGCGAGTCAGGGTATTAGCAGCTAC TTAGCCTGGTATCAGCAGAAACCAGGGAAAG CCCCTAAGCTCCTGATCTATGCTGCATCCAGTT TGCAAAGTGGGGTCCATCAAGATTCAGCGGC AGTGGGTCTGGGACAGATTTCACTCTCACCAT CAGCAGCCTGCAGCCTGAAGATTTTGCAACTT ACTATTGTCAACAGGCTAACAGTTCCCGCTC ACTTTCGGCGGAGGGACCAAGGTGGAGATCA AA | GAGGTGCAGATGTTGGAGTCTGGGGGAGGCTTG GGACAGTCGGGGGGGTCCCTGAGACTCTCCTGTA CAGCCTCTGGATTCACCTTCACCACTTCTGCCAT GAGCTGGGTCGCCAGGCTCCAGGGAAGGGCT GGAGTGGGTCTCAGCTATTAGTGGTAGTGGTGCT AACACATTCTACGCAGACTCCGTGAAGGGCCGGT TCACCGTCACCAGAGACAATTCAAGAACACGCT GTATCTGCAAATGAACAGCCTGACAGCCGAGGA CACGGCCGTTTATTATTGTGTGAAAGTTATAGCA GTGGCTGGAGGGCACTTTTTCGACCCCTGGGGCC AGGGAACCCTGGTCACCGTCTCCTCA |
| | | | SEQ ID NO: 31833 |
| | | AA | DIQMTQSPSSVYASVGDRVTITCRASQGISSYLA WYQQKPGKAPKLLIYAASSLQSGVPSRFSGSGS GTDFTLTISSLQPEDFATYYCQQANSPLTFGGG TKVEIK | EVQMLESGGGLGQSGGSLRLSCTASGFTFTSAMS WVRQAPGKGLEWVSAISGSGANTFYADSVKGRFT VTRDNSKNTLYLQMNSLTAEDTAVYYCVKVIAVA GGHFFDPWGQGTLVTVSS |
| | | | SEQ ID NO: 31834 |
| | | | SEQ ID NO: 27828 |
| iPS:437234 | 21-225_64E2 | NA | GACATCCAGATGACCCAGTCTCCATCTTCCGT GTCTGCATCTGTAGGAGACAGAGTCACCATCA CTTGTCGGGCAGTCAGGGTATTAGCAGGTGG TTAGCCTGGTATCAGCAGAAACCAGGGAAAG CCCCTAAGCTCCTGATCTATGCTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A | CAGGTGCAGCTGGTGCAGTCTGGGGCTGAGGTG AAGAAGCCTGGGGCCTCAGTGAAGGTCCTGC AAGGCTTCTGGATACACCTTCACCGGCTACTATA TGCACTGGGTGCGACAGGCCCCTGGACAAGGC TTGAGTGGATGGGATGGATCAACAGAAGTTTCAGGCAG TGGCACAAACTATGCACAGGGACACGTCCATCAGCAC GGTCACCATGACCAGGGACACGTCCATCAGCAC AGCCTACATGGAGCTGAGCAGGCTGAGATCTGA CGACACGGCCGTGTATTACTGTGCGAGAGATGG GAGCAGTGGCTTTGACTACTGGGGCCAGGGAAC CCTGGTCACCGTCTCCTCA |
| | | | SEQ ID NO: 31835 |
| | | | SEQ ID NO: 27829 |

FIGURE 50
(Continued)

| | | | |
|---|---|---|---|
| iPS:437248 | | AA | DIQMTQSPSSVSASVGDRVTITCRASQGISRWLA WYQQKPGKAPKLLIY AASSLQSGVPSRFSGSGS GTDFTLTISSLQPEDFATYYCQQANSFPFTFGPGT KVDIK<br>SEQ ID NO: 27830 | QVQLVQSGAEVKKPGASVKVSCKASGYTFTGYYM HWVRQAPGQGLEWMGWINPNNNGTNYAQKFQGR VTMTRDTSISTAYMELSRLRSDDTAVYYCARDGSS GFDYWGQGTLVTVSS<br>SEQ ID NO: 31836 |
| | 21-225_97H3 | NA | GATATTGTGATGATTCAGTCTCCACTCTCCCTG CCCGTCACCCCTGGAGAGCCGGCCTCCATCTC CTGCAGGTCTAGTCAGAGCCTCCTGCATAGTA ATGGAACACAACTATTTGGATTGGTACCTACAG AAGCCAGGGCGGTCTCCACAGTCTCTTGATCTA TTTGGGTTCTAATGGGCCTCCGGGTCCCTG AGAGGTTCAGTGCAGTGGATCAGGCACAGA TTTTTACACTGAAAATCAGCAGAGTGGAGGCTG AGGATGTTGGGGTTTATTACTGCATGCAACCT CTACAAACTCCGTTCACTTTCGGCGGAGGGAC CAAGGTGGAGATCAAA<br>SEQ ID NO: 27831 | CAGGTGCAGGTACAGCAGTGGGGCGCAGGACTG TTGAAGCCTTCGGAGACCCTGTCCTCACCTGCG CTGTCTATGGTGGGTCCTTCACTGATTACTACTGG AGCTGGATCCGCCAGCCCCCAGGGAAGGGCTG GAGTGGATTGGGGAAATCAATCATAGTGGAGAC ACCAACTACAACCCGTCCCTCAAGAGTCGAGTCA CCATATCAGTAGACACGTCCAAGAACCAGTTCTC CCTGAAGCTGAGTTCTGTGACCGCCGGACACG GCTGTGTATTACTGTGCGAGAGAGTTCCATATA GTGGAAGCTACCTCTACTACTACGGTATGGACGT CTGGGGCCAAGGGACCACGGTCACCGTCTCCTCA<br>SEQ ID NO: 31837 |
| | | AA | DIVMIQSPLSLPVTPGEPASISCRSSQSLLHSNGH NYLDWYLQKPGRSPQLLIYLGSNRASGVPERFS GSGSGTDFTLKISRVEAEDVGVYYCMQPLQTPF TFGGGTKVEIK<br>SEQ ID NO: 27832 | QVQVQQWGAGLLKPSETLSLTCAVYGGSFTDYYW SWIRQPPGKGLEWIGEINHSGDTNYNPSLKSRVTIS VDTSKNQFSLKLSSVTAADTAVYYCAREFPYSGSY LYYYGMDVWGQGTTVTVSS<br>SEQ ID NO: 31838 |

FIGURE 50
(Continued)

| | | | |
|---|---|---|---|
| iPS:437250 | 21-225_148C6 | NA | GATGTTGTGATGACTCAGTCTCCACTCTCCCTG CCCGTCACCCTTGGACAGCCGGCTCCATCTC CTGCAGGTCTAGTCAAAGCCTCGTATACAGTG ATGGAAACACCTACTTGAATTGGTTTCAGCAG AGGCCAGGCCAATCTCCAAGGCGCCTAATTTA TAAGGTTTCTAACTGGGACTCTGGGGTCCAG ACAGATTCAGCGGCAGTGGGTCAGGCACTGAT TTCACACTGAAAATCAGCAGGGTGGAGGCTGA GGATGTTGGGGTTTATTACTGTCATGCAAGGTA CACACTGGTCGCTCACTTTCGGCGGAGGGACC AAGGTGGAGATCAAA<br><br>SEQ ID NO: 27833 | GAGGTGCAACTGTTGGAGTCTGGGGGAGGCTTG GTACAGCCTGGGGGGTCCCTGAGACTCTCCTGTG CAGCCTCTGGATTCACCTTTAGCAGTTATGCCAT GAGCTGGGTCCGCCAGGCTCCAGGGAAGGGGCT GGAGTGGGTCTCAGTTATTAGTGGTGGTAGT AGTACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCACTGACTACGGTATGGACGTCTGGGG CCAAGGGACCACGGTCACCGTCTCCTCA<br><br>SEQ ID NO: 31839 |
| | | AA | DVVMTQSPLSLPVTLGQPASISCRSSQSLVYSDG NTYLNWFQQRPGQSPRRLIYKVSNWDSGVPDRF SGSGSGTDFTLKISRVEAEDVGVYYCMQGTHWS LTFGGGTKVEIK<br><br>SEQ ID NO: 27834 | EVQLLESGGGLVQPGGSLRLSCAASGFTFSSYAMS WVRQAPGKGLEWVSVISGGSSTYYADSVKGRFTI SRDNSKNTLYLQMNSLRAEDTAVYYCAKWRGNPT DYGMDVWGQGTTVTVSS<br><br>SEQ ID NO: 31840 |
| iPS:437252 | 21-225_148H11 | NA | GATGTTGTGATGACTCAGTCTCCACTCTCCCTG CCCGTCACCCTTGGACAGCCGGCTCCATCTC CTGCAGGTCTAGTCAAAGCCTCGTATACAGTG ATGGAAACACCTACTTGAATTGGTTTCAGCAG AGGCCAGGCCAATCTCCAAGGCGCCTAATTTA TAAGGTTTCTAACTGGGACTCTGGGGTCCAG ACAGATTCAGCGGCAGTGGGTCAGGCACTGAT TTCACACTGAAAATCAGCAGGGTGGAGGCTGA GGATGTTGGGGTTTATTACTGTCATGCAAGGTA CACACTGGTGCTCACTTTCGGCGGAGGGACC AAGGTGGAGATCAAA<br><br>SEQ ID NO: 27835 | GAGGTGCAACTGTTGGAGTCTGGGGGAGGCTTG GTACAGCCTGGGGGGTCCCTGAGACTCTCCTGTG CAGCCTCTGGATTCACCTTTAGCAGTTATGCCAT GAGCTGGGTCCGCCAGGCTCCAGGGAAGGGGCT GGAGTGGGTCTCAGTTATTAGTGGTGGTAGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCACTGACTACGGTATGGACGTCTGGGG CCAAGGGACCACGGTCACCGTCTCCTCA<br><br>SEQ ID NO: 31841 |

FIGURE 50
(Continued)

| | | AA | DVVMTQSPLSLPVTLGQPASISCRSSQSLVYSDG NTYLNWFQQRPGQSPRRLIYKVSNWDSGVPDRF SGSGSGTDFTLKISRVEAEDVGVYYCMQGTHWL LTFGGGTKVEIK<br><br>SEQ ID NO: 27836 | EVQLLESGGGLVQPGGSLRLSCAASGFTFSSYAMS WVRQAPGKGLEWVSVISGGSSTYYADSVKGRFTI SRDNSKNTLYLQMNSLRAEDTAVYYCAKWRGNPT DYGMDVWGQGTTVTVSS<br><br>SEQ ID NO: 31842 |
|---|---|---|---|---|
| iPS:437254 | 21-225_149F2 | NA | GATGTTGTGATGACTCAGTCTCCACTCTCCCTG CCCGTCACCCTTGGACAGCCGGCCTCCATCTC CTGCAGGTCTAGTCAAAGCCTCGTATACAGTG ATGGAAACACCTCCTTGAATTGGTTTCAGCAG AGGCCAGGCCAATCTCCAAGGCGCCTAATTTA TAAGGTTTCTAACTGGGACTCTGGGGTCCCAG TCAGATTCAGCGGCAGTGGGTCAGGCACTGAT TTCACACTGAAAATCAGCAGGGTGGAGGCTGA GGATGTTGGGATTTATTACTGCATGCAAGGTA CACACTGGCCTCCCCACTTTCGGCGGAGGGACC AAGGTGGAGATCAAA<br><br>SEQ ID NO: 27837 | CAGGTGCAGCTGGGGGAGGCTGGGGAGGCGTG GTCCAGCCTGGGAGGTCCCTGAGACTCTCTGTG CAGCGTCTGGATTCACCTTCAGTGCTATGGCAT GCACTGGGTCCGCCAGGCTCCAGGCAAGGGGCT GGAGTGGTGGCTTTTATATGGTATGATGGAAGT GAGAACTACTATGCAGACTCCGTGAAGGCCGA TTCACCATTCCAGAGTCAATTCCAGGAACACGC TGTATCTGCAAATGAACAGCCTGAGAGCGAGG ACACGGCTGTGTATTACTGTGCGAGAGATCGGT GGAGGGTTCGGGGACTCCCTACTACTACTACGGT ATGGACGTCTGGGGCCAAGGGACCACGGTCACC GTCTCCTCA<br><br>SEQ ID NO: 31843 |
| | | AA | DVVMTQSPLSLPVTLGQPASISCRSSQSLVYSDG NTSLNWFQQRPGQSPRRLIYKVSNWDSGVPVRF SGSGSGTDFTLKISRVEAEDVGIYYCMQGTHWP PTFGGGTKVEIK<br><br>SEQ ID NO: 27838 | QVQLGEAGGGVVQPGRSLRLSCAASGFTFSRYGM HWVRQAPGKGLEWVAFIWYDGSENYYADSVKGR FTISRVNSRNTLYLQMNSLRAEDTAVYYCARDRVE GSGTPYYYGMDVWGQGTTVTVSS<br><br>SEQ ID NO: 31844 |

FIGURE 50
(Continued)

| | | NA | GATGTTGTGATGAGTCAGTATCCACTCTCCCT<br>GCCCGTCACCTTTGGACAGCCGGCCTCCATCT<br>CATGCAGGTCTAGTCAAAGCCTCGTATACAGT<br>GATGGAAACACCTCCTTGAATTGGTTTCAGCA<br>GAGGCCAGGCCAATATCCAAGGCGCTTAATTT<br>ATAAGGTTTCTAACTGGGACTATGGGGTCCCA<br>GTCAGATTCAGCGGCAGTGGGTCAGGCACTGA<br>TTTCACACTGAAAATCAGCAGGGTGCATGCTG<br>AGGATGTTGGGATTTATTACTGCATGCAAGGT<br>ACACACTGGCCTCCACTTTCGGCGGAGGGAC<br>CAAGGTGGAGATCAAA | CAGGTGCAGCTGGGGGAGGCTGGGGAGGCGTG<br>GTCCAGCCTGGGAGGTCCCTGAGACTCTCCTGT<br>CAGCCGTCTGGATTCACCTTCAGTCGCTATGGCAT<br>GCACTGGGTCCGCCAGGCTCCAGGCAAGGGGCT<br>GGAGTGGGTGGCTTTTATATGGTATGATGGAAGT<br>GAGAACTACTATGCAGACTCCGTGAAGGGCCGA<br>TTCACCATCTCCAGAGTCAATTCCAGAACACGC<br>TGTATCTGCAAATGAACAGCCTGAGAGCCGAGG<br>ACACGGCTGTGTATTACTGTGCGAGAGATCGGGT<br>GGAGGGTTCGGGGACTCCCTACTACTACTACGGT<br>ATGGACGTCTGGGGCCAAGGGACCACGGTCACC<br>GTCTCCTCA |
| iPS:437256 | 21-225_150F11 | | SEQ ID NO: 27839 | SEQ ID NO: 31845 |
| | | AA | DVVMSQYPLSLPVTFGQPASISCRSSQSLVYSDG<br>NTSLNWFQQRPGQYPRRLIYKVSNWDYGVPVR<br>FSGSGSGTDFTLKISRVEAEDVGIYYCMQGTHW<br>PPTFGGGTKVEIK | QVQLGEAGGGVVQPGRSLRLSCAASGFTPSRYGM<br>HWVRQAPGKGLEWVAFIWYDGSENYYADSVKGR<br>FTISRVNSRNTLYLQMNSLRAEDTAVYYCARDRVE<br>GSGTPYYYYGMDVWGQGTTVTVSS |
| | | | SEQ ID NO: 27840 | SEQ ID NO: 31846 |
| iPS:437258 | 21-225_153F9 | NA | GACATCCAGATGACCCAGTCTCCATCCTCACT<br>GTCTGCATCTGTAGGAGACAGAGTCACCATCA<br>CTTGTCGGGCGAGTCAGGGCATTAGCAATTAT<br>TTAGCCTGGTTTCAGCAGAAGCCAGGGAAAGC<br>CCCTAAGTCCCTGATCTCTGCTGCATCCAGTTT<br>GCAAAGTGGGGTCCCATCAAAGTTCAGCGGCA<br>GTGGATCTGGGACAGATTTCACTCTCACCATC<br>AGCAGCCTGCAGCCTGAAGATTTTGCAACTTA<br>TTACTGCCAACAGTATAATAGTTACCCGCTCA<br>GTTTCGGCGGAGGGACCAAGGTGGAGATCAA<br>A | CAGGTACACCTGGTGGAGTCTGGGGGAGGCGTG<br>GTCCAGCCTGGGAGGTCCCTGAGACTCTCTGTG<br>CAGCGTCTGGATTCACCATCAGTAGCTATGGCAT<br>GCACTGGGTCCGCCAGGTCCAGGCAAGGGGCT<br>GGAGTGGGTGGCAGTTATATGGTATGGTGAAGT<br>GATACAGACTATGCAGACTCCGTGAGGGGCCGA<br>TTCACCATCTCCAGAGACATTTCCAAGAACACGC<br>TGTATCTGCAAATGAACAGCCTGAGAGCCGAGG<br>ACACGGCTGTGTATTACTGTGCGAGAGATCGGGA<br>TTATTGTAGTGGTGGTAACTGCCCTTACTACTACT<br>ACTACGGTATGGACGTCTGGGGCCAAGGGACCA<br>CGGTCACCGTCTCCTCA |

FIGURE 50
(Continued)

| | | | |
|---|---|---|---|
| iPS:437260 | 21-225_170D1 | AA | SEQ ID NO: 27841<br>DIQMTQSPSSLSASVGDRVTITCRASQGISNYLA WFQQKPGKAPKSLISAASSLQSGVPSKFSGSGSG TDFTLTISSLQPEDFATYYCQQYNSYPLSFGGGT KVEIK | SEQ ID NO: 31847<br>QVHLVESGGGVVQPGRSLRLSCAASGFTISTYGMH WVRQGPGKGLEWVAVIWYGGSDTDYADSVRGRF TISRDISKNTLYLQMNSLRAEDTAVYYCARDRDYC SGGNCPYYYYGMDVWGQGTTVTVSS |
| | | NA | SEQ ID NO: 27842<br>GACATCCAGATGACCCAGTCTCCATCCTCACT GGCTGCATCTGTAGGAGACAGAGTCACCATCA CTTGTCGGGCGAGTCAGGACATTAGCAATTAT TTAGCCTGGTTTCAGCAGAAACCAGGGAAAGC CCCTAAGTCCCTGATCTATGCTGCATCCAGTTT GCAAAGTGGGGTCCCATCAAGGTTCAGCGGCA GTGGATCTGGGACAGATTTCACTCTCACCATC AGCAGCCTGCAACAGTGTGATAGTTTCCCTCAC TTTCGGCGGAGGGACCAAGGTGGAGATCAAA | SEQ ID NO: 31848<br>CAGGTGCAGTTGGTGCAGTCTGGGGCTGAGGTGA AGAAGCCTGGGGCCTCAGTGAAGGTCTCCTGCA AGGCTTCTGGATACACCTTCACCGGCTACTTTAT GCACTGGGTGCGACAGGCCCCTGGACAAGGGCT TGAGTGGATGGGATGGATCAAGCCTAAAAGCGG TGGCACAAACTGTGCACAGAAGTTTCAGGGCAG GGTCACCATGACCAGGGACACGTCCAGCAGCAC AGCCTACATGAGCTGAGCAGGCTGACATCTGA CGACACGGCCGTGTATTACTGTGCGAGAGGGG GCTACGGTGACTACGTGGGGGGTCTTGACTAC TGGGGCCAGGGAACCCTGGTCACCGTCTCCTCA |
| | | AA | SEQ ID NO: 27843<br>DIQMTQSPSSLAASVGDRVTITCRASQDISNYLA WFQQKPGKAPKSLIYAASSLQSGVPSRFSGSGSG TDFTLTISSLQPEDFATYYCQQCDSFPLIFGGGT KVEIK | SEQ ID NO: 31849<br>QVQLVQSGAEVKKPGASVKVSCKASGYTFTGYFM HWVRQAPGQGLEWMGWIKPKSGGTNCAQKFQGR VTMTRDTSSSTAYMELSRLTSDDTAVYYCARGGA TVTIWGVFDYWGQGTLVTVSS |
| | | | SEQ ID NO: 27844 | SEQ ID NO: 31850 |

FIGURE 50
(Continued)

| | | | |
|---|---|---|---|
| iPS:437262 | 21-225_170E4 | NA | GACATCCAGATGACCCAGTCTCCATCCTCCCT GTCTGCATCTGTAGGAGACAGAGTCACCATCA CTTGCCGGGCAAGTCAGGCATTAGAAATGAT TTAGGCTATTATCAGCAGAAACCAGGGAAAGC CCCTAAGCGCCTGATCTATTGTTGCATCCGTTT GCAAAGTGGGGTCCCATCAAGGTTCAGCGGCA GTGGATCTGGGACAGAATTCACTCTCACAATC AGCAGCCTGCAGCCTGAAGATTTTGCAACTTA TTACTGTCTACAGCACAATAGTTACCCTCCGT GGACGTTCGGCCAAGGGACCAAGGTGGATAT CAAA<br>SEQ ID NO: 27845 | GAGGTGCAACTGGTGGAGTCTGGGGGAGGCTCG GTACAGCCTGGGGGGTCCCTGAGACTCTCCTGTG CAGCCTCTGATTCACCTTCAGTAGTAGTATAGCAT GAACTGGGTCCGCCAGGCTCCAGGGAAGGGGCT GGAGTGGGTTTCATACATTAGCAGTAGTGGTAGT ACCAAATACTACGCAGACTCTGTGGAGGGCCGA TTCACCATCTCCAGAGACAATGCCAAGAATTCAC TGGATCTGCAAATGAACAGCCTGAGAGACGAGG ACACGGCTGTGTATCGCTGTGCAGAGATAGTAG GAAGGGGTTCTACTACGGTCTGGACGTCTGGGGC CAAGGGACCACGGTCACCGTCTCCTCA<br>SEQ ID NO: 31851 |
| | | AA | DIQMTQSPSSLSASVGDRVTITCRASQGIRNDLG YYQQKPGKAPKRLIYVASGLQSGVPSRFSGSGS GTEFTLTISSLQPEDFATYYCLQHNSYPPWTFGQ GTKVDIK<br>SEQ ID NO: 27846 | EVQLVESGGGSVQPGGSLRLSCAASGFTFSSYSMN WVRQAPGKGLEWVSYISSSGSTKYYADSVEGRFTI SRDNAKNSLDLQMNSLRDEDTAVYRCARDSRKGF YYGLDVWGQGTTVTVSS<br>SEQ ID NO: 31852 |
| iPS:437264 | 21-225_171H12 | NA | GACATCCAGATGACCCAGTCTCCATCCTCACT GTCTGCATCTGTAGGAGACAGAGTCACCATCA CTTGTCGGGCGAGTCAGGACATTAGCACATTAT TTAGCTGGTTTCAGCAGAAAGCCAGGGAAAGC CCCTAAGTCCCTGATCTATTCTGCATCCAGTTT GCAAAGTGGGGTCCCATCAAGTTCAGCGGCA GTGGATCTGGGACAGATTTCACTCTCACCATC AGCAGCCTGCAGCCTGAAGATTTTGCAACTTA TTACTGCCAACAATCTGATAGTTACCCTCTCAC TTTCGGCGGAGGGACCAAGGTGGAGATCAAA<br>SEQ ID NO: 27847 | CAGGTGCAGCTGGTGCAGTCTGGGGCTGAGGTG AAGAAGCCTGGGGCCTCAGTGAGGGTCTCCTGC AAGGCTTCTGATACACCTTCACCGGCTACTTTA TGCACTGGGTGCGACAGGCCCCTGGACAAGGGC TTGAGTGGATGGATGGATCAAGCTAAGAGTG GTGGCACAAACTCTGCACAGAGGTTTCAGGGCA GGGTCACCATGACCAGGGACACGTCCATCAACA CAGCCTACATGGAGCTGAACAGGCTGAGATCTG ACGACACGGCCGTATATTACTGTGCGAGAGGGG GGACTACGGTGGCTACGGTGGGGGTCTTTGACTA CTGGGGCCAGGGAACCCTGGTCACCGTCTCCTCA<br>SEQ ID NO: 31853 |

FIGURE 50
(Continued)

| | | | | |
|---|---|---|---|---|
| | | AA | DIQMTQSPSSLSASVGDRVTITCRASQDISNYLAWFQQKPGKAPKSLIYSASSLQSGVPSKFSGSGSGTDFTLTISSLQPEDFATYYCQQSDSYPLTFGGGTKVEIK | QVQLVQSGAEVKKPGASVRVSCKASGYTFTGYFMHWVRQAPGQGLEWMGWIKPKSGGTNSAQRFQGRVTMTRDTSINTAYMELNRLRSDDTAVYYCARGGTTVATWGVFDYWGQGTLVTVSS |
| | | | SEQ ID NO: 27848 | SEQ ID NO: 31854 |
| iPS:437266 | 21-225_177A5 | NA | GACATCCAGATGACCCAGTCTCCATCCTCACTGTCTGCATCTGTAGGAGACAGAGTCACCATCACTTGTCGGGCGAGTCAGGACATTAGCAATTATTTAGCCTGGTTTCAGCAGAAAGCCAGGAAAGCCCCTAAGTCCCTGATCTATTCTGCATCCAGTTTGCAAAGTGGGGTCCCATCAAAGTTCAGCGGCAGTGGATCTGGGACAGATTTCACTCTCACCATCAGCAGCCTGCAGCCTGAAGATTTTGCAACTTATTACTGCCAACAATCTGATAGTTACCCTCTCACTTTCGGCGGAGGGACCAAGGTGGAGATCAAA | CAGGTGCAGCTGGTACAGTCTGGGGCTGAGGTGAAGAAGCCTGGGGCCTCAGTGCGGGTCTCCTGCAAGGCTTCTGGATACACCTTCACGGCTACTTTATGCACTGGGTGCGACAGGCCCCTGGACAAGGGCTTGAGTGGATGGGATGGATCAAGCCTAAGAGTGGTGGCACAAACTGACCAGGAGACACGTCCATCAACACAGTCACCATGAGCTGACTGGCTGAGATCTGACGACACGGCCGTATATTACTGTGCGAGAGGGGGGACTACGGTGGCTACGTGGGGGTCTTTGACTACTGGGGCCAGGGAACCCTGGTCACCGTCTCCTCA |
| | | | SEQ ID NO: 27849 | SEQ ID NO: 31855 |
| | | AA | DIQMTQSPSSLSASVGDRVTITCRASQDISNYLAWFQQKPGKAPKSLIYSASSLQSGVPSKFSGSGSGTDFTLTISSLQPEDFATYYCQQSDSYPLTFGGGTKVEIK | QVQLVQSGAEVKKPGASVRVSCKASGYTFTGYFMHWVRQAPGQGLEWMGWIKPKSGGTNSAQRFQGRVTMTRDTSINTAYMELNWLRSDDTAVYYCARGGTTVATWGVFDYWGQGTLVTVSS |
| | | | SEQ ID NO: 27850 | SEQ ID NO: 31856 |

FIGURE 50
(Continued)

| | | | |
|---|---|---|---|
| iPS:437268 | 21-225_177D2 | NA | CAGGTGCAGCTGGTGGTGGAGTCTGGGGGAGGCGTG<br>GTCCAGCCTGGGAGGTCCCTGAGACTCTCCTGTG<br>CAGCGTCTGGATTCACCTTCAGTAGCTATGGCAT<br>GGAGTGGGTCCGCCAGGCTCCAGGCAAGGGGCT<br>GGAGTGGGTGGCAATTATATGGTTGATGGAAGT<br>AATAAATACTATGCAGACTCCGTGAAGGGCCGA<br>TTCACCATCTCCAGAGACAATTCCAAGAACACGC<br>TGTATCTGCAAATGAACAGCTGAGAGCCGAGG<br>ACACGGCTGTGTATTACTGTGCGAGAGCATATTG<br>TGGTGTGACTGCTATTTCCCCCATCTCATTACT<br>ACGGTATGGACGTCTGGGGCCAAGGGACCACGG<br>TCACCGTCTCCTCA |
| | | | SEQ ID NO: 31857 |
| | | AA | QVQLVESGGGVVQPGRSLRLSCAASGFTFSSYGMD<br>WVRQAPGKGLEWVAIIWFDGSNKYYADSVKGRFT<br>ISRDNSKNTLYLQMNSLRAEDTAVYYCARAYCGG<br>DCYFPHLHYYGMDVWGQGTTVTVSS |
| | | | SEQ ID NO: 31858 |
| iPS:437270 | 21-225_178H4 | NA | GACATCCAGATGACCCAGTCTCCATCTCCACT<br>GTCTGCATCTGTAGGAGACAGAGTCACCATCA<br>CTTGTCGGGCGAGTCAGGACATTAGCAATTAT<br>TTAGCCTGGTTTCAGCAGAAACCAGGGAAAGC<br>CCCTAAGTCCCTGATCTTTCTGCATCCAGTTT<br>GCAAAGTGGGGTCCCATCAAAGTTCAGCGGCA<br>GTGGATCTGGGACAGATTTCACTCTCACCATC<br>AGCAACCTGCAGCCTGAAGATTTTGCAACTTA<br>TTACTGCCAACAATCTAATAGTTACCCTCTCAC<br>TTTCGGCGGAGGGACCAAGGTGGAGATCAAA |
| | | | SEQ ID NO: 27852 |
| | | | CAGGTACAGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTTTA<br>TGCACTGGGTGCGACAGGCCCCTGGACAAGGGC<br>TTGAGTGGATGGGATGGATCAAGCCTAAAAGTG<br>GTGGCACAAACTGTGCACAGAGGTTTCAGGGCA<br>GGGTCACCATGACCAGGGACACGTCCATCAGCA<br>CAGCCTACATGGAACTGAGCAGGCTGAGATCTG<br>ACGACACGGCCGTGTACTACTGTGGGGGGTCTTTGACTAC<br>GACTACGGTGACTACGGTGGGGGTCTTTGACTAC<br>TGGGGCCAGGGAACCATGGTCACCGTCTCCTCA |

FIGURE 50
(Continued)

| | | | |
|---|---|---|---|
| iPS:437274 | 21-225_196D4 | AA | SEQ ID NO: 27853<br>DIQMTQSPSSLSASVGDRVTITCRASQDISNYLA WFQQKPGKAPKSLIFSASSLQSGVPSKFSGSGSG TDFTLTISNLQPEDFATYYCQQSNSYPLTFGGGT KVEIK | SEQ ID NO: 31859<br>QVQLVQSGAEVKKPGASVKVSCKASGYTFTGYFM HWVRQAPGQGLEWMGWIKPKSGGTNCAQKFQGR VTMTRDTSISTAYMELSRLRSDDTAVYYCVRGGTT VTTWGVFDYWGQGTMVTVSS |
| | | | SEQ ID NO: 27854<br>GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCCAGGGAAAGC CCCTAAGTCCCTTATCTATGCTGCATCCAGTTT GCAAAGTGGGGTCCCATCAAAGTTCAGCGGCA GTGGATGTGGGACAGATTTCACTCTCACCATC AGCAGCCCGCAGCCTGAAGATGTTGCAACCTA TTACTGCCAACATTATCTTAATTACCCTCTCAC CTTCGGCCAAGGGACACGACTGGAGATTAAAA | SEQ ID NO: 31860<br>CAGGTGCAGGTGGTGGAGTCTGGGGGAGGCGTG GTCCAGCCTGGGAGGTCCCTGAGACTCTCCTGTG CAGCCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAGAAACTATGCAGACTCCGTGAAGGGCCGA TTCACCATCTCCAGAGACAATTCCAAGAACACGC TGTATCTGCAAATGAACAGCCTGAGAGATCGGTC ACACGGCTGTGTATTACTGTGCGACGTCTGGGGCCA TAAGGGTTACGACGGTATGGACGTCTGGGGCCA AGGGACCACGGTCACCGTCCTCCTCA |
| | | | SEQ ID NO: 27855<br>DIQMTQSPSSLSASVGDRVTITCRASQGISNYLA WFQQNPGKAPKSLIYAASSLQSGVPSKFSGSGCG TDFTLTISSPQPEDVATYYCQHYLNYPLTFGQGT RLEIK | SEQ ID NO: 31861<br>QVQVVESGGGVVQPGRSLRLSCAASGFTFSSYGMH WVRQAPGKGLEWVAVIWYDGSNRNYADSVKGRF TISRDNSKNTLYLQMNSLRVEDTAVYYCARDRSKG YDGMDVWGQGTTVTVSS |
| | | | SEQ ID NO: 27856 | SEQ ID NO: 31862 |

FIGURE 50
(Continued)

| | | | |
|---|---|---|---|
| iPS:437280 | 21-225_203C10 | NA | GACATCCAGATGACCCAGTCTCCATCTCCCT GTCTGCATCTGTAGGAGACAGAGTCACCATCA CTTGCCGGGCAAGTCAGGACAGATTAGAAATGAT TTAGGCTGGTATCAGCAGCAGAAACCAGGGAAAG CCCCTAAGCGCCTGATCTATAGAGCATCCAGT TTGCAAAGTGGGGTCCCATCACGCTTCAGCGG CAGTGGATCTGGGACAGAATTCACTCTCACAA TCAGCAGCCTGCAGCCTGAAGATTTTGCCGCT TATTACTGTCTACAGCATAATAGTTACCCGTG GACGTTCGGCCAAGGGACCAAGGTAGAGATC AAA<br>SEQ ID NO: 27857 | CAGGTGCAGCTGGTGGAGTCTGGGGGAGGCGTG GTCCAGCCTGGGAGGTCCCTGAGACTCTCCTGTG CAGCGGTCTGATTCACCTTCAGTGACTTATGGCAT GCACTGGGTCCGCCAGGCTCCAGGCAAGGGGCT GGAGTGGGTGGCAGTTATATGACTCCGTGAAGGGCGAT AATACACATTATACAGACTCCGTGAAGGGCCGAT TCACCATCTCCAGAGACAATGAACAGCCTGAGA GTATCTGCAAATGAACAGCCTGAGAGACGCT CACGGCTGTATATTACTGTGCGAGAGAAGTGGGT TGGCTTGATGACTACTGGGGCCAGGGAACCCTGG TCACCGTCTCCTCA<br>SEQ ID NO: 31863 |
| | | AA | DIQMTQSPSSLSASVGDRVTITCRASQDIRNDLG WYQQKPAKAPKRLIYRASSLQSGVPSRFSGSGS GTEFTLTISSLQPEDFAAYYCLQHNSYPWTFGQG TKVEIK<br>SEQ ID NO: 27858 | QVQLVESGGGVVQPGRSLRLSCAASGFTFSDYGM HWVRQAPGKGLEWVAVIWYDGGNTHYTDSVKGR FTISRDNSKNTLYLQMNSLRAEDTAVYYCAREVG WLDDYWGQGTLVTVSS<br>SEQ ID NO: 31864 |
| iPS:437282 | 21-225_207C9 | NA | GACAACCAGATGACCCAGTCTCCATCTCCCT GTCTGCATCTGTAGGAGACAGAGTCACCATCA CTTGCCGGGCAAGTCAGAGGTTTAGTAACTAT TTAAATTGGTATCAGCAGCAGAAACCAGGGAAAG CCCCTAAGCTCCTGATCTATACTGCATCCAGTT TGCAAAGTGGGGTCCCATCAAGGTTCAGTGCC AGTGTCTCTGGGACAGACTTCACTCTCACAAT CAGCAGTCTGCAACCTGAAGATTTTGCAACTT ATTACTGTCAACAGAGTTACAGTATTCCGCTC ACTTTCGGCGGAGGGACCAAGGTGGAGATCA AA<br>SEQ ID NO: 27859 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTAGTGGTGGTGGT AGCACATACTACGCAGACTCCGTGAAGGGCCGG TTCACCATCTCCAGAGACAATGCCAAGAACACGC TGTATCTGCAAATGAACAGCTGAGAGCCGAGG ACACGGCCGTATATTACTGTGCGAAAGCTGGTGG AACTACGGGGAGCTACTACTACAACGGTATGGA CGTCTGGGGCCAAGGGACCACGGTCACCGTCTCC TCA<br>SEQ ID NO: 31865 |

FIGURE 50
(Continued)

| | | | | |
|---|---|---|---|---|
| iPS:437286 | 21-225_208F1 | AA | DNQMTQSPSSLSASVGDRVTITCRASQRFSNYLN WYQQKPGKAPKLLIYTASSLQSGVPSRFSASVSG TDFTLTISSLQPEDFATYYCQQSYSIPLTFGGGTK VEIK SEQ ID NO: 27860 | EVQLLESGGGLVQPGGSLRLSCAASGFTFSSYAMS WVRQAPGKGLEWVSAISGSGGSTYYADSVKGRFTI SRDNSKNTLYLQMNSLRAEDTAVYYCAKAGGTTG SYYYNGMDVWGQGTTVTVSS SEQ ID NO: 31866 |
| | | NA | GACATCCAGATGACCCAGTCTCCATCTCCCT GTCTGCATCTGTAGGAGACAGAGTCACCATCA CTTGCCGGGCAAGTCAGAGGCATTAGACATGAT TTAGGCTGGTATCAGCAGAAACCAGGGAAAG CCCCTAAGCTCCTGATCTTTGCTGCATCCAGTT TGCAAAGTGGGGTCCCATCGAGATTCAGCGGC AGTGGATCTGGGACAGAATTCACTCTCACAAT CAGCAGCCTGCAGCCTGAAGATTTTGCAACTT ATTACTGTCTACAGAGTATTAGTTCCCTCGGA CGTTCGGCCAAGGGACCAAGGTGAAATCAA A SEQ ID NO: 27861 | CAGGTGCAGCTGGTGGAGTCTGGGGGAGGCGTG GTCCAGCCTGGGAGGTCCCTGAGACTCTCCTGTG CAGCGTCTAGATTCACCTTCAGTGACTATGTCAT GCACTGGGTCCGCCAGGCTCCAGGCAAGGGGCT GGAGTGGGTGGCAGTTATATGGTATGATGGAAGT AATAAATACTATGTAGACTCCGTGAAGGGCCGAT TCACCATCTCCAGAGACAATTCCAGGAACACGCT GTATCTGCAAATGAACAGCCTGAGAGCCGAGGA CACGGCTGTATATTACTGTGCGAGAGAACGGTAT AGCAGTGGCTTGTACGACTACGGTATGGACGTCT GGGGCCAAGGGACCACGGTCACCGTCTCCTCA SEQ ID NO: 31867 |
| | | AA | DIQMTQSPSSLSASVGDRVTITCRASQGIRHDLG WYQQKPGKAPKRLIFAASSLQSGVPSRFSGSGSG TEFTLTISSLQPEDFATYYCLQHYSFPRTFGQGTK VEIK SEQ ID NO: 27862 | QVQLVESGGGVVQPGRSLRLSCAASRFTFSDYVMH WVRQAPGKGLEWVAVIWYDGSNKYYVDSVKGRF TISRDNSRNTLYLQMNSLRAEDTAVYYCARERYSS GLYDYGMDVWGQGTTVTVSS SEQ ID NO: 31868 |

FIGURE 50
(Continued)

| | | | |
|---|---|---|---|
| iPS:437290 | 21-225_210G6 | NA | GACATCCAGATGACCCAGTCTCCATCTCCG TTTTGCATTTGTAGGAGACAGAGTCACCATCA CTTGCCGGGCAAGTCAGGGCATTAGACATGAT TTAGGCTGGTATCAGCAGAAACCAGGGAAAG CCCTTAAGCGCTTGATATATGCTGCATCCAGTT CGCAAAGTGGGGTCCATCAAGGTTCAGCGGC AGTGGATGTGGGACAGAATTCACTCTCACAAT CAGCAGCCTGCAGCCTGAAGATTTTGCAAATT ATTACTGTGTACAGCATTATAGTTTCCCTCGA CGTTCGGCCAAGGGACCAAGGTGGAAATCAA A |
| | | | SEQ ID NO: 27863 |
| | | AA | DIQMTQSPSSLSASVGDRVTITCRASQGIRHDLG WYQQKPGKALKRLIYAASSSQSGVPSRFSGSGC GTEFTLTISSVQREDFANYYCVQHYSFPRTFGQG TKVEIK |
| | | | SEQ ID NO: 27864 |
| iPS:437294 | 21-225_216D5 | NA | GATGTTGTGATGACTCAGTCTCCACTCTCCCTG CCCGTCACCCCTGGAGAGCCGGCTCCATCTC CTGCAGGTCTAGTCAAAGCCTCGTATACAGTG ATGGAAACACCTACTTGAATTGGTTTCAGCAG AGGCCAGGCCAATCTCCAAGGCGCCTCATTTA TAAGGTTTCTAACTGGGACTCTGGGGTCCCAG ACAGAATCAGCGGCAGTGGGTCAGGCACTGA TTTCACACTGAAAATCAGCAGGGTGGAGGCTG AGGATGTTGGGATTTATTACTGCATGCAAGGT GCACACTGGTTCACCTTCGGCCAAGGGACACG ACTGGAGATTAAA |
| | | | SEQ ID NO: 27865 |

| | | | |
|---|---|---|---|
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGGCAGTTATATGGTATGATGGAAGT AATAAATACTATGTAGACTCCGTGAAGGGCCGAT TCACCATCTCCAGAGACAATTCCAGGAACACGCT GTATCTGCAAATGAACAGCCTGAGAGCCGAGGA CACGGCTGTGTATTACTGTGCGAGAGAACGGTAT AGCAGTGGCTTGTACGACTACGGTATGGACGTCT GGGGCCAAGGGACCACGGTCACCGTCTCCTCA |
| | | | SEQ ID NO: 31869 |
| | | | QVQLVESGGGVVQPGRSLRLSCAASGFTFSDYVM HWVRQAPGKGLEWVAVIWYDGSNKYYVDSVKGR FTISRDNSRNTLYLQMNSLRAEDTAVYYCARERYS SGLYDYGMDVWGQGTTVTVSS |
| | | | SEQ ID NO: 31870 |
| | | | CAGGTGCAGCTGCAGGAGTCGGGCCCAGGACTG GTGAAGCCTTCACAGACCCTGTCCCTCACCTGCA CTGTCTCTGGTGGCTCCATCAGCAGTAGTGGTTA CTACTGGAGCTGGATCCGCCAGCACCCAGGGAA GGGCCTGGAGTGGATTGGGTACATCTATTACAGT GGGAGCACCTACTACAACCCGTCCCTCAAGAGTC GAGTTACCATATCAGTAGACACGTCTAAGAACCA ATTCTCCCTGAAACTGAACTCTGTGACTGCCGCG GACACGGCCGTGTATTTCTGTGCGAGAGATTCCC CTGACAGGGGGTTTGACTACTGGGGCCAGGGAA CCCTGGTCACCGTCTCCTCA |
| | | | SEQ ID NO: 31871 |

FIGURE 50
(Continued)

| | | | |
|---|---|---|---|
| iPS:437302 | 21-225_225B11 | AA | DVVMTQSPLSLPVTLGQPASISCRSSQSLVYSDG NTYLNWFQQRPGQSPRRLIYKVSNWDSGVPDRI SGSGSGTDFTLKISRVEAEDVGIYYCMQGAHWP TFGQGTRLEIK<br>SEQ ID NO: 27866 | QVQLQESGPGLVKPSQTLSLTCTVSGGSISSGGYYW SWIRQHPGKGLEWIGYIYYSGSTYYNPSLKSRVTIS VDTSKNQFSLKLNSVTAADTAVYFCARDSPDRGFD YWGQGTLVTVSS<br>SEQ ID NO: 31872 |
| | | NA | GACATCCAGATGACCCAGTCTCCATCCTCCCT GTCTGCATCTATAGGAGACAGAGTCACCATCA CTTGCCAGGCGAGTCAGGACATTTTCAACTAT TTAAATTGGTATCAGCAGAAACCAGGGAAAG CCCCTAAGCTCCTGATCTACGATGCATCCACTT TGGAAACAGGGGGTCCCATCAAGGTTCAGTGA AGTGGATCTGGGACAGATTTTACTTTCACCAT CAGCAGCCTCAGCCTGAAGATATTGCAACAT ATTACTGTCAACAGGGACACAGACTGGAGATTAA ACCTTCGGCCAAGGGACCACGACTGGAGATTAA A<br>SEQ ID NO: 27867 | CAGGTGCAGCTGGTGGAATCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGACAATTATATCAGATGGAAGT AATAAATACTATGCAGACTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGCGAGACGGGGATA CAGCTATGGCGGGTACGGTATGGACGTCTGGGG CCAAGGGACCACGGTCACCGTCTCCTCA<br>SEQ ID NO: 31873 |
| | | AA | DIQMTQSPSSLSASIGDRVTITCQASQDIFNYLNW YQQKPGKAPKLLIYDASTLETGVPSRFSGSGSGT DFTFTISSLQPEDIATYYCQQYDNLPITFGQGTRL EIK<br>SEQ ID NO: 27868 | QVQLVESGGGVVQPGRSLRLSCAASGFTFSSYGMH WVRQAPGKGLEWVTIISYSGSNKYYADSVKGRFTI SRDNSKNTLYLQMNSLRAEDTAVYYCARRGYSYG GYGMDVWGQGTTVTVSS<br>SEQ ID NO: 31874 |

FIGURE 50
(Continued)

| | | | |
|---|---|---|---|
| iPS:437320 | 21-225_75A1 | NA | GATATTGTGATGACTCAGTCTCCACTCTCCCTG CCCGTCACCCCTGGAGAGCCGGCCTCCATCTC CTGCAGGTCTAGTCAGAGCCTCCTGCATAGTA ATGGACACAAACTATTTGGATTGGTACCTACAG AAGCCAGGGCAGTCTCCACAGCTCCTGATCTA TTTGGGTTCTAATGGGCCTCCGGGGTCCCTG AGAGGTTCAGTGGCAGTGGATCAGGCACAGA TTTTACACTGAAAATCAGCAGAGTGGAGGCTG AGGATGTTGGGGTTTATTACTGCATGCAACCT CTACAAACTCCGTTCACTTTCGGCGGAGGGAC CAAGGTGGAGATCAAA<br><br>SEQ ID NO: 27869 | CAGGTGCAGTACAGCAGTGGGGCGCAGGACTG TTGAAGCATTCGGAGACCCGTCCCTCACCTGC CTGTCTATGTGGGTCCTTCACTGATTACTACTGG AGCTGGATCCGCCAGCCCCCAGGGAAGGGCTG GAGTGGATTGGGGAAATCAATCATAGTGGAGAC ACCAACTACAACCCGTCCCTCAAGAGTCGAGTCA CCATATCAGTAGACACGTCCAAGAACCAGTTCTC CCTGAAGCTGAGTTCTGTGACCGCCGCGGACACG GCTGTGTATTACTGTGCGAGAGAGTTCCATATA GTGGAAGCTACCTCTACTACTGGTATGGACGT CTGGGGCCAAGGGACCACGGTCACCGTCTCCTCA<br><br>SEQ ID NO: 31875 |
| | | AA | DIVMTQSPLSLPVTPGEPASISCRSSQSLLHSNGH NYLDWYLQKPGQSPQLLIYLGSNRASGVPDR FSGSGSGTDFTLKISRVEAEDVGVYYCMQPLQTPF TFGGGTKVEIK<br><br>SEQ ID NO: 27870 | QVQVQQWGAGLLKHSETLSLTCAVYGGSFTDYYW SWIRQPPGKGLEWIGEINHSGDTNYNPSLKSRVTIS VDTSKNQFSLKLSSVTAADTAVYYCAREFPYSGSY LYYYGMDVWGQGTTVTVSS<br><br>SEQ ID NO: 31876 |
| iPS:437322 | 21-225_75B1 | NA | GAATTTATGTTGACGCAGTCTCCAGGCACCCT GTATTGGTCTCCAGGGGAAAAGAGCCACCATCT CGAGCAGGGCCAGTCAGAGTGTTAGCAGCAG CTACTTAGTCTGGTATCAGCAGAAACCTGGCC AGGCTCCCAGGCTCCTCATCTATGGTGCATC ACCAGGGCCACTGGCATCCCAGACAGGTTCAG TGGCAGTGGGTCTGGGACAGACTTCACTCTCA CCATCAGCAGACTGGAGCCTGAATATTTTGCA GTTTATTACTGTCAGCAGTATGGTGCTCACCG CTCACTTTCGGCGGAGGGACCAAGGTGGAGAT CACA<br><br>SEQ ID NO: 27871 | CAGGTGCAGCTGGTGCAGTCTGGGCTGAGGTG AAGAAGCCTGGGCCTCAGTGAAGGTCTCCTGC AAGGCTTCTGGATACACCTTCACCAATTATGATA TCAACTGGGTGCGACAGGTCCTGGACAAGGC TTGAGTGGATGGGATGGATGCACCCTAACAGTGG TAACACAGGCTATGCACAGAAGTTCCAGGGCAG AGTCACCATGACCAGGGACACCTCCATCAGCAC AGCCTACATGGAGCTGAGCAGCCTGAGATCTGA GGACACGGCCGTGTATTACTGTGCGATTAGTAGT GGCTGGTACTGGTTCGACCCCTGGGGCCAGGGA ACCCTGGTCACCGTCTCCTCA<br><br>SEQ ID NO: 31877 |

FIGURE 50
(Continued)

| | | | | |
|---|---|---|---|---|
| | | AA | EFMLTQSPGTLYWSPGERATISSRASQSVSSSYL VWYQQKPGQAPRLLIYGASTRATGIPDRFSGSGS GTDFFLTISRLEPEYFAVYYCQQYGCSPLTFGGG TKVEIT<br><br>SEQ ID NO: 27872 | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS<br><br>SEQ ID NO: 31878 |
| iPS:437324 | 21-225_75C2 | NA | GAAATTGTGTTGACGCAGTCTCCAGGCACCCG GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATCTATGGTGCATCCA GCCGGGCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTATGATAACTCACCG TGGACGTTCGGCCGAGGGACCAAGGTGGAAA TCAAA<br><br>SEQ ID NO: 27873 | CAGGTGCAGCTACAGCAGTGGGGCGCAGGACTG TTGAAGCCTTCGGAGACCCTGTCCCTCACCTGCG CTGTCCATGTGGGTCCTTCAGTGGTGTTGCTACTG GAGCTGGATCCGCCAGCCCCCAGGGAAGGGGCT GGAGTGGATTGGGGAAATCAATCATAGTGGAAG CACCAACTACAACCGTCCTCAAGAGTCGAGTC ACCATTTCAGTAGACACGTCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 31879 |
| | | AA | EIVLTQSPGTRYLSPGERATLSCRASQSVYSSYL AWYQQKPGQAPRLLIYGASSRATGIPDRFSGSGS GTDFALTISRLEPEDCAVYYCQHYDNSPWTFGR GTKVEIK<br><br>SEQ ID NO: 27874 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 31880 |

FIGURE 50
(Continued)

| | | | |
|---|---|---|---|
| iPS:437326 | 21-225_75C10 | NA | GACATCCAGATGACCCAGTCTCCGTCTTCCGT GTCTGCTTCTGTAGGAGACAGAGTCATCATCA CTTGTCGGGCGAGTCAGGCATTAGCATCTGG TTAGCCTGGTATCAGCAGAAACCAGGGAAAG CCCCTAAGCTCCTGATCTATGCTGCATCCAGTT TGCAAAGTGGGGTCCCATTAAGGTTCAGCGGC AGTGGATCTGGGACAGATTTCACTCTCACCAT CAGCAGCCTGCAGCCTGAAGATTTTGCAACTT ACTATTGTCAACAGGCTAAAAGTTTCCCGCTC ACTTTCGGCGGAGGGACCAAGGTGGAGATCA AA SEQ ID NO: 27875 | CAGGTGCAACTGGTGGAGTCTGGGGGAGGCGTG GTCCAGCCTGGGAGGTCCCTGAGACTCTCCTGTG CAGCGCTCTGGATTCACCTTCAGTAGTTATGGCAT GCATTGGGTCCGCCAGGCTCCAGGCAAGGGCT GGAGTGGGTGGCAGTTATATGGTATGATGGAAGT GATAAATACTATGCAGACTCCGTGAAGGGCGA TTCACCATCTCCAGAGACAATTCCAAGAACACGC TGTATCTGCAAATGAACAGCCTGAGAGCCGAGG ACACGGCTGTGTATTACTGTGCGAGAGATCGGTT AGTGGGAGCTACGGTTGATGCTTTTGATATCTGG GGCCAAGGGACAATGGTCACCGTCTCTTCA SEQ ID NO: 31881 |
| | | AA | DIQMTQSPSSVSASVGDRVIITCRASQGISIWLAW YQQKPGKAPKLLIYAASSLQSGVPLRFSGSGSGT DFTLTISSLQPEDFATYYCQQAKSFPLTFGGGTK VEIK SEQ ID NO: 27876 | QVQLVESGGGVVQPGRSLRLSCAASGFTFSSYGMH WVRQAPGKGLEWVAVIWYDGSDKYYADSVKGRF TISRDNSKNTLYLQMNSLRAEDTAVYYCARDRLVG ATVDAFDIWGQGTMVTVSS SEQ ID NO: 31882 |
| iPS:437328 | 21-225_75D3 | NA | GAAATTGTGTTGACGCAGTCTCCAGGCACCCT GTATTTGTCTCCAGGGGAAAGAGCCACCCTCT CATGCAGGCCAGTCAGAGTGTTTACAGCAGC TACTTAGCCTGGTACCAGCAGAAACCTGGCCA GGCTCCCAGGCTCCTCATCTATGGTGCATCCA GCCGGGTCCACTGGCATACCAGACAGGTTCAGT GGCAGTGGGTGTGGGACAGACTTCGCTCTCAC CATCAGCAGAGTGGAGCATGAAGATTGTGCA GTGTATTACTGTCAGCACTATGATAACTCACC GTGGACGTTCGGCCAAGGGACCAAGGTGGAA ATCAAA SEQ ID NO: 27877 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGTGGATCCGCCAGCCCCCAGGGAAGGGGCT GGAGTGGATTGGGAAATCAATCATAGTGGAAG CACCAACTACAACCGTCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA SEQ ID NO: 31883 |

FIGURE 50
(Continued)

| | | | |
|---|---|---|---|
| iPS:437332 | 21-225_75F3 | AA | EIVLTQSPGTLYLSPGERATLSCRASQSVYSSYLA WYQQKPGQAPRLLIYGASSRSTGIPDRFSGSGCG TDFALTISRVEHEDCAVYYCQHYDNSPWTFGQG TKVEIK<br>SEQ ID NO: 27878 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 31884 |
| | | NA | GAAATTGTGTTGACGCAGTCTCCAGGCACCCT GTATTTGTCTCCAGGGGAAAGAGCCACCCTCT CATGCAGGGCCAGTCAGTCAGAGTGTTTACAGCAGC TACTTAGCCTGGTACCAGCAGAAACCTGGCCA GGCTCCCAGGCTCCTCATTTATGGTGCATCA GCCGGGCCACTGGCATCCCAGACAGTTCAGT GGCAGTGGGTGTGGGACAGATGGCTCGCTCTCAC CATCAGCAGACTGGAGCACTGAAGATTTTGCAG TGTATTACTGTCAGCACTATGATAACTCACCG TGGACGTTCGGCCAAGGGACCAAGGTGGAAA TCAAA<br>SEQ ID NO: 27879 | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCAGGGAAGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGACAC GGCTGTGTATTACTGTGCGAGGGACTACGGCGGT ATGGACGTCTGGGGCCAAGGGACCACGGTCACC GTCTCCTCA<br>SEQ ID NO: 31885 |
| | | AA | EIVLTQSPGTLYLSPGERATLSCRASQSVYSSYLA WYQQKPGQAPRLLIYGASSRATGIPDRFSGSGCG TDFALTISRLEHEDFAVYYCQHYDNSPWTFGQG TKVEIK<br>SEQ ID NO: 27880 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 31886 |

FIGURE 50
(Continued)

| | | | | |
|---|---|---|---|---|
| iPS:437334 | 21-225_75F11 | NA | GAAATAGTGATGACGCAGTCTCCAGCCACCCTGTTTGTGTCTCCAGGGGAAAGAGCCACCCTCTCCTGCAGGGCCAGTCAGAGTGTTAGCAGAAATTTAGCCTGGTTCCAGCAGAAACCTGGCCAGGCTCCCAGGCTCCTCTTTTATGGTGCATCCATCAGGGCCACTGGTATCCCAGCCAGGTTCAGTGGCAGTGGGTCTGGGACAGAGTTCACTCTCACCATCTACAGCCTGCAGTATGAAGATTTTGCAGTTTATTACTGTCAGCAGTATAATAACTGGCCTCCGCTCACTTTCGGCGGAGGGACCAAGGTGGAGATCAAA | CAGATCACCTTGAAGGAGTCTGGTCCTACGCTGGTGAAACCCACACAGACCCTCACGCTGACCTGCACCTTCTCTGGGTTCTCACTCAGCACTGGTGGAGTGGGTGTGGGCTGGATCCGTCAGCCCCCAGGAAAGGCCCTGGAGTGGCTTGCACTCATTTATTGGGATGATGATAAGCGCTACAGCCCATCTCTGAAGAGCAGGCTCACCATCACCAAGGACACCCCCAAAAACCAGGTGGTCCTTACAATGACCAACATGGACCCTGTGGACACAGCCACATATTACTGTGCACACCTTATAGCAGTGGCCTTTGACTACTGGGGCCAGGGAACCCTGGTCACCGTCTCCTCA |
| | | | SEQ ID NO: 27881 | SEQ ID NO: 31887 |
| | | AA | EIVMTQSPATLFVSPGERATLSCRASQSVSRNLAWFQQKPGQAPRLLFYGASIRATGIPARFSGSGSGTEFTLTIYSLQYEDFAVYYCQQYNNWPPLTFGGGTKVEIK | QITLKESGPTLVKPTQTLTLTCTFSGFSLSTGGVGVGWIRQPPGKALEWLALIYWDDDKRYSPSLKSRLTITKDTPKNQVVLTMTNMDPVDTATYYCAHLIAVAFDYWGQGTLVTVSS |
| | | | SEQ ID NO: 27882 | SEQ ID NO: 31888 |
| iPS:437340 | 21-225_75G9 | NA | GAAATTGCGTTGACGCAGTCTCCAGGCACCCTGTCTTTGTCTCCAGGGGAAAGAGCCACCCTCTCCTGCAGGGCCAGTCCGAGTGTTGACAGCAGCTACTTAGCCTGGTACCAGCAGAAACCTGGCCAGGCTCCCAGGCTCCTCATCTATGGTGCATCCAGCAGGGCCCCTGGCATCCCAGACAGGTTCAGTGGCAGTGGGTCTGGGACAGACTTCACTCTCACCATCAGCAGACTGGAGCCTGAAGATTTTGCAGTGTATTACTGTCAGCAGTATGAAAGTTCACCGTGGACGTTCGGCCAAGGGACCAAGGTGGAAATCAAA | CAGGTGCAGCTACAGCAGTGGGGCGCAGGACTGTTGAAGCCTTCGGAGACCCTGTCCCTCACCTGCGCTGTCTATGGTGGGTCCTTCAGTGGTTGCTACTGGAGCTGGATCCGCCAGCCCCCAGGGAAGGGGCTGGAGTGGATTGGGGAAATCAATCATAGTGGAAGGACCAACTACAACCCGTCCCTCAAGAGTCGAGTCACCATATCAGTAGACACGTCCGAGAACCAGTTCTCCCTGAAGCTGAGCTCTGTGACCGCCGCGGACACGGCTGTGTATTACTGTGCGAGAGACTACGGTGGGCTTGACTACTGGGGCCAGGGAACCCTGGTCACCGTCTCCTCA |
| | | | SEQ ID NO: 27883 | SEQ ID NO: 31889 |

FIGURE 50
(Continued)

| | | AA | EIALTQSPGTLSLSPGERATLSCRASPSVDSSYLA WYQQKPGQAPRLLIYGASSRAPGIPDRFSGSGSG TDFTLTISRLEPEDFAVYYCQQYESSPWTFGQGT KVEIK<br>SEQ ID NO: 27884 | QVQLQQWGAGLLKPSETLSLTCAVYGGSFSGCYW SWIRQPPGKGLEWIGEINHSGRTNYNPSLKSRVTIS VDTSENQFSLKLSSVTAADTAVYYCARDYGGLDY WGQGTLVTVSS<br>SEQ ID NO: 31890 |
|---|---|---|---|---|
| iPS:437344 | 21-225_75G12 | NA | GAAATTGTTGACGCAGTCTCCAGGCACCCT GTATTTGTCTCCAGGGGAAAGAGCCACCCTGT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGCCACTGGCATCCCAGACAGGTTCAGT GGCAGTGGGTCTGGGACAGATTCGCTCTCAC CATCAGCAGACTAGAGTGGAGCCTGAAGATTGTGCAG TGTATTACTGTCAGCACTATGATAACTCACCG TGGACGTTCGGCCAAGGGACCAAGGTGGAAA TCAAA<br>SEQ ID NO: 27885 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCCAGGAAGGGCT GGAGTGGATTGGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br>SEQ ID NO: 31891 |
| | | AA | EIVLTQSPGTLYLSPGERATLSCRASQSVYSSYLA WYQQKPGQAPRLLIYGASSRATGIPDRFSGSGSG TDFALTISRVEPEDCAVYYCQHYDNSPWTFGQG TKVEIK<br>SEQ ID NO: 27886 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 31892 |

FIGURE 50
(Continued)

| | | | |
|---|---|---|---|
| iPS:437346 | 21-225_75H7 | NA | GACATTCAGATGACCCAATCTCCATCCTCCCG GTATGCATCTGTAGGAGACAGAGTCACCATCA ATAGCCCGGGCAAGTCAGGGCATAAGAAATGA TTTAGGCTGGTATCAACAGAAACCAGGAGAAAT CCCCTCAGCGCCTGATTTATGATGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGGTGTTT ATTACTGTATACAGCATAGTAATTACCCGCTC ACTTTCGGCGGAGGGACCAAGGTGGAGATCA AA<br><br>SEQ ID NO: 27887<br><br>DIQMTQSPSSLSASVGDRVTINSRASQGIRNDLG WYQQKPGKSPQRLIYDASSLQSGVPSRFSGSGSG TEFTLTISSVQPEDFGVYYCIQHSNYPLTFGGGTK VEIK<br><br>SEQ ID NO: 27888 | CAGGTGCAGCTGCAGGAGTCGGGCCCAGGACTG GTGAAGCCCTTCGGAGACCCCTGTCCTCACCTGCA CTGTCTCTGGCGGCTCCATCAGCAGGAGTAGTTA CTACTGGGGCTGGATCCGCCAGCCCCCAGGAA GGGGCTGGAGTGGATTGGGAGTATCTATTATAGT GGGAGCGCCTACTCCAACCGTCCCCTCAAGAGTC GAGTCACCATATCCGTAGACACGTCCAAGAACC AGTTCTCCCTGAAGCTGAGCTCTGTGACCGCGC GGACACGGCTGTGTTTACTGTGCGAGACTTGAC TCTAACTGGGGTCTTGACTACTGGGGCCAGGGAA CCCTGGTCACCGTCTCCTCA<br><br>SEQ ID NO: 31893<br><br>QLQLQESGPGLVTPSETLSLTCTVSGGSISRSSYYW GWIRQPPGKGLEWIGSIYYSGSAYSNPSLKSRVTIS VDTSKNQFSLKLSSVTAADTALFYCARLDSNWGLD YWGQGTLVTVSS<br><br>SEQ ID NO: 31894 |
| iPS:437350 | 21-225_74A3 | NA | GAAATTGTGTTGACGCAGTCTCCAGGCACCCT GTCTTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTGTGGGACAGACTTCGCTCTCAC CATCAGCAGACTGGAGCCTGAAGATTTTGCAG TGTATTACTGTCAGCACTCTGATAACTCACCGT GGACGTTCGGCCAAGGGACCAAGGTGAAAT CAAA<br><br>SEQ ID NO: 27889 | CAGGTGCAGCTACAGCAGTGGGGCGCAGGACTG TTGAAGCCTTCGGAGACCCTGTCCTCACCTGCG CTGTCCATGTGGGTCCTTCAGTGGTTGCTACTG GAGCTGGATCCGCCAGCCCCCAGGGAAGGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 31895 |

FIGURE 50
(Continued)

| | | | | |
|---|---|---|---|---|
| iPS-437356 | 21-225_74B1 | AA | EIVLTQSPGTLSLSPGERATLSCRASQSVSSYLA WYQQKPGQAPRLLIYGASSRSTGIPDRFSGSGCG TDFALTISRLEPEDFAVYYCQHSDNSPWTFGQGT KVEIK<br>SEQ ID NO: 27890 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 31896 |
| | | NA | GACATCGTGATGACCCAGTCTCCAGACTTCCT GGCTGTGTCTCTGGGCGAGAGGGCCACCACCA ATTGTAAGTCAGCCAGAGTGTTTACACAGG TCCAACAATTACAACTACTTAGCGTGGTACCA GCAGAAACCAGGACAGGCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAAA<br>SEQ ID NO: 27891 | CAGGTGCAGCTGCTGGTGCAGTCTGGGGCTGAGGTG AAGAAGCCTGGGGCCTCAGTGAAGGTCTCCTGC AAGGCTTCTGGATACACCTTGACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACTCCATAAGCA CAGCCTACATGAACTGAGCAGCCTGAGATCTG AGGACACGGCCGTGTATTACTGTGGGAGTACCA GTGGCTGGAACTTCTTTGACTACTGGGGCCAGGG AACCCTGGTCACCGTCTCCTCA<br>SEQ ID NO: 31897 |
| | | AA | DIVMTQSPDFLAVSLGERATTNCKSSQSVLHRSN NYNYLAWYQQKPGQPPKLLIYWASTRESGVPD RFSGSGSGTDFTLTISSLQAEDVAVYYCQQYYST PPTFGQGTKVEIK<br>SEQ ID NO: 27892 | QVQLVQSGAEVKKPGASVKVSCKASGYTLTNYDI NWVRQATGQGLEWMGWMNPNSGNTGYAQKFQG RVTMTRNTSISTAYMELSSLRSEDTAVYYCGSTSG WNFFDYWGQGTLVTVSS<br>SEQ ID NO: 31898 |

FIGURE 50
(Continued)

| | | | | |
|---|---|---|---|---|
| iPS:437361 | 21-225_74C1 | NA | GACATCGTGATGACCCAGTCTCCAGACTCCCC<br>GGCTGTGTCTCTGGGCGAGAGGGCCTCCATCA<br>ATTGCAAGTCCAGCCAGAGTATTTTACACAGC<br>TCCAACAATTACAATTACTTAGCTTGGTACCA<br>GCAGAAACCAGGACAGCCTCCTAAGCTGCTCA<br>TTTACTGGGCATCTACCCGGGAATCCGGGTC<br>CCTGACCGATTCAGTGGCAGCGGGTATGGAC<br>AGATTTCACTCTAACCATCAGCAGCCTGCAGG<br>CTGAAGATGTGGCAGTTTATTACTGTCAGCAA<br>TATTATAGTACTCCGTGACGTTCGGCCAAGG<br>GACCAAGGTGGAAATCAAA<br><br>SEQ ID NO: 27893 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCAATTATGATA<br>TCAACTGGGTGCGACAGGCCACTGGACAAGGGC<br>TTGAGTGGATGGGATGGATGAACCCTGACAGTG<br>GTAACACAGGCTTTGCACAGAAGTTCCAGGGCA<br>GAGTCACCATGACCAGGAACACCTCCATAAGCA<br>CAGCCTACATGGAGCTGAGCAGCCTGAGATCTG<br>AGGACACGGCCGTGTATTACTGTGCGGTTCCAG<br>TGGCTGGTACTGGTTCGACCCTGGGGGCCAGGA<br>ACCCTGGTCACCGTCCTCA<br><br>SEQ ID NO: 31899 |
| | | AA | DIVMTQCPDSPAVSLGERASINCKSSQSILHSSNN<br>YNYLAWYQQKPGHPHKLLIYWASTRESGVPDR<br>FSGSGYGTDFTLTISSLQAEDVAVYYCQQYYSTP<br>WTFGQGTKVEIK<br><br>SEQ ID NO: 27894 | QVQLVQSGAEVKKPGASVKVSCKASGYTFTNYDIN<br>WVRQATGQGLEWMGWMNPDSGNTGFAQKFQGR<br>VTMTRNTSISTAYMELSSLRSEDTAVYYCAVSSGW<br>YWFDPWGQGTLVTVSS<br><br>SEQ ID NO: 31900 |
| iPS:437363 | 21-225_74C10 | NA | GACATCGTGATGACCCAGTCTCCAGACTCCCT<br>GGCTGTGTCTCTGGGCGAGAGGGCCACCATCA<br>ACTGCAAGTCCAGCAGTACTTAGCTTGTACCA<br>TCCAACAATGCAACTACTTAGCTTGGTACCA<br>GCAGAAACCAGGACAGCCTCCTAACCTGCTCA<br>TTTACTGGGCATCTACCCGGGAATCCGGGTC<br>CCTGACCGATTCAGTGGCAGCGGGTCTGGAC<br>AGATTTCACTCTCACCATCAGCAGCCTGCAGG<br>CTGAAGATGTGGCAGTTTATTACTGTCAGCAA<br>TATTATAGTACTCCGTGCAGTTTTGGCCAGG<br>GACCAAGCTGGAGATCAAA<br><br>SEQ ID NO: 27895 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCAATTATGATA<br>TCAACTGGGTGCGACAGGCCACTGGACAAGGGC<br>TTGAGTGGATGGGATGGATGAACCCTAACAGTG<br>GTAACATAGGCTATGCACAGAAGTTCCAGGGCA<br>GAGTCACCATGACCAGGAACACCTCCATAAGCA<br>CAGCCTACATGGAGCTGAGCAGCCTGAGATCTG<br>AGGACACGGCCGTGTATTACTGTGCGATTAGCAG<br>TGGCTGGTACTGGTTCGACCCCTGGGGCCAGGGA<br>ACCCTGGTCACCGTCCTCA<br><br>SEQ ID NO: 31901 |

FIGURE 50
(Continued)

| | | | | |
|---|---|---|---|---|
| iPS:437369 | 21-225_74D6 | AA | DIVMTQSPDSLAVSLGERATINCKSSQSVLYSSN NANYLAWYQQKPGQPPNLLIYWASTRESGVPD RFSGSGSGTDFTLTISSLQAEDVAVYYCQQYYST PCSFGQGTKLEIK<br><br>SEQ ID NO: 27896 | QVQLVQSGAEVKKPGASVKVSCKASGYTFTNYDIN WVRQATGQGLEWMGWMNPNSGNIGYAQKFQGR VTMTRNTSISTAYMELSSLRSEDTAVYYCAISSGW YWFDPWGQGTLVTVSS<br><br>SEQ ID NO: 31902 |
| | | NA | GAAATTGTGTTGACGCAGTCTCCAGGCACCCT GTCTTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGCCACTGGCATCCCAGACAGTTCAGT GGCAGTGGGTGTGGGACAGACTTCGCTCTCAC CATCAGCAGACTGGAGCCTGAAGATTTTGCAG TGTATTACTGTCAGCATTATGATAACTCACCGT GGACGTTCGGCCAAGGGACCAAGGTGGAAAT CAAA<br><br>SEQ ID NO: 27897 | CAGGTGCAGCTACAGCAGTGGGGCGCAGGACTG TTGAAGCCTTCGGAGACCCTGTCCCTCACCTGCG CTGTCCATGTGGGTCTTCAGTGGTTGCTACTG GAGCTGGATCCGCCAGCCCCAGGGAAGGGGCT GGAGTGGATTGGGGAAATCAATCATAGTGGAAG CACCAACTACAACCCGTCCTCCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 31903 |
| | | AA | EIVLTQSPGTLSLSPGERATLSCRASQSVYSSYLA WYQQKPGQAPRLLIYGASSRATGIPDRFSGSGCG TDFALTISRLEPEDFAVYYCQHYDNSPWTFGQG TKVEIK<br><br>SEQ ID NO: 27898 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 31904 |

FIGURE 50
(Continued)

| | | | |
|---|---|---|---|
| iPS:437371 | 21-225_74D8 | NA | GATATTGTGATGACTCAGTCTCCACTCTCCCTG CCCGTCACCCCTGGAGAGCCGGCCTCCATCTC ATGCAGGGTCTAGTCAGAGCCTGTGCATAGTA GTGGATACAACTATTTGGATTGGTACCTGCAG AAGCCAGGGCAGTCTCCACAGCTCGTTATCTA TTTGGGTTCTAGTCAGTGCAGCAGTGGATCAGGCTCCTG ACAGGTTCAGTGCAGTGGATCAGGCTCAGAT TTTACACTGAAGATCAGCAGAGTGGAGGCTGA GGATGTTGGACTTTATTACTGCATGCAAGCTC TACACCCTCCTCTCACTTTCGGCGGAGGGACC AAGGTGGAGATCAAA SEQ ID NO: 27899 | GAGGTGCAGCTGGTGGAGTCTGGGGGAGGCTTG GTACAGCCGGGGGGGTCCCTGAGACTCTCCTGTG CAGCCTCTGGATTCACCTTCAGTAACTACGACAT GCACTGGGTCCGCCAAGCTACAGGAAAAGGTCT GGAGTGGGTCTCAGCTATTGGTACTGCTGGTGAC ACATACTATCCAGGCTCCGTGAAGGGCCGATTCA CCATCTCCAGAGAAAATGCCAAGAACTCCTTGTA TCTTCAAATGAACAGCCTGAGAGCCGGGGACAC GGCTGTGTATTACTGTGCAAGAGTTCTTGACTAC GGTGACTCCTTGGGCTACTACTACGGTATGG ACGTCTGGGGCCAAGGGACCACGGTCACCGTCTC CTCA SEQ ID NO: 31905 |
| | | AA | DIVMTQSPLSLPVTPGEPASISCRSSQSLVHSSGY NYLDWYLQKPGQSPQLVIYLGSNRASGVPDRFS GSGSGSDFTLKISRVEAEDVGLYYCMQALHPPL TFGGGTKVEIK SEQ ID NO: 27900 | EVQLVESGGGLVQPGGSLRLSCAASGFTFSNYDMH WVRQATGKGLEWVSAIGTAGDTYYPGSVKGRFTIS RENAKNSLYLQMNSLRAGDTAVYYCARVLDYGDS LGYYYYGMDVWGQGTTVTVSS SEQ ID NO: 31906 |
| iPS:437377 | 21-225_74G9 | NA | GAATTTATGTTGACGCAGTCTCCAGGCACCCT GTCTTTGTCTCCAGGGGAAAGAGCCACCCTCT CCTGCAGGGCCAGTCAGAGTGTTAGCAGCAGC TACTTAGTCTGGTATCAGCAGAAACCTGGCCA GGCTCCCAGGCTCCTCATCTATGGTGCATCCA CCAGGGCCACTGGCATCCCAGACAGGTTCAGT GGCAGTGGGTCTGGGACAGACTTCACTCTCAC CATCAGCAGACTGGAGCCTGAATATTTTGCAG TTTATTACTGTCAGCAGTATGGTTGCTCACGGC TCACTTTCGGCGGAGGGACCAAGGTGGAGATC ACA SEQ ID NO: 27901 | CAGATCACCTTGAAGGAGTCTGGTCCTACGCTGG TGAAACCCACACAGACCCTCACGCTGACCTGCAC CTTCTCTGGGTTCTCACTCAGCACTGGTGAGTG GGTGTGGGCTGGATCCGTCAGCCCCCAGGAAAG GCCCTGGAGTGGCTTGCACTCATTTATTGGGATG ATGATAAGCGCTACAGCCCATCTCTGAAGAGCA GGCTCACCATCACCAAGGACACCTCCCAAAAACC AGGTGGTCCTTACAATGACCAACATGGACCCTGT GGACAGCCACCACATATTACTGTGCACACCTTATA GCAGTGGCCTTGACTACTGGGGCCAGGGAACCC TGGTCACCGTCTCCTCA SEQ ID NO: 31907 |

FIGURE 50
(Continued)

| | | | |
|---|---|---|---|
| iPS:437379 | 21-225_74H2 | AA | EFMLTQSPGTLSLSPGERATLSCRASQSVSSSYL VWYQQKPGQAPRLLIYGASTRATGIPDRFSGSGS GTDFTLTISRLEPEYFAVYYCQQYGCSPLTFGGG TKVEIT<br>SEQ ID NO: 27902 | QITLKESGPTLVKPTQTLTLTCTFSGFSLSTGGVGVG WIRQPPGKALEWLALIYWDDDKRYSPSLKSRLTIT KDTPKNQVLTMTNMDPVDTATYYCAHLIAVAFD YWGQGTLVTVSS<br>SEQ ID NO: 31908 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTACACAGC TCCAACAATAAGAACTACTTAACTTGGTACCA GCAGAAACCAGGACAGCCTCATAAGCTGCTCA TTTACTGGGCATCTACTCGGGAATCCGGGTC CCTGACCGATTCAGTGGCAGCGGGTCTGGGAC AGATTTCAGTCTCACGATCGGCAGCCTGCAGG CTGAAGATGTGGCAGTTTATTACTGTCAGCAA TATTATAGTATTCCTCCGACGTTCGGCCAAGG GACCAAGGTGGAAATCAAA<br>SEQ ID NO: 27903 | CAGGTGCAGCTGGTGCAGTCTGGGGCTGAGGTG AAGAAGCCTGGGGCCTCAGTGAAGGTCTCCTGC AAGGCTTCTGGATTCACCTTCACCAATTATGATA TCAACTGGGTGCGACAGGCCACTGGACAAGGGC TTGAGTGGATGGGATGGATGCACCTAACAGTGG TAACACAGGCTTTGCACAGAAGTTCCAGGGCAG AGTCACCATGACCAGGAACACCTCCATAAGCAC AGCCTACATGAACTGAGCAGCCTGAGATCTGA GGACACGGCCGTGTATTACTGTGCGGTTTCCAGT GGCTGGTACTGGTTCGACCCCTGGGGCCAGGGA ACCCTGGTCACCGTCCTCCTCA<br>SEQ ID NO: 31909 |
| | | AA | DIVMTQSPDSLAVSLGERATINCKSSQSVLHSSN NKNYLTWYQQKPGQPHKLLIYWASTRESGVPD RFSGSGSGTDFSLTIGSLQAEDVAVYYCQQYYSI PPTFGQGTKVEIK<br>SEQ ID NO: 27904 | QVQLVQSGAEVKKPGASVKVSCKASGFTFTNYDIN WVRQATGQGLEWMGWMHPNSGNTGFAQKFQGR VTMTRNTSISTAYMELSSLRSEDTAVYYCAVSSGW YWFDPWGQGTLVTVSS<br>SEQ ID NO: 31910 |

FIGURE 50
(Continued)

| | | | |
|---|---|---|---|
| iPS-437383 | 21-225_74H8 | NA | GAAATTGTGTTGACGCAGTCTCCAGGCACCCT GTCTTTGTCTCCAGGGGAAAGAGCCACCCTCT CCTGCAGGGCCAGTCAGAGTTTTAGCAGCAGC TACTTAGCCTGGTACCAGCAGAAACCTGGCCA GGCTCCCAGGCTCCTCATTTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAGCTCAAGG ACGTTCGGCCAAGGGACCAAGGTGGAAATCA AA SEQ ID NO: 27905 | GAGGTGCACCTGGTGGAGTCTGGGGGAGGCTTG GTAAAGCCTGGGGGGTCCCTGAGACTCTCCTGTG CAGCCTCTGGATTCACTTTCAGTAACGCTGGAT GAACTGGGTCCGCCAGGCTCCAGGGAAGGGGCT GGAGTGGGTTGGCCGTATTAAAAGCAAACTGA TGGTGGGACAACAGATACGCTGCACCGTGAA AGGCAGATTCACCATCTCAAGAGATGATTCAAA AAACACGTGTATCTGCAAATGAACAGCCTGAA AACCGAGGACACAGCCGTGTATTACTGTACCACA GTGGGAGCTACTACGGACTACTGGGGCCAGGGA ACCCTGGTCACCGTCTCCTCA SEQ ID NO: 31911 |
| | | AA | EIVLTQSPGTLSLSPGERATLSCRASQSFSSSYLA WYQQKPGQAPRLLIYGASSRATGIPDRFSGSGSG TDFTLTISRLEPEDFAVYYCQQYGSSRTFGQGTK VEIK SEQ ID NO: 27906 | EVHLVESGGGLVKPGGSLRLSCAASGFTFSNAWM NWVRQAPGKGLEWVGRIKSKTDGGTTDYAAPVK GRFTISRDDSKNTLYLQMNSLKTEDTAVYYCTTVG ATTDYWGQGTLVTVSS SEQ ID NO: 31912 |
| iPS-438664 | 21-225_216G1 | NA | GACATCGAGATGACCCAGTCTCCATCCTCACT GTCTGCATCTGTAGGAGACAGAGTCACCATCA CTTGTCGGGCGAGTCAGGGCATTAGCAGTTAT TTAGCCTGGCTTCAGCAGAAACCAGGGAAAGC CCCTAAGTCCCTGATCTATGCTGCATCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTATTGCCTACGGTATGATACTTACCCTCTCAC TTTCGGCGGAGGGACCAAGGTGGAGATCAAAG SEQ ID NO: 27907 | CAGGTGCACCTGGTGGAGTCTGGGGGAGGCCTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGGGGACTG GAACCCCGAGGTATGGACGTCTGGGGCCAAGG GACCACGGTCATCGTCCTCA SEQ ID NO: 31913 |

FIGURE 50
(Continued)

| | | | |
|---|---|---|---|
| iPS:441468 | 21-225_25A4.001.001 | AA | DIEMTQSPSSLSASVGDRVTITCRASQGISSYLA WLQQKPGKAPKSLIYAASSLQSGVPSRFSGSGSG TDFTLTISSLQPEDFATYYCLRYDTYPLTPGGGT KVEIK SEQ ID NO: 27908 | QVHLVESGGGVVQPGRSLRLSCAASGFTFSNYGM HWVRQAPGKGLEWVAVIWYDGSNKYYADSVKGR FTISRDNSKNTLYLQMNSLRAEDTAVYYCARGDW NPEGMDVWGQGTTVTVSS SEQ ID NO: 31914 |
| | | NA | GACATCGTGATGACCCAGTTTCCAGACTCCCT GGCTGTGTCTCTGGGCGAGAGGGCCACCATCA AGTGTAAGTCCAGCCAGAGTGTTTTATACAGC TCCCACAATAACCAGGACAGCCTCCTAAGTTGCTCC GCAGAAACCAGGACAGCCTCCTAAGTTGCTCC TTTACTGGGCATCTACCCGGGAATCCGGGGTC CCTGACCGATTCAGTGGCAGCGGGTCTGGGAC AGAATTCACTCTCACCATCAGCAGCCTGCAGAG CTGAAGATGTGGCAGTTTATTACTGTCAGCAG TATTATAGTACTCCTCCGACGTTCGGCCAAGG GACCAAGGTGGAAATCAAA SEQ ID NO: 27909 | CAGGTGCTCCTGGTGCAGTCTGGGCTGAGGTGA AGAGGCCTGGGCCTCAGTGAAGGTCAGCTGCA AGGCTTCTGGATACACCTTCACCAATTATGATAT TAATTGGGTGCGACAGGCCACTGGACAAGGCT TGAGTGGATGGGATGGATGTACCCTAACAGTGGT AGCACAGGCTATGCACAGAAATTCCAGGCAGA GTCACCATGACCAGGACACCTCCATCAGCACA GCCTACATGGAGCTGAGCAGCCTGAGATCTGAG GACACGGCCGTCTATTACTGTGCGAGTAGCAGTG GCTGGTACTACTTTGACTACTGGGGCCAGGGAAC CCTGGTCACCGTGTCCTCA SEQ ID NO: 31915 |
| | | AA | DIVMTQFPDSLAVSLGERATIKCKSSQSVLYSSH NNNYLAWYQQKPGQPPKLLLYWASTRESGVPD RFSGSGSGTEFTLTISSLEAEDVAVYYCQQYYST PPTFGQGTKVEIK SEQ ID NO: 27910 | QVLLVQSGAEVKRPGASVKVSCKASGYTFTNYDIN WVRQATGQGLEWMGWMYPNSGSTGYAQKFQGR VTMTRDTSISTAYMELSSLRSEDTAVYYCASSSGW YYFDYWGQGTLVTVSS SEQ ID NO: 31916 |

FIGURE 50
(Continued)

| | | | |
|---|---|---|---|
| iPS:441475 | 21-225_25A4.001.002 | NA | CAGGTGCTCCTGGTGCAGTCTGGGGCTGAGGTGA AGAGGCCTGGGGCCTCAGTGAAGGTCAGCTGCA AGGCTTCTGGATACACCTTCACCAATTATGATAT TAATTGGGTGCGACAGGCCACTGGACAAGGGCT TGAGTGGATGGATTGGATGTACCTAACAGTGGT AACGCAGGCTATGCACAGAAATTCCAGGGCAGA GTCACCATGACCAGGGACACCTCCATCAGCACA GCCTACATGGAGCTGAGCAGCCTGAGATCTGAG GACACGGCCGTCTATTACTGTGCGAGTAGCAGTG GCTGGTACTACTTTGACTACTGGGGCCAGGGAAC CCTGGTCACCGTGTCCTCA<br><br>SEQ ID NO: 31917 |
| | | AA | QVLLVQSGAEVKRPGASVKVSCKASGYTFTNYDIN WVRQATGQGLEWMGWMYPNSGNAGYAQKPQGR VTMTRDTSISTAYMELSSLRSEDTAVYYCASSSGW YYFDYWGQGTLVTVSS<br><br>SEQ ID NO: 31918 |
| iPS:441482 | 21-225_25A4.001.003 | NA | CAGGTGCTCCTGGTGCAGTCTGGGGCTGAGGTGA AGAGGCCTGGGGCCTCAGTGAAGGTCAGCTGCA AGGCTTCTGGATACACCTTCACCAATTATGATAT TAATTGGGTGCGACAGGCCACTGGACAAGGGCT TGAGTGGATGGATTGGATGTACCTAACAGTGGT AACGTAGGCTATGCACAGAAATTCCAGGGCAGA GTCACCATGACCAGGGACACCTCCATCAGCACA GCCTACATGGAGCTGAGCAGCCTGAGATCTGAG GACACGGCCGTCTATTACTGTGCGAGTAGCAGTG GCTGTGTACTACTTTGACTACTGGGGCCAGGGAAC CCTGGTCACCGTGTCCTCA<br><br>SEQ ID NO: 31919 |

Partial earlier row (iPS:441475 light chain):

| | | | |
|---|---|---|---|
| | | NA | GACATCGTGATGACCCAGTTTCCAGACTCCCT GGCTGTGTCTCTGGGCGAGAGGGCCACCATCA AGTGTAAGTCCAGCCAGAGTGTTTTATACAGC TCCCACAATAACAACTACTTAGCTTGGTACCA GCAGAAACCAGGACAGCCTCCTAAGTTGCTCC TTTACTGGGCATCTACCCGGGAATCCGGGGTC CCTGACCGATTCAGTGGCAGCGGGTCTGGGAC AGAATTCACTCTCACCATCAGCAGCCTGGAGG CTGAAGATGTGGCAGTTTATTATTGTCAGCAG TATTATAGTACTCCTCCGACGTTCGGCCAAGG GACCAAGGTGGAAATCAAA<br><br>SEQ ID NO: 27911 |
| | | AA | DIVMTQFPDSLAVSLGERATIKCKSSQSVLYSSH NNNYLAWYQQKPGQPPKLLLYWASTRESGVPD RFSGSGSGTEFTLTISSLEAEDVAVYYCQQYYST PPTFGQGTKVEIK<br><br>SEQ ID NO: 27912 |
| | | NA | GACATCGTGATGACCCAGTTTCCAGACTCCCT GGCTGTGTCTCTGGGCGAGAGGGCCACCATCA AGTGTAAGTCCAGCCAGAGTGTTTTATACAGC TCCCACAATAACAACTACTTAGCTTGGTACCA GCAGAAACCAGGACAGCCTCCTAAGTTGCTCC TTTACTGGGCATCTACCCGGGAATCCGGGGTC CCTGACCGATTCAGTGGCAGCGGGTCTGGGAC AGAATTCACTCTCACCATCAGCAGCCTGGAGG CTGAAGATGTGGCAGTTTATTATTGTCAGCAG TATTATAGTACTCCTCCGACGTTCGGCCAAGG GACCAAGGTGGAAATCAAA<br><br>SEQ ID NO: 27913 |

FIGURE 50
(Continued)

| | | | | |
|---|---|---|---|---|
| | | AA | DIVMTQFPDSLAVSLGERATIKCKSSQSVLYSSH NNNYLAWYQQKPGQPPKLLLYWASTRESGVPD RFSGSGSGTEFTLTISSLEAEDVAVYYCQQYYST PPTFGQGTKVEIK<br>SEQ ID NO: 27914 | QVLLVQSGAEVKRPGASVKVSCKASGYTFTNYDIN WVRQATGQGLEWMGWMYPNSGNVGYAQKFQGR VTMTRDTSISTAYMELSSLRSEDTAVYYCASSSGW YYFDYWGQGTLVTVSS<br>SEQ ID NO: 31920 |
| iPS:441489 | 21-225_25A4.001.004 | NA | GACATCGTGATGACCCAGTTTCCAGACTCCCT GGCTGTGTCTCTGGGCGAGAGGGCCACCATCA AGTGTAAGTCCAGCCAGAGTGTTTTATACAGC TCCCACAATAACAACTACTTAGCTTGGTACCA GCAGAAACCAGGACAGCCTCCTAAGTTGCTCC TTTACTGGGCATCTACCCGGAATCCGGGGTC CCTGACCGATTCAGTGGCAGCGGGTCTGGGAC AGAATTCACTCTCACCATCAGCAGCTGTCAGCAG CTGAAGATGTGGCAGTTTATTACTGTCAGCAGT ATTATAGTACTCCTCCGACGTTCGGCCAAGG GACCAAGGTGGAAATCAAA<br>SEQ ID NO: 27915 | CAGGTGCTCCTGGTGCAGTCTGGGGCTGAGGTGA AGAGGCCTGGGGCCTCAGTGAAGGTCAGCTGCA AGGCTTCTGGATACACCTTCACCAATTATGATAT TAATTGGGTGCGACAGGCCACTGGACAAGGCT TGAGTGGATGGGATGGATGTACCTAACAGTGGT CAAACAGGCTATGCACAGAAATTCCAGGGCAGA GTCACCATGACCAGGGACACCTCCATCAGCACA GCCTACATGGAGCTGAGCAGCCTGAGATCTGAG GACACGGCCGTCTATTACTGTGCGAGTAGCAGTG GCTGGTACTACTTTGACTACTGGGGCCAGGGAAC CCTGGTCACCGTGTCCTCA<br>SEQ ID NO: 31921 |
| | | AA | DIVMTQFPDSLAVSLGERATIKCKSSQSVLYSSH NNNYLAWYQQKPGQPPKLLLYWASTRESGVPD RFSGSGSGTEFTLTISSLEAEDVAVYYCQQYYST PPTFGQGTKVEIK<br>SEQ ID NO: 27916 | QVLLVQSGAEVKRPGASVKVSCKASGYTFTNYDIN WVRQATGQGLEWMGWMYPNSGQTGYAQKFQGR VTMTRDTSISTAYMELSSLRSEDTAVYYCASSSGW YYFDYWGQGTLVTVSS<br>SEQ ID NO: 31922 |

FIGURE 50
(Continued)

| | | | |
|---|---|---|---|
| iPS:441496 | 21-225_25A4.001.005 | NA | GACATCGTGATGACCCAGTCTCCAGACTCCCT GGCTGTGTCTCTGGGCGAGAGGGCCACCATCA AGTGTAAGTCCAGCCAGAGTGTTTTATACAGC TCCCACAATAACAACTACTTAGCTTGGTACCA GCAGAAACCAGGACAGCCTCCTAAGTTGCTC TTTACTGGGCATCTACCCGGGAATCCGGGGTC CCTGACCGATTCAGTGGCAGCGGGTCTGGGAC AGAATTCACTCTCACCATCAGCAGCCTGCAGG CTGAAGATGTGGCAGTTTATTACTGTCAGCAG TATTATAGTACTCCTCCGACGTTCGGCCAAGG GACCAAGGTGGAAATCAAA SEQ ID NO: 27917 |
| | | AA | DIVMTQSPDSLAVSLGERATIKCKSSQSVLYSSH NNNYLAWYQQKPGQPPKLLLYWASTRESGVPD RFSGSGSGTEFTLTISSLQAEDVAVYYCQQYYST PPTFGQGTKVEIK SEQ ID NO: 27918 |
| | | NA | CAGGTGCAACTGGTGCAGTCTGGGGCTGAGGTG AAGAGGCCTGGGGCCTCAGTGAAGGTCAGTGC AAGGCTTCTGGATACACCTTCACCAATTATGATA TTAATTGGGTGCGACAGGCCACTGGACAAGGC TTGAGTGGATGGGATGGATGTACAGAAATTCCAGGCAG TAGCACAGGCTATGCACAGAAATTCCAGGGCAG AGTCACCATGACCAGGGACACCTCCATCAGCAC AGCCTACATGGAGCTGAGCAGCTGAGATCTGA GGACACGGCCGTCTATTACTGTGCGAGTAGCAGT GGCTGGTACTACTTTGACTACTGGGGCCAGGGAA CCCTGGTCACCGTGTCCTCA SEQ ID NO: 31923 |
| iPS:441505 | 21-225_25A4.001.006 | AA | QVQLVQSGAEVKRPGASVKVSCKASGYTFTNYDIN WVRQATGQGLEWMGWMYPNSGSTGYAQKFQGR VTMTRDTSISTAYMELSSLRSEDTAVYYCASSSGW YYFDYWGQGTLVTVSS SEQ ID NO: 31924 |
| | | NA | GACATCGTGATGACCCAGTCTCCAGACTCCCT GGCTGTGTCTCTGGGCGAGAGGGCCACCATCA AGTGTAAGTCCAGCCAGAGTGTTTTATACAGC TCCCACAATAACAACTACTTAGCTTGGTACCA GCAGAAACCAGGACAGCCTCCTAAGTTGCTCC TTTACTGGGCATCTACCCGGGAATCCGGGGTC CCTGACCGATTCAGTGGCAGCGGGTCTGGGAC AGAATTCACTCTCACCATCAGCAGCCTGCAGG CTGAAGATGTGGCAGTTTATTACTGTCAGCAG TATTATAGTACTCCTCCGACGTTCGGCCAAGG GACCAAGGTGGAAATCAAA SEQ ID NO: 27919 |
| | | | CAGGTGCAACTGGTGCAGTCTGGGGCTGAGGTG AAGAGGCCTGGGGCCTCAGTGAAGGTCAGTGC AAGGCTTCTGGATACACCTTCACCAATTATGATA TTAATTGGGTGCGACAGGCCACTGGACAAGGC TTGAGTGGATGGGATGGATGTACAGAAATTCCAGGCAG TAACGCAGGCTATGCACCAGGGACACCTCCATCAGCAC AGCCTACATGGAGCTGAGCAGCTGAGATCTGA GGACACGGCCGTCTATTACTGTGCGAGTAGCAGT GGCTGGTACTACTTTGACTACTGGGGCCAGGGAA CCCTGGTCACCGTGTCCTCA SEQ ID NO: 31925 |

FIGURE 50
(Continued)

| | | | | |
|---|---|---|---|---|
| | | AA | DIVMTQSPDSLAVSLGERATIKCKSSQSVLYSSH NNNYLAWYQQKPGQPPKLLLYWASTRESGVPD RFSGSGSGTEFTLTISSLQAEDVAVYYCQQYYST PPTFGQGTKVEIK | QVQLVQSGAEVKRPGASVKVSCKASGYTFTNYDIN WVRQATGQGLEWMGWMYPNSGNAGYAQKFQGR VTMTRDTSISTAYMELSSLRSEDTAVYYCASSSGW YYFDYWGQGTLVTVSS |
| | | | SEQ ID NO: 27920 | SEQ ID NO: 31926 |
| iPS:441512 | 21-225_25A4.001.007 | NA | GACATCGTGATGACCCAGTCTCCAGACTCCCT GGCTGTGTCTCTGGGCGAGAGGGCCACCATCA AGTGTAAGTCCAGCCAGAGTGTTTTATACAGC TCCCACAACAATAACTACTTAGCTTGGTACCA GCAGAAACCAGGACAGCCTCCTAAGTTGCTCC TTTACTGGGCATCTACCCGGGAATCCGGGTC CCTGACCGATTCAGTGGCAGCGGGTCTGGGAC AGAATTCACTCTCACCATCAGCAGCCTGCAGG CTGAAGATGTGGCAGTTATTACTGTCAGCAG TATTATAGTACTCCTCCGACGTTCGGCCAAGG GACCAAGGTGGAAATCAAA | CAGGTGCAACTGGTGCAGTCTGGGCTGAGGTG AAGAGGCCTGGGGCCTCAGTGAAGGTCAGCTGC AAGGCTTCTGGATACACCTTCACCAATTATGATA TTAATTGGGTGCGACAGGCCACTGGACAAGGC TTGAGTGGATGGGATGGATGTACCTAACAGTGG TAACGTAGGCTATGCACAGAAATTCCAGGCAG AGTCACCATGACCAGGACACTCCATCAGCAC AGCCTACATGGAGCTGAGCAGCCTGAGATCTGA GGACACGGCCGTCTATTACTGTGCGAGTAGCAGT GGCTGGTACTACTTTGACTACTGGGGCCAGGGAA CCCTGGTCACCGTGTCCTCA |
| | | | SEQ ID NO: 27921 | SEQ ID NO: 31927 |
| | | AA | DIVMTQSPDSLAVSLGERATIKCKSSQSVLYSSH NNNYLAWYQQKPGQPPKLLLYWASTRESGVPD RFSGSGSGTEFTLTISSLQAEDVAVYYCQQYYST PPTFGQGTKVEIK | QVQLVQSGAEVKRPGASVKVSCKASGYTFTNYDIN WVRQATGQGLEWMGWMYPNSGNVGYAQKFQGR VTMTRDTSISTAYMELSSLRSEDTAVYYCASSSGW YYFDYWGQGTLVTVSS |
| | | | SEQ ID NO: 27922 | SEQ ID NO: 31928 |

FIGURE 50
(Continued)

| | | | |
|---|---|---|---|
| iPS:441519 | 21-225_25A4.001.008 | NA | GACATCGTGATGACCCAGTCTCCAGACTCCCT GGCTGTGTCTCTGGGCGAGAGGGCCACCATCA AGTGTAAGTCCAGCCAGAGTGTTTTATACAGC TCCCACAATAAACAACTACTTAGCTTGGTACCA GCAGAAACCAGGACAGCCTCCTAAGTTGCTCC TTTACTGGGCATCTACCCGGGAATCCGGGGTC CCTGACCGATTCAGTGGCAGCGGGTCTGGGAC AGAATTCACTCTCACCATCAGCAGCCTGCAGG CTGAAGATGTGGCAGTTTATTACTGTCAGCAG TATTATAGTACTCCTCGACGTTCGGCCAAGG GACCAAGGTGGAAATCAAA<br>SEQ ID NO: 27923<br>DIVMTQSPDSLAVSLGERATIKCKSSQSVLYSSH NNNYLAWYQQKPGQPPKLLLYWASTRESGVPD RFSGSGSGTEFTLTISSLQAEDVAVYYCQQYYST PPTFGQGTKVEIK<br>SEQ ID NO: 27924 | CAGGTGCAACTGGTGCAGTCTGGGGCTGAGGTG AAGAGGCCTGGGGCCTCAGTGAAGGTCAGTGC AAGGCTTCTGGATACACCTTCACCAATTATGATA TTAATTGGGTGCGACAGGCCACTGGACAAGGGC TTGAGTGGATGGGATGGATGTACCTAACAGTGG TCAAACAGGCTATGCACAGAAATTCCAGGCAG AGTCACCATGACCAGGGACACCTCCATCAGCAC AGCCTACATGGAGCTGAGCAGCCTGAGATCTGA GGACACGGCCGTCTATTACTGTGCGAGTAGCAGT GGCTGGTACTACTTTGACTACTGGGGCCAGGGAA CCCTGGTCACCGTGTCCTCA<br>SEQ ID NO: 31929 |
| | | AA | | QVQLVQSGAEVKRPGASVKVSCKASGYTFTNYDIN WVRQATGQGLEWMGWMYPNSGQTGYAQKFQGR VTMTRDTSISTAYMELSSLRSEDTAVYYCASSSGW YYFDYWGQGTLVTVSS<br>SEQ ID NO: 31930 |
| iPS:441554 | 21-225_25A4.001.013 | NA | GACATCGTGATGACCCAGTTCCAGACTCCCT GGCTGTGTCTCTGGGCGAGAGGGCCACCATCA AGTGTAAGTCCAGCCAGAGTGTTTTATACAGC TCCCACAATAAACAACTACTTAGCTTGGTACCA GCAGAAACCAGGACAGCCTCCTAAGTTGCTCC TTTACTGGGCATCTACCCGGGAATCCGGGGTC CCTGACCGATTCAGTGGCAGCGGGTCTGGGAC AGAATTCACTCTCACCATCAGCAGCCTGCAGG CTGAAGATGTGGCAGTTTATTACTGTCAGCAG TATTATAGTACTCCTCGACGTTCGGCCAAGG GACCAAGGTGGAAATCAAA<br>SEQ ID NO: 27925 | CAGGTGCTCCTGGTGCAGTCTGGGGCTGAGGTGA AGAGGCCTGGGGCCTCAGTGAAGGTCAGTGCA AGGCTTCTGGATACACCTTCACCAATTATGATAT TAATTGGGTGCGACAGGCCACTGGACAAGGCT TGAGTGGATGGGATGGATGTACCTAACAGTGGT AGCACAGGCTATGCACAGAAATTCCAGGCAGA GTCACCATGACCAGGGACACCTCCATCAGCACA GCCTACATGGAGCTGAGCAGCCTGAGATCTGAG GACACGGCCGTCTATTACTGTGCGAGTAGCAGTG GCTGGTACTACTTTGACTACTGGGGCCAGGGAAC CCTGGTCACCGTGTCCTCA<br>SEQ ID NO: 31931 |

FIGURE 50
(Continued)

| | | | |
|---|---|---|---|
| iPS:441595 | 21-225_25.A4.001.019 | AA | DIVMTQFPDSLAVSLGERATIKCKSSQSVLYSSH NNNYLAWYQQKPGQPPKLLLYWASTRESGVPD RFSGSGSGTEFTLTISSLQAEDVAVYYCQQYYST PPTFGQGTKVEIK<br>SEQ ID NO: 27926 | QVLLVQSGAEVKRPGASVKVSCKASGYTFTNYDIN WVRQATGQGLEWMGWMYPNSGSTGYAQKFQGR VTMTRDTSISTAYMELSSLRSEDTAVYYCASSSGW YYFDYWGQGTLVTVSS<br>SEQ ID NO: 31932 |
| | | NA | GACATCGTGATGACCCAGTTCCCAGACTCCCT GGCTGTGTCTCTGGGCGAGAGGGCCACCATCA ACTGTAAGTCCAGCCAGAGTGTTTTATACAGC TCCCACAATAAACAACTACTTAGCTTGGTACCA GCAGAAACCAGGACAGCCTCCTAAGTTGCTCC TTTACTGGGCATCTACCCGGGAATCCGGGGTC CCTGACCGATTCAGTGGCAGCGGGTCTGGGAC AGAATTCACTCTCACCATCAGCAGCCTGCAGG CTGAAGATGTGGCAGTTTATTACTGTCAGCAG TATTATAGTACTCCTCCGACGTTCGGCCAAGG GACCAAGGTGGAAATCAAA<br>SEQ ID NO: 27927 | CAGGTGCAACTGGTGCAGTCTGGGGCTGAGGTG AAGAGGCCTGGGGCCTCAGTGAAGGTCAGCTGC AAGGCTTCTGGATACACCTTCACCAATTATGATA TTAATTGGGTGCGACAGGCCCCTGGACAAGGCT TGAGTGGATGGGATGGATGTACACAGAAATTCCAGGCAGA AGCACCATGACCAGGGACACCTCCATCAGCACA GTCACACATGGCCTACATGGAGCTGAGCAGCTCTGAGATCTGAG GACACGGCCGTCTATTACTGTGCGAGTAGCAGTG GCTGGTACTACTTTGACTACTGGGGCCAGGGAAC CCTGGTCACCGTGTCCTCA<br>SEQ ID NO: 31933 |
| | | AA | DIVMTQSPDSLAVSLGERATINCKSSQSVLYSSH NNNYLAWYQQKPGQPPKLLLYWASTRESGVPD RFSGSGSGTEFTLTISSLEAEDVAVYYCQQYYST PPTFGQGTKVEIK<br>SEQ ID NO: 27928 | QVQLVQSGAEVKRPGASVKVSCKASGYTFTNYDIN WVRQAPGQGLEWMGWMYPNSGSTGYAQKFQGR VTMTRDTSISTAYMELSSLRSEDTAVYYCASSSGW YYFDYWGQGTLVTVSS<br>SEQ ID NO: 31934 |

FIGURE 50
(Continued)

| | | | |
|---|---|---|---|
| iPS:441604 | 21-225_25A4.001.020 | NA | GACATCGTGATGACCCAGTCTCCAGACTCCCT GGCTGTGTCTCTGGGCGAGAGGGCCACCATCA ACTGTAAGTCCAGCCAGAGTGTTTTATACAGC TCCCACAATAACAACTACTTAGCTTGGTACCA GCAGAAACCAGGACAGCCTCCTAAGTTGCTC TTTACTGGGCATCTACCCGGGAATCCGGGGTC CCTGACCGATTCAGTGGCAGCGGGTCTGGGAC AGAATTCACTCTCACCATCAGCAGCCTGCAGG CTGAAGATGTGGCAGTTTATTACTGTCAGCAG TATTATAGTACTCCTCCGACGTTCGGCCAAGG GACCAAGGTGAAATCAAA | CAGGTGTCTCCTGGTGCAGTCTGGGCTGAGGTGA AGAGGCCTGGGGCCTCAGTGAAGGTCAGCTGCA AGGCTTCTGGATACACCTTCACCAATTATGATAT TAATTGGGTGCGACAGGCCCCTGGACAAGGGCTT GAGTGGATGGGATGGATGTACCTAACAGTGGTC AAACAGGCTATGCACAGGAAATTCCAGGCAGAG TCACCATGACCAGGGACACCTCCATCAGCACAGC CTACATGGAGCTGAGCAGCCTGAGATCTGAGGA CACGGCCGTCTATTACTGTGCGAGTAGCAGTGGC TGGTACTACTTTGACTACTGGGGCCAGGGAACCC TGGTCACCGTGTCCTCA |
| | | | SEQ ID NO: 27929 | SEQ ID NO: 31935 |
| | | AA | DIVMTQSPDSLAVSLGERATINCKSSQSVLYSSH NNNYLAWYQQKPGQPPKLLLYWASTRESGVPD RFSGSGSGTEFTLTISSLQAEDVAVYYCQQYYST PPTFGQGTKVEIK | QVLLVQSGAEVKRPGASVKVSCKASGYTFTNYDIN WVRQAPGQGLEWMGWMYPNSGQTGYAQKFQGR VTMTRDTSISTAYMELSSLRSEDTAVYYCASSSGW YYFDYWGQGTLVTVSS |
| | | | SEQ ID NO: 27930 | SEQ ID NO: 31936 |
| iPS:441613 | 21-225_25A4.001.021 | NA | GACATCGTGATGACCCAGTCTCCAGACTCCCT GGCTGTGTCTCTGGGCGAGAGGGCCACCATCA ACTGTAAGTCCAGCCAGAGTGTTTTATACAGC TCCCACAATAACAACTACTTAGCTTGGTACCA GCAGAAACCAGGACAGCCTCCTAAGTTGCTC TTTACTGGGCATCTACCCGGGAATCCGGGGTC CCTGACCGATTCAGTGGCAGCGGGTCTGGGAC AGAATTCACTCTCACCATCAGCAGCCTGCAGG CTGAAGATGTGGCAGTTTATTACTGTCAGCAG TATTATAGTACTCCTCCGACGTTCGGCCAAGG GACCAAGGTGAAATCAAA | CAGGTGCAACTGGTGCAGTCTGGGCTGAGGTG AAGAGGCCTGGGGCCTCAGTGAAGGTCAGCTGC AAGGCTTCTGGATACACCTTCACCAATTATGATA TTAATTGGGTGCGACAGGCCACTGGACAAGGGC TTGAGTGGATGGGATGGATGTACCCTAACAGTGG TAACGCAGGCTATGCACAGGAAATTCCAGGCAG AGTCACCATGACCAGGGACACCTCCATCAGCAC AGCCTACATGGAGCTGAGCAGCCTGAGATCTGA GGACACGGCCGTCTATTACTGTGCGAGTAGCAGT GGCTGGTACTACTTTGACTACTGGGGCCAGGGAA CCCTGGTCACCGTGTCCTCA |
| | | | SEQ ID NO: 27931 | SEQ ID NO: 31937 |

FIGURE 50
(Continued)

| | | AA | DIVMTQSPDSLAVSLGERATINCKSSQSVLYSSH<br>NNNYLAWYQQKPGQPPKLLLYWASTRESGVPD<br>RFSGSGSGTEFTLTISSLQAEDVAVYYCQQYYST<br>PPTFGQGTKVEIK<br>SEQ ID NO: 27932 | QVQLVQSGAEVKRPGASVKVSCKASGYTFTNYDIN<br>WVRQATGQGLEWMGWMYPNSGNAGYAQKFQGR<br>VTMTRDTSISTAYMELSSLRSEDTAVYYCASSSGW<br>YYFDYWGQGTLVTVSS<br>SEQ ID NO: 31938 |
| iPS:441841 | 21-225_4A2.001.001 | NA | GACATCGTGATGACCCAGTCTCCAGACTCCCT<br>GGCTGTGTCTCTGGGCGAGAGGGCCACCATCA<br>ACTGCAAGTCCAGCCAGAGTGTATTTACACAGC<br>TCCAACAATAACAACTACTTAGCTTGGTTCCA<br>GCAGAAACCAGGACAGCCTCCTAAACTGCTCC<br>TTTACTGGGCATCTACCCGGGAATCCGGGGTC<br>CCTGACCGATTCAGTGGCAGCGGGTCTGGGAC<br>AGATTTCACTCTCACCATCAGCAGCCTGCAGC<br>CTGAAGATGTGGCAGTTATTACTGTCAGCAA<br>TATTATAGTACTCCAGTCACTTTCGGCCCTGGG<br>ACCAAAGTGGGTATCAAA<br>SEQ ID NO: 27933 | CAGGTGCAGCTGGTGCAGTCTGGGACTGAGGTG<br>AAGAAGCCTGGGGCCTCAGTGAAGGTGTCCTGC<br>AAGGCTTCTGGATACACCTTCACCAATTATGATA<br>TCAACTGGGTGCGACAGGCCACTGGACAAGGGC<br>TTGAGTGGATGGGATGGATGCACCTAACAGTGG<br>TAACACAGGCTATGCACAGAAGTTCCAGGGCAG<br>AGTCACCTTGACCAGGGACACCTCCATCAGCACA<br>GCCTACATGGAACTGAGCAGCCTGAGATCTGAG<br>GACACGGCCGTGTATTACTGTGCGAGTAGCAGTG<br>GCTGGTACTACTTTGACTACTGGGGCCAGGGAAC<br>CCTGGTCACCGTGTCCTCA<br>SEQ ID NO: 31939 |
| | | AA | DIVMTQSPDSLAVSLGERATINCKSSQSILHSSNN<br>NNYLAWFQQKPGQPPKLLLYWASTRESGVPDR<br>FSGSGSGTDFTLTISSLQPEDVAVYYCQQYYSTP<br>VTFGPGTKVGIK<br>SEQ ID NO: 27934 | QVQLVQSGTEVKKPGASVKVSCKASGYTFTNYDIN<br>WVRQATGQGLEWMGWMHPNSGNTGYAQKFQGR<br>VTLTRDTSISTAYMELSSLRSEDTAVYYCASSSGWY<br>YFDYWGQGTLVTVSS<br>SEQ ID NO: 31940 |

FIGURE 50
(Continued)

| | | | | |
|---|---|---|---|---|
| iPS:441847 | 21-225_4A2.001.002 | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAATGCTCCAGTCACTTTCGGCCCTGGG ACCAAAGTGGGTATCAAA SEQ ID NO: 27935 | CAGGTGCAGCTGGTGCAGTCTGGGACTGAGGTG AAGAAGCCTGGGCCTCAGTGAAGGTGTCCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TAACACAGGCTATGCACAGAAGTTCCAGGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA SEQ ID NO: 31941 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYNAP VTFGPGTKVGIK SEQ ID NO: 27936 | QVQLVQSGTEVKKPGASVKVSCKASGYTFTNYDIN WVRQATGQGLEWMGWMHPNSGNTGYAQKFQGR VTLTRDTSISTAYMELSSLRSEDTAVYYCASSSGWY YFDYWGQGTLVTVSS SEQ ID NO: 31942 |
| iPS:441853 | 21-225_4A2.001.003 | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATCAAACTCCAGTCACTTTCGGCCCTGG GACCAAAGTGGGTATCAAA SEQ ID NO: 27937 | CAGGTGCAGCTGGTGCAGTCTGGGACTGAGGTG AAGAAGCCTGGGCCTCAGTGAAGGTGTCCTGC AAGGCTTCTGGATACACCTTCACCAATTATGATA TCAACTGGGTGCGACAGGCCACTGGACAAGGGC TTGAGTGGATGGGATGGATGCACAGAAGTTCCAGGGCAG TAACACAGGCTATGCACAGAAGTTCCAGGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA SEQ ID NO: 31943 |

FIGURE 50
(Continued)

| | | | |
|---|---|---|---|
| iPS:441859 | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYQTP VTFGPGTKVGIK<br>SEQ ID NO: 27938 | QVQLVQLVQSGTEVKKPGASVKVSCKASGYTFTNYDIN WVRQATGQGLEWMGWMHPNSGNTGYAQKFQGR VTLTRDTSISTAYMELSSLRSEDTAVYYCASSSGWY YFDYWGQGTLVTVSS<br>SEQ ID NO: 31944 |
| | 21-225_4A2.001.004 | NA | GACATCGTGATGACCCAGTCTCCAGACTCCCT GGCTGTGTCTCTGGGCGAGAGGGCCACCATCA ACTGCAAGTCCAGCCAGAGTATTTACACAGC TCCAACAATAACAACTACTTAGCTTGGTTCCA GCAGAAACCAGGACAGCCTCCTAAACTGCTCC TTTACTGGGCATCTACCCGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAATACTCCAGTCACTTTCGGCCCTGGG ACCAAAGTGGGTATCAAA<br>SEQ ID NO: 27939 | CAGGTGCAGCTGGTGCAGTCTGGGACTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TAACGCAGGCTATGCACAGAAGTTCCAGGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br>SEQ ID NO: 31945 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYNTP VTFGPGTKVGIK<br>SEQ ID NO: 27940 | QVQLVQLVQSGTEVKKPGASVKVSCKASGYTFTNYDIN WVRQATGQGLEWMGWMHPNSGNAGYAQKFQGR VTLTRDTSISTAYMELSSLRSEDTAVYYCASSSGWY YFDYWGQGTLVTVSS<br>SEQ ID NO: 31946 |

FIGURE 50
(Continued)

| | | | |
|---|---|---|---|
| iPS:441866 | 21-225_4A2.001.005 | NA | GACATCGTGATGACCCAGTCTCCAGACTCCCT GGCTGTGTCTCTGGGCGAGAGGGCCACCATCA ACTGCAAGTCCAGCCAGAGTATTTACACAGC TCCAACAATAACAACTACTTAGCTTGGTTCCA GCAGAAACCAGGACAGCCTCCTAAACTGCTCC TTTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAATACTCCAGTCACTTTCGGCCCTGGG ACCAAAGTGGGTATCAAA SEQ ID NO: 27941 | CAGGTGCAGCTGGTGCAGTCTGGGACTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGCACCCTAACAGTGG TAGCACAGGCTATGCACAGAAGTTCAGGGCAG AGTCACCTTGACCAGGGACACCTCCATCAGCACA GCCTACATGGAACTGAGCAGCCTGAGATCGAG GACACGGCCGTGTATTACTGTGCGAGTAGCAGTG GCTGGTACTACTTTGACTACTGGGGCCAGGGAAC CCTGGTCACCGTGTCCTCA SEQ ID NO: 31947 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYNTP VTFGPGTKVGIK SEQ ID NO: 27942 | QVQLVQSGTEVKKPGASVKVSCKASGYTFTNYDIN WVRQATGQGLEWMGWMHPNSGSTGYAQKFQGR VTLTRDTSISTAYMELSSLRSEDTAVYYCASSSGWY YFDYWGQGTLVTVSS SEQ ID NO: 31948 |
| iPS:441873 | 21-225_4A2.001.006 | NA | GACATCGTGATGACCCAGTCTCCAGACTCCCT GGCTGTGTCTCTGGGCGAGAGGGCCACCATCA ACTGCAAGTCCAGCCAGAGTATTTACACAGC TCCAACAATAACAACTACTTAGCTTGGTTCCA GCAGAAACCAGGACAGCCTCCTAAACTGCTCC TTTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAATACTCCAGTCACTTTCGGCCCTGGG ACCAAAGTGGGTATCAAA SEQ ID NO: 27943 | CAGGTGCAGCTGGTGCAGTCTGGGACTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGCACCCTAACAGTGG TCAAACAGGCTATGCACAGAAGTTCAGGGCAG AGTCACCTTGACCAGGGACACCTCCATCAGCACA GCCTACATGGAACTGAGCAGCCTGAGATCGAG GACACGGCCGTGTATTACTGTGCGAGTAGCAGTG GCTGGTACTACTTTGACTACTGGGGCCAGGGAAC CCTGGTCACCGTGTCCTCA SEQ ID NO: 31949 |

FIGURE 50
(Continued)

| | | | | |
|---|---|---|---|---|
| iPS:441880 | 21-225_4A2.001.007 | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYNTP VTFGPGTKVGIK<br><br>SEQ ID NO: 27944 | QVQLVQSGTEVKKPGASVKVSCKASGYTFTNYDIN WVRQATGQGLEWMGWMHPNSGQTGYAQKFQGR VTLTRDTSISTAYMELSSLRSEDTAVYYCASSSGWY YFDYWGQGTLVTVSS<br><br>SEQ ID NO: 31950 |
| | | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAACTACTTAGCTTGGTTCCA GCAGAAACCAGGACAGCCTCCTAAACTGCTCC TTTACTGGGCATCTACCCGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAGTACTCCAGTCACTTTCGGCCCTGGG ACCAAAGTGGGTATCAAA | CAGGTGCAGCTGGTGCAGTCTGGGACTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TCAAACAGGCTATGCACAGAAGTTCCAGGGCAG AGTCACCTTGACCAGGGACACCTCCATCAGCACA GCCTACATGGAACTGAGCAGCCTGAGATCTGAG GACACGGCCGTGTACTTTGACTACTGGGGCCAGTG GCTGGTACTACTTTGACTACTGGGGCCAGGGAAC CCTGGTCACCGTGTCCTCA |
| | | | | SEQ ID NO: 31951 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYSTP VTFGPGTKVGIK<br><br>SEQ ID NO: 27946 | QVQLVQSGTEVKKPGASVKVSCKASGYTFTNYDIN WVRQATGQGLEWMGWMHPNSGQTGYAQKFQGR VTLTRDTSISTAYMELSSLRSEDTAVYYCASSSGWY YFDYWGQGTLVTVSS<br><br>SEQ ID NO: 31952 |

FIGURE 50
(Continued)

| | | | | |
|---|---|---|---|---|
| iPS:441884 | 21-225_4A2.001.008 | NA | GACATCGTGATGACCCAGTCTCCAGACTCCCT GGCTGTGTCTCTGGGCGAGAGGGCCACCATCA ACTGCAAGTCCAGCAGTATTTTACACAGC TCCAACAATAACAAGGAACTACTTAGCTTGGTTCCA GCAGAAACCAGGACAGCCTCCTAAACTGCTCC TTTACTGGGCATCTACCCGGAATCCGGGGTC CCTGACCGATTCAGTGGCAGCGGGTCTGGGAC AGATTTCACTCTCACCATCAGCAGCCTGCAG CTGAAGATGTGGCAGTTTATTACTGTCAGCAA TATTATAGTACTCCAGTCACTTTCGGCCCTGGG ACCAAAGTGGGTATCAAA<br><br>SEQ ID NO: 27947 | CAGGTGCAGCTGGTGCAGTCTGGGACTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACGCAGGCTATGCACAGAAGTTCCAGGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br><br>SEQ ID NO: 31953 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYSTP VTFGPGTKVGIK<br><br>SEQ ID NO: 27948 | QVQLVQSGTEVKKPGASVKVSCKASGYTFTNYDIN WVRQATGQGLEWMGWMHPNSGNAGYAQKFQGR VTLTRDTSISTAYMELSSLRSEDTAVYYCASSSGWY YFDYWGQGTLVTVSS<br><br>SEQ ID NO: 31954 |
| iPS:441888 | 21-225_4A2.001.009 | NA | GACATCGTGATGACCCAGTCTCCAGACTCCCT GGCTGTGTCTCTGGGCGAGAGGGCCACCATCA ACTGCAAGTCCAGCAGTATTTTACACAGC TCCAACAATAACAAGGAACTACTTAGCTTGGTTCCA GCAGAAACCAGGACAGCCTCCTAAACTGCTCC TTTACTGGGCATCTACCCGGAATCCGGGGTC CCTGACCGATTCAGTGGCAGCGGGTCTGGGAC AGATTTCACTCTCACCATCAGCAGCCTGCAG CTGAAGATGTGGCAGTTTATTACTGTCAGCAA TATTATAATGCTCCAGTCACTTTCGGCCCTGGG ACCAAAGTGGGTATCAAA<br><br>SEQ ID NO: 27949 | CAGGTGCAGCTGGTGCAGTCTGGGACTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAAACAGGCTATGCACAGGAGTTCCAGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br><br>SEQ ID NO: 31955 |

FIGURE 50
(Continued)

| | | | | |
|---|---|---|---|---|
| iPS:441892 | 21-225_4A2.001.010 | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYNAP VTFGPGTKVGIK<br>SEQ ID NO: 27950 | QVQLVQSGTEVKKPGASVKVSCKASGYTFTNYDIN WVRQATGQGLEWMGWMHPNSGQTGYAQKFQGR VTLTRDTSISTAYMELSSLRSEDTAVYYCASSSGWY YFDYWGQGTLVTVSS<br>SEQ ID NO: 31956 |
| | | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAACTACTTAGCTTGGTTCCA GCAGAAACCAGGACAGCCTCCTAAACTGCTCC TTTTACTGGGCATCTACCCGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATCAAACTCCAGTCACTTTCGGCCCTGG GACCAAAGTGGGTATCAAA<br>SEQ ID NO: 27951 | CAGGTGCAGCTGGTGCAGTCTGGGACTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TAACGCAGGCTATGCACAGAAGTTCCAGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br>SEQ ID NO: 31957 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYQTP VTFGPGTKVGIK<br>SEQ ID NO: 27952 | QVQLVQSGTEVKKPGASVKVSCKASGYTFTNYDIN WVRQATGQGLEWMGWMHPNSGNAGYAQKFQGR VTLTRDTSISTAYMELSSLRSEDTAVYYCASSSGWY YFDYWGQGTLVTVSS<br>SEQ ID NO: 31958 |

FIGURE 50
(Continued)

| | | | |
|---|---|---|---|
| iPS:441896 | 21-225_4A2.001.011 | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAAGAAACTGTTCCA GCAGAAACCAGGACAGCCTCCTAAACTGCTCC TTTACTGGGCATCTAGCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATCAAACTCCAGTCACTTTCGGCCCTGG GACCAAAGTGGGTATCAAA<br><br>SEQ ID NO: 27953 | CAGGTGCAGCTGGTGCAGTCTGGGACTGAGGTG AAGAAGCCTGGGCCTCAGTGAAGGTGTCCTGC AAGGCTTCTGGATACACCTTCACCAATTATGATA TCAACTGGGTGCGACAGCCACTGGACAAGGGC TTGAGTGGATGGGATGGATGCACCTAACAGTGG TCAAACAGGCTATGCACAGAAGTTCCAGGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br><br>SEQ ID NO: 31959 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYQTP VTFGPGTKVGIK<br><br>SEQ ID NO: 27954 | QVQLVQSGTEVKKPGASVKVSCKASGYTFTNYDIN WVRQATGQGLEWMGWMHPNSGQTGYAQKFQGR VTLTRDTSISTAYMELSSLRSEDTAVYYCASSSGWY YFDYWGQGTLVTVSS<br><br>SEQ ID NO: 31960 |
| iPS:441900 | 21-225_4A2.001.012 | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAAGAAACTGTTCCA GCAGAAACCAGGACAGCCTCCTAAACTGCTCC TTTACTGGGCATCTAGCCGGGAATCCGGGGTC CCTGACCGATTCAGTGGCAGCGGGTCTGGGAC AGATTTCACTCTCACCATCAGCAGCCTGTCAGCAA CTGAAGATGTGGCAGTTTATTACTGTCAGCAA TATTATCAAACTCCAGTCACTTTCGGCCCTGG GACCAAAGTGGGTATCAAA<br><br>SEQ ID NO: 27955 | CAGGTGCAGCTGGTGCAGTCTGGGACTGAGGTG AAGAAGCCTGGGCCTCAGTGAAGGTGTCCTGC AAGGCTTCTGGATACACCTTCACCAATTATGATA TCAACTGGGTGCGACAGCCACTGGACAAGGGC TTGAGTGGATGGGATGGATGCACCTAACAGTGG TAGCACAGGCTATGCACAGAAGTTCCAGGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br><br>SEQ ID NO: 31961 |

FIGURE 50
(Continued)

| | | | |
|---|---|---|---|
| iPS:441955 | 21-225_4A2.001.022 | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYQTP VTFGPGTKVGIK<br>SEQ ID NO: 27956 | QVQLVQSGTEVKKPGASVKVSCKASGYTFTNYDIN WVRQATGQGLEWMGWMHPNSGSTGYAQKFQGR VTLTRDTSISTAYMELSSLRSEDTAVYYCASSSGWY YFDYWGQGTLVTVSS<br>SEQ ID NO: 31962 |
| | | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAACTACTTAGCTTGGTTCCA GCAGAAACCAGGACAGCCTCCTAAACTGCTCC TTTACTGGGCATCTACCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAGTACTCCAGTCACTTTCGGCCCTGGG ACCAAAGTGGGTATCAAA<br>SEQ ID NO: 27957 | CAGGTGCAGCTGGTGCAGTCTGGGGCTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGCAG AGTCACCTTGACCAGGGACACTCCATCAGACA GCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br>SEQ ID NO: 31963 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYSTP VTFGPGTKVGIK<br>SEQ ID NO: 27958 | QVQLVQSGAEVKKPGASVKVSCKASGYTFTNYDIN WVRQATGQGLEWMGWMHPNSGNTGYAQKFQGR VTLTRDTSISTAYMELSSLRSEDTAVYYCASSSGWY YFDYWGQGTLVTVSS<br>SEQ ID NO: 31964 |

FIGURE 50
(Continued)

| | | | |
|---|---|---|---|
| iPS:441962 | 21-225_4A2.001.023 | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGTCACCTTGACCAGGACACCTCCATCAGCACA CTGAAGATGTGGCAGTTTATTACTGTCAGCAA TATTATAGTACTCCAGTCACTTTCGGCCAAGG GACCAAAGTGGAAATCAAA<br><br>SEQ ID NO: 27959 | CAGGTGCAGCTGGTGCAGTCTGGGGCTGAGGTG AAGAAGCCTGGGGCCTCAGTGAAGGTGTCCTGC AAGGCTTCTGGATACACCTTCACCAATTATGATA TCAACTGGGTGCGACAGGCCCCTGGACAAGGGC TTGAGTGGATGGGATGGATGCACAGAAGTTCAGGGCAG TAACACAGGCTATGCACAGAAGTTCCAGGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br><br>SEQ ID NO: 31965 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYSTP VTFGQGTKVEIK<br><br>SEQ ID NO: 27960 | QVQLVQSGAEVKKPGASVKVSCKASGYTFTNYDIN WVRQAPGQGLEWMGWMHPNSGNTGYAQKFQGR VTLTRDTSISTAYMELSSLRSEDTAVYYCASSSGWY YFDYWGQGTLVTVSS<br><br>SEQ ID NO: 31966 |
| iPS:441971 | 21-225_4A2.001.024 | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAGTACTCCAGTCACTTTCGGCCCTGGG ACCAAAGTGGGTATCAAA<br><br>SEQ ID NO: 27961 | CAGGTGCAGCTGGTGCAGTCTGGGGCTGAGGTG AAGAAGCCTGGGGCCTCAGTGAAGGTGTCCTGC AAGGCTTCTGGATACACCTTCACCAATTATGATA TCAACTGGGTGCGACAGGCCCCTGGACAAGGGC TTGAGTGGATGGGATGGATGCACAGAAGTTCAGGGCAG TCAAACAGGCTATGCACAGAAGTTCCAGGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br><br>SEQ ID NO: 31967 |

FIGURE 50
(Continued)

| | | | | |
|---|---|---|---|---|
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYSTP VTFGPGTKVGIK<br><br>SEQ ID NO: 27962 | QVQLVQSGAEVKKPGASVKVSCKASGYTFTNYDIN WVRQATGQGLEWMGWMHPNSGQTGYAQKFQGR VTLTRDTSISTAYMELSSLRSEDTAVYYCASSSGWY YFDYWGQGTLVTVSS<br><br>SEQ ID NO: 31968 |
| iPS:441999 | 21-225_4A2.001.028 | NA | GACATCGTGATGACCCAGTCTCCAGACTCCT GGCTGTGTCTCTGGGCGAGAGGGCCACATCA ACTGCAAGTCCAGCCAGAGTATTTACACAGC TCCAACAATAACAACTACTTAGCTTGGTTCCA GCAGAAACCAGGACAGCCTCCTAAACTGCTCC TTTACTGGGCATCTACCCGGAGAATCCGGGGTC CCTGACCGATTCAGTGGCAGGGGTCTGGGAC AGATTTCACTCTCACCATCAGCAGCCTGCAGC CTGAAGATGTGGCAGTTTATTACTGTCAGCAA TATTATAGTACTCCAGTCACTTTCGGCCAAGG GACCAAAGTGGAAATCAAA<br><br>SEQ ID NO: 27963 | CAGGTGCAGCTGGTGCAGTCTGGGGCTGAGGTG AAGAAGCCTGGGGCCTCAGTGAAGGTGTCCTGC AAGGCTTCTGGATACACCTTCACCAATTATGATA TCAACTGGGTGCGACAGGCCCCTGGACAAGGGC TTGAGTGGATGGGATGGATGCACAGAAGTTCCAGGGCAG TCAAACAGGCTATGCACAGGGACACCTCCATCAGCACA AGTCACTTGACCAGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br><br>SEQ ID NO: 31969 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYSTP VTFGQGTKVEIK<br><br>SEQ ID NO: 27964 | QVQLVQSGAEVKKPGASVKVSCKASGYTFTNYDIN WVRQAPGQGLEWMGWMHPNSGQTGYAQKFQGR VTLTRDTSISTAYMELSSLRSEDTAVYYCASSSGWY YFDYWGQGTLVTVSS<br><br>SEQ ID NO: 31970 |

FIGURE 50
(Continued)

| | | | | |
|---|---|---|---|---|
| iPS:442006 | 21-225_4A2.001.029 | NA | GACATCGTGATGACCCAGTCTCCAGACTCCCTGGCTGTGTCTCTGGGCGAGAGGGCCACCATCAACTGCAAGTCCAGCCAGAGTATTTTACACAGCTCCAACAATAACCAGGACAGCTCCTAGCTTGGTTCAAGCAGAAACCAGGACAGCCTCCTAAACTGCTCCTTTACTGGGCATCTACCCGGAATCCGGGGTCCCTGACCGATTCAGTGGCAGCGGGTCTGGGACAGATTTCACTCTCACCATCAGCAGCCTGCAGCCTGAAGATGTGGCAGTTTATTACTGTCAGCAATATTATAGTACTCCAGTCACTTTCGGCCAAGGGACCAAAGTGGAAATCAAA | CAGGTGCAGCTGGTGCAGTCTGGGGCTGAGGTGAAGAAGCCTGGGGCCTCAGTGAAGGTGTCCTGCAAGGCTTCTGGATACACCTTCACCAATTATGATATCAACTGGGTGCGACAGGCCCCTGGACAAGGGCTTGAGTGGATGGGATGGATGCACCTAACAGTGGTAGCACAGGCTATGCACAGAAGTTCCAGGCAGAGTCACCTTGACCAGGGACACCTCCATCAGCACAGCCTACATGGAACTGAGCAGCCTGAGATCTGAGGACACGGCCGTGTATTACTGTGCGAGTAGCAGTGGCTGGTACTACTTTGACTACTGGGGCCAGGGAACCCTGGTCACCGTGTCCTCA |
| | | | SEQ ID NO: 27965 | SEQ ID NO: 31971 |
| | | AA | DIVMTQSPDSLAVSLGERATINCKSSQSILHSSNNNNYLAWFQQKPGQPPKLLLYWASTRESGVPDRFSGSGSGTDFTLTISSLQPEDVAVYYCQQYYSTPVTFGQGTKVEIK | QVQLVQSGAEVKKPGASVKVSCKASGYTFTNYDINWVRQAPGQGLEWMGWMHPNSGSTGYAQKFQGRVTLTRDTSISTAYMELSSLRSEDTAVYYCASSSGWYYFDYWGQGTLVTVSS |
| | | | SEQ ID NO: 27966 | SEQ ID NO: 31972 |
| iPS:442020 | 21-225_4A2.001.031 | NA | GACATCGTGATGACCCAGTCTCCAGACTCCCTGGCTGTGTCTCTGGGCGAGAGGGCCACCATCAACTGCAAGTCCAGCCAGAGTATTTTACACAGCTCCAACAATAACCAGGACAGCTCCTAGCTTGGTTCAAGCAGAAACCAGGACAGCCTCCTAAACTGCTCCTTTACTGGGCATCTACCCGGAATCCGGGGTCCCTGACCGATTCAGTGGCAGCGGGTCTGGGACAGTCACCTTGACCAGGGACAGTCACCAAGAAGGCTATGCACAGAAGTTCCAGGCAGAGATTTCACTCTCACCATCAGCAGCCTGCAGCCTGAAGATGTGGCAGTTTATTACTGTCAGCAATATTATAATACTCCAGTCACTTTCGGCCCTGGGACCAAAGTGGAAATCAAA | CAGGTGCAGCTGGTGCAGTCTGGGGGTGAGGTGAAGAAGCCTGGGGCCTCAGTGAAGGTGTCCTGCAAGGCTTCTGGATACACCTTCACCAATTATGATATCAACTGGGTGCGACAGGCCGAAGGACAAGGGCTTGAGTGGATGGGATGCACCTAACAGTGGTAACGAAGGCTATGCACCAGGACACCTCCATCAGCACAAGTCACCTTGACCAAGAGCTGAGCAGCCTGAGATCTGAGGACACGGCCGTGTATTACTGTGCGAGTAGCAGTGGCTGGTACTACTTTGACTACTGGGGGCCAGGGAACCCTGGTCACCGTGTCCTCA |
| | | | SEQ ID NO: 27967 | SEQ ID NO: 31973 |

FIGURE 50
(Continued)

| | | | | |
|---|---|---|---|---|
| iPS:442050 | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYNTP VTFGPGTKVEIK<br>SEQ ID NO: 27968 | QVQLVQSGGEVKKPGASVKVSCKASGYTFTNYDIN WVRQAEGQGLEWMGWMHPNSGNEGYAQKFQGR VTLTRDTSISTAYMELSSLRSEDTAVYYCASSSGWY YPDYWGQGTLVTVSS<br>SEQ ID NO: 31974 |
| | | NA | GACATCCAGATGACCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAACCAGGGAAAG CCCCTAAGCTCCTGATCTATGGTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAATTT ATTATTGTCAACAGGCTAACAGTTTCCCATTC ACTTTCGGCCCTGGGACCAAAGTGGATATCAA A<br>SEQ ID NO: 27969 | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCCACCTAACAGTGGT GGCACAAACTATGCACAGAAGTTTCAGGGCAGG GTCACCATGACCAGGGACACAGTCCATCAGCACA GCCTACATGGAGCTGAGCAGTCTGAGATCTGACG ACACGGCCGTGTATTACTGTGCGAGAGATGTAC CAGCTCGTTTGACTACTGGGGCCAGGGAACCCTG GTCACCGTGTCCTCA<br>SEQ ID NO: 31975 |
| | 21-225_4H6.004 | AA | DIQMTQSPSSVSASVGDRVTITCRASQGISRWLA WYQQKPGKAPKLLIYGASSLQSGVPSRFSGSGS GTDFTLTISSLQPEDFAIYYCQQANSFPFTGPGT KVDIK<br>SEQ ID NO: 27970 | QVQLVQSGAEVKKPGASVKVSCKASGYTFTDYYL HWVRQAPGQGLEWMGWIHPNSGGTNYAQKFQGR VTMTRDTSISTAYMELSSLRSDDTAVYYCARDGTS SFDYWGQGTLVTVSS<br>SEQ ID NO: 31976 |

FIGURE 50
(Continued)

| | | | |
|---|---|---|---|
| iPS:442059 | 21-225_4H6.005 | NA | GACATCCAGATGACCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAACCAGGGAAAG CCCCTAAGCTCCTGATCTATGGTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAATTT ATTATTGTCAACAGGCTAACAGTTTCCCATTC ACTTTCGGCCAAGGGACCAAAGTGGATATCAA A<br>SEQ ID NO: 27971 | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCCACAGAAGTTCAGT GGCACAAACTATGCACAGAAGTTCAGGGCAGG GTCACCATGACCAGGGACACGTCCATCAGCACA GCCTACATGGAGCTGAGCAGTCTGAGATCTGACG ACACGGCCGTGTATTACTGTGCGAGAGATGGTAC CAGCTCGTTTGACTACTGGGGCCAGGGAACCCTG GTCACCGTGTCCTCA<br>SEQ ID NO: 31977 |
| | | AA | DIQMTQSPSSVSASVGDRVTITCRASQGISRWLA WYQQKPGKAPKLLIYGASSLQSGVPSRFSGSGS GTDFTLTISSLQPEDFAIYYCQQANSPPFTFGQGT KVDIK<br>SEQ ID NO: 27972 | QVQLVQSGAEVKKPGASVKVSCKASGYTFTDYYL HWVRQAPGQGLEWMGWIHPNSGGTNYAQKFQGR VTMTRDTSISTAYMELSSLRSDDTAVYYCARDGTS SFDYWGQGTLVTVSS<br>SEQ ID NO: 31978 |
| iPS:442065 | 21-225_4H6.006 | NA | GACATCCAGATGACCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAACCAGGGAAAG CCCCTAAGCTCCTGATCTATGGTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ATTATTGTCAACAGGCTAACAGTTTCCCATTC ACTTTCGGCCAAGGGACCAAAGTGGATATCAA A<br>SEQ ID NO: 27973 | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCCACAGAAGTTCAGT GGCACAAACTATGCACAGGGACACGTCCATCAGCACA GTCACCATGACCAGGGACACGTCCATCAGCACA GCCTACATGGAGCTGAGCAGTCTGAGATCTGACG ACACGGCCGTGTATTACTGTGCGAGAGATGGTAC CAGCTCGTTTGACTACTGGGGCCAGGGAACCCTG GTCACCGTGTCCTCA<br>SEQ ID NO: 31979 |

FIGURE 50
(Continued)

| | | | | |
|---|---|---|---|---|
| iPS:442071 | 21-225_4H6.007 | AA | DIQMTQSPSSVSASVGDRVTITCRASQGISRWLA WYQQKPGKAPKLLIYGASSLQSGVPSRFSGSGS GTDFTLTISSLQPEDFATYYCQQANSFPFTFGQG TKVDIK SEQ ID NO: 27974 | QVQLVQSGAEVKKPGASVKVSCKASGYTFTDYYL HWVRQAPGQGLEWMGWIHPNSGGTNYAQKFQGR VTMTRDTSISTAYMELSSLRSDDTAVYYCARDGTS SFDYWGQGTLVTVSS SEQ ID NO: 31980 |
| | | NA | GACATCCAGATGACCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAACCAGGGAAAG CCCCTAAGCTCCTGATCTATGGTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAATTT ATTATTGTCAACAGGCTAACAGTTTCCCATTC ACTTTCGGCCCTGGGACCAAAGTGGATATCAA A SEQ ID NO: 27975 | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCCAACCTAACAGTGGT GGCACAAACTATGCACAGAAGTTTCAGGGCAGG GTCACCATGACCAGGGACACGTCCATCAGCACA GCCTACATGGAGCTGAGCAGTCTGAGATCTGACG ACACGGCCGTGTATTACTGTGCGAGAGATGCTAC CAGCTCGTTTGACTACTGGGGCCAGGGAACCCTG GTCACCGTGTCCTCA SEQ ID NO: 31981 |
| | | AA | DIQMTQSPSSVSASVGDRVTITCRASQGISRWLA WYQQKPGKAPKLLIYGASSLQSGVPSRFSGSGS GTDFTLTISSLQPEDFAIYYCQQANSFPFTFGPGT KVDIK SEQ ID NO: 27976 | QVQLVQSGAEVKKPGASVKVSCKASGYTFTDYYL HWVRQAPGQGLEWMGWIHPNSGGTNYAQKFQGR VTMTRDTSISTAYMELSSLRSDDTAVYYCARDATS SFDYWGQGTLVTVSS SEQ ID NO: 31982 |

FIGURE 50
(Continued)

| | | | |
|---|---|---|---|
| iPS:442078 | 21-225_4H6.008 | NA | GACATCCAGATGACCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAACCAGGGAAAG CCCCTAAGCTCCTGATCTATGCTGCATCCAGTT TGCAAAGTGGGGGTCCCATCAAGGTTCAGCGGC AGTGGATCTGGGACAGATTTCACTCTCACCAT CAGCAGCCTGCAGCCTGAAGATTTTGCAATTT ATTATTGTCAACAGGCTAACAGTTTCCCATTC ACTTTCGGCCCTGGGACCAAAGTGGATATCAA A | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCCACCTAACAGTGGT GGCACAAACTATGCACAGAAGTTTCAGGGCAGG GTCACCATGACCAGGGACACGTCCATCAGCACA GCCTACATGGAGCTGAGCAGTCTGAGATCTGACG ACACGGCCGTGTATTACTGTGCGAGAAGTGGTAC CAGCTCGTTTGACTACTGGGGCCAGGGAACCCTG GTCACCGTGTCCTCA |
| | | | SEQ ID NO: 27977 | SEQ ID NO: 31983 |
| | | AA | DIQMTQSPSSVSASVGDRVTITCRASQGISRWLA WYQQKPGKAPKLLIYGASSLQSGVPSRFSGSGS GTDFTLTISSLQPEDFAIYYCQQANSFPFTFGPGT KVDIK | QVQLVQSGAEVKKPGASVKVSCKASGYTFTDYYL HWVRQAPGQGLEWMGWIHPNSGGTNYAQKFQGR VTMTRDTSISTAYMELSSLRSDDTAVYYCARSGTSS FDYWGQGTLVTVSS |
| | | | SEQ ID NO: 27978 | SEQ ID NO: 31984 |
| iPS:442085 | 21-225_4H6.009 | NA | GACATCCAGATGACCCAGTCTCCATCTTCCGT GTCTGCATCTGTAGGAGATAGAGTCACCATCA CTTGTCGGGCGAGTCAGGGTATTAGCAGGTGG TTAGCCTGGTATCAGCAGAAACCAGGGAAAG CCCCTAAGCTCCTGATCTATGCTGCATCCAGTT TGCAAAGTGGGGGTCCCATCAAGGTTCAGCGGC AGTGGATCTGGGACAGATTTCACTCTCACCAT CAGCAGCCTGCAGCCTGAAGATTTTGCAATTT ATTATTGTCAACAGGCTAACAGTTTCCCATTC ACTTTCGGCCAAGGGACCAAAGTGGATATCAA A | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCCACCTAACAGTGGT GGCACAAACTATGCACAGAAGTTTCAGGGCAGG GTCACCATGACCAGGGACACGTCCATCAGCACA GCCTACATGGAGCTGAGCAGTCTGAGATCTGACG ACACGGCCGTGTATTACTGTGCGAGAAGTGGTAC CAGCTCGTTTGACTACTGGGGCCAGGGAACCCTG GTCACCGTGTCCTCA |
| | | | SEQ ID NO: 27979 | SEQ ID NO: 31985 |

FIGURE 50
(Continued)

| | | | | |
|---|---|---|---|---|
| | | | AA | DIQMTQSPSSVSASVGDRVTITCRASQGISRWLA WYQQKPGKAPKLLIYGASSLQSGVPSRFSGSGS GTDFTLTISSLQPEDFAIYCQQANSFPFTFGQGT KVDIK<br><br>SEQ ID NO: 27980 | QVQLVQSGAEVKKPGASVKVSCKASGYTFTDYYL HWVRQAPGQGLEWMGWIHPNSGGTNYAQKFQGR VTMTRDTSISTAYMELSSLRSDDTAVYYCARSGTSS FDYWGQGTLVTVSS<br><br>SEQ ID NO: 31986 |
| iPS:442089 | 21-225_4H6.010 | NA | GACATCCAGATGACCCAGTCTCCATCTTCCGT GTCTGCATCTGTAGGAGATAGAGTCACCATCA CTTGTCGGGCGAGTCAGGGTATTAGCAGGTGG TTAGCCTGGTATCAGCAGAAACCAGGGAAAG CCCCTAAGCTCCTGATCTATGGTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAATTT ATTATTGTCAACAGGCTAACAGTTTCCCATTC ACTTTCGGCCAAGGGACCAAAGTGGATATCAA A<br><br>SEQ ID NO: 27981 | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCACAGAAGTTCAGGGCAGG GGCACAAACTATGCACAGAAGTTTCAGGGCAGG GTCACCATGACCAGGGACACGTCCATCAGCACA GCCTACATGGAGCTGAGCAGTCTGAGATCTGACG ACACGGCCGTGTATTACTGTGCGAGAGATGCTAC CAGCTCGTTTGACTACTGGGGCCAGGGAACCCTG GTCACCGTGTCCTCA<br><br>SEQ ID NO: 31987 |
| | | AA | DIQMTQSPSSVSASVGDRVTITCRASQGISRWLA WYQQKPGKAPKLLIYGASSLQSGVPSRFSGSGS GTDFTLTISSLQPEDFAIYCQQANSFPFTFGQGT KVDIK<br><br>SEQ ID NO: 27982 | QVQLVQSGAEVKKPGASVKVSCKASGYTFTDYYL HWVRQAPGQGLEWMGWIHPNSGGTNYAQKFQGR VTMTRDTSISTAYMELSSLRSDDTAVYYCARDATS SPDYWGQGTLVTVSS<br><br>SEQ ID NO: 31988 |

FIGURE 50
(Continued)

| | | | |
|---|---|---|---|
| iPS:442093 | 21-225_4H6.011 | NA | GACATCCAGATGACCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAACCAGGGAAAG CCCCTAAGCTCCTGATCTATGGTGCATCCAGTT TGCAAAGTGGGGTCCATCAAGGTTCAGCGGC AGTGGATCTGGGACAGATTTCACTCTCACCAT CAGCAGCCTGCAGCCTGAAGATTTTGCAACT ATTATTGTCAACAGGCTAACAGTTTCCCATTC ACTTTCGGCCAAGGGACCAAAGTGGATATCAA A<br>SEQ ID NO: 27983 | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCCACCCTAACAGTGGT GGCACAAACTATGCACAGAAGTTTCAGGGCAGG GTCACCATGACCAGGGACACGTCCATCAGCACA GCCTACATGGAGCTGAGCAGTCTGAGATCTGACG ACACGGCCGTGTATTACTGTGCGAGAGATGTAC AGCTCGTTTGACTACTGGGGCCAGGGAACCCTG GTCACCGTGTCCTCA<br>SEQ ID NO: 31989 |
| | | AA | DIQMTQSPSSVSASVGDRVTITCRASQGISRWLA WYQQKPGKAPKLLIYGASSLQSGVPSRFSGSGS GTDFTLTISSLQPEDFATYYCQQANSFPFTFGQG TKVDIK<br>SEQ ID NO: 27984 | QVQLVQSGAEVKKPGASVKVSCKASGYTFTDYYL HWVRQAPGQGLEWMGWIHPNSGGTNYAQKFQGR VTMTRDTSISTAYMELSSLRSDDTAVYYCARDATS SFDYWGQGTLVTVSS<br>SEQ ID NO: 31990 |
| iPS:442115 | 21-225_5E5.003 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAAGGACATTATAGTTACCCTCGG ACGTTCGGCCAAGGGACCAAGGTGGAAGTCA AA<br>SEQ ID NO: 27985 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTACTATCAT GCACTGGGTCCGCCAGGCTCCAGGCAAGGGGCT GGAGTGGGTGGCAGTTATCTGGTATGATGCAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATTACTGTACGAGAGAGGTATA TAGCAGTGGCTGGTACGACTACGGTATGGACGTC TGGGGCCAAGGGACCACGGTCACCGTGTCCTCA<br>SEQ ID NO: 31991 |

FIGURE 50
(Continued)

| | | | |
|---|---|---|---|
| iPS:442122 | 21-225_5E5.004 | AA | DIQMTQSPSSLSASVGDRVTITCRASQGIRNDLGWYQQKPGKAPKRLIYAASSLQSGVPSRFSGSGSGTEFTLTISSLQPEDFATYYCLQHYSYPRTFGQGTKVEVK<br>SEQ ID NO: 27986 | QVQLVESGGGVVQPGRSLRLSCAASGFTFSNYVMHWVRQAPGKGLEWVAVIWYDASNKYYADSVKGRFTISRDNSKNTLYLQMNSLRAEDTAVYYCTREVYSSGWYDYGMDVWGQGTTVTVSS<br>SEQ ID NO: 31992 |
| | | NA | GACATCCAGATGACCCAGTCTCCATCCTCCCTGTCTGCATCTGTAGGAGACAGAGTCACCATCACTTGCCGGGCAAGTCAGGGCATTAGAAATGATCTTGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATTATAGTTACCCTCGGACGTTCGGCCAAGGGACCAAGGTGGAAGTCAAA<br>SEQ ID NO: 27987 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAACTATGTCATGCACTGGGTCCGCCAGGCTCCAGGCAAGGGGCTGGAGTGGGTGGCAGTTATCTGGTATGATGAAGTAATAAATACTATGCAGAATCCGTGAAGGGCCGATTCACCATCTCCAGAGACAATTCCAAGAACACGCTGTATCTGCAAATGAACAGCCTGAGAGCCGAGGACACGGCTGTGTATTACTGTACGAGAGAGGTATATAGCAGTGGCTGGTACGACTACGGTATGGACGTCTGGGGCCAAGGGACCACGGTCACCGTGTCCTCA<br>SEQ ID NO: 31993 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHYSYPRTFGQGTKVEVK<br>SEQ ID NO: 27988 | QVQLVESGGGVVQPGRSLRLSCAASGFTFSNYVMHWVRQAPGKGLEWVAVIWYDGSNKYYAESVKGRFTISRDNSKNTLYLQMNSLRAEDTAVYYCTREVYSSGWYDYGMDVWGQGTTVTVSS<br>SEQ ID NO: 31994 |

FIGURE 50
(Continued)

| | | | |
|---|---|---|---|
| iPS:442129 | 21-225_5E5.005 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGGCGCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA SEQ ID NO: 27989 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK SEQ ID NO: 27990 |
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATCTGGTATGATGGAAGT AATAAATACTATGCAGGCTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTACGAGAGAGGTATA TAGCAGTGGCTGGTACGACTACGGTATGGACGTC TGGGGCCAAGGGACCACGGTCACCGTGTCCTCA SEQ ID NO: 31995 |
| | | | QVQLVESGGGVVQPGRSLRLSCAASGFTFSNYVM HWVRQAPGKGLEWVAVIWYDGSNKYYAGSVKGR FTISRDNSKNTLYLQMNSLRAEDTAVYYCTREVYS SGWYDYGMDVWGQGTTVTVSS SEQ ID NO: 31996 |
| iPS:442136 | 21-225_5E5.006 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGGCGCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA SEQ ID NO: 27991 |
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATCTGGTATGATGGAAGT AATAAATACTATGCAGACGCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGTACGAGAGAGGTATA TAGCAGTGGCTGGTACGACTACGGTATGGACGTC TGGGGCCAAGGGACCACGGTCACCGTGTCCTCA SEQ ID NO: 31997 |

FIGURE 50
(Continued)

| | | | |
|---|---|---|---|
| iPS:442171 | 21-225_5E5.011 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK<br>SEQ ID NO: 27992 | QVQLVESGGGVVQPGRSLRLSCAASGFTFSNYYM HWVRQAPGKGLEWVAVIWYDGSNKYYADAVKG RFTISRDNSKNTLYLQMNSLRAEDTAVYYCTREVY SSGWYDYGMDVWGQGTTVTVSS<br>SEQ ID NO: 31998 |
| | | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA<br>SEQ ID NO: 27993 | CAGGTGCAGCTGGTGGAGTCTGGGGGAGGCGTG GTCCAGCCTGGGAGGTCCCTGAGACTCTCCTGTG CAGCGGTCTGGATTCACCTTCAGTAACTATGTCAT GCACTGGGTCCGCCAGGCTCCAGGCAAGGGGCT GGAGTGGGTGGCAGTTATCTGGTATGATGGAAGT AATAAATACTATGCAGATGCAGATGCAGAAGGCCGA TTCACCATCTCCAGAGACAATTCCAAGAACACGC TGTATCTGCAAATGAACAGCCTGAGAGCCGAGG ACACGGCTGTGTATTACTGTACGAGAGAGGTATA TAGCAGTGGCTGGTACGACTACGGTATGGACGTC TGGGGCCAAGGGACCACGGTCACCGTGTCCTCA<br>SEQ ID NO: 31999 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK<br>SEQ ID NO: 27994 | QVQLVESGGGVVQPGRSLRLSCAASGFTFSNYYM HWVRQAPGKGLEWVAVIWYDASNKYYAESVKGR FTISRDNSKNTLYLQMNSLRAEDTAVYYCTREVYS SGWYDYGMDVWGQGTTVTVSS<br>SEQ ID NO: 32000 |

FIGURE 50
(Continued)

| | | | |
|---|---|---|---|
| iPS:442178 | 21-225_5E5.012 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA<br><br>SEQ ID NO: 27995 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATCTGGTATGATGCAAGT AATAAATACTATGCAGACGCCGTGAAGGGCCGA TTCACCATCTCCAGAGACAATTCCAAGAACACGC TGTATCTGCAAATGAACAGCCTGAGAGCCGAGG ACACGGCTGTGTATTACTGTACGACTACGGTATA TAGCAGTGGCTGGTACGACTACGGTATGGACGTC TGGGGCCAAGGGACCACGGTCACCGTGTCCTCA<br><br>SEQ ID NO: 32001 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK<br><br>SEQ ID NO: 27996 | QVQLVESGGGVVQPGRSLRLSCAASGFTFSNYVM HWVRQAPGKGLEWVAVIWYDASNKYYADAVKG RFTISRDNSKNTLYLQMNSLRAEDTAVYYCTREVY SSGWYDYGMDVWGQGTTVTVSS<br><br>SEQ ID NO: 32002 |
| iPS:442199 | 21-225_5E5.015 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA<br><br>SEQ ID NO: 27997 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATCTGGTATGATGCAAGT AATAAATACTATGCAGACGCCGTGAAGGGCCGA TTCACCATCTCCAGAGACAATTCCAAGAACACGC TGTATCTGCAAATGAACAGCCTGAGAGCCGAGG ACACGGCTGTGTATTACTGTACGACTACGGTATA TAGCAGTGGCTATTACGACTACGGTATGGACGTC TGGGGCCAAGGGACCACGGTCACCGTGTCCTCA<br><br>SEQ ID NO: 33003 |

FIGURE 50
(Continued)

| | | | | |
|---|---|---|---|---|
| iPS:442206 | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK SEQ ID NO: 27998 | QVQLVESGGGVVQPGRSLRLSCAASGFTFSNYVM HWVRQAPGKGLEWVAVIWYDASNKYYADSVKGR FTISRDNSKNTLYLQMNSLRAEDTAVYYCTREVYS SGYYDYGMDVWGQGTTVTVSS SEQ ID NO: 32004 |
| | | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA SEQ ID NO: 27999 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATCTGGTATGATGCAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTACGAGAGAGTATA TAGCAGTGGCTTCTACGACTACGGTATGGACGTC TGGGGCCAAGGGACCACGGTCACCGTGTCCTCA SEQ ID NO: 32005 |
| | 21-225_5E5.016 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK SEQ ID NO: 28000 | QVQLVESGGGVVQPGRSLRLSCAASGFTFSNYVM HWVRQAPGKGLEWVAVIWYDASNKYYADSVKGR FTISRDNSKNTLYLQMNSLRAEDTAVYYCTREVYS SGFYDYGMDVWGQGTTVTVSS SEQ ID NO: 32006 |

FIGURE 50
(Continued)

| | | | | |
|---|---|---|---|---|
| iPS:442213 | 21-225_5E5.017 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA | CAGGTGCAGCTGGTGGAGTCTGGGGGAGGCGTG GTCCAGCCTGGGAGGTCCCTGAGACTCTCCTGTG CAGCGCTCTGGATTCACCTTCAGTAGCTATGTCAT GCACTGGGTCCGCCAGGCTCCAGGCAAGGGGCT GGAGTGGGTGGCAGTTATCTGGTATGATGGAAGT AATAAATACTATGCAGAATCCGTGAAGGGCCGA TTCACCATCTCCAGAGACAATTCCAAGAACACGC TGTATCTGCAAATGAACAGCCTGAGAGCCGAG ACACGGCTGTGTATTACTGTACGAGAGAGGTATA TAGCAGTGGCTATTACGACTACGGTATGGACGTC TGGGGCCAAGGGACCACGGTCACCGTGTCCTCA |
| | | | SEQ ID NO: 28001 | SEQ ID NO: 32007 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK | QVQLVESGGGVVQPGRSLRLSCAASGFTFSNYVM HWVRQAPKGLEWVAVIWYDGSNKYYAESVKGR FTISRDNSKNTLYLQMNSLRAEDTAVYYCTREVYS SGYYDYGMDVWGQGTTVTVSS |
| | | | SEQ ID NO: 28002 | SEQ ID NO: 32008 |
| iPS:442220 | 21-225_5E5.018 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA | CAGGTGCAGCTGGTGGAGTCTGGGGGAGGCGTG GTCCAGCCTGGGAGGTCCCTGAGACTCTCCTGTG CAGCGCTCTGGATTCACCTTCAGTAGCTATGTCAT GCACTGGGTCCGCCAGGCTCCAGGCAAGGGGCT GGAGTGGGTGGCAGTTATCTGGTATGATGGAAGT AATAAATACTATGCAGAATCCGTGAAGGGCCGA TTCACCATCTCCAGAGACAATTCCAAGAACACGC TGTATCTGCAAATGAACAGCCTGAGAGCCGAG ACACGGCTGTGTATTACTGTACGAGAGAGGTATA TAGCAGTGGCTATTACGACTACGGTATGGACGTC TGGGGCCAAGGGACCACGGTCACCGTGTCCTCA |
| | | | SEQ ID NO: 28003 | SEQ ID NO: 32009 |

FIGURE 50
(Continued)

| | | | | |
|---|---|---|---|---|
| iPS:442227 | 21-225_5E5.019 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK SEQ ID NO: 28004 | QVQLVESGGGVVQPGRSLRLSCAASGFTFSNYYM HWVRQAPGKGLEWVAVIWYDGSNKYYADSVKGR FTISRDNSKNTLYLQMNSLRAEDTAVYYCTREVYS SGYYDYGMDVWGQGTTVTVSS SEQ ID NO: 32010 |
| | | NA | GACATCCAGATGACCCAGTCTCCATCCTCCCT GTCTGCATCTGTAGGAGACAGAGTCACCATCA CTTGCCGGGCAAGTCAGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA SEQ ID NO: 28005 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGCT GGAGTGGGTGGCAGTTATCTGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGTACGAGAGAGGTATA TAGCAGTGGCTTCTACGACTACGGTATGGACGTC TGGGGCCAAGGGACCACGGTCACCGTGTCCTCA SEQ ID NO: 32011 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK SEQ ID NO: 28006 | QVQLVESGGGVVQPGRSLRLSCAASGFTFSNYYM HWVRQAPGKGLEWVAVIWYDGSNKYYADSVKGR FTISRDNSKNTLYLQMNSLRAEDTAVYYCTREVYS SGFYDYGMDVWGQGTTVTVSS SEQ ID NO: 32012 |

FIGURE 50
(Continued)

| | | | |
|---|---|---|---|
| iPS:442255 | 21-225_5E5.023 | NA | GACATCCAGATGACCCAGTCTCCATCTCCCT GTCTGCATCTGTAGGAGACAGAGTCACCATCA CTTGCCGGGCAAGTCAGGACAGATTAGGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA SEQ ID NO: 28007 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATCTGGTATGATGCAAGT AATAAATACTATGCAGAATCCGTGAAGGGCCGA TTCACCATCTCCAGAGACAATTCCAAGAACACGC TGTATCTGCAAATGAACAGCCTGAGAGAGCCGAGG ACACGGCTGTGTATTACTGTACGAGAGAGGTATA TAGCAGTGGCTATTACGACTACGGTATGGACGTC TGGGGCCAAGGGACCACGGTCACCGTCTCCTCA SEQ ID NO: 32013 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK SEQ ID NO: 28008 | QVQLVESGGGVVQPGRSLRLSCAASGFTFSNYVM HWVRQAPGKGLEWVAVIWYDASNKYYAESVKGR FTISRDNSKNTLYLQMNSLRAEDTAVYYCTREVYS SGYYDYGMDVWGQGTTVTVSS SEQ ID NO: 32014 |
| iPS:442262 | 21-225_5E5.024 | NA | GACATCCAGATGACCCAGTCTCCATCTCCCT GTCTGCATCTGTAGGAGACAGAGTCACCATCA CTTGCCGGGCAAGTCAGGACAGATTAGGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA SEQ ID NO: 28009 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATCTGGTATGATGCAAGT AATAAATACTATGCAGACGCGTGAAGGGCCGA TTCACCATCTCCAGAGACAATTCCAAGAACACGC TGTATCTGCAAATGAACAGCCTGAGAGCCGAGG ACACGGCTGTGTATTACTGTACGAGAGAGGTATA TAGCAGTGGCTATTACGACTACGGTATGGACGTC TGGGGCCAAGGGACCACGGTCACCGTCTCCTCA SEQ ID NO: 32015 |

FIGURE 50
(Continued)

| | | | | |
|---|---|---|---|---|
| iPS:442269 | 21-225_5E5.025 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK<br>SEQ ID NO: 28010 | QVQLVESGGGVVQPGRSLRLSCAASGFTFSNYVM HWVRQAPGKGLEWVAVIWYDASNKYYADAVKG RFTISRDNSKNTLYLQMNSLRAEDTAVYYCTREVY SSGYYDYGMDVWGQGTTVTVSS<br>SEQ ID NO: 32016 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA<br>SEQ ID NO: 28011 | GAGGTGCAGCTGGTGGAGTCTGGGGGAGGCGTG GTCCAGCCTGGGGGGTCCCTGAGACTCTCCTGTG CAGCGTCTGATTCACCTTCAGTAACTATGTCAT GCACTGGGTCCGCCAGGCTCCAGGCAAGGGCT GGAGTGGGTGGCAGTTATCTGGTATGATGAAGT AATAAATACTATGCAGAATCCGTGAAGGGCCGA TTCACCATCTCCAGAGACAATGCCAAGAACACGC TGTATCTGCAAATGAACAGCCTGAGAGCCGAGG ACACGGCTGTGTATTACTGTACGAGAGAGGTATA TAGCAGTGGCTGGTACGACTACGGTATGGACGTC TGGGGCCAAGGGACCACGGTCACCGTCTCCTCA<br>SEQ ID NO: 32017 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK<br>SEQ ID NO: 28012 | EVQLVESGGGVVQPGGSLRLSCAASGFTFSNYVMH WVRQAPGKGLEWVAVIWYDGSNKYYAESVKGRF TISRDNAKNTLYLQMNSLRAEDTAVYYCTREVYSS GWYDYGMDVWGQGTTVTVSS<br>SEQ ID NO: 32018 |

FIGURE 50
(Continued)

| | | | |
|---|---|---|---|
| iPS:442311 | 21-225_7E11.001.001 | NA | GACATCCAGATGACCCAGTCTCCATCCTCCT GTCTGCATCTGTAGGAGACAGAGTCACCATTA CTTGCCGGGCAAGTCAAAACATTATCAGCTAT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGTC ACTTTCGGCGGCGGGACCAAGGTGGAGATCA AA |
| | | | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGCT GGAGTGGGTGGCAATTATCTGGCATGATGGAAGT AATAAATACTATGCAGACTCCGTGAAGGGCCGA TTCACCATCTCCAGAGACAATTCCAAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTGTCCTCA |
| | | | SEQ ID NO: 28013 |
| | | AA | DIQMTQSPSSLSASVGDRVTITCRASQNISYLNW YQQKPGKAPKFLIYTASSLQSGVPSRFSGSGSGT DFTLTISSLQPEDFAIYYCQQTYSTPLTFGGGTKV EIK |
| | | | SEQ ID NO: 28014 |
| | | | QVQLVESGGGVVQPGRSLRLSCAASGFTFSSFGMH WVRQAPGKGLEWVAIIWHDGSNKYYADSVKGRFT ISRDNSKNTLYLQMSSLRAEDTAVYYCARDLSMGG MDVWGQGTTVTVSS |
| | | | SEQ ID NO: 32019 |
| iPS:442317 | 21-225_7E11.001.002 | NA | GACATCCAGATGACCCAGTCTCCATCCTCCT GTCTGCATCTGTAGGAGACAGAGTCACCATTA CTTGCCGGGCAAGTCAAAACATTATCAGCTAT TTAAATTGGTATCAACAGAAACCAGGGAAAG CCCCTAAACTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGACTTACAGTACCCCGCTC ACTTTCGGCGGCGGGACCAAGGTGGAGATCA AA |
| | | | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGCT GGAGTGGGTGGCAATTATCTGGCATGATGGAAGT AATAAATACTATGCAGACTCCGTGAAGGGCCGA TTCACCATCTCCAGAGACAATTCCAAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTGTCCTCA |
| | | | SEQ ID NO: 28015 |
| | | | SEQ ID NO: 32020 |
| | | | SEQ ID NO: 32021 |

FIGURE 50
(Continued)

| | | | | |
|---|---|---|---|---|
| | | AA | DIQMTQSPSSLSASVGDRVTITCRASQNIISYLNW YQQKPGKAPKLLIYTASSLQSGVPSRFSGSGSGT DFTLTISSLQPEDFATYYCQQTYSTPLTFGGGTK VEIK<br>SEQ ID NO: 28016 | QVQLVESGGGVVQPGRSLRLSCAASGFTFSSFGMH WVRQAPGKGLEWVAIIWHDGSNKYYADSVKGRFT ISRDNSKNTLYLQMSSLRAEDTAVYYCARDLSMGG MDVWGQGTTVTVSS<br>SEQ ID NO: 32022 |
| iPS:442323 | 21-225_7E11.001.003 | NA | GACATCCAGATGACCCAGTCTCCATCCTCCCT GTCTGCATCTGTAGGAGACAGAGTCACCATTG CTTGCCGGGCAAGTCAAAACATTATCAGCTAT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGCGGGACCAAGGTGGAGATCA AA<br>SEQ ID NO: 28017 | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGTTCCAGGCAAGGGCT GGAGTGGGTGGCAATTATCTGGCATAGTGGAAGT AATAAATACTATGCAGACTCCGTGAAGGGCCGA TTCACCATCTCCAGAGACAATTCCAAAAACACGC TGTATCTGCAAATGAGCAGCCTGCGAGCGAGG ACACGGCTGTGTATTACTGTGCGAGAGATCTGAG TATGGGCGGTATGGACGTCTGGGGCCAAGGGAC CACGGTCACCGTGTCCTCA<br>SEQ ID NO: 32023 |
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK<br>SEQ ID NO: 28018 | QVQLVESGGGVVQPGRSLRLSCAASGFTFSSFGMH WVRQAPGKGLEWVAIIWHSGSNKYYADSVKGRFT ISRDNSKNTLYLQMSSLRAEDTAVYYCARDLSMGG MDVWGQGTTVTVSS<br>SEQ ID NO: 32024 |

FIGURE 50
(Continued)

| | | | |
|---|---|---|---|
| iPS:442330 | 21-225_7E11.001.004 | NA | GACATCCAGATGACCCAGTCTCCATCTCCT GTCTGCATCTGTAGGAGACAGAGTCACCATTG CTTGCCGGGCAAGTCAAAACAGAAACCAGGGAAAGC TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGAGACTTACAGTACCCGCTC ACTTTCGGCGGCGGGACCAAGGTGGAGATCA AA <br><br>SEQ ID NO: 28019 | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGCT GGAGTGGGTGGCAATTATCTGGCATGAAGGAAG TAATAAATACTATGCAGACTCCGTGAAGGGCCG ATTCACCATCTCCAGAGACAATTCCAAAAACACG CTGTATCTGCAAATGAGCAGCCTGCGAGCGAG GACACGGCTGTGTATTACTGTGCGAGAGATCTGA GTATGGGCGTATGGACGTCTGGGGCCAAGGGA CCACGGTCACCGTGTCCTCA<br><br>SEQ ID NO: 32025 |
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK <br><br>SEQ ID NO: 28020 | QVQLVESGGGVVQPGRSLRLSCAASGFTFSSFGMH WVRQAPGKGLEWVAIIWHEGSNKYYADSVKGRFT ISRDNSKNTLYLQMSSLRAEDTAVYYCARDLSMGG MDVWGQGTTVTVSS <br><br>SEQ ID NO: 32026 |
| iPS:442337 | 21-225_7E11.001.005 | NA | GACATCCAGATGACCCAGTCTCCATCTCCT GTCTGCATCTGTAGGAGACAGAGTCACCATTG CTTGCCGGGCAAGTCAAAACATTATCAGCTAT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATT ACTACTGTCAACAGAGCTTACAGTACCCCGCTC ACTTTCGGCGGCGGGACCAAGGTGGAGATCA AA <br><br>SEQ ID NO: 28021 | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATCTGGCATGATGCAAGT AATAAATACTATGCAGACTCCGTGAAGGGCCGA TTCACCATCTCCAGAGACAATTCCAAAAACACGC TGTATCTGCAAATGAGCAGCCTGCGAGCCGAGG ACACGGCTGTGTATTACTGTGCGAGAGATCTGAG TATGGGCGTATGGACGTCTGGGGCCAAGGGAC CACGGTCACCGTGTCCTCA<br><br>SEQ ID NO: 32027 |

FIGURE 50
(Continued)

| | | | | |
|---|---|---|---|---|
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK<br><br>SEQ ID NO: 28022 | QVQLVESGGGVVQPGRSLRLSCAASGFTFSSFGMH WVRQAPGKGLEWVAIIWHDASNKYYADSVKGRFT ISRDNSKNTLYLQMSSLRAEDTAVYYCARDLSMGG MDVWGQGTTVTVSS<br><br>SEQ ID NO: 32028 |
| iPS:442344 | 21-<br>225_7E11.001.006 | NA | GACATCCAGATGACCCAGTCTCCATCTCCCT GTCTGCATCTGTAGGAGACAGAGTCACCATTG CTTGCCGGGCAAGTCAAAACATTATCAGCTAT TTAAATTGGTATCAACAGAAACCAGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACAGACTTACAGTACCCGCTC ACTTTCGGCGGCGGGACCAAGGTGGAGATCA AA<br><br>SEQ ID NO: 28023 | CAGGTGCAGCTGGTGGAGTCTGGGGGAGGCGTG GTCCAGCCTGGGAGGTCCCTGCGACTCTCTGTG CAGCGTCTGGATTCACCTTCAGTAGCTTTGGCAT GCACTGGGTCCGCCAGGCTCCAGGCAAGGGCT GGAGTGGGTGGCAATTATCTGGCATGATGAAGT AATAAATACTATGCAGAATCCGTGAAGGGCCGA TTCACCATCTCCAGAGACACAATTCCAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTGTCCTCA<br><br>SEQ ID NO: 32029 |
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK<br><br>SEQ ID NO: 28024 | QVQLVESGGGVVQPGRSLRLSCAASGFTFSSFGMH WVRQAPGKGLEWVAIIWHDGSNKYYAESVKGRFT ISRDNSKNTLYLQMSSLRAEDTAVYYCARDLSMGG MDVWGQGTTVTVSS<br><br>SEQ ID NO: 32030 |

FIGURE 50
(Continued)

| | | | |
|---|---|---|---|
| iPS:442351 | 21-225_7E11.001.007 | NA | GACATCCAGATGACCCAGTCTCCATCTCCCT GTCTGCATCTGTAGGAGACAGAGTCACCATTG CTTGCCGGGCAAGTCAAAACATTATCAGCTAT TTAAATTGGTATCAACAGAAACCAGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGCGGGACCAAGGTGGAGATCA AA SEQ ID NO: 28025 | CAGGTGCAGCTGGTGGAGTCTGGGGGAGGCGTG GTCCAGCCTGGGAGGTCCCTGCGACTCTCCTGTG CAGCGTCTGATTCACCTTCAGTAGCTTTGGCAT GCACTGGGTCCGCCAGGCTCCAGGCAAGGGCT GGAGTGGGTGGCAATTATCTGGCATGATGAAGT AATAAATACTATGCAGACGCCGTGAAGGGCCGA TTCACCATCTCCAGAGACAACGCCAAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTGTCCTCA SEQ ID NO: 32031 |
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK SEQ ID NO: 28026 | QVQLVESGGGVVQPGRSLRLSCAASGFTFSSFGMH WVRQAPGKGLEWVAIIWHDGSNKYYADAVKGRF TISRDNSKNTLYLQMSSLRAEDTAVYYCARDLSMG GMDVWGQGTTVTVSS SEQ ID NO: 32032 |
| iPS:442358 | 21-225_7E11.001.008 | NA | GACATCCAGATGACCCAGTCTCCATCTCCCT GTCTGCATCTGTAGGAGACAGAGTCACCATTG CTTGCCGGGCAAGTCAAAACATTATCAGCTAT TTAAATTGGTATCAACAGAAACCAGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGCGGGACCAAGGTGGAGATCA AA SEQ ID NO: 28027 | CAGGTGCAGCTGGTGGAGTCTGGGGGAGGCGTG GTCCAGCCTGGGAGGTCCCTGCGACTCTCCTGTG CAGCGTCTGATTCACCTTCAGTAGCTTTGGCAT GCACTGGGTCCGCCAGGCTCCAGGCAAGGGCT GGAGTGGGTGGCAATTATCTGGCATGAAGGAAG TAATAAATACTATGCAGAGCGCGTGAAGGGCCG ATTCACCATCTCCAGAGACAATTCAAAAACACG CTGTATCTGCAAATGAGCAGCCTGCGAGCCGAG GACACGGCTGTGTATTACTGTGCGAGAGATCTGA GTATGGGCGGTATGGACGTCTGGGGCCAAGGGA CCACGGTCACCGTGTCCTCA SEQ ID NO: 32033 |

FIGURE 50
(Continued)

| | | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK<br><br>SEQ ID NO: 28028 | QVQLVESGGGVVQPGRSLRLSCAASGFTFSSFGMH WVRQAPGKGLEWVAIIWHEGSNKYYADAVKGRF TISRDNSKNTLYLQMSSLRAEDTAVYYCARDLSMG GMDVWGQGTTVTVSS<br><br>SEQ ID NO: 32034 |
|---|---|---|---|---|---|
| iPS:442365 | 21-225_7E11.001.009 | | NA | GACATCCAGATGACCCAGTCTCCATCCCCT GTCTGCATCTGTAGGAGACAGAGTCACCATTG CTTGCCGGGCAAGTCAAAACATTATCAGCTAT TTAAATTGTATCAACAGAAACCAGGGAAAG CCCCTAAATTCCTGATCTATACTGCATCAGTT TGCAAAGTGGGGTCCCATCAAGGTTCAGTGGC AGTGGATCTGGACAGATTTCACTCTCACCAT CAGCAGTCTGCAACAGACTTACAGTACCCCGCTC ACTTTCGGCGGCGGGACCAAGGTGGAGATCA AA<br><br>SEQ ID NO: 28029 | CAGGTGCAGCTGGTGGAGTCTGGGGGAGGCGTG GTCCAGCCTGGGAGGTCCCTGCGACTCTCCTGTG CAGCGGTCTGGATTCACCTTCAGTAGCTTTGGCAT GCACTGGGTCCGCCAGGCTCCAGGCAAGGGGCT GGAGTGGGTGGCAATTATCTGGCATGAAGGAAG TAATAAATACTATGCAGAATCCGTGAAGGGCCG ATTCACCATCTCCAGAGACAACAATTCCAAAAACACG CTGTATCTGCAAATGAGCAGCCTGCGAGCCGAG GACACGGCTGTGTATTACTGTGCGAGAGATCTGA GTATGGGCGGTATGGACGTCTGGGGCCAAGGGA CCACGGTCACCGTGTCCTCA<br><br>SEQ ID NO: 32035 |
| | | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK<br><br>SEQ ID NO: 28030 | QVQLVESGGGVVQPGRSLRLSCAASGFTFSSFGMH WVRQAPGKGLEWVAIIWHEGSNKYYAESVKGRFT ISRDNSKNTLYLQMSSLRAEDTAVYYCARDLSMGG MDVWGQGTTVTVSS<br><br>SEQ ID NO: 32036 |

FIGURE 50
(Continued)

| | | | |
|---|---|---|---|
| iPS:442372 | 21-225_7E11.001.010 | NA | GACATCCAGATGACCCAGTCTCCATCCTCCCT GTCTGCATCTGTAGGAGACAGAGTCACCATTG CTTGCCGGGCAAGTCAAACAGAGTCACCATT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGCGGGACCAAGGTGGAGATCA AA | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATCAGAGAATCCGTGAAGT AATAAATACTATGCAGAGAATCCGTGAAGGGCCGA TTCACCATCTCCAGAGACAATTCCAAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTGTCCTCA |
| | | | SEQ ID NO: 28031 | SEQ ID NO: 32037 |
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK | QVQLVESGGGVVQPGRSLRLSCAASGFTFSSFGMH WVRQAPGKGLEWVAIIWHSGSNKYYAESVKGRFT ISRDNSKNTLYLQMSSLRAEDTAVYYCARDLSMGG MDVWGQGTTVTVSS |
| | | | SEQ ID NO: 28032 | SEQ ID NO: 32038 |
| iPS:442379 | 21-225_7E11.001.011 | NA | GACATCCAGATGACCCAGTCTCCATCCTCCCT GTCTGCATCTGTAGGAGACAGAGTCACCATTG CTTGCCGGGCAAGTCAAACAGAGTCACCATT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGCGGGACCAAGGTGGAGATCA AA | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATCTGGCATAGTGGAAGT AATAAATACTATGCAGAGAATCCGTGAAGGGCCGA TTCACCATCTCCAGAGACAACGCCGTGAAGGGCCGA ACACGGCTGTGTATTACTGTGCGAGAGATCTGAG TATGGGCGGTATGGACGTCTGGGGCCAAGGGAC CACGGTCACCGTGTCCTCA |
| | | | SEQ ID NO: 28033 | SEQ ID NO: 32039 |

FIGURE 50
(Continued)

| | | | |
|---|---|---|---|
| iPS:442386 | 21-225_7E11.001.012 | AA | DIQMTQSPSSLSASVGDRVTIACRASQNIISYLNWYQQKPGKAPKFLIYTASSLQSGVPSRFSGSGSGTDFTLTISSLQPEDFAIYYCQQTYSTPLTFGGGTKVEIK<br>SEQ ID NO: 28034 | QVQLVESGGGVVQPGRSLRLSCAASGFTSSFGMHWVRQAPGKGLEWVAIIWHSGSNKYYADAVKGRFTISRDNSKNTLYLQMSSLRAEDTAVYYCARDLSMGGMDVWGQGTTVTVSS<br>SEQ ID NO: 32040 |
| | | NA | GACATCCAGATGACCCAGTCTCCATCCTCCTGTCTGCATCTGTAGGAGACAGAGTCACCATTACTTGCCGGGCAAGTCAAAACATTATCAGCTATTTAAATTGGTATCAACAGAAACCAGGAAAGCCCCTAAATTCCTGATCTATACTGCATCCAGTTGCAAAGTGGGGTCCCATCAAGGTTCAGTGGCAGTGGATCTGGGACAGATTTCACTCTCACCATCAGCAGTCTGCAACCTGAAGATTTTGCAATTTACTACTGTCAACAGACTTACAGTACCCCGCTCACTTTCGGCGGCGGGACCAAGGTGGAGATCAAA<br>SEQ ID NO: 28035 | CAGGTGCAGCTGGTGGAGTCTGGGGGAGGCGTGGTCCAGCCTGGAGGTCCCTGCGACTCTCTGTGCAGCGTCTGGATTCACCTTCAGTAGCTTTGGCATGCACTGGGTCCGCCAGGCTCCAGGCAAGGGGCTGGAGTGGGTGGCAATTATCTGGCATAGTGGAAGTAATAAATACTATGCAGACTCCGTGAAGGGCCGATTCACCATCTCCAGAGACAATTCCAAAAACACGCTGTATCTGCAAATGAGCAGCCTGCGAGCCGAGGACACGGCTGTGTATTACTGTGCGAGAGATCTGAGTATGGGCGGTATGGACGTCTGGGGCCAAGGGACCACGGTCACCGTCTCCTCA<br>SEQ ID NO: 32041 |
| | | AA | DIQMTQSPSSLSASVGDRVTITCRASQNIISYLNWYQQKPGKAPKFLIYTASSLQSGVPSRFSGSGSGTDFTLTISSLQPEDFAIYYCQQTYSTPLTFGGGTKVEIK<br>SEQ ID NO: 28036 | QVQLVESGGGVVQPGRSLRLSCAASGFTSSFGMHWVRQAPGKGLEWVAIIWHSGSNKYYADSVKGRFTISRDNSKNTLYLQMSSLRAEDTAVYYCARDLSMGGMDVWGQGTTVTVSS<br>SEQ ID NO: 32042 |

FIGURE 50
(Continued)

| | | | |
|---|---|---|---|
| iPS:442390 | 21-225_7E11.001.013 | NA | GACATCCAGATGACCCAGTCTCCATCTCCCTGTCTGCATCTGTAGGAGACAGAGTCACCATTACTTGCCGGGCAAGTCAAACAGATTATCAGCTATTTAAATTGGTATCAACAGAAACCAGGGAAAGCCCCTAAATTCCTGATCTATACTGCATCCAGTTTGCAAAGTGGGGTCCCATCAAGGTTCAGTGGCAGTGGATCTGGGACAGATTTCACTCTCACCATCAGCAGTCTGCAACCTGAAGATTTTGCAATTTACTACTGTCAACAGACTTACAGTACCCCGCTCACTTTCGGCGGCGGGACCAAGGTGGAGATCAAA<br>SEQ ID NO: 28037 | CAGGTGCAGCTGGTGGAGTCTGGGGGAGGCGTGGTCCAGCCTGGGAGGTCCCTGCGACTCTCTGTGCAGCGTCTGGATTCACCTTCAGTAGCTTTGGCATGCACTGGGTCCGCCAGGCTCCAGGCAAGGGCTGGAGTGGGTGGCAATTATCTGGCATGATGGAAGTAATAAATACTATGCAGAGATCCGTGAAGGGCCGATTCACCATCTCCAGAGACAATTCCAAAAACACGCTGTATCTGCAAATGAGCAGCCTGCGAGCCGAGGACACGGCTGTGTATTACTGTGCGAGAGATCTGAGTATGGGCGGTATGGACGTCTGGGGCCAAGGGACCACGGTCACCGTGTCCTCA<br>SEQ ID NO: 32043 |
| | | AA | DIQMTQSPSSLSASVGDRVTITCRASQNIISYLNWYQQKPGKAPKFLIYTASSLQSGVPSRFSGSGSGTDFTLTISSLQPEDFAIYYCQQTYSTPLTFGGGTKVEIK<br>SEQ ID NO: 28038 | QVQLVESGGGVVQPGRSLRLSCAASGFTFSSFGMHWVRQAPGKGLEWVAIIWHDGSNKYYAESVKGRFTISRDNSKNTLYLQMSSLRAEDTAVYYCARDLSMGGMDVWGQGTTVTVSS<br>SEQ ID NO: 32044 |
| iPS:442394 | 21-225_7E11.001.014 | NA | GACATCCAGATGACCCAGTCTCCATCTCCCTGTCTGCATCTGTAGGAGACAGAGTCACCATTACTTGCCGGGCAAGTCAAACAGATTATCAGCTATTTAAATTGGTATCAACAGAAACCAGGGAAAGCCCCTAAATTCCTGATCTATACTGCATCCAGTTTGCAAAGTGGGGTCCCATCAAGGTTCAGTGGCAGTGGATCTGGGACAGATTTCACTCTCACCATCAGCAGTCTGCAACCTGAAGATTTTGCAATTTACTACTGTCAACAGACTTACAGTACCCCGCTCACTTTCGGCGGCGGGACCAAGGTGGAGATCAAA<br>SEQ ID NO: 28039 | CAGGTGCAGCTGGTGGAGTCTGGGGGAGGCGTGGTCCAGCCTGGGAGGTCCCTGCGACTCTCTGTGCAGCGTCTGGATTCACCTTCAGTAGCTTTGGCATGCACTGGGTCCGCCAGGCTCCAGGCAAGGGCTGGAGTGGGTGGCAATTATCTGGCATAGTGGAAGTAATAAATACTATGCAGAGATCCGTGAAGGGCCGATTCACCATCTCCAGAGACAATTCCAAAAACACGCTGTATCTGCAAATGATGAGCAGCCTGCGAGCCGAGGACACGGCTGTATTACTGTGCGAGAGATCTGAGTATGGGCGGTATGGACGTCTGGGGCCAAGGGACCACGGTCACCGTGTCCTCA<br>SEQ ID NO: 32045 |

FIGURE 50
(Continued)

| | | | |
|---|---|---|---|
| iPS:442398 | 21-225_7E11.001.015 | AA | DIQMTQSPSSLSASVGDRVTITCRASQNIISYLNWYQQKPGKAPKFLIYTASSLQSGVPSRFSGSGSGTDFTLTISSLQPEDFAIYYCQQTYSTPLTFGGGTKVEIK | QVQLVESGGGVVQPGRSLRLSCAASGFTFSSFGMHWVRQAPGKGLEWVAIIWHSGSNKYYAESVKGRFTISRDNSKNTLYLQMSSLRAEDTAVYYCARDLSMGGMDVWGQGTTVTVSS |
| | | | SEQ ID NO: 28040 | SEQ ID NO: 32046 |
| | | NA | GACATCCAGATGACCCAGTCTCCATCCTCCCTGTCTGCATCTGTAGGAGACAGAGTCACCATTACTTGCCGGGCAAGTCAGAGTCAAAAACATTATCAGCTATTTAAAATTGGTATCAACAGAAACCAGGGAAAGCCCCTAAACTCCTGATCTATACTGCATCCAGTTTGCAAAGTGGGGTCCCATCAAGGTTCAGTGGCAGTGGATCTGGGACAGATTTCACTCTCACCATCAGCAGTCTGCAACAGACTTACAGTACCCGCTCACTTTCGGCGGCGGGACCAAGGTGGAGATCAAA | CAGGTGCAGCTGGTGGAGTCTGGGGGAGGCGTGGTCCAGCCTGGGAGGTCCCTGCGACTCTCCTGTGCAGCGTCTGGATTCACCTTCAGTAGCTTTGGCATGCACTGGGTCCGCCAGGCTCCAGGCAAGGGCTGGAGTGGGTGGCAATTATCGGCATAGTGGAAGTAATAAATACTATGCAGACTCCGTGAAGGGCCGATTCACCATCTCCAGAGACAATGAGCAGCTCCAAAACACGCTGTATCTGCAAATGAGCAGCCTGCGAGCTGAGGACACGGCTGTGTATTACTGTGCGAGAGATCTGAGTATGGGCGGTATGGACGTCTGGGGCCAAGGGACCACGGTCACCGTCTCCTCA |
| | | | SEQ ID NO: 28041 | SEQ ID NO: 32047 |
| | | AA | DIQMTQSPSSLSASVGDRVTITCRASQNIISYLNWYQQKPGKAPKLLIYTASSLQSGVPSRFSGSGSGTDFTLTISSLQPEDFATYYCQQTYSTPLTFGGGTKVEIK | QVQLVESGGGVVQPGRSLRLSCAASGFTFSSFGMHWVRQAPGKGLEWVAIIWHSGSNKYYADSVKGRFTISRDNSKNTLYLQMSSLRAEDTAVYYCARDLSMGGMDVWGQGTTVTVSS |
| | | | SEQ ID NO: 28042 | SEQ ID NO: 32048 |

FIGURE 50
(Continued)

| | | | |
|---|---|---|---|
| iPS:442402 | 21-225_7E11.001.016 | NA | GACATCCAGATGACCCAGTCTCCATCTCCT GTCTGCATCTGTAGGAGACAGAGTCACCATTA CTTGCCGGGCAAGTCAAAACAGAAACCAGGGAAAG TTAAATTGGTATCAACAGAAACCAGGGAAAG CCCCTAAACTCCTGATCTATACTGCATCCAGTT TGCAAAGTGGGGTCCATCAAGGTTCAGTGGC AGTGGATCTGGGACAGATTTCACTCTCACCAT CAGCAGTCTGCAACCTGAAGATTTTGCAACTT ACTACTGTCAACAGACTTACAGTACCCGCTC ACTTTCGGCGGAGGGACCAAGGTGGAGATCA AA SEQ ID NO: 28043 | CAGGTGCAGCTGGTGGTGAGTCTGGGGGAGGCGTG GTCCAGCCTGGGAGGTCCCTGCGACTCTCCTGTG CAGCGTCTGATTCACCTTCAGTAGCTTTGGCAT GCACTGGGTCCGCCAGGCTCCAGGCAAGGGGCT GGAGTGGGTGGCAATTATCTGGCATAGTGGAAGT AATAAATACTATGCAGAATCCGTGAAGGGCCGA TTCACCATCTCCAGAGACAATTCCAAAACACGC TGTATCTGCAAATGAGCAGCCTGCGAGCGAGG ACACGGCTGTGTATTACTGTGCGAGAGATCTGAG TATGGGCGGTATGGACGTCTGGGGCCAAGGGAC CACGGTCACCGTGTCCTCA SEQ ID NO: 32049 |
| | | AA | DIQMTQSPSSLSASVGDRVTITCRASQNIISYLNW YQQKPGKAPKLLIYTASSLQSGVPSRFSGSGSGT DFTLTISSLQPEDFATYYCQQTYSTPLTFGGGTK VEIK SEQ ID NO: 28044 | QVQLVESGGGVVQPGRSLRLSCAASGFTFSSFGMH WVRQAPGKGLEWVAIIWHSGSNKYYAESVKGRFT ISRDNSKNTLYLQMSSLRAEDTAVYYCARDLSMGG MDVWGQGTTVTVSS SEQ ID NO: 32050 |
| iPS:442406 | 21-225_7E11.001.017 | NA | GACATCCAGATGACCCAGTCTCCATCTCCCT GTCTGCATCTGTAGGAGACAGAGTCACCATTA CTTGCCGGGCAAGTCAAAACAGAAACCAGGGAAAG TTAAATTGGTATCAACAGAAACCAGGGAAAG CCCCTAAACTCCTGATCTATACTGCATCCAGTT TGCAAAGTGGGGTCCATCAAGGTTCAGTGGC AGTGGATCTGGGACAGATTTCACTCTCACCAT CAGCAGTCTGCAACCTGAAGATTTTGCAACTT ACTACTGTCAACAGACTTACAGTACCCGCTC ACTTTCGGCGGAGGGACCAAGGTGGAGATCA AA SEQ ID NO: 28045 | CAGGTGCAGCTGGTGGTGAGTCTGGGGGAGGCGTG GTCCAGCCTGGGAGGTCCCTGCGACTCTCCTGTG CAGCGTCTGATTCACCTTCAGTAGCTTTGGCAT GCACTGGGTCCGCCAGGCTCCAGGCAAGGGGCT GGAGTGGGTGGCAATTATCTGGCATGAAGGAAG TAATAAATACTATGCAGAGACGCCGTGAAGGGCCG ATTCACCATCTCCAGAGACAATTCCAAAACACG CTGTATCTGCAAATGAGCAGCCTGCGAGCCGAG GACACGGCTGTGTATTACTGTGCGAGAGATCTGA GTATGGGCGGTATGGACGTCTGGGGCCAAGGGA CCACGGTCACCGTGTCCTCA SEQ ID NO: 32051 |

FIGURE 50
(Continued)

| | | | | |
|---|---|---|---|---|
| iPS:442410 | 21-225_7E11.001.018 | AA | DIQMTQSPSSLSASVGDRVTITCRASQNIISYLNWYQQKPGKAPKLLIYTASSLQSGVPSRFSGSGSGTDFTLTISSLQPEDFATYYCQQTYSTPLTFGGGTKVEIK<br>SEQ ID NO: 28046 | QVQLVESGGGVVQPGRSLRLSCAASGFTFSSFGMHWVRQAPGKGLEWVAIIWHEGSNKYYADAVKGRFTISRDNSKNTLYLQMSSLRAEDTAVYYCARDLSMGGMDVWGQGTTVTVSS<br>SEQ ID NO: 32052 |
| | | NA | GACATCCAGATGACCCAGTCTCCATCTCCCTGTCTGCATCTGTAGGAGACAGAGTCACCATCACTTGCCGGGCAAGTCAAAACATTATCAGCTATTTAAATTGGTATCAACAGAAACCAGGAAAGCCCCTAAATTCCTGATCTATACTGCATCCAGTTGCAAAGTGGGGTCCCATCAAGGTTCAGTGGCAGTGGATCTGGGACAGATTTCACTCTCACCATCAGCAGTCTGCAACCTGAAGATTTTGCAATTACTACTGTCAAACAGACTTACAGTACCCCGCTCACTTTCGGCGGCGGGACCAAGGTGGAGATCAAA<br>SEQ ID NO: 28047 | CAGGTGCAGCTGGTGGAGTCTGGGGGAGGCGTGGTCCAGCCTGGGAGGTCCCTGCGACTCTCCTGTGCAGCCGTCTGGATTCACCTTCAGTAGCTTTGGCATGCACTGGGTCCGCCAGGCTCCAGGCAAGGGGCTGGAGTGGGTGGCAATTATCTGGCATGATGCAAGTAATAAATACTATGCAGAATCCGTGAAGGGCCGATTCACCATCTCCAGAGACAATTCCAAAAACACGCTGTATCTGCAAATGAGCAGCCTGCGAGCCGAGGACACGGCTGTGTATTACTGTGCGAGAGATCTGAGTATGGGCGGTATGGACGTCTGGGGCCAAGGGACCACGGTCACCGTGTCCTCA<br>SEQ ID NO: 32053 |
| | | AA | DIQMTQSPSSLSASVGDRVTITCRASQNIISYLNWYQQKPGKAPKFLIYTASSLQSGVPSRFSGSGSGTDFTLTISSLQPEDFAIYYCQQTYSTPLTFGGGTKVEIK<br>SEQ ID NO: 28048 | QVQLVESGGGVVQPGRSLRLSCAASGFTFSSFGMHWVRQAPGKGLEWVAIIWHDASNKYYAESVKGRFTISRDNSKNTLYLQMSSLRAEDTAVYYCARDLSMGGMDVWGQGTTVTVSS<br>SEQ ID NO: 32054 |

FIGURE 50
(Continued)

| | | | |
|---|---|---|---|
| iPS:442417 | 21-225_7E11.001.019 | NA | GACATCCAGATGACCCAGTCTCCATCCTCCCT GTCTGCATCTGTAGGAGACAGAGTCACCATTG CTTGCCGGGCAAGTCAAAACAGAAACCAGGGAAAG TTAAATTGGTATCAACAGAAACCAGGGAAAG CCCCTAAATTCCTGATCTATACTGCATCCAGT TGCAAAGTGGGGTCCCATCAAGGTTCAGTGGC AGTGGATCTGGGACAGATTTCACTCTCACCAT CAGCAGTCTGCAACCTGAAGATTTTGCAATT ACTACTGTCAACAGACTTACAGTACCCCGCTC ACTTTCGGCGGCGGGACCAAGGTGGAGATCA AA<br><br>SEQ ID NO: 28049 | GAGGTGCAGCTGGTGGAGTCTGGGGGAGGCGTG GTCCAGCCTGGGGGGTCCCTGCGACTCTCTGTG CAGCGTCTGGATTCACCTTCAGTAGCTTTGGCAT GCACTGGGTCCGCCAGGCTCCAGGCAAGGGGCT GGAGTGGGTGGCAATTATCTGGCATGATGGAAGT AATAAATACTATGCAGAATCCGTGAAGGGCCGA TTCACCATCTCCAGAGACAATGCCAAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTCTCCTCA<br><br>SEQ ID NO: 32055 |
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK<br><br>SEQ ID NO: 28050 | EVQLVESGGGVVQPGGSLRLSCAASGFTFSSFGMH WVRQAPGKGLEWVAIIWHDGSNKYYAESVKGRFT ISRDNAKNTLYLQMSSLRAEDTAVYYCARDLSMG GMDVWGQGTTVTVSS<br><br>SEQ ID NO: 32056 |
| iPS:442431 | 21-225_7E11.001.021 | NA | GACATCCAGATGACCCAGTCTCCATCCTCCCT GTCTGCATCTGTAGGAGACAGAGTCACCATTG CTTGCCGGGCAAGTCAAAACAGAAACCAGGGAAAG TTAAATTGGTATCAACAGAAACCAGGGAAAG CCCCTAAATTCCTGATCTATACTGCATCCAGT TGCAAAGTGGGGTCCCATCAAGGTTCAGTGGC AGTGGATCTGGGACAGATTTCACTCTCACCAT CAGCAGTCTGCAACCTGAAGATTTTGCAATT ACTACTGTCAACAGACTTACAGTACCCCGCTC ACTTTCGGCGGCGGGACCAAGGTGGAGATCA AA<br><br>SEQ ID NO: 28051 | GAGGTGCAGCTGGTGGAGTCTGGGGGAGGCGTG GTCCAGCCTGGGGGGTCCCTGCGACTCTCTGTG CAGCGTCTGGATTCACCTTCAGTAGCTTTGGCAT GCACTGGGTCCGCCAGGCTCCAGGCAAGGGGCT GGAGTGGGTGGCAATTATCTGGCATAGTGGAAGT AATAAATACTATGCAGAGACACTCCAAAACACGC TTCACCATCTCCAAATGAGCAGCCTGCGAGCCGAGG TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTCTCCTCA<br><br>SEQ ID NO: 32057 |

FIGURE 50
(Continued)

| | | | | |
|---|---|---|---|---|
| iPS:442438 | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK<br>SEQ ID NO: 28052 | EVQLVESGGGVVQPGGSLRLSCAASGFTFSSFGMH WVRQAPGKGLEWVAIIWHSGSNKYYAESVKGRFT ISRDNAKNTLYLQMSSLRAEDTAVYYCARDLSMG GMDVWGQGTTVTVSS<br>SEQ ID NO: 32058 |
| | 21-225_7E11.001.022 | NA | GACATCCAGATGACCCAGTCTCCATCCTCCCT GTCTGCATCTGTAGGAGACAGAGTCACCATTA CTTGCCGGGCAAGTCAAAACATTATCAGTAT TTAAATTGGTATCAACAGAAACCAGGGAAAG CCCCTAAATTCCTGATCTATACTGCATCCAGTT TGCAAAGTGGGGTCCCATCAAGGTTCACTCTCACCAT AGTGGATCTGGGACAGATTTCACTCTCACCAT CAGCAGTCTGCAACTGAAGATTTTGCAATTT ACTACTGTCAACAGACTTACAGTACCCCGCTC ACTTTCGGCGGAGGGACCAAGGTGGAGATCA AA<br>SEQ ID NO: 28053 | GAGGTGCAGCTGGTGGAGTCTGGGGGAGGCGTG GTCCAGCCTGGGGGGTCCCTGCGACTCTCCTGTG CAGCGTCTGGATTCACCTTCAGTAGCTTTGGCAT GCACTGGGTCCGCCAGGCTCCAGGCAAGGGCT GGAGTGGGTGGCAATTATCTGGCATGAAGGAAG TAATAAATACTATGCAGAATCCGTGAAGGGCCG ATTCACCATCTCCAGAGACAATGAGCAGCCTGA GCTGTATCTGCAAATGAGCAGCCTGAGAGATCTG GGACACGGCTGTGTATTACTGTGCGAGAGATCTG AGTATGGGCGGTATGGACGTCTGGGGCCAAGGG ACCACGGTCACCGTGTCCTCA<br>SEQ ID NO: 32059 |
| | | AA | DIQMTQSPSSLSASVGDRVTITCRASQNIISYLNW YQQKPGKAPKFLIYTASSLQSGVPSRFSGSGSGT DFTLTISSLQPEDFAIYYCQQTYSTPLTFGGGTKV EIK<br>SEQ ID NO: 28054 | EVQLVESGGGVVQPGGSLRLSCAASGFTFSSFGMH WVRQAPGKGLEWVAIIWHEGSNKYYAESVKGRFT ISRDNAKNTLYLQMSSLRAEDTAVYYCARDLSMG GMDVWGQGTTVTVSS<br>SEQ ID NO: 32060 |

FIGURE 50
(Continued)

| | | | |
|---|---|---|---|
| iPS:442568 | 21-225_149D8 | NA | GAAATTGTGTTGACGCAGTCTCCAGGCACCCT GTCTTTGTTTCCAGGGGAAAGAGCCACCCTCT CCTGCAGGGCCAGTCAGAGTGTGATCAGCAGC TACTTAGCCTGGTACCAGCAGAAACCTGGCCA GGCTCCCAGGCTCCTCATCTTTGGTGTATCTAG TTGGGCCACTGGCATCCCAGACAGGTTCAGTG GCAGTGGGTCTGGGACAGACTTCACTCTCACC ATCAGCAGACTGGAGCCTGAAGATTTTGCAGT GTATTACTGTCAACAATATGTAGGTCACCAT TCAATTTCGGCCCTGGGACCAAAGTGGATATC AAA<br><br>SEQ ID NO: 28055 | CAGGTGCAGCTGCAGGAGTCGGGCCCAGGACTG GTGAAGCCTTCACAGACCCTGTCCCTCAATTGCA CTGTCTCTGGTGGCTCCATCAGCAGCAGTGGTTA CTACTGGAGCTGGATCCGCCAGCACCCAGGGAA GGGCCTGGAATGGATTGGGTACAGTATTACAGT GGGAGCACCTACTACAACCGTCCTCCAAGAGTC GAATTACCATATCAGTAGACAGTCTAACAACCA GTTCTCCCTGAAGCTGAGCTCTGTGACTGCCGCG GACACGGCCGTGTATTACTGTGCGAGAGGGGGA TATAACTGAACATGCTTTTGATATCGGGGCC AAGGGACAAATGGTCACCGTCTCTTCA<br><br>SEQ ID NO: 32061 |
| | | AA | EIVLTQSPGTLSLFPGERATLSCRASQSVISSYLA WYQQKPGQAPRLLIFGVSSWATGIPDRFSGSGSG TDFTLTISRLEPEDFAVYYCQQYGRSPFNFGPGT KVDIK<br><br>SEQ ID NO: 28056 | QVQLQESGPGLVKPSQTLSLNCTVSGGSISNSGYY WSWIRQHPGKGLEWIGYSYSYSGSTYYNPSLKSRITI SVDTSNNQFSLKLSSVTAADTAVYYCARGGYNWN HAFDIWGQGTMVTVSS<br><br>SEQ ID NO: 32062 |
| iPS:443003 | 21-225_43F11_LC2 | NA | CAGTCTGTGCTGACGCAGCCGCCCTCAGTGTC TGGGGCCCCAGGGCAGAGGGTCACCATCTCCT GCACTGGGAGCAGCTCCAACATCGGGGCAGG TTATGATGTACACTGGTACCAGCAGCTTCCAG GAACAGGCCCCAAACTCTCATCTATGGTAAC AGCAATCGGCCCTCAAGTCTGGCACCTCAGCCTCCCT CTCTGGCTCCAAGTCTGGCACCTCAGCCTCCCT GGCCATCACTGGGCTCCAGGCTGAGGATGAGG CTGATTATTACTGCGCAGTCTGTATGACAACAGC CTGAGTGGTTCGGTATTCGGCGGAGGGACCAA GCTGACCGTCCTA<br><br>SEQ ID NO: 28057 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGCC TTGAGTGGATGGGATGGATCAACCCTAACAGTGG TGGCACAAACTATGCACAGGCTCAGTCCATCAACACA GGTCACCATGACCAGGGACACGTCCACGAGCACA GCCTACATGGACCTGAGCAGGCTGAGATCTGAC GACACGGCCGTGTATTACTGTGCGAGAGAGGG AATTACTTCTACAACCACGTTATGGACGTCTGGG GCCAAGGGACCCCGGTCACCGTCTCCTCA<br><br>SEQ ID NO: 32063 |

FIGURE 50
(Continued)

| | | | | |
|---|---|---|---|---|
| | | AA | QSVLTQPPSVSGAPGQRVTISCTGSSSNIGAGYD VHWYQQLPGTAPKLLIYGNSNRPSGVPDRFSGS KSGTSASLAITGLQAEDEADYYCQSYDNSLSGS VFGGGTKLTVL SEQ ID NO: 28058 | QVQLVQSGAEVKKPGASVKVSCKASGYTFTGYYIH WVRQAPGQGLEWMGWINPNSGGTNYAQKFQGGV TMTRLTSINTAYMDLSRLRSDDTAVYYCARGGNYF YNHVMDVWGQGTPVTVSS SEQ ID NO: 32064 |
| iPS:443005 | 21-225_43F11_LC1 | NA | GATGTGTGATGACTCAGTCTCCACTCTCCCTG CCCGTCACCCTTGGACAGCCGGCTCCATCTC CTGCAGGTCTAGTCAAAGCCTCGTATACAGTG ATGGAAACACCTACTTGAATTGGTTTCAGCAG AGGCCAGGCCAATCTCCAAGGCGCCTAATTTA TAAGGTTTCTAACTGGGACTCTGGGGTCCCAG ACAGATTCAGCGGCAGTGGGTCAGGCACTGAT TTCACACTGAAAATCAGCAGGGTGGAGGCTGA GGATGTTGGGGTTTATTACTGCATGCAAGGTA CACACTGGCGCCTCACTTTCGGCGGAGGGACC AAGGTTGGAGATCAAAA SEQ ID NO: 28059 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGCC TTGAGTGGATGGGATGGATCAACCCTAACAGTGG TGGCACAAACTATGCACAGAAGTTTCAGGGCGG GGTCACCATGACCAGGCTCACGTCCATCAACACA GCCTACATGGACCTGAGCAGGCTGAGATCTGAC GACACGGCCGTGTATTACTGTGCGAGAGGAGGG AATTACTTCTACAACCAGTTATGGACGTCTGGG GCCAAGGGACCCCGGTCACCGTCTCCTCA SEQ ID NO: 32065 |
| | | AA | DVVMTQSPLSLPVTLGQPASISCRSSQSLVYSDG NTYLNWFQQRPGQSPRRLIYKVSNWDSGVPDRF SGSGSGTDFTLKISRVEAEDVGVYYCMQGTHWP LTFGGGTKVEIK SEQ ID NO: 28060 | QVQLVQSGAEVKKPGASVKVSCKASGYTFTGYYIH WVRQAPGQGLEWMGWINPNSGGTNYAQKFQGGV TMTRLTSINTAYMDLSRLRSDDTAVYYCARGGNYF YNHVMDVWGQGTPVTVSS SEQ ID NO: 32066 |

FIGURE 50
(Continued)

| | | | |
|---|---|---|---|
| iPS:443006 | 21-225_25A4.001.029 | NA | GACATCGTGATGACCCAGTTTCCAGACTCCCT GGCTGTGTCTCTGGGCGAGAGGGCCACCATCA AGTGTAAGTCCAGCCAGAGTGTTTATACAGC TCCCACACAATAAACAACTACTTAGCTTGGTACCA GCAGAAACCAGGACAGCCTCCTAAGTTGCTCC TTTACTGGGCATCTACCCGGGAATCCGGGGTC CCTGACCGATTCAGTGGCAGCGGGTCTGGGAC AGAATTCACTCTCACCATCAGCAGCCTGCAGG CTGAAGATGTGGCAGTTTATTACTGTCAGCAG TATTATAGTACTCCTCCGACGTTCGGCCAAGG GACCAAGGTGGAAATCAAA SEQ ID NO: 28061 |
| | | AA | DIVMTQFPDSLAVSLGERATIKCKSSQSVLYSSH NNNYLAWYQQKPGQPPKLLLYWASTRESGVPD RFSGSGSGTEFTLTISSLQAEDVAVYYCQQYYST PPTFGQGTKVEIK SEQ ID NO: 28062 |
| | | NA | CAGGTGCTCCTGGTGCAGTCTGGGGCTGAGGTGA AGAGGCCTGGGGCTCAGTGAAGGTCAGCTGCA AGGCTTCTGGATACACCTTCACCAATTATGATAT TAATTGGGTGCGACAGGCCACTGGACAAGGCT TGAGTGGATGGGATGGATGTACCCTAACAGTGGT CAAACAGGCTATGCACAGAAATTCAGGGCAGA GTCACCATGACCAGGGACACCTCCATCAGCACA GCCTACATGGAGCTGAGCAGCCTGAGATCTGAG GACACGGCCGTCTATTACTGTGCGAGTAGCAGTG GCTGGTACTACTTTGACTACTGGGGCCAGGGAAC CCTGGTCACCGTCCTCA SEQ ID NO: 32067 |
| iPS:443016 | 21-225_4H6.014 | AA | QVLLVQSGAEVKRPGASVKVSCKASGYTFTNYDIN WVRQATGQGLEWMGWMYPNSGTGYAQKFQGR VTMTRDTSISTAYMELSSLRSEDTAVYYCASSSGW YYFDYWGQGTLVTVSS SEQ ID NO: 32068 |
| | | NA | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCCACAGAAGTTTCAGGCAGG GGCACAAACTATGCACAGAAGTTTCAGGCAGG GTCACCATGACCAGGGACACGTCCATCAGCACA GCCTACATGGGGCTGAGCAGTCTGAGATCTGACG ACACGGCCGTGTATTACTGTGCGAGAGATGCTAC CAGCTCGTTTGACTACTGGGGCCAGGGAACCCTG GTCACCGTGTCCTCA SEQ ID NO: 32069 |
| | | | SEQ ID NO: 28063 |

FIGURE 50
(Continued)

| | | | | |
|---|---|---|---|---|
| iPS:443027 | 21-225_7E11.001.023 | AA | DIQMTQSPSSVSASVGDRVTITCRASQGISRWLA WYQQKPGKAPKLLIYGASSLQSGVPSRFSGSGS GTDFTLTISSLQPEDFATYYCQQANSFPFTFGPGT KVDIK<br>SEQ ID NO: 28064 | QVQLVQSGAEVKKPGASVKVSCKASGYTFTDYYL HWVRQAPGQGLEWMGWIHPNSGGTNYAQKFQGR VTMTRDTSISTAYMGLSSLRSDDTAVYYCARDATS SFDYWGQGTLVTVSS<br>SEQ ID NO: 32070 |
| | | NA | GACATCCAGATGACCCAGTCTCCATCCCCT GTCTGCATCTGTAGGAGACAGAGTCACCATTG CTTGCCGGGCAAGTCAGGGCATTAGCTAT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGGGACCAAGGTGGAGATCA AA<br>SEQ ID NO: 28065 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATCTGGCATGATGCAAGT AATAAATACTATGCAGACGCCGTGAAGGGCCGA TTCACCATCTCCAGAGACAATTCCAAAAACGC TGTATCTGCAAATGAGCAGCCTGCGAGCGAGG ACACGGCTGTGTATTACTGTGCGAGAGATCTGAG TATGGGCGGTATGGACGTCTGGGGCCAAGGGAC CACGGTCACCGTGTCCTCA<br>SEQ ID NO: 32071 |
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK<br>SEQ ID NO: 28066 | QVQLVESGGGVVQPGRSLRLSCAASGFTFSSFGMH WVRQAPGKGLEWVAIIWHDASNKYYADAVKGRF TISRDNSKNTLYLQMSSLRAEDTAVYYCARDLSMG GMDVWGQGTTVTVSS<br>SEQ ID NO: 32072 |

FIGURE 50
(Continued)

| | | | | |
|---|---|---|---|---|
| iPS:446086 | 21-225_94D8 | NA | GACATCGTGTTGACCCAGTCGCCAGACTCCT GGCTGTGTCTCTGGGCGAGAGGGCCACCATCA ACTGCAAGTCCAGACAGAGTGTTTATACAGC TCCAACAATTACAACTACTTAACTTGGTACCA GCAGAAACCAGGACAGCCTCCTAAGCTGCTCA TTTACTGGGCATCTACCCGGAATCCGGGGTC CCTGACCGATTCAGTGGCAGCGGGTCTGGAC AGATTTCACTCTCACCATCAGCAGCCTGCAGG CTGAAGAGCGTGGCAGTTTATTACTGTCAGCAA TATTATAGTTCTCCTCCTACTTTCGGCGGAGGG ACCAAGGTGGAGATCAAA | CAGGTGCAGCTGGTGCAGTCTGGGGCTGAGGTG AAGAAGCCTGGGGCCTCAGTGAAGGTCTCCTGC AAGACTTCTGGATACACCTTCACCAATTATGATA TCAACTGGGTGCGACAGGCCACTGGACAAGGC TTGAGTGGATGGGATGGATGAACCCTAACAGTG GTAACACAGGCTATGCACAGAAGTTCCAGGTCA GAGTCACCATGACCAGGAACACCTCCATAAGCA CAGCCTACATGGAGGTGAGCAGCCTGAGATCTG AGGACACGGCCGTCTATTACTGTGCGTATAGCAG TGGCTGGTACATCTTTGACTACTGGGGCCAGGGA ACCCTGGTCACCGTCTCTTCA |
| | | | SEQ ID NO: 28067 | SEQ ID NO: 32073 |
| | | AA | DIVLTQSPDSLAVSLGERATINCKSRQSVLYSSN NYNYLTWYQQKPGQPPKLLIYWASTRESGVPDR FSGSGSGTDFTLTISSLQAEDVAVYYCQQYYSSP PTFGGGTKVEIK | QVQLVQSGAEVKKPGASVKVSCKTSGYTFTNYDIN WVRQATGQGLEWMGWMNPNSGNTGYAQKFQVR VTMTRNTSISTAYMEVSSLRSEDTAVYYCAYSSGW YIFDYWGQGTLVTVSS |
| | | | SEQ ID NO: 28068 | SEQ ID NO: 32074 |
| iPS:446094 | 21-225_77E1 | NA | GACATCGTGATGACCCAGTCTCCAGACTCCT GGCTGTGTCTCTGGGCGAGAGGGCCACCATCA ACTGCAAGTCCAGCAGCAGTGTCTTACACAGC TCCAACAATTATAACTACTTAGCTTGGTACCA GCAGAAAGCCAGGACAGCCCCCTAAGGTGCTC ATTTACTGGGCATCTACCCGGAATCCGGGGT CCATGACCGATTCAGTGGCAGCGGGTCTGGGA CAGATTTCACTCTCACCATCAGCAGCCTGCAG GCTGAAGATGTGGCAGTTTATTACTGTCACCA ATATCTTAGTAGTCCTCTGACGTTCGGCCAAG GGACCAAGGTGGAAATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCCCAATTATGATA TCAACTGGGTGCGACAGGCCACTGGACAAGGC TTGAGTGGATGGGATGGATGAACAGAAGTTCCAGGCA GTAACACAGGCTATGCACCAGGAACACCTCCAGGCA GAGTCACCATGACCAGGAACACCTCCATAAGCA CAGCCTACATGGAGCTGAGCAGCCTGAGATCTG AGGACACGGCCGTGTATTATTGTGCGGTTTCCAG TGGCTGGCACTGGTTCGACCCCTGGGGCCAGGGA ACCCTGGTCACCGTCGCCTCA |
| | | | SEQ ID NO: 28069 | SEQ ID NO: 32075 |

FIGURE 50
(Continued)

| | | | |
|---|---|---|---|
| iPS:448904 | 21-225_65C12 | AA | DIVMTQSPDSLAVSLGERATINCKSSQTVLHSSN NYNYLAWYQQKPGQPPKVLIYWTSTRESGVHD RFSGSGSGTDFTLTISSLQAEDVAVYYCHQYLSS PLTFGQGTKVEIK<br>SEQ ID NO: 28070 | QVQLVQSGAEVKKPGASVKVSCKASGYTFPNYDIN WVRQATGQGLEWMGWMNPNSGNTGYAQKFQGR VTMTRNTSISTAYMELSSLRSEDTAVYYCAVSSGW HWFDPWGQGTLVTVAS<br>SEQ ID NO: 32076 |
| | | NA | GAGATAGTGACGCAGTCTCCAGCCACCCT GTCTGTGTTTCCAGGGAAGGAGCCAGCCCTCT CCTGCAGGGCCAGTCAGTGTTAGCATCAAC TTAGCCTGGTACCAGCAGAAACCTGGCCAGGC TCCCAGACTCCTCATCTATGTGCATCACCA GGGCCACTGGTATCCCAGCCAGGTTCAATGCC AGTGGGTCTGGGACAGAGTTCACTCTCCAT CAGCAGCCTGCAGTCTGAAGATATATACCTGCCTC ATTACTGTCAGCAGCAGTATATACCTGCCTC ACTTTCGGCGGAGGGACCAAGGTGGAAATCA AA<br>SEQ ID NO: 28071 | GAGGTGCAGCTGGTGGAGTCTGGGGGAGGCTG GTCAAGCCTGGGGGGTCCCTGAGACTCTCCTGTG CAGCCTCTGGATTCACCTTCAGGAGCTTTAGCTT GAACTGGGTCCGCCAGGCTCCAGGGAAGGGCT GGAGTGGGTCTCATCATTAGTAGTAGTAGTAGT TACATATACTACGCAGACTCAGTGAAGGCCGAT TCACCATCTCCAGAGACAACAGCCAAGAACTCACT GTATCTGCAAATGAACAGCCTGAGAGCCGAGGA CACGGCTGTGTATTACTGTGCGAGAGATGCGTAT AGCCACTACTGGGGCCAGGGAACCCTGGTCACC GTCTCCTCA<br>SEQ ID NO: 32077 |
| | | AA | EIVMTQSPATLSVFPGEGATLSCRASQSVSINLA WYQQKPGQAPRLLIYGASTRATGIPARFNASGS GTEFTLSISSLQSENFAVYYCQQYNTWPLTFGGG TKVEIK<br>SEQ ID NO: 28072 | EVQLVESGGGLVKPGGSLRLSCAASGFTFRSFSLN WYRQAPGKGLEWVSSISSSSYIYYADSVKGRFTIS RDNAKNSLYLQMNSLRAEDTAVYYCARDAYSHY WGQGTLVTVSS<br>SEQ ID NO: 32078 |

FIGURE 50
(Continued)

| | | | |
|---|---|---|---|
| iPS:448906 | 21-225_72G9 | NA | GACATCCAGATGACCCAGTCTCCATCCTCCCT GTCTGCATCTGTAGGAGACAGAGTCACCATCA CTTGCCGGGCAAGTCAGAGCATTACCAGCTAT TTAAATTGGTATCAGCAGAAACCAGGGAAAG CCCCTAAGCTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTCACAGTTTCCCATTC ACTTTCGGCCCTGGGACCAAAGTGGATATCAA A | GAGGTGCAGCTGGTGGAGTCTGGGGGAGGCTG GTCAAGCCTGGGGGGTCCCTGAGACTCTCCTGTG CAGCCTCTGGATTCACCTTCAGTAGTTATAGCAT GAACTGGGTCCGCCAGGCTCCAGGGAAGGGGCT GGAGTGGGTCTCATCCATTAGTGGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTCTGTGCGAGAGGGGTTCG AGGGGGTTCGACCCTGGGGCCAGGGAACCCTG GTCACCGTCTCCTCA |
| | | | SEQ ID NO: 28073 | SEQ ID NO: 32079 |
| | | AA | DIQMTQSPSSLSASVGDRVTITCRASQSITSYLN WYQQKPGKAPKLLIYTASSLQSGVPSRFSGSGSG TDFTLTISSLQPEDFATYCQQSHSFPFTFGPGTK VDIK | EVQLVESGGGLVKPGGSLRLSCAASGFTFSSYSMN WVRQAPGKGLEWVSSISGSSSYIYYADSVKGRFTIS RDNAKNSLYLQMNSLRAEDTAVYFCARGGSRGFD PWGQGTLVTVSS |
| | | | SEQ ID NO: 28074 | SEQ ID NO: 32080 |
| iPS:448908 | 21-225_50G9 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TGCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTGCGGAACAGCCGGAGGCTGATGAGGCTGAATATT ACTGTCAGGCGCGGAACAGCCTGACGTCCTA ATTCGGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGCCTCCGGATTCATCTTCAGTAGCTATGGCAT GCACTGGGTCCGCCAGGCTCCAGGCAAGGGGCT GGAGTGGGTGGCAGTTATATCACAAGATGGAATT ATTAGATACTATGCAGACTCCGTGAAGGGCCGAT TCACCATCTCCAGAGACAATTCCAAGAACACGCT GTATCTGCAAATGAACAGCCTGAGAGCTGAGGA CACGGCTGTGTATTACTGTGCGAGAGATGTGAAG CAGTGGCTGGTACGGACCTACGGTATGGACGTCT GGGGCCAAGGGACCACGGTCACCGTCTCCTCA |
| | | | SEQ ID NO: 28075 | SEQ ID NO: 32081 |

FIGURE 50
(Continued)

| | | | | |
|---|---|---|---|---|
| iPS:451102 | 21-225_45F6 | AA | SYELTQPPSVSVSPGQTASITCSGDKLGDKYACW YQQKPGQSPVLVIYQDSKRPSGIPERFSGSNSGN TATLTISGTQARDEAEYYCQARNSRRGVFGGGT RLTVL<br><br>SEQ ID NO: 28076 | QVQLVESGGGVVQPGRSLRLSCAASGFIFSSYGMH WVRQAPGKGLEWVAVISQDGIIRYYADSVKGRFTI SRDNSKNTLYLQMNSLRAEDTAVYYCARDVKQW LVRTYGMDVWGQGTTVTVSS<br><br>SEQ ID NO: 32082 |
| | | NA | TCCTATGAGCTGACTCAGCCACCCTCAGTGTC CGTGTCCCCAGGACAGACCGCCAGCATCACCT GCTCTGGAGATAAATTGGGGGATAAATATGCT TCCTGGTATCAGCAGAAGCCAGGCCAGTCCCC TGTGCTGGTCGTCATCTATCAAGATAGTAAGCGGC CCTCAGGGATCCCTGAGCGATTCTCTGGCTCC AACTCTGGAAACACAGCCACTCTGACCATCAG CGGGACCCAGGCTATGGATGAGGCTGAATATT ACTGTCAGGCGTGGGACAACAGAACTATGGTA TTCGGCGGAGGGACCAAGCTGACCGTCCTA<br><br>SEQ ID NO: 28077 | CAGGTGCAGCTGGTGGAGTCTGGGGGAGGCGTG GTCCAGCCTGGGAGGTCCCTGAGACTCTCTGTG CAGCCTCTGGATTCACCTTCAGTTACTATGGCTT GCACTGGGTCCGCCAGGCTCCAGGCAAGGGGCT GGAGTGGGTGGCAGTTATATCATATGATGAAGT AATAAATATTATGCAGACTCCGTGAAGGGCCGAT TCACCATCTCAGAGACAATTCCAAGAACACGCT GTATCTGCAAATGAACAACCTGAGAGCTGAGGA CACGGCTGTGTTTTACTGTGCGAGAGAGGATGA TATTGTAGTGGTACCAGCTGCCCTACTACTACT ACTACGGTATGGACGTCTGGGGCCAAGGGACCA CGGTCACCGTCTCCTCA<br><br>SEQ ID NO: 32083 |
| | | AA | SYELTQPPSVSVSPGQTASITCSGDKLGDKYASW YQQKPGQSPVLVIYQDSKRPSGIPERFSGSNSGN TATLTISGTQAMDEADYYCQAWDNRTMVFGGG TKLTVL<br><br>SEQ ID NO: 28078 | QVQLVESGGGVVQPGRSLRLSCAASGFTFSYYGLH WVRQAPGKGLEWVAVISYDGSNKYYADSVKGRFT ISRDNSKNTLYLQMNNLRAEDTAVFYCAREDRYCS GTSCPYYYYGMDVWGQGTTVTVSS<br><br>SEQ ID NO: 32084 |

FIGURE 50
(Continued)

| | | | |
|---|---|---|---|
| iPS:451104 | 21-225_49C5 | NA | CAGTCTGTGCTGACTCAGCCACCCTCAGCGTC TGGGACCCCCGGGCAGAGAGGGTCACCATCTCT TGTTCTGGAAGCAGCTCCAACATCGGAAGTAAT ATTGTGACCTGGTACCAGCAGCTCCCAGGAAC GGCCCCAAACTCCTCATCTATAGTAATGATC AGCGGCCCTCAGGGGTCCCTGACCGATTCTCT GGCTCCAAGTCTGGCACCTCAGCCTCCCTGGC CATCAGTGGGCTCCAGTCTGAGGATGAGGCTG ATTATTACTGTACAGCATGGGATGACAGCCTG AATGGTTGGGTGTTCGGCGGAGGGACCACGCT GACCGTCCTA<br><br>SEQ ID NO: 28079 | CAGGTTCAGCTGGTGCAGTCTGGAGCTGAGGTGA AGAAGCCTGGGGCCTCAGTGAAGGTCTCCTGCA AGGCTTCTGGTTACACCTTTAACAGCTATGGTAT ACGCTGGGTGCGACAGGCCCCTGGACAAGGGCT TGAGTGGATGGGATGGATCAGCGTTATAATGGT AACACAAAGTATGCACAGAAGCTCCAGGGACAGA GTCACCATGACCACAGACACATCCACGAGCACA GCCTACATGGAGCTGAGGAGCCTGAGATCTGAC GACACGGCCGTGTATTACTGTGCGAGACACGATT TTTGGAGTGGTTATTATAAGGTATGGACGTCTG GGGCCAAGGGACCACGGTCACCGTCCTCA<br><br>SEQ ID NO: 32085 |
| | | AA | QSVLTQPPSASGTPGQRVTISCSGSSSNIGSNIVT WYQQLPGTAPKLLIYSNDQRPSGVPDRFSGSKS GTSASLAISGLQSEDEADYYCTAWDDSLNGWVF GGGTTLTVL<br><br>SEQ ID NO: 28080 | QVQLVQSGAEVKKPGASVKVSCKASGYTFNSYGIS WVRQAPGQGLEWMGWISAYNGNTKYAQKLQGR VTMTTDTSTSTAYMELRSLRSDDTAVYYCARHDF WSGYYKGMDVWGQGTTVTVSS<br><br>SEQ ID NO: 32086 |
| iPS:451106 | 21-225_49D10 | NA | CAGTCTGTGCTGACTCAGCCACCCTCAGCGTC TGGGACCCCCGGGCAGAGAGGGTCACCATCTCT TGTTCTGGAAGCAGCAACTCCAACATCGGAAGTAAT ATTGTAACCTGGTACCAGCAGCTCCCAGGAAC GGCCCCCAAACTCCTCATCTATAGTAATGATC AGCGGCCCTCAGGGGTCCCTGACCGATTCTCT GGCTCCAAGTCTGGCACCTCAGCCTCCCTGGC CATCAGTGGGCTCCAGTCTGAGGATGAGGCTG ATTATTACTGTGCAGCATGGGATGACAGCCTG AATGGTTGGGTGTTCGGCGGAGGGACCACGCT GACCGTCCTA<br><br>SEQ ID NO: 28081 | CAGGTTCAGCTGGTGCAGTCTGGAGCTGAGGTGA AGAAGCCTGGGGCCTCAGTGAAGGTCTCCTGCA AGGCTTCTGGTTACACCTTTAACAGCTATGGTAT CAGCTGGGTGCGACTGGCCCCTGGACAAGGGTTT GAGTGGATGGGATGGATCAGCGTTATAATGGTA ACACAAAGAATGCACAGAAGCTCCAGGGCAGAG TCACCATGACCACAGACACATCCACGAGCACAG CCTACATGGAGCTGAGGAGCCTGAGATCTGACG ACACGGCCGTTTATTACTGTGCGAGACACGATTT TTGGAGTGGTTATTATAAGGTATGGACGTCTGG GGCCAAGGGACCACGGTCACCGTCCTCA<br><br>SEQ ID NO: 32087 |

FIGURE 50
(Continued)

| | | | |
|---|---|---|---|
| iPS:451108 | 21-225_53E8 | AA | QSVLTQPPSASGTPGQRVTISCSGSNSNIGSNIVTWYQQLPGTAPKLLIYSNDQRPSGVPDRFSGSKSGTSASLAISGLQSEDEADYCAAWDDSLNGWVFGGGTLTVL<br>SEQ ID NO: 28082 | QVQLVQSGAEVKKPGASVKVSCKASGYTFNSYGISWVRLAPGQGFEWMGWISAYNGNTKNAQKLQGRVTMTTDTSTSTAYMELRSLRSDDTAVYYCARHDFWSGYYKGMDVWGQGTTVTVSS<br>SEQ ID NO: 32088 |
| | | NA | CAGTCTGTGCTGACTCAGCCACCCTCAGCGTCTGGGACCCCCGGGCAGAGGGTCACCATCTCTTGTTCTGGAAGCTGCTCCAACATCGGAAGTAATATTGTGACCTGGTACCAGCAGCTCCCAGGAACGGCCCCAAACTCCTCATCTATAGTAATGATCAGCGGCCCTCAGGGGTCCCTGACCGATTCTCTGGCTCCAAGTCTGGCACCTCAGCTCCCTGGCCATCAGTGGGCTCAGTCTGAGGATGACAGCTGATTATTACTGTGCAGCATGGGATGACAGCCTGAATGGGGTGTTCGGCGGAGGGACCACGCTGACCGTCCTA<br>SEQ ID NO: 28083 | CAGGTTCAGCTGGTGCAGTCTGGAGCTGAGGTGAAGAAGCCTGGGGCCTCAGTGAAGGTCTCCTGCAAGGCTTCTGGTTACACCTTTAACAGTATGGTATCAGCTGGGTGCGACAGGCCCCTGACAAGGGCTTGAGTGGATGGATGGATCAGCGCTTATAATGGTAACACAAAGTTTGCACAGAAGTCCAGGCAGAGTCACCATGACCACAGACACATCCACGAGCACAGCCTACATGGAACTGAGGAGCCTGAGATCTGACGACACGGCCGTGTATTACTGTGCGAGACGATTTTTGGAGTGGTTATTATAAGGGTATGGACGTCTGGGGCCAAGGGACCACGGTCACCGTCTCCTCA<br>SEQ ID NO: 32089 |
| | | AA | QSVLTQPPSASGTPGQRVTISCSGSCSNIGSNIVTWYQQLPGTAPKLLIYSNDQRPSGVPDRFSGSKSGTSASLAISGLQSEDEADYYCTAWDDSLNDWVFGGGTLTVL<br>SEQ ID NO: 28084 | QVQLVQSGAEVKKPGASVKVSCKASGYTFNSYGISWVRQAPGQGLEWMGWISAYNGNTKFAQKLQGRVTMTTDTSTSTAYMELRSLRSDDTAVYYCARHDFWSGYYKGMDVWGQGTTVTVSS<br>SEQ ID NO: 32090 |

FIGURE 50
(Continued)

| | | | |
|---|---|---|---|
| iPS:451110 | 21-225_74C9 | NA | TCTTATGAGCTGACTCAGCCACCCTCAGAGTC TGTGTCCCAGGAGACAGCCAGCATCACCT GCTCAGGAGATAAATCGGGAATAAATATGTT TCCTGGTATCAGCAGAAGCCAGGCCAGTCCCC TGTGCTGGTCATCTATCAAGATAACAGGCGGC CGTCAGGGATCCCTGAGCGATTTCTGGCTCC AACTCTGGGAGCACAGCCACTTTGACCATCAG CGGGACCCAGGCTATGGATGAGGCTGACTATT ACTGTCAGGCGTGGGACAGCAAGCTGACCGTCCTA TTCGGCGGAGGGACCAAGCTGACCGTCCTA<br><br>SEQ ID NO: 28085 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAAT AATAAATCTATGCAGACTCCGTGAAGGGCCGAT TCACCATCTCCAGAGACATTTCCAAAACACGCT GTATCTGCAAATGAACAGCCTGAGAGCCGAGGA CACGGCTGTGTATTACTGTGCGAGGGATCGAGAT TATTGTAGTAGTACCAGCTGCCCTTATTATTACTA CTACGGTATGGACGTCTGGGGCCAAGGGACCAC GGTCACCGTCTCCTCA<br><br>SEQ ID NO: 32091 |
| | | AA | SYELTQPPSESVSPGQTASITCSGDKSGNKYVSW YQQKPGQSPVLVIYQDNRRPSGIPERFSGSNSGS TATLTISGTQAMDEADYYCQAWDSTPVIFGGGT KLTVL<br><br>SEQ ID NO: 28086 | QVQLVESGGGVVQPGRSLRLSCAASGFTFSSYGMH WVRQAPGKGLEWVAVIWYDGNNKSYADSVKGRF TISRDISKNTLYLQMNSLRAEDTAVYYCARDRDYC SSTSCPYYYYYGMDVWGQGTTVTVSS<br><br>SEQ ID NO: 32092 |
| iPS:451112 | 21-225_53D10 | NA | TCCTATGAGCTGACTCAGCCACCCTCAGTGTC CGTGTCCCCAGGACAGACAGCCAGCATCACCT GCTCTCGGAGATAAATTGGGGAATAAATATGCT TGCCTGGTATCAGCAGAAGCCAGGCCAGTCCCC TGTGCTGGTCATCTATCAAGATCGCAAGCGGC CCTCAGGGATCCCGAGCGATTCTCTGGCTCC AACTCTGGGAACACAGGCTATGGATGAGGCTGACTCAG CGGGACCCAGGCTATGGATGAGGCTGACTATT ACTGTCAGGCGTGGGACAGCAGCACTGTGGTA TTCGGCGGAGGGACCAAGCTGACCGTCCTA | CAGGTGCAGTTGGTGCAGTCTGGGGCTGAGGTGA AGAAGCCTGGGGCCTCAGTGAAGGTCTCCTGCA AGGCTTCTGGATACATTTTCACCGGCTACTATAT ACACTGGGTGCGACAGGCCCCTGGACAAGGGCT TGAGTGGATGGATGGATCAACCCTAACAGTGGT GGCACAAACTATGCACAGAAGTTTCAGGGCAGG GTCACCATGACCAGGGACACGGTCCATCAGCACA GCCTACATGGAGCTGATCAGGCTGAGATCTGACG ACACGGCCGTGTATTATTGTGCGAGAGAAAACG AAAGTCTAGCAACTCGTCCTTTCTACGACTACTA CGGTATGGACGTCTGGGGCCAAGGGACCACGGT CACCGTCTCCTCA |

FIGURE 50
(Continued)

| | | | | SEQ ID NO: 28087 | SEQ ID NO: 32093 |
|---|---|---|---|---|---|
| iPS-451114 | 21-225_159A3 | | AA | SYELTQPPSVSVSPGQTASITCSGDKLGNKYACW YQQRPGQSPVLVIYQDRKRPSGIPERFSGSNSGN TATLTISGTQAMDEADYYCQAWDSSTVVFGGG TKLTVL | QVQLVQSGAEVKKPGASVKVSCKASGYIFTGYYIH WVRQAPGQGLEWMGWINPNSGGTNYAQKFQGRV TMTRDTSISTAYMELIRLRSDDTAVYYCARENESLA TRPFYDYGMDVWGQGTTVTSS |
| | | | | SEQ ID NO: 28088 | SEQ ID NO: 32094 |
| | | | NA | GACATCCAGATGACCCAGTCTCCATCTCCCT GTCTGCATCTGTAGGAGACAGAGTCACCATCA CTTGCCGGGCAAGTCAGGACATTAGAAGGAT TTAGGCTGGTATCAGCAGAAACCAGGGAAAG CCCCTAACCGCCTGATCTATGCTGCATCCAGTT TGCAAAGTGGGGTCCCATCAAGGTTCAGCGGC AGTGGATCTGGGACAGAATTCACTCTCACATT CAGCAGCCTGCAGCCTGAAGATTTTGCAACTT ATTACTGTCTACAGCATCATAGTTATCCTCGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTTAGTGACTATGTCAT GCAGCTGGGTCCGCCAGGCTCCAGGCAAGGGCT GGAGTGGGTGGCAGTTATATCAGACTCCGTGAAGT AATAAATACTATGCAGAGACTCCGTGAAGGGCCGA TTCACCATCTGCAAATGAACAGCCTGAGAGCCGAGG TGTATCTGCAAATGAACAGCCTGAGAGCCGAGG ACACGGCTGTGTATTACTGTGCGAGAGAAACCGTA TAATAGTGGCTGGTACGACTACGGTATGGACGTC TGGGGCCAAGGGACCACGGTCACCGTCTCCTCA |
| | | | | SEQ ID NO: 28089 | SEQ ID NO: 32095 |
| | | | AA | DIQMTQSPSSLSASVGDRVTITCRASQDIRKDLG WYQQKPGKAPNRLIYAASSLQSGVPSRFSGSGS GTEFTLTFSSLQPEDFATYCLQHHSYPRTFGQG TKVEIK | QVQLVESGGGVVQPGRSLRLSCAASGFTFSDYVM QWVRQAPGKGLEWVAVIWYDGSNKYYADSVKGR FTISRDISKNTLYLQMNSLRAEDTAVYYCAREPYNS GWYDYGMDVWGQGTTVTSS |
| | | | | SEQ ID NO: 28090 | SEQ ID NO: 32096 |

FIGURE 50
(Continued)

| | | | |
|---|---|---|---|
| iPS:451116 | 21-225_164A4 | NA | GACATCGTGATGACCCAGTCTCCAGACTCCCG CAGGTGCAGCTGGTGGTGCAGTCTGGGGCTGAGGTG GGCTGTGTCTCTGGGCGAGAGGGCCACCATCA AAGAAGCCTGGGGCCTCAGTGAAGGTCTCCTGC AGTGCAAGTCCAGCCAGAGTGTTTTATACAGC AAGGCTTCTGGATTCACCTTCCCAATTATGATA TCCAACAATAAGAACTACTTAACTTGGTACCA TCAACTGGGTGCGACAGGCCACTGGACAAGCC GCAGAAACCAGGACAGCCTCCAAACTGTTCA TTGAGTGGATGGGATGGATGCACCCTAACAGTGG TTTACTGGGCATCTACCCGGGAATCCGGGGTT TAACACAGGCTATGCACAGAAGTTCCAGGCAG CCTGACCGATTCAGTGGCAGCGGGTGTGGGAC AGTCACCATGACCAGGAACACCTCCATAAGCAC AGATTTCACTCTCACCATCAGCAGCGTGCAGG AGCCTACATGGAGCTGAGCAGCCTGAGATCTGA CCGAAGATGTGGCAGTTTATTACTGTCAGCAA GGACACGGCCGTGTATTACTGTGCGAGTAGCAGT TATTTTAGTACTCCGTGGACGTTCGGCCAAGG GGCTGGTACTTCTTTGACTACTGGGGCCAGGGAA GACCAAGGTGGAAATCAAA CCCTGGTCACCGTCTCCTCA SEQ ID NO: 28091 SEQ ID NO: 32097 |
| | | AA | DIVMTQYPDSRAVSLGERATIKCKSSQSVLYSSN QVQLVQSGAEVKKPGASVKVSCKASGFTFPNYDIN NKNYLTWYQQKPGQPPKLFIYWASTRESGVPDR WVRQATGQLEWMGWMHPNSGNTGYAQKFQGR FSGSGGTDFTLTISSVQAEDVAVYYCQQYFSTP VTMTRNTSISTAYMELSSLRSEDTAVYYCASSSGW WTFGQGTKVEIK YFFDYWGQGTLVTVSS SEQ ID NO: 28092 SEQ ID NO: 32098 |
| iPS:451118 | 21-225_191C8 | NA | GAAATAGTGATGACCCAGTCTCCAGCCACCCT CAGGTGCAGCTGCAGGAGTCGGGCCCAGGACTG GTCTGTCTCCAGGGGAAAGAGCCACCCTCT GTGAAGCCTTCGGAGACCCTGTCCCTCACCTGCA CCTGCAGGGCCAGTCAGAGTGTTCGCAGTAAC CTGTCTCTAGTGGCTCCGTCAGCAGTGGTGGTTA TTAGCCTGGTACCAGCAGAAACCTGGCCAGGC CTACTGGAGCTGGATCCGGCAGCCCCCAGGGAA TCCCAGGCTCCTCATCTATGGTGCATCCACCA GGGACTGGAGTGGATTGGGTATATCTATTACAGT GGGCCACTGGTATCCCAGCCAGGTTCAGTGGC GGGACCACCATTTACAACCCCTCCCTCAAGAGTC AGTGGGTCTGGGACAGAATTCACTCTCACCAT GAGTCACCATATCAGTAGACACGTCCAAGAACC CAGCAGCCTTGCAGTCTGAAGATTTTGCAGTT AGTTCTCCCTGAAGCTGACCTCTGTGACCGTTGC ATTACTGTCAGCAGTCTTTTACCTGGCTCCGGA GGACACGGCCGTGTATTACTGTGCGGAGACAC CGTTCGGCGGAGGGACCAAGGTGGAAATCAA GTTTTGCTTTGATGGTGTGGTTATTCTTTGACT A CCTGGGGCCAGGGAACCCTGGTCACCGTCTCCTC A SEQ ID NO: 28093 SEQ ID NO: 32099 |

FIGURE 50
(Continued)

| | | | |
|---|---|---|---|
| iPS:451120 | 21-225_197D3 | AA | EIVMTQSPATLSVSPGERATLSCRASQSVRSNLA WYQQEPGQAPRLLIYGASTRATGIPARFSGSGSG TEFTLTISSLQSEDFAVYYCQQSFTWLRTFGQGT KVEIK<br><br>SEQ ID NO: 28094 | QVQLQESGPGLVKPSETLSLTCTVSSGSVSSGGYY WSWIRQPPGKGLEWIGYIYYSGTTIYNPSLKSRVTIS VDTSKNQFSLKLTSVTVADTAVYYCARDTFCFDGC GYFFDSWGQGTLVTVSS<br><br>SEQ ID NO: 32100 |
| | | NA | GACATCAGATGACCCAGTCTCCATCCTCACT GTCTGCATCTGTAGGAGACAGAGTCACCATCA CTTGTCGGGCGAGTCAGGGCATTAGAAATTAT TTAGCCTGGTTTCAGCAGAAACCAGGGAAAGC CCCTAAGTCCCTGATCTATGCTGCATCCAGTTT GCAAAGTGGGGTCCCCTCAAAGTTCAGCGGCA GTGGATCTGGGACAGATTTCACTCTCACCATC AGCAGCCTGCAGCCTGAAGATTTTGCAACTTA TTACTGCCAACATTATCTTACTTACCCGCTCAC TTTCGGCGGAGGGACCAAGGTGGAGATCAAA<br><br>SEQ ID NO: 28095 | CAGGTGCAGCTGGTGGAGTCTGGGGAGGCGTG GTCCAGCCTGGGAGGTCCCTGAGACTCTCTGTG CAGCGTCTGGATTCATCTTCAGTAGCCATGGCAT GCACTGGGTCGCCAGGCTCCAGGCAAGGGGCT GGAGTGGGTGGCAGTTATATGGTATGATGAAGT AATGAACACTATGCAGACTCCGTGAAGGGCCGA TTCACCATCTCCAGAGACAATTCAAGAAACACGC TGTATCTGCAAATGAACAGCCTGAGAGCCGAGG ACACGGCTGTTTATTACTGTGCGAGAGATCAAGG TGTGGGGTACTACGGTATGGACGTCTGGGGCCAA GGGACCACGGTCACCGTCTCCTCA<br><br>SEQ ID NO: 32101 |
| | | AA | DIQMTQSPSSLSASVGDRVTITCRASQGIRNYLA WFQQKPGKAPKSLIYAASSLQSGVPSKIFSGSGSG TDFTLTISSLQPEDFATYYCQHYLTYPLTFGGGT KVEIK<br><br>SEQ ID NO: 28096 | QVQLVESGGGVVQPGRSLRLSCAASGFIESSHGMH WVRQAPGKGLEWVAVIWYDGSNEHYADSVKGRF TISRDNSKNTLYLQMNSLRAEDTAVYYCARDQGV GYYGMDVWGQGTTVTVSS<br><br>SEQ ID NO: 32102 |

FIGURE 50
(Continued)

| | | | |
|---|---|---|---|
| iPS:451122 | 21-225_200A1 | NA | GAAATTGTGTTGACGCAGTCTCCAGGCATCCT GTCTTTGTATCCAGGGGAAAGAGCCACCCTCT CCTGTAGGGCCAGTCAGAGTGTTAACAGCAAC TATTTAGCCTGGTACCAGCAGAAACCTGGCCA GGCTCCCAGGTCTCCTCATTTATGGGACATCCA GCAGGGCCACTTGCATCCTGGACAGGTTCAGT GGCAGTGGGTGTGGGACAGACTTCACTCTCAC GATCAGCAGACTGGAGCTGAAGATTTTGCAG TGTATTGCTGTCAGCAGTATGAGATCTCACCG TGGACGTTCGGCCAAGGGACCAAGGTGGAAA GCAAA<br>SEQ ID NO: 28097 | CAGGTGCAGCTACAGCAGTGGGGCGCAGGACTG TTGAAGCCTTCGGAGACCCTGTCCCTCACCTGC CTGTCTATGGTGGTCTTCAGTGTTACTATTGG AGCTGGATCCGCCAGCCCCCAGGGAAGGGCTG GAGTGGATTGGGAAATCAATCATAGTGGAAGC ACCAACTACAACCCGTCCCTCAAGAGTCGAGTCA CCATTTCACTAGACACGTCCAAGAACCAGTTCTC CCTGAAGCTGAGCTCTGTGACCGCCGGACACG GCTGTGTATTACTGTGCGAGAGACTACGGTGTCT TTGACTACTGGGGCCAGGGAACCCTGGTCACCGT CTCCTCA<br>SEQ ID NO: 32103 |
| | | AA | EIVLTQSPGILSLYPGERATLSCRASQSVNSNYLA WYQQKPGQAPSLLIYGASSRATGILDRFSGSGCG TDFTLTISRLEPEDFAVYYCQQYEISPWTFGQGT KVESK<br>SEQ ID NO: 28098 | QVQLQQWGAGLLKPSETLSLTCAVYGGSFSVYYW SWIRQPPGKGLEWIGEINHSGSTNYNPSLKSRVTISL DTSKNQFSLKLSSVTAADTAVYYCARDYGVFDYW GQGTLVTVSS<br>SEQ ID NO: 32104 |
| iPS:451124 | 21-225_74F6 | NA | GACATCGTGATGACCCAGTCTCCAGACTCCCT GGCTGTGTCTCTGGGCGAGAGGGCCACCATCA ATTGCAAGTCCAGTCAGAGTATTTATCCAGC TCCAACAATAAGAACTACTTAACTTGGTACCA GCAGAAACCAGGACAGCCTCCTAAAATACTCA TTTACTGGACATCTACCCGGGAATCCGGGGTC CCTGACCGATTCAGTGGCAGCGGGTTTGGGAC AGTTTCACTCTCACCATCAGCAGCCTGCAGG CTGAAGATGTGGCTGTTATTACTGTCAGCAA TATTTAGTGTTCCCTGACGTTCGGCCAAGGG ACCAAGGTGGAAATCAAA<br>SEQ ID NO: 28099 | CAGGTGCAGCTGGTTGCAGTCTGGGGCTGAGGTG AAGAAACCTGGGCCTCAGTGAGGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGCAG AGTCACCATGACCAGGAACACCTCCATGAGCAC AGCCTACATGGAGCTGAGCAGCTGAGATCTGA GGACACGGCCGTGTATTACTGTGCCCATAGCAGT GGCTGGTACTTTTTGACTACTGGGGCCAGGGAA CCCTGGTCACCGTCTCCTCA<br>SEQ ID NO: 32105 |

FIGURE 50
(Continued)

| | | | |
|---|---|---|---|
| iPS:451127 | | AA | DIVMTQSPDSLAVSLGERATINCKSSQNILSSSNN KNYLTWYQQKPGQPPKLILYWTSTRESGVPDRFS GSGFGTDFTLTISSLQAEDVAVYYCQQYFSVPLT FGQGTKVEIK<br>SEQ ID NO: 28100 | QVQLVQSGAEVKKPGASVRVSCKASGYTFTNYDIN WVRQATGQGLEWMGWMHPNSGNTGYAQKFQGR VTMTRNTSMSTAYMELSSLRSEDTAVYYCAHSSG WYFFDYWGQGTLVTVSS<br>SEQ ID NO: 32106 |
| | | NA | GACATCGTGATGACCCAGTCTCCAGACTCCCT GGCTGTGTCTCTGGGCGAGAGGGCCACCATCA ATTGCAAGTCCAGCAGAGTGTTTACACAGC TCCAACAATAACAACTACTTAGCTTGGTACCA GCAGAAACCAGGACAGCCTCATAAGTGCTCA TTTACTGGACATCTCAGTGGCAGCGGGTATGGGAC CCTGACCGATTCTCTGGCAGCGGGTATGGGAC AGATTCTCTCACCATCAGCCAGCCTGCAGG CTGAAGATGTGGCAGTTTATTACTGTCAGCAA TATTATAGTATTCCCTGACGTTCGGCCAAGG GACCAAGGTGGAAATCAAA<br>SEQ ID NO: 28101 | CAGGTGCAGCTGGTGCAGTCTGGGCTGAGGTG AAGAAGCCTGGGCCTCAGTGAAGGTCTCCTGC AAGGCTTCTGGATACACCTTCACCAATTATGATG TCAACTGGGTGCGACAGGCCACTGGACAAGGGC TTGAGTGGATGGGATGGATGCACCCTAACAGTGG TAACACAGGCTATGCACAGAACACCTCCAGGCAG AGTCACCATGAGCCAGAACACCTCCACAAGCTGA AGCCTACATGGAGCTGAGCAGCCTGAGATCTGA GGACTCGGCCGTGTATTACTGTGCGAGTAGCAGT GGCTGGTACCTCTTTGACTACTGGGGCCAGGGAA CCCTGGTCACCGTCTCCTCA<br>SEQ ID NO: 32107 |
| 21-225_164A7 | | AA | DIVMTQCPDSLAVSLGERATINCKSSSQSVLHSSN NNNYLAWYQQKPGQPHKLLIYWTSTRESGVPD RFSGSGYGTDFSLTIASLQAEDVAVYYCQQYYSI PLTFGQGTKVEIK<br>SEQ ID NO: 28102 | QVQLVQSGAEVKKPGASVKVSCKASGYTFTNYDV NWVRQATGQGLEWMGWMHPNSGNTGYAQKFQG RVTMTRNTSTSTAYMELSSLRSEDSAVYYCASSSG WYLFDYWGQGTLVTVSS<br>SEQ ID NO: 32108 |

FIGURE 50
(Continued)

| | | | |
|---|---|---|---|
| iPS:451129 | 21-225_94D2 | NA | GACATCGTGATGACCCAGTCTCCAGACTCCCT GGCTGTGTCTCTGGGCGAGAGGGCCACCATCA ACTGCAAGTCCAGCCAGAGTGTTTTACACAGC TCCAACAATAAGAACTACTTAACTTGGTACCA GCAGAAACCAGGACAGCCTCATAAGCTGCTCA TTTACTGGGCATCTACTCGGGAATCCGGGGTC CCTGACCGATTCAGCGGCAGCGGGTCTGGGAC AGATTTCAGTCTCACGATCGGCAGCCTGCAGC ATGAAGATGTGGCAGTTTATTACTGTCAGCAA TATCATAGTATTCCTCGACGTTCGGCCACGG GACCAAGGTGGAAATCAAA<br><br>SEQ ID NO: 28103 | CAGGTGCAGCTGGTGCAGTCTGGGGCTGAGGTG AAGAAGCCTGGGGCCTCAGTGAAGGTCTCCTGC AAGGCTTCTGGATTCACCTTCACCAATTATGATA TCAACTGGGTGCGACAGGCCACTGGACAAGGGC TTGAGTGGATGGGATGGATGCACCTAACAGTGG TAACACAGGCTTTGCACAGAAGTTCCAGGGCAG AGTCACAATGACCAGGAACACCTCCATAAGCAC AGCCTACATGGAACTGAGCAGCCTGAGATCTGA GGACACGGCCGTGTATTACTGTGCGGTTTCCAGT GGCTGGTACTGGTTCGACCCCTGGGGCCAGGGA ACCCTGGTCACCGTCCTCA<br><br>SEQ ID NO: 32109 |
| | | AA | DIVMTQSPDSLAVSLGERATINCKSSQSVLHSSN NKNYLTWYQQKPGQPHKLLIYWASTRESGVPD RFSGSGSGTDFSLTIGSLQHEDVAVYYCQQYHSI PPTFGHGTKVEIK<br><br>SEQ ID NO: 28104 | QVQLVQSGAEVKKPGASVKVSCKASGFTFTNYDIN WVRQATGQGLEWMGWMHPNSGNTGFAQKFQGR VTMTRNTSISTAYMELSSLRSEDTAVYYCAVSSGW YWFDPWGQGTLVTVSS<br><br>SEQ ID NO: 32110 |
| iPS:451131 | 21-225_160A7 | NA | GACATCGTGCTGACCCAGTCTCCAGACTCCCC GGCTGTGTCTCTGGGCGAGAGGGCCACCATCA ATTGCAAGTCCAGCCAGAGTGTTTTATCCAAC TCCCACAATAACAACTACTTAGCTTGGTACCA GCAGAGACCAGGACATCCTCATAAACTCCTCA TTTTCTGGGCATCTACCCGGGAATCCGGGGTC CCTGACCGATTCAGTGGCAGCGGGTATGGGAC AGATTTCACTCTCACCATCAGCAGCCTGCAGG CTGAAGATGTGGCAGTTTATTACTGTCAGCAA TATTATAGTACTCCGTGCAGTTTGGCCAGGG GACCAAGCTGGAGATCAAA<br><br>SEQ ID NO: 28105 | CAGGTGCAGCTGGTGCAGTCTGGGGCTGAAGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTCACAGTGG TAACACAGGCTATGCACAGAAGTTCCAGGGCAG AGTCACCATGACCAGGAACACCTCCATAAACAC AGCCTACATGGAGCTGAGCAGCCTGAGATCTGA GGACACGGCCGTGTATTACTGTGCCCATAGCAGT GGCTGGTACTACTTTGACTACTGGGGCCAGGGAA CCCTGGTCACCGTCCTCA<br><br>SEQ ID NO: 32111 |

FIGURE 50
(Continued)

| | | | | |
|---|---|---|---|---|
| | | AA | DIVLTQSPDSPAVSLGERATINCKSSQSVLSNSHN NNYLAWYQQRPGHPHKLLIFWASTRESGVPDRF SGSGYGTDFTLTISSLQAEDVAVYYCQQYYSTPC SFGQGTKLEIK<br><br>SEQ ID NO: 28106 | QVQLVQSGAEVKKPGASVKVSCKASGYTFTNYDIN WVRQATGQGLEWMGWMHPHSGNTGYAQKFQGR VTMTRNTSINTAYMELSSLRSEDTAVYYCAHSSGW YYFDYWGQGTLVTSS<br><br>SEQ ID NO: 32112 |
| iPS-451133 | 21-225_95H4 | NA | GACATCGTTATGACCCAGTCTCCAGACTCCCT GGCTGTGTCTGTGGGCGAGAGGGCCACCATCA ATTGCAAGTCCAGCCAGAGTGTTTTAATTCAGC TCCAACAATTATAATTACTTAGCTTGGTACCA GCAGAGACCAGGACAGCCTCATAACCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGCTGATGTGGCAGTTTATTACTGTCAGCAA TATCATAAGTTCTCCTGACGTTCGGCCAAGG GACCAACGGTGCAAATCAAA<br><br>SEQ ID NO: 28107 | CAGGTGCAGTTGGTGCAGTCTGGGGCTGAGGTGA AGAAGCCTGGGGCCTCAGTGAAGGTCTCCTGCA AGGCTTCTGGATACACCTTCACCAATTATGATAT CAACTGGGTGCGACAGGCCACTGGACAAGGCT TGAGTGGATGGGATGGATGCACAGAAGTTCCAGGGCAG TAACACAGGCTATGCACAGAACACTCCACAAGCAC AGCCCACCATGGAGTGAGCAGCCTGAGATCTGA GGACACGGCCGTGTATTACTGTGCGCTCTCCAGT GGCTGGAACTGGTTCGACCCCCTGGTTCTCAGT ACCCTGGTCACCGTCTCCTCA<br><br>SEQ ID NO: 32113 |
| | | AA | DIVMTQCPDSLAVSLGERATINCKSSQSVLFSSN NYNYLAWYQQRPGQPHNLLIYWASTRESGVPD RFSGSGSGTDFTLTISSLQAADVAVYYCQQYHSS PLTFGQGTTVQIK<br><br>SEQ ID NO: 28108 | QVQLVQSGAEVKKPGASVKVSCKASGYTFTNYDIN WVRQATGQGLEWMGWMNPNSGNTGYAQKFQGR VTMTRNTSTAHMELSSLRSEDTAVYYCAVSSGW NWFDPWGQGTLVTSS<br><br>SEQ ID NO: 32114 |

FIGURE 50
(Continued)

| | | | |
|---|---|---|---|
| iPS:437240 | 21-225_84H12 | NA | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGGC TTGAGTGGATGGGATGGCTGAACCCTCACAGTGG TAACACAGGCTATGCACAGAAGTTCCAGGGCAG AATCACCATGACCTGGAACACCTCCATACGCACT GCCTACATGGAGCTGAGCAGCCTGAGATCTGAG GACACGGCCGTGTATTACTGTGCGAGAGGGTTT ACGATATTTTGACTGGTTATTCCCCACTACTAC TACTACGATATGGACGTCTGGGGCCAAGGGACC ACGGTCACCGTCTCCTCA |
| | | | GACATCCAGATGACCCAGTCTCCATCCTACCA GTCTGCATCTGTGGGAGACAGAGTCACCATCA CTTGCCGGGCAAGTCAGGCATTAGAAATGAT CTTGAGGCTGGTTTCAGCAGAAACCAGGGAAAGC CCCTAAGCGCCTGATCTATGCTGCATCCAGTTT GCAAAGTGGGGTCCCATCAAGGTTCAGCGGCA GTGGATCTGGGACAGAATTCACTCTCACAATC AGCAGCCTGCAGCCTGAAGATTTTGCAACTTA TTACTGTTTACAGCATAATGATTACCCATTCAC TTTCGGCCCTGGGACCAAAGTGGATATCAAA | |
| | | | SEQ ID NO: 28109 | SEQ ID NO: 32115 |
| | | AA | DIQMTQSPSYQSASVGDRVTITCRASQGIRNDLG WFQQKPGKAPKRLIYAASSLQSGVPSRFSGSGSG TEFTLTISSLQPEDFATYCLQHNDYPFTFGPGTK VDIK | QVQLVQSGAEVKKPGASVKVSCKASGYTFTSYDIN WVRQATGQGLEWMGWLNPHSGNTGYAQKFQGRI TMTWNTSIRTAYMELSSLRSEDTAVYYCARGFYDI LTGYSPTYYYYDMDVWGQGTTVTVSS |
| | | | SEQ ID NO: 28110 | SEQ ID NO: 32116 |

FIGURE 50
(Continued)

| | | NA | GACATCCAGATGACCCAGTCTCCATCCTCCT GTCTGCATCTGTGGGAGACAGAGTCACCATCA CTTGCCGGGCAAGTCAGGCATTAGAAATGAT TTAGGCTGGTTTCAGCAGAAACCAGGGAAAGC CCCTAAGCGCCTGATCTATGCTGCATCCAGTT GCAAAGTGGGGTCCCATCAAGGTTCAGCGGCA GTGGATCTGGGACAGAATTCACTCTCACAATC AGCAGCCTGCAGCCTGAAGATTTTGCAACTTA TTACTGTCTACAGCATAATGATTACCCATTCAC TTTCGGCCCTGGGACCAAAGTGGATATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGGC TTGAGTGGATGGGATGGCTGAACCCTCACAGTGG TAACACAGGCTATGCACAGAAGTTCCAGGGCAG AATCACCATGACCTGGAACACCTCCATACGCACT GCCTACATGGAGCTGAGCAGCCTGAGATCTGAG GACACGGCCGTGTATTACTGTGCGAGAGGGTTT ACGATATTTGACTGGTTATTCCCCACTACTAC TACTACGATATGGACGTCTGGGGCCAAGGGACC ACGGTCACCGTCTCCTCA |
| | 21-225_75C11 | | SEQ ID NO: 28111 | SEQ ID NO: 32117 |
| iPS:434577 | | AA | DIQMTQSPSSLSASVGDRVTITCRASQGIRNDLG WFQQKPGKAPKRLIYAASSLQSGVPSRFSGSGSG TEFTLTISSLQPEDFATYCLQHNDYPFTFGPGTK VDIK | QVQLVQSGAEVKKPGASVKVSCKASGYTFTSYDIN WVRQATGQGLEWMGWLNPHSGNTGYAQKFQGRI TMTWNTSIRTAYMELSSLRSEDTAVYYCARGFYDI LTGYSPTYYYDMDVWGQGTTVTVSS |
| | | | SEQ ID NO: 28112 | SEQ ID NO: 32118 |

FIGURE 50
(Continued)

| | | | |
|---|---|---|---|
| iPS:435477 | 21-225_154E8 | NA | GACATCCAGATGACCCAGTCTCCATCTTCCGT GTCTGCATCTATAGGAGACAGAGTCACCATCA CTTGTCGGGCGAGTCAGTTATTAGCAGCTGG TTAGCCTGGTATCAGCAGAAACCAGGGAAAG CCCCTAAGCTCCTGATCTATACTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTGTTGTCAACAGGCTAACAGTTCCCGTGG ACGTTCGGCCAAGGGACCAAGGTGGAATTCA AC SEQ ID NO: 28113 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTAGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGATCCACGGTATA GCAGTGGCTGGTACTGGGGCTCACTACTTTGACT ACTGGGGCCAGGGAACCCTGGCCACCGTCTCCTC A SEQ ID NO: 32119 |
| | | AA | DIQMTQSPSSVSASIGDRVTITCRASQFISSWLAW YQQKPGKAPKLLIYTASSLQSGVPSRFSGSGSGT DFTLTISSLQPEDFATYCCQQANSFPWTFGQGTK VEFN SEQ ID NO: 28114 | EVQLLESGGGLVQPGGSLRLSCAASGFTFSSYAMS WVRQAPGRGLEWVSAISGSGGNTFYADSVKGRFTI SRDNSKNTLYLQMNSLRAEDTAVYYCAIHGIAVAG TGAHYFDYWGQGTLATVSS SEQ ID NO: 32120 |
| iPS:434553 | 21-225_76H12 | NA | GACATCCAGATGACCCAGTCTCCATCCTCCCT GTCTGCATCTGTGGGAGACAGAGTCACCATCA CTTGCCGGGCAAGTCAGGGCATTAGAAATGAT TTAGGCTGGTTTCAGCAGAAACCAGGGAAAGC CCCCAAGGCGCTGATCTATGCTGCATCCAGAT TGCAAAGTGGGGTCCCATCAAGGTTCAGCGGC AGTGGATCTGGGACAGATTTCACTCTCACAAT CAGCAGCCTGCAGCCTGAAGATTTTGCAACTT ATTACTGTCTACAGCATAATGATTACCCATTC ACTTTCGGCCCTGGGACCAAAGTGGATATCAA A | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGC TTGAGTGGATGGGATGGTGAACCTCACAGTGG TAACACAGGCTATGCACAGAAGTTCCAGGGCAG AATCACCATGACCTGGAACACCTCCATACGCACT GCCTACATGGAGCTGAGCAGCCTGAGATCTGAG GACACGGCCGTGTATTACTGTGCGAGAGGGTTTT ACGATATTTTGACTGGTTATTCCCCACTACTAC TACTACGATATGGACGTCTGGGGCCAAGGGACC ACGGTCACCGTCTCCTCA |

FIGURE 50
(Continued)

| | | | SEQ ID NO: 28115 | DIQMTQSPSSLSASVGDRVTITCRASQGIRNDLG WFQQKPGKAPKRLIYAASRLQSGVPSRFSGSGS GTEFTLTISSLQPEDFATYYCLQHNDYPFTFGPGT KVDIK | SEQ ID NO: 32121 | QVQLVQSGAEVKKPGASVKVSCKASGYTFTSYDIN WVRQATGQGLEWMGWLNPHSGNTGYAQKFQGRI TMTWNTSIRTAYMELSSLRSEDTAVYYCARGFYDI LTGYSPTYYYDMDVWGQGTTVTVSS |
|---|---|---|---|---|---|---|
| iPS:434927 | 21-225_86E5 | AA | SEQ ID NO: 28116 | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATCACTGTCTACAGCATAATGATTACCCATTC ACTTTCGGCCCTGGGACCAAAGTGGAAATCAA A | SEQ ID NO: 32122 | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGC TTGAGTGGATGGGATGGATGAACCTAACAGTG GTAACACAGGCTATGCACAGAAGTTCCAGGCA GAGTCACCATGACCTGGAACACCTCATACGAC TGCCTACATGGAGCTGAGCAGCCTGAGATCTGAG GACACGGCCGTGTATTACTGTGCGAGAGGGTTT ACGATATTTGACTGGTATTCCCCACCTACTAC TACTACGATATGGACGTCTGGGGCCAAGGGACC ACGGTCACCGTCTCCTCA |
| | | NA | SEQ ID NO: 28117 | DIQMTQSPSSLSASVGDRVTITCRASQGIRNDLG WYQQKPGKAPKRLIYAASSLQSGVPSRFSGSGS GTEFTLTISSLQPEDFATYHCLQHNDYPFTFGPGT KVEIK | SEQ ID NO: 32123 | QVQLVQSGAEVKKPGASVKVSCKASGYTFTSYDIN WVRQATGQGLEWMGWMNPNSGNTGYAQKFQGR VTMTWNTSIRTAYMELSSLRSEDTAVYYCARGFYD ILTGYSPTYYYDMDVWGQGTTVTVSS |
| | | AA | SEQ ID NO: 28118 | | SEQ ID NO: 32124 | |

FIGURE 50
(Continued)

| | | | |
|---|---|---|---|
| iPS:435385 | 21-225_149G7 | NA | GACATCCAGATGACCCAGTCTCCATCTTCCGT GTCTGCATCTGTAGGAGACAGAGTCACCATCA CTTGTCGGGCGAGTCAGTTTATTAGCAGCTGG TTAGCCTGGTATCAGCAGAAACCAGGGAAAG CCCCTAAGTTCCTGATCTATGCTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCGTGG ACGTTCGGCCAAGGGACCAAGGTGGAAATCA AC | GAGGTGCAGCTGTTGGAGTCTGGGGGAGGCTTG GTACAGCCTGGGGGGTCCCTGAGACTCTCCTGTG CAGCCCTGGATTCACCTTTAGCAGTATGCCAT GAGCCTGGGTCCGCCAGGCTCCAGGGAAGGGGCT GGAGTGGGTCTCAGCTATTAGTGGTAGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGATCCACGGTATA GCAGTGGCTGGTACTGGGGCTCACTACTTTGACT ACTGGGGCCAGGGAACCCTGGCCACCGTCTCCTC A |
| | | | SEQ ID NO: 32125 |
| | | SEQ ID NO: 28119 | |
| | | AA | DIQMTQSPSSVSASVGDRVTITCRASQFISSWLA WYQQKPGKAPKFLIYAASSLQSGVPSRFSGSGSG TDFTLTISSLQPEDFATYYCQQANSFPWTFGQGT KVEIN | EVQLLESGGGLVQPGGSLRLSCAASGFTFSSYAMS WVRQAPGKGLEWVSAISGSGGNTFYADSVKGRFTI SRDNSKNTLYLQMNSLRAEDTAVYYCAIHGIAVAG TGAHYFDYWGQGTLATVSS |
| | | | SEQ ID NO: 32126 |
| | | SEQ ID NO: 28120 | |

FIGURE 51 (Table 4)
Standard IgG Antibody Variable Region Protein Alignment
CDRs defined by Kabat
Alignment numbering defined by Amgen Reference (AHo)

| KAPPA_VARIABLE | Germline | SEQ ID NO: | K_FR1 | K_CDR1 | K_FR2 | K_CDR2 | K_FR3 | K_CDR3 | K_FR4 |
|---|---|---|---|---|---|---|---|---|---|
| VK4|B3|JK3 | | | DIVMTQSPDSLAV SLGERATINC | KSS--- QSVLHSSNNKN YLA | WYQQKPGQ PPKLLIY | ASTRES | GVPDRFSGSGSG TDFTLTISSLQAEDVAVYYC | QQYYS ----TPFT | FGPGT KVDIK |
| iPS:426 126 | 21-225_6G6 VK4|B3|JK3 | | DIVMTQSPDSLAV SLGERATINC | KSS--- QSVLHNSNNYN YLA | WYQQKPGQ PPNLLIF | ASTRES | GVPDRFSGSGSG--- TDFTLNISSLQAEDVAVYYC | QQYYD----TPFT | FGHGT RVDIK |
| iPS:412 232 | 21-225_4A2 VK4|B3|JK3 | | DIVMTQSPDSLAV SLGERATINC | KSS--- QSILHSSNNNM YLA | WFQQKPGQ PPKLLLY | ASTRES | GVPDRFSGSGSG--- TDFTLTISLQPEDVAVYYC | QQYYN----TPVT | FGFGT KVGIK |
| iPS:451 141 | 21-225_164B1 VK4|B3|JK3 | | DIVMTQSPDSLAV SLGERATINC | KSS--- QSLLKSSNNKS YLA | SYQQKPGQ LPKLLIY | ASSRES | GVPDRFSGSGSG--- TDFTLTISSLQAEDVALYYC | QQYYS----IPFT | FGHGT NVDIT |
| iPS:423 314 | 21-225_12F11 VK4|B3|JK3 | | DIVMTQSPDSLAV SLGERATINC | KSS--- QSVLHSSNNRN YLA | WYQQKPGQ PPNLLIF | ASTRES | GVPDRFSGSGSG--- TDFTLNISSLQAEDVAVYYC | QQYYD----TPFT | FGPGT KVDIK |
| iPS:435 327 | 21-225_147G6 VK4|B3|JK3 | | DIVMTQSPDSLAV SLGERATINC | KSS--- QSVLYSSNSMN YLA | WYQQKPGQ PPKLLIY | ASARES | GVPDRFSGSGSG--- TDFTLTISSLQAEDVAVYYC | QQYYT----TPFT | FGPGT KVDIK |
| iPS:435 345 | 21-225_148G3 VK4|B3|JK3 | | DIVMTQSPDSLAV SLGERATINC | KSS--- QRVLHSSNNYN YLA | WYQQKPGQ PPKLLIY | ASTRDS | GVPDRFSGSGSG--- ADFTLTISSLQAEDVALYYC | QQYYS----TPFT | FGPGT KVDIK |
| iPS:435 405 | 21-225_150B7 VK4|B3|JK3 | | DIVMTQSPDSLAV SLGERATINC | KSS--- QNVLYSSHNNN YLA | WYQQKPGQ PPKLLIY | ASTRKS | GVPDRFSGSGSG--- TDFTLTITSLQAEDVAVYYC | QQYYS----TPFT | FGPGT KVDIK |
| iPS:435 433 | 21-225_152E3 VK4|B3|JK3 | | DIVMTQSPDSLAV SLGERATINC | KSS--- QSVLHSSNNYN YLV | WYQQKPGQ SPKRLIY | ASTRES | GVPDRFSGSGSG--- IDFSLITISSLQAEDVAVYYC | QQYYS----TPFT | FGPGT KVDIK |
| iPS:435 437 | 21-225_152F4 VK4|B3|JK3 | | DIVMTQSPDSLAV SLGERATINC | KSS--- QSVLHSSNNYN YLA | WYQQKPGQ PPKLLIY | ASTRES | GVPDRFSGSGSG--- TDFTLTVSSLQAEDVAVYYC | QQYFN----TPFT | FGPGT KVDIK |
| iPS:435 649 | 21-225_165H2 VK4|B3|JK3 | | DIVMTQSPDSLTV SPGERATINC | KSS--- QSVLHSSNNRM YLI | WYQQKPGQ PPKLLIY | ASTRES | GVPVRFSGSGSG--- TDFTVPISSMQDDVAVYYR | QQSYS----IPFT | FGPGT NVDIK |
| iPS:435 855 | 21-225_191G3 VK4|B3|JK3 | | DIVMTQSPDSLAV SLGERATIDC | KSS--- QSVLHSSNSYN YLT | WYQQKLGQ PPKLLIY | ASTRKS | GVPDRFSGSGSG--- TDFTLTISSLQAEDVAFYYC | QQSYS----SPFT | FGPGT KMDIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:435 903 | 21-225_190E2 | VK4|B3/JK3 | DIVMTQSPDSLAV SLGERATINC | KSS---QSVLFNSNNKN YLA | WYQQKPGQ PPNLLIY | W-------ASTRES | GVPDRFSGSGSG---TDFTLTISSMQAEDVAVYYC | QQYCS--------LPFT | FGPGT KVDIR |
| iPS:435 915 | 21-225_190H4 | VK4|B3/K3 | ANVMTQSPDSLAV SLGERTTINC | KSS---QSVLHSSNNYN YLA | WYRQKPGQ PPKLLIY | W-------ASTRES | GVPDRFSGSGSG---TDFTLTISSLQAEDVAVYYC | QQYS---------IPPT | FGPGT KVDIK |
| iPS:435 923 | 21-225_190H6 | VK4|B3/K3 | DIVMTQSPDSLAV SLGERATINC | KSS---QSVLFNSNNKN YLA | WYQQKPGQ PPNLLIY | W-------ASTRES | GVPDRFSGSGCG---TDFTLTIISSLQAEDVAVYYC | QQYCS--------LPFT | FGPGT KVDIR |
| iPS:435 953 | 21-225_191B1 2 | VK4|B3/K3 | DIVMTQSPDSLAV SLGERATINC | KSS---QSVLFNSNNKN YLA | WYQQKPGQ PPNLLIY | W-------ASTRES | GVPDRFSGSGSG---TDFTLTISNLQAEDVAIYYC | QQYCS--------LPFT | FGPGT KVDIK |
| iPS:436 098 | 21-225_195G1 | VK4|B3/K3 | DIVMTSPDSLAV SLGERATINC | KSS---QSVLHSSNNMKN YLA | WYQQKPGQ PPKLLIY | W-------ASTIES | GVPDRFSGSGCG---TDFTLTISSMQAEDVAVYYC | QQYCS--------FPFT | FGPGT KVDIR |
| iPS:436 102 | 21-225_196B1 | VK4|B3/K3 | DIVMTQSPDSLAV FLGERATINC | KSS---QSILFSSNNKR YLA | WYQQKPGQ PPKLLIY | W-------ASTRES | GVPDRFSGSGSG---TDFTLTIISSLQAEDVAVYYC | QQYSS--------LPFT | FGPGT KVDIK |
| iPS:436 104 | 21-225_196C1 | VK4|B3/K3 | DIVMTQSPDSLAV SLGERATINC | KSS---QSVLFNSNNKN YLA | WYQQKPGQ LPNLLIY | W-------ASTIES | GVPDRFSGSGCG---TDFTLTISSMQAEDVAVYYC | QQYCS--------FPFT | FGPGT KVDIR |
| iPS:436 156 | 21-225_197C8 | VK4|B3/K3 | DIVMTSPDSLAV SLGERATINC | KSS---QSVLHSSNNMKN YLA | WYQQKPGQ PPKLLIY | W-------ASTRES | GVPDRFSGSGSG---TDFTLSISSLQAEBVAVYYC | QQSYT--------IPFT | FGPGT KVDNK |
| iPS:436 270 | 21-225_203F10 | VK4|B3/K3 | DIVMTQSPDSLAV SLGERATINC | KSS---QSVFFHSNMKN YLA | WYQQKPGQ PPKLLIY | W-------ASTRES | GVPDRFSGSGSG---TDFTLTIISSLQAEDVTYYC | QQYFS--------LPFT | FGPGT KVDIT |
| iPS:436 570 | 21-225_225F4 | VK4|B3/K3 | DIVMTQSFDSLAV SLGERATINC | KSS---QSVLYSSNNKN YLA | WYQQKPGQ PPKLLIY | W-------ASTRES | GVPDRFSGSGSG---TDFTLTIISCVQPEDVAVYYC | HQYHN--------SPPT | FGHGT EVDIK |
| iPS:394 065 | 21-225_11E2 | VK4|B3/K3 | DIVMTQSPDSLAV SLGERATINC | KSN---QRVLSSSMNHN YLA | WYQQRPGQ PPKLLIY | W-------ASTRES | GVPDRFSGSGSG---TDFTLTIISSLQAEDVAVYYC | QQYFS--------TPFT | FGPGT KVDIK |
| VK1A30/JK5 | | Germline | | | | | | | |
| iPS:473 253 | 21-225_7C3_L C1 | VK1|A30/JK5 | DIQMTQSFSSLSA SVGDRVTITC | RAS---QGIR------SDLG | WYQQNFVK APKRLIY | A-------ASSLQS | GVPSRFSGSGSG---TEFFLTVSSLPEDFAFYYC | LQHNS--------YLPIT | FGQGT RLEIK |
| iPS:473 256 | 21-225_9F12_LC2 | VK1|A30/JK5 | DIQMTQSPSSLSA SVGDRVTITC | RAS---QGIR------NDLG | WYQQKPGK APKRLIY | A-------ASSLQS | GVPSRFSGSGSG---TEFTLTIISLQPEDFATYYC | LQHNS--------YLPIT | FGQGT RLEIK |
| iPS:453 449 | 21-225_208A2 | VK1|A30/JK5 | DIQMTQSPSSLSA SVGDRVTITC | RTS---QGIR------NDLG | WYQQPGK TPKRLIY | A-------ASSLLS | GVPSRFSGSR3G---TDFTLTIISLQPEGFATYYC | LQNS---------YPFT | FGQGT RLEIK |
| iPS:434 467 | 21-225_73H8 | VK1|A30/JK5 | DIQMTQSPSSLYA SVGDRVTIITR | RAS---QDIR------NDLG | WYQQKPGK ALKRVIY | A-------ASSLQS | GVPSSFSGSGSG---TEFFLTIISLQPEDFATYYG | IQHNS--------YPPIT | VGQGT RLEIK |
| iPS:435 045 | 21-225_90H5 | VK1|A30/JK5 | DIQMTQSFSSLSA SVGDRVTITC | RAS---QGIR------NDLG | WYQQKPGK APKRLIY | I-------ASSLQS | GVPSRFSGSGSG---TEFFLTIISLQPEDFATYYC | LQHNS--------YPIT | FGQGT RLEIK |

FIGURE 51 (Continued)

| | | | K_FR1 | K_CDR1 | K_FR2 | K_CDR2 | K_FR3 | K_CDR3 | | K_FR4 |
|---|---|---|---|---|---|---|---|---|---|---|
| iPS:435 561 | 21-225_159F1 | VK1|A30/JK5 | DIQMTQSPSSLSA SVGDRVTITC | RAS--QRVR------NDLG | WYQQKPAK APKRIIF | D------ASNLQS | GVPSRFSGSGSG--- TEFTLTISSLQPEDFATYYC | LQHHS--- | ------FPIT | FGQGT RLEIK |
| iPS:436 328 | 21-225_207F12 | VK1|A30/JK5 | DIQMTQSPSSLSA SVGDRVTITC | RAS--QGIR------NDLG | WYQQKPGK APKRLIY | A------ASSLQS | GVPSRFSGSGSG--- TEFTLTISSLQPEDFATYFC | LQHNS--- | ------YPLT | FGQGT RLEIK |
| iPS:436 354 | 21-225_210G1 | VK1|A30/JK5 | DIQMTQSPSSLSA SVGDRVTITF | RTS--QGIR------NDLG | WYQQQPGK TPKRMIY | A------ASSLFS | GVPSRFSGSRSG--- TDFTLTISSLQPEDFATYYC | LQYNS--- | ------YPPT | FGQGT RLEIK |
| iPS:393 094 | 21-225_34C4 | VK1|A30/JK5 | DIQMTQSPSSLSA SVGDRVTITC | RAS--QGIR------NDLG | WYQQKPGK APKRLIY | T------ASNLQS | GVPSRFSGSGSG--- TEFTLTISSLQPEDFATYYC | LQHSS--- | ------YPIT | FGQGT RLEIK |
| iPS:398 484 | 21-225_18D4 | VK1|A30/JK5 | DIQMTQSPSSLSA SVGDRVTITC | RAS--QGIR------NDLG | WYQQKPGK APKRLIY | A------ASSLES | GVPSRFSGSGSG--- TEFTLTVSSLQPEDFATYYC | LHHNN--- | ------YLPIT | FGQGT RLEIK |
| | Germline | | K_FR1 | K_CDR1 | K_FR2 | K_CDR2 | K_FR3 | K_CDR3 | | K_FR4 |
| | VK1|L5/JK3 | | | | | | | | | |
| iPS:473 254 | 21-225_7C3_LC2 | VK1|L5/JK3 | DIQMTQSPSSVSA SLGDRVTITC | RAS--QGIS------SWLA | WYQQKPGK APKLLIF | A------ASRLQS | GAPSRFSGSGSG--- IDFTLTISSLQPEDFATYYC | QQANS--- | ------FPFT | FGPGT KVDIK |
| iPS:473 255 | 21-225_9F12_LC1 | VK1|L5/JK3 | DIQMTQSPSSVSA SVGDRVTITC | RAS--QGIR------RWLA | WYQQKPGK APKLLIY | A------ASRLQS | GVPSRFSGSGSG--- TDFTLTISGLLPEDFATYYC | QQANS--- | ------FPFT | FGPGT KVDFK |
| iPS:426 108 | 21-225_10G6 | VK1|L5/JK3 | DIQMTQSPSSVSA SVGDRVTITC | RAS--QGIS------KWLA | WYQQKPGE APKLLIY | A------AYSLQS | GVPARFSGSGSG--- IDFTLTIRSLQPEDFATYYC | QQANS--- | ------FPFT | FGPGT KVDIK |
| iPS:426 110 | 21-225_12E9 | VK1|L5/JK3 | DIQMTQSPSSVSA SVGDRVTITC | RAS--QGIS------SWLA | WYQQKPGK APKLLIY | A------ASRLQS | GVPSRFSGSGSG--- TDFTLTISSLQPEDFATYYC | QQANS--- | ------FPFT | FGPGT KVDIK |
| iPS:453 447 | 21-225_65F10 | VK1|L5/JK3 | DIQMTQSPSSVSA SVGDRVTITC | RGG--QGIS------TWLA | WYQQKPGK APKLLIY | A------ASILQS | GVPSRFSGRGSG--- IDFTLTISSLQPEDFATYYC | QQGNI--- | ------FPFT | FGRGT KVDIK |
| iPS:453 451 | 21-225_52G11 | VK1|L5/JK3 | DIQMTQSPSSVSA SVGDRVTITC | RAS--QGIS------KWLA | WYQQKPGK APKLLIY | A------ASSLQS | GVPSRFSAGSG--- TDFTLTISSLQPEDFATYYC | QQANS--- | ------FPFT | FGPGT KVDVK |
| iPS:453 453 | 21-225_53F2 | VK1|L5/JK3 | DIQMTQSPSSVSV SVGDRVTITC | RAS--QDIS------DWLA | WYQQRPGK APKLLIY | A------ASSLES | GVPSKFSGSGSG--- TDFTLTISSLQPEDFATYYC | QQANS--- | ------FPFT | FGPGT KVDVK |
| iPS:433 915 | 21-225_43H9 | VK1|L5/JK3 | DIQMTQSPSSVSA SVGDRVTITC | RAS--QDIS------SWLA | WYQQKKPGK APNLLIY | D------ASSLQS | GVPSRFSGSGSG--- TDFTLTISLQPEDFATYYC | QQANS--- | ------LPFT | FGPGT KVDIK |
| iPS:433 925 | 21-225_44F3 | VK1|L5/JK3 | DIQMTQSPSSVSA SVGDRVTITC | RAS--QGIS------DWLA | WYQQKPGK APKLLIY | A------ASSLQS | GVPSRFSGSGFG--- TDFTLTISSLQPEDFATYYC | QQANS--- | ------FPFT | FGPGT KVDIK |
| iPS:433 953 | 21-225_45H4 | VK1|L5/JK3 | DIQMTQSPSSVSA SVGDRVTITC | RAS--QDIS------SWLA | WYQKKPGK APKYLIY | D------ASSLQS | GVPSRFSGSGSG--- IDFTLTISSLQPEDFATYFC | QQANS--- | ------FPFT | FGPGT KVDIK |
| iPS:433 959 | 21-225_45C9 | VK1|L5/JK3 | DIQMTQSPSSVSV SVGDRVTITC | RAS--QDIS------DWLA | WYQQRPGK APKLLIY | A------ASSLES | GVPSRFSGSGSG--- IDFTLTISLQPEDFATYYC | QQANS--- | ------FPFT | FGPGT KVDIK |
| iPS:434 023 | 21-225_49F1 | VK1|L5/JK3 | DIQMTQSPSSVSA SVGDRVTITC | RAS--RDIN------GMLA | WYQQKPGK APKLLIY | T------VSSLQS | GVPSRFSGSGSG--- TDFTLTISSLQPEDFATYYC | QQNS--- | ------FPFT | FGPGT KVDIK |
| iPS:434 027 | 21-225_49H5 | VK1|L5/JK3 | DIQMTQSPSSVSA SVGDRVTITC | RAS--QGFS------TWLA | WFQQKPGK APKLLIY | A------ASSLQD | GVPSRFSGSGSG--- TDFTLTISGLLPEDFATYYC | QQANS--- | ------FPFT | FGPGT KVDIK |
| iPS:434 035 | 21-225_49F10 | VK1|L5/JK3 | DIQMTQSPSSVSA SVGDRVTITC | RAS--QGIS------RWLA | WIQQKPGK APKVLIY | A------ASTLQS | GVPSRFSGSGSG--- TDFTLTISSLQPEDFATYYC | QQANS--- | ------FPFT | FGPGT KVDIK |
| iPS:434 061 | 21-225_51C7 | VK1|L5/JK3 | DIQMTQSPSSVSA SVGDRVTITC | RAS--QDVN------NYLA | WFQQKPGK APKLLIY | A------ASSLQN | GVPSRFSGSGSG--- IDFTLTISSLLPEDFATYYC | QQTNS--- | ------FPFT | FGPGT KVDIK |

FIGURE 51 (Continued)

| | | | | | | | | | |
|---|---|---|---|---|---|---|---|---|---|
| iPS:434_065 | 21-225_50D4 | VK1lL5lJK3 | DIQMTQSPSSVSA SVGDRLIITC | RAS--QGIS-- ----RWLA | WYQQKPGK APKVLIY | A------ ASTLQS | GVPSRFSGSGSG--- TDFTLTISSLQPEDFATYYC | QQANS---------- ------FPFT | FGPGT KVDIR |
| iPS:434_069 | 21-225_51E9 | VK1lL5lJK3 | DIQMTQSPSSVSA SVGDRVTITC | RAS--QGIS-- -----SWLA | WYQQKPGK APKLLIY | V------ ASSLQS | GVPSRFSGSGSG--- TDFTLTIRSLQPEDFATYFC | QQAKS---------- ------FPFT | FGPGT KVDIK |
| iPS:434_079 | 21-225_52B1 | VK1lL5lJK3 | DIQMTQSPSSVST FVGDRVTITC | RAS--QDIR-- -----TWLA | WYQQKPGK APKLLIY | A------ ASSLQN | GAPSRFSGSGSG--- TDFTLTIISLQPEDFATYFC | QQAKS---------- ------FPFT | FGPGT KVDIK |
| iPS:434_097 | 21-225_52H10 | VK1lL5lJK3 | DIQMTQSPSSVSA SVGDRVTITC | RAS--QDIN-- -----SWLA | WYQQKPGK APKLLIY | V------ ASSLQS | GAPSRFSGSGSG--- TDFTLTISSLQPEDFATYYC | QQAKS---------- ------FPFT | FGPGT KVDIK |
| iPS:434_123 | 21-225_53F7 | VK1lL5lJK3 | DIQMSQSPSSVSA SVGDRVTITC | RAS--QGIS-- -----RWLA | WYQQKPGK APKLLIY | A------ ASSLQS | GVPSRFSGSGSG--- TDFTLTISSLQPEDFATYYC | QQANS---------- ------FPFT | FGPGT KVDIK |
| iPS:434_145 | 21-225_55B1 | VK1lL5lJK3 | DIQMTQSPSSVSA SVGDRVTITC | RAS--QVIS-- -----RWLA | WFQQKPGK APNLLIY | A------ ASSLQS | GVPSRFSGSGSG--- TDFTLTISSLQPEDFATYYC | QQTNS---------- ------FPFT | FGPGT KVDLK |
| iPS:434_167 | 21-225_50F3 | VK1lL5lJK3 | DIQMTQSPSSVSA SVGDRVTITC | RAS--QGIS-- -----SWLA | WYQQKPGK APKLLIY | A------ ASSLQN | GVPSRFSGSGSG--- TDFTLTIISLQPEDFATYYC | QQANS---------- ------FPFT | FGPGT KVDIK |
| iPS:434_189 | 21-225_56E5 | VK1lL5lJK3 | DIQMTQSPSSVSA SVGDRVTITC | RAS--QGIR-- -----KWLA | WYQQKPGK APKLLIY | A------ ASSLQS | GVPSRFSGSGSG--- TDFTLTIISLQPEDFATYYC | QQANS---------- ------FPFT | FGPGT KVDIK |
| iPS:434_193 | 21-225_56C6 | VK1lL5lJK3 | DIQMTQSPSSVSA SVGDRVTITC | RAS--QGIS-- -----SWLA | WYQQKSGN APKLLIY | A------ ASRLQS | GVPSRFSGSGSG--- TYFTLIISSLQSEDFATYYC | QQANS---------- ------FPFT | FGPGT KVDIK |
| iPS:434_195 | 21-225_56F6 | VK1lL5lJK3 | DIQMTQSPSSVCA YVGDRVTITC | RVS--QDIS-- -----KWLA | WFQQKPGK APKFLIY | V------ ASGLQS | GVPSRFSGSGSG--- TDFTLTISSLQPEDFATYYC | QQGNS---------- ------FPFT | FGPGT KVDIK |
| iPS:434_273 | 21-225_57E4 | VK1lL5lJK3 | DIQMTQSPSSVSA SVGDRVSITC | RAS--QDIS-- -----NWLA | WYQQKPGK APKLLIY | A------ ASSLQS | GVPSRFSGSGSG--- TDFTLTIISSLQPEDFATYSC | QQANS---------- ------FPFT | FGPGT KVDIK |
| iPS:434_277 | 21-225_57A7 | VK1lL5lJK3 | DIQMTQSPSSVSA SVGDRVTITC | RAS--QGIS-- -----RWLA | WYQQKPGK APNLLIY | A------ ASNLQS | GVPSRFSGSGSG--- TDFTLTIISSLQPEDFATYIK | QQANS---------- ------FPFT | FGPGT KVDIK |
| iPS:434_355 | 21-225_64G12 | VK1lL5lJK3 | DIQMTQSPSSVSA SVGDRVTITC | RAS--QGIT-- -----TWLA | WYQQKPGK APKLLIS | A------ ASSLQS | GVPSRFSGSGYG--- TDFTLTIISSVQPEDFATYIC | QQANS---------- ------FPFT | KLDIK KVDIK |
| iPS:434_389 | 21-225_66F11 | VK1lL5lJK3 | DIQMTQSPSSVCA SVGDRVTITC | RES--QGIS-- -----IWLA | WYQQKPGK APKLLIY | A------ ASSLQS | GVPSRFSGSGSG--- IDFTLTISSVQPEDFATYYC | QQANS---------- ------FPFT | FGPGT KVDIK |
| iPS:434_423 | 21-225_70D1 | VK1lL5lJK3 | DIQMTQSPASVSA SVGDRVTITC | RAS--QGVS-- -----RWLA | WIQQKPGK APKLLIY | A------ ASSIQS | GVPSKFSGSGSG--- TDFTVTISSLQPEDFATYYC | QQANS---------- ------FPFT | FGPGT KVDIK |
| iPS:435_291 | 21-225_146E1 | VK1lL5lJK3 | DIKMTQSPASVSA SVGDRVTITC | RAS--QGIN-- -----NWLV | WYQEKPGK APKLLIY | A------ ASSLQS | GVPSRFRGSGSG--- TDFTLTIISSLQPEDFATYYC | QQANS---------- ------FPFT | FGPGT KVDVK |
| iPS:435_303 | 21-225_146A6 | VK1lL5lJK3 | DIQMTQSPASVSA SVGDRVTITC | RAS--QGIS-- -----NWLA | WYQQKPGK APKLLIY | A------ ASSLQG | GVPSRFSGSGSG--- TDFTLSISSLQPEDFATYYC | QQTDS---------- ------FPFT | FGPGT KVDVK |
| iPS:435_335 | 21-225_147D1 | VK1lL5lJK3 | DIQMTQSPASVSA SVGDRVTITC | RAS--QNIS-- -----NWLT | WYQQKPGK APKLLIY | A------ ASSIQS | GVPSRFSGSGSG--- TDFTLSISSLQPEDFATYYC | QQGNS---------- ------FPFT | FGPGT KVDIK |
| iPS:435_339 | 21-225_147D10 | VK1lL5lJK3 | DIQMTQSPASVSA SVGDRVTITC | RAS--QGIS-- -----NWLA | WYQQKPGR APKLLIY | A------ ASSLQG | GVPSRFSGNESG--- IDYTLSISSLQPEDFATYYC | QQTDS---------- ------FPFT | FGPGT KVDVK |
| iPS:435_343 | 21-225_148E2 | VK1lL5lJK3 | | | | | | | |
| iPS:435_379 | 21-225_149B6 | VK1lL5lJK3 | | | | | | | |
| iPS:435_381 | 21-225_149C6 | VK1lL5lJK3 | | | | | | | |

FIGURE 51 (Continued)

| | | | | | | | | | |
|---|---|---|---|---|---|---|---|---|---|
| iPS:435 391 | 21-225_149F8 | VK1|L5/J K3 | DIQMTQSPASVSA SVGDRVTITC | RAS--QGIS- ----NWLA | WYQQKPGK APKLLIY | A------ ASSLQS | GVPSRFSGNESG--- TDFTLSISSLQPEDFAIYYC | QQTDS------ ------FPFT | FGPGT KVDVK |
| iPS:435 395 | 21-225_149D1 | VK1|L5/J K3 | DIQMTQSPASVSA SVGDRVTITC | RAS--QNIS- ----NWLT | WYQQKPGK APKLLIY | A------ ASSLQG | GVPSRFSGSGSG--- TDFTLSISSLQPEDFATYYC | QQTDS------ ------FPFT | FGPGT KVDIK |
| iPS:435 403 | 21-225_150C5 | VK1|L5/J K3 | DIQMTQSPGSVSA SVGDRVTITC | RAS--QGIN- ----NWLA | WYQQKPGK APKLLIY | A------ ASSLQG | GVPSRFSGSGSG--- TDFTLSISSLQPEDFATYYC | QQTDS------ ------FPFT | FGPGT KVDIK |
| iPS:435 447 | 21-225_152H7 | VK1|L5/J K3 | DIQMTQSPASVSA SVGDRVTITC | RAS--QDIS- ----NWLA | WYQQKPGK APKLLIY | A------ ASSLQG | GVPSRFSGSGSG--- TDFTLSISSLQPEDFATYYC | QQTDS------ ------FPFT | FGPGT KVDIK |
| iPS:435 453 | 21-225_152G1 0 | VK1|L5/J K3 | DIQMTQSPASVSA SVGDRVTITC | RAS--QGIS- ----NWLA | WYQQKPGK APKLLIS | A------ ASSLQG | GVPSRFSGNESG--- TDFTLSISSLQPEDFATYYC | QQTDS------ ------FPFT | FGPGT KVDVK |
| iPS:435 483 | 21-225_155A4 | VK1|L5/J K3 | DIQMTQSPASVSA SVGDRVTITC | RAS--QGIS- ----NWLA | WYHQKPGK APKLLIY | A------ ASSLQG | GVPSRFSGSGSG--- TDFTLSISSLQPEDFATYYC | HQTDS------ ------FPFT | FGPGT KVDIK |
| iPS:435 485 | 21-225_155B4 | VK1|L5/J K3 | DIQMTQSPASVSA SVGDRVTITC | RAS--QDIS- ----NWLA | WYQQKPGK APKLLIY | A------ ASSLQG | GVPSRFSGMGSG--- TDFTLSISSLQPEDFATYYC | HQTDS------ ------FPFT | FGPGT KVDIK |
| iPS:435 787 | 21-225_180A3 | VK1|L5/J K3 | DIQMTQSPSSVSA SVGDRVTITC | RAS--QDIT- -----SWLA | WYQQKPGK APKLLIY | A------ ASSLQS | GVPSRFSGSGSG--- TDFTLTISSLQPEDFAFYYC | QQANS------ ------IPFT | FGPGT KVDIN |
| iPS:435 809 | 21-225_182H5 | VK1|L5/J K3 | DIQMTQSPSSVYA SVGDRVTITC | RAS--QDIT- -----SWLA | WYQQKPGK APKLLIY | A------ ASSLQS | GVPSRFSGSGSG--- TDFILTITSVQPDDFATYYC | QQVNS------ ------FPFT | FGHGT KVDIK |
| iPS:435 889 | 21-225_186A1 | VK1|L5/J K3 | DIQMTQSPSSVSA SVGDRVTITC | RAS--QDIT- -----SWLA | WYQQKPGK APKLLIY | A------ ASSLQS | GVPSRFSGSGSG--- TDFILTITSVQPDDFATYYC | QQVNS------ ------FPFT | FGHGT KVDIK |
| iPS:435 965 | 21-225_192H2 | VK1|L5/J K3 | DIQMTQSPSSVSA SVGDRVTITC | RAS--QGIS- -----SWLA | WYQQKPGK APKLLIY | G------ ASSLQS | GVPSRFSGSGSG--- TDFTLTISSLQPEDFATYYC | QQSNS------ ------FPFT | FGPGT KVDIK |
| iPS:436 106 | 21-225_196F2 | VK1|L5/J K3 | DIQMTQSPSSVSA SVGDRVTITC | RAS--QGIS- -----SWLA | WYQQKPGK APKLLIY | A------ ASSLQS | GVPSRFSGSGSG--- TDFTLTISSLQPEDFATYYC | QQTNS------ ------VPFT | FGPGT KVDIK |
| iPS:436 360 | 21-225_210H1 | VK1|L5/J K3 | DIQMTQSPSSVSA SVGDRVTITC | RAS--QGIS- ----IWLA | WYQQKPGK APNLLIY | A------ ASSLQS | GVPSRFSGRGSG--- TDFTLTISSLQPEDFAPYYC | QQAKS------ ------FPFT | FGPGT KVDIK |
| iPS:436 488 | 21-225_221A6 | VK1|L5/J K3 | DIQMTQSPSSVSA SVGDRVTITC | RAS--QGIS- -----SWLA | WYQQKPGK APKLLIY | T------ ASNLQS | GVPSRFSGSGSG--- TDFTLTISSLQPEDFATYYC | QQANS------ ------FPFT | FGPGT KVDIK |
| iPS:436 496 | 21-225_222E1 | VK1|L5/J K3 | DIQMTQSPSSVSA SVGDRVTITC | RAS--QGIS- -----SWLA | WYQQKPGK APKLLIY | T------ ASNLQS | GVPSREGSGSG---- TDFTLTISSLQPEDFATYYC | QQANS------ ------FPFT | FGRGT KVDIK |
| iPS:436 508 | 21-225_222F7 | VK1|L5/J K3 | DIQMTQSPSSVSA SVGDRVTITC | RAS--QGIS- -----SWLA | WYQQKPGK APKLLIY | A------ ASSFQS | GVPSRFSGSGSG--- TDFTLTISSLQPEDFATYYC | QQANS------ ------FPFT | FGPGT KVDIK |
| iPS:436 516 | 21-225_222C1 2 | VK1|L5/J K3 | DIQMTQSPSSVSA SVGDRVTITC | RVS--QGIS- ----SWLA | WYQQKPGK ALKLVIY | A------ ASNLQS | GVPSRFSGSGSG--- TDFTLTISSVQREDFATYYC | QQDNS------ ------FPPT | FGPGT KVDIK |
| iPS:437 234 | 21-225_64E2 | VK1|L5/J K3 | DIQMTQSPSSVSA SVGDRVTITC | RAS--QGIS- ----RWLA | WYQQKPGK APKLLIY | A------ ASSLQS | GVPSRFSGSGSG--- TDFTLTISSLPEDFATYYC | QQANS------ ------FPFT | FGPGT KVDIK |
| iPS:392 996 | 21-225_28B1 | VK1|L5/J K3 | DIQMTQSPSSVSA SVGDRVTITC | RAS--QAIN- ----QWLA | WYQQKPGK APKLLIY | A------ ASSFQS | TDFTLTITSLQPEDFATYYC | QQASS------ ------FPFT | FGPGT KVDIK |
| iPS:393 010 | 21-225_25E11 | VK1|L5/J K3 | DIQMTQSPSSVSA SVGDRVTITC | RAS--QGIS- ----NWLA | WYQQKPGK APKLLIY | A------ ASSLQG | GVPSRFSGSGSG--- TDFTLTISSLQPEDFATYYC | QQANS------ ------SPII | FGPGT KVDIK |
| iPS:393 016 | 21-225_28F11 | VK1|L5/J K3 | DIQMTQSPSSVSA SVGDRVTITC | RAS--QGIS- ----NWLA | WYQQKPGK APKLLIS | A------ ASNLQS | GVPSRFSGSGSG--- TDFLTITSLQPEDFATYYC | QQANS------ ------LPFT | FGPGT KVDIK |

FIGURE 51 (Continued)

| | | K_FR1 | K_CDR1 | K_FR2 | K_CDR2 | K_FR3 | K_CDR3 | K_FR4 |
|---|---|---|---|---|---|---|---|---|
| | Germline | | | | | | | |
| iPS:393_024 | 21-225_31H9 | VK1|L5/J K3 | DIQMTQSPSSVSA SVGDRVTITC | RAS--QGIT----SWLT | WYQQRPGK APKLLIY | D----------TSSLQS | GVPSRFSGSGSG---TDFTLTISSLQPEDFATYYC | QQGNS-------FPFT | FGQGT KVDIK |
| iPS:393_080 | 21-225_34F3 | VK1|L5/J K3 | DIQMTQSPSSVSA TVGDRVTSTC | RAS--QGIS-------KWLA | WYQQKPGK APKLLIY | A----------ASSLQS | GVPSRFSGSGSG---TDFTLTISSLQPEDSATYYC | QQANS-------FPFT | FGPGT KVDIK |
| iPS:393_084 | 21-225_35C6 | VK1|L5/J K3 | DIQMTQSPSSVSA SVGDRVTITC | RAS--QGIS-------KWLA | WYQQKPGK APKLLIY | A----------ASSLQS | GVPTRFSGSGSG---TDFTLTISSLQPEDFAIYYC | QQANS-------FPFT | FGPGT KVDIK |
| iPS:393_086 | 21-225_36H5 | VK1|L5/J K3 | DIQMTQSPSSVSA SVGDRLIIC | RAS--QGIS-------RWLA | WYQQKVGK VPKLLIY | A----------ASRLQS | GIPSRFSGSGSG---TDFTLTISSLQPEDFATYYC | QQANS-------FPFT | FGPGT KVDIK |
| iPS:393_098 | 21-225_35G6 | VK1|L5/J K3 | DIQMTQSPSSVSA SVGDRLIIC | RAS--QGIS-------RWLA | WYQQKVGK VPKLLIY | A----------ASRLQS | TAFTLTIGSLQPEDFATYYC | QQANS-------FPFT | FGPGT KVDLK |
| iPS:393_112 | 21-225_33G1 | VK1|L5/J K3 | DIQMTQSPSSVSV SVGDRVTITC | RAS--QGIS-------RWLA | WYQQKPGK APKLLIY | G----------AYSLQS | GVPSRFSGSGSG---TDFTLTISSLQPEDFATYYC | QQANS-------FPFT | FGPGT KVDIK |
| iPS:393_116 | 21-225_34G7 | VK1|L5/J K3 | DIQMTQSPSSVSA SVGDRVTITC | RAS--QLIS-------KWLA | WYQQKPGK APKLLIY | A----------ASSLQS | GVPLRFSGSGSG---TDFTLTISSLQPEDFATYYC | QQANS-------FPFT | FGPGT KVDIK |
| iPS:393_132 | 21-225_33H7 | VK1|L5/J K3 | DIQMTQSPSSVSA SVGDRVTITC | RAS--QGIS-------KWLA | WYQQKVGK VPKLLIY | A----------ASRLQS | GVPSRFSGSGSG---TDFTLTISSLQPEDFATYYC | QQANI-------FPFT | FGPGT KVDLK |
| iPS:393_140 | 21-225_35H12 | VK1|L5/J K3 | DIQMTQSPSSVSA SVGDRVTITC | RAS--QGIS-------RWLA | WYQQKPGK APELLIY | A----------ASRLQS | GIPSRFSGSGSG---TDFTLTISSLQPEDFATYYC | QQANS-------FPFT | FGPGT KVDIK |
| iPS:393_954 | 21-225_4H6 | VK1|L5/J K3 | DIQMTQSPSSVSA SVGDRVTITC | RAS--QGIS-------RWLA | WYQQKPGK APKLLIY | G----------ASSLQS | GVPSRFSGSGSG---TDFTLTISSLQPEDFAIYYC | QQANS-------FPFT | FGPGT KVDIK |
| iPS:398_502 | 21-225_23B11 | VK1|L5/J K3 | DIQMTQSPSSVSA SVGDRVTITC | RAS--QGIT-------KWLA | WYQQKPGK APKVLIY | A----------ASSLQS | RVPSRFSGSRSG---TDFTLTISSLQPEDFATYYC | QQANS-------FPFT | FGPGT KVDIK |
| iPS:398_520 | 21-225_31C4 | VK1|L5/J K3 | DIQMTQSPSSVSA SVGDRVTITC | RAS--QGIS-------KWLA | WYQQKPGK APKLIY | A----------ASSLQS | GVPTRFSGSGSG---TDFTLTISSLQPEDFAIYYC | QQANS-------FPFT | FGPGT KVDIK |
| iPS:402_223 | 21-225_30A11 | VK1|L5/J K3 | DIQMTQSPSSVSA SVGDRVTITC | RAS--QGIS-------RWLA | WYQQKPGR APELLIY | A----------ASRLQS | GIPSRFSGSGSG---TDFTLTISSLQPEDFATYYC | QQANS-------FPFT | FGPGT KVDNK |
| | VK4|B3/JK1 | | | | | | | |
| iPS:426_112 | 21-225_12F12 | VK4|B3/J K1 | DIVMTQSPDSLAV SLGERATINC | KSS----QTVLFSSNNNH YLA | WYQQKPGQ PPNLLIY | W----------ASTRAS | GVPDRFSGSGSG---TDFTLTISSLQAEDVAVYYC | QQYYS-------SPWT | FGQGT KVEIK |
| iPS:451_137 | 21-225_74A7 | VK4|B3/J K1 | DIVMTQSPDSLAV SLGERATINC | KSS----QSVLFSSNNYN YLA | WYQQKPGQ PPNLLIY | W----------ASTRES | GVPDRFSGSGSG---TDFTLTISSLQAADVAVYYC | QQYHS-------SPPT | FGQGT TVQIK |
| iPS:433_909 | 21-225_43D8 | VK4|B3/J K1 | DIVMTQSPDSLAV SLGERATINC | KSS----QSVLMTSNDKM YLT | WYQQRPGQ PPKLLIY | W----------ASTRES | GVPDRFSGGSG---TDFTLTISGLQAEDVAVYYC | QQYYS-------TPPT | FGQGT KVEIK |
| iPS:434_177 | 21-225_56A1 | VK4|B3/J K1 | DIVMTQSPDSLAV SLGERATINC | KSS----QSVLHSSNNKN YLV | WYQQRPGQ PPNLLIY | W----------ASTRES | GVPDRFSGSGSG---TDFTLTISSLQAEDVAVYYC | QQYYS-------TPPT | FGQGT KVEIK |
| iPS:434_237 | 21-225_61B5 | VK4|B3/J K1 | DIVMTQSPDSLAV SLGERATINC | KSS----QSVLYSSMNNN SLT | WYQLKPGQ PPKKLIY | W----------ASTRES | GVPDRFSGSGSG---TDFTLTISSLQAEDVAVYYC | QQYYS-------TPPT | FGQGS KVEIK |

FIGURE 51 (Continued)

| | | | | | | | | |
|---|---|---|---|---|---|---|---|---|
| iPS:434 285 | 21-225_57A11 | VK4jB3/J K1 | DIVMTQSPDSLTV SLGERATINC | IKSS--- QSVLHSSNNYN YLA | WYQQRPGQ PPKLVIY | W------ ASTRAS | GVPDRFSGSGSG--- TDFTLTISSLQAEDMAVYYC | QQYYS----------TPWT | FGQGT KVEFK |
| iPS:434 295 | 21-225_58B9 | VK4jB3/J K1 | DIVMTQSPDSLAV SLGERATINC | IKSG--- QSILYSSNNNN YLA | WYQQKPGQ PPNKLLIY | W------ ASTRDS | GVPARFSGSGSG--- TDFTLTISSLQAEDVAVYYC | QQYYS----------TPPT | FGQGS KVEIK |
| iPS:434 321 | 21-225_59F10 | VK4jB3/J K1 | DIVMTQFPDSLAV SLGERATINC | IKSS--- QTVLYRSNNYN YLA | WYQQKPGQ PPKLLIY | W------ ASTRES | GVPDRFSGSGSG--- TDFTLTISSLQAEDVAVYYC | QQYFS----------TPPT | FGQGT KVEIK |
| iPS:434 431 | 21-225_70E7 | VK4jB3/J K1 | DIVMTQSPDSLAV SLGERATINC | IKSS--- QSVLYSSNMNN YLA | WYQQKPGQ PPKLLIY | W------ ASTRES | GVPDRFSGSGSG--- TDFTLTISSLQAEDVAVYYC | QQYYN----------IPPT | FGQGT KVEIK |
| iPS:434 475 | 21-225_74F9 | VK4jB3/J K1 | DIVMTQSPDSLAV SLGERATINC | IKSS--- QSVLYSSNNYN YLA | WYQQRPGQ PPKKLIY | W------ ASTRES | GVPDRFSGSGSG--- TDFTLTISSLQAEDVAVYSC | QQYYS----------SPPT | FGQGT KVEIK |
| iPS:434 477 | 21-225_74A6 | VK4jB3/J K1 | DIVMTQSPDSLAV SPGERATINC | IKSS--- QSVLHSSNNNN YLA | WYQQKPGQ PPDLLIY | W------ ASTRES | GVPDRFSGSGSG--- TDFTLTISSLQAEDVAVYYC | QQYFS----------TPWT | FGQGT QVEIK |
| iPS:434 481 | 21-225_74B10 | VK4jB3/J K1 | DIVMTQSPDSLAV SLGERATINC | IKSS--- QSVLYSSNMKN YLT | WYQQKPGQ PPKLLIY | W------ ASTRES | GVPDRFSGSGSG--- TDFSLTIGSLQAEDVAVYYC | QQYYS----------IPPT | FGQGT KVEIK |
| iPS:434 487 | 21-225_76G2 | VK4jB3/J K1 | DIVMTQSPDSLAV SLGERATINC | IKSS--- QSVLHSSNNYN YLA | WYQQRPGQ PPRLLIY | W------ ASTRES | GVPDRFSGSGSG--- TDFTLTISSLQVEDVAVYYC | QQYYS----------SPPT | FGQGT KVEIK |
| iPS:434 493 | 21-225_76F3 | VK4jB3/J K1 | DIVMTQCPDSPAV SLGERATINC | IKSS--- QSVLFSSNNNY YLA | WYQQRPGQ PHDLLIY | W------ ASTRES | GVPDRFSGSGSG--- TDFTLTISSLQAADVAVYYC | QQYYS----------SPLT | FGQGT TVQIK |
| iPS:434 509 | 21-225_76F5 | VK4jB3/J K1 | VIVLTQSPDSLAV SLGERATINC | IKSS--- QSVLPSSNNYN YLA | WYQQKPGQ SPKVLIY | W------ TSTRES | GVPDRFSGSGSG--- TDFTLTISSLQAEDVAVYYC | QQYYS----------SPPT | FGQGT KVEIK |
| iPS:434 525 | 21-225_76E8 | VK4jB3/J K1 | DIVMTQSPDSLAV SLGERATINC | IKSR--- QTVLHSSNNYN YLA | WYQQRPGQ PPKVLIY | W------ TSTRES | GVPDRFSGSGSG--- TDFTLTISSLQAEDVAVYYC | QQYYS----------SPLT | FGQGT KVEIR |
| iPS:434 549 | 21-225_76E11 | VK4jB3/J K1 | DIVMTQSPDSLAV SLGERATINC | IKSS--- QCSILYSSNNNN YLA | WYQQKAGQ PPKLLIY | W------ ASTRES | GVPDRFSGSGSG--- TDFTLTISSLQAEDVAVYYC | QQYYS----------TPPT | FGQGT KVEIK |
| iPS:434 551 | 21-225_75C4 | VK4jB3/J K1 | DIVMTQSPDSLAV SLGERATINC | IKSS--- QSILYSSNMNN YLA | WFQQKPGQ PPKLLIY | W------ ASTRES | GVPDRFSGSGSG--- TDFTLTISSLQAEDVAVYYC | QQYYT----------TPPT | FGQGT KVEIK |
| iPS:434 575 | 21-225_77C7 | VK4jB3/J K1 | DIVMTQSPDSLAV SLGERATINC | IKSS--- QTVLHSSNNYN YLA | WYQQKPGQ PPKVLLIY | W------ TSTRES | GVPDRFSGSGSG--- TDFTLTISSLQAEDVAVYYC | QQYFS----------SPPT | FGQGT KVEIK |
| iPS:434 597 | 21-225_77C10 | VK4jB3/J K1 | DIVMTQSPDCLAV SLGERATINC | IKSS--- QSVLYTSNNNN YLA | WYQQKPGQ PPKLLIY | W------ ASTRES | GVPDRFSGSGSG--- TDFTLTISSLQAEDVAVYYC | QHYYN----------TPWK | FVQGT KVEIT |
| iPS:434 617 | 21-225_74B8 | VK4jB3/J K1 | DSVMTQSPDSLAV SLGERATINC | IKSS--- QSVLRSSNKKN YLA | WYQQKPGQ PPKLLIY | W------ ASTRES | GVPDRFSGSGSG--- TDFTLTISSLQAEDVAVYYC | QQYYR----------TPWT | FGQGT KVEIK |

FIGURE 51 (Continued)

| | | | | | | | | | |
|---|---|---|---|---|---|---|---|---|---|
| iPS:434 619 | 21-225_78C1 | VK4|B3|J K1 | DIVMTQSPDCLAV SLGERATINC | KSS--- QSVLYTSNNMN YLA | WYQQKPGQ PPKLLIY | W------ ASTRES | GVPDRFSGSGSG--- TDFTLTISSLQAEDVAVYYC | QHYYN---------TPWK | FVQGT KVEIK |
| iPS:434 639 | 21-225_74B7 | VK4|B3|J K1 | DIVMTQSPDSLAV SLGERATINC | KSS--- QTVLHSSNNYN YLA | WYQQKPGQ PPKLLIY | W------ TSTRES | GVPDRFSGSGSG--- TDFTLTISSLQAEDVAVYYC | QQYFS---------SPPT | FGQGT KVEIK |
| iPS:434 649 | 21-225_78E11 | VK4|B3|J K1 | DIVMTQSPDSLAV SLGERATINC | KSS--- QSVLFSFNNYN YLA | WYQQKPGQ PPKLLIY | W------ ASTRES | GVPDRFSGSGSG--- TDFTLTISSLQAADVAVYYC | QQYYS---------SPPT | FGQGT KVEIK |
| iPS:434 653 | 21-225_74B5 | VK4|B3|J K1 | DIVMTQSPDSLAV SLGERATINC | KSS--- QSVLFSSNNYN YLA | WYQQRPGQ PPNLLIY | W------ ASTRES | GVPDRFSGSGSG--- TDFTLTISSLQAADVAVYYC | QQYYS---------SPPT | FGQGT TVQIK |
| iPS:434 655 | 21-225_78H12 | VK4|B3|J K1 | DIVMTQSPDSLAV SLGERATINC | KSS--- QTVLHSFNNNN YLA | WYQQKPGQ PPKVLIY | W------ TSTRES | GVPDRFSGSGSG--- TDFTLTISSLQAEDVAVYYC | QQYFS---------SPPT | FGQGT KVEIK |
| iPS:434 665 | 21-225_74G4 | VK4|B3|J K1 | DIVMTQSPDSLAV SLGERATINC | KSS--- QSVLYSSNNMN YLA | WYQQKRAGQ PPKLLIY | W------ ASTRES | GVPDRFSGSGSG--- TDFTLTISSLQAADVAVYYC | QQYYS---------IPPT | FGQGT KVEIK |
| iPS:434 675 | 21-225_79G6 | VK4|B3|J K1 | DIVMTQSPDCLAV SLGERATINC | MSS--- QSVLHSFNNKN YLT | WYQQKPGQ PPKLLIY | W------ ASTWES | GVPDRFSGSGSG--- TDFSLPIGSLQAEDVAVYYC | QQYYS---------IPPT | FGQGT KVEIK |
| iPS:434 685 | 21-225_79E9 | VK4|B3|J K1 | DIVMTQSPDSLAV SLGERATINC | KSS--- QSILYSSNNMN YLA | WFQQKPGQ PPKLLIY | W------ ASTRES | GVPDRFSGSGCG--- TDFTLTISSLQAEDVAVYYC | QHYYI---------TPPT | FGQGT KVEIK |
| iPS:434 689 | 21-225_79G10 | VK4|B3|J K1 | DIVMTQSPDSLAV SLGERATINC | KSS--- QSVLFSSNNMN YLA | WYQQRPGQ PHNLLIY | W------ ASTRES | GVPDRFSGSGSG--- TDFTLTISSLQAADVAVYYC | QQYHS---------SPLI | FGQGT TVQIK |
| iPS:434 697 | 21-225_79F12 | VK4|B3|J K1 | DIVMTQSPDSLAV SLGERATINC | KSS--- QSILYSSNNYN YLA | WYQQKPGQ PPKLLIY | W------ ASTRES | GVPDRFSGSGSG--- TDFTLTISSLQAEDVAVYYC | QQYYS---------TPWI | FGQGT KVEIK |
| iPS:434 707 | 21-225_80D3 | VK4|B3|J K1 | DIVMTQSPDSLAV SLGERATISC | KSS--- QSILYSSNRYN YLA | WYQQRPGQ PPNLLIY | W------ ASTRES | GVPDRFSGSGSG--- TDFTLTISSLQAADVAVYYC | QHYNE---------TFGK | FVQVT KVEIT |
| iPS:434 711 | 21-225_80H3 | VK4|B3|J K1 | DIVMTQSPDSLAV SLGERATTNC | KSS--- QSVLHRSNNYN YLA | WYQQKPGQ PFKLLIY | W------ ASTRES | GVPDRFSGSGSG--- TDFTLTISSLQAEDVAVYYC | QQYYS---------TPPT | FGQGT KVEIK |
| iPS:434 731 | 21-225_80E9 | VK4|B3|J K1 | DIVMTQSPDSLAV SLGERATINC | KSS--- QSVLYTSNNMN YLA | WYQQKPGQ PPKLLIY | W------ ASTRES | GVPDRFSGSGSG--- TDFTLTISSLQAEDVAVYYC | QQYYN---------TPWI | FGQGT KVEIK |
| iPS:434 761 | 21-225_81E5 | VK4|B3|J K1 | DIVMTQSPDSLAV SLGERATINC | KSS--- QSVLFSSNNMN YLA | WYQQRPGQ PPNLLIY | W------ ASTRES | GVPDRFSGSGSG--- TDFTLTISSLQAADVAVYYC | QQYYS---------SPLI | FGQGT TVQIK |
| iPS:434 771 | 21-225_81F9 | VK4|B3|J K1 | DIVMTQSPDSLAV SLGERATINC | KSS--- QSVLYTSNNNN YLA | WYQQKPGQ PFKLLIY | W------ ASTRES | GVPDRFSGSGSG--- TDFTLTISSLQAEDVAVYYR | QHYND---------TPGK | FVQGI MVEIT |
| iPS:434 827 | 21-225_83F3 | VK4|B3|J K1 | DIVMTQSPDCLAV SLGERATINC | KSS--- QSVLYTSNNMN YLA | WYQQKPGQ PPKLLIY | W------ ASTRES | GVPDRFSGSGSG--- TDFTLTISSLQAEDVAVYYC | QHYND---------TPWK | FVQGI KVEIK |

FIGURE 51 (Continued)

| | | | | | | | |
|---|---|---|---|---|---|---|---|
| iPS:434 829 | 21-225_83G3 | VK4|B3|J K1 | DIVMTQSPDCLAV SLGERATINC | KSS--- QSVLYTSNNKN YLA | WYQQKPGQ PPKLLIY | W------ ASTRES | GVPDRFSGSGSG--- TDFTLTISSLQAEDVAVYYC | QHYYN---------- ------TPWT | FVQGT KVEIK |
| iPS:434 841 | 21-225_83G7 | VK4|B3|J K1 | DIVMTQSPDSLAV SLGERATIIC | KSS--- QIVLHSSNNYN YLA | WYQQKPGQ PPKVLIY | W------ TSTRES | GVPDRFSGSGSG--- TDFTLTISSLQAEDVAVYYC | QQYFS---------- ------SPLT | FGQGT KVEIK |
| iPS:434 863 | 21-225_84G7 | VK4|B3|J K1 | DIVMTQSPDSPAV SLGERATINC | KSS--- QTVLHSSNRYN YLA | WYQQKPGQ PPKVLIY | W------ TSTRES | GVPDRFSGSGSG--- TDFTLTISSLQAEDVAVYYC | QQYFS---------- ------SPPT | FGQGT KVEIK |
| iPS:434 877 | 21-225_85H2 | VK4|B3|J K1 | DSMMTQSPDSLAV SLGERATINC | KSS--- QSVLHSSNKKN YLA | WYQQKPGQ PPKLLIY | W------ ASTRES | GVPDRFSGSGSG--- TDFTLTISSLQAEDVAVYYC | QQYYR---------- ------TPWT | FGQGT KVEIK |
| iPS:434 901 | 21-225_85H9 | VK4|B3|J K1 | DIVMTQSPDSLAV SLGERATINC | KSS--- QSVLHSSNNYN YLA | WYQQKPGQ PPKLLIY | W------ ASTRES | GVPDRFSGSGSG--- TDFTLTISSLQAEDVAVYYC | QQYYS---------- ------TPPT | FGQGT KVEIK |
| iPS:434 935 | 21-225_86E9 | VK4|B3|J K1 | DIVMTQCPDSPAV SLGERATINC | KSS--- QSVLHSSNNYN YLA | WYQQKPGQ PPNLLIY | W------ TSTRES | GVPDRFSGSGSG--- TDFTLTISSLQAEDVAVYYC | QQYHS---------- ------SPLT | FGQGT KVEIK |
| iPS:434 965 | 21-225_88A1 | VK4|B3|J K1 | NIVMTQSPDSLAV SLGARATINC | KSS--- QSVLHSSNNYN YLT | WYQQKPGQ PPKLLIY | W------ ASTRKS | GVPDRFSGSGSG--- TDFTLTISSLQAEDVAVYFC | QQYYS---------- ------SPPT | FGQGT KVEIK |
| iPS:434 971 | 21-225_88G2 | VK4|B3|J K1 | DIVMTQSPDCLAV SLGERATINC | KSS--- QSVLYTSNNKN YLA | WYQQKPGQ PPKLLIY | W------ ASTRES | GVPDRFSGSGSG--- TDFTLTISSLQAEDVAVYYC | QQYYN---------- ------TPWT | FVQGT KVEIK |
| iPS:434 973 | 21-225_88B4 | VK4|B3|J K1 | DIVMTQSPDSLAV SLGERATINC | KSS--- QIVLHSSNNYN YLA | WYQQKPGQ PPKVLIY | W------ TSTRES | GVPARFSGSGSG--- TDFTLTISSLQAEDVAVYYC | QQYYS---------- ------TPPT | FGQGT KVEIK |
| iPS:434 997 | 21-225_88C10 | VK4|B3|J K1 | DIVMTQSPDSLAV SLGERATINC | KSS--- QSVLHSSNNWN YLA | WHQQKPGQ PPKLLIH | W------ AFTRKS | GVPDRFSGGGSG--- TNFTLTISSLQAEDVAVYYC | QQYYR---------- ------APPT | FGQGT KVEIK |
| iPS:435 051 | 21-225_90D9 | VK4|B3|J K1 | DIVMTQSPDSLAV SLGERATINC | KSS--- QSVLYTSNNKN YLA | WYQQKPGQ PPKLLIY | W------ ASTRES | GVPDRFSGSGSG--- TDFTLTISSLQAEDVAVYYC | QQYLS---------- ------SPLT | FGQGT KVEIK |
| iPS:435 053 | 21-225_75F9 | VK4|B3|J K1 | DIVMTQSPDSLPV SLGERATVNC | KSS--- QSVLHNSNNNN YLA | WYQQKPGQ PPKVLIY | W------ ASTRES | GVPDRFSGSGSG--- TDFTLTISSLQAEDVAVYYC | QQYYS---------- ------SPPT | FGQGT KVEIK |
| iPS:435 071 | 21-225_91F1 | VK4|B3|J K1 | DIVMTQSPDCLAV SLGERATVNC | KSS--- QSVLYISNNGN YLA | WYQQKPGQ PPKLLIY | W------ ASTRES | GVPDRFSGSGSG--- TDFTLTISSLQAEDVAVYYC | QHYYN---------- ------TPWK | FVQGT KVEIK |
| iPS:435 087 | 21-225_91G8 | VK4|B3|J K1 | DIVMTQSPDCLAV SLGERATINC | KSS--- QSVLYTSNNWN YLA | WYQQKPGQ PPKLLIY | W------ ASTRES | GVPDRFSGSGSG--- TDFTLTISSLQAEDVAVYYC | QQYYT---------- ------TPWT | FGQGT KVEIK |
| iPS:435 113 | 21-225_92E6 | VK4|B3|J K1 | DIVMTQSPDSLAA SLGERATINC | QNI,SSSNNKN YLT | WYQQKPGQ PPKILIY | W------ TSTRES | GVPDRFSGSGFG--- TDFTLTISSLQAEDVAVYYC | QQYFS---------- ------VPPT | FGQGT KVEIK |
| iPS:435 167 | 21-225_92F12 | VK4|B3|J K1 | DIVMTQSPDSLAV SLGERATINC | KSS--- QSVLHRSNNYN YLA | WYQQKPGQ PPKLLIY | W------ ASTRES | GVPDRFSGSGSG--- TDFTLTISSLQAEDVAVYYC | QQYYS---------- ------TPPT | FGQGT KVEIK |

FIGURE 51 (Continued)

| | | | | | | | | | |
|---|---|---|---|---|---|---|---|---|---|
| iPS:435 203 | 21- 225_75A7 | VK4|B3|J K1 | DIVMTQSPDSLAV SLGERATINC | KSS--- QTVLHSSNNYN YLA | WYQQKPGQ PPKVLIY | W------- TSTRES | GVPDRFSGSGSG--- TDFTLTISSLQAEDVAVYYC | QQYFS--------------SPPT | FGQGT KVEIK |
| iPS:435 209 | 21- 225_75A10 | VK4|B3|J K1 | NIVMTQSPDSLAV SLGERATINC | KSS--- QSVLHNSNNYN YLI | WYQQKPGQ PPKLLIY | W------- ASTRKS | GVPDRFSGSGSG--- TDFTLTISSLQAEDVAVYFC | QQYFS--------------SPPT | FGQGT KVEIK |
| iPS:435 211 | 21- 225_94E11 | VK4|B3|J K1 | DIVMTQSPDSLAV SLGERATINC | KSS--- QSVLFSSNNYN YLA | WYQQRPGQ PPNLLIY | W------- ASTRES | GVPDRFSGSGSG--- TDFTLTISSLQAADVAVYYC | QQYHS--------------SPLT | FGQGT TVQIK |
| iPS:435 215 | 21- 225_94E12 | VK4|B3|J K1 | DIVMTQSPDSLAV SLGERATINC | KSS--- QSVLHRSNNYN YLA | WYQQKPGQ PPKLLIY | W------- ASTRES | GVPDRFSGSGSG--- TDFTLTISSLQAEDVAVYYC | QQYYS--------------TPPT | FGQGT KVEIK |
| iPS:435 227 | 21- 225_95G4 | VK4|B3|J K1 | DIVMTQCPDSLAV SLGERATINC | KSS--- QSVLFKSNNYN YLA | WYQQKPGQ PPNNLIY | W------- ASTRES | GVPDRFSGSGYG--- TDFTLTISSVQAADVAVYYC | QQYHS--------------SPLT | FGQGT TVQIK |
| iPS:435 245 | 21- 225_95E12 | VK4|B3|J K1 | DIVMTQSPDSLAV SLGERATINC | KSS--- QSVLYSSNNAN YLA | WYQQKPGQ PPNLFIY | W------- ASTRES | GVPDRFSGSGSG--- TDFTLTISSLQAEDVAVYYC | QQYYS--------------TPCS | FGQGT KVEIK |
| iPS:435 249 | 21- 225_96E2 | VK4|B3|J K1 | DSVMTQSPDSLAV SLGERATINC | KSS--- QSVLHSSNNKN YLA | WYQQKPGQ PPKLLIY | W------- ASTWES | GVPDRFSGSGSG--- TDFTLTISSLQAEDVAVYYC | QQYYR--------------TPWT | FGQGT KVEIK |
| iPS:435 255 | 21- 225_96D5 | VK4|B3|J K1 | DIVMTQSPDSLAV SLGERATINC | KSS--- QSVLHSSNNYN YLA | WYQQKPGQ PPKLLIY | W------- ASTRES | GVPDRFSGSGSG--- TDFTLTISSLQAADVAVYYC | QQYYS--------------SPPT | FGQGT TVEIK |
| iPS:435 257 | 21- 225_96H5 | VK4|B3|J K1 | DIVMTQSPDSLAV SLGERATINC | KSS--- QSVLYSSNSHN YLA | WYQQKPGQ PPKLLIY | W------- ASIRES | GVPDRFSGSGSG--- TDFTLSISSMQAEDVAVYYC | QQYFS--------------TPCS | FGQGT KVEIK |
| iPS:435 267 | 21- 225_96D10 | VK4|B3|J K1 | DIVMTQSPDCLAV SLGERATINC | KSS--- QNILSSSNNKN YLT | WYQQKPGQ PPKLLIY | W------- ASTRES | GVPDRFSGSGSFG--- TDFTLTISSLQAEDVAVYYC | QQYFS--------------VPPT | FVQGT KVEIK |
| iPS:435 279 | 21- 225_97H4 | VK4|B3|J K1 | DIVMTQSPDSLAV SLGERATINC | KSS--- QSVLYTSNNNN YLA | WYQQKPGQ PPKLLIY | W------- ASTRES | GVPDRFSGSGSG--- TDFTLTISSLQAEDVAVYYC | QHYND--------------TPWR | FGPGT KVEIK |
| iPS:435 321 | 21- 225_147E4 | VK4|B3|J K1 | DIVMTQSPDSLAV SLGERATINC | KSS--- QSVLHSSNNYN YLA | WYGLKPRQ PPKLLIY | W------- ASTRKS | GVPDRFSGRGSG--- TDFTLTISSLQAEDVAIYYC | QQYYS--------------TPST | FGPGT KVEIK |
| iPS:435 353 | 21- 225_148F8 | VK4|B3|J K1 | DIVMTQSLDSLAV SLGERATINC | KSS--- QSALHSSNNYN YLA | WYQQKPGQ PPKLLIY | W------- ASTRES | GVPDRFSGSGSG--- TDFTLTISSLQAEDVAVYYC | QQYYS--------------IPPT | FGQGT KVEIK |
| iPS:435 369 | 21- 225_149A2 | VK4|B3|J K1 | DIVMTQSPDSLAV SLGERATINC | KSS--- QSVLYSPNNNN YLA | WYQQKPGQ PPKLLIY | W------- ASTRES | GVPDRFSGSGSG--- TDFTLTISSLQAEDVAVYYC | QQYYS--------------TPCS | FGQGT KVEIK |
| iPS:435 373 | 21- 225_149E3 | VK4|B3|J K1 | DIVMTQSPDSLAV SLGERATISC | KSS--- QSVLHNSRNHN YFA | WYQQKPGQ PPKLLIY | W------- ASTLRS | GVPDRFSGSGSG--- TDFTLTISSLQAEDVAVYYC | QQYYS--------------TPPT | FGQGT KVEIK |
| iPS:435 375 | 21- 225_149H4 | VK4|B3|J K1 | DIVMTQSPDSLAV SLGERATINC | KSS--- QSVLSSSNDNN YLA | WYQQKPGR PPKLLIY | W------- SSTRES | GVPDRFSGSGSG--- TDFTLTISSLQAEDVAVYYC | HQYYS--------------YPPT | FGQGT KVEIK |

FIGURE 51 (Continued)

| | | | | | | | | | |
|---|---|---|---|---|---|---|---|---|---|
| iPS:435 481 | 21-225_154A1 | VK4|B3|J K1 | DIVMTQSPDSLAV SLGERATINC | RSS--- QSVLHSSNNYN YLA | WYQQKPGQ PPKLLIY | W------- ASKRDS | GVPDRFSGSGSG--- TDFTLTISSLQAEDVAVYYC | QQYFS----- -----SPRT | FGQGT KVEIK |
| iPS:435 557 | 21-225_158B1 | VK4|B3|J K1 | DIVMTQSPDSFAV SLGERATINC | KSS--- QNVLHSSNNNN YLT | WYQQRPGQ PPKLLIY | W------- ASTRES | GVPDRFSGSGSG--- TEFTLTISSLQAEDVAVYYC | QQYS----- -----TPPT | FGQGT KVEIK |
| iPS:435 627 | 21-225_162F6 | VK4|B3|J K1 | DIVMTQSPDSLAV SLGERATINC | KSS--- QNVLHSSNNNN YLT | WYQQRPGQ PPKLLIY | W------- ASTRES | GVPDRFSGSGSG--- TEFTLTISSLQAEDVAVYYC | QQYS----- -----TPPT | FGQGT KVEIK |
| iPS:435 701 | 21-225_170F6 | VK4|B3|J K1 | DIVMTQSPDSLAV SLGERATINC | KSS--- QSVLHSSNNYN YLA | WYQQKPGQ PPKVLIH | W------- ASTRKS | GVPDRFSGSVSG--- TDFTLINSLQAEDVAVYYC | QQYS----- -----TPWT | FGQGT KVEIK |
| iPS:435 737 | 21-225_174G5 | VK4|B3|J K1 | DIVMTQSPDSLAV SLGERATINC | KSS--- QSVLHSSNRYN YLT | WYQQKSGQ PPKLLIY | W------- ASTRES | GVPDRFSGSGSG--- TDFTLTISSLQAEDVAVYYC | QQYS----- -----TPWT | FGQGT KVEIK |
| iPS:435 751 | 21-225_175D1 0 | VK4|B3|J K1 | DIVMTQSPDSLAV SLGERATINC | KSS--- QSVLYSSNNRN YLA | WYQQKPGQ PPNLLIY | W------- TSTRES | GVPDRFSGSGSG--- TNFTLTISSLQAEDVAVYYC | QQYS----- -----TPPT | FGQGT KVEIK |
| iPS:435 773 | 21-225_177B1 | VK4|B3|J K1 | DIVMTQSPDSLAV SLGERATINC | KSS--- QSVLHSSNNNN YLT | WYQQKPGQ PPKLLIY | W------- ASTRES | GVPDRFSGSGSG--- TDFTLTISSLQAEDVAVYYC | HQYFI----- -----SPPT | FGQGT KVEIK |
| iPS:435 801 | 21-225_181E5 | VK4|B3|J K1 | DIVMTQSPDSLAV SLGERATINC | RSS--- QSVLHSSNRYN YLA | WYQQKPGQ PPKLLIY | W------- ASTRES | GVPDRFSGSGSG--- TDFTLTISSLQAEDVAVYYC | QQYS----- -----TPWT | FGLGT KVEIK |
| iPS:435 841 | 21-225_191D8 | VK4|B3|J K1 | DIVMTQSPDSLAV SLGERATINC | KSS--- QSVLHSFNRYN YLA | WYQQKPGH PPKLLIY | W------- ASTRES | GVPDRFSGSGSG--- TDFTLPISSLQAEDVAVYYC | QQYS----- -----TPFT | FGQGT KVEIK |
| iPS:435 925 | 21-225_190D7 | VK4|B3|J K1 | DIMMTQSSDSLAV SLGERAIISC | KSS--- QSVLSSSNNKN YLV | WYQQKPGH PPKLLIY | W------- ASTRKS | GVPDRFSGSGSG--- TDFTLTISSLQAEDVAVYYC | QQYS----- -----TPWT | FGQGT KVEIK |
| iPS:436 021 | 21-225_193G4 | VK4|B3|J K1 | DIVMTQSPDSLAV SLGERATINC | KSS--- QSVLYSSNRYN YLT | WYQQKPGQ PPKLLIY | W------- ASTRKS | GVPDRFSGSGSG--- TDFTLAISSLQAEDVAVYYC | QQYI----- -----TPWT | FGQGT KVDIK |
| iPS:436 114 | 21-225_196G8 | VK4|B3|J K1 | DIVMTQSPDSLAV SLGERATINC | KSS--- QSVLHSSNNNN YLT | WYQQKPGQ PPKLLIY | W------- ASTRES | GVPDRFSGSGSG--- TDFTLTISSLQAEDVAVYYC | QQYN----- -----TPPT | FGQGT KVEIK |
| iPS:436 150 | 21-225_197H4 | VK4|B3|J K1 | DIMMTQSPDSLTV SLGERATINC | KSS--- QSVLHSFNRYN YLA | WYQQKAGH PPNLLIY | W------- ASTRES | GVPDRFSGSGSG--- TDFTLPISSLQAEDVAVYYC | QQYS----- -----TPFT | FGLGT KVEIK |
| iPS:436 154 | 21-225_197C6 | VK4|B3|J K1 | DIVMTQSPDSLAV SLGERATIISC | RSS--- QSVLHSSNNYN YLA | WYQQKFGH FPNLLIY | W------- ASTRKS | GVPDRFSGSGSG--- TDFTLTISSLQAEDVAVYYC | QQYS----- -----TPFT | FGLGT KVEIK |
| iPS:436 218 | 21-225_200G7 | VK4|B3|J K1 | DIVMTQSPDSPTA SLGERATVKC | KSS--- QSVLHSSNNNN YLA | WYQQKPGQ PPKLLIY | W------- ASTRES | GVPDRFSGSGSG--- TDFTLAISSLQADDVAVYYC | QQYN----- -----TPPT | FGQGT KVEIK |
| iPS:436 272 | 21-225_201F5 | VK4|B3|J K1 | DIVMTQSPESLAV SLGERATINC | KSS--- QSVLYSNNKN YLV | WYQQKPGQ PPKLLIY | W------- ASTRES | GVPDRFSGSGSG--- TDFTLTISSLQAEDVAVYYC | QQYS----- -----TPFT | FGQGT KVEIK |

FIGURE 51 (Continued)

| | | | | | | | | |
|---|---|---|---|---|---|---|---|---|
| iPS:436 400 | 21-225_213H7 | VK4|B3|J K1 | DIVMTQSPDSLAV SLGERATINC | KSS--- QNVLDISNKKN SLG | WFQQKPGQ PPKLLIN | W------- ASTRES | GVPDRFSGSGSG--- TDFTLTISSLQTEDVAVYHC | QQYYN------ -------TPPT | FGRGT KVEIK |
| iPS:436 402 | 21-225_213H1 2 | VK4|B3|J K1 | DIVMTQSPDSLAV SLGERATITC | KSS--- QNVLKTSNNRN YLA | WYQQKPGQ PPKVLIY | W------- ASTRES | GVPDRFSGSGSG--- TDFTLTISSLQAEDVAVYYC | HQYYS------ -------IPWT | FGQGT KVEIK |
| iPS:436 500 | 21-225_222H3 | VK4|B3|J K1 | DIVMTQSPDSLAV SLGERATINC | KSS--- QSVLKSSNNHRN YLA | WYQQKPGQ PPQLLIY | W------- ASTRET | GVPDRFSGSGSG--- TDFTLTISSLQAEDVSVYSC | QQYSS------ -------IPWT | FGQGT KVEIN |
| iPS:436 520 | 21-225_223G1 0 | VK4|B3|J K1 | DIVMTQSPDSLAV SLGERATINC | KSS--- QSILLSSNRDKN YLA | WHQQKPGQ PPKLLIY | W------- ASTRES | GVPDRFSGSGSG--- TDFTLTISSLQAEDVAVYYC | LQYFS------ -------TPWT | FGQGT KVEIK |
| iPS:436 544 | 21-225_224H5 | VK4|B3|J K1 | DIVMTQSPDSLAV SLGERATINC | KSS--- QSVLYSSNNFN YLT | WYQQKPGQ PPKLLIY | W------- ASTRES | GVPDRFSGSGSG--- TDFTLTINSLQAEDVAVYYC | QQYYS------ -------TPPT | FGQGT KVEIK |
| iPS:436 550 | 21-225_224D8 | VK4|B3|J K1 | DIVMTQSPDSLAV SLGERAAINC | KSS--- QSVLYSSNNKN YLA | WYQQKPGQ PPKLLIY | W------- SSTRKS | GVPDRFSGSGSG--- TDFTLTISSLQAEDVAVYYC | QQYFS------ -------TPPT | FGQGT KVEIK |
| iPS:436 574 | 21-225_225F5 | VK4|B3|J K1 | DIVMTQSPDSLAV SLGERATINC | KSS--- QNVLYNSNNNN YLA | WFQQKPGQ PPNLLIN | W------- ASTRES | GVPDRFSGSGSG--- TDFTLTISSLQAEDVAVYFC | QQYYS------ -------SPPT | FGQGT KVEIN |
| iPS:436 586 | 21-225_225F11 | VK4|B3|J K1 | DIVMTQSPDSLAV SLGERATINC | KSS--- QSVLYSSNRNYN YLA | WYQQKPGQ PPKLLIY | W------- ASTRES | GVPDRFSGSGSG--- PDFTLTISSLQAEDVAVYYC | QQYYT------ -------TPPT | FGQGT KVEIK |
| iPS:436 600 | 21-225_226F6 | VK4|B3|J K1 | DIVMTQSPDSLAV SLGERATINC | KSS--- QSILYSSNNNYN YLA | WYQQKPGQ PPKLLIY | W------- ASTRES | GVPDRFSGSGSG--- PDFTLTISSLQAEDVAVYYC | QQYYT------ -------TPPT | FGQGT KVEIK |
| iPS:436 616 | 21-225_226D1 | VK4|B3|J K1 | DIVMTQSPDSLAV SLGERATINC | KSS--- QSVLHSSNGNN YLV | WYQQKPGQ PPKLLIY | W------- ASTRES | GVPDRFSGSGSG--- TDFTLTISSLQAEDVAVYYC | QQYYK------ -------TPWT | FGQGT KVEIK |
| iPS:436 622 | 21-225_226A1 | VK4|B3|J K1 | DIVMTQSPDSLAV SLGERATINC | KSS--- QNVLYNSNNNN YLA | WYQQTPGQ PPKLLFY | W------- ASTRES | GVPDRFSGSGSG--- TDFTLTISSLQAEDVAVYYC | QQYYS------ -------TPWT | FGQGT KVEIK |
| iPS:436 638 | 21-225_227C7 2 | VK4|B3|J K1 | DIVMTQSPDSLAV SLGERATINC | RSS--- QIVLSDSNNNN YLA | WYQQKPGQ PPNLLIY | W------- ASTRES | GVPDRFSGSGSG--- TDFSLTISSLQAEDVAVYFC | QQYYS------ -------SPPT | FGQGT KVEIK |
| iPS:437 356 | 21-225_74B1 | VK4|B3|J K1 | DIVMTQSPDFLAV SLGERATINC | KSS--- QSVLHRSNNYN YLA | WYQQKPGQ PPKLLIY | W------- ASTRES | GVPDRFSGSGSG--- TDFTLTIGSLQAEDVAVYYC | QQYYS------ -------TPPT | FGQGT KVEIK |
| iPS:437 361 | 21-225_74C1 | VK4|B3|J K1 | DIVMTQCPDSFAV SLGERASINC | KSS--- QSILHSSNNYN YLA | WYQQKPGH PPKLLIY | W------- ASTRES | GVPDRFSGSGYG--- TDFTLTISSLQAEDVAVYYC | QQYYS------ -------TPWT | FGQGT KVEIK |
| iPS:437 379 | 21-225_74H2 | VK4|B3|J K1 | DIVMTQSPDSLAV SLGERATINC | KSS--- QSVLHSSNNKN YLT | WYQQKPGQ PPKLLIY | W------- ASTRES | GVPDRFSGSGSG--- TDFSLTIGSLQAEDVAVYYC | QQYYS------ -------IPPT | FGQGT KVEIK |
| iPS:446 094 | 21-225_77E1 | VK4|B3|J K1 | DIVMTQSPDSLAV SLGERATINC | KSS--- QTVLRSSNMYN YLT | WYQQKPGQ PPKVLIY | W------- TSTRES | GVHDRFSGSGSG--- TDFTLTISSLQAEDVAVYYC | HQYLS------ -------SPLT | FGQGT KVEIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS.451 116 | 21-225_164A4 | VK4|B3/J K1 | DIVMTQYPDSRAV SLGERATIKC | KSS--- QSVLYSSNNKN YLI | WYQQKFGQ PPKLFIY | W------- ASTRES | GVPDRFSGSGCG--- TDFTLTISSVQAEDVAVYYC | QQYFS------------TPWT | FGQGT KVEIK |
| iPS.451 124 | 21-225_74F6 | VK4|B3/J K1 | DIVMTQSPDSLAV SLGERATINC | KSS--- QNILSSSNNKN YLI | WYQQKPGQ PPKILIY | W------- TSTRES | GVPDRFSGSGFG--- TDFTLTISSLQAEDVAVYYC | QQYFS------------VPLI | FGQGT KVEIK |
| iPS.451 127 | 21-225_164A7 | VK4|B3/J K1 | DIVMTQCPDSLAV SLGERATINC | KSS--- QSVLHSSNNKN YLA | WYQQKPGQ PHKILIY | W------- ISTRES | GVPDRFSGSGYG--- TDFSLTIASLQAEDVAVYYC | QQYYS------------IPLI | FGQGT KVEIK |
| iPS.451 129 | 21-225_94D2 | VK4|B3/J K1 | DIVMTQSPDSLAV SLGERATINC | KSS--- QSVLHSSNNKN YLA | WYQQKPGQ PHKLLIY | W------- ISTRES | GVPDRFSGSGSG--- TDFSLTIGSLQHEDVAVYYC | QQYHS------------IPPT | FGHGT KVEIK |
| iPS.451 133 | 21-225_95H4 | VK4|B3/J K1 | DIVMTQCPDSLAV SLGERATINC | KSS--- QSVLSSSNNYN YLA | WYQQKPGQ PHNLLIY | W------- ASTRES | GVPDRFSGSGSG--- TDFSLTISSLQAADVAVYYC | QQYHS------------SPLI | FGQGT TVQIK |
| iPS.451 786 | 21-225_24E1 | VK4|B3/J K1 | DIVMTQSPDSLAV SLGERATINC | KSS--- QSVLYTSNNNN YLI | WYQQKPGQ RPNLLIY | W------- ASTRES | GVPDRFSGSGSG--- TDFTLTISSLQAEDVAVYYC | QQFYS------------TPPT | FGQGT KVEIK |
| iPS.392 886 | 21-225_23A12 | VK4|B3/J K1 | DIVMTQSPDSLAV SLGERATINC | KSS--- QSVLYSSNNNN YLA | WYQQKPGQ PPKLLIY | W------- ISTRES | GVPDRFSGSGSG--- TEFTLTISSLQAEDVAVYYC | QQYYD------------TPPT | FGQGT KVEIK |
| iPS.392 928 | 21-225_25A4 | VK4|B3/J K1 | DIVMTQFPDSLAV SLGERATINC | KSS--- QSVLHSSNNKN YLA | WYQQKPGQ PPKLLIY | W------- ASTRES | GVPDRFSGSGSG--- IEFTLTISSLEAEDVAVYYC | QQYYS------------TPPT | FGQGT KVEIK |
| iPS.392 960 | 21-225_29E6 | VK4|B3/J K1 | DIVMTQFPDSLAV SLGERATINC | KSS--- QSVLYSSHNNY YLA | WYQKPGQ PHKLLIY | W------- ASSRES | GVPDRFSGSGSG--- TEFTLTISSLQAEDVAVYYC | QQYYS------------TPPT | FGQGT KVEIK |
| iPS.392 992 | 21-225_26C4 | VK4|B3/J K1 | DIVMTQSPDSLAV SLGERATINC | KSS--- QSVLYRSNNYN YLA | WYQKPGQ PPKLLIY | W------- ASTRES | GVPDRFSGSGSG--- IDFTLTISSLQAEDVAVYYC | QQYS-------------TPPT | FGQGT KVEFK |
| iPS.393 368 | 21-225_29H8 | VK4|B3/J K1 | DIVMTQSPDSLAV SLGERATINC | RSS--- QTILHSSNNYN YLA | WYQQKPGQ PPKLLIY | A------- ASTRES | GVPDRFSGSGSG--- TDFTLTISSLQAEDVAVYYC | QQYYC------------TPPT | FGQGT KVEIK |
| iPS.393 942 | 21-225_11E5 | VK4|B3/J K1 | DIVMTQSPDSLAV SLGERATINC | KSS--- QSVLYSSNNNN YLA | WYQQKPGQ RPKLLIY | W------- ASTRES | GVPDRFSGSGSG--- TNFTLTISSLQAEDVAVYYC | QQYS-------------TPPT | FGQGT KVEIK |
| iPS.398 506 | 21-225_23G12 | VK4|B3/J K1 | DIVMTQSPDSLAV SLGERATINC | KSS--- QSILFSSNNNN YLA | WYQQKPGQ PPKLLIY | W------- ASTRES | GVPSRFSGSGSG--- TDFTLTISSLQAEDVAVYFC | QQYSS------------TPWT | FGQGT KVEIK |
| Germline | | | K_FR1 | K_CDR1 | K_FR2 | K_CDR2 | K_FR3 | K_CDR3 | K_FR4 |
| VK1|A30|JK 2 | | | | | | | | | |
| iPS.426 114 | 21-225_28H2 | VK1|A30/ JK2 | DIQMTQSPSSLSA SIGDRVTITC | RAS--- QGIR------NDLG | WYQQKPGK APKRLIY | A------- ASSLQS | GVPSRFSGSGSG--- TEFTLTISLQPEDFATYYC | LQHYS------------YPRS | FGQGT KLEIK |
| iPS.426 116 | 21-225_29E2 | VK1|A30/ JK2 | DIQMTQSPSSLSA SVGDRVTITC | RAS--- QAIR------NDLG | WYQQRPGK APKRLIY | A------- ASSLQS | GVPSRFSGSGSG--- TDFILTISLQPEDFATYYC | LQHYN------------YPRS | FGQGT KLEIK |
| iPS.434 231 | 21-225_61F2 | VK1|A30/ JK2 | DIQMTQSPSSLSA SVGDRVTVTC | RAS--- QGIR------DDLG | WYQQKPGK APERLIY | A------- ASSLQS | GVPSRFSGSGSG--- TEFTLTISSLQPEDFATYYC | LQHYS------------YPRS | FGQGT KLEIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:435 401 | 21-225_150E2 | VK1A30/JK2 | DIQMTQSPSSLSA SVGDRVTITC | RAS--QGIG------NDLG | WYQQKPGK APTRLIY | A-------ASSLQS | GVPSRFSGSGSG--TEFTLTISSLQPADFATYYC | LQHYS----------FPYS | FGQGT KLEIK |
| iPS:435 445 | 21-225_152F7 | VK1A30/JK2 | DIQMTQSPSSLSA SVGDRVTIIC | RAS--QGIR------NDLG | WYQQKPGK APKRLIY | A-------TSSLQS | TEFTLTISSLQPEDFATYYC | LQHYN----------YPYS | FGQGT KLEIK |
| iPS:435 763 | 21-225_176H1 2 | VK1A30/JK2 | DIQMTQSPSSLSA SVGDRVTITC | RAS--QGIR------NDLG | WYQQKPGK APMRLIY | A-------ASSLQS | GVPSRFSGSGSG--TEFTLTISSLQREDFATYYG | LQHNS----------YPRS | FGQGT KLEIK |
| iPS:435 767 | 21-225_177B4 | VK1A30/JK2 | DIQMTQSPSSLSA SVGDRVTITC | RAS--QGIR------NDLG | WYQQKPGK APKRLIY | A-------ASSLQS | GVPSRFSGSGSG--TEFTLTISSLQPEDFATYYC | LQHYS----------FPRS | FGQGT KLEIK |
| iPS:392 974 | 21-225_26A11 | VK1A30/JK2 | DIQMTQSPFSLSA SVGDRVTITC | RAS--QAIR------NDLG | WYQQKPGK APKRLIY | A-------ASSLQS | GVPSRFSGSGSG--TEFTLTISSLQPEDFATYYC | LQHYN----------YPRS | FGQGT KLEIR |
| iPS:393 046 | 21-225_25A12 | VK1A30/JK2 | DIQMTQSPSSLSA SVGDRVTYTC | RAS--QAIR------DDLG | WYQQKPGK APKRLIY | A-------ASSLQS | GVPSRFSGSGSG--TEFTLTISSLQPEDFATYYC | LQHYN----------YPRS | FGQGT KLEIK |
| | Germline | | K_FR1 | K_CDR1 | K_FR2 | K_CDR2 | K_FR3 | K_CDR3 | K_FR4 |
| | VK1O12/JK4 | | DIQMTQSPSSLSA SVGDRVTITC | | | | | QQSYS | |
| iPS:426 118 | 21-225_7A10 | VK1O12/JK4 | DIQMTQSPSSLSA SVGDRVTITC | RAS--QNIY------SYLN | WYQQKPGR APKLVIY | S-------TSSLQS | GVPSRFSGSGSG--TDFSLTISNLQPEDFSTYYC | QQSYS----------PPLT | FGGGT KVEIR |
| iPS:426 124 | 21-225_32D6 | VK1O12/JK4 | DIQMTQSPSSLST SVGDRVTITC | RAS--QNII------SYLN | WYQQKPGK APKLLMY | V-------ASRLQS | TDFTLTISSLQAEDFATYYC | QQSYS----------TPYT | FGGGT KVAIK |
| iPS:451 135 | 21-225_64A11 | VK1O12/JK4 | DIQMTQSPFSLSA SVGDRITITC | RAS--RSVS------RYLN | WYQQTLGK ALKLLIS | V-------ASRLQS | GVPSRFSGSGSG--TDFTLTISSVQREDFATYYC | QQSDS----------FPLT | FGGGT KVEIK |
| iPS:434 011 | 21-225_48B10 | VK1O12/JK4 | DIQMTQSPSSLSA SVGDRVTITC | RAS--QSIR------KYLN | WYQKTPGK APKLLIY | A-------ASSLQS | GVPSRFSGSGSG--TDFTLTISSVQPEDFATYYC | QQTYS----------NPLT | FGGGT KVEFT |
| iPS:434 015 | 21-225_48F12 | VK1O12/JK4 | DIQMTQSPSSLSA SVGDRVTITC | RAS--QSIR------KYLN | WYQKIPGK APKLLIY | A-------ASSLQS | TDFTLTISSVQPEDFANYYC | QQTYS----------NPLT | FGGGT EVEIT |
| iPS:434 017 | 21-225_48G12 | VK1O12/JK4 | DIQMTQSPSSLSA SVGDRVTITC | RAS--QSIR------KYLN | WYQQKPGK APKLLIY | A-------ASSLQS | GVPSRFSGSGSG--TDFTLTISSVQPEDFANYYC | QQSYS----------NPLT | FGGGT EVEIT |
| iPS:434 165 | 21-225_50F2 | VK1O12/JK4 | DIQMTQSPDRITITC SVGDRITITC | RAS--QSIL------SYLN | WYQQKPGH APKLLIY | V-------ASSFQS | TDFTLTISSLQPDDFATYYC | QQSYS----------FPLT | FGGGT KVEIK |
| iPS:434 191 | 21-225_56B6 | VK1O12/JK4 | DIQMTQSPSSLSV SVGDRVTITC | RAS--QSIF------RVLN | WYQQKPGR APKLLIF | A-------ASSFQS | TDFTLTISSLQPERFATYYC | QQTYS----------FPLT | FGGGT KVEIK |
| iPS:434 247 | 21-225_62D2 | VK1O12/JK4 | DIQMTQSPSSLSA SVGDRVTITC | RAS--QSIF------SYLN | WYQQKPGK APKLLIY | A-------TSSLQS | GVPSRFSGSGSG--TDFTLTISSLQPEDFATYYC | QQTYS----------FPLT | FGGGT KVEIK |
| iPS:434 335 | 21-225_63C10 | VK1O12/JK4 | DIQMTQSPSSLST SVGDRVTITC | RAS--QSIF------SYLH | WYQQKPGK APKLLIS | A-------ASSLQS | GVPSRFSGSGSG--TDFTLTISSLQPEDFATYYC | QQTYS----------FPLT | FGGGT KVEIK |
| iPS:434 341 | 21-225_64F7 | VK1O12/JK4 | DIQMTQSPSSLSA SVGDRVTITC | RAS--QNIK------KYLN | WYQQKPGK APKFLIY | G-------ASSLQS | TDFTLTISSLQPEDFAAYYC | QQSYN----------ISFT | FGGGT KVELK |
| iPS:435 295 | 21-225_146H1 | VK1O12/JK4 | DIQMTQSPSSLSA SVGDRVTITC | RAS--QSIS------DYLN | WYQLKPGK APKVLIY | T-------TSSLQS | GVPSRFSGSGSG--TDFTLTISSLQPEDFATYYC | QQSY-----------STPT | FGGGT KVEIK |
| iPS:435 307 | 21-225_146E9 | VK1O12/JK4 | DIQMTQSPSSLSA SVGDRVTITC | RAS--QSIS------DYLN | WYQQKPGK APKVLIY | T-------TSSLQS | TDFTLTISSLQPEDFATYYC | QQSY-----------STPT | FGGGT KVEIK |
| iPS:435 347 | 21-225_148C4 | VK1O12/JK4 | DIQMTQSPSSLSA SVGDRVTITC | RAS--QSII------NYLN | WYQQKPGK APKVLIY | A-------ASSLQS | TDFTLTISSLQPERFTTYYC | QQSY-----------STPT | FGGGT KVEIE |
| iPS:435 355 | 21-225_148H9 | VK1O12/JK4 | DIQMTQSPSSLSA SVGDRVTITC | RAS--QSIS------NYLN | WYQQKPGK APKVLIY | I-------ASSLQS | GVPSRFSGSGSG--TDFTLTISSLQPEDFATYYC | QQSY-----------STPT | FGGGT KVEIK |

FIGURE 51 (Continued)

| | | | | | | | |
|---|---|---|---|---|---|---|---|
| iPS-435 371 | 21-225_149A3 | VK1|O12/ JK4 | DIQMTQSPSSLSA SVGDRVTITC | RAS---QSIS-- -----SYLN | WYQQKPGK APKVMIY | T------- ASSLQS | GVPSRFSGSGSG--- TDFTLTINSLQPEDFATYYC | QQSY---------STPT | FGGGT KVEIK |
| iPS-435 415 | 21-225_150C1 | VK1|O12/ JK4 | DIQMTQSPSSLSA SVGDRVTITC | RAS---QSIS-- -----SYLN | WYQQKPGK APKVLIY | T------- ASSLQS | GVPSRFSGSGSG--- TDFTLTISSLQPEDFATYYC | QQSY---------SIYT | FGGGS KVEIK |
| iPS-435 419 | 21-225_150C1 | VK1|O12/ JK4 | DIQMTQSPSSLSA SVGDRVTITC | RAS---QSIS-- -----DYLN | WYQQKPGK APKVLIY | T------- ISSLQS | GVPSRFSGSGSG--- TDFTLTISSLQPEDFATYYC | QQSF---------STPT | FGGGT KVEIK |
| iPS-435 425 | 21-225_151B1 | VK1|O12/ JK4 | DIQMTQSPSSLSA SVGDRVTITC | RAS---QSIS-- ----NFLN | WYQQKPGK APKVLIY | I------- ASSLES | GVPSRFSGSESG--- TDFTLTISSLQPEDFATYYC | QQSY---------STPT | FGGGT RVEIK |
| iPS-435 431 | 21-225_152D2 | VK1|O12/ JK4 | DIQMTLSPSSLSA SVGDRVTITC | RAS---QSIS-- -----DYLN | WYQLKPGK APRVLIY | T------- TSSLQS | GVPSRFSGSGSG--- TDFTLTISSLQPEDFATYYC | QQSY---------STPT | FGGGT KVEIK |
| iPS-435 439 | 21-225_152G4 | VK1|O12/ JK4 | DIQMTQSPSSLSA SVGDRVTITC | RAS---QSIS-- -----DYLN | WYQQKPGK APKVLIY | T------- ISSLQS | GVPSRFSGSGSG--- TDFTLTISSLQPEDFATYYC | QQSY---------STPT | FGGGT KVEIK |
| iPS-435 455 | 21-225_152B1 | VK1|O12/ JK4 | DIQMTQSPSSLSA SVGDRVTITC | RAS---QSIS-- -----DYLN | WYQQKPGK APKVLIY | T------- TSSLQS | GVPSRFSGSGSG--- TDFTLTISSLQPEDFATYFC | QQSY---------STPT | FGGGT KVEIK |
| iPS-435 487 | 21-225_155C4 | VK1|O12/ JK4 | DIQMTQSPSSLSA SVGDRVTITC | RAS---QSIS-- -----SYLN | WYQQKPGK APKVLIF | T------- ASSLQS | GVPSRFSGSGSG--- TDFTLTISSLQPEDFATYYC | QQSY---------STPT | FGGGT RVEIK |
| iPS-435 503 | 21-225_156E4 | VK1|O12/ JK4 | DIQMTQSPSSLSA SVGDRVTITC | RAS---QSIS-- -----SYLN | WYQQKPGK APKVLIY | A------- ASSLQS | GVPSRFSGSGSG--- TDFTLTISSLQPEDFATYYC | QQSY---------SAPT | FGGGT KVEIK |
| iPS-435 563 | 21-225_159H2 | VK1|O12/ JK4 | DIQLTQSPSSLSA SVGDRVTITC | RAS---QSIS-- -----KYLN | WYQQKPGK APELLIY | A------- TSNLQS | GVPSRFSGSGSG--- TDFTLTISLQPEDVTYYC | QQSY---------LPVT | FGGGT KVEIK |
| iPS-436 110 | 21-225_196F4 | VK1|O12/ JK4 | DFQMTQSPSSLSA SVGDRVTITC | RAS---QRIH-- -----SYLN | WYQQKPGK APKLLIY | T------- ASSLQG | GVPSRFSGSGSG--- TDFTLTISSLQPEDFATYYC | QQSYG--------SPLT | FGGGT KVEIK |
| iPS-436 244 | 21-225_201H1 | VK1|O12/ JK4 | DIQMTQSPSSLSA SVGDRVTITC | RAS---HNIN-- -----SYLN | WYQQKSGK APKLLIY | A------- ASSLQS | GVPSRFSGSGSG--- TDFTLTFSSLQPEDFATYYC | QQSYS--------FPLT | FGGGT KVEMR |
| iPS-436 262 | 21-225_203E3 | VK1|O12/ JK4 | DIQMTQSPSPSSA SVGDRVTITR | RAS---HNIN-- -----SYLN | WYQQKSGK APKLLIY | A------- ASSLQS | GVPSRFSGSGSG--- TDFTLTFSSLQPEDFATYYC | QQSYS--------FPLT | FGGGT KVEMR |
| iPS-436 276 | 21-225_204H4 | VK1|O12/ JK4 | DIQMTLSPSSFSA FVGDRVTITR | RAS---HNIN-- -----SYLN | WYQQKSGK APKLLIY | A------- ASSLQS | GVPSRFSGSGSG--- TDFTLTFSSLQPEDFATYYC | QQSYS--------FPLT | FGGGT KVEMR |
| iPS-436 280 | 21-225_204D6 | VK1|O12/ JK4 | GSQMTQSPSSLSA SVGDRVTITC | RAS---RSVH-- -----TYLN | WYQQKPGK APKVLIY | G------- TSSLQR | GVPSRFSGSGSG--- TDFTLTISSLQPEDVATYYC | QQSYS--------SPLT | FGGGT KVEIQ |
| iPS-436 312 | 21-225_206A4 | VK1|O12/ JK4 | DIQMTLSPSSFSA SVGDRVTITC | RAS---HNIN-- -----SYLN | WYQQKSGK APKLLIC | A------- ASSLQS | GVPSRFSGSGSG--- TDFTLTFSSLQPEDFATYYC | QQSYS--------FPLT | FGGGT KVEMR |
| iPS-436 316 | 21-225_206A5 | VK1|O12/ JK4 | DIQMTQSPSSFSA SVGDRVTITC | RAS---HNIN-- -----SYLN | WYQQKSGK APKLLIC | A------- ASSLQS | GVPSRFSGSGSG--- TDFTLTFSSLQPEDFATYYC | QQSYS--------FPLT | FGGGT KVEMR |
| iPS-436 338 | 21-225_208E8 | VK1|O12/ JK4 | DIQMTQSPSSFSA FVGDRVTITR | RAS---HNIN-- -----SYLN | WYQQKSGK APKLLIY | A------- ASSLQS | GVPSRFSGSGSG--- TDFTLTFSSLQPEDFATYYC | QQSYS--------FPLT | FGGGT KVEMR |
| iPS-436 344 | 21-225_208B1 | VK1|O12/ JK4 | DIQMTQSPSSFSA SVGDRVTITC | RAS---HNIN-- -----SYLN | WYQQKSGK APKLLIY | A------- ASSLQS | GVPSRFSGSGSG--- TDFTLTFSSLQPEDFATYYC | QQSYS--------FPLT | FGGGT KVEMR |
| iPS-436 358 | 21-225_210D1 | VK1|O12/ JK4 | DIQMTQSPSSLSA SVGDRVTITC | RAS---HNIN-- -----SYLN | WYQQKSGK APKLLIY | A------- ASSLQS | GVPSRFSGSGSG--- TDFTLTFSSLQPEDFATYYC | QQSYS--------FPLT | FGGGT KVEMR |

FIGURE 51 (Continued)

| | | | | | | | | | |
|---|---|---|---|---|---|---|---|---|---|
| iPS:437 282 | 21-225_207C9 | VK1|O12/ JK4 | DNQMTQSPSSLSA SVGDRVTITC | RAS--QRFS-- ----NYLN | WYQQKPGK APKLLIY | T------ ASSLQS | GVPSRFSASVSG- TDFTLTISSLQPEDFATYYC | QQSYS--------- ----IPLT | FGGGT KVEIK |
| iPS:392 636 | 21-225_17A6 | VK1|O12/ JK4 | DIQMTQSPSSLSA SVGDRVTITC | RAS--QTIS-- ----NYLN | WYHQKPGK APKLLIY | A------ ASSLQS | GVPSRFSGSGSG- TDFTLTISSLQPEDFATYYC | QQSHT--------- ----SPLT | FGGGT KVEIK |
| iPS:392 648 | 21-225_16D11 | VK1|O12/ JK4 | DIQMTQSPSSLSA SVGDRVTITC | RAS--QTIS-- ----NYLN | WYHQKPGK APKLLIY | A------ ASSLQS | GVPSRFSGSGSG- TDFTLTISSLQPEDFATYYC | QQSHS--------- ----SPLT | FGGGT KVEIK |
| iPS:392 664 | 21-225_20F6 | VK1|O12/ JK4 | DIQMTQSPSSLSA SVGDRVTITC | RAS--QSII-- ----TYLN | WYQQKPGK APKLLIH | T------ ASSLQS | GVPSRFSGSGSG- TDFTLTISSLQPEDFATYYC | QQTYS--------- ----PPLT | FGGGT KVEIK |
| iPS:392 738 | 21-225_18G4 | VK1|O12/ JK4 | DIHMTQSPSSLSA SVGDRVTITC | RAS--QSII-- ----SYLN | WYQQKPGK APKVLIH | T------ ASSLQT | GVSGFSGSGSG-- TDFTLTISSLQPEDFATYYC | QQTYS--------- ----PPLT | FGGGT KVEIK |
| iPS:392 798 | 21-225_22C7 | VK1|O12/ JK4 | DIQMTQSPSSLSA SVGDRVTITC | RAS--QNII-- ----SYLN | WYQQKPEK APKLLIH | I------ ASSLQS | GVPSRFSGSGSG- TDFTLTISSLQPEDFATYYC | QQTYS--------- ----TPLI | FGGGT KVEIK |
| iPS:392 922 | 21-225_30G4 | VK1|O12/ JK4 | DIQMTQSPSSLST SVGDRVTITC | RAT--QNIP-- ----SYLN | WHQQKPGK APKLLIH | A------ ASSLQG | GVPSRFSGSGSG- TDFTLTISMQPEDFSTYYC | QLSYS--------- ----PPYT | FGGGT KVEIK |
| iPS:393 002 | 21-225_30G1 | VK1|O12/ JK4 | DIQMTQSPSSLSA SVGDRVTITC | RAS--QNIY-- ----SYLN | WYQQKPGK DPKLLIY | A------ ASSLHS | GVPSRFSGSGSG- TDFTLTISSLQPEDFATYYC | QQSYS--------- ----TPLT | FGGGT KVEIK |
| iPS:393 042 | 21-225_31F1 | VK1|O12/ JK4 | DIQMTQSPSSLSA SVGDRVTITC | RAS--QRIS-- ----SYLN | WYQQKPGK APKLLIF | T------ ASSSQS | GVPSRFSGSGSG- TDFTLTISSLQPEDFATYYC | QQSYI--------- ----TPLI | TVEIR |
| iPS:393 066 | 21-225_34D3 | VK1|O12/ JK4 | DIQMTQSPSSLST SVGDRVTITC | RAS--QNIY-- ----SYLN | WYQQKPGK DPKLLIY | A------ ASSLHS | GVPSRFSGSGSG- TDFTLTISSLQPEDFATYYC | QQSYS--------- ----TPLT | FGGGT KVEIK |
| iPS:393 082 | 21-225_34C11 | VK1|O12/ JK4 | DIQMTQSPSSLSTC | RAS--QNIR-- ----NFLN | WYQQKPEK DPKLQIY | G------ ASTLQS | GVPSRFSGSGFG- TDFTLTISSLQPRDFATYYC | QQTCS--------- ----TPLT | FGGGT KVEIK |
| iPS:393 092 | 21-225_33C12 | VK1|O12/ JK4 | DIQMTQSPSSLST SVGDRVTITC | RAS--QSII-- ----SYLN | WYQQKPGK APKLLIY | V------ ASSLQG | GVPSRFNGSGSG- TDFTLTISSLQPEDFATYYC | QQSYS--------- ----TPYT | FGGGT KVEIK |
| iPS:393 100 | 21-225_36B8 | VK1|O12/ JK4 | DIQMTQSPSSLST SVGDRVTITC | RAS--QSII-- ----SYLN | WYQQKPGK APKLLIY | V------ ASSLQS | GVPSRFSGSGSG- TYFTLTISSLQPEDFATYYC | QQSYS--------- ----TPYT | FGGGT KMEIK |
| iPS:393 108 | 21-225_34G11 | VK1|O12/ JK4 | DIQMTQSPSSLST SVGDRVTITC | RAS--QNIN-- ----RYLN | WYQQKPGK APKLLIY | G------ ASSLQS | GVPSRFSGSGSG- TDFTLTISTLQPEDFATYYC | QQTYT--------- ----TPLT | FGGGT NVEIK |
| iPS:393 122 | 21-225_33B2 | VK1|O12/ JK4 | DIQMTQSPSSLST SVGDRVTITC | RAS--QSII-- ----SYLN | WYQQKPGK APKLLIY | V------ ASSLQS | GVPSRFSGSGSG- TDFTLTISSLQPEDFATYYC | QQSYS--------- ----TPYT | FGGGT NVEIK |
| iPS:393 134 | 21-225_34C2 | VK1|O12/ JK4 | DIQMTQSPSSLST SVGDRVTITC | RAS--QRII-- ----SYLN | WFQQKPGK APKLLIY | V------ ASSLQS | GVPSRFSGSGSG- TYFTLTISSLQPEDFATYYC | QQSYS--------- ----TPYT | FGGGT NMEIK |
| iPS:393 136 | 21-225_34D8 | VK1|O12/ JK4 | DIQMTQSPSSLST SVGDRVTITC | RAS--QSII-- ----SYLN | WYQQKPGK APKLLIY | V------ ASSLQS | GVPSRFSGSGSG- TDFTLTISSLQPEDFATYYC | QQSYS--------- ----TPYT | FGGGT KVEIK |
| iPS:393 840 | 21-225_3F8 | VK1|O12/ JK4 | DIQMTQSPSSLSA SVGDRVTITC | RAS--QSIL-- ----RYLN | WYRQKPGR APQVLIH | T------ TSSLQS | GVPSRFSGSGSG- TVFTLTISSLQPEDFATYYC | QQTYS--------- ----TPLT | FGGGT RVEIN |
| iPS:393 844 | 21-225_3G7 | VK1|O12/ JK4 | DIQMTQSPSSLSA SVGDRVTITC | RAS--QNIY-- ----SYLN | WYQQKPGR APKLMIY | A------ ASSSQS | GVPSRFSGSGSG- TDFTVISLQPEDFATYYC | QQSYS--------- ----PPFT | FGGGA KVEID |
| iPS:393 852 | 21-225_12A10 | VK1|O12/ JK4 | DVQMTQSPSSLSA SAGDRVTITC | RAS--QKPGR-- ----SYLN | WYQEKPGK APKVLIH | T------ ASSLQS | GVPSRFSGSGSG- ADFTLTINSLQPEDFATYYC | QQSYS--------- ----PPLT | FGGGT KVEIK |
| iPS:393 900 | 21-225_10E12 | VK1|O12/ JK4 | DIQMTQSPSSLSA SVGDRVTITC | RAS--QNIY-- ----SYLN | WYQEKPGK APKLLIY | T------ TSSLQS | GVPSRFGSGSGSG- TDFTLTISSLQPEDFATYYC | QQNYS--------- ----PPLI | FGGGT KVEIE |
| iPS:393 920 | 21-225_1H12 | VK1|O12/ JK4 | DIQMTQSPSSLSA SVGDRVTITC | RAS--QTII-- ----RYLN | WYQEKPGR APKLLIY | T------ ASSLQS | GVPSRFSGSDSG- | QQSYS--------- ----PPLI | FGGGT KVEIK |
| iPS:393 926 | 21-225_4G4 | VK1|O12/ JK4 | DIQMTQSPSSLAA SVGDRVTITC | RAS--QTII-- ----SYLN | WYQQKPGK APKLLIH | T------ ASSLQS | GVPSRFSGSGSG- TDFTLTISSLQPEDFATYYC | QQTYS--------- ----TFLT | FGGGT KVEIK |

FIGURE 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:393 930 | 21-225_7E11 | VK1|O12/ JK4 | DIQMTQSPSSLSA SVGDRVTIAC | RAS--QNII-----SYLN | WYQQKPGK APKFLIY | T------ASSLQS | GVPSRFSGSGSG---TDFTLTISSLQPEDFAIYYC | QQTYS--------TPLT | FGGGT KVEIK |
| iPS:393 932 | 21-225_10F5 | VK1|O12/ JK4 | DIQMTQSPSSLSA SVGDRVTITC | RAS--QNIY-----RYLN | WYQEKPGR APKLLIY | T------ASSLQS | GVPSRFSGSDSG---TDFTLTISSLQPEDSAG | QQSYS--------PPLT | FGGGT KVEIK |
| iPS:393 964 | 21-225_6G1 | VK1|O12/ JK4 | DIQMTQSPSSLSA SVGDRVTITC | RTS--QNII-----SYLN | WYQQKPGK APKVLIY | T------ASMLQT | GVPSGFSGSGSG---TDFTLTISSLQPEDFATYYC | QQPHS--------PPLT | FGGGT KVEIK |
| iPS:394 012 | 21-225_15A3 | VK1|O12/ JK4 | DIQMTQSPSSLSA SVGDRVTITC | RAS--QSII-----SYLN | WYLQKFGK APKFLIY | T------ASSLQS | GVPSRFSGSGSG---TDFTLTISSLQPEDFATYYC | QQTYS--------TPLT | FGGGT KVEIK |
| iPS:394 016 | 21-225_13D4 | VK1|O12/ JK4 | DLQMTQSPSSLSA SVGDRVTITC | RAS--QSIF-----SYLN | WYQQKPGK APKLLIC | T------ASSLQN | GVPSRFSGSGSG---TDFTLTISSLQPEDFATYYC | QQTYS--------LPLT | FGGGT KVEIK |
| iPS:394 083 | 21-225_16E6 | VK1|O12/ JK4 | DIQMTQSPSSLSA SVGDRVTITC | RAS--QSII-----SYLN | WYQQKPGK APKFLIY | T------TSSLQS | GVPSRFSGSGSG---TDFTLTISSLQPEDFATYYC | QQTYS--------TPLT | FGGGT KVEIK |
| iPS:398 480 | 21-225_17G4 | VK1|O12/ JK4 | DIQMTQSPSSLSA SAGDRVTITC | RTS--QNIS-----NYLN | WYQQKPGK APKLLIY | V------ASSFPS | GVPSRFSGSGSG---FEFTLTISSLQPEDFATYYC | QQSNF--------FPLT | FGGGT KVEII |
| iPS:398 486 | 21-225_19A1 | VK1|O12/ JK4 | DIQMTQSPSSLSA SVGDRVTITC | RAS--HTII-----SYLN | WYQQKPGK APKFLIY | A------ISNLQS | GVPSRFSGSGSG---TDFTFISSLQPEDFAIYYC | QQSYN--------FPLT | FGGGT KVEIK |
| | Germline | VK2|A18|JK 4 | | | | | K_CDR3 | K_FR4 |
| iPS:451 139 | 21-225_71A6 | VK2|A18/ JK4 | DIVMTQTPLSLSV TPGQPASISC | KSS----QSLLRSD-GRTHLY | WYLQKPGQ PPQLLIY | E------VSNRFS | GVSDRFSGSGSG---TDFTLKISRVEAEDVGVYYC | MQSKQ--------LPLT | FGGGT KVEFK |
| iPS:433 937 | 21-225_44B10 | VK2|A18/ JK4 | HIVMTQTPLSLSV TPGQPASISC | KSS----QSLLHSE-GRTYLY | WYLQKPGQ PPQLLIY | E------ISNRFS | GVPDRFSGSGSG---TDFTLKISRVEAEDVGVYYC | MQSIH--------LPFT | FGGGT KVEIK |
| iPS:433 979 | 21-225_46B9 | VK2|A18/ JK4 | DIVMTQTPLSLSV TPGQPASISC | KSS----QSLLHSE-GKTYLN | WYLQKPGQ PPQLLIY | E------VSYRFS | GVPDRFSGSGSG---TDFTLKISRMEAEDVGVYYC | MHSIQ--------YPLT | FGGGT KVEIQ |
| iPS:434 201 | 21-225_59A12 | VK2|A18/ JK4 | DIVMTQTPLSLSV TPGQPASISC | KSS----QSLQHGE-GKTYLN | WYQQKPGQ PPQLLIY | E------VSYRFS | GVPDRFSGSGSG---TDFTLKISRVEBDVGVYYC | MQSTQ--------LPLT | FGGGT KVEIK |
| iPS:434 205 | 21-225_60G2 | VK2|A18/ JK4 | DIVMTQTPLSLSV TPGQPASISC | KSS----QSLLHSE-GKTYLN | WYLQKPGQ PPQLLIY | E------VSNRIS | GVPDRFSGSGSG---TDFTLKISRVEAEDVGVYYC | MQSIQ--------LPLT | FGGGT KVEIK |
| iPS:434 223 | 21-225_60C12 | VK2|A18/ JK4 | DIVMTQTPLSLSV TPGQPASISC | KSS----QSLLHSE-PFQFLIY | WYLQKPGQ PPQLLIY | E------VSNRFS | GVPDRFSGSGSG---TDFTLKISRVEAEDVGTYYC | MQSIK--------YPLT | FGGGT KVEIK |
| iPS:434 233 | 21-225_61B3 | VK2|A18/ JK4 | DIVMTQTPLSLSV TPGQPASISC | KSS----QSLLHSE-GKTYLY | WYLQKPGQ PPQLLIY | E------VSNRIS | GVPDRFSGSGSG---TDFTLKISRVEAEDVGVYYC | MQSIQ--------LPLT | FGGGT KVEIK |
| iPS:434 303 | 21-225_58H11 | VK2|A18/ JK4 | DIVMTQTPLSLSV TPGQPASISC | KSS----QSLLHSE-GKTYLY | WYLQKPGQ PPQLLIY | E------VSNRFS | GVPDRFSGSGSG---TDFTLKISRVEAEDVGVYYC | MQSIQ--------LPLT | FGGGT KVEIK |
| iPS:435 349 | 21-225_148F5 | VK2|A18/ JK4 | DIVMTQTPLSLSV TPGQPASISC | KSS----QSLLHSE-GKTYLY | WYLQKPGQ PPQLLIY | E------VSYRVS | GVPDRFSGSGSG---TDFTLKISRVEAEDVGVYFC | MQSIQ--------LPLT | FGGGT KVEIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:435 359 | 21-225_148H10 | VK2|A18/ JK4 | DIVMTQTPLSLSV TPGQPASISC | KSS--- QSLLHSE- GKTYLY | WYLQKPGQ PPQLLIY | E------- VSYRVS | GVPDRFSGSGSG-- TDFTLKISRVEAEDVGVYYC | MQSIQ--------- -------LPLT | FGGGT KVEIK |
| iPS:435 417 | 21-225_150D1 | VK2|A18/ JK4 | DIVMTQTPLSLSV TPGQPASISC | KSS--- QSLLHSE- GKTYLY | WYLQKPGQ PPQLLIY | E------- VSYRFS | GVPDRFSGSGSG-- TDFTLKISRVEAEDVGVYYC | MQGIQ--------- -------LPLT | FGGGT KVEIK |
| iPS:435 469 | 21-225_153G9 | VK2|A18/ JK4 | DIVMTQTPFSLSV TPGQPASISC | KSS--- QSLLHSD- GKTYLY | WYLQKPGQ PPQFLIY | E------- VSNRFS | GVPDRFSGSGSG-- TDFTLKISRVEADDVGVYYC | MQNIK--------- -------YPLT | FGGGT KVEIK |
| iPS:435 733 | 21-225_173C1 | VK2|A18/ JK4 | DIVMTQTPLSLSV TPGQPASISC | KSS--- QSLLHSE- GKTYLY | WYLQKPGQ PPQLLIY | E------- VSHRFS | GVPDRFSGSGSG-- TDFTLKISRVEAEDVGVYYC | MQSI---------- -------QLLT | FGGGT KVEIK |
| iPS:435 785 | 21-225_179C2 | VK2|A18/ JK4 | DIVMTQTPLSLSV TPGQPASISC | KSS--- QSLLHSE- GKTYLY | WYLQKPGQ PPQLLIY | E------- VSHRFS | GVPDRFSGSGSG-- TDFTLKISRVEAEDVGVYYC | MQSI---------- -------QVLT | FGGGT KVEIK |
| iPS:392 618 | 21-225_16F10 | VK2|A18/ JK4 | DIVMTQTPLSLSV TPGQPASISC | KSS--- QSLLHSD- GKTHLN | WYLQKPGQ PPQLLIY | E------- VSYRFS | GVPDRFSGSGSG-- TVFTLEISRVEAADVGVYYC | FQSIQ--------- -------LPLT | FGGGT KVEIK |
| iPS:392 860 | 21-225_22H8 | VK2|A18/ JK4 | DIVMTQTFLSLSV TPGQPASISC | KSS--- QSLLHSD- GKTYLY | WYLQKPGH PPQLLIY | E------- VSNRFS | GVPDRFSGSGSG-- TDFTLKISRVEAEDVGIYYC | MQSIQ--------- -------LPLS | FGGGT KVEIN |
| iPS:392 888 | 21-225_25A2 | VK2|A18/ JK4 | DIVMTQTPLSLSV TPGQPASISC | KSS--- QSLLHSE- GKTYLY | WYLQKPGQ PPQLLIY | E------- ISNRFS | GVPARLSGSGSG-- TDFTLKISRVEAEDVGVYYC | MQSTQ--------- -------FPLT | FGGGT KVEIK |
| iPS:392 938 | 21-225_29H4 | VK2|A18/ JK4 | DIVMTQTPASPSC TPGQPASFSC | KSS--- QSLLHSD- GKTYLY | WYLQKPGQ PPQLLIF | E------- VSHRFS | GLPDRFSGSGSG-- TDFTLKISRVEAEDVGVYYC | MQSIK--------- -------HPFT | FGGGT KVEIK |
| iPS:392 994 | 21-225_26G11 | VK2|A18/ JK4 | DIVMTQTPLSLSV TPGQPASISC | KSS--- QTLLHGE- GKTYLY | WYLQKPGH PPHLLIY | E------- VSNRFS | GVPDRFSGSGSG-- TDFTLKISRVEAEDVGIYYC | MQSIK--------- -------LPLT | FGGGT KVEIK |
| iPS:393 012 | 21-225_26G7 | VK2|A18/ JK4 | DILMTQTPLSLSV TPGQPASISC | KSS--- QSLLHSE- GKTYLY | WYLQKPGQ PPQFLIY | E------- VSHRLS | GVPDRFSGSGSG-- TDFTLKISRVEAEDVGVYYC | MQSIQ--------- -------LPLT | FGGGT KVEIK |
| iPS:393 144 | 21-225_34D2 | VK2|A18/ JK4 | DIVMTQTPLSLSV TPGQPASISC | KSS--- QSLLHSD- GKTYLY | WYLQKPGQ PPQLLIY | E------- VSNRFS | GVPSRFSGSGSG-- TDFTLKISRVEAEDVGVYYC | MQSK---------- -------QLPP | FGGGT KVEIR |
| Germline | | | K_FR1 | K_CDR1 | K_FR2 | K_CDR2 | K_FR3 | K_CDR3 | K_FR4 |
| VK1|L1|JK3 | | | | | | | | | |
| iPS:451 143 | 21-225_66H11 | VK1|L1/ K3 | DIQMTQFPSSLFA FVGDRVTITC | PAS--QGIS- ---NYLA | WFQQKPGK APKSLIY | G------- AFNLHS | GVPSKFSGSGSFG TDFTLTINSLQPEDFANYYC | QQYSC--------- -------YPFT | FGHGT RVDIK |
| iPS:468 814 | 21-225_223D1 | VK1|L1/ K3 | DIQMTQSPSSLSA SVGDRVTITC | RAS--QGIS- ---NYLA | WFQQKPGK APKSLIY | A------- ASTLQS | GVPSRFSGSRSG-- TDFNLTISNLQPEDFATYYC | QQYSG--------- -------YPFT | FGPGT KVDIK |
| iPS:433 901 | 21-225_43A4 | VK1|L1/ K3 | DIQMTQSPSSLSA SVGDRVTITC | RAS--QGIN- ---NYLA | WFQQKPGK APKSLIN | A------- ASSLQS | GVPSRFSGSGSG-- TDFTLAISSLQPEDFATYYC | QQYYS--------- -------YPFT | FGRGT RVDIK |
| iPS:433 961 | 21-225_45D9 | VK1|L1/ K3 | DIQMTQSPSSLSA SVGDRVTITC | RAS--QGIN- ---NYLA | WFQQKPGK APKSLIN | A------- ASSLQS | GVPSRFSGSGSG-- TDFTLAISSLQPEDFATYYC | QHYYS--------- -------YPFT | FGRGT KVDIK |

FIGURE 51 (Continued)

| ID | | | | | | | | | | |
|---|---|---|---|---|---|---|---|---|---|---|
| iPS:434 059 | 21-225 51C5 | VK1\|L1/J K3 | DIQMTQSPSSLSA SVGDRVTITC | RAS--QGIS-----NYLA | WFQQKPGE APKSLIY | A------ASSLRS | GVPSQFSGSGSG--TDFTLTISSLQPEDFATYYC | QQYIS-------YPFT | FGPGT KVDIK |
| iPS:434 085 | 21-225 52E3 | VK1\|L1/J K3 | DIQMTQSPSSLSA SVGDRVTITC | RAS--QGIS-----NYLA | WFQQKPGK APKSLIN | A------ASSLQS | GVPSKFSGSGSG--TDFTLTISSLQPEDFATYYC | -------------FPFT | FGPGT KVDIK |
| iPS:434 115 | 21-225 53E4 | VK1\|L1/J K3 | DIQMTQSPSSLSA SVGDRVTITC | RAS--QVIS-----NYLA | WFQQKPGK APKSLIS | A------ASSLQS | GVPSKFSGSGSG--TDFTLTISSLQPEDFATYYC | QQYHS-------YPLT | FGRGT KVDIK |
| iPS:434 213 | 21-225 60A4 | VK1\|L1/J K3 | DIQMTQSPSSLSA SVGDRVTITC | RAS--QGIS-----NYLA | WFQQKPGK APKSLIY | A------ASSLQS | GVPSKFSGSGSG--TDFTLTISSLQSEDFATYYC | QQYKS-------MPFT | FGPGT KVDIK |
| iPS:434 215 | 21-225 60F7 | VK1\|L1/J K3 | DIQMTQSPSSLSA SVGDRVTITC | RAS--QVIK-----NYLV | WVQQKPGK APKSLIY | A------ASSLQS | GVPSTFSGSGSG--TDFTLTISSLQPEDFATYYC | LQFHS-------YPFT | FGPGT KMDIK |
| iPS:434 261 | 21-225 56F7 | VK1\|L1/J K3 | DILMTQSPSSLSA SVGDRVTITC | RAS--QGIS-----TYLA | WFQQTPGT APKSLIY | A------ASSLQG | GVPSKFSGSGSG--TDFTLTISSLQPEDFATYYC | HQYNS-------FPFK | FGRGT KVDIT |
| iPS:434 331 | 21-225 63H8 | VK1\|L1/J K3 | DIQMTQSPSSLSA SVGDRVTITC | RAS--QGIS-----NYLA | WFQQKPGK AHKSLIY | A------ASSLQS | GVPSKFSGSGSG--TDFTLTISSLQPEDFATYYC | QQYHS-------YPFT | FGPGT KVDIR |
| iPS:434 361 | 21-225 65D5 | VK1\|L1/J K3 | DIQMTQSPSSLSA SVGDRVTITC | RAS--QDIN-----NYLA | WFQQKPGK APRSLIY | A------ASSLQS | GVPSQFSASGSG--SDFTLTISSLQPEDFATYYC | PLYKS-------YPLT | FGPGT KVDIK |
| iPS:434 405 | 21-225 68E6 | VK1\|L1/J K3 | DIQMTQSPSSLSA SVGDRVTITC | RAS--QGIS-----YYLA | WFQQKPGR APKSLIY | V------ASSLQS | GVPSKFSGSGSG--TDFTLTISSLQPEDFATYYC | QQYDS-------YPFT | FGPGT KVDIR |
| iPS:434 259 | 21-225 96C6 | VK1\|L1/J K3 | DIQMTQSPSSLSA SVGDRVTITC | RAS--QGIS-----NYLA | WFQQKPGK APRSLIY | A------ASSLQS | GVPSKFSGSGSG--TDFTLTISSLQPEDFATYYC | HQYRD-------YPFT | FGPGT KVDIK |
| iPS:435 351 | 21-225 148B6 | VK1\|L1/J K3 | DIQMTQSPSSLSA SVGDRVTITC | RAS--QGIS-----KYLA | WFQQKPGK APKSLIF | A------ASSLQS | GVPSKFSGSGSG--TDFTLTISSLQPEDFATYYC | QQYNS-------FPFT | FGPGT KVDIK |
| iPS:435 461 | 21-225 153A1 | VK1\|L1/J K3 | DIQMTQSPSSLSA SVGDRVTITC | RAS--QVIS-----NYLA | WFQQKPGK APKSLIS | A------ASSLRS | GVPSNFSGSGSG--TDFTLTISSLQPEDFATYYC | QQYHS-------YPFT | FGPGT KVDFK |
| iPS:435 509 | 21-225 157H1 | VK1\|L1/J K3 | DIQMTQSPSSLSA SVGDRVTITC | RAS--QDIS-----NYLV | WFQQRPGK APRSLIY | A------ASSLRS | GVPSKFSGSGSG--TDFTLTISSLQPEDFATYYC | QQYHS-------YPFT | FGPGT KVDIK |
| iPS:435 515 | 21-225 157E4 | VK1\|L1/J K3 | DIQMTQSPSSLSA SVGDRVTITC | RAS--QGIS-----NYLA | WFQQKPGK APRSLIY | A------ASSLRS | GVPSQFSGSGSG--TDFTLTINSLQPEDFATYYC | QQYHS-------YPFT | FGPGT KVDIK |
| iPS:435 523 | 21-225 157G5 | VK1\|L1/J K3 | DIQMTQSPSSLSA SVGDRVTITC | RAS--QDIN-----NYLA | WFQQKPGK APTSLIY | A------ASSLQS | GVPSNFSGSGSG--TDFTLTISSLQPEDFATYYC | QQYNS-------YPFT | FGPGT KVDIK |
| iPS:435 535 | 21-225 157H10 | VK1\|L1/J K3 | DIQMTQSPSSLSA SVGDRVTITC | RAS--QGIT-----NYLA | WFQQKPGK APTSLIY | T------ASNLQS | GVPSKFSGSGSG--TDFTLTISSLQPEDFATYYC | QQYHS-------YPFT | FGPGT KVDIK |
| iPS:435 559 | 21-225 158H12 | VK1\|L1/J K3 | DIQMTQSPSSLSA SVGDRVTITC | RAS--QGIS-----NYLA | WFQQKPGK APKSLIS | A------ASSLQS | GVPSKFSGSGSG--TDFTLTISSLQPEDFATYYC | QQYNS-------YPFT | FGPGT KVDIK |
| iPS:435 575 | 21-225 159H11 | VK1\|L1/J K3 | DIQMTQSPSSLSA SVGDRVTITC | RAS--QGIS-----KYLV | WFQQKPGK APKSLIY | A------ASSLQS | GVPSKFSGSGSG--TDFTLTISNLQPEDFATYYC | QQYNS-------YPFT | FGPGT KVDIK |
| iPS:435 579 | 21-225 160G1 | VK1\|L1/J K3 | DIQMTQSPSSLSA SVGDRVTITC | RAS--QDIN-----NYLA | WFQQKPGK APKSLIY | A------SSSLQS | GVPSKFSGSGSG--TDFTLTISSLQPEDFATYYC | QQYHS-------YPFT | FGPGT KVDIR |
| iPS:435 585 | 21-225 160G3 | VK1\|L1/J K3 | DIQMTQSPSSLSA SVGDRVTITC | RAS--QDIN-----NYLA | WFQQKPGK APTSLIY | A------SSSLQS | GVPSKFSGSGSG--TDFTLTISSLQPEDFATYYC | QQYHS-------YPFT | FGPGT KVDIK |
| iPS:435 635 | 21-225 163F1 | VK1\|L1/J K3 | DIQMTQSPSSLSA SVGDRVTITC | RAS--QDIS-----NYLA | WFQQKPGK APKSLIY | A------ASSLQS | GVPSKFSGSGSG--TDFTLTISSLQPEDFAAYYC | QQYNS-------YPFT | FGPGT QVDAQ |

FIGURE 51 (Continued)

| | | | | | | | | |
|---|---|---|---|---|---|---|---|---|
| iPS:435 659 | 21-225_167D1 | VK1|L1/J K3 | DIQMTQSPSSLSA SVGDRVTITC | RAS--QGIN--- ------NYLA | WFQQKPGK APESLIY | A------ ASSLQS | GVPSKFSGSGSG--- TDFTLTISSLQPEDFATYFC | QQYNS------ ---------YPFT | FGPGT KVDIK |
| iPS:435 679 | 21-225_169D1 | VK1|L1/J K3 | DIQMTQSPSSLSA SVGDRVTITC | RAS--QDIS--- ------NYLA | WFQQKPGK APKSLIY | A------ ASSLQS | GVPSKFSGSGSG--- TDFTLTISSLQPEDFATYYC | QQYHS------ ---------YPFT | FGPGT KVDIK |
| iPS:435 685 | 21-225_170E1 | VK1|L1/J K3 | DIQMTQSPSSLSA SEGDRVTITC | RAS--QGIS--- ------NYLA | WFQQKPGK APKSLIY | A------ ASSLQS | GVPSKFSGSGSG--- TDFTLTISSLQPEDFATYYC | QQYNS------ ---------YPFT | FGPGT KVDIK |
| iPS:435 747 | 21-225_175C4 | VK1|L1/J K3 | DIQMTQSPSSLSA SVGDRVTITC | RAS--QGIG--- ------NYLA | WFQQKPGK APKSLIY | A------ ASGLQS | GFPSKFSGSGSG--- TDFTLTISSLQPEDFATYYC | QQYYS------ ---------YPFT | FGPGT KVDIK |
| iPS:435 765 | 21-225_177D3 | VK1|L1/J K3 | DIQMSQSPSSLSA SVGDRVTITC | RAS--QGIT--- ------NYLA | WFQQKPGK APKSLIY | A------ ASSLQS | GVPSKFSGSGSG--- TDFTLTISSLQPEDFATYYC | QQYNS------ ---------YPFT | FGPGT KVDIK |
| iPS:435 797 | 21-225_181G2 | VK1|L1/J K3 | DIQMTQSPSSLSA SIGDRVTITC | RAS--QGIS--- ------NYLA | WIQQKPGT APKSLIY | A------ ASSLQS | GVSSRFSGSGFG--- TDFTLTISSLQPEDFATYYC | QQYNG------ ---------YPFT | FGPGT KVDIK |
| iPS:435 835 | 21-225_190F12 | VK1|L1/J K3 | DIQMTQSPSSLSA SVGDRVTITC | RAS--QGIG--- ------KYLA | WFQQKPGK APKSLIY | A------ ASSLQS | GVPSKFSGSGSG--- TDFTLTISSLQPDGFATYYC | QRYDT------ ---------YPFT | FGPGT KVDIK |
| iPS:435 861 | 21-225_190A5 | VK1|L1/J K3 | DIQMTQSPSSLSA SVGDRVTITC | RAS--QGIG--- ------NHLA | WFQQKPGK APKSLIH | A------ ASSLQS | GVPSKFSGSGSG--- TDFTLTISSLQPEDFATYYC | QQISN------ ---------YPVT | FGPGT KVDIK |
| iPS:435 869 | 21-225_190B1 | VK1|L1/J K3 | DIQMTQSPSSLSA SVGDRVTITC | RAS--QGIR--- ------NYLA | WFQQKPGK APKSLIY | V------ ASSLES | GVPSKFSGSGSG--- TDFTLTISSLQPEDFGTYYC | QQYLN------ ---------YPVT | FGHGT KVDIR |
| iPS:435 877 | 21-225_184E7 | VK1|L1/J K3 | DIQMTQSPSSRSA SVGDRVTITC | RAS--QGIS--- ------NYLA | WIQQKPGT APKSLIY | A------ ASSLQS | GVSSRFSGSGFG--- TDFTLTISSVQREDFATYYC | QQYNG------ ---------YPFT | FGHGT KVDIK |
| iPS:435 883 | 21-225_185A1 | VK1|L1/J K3 | DIQMTQSPSSLSA SVGDRVTITC | RAS--QGIG--- ------NYLA | WFQQTPGK APKSLIS | V------ ASSLQS | GVPSRFSASGSG--- TDFTLTISSLQPEDFATYYC | RQYHS------ ---------YPFT | FGPGT KVDIK |
| iPS:435 885 | 21-225_185E1 | VK1|L1/J K3 | DIQMTQSPSSRSA SVGDRVTITC | RAS--QGIS--- ------NYLA | WIQQKPGT APKSLIY | A------ ASSLQS | GVSSRFSGSGFG--- TDFTLTISSLQPEDFATYYC | QQYNG------ ---------YPFT | FGPGT KVDIK |
| iPS:435 891 | 21-225_188H5 | VK1|L1/J K3 | DIQMTQSPSSLSA SIGDRVTITC | RAS--QGIS--- ------NYLA | WLQQKPGK APKSLIY | A------ ASSLQS | GVSSRFSGSGFG--- TDFTLTISSLQPEDFATYYC | QQYNS------ ---------YPFT | FGPGT KVDIK |
| iPS:435 897 | 21-225_188B9 | VK1|L1/J K3 | DIQMTQSPSSLSA SIGDRVTITC | RAS--QGIS--- ------NYLA | WLQQKPGT APKSLIY | A------ ASSLQS | GVSRFSGSGFG--- TDFTLTISSLQPEDFATYYC | QQYNS------ ---------YPFT | FGPGT KVDIK |
| iPS:435 937 | 21-225_190H9 | VK1|L1/J K3 | DIQMTQSPSSLSA SIGDRVTITC | RAS--QGIG--- ------KYLA | WFQQKPGK ALKSLIY | A------ ASSLQS | GVPSKFSGSGSG--- TDFTLTISSLQPDFATYYC | QRYDT------ ---------YPFT | FGPGT KVDIK |
| iPS:435 961 | 21-225_192A2 | VK1|L1/J K3 | DIQMTQSPSSLSA SVGDRVTITC | RAN--QGIN--- ------NYLA | WFQQKPGK APKSLIY | A------ ASSLQS | GVPSKFSGSGSG--- TDFTLTISSLQPEDFATYYC | QQYNS------ ---------YPFT | FGPGT KVDIK |
| iPS:435 977 | 21-225_192E4 | VK1|L1/J K3 | DIQMTQSPSSLSA SVGDRVTITC | RAS--QGIG--- ------NYLA | WFQQKPGK APKSLIY | V------ VSSLQS | GVPSRFSGSGFG--- TDFTLTISSLQPEDFATYYC | QRYDT------ ---------YPFT | FGPGT KVDIK |
| iPS:436 001 | 21-225_192C1 | VK1|L1/J K3 | DIQMTQSPSSLSA SIGDRVTITC | RAS--QGIG--- ------NYLA | WFQQKPGR APKSLIY | A------ ASSLQS | GVSKFSGSGSG--- ADFTLTISSLQPEDFATYYC | QQYNS------ ---------YPFT | FGPGT KVDIK |
| iPS:436 039 | 21-225_193F8 | VK1|L1/J K3 | DIQMTQSPSSLSA SVGDRVTITC | RAS--QGVS--- ------NHLA | WFQQKPGK APKSLIY | A------ ASSLQS | GVPSKFSGSGSG--- TDFTLTISSLQPEDFATYYC | QRYDT------ ---------YPFT | FGPGT KVDIK |
| iPS:436 078 | 21-225_194H1 | VK1|L1/J K3 | DIQMTQSPSSLSA SVGDRVTITR | RAS--QGIG--- ------KYLA | WFQQKPGK ALKSLIY | A------ ASSLQS | GVPSKFSGSGSG--- TDFTLTISSLQPDGFATYYC | QRYDT------ ---------YPFT | FGPGT KVDIK |
| iPS:436 140 | 21-225_197G3 | VK1|L1/J K3 | DIQMTQSPSSLSA SVGDRVTITC | RAS--QGIG--- ------NHLA | WFQQKPGK APKSLIY | A------ ASSLQS | GVPSKFSGSRSG--- TDFSLTISSLQPEDFATYYC | QQYSN------ ---------YPVT | FGPGT KVDFK |

FIGURE 51 (Continued)

| | | | | | | | | | |
|---|---|---|---|---|---|---|---|---|---|
| iPS:436_167 | 21-225_197E1 | VK1|L1/J K3 1 | DIQMTQSPSSLSA SVGDRVTITC | RAS--QGIN------KYLS | WFQQKPGK APKSLIY | A---------ASSVQS | GVPSKFSGSGSG---TDFTLTISSLQPEDFATYYC | QRYDT------------YPFT | FGPGT KVDIK |
| iPS:436_370 | 21-225_211A6 | VK1|L1/J K3 | DIQMTQSPSSLSA SVGDSVTITC | RAS--QGIG------KYLA | WFQQKPGK APKSLIY | A---------ASSLLS | GVPSKFSGSGSG---TDFTLTISSLQPEDFATYYC | QKYDT------------YPFT | FGPGT KVDIK |
| iPS:436_392 | 21-225_213B3 | VK1|L1/J K3 | DIQMTQSPSSLSA SVGDRVTITC | RAS--QGIG------KYLA | WFQQKPGK APKSLIS | A---------ASSVLS | GVPSKFSGSGSG---TDFTLTISSLQPEDFATYYC | QKYDT------------YPFT | FGPGT KVDIK |
| iPS:436_404 | 21-225_214C3 | VK1|L1/J K3 | DIQMTQSPSSLSA SVGDRVTITC | RAS--QGIG------NYLA | WFQQKPGK VPKSLIY | A---------ASSLQS | GVPSKFSGSGSG---TDFTLTISSLQPEDFTTYYC | QQYMT------------YPIT | FGPGT KVDIK |
| iPS:436_406 | 21-225_214E4 | VK1|L1/J K3 | DIQMTQSPSSLSA SVGDRVTITC | RAS--QGIS------NYLA | WFQQKPGK APKSLIY | A---------ASSLQS | GVPSKFSGSGSG---TDFTLTISSLQPEDFATYYC | QQYLT------------YPFT | FGPGT KVDIK |
| iPS:437_216 | 21-225_51D5 | VK1|L1/J K3 | DIQMTQSPSSLSA SVGDRVTITC | RAS--QGIN------NYLA | WFQQKPGE APKSLIY | A---------ASSLRS | GVPSQFSGSGSG---TDFTLTISSLQPEDFATYYC | QQYYS------------YPFT | FGPGT KVDIK |
| iPS:437_224 | 21-225_56H1 | VK1|L1/J K3 | DIQMTQSPSSLSA SVGDRVTITC | RAS--QGIS------HYLA | WFQQKPGK APQSLMS | A---------ASGLQS | GVPSKFSGSGSG---TDFTLTISSLQPEDFATYYC | QQYQN------------YPFT | FGPGT KVDIK |
| iPS:392_620 | 21-225_17H5 | VK1|L1/J K3 | DIQMTQSPSSLSA SVGDRVTITC | RAS--QGIG------NYLA | WFQQKPGK APKSLIN | A---------ASSLQS | GVPSKFSGSGSG---TDFTLTISSLQPEDFATYYC | QQYHS------------YPFT | FGPGT KVDIK |
| iPS:392_692 | 21-225_18G10 | VK1|L1/J K3 | DIQMTQSPSSLFA FVGDRVTITC | RAS--QGIS------YYLA | WFQQKPGK APKSLIY | V---------ASSLQS | GVPSKFGGSGFG---TDFTLTISSLQPEDFATYYC | LQYNS------------YPFT | FGPGT KVDIK |
| iPS:392_708 | 21-225_18D11 | VK1|L1/J K3 | DIQMTQSPSSLSA SVGDRVTITC | RAS--QGIS------YYLA | WFQQKPGK APKSLIY | A---------ASSLQS | GVPSKFSGSGFG---TDFTLTISSLQPEDFATYYC | QQYNT------------YPFT | TVDIK KVDIK |
| iPS:392_802 | 21-225_23E7 | VK1|L1/J K3 | DIQMTQSPSSLSA SVGDRVTITC | RAS--QGIS------NYLA | WFQQIPGK APKSLIY | A---------ASSLQS | GVPSKFSGSGSG---TDFTLTISNLQPEDFASYYC | QQYHS------------FPFT | FGPGT KVDIM |
| iPS:392_714 | 21-225_16G12 | VK1|L1/J K3 | DIQMTQSPSSLSA SVGDRVTITC | RTS--QGIN------NYLV | WFQQKPGK APKRLIY | A---------ASSLQS | GVPSKFSGSGSG---TDFTLTISSLQPEDFATYYC | QQYYS------------YPFT | FGPGT KMDFK |
| iPS:392_746 | 21-225_20H7 | VK1|L1/J K3 | DIQMTQSPSSLSA SVGDRVTITC | RAS--QGIS------NYLV | WFQEKPGK AHKSLIY | G---------ASSLRS | TDFNLTISSLQPEDLATYYC | QQYHS------------YPFT | KVDFR |
| iPS:392_782 | 21-225_22B12 | VK1|L1/J K3 | DIQMTQSPSSLSA SVGDRVTITC | RAS--QGIG------IYLA | WFQQKPGK APKSLIS | A---------ASSLQS | GVPSKFSGSGSG---TEFTLTISSLQPEDFATYYC | QQYNS------------YPFT | FGPGT KVDIK |
| iPS:392_784 | 21-225_23C7 | VK1|L1/J K3 | DIQMTQSPSSLSA SVGDRVTITC | RAS--QGIS------YYLA | WFQQIPGK APKSLIY | A---------ASSLQS | GVPSKFSGSGSG---TDFTLTISSLQPEDFASYYC | QQFYS------------YPFT | FGPGT KVDIK |
| iPS:392_826 | 21-225_20B9 | VK1|L1/J K3 | DIQMTQSPSSLSA SVGDRVTITC | RAS--QGIS------NYLA | WFQQKPGK APKSLIY | V---------ASSLQS | GVPSKFSGSGSG---TDFTLTISSLQPEDFATYYC | QQYNT------------YPFT | FGPGT KVDIK |
| iPS:392_840 | 21-225_23G1 | VK1|L1/J K3 | DIQMTQSPSSLSA SVGDRVTITC | RAS--QGIR------NYLA | WFQQKPGK APKSLIS | A---------ASSLQS | GVPSQFSGSGFG---TDFTLTISSLQPEDFATYYC | QQYNS------------YPFT | FGPGT KVDIK |
| iPS:392_842 | 21-225_23G8 | VK1|L1/J K3 | DIQMTQSPSSLSA SVGDRVTITC | RAS--QGIS------NYLA | WFQQKPGK APKSLIY | A---------ASSLQS | GVPSKFSGSGSG---TDFTLTISSLQPEDFATYYC | QQYNS------------YPFT | IGPGT KVDIK |
| iPS:392_890 | 21-225_20H9 | VK1|L1/J K3 | DIQMTQSPSSLSA SVGDRVTITC | RAS--QGIS------NYLA | WFQQKPGK APKSLIS | A---------ASSLQS | GVPSKFSGSGSG---TDFTLTISSLQPEDFATYYC | QQYHS------------YPFT | FGPGT KVDIK |
| iPS:392_892 | 21-225_20C11 | VK1|L1/J K3 | DIQMTQSPSSLSA SVGDRVTITC | RAS--QDIS------NYLA | WFQQKPGK APKSLIY | A---------ASSLQS | GFPSKFSGSGSG---TDFTLTISSLQPEDFATYYC | QQYHS------------FPFT | FGPGT KVDVK |
| iPS:392_950 | 21-225_25C10 | VK1|L1/J K3 | DIQMTQSPSSLSA SVGDRVTITC | RAS--QGIS------NYLA | WFQQKPGK APKSLIY | A---------ASSLQS | GVPSNFSGSGSG---TDFTLTISSLQPENFATYYC | QQYHS------------YPFT | FGPGT KVDIK |
| iPS:392_952 | 21-225_26G1 | VK1|L1/J K3 | DIQMTQSPSSLSA SVGDRVTITC | RAS--QGIS------NYLA | WFQQKPGK APKSLIY | A---------ASSLRS | GVPSKFSGSGSG---TDFTLTISSLQPEDFATYYC | QQYNS------------YPFT | FGPGT KVDIK |
| iPS:392_962 | 21-225_30A1 | VK1|L1/J K3 | DIQMTQSPSSLSA SVGDRVTITC | RAS--QGIS------NYLA | WFQQKPGK APKSLIS | A---------ASSLQT | TDFTLTISSLQPEDFATYYC | QQYNS------------YPFT | FGPGT KVDIK |

FIGURE 51 (Continued)

| | | | K_FR1 | K_CDR1 | | K_FR2 | K_CDR2 | K_FR3 | K_CDR3 | | K_FR4 |
|---|---|---|---|---|---|---|---|---|---|---|---|
| | | Germline | | | | | | | | | |
| iPS:392 976 | 21-225_27H12 | VK1|L1|J K3 | DIQMTQSPSSLSA SVGDRVTITC | RAS--QGIS- -----NYLA | WFQQKPGK APKSLIN | A----- ASSLQS | GVPSKFSGSGSG--- TDFTLTISSLQPEDFATYYC | QQYYS------ -------YPFT | FGPGT KVNIN |
| iPS:393 090 | 21-225_33A5 | VK1|L1|J K3 | DIQMTQSPSSLSA SVGDRVTITC | RAS--QGIS- -----NYLA | WFQQKPGK APKSLIS | A----- ASSLQS | GVPSKFSGSGSG--- TDFTLTISSLQPEDFATYYC | QQYNS------ -------YPFT | FGPGT NVDIK |
| iPS:393 120 | 21-225_35H8 | VK1|L1|J K3 | DIQMTQSPSSLSA SVGDRVTITC | RAS--QAIS- -----NYLA | WFQQKPGK APKSLIY | G----- ASGLQS | GVPSKFSGSGSG--- TDFTLTISSLQPEDFATYYC | QQYNS------ -------YPFT | FGPGT KVDFK |
| iPS:393 836 | 21-225_15A2 | VK1|L1|J K3 | DIQMTQSPSSLFA FIGDRVTITC | RAS--QGIS- -----NYLA | WFQQKPGK APKSLIF | A----- ASSLQS | GVPSKFSGSGSFG-- TDFTFPISSLQPEDFANYYC | QQYYS------ -------YPFT | FGPGT QVDVK |
| iPS:393 870 | 21-225_7B1 | VK1|L1|J K3 | DIQMTQAPSSLSA SVGDRVTITC | RAS--QDIS- -----NHLV | WFQQKPGK APKSLIF | A----- ASSLQS | GVPSQFSGSGSG--- TDFTLTISSLQPEDFATYYC | HQYNS------ -------YPFT | FGPGT KVDFK |
| iPS:393 894 | 21-225_5E11 | VK1|L1|J K3 | VIQMTQSPSSLSA SVGDRVTITC | RAS--QGIS- -----NYLA | WFQQKPGK APKSLIN | A----- ASSVQS | GVPSKFSGNGSG--- TDFTLTISSLQPEDFATYYC | HQYHS------ -------YPFT | FGPGT KVDIK |
| iPS:393 896 | 21-225_2A4 | VK1|L1|J K3 | DIQMTQSPSSLFA SVGDRVTITC | RAS--QGIS- -----NYLA | WFQQKPGFG APKRLIY | T----- ASSLQS | GVPSKFSGSGFG--- TDFTLTISSLQPEDFATYYC | QQYNS------ -------YPFT | FGPGT KVDIK |
| iPS:393 914 | 21-225_16B8 | VK1|L1|J K3 | DIQMTQSPSSLSA SVGDRVTITC | RAS--QGIN- -----NYLA | WFQQKPGK ALKSLIN | A----- ASSVQS | GVPSKFSGSGSG--- IDFTLTISSLQPEDFATYYC | QQYHS------ -------YPFT | FGPGT KVDIV |
| iPS:393 968 | 21-225_5A5 | VK1|L1|J K3 | DIQMTQSPSSLSA SVGDRVTITC | RAS--QGIS- -----NYLA | WFQQKPGK APKSLIS | A----- ASSLQS | GVPSKFSGSGSG--- IDFTLTISSLQPEDFATYYC | QQYNS------ -------YPFT | FGPGT KVDIK |
| iPS:393 992 | 21-225_14H8 | VK1|L1|J K3 | DIQMTQSPSSLSA SVGDRVTITC | RAS--QGIS- -----YYLA | WFQQKPGK APKSLIY | V----- ASSLQS | GVPSKFSGSGSG--- TDFTLTISSLQPEDFATYYC | QQYDS------ -------YPFT | FGPGT KVDIN |
| iPS:394 018 | 21-225_15B1 | VK1|L1|J K3 | DIQMTQSPSSLSA SVGDRVTITC | RAS--QGIS- -----NYLA | WFQQKPGK APKSLIS | A----- ASSLQS | GVPSNFSGSGSG--- TDFTLTISSLQPEDFATYYC | QQYHS------ -------YPFT | FGPGT KVDIK |
| iPS:394 026 | 21-225_16C7 | VK1|L1|J K3 | DIQMTQSPSSLSA SVGDRVTITC | RAS--QGIS- -----NYLA | WFQQKPGK APKSLIS | A----- ASSLQS | GVPSKFSGSGSG--- IDFTLTISSLQPEDFATYYC | QQYNS------ -------YPFT | FGPGT KVEIK |
| iPS:394 055 | 21-225_9C8 | VK1|L1|J K3 | DIQMTQSPSSLSA SVGDRVTITC | RAS--QGIS- -----YYLA | WFQQKPGK APKSLIY | V----- ASSLQS | GVPSKFSGSGSG--- TDFTLTISSLQPEDFATYYC | QQYDS------ -------YPFT | FGPGT KVDIK |
| iPS:398 482 | 21-225_17H6 | VK1|L1|J K3 | DIQMTQSPSSLSA SVGDRVTITC | RAS--QDIS- -----NYLA | WFQQKPGK APKSLIS | T----- ASSLQS | GVPSKFSGSGSG--- TDFTLTISSLQPEDFATYYC | QQYHS------ -------YPFT | FGPGT KVDIQ |
| iPS:398 500 | 21-225_23A11 | VK1|L1|J K3 | DIQMTQSPSSLST SPGERATLSC | RAS--QDIS- -----NYLA | WFQQKPGK AFKRLIY | A----- ASTLQS | GVPSKFSGSGSG--- TDFTLTISSLQPEDFATYYC | QQYNS------ -------YPFT | FGPGT KVDLK |
| iPS:398 526 | 21-225_32B3 | VK1|L1|J K3 | DIQMTQSPSSLSA SVGDRVTITC | RAS--QGIS- -----NYLA | WFQQKPGK APKSLIY | A----- ASSLQS | GVPSTFSGSGSG--- TDFTLTISSLQPEDFATYYC | QQYNS------ -------YPFT | FGPGT KVDIK |
| iPS:402 235 | 21-225_20F10 | VK1|L1|J K3 | DIQLTQSPSSLSA SVGDRVTITC | RAS--QGIN- -----NYLA | WFQQKPGK APKSLIY | A----- ASSLQS | GVPSKFSGSGFG--- TDFTLTISSLQPEDFATYYC | QQYNS------ -------YPFT | FGPGT KVDNK |
| | VK3|A27|JK 1 | Germline | | | | | | | | | |
| iPS:468 810 | 21-225_74D5 | VK3|A27| JK1 | EIVLTQSPGTLSL SPGERATLSC | RAS--QSVNS -----NYLA | WYRQKPGQ APRLLIY | G----- ASSRAT | GIPDRFSGSGSG--- TDFTLTIISRLEPEDFAVYYC | QQYES------ -------SPWT | FGQGT NVEIK |
| iPS:468 834 | 21-225_94G10 | VK3|A27| JK1 | ETVLTQSPGTLSL SPGERATLSC | RAS--QSVNS -----NYLA | WYRQKPGQ APRLLIY | G----- ASSRAT | GIPDRFSGSGSG--- TDFTLIISRLEPEDFAVYYC | QQYES------ -------SPWT | FGQGT KVEIK |
| iPS:468 838 | 21-225_80E12 | VK3|A27| JK1 | EIVLTQCFGTLSL SPGERATVSC | RAS--QSVNS -----NYLA | WYRQKPGQ APRLLIY | G----- ASSRAT | GIPDRFSGSGSG--- TDFTLTIISRLEPEDFAVYYC | QQYES------ -------SPWT | FGQGT KVEIK |
| iPS:468 820 | 21-225_76E10 | VK3|A27| JK1 | EIVLTQSPGTLSL SIGDRATLSC | RAS--QSVNS -----NYLA | WYRQKPGQ AFRLLIY | G----- ASSRAT | GIPDRFSGSGSG--- TDFTLTIISRLEPEDFAVYYC | QQYGS------ -------SPWT | FGQGI KVEIK |
| iPS:433 931 | 21-225_44F6 | VK3|A27| JK1 | EIVLTQSPGTLSL SPGERATLSC | RAS--QSVSG -----SYLA | WYRQKPGQ APRLLIY | G----- ASSRAT | GIPDRFSGSGSG--- TDFTLTISRLEPEDFAVYYC | QQYGS------ -------SPWT | FGPGT KVEIK |

FIGURE 51 (Continued)

| | | | | | | | | | |
|---|---|---|---|---|---|---|---|---|---|
| iPS:434_307 | 21-225_59B2 | VK3|A27/JK1 | EIVLTQSPGTLSLSPGERATLSC | WAS--QSVIS-SFLA | WFQQKSGQ APRLLIY | G------ASSRAT | GIPDRFSGGSGSG-TDFTLTISRLEPEDFAVFYC | QQYGT------SPWT | FGQGT KVEIK |
| iPS:434_471 | 21-225_75G3 | VK3|A27/JK1 | EIVLTQSPGTLSLSPGERATLSC | RAR--QNVDS-SYLA | WYQQKPGQ APRLLIY | ASSRAT | GIPDRFSGSGSG-TDFTLTISRLEPEDFAVYYC | QQYER------SPWT | FGQGT KVEIK |
| iPS:434_473 | 21-225_76D1 | VK3|A27/JK1 | EIVLTQSPGTLSLSPGERATLSC | RAS--QNIYS-NYLA | WYGEKPGQ APRLLIY | G------ASSRAT | TDFTLTISRLEPEDFVVYYC | QQYES------SPWT | FGQGT KVEIK |
| iPS:434_495 | 21-225_74B2 | VK3|A27/JK1 | EIVLTQSPGTLSLSPGERATLSC | RAS--QNIYS-SFLA | WYQQKPGQ APRLLIY | ASSRAT | TDFTLTISRLEPEDFAVYYC | QQYES------SPWT | FGQGT KVEIK |
| iPS:434_497 | 21-225_76A4 | VK3|A27/JK1 | EIVLTQSPGTLYLSPGERATLSC | RAS--QSVYS-SYLA | WYQQKPGQ APRLLIY | G------ASSRAT | GIPDRFSGSGSG-TDFTLTISRLEPEDFAVYYC | QHSDN------SPWT | FGQGT KVEIK |
| iPS:434_501 | 21-225_76G4 | VK3|A27/JK1 | EIVLTQSPGTLSLSPGERATLSC | RAS--QSVYS-SYLA | WYQQKPGQ APRLLIY | ASSRAT | GIPDRFSGSGSG-TEFALTISRLEPEDCAVYYC | QHSDN------SPWT | FGQGT KVEIK |
| iPS:434_507 | 21-225_74C5 | VK3|A27/JK1 | EIVLTQSPGTLSLSPGERATLSC | RAS--QSVNS-NYLA | WYQQKPGQ APRLLIY | G------AFSRAT | GIPDRVSGSGSG-TDNLIISRLEPEDFAVYYC | QQYES------SPWT | FGQGT KVEIK |
| iPS:434_517 | 21-225_76A7 | VK3|A27/JK1 | EIALTQSPGTLSLSFGERATLSC | RAS--PSVDS-SYLA | WYQQRPGQ APRLLIY | G------ASSRAP | GIPDRFSGSGSG-TDFTLTISRLEPEDFAVYYC | QQYES------SPWT | FGQGT KVEIK |
| iPS:434_519 | 21-225_74C7 | VK3|A27/JK1 | EIVLTQSPGTLSLSPGERATLSC | RTS--PNVDS-SYLA | WYQQKPGQ APRLLIY | G------ASSRAT | GIPDRFSGSGSG-TDFTLTISRLEPEDFAVFYC | QQYER------SPWT | FGQGT KVEIK |
| iPS:434_523 | 21-225_75C3 | VK3|A27/JK1 | EIVLTQSPGTLSLSQGERATLSC | RAS--QSVSS-RYLA | WYQQKPGQ APRLLIY | ASSRAT | GIPDRFSGSGSG-TDFTLTISRLEPEDFAVYYC | QHYDS------SPWT | FGQGT KVEIK |
| iPS:434_531 | 21-225_76C9 | VK3|A27/JK1 | EPVLTQSPGTLSLSPGERATLSC | RAS--QNIYS-SYLS | WYQQKPGQ APRLLIY | G------ASSRAT | GIPDRFSGSGSG-TDFTLTISRLEPEDFAVYYC | QQYG-------RSRT | FGQGT KVEIR |
| iPS:434_533 | 21-225_85F7 | VK3|A27/JK1 | EIVLTQSPGTLSLSPGERATLSC | RAS--QNIYS-NYLA | WYRQKPGQ APRLLIY | G------ASSRAT | GIPDRFSGSGSG-TDFALTISRLEPEDCAVYYC | QQYES------SPWT | FGQGT KVEIK |
| iPS:434_547 | 21-225_74H5 | VK3|A27/JK1 | EIVLTQSPGTLSLSPGERATLSC | RAS--QSVSS-NYLA | WYQQKPGQ APRLLIY | ATSRAT | GIPDRFSGSGSG-TDFLIISRLEPEDFAVYYC | QQYES------SPWT | FGQGT KVEIK |
| iPS:434_559 | 21-225_74D11 | VK3|A27/JK1 | EIVLTQSPGTLSLSPGERATLSC | RAS--QSVDS-SYLA | WYQQKPGQ APRLLIY | G------ASSRAP | GIPDRFSGSGSG-TDFALTISRLEPEDFAVYFC | QQYDN------SPWT | FGQGT KVEIK |
| iPS:434_561 | 21-225_77G1 | VK3|A27/JK1 | EIVLTQSPGTLYLSPGERATLSC | RAS--QSVIS-SYLA | WYQQKPGQ APRLLIY | G------ASSRAT | GIPDRFSGSGSG-TDFALTISRLEPEDCAVYYC | QQYED------SPWT | FGQGT KVEIK |
| iPS:434_565 | 21-225_75B10 | VK3|A27/JK1 | EIVLTQSPGTLSLSPGERATLSC | RAS--PSVNS-YYLA | WYQQKPGQ APRLLIY | G------ASSRAT | GIPDRFSGSGSG-TDFTLTINRLEPADFAVYYC | QQYES------SPWT | FGQGT KVEIK |
| iPS:434_571 | 21-225_74D2 | VK3|A27/JK1 | EIVLTQSPGTLSLSPGERATLSC | RAS--QSVDS-NYLA | WYQQKPGQ APRLLIF | ASSRAP | GIPDRFSGSGSG-TDFTLTINRLEPEDFAVYFC | QQYES------SPWT | FGQGT KVEIK |
| iPS:434_579 | 21-225_77F7 | VK3|A27/JK1 | EIVLTQSPGTLSLSPGERATLSC | RAS--QSVIS-SYLA | WYQQKPGQ APRLLIY | G------ASSRAT | GIPDRFSGSGSG-TDFALTISRVEHEDCAVYYC | QHYDN------SPWT | FGQGT KVEIK |
| iPS:434_581 | 21-225_74B12 | VK3|A27/JK1 | EIVLTQSPGTLYLSPGERATLSC | RAS--QSVYS-SYLA | WYQQKPGQ APRLLIY | G------ASSRST | GIPDRFSGSGSG-TDFALTISRLEPEDFAVYYC | QQYED------SPWT | FGQGT KVEIK |
| iPS:434_585 | 21-225_75A12 | VK3|A27/JK1 | EIVLTQSPGTLSLSPGERATLSC | RAS--QSVSS-RYLA | WYQQKPGQ APRLLIY | ASSRAT | GIPDRFSGSGSG-TDFTLTISRLEPADFAVYYC | QHYDS------SPWT | FGQGT KVEIK |
| iPS:434_595 | 21-225_77A10 | VK3|A27/JK1 | EIVLTQSPGTLSLSPGERATLSC | RAS--QSVHS-RYLA | WYQQKPGQ APRLLIF | ASSRAP | GIPDRFSGSGSG-TDFTLTISRLEPEDFAVYYC | QHYDS------SPWT | FGQGT KVEIK |
| iPS:434_611 | 21-225_77C12 | VK3|A27/JK1 | EIVLTQSPGTLSLSPGERATLSC | RAR--QSVDS-SYLA | WYQQKPGQ APRLLIY | G------ASSRAT | GIPDRFSGSGSG-TDFTLTISRLEPEDFAVYYC | QQYES------SPWT | FGQGT KVEIK |
| iPS:434_633 | 21-225_74G8 | VK3|A27/JK1 | EIVLTQSPGTLSLSPGERATLSC | RAS--QSFSS-AYLA | WYQQKPGQ APRLLIY | G------TSSRAT | GIPDRFSGSGSG-TDFTLTIGRLEPEDFAVYYC | QQYG-------NSRI | FGQGT KVEIK |

FIGURE 51 (Continued)

| | | | | | | | | | |
|---|---|---|---|---|---|---|---|---|---|
| iPS-434 637 | 21- 225_78E7 | VK3|A27/ JK1 | EIVLTQSPGTLSL SPGERATLSC | RAS--QNVDS- --NYLA | WYQQKPGQ APRLLIY | G------- ASSRAT | GIPDRFSGSGSG--- TDFTLTISRLEPEDFAVYYC | QQYKR--------- ------SPWT | FGQGT KVEIK |
| iPS-434 657 | 21- 225_79G1 | VK3|A27/ JK1 | EIVLTQSPGTLYL SSGERATLSC | RAS--QSVYS- ---SYLA | WYQQKPAQ APRLLIY | G------- ASSRST | GIPDRFSGSGSG--- TDFALTISRLEPEDFAVYYC | QHYDN--------- ------SPWT | FGQGT KVEIK |
| iPS-434 663 | 21- 225_79F3 | VK3|A27/ JK1 | EIVLTQSPGTLYL SPGERATLSC | RAS--QSVYS- ---SYLA | WYQQKPGQ APRLLIY | G------- ASSRST | GIPDRFSGSGSG--- TDFTLTISRLEPEDFAVYYC | QHYDN--------- ------SPWT | FGQGT KVEIK |
| iPS-434 671 | 21- 225_74F4 | VK3|A27/ JK1 | EIVLTQSPGTLSL SPGERATLSC | RAS--QIFSS- ---SYLA | WYQQKPGQ SPRLLIY | G------- ASSRAT | GIPDRFSGSGSG--- TDFTLTISRLEPEDFAVYYC | QQYIG--------- ------SSRT | FGQGT RVEIK |
| iPS-434 687 | 21- 225_75A5 | VK3|A27/ JK1 | EIVLTQSPGTLYL SPGERATLSC | RAS--QSVYS- ---NYLA | WYQQKPGQ APRLLIY | G------- ASSRAT | GIPDRFSGSGSG--- TDFTLTISRLEPEDFAVYYC | QHYDN--------- ------SPWT | FGQGT KVEIK |
| iPS-434 691 | 21- 225_75G7 | VK3|A27/ JK1 | EIVLTQSPGTLSL SPGERATLSC | RAR--QSVDS- ---SYLA | WYQQKRGQ APRLLIY | G------- ASSRST | GIPDRFSGSGSG--- TDFTLTISRLEPEDFAVYYC | QQYES--------- ------SPWT | FGQGT KVEIK |
| iPS-434 693 | 21- 225_79F11 | VK3|A27/ JK1 | EIVLTQSPGTLSL SPGERATLSC | RAS--QSVYS- ---SYLA | WYQQKPGQ APRLLIY | G------- ASSRAT | GIPDRFSGSGSG--- TDFTLTISRLEPEDFAVYYC | QHSDN--------- ------SPWT | FGQGT KVEIK |
| iPS-434 699 | 21- 225_79G12 | VK3|A27/ JK1 | EIVLTQSPGTLYL SPGERATLSC | RAS--QSVYS- ---SYLA | WYQQKPGQ APRLLIY | G------- ASSRST | GIPDRFSGSGCG--- TDFALTISRLEPEDCAVYYC | QHSDN--------- ------SPWT | FGQGT KVEIK |
| iPS-434 701 | 21- 225_80A1 | VK3|A27/ JK1 | EIVLTQSPGTRYL SPGERATLSC | RAS--QSVYS- ---SYLA | WYQQKPGQ APRLLIY | G------- ASSRST | GIPDRFSGSGCG--- TDFALTISRLEPEDCAVYYC | QHSCN--------- ------SPWT | FGQGT KVEIK |
| iPS-434 703 | 21- 225_80C1 | VK3|A27/ JK1 | EIVLTQSPGTLYL SPGEIFTLSC | RAS--QSVYS- ---SYLA | WYQQKPGQ APRLLIY | G------- ASSRST | GIPDRFSGSGSG--- TDFTLTISRVEPEDCAVYYC | QHSDN--------- ------SPWT | FGQGT KVEIK |
| iPS-434 709 | 21- 225_80E3 | VK3|A27/ JK1 | EIVLTQSPGTLSL SSGERATLSC | RAS--QSVYS- ---SYLA | WYQQKPGQ APRLLIY | G------- ASSRST | GIPDRFSGSGSG--- TDFALTISRVEPEDFAVYYC | QHSDN--------- ------SPWT | FGQGT KVEIK |
| iPS-434 715 | 21- 225_80D5 | VK3|A27/ JK1 | EIVLTQSPGTLSL SPGKRVTLSC | RAS--QSVDS- ---SYLA | WYQQKPGQ APRLLIY | G------- ASSRST | GIPDRFSGSGSG--- TDFTLTITRLEPEDFAVYYC | QQYES--------- ------SPWT | FGQGT KVEIK |
| iPS-434 717 | 21- 225_80A6 | VK3|A27/ JK1 | EIVLTQSPGTLSL SPGEIFTLSC | RAS--QNIYS- ---SYLA | WYQQKPGQ APRLLIY | G------- ASSRAP | GIPDRFSGSGSG--- TDFTLTITRLEPEDFAVYYC | QQYES--------- ------SPWT | FGQGT KVEIK |
| iPS-434 725 | 21- 225_80H7 | VK3|A27/ JK1 | EIVLTQSPGTLSL SPGERATLSC | RAS--QSVDS- ---SYLA | WYQQKPGQ APRLLIY | G------- ASSRAT | GIPDRFSGSGCG--- TDFTLTISRLEPEDCAVYYC | QHSDN--------- ------SPWT | FGQGT KVEIK |
| iPS-434 735 | 21- 225_80B10 | VK3|A27/ JK1 | EIVLTQSPGTLSL SPGERATLSC | RAS--QSVDS- ---SYLA | WYQQKPGQ APRLLIY | G------- ASSRAP | GIPDRFSGSGSG--- TDFALTISRLEPEDCAVYYC | QQYES--------- ------SPWT | FGQGT KVEIK |
| iPS-434 743 | 21- 225_74A4 | VK3|A27/ JK1 | EIVLTQSPGTLSL SPGERATLSC | RAS--QSVSS- ---SYLA | WYQQKPGQ APRLLIY | G------- ASSRST | GIPDRFSGSGSG--- TDFTLTISRLEPEDFAVYYC | QHSDN--------- ------SPWT | FGQGT KVEIK |
| iPS-434 751 | 21- 225_80H12 | VK3|A27/ JK1 | EIVLTQSPGTLSL SPGERATLSC | RAS--QSINS- ---NYLA | WYQQKPGQ APRLLIY | G------- ASSRST | GIPDRFSGSGCG--- TDFTLTISRLEPEDFAVYYC | QHSDN--------- ------SPWT | FGQGT KVEIK |
| iPS-434 759 | 21- 225_81C5 | VK3|A27/ JK1 | EIVLTQSPGTRYL SPGERATLSC | RAS--QSVVS- ---SYLA | WYQQKPGQ APRLLIY | G------- ASSRST | GIPDRFSGSGSG--- TDFTLTISRLEPEDFAVYYC | QHSDN--------- ------SPWT | FGQGT KVEIK |
| iPS-434 773 | 21- 225_75D9 | VK3|A27/ JK1 | EIVLTQSPGTLSL SPGERATLSC | RAS--QSVYS- ---SYLA | WYQQKRGQ APRLLIY | G------- ASSRST | GIPDRFSGSGSG--- TDFALTISRVEPEDCAVYYC | QQYES--------- ------SPWT | FGQGT KVEIK |
| iPS-434 777 | 21- 225_81C11 | VK3|A27/ JK1 | EIVLTQSPGTLYL SPGERATLSC | RAS--QSVYS- ---SYLA | WYQQKPGQ APRLLIY | G------- ASSRST | GIPDRFSGSGCG--- TDFTLTISRLEPEDFAVYYC | QHSDN--------- ------SPWT | FGQGT KVEIK |
| iPS-434 809 | 21- 225_74F5 | VK3|A27/ JK1 | EIVLTQSPGTLSL SPGERATLSC | RAS--QSVYS- ---SYLA | WYQQKPGQ APRLLIY | G------- ASSRST | GIPDRFSGSGSG--- TDFTLTISRVEPEDCAVYYC | QHSDN--------- ------SPWT | FGQGT KVEIK |
| iPS-434 821 | 21- 225_83G1 | VK3|A27/ JK1 | EIVLTQSPGTRYL SPGERATLSC | RAS--QSVLA- ---SYLA | WYQQKPGQ APRLLIY | G------- ASSRST | GLPDRFSGSGSG--- VLPDRFSGSGSG--- | QQYES--------- ------SPWT | FGQGT KVEIK |
| iPS-434 835 | 21- 225_83B6 | VK3|A27/ JK1 | EIVLTQSPGTLSL SPGERATLSC | RAS--QSVDS- ---GYLA | WYQQKPGQ APRLLIY | G------- ASSRTP | GIPDRFSGSGSG--- TDFTLTISRLEPEDFAVYYC | QQYES--------- ------SPWT | FGQGT KVEIK |

FIGURE 51 (Continued)

| ID | Gene | | | | | | | | |
|---|---|---|---|---|---|---|---|---|---|
| iPS:434_839 | VK3JA27/JK1 | EIVLTQSPGTRYL SSVERATLSC | RAS--QSVYS- ----SYLA | WYQQKPGQ APRLLIY | G------ ASSRST | GIPDRFSGSGSG-- TDFALTISRLEPEDCAVYYC | QHSDN------ ----SPWT | FGQGT KVEIK |
| iPS:434_849 | VK3JA27/JK1 | EIVLTQSPGTLSL SPGERATLSC | RAS-PSVHS- ----NYLA | WYQQKPGQ APRLLIY | G------ ASSRAI | GIPDRFSGSGSG-- TDFLTISRLEPEDFAVYYC | QQYES------ ----SPWT | FGQGT KVEIK |
| iPS:434_869 | VK3JA27/JK1 | EIVLTQSPGTLSL SPGERATLSC | RAS--QSINS- ----NYLA | WYQQKPGQ APRLLIY | G------ ASSRAT | TDFLTISRLEPDDFAVYYC | QQYES------ ----SPWT | FGQGT KVEIK |
| iPS:434_879 | VK3JA27/JK1 | EIVLTQSPGTLFL SPGERATLSC | RAS--QSVYS- ----SYLA | WYQQKPAQ APRLLIY | G------ ASSRAS | TDFALTISRLEPEDFAVYYC | QHYDN------ ----SPWT | FGQGT KVEIK |
| iPS:434_881 | VK3JA27/JK1 | EIVLTQSPGTLFL SPGERATLSC | RAS--QSVSS- ----SYLA | WYQQKPGQ APRLLIY | G------ ASSRAT | GIPDRFSGSGSG-- TDFALTISRLEPEDFAVYYC | QHSDN------ ----SPWT | FGQGT KVEIK |
| iPS:434_887 | VK3JA27/JK1 | EIVLTQSPGTLFL SQGERATLSC | RAS--QSVSS- ----RYLA | WYQQKPGQ APRLLIY | G------ ASSRAI | GIPDRFSGSGSG-- TDFALTISRLEPEDFAVYYC | QHYDS------ ----SPWT | FGQGT KVEIK |
| iPS:434_891 | VK3JA27/JK1 | EIALTQSPGTLSL SPGERATLSC | RAS-PSVDS- ----SYLA | WYQQKPGQ APRLLIY | G------ AASRAP | GIPDRFSGSGSG-- TDFLTISRLEPEDFVVYYC | QQYES------ ----SPWT | FGQGT KVEIK |
| iPS:434_895 | VK3JA27/JK1 | EIVLTQSPGTLSL SPGERATLSC | RAS--QNIYS- ----SYLA | WYQQKPGQ APRLLIY | G------ ASSRAT | GIPDRFSGSGSG-- TDFLTISRLEPEDFAVYYC | QQYES------ ----SPWT | FGQGT KVEIK |
| iPS:434_899 | VK3JA27/JK1 | EIVLTQSPGTLFL SPGERATLSC | RAS--QSVNS- ----NYLA | WYRQKPGQ APRLLIY | G------ ASSRAI | TDFILISRLEPEDFAVYYC | QQYES------ ----SPWT | FGQGT KVEIK |
| iPS:434_907 | VK3JA27/JK1 | EIVLTQSPGSLSL SPGERATLSC | RAS--QSVWS- ----GYLA | WYQQKPGQ APRLLIY | G------ ASSRAT | GIPDRFSGSGSG-- TDFALTISRLEPEDFAVYFC | QQYES------ ----SPWT | FGQGT KVEIK |
| iPS:434_913 | VK3JA27/JK1 | EIVLTQSPGTLYL SPGERATLSC | RAS--QSVYS- ----SYLA | WYQQKPAQ APRLLIY | G------ ASSRAT | GIPDRFSGSGSG-- TDFALTISRLEPEDCAVYYC | QHYDN------ ----SPWT | FGQGT KVEIK |
| iPS:434_921 | VK3JA27/JK1 | EIVLTQSPGTLFL SPGERATLSC | RAS--QSVNS- ----NYLA | WYRQKPGQ APRLLIY | G------ ASSRST | TDFALTISRLEPEDCAVYYC | QHSDN------ ----SPWT | FGQGT KVEIK |
| iPS:434_939 | VK3JA27/JK1 | EIVLTQSPGTLYL SPGERATLSC | RAS--QSVYS- ----SYLA | WYQQKPGQ APRLLIY | G------ ASSRST | GLPDRFSGSGSG-- TDFALTISRLEPEDCAVYYC | QHSDN------ ----SPWT | FGQGT KVEIK |
| iPS:434_943 | VK3JA27/JK1 | EIVLTQSPGTLSL SPGERATLSC | RAS--QSVDS- ----NYLA | WYQQKPGQ APRLLIY | G------ ASARTT | VIPDRFSGSGSG-- TDFLTISRLEPEDCAVYYC | QQYES------ ----SPWT | FGQGT KVEIK |
| iPS:434_945 | VK3JA27/JK1 | EFVLTQSPGTLYL SPVERATLSC | RAS--QSVYS- ----SYLA | WYQQKPGQ APRLLIY | G------ ASARTI | VIPDRFSGSGCG-- TDFALTISRVEPEDCAVYYC | QHYDN------ ----SPWT | FGQGT KVEIK |
| iPS:434_955 | VK3JA27/JK1 | EIVLTQSPGTLYL SPGERATLSC | RAS--QSVYS- ----SYLA | WYQQKPGQ APRLLIY | G------ ASSRST | GIPDRFSGSGSG-- TDFALTISRVEPEDCAVYYC | QHSDN------ ----SPWT | FGQGT KVEIK |
| iPS:434_961 | VK3JA27/JK1 | EIVLTQSPGTRYL SPGERATLSC | RAS--QSVYS- ----SYLA | WYQQKPGQ APRLLIY | G------ ASSRST | GIPDRFSGSGSG-- TDFALTISRVEPEDCAVYYC | QHSDN------ ----SPWT | FGQGT KVEIK |
| iPS:434_969 | VK3JA27/JK1 | EIVLTQSPGTLSL SPGERATLSC | RAS--QSVYS- ----SYLA | WYQQKPGQ APRLLIY | G------ ASSRST | GIPDRFSGSGCG-- TDFALTISRVEPEDCAVYYC | QHSDN------ ----SPWT | FGQGT KVEIK |
| iPS:434_981 | VK3JA27/JK1 | EIVLTQSPGTLSL SPGERATLSC | RAS--QSVYS- ----SYLA | WYQQKPGQ APRLLIY | G------ ASSRST | GIPDRFSGSGSG-- TDFALTISRLEPEDCAVYYC | QHSDN------ ----SPWT | FGQGT KVEIK |
| iPS:434_983 | VK3JA27/JK1 | EIVLTQSPGTLYL SPGERATLSC | RAS--QSVYS- ----SYLA | WYQQKPGQ APRLLIY | G------ ASSRST | TDFALTISRVEPEDCAVYYC | QHSDN------ ----SPWT | FGQGT KVEIK |
| iPS:434_995 | VK3JA27/JK1 | EIVLTQSPGTLSL SPGERATLSC | RAS--QSVYS- ----SYLA | WYQQKPGQ APRLLIY | G------ ASSRST | GIPDRFSGSGSG-- TDFALTISRLEPEDCAVYYC | QHSDN------ ----SPWT | FGQGT KVEIK |
| iPS:434_999 | VK3JA27/JK1 | EIVLTQSPGTLYL SPGERATLSC | RAS--QSVYS- ----SYLA | WYQQKPGQ APRLLIY | G------ ASSRAT | TDFALTISRVEPEDCAVYYC | QHSDN------ ----SPWT | FGQGT KVEIK |
| iPS:435_013 | VK3JA27/JK1 | EIVLTQSPGTLYL SSGERATLSC | RAS--QSVYS- ----SYLA | WYQQKPGQ APRLLIY | G------ ASSRST | GIPDRFSGSGSG-- TDFALTISRLEPEDFAVYYC | QHYDN------ ----SPWT | FGQGT KVEIK |

FIGURE 51 (Continued)

| | | | | | | | | |
|---|---|---|---|---|---|---|---|---|
| iPS-435_015 | 21-225_89H5 | VK3／A27/JK1 | EIVLTQSPGTLSLSPGERATLSC | RAS---QSVNS------NYLA | WYQQKPGQAPRLLIY | G------AFSRAT | GIPDRVSGSGSG---TDFNLTISRLEPEDFAVYYC | QQYES---------SVWT | FGQGTKVEIK |
| iPS-435_025 | 21-225_89E10 | VK3／A27/JK1 | EIVLTQSPGTLYLSSGERATLSC | RAS---QSVYS------SYLA | WYQQKPGQAPRLLIY | G------ASSRST | VIPDRFSGSGSG---TDFALTISRVEPEDFAVYYC | QHSDN---------SPWT | FGQGTKVEIK |
| iPS-435_029 | 21-225_89A11 | VK3／A27/JK1 | EIVLTQSPGTLYLSPGERATLSC | RAS---QSVDS------NFLA | WYQQKPGQAPRLLIY | G------ASARTT | TDFALTISRLEPEDFAVYYC | QQYEI---------SPWT | FGQGTKVEIK |
| iPS-435_039 | 21-225_90G4 | VK3／A27/JK1 | EIVLTQSPGTLYLSPGERATLSC | RAS---QSVYS------SYLA | WYQQKPGQAPRLLIY | G------ASSRST | GIPDRFSGSGSG---TDFALTISRVEPEDCAVYYC | QHSDN---------SPWT | FGQGTKVEIK |
| iPS-435_041 | 21-225_90A5 | VK3／A27/JK1 | EIVLTQSPGTLYLSPGERATLSC | RAS---QSVYS------SYLA | WYQQKPGQAPRLLIY | G------ASSRAT | VIPDRFSGSGSG---TDFALTISRVEHEDCAVYYC | QHYDN---------SPWT | FGQGTKVEIK |
| iPS-435_043 | 21-225_90G5 | VK3／A27/JK1 | EIVLTQSPGTLYLSPGERATLSC | RAS---QSVYS------SYLA | WYQQKPGQAPRLLIY | G------ASSRAT | GIPDRFSGSGSG---TDFALTISRVEHEDFAVYYC | QHYDN---------SPWT | FGQGTKVEIK |
| iPS-435_055 | 21-225_90F10 | VK3／A27/JK1 | EIVLTQSPGTLYLSPGERATLSC | RAS---QSVYS------SYLA | WYQQKPGQAPRLLIY | G------ASSRST | GIPDRFSGSGSG---TDFALTISRLEPEDCAVYYC | QHYDN---------SPWT | FGQGTKVEIK |
| iPS-435_073 | 21-225_91B2 | VK3／A27/JK1 | EIVLTQSPGTLYLSPGERATLSC | RAS---QSVYS------SYLA | WYQQKPGQAPRLLIY | G------ASSRST | GIPDRFSGSGSG---TDFALTISRVEPEDCAVYYC | QHYDN---------SPWT | FGQGTKVEIK |
| iPS-435_075 | 21-225_91B3 | VK3／A27/JK1 | EIVLTQSPGTLYLSPGERATLSC | RAS---QSVYS------SYLA | WYQQKPGQAPRLLIY | G------ASSRST | GIPDRFSGSGSG---TDFALTISRVEPEDCAVYYC | QHYDN---------SPWT | FGQGTKVEIK |
| iPS-435_077 | 21-225_91F3 | VK3／A27/JK1 | EIVLTQSPGTLYLSPGERATLSC | RAS---QSVYS------SYLA | WYQQKPGQAPRLLIY | G------ASSRAQ | GIPDRFSGSGSG---TDFALTISRVEPEDCAVYYC | QHSDN---------SPWT | FGQGTKVEIK |
| iPS-435_079 | 21-225_91B4 | VK3／A27/JK1 | EIVLTQSPGTLYLSPGERATLSC | RAS---QSVYS------SYLA | WYQQKPGQAPRLLIY | G------ASSRST | GIPDRFSGSGCG---TDFALTISRVEPEDCAVYYC | QHYDN---------SPWT | FGQGTKVEIK |
| iPS-435_089 | 21-225_91E9 | VK3／A27/JK1 | EIVLTQSPGTLYLSPGERATLSC | RAS---QSVYS------SYLA | WYQQKPGQAPRLLIY | G------ASSRAT | GIPDRFSGSGCG---TDFALTISRVEHEDCAVYYC | QHYDN---------SPWT | FGQGTKVEIK |
| iPS-435_097 | 21-225_92B1 | VK3／A27/JK1 | EIVLTQSPGTLYLSPGERATLSC | RAS---QSVGS------NYLA | WYQQKRGQAPRLLIY | G------ASSRAT | DIPDRFSGSGCG---TCFTLTISRLEPEDFAVYYC | QHYDN---------SPWT | FGQGTKVEIK |
| iPS-435_111 | 21-225_92D6 | VK3／A27/JK1 | EIVLTQSPGTLYLSPGERATLSC | RAS---QSVYS------SYLA | WYQQKPGQAPRLLIY | G------ASSRST | VIPDRFSGSGCG---TCFALTISRLEPEDCAVYYC | QHYDN---------SPWT | FGQGTKVEIK |
| iPS-435_115 | 21-225_77C5 | VK3／A27/JK1 | EIVLTQSPGTLSLSPGERATLSC | RAS---QSVYS------SYLA | WYQQKPGQTGQAPRLLIY | G------ASSRAP | TDFTLTISRLEPEDFAVYYC | QHYDN---------SPWT | FGQGTKVEIK |
| iPS-435_171 | 21-225_93C2 | VK3／A27/JK1 | EIVLTQSPGTLSLSPGERATLSC | RAS---QSVSS------SYLA | WYQQKPGQAPRLLIY | G------ASSRAT | GIPDRFSGSGSG---TDFALTISRLEHEDCAVYYC | QHYDN---------SPWT | FGQGTKVEIK |
| iPS-435_177 | 21-225_93E4 | VK3／A27/JK1 | EIVLTQSPGTLYLSQGERATLSC | RAS---QSVYS------RYLA | WYQQKPGQAPRLLIY | G------ASSRAT | GIPDRFSGSGCG---TDFALTISRLEPEDFAVYYC | QQYES---------SPWT | FGQGTKVEIK |
| iPS-435_183 | 21-225_93E9 | VK3／A27/JK1 | EIVLTQSPGTLYLSPGERATLSC | RAS---QSVYS------SYLA | WYQQKPGQAPRLLIY | G------ASSRAT | TDFTLTISRLEPEDFAVYYC | QHYDS---------SPWT | FGQGTKVEIK |
| iPS-435_195 | 21-225_94D3 | VK3／A27/JK1 | EIVLTQSPGTLSLSPGERATLSC | RAS---QSVSS------SYLA | WYQQKPGQAPRLLIY | G------ASSRST | GIPDRFSGSGCG---GIPDRFSGSGCG---GIPDRFSGSGSG--- | QHYDN---------SPWT | FGQGTKVEIK |
| iPS-435_217 | 21-225_94F12 | VK3／A27/JK1 | EIVLTQSPGTFSLSPGERATLSC | RAS---QSVYS------SYLA | WYQQKPGQAPRLLIY | G------ASSRST | GIPDRFSGSGCG---GIPDRFSGSGCG--- | QHYDN---------SPWT | FGQGTKVEIK |
| iPS-435_219 | 21-225_95D2 | VK3／A27/JK1 | EIVLTQSPGTLYLSPGERATLSC | RAS---QSVYS------SYLA | WYQQKPGQAPRLLIY | G------ASSRST | TDFALTISRLEPEDCAVYYC | QHYDN---------SPWT | FGQGTKVENQ |
| iPS-435_235 | 21-225_95F9 | VK3／A27/JK1 | EIVLTQSPGTLYLSPGERATLSC | RAS---QSVYS------SYLA | WYQQKPGQAPRLLIY | G------ASSRST | GIPDRFSGSGSG---TDFALTISRVEHEDCAVYYC | QHYDN---------SPWT | FGQGTKVEIK |
| iPS-435_237 | 21-225_95G9 | VK3／A27/JK1 | EIVLTQSPGTLYLSSGERATLSC | RAS---QSVYS------SYLA | WYQQKPGQAPRLLIY | G------ASSRST | GIPDRFSGSGSG---TDFALTISRVEHEDCAVYYC | QHYDN---------SPWT | FGQGTKVEIK |

FIGURE 51 (Continued)

| ID | V/J | Seq1 | Seq2 | Seq3 | Seq4 | Seq5 | Seq6 | Seq7 | Seq8 | Seq9 |
|---|---|---|---|---|---|---|---|---|---|---|
| iPS:435_239 | VK3/A27/JK1 | EIVLSQSPGTLYL SSGERATLSC | RAS---QSVYS- ------SYLA | WYQQKFGQ APRLLIY | G------ ASSRAT | GIPDRFSGSGSG--- TDFALTISRLEPEDFAVYYC | QHYDN------ ------SPWT | FGQGT KVEIK |
| iPS:435_273 | VK3/A27/JK1 | EIVLTQSPGTLYL SSGERATLSC | RAS---QSVYS- ------SYLA | WYQQKFGQ APRLLIY | G------ ASSRST | GIPDRFSGSGCG--- TDFALTISRLEPEDFAVYYC | QHSDN------ ------SPWT | FGQGT KVEVK |
| iPS:435_281 | VK3/A27/JK1 | EIVLTQSPGTLSL SPGERATLSC | RAS---QSVYS- ------SYLA | WYQQKPGQ APRLLIY | G------ ASSRAT | GIPDRFSGSGCG--- TDFALTISRKVEPEDCAVYYC | QHSDN------ ------SPWT | FGQGT KVEVK |
| iPS:435_331 | VK3/A27/JK1 | QIVLTQSPGTLSL SPGERATLSC | RAS---QRIFS- ------NYLA | WYQQKPGQ APRLLIY | G------ ASSRAT | GIPDRISGSGSG--- TDFTLTITRLEPEDFAVYYC | QQYDS------ ------SPWT | FGQGT KVEIN |
| iPS:435_815 | VK3/A27/JK1 | EIVLTQSPGTLSL SPGERATLSC | RAS---PSVSS- ------RPLA | WYQQKPGQ APRLLIY | G------ ASSRAT | GIPDRFSGSGSG--- TDFTLTINRLEPEDFAVYYC | QQYGS------ ------SPPWT | FGQGT KVEIK |
| iPS:435_843 | VK3/A27/JK1 | EIVLTQSPGTLSL SPGERAALSC | RAS---QSISL- ------NFLA | WYQQKPGQ APRLLIY | G------ ASSRAT | GIPDRFSGSGSG--- TDFTLIINRLEPEDFAVYYC | QQYGR------ ------SPWT | FGQGT KVEVK |
| iPS:435_847 | VK3/A27/JK1 | EIVLTQSPGTLSL SPGERATLSC | RAS---QSIRS- ------SFLA | WYQQKPGQ APRLLIY | G------ ASSRAT | GIPDRFSGSGSG--- TDFTLIISRLEPEDFAVYYC | QQYGN------ ------SPWA | FGQGT KVEVK |
| iPS:435_849 | VK3/A27/JK1 | EIVLTQSPGTLSL SPGERATLSC | RAS---QSIRS- ------SFLA | WYQQKPGQ APRLLIY | G------ ASSRAT | GIPDRFSGSGSG--- TDFTLTIISRLEPEDFAVYYC | QQYGN------ ------SPWA | FGQGT KVEIK |
| iPS:435_851 | VK3/A27/JK1 | EIVLTQSPGTLSL SPGERATLSC | RAG---QSIRT- ------SFLA | WQQQKPGQ APRLLIY | G------ ASSRAT | GIPDRFSGSGSG--- TDFTLTINRLEPEDFAVYYC | QQYGS------ ------SPWT | FGQGT KVEIK |
| iPS:435_865 | VK3/A27/JK1 | EIVLTQSPGTLSL SPGERATLSC | RAS---QSVSS- ------RPLA | WYQQKPGQ APRLLIY | G------ ASNRAT | GIPDRFSGSVSG--- TDFTLTISRLEPEDFAVYYC | QQYGG------ ------SPPWT | FVQGT KVEIK |
| iPS:435_905 | VK3/A27/JK1 | EIMLTQSPGTLSL SPGERATLSC | RAS---QNIRS- ------NFLA | WYQQKPGQ APRLLIY | G------ ASSRAT | GIPDRFSGSVSG--- TDFTLTINRLEPEDFAVYYC | QQYGN------ ------SPWT | FGQGT KVEIK |
| iPS:435_911 | VK3/A27/JK1 | EIVLTQSPGTLSL SPGERATLSC | RAS---QSIRS- ------SFLA | WYQQKPGQ APRLLIY | G------ ASSRAT | GIPARFSGSGSG--- TDFTLTIISRLEPEDFAVYYC | QQYES------ ------SPWA | FGQGT KVEIK |
| iPS:435_913 | VK3/A27/JK1 | EIVLTQSPGTLSL SPGERATLSC | RAS---QSVRS- ------NFLA | WHQQKPGQ APRLLIY | AYRRAT | GIPDRFSGSGSG--- TDFTLTINRLEPEDFAVYYC | QQYGN------ ------SPWT | FGQGT KVEIK |
| iPS:435_939 | VK3/A27/JK1 | EIVLTQSPGSATLSL SPGESATLSC | RAG---QSIRT- ------DFLA | WYQQPFGQ APRLLIY | PSSRAT | GIPDRFSGSGSG--- TDFTLTINRLEPEDFAVYYC | QQYGS------ ------SPWT | FGQGT KVEIN |
| iPS:435_967 | VK3/A27/JK1 | EIVLTQSPGTLSL SPGERATLSC | RAS---QSVRS- ------SFLA | WYQQKPGQ APRLLIY | G------ ASSRAT | GIPDRFSGSGSG--- TDFTLIISRLEPEDFAVYYC | QQYGN------ ------SPWA | FGQGT KVEIK |
| iPS:435_973 | VK3/A27/JK1 | EIVLTQSPGTLSL SPGERATLSC | RAS---QSVSS- ------NFLA | WYQQKPGQ APRLLIF | G------ ASSRAT | GIPDRFSGSGSG--- TDFTLTINRLEPEDFAVYYC | QQYGI------ ------SPWT | FGQGT KVEIK |
| iPS:435_995 | VK3/A27/JK1 | EIVLTQSPGTLSL SPGERATLSC | RAS---QSISS- ------SYLA | WYQQKPGQ APRLLIY | G------ ASSRAT | GIPARFSGSGSG--- TDFTLTIISRLEPEDFAVYYC | QQYES------ ------SPWT | FGQGT KVEIK |
| iPS:436_007 | VK3/A27/JK1 | EIVLTQSPGTLSL SPGERATLSC | RAS---QSVRS- ------DFLA | WLQQKPGQ APRLLIY | G------ VSRRAT | GIPDRFSGSGSG--- TDFTLTINRLEPEDFAVYYC | QQYGN------ ------SPWT | FGQGT KVEIN |
| iPS:436_009 | VK3/A27/JK1 | EIVLTQSPGTLSL SPGERATLSC | RAS---QSVRS- ------NFLA | WHQQKPGQ APRLFIY | G------ ASRRAT | GIPDRFSGSGSG--- TDFTLTINRLEPEDFAVYYC | QQYGI------ ------SPWA | FGQGT KVEIK |
| iPS:436_011 | VK3/A27/JK1 | EIVLTQSPGTLSL SPGERATLSC | RAS---QSVRS- ------NFLA | WHQQKPGQ APRLLIY | G------ ASRRAT | GIPDRFSGSGSG--- TDFTLTINRLEPEDFAVYYC | QQYGN------ ------SPWT | FGQGT KVEIK |
| iPS:436_015 | VK3/A27/JK1 | EIVLTQSPGTLSL SPGERATLSC | RAS---QSIRS- ------SFLA | WYQQKPGQ APRLLIY | G------ ASNRAT | GIPARFSGSGSG--- TDFTLTIISRLEPEDFAVYYC | QQYGN------ ------SPWA | FGQGT KVEIK |
| iPS:436_017 | VK3/A27/JK1 | EIVLTQSPGSATLSL SPGESATLSC | RAG---QSIRT- ------DFLV | WYQQPPGQ APRLLIY | G------ ASSRAT | GFPDRFSGSGSG--- TDFTLTINRLEPEDFAVYYC | QQYGS------ ------SPWT | FGQGT KVEIN |

FIGURE 51 (Continued)

| | | | | | | | | |
|---|---|---|---|---|---|---|---|---|
| iPS:436_027 | 21-225_193E6 | VK3|A27/ JK1 | EIVLAQSPGTLSL SPGERATLSC | RAS--QSVRS- ----GYLA | WYQQKPGQ APRLLIY | G------- ASSRAT | GIPDRFGSGSG-- TDFTLTISRLEPEDFAVYYC | QQYES------ ------SPWT | FGQGT KVEIK |
| iPS:436_029 | 21-225_193H6 | VK3|A27/ JK1 | EIVLTQSPGTLSL SPGESATLSC | RAG--QSIRT- ----NFLA | WYQQQPGQ APRLLIY | G------- ASSRAT | GIPDRFSGSGSG-- TDFTLTINRLEPEDFAVYYC | QQYGS------ ------SPWT | FGQGT KVEIN |
| iPS:436_035 | 21-225_193C8 | VK3|A27/ JK1 | EIVLTQSPGTLFL SPGERATLSC | RAS--QSIRS- ----SFLA | WYQQKPGQ APRLLIY | G------- ASSRAT | GIPDRFSGSGSG-- TDFTLTINRLEPEDFAVYYC | QQYGN------ ------SPWA | FGQGI KVEIK |
| iPS:436_037 | 21-225_193D8 | VK3|A27/ JK1 | EIVLKQSPGTLFL SPGERATLSC | RAS--QSIRT- ----NFLA | WYQQKPGQ APRLLIY | G------- ASSRAT | GIPDRFSGSGSG-- TDFTLTINNLEPEDFAVYYC | QQYGN------ ------SPWT | FGQGT KVEIK |
| iPS:436_041 | 21-225_193G8 | VK3|A27/ JK1 | EIVLTQSPGTLSL SPGERATLSC | RAS--QSVRT- ----NFLA | WHQQKPGQ APRLLIY | G------- ASRRAT | GIPDRFSGSGSG-- TDFTLTINRLEPEDFAVYYC | QQYGN------ ------SPWT | FGQGT KVEIK |
| iPS:436_047 | 21-225_193B1 | VK3|A27/ JK1 | EIVLTQSPGTLSL SPGERATLSC | RAS--PSVSS- ----SYLA | WYQQKPGQ APRLVIY | G------- ASRRAT | GIPDRFSGSGSG-- TDFTLTISRLEPEDFAVYYC | QQYGS------ ------SPPWT | FGQGT KVEIK |
| iPS:436_049 | 21-225_193B12 | VK3|A27/ JK1 | EIVLTQSPGTLSL SPGERATLSC | RAS--QSIRS- ----SFLA | WYQQKPGQ APRLLIY | D------- ASSRAT | GIPDRFSGSGSG-- TDFTLTISRLEPEDFAVYYC | QQYGN------ ------SPWA | FGQGT KVEIK |
| iPS:436_062 | 21-225_194E5 | VK3|A27/ JK1 | EIVLTQSPGTLSL SPGERATLSC | RAG--QSIRT- ----NFLA | WYQQKPGQ APRLLIY | G------- ASSRAT | GIPDRFSGSGSG-- TDFTLTINRLEPKDFAVYYC | QQYGS------ ------SPWT | FGQGT KVEIK |
| iPS:436_064 | 21-225_194E6 | VK3|A27/ JK1 | EIVLTQSPGTLSL SPGERATLSC | RAS--QSIRS- ----NFLA | WYQQKPGQ APRLLIY | G------- ASSRAT | GIPDRFSGSVSG-- TDFTLTINRLEPEDFAVYYC | QQYGS------ ------SPWT | FGQGT KVEIK |
| iPS:436_072 | 21-225_194C1 | VK3|A27/ JK1 | EIVLTQSPGTLLL SPGERATLSC | RAS--PSVNS- ----GYLA | WYQQKPGQ TPRLLIF | G------- ASSRAT | ADFTLTISRLEPEDFAVYFC | QQYES------ ------SPWT | FGQGT KVEIK |
| iPS:436_080 | 21-225_195B1 | VK3|A27/ JK1 | EIVLTQSPGTLFL SSGERATLSC | RAS--QSVRS- ----NYLA | WYQQKPGQ TPRLLIY | G------- ASNRAT | GVPDRFSGSGSG-- TDFTLTIRRLEPEDFAVYYC | QQYGN------ ------SPWT | FGQGT KVEIK |
| iPS:436_088 | 21-225_195C8 | VK3|A27/ JK1 | EIVLTQSPGTLSL SPGERATLSC | RAS--QSIRS- ----SFLA | WYQQKPGQ APRLLIY | G------- AFSRAT | GIPDRFSGSGSG-- TDFTLTISRLEPEDFAVYYC | QQYGN------ ------SPWA | FGQGT KVEIK |
| iPS:436_122 | 21-225_196G1 | VK3|A27/ JK1 | EIVLTQSPGTLSL SPGERATLSC | RAS--PSVSN- ----SFLA | WYQQKPGQ APRLLIY | G------- AFSRAT | GIPDRFSASGSG-- TDFTLTISRLEPEDFAVYYC | QQYGN------ ------SPPWT | FGQGT KVEIK |
| iPS:436_134 | 21-225_196H12 | VK3|A27/ JK1 | EIVLTQSPGTLFL SPGERATLSC | RAS--QSVRS- ----NFLA | WHQQKPGQ APRLLIY | G------- AYRRAT | GIPDRFSGSGSG-- TDFTLTISRLEPEDFAVYYC | QQYGN------ ------SPWT | FGQGT KVEIK |
| iPS:436_146 | 21-225_197F4 | VK3|A27/ JK1 | EIVLTQSPGTLSL SPGEGATLSC | RAS--QSIRS- ----SFLA | WYLQKPGQ APRLLIY | G------- ASSRAT | GIPDRFSGSGSG-- TDFTLTINRLEPEDFAVYYC | QQYGS------ ------SPWA | FGQGT KVEIK |
| iPS:436_177 | 21-225_198B1 | VK3|A27/ JK1 | EIVLTQSPGTLSL SPGERATLSC | RAG--QSIRT- ----NFLA | WYQQQPGQ APRLLIY | G------- ASSRAT | GIPDRFSGSGSG-- TDFTLTINRLEPEDFAVYYC | QQYGS------ ------SPWT | FGQGT KVEIK |
| iPS:436_179 | 21-225_198E1 | VK3|A27/ JK1 | EIVLTQSPGTLSL SPGERATLSC | RAS--QSIRS- ----NFLA | WYQQKPGQ APRLLIY | G------- AFSRAT | GIPDRFSGSGSG-- TDFTLTINRLEPEDFAVYYC | QQYGN------ ------SPWT | FGQGT KVEIK |
| iPS:436_181 | 21-225_198C2 | VK3|A27/ JK1 | EIVVTQSPGTLSL YSEERSTLSC | RAS--QSVRS- ----SYLA | WYQQKPGQ APRLLIC | AFSRAS | GIPDRFSGSGSG-- TDFTLTISRLEPEDFAVYYC | QQYGN------ ------SPWT | LGHAT KVEIK |
| iPS:436_195 | 21-225_198G1 | VK3|A27/ JK1 | EIVLTQSPGTLSL SPGERATLSC | RAS--QSIRS- ----SFLA | WYQQKPGQ APRLLIY | G------- ASSRAT | GIPDRFSGSGSG-- TDFTLTISRLEPEDFAVYYC | QQYGN------ ------SPWA | FGQGT KVEIK |
| iPS:436_197 | 21-225_199C2 | VK3|A27/ JK1 | EIVLTQSPGTLSL SPGERATLSC | RAS--QSIRS- ----SFLA | WYQQKPGQ APRLLIY | G------- ASSRAT | GIPDRFSGSGSG-- TDFTLTINRLEPEDFAVYYC | QQYGN------ ------SPWA | FGQGI KVEIK |

FIGURE 51 (Continued)

| | | | | | | | | | |
|---|---|---|---|---|---|---|---|---|---|
| iPS:436 207 | 21-225_199C7 | VK3|A27/ JK1 | EIVLTQSPGTLSL SPGERATLSC | RAS---QSIRI- -----NFLA | WYQQKPGQ APRLLIY | G------ ASSRAT | GIPDRFSGSGSG--- TDFTLTINRLEPEDFAVYYC | QQYGN------------ ---------SPWT | FGQGT KVEIK |
| iPS:436 210 | 21-225_199G1 | VK3|A27/ JK1 | EIVVTQSPGTLSL SPGERATLSC | RAS---QSVRS- -----SYLA | WYQQKPGQ APRLLIY | G------ AFSRAT | GIPDRFSGSGSG--- TDFTLTISRLEPEDFAVYYC | QQYGN------------ ---------SPWT | FGHGT KVEIK |
| iPS:436 226 | 21-225_200F10 | VK3|A27/ JK1 | EIVLTQSPGTLSL SPGERATLSC | RAS---QNIRS- -----SFLA | WYQQKPGQ APRLLIY | G------ ASSRAT | GIPDRFSGSGSG--- TDFTLTINRLEPEDFAVYYC | QQYED------------ ---------SPWA | FGQGT KVEIK |
| iPS:436 232 | 21-225_201E1 | VK3|A27/ JK1 | EIVLTQSPDTLSL SPGERATLSC | RAS---PSINS- -----GFLA | WYQQKPGQ APRLLIY | G------ ASSRAT | GIPDRFSGSGSG--- TDFTLTISRLEPEDFAMFHC | HQYET------------ ---------SPWT | FGQGT KVEIK |
| iPS:436 238 | 21-225_201B2 | VK3|A27/ JK1 | EIVLTQSPGTLSL SPGERATLSC | RAS---QSVSS- -----NYLA | WYQQKPGQ APRLLIY | G------ ASSRAT | GIPDRFSGSGSG--- TDFTLTISRLEPEDFAVYYC | QQYEN------------ ---------SPWT | FGQGT KVEIK |
| iPS:436 256 | 21-225_202D9 | VK3|A27/ JK1 | EIVLTQSPDTLSL SPGERATLSC | RAS---QSVNS- -----GYLA | WYQQKPGQ SPRLLIY | G------ ASSRAT | IDFTLTISRLEPEDFAVHYC | QQYET------------ ---------SPWT | FGQGT KVEIK |
| iPS:436 302 | 21-225_205G7 | VK3|A27/ JK1 | EIVLTQSPGTLSL SPGERATLSC | RAS---QSVFS- -----NYLA | WYQQKPGQ APRLLIY | G------ ASSRAA | GIPDRFSGSGSG--- TDFTLTISRLEPENFAVYYC | QQYES------------ ---------SPWT | FGQGT KVEIK |
| iPS:436 310 | 21-225_202D1 | VK3|A27/ JK1 | EIVLTQSPGTLSL SPGERATLSC | RAS---QSINS- -----NYLA | WYQRKFGQ APRVLIY | G------ ASSRAT | GIPDRFSGSGSG--- TDFTLTISRLEPEDFAVFYC | QQYEN------------ ---------SPWT | FGQGT KVEIK |
| iPS:436 336 | 21-225_208B5 | VK3|A27/ JK1 | EIVLTQSPGTLSL SPGERATLSC | RAS---QSVSS- -----NYLA | WYQQRPGQ APRLLIY | G------ ASSRAT | GIPDRFSGSGSG--- TDFTLTISRLEPEDFAVYFC | QHYEN------------ ---------SPWT | FGQGT KVEIK |
| iPS:436 340 | 21-225_208A9 | VK3|A27/ JK1 | EIVLTQSPGTLSL SPGERATLSC | RAS---QSVSM- -----NYLA | WYQQKPGQ APRVLIY | G------ ASSRAT | GIPDRFSGSGSG--- TDFTLTISRLEPEDFAVYYC | QHYHS------------ ---------SPWT | FGQGT KVEIK |
| iPS:436 472 | 21-225_220E1 | VK3|A27/ JK1 | EIVLTQSPGTLSL SPGERATLSC | RAS---QSISR- -----SHLV | WYQQKPNQ APRLLIY | V------ TSSRAT | GIPDRFSGSGSG--- TDFTLTIRSLEPEDFAMYC | QQYGS------------ ---------SPWT | FGQGT KVEIK |
| iPS:436 506 | 21-225_222C7 | VK3|A27/ JK1 | EIVLTQSPGTLSL SPGERATLSC | RAS---QSVYS- -----NYLA | WYQQKPGQ APRLLIY | G------ ASSRAT | GIPDRFSGSGSG--- TDFALISRLEPEDFTIYYC | QQYED------------ ---------SPWT | FGQGT KVEIK |
| iPS:436 580 | 21-225_225E7 | VK3|A27/ JK1 | EIVLTQSPGTLSL SPGERATLSC | RAS---QSVYS- -----SYLA | WYQQKPGQ APRLLIY | G------ ASSRAT | GIPDRFSGSGSG--- TDFTLAISRLEPEDFTIYYC | QQYGT------------ ---------SPRT | FGRGT KVEIK |
| iPS:437 324 | 21-225_75C2 | VK3|A27/ JK1 | EIVLTQSPGTRYL SPGERATLSC | RAS---QSVYS- -----SYLA | WYQQKPGQ APRLLIY | G------ ASSRAT | GIPDRFSGSGSG--- TDFALTISRVEHEDCAVYYC | QHYDN------------ ---------SPWT | FGQGT KVEIK |
| iPS:437 328 | 21-225_75D3 | VK3|A27/ JK1 | EIVLTQSPGTLYL SPGERATLSC | RAS---QSVYS- -----SYLA | WYQQKPGQ APRLLIY | G------ ASSRST | GIPDRFSGSGCG--- TDFALISRLEHEDFAVYYC | QHYDN------------ ---------SPWT | FGQGT KVEIK |
| iPS:437 332 | 21-225_75F3 | VK3|A27/ JK1 | EIVLTQSPGTLYL SPGERATLSC | RAS---QSVYS- -----SYLA | WYQQKPGQ APRLLIY | G------ ASSRST | GIPDRFSGSGCG--- TDFALISRLEHEDFAVYYC | QHSDN------------ ---------SPWT | FGQGT KVEIK |
| iPS:437 340 | 21-225_75G9 | VK3|A27/ JK1 | EIALTQSPGTLSL SPGERATLSC | RAS---PSVDS- -----SYLA | WYQQKPGQ APRLLIY | G------ ASSRAP | GIPDRFSGSGSG--- TDFALISRLEPEDFAVYYC | QQYES------------ ---------SPWT | FGQGT KVEIK |
| iPS:437 344 | 21-225_75G12 | VK3|A27/ JK1 | EIVLTQSPGTLYL SPGERATLSC | RAS---QSVYS- -----SYLA | WYQQKPGQ APRLLIY | G------ ASSRAT | GIPDRFSGSGSG--- TDFTLTISRVEPEDCAVYYC | QHYDN------------ ---------SPWT | FGQGT KVEIK |
| iPS:437 350 | 21-225_74A3 | VK3|A27/ JK1 | EIVLTQSPGTLSL SPGERATLSC | RAS---QSVYS- -----SYLA | WYQQKPGQ APFLLIY | G------ ASSRST | GIPDRFSGSGCG--- TDFALISRLEPEDFAVYYC | QHSDN------------ ---------SPWT | FGQGT KVEIK |
| iPS:437 369 | 21-225_74D6 | VK3|A27/ JK1 | EIVLTQSPGTLSL SPGERATLSC | RAS---QSVYS- -----SYLA | WYQQKPGQ APRLLIY | G------ ASSRAT | GIPDRFSGSGCG--- TDFALISRLEPEDFAVYYC | QHYDN------------ ---------SPWT | FGQGT KVEIK |
| iPS:437 383 | 21-225_74H8 | VK3|A27/ JK1 | EIVLTQSPGTLSL SPGERATLSC | RAS---QSFSS- -----SYLA | WYQQRPGQ APRLLIY | G------ ASSRAT | GIPDRFSGSGSG--- TDFTLTISRLEPEDFAVYYC | QQYG-------------- ---------SSRI | FGQGT KVEIK |
| iPS:451 122 | 21-225_200A1 | VK3|A27/ JK1 | EIVLTQSPGTLSL YPGERATLSC | RAS---QSVNS- -----NYLA | WYQQRPGQ APSLLIY | G------ ASSRAT | CILDRFSGSGSG--- TDFTLTISRLEPEDFAVYYC | QQYEI------------ ---------SPWT | FGQGT KVESK |

FIGURE 51 (Continued)

| iPS:392 | 21-225_23B9 | VK3/A27/JK1 Germline | EIVLTQSPGTLSL SFGERATLSC K_FR1 | RAS--QNVYS-----SYLA K_CDR1 | WYQQKPGQ TPRLLIY K_FR2 | G------ ASSRAS K_CDR2 | GIFDRFSGSGSG-- TDFTLTISRLEPEDFAVYYC K_FR3 | QQYGS---------- ----SPRT K_CDR3 | FGQGT KVEIK K_FR4 |
|---|---|---|---|---|---|---|---|---|---|
| | | VK1/A30/JK4 | | | | | | | |
| iPS:468 812 | 21-225_48H4 | VK1/A30/JK4 | DIQMTQFFPSSLSA SVGDRVTITC | RAS----RDIR ---NDLG | WYQQKPGK APKRLIY | A------ ASSLQS | GVPSRFSGSGSG-- TEFTLTISSLQPEDFATYYC | LQHYS---------- ----YPLT | FGGGT KVEIK |
| iPS:468 824 | 21-225_73G6 | VK1/A30/JK4 | DIQMTQSPSSLSA SVGDRVTITC | RAS--QGIR-- ---NDLG | WYQQKPGK APKRLIY | A------ ASSLQS | GVPSRFSGSGSG-- TEFTLTISSLQPEDFATYYC | LQHNS---------- ----YPLI | FGGGT KVEIK |
| iPS:468 818 | 21-225_190C8 | VK1/A30/JK4 | DIQMTQSPSSLSA SVGDRVTITC | RAS--QGIR-- ---NDLG | WYQQKPGK APKRLIY | A------ ASSLQS | GVPSRFSGSGSG-- TEFTLTISSLQPEDFETYYC | LQRND---------- ----YPFT | FGGGT KVEIK |
| iPS:468 840 | 21-225_200H9 | VK1/A30/JK4 | DIQMTQSPSSLSA SVGDRVTITC | RAS--QGIR-- ---NDLG | WYQQKPGK APKRLIY | A------ ASSLQS | GIPSRFSGSGSG-- TEFTLTISSLQPEDFATYYC | LQHNS---------- ----YPLT | FGGGT KVEIK |
| iPS:468 868 | 21-225_74A1 | VK1/A30/JK4 | DIQMTQSPSSLSA SVGDRVTITC | RAS--QGIR-- ---NDLG | WYQQKPGK APKRLIY | A------ ASSLQS | GVPSRFSGSGSG-- TEFTLTISSLQPEDFATYYC | LQHDS---------- ----YPLT | FGGGA KVEIK |
| iPS:392 920 | 21-225_29G4 | VK1/A30/JK4 | DIQMTQSPSSLSA SVGDRVTITC | RAS--QGIR-- ---NDLG | WYQQKPGK APKRLIY | A------ ASSLQS | GVPSRFSGSGSG-- TEFTLTISSLQPEDFATYYC | LQHNS---------- ----YPLT | FGGGT KVEIT |
| iPS:433 899 | 21-225_43C3 | VK1/A30/JK4 | DIQMTQSPSSLSA SVGDRVTITC | RAS--QGIR-- ---NDLG | WYQQKPGK APKRLIY | A------ ASSLQS | GVPSRFSGSGSG-- TEFTLTISSLQPEDFATYYC | LQHNS---------- ----YPLT | FGGGT KVGIT |
| iPS:433 921 | 21-225_44C3 | VK1/A30/JK4 | DIQMTQSPSSLSA SVGDRVTITC | RAS--QGIR-- ---NDLG | WYQQKPGK APKRLIY | A------ ASSLQS | GVPSRFSGSGSG-- TEFTLTISSLQPEDFATYYC | LQHSS---------- ----YPLT | FGGGT KVEIK |
| iPS:433 947 | 21-225_44E12 | VK1/A30/JK4 | DIQMTQSPSSLSA SVGDRVTITC | RTS--QGIR-- ---NDLG | WYQQKPGK APKRLIY | A------ ASSLQS | GVPSRFSGSGSG-- TEFTLTISSLQPEDFATYYC | LQHNS---------- ----YPLT | FGGGT KVEIK |
| iPS:433 963 | 21-225_46B1 | VK1/A30/JK4 | DIQMTQSPSSLSA SVGDRVTITC | RAS--QGIR-- ---KDLG | WYQQKPGK APKRLIY | A------ ASSLQS | GVPSRESGSGSG-- TEFSLTISSLQPEDFATYYC | LQHNS---------- ----YPLT | FGGGT KVEIK |
| iPS:433 969 | 21-225_46F3 | VK1/A30/JK4 | DIQMTQSPSSLSA SVGDRVTITC | RAS--QDIR-- ---NDLG | WYQQKPGK APKRLIY | A------ ASSLQS | GVPSRESGSGSG-- TEFTLTISSLQPEDFATYYC | LQHNS---------- ----YPLT | FGGGT KVEIK |
| iPS:433 975 | 21-225_46C6 | VK1/A30/JK4 | DIQMTQSPSSLSA SVGDRVTITC | RAS--QGIR-- ---NDLG | WYQQKPGK APKRLIY | A------ ASSLQS | GVPSRESGSGSG-- TEFTLTISSLQPEDFATYYC | LQHNS---------- ----YPLT | FGGGT KVEIT |
| iPS:433 977 | 21-225_46D8 | VK1/A30/JK4 | DIQMTQSPSSLSA SVGDRVTITC | RAS--QGIR-- ---KDLG | WYQQKPGK APKRLIY | A------ ASSLQS | GVPSRESGSGSG-- TEFSLTISSLQPEDFATYYC | LQHNS---------- ----YPLT | FGGGT KVEIK |
| iPS:433 983 | 21-225_47A1 | VK1/A30/JK4 | DIQMTQSPSSLSA SVGDRVTITC | RAS--QDIR-- ---NDLG | WYQQKPGK APKRLIY | A------ ASSLQS | GVPSRESGSRSG-- TEFTLTISSLQPEDFATYYC | LQHNS---------- ----YPLT | FGGGT KVEIK |
| iPS:433 987 | 21-225_47A5 | VK1/A30/JK4 | DIQMTQSPSSLSA SVGDRVTITC | RAS--QGIR-- ---NDLG | WYQQKFGK APKRLIY | A------ AFSLQS | GVPSRESGSGSG-- TEFTLTISSLQPEDFATYYC | LQHNS---------- ----YPLT | FGGGT KVEIK |
| iPS:434 013 | 21-225_48D12 | VK1/A30/JK4 | DIQMTQSPSSLSA SVGDRVTITC | RAS--QGIR-- ---NDLG | WYQQKPGK APKRLIY | A------ ASSLQS | GVPSRESGSGSG-- TEFTLTISSLQPEDFATYYC | LQHNS---------- ----YPLT | FGGGT KVEIK |
| iPS:434 019 | 21-225_49A1 | VK1/A30/JK4 | DIQMTQSPSSLSA SVGDRVTITC | RAS--QGIR-- ---NDLD | WYQQKFGK APKRLIY | A------ ASTLQS | GVPSRESGSGSG-- TEFTLTISSLQPEDFATYYC | LQHNS---------- ----YPLT | FGGGT KVEIK |
| iPS:434 029 | 21-225_49C6 | VK1/A30/JK4 | DIQMTQSPSSLSA SVGDRVTITC | RAS--QGIR-- ---NDLG | WYQQKFGK APKRLIY | A------ ASSLQS | GFFSRESGSGSG-- TEFTLTISSLQPEDFATYYC | LQHNS---------- ----YPLT | FGGGT KVEIK |
| iPS:434 043 | 21-225_50G10 | VK1/A30/JK4 | DIQMTQSPSSLSA SVGDRVTITC | RAS--QGIR-- ---NNLG | WYQQKPGK VPKRLIY | A------ ASSLQS | GVPSRESGSGSG-- TEFTLTISSLQPEDFATYYC | LQHNS---------- ----YPFT | FGGGT KVESK |
| iPS:434 077 | 21-225_51F11 | VK1/A30/JK4 | DIQMTQSPSALSA SVGDRVTITC | RAS--QGIR-- ---NDLG | WYQQKPGK APKRLIY | A------ ASSLQS | GVPSRESGSGSG-- TEFTLTISSLQPEDFATYYC | LQHNS---------- ----YPFT | FGGGT KVEIK |
| iPS:434 081 | 21-225_52B2 | VK1/A30/JK4 | DIQMTQSPSSLSA SVGDRVTITC | RAS--QGIR-- ---NDLG | WYQQKPGK APKRLIY | A------ ASFLQS | GVFSTSGSGSG-- TEFTLTISSLQPEDFATYYC | LQHNS---------- ----YPLT | FGGGT KVEIK |

FIGURE 51 (Continued)

| | | | | | | | | | | |
|---|---|---|---|---|---|---|---|---|---|---|
| iPS:434 105 | 21-225_53D2 | VK1|A30/ JK4 | DIQMTQSPSSLSA SVGDRVTITC | RAS--QGIR- -----NDLG | WYQQKPGK APKRLIY | A------ ASSLQS | GVPSRFSGSGSG--- TEFTLTISSLQPEDFATYYC | LQHNR-------------YPLT | FGGGT KVEIK |
| iPS:434 119 | 21-225_53E6 | VK1|A30/ JK4 | DIQMTQSPSSLSA SVGARVTITC | RAS--QGIR- -----NDLG | WYQQNPGK APKRLIY | A------ ASNLQS | GVPSRFSGSGSG--- TEFTLTISSLQPEDFATYFC | LQHNR-------------YPLT | FGGGT KVEIK |
| iPS:434 141 | 21-225_54C6 | VK1|A30/ JK4 | DIQMTQSPSSLSA SVGDRVTITC | RAS--QGIR- -----NDLG | WYQQNPGK APKRLIY | A------ ASNLQS | GVPSRFSGSGSG--- TEFTLTISSLQPEDFATYYC | LQHNR-------------YPLT | FGGGT KVEIK |
| iPS:434 159 | 21-225_55B8 | VK1|A30/ JK4 | DIQMTQSPSSLSS SVGDRVTITC | RAS--QAIR- -----NDLG | WYQQKPGK APKRLIH | A------ AFRLQS | GVPSRFSGSGSG--- TEFTLTISSLQPEDFATYYC | LQHNS-------------YPLT | FGGGT KVEIK |
| iPS:434 179 | 21-225_56F1 | VK1|A30/ JK4 | DIQMTQSPSSLSA SVGDRVTITC | RAS--QDIR- -----NNLG | WYQQKPGK APKRLIN | A------ ASSLQS | GVPSRFSGSGSG--- TEFTLTISSLQPEDFATYYC | LQDNS-------------HPFT | FGGGT KVEIK |
| iPS:434 217 | 21-225_60E8 | VK1|A30/ JK4 | DIQMTQSPSSLSA SVGDRVTFTC | RAS--QGIR- -----NDLG | WFQQKPGK APKRLIY | A------ ASSLQS | GVPSRFSGSGSG--- TEFTLTISSLQPEDFATYYC | LQHSS-------------YPLT | FGGGT KVEIK |
| iPS:434 249 | 21-225_62E2 | VK1|A30/ JK4 | DIQMTQSPSSLSA SVGDRVTITC | RAS--QGIR- -----NDLG | WYQQKPGK APKRLIY | A------ ASRLQS | GVPSRFSGSGSG--- TEFTLTISSLQPEDFATYYC | LQHSN-------------YPLT | FGGGT KVEIK |
| iPS:434 253 | 21-225_62E4 | VK1|A30/ JK4 | DIQMTQSPSSLSA SVGDRVTITC | RAS--QGIR- -----NDLG | WYQQKPGK APKRLIY | A------ AFSLQS | GVPSRFSGSGSG--- TEFTLTISSLQPEDFATYYC | LQHNS-------------YPLT | FGGGT KVEIK |
| iPS:434 313 | 21-225_59E6 | VK1|A30/ JK4 | DIQMTQSPSSLSA SVGDRVTITC | RAS--QDIR- -----NDLG | WYQQKPGK APKRLIY | A------ ASSLQS | GVPSRFSGSGSG--- TEFTLTISSLQPEDFATYYC | LQHNS-------------YPLT | FGGGT KVEIK |
| iPS:434 337 | 21-225_64E1 | VK1|A30/ JK4 | DIQMTQSPSSLSA SVGDRVTITC | RAS--QGIR- -----NDLG | WYQQKPGK APKRLIY | A------ ASSLQS | GVPSRFSGSGSG--- TEFTLTISSLQPEDFATYYC | LQHNS-------------YPLT | FGGGT KVEIK |
| iPS:434 411 | 21-225_68F11 | VK1|A30/ JK4 | DIQMTQSPSSLSA SVGDRVTITC | RAS--QGIR- -----NDLG | WYQQKPGK APKRLIY | A------ ASSLQS | GVPSRFSGSGSG--- PEFTLSISSLQPEDFATYYC | LQHST-------------YPFT | FGGGT KVEIK |
| iPS:434 413 | 21-225_68D12 | VK1|A30/ JK4 | DIQMTQSPSSLSA SVGDRVTITC | RAS--QGIR- -----NDLG | WYQQKPGK APKRLIY | A------ ASSLQS | GVPSRFSGSGSG--- TEFTLTISSLQPEDFATYYC | LQHNR-------------YPLT | FGGGT KVEIK |
| iPS:434 433 | 21-225_70E8 | VK1|A30/ JK4 | DIQMTQSPSSLST SVGDRVTITC | RAS--QGIR- -----KDLG | WYQQKPGK APKRLIY | A------ ASSLQS | GVPSRFSGSGSG--- TEFTLTISSLQPEDFATYYC | LQHNR-------------YPLT | FGGGT KVEIK |
| iPS:434 439 | 21-225_70E12 | VK1|A30/ JK4 | DIQMTQSFSSLSA SVGDRVTITC | RAS--QGIR- -----NNLN | WFQQKPGK APKRLIY | A------ ASTLQS | GVPSRFSGSGSG--- TEFTLTISSLQPEDFATYHC | LQHNS-------------YPLT | FGGGT KVEIK |
| iPS:434 489 | 21-225_74E4 | VK1|A30/ JK4 | DIQMTQSPSSLSA SVGDRVTITC | RAS--QGIR- -----NDLG | WYQQKPGK APKRLIY | A------ ASTLQS | GVPSRFSGSGSG--- TEFTLTISGLQPEDFATYYC | LQHSN-------------YPLT | FGGGT KVEIK |
| iPS:434 503 | 21-225_74D7 | VK1|A30/ JK4 | DIQMTQSPSSLSA SVGDRVTITC | RAS--QGIR- -----NDLG | WYQQKPGK APKRLIY | A------ ASSLQS | GVPSRFSGSGSG--- TEFTLTISSLQPEDFATYYC | LQHSN-------------YPLT | FGGGT KVEIK |
| iPS:435 251 | 21-225_96A3 | VK1|A30/ JK4 | DIQMTQSPSSLSA SVGDRVTITC | RAS--QGIR- -----NDLG | WYQQKPGK APKRLIY | A------ ASTLQS | GVPSRFSGSGSG--- TEFTLTISGLQREDFATYYC | LQHST-------------YPLT | FGGGT KVEIK |
| iPS:435 293 | 21-225_146F1 | VK1|A30/ JK4 | DIQMTQSPSSLSA SVGDRVTITC | RAS--QGIR- -----NDLG | WYQQKPGK APKRLIY | A------ ASSLQS | GVPSRFSGSGSG--- TEFTLTISSLQPEDFATYYC | LQHNS-------------YPLT | FGGGT KVEIK |
| iPS:435 311 | 21-225_146H9 | VK1|A30/ JK4 | DIQMTQSPSSLSA SVGDRVTITC | RAS--QDIR- -----NDLG | WYQQKPGK APKRLIY | A------ ASSLQS | GVPSRFSGSGSG--- TEFTLTISSLQPEDFATYYC | LQHNS-------------YPLT | FGGGT KVEIK |
| iPS:435 313 | 21-225_146G1 | VK1|A30/ JK4 | DIQMTQSPSSLSA SVGDRVTITC | RAS--QDIR- -----NNFG | WYQQKPGK APKRLIY | A------ ASSLQS | GVPLRFSGSGSG--- TEFTLTISSLQPEDFATYYC | LQHDS-------------YPLT | FGGGS KVEIK |
| iPS:435 361 | 21-225_148E1 | VK1|A30/ JK4 | DIQMTQSPSSLSA SVGDRVTITC | RAS--QGIR- -----NDLG | WYQQKPGK APKRLIS | A------ ASSLQS | GVPSRFTGSGSG--- TEFTLTISSVQPEDFATYYC | LQHRN-------------YPLT | FGGGT KVEIK |
| iPS:435 363 | 21-225_148F12 | VK1|A30/ JK4 | DIQMTQSPSSLSA SVGDRVTITC | RAS--QGIR- -----NALG | WYQQKPGK APKRLIY | A------ ASSLQS | GVPSRFSGSGSG--- TEFTLTISSLQPEDFATYFC | LQHNS-------------YPLI | FGGGT KVEIK |

FIGURE 51 (Continued)

| | | | | | | | | | |
|---|---|---|---|---|---|---|---|---|---|
| iPS:435_367 | 21-225_149G1 | VK1/A30/ JK4 | DIQMTQSPSSLSA SVGARVTITC | RAS--QGIR--- ----NDLG | WYQQKPGK APKRLIY | A------- ASNLQS | GVPSRFSGSGSG--- TEFTLTISSLQPEDFATYYC | LQHNS-------- --------YPLT | FGGGT KVEIK |
| iPS:435_377 | 21-225_149G5 | VK1/A30/ JK4 | DIQMTQSPSSLSA SVGDRVTITC | RAS--QGIR--- ----NALG | WFQQKPGK APKRLIY | A------- ASSLQS | GVPSRFSGSGSG--- TEFTLTISSLQPEDFATYYC | LQHNS-------- --------YPLT | FGGGT KVEIK |
| iPS:435_397 | 21-225_149F12 | VK1/A30/ JK4 | DIQMTQSPSSLSA SVGDRVTITC | RAS--QGIR--- ----NDLG | WYQQKPGK APKRLIY | A------- ASNLQS | GVPSRFSGSGSG--- TEFTLTISSLQPEDFATYYC | LQHNS-------- --------YPLT | FGGGT KVEIK |
| iPS:435_407 | 21-225_150E7 | VK1/A30/ JK4 | DIQMTQSPSSLSA SVGDRVTITC | RAS--QGIR--- ----NDLG | WYQQKPGK APKRLIY | A------- ASNLQS | GVPLRFSGSGSG--- TDFTLTISSLQPEDFAAYYC | LQHNS-------- --------YPLT | FGGGT KVEIK |
| iPS:435_449 | 21-225_152H9 | VK1/A30/ JK4 | DIQMTQSPSSLSA SVGDRVTITC | RAS--QGIR--- ----NDLG | WYQQKPGK APKRLIY | A------- ASSLQS | GVPSRFTGSGSG--- TEFTFTISSLQPEDFATYYC | LQHSN-------- --------YPLT | FGGGT KVEIK |
| iPS:435_499 | 21-225_156G1 | VK1/A30/ JK4 | DIQMTQSPSSLSA SVGDRVTITC | RAS--QGIR--- ----NDLG | WYQQKPGK APKRLIY | A------- ASSLQS | GVPSRFSGSGSG--- TEFTLTISSLQPEDFATYYC | LQHSN-------- --------YPLT | FGGGT KVEIK |
| iPS:435_549 | 21-225_158H5 | VK1/A30/ JK4 | DIQMTQSFSFLFA SVGDRVTITC | RAS--QGMR--- ----IDLG | WYQQKPGK APKRLIY | R------- ASSLQS | GVPSRFSGSGCG--- TEFTLTISSVQRDFASYYC | VQHNS-------- --------YPLT | FGGGT KVEIK |
| iPS:435_587 | 21-225_160H3 | VK1/A30/ JK4 | DIQMTQSPSSLSA SVGDRVTITC | RAS--QGIR--- ----NDLG | WYQQKPGK APKRLIY | A------- ASSLQS | GVPSRFSGSGSG--- TEFTLTISSLQPEDFATYYC | LQHSM-------- --------YPLT | FGGGT QVESK |
| iPS:435_599 | 21-225_160B10 | VK1/A30/ JK4 | DIQMTQSPSSPSA SVGDRVTITC | RAS--QGIR--- ----NDLG | WYQQKPGT APKRLIY | A------- ASSLQS | GVPSRFSGSGSG--- TEFTLTISNLQPEDFATYYC | LQHSS-------- --------YPLT | FGGGT KVEIK |
| iPS:435_663 | 21-225_169B1 | VK1/A30/ JK4 | DIQMTQSPSSLSA SVGDRVTITC | RAS--QGIR--- ----NDLG | WYQQKPGK APKRLIY | A------- ESSLQS | GVPSRFSGSGSG--- TEFTLTISGLQPEDFATYYC | LQHYS-------- --------YPLT | FGGGT KVEIK |
| iPS:435_669 | 21-225_169F9 | VK1/A30/ JK4 | DIQMTQSPSSLSA SVGDRVTITC | RAS--QGIR--- ----NDLG | WYQQKPGK APKRLIF | A------- ASSLQS | GVPSRFSGSGSG--- TEFTLTISSLQPEDFATYYC | LQHYS-------- --------YPLT | FGGGT KVEIK |
| iPS:435_693 | 21-225_170G4 | VK1/A30/ JK4 | DIQMTQSPSSLSA SVGDRVTITC | RAS--QGIR--- ----NDLG | WYHQKPGK APKRLIY | A------- ASTLQS | GVPSRFSGSGSG--- TEFTLTISSLQPEDFATYYC | LQHYS-------- --------YPLT | FGGGT RVEIK |
| iPS:435_695 | 21-225_170D5 | VK1/A30/ JK4 | DIQMTQSPSSLSA SVGDRVTITC | RAS--QGIR--- ----NDLG | WYQEKPGK APKHLIY | A------- ASSLQN | GVPSRFSGSGSG--- TEFTLTISSLQPEDFATYYC | LQHYS-------- --------FPLT | FGGGT KVEIK |
| iPS:435_697 | 21-225_170G5 | VK1/A30/ JK4 | DIQMTQSPSSLSA SVGDRVTITC | RAS--QGIR--- ----TDLG | WYQQKPGK APKRLIY | T------- ASSLQS | GVPSRFSGSGSG--- TEFTLTISSLQPEDFATYYC | LQHYS-------- --------YPLT | FGGGT KVEIK |
| iPS:435_703 | 21-225_170D1 | VK1/A30/ JK4 | DIQMTQSPSSLSA SVGDRVTITC | RAS--QGIR--- ----NDLG | WYQQKPGK APKHLIY | A------- ASSLQN | GVPSRFSGSGSG--- TEFTLTISSLQPEDFATYYC | LQHYS-------- --------FPLT | FGGGT KVEIR |
| iPS:435_705 | 21-225_171C3 | VK1/A30/ JK4 | DIQMTQSPSSLSA SVGDRVTITC | RAS--QGIR--- ----TDLG | WFQQKPGK APKRLIY | T------- ASSLQS | GVPSRFSGSGSG--- TEFTLTISSLQPEDFATYYC | LQHYS-------- --------YPLT | FGGGT KVEIK |
| iPS:435_709 | 21-225_171A4 | VK1/A30/ JK4 | DIQMTQSPSSLSA SVGDRVTITC | RAS--QGIR--- ----NDLG | WYQQKPGK APKRLIY | A------- ASSLQS | GVPSRFSGSGSG--- TEFTLTISSLQPEDFATYYC | LQHYS-------- --------YPLT | FGGGT KVEIK |
| iPS:435_721 | 21-225_172B3 | VK1/A30/ JK4 | DIQMTQSPSSLSA SVGDRVTITC | RAS--QGVR--- ----NDLG | WYQQKPGK APKRLIG | A------- ESSLQS | GVPSRFSGSGSG--- TEFTLTISSLQPEDFATYYC | LRHYS-------- --------YPLT | FGGGT KVEIK |
| iPS:435_725 | 21-225_172G8 | VK1/A30/ JK4 | DIQMTQSPSSLSA SVGDRVTITC | RAS--QGIR--- ----NDLG | WYQQKPGK APKHLIY | A------- ASSLQN | GVPSRFSGSGSG--- TEFTLTISSLQPEDFATYYC | LQHYS-------- --------FPLT | FGGGT KVEIK |
| iPS:435_735 | 21-225_173H1 | VK1/A30/ JK4 | DIQMTQSPSSLSA SVGDRVTITC | RAS--QGIR--- ----NDLG | WYQQKPGK APKRLIY | T------- TSSLQS | GVPSRFSGSGSG--- TEFTLTISSLQPEDFASYYC | LQHYS-------- --------FPNT | FGGGT RVEIK |
| iPS:435_743 | 21-225_175G12 | VK1/A30/ JK4 | DIQMTQSPSSLSA SVGDRVTITC | RAS--QGIR--- ----TDLG | WYQQKPGK APKRLIY | A------- ASSLQS | GVPSRFSGSGSG--- TEFTLTISSLQPEDFATYYC | LQHYS-------- --------YPLT | FGGGT KVEIK |

FIGURE 51 (Continued)

| ID | V/J | | | | | | | | |
|---|---|---|---|---|---|---|---|---|---|
| iPS:435 761 | 21-225_176B1 | VK1|A30/JK4 | DIQMTQSPSSLSA SVGDRVTIIC | RAS---QGIR-----NDLG | WFQQKPGK APKRLIY | A------ASSLQS | GVPSRFSGSGSG---TEFTLTISSLQPEDFATYYC | LQHYS---------YPLT | FGGGT KVEIK |
| iPS:435 779 | 21-225_178B1 | VK1|A30/JK4 | DIQMTQSPSSLSA SVGDRVTITC | RAS---QGIR-----NDLG | WYQQKPGK APKRLIY | A------ASSLQN | GVPSRFSGSGSG---TEFTLTISSVQPEDFETYYC | LHHYS---------FPLT | FGGGT KVEIK |
| iPS:436 023 | 21-225_193A5 | VK1|A30/JK4 | DIQMTQSPSSLFA SVGDRVIISC | RAS---QGIR-----NDLG | WYQQYPGK APKRVIY | A------ASSLQS | GVPSRFSGSGFG---TEFTLTISSVQPEDFETYYC | LQHND---------FPFT | FGGGT KVEIK |
| iPS:436 033 | 21-225_193E7 | VK1|A30/JK4 | DIQMTQSPSSLSA SVGDRVTITC | RAS---QGIR-----NDLG | WYQQKPGK APKRLIY | S------ASSLQR | GVPSRFSGSGSG---TEFTLTISSLQPEDFATYYC | LQHKR---------YPLT | FGGGT KVEIK |
| iPS:436 120 | 21-225_196C1 | VK1|A30/JK4 | DIQMTQSPSSLSA SVGDRVTITC | RAS---QGIR-----NDLG | WYQQKPGK APKRLIY | A------ASSLQS | GVPSRFSGSGSG---TEFTLTISSLQPEDFATYYC | LQYNS---------YPLT | FGGGT KVEIK |
| iPS:436 199 | 21-225_199E3 | VK1|A30/JK4 | DIQMTQSPSSLSA SVGDRVTITC | RAS---QGIR-----NDLG | WYQQKPGK APKRLIS | S------ASSLQR | GVPSRFSGSGSG---TEFTLTISSLQPEDFATYYC | LQHKR---------YPLT | FGGGT KVEIK |
| iPS:436 228 | 21-225_200F12 | VK1|A30/JK4 | DIQMTQSPSSLSA SVGDRVTITC | RAS---QGIR-----NDLG | WYQQKPGR APKRLIY | S------ASSLHT | GVPSRFSGSGSG---TEFTLTISSLQPEDFATYYC | LQHKS---------YPLT | FGGGT KVEIK |
| iPS:436 230 | 21-225_201A1 | VK1|A30/JK4 | DIQMTQSPSSLSA SVGDRVTITC | RAS---QGIR-----NDLG | WYQQKPGK APKRLIY | S------ASILQR | GVPSRFSGSGSG---TEFTLTISSLQPEDFATYYC | LQHKS---------YPLT | FGGGT KVEVK |
| iPS:436 242 | 21-225_201A1 | VK1|A30/JK4 | DIQMTQSPSSLSA SVGDRVTITC | RAS---QGIR-----NDLG | WYQQKPGR APKRLIY | T------TSSLHS | GVPSRFSGSGSG---TEFTLTISSLQPEDFATYYC | LQHNS---------YPLT | FGGGT KVEIK |
| iPS:436 286 | 21-225_204H8 | VK1|A30/JK4 | DIQMTQSPSSLSA SVGDRVTITC | RAS---QGIR-----NDLG | WYQQKPGK APKRLIY | S------ASSLQS | GVPSRFSGRGSG---TEFTLTVSSLQPEDFATYYC | LQHNS---------YPLT | FGGGT KVEIK |
| iPS:436 308 | 21-225_205H8 | VK1|A30/JK4 | DIQMTQSPSSLSA SVGDRVTITC | RAS---QGIR-----NDLG | WYQQKQGK APKRLIY | S------ASFLQR | GVPSRFSGSGSG---TEFTLTISSLQPEDSAAYYC | LQHNS---------YPLT | FGGGT TVKIK |
| iPS:436 526 | 21-225_224A1 | VK1|A30/JK4 | DIQMTQSPSSLSA SVGDRVTITC | RAS---QGIE-----NDLG | WYQQKPGK APKRLIY | A------ASSLQS | GVPSRFSGSGSG---TEFTLTISSLQPEDFATYYC | LQHNS---------YPLT | FGGGT KVEIK |
| iPS:436 528 | 21-225_224B1 | VK1|A30/JK4 | DIQMTQSPSSLSA SVGDRVTITC | RAS---QGIS-----NDLG | WYQQKPGK APKRLIY | A------ASSLQS | GVPSRFSGSGSG---TEFTLTISSLQPEDFATYHC | LQHNS---------YPPT | FGGGT KVEIK |
| iPS:436 538 | 21-225_224C3 | VK1|A30/JK4 | DIQMTQSPSSLSA SVGDRVTITC | RAS---QDIR-----NDLG | WYQQKPGK APKRLIY | A------TSSLQS | GVPSRFSGSGSG---TEFTLTISSLQPEDFATYYC | LQHNS---------YPLT | FGGGT KVEIK |
| iPS:436 556 | 21-225_224D1 | VK1|A30/JK4 | DILMTQSPSSLSA SVGDRVTITC | RAS---QGIR-----NDLG | WYQQKPGK APKRLIY | A------ASSLQS | GVPSRFSGSGSG---TEFTLTITSLQPEDFATYYC | LQHNS---------YPLT | FGGGT KVEIK |
| iPS:437 220 | 21-225_55H6 | VK1|A30/JK4 | DIQMTQSPSSLSA SVGDRVTITC | RAS---QGIR-----NDLG | WYQQKPGK APKRLIY | G------ASSLQS | GVPSRFSGSGSG---TEFTLTISSLQPEDFAAYYC | LQRDS---------YPFT | FGGGT KVEIK |
| iPS:437 346 | 21-225_75H7 | VK1|A30/JK4 | DIQMTQSPSSRYA SVGDRVTINS | RAS---QGIR-----NDLG | WYQQKPGK SPQRLIY | D------ASSLQS | GVPSRFSGSGSG---TEFTLTISSVQPEDFGVYYC | LQHSN---------YPLT | FGGGT KVEIK |
| iPS:472 730 | 21-225_14B1_LC1 | VK1|A30/JK4 | DIQMTQSPSYLSA SVGDRVTITC | RAS---QDIR-----DNLG | WYQQKPGK APKRLIY | T------AYSLQS | GVPSRFSGSGSG---TEFTLTISSLQPEDFATYYC | LQHYN---------YPLT | FGGGT KVEIK |
| iPS:392 622 | 21-225_17H8 | VK1|A30/JK4 | DIQMTQSPSSLSA SVGDRVTITC | RAS---QGIR-----NDLG | WYQQKPGK APKRLIY | G------ASSLQS | GVPSRFSGSGSG---TEFTLTISSLQPEDFTTYYC | LQHNS---------YPLT | FGGGT KVEIK |
| iPS:392 624 | 21-225_17H12 | VK1|A30/JK4 | DIQMTQSPSSLSA SVGDRVTITC | RAS---QDIR-----NDLG | WYQQKAGK APKRLIN | A------ASSLQS | GVPSRFSGIGSG---TEFTLIITGLQPEDFATYYC | LQHYS---------YMFT | FGGGT KVEIK |

FIGURE 51 (Continued)

| | | | | | | | | | |
|---|---|---|---|---|---|---|---|---|---|
| iPS:392_628 | 21-225_20C2 | VK1/A30/JK4 | DIQMTQSPSSLSA SVGDRVTITC | RAS--QGIR-----NDLG | WYQQKPGK APKRLIF | A-------ASSLQS | GVPSRFSGSGSG---TEFTLTISSLQPEDFATYYC | LQHAS-------------YPLT | FGGGT KVEIE |
| iPS:392_630 | 21-225_20E5 | VK1/A30/JK4 | DIQMTQSPSSLSA SVGDRVTITC | RAS--QGIR-----NDLG | WYQQKPGK APKRLIY | A-------ASSLQS | GVPSRFSGSGSG---TEFTLTISSLQPEDFATYYC | LQHNS-------------YPLT | FGGGT KVEIK |
| iPS:392_638 | 21-225_17F9 | VK1/A30/JK4 | DIQMTQSPSSLSA SVGDRVTITC | RAS--QVIR-----NDLG | WYQQKPGK APKRLIY | V-------VSSLQS | GVPSRFSGSGSG---TEFTLTISSLQPEDFATYYC | LQHNT-------------YPLT | FGGGT KVEFK |
| iPS:392_640 | 21-225_18A1 | VK1/A30/JK4 | DIQMTQSPSSLSA SVGDRVTITC | RAS--QGIR-----NDLG | WYQQKPGK APKRLIY | A-------ASSLQS | GVPSRFSGSGSG---TEFTLTISSLQPEDFATYYC | LQHNS-------------YPLT | FGGGT KVEIK |
| iPS:392_642 | 21-225_18C6 | VK1/A30/JK4 | DIQMTQSPSSLSA SVRDRVTITC | RTS--QGIR-----NDLG | WYQQKPGK APKRLIY | A-------ASSLQS | GVPSRFSGSGSG---TEFTLTISSLQPEDFATYYC | LQHSS-------------YPLT | FGGGT KVEIK |
| iPS:392_644 | 21-225_19E1 | VK1/A30/JK4 | DIQMTQSPSSLSA SVGDRVTITC | RAS--QGIR-----NDLG | WYQQKPGK APKRLIY | A-------ASNLQS | GVPSRFSGSGSG---TEFTLTISSLQPEDFATYYC | LQHNS-------------FPLT | FGGGT KVEIK |
| iPS:392_646 | 21-225_20G2 | VK1/A30/JK4 | DIQMTQSPSSLSA SVGDRVTITC | RAS--QGIR-----NDLG | WYQQKPGK APKRLIY | A-------ASSFQS | GVPSRFSGSGSG---TEFTLTISSLQPEDFASYYC | LQHNS-------------YPLT | FGGGT KVEIK |
| iPS:392_654 | 21-225_17A10 | VK1/A30/JK4 | DIQMTQSPSSLSA SVGDRVTITC | RAS--QGIR-----NDLG | WYQQKPGK APKRLIY | A-------ASSLQS | GVPSRFSGSGSG---TEFTLTISSLQPEDFATYYC | LQHNS-------------YPLT | FGGGT KVEIK |
| iPS:392_656 | 21-225_1F2 | VK1/A30/JK4 | DIQMTQSPSSLSA SVGDRVTITC | RAS--QGIR-----NDLG | WYQQKPGK APKRLIY | A-------ASSVQS | GVPSRFSGSGSG---TEFTLTISSLQPEDFATYYC | LQHNS-------------YPLT | FGGGT KVEIK |
| iPS:392_658 | 21-225_18E8 | VK1/A30/JK4 | DIQMTQAPSPSSLSA SVGDRVTITC | RAS--QGIR-----NDLG | WYQQKPGK APKRLIY | A-------ASSLQS | GVPSRFSGSGSG---TEFLTISSLQPEDFATYYC | LQHNS-------------YPLT | FGGGT KVEIK |
| iPS:392_666 | 21-225_16F11 | VK1/A30/JK4 | DIQMTQSPSSLSA SVGDRVTITC | RAS--QGIR-----NDLG | WYQQKPGK APKRLIY | A-------ASVVQS | GVPSRFSGSGSG---TEFLTISSLQPEDFATYYC | LQHNS-------------YPLT | FGGGT KVEIK |
| iPS:392_676 | 21-225_19F3 | VK1/A30/JK4 | DIQMTQSPSSLSA SVGDRVTITC | RAS--QGIR-----NDLG | WYQQKPGK APKRLIY | V-------VSSLQS | GVPSRFSGSGSG---TEFLTISSLQPEDFATYYC | LQHSS-------------YPLT | FGGGT KVEIK |
| iPS:392_680 | 21-225_20A7 | VK1/A30/JK4 | DIQMTQSPSSLSA SVGDRVTITC | RAS--QGIR-----NDLG | WYQQKPGK APKRLIY | A-------ASNLQS | GVPSRFSGSGSG---TEFLTISSLQPEDFATYYC | LQHNS-------------YPLT | FGGGT KVEIK |
| iPS:392_700 | 21-225_16E12 | VK1/A30/JK4 | DIQMTQSPSSLSA SVGDRVTITC | RAS--QGIR-----NDLG | WYQQKPGK APKRLIY | A-------ASSLQS | GVPSRFSGSGSG---TEFLTISSLQPEDFATYYC | LQHNS-------------YPLT | FGGGT KVEIK |
| iPS:392_706 | 21-225_18A3 | VK1/A30/JK4 | DIQMTQSPSSLSA SVGDRVTITC | RAS--QGIR-----NDLG | WYQQKPGK APKRLIY | V-------ASSLQS | GVPSRFNGSGSG---TEFLTISSLQPEDFATYYC | LQHSS-------------YPLT | FGGGT KVEIK |
| iPS:392_716 | 21-225_17B5 | VK1/A30/JK4 | DIQMTQSPSSLSA SVGDRVTITC | RAS--QGIR-----NDLG | WYQQKPGK APKRLIY | A-------ASNLQS | GVPSRFSGSGSG---TEFLTISSLQPEDFATYYC | LQHNS-------------YPLT | FGGGT KVEIK |
| iPS:392_744 | 21-225_20D5 | VK1/A30/JK4 | DIQMTQSPSSLSA SVGDRVTITC | RAS--QGIR-----NDLG | WYQQKPGK APKRLIY | A-------ASSLQS | GVPSRFSGSGSG---TEFLTISSLQPEDFATYYC | LQHSS-------------YPFT | FGGGT KVEIK |
| iPS:392_750 | 21-225_20A10 | VK1/A30/JK4 | DIQMTQSPSSLSA SVGDRVTITC | RAS--QGIR-----NDLG | WYQQKPGK APKRLIY | A-------ASSLQS | GVPSRFSGSGSG---TEFLTISSLQPEDFATYYC | LQHNR-------------YPLT | FGGGT KVEIK |
| iPS:392_772 | 21-225_20E12 | VK1/A30/JK4 | DIQMTQSPSSLSA SVGDRVTITC | RAS--QGIR-----NDLG | WYQQKPGK APKRLIF | A-------ASSLQS | GVPSRFSGSGSG---TEFLTISSLQPEDFATYYC | LQHNS-------------YPFT | FGGGT KVEIK |
| iPS:392_774 | 21-225_21F3 | VK1/A30/JK4 | DIQMTQSPSSLSA SVGDRVTITC | RAS--QGIR-----NDLG | WYQQKPGK APKRLIY | A-------ASSLQS | GVPSRFSGSGSG---TEFLTISSLQPEDFATYYC | LQHSS-------------YPLT | FGGGT KVEIK |
| iPS:392_780 | 21-225_22B7 | VK1/A30/JK4 | DIQMTQSPSSLSA SVGDRVTITC | RAS--QCIR-----NDLG | WYQQKQGK APKRLIY | A-------ASSLQS | GVPSRFSGSGSG---TEFLTISSLQPEDFATYYC | LQHNT-------------YPLT | FGGGT KVEIT |
| iPS:392_788 | 21-225_20C8 | VK1/A30/JK4 | DIQMTQSPSSLSA SVGDRVTITC | RAS--QGIR-----NDLG | WYQQKPGK APKRLIN | T-------ASSLQS | GVPSRFSGSGSG---TEFLTISSLQPEDFATYYC | LQDNS-------------YPFT | FGGGT KVEIT |
| iPS:392_794 | 21-225_21H3 | VK1/A30/JK4 | DIQMTQSPSSLSA SVGDRVTITC | RAS--QGIR-----NDLG | WYQQKPGK APKRLIY | A-------ASSVQT | TDFSRFSGSGSG---TEFLTISSLQAEDLAIYYC | LQHNS-------------YPLT | FGGGT KVEIK |

FIGURE 51 (Continued)

| | | | | | | | | | |
|---|---|---|---|---|---|---|---|---|---|
| iPS:392_800 | 21-225_22D12 | VK1|A30/JK4 | DIQMTQSFSSLSA SVGDRVTITC | RAS--QGIR- ----NDLG | WYQQKPGK APKRLIY | A- ASSLQS | GVPSRFSGSGSG--- TEFTLTISSLQPEDFATYYC | LQHST--- | ----YPLT FGGGT KVEIK |
| iPS:392_810 | 21-225_20H12 | VK1|A30/JK4 | DIQMTQSFSSLSA SVGDRVTITC | RAS--QGIR- ----NDLG | WYQQKPGK APKRLIY | A- ASSLQS | GVPSRFSGSGSG--- TEFTLTISSLQPEDFATYYC | LQHNS--- | ----YPLT FGGGT KVEIK |
| iPS:392_820 | 21-225_23D1 | VK1|A30/JK4 | DIQMTQSFSSLSA SVGDRVTITC | RAS--QGIR- ----NDLG | WYQQKPGK APKRLIY | A- ASSVQS | GVPSRFSGSGSG--- TEFTLTVSSLQPEDFVIYYC | LQHSS--- | ----YPLT FGGGT KVEIK |
| iPS:392_822 | 21-225_23C8 | VK1|A30/JK4 | DIQMTQSFSSRSA SVGDRVTITC | RAS--QDIK- ----NDLG | WYQQKPGK APKRLIN | G- AFSLQS | GVPSRFSGSGSG--- TEFTLTISSLQPEDFVIYYC | LQHSN--- | ----YPLT FGGGT KVEIK |
| iPS:392_824 | 21-225_24E5 | VK1|A30/JK4 | DIQMTQSFSSLSA SVGDRVTITC | RAS--QGIR- ----NDLG | WYQQKPGK APKRLIY | A- ASSLQS | GVPSRFSGSGSG--- TEFTLTISSLQPEDFATYYC | LQHST--- | ----YPLT FGGGT KVEIK |
| iPS:392_834 | 21-225_22C1 | VK1|A30/JK4 | DIQMTQSFSSLSA SVGDRVTITC | RTS--QGIR- ----NDLG | WYQQKPGK APKRLIY | A- ASSLQS | GVPSRFSGSGSG--- TEFTLTISSLQPEDFATYYC | LQHNS--- | ----YPLT FGGGT KVEIK |
| iPS:392_838 | 21-225_22G8 | VK1|A30/JK4 | DIQMTQSPSSLFA SVGDRVTITC | RTS--QGIR- ----NDLG | WYQQKPGK APKRLIY | A- TSSLQS | GVPSKFSGSGSG--- TEFTLTISSLQPEDFATYYC | LQHNS--- | ----YPLT FGGGT KVEIK |
| iPS:392_850 | 21-225_20H10 | VK1|A30/JK4 | GIQMTQSFSSLSA SVGDRVTITC | RAS--QGIK- ----NNLG | WYQQKPGK GPKCLIY | A- ASSLQS | GVPSRFSGSGSG--- TEFTLTISSLQPEDFATYYC | LQHNR--- | ----YPLT FGGGT KVEIK |
| iPS:392_854 | 21-225_21E5 | VK1|A30/JK4 | DIQMTQSPSSLSA SVGDRVTITC | RAS--QGIR- ----NDLG | WYQQKPGK APKRLIY | A- ASSVQS | GVPSRFSGSGSG--- TEFTLTISSLQPEDFALYYC | LQHST--- | ----YPLT FGGGT KVEIK |
| iPS:392_858 | 21-225_22H4 | VK1|A30/JK4 | DIQMTQSPSSLSA SVGDRVTITC | RAS--QGIR- ----NDLD | WYQQKPGK APKRLIY | A- ASSLQS | GVPSRFSGSGSG--- TEFTLTISSLQPEDFATYYC | LQHNS--- | ----YPLT FGGGT KVEIK |
| iPS:392_866 | 21-225_23H11 | VK1|A30/JK4 | DIQMTQSPSSLSA SVGDRVTITC | RAS--QGIR- ----NDLG | WYQQKPGK APKRLIY | A- ASSLQS | GVPSRFSGSGSG--- TEFTLTISSLQPEDFATYYC | LQHST--- | ----YPLT FGGGT KVEIK |
| iPS:392_870 | 21-225_20G9 | VK1|A30/JK4 | DIQMTQSPSSLSA SVGDRVTITC | RAS--QGVR- ----NDLG | WYQQKPGK APQRLIY | A- ASSLQS | GVPSRFNGSGSG--- TEFTLTISSLQPEDFATYYC | LQHSS--- | ----YPLT FGGGT KVEIK |
| iPS:392_880 | 21-225_22F9 | VK1|A30/JK4 | DIQMTQSPSSLSA SVGDRVTITC | RAS--QGIR- ----NDLG | WYQQKPGK AHKRIIY | A- ASSLQS | GVPSRFSGSGSG--- TEFTLTISSMQPDDFSNYIC | LQHNS--- | ----YPLT FGGGT KVEIK |
| iPS:392_882 | 21-225_23A3 | VK1|A30/JK4 | DIQMTQSPSSLSA SVGDRVTITC | RAS--QDIR- ----NDLG | WYQQKPGK APKRLIY | A- ASSLQS | GVPSRFSGSGSG--- TEFTLTISSLQPEDFATYYC | LQHAS--- | ----YPLT FGGGT KVEIK |
| iPS:392_896 | 21-225_21G7 | VK1|A30/JK4 | DIQMTQSPSSLSA SVGDRFIISF | RAS--QDIR- ----DDLG | WYQQKPGK APRRLIY | A- AFSLQS | GVPSRFSGSGSG--- TEFTLTISSLQPEDFATYYC | LQTS--- | ----YPPT FGGGT KVEIK |
| iPS:392_900 | 21-225_22F2 | VK1|A30/JK4 | DIQMTQSPSSLSA SVGDRVTITC | RAS--QDIR- ----SDLG | WYQQKPGK APKRLIY | A- ASSLQS | GVPSRFSGSGSG--- TEFTLTISSLQPEDFATYYC | LQHII--- | ----YPPT FGGGT KVEIK |
| iPS:392_904 | 21-225_22G9 | VK1|A30/JK4 | DIQMTQSPSSLSA SVGDEVTITC | RAS--QDIR- ----NDLG | WYQQKSGK APRKLIY | A- ASSLQS | GVPSRFSGSGSG--- TEFTLTISSLQPEDFATYYC | LQHTI--- | ----YPLT FGGGT KVEIK |
| iPS:392_942 | 21-225_30E9 | VK1|A30/JK4 | DIQMTQSPSSLSA SVGDRVTITC | RAS--QDIR- ----NDLG | WYQQKPGK TPKRLIY | G- AFSLQS | GVPSRFSVGSGG--- TEFTLTISSLQPEDFATYYC | LQHTS--- | ----YPPT FGGGT KVEIK |
| iPS:392_944 | 21-225_31H5 | VK1|A30/JK4 | DIQMTQSPSSLSA SVGDRVTITC | RAS--QDIR- ----NDLG | WYQQKPGK APKRLIY | A- VSSLQS | GVPSRFSGSGSG--- TEFTLTISSLQPEDFATYYC | LQHNS--- | ----YPLT FGGGT KVEIK |
| iPS:392_964 | 21-225_31A8 | VK1|A30/JK4 | DIQMTQSPSSLSA SVGDRVTITC | RAS--QDIR- ----NDLG | WYQQKPGK APKRLIY | A- ASSLQS | GVPSRFSGSGSG--- TEFTLTISSLQPEDFATYYC | LQHTI--- | ----YPLT FGGGT KVEIK |
| iPS:392_980 | 21-225_29H6 | VK1|A30/JK4 | DIQMTQSPSSLSA SVGDRVTITC | RAS--QDIR- ----NDLG | WYQQKSGK TPKRLIY | A- ASSLQS | GVPSRFSGSGSG--- TEFTLTISSLQPEDFATYYC | LQHTS--- | ----YPLT FGGGT KVEIK |
| iPS:392_982 | 21-225_30D1 | VK1|A30/JK4 | DIQMTQSPSSLSA SVGDRVTITC | RAS--QDIR- ----SDLG | WYQQKPGK APERLIY | A- ASSLQS | GVPSRFSGSGSG--- TEFTLTISSLQPEDFATYYC | LQHTI--- | ----YPPT FGGGT KVEIK |
| iPS:392_986 | 21-225_31B8 | VK1|A30/JK4 | DIQMTQSPSSLSA SVGDRVTITC | RAS--QDIR- ----SDLG | WYQQKPGK APKRLIY | G- ASSLQS | GVPSRFSGSGSG--- TEFTLTISSLQPEDFTTYYC | LQHII--- | ----YPPT FGGGT KVEIK |

FIGURE 51 (Continued)

| | | | | | | | | | |
|---|---|---|---|---|---|---|---|---|---|
| iPS:392988 | 21-225_25E6 | VK1A30/JK4 | DIQMTQSPSSLSA SVGDRVTIITC | RAS--QGIR------NDLG | WYQRKPGK APKRLIY | A------ASSLQS | GVPSRFSGSGSG---TEFTLTISSLQPEDFATYYC | LQHNS-------YPLT | FGGGT KVEIK |
| iPS:392990 | 21-225_25H10 | VK1A30/JK4 | DIQMTQSPSSLSA SVGDRVTIITC | RAS--RGIR------NDLG | WYQQKPGK APKRLIY | A------AFSLQS | GVPSRFSGSGSG---TEFTLTISSLQPEDFATYYC | LQHNS-------YPLT | FGGGT KVEIK |
| iPS:393004 | 21-225_30G11 | VK1A30/JK4 | DIQMTQSPSSLSA SVGDRVTIITC | RAS--QDIR------SDLG | WYQQKPGK APKRLIY | A------ASSLQS | GVPSRFSGSGSG---TEFTLTISSLQPEDFATYYC | LQHTI-------YPPT | FGGGT KVEIK |
| iPS:393018 | 21-225_29B8 | VK1A30/JK4 | DIQMTQSPSSLSA SVGDRVTIITC | RAS--QGIR------NDLG | WYQQKPGK APKRLIY | A------ASSLQS | GVPSRFSGSGSG---TEFTLTISSLQPEDFATYYC | LQHNS-------YPLT | FGGGT KVEIK |
| iPS:393030 | 21-225_25H11 | VK1A30/JK4 | DIQMTQSPSSLSA SVGDRVTIITC | RAS--QGIR------TDLG | WYQQKPGK APKRLIY | A------ASSLQS | GVPSRFSGSGSG---TEFTLTISSLQPEDFATYYC | LQHNS-------YPLT | FGGGT KVEIK |
| iPS:393034 | 21-225_27F2 | VK1A30/JK4 | DIQMTQSPSSLSA SVGDRVTIITC | RAS--QGIR------NDLG | WYQQKPGK APKRLIY | V------ASSLQS | GVPSRFSGSGSG---TEFTLTISSLQPEDFATYYC | LQHNS-------YPLT | FGGGT KVEIK |
| iPS:393040 | 21-225_30E3 | VK1A30/JK4 | DIQMTQSPSSLSA SVGDRVTIITC | RAS--QGIR------DDLG | WYQQKPGK AFRRLIY | A------AFSLQS | GVPSRFSGSGSG---TEFTLTISSLQPEDFASYYC | LQHTS-------YPPT | FGGGT KVEIK |
| iPS:393048 | 21-225_27C3 | VK1A30/JK4 | DIQMTQSPSSLSA SVGDRVTIITC | RAS--QGIR------NDLG | WYQQKPGK APKRLIY | A------ASSLQS | GVPSRFSGSGSG---TEFTLTISSLQPEDFATYYC | LQHNR-------YPLT | FGGGT KVEIK |
| iPS:393054 | 21-225_29G8 | VK1A30/JK4 | DIQMTQSPSSLSA SVGDRVTIITC | RAS--QDIR------NDLG | WYQLKPGK APKRLIY | A------ASSLQS | GVPSRFSGSGSG---TEFTLTISSLQPEDFATYNC | LQHNS-------YPLT | FGGGT KVEIK |
| iPS:393056 | 21-225_30F3 | VK1A30/JK4 | DIQMTQSPSSLSA SVGDRVTIITC | RAS--QGIR------NDLG | WYQQKPGK APKRLIY | T------ASSLQS | GVPSRFTGSGSG---TDFTLTISSLQPEDFASYYC | LQHTS-------YPFT | FGGGT KVEIK |
| iPS:393058 | 21-225_31H3 | VK1A30/JK4 | DIQMTQSPSSLSA SVGDRVTIITC | RAS--QDIR------DDLG | WYQQKPGK APKRLIY | A------AFSLQS | GVPSRFSGSGSG---TEFTLTISSLQPEDFATYYC | LQHTI-------YPPT | FGGGT KVEIK |
| iPS:393060 | 21-225_32G12 | VK1A30/JK4 | DIQMTQSPSSLSA SVGDRVTIITC | RTS--QGIR------SDLG | WYQQKPGK APKRLIY | A------ASSLQS | GVPSRFSGSGSG---TEFTLTISSLQPEDFATYYC | LQHTI-------YPLT | FGGGT KVEVK |
| iPS:393068 | 21-225_34G9 | VK1A30/JK4 | DIQMTQSPSSLSA SVGDRVTIITC | RAS--QDIR------SDLG | WYQQKPGK APKRLIY | A------ASSLQS | GVPSRFSGSGSG---TEFTLTISSLQPEAFAIYYC | LQHTI-------YPPT | FGGGT KVNIK |
| iPS:393072 | 21-225_36C5 | VK1A30/JK4 | DIQMTQSPSSLSA SVGDRVTIITC | RAS--QGIR------NDLG | WFQQKPGK APKRLIY | T------ASSLQS | GVPSRFTGSGSG---TEFTLTISSVQPEDFATYYC | LHHPI-------YPPT | FGGGT KVEIK |
| iPS:393074 | 21-225_33B1 | VK1A30/JK4 | DIQMTQSPSSLSA SVGDRVTIITC | RTS--QGIR------NDLG | WYQQKPGK APKRLIY | A------ASSLQS | GVPSRFSGSGSG---TEFTLTISSLQPEDFATYYC | LQHNS-------YPLT | FGGGT KVEVK |
| iPS:393076 | 21-225_33A4 | VK1A30/JK4 | DIQMTQSPSSLSA SVGDRVTIITC | RAS--QDIR------NDVG | WYQQKPGK AFERLIY | A------ASSLQR | GVPSRFSGSGSG---TEFTLTISSLQPEDFARYYC | LQHYS-------YPPT | FGGGT KVEIK |
| iPS:393096 | 21-225_34D11 | VK1A30/JK4 | DIQMTQSPSSLSA SVGDRVTIITC | RAS--QDIR------SDLG | WYQQKPGK APKRLIY | A------ASSLQS | GVPSRFSGSGSG---TEFTLTVISLQPEDFATYYC | LQHTI-------YPPT | FGGGT KVEIK |
| iPS:393102 | 21-225_33F1 | VK1A30/JK4 | DIQMTQSPSSLSA SVGDRITIITC | RAS--QDIR------SDLG | WYQQKPGK APERLIY | A------ASSLQS | GVPSRFSGSGSG---TEFTLTISSLQPEDFATYYC | LQHTI-------YPPT | FGGGT KVEIK |
| iPS:393104 | 21-225_33A7 | VK1A30/JK4 | DIQMTQSPSSLSA SVGDRVTIITC | RAS--QDIR------SDLG | WYQQKPGK APKRLIY | A------ASSLQS | GVPSRFSGSGSG---TEFTLTISSLQPEDFAAYYC | LQHTI-------YPPT | FGGGT KVEIK |
| iPS:393106 | 21-225_34A6 | VK1A30/JK4 | DIQMTQSPSSLSA SVGDRVTIITC | RAS--QRLIF | WYQQKPGK APKRLIF | A------ASSLQS | GVPSRFSGSGSG---TEFTLTISSLQPEDFATYYC | LQHNS-------YPPT | FGGGT KVEIK |
| iPS:393110 | 21-225_35B7 | VK1A30/JK4 | DIQMTQSPSSLSA SVGDRVTIITC | RAS--QDIR------SDLG | WYQQKPGK APERLIY | V------TSSLQS | GVPSRFSGSGSG---TEFTLTISSLQPEDFATYYC | LQHTI-------YPPT | FGGGT KVEIK |
| iPS:393118 | 21-225_34H11 | VK1A30/JK4 | DIQMTQSPSSLSA SVGDRVTIITC | RAS--QDIR------NDLG | WYQQKPGK APKRLIY | A------ASSLQS | GVPSRFSGSGSG---TEFTLTISSLQPEDFATYYC | LQHNS-------YPPT | FGGGT KVEIK |
| iPS:393124 | 21-225_33G7 | VK1A30/JK4 | DIQMTQSPSSLSA SVGDRVTIITC | RAS--QGIR------NDLG | WYQQKPGK APKRLIY | A------ASSLQS | GVPSRFSGSGSG---TEFTLTISSLQPEDFATYYC | LQHYS-------YPPT | FGGGT KVEIK |

FIGURE 51 (Continued)

| ID | Clone | V/J | Seq1 | Seq2 | Seq3 | Seq4 | Seq5 | Seq6 | Seq7 | Seq8 | Seq9 |
|---|---|---|---|---|---|---|---|---|---|---|---|
| iPS.393_126 | 21-225_35D1 | VK1|A30/JK4 | DIQMTQSPSSLSA SVGDRVTIIC | RAS--QDIR ------SDLG | WYQQKPGK APKRLIY | A------- ASSLQS | GVPSRFSGSGSG--- TEFTLTISSLQPEDFATYYC | LQHTI---------- LQHTV---------- | YPPT FGGGT KVEIK |
| iPS.393_128 | 21-225_35F11 | VK1|A30/JK4 | DIQMTQSPSSLSA SVGDRVTIIC | RAS--QDIR ------SDLG | WYQQKPGK APKRLIY | A------- ASSLQS | GVPSRFSGSGSG--- TEFTLTISSLQPEDFATYYC | LQHTI---------- | YPPT FGGGT KVEIK |
| iPS.393_146 | 21-225_34G8 | VK1|A30/JK4 | DIQMTQSPSSLSA SVGDRVTIIC | RAS--QDIR ------SDLG | WYQQKPGK APKRLIY | A------- ASSLQS | GVPSRFSGSGSG--- TEFTLTISSLQPEDFATYYC | LQHTI---------- | YPPT FGGGI KVEIT |
| iPS.393_150 | 21-225_36A5 | VK1|A30/JK4 | DIQMTQSPSSLSA SVGDRVTIIC | RTS--QDIR ------SDLG | WYQQKPGK APKRLIF | A------- ASSLQS | GVPSRFSGSGSG--- TEFTLTISSLQPEDFATYYC | LHHNS---------- | YPPK FGGGI KVEIT |
| iPS.393_804 | 21-225_5H7 | VK1|A30/JK4 | DIQMTQSPSSLSA SVGDRVTIIC | RAS--QGIR ------NDLG | WYQQKPGK APKRLIY | V------- TSSLQG | GVPSRFSGSGSG--- TEFTLTISSLQPEDFATYYC | LQHNS---------- | YPLT FGGGT KVEIK |
| iPS.393_806 | 21-225_6A6 | VK1|A30/JK4 | DIQMTQSPSSLSA SVGDRVTIIC | RAS--QGIR ------NDLG | WYQQKPGK APKRLIY | A------- ASSLQS | GVPSRFSGSGSG--- TEFTLTISSLQPEDFATYYC | LQHSS---------- | YPLT FGGGT KVEIK |
| iPS.393_808 | 21-225_1A2 | VK1|A30/JK4 | DIQMTQSPSSLSA SVGDRVTIIC | RAS--QGIR ------NDLG | WYQQKPGK APKRLIY | A------- ASSLQS | GVPSRFSGSGSG--- TEFTLTISSLQPEDFATYYC | LQHNS---------- | HPLI FGGGT KVEIK |
| iPS.393_814 | 21-225_7F4 | VK1|A30/JK4 | DIQMTQSPSSLSA SVGDRVTIIC | RTS--QGIR ------NDLG | WYQQKPGK APKRLIY | A------- ASNLQS | GVPSRFSGSGSG--- TEFTLTISSLQPEDFATYYC | LQHSA---------- | YPLT FGGGT KVEIK |
| iPS.393_816 | 21-225_6D4 | VK1|A30/JK4 | DIQMTQSPSSLSA SVGDRVTIIC | RAS--QAIR ------NDLG | WYQQKPGK APKRLIY | A------- ASSLQS | GVPSRFSGSGSG--- TEFTLTISSLQPEDFATYYC | LQHSS---------- | YPLT FGGGT KVEIK |
| iPS.393_818 | 21-225_6G12 | VK1|A30/JK4 | DIQMTQSPSSLSA SVGDRVTIIC | RAS--QGIR ------NDLG | WYQQKPGK APKRLIY | A------- ASTLQS | GVPSRFSGSGSG--- TEFTLTISSLQPEDFATYYC | LQHNS---------- | YPLT FGGGT KVEIK |
| iPS.393_820 | 21-225_8H7 | VK1|A30/JK4 | DIQMTQSPSSLSA SVGDRVTIIC | RAS--QGIR ------NDLG | WYQQKPGK APKRLIY | A------- ASSLQS | GVPSRFSGSGSG--- TEFTLTISSLQPEDFATYYC | LQHNS---------- | YPFT FGGGT KVEIK |
| iPS.393_826 | 21-225_10G5 | VK1|A30/JK4 | DIQMTQSPSSLSA SVGDRVTIIC | RAS--QGIR ------NDLG | WYQQKPGK APKRLIY | A------- ASSLQS | GVPSRFSGSGSG--- TEFTLTISSLQPEDFATYYC | LQHNS---------- | YPLT FGGGT KVEIK |
| iPS.393_828 | 21-225_10H12 | VK1|A30/JK4 | DIQMTQSPSSLSA SVGDRVTIIC | RAS--QGIR ------NDLG | WYQQKPGK APKRLIY | G------- ASSLQS | GVPSRFSGSGSG--- TEFTLTISSLQPEDFATYYC | LQHNS---------- | YPLT FGGGT KVEIK |
| iPS.393_830 | 21-225_12A1 | VK1|A30/JK4 | DIQMTQSPSSLSA SVGDRVTIIC | RAS--QGIR ------NDLG | WYQQKPGK APKRLIY | A------- ASSLQS | GVPSRFSGSGSG--- TEFTLTISSLQPEDFATYYC | LQHNS---------- | YPLT FGGGT KVEIK |
| iPS.393_832 | 21-225_14B2 | VK1|A30/JK4 | DIQMTQSPSSLSA SVGDRVTIIC | RAS--QGIR ------NDLG | WYQQKPGK APKRLIY | V------- TSSLQG | GVPSRFSGSGSG--- TEFTLTISSLQPEDFATYYC | LQHNS---------- | YPLT FGGGT KVEIK |
| iPS.393_854 | 21-225_7H11 | VK1|A30/JK4 | DIQMTQSPSSASA SVGDRVTIIC | LAS--QGIR ------NDLG | WYQQKPGK APKRIIY | V------- ACSFQS | GVPSRFSGSGSYG-- TEFTLTISIMQPEDFATYYC | LQHNL---------- | YPLT FGGGT KVEIK |
| iPS.393_856 | 21-225_14C2 | VK1|A30/JK4 | DIQMTQSPSSLFA CVGDRVTIIC | RAS--QGIR ------NDLD | WYQQKPGK APKRLIY | A------- ASSLQS | GVPSRFSGSGSG--- TEFTLTISSVQREDFATYYC | VQHNS---------- | YPLT FGGGI KVEIR |
| iPS.393_866 | 21-225_14E3 | VK1|A30/JK4 | DIQMTQSPSSLSA SVGDRVTIIC | RAS--QGIR ------NDLG | WYQQKPGK APKRLIY | S------- ASSLQS | GVPSRFIGSGCG--- TEFTLTISSLQREDFAAYIS | VQHYS---------- | YPFT FGGGT KVEIK |
| iPS.393_872 | 21-225_2A11 | VK1|A30/JK4 | DIQMTQSPSSLSP SVGDRVTIIC | RAS--QGIR ------NDLG | WYQQKPGK APQRLIS | A------- ASSLQS | GVPSRFSGSGSG--- IDFTLTISSLQPEDFATYYC | LQHNS---------- | YPLT KMEIK FGGGT |
| iPS.393_874 | 21-225_4C8 | VK1|A30/JK4 | DIQMIQSPSFLFA CVGDRVTIIC | RAS--QGIR ------NDLG | WYQQKPGK APKRLIY | A------- ASSLQS | GVPSRFSGSGSG--- TEFTLTISSVQPEDFATYYC | LQHNS---------- | YPLT FGGGT KVEIK |
| iPS.393_880 | 21-225_15A1 | VK1|A30/JK4 | DIQMTQSPSSLSA SVGDRVTIIC | RAS--QGIR ------NDLG | WYQQKPGK APKRLIY | A------- ASSLQS | GVPSRFSGSGSG--- TEFTLTVSSLQPEDFASYYC | LHHNS---------- | YPVK FGGGI KVEIT |
| iPS.393_882 | 21-225_15E3 | VK1|A30/JK4 | DIQMTQSPSSPSA SVGDRVTIIC | RAS--QGIR ------NDLG | WYQQKSGK APKRLIY | A------- ASSSQS | GVPSRFSGSRSG--- TEFTLPEDLAAYYC | LQHHS---------- | YPLI EVEIY FGGGT |
| iPS.393_884 | 21-225_16F4 | VK1|A30/JK4 | DIQMTQSPSFPSA SVGDRVTIIC | ------NDLG | APKRLIY | V------- ASSLQS | GVPSRFSGSGSG--- TEFTITISSVQPEDFATYYC | IQHNS---------- | YPFT FGGGT KVEIK |

FIGURE 51 (Continued)

| ID | V/J | Seq1 | Seq2 | Seq3 | Seq4 | Seq5 | Seq6 | Seq7 | Seq8 | Seq9 |
|---|---|---|---|---|---|---|---|---|---|---|
| iPS:393886 | 21-225_2G9 | VK1|A30/JK4 | DIQMTQSPSSLFA SVGDRVTITC | RAS--QGIR----NDLG | WYQQKPGK APQRLIY | A------ASSLQS | GVPSRFSGSGFG---- TEFTLTISSLQLEDFATYYC | LQHES------- ---------YPLT | FGGGT KVEIK |
| iPS:393922 | 21-225_2B2 | VK1|A30/JK4 | DIQMTQSPSSLSA SVGDRVTITC | RAS--QGIR----NDLG | WYQQKPGK APKRLIY | A------ASSLQS | GVPSRFSGSGSG---- TEFTLTISSLQPEDFATYYC | LQHNS------- ---------YPLT | FGGGT KVEIK |
| iPS:393928 | 21-225_4E10 | VK1|A30/JK4 | DIQMTQSPSSLFA SVGDRVTITC | RAS--QGIR----NDLG | WYQQKPGK APKRLIY | A------ASSLQS | GVPSRFSGSGFG---- TEFTLTISSLQEDFATYYC | LQHDN------- ---------YPLT | FGGGT KVEIK |
| iPS:393934 | 21-225_13E6 | VK1|A30/JK4 | DIQVTQSPSSLSA SVGDRVTIIS | RAS--QGIR----NDLG | WYQQKPGK APKRLIY | A------ASSLQS | GVPSRFSGSGSG---- TEFTLTISSLQPEDFATYYC | VQHNS------- ---------YPLT | FGGGT KVAIK |
| iPS:393958 | 21-225_5H2 | VK1|A30/JK4 | DIQMTQSPSSLSA SVTDRVTITC | RAS--QGIR----NDLG | WYQQKPGK APKRLIY | A------ASSLQS | GVPSRFSGSGSG---- TEFTLTISSLQPEDFATYYC | LQHNS------- ---------YPLT | FGGGT KVEIK |
| iPS:393962 | 21-225_7H7 | VK1|A30/JK4 | DIQMTQSPSSLSA SVGDRVTITC | RAS--QGIR----NDLG | WYQQKPGK APQRLIY | A------ASSLQS | GVTSRFSGSGSG---- TEFTLTISSLQPEDFATYYC | LQHSS------- ---------YPFT | FVGGT KVEIK |
| iPS:393974 | 21-225_7C4 | VK1|A30/JK4 | DIQMTQSPSSLFA SVGDRVTITC | RAS--QGIR----NDLG | WYQQKPGK AHKRLIY | A------ASSLQS | GVPSRFSGSGSG---- TEFTLTISSLQPEDFATYYC | LQHNS------- ---------YPLT | FGGGT KVEIK |
| iPS:393976 | 21-225_7E9 | VK1|A30/JK4 | DIQMTQSPSSLFA SVGDRVTITC | RAS--QGIR----NDLG | WYEQKPGK APKRLIY | T------ASSLQS | GVPSRFSGSGSG---- TEFTLTISSLQPEDFATYYC | LQHNS------- ---------YPLT | FGGGT KVEIK |
| iPS:393980 | 21-225_6C12 | VK1|A30/JK4 | DIQMTQSPSSLSA SVGDRGTITC | RAS--QGIR----SNLG | WYQQKPGK APKRLIY | A------ASSIES | GVPSRFSGSGSG---- TEFTLTISSLQPEDFATYFC | LQHNS------- ---------YPFT | FGGGT KVEIK |
| iPS:393984 | 21-225_4F12 | VK1|A30/JK4 | DIQMTQSPSSLSA SVGDRVTITC | RAS--QGIR----NDLG | WYQQKPGK APKRLIY | A------ASSLQS | TIFTLTISSLQPEDFATYYC TIFTLTISSLQPEDFATYYC | LQHSN------- ---------YALT | FGGGT KVEIK |
| iPS:393990 | 21-225_11G7 | VK1|A30/JK4 | DIQMTQSPSSLSA SVGDRVTITC | RAS--QGIR----NDLG | WYQQKPGK APKRLIY | A------ASSLQS | GVPSRFSGSGSG---- TEFTLTISSLQPEDFATYYC | LQHNS------- ---------YPLT | FGGGT MVEIR |
| iPS:393992 | 21-225_8C9 | VK1|A30/JK4 | DIQMTQSPSSLSA SIGDRVTITC | RAS--QAIR----NDLD | WYQQKPGK APKRLIY | A------ASSIES | GVPSRFSGSGSG---- TEFTLTISSLQPEDFATYFC | LQHNS------- ---------YPFT | FGGGT KVEIK |
| iPS:393994 | 21-225_15H10 | VK1|A30/JK4 | DIQMTQSPSSLSA SVGDRVTITC | RAS--QGIR----NDLG | WYQQKPGK APKRLIY | A------ASSLQS | GIPSRFSGSGFG---- TEFTLTISSLQPEDFATYYC | LQHSN------- ---------YPLT | FGGGT KVEIK |
| iPS:394002 | 21-225_15G7 | VK1|A30/JK4 | DIQMTQSPSSLSA SVGDRVTITC | RAS--QGIR----NDLG | WYQQKPGK APKRLIY | A------ASSLQS | GVPSRFSGSGSG---- TEFTLTISSLQPEDFATYYC | LQHNS------- ---------YPLT | FGGGT KVEIK |
| iPS:394008 | 21-225_15H8 | VK1|A30/JK4 | DIQMTQSPSSLSA SVGDRVTITC | RAS--QGIR----NDLG | WYQQKPGK APKRLIY | A------ASSLQS | GVPSRFSGSGSG---- TEFTLTISSLQPEDFATYYC | LQHNS------- ---------YPLT | FGGGT KVEIR |
| iPS:394020 | 21-225_15H10 | VK1|A30/JK4 | DIQMTQSPSSLSA SVGDRVTITC | RAS--QGIR----NDLG | WYQQKPGK APKRLIF | A------ASSLQS | GVPSRFSGSGSG---- TEFTLTISSLQPEDFASYYC | LQHNS------- ---------YPLT | FGGGT NVEIN |
| iPS:394024 | 21-225_16B7 | VK1|A30/JK4 | DIQMTQSPSSLSA SVGDRVTITC | RAS--QGIR----NDLG | WYQQKPGK APKRLIY | A------ASSLQS | GVPSRFSGSGSG---- TEFTLTISSLQPEDFATYYC | LQHNS------- ---------YPLT | FGGGT NVEFN |
| iPS:394037 | 21-225_4S4 | VK1|A30/JK4 | DIQMTQSPSSLSA SVGDRVTITC | RAS--QGIR----NDLG | WYQQKPGK APKRLIY | A------ASSVQT | GVPSRFSGSGSG---- TEFTLTISSLQPEDFATYYC | LQHNS------- ---------YFLT | NVEFN KVEIK |
| iPS:394045 | 21-225_4H4 | VK1|A30/JK4 | DIQMTQSPSSLSA SVGDRVTITC | RAS--QGIR----NDLG | WYQQKPGK APKRLIY | A------ASSVQS | GVPSRFSGSGSG---- TEFTLTISSLQPEDFATYYC | LQHNS------- ---------YPLT | FGGGT KVEIR |
| iPS:394049 | 21-225_13H5 | VK1|A30/JK4 | DIQMTQSPSSLSA SVGDRVTITC | RAS--QGIR----NDLG | WYQQKPGK APKRLIY | A------ASSLQT | GVPSRFSGSGSG---- TEFTLTISSLQPEDFAIYYC | LQHNS------- ---------YPLT | FGGGT KVEIK |
| iPS:394053 | 21-225_11F10 | VK1|A30/JK4 | DIQMTQSPSSLSA SVGDRVTITC | RAS--QGIR----NDLG | WYQQKPGK APKRLIY | A------ASSLQS | GVPSRFNGSGSG---- TEFTLTISSLQPEDFATYYC | LQHSS------- ---------YPLT | FGGGT KVEIK |
| iPS:394057 | 21-225_15H1 | VK1|A30/JK4 | DIQMTQSPSSLSA SVGDRVTITC | RAS--QGIR----NDLG | WYQQKPGK APKRLIY | T------ASSLQS | GVPSRFSGSGSG---- TEFTLTISSLQPEDFATYYC | LQHSS------- ---------YPLT | FGGGT KVEIK |
| iPS:394059 | 21-225_9E8 | VK1|A30/JK4 | DIQMTQSPSSLFA SVGDRVTITC | RAS--QGIR----NDLG | WYQQKPGK APKRLIY | A------ASSLQS | GVPSRFSGSGSG---- TEFTLTISSLQPEDFATYYC | LQHNS------- ---------YPLT | FGGGT KVEIK |
| iPS:394063 | 21-225_16A1 | VK1|A30/JK4 | DIQMTQSPSSLSA SVGDRVTITC | RAS--QGIR----NDLG | WYQQKPGK APKRLIY | A------ASSLQS | GVPSRFSGSGSG---- TEFTLTISSLQPEDFATYYC | LHHSN------- ---------YPLT | FGGGT KVEIE |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:394 073 | 21- 225_15C9 | VK1|A30/ JK4 | DIQMTQSPSSLSA SVGDRVTITC | RAS--QGIR-----NDLG | WYQQKPGK APKRLIY | A-------ASSLQS | GVPSRFSGSGSG---TEFTLTISSLQPEDFATYYC | LQHTS----------YPLT | FGGGT KVEIK |
| iPS:394 075 | 21- 225_8D12 | VK1|A30/ JK4 | DIQMTQSPSSLSA SVGDRVTITC | RAS--QGIR-----NDLG | WYQQKPGK APKRLIY | A-------ASSLQS | GVPSRFNGSGSG---TEFTLTISSLQPEDFATYYC | LQHSS----------YPLT | FGGGT KVEIK |
| iPS:394 079 | 21- 225_11F5 | VK1|A30/ JK4 | DIQMTQSPSSLSA SVGDRVTITC | RAS--QGIR-----NDLG | WYQQKPGK APKRLIY | A-------ASSVQS | GVPSRFSGSGSG---TEFTLTISSLQPEDFATYYC | LQHNS----------YPLT | FGGGT KVEIK |
| iPS:394 091 | 21- 225_13H3 | VK1|A30/ JK4 | DIQMTQSPSSLSA SVGDRVTITC | RAS--QGIR-----NDLG | WYQQKPGK APKRLIY | A-------ASSLQS | GVPSRFSGSGSG---TEFTLTISSLQPEDFATYYC | LQHNS----------YPLT | FGGGT KVEIK |
| iPS:398 528 | 21- 225_32G1 | VK1|A30/ JK4 | DIQMTQSPSSLSA SVGDRVTITC | RAS--QDMR-----SDLG | WYQQKPGK APKRLIY | A-------ASSLQS | GVPSRFSGSGSG---TEFTLTISSLQPEDFATYYC | LQHTI----------SPFT | FGGGT KVEIK |
| iPS:398 534 | 21- 225_33B8 | VK1|A30/ JK4 | DIQMTQSPSSLSA SVGDRVTITC | RAS--QGIR-----SDLG | WYQQKPGK APKRLIY | A-------ASSLQS | GVPSRFSGSGSG---TEFTLTISSLQPEDFATYFC | LQHTI----------YPFT | FGGGT KVEIK |
| iPS:398 540 | 21- 225_35A6 | VK1|A30/ JK4 | DIQMTQSPSSLSA SVGDRVTITC | RAS--QDIR-----SDLG | WYQQKPGK APKRLIY | A-------TSSLQS | GVPSRFSGSGSG---TEFTLTISSLQPEDFATYYC | LQHTI----------YPFT | FGGGT KVEIK |
| iPS:402 219 | 21- 225_1C12 | VK1|A30/ JK4 | DIQMTQSPSSLSA SVGDRVTITC | RAS--QGIR-----NDLG | WYQQKPGK APKRLIY | A-------ASSLQS | GVPSRFSGSGSG---TEFTLTISSLQPEDFATYYC | LQHNS----------YPLT | FGGGT KVAIK |
| iPS:403 868 | 21- 225_19D11 | VK1|A30/ JK4 | DIQMTQSPSSLSA SVGDRVTITC | RAS--QGIR-----NDLG | WYQQKPGK APKRLIY | A-------TSSLQS | GVPSRFSGSGSG---TEFTLTISSLQPEDFATYYC | LQYYS----------YPLT | FGGGT EVEIK |
| iPS:403 872 | 21- 225_8F11 | VK1|A30/ JK4 | DIQMTQSPSSLSA SVGDRVTITC | RAS--QGIR-----SDLG | WFQQKPGK APKRLIF | D-------ASSVQS | GVPSRFSGSGSG---TEFTLTISSLQPEDFATYYC | LQHYT----------YPLT | FGGGT KVEIK |
| | Germline VK2|A18|JK5 | | | | | | | | |
| iPS:468 816 | 21- 225_52G8 | VK2|A18/ JK5 | DIVMTQTPLSLSV TPGQPASMSC | KSS---QSLLHSE-GKTYLY | WYLQKPGQ PPHLLIY | E-------VSKRLS | GVPDRFSGSGSG---TDFTLKISRMEAEDVGVYYC | MQSMQ----------LPII | FGQGT RLEIK |
| iPS:434 021 | 21- 225_49C1 | VK2|A18/ JK5 | DIVMTQTPLSLSV TPGQPASISC | KSS---QSLLHSE-GKTYLY | WYLQRPGQ APQFLIF | E-------VSNRFS | GVPDRFSGSGSG---TDFTLKISRVEAEDVGVYYC | MQSIQ----------YPIT | LGQGT RLEIK |
| iPS:434 025 | 21- 225_49G3 | VK2|A18/ JK5 | DIVMTQTPLSLSV TPGQPASMSC | KSS---QSLVHSE-GKTYLY | WYLQKTGQ PPHLLIY | E-------VSKRLS | GVPDRFSGSGSG---TDFTLKISRMEAEDVGVYYC | MQSMQ----------LPIT | FGQGT RLEIK |
| iPS:434 031 | 21- 225_49E7 | VK2|A18/ JK5 | DIVMTQTPLSLSV TPGQPAFMSC | KSS---QIFLHSE-GKTYLY | WYLQKTGQ PPHLLIY | E-------VSKRLS | GVPDRFSGSGSG---TDFTLKISRMEAEDVGVYYC | MQSMQ----------LPII | FGQGT RLEIK |
| iPS:434 033 | 21- 225_49F9 | VK2|A18/ JK5 | DIVMTQTPLSLSV TPGQPASISC | KSM---QSLVHNE-GKTYLY | WYLQRPGQ PPQLLIF | E-------VSNRFS | GVPDRFSGSGSG---TDFTLKISRVEAEDVGVYYC | MQSIQ----------YPIT | FGQGT RLEIK |
| iPS:434 093 | 21- 225_52D10 | VK2|A18/ JK5 | DVVMTQTPLSLSV TPGQPASISC | KSS---QSLLHSE-GKTYLY | WYLQKPGQ PPQLLIF | D-------VSNRVS | GVPDRFSGRGSG---TDFTLKISRVEAEDVGVYYC | MQSMQ----------LPIT | FGQGT RLEIK |
| iPS:434 151 | 21- 225_55C2 | VK2|A18/ JK5 | DVVMTQIPLSLSV TPGQPASISC | KSS---QSLVHSE-GKTYLY | WYLQKPGQ PPQLLIF | E-------VSNRVS | GVPDRFSGRGSG---TDFTLKISRVEAEDVGVYYC | MQSIL----------YPIT | FGQGT RLEIK |
| iPS:434 161 | 21- 225_55F9 | VK2|A18/ JK5 | DIVMTQTPLSLSV TPGQPASISC | KSS---QSLLHSE-GKTYLY | WYLQKPGQ PPQLLIY | E-------VSNRFS | GVPDRFSGSGSG---TDFTLKISRVEAEDVGVYYC | IQSIQ----------LPIT | FGQGT RLEIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:435 329 | 21-225_147A8 | VK2|A18/ JK5 | DIVMTQTPLSLSV TPGQPASISC | KTS--- QSLLHSE- GKTYLY | WYLQKPGQ PPQLLIY | E------ VSNRFS | GVPDRFSGSGSG--- TDFTLKISRVEAEDVGYYC | MQSI---------QLIT | FGQGT RLEIK |
| iPS:392 924 | 21-225_32H2 | VK2|A18/ JK5 | DIVMTQTPLSLSV TPGQPASISC | RSS--- QSLLHSD- GRTYLY | WYLQKPGQ PPQLLIY | E------ LSNRFS | GVPDRFSGSGSG--- TDFTLKISRVEAEDVGIYSC | LQSIQ--------YPIT | FGQGT RLEIK |
| | Germline | | K_FR1 | K_CDR1 | K_FR2 | K_CDR2 | K_FR3 | K_CDR3 | K_FR4 |
| | VK2|A18/JK 1 | | DIVMTQTPLSLSV TPGQPASISC | KSS--- QSLLHSD- GRTYLY | WYLQKPGQ PPQLLIY | E------ VSNRFS | GVPDRFSGSGSG--- TDFTLKISRVEAEDVGVYYC | MQSIH-------LPWT | FGQGT KVEIK |
| iPS:468 822 | 21-225_147E1 0 | VK2|A18/ JK1 | AIVMTQTPLSLSV TPGQPASISC | KSS--- QRLLHGD- GKTYLY | WYLQKPGQ PPHLLIS | E------ VSNRFS | GVPDRFSGSGSG--- TDFTLKISRVEAEDVGVYYC | MQSIQ--------VPWT | FGQGT KVEIK |
| iPS:433 917 | 21-225_43E11 | VK2|A18/ JK1 | DIVMTQTPLSLSV TPGQPASISC | KSS--- QSLLHSD- GRTYLY | WYLQKPGQ PPQLLIY | E------ VSNRFS | GVPDRFSGSGSG--- TDFTLKISRVEAEDVGVYYC | MQSIQ--------LPWT | FGQGT KVEIK |
| iPS:433 965 | 21-225_46F2 | VK2|A18/ JK1 | DIVMTQTPLSLITV TPGQPASISC | KSS--- QSLLHGD- GRTYLY | WYLQKPGQ PPQVLIY | E------ VSNRFS | GVPDRFSGSGSG--- TDFTLKISRVEAEDVGVYYC | MQSIQ--------LPWT | FGQGT KVEIK |
| iPS:433 985 | 21-225_47C1 | VK2|A18/ JK1 | DIVMTQTPLSLSV TPGQPASISC | TSS--- QSLLHSE- GKTYLY | WYLQKPGQ PPQLLIY | E------ VSNRFS | GVPDRFSGSGSG--- TDFTLKISRVEAEDVGVPYC | MQSIQ--------LPWT | FGQGT KVEIK |
| iPS:433 991 | 21-225_47E7 | VK2|A18/ JK1 | DIVMTQTPLSLSV TPGQPASISC | KSS--- QSLLHSD- GRTYLY | WYLQKPGQ PPQLLIY | E------ VSHRFS | GVPDRFSGSGSG--- TDFALKISRVEAEDVGVYYC | MQSIQ--------LPWT | FGQGT KAEIK |
| iPS:434 345 | 21-225_64H9 | VK2|A18/ JK1 | EIVMTQTPLSLSV TPGQPASISC | KSS--- QSLLHGD- GKTYLF | WYLQKPGQ PPQLLIY | E------ VSNRLC | GVPDRFSGSGSG--- TDFSLKISRVEAEDVGVYYC | MQSIQ--------VPWT | FGQGT KVEIT |
| iPS:435 297 | 21-225_146B3 | VK2|A18/ JK1 | DIVMTQTPFLSLSV TPGQPASISC | KSS--- QSLLHGD- GKTYLY | WYLQKPGQ PPQLLIY | E------ VSHRFS | GVPDRFSGSGSG--- TDFTLKISRVEAEDVGVYYC | MQSIQ--------LPWT | FGQGT KVEIK |
| iPS:435 341 | 21-225_148B2 | VK2|A18/ JK1 | AIVMTQTPLSLSV TPGQPASISC | KSS--- QSLLHGD- GKTYFY | WYLQKPGQ PPQLLIY | E------ VSNRFS | GVPDRFSGSGSG--- TDFTLKISRVEAEDVGVYYC | MQSIQ--------IPWT | FGQGT KVEIK |
| iPS:435 357 | 21-225_148G1 0 | VK2|A18/ JK1 | DIVMTQSPLSLFV TPGQPASISC | KIS--- QSLLHGD- GKTYFY | WYLQKPGQ PPQLLIY | E------ VSHRFS | GVPDRFSGSGSG--- TDFTLKISRVEAEDVGVYYC | MQSIQ--------LPWT | FGQGT KVEIK |
| iPS:435 365 | 21-225_149F1 | VK2|A18/ JK1 | DIVMTQTPLSLSV TPGQPASISY | KSS--- QSLLHGD- GKTYLY | WYLQKPGQ PPQLLIY | E------ VSNRFS | GVPDRFSGSGSG--- TDFTLKISRVEAEDVGVYYC | MQSIQ--------IPWT | FGQGT KVEIK |
| iPS:435 413 | 21-225_150B1 1 | VK2|A18/ JK1 | DIVMTQTPLSLFV TPGQPASISC | KIS--- QSLVHGD- GKTYLY | WYLQKPGQ PPQLLIY | E------ VSNRFS | GVPDRFSGSGSG--- TDFTLKISRVEAEDVGVYYC | MQSIQ--------LPWT | FGQGT KVEIK |
| iPS:435 423 | 21-225_151G5 | VK2|A18/ JK1 | DIVMTQTPLSLSV TPGQPASISC | KSS--- QRLLHGD- GKTYLY | WYLQKPGQ PPQLLIY | E------ VSNRFS | GVPDRFSGSGSG--- TDFTLKISRVEAEDVGVYYC | MQSIQ--------VPWT | FGQGT KVEIK |

FIGURE 51 (Continued)

| | | | | | | | | |
|---|---|---|---|---|---|---|---|---|
| iPS:435 429 | 21- 225_151A1 0 | VK2jA18/ JK1 | DIVMTQTPLSLSV TPGQPASISC | KSS--- QSLLHGD- GKTYLY | WYLQKPGQ PPQLLIY | E------ VSHRFS | GVPDRFSGSGSG--- TDFTLKISRVEAEDVGVYYC | MQSIQ---------- ---------IPWT | FGQGT KVEIK |
| iPS:435 441 | 21- 225_152F6 | VK2jA18/ JK1 | DIVMTQTPLSLSV TPGQPASISC | KSS--- QSLRHGD- GKTYLT | WYLQRPGQ PPQLLIH | E------ ISKRFT | GVPDRFSGSGSG--- TDFTLNISRVEAEDVGFYYC | MQSIQ---------- ---------VPWT | FGQGT KVEIK |
| iPS:435 457 | 21- 225_152C1 | VK2jA18/ JK1 | DIVMTQAPLSLSV TPGQPASISC | KSS--- QSLLHGD- GKTYLY | WYLQKPGQ PPQVLIY | E------ VSNRFS | GVPDRFSGSGSG--- TDFTLNISRVEAEDFGFYYC | MQSIQ---------- ---------IPWT | FGQGT KVDIK |
| iPS:435 463 | 21- 225_153D2 | VK2jA18/ JK1 | DIVMTQTPLSLSV TPGQPASISC | KSS--- QSLRHGD- GKTYLI | WYLQKPGQ PPQVLIH | E------ VSKRFT | GVPDRFSGSGSG--- TDFTLKISRVEAEDVGFYYC | MQSIQ---------- ---------VPWT | FGQGT KVEIK |
| iPS:435 489 | 21- 225_155A5 | VK2jA18/ JK1 | DIVMTQTPLSLSV TPGQPASISC | KSS--- QSLLHGD- GKTYLY | WYLQRPGQ PPQLLIY | E------ VSNRFS | GVPDRFSGSGSG--- TDFTLKISRVEAEDVGFYYC | MQSIQ---------- ---------VPWT | FGQGT KVEIK |
| iPS:435 531 | 21- 225_157G8 | VK2jA18/ JK1 | DIVMTQTPLSLSV TPGQPASISC | KSS--- QSLLHGD- GKTYLY | WYLQKPGQ SPQLLIY | E------ ISKRFS | GVPDRFSGSGSG--- TDFTLKISRVEAEDVGVYYC | MQSIQ---------- ---------IPWT | FGQGT KVEIK |
| iPS:435 577 | 21- 225_160B1 | VK2jA18/ JK1 | DIVMTQTPLSLSV TPGQPASISC | KSS--- QSLLHGD- GKTYFY | WYLQKPGQ PPQVLIY | E------ VSKRFS | GVSERFSGSGSG--- TDFTLKISRVEAEDVGVYYC | MQSIQ---------- ---------LPWT | FGQGT KVEIK |
| iPS:435 601 | 21- 225_160G1 | VK2jA18/ JK1 | AIVMTQTPLSLSV TPGQPASISC | KSS--- QSLLHGD- GKTYLY | WYLQRPGQ PPHLLIY | E------ VSNRFS | GVPDRFSGSGSG--- TDFTLNISRVEAEDVGVYYC | MQSIQ---------- ---------LPWT | FVQGT KVEIT |
| iPS:435 629 | 21- 225_162H6 | VK2jA18/ JK1 | DIVMTQTPLSLSV TPGQPASISC | KST--- QSLLHGD- GKTYLY | WYLQKPGQ PPQLLIY | E------ VSNRFS | GVPDRFSGSGSG--- TDFTLKISRVEAEDVGVYYC | KQSIQ---------- ---------LPWT | FGQGT KVEIK |
| iPS:435 655 | 21- 225_167E2 | VK2jA18/ JK1 | DIVMTQTPLSLSV TPGQPASISC | KSS--- QSLLHGD- GKTYLY | WYLQKPGQ PPHLLIY | E------ VSKRFS | GVPDRFSGSGSG--- TDFTLKISRVEAEDVGLYHC | MQSIQ---------- ---------LPWT | FGQGT KVEIK |
| iPS:435 657 | 21- 225_167H1 | VK2jA18/ JK1 | DIVMTQTPLSLSV TPGQPASISC | KSS--- QSLLHGD- GKTYLY | WYLQKPGQ PPHLLIY | E------ VSKRFS | GVPDRFSGSGSG--- TDFTLKISRVEAEDVGLYHC | MQSIQ---------- ---------LPWT | FGQGT KVEIK |
| iPS:435 683 | 21- 225_170A1 | VK2jA18/ JK1 | DIVMTQTPLFLSV TPGQPASISC | KSS--- QSLLHGD- GKTYLY | WYLQRPGQ PPQVLIN | E------ VSNRFS | GVPDRFSGSGSG--- TDFTLNISRVEAEDVGVYYC | MQSIQ---------- ---------LPWT | FGQGT KVEIK |
| iPS:435 723 | 21- 225_172B7 | VK2jA18/ JK1 | DIVMTQTPLSLSV TPGQPASISC | KSS--- QSLLHGD- GKTYFY | WYLQKPGQ PPQLLF | E------ VSNRFS | GVPDRFSGGGSG--- TDFTLKISRVEAEDVGVYYC | MQSIQ---------- ---------FPWT | FGQGT RVDIK |
| iPS:435 731 | 21- 225_173A1 | VK2jA18/ JK1 | DIVMTQTPLSLSV TPGQPASISC | KSS--- QSLLHGD- GKTYLY | WYLQKPGQ PPQLLIY | E------ VSNRFS | GVPDRFSGSGSG--- TDFTLKISRVEAEDVGVFPC | MQSIQ---------- ---------VPWT | FGQGT RVEIK |
| iPS:435 755 | 21- 225_176H4 | VK2jA18/ JK1 | DIVMTQTPLSLSV TPGQPASISC | KSS--- QSLLHGD- GKTYLN | WYLQKPGQ PPQLLIY | E------ VSNRFS | GVPDRFSGSGSG--- TDFTLKISRVEAEDVGIYYC | MQSIQ---------- ---------LPWT | FGQGT RVEIK |
| iPS:435 771 | 21- 225_177B1 1 | VK2jA18/ JK1 | DIVMTQTPLSLSV TPGQPASISC | KSS--- QRLLHGD- GKTYLN | WYLQKPGQ PPQLLIY | E------ VSNRFS | GVPDRFSGSGSG--- TDFTLKISRVEAEDVGIYYC | MQSIQ---------- ---------LPWT | FGQGT KVEIK |

FIGURE 51 (Continued)

| | | | | | | | | |
|---|---|---|---|---|---|---|---|---|
| iPS:435781 | 21-225_178G10 | VK2/A18/JK1 | DIVMTQTPLSLSV TPGQPASISC | KSS--- QSLLHSD- GKTYLY | WYLQKPGQ PPQLLIY | E------ VSNRFS | GVPDRLSGGSG--- TDFTLKISRVEAEDVGIYYC | MQSIQ------ ------VPWT | FGQGT KVEIK |
| iPS:435789 | 21-225_180C4 | VK2/A18/JK1 | DIVMTQTPLSLSV TPGQPASISC | KSS--- QSLLHGD- GKTYLY | WYLQKPGQ PPQLLIY | A------ TSNRFP | GVSDRFSGSGSG--- TDFTLKISRVEAEDVGVYYC | MQSTQ------ ------VPWT | FGQGT KVEIK |
| iPS:435795 | 21-225_181C2 | VK2/A18/JK1 | EIVMTQTPLSLSV TPGQPASISC | KSS--- QSLLHGD- GKTYLY | WYLQKPGQ PPQLLIH | E------ VSNRFS | GVPDRFSGSGSG--- TDFTLKISRVEAEDVGVYYC | MQSIQ------ ------VPWT | FGQGT KVEIK |
| iPS:435807 | 21-225_181C10 | VK2/A18/JK1 | DIVMTQTPLSLSV TPGQPASISC | KSS--- QSLLMGD- GKTYLY | WYLQKPGQ PPQLLIY | E------ VSNRFS | GVPDRFSGSGSG--- TDFTLKISRVEAEDVGVYHC | MQSIQ------ ------VPWT | FGQGT KVEIK |
| iPS:435827 | 21-225_190H1 | VK2/A18/JK1 | DIVMTQTPLSLSV TPGQPASISC | KSS--- QSLLMSD- GRTYLY | WYLQKPGQ PPQLLIC | E------ VSNRFA | GVTDRFSGSGSG--- TDFTLKISRVEAGDVGVYYC | MQSIQ------ ------FPWT | FGQGT KVEIK |
| iPS:435839 | 21-225_191B1 | VK2/A18/JK1 | DIVMTQTPLSLSV TPGQPASISC | KSS--- QSLLRSD- GKTYLF | WYLQKPGQ PPQVLIY | E------ LSNRFS | GVPDRFSGSGSG--- TDFTLKISRVEAEDVGVYYC | MQSFQ------ ------LPWT | FGQGT KVEIN |
| iPS:435853 | 21-225_191E3 | VK2/A18/JK1 | DIVMTQTPLSLSV TPGQPASISC | KSS--- QSLLHSD- GRTYLY | WYLQKPGQ PPQLLIC | E------ VSNRFA | GVTDRFSGSGSG--- TDFTLKISRVEAGDVGVYYC | MQSIQ------ ------LPWT | FGQGT KVEIK |
| iPS:435871 | 21-225_191E6 | VK2/A18/JK1 | DIVMTQTPLSLSV TPGQPASISC | KSS--- QSLLHSD- GRTYLY | WYLQKPGQ PPQLLIC | E------ VSNRFA | GVTDRFSGSGSG--- TDFTLKISRVEAGDVGIYYC | MQSIH------ ------FPWT | FGQGT KVEIK |
| iPS:435887 | 21-225_186F7 | VK2/A18/JK1 | DVVMAQTPLSLSV TPGQPASISC | KSS--- QSLLHGD- GKTYLC | WYLQKPGQ PPQLLIY | E------ VSNRFS | GVPDRFSGSGSG--- TDFTLKISRVEAEDVGVYYC | MQSIQ------ ------VPWT | FGQGT KVEIK |
| iPS:435899 | 21-225_188G1 | VK2/A18/JK1 | DIVMTQTPLSLSV TPGQPASISC | MSS--- QSLLHGD- GKTYLY | WYLQKPGQ PPQLLIY | E------ VSNRFS | GVPTFSGSGSG--- TDFTLKISRVEAEDVGVYYC | MQSIQ------ ------IPWT | FGQGT KVEIK |
| iPS:435901 | 21-225_189G2 | VK2/A18/JK1 | DIVMTQTPLSLSV TPGQPASISC | KSS--- QSLLHSD- GKTYLY | WYLQRPGQ PPQLLIY | E------ VSNRFS | GVSDRFSGSGSG--- TDFTLKISRVEAEDVGVYYC | MQSIQ------ ------IPWT | FGQGT KVEIK |
| iPS:435927 | 21-225_190E7 | VK2/A18/JK1 | DIVLTQTPLSLSV TPGQPASISC | KSS--- QSLLRSD- GKTYLY | WYLQRPGQ PPQLLIC | E------ VSNRFA | GVPDRFSGSGSG--- TDFTLKISRVEAEGDVGVYYC | MQSIQ------ ------LPWT | FGQGT KVEIK |
| iPS:435999 | 21-225_192F9 | VK2/A18/JK1 | DIVMTQTPLSLSV TPGQPASISC | KSS--- QSLLRSD- GRTYLY | WYLQKPGQ PPQVLIY | E------ VSNRFS | GVPDRFSGSGSG--- TDFTLKISRVEAEGDVGVYYC | MQSIQ------ ------LPWT | FGQGT KVEIK |
| iPS:436060 | 21-225_194F4 | VK2/A18/JK1 | DIVMTQTPLSLSV TPGQPASISC | KSS--- QSLLHSD- GKTYLY | WYLQKPGQ PPQLLIC | E------ VSNRFS | GVPDRFSGSGSG--- TDFTLKISRVEAGDVGVYYC | MQSIQ------ ------LPWT | FGQGT KVEIK |
| iPS:436158 | 21-225_197G8 | VK2/A18/JK1 | EIVMTQTPLSLSV IPGQPASISC | KSS--- QNLLHSD- GRTYLY | WYLQKPGQ PPQLLIY | E------ VSNRFS | GVPDRFSGSGSG--- TDFTLKISRVEAGDVGVYSC | MQSIQ------ ------LPWT | FAQGS KVEIK |
| iPS:436193 | 21-225_198A10 | VK2/A18/JK1 | DIVLTQTPLSLSV TPGQPASISC | KSS--- QSLLYSD- GRTYLY | WYLQKPGQ PPQVLIC | E------ VSNRFS | GVPDRFSGSGSG--- TDFTLKISRVEAGDVGVYYC | MQSIQ------ ------LPWT | FGQGT KVEIK |

FIGURE 51 (Continued)

| | | | | | | | | |
|---|---|---|---|---|---|---|---|---|
| iPS:436_536 | 21-225_224G1 | VK2|A18/JK1 | DIVMTQTPLSLSV TPGQPASISC | KSG---QSLLHSD GKTFLS | WYLQKPGQ PPQLLIY | KSG--- | GVPDRFSGSGSG--- TDFTLKISRVEAEDVGIYYC | MQSTQ-------------LPRT | FGQGT KVEIK |
| iPS:436_548 | 21-225_224A7 | VK2|A18/JK1 | DIVMTQTPLSLSV TPGQPASISC | KSS---QSLLHSD GKTFLY | WYLQKPGQ PPQLLIY | E------ ISNRFS | GVPDRFSGSGSG--- TDFTLKISRVEAEDVGIYYC | MQSTQ-------------LPRT | FGQGT KVEIK |
| iPS:436_558 | 21-225_224C1 | VK2|A18/JK1 | DFVMTQTPLSLSV TPGQPASISC | KSS---QSLLHSD GKTFLY | WYLQKPGQ PPQLLIY | E------ ISNRFS | GVPDRFSGSGSG--- TDFTLKISRVEAEDVGIYYC | MQSTQ-------------LPRT | FGQGT KVDIK |
| iPS:436_562 | 21-225_224H1 | VK2|A18/JK1 | DIVMTQTPLSLSV TPGQPASISC | KSS---QSLLHSD GKTFLY | WYLQKPGQ PPQLLIY | E------ ISNRFS | GVPDRFSGSGSG--- TDFTLKISRVEAEDVGIYYC | MQSTQ-------------LPRT | FGQGT KVEIK |
| iPS:436_572 | 21-225_223G4 | VK2|A18/JK1 | DIVMTQTPLSLSV TPGQPASISC | KSS---QSLLHSD GKTFLY | WYLQKPGQ PPQLLIY | E------ ISNRFS | GVPDRFSGSGSG--- TDFTLKISRVEAEDVGIYYC | MQSTQ-------------LPRT | FGQGT KVEIK |
| iPS:436_592 | 21-225_226B1 | VK2|A18/JK1 | DIVMTQTPLSLSV TPGQPASISC | KSS---QSLLMGD GKTFLY | WYLQKPGQ PPQLLIN | E------ VSIRFS | GVPDRFSGSGSG--- TDFTLKISRVEAEDVGVYYC | MQSIQ-------------IPWT | FGQGT KVEIK |
| iPS:436_594 | 21-225_226A5 | VK2|A18/JK1 | DIVMTQTPLSLSV TPGQPASISC | KSS---QSLLHGD GKTYLY | WYLQKPGQ PPQLLIY | E------ VSNRFS | GVPDRFSGSGSG--- TDFTLKISRVEAEDVGVYYC | MQSTQ-------------LPRT | FGQGT KVEIK |
| iPS:436_602 | 21-225_226E7 | VK2|A18/JK1 | DIVMTQTPLSLSV TPGQPASISC | KSS---QSLLHSD GKTFLY | WYQQKPGQ PPQLLIY | E------ VSNRFS | GVPDRFSGSGSG--- TDFTLKISRVEAEDVGIYYC | MQSTQ-------------LPRT | FGQGT KVEIK |
| iPS:436_606 | 21-225_226G8 | VK2|A18/JK1 | DIVMTQTPLSLSV TPGQPASISC | KSS---QSLLHSD GKTFLY | WYLQKPGQ PPQLLIY | E------ ISNRFS | GVPDRFSGSGSG--- TDFTLKISRVEAEDVGIYYC | MQSTQ-------------LPRT | FGQGT KVEIK |
| iPS:436_610 | 21-225_226F9 | VK2|A18/JK1 | DIVMTQTPLSLSV TPGQPASISC | KSS---QSLLHSD GKTFLY | WYLQKPGQ PPQLLIY | E------ ISNRFS | GVPDRFSGSGSG--- TDFTLKISRVEAEDVGIYYC | MQSTQ-------------LPRT | FGQGT KVEIK |
| iPS:436_612 | 21-225_226H9 | VK2|A18/JK1 | DIVMTQTPLSLSV TPGQPASISC | KSS---QSLLHSD GKTFLY | WYLQRPGQ PPQLLIY | E------ VSNRFS | GVPDRFSGSGSG--- TDFTLKISRVEAEDVGIYYC | MQSTQ-------------LPRT | FGQGT KVEIK |
| iPS:436_614 | 21-225_226F10 | VK2|A18/JK1 | DIVMTQTPLSLSV TPGQPASISC | KSS---QSLLHSD GKTFLY | WYLQKPGQ PPQLLIY | E------ ISNRFS | GVPDRFSGSGSG--- TDFTLKISRVEAEDVGIYYC | MQSTQ-------------LPRT | FGQGT KVEIK |
| iPS:436_618 | 21-225_226E1 | VK2|A18/JK1 | DIVMTQTPLSLSV TPGQPASISC | KSS---QSLLHSD GKTFLY | WYLHKPGQ PPHLLIY | E------ ISNRFS | GVPDRFSGSGSG--- TDFTLKISRVEAEDVGIYYC | MQSTQ-------------VFWT | FGQGT KVEIK |
| iPS:436_624 | 21-225_226H1 | VK2|A18/JK1 | DIVMTQTPLSLSV TPGQPASISC | KSS---KTLLHSD GKTFLY | WYLQKPGQ PPQPLIY | E------ ISNRFS | GVPDRFSGSGSG--- TDFTLKISRVEAEDVGIYYC | MQSTQ-------------LPRT | FGQGT KVEIK |
| iPS:436_626 | 21-225_227C1 | VK2|A18/JK1 | DIVMTQTPLSLSV TPGQPASISC | KSS---QSLLHSD GKTFLY | WYLQKPGQ PPQLLIY | E------ ISNRFS | GVPDRFSGSGSG--- TDFTLKISRVEAEDVGIYYC | MQSTQ-------------LPRT | FGQGT KVEIK |
| iPS:436_628 | 21-225_227F2 | VK2|A18/JK1 | DIVMTQTPLSLSV TPGQPASISC | KSS---QSLLHSD GKTFLY | WYLQKFGQ PPQLLIY | E------ ISNRFS | GVPDRFSGSGSG--- TDFTLKISRVEAEDVGIYYC | MQSTQ-------------LPRT | FGQGT KVEIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:436 640 | 21-225_227A8 | VK2[A18]/JK1 | DIVMTQTPLSLSV TPGQPASISC | KSS---QSLLHSD-GKTFLY | WYLQKPGQ PPQLLIY | E------ISNRFS | GVPDRFSGSGSG---TDFTLKISRVEAEDVGIYYC | MQSTQ------LPRT | FGQGT RVEIK |
| iPS:392 814 | 21-225_22A1 | VK2[A18]/JK1 | DIVMTQTPLSLSV TPGQPASISC | KSS---QSLLHSG-GKTYLY | WYLQKPGQ PPQLLIY | E------VSNRFS | GLPDRFSGSGSG---TDFTLKISRVEAADVGVYYC | MQTLH------LPWT | FGQGT KVEIK |
| iPS:392 930 | 21-225_25H9 | VK2[A18]/JK1 | DIVMTQTPLSLSV TPGQPASISC | KSS---QSLLHGD-GKTYLF | WYLQKPGQ PPQLLIY | E------VSNRFS | GVPDRFSGSGSG---TDFTLKISRVEAEDVGVYYC | MQSIQ------LPWT | FGQGT KVEIK |
| iPS:393 032 | 21-225_26F8 | VK2[A18]/JK1 | DIVMTQTPLSLSV TPGQPASISC | KSS---QSLLMGD-GKTYLY | WYLQKPGQ PPQLLIY | E------VSNRFS | GVPDRFSGSGSG---TDFTLKISRVEAEDVGVYYC | MQSIQ------LPWT | FGQGT KVEIK |
| iPS:393 036 | 21-225_28G3 | VK2[A18]/JK1 | EIVMTQTPLSLSV TPGQPASISC | KSS---QSLLHGD-GKTYLY | WYLQKPGQ PPQLLIY | E------VSNRFS | GVPERFSGSGSG---TDFTLKISRVEAEDVGVYYC | MQSIQ------IPWT | FGQGT KVEIK |
| | Germline | VK1[A30]/JK1 | | | | | | | |
| iPS:468 826 | 21-225_201C5 | VK1[A30]/JK1 | DIQMTQSPSSLSA SVGDRVTITC | RAS---QGIR-----HDLG | WYQQKPGK APKRLIY | A------ASSLQS | GVPSRFSGSGSG---TEFTLTISSLQPEDFATYYC | LQHYS------FPRT | FGQGT KVEIK |
| iPS:468 842 | 21-225_50H4 | VK1[A30]/JK1 | DIQMTQSPSSLSA SVGDRVTITC | RAS---QGIR-----NDLG | WYQQKPGK APKRLIY | A------ASSLQS | GVPSRFSGSGSG---TEFTLTISSLQPEDFATYYC | LQHYS------YPRT | FGQGT KVEIK |
| iPS:468 858 | 21-225_148C9 | VK1[A30]/JK1 | DIQMTQSPSSLSA SVGDRVTITC | RAS---QGIR-----RGIR | WYQQKPGK APKRLIY | A------ASSLQS | GVPSRFSGSGSG---TEFTLTISSLQPEDFATYYC | LQHYS------YPRT | FGQGT KVEIK |
| iPS:468 860 | 21-225_224E7 | VK1[A30]/JK1 | DIQMTQSPSSLSA SVGDRVTITC | RAS---QGIR-----DDLG | WYQQKPGK APTRLIY | A------ASTLES | GVPSRFSGSGSG---TEFTLTISSLQPEDFATYYC | LQHYS------YPRT | FGQGT KVEIK |
| iPS:433 919 | 21-225_44B3 | VK1[A30]/JK1 | DIQMTQSPSSLSA SVGDRVTITC | RAS---QGIR-----NDLG | WYQQKPGK APKRLIY | A------ASSLQS | GVPSRFSGSGSG---TEFTLTISSLQPEDFATYYC | LQHYS------YPRT | FGQGT KVEIK |
| iPS:433 923 | 21-225_44D3 | VK1[A30]/JK1 | DIQMTQSPSSLSA SVGDRVTITC | RAS---QGIR-----DDLG | WYQQKPGK APKRLIY | A------ASSLQS | GVPSRFSGSGSG---REFTLTISSLQPEDFATYYC | LQHYS------YPRT | FGQGT KVEIK |
| iPS:433 929 | 21-225_44D5 | VK1[A30]/JK1 | DIQMTQSPSSLSA SVGDRVTITC | RAS---QGIR-----NDLG | WYQQKPGK APKRLIY | A------ASSLQS | GVPSRFSGSGSG---TEFTLTISSLQPEDFATYYC | LQHYS------FPWT | FGQGT KVEIK |
| iPS:433 935 | 21-225_44F9 | VK1[A30]/JK1 | DVQMTQSPSSLSA SVGDRVTITC | RAS---QGIR-----KDLG | WYQQKPGK APKRLIY | A------ASSLES | CVPSRFSGSGSG---TEFTLTISSLQPEDFATYYC | LHHYN------YPRT | FGQGT KVEIT |
| iPS:433 939 | 21-225_44C10 | VK1[A30]/JK1 | DIQMTQSPSSLSA SVGDRVTITC | RAS---QGIR-----NDLG | WYQQKPGK APKRLIY | T------TSSLQS | GVPSRFSGSGSG---TEFTLTISSLQPEDFATYYC | LQHYS------YPRT | FGQGT KVEIK |
| iPS:433 951 | 21-225_45B4 | VK1[A30]/JK1 | DIQMTQSPSSLSA SVGDRVTFTC | RAS---QGIR-----DDLG | WYQQKPGK APKRLIY | A------ASSLQS | GVPSRFSGSGSG---TEFTLTISSLQPEDFATYYC | LQHYS------YPRT | FGQGT KVEIK |
| iPS:433 955 | 21-225_45B8 | VK1[A30]/JK1 | DIQMTQSPSSLSA SVGDRVTFTC | RAS---QDIR-----DDLG | WYQQKPGK APKRLIY | A------ASSLQS | GVPSRFSGSGSG---TEFTLTISSLQPEDFATYYC | LQHYN------YPRT | FGQGT KVEIK |
| iPS:433 967 | 21-225_46C3 | VK1[A30]/JK1 | DIQMTQSPSSLSA SVGDRVTITC | RAS---QGIR-----NDLG | WYQQKVGK APKRLIY | A------ASSLQS | GVPSRFSGSRSG---TEFTLTISSLQPEDFATYYC | LQHYS------YPRT | FGQGT KVEIK |
| iPS:433 971 | 21-225_46D4 | VK1[A30]/JK1 | DIQMTQSPSSLSA SVGDRVTITC | RTS---QDIR-----KDLG | WYQQKPGK APKRLIY | A------ASSLES | GVPSRFSGSGSG---TEFTLTISSLQPEDFATYYC | LQHYS------FPWT | FGQGT KVEIK |
| iPS:433 997 | 21-225_48C1 | VK1[A30]/JK1 | DIQMTQSPSSLSA SVGDRVTITC | RTS---QGIR-----NDLG | WYQQKPGK APKRLIY | R------ASSLQS | GVPARFSGSGSG---TEFTLTISSLQPEDFATYYC | LQHNF------YPWT | FGQGT KVEIK |

FIGURE 51 (Continued)

| | | | | | | | | | |
|---|---|---|---|---|---|---|---|---|---|
| iPS:434 001 | 21- 225_48F2 | VK1|A30/ JK1 | DIQMTQSPSSLSA SVGDRVTITC | RAS---RGIR- ----DDLG | WYQQKPGK PPNRLIY | A------ ASSLQS | GVPSRFNGSGSG- TEFTLTISSLQSEGLATYYC | LQQYS----- ---------YPRT | FGQGT KVEIK |
| iPS:434 009 | 21- 225_48A9 | VK1|A30/ JK1 | DIQMTQSPSSLSA SVGDRVTITC | RAS---QGIR- ----NDLG | WYQQKPGK APKRLIY | I------ ASSLQS | GVPSRFSGSGSG- TEFTLTISSLQPEDFAIYYC | LQHNR----- ---------YPWT | FGQGT KVEIK |
| iPS:434 047 | 21- 225_50A12 | VK1|A30/ JK1 | DIQMTQSPSSLSA SVGDRVTITC | RAS---QGIR- ----NDLG | WYQQKPGK APKRLIY | T------ ASNLQS | GVPSRFSGSGSG- TEFTLTISSLQPEDFATYYC | LQHNS----- ---------YPWT | FGQGT KVEIK |
| iPS:434 067 | 21- 225_51H8 | VK1|A30/ JK1 | DIQMTQSPSSLSA SVGDRVTITC | RAS---QGIR- ----NDLG | WYQQKPGK APKRLIY | A------ ASSLQS | IHFTLTISSLQPEDFATYYC | LQYNS----- ---------YPWT | FGQGT KVEIK |
| iPS:434 135 | 21- 225_54H3 | VK1|A30/ JK1 | DIQMTQSPSSLSA SVGDRVTITC | RAS---QDIR- ----NILG | WYQQKPGK APKRLIY | A------ ASNLQS | GVPSRFSGSGSG- TEFTLTISSLQPEDFATYYC | LQYNS----- ---------YPWT | FGQGT KVEIK |
| iPS:434 197 | 21- 225_56C7 | VK1|A30/ JK1 | DIQMTQSPSSLSA SVGDRVTITC | RAS---QGIR- ----NDLG | WYQQKPGK APKRLIY | T------ ASNLQS | GVPSRFSGSGSG- TEFTLTISSLQPEDFATYYC | LQHNS----- ---------YPWT | FGQGT KVEIK |
| iPS:434 203 | 21- 225_60E2 | VK1|A30/ JK1 | DIQMTQSPSSLSA SVGDRVTITC | RAS---QGIR- ----KDLG | WYQQKPGK APKRLIY | A------ ASSLQS | GVPSRFSGSGSG- TEFTLTISSLQPEDFATYYC | LQHNS----- ---------YPWT | FGQGT KVEIK |
| iPS:434 209 | 21- 225_60C3 | VK1|A30/ JK1 | DIQMTQSPSSLSA SVGDRITITC | RAS---QGIR- ----NDLG | WYQQKPGK APKRLIY | S------ ASSLQS | GVPSRFSGSGSG- TEFTLTISSLQPEDFATYYC | LQHNS----- ---------YPWT | FGLGT KVEIK |
| iPS:434 229 | 21- 225_61H1 | VK1|A30/ JK1 | DIQMTQSPSSLSA SVGDRVTITC | RAS---QGIR- ----KDLG | WYQQKPGK APKRLIF | A------ ASSLQS | GVPSRFSGSGSG- TEFTLTISSLQPEDFATYYC | LQHNS----- ---------YPWT | FGQGT KVEIK |
| iPS:434 241 | 21- 225_61E6 | VK1|A30/ JK1 | DIQMTQSPSSLSA SVGDRVTITC | RAS---QGIG- ----NDLG | WYQQKPGK APERLIY | A------ ASSLQS | GVPSRFSGSGSG- TEFTLTISSLQPEDFATYYC | LQYNS----- --------FPPWT | FGQGT KVEIK |
| iPS:434 257 | 21- 225_62F7 | VK1|A30/ JK1 | DIQMTQSPSSLSA SVGDRVTITC | RAS---QAIR- ----NDLG | WYQQKPGK APKRLIY | P------ ASRLQS | GVPSRFSGSGSG- TEFTLTISSLQPEDFATYYC | LQYNS----- ---------YPPWT | FGQGS KVEIK |
| iPS:434 281 | 21- 225_57B8 | VK1|A30/ JK1 | DIQMTQSPSSLSA SVGDRVTITC | RAS---QGIG- ----NDLG | WYQQKPGK APERLIY | A------ ASSLQS | GVPSRFSGSGSG- TEFTLTISSLQPEDFATYYC | LQHNS----- --------FPPWT | FGQGT KVEIK |
| iPS:434 315 | 21- 225_59G7 | VK1|A30/ JK1 | DIQMTQSPSSLSA SVGDRVTITC | RAS---QGIR- ----NDLG | WYQQKPGK APKRLIY | S------ ASSLQS | GVPSRFSGSGSG- TEFTLTISSLQPEDFATYYC | LQHNS----- ---------YPWT | FGQGT KVEIK |
| iPS:434 319 | 21- 225_59B9 | VK1|A30/ JK1 | DIQMTQSPSSLSA SVGDRVTITC | RAS---QDIR- ----NDLG | WYQQHPGK APKRLIY | A------ ASSLQS | GVPSRFSGTR3G- TEFTLTISSLQPEDFATYYC | LQHNS----- ---------YPWT | FGQGT KVEIK |
| iPS:434 339 | 21- 225_64A4 | VK1|A30/ JK1 | DIQMTQSPSSLSA SVGDRVTITC | RAS---QGIR- ----NDLG | WYQQKPGK APKRLIY | A------ ASSLQS | GVPSRFSGSGSG- TEFTLTISSLQPEDLATYYC | LQHYS----- ---------YPRT | FGQGT KVEIK |
| iPS:434 343 | 21- 225_64C8 | VK1|A30/ JK1 | AVGDMTQSPSSLSA SVGDRVTITC | RAS---QGIR- ----NDLG | WYQQKCLIY APKCLIY | A------ AFRLQI | GVPSRFSGSGSG- TEFTLTISSLQPEDFATYYC | LHHYS----- ---------YPWT | FGQGT KVEIK |
| iPS:434 385 | 21- 225_66C10 | VK1|A30/ JK1 | DIQMTQSPSSLSA SVGDRVTITC | RAS---QAIR- ----NDLG | WYQQKPGK APKRLIY | P------ ASSLQS | GVPSRFSGSGSG- TEFTLTISSLQPEDFATYYC | LQYNS----- --------YEPWT | FGQGS KVEIK |
| iPS:434 387 | 21- 225_66D11 | VK1|A30/ JK1 | DIQMTQPSSQSA SVGDRVTITC | RAS---QGIG- ----NDLG | WYQQKPGK AHKRLIY | A------ ASSLQS | GVPSRFSGSGSG- TEFTLTISISMQREDFATYYC | LQHNS----- ---------YPWT | FGQGT KVEIK |
| iPS:434 441 | 21- 225_71A2 | VK1|A30/ JK1 | DIQMTQSPSSRSA SVGDRVTITC | RAS---QGIR- ----NDLG | WYQQKPGK APKRLIY | S------ ASSCQS | GVPSRFSGSGCG- TEFTLTISISMQREDFATYYC | IHHNS----- ---------YPWT | FGQGT KVEIK |
| iPS:434 469 | 21- 225_73C9 | VK1|A30/ JK1 | DIQMTQSPSSLSA SVGDRVTITC | RAS---QGIR- ----NDLG | WYQQKPGK APKRLIY | I------ AEFRLQI | GVPSRFSGSGSG- TEFTLTISSLQPEDFATYYC | LQYNS----- ---------YPWT | FGQGS KVEIK |
| iPS:435 197 | 21- 225_94F3 | VK1|A30/ JK1 | DIQMTQSPSSLSA SVGDRVTITC | RAS---QAIR- ----NDLG | WYQQKPGK APQRLIF | A------ ASSLQS | GVPSRFSGSGSG- TEFTLTISSLQPEDFATYYC | IVHNS----- ---------YPRT | FGRGT KVAIK |
| iPS:435 325 | 21- 225_147H5 | VK1|A30/ JK1 | DIQMTQSPSSLSA SVGDRVTITC | RAS---RGIR- ----DDLG | WYQQKPGK APKRLIY | A------ ASSCQS | GVPSRFSGSGSG- TEFTLTISSLQPEDFATYYC | LQHYS----- ---------YPRT | FGQGT KVEIK |
| iPS:435 3930 | 21- 225_149D1 | VK1|A30/ JK1 | DIQMTQSPSSLSA SVGDRVTITC | RAS---RGIR- ----NDLG | WYQQKFGN APKRLIY | A------ ASSLQS | GVPSRFSGSGSG- TEFTLTISSLQPEDFATYYC | LQHYS----- ---------YPRT | FGQGT KVEIK |

FIGURE 51 (Continued)

| | | | | | | | | | |
|---|---|---|---|---|---|---|---|---|---|
| iPS:435 539 | 21- 225_158G1 | VK1|A30/ JK1 | DIQMTQSPSSLSA SVGDRVTITC | RAS--QGIR- -----NDLG | WYQQKPGK APKRLIY | T------ ASSLQS | GVPSRFSGSGCG--- TEFTLTVSSLQPEDFATYYC | LQHNS------------- | -----YPWT FGQGT KVEIK |
| iPS:435 543 | 21- 225_158D4 | VK1|A30/ JK1 | DIQMTQSPSSLSA SVGDRVTITC | RAS--QDIR- -----KDLG | WYQQKPGK APKRLIY | A------ ASSLQS | GVPSRFSGSGSG--- TEFTLTFSSLQPEDFATYYC | LQHYS------------- | -----YPRT FGQGT KVEIK |
| iPS:435 571 | 21- 225_159C8 | VK1|A30/ JK1 | DIQMTQSPSSLSA SVGDRVTITC | RAS--QDIR- -----KDLG | WYQQKPGK APNRLIY | A------ ASSLQS | GVPSRFSGSGSG--- TEFTLTFSSLQPEDFATYYC | LQHHS------------- | -----YPRT FGQGT KVEIK |
| iPS:435 573 | 21- 225_159D8 | VK1|A30/ JK1 | DIQMTQSPSSLSA SVGDRVTITC | RAS--RDIG- -----NDLG | WYQQKPGK APKRLIS | A------ ASSLQS | GVPSRFSGSGSG--- TEFTLTFSSLQPEDFATYYC | LQHYS------------- | -----YPRT FGQGT KVEIK |
| iPS:435 581 | 21- 225_160H1 | VK1|A30/ JK1 | DIQMTQSPSSLSA SVGDRVTITC | RAS--QDIR- -----NDLG | WYQQKPGK APKRLIY | A------ ASSLQN | GVPSRFSGSGSG--- TEFTLTISSLQPEDFTTYYC | LQHNS------------- | -----FPWT FGQGT KVEIK |
| iPS:435 583 | 21- 225_160F2 | VK1|A30/ JK1 | DIQMTQSPSSLSA SVGDRVTITC | RAS--QGIR- -----NDLG | WYQQKPGK APKRLIY | T------ ASSLQN | GVPSRFSGSGSG--- TEFTLTVSSLQPEDFATYYC | LQHNS------------- | -----YPWT FGQGT KVEIK |
| iPS:435 591 | 21- 225_160C4 | VK1|A30/ JK1 | DIQMTQSPSSLSA SVGDRVTITC | RAS--QDIR- -----KDLG | WYQQKPGK APNRLIY | A------ ASSLQS | GVPSRFSGSGSG--- TEFTLTFSSLQPEDFATYYC | LQHYS------------- | -----YPRT FGQGT KVEIK |
| iPS:435 615 | 21- 225_161G1 2 | VK1|A30/ JK1 | DIQMTQSPSSRSA SVGDRVTITC | RAS--QDIR- -----KDLG | WYQQKPGK APKRLIY | A------ ASSLQS | GVPSRFSGSGSG--- TEFTLTFSSLQPEDFATYYC | LQHHS------------- | -----YPRT FGQGT KVEIK |
| iPS:435 675 | 21- 225_169D7 | VK1|A30/ JK1 | DIQMTQSPSSLSA SVGDRVTITC | RAS--QGIR- -----NDLG | WYQQKPGK APKRLIY | A------ ASSLQS | GVPSRFSGSGSG--- TEFTLTISSLQPEDFATYYC | LQHHS------------- | -----CPWT FGQGT KVEIK |
| iPS:435 681 | 21- 225_169D1 1 | VK1|A30/ JK1 | DIQMTQSPSSLSA SVGDRVTITC | RAS--QGIR- -----DDLG | WYQQKFGN VPKRLIY | A------ ASSLQS | GVPSRFSGSGSG--- TEFTLTISSLQPEDFATYYC | LQHYS------------- | -----YPRT FGQGT KVEIK |
| iPS:435 687 | 21- 225_170H1 | VK1|A30/ JK1 | DIQMTQSPSSLSA SVGDRVTITC | RAS--QGIR- -----NDLG | WYQQKPGK APKRLIY | A------ TSSLQS | GVPLRFSGSGSG--- TEFTLTIISSLQPECFATYYC | LQHSS------------- | -----NPWT FGQGT KVESK |
| iPS:435 689 | 21- 225_170F3 | VK1|A30/ JK1 | DIQMTQSPSSLSA SVGDRVTITC | RAS--RGIR- -----NDLG | WYQQKPGK APKRLIY | A------ ASSLQS | GVPSRFSGSGSG--- TEFTLTIISSLQPEDFATYYC | LQHYS------------- | -----YPRT FGQGT KVEIK |
| iPS:435 741 | 21- 225_174G1 0 | VK1|A30/ JK1 | DIQMTQSPSSLSA SVGDRVTITC | RAS--QGIR- -----DDLG | WYQQKPGK VPKRLIY | A------ ASSLQS | GVPSRFSGSGSG--- TEFTLTIISSLQPEDFATYYC | LQHSS------------- | -----YPRT FGQGT KVEIK |
| iPS:435 831 | 21- 225_190C1 2 | VK1|A30/ JK1 | DIQMTQSPSSLSA SVGDRVTITC | RAS--QGIR- -----KDLG | WYQQKPGK APKRLIH | T------ ASSLQN | GVPLRFSGSGSG--- TEFTLTISSLQPEDFATYYC | LQHNS------------- | -----YPWT FGQGT KVEIK |
| iPS:435 857 | 21- 225_191A4 | VK1|A30/ JK1 | DIQMTQSPSSLSA SVGDRVTITC | RAS--QDIR- -----KDLG | WYQQKPGK APKRLIH | A------ ASSLQS | GVPLRFSGSGSG--- TEFTLTIISSLQPEDFATYYC | LQHNS------------- | -----YPRT FGQGT KVEIK |
| iPS:435 907 | 21- 225_190G3 | VK1|A30/ JK1 | DIQMTQSPSSLSA SVGDRVTITC | RAS--QGIR- -----KDLG | WYQQKPGK APNRLIY | T------ ASSLQS | GVPLRFSGSGSG--- TEFTLTIISSLQPEDFATYYC | LQHNS------------- | -----YPWT FGQGT KVEIK |
| iPS:435 919 | 21- 225_190H5 | VK1|A30/ JK1 | DIQMTQSPSSLSA SVGDRVTITC | RAS--QGIR- -----KDLG | WYQQKFGN APKRLIH | T------ ASSLQN | GVPLRFSGSGSG--- TEFTLTIISSLQPEDFATYYC | LQHNN------------- | -----YPWT FGQGT KVEIK |
| iPS:435 989 | 21- 225_192F7 | VK1|A30/ JK1 | DIQMTQSPSSLSA SVGDRVTITC | RAS--QGIR- -----KDLG | WYQQKPGK APKRLIH | T------ ASSLQS | GVPLRFSGSGSG--- TEFTLTISSLQPEDFATYYC | LQHTS------------- | -----YPWT FGQGT KVEIY |
| iPS:436 132 | 21- 225_196C1 2 | VK1|A30/ JK1 | DIQMTLSPSSLFA CVGDRVIITC | RAS--QGIR- -----NDLG | WSQQNPGK APKRLIY | A------ ASSLQS | GVPSRFSGSGSG--- TEFTLTISSLQPEDFATYYC | LQHND------------- | -----FPFT FGRGT KVEIK |
| iPS:436 222 | 21- 225_200C9 | VK1|A30/ JK1 | DIQMTQSPSSLSA SVGDRVTITC | RAS--QGIR- -----NDLG | WYQQKPGK ALKRLIY | A------ ASSLQS | GVPLRFSGSGSG--- TEFTLTIISSLQPEDFATYYC | LQHYS------------- | -----YPWT FGQGT KVEIK |
| iPS:436 264 | 21- 225_203F7 | VK1|A30/ JK1 | DIQMTQSFSSRFA SVGDRVTITC | RAS--QGIR- -----KDLG | WYQQKPGK ALKRLIY | A------ ASSLQS | GVPSRFSGSGCG--- TEFTLTISSVQPEDFANYYC | LQHYS------------- | -----FPFT FGQGT KVEIK |

FIGURE 51 (Continued)

| | | | | | | | | |
|---|---|---|---|---|---|---|---|---|
| iPS:436_274 | 21-225_204H3 | VK1A30/JK1 | DIQMTQSPSSLSA SVGDRVTITC | RAS--QGIR----NDLG | WYQQKPGK APELLIY | A------- AASLQG | GVPSRFSGSGSG--- TEFTLTISSLQPEDFATYYC | LQHYS---------- -------YPRT | FGQGT KVEIQ |
| iPS:436_332 | 21-225_208B2 | VK1A30/JK1 | DIQMTQSPSSLSA SVGDRVTITC | RAS--QGIR----HDLG | WYQQKPGK APKRLIY | A------- ASSLQS | GVPSGFSGSGSG--- TEFTLTISSLQPEDFATYYC | LQHYS---------- -------YPRT | FGQGT KVEIK |
| iPS:436_352 | 21-225_210G5 | VK1A30/JK1 | DIQMTQSPSSLSA SVGDRVTITC | RAS--QGIR----NDLG | WYQQKPGK APKRLIY | A------- ASSLQS | GVPSGFSGSGSG--- TEFTLTISSLQPEDFATYYC | LRHYS---------- -------YPRT | FGQGT KVEIK |
| iPS:436_386 | 21-225_212B1 | VK1A30/JK1 | DIQMTQSPSSLPA SVGDRVTITC | RAS--QGIR----NDLG | WYQQKPGK APKRLIY | A------- ASSLQS | GVPSRFSGSGSG--- TEFTLTISSLQPEDFATYYC | LLHYS---------- -------YPRT | FGQGT KVEIK |
| iPS:436_412 | 21-225_214H9 | VK1A30/JK1 | DIQMTQSPSSLSA SVGDRVTITC | RAS--QGIR----NDLG | WYQQKPGK APKRLIY | A------- ASSLQS | GVPSRFSGSGSG--- TEFTLTISSLQPEDFATYYC | LQHYS---------- -------YPRT | FGQGT KVEIK |
| iPS:436_414 | 21-225_214G1 | VK1A30/JK1 | DIQMTLCPSSPPA SVGDRVTITC | RAS--QGIR----NDLG | WYQQKPGK APKRLIY | A------- ASSLQS | GVPSRFSGSGSG--- TEFTLTISSLQPEDFATYYC | LLHNS---------- -------YPRT | FGQGT KVEIK |
| iPS:436_416 | 21-225_214G10 | VK1A30/JK1 | DIQMTQSPSSPPA SVGDRVTITC | RAS--QGIR----NDLG | WYQQKPGK APKRLIY | A------- ASSLQS | GVPSRFSGSGSG--- TEFTLTISSLQPEDFATYYC | VMHYS---------- -------YPRT | FGQGT KVEIK |
| iPS:436_418 | 21-225_215E3 | VK1A30/JK1 | DIQMTQSPSSPPA SVGDRVTITC | RAS--QGIR----NDLG | WYQQKPGK APKRLIY | A------- ASSLQS | GVPSRFSGSGSG--- TEFTLTISSLQPEDFATYYC | VMHNS---------- -------YPRT | FGQGT KVEIK |
| iPS:436_428 | 21-225_215E1 | VK1A30/JK1 | DIQMTQSPSSLPA SVGDRVTITC | RAS--QGIR----NDLG | WYQQKPGK APKRLIY | A------- ASSLQS | GVPSRFSGSGSG--- TEFTLTISSVQREDFATYYC | VMHYS---------- -------YPRT | FGQGT KVEIK |
| iPS:436_438 | 21-225_216E8 | VK1A30/JK1 | DIQMTQSPSSLPA SVGDRVTITC | RAS--QGIR----NDLG | WYQQKPGK APKRLIY | A------- ASSLQS | GVPSRFSGSGSG--- TEFTLTISSLQPEDFATYYC | LMHYS---------- -------YPRT | FGQGT KVEIK |
| iPS:436_440 | 21-225_216H1 | VK1A30/JK1 | DIQMTLSPSSLPA SVGDRVTITC | RAS--QGIR----NDLG | WYQQKPGK AFKRLIY | G------- ASSLQS | GVPSRFSGSGSG--- TEFTLTISSLQPEDFATYYC | VMHNS---------- -------YPRT | FGQGT KVEIK |
| iPS:436_450 | 21-225_217E5 | VK1A30/JK1 | DIQMTQSPSSLPA FVGDRVTITC | RAS--QGIR----NDLG | WYQQKPGN APKRLIC | A------- ASSLQS | GVPSEISGSGSG--- TEFTLTISSLQPEDFATYYC | VMHNS---------- -------YPRT | FGQGT KVEIK |
| iPS:436_456 | 21-225_217G10 | VK1A30/JK1 | DIQMTQSPSFPPA SVGDRVTITC | RAS--QGIR----DDLG | WYQQKPGN APKRLIY | A------- ASSLQS | GVPSRFSGSGSG--- TEFTLTISSLQPEDFATYYC | VMHNS---------- -------YPRT | FGQGT KVEIK |
| iPS:436_458 | 21-225_217H12 | VK1A30/JK1 | DIQMTQSPSSPPA SVGDRVTITC | RAS--QGIR----NDLG | WYQQKPGK APKRLIY | A------- ASSLQS | GVPSRFSGSGSG--- TEFTLTISSLQPEDFATYYC | LMHYS---------- -------YPRT | FGQGT KVEIK |
| iPS:436_462 | 21-225_218C4 | VK1A30/JK1 | DIQMTQCPSPPPA SVGDRVTITC | RAS--QGIR----NDLG | WYQQKPGK AFKRLIY | A------- ASSLQS | GVPSRFSGSGSG--- TEFTLTISSVQREDFATYYC | VMHYS---------- -------YPRT | FGQGT KVEIK |
| iPS:436_480 | 21-225_220F8 | VK1A30/JK1 | DIQMTLSPSSPPA FVGDRVTIIR | RAS--QGIR----NDLG | WYQQIPGK APKRLIY | G------- ASSLQS | GVPSGFSGSGSG--- TEFTLTISSLQREDFATYYC | VMHNS---------- -------YPRT | FGQGT KVEIK |
| iPS:436_534 | 21-225_224F1 | VK1A30/JK1 | AIQMTQSPSSLSA SVGDRVTITC | RAS--QGIR----DDLG | WYQQKPGK APKRLIY | A------- ASSLQS | GVPSEISGSGSG--- TEFTLTISSLQPEDFATYYC | LQHYS---------- -------YPRT | FGQGT KVEIK |
| iPS:436_540 | 21-225_224F3 | VK1A30/JK1 | DIQMTQSPSSLSA SVGDRVTITC | RAS--QGIR----NDLG | WYQQKPGK APERLIY | A------- ASSLQS | GVPSRFSGSGSG--- TEFTLTISSLQPEDFATYYC | LQHYN---------- -------YPRA | FGQGT KVEIK |
| iPS:436_564 | 21-225_225A1 | VK1A30/JK1 | DIQMTQSPSSLSA SVGDRVTITC | RAS--QGIR----DDLG | WYQQIPGK APKRLIY | A------- ASSLQS | GVPSRFSGSGSG--- TEFTLTISSLQPEDFATYYC | LQHYS---------- -------YPRT | FGQGT KVEIK |
| iPS:436_596 | 21-225_226C6 | VK1A30/JK1 | DIQMTQSPSSLSA SIGDRVTITC | RAS--QGIR----NDLG | WYQQKPGK APKRLIY | A------- ASSLQS | GLPSRFSGSGSG--- TEFTLTISNLQPEDFATYYC | LQHYN---------- -------YPRA | FGQGT KVEIQ |

FIGURE 51 (Continued)

| | | | | | | | | |
|---|---|---|---|---|---|---|---|---|
| iPS:436 604 | 21-225_226F7 | VK1|A30/ JK1 | DIQMTQSPSSLSA SVGDRVTITC | RAS--QGIG- ----NDLG | WYQQKPGK APKRLIY | A------ ASSLQS | GVPSRFSGSVSG--- TEFTLTISSLQPEDFATYYC | LHHYS-------- -------YPRT | FGQGT KVEIK |
| iPS:436 620 | 21-225_226H1 | VK1|A30/ JK1 | DIQMTQSPSSLSA SVGDRVTITC | RTS--QGIR- ----NDLG | WYQQKPGK APKRLIY | A------ ASSLQS | GVPSRFSGSGSG--- TDFTLTISSLQPEDFATYYC | LQHYS-------- -------YPRT | FGQGT KVEIK |
| iPS:437 262 | 21-225_170E4 | VK1|A30/ JK1 | DIQMTQSPSSLSA SVGDRVTITC | RAS--QGIR- ----NDLG | IYQQKPGK APKRLIY | V------ ASGLQS | GVPSRFSGSGSG--- TEFTLTISSLQPEDFATYYC | LQHNS-------- -------YPWT | FGQGT KVDIK |
| iPS:437 280 | 21-225_203C1 | VK1|A30/ JK1 | DIQMTQSPSSLSA SVGDRVTITC | RAS--QDIR- ----NDLG | WYQQKPAK APKRLIY | R------ ASSLQS | GVPSRFSGSGSG--- TEFTLTISSLQPEDFAAYYC | LQHS--------- -------YPWT | FGQGT KVEIK |
| iPS:437 286 | 21-225_208F1 | VK1|A30/ JK1 | DIQMTQSPSSLSA SVGDRVTITC | RAS--QGIR- ----HDLG | WYQQKPGK APKRLIF | A------ ASSLQS | GVPSRFSGSGSG--- TEFTLTISSLQPEDFATYYC | LQHYS-------- -------FPRT | FGQGT KVEIK |
| iPS:437 290 | 21-225_210G6 | VK1|A30/ JK1 | DIQMTQSPSSRFA FVGDRVTITC | RAS--QGIR- ----HDLG | WYQQKPGK ALKRLIY | A------ ASSSQS | GVPSRFSGSGCG--- TEFTLTISSVREDFANYYC | VQHYS-------- -------FPRT | FGQGT KVEIK |
| iPS:451 114 | 21-225_159A3 | VK1|A30/ JK1 | DIQMTQSPSSLSA SVGDRVTITC | RAS--QDIR- ----KDLG | WYQQKPGK APNRLIY | A------ ASSLQS | GVPSRFSGSGSG--- TEFTLTFSSLQPEDFATYYC | LQHHS-------- -------YPRT | FGQGT KVEIK |
| iPS:392 626 | 21-225_18A5 | VK1|A30/ JK1 | DIQMTQSPSSLSA SVGDRVTITC | RAS--QGIR- ----NDLG | WYQQKPGK APKRLIY | A------ ASSLQS | GVPSRFSGSGSG--- TEFTLTISSLQPEDFATYYC | LQHNS-------- -------YPWT | FGQGT KVEIK |
| iPS:392 634 | 21-225_17H3 | VK1|A30/ JK1 | DIQMTQSPSSLSA SVGDRVTFTC | RAS--QGIR- ----SDLG | WYQQKPGK APKRLIY | A------ ASSLQS | GVPSRFSGSGSG--- TEFTLTISSLQPEDFATYYC | LQQYS-------- -------YPRT | FGQGT KVEIK |
| iPS:392 674 | 21-225_18C2 | VK1|A30/ JK1 | DIQMTQSPSSLSA SVGDRVTITC | RAS--QGIR- ----NDLG | WYQQKPGK APKRLIY | T------ ASSLQS | GVPSRFSGSGFG--- TEFTLTISSLQPEDFATYYC | LQHNS-------- -------YPWT | FGLGT KVVIK |
| iPS:392 686 | 21-225_17C7 | VK1|A30/ JK1 | DIQMTQSPSSLSA SVGDRVTITC | RAS--QGIR- ----NDLG | WYQQKPGK APKRLIY | A------ ASSLQS | GVPSRFSGSGSG--- TEFTLTISSLQPEDFATYYC | LQHNS-------- -------YPWT | FGQGT KVEIK |
| iPS:392 690 | 21-225_18F2 | VK1|A30/ JK1 | DIQMTQSPSSLSA SVGDRVTITC | RAS--QDIR- ----NDLG | WYQQKPGK APKRLIY | A------ ASSLQS | GVPSRFSGSGSG--- TEFTLTISSLQPEDFATYYC | LQHNS-------- -------YPWT | FGQGT KVEIK |
| iPS:392 710 | 21-225_19A10 | VK1|A30/ JK1 | DIQMTQSPSSLSA SVGDRVTITC | RAS--QGIR- ----TDLG | WYQQKPGK APKRLIY | T------ ASSLQS | GVPSRFSGSGSG--- TEFTLTISRLQPEDFATYYC | LQHNG-------- -------YPWT | FGQGT KVEIK |
| iPS:392 740 | 21-225_18H12 | VK1|A30/ JK1 | DIQMTQSPSSLSA SYGDRVTITC | RAS--QGIR- ----NDLG | WYQQKPGK APKRLIY | A------ ASSLQS | GVPSRFSGSGSG--- TEFTLTISSLQPEDFATYYC | LQHNN-------- -------YPWT | FGLGT KVVIK |
| iPS:392 742 | 21-225_20B2 | VK1|A30/ JK1 | DIQMTQSPSSLSA SVGDRVNITC | RAS--QDIR- ----NDLG | WYQQKPGK APKRLIY | A------ ASSLQS | GVPSRFGSGSG--- TEFTLTISSLQPEDFATYYC | LQHYN-------- -------YPRA | FGQGT KVDIK |
| iPS:392 758 | 21-225_21G11 | VK1|A30/ JK1 | DIQMTQSPSSLSA SVGDRVTITC | RAS--QGIR- ----NDLG | WYQQKPGK APKRLIY | T------ ASSLQS | GVPSRFSGSGSG--- TEFTLTISSLQPEDFATYYC | LQHNN-------- -------YPWT | FGLGT KVVIK |
| iPS:392 790 | 21-225_20D10 | VK1|A30/ JK1 | DIQMTQSPSSLSA FVGDRVTITC | RAS--QVIR- ----NDLG | WYQQKPGV ARKRLIY | V------ AYSLQS | GVPSRFSGSTG--- TEFTLTISSLQPEDFATYYC | IQQNS-------- -------YPWT | FGQGT KVVIK |
| iPS:392 796 | 21-225_22A4 | VK1|A30/ JK1 | DIQMTQSPSSLSA SVGDRVTITC | RAS--QGIR- ----NDLG | WYQQRPGK APKRLIY | A------ ASSLQS | GVPSRFSGSRSG--- TEFTLTISSLQPEDFATYYC | LQHNS-------- -------YPWT | FGQGT KVEIK |
| iPS:392 832 | 21-225_21H8 | VK1|A30/ JK1 | DIQMTQSPSSLSA SVGDRVTITC | RAS--QDIR- ----NDLG | WYQQKPGK APKRLIY | A------ ASSLQS | GVPSRFRGSGSG--- TEFTLTISSLQPEDFATYYC | LQHNS-------- -------YPWT | FGQGT KVEIK |
| iPS:392 836 | 21-225_22F4 | VK1|A30/ JK1 | DIQMTQSPSSLSA SVGDRVTITC | RAS--QGIR- ----DDLG | WYQQKPGK APKRLIY | A------ ASSLQS | GVPSRFSGSRSG--- TDFTLTISSLQPEDFATYYC | LHHYS-------- -------YPRT | FGQGT KVEIK |
| iPS:392 844 | 21-225_23E11 | VK1|A30/ JK1 | DIQMTQSPSSRITC SVGDRVTITC | RAS--QGIR- ----NDLG | WYQQKPGK APKRLIY | A------ ASSLQS | GVPSRFSGSGSG--- TEFTLTISSLQPEDFATYYC | LQHNS-------- -------YPWT | FGQGT KVEIK |
| iPS:392 846 | 21-225_24B6 | VK1|A30/ JK1 | DIQMTQSPSSLSA SVGDRVTITC | RAS--QDIR- ----NDLG | WYQQKPGR APKRLIY | A------ ASSLHS | GVPSRFSGSGSG--- TEFTLTISSLQTEDFATYYC | LQHYS-------- -------YPWT | FGQGT KVEVK |

FIGURE 51 (Continued)

| | | | | | | | | | |
|---|---|---|---|---|---|---|---|---|---|
| iPS:392872 | 21-225_20B11 | VK1|A30/JK1 | DIQMTQSPSSLSA SVGDRVTIIC | RAS---QGIG------NDLG | WYQQKPEK APKRLIY | A------ASSLHS | GVPSRFSGSGSG--- TEFTLTISSLQPEDFATYYC | LQHYS-------YPRT | FGQGT KVEIK |
| iPS:392876 | 21-225_21F7 | VK1|A30/JK1 | DIQMTQSPSSLSA SVGDRVTIIC | RAS---QDIR------NDLG | WYQQKPGK APKRLIY | A------ASNFQS | GVPSRFSGSGSG--- TEFTLTISSLQPEDFATYYC | LQHNN-------YPWT | FGLGT KVEIK |
| iPS:392884 | 21-225_23A10 | VK1|A30/JK1 | DIQMTQSPSSLSA SVGDRVTIIC | RAS---QGIR------NDLG | WYQQKPGK APKRLIY | A------ASSLQS | GVPSRFSGSGSG--- TEFTLTIGSLQPEDFATYYC | LQHYS-------YPRT | FGLGT KVEIK |
| iPS:392894 | 21-225_21G2 | VK1|A30/JK1 | DIQMTQSPSSLSA SVGDRVTIIC | RAS---QGIR------NDLG | WYQQKPGK APKRLIY | T------SSSLQS | GVPSRFSGSGSG--- TEFTLTISSLQPEDFATYYC | LQHNS-------YPWT | FGLGT KVVIK |
| iPS:392908 | 21-225_23F12 | VK1|A30/JK1 | DIQMTQSPSSLSA SVGDRVTIIC | RAS---QGIR------NDLG | WYQQKPGK APKRLIY | V------ASSLQS | GVPSRFSGSGSG--- TEFTLTISSLQPEDFASYYC | LQHYS-------YPWT | FGQGT KVEIK |
| iPS:392914 | 21-225_25D12 | VK1|A30/JK1 | DIQMTQSPSSLSA SVGDRVTIIC | RTS---QGIR------NDLG | WYQQKFGK APKRLIY | A------ASSLQS | GVPSRFSGSGSG--- TEFTLTISSLQPEDFATYYC | LQHYS-------FPRT | FGQGT KVEIK |
| iPS:392918 | 21-225_28F5 | VK1|A30/JK1 | DIQMTQSPSSLSA SVGDRVTIIC | RAS---QGIR------NDLG | WYQQKPGK APKRLIY | I------ASSLQS | GVPSRFSGSGSG--- TEFTLTISSLQPEDFATYYC | LQHNT-------YPWT | FGQGT KVEVK |
| iPS:392958 | 21-225_28C7 | VK1|A30/JK1 | DIQMTQSPSSLSA SVGDRVTIIC | RAS---QGIR------SDLG | WYQQKPGK APKRLIY | T------ASSLQS | GVPSRFSGSGSG--- TEFTLTFSSLQPEDFATYYC | LQHNR-------YPWT | FGQGT KVEIK |
| iPS:392972 | 21-225_26A2 | VK1|A30/JK1 | DIQMTQSPSSLSA SVGDRVTIIC | RAS---QGIR------NDLG | WYQQKPGK APKRLIY | I------ASSLQS | GVPSRFSGSGSG--- TEFNITISSLQPEDFAIYYC | LQHNS-------YLWT | FGQGT KVEIT |
| iPS:393026 | 21-225_32B6 | VK1|A30/JK1 | DIQMTQSPSSLSA SVGDRVTIIC | RAS---QGIR------NDLG | WYQQKPVK APKRLIY | A------APSLQS | GVPSRFSGSGSG--- TEFTLTISSLQPEHFATYYC | LQHYS-------YPWT | FGQGT KVEIK |
| iPS:393130 | 21-225_33C2 | VK1|A30/JK1 | DIQMTQSPSSLSA SVGHRVHLTC | RAS---QNIR------NYLN | WYQQKSGR APKLLIY | V------ASSLQS | GVPSRFSGSGSG--- TEFTLTINSLQPEDFAIYHC | HQSNS-------TPLT | FGQGT KVEIK |
| iPS:393812 | 21-225_6A11 | VK1|A30/JK1 | DIQMTQSPSSRSA SVGDRVTIIC | RAS---QGIR------NDLG | WYQQKPGK ARKRLIY | T------ASSLQS | GVPSRFSGSGSG--- TEFTLTISSLQPEDFATYYC | IQHNS-------YLWT | FGQGT KVEIK |
| 21-225_6G2 | iPS:393838 | VK1|A30/JK1 | DIQMTQSPSSLSA FVGDRVTIIC | RAS---QGIR------NDLG | WYQQKPGK APQRLIY | A------ASSLQS | GVPSRFSGSGYG--- TEFNITISSLQPEDFAIYYC | LQHYS-------YPWT | FGQGT KVEIT |
| 21-225_4C5 | iPS:393864 | VK1|A30/JK1 | DIQMTQSPSSLSA SVGHRVHLTC | RAS---RGIR------GDLG | WYRQKPGK APTRLIY | A------ASNLQS | GVPSRFSGSGYG--- TEFTLTISSLQPEDLATYYC | LQHYS-------FPRT | FGRGT KVEIK |
| iPS:393868 | 21-225_9C11 | VK1|A30/JK1 | DIQMTQSPSSLSA SVGDRVTIIC | RAS---QGIR------NDLG | WYQQKSGR APKLLIY | A------ASSLHS | GVPSRFSGNGYG--- TEFTLTISSLQPEDFATYYC | HQSNS-------TPLT | FGQGT KVEIK |
| 21-225_9A1 | iPS:393876 | VK1|A30/JK1 | DIQMTQSPSSLSA SVGDRVTIIC | RAS---QGIR------NDLG | WYQQKPGK APKRLIY | T------ASSLQS | GVPSRFSGSGSG--- TEFTLTISSLQPEDFATYYC | IQHNS-------YLWT | FGQGT KVEIK |
| iPS:393902 | 21-225_14E10 | VK1|A30/JK1 | DIQMTQSPSSLSA SVGDRVTIIC | RTS---QGIR------NDLG | WYQHKPGK APKRLIY | A------ASSLQS | GVPSRFSGSGSG--- TEFTLTISSLQPEDFATYYC | LQHYS-------YPRT | FGQGT KVEIK |
| iPS:393908 | 21-225_10E9 | VK1|A30/JK1 | DIQMTQSPSSLSA SVGDRVTIIC | RAS---QDIR------SDLG | WYQQKPGK APTRLIP | A------ASSLQS | GVPSRFSGSGSG--- TEFTLTIINSLQPEDFATYYC | LQHYS-------YPRT | FGQGT KVEIK |
| 21-225_2G4 | iPS:393916 | VK1|A30/JK1 | DIQMTQSPSSLSA SVGDRVTIIC | RAS---QGIR------NDLG | WYQQKPGK APTRLIY | A------ASNLQS | GVPSRFSGSGYG--- TEFTLTISSLQPEDLATYYC | LQHYS-------FPRT | FGRGT KVEIK |
| iPS:393948 | 21-225_16A5 | VK1|A30/JK1 | DIQMTQSPSSLSA SVGDRVTIIC | CAS---QGIR------NDLG | CYQQKPGK APKRLIY | A------ASSLQS | GVPSRFSGSGSG--- TEFTLTISSLQPEDFATYYC | LQHNS-------YPWT | FGQGT KVEIK |
| 21-225_7G2 | iPS:393960 | VK1|A30/JK1 | DIQMTQSPSSLSA SVGDRVTIIC | RAS---QGIR------NDLG | WYQQKPGK APKRLIY | T------ASSLQS | GVPSRFSGSGSG--- TEFTLTISSLQPEDFATYYC | LQHNS-------YPWT | FGLGT KVVIK |
| 21-225_7F8 | iPS:393966 | VK1|A30/JK1 | DIQMTQSPSSLSA SVGDRVFTC | RAS---QGIG------NDLG | WYQQKPGK APKRLIY | A------ASSLQS | GVPSRFSGSVSG--- TEFTLPISSLQPEDFATYYC | LQRYT-------YPRT | FGQGT KVEIK |
| 21-225_7C9 | iPS:393972 | VK1|A30/JK1 | DIQMTQSPSSLSA SGGDRVTIIC | RAS---QGIR------NDLG | WYQQKPGK APKRLIY | A------ASSLQS | GVPSRFSGSGSG--- TEFTLTISSLQPEDFATYYC | LQLYS-------YPRT | FGQGT KVDIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:393 978 | 21-225 4C12 | VK1|A30/ JK1 | DIQMTQSPSSLSA SVGDRVTITC | RAS--QGIR- ----NDLG | WYQQKPGK APTRLIY | A------ ASSLHS | GVPSRFSGSGSG--- TEFTLTISSLQPEDLATYYC | LQHYS------------- -------FPRT | FGQGT KVEIK |
| iPS:393 986 | 21-225 7G4 | VK1|A30/ JK1 | DIQMTQSPSSLSA SVGDRVTITC | RAS--QGIR- ----NDLG | WYQQRPGK APKRLIY | A------ ASSLQS | GVPSRFSGSGSG--- TEFTLTISSLQPEDSATYYC | LHQYS------------- -------YPRT | FGRGT KVEIK |
| iPS:393 996 | 21-225 15C11 | VK1|A30/ JK1 | DIQMTQSPSSLSA SVGDRVTITC | RAS--QGIR- ----NDLG | WYQQKPGK VPKRLIY | A------ ASSLQS | GVPSRFSGSGSG--- TEFTLTISSLQPEDFATYYC | LLHYS------------- -------YPRT | FGRGT KVEIK |
| iPS:393 998 | 21-225 12B12 | VK1|A30/ JK1 | DIQMTQSPSSLSA SVGDRVTITC | RAS--QGIR- ----NDLG | WYQQKPGK APKRLIY | T------ ASSLQS | GVPSRFSGSGSG--- TEFTLTISSLQPEDFATYYC | LQHNS------------- -------YPWT | FGLGT KVVIK |
| iPS:394 041 | 21-225 5E5 | VK1|A30/ JK1 | DIQMTQSPSSLSA SVGDRVTITC | RAS--QGIR- ----NDLG | WYQQKPGK APKRLIY | A------ ASSLQS | GVPSRFSGSGSG--- TEFTLTISSLQPEDFATYYC | LQHYS------------- -------YPRI | FGQGT KVEVK |
| iPS:394 067 | 21-225 12F2 | VK1|A30/ JK1 | DIQMTQSPSSLSA SVGDRVTITC | RAS--QGIR- ----NDLG | WYQQKPGK APKRLIY | A------ ASSLQS | GVPSRFSGSGSG--- TEFTLTISSLQPEDFVTYYC | LQHNS------------- -------YPWT | FGQGT KVEIK |
| iPS:394 089 | 21-225 12E6 | VK1|A30/ JK1 | DIQMTQSPSSLSA SVGDRVTITC | RAS--QGIR- ----SDLG | WYQQKPGK APKRLIY | A------ ASSLQS | GVPSRFSGSGSG--- TEFTLTISSLQPEDFATYYC | LQHNS------------- -------YPWT | FGQGT KVEIK |
| iPS:394 093 | 21-225 9D12 | VK1|A30/ JK1 | DIQMTQSPSSLSA SVGDRVTITC | RAS--QGIR- ----NDLG | WYQQKPGK APKRLIY | A------ ASSLQS | GVPSRFSGSGSG--- TEFTLTISSLQPEDFATYYC | LQHNS------------- -------YPWT | FGQGT KVEIK |
| iPS:394 095 | 21-225 16H4 | VK1|A30/ JK1 | DIQMTQSPSSLSA SVGDRVTITC | RAS--QGIR- ----NDLG | WYQQKPGK APKRLIY | T------ ASSLQS | GVPSRFSGSGSG--- TEFTLTISSLQPEDFATYYC | LQHNS------------- -------YPWT | FGQGT KVEIK |
| iPS:394 097 | 21-225 16G7 | VK1|A30/ JK1 | DIQMTQSPSSLSA SVGDRVTITC | RAS--QGIR- ----NDLG | WYQQKPGK APKRLIY | G------ ASTRAT | TEFTLTISSLQPEDFVTYYC | LQHNS------------- -------YPWT | FGQGT KVEIK |
| | Germline | VK3|L2/JK2 | | | | | | | |
| iPS:468 828 | 21-225 162A1 | VK3|L2/J K2 | EIVMTQSPATLSV SPGERATLSC | ----SNLA | WYQQKSCQ APRLLIF | V------ ASTRAT | VIPARINGSGSG--- TEFTLTISSLRSEDFAVYFC | QQYND------------- -------WPCS | FGQGT KLEIK |
| iPS:434 255 | 21-225 62E6 | VK3|L2/J K2 | EIVMTQSPATLSV SPGERATLSC | RAS--QSVN- ----SNLA | WYQQKPGQ APRLLIS | V------ ASTRAT | GIPARFNGSGSG--- TEFTLTISSLQSEDFAVYYC | QQYND------------- -------WPCS | FGQGT KLEIK |
| iPS:434 269 | 21-225 57H3 | VK3|L2/J K2 | EIVMTQSPATLSV SPGERATLSC | RAS--QSVS- ----SSLA | WYQQKPGQ APKRLIY | G------ ASTRAT | GFPARFNGSGSG--- TEFTLTISSLQSEDFAIYYC | QQYND------------- -------WPCS | FGQGT KLEIK |
| iPS:434 363 | 21-225 65A6 | VK3|L2/J K2 | EIVMTQSPATLSV SPGERATLSC | RAS--QSVN- ----SNLA | WYQQKPGQ APRLLIS | V------ ASTRAT | GIPARFNGSGSW--- TEFTLTISSLQSEDFAVYYC | QQYND------------- -------WPCS | FGLET KLEIK |
| iPS:434 393 | 21-225 67C3 | VK3|L2/J K2 | EIVMTQSPATLSV SPGERATLSC | RAS--QSVN- ----SNLA | WYQQKPGQ APRLLIS | I------ ASTRAT | GIPARFNGSGSG--- TEFTLTISSLQSEDFAVYYC | QQYND------------- -------WPCS | FGQGT KLEIK |
| iPS:434 425 | 21-225 70A5 | VK3|L2/J K2 | EIVMTQSPATLSV SPGERATLSC | RAS--QSVN- ----SNLA | WYQLKPGQ APRLLIS | I------ ASTRAT | GIPPRFNGSGSG--- TEFTLTISSLQSEDFAVYYC | QQYND------------- -------WPCS | FGQGT KLEIK |
| iPS:434 485 | 21-225 76D2 | VK3|L2/J K2 | EIVMTQSPATPSV SPGERATLSC | RAS--VSVV- ----NSLA | WYQQKPSQ APRLLIH | G------ ASTRAT | GIPARFSGSGSG--- TEFTLTISSVQSEDFAVYYC | QQYND------------- -------WPCS | FGQGT KLEIK |
| iPS:434 537 | 21-225 74E11 | VK3|L2/J K2 | EIVMTQSPATLSV SPGERATLSC | RAS--LSVV- ----NSLA | WYQQKPGQ APRLLIF | G------ ASTRAT | GIPARFNGSGSG--- TEFTLTISSLQSEDFAIYYC | QQYND------------- -------WPCS | FGQGT KLEIK |
| iPS:434 569 | 21-225 77H5 | VK3|L2/J K2 | EIVMTQSPVTLSV SPGERATLSC | RAS--QSVS- ----SSLA | WYQQKPGL APRLLIY | G------ ASTRAT | GIPARFSGSGSG--- TEFSFTISSLQSEDFAVYFC | QQYND------------- -------WPCS | FGQGS KLEIQ |
| iPS:434 629 | 21-225 74C3 | VK3|L2/J K2 | EIVMTQSPATLSV SPGERATLSC | RAS--QSVA- ----SSLA | WYQQKPGQ APRLLIF | I------ TSTRAT | GIPARFNGSGSG--- TEFTLTISSLQSEDFAVYYC | QQYND------------- -------WPCS | FGLGT KLEIK |
| iPS:434 673 | 21-225 74E3 | VK3|L2/J K2 | EIVMTQSPATLSL SPGERATLSC | RAS--LSVV- ----NSLA | WYQQKPGQ APRLLIY | G------ ASTRAT | GIPARFSGSGSG--- TEFTLTISSLQSEDFAIYYC | QQYND------------- -------WPCS | FGQGT KLEIK |

FIGURE 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:435 109 | 21-225_92H5 | VK3\|L2\|J K2 | EIVMTQSPATLSV SPGERATLSC | RAS---QDVI------TYLA | WYQQKPGQ APRLLIY | G-------ASTRAT | GVPARFSGSGSG-- TEFTLTITSLQSEDFALYYC | QEYND---------WPCS | FGQGT KLEIK |
| iPS:435 221 | 21-225_95G2 | VK3\|L2\|J K2 | EIVMTQSPATLSL SPGERATLSC | RAS---MSVV------NSLA | WYQQKPGQ APRLLIY | G-------ASTRAT | GIPARFSGSGSG-- TEFTLTISSLQSEDFAVYYC | QQYND---------WPCS | FGQGT KLEIK |
| iPS:436 051 | 21-225_193G1 | VK3\|L2\|J K2 | EIVMTQSPATLSV SPGERATLSC | RAS---QSVS------SSLA | WYQQKPGQ APRLIS | G-------ASTRAT | GIPARFSGSGSG-- TEFTLTISSLQSADFAVYYC | QQYNN---------WPCS | FGQGT KLEIK |
| iPS:436 236 | 21-225_201F7 | VK3\|L2\|J K2 | EIVMTQSPATLSV SPGERATLSC | RAS---QNIK------NNLA | WYQQKPGQ APRLLIF | G-------ASTRAT | GIPARFSGSGSG-- TEFTLTISSLQSEDFAVYYC | QQFYN---------WLCS | FGQGT KLELK |
| iPS:436 250 | 21-225_201A4 | VK3\|L2\|J K2 | EIVMTQSPATLSV SPGERATLSC | RSS---QNIK------SNLA | WYQQKPGQ APRLLIF | G-------ASTRAT | GIPARFSGSGSG-- TEFTLTISSLQSEDFAVYYC | QQFYN---------WLCS | FGQGT KLELK |
| iPS:436 252 | 21-225_202A8 | VK3\|L2\|J K2 | EIVMTQSPATLSV SPGERATLSC | RAS---QRIN------NNLA | WYQQNPGQ APRLLIY | G-------ASTRAT | GVPARFSGSGSG-- TEFTLTISSLQSEDFTVYYC | QQYYN---------WLCS | FGQGT KLEIR |
| iPS:436 258 | 21-225_202F12 | VK3\|L2\|J K2 | EIVMTQSPATLSV SPGERATLSC | RAS---QSVL------NNLA | WYQQRPGQ APRLLIY | G-------ASTRAT | GIPARFSGSGSG-- TEFTLTISSLQSEDFAVYYC | QQYDN---------WPPCS | FGQGT KLEIN |
| iPS:436 278 | 21-225_201F2 | VK3\|L2\|J K2 | EIVMTQSPATLSV SPGERATLSC | RAS---QNIK------SNLA | WYQQKPGQ APRLLIF | G-------ASTRAT | GIPARFSGSGSG-- TEFTLTISSLQSEDFAVYYC | QQYYN---------WLCS | FGQGT KLELK |
| iPS:436 294 | 21-225_205G4 | VK3\|L2\|J K2 | EIVMTQSPATLSV SPGERATLSC | RAS---QNIK------SNLA | WYQQKPGQ APRLLIF | G-------ASTRAT | GIPARFSGSGSG-- TEFTLTISSLQSEDFAVYYC | QQFYN---------WLCS | FGQGT KLELK |
| iPS:436 306 | 21-225_201H4 | VK3\|L2\|J K2 | EIVMTQSPATLSV SPGERATLSC | RAS---QSVN------SYLA | WYQQNPGQ APRLLIY | G-------ASTRAT | GIPARFSGSGSG-- TEFTLTISSLQSEDFAVYYC | QEYND---------WLCS | FGQGT NLEIK |
| iPS:436 356 | 21-225_210H1 | VK3\|L2\|J K2 | EIVMTQSPATLSV SPGERATLSC | RAS---QSVK------SNLA | WYQQRPGQ APRLLIY | F-------ASTRAI | GIPARFSGSGSG-- TEFTLTISSLQSEDFAVYYC | QQYYN---------WPCS | FGQGT KLEIK |
| iPS:436 382 | 21-225_212C1 0 | VK3\|L2\|J K2 | EIVMTQSPATLSV SPGERATLSC | RAS---QSVA------SSLA | WYQQKPGQ APRLLIH | G-------TSTRAT | DVPARFSGFGSG-- SDFTLTISLQSEDFAVYSC | QQYND---------WPCS | FGQGT KLEIK |
| iPS:436 434 | 21-225_216B1 0 | VK3\|L2\|J K2 | EIVMTEQSPATLSV SPGERATLSC | RAS---QSVN------NNLA | WYRQKPGQ AFRLLIY | G-------ASTRAT | GIPPRFSGSGSG-- TEFTLSISSLQSEDFAVYYC | QQYND---------WPCS | FGQGT KLEIR |
| iPS:392 806 | 21-225_24H3 | VK3\|L2\|J K2 | EIVMTQSPATLSV SPGERATLSC | RAS---QSVS------SNLA | WYQQKPGQ APRLLIY | G-------ASTRAI | GIPARFSGSGSG-- TEFTLTISSLQSEDFAVYYC | QQYNN---------WPMCS | FGQGT KLEIK |
| | | Germline VK3\|L2\|K4 | | | | | | | |
| iPS:468 830 | 21-225_191G1 1 | VK3\|L2\|J K4 | EIVMTQSPATLSV SPGERANLSC | RTS---QSVW------ISVA | WYHQKPGQ APRLLIY | G-------AATRAT | GIPARFSGSGSG-- TEFTLTISSLQSEDFAVYYC | QQYNY---------WPLT | FGGGT KVEIK |
| iPS:434 147 | 21-225_55E1 | VK3\|L2\|J K4 | EIVMTQSPATLSV SPGERATLSC | RAS---QSVS------SDLA | WYQLKPGQ APRLLIY | D-------ASARAT | GIPARFSGSGSG-- TEFTLTISSLQSEDFFAVYYC | QQYNN---------WPLT | FGGGT KVEIK |
| iPS:434 621 | 21-225_74D1 | VK3\|L2\|J K4 | EIVMTQSPATLSV SPGERATLSC | RAS---QSVS------RNLA | WFQQKPGQ APRLLIY | G-------ASARAT | GIPARFSGSGSG-- TEFTLTISSLQSEDFAVYYC | QQYNN---------WPPLT | FGGGT KVEIK |
| iPS:435 821 | 21-225_190E1 1 | VK3\|L2\|J K4 | EIVMTQSPATLSV SPGERATLSC | RAS---QSFR------INLA | WYQGRPGQ APRLLIY | G-------ASTRAT | GIPARFSGSGSG-- TEFTLTISSLQSEDFAVYYC | QQYNN---------WPLT | FGGGT KVEIK |
| iPS:435 941 | 21-225_191E8 | VK3\|L2\|J K4 | EIVMTQSPATLSV SPGERATLSC | RPS---QSFS------RNLA | WYQQKPGQ APRLLIY | G-------ASTRAT | GIPSRFSGSGSG-- TEFTLTISSLESEDFAVYYC | QQYNN---------WPLT | FGGGI KVEIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:436 203 | 21-225 199A6 | VK3L2/J K4 | DIVMTQSPATLSV SPGDRATLSC | RPS--QSFS------RNLA | WYQQKPGQ APRLLIY | G------ASTRAT | GIPARFSGSGSG------TEFTLTISSLECEDFAVYYC | QQYNN---------WPLT | FGGGT KVEIK |
| iPS:437 334 | 21-225 75F11 | VK3L2/J K4 | EIVMTQSPATLFV SPGERATLSC | RAS--QSVS------RNLA | WFQQKPGQ APLLLFY | G------ASIRAT | GIPARFSGSGSG------TEFTLTIYSLQYEDFAVYYC | QQYNN---------WPLT | FGGGT KVEIK |
| iPS:448 904 | 21-225 65C12 | VK3L2/J K4 | EIVMTQSPATLSV FPGEGATLSC | RAS--QSVS------INLA | WYQQKPGQ APRLLIY | G------ASTRAT | GIPARFNASGSG------TEFTLSISSLQSENFAVYYC | QQYNT---------WPLT | FGGGT KVEIK |
| | | Germline | K_FR1 | K_CDR1 | K_FR2 | K_CDR2 | K_FR3 | K_CDR3 | K_FR4 |
| | VK1A30JK3 | | | | | | | | |
| iPS:468 832 | 21-225 76H10 | VK1A30/ JK3 | DIQMTQSPSSLSA SAGDRVTITC | RAS--QDIR------NYLG | WYQQKPGK APKRLIY | ASSLQS | GVPSRFSGSGSG------TEFTLTISSLQPEDFATYYC | LQYNS---------YPFT | FGPGT KVDIK |
| iPS:468 836 | 21-225 198E3 | VK1A30/ JK3 | DIQMTQSPSSLSA SVGDRVTITC | RAS--QGIR------KDLG | WYQQKPGK APKRLIY | ASSLQS | GVPSRFSGSGSG------TEFTLTISSLQPEDFATYYC | LQHYR---------YPFT | FGPGT KVDIK |
| iPS:468 844 | 21-225 48E10 | VK1A30/ JK3 | DIQMTQSPSSLSA SVGDRVTITC | RAS--QGIR------SDLG | WYQQKPGK APKRLIY | T------ASSLQS | GVPSRFSGSGSG------TEFTLTISSLQPEDFATYYC | LQYNS---------YPFT | FGPGT KVDIK |
| iPS:468 846 | 21-225 53B10 | VK1A30/ JK3 | DIQMTQSPSSLSA SAGDRVTITC | RAS--QDIR------NYLG | WYQQKPGK APKRLIY | G------ASSLQS | GVPSRFSGSGSG------TEFTLTISSLQPEDFATYYC | LQYNS---------YPFT | FGPGT KVDIK |
| iPS:433 895 | 21-225 43E1 | VK1A30/ JK3 | DIQMTQSPSSLSA SVGDRVTITC | RAS--QGIR------NDLG | WYQQKPGK APKRLIN | A------ASSLQS | GVPSRFSGSGSG------TEFTLTISSLQPEDFATYYC | LQHNS---------YPFT | FGPGT KVDIK |
| iPS:433 905 | 21-225 43E5 | VK1A30/ JK3 | DIQMTQSPSFSLSA SVGDRVTITC | RAS--QGIR------NDLG | WYQQKPGK APKRLIY | G------ASNLQS | GVPSRFSGSGSG------TEFTLTVSSLQPEDFATYFC | LQHTS---------FPFT | FGPGT KVDIK |
| iPS:433 913 | 21-225 43H8 | VK1A30/ JK3 | DIQMTQSPSSLSA SVGDRVTITC | RAS--QGIR------NDLG | WHQQKPGK APKRLIY | A------ASSLQS | GVPSRFSGSGSG------TEFTLTISSLQPEDFATYYC | LQHNS---------FPFT | FGPGT NVDIK |
| iPS:433 933 | 21-225 44C8 | VK1A30/ JK3 | DIQMTQSPSSLSA SVGDRVTITC | RAS--QGIR------NDLG | WYQQKPGK AFKRLIY | A------ASNLQS | GVPSRFSGSRSG------TEFTLTISSLQPEDFATYYC | LQHNS---------YPFT | FGPGT KVDIK |
| iPS:433 949 | 21-225 45H2 | VK1A30/ JK3 | DIQMTQSPSSLSA SVGDRVTITC | RAS--QGIR------NDLG | WYQQKPGK APKRLIY | G------ASNLQS | GVPSRFSGSGSG------TEFTLTISSLQPEDFATYFC | LQHTS---------FPFT | FGPGT KVDIK |
| iPS:433 981 | 21-225 46E9 | VK1A30/ JK3 | DIQMTQSPSSLSA SVGDRVTITC | RAS--QGIR------NDLG | WYQQKPGK APKRLIY | A------ASSLQR | GVPSRFSGSGSG------TEFTLTVSSLQPEDFATYFC | LQHTS---------FPFT | FGPGT KVDIK |
| iPS:433 995 | 21-225 47H7 | VK1A30/ JK3 | DIQMTQSPSSLSA SVGDRVTITC | RTS--QGIR------NDLG | WYQKKPGK APKRLIY | A------ASSLQS | GVPSRFSGSGSG------TEFTLTVSSLQPEDFATYFC | LQHTS---------FPFT | FGPGT KVDIK |
| iPS:434 039 | 21-225 43B1 | VK1A30/ JK3 | DIQMTQSPSSLSA SVGDRVTITC | RAS--QGIR------NDLG | WYQQKPGK APKRLIY | A------ASSLQS | GVPSRFSGSGSG------TEFTLTISSLQPEDFATYFC | LQHTS---------FPFT | FGPGT KVDIK |
| iPS:434 057 | 21-225 51E4 | VK1A30/ JK3 | DIQMTQSPSSLSA SVGDRVTITC | RAS--QGIR------NDLG | WYQQKPGK APQRLIY | A------ASSLQS | GVPSRFSGSGSG------TEFTLTISSLQPEDFAAYYC | LQHNS---------YPFT | FGPGT KVDIK |
| iPS:434 071 | 21-225 51F9 | VK1A30/ JK3 | DIQMTQSPSSLSA SVGDRVTITC | RAS--QGIR------TDLG | WYQQKPEK APKRLIY | A------ASSLQR | TDFTLTISSLQPEDFASYYC | LQHNS---------YPFT | FGPGT KVDIK |
| iPS:434 075 | 21-225 51B11 | VK1A30/ JK3 | AIQMTQSPSSLSA SVGDRVTITC | RTS--QGIR------NDLG | WYQQKFRK APKRLIY | A------ASSLQS | GVPSRFSGSGSG------TEFTLTISSLQPEDFATYYC | LQHNS---------YPFT | FGPGT KVDIK |
| iPS:434 091 | 21-225 52B9 | VK1A30/ JK3 | AIQMTQSPSSLSA SVGDRVTITC | RAS--QGIR------NDLG | WYQQKPRK APKRLIY | A------ASSLQS | GVPLRFSGSGSG------TEFTLTISSLQPEDFATYYC | LQHNS---------YPFT | FGPGT KVDIK |
| iPS:434 101 | 21-225 52H12 | VK1A30/ JK3 | DIQMTQSPSSLSA SVGDRVTITC | RAS--QGIR------MNLG | WYQQKPGK APKRLIY | G------ASSLQS | GVPSRFSGSGSG------TEFTLTISSLQPEDFATYYC | LQYNS---------YPFT | FGPGT NVDIK |
| iPS:434 103 | 21-225 53G1 | VK1A30/ JK3 | DIQMTQSPSSLSA SVGDRVTITC | RAS--QGIR------NDLG | WYQQKPGK APKRLIY | P------ASSLQS | GVPSRFSGSGSG------TEFSJTISSLQPEDFATYYC | LQDNS---------YPFT | FGPGT KVDIK |
| iPS:434 129 | 21-225 53B12 | VK1A30/ JK3 | DIQMTQSPSSLSA SVGDRVTITC | RAS--QGIR------NDLG | WYQQKPGK APKRLIY | A------ASSLQS | GVPSRFSGSGSG------TEFTLTISSLQPEDFATYYC | LQHNS---------YPFT | FGPGT KVDIK |

FIGURE 51 (Continued)

| | | | | | | | | | |
|---|---|---|---|---|---|---|---|---|---|
| iPS:434 131 | 21- 225_54D3 | VK1|A30/ JK3 | DIQMTQSPSSLSA SVGDRVTITC | RAS--QGIR- -----NDLG | WYQQKPGK APKRLIY | A------- ASSLQS | GVPSRFSGSGSG--- TEFTLTISSLQPEDFATYYC | LQHNS------------- --------YPFT | FGPGT KVDIK |
| iPS:434 143 | 21- 225_54G7 | VK1|A30/ JK3 | DIQMTQSPSSLSA SVGDRVTITC | RAS--QGIR- -----NDLG | WYQQKPGK APKRLIY | A------- ASSLQS | GVPSRFSGSRSG--- TEFTLTISSLQPEDFASYYC | LHHNT------------- --------YPFT | FGPGT KVDIK |
| iPS:434 155 | 21- 225_55B3 | VK1|A30/ JK3 | DIQMTQSPSSLSA SVGDRVTITC | RAS--QGIR- -----NDLG | WYQQKPGK APKRLIY | A------- ASSLQS | GVPSRFSGSGSG--- TEFTLTISSLQPEDFATYYC | LQHNS------------- --------YPFT | FGPGT KVDIK |
| iPS:434 169 | 21- 225_50C4 | VK1|A30/ JK3 | DIQMTQSPSSLSA SVGDRVTITC | RAS--QGIR- -----NDLG | WYQQKPGI APKRLIY | A------- ASSLQS | GVPSRFSGSGSG--- TEFTLTISSLQPEDFATYYC | LQHNR------------- --------YPFT | FGPGT KVDIK |
| iPS:434 187 | 21- 225_56A5 | VK1|A30/ JK3 | DIQMTQSPSSLSA SVGDRVTITC | RAS--QDIR- -----NLLG | WYQQKPGK APKRLIY | A------- ASSLQS | GVPSRFSGSGSG--- TEFTLTISSLQPEDFATYYC | LQYNS------------- --------YPFT | FGPGT KVDIR |
| iPS:434 199 | 21- 225_59F11 | VK1|A30/ JK3 | DIQMTQSPSSLSA SVGDRVTITC | RAS--QGIR- -----NDLG | WYQQKPGK APKRLIY | A------- ASSLQS | GVPSRFSGSGSG--- TEFTLTISSLQPEDFATYYC | LQHNR------------- --------YPFT | FGPGT KVDFK |
| iPS:434 207 | 21- 225_60A3 | VK1|A30/ JK3 | DIQMTQSPSSLSA SVGDRVTITC | RAS--QGIR- -----NDLG | WYQQKPGK APKRLIY | A------- AFSLQS | GVPSRFSGSGSG--- TEFTLTISSLQPEDFATYYC | LQHNS------------- --------YPFT | FGPGT KVDIK |
| iPS:434 251 | 21- 225_62G3 | VK1|A30/ JK3 | DIHMTQSPSSLSA SVGDRVTITC | RAS--QDIR- -----NNLG | WYQQKPGK APKRLIY | T------- ASSLQS | GVPSRFSGSGSG--- TEFTLTISSLQPEDFATYYC | LQYNS------------- --------YPFT | FGPGT KVDIK |
| iPS:434 263 | 21- 225_56H7 | VK1|A30/ JK3 | DIQLTQSPSSLSA SVGDRVTITC | RAS--QGIR- -----NDLG | WYQQRPGK APKRLIY | P------- ASSLLS | GVPSRFSGSGSG--- TEFTLTISSLQPEDFATYYC | LQDNS------------- --------YPFT | FGPGT KVDSK |
| iPS:434 265 | 21- 225_57B2 | VK1|A30/ JK3 | DIQMTQSPSSLSV SVGDRVTITC | RAS--QDIR- -----NALG | WYQQKPGK APKRLIY | A------- ASSLQS | GVPSRFSGSGSG--- TEFTLTISSLQPEDFATYYC | LQHNS------------- --------YPFT | FGPGT KVDIK |
| iPS:434 271 | 21- 225_57A4 | VK1|A30/ JK3 | DIQMTQSPSSLSA SVGDRVTITC | RAS--QGIR- -----NDLG | WYLQKFGK APKRLIY | A------- ASSLLS | GVPSRFSGSGSG--- TEFTLTISSLQPEDFATYYC | LQHNS------------- --------YPFT | FGPGT KVDIK |
| iPS:434 275 | 21- 225_57F4 | VK1|A30/ JK3 | DIQMTQSPSSLSA SVGDRVTITC | RAS--QVIR- -----NDLG | WYQQKPGK APNRLIY | T------- ASTLQS | GVPSRFSGSGSG--- TEFTLTISSLQPEDFATYHC | LQYGS------------- --------FPFT | FGPGT KVDIK |
| iPS:434 293 | 21- 225_58F5 | VK1|A30/ JK3 | DIQMTQSPSSLSA SVGDRVTITC | RAS--QGIR- -----NDLG | WFLQTPGK APKRLIY | A------- ASSLQS | GVPSRPGGSGSG--- TEFTLTISSLQPEDFATYYC | LQHNS------------- --------YPFT | FGPGT KVEIK |
| iPS:434 299 | 21- 225_58D11 | VK1|A30/ JK3 | DIQMTQSPSSLSA SVGDRVTITC | RAS--QGIR- -----SDLD | WYQQKPGK APKRLIY | A------- ASSLLS | GVPSRFSGSGSG--- TEFTLAISSLRPEDFATYYC | LQHNN------------- --------FPFT | FGPGT KVDIK |
| iPS:434 351 | 21- 225_64A12 | VK1|A30/ JK3 | DIQMTQSPSSLSA SVGDRVTITC | RAS--QGIR- -----NDLG | WYQQKPGK APTRLIY | T------- ASTLQS | GVPSRFSGSGSG--- TEFTLTISSLQPEDFATYYC | LQHNG------------- --------YPFT | FGPGT KVDIK |
| iPS:434 383 | 21- 225_66F9 | VK1|A30/ JK3 | DIQMTQSPSSLSA SVGDRVTITC | RAS--QDIR- -----NVLG | WYQQKPGK APKRLIY | T------- ASSLQS | GVPSGFSGSGSG--- TEFTLTISSLQPEDFATYYC | LQYNS------------- --------YPFT | FGPGT KVDIK |
| iPS:434 399 | 21- 225_67B7 | VK1|A30/ JK3 | DIQMTQSPSSLSA SVGDRVTITC | RAS--QGIR- -----NDLG | WFQQKPGK APKRLIY | A------- ASSLQS | GVPSRFSGSGSG--- TEFSLTISSLQPEDFATYYC | LHHNS------------- --------YPFK | FGPGT KVDIK |
| iPS:434 407 | 21- 225_68G8 | VK1|A30/ JK3 | DIQMTQSPSSLSA SVGDRVTITC | RAS--QGRGK -----NNLG | WYQQRPGK APKRLIY | A------- ASSVQS | GVPSRFSGSGSG--- TEFTLTISSLQPEDFATYYC | LQYNS------------- --------YPFT | FGPGT KVDIK |
| iPS:434 447 | 21- 225_71B6 | VK1|A30/ JK3 | DIQMTQSPSSLSA SVGDRVTITC | RAS--QDIR- -----NDLD | WYQQKFGK APQRLIY | A------- ASSLQS | GVPSRFSGSGSG--- TEFTLTISSLQPEDFATYYC | LQHNS------------- --------YPFT | FGPGT KVDIK |
| iPS:434 449 | 21- 225_71H6 | VK1|A30/ JK3 | DIQMTQSPSSLSA SVGDRVTITC | RAS--QGIR- -----NVLG | WYQQKPGK APKRLIY | A------- ASSLQS | GVPSGFSGSGSG--- TEFTLTISSLQPEDFTTYYC | LQHNT------------- --------YPFT | FGPGT KVDIK |
| iPS:434 453 | 21- 225_71B11 | VK1|A30/ JK3 | DIQMTQSPSFSA SVGDRVTITC | RAS--QGIR- -----NDLG | WYQQTPGK APKRLIY | A------- ASNLQS | GVPSRFSGSGSG--- TEFTLTISSLQPEDFATYYC | LQHNS------------- --------YPFT | FGPGT KVCVK |
| iPS:434 463 | 21- 225_73A6 | VK1|A30/ JK3 | DIQMTQSPSSLSA SVGDRVTITC | RAS--QGIR- -----NDLG | WFQQKPGK APKRLIY | A------- ASNLQS | GVPSRFSGSGSG--- TEFTLTISSLQPEDFATYYC | LQHNS------------- --------YPFT | FGPGT KVDIK |
| iPS:434 815 | 21- 225_74A11 | VK1|A30/ JK3 | DIQMTQSPSSLSA SVGDRVTITC | RAS--QDIR- -----NDLG | WYQQKPGK APKRLIC | A------- ASSLQS | GVPSRFSGSGSG--- TEFTLTISSLQPEDFATYFC | LQHND------------- --------YPFT | FGPGT KVDIK |

FIGURE 51 (Continued)

| ID | Name | Germline | | | | | | | | |
|---|---|---|---|---|---|---|---|---|---|---|
| iPS:434 977 | 21-225_88A5 | VK1|A30/JK3 | DIQMTQSPSSLSA SVGDRVTITC | RAS---QGIR- ----NDLG | WYQQKPGK APKRLIY | A------ ASSLQS | GVFSRFSGSGSG--- TEFTLTISSLQPEDFATYYC | LQHND------- ------YPFT | FGPGT KVEIK |
| iPS:435 253 | 21-225_96A4 | VK1|A30/JK3 | DIQMTQSPSSLSA SVGDRVTITC | RAS---QDIR- ----NDLG | WYQQKPGK APKRLIY | G------ VSSLQS | GVFSRFSGSGSG--- TEFTLTISSLQPEDFATYYC | LQHND------- ------YPFT | FGRGT RVDIK |
| iPS:435 511 | 21-225_157C3 | VK1|A30/JK3 | DIQMTQSPSSLSA SVGDRVTITC | RAS---QGIR- ----NDLG | WYQQKPGK APKRLIY | A------ ASSLQS | GVFSRFSGSGSG--- TDFTLTISSLQPEDFATYYC | LQHNS------- ------YPFI | FGPGT KVDIK |
| iPS:435 521 | 21-225_157H4 | VK1|A30/JK3 | DIQMTQSPSSLSA SVGDRVTITC | RAS---QGIR- ----NDLG | WYQQKPGK APKRLIY | P------ ASSLQT | GVFSRFSGSGSG--- TEFTLTISSLQPEDFATYYC | LQDNS------- ------YPFT | FGPGT KVDIK |
| iPS:435 527 | 21-225_157G7 | VK1|A30/JK3 | DIQMTQSPSSLCA SVGDRVTITC | RAS---QGIR- ----NDLG | WYQQKPGK APKRLIY | V------ ASSLQS | GVFSRFSGSGSG--- TEFTLTISSVQREDFATYYC | IQDNS------- ------HPFT | FGPGT RVEIK |
| iPS:435 533 | 21-225_157H8 | VK1|A30/JK3 | DIQMTQSPSSLSA SVGDRVTITC | RAS---QGIR- ----NDLG | WYQQKPGK APKRLIY | A------ ASSLQS | GVFSRFSGSGSG--- TDFTLTISSLQPEDFATYYC | LQHNS------- ------YPFT | FGPGT KVDIK |
| iPS:435 537 | 21-225_157H1 2 | VK1|A30/JK3 | DIQMTQSPSSLSA SVGDRVTITC | RAS---QGIR- ----NDFG | WYQQRPGK APKCLIH | A------ ASSLQS | GVFSRFSGSGSG--- TEFTLTISSLQPEDFATYYC | LQHYS------- ------YPFT | FGPGT KVDIK |
| iPS:435 547 | 21-225_158F5 | VK1|A30/JK3 | DIQMTQSPSSLSA SVGDRVTITC | RAS---QGIR- ----NDLG | WYQQKPGK APKRLIN | A------ ASSLQS | GVPSRFSGSGSG--- TEFTLTISSLQPEDFATYYC | LQDNS------- ------HPFT | FGPGT KVEIK |
| iPS:435 551 | 21-225_158H6 | VK1|A30/JK3 | DIQMTQSPSSLSA SVGDRVTITC | RAS---QGIR- ----SDLG | WYQQKPGN APKRLIY | T------ ASSLQS | GVPSRFSGSGSG--- TEFTLTISSLQPEDFATYYC | LQHNS------- ------YPFT | FGPGT KVDIK |
| iPS:435 553 | 21-225_158G8 | VK1|A30/JK3 | DIQMTQSPSSLSA SVGDRVTITC | RAS---QDIR- ----NDLG | WYQQKPGK APKRLMY | T------ ASSLQS | GVPSRFSGSGSG--- TEFTLTISSLQPEDFATYYC | LQHNS------- ------YFFT | FGPGT KVDIK |
| iPS:435 569 | 21-225_159C5 | VK1|A30/JK3 | DIQMTQSPSSLSA SVGDRVTITC | RTS---QGIR- ----NDLG | WYQQKPGK APKRLIY | A------ ASSLQS | GVPSRFSGSGSG--- TDFTLTISSLQPEDFATYYC | LQHNS------- ------YFFT | FGPGT KVDIK |
| iPS:435 593 | 21-225_160F4 | VK1|A30/JK3 | DIQMTQSPSSPSA SVGDRVTITC | RAS---QGIR- ----NDLG | WYQQKPGK APKRLIN | V------ ASSLQS | GVPSRFSGSGSG--- TEFTLTISSVQREDFATYYC | IQDNS------- ------HFFT | FGPGT KVEIK |
| iPS:435 609 | 21-225_161F7 | VK1|A30/JK3 | DIQMTQSPSSLSA SVGDRVTITC | RAS---QGIR- ----NELG | WYQQKPGE APKRLIY | A------ ASTLQS | GVPSRFSGSGSG--- AEFTVTIGSVQREDFATYYG | LLYIR------- ------YFFT | FGRGT RVDIK |
| iPS:435 613 | 21-225_161D1 | VK1|A30/JK3 | DIQMTQSPSSLSA SVGDRVTITC | RAS---QGIR- ----NELG | WYQQKPGE APKRLIY | A------ ASTLQS | GVPSRFSGSGSG--- AEFTLTIGSVQREDFATYYG | LQYNR------- ------YPFT | FGRGT KVDIK |
| iPS:435 617 | 21-225_162F2 | VK1|A30/JK3 | DIQMTQSPSSLCA SVGDRVTITC | RAS---QGIR- ----NDLG | WYQQKPGK APKRLIN | A------ ASSLQS | GVPSRFSGSGSG--- TEFTLTISSVQPEDFATYYC | IQDNS------- ------HPFT | FGPGT KVDIK |
| iPS:435 621 | 21-225_162H3 | VK1|A30/JK3 | DIQMTQSPSSLSA SVGDRVTITC | RAS---QDIR- ----NDLG | WYQQKPGK APKRLIN | A------ ASSLQS | GVPSRFSGSGSG--- TEFTLTISSLQPEDFATYYC | LQDNS------- ------YPFT | FGPGT KVEIK |
| iPS:435 637 | 21-225_163E2 | VK1|A30/JK3 | DIQMTQSPSSLSA SVGDRVTITC | RAS---QDLG- ----NDLG | WYQQKPGK APTRLIY | A------ ASSLQS | GVPSRFSGSGSG--- TEFTLTISSLQPEDFATYYC | LQHNS------- ------HPFT | FGPGT KVDIK |
| iPS:435 641 | 21-225_163F9 | VK1|A30/JK3 | DIQMTQSPSSLSA SVGDRVTITC | RAS---QGIR- ----DDLG | WYQQKPGK APKRLIY | P------ ASSLQS | GVPSRFSGSGSG--- TEFTLTISSLQPEDFAAYYC | LQDNS------- ------YPFT | FGPGT KVDIK |
| iPS:435 643 | 21-225_163G1 | VK1|A30/JK3 | DIQMTQSPSSLSA SVGDRVTITC | RAS---QDIR- ----NNLG | WYQQKPGK APKRLIY | P------ ASSLQS | GVPSRFSGSGSG--- TEFTLTIGSVQPEDFATYYC | LQDYS------- ------YPFT | FGPGT KVDIK |
| iPS:435 719 | 21-225_171A1 | VK1|A30/JK3 | DIQMTQSPSSLSA SVGDRVTITC | RAS---QGIR- ----NNLG | WYQQKPGK APKRLIY | A------ ASSLQS | GVFSRFSGSGSG--- TEFTLTISSLQPEDFATYYC | LQHS-------- ------YPFT | FGPGT KVDIK |
| iPS:435 769 | 21-225_177B6 | VK1|A30/JK3 | DIQMTQSPSSLSA SVGDRVTITC | RAS---QDIS- ----NDLG | WYQQKPGK APKRLIY | A------ ASSLQS | GVPSRFSGSGSG--- TEFTLTINSLQPEDFATYYC | LQNS-------- ------YPFT | FGPGT KVDIK |

FIGURE 51 (Continued)

| | | | | | | | | | |
|---|---|---|---|---|---|---|---|---|---|
| iPS:435_791 | 21-225_180H7 | VK1|A30/ JK3 | DIQMTQSPSSLSA SVGDRVTITC | RAS--QGIR- -----NDLG | WYQQKPGK APKRLIY | T------- ASSLQS | GVPSRFSGSGSG-- TEFTLTISSLQPEDFASYYC | LQHNS--------YPFT | FGPGT KVDFK |
| iPS:435_805 | 21-225_181A8 | VK1|A30/ JK3 | DIQMTQSPSSLSA SVGDRVTITC | RAS--QGIR- -----NDLG | WYQQKPGK APKRLIY | T------- ASSLQS | GVPSRFSGSGSG-- TEFTLTISSLQPEDFATYYC | LQHNS--------YPFI | FGPGT KVDIK |
| iPS:435_879 | 21-225_184H1 | VK1|A30/ JK3 | DIQMTQSPSSLSA SVGDRVTITC | RAS--QGIR- -----NDLG | WYQQKPGK APKRLIY | I------- ASSLQS | GVPSRFSGSGSG-- TEFTLTISSLQPEDFATYYC | LQHNS--------YPFT | FGPGT KVDIK |
| iPS:435_881 | 21-225_184D1 | VK1|A30/ JK3 | DIQMTQSPSSLSA SVGDRVTITC | RAS--QGIR- -----NDLG | WYQQKPGK APKRLIY | I------- ASSLQS | GVPSRFSGSGSG-- TEFTLTISSLQPEDFATYYC | LQHYS--------YPFT | FGPGT KVDIK |
| iPS:435_921 | 21-225_190D6 | VK1|A30/ JK3 | DIQMTQSPSSLSA SVGDRVTITC | RAS--QGIR- -----NDLG | WYQLKPGK APKRLIY | A------- ASSLQS | PEFTLTISSLQPEDFATYYC | LQHYS--------FPFT | FGPGT KVDFK |
| iPS:435_985 | 21-225_192F6 | VK1|A30/ JK3 | DIQMTQSPSSLSA SVGDRVTITC | RAS--QGIR- -----NDLG | WYQLKPGK APKRLIY | A------- ASSLQS | PEFTLTISSLQPEDFATYYC | LQHNS--------FPFT | FGPGT KVDFK |
| iPS:436_074 | 21-225_194F10 | VK1|A30/ JK3 | DIQMTQSPSSLSA SVGDRVTITC | RAS--QGIR- -----NDLG | WYQQKPGK APKRLIY | A------- ASSLQS | GVPSRFSGSGSG-- PEFTLTISSLQPEDFATYYC | LQHYR--------FPFT | FGPGT KVDIK |
| iPS:436_092 | 21-225_195B9 | VK1|A30/ JK3 | DIQMTQSPSSLSA SVGDRVTITC | RAS--QGIR- -----KDLG | WYQQKPGK APKRLIY | A------- ASDLQS | GVPSRFSGSGSG-- TEFTLTISSLQPEDFATYYC | LQHYR--------YPFT | FGPGT KVDFK |
| iPS:436_164 | 21-225_197G1 | VK1|A30/ JK3 | DIQMTQSPSSLSA SVGDRVTITC | RAS--QGIR- -----NDLG | WYQQKPGK APKRLIY | G------- ASSLQS | GVPSRFSGSGSG-- TEFTLTISSLQPEDFATYYC | LQHYR--------YPFT | FGPGT KVDIK |
| iPS:436_191 | 21-225_198B9 | VK1|A30/ JK3 | DIQMTQSPSSLSA SVGDRVTITC | RAS--QGIR- -----KDLG | WYQQKPGK APKRLIY | A------- ASSLQS | GVPSRFSGSGSG-- TEFTLTISSLQPEDFATYHC | LQHHD--------YPFT | FGPGT KVDFK |
| iPS:436_205 | 21-225_199A7 | VK1|A30/ JK3 | DIQMTQSPSSLSA SVGDRVTITC | RAS--QGIR- -----KDLG | WYQQKPGK APKRLIC | R------- ASRLQS | TEFTLTISSLQPEDFATYHC | LQHYR--------YPFT | FGPGT KVDIK |
| iPS:436_214 | 21-225_200F6 | VK1|A30/ JK3 | DIQMTQSPSSLSA SVGDRVTITC | RAS--QGIR- -----NDLG | WYQQKPGK APKRLIY | A------- ASSVQN | GVPSRFSGSGSG-- TEFTLTISSLQPEDFATYYC | LQHNS--------YPFT | FGPGT KVDIK |
| iPS:436_248 | 21-225_202A3 | VK1|A30/ JK3 | DIQMTQSPSSLSA SVGDRVTITC | RAS--QGIR- -----NDLG | WYQQKPGK APKRLIY | A------- ASSLQS | GVPSRFSGSGSG-- TEFTLTISSLQPEDFATYYC | LQHNS--------YPFT | FGPGT KVDIK |
| iPS:436_268 | 21-225_203B9 | VK1|A30/ JK3 | DIQMTQSPSSLSA SVGDRVTITC | RAS--QGIR- -----NDLG | WYQQKPGK APKRLIY | A------- ASSLQS | GVPSRFSGSGSG-- TEFTLTISSLQPEDFATYYC | LQHNS--------YPFT | FGPGT KVDIK |
| iPS:436_350 | 21-225_210E4 | VK1|A30/ JK3 | DIQMTQSPSSLSA SVGDRVTITC | RAS--QGIR- -----NDLG | WYQQKPGK APKRLIY | A------- ASSLLG | TEFTLTISSLQPEDFATYYC | LQHNS--------YPFT | FGPGT KVDIK |
| iPS:436_576 | 21-225_225B6 | VK1|A30/ JK3 | DIQMTQSPSSLSA SVGDRVTITC | RAS--QGMR- -----KDLG | WYQQKPGK APKRLIY | A------- ATSLQS | GVPSRFSGSGSG-- TEFTLTISSLQPEDFATYYC | LQHNT--------YPFT | FGPGT KVDIK |
| iPS:436_578 | 21-225_225D6 | VK1|A30/ JK3 | DIQMTQSPSSLSA SVGDRVTITC | RAS--QGIR- -----NDLG | WYQQKPGK APKRLIY | A------- ASSLQS | GVPSRFSGSGSG-- TEFTLTISSLQPEDFATYYC | LQHNS--------YPFT | FGPGT KVDIK |
| iPS:436_582 | 21-225_225F8 | VK1|A30/ JK3 | DIQMTQSPSSLSA SVGDRVTITC | RAS--QGIR- -----NDLG | WYQQKPGK APKRLIY | A------- ASSLQS | TEFTLTISSLQPEDFATYYC | LQHNS--------YPFT | FGPGT KVDIK |
| iPS:436_608 | 21-225_226A9 | VK1|A30/ JK3 | DIQMTQSPSSLSA SVGDRVTITC | RAS--QGIR- -----NDLG | WYQQKPGK APKRLIY | A------- ASSLQS | GVPSRFSGSGSG-- TEFTLTISSLQPEDFATYYC | LQHNS--------YPFT | FGPGT KVDIK |
| iPS:436_630 | 21-225_227G3 | VK1|A30/ JK3 | DIQMTQSPSSLSA SVGDRVTITC | RAS--QGIR- -----NDLG | WYQQKPGK APKRLIY | A------- ASSLQS | GVPSRFSGSGSG-- TEFTLTISSLPADFATYYC | LHHNS--------YPFT | FGPGT KVDIK |
| iPS:436_634 | 21-225_227H5 | VK1|A30/ JK3 | DIQMTQSPSSLSA SVGDRVTITC | RAS--QDIR- -----NDLG | WYQQKPGK APKRLIY | A------- ASSLQS | GVPSRFSGSGSG-- TEFTLTISSLQPEDFATYYC | LQHNS--------YPFT | FGPGT KVDIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:436650 | 21-225_227C12 | VK1A30/JK3 | DIQMTQSPSSLSA SVGDRVTITC | RAS--QGIR-----NDLG | WYQQKPGK APKRLIY | A------ASSLQS | GVPSRFSGSGSG---TEFTLTISSLQPEDFATYYC | LQHNS--------YPFT | FGPGT KVDIK |
| iPS:392632 | 21-225_16A11 | VK1A30/JK3 | DIQMTQSPSSLSA SVGDSVTISC | RAS--QDIR-----NHLG | WYQRNPGK AFKRLIY | A------ASSLQS | GVPSRFSGSGSG---TEFTLTISSLQPEDFATYYC | LQYNS--------YPFT | FGPGT KVDIK |
| iPS:392684 | 21-225_17F4 | VK1A30/JK3 | DIQMTQSPSSLSA SVGDRVTITC | RAS--QGIR-----NDLG | WYQQKPGK APKRLIY | A------ASSLQS | GVPSRFSGSGSG---TEFTLTISSLQPEDFATYYC | LQHNS--------YPFT | FGPGT KVDIK |
| iPS:392732 | 21-225_17E5 | VK1A30/JK3 | DIQMTQSPSSLSA SVGDRVTITC | RAS--QDIR-----NDLG | WYQQKPGK APKRLIY | T------ASSLQS | GVPSRFSGSGSG---TEFTLTISSLQPEDFATYYC | LQHNS--------YFLI | FGPGT KVVIK |
| iPS:392778 | 21-225_22H3 | VK1A30/JK3 | DIQMTQSPSSLSA SVGDRVTITC | RAS--QDIR-----NNLG | WYQQKPGK APKRLIY | P------ASSLQT | GVPSRFSGSGSG---TEFTLTISSLQPEDFATYYC | LQDNS--------YPFT | FGPGT KVDIK |
| iPS:392912 | 21-225_25A9 | VK1A30/JK3 | DIQMTQSPSSLSA SVGDRVTITC | RAS--QGIR-----NDLG | WYQQKPGK APKRLIY | A------ASSLQS | GVPSRFSGSGSG---TEFTLTISSLQPEDFATYYC | LQHNS--------YPFT | FGPGT KVDIK |
| iPS:392934 | 21-225_27D5 | VK1A30/JK3 | DIQMTQSPSSLSA SVGDRVTITC | RAS--QGIR-----NDLG | WYQQKPGK APKRLIY | A------ASSLQS | GVPSRFSGSGSG---TEFTLTISSLQPEDFATYYC | LQHNT--------YPFT | FGPGT KVDFK |
| iPS:392940 | 21-225_29D9 | VK1A30/JK3 | DIQMTQSPSSLSA SVGDRVTITC | RAS--QDIR-----NDLG | WYQQKPGK APKRLIY | A------ASSLQS | GVPSRFSGSGSG---TEFTLTISSLQPEDFATYYC | LQHNS--------YPFT | FGPGT KVDIK |
| iPS:392948 | 21-225_25G5 | VK1A30/JK3 | DIQMTQSPSSLSA SVGDRVTITC | RAS--QGIR-----NDLG | WYQQKPGK APKRLIY | A------ASSLQS | GVPSRFSGSGSG---TEFTLTVSSLQPEDFATYYC | LQHNS--------YPFT | FGPGT KVDIK |
| iPS:392968 | 21-225_25B6 | VK1A30/JK3 | DIQMTQSPSSLSA SVGDRVTITC | RAS--QGIR-----NDLG | WYQQKPGK APKRLIY | R------ASSLQS | GVPSRFSGSGSG---TEFTLTISSLQPEDFATYYC | LQHNS--------YFFT | FGPGT KVDIK |
| iPS:392978 | 21-225_28B8 | VK1A30/JK3 | DIQMTQSPSSLSA SVGDRVTITC | RAS--QGIR-----NDLG | WYQHKPGK APKRLIY | A------ASSLQN | GVPSRFSGSGSG---TEFTLTISSLQPEDFATYYC | LQHNR--------YPFT | FGPGT KVDIN |
| iPS:392998 | 21-225_28A9 | VK1A30/JK3 | DIQMTQSPSSLSA SVGDRVTITC | RAS--QGIR-----NDLG | WYQQKPGK APKRLIY | A------ASSLQS | GVPSRFSGSGSG---TEFTLTISSLQPEDFATYYC | LQHNS--------YPFT | FGPGT KVDIK |
| iPS:393000 | 21-225_29D7 | VK1A30/JK3 | DIQMTQSPSSLSA SVGDRVTITC | RAS--QGIR-----NDLG | WYQQKPGK APKRLIY | P------ASSLQS | GVPSRFSGSGSG---TEFTLTISSLQPEDFATYYC | LQDNS--------YPFT | FGPGT KVDIK |
| iPS:393006 | 21-225_31G9 | VK1A30/JK3 | DIQMTQSPSSLSA SVGDRVTITC | RAS--QGIR-----NDLG | WYQQKPGK APKRLIY | A------ASSLQS | GVPSRFSGSGSG---TEFTLTISSLQPEDFATYYC | LQHNS--------YPFT | FGPGT KVDIK |
| iPS:393022 | 21-225_30H11 | VK1A30/JK3 | DIQMTQSPSSLSA SVGDRVTITC | RAS--QGIR-----NDLG | WYQQKPGK APKRLVY | P------ASSLQS | GVPSRFSGSGSG---TEFTLTISSLQPEDFATYYC | LQDNS--------HPFT | FGPGT KVDIT |
| iPS:393038 | 21-225_29D8 | VK1A30/JK3 | DIQMTQSPSSLSA SVGDRVTITC | RAS--QGIR-----NDLG | WYQQKPGK APKRLIY | T------ASSLQS | GVPSRFSGSGSG---TEFTLTISSLQPEDFATYYC | LQHNS--------YPFT | FGPGT KVDIK |
| iPS:393822 | 21-225_15B11 | VK1A30/JK3 | DIQMTQSPSSLSA SVGDRVTITC | RAS--QGIR-----NDLG | WYQQKPGK APKRLIY | A------ASSLQS | GVPSRFSGSGSG---TEFTLTISSLQPEDFATYYC | LQHNS--------YFFT | FGPGT KVDIK |
| iPS:393944 | 21-225_14D6 | VK1A30/JK3 | DIQMTQSPSSLSA SVGDSVTISC | RAS--QDIR-----NHLG | WYQQKPGK APKRLIY | A------ASSLQS | GVPSRFSGSGSG---TEFTLTISSLQPEDFATYYC | LQYNS--------YPFT | FGPGT KVDIN |
| iPS:394033 | 21-225_5F4 | VK1A30/JK3 | DIQMTQSPSSLSA SVGDRVTITC | RAS--QGIR-----NDLG | WYQQKPGK APKRLIY | A------ASSLQS | GVPSRFSGSGSG---TEFTLTISSLQPEDFATYYC | LQYNG--------YPFT | FGPGT KVDIK |
| iPS:394069 | 21-225_16H1 | VK1A30/JK3 | DIQMTQSPSSLSA SVGDRVTITC | RAS--QGIR-----DILG | WYQQKPGK APKRLIY | A------ASSLQN | GVPSRFSGSGSG---TEFTLTISSLQPEDFATYYC | LQYHS--------YFFT | FGPGT KVDVK |
| iPS:402229 | 21-225_16H9 | VK1A30/JK3 | DIQMTQSPSSLSA SVGDRVTITC | RAS--QGIR-----NYLG | WFQQKPGK APKRLIY | G------ASSLQS | GVPSRIGGSGSG---TEFTLTISSLQPEDFATYYC | LQHS---------YLFT | FGPGT KVDIK |
| VK1O12/JK1 Germline | | | | | | | | | |

FIGURE 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:468_848 | 21-225_54B1 | VK1|O12/ JK1 | DIQMTQSPSSLSA SIGDRVTITC | RAS--QNIS---SYLN | WFQQKPGK APKFLIY | A-------ASSLHS | GVPPRFSGSGSG--TDFTLTISSLQPEDFAIYYC | QQSYR------TPLWT | FGQGT KVEIK |
| iPS:434_239 | 21-225_58F1 | VK1|O12/ JK1 | DIQMTQSPSSLSA SVGDRVTITC | RAS--QSIT--NFLN | WYQQKPGK APKLLIF | A-------ASSLQS | GIPSRFSGSGSG--TDFTLTISSLQPEDFATYYC | QQSYS------IPWT | FGQGT KVEIK |
| iPS:435_513 | 21-225_157F3 | VK1|O12/ JK1 | DIQMTQSPSSLSA SVGDRVTITC | RAS--QNIS---SYLN | WYQLKPGK APKLLIY | T-------ASSLQS | GVPSRFSGSGSG--TDFTLTISSLQPEDFATYYC | QQSYN------TPTWT | FGQGT KVEIK |
| iPS:435_729 | 21-225_173E7 | VK1|O12/ JK1 | DIQMTQSPSSRSA CIGDRATIY | RAS--QTIS---NYLN | WYQQKPGK APKLLIY | A-------ASSLQI | GVPSRFSGSGSG--TDFTLTISSVQPEDFATYFC | QQSYR------TPQWT | FGQGT KVEIK |
| iPS:435_753 | 21-225_175G10 | VK1|O12/ JK1 | DIQMTQSPSSLSA SVGDRVTITC | RAS--QTIG---NYLN | WYQQKPGR APKLLIY | A-------ASSLHS | GVPSGFSGSGSG--TDFTLTISSLQPEDFATYFC | QQSYR------TPQWT | FGQGT KVEIK |
| iPS:435_799 | 21-225_181G3 | VK1|O12/ JK1 | DIQMTQSPSSLSA SVGDRVNITC | RAS--HSIS---NYLN | WYQQKAGK APKLLIY | T-------TLNLQS | GVPSRFSGSGSG--TDFTLTISSLQPEDFATYYC | QQSYS------SPPWT | FGQGT KVEFK |
| iPS:435_813 | 21-225_183A1 | VK1|O12/ JK1 | DIQMTQSPSSLCA SVGDRVTITC | RAS--RNIS---NYLN | WYQQKPGK APKLLIY | V-------VSSLQS | GVPSRFSGSGSG--TDFTLTISSLQPEDFATYYC | QQSYS------SPPWT | FGQGT KVDIR |
| iPS:436_003 | 21-225_192G10 | VK1|O12/ JK1 | DIQMTQSPSSLSA SVGDRVTITC | RAS--QSIS---NYLN | WYQQTPGK APKLLIY | A-------ESSLQS | GVPSRFSGSGSG--TDFTLTISSLQPEDFATYYC | QQSYS------SPPWT | FGQGT KVEIK |
| iPS:436_212 | 21-225_200G1 | VK1|O12/ JK1 | DIQMTQSPSSLSA SVGDRVTITC | RAS--QSIS---SYLN | WFQQKPGK APKLLIY | A-------ESSLQS | GVPSRFSGSGSG--TDFTLTISSLQPEDFATYSC | QQSYS------SPPWT | FGQGT KVEIK |
| iPS:392_730 | 21-225_17A1 | VK1|O12/ JK1 | DIQMTQSPSSLSA SVGDRVSITC | RAS--QNIN---NYLN | WYQQKPGK GPKVLIF | T-------TSSLQS | GVPSRFSGSGSG--TDFTLTISSLQPEDFATYYC | QQSYT------TPTWT | FGQGT KVEIK |
| iPS:392_736 | 21-225_17B12 | VK1|O12/ JK1 | DIQMTQSPSSLSA SVGDRVSITC | RAS--QNIN---NYLN | WYQQKPGK GPKVLIL | A-------ASSLQS | GVPSRFSGSGSG--TDFTLTISSLQPEDFATYYC | QQTYT------TPTWT | FGQGT KVEIK |
| iPS:392_766 | 21-225_23H4 | VK1|O12/ JK1 | DIQMTQSPSSLSA SVGDRVTITC | RAS--QSIS---RYLN | WYQQKPGR APKLLIC | S-------TSSLQS | GVPSRFSGSGSG--TDFTLTISSLQPEDFATYYC | QQSYS------TPTWT | FGQGT KVEIR |
| iPS:392_770 | 21-225_20C10 | VK1|O12/ JK1 | DIBMTQSPSSLSA SVGDRVSITC | RAS--HHIS---NYLN | WYQQKPGK GPKVLIL | T-------TSSLQS | GVPSRFSGSGSG--TDFTLTISSLQPEDFATYYC | QQSYT------TPTWT | FGQGT KVEIK |
| iPS:392_808 | 21-225_20F8 | VK1|O12/ JK1 | DIQMTQSPSSLSA RYLN | RAS--QSIS-- | WYQQKPGK APKLLIY | A-------ASSLQS | GVPSRFSGSGSG--TDFTLTISSLQPEDFATYYC | QQSIN------TPTWT | FGQGT KVEIK |
| iPS:392_954 | 21-225_26A10 | VK1|O12/ JK1 | DIQMTQSPSSLSA SVGDRVSITC | RAS--QSIS---SYLN | WYQQKFGK APKVLIY | A-------ASSLQS | GVPSRFSGSGSG--TDFTLTISSLQPEDFATYYC | QQSYS------TPTWT | FGQGT KVEIK |
| iPS:393_878 | 21-225_7G12 | VK1|O12/ JK1 | DIQMTQSFSSLSA SVGDRVSITC | RAS--QNIN---NYLN | WYQQKPGK GPKVLIL | T-------ASSLQS | GVFSRFSGSGSG--TDFTLTISSLQPEDFATYYC | QQSIT------TPTWT | FGQGT KVEIK |
| iPS:398_474 | 21-225_17B10 | VK1|O12/ JK1 | DIQMTQSPSSLSA SVGDRVTITC | RSS--QSIN---SYLN | WYQQKPGK APKLLIF | A-------ASSLHS | GVPSRFSGSGSG--TDFTLTISSLQPEDFATYYC | QQGYN------TPTWT | FGQGT KVEIN |
| VK4|B3/JK2 | | Germline | | | | | | | |
| iPS:468_850 | 21-225_63F4 | VK4|B3/ K2 | DIVMTQSPDSLAV SLGERATINC | KSS--QSVLSSSNNNN YLA | WYQQKPGQ PPKLLIY | W-------ASTRES | GIPDRFSGSGSG--TGFTLTISSLQAEDVAVYYC | QQYYT------TPCS | FGQGT KLEIN |
| iPS:468_852 | 21-225_71F3 | VK4|B3/ K2 | DIVMTQSPDSLAV SLGARATINC | KSS--QSVLSNSNNNN YLA | WYQQKPGQ PPKLLIY | W-------ASTRES | GIPDRFSGSGSG--TDFTLTINSLQAEDVAVYYC | QQYYT------TPCS | FGQGT KLEIK |

FIGURE 51 (Continued)

| | | | | | | | | |
|---|---|---|---|---|---|---|---|---|
| iPS:468 870 | 21-225_74A8 | VK4\|B3/J K2 | DIVMTQSPDSLAV SLGERATINC | KSS--- QSVLYSSNSHN YLA | WYQQKPGQ PPKLLIY | W------- ASTRES | GVPDRFSGSGSG--- TDFTLTISSLQAEDVAVYYC | QQYYS---------TPCS | FGGGT KLEIK |
| iPS:434 211 | 21-225_60F3 | VK4\|B3/J K2 | DIVMTQSPDSLTV SLGERATINC | KSS--- QSVLYSSNNKM YLA | WYQQKPGQ PPKLLIY | W------- ASTRES | GVPDRFSGSGSG--- TDFTLTISSLQAEDVALYYC | QQYYS---------TPCS | FGGGT KLEIN |
| iPS:434 235 | 21-225_61E3 | VK4\|B3/J K2 | DIVMTQSPDSLAV SLGERATINC | KSS--- QSVLHISNNRM YLA | WYQQPGQ PPKLLIY | W------- ASIRES | GVPDRFSGSGSG--- TDFTLTISSLQAEDVAVYYC | QQYYS---------TPCS | FGGGT KLEIK |
| iPS:434 287 | 21-225_57F12 | VK4\|B3/J K2 | DIVMTQSPDSLAV SLGERATINC | KSS--- QSVLFSSNNYN YLA | WYQQKTGQ PPKLLIY | W------- ASIRES | GVPDRFSGSGSG--- TDFTLTISSLQAEDVAIYYC | QQYYS---------NPCS | FGGGT KLEIK |
| iPS:434 305 | 21-225_59E1 | VK4\|B3/J K2 | DIVMTQSPDSLAV SLGERATINC | KSS--- QSVLYSSNNNN YLA | WYQQKPGQ PPKLLIY | W------- SSTRES | GVPDRFSGSGSG--- TDFTLTISSLQAEDVAVYYC | QQYFS---------TPCS | FGGGT KLEIK |
| iPS:434 443 | 21-225_71G3 | VK4\|B3/J K2 | DIVMTQSPDSLAV SLGERVAINC | KSS--- QSVLHSSNNKM YLD | WYQQKPGQ LPKLLIF | W------- ASTREF | GVPDRFSGSGFG--- TDFTLTISSLQAEDVADYYC | QQYYI---------TPCS | FGGGT KLEIK |
| iPS:434 483 | 21-225_74C12 | VK4\|B3/J K2 | DIVMTQSPDSLAV SLGERATINC | KSS--- QSVLYSSNNAN YLA | WYQQKPGQ PPNLLIY | W------- ASTRES | GVPDRFSGSGSG--- TDFTLTISSLQAEDVAVYYC | QQYYT---------TPCS | FGGGT KLEIK |
| iPS:434 613 | 21-225_77D12 | VK4\|B3/J K2 | DIVMTQSPDSLAV SLGERATINC | RSS--- QSVLYSSNNYN YLA | WYQQKPGQ PPKLLIY | W------- ASTRDS | GVPDRFSGSGSG--- TDFTLTISSLQAEDVAVYYC | QQYYS---------TPCS | FGGGT KLEIK |
| iPS:434 635 | 21-225_78E6 | VK4\|B3/J K2 | DIVMTQSPDSLAV SLGERATINC | KSS--- QSVLYSNSHM YLA | WYQQKPGQ PPKLLIY | W------- ASIRES | GVPDRFSGSGSG--- TDFTLTISSLQAEDVAVYYC | QQYYS---------TPCS | FGGGT KLEIK |
| iPS:434 679 | 21-225_79G7 | VK4\|B3/J K2 | DIVMTQSPDSLAV SLGERATINC | KSS--- QSVLYSSNSHM YLA | WYQQKPGQ PPKLLIF | W------- ASIRES | GVPDRFSGSGSG--- TDFTLTISSMQAEDVAVYYC | QQYYS---------TPCS | FGGGT KLEIK |
| iPS:434 909 | 21-225_85C11 | VK4\|B3/J K2 | DIVMTQSPDSLAV SLGERATINC | KSS--- QSVLYSSNSHN YLA | WYQQNPGQ PPKLLIF | W------- AFIRES | GVPEGFSGSGSG--- ADFTLSISIGLQAEDVAVYYC | QQYYS---------TPCS | FGGGT KLEIK |
| iPS:434 959 | 21-225_87E10 | VK4\|B3/J K2 | DIVMTQSPDSLAV SLGERATINC | KSS--- QSVLYSSNSHN FLA | WYQQKPGQ PPYLLIF | W------- ASTRKS | GVPDRFSGTGSG--- TDFTLTISSLQAEDVAVYYC | QQYYS---------SPCS | FGGGT KLEIK |
| iPS:435 299 | 21-225_146D4 | VK4\|B3/J K2 | DIVMTQSPDSLAV SLGERATINC | KSS--- QSVLYSSNNNN YLA | WYQQKPGQ PPKLVIY | W------- ASTRES | GVPDRFSGSGSG--- TDFTLTISSLQAEDVAVYYC | QQYYS---------TPCS | FGGGT KLEIK |
| iPS:435 305 | 21-225_146C9 | VK4\|B3/J K2 | DIVMTQSPDSLAV SLGERATINC | KSS--- QSVLHSSNNYN YLA | WYQQKPGQ PPKLLIY | W------- ASTRKS | GVPDRFSGSGSG--- TDFTLTISSLQAEDVAVYYC | QQYYS---------TPCS | FGGGT KLEIK |
| iPS:435 309 | 21-225_146F9 | VK4\|B3/J K2 | DIVMTQSPDSLAV SLGERATINC | KSS--- QNILHSSNNNN YLA | WYQQKPGQ PPYLLIY | W------- ASTRES | GVPDRFSGSGSG--- TDFTLTITSLQAEDVAVYYC | QQYYT---------TPCS | FGGGT KLEIT |
| iPS:435 323 | 21-225_147D5 | VK4\|B3/J K2 | DIVMTQSPDSLAV SLGERATINC | KSS--- QSVLYSSNNNM YLA | WYQQKPGQ PPKLLIY | W------- ASTRES | GVPDRFSGSGSG--- TDFTLSISILQAEDVAVYYC | HQYYS---------TPCS | FGGGT KLEIK |

FIGURE 51 (Continued)

| | | | | | | | | | |
|---|---|---|---|---|---|---|---|---|---|
| iPS-435_399 | 21-225_150D2 | VK4jB3/J K2 | DIVMTQSPDSLAV SLGERATIKC | KSS--- QSVLYRSNSKK YLT | WYQQKPGQ PPKLFIY | W------- ASTRKS | GVPDRFSGSGSG--- TDFTLTISSLQAEDVAVYFC | QQYFS------- ---------TPYN | FGQGT KLEIK |
| iPS-435_435 | 21-225_152H3 | VK4jB3/J K2 | DIVMTQSPDSLAV SLGEKATINC | KSS--- QSVLHSSNRYM YLT | WYQQKPGQ PPKLLIY | W------- ASTRKS | GVPDRFSGSGSG--- TDFTLTISSLQAEDVAVYYC | QQYYS------- ---------TPCS | FGQGT KLEIK |
| iPS-435_451 | 21-225_152D10 | VK4jB3/J K2 | GIVMTQSPDSLAV SLGARATIDC | KSS--- QSVLYSSKNNN YLA | WYQQKPGQ PPKLLIY | W------- ASTRES | GVPDRFSGSGSG--- TDFTLTIYSLQAEDVAVYYC | QQYY-------- ---------RSPS | FGQGT KLEIK |
| iPS-435_459 | 21-225_152E1 | VK4jB3/J K2 | AVVMTQSPDSLAV SLGERATINC | TSS--- QSILHSSNRYN YLA | WYQQKPGQ PPKLLIY | W------- ASTRES | GVPDRFSGSGSG--- TDFTLTISSLQAEDVAVYYC | QQYYS------- ---------GPCS | FGQGT KLEIK |
| iPS-435_467 | 21-225_153B9 | VK4jB3/J K2 | GIVMTQPPDSLAV SLGERATINC | KSS--- QSVLHSSNRKN YLA | WYQQKPGQ PHKLLIY | W------- ASTREF | GVPDRFSGSGCG--- TDFTLIYSVQAEDVAVYYC | QQYN-------- ---------RSLS | FGQGT KLEIK |
| iPS-435_471 | 21-225_153F11 | VK4jB3/J K2 | DIVMTQSPDSLAV SLGERATINC | KSS--- QSVLYSSNRYK YLA | WYQQKPGQ PPNLLIY | W------- ASTRKS | GVPDRFSGSGSG--- TDFTLTISSLQAEDVAVYYC | QQYYS------- ---------TPCS | FGQGT KLEIK |
| iPS-435_475 | 21-225_154H6 | VK4jB3/J K2 | DIVMTQSPDSLAV SLGERATINC | KSS--- QSVLHSSNMYN YLA | WYQQKPGQ PPKLLIY | W------- TSTRKS | GVPDRFSGSGSG--- THFTLSISSLQAEDVAVYYC | QHYIS------- ---------TPCS | FGQGT KLEIK |
| iPS-435_491 | 21-225_155E5 | VK4jB3/J K2 | DIVMTQSPDSLAV SLGERATINC | KSS--- QSVLSSSNNNN YLA | WYQQKPGQ PPKLLIY | W------- ASTRKS | GVPDRFSGSGSG--- TDFTLTISSLQAEDVAVYYC | QQYIS------- ---------TPCS | FGQGT KLEIK |
| iPS-435_495 | 21-225_155B6 | VK4jB3/J K2 | DIVMTQSPDSLAV SLGERATINC | KSS--- QSVLHSSNNYH YLA | WYQQKPGQ PPKLLIY | W------- TSTRES | GVPDRFSGSGSG--- TDFTLTISSLQAEDVAVYYC | QQYYS------- ---------TPCS | FGQGT KLEIK |
| iPS-435_501 | 21-225_156H1 | VK4jB3/J K2 | DIVMTQSPDSLAV SLGERATINC | KSS--- QSVLYSSNNNM YLA | WYQQKPGQ PPKLLIY | W------- ASTRES | GVPARFSGSGSG--- TDFTLTISSLQAEDVAVYYC | HQYYS------- ---------TPCS | FGQGT KLEIK |
| iPS-435_589 | 21-225_160A4 | VK4jB3/J K2 | DIVMTQSPDSLAV SLGERATINC | KSS--- QSVLHSSNNNM YLA | WYQQKPGQ PPKLLIY | W------- ASTRES | GVPDRFSGSGSG--- TDFTLTISSLQAEDVAVYYC | QQYYN------- ---------SPCS | FGQGT KLEIK |
| iPS-435_727 | 21-225_172E1 | VK4jB3/J K2 | DIVMTQSPDSLAV SLGERATINC | KSS--- QSVLHSSNNNN YLA | WYQQKPGQ PPKLLIY | W------- ASTRES | GVPDRFSGSGSG--- TDFTLTISSLQAEDVAVYYC | QQYFT------- ---------TPCS | FGQGT KLEIK |
| iPS-436_560 | 21-225_224F11 | VK4jB3/J K2 | NIVMTQSPDSLAV SLDERATINC | KSS--- QSVLSSSNRHM YLA | WYQQKPGQ PPKMLIY | W------- ASTRES | GVPDRFSGSGSG--- TDFTLTISSLQAEDVAVYYC | QQYYT------- ---------TPCS | FGQGT KLEIK |
| iPS-436_584 | 21-225_225B9 | VK4jB3/J K2 | DIVMTQSPDSLAV SLGERATINC | KSS--- QSVLYSSNRNM YLA | WYQQKPGQ PPKLLIF | W------- ASTRES | GVPDRFSGSGSG--- TDFTLTISSLQAEDVAVYYC | QHSKS------- ---------IPGK | FGQGI KLEIQ |
| iPS-436_588 | 21-225_225F12 | VK4jB3/J K2 | DIVMTQSPDSLAV SLGERATINC | KSS--- QSVLHSSNNQN YLA | WYQQKPGQ PPRLLIY | W------- TSTRES | GVPDRFSGSGSG--- TDFTLTISNLQAEDVAVYYC | QQYYI------- ---------TPCS | FGQGT KLEIK |
| iPS-436_590 | 21-225_225H12 | VK4jB3/J K2 | DIVMTQSPDSLAV SLGERATINC | KSS--- QSVLYNSQNNN YLA | WYQQKPGQ PPNLLIY | W------- ASTRES | GVPDRFSGSGSG--- TDFTLTISSLQTEDVAVYYC | QQYYI------- ---------TPCS | FGQGT KLEIK |

FIGURE 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:436 598 | 21-225_226D6 | VK4\|B3/J K2 | DIVMTQSPDSLAV SLGERATINC | KSS--- QSILYISNNKN YLA | WYQQKPGQ PPKMLIY | W------- ASTRES | GVPDRFSGSGSG-- TDFTLTISSLQAEDVAVYYC | QQYYS------- -------SPCS | FGQGT KLEIK |
| iPS:436 636 | 21-225_227E6 | VK4\|B3/J K2 | DIVMTQSPDSLTV SLGERATINC | KSS--- QSVLYSSNDKN YLA | WYQQKPGQ PPKMLIY | W------- ASTRES | GVPDRFSGSGSG-- TDFTLTISSLQAEDVAVYYC | QQYYI------- -------TPCS | FGQGT KLEIK |
| iPS:436 644 | 21-225_227G9 | VK4\|B3/J K2 | DIVMTQSPDSLAV SLGERATINC | KSS--- QSVLHSSNNER YLA | WYQQKPGQ PPKLLIY | W------- GSTRES | GVPDRFSGSGSG-- TDFTLTISSLQAEDVAVYYC | QQYYS------- -------APYS | FGQGT KLEIK |
| iPS:436 646 | 21-225_227D1 | VK4\|B3/J K2 | DIVMTQSPDSLAV SLGERATINC | KSS--- QSVLHSSNNNR YLA | WYQQKPGQ PPKLLIY | W------- ASTRES | GIPDRFSGSGSG-- TDFTLTISSLQAEDVAVYYC | QQYIN------- -------TPCS | FGQGT KLEIK |
| iPS:437 363 | 21-225_74C10 | VK4\|B3/J K2 | DIVMTQSPDSLAV SLGERATINC | KSS--- QSVLYSSNNAN YLA | WYQQKPGQ PPNLLIY | W------- ASTRES | GVPDRFSGSGSG-- TDFTLTISSLQAEDVAVYYC | QQYYS------- -------TPCS | FGQGT KLEIK |
| iPS:451 131 | 21-225_160A7 | VK4\|B3/J K2 | DIVLTQSPDSPAV SLGERATINC | KSS--- QSVLSNSHMNN YLA | WYQQRPGH PHKLLIF | W------- ASTRES | GVPDRFSGSGYG-- TDFTLTISSLQAEDVAVYYC | QQYYS------- -------TPCS | FGQGT KLEIK |
| iPS:393 088 | 21-225_33D1 | VK4\|B3/J K2 | DIVMTQSPDSLSV SLGERATINC | KSI--- QSVLYRSNNKN YLT | WYQQKPGQ PRKLFIY | W------- ASTRES | GVLDRFSGSGCG-- TDFTLTISSLQAEDVAVYYC | QQYYT------- -------SPCS | FGQGT KLEIK |
| iPS:394 085 | 21-225_8B11 | VK4\|B3/J K2 | DIVMTQSPDSLAV SLGERATINC | KSS--- QNVLYNSNNNN YLA | WYQQKPGQ PPKLLIY | W------- ASTRKS | GVPDRFSGSGSG-- TDFTLTISSLQAEDVAVYYC | QQYYT------- -------TPCS | FGQGT KLEIK |
| iPS:398 496 | 21-225_22D2 | VK4\|B3/J K2 | DIVMTQSPDSLAV SLGERATITC | KSS--- QSVLHSSNNNR YLA | WYQQKPGQ PPKLLIY | W------- ASTRKS | GVPDRFSGSGSG-- TDFTLTISSLQAEDVAVYYC | QQYYS------- -------TPCS | FGQGT KLEIK |
| iPS:398 512 | 21-225_25E12 | VK4\|B3/J K2 | DIVLTQSPDFLAM SLGERATINC | KSS--- QSVLYHSNNYN YLA | WYQQKPEKQ PPKLLIY | W------- ASTRES | GVPDRFSGSGSG-- TYFTLTISSLQAEDVAVYYC | QQYYS------- -------TPCS | FGQGT NLEIK |
| iPS:398 522 | 21-225_32A1 | VK4\|B3/J K2 | DIVMTQSPDSLAV SLGERATINC | KSS--- QSVLYSSNNYN YLA | WYQLKPGQ PPKLLIY | W------- ASTRES | GVPDRFSGSGSG-- TDFTLTISSLQTEDVALYYC | QQYYT------- -------SPCS | FGQGT KLEIK |
| iPS:398 524 | 21-225_32A5 | VK4\|B3/J K2 | DIVMTQSPDSLAV SLGERATINC | KSS--- QSVLHSSNNKN YLA | WYQQKPGQ PPKLLIY | W------- ASTRKS | GVPDRFSGSGSG-- TDFLAISSLQAEDVALYKC | QQYYS------- -------SPCS | FGQGT GLEIK |
| iPS:398 538 | 21-225_34H7 | VK4\|B3/J K2 | DIVMTQSPDSLAV SLGERATINC | KSS--- QSVLYSSNNYN YLA | WYQLKPGQ PPKLLIY | W------- ASTRKS | GVPDRFSGSGSG-- TDFTLTISSLQTEDVALYYC | QQYYT------- -------SPCS | FGQGT KLEIK |
| Germline | | | | | | | | | |
| VK2\|A17/JK4 | | | | | | | | | |
| iPS:468 854 | 21-225_72C4 | VK2\|A17/ JK4 | DVVMTQSPLSLPV TLGQPASISC | RSG--- QSLVYSD- GNTYLN | WFQQRPGQ SPERLIY | E------- VSKWDS | GVPDRFSGSGSG-- TMFTLKISRVEAEDVGVFYC | MQGTH------- -------WPLT | FGQGT KVEIK |

FIGURE 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:437 250 | 21-225_148C6 | VK2|A17/ JK4 | DVVMTQSPLSLPV TLGQPASISC | RSS--- QSLVYSD- GNTYLN | WFQQRPGQ SPRRLIY | K------ VSNWDS | GVPDRFSGSGSG- TDFTLKISRVEAEDVGVYYC | MQGTH---------- ----------WSLT | FGGGT KVEIK |
| iPS:437 252 | 21-225_148H1 | VK2|A17/ JK4 | DVVMTQSPLSLPV TLGQPASISC | RSS--- QSLVYSD- GNTYLN | WFQQRPGQ SPRRLIY | K------ VSNWDS | GVPDRFSGSGSG- TDFTLKISRVEAEDVGVYYC | MQGTH---------- ----------WLLT | FGGGT KVEIK |
| iPS:437 254 | 21-225_149F2 | VK2|A17/ JK4 | DVVMTQSPLSLPV TLGQPASISC | RSS--- QSLVYSD- GNTSLN | WFQQRPGQ SPRRLIY | K------ VSNWDS | GVPVRFSGSGSG- TDFTLKISRVEAEDVGIYYC | MQGTH---------- ----------WPFT | FGGGT KVEIK |
| iPS:437 256 | 21-225_150F11 | VK2|A17/ JK4 | DVVMSQYPLSLPV TFGQPASISC | RSS--- QSLVYSD- GNTSLN | WFQQRPGQ YFRRLIY | K------ VSNWDY | GVPDRFSGSGSG- TDFTLKISRVEAEDVGIYYC | MQGTH---------- ----------WPFT | FGGGT KVEIK |
| iPS:437 268 | 21-225_177D2 | VK2|A17/ JK4 | DVVMTQSPLSLPV TLGQPASISC | RSS--- QSLVYSD- GNTYLN | WFQQRPGQ SPRRLIY | K------ VSNWDS | GVPDRFSGSGSG- TDFTLKISRVEAEDVGVYYC | MQGTH---------- ----------WPLT | FGGGT KVEIK |
| iPS:443 005 | 21-225_43F11_LC1 | VK2|A17/ JK4 | DVVMTQSPLSLPV TLGQPASISC | RSS--- QSLVYSD- GNTYLN | WFQQRPGQ SFRRLIY | K------ VSNWDS | GVPDRFSGSGSG- TDFTLKISRVEAEDVGVYYC | MQGTH---------- ----------WPLT | FGGGT KVEIK |
| iPS:398 530 | 21-225_32G4 | VK2|A17/ JK4 | DVVMTQSPLSLSV TLGQPASISC | RSS--- QSLVYSD- GDTYLN | WFQQRPGQ SFRRLIY | K------ VSNWDS | GVPDRFSGSGSG- TDFTLKISRVEAEDVGVYYC | MQGI----------- ----------HWLT | FGGGT KVEIK |
| Germline | VK2|A17/JK3 | | | | | | | | |
| iPS:468 856 | 21-225_77C9 | VK2|A17/ JK3 | DVVMTQSPLSLPV TLGQPASISC | RSS--- QSLVYSV- GNTSLS | WFQQRPGQ SFRRLIY | K------ VSNWDS | GVPDRFSGSGSG- TDFTLKISRVEAEDVGVYYR | MQGTH---------- ----------WPFT | FGPGT KVDIK |
| iPS:392 936 | 21-225_28B6 | VK2|A17/ JK3 | DVVMTQSPLSLPV TLGQPASISC | RSS--- QSLVYSD- GNTYLN | WFQQRPGQ SFRRQIY | K------ VSNWDS | GVPDRFSGSGSG- TDFTLNISRVEAEDVGIYFC | MHCI----------- ----------HWLL | PGPGT KVDIK |
| Germline | VK2|A17/JK5 | | | | | | | | |
| iPS:472 741 | 21-225_30D9_LC1 | VK2|A17/ JK5 | DVVMTQSPLSLPV TLGQPASISC | RSS--- QSLVSSD- GNTFLN | WFQQRPGQ SFRRLIY | K------ VSNWDS | GVPDRFSGSGSG- TDFTLKISRLEAEDVGIYYC | LQGTH---------- ----------WPLI | FGPGT RLEIK |
| iPS:437 294 | 21-225_216D5 | VK2|A17/ JK5 | DVVMTQSPLSLPV TLGQPASISC | RSS--- QSLVYSD- GNTFLN | WFQQRPGQ SFRRLIY | K------ VSNWDS | GVPDRISGSGSG- TGFTLKISRVEAEDVGIIYC | MQGA----------- ----------HWFT | FGQGT RLEIK |
| iPS:472 732 | 21-225_2B10_LC1 | VK2|A17/ JK5 | DVVMTQSPLSLPV TLGQPASISC | RSS--- QSLVYSD- GNTYLN | WFQQRPGQ SPRRLIY | K------ VSNWDS | GVPDRFSGSGSG- TDFTLKISRVEAEDVGIYYC | IQGTH---------- ----------WPFP | FGPGT RLEIK |
| iPS:398 508 | 21-225_24B1 | VK2|A17/ JK5 | DVVMTQSPLSLPV TLGQPASISC | RSS--- QSLVYSD- GNTYLN | WFQQRPGQ SFRRLIY | K------ VSNWDS | GVPDRFSGSGSG- TDFTLKISWEAEDVGVCYC | MQGAH---------- ----------WPPIT | FGQGT RLEIK |

FIGURE 51 (Continued)

| IPS:423 019 | 21-225_31D12 _LC1 | VK2|A17/ JK5 | DVVMTQSPLSLPV TLGQPASISC | RSS--- QSLIYSD- GNFLN | WFQQRPGQ SPRRLIY | K------- VSNWDS | GVPDRFSGSGSG--- TDFTLKISRIEAEDVGIYYC | MQGTH----- ---WPLT | FGQGT RLEIK |
|---|---|---|---|---|---|---|---|---|---|
| | | Germline | K_FR1 | K_CDR1 | K_FR2 | K_CDR2 | K_FR3 | K_CDR3 | K_FR4 |
| | VK1|L5/JK1 | | | | | | | | |
| IPS:433 897 | 21-225_43C2 | VK1|L5/J K1 | DIQMTQSPSSVSA SVGDRVTITC | RAS--QGIS- ----DWLA | WYQQKPGK APKLLIY | A------- ASSLQS | GVPSRFSGSGSG--- TDFTLTISSLQPEDFATYYC | QQTNS---- ----FPWT | FGQGT KVEIK |
| IPS:433 903 | 21-225_43H4 | VK1|L5/J K1 | DIQMTQSPSSVSA SVGDRVTITC | RAS--QGII- ----NWLA | WYQQKPGK APKLLIY | A------- ASSLQS | GVPSRFSGSGSG--- TDFTLTISSLQPEDFATYYC | QQTNS---- ----FPWT | FGQGT KVEIK |
| IPS:433 911 | 21-225_43E8 | VK1|L5/J K1 | DIQMNQSPSSVSA SVGDRVTITC | RAS--QGIS- ----NWLA | WYQQKFGR APKLLIY | A------- ASSLQS | GVPSRFSGSGSG--- TDFTLTISNLQPEDFATYYC | QQTNS---- ----FPWT | FGQGT KVEIK |
| IPS:433 941 | 21-225_44D10 | VK1|L5/J K1 | DIQMTQSPSSVSA SVGDRVTITC | RAS--QGIS- ----DWLA | WYQQKPGK APRLLIY | A------- ASSLQS | GVPSRFSGSGSG--- TDFTLTISNLQPEDFATYYC | QQTNS---- ----FPWT | FGQGT KVEIK |
| IPS:433 945 | 21-225_44C12 | VK1|L5/J K1 | DIQMTQSPSSVSA SVGDRVTITC | RAS--QGIS- ----NWLA | WYQQKPGK APKLLIS | A------- AFSLQS | GVPSRFSGSGSG--- TDFTLSISSLQPEDFATYYC | QQSNS---- ----FPWT | FGQGT KVEIK |
| IPS:433 957 | 21-225_45F8 | VK1|L5/J K1 | DIQMTQSPSSVSA SVGDRVTITC | RAS--QGIS- ----DWLA | WYQQKPGK APRLLIY | G------- ASSLQS | GVPSRFSGSGSG--- TDFTLTISMLQPEDFATYYC | QQTNS---- ----FPWT | FGQGT KVEIK |
| IPS:433 973 | 21-225_46A6 | VK1|L5/J K1 | DIQMNQSPSSVNIC SVGDRVTITC | RAS--QGIS- ----NWLA | WYQQKFGK VPKLLIY | A------- ASSLQS | GVPSRFSGSGSG--- TDFTLTISNLQPEDFATYYC | QQTNS---- ----FPWT | FGQGT KVEIK |
| IPS:433 993 | 21-225_47G7 | VK1|L5/J K1 | DIQMTQSPSSVSA SVGDRVTITC | RAS--QGIS- ----NWLA | WYQQKPGK APKLLIF | A------- AFSLQS | GVPSRFSGSGSG--- TDFTLTISSLQPADFATYYC | QQANS---- ----FPWT | FGQGT KVEIK |
| IPS:434 007 | 21-225_48D7 | VK1|L5/J K1 | DIQMTQSPSSVSA SVGDRVTITC | RAS--QNIT- ----SWLA | WYQQKPGK APKLLIY | S------- ASSLQN | AVPSRFSGSGSG--- TDFTLTISSLQPEDVTYYC | QQANS---- ----FPWT | FGQGT KVEIK |
| IPS:434 063 | 21-225_51G7 | VK1|L5/J K1 | DIQMTQSPSSVSA SVGDRVTITC | RAS--QGIS- ----SWLA | WYQQKPGK APKVLIY | A------- PSNLQS | GVPSRFSGSGSG--- TDFTLTISSLQPEDFATYYC | QQAHS---- ----FPWT | FGQGT KVEIK |
| IPS:434 083 | 21-225_52H2 | VK1|L5/J K1 | DIQMTQSFSSVSA SVGDRVTITC | RAS--QNIT- ----NWLA | WFQQKPGK APKLLIY | T------- TSSLQS | GVPSRFSGSGSG--- TDFTLTISSLQPEDFATYYC | QQTNS---- ----FPWT | FGHGT KVEIK |
| IPS:434 133 | 21-225_54G3 | VK1|L5/J K1 | DIQMTQSPSSVSA SVGDRVTITC | RAS--QGIS- ----SWLA | WYQQKPGK APKLLIY | D------- ASSLQS | GVPSRFSGSGSE--- TDFTLTISSLQPEDFATYYC | QQANS---- ----FPWT | FGQGT KVEIK |
| IPS:434 221 | 21-225_60A11 | VK1|L5/J K1 | DIQMTQSPSSVSA SVGDRVTITC | RAS--QVIS- ----NWLA | WYQLKPGK APKLLIY | T------- ASSLQS | GVPSRFSGSGNE--- TDFTLTISSLQPEDFATYYC | QQANS---- ----FPWT | FGQGT KVEIK |
| IPS:434 283 | 21-225_57F8 | VK1|L5/J K1 | DIQMTQSPSSVSA SVGDRVTITC | RAS--QGIS- ----NWLA | WYQQKPGK APKLLIY | T------- ASSLQS | GVPSRFSGNEKG--- TDFTLTISSLQPEDFATYYC | QQANS---- ----FPWT | FGQGT KVEIK |
| IPS:435 711 | 21-225_171G4 | VK1|L5/J K1 | DIQMTQSPSSVSA SVGDRVTITC | RAS--QGVN- ----DWLA | WYQQKPGR APKLLIY | D------- ASSLQS | GVPSRFSGSGSG--- TDFTLTISSLQPEDFATYYC | QQTNS---- ----FPWT | FGQGT KVEIK |
| IPS:435 715 | 21-225_171A8 | VK1|L5/J K1 | AIQMTQSPSSVSA SVGDRVTITC | RAS--QGIS- ----NWLA | WYQQKPGK APNLMIH | A------- AFSLQG | GVPSRFSGSGSG--- TDFTLTISSLQPEDFATYYC | QQTNS---- ----FPWT | FGQGT KVEIK |
| IPS:435 717 | 21-225_171A9 | VK1|L5/J K1 | DIQMTQSPSSVSA SVGDRVTITC | RAS--QDIT- ----TWLA | WYQLKPGK APKLLIY | D------- ASSLQS | AVPSRFSGSGSG--- TDFTLTVSSLQPEDFATYYC | LQTNS---- ----FPWT | FGQGT KVEIK |
| IPS:435 739 | 21-225_174G7 | VK1|L5/J K1 | DIQMTQSPSSVSA SVGDRVTITC | RAS--QGIS- ----NWLA | WYQQKPGK APKLLIY | A------- ASSLQS | GVPSRFSGSGSG--- TDFTLTISSLQPEDFATYYC | QQTNS---- ----FPWT | FGQGT KVEIK |
| IPS:435 749 | 21-225_175C1 0 | VK1|L5/J K1 | DIQMTQSPSSVSA SVGDRVTITC | RAS--QGIT- ----DWLA | WYQQKPGK APKLLIY | A------- ASSLQS | GVPSRFSGSGSG--- TDFTLIFSSLQPDEFATYYC | QQTNS---- ----FPWT | FGQGT KVEIK |
| IPS:435 775 | 21-225_178A5 | VK1|L5/J K1 | DIQMTQSPSSVSA SVGDRVTITC | RAS--QGIS- ----NWLA | WYQQKPGK APKLLIY | A------- ASSLQS | GVPSRFNGSGSG--- TDFTLTISSLQPEDFATYCC | QQANS---- ----LPWT | FGQGT KVEIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:435777 | 21-225_178F7 | VK1|L5/J K1 | DIQMTQSPSSVSA SVGDRVTITC | RAS--QDIT----DWLA | WYQQKPGK APKLLIS | A-------ASSLQS | GVPSRFSGSGSG--TDFTLAISSLQPEDFATYYC | QQANS--------LPWT | FGGGT KVEIK |
| iPS:435783 | 21-225_179G1 | VK1|L5/J K1 | DIQMTQSPSSVSA SVGDRVTITC | RAS--QDIS----DWLA | WYQQKSGK APKLLIS | A-------ASSLQS | GVPSRFSGSGSG--TDFTLTISSLQPEDFATYSC | QQANS--------LPWT | FGGGT KVEIK |
| iPS:435875 | 21-225_190B9 | VK1|L5/J K1 | DIQMTQSPSSVSA SVGDRVTITC | RAS--QGIN----NWLA | WYQQKPGK APKLLIY | G-------VSSLQS | GVPSRFSGSGSG--TDFTLTISSLQPEDFATYSC | QQANS--------FPWT | FGGGT KVEIK |
| iPS:435895 | 21-225_188E8 | VK1|L5/J K1 | DIQMTQSPSSVSA SVGDRVTITC | RAN--QDIS----SWLA | WYQQKPGK APKLLIY | A-------ASNLQS | GVPSGFSGSGSG--TDFTLTISSLQPEDFATYYC | QQANS--------FPWT | FGGGT KVEIK |
| iPS:435909 | 21-225_190H3 | VK1|L5/J K1 | DIQMTQSPSSVSA SVGDRVTITC | RAS--QGLN----NWLA | WYQLKPGK APKLLIY | V-------VSSLQS | GVPSRFSGSGSG--SEFTLTISSLQPEDFATYHC | QQANS--------LPWT | FGGGT KVEIK |
| iPS:436013 | 21-225_193F2 | VK1|L5/J K1 | DIQMTQSPSSVSA SVGDRVTITC | RAS--QGIN----NWLA | WYQQKPGK APKLLIY | G-------VSSLQS | GVPSRFSGSGSG--TDFTLTISSLQPEDFATYSC | QQANS--------FPWT | FGGGT KVEIK |
| iPS:436068 | 21-225_194F7 | VK1|L5/J K1 | DIQMTQSPSSVSA SVGDRVTITC | RAS--QGIS----RWLA | WFQQKPGK APKLLIY | A-------ASSLQS | GVPSRFSGSGSG--TDFTLTISSLQPEDFATYYC | QQANS--------FPWT | FGGGT KVEIK |
| iPS:436100 | 21-225_195G12 | VK1|L5/J K1 | DIQMTQSPSSVSA SVGDRVTITC | RAS--QGIN----NWLA | WYQQKPGK APKLLIY | G-------VSSLQS | GVPSRFSGSGSG--TDFTLTISSLQPEDFATYSC | QQANS--------FPWT | FGRGT KVENQ |
| iPS:436116 | 21-225_196B9 | VK1|L5/J K1 | DIQMTQSPSSVSA SVGDRVTITC | RAS--QGIS----NCLA | WYQQKPGK APKFLIC | A-------ASSLQS | AVPSRFSGSGSG--TDFTLTISSLQPEDFASYYC | QQGDS--------FPPT | FGGGT KVEFR |
| iPS:436160 | 21-225_197C9 | VK1|L5/J K1 | DIQMTQSPSSVSA SVGDRVTITC | RAS--QGIS----NWLA | WFQQKPGK APQLLIY | A-------ASSLQS | GVPSRFSGSGSG--TDFTLTISSLQPEDFATYYC | QQANS--------FPWT | FGGGT KVEIK |
| iPS:436546 | 21-225_224D6 | VK1|L5/J K1 | DIQMTQSPSSVSA SVGDRVTITC | RAS--QGIS----SWLA | WYQQKPGK APKLLIY | G-------ASSLQS | GVPSRFSASGSG--TDFTLTISSLQPEDFATYCC | QQANS--------FPRT | FGGGT KVEIK |
| iPS:436632 | 21-225_227E4 | VK1|L5/J K1 | DILMTQSPSSVSA SVGDRVTITC | RAS--QGII----NWLA | WYQQKPGK APKLLIY | A-------ASSLQS | GVPSRFSGSGSG--TDFTLTISSLQPEDFATYCC | QQANS--------FPWT | FGGGT KVEIK |
| iPS:436650 | 21-225_17A4 | VK1|L5/J K1 | DIQMTQSPSSVSA SVGDRVTITC | RAS--QGIG----NWLA | WYQQKPGK APKLLIF | A-------ASSLQS | GVPSRFSGSGSG--TDFTLTISSLQPEDFVTYYC | QQANS--------FPRT | FGGGT KVEIK |
| iPS:392728 | 21-225_20F7 | VK1|L5/J K1 | DIQMTQSPSSVSA SVGDRVTITC | RAS--QGIS----SWLA | WYQQKPGK APKLLIY | A-------ASSLQS | GVPSRFSGSGSG--TDFTLTISSLQPEDFATYYC | QQANS--------FPWT | FGGGT KVEIK |
| iPS:392916 | 21-225_27C5 | VK1|L5/J K1 | DIQMTQSPSSVSA SVGDRVTITC | RAS--QGIS----SWLA | WYQQKPGK APKFLIY | G-------ASSLQS | GVPSRFSASGSG--TDFTLTISSLQPEDFATYYC | QQYDS--------FPRT | FGGGT KVEIK |
| iPS:392956 | 21-225_27A11 | VK1|L5/J K1 | DIQMTQSPSSVSA SVGDRVTITC | RAS--QGIS----SWLA | WYQQKPGK APKLLIY | G-------ASSLQS | GVPSRFSASGSG--TDFTLTISSLQPEDFATYYC | QQSDS--------FPRT | FGGGT KVEIK |
| iPS:393014 | 21-225_26D12 | VK1|L5/J K1 | DIQMTQSPSSVSA SVGDRVTITC | RAS--QGIS----SWLA | WYQQKPGK APKLLIY | A-------ASSLQS | GVPSRFSGSGSG--TDFTLTISSLQPEDFATYYC | QQSDS--------FPRT | FGGGT KVEIK |
| iPS:393028 | 21-225_25D7 | VK1|L5/J K1 | DIQMTQSPSSVSA SVGDRVTITC | RAS--QDIF----DWLA | WYQQKPGT APKLLIY | A-------ASSLQS | GVPSRFSGSGSG--TNFTLTVSGLQPEDFATYYC | QQAYS--------FPWT | FGGGT KVEIK |
| iPS:393152 | 21-225_25B3 | VK1|L5/J K1 | DIQMTQSPSSVSA SVGDRVTITC | RAS--QGIS----SWLA | WYQQKPGK APKLLIY | G-------ASSLQS | GVPSRFSASGSG--TDFTLTISSLQPEDFATYYC | QQSDS--------FPRT | FGGGT KVEIK |
| iPS:393810 | 21-225_5A4 | VK1|L5/J K1 | DIQMTQSPSSVSA SVGDRVTITC | RAS--QGIS----TWLA | WYQQKPGK APKLLIY | D-------ASSLQS | GVPSRFSGSGSG--TDFTLTISSLQPEDFATYYC | QQANS--------FPWT | FGGGT KVEIK |
| VK2A19/JK3 | | Germline | | | | | | | |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:433 943 | 21-225_44E10 | VK2|A19/ JK1 | DIVMTQSPLSLPV TPGEPASISC | RSS---QSLLHSN-GYSYLE | WYLQKPGQ SPQLLIY | L------GSNRAS | GVPDRFSGSGSG-TDFTLKISRVEAEDVGVYYC | MQYLQ-------TPFT | FGPGT KVDIK |
| iPS:433 989 | 21-225_47C7 | VK2|A19/ JK3 | DIVMTQSPLSPPV TPGEPASISC | RSS---QSLLHSN-GYNYLE | WYLQKSGQ SPQFLIY | L------GFNRAS | GVPDRPTGSGSG-TDFTKISRVEAEDVGVYYC | MQVLQ-------TPFT | FGPGT KVDIK |
| | VK1|O12/ K3 | Germline | | | | | | | K_FR4 |
| iPS:433 999 | 21-225_48D1 | VK1|O12/ JK3 | DIQMTQSPSSLSA SVGDRVNITC | RAS---QSIS-------SYLI | WYQQKPGK APKLLIY | A-------ASSLQS | GVPSRFSASGSG-TDFTLTISSLQPEDFASYYC | QQSNS-------IPFT | FGPGT KVDIK |
| iPS:434 003 | 21-225_48C3 | VK1|O12/ JK3 | DIQMTQSPSSLSA SVGDRVNITC | RAS---QSII-------SYLI | WYQQKPGK APKLLIY | A-------ASSLQS | GVPSRFSASGSG-TDFTLTISSLQPEDFASYYC | QQTNS-------IPFT | FGPGT KVDIK |
| iPS:434 037 | 21-225_49G12 | VK1|O12/ JK3 | DIQMTQSPSSLSA SVGDRVTITC | RSS---QSIS-------TYLM | WYQQKPGK APKLLIY | A-------ASSLQI | GVPSEFSASGSG-TDFTLTISSLQPEDFATYYC | QQSYS-------IPFT | FGPGT KVDIK |
| iPS:434 041 | 21-225_50H8 | VK1|O12/ JK3 | DIQMTQSPSSLSA SVGDRVNITC | RAS---QSIS-------SYLI | WYQQKPGK APKLLIY | A-------ASSLQS | GVPSRFSASGSG-TDFTLTISSLQPEDFASYYC | QQSNS-------LFFT | FGPGT KVDIK |
| iPS:434 045 | 21-225_50H10 | VK1|O12/ JK3 | DIQMTQSPSSLSA SVGDRVNITC | RAS---QSIY-------SYLI | WYQQKPGK APKLLIY | A-------ASSLQS | GVPSRFSASGSG-TDFTLTISSLQPEDFASYYC | QQSNS-------IPFT | FGPGT KVDIK |
| iPS:434 049 | 21-225_50B12 | VK1|O12/ JK3 | DIQMTQSPSSLSA SVGDRVTITC | RAS---QSIS-------SYLN | WYQHKPGK APKLLIY | A-------ASSLQS | GVPSRPSGSESG-TDFTLTISSLQPEDFTTYYC | QQSYI-------APFT | FGPGT KVDIK |
| iPS:434 073 | 21-225_51H10 | VK1|O12/ JK3 | DIQMTQSPSSLSA SVGDRVTITC | RAS---QSIS-------TYLM | WYQQKPGK APKLLIY | A-------ASSLQS | GVPSEFSASGSG-TDFTLTISSLQPEDFATYYC | QQSYS-------IPFT | FGPGT KVDIK |
| iPS:434 107 | 21-225_53E2 | VK1|O12/ JK3 | DIQMTQSPSSLSA SVGDRVTITC | RAS---QSFS-------HYLN | WYQQKPGK APNLLIF | V-------VSSLQS | SDFTLPISSLQPEDFATYFC | QQSFS-------TPFT | FGPGT KVDIK |
| iPS:434 181 | 21-225_56B2 | VK1|O12/ JK3 | DIQMTQSPSSLSA SVGDRVTITC | RAS---QSFS-------HYLN | WYQQKPGK APNLLIF | A-------VSSLQS | GVPSRFSGSGSG-TDFTLTISSLQPEDFAPYYC | QQSYS-------TPFT | FGPGT KVDIK |
| iPS:434 225 | 21-225_60E12 | VK1|O12/ JK3 | DIQMTQSPSSLSA SVGDRVTITC | RAS---QSIS-------SYLN | WYQQKPGK APKLLIY | A-------ASSLQS | GVPSRFSGSGSG-TDFTLTISSLQPEDFAPYYC | QQSYN-------ISFT | FGPGT KVDIK |
| iPS:434 227 | 21-225_61A1 | VK1|O12/ JK3 | DIQMTQSPSSLSA SVGDRVTITC | RAS---QNIF-------SYLN | WYQQKPGK APKLLIY | A-------ASSLQS | GVPSRFSGSGSG-TDFTLTISSLQPEDFAPYYC | QQSYS-------ISFT | FGPGT KVDIK |
| iPS:434 245 | 21-225_62H1 | VK1|O12/ JK3 | DIQMTQSPSSLSA YVGDRVTITC | RAS---QNIF-------SYLN | WYQFLPGK APKLLIY | V-------VFSLQS | GVPSRFSGSGSG-TDFTLTISSLQPEDFATYYC | QQSYS-------TPFT | FGPGT KVDIK |
| iPS:434 267 | 21-225_57F2 | VK1|O12/ JK3 | DIQMTQSPSSLSA SVGDRVTITC | RAS---QSIS-------SYLN | WYQQKPGK APKLLIY | A-------ASSLQS | GVPSRFSGSGSG-TDFTLTISSLQPEDFAPYYC | QQSYN-------ISFT | FGPGT KVDIK |
| iPS:434 323 | 21-225_62H8 | VK1|O12/ JK3 | DIQMTQSPSSLSA SVGDRVTITC | RAS---QSIF-------SYLN | WYQQNPGK APKLLIY | A-------SSSLQS | GVPSRLSGNGSG-TDFTLTISSLQPEDFATYYC | QQSYS-------IPFT | FGPGT KVDIK |
| iPS:434 379 | 21-225_66A9 | VK1|O12/ JK3 | DIQMTQSPSSLSA SVGDRVTITC | RAS---QNIF-------SYLN | WYQQKPGK APKLLIY | A-------ASSLQS | GVPSRFSGSGSG-TDFTLTISSLQPEDFATYYC | QQTYS-------VPFT | FGPGT KVDFK |
| iPS:434 417 | 21-225_69C8 | VK1|O12/ JK3 | DIQMTQSPSSLSA SVGDRVTITC | RAG---QTIY-------NYLN | WYQFLPGK APKLLIH | V-------ASSLQS | TDFTLVISSLQPEDFATYYC | QQSYS-------TPFT | FGPGT KVDIK |
| iPS:435 545 | 21-225_158F4 | VK1|O12/ JK3 | DIQMTQSPSSLPA SVGDRVTITC | RAS---QNIR-------KYLH | WYQFLPGK APKLLIY | T-------ASTLQS | GVPSRFSGSGSG-TDFTLTISSLQPEDFATYYC | QQSYN-------ISFT | FGPGT KVDIK |
| iPS:435 793 | 21-225_180F8 | VK1|O12/ JK3 | DIQMTQSPSSLSA SVGDRVTITC | RAS---QTIL-------SYLN | WYQQKPGK APKLLIY | G-------VSSLQS | GVPSRFSGSGSG-TDFSLTISSLQPEDFATYYC | QQSYS-------TPFT | FGPGT KVDIK |
| iPS:436 504 | 21-225_222H4 | VK1|O12/ JK3 | DIQMTHSPSSLSA SVGDRVTITC | RAS---QNIS-------NYVN | WYQQKPGK APKFLIY | T-------ASSLQS | GVSSRFSGSGSG-TDFTLTISSVHRDDFAIYYC | QQYIF-------TPFT | FGRGT KVDIK |

FIGURE 51 (Continued)

| ID | | | | | | | | | |
|---|---|---|---|---|---|---|---|---|---|
| iPS:436 510 | 21-225_222H8 | VK1/O12/ JK3 | DIQMTHSPSSLSA SVGDRVTITC | RAS--QNIS--- ---NYVN | WYQQKPGK APKLLIY | I------ ASSLQS | GVSSRFSGSGSG--- TDFTLTISSVHRDPAIYYC | QQYYP------- -------TPFT | FGRGT KVDIK |
| iPS:437 230 | 21-225_62H10 | VK1/O12/ JK3 | DIQMTQSPSSLSA SVGDRVTITC | RAS--QSIT--- ---SYLN | WYQQKPGK VPRLLIS | T------ ASSLQS | GVFSRFSGSGSG--- TDFTLSRFSGSGSG--- | QQSHS------- -------FPFT | FGPGT NVDFK |
| iPS:448 906 | 21-225_72G9 | VK1/O12/ JK3 | DIQMTQSPSSLSA SVGDRVTITC | RAS--QSIT--- ---SYLN | WYQQKPGK APKLLIY | T------ ASSLQS | GVFSRFSGSGSG--- TDFTLTISSLQPEDFATYYC | QQSHS------- -------FPFT | FGPGT KVDIK |
| iPS:392 652 | 21-225_17C6 | VK1/O12/ JK3 | DIQMTQSPSSLSA SVGDRVTITC | RAS--QSIN--- ---TYLN | WYQQKPGK APKLLIY | A------ ASSLQS | GVFSRFSGSGSG--- TDFTLTISSLQPEDFATYYC | QQSYR------- -------TPFFT | FGPGT KVDFK |
| iPS:392 660 | 21-225_19B3 | VK1/O12/ JK3 | DIQMTQSPSSLSA SVGDRITITC | RAG--QNII--- ---NYLN | WYQQKPGK APNLLIY | V------ ASSLQS | GVFSRFNGSGSG--- TDFTLTISSLQPEDFATYYC | QQSYR------- -------TPFT | FGPGT KVDIK |
| iPS:392 668 | 21-225_17B4 | VK1/O12/ JK3 | DIQMTQSPSSLSA SVGDRVTITC | RAS--QNIS--- ---SYLN | WYQQKPGK APKLLIF | G------ ASSLQT | GVPSRFSGSGSG--- TDFTLTINSLQPEDFATYFC | QQSYR------- -------TPFFT | FGPGT KVDFK |
| iPS:392 678 | 21-225_20F3 | VK1/O12/ JK3 | DIQMTQSPSSLSA SVGDRVTITC | RAS--QSIS--- ---SYLY | WYQQKPGK APKLLIY | A------ ASSLQS | GVPSRFSGSGSG--- TDFTLTISSLQPEDFATYYC | QQSYS------- -------APPFT | FGPGT KVDIK |
| iPS:392 694 | 21-225_19A5 | VK1/O12/ JK3 | DIQMTQSPSSLSA PVGDRVSITC | RAS--QNII--- ---NYLN | WYQQKPGK APKLLID | V------ ASNLQG | GVPSRFSGSGSG--- TDFTLTISSLQPEDFATYYC | QQSYS------- -------TPFT | FGPGT KVDIK |
| iPS:392 696 | 21-225_20A4 | VK1/O12/ JK3 | DIQMTQSPASLSA SVGDRVTITC | RAS--QSII--- ---NYLN | WYQQRPGK SPKLLIY | A------ ASSLHS | GVPSRFCGRGSG--- TDFTLTISSLQPEDFATYYC | QQSYR------- -------TPLFT | FGPGT KVDFK |
| iPS:392 702 | 21-225_17F7 | VK1/O12/ JK3 | DIQMTQSPSSLSA SVGDRVTITC | RAS--QTIS--- ---SFLN | WYQQKPGK APKLLIY | A------ ASSLQS | GVPSRFSGSGSG--- TDFTLTISSLQPEDFATYYC | QQSYR------- -------TPFT | FGPGT KVDIK |
| iPS:392 704 | 21-225_17F11 | VK1/O12/ JK3 | DIQMTQSPSSLSA SIGDRVSITC | RAS--RTIN--- ---NYLN | WYQQKPGK APKLLIF | A------ TSSLQS | GVPSRFSGSGSG--- TDFTLTISSLQPEDFATYYC | QQTYS------- -------TPLFA | FGPGT KVDIK |
| iPS:392 720 | 21-225_17A12 | VK1/O12/ JK3 | DIQMTQSPSSLSA SVGDRVTITC | RAS--QSIS--- ---SYLN | WYHQKPGK APKLLIY | A------ ASSLQS | GVPSRFSGSGSG--- TDFTLTISNLQPEDFATYYC | QQSYN------- -------TPLFT | FGPGT KVDIK |
| iPS:392 722 | 21-225_18E12 | VK1/O12/ JK3 | DIQMTQSPSSLSA SVGDRVTITC | RAS--QSIS--- ---SYLN | WYQQKFGK APTLLIY | A------ ASSLQS | GVPSRFSGSGSG--- TDFTLTINSLQPEDFATYYC | QQSYR------- -------TPFT | FGPGT KVDIK |
| iPS:392 760 | 21-225_22G3 | VK1/O12/ JK3 | DIQMTQSPSSLSA SVGDRVTITC | RAS--QSIS--- ---NYLN | WYQQKPGK APKLLIF | A------ ASSLQS | GVPSRFSGSGSG--- TDFTLTISGLQPEDFATYFC | QQSFR------- -------TPFFT | FGPGT KVDFK |
| iPS:392 762 | 21-225_22G5 | VK1/O12/ JK3 | DIQMTQSPSSLSA SVGDRVTITC | RAS--QNIS--- ---SYLN | WYQQKQGK APKLLIY | A------ ASSLQN | GVPSRFSGSGSG--- TDFTLTISSLQPEDFATYYC | QQSYR------- -------TPLFT | FGPGT KVDFK |
| iPS:392 764 | 21-225_22G10 | VK1/O12/ JK3 | DIQMTQSPSSLSA SVGDRVTITC | RAS--QSIS--- ---SYLN | WYHQKPGK APKLLIY | A------ ASSLQS | GVPSRFSGSGSG--- TDFTLTISSLQPEDFATYYC | QQSFR------- -------TPLFT | FGPGT KVDFK |
| iPS:392 812 | 21-225_21F4 | VK1/O12/ JK3 | DIQMTQSPSSLSA SVGDRVTITC | RAS--QNIG--- ---SYLN | WYQQKPGK APKLLIF | A------ ASSLQS | GVPSRFSGSGSG--- TDFTLTISSLQPEDFATFFC | QQSYN------- -------TPFFT | FGPGT KVDFK |
| iPS:392 816 | 21-225_22E4 | VK1/O12/ JK3 | DIQMTQSPSSLSA SVGDRVTITC | RAS--QNIS--- ---SYLN | WYQQKPGK APKLLIY | A------ ASSLQS | GVFSRFSGSGSG--- TDFTLTISSLQPEDFATYYC | QQSYN------- -------TPLFT | FGPGT KVDIK |
| iPS:392 830 | 21-225_21A5 | VK1/O12/ JK3 | DIQMTQSPSSLCA SVGDRVTITC | RAS--QIIS--- ---SHLN | WYQRKPGK APKLLIY | A------ ASSLQS | GVFSRFSGSGSG--- TDFTLTISSVQPEDFATYYC | QQSYN------- -------ISFT | FGPGT KVDIK |
| iPS:392 852 | 21-225_21A2 | VK1/O12/ JK3 | DIQMTQSPSSLSA SVGDRVTITC | RAS--QSIS--- ---NYLN | WYQQKPGK APKLLIF | A------ ASSLQS | GVPSRFSGSGSG--- TDFTLTISSLQPEDFATYFC | QQSYR------- -------TPFFT | FGPGT KVDFK |
| iPS:392 878 | 21-225_22C5 | VK1/O12/ JK3 | DIQMTQSPASLSA SVGDRVTITC | RAS--QSIS--- ---SYLN | WYQQKPGK APKLLIY | A------ ASVLQH | GIFSRFSGRGSG--- TDFTLTISSLQPEDFATYYC | QQSYS------- -------TPLFT | FGPGT KVDFK |
| iPS:392 902 | 21-225_22D5 | VK1/O12/ JK3 | DIQMTQSPSSLSA SVGDRVTITC | RAS--QNIF--- ---SYLN | WYHQKPGK APKLLIY | A------ ASSLQS | GVFSRFSGSGSG--- TDFTLTISSLQPEDFATYYC | QQSYS------- -------TPLFT | FGPGT KVDIK |
| iPS:392 984 | 21-225_30E11 | VK1/O12/ JK3 | DIQMTQSPSSLSA SVGDRVTITC | RAS--QSIS--- ---NYLN | WYQQQTGK APKLIY | A------ ASSLQS | GVPSRFSGSGSG--- TDFTLTISSLQPEDFATYYC | QQSYS------- -------TPFT | FGPGT KVDIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| | | Germline | | | | | | | |
| iPS:393_114 | 21-225_33G12 | VK1|O12/JK3 | DIQMTQSPSSLSA SVGDRVTITC | RAS--QSIS-----NYLN | WYQQQTGK APKFLIY | A------ASSLQS | GVPSRFSGGSG--TDFTLTISSLQPEDFATYYC | QQSYS-------TPFT | FGPGT KVDIK |
| iPS:393_824 | 21-225_10F12 | VK1|O12/JK3 | DIQMTQSPSSLSA SVGDRVTITC | RAS--QNIS-----SYLN | WYQQKPGK APKLLIY | A------ASSLQS | GVPSRFSGGSG--TDFTLTISSLQPEDFATYYC | QQSYN-------TPFFT | FGPGT KVDIK |
| iPS:393_848 | 21-225_4H2 | VK1|O12/JK3 | DIQMTLSPSSLSA SVGDRVTITC | RAI--QNIS-----SYLN | WYQQKPGK APKLVIY | A------ASSLQS | GVPSRFSGRGSG--TDFTLTIGCVQREDFATYYC | QQSYR-------TPLFT | FGPGT KVDIK |
| iPS:393_862 | 21-225_5G2 | VK1|O12/JK3 | DIQMTQSPSFSPA SVGDRVTITF | RAS--QNII-----SYLN | WTQQKPGK ARKLVIY | G------ASSLQS | GVPSRFSGGSG--TDFTLNIRLQPEDFATYYC | QQSYS-------TPLPT | FGPGT KVDIK |
| iPS:393_888 | 21-225_3E3 | VK1|O12/JK3 | DIQMTQSPSPSA SVGDRVTITF | RAS--QSIR-----SYLN | WYQQKPGK AHKIVIY | A------TSSLQS | GVPSRFSGGSG--TDFTLTISSLQPEDFATYYC | QQSYS-------TPLPT | FGPGT KVDIK |
| iPS:393_890 | 21-225_4B1 | VK1|O12/JK3 | DIQMTQSPSSLSA SVGDRVTITC | RAS--HTIR-----TYLN | WYQQKPGK APKLLIY | A------ASSLQS | GVPSRINGSSG--TDFTLTITNLQPEDFATYYC | QQSYN--------ISPT | FGPGT KVVIK |
| iPS:393_898 | 21-225_5F7 | VK1|O12/JK3 | DIQMTQSPSFSA FVGDRVTITF | RAS--QTIS-----SYLN | WYQQKPGK APKLLIS | A------ASSLQS | GVPSRFSGGSG--TDFTLTISSLQPEDFATYYC | QQSYS-------TPLPT | FGPGT KVVIK |
| iPS:393_904 | 21-225_8H11 | VK1|O12/JK3 | DIQMTQSPSSLSA SVGDRVTITC | RAS--QNII-----SYLN | WYQQKPGK APNLMIY | V------TSSLHS | GVPSRFSGGSG--TDFSLTIISSLQPEDFATYYC | QQSYS-------TPFT | FGPGT KVVIK |
| iPS:393_936 | 21-225_14A11 | VK1|O12/JK3 | DIQMTQSPSSLSA SIGDRVTITC | RAS--QSIS-----SYLN | WYQQKPGK APKLLIF | A------ASSLQN | GVPSRFSGGSG--TDFTLTISSLQPEDFATYFC | QQTYS-------SPFFT | FAPGT KVDIK |
| iPS:393_980 | 21-225_6D3 | VK1|O12/JK3 | DIQMTQSPSSLSA SVGDRVTITC | RTS--QSIS-----TYLN | WYQQKPGK APKLLIF | A------ASSLQS | GVPSRFSGGSG--TDFTLTISSLQPEDFATYYC | QQSYR-------TPFT | FGPGT KVDIK |
| iPS:394_014 | 21-225_8G6 | VK1|O12/JK3 | DIQMTQSPSSLSA SVGDRVTITC | RAS--QSIS-----SYLN | WYQQKPGK APKLLIE | A------ASSLQS | GVPSRFSGGSG--TDFTLTISSLQPEDFATYYC | QQSYS-------TPFT | FGPGT KVDIK |
| iPS:394_022 | 21-225_16H6 | VK1|O12/JK3 | DIQMTQSPSLSA SVGDRVTITC | RAS--QNIS-----SYLN | WYQQKPGK APKLLIY | A------ASSLQS | GVPSRFSGRGSG--TDFTLTISSLQPEDFATYYC | QQSYR-------TPLFT | FGPGT KVDFK |
| iPS:394_043 | 21-225_3B1 | VK1|O12/JK3 | DIQMTQSPSSLSA SVGDRVTITC | RAS--QSIN-----NYLN | WYQQKPGK APKLLIY | A------TSSLQN | GVPSRFSGGSG--TDFTLTISSLQPEDFATYYC | QQSYS-------TPLFT | FGPGT KVDIN |
| iPS:394_051 | 21-225_9E5 | VK1|O12/JK3 | DIQMTQSQSSLSA SVGDRVTITC | RAS--QSIA-----SYLN | WYQQKPGK APKLLIY | G------ASSLQS | GVPSRFSGGSG--TDFTLTISSLQPEDFATYYC | QQSYS-------TPLFS | FGPGT KVDIK |
| iPS:394_077 | 21-225_8E12 | VK1|O12/JK3 | DIQMTQSPSSLSA SVGDRVTITC | RAS--QSIS-----NYLN | WYQQKPGK APKLLIY | A------ASSLQS | GVPSRFSGGSG--TDFTLTISSLQPEDFATYFC | QQSYR-------TPFFT | FGPGT KVDIK |
| iPS:394_087 | 21-225_11A5 | VK1|O12/JK3 | DIQMTQSPSSLSA SVGDRVTITC | RAS--QNIY-----SYLN | WYQQKPGK APKLLIY | E------VSHRFS | GVPSRFSGGSG--TDFTLTISSLQPEDFATYYC | QQSYN-------TPLFT | FGPGT KVDIK |
| VK2|A18|JK3 | | | | | | | | | |
| iPS:434_053 | 21-225_51E1 | VK2|A18/JK3 | DIVMTQTPLSLSV TPGQPASMSC | KSS---QSLLHSE-GKTYLY | WYLRKPGQ PPQFLIF | E------VSNRFS | GVPDRFSGGSG--TEFTLKISRVEAEDVGVYYC | MQSIQ--------LPPT | FGPGT KVDIK |
| iPS:434_137 | 21-225_54D4 | VK2|A18/JK3 | DIVMTQTPLSLSV TPGQPASMSC | KSS---QSLLHSE-GKTYLY | WYLRKPGQ PPQFLIF | E------VSNRFS | GVPDRFSGGSG--TEFTLKISRVEAEDVGIYYC | MQSIQ--------FPPT | FGFGT KVDIK |
| iPS:434_149 | 21-225_55H1 | VK2|A18/JK3 | DIVMTQTPLSLSV TPGQPASISC | KSS---QSLLHSE-GNTYLY | WYLQKPGQ PPQFLIF | E------VSHRFS | GVPDRFSGGSG--TDFTLKISRVEAEDVGVYYC | MQSIQ--------LPFT | FGPGT KVDIK |

FIGURE 51 (Continued)

| iPS | | VK2/A18/JK3 | DIVMTQTPLSLSV TPGQPASISC | KSS—QSLLHSE-GNTYLY | WYLQKPGQ PPQLLIY | E—VSHRVS | GVPDRFSGSGSG—TDFTVKISRVEAEDVGVYYC | MQSTQ——FPPT | FGPGT KVDIK |
|---|---|---|---|---|---|---|---|---|---|
| iPS:435 315 | 21-225_147B2 | | | | | | | | |
| | | Germline | K_FR1 | K_CDR1 | K_FR2 | K_CDR2 | K_FR3 | K_CDR3 | K_FR4 |
| | | VK1|O18/J K3 | | | | | | | |
| iPS:434 055 | 21-225_51B4 | VK1|O18/ JK3 | DIQMTQSPSSLSA SVGDRVTITC | QAS—RDIT—-----FYLN | WYQQKPGK APKLLIY | D-------ASNLET | TDFTFTISCVHPEDIATYLC | QQYDN——LPFT | FGPGT TVDIK |
| | | Germline | K_FR1 | K_CDR1 | K_FR2 | K_CDR2 | K_FR3 | K_CDR3 | K_FR4 |
| | | VK1|O18/J K4 | | | | | | | |
| iPS:434 087 | 21-225_52F6 | VK1|O18/ JK4 | DIQMTQSPSSLSA SVGDRVTITC | QAS—QDIS—-----NYLH | WYQQKPGK APKLLIY | D-------ASTLGT | GVPLRFSGSGSG—TDFFTINSLQPEDIATYSC | QQCDN——LPLT | FGGGT KVEIK |
| iPS:434 111 | 21-225_53H2 | VK1|O18/ JK4 | DIQMTQSPSSLSA SVGDRVTITC | QAS—QDIS—-----NYLH | WYQQKPGK APQLLIY | D-------ASNLET | GVPSRFTGSGSG—TDFTFTISSLQPEDIATYYC | HQYDN——LPLI | FGGGT KVEIK |
| iPS:434 121 | 21-225_53F6 | VK1|O18/ JK4 | DIQMTQSPSSLSA SVGDRVTITC | QAS—QDIT—-----NYLD | WYQQKPGK APKLLIY | D-------ASNLGT | TDFTFTISSLQPEDIATYYC | QQCDN——LPLI | FGGGT KVEIK |
| iPS:434 163 | 21-225_50H1 | VK1|O18/ JK4 | DIQMTQSPSSPSA SVGDRVTITC | QAS—QDIS—-----NYLD | WYQQKPGK APKLLIY | D-------ASNLEI | GVPSRFSGSGSG—TDFAFTISSLQPEDIATYYC | QQCDN——LPLT | FGGGT KVEIK |
| iPS:435 611 | 21-225_161F10 | VK1|O18/ JK4 | DIQMTQSPSSLSA SVGDRVTITC | QAS—QDIY—-----NHLS | WYQQKPGK APKLLIY | D-------ASNWEI | GVPSRFSGSGSG—TDFTFTISSLQPEDIATYYC | QQYEN——LPLT | FGGGT KVEIK |
| iPS:435 811 | 21-225_183H6 | VK1|O18/ JK4 | DIQMTQSPSSLSA SVGDRVTIAC | QAS—QDIS—-----NYLN | WYQQTPGN APKVLIY | D-------ASNLET | GVPARFSGSGSG—TDFTFTISSLQPEDIATYYC | QQYDN——LPLI | FGGGT KVDIK |
| iPS:394 035 | 21-225_5G9 | VK1|O18/ JK4 | DIQMTQSPSSLSA SVGDRVTITC | QAS—QGIS—-----NSLN | WYQQKPGK APKLLIY | D-------ASNLET | GVPSRFSGSGAG—TDFTFTISSLQPEDIATYYC | QQYDN——LPLT | FGGGT KVEIK |
| | | Germline | K_FR1 | K_CDR1 | K_FR2 | K_CDR2 | K_FR3 | K_CDR3 | K_FR4 |
| | | VK1|L1|JK1 | | | | | | | |
| iPS:434 095 | 21-225_52F10 | VK1|L1/ K1 | DIQMTQSPSSLSV SVGDRVTITC | RAS—QGIS—-----NYLG | WFQQKPGK APKSLII | A-------ASSLQS | GVPSRFSGSGSG—TDFTLTISSLQPEDFATYYC | QQYNS——YPPT | FGQGT KVEIK |
| iPS:392 848 | 21-225_20F9 | VK1|L1/ K1 | DIQMTQSPSSLSA SVGDRITITC | RAS—QGIS—-----NYLA | WFQQKPGK APKSLIS | A-------ASSLQS | GVPSKFSGSGSG—TDFTLTISSLQPEDFATYYC | QQYHS——YFMT | FGQGT KVEIK |
| iPS:393 078 | 21-225_33H11 | VK1|L1/ K1 | DIQMTQSPSSLSA FVGDRVTITC | WAS—QGIN—-----SYLA | WFQQRPGK AHKSLIY | A-------ASSLQS | GVPSRFSGSGSG—TDFLLTISLQREDFATYYC | QQFNS——YPLI | FGQGT KVEIK |
| iPS:393 142 | 21-225_33A3 | VK1|L1/ K1 | DIQMTQSPSSLSA SVGDRVTITC | RAS—QGIN—-----NYLA | WFQQKPGK APKSLIY | A-------ASSLQS | GVPSKFSGSGSG—TDFTLTISSLQPEDFATYYC | QQFNS——YFPT | FGQGT KVEIK |
| iPS:393 946 | 21-225_16A4 | VK1|L1/ K1 | DIQMTQSPSSLSA SVGDRVTITC | RAS—QDIS—-----NYLA | WFQQKPGK APKSLIS | A-------ASSLQS | GVPSKFSGSGSG—TDFTLTISSLQPEDFATYYC | QQYHS——YFWT | FGQGT KVEIN |
| | | Germline | K_FR1 | K_CDR1 | K_FR2 | K_CDR2 | K_FR3 | K_CDR3 | K_FR4 |
| | | VK1|L12|K5 | | | | | | | |
| iPS:434 117 | 21-225_53C6 | VK1|O12/ JK5 | DIQMTQSPSSLSA SVGDRVTITC | RAS—QYSS—-----DYLN | WYQQKPGK APKVLIF | A-------ASSLKS | GVPSRFSGSGSG—TDFTLTISSLEPEDFATYFC | QQSYS——TPFT | FGQGT RLEIK |
| iPS:434 317 | 21-225_59E8 | VK1|O12/ JK5 | DIQMTQSPSSLSA SVGDRVTITC | RAS—QSIS—-----SYLN | WYQQKPGK APKLLIY | A-------ASSLQS | GVPSRFSGSGSG—TDFTLTISSLQPEDFATYFC | QQSFS——NSIT | FGQGT RLEIK |
| iPS:434 327 | 21-225_63G6 | VK1|O12/ JK5 | DIQMTQSPSSLSA SVGDRVIISC | RAS—QSIF—-----SYLN | WYQVKPGK APKLLIY | D-------TSTLQT | GVPSRFSGSGSG—TDFTLTISSLQPEDFATYYC | QQSYG——IPIT | FGQGT RLEIQ |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:434 455 | 21-225_72F5 | VK1|O12/ JK5 | DIQMTQSPSSLSA SVGDRVTIFC | RAS--QNIS-----SYLN | WYQQKPGK APKLLIY | A------ASSLQS | GVPSRFSGSGSG--TDFTLTISSLQPEDFATYSC | QQTY-------STFT | FGQGT RLDIN |
| iPS:435 525 | 21-225_157E7 | VK1|O12/ JK5 | DIQMTQSPSSLSA SVGDRVTIFC | RAS--QSFS-----SYLN | WYQQKPGK APRLLIY | A------ASSLQS | GVPSRFSGSGSG--TDFTLTISSLQPEDFATYYC | QESYS------IRFA | FGQGT RLEIK |
| iPS:392 754 | 21-225_21D3 | VK1|O12/ JK5 | DIQMTQSPSSLSA SVGDRVTIIC | RAS--QSIT-----GYSN | WYQQKPGK TPKLLIF | A------TYSLES | GVPSRFSGSGFG--TNFTLTITSLQPEDFATYYC | QQSYS------TSIT | FGQGT RLEIK |
| iPS:392 818 | 21-225_22D8 | VK1|O12/ JK5 | DIQMTQSPSSLSA SVGDRVTIFC | RTS--QNSN-----SYLN | WYQQKPGK APKLQIF | A------AYSLES | GVPSRFSGNRSG--TDFTLTISSLQPEDFATYYC | QQTYG------TSIT | FGQGT RLEIK |
| iPS:393 064 | 21-225_33A9 | VK1|O12/ JK5 | DIQMTQSPSSLSA SVGDRVTIFC | RAS--QSIS-----RYLS | WYQQKPGR APRLLIY | A------ASSLQS | GVPSRFSGSGSG--TDFTLTISSLQPEDFATYYC | QQSYN------IPIT | FGQGT RLEIK |
| iPS:393 148 | 21-225_35E5 | VK1|O12/ JK5 | DIQMTQSPSSLSA SVGDRVTIIY | RAS--QSIS-----SYLN | WYQQKPAK APKLHIY | G------ASSFQS | WVPSRFSGSGSS--TDFTLTISMQPGDYATYYC | HQSYN------LPIT | FGQGT RLEIK |
| iPS:398 536 | 21-225_33D12 | VK1|O12/ JK5 | DVQMTQSPSSLSA SLGDRVTIFC | RAS--QSIR-----SYLN | WYQQKPGK APNLLIY | S------ASSLQS | GVPSRFSGSGSG--TDFTLTISSLQPEDFANYYC | QQSYS------IPIT | FGQGT RLEIK |
| | Germline | | K_FR1 | K_CDR1 | K_FR2 | K_CDR2 | K_FR3 | K_CDR3 | K_FR4 |
| VK3|A27|JK2 | | | | | | | | | |
| iPS:434 127 | 21-225_53H8 | VK3|A27/ JK2 | EIVLTQSPGTLSL SPGERATLSC | RAS--QSITS----SYLA | WYQQKPGQ APRLLIY | G------ASGRAT | GIPDRFSGSGSG--IDFTLTISRLEPEDFAVYYC | QQPES------SPMCS | FGQGI NLEIK |
| iPS:436 290 | 21-225_205G3 | VK3|A27/ JK2 | EIVLTQSPGTLSL SPGERATLSC | RAS--QNVSY----SYLA | WYQQKPGQ APRLLIY | A------ASRRAT | GIPDRFSGSGSG--TDFTLTISRLEPEDFAVYYC | QQYGS------SPCS | FGQGT KLEIK |
| iPS:436 568 | 21-225_225B3 | VK3|A27/ JK2 | EIVLTQSPGTLSL SPGERATLSC | RAS--QNLSS----SYLG | WYQQKPGQ APRLLIY | D------TSSRAT | GIPDRFSGSGSG--TDFTLTISRLEPEDFAVYYC | QEYGS------SLMCS | FGQGT KLEIK |
| iPS:392 898 | 21-225_21H10 | VK3|A27/ JK2 | EIVLTQSPGTLSL SPGERATLSC | RAS--QSFSS----SYLA | WYQQKPGQ APRLLIY | G------ASSRAT | GIPDRFSGSGSG--TDFTLTISRLEPEDFAVYYC | QQYG-------SSRS | FGQGT KLEIK |
| iPS:393 802 | 21-225_3D12 | VK3|A27/ JK2 | EIVLTQSPGTLSL SPGERATLSC | RAS--QSVSS----SYLA | WYQQKPGQ APRLLIY | G------TSSRAT | GIPDRFSGSGSG--TDFTLTISRLEPEDFAVYYC | QQYG-------SSRS | FGQGT KLEIK |
| | Germline | | K_FR1 | K_CDR1 | K_FR2 | K_CDR2 | K_FR3 | K_CDR3 | K_FR4 |
| VK1|L1|JK4 | | | | | | | | | |
| iPS:434 157 | 21-225_55D4 | VK1|L1/ K4 | DIQMTQSPSSLFA SVGDRVTITC | RAS--QDIS-----NYLI | WFQQKPGK APKSLIY | T------ASSLQS | GVPSKFSGSGFG--TDFTLTISNLQPEDFATYYC | QQYHS------FPLT | FGGGT RVEIK |
| iPS:434 175 | 21-225_55A11 | VK1|L1/ K4 | DIQMTQSPSSLSA SVGDRVTITC | RAS--QDIN-----IYLA | WFQQKPGK APKSLIY | A------ASSLQS | GVPSKFSGSGSG--TDFTLTISRLQPEDFATYYC | QQYNS-----YPLT | FGGGT KVEIK |
| iPS:434 367 | 21-225_65H11 | VK1|L1/ K4 | DIQMTQSPSSLSA SVGDRVTITC | RAS--QDIS-----TYLA | WFGHKPGK APKSLIY | A------ASSLQS | GVPSKFSGSGSG--TDFTLTISRLQPEDFATYYC | QQYNS------FPLT | FGGGT KVEIK |
| iPS:434 429 | 21-225_70H6 | VK1|L1/ K4 | DIQMTQSPSSLSA SLGDRVTITC | RTS--QSIF-----NYLN | WFGRKPGK APKVLIY | T------ASSLQS | GIPSKFSGSGSG--TDFTLTISRLQPEDFATYYC | QQSYS------IPIT | FGGGT KVEIK |
| iPS:434 535 | 21-225_74C8 | VK1|L1/ K4 | DIQMTQSPSSLSA SVGDRVTITC | RAS--QGIG-----KYLA | WFQQKPGK APKSLIY | T------TSNLQS | GAPSKFSGSGSG--TDFTLTISSLQYEDSATYYC | QQYSN------YPLT | FGGGT KVEIN |
| iPS:434 573 | 21-225_77E6 | VK1|L1/ K4 | DIQMTQSPSSLSA SVGDRVTITC | RAS--QGIS-----KYLA | WFQQKPGK APKSLIY | A------ASSLQG | GAPSKFSGSGSG--TDFTLTISSLQPEDFATYYC | QQYSN------YPLT | FGGGT RVEIK |
| iPS:434 615 | 21-225_76C5 | VK1|L1/ K4 | DIQMTQSPSSLSA SVGDRVTITC | RAS--QVIS-----KYLA | WFQQKPGK APKSLIY | A------ASSLQS | GAPSKFSGSGSG--TDFTLTISSLQPEDFATYYC | QQYSN------YPLT | FGGGT KVEIK |
| iPS:434 669 | 21-225_79F4 | VK1|L1/ K4 | DIQMTQSPSSLSA SVGDRVTITC | RAS--QGIS-----KYLA | WFQQKPGK APKSLIY | A------ASSLQG | GAPSKFSGSGSG--TDFTLTISSLQPEDFATYYC | QQYSN------YPLT | FGGGT RVEIK |

FIGURE 51 (Continued)

| ID | V gene | Sequence | | | | | |
|---|---|---|---|---|---|---|---|
| iPS.434_737 | VK1/L1/J K4 | DIQMTQSPSSLSA SVGDRVTITC | RAS--QGIG-------KYLA | WFQQKPGK APKSLIY | T------TSSLQS | GAPSKFSGSSG---TDFTLTISSLQPEDFATYYC | QQYSN--------YPLT | FGGGT KVEIN |
| iPS.434_741 | VK1/L1/J K4 | DIQMTQSPSSLSA SVGDRVTITC | RAS--QGIG-------RYLA | WFQQKPGR APKSLIY | ASSLQS | GAPSKFSGSSG---TDFTLTISSLQPEDFATYYC | QQYSN--------YPLT | FGGGT KVEIK |
| iPS.434_867 | VK1/L1/J K4 | DIQMTQSPSSLSA SVGDRVTITC | RAS--QVIS-------KYLA | WFQQKPGK APKSLIY | A------ASSLQS | GAPSKFSGSSG---TDFTLTISSLQPEDFATYYC | QQYSN--------YPLT | FGGGT KVEIK |
| iPS.435_333 | VK1/L1/J K4 | DIQMTQSPSSLSA SVGDRVTITC | RAS--QDIN-------NYLA | WFQQKPGK APKSLIV | A------ASSLQS | GVPSKFSGSSG---TDFTLTISSLQPEDFATYYC | QQYNS--------YPLT | FGGGT KVEIK |
| iPS.435_409 | VK1/L1/J K4 | DIQMTQSPSSLSA SVGDRVTITC | RAS--QGIS-------HYLA | WFQQKPGK APKSLIY | V------ASSLQN | GVPSKFSGSSG---TDFTLTISSLQPEDFATYYC | QQYNM--------YPLT | FGGGT KVEIK |
| iPS.435_505 | VK1/L1/J K4 | DIQMTQSPSSLSA SIGDRILIC | RAS--QGIS-------NYLA | WFQQRPGK APKSLIY | A------ASSLLS | GVPSKFSGSSG---TDFTLTISSLQPEDFATYYC | QQYNS--------FPFT | FGGGT KVEIK |
| iPS.435_595 | VK1/L1/J K4 | DIQMTQSPSSLSA SVGDRVTITC | RAS--QDIS-------NYLV | WFQQKLGK APKSLIY | V------ASSLQS | GVPSRFSGSSG---TDFTLTISSLQPEDFATYYC | QQYNS--------YPLT | FGGGT KVEIK |
| iPS.435_639 | VK1/L1/J K4 | DIQMTQSPSSLSA SVGDRVTITC | RAS--QDIS-------NYLV | WFQQKPGK APKSLIY | A------ASSLLS | GVPSKFSGSSG---TDFTLTISSLQPEDFATYYC | QQYHS--------YPLT | FGGGT KVAIK |
| iPS.435_653 | VK1/L1/J K4 | DIQMTQSPSSLST SVGDRVTITC | RAS--QDIS-------HYLA | WFQQKPGK APKSLIY | V------ASSLQS | GVPSKFSGSSG---TDFTLTISSLQPEDFATYYC | QQYNS--------FPLT | FGGGT KVEIT |
| iPS.435_677 | VK1/L1/J K4 | DIQMTQSPSSLSA SVGDRVTITC | RAS--QDIS-------NYLA | WFQQKPGK APKSLIF | S------ASSLQS | GVPSKFSGSSG---TDFNLTISSLQPEDFATYYC | QQSDS--------YPLT | FGGGT KVEIK |
| iPS.435_699 | VK1/L1/J K4 | DIQMTQSPSSLSA SVGDRVAITC | RAS--QDIG-------NCLA | WFQQKPGK APKSLIY | S------ASSLQG | GVPSKFSGSSG---TDFTLTISSLQPEDFATYYC | QQSDS--------YPLT | FGGGT KVEIK |
| iPS.435_745 | VK1/L1/J K4 | DIQMTQSPSSLSA SVGDRVTITC | RAS--QDIS-------NDLA | WFQQKPGK APKSLIF | A------ASSLQS | GVPSKFSGSSG---TDFTLTISSLQPEDFATYYC | QQSDS--------YPLT | FGGGT KVEIK |
| iPS.435_819 | VK1/L1/J K4 | DIQMTQSPSSLSA SVGDRVTITC | RTS--QGIG-------NYLA | WFQQKPGK APKSLIY | K------TSSLQS | GVPSKFSGSSG---TDFTLTISSLQPEDFATYYC | QQYMT--------YPLT | FGGGT KVEIK |
| iPS.435_825 | VK1/L1/J K4 | DIQMTQSPSSLSA SVGDRVTITC | RAS--QDIG-------NYLA | WFQQKPGK APKSLIY | K------ASSLQS | GVPSKFSGSSG---TDFTLTISSLQPEDFATYYC | QQYMT--------YPLT | FGGGT KVEIK |
| iPS.435_837 | VK1/L1/J K4 | DIQMAQSPSSLSA SVGDRVTITC | RTS--QGIS-------KYLA | WFQQKPGK APKSLLY | K------ASSLQG | GVPSKFSGSSG---TDFTLTISSLQPEDFATYYC | QQYMT--------YPLT | FGGGT KVEIK |
| iPS.435_845 | VK1/L1/J K4 | DIQMTQSPSSLSA SVGDRVTITC | RAS--QGIS-------NYLA | WFQQKPGK APKSLIY | K------ASSLQS | GVPSKFSGSSG---TDFTLTISSLQPEDFATYYC | QHYLT--------YPLT | FGGGT KVEIK |
| iPS.435_859 | VK1/L1/J K4 | DIQMTQSPSSLSA SVGDRVTITC | RTS--QGIG-------NYLA | WFQQKPGK APKSLIY | K------ASSLQS | GVPSKFSGSSG---TDFTLTISSLQPEDFATYYC | QQYMT--------YPLT | FGGGT KVEIK |
| iPS.435_873 | VK1/L1/J K4 | DIQMTQSPSSLSA SVGDRVTITC | RAS--QDIG-------RYLA | WFQQKPGK APKSLIY | A------ASSLQS | GVPSKFSGSSG---TDFTLTISSLQPENFATYYC | QQYST--------YPLT | FGGGT KVEIK |
| iPS.435_933 | VK1/L1/J K4 | DIQMTQSPSSLSA SVGDRVTITC | RTS--QGIG-------NYLA | WFQQKPGK APKSLLY | K------ASSLQS | GVPSKFSGSSG---TDFTLTISSLQPEDFATYYC | QQYMT--------YPLT | FGGGT KVEIK |
| iPS.435_945 | VK1/L1/J K4 | DIQMTQSPSSLSA SVGDRVTITC | RAS--QGIG-------KYLA | WFQQKPGK APKSLIY | A------ASSLQS | GVPSKFSGYG---TDFTLTISSLQPENFATYYC | QQYST--------YPLT | FGGGT KVEIK |

FIGURE 51 (Continued)

| | | | | | | | | | | |
|---|---|---|---|---|---|---|---|---|---|---|
| iPS:435 947 | 21-225_191E1 0 | VKl|L1/J K4 | DIQMTQSPSSLSA SVGDRVTITC | RAS---QGIG- ----KYLA | WFQQKPGK APKSLLIY | A------- ASSLQS | GVPSKFSGSGSG--- TDFTLTISSLQPENFATYYC | QQYST------ -------YPLT | FGGGT KVEIK |
| iPS:435 957 | 21-225_191G1 2 | VKl|L1/J K4 | DIQMTQSPSSLSA SVGDRVTITC | RTS---QGIG- ----KYLA | WFQQKPGK APKSLLIY | K------- ASSLQS | GVPSKFSGSGSG--- TDFTLTISSLQPEDFATYYC | QQYIT------ -------YPLT | FGGGS KVEIK |
| iPS:435 963 | 21-225_192D2 | VKl|L1/J K4 | DIQMTQSPSSLSA SVGDRVTITC | RAS---QGIS- ----NYLA | WFQQKPGK APKSLLIY | A------- ASSLQS | GVPSKFSGSGSG--- TDFTLTISSLQPEDFATYYC | QHYVT------ -------YPNT | FGGGT KVEIK |
| iPS:435 971 | 21-225_192D3 | VKl|L1/J K4 | DIQMTQSPSSLSA SVGDRVTITC | RAS---QGIS- ----NYLA | WFQQKPGK APKSLLIY | A------- ASSLQS | GVPSKFSGSGSG--- TDFTLTISSLQPEDFATYYC | LHYLT------ -------YPLT | FGGGT KVEIK |
| iPS:435 979 | 21-225_192H4 | VKl|L1/J K4 | DIKMTQSPSSLSA SVGDRVTITC | RAS---QDIS- ----NYLA | WFQQKPGK APKSLIS | A------- ASSLQS | GVPSKFSGSGSG--- TDFTLTISSLQPEDFATYYG | LHYLN------ -------YPLT | FGGGT KVEIR |
| iPS:435 987 | 21-225_192G6 | VKl|L1/J K4 | DIQMTQSPSSLSA SVGDRVTITC | RTS---QGIG- ----NYLA | WFQQKPGK APKSLLIY | A------- ASSLQS | GVPSKFSGSGSG--- TDFTLTISSLQPEDFATYYC | QQYMT------ -------YPLT | FGGGT KVEIK |
| iPS:435 993 | 21-225_192C8 | VKl|L1/J K4 | DIQMTQSPSSLSA SVGDRVTITC | RAS---QGIS- ----NYLA | WFQQKPGK APKSLLIY | A------- ASSLQS | GVPSKFSGSGSG--- TDFTLTISSLQPEDFATYYC | QHYLT------ -------YPLT | FGGGT KVEIK |
| iPS:435 997 | 21-225_192G8 | VKl|L1/J K4 | DIQMTQSPSSLSA SVGDRVTITC | RTS---QGIG- ----NYLA | WFQQKPGK APKSLLIY | K------- ASSLQS | GVPSKFSGSGSG--- TDFTLTISSLQPEDFATYYC | QQYIT------ -------YPLT | FGGGT KVEIK |
| iPS:436 005 | 21-225_192H1 | VKl|L1/J K4 | DIQMTQSPSSLSA SVGDRVTITC | RAS---QGIG- ----KYLA | WFQQKPGK APKSLLIY | A------- ASSLQS | GVPSKFSGSGSG--- TDFTLTISSLQPENFATYYC | QQYST------ -------YPLT | FGGGT KVEIK |
| iPS:436 031 | 21-225_193C7 | VKl|L1/J K4 | DIQMTQSPSSLSA SVGDRVTITC | RAS---QGIS- ----KYLA | WFQQKPGK APKSLLIY | A------- ASSLQS | GVPSKFSGSGSG--- TDFTLTISSLQPEDFATYFC | QQYST------ -------YPLT | FGGGT KVEIK |
| iPS:436 045 | 21-225_193A1 | VKl|L1/J K4 | DIQMTQSPSSLSA SVGDRVTITC | PAN---QAIS- ----NYLA | WFQQKPGK APKSLLIY | A------- ASSLQS | GVPSKFSGSGSG--- TDFTLTISSLQPEDFATYYC | QHYLT------ -------YPLT | FGGGT KVEIK |
| iPS:436 054 | 21-225_194C1 | VKl|L1/J K4 | DIQMTQSPSSLSA SVGDRVTITC | RTS---QGIS- ----NYLA | WFQQKPGK APKSLLIY | K------- ASSLQS | GVPSKFSGSGSG--- TDFTLTISSLQPEDFATYYF | LHYLT------ -------YPLT | FGGGT KVEIK |
| iPS:436 076 | 21-225_194H1 | VKl|L1/J K4 | DIQMTQSPSSLSA SVGDRVTITC | RAS---QGIS- ----NYLA | WFQQKPGK APKSLLIY | A------- ASSLQS | GVPSKFSGSGSG--- TDFTLTISSLQPEDFATYYC | QHYLT------ -------YPLT | FGGGT KVEIK |
| iPS:436 086 | 21-225_191G1 0 | VKl|L1/J K4 | DIQMTQSPSSLSA SVGDRVTITC | RTS---QGIG- ----KYLA | WFQQKPGK APKSLLIY | G------- VSSLQS | GVPSKFSGSGSG--- TDFTLTISSLQPEDFATYYC | QQYST------ -------YPLT | FGGGT KVEIK |
| iPS:436 090 | 21-225_195A9 | VKl|L1/J K4 | DIQMTQSPSSLSA SVGDRVTITC | RAS---QGIS- ----KYLA | WFQQKPGK APKSLLIY | A------- ASSLQS | GVPSKFSGSGSG--- TDFTLTISSLQPEDFATYYC | QHYLT------ -------YPLT | FGGGT KVEIK |
| iPS:436 112 | 21-225_196C7 | VKl|L1/J K4 | DIQMTQSPSSLSA SVGDRVTITC | RAS---QGIS- ----NYLA | WFQQKPGK APKSLLIY | A------- ASSLQS | GVPSKFSGSGSG--- TDFTLTISSLQPEDFATYYC | QHYLT------ -------YPLT | FGGGT KVEIK |
| iPS:436 138 | 21-225_197F2 | VKl|L1/J K4 | DIQMTQSPSSLSA SVGDRVTITC | RAS---QGIS- ----NYLA | WFQQKPGK APKSLLIY | K------- TSSLQS | GVPSKFSGSGSG--- TDFTLTISSLQPEDFATYYF | QQYIT------ -------YPLT | FGGGT KVEIK |
| iPS:436 152 | 21-225_197B6 | VKl|L1/J K4 | DIQMTQSPSSLSA SVGDRVTITC | RAS---QGIG- ----KYLA | WFQQKPGK APKSLLIY | G------- ASSLQS | GVPSKFSGSGSG--- TDFTLTISSLQPEDFATYYC | QQYST------ -------YPLT | FGGGT KVEIK |
| iPS:436 173 | 21-225_197G1 | VKl|L1/J K4 | DIQMTQSPSSLSA SVGDRVTITC | RTS---QGIG- ----NYLA | WFQQKPGK APKSLLIY | K------- TSSLQS | GFPSKFSGSGSG--- TDFTLTISSLQPEDFATYYC | QQYMT------ -------YPLT | FGGGT KVEIK |
| iPS:436 189 | 21-225_198B6 2 | VKl|L1/J K4 | DIQMTQSPSSLSA SVGDRVTITC | RAS---QGIG- ----NYLA | WFQQKPGK APKSLLIY | A------- ASSLQS | GVPSKFSGNRSG--- TDFTLTISSLQPEDFATYYC | QQYST------ -------YPLT | FGGGT KVEIK |

FIGURE 51 (Continued)

| | | | | | | | | | |
|---|---|---|---|---|---|---|---|---|---|
| iPS:436 201 | 21-225 199C5 | VK1jL1/J K4 | DIQMTQSPSSLSA SVGDRVTITC | RAS---QGIS------KYLA | WFQQKPGK APKSLIY | A------ ASSLQS | GVPSRFSGSGSG--- TDFTLTISSLQPEDFAAYYC | QQYLT------------YPLT | FGGGT KVEIK |
| iPS:436 260 | 21-225 203H1 | VK1jL1/J K4 | DIQMTQSPSSLSA SVGDRVTITC | RAS---QGIG------NYLA | WFQQKPGK APKSLIY | V------ ASRLQS | GVPSKFSGTGSG--- SDFTLTISSLQPEDDFATYYC | QRYHT------------YPLT | FGGGT KVEIK |
| iPS:436 282 | 21-225 204G6 | VK1jL1/J K4 | DIRMTQSPSSLSA SVGDRITITC | RTS---QGIG------NYLA | WFQQKPGK APKSLIY | A------ ASSLQS | GVPSRFSGSGSG--- TDFTLTISSLQPEDFATYYC | QHYLS------------YPLT | FGGGT KVEIK |
| iPS:436 284 | 21-225 204G8 | VK1jL1/J K4 | DIQMTQSPSSLSA SVGDRVTITC | RAS---QGIS------NHLA | WFQQKPGK APKSLIF | A------ ASSLQS | GVPSQFSGSGSG--- TEFTLTISSLQPEDFATYYC | QQYSN------------YPVT | FGGGT KVEIK |
| iPS:436 292 | 21-225 205H3 | VK1jL1/J K4 | DIPMTQSPSSLSA SVGDRVTITC | RAS---QAIS------NHLA | WFQLKPGK APKSLIY | A------ ASSLQS | GVPSKFSGSGSG--- TDFTLTISSLQPEDFATYYC | QQYSN------------YPLT | FGGGT KVEIK |
| iPS:436 296 | 21-225 205F5 | VK1jL1/J K4 | DIQMTQSPSSLSA SVGDRVTITC | RAS---QGIG------NYLA | WFQQKPGK APKSLIY | G------ VSSLQS | SDFTLTISSLQPEDFATYYC | QQYSN------------YPLT | FGGGT KVDIR |
| iPS:436 324 | 21-225 207G6 | VK1jL1/J K4 | DIQMTQSPSSLSA SVGDRVTITC | RAS---QGIR------NYLA | WLQQKPGK APKSLIH | A------ ASSLQS | GVPSKFSGNRSG--- TDFTLTISSLQPEDFATYYC | QQYSN------------YPLT | FGGGT KVEIK |
| iPS:436 364 | 21-225 211A1 | VK1jL1/J K4 | DIQMTQSPSSLSA SVGDRVTITC | RAS---QGIG------NYLA | WFQQKPGK APKSLIY | D------ ASSLES | GVPSKFSGSRSG--- TDFTLTIGSLQPEDFATYYC | QHYMT------------YPLT | FGAGT KVEIK |
| iPS:436 366 | 21-225 211A3 | VK1jL1/J K4 | DIRMTQSPSSLSA SVGDRVTITC | RAS---QAIG------KHLA | WFQQRPGK APKSLIY | A------ ASRLQS | GVPSKFSGSGSG--- TDFTLTISSLQPEDFATYYC | QQYSN------------YPLT | FGGGT KVEIK |
| iPS:436 372 | 21-225 211A8 | VK1jL1/J K4 | DIEMTQSPSSLSA FVGDRVTITC | RAS---QGIS------RYLA | WYQQKPGK APKSLIY | A------ ASSLQS | GVSSRFSGSGSG--- TDFTLTISSLQPEDFATYYC | LRYDT------------YPLT | FGGGT KVEIK |
| iPS:436 376 | 21-225 212E6 | VK1jL1/J K4 | DIQMTQSPSSLSA SVGDRVTITC | RAS---QGIS------NYLA | WFQQKPGQ APKSLIY | A------ ASSLQS | GVPSKFSGSGSG--- TDFTLTISSLQPEDFATYYC | QQYVT------------YPLT | FGGGT KVEIK |
| iPS:436 378 | 21-225 212D7 | VK1jL1/J K4 | DIQMTQSPSSLSA SVGDRVTITC | RAS---QGIS------KHLA | WFQQKPGK APKSLIH | A------ ASSLQS | GVPSKFSGNRSG--- TDFTLTINNLQPEDFVTYYC | QQYSN------------YPLT | FGGGT KVEIK |
| iPS:436 380 | 21-225 212H9 | VK1jL1/J K4 | DIEMTQSPSSLSA SVGDRVTITC | RAS---QGIS------SYLA | WLQQKPGK APKSLIY | A------ ASSLQS | GVPSKFSGSGSG--- TDFTLTISSLQPEDFATYYC | LRYDT------------YPLT | FGGGT KVEIK |
| iPS:436 384 | 21-225 212F10 | VK1jL1/J K4 | DIQMTQSPSSLSA SVGDRVTITC | RAS---QGIS------NYLD | WFQQKPGK APKSLIY | S------ ASNLQS | GVPSKFSGSRSG--- TDFTLTISSLQPEDFATYYC | QHYSN------------YPLT | FGGGT KVEIK |
| iPS:436 388 | 21-225 212H1 | VK1jL1/J K4 | DIRMTQSPSSLSA SVGDRVTITC | RAS---QAIG------KHLA | WFQQRPGK APKSLIY | A------ ASRLQS | GVPSKFSGSGSG--- TDFTLTISSLQPEDLATYYC | QHYSN------------YPLT | FVGGT KVEIT |
| iPS:436 390 | 21-225 213D2 | VK1jL1/J K4 | DIQMTQSPSSLSA SVGDRVTITC | RAS---QGIS------NHLA | WFQQKPGK APKSLIH | A------ ASSLQS | GVPSKFSGNRSG--- TDFTLTINNLQPEDFVTYYC | BQYSN------------YPLT | FGGGT KVEIK |
| iPS:436 394 | 21-225 213C4 | VK1jL1/J K4 | DIHMTQSPSSLSA SVGDRVTITC | RAS---QAIR------NYLA | WCQQKPGK APKTLIY | A------ ASSLQS | GVPSKFSGSGSG--- TDFTLTISSLQPEDFATYYC | QQYSN------------YPLT | FGGGT KVEIK |
| iPS:436 396 | 21-225 213E5 | VK1jL1/J K4 | DIQMTQSPSSLSA SVGDRVTITC | RAS---QAIG------KHLA | WFQQRPGK APKSLIY | A------ ASRLQS | GVPSKFSGSGSG--- TDFTLTISSLQPEDLATYYC | QHYSN------------YPLT | FGGGT KVEIK |
| iPS:436 398 | 21-225 213B8 | VK1jL1/J K4 | DIQMTQSPSSLSA SVGDRVTITC | RAS---QGIS------NHLA | WFQQKPGK APKSLIY | A------ ASSLQS | GVPSKFSGSGSG--- TDFTLTISSLQPEDFATYYC | QQYSN------------YPLT | FGGGT KVEIK |
| iPS:436 410 | 21-225 212E1 | VK1jL1/J K4 | DIQMTQSPSSLSA SVGDRVTITC | RAS---QGIS------NHLA | WFQQKPGK APKSLIY | A------ ASSLQS | GVPSKFSGSGSG--- TDFTLTISSLQPEDFATYYC | QQYSN------------YPLT | FGGGT KVEIK |
| iPS:436 420 | 21-225 215B5 | VK1jL1/J K4 | DIQMTQSPSSLSA SVGDRVTITC | RAS---NHLA | WFQQKPGK APKSLIH | A------ ASSLQS | GVPSKFSGNRSG--- TDFTLTINNLQPEDFVTYYC | QQYIN------------YPLT | FGGGT KVEIK |
| iPS:436 422 | 21-225 215D6 | VK1jL1/J K4 | DIQMTQSPSSLSA SVGDRVTITC | RAS---NHLA | WFQQKPGK APKSLIY | A------ ASSLHS | GVPSKFSGSRSG--- TDFTLTISSLQPEDFATYYC | QQYVT------------YPLT | FGGGT KVEIK |

FIGURE 51 (Continued)

| | | | | | | | |
|---|---|---|---|---|---|---|---|
| iPS:436430 | 21-225_215A12 | VK1|L1J K4 | DIQMTQSPSSLSA SVGDRITIC | RTS--QDIG-----NYLA | WFQQKPGK APKSLIY | A-------ASSLQS | GVPSKFSGSRSG---TDFTLTISSLQEDFATYYC | QQVVT----------YPLT | FGGGT KVEIK |
| iPS:436452 | 21-225_217G5 | VK1|L1J K4 | DILMTQSPSSLSA SVGDRVTITC | RAS--QGIG-----NYLA | WFQQRPGK APKSLIY | A-------ASSLQS | GVPSKFSGTRSG---TDFTLTISSLQPDDFATYYC | QQYVN----------YPLT | FGGGT KVEIN |
| iPS:436454 | 21-225_217B10 | VK1|L1J K4 | DIEMTQSPSSLSA SVGDRVTITC | RAS--QAIG-----KHLA | WFQQRPGK APKSLIY | A-------ASRLQS | GVPSKFSGSGSG---TDFTLTSSVQPEDLATYYR | QHTSK----------SPVQ | LVGGT KVEIT |
| iPS:436464 | 21-225_219H1 | VK1|L1J K4 | DIQMTQSPSSQSA SVGDRVTITC | RAS--QGIS-----NYLD | WFQQKPGK APKSLIY | S-------ASNLQS | GVPSKFSGSRSG---TDFTLTISSLQPEDFATYYC | QHYSN----------YPLT | FGGGT KVEIK |
| iPS:436490 | 21-225_221F6 | VK1|L1J K4 | DIQMTQSPSSLSG SVGDRVTITC | RAS--QGIS-----NYLA | WFQQKPGK APKSLIY | A-------ASNLQS | GVPSKFSGSRSG---TDFTLTISSLQPEDFATYYC | QQYMT----------YPLT | FGGGT KVEIK |
| iPS:436502 | 21-225_222A1 | VK1|L1J K4 | DIQMTQSPSSLSA SVGDRVTITC | RAS--QGIS-----NYLA | WFQQKPGK APKSLIY | A-------ASRLQS | GVPSKFSGSGSG---TDFTLTISSLQPEDFATYYC | LIYLN----------YPLT | FGGGT KVEIK |
| iPS:436514 | 21-225_222D11 | VK1|L1J K4 | DIQMTQSPSSLSA SVGDRVTITC | RAS--QGIS-----NYLA | WFQQKPGK APKSLIY | A-------ASSLQS | GVPSKFSGSGSG---TDFTLTISSLQPEDFATYYC | LHYLN----------YPLT | FGGGT RVEIK |
| iPS:436522 | 21-225_223H10 | VK1|L1J K4 | DIQMTQSPSSLSA SVGDRVTITC | RAS--QGIS-----NYLA | WFQQKPGK APKSLIY | A-------ASNLQS | GVPSKFSGSGSG---TDFTLTISSLQPEDFATYYC | LHYLN----------YPLT | FGGGT KVEIK |
| iPS:437258 | 21-225_153F9 | VK1|L1J K4 | DIQMTQSPSSLSA SVGDRVTITC | RAS--QGIS-----NYLA | WFQQKPGK APKSLIY | A-------ASSLQS | GVPSKFSGSGSG---TDFTLTISSLQPEDFATYYC | QQYNS----------YPLS | FGGGT KVEIK |
| iPS:437260 | 21-225_170D1 | VK1|L1J K4 | DIQMTQSPSSLAA SVGDRVTITC | RAS--QDIS-----NYLA | WFQQKPGK APKSLIY | A-------ASSLQS | GVPSRFSGSGSG---TDFTLTISSLQPEDFATYYC | QQCGS----------FPLT | FGGGT KVEIK |
| iPS:437264 | 21-225_171H12 | VK1|L1J K4 | DIQMTQSPSSLSA SVGDRVTITC | RAS--QDIS-----NYLA | WFQQKPGK APKSLIY | S-------ASSLQS | GVPSKFSGSGSG---TDFTLTISSLQPEDFATYYC | QQSDS----------YPLT | FGGGT KVEIK |
| iPS:437266 | 21-225_177A5 | VK1|L1J K4 | DIQMTQSPSSLSA SVGDRVTITC | RAS--QDIS-----NYLA | WFQQKPGK APKSLIY | S-------ASSLQS | GVPSKFSGSGSG---TDFTLTISSLQPEDFATYYC | QQSDS----------YPLT | FGGGT KVEIK |
| iPS:437270 | 21-225_178H4 | VK1|L1J K4 | DIQMTQSPSSLSA SVGDRVTITC | RAS--QDIS-----NYLA | WFQQKPGK APKSLIF | S-------ASSLQS | GVPSKFSGSGSG---TEFTLTISNLQPEDFATYYC | QQSNS----------YPLT | FGGGT KVEIK |
| iPS:438664 | 21-225_216G1 | VK1|L1J K4 | DIEMTQSPSSLSA SVGDRVTITC | RAS--QGIS-----SYLA | WLQQKPGK APKSLIY | A-------ASSLQS | GVPSRFSGSGSG---TDFTLTISSLQPEDFATYYC | LRYDT----------YPLT | FGGGT KVEIK |
| iPS:451120 | 21-225_197D3 | VK1|L1J K4 | DIQMTQSPSSLSA SVGDRVTITC | RAS--QDIR-----NYLA | WFQQKPGK APKSLIY | A-------TSSLQS | GVPSKFSGSGSG---TDFTLTISTLQPEDFATYYC | QHYLT----------YPLT | FGGGT KVEIK |
| iPS:392682 | 21-225_16A12 | VK1|L1J K4 | DIQMTQSPSSLSA SVGDRVTITC | RAS--QAIN-----TYLA | WFQQKPGK APKSLIS | A-------ASSLQS | GVPSKFSGSGSG---TDFTLTISSLQPEDFATYYC | QQYYS----------YPLT | FGGGT KVEIK |
| iPS:392856 | 21-225_22A2 | VK1|L1J K4 | DIQMTQSPSSLSA SVGDRVTITC | RAS--QDIS-----NYLA | WVQQKPGK APKSLIY | A-------ASSLQS | GVPSRFSGSGSG---TDFTLTISSLQPEDFASYYC | QQSNS----------YPLT | FGGGT KVEIK |
| iPS:392966 | 21-225_32G3 | VK1|L1J K4 | DIQMTQSPTSLSA SVGDRVTITC | RAS--QAIS-----NYLA | WFQQKPGK APKSLIY | D-------TSSLQS | GVPSKFSGSGSG---TDFTLTISTLQPEDFATYYC | QQYHS----------YPLT | FGGGT KVEIK |
| iPS:393952 | 21-225_1F1 | VK1|L1J K4 | DIQMTQSPSSLSA SVGDRVTITC | RAS--QGIN-----NYLA | WFQQKPGK APKSLIS | ASSLQT | GVPSKFSGSGSG---TDFTLTISSLQPEDFATYYC | QQYNS----------YPLT | FGGGT KVEIK |
| iPS:393988 | 21-225_7F10 | VK1|L1J K4 | DIQMTQSPSALSA SVGDRVTITC | RAS--QDIR-----NYLA | WFQQKPGK APKSLIS | V-------ASSLQS | GVPSKFSGSGSG---TDFTLTISSLQPEDFATYYC | QQYNS----------YPLT | FGGGT KVEIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:402 233 | 21-225_16D10 | VK1|L1/J K4 | DIQMTQSPSSLSA SVGDRVTITC | RAS--QDIS- ----NYLA | WFQQKPGK APKSLIY | A------- TPSLQS | GVPSKFSGSGSG- TEFTLTISSLQPEDFATYYC | QQYNS------ --------YPLT | FGGGT KVEIK |
| iPS:402 237 | 21-225_23D11 | VK1|L1/J K4 | DIQMTQSPSSLSA SVGDRVTITC | RAS--QGIA- ----NYLA | WFQQRPGK APKSLIS | A------- ASSLQS | GVPSKFSGSGSG- TEFTLTISSLQPEDFATYYC | QQYHS------ --------YPLT | FGGGS KVEIK |
| Germline | VK1|O18/J K5 | | | | | | | | K_FR4 |
| iPS:434 171 | 21-225_50G4 | VK1|O18/ JK5 | DIQMTQSPTSLSA SVGDRVTITC | QAS--QDIT- ----NFLN | WYQQKPGK APKLLIY | D------- ASNLET | GVPSRFSGSGSG- TDFTFTISSLQPEDIATYYC | QQYD------- --------NLIT | FGQGT RLEIK |
| iPS:435 565 | 21-225_159C4 | VK1|O18/ JK5 | DIQMTQSPSSLSA SVGDRVTITC | RAS--QDIS- ----DYLN | WFQQKPGK APKLLIY | A------- ASTLET | GVPSKFSGSGSG- TEFTLTISSLQPEDIATYFC | QQYDN------ --------LPIT | FGQGT RLEIK |
| iPS:435 607 | 21-225_161G4 | VK1|O18/ JK5 | DIQMTQSPSSLSA SVGDRVTITC | QAS--QDIY- ----NYLN | WYQQKPGK APKLLIY | D------- ASNLET | GVPSRFSGSGSG- TDFTFTISSLQPEDIATYYC | QQYDI------ --------LPIT | FGQGT RLEIK |
| iPS:437 302 | 21-225_225B1 | VK1|O18/ JK5 | DIQMTQSPSSLSA SIGDRVTITC | QAS--QDIF- ----NYLN | WYQQKPGK APKLLIY | D------- ASTLET | GVPSRFSGSGSG- TDFTFTISSLQPEDIATYYC | QQYDN------ --------LPIT | FGQGT RLEIK |
| iPS:392 868 | 21-225_24D6 | VK1|O18/ JK5 | DIQMTQSPSSLSA SVGDRVTITC | QAS--QDIN- ----NYLN | WYQQKPGK ALKLLIY | D------- ASDLET | GVPSRFSGSGSG- TDFTFTISSLQPEDIAIYYC | QQYEN------ --------LPIT | FGQGT RLEIK |
| iPS:393 020 | 21-225_30E2 | VK1|O18/ JK5 | DIQMTQSPHSLSA SVGDRVTITC | QAS--QYIS- ----NYLN | WYQQKSGK APKLLIY | D------- GSSLET | GVPSRFSGSGSG- TDFTFTISSLQPEDIATYYC | QQYDN------ --------LPIT | FGQGT RLEIK |
| iPS:393 138 | 21-225_35E3 | VK1|O18/ JK5 | DIQMTQSPFSLSA SVGDRVTITC | QAS--QDIP- ----NYLN | WYQQKPGK APNLLIY | D------- ASNLET | GVPSRFSGSGSG- TDFTFTISSLQPEDIATYFC | QQYDN------ --------LPIT | FGQGT RLDIR |
| iPS:393 892 | 21-225_6G7 | VK1|O18/ JK5 | DIQMTQSPSRSA SVGDRVTITC | QAS--QDIS- ----NYLN | WCQQKPGK ALKLLIY | D------- ASTLET | GVPSRFSGSGSG- TDFTFTISSVQPEDIATYYC | QQYDN------ --------VPIT | FGQGT RLEIK |
| iPS:393 910 | 21-225_15F10 | VK1|O18/ JK5 | DIQMTQSPSSLSA SVGDRVTITC | QAN--QDIT- ----NFLN | WYQLKPGK APNLLIS | D------- ASNLET | GVPSRFSGSGSG- TDFTFTISSLQPEDVATYYC | QQYEN------ --------LPIT | FGQGT RLEIK |
| iPS:393 912 | 21-225_16F6 | VK1|O18/ JK5 | DIQMTQSPSSLSA SVGDRVTITC | QAN--QDIT- ----NFLN | WYQLKPGK APNLLIY | D------- ASNLET | GVPSRFSGSGSG- TDFTFTISSLQPEDVATYYC | QQYDN------ --------LPIT | FGQGT RLEIK |
| iPS:394 000 | 21-225_11A2 | VK1|O18/ JK5 | DIQMTQSPSSLSA SVGDRVTITC | QAS--QDIS- ----NYLN | WYQQKPGK APKLLIY | D------- ASNLET | GVPSRFSGSGSG- TDFTFTISSLQPEDIATYYC | QQYDN------ --------LPIT | FGQGT RLDIK |
| iPS:394 004 | 21-225_13A1 | VK1|O18/ JK5 | DIQMTQSPSSLSA SVGDRVTITC | QAS--QDIN- ----NYLN | WYQQKLGT APKLLIY | D------- GSNLET | GVPSRFSGSGSG- TDFTFTISSLQPEDIATYYC | QQYEN------ --------LPIT | FGQGT RLEIK |
| iPS:394 006 | 21-225_15C2 | VK1|O18/ JK5 | DIQMTQSPSSLSA SVGDRVTITC | QAS--QDIT- ----NYLN | WYQQKPGK APNLLIY | D------- ASNLET | GVPSRFSGSGSG- TDFTFTISSLQPEDIATYYC | QQYDN------ --------LPIT | FAQGT RLEIK |
| iPS:394 029 | 21-225_1B12 | VK1|O18/ JK5 | DIQMTQSPSSLSA SVGDRVTITC | QAS--QDIS- ----NYLN | WYQQKPGK APKLLIY | D------- ASNLET | GVPSRFSGSGSG- TDFTFTISSLQPEDITTYYC | QQYEN------ --------LPIT | FGQGT RLEIK |
| iPS:394 047 | 21-225_5E6 | VK1|O18/ JK5 | DIQMTQSPSSLSA SVGDRVTITC | QAS--QDIN- ----NYLN | WCQQKPGK APKLLIY | D------- ASMLET | GVPSRFSGSGSG- TDFTFTISSLQPEDIATYYC | QQYDN------ --------LPIT | FGQGT RLEIK |
| iPS:394 081 | 21-225_16B3 | VK1|O18/ JK5 | DIQMTQSPSSLSA SVGDRVTITC | QAS--QDIN- ----NYLN | WYQQKPGR APNLLIY | D------- ASNLET | GVPSRFSGSGSG- TDFTFTISSLQSEDIATYYC | QQFDN------ --------LPIT | FGPGT RLEIK |
| Germline | VK3|L2/JK3 | | | | | | | | K_FR4 |
| iPS:434 219 | 21-225_60E9 | VK3|L2/J K3 | EIVMTQSPAILSV SPGERATLSC | RAS--QSVS- ----SSLA | WYRQKPGQ APRLLIY | G------- ASTRAT | GIPARFSGSGSG- TEFTLTISSLQSEDFAVYCC | QQYNN------ | FGPGT KIDIK |
| iPS:434 279 | 21-225_57F7 | VK3|L2/J K3 | EIVMTQSPAILSV FPGERATLSC | RAS--QSVS- ----SDLA | WYQQKPGQ APRLLIY | G------- ASTRAT | GMPARFSGSGSG- TEFTLTISSLQSEHFAVYYC | QQYSN------ --------WPFT | FGPGT KVDIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:434 289 | 21-225_57H12 | VK3|L2/J K3 | EIVMTQSPATLSV SPGERATLSC | RAS--QSVS------SDLA | WYQQKPGQ APRLLIY | A------ ASTRAT | GIPARFSGSGSG--- TEFTLTISSLQSEDFAVYYC | QQYDN----------WPFT | FGPGT KVDNK |
| iPS:434 291 | 21-225_58A4 | VK3|L2/J K3 | EIVMTQSPATLSV SPGERATLSC | RAS--QSVS------SDLA | WYQQRPGQ APRLLIY | A------ ASTRAT | GIPARFSGSGSG--- TEFTLTISSLQSEDFAVYYC | QQFNN----------WPFT | FGPGT KVDIK |
| iPS:434 297 | 21-225_58A10 | VK3|L2/J K3 | EIVMTQSPATLSV CPGERATLSC | RAS--QSVS------SSLA | WYQQKPGQ APRLLIY | G------ ASTRAT | GIPARFSGSGSG--- TEFTLTISSLQSEDFAVYYC | QQYNN----------WPFT | FGEGT KVDIK |
| iPS:434 301 | 21-225_58F11 | VK3|L2/J K3 | EIVMTQSPATLSV SPGERATLSC | RAS--QSVS------SDLV | WYQQKPGQ APRLLIY | G------ VSTRAT | GIPARFSGSGSG--- TEFTLTISSLQSEDFAVYYC | QQYNN----------WPFT | FGPGT KVDIK |
| iPS:437 228 | 21-225_60C11 | VK3|L2/J K3 | EIVMTQSPATLSV SPGERATLSC | RAS--QSVS------NDLA | WYQQKPGQ APRLLIY | G------ ASTRAT | GIPARFSGSGSG--- TEFTLTISALQSEHFAVYYC | QQYSN----------WPFT | FGPGT KVDIK |
| Germline | VK2|A19|JK 5 | | DIVMTQSPLSLPV TPGEPASISC | QSLLHSN-GYNYLD | WYLQKPGQ SPQLLIY | L------ TDFTLKISRVEAEDVGVYYC | | | |
| iPS:434 243 | 21-225_62C1 | VK2|A19/JK5 | DIVMTQSPLSLPV TPGEPASISC | RSS------QSLLHSN-GYNYLD | WYLQKPGQ SPQLLIY | L------ VSNRAS | GVPDRFSGSGSG--- TDFTLKISRVGAEDVGVYYC | LQALQ-----------TPLI | FGQGT RLEIK |
| iPS:436 648 | 21-225_227F11 | VK2|A19/JK5 | DVVMTQPLSLPV TPGEPASISC | WSS------QSLLHSN-GYNYLD | WYLQKPGQ SFQVLIY | L------ GSNRAS | GVPDRFSGSGSG--- TDFTLKISRVEAEDVGVYYC | MQALQ-----------TPLI | FGQGT RLEIK |
| iPS:394 061 | 21-225_12D2 | VK2|A19/JK5 | DIVMTQSPLSLPV TPGEPASISC | RSS------QSLLHSN-GYNYLD | WYLQKPGQ SFQVLIY | L------ GSNRAS | GVPDRFSGSGSG--- TDFTLKISRVEAEDVGVYYC | MQALQ-----------TPIT | FGQGT RLEIK |
| iPS:394 071 | 21-225_10C7 | VK2|A19/JK5 | DIVMTQSPLSLPV TPGEPASISC | RSS------QSLLHSK-GYNYLD | WYLQKPGQ SFQVLIY | L------ GSNRAS | GVPDRFSGSGSG--- TDFTLKISRVEAEDVGVYYC | MQALQ-----------TPLI | FGQGT RLEIK |
| Germline | VK1|L5|JK4 | | | | | | | | |
| iPS:434 259 | 21-225_62G7 | VK1|L5/J K4 | DIQMTQSPSSVSA SVGDRVTFTC | RAS--QDIS------SWLA | WYQQNPGK APKLLIY | A------ ASSLQS | GVPSRFSGSGSG--- TNFTLTISSLQPEDFATYYC | QQTNS-----------FPLT | FGGGT KVEIK |
| iPS:434 333 | 21-225_63C9 | VK1|L5/J K4 | DIQMTQSPSSVSA SVGDRVTITC | RAS--QGIS------SWLA | WYQQKPGK APKLLIY | A------ ASSLQS | GVPSRFSGSGSG--- TDFTLTISSLQPEDFATYFC | QQINS-----------FPLI | FGGGT KVAIK |
| iPS:434 347 | 21-225_64H10 | VK1|L5/J K4 | DIQMTQSPSSVSA SVGDRVTITC | RAS--QGIS------SWLA | WYQQKPGK ALKLLIY | A------ ASSLQS | GVPSRFSGSGSG--- TDFTLTISSLQPEDFATYYC | QQINS-----------FPLI | FGGGT KVEIK |
| iPS:434 359 | 21-225_65G3 | VK1|L5/J K4 | DIQMTQSPSSVSA SVGDRVTITC | RAS--QGIS------SWLA | WYQQKPGK APKLLIY | A------ ASSLQS | GVPSRFSGSGSG--- TDFTLTISSLQPEDFATYYC | QQVNS-----------FPLT | FGGGT KVEIK |
| iPS:434 369 | 21-225_66B1 | VK1|L5/J K4 | DIQMTQSPSVSA SVGDRVTITC | RAS--QGIS------SWLA | WYQQKPGK ALKLLIY | A------ ASSLQS | GVPSRFSGSGSG--- TDFTLTISSLQPEDFATYYC | QQINS-----------FPLT | FGGGT KVEIK |
| iPS:434 373 | 21-225_66A7 | VK1|L5/J K4 | DIQMTQSPSSVSA SVGDRVTITC | RAS--QGIS------SWLA | WYQQKPGK APKLLIY | A------ ASSLQS | GVPSRFSGSGSG--- TDFTLTISSLQPEDFATYYC | QQINS-----------FPLI | FGGGT KVEIK |
| iPS:434 397 | 21-225_67H4 | VK1|L5/J K4 | DIQMTQSPSSVSA SVGDRVTITC | RAS--QGIS------SWLA | WYQQNPGK AFKLLIF | A------ ASSLQS | GVPSRFSGSGSG--- IDFTLTISSLQPEDFATYYC | QQINS-----------FPLI | FGGGT KVEIK |
| iPS:434 427 | 21-225_70D6 | VK1|L5/J K4 | DIQMTQSPSSVSA SVGDRVTITC | RAS--QGIS------KWLA | WYQQNPGK ALKLLIF | A------ ASSLQS | GVPSRFSGSGSG--- TCFTLTISSLQPEDFANYYC | QQINS-----------FPLI | FGGGT KVEIK |
| iPS:434 435 | 21-225_70G9 | VK1|L5/J K4 | DIQMTQSPSSVSA SVGDRVTITC | RAS--QDIS------SWLA | WYQQNPGK APKLLIY | A------ ASSLQS | GVPSRFSGSGSG--- IDFTLTISSLQPEDFATYYC | QQTNS-----------FPLI | FGGGT KVEIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS.434 437 | 21-225 70A12 | VK1\|L5/J K4 | DIQMTQSPSSVSA SVGDRVTITC | RAS--QGIS-----SWLA | WYQQKPGK ALKLLIY | A-------ASSLQS | GVPSRFSGGSGSG---TDFTLTISSVQPEDFATYYC | QQINS----------FPLT | FGGGT KVEIK |
| iPS.434 451 | 21-225 71B7 | VK1\|L5/J K4 | DIQMTQSPSSVSA SVGDRVTITC | RAS--QGIS-----SWLA | WYQQNPGE APKLLIY | A-------ASSLQG | GVPSRFSGSGSG---TDFTLTISSLQPEDFATYANYC | QQTNS----------FPLT | FGGGT KVEIK |
| iPS.434 459 | 21-225 71A7 | VK1\|L5/J K4 | DIQMTQSPSSVSA SVGDRVTITC | RAS--QGIS-----SWLA | WYQQKPGK APKLLIY | A-------ASSLQS | GVPSRFSGGSGSG---TDFTLTISSLQPEDFATYYC | QQVNS----------FPLT | FGGGT KVEIK |
| iPS.434 461 | 21-225 73A3 | VK1\|L5/J K4 | DIQMTQSPSSVYA SIGDRVTITC | RAS--QGIS-----NWLA | WYQQKPGK APKLLIY | A-------ASSLQS | GVPSRFSGGSGSE---TDFTLTISSLQPEDFATYYC | QQVNS----------FPLT | FGGGT KVEIK |
| iPS.435 479 | 21-225 154E9 | VK1\|L5/J K4 | DIQMTLSPSSVYA SVGDRVTITC | RAS--QDIS-----NWLA | WYQQKPGK APKLLIY | A-------ASSLQS | GVPSRFSGSGSG---TDFTLTISSVQPEDFATYYC | QQGNS----------FPLT | FGGGT KVDIK |
| iPS.437 232 | 21-225 63E1 | VK1\|L5/J K4 | DIQMTQSPSSVYA SVGDRVTITC | RAS--QGIS-----SYLA | WYQQKPGK APKLLIY | A-------ASSLQS | GVPSRFSGSGSG---TDFTLTISSLQPEDFATYYC | QQANS----------FPLT | FGGGT KVEIK |
| iPS.437 326 | 21-225 75C10 | VK1\|L5/J K4 | DIQMTQSPSSVSA SVGDRVTITC | RAS--QGIS-----IWLA | WYQQKPGK APKLLIF | A-------ASSLQS | GVPLRFSGSGSG---TDFTLTISSLQPEDFATYYC | QQAKS----------FPLT | FGGGT KVEIK |
| VK1\|O12/JK2 | | Germline | K_FR1 | K_CDR1 | K_FR2 | K_CDR2 | K_FR3 | K_CDR3 | K_FR4 |
| iPS.434 309 | 21-225 59B5 | VK1\|O12/JK2 | DIQMTQSPSSLSLSA SVGDRVTITC | RAS--QSII-----SYLN | WYQQKPGK APKLLIY | G-------ASSLQS | GVPSRFSGSGSG---TDFTLTISSLQPEDFATYYC | QQSYS----------TPMFS | FGQGT KLEIK |
| iPS.392 874 | 21-225 21D2 | VK1\|O12/JK2 | DIQMTQSPSSLFA SVGDRVTITC | RAS--QSIS-----DYLN | WYQQKPGK APKLLIY | D-------TSSLQS | GVPSRFSGSGSG---TDFTLTINSLQPEDFATYYC | QQTYNI---------LPERS | FGRGT KLEIK |
| iPS.393 940 | 21-225 16B2 | VK1\|O12/JK2 | GVQMTQSPSSLSA SVGDRVTITC | RAS--QSIS-----GYLN | WYQQKPGK APKLLIY | A-------ASSLQS | GVPSRFSGSGSG---TDFTLTISSLQPEDFATYYC | QQTYNT---------PPERS | FGGGT KLEIK |
| iPS.393 956 | 21-225 4D7 | VK1\|O12/JK2 | DIQMTQSPSSLSA SVGDRVTITC | RAS--QSIS-----DYLN | WYQQKPGK APKLLIF | D-------ITSLQS | GVPSRFSGSGSG---TDFTLTISSLQPEDFATYYC | QQTYNT---------PPERS | FGGGT KLEIK |
| iPS.398 476 | 21-225 17C1 | VK1\|O12/JK2 | DIQMTQSPSSLSA SVGDRVTITC | RAS--QNIN-----DYLN | WYQQKPGK APKLLIY | A-------ASNLQS | GVPARFSGGSRSG---TDFTLTISSLQPEDFATYYC | QQTYNT---------PPERS | FGGGT KLEIK |
| iPS.403 870 | 21-225 23G4 | VK1\|O12/JK2 | DIQMTQSPSSLSA SVGDRVTITC | RAS--QNIY-----SYLN | WYQQKPGK APKLLIF | A-------------- | GVPSRFSGSGSG---TEFTLTISILQPEDFATYYC | QQSYNT---------PPECN | FGQGT KLEIK |
| VK3\|A27/JK3 | | Germline | K_FR1 | K_CDR1 | K_FR2 | K_CDR2 | K_FR3 | K_CDR3 | K_FR4 |
| iPS.434 311 | 21-225 59H5 | VK3\|A27/JK3 | EIVLTQSPGTLSL SFGERATLSC | RAS--QSVSS----IYLA | WFLQKPGQ APRLLIY | G-------ASSRAT | GIPDRFSGSGSG---TDFTLTISRLEPEDFAVYYC | HQYGN-----------SPFT | FGPGT KVDFK |
| iPS.435 301 | 21-225 146G4 | VK3\|A27/JK3 | EIVLTQSPGTLSL FFGERATLSC | RAS--QNII5----QNLA | WYQQKPGQ APRLLIF | G-------ASSRAT | GIPDRFSGSGSG---TDFTLTISRLEPEDFAVYYC | QQYGR-----------SPFN | FGPGT KVDIN |
| iPS.435 317 | 21-225 147D2 | VK3\|A27/JK3 | EIVLTQSPGTLSL SFGERATLSC | RAS--QSVGS----SYLA | WYQQKPGQ APRLLIY | G-------ASSRAT | GIPDRFSGSGSG---TDFTLTISRLEPEDFAVYYC | QQYG------------SLFT | FGPGT KVDIK |
| iPS.435 319 | 21-225 147E3 | VK3\|A27/JK3 | EIVLTQSPGTLSL SFGERATLSC | RAS--QSVIS----SYLA | WYQQKPGQ APRLLIY | G-------ASSRAT | AIPDRFSGSGSG---TDFTLTISRLEPEDFAVYYC | QQYGR-----------SPFN | FGPGT KVDIK |
| iPS.435 383 | 21-225 149D7 | VK3\|A27/JK3 | EIVLTQSPGTLSL FFGERVTLSC | RAS--QSIIS----NYLA | WYQQKPGQ APRLLIF | G-------VSSRAT | GIPDRFSGSGSG---TDFTLTISRLEPEDFAVYYC | QQYGR-----------SPFN | FGPGT KVDIK |
| iPS.435 443 | 21-225 152E7 | VK3\|A27/JK3 | EIVLTQSPGTLSL FFGERATLSC | RAS-----------SYLA | WYQQKPGQ APRLLIF | G-------VSSRAT | GIPDRFSGSGSG---TDFTLTISRLEPEDFAVYYC | QQYGR-----------SPFN | FGPGT KVDIK |
| iPS.435 465 | 21-225 153A6 | VK3\|A27/JK3 | EIVLTQSPGTLSL FFGERAPLSC | RAS--QSVIS----SYLA | WYQQKPGQ APRLLIF | G-------VSSRAT | GIPDRFSGSGSG---TDFTLTISRLEPEDFAVYYC | QQYGR-----------SPFN | FGPGT KVDIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:436_058 | 21-225_194A4 | VK3jA27/JK3 | EIVLTQSPGTLSLSPGERATLSC | RAS---RGVSN----IYLA | WYQQKPGQAPRLLIY | G-------ASNRAT | GIPDRFSGSGSG---TDFTLTISRLEPEDFAVYYC | QHNDY--------SMFT | FGPGTKVDIK |
| iPS:436_436 | 21-225_216F10 | VK3jA27/JK3 | EVVLTQSPGTLSLSPGERATLSC | RAS---QSVSS-----SFLA | WYQQKPGQAPRLLIY | TSTRAT | TCFTLTISRLEPEDFAVYYC | QQYDR--------SPFT | FGPGTKVDIK |
| iPS:442_568 | 21-225_149D8 | VK3jA27/JK3 | EIVLTQSPGTLSLFPGERATLSC | RAS---QSVIS-----SYLA | WYQQKPGQAPRLLIF | VSSWAT | GIPDRFSGSGSG---TDFTLTISRLEPEDFAVYYC | QQYGR--------SPFN | FGPGTKVDIK |
| VK1jO18jJK1 | | Germline | | K_CDR1 | K_FR2 | K_CDR2 | K_FR3 | K_CDR3 | K_FR4 |
| iPS:434_353 | 21-225_64B12 | VK1jO18/JK1 | DIQMTQSPSSLSASVGDRVTITC | RAS---QDIS-----NYLN | WYQQKPGTAPNLLIS | D-------ASILET | GVPSTFSGSGSG---TGFTTTISSLQPEDIATYYC | QQSDN--------LPCS | FGQGTKVEIK |
| VK1jA20jJK | | Germline | | K_CDR1 | K_FR2 | K_CDR2 | K_FR3 | K_CDR3 | K_FR4 |
| iPS:434_357 | 21-225_65C1 | VK1jA20/JK4 | DIQLTQSPSSLSASVGDRVTITC | RAS---QVIS-----SYLH | WYQQKPGKVPKVLIY | S-------ASNLQC | GVPSRFSGSGSG---TDFTLTFSSLQPEDVATYYG | QRFYN--------APLT | FGGGTKVEIK |
| iPS:434_375 | 21-225_66C7 | VK1jA20/JK4 | DIQLTQSFSSLSASVGDRVTITR | RAS---QGIS-----NYLH | WYQQKPGKAPRLLIY | C-------ASNLQC | GVPSRFSGSGSG---TDFTLTISSLQPEDVATYYC | QQHNN--------SPLT | FGGGTKVEIK |
| iPS:434_457 | 21-225_72G12 | VK1jA20/JK4 | DIQLTQSPSSLSASVGDRVTITC | RAS---QGIS-----SYLN | WSQQKPGKVPKLLIC | G-------ASNLQS | GVPSRFSGSASG---TEFTLTISSLQPEDVTTYYG | QQMYN--------APLT | FGGGTKVEIK |
| VK3jA27jJK | | Germline | | K_CDR1 | K_FR2 | K_CDR2 | K_FR3 | K_CDR3 | K_FR4 |
| iPS:434_479 | 21-225_76H1 | VK3jA27/JK4 | EFMLTQSPGTLYWSPGERATLSC | RAS---QSVSS-----SYLV | WYQQKPGQAPRLLIY | G-------ASTRAT | GIPDRFSGSGSG---TDFTLTISRLEPEYFAVYYC | QQYGC--------SPLT | FGGGTKVEIT |
| iPS:434_513 | 21-225_76A6 | VK3jA27/JK4 | EIVLTQSPGTRSWSPGERATLSC | RAS---QSVSS-----SYLA | WYQQKPGQAPRLLIY | ASTRAT | TCFTLTISRLEPEYFAVYYC | QQYGN--------SPLT | FGGGTKVEIT |
| iPS:434_515 | 21-225_74A5 | VK3jA27/JK4 | EFMLTQSPGTILYWSPGERATLSC | RAS---QSVSS-----SYLA | WYQQKPGQAPRLLIY | ASTRAT | GIPDRFSGSGSG---TDFTLTISRLEPEYFAVYYC | QQYGS--------SPLT | FGGGTKVEIT |
| iPS:434_529 | 21-225_76B9 | VK3jA27/JK4 | EFMLTQSPGTILSWSPGERATLSC | RAS---QSVSS-----SYLV | WYQQKPGQAPRLLIY | G-------ASTRAT | GIPDRFSGSGSG---TDFTLTISRLEPEYFAVYYC | QQYGN--------SPLT | FGGGTKVEIT |
| iPS:434_583 | 21-225_74B6 | VK3jA27/JK4 | EIVLTQSPGTLSLSPGERATLSC | RAS---QSVSS-----SYLA | WYQQKPGQAPRLLIY | G-------ASTRAT | GIPDRFSGSGSG---TDFTLTISRLEPEYFAVYYC | QQYGN--------SPLT | FGGGTKVEIT |
| iPS:434_587 | 21-225_74G3 | VK3jA27/JK4 | EFMLTQSPGTLKWSPGERATLSC | RAS---QSVSS-----SYLA | WYQQKPGQAPRLLIY | G-------ASTRAT | GIPDRFSGSGSG---TDFTLTISRLEPEYFAVYYC | QQYGC--------SPLT | FGGGTKVEIT |
| iPS:434_603 | 21-225_77D11 | VK3jA27/JK4 | EFMLTQSPGTILYWSPGERATLSC | RAS---QSVSS-----SYLY | WYQQKPGQAPRLLIY | G-------ASTRAT | GIPDRFSGSGSG---TDFTLTISRLEPEYFAVYYC | QQYGC--------SPLT | FGGGTKVEIT |
| iPS:434_705 | 21-225_80A2 | VK3jA27/JK4 | EFMLTQSPGTIYLSPGERATLSC | RAS---QSVSS-----SYLV | WYQQKPGQAPRLLIY | G-------ASTRAT | GIPDRFSGSGSG---TDFTLTISRLEPEYFAVYYC | QQYGC--------SPLT | FGGGTKVEIT |
| iPS:434_747 | 21-225_80C12 | VK3jA27/JK4 | EIVLTQSPGTLSWSPGERATLSC | RAS---QSVSS-----SYLA | WYQQKPGQAPRLLIY | G-------ASTRAT | GIPDRFSGSGSG---TDFTLTISRLEPEYFAVYYC | QQYGN--------SPLT | FGGGTKVEIK |
| iPS:434_793 | 21-225_82A5 | VK3jA27/JK4 | EFMLTQSPGTLYWSPGERATLSC | RAS---QSVSS-----SYLA | WYQQKPGQAPRLLIY | ASTRAT | TCFTLTISRLEPEYFAVYYC | QQYGC--------SPLT | FGGGTKVEIT |
| iPS:434_797 | 21-225_82G5 | VK3jA27/JK4 | EFMLTQSPGTLSSSPGERATLSC | RAS---ESVSS-----SYLV | WYQQKPGQAPRLLIY | ASTRAT | GIPDRFSGSGSG---TDFTLTISRLEPEYFAVYYC | QQYGC--------SPLT | FGGGTKVEIT |
| iPS:434_805 | 21-225_82D9 | VK3jA27/JK4 | EFMLTQSPGTILSWSPGERATLSC | RAS---ESVSS-----SYLV | WYQQKPGQAPRLLIY | G-------ASTRAT | GIPDRFSGSGSG---TDFTLTISRLEPEYFAVYYC | QQYGC--------SPLT | FGGGTKVEIT |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:434 813 | 21-225_82C12 | VK3|A27/JK4 | EIVLTQSPGTLSW SPGERATLSC | RAS--QSVSS-----SYLA | WYQQKPGQ APRLLIY | G------ ASTRAS | GIPDRFSGSGSG-- TDFTLTISRLEPEYFAVYYC | QQYGN---------- ---------SPLT | FGGGT KVEIK |
| iPS:434 825 | 21-225_83C2 | VK3|A27/JK4 | EFMLTQSPGTLCL SPGERATLSC | RAS--QSVSS-----SYLV | WYQQKPGQ APRLLIY | G------ ASTRAT | GIPDRFSGSGSG-- TDFTLTISRLEPEYFAVYYC | QQYGC---------- ---------SPLT | FGGGT KVEIT |
| iPS:434 833 | 21-225_83C5 | VK3|A27/JK4 | EFMLTQSPGTLCW SPGERATLSC | RAS--ESVSS-----SYLV | WYQQKPGQ APRLLIY | G------ ASTRAT | GIPDRFSGSGSG-- TDFTLTISRLEPEYFAVYYC | QQYGC---------- ---------SPLT | FGGGT KVEIT |
| iPS:434 883 | 21-225_85B5 | VK3|A27/JK4 | EFMLTQSPGTLSL SPGERATLSC | RSS--QSVSS-----SYLV | WYQQKPGQ APRLLIY | G------ ASTRAT | TDFTLTISRLEPEYFAVYYC | QQYGC---------- ---------SPLT | FGGGT KVEIT |
| iPS:434 911 | 21-225_86D11 | VK3|A27/JK4 | EFMLTQSPGTLSL STGERATLSC | RSS--QSVSS-----SYLA | WYQQKPGQ APRLLIY | G------ ASTRAT | GIPDRFSGSGSG-- | QQYGN---------- ---------SPLT | FGGGT KVEIT |
| iPS:434 957 | 21-225_87A10 | VK3|A27/JK4 | EFVLTQSPGTLYL SPGERATLSC | RAS--QSVSS-----SYLA | WYQQKPGQ APRLLIY | G------ ASTRAT | TDFTLTISRLEPEYFAVYYC | QQIGN---------- ---------SPLT | FGGGT KVEIK |
| iPS:435 247 | 21-225_96G1 | VK3|A27/JK4 | EIVLTQSPGTLSL STGERATLSC | RAS--QSVSS-----SYLA | WYQQKPGQ PPRLLIY | G------ ASTRAS | TDFTLTISRLEPEYFAVYYC | QQYVS---------- ---------SPLT | FGGGT KVEIK |
| iPS:436 368 | 21-225_211G3 | VK3|A27/JK4 | EIVLTQSPGTLSL SPGERATLSC | RAS--QSVSS-----SFLA | WYQQKPGQ APRLLIY | G------ ASSRAT | GIPDRFSGSGSG-- | QQYVS---------- ---------SPLT | FGGGT KVEIK |
| iPS:436 426 | 21-225_215C7 | VK3|A27/JK4 | EIVLTQSPGVTLSL SPGERVTLSC | RAS--QRITT-----NFLA | WYQQKPGQ APRLLIY | G------ ASSRAT | TDFTLTISRLESEDFAVYYC | QQYVS---------- ---------SLLT | FGGGT KVEIK |
| iPS:436 432 | 21-225_215H1 2 | VK3|A27/JK4 | EIVLTQSPGTLSL SPGERATLSC | RAS--QSVSS-----SFLA | WYQQKPGQ APRLLMY | G------ ASSRAI | GIPDRFSGSGSG-- | QQYVS---------- ---------SPLT | FGGGT KVEIK |
| iPS:437 322 | 21-225_75B1 | VK3|A27/JK4 | EFMLTQSPGTLYW SPGERATISS | RAS--QSVSS-----SYLV | WYQQKPGQ APRLLIY | G------ ASTRAT | GIPDRFSGSGSG-- TDFTLTISRLEPEYFAVYYC | QQYGC---------- ---------SPLT | FGGGT KVEIT |
| iPS:437 377 | 21-225_74G9 | VK3|A27/JK4 | EFMLTQSPGTLSL SPGERATLSC | RAS--QSVSS-----SYLV | WYQQKPGQ APRLLIY | G------ ASTRAT | GIPDRFSGSGSG-- TDFTLTISRLEPEYFAVYYC | QQYGC---------- ---------SPLT | FGGGT KVEIT |
| | | Germline | K_FR1 | K_CDR1 | K_FR2 | K_CDR2 | K_FR3 | K_CDR3 | K_FR4 |
| | VK4|B3/JK4 | | | | | | | | |
| iPS:434 511 | 21-225_74B11 | VK4|B3/JK4 | DIVMTQSPDSLTV SLGERATINC | KSS----QSILYNSNNYN YLA | WYQQKPGQ PPKLLIY | W------ ASTRES | GVPDRFSGSGSG-- TDFTLTISSLQAEDVAVYYC | QQYYS---------- ---------TPPT | FGGGT KVEIK |
| iPS:434 729 | 21-225_80B12 | VK4|B3/JK4 | DIVLTQSPDSLAV SLGERATINC | KSR----QSVLYSSNNYN YLT | WYQQKPGQ PPKLLIY | W------ ASTRES | GVPDRFSGSGSG-- TDFTLTISSLQAEDVAVYYC | QQYYS---------- ---------SPPT | FGGGT KVEIK |
| iPS:434 851 | 21-225_75A6 | VK4|B3/JK4 | DIVMTQSPDSLAV SLGERATINC | KSR----QSVLHSSNNYN YLA | WYQQKPGQ PPELLIY | W------ ASTRES | GVPDRFSGSGSG-- TDFTLTISSLQAEDVAVYYC | QQYYS---------- ---------TPPT | FGGGT KVEIK |
| iPS:435 623 | 21-225_162D5 | VK4|B3/JK4 | DIVMTQSPDFRNV SMGERAIINE | KSN----HSVLYRSNNNQ YLA | WYQRKPGQ PPKNLLIY | R------ TSIRKS | GVPDRFSGSGCG-- TDFTLTIDSLQAEDVAVYYC | QQYYS---------- ---------TPPT | FGGGT KVEIK |
| iPS:446 086 | 21-225_94D8 | VK4|B3/JK4 | DIVLTQSPDSLAV SLGERATINC | KSR----QSVLYSSNNYN YLT | WYQQKPGQ PPKLLIY | W------ ASTRES | GVPDRFSGSGSG-- TDFTLTISSLQAEDVAVYYC | QQYYS---------- ---------SPPT | FGGGT KVEIK |
| | | Germline | K_FR1 | K_CDR1 | K_FR2 | K_CDR2 | K_FR3 | K_CDR3 | K_FR4 |

FIGURE 51 (Continued)

| VK2A19JK4 | | | K_FR1 | K_CDR1 | K_FR2 | K_CDR2 | K_FR3 | K_CDR3 | K_FR4 |
|---|---|---|---|---|---|---|---|---|---|
| | | Germline | DIVMTQSPLSLPV TPGEPASISC | RSS---QSLLHSN GYNYLD | WYLQKPGR SPQLLIY | L------GSNRAS | GVPDRFSGSGSG---TDFTLKISRVEAEDVGVYYC | MQALH------TPLT | FGGGT KVEIK |
| iPS:434 539 | 21-225_74A2 | VK2/A19/JK4 | DIVMTQSPLSLPV TPGEPASISC | RSS---QSLLHSN GYNYLD | WYLQKPGR SPQLLIY | L------GSNRAS | GVPERFSGSGSG---TDFTLKISRVEAEDVGVYYC | MQPLQ------TPFT | FGGGT KVEIK |
| iPS:434 563 | 21-225_75D8 | VK2/A19/JK4 | DIVMTQSPLSLPV TPGEPASISC | RSS---QSLLHSS GYNYLD | WYLQKPGQ SPQLLIY | L------GSNRAS | GVPDRFSGSGSG---SDFTLKISRVEAEDVGLYYC | MQALH------PPLT | FGGGT KVEIK |
| iPS:435 009 | 21-225_89G4 | VK2/A19/JK4 | DIVMTQSPLSLPV TPGEPASISC | RSS---QSLLHSS GYNYLD | WYLQKPGQ SPQLLIY | L------GSNRAS | GVPDRFSGSGSG---TDFTLKISRVEAEDIGVYYC | MQALH------IPLT | FGGGT KVEIK |
| iPS:435 059 | 21-225_90C11 | VK2/A19/JK4 | DIVMTQSPLSLPV TPGEPASISC | RYS---QSLVHSS GYNYLD | WYLQKPGQ SPQLVIY | L------GSNRAS | GVPERFSGSGSG---SDFTLKISRVEAEDVGLYYC | MQALH------PPLT | FGGGT KVEIK |
| iPS:435 103 | 21-225_92B2 | VK2/A19/JK4 | DIVMTQSPLSLPV TPGEPASISC | RSS---QSLLHSN GYNYLD | WYLQKPGR SPQLLIY | L------GSNRAS | GVPDRFSGSGSV---TDFTLKISRVEAEDIGIYYC | MQTLQ------IPLT | FGGGT KVEIK |
| iPS:435 713 | 21-225_171D7 | VK2/A19/JK4 | DIVMTQSPLSLPV TPGEPASISC | RSS---QSLLYHN RYHHLD | WYLQKTGQ SPQLLIY | V------GSNRAS | GVPDRFSGSGSG---TDFTLKISRVEAEDVGVYYC | MQAL-------QTFT | FGGGT KVEIK |
| iPS:436 246 | 21-225_201G6 | VK2/A19/JK4 | DIVLTQSPLSLPV TPGEPASISC | RSS---QSLLHNN RYHHLD | WYLQKPGQ SPQLLIY | L------GSNRAS | GVPDRFSGSGSG---TDFTLKISRVEAEDVGVYYC | MQAL-------QTFT | FGGGT KVEIK |
| iPS:436 254 | 21-225_202C1 | VK2/A19/JK4 | DIVMTQSPLSLPV TPGEPASISC | RSS---QSLLHNN KYNHLD | WYLQKPGQ SPQLLIY | L------GSNRAS | GVPDRFSGSGSG---TDFTLKISRVEAEDVGVYYC | MQAL-------QTFT | FGGGT KVEIK |
| iPS:436 304 | 21-225_201F3 | VK2/A19/JK4 | DIVMTQSPLSLPV TPGEPASISC | RSS---QSLLHNN RYHHLD | WYLQKPGQ SPQLLIY | L------GSNRAS | GVPDRFSGSGSG---TDFTLKISRVEAEDVGVYYC | MQAL-------QTFT | FGGGT KVEIK |
| iPS:436 334 | 21-225_208G3 | VK2/A19/JK4 | DIVLTQSPLSLPV TPGEPASISC | RSS---QSLLHNN KYNHLD | WYLQKPGQ SPQLLIY | L------GSNRAS | GVPDRFSGSGSG---TDFTLKISRVEAEDVGVYYC | MQAL-------QTFT | FGGGT KVEIK |
| iPS:437 248 | 21-225_97H3 | VK2/A19/JK4 | DIVMTQSPLSLPV TPGEPASISC | RSS---QSLLHSN GNNYLD | WYLQKPGR SPQLLIY | L------GSNRAS | GVPERFSGSGSG---TDFTLKISRVEAEDVGVYYC | MQPLQ------TPFT | FGGGT KVEIK |
| iPS:437 320 | 21-225_75A1 | VK2/A19/JK4 | DIVMTQSPLSLPV TPGEPASISC | RSS---QSLLHSN GHNYLD | WYLQKPGQ SPQLLIY | L------GSNRAS | GVPERFSGSGSG---TDFTLKISRVEAEDVGVYYC | MQPLQ------TPFT | FGGGT KVEIK |
| iPS:437 371 | 21-225_74D8 | VK2/A19/JK4 | DIVMTQSPLSLPV TPGEPASISC | RSS---QSLVHSS GHNYLD | WYLQKPGQ SPQLVIY | L------GSNRAS | GVPDRFSGSGSG---SDFTLKISRVEAEDVGLYYC | MQALH------PPLT | FGGGT KVEIK |
| iPS:392 718 | 21-225_17B8 | VK2/A19/JK4 | DIVMTQSPLSLPV TPGEPASISC | RSS---QSLLHSN GNNSLD | WYLQKPGQ SPQLLIY | L------GSHRAS | GVPDRFSDSGSG---TDFTLKISRVEAEDVGVYYC | MQVLQ------TPPLT | FGGGT KVEIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:434 871 | 21-225 85H1 | VK3\|L2\|J K1 | EIVMTQSPATLSV SPGERATLSC | RAS--QDVI---TYLA | WYQQKPGQ APRLLIY | G------ ASTRAT | GVPARFSGSGSG-- IEFTLTISSLQSEDFALYYC | QEYND---------WPCS | FGQGT KVEIK |
| iPS:435 421 | 21-225 151F1 | VK3\|L2\|J K1 | EMVMTQSPATLSV SPGERVTLSC | RAS--QSIN---INIA | WYQQKPGQ APRLLIY | G------ ASTRAT | GIPARFSGSGSG-- TEFTLTISSLQSEDFAVYYC | QQYND---------WPFWT | FGQGT KVEIK |
| iPS:435 497 | 21-225 155H9 | VK3\|L2\|J K1 | EIVMTQSPATLSV SPGERAILSC | RAS--QSVS---SNLA | WYQQKPGQ APRLLIY | G------ ASTRAT | GIPARFSGSGSG-- TEFTLTISSLQSEDFAVYYC | QQYDD---------WPPWT | FGQGT KVEIK |
| iPS:435 605 | 21-225 161A4 | VK3\|L2\|J K1 | EIVMTQSPATLSV SPGERASLSC | RSS--QSVN---SNLA | WYQQKPGQ ALRLLIY | G------ ASTRAT | DIPARFNGSGSG-- TEFTLTISSLQSEDFAVYFC | QQYN----------NWWT | FGQGT TVEIK |
| iPS:451 118 | 21-225 191C8 | VK3\|L2\|J K1 | EIVMTQSPATLSV SPGERATLSC | RAS--QSVR---SNLA | WYQQKPGQ APRLLIY | G------ ASTRAT | GIPARFSGSGSG-- TEFTLTISSLQSEDFAVYFC | QQSFT---------WLRT | FGQGT KVEIK |
| iPS:392 734 | 21-225 17D8 | VK3\|L2\|J K1 | EIVMTQSPSTLSV SPGERATLSC | RAS--QSVS---SNLA | WFQQKPGQ APRLLIN | G------ ASTRAS | GIPARFSGSGSG-- TEFTLTISSLQSEDFAVYYC | QQYNN---------WPLT | FGQGT KVEIK |
| iPS:392 768 | 21-225 20B8 | VK3\|L2\|J K1 | EIVMTQSPSTLSV SPGERAVLSC | RAS--QSVS---SNLA | WFQQKPGQ APRLLIN | G------ ASTRAS | GIPARFSGSGSG-- TEFTLTISSLQSEDFAVYYC | QQYNN---------CPLT | FGQGT KVEIK |
| iPS:393 044 | 21-225 25B8 | VK3\|L2\|J K1 | EIVMTQSPATLSV SPGERATLSC | RAS--QSVR---SNLA | WYQQKPGQ APRLLIY | G------ ASTRAT | GIPARFSGSGSG-- TEFTLTISSLQSEDFALYYC | QQYNN---------WPPWP | FGQGT KVEIK |
| iPS:393 050 | 21-225 28C5 | VK3\|L2\|J K1 | EIVMTQSPATLSV SPGERALSC | RAS--QSVS---SNLA | WYHQKPGQ APRLLIY | G------ ASTRAT | GIPARFSGSGSG-- TEFTLTISSLQSEDFALYYC | QQYNN---------WPPWP | FGQGT KVEIK |
| iPS:393 906 | 21-225 13D3 | VK3\|L2\|J K1 | EIVMTQSPATLSV SPGESASLSC | RAS--QTVS---SNLA | WFQQKPGQ APRLLIN | G------ ASTRAT | GIPARFSGSGSG-- TEFTLTISSLQSEDFAVYFC | QQYHD---------WPFT | FGQGT KVEIK |
| | Germline | | K_FR1 | K_CDR1 | K_FR2 | K_CDR2 | K_FR3 | K_CDR3 | K_FR4 |
| VK1\|L1\|K5 | | | | | | | | | |
| iPS:434 947 | 21-225 87B7 | VK1\|L1\|J K5 | DIQMTQSPSSLSA SVGDRVTITC | RAS--QGIS---NYLA | WFQQKPGK APKSLIY | A------ ASSLHS | GVPSKFSGSGSG-- TDFTLTISSLQPEDSATYFC | LLYLT---------YPLT | FGQGT RLEIK |
| iPS:435 427 | 21-225 151C9 | VK1\|L1\|J K5 | DIQMTQSPSSLSA SVGDRVTITC | RAS--QGIS---KYLA | WFQQKPGK APKSLIY | D------ ASRLQS | GVPSKFSGSGSG-- TDFTLTISSLQPEDFASYYC | HQYKH---------YPIT | FGQGT RLEIK |
| iPS:435 529 | 21-225 157H7 | VK1\|L1\|J K5 | DIQMTQSPSSLSA SVGDRVTITC | RAS--QDIS---NFLA | WFQQKPGK APKSLVS | T------ ASSLQS | GVPSKFSGSGSG-- TDFTLTISSLQPEDFATYYC | QQYHS---------YPIT | FGQGT RLEIK |
| iPS:436 066 | 21-225 194B7 | VK1\|L1\|J K5 | DIQMTQSPSSLSA SVGDRVTITC | RAS--QGIS---KYLA | WFQQKPGK APKSLIY | A------ ASRLQS | GVPSKFSGSGSG-- TDFTLTISSLQPEDFATYYC | QHYLN---------YPLT | FGQGT RLEIK |
| iPS:437 274 | 21-225 196D4 | VK1\|L1\|J K5 | DIQMTQSPSSLSA SVGDRVTITC | RAS--QGIS---NYLA | WFQQNPGK APKSLIY | A------ ASSLQS | GVPSKFSGSGCG-- TDFTLTISSPQPEDVATYYC | QHYLN---------YPLT | FGQGT RLEIK |
| iPS:392 748 | 21-225 20A8 | VK1\|L1\|J K5 | DIQMTQSPSSLSA SVGDRVTITC | RAS--QGIN---NYLV | WFQQKPGK APKSLIY | A------ ASSLLS | GVPSRFSGSGSG-- TDFTLTISSLQPEDFATYYC | QQYNS---------YPIT | FGQGT RLEIK |
| iPS:393 062 | 21-225 33H3 | VK1\|L1\|J K5 | DIQMTQSPSSLSA SVGDRVTITC | QAS--QDIS---NFLN | WFRQKPGK APNSLIY | D------ ASNLVT | GVPSKFSGSGRSG-- TDFTFTISSLQPEDFATYYC | QQYDN---------LPIT | FGQGT RLEIK |
| iPS:398 532 | 21-225 33B7 | VK1\|L1\|J K5 | DIQMTQSPSSLSA SVGDRVTITC | RAS--QDIS---NYLA | WFQQKPGK APTSLIY | A------ ASSLQS | GVPSKFSGSGSG-- TDFTLTISSPQPEDFATFYC | QQYHS---------YPLT | FGQGT RLEIK |
| iPS:402 221 | 21-225 2C12 | VK1\|L1\|J K5 | DIQMTQSPSSLSA SVGDRVTITC | RAS--QGIS---NYLA | WFQQKSGK APKSLIS | A------ ATSLQS | GVPSQFSGSGSG-- TDFTLTISSLQPEDVAYYC | QQYIS---------YPIT | FGQGT RLEIK |
| | Germline | | K_FR1 | K_CDR1 | K_FR2 | K_CDR2 | K_FR3 | K_CDR3 | K_FR4 |
| VK4\|B3\|JK5 | | | | | | | | | |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:435 665 | 21-225_169F2 | VK4|B3/JK5 | DIVMTQSPDSLAV SLGERATINC | KSS--- QSVLYTSNNKN YLA | WYQQKPGQ PPKLLIY | W------ ASTRES | GVPDRFSGSGSG--- TDFTLTISSLQAEDVAVYYC | QQYY------------RAPT | FGQGT RLEIK |
| iPS:435 671 | 21-225_169H5 | VK4|B3/JK5 | DIVMTQSPDSLAV SLGERATINC | KSS--- QSVLYISNNKN YLA | WYQQKPGQ PPKLLIY | W------ ASTRES | GVPDRFSGSGSG--- TDFTLTISSLQAEDVAVYYC | QQYI------------RAFT | FGQGT RLEIK |
| iPS:436 554 | 21-225_224C10 | VK4|B3/JK5 | DIVMTQSPDSLAA SLGERATITC | KSS--- QSVLYNSNNKN YLA | WYQQKPGQ PPKLLIY | W------ ASTRES | GVPDRFSGSGSG--- TDFTLTISSLQAEDVAVYYC | QQYI------------NPCS | FGQGT RLEIK |
| iPS:398 510 | 21-225_25A3 | VK4|B3/JK5 | DIVMTQSPDSLTV SLGERATINC | KSS--- QSVLYSSNNKN YLA | WYQQKPGQ PPKLLIY | W------ ASTRES | GVPDRFSGSGSG--- TDFTLTISSLQAEDVAVYYC | QQYYS------------TPCS | FGQGT RLEIK |
| iPS:398 516 | 21-225_26A9 | VK4|B3/JK5 | DIVMTQSPDSLAV SLGERATINC | KSS--- QSVLYSSNNKN YLA | WYQQKPGQ PPKLLIY | W------ ASTRES | GVPDRFSGSGSG--- TDFTLTISSLQAEDVAVYYC | QQYYS------------SPCS | FGQGT RLEIK |
| Germline | | | | K_FR1 | K_CDR1 | K_FR2 | K_CDR2 | K_FR3 | K_CDR3 | K_FR4 |
| VK2|A19/JK1 | | | | | | | | | | |
| iPS:435 667 | 21-225_169E3 | VK2|A19/JK1 | DIVMTQSPLSLPV TPGEPASISC | RSS--- QSLLHNN- GYKYLD | WYLQKPGQ SPQLLIY | L------ GSNRAS | GVPDRFSASGSG--- TDFTLKISRVEAEDVGVYYC | MQVLQ------------TPWT | FGQGT KVEIK |
| iPS:435 673 | 21-225_169E6 | VK2|A19/JK1 | DIVMTQSPLSLPV TPGEPASISC | RSS--- QSLLHNN- GYKYLD | WYLQKPGQ SPQLLIY | L------ GSNRAS | GVPDRFSASGSG--- TDFTLKISRVEAEDVGVYYC | MQVLQ------------TPWT | FGQGT KVEIK |
| iPS:435 759 | 21-225_176E6 | VK2|A19/JK1 | DIVMTQSPLSLPV TPGEPASISC | RSS--- QSLLHNN- GYKYLD | WYLQKPGQ SPQLLIY | L------ GSNRAS | GVPDRFSASGSG--- TDFTLKISRVEAEDVGVYYC | MQVLQ------------TPWT | FGQGT KVEIK |
| Germline | | | | K_FR1 | K_CDR1 | K_FR2 | K_CDR2 | K_FR3 | K_CDR3 | K_FR4 |
| VK6|A26/JK1 | | | | | | | | | | |
| iPS:435 817 | 21-225_190B1 | VK6|A26/JK1 | EIVLTQSPDFQSV APKKVTITC | RAS--QSIG- --SNLH | WYQQKPDQ SFKLLIK | S------ ASQSFS | GVPSRFSGSGSG--- TDFTLINSLETEDAATYYC | QQSSS------------LPWT | FGQGT KVEIK |
| iPS:435 823 | 21-225_190F11 | VK6|A26/JK1 | EIVLTQFPDSQSV TPKEKVTITC | RAS--QNIG- ----SSLH | WYQQKPDQ SFEKVIK | Y------ ASQSFK | GVPSRFSGSGSG--- TDFTLITNSLEAEDAATYYC | ------------------FPRT | FGQGT KVEIK |
| iPS:435 867 | 21-225_191E5 | VK6|A26/JK1 | EIVLTQFPDSQSV TPKEKVTITC | RAS--QSIG- ----SSLH | WYQQKPDQ SFKLLIK | Y------ ASQSFS | GVPSRFSGSGSG--- TDFTLITNSLEAEDAATYYC | HQSSS------------FPRT | FGQGT KVEIK |
| iPS:435 917 | 21-225_190D5 | VK6|A26/JK1 | EIVLTQSPDFQSV APKKVTITC | RAS--QSIG- ----SNLH | WYQQKPDQ SFEKLIK | S------ ASQSFS | GVPSRFSGSGSG--- TDFTLITNSLETEDAATYYC | QQSSS------------LPWT | FGQGT KVEIK |
| iPS:435 929 | 21-225_190D9 | VK6|A26/JK1 | EIVLTQFPDSQSV TPKEKVTITC | RAS--QSIG- ----SSLH | WYQQKPDQ SFKLLIK | Y------ ASQSFS | GVPSRFSGSGSG--- TDFTLITNSLEAEDAATYYC | HQSSS------------FPRT | FGQGT KVEIK |
| iPS:435 935 | 21-225_190H8 | VK6|A26/JK1 | EIVLTQFPDSQSV TPKEKVTITC | RAS--QSIG- ----SSLH | WYQQKPDQ SFKLLIK | S------ ASQSFS | GVPSRFSGSGSG--- TDFTLITNSLEAEDAATYYC | HQSSS------------FPRT | FGQGT KVEIK |
| iPS:436 056 | 21-225_194C3 | VK6|A26/JK1 | EIVLTQSPDFQSV APKKVTITC | RAS--QSIG- ----SNLH | WYQQKPDQ SFKLLIK | Y------ ASQSFS | GVPSRFSGSGSG--- TDFTLITNSLETEDAATYYC | QQSSS------------LPWT | FGQGT KVEIK |
| iPS:436 216 | 21-225_200B7 | VK6|A26/JK1 | EIVLTQSPDFQSV TPKEKVTITC | RAS--QNIG- ----NTLH | WYQQKPDQ SFKLLIK | Y------ ASQSFS | GVPSRFSGSGSG--- TDFTLITNSLEAEDAATYYC | HQGSS------------LPQT | FGQGT KVEIK |

FIGURE 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:436 220 | 21-225_200F8 | VK6|A26/JK1 | EIVLTQSPDFQSV APKEKVTITC | RAS--QSIG---SNLH | WYQQKPDQ SPKLLIK | S------- ASQSFS | GVPSRFSGSGSG--- TDFTLTINSLETEDAATYYC | QQSSS---------LPWT | FGQGT KVEIK |
| iPS:436 448 | 21-225_217A3 | VK6|A26/JK1 | EIVLTQSPDFKSV TPKEKVTITC | RAS--QSIG----SSLH | WYQQKPDQ SPKLLVK | Y------- ASQSFS | GVPSRFSGSGSG--- TDFTLTINSLEAEDGATYYC | HQSRS---------LPWT | FGQGT KVEIK |
| VK6|A26/JK1 Germline | | | | K_CDR1 | K_FR2 | K_CDR2 | K_FR3 | K_CDR3 | K_FR4 |
| iPS:435 829 | 21-225_190B1 | VK6|A26/JK4 | EIVLTQSPDFQSV TPKEKVTITC | RAS--QSIG----SSLH | WYQQKPDQ SPKLLIK | Y------- ASQSFS | GDPSRFSGSGSG--- TDFTLTINSLEAEDAATYYC | HQTRS---------LPLT | FGGGT KVEIK |
| iPS:435 863 | 21-225_191H4 | VK6|A26/JK4 | EIVLTQSPDFQSV TPKEKVTITC | RAN--QSIG----SSLH | WYQQKPDQ SPKLLIK | Y------- ASQSLS | GVPSRFSASGSG--- TDFTLTINSLDAEDAATYYC | HQTRS---------LPLT | FGGGT KVEIK |
| iPS:435 943 | 21-225_191C9 | VK6|A26/JK4 | EIVLTQSPDFQSV TPKEKVTITC | RAS--QSIG----SSLH | WYQQKPDQ SPKLLIK | Y------- ASQSFS | GDPSRFSGSGSG--- TDFTLTINSLEAEDAATYYC | HQTRS---------LPLT | FGGGT KVEIK |
| iPS:435 983 | 21-225_192E5 | VK6|A26/JK4 | EIVLTQSPDFQSV TPKEKVTITC | RAS--QSIG----SSLH | WYQQKPDQ SPKLLIK | Y------- ASQSFS | GVPSRFSGSGSG--- TDFTLTINSLEAEDAATYYC | HQSSR---------LPLT | FGGGT KVEIK |
| iPS:436 043 | 21-225_193G9 | VK6|A26/JK4 | EIVLTQSPDFQSV TPKEKVTITC | RAS--QSIG----RSLH | WYQQKPDQ SLKLLIK | Y------- ASQSFS | GVPSRFSGSGSG--- TDFTLTINSLEAEDAATYFC | HQSSR---------LPLT | FGGGT KVEIK |
| iPS:436 084 | 21-225_195F2 | VK6|A26/JK4 | EIVLTQSPDFQSV TPKEKVTITC | RAS--QSIG----SSLH | WYQQKPDQ SPKLLIK | Y------- ASQSFS | GVPSRFSGSGSG--- TDFALTISSLEAEDAATYYC | HQSGR---------LPLT | FGGGT KVEIK |
| iPS:436 094 | 21-225_195B1 | VK6|A26/JK4 | EIVLTQSPDFQSV TPKEKVTITC | RAS--QSIG----RSLH | WYQQKPDQ SPKLLIK | Y------- ASQSFS | GVPSRFSGSGSG--- TDFTLTINSLEAEDAATYYC | HQSRT---------LPLT | FGGGT KVEIK |
| iPS:436 240 | 21-225_201E8 | VK6|A26/JK4 | EIVLTQSPAFQSV TPKEKVTITC | RAS--QNIG----RSLH | WYQQKPDQ SPKLLIY | Y------- ASQSFS | GVPSRFSGSGSG--- TNFTLTINSLEAEDAATYYC | HQSRS---------LPLT | FGGGT KVEIR |
| iPS:436 314 | 21-225_206G4 | VK6|A26/JK4 | EIVLTQSPDFQSV TPKEKVTITC | RAS--QSIG----RSLH | WYQQKPDQ SPKLLIK | Y------- ASQSFS | GVPSRFSGSGSG--- TDFTLTINSLEAEDAATYYC | HQSRS---------LPLT | FGGGT KVEIK |
| VK6|A26/JK4 Germline | | | | K_CDR1 | K_FR2 | K_CDR2 | K_FR3 | K_CDR3 | K_FR4 |
| iPS:435 833 | 21-225_190D1 | VK1|A20/JK3 | DIQMTQSPSSLSA SVGDRVTITC | RAS--QGIS----NYLA | WYQQKPGK VPKLLIY | V------- ASTLQS | GVPSRFSGSGSG--- TDFTLTISSLQPEDVATYYC | QKYNS---------APFT | FGPGI KVDIK |
| iPS:436 019 | 21-225_193C4 | VK1|A20/JK3 | DIQMTQSPSSLSA SVGDRVTISC | RPS--QGIS----IYLA | WYQQKPGN VPKLLIK | A------- ASTLQS | GVPSRFSGSGSG--- TDFTLTISSLQPEDVATYYC | QKYNS---------APFT | FGPGT KVDIK |
| iPS:394 010 | 21-225_195E1 | VK1|A20/JK3 | DIQMTQSPSSLSA SVGDRVTIPC | RAS--QDIS----NYLA | WYQQKPGK VPKLLIY | A------- AYILQS | GVPSRFSGSGSG--- TDFTLTISSLQPEDVAAYYC | QKYDS---------APFT | FGPGT KVDIK |
| VK1|A20|JK3 Germline | | | | K_CDR1 | K_FR2 | K_CDR2 | K_FR3 | K_CDR3 | K_FR4 |
| iPS:436 025 | 21-225_193B5 | VK6|A26/JK3 | EIVLTQSPDFQSV TPKEKVTITC | RAS--QSIG----SSLH | WYQQKPDQ SPKLLIK | Y------- ASQSFS | GVPSRFSGSGSG--- TDFTLTINSLEAEDAATYYC | HQSSR---------LPFT | FGPGT KVDIK |
| iPS:436 096 | 21-225_195E1 | VK6|A26/JK3 | EIVLTQSPDFQSV TPKEKVTITC | RAS--QSIG----SSLH | WYQQKPDQ SPQLLIK | Y------- ASQSFS | GVPSRFSGSGSG--- TDFTLTINSLEAEDAATYYC | HQSSR---------LEFT | FGPGT KVDIK |
| iPS:436 408 | 21-225_214H8 | VK6|A26/JK3 | EIVLTQSPDFQSV TPKEKVTITC | RAS--QSIG----VSLH | WYQQKPDQ SPKLLIK | Y------- ASQSFS | GVPSRFSGSGSG--- TDFTLTINSLEAEDAATYYC | HQSRS---------LPFT | FGPGS KVDIK |

| | | | L_FR1 | L_CDR1 | L_FR2 | L_CDR2 | L_FR3 | L_CDR3 | L_FR4 |
|---|---|---|---|---|---|---|---|---|---|
| iPS:434 577 | 21-225_75C11 | VK1|A30/ JK3 | DIQMTQSPSSLSA SVGDRVTITC | RAS---QGIR- -----NDLG | WFQQKPGK APKKLLIY | A------ ASSLQS | GVPSRFSGSGSG--- TEFTLTISSLQPEDFATYYC | LQHND------ -------YPFT | FGPGT KVEIK |
| iPS:434 553 | 21-225_76H12 | VK1|A30/ JK3 | DIQMTQSPSSLSA SVGDRVTITC | RAS---QGIR- -----NDLG | WFQQKPGK APKRLLIY | A------ ASRLQS | GVPSRFSGSGSG--- TEFTLTISSLQPEDFATYYC | LQHND------ -------YPFT | FGPGT KVEIK |
| iPS:434 927 | 21-225_86E5 | VK1|A30/ JK3 | DIQMTQSPSSLSA SVGDRVTITC | RAS---QGIR- -----NDLG | WYQQKPGK APKRLLIY | A------ ASSLQS | GVPSRFSGSGSG--- TEFTLTISSLQPEDFATYHC | LQHND------ -------YPFT | FGPGT KVEIK |
| VK1|L5JK1 | | Germline | | K_CDR1 | K_FR2 | K_CDR2 | K_FR3 | K_CDR3 | K_FR4 |
| iPS:435 477 | 21-225_154E8 | VK1|L5/J K1 | DIQMTQSPSSVSA SIGDRVTITC | RAS---QFIS- -----SWLA | WYQQKPGK APKLLIY | T------ ASSLQS | GVPSRFSGSGSG--- TDFTLTISSLQPEDFATYCC | QQANS------ -------FPWT | FGQGT KVEFN |
| iPS:435 385 | 21-225_149G7 | VK1|L5/J K1 | DIQMTQSPSVSA SVGDRVTITC | RAS---QFIS- -----SWLA | WYQQKPGK APKRLLIY | A------ ASSLQS | GVPSRFSGSGSG--- TDFTLTISSLQPEDFATYYC | QQANS------ -------FPWT | FGQGT KVEIN |
| LAMBDA VARIABLE | | | | | | | | | |
| | | Germline | L_FR1 | L_CDR1 | L_FR2 | L_CDR2 | L_FR3 | L_CDR3 | L_FR4 |
| VL3|3r/JL2 | | | PSVSVSPGQTASI TC | KYSC | SPELVTY | DSKRPS | NTATLTISGTQAMDEADYYC | QAWDS------ -------STAV | FGGGT KLTVL |
| iPS:4 53445 | 21-225_148E10 | VL3|3r/JL 2 | SYELTQP-- PSVSVSPGQTASI TC | SGD----KLGN- -----KYVC | WYQQRPGH AAVLIIY | Q------ DSKRPS | GIPERFSGSNSG--- NTATLTISGTQAMDEADYFC | QAWDR------ -------NTYVV | FGGGT KLTVL |
| iPS:4 72742 | 21-225_3D09_LC 2 | VL3|3r/JL 2 | SYELTQP-- PSVSVSPGQTASI TC | SGD----KLGD- -----KVVY | WFQQKPGQ SPVLVIY | Q------ DRKRPS | GIPERFSGSNSG--- NTATLTISGTQALDEADYYC | QAWDN------ -------STAV | FGGGT KLTVL |
| iPS:4 72743 | 21-225_68G6 | VL3|3r/JL 2 | SYEVTQP-- PSVSVSPGQTASI TC | SGD----KLGD- -----KYTY | WYQQKAGQ SPFLVIY | Q------ DRKRPS | GIPDRFSGSNSG--- NTATLTISGTQAMDAADYYC | QAWDN------ -------STAV | FGGGT KLTVL |
| iPS:4 36652 | 21-225_146B11 | VL3|3r/JL 2 | SYELTQP-- PSVSVSPGQTASI TC | SGD----KLGD- -----KYAS | WYQQKPGQ SPFLVIY | Q------ DSKRPS | GIPERFSGSNSG--- NTATLTISGIQAMDEADYYC | QAWDS------ -------STVV | FGGGT KLTVL |
| iPS:4 36654 | 21-225_146C11 | VL3|3r/JL 2 | SYELTQP-- PSVSVSPGQTASI TC | SGD----KLGD- -----RYAS | WYQQKPGQ SPVLVIY | Q------ DSKRPS | GIPERFSGSNSG--- NTATLTISGIQAMDEADYYC | QAWDS------ -------STVV | FGGGT KLTVL |
| iPS:4 36658 | 21-225_146A2 | VL3|3r/JL 2 | SYELTQP-- PSVSVSPGQTASI TC | SGD----KLGD- -----KYVS | WYQQKPGQ SPVLVIY | Q------ DSKRPS | GIPERFSGSNSG--- NTATLTISGIQAMDEADYYC | QAWDS------ -------STVV | FGGGT KLTVL |
| iPS:4 36664 | 21-225_147E7 | VL3|3r/JL 2 | SYELTQP-- PSVSVSPGQTASI TC | SGD----KLGD- -----RYAS | WYQQKPGQ SPVLVIY | Q------ DRKRPS | GIPERFSGSNSG--- NTATLTISGIQAMDEADYYC | QAWDS------ -------STVV | FGGGT KLTVL |
| iPS:4 36666 | 21-225_147B8 | VL3|3r/JL 2 | SYELTQP-- PSVSVSPGQTASI TC | SGD----KLGD- -----KYVC | WYQQKPGQ SPELVIY | Q------ DSKRPS | GIPERFSGSNSG--- NTATLTISGTQAMDEADYYC | QAWGS------ -------NTAVV | FGGGT KLTVL |
| iPS:4 36668 | 21-225_147B9 | VL3|3r/JL 2 | SYELTQP-- PSVSVSPGQTASI TC | SGD----KLGD- -----KYVS | WYQQRPGQ SPVLVIY | Q------ DSKRPS | GIPERFSGSNSG--- NTATLTISGTLAVDEADYYC | LAWDS------ -------STFVV | FGGGT KLTVL |
| iPS:4 36670 | 21-225_147D9 | VL3|3r/JL 2 | SYELTQP-- PSVSVSPGQTASI TS | SGD----KLGN- -----KYVC | WYQQRPGQ SPVLVIY | Q------ DSKRPS | GIPERFSGSNSG--- NTATLTISGTQAMDEADYYC | QAWDR------ -------NTYVV | FGGGT KLTVL |

FIGURE 51 (Continued)

| | | | | | | | | |
|---|---|---|---|---|---|---|---|---|
| iPS:4 36672 | 21-225_147F9 | VL3\|3r/JL2 | SYELTQP-PSVSVSPGQTASITC | SGD----ELGN----KYAC | WYQQKPGQ SPVLVIY | Q------- DSKRPS | GIPERFSGSNSG---NTATLTISGTQAMDEADYYC | QAWDS---------STVV PGGGT KLTVL |
| iPS:4 36674 | 21-225_147G9 | VL3\|3r/JL2 | SYELTQP-PSVSVSPGQTASITC | SGD----KLGD----KYAC | WYQQKPGQ SPVLVIY | Q------- DRKRPS | GIPERFSGSNSG---NTATLTISGTQAMDEADYYC | QAWDS---------STVV PGGGT KLTVL |
| iPS:4 36676 | 21-225_147E1 | VL3\|3r/JL2 | SYELTQP-PSVSVSPGQTASITC | SGD----KLGD----KYAS | WYQQKPGQ SPVLVIY | Q------- DSKRPS | GIPERFSGSNSG---NTATLTISGTQAMDEADYYC | QAWDS---------STVV PGGGT KLTVL |
| iPS:4 36678 | 21-225_147B12 | VL3\|3r/JL2 | SYELTQP-PSVSVSPGQTASITC | SGD----KLGD----KYAS | WYQQKPGQ SPVLVIY | Q------- DSKRPS | GIPERFSGSNSG---NAATLTISGTQAMDEADYYC | QAWDS---------STVV PGGGT KLTVL |
| iPS:4 36686 | 21-225_148G6 | VL3\|3r/JL2 | SYELTQP-PSVSVSPGQTASITC | SGD----KLGD----KYAS | WYQQKPGQ SPVLVIY | Q------- DSKRPS | GIPERFSGSNSG---NTATLTISGTQAMDEADYYC | QAWDS---------STVV PGGGT KLTVL |
| iPS:4 36688 | 21-225_148C8 | VL3\|3r/JL2 | SYELTQP-PSVSVSPGQTASITC | SGD----KLGD----KYVS | WYQQKPGQ SPILVIY | Q------- DRKRPS | GTPERFSGSNSG---NTATLTISGTQAMDEADYYC | LAWDS---------STFVV PGGGT KLTVL |
| iPS:4 36690 | 21-225_148A9 | VL3\|3r/JL2 | SYELTQP-PSVSVSPGQTASITC | SGD----KLGN----KYVC | WYQQKPGQ SPVLVIY | Q------- DSKRPS | GIPERFSGSNSG---NTATLTISGTQAMDEADYYC | QAWDS---------STVV PGGGT KLTVL |
| iPS:4 36694 | 21-225_148G11 | VL3\|3r/JL2 | SYELTQP-PSVSVSPGQTASITC | SGD----KLGD----KFAS | WYQQKPGQ SPVLVIY | Q------- DSKRPS | GIPERFSGSNSG---NTATLTISGTQAMDEADYYC | QAWDS---------STVV PGGGT KLTVL |
| iPS:4 36698 | 21-225_149B5 | VL3\|3r/JL2 | SYELTQP-PSVSVSPGQTASITC | SGY----KLGY----KYVC | WYQQKPGQ SPVLVIF | Q------- NNQRPS | GIPERFSGSNSG---NTASLTISGTQAMDEADYYC | QAWDS---------STVV PGGGT KLTVL |
| iPS:4 36700 | 21-225_149C7 | VL3\|3r/JL2 | SYELTQP-PSVSVSPGQTASITC | SGD----KLGD----KYAS | WYQQKPGQ SPVLVIY | Q------- DSKRPS | GIPERFSGSKSG---NTATLTISGTQAMDEADYYC | QAWDS---------STVV PGGGT KLTVF |
| iPS:4 36704 | 21-225_149C10 | VL3\|3r/JL2 | SYELTQP-PSVSVSPGQTASITC | SGD----KLGD----KYAS | WYQQKPGQ SPVLVIY | Q------- DNKRPS | GIPERFSGSNSG---NTATLTIGGIQAMDEADYYC | QAWDS---------STVV PGGGT KLTVL |
| iPS:4 36706 | 21-225_149A11 | VL3\|3r/JL2 | SYELTQP-PSVSVSPGQTASITC | SGD----KLGN----KYVS | WYQQKPGQ SPVLVIY | Q------- DSKRPS | GIPERFSGSNSG---NTATLTISGTQAMDEADYYC | LAWDS---------STFVV PGGGT KLTVL |
| iPS:4 36708 | 21-225_150D3 | VL3\|3r/JL2 | SYELTQP-PSVSVSPGQTASITC | SGD----ELGN----KYAC | WYQQKPGQ SPVLVIY | Q------- DNKRPS | GIPERFSGSSSG---NTATLTISGTQAMDEADYYC | QAWDS---------STVV PGGGT KLTVL |
| iPS:4 36710 | 21-225_150F6 | VL3\|3r/JL2 | SYELTQP-PSVSVSPGQTASITC | SGD----KLGD----KYAS | WYQQKPGQ SPVLVIC | Q------- DSKRPS | GIPERFSGSNSG---NTATLTISGTQAMDEADYCC | QAWDS---------STVV PGGGT KLTVL |
| iPS:4 36714 | 21-225_150H11 | VL3\|3r/JL2 | SYELTQP-PSVSVSPGQTASITC | SGD----KLGD----KYAS | WYQQKPGQ SPVLVIY | Q------- DSKRPS | GIPERFSGSNSG---NTATLTISGTQAMDEADFYC | QAWDS---------STFVV PGGGT KLTVL |
| iPS:4 36716 | 21-225_151F3 | VL3\|3r/JL2 | SYELTQP-PSVSVSPGQTASITC | SGD----KLGD----KYVC | WYQQKPGQ SPVLVIY | Q------- DRKRPS | GIPERFSGSNSG---NTATLTISGTQAMDEADYYC | QAWDS---------STVV PGGGT KLTVL |

FIGURE 51 (Continued)

| | | | | | | | | | |
|---|---|---|---|---|---|---|---|---|---|
| iPS:4 36718 | 21-225_151H5 | VL3j3rJjL2 | SYELTQP-PSVSVSPGQTASI AC | SGD----KLGD------KYAS | WYQQKPGQ SPVLVIY | Q-------DSKRPS | GIPERFSGSNSG---NTAILTISGIQAMDEADYYC | QAWDS-------- | -------STVV | FGGGT KLTVL |
| iPS:4 36722 | 21-225_151H7 | VL3j3rJjL2 | SYDLTQP-PSVSVSPGQTASI TC | SGD----KLGD------KYAS | WYQQKPGQ SPVLVIY | Q-------DSKRES | GIPERFSGSNSG---NTAILTISGIQAMDEADYYC | QAWDS-------- | -------STVV | FGGGT KLTVL |
| iPS:4 36724 | 21-225_151B9 | VL3j3rJjL2 | SYELTQP-PSVSVSPGQTASI TC | SGD----NLGD------KYAS | WYQQKPGQ SPVLVIY | Q-------DSKRPS | GIPERFSGSNSG---NTAILTISGIQAMDEADYYC | QAWDS-------- | -------STVV | FGGGT KLTVL |
| iPS:4 36728 | 21-225_152G6 | VL3j3rJjL2 | SYELTQP-PSVSVSPGQTASI AC | SGD----KLGD------KYAS | WYQQKPGQ SPVLVIY | Q-------DSKRPS | GIPERFSGSNSG---NTAILTISGIQALDEADYYC | QAWDN-------- | -------STVV | FGGGT KLTVL |
| iPS:4 36730 | 21-225_152D7 | VL3j3rJjL2 | SYELTQP-PSVSVSPGQTASI TC | SGD----KLGD------KYAS | WYQQKPGQ SPVLVIY | Q-------DSKRPS | GIPERFSGSNSG---NTAILTISGIQAMDEADYYC | QAWDS-------- | -------STVV | FGGGT KLTVL |
| iPS:4 36736 | 21-225_153E8 | VL3j3rJjL2 | SYELTQP-PSVSVSPGQTASI TC | SGS----KLGN------KYVC | WYQQRPGQ SPVLVIY | Q-------DNKRPS | GIPERFSGSNSG---NTAILTISGTQAMDEADYYC | QAWDS-------- | -------STYVI | FGGGT KLTVL |
| iPS:4 36738 | 21-225_153D9 | VL3j3rJjL2 | SYELTQP-PSVSVSPGQTASI TC | SGD----KLGD------KYAC | WYQQKPGQ SPVLVIY | Q-------DRKRPS | GIPERFSGSNSG---NTAILTISGIQAMDEADYYC | QAWHS-------- | -------STVV | FGGGT KVTVL |
| iPS:4 36740 | 21-225_154C3 | VL3j3rJjL2 | SYELTQP-PSVSVSPGQTASI TC | SGD----KLGD------KYVC | WYQQKPGQ SPVLVIY | Q-------DRKRPS | GIPERFSGSNSG---NTAILTIGTQAMDEADYYC | QAWDS-------- | -------STVV | FGGGT KLTVL |
| iPS:4 36742 | 21-225_154C4 | VL3j3rJjL2 | SYELTQP-PSVSVSPGQTASI TC | SGD----KLGD------KYAS | WYQQKPGQ SPVEVIY | K-------DSKRPS | GIPERFSGSNSG---NTGILTISGIQAMDEADYYC | QAWDN-------- | -------STLV | FGGGT KLTVL |
| iPS:4 36744 | 21-225_154F4 | VL3j3rJjL2 | SYELTQP-PSVSVSPGQTASI TC | SGD----KLGN------KYVC | WYQQKPGQ SPVLVIY | Q-------DSKRPS | GIPERFSGSNSG---NTAILTISGIQAMDEADYYC | QAWDN-------- | -------STVV | FGGGT KLTVL |
| iPS:4 36746 | 21-225_154E10 | VL3j3rJjL2 | SYELTQP-PSVSVSPGQTASI TC | SGD----KLGD------KYAS | WYQQKPGQ SPVLVIY | Q-------DSKRPS | GIPERFSGSNSG---NTAILTISGIQAMDEADYYC | QAWHS-------- | -------SIVV | FGGGT KLTVL |
| iPS:4 36748 | 21-225_154D11 | VL3j3rJjL2 | SYELTQP-PSVSVSPGQTASI TC | SGD----KLGD------KYAC | WYQQKPGQ SPVLVIY | Q-------DKKRPS | GIPERFSGSNSG---NIAILTISGIQAMDEADYYC | QAWDS-------- | -------STVV | FGGGT KLTVL |
| iPS:4 36756 | 21-225_146A10 | VL3j3rJjL2 | SYELTQP-PSVSFGQTASI TC | SGD----KLGD------KYVC | WYQQKPGQ SPVLVIF | Q-------DRKRPS | GIPERFSGSNSG---NTAILTISGTQAMDEADYYC | QAWDS-------- | -------STVV | FGGGT KVTVL |
| iPS:4 36758 | 21-225_155C10 | VL3j3rJjL2 | SYELTQF-PSVSVSPGQTVSI TC | SGD----KLGD------KYVS | WYQQKPGQ SPVLVIY | Q-------DRKRPS | GIPERFSGSNSG---NTAILTISGIQAMDEADYYC | QAWDS-------- | -------STVV | FGGGT KLTVL |
| iPS:4 36760 | 21-225_155E10 | VL3j3rJjL2 | SYELTQP-PSVSVSPGQTASI TC | SGD----KLGD------KYVS | WYQQKPGQ SPVLVIY | Q-------DRKRPS | GTPERFSGSNSG---NTAILTISGIQAMDEADYYC | LAWDS-------- | -------STFVV | FGGGT KLTVL |
| iPS:4 36764 | 21-225_158E9 | VL3j3rJjL2 | SYDLTQP-PSVSVSPGQTASI TC | SGD----KLGD------KYVC | WYQQKPGQ SPVLVIY | Q-------DSKRPS | GIPERFSGSNSG---NTAILTIGTQAMDEANYYC | QAWDN-------- | -------SSFVL | FGGGT KLTVL |

FIGURE 51 (Continued)

| | | | | | | | | |
|---|---|---|---|---|---|---|---|---|
| iPS:4 36766 | 21-225_158D10 | VL3l3r/JL2 | SYELTQP-PSVTVSPGQTASIIC | SGD----KLGD----KYVC | WYQQKPGQSPVLVIY | Q-------DRKRPS | GIPERLSGSNSG-NTATLTISGTQALDEADYYC | QAWGN-------SSFVV | FGGGTKLTVL |
| iPS:4 36768 | 21-225_159H8 | VL3l3r/JL2 | SYELTQP-PSVSVSPGQTASIIC | SGD----KLGD----KYVC | WYQQKPGQSPVLVIY | Q-------DRKRPS | GIPERFSGSNSG-NTATLTISGTQALDEADYYC | QAWGN-------SSFVV | FGGGTKLTVL |
| iPS:4 36770 | 21-225_160B12 | VL3l3r/JL2 | SDELTQS-PSVSVSPGQTASIIC | SGD----KLGD----KYVC | WYQQKPGQSPVLVIY | Q-------DSKRPS | GIPERFSGSNSG-NTATLTISGTQALDEADYYC | QAWGN-------SSFVV | FGGGTKLTVL |
| iPS:4 36772 | 21-225_161H3 | VL3l3r/JL2 | SYELTQP-PSVSVSPGQTASIIC | SGD----RLGD----KYVC | WYQQKPGQSPVLVIF | Q-------DNKRPS | GIPERFSGSNSG-NTATLTISGTQALDEADYYC | QAWVN-------NTAVV | FGGGTKLTVL |
| iPS:4 36774 | 21-225_161E10 | VL3l3r/JL2 | SFDLTQP-PSVSVSPGQTASIIC | SGD----KLGD----KYVC | WYQQKPGQSPVLVIY | Q-------DSKRPS | GIPERFSGSNSG-NTATLTISGTQAMDEADYYC | QTWDN-------SSFAL | FGGGTKLTVL |
| iPS:4 36776 | 21-225_161F12 | VL3l3r/JL2 | SYELTQP-PSVSVSPGQTASIIC | SGD----NLGD----KYAC | WYQQKPGQSPVLVIY | Q-------DTKRPS | GIPERFSGSNSG-NTATLTISGTQAMDEADYYC | QAWDS-------TTIV | FGGGTKLTVL |
| iPS:4 36780 | 21-225_165H3 | VL3l3r/JL2 | SYELTQP-PSVSVSPGQTASIIC | SGD----KLGD----KYAC | WYQQKPGQSPVLVIY | Q-------DSKRPS | GIPERFSGSNSG-NTATLTISGTQAMDEADYYC | QAWDS-------TTLV | FGGGTKLTVL |
| iPS:4 36782 | 21-225_166G11 | VL3l3r/JL2 | SYELSQP-PSVSVSPGQTASIIC | SGD----KLGD----KIVH | WYQQKPGQSPLLVIY | Q-------DSKRPS | GIPERFSGSNSG-NTATLTISGTQAMDEADYYC | QAWDN-------STAV | FGGGTKLTVL |
| iPS:4 36784 | 21-225_169C1 | VL3l3r/JL2 | SYELTQP-PSVSVSPGQTASIIC | SGD----KLGD----KYVC | WYQRKPGQSPVLVIY | K-------DIKRPS | GIPARFSGSNSG-NTATLTISGTQAMDEADYYC | QAWDT-------NTVI | FGGGTKLTVL |
| iPS:4 36786 | 21-225_169A6 | VL3l3r/JL2 | SYELTQP-PSVSVSPGQTASIIC | SGD----KLGD----KYVC | WYQRKPGQSPVLVIY | Q-------DYKRPS | GIPERFSGSNSG-NTATLTISGTQAMDEADYYC | QAWDN-------NTVL | FGGGTKLTVL |
| iPS:4 36788 | 21-225_169B7 | VL3l3r/JL2 | AYDLTQP-PSVSVSPGGTARII | SGD----KLGG----KYAS | WYQQKPGQSPVLVIY | Q-------DRKRPS | GIPERFSGSNSG-NTATLTISGTQAMDEADYYC | QAWDK-------NTVV | FGGGTKLTVL |
| iPS:4 36790 | 21-225_169G11 | VL3l3r/JL2 | SYELTQP-PSVSVSPGQTASIIC | SGD----KLGD----KYAC | WYQQKPGQSPVLVIY | Q-------DSKRPS | GIPERFSGSNSG-NTATLTISGTQAMDEADYYC | QAWDN-------STAV | FGGGTKLTVL |
| iPS:4 36794 | 21-225_170F1 | VL3l3r/JL2 | SYELSQP-PSVSVSPGQTASIIC | SGD----KLGD----KYSC | WYQQKPGQSPVLVIY | Q-------DSKRPS | GIPARFSGSNSG-NTATLTISGTQAMDEADYYC | QAWDS-------NTAV | FGGGTKLTVL |
| iPS:4 36796 | 21-225_170A5 | VL3l3r/JL2 | SYDLTQP-PSVSVSPGQTASIIC | SGD----KLGD----KYAC | WYQRKPGQSPILVIY | Q-------DYKRPS | GIPERFSGSNSG-NTATLTISGTQAMDEADYYC | QAWDN-------STMV | FGGGTKLTVL |
| iPS:4 36798 | 21-225_171F5 | VL3l3r/JL2 | SYELTQP-PSVSVSPGQTASIIC | SGD----KLGG----KYAS | WYQQKPGQSPVLVIY | Q-------DRKRPS | GIPERFSGSNSG-NTATLTISGTQAMDEADYYC | QAWDK-------NTVV | FGGGTKLTVL |
| iPS:4 36802 | 21-225_171E12 | VL3l3r/JL2 | SYELTQP-PSVSVSPGQTASIIC | SGD----KLGD----KYAC | WYQQKPGQSPVLVIY | Q-------DRKRPS | GIPERFSGSNSG-NTATLTISGTQAMDEADYYC | QAWDI-------STYVV | FGGGTKLTVL |

FIGURE 51 (Continued)

| | | | | | | | | |
|---|---|---|---|---|---|---|---|---|
| iPS:4 36808 | 21-225_173F8 | VL3|3r/JL2 | SYELTQP-PSVSVSPGQTASI TC | SSN----KLGN--  ----KYVC | WYQQRPGQ SPVLVIS | Q-------  DSRRPS | GIPERFSGSNSG---  NTATLTISGTQAMDEADYYC | QAWDS------------  -------FTVV | FGGGT KLTVL |
| iPS:4 36812 | 21-225_175C6 | VL3|3r/JL2 | SYDLTQP-PSVSVSPGQTASI TC | SGD----KLGD--  ----KYAC | WYQQRPGQ SPILVIY | Q-------  DYKRPS | GIPERFSGSNSG---  NTATLTISGTQAMDEADYYC | QAWDN------------  -------STAV | FGGGT RLTVL |
| iPS:4 36818 | 21-225_179C7 | VL3|3r/JL2 | SYELTQP-PSVSVSPGQTASI TC | SGD----KLGD--  ----KYVC | WYQQRPGQ SPVLVIY | Q-------  DSKRPS | GIPERFSGSNSG---  NTATLTIRGTQAMDEADYYC | QAWDS------------  -------NTAVV | FGGGT KLTVL |
| iPS:4 36822 | 21-225_180D4 | VL3|3r/JL2 | SYELTQT-PSVSVSPGQTASI TC | SGD----RLGD--  ----KYAC | WYQQRPGQ SPVLVIY | E-------  DRKRPS | GIPERFSGSNSG---  NTATLFISGTQAMDEGDYYC | QAWDS------------  -------RKVV | FGGGT KLTVL |
| iPS:4 36824 | 21-225_180C5 | VL3|3r/JL2 | SYELTQP-PSVSVSPGQTASI TC | SGD----KLGE--  ----KYAC | WYQQKPGQ SPVLVIY | Q-------  DRKRPS | GIPERFSGSNSG---  NTATLFISGTQAMDEADYYC | QAWDS------------  -------STAV | FGGGT KLTVL |
| iPS:4 36826 | 21-225_180G5 | VL3|3r/JL2 | SYELTQP-PSVSVPGQTASI TC | SGD----KLGD--  ----KYVS | WYQQKPGQ SPVLVIY | Q-------  DSKRPS | GIPERFSGSNSG---  NPASLTISGTQAMDEADYYC | QAWDI------------  -------TTAV | FGGGT KLTVL |
| iPS:4 36828 | 21-225_181H1 | VL3|3r/JL2 | SYELTQT-PSVSVSPGQTASI TC | SGD----KLGD--  ----KYAC | WYQQRPGQ SPVLVIY | E-------  DRKRPS | GIPERFSGSNSG---  NTATLTISGTQAMDEADYYC | QAWDS------------  -------RKVV | FGGGT KLTVL |
| iPS:4 36836 | 21-225_52H1 | VL3|3r/JL2 | SYELTQP-PSVFVSPGQTASI TS | SGD----KLGD--  ----KYVS | WYQQKPGQ SPVLVIY | Q-------  DRKRPS | GIPERFSGSNSG---  NTATLTISGTQAMDEADYYC | QAWDN------------  -------STVV | FGGGT KLTVL |
| iPS:4 36848 | 21-225_57F1 | VL3|3r/JL2 | SYELTQP-PSASVSPGQTASI TC | SGD----KLGE--  ----KYAC | WYQQKRPGQ SPVLVIY | Q-------  DRKRPS | GIPERFSGSNSG---  NTATLTISGTQAMDEADYYC | QAWDS------------  -------STVV | FGGGT KLTAL |
| iPS:4 36850 | 21-225_57D9 | VL3|3r/JL2 | SYELTQP-PSVSVSPGQTASI TC | SGE----KLGE--  ----KFAC | WSQQKPGQ SPVLVIY | Q-------  DSKRPS | GIPERFSGSNSG---  NTATLTISGTQAMDEADYYC | QAWDS------------  -------STVV | FGGGT KLTVL |
| iPS:4 36852 | 21-225_57H11 | VL3|3r/JL2 | SYALTQP-PSASVSPGQTASI TC | SGD----KLGE--  ----KYAC | WYQQKPGQ SPVLVIY | Q-------  DRKRPS | GIPERFSGSNSG---  NTATLTISGTQAMDEADYYC | QAWDS------------  -------STVV | FGGGT KLTVL |
| iPS:4 36854 | 21-225_58C1 | VL3|3r/JL2 | SYELTQP-PSVSVSPGQTANI TS | SGD----KLGN--  ----KYAC | WYQQKPGQ SPVLVIY | Q-------  DRKRPS | GIPERFSGSNSG---  NTATLTISGTQAMDEADYYC | QAWD-------------  -------SSTA | FGGGT KLTVL |
| iPS:4 36858 | 21-225_58E7 | VL3|3r/JL2 | SYELTQS-PSVSVSPGQTASI TC | SGD----KLGD--  ----KYTC | WYQKKPGQ SPVLVIY | Q-------  DNKRPS | GIPERFSGSNSG---  NTATLTISGTQAMDEADYFC | QAWNN------------  -------YTVV | FGGGT KLTAL |
| iPS:4 36860 | 21-225_58F7 | VL3|3r/JL2 | SYELTQP-PSVSVSPGQTASI TC | SGD----KLGE--  ----KYAC | WYQQKPCQ SPVLVIY | Q-------  DRKRPS | GIPERFSGSNSG---  NTATLTISGTQAMDEADYYC | QAWDS------------  -------STVV | FGGGT KLTVL |
| iPS:4 36862 | 21-225_58F8 | VL3|3r/JL2 | SYELTQP-PSVSVSPGQTASI TC | SGD----KLGN--  ----KYAC | WYQQKPGQ SPVLVIY | Q-------  DSKRPS | GIPERFSGSNSG---  NTATLTISGTQAMDEADYYC | QAWDS------------  -------STVV | FGGGT KLTVL |
| iPS:4 36864 | 21-225_58G11 | VL3|3r/JL2 | SYELTQF-PSVSVSPGQTASI TC | SGD----KLGD--  ----KYAS | WYQQKPSQ SPVLVIY | Q-------  DNKRPS | GIPERFSGSNSG---  NTATLTISGTQAMDEADYYC | QAWNN------------  -------NTVM | FGGGT RLTVL |

FIGURE 51 (Continued)

| | | | | | | | |
|---|---|---|---|---|---|---|---|
| iPS:4 36866 | 21-225_59F2 | VL3j3r/JL2 | SYELTQP-PSVSVSPGQTASITC | SGD----KLGD-----KYAS | WYQQKPGQSPVLVIY | Q-------DNKRPS | GIPERFSGSNSG---NTATLTISGTQAMDEADYYC | QAWDN----------NTVV | FGGGTKLTVL |
| iPS:4 36868 | 21-225_59B11 | VL3j3r/JL2 | SYELTQP-PSVSVSPGQTASITC | SGD----KLGD-----KYAC | WYQQKPGQSPVLVIY | Q-------DSKRPS | GILERFSGSNSG---NTATLIISGTQAMDEADYYC | QAWDS----------STYVV | FGGGTKLTVL |
| iPS:4 36870 | 21-225_60B1 | VL3j3r/JL2 | SYELTQP-PSASVSPGQTASITC | SGD----KLGE-----KYAC | WYQQKPGQSPVLVIY | Q-------DRKRPS | GIPERFSGSNSG---NTATLISGTQAMDEADYYC | QAWDS----------STVV | FGGGTKLTVL |
| iPS:4 36872 | 21-225_60D2 | VL3j3r/JL2 | SYELTQP-PSVSVSPGQTASITC | SGN----KLGD-----KYAS | WYQQKPGQSPVLVIY | Q-------DNKRPS | GIPERFSGSNSG---NTATLISGTQTMEADYYC | QAWDN----------NTVV | FGGGTKLTVL |
| iPS:4 36874 | 21-225_60A12 | VL3j3r/JL2 | SYELTQP-PSVSVSPGQTANI | SGD----KLGN-----KYAC | WYQQKPGQSPVLVIY | Q-------DRKRPS | GIPERFSGSNSG---NTAILIISGTQAMDEADYYC | QAWD-----------SSTA | FGGGTKLTVL |
| iPS:4 36876 | 21-225_61F5 | VL3j3r/JL2 | SYELTQP-PSVSVSPGQTASITC | SGD----KLGE-----KYAC | WYQQKPGQSPVLVIY | Q-------DSKRPS | GIPERFSGSNSG---NTATLISGTQAMDEADYYC | QAWDS----------STVV | FGGGTKLTVL |
| iPS:4 36878 | 21-225_62E3 | VL3j3r/JL2 | SYELTQP-PSVSVSPGQTASITC | SGD----KLGN-----KYAC | WYQQKPGQSPVVVIY | Q-------DRKRPS | GIPERFSGSNSG---NTATLISGTQAMDEADYYC | QAWDS----------STAV | FGGGTKLTVL |
| iPS:4 36880 | 21-225_62E8 | VL3j3r/JL2 | SYELTQP-PSVSVSPGQTASITC | SGD----RLGN-----KYAS | WYQQKPGQSPVVVIY | Q-------DRKRPS | GIPERFSGSNSG---NTATLISGTQAMDEADYYC | QAWDS----------STAV | FGGGTKLTVL |
| iPS:4 36882 | 21-225_62D10 | VL3j3r/JL2 | SYELTQP-PSVSVSPGQTASITC | SGD----KLGN-----KYAC | WYQQKPGQSPVLVIY | Q-------DRKRPS | GIPERFSGSNSG---NTATLISGTQAMDEADYYC | QAWDS----------STAV | FGGGTKLTVL |
| iPS:4 36884 | 21-225_62A12 | VL3j3r/JL2 | SYELTQP-PSVSVSPGQTASITC | SGD----KLGE-----KYAC | WYQQKPGQSPVLVIY | Q-------DRKRPS | GIPERFSGSNSG---NTATLISGTQAMDEADYYC | QAWDS----------STAV | FGGGTKLTVL |
| iPS:4 36886 | 21-225_62B12 | VL3j3r/JL2 | SYELTQP-PSVSVSPGQTASITC | SGD----KLGN-----KYTC | WYQQKPGQSPVLVIY | Q-------DRKRPS | GIPERFSGSNSG---NTATLISGTQAMDEADYYC | QAWDS----------STAV | FGGGTKLTVL |
| iPS:4 36892 | 21-225_65E9 | VL3j3r/JL2 | SYELTQP-PSVSVSPGQTASITC | SGD----KLGN-----KYDY | WYQQKPGQSPVLVIY | Q-------DRKRPS | GIPERFSGSNSG---NTATLISGTQAMDEADYYC | QAWDS----------STVV | FGGGTKLTVL |
| iPS:4 36894 | 21-225_66G9 | VL3j3r/JL2 | SYELTQP-PSVTVSPGQTASITC | SGD----KLGN-----KYAC | WYQQKPGQSPVLVIY | Q-------DRKRPS | GIPERFSGSNSG---NTATLISGTQAMDEADYYC | QAWDS----------STVV | FGGGTKLTVL |
| iPS:4 36896 | 21-225_67F10 | VL3j3r/JL2 | SYELTQP-PSVSVSPGQTASITC | SGD----KLGY-----KYAW | WYQQKPGQSPVLVIF | E-------DRKRPS | GIPERFSGSNSG---NTATLISGTQAMDEADYYC | QAWDI----------NTAV | FGGGTKLTVL |
| iPS:4 36898 | 21-225_68D8 | VL3j3r/JL2 | SYELTQP-PSVSVSPGQTASITC | SGD----KLGD-----KYAC | WYQQKPGQSPVLVIY | Q-------DSKRPS | GIPERFSGSNSG---NTATLIISGTQAMDEADYYC | QAWDS----------STVV | FGGGTKLTVL |
| iPS:4 36900 | 21-225_69B9 | VL3j3r/JL2 | SYELTQP-PSVSVSPGQTASITC | SGD----KLGN-----KYDY | WYQQNPGQSPVLVIY | Q-------DRKRPS | GIPERFSGSNSG---NTATLISGTQAMDEADYYC | QAWDN----------STVV | FGGGTKLTVL |

FIGURE 51 (Continued)

| | | | | | | | | |
|---|---|---|---|---|---|---|---|---|
| iPS:4 36902 | 21-225_69B11 | VL3J3r/JL2 | SYELTQP-PSVSVSPGGAASITC | SGD----KLGD-----KYAR | WYQQKPGQ SPVLVIY | E------DRKRPS | GIPERFSGSNSG---NTATLTISGTQAMDEADYYC | QAWDN------------STVV | FGGGT KLTVL |
| iPS:4 36904 | 21-225_71D4 | VL3J3r/JL2 | SYELTQP-PSVSVSPGQTASITC | SGD----KLGD-----KYAY | WYQQKPGQ SPVLVIY | Q------DRKRPS | GIPDRFSGSNSG---NTAILTISGTQAMDEADYYC | QAWVN------------STVV | FGGGT KLTVL |
| iPS:4 36906 | 21-225_72B4 | VL3J3r/JL2 | SYDLTQP-PSVSVSPGQTASITC | SGD----KLGD-----KYAW | WYQQRPGQ SPVLVIY | E------DRKRPS | GIPERFSGSNSG---NTATLTISGTQAMDEADYYC | QAWDN------------STVV | FGGGT KLTVL |
| iPS:4 36908 | 21-225_72D5 | VL3J3r/JL2 | SYDLTQP-PSVSVSPGQTASITC | SGD----KLGN-----KYAC | WYQQKPGQ SFVVVIY | Q------DRKRPS | GIPERFSGSNSG---NTATLTISGTQAMDEADYYC | QAWDS------------STAV | FGGGT KLTVL |
| iPS:4 36912 | 21-225_73C4 | VL3J3r/JL2 | SYDLTQP-PSVSVSPGQTASITC | SGD----KLGN-----KYAC | WYQQKPGQ SFVLVIY | Q------DMKRPS | GIPERFSGSNSG---NTATLTISGTQAMDEADYYC | QAWDS------------STAV | FGGGT KLTVL |
| iPS:4 36914 | 21-225_76B4 | VL3J3r/JL2 | PYELNQT-PSVSVSPGQTASITC | SGD----RLGT-----KFAC | WYQQKPGQ SPVLVIY | Q------DSKRPS | GIPERFSGSNSG---NTATLTISGTQAMDEADYYC | QAWD-------------SSTV | FGGGT KLTVL |
| iPS:4 36916 | 21-225_74A9 | VL3J3r/JL2 | SYELTQP-PSVSVSPGQTASITC | SGD----KLGN-----KYVC | WYQQKPGQ SPVLVIY | Q------DRKRPS | GIPERFSGSNSG---NTATLTISGTQAMDEADYYC | QAWDS------------SPVI | FGGGT KLTVL |
| iPS:4 36918 | 21-225_77A2 | VL3J3r/JL2 | SYELTQP-PSESVSPGQTASITC | SGD----KLGN-----KYAC | WYQQKPGQ SFVLVIY | Q------DRKRPS | GIPERFSGSNSG---STATLTISGTQAMDEADYYC | QAWD-------------STAV | FGGGT KLTVL |
| iPS:4 36922 | 21-225_78E9 | VL3J3r/JL2 | SYELTQP-PSVSVSPGQTASITC | SGD----KLGN-----KYVS | WYQQKPGQ SPVLVIY | Q------DNRRPS | GIPERFSGSNSG---NTATLTISGTQAMDEADYYC | QAWDS------------SPVI | FGGGT KLTVL |
| iPS:4 36924 | 21-225_74B3 | VL3J3r/JL2 | SYELTQP-PSVSVSPGQTASITC | SGD----RLGD-----KYAC | WYQQKPGQ SPVLVIY | Q------DSKRPS | GIPERFSGSNSG---NTATLTISGTQAMDEADYYC | QAWDS------------TTVV | FGGGT KLTVL |
| iPS:4 36928 | 21-225_79E7 | VL3J3r/JL2 | SYELTQP-PSVSVSPGQTASITC | SGD----KLGN-----KYVS | WYQQKPGQ SPVLVIY | Q------DNRRPS | GIPERFSGSNSG---STATLTISGTQAMDEADYYC | QAWDS------------SPVI | FGGGT KLTVL |
| iPS:4 36932 | 21-225_92A4 | VL3J3r/JL2 | SYELTQP-PSVSVSPGQTANI | SGD----KLGN-----KYVC | WYQQKPGQ SPVLVIY | Q------DNRRPS | GIPERFSGSNSG---NTATLTISGTQAMDEADYYC | QAWDS------------SPVI | FGGGT KLTVL |
| iPS:4 36934 | 21-225_96B5 | VL3J3r/JL2 | PYELNQT-PSVSVSPGQTASITC | SGD----KLGT-----KFAC | WYQQKPGQ SPVLVIY | Q------DSKRPS | GIPERFSGSNSG---NTATLTISGTQAMDEADYYC | QAWD-------------SSTV | FGGGT KLTVL |
| iPS:4 36936 | 21-225_97E6 | VL3J3r/JL2 | SYELTQP-PSVSVSPGQTVSI | SGD----KLGN-----KYVS | WYQQKPGQ SFVLVIY | Q------DSKRPS | GIPERFSGSNSG---STATLTISGTQAMDEADYYC | QAWDS------------TFVI | FGGGT KLTVL |
| iPS:4 36938 | 21-225_146A3 | VL3J3r/JL2 | SYAMTQP-PSMSVSPGQTASI | SGN----KLGN-----RYAC | WYQQKPGQ SPVLVIY | Q------DSKRPS | GIPERFSGSNSG---NIATLTISGTQAMDEADYYC | QAWDS------------STVV | FGGGT KLTVL |
| iPS:4 36940 | 21-225_146B8 | VL3J3r/JL2 | SYELTQP-PSVSVSPGQTASI | SGD----KLGD-----RYVC | WYQQKPGQ SPVLVIY | Q------DRKRPS | GIPERFSGSNSG---NTATLTISGTQAMDEADYYC | QAWHS------------STVV | FGGGT KLTVL |

FIGURE 51 (Continued)

| | | | | | | | | |
|---|---|---|---|---|---|---|---|---|
| iPS:4 36942 | 21-225_146H8 | VL3\|3r\|JL2 | SYELTQP-PSVSVSPGQTASITC | SGD----KLGD-----KYAC | WYQQKPGQ SPVLVIY | Q------- DKKRPS | GIPERFSGSNSG--- NTATLTISGTQVMDEADYYC | QAWDI------------RTVV | FGGGT KLTVL |
| iPS:4 36944 | 21-225_182D12 | VL3\|3r\|JL2 | SYELTQP-PSVSVSPGQTASITC | SGD----KLGE-----RYAC | WYQQKSGQ SFVLVIY | Q------- DRKRPS | GIPERFSGSNSG--- NTATLTISGTQAMDEADYYC | QAWDS------------RTAV | FGGGT KLIVL |
| iPS:4 36946 | 21-225_183F4 | VL3\|3r\|JL2 | SYELTQP-PSVSVSPGQTASITC | SGD----KLGD-----RYAC | WYQQKPGQ SPVLVIY | Q------- DKKRPS | GIPERFSGSNSG--- NTATLTISGTQAMDEADYYC | QAWDN------------STAVV | FGGGT KLIVL |
| iPS:4 36952 | 21-225_185D2 | VL3\|3r\|JL2 | SYELTQT-PSVSVSPGQTASITC | SGD----KLGD-----KYAC | WYQQKPGQ SPVLVIY | E------- DRKRPS | GIPDRFSGSNSG--- NTATLTISGTQAMDEADYYC | QAWDS------------RKVV | FGGGT KLIVL |
| iPS:4 36954 | 21-225_185G7 | VL3\|3r\|JL2 | SYELTQP-PSVSVSPGQTASITC | SGD----KLGH-----KFVC | WYQQKPGQ SPVLVIY | Q------- DKKRPS | GIPERFSGSNSG--- NTATLTISGTQAMDEADYYC | QAWD-------------SSIV | FGGGT KLIVL |
| iPS:4 36956 | 21-225_186H6 | VL3\|3r\|JL2 | SYELTQP-PSVSVSPGQTASITC | SGD----NMGE-----KYAC | WYQQKPGQ SPVLVIY | Q------- DKKRPS | GIPERFSGSNSG--- NTATLTISGTQAMDEADYYC | QAWDS-------------STAV | FGGGT KLIVL |
| iPS:4 36962 | 21-225_190H1 | VL3\|3r\|JL2 | SYELTQP-PSVSVSPGQTASITC | SGD----KLGD-----RFAY | WYQQKPGQ SFVLVIY | Q------- DSKRPS | GIPERFSGSNSG--- NTATLTISGTQAMDEADYYC | NAWDS-------------STVV | FGGGT KLIVL |
| iPS:4 36978 | 21-225_190G9 | VL3\|3r\|JL2 | SYELTQP-PSVSVSPGQTASITC | SGD----KLGD-----RFAY | WYQQKPGQ SPVLVIY | Q------- DNKRPS | GIPERFSGSNSG--- NTASLTISGTQAMDEADYYC | QAWDS-------------STAV | FGGGT KLIVL |
| iPS:4 37018 | 21-225_193H5 | VL3\|3r\|JL2 | SYELTQP-SSVSVSPGQTASITC | SGD----KLGD-----RFAC | WYQQKPGQ SPVLVIY | Q------- DSKRPS | GIPERFSGSNSG--- NTATLTISGTQAMDEADYYC | QAWDS-------------STAV | FGGGT KLIVL |
| iPS:4 37030 | 21-225_195E3 | VL3\|3r\|JL2 | SYELTQP-PSVSVSPGQTASITC | SGD----KLGY-----RSVC | WYQQKPGQ SPVLVIY | E------- DSKRPS | GIPERFSGSNSG--- NTATLTISGTQAMDEADYYC | QAWDS-------------VTVV | FGGGT KLIVL |
| iPS:4 37034 | 21-225_195E9 | VL3\|3r\|JL2 | SYELTQP-PSVSVSPGQTASITC | SGD----KLGN-----KYAY | WYQQKPGQ SPVLVIY | Q------- DKKRPS | GIPERFSGSNSG--- NTIGLTISGTQGMDEADYYC | QAWDR-------------GIVV | FGGGT KLIVL |
| iPS:4 37070 | 21-225_201G11 | VL3\|3r\|JL2 | SYELTQP-PSVSVSPGQTASITC | SGD----KLGD-----RFAX | WYQQKPGQ SPVLVIY | Q------- DSKRPS | GIPERFSGSNSG--- NTATLTISGTQAMDEADYYC | QAWDS-------------STVV | FGGGT KLIVL |
| iPS:4 37076 | 21-225_203G6 | VL3\|3r\|JL2 | SYELTQP-PSVSVSPGQTASITC | SGD----KLGD-----RFAC | WYQQKPGQ SPVLVIY | Q------- DSKRPS | GIPERFSGSNSG--- NTATLTISGTQSMDEADYYC | QAWDS-------------STVV | FGGGT KLIVL |
| iPS:4 37144 | 21-225_215B3 | VL3\|3r\|JL2 | SYELTQP-PSVSVSPGQTASITC | SGD----KLGD-----KFAC | WYQQKPGQ SPVLVIY | Q------- DSKRPS | GIPERFSGSNSG--- NTATLTISGTQAMDEADYYC | QAWDS-------------STVV | FGGGT KLIVL |
| iPS:4 37186 | 21-225_224H2 | VL3\|3r\|JL2 | SYELTQP-SSVSVSPGQTASITC | SGD----NLGV-----KYTY | WYQQKPGQ SPVLVVY | Q------- DSKRPS | GIPERFSGSNSG--- NTATLTISGTQAMDEADYYC | QAWDS-------------STVV | FGGGT KLIVL |
| iPS:4 37192 | 21-225_225E9 | VL3\|3r\|JL2 | SYDLTQP-PSVSVSPGQTASITC | SGD----NLGN-----RYAC | WYQQKPGQ SFVLVMY | Q------- DRKRPS | GIPERFSGSNSG--- NTATLTISGTQAMDEADYYC | QAWDS-------------RTAVV | FGGGT KLIVL |

FIGURE 51 (Continued)

| | | | | | | | | |
|---|---|---|---|---|---|---|---|---|
| iPS:4 37194 | 21-225_226B2 | VL3|3r/JL2 | SYELTQP-PSVSVSPGQTASITC | SGD---TLGG-----KYAW | WYQQRPGQ SPVLVIY | Q-------DRKRPS | GIPERFSGSSSG--NTATLTISGTQAMDEADYYC | QAWDN---------GAAV | FGGGT KLTVL |
| iPS:4 37200 | 21-225_226A10 | VL3|3r/JL2 | SYELTQP-PSVSVSPGQTASITC | SGD---TLGG-----KYAW | WYQQKPGQ SPVLVIY | Q-------DRKRPS | GIPERFSGSSSG--NTATLTISGTQAMDEADYYC | QAWDN---------GAAV | FGGGT KLTVL |
| iPS:4 37204 | 21-225_227E5 | VL3|3r/JL2 | SYELTQP-PSVSVSPGQTASITC | SGD---KLGE-----KYAC | WYQQKPGQ SPVLVIY | Q-------DRKRPS | GIPERFSGSNSG--NKATLTISGTQAMDEADYYC | QAWVN---------NIMI | FGGGT KLTVL |
| iPS:4 37210 | 21-225_227E12 | VL3|3r/JL2 | SYELTQP-PSVSVSPGQTASITC | SGD---KLGD-----KYVC | WYQQKPGQ SPVLVIY | Q-------DSKRPS | GIPERFSGSNSG--NTATLTISGTQAMDEADYYC | QAWNS---------SNVV | FGGGT KLTVL |
| iPS:4 48908 | 21-225_50G9 | VL3|3r/JL2 | SYELTQP-PSVSVSPGQTASITC | SGD---KLGD-----KYAC | WYQQKPGQ SPVLVIY | Q-------DSKRPS | GIPERFSGSNSG--NTATLTISGTQARDEAEYYC | QARNS---------RRGV | FGGGT RLTVL |
| iPS:4 51102 | 21-225_45F6 | VL3|3r/JL2 | SYELTQP-PSVSVSPGQTASITC | SGD---KLGD-----KYAS | WYQQKPGQ SPVLVIY | Q-------DSKRPS | GIPERFSGSNSG--NTATLTISGTQAMDEADYYC | QAWDN---------RTMV | FGGGT KLTVL |
| iPS:4 51110 | 21-225_74C9 | VL3|3r/JL2 | SYELTQP-PSESVSPGQTASITC | SGD---KSGN-----KYVS | WYQQRPGQ SPVLVIY | Q-------DNRRPS | GIPERFSGSNSG--STATLTISGTQAMDEADYYC | QAWDS---------TPVI | FGGGT KLTVL |
| iPS:4 51112 | 21-225_53D10 | VL3|3r/JL2 | SYELTQP-PSVSVSPGQTASITC | SGD---KLGN-----KYAC | WYQQKPGQ SPVLVIY | Q-------DRKRPS | GIPERFSGSNSG--NTATLTISGTQAMDEADYYC | QAWDS---------STVV | FGGGT KLTVL |
| iPS:4 72731 | 21-225_14B1_LC2 | VL3|3r/JL2 | SFELTQP-PSVSVSPGQTASITC | SGD---KLGD-----KYAY | WYQQKPGQ SPVLVIY | Q-------DRKRPS | GIPERFSGSNSG--NTATLTISGTQAMDEADYYC | QAWDN---------STVV | FGGGT KLTVL |
| iPS:3 92583 | 21-225_10B10 | VL3|3r/JL2 | SYELTQP-PSVSVSPGQTASITC | SGD---KLGN-----KYAW | WYQQKPGQ SPVLVIY | Q-------DRKRPS | GIPERFSGSNSG--NTATLTISGTQAMDEADYYC | QAWDN---------STVV | FGGGT KLTVL |
| iPS:3 92585 | 21-225_14H11 | VL3|3r/JL2 | TYELTQP-SSVSVSPGQTASITC | SGD---KLGE-----KYVC | WYQQKPGQ SPVLVIY | Q-------DTKRPS | GIPERFSGSNSG--NTATLTISGTQAMDEADYYC | QAWDS---------SSTI | FGGGT KLTVL |
| iPS:3 92587 | 21-225_18G5 | VL3|3r/JL2 | SYELTQP-PSVSVSPGQTASITC | SGE---KLGD-----KYVC | WYQQKPGQ SPVLVIY | Q-------DSKRPS | GIPERFSGSNSG--NTATLTISGTQAMDEADYYC | QAWNS---------SNVV | FGGGT KLTVL |
| iPS:3 92589 | 21-225_27H2 | VL3|3r/JL2 | SYELTQP-PSVSVSPGQTASITC | SGD---KLGD-----KYAS | WYQQKPGQ SPVLVIY | Q-------DGKRPS | GIPERFSGSNSG--NTATLTISGTQAMDEADYYC | QAWDS---------STYVV | FGGGT KLTVL |
| iPS:3 92598 | 21-225_18E10 | VL3|3r/JL2 | SYELTQP-PSVSVSPGQTASITC | SGD---RLGD-----KYAW | WYQQKPGQ SPVLVIY | Q-------DRKRPS | GIPERFSGSNSG--NTATLTISGTQAMDEADYYC | QAWDS---------STVV | FGGGT KLTVL |
| iPS:3 93166 | 21-225_27G6 | VL3|3r/JL2 | SYELTQP-PSVSVSPGQTASITC | SGD---KLGD-----KYAC | WYQQKPGQ SPVLVIY | Q-------DRKRPS | GIPERFSGSNSG--NTATLTISGTQMDEADYYC | QAWDS---------SSYVV | FGGGT KLTVL |
| iPS:3 93168 | 21-225_32B11 | VL3|3r/JL2 | SYELTQP-PSVSVSPGQTASITC | SGD---KLGD-----KYAY | WYQQKPGQ SPVLVIY | Q-------DSKRSS | GIPERFSGSNSG--NTATLTISGTQAMDEADYYC | QAWDN---------STVV | FGGGT KLTVL |

FIGURE 51 (Continued)

| | | | | | | | | | |
|---|---|---|---|---|---|---|---|---|---|
| iPS.3 93172 | 21-225_3B12 | VL3|3r/JL2 | SYELSQP-PSVSVSPGQTASI TC | SGD----KLGE-----KYAC | WYQQKPGQ SPVLVIY | Q------- DRKRPS | GIPERFSGSNSG-- MKATLTISGTQAMDEADYYC | QAWVN--------- --------NTMI | FGGGT KLTVL |
| iPS.3 93176 | 21-225_27E7 | VL3|3r/JL2 | SYELTQP-PSVSVSPGQTASI TC | SGD----KLGN-----KYAY | WYQQKPGQ SPVEVIY | Q------- DSKRPL | GIPERFSGSNSG-- NTATLTISGTQAMDEADYYC | QAWDS--------- --------STVV | FGGGT KLTVL |
| iPS.3 93178 | 21-225_34D7 | VL3|3r/JL2 | SYELTQP-PSVSVSPGQTASI TC | SGD----KLGE-----KYAY | WYQQKPGQ SPVLVLY | Q------- DSKRPS | GIPERFSGSNSG-- NTATLTISGTQMDEADFYC | QAWDN--------- --------TIVV | FGGGT KLTVL |
| iPS.3 93182 | 21-225_4B3 | VL3|3r/JL2 | SYELTQP-PSVSVSPRQTVSI TC | SGD----KLGD-----KYAC | WYQQKPGQ SPVLVIY | Q------- DRKRPS | GIPERFSGSNSG-- NTATLTISGTQAMDEADYYC | QAWDN--------- --------NTVI | FGGGT KLTVL |
| iPS.3 93184 | 21-225_15H11 | VL3|3r/JL2 | SYELTQP-PSVSVSPGQTASI TC | SGD----KLGE-----KYAC | WYQQKPGQ SPVLVIY | Q------- DRKRPS | GIPERFSGSNSG-- NTATLTISGTQAIDEADYYC | QAWDS--------- --------STAV | FGGGT KLTVL |
| iPS.3 93186 | 21-225_27D9 | VL3|3r/JL2 | SYELTQP-PSMSVSPGQTASI TC | SGY----KLGD-----KYAC | WFQQKPGQ SPVLVIY | Q------- DSKRPS | GIPERFSGSNSG-- NTATLTISGTQAMDEADYYC | QAWV---------- --------NNTV | FGGGT KLTVL |
| iPS.3 93188 | 21-225_34B9 | VL3|3r/JL2 | SYELTQA-PSVSVSPGQTASI TC | SGD----KLGE-----KYVS | WYQQKPGQ SPVLVIY | Q------- DSKRPS | GIPERFSGSNSG-- NTATLTISGTQAMDEADYYC | QAWD---------- --------SSTV | FGGGT KLTVL |
| iPS.3 93192 | 21-225_12B1 | VL3|3r/JL2 | SYELTQP-PSVSVSPRQTVSI TC | SGD----KLGD-----KYAC | WYQQKPGQ SPVLVIY | Q------- DRKRPS | GIPERFSGSNSG-- NTATLTISGTQAMDEADYYC | QAWDN--------- --------NTVI | FGGGT KLTVL |
| iPS.3 93194 | 21-225_16D2 | VL3|3r/JL2 | SYELTQP-PSVSVSPGQTASI TC | SGD----KLGD-----KYAC | WYQQKPGQ SPVLVIY | Q------- DSKRPS | GIPERFSGSNSG-- NTATLTISGTQAMDEADYYC | QAWDS--------- --------STYVV | FGGGT KLTVL |
| iPS.3 93196 | 21-225_16G8 | VL3|3r/JL2 | SYELSQP-PSVSVSPGQTASI TC | SGD----KLGE-----KYAC | WYQQKPGQ SPVLVIY | Q------- DRKRPS | GIPERFSGSNSG-- NKATLTISGTQAMDEADYYC | QAWVN--------- --------NTMI | FGGGT KLTVL |
| iPS.3 93198 | 21-225_28A11 | VL3|3r/JL2 | SYELTQP-PSVSVSPGQTASI TC | SGD----KLGE-----KYAC | WYQQKPGQ SPVLVIY | Q------- DSKRPS | GIPERFSGSNSG-- NTATLTISGTQAMDEADYYC | QAWDS--------- --------STYVV | FGGGT KLTVL |
| iPS.3 93200 | 21-225_35E1 | VL3|3r/JL2 | SYELTQP-PSVSVSPGQTASI TC | SGD----KLGE-----KYAY | WFQQKPGQ SPVIVIY | Q------- DRKRPS | GIPERFSGSNSG-- NTATLTISGTQAMDEADYYC | QAWDN--------- --------STAV | FGGGT KLTVL |
| iPS.3 93202 | 21-225_6B4 | VL3|3r/JL2 | SYELTQP-PSVSVSPRQTVSI TC | SGD----KLGD-----KYAC | WYQQKPGQ SPVLVIY | Q------- DRKRPS | GIPERFSGSNSG-- NTATLTISGTQAMDEADYYC | QAWDN--------- --------NTVI | FGGGT KLTVL |
| iPS.3 93206 | 21-225_13F6 | VL3|3r/JL2 | SYELTQP-PSVSVSPGQTASI TC | SGD----KLGD-----KYAC | WYQQKPGQ SPVLVIY | Q------- DSKRPS | GIPERFSGSNSG-- NTATLTISGTQAMDEADYYC | QAWGN--------- --------STAVV | FGGGT KLTVL |
| iPS.3 93210 | 21-225_17D3 | VL3|3r/JL2 | SYELTQS-PSVSVSPGQTASI TC | SGD----KLGD-----KYVY | WYQQKPGQ SPVVVIY | Q------- DRKRPS | GIPERFSGSNSG-- NTATLTISGTQAMDEADYYC | QAWDS--------- --------ITAV | FGGGT KLTVR |
| iPS.3 93212 | 21-225_30H6 | VL3|3r/JL2 | SYELTQP-PSVSVSPGQTASI TC | SGD----KLGN-----KYAC | WYQQKPGQ SPVLVIY | Q------- DSKRPS | GIPERFSGSNSG-- NTATLTISGTQAMDEADYYC | QAWD---------- --------SSTV | FGGGT KLTVL |

FIGURE 51 (Continued)

| | | | | | | | | | |
|---|---|---|---|---|---|---|---|---|---|
| iPS:3 93214 | 21-225_33A1 | VL3|3r/JL2 | SYELTQP-PSVSVSPGQTASIIC | SGD---KLGD----KFVY | WYQQKPGQ SPVLVIY | Q------- DSKRPS | GIPERFSGSNSG---NTATLTISGTQAMDEADYYC | QAWDS-------TTVV | FGGGT KLTVL |
| iPS:3 93218 | 21-225_14G3 | VL3|3r/JL2 | SYELTQP-PSVSVSPGQTASIIC | SGD---KLGD----KYVC | WYQQKPGQ SPVLVIY | Q------- DRKRPS | GIPERFSGSNSG---NTATLTISGTQAMDEADYYC | QAWGN-------STAVV | FGGGT KLTVL |
| iPS:3 93222 | 21-225_17F5 | VL3|3r/JL2 | SYELTQP-PSVSVSPGQTASIIC | SGD---KLGE----KYAC | WYQQKPGQ SPVLVIY | Q------- DRKRPS | GIPERFSGSNSG---NTATLTISGTQAMDEADYYC | QAWD--------SSTV | FGGGT KLTVL |
| iPS:3 93224 | 21-225_31C2 | VL3|3r/JL2 | SYELTQP-PSVSVSPGQTASIIC | SGD---KLGN----KYAC | WYQQKPGQ SPVLVIY | Q------- DSKRPS | GIPERFSGSNSG---NTATLTISGTQAMDEADYYC | QAWD--------SSTV | FGGGT KLTVL |
| iPS:3 93226 | 21-225_33E6 | VL3|3r/JL2 | SYELTQP-PSVSVSPGQTASIIC | SGD---KLGD----KYAY | WFQQKPGQ SPVTVIY | Q------- DRKRPS | GIPERFSGSNSG---NTATLTISGTQAMDEADYYC | QAWDN-------STAV | FGGGT KLTVL |
| iPS:3 93234 | 21-225_26C10 | VL3|3r/JL2 | SYELTQP-PSMSVSPGQTASIIC | SGD---KLGD----KYVC | WFQQKPGQ SPVLVIY | Q------- DSKRPS | GIPERFSGSNSG---NTATLTISGTQAMDEADYYC | QAWV--------NNTV | FGGGT KLTVL |
| iPS:3 93345 | 21-225_5G7 | VL3|3r/JL2 | SYELTQP-PSVSVSPGQTASIIC | SGD---KLGN----KYAW | WYQQKPGQ SPVLVIY | Q------- DRKRPS | GIPERFSGSNSG---NTATLTISGTQAMDEADYYC | QAWDN-------STVV | FGGGT KLTVL |
| iPS:3 93565 | 21-225_34B11 | VL3|3r/JL2 | SYELTQP-PSVSVSPGQTASIIC | SGD---KLGD----KYAC | WYQQKPGQ SPVVVIY | Q------- DMKRPS | GIPERFSGSNSG---NTATLTISGTQAMDEADYYC | QAWV--------STAV | FGGGT KLTVL |
| iPS:3 93950 | 21-225_3H10 | VL3|3r/JL2 | SYELTQP-PSVSVSPGQTASIIC | SGD---KLGE----KYAC | WYQQKPGQ SPVLVIY | Q------- DRKRPS | GIPERYSGSNSG---NRAALTISGTQAMDEADYYC | QAWVN-------NTMI | FGGGT KLTVL |
| iPS:3 98470 | 21-225_14B7 | VL3|3r/JL2 | SYELTQP-PSVSVSPGRTASIIC | SGD---KLGN----KYAY | WYQQKPGQ SPVLVIY | Q------- DRKRPS | GIPERFSGSNSG---NTATLTISGTQTMDEADYYC | QAWNN-------STVV | FGGGT KLTVL |
| iPS:3 98472 | 21-225_16E4 | VL3|3r/JL2 | PYELTQP-PSVSVSPGQTASIIC | SGD---KLGD----KYVY | WYQQKSGQ SPVLVIY | Q------- DSKRPS | GIPERFSGSNSG---NTATLTISGTQAMDEADYYC | QAWDS-------STVV | FGGGT KLTVL |
| iPS:3 98488 | 21-225_19F6 | VL3|3r/JL2 | SYELTQP-PSVSVSPGQTVSIIC | SGD---KLGD----KYVV | WYQQKPGQ SPVLVIY | Q------- DSKRPS | GIPERFSGSNSG---NTATLTISGTQAMDEADYYC | QAWDN-------NTVV | FGGGT KLTVL |
| iPS:3 98490 | 21-225_21D12 | VL3|3r/JL2 | SYELTQP-PSVSVSPGQTASIIC | SGD---KLGN----KYAY | WYQQKPGQ SPVLVIY | Q------- DRKRPS | GIPERFSGSNSG---NTATLTISGTQAMDEADYYC | QAWDN-------STAV | FGGGT KLTVL |
| iPS:3 98498 | 21-225_22E6 | VL3|3r/JL2 | SYELTQP-PSVSVSPGQTASIIC | SGD---KLGE----KYAC | WYQQKPGQ SPVLVIY | Q------- DRKRPS | GIPERYSGSNTG---NTATLTISGTQAMDEADYYC | QAWDS-------STAV | FGGGT KLTVL |
| iPS:3 98504 | 21-225_23D7 | VL3|3r/JL2 | SYELTQP-PSVSVSPGQTASIIC | SGE---KLGD----KYVC | WYQQKPGQ SPVLVIY | Q------- DSKRPS | GIPERFSGSNSG---NTATLTISGTQAMDEADYYC | QAWNS-------SNVV | FGGGT KLTVL |
| iPS:3 98546 | 21-225_9H10 | VL3|3r/JL2 | SYELTQP-PSVSVSPGQTASIIC | SGD---KLGD----KYAC | WYQQKPGQ SPVLVIY | Q------- DSKRPS | GIPERFSGSNSG---NTATLTISGTQAMDEADYYC | QAWDS-------STYVV | FGGGT KLTVL |

FIGURE 51 (Continued)

| | | | L_FR1 | L_CDR1 | L_FR2 | L_CDR2 | L_FR3 | L_CDR3 | L_FR4 |
|---|---|---|---|---|---|---|---|---|---|
| iPS:4 02225 | 21-225_2B1 | VL3\|3r/JL2 | SYELTQP-PSVSVSPGQTVSITC | SGD----KLGD-----KYAC | WYQQKPGQ SPVLVIY | Q-------DRKRPS | GIPERFSGSNSG--NTAILTISGTQAMDEADYYC | QAWDN-----------NTVV | FGGGT KLTVL |
| iPS:4 02231 | 21-225_6D9 | VL3\|3r/JL2 | SYELTQP-PSVSVSPGQTASI TC | SGD----KLGE-----KYAC | WYQQKPGQ SPVLVIY | Q-------DKKRPS | GIPERFSGSNSG--NTAILTISGTQAMDEADYYC | QAWD------------SSTV | FGGGT KLTVL |
| iPS:4 04090 | 21-225_8D8 | VL3\|3r/JL2 | SYELTQP-PSVSVSPGQTASI TC | SGD----KLGE-----KYAC | WYQQKPGQ SPVVVIY | Q-------DKKRPS | GIPERFSGSNSG--NTAILTISGTQAIDEADYYC | QAWDS------------STAV | FGGGT KLTVL |
| iPS:4 23018 | 21-225_31D12_L C2 | VL3\|3r/JL2 | SYELTQP-PSVSVSPGQTASI TC | SGD----KLGD-----KYAY | WFQQKPGQ SPVIVIY | Q-------DKKRPS | GIPERFSGSNSG--NTAILTISGTQAMDEADYYC | QAWDN------------STAV | FGGGT KLTVL |
| | Germline | | L_FR1 | L_CDR1 | L_FR2 | L_CDR2 | L_FR3 | L_CDR3 | L_FR4 |
| | VL2\|2a2/JL3b | | QSALTQP-ASVSGSPGQSITI SC | TGTS-SDVGGY-----NYVS | WYQQHPGK APKLMIY | E-------VSNRPS | GVSNRFSGSKSG--NTASLTISGLQAEDEADYYC | SSYTS------------STWV | FGGGT KLTVL |
| iPS:4 68862 | 21-225_178H8 | VL2\|2a2/JL3b | QSALTQS-ASVSGSPGQSITI SC | TGTS-SDVGGY-----NFVS | WYQQHPGK VFKFMIY | E-------VSNRPS | GVPNRFSGGSKSG--NTASLTISGLQAEDEADYYC | SSYTS------------SYTWV | FGGGT KLTVL |
| iPS:4 36838 | 21-225_52H4 | VL2\|2a2/JL3b | QSALTQP-ASVSGSPGQSITI SC | TGTS-SDVGGY-----NYVS | WYQQHPGK APKLMIY | E-------VSNRPS | GVSNRFSGSKSG--NTASLTISGLQAEDEADYYC | NSYTS------------NITWV | FGGGT KLTVL |
| iPS:4 37094 | 21-225_210D12 | VL2\|2a2/JL3b | QSALTQP-ASVSGSPGQSITI SC | TGTS-SDVGGY-----NYVS | WYQQHPVK APKLLIY | E-------VSNRPS | GVSNRFSGSKSG--NTASLTISGLQAEDEADYYC | NSYTS------------SITWV | FGGGT KLTVL |
| iPS:4 37096 | 21-225_210E12 | VL2\|2a2/JL3b | QSALTQP-ASVSGSPGQSITI SC | TGTS-SDVGGY-----NYVS | WYQQHPGK APKLMIY | E-------VSNRPS | GVSNRFSGSKSG--NTASLTISGLQAEDEADYYC | GSYVK------------GITWV | FGGGT KLTVL |
| iPS:4 37098 | 21-225_211C1 | VL2\|2a2/JL3b | QSALTQP-ASVSGSPGQSITI SC | TGTS-SDVGSY-----NYVS | WYQQYPGK APKLMIY | E-------VSNRPS | GVSNRFSGSKSG--NTASLTISGLQAEDEADYYC | NSYTS------------SITWV | FGGGT KLTVL |
| iPS:4 37104 | 21-225_211G5 | VL2\|2a2/JL3b | QSALTQP-ASVSGSPGQSITI SC | TGTS-SDVGGY-----NYVS | WYQQHPGK APKLMIY | E-------VRNRPS | GVSNRFSGSKSG--NTASLTISGLQAEDEADYYC | NSYTR------------SITWV | FGGGT KLTVL |
| iPS:4 37112 | 21-225_212C2 | VL2\|2a2/JL3b | QSALTQP-ASVSGSPGQSITI SC | TGTS-SDVGGY-----NYVS | WYQQHPGK APKLMIY | E-------VSNRPS | GVSNRFSGSKSG--NTASLTISGLQAEDEADYYC | SSYTR------------SITWV | FGGGT SLTVL |
| iPS:4 37114 | 21-225_212A4 | VL2\|2a2/JL3b | QSALTQP-ASVSGSPGQSITI SC | TGTS-SDVGGY-----NYVS | WYQQHPGK APKLMIY | E-------VSNRPS | GVSNRFSGSKSG--NTASLTISGLQAEDEADYYC | GSYVK------------GITWV | FGGGT SLTVL |
| iPS:4 37116 | 21-225_212F6 | VL2\|2a2/JL3b | QSALTQP-ASVSGSPGQSITI SC | TGTS-SDVGGY-----NYVS | WYQQYPGK APKLMIY | E-------VSNRPS | GVSNRFSGSKSG--NTASLTISGLQAEDEADYYC | NSYTS------------SITWV | FGGGT KLTVL |
| iPS:4 37118 | 21-225_212G7 | VL2\|2a2/JL3b | QSALTQP-ASVSGSPGQSITI SC | TGTS-SDVGGY-----NYVS | WYQQHPGK TFKLMIY | E-------VSNRPS | GVSNRFSGSKSG--NTASLTISGLQAEDEADYYC | NSYTS------------SITWV | FGGGT KLTVL |

FIGURE 51 (Continued)

| | | L_FR1 | L_CDR1 | L_FR2 | L_CDR2 | L_FR3 | L_CDR3 | L_FR4 |
|---|---|---|---|---|---|---|---|---|
| iPS:4 37128 | 21-225_213G3 VL2|a2J L3b | LSALTQP-ASVSGSPGQSITI SC | TGTS-SDVGGY-----NYYS | WYQQHPGK APKLMIS | E-------VRNRPS | GVSNRFSGSKSG---NTASLTISGLQAEDEADYYC | NSYTR-------SITWV | FGGGT KLTVL |
| iPS:4 37130 | 21-225_213D5 VL2|a2J L3b | QSALTQP-ASVSGSPGQSITI SC | TGTS-SDVGGY-----NYYS | WYQQHPGK APKLVIY | E-------VRNRFS | GVSTRFSGSKSG---MKASLTISGLQAEDEADYYC | CSYTR-------RITWV | FGGGT KLTVL |
| iPS:4 37146 | 21-225_215D3 VL2|a2J L3b | QSALTQP-ASVSGSPGQSITI SC | TGTS-SDIGGY-----NYYS | WYQQHPGK APTLMIY | E-------VSNRPS | GVSNRFSGSKSG---NTASLTISGLQAEDEADYYC | NSYKR-------GSTWV | FGGGT KVIVL |
| iPS:4 37150 | 21-225_216A3 VL2|a2J L3b | QSALTQP-ASVSGSPGQSITI SC | TGTS-SDVGGY-----NYYS | WYQQHPGK APKLMIY | E-------VSNRPS | GVSNRFSGSKSG---NTASLTISGLEDEADYYC | NSYTS-------SITWV | FGGGT KLTVL |
| iPS:4 37162 | 21-225_217B2 VL2|a2J L3b | QSALTQP-ASVSGSPGQSITI SC | TGTS-SDVGGY-----NYYS | WYQQHPGK APKLLIY | E-------VSNRPS | GVYNRFSGSKSG---NTASLTISGLQAEDEADYYC | GSYVK-------GITWV | FGGGT SLIVL |
| iPS:4 37172 | 21-225_219A7 VL2|a2J L3b | QSALTQP-ASVSGSPGQSITI SC | TGTS-SDVGGY-----NYYS | WYQQHPGK APKLMIY | E-------VRNRFS | GVSNRFSGSKSG---NTASLTISGLQAEDEADYYC | CSYTR-------SITWV | FGGGT KLTVL |
| iPS:4 37182 | 21-225_221H2 VL2|a2J L3b | LSALTQP-ASVSGSPGQSITI SC | TGTS-SDVGGY-----NYYS | WYQQHPGK APKLMIS | E-------VRNRPS | GVSNRFSGSKSG---NTASLTISGLQAEDEADYYC | NSYTR-------SITWV | FGGGT KLTVL |
| iPS:4 37184 | 21-225_221G4 VL2|a2J L3b | QSALTQP-ASVSGSPGQSITI SC | TGTS-SDVGGY-----NYYS | WYQQHPGK APKLMIY | E-------VRNRPS | GVSNRFSGSKSG---NTASLTISGLQAEDEADYYC | NSYTR-------SITWV | FGGGT KLTVL |
| VL1|tcJL2 | Germline | | SGSS-SNIGS-NTVN | WYQQLPGT APKLLIY | S-------NNQRPS | GVPDRFSGSKSG---TSASLAISGLQSEDEADYYC | AAWDD-------LNGVV | |
| iPS:4 68864 | 21-225_60D6 VL1|tcJL2 | QSVLTQP-PSASGTPGQRVTI SC | SGSS-SNIGS-NTVN | WYQQLPGT APKLLIY | S-------SLNGP | GVPDRFSGSKSG---TSASLAISGLQSEDEADYYC | AAWDD-------SLNGP | VGGGT KLTVL |
| iPS:4 36660 | 21-225_146D8 VL1|tcJL2 | QSVLTQP-PSTSGTPGQRVTI SC | SGSS-SYIGS-NTVD | WYQQLPGT APKLLIY | S-------NNQRPS | GVPDRFSGSKSG---TSASLAISGLQSEDEADYYC | AAWDDS-------LNGVV | FGGGT KLTVL |
| iPS:4 36680 | 21-225_147H12 VL1|tcJL2 | QSVLTQP-PSASGTPGQRVTI SC | SGSS-SNIGS-----YAVN | WYQQLPGT APKLLIY | S-------NNHRFS | GVPDRFSGSKSG---TSASLAISGLQSEDEADYYC | EAWDDS-------LNGPV | FGGGT KLTVL |
| iPS:4 36682 | 21-225_146A8 VL1|tcJL2 | QSVLTQP-PSASGTPGQRVTI SC | SGSS-SNIGS-MSIN | WYQQLFRT APKLLIY | S-------NNQRPS | GVPDRFSGSKSG---TSASLAISGLQSEDEADYYC | AAWDDS-------LNGVV | FGGGT KLTVL |
| iPS:4 36684 | 21-225_146B6 VL1|tcJL2 | QSVLTQP-PSASGTPGQRVTI SC | SGSS-SNIGS-NAVN | WYQQLPGT APKLLIY | S-------NNQRPS | GVPDRFSGSKSG---TSASLAISGLQSEDEADYYC | AAWDDS-------LNGVV | FGGGT KLTVL |
| iPS:4 36696 | 21-225_149A1 VL1|tcJL2 | QSVLTQP-PSASGTPGQRVTI SC | SGSS-SNIGS-NAVN | WYQQLPGT APKLLIY | S-------NNQRPS | GVPDRFSGSKSG---TSASLAISGLQSEDEADYYC | AAWDDS-------LNGVV | FGGGT KLTVL |

FIGURE 51 (Continued)

| | | | L_FR1 | L_CDR1 | L_FR2 | L_CDR2 | L_FR3 | L_CDR3 | L_FR4 |
|---|---|---|---|---|---|---|---|---|---|
| iPS:4 36712 | 21-225_150F9 | VL1f1c/JL2 | QSVLTQP-PSASGTPGQRVTISC | SGSS-SNIGS-----NAVN | WYQQLPGT APKLLIY | S------NSGRPS | GVPDRFSGSKSG---TSASLAISGLQSEDEADYFC | AAWDDS--------LNGVV | FGGGT KLTVL |
| iPS:4 36750 | 21-225_154G12 | VL1f1c/JL2 | QSVLTQP-PSASGTPGQRVTISC | SGSS-SNIGN-----NAVS | WYQQLPGT APKLLIY | S------NDHRPS | GVPDRFSGSKSG---TSASLAISGLQSEDEADYYC | AAWDDS--------LKGPV | FGGGT KLTVL |
| iPS:4 36762 | 21-225_156H2 | VL1f1c/JL2 | QSVVTQP-PSASGTPGQRVTISC | SGSS-SNIGS-----NTVN | WYQQLPGT APKLLIY | S------SNQRPS | GVPDRLSGSKSG---TSASLAISGLQSEDEADYYC | AAWDDS--------LNGVV | FGGGT KVTVL |
| iPS:4 37044 | 21-225_197F9 | VL1f1c/JL2 | QSVLTQP-PSASGTPGQRVTISC | SGSS-SNIGS-----NTVN | WYQQLPGT APKLLIY | S------NNQRPS | GVPDRFSGSKSG---TSASLAISGLQSEDEADYYC | AAWDDS--------MNGFV | FGGGT KLTVL |
| iPS:3 37060 | 21-225_199C3 | VL1f1c/JL2 | QSVLTQP-PSASGTPGQRVTISC | SGSS-SNIGS-----NTVN | WYQQLPGT APKLLIY | S------NNQRPS | GVPDRFSGSKSG---TSASLAISGLQSEDEADYYC | AAWDDS--------LNGFV | FGGGT KLTVL |
| iPS:3 93180 | 21-225_4G12 | VL1f1c/JL2 | QSVLTQP-PSASGTPGQRVNM | SGTN-SNIGS-----YTVN | WYQQLPGT APKLLIY | I------NNQRPS | GVPDRFSGSKSG---TSASLAISGLQSEDEADYYC | AAWDDS--------LNGHVV | FGGRT KLTVL |
| iPS:3 93230 | 21-225_9G9 | VL1f1c/JL2 | QSVLTQP-PSASGTPGQRVNM | SGTN-SNIGS-----YTVN | WYQQLPGT APKLLIY | I------NNQRPS | GVPDRFSGSKSG---TSASLAISGLQSEDEADYYC | AAWDDS--------LNGHVV | FGGRT KLTVL |
| | Germline VL3p/JL2 | | | | | | | | |
| iPS:4 68866 | 21-225_190C1 | VL3p/JL2 | SYELTQP-PSVSPGQTARITC | TGD---AMPK-----KYAY | WDQQKSGQ AFVLVIS | E------DSKRPS | GIPERFSGSSSG---TMAPLTISGAQVEDETDYDC | NSTDS---------SSNRV | FGGGT KLTVL |
| iPS:4 37214 | 21-225_48B12 | VL3p/JL2 | SYELTQP-PSVSPGQTARITC | SGD---ALPK-----NYAY | WYQQKSGQ APVLVIY | E------DSKRPS | GIPERFSGSSSG---TMATLTISGAQVEDEADYYC | NSTDSS--------GNRVV | FGGGT KLTVL |
| | Germline VL1f1c/JL3b | | | | | | | | |
| iPS:4 36234 | 21-225_51E3 | VL1f1c/JL3b | QSVLTQP-PSASGTPGQRVTISC | SGSN-SNIGS-----NIVT | WYQQLPGT APKLLIY | S------NDQRPS | GVPDRFSGSKSG---TSASLAISGLQSEDEADYYC | TAWDDS--------LNGWV | FGGGT TLTVL |
| iPS:4 36830 | 21-225_51F4 | VL1f1c/JL3b | QSVLTQP-PSASGTPGQRVTISC | SGSS-SNIGS-----NIVT | WYQQLPGT APKLLIY | S------NDQRPS | GVPDRFSGSKSG---TSASLAISGLQSEDEADYYC | TAWDDS--------LNGWV | FGGGT TLTVL |
| iPS:4 36834 | 21-225_52F1 | VL1f1c/JL3b | QSVLTQP-PSASGTPGQRVTISC | SGSS-SNIGS-----NIVT | WYQQLPGT APKLLIY | S------NDQRPS | GVPDRFSGSKSG---TSASLAISGLQSEDEADYYC | AAWDDS--------LNGWV | FGGGT TLTVL |
| iPS:4 36842 | 21-225_54E9 | VL1f1c/JL3b | QSVLTQP-PSASGTPGQRVTISC | SGSN-SNIGN-----NIVT | WYQQLPGT APKLLIY | V------NDQRPS | GVPDRFSGSKSG---TSASLAISGLQSEDEADYYC | AAWDDS--------LNGWV | FGGGT TLTVL |

FIGURE 51 (Continued)

| | | L_FR1 | L_CDR1 | L_FR2 | L_CDR2 | L_FR3 | L_CDR3 | L_FR4 |
|---|---|---|---|---|---|---|---|---|
| iPS:4 36844 | 21-225_56G1 | VL1\|1c/JL3b | QSVLTQP-PSASGTPGQRVTISC | SGSS--SNIGS------HIVT | WYQQLPGTAPKLLIY | S-------NDQRPS | GVPDRFSGSKSG---TSASLAISGLQSEDEADYYC | AVWDDS--------------LIGWV | FGGGTTLTVL |
| iPS:4 36846 | 21-225_56E3 | VL1\|1c/JL3b | QSVLTQP-PSASGTPGQRVTISC | SGSS--SNIGS-------NIVT | WYQQLPGTAPKLLIY | S-------NNQRPS | GVPDRFSGSKSG---TSASLAISGLQSEDEADYYC | AAWDDS--------------LNGWV | FGGGTTLTVL |
| iPS:4 37010 | 21-225_192G3 | VL1\|1c/JL3b | QSVLTQP-PSASGTPGQRVIM SC | SGSS--SNIGS-------NTVN | WYQQFPGTAPKLLIY | G-------NKQRPS | RVPDRFSGSKSG---TSASLAISGLQSEDETDYYC | AAWDDS--------------LNGWV | FGGGTKLTVL |
| iPS:4 37032 | 21-225_195H6 | VL1\|1c/JL3b | QSVLTQP-PSASGTPGQRVTISC | SGSS--SNIGS-------HTVN | WYQQLPGTAPKLLIY | N-------NYQRPS | GVPDRFSGSKSG---TSASLTISGLQSEDEADYYC | ATWDDS--------------LSVWV | FGGGTKVTVL |
| iPS:4 51104 | 21-225_49C5 | VL1\|1c/JL3b | QSVLTQP-PSASGTPGQRVTISC | SGSS--SNIGS-------NIVT | WYQQLPGTAPKLLIY | S-------NDQRPS | GVPDRFSGSKSG---TSASLAISGLQSEDEADYYC | TAWDDS--------------LNGWV | FGGGTTLTVL |
| iPS:4 51106 | 21-225_49D10 | VL1\|1c/JL3b | QSVLTQP-PSASGTPGQRVTISC | SGSN--SNIGS-------NIVT | WYQQLPGTAPKLLIY | S-------NDQRPS | GVPDRFSGSKSG---TSASLAISGLQSEDEADYYC | AAWDDS--------------LNGWV | FGGGTTLTVL |
| iPS:4 51108 | 21-225_53E8 | VL1\|1c/JL3b | QSVLTQP-PSASGTPGQRVTISC | SGSC--SNIGS-------NIVT | WYQQLPGIAPKLLIY | S-------NDQRPS | GVPDRFSGSKSG---TSASLAISGLQSEDEADYYC | TAWDDS--------------LNDWV | FGGGTTLTVL |
| | VL3\|3r/JL1 | Germline | SYELTQP-PSVSVSPGQTASITC | SGD----KLGD-------KYAC | WYQQKPGQSPVLVIY | Q-------DSKRPS | GIPERFSGSNSG---NTATLTISGTQAMDEADYYC | QAWDS---------------STYV | FGTGTKVTVL |
| iPS:4 36662 | 21-225_147D7 | VL3\|3r/JL1 | SYELTQP-PSVSVSPGQTASITC | SGD----KLGD-------KFAC | WYQQKPGQSPVLVIY | Q-------DRKRPS | GIPERFSGSNSG---NTATLTISGTQAMDEADYYC | QAWDR---------------NTAV | FGTGTKVTVL |
| iPS:4 36720 | 21-225_151H6 | VL3\|3r/JL1 | SYELTQP-PSVSVSPGQTASITC | SGD----KLGD-------KYAC | WYQQKPGQSPVLVIY | Q-------DTKRPS | GIPERFSGSNSG---NTATLTISGTQAMDEADYYC | QAWDS---------------STYV | FGTGTKVTVL |
| iPS:4 36726 | 21-225_152G5 | VL3\|3r/JL1 | SYEMTQP-PSVSVSPGQTAII TC | SGD----KLGD-------KYAC | WYQQKPGQSPVLVIY | Q-------DSKRPS | GIPERFSGSNSG---NTATLTISGTQAMDEADYYC | QAWDS---------------STYV | FGTGTKVTVL |
| iPS:4 36732 | 21-225_152B12 | VL3\|3r/JL1 | SYELTQP-PSVSVSPGQTASITC | SGD----KLGN-------KYAC | WYQQKPGQSPVLVIY | Q-------DTKRPS | GIPERFSGSNSG---NTATLTISGTQAMDEADYYC | QAWDS---------------STYV | FGTGTKVTVL |
| iPS:4 36734 | 21-225_153A8 | VL3\|3r/JL1 | SYELTQP-PSVSVSPGQTASITC | SGD----KLGD-------KYAC | WYQQKPGQSPVLVIY | Q-------DTKRPS | GIPERFSGSNSG---NTATLTISGTQAMDEADYYC | QAWDS---------------STYV | FGTGTKVTVL |
| iPS:4 36754 | 21-225_155G3 | VL3\|3r/JL1 | SYELTQP-PSVSVSPGQTASITC | SGD----KLGD-------KYVC | WYQQKPGQSPMLVIY | Q-------DSKRPS | GIPERFSGSNSG---NTATLTISGTQAMDEADYYC | QAWDN---------------SIVV | FGTGTKVTVL |
| iPS:4 37190 | 21-225_225A9 | VL3\|3r/JL1 | SYELTQP-PSVSVSPGQTASITC | SGD----KLGN-------KYAC | WYQQKPGQSPVLVIY | Q-------DSKRPS | GIPERFSGSNSG---NTATLTISGTQAMDEADYYC | QAWDS---------------NTACV | FGTGTKVTVL |
| | | Germline | L_FR1 | L_CDR1 | L_FR2 | L_CDR2 | L_FR3 | L_CDR3 | L_FR4 |

FIGURE 51 (Continued)

| | | | L_FR1 | L_CDR1 | L_FR2 | L_CDR2 | L_FR3 | L_CDR3 | L_FR4 |
|---|---|---|---|---|---|---|---|---|---|
| VL5j5c/JL3b | | | | | | | | | |
| iPS:4 36702 | 21-225_149E8 | VL5j5c/JL3b | QAVSTQP-SSLSASFGASASL TC | TLRS------GITVTT-YRIY | WYQQKPGS PFQFLLR | YTS---DSDKHQGS | GVPDRFSGSKDASANAGLLF ISGLQSEDEADYYC | MIKHIS------SAWV | FGGGT KLTVL |
| | Germline | | | L_CDR1 | L_FR2 | L_CDR2 | L_FR3 | L_CDR3 | L_FR4 |
| VL1j1e/JL2 | | | | | | | | | |
| iPS:4 36752 | 21-225_155H1 | VL1j1e/JL2 | QSVLTQP-PSVSGAPGQRVTI SC | TGSS-----SNIGAG------YDVH | WYQQLPGT APKLLIY | G-------NSNRPS | GVPDRFSGSKSG---TSASLAITGLQAEDEADYYC | QSYDSS------LSGPVI | FGGGT KLTVL |
| iPS:4 36820 | 21-225_179D10 | VL1j1e/JL2 | QSVLTQP-PSVSGAPGQRVTI SC | TGSS-----SNFGTD------YDVH | WYQQLPGT APKLLIY | G-------HSNRPS | GVPDRFSGSKSG---TSASLAITGLQAEDEADYYC | QSYDR-------SLNVV | FGGGT KLTVL |
| iPS:4 37188 | 21-225_224B11 | VL1j1e/JL2 | QSVLTQP-PSVSGAPGQRVTI SC | TGSS-----SNIGAG------YDVH | WYQQLPGT APKLLIF | G-------NSNRPS | GVPDRFSGSKSG---TSASLAITGLQAEDEADYYC | QSYDN-------SLSGV | FGGGT KLTVL |
| iPS:4 37198 | 21-225_226F8 | VL1j1e/JL2 | QSVLTQP-PSVSGAPGQRVTI SC | TGSS-----SNIGAG------YDVH | WYQQLPGT APKLLIY | G-------NSNRPS | GVPDRFSGSKSD---TSASLAITGLQAEDEADYYC | QSYDN-------SLSGV | FGGGT KLTVL |
| iPS:4 37202 | 21-225_227D3 | VL1j1e/JL2 | QSVLTQP-PSVSGAPGQRVTI SC | TGSS-----SNIGAG------YDVH | WYQQLPGT APKLLIY | G-------NSNRPS | GVPDRFSGSKSD---TSASLAITGLQAEDEADYYC | QSYDN-------SLSGV | FGGGT KLTVL |
| iPS:4 37208 | 21-225_227C10 | VL1j1e/JL2 | QSVLTQP-PSVSGAPGQRVTI SC | TGSS-----SNIGAG------YDVH | WYQQLPGT APKLLIY | G-------NSNRPS | GVPDRFSGSKSD---TSASLAITGLQAEDEADYYC | QSYDN-------NLSGV | FGGGT KLTVL |
| iPS:4 43003 | 21-225_43F11_LC2 | VL1j1e/JL2 | QSVLTQP-PSVSGAPGQRVTI SC | TGSS-----SNIGAG------YDVH | WYQQLPGT APKLLIY | G-------NSNRPS | GVPDRFSGSKSG---TSASLAITGLQAEDEADYYC | QSYDNS------LSGSV | FGGGT KLTVL |
| | Germline | | | L_CDR1 | L_FR2 | L_CDR2 | L_FR3 | L_CDR3 | L_FR4 |
| VL6j6a/JL3b | | | | | | | | | |
| iPS:4 36792 | 21-225_169D12 | VL6j6a/JL3b | NPMLTQP-HSVSESPGKTVTI SC | TRSS-GSITG-----NYVQ | WHQQRPGN SPTTLIY | E-------DKKRPS | GVPDRFSGSIDSSNSASLT ISGLKTEDEADYYC | QSYYS------GNWV | FGGGT KLTVL |
| | Germline | | | L_CDR1 | L_FR2 | L_CDR2 | L_FR3 | L_CDR3 | L_FR4 |
| VL3j3i/JL2 | | | | | | | | | |
| iPS:4 36800 | 21-225_171D12 | VL3j3i/JL2 | SSELTQQ-PAVSVALGQTVRI TC | QGD----SLRS-----YYAS | WYQQKPGQ APILVIY | A-------KNNRPS | GIPDRFSGSNSG---NTASLIITGAQAEDEADYYC | NSRDSS------GSHVV | FGGGT KLTVL |
| iPS:4 36804 | 21-225_172C3 | VL3j3i/JL2 | SSELTQQ-PAVSVALGQTVRI TC | QGD----SLRN-----YYVS | WYQQKPGQ APILVIY | T-------KNSRPS | GIPDRFSGSTSG---NTASLIITGTQAEDEADYYC | NSRDSS------GNHVV | FGGGT KLTVL |

FIGURE 51 (Continued)

| | | L_FR1 | L_CDR1 | L_FR2 | L_CDR2 | L_FR3 | L_CDR3 | L_FR4 |
|---|---|---|---|---|---|---|---|---|
| iPS:4 36806 | 21-225_172B12 | VL3l3l/JL2 | SSELTQD-PAVSVALGQTVRITC | QGD---SLRN------YYAS | WYQQKPGQ APILVIY | T-------KNSRPS | GIPDRFSGTSG-NTASLTITGAQAEDEADYYC | NSRDSS------GNHVV | FGGGT KLTVL |
| iPS:4 36964 | 21-225_190B3 | VL3l3l/JL2 | SSELTQD-PAVSVALGQTVRITC | QGD---KLRT------YYAS | WYQQKPGQ APVLVVY | G-------KNNRPS | GIPDRFSGSSSG-NTASLTITGAQAEDEADYYC | NSRDSS------GNHLVL | FGGGT KLTVL |
| iPS:4 36970 | 21-225_190B8 | VL3l3l/JL2 | SSELTQD-PAVSVALGQTVRITC | QGD---TLRP------YYVS | WYQQKPGQ APVLVIY | G-------KNNRPS | GIPDRFSGSSSG-NTASLTITGAQAEDEADYYC | NSRDSS------GNHLVV | FGGGT KLTVL |
| iPS:4 36980 | 21-225_190C10 | VL3l3l/JL2 | SSELTQD-PAVSVALGQTVRITC | QGD---SLRP------YYAS | WYQQKPGQ APVLVIY | G-------KNNRPS | GIPDRFSGSSSG-NTASLTITTEAQAEDEADYYC | NSRDSS------GNHLVV | FGGGT KLTVL |
| iPS:4 36992 | 21-225_191B8 | VL3l3l/JL2 | SSELTQD-PAVSVALGQTVRITC | QGD---TLRP------YYAS | WYQQKPGQ APVLVIY | G-------KNMRPS | GISDRFSGSSSG-NTASLTITGAQAEDEADYYC | NSRDSS------GNHLVV | FGGGT KLTVL |
| iPS:4 36994 | 21-225_191A9 | VL3l3l/JL2 | SSELTQD-PAVSVALGQTVRITC | QGD---SLRP------YYAS | WYQQKPGQ APVLVIY | G-------KNNRPS | GIPDRFSGSSSG-NTASLTITTEAQAEDEADYYC | NSRDSC------GNHLVV | FGGGT KLTVL |
| iPS:4 37016 | 21-225_193A6 | VL3l3l/JL2 | SSELTQD-PAVSVALGQTVRITC | QGD---SLRS------YYAN | WYQQKPGQ APVLFIY | A-------KNNRPS | GIPDRFSGSNSG-NTASLTITGAQAEDEADYYC | NSRDSS------GNHLVV | FGGGT KLTVL |
| | Germline | | L_FR1 | L_CDR1 | L_FR2 | L_CDR2 | L_FR3 | L_CDR3 | L_FR4 |
| VL2l2b2/JL2 | | | | | | | | | |
| iPS:4 36810 | 21-225_175F4 | VL2l2b2/JL2 | QSALTQP-ASVSGSPGQSITISC | TGTS-SDVGRF-----NLVS | WYQQHPGY APKLMII | E-------VSKKRPS | GVSKRFSGSKSG-NTASLTIISGLQAEDEADYYC | CSYAGS------STYVV | FGGGT KLTVL |
| iPS:4 36814 | 21-225_178H10 | VL2l2b2/JL2 | QSALTQP-ASVSGSPGQSITISC | TGTS-SDVGRF-----NLVS | WYQQHPGM APKLMIY | E-------VSKRPS | GVSNRFSGSKSG-NTASLTISGLQAEDEADYYC | CSYAGS------STFVV | FGGGT KLTVL |
| | Germline | | L_FR1 | L_CDR1 | L_FR2 | L_CDR2 | L_FR3 | L_CDR3 | L_FR4 |
| VL3l3l/JL3b | | | | | | | | | |
| iPS:4 36816 | 21-225_179H5 | VL3l3l/JL3b | SSELTQD-PAVSVALGQTVRITC | QGD---SLRN------YYAS | WYQQKPGQ APVFVIY | G-------KNNRPS | GIPDRFSGGRSG-NTASLTITGAQAEDEADYYC | NSRDSS------GNHWV | FGGGT KLTVL |
| | Germline | | L_FR1 | L_CDR1 | L_FR2 | L_CDR2 | L_FR3 | L_CDR3 | L_FR4 |
| VL1l1e/JL1 | | | | | | | | | |
| iPS:4 36832 | 21-225_51D8 | VL1l1e/JL1 | QSVLTQP-PSVSGAPGQRVTISC | TGSS-SNIGAG-----FEVH | WYQQLPGT APKLLIY | G-------NSNRPS | GVEDRFSGSKSG-TSASLAITGLQAEDEADYYC | QSYDSS------LSGVV | FGTGT KVTVL |
| | Germline | | L_FR1 | L_CDR1 | L_FR2 | L_CDR2 | L_FR3 | L_CDR3 | L_FR4 |

FIGURE 51 (Continued)

| | | L_FR1 | L_CDR1 | L_FR2 | L_CDR2 | L_FR3 | L_CDR3 | L_FR4 |
|---|---|---|---|---|---|---|---|---|
| VL3j3rJL7 | | SYELTQP-PSVSVSPGQTASI | SGD---KLGD NYAC | WYQQKPGQ SPVLVTY | Q DTMRPS | GIPERFSGSNSG-NTATLTISGTQAMDEADYYC | QAWDS----------STAV | FGGGT QLTVL |
| iPS:4 36840 | 21-225_53E9 | VL3j3rJL7 | SYELTQP-PSVSVSPGQTASI TC | SGT---KLGD ----KYVC | WYQQKPGQ SPVLVIN | Q DTMRPS | GIPERFSGSNSG-NTATLTISGTQAMDEADYYC | QTWDS----------STAV | FGGGT TLTVL |
| iPS:4 36950 | 21-225_184G4 | VL3j3rJL7 | SYELTQP-PSVSVSPGQTASI TC | SGD---KLGD ----KFAC | WYQQKPGQ SPVLVTY | E DEKRPS | GIPERFSGSNSG-NTATLTISGTQAMDEADYYC | QAWDS----------RTVV | FGGGT QLTVL |
| | Germline | L_FR1 | L_CDR1 | L_FR2 | L_CDR2 | L_FR3 | L_CDR3 | L_FR4 |
| VL1j1bJL2 | | QSVLTQP-PSVSAAPGQKVTI SC | SGSS-SNIGN-----NYVS | WYQQLPGT APKLLIY | D NNKRPS | GIPDRFSGSKSG-TSATLGITGLQTGDEADYYC | GTWDSS--------LSAGV | FGGGT KLTVL |
| iPS:4 36856 | 21-225_58C5 | VL1j1bJL2 | QSVLTQP-PSVSAAPGQKVTI SC | SGSS-SNIGN-----NYVS | WYQQLPGT APKLLIY | D NNKRPS | GIPDRFSGSKSG-TSATLGITGLQTGDEADYYC | GTWDIS--------LSVGV | FGGGT KLTVL |
| iPS:4 36960 | 21-225_198D2 | VL1j1bJL2 | QSVLTQP-PSVSAAPGQKVTI SC | SGSS-SNIGS-----NYVS | WYQQLPGT APKLLIY | D NNKRPS | GIPDRFSGSKSG-TSATLGITGLQTGDEADYYC | GTWDSR--------LNVGV | FGGGT KLTVL |
| iPS:4 36966 | 21-225_190C3 | VL1j1bJL2 | QSVLTQP-PSVSAAPGQKVTI SC | SGSS-SNIGN-----NYVS | WYQQLPGT APKLLIY | D SNKRPS | GIFGRPSGSKSG-TSATLGITGLQTGDEADYYC | GTWDSS--------LSTVV | FGGGT KLTVL |
| iPS:4 36968 | 21-225_190B10 | VL1j1bJL2 | QSVLTQP-PSVSAAPGQKVTI SC | SGSS-SNIGN-----NYVS | WYQHLPGT APKLLIY | D NNKRPS | GIPDRFSGSKSG-TSATLGITGLQTGDEADYYC | GTWDSS--------LSAGV | FGGGT KLTVL |
| iPS:4 36974 | 21-225_190H7 | VL1j1bJL2 | QSVLTQP-PSVSAAPGQKVTI SC | SGSS-SNIGS-----NYVS | WYQQLPGT APKLLIY | D NNKRPS | GIPDRFSGSKSG-TSATLGITGLQTGDEADYYC | GTWDGR--------LNVGV | FGGGT KLTVL |
| iPS:4 36976 | 21-225_190D8 | VL1j1bJL2 | QSVLTQP-PSVSAAPGQKVTI SC | SGSS-SNIGS-----HYVS | WYQQLPGT APKLLIY | D SSKRPS | EIPDRFSGSKSG-TSATLGITGLQTGDEADYYC | GTWDSS--------LSTVV | FGGGT KLTVL |
| iPS:4 36982 | 21-225_190D10 | VL1j1bJL2 | QSVLTQP-PSVSAAPGQKVTI SC | SGSS-SNIGS-----NYVS | WYQQLPGT VPKVLIY | D NNKRPS | GIPDRFSGSKSG-TSATLGITGLQTGDEADYYC | GTWDSR--------LNVGV | FGGGT KLTVL |
| iPS:4 36986 | 21-225_191A1 | VL1j1bJL2 | QSVLTQP-PSVSAAPGQKVTI SC | SGSS-SNLGN-----NFVS | WYQQFPGT APKLLIY | D NYKRPS | GIPDRFSGSVSKSG-TSATLGITGLQTGDEADYYC | GTWDSS--------LNTGV | FGGGT KLTVL |
| iPS:4 37006 | 21-225_192G2 | VL1j1bJL2 | QSVLTQP-PSVSAAPGQKVTI SC | SGSS-SNIGN-----NYVS | WYQQLPGT APKLLIY | D NNKRPS | RIPDRFSGSKSG-TSATLGITGLQTGDEADYYC | GTWDSS--------LSAGV | FGGGT KLTVL |
| iPS:4 37024 | 21-225_194F11 | VL1j1bJL2 | QSVLTQP-PSVSAAPGQKVTI SC | SGSS-SNIGN-----NYVS | WYQQLPGT APKLLIY | D NNKRPS | GIPDRFSGSKSG-TSATLGITGLQTGDEADYYC | GTWDSS--------LSAGV | FGGGT KLTVL |
| iPS:4 37028 | 21-225_194G12 | VL1j1bJL2 | QSVLTQP-PSVSAAPGQKVTI SC | SGSS-SNIGN-----NYVS | WYQQLPGT APKLLIY | D NNKRPS | RIPDRFSGSKSG-TSATLGITGEEADYYC | GTWDSS--------LSVGV | FGGGT KLTVL |

FIGURE 51 (Continued)

| | | L_FR1 | L_CDR1 | L_FR2 | L_CDR2 | L_FR3 | L_CDR3 | L_FR4 |
|---|---|---|---|---|---|---|---|---|
| iPS.4 37042 | 21-225_197E8 | VL1j1b/JL2 | QSVLTQP-PSVSAAPGQKVTISC | SGSS-SNIGN-----KYVS | WYQQFPGT APKLLIY | D-------NNKRPS | KIPDRFSGSKSG---TSATLGITGLMTGDEADYYC | GIWDRS------LSVMV | FGGGT KLTVL |
| iPS.4 37064 | 21-225_200G8 | VL1j1b/JL2 | QSVLTQP-PSVSAAPGQRVTISC | SGSS-SNLGN-----NFVS | WYQQFPGT APKLLIY | D-------NYKRPS | GIPDRFSVSKSG---TSATLGITGLQTGDEADYYC | GTWDSS------LNTGV | FGGGT KLTVL |
| iPS.4 37086 | 21-225_209A8 | VL1j1b/JL2 | QSVLTQP-PSVSAAPGQKVTISC | SGSS-SNIGS-----NFLS | WYQQLPGT APKLLIY | D-------NNKRPS | GIPDRFSGSKSG---TSATLGITGLQTGDEADYYC | GTWDSS------LSAGV | FGGGT KLTVL |
| iPS.4 37138 | 21-225_214D8 | VL1j1b/JL2 | QSVLTQP-PSVSAAPGQKVTISC | SGSS-SNIGN-----NYVS | WYQQFPGT APKLLIH | D-------NNKRPS | GIPDRFSGSKSG---TSATLGITGLQTGDEADYYC | GAWDSS------LSAVV | IGGGS KLTVL |
| iPS.4 37168 | 21-225_218G4 | VL1j1b/JL2 | QSVLTQP-PSVSAAPGQKVTISC | SGSS-SNIGN-----NYVS | WYQQLPGT APKLLIY | D-------SNKRPS | GIPARFSGSKSG---TSATLGITGLQTGDEADYYC | GTWDSS------LMTVV | FGGGT KLTVL |
| | Germline | | | L_CDR1 | L_FR2 | L_CDR2 | L_FR3 | L_CDR3 | L_FR4 |
| VL6j6a/JL3 | | | | | | | | | |
| iPS.4 36888 | 21-225_63G7 | VL6j6a/JL2 | NFMLTQP-HSVSESPGKTVTISC | TRSN-GSIVS-----NYVQ | WYQQRPGS SPTTMIY | E-------DSRRPS | GVPDRFSGSIDSSSNSASLT ISGLKTEDEADYSC | QSYDG------INVV | FGGGT KLTVL |
| iPS.4 36890 | 21-225_63A10 | VL6j6a/JL2 | NFMLTQP-HSVSESPGKTVTISC | TRSN-GSIVS-----NYVQ | WYQQRPGS SPTTVIY | E-------DNRRPS | GVPDRFSGSIDSSSNSASLT ISGLKTEDEADYYC | QSYDS------INVV | FGGGT KLTVL |
| | Germline | | | L_CDR1 | L_FR2 | L_CDR2 | L_FR3 | L_CDR3 | L_FR4 |
| VL8j8a/JL3b | | | | | | | | | |
| iPS.4 36910 | 21-225_73G1 | VL8j8a/JL3b | QTVVTQE-PSFSVSPGGTVTLTC | GLSS----GSVSTS-YYPS | WYQQTPGQ APRTLIY | N-------TNTRSS | GVPDRFSGSILG---NKAALTITGAQADDESDYYC | VLYMG------SAIWV | FGGGT KLTVL |
| iPS.4 36948 | 21-225_183F5 | VL8j8a/JL3b | QTVVTQE-PSFSVSPGGTVTLTC | GLSS----GSVSTT-FYPS | WYQQTPGQ APRTLIY | N-------TNTRSS | GVPDRFSGSILG---NKAALTITGAQADDESDYYC | VLYMG------SGIWV | FGGGT KLTVL |
| | Germline | | | L_CDR1 | L_FR2 | L_CDR2 | L_FR3 | L_CDR3 | L_FR4 |
| VL7j7a/JL2 | | | | | | | | | |
| iPS.4 36920 | 21-225_74E5 | VL7j7a/JL2 | QTVVTQE-PSLTVSPGGTVTLTC | ASST----ETVTSG-SYPN | WFQQKPGS APRALIY | S-------TSNKHS | WTPARFSGSLLG---GKAALTLSDVQPEDEAEYYC | LLIYG------GAQLV | FGGGT RLTVL |
| iPS.4 36926 | 21-225_78D10 | VL7j7a/JL2 | QTVVTQE-PSLTVSPGGTVTLTC | ASST----GAVTSG-YFPN | WFQQKPGS APRALIY | S-------TGNKHS | WTPARFSGSLLG---GKAALTLSGVQPEDEAEYYC | LLIYG------GAQLM | FGGGT KLTVL |
| iPS.4 36958 | 21-225_190D1 | VL7j7a/JL2 | QTVVTQE-PSLTVSPGGTVTLTC | ASST----GAVTSG-SYPN | WFQQKPGQ APRALIY | S-------TSNKHS | WTPARFSGSLLG---GKAALTLSGVQPEDEADYYC | LLYYG------GAQVA | FGGGT KLTVL |

FIGURE 51 (Continued)

| | | | | | | | |
|---|---|---|---|---|---|---|---|
| iPS:4 36984 | 21-225_190F10 | VL7/7a/3L2 | QTVVTQE-PSLTVSPGGTVTLTC | VFST-GAVTSG-SFPN | WFQQKPGQAPRALIY | S-------TSNKHS | WTPARFSGSLLG-GKAALTLSGVQPEDEADYYC | LLYCG--------GAQLV | FGGGT KLTVL |
| iPS:4 36988 | 21-225_191A2 | VL7/7a/3L2 | QTVVTQE-PSLTVSPGGTVTLTC | VLST-GAVTSG-SFPN | WFQQKPGQAPRALIY | S-------TSNKHS | WTPARFSGSLLG-GKPAALTLSGVQPEDEAEYYC | MLYCG--------GAQLV | FGGGT KLTVL |
| iPS:4 37002 | 21-225_191H9 | VL7/7a/3L2 | QTVVTQE-PSLTVSPGGTVTLTC | ASST-GAVTSA-YYPN | WLQQKPGQAPRTLIY | S-------TNNKHS | WTPARFSGSLLG-GKAALTLSDVQPEDEAEYYC | LIFYG--------GVHVI | FGGGT KLTVL |
| iPS:4 37008 | 21-225_192E3 | VL7/7a/3L2 | QTVVTQE-PSLTVSPGGTVTLTC | AFST-GSVTSG-SYPN | WFQQKPGQAPRALIY | S-------TNNKHS | WTPARFSGSLLG-GKAALTLSGVQREDEAEYYC | LLYYG--------GAQLV | FGGGT KLTVL |
| iPS:4 37012 | 21-225_192G7 | VL7/7a/3L2 | QTVVTQE-PSLTVSPGGTVTLTC | ASST-GAVTSG-NYPQ | WFQQKPGQAPRALIY | S-------TNNRHS | WTPARFSGSLLG-GKAALTLSGVQPEDEAEYYC | LFYYG--------GAQVI | FGGGT KLTVL |
| iPS:4 37014 | 21-225_192H8 | VL7/7a/3L2 | QTVVTQE-PSLTVSPGGTVTLTC | AFST-GTVTSG-FYPN | WFQQKPGQAPRALIY | N-------TSNKHS | WTPARFSGSLLG-GMAALTLSDVQPEDEAEYYC | LLYYG--------GAQLM | FGGGT KLTVL |
| iPS:4 37022 | 21-225_194G5 | VL7/7a/3L2 | QTVVTQE-PSLTVSPGGTVTLTC | ASST-GAVTSG-NYPN | WFQQKPGQTPRALIY | S-------TSNKHS | WTPARFSGSLLG-GKAALTLSGVQPEDEAEYYC | LIYYG--------GAQLM | FGGGT KLTVL |
| iPS:4 37026 | 21-225_194D12 | VL7/7a/3L2 | QTVVTQE-PSLTVSPGGTVTLTC | ASST-GAVTSG-SFPS | WFQQKPGQAPRALIY | S-------TSNRHS | STPARFSGSLLG-GKAALTLSGVQPEDEAEYYC | LIYYG--------GAQLA | FGGGT KLTVL |
| iPS:4 37040 | 21-225_196E7 | VL7/7a/3L2 | QTVVTQE-PSLTVSPGGTVTLTC | ASST-GAVTSA-YYPN | WLQQKPGQAPRTLIY | S-------TNNKHS | WTPARFSGSLLG-GKAALTLSDVQPEDEAEYYC | LIFYG--------GVHVI | FGGGT KLTVL |
| iPS:4 37048 | 21-225_197B11 | VL7/7a/3L2 | QTVVTQE-PSLTVSPGGTVTLTC | AFST-GSVTSG-SYPN | WFQQKPGQAPRALIY | S-------TNNKHS | WTPARFSGSLLG-GKAALTLSGVQPEDEAEYYC | LLYYG--------GAQLV | FGGGT KLTVL |
| iPS:4 37050 | 21-225_197C11 | VL7/7a/3L2 | QTVVTQE-PSLTVSPGGTVTLTC | ASST-GAVTSA-SYPN | WLQQKPGQAPRTLIY | S-------TNNKHS | WTPARFSGSLLG-GKAALTLSDVQPEDEAEYYC | LIFYG--------GVHVI | FGGGT KLTVL |
| iPS:4 37056 | 21-225_198B8 | VL7/7a/3L2 | QTVVTQE-PSLTVSPGGTVTLTC | VLST-GAVTSG-SFPN | WFQQKPGQAPRALIY | S-------TSNKHS | WTPARFSGSLLG-GKAALTLSGVQPEDEADYYF | MLYCG--------GAQMV | FGGGT KLTVL |
| iPS:4 37062 | 21-225_200H1 | VL7/7a/3L2 | QTVVTQE-PSLTVSPGGTVTLTC | ASNT-GAVTSG-SFPN | WFQQKPGQAPRALIY | H-------TNNKHS | WTPARFSGSLLG-GKAALTLSGVQPEDEAEYYC | LIYYG--------GAQLV | FGGGT KLTVL |
| iPS:4 37066 | 21-225_200G9 | VL7/7a/3L2 | QTVVTQE-PSLTVSPGGTVTLTC | ASNT-GAVTSA-SYPN | WLQQKPGQAPRTLIY | S-------TNNKHS | WTPARFSGSLLG-GKAALTLSGQPEDEAEYYC | LIYYG--------GVHVI | FGGGT KLTVL |
| iPS:4 37068 | 21-225_200A11 | VL7/7a/3L2 | QTVVTQE-PSLTVSPGGTVTLTC | ASST-GAVTSG-YYPN | WFQQKPGQVPRALIY | S-------TNNKHS | WTPARFSGSLLG-GKAALTLSGAQPEDEADYYC | LLYYG--------GAHLA | FGGGT KLTVL |
| iPS:4 37090 | 21-225_210F11 | VL7/7a/3L2 | QTVVTQE-PSLTVSPGGTVTLTC | AFST-GAVTSG-NYPN | WFQQKPGQAPRALIY | S-------TSNKHS | WTPARFSGSLLG-GKAALTLSGVQPEDEAEYYC | LLYYG--------GAQLV | FGGGT KLTVL |

FIGURE 51 (Continued)

| | | L_FR1 | L_CDR1 | L_FR2 | L_CDR2 | L_FR3 | L_CDR3 | L_FR4 |
|---|---|---|---|---|---|---|---|---|
| iPS:4 37106 | 21-225_211H7 | VL7l7a/JL2 | QTVVTQE-PSLTVSPGGTVTLTC | AFSI-GAVTSG-----NYPS | WFQQKPGQVPRALIY | S------TSNRHS | WTPARFSGSLLG--GKAALTLSGVQPEDEAEYYC | LLIYG-------GAQLV | FGGGT KLTVL |
| iPS:4 37108 | 21-225_211C9 | VL7l7a/JL2 | QTVVTQE-PSLTVSPGGTVTLTC | GSST-GSVTSG-----YFPN | WFQQKPGQAPRALIY | S------TNNKHS | WTPARFSGSLLG--GKAALTLSDVQPEDEADYYC | LLYYG-------GAQLA | FGGGT KLTVL |
| iPS:4 37110 | 21-225_211E9 | VL7l7a/JL2 | QTVVTQE-PSLTVSPGGTVTLTC | ASST-GAVTSG-----NYPS | WFQQKPGQAPRALIY | S------TINKHS | GTPARFGFLLG--GKAALTLSGVQPEDEAEYYC | LLYYG-------GAQLA | FGGGT KLTVL |
| iPS:4 37120 | 21-225_212A9 | VL7l7a/JL2 | QTVVTQE-PSLTVSPGGTVTLTC | ASST-GAVTSG-----YYPN | WFQQKPGQAPRALIY | S------TNNKHS | WTPARFSGSLLG--GKAALTLSGVQPDDEADYYC | LLYYG-------GAQVG | FGGGT KLTVL |
| iPS:4 37124 | 21-225_212H12 | VL7l7a/JL2 | QTVVTQE-PSLTVSPGGTVTLTC | ASST-GAVTSG-----YYPN | WFQQKPGQAPRALIY | S------TSNKHS | WTPARFSGSLLG--GKAALTLSGVQPEDEAEYYC | LLYYG-------GAHVV | FGGGT KLTVL |
| iPS:4 37132 | 21-225_213F5 | VL7l7a/JL2 | QTVVTQE-PSLTVSPGGTVTLTC | GSST-GSVTSG-----YFPN | WFQQKPGQTPRPLIY | S------TNNKHS | WTPARFSGSLLG--GKTALTLSDVQPEDEADYYC | LLYFG-------GAQLA | FGGGT KLTVL |
| iPS:4 37136 | 21-225_214H3 | VL7l7a/JL2 | QTVVTQE-PSLTVSPGGTVTLTC | ASST-GAVTSG-----YYPN | WFQQKPGQAPRALIY | S------TSNKHS | CTPARFSGSLLG--GKAALTLSGVQPEDEADYYC | LLYYG-------GAHVV | FGGGT KLTVL |
| iPS:4 37140 | 21-225_214E12 | VL7l7a/JL2 | QTVVTQE-PSLTVSPGGTVTLTC | ASST-GAVTSG-----YYPN | WFQQKPGQAPRALIY | S------TNNKHS | WTPARFSGSLLG--GKAALTLSGVQPEDEAEYYC | LLYCD-------GAQLV | FGGGT KLTVL |
| iPS:4 37142 | 21-225_215A3 | VL7l7a/JL2 | QTVVTQE-PSLTVSPGGTVTLTC | ASST-EAVTSG-----NYPS | WFQQKPGQAPRALIY | S------TNNKHS | GTPARFSGSLLG--GKAALTLSGVQPEDEAEYYC | LLYYG-------GAQLA | FGGGT KLAVL |
| iPS:4 37148 | 21-225_215H3 | VL7l7a/JL2 | QTVVTQE-PSLTVSPGGTVTLTC | ASST-GAVTSG-----YYPN | WFQQKPGQAPRALIY | S------TNNKHS | CGFARFSGSLLG--GKAALTLSGVQPEDEADYYC | LLYYG-------GAQVG | FGGGT KLTVL |
| iPS:4 37154 | 21-225_216A7 | VL7l7a/JL2 | QTVVTQE-PSLTVSPGGTVTLTC | ASST-GAVTSG-----YYPN | WFQQFPGQAPRALIY | S------TNNKHS | CTPARFSGSLLG--GKAALTLSGVQPDDEADYYC | LLYYG-------GAQVG | FGGGT KLTVL |
| iPS:4 37158 | 21-225_216H11 | VL7l7a/JL2 | QTVVTQE-PSLTVSPGGTVTLTC | ASST-GAVTSG-----YYPN | WFQQKPGQAPRALIY | S------TSNKHS | WTPARFSGSLLG--GKAALTLSDVQPEDEADYYC | LLYCD-------GAQLV | FGGGT KLTVL |
| | Germline | | | | | | | | |
| VL1l1b/JL3b | | | | | | | | | |
| iPS:4 36972 | 21-225_190C7 | VL1l1b/JL3b | QSVLTQP-PSVSAAPGQKVTISC | SGGS-SNIGN-----NYVS | WFQQFPGTAPRLIY | D------NNKRPS | GIPDRFSGSKSG--TSATLGITGLQTGDEADYYC | GTWDRT------LSDWV | FGGGI KLTVL |
| iPS:4 37020 | 21-225_193F11 | VL1l1b/JL3b | QYVLTQP-PSVSAAPGQKVTISC | FGGS-SNIGN-----NYVS | WFQQFPGTAPKFLIY | D------NNKRPS | GILDRLSGSKSG--TSATLDITGLQNGDEADYYC | GTWDRT------MSDWV | FGGGT KLTVL |

FIGURE 51 (Continued)

| | | | L_FR1 | L_CDR1 | L_FR2 | L_CDR2 | L_FR3 | L_CDR3 | L_FR4 |
|---|---|---|---|---|---|---|---|---|---|
| iPS:4 37036 | 21-225_195H9 | VL1|1b/JL 3b | QSVLTQP-PSVSAAPGQKVTISC | SGGS-SNIGN-----NYVS | WYQQFPGT APKFLIY | D------NNKRPS | GILDRFSGSKSG-TSAILGITGLQTGDEADYYC | GTWDET------MSDWV | FGGGT KLTVL |
| | Germline | | QSVLTQP ASVSAAPGASASC | SGSS SNIGN NYS | WYQQLPGT APKLLIY | D NNKRPS | GIPDRFSGSKSG TSATLGITGLQTGDEADYYC | GTWDSS STAVV | FGTGT KLTVL |
| | | | L_FR1 | L_CDR1 | L_FR2 | L_CDR2 | L_FR3 | L_CDR3 | L_FR4 |
| iPS:4 36996 | 21-225_191B9 | VL1|1b/JL 1 | QSVLTQP-PSVSAAPGQKVTISC | SGSS-SNIGN-----NYVS | WYQQLPGT APKLLIY | D------NKKRPS | GIPDRFSGSKSG-TSATLGITGLQTGDEADYYC | GTWDSS-------LSVCV | FGTGT KVTVL |
| iPS:4 37054 | 21-225_194G3 | VL1|1b/JL 1 | QSVLTQP-PSVSAAPGQKVTISC | SGSS-SNIGN-----NYIS | WYQQLPGT APKLLIY | D------NKKRPS | GIPDRFSGSKSG-TSATLGITGLQTGDEADYYC | GTWDSS-------LSVCV | FGTGT KVTVL |
| iPS:4 37058 | 21-225_199F3 | VL1|1b/JL 1 | QSVLTQP-PSVSAAPGQKVTISC | SGSS-SNIGN-----NYVS | WYQQLPGT APKLLIY | D------NKKRPS | GIPDRFSGSKSG-TSATLGITGLQTGDEADYYC | GTWDSS-------LSACV | FGTGT KVTVL |
| | Germline | | QSVLTQP ASVSASPGASASC | TRSS TGAVT | WYQQKPGS PPRLLIR | KNS DSKKQGS | GVPSRFSGSKSGNAGNL TSGLQSEDEADYYC | MIWHS SAVV | FGGGT KLTVL |
| | | | L_FR1 | L_CDR1 | L_FR2 | L_CDR2 | L_FR3 | L_CDR3 | L_FR4 |
| iPS:4 37000 | 21-225_191G9 | VL5|5c/JL 2 | QAVSTRP-SSLSASPGASASLTC | TLRS----------GINGT-YRIY | WYQQKPGS PPQYLLR | YKS-DSDKQGGS | GVPSRFSGSKDASANAGILL ISGLQSEDEADYYC | MIWHS-------SAVV | FGGGT KLTVL |
| | Germline | | SYELTQP LSVSVALGQTARI | GGN NIGS KNVH | WYQQKPGQ APVLVIY | R DSNRPS | GIPERFSGSNSG NTATLISRAQAGDEADYYC | QVWDS STAVV | FGGGT KLTVL |
| | | | L_FR1 | L_CDR1 | L_FR2 | L_CDR2 | L_FR3 | L_CDR3 | L_FR4 |
| iPS:4 37074 | 21-225_203B2 | VL3|3j/JL 2 | SYELTQP-LSVSVALGQTARITC | GGN----NIGR-----KNVH | WYQQKPGQ SPVLIIH | R------DSDRPS | GIPERFSGSNSG-NTATLTISRAQAGEDEADYYC | QVWDS-------GTAV | FGGGT KLPVL |
| iPS:4 37082 | 21-225_205E12 | VL3|3j/JL 2 | SYELTQP-LSVSAALGQTARITC | GGN----NIGK-----KNVH | WYQQKPGQ SPVLIIH | R------DSDRPS | GIPERFSGSNSG-NTATLTISRAQAGEADYYC | QVWDS-------GTAV | FGGGT KLPVL |
| iPS:4 37084 | 21-225_206B5 | VL3|3j/JL 2 | SYELTQP-LSVSVALGQTARITC | GGN----NIGR-----KNVH | WYQQKPGL APVPVIK | R------DSYRSS | GIPERFSGSNCG-NTTTVTISRAQAGEFAEYYC | QDWDS-------STVV | FGGGT KLTVL |
| iPS:4 37088 | 21-225_209H10 | VL3|3j/JL 2 | SYELTQP-LSVSVALGQTARIAC | GGN----NIGR-----KNVH | WYQQKPGL AFVPVIL | R------DSIRSS | GIPDRFSGSNWG-NTATVTISRAQAGELAEYYC | QDWDS-------STVV | FGGGT KLTVL |
| iPS:4 37100 | 21-225_211H2 | VL3|3j/JL 2 | SYELTQP-LSVSVALGQTARITC | GGN----NIGR-----RNVH | WYQQKPGQ APILVIY | R------DRDRPS | GIPERFSGSKSG-NTATLTISRAQAGDEADYYC | QVWDS-------STAV | FGGGT KLTVL |
| iPS:4 37160 | 21-225_216B12 | VL3|3j/JL 2 | SYELTQP-LSVSVALGQTARITC | GGD----NIRR-----RNVH | WYQQKPGQ APVLVIY | R------DSNRPS | GIPERFSGSNSG-NTATLTISRAQGDEADYYC | QVWDS-------STGV | FGGGT KLTVL |
| iPS:3 92593 | 21-225_3E10 | VL3|3j/JL 2 | SYELTQP-HSVSVATAQMARITC | GGN----NIGS-----KAVH | WYQQKPGQ DPVLVIY | S------DSNRPS | GIPERFSGSNPG-NTATLIISRLEAGDEADYYC | QVWDS-------SDHVV | FGGGT KLTVL |

FIGURE 51 (Continued)

| | | | L_FR1 | L_CDR1 | L_FR2 | L_CDR2 | L_FR3 | L_CDR3 | L_FR4 |
|---|---|---|---|---|---|---|---|---|---|
| iPS:3 93204 | 21-225_8C12 | VL3j3j/JL2 | SYELTQP-PSVSVATAQMARITC | GGN----NIGS-----KAVH | WYQQKPGQ DPVLVIY | S-------DSNRPS | GIPERFSGSNPG--NTATLTISRIEAGDEADYYC | QVWDSS--------SDKVV | FGGGT KLTVL |
| | VL2j2a2/JL2 | Germline | QSALTQP-ASVSGSPGQSITISC | TGTSSDVGGYNYVS | WYQQHPGK APKLMIY | E-------VSNRPS | GVSNRFSGSKSG--NTASLTISGLQAEDEADYYC | SSYTS--------SSTYV | FGGGT KLTVL |
| iPS:4 37092 | 21-225_210B12 | VL2j2a2/J L2 | QSALTQP-ASVSGSPGQSITISC | TGTS-SDVGGY----NYYS | WYQQHPGK APKFMIY | E-------VRNRPS | GVSNRFSGSKSG--NTASLTISGLQAEDEADYYC | SSYTS--------SRTLV | FGGGT KLTVL |
| iPS:4 37134 | 21-225_213A7 | VL2j2a2/J L2 | QSALTQP-ASVSGSPGQSITI3C | TGTS-SDVGGY----NYVS | WYQQHPGK APKFMIY | E-------VRNRPS | GVSNRFSGSKSG--NTASLTISGLQAEDEADYYC | SSYTS--------SRTLV | FGGGT KLTVL |
| iPS:4 72733 | 21-225_2B10_LC2 | VL2j2a2/J L2 | QSALTQP-ASVSGSPGQSITISC | TGTS-SDVGGY----NFVS | WYQQHPGK APKLMIY | E-------VSNRPS | GVSNRFSGSKSG--NTASLTISGLQAEDEADYYC | SSYTS--------TGTVV | IGGGT KLFVL |
| iPS:3 92573 | 21-225_15G2 | VL2j2a2/J L2 | QSALTQP-ASVSGSPGQSITISC | TGTS-SDVGGY----NYYS | WYQQHPGK APKLMII | E-------VSNRPS | GVSNRFSGSKSG--NTASLTISGLQAEDEADYYC | TSYTS--------TSTVV | FGGGT KLFVL |
| iPS:3 93232 | 21-225_17F12 | VL2j2a2/J L2 | QSALTQP-ASVSGSPGQSITISC | TGAS-SDVGDY----NSVS | WYQQHPGK APKLMIY | E-------VSNRPS | GVSNRFSGSKSG--NTASLTISGLQAEDEADYYC | SSYTS--------SITVV | FGGGT KLTVL |
| iPS:3 98494 | 21-225_21H4 | VL2j2a2/J L2 | QSALTQP-ASVSGSPGQSITISC | TGTS-SDVGGY----NSVS | WYQQHPGK APKLMIY | E-------VSNRPS | GVSNRFSGSKSG--NTASLTISGLQAEDEADYYC | SSYTR--------SSTVV | FGGGT KLTVL |
| | VL3j3mjJL1 | Germline | SYELTQPPSVSVSPGQTARITC | SGD----ALPK------QYAY | WYQQKPGQ APVLVIY | K-------DSERPS | GIPERFSGSRSG--TTVTLTIRGVQAEDEADYYC | QLVVS--------SSTYV | FGTGT MLTVL |
| iPS:4 37102 | 21-225_211E5 | VL3j3mjJ L1 | SYELTQP-PSVSVSPGQTARITC | SGD----ALPK------QYAY | WYQQKPGQ APVLVIY | K-------DSARPS | GIPERFSGSRSG--TTVTLTIRGVQAEDEADYYC | QLVVS--------SDTYV | FGTGT MLTVL |
| iPS:4 37164 | 21-225_217C6 | VL3j3mjJ L1 | SYELTQP-PSVSVSPGQTARITC | SGD----ALPK------QYAY | WYQQKPGQ APVLVIY | K-------DSERPS | GIPERFSGSRSG--TTVTLTIRGVQAEDEADYYC | QLVVS--------SDTYV | FGTGT KVTVL |
| iPS:4 37466 | 21-225_217G11 | VL3j3mjJ L1 | SYELTQP-PSVSVSPGQTARITC | SGD----ALPK------QYAY | WYQQKPGQ APVLVIY | K-------DSERPS | GIPERFSGSRSG--TTVTLTIRGVQAEDEADYYC | QLVVS--------SSTYV | FGTGT KVTVL |
| iPS:4 37170 | 21-225_218E5 | VL3j3mjJ L1 | SYELTQP-PSVSVSPGQTARITC | SRD----VLPK------QYAY | WYQQKPGQ APVLVIY | K-------DSERPS | GIPERFSGSRSG--TTVTLTIRGVQAEDEADYYC | QLVVS--------SDTYV | FGTGT KVTVL |
| iPS:4 37196 | 21-225_226B7 | VL3j3mjJ L1 | SFELTQP-PSVSVSPGQTARITC | SGD----ALPR------HYYY | WYQQNPGQ APVLVIY | K-------DSERPS | GIPERFSGSESG--TTVTLTISGLQSEDEADYYC | QSADS--------SGTYV | EGTGT KVTVL |
| | VL4j4cjJL2 | Germline | | | | | | | |
| | | | L_FR1 | L_CDR1 | L_FR2 | L_CDR2 | L_FR3 | L_CDR3 | L_FR4 |

FIGURE 51 (Continued)

| | | | L_FR1 | L_CDR1 | L_FR2 | L_CDR2 | L_FR3 | L_CDR3 | L_FR4 |
|---|---|---|---|---|---|---|---|---|---|
| iPS:3 92596 | 21-225_12D8 | VL4|4c/JL2 | LPVLTQP-PSASALLGASIKL TC | TLSS-EHSTY-------TIE | WYQQRPGR SPQYIMK | VKS----DGSHSKGD | GIPDRFMGSSSG--ADRYLTFSNLQSDDEDEYHC | GESHTID-------GQVGVV | FGGGT KLTVL |
| iPS:3 93174 | 21-225_15D8 | VL4|4c/JL2 | LPVLTQP-PSASALLGASIKL TC | TLSS-EHSTY-------TIE | WYQQRPGR SPQYIMK | VKS----DGSHSKGD | GIPDRFMGSSSG----ADRYITFSNLQSDEEEYHC | GESHTID-------GQVGVV | FGGGT KLTVL |
| iPS:3 98544 | 21-225_7C8 | VL4|4c/JL2 | LPVLTQP-PSASALLGASIKL TC | TLSS-EHSTY-------TIE | WYQQRPGR SPQYIMK | VKS----DGSHSKGD | GIPDRFMGSSSG--GDRYLTFSNLQSDDEDEYHC | GESHPID-------GQVGVV | FGGGT KLTVL |
| VL3|3hJL2 | | Germline | | | | | | | |
| iPS:3 93208 | 21-225_16F3 | VL3|3h/JL2 | SYVLTQP-PSVSVAPGQTARI TC | GGN-----NIGS-----KSVH | WYQQKPGQ APVLVVY | D-------DIDRPS | GIPERFSGSNSG-NTATLTISRVEAGDEADYYC | QVWDSS--------SDHVV | FGGGT KLTVL |
| HEAVY VARIABLE | | | H_FR1 | H_CDR1 | H_FR2 | H_CDR2 | H_FR3 | H_CDR3 | H_FR4 |
| VH1|1-08/D6|6-19|RF1/JH4 | | Germline | | | | | | | |
| iPS:4 26126 | 21-225_6G6 | VH1|1-08/D6|6-19|RF1/JH4 | QVQLVQS-GAEVKKPGASVKV SCKASG-YTFT | N------YDIN | WVRQATGQ GPEWMG | WMHPN----SGNTGYAKK FQG | RVTMTRNTSISAAYMVLSSL RSEDTAVYYCAL | SSGWY----------YFDY | WGQGT LVTVS S |
| iPS:4 12232 | 21-225_4A2 | VH1|1-08/D6|6-19|RF1/JH4 | QVQLVQS-GTEVKKPGASVKV SCKASG-YTFT | N------YDIN | WVRQATGQ GLEWMG | WMHPN----SGNTGYAQK FQG | RVTLTRNTSISTAYMELSSL RSEDTAVYYCAS | SSGWY----------YFDY | WGQGT LVTVS S |
| iPS:4 26112 | 21-225_12F12 | VH1|1-08/D6|6-19|RF1/JH4 | QVQLVQS-GAEVKKPGASVKV SCKASG-YTFT | N------YDIN | WVRQATGQ GLEWMG | WMYPN----SGNTGYAQK FQG | RVTMTRNTSISTAYMELSSL RSEDTAVYYCAM | SSGWY----------YFDF | WGQGT LVTVS S |
| iPS:4 51141 | 21-225_164B11 | VH1|1-08/D6|6-19|RF1/JH4 | QVQLVQS-GAEVKKPGASVKV SCKASG-YTFT | N------YDIN | WVRQATGQ GLEWMG | WMTPN----SGNTGYAQK FQG | RVTMTRNTSMSTAYMELSSL RSEDSAVYYCSI | SSGWY----------MFDY | WGQGT LVTVS S |
| iPS:4 68850 | 21-225_63F4 | VH1|1-08/D6|6-19|RF1/JH4 | QVQLVQS-GAEVKKPGASVKV SCKASG-YTFT | N------YDVN | WVRQATGQ GLEWMG | WMHPN----SGNTGYAQK FRG | RVTMTRNTSLSTVYMELSSL RSEDTAVYYCAY | SSGWY----------VFDY | WGQGT LVTVS S |
| iPS:4 68852 | 21-225_71F3 | VH1|1-08/D6|6-19|RF1/JH4 | QVQLVQS-GAEVKKPGASVKV SCKASG-YTFT | N------YDVN | WVRQATGQ GLEWMG | WMHPN----SGNTGYAQK FQG | RVTMTRNTSISTAYMELSSL RSEDTAVYYCAY | SSGWY----------VFDS | WGQGT LVTVS S |

FIGURE 51 (Continued)

| | | | | | | | | | |
|---|---|---|---|---|---|---|---|---|---|
| iPS:4 68854 | 21-225_72C4 | VH1|1-08/D6|6-19|RF1/J H4 | QVQLVQS-GAEVKKPGASVKV SCKASG-YTFT | N------YDIN | WVRQVTGQ GLEWMG | WMHPN----SGNTGYAQK FQG | RVTMTRNTSISTAYMELNSL RSEDTAVYYCSH | SSGWY--------LFDY | WGQGT LVTVS S |
| iPS:4 68870 | 21-225_74A8 | VH1|1-08/D6|6-19|RF1/J H4 | QVQLVQS-GAEVKKPGASVKV SCKASG-YTFT | N------YDIN | WVRQASGQ GLEWMG | WMHPN----SGNTGYAQK FQG | RVTMTRNTSISTAYMELSSL RSEDSAVYYCAY | SSGWY--------NFDY | WGQGT LVTVS S |
| iPS:4 23314 | 21-225_12F11 | VH1|1-08/D6|6-19|RF1/J H4 | QVQLVQS-GAEVKKPGASVKV SCKASG-YTFT | N------YDIN | WVRQATGQ GPERMG | WMHPN----SGNTGYAKR FQG | RVTMTRNTSISAAYMVLSSL RSEDTAVYYCAL | SSGWY--------YFDY | WGQGT LVTVS S |
| iPS:4 33909 | 21-225_43D8 | VH1|1-08/D6|6-19|RF1/J H4 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL TSEDTAVYYCAH | SSGWT--------LFDY | WGQGT LVTVS A |
| iPS:4 34177 | 21-225_56A1 | VH1|1-08/D6|6-19|RF1/J H4 | QVQLVQS-GAEVKKPGASVKV SCKASG-YTFT | N------YDIN | WVRQATGQ GLEWLG | WMHPN----SGNTGYAQK FQG | RVTMTRNTSISTAYMELSSL RSEDTAVYYCAY | SSGWY--------VFDY | WGQGT LVTVS S |
| iPS:4 34211 | 21-225_60F3 | VH1|1-08/D6|6-19|RF1/J H4 | QVQLLVQS-GAEVKKPGASVKV SCKASG-YTFT | N------YDIN | WVRQATGQ GLEWMG | WMHPN----SGSTGYAQK FQG | RVTMTRNTSISTAYMELSSL RSEDTAVYYCAY | SSGWY--------FFDY | WGQGT LVTVS S |
| iPS:4 34235 | 21-225_61E3 | VH1|1-08/D6|6-19|RF1/J H4 | QVQLVQS-GAEVKKPGASVKV SCKASG-YTFT | N------YDIN | WVRQATGQ GLEWMG | WMTPN----SGNTGYAQK FQG | RVTMTRNTSISTAYMELSSL RSEDTAVYYCAY | SSGWY--------RFDY | WGQGT LVTVS S |
| iPS:4 34237 | 21-225_61B5 | VH1|1-08/D6|6-19|RF1/J H4 | QVQLVQS-GAEVKKPGASVKV SCKASG-YTFT | N------YDIN | WVRQATGQ GLEWMG | WMHPN----SGSTGYAQK FQG | RVTMTRNTSISTAYMELSSL RSEDTAVYYCAY | SSGWY--------YFDY | WGQGT LVTVS S |
| iPS:4 34295 | 21-225_58B9 | VH1|1-08/D6|6-19|RF1/J H4 | QVQLVQS-GAEVKKPGASVKV SCKASG-YTFT | N------YDIN | WVRQATGQ GLEWMG | WMHPN----SGSTGYAQK FQG | RVTMTRNTSISTAYMELSSL RSEDTAVYYCAY | SSGWY--------YFDY | WGQGT LVTVS S |
| iPS:4 34305 | 21-225_59E1 | VH1|1-08/D6|6-19|RF1/J H4 | QVQLVQS-GAEVKKPGASVKV SCKASG-YTFT | N------YDIN | WVRQATGQ GLEWMG | WMTPN----SGNTGYAQK FQG | RVTMTRNTSISTAYMELSSL RSEDTAVYYCAF | SSGWY--------FFDY | WGQGT LVTVS S |
| iPS:4 34321 | 21-225_59F10 | VH1|1-08/D6|6-19|RF1/J H4 | QVQLVQS-GAEVKKPGASVKV SCKASG-YTFT | N------YDIN | WVRQATGQ GLEWMG | WMNPN----SGNTGYAQK FQG | RVTMTRNTSISTAYMELSSL RSEDTAVNCAV | SSGWY--------YFDY | WGQGT LVTVS S |
| iPS:4 34431 | 21-225_70E7 | VH1|1-08/D6|6-19|RF1/J H4 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAY | SSGWY--------VFDY | WGQGT LVTVS S |

FIGURE 51 (Continued)

| | | | | | | | | | |
|---|---|---|---|---|---|---|---|---|---|
| iPS:4 34443 | 21-225_71G3 | VH1J1-08/D6J6-19|RF1/J H4 | QVQLVQS-GAEVKKPGASVKV SCKASG-YTFT | N------YDIN | WVRQATGQ GLEWMG | WMHPN---- SGSTGYAQK FQG | RVTMTRDISVSTAYMELSSL RSEDTAVYYCAY | SSGWY---------YFDY | WGQGT LVTVS S |
| iPS:4 34475 | 21-225_74F9 | VH1J1-08/D6J6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAR | SSGWN---------FFDY | WGQGT LVTVS S |
| iPS:4 34477 | 21-225_74A6 | VH1J1-08/D6J6-19|RF1/J H4 | QVQLVQS-GAEVKKPGASVKV SCKASG-YTFT | N------YDIN | WVRQATGQ GLEWMG | WMHPN---- SGNTGYAQK FRG | RVTMTRNTSISTAYMELSSL RSEDTAVYYCAS | SSGWY---------YFDY | WGQGT LVTVS S |
| iPS:4 34487 | 21-225_76G2 | VH1J1-08/D6J6-19|RF1/J H4 | QVQLVQS-GAEVKKPGASVKV SCKASG-YTFT | N------YDIN | WVRQATGQ GLEWMG | WMHPN---- SGNTGYACK FQG | RVTMTRNTSISTAYMELSSL RSEDTAVYYCAG | SSGWY---------MFDY | WGQGT LVTVS S |
| iPS:4 34511 | 21-225_74B11 | VH1J1-08/D6J6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAY | SSGWY---------YFDY | WGQGT LVTVS S |
| iPS:4 34549 | 21-225_76E11 | VH1J1-08/D6J6-19|RF1/J H4 | QVQLVQS-GAEVKKPGASVKV SCKASG-YTFT | N------YDIN | WVRQATGQ GLEWMG | WMHPN---- SGNTGYAQK FQG | RLTMTRNTSISTAYMELSSL RSEDTAVFYCAY | SSGWY---------YFDY | WGQGT LVTVS S |
| iPS:4 34551 | 21-225_75C4 | VH1J1-08/D6J6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDSAVYYCAY | SSGWY---------YFDY | WGQGT LVTVS S |
| iPS:4 34635 | 21-225_78E6 | VH1J1-08/D6J6-19|RF1/J H4 | QVQLVQS-GAEVKKPGASVKV SCKASG-YTFT | N------YDIN | WVRQASGQ GLEWMG | WMHPN---- SGNTGYAQK FQG | RVTMTRNTSISTAYMELSSL RSEDSAVYYCAY | SSGWY---------KFDY | WSQGT LVTVS S |
| iPS:4 34649 | 21-225_78E11 | VH1J1-08/D6J6-19|RF1/J H4 | QVQLVQS-GAEVKKPGASVKV SCKASG-YTFT | N------YDIN | WVRQATGQ GLEWMG | WMHPN---- SGNTGCAQK FQG | RVTMTRNTSISTAYMELSSL RSEDTAVYYCAS | SSGWN---------FFDY | WGQGT LVTVS S |
| iPS:4 34665 | 21-225_74G4 | VH1J1-08/D6J6-19|RF1/J H4 | QVQLVQS-GAEVKKPGASVKV SCKASG-YTFT | N------YDVN | WVRQATGQ GLEWMG | WMHPN---- SGNTGYAQK FQG | RVTMTRNTSIRTAYMELSSL RSEDTAVYYCAS | SSGWY---------MFDY | WGQGT LVTVS S |
| iPS:4 34679 | 21-225_79G7 | VH1J1-08/D6J6-19|RF1/J H4 | QVQLVQS-GAEVKKPGASVKV SCKASG-YTFT | N------YDIN | WVRQASGQ GLEWMG | WMHPN--- SGNTGYAQK FQG | RVTMTRNTSISTAYMELSSL RSEDSAVYYCAY | SSGWY---------KFDY | WSQGT LVTVS S |
| iPS:4 34685 | 21-225_79E9 | VH1J1-08/D6J6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAS | SSGWY---------YFDY | WGQGT LVTVS S |

FIGURE 51 (Continued)

| | | | | | | | | |
|---|---|---|---|---|---|---|---|---|
| iPS:4 34697 | 21-225_79F12 | VH1|1-08/D6|6-19|RF1/JH4 | QVQLVQS-GAEVKKPGASVKVSCKASG-YTFT | N------YDIN | WVRQATGQGLEWMG | WMNPN----SGNTGYAQKFQG | RVTMTRNTSISTAYMELSSLRSEDTAVYYCAS | SSGWY-------FFDY | WGQGTLVTLSS |
| iPS:4 34729 | 21-225_80B12 | VH1|1-08/D6|6-19|RF1/JH4 | QVQLVQS-GAEVKKPGASVKVSCKTSG-YTFT | N------YDIN | WVRQATGQGLEWMG | WMNPN----SGNTGYAQKFQV | RVTMTRNTSISTAYMELSSLRSEDTAVYYCAY | SSGWY-------IFDY | WGQGTLVTVSS |
| iPS:4 34851 | 21-225_75A6 | VH1|1-08/D6|6-19|RF1/JH4 | QVQLVQS-GAEVKKPGASVRVSCKASG-YTFT | N------YDIN | WVRQATGQGLEWMG | WMNPN----SGNTGYAQKFQG | RVTMTRNTSISTAYMELSSLRSEDTAVYYCAY | SSGWY-------IFDY | WGQGTLVTVSS |
| iPS:4 34909 | 21-225_85C11 | VH1|1-08/D6|6-19|RF1/JH4 | QVQLVQS-GAEVKKPGASVKVSCKASG-YTFT | N------YDIN | WVRQASGQGLEWMG | WMHPN----SGNTGYAQKFQG | RVTMTRNTSISTAYMELSSLRSEDTAVYYCAY | SSGWY-------KFDY | WGQGTLVTVSS |
| iPS:4 34959 | 21-225_87E10 | VH1|1-08/D6|6-19|RF1/JH4 | QVQLVQS-GAEVKKPGASVKVSCKASG-YTFT | N------YDIN | WVRQATGQGLEWMG | WMNPN----SGNTGYAQKFQG | RVTMTRNTSISTAYMELSSLRSEDTAVYYCAY | SSGWY-------FFDY | WGQGTLVTVSS |
| iPS:4 34965 | 21-225_88A1 | VH1|1-08/D6|6-19|RF1/JH4 | QVQLVQS-GAEVKKPGASVKVSCKASG-YTFT | N------YDIN | WVRQATGQGLEWMG | WMNPN----SGNTGYAQKFQG | RVTMTRNTSISTAYMELSSLRSEDTAVYYCAY | SSGWY-------YFDY | WGQGTLVTVSS |
| iPS:4 34973 | 21-225_88B4 | VH1|1-08/D6|6-19|RF1/JH4 | QVQLVQS-GAEVKKPGASVKVSCKASG-YTFT | N------YDIN | WVRQATGQGLEWMG | WMNPN----SGDTGYAQKFQG | SVTMTRNTSITTAYMELSSLRSEDTAVYYCSY | SSGWY-------YFDY | WGQGTLVTVSS |
| iPS:4 34997 | 21-225_88C10 | VH1|1-08/D6|6-19|RF1/JH4 | QVQLVQS-GAEVKKPGASVRVSCKASG-YTFS | N------YDIN | WVRQATGQGLEWMG | WMNPN----SGNTGYAQKFQG | RVTMTRNTSISTAYMELSSLRSEDTAVYYCAS | SSGWY-------YFDS | WGQGTLVTVSL |
| iPS:4 35053 | 21-225_75F9 | VH1|1-08/D6|6-19|RF1/JH4 | QVQLVQS-GAEVKKPGASVKVSCKASG-YTFT | N------YDIN | WVRQATGQGLEWMG | WMNPN----SGNTGYAQKFQG | RVTMTRNTSISTAYMELSSLRSEDTAVYYCAY | SSGWY-------IFDY | WGQGTLVTVSS |
| iPS:4 35113 | 21-225_92E6 | VH1|1-08/D6|6-19|RF1/JH4 | QVQLVQS-GAEVKKPGASVKVSCKASG-YTFT | N------YDIN | WVRQATGQGLEWMG | WMNPN----SGNTGYAQKFQG | RVTMTRNTSMSTAYMELSSLRSEDTAVYYCAH | SSGWY-------FFDY | WGQGTLVTVSS |
| iPS:4 35209 | 21-225_75A10 | VH1|1-08/D6|6-19|RF1/JH4 | QVQLVQS-GAEVKKPGASVKVSCKASG-YTFT | N------YDIN | WVRQATGQGLEWMG | WMNPN----SGNTGYAQKFQG | RVTMTRNTSISTAYMELSSLRSEDTAVYYCAY | SSGWY-------YFDY | WGQGTLVTVSS |
| iPS:4 35257 | 21-225_96H5 | VH1|1-08/D6|6-19|RF1/JH4 | QVQLVQS-GAEVKKPGASVKVSCKASG-YTFT | N------YDIN | WVRQASGQGLEWMG | WMHPN----SGNTGYAQKFQG | RVTMTRNTSISTAYMELSSLRSEDTAVYYCAY | SSGWY-------KFDY | WGQGTLVTVSS |

FIGURE 51 (Continued)

| | | | | | | | | |
|---|---|---|---|---|---|---|---|---|
| iPS:4 35267 | 21-225_96D10 | VH1|1-08/D6|6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSMSTAYMELSSL RSEDTAVYYCAH | SSGWY---- --------FFDY | WGQGT LVTVS S |
| iPS:4 35299 | 21-225_146D4 | VH1|1-08/D6|6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAG | SSGWY---- --------YFDY | WGQGT LVTVS S |
| iPS:4 35305 | 21-225_146C9 | VH1|1-08/D6|6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAY | SSGWY---- --------SFDY | WGQGT LVTVS S |
| iPS:4 35309 | 21-225_146F9 | VH1|1-08/D6|6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAS | SSGWY---- --------FFDY | WGQGT LVTVS S |
| iPS:4 35321 | 21-225_147E4 | VH1|1-08/D6|6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAS | SSGWY---- --------FFDY | WGQGT LVTVS S |
| iPS:4 35323 | 21-225_147D5 | VH1|1-08/D6|6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSGDTAVYYCAS | SSGWY---- --------YFDY | WGQGT LVTVS S |
| iPS:4 35345 | 21-225_148G3 | VH1|1-08/D6|6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAS | SSGWY---- --------FFDY | WGQGT LVTVS S |
| iPS:4 35353 | 21-225_148F8 | VH1|1-08/D6|6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAS | SSGWY---- --------YFDY | WGQGT LVTVS S |
| iPS:4 35369 | 21-225_149A2 | VH1|1-08/D6|6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAG | SSGWY---- --------YFDY | WGQGT LVTVS S |
| iPS:4 35373 | 21-225_149E3 | VH1|1-08/D6|6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL TSEDTAVYYCAY | SSGWY---- --------MFDY | WGQGT LVTVS S |
| iPS:4 35375 | 21-225_149H4 | VH1|1-08/D6|6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSITTVYMLSSL RSEDTAVYYCIF | SSGWY---- --------YFDY | WGQGT LVTVS S |
| iPS:4 35399 | 21-225_150D2 | VH1|1-08/D6|6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAY | SSGWY---- --------YFDY | WGQGT LVTVS S |

FIGURE 51 (Continued)

| | | | | | | | | |
|---|---|---|---|---|---|---|---|---|
| iPS:4 35405 | 21-225_150B7 | VH1\|1-08/D6\|6-19\|RF1/J H4 | QVQLVQS-GAEVKKPGASVTV SCKASG-FPFT | N------YDIN | WVRQATGQ GLEWMG | WMHPN---- SGNTGYAQK FQG | RVTMTRNTSISTAYMELSSL RSEDTAVYYCAS | SSGWY-------------- ---------------FFDY | WGQGT LVTVS S |
| iPS:4 35433 | 21-225_152E3 | VH1\|1-08/D6\|6-19\|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAS | SSGWY-------------- ---------------FFDY | WGQGT LVTVS S |
| iPS:4 35435 | 21-225_152H3 | VH1\|1-08/D6\|6-19\|RF1/J H4 | QVQLVQS-GAEVKNKPGASVKV SCKASG-YTFP | N------YDIN | WVRQATGQ GLEWMG | WMHPN---- SGNTGYAQK FQG | RVTMTRNTSISTAYMELSSL RSEDTAVYYCAY | SSGWY-------------- ---------------WFDY | WGQGT LVTVS S |
| iPS:4 35459 | 21-225_152E12 | VH1\|1-08/D6\|6-19\|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAY | SSGWY-------------- ---------------YFDY | WGQGT LVTVS S |
| iPS:4 35471 | 21-225_153F11 | VH1\|1-08/D6\|6-19\|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSINTAYMELSSL RSEDTAVYYCAY | SSGWY-------------- ---------------FFDN | WGQGT LVTVS S |
| iPS:4 35475 | 21-225_154H6 | VH1\|1-08/D6\|6-19\|RF1/J H4 | QVQLVQS-GAEVKKPGASVKV SCKASG-YTFT | N------YDIN | WVRQATGQ GLEWMG | WMNPN---- SGNTGYAQK FQG | RVTMTRNTSISTAYMELSSL RSEDTAVYYCAS | SSGWY-------------- ---------------IFDY | WGQGT LVTVS S |
| iPS:4 35481 | 21-225_154A11 | VH1\|1-08/D6\|6-19\|RF1/J H4 | QVQLVQS-GAEVKNKPGASVKV SCKASG-YTFT | N------YDIN | WVRQATGQ GLEWMG | WMHPN---- SGNTGYAQK FQG | RVTMTRNTSISTAYMELSSL RSEDTAVYYCAS | SSGWY-------------- ---------------YFDY | WGQGT LVTVS S |
| iPS:4 35491 | 21-225_155E5 | VH1\|1-08/D6\|6-19\|RF1/J H4 | QVQLVQS-GAEVKKPGASVKV SCKASG-YTFT | N------YDIN | WVRQATGQ GLEWMG | WMHPN---- SGSTGYAQR FQG | RVTMTRNTSISTAYMELSSL RSEDTAVYYCAF | SSGWY-------------- ---------------YFDY | WGQGT LVTVS S |
| iPS:4 35495 | 21-225_155B6 | VH1\|1-08/D6\|6-19\|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAG | SSGWY-------------- ---------------YFDY | WGQGT LVTVS S |
| iPS:4 35501 | 21-225_156H1 | VH1\|1-08/D6\|6-19\|RF1/J H4 | QVQLVQS-GAEVKKPGASVKV SCKASG-YTFT | N------YDIN | WVRQATGQ GLEWMG | WMHPN---- SGNTGYAQK FQG | RFTMTRNTSISTAYMELSSL RSEDTAVYYCAG | SSGWY-------------- ---------------RFDY | WGQGT LVTVS S |
| iPS:4 35557 | 21-225_158B12 | VH1\|1-08/D6\|6-19\|RF1/J H4 | QVQLVQS-GAEVRNKPGASVKV SCKASG-YTFT | N------YDIN | WVRQATGQ GLEWMG | WMHPN---- SGNTGYAQK FQG | RVTMTRNTSISTAYMELSSL RSEDTAVYYCAY | SSGWY-------------- ---------------YFDY | WGQGT LVTVS S |
| iPS:4 35589 | 21-225_160A4 | VH1\|1-08/D6\|6-19\|RF1/J H4 | QVQLVQS-GTEVKKPGASVKV SCKASG-YTFT | N------YDIN | WVRQATGQ GPEWMG | WMHPN---- SGNTGYPQK FQG | RVTMTRNTSISTAYMELSSL RSEDTAVYYCAY | SSGWY-------------- ---------------IFDY | WGQGT LVTVS S |

FIGURE 51 (Continued)

| | | | | | | | | |
|---|---|---|---|---|---|---|---|---|
| iPS:4 35623 | 21-225_162D5 | VH1j1-08jD6j6-19jRF1j3 H4 | QVQLVQS-GAEVKKPGASVKVSCKASG-YTFT | N------YDIN | WVRQATGQ GLEWMG | WMHPN----SGNTGYAQK FQG | RVTMTRNTSIDTAYMELSSL RSSEDTAVYFCAF | SSGWY---------FPDY | WGQGT LVTVS S |
| iPS:4 35627 | 21-225_162F6 | VH1j1-08jD6j6-19jRF1j3 H4 | QVQLVQS-GAEVKKPGASVKVSCKASG-YTFT | N------YDIN | WVRQATGQ GLEWMG | WMHPN----SGNTGYAQK FQG | RFTMTRNTSISTAYMELSSL RSEDTAVYYCAY | SSGWY---------RFDY | WGQGT LVTVS S |
| iPS:4 35649 | 21-225_165H2 | VH1j1-08jD6j6-19jRF1j3 H4 | QVQLVQS-GAEVKKPGASVKVSCKASG-YTFT | H------YDIN | WVRQATGQ GLEWMG | WMHPN----SHKTGYAQK FQG | RVTMTRNTSISTAYMDLSSL RSEDTAVYYCAY | SSGWY---------GFPDY | WGQGT LVTVS S |
| iPS:4 35727 | 21-225_172E11 | VH1j1-08jD6j6-19jRF1j3 H4 | QVQLVQS-GAEVKKPGASVMVSCKASG-YTFT | N------YDIN | WVRQATGQ GLEWMG | WMHPN----SGNTGYAQK FQG | RVTMTRNTSISTAYMELSSL RSEDTAVYYCAY | SSGWY---------RPDY | WGQGT LVTVS S |
| iPS:4 35751 | 21-225_175D10 | VH1j1-08jD6j6-19jRF1j3 H4 | QVQLVQS-GAEVKKPGASVKVSCKASG-YTFT | N------YDIN | WVRQATGQ GLEWMG | WMHPN----SGNTGYAQK FQG | RVTMTRNTSISTVYMELSSL RSEDTAVYYCAY | SSGWY---------YFDY | WGQGT LVTVS S |
| iPS:4 35773 | 21-225_177B12 | VH1j1-08jD6j6-19jRF1j3 H4 | QVQLVQS-GAEVKKPGASVKVSCKASG-YTFT | N------YDIN | WVRQATGQ GLEWMG | WMHPN----SGNTGYAQK FQG | RVTMTRNTSISTAYMELSSL RSEDTAVYYCAY | SSGWY---------YFDF | WGQGT LVTVS S |
| iPS:4 35801 | 21-225_181E5 | VH1j1-08jD6j6-19jRF1j3 H4 | QVQLVQS-GAEVKKPGASVKVSCKASG-YTFT | N------YDIN | WVRQATGQ GLEWMG | WMHPN----SGNTGYAQK FQG | RVTMTRNTSISTAYMELSSL RSEDTAVYYCAH | SSGWY---------IFDY | WGQGT LVTVS S |
| iPS:4 35841 | 21-225_191D8 | VH1j1-08jD6j6-19jRF1j3 H4 | QVQLVQS-GAEVKKPGASVKVSCKASG-YTFT | N------YDIN | WVRQATGQ GLEWMG | RMNPN----SGNTGYAQK FQG | RVTMTRNTSISTAYMELSSL RSEDTAVYYCAH | SSGWY---------YFDY | WGQGT LVTVS S |
| iPS:4 35885 | 21-225_191G3 | VH1j1-08jD6j6-19jRF1j3 H4 | QVQLVQS-GAEVKKPGASVKVSCKASG-YTFT | N------YDIN | WVRQATGQ GLEWMG | WMHPN----SGNTGYAQK FQG | RVTMTRNTSISTAYMELSSL RSEDTAVYYCAH | SSGWY---------IFDY | WGQGT LVTVS S |
| iPS:4 35915 | 21-225_190H4 | VH1j1-08jD6j6-19jRF1j3 H4 | QVQLVQS-GAEVKKPGASVKVSCKASG-NTFT | N------YDIN | WVRQATGQ GLEWMG | WMHPN----SGNTGYAQK FQG | RVTMTRNTSISTAYMELSSL RSEDTAVYYCAH | SSGWY---------IFDY | WGQGT LVTVS S |
| iPS:4 35925 | 21-225_190D7 | VH1j1-08jD6j6-19jRF1j3 H4 | QVQLVQS-GAEVKKPGASVKVSCKASG-YTFT | N------YDIN | WVRQATGQ GLEWMG | WMHPN----SGNTGYAQK FQG | RVTMTRNTSISTAYMELSSL RSEDTAVYYCAS | SSGWY---------FFDY | WGQGT LVTVS S |
| iPS:4 36021 | 21-225_193G4 | VH1j1-08jD6j6-19jRF1j3 H4 | QVQLVQS-GAEVKKPGASVKVSCKASG-YTFT | N------YDIN | WVRQATGQ GLEWMG | WMHPN----SGNTGYAQK FQG | RVTMTRNTSIRTAYMELNSL RSEDTAVYYCAS | SSGWY---------FFDY | WGQGT LVTVS S |

FIGURE 51 (Continued)

| | | | | | | | | |
|---|---|---|---|---|---|---|---|---|
| iPS:4 36150 | 21-225_197H4 | VH1\|1-08\|D6\|6-19\|RF1/J H4 | QVQLVQS-GAEVKKPGASVKV SCKASG-YTFT | N------YDIN | WVRQATGQ GLEWMG | WMHPN------SGNTGYAQK FQG | RVTMTRNTSISTAYMELSSL RSEDTAVYYCAH | SSGWY------------YFDY | WGQGT LVTVS S |
| iPS:4 36154 | 21-225_197C6 | VH1\|1-08\|D6\|6-19\|RF1/J H4 | QVQLVQS-GAEVKKPGASVKV SCKASG-YTFT | N------YDIN | WVRQATGQ GLEWMG | WMHPN------SGNTGYAQK FQG | RVTMTRNTSISTAYMELSSL RSEDTAVYYCAH | SSGWY------------YFDY | WGQGT LVTVS S |
| iPS:4 36272 | 21-225_201F5 | VH1\|1-08\|D6\|6-19\|RF1/J H4 | QVQLVQS-GAEVKKPGASVKV SCKASG-YTFT | N------YDIN | WVRQATGQ GLEWMG | WMHPN------SGNTGYAQK FQG | RVTMTRNTSISTAYMELSSL RSEDTAVYYCAY | SSGWY------------YFDY | WGQGT LVTVS S |
| iPS:4 36550 | 21-225_224D8 | VH1\|1-08\|D6\|6-19\|RF1/J H4 | QVQLVQS-GAEVKKPGASVKV SCKASG-YTFT | N------YDIN | WVRQATGQ GLEWMG | WLYPN------SGNTGYAQK FQG | RVTMTRNTSISTAYMELSSL RSEDTAVYYCAY | SSGWY------------YFDY | WGQGT LVTVS S |
| iPS:4 36554 | 21-225_224C10 | VH1\|1-08\|D6\|6-19\|RF1/J H4 | QVQLVQS-GAEVKKPGASVKV SCKASG-STFT | N------YDIN | WVRQATGQ GLEWMG | WMHPN------SGNTGYAQK FQG | RVTMTRNTSISTAYMELSSL RSEDTAVYYCAY | SSGWY------------KFDY | WGQGT LVTVS S |
| iPS:4 36560 | 21-225_224F11 | VH1\|1-08\|D6\|6-19\|RF1/J H4 | QVQLVQS-GAEVKKPGASVKV SCKASG-YTFT | N------YDIN | WVRQATGQ GLEWMG | WMHPN------SGNTGYAQK FQG | RVTMTRNTSISTAYMELSSL RSEDTAVYYCAY | SSGWY------------KFDY | WGQGT LVTVS S |
| iPS:4 36574 | 21-225_225F5 | VH1\|1-08\|D6\|6-19\|RF1/J H4 | QVQLVQS-GAEVKKPGASVKV SCKASG-HTFT | N------YDIN | WVRQATGQ GLEWMG | WMHPN------SGNTGFAQK FQG | RVTMTRNTSISTAYMELSSL RSEDTAVYYCAY | SSGWY------------RFDY | WGQGT LVTVS S |
| iPS:4 36584 | 21-225_225B9 | VH1\|1-08\|D6\|6-19\|RF1/J H4 | QVQLVQS-GTEVKKPGASVKV SCKASG-YTFT | N------YDIN | WVRQATGQ RLEWMG | WMHPN------SGNTGYAQK FRG | RVTMTRNTSINTAYMELNSL RSEDTAVYYCAY | SSGWT------------LFDY | WGQGT LVTVS S |
| iPS:4 36586 | 21-225_225F11 | VH1\|1-08\|D6\|6-19\|RF1/J H4 | QVQLVQS-GAEVKKPGASVKV SCKASG-YTFT | N------YDIN | WVRQATGQ GLEWMG | WMHPN------SGNTGYAQK FQG | RVTMTRNTSINTAYMELSSL RSEDTAVYYCAY | SSGWY------------RFDY | WGQGT LVTVS S |
| iPS:4 36588 | 21-225_225F12 | VH1\|1-08\|D6\|6-19\|RF1/J H4 | QVQLVQS-GAEVKKPGASVKV SCKASG-YTFT | N------YDIN | WVRQATGQ GLEWMG | WMHPN------SGNTGYAQK FQG | RVTMTRNTSISTAYMELSSL RSEDTAVYYCAY | SSGWY------------KFDY | WGQGT LVTVS S |
| iPS:4 36590 | 21-225_225H12 | VH1\|1-08\|D6\|6-19\|RF1/J H4 | QVQLVQS-GAEVKKPGASVKV SCKASG-YTFT | H------YDIN | WVRQATGQ GLEWMG | WMHPN------SGNTGYAQK FQG | RVTMARNTSISTAYMELSSL RSEDTAVYYCAY | SSGWY------------KFDY | WGQGT LVTVS S |
| iPS:4 36598 | 21-225_226D6 | VH1\|1-08\|D6\|6-19\|RF1/J H4 | QVQLVQS-GAEVKKPGASVKV SCKASG-YTFT | N------YDIN | WVRQATGQ GLEWMG | WMHPN------SGNTGYAQK FQG | RVTMTRNTSISTAYMELSSL RSEDTAVYYCAY | SSGWY------------KFDY | WGQGT LVTVS S |

FIGURE 51 (Continued)

| | | | | | | | | | |
|---|---|---|---|---|---|---|---|---|---|
| iPS:4 36600 | 21-225_226F6 | VH1|1-08|D6|6-19|RF1|J H4 | QVQLVQS-GAEVKKPGASVKV SCKASG-YTFT | N------YDIN | WVRQATGQ GLEWMG | WMHPN----SGNTGYAQK FQG | RVTMTRNTSINTAYMELSSL RSEDTAVYYCAY | SSGWY-------RFDY | WGQGT LVTVS S |
| iPS:4 36616 | 21-225_226D11 | VH1|1-08|D6|6-19|RF1|J H4 | QVQLVQS-GAEVKKPGASVKV SCRSSG-YTFT | N------YDIN | WVRQATGQ GLEWMG | WMHPN----SGNTGYAQK FQG | RVTMTRNTSISTAYMELSSL RSEDTAVYYCAY | SSGWY-------YFDY | WGQGT LVTVS S |
| iPS:4 36622 | 21-225_226A12 | VH1|1-08|D6|6-19|RF1|J H4 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAY | SSGWY-------YFDY | WGQGT LVTVS S |
| iPS:4 36636 | 21-225_227E6 | VH1|1-08|D6|6-19|RF1|J H4 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAY | SSGWY-------RFDY | WGQGT LVTVS S |
| iPS:4 36638 | 21-225_227C7 | VH1|1-08|D6|6-19|RF1|J H4 | QVQLVQS-GAEVKKPGASVKV SCKASG-HIFT | N------YDIN | WVRQATGQ GLEWMG | WMHPN----SGNTGYAQK FQG | RVTMTRNTSISTAYMELSSL RSEDTAVYYCAY | SSGWY-------RFDY | WGQGT LVTVS S |
| iPS:4 36646 | 21-225_227D11 | VH1|1-08|D6|6-19|RF1|J H4 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAY | SSGWY-------YFDY | WGQGT LVTVS S |
| iPS:4 46086 | 21-225_94D8 | VH1|1-08|D6|6-19|RF1|J H4 | QVQLVQS-GAEVKKPGASVKV SCKTSG-YTFT | N------YDIN | WVRQATGQ GLEWMG | WMHPN----SGNTGYAQK FQV | RVTMTRNTSISTAYMEVSSL RSEDTAVYYCAY | SSGWY-------YFDY | WGQGT LVTVS S |
| iPS:4 51116 | 21-225_164A4 | VH1|1-08|D6|6-19|RF1|J H4 | QVQLVQS-GAEVKKPGASVRV SCKASG-PTFP | N------YDIN | WVRQATGQ GLEWMG | WMHPN----SGNTGYAQK FQG | RVTMTRNTSISTAYMELSSL RSEDTAVYYCAY | SSGWY-------FFDY | WGQGT LVTVS S |
| iPS:4 51124 | 21-225_74F6 | VH1|1-08|D6|6-19|RF1|J H4 | QVQLVQS-GAEVKKPGASVKV SCKASG-YTFT | N------YDIN | WVRQATGQ GLEWMG | WMHPN----SGNTGYAQK FQG | RVTMTRNTSMSTAYMELSSL RSEDTAVYYCAH | SSGWY-------FFDY | WGQGT LVTVS S |
| iPS:4 51127 | 21-225_164A7 | VH1|1-08|D6|6-19|RF1|J H4 | QVQLVQS-GAEVKKPGASVKV SCKASG-YTFT | N------YDVN | WVRQATGQ GLEWMG | WMHPN----SGNTGYAQK FQG | RVTMTRNTSISTAYMELSSL RSEDSAVYYCAS | SSGWY-------LFDY | WGQGT LVTVS S |
| iPS:4 51131 | 21-225_160A7 | VH1|1-08|D6|6-19|RF1|J H4 | QVQLVQS-GAEVKKPGASVKV SCKASG-YTFT | N------YDIN | WVRQATGQ GLEWMG | WMHPN----SGNTGYAQK FQG | RVTMTRNTSINTAYMELSSL RSEDTAVYYCAH | SSGWY-------YFDY | WGQGT LVTVS S |
| iPS:3 92786 | 21-225_24E1 | VH1|1-08|D6|6-19|RF1|J H4 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAI | SSGWE-------YFDY | WGQGT LVTVS S |

FIGURE 51 (Continued)

| | | | | | | | | |
|---|---|---|---|---|---|---|---|---|
| iPS:3 92886 | 21-225_23A12 | VH1|1-08/D6|6-19|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSINTAYMELSSL RSEDTAVYYCAG | SSGWY----------YFDY | WGQGT LVTVS S |
| iPS:3 92928 | 21-225_25A4 | VH1|1-08/D6|6-19|RF1/J H4 | QVILLVQS-GAEVKRPGASVKV SCKASG-YTFT | N------YDIN | WVRQATGQ GLEWMG | WMYPN---- SGNTGYAQK FQG | RVTMTRNTSISTAYMELSSL RSEDTAVYYCAS | SSGWY----------YFDY | WGQGT LVTVS S |
| iPS:3 92936 | 21-225_28B6 | VH1|1-08/D6|6-19|RF1/J H4 | QVQLVQS-GAEVKRPGASVKV SCKASG-YTFT | N------YDIN | WVRQATGQ GLEWMG | WMHPD---- SGNTGYAQK FQG | RVTMTRNTSISTAYMELSSL RSEDTAVYYCAS | SSGWY----------YFDY | WGQGT LVTVS S |
| iPS:3 92960 | 21-225_29E6 | VH1|1-08/D6|6-19|RF1/J H4 | QVQLVQS-GAEVKKPGASVKV SCKASG-YTFT | N------YDIN | WVRQA·SGQ GLEWMG | WMHPN---- SGNTGYAQK FQG | RVTMTRNTSINTAYMELSSL RSEDTAVYYCAS | SSGWY----------YFDY | WGQGT LVTVS S |
| iPS:3 92992 | 21-225_26C4 | VH1|1-08/D6|6-19|RF1/J H4 | QVQLVQS-GAEVKRPGASVKV SCKASG-YTFT | N------YDIN | WVRQATGQ GLEWMG | WMHPN---- SGNTGYAQK FRG | RVTMTRNTSISTAYMELSSL RSEDTAVYYCAS | SSGWY----------FFDY | WGQGT LVTVS S |
| iPS:3 93088 | 21-225_33D1 | VH1|1-08/D6|6-19|RF1/J H4 | QVQLVQS-GAEVKRPGASVKV SCKASG-YTFT | N------YDIN | WVRQATGQ GLEWMG | WLHPN---- SGTTGYAQK FRG | RVTMTRNTSISTAYLELSSL RSEDTAVYYCAS | SSGWY----------FFDY | WGQGT LVTVS S |
| iPS:3 93144 | 21-225_34D2 | VH1|1-08/D6|6-19|RF1/J H4 | QVQLVQS-GAEVQKPGASVKV SCKASG-YTFT | N------YDIN | WVRQATGQ GLEWMG | WMNPG---- SGNTGYAQK FQG | RVTMTRNTSAAYMELSSL RSEDTAVYYCAS | SSGWY----------YFDY | WGQGT LVTVS S |
| iPS:3 93368 | 21-225_29H8 | VH1|1-08/D6|6-19|RF1/J H4 | QVQLVQS-GAEVKRPGASVKV SCKASG-YTFT | N------YDIN | WVRQATGQ GLEWMG | WMHPN---- SGATGYAQK FQG | RVTMTRNTSISTAYMELSSL RSEDTAVYYCAT | SSGWE----------VFDY | WGQGT LVTVS S |
| iPS:3 93942 | 21-225_11E5 | VH1|1-08/D6|6-19|RF1/J H4 | QVQLVQS-GPEVKRPGASVKV SCKASG-YTFI | N------YDIN | WVRQATGQ GLEWMG | WMHPN---- SGNTGYAQK FQG | RVTMTRNTSISTAYMELSSL RSEDTAVYYCAY | SSGWY----------VFDY | WGQGT LVTVS S |
| iPS:3 94085 | 21-225_8B11 | VH1|1-08/D6|6-19|RF1/J H4 | QVQLVQS-GAEVKKPGASVKV SCKASG-YTFT | N------YDIN | WVRQAAGQ GLEWMG | WMHPN---- SGNTGYAQK FQG | RVTMTRNTSRSTAYMELSSL RSEDTAVYYCAY | SSGWY----------YFDY | WGQGT LVTVS S |
| iPS:3 98496 | 21-225_22D2 | VH1|1-08/D6|6-19|RF1/J H4 | QVQLVQS-GAEVKRPGASVKV SCKASG-YTFI | N------YDIN | WVRQATGQ GLEWMG | WMHPD---- SGNTGYAQK FQG | RVTMTRNTSISTAYMELSSL RSEDTAVYYCAS | SSGWY----------YFDY | WGQGT LVTVS S |
| iPS:3 98522 | 21-225_32A1 | VH1|1-08/D6|6-19|RF1/J H4 | QVQLVQS-GAEVKKPGASVKV SCKASG-YTFT | N------YDIN | WVRQATGQ GLEWMG | WMNPN---- SGNTGYAQK FQG | RVTMTRNTSISTAYMELSSL RSEDTAVYYCAS | SSGWY----------FFDY | WGQGT LVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 98524 | 21-225_32A5 | VH|1-08/D6|6-19|RF1/JH4 | QVQLVQS-GAEVKKPGASVKV SCKASG-YTFT | N------YDIN | WVRQATGQ GLEWMG | WMHPN---- SGNTGFAQK FRG | RVTMTRNTSISTAYMELSSL RSEDTAVYYCSS | SSGWY---------FFDY | WGQGT LVTVS S |
| iPS:3 98538 | 21-225_34H7 | VH|1-08/D6|6-19|RF1/JH4 | QVQLVQS-GAEVKKPGASVKV SCKASG-YTFT | N------YDIN | WVRQATGQ GLEWMG | WMNPN---- SGNTGYAQK FQG | RVTMTRNTSISTAYMELNSL RSEDTAVYYCAS | SSGWY---------FFDY | WGQGT LVTVS S |
| | Germline | | H_FR1 | H_CDR1 | H_FR2 | H_CDR2 | H_FR3 | H_CDR3 | H_FR4 |
| VH|1-02D|1-1|RF1|JH4 | | | QVQLVQS-GAEVKKPGASVKV SCKASG-YTFT | YYLH | WVRQAPGQ GLEWMG | SGGTNYAQK FQG | RSDDTAVYYCAR | YFDY | WGQGT LVTVS S |
| iPS:4 73253 | 21-225_7C3_LC1 | VH|1-02/D|1-1|RF1/JH4 | QVQLVQS-GAEVKKPGASVKV SCKASG-YTFN | D------YYLH | WVRQAPGQ GLEWMG | WIHPN---- SGGTNYAQK FQG | RVTMTRDTSISTAYMELSSL RSDDTAVYYSCAR | DGTS----------SFDY | WGQGT LVTVS S |
| iPS:4 73254 | 21-225_7C3_LC2 | VH|1-02/D|1-1|RF1/JH4 | QVQLVQS-GAEVKKPGASVKV SCKASG-YTFN | D------YYLH | WVRQAPGQ GLEWMG | WMNPN---- SGNTGYAQK FQG | RVTMTRDTSISTAYMELSSL RSDDTAVYYCAS | DGTS----------SFDY | WGQGT LVTVS S |
| iPS:4 73255 | 21-225_9F12_LC1 | VH|1-02/D|1-1|RF1/JH4 | QVQLVQS-GAEVKKPGASVKV SCKASG-YTFA | D------YYLH | WVRQAPGQ GLEWMG | WIHPN---- SGGTNYAQK FQG | RVTMTRDTSISTAYLELSSL RSDDTAFYYCAR | DGTS----------SFDY | WGQGT LVTVS S |
| iPS:4 73256 | 21-225_9F12_LC2 | VH|1-02/D|1-1|RF1/JH4 | QVQLVQS-GAEVKKPGASVKV SCKASG-YTFA | D------YYLH | WVRQAPGQ GLEWMG | WIHPN---- SGGTNYAQK FQG | RVTMTRDTSISTAYMELSSL RSDDTAFYYCAR | DGTS----------SFDY | WGQGT LVTVS S |
| iPS:4 26108 | 21-225_10G6 | VH|1-02/D|1-1|RF1/JH4 | QVQLVQS-GAEVKKPGASVKV SCKASG-YTFT | A------YHMH | WVRQAPGQ GLEWMG | WINPN---- NNGTNYAQK FQG | RVTMTRDTSISTAYMELSRL RSDDTAVYYCGR | DVTS----------SFDY | WGQGT LVTVS S |
| iPS:4 26110 | 21-225_12E9 | VH|1-02/D|1-1|RF1/JH4 | QVQLVQS-GAEVKKPGASVKV SCKASG-YTFT | D------YYLH | WVRQAPGQ GLEWMG | WVHPN---- SGGTNYAQK FQG | RVTMTRDTSISTAYMELSSL RSDDTAVYYCAR | DGTS----------SFDY | WGQGT LVTVS S |
| iPS:4 53451 | 21-225_52G11 | VH|1-02/D|1-1|RF1/JH4 | QVQLVQS-GAEVKKPGASVKV SCKASG-YTFT | G------YYLH | WVRQAPGQ GLEWMG | WINPN---- RNGTNYAQK FQG | RVTMTRDTSISTAFMELSRL RSDDTAVYYCAR | DGTS----------SFDY | WGQGT LVTVS S |
| iPS:4 53453 | 21-225_53F2 | VH|1-02/D|1-1|RF1/JH4 | QVQLVQS-GAEVKKPGASVKV SCKASG-YTFT | G------YYLH | WVRQAPGQ GLEWMG | WINPN---- RNGTNYAQN FQG | RVTMTRDTSISTAYMELSRL KSDDTAVYYCAR | DGTS----------SFDY | WGQGT LVTVS S |
| iPS:4 34035 | 21-225_49F10 | VH|1-02/D|1-1|RF1/JH4 | QVQLVQS-GAEVKKPGASVKV SCKASG-YTFT | G------YHMH | WVRQAPGQ GLEWMG | WINPN---- NNATNYAQN FQG | RVTLTRDTSISTAYMELSRL RSDDTAVYYCAR | DGTS----------SFDF | WGQGT LVTVS S |

FIGURE 51 (Continued)

| | | | | | | | | | |
|---|---|---|---|---|---|---|---|---|---|
| iPS:4 34065 | 21-225_50D4 | VH1|1-02|D1|1-1|RF1|JH4 | QVQLVQS-GAEVKKPGASVKV SCKASG-YTFT | G------ | -YHMH | WVRQAPGQ GLEWMG | WINPN---NMATNYAQS FQG | RVTLTRDTSISTAYMELSRL RSDDTAVYYCAR | DGTS------SFDF | WGQGT LVTVS S |
| iPS:4 34069 | 21-225_51E9 | VH1|1-02|D1|1-1|RF1|JH4 | QVQLVQS-GAEVKKPGASVKV SCKASR-YTFT | G------ | -YHIH | WVRQAPGQ GLEWMG | WINPN---TNGTQYAQK FQG | RVTMTRDTSISTAYMELSRL RSDDTAVYYCAR | DGTS------SFDY | WGQGT LVTVS S |
| iPS:4 34079 | 21-225_52B1 | VH1|1-02|D1|1-1|RF1|JH4 | QVQLVQS-GAEVKKPGASVKV SCKASG-YTFT | G------ | -YHMQ | WVRQAPGQ GLEWMG | WINPN---SGATNYAQN FQG | RVTMTRDTSISTAYLDLSRL RSDDTAVYYCAR | DGTS------SFDY | WGQGT LVTVS S |
| iPS:4 34097 | 21-225_52H10 | VH1|1-02|D1|1-1|RF1|JH4 | QVQLVQS-GAEVKKPGASVKV SCKASG-YTFT | G------ | -YHMQ | WVRQAPGQ GLEWMG | WINPN---NGGTQYAQK FQG | RVTMTRDTSISTAYMELSRL RSDDTAVYYCAR | DGTS------SFDY | WGQGT LVTVS S |
| iPS:4 34123 | 21-225_53F7 | VH1|1-02|D1|1-1|RF1|JH4 | QVQLVQS-GAEVKKPGASVKV SCKASG-YTFT | G------ | -YHMH | WVRQAPGQ GLEWMG | WINPN---NNGTNYAQK FQG | RVTMTRDTSISTAYMELNRL TSDDTAVYYCAR | DGTS------SFDY | WGQGT LVTVS S |
| iPS:4 34189 | 21-225_56E5 | VH1|1-02|D1|1-1|RF1|JH4 | QVQLVQS-GAEVKKPGASVKV SCQASG-YTFT | G------ | -YHMH | WVRQAPGQ GLEWMG | WINPN---NNATNYAQN FQG | RVTMTRDTSISTAYMELRRL RSDDTAVIHCAR | DGTS------SFDY | WGQGT LVTVS S |
| iPS:4 35677 | 21-225_169C10 | VH1|1-02|D1|1-1|RF1|JH4 | QVQLVQS-GAEVKKPGASVKV SCKASG-YTFT | G------ | -YFMH | WVRQAPGQ GLEWMG | WIKPK---SGGTNSAQR FQG | RVTMTRDTSINTAYMELNRL RSDDTAVYYCAR | GGTTVAT------WGVFDY | WGQGT LVTVS S |
| iPS:4 35699 | 21-225_170D6 | VH1|1-02|D1|1-1|RF1|JH4 | QVQLVQS-GAEVKKPGASVKV SCKASG-YTFT | G------ | -YFIH | WVRQAPGQ GLEWMG | WIKPN---SGGTNSAQR FQG | RVTMTRDTSINTAYMELNRL RSDDTAVYYCAR | GGTTVAT------WGVFDY | WGQGT LVTVS S |
| iPS:4 35797 | 21-225_181G2 | VH1|1-02|D1|1-1|RF1|JH4 | QVQLVQS-GAEVKTPGASVKV SCRASG-YTFT | S------ | -YNMH | WVRQVPGQ GLEWMG | WINPN---NGGSNYTQK FQG | RVTMTRDTSISTAYMELSRL RSDDTAVYYCAR | KF------GD | WGQGT LVTVS S |
| iPS:4 35877 | 21-225_184E7 | VH1|1-02|D1|1-1|RF1|JH4 | QVQLVQS-GAEVKTPGASVKV SCRASG-YTFT | S------ | -YNMH | WVRQVPGQ GLEWMG | WINPN---MGGSNYTQK FQG | RVTMTRDTSISTAYMELSRL RSDDTAVYYCAR | KF------GD | WGQGT LVTVS S |
| iPS:4 35885 | 21-225_185E10 | VH1|1-02|D1|1-1|RF1|JH4 | QVQLVQS-GAEVKTPGASVKV SCRASG-YTFT | S------ | -YNMH | WVRQVPGQ GLEWMG | WINPN---NGGSNYTQK FQG | RVTMTRDTSISTAYMELSRL RSDDTAVYYCAR | KF------GD | WGQGT LVTVS S |
| iPS:4 35891 | 21-225_188H5 | VH1|1-02|D1|1-1|RF1|JH4 | QVQLVQS-GAEVKTPGASVKV SCRASG-YTFT | S------ | -YNMH | WVRQVPGQ GLEWMG | WINPN---SGGSNYTQK FQG | RITMTRDTSISTAYMELSRL RSDDTAVYYCAR | KF------GD | WGQGT LVTVS S |

FIGURE 51 (Continued)

| | | | | | | | | | |
|---|---|---|---|---|---|---|---|---|---|
| iPS:4 35897 | 21-225_188B9 | VH1¦1-02/D1¦1-1¦RF1/JH4 | QVQLVQS-GAEVKKPGASVKV SCKRASG-YTFT | S------YNMH | WVRQVPGQ GLEWMG | WINPN---- SGGSNYTQK FQG | RVTMTRDTSISTAYMELSRL RSDDTAVYYCAR | KF-------- ------GD | WGQGT LVTVS S |
| iPS:4 36400 | 21-225_213H7 | VH1¦1-02/D1¦1-1¦RF1/JH4 | QVQLVQS-GAEVKKPGASVKV SCKASG-YTFT | G------YHMH | WVRQAPGQ GLEWMG | WINPN---- SDGTNYAQK FQG | RVTMTRDTSISTAYMELSRL RSDDTAVYYCAR | EKPGS----- -----YYKY | WGQGT LVTVS S |
| iPS:4 36488 | 21-225_221A6 | VH1¦1-02/D1¦1-1¦RF1/JH4 | QVQLVQS-GAEVKKPGASVKV SCKASG-YTFT | G------YYMH | WVRQAPGQ GLEWMG | WIHPN---- SGGTNYAQK FQG | RVTMTRDTSISTAYMDLSRL RSDDTAVYYCAR | DGTS------ ------SFDY | WGQGT LVTVS S |
| iPS:4 36494 | 21-225_221F12 | VH1¦1-02/D1¦1-1¦RF1/JH4 | QVQLVQS-GAEVKKPGASVKV SCKTSG-YTFT | G------YYMH | WVRQAPGQ GLEWMG | WIHPN---- SGGTNYAQK FQG | RVTMTRDTSISTAYMDLSRL RSDDTAVYYCAR | DGTS------ ------SFDY | WGQGT LVTVS S |
| iPS:4 36496 | 21-225_222E1 | VH1¦1-02/D1¦1-1¦RF1/JH4 | QVQLVQS-GAEVKKPGASVKV SCKTSG-YTFT | G------YYMH | WVRQAPGQ GLEWMG | WIHPN---- SGGTNYAQK FQG | RVTLTRDTSISTAYMDLSRL RSDDTAVYYCAR | DGTS------ ------SFDY | WGQGT LVTVS S |
| iPS:4 36508 | 21-225_222F7 | VH1¦1-02/D1¦1-1¦RF1/JH4 | QVQLVQS-GAEVKKPGASVKV SCKTSG-YTFT | G------YYMH | WVRQAPGQ GLEWMG | WIHPN---- SGGTNYAQK FQG | RVTLTRDTSISTAYMDLSRL RSDDTAVYYCAR | DGTS------ ------SFDY | WGQGT LVTVS S |
| iPS:4 36516 | 21-225_222C12 | VH1¦1-02/D1¦1-1¦RF1/JH4 | QVQLVQS-GAEVKKPGASVKV SCKTSG-YTFT | G------YYMH | WVRQAPGQ GLEWMG | WIHPK---- SGGTNYAQK FQG | RVTLTRDTSISTAYMDLSRL RSDDTAVYYCAR | DGTS------ ------SFDY | WGQGT LVTVS S |
| iPS:4 37264 | 21-225_171H12 | VH1¦1-02/D1¦1-1¦RF1/JH4 | QVQLVQS-GAEVKKPGASVRV SCKASG-YTFT | G------YFMH | WVRQAPGQ GLEWMG | WIKPK---- SGGTNSAQR FQG | RVTMTRDTSINTAYMELNRL RSDDTAVYYCAR | GGTTVAT--- ----WGVFDY | WGQGT LVTVS S |
| iPS:4 37266 | 21-225_177A5 | VH1¦1-02/D1¦1-1¦RF1/JH4 | QVQLVQS-GAEVKKPGASVRV SCKASG-YTFT | G------YFMH | WVRQAPGQ GLEWMG | WIKPK---- SGGTNSAQR FQG | RVTMTRDTSINTAYMELNWL RSDDTAVYYCAR | GGTTVAT--- ----WGVFDY | WGQGT LVTVS S |
| iPS:3 93080 | 21-225_34F3 | VH1¦1-02/D1¦1-1¦RF1/JH4 | QVQLVQS-GAEVKKPGASVKV SCKASG-YTFT | G------YHMH | WVRQAPGQ GLEWMG | WINPN---- SGGTNYAQK FQG | RVTMTRDTSISTAYMELSRL RSDDTAVYYCAR | DGTS------ ------SFDY | WGQGT LVTVS S |
| iPS:3 93084 | 21-225_35C6 | VH1¦1-02/D1¦1-1¦RF1/JH4 | QVQLVQS-GTEVKKPGASVKV SCKASG-YTFT | G------DYMH | WVRQAPGQ GLEWMG | WISPK---- NGGTNYAQK FQG | RVTMTRDTSISTAYMELNRL RSDDTAVYYCAR | DGTG------ ------SFDY | WGQGT LVTVS S |
| iPS:3 93086 | 21-225_36H5 | VH1¦1-02/D1¦1-1¦RF1/JH4 | QVQLVQS-GAEVKKPGASMKV SCKASG-YTFT | D------YHMH | WVRQAPGQ GLEWMG | WINPN---- RGGTNYAQK FQD | RVTMTRDTSISTAYMELSRL RSDDTAVYYCAR | DGTG------ ------SFDY | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS.3 93098 | 21-225_35G6 | VH1|1-02/D1|1-1|RF1/JH4 | QVQLVQS-GADVKKPGASVKVSCKASG-YTFT | D-------YHIH | WVRQAPGQGLEWMG | WINPN----NGGTHYAQEFQG | RVTMTRDTSISTAYMELSSLRSDDTAVYYCAR | DGTG---------SFDY | WGQGTLVTVSS |
| iPS.3 93112 | 21-225_33G1 | VH1|1-02/D1|1-1|RF1/JH4 | QVQLAQS-GAEVKKPGASVKVSCKASG-YTFT | G-------YYMH | WVRQAPGQGLEWMG | WISPN----NGGTNYAQKFQG | RVTMTRDTSISTAYMELSRLRSDDTAVYYCAR | DGTG---------SFDY | WGQGTLVTVSS |
| iPS.3 93116 | 21-225_34G7 | VH1|1-02/D1|1-1|RF1/JH4 | QVQLVQS-GAEVKKPGASVKVSCKASG-YTFT | D-------YHIH | WVRQAPGQGLEWMG | WINPN----NGGTNYAQKFQG | RVTMTRDTSISTAYMELSRLRSDDTAVYYCAR | DGTG---------SFDY | WGQGNLVTVSS |
| iPS.3 93132 | 21-225_33H7 | VH1|1-02/D1|1-1|RF1/JH4 | QVQLVQS-GADVKKPGASVKVSCKASG-YTFT | D-------YHIH | WVRQAFGQGLEWMG | WINPN----NGGTHYAQEFQG | RVTMTRDTSISTAYMELSSLRSDDTAVYHCAR | DGTG---------SFDY | WGQGTLVTVSS |
| iPS.3 93140 | 21-225_35H12 | VH1|1-02/D1|1-1|RF1/JH4 | QVQLVQS-GAEVKKPGASVKVSCKASG-YTFT | D-------YYIH | WVRQAPGQGLEWMG | WINPN----NGGTNYAQKFQG | RVTMTRDTSISTAYMELSRLRSDDTAVYYCAR | DGTG---------SFDY | WGQGTLVTVSS |
| iPS.3 93954 | 21-225_4H6 | VH1|1-02/D1|1-1|RF1/JH4 | QVQLVQS-GAEVKKPGASVKVSCKASG-YTFT | D-------YYLH | WVRQAPGQGLEWMG | WIHPN----SGGTNYAQKFQG | RVTMTRDTSISTAYMELSSLRSDDTAVYYCAR | DGTS---------SFDY | WGQGTLVTVSS |
| iPS.3 98484 | 21-225_18D4 | VH1|1-02/D1|1-1|RF1/JH4 | QVQLVQS-GAEVKKPGASVKVSCKASG-YTFT | G-------YYLH | WVRQAPGQGLEWLG | WINPD----SNGTISAQHFQG | RVTMTRDTSISTAYMELSRLISDDTAVYYCAR | DGTS---------SLDY | WGQGTLVTVSS |
| iPS.3 98502 | 21-225_23B11 | VH1|1-02/D1|1-1|RF1/JH4 | QVQLVQS-GAEVKKPGASVKVSCKASG-YTFT | G-------YYLH | WVRQAPGQGLEWMG | WINPN----NNGTNYAQKFQG | RVTMTRDTSISTAYMELSRLRSDDTAVYYCAR | DGTS---------SFDY | WGQGTLVTVSS |
| iPS.3 98520 | 21-225_31C4 | VH1|1-02/D1|1-1|RF1/JH4 | QVQLVQS-GAEVKKPGASVKVSCKASG-YTFT | G-------DYMH | WVRQAPGQGLEWMG | WISPK----NGGTNYAQKFQG | RVTMTRDTSVYMELNRLRSDDTAVYYCAR | DGTG---------SFDY | WGQGTLVTVSS |
| iPS.4 02223 | 21-225_30A11 | VH1|1-02/D1|1-1|RF1/JH4 | QVQLVQS-GAEVKKPGASVKVSCKASG-YTFT | D-------YHMH | WVRQAPGKGLEWMG | WINPN----RGGTNYAQKFQG | RVTMTRDTSISTAYMELSRLRSDDTAVYYCAR | DGTG---------SFDY | WGQGTLVTVSS |
| VH3|3-33/D6|6-6|RF1/JH6 | Germline | | | | | | | |
| iPS.4 26114 | 21-225_28H2 | VH3|3-33/D6|6-6|RF1/JH6 | QVQLVES-GGGVVQPGRSLRLSCAASG-FTFS | N-------YVMH | WVRQAPGKGLEWVA | VIWYD----GSNKYYADSVKG | RFTISRDNSKNTLYLQMNSLRAVDTAVYYCAR | EEYSSGW-------YDYGMDV | WGQGTTVTVSS |

FIGURE 51 (Continued)

| | | | | | | | | | |
|---|---|---|---|---|---|---|---|---|---|
| iPS:4 26116 | 21-225_29E2 | VH3|3-33|D6|6-6|RF1|JH6 | QVQLVES-GGGVVQPGRSLRL SCAASG-FTFS | N-----CVMH | WVRQAPGK GLEWVA | VIWYD---GSNKYYADS VKG | RITISRDNSKNTLYLQMNSL RAEDTAVYYCAR | EEYSSW------YDYGMDV | WGQGT TVTVS S |
| iPS:4 68812 | 21-225_48H4 | VH3|3-33|D6|6-6|RF1|JH6 | QVQLVES-GGGVVQPGRSLRL SCAASG-FTFS | D-----SLMH | WVRQAPGK GLEWVA | VIWYD---GSNKYYTDS VKG | RFTISRDNSKNTLYLQMNSL RAEDTAVYYCAR | ERYSSGW------YGYGMDV | WGQGT TVTVS S |
| iPS:4 68816 | 21-225_52G8 | VH3|3-33|D6|6-6|RF1|JH6 | QVQLVES-GGGVVQPGRSLRL SCAASG-FTFS | S-----YGMH | WVRQAPGK GLEWVA | VIWYD---GSNKYYADS VKG | RFTISRDNSKNTLYLQMNSL RAEDTALYYCAR | RYSSSW------SGGMDV | WGQGT TVTVS S |
| iPS:4 68826 | 21-225_201C5 | VH3|3-33|D6|6-6|RF1|JH6 | QVQLVES-GGGVVQPGRSLRL SCAASG-FTFS | D-----YVMH | WVRQAPGK GLEWVA | VIWYD---GSNKYYVDS VKG | RFTISRDNSRNTLYLQMNSL RAEDTAVYYCAR | ERYSSGL------YDYGMDV | WGQGT TVTVS S |
| iPS:4 68842 | 21-225_50H4 | VH3|3-33|D6|6-6|RF1|JH6 | QVQLVES-GGGVVQPGRSLRL SCAASG-FTFS | S-----YVMH | WVRQAPGK GLEWVA | AIWYD---GSNKYYADS VKG | RFTISRDNSKNTLQLQMNSL RAEDTAVYYCAR | ELYSSNW------YDYGMDV | WGQGT TVTVS S |
| iPS:4 68858 | 21-225_148C9 | VH3|3-33|D6|6-6|RF1|JH6 | QVQLVES-GGGVAQPGRSLRL SCAASG-FTFS | D-----YGMH | WVRQAPGK GLEWVA | VIWYD---GSNKYYADS VKG | RFTISRDNSKNTLYLQMNSL RAEDTAVYYCAR | ERYSSGW------YDYGLDV | WGQGT TVTVS S |
| iPS:4 68860 | 21-225_224E7 | VH3|3-33|D6|6-6|RF1|JH6 | QVQLVES-GGGVVQPGRSLSL SCAASG-FTFS | S-----YVMH | WVRQAPGK GLEWVA | VIWYD---GSNKYYADS VKG | RFTISRDNSKNTLYLQMNSL RAEDTAVYYCAR | EQYSSSW------YDFGLDV | WGQGT TVTVS S |
| iPS:4 33917 | 21-225_43E11 | VH3|3-33|D6|6-6|RF1|JH6 | QVQLVES-GGGVVQPGRSLRL SCAASG-FSFS | D-----YGMH | WVRQAPGK GLEWVA | VIWYD---GSNKYYADS VKG | RLTISRDNSKNTLYLQMNSL RAEDTAVYYCAR | RIVRSW------VGGMDV | WGQGT TVTVS S |
| iPS:4 33919 | 21-225_44B3 | VH3|3-33|D6|6-6|RF1|JH6 | QVQLVES-GGGVVQPGRSLRL SCAASG-FTFS | D-----YGMH | WVRQAPGK GLEWVA | VIWYD---GSNKYYADS VKG | RFTISRDNSKNTLYLQMNSL RAEDTAVYYCAR | ERYSSGW------YDYGMDV | WGQGT TVTVS S |
| iPS:4 33923 | 21-225_44D3 | VH3|3-33|D6|6-6|RF1|JH6 | QVQLVES-GGGVVQPGRSLRL SCAASG-FTFS | S-----YVMH | WVRQAPGK GLEWVA | VIWYD---GSNKYYADS VKG | RFTISRDNSKNTLYLQMNSL RAEDTAVYYCAR | ERYSSGL------YDYGMDV | WGQGT TVTVS S |
| iPS:4 33929 | 21-225_44D5 | VH3|3-33|D6|6-6|RF1|JH6 | QVQLVES-GGGVVQPGRSLRL SCAASG-FTFS | S-----YVMH | WVRQAPGK GLEWVA | VIWYD---GSNKYYADS VKG | RFTISRDNSKNTLYLQMNSL RAEDTAVYYCAR | VPYSSSW------YDYGMDV | WGQGT TVTVS S |
| iPS:4 33935 | 21-225_44F9 | VH3|3-33|D6|6-6|RF1|JH6 | QVQLVES-GGGVVQPGRSLRL SCAASG-FTFS | S-----YVMH | WVRQAPGK GLEWVA | VIWID---GSNKYYADS VKG | RFTISRDMGSKNTLYLQMNSL RAEDTAVYYCAR | EEYSSSW------YDYGMDV | GGQGT TVTVS S |

FIGURE 51 (Continued)

| | | | | | | | | |
|---|---|---|---|---|---|---|---|---|
| iPS:4 33937 | 21-225_44B10 | VH3/3-33/D6/6-6/RF1/JH6 | QVQLVES-GGGVVQPGRSLRLSCVASG-FTFS | S------YGMH | WVRQAPGK GLEWVA | VIWYD----GSNKYYADS VKG | RFTISRDNSKNTLYLQMNSL RAEDTAVYYCAR | RYSSSW--------VGGMDV | WGQGT TVTVS S |
| iPS:4 33939 | 21-225_44C10 | VH3/3-33/D6/6-6/RF1/JH6 | QVQLVES-GGGVVQPGRSLRLSCAASG-FTFS | D------CVMH | WVRQAPGK GLEWVA | VIWYD----GSNKYYADS VKG | RFTISRDNSKNTLYLQMNSL RAEDTAVYYCAR | ERYSSGL-------YDYGMDV | WGQGT TVTVS S |
| iPS:4 33951 | 21-225_45B4 | VH3/3-33/D6/6-6/RF1/JH6 | QVQLVES-GGGVVQPGRSLRLSCAASG-FTFS | D------CVMH | WVRQAPGK GLEWVA | VIWYD----GSNKYYADS VKG | RFTISRDNSKNTLYLQMNSL RAEDTAVYYCAR | ERYSSGL-------YDYGMDV | WGQGT TVTVS S |
| iPS:4 33955 | 21-225_45B8 | VH3/3-33/D6/6-6/RF1/JH6 | QVQLVES-GGGVVQPGRSLRLSCAASG-FTFS | D------CVMH | WVRQAPGK GLEWVA | VIWYD----GSNKYYADS VKG | RFTISRDNSKNTLYLQMNSL RAEDTAVYYCAR | ERYSSGL-------YDYGMDV | WGQGT TVTVS S |
| iPS:4 33967 | 21-225_46C3 | VH3/3-33/D6/6-6/RF1/JH6 | QVQLVES-GGGVVQPGRSLRLSCAASG-FTFS | S------YVMH | WVRQAPGK GLEWVA | VIWYD----GSNKYYADS VKG | RFTISRDNSKNTLYLQMNSL RAEDTAVYYCAR | ERYSSGL-------YDYGMDV | WGQGT TVTVS S |
| iPS:4 33971 | 21-225_46D4 | VH3/3-33/D6/6-6/RF1/JH6 | QVQLVES-GGGVVQPGRSLRLSCAASG-FTFS | S------YVMH | WVRQAPGK GLEWVA | VIWYD----GSNKYYADS VKG | RFTISRDNSKNTLYLQMNSL RAEDTAVYYCAR | VFYSSSW-------YDYGMDV | WGQGT TVTVS S |
| iPS:4 33979 | 21-225_46E9 | VH3/3-33/D6/6-6/RF1/JH6 | QVQLVES-GGGVVQPGRSLRLSCAASG-FTFS | S------YGMH | WVRQAPGK GLEWVA | VIWYD----GSNKYYADS VKG | RITISRDNSKNTLYLQMNSL RAEDTAVYYCAR | RYSSSW--------MGGMDV | WGQGT TVTVS S |
| iPS:4 33985 | 21-225_47C1 | VH3/3-33/D6/6-6/RF1/JH6 | QVQLVES-GGGVVQPGRSLRLSCAASG-FTFS | D------YGMH | WVRQTPGK GLEWVA | VIWYD----GSNKYYADS VKG | RFTISRDNSKNTLFLQMNSL RDEDTAVYYCAR | RYSRSW--------VGGMDV | WGQGT TVTVS S |
| iPS:4 33991 | 21-225_47E7 | VH3/3-33/D6/6-6/RF1/JH6 | QVQLVES-GGGVVQPGRSLRLSCAASG-FTFS | I------YGMH | WVRQAPGK GLEWVA | VIWYD----GSNKYYADS VKG | RFTISRDNSKNTLYLQMNSL RAEDTAVYYCAR | RYSRSW--------VGGMDV | WGQGT TVTVS S |
| iPS:4 34001 | 21-225_48F2 | VH3/3-33/D6/6-6/RF1/JH6 | QVQLVES-GGGVVQPGRSLRLSCAASG-FTFS | N------YVMH | WVRQAPGK GLEWVA | VIWYD----GSNKYYADS VKG | RFTISRDNSKNTLYLQMNSL RAEDTAVYYCAR | ERYSSSW-------YDYGLDV | WGQGT TVTVS S |
| iPS:4 34021 | 21-225_49C1 | VH3/3-33/D6/6-6/RF1/JH6 | QVQLVES-GGGVVQPGRSLRLSCTASG-FTFS | S------YGMH | WVRQAPGK GLEWVA | VIWYD----GSNKYYADS VKG | RFTISRDNSKNTLYLQMNSL RAEDTAVYYCAR | RYSSSW--------SGGMDV | WGQGT TVTVS S |
| iPS:4 34025 | 21-225_49G3 | VH3/3-33/D6/6-6/RF1/JH6 | QVQLVES-GGGVVQPGRSLRLSCAASG-FTFS | S------YGMH | WVRQAPGK GLEWVA | VIWYD----GSNKYYADS VKG | RFTISRDNSKNTLYLQMNSL RAEDTAVYYCAR | RYSSSW--------SGGMDV | WGQGT TVTVS S |

FIGURE 51 (Continued)

| | | | | | | | | |
|---|---|---|---|---|---|---|---|---|
| iPS:4 34031 | 21-225_49E7 | VH3J3-33|D6|6-6|RF1/JH6 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTALYYCAR | RYSSSW------ ------SGGMDV | WGQGT TVTVS S |
| iPS:4 34033 | 21-225_49F9 | VH3J3-33|D6|6-6|RF1/JH6 | QVQLVES-GGGVVQPGRSLRL SCAASG-FTFS | S------YGMH | WVRQAPGK GLEWVA | LIWYD---- GRNKYYADS VKG | RFTISRDNFKNTLYLQMNSL RAEDTAVYHCAR | RYSSSW------ ------SGGMDV | WGQGT TVTVS S |
| iPS:4 34053 | 21-225_51E1 | VH3J3-33|D6|6-6|RF1/JH6 | QVQLVES-GGGVVQPGRSLRL SCAASG-FTFS | S------YGMH | WVRQAPGK GLEWVA | VIWYD---- GSSKYYADS VKG | RFTISRDNSKNTLYLQMNSL RAEDTAVYYCAR | RYSSSW------ ------SGGMDV | WGQGT TVTVS S |
| iPS:4 34093 | 21-225_52D10 | VH3J3-33|D6|6-6|RF1/JH6 | QVQLVES-GGGVVQPGRSLRL SCAASG-FTFS | S------YGMH | WVRQAPGK GLEWVA | LIWYD---- GSNKYYADS VKG | RFTISRDNSKNTLYLQMNSL RAEDTAVYYCAR | RYSSSW------ ------SGGMDV | WGQGT TVTVS S |
| iPS:4 34137 | 21-225_54D4 | VH3J3-33|D6|6-6|RF1/JH6 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | RYSSSW------ ------SGGMDV | WGQGT TVTVS S |
| iPS:4 34149 | 21-225_55H1 | VH3J3-33|D6|6-6|RF1/JH6 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | RYSSSW------ ------SGGMDV | WGQGT TVTVS S |
| iPS:4 34151 | 21-225_55C2 | VH3J3-33|D6|6-6|RF1/JH6 | QVQLVES-GGGVVQPGRSLRL SCAASG-FTFS | S------YGMH | WVRQAPGK GLEWVA | LIWYD---- GSNKYYADS VKG | RFTISRDNSKNTLYLQMNSL RAEDTAVYYCAR | RYSSSW------ ------SGGMDV | WGQGT TVTVS S |
| iPS:4 34161 | 21-225_55F9 | VH3J3-33|D6|6-6|RF1/JH6 | QVQLVES-GGGVVQPGRSLRL SCAASG-FTFS | S------YGMH | WVRQAPGK GLEWVA | VIWYD---- GNGKYYADS VKG | RFTISRDNSKNTLYLQMNSL RAEDTAVYYCAR | RYSSSW------ ------SGGMDV | WGQGT TVTVS S |
| iPS:4 34201 | 21-225_59A12 | VH3J3-33|D6|6-6|RF1/JH6 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | RYSSSW------ ------SGGMDV | WGQGT TVTVS S |
| iPS:4 34205 | 21-225_60G2 | VH3J3-33|D6|6-6|RF1/JH6 | QVQLVES-GGGVVQPGRSLRL SCAASG-FTFS | S------YGMH | WVRQAPGK GLEWVA | LIWYD---- GSNKYYADS VKG | RFTISRDNSKNTLYLQMNSL RAEDTAVYYCAR | RYSSSW------ ------DGGMDV | WGQGT TVTVS S |
| iPS:4 34223 | 21-225_60C12 | VH3J3-33|D6|6-6|RF1/JH6 | QVQLVES-GGGVVQPGRSLRL SCAASG-FTFS | S------YGMH | WVRQAPGK GLEWVA | VIWYD---- GSNKYYVDS VKG | RFTISRDNSKNTLYLQMNSL RAEDTAVYYCAR | RYSRSW------ ------TGGMDV | WGQGT TVTVS S |
| iPS:4 34231 | 21-225_61F2 | VH3J3-33|D6|6-6|RF1/JH6 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | ERYSSGW------ ------YDYGMDV | WGQGT TVTVS S |

FIGURE 51 (Continued)

| | | | | | | | | | |
|---|---|---|---|---|---|---|---|---|---|
| iPS:4 34233 | 21-225_61B3 | VH3-33/D6-6/RF1/JH6 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | RYSRSW------ ------AGGMDV | WGQGT TVTVS S |
| iPS:4 34303 | 21-225_58H11 | VH3-33/D6-6/RF1/JH6 | QVQLVES-GGGVVQPGRSLRL SCAASG-FTFS | S------YGMH | WVRQAPGK GLEWVA | VIWYD---- GSNKYHADS VKG | RFTISRDNSKNTLYLQMNSL RAEDTAVYYCAR | RYSSSW------ ------DGGMDV | WGQGT TVTVS S |
| iPS:4 34339 | 21-225_64A4 | VH3-33/D6-6/RF1/JH6 | QVQLVES-GGGVVQPGRSLRL SCAASG-FTFS | D------YVMH | WVRQAPGK GLEWVA | VIWYD---- GSNKYYADS VKG | RFTISRDNSQNTLYLQMNSL RAEDTAVYYCAR | ERYSSW------ ------YDYGMDV | WGQGT TVTVS S |
| iPS:4 34343 | 21-225_64C8 | VH3-33/D6-6/RF1/JH6 | QVQLVES-GGGVVQPGRSLRL SCAASG-FTFS | D------YVMH | WVRQAPGK GLEWVA | VIWYD---- GSNKYYADS MKG | RFTISRDNSKNTLYLQMNSL RAEDTAVYYCAR | ERYSSGW------ ------YDYGMDV | WGQGT TVTVS S |
| iPS:4 34387 | 21-225_66D11 | VH3-33/D6-6/RF1/JH6 | QVQLVES-GGGVVQPGRSLRL SCAASG-FTFS | S------YGMH | WVRQAPGK GLEWVA | VIWYD---- GSNKYYADS VKG | RFTISRDNSKNTLSLQMNSL RAEDTALYYCAR | EMYSSNW------ ------YDYGLDV | WGQGT TVTVS S |
| iPS:4 34469 | 21-225_73C9 | VH3-33/D6-6/RF1/JH6 | QVQLVES-GGGVVQPGRSLRL SCAASG-FTFS | N------YVMH | WVRQAPGK GLEWVA | VIWYD---- GSNKYYADS VKG | RFTISRDNSKNTLYLQINSL RAEDTAVYYCAR | ERYSSW------ ------FDYGMDV | WGQGT TVTVS S |
| iPS:4 35197 | 21-225_94F3 | VH3-33/D6-6/RF1/JH6 | QVQLVES-GGGVVQPGRSLRL SCAASG-FTFS | N------DIMH | WVRQAPGK GLEWVA | VIWYD---- GSNKYYADS VKG | RFTISRDNSKNTLYLQMNSL RAEDTAVYFCAR | ERYSSGW------ ------YDYGMDV | WGQGT TVTVS S |
| iPS:4 35315 | 21-225_147B2 | VH3-33/D6-6/RF1/JH6 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | RYSSSW------ ------SGGMDV | WGQGT TVTVS S |
| iPS:4 35325 | 21-225_147H5 | VH3-33/D6-6/RF1/JH6 | QVQLVES-GGGVVQPGRSLRL SCAASG-FTFS | D------YGMH | WVRQAPGK GLEWVA | VIWYD---- GSNKYYADS VKG | RLIISRDNSKNTLYLQMNSL SAEDTAVYYCAR | ERYSSW------ ------YDYGLDV | WGQGT TVTVS S |
| iPS:4 35329 | 21-225_147A8 | VH3-33/D6-6/RF1/JH6 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | RYSSSW------ ------TGGMDV | WGQGT TVTVS S |
| iPS:4 35349 | 21-225_148F5 | VH3-33/D6-6/RF1/JH6 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | RYSSSW------ ------SGGMDV | WGQGT TVTVS S |
| iPS:4 35359 | 21-225_148H10 | VH3-33/D6-6/RF1/JH6 | QVQLVES-GGGVVQPGRSLRL SCAASG-FTFS | S------YGMH | WVRQAPGK GLEWVA | VIWYD---- GSNKYYGDS VKG | RFTISRDNSKNTLYLQMNSL RAEDTAVYYCAR | RYSSSW------ ------SGGMDV | WGQGT TVTVS S |

FIGURE 51 (Continued)

| | | | | | | | | |
|---|---|---|---|---|---|---|---|---|
| iPS:4 35393 | 21-225_149D10 | VH3|3-33/D6|6-6|RF1/JH6 | QVQLVES-GGGVVQPGRSLRL SCAASG-FTFS | D------YGMH | WVRQAPGK GLEWVA | VIWYD---GSNKYYADS VKG | RLTISRDNSKNTLYLQMNSL RAEDTAVYYCAR | ERYSGW------------YDYGMDV | WGQGT TVTVS S |
| iPS:4 35401 | 21-225_150E2 | VH3|3-33/D6|6-6|RF1/JH6 | QVQLVES-GGGVVQPGRSLRL SCAASG-FTFS | S------YVMH | WVRQAPGK GLEWVA | VIWYD---GSNKYYADS VKG | RFTISRDNSKNTLYLQMNSL RAEDTAVYYCAR | EEYSSSW-----------YGYGMDV | WGQGT TVTVS S |
| iPS:4 35417 | 21-225_150D11 | VH3|3-33/D6|6-6|RF1/JH6 | QVQLVES-GGGVVQPGRSLRL SCAASG-FTFS | S------YGMH | WVRQAPGK GLEWVA | VIFYD---GSNKHYADS VKG | RFTISRDNSKNTLYLQMNSL RAEDTAVYYCTR | RFSSSW-------------SGGMDV | WGQGT TVTVS S |
| iPS:4 35445 | 21-225_152F7 | VH3|3-33/D6|6-6|RF1/JH6 | QVQLVES-GGGVVQPGRSLRL SCAASG-FTFS | S------YIMH | WVRQAPGK GLEWVA | VIWYD---GSNKYYADS VKG | RFTISRDNSKNTLYLQMNSL RAEDTAVYYCAR | EEYSSSW-----------YGYGMDV | WGQGT TVTVS S |
| iPS:4 35469 | 21-225_153G9 | VH3|3-33/D6|6-6|RF1/JH6 | QVQLVES--GGGVVQPGRSLRL SCAASG-FTFS | S------YGMH | WVRQAPGK GLEWVA | LIFYD---GSNKYYADS VKG | RFTISRDNSKNTLYLQINSL RAEDTAVYFCAR | RYSRSW-------------AGGMDV | WGQGT AVTVS S |
| iPS:4 35573 | 21-225_159D8 | VH3|3-33/D6|6-6|RF1/JH6 | QVQLVES-GGGVVQPGRSLRL SCAASG-FTFS | M------YVMH | CVRQAPGK GLEWVA | VIWYD---GSNKYYADS VKG | RFTISRDNSKNTLYLQMNSL RAEDTAVYYCAR | EFYSGW------------YDYGMDV | WGQGT TVTVS S |
| iPS:4 35681 | 21-225_169D11 | VH3|3-33/D6|6-6|RF1/JH6 | QVQLVES-GGGVVQPGRSLRL SCAASG-FTFS | D------YVMH | WVRQAPGK GLEWVA | VIWYD---GSNKYYADS VKG | RFTISRDNSKNTLYLQLNSL RAEDTAVYYCAR | ERYSSGW------------YDYGMDV | WGQGT TVTVS S |
| iPS:4 35689 | 21-225_170F3 | VH3|3-33/D6|6-6|RF1/JH6 | QVQLVES-GGGVVQPGRSLRL SCAASG-FSFS | D------YVMH | WVRQAPGK GLEWVA | VIWYD---GSNKYEDS VKG | RFTISRDNSKNTLYLQMNSL RAEDTAVYYCAR | ETYSSSW------------YDYGMDV | WGQGT TVTVS S |
| iPS:4 35733 | 21-225_173C11 | VH3|3-33/D6|6-6|RF1/JH6 | QVQLVES-GGGVVQPGRSLRL SCAASG-FTFS | S------YGIH | WVRQAPGK GLEWVA | LIFYD---GSNKYYADS VKG | RFTISRDNSKNTLYLHMSSL RAEDTAVYYCAR | RYSSSW-------------SGGMDV | WGQGT TVTVS S |
| iPS:4 35741 | 21-225_174G10 | VH3|3-33/D6|6-6|RF1/JH6 | QVQLVES-GGGVVQPGRSLRL SCAASG-FTFS | D------YVMH | WVRQAPGK GLEWVA | VIWYD---GSNKYYADS VKG | RFTISRDNSKNTLYLQLNSL RAEDTAVYYCAR | ERYSGW-------------YDYGMDV | WGQGT TVTVS S |
| iPS:4 35763 | 21-225_176H2 | VH3|3-33/D6|6-6|RF1/JH6 | QVQLVES-GGGVVQPGRSLRL SCAASG-FTFS | D------YVMH | WVRQAPGK GLEWVA | VIWYD---GSNKYYADS VKG | RFTISRDNSKNTLYLQMNSL RAEDTAVYYCAR | EKYSSNW------------YDYGMDV | WGQGT TVTVS S |
| iPS:4 35767 | 21-225_177B4 | VH3|3-33/D6|6-6|RF1/JH6 | QVQLVES-GGGVVQPGRSLRL SCAASG-FTFS | D------YVMH | WVRQAPGK GLEWVA | VIWYD---GSNKYYADS VKG | RFIVSRDNSKNTLYLQMNSL RAEDTAVYYCAR | ERYSSSW------------YDYGLDV | WGQGT TVTVS S |

FIGURE 51 (Continued)

| | | | | | | | | |
|---|---|---|---|---|---|---|---|---|
| iPS:4 35785 | 21-225_179C2 | VH3j3-33/D6j6-6jRF1/JH6 | QVQLVES-GGGVVQPGRSLRL SCAASG-FTFS | S------YGMH | WVRQAPGK GLEWVA | LIFYD---- GSNKYYADS VKG | RFTISRDNSKNTLFLQMNSL RAEDTAVYYCAR | RYSGSW--------- ----------SGGMDV | WGQGT TVTVS S |
| iPS:4 35921 | 21-225_190D6 | VH3j3-33/D6j6-6jRF1/JH6 | QVQLVES-GGGVVQPGRSLRL SCAASG-FTFS | S------FIMH | WVRQAPGR GLEWVA | VIWYD---- GSNKYYADS VKG | RFTISRDNSKNTLYLQMNSL RAEDTAVYYCAR | EEYSGW--------- ----------FGYGMEV | WGQGT TVTVS S |
| iPS:4 35961 | 21-225_192A2 | VH3j3-33/D6j6-6jRF1/JH6 | QVQLVES-GGGVVQPGRSLRL SCAASG-FTFS | S------YGMH | WVRQAPGK GLEWLA | VIWYD---- GSNKYYADS VKG | RFTISRDNSKNTLYLQMNSL RAEDTAVYYCAR | EDSPYSGYA------ ----------LDYFYGMDV | WGQGT TVTVS S |
| iPS:4 39985 | 21-225_192F6 | VH3j3-33/D6j6-6jRF1/JH6 | QVQLVES-GGGVVQPGRSLRL SCAASG-FTFS | S------FIMH | WVRQAPGR GLEWVA | VIWYD---- GSNKYYADS VKG | RFTISRDNSKNTLYLQMNSL RAEDTAVYYCAR | EEYSGW--------- ----------FGYGMDV | WGQGT TVTVS S |
| iPS:4 36039 | 21-225_193F8 | VH3j3-33/D6j6-6jRF1/JH6 | QVQLVES-GGGVVQPGRSLRL SCAASG-FTFS | T------YGMD | WVRQAPGK GLEWVA | VIWYD---- GSYKYYADS VKG | RFTISRDNSKNTLYLQMNSL RVEDTAVYYCVR | EDSPYSGYG------ ----------LDYYYGMDV | WGQGT TVTVS S |
| iPS:4 36074 | 21-225_194F10 | VH3j3-33/D6j6-6jRF1/JH6 | QVQLVES-GGGVVQPGRSLRL SCAASG-FTFS | S------FIMH | WVRQAPGR GLEWVA | VIWYD---- GSNKYYADS VKG | RFTISRDNSKNTLYLEMNSL RAEDTAVYYCAR | EEYSGW--------- ----------FGYGMDV | WGQGT TVTVS S |
| iPS:4 36264 | 21-225_203F7 | VH3j3-33/D6j6-6jRF1/JH6 | QVQLVES-GGGVVQPGRSLRL SCAASG-FTFS | D------YVMH | WVRQAPGK GLEWVA | VIWYD---- GSNKYYVDS VKG | RFTISRDNSRNTLYLQMNSL RAEDTAVYYCAR | ERYSSGL-------- ----------YDYGMDV | WGQGT TVTVS S |
| iPS:4 36274 | 21-225_204H3 | VH3j3-33/D6j6-6jRF1/JH6 | QVQLVES-GGGVVQPGRSLRL SCAASG-FTFS | D------CVMH | WVRQAPGK GLEWVA | VIWYD---- GSNKYYVDS VKG | RFTISRDNSKNTLYLQMNSL RAEDTAVYYCAR | EPYSSGW-------- ----------YDYGMDV | SGQGT TVTVS S |
| iPS:4 36332 | 21-225_208B2 | VH3j3-33/D6j6-6jRF1/JH6 | QVQLVES-GGGVVQPGRSLRL SCAASG-FTFS | D------CVMH | WVRQAPGK GLEWVT | VIWYD---- GSNKYYADS VKG | RFTISRDNSRNTLYLQMNSL RAEDTAVYYCAR | ERYSSGL-------- ----------YDYGLDV | WGQGT TVTVS S |
| iPS:4 36352 | 21-225_210G5 | VH3j3-33/D6j6-6jRF1/JH6 | QVQLVES-GGGVVQPGRSLRL SCAASG-FTFS | D------YVMH | WVRQAPGK GLEWVA | VIWYD---- GSNKYYVDS VKG | RFTISRDNSRNTLYLQMNSL RAEDTAVYYCAR | ERYSSGL-------- ----------YDYGLDV | WGQGT TVTVS S |
| iPS:4 36386 | 21-225_212B11 | VH3j3-33/D6j6-6jRF1/JH6 | QVQLVES-GGGVVQPGRSLRL SCAASG-FTFS | D------YVMH | WVRQAPGK GLEWVA | VIWYD---- GSNKYYADS VKG | RFTISRDNSKNTLYLQMNSL RAEDTAVYYCAR | ERYSSGW-------- ----------YDYGMDV | WGQGT TVTVS S |
| iPS:4 36412 | 21-225_214H9 | VH3j3-33/D6j6-6jRF1/JH6 | QVQLVES-GGGVVQPGRSLRL SCAASG-FTFS | S------YVMH | WVRQAPGK GLEWVA | VIWYD---- GSNKYYADS VKG | RFTISRDNSKNTLYLQMNSL RAEDTAVFYCAR | ERYSSW--------- ----------YDYGMDV | WGQGT TVTVS S |

FIGURE 51 (Continued)

| | | | | | | | | |
|---|---|---|---|---|---|---|---|---|
| iPS:4 36414 | 21-225_214G10 | VH3j3-33jD6j6-6jRF1jJH6 | QVQLVES-GGGVVQPGRSLRL SCAASG-FTFS | D------YVMH | WVRQAPGK GLEWVT | VIWYD---GSNKYYADS VKG | RFTISRDNSKNTLYLQMNSL RAEDTAVYYCAR | ERYSSGW------ ------YDYGMDV | WGQGT TVTVS S |
| iPS:4 36416 | 21-225_214G12 | VH3j3-33jD6j6-6jRF1jJH6 | QVQLVES-GGGVVQPGRSLRL SCAASG-FTFS | D------YVMH | WVRQAPGK GLEWVT | VIWYD---GSNKYYADS VKG | RFTISRDNSKNTLYLQMNSL RAEDTAVYYCAR | ERYSSGW------ ------YDYGMDV | WGQGT TVTVS S |
| iPS:4 36418 | 21-225_215E3 | VH3j3-33jD6j6-6jRF1jJH6 | QVQLVES-GGGVVQPGRSLRL SCAASG-FTFS | D------YVIH | WVRQAPGK GLEWVT | VIWYD---GSNKYYADS VKG | RFTISRDNSKNTLYLQMNSV RAEDTAVYYCAR | ERYSSGW------ ------YDYGMDV | WGQGT TVTVS S |
| iPS:4 36428 | 21-225_215E11 | VH3j3-33jD6j6-6jRF1jJH6 | QVQLVES-GGGVVQPGRSLRL SCAASG-FTFS | D------YVMH | WVRQAPGK GLEWVT | VIWYD---GSNKYYADS VKG | RFTISRDNSKNTLYLQMNSL RAEDTAVYYCAR | ERYSSGW------ ------YDYGMDV | WGQGT TVTVS S |
| iPS:4 36438 | 21-225_216E8 | VH3j3-33jD6j6-6jRF1jJH6 | QVQLVES-GGGVVQPGRSLRL SCAASG-FTFS | D------YVMH | WVRQAPGK GLEWVT | VIWYD---GSNKYYADS VKG | RFTISRDNSKNTLYLQMNSL RAEDTAVYYCAR | ERYSSGW------ ------YDYGMDV | WGQGT TVTVS S |
| iPS:4 36440 | 21-225_216H12 | VH3j3-33jD6j6-6jRF1jJH6 | QVQLVES-GGGVVQPGRSLRL SCAASG-FTFS | D------YVMH | WVRQAPGK GLEWVT | VIWYD---GSNKYYADS VKG | RFTISRDNSKNTLYLQMNSL RAEDTAVYYCAR | ERYSSGW------ ------YDYGMDV | WGQGT TVTVS S |
| iPS:4 36450 | 21-225_217E5 | VH3j3-33jD6j6-6jRF1jJH6 | QVQLVES-GGGVVQPGRSLRL SCAASG-FTFS | D------YVMH | WVRQAPGK GLEWVT | VIWYD---GSNKYYADS VKG | RFTISRDNSKNTLYLQMNSL RAEDTAVYYCAR | ERYSSGW------ ------YDYGMDV | WGQGT TVTVS S |
| iPS:4 36456 | 21-225_217G10 | VH3j3-33jD6j6-6jRF1jJH6 | QVQLVES-GGGVVQPGRSLRL SCAASG-FTFS | D------YVMH | WVRQAPGK GLEWVT | VIWYD---GSNKYYADS VKG | RFTISRDNSKNTLYLQMNSL RAEDTAVYYCAR | ERYSSGW------ ------YDYGMDV | WGQGT TVTVS S |
| iPS:4 36458 | 21-225_217H12 | VH3j3-33jD6j6-6jRF1jJH6 | QVQLVES-GGGVVQPGRSLRL SCAASG-FTFS | D------YVMH | WVRQAPGK GLEWVT | VIWYD---GSNKYYADS VKG | RFTISRDNSKNTLYLQMNSL RAEDTAVYYCAR | ERYSSGW------ ------YDYGMDV | WGQGT TVTVS S |
| iPS:4 36462 | 21-225_218C4 | VH3j3-33jD6j6-6jRF1jJH6 | QVQLVES-GGGVVQPGRSLRL SCAASG-FTFS | D------YVMH | WVRQAPGK GLEWVT | VIWYD---GSNKYYADS VKG | RFTISRDNSKNTLYLQMNSL RAEDTAVYYCAR | ERYSSGW------ ------YDYGMDV | WGQGT TVTVS S |
| iPS:4 36480 | 21-225_220F8 | VH3j3-33jD6j6-6jRF1jJH6 | QVQLVES-GGGVVQPGRSLRL SCAASG-FTFS | D------YVMH | WVRQAPGK GLEWVA | VIWYD---GSNKYYADS VKG | RFTISRDNSKNTLYLQMNSL RAEDTAVYYCAR | ERYSSGW------ ------YDYGMDV | WGQGT TVTVS S |
| iPS:4 36534 | 21-225_224F1 | VH3j3-33jD6j6-6jRF1jJH6 | QVQLVES-GGGVVQPGRSLRL SCAASG-FTFS | S------YIMH | WVRQAPGR GLEWVA | VIWYD---GSNKYYADS VKG | RFTISRDNSKNTLYLQMNSL RAEDTAVYYCAR | ERYSSNW------ ------YDYGMDV | WGQGT TVTVS S |

FIGURE 51 (Continued)

| | | | | | | | | |
|---|---|---|---|---|---|---|---|---|
| iPS:4 36540 | 21-225_224F3 | VH3\|3-33/D6\|6-6\|RF1/JH6 | QVQLVES-GGGVVQPGRSLRL SCAASG-FSFS | S------YGMH | WVRQAPGK GLEWVA | VIWYD---GSNKYADS VKG | RFTISRDNSKNTLYLQMNSL RAEDTAVYYCAR | ERYSSSW-------------YDYGMDV | WGQGT TVTVS S |
| iPS:4 36564 | 21-225_225A1 | VH3\|3-33/D6\|6-6\|RF1/JH6 | QVQLVES-GGGVVQPGRSLRL SCAASG-FTFS | D------YVIH | WVRQAPGK GLEWVA | VIWYD---GSNKYADS VKG | RFTISRDNSKNTLYLQMNSL RAEDTAVYYCAR | ERYSSGW-------------YDYGMDV | WGQGT TVTVS S |
| iPS:4 36596 | 21-225_226C6 | VH3\|3-33/D6\|6-6\|RF1/JH6 | QVQLVES-GGGVVQPGRSLRL SCAASG-FTFS | D------YGMH | WVRQAPGK GLEWVA | VIWYD---GSNKYADS VKG | RFTISRDNSKNTLYLQTNSL RAEDTAVYYCAR | ERYSSSW-------------YDYGMDV | WGQGT TVTVS S |
| iPS:4 36620 | 21-225_226H11 | VH3\|3-33/D6\|6-6\|RF1/JH6 | QVQLVES-GGGVVQPGRSLRL SCAASG-FTFS | N------CGMH | WVRQAPGK GLEWVT | VIWYD---GSNKYADS VKG | RFTISRDNSKNTLYLQMNSL RAEDTAVYYCAR | ELYSSSW-------------YDYGLDV | WGQGT TVTVS S |
| iPS:4 36744 | 21-225_154F4 | VH3\|3-33/D6\|6-6\|RF1/JH6 | QVQLVES-GGGVVQPGRSLRL SCAASG-FTFS | S------YGMH | WVRQAPGK GLEWVA | VIWYD---GSNKYADS VKG | RFTISRDNSKNTLYLQMNSL RAEDTAVYYCAR | EDSYCSGTSC----PYYYYGMDV | WGQGT TVTVS S |
| iPS:4 36946 | 21-225_183F4 | VH3\|3-33/D6\|6-6\|RF1/JH6 | QVQLVES-GGGVVQPGRSLRL SCAASG-FTFS | S------YGMH | WVRQAPGK GLEWVA | VIWYD---GSNKYADS VKG | RFTISRDNSKNTLYLQMNSL RAEDTAVYYCAR | ERTYCSGTTC----PYYYYGLGV | WGQGT TVTVS S |
| iPS:4 37286 | 21-225_208F1 | VH3\|3-33/D6\|6-6\|RF1/JH6 | QVQLVES-GGGVVQPGRSLRL SCAASG-FTFS | D------YYMH | WVRQAPGK GLEWVA | VIWYD---GSNKYVDS VKG | RFTISRDNSRNTLYLQMNSL RAEDTAVYYCAR | ERYSSGL-------------YDYGMDV | WGQGT TVTVS S |
| iPS:4 37290 | 21-225_210G6 | VH3\|3-33/D6\|6-6\|RF1/JH6 | QVQLVES-GGGVVQPGRSLRL SCAASR-FTFS | D------YYMH | WVRQAPGK GLEWVA | VIWYD---GSNKYVDS VKG | RFTISRDNSRNTLYLQMNSL RAEDTAVYYCAR | ERYSSGL-------------YDYGMDV | WGQGT TVTVS S |
| iPS:3 92634 | 21-225_17H3 | VH3\|3-33/D6\|6-6\|RF1/JH6 | QVQLVES-GGGVVQPGRSLRL SCAASG-FTFS | N------CVMH | WVRQAPGK GLEWVA | VIWYD---GSNKYADS VKG | RFTISRDNSKNTLYLQMNSL RAEDTAVYYCAR | EKYSSSW-------------YDYGMDV | WGQGT TVTVS S |
| iPS:3 92742 | 21-225_20B2 | VH3\|3-33/D6\|6-6\|RF1/JH6 | QVQLVES-GGGVVQPGRSLRL SCAASG-FTFS | N------YVIH | WVRQAPGK GLEWVA | VIWYD---GSNKYVDS VKG | RFTISRDNSKNTLYLQMNSL RAEDTAVYYCAR | EKYSSSW-------------YDYGMDV | WGQGT TVTVS S |
| iPS:3 92836 | 21-225_22F4 | VH3\|3-33/D6\|6-6\|RF1/JH6 | QVQLVES-GGGVVQPGRSLRL SCAASG-FTFS | D------YGMH | WVRQAPGK GLEWVA | VIWYD---GSNKYADS VKG | RFTISRDNSKNTLYLQMNSL RAEDTAVYYCAR | EKYSSSW-------------YDYGMDV | WGQGT TVTVS S |
| iPS:3 92846 | 21-225_24B6 | VH3\|3-33/D6\|6-6\|RF1/JH6 | QVQLVES-GGGVVQPGRSPRL SCAASG-FIFS | N------YVMH | WVRQAPGK GLEWVA | VIWYD---GSNKYVDS VKG | RFTISRDNSKNTLYLQMNSL RAEDTAVYYCAR | EEYSSGW-------------YDYGMDV | WGQGT TVTVS S |

FIGURE 51 (Continued)

| | | | | | | | | | |
|---|---|---|---|---|---|---|---|---|---|
| iPS:3 92884 | 21-225_23A10 | VH3|3-33|D6|6-6|RF1|JH6 | QVQLVES-GGGVVQPGRSLRLSCAASG-FTFS | S------YGMH | WVRQAPGK GLEWVA | VIWYD----GSNKYYADS VKG | RFTISRDNSKNTLYLQMNSL RAEDTAVYYCAR | ERYSSGW--------HDYGMDV | WGQGT TVTVS S |
| iPS:3 92888 | 21-225_25A2 | VH3|3-33|D6|6-6|RF1|JH6 | QVQLVES-GGGVVQPGRSLRLSCAASG-FTFS | S------YGMH | WVRQAPGK GLEWVA | VIWYD----GSNKYYADS VKG | RFTISRDNSKNTLYLQMNSL RAEDTAVYYCAR | RYSSSW---------SGGMDV | WGQGT TVTVS S |
| iPS:3 92914 | 21-225_25D12 | VH3|3-33|D6|6-6|RF1|JH6 | QVQLVES-GGGVVQPGRSLRLSCAASG-FTFS | S------DGMH | WVRQAPGK GLEWVA | VIWYD----GSNKYYADS VKG | RFTISRDNSKNTLYLQMNSL RAEDTAVYYCAR | ERYSSSW--------YDYGMDV | WGQGT TVTVS S |
| iPS:3 92924 | 21-225_32H2 | VH3|3-33|D6|6-6|RF1|JH6 | QVQLVES-GGGVVQPGRSLRLSCAASG-FTFS | S------YGMH | WVRQAPGK GLEWVA | VIWYD----GSNKYYADS VKG | RFTISRDNSKNTLNLQMNSL RAEDTGVYYCAR | RYSSSW---------TGGMDV | WGQGT TVTVS S |
| iPS:3 92938 | 21-225_29H4 | VH3|3-33|D6|6-6|RF1|JH6 | QVQLVES-GGGVVQPGRSLRLSCAASG-FTFS | S------YGIH | WVRQAPGK GLEWVA | VIWYD----GSNKYYADS VKG | RFTISRDNSKNTLYLQMNSL RAEDTAVYYCAR | RYSSSW---------SGGMDV | WGQGT TVTVS S |
| iPS:3 92974 | 21-225_26A11 | VH3|3-33|D6|6-6|RF1|JH6 | QVQLVES-GGGVVQPGRSLRLSCAASG-FTFS | N------CVMH | WVRQAPGK GLEWVA | VIWYD----GSNKYYADS VKG | RFTISRDNSNNTLYLQMNSL RAEDTAVYYCAR | EERYSSGW-------YDYGMDV | WGQGT TVTVS S |
| iPS:3 93012 | 21-225_26G7 | VH3|3-33|D6|6-6|RF1|JH6 | QVQLVES-GGGVVQPGRSLRLSCAASG-FTFS | S------YGMH | WVRQAPGK GLEWVA | VIWYD----GSNKYYADS VKG | RFTISRDNSKNTLYLQMNSL RAEDTAVYYCAR | RYSSSW---------SGGMDV | WGQGT TVTVS S |
| iPS:3 93176 | 21-225_27E7 | VH3|3-33|D6|6-6|RF1|JH6 | QVQLVES-GGGVVQPGRSLRLSCAASG-FTFS | S------YGMH | WVRQAPGK GLEWVA | VIWYD----GSNKYYADS VKG | RFTISRDNSKNTLYLQMNSL RAEDTAVYYCAR | EDSYCSSTSC-----FYYYYGMDV | WGQGT TVTVS S |
| iPS:3 93864 | 21-225_4C5 | VH3|3-33|D6|6-6|RF1|JH6 | QVQLVES-GGGVVQPGRSLRLSCAASG-FTFS | S------YVLH | WVRQAPGK GLEWVA | VIWYD----GSNKYYADS VKG | RFTISRDNSKNTLYLQMNSL RAEDTAVYYCAR | ERYTSSW--------YDYGMDV | WGQGT TVTVS S |
| iPS:3 93902 | 21-225_14E10 | VH3|3-33|D6|6-6|RF1|JH6 | QVQLVES-GGGVVQPGRSLRLSCAASG-FTFS | D------YGMH | WVRQAPGK GLEWVA | VIWYD----GSNKYYADS VKG | RFTISRDNSKNTLYLQMNSL RAEDTAVYYCAR | EKYSSSW--------YDYGMDV | WGQGT TVTVS S |
| iPS:3 93908 | 21-225_10E9 | VH3|3-33|D6|6-6|RF1|JH6 | QVQLVES-GGGVVQPGRSLRLSCAASG-FTFS | N------YVIH | WVRQAPGK GLEWVA | VIWYD----GSNKYYADS VKG | RFTISRDNSKNTLYLQMNSL RAEDTAVYYCAR | EKYSSSW--------YDYGMDV | WGQGT TVTVS S |
| iPS:3 93916 | 21-225_2G4 | VH3|3-33|D6|6-6|RF1|JH6 | QVQLVES-GGGVVQPGRSLRLSCAASG-FTFS | S------YVMH | WVRQAPGK GLEWVA | VIWYD----GSNKYYADS VKG | RFTISRDNSKNTLYLQMNSL RAEDTAVYYCAR | EKYSSSW--------YDYGMDV | WGHGT TVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 93950 | 21-225_3H10 | VH3}3-33|D6|6-6|RF1/JH6 | QVQLVES-GGGVVQPGRSLRL SCAASG-FTFS | S------YVMH | WVRQAPGK GLEWVA | VIWYD----GSNKYYADS VKG | RFTISRDMSKNTLYLQMNSL RAEDTAVYYCAR | ERYSSGW------YDYGLDV | WGQGT TVTVS S |
| iPS:3 93972 | 21-225_7C9 | VH3}3-33|D6|6-6|RF1/JH6 | QVQLVES-GGGVVQPGRSLRL SCAASG-LTFS | N------YVMH | WVRQAPGK GLEWVA | VIWYD----GSNKYYADS VKG | RFTISRDNSKNTLYLQMNSL RAEDTAVYYCAR | ERYSSSW------YDYGMDV | WGQGT TVTVS S |
| iPS:3 93978 | 21-225_4C12 | VH3}3-33|D6|6-6|RF1/JH6 | QVQLVES-GGGVVQPGRSLRL SCAASG-FTFS | S------YVMH | WVRQAPGK GLEWVA | VIWYD----GSNKYYADS VKG | RFTISRDNSKNTLYLQMNSL RAEDTAVYYCAR | ERYSSNW------YDYGMDV | WGHGT TVTVS S |
| iPS:3 93986 | 21-225_7G4 | VH3}3-33|D6|6-6|RF1/JH6 | QVQLVES-GGGVVQPGRSLRL SCAASG-FTFN | N------YVMH | WVRQAPGK GLEWVA | VIWYD----GSNKYYADS VKG | RFTISRDNSKNTLYLQMTSL RAEDTAVYYCAR | ERYSSNW------YDYGMDV | WGQGT TVTVS S |
| iPS:3 93996 | 21-225_15C11 | VH3}3-33|D6|6-6|RF1/JH6 | QVQLVES-GGGVVQPGRSLRL SCAASG-FTFS | D------YVMH | WVRQAPGK GLEWVA | VIWYD----GSNKYYADS VKG | RFTISRDNSKNTLYLQMNSL RAEDTAVYYCAR | ERYSSSW------YDYGLDV | WGQGT TVTVS S |
| iPS:3 94041 | 21-225_5E5 | VH3}3-33|D6|6-6|RF1/JH6 | QVQLVES-GGGVVQPGRSLRL SCAASG-FTFS | N------YVMH | WVRQAPGK GLEWVA | VIWYD----GSNKYYADS VKG | RFTISRDNSKNTLYLQMNSL RAEDTAVYYCTR | EVYSSGW------YDYGMDV | WGQGT TVTVS S |
| | Germline | VH3}3-33|D2|2-8|RF3/JH4 | QVQLVES-GGGVVQPGRSLRL SCAASG-FTFS | S------YGMH | WVRQAPGK GLEWVA | VIWYD----GSNKYYADS VKG | RFTISRDNSKNTLYLQMNSL RAEDTAVYYCAR | DRLG----------IFDY | WGQGT LVTVS S |
| iPS:4 26118 | 21-225_7A10 | VH3}3-33|D2|2-8|RF3/JH4 | QVQLVES-GGGVVQPGRSLRL SCAASG-FNFS | S------YGMH | WVRQAPGK GLEWVA | VIWYD----GSNKYYADS VKG | RFTISRDNSKNTLYLQMHSL RAEDTAVYYCAR | DERLG---------IFDY | WGQGT LVTVS S |
| iPS:3 93844 | 21-225_3G7 | VH3}3-33|D2|2-8|RF3/JH4 | QVQLVES-GGGVVQPGRSLRL SCAASG-FNFS | N------YGMH | WVRQAPGK GLEWVA | VIWYD----GSNKYYVDS VKG | RFTISRDNSKNTLYLQMNSL RAEDTAVYYCAR | DERLG---------IFDY | WGQGT LVTVS S |
| iPS:3 93852 | 21-225_12A10 | VH3}3-33|D2|2-8|RF3/JH4 | QVQLVES-GGGVVQPGRSLRL SCAASG-FTFS | S------YGMH | WVRQAPGK GLEWVA | VIWHD----ESNKYYTDS VKG | RFTISRDNSKNTLYLQMNSL RAEDTAVYYCAR | DERLG---------IFDY | WGQGT LVTVS S |
| iPS:3 93868 | 21-225_9C11 | VH3}3-33|D2|2-8|RF3/JH4 | QVQLVES-GGGVVQPGRSLRL SCAASG-FTFS | S------YGMH | WVRQAPGK GLEWVA | VIWHD----ETNKYYADS VKG | RFTISRDNSKNTLSLQMNSL RAEDTAVYYCAR | DERLG---------IFDY | WGQGT LVTVS S |
| iPS:3 93900 | 21-225_10E12 | VH3}3-33|D2|2-8|RF3/JH4 | QVQLVES-GGGVVQPGRSLRL SCAASG-FNFS | N------YGMH | WVRQVPGK GLEWVA | VIWHD----GSNKYYVDS VKG | RFTISRDNSKNTLSLQMNSL RAEDTAVYCCAR | DERLG---------IFDY | WGQGT LVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 93920 | 21-225_1H12 | VH3-33/D2/2-8/RF3/JH | QVQLVES-GGGVVQSGRSLRL SCAASG-FNFS | S------YGMH | WVRQAPGK GLEWVA | IIWHD---- GSNKYYVDS VKG | RFTISRDNSKNTLYLQMNSL RAEDTAVYYCAR | DERLG--------IFDY | WGQGT LVTVS S |
| iPS:3 93932 | 21-225_10F5 | VH3-33/D2/2-8/RF3/JH 4 | QVQLVES-GGGVVQPGRSLRL SCAASG-FNFS | S------YGMH | WVRQAPGK GLEWVS | IIWHD---- GSNKYYVDS VKG | RFTISRDNSKNTLYLQMNSL RAEDSAVYYCAR | DERLG--------IFDY | WGQGT LVTVS S |
| | Germline | | QVQLVES-GGGVVQPGRSLRL SCAASG-FTFS | ------YGMH | WVRQAPGK GLEWVA | VIWHD---- GSNKYYADS VKG | RFTISRDNSKNTLYLQMNSL RAEDTAVYYCAR | ----------YYFDY | WGQGT LVTVS S |
| | VH3-33 D6/6-6/RF1/JH4 | | | | | | | | |
| iPS:4 26124 | 21-225_32D6 | VH3-33/D6/6-6/RF1/JH 4 | QVQLVES-GGGVVQPGRSLRL SCAASG-FTFS | S------YGMH | WVRQAPGK GLEWVT | VIWHD---- GSNAYYVDS VKG | RFTISRDNSKNTLYLQMNSL RAEDTAVYYCAR | ENSSS--------YYFDY | WGQGT LVTVS S |
| iPS:3 92922 | 21-225_30G4 | VH3-33/D6/6-6/RF1/JH 4 | QVQLVES-GGGVVQPGRSLRL SCAASG-FTFS | S------YGMH | WVRQAPGK GLEWVS | VIWYD---- GTDKYYVDS VKG | RFTISRDNSKNTLYLQMNSL RAEDSAVYYCAR | ENSSS--------YYFDY | WGQGT LVTVS S |
| iPS:3 93002 | 21-225_30G1 | VH3-33/D6/6-6/RF1/JH 4 | QVQLVES-GGGVVQPGRSLRL SCAASG-FTFS | Y------YGMH | WVRQAPGK GLEWVA | VIWHD---- GSNKYYVDS VKG | RFTISRDNSKNTLYLQMNSL RAEDTAVYYCAR | ENSSS--------YYFDY | WGQGT LVTVS S |
| iPS:3 93066 | 21-225_34D3 | VH3-33/D6/6-6/RF1/JH 4 | QVQLVES-GGGVVQPGRSLRL SCAASG-FTFS | Y------YGMH | WVRQAPGK GLEWVA | VIWYD---- GSNKYYVDS VKG | RFTISRDNSKNTLYLQMNSL RAEDTAVYYCAR | ENSSS--------FYFDY | WGQGT LVTVS S |
| iPS:3 93092 | 21-225_33C12 | VH3-33/D6/6-6/RF1/JH 4 | QVQLVES-GGGVVQPGRSLRL SCAASG-FTFS | H------YGMH | WVRQAPGK GLEWVA | VIWHD---- GSNKYYADS VKG | RFTISRDNSKNTLYLQMNSL RAEDTAVYYCAR | ENSSS--------YYFDY | WGQGT LVTVS S |
| iPS:3 93100 | 21-225_36B8 | VH3-33/D6/6-6/RF1/JH 4 | QVQLVES-GGGVVQPGRSLRL SCAASG-FTFS | N------YGMH | WVRQAPGK GLEWVA | VIWHD---- GSNKYYGDS VKG | RFTISRDNSKNTLYLQMNSL RAEDTAVYYCAR | ENSSS--------YYFDY | WGQGT LVTVS S |
| iPS:3 93122 | 21-225_33B2 | VH3-33/D6/6-6/RF1/JH 4 | QVQLVES-GGGVVQPGRSLRL SCAASG-FTFS | N------YGMH | WVRQAPGK GLEWVA | VIWHD---- GSNKYYADS VKG | RFTISRDNSKNTLYLQMNSL RAEDTAVYYCAR | ENSSS--------YYFDY | WGQGT LVTVS S |
| iPS:3 93134 | 21-225_34C2 | VH3-33/D6/6-6/RF1/JH 4 | QVQLVES-GGGVVQPGRSLRL SCAASG-FTFS | N------YVMH | WVRQAPGK GLEWVA | LIWYD---- GSNKYYADS VKG | RFTISRDNSKNTLYLQMNSL RAEDTAVYYCAR | ENSSS--------YYFDY | WGQGT LVTVS S |
| iPS:3 93136 | 21-225_34D8 | VH3-33/D6/6-6/RF1/JH 4 | QVQLVES-GGGVVQPGRSLRL SCAASG-FTFS | N------YGMH | WVRQAPGK GLEWVA | VIWYD---- GSNKYYADS VKG | RFTISRDNSKNTLYLQMNSL RAEDTAVYYCAR | ENSSS--------YYFDY | WGQGT LVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3/3-30.3/D6/6-19/RF2/JH6 | | QVQLVES-GGGVVQPGRSLRL SCAASG-FTFS | N------YAMH | WVRQAPGK GLEWVA | VISYD------ GSNKYYADS VKG | RFTISRDNSKNTLYLQMNSL RAEDTAVYYCAR | STAVKSSS | WGQGT LVTVSS |
| iPS:4 51135 | VH3/3-30.3/D6/6-19/RF2/JH6 | QVQLVES-GGGVVQPGRSLRL SCAASG-FTFS | N------YGMH | WVRQAPGK GLEWVA | VISYD------ GSNKYYADS VKG | RFTISRDNSNTLYLQMNTL RAEDTAVYYCAR | RGAVAP------ YYGMDV | WGQGT TVTVS S |
| | Germline | H_FR1 | H_CDR1 | H_FR2 | H_CDR2 | H_FR3 | H_CDR3 | H_FR4 |
| VH1/1-08/D6/6-19/RF1/JH5 | | QVQLVQS-GAEVKKPGASVKV SCKASG-YTFT | N------YDIN | WVRQATGQ GLEWMG | WMNPN------ SGNTGYAQK FQG | RVTMTRNTSISTAYMELSSL RSEDTAVYYCAR | CSEWN------ WFDP | WGQGT LVTVS S |
| iPS:4 51137 | VH1/1-08/D6/6-19/RF1/JH5 | QVQLVQS-GAEVKKPGASVKV SCKASG-YTFT | N------YDIN | WVRQATGQ GLEWMG | WMNPN------ SGNTGYAQK FQG | RVTMTRNTSISTAYMELSSL RSEDTAVYYCAV | SSGWN------ WFDP | WGQGT LVTVS S |
| iPS:4 34285 | VH1/1-08/D6/6-19/RF1/JH5 | QVQLVQS-GAEVKKPGASVKV SCKASG-YTFT | N------YDIN | WVRQATGQ GLEWMG | WMNPN------ SVNTGYAQK FQG | RVTMTRDTSISTAYMELSSL RSEDTAVYYCAI | SSGWN------ WFDP | WGQGT LVTVS S |
| iPS:4 34287 | VH1/1-08/D6/6-19/RF1/JH5 | QVQLVQS-GAEVKKPGASVKV SCKASG-YTFT | N------YDIN | WVRQATGQ GLEWMG | WMNPN------ SGNTGYAQK FQG | RVTMTRNTSISTAYMELSSL RSEDTAVYYCAI | SSGWY------ RFDP | WGQGT LVTVS S |
| iPS:4 34479 | VH1/1-08/D6/6-19/RF1/JH5 | QVQLVQS-GAEVKKPGASVKV SCKASG-YTFT | N------YDIN | WVRQVPGQ GLEWMG | WMHPN------ SGNTGFAQK FQG | RVTMTRNTSISTAYMELSSL RSEDTAVYYCAI | SSGWY------ WFDP | WGQGT LVTVS S |
| iPS:4 34481 | VH1/1-08/D6/6-19/RF1/JH5 | QVQLVQS-GAEVKKPGASVKV SCKASG-YTFT | N------YDIN | WVRQATGQ GLEWMG | WMNPN------ SGNTGYAQK FQG | RVTMTRNTSISTAYMELSSL RSEDTAVYYCAI | SSGWY------ WFDP | WGQGT LVTVS S |
| iPS:4 34483 | VH1/1-08/D6/6-19/RF1/JH5 | QVQLVQS-GAEVKKPGASVKV SCKASG-YTFT | N------YDIN | WVRQATGQ GLEWMG | WMNPN------ SGNTGYAQK FQG | RVTMTRNTSISTAHMELSSL RSEDTAVYYCAV | SSGWN------ WFDP | WGQGT LVTVS S |
| iPS:4 34493 | VH1/1-08/D6/6-19/RF1/JH5 | QVQLVQS-GAEVKKPGASVKV SCKASG-YTFT | N------YDIN | WVRQATGQ GLEWMG | WMNPN------ SGNTGYAQK FQG | RVTMTRNTSISTAYMELSSL RSEDTAVYYCAV | SSGWY------ WFDP | WGQGT LVTVS S |
| iPS:4 34509 | VH1/1-08/D6/6-19/RF1/JH5 | QVQLVQS-GAEVKKPGASVKV SCKASG-YTFT | N------YDIN | WVRQATGQ GLEWMG | WMNPN------ SGNTGYAQK FQG | RVTMTRNTSISTAYMELSSL RSEDTAVYYCAS | SSGWY------ WFDP | WGQGT LVTVS S |
| iPS:4 34513 | VH1/1-08/D6/6-19/RF1/JH5 | QVQLVQS-GAEVKKPGASVKV SCKASG-YTFT | N------YDIN | WVRQATGQ GLEWMG | WMNPN------ NGNTGYAQK FQG | RVTMTRNTSISTAYMELNSL RSEDTAVYYCAI | SSGWY------ WFDP | WGQGT LVTVS L |

FIGURE 51 (Continued)

| | | | | | | | | | |
|---|---|---|---|---|---|---|---|---|---|
| iPS:4 34515 | 21-225_74A5 | VH1\|1-08\|D6\|6-19\|RF1/JH5 | QVQLVQS-GAEVKKPGASVKVSCKASG-YTFT | N------YDIN | WVRQAIGQGLEWMG | WMHPN----SGNTGYAQKFQG | RVTMTRNTSISTAYMELSSLRSEDTAVYYCAI | SSGWY------ | ------WFDP | WGQGTLVTVSS |
| iPS:4 34525 | 21-225_76E8 | VH1\|1-08\|D6\|6-19\|RF1/JH5 | QVQLVQS-GAEVKKPGASVKVSCKASG-YTFP | N------YDIN | WVRQAIGQGLEWMG | WMNFN----SGNTGYAQKFQG | RVTMTRNTSISTAYMELSSLRSEDTAVYYCAV | SSGWH------ | ------WFDP | WGQGTLVTVAS |
| iPS:4 34529 | 21-225_76B9 | VH1\|1-08\|D6\|6-19\|RF1/JH5 | QVQLVQS-GAEVKKPGASVKVSCKASG-YTFT | N------YDIN | WVRQVPGQGLEWMG | WMHPN----SGNTGYAQKFQG | RVTMTRNTSISTAYMELSSLRSEDTAVYYCAI | SSGWY------ | ------WFDP | WGQGTLVTVSS |
| iPS:4 34575 | 21-225_77C7 | VH1\|1-08\|D6\|6-19\|RF1/JH5 | QVQLVQS-GAEVKKPGASVKVSCKASG-YTFP | N------YDIN | WVRQAIGQGLEWMG | WMNFN----SGNTGYAQKFQG | RVTMTRNTSISTAYMELSSLRSEDTAVYYCAV | SSGWH------ | ------WFDP | WGQGTLVTVA |
| iPS:4 34583 | 21-225_74B6 | VH1\|1-08\|D6\|6-19\|RF1/JH5 | QVQLVQS-GAEVKKPGASVKVSCKASG-YTFT | N------YDIN | WVRQAIGQGLEWMG | WMHPN----NGNTGYAQKFQG | RVTMTRNTSISTAYMELNSLRSEDTAVYYCAI | SSGWY------ | ------WFDP | WGQGTLVTVSL |
| iPS:4 34587 | 21-225_74G3 | VH1\|1-08\|D6\|6-19\|RF1/JH5 | QVQLVQS-GAEVKKPGASVKVSCKASG-YTFT | N------YDIN | WVRQVPGQGLEWMG | WMHPN----SGNTGYAQKFQG | RVTMTRNTSISTAYMELSSLRSEDTAVYYCAI | SSGWY------ | ------WFDP | WGQGTLVTVSS |
| iPS:4 34597 | 21-225_77C10 | VH1\|1-08\|D6\|6-19\|RF1/JH5 | QVQLVQS-GAEVKKPGASVKVSCKASG-YTFT | N------YDIN | WVRQAIGQGLEWMG | WMHPN----SGNTGYAQKFQG | RVTMTRNTSISTAYMELSSLRSEDTAVYYCAI | SSGWY------ | ------WFDP | WGQGTLVTVSS |
| iPS:4 34603 | 21-225_77D11 | VH1\|1-08\|D6\|6-19\|RF1/JH5 | QVQLVQS-GAEVKKPGASVKVSCKASG-YTFT | N------YDIN | WVRQVPGQGLEWMG | WMHPN----SGNTGYAQKFQG | RVTLTRNTSISTAYMELSSLRSEDTAVYYCAV | SSGWY------ | ------WFDP | WGQGTLVTVSS |
| iPS:4 34613 | 21-225_77D12 | VH1\|1-08\|D6\|6-19\|RF1/JH5 | QVQLVQS-GAEVKKPGASVKVSCKASG-YTFT | N------YDIN | WVRQAIGQGLEWMG | WMHPN----SGNTGYAQKFQG | RVTMTRNTSINTAYMELSSLRSEDTAVYYCAV | SSGWY------ | ------WFDP | WGQGTLVTVSS |
| iPS:4 34617 | 21-225_74B8 | VH1\|1-08\|D6\|6-19\|RF1/JH5 | QVQLVQS-GAEVKKPGASVKVSCKASG-YTFT | N------YDIN | WVRQAIGQGLEWMG | WMHPN----SGNTGYAQKFQG | RVTMTRNTSISTAYMELSSLRSEDTAVYYCAI | SSGWY------ | ------WFDP | WGQGTLVTVSS |
| iPS:4 34619 | 21-225_78C1 | VH1\|1-08\|D6\|6-19\|RF1/JH5 | QVQLVQS-GAEVKKPGASVKVSCKASG-YTFP | N------YDIN | WVRQAIGQGLEWMG | WMHPN----SGNTGYAQKFQG | RVTMTRNTSISTAYMELSSLRSEDTAVYYCAV | SSGWY------ | ------WFDP | WGQGTLVTVSS |
| iPS:4 34639 | 21-225_74B7 | VH1\|1-08\|D6\|6-19\|RF1/JH5 | QVQLVQS-GAEVKKPGASVKVSCKASG-YTFP | N------YDIN | WVRQAIGQGLEWMG | WMNFN----SGNTGYAQKFQG | RVTMTRNTSISTAYMELSSLRSEDTAVYYCAV | SSGWH------ | ------WFDP | WGQGTLVTVSS |

FIGURE 51 (Continued)

| | | | | | | | | |
|---|---|---|---|---|---|---|---|---|
| iPS:4 34653 | 21-225_74B5 | VH1|1-08|D6|6-19|RF1|J H5 | QVQLVQS-GAEVKKPGASVKV SCKASG-YTFT | N------YDIN | WVRQATGQ GLEWMG | WMNPN----SGNTGYAQK FQG | RVTMTRNTSISTAHMELSSL RSEDTAVYYCAV | SSGWN-------WFDP | WGQGT LVTVS S |
| iPS:4 34655 | 21-225_78H12 | VH1|1-08|D6|6-19|RF1|J H5 | QVQLVQS-GAEVKKPGASVKV SCKASG-YTFF | N------YDIN | WVRQATGQ GLEWMG | WMNPN----SGNTGYAQK FQG | RVTMTRNTSISTAYMELSSL RSEDTAVYYCAV | SSGWH-------WFDP | WGQGT LVTVA S |
| iPS:4 34675 | 21-225_79G6 | VH1|1-08|D6|6-19|RF1|J H5 | QVQLVQS-GAEVKKPGASVKV SCKASG-FTFT | N------YDIN | WVRQATGQ GLEWMG | WMHPN----SGNTGFAQK FQG | RVTMTRNTSISTAYMELSSL RSEDTAVYYCAV | SSGWN-------WFDP | WGQGT LVTVS S |
| iPS:4 34689 | 21-225_79G10 | VH1|1-08|D6|6-19|RF1|J H5 | QVQLVQS-GAEVKKPGASVKV SCKASG-YTFT | N------YDIN | WVRQATGQ GLEWMG | WMNPN----SGNTGYAQK FQG | RVTMTRNTSISTAHMELSSL RSEDTAVYYCAV | SSGWN-------WFDP | WGQGT LVTVS S |
| iPS:4 34705 | 21-225_80A2 | VH1|1-08|D6|6-19|RF1|J H5 | QVQLVQS-GAEVKKPGASVKV SCKASG-YTFT | N------YDIN | WVRQVPGQ GLEWMG | WMHPN----SGNTGYAQK FQG | RVTMTRNTSISTAYMELSSL RSEDTAVYYCAI | SSGWY-------WFDP | WGQGT LVTVS S |
| iPS:4 34707 | 21-225_80D3 | VH1|1-08|D6|6-19|RF1|J H5 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAI | SSGWY-------WFDP | WGQGT LVTVS S |
| iPS:4 34731 | 21-225_80E9 | VH1|1-08|D6|6-19|RF1|J H5 | QVQLVQS-GAEVKKPGASVKV SCKASG-YTFT | N------YDIN | WVRQATGQ GLEWMG | WMHPN----SGNTGYAQK FQG | RVTMTRNTSISTAYMELNSL RSEDTAVYYCAI | SSGWY-------WFDP | WGQGT LVTVS L |
| iPS:4 34747 | 21-225_80C12 | VH1|1-08|D6|6-19|RF1|J H5 | QVQLVQS-GAEVKKPGASVKV SCKASG-YTFT | N------YDIN | WVRQATGQ GLEWMG | WMNPN----SGNTGYAQK FQG | RVTMTRNTSISTAHMELSSL RSEDTAVYYCAI | SSGWN-------WFDP | WGQGT LVTVS S |
| iPS:4 34761 | 21-225_81E5 | VH1|1-08|D6|6-19|RF1|J H5 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAI | SSGWY-------WFDP | WGQGT LVTVS S |
| iPS:4 34771 | 21-225_81F9 | VH1|1-08|D6|6-19|RF1|J H5 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAI | SSGWY-------WFDP | WGQGT LVTVS S |
| iPS:4 34793 | 21-225_82A5 | VH1|1-08|D6|6-19|RF1|J H5 | QVQLVQS-GAEVKKPGASVKV SCKASG-YTFT | N------YDIN | WVRQATGQ GLEWMG | WMHPN----NGNTGYAQK FQG | RVTMTRNTSISTAYMELSSL RSEDTAVYYCAI | SSGWY-------WFDP | WGQGT LVTVS L |
| iPS:4 34797 | 21-225_82G5 | VH1|1-08|D6|6-19|RF1|J H5 | QVQLVQS-GAEVKKPGASVKV SCKASG-YTFT | N------YDIN | WVRQVPGQ GLEWMG | WMHPN----SGNTGYAQK FQG | RVTMTRNTSISTAYMELSSL RSEDTAVYYCAI | SSGWY-------WFDP | WGQGT LVTVS S |

FIGURE 51 (Continued)

| | | | | | | | | | |
|---|---|---|---|---|---|---|---|---|---|
| iPS:4 34805 | 21-225_82D9 | VH|1-08/D6|6-19|RF1/J H5 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAI | SSGWY----------WFDP | WGQGT LVTVS S |
| iPS:4 34813 | 21-225_82C12 | VH|1-08/D6|6-19|RF1/J H5 | QVQLVQS-GAEVKKPGASVKV SCKASG-YTFT | N------YDIN | WVRQATGQ GLEWMG | WMHPN---- MGNTGYAQK FQG | RVTMTRNTSISTAYMELSSL RSEDTAVYYCAI | SSGWY----------WFDP | WGQGT LVTVS L |
| iPS:4 34825 | 21-225_83C2 | VH|1-08/D6|6-19|RF1/J H5 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAI | SSGWY----------WFDP | WGQGT LVTVS S |
| iPS:4 34827 | 21-225_83F3 | VH|1-08/D6|6-19|RF1/J H5 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAI | SSGWY----------WFDP | WGQGT LVTVS S |
| iPS:4 34829 | 21-225_83G3 | VH|1-08/D6|6-19|RF1/J H5 | QVQLVQS-GAEVKKPGASVKV SCKASG-YTFT | N------YDIN | WVRQVPGQ GLEWMG | WMHPN---- SGNTGYAQK FQG | RVTMTRNTSISTAYMELSSL RSEDTAVYYCAI | SSGWY----------WFDP | WGQGT LVTVS S |
| iPS:4 34833 | 21-225_83C5 | VH|1-08/D6|6-19|RF1/J H5 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAV | SSGWY----------WFDP | WGQGT LVTVA S |
| iPS:4 34841 | 21-225_83G7 | VH|1-08/D6|6-19|RF1/J H5 | QVQLVQS-GAEVKKPGASVKV SCKASG-YTFT | N------YDIN | WVRQVPGQ GLEWMG | WMHPN---- SGNTGYAQK FQG | RVTLTRNTSISTAYMELSSL RSEDTAVYYCAV | SSGWH----------WFDP | WGQGT LVTVA S |
| iPS:4 34863 | 21-225_84G7 | VH|1-08/D6|6-19|RF1/J H5 | QVQLVQS-GAEVKKPGASVKV SCKASG-YTFT | N------YDIN | WVRQATGQ GLEWMG | WMHPN---- SGNTGYAQK FQD | RVTMTRNTSISTAYMELSSL RSEDTAVYYCAV | SSGWH----------WFDP | WGQGT LVTVS S |
| iPS:4 34877 | 21-225_85H2 | VH|1-08/D6|6-19|RF1/J H5 | QVQLVQS-GAEVKKPGASVKV SCKASG-YTFT | N------YDIN | WVRQVPGQ GLEWMG | WMHPN---- SGNTGYAQK FQG | RVTMTRNTSISTAYMELSSL RSEDTAVYYCAV | SSGWY----------WFDP | WGQGT LVTVS S |
| iPS:4 34883 | 21-225_85B5 | VH|1-08/D6|6-19|RF1/J H5 | QVQLVQS-GAEVKKPGASVKV SCKASG-YTFP | N------YDIN | WVRQATGQ GLEWMG | WMHPN---- SGNTGYAQK FQG | RVTMTRNTSISTAYMELSSL RSEDTAVYYCAI | SSGWY----------WFDP | WGQGT LVTVS S |
| iPS:4 34911 | 21-225_85D11 | VH|1-08/D6|6-19|RF1/J H5 | QVQLVQS-GAEVKKPGASVKV SCKASG-YTFT | N------YDIN | WVRQVPGQ GLEWMG | WMHPN---- SGNTGYAQK FQG | RVTMTRNTSISTAYMELSSL RSEDTAVYYCAI | SSGWY----------WFDP | WGQGT LVTVS S |
| iPS:4 34935 | 21-225_86E9 | VH|1-08/D6|6-19|RF1/J H5 | QVQLVQS-GAEVKKPGASVKV SCKASG-YTFT | N------YDIN | WVRQATGQ GLEWMG | WMHPN---- SGNTGYAQK FQG | RVTMTRSTSTAHMELSSL RSEDTAVYYCAV | SSGWS----------WFDP | WGQGT LVTVS S |

FIGURE 51 (Continued)

| ID | Clone | Gene | FR1 | CDR1 | FR2 | CDR2 | FR3 | CDR3 | FR4 |
|---|---|---|---|---|---|---|---|---|---|
| iPS:4 34957 | 21-225_87A10 | VH1|1-08/D6|6-19|RF1/JH5 | QVQLVQS-GAEVKKPGASVKVSCKASG-YTFT | N------YDIN | WVRQATGQGLEWMG | WMHPN------NGNTGYAQKFQG | RVTMTRNTSISTAYMELSSLRSEDTAVYYCAI | SSGWY------MFDP | WGQGTLVTVSL |
| iPS:4 34971 | 21-225_88G2 | VH1|1-08/D6|6-19|RF1/JH5 | QVQLVQS-GAEVKKPGASVKVSCKASG-YTFT | N------YDIN | WVRQATGQGLEWMG | WMHPN------SGNTGYAQKFQG | RVTMTRNTSISTAYMELSSLRSEDTAVYYCAI | SSGWY------MFDP | WGQGTLVTVSS |
| iPS:4 35051 | 21-225_90D9 | VH1|1-08/D6|6-19|RF1/JH5 | QVQLVQS-GAEVKKPGASVKVSCKASG-YTFT | N------YDIN | WVRQATGQGLEWMG | WMHPN------SGNTGYAQKFQG | RVTMTRNTSISTAYMELSSLRSEDTAVYYCAV | SSGWH------MFDP | WGQGTLVTVA S |
| iPS:4 35071 | 21-225_91F1 | VH1|1-08/D6|6-19|RF1/JH5 | QVQLVQS-GAEVKKPGASVKVSCKASG-YTFT | N------YDIN | WVRQATGQGLEWMG | WMHPN------SGNTGYAQKFQG | RVTMTRNTSISTAYMELSSLRSEDTAVYYCAI | SSGWY------MFDP | WGQGTLVTVSS |
| iPS:4 35087 | 21-225_91G8 | VH1|1-08/D6|6-19|RF1/JH5 | QVQLVQS-GAEVKKPGASVKVSCKASG-YTFP | N------YDIN | WVRQATGQGLEWMG | WMHPN------SGNTGYAQKFQG | RVTMTRNTSISTAYMELSSLRSEDTAVYYCAV | SSGWH------MFDP | WGQGTLVTVSS |
| iPS:4 35203 | 21-225_75A7 | VH1|1-08/D6|6-19|RF1/JH5 | QVQLVQS-GAEVKKPGASVKVSCKASG-YTFT | N------YDIN | WVRQATGQGLEWMG | WMHPN------SGNTGYAQKFQD | RVTMTRNTSISTAHMELSSLRSEDTAVYYCAV | SSGWH------MFDP | WGQGTLVTVSS |
| iPS:4 35211 | 21-225_94E11 | VH1|1-08/D6|6-19|RF1/JH5 | QVQLVQS-GAEVKKPGASVKVSCKASG-YTFT | N------YDIN | WVRQATGQGLEWMG | WMNPN------SGNTGYAQKFQG | RVTMTRNTSISTAHMELSSLRSEDTAVYYCAV | SSGWK------MFDP | WGQGTLVTVSS |
| iPS:4 35227 | 21-225_95G4 | VH1|1-08/D6|6-19|RF1/JH5 | QVQLVQS-GAEVKKPGASVKVSCKASG-YTFT | N------YDIN | WVRQATGQGLEWMG | WMHPN------SGNTGYAQKFQG | RVTMTRNTSISTAHMELSSLRSEDTAVYYCAV | SSGWN------MFDP | WGQGTLVTVSS |
| iPS:4 35245 | 21-225_95E12 | VH1|1-08/D6|6-19|RF1/JH5 | QVQLVQS-GAEVKKPGASVKVSCKASG-YTFT | N------YDIN | WVRQATGQGLEWMG | WMHPN------SGNTGYAQKFQG | RVTMTRNTSISTAYMELSSLRSEDTAVYYCAV | SSGWY------MFDP | WGQGTLVTVSS |
| iPS:4 35247 | 21-225_96G1 | VH1|1-08/D6|6-19|RF1/JH5 | QVQLVQS-GAEVKKPGASVKVSCKASG-YTFT | N------YDIN | WVRQATGQGLEWMG | WMHPN------NGNTGYAQKFQG | RVTMTRNTSISTAYMEINGLRSEDTAVYYCAV | SSGWY------MFDP | WGQGTLVTVSL |
| iPS:4 35249 | 21-225_96E2 | VH1|1-08/D6|6-19|RF1/JH5 | QVQLVQS-GAEVKKPGASVKVSCKASG-YTFT | N------YDIN | WVRQATGQGLEWMG | WMHPN------SGNTGYAQKFQG | RVTLTRNTSISTAYMELSSLRSEDTAVYYCAV | SSGWY------MFDP | WGQGTLVTVSS |
| iPS:4 35255 | 21-225_96D5 | VH1|1-08/D6|6-19|RF1/JH5 | QVQLVQS-GAEVKKPGASVKVSCKASG-YTFT | N------YDIN | WVRQATGQGLEWMG | WMHPN------SGNTGYAQKFQG | RVTMTRSTSISTAHMELSSLRSEDTAVYYCAV | SSGWS------MFDP | WGQGTLVTVSS |

FIGURE 51 (Continued)

| | | | | | | | | | |
|---|---|---|---|---|---|---|---|---|---|
| iPS:4 35279 | 21-225_97H4 | VH|1-08|D6|6-19|RF1|J H5 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAI | SSGWY--------WFDP | WGQGT LVTVS S |
| iPS:4 35327 | 21-225_147G6 | VH|1-08|D6|6-19|RF1|J H5 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAY | SSGWY--------WFDP | WGQGT LVTVS S |
| iPS:4 35437 | 21-225_152F4 | VH|1-08|D6|6-19|RF1|J H5 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAY | SSGWY--------WFDP | WGQGT LVTVS S |
| iPS:4 35701 | 21-225_170F6 | VH|1-08|D6|6-19|RF1|J H5 | QVQLVQS-GAEVKKPGASVKV SCKASG-YTFT | N------YDIN | WVRQATGQ GLEWMG | WMHPN----SGNTGYAQK FQD | RVTMTRNTSISTAYMELSSL RSEDTAVYYCAI | SSGWY--------WFDP | WGQGT LVTVS S |
| iPS:4 35737 | 21-225_174G5 | VH|1-08|D6|6-19|RF1|J H5 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAV | SSGWY--------WFDP | WGQGT LVTVS S |
| iPS:4 36544 | 21-225_224H5 | VH|1-08|D6|6-19|RF1|J H5 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAS | SSGWN--------WFDP | WGQGT LVTVS S |
| iPS:4 36570 | 21-225_225F4 | VH|1-08|D6|6-19|RF1|J H5 | QVQLVQS-GAEVKKPGASVKV SCKASG-YTFT | N------YDIN | WVRQATGQ GLEWMG | WMHPN----SGSTGYAQK FQG | RLIMTRNTSISTVYMELNSL RSEDTAVYYCAS | SSGWY--------WFDP | WGQGT LVTVS S |
| iPS:4 36644 | 21-225_227G9 | VH|1-08|D6|6-19|RF1|J H5 | QVQLVQS-GAEVKKPGASVKV SCKASG-YTFT | N------YDIN | WVRQATGR GLEWMG | WMYPN----SGNTGYAQK FQG | RVTMTRNTSISTAYMELSSL RSEDTAVYYCAL | SSGWY--------WFDP | WGQGT LVTVS S |
| iPS:4 37322 | 21-225_75B1 | VH|1-08|D6|6-19|RF1|J H5 | QVQLVQS-GAEVKKPGASVKV SCKASG-YTFT | N------YDIN | WVRQVPGQ GLEWMG | WMHPN----SGNTGYAQK FQG | RVTMTRNTSISTAYMELSSL RSEDTAVYYCAI | SSGWY--------WFDP | WGQGT LVTVS S |
| iPS:4 37361 | 21-225_74C1 | VH|1-08|D6|6-19|RF1|J H5 | QVQLVQS-GAEVKKPGASVKV SCKASG-YTFT | N------YDIN | WVRQATGQ GLEWMG | WMNFD----SGNTGFAQK FQG | RVTMTRNTSISTAYMELSSL RSEDTAVYYCAV | SSGWY--------WFDP | WGQGT LVTVS S |
| iPS:4 37363 | 21-225_74C10 | VH|1-08|D6|6-19|RF1|J H5 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAI | SSGWY--------WFDP | WGQGT LVTVS S |
| iPS:4 37379 | 21-225_74H2 | VH|1-08|D6|6-19|RF1|J H5 | QVQLVQS-GAEVKKPGASVKV SCKASG-FTFT | N------YDIN | WVRQATGQ GLEWMG | WMHPN----SGNTGFAQK FQG | RVTMTRNTSISTAYMELSSL RSEDTAVYYCAV | SSGWY--------WFDP | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 46094 | 21-225_77E1 | VH1f1-08/D6f6-19|RF1/JH5 | QVQLVQS-GAEVKKPGASVKV SCKASG-YTFP | N------YDIN | WVRQATGQ GLEWMG | WMNPN------ SGNTGYAQK FQG | RVTMTRNTSISTAYMELSSL RSEDTAVYYCAV | SSGWH------- -----WFDP | WGQGT LVTVS S |
| iPS:4 51129 | 21-225_94D2 | VH1f1-08/D6f6-19|RF1/JH5 | QVQLVQS-GAEVKKPGASVKV SCKASG-FTFT | N------YDIN | WVRQATGQ GLEWMG | WMHPN------ SGNTGFAQK FQG | RVTMTRNTSISTAYMELSSL RSEDTAVYYCAV | SSGWY------- -----WFDP | WGQGT LVTVS S |
| iPS:4 51133 | 21-225_95H4 | VH1f1-08/D6f6-19|RF1/JH5 | QVQLVQS-GAEVKKPGASVKV SCKASG-YTFT | N------YDIN | WVRQATGQ GLEWMG | WMNPN------ SGNTGYAQK FQG | RVTMTRNTSTSTAHMELSSL RSEDTAVYYCAV | SSGWH------- -----WFDP | WGQGT LVTVS S |
| iPS:3 98510 | 21-225_25A3 | VH1f1-08/D6f6-19|RF1/JH5 | QVQLVQS-GAEVKKPGASVKV SCKASG-YIFT | N------YDIN | WVRQATGQ GLEWMG | WMHPN------ SGNTGYAQK FQG | RVTMTRNTSISTANMELSSL RSEDTAVYYCAS | SSGWY------- -----WFDP | WGQGT LVTVS S |
| iPS:3 98516 | 21-225_26A9 | VH1f1-08/D6f6-19|RF1/JH5 | QVQLVQS-GAEVKKPGASVKV SCKASG-YTFP | N------YDIN | WVRQATGQ GLEWMG | WMHPN------ SGNTGCAQK FQG | RVTMTWNMSISTAYMELSSL RSEDTAVYYCAS | SSGWY------- -----WFDP | WGQGT LVTVS S |
| | Germline | | H_FR1 | H_CDR1 | H_FR2 | H_CDR2 | H_FR3 | H_CDR3 | H_FR4 |
| | VH3f3-30.3D|5-18|RF3/JH4 | | | | | | | | |
| iPS:4 51139 | 21-225_71A6 | VH3f3-30.3/D5|5-18|RF3/JH4 | QVQLVES-GGGVVQPGRSLRL SCAASG-FTFS | N------YGMH | WVRQAPGK GLEWVA | VISYD------ GSNEYYADS VKG | RFTISRDNSKNTLYLQMNSL RAEDTAVYYCAR | DHRYGV------ ----RGGFDY | WGQGT LVTVS S |
| | Germline | | H_FR1 | H_CDR1 | H_FR2 | H_CDR2 | H_FR3 | H_CDR3 | H_FR4 |
| | VH1f1-18|D6f6-19|RF2/JH6 | | | | | | | | |
| iPS:4 51143 | 21-225_66H11 | VH1f1-18/D6f6-19|RF2/JH5 | QVQLVQS-GAEVKKPGASVKV SCKASG-YTFA | T------YGIS | WVRQAPGQ GLEWMG | WISAY------ NGNTNYAQK LQG | RVTMTDTSTSTAYMELRSL RSDDTAVYYCAR | GEAVA------- -----VFDP | WGQGT LVTVS S |
| iPS:4 34361 | 21-225_65D5 | VH1f1-18/D6f6-19|RF2/JH5 | QVQLVQS-GAEVKKPGASVKV SCKASG-YTFP | S------YGIS | WVRQAPGQ GLEWMG | WISAY------ SGNTNYAQK LQG | RVTMTDTSTSTAYMELRSL RSDDTAVYFCAR | GEAVA------- -----VFDP | WGQGT LVTVS S |
| | Germline | | H_FR1 | H_CDR1 | H_FR2 | H_CDR2 | H_FR3 | H_CDR3 | H_FR4 |
| | VH3f3-33|D4f4-23|RF2/JH6 | | | | | | | | |
| iPS:4 53445 | 21-225_148E10 | VH3f3-33/D4f4-23|RF2/JH6 | QVQLVES-GGGVVQPGRSLRL SCAASG-FTFS | S------YGMH | WVRQAPGK GLEWVA | VIWFD------ GSNKIYYDS VKD | RFTISRDNSKNTLYLQMNSL RAEDTAVYYCAR | DRVEGSGTP--- ----YYYYGMDV | WGQGT TVTVS S |

FIGURE 51 (Continued)

| | | | | | | | | |
|---|---|---|---|---|---|---|---|---|
| iPS:4_36082 | 21-225_195D9 | VH3|3-33|D4|4-23|RF2|JH6 | QVQLVES-GGGVVQPGRSLRLSCAASG-FTFS | H------YVMH | WVRQAPGKGLEWVA | VIWYD----GTNKYYADSVKG | RFTISRDNSKNTLYLQMNSLRAEDTAVYYCAR | DWFGEGN-------YYGMDV | WGQGTTVTVSS |
| iPS:4_36118 | 21-225_196A10 | VH3|3-33|D4|4-23|RF2|JH6 | QVQLVES-GGGVVQPGRSLRLSCAASG-FTFS | H------YVMH | WVRQAPGKGLEWVA | VIWYD----GTNKYYADSVKG | RFTISRDNSKNTLYLQMNSLRAEDTAVYYCAR | DWFGEGN-------YYGMDV | WGQGTTVTVSS |
| iPS:4_36670 | 21-225_147D9 | VH3|3-33|D4|4-23|RF2|JH6 | QVQLVES-GGGVVQPGRSLRLSCAASG-FTFS | S------YGMH | WVRQAPGKGLEWVA | DIWFD----GSNKYYVDSVKD | RFTISRDNSKNTLYLQMNSLRAEDTAVYYCAR | DRVEGSGTP-----YYYYGMDV | WGQGTTVTVSS |
| iPS:4_36720 | 21-225_151H6 | VH3|3-33|D4|4-23|RF2|JH6 | QVQLVES-GGGVVQPGRSLRLSCAASG-FTFS | D------YGMH | WVRQAPGKGLEWVA | LIWYD----GSNKYYADSVKG | RFTISRDNSKNTLYLQMNSLRAEDTAVYYCAR | DDRSCSRTSC----PYYYYGLDV | WGQGTTVTVSS |
| iPS:4_36726 | 21-225_152G5 | VH3|3-33|D4|4-23|RF2|JH6 | QVQLVES-GGGVVQPGRSLRLSCAASG-FTFS | D------YGMH | WVRQAPGKGLEWVA | LIWYD----GSNKYYADSVKG | RFTISRDNSKNTLYLQMNSLRAEDTAVYYCAR | DDRSCSRTSC----PYYYYGLDV | WGQGTTVTVSS |
| iPS:4_36732 | 21-225_152B12 | VH3|3-33|D4|4-23|RF2|JH6 | QVQVVES-GGGVVQPGRSLRLSCAASG-FTFS | D------YGMH | WVRQAPGKGLEWVA | VIWYD----GSNKYYADSVKG | RFTISRDNSKNTLYLQMNSLRAEDTAVYYCAR | DDRSCSRTSC----PYYYYGLDV | WGQGTTVTVSS |
| iPS:4_36734 | 21-225_153A8 | VH3|3-33|D4|4-23|RF2|JH6 | QVQLMES-GGGVVQPGRSLRLSCAASG-FTFS | D------YGMH | WVRQAPGKGLEWVA | LIWYD----GSNKYYADSVKG | RFTISRDNSKNTLYLQMNSLRAEDTAVYYCAR | DDRSCSRTSC----PYYYYGLDV | WGQGTTVTVSS |
| iPS:4_36736 | 21-225_153E8 | VH3|3-33|D4|4-23|RF2|JH6 | QVQLVES-GGGVVQPGRSLRLSCAASG-FTLS | N------YGMH | WVRQAPGKGLEWVA | VIWFD----GSNKYYVDSVKD | RFTISRDNSKNTLYLQMNSLRAEDTAVYYCAR | DRVEGSGTP-----YYYYGMDV | WGQGTTVTVSS |
| iPS:4_36756 | 21-225_146A10 | VH3|3-33|D4|4-23|RF2|JH6 | QVQLEES-GGGVVQPGRSLRLSCAASG-FTFS | G------YGMH | WVRQAPGKGLEWMT | LIRYD----GSDKNYADSVKG | RFTISRDNSKNTLYLQMNSLRAEDTAVYYCAR | DRVFCSSTSCL---SYYYYGMDV | WGQGTTVTVSS |
| iPS:4_36766 | 21-225_158D10 | VH3|3-33|D4|4-23|RF2|JH6 | QVQLVES-GGGVVQPGRSLRLSCAASG-FTFS | S------YGMH | WVRQAPGKGLEWVA | VIWYD----GSNKYYADSVKG | RFTISRDNSKNTLYLQMNSLRAEDTAVYYCAR | DRVSCSSTSC----PYYYYGMDV | WGQGTTVTVSS |
| iPS:4_36768 | 21-225_159H8 | VH3|3-33|D4|4-23|RF2|JH6 | QVQLVES-GGGVVQPGRSLRLSCAASG-FTFS | T------YGMH | WVRQAPGKGLEWVA | VIWYD----GSNKYYADSVKG | RFTISRDNSKNTLYLQMNSLRAEDTAVYYCAR | DRVSCSSTSC----PYYYYGMDV | WGQGTTVTVSS |
| iPS:4_36770 | 21-225_160B12 | VH3|3-33|D4|4-23|RF2|JH6 | QVQLVES-GGGVVQPGRSLRLSCAASG-FTFS | S------YGMH | WVRQAPGKGLEWVA | VIWYD----GSNKYYADSVKG | RFTISRDNSKNTLYLQMNSLRAEDTAVYYCAR | DRVSCSSTSC----PYYYYGMDV | WGQGTTVTVSS |

FIGURE 51 (Continued)

| | | | | | | | | |
|---|---|---|---|---|---|---|---|---|
| iPS:4 36782 | 21-225_166G11 | VH3\|3-33\|D4\|4-23\|RF2\|JH6 | QVQLVES-GGGVVQPGRSLRLSCAASG-FTFN | G------YGMH | WVRQAPGKGLEWVA | VIWYD----GSNKYYADSVKG | RFTISRDTSKNTLFLQMNSLTAEDTAVYCAR | DDYCSSPTCH-------PYYYYGLDV | WGQGTTVTVSS |
| iPS:4 36794 | 21-225_170F1 | VH3\|3-33\|D4\|4-23\|RF2\|JH6 | QVQLVES-GGGVVQPGRSLRLSCAASG-FTFS | G------YGMH | WVRQAPGKGLEWVA | IIWYD----GNNKYYADSVKG | RFTISRDNSKNTLYLQMNSLRAEDTAVYYCAR | DRVYCSSTSCH-------PYYYYAMDV | WGQGTTVTVSS |
| iPS:4 36836 | 21-225_52H1 | VH3\|3-33\|D4\|4-23\|RF2\|JH6 | QVQLVES-GGGVVQPGRSLRLSCAASG-FTFS | G------YGMH | WVRQAPGKGLEWVA | VIWYD----GSNKYYADSVKG | RFTISRDNSKNTLYLQMNSLRAEDTAVYYCAR | DRVYCSSSSCS-------YYYYYGMDV | WGQGTTVTVSS |
| iPS:4 36922 | 21-225_78E9 | VH3\|3-33\|D4\|4-23\|RF2\|JH6 | QVQLVES-GGGVVQPGRSLRLSCAASG-FTFS | S------YGMH | WVRQAPGKGLEWVA | VIWYD----GSNKYYADSVKG | RFTISRDISKNTLYLQMNSLRAEDTAVYYCAR | DRDYCSSTSC--------PYYYYGMDV | WGQGTTVTVSS |
| iPS:4 36924 | 21-225_74B3 | VH3\|3-33\|D4\|4-23\|RF2\|JH6 | QVQLVES-GGGVVQPGRSLRLSCAASG-FTFS | R------YGMH | WVRQAPGKGLEWVA | VFWYD----GSNKYYADSVKG | RFTISRDNSKNTLYLQMNSLRAEDTAVYYCAR | DRDYCSSTSC--------PYYYYGMDV | WGQGTTVTVSS |
| iPS:4 36928 | 21-225_79E7 | VH3\|3-33\|D4\|4-23\|RF2\|JH6 | QVQLVES-GGGVVQPGRSLRLSCAASG-FTFS | S------YGMH | WVRQAPGKGLEWVA | VIWYD----GNNKSYADSVKG | RFTISRDISKNTLYLQMNSLRAEDTAVYYCAR | DRDYCSSTSC--------PYYYYGMDV | WGQGTTVTVSS |
| iPS:4 36932 | 21-225_92A4 | VH3\|3-33\|D4\|4-23\|RF2\|JH6 | QVQLVES-GGGVVQPGRSLRLSCAASG-FTFS | S------YGMH | WVRQAPGKGLEWVA | VIWYD----GNNKYYADSVKG | RFTISRDISKNTLYLQMNSLRAEDTAVYYCAR | DRDYCSSTSC--------PYYYYGMDV | WGQGTTVTVSS |
| iPS:4 36936 | 21-225_97E6 | VH3\|3-33\|D4\|4-23\|RF2\|JH6 | QVQLVES-GGGVVQPGRSLRLSCAASG-FTFS | S------YGMH | WVRQAPGKGLEWVA | VIWYD----GNNKSYADSVKG | RFTISRDISKNTLYLQMNSLRAEDTAVYYCAR | DRDYCSSTSC--------PYYYYYGMDV | WGQGTTVTVSS |
| iPS:4 37190 | 21-225_225A9 | VH3\|3-33\|D4\|4-23\|RF2\|JH6 | QVQLVES-GGGVVQPGRSLRLSCAASG-FTFS | T------YGMH | WVRLAPGKGLEWVA | VIWYD----GNNKSYADSVKG | RFTISRDISQNTLYLQMNSLRAEDTAVYYCAR | DNHYCSSTSCS-------PYYYYGMDV | WGQGTTVTVSS |
| iPS:4 37254 | 21-225_149F2 | VH3\|3-33\|D4\|4-23\|RF2\|JH6 | QVQLGEA-GGGVVQPGRSLRLSCAASG-FTFS | R------YGMH | WVRQAPGKGLEWVA | FIWYD----GSENYYADSVKG | RFTISRVNSRNTLYLQMNSLRAEDTAVYYCAR | DRVEGSGTP---------YYYYGMDV | WGQGTTVTVSS |
| iPS:4 37256 | 21-225_150F11 | VH3\|3-33\|D4\|4-23\|RF2\|JH6 | QVQLGEA-GGGVVQPGRSLRLSCAASG-FTFS | R------YGMH | WVRQAPGKGLEWVA | FIWYD----GSENYYADSVKG | RFTISRVNSRNTLYLQMNSLRAEDTAVYYCAR | DRVEGSGTP---------YYYYGMDV | WGQGTTVTVSS |
| iPS:4 51110 | 21-225_74C9 | VH3\|3-33\|D4\|4-23\|RF2\|JH6 | QVQLVES-GGGVVQPGRSLRLSCAASG-FTFS | S------YGMH | WVRQAPGKGLEWVA | VIWYD----GNNKYYADSVKG | RFTISRDISKNTLYLQMNSLRAEDTAVYYCAR | DRDYCSSTSC--------PYYYYYGMDV | WGQGTTVTVSS |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 92589 | 21-225_27H2 | VH3｜3-33/D4｜4-23｜RF2/JH6 | QVQLVES-GGGVVQPGRSLRL SCAASG-FTFS | G------YGMH | WVRQAPGK GLEWVA | VIWYD----GSNRYYADS VKG | RFTISRDNSKNTLFLQMNSL RAEDTAVYYCAR | DRVYCSSTSCS-----PYYYYYGMDV | WGQGT TVTVS S |
| iPS:3 93166 | 21-225_27G6 | VH3｜3-33/D4｜4-23｜RF2/JH6 | QVQLVES-GGGVVQPGRSLRL SCAASG-FTFS | G------YGMH | WVRQAPGK GLEWVA | IIWYD----GSKKYNADS VKG | RFTISRDNSKNTLYLQMNSL RAEDTAVYYCAR | DRVYCSSTSCS-----PYYYYYGMDV | WGQGT TVTVS S |
| iPS:3 93198 | 21-225_28A11 | VH3｜3-33/D4｜4-23｜RF2/JH6 | QVQLVES-GGGVVQPGRSLRL SCAASG-FTFS | G------YGLH | WVRQAPGK GLEWVA | LIWYD----GNNTYYADS VKG | RFTISRDNSKNTLYLQMNSL RAEDTAVYYCAR | DRVYCSSTSCS-----PYYYYYGMDV | WGQGT TVTVS S |
| iPS:3 93204 | 21-225_8C12 | VH3｜3-33/D4｜4-23｜RF2/JH6 | QVQLVES-GGGVVQPGRSLRL SCAASG-FTFG | S------YGMH | WVRQAPGK GLEWVA | LIWYD----GSNKYYADS VKG | RFTISRDNSKNTLYLQMNSL RAEDTAVYYCAR | DRVSCSSSSCY-----PYYYYYGMDV | WGQGT TVTVS S |
| Germline | VH3｜3-33/D4｜4-23｜RF2/JH6 | | | | | | | |
| iPS:4 53447 | 21-225_65F10 | VH1｜1-02/D4｜4-11｜RF2/JH4 | QVQLVQS-GAEVKKPGASVKV SCKASG-YTFT | G------YHMH | WVRQAPGQ GLEWMG | WINPN----NGGTSYAQK FQD | RVNMTRDTSISTAYMELSRL RSDDTAVYYCAR | DSRS-------SWDY | WGQGT LVTVS S |
| iPS:4 34145 | 21-225_55B1 | VH1｜1-02/D4｜4-11｜RF2/JH4 | QVQLVQS-GAEVKKPGASVKV SCKASG-YTFT | G------YYFH | WVRQAPGQ GLEWMG | WINPN----NNATNYAQK FQG | RVTMTRDTSISTAYMELSRL RSDDTAVYYCAK | DGRS-------GFDY | WGQGT LVTVS S |
| iPS:4 34277 | 21-225_57A7 | VH1｜1-02/D4｜4-11｜RF2/JH4 | QVQLVQS-GAEVKKPGASVKV SCKASG-YTFT | G------YIHH | WVRQAPGQ DLEWMG | WINPN----NNGTNYAQK FQG | RVTMTRDTSISTAYMELSRL RSDDTAVYYCAR | DGRS-------GFDY | WGQGT LVTVS S |
| iPS:4 34389 | 21-225_66F11 | VH1｜1-02/D4｜4-11｜RF2/JH4 | QVQLVQS-GAEVKKPGASVKV SCKASG-YTFT | G------YHMH | WVRQAPGQ GLEWMG | WINPN----NGGTHYAQK FQD | WVTMTRDTSISTAYMELSRL RSDDTAVYYCAR | DSRS-------SWDY | WGQGT LVTVS S |
| iPS:4 34423 | 21-225_70D1 | VH1｜1-02/D4｜4-11｜RF2/JH4 | QVQLVQS-GAEVKKPGASVKV SCKASG-YTFT | G------YHMH | WVRQAPGQ GLEWMG | WINPN----SNATNYAQK FQG | RVTMTRDTSISTAYMELSRL RSDDTAVYYCAR | DSIS-------SWDY | WGQGT LVTVS S |
| iPS:4 37234 | 21-225_64E2 | VH1｜1-02/D4｜4-11｜RF2/JH4 | QVQLVQS-GAEVKKPGASVKV SCKASG-YTFT | G------NYYH | WVRQAPGQ GLEWMG | WINPN----NNGTNYAQK FQG | KVIMTRDTSISTAYMELSRL RSDDTAVYYCAR | DGSS-------GFDY | WGQGT LVTVS S |
| Germline | VH4｜4-59/D7｜7-27｜RF1/JH4 | | | | | | | |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 53449 | 21-225_208A2 | VH4|4-59/D7|7-27|RF1/J H4 | QVQLQES-GPGLVKPSETLSL NCTVSG-GSIR | S-----YYWS | WIRQPAGK GLEWIG | RIYT----SGSTDYNPS LKS | RITMSVDTSKNQFSLKLSSV TAADTAVYYCAR | GFGD--------WDY | WGQGT LVTVS S |
| iPS:4 35451 | 21-225_152D10 | VH4|4-59/D7|7-27|RF1/J H4 | QVQLQES-GPGLVKPSETLSL ICTVSG-GSIS | N-----YYWS | WIRQPAGK GLEWIG | RIDT----SGITNYNPS LKS | RVTMSVDTSKNQFSLKLTSV TAADTAVYYCAR | EGGLGA------TFFDY | WGQGT LVTVS S |
| iPS:4 35467 | 21-225_153B9 | VH4|4-59/D7|7-27|RF1/J H4 | QVQLQES-GPGLVKPSETLSL TCTVSG-GSIS | S-----YYWS | WIRQPAGK GLEWIG | RIDT----SGITNYNPS LKS | RVTMSVDTSKNQFSLKLTSV TAADTAVYYCAR | EGGVGA------TYFDY | WGQGT LVTVS S |
| iPS:4 35545 | 21-225_158F4 | VH4|4-59/D7|7-27|RF1/J H4 | QVQLQES-GPGLVKPSETLSL NCTVSG-GSIS | S-----HFWS | WIRQPAGK GLEWIG | RIYT----SGTMNYTPS LKS | RVTMSVDTSKNQFSLKLSSV TAADTAVYYCAR | LSSG--------WFDY | WGQGT LVTVS S |
| iPS:4 35665 | 21-225_169F2 | VH4|4-59/D7|7-27|RF1/J H4 | QVQLQES-GPGLVKPSETLSL ICTVSG-GSIS | S-----YYWS | WIRQPAGK GLEWIG | RIDT----SGITNYNPS LKS | RVTMSIDTSKSQISLKLSSV TAADTAVYYCAR | EGGVGA------TYFDY | WGQGT LVTVS S |
| iPS:4 35671 | 21-225_169H5 | VH4|4-59/D7|7-27|RF1/J H4 | QVQLQES-GPGLVKPSETLSL TCTVSG-GSIS | S-----YYWS | WIRQPAGK GLEWIG | RIDT----SGITNYNPS LKS | RVTMSVDTSKSQISLKLSSV TAADTAVYYCAR | EGGVGA------TYFDY | WGQGT LVTVS S |
| iPS:4 36354 | 21-225_210G10 | VH4|4-59/D7|7-27|RF1/J H4 | QVQLQES-GPGLVKPSETLSL NCTVSG-GSIR | S-----YYWS | WIRQPAGK GLEWIG | RIYT----SGSTDYNPS LKS | RITMSVDTSKNQFSLKLSSV TAADTAVYYCAR | GFGD--------WDY | WGQGT LVTVS S |
| | Germline | VH4|4-34|D4|4-17|RF2|H6 | | H_CDR1 | H_FR2 | H_CDR2 | H_FR3 | H_CDR3 | H_FR4 |
| iPS:4 68810 | 21-225_74D5 | VH4|4-34|D4|4-17|RF2|J H6 | QVQLQQW-GAGLLKPSETLSL TCAVNG-GPFS | G-------CYWS | WIRQPPGK GLEWIG | EINY----SGRTNFNPS LKS | RVTISVDTSKNQFSLKLSSV TAADTAVYYCAR | DYGG--------MDV | WGQGT TVTVS S |
| iPS:4 68832 | 21-225_76H10 | VH4|4-34|D4|4-17|RF2|J H6 | QVQLQQM-GAGLLKPSETLSL TCAVNG-GPFS | G-------CYWS | WIRQPPGK GLEWIG | EINY----SGRTNFNPS LKS | RVTISVDTSKNQFSLKLSSV TAADTAVYYCAR | DYGG--------MDV | WGQGT TVTVS S |
| iPS:4 68834 | 21-225_94G10 | VH4|4-34|D4|4-17|RF2|J H6 | QVQLQQW-GAGLLKPSETLSL TCAVNG-GPFS | G-------CYWS | GIRQPPGK GREWIG | EINY----SGRTNFNPS LKS | RVTISVDTSKNQFSLKLSSV TAADTAVYYCAR | DYGG--------MDV | WGQGT TVTVS S |
| iPS:4 68838 | 21-225_80E12 | VH4|4-34|D4|4-17|RF2|J H6 | QVQLQQM-GAGLLKPSETLSL TCAVNG-GPFS | G-------CYWS | WIRQPPGK GLEWIG | EINY----SGRTNFNPS LKS | RVTISVDTSKNQFSLKLSSV TAADTAVYYCAR | DYGG--------MDV | WGQGT TVTVS S |

FIGURE 51 (Continued)

| | | | | | | | | |
|---|---|---|---|---|---|---|---|---|
| iPS:4 68820 | 21-225_76E10 | VH4\|4-34\|D4\|4-17\|RF2\|J H6 | QVQLQQW-GAGLLKPSETLSL TCAVNG-GFFS | G------SYWS | WIRQPPGK GLEWIG | EINY------SGRTNFNPS LKS | RVTISVDTSKNQFSLKLSSV TAADTAVYYCAR | DYGG------MDV | WGQGT TVTVS S |
| iPS:4 34473 | 21-225_76D1 | VH4\|4-34\|D4\|4-17\|RF2\|J H6 | QVQLQQW-GAGLLKPSETLSL TCAVYS-GSFS | G------CYWS | WIRQPPGK GLEWIG | EINH------SGRTNYNPS LKS | RVTISVDTSKNQFSLKLSSV TAADTAVYYCAR | DYGG------MDV | WGQGT TVTVS S |
| iPS:4 34495 | 21-225_74B2 | VH4\|4-34\|D4\|4-17\|RF2\|J H6 | QVQLQQW-GAGLLKPSEPLSL TCAVYG-GSFS | G------PYWS | WIRQPPGK GLEWIG | EINH------SGSTNYNPS LTS | RVTISVDTSKNQFSLKLISV TAADTAVYYCAR | DYGG------LDV | WGQGT TVTVS S |
| iPS:4 34497 | 21-225_76A4 | VH4\|4-34\|D4\|4-17\|RF2\|J H6 | QVQLQQW-GAGLLKPSETLSL TCAVHG-GSFS | G------CYWS | WIRQPPGK GLEWIG | EINH------SGRTNFNPS LKS | RVTISVDTSKNQFSLKLSSV TAADTAVYYCAR | DYGG------MDV | WGQGT TVTVS S |
| iPS:4 34501 | 21-225_76G4 | VH4\|4-34\|D4\|4-17\|RF2\|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------MDV | WGQGT TVTVS S |
| iPS:4 34507 | 21-225_74C5 | VH4\|4-34\|D4\|4-17\|RF2\|J H6 | QVQLQQW-GAGLLKPSETLSL TCAVYG-GSFS | G------CYWS | WIRQPPGK GLEWIG | EINH------SGRTNFNPS LKS | RVTISVDTSKNQFSLKLSSV TAADTAVYYCAR | DYGG------MDV | WGQGT TVTVS S |
| iPS:4 34523 | 21-225_75C3 | VH4\|4-34\|D4\|4-17\|RF2\|J H6 | QVQLQQG-GAGFLKPSETLSL TCAVYG-GSFS | G------CYWS | WIRQPPGK GLEWIG | EINY------SGRTNFNPS LKS | RVTISVDTSKNQFSLKLSSV TAADTAVYYCAR | DYGG------MDV | WGQGT TVTVS S |
| iPS:4 34533 | 21-225_85F7 | VH4\|4-34\|D4\|4-17\|RF2\|J H6 | QVQLQQW-GAGLLKPSEPLSL TCAVYG-GSFS | G------PYWS | WIRQPPGK GLEWIG | EINH------SGSTNYNPS LKS | RVTISVDTSKNQFSLKLITSV TAADTAVYYCAR | DYGG------LDV | WGQGT TVTVS S |
| iPS:4 34547 | 21-225_74H5 | VH4\|4-34\|D4\|4-17\|RF2\|J H6 | QVQLQQW-GAGLLKPSETLSL TCAVYG-GSFS | G------CYWS | WIRQPPGK GLEWIG | EINH------SGRTNFNPS LKS | RVTISVDTSKNQFSLKLSSV TAADTAVYYCAR | DYGG------MDV | WGQGT TVTVS S |
| iPS:4 34559 | 21-225_74D11 | VH4\|4-34\|D4\|4-17\|RF2\|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------MDV | WGQGT TVTVS S |
| iPS:4 34561 | 21-225_77G1 | VH4\|4-34\|D4\|4-17\|RF2\|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------MDV | WGQGT TVTVS S |
| iPS:4 34565 | 21-225_75B10 | VH4\|4-34\|D4\|4-17\|RF2\|J H6 | QVQLQQW-GAGLLKPSETLSL KCDVYG-GSFS | G------YYWS | WIRQPPGK GLEWIG | EINH------SGSTNYNPS LKS | RVTISVDTSKNQFSLKLSSV TAADTAVYYCAR | DYGG------LDV | WGQGT TVTVS S |

FIGURE 51 (Continued)

| | | | | | | | | |
|---|---|---|---|---|---|---|---|---|
| iPS:4 34579 | 21-225_77F7 | VH4|4-34|D4|4-17|RF2|J H6 | QVQLQQW-GAGLLKPSETLSL TCAVHG-GSFS | G------CYWS | WIRQPPGK GLEWIG | EINH----SGSTNYNPS LKS | RVTISVDTSKNQFSLKLSSV TAADTAVYYCAR | DYGG-------------- | ----MDV | WGQGT TVTVS S |
| iPS:4 34581 | 21-225_74B12 | VH4|4-34|D4|4-17|RF2|J H6 | QVQLQQW-GAGLLKPSETLSL TCAVHG-GSFS | G------CYWS | WIRQPPGK GLEWIG | EINH----SGSTNYNPS LKS | RVTISVDTSKNQFSLKLSSV TAADTAVYYCAR | DYGG-------------- | ----MDV | WGQGT TVTVS S |
| iPS:4 34585 | 21-225_75A12 | VH4|4-34|D4|4-17|RF2|J H6 | QVQLQQG-GAGPLKPSETLSL TCAVYG-GSFS | G------CYWS | WIRQPPGK GLEWIG | EINY----SGRTNYNPS LKS | RVTISVDTSKNQFSLKLSSV TAADTAVYYCAR | DYGG-------------- | ----MDV | WGQGT TVTVS S |
| iPS:4 34595 | 21-225_77A10 | VH4|4-34|D4|4-17|RF2|J H6 | QVQLQQG-GAGLLKPSETLSL TCAVYG-GSFS | G------CYWS | WIRQPPGK GLEWIG | EINH----SGSTNYNPS LKS | RVTISVDTSKNQFSLKLSSV TAADTAVYYCAR | DYGG-------------- | ----MDV | WGQGT TVTVS S |
| iPS:4 34611 | 21-225_77C12 | VH4|4-34|D4|4-17|RF2|J H6 | QVQLQQW-GAGLLKPSETLSL TCAVHG-GAFS | G------SYWS | WIRQSPGK GLEWIG | EINY----RGSTNYNPS LKS | RVTISVDTSKNQFSLNLSSV TAADTAVYYCAR | DYGG-------------- | ----MDV | WGQGT TVTVS S |
| iPS:4 34657 | 21-225_79G1 | VH4|4-34|D4|4-17|RF2|J H6 | QVQLQQW-GAGLLKPSETLSL TCAVHG-GSFS | G------CYWS | WIRQPPGK GLEWIG | EINH----SGSTNYNPS LKS | RVTISVDTSKNQFSLKLSSV TAADTAVYYCAR | DYGG-------------- | ----MDV | WGQGT TVTVS S |
| iPS:4 34663 | 21-225_79F3 | VH4|4-34|D4|4-17|RF2|J H6 | QVQLQQW-GAGLLKPSETLSL TCAVHG-GSFS | G------CYWS | WIRQPPGK GLEWIG | EINH----SGSTNYNPS LKS | RVTISVDTSKNQFSLKLSSV TAADTAVYYCAR | DYGG-------------- | ----MDV | WGQGT TVTVS S |
| iPS:4 34687 | 21-225_75A5 | VH4|4-34|D4|4-17|RF2|J H6 | QVQLQQW-GAGLLKPSETLSL TCAVHG-GSFS | G------CYWS | WIRQPPGK GLEWIG | EINH----SGSTNYNPS LKS | RVTISVDTSKNQFSLKLSSV TAADTAVYYCAR | DYGG-------------- | ----MDV | WGQGT TVTVS S |
| iPS:4 34691 | 21-225_75G7 | VH4|4-34|D4|4-17|RF2|J H6 | QVQLQQW-GAGLLKPSETLSL TCTVYG-GAFS | G------SYWS | WIRQPPGK GLEWIG | EINY----SGSTNYNPS LKS | RVTISVDTSKNQFSLNLSSV TAADTAVYYCAR | DYGG-------------- | ----MDV | WGQGT TVTVS S |
| iPS:4 34693 | 21-225_79F11 | VH4|4-34|D4|4-17|RF2|J H6 | QVQLQQW-GAGLLKPSETLSL TCAVHG-GSFS | G------CYWS | WIRQPPGK GLEWIG | EINH----SGSTNYNPS LKS | RVTISVDTSKNQFSLKLSSV TAADTAVYYCAR | DYGG-------------- | ----MDV | WGQGT TVTVS S |
| iPS:4 34699 | 21-225_79G12 | VH4|4-34|D4|4-17|RF2|J H6 | QVQLQQW-GAGLLKFSETLSL TCAVHG-GSFS | G------CYWS | WIRQPPGK GLEWIG | EINH----SGSTNYNPS LKS | RVTISVDTSKNQFSLKLSSV TAADTAVYYCAR | DYGG-------------- | ----MDV | WGQGT TVTVS S |
| iPS:4 34701 | 21-225_80A1 | VH4|4-34|D4|4-17|RF2|J H6 | QVQLQQW-GAGLLKPSETLSL TCAVHG-GSFS | G------CYWS | WIRQPPGK GLEWIG | EINH----SGSTNYNPS LKS | RVTISVDTSKNQFSLKLSSV TAADTAVYYCAR | DYGG-------------- | ----MDV | WGQGT TVTVS S |

FIGURE 51 (Continued)

| | | | | | | | | |
|---|---|---|---|---|---|---|---|---|
| iPS:4 34703 | 21-225_80C1 | VH4/4-34/D4/4-17/JRF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG-----------MDV | WGQGT TVTVS S |
| iPS:4 34709 | 21-225_80E3 | VH4/4-34/D4/4-17/JRF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG-----------MDV | WGQGT TVTVS S |
| iPS:4 34715 | 21-225_80D5 | VH4/4-34/D4/4-17/JRF2/J H6 | QVQLQQW-GAGLLKPSEFLSL TCAVHG-GSFS | G------PYWS | WIRQPPGK GLEWIG | EINH------SGSTNYNPS LKS | RVTISVDTSKNQFSLKLTSV TAADNAVYYCAR | DYGG-----------LDV | WGQGT TVTVS S |
| iPS:4 34725 | 21-225_80H7 | VH4/4-34/D4/4-17/JRF2/J H6 | QVQLQQW-GAGLLKPSETLSL TCAVHG-GSFS | G------SYWS | WIRQPPGK GLEWIG | EINQ------SGRTNYNPS LKS | RVTISVDTSKNQFSLKLSSV TAADTAVYYCAR | DYGG-----------IDV | WGQGT TVTVS S |
| iPS:4 34743 | 21-225_74AA | VH4/4-34/D4/4-17/JRF2/J H6 | QVQLQQW-GAGLLKPSETLSL TCAVYV-GSFS | G------CYWS | WIRQPPGK GLEWIG | EINH------SGSTNYNPS LKS | RVTISVDTSKNQFSLKLSSV TAADTAVYYCAR | DYGG-----------MDV | WGQGT TVTVS S |
| iPS:4 34751 | 21-225_80H12 | VH4/4-34/D4/4-17/JRF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG-----------MDV | WGQGT TVTVS S |
| iPS:4 34759 | 21-225_81C5 | VH4/4-34/D4/4-17/JRF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG-----------MDV | WGQGT TVTVS S |
| iPS:4 34773 | 21-225_75D9 | VH4/4-34/D4/4-17/JRF2/J H6 | QVQLQQW-GAGLLKPSETLSL TCAVHG-GSFS | G------PYWS | WIRQPPGK GLEWIG | EINH------RGSTNYNPS LKS | RVTISVDTSKNQFSLKLSSV TAADTAVYYCAR | DYGG-----------MDV | WGQGT TVTVS S |
| iPS:4 34777 | 21-225_81C11 | VH4/4-34/D4/4-17/JRF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG-----------MDV | WGQGT TVTVS S |
| iPS:4 34809 | 21-225_74F5 | VH4/4-34/D4/4-17/JRF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG-----------MDV | WGQGT TVTVS S |
| iPS:4 34821 | 21-225_83G1 | VH4/4-34/D4/4-17/JRF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG-----------MDV | WGQGT TVTVS S |
| iPS:4 34839 | 21-225_83B7 | VH4/4-34/D4/4-17/JRF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG-----------MDV | WGQGT TVTVS S |

FIGURE 51 (Continued)

| | | | | | | | | |
|---|---|---|---|---|---|---|---|---|
| iPS:4 34869 | 21-225_84E12 | VH4|4-34|D4|4-17|RF2|J H6 | QVQLQQW-GAGLLKPSETLSL TCAVYG-GSFS | G------SYWS | WIRQPPGK GLEWIG | EINQ------SGRTNYNPS LKS | RVTISVDTSKNQFSLKLSSV TAADTAVYYCAR | DYGG------------IDV | WGQGT TVTVS S |
| iPS:4 34879 | 21-225_85A3 | VH4|4-34|D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34881 | 21-225_85B4 | VH4|4-34|D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34887 | 21-225_85D6 | VH4|4-34|D4|4-17|RF2|J H6 | QVQLQQG-GAGPLKPSEPLSL TCAVYG-GSFS | G------CYWS | WIRQPPGK GLEWIG | EINQ------SGRTNYNPS LKS | RVTISVDTSKNQFSLKLSSV TAADTAVYYCAR | DYGG------------MDV | WGQGT TVTVS S |
| iPS:4 34895 | 21-225_74H7 | VH4|4-34|D4|4-17|RF2|J H6 | QVQLQQM-GAGLLKPSEPLSL TCAVHG-GSFS | G------PYWS | WIRQPPGK GLEWIG | EINH------SGSTNYNPS LKS | RVTISVDTSKNQFSLKLTSV TAADTAVYYCAR | DYGG------------MDV | WGQGT TVTVS S |
| iPS:4 34899 | 21-225_85B9 | VH4|4-34|D4|4-17|RF2|J H6 | QVQLQQM-GAGLLKPSETLSL TCAVNG-GPFS | G------CYWS | WIRQPPGK GLEWIG | EINH------SGSTNFMPS LKS | RVTISVDTSKNQFSLKLSSV TAADTAVYYCAR | DYGG------------MDV | WGQGT TVTVS S |
| iPS:4 34907 | 21-225_85G10 | VH4|4-34|D4|4-17|RF2|J H6 | QVQLQQR-GAGLLKPSETLSL TCAVHG-GSFS | G------CYWS | WIRQPPGK GLEWIG | EINH------SGITNYNPS LKS | RVTISVDTSKNQFSLKLTSV TAADTAVYYCAR | DYGG------------LDV | WGQGT TVTVS S |
| iPS:4 34913 | 21-225_86C1 | VH4|4-34|D4|4-17|RF2|J H6 | QVQLQQM-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34921 | 21-225_86E4 | VH4|4-34|D4|4-17|RF2|J H6 | QVQLQQM-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34939 | 21-225_86C11 | VH4|4-34|D4|4-17|RF2|J H6 | QVQLQQM-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34943 | 21-225_87H1 | VH4|4-34|D4|4-17|RF2|J H6 | QVQLQPM-GAGLLKPSETLSL TCAVHG-GSFS | G------YYWS | WIRQPPGK GLEWIG | EINH------SGTNYNPS LKS | RVTISVDTSKDQFSLKLSSV TAADTAVYYCAR | DYGG------------LDV | WGQGT TVTVS S |
| iPS:4 34945 | 21-225_87E5 | VH4|4-34|D4|4-17|RF2|J H6 | QVQLQQM-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |

FIGURE 51 (Continued)

| | | | | | | | | |
|---|---|---|---|---|---|---|---|---|
| iPS:4 34955 | 21-225_87C9 | VH4\|4-34\|D4\|4-17\|RF2\|JH6 | QVQLQQW-GAGLLKPSETLSL TCAVHG-GSFS | G------CYWS | WIRQPPGK GLEWIG | EINH------ SGSTNYNPS LKS | RVTISVDTSKNQFSLKLSSV TAADTAVYYCAR | DYGG------ --------MDV | WGQGT TVTVS S |
| iPS:4 34961 | 21-225_87A12 | VH4\|4-34\|D4\|4-17\|RF2\|JH6 | QVQLQQW-GAGLLKPSETLSL TCAVHG-GSFS | G------CYWS | WIRQPPGK GLEWIG | EINH------ SGSTNYNPS LKS | RVTISVDTSKNQFSLKLSSV TAADTAVYYCAR | DYGG------ --------MDV | WGQGT TVTVS S |
| iPS:4 34969 | 21-225_88H1 | VH4\|4-34\|D4\|4-17\|RF2\|JH6 | QVQLQQW-GAGLLKPSETLSL TCAVHG-GSFS | G------CYWS | WIRQPPGK GLEWIG | EINH------ SGSTNYNPS LKS | RVTISVDTSKNQFSLKLSSV TAADTAVYYCAR | DYGG------ --------MDV | WGQGT TVTVS S |
| iPS:4 34981 | 21-225_88E7 | VH4\|4-34\|D4\|4-17\|RF2\|JH6 | QVQLQQW-GAGLLKPSETLSL TCAVHG-GSFS | G------CYWS | WIRQPPGK GLEWIG | EINH------ SGSTNYNPS LKS | RVTISVDTSKNQFSLKLSSV TAADTAVYYCAR | DYGG------ --------MDV | WGQGT TVTVS S |
| iPS:4 34983 | 21-225_88F7 | VH4\|4-34\|D4\|4-17\|RF2\|JH6 | QVQLQQW-GAGLLKPSETLSL TCAVHG-GSFS | G------CYWS | WIRQPPGK GLEWIG | EINH------ SGSTNYNPS LKS | RVTISVDTSKNQFSLKLSSV TAADTAVYYCAR | DYGG------ --------MDV | WGQGT TVTVS S |
| iPS:4 34995 | 21-225_88G9 | VH4\|4-34\|D4\|4-17\|RF2\|JH6 | QVQLQQW-GAGLLKPSETLSL TCAVHG-GSFS | G------CYWS | WIRQPPGK GLEWIG | EINH------ SGSTNYNPS LKS | RVTISVDTSKNQFSLKLSSV TAADTAVYYCAR | DYGG------ --------MDV | WGQGT TVTVS S |
| iPS:4 34999 | 21-225_75A8 | VH4\|4-34\|D4\|4-17\|RF2\|JH6 | QVQLQQW-GAGLLKPSETLSL TCAVHG-GSFS | G------CYWS | WIRQPPGK GLEWIG | EINH------ SGSTNYNPS LKS | RVTISVDTSKNQFSLKLSSV TAADTAVYYCAR | DYGG------ --------MDV | WGQGT TVTVS S |
| iPS:4 35013 | 21-225_89D5 | VH4\|4-34\|D4\|4-17\|RF2\|JH6 | QVQLQQW-GAGLLKPSETLSL TCAVHG-GSFS | G------CYWS | WIRQPPGK GLEWIG | EINY------ SGSTMFNPS LKS | RVTISADTSKNQFSLKLSSV TAADTAVYYCAR | DYGG------ --------MDV | WGQGT TVTVS S |
| iPS:4 35015 | 21-225_89H5 | VH4\|4-34\|D4\|4-17\|RF2\|JH6 | QVQLQQW-GAGLLKPSETLSL TCAVHG-GSFS | G------CYWS | WIRQPPGK GLEWIG | EINH------ SGSTNYNPS LKS | RVTISVDTSKNQFSLKLSSV TAADTAVYYCAR | DYGG------ --------MDV | WGQGT TVTVS S |
| iPS:4 35025 | 21-225_89E10 | VH4\|4-34\|D4\|4-17\|RF2\|JH6 | QVQLQQW-GAGLLKPSETLSL TCAVHG-GSFS | G------CYWS | WIRQPPGK GLEWIG | EINH------ SGSTNYNPS LKS | RVTISVDTSKNQFSLKLSSV TAADTAVYYCAR | DYGG------ --------MDV | WGQGT TVTVS S |
| iPS:4 35029 | 21-225_89A11 | VH4\|4-34\|D4\|4-17\|RF2\|JH6 | QVQLQQW-GAGLLKPSETLSL TCAVHG-GSFS | G------YYWS | WIRQPPGK GLEWIG | EINH------ SGRTSYNPS LKS | RVTISVDTSKNQFSLKLSSV TAADTAVYYCAR | DYGG------ --------LDV | WGQGT TVTVS S |
| iPS:4 35039 | 21-225_90G4 | VH4\|4-34\|D4\|4-17\|RF2\|JH6 | QVQLQFN-GAGLLKPSETLSL TCAVHG-GSFS | G------CYWS | WIRQPPGK GLEWIG | EINH------ SGSTNYNPS LKS | RVTISVDTSKNQFSLKLSSV TAADTAVYYCAR | DYGG------ --------MDV | WGQGT TVTVS S |

FIGURE 51 (Continued)

| | | | | | | | | |
|---|---|---|---|---|---|---|---|---|
| iPS.4 35041 | 21-225_90A5 | VH4/4-34/D4/4-17/JRF2/JH6 | QVQLQQW-GAGLLKPSETLSL TCAVHG-GSFS | G------CYWS | WIRQPPGK GLEWIG | EINH---- SGSTNYNPS LKS | RVTISVDTSKNQFSLKLSSV TAADTAVYYCAR | DYGG---------------- | ---MDV | WGQGT TVTVS S |
| iPS.4 35043 | 21-225_90G5 | VH4/4-34/D4/4-17/JRF2/JH6 | QVQLQQW-GAGLLKPSETLSL TCAVHG-GSFS | G------CYWS | WIRQPPGK GLEWIG | EINH---- SGSTNYNPS LKS | RVTISVDTSKNQFSLKLSSV TAADTAVYYCAR | DYGG---------------- | ---MDV | WGQGT TVTVS S |
| iPS.4 35055 | 21-225_90F10 | VH4/4-34/D4/4-17/JRF2/JH6 | QVQLQQW-GAGLLKPSETLSL TCAVHG-GSFS | G------CYWS | WIRQPPGK GLEWIG | EINH---- SGSTNYNPS LKS | RVTISVDTSKNQFSLKLSSV TAADTAVYYCAR | DYGG---------------- | ---MDV | WGQGT TVTVS S |
| iPS.4 35073 | 21-225_91B2 | VH4/4-34/D4/4-17/JRF2/JH6 | QVQLQQW-GAGLLKPSETLSL TCAVHG-GSFS | G------CYWS | WIRQPPGK GLEWIG | EINH---- SGSTNYNPS LKS | RVTISVDTSKNQFSLKLSSV TAADTAVYYCAR | DYGG---------------- | ---MDV | WGQGT TVTVS S |
| iPS.4 35075 | 21-225_91B3 | VH4/4-34/D4/4-17/JRF2/JH6 | QVQLQQW-GAGLLKPSETLSL TCAVHG-GSFS | G------CYWS | WIRQPPGK GLEWIG | EINH---- SGSTNYNPS LKS | RVTISVDTSKNQFSLKLSSV TAADTAVYYCAR | DYGG---------------- | ---MDV | WGQGT TVTVS S |
| iPS.4 35077 | 21-225_91F3 | VH4/4-34/D4/4-17/JRF2/JH6 | QVQLQQW-GAGLLKPSETLSL TCAVHG-GSFS | G------CYWS | WIRQPPGK GLEWIG | EINH---- SGSTNYNPS LKS | RVTISVDTSKNQFSLKLSSV TAADTAVYYCAR | DYGG---------------- | ---MDV | WGQGT TVTVS S |
| iPS.4 35079 | 21-225_91B4 | VH4/4-34/D4/4-17/JRF2/JH6 | QVQLQQW-GAGLLKPSETLSL TCAVHG-GSFS | G------CYWS | WIRQPPGK GLEWIG | EINH---- SGSTNYNPS LKS | RVTISVDTSKNQFSLKLSSV TAADTAVYYCAR | DYGG---------------- | ---MDV | WGQGT TVTVS S |
| iPS.4 35089 | 21-225_91E9 | VH4/4-34/D4/4-17/JRF2/JH6 | QVQLQQW-GAGLLKPSETLSL TCAVHG-GSFS | G------CYWS | WIRQPPGK GLEWIG | EINH---- SGSTNYNPS LKS | RVTISVDTSKNQFSLKLSSV TAADTAVYYCAR | DYGG---------------- | ---MDV | WGQGT TVTVS S |
| iPS.4 35097 | 21-225_92B1 | VH4/4-34/D4/4-17/JRF2/JH6 | QVQLQQW-GAGLLKPSETLSL TCAVHG-GSFS | G------SYWS | WIRQPPGK GLEWIG | EINY---- RGSTNYNPS LKS | RVAISVDTSKNQFSLNLTSV TAADTAVYYCAR | DYGG---------------- | ---LDV | WGQGT TVTVS S |
| iPS.4 35111 | 21-225_92D6 | VH4/4-34/D4/4-17/JRF2/JH6 | QVQLQQW-GAGLLKPSETLSL TCAVHG-GSFS | G------CYWS | WIRQPPGK GLEWIG | EINH---- SGSTNYNPS LKS | RVTISVDTSKNQFSLKLSSV TAADTAVYYCAR | DYGG---------------- | ---MDV | WGQGT TVTVS S |
| iPS.4 35115 | 21-225_77C5 | VH4/4-34/D4/4-17/JRF2/JH6 | QVQLQQW-GAGLLKPSETLSL TCAVHG-GSFS | G------CYWS | WIRQPPGK GLEWIG | EINH---- SGSTNYNPS LKS | RVTISVDTSKNQFSLKLSSV TAADTAVYYCAR | DYGG---------------- | ---MDV | WGQGT TVTVS S |
| iPS.4 35171 | 21-225_93C2 | VH4/4-34/D4/4-17/JRF2/JH6 | QVQLQQW-GAGLLKPSETLSL TCAVHG-GSFS | G------CYWS | WIRQPPGK GLEWIG | EINH---- SGSTNYNPS LKS | RVTISVDTSKNQFSLKLSSV TAADTAVYYCAR | DYGG---------------- | ---MDV | WGQGT TVTVS S |

FIGURE 51 (Continued)

| | | | | | | | | |
|---|---|---|---|---|---|---|---|---|
| iPS:4 35177 | 21-225_93E4 | VH4/4-34|D4|4-17|RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG------ ---------MDV | WGQGT TVTVS S |
| iPS:4 35195 | 21-225_94D3 | VH4/4-34|D4|4-17|RF2/J H6 | QVQLQQG-GAGLLKPSETLSL TCAVHG-GSFS | G------CYWS | WIRQPPGK GLEWIG | EINY----- SGSTNYNPS LKS | RVTISVDTSKNQFSLKLSSV TAADTAVYYCAR | DYGG------ ---------MDV | WGQGT TVTVS S |
| iPS:4 35217 | 21-225_94F12 | VH4/4-34|D4|4-17|RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG------ ---------MDV | WGQGT TVTVS S |
| iPS:4 35219 | 21-225_95D2 | VH4/4-34|D4|4-17|RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG------ ---------MDV | WGQGT TVTVS S |
| iPS:4 35235 | 21-225_95F9 | VH4/4-34|D4|4-17|RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG------ ---------MDV | WGQGT TVTVS S |
| iPS:4 35237 | 21-225_95G9 | VH4/4-34|D4|4-17|RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG------ ---------MDV | WGQGT TVTVS S |
| iPS:4 35239 | 21-225_95H10 | VH4/4-34|D4|4-17|RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG------ ---------MDV | WGQGT TVTVS S |
| iPS:4 35273 | 21-225_97A2 | VH4/4-34|D4|4-17|RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG------ ---------MDV | WGQGT TVTVS S |
| iPS:4 35281 | 21-225_97E5 | VH4/4-34|D4|4-17|RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG------ ---------MDV | WGQGT TVTVS S |
| iPS:4 37324 | 21-225_75C2 | VH4/4-34|D4|4-17|RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG------ ---------MDV | WGQGT TVTVS S |
| iPS:4 37328 | 21-225_75D3 | VH4/4-34|D4|4-17|RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG------ ---------MDV | WGQGT TVTVS S |
| iPS:4 37332 | 21-225_75F3 | VH4/4-34|D4|4-17|RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG------ ---------MDV | WGQGT TVTVS S |

FIGURE 51 (Continued)

| | | | | H_FR1 | H_CDR1 | H_FR2 | H_CDR2 | H_FR3 | H_CDR3 | H_FR4 |
|---|---|---|---|---|---|---|---|---|---|---|
| iPS.4 37344 | 21-225_76G12 | VH4/4-34/D4/4-17/RF2/JH6 | | QVQLQQW-GAGLLKPSETLSL TCAVHG-GSFS | G------CYWS | WIRQPPGK GLEWIG | EINH----SGSTNYNPS LKS | RVTISVDTSKNQFSLKLSSV TAADTAVYYCAR | DYGG-----------MDV | WGQGT TVTVS S |
| iPS.4 37350 | 21-225_74A3 | VH4/4-34/D4/4-17/RF2/JH6 | | QVQLQQW-GAGLLKPSETLSL TCAVHG-GSFS | G------CYWS | WIRQPPGK GLEWIG | EINH----SGSTNYNPS LKS | RVTISVDTSKNQFSLKLSSV TAADTAVYYCAR | DYGG-----------MDV | WGQGT TVTVS S |
| iPS.4 37369 | 21-225_74D6 | VH4/4-34/D4/4-17/RF2/JH6 | | QVQLQQW-GAGLLKPSETLSL TCAVHG-GSFS | G------CYWS | WIRQPPGK GLEWIG | EINH----SGSTNYNPS LKS | RVTISVDTSKNQFSLKLSSV TAADTAVYYCAR | DYGG-----------MDV | WGQGT TVTVS S |
| | | Germline | H_FR1 | H_CDR1 | H_FR2 | H_CDR2 | H_FR3 | H_CDR3 | H_FR4 | | |
| | VH3/3-33/D4/4-17/RF2/JH6 | | | | | | | | | | |
| iPS.4 68814 | 21-225_223D11 | VH3/3-33/D4/4-17/RF2/JH6 | | QVQLVES-GGGVVQPGRSLRL SCAASG-FTFS | N------YGMD | WVRQAPGK GLEWVA | VIWYD----GSNDYYADS VKG | RFTISRDNSKNTLFLQMNSL RAEDTAVYYCAR | DRGIGY-----NDMDV | WGQGT TVTVS S |
| iPS.4 34621 | 21-225_74D1 | VH3/3-33/D4/4-17/RF2/JH6 | | QVQLVES-GGGVVQPGRSLRL SCAASG-FTFS | S------YGMH | WVRQAPGK GLEWVA | VIWYD----GSNKYHADS VKG | RFTISRDNSKNTLYLQMNSL RAEDTAMYYCAR | DEGFGEFD---YNYGMDV | WGQGT TVTVS S |
| iPS.4 34947 | 21-225_87B7 | VH3/3-33/D4/4-17/RF2/JH6 | | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAVYYCAR | DFGVGY---------YGMDV | WGQGT TVTVS S |
| iPS.4 35819 | 21-225_190C11 | VH3/3-33/D4/4-17/RF2/JH6 | | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAVYYCAR | DQGVGY---------DGLDV | WGQGT TVTVS S |
| iPS.4 35825 | 21-225_190G11 | VH3/3-33/D4/4-17/RF2/JH6 | | QVQLVES-GGGVVQPGRSLRL SCAASG-FTFS | I------YGMH | WVRQAPGK GLEWVA | VIWYD----GTNKNYADS VKG | RFTISRDNSKNTLYLQMNSL RAEDTAVYYCAR | DQGVGY---------DGLDV | WGQGT TVTVS S |
| iPS.4 35837 | 21-225_198G3 | VH3/3-33/D4/4-17/RF2/JH6 | | QVQLVES-GGGVVQPGRSLRL SCAASG-FTFS | T------YGMH | WVRQAPGK GLEWVA | VIWYD----GSNKNYADS VKG | RFTISRDNSKNTLCLQMNSL RAEDTAVYYCAR | DQGVGY---------DGLDV | WGQGT TVTVS S |
| iPS.4 35845 | 21-225_191G1 | VH3/3-33/D4/4-17/RF2/JH6 | | QVQLVES-GGGVVQPGRSLRL SCAASG-FTFS | S------YGMH | WVRQAPGK GLEWVA | VIWYD----GSNEHYADS VKG | RFTISRDNSKNTLYLQMNSL RAEDTAVYYCAR | ERGVGY---------YGLDV | WGQGT TVTVS S |
| iPS.4 35859 | 21-225_190E6 | VH3/3-33/D4/4-17/RF2/JH6 | | QVQLVES-GGGVVQPGRSLRL SCAASG-FTFS | S------YGMH | WVRQAPGK GLEWVA | VIWYD----GSNKNYADS VKG | RFTISRDNSENTLYLQMNSL RAEDTAVYYCAR | DQGVGY---------DGLDV | WGQGT TVTVS S |

FIGURE 51 (Continued)

| | | | | | | | | | |
|---|---|---|---|---|---|---|---|---|---|
| iPS:4 35873 | 21-225_190G4 | VH3/3-33/D4/4-17/RF2/J H6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAMYYCAR | DQGVGY--------DGLDV | WGQGT SVTVS S |
| iPS:4 35933 | 21-225_190F8 | VH3/3-33/D4/4-17/RF2/J H6 | QVQLVES-GGGVVQPGRSLRL SCAASG-FTFS | T------YGMH | WVRQAPGK GLEWVA | VIWYD----GSNKNYADS VKG | RFTISRDNSKNTLYLQMNSL RAEDTAVYYCAR | DQGVGY--------DGLDV | WGQGT TVTVS S |
| iPS:4 35941 | 21-225_191E8 | VH3/3-33/D4/4-17/RF2/J H6 | QVQLVES-GGGVVQPGRSLRL SCAASG-FTFS | N------YGMH | WVRQAPGK GLEWVA | IIWFD----GSNQYYADS VKG | RFTISRDNSKNTLYLQLNSL RAEDTAVYYCAR | AHGVYY--------YAMDV | WGQGT TVTVS S |
| iPS:4 35945 | 21-225_191A10 | VH3/3-33/D4/4-17/RF2/J H6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAMYYCAR | DQGVGY--------DGLDV | WGQGT SVTVS S |
| iPS:4 35947 | 21-225_191E10 | VH3/3-33/D4/4-17/RF2/J H6 | QVQLVES-GGGVVQPGRSLRL SCAASG-FTFS | S------YGMH | WVRQAPGK GLEWVA | VIWYD----GSNKNYADS VKG | RFTISRDMSKNTLYLQMNSL RAEDTAMYYCAR | DQGVGY--------DGLDV | WGQGT SVTVS S |
| iPS:4 35957 | 21-225_191G12 | VH3/3-33/D4/4-17/RF2/J H6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAVYYCAR | DQGVGY--------DGLDV | WGQGT TVTVS S |
| iPS:4 35963 | 21-225_192D2 | VH3/3-33/D4/4-17/RF2/J H6 | QVQLVES-GGGVVQPGRSLRL SCAASG-FTFS | S------YGMH | WVRQAPGK GLEWVA | VIWYD----GSNKNYADS VKG | RFTISRDNSKNMLYLQMNSL RAEETAVYYCAR | DRGVGY--------YGMDV | WGQGT TVTVS S |
| iPS:4 35971 | 21-225_192D3 | VH3/3-33/D4/4-17/RF2/J H6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAVYYCAR | DRGVGY--------YGLDV | WGQGT TVTVS S |
| iPS:4 35979 | 21-225_192H4 | VH3/3-33/D4/4-17/RF2/J H6 | QVQLVES-GGGVVQPGRSLRL SCAASG-FTFS | S------YGMH | WVRQAPGK GLEWVA | VIWYD----GSNEHYADS VKG | RFTISRDNSKNTLYLQMNSL RAEDTAVYYCAR | DQGVGY--------YGMDV | WGQGT TVTVS S |
| iPS:4 35987 | 21-225_192G6 | VH3/3-33/D4/4-17/RF2/J H6 | QVQLVES-GGGVVQPGRSLRL SCAASG-FTFS | S------YGMH | WVRQAPGK GLEWVA | VLWYD----GTMKNYADS VKG | RFTISRDNSKNTLYLQMNSL RAEDTAVYYCAR | DQGVGY--------DGLDV | WGQGT TVTVS S |
| iPS:4 35993 | 21-225_192C8 | VH3/3-33/D4/4-17/RF2/J H6 | QVQLVES-GGGVVQPGRSLRL SCAASG-FTFS | S------YGMH | WVRQAPGK GLEWVA | VIWYD----GSNEHYADS VKG | RFMISRDNSKNTLYLQMNSL RAEDTAVYYCAR | DRGVGY--------YGMDV | WGQGT TVTVS S |
| iPS:4 35997 | 21-225_192G8 | VH3/3-33/D4/4-17/RF2/J H6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAVYYCAR | DQGVGY--------DGLDV | WGQGT TVTVS S |

FIGURE 51 (Continued)

| | | | | | | | | |
|---|---|---|---|---|---|---|---|---|
| iPS:4_36005 | 21-225_192H10 | VH3|3-33/D4|4-17|RF2|JH6 | QVQLVES-GGGVVQPGRSLRLSCAASG-FTFS | S------YGMH | WVRQAPGKGLEWVA | VIWYD----GSNKNYADSVKG | RFTISRDNSKNTLYLQMNSLRAEDTAMYYCAR | DQGVGY---------DGLDV | WGQGTSVTVSS |
| iPS:4_36031 | 21-225_193C7 | VH3|3-33/D4|4-17|RF2|JH6 | QVQLVES-GGGVVQPGRSLRLSCAASG-FTFS | S------YGMH | WVRQAPGKGLEWVA | VIWYD----GSNKNYADSVKG | RFTISRDNSKNTLYLQMNSLPAEDTAVYYCAR | DQGVGY---------DGLDV | WGQGTSVTVSS |
| iPS:4_36045 | 21-225_193A10 | VH3|3-33/D4|4-17|RF2|JH6 | QVQLVES-GGGVVQPGRSLRLSCAASG-FTFS | S------YGMH | WVRQAPGKGLEWVA | VIWYD----GSNEHYADSVKG | RFTISRDNSKNTLYLQMNSLRAEDTAVYYCAR | DRGVGY---------YGLDV | WGQGTTVTVSS |
| iPS:4_36076 | 21-225_194H11 | VH3|3-33/D4|4-17|RF2|JH6 | QVQLVES-GGGVVQPGRSLRLSCAASG-FTFS | S------YGMH | WVRQAPGKGLEWVA | VIWYD----GSNEHYADSVKG | RFTISRDNSKNTLSLQMNSLRAEDTAVYYCAR | DRGVGY---------YGLDV | WGQGTTVTVSS |
| iPS:4_36086 | 21-225_191G10 | VH3|3-33/D4|4-17|RF2|JH6 | QVQLVES-GGGVVQPGRSLRLSCAASG-FTFS | S------YGMH | WVRQAPGKGLEWVA | VIWYD----GSNKNYADSVKG | RFTISRDNSKNTLYLQMNSLRAEDTAVYYCAR | DQGVGY---------DGLDV | WGQGTTVTVSS |
| iPS:4_36090 | 21-225_195A9 | VH3|3-33/D4|4-17|RF2|JH6 | QVQLVES-GGGVVQPGRSLRLSCAASG-FTFS | S------YGMH | WVRQAPGKGLQWVA | VIWYD----GSNEHYADSVKG | RFTISRDNSKNTLYLQMNSLRAEDTAVYYCAR | DRGVGY---------YGLDV | WGQGTTVTVSS |
| iPS:4_36112 | 21-225_196C7 | VH3|3-33/D4|4-17|RF2|JH6 | QVQLVES-GGGVVQPGRSLRLSCAASG-FTFS | S------YGMH | WVRQAPGKGLEWVA | VIWYD----GSMEHYADSVKG | RFTISRDNSKNTLYLQMNSLRAEDTAVYYCAR | DRGVGY---------YGLDV | WGQGTTVTVSS |
| iPS:4_36138 | 21-225_197F2 | VH3|3-33/D4|4-17|RF2|JH6 | QVQLVES-GGGVVQPGRSLRLSCAASG-FTFS | S------YGMH | WVRQAPGKGLEWVA | VIWYD----GSNKNYADSVKG | RFTISRDNSKNTLYLQMNSLRAEDTAVYYCAR | DQGVGY---------DGLDV | WGQGTTVTVSS |
| iPS:4_36152 | 21-225_197B6 | VH3|3-33/D4|4-17|RF2|JH6 | QVQLVES-GGGVVQPGRSLRLSCAASG-FTFS | S------YGMH | WVRQAPGKGLEWVA | VIWYD----GSNKHYADSVKG | RFTISRDNSKNMLYLQMNSLRAEDTAVYYCAR | DQGVGY---------DGLDV | WGQGTSVTVSS |
| iPS:4_36173 | 21-225_197G12 | VH3|3-33/D4|4-17|RF2|JH6 | QVQLVES-GGGVVQPGRSLRLSCAASG-FTFS | S------YGMH | WVRQAPGKGLEWVA | VIWYD----GSNKNYADSVKG | RFTISRDNSKNTLYLQMNSLRAEDTAVYYCAR | DQGVGY---------DGLDV | WGQGTTVTVSS |
| iPS:4_36189 | 21-225_198B6 | VH3|3-33/D4|4-17|RF2|JH6 | QVQLVES-GGGVVQPGRSLRLSCAASG-FTFS | S------YGMH | WVRQAPGKGLEWVA | VIWYD----GSNKNYADSVKG | RFTISRDNSKNTLYLQMNSLRAEDTAVYYCAR | DQGVGY---------YGMDV | WGQGTSVTVSS |
| iPS:4_36201 | 21-225_199C5 | VH3|3-33/D4|4-17|RF2|JH6 | QVQLVES-GGGVVQPGRSLRLSCAASG-FTFS | S------YGMH | WVRQAPGKGLEWVA | VIWYD----GSNKNYADSVKG | RFTISRDNSKNTLYLQMNSLRAEDTAVYYCAR | DQGVGY---------YGMDV | WGQGTTVTVSS |

FIGURE 51 (Continued)

| | | | | | | | | |
|---|---|---|---|---|---|---|---|---|
| iPS:4 36203 | 21-225_199A6 | VH3/3-33/D4/4-17/RF2/JH6 | QVQLVES-GGGVVQPGRSLRLSCAASG-FTFS | N------YGMH | WVRQAPGKGLEWVA | IIWFD----GSNQYYADSVKG | RFTISRDNSKNTLYLQLNSLRAEDTAVYYCAR | AHGVYY------YAMDV | WGQGTTVTVSS |
| iPS:4 36282 | 21-225_204G6 | VH3/3-33/D4/4-17/RF2/JH6 | QVQLVES-GGGVVQPGRSLRLSCAASG-FTFS | S------YGMH | WVRQAPGKGLEWVA | VIWYD----GSNKNYADSVKG | RFTISRDNSKNTLYLQMNSLRAEDTAVYYCAR | DRGVGY------DGMDV | WGQGTTVTVSS |
| iPS:4 36296 | 21-225_205F5 | VH3/3-33/D4/4-17/RF2/JH6 | QVQLVES-GGGVVQPGRSLRLSCAASG-FTFS | R------YGMH | WVRQAPGKGLEWVA | VIWYD----GSNENYVDSVKG | RFTISRDTSKKMLFLQMNSLRTDDTAVYYCAR | DMGIGY------YGMDV | WGQGTTVTVSS |
| iPS:4 36324 | 21-225_207G6 | VH3/3-33/D4/4-17/RF2/JH6 | QVQLVES-GGGVVQPGRSLRLSCAASG-FTFS | S------YGMH | WVRQAPGKGLEWVA | VIWYD----GSNKNYAESVKG | RFTISRDNSKNTLYLQMNSLRAEDTAVYYCAR | DAGIGY------YGIDV | WGQGTTVTVSS |
| iPS:4 36364 | 21-225_211A11 | VH3/3-33/D4/4-17/RF2/JH6 | QVQLVGS-GGGVVQPGRSLRLSCAASG-FTFS | S------YGMH | WVRQAPGKGLEWVA | VLWFD----GSNRNYADSVKG | RFTISRDNSKNTLYLQMNSLRAEDTAVYYCAR | DRGVGY------YGIDV | WGQGTTVTVSS |
| iPS:4 36372 | 21-225_211A8 | VH3/3-33/D4/4-17/RF2/JH6 | QVQLVES-GGGVVQPGRSLRLSCAASG-FTFS | S------YGMH | WVRQAPGKGLEWVA | VIWYD----GSNEHYADSVKG | RFTISRDNSKKTLYLQMNSLRAEDTAVYYCAR | DHGVGY------YGMDV | WGQGTTVTVSS |
| iPS:4 36376 | 21-225_212E6 | VH3/3-33/D4/4-17/RF2/JH6 | QVQLVES-GGGVVQPGRSLRLSCAASG-FTFS | S------YGMH | WVRQAPGKGLEWVA | VIWYD----GSNKNYVDSVKG | RFTISRDNSKNTLYLSLQMNSLRAEDTAVYYCAR | DYGVGY------YGIDV | WGQGTTVTVSS |
| iPS:4 36378 | 21-225_212D7 | VH3/3-33/D4/4-17/RF2/JH6 | QVQLVES-GGGVVQPGRSLRLSCAASG-FTFS | S------YGMH | WVRQAPGKGLEWVA | VIWYD----GSNKNYADSVKG | RFTISRDNSKNTLYLQMNSLRAEDTAVYYCAR | DYGVGY------YGIDV | WGQGTTVTVSS |
| iPS:4 36380 | 21-225_212H9 | VH3/3-33/D4/4-17/RF2/JH6 | QVQLVES-GGGVVQPGRSLRLSCAASG-FTFS | S------YGMH | WVRQAPGKGLEWVA | VIWYD----GSNEHYADSVKG | RFTISRDNSKNTLYLQMNSLRAEDTAVYYCAR | DHGVGY------NGMDV | WGQGTTVTVSS |
| iPS:4 36384 | 21-225_212F10 | VH3/3-33/D4/4-17/RF2/JH6 | QVQLVES-GGGVVQPGRSLRLSCAASG-FTFS | R------YGMH | WVRQAPGKGLEWVA | VIWYD----GSNKHYADSVKG | RFTISRDNSKNTLYLQMNSLRGEDTAVYYCAR | DRGVGY------YGMDV | WGQGTTVTVSS |
| iPS:4 36390 | 21-225_213D2 | VH3/3-33/D4/4-17/RF2/JH6 | QVQLVES-GGGVVQPGRSLRLSCAASG-FTFS | S------YGMH | WVRQAPGKGLEWVA | VIWYD----GSNKHYADSVKG | RFTISRDNSKNTLSLQMNSLRAEDTAVYYCAR | DYGVGY------YGIDV | WGQGTTVTVSS |
| iPS:4 36394 | 21-225_213C4 | VH3/3-33/D4/4-17/RF2/JH6 | QVQLVES-GGGVVQPGRSLRLSCATSG-FTFS | S------YGMH | WVRQAPGKGLEWVA | VIWYD----GSNKHYADSVKG | RFTISRDNSKNTLYLQMNSLRAEDTAVYYCAR | DYGVGY------DGMDV | WGQGTTVTVSS |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 36398 | 21-225_213B8 | VH3/3-33/D4/4-17/RF2/JH6 | QVQLVES-GGGVVQPGRSLRLSCAASG-FTFS | S------YGMH | WVRQAPGKGLEWVA | VIWYD----GSNKHYADSVKG | RFTISRDNSKNTLYLQMNSLRAEDTAVYYCAR | DYGVGY-------YGTDV | WGQGTTVTVSS |
| iPS:4 36404 | 21-225_214C3 | VH3/3-33/D4/4-17/RF2/JH6 | QVQLVES-GGGVVQPGRSLRLSCAASG-FTFS | S------YGMH | WVRQAPGKGLEWVA | VIWYD----GSNKNYGDSVKG | RFTISRDNSKNTLYLQMNSLRAEDTAVYYCAR | DRGVGY-------DGMDV | WGQGTTVTVSS |
| iPS:4 36410 | 21-225_212E10 | VH3/3-33/D4/4-17/RF2/JH6 | QVQLVES-GGGVVQPGRSLRLSCAASG-FTFS | S------YGMH | WVRQAPGKGLEWVA | VIWYD----GSNKNYADSVKG | RFTISRDNSKNTLYLSLQMNSLRAEDTAVYYCAR | DYGVGY-------YGTDV | WGQGTTVTVSS |
| iPS:4 36420 | 21-225_215B5 | VH3/3-33/D4/4-17/RF2/JH6 | QVQLVES-GGGVVQPGRSLRLSCAASG-FTFS | S------YGMH | WVRQAPGKGLEWVA | VIWYD----GSNKHYADSVKG | RFTISRDNSKNTLYLQMNSLRAEDTAVYYCAR | DYGVGY-------YGTDV | WGQGTTVTVSS |
| iPS:4 36422 | 21-225_215D6 | VH3/3-33/D4/4-17/RF2/JH6 | QVQLVES-GGGVVQPGRSLRLSCAASG-FTFS | S------YGMH | WVRQAPGKGLEWVA | VIWYD----GSNKNYADSVKG | RFTISRDNSKNTLYLQMNSLRAEDTAVYYCAR | DCGVGY-------YGTDV | WGQGTTVTVSS |
| iPS:4 36430 | 21-225_215A12 | VH3/3-33/D4/4-17/RF2/JH6 | QVQLVES-GGGVVQPGRSLRLSCAASG-FTFS | S------YGMH | WVRQAPGKGLEWVA | VIWYD----GSNKHYADSVKG | RFTISRDNSKNTLYLQMNSLRAEDTAVYYCAR | DRGVGY-------YGMDV | WGQGTTVTVSS |
| iPS:4 36452 | 21-225_217G5 | VH3/3-33/D4/4-17/RF2/JH6 | QVQLVES-GGGVVQPGRSLRLSCAASG-LTFS | S------NGMH | WVRQAPGKGLEWVA | VIWYD----GSNKHYADSVKG | RFTISRDNSKNTLYLQMNSLRAEDTAVYYCAR | DYGVGY-------YGLDV | WGQGTTVTVSS |
| iPS:4 36464 | 21-226_219H1 | VH3/3-33/D4/4-17/RF2/JH6 | QVQLVES-GGGVVQPGRSLRLSCAASG-FTFS | R------YGMH | WVRQAPGKGLEWVA | VIWYD----GSNKHYADSVKG | RFTISRDNSKNTLYLQMNSLRGEDTAVYYCAR | DRGVGY-------NGMDV | WGQGTTVTVSS |
| iPS:4 51120 | 21-225_197D3 | VH3/3-33/D4/4-17/RF2/JH6 | QVQLVES-GGGVVQPGRSLRLSCAASG-FTFS | S------HGMH | WVRQAPGKGLEWVA | VIWYD----GSNEHYADSVKG | RFTISRDNSKNTLYLQMNSLRAEDTAVYYCAR | DQGVGY-------YGMDV | WGQGTTVTVSS |
| | Germline | VH3/3-33/D4/4-17/RF2/JH4 | H_FR1 | H_CDR1 | H_FR2 | H_CDR2 | H_FR3 | H_CDR3 | H_FR4 |
| iPS:4 68822 | 21-225_147E10 | VH3/3-33/D4/4-17/RF2/JH4 | QVQLVES-GGGVVQPGRSLRLSCAASG-FTFS | N------YGLH | WVRQAPGKGLEWVA | IIWYD----GSNKYYADSVKG | RFTISRDNSKNTLYLQMNSLRAEDTAVYYCAR | DHYDFW-------SGHFDY | WGQGTLVTVSS |
| iPS:4 33865 | 21-225_46F2 | VH3/3-33/D4/4-17/RF2/JH4 | QVQLVES-GGGVVQPGRSLRLSCAASG-FTFS | S------YGMH | WVRQAPGKGLEWVA | IIWYD----GSNKYYVDSVKG | RFTISRDNSKNTLYLQMNSLRAEDTAVYYCAR | DRYDFW-------SGYFDY | WGQGTLVTVSS |

FIGURE 51 (Continued)

| | | | | | | | | |
|---|---|---|---|---|---|---|---|---|
| iPS:4 34255 | 21-225_62E6 | VH3J3-33D4J4-17JRF2J H4 | QVQLVES-GGGVVQPGRSLRL SCAASG-FTFS | S------YGMH | WVRQAPGK GLEWVA | AIWYD---- GSNKYYGDS VKG | RVTISRDNSKNSLHLQMNSL RAEDTAVYYCAR | DQGIVG------ATWFDY | WGQGT LVTVS S |
| iPS:4 34269 | 21-225_57H3 | VH3J3-33D4J4-17JRF2J H4 | QVQLVES-GGGVVQPGRSLRL SCAASG-FTFS | S------YGMH | WVRQAPGK GLEWVA | AIWYD---- GSNKYYADS VKG | RFTISRDNSKNTLYLQMNSL RAEDTAVYYCAR | DYGIVG------ATYFDY | WGQGT LVTVS S |
| iPS:4 34345 | 21-225_64H9 | VH3J3-33D4J4-17JRF2J H4 | QVQLVES-GGGVVQPGRSLRL SCAASG-FTFS | T------YGMH | WVRQAPGK GLEWVA | IIWYD---- GSNKYYADS VKG | RFTISRDNSKNTLYLQMNSL RAEDTAVYYCAR | DTYDFW------SGYLGY | WGQGT LVTVS S |
| iPS:4 34363 | 21-225_65A6 | VH3J3-33D4J4-17JRF2J H4 | QVQLVES-GGGVVQPGRSLRL SCAASG-FTFS | N------YGMH | WVRQAPGK GLEWVA | VIWYD---- GSNKYYGDS VKG | RVTISRDNSKNSLHLQMNSL RAEDTAVYYCAR | DQGIVG------ATWFDY | WGQGT LVTVS S |
| iPS:4 34393 | 21-225_67C3 | VH3J3-33D4J4-17JRF2J H4 | QVQLVES-GGGVVQPGRSLRL SCAASG-FTFS | S------YGMH | WVRQAPGK GLEWVA | AIWYD---- GSNKYYGDS VKG | RFTISRDNSKNTLYLQMNSL SAEDTAVYYCAR | DQGIVG------ATWFDY | WGQGT LVTVS S |
| iPS:4 34425 | 21-225_70A5 | VH3J3-33D4J4-17JRF2J H4 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | DQGIVG------ATWFDY | WGQGT LVTVS S |
| iPS:4 35341 | 21-225_148B2 | VH3J3-33D4J4-17JRF2J H4 | QVQLVES-GGGVVQPGRSLRL SCAASG-FTFS | S------YGMH | WVRQAPGK GLEWVA | IIWYD---- GSYKYYADS VKG | RFTISRDNSKNTLYLQMNSL SAEDTAVYYCAR | DHFDFW------SGHFDY | WGQGT LVTVS S |
| iPS:4 35357 | 21-225_148G10 | VH3J3-33D4J4-17JRF2J H4 | QVQLVES-GGGVVQPGRSLRL SCAASG-FTFS | S------YGMH | WVRQAPGK GLEWVA | IIWYD---- GSNKYYADS VKG | RFTISRDNSKNTLYLQMNSL RAEDTAVYYCAR | DRYDFW------SGHFDY | WGQGT LVTVS S |
| iPS:4 35365 | 21-225_149F1 | VH3J3-33D4J4-17JRF2J H4 | QVQLVES-GGGVVQPGRSLRL SCAASG-FTFS | S------YGMH | WVRQAPGK GLEWVA | IIWYD---- GSNKYYADS VKG | RFTISRDNSKNTLYLQMNSL SAEDTAVYYCAR | DHFDFW------SGHFDY | WGQGT LVTVS S |
| iPS:4 35413 | 21-225_150B11 | VH3J3-33D4J4-17JRF2J H4 | QVQLVES-GGGVVQPGRSLRL SCAASG-FTFS | S------YGMH | WVRQAPGK GLEWVA | IIWYD---- GSNKYYADS VKG | RFTISRDNSKNTLYLQMNSL RAEDTAVYYCAR | DRYDFW------SGHFDY | WGQGT LVTVS S |
| iPS:4 35423 | 21-225_151G5 | VH3J3-33D4J4-17JRF2J H4 | QVQLMES-GGGVVQPGRSLRL SCAASG-FTFS | S------YGMH | WVRQAPGK GLEWVA | IIWYD---- GSNKYYADS VKG | RFTISRDNSKNTLYLQMNSL RAEDTAVYYCAR | DKYDFW------SGHFDY | WGQGT LVTVS S |
| iPS:4 35429 | 21-225_151A10 | VH3J3-33D4J4-17JRF2J H4 | QVQLVES-GGGVVQPGRSLRL SCAASG-FTFS | N------YGMH | WVRQAPGK GLEWLA | IIWYD---- GSNKYYADS VKG | RFTISRDNSKNTLYLQMNSL RAEDTAVYYCAR | DHYDFW------SGHFDY | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35489 | 21-225_155A5 VH3|3-33|D4|4-17|RF2|JH4 | QVQLVES-GGGVVQPGRSLRL SCAASG-FTFS | S------YGMH | WVRQAPGK GLEWVA | IIWYD---- GSYKYYADS VKG | RFTISRDNSKNTLYLHMNSL RAEDTAVYYCAR | DRYDFW---- -------SGHFDY | WGQGT LVTVS S |
| iPS:4 35683 | 21-225_170A1 VH3|3-33|D4|4-17|RF2|JH4 | QVQLVES-GGGVVQPGRSLRL SCAASG-FTFS | S------YGMH | WVRQAPGK GLEWVA | IIWYD---- GSYKYYADS VKG | RFTISRDNSKNTLYLQMNSL RAEDTAVYYCAR | DAHDFW---- -------SGYFDS | WGQGT LVTVS S |
| iPS:4 35755 | 21-225_176H4 VH3|3-33|D4|4-17|RF2|JH4 | QVQLVES-GGGVVQPGRSLRL SCAASG-FTFS | S------YGMH | WVRQAPGK GLEWVA | IIWYD---- GSYKYYADS VKG | RFTISRDNSKNTLYLQMNSL RAEDTAVYYCAR | DAHDFW---- -------SGYFAY | WGQGA LVTVS S |
| iPS:4 35795 | 21-225_181C2 VH3|3-33|D4|4-17|RF2|JH4 | QVQLVES-GGGVVQPGRSLRL SCVASG-FTFS | S------YGMH | WVRQAPGK GLEWVT | IIWYD---- GSYKYYADS VKG | RFTISRDNSKNTLYLQMNSL RAEDTAVYYCAR | DHYDFW---- -------SGHFDF | WGQGT LVTVS S |
| iPS:4 35807 | 21-225_181C10 VH3|3-33|D4|4-17|RF2|JH4 | QVQLVES-GGGVVQPGRSLRL SCAASG-FTFS | S------YGMH | WVRQAPGK GLEWMA | IIWYD---- GSYKYYADS VKG | RFTISRDNSKNTLYLQMNSL RAEDTAVYYCAR | DHYDFW---- -------SGHFDY | WGQGT LVTVS S |
| iPS:4 35887 | 21-225_186F7 VH3|3-33|D4|4-17|RF2|JH4 | QVQLVES-GGGVVQPGRSLRL SCAASG-FTFS | T------YGMH | WVRQAPGK GLEWVA | IIWYD---- GSYKYYADS VKG | RFTISRDNSKNTLYLQMNSL RAEDTAVYYCAR | DHYDFW---- -------SGHFDY | WGQGT LVTVS S |
| iPS:4 35901 | 21-225_189G2 VH3|3-33|D4|4-17|RF2|JH4 | QVQLVES-GGGVVQPGRSLRL SCAASG-FTFS | N------YGMH | WVRQAPGK GLEWVA | IIWYD---- GSYKYYADS VKG | RFTISRDNSKNTLYLQMNSL RAEDTAVYYCAR | DRFDFW---- -------SGYSDY | WGQGT LVTVS S |
| iPS:4 36594 | 21-225_226A5 VH3|3-33|D4|4-17|RF2|JH4 | QVQLVES-GGGVVQPGRSLRL SCAASG-FTFS | N------YGMH | WVRQAPGK GLEWVA | IINYD---- GTNKYYTDS VKG | RFTISRDNSKNTLYLQMNSL RAEDTAVYYCAR | EGRDFW---- -------SGFFCY | WGQGT LVTVS S |
| iPS:3 92814 | 21-225_22A1 VH3|3-33|D4|4-17|RF2|JH4 | QVQLVES-GGGVVQPGRSLRL SCAASG-FTFS | S------YGMH | WVRQAPGK GLEWVA | VNWYD---- GSNKYYADS VKG | RFTISRDNSKNTLYLQMNSL RAEDTAVYYCAR | DGGPL------ --------EWLDY | WGQGT LVTVS S |
| iPS:3 93036 | 21-225_28G3 VH3|3-33|D4|4-17|RF2|JH4 | QVQLVES-GGGVVQPGRSLRL SCAASG-FIFS | T------YGMH | WVRQAPGK GLEWVA | VIWYD---- GSNKYYADS VKG | RFTISRDNSKNTLYLQMNSL RAEDTAVYYCAR | DRYDFW---- -------SGYFDY | WGQGT LVTVS S |
| | Germline | H_FR1 | H_CDR1 | H_FR2 | H_CDR2 | H_FR3 | H_CDR3 | H_FR4 |
| VH3|3-33|D7|7-27|RF1|JH4 | | QVQLVES-GGGVVQPGRSLRL SCAASG-FTFS | | WVRQAPGK GLEWVA | | RFTISRDNSKNTLYLQMNSL RAEDTAVYYCAR | | WGQGT LVTVS S |
| iPS:4 68824 | 21-225_73G6 VH3|3-33|D7|7-27|RF1|JH4 | QVQLVES-GGGVVQPGRSLRL SCAASG-FTFS | S------YGMH | WVRQAPGK GLEWVA | VIWYD---- VSNKYYGDS VKG | RFTISRDNSKMTLYLQMNSL RAEDTAVYYCAR | EVGM------ --------TSDY | WGQGT LVTVS S |

FIGURE 51 (Continued)

| | | | | | | | | |
|---|---|---|---|---|---|---|---|---|
| iPS:4 34169 | 21-225_50C4 | VH3-33/D7/7-27/RF1/J H4 | QVQLVES-GGGVVQPGRSLRL SCAASG-FTFS | D------YGMH | WVRQAPGK GLEWVA | VIWYE----ETNRYYADS VKG | RFTISRDNSKNTLYLQMNSL RGEDTAVYYCAR | EVGF--------LNDY | WGQGT LVTVS S |
| iPS:4 35045 | 21-225_90H5 | VH3-33/D7/7-27/RF1/J H4 | QVQLVES-GGGVVQPGRSLRL SCAASG-FTFS | D------YGMH | WVRQSPGK GLEWVA | VIWYADS GSNFYYADS VKG | RFTISRDNSKNTLYLQMNSL RAEDTAVYYCVR | EMGW--------LDDY | WGQGT LVTVS S |
| iPS:4 35367 | 21-225_149G1 | VH3-33/D7/7-27/RF1/J H4 | QVQLVES-GGGVVQPGRSLRL SCAASG-FTFS | D------YGMH | WVRQAPGK GLEWVA | VIWYE----GSNKYYADS VKG | RFTISRDNSKNMLYLQMNSL RAEDTAVYYCAR | EIGF--------SEDY | WGQGT LVTVS S |
| iPS:4 35397 | 21-225_149F12 | VH3-33/D7/7-27/RF1/J H4 | QVQLVES-GGGVVQPGRSLRL SCAASG-FTFS | D------YGMH | WVRQAPGK GLEWVA | VIWYE----EMNRYYADS VKG | RFTISRDNSKNTLFLQMNSL RAEDTAVYYCAR | EIGF--------SEDY | WGQGT LVTVS S |
| iPS:4 35407 | 21-225_150E7 | VH3-33/D7/7-27/RF1/J H4 | QVQLVES-GGGVVQPGRSLRL SCAASG-FTFS | D------YGMH | WVRQAPGK GLEWVA | VIWYE----GSNKYYADS VKG | RFTISRDNSKNTLYLQMNSL RAEDTAVYYCAR | EIGF--------SEDY | WGQGT LVTVS S |
| iPS:4 35609 | 21-225_161F7 | VH3-33/D7/7-27/RF1/J H4 | QVQLVES-GGGVVQPGRSLRL SCAASG-FTFS | D------FGLH | WVRQAPGQ GLEWVA | VIWFD----GSNRYYADS VKG | RFTIFRDNSKNTLYLQMNSL RAEDTAVYYCAR | EIGW--------LSDY | WGQGT LVTVS S |
| iPS:4 35613 | 21-225_161D11 | VH3-33/D7/7-27/RF1/J H4 | QVQLVES-GGGVVQPGRSLRL SCAASG-FTFS | D------FGLH | WVRQAPGG GLEWVA | VIWFD----GSNRYYADS VKG | RFTISRDNSKNTLYLQMNSL RAEDTAVYYCAR | EIGW--------LSDY | WGQGT LVTVS S |
| iPS:4 35791 | 21-225_180H7 | VH3-33/D7/7-27/RF1/J H4 | QVQLVES-GGGVVQPGRSLRL SCAASG-FTFS | D------YGMH | WVRQAPGK GLEWVA | VIWYADS EENKHYADS AKG | RFTISRDNSKNTLYLQMNSL RVEDTAVYYCAR | EVGW--------SDDY | WGQGT LVTVS S |
| iPS:4 35805 | 21-225_181A8 | VH3-33/D7/7-27/RF1/J H4 | QVQLVES-GGGVVQPGRSLRL SCAASG-FTFS | D------YGMH | WVRQAPGK GLEWVA | VIWYD----ENNKHYADS AKG | RFTISRDNSKNTLYLQMNSL RAEDTAVYYCAR | EVGW--------SDDY | WGQGT LVTVS S |
| iPS:4 35879 | 21-225_184H10 | VH3-33/D7/7-27/RF1/J H4 | QVQLVES-GGGVVQPGRSLRL SCAASG-FTFS | D------YGMH | WVRQAPGK GLEWVA | VIWYD----ETNKKYADS VKG | RFTIFRDNSKNTLYLQMNSL RAEDTAVYYCAR | EVGW--------HDDY | WGQGT LVTVS S |
| iPS:4 35881 | 21-225_184D11 | VH3-33/D7/7-27/RF1/J H4 | QVQLVES-GGGVVQPGRSLRL SCVASG-FTFS | D------YGMH | WVRQAPGK GLEWVA | VIWYD----ETNKHYGDS VKG | RFTISRDNSKDTLYLQMNSL RAEDTAVYYCAR | EVGW--------HDDY | WGQGT LVTVS S |
| iPS:4 36350 | 21-225_210E4 | VH3-33/D7/7-27/RF1/J H4 | QVQLVES-GGGVVQPGRSLRL SCAASG-FTLI | N------YGMH | WVRQAPGK GLEWVA | VIWYD----ENNRYVDS VKG | RFTISRDDSKNTLYLQMNSL RAEDSAVYYCAR | ETGF--------LSDY | WGQGT LVTVS S |

FIGURE 51 (Continued)

| | | | | | | | | |
|---|---|---|---|---|---|---|---|---|
| iPS:4 36576 | 21-225_225B6 | VH3\|3-33/D7\|7-27\|RF1/J H4 | QVQLVES-GGGVVQPGRSLRL SCAASG-FTFS | D------YGMH | WVRQAPGK GLEWVA | VIWYD---ENNKYYADS VKG | RFTISRDNSKNTLYLQMNSL RAEDTAVYYCAR | EVGF--------TEDY | WGQGT LVTVS S |
| iPS:4 36578 | 21-225_225D6 | VH3\|3-33/D7\|7-27\|RF1/J H4 | QVQLVES-GGGVVQPGRSLRL SCAASG-FTFS | N------YGMH | WVRQAPGK GLEWVA | VIWYD---ENNKYYADS VKG | RFTISRDNSQNTLYLQMTSL RAEDTAVYYCAR | EVGF--------TEDY | WGQGT LVTVS S |
| iPS:4 36582 | 21-225_225F8 | VH3\|3-33/D7\|7-27\|RF1/J H4 | QVQLVES-GGGVVQPGRSLRL SCAASG-FTFS | S------YGMH | WVRQAPGK GLEWVA | VIWYD---ENNKYYVDS VKG | RFTISRDNSKNTLYLQMNSL RAEDTAVYYCAR | EVGF--------TEDY | WGQGT LVTVS S |
| iPS:4 36608 | 21-225_226A9 | VH3\|3-33/D7\|7-27\|RF1/J H4 | QVQLVES-GGGVVQPGRSLRL SCAASG-FTFS | N------YGMH | WVRQAPGK GLEWVA | VIWYE---ESNKYYTDS VKG | RFTISRDNSKNTLFLQMNSL RAEDTAVYYCAR | EVGF--------TEDY | WGQGT LVTVS S |
| iPS:4 36630 | 21-225_227G3 | VH3\|3-33/D7\|7-27\|RF1/J H4 | QVQLVES-GGGVVQPGRSLRL SCAASG-FTFS | S------YGMH | WVRQAPGK GLEWVA | VIWYV---GSMQYYADS VKG | RFTISRDNSKNTLYLQMSSL RAEDTAVYYCAR | EVGF--------TEDY | WGQGT LVTVS S |
| iPS:4 36634 | 21-225_227H5 | VH3\|3-33/D7\|7-27\|RF1/J H4 | QVQLVES-GGGVVQPGRSLRL SCAASG-FTFS | N------YGMH | WVRQAPGK GLDWVA | VIWYE---ESNKYYADS VKG | RFTISRDNSKNTLYLQMNSL RAEDTAMYYCAR | EVGF--------TEDY | WGQGT LVTVS S |
| iPS:4 36650 | 21-225_227C12 | VH3\|3-33/D7\|7-27\|RF1/J H4 | QVQLVES-GGGVVQPGRSLRL SCAASG-FTFS | N------YGMH | WVRQAPGK GLEWVA | VIWYI---VTNKYYADS VKG | RFTISRDNSKNTLYLQMNSL RAEDTAVYYCAR | EVGW--------TEDY | WGQGT LVTVS S |
| iPS:4 37280 | 21-225_203C10 | VH3\|3-33/D7\|7-27\|RF1/J H4 | QVQLVES-GGGVVQPGRSLRL SCAASG-FTFS | D------YGMH | WVRQAPGK GLEWMA | VIWID---GGNTHYTDS VKG | RFTISRDNSKNTLYLQMNSL RAEDTAVYYCAR | EVGW--------LDDY | WGQGT LVTVS S |
| iPS:3 92740 | 21-225_18H12 | VH3\|3-33/D7\|7-27\|RF1/J H4 | QVQLVES-GGGVVQPGRSLRL SCAASG-FTFS | D------YGMH | WVRQAPGK GLEWVA | VIWYE---EMNQYYADS VKG | RFTISRDNSKNTLYLQMNSL RAEDTAVYYCAR | EVGW--------YEDY | WGQGT LVTVS S |
| iPS:3 92780 | 21-225_22B7 | VH3\|3-33/D7\|7-27\|RF1/J H4 | QVQLVES-GGGVVQPGRSLRL SCAASG-FTFS | S------YGMH | WVRQAPGK GLEWVA | VIWYE---EMNQYYADS VKG | RFTISRDNSKNTLYLQMNSL RAEDTAVYYCAR | EVGF--------RSDY | WGQGT LVTVS S |
| iPS:3 92912 | 21-225_25A9 | VH3\|3-33/D7\|7-27\|RF1/J H4 | QVQLVES-GGGVVQPGRSLRL SCAASG-FTFS | S------YGMH | WVRQAPGK GLEWVA | VIWYD---VTNKYYTGS VKG | RFTISRDNSKNTLYLQMNSL RAEDTAVYYCAR | EIGW--------LDDY | WGQGT LVTVS S |
| iPS:3 92940 | 21-225_29D9 | VH3\|3-33/D7\|7-27\|RF1/J H4 | QVQLVES-GGGVVQPGRSLKL SCSASG-FTFS | D------YGIH | WVRQAPGK GLEWVA | VIWYD---ESNNYYADS VKG | RFTISRDNSKNTLYLQMNSL RAEDTAVYYCAR | EIGW--------LDDY | WGQGT QVTVS S |

FIGURE 51 (Continued)

| | | | | | | | | |
|---|---|---|---|---|---|---|---|---|
| iPS:3 92948 | 21-225_2G5 | VH3/3-33/D7/7-27/RF1/J H4 | QVQLVES-GGGVVQPGRSLRL SCAASG-FTFS | D------YGIH | WVRQAPGK GLEWVA | VIWYD---- GNNKYYADS VKG | RFTISRDNSKNTLYLQMNSL RAEDTAVYYCAR | EIGW----------LDDY | WGQGT LVTVS S |
| iPS:3 92978 | 21-225_2B8 | VH3/3-33/D7/7-27/RF1/J H4 | QVQLVES-GGGVVQPGRSLRL SCAASG-FTFS | D------YGMH | WVRQAPGK GLEWVT | VIWYD---- ANNKYYADS VKG | RFTISRDNSKNTLYLQMNSL RAEDTAVYYCAR | EIGW----------LDDY | WGQGT LVTVS S |
| iPS:3 92998 | 21-225_2BA9 | VH3/3-33/D7/7-27/RF1/J H4 | QVQLVES-GGGVVQPGRSLRL SCAASG-FTFS | S------YGIH | WVRQAPGK GLEWVA | VIWFD---- GSNKYYADS VKG | RFTISRDNSKNTLFLQMNSL RVEDTAVYYCAR | EIGW----------LDDY | WGQGT LVTVS S |
| iPS:3 93038 | 21-225_29D8 | VH3/3-33/D7/7-27/RF1/J H4 | QVQLVES-GGGVVQPGRSLRL SCAASG-FTFR | D------YGIH | WVRQAPGK GLEWVA | VIWFD---- GTNKYYADS VKG | RFTISRDNSKNTLYLQMNSL RAEDTAVYYCAR | EIGW----------LDDY | WGQGT LVTVS S |
| iPS:3 93056 | 21-225_30F3 | VH3/3-33/D7/7-27/RF1/J H4 | QVQLVES-GGGVVQPGRSLRL SCAASG-FTFS | S------YGMH | WVRQAPGK GLEWVA | VIWYD---- VSNKYYADS VKG | RFTISRDNSKNTLYLQMNSL RAEDTAVYYCAR | EMGW----------YDDY | WGQGT LVTVS S |
| iPS:3 93074 | 21-225_33B1 | VH3/3-33/D7/7-27/RF1/J H4 | QVQLVES-GGGVVQPGRSLRL SCAASG-FTFS | D------YGIH | WVRQAPGK GLEWVA | VIWYD---- RNNKYYADS VKG | RFTISRDNSKNTLYLQMNSL RAEDTAVYYCAR | EMGW----------YDDY | WGQGT LVTVS S |
| iPS:3 93822 | 21-225_15B11 | VH3/3-33/D7/7-27/RF1/J H4 | QVQLVES-GGGVVQPGRSLRL SCAASG-FTFS | N------YGMH | WVRQAPGK GLEWVA | VIWYE---- ESNKYYTDS VKG | RFTISRDNSKNTLYLQMNSL RPEDTAVYYCAR | EVGF----------TEDY | WGQGT LVTVS S |
| iPS:3 93856 | 21-225_14C2 | VH3/3-33/D7/7-27/RF1/J H4 | QVQLVES-GGGVVQPGRSLRL SCAASG-FTFS | D------YGMH | WVRQAPGK GLEWVA | VIWYD---- ESNKYYADS VKG | RFTISRDNSKNTLYLQMNSL RAEDTGVYYCAR | EVGF----------RSDY | WGQGT LVTVS S |
| iPS:3 93874 | 21-225_4C8 | VH3/3-33/D7/7-27/RF1/J H4 | QVQLVES-GGGVVQPGRSLRL SCAASG-FTFS | N------YGMH | WVRQAPGK GLEWVA | VIWYE---- EMNQYYADS VKG | RFTISRDNSKNTLYLQMNSL TAEDTAVYYSPR | EMGF----------LSDY | WGQGT LVTVS S |
| iPS:3 93984 | 21-225_4F12 | VH3/3-33/D7/7-27/RF1/J H4 | QVQLVES-GGGVVQPGRSLRL SCAASG-FTFS | S------YGMH | WVRQAPGK GLEWVA | VIWYD---- VTNKYYADS VKG | RFTISRDNSKNTLYLQMNSL TPENTGGYENQR | EKGG----------LFDY | WGQGT LVTVS S |
| iPS:3 94020 | 21-225_15H10 | VH3/3-33/D7/7-27/RF1/J H4 | QVQLVES-GGGVVQPGRSLRL SCAASG-FTFS | N------YGMH | WVRQAPGK GLEWVA | VIWYD---- ESNKYYEDS VKG | RFTISRDNSKNTLYLQMNSL RAEDTAVYYCVR | EVGF----------LSDY | WGQGT LVTVS S |
| iPS:3 94095 | 21-225_16H4 | VH3/3-33/D7/7-27/RF1/J H4 | QVQLVES-GGGVVQPGRSLRL SCAASG-FTFS | N------YGMH | WVRQAPGK GLEWVA | VIWYD---- VSNKYYADS VKG | RFTISRDNSKNMLYLQMNSL RAEDTAVYYCAR | EMGW----------TDDC | WGQGI LVTVS S |

FIGURE 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| | | VH1]1-08/D5]5-24]RF3/JH6 | QVQLVQS-GAEVKKPGASVKV SCKASG-YTFT | S | WVRQAPGK GLEWMG | WMNPT SGNTGAPK FQG | RVTMTRDTSISTAYMELSSL RSEDTAVYYCAR | EDCHVVY-YYGMDV | WGQGT TVTVS S |
| iPS:4 68818 | 21-225_190C8 | VH1]1-08/D5]5-24]RF3/JH6 | QVQLVQS-GAEVKKPGASVKV SCKASG-YTFI | S------YDIN | WVRQATGQ GLEWMG | WMNPK---- RGNTGYAQK FQG | RVTMTRDTSISTAYMELSSL RSEDTAVYYCAR | GDFYNWN---------SYAMDV | WGQGA TVTVS S |
| iPS:4 36023 | 21-225_193A5 | VH1]1-08/D5]5-24]RF3/JH6 | QVQLVQS-GAEVKKPGASVKV SCKASG-YTFI | S------YDIN | WVRQATGQ GLEWMG | WMNPK---- RGNTGYAQK FQG | RVTMTRDTSISTAYMELSSL RSEDTAVYYCAR | GDFYNWN---------SYAMDV | WGQGA TVTVS S |
| iPS:4 36132 | 21-225_196C12 | VH1]1-08/D5]5-24]RF3/JH6 | QVQLVQS-GAEVKKPGASVKV SCKASG-YTFI | S------YDIN | WVRQATGQ GLEWMG | WMNPK---- RGNTGYAQK FQG | RVTMTRDTSISTAYMELSSL RSEDTAVYYCAR | GDFYNWN---------SYAMDV | WGQGA TVTVS S |
| | | Germline | H_FR1 | H_CDR1 | H_FR2 | H_CDR2 | H_FR3 | H_CDR3 | H_FR4 |
| | | VH3]3-33/D2]2-8]RF3/JH5 | QVQLVES-GGGVVQPGRSLRL SCAASG-FTFS | S------YGMH | WVRQAPGK GLEWVA | VIWYD---- GSNKYYADS VKG | RFTISRDNSKNTLFLQMNSL RAEDTAVYYCAR | ETV1AFV---ANGFDP | WGQGT LVTVS S |
| iPS:4 68828 | 21-225_162A10 | VH3]3-33/D2]2-8]RF3/JH5 | QVQLVES-GGGVVQPGRSLRL SCAASG-FTFS | S------CGMH | WVRQAPGK GLEWVA | AIWYD---- GSNKYYADS VKG | RFTISRDNSKNTLFLQMNSL RAEDTAVYYCAR | DKNIMG--------DTWFDP | WGQGT LVTVS S |
| | | Germline | H_FR1 | H_CDR1 | H_FR2 | H_CDR2 | H_FR3 | H_CDR3 | H_FR4 |
| | | VH1]1-02/D5]5-18]RF3/JH4 | QVQLVQS-GAEVKKPGASVKV SCKASG-YTFT | G------YYMH | WVRQAPGQ GLEWMG | WINPN---- SGGTNYAQK FQG | RVTMTRDTSISTAYMELSRL RSDDTAVYYCAR | ETVIG---------YYFDV | WGQGT LVTVS S |
| iPS:4 68830 | 21-225_191G11 | VH1]1-02/D5]5-18]RF3/JH4 | QVQLVQS-GAEVKKPGASVKV SCKASG-YTFT | G------YYMH | WVRQAPGQ GLEWMG | WINPN---- SGGTNFAQK FQG | RVTLIRDTSINTAYMELSRL RSDDTAVYYCAR | GKNYG---------SYFDY | WGQGT LVTVS S |
| iPS:4 36896 | 21-225_67F10 | VH1]1-02/D5]5-18]RF3/JH4 | QVQLVQS-GAEVKKPGASVKV SCKASG-YTFT | G------YYMH | WVRQAPGQ GLEWMG | WINPN---- SGGTNYGQK FQG | RVTMTRDTSISTAYMELSRL RSDDTAVYYCAR | TYFYSGS---------YYNGFDY | WGQGT LVTVS S |
| iPS:3 93218 | 21-225_14G3 | VH1]1-02/D5]5-18]RF3/JH4 | QVQLVQS-GAEVKKPGASVKV SCKASG-YTFT | G------YYMH | WVRQAPGQ GLEWMG | WINPN---- SGGTNYAQK FQG | RVTMTRDTSISTAYMELSRL RSDDTAVYYCAR | SYFYGSGS---------YYNEFDY | WGQGT LVTVS S |
| iPS:3 93565 | 21-225_34B11 | VH1]1-02/D5]5-18]RF3/JH4 | QVKLVQS-GAEVKKPGASVKV SCKASG-YTFT | G------YYMH | WVRQAPGQ GLEWMG | WINPN---- SGGTNYAQK FQG | RVTMTRDTSISTAYMELSRL RSDDTAVYYCAR | VYFYGSGS---------YYNEFDY | WGQGT LVTVS S |
| iPS:3 98470 | 21-225_14B7 | VH1]1-02/D5]5-18]RF3/JH4 | QVQLVQS-GAEVKKPGASVKV SCKASG-YTFT | G------YYMH | WVRQAPGQ GLEWMG | WINPN---- SGGTNYQQK FQG | RVTMTRDTSISTACMELSRL KSDDTAVYFCAR | SFFYGSGS---------YYNEFDY | WGQGT LVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3-30.3D1|1-1|RF1/JH6 | | QVQLVES-GGGVVQPGRSLRLSCAASG-FTFS | S------YGMH | WVRQAPGKGLEWVA | VISYD----GGYKNYADSVKG | RFTISRDNSKNTLYLQMNSLRAEDTAVYYCAR | GTHGYY--------YGVDV | WGQGTTVTVSS |
| iPS:4 68836 21-225_198E3 | VH3-30.3D1|1-1|RF1/JH6 | QVQLVES-GGGVVQPGRSLRLSCAASG-FTFS | S------YGMH | WVRQAPGKGLEWVA | VISYD----GGYKNYADSVKG | RFTISRDNSKNTLYLQMNSLRAEDTAVYYCAR | GTHGYY--------YGVDV | WGQGTTVTVSS |
| iPS:4 35831 21-225_190C12 | VH3-30.3D1|1-1|RF1/JH6 | QVQLVES-GGAVVQPGRSLRLSCAASG-FTFS | S------YGMH | WVRQAPGKGLEWVA | VISYD----GGYKNYVDSVKG | RFTISRDNSKNTLYLQMNSLRAEDTAVYYCAR | GTHGYY--------YGVDV | WGQGTTVTVSS |
| iPS:4 35857 21-225_191A4 | VH3-30.3D1|1-1|RF1/JH6 | QVQLVES-GGGVVQPGRSLRLSCAASG-FTFS | S------YGMH | WVRQAPGKGLEWVA | VISYD----GGYKNYADSVKG | RFTISRDNSKNTLYLQMNSLRAEDTAVYYCAR | GTHGYY--------YGVDV | WGQGTTVTVSS |
| iPS:4 35907 21-225_190G3 | VH3-30.3D1|1-1|RF1/JH6 | QVQLVES-GGGVVQPGRSLRLSCAASG-FTFS | S------YGMH | WVRQAPGKGLEWVA | VISYD----GGYKNYVDSVKG | RFTISRDNSKNTLYLQMNSLRAEDTAVYYCAR | GTHGYY--------YGVDV | WGQGTTVTVSS |
| iPS:4 35919 21-225_190H5 | VH3-30.3D1|1-1|RF1/JH6 | QVQLVES-GGGVVQPGRSLRLSCAASG-FTFS | S------YGMH | WVRQAPGKGLEWVA | VISYD----GGYKNYADSVKG | RFTISRDNSKNTLYLQMNSLRAEDTAVYYCAR | GTHGYY--------YGVDV | WGQGTTVTVSS |
| iPS:4 35989 21-225_192F7 | VH3-30.3D1|1-1|RF1/JH6 | QVQLVES-GGGVVQPGRSLRLSCAASG-FTFS | S------YGMH | WVRQAPGKGLEWVT | VISYD----GGYKNYADSVKG | RFTISRDNSKNTLYLQMNSLRAEDTAVYYCAR | GTHGYY--------YGVDV | WGQGTTVTVSS |
| iPS:4 36222 21-225_200C9 | VH3-30.3D1|1-1|RF1/JH6 | QVQLVES-GGGVVQPGRSLRLSCAASG-FTFS | S------YGMH | WVRQAPGKGLEWVA | VISYD----GGYKNYIDSVKG | RFTISRDNSKNTLYLQMNSLRAEDTAVYYCAR | GTHGYY--------YGVDV | WGQGTTVTVSS |
| | Germline | H_FR1 | H_CDR1 | H_FR2 | H_CDR2 | H_FR3 | H_CDR3 | H_FR4 |
| VH4-4-30.1D5|5-24|RF3/JH6 | | | | | | | | |
| iPS:4 68840 21-225_200H9 | VH4-4-30.1D5|5-24|RF3/JH6 | QVQLQES-GPGLVKPSQTLSLTCTVSG-GSMR | SG----GDYWS | WIRQHPGKGLEWPG | YIYY----SGSTYYNPSLKS | RVTLSVDTSKNQFSLKLSSVTAADTAVYYCAR | MDYSNI--------YYGMDV | WGQGTSVTVSS |
| iPS:4 36096 21-225_195E10 | VH4-4-30.1D5|5-24|RF3/JH6 | QVQLQES-GPGLVKPSQTLSLTCTVSG-GSIS | SG----GYYWS | WIRQHPGKGLEWIG | YIYY----SGSTYYNPSLKS | RVTISVDTSKNQFSLKLSSVAAADTAVYYCAR | GGYWN--------HGMDV | WGQGTTVTVSS |
| iPS:4 36120 21-225_196C10 | VH4-4-30.1D5|5-24|RF3/JH6 | QVQLQES-GPGLVKPSQTLSLTCTVSG-GSMR | SG----GDYWS | WIRQHPGKGLEWIG | FIYY----SGSTYYNPSLKS | RVTLSVDTSKNQFSLKLSSVTAADTAVYYCAR | MDYSNI--------YYGMDV | WGQGTTVTVSS |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36216 | 21-225_200B7 | VH4/4-30.1/D3/5-24/RF3/J H6 | EVQLQES-GPGLVKPSQTLSL TCTVSG-GSIS | SG----GYYWS | WIRQHPGK GLEWIG | YIFY-SGSTNYNPS LRS | RVTISVDTSKNQFSLRLSSV TAADTAVYYCAR | AGYWWN-----NGMDV | WGQGT TVTVS S |
| | Germline | VH3/3-21/D6/6-6/RF2/JH4 | | | | | | | |
| iPS:4 68844 | 21-225_48E10 | VH3/3-21/D6/6-6/RF2/JH 4 | EVQLVES-GGGLVKPGGSLRL SCAASG-FTFS | S-----YSMN | WVRQAPGK GLEWVS | SISGS----SSYIYYADS VKG | RFTISRDNAKNSLYLQMNSL RAEDTAVYYCAR | SL------------DL | WGQGT LVTVS S |
| iPS:4 35537 | 21-225_157H12 | VH3/3-21/D6/6-6/RF2/JH 4 | EVQLVES-GGGLVKPGGSLRL SCAASG-FTFS | S-----YSMN | WVRQAPGK GLEWVS | SISGS----GSTNYADS VKG | RFTISRDNAKTSLYLQVNGL RAEDTAVYYCAR | SKF------------DS | WGQGT LVTVS S |
| iPS:4 35539 | 21-225_158G1 | VH3/3-21/D6/6-6/RF2/JH 4 | EVQLVES-GGGLVKPGGSLRL SCAASG-FTFS | S-----YGMN | WVRQAPGK GLEWIS | SISGS----SSYIYYADS VKG | RFTISRDNAKNSLYLQMNSL RAEDTAVYYCAI | SSG------------WS | WGQGT LVTVS S |
| iPS:4 35583 | 21-225_160F2 | VH3/3-21/D6/6-6/RF2/JH 4 | EVQLVES-GGGLVKPGGSLRL SCAASG-FTFS | S-----YGMN | WVRQAPGK GLEWVS | SISGS----SSYIYYADS VKG | RFTISRDNAKNSLYLQMNSL RAEDTAVYYCAI | SSG------------WS | WGQGT LVTVS S |
| | Germline | VH3/3-21/D1/1-11/RF2/JH5 | | | | | | | |
| iPS:4 68846 | 21-225_53B10 | VH3/3-21/D1/1-1/RF2/JH 5 | EVQLVES-GGGLVKPGGSLRL SCAASG-FTFS | S-----YSMN | WVRQAPGK GLEWVS | SISSS----SSYIYYADS VKG | RFTISRDNAKNSLYLQMNSL RAEDTAVYYCAR | VNS------------FDS | WGQGT LVTVS S |
| iPS:4 34251 | 21-225_62G3 | VH3/3-21/D1/1-1/RF2/JH 5 | EVQLVES-GGGLVKPGGSLRL SCAASG-FTFS | S-----YSMN | WVRQAPGK GLEWVS | SISGS----SSYIYYADS VKG | RFTISRDNAKNSLYLQMNSL RAEDTAVYYCAR | VNS------------FDS | WGQGT LVTVS S |
| iPS:4 34407 | 21-225_68G8 | VH3/3-21/D1/1-1/RF2/JH 5 | EVQLVES-GGGLVKPGGSLRL SCAASG-FTFS | S-----YSMN | WVRQAPGK GLEWVS | SISGS----SSYIYYADS VWG | RFTISRDNAKNSLYLQMNSL RAEDTAVYYCAR | VNS------------FDS | WGQGT LVTVS S |
| iPS:4 35575 | 21-225_159H11 | VH3/3-21/D1/1-1/RF2/JH 5 | EVQLVES-GGGLVKPGGSLRL SCAASG-FTFS | S-----YTMN | WVRQAPGK GLEWVS | SISGS----SSYIYYADS VKG | RFTISRDNAKNSLYLQMNSL RAEDTAVYYCAR | VSW------------ADC | WGQGT LVTVS S |
| | Germline | VH3/3-21/D1/1-11/RF2/JH4 | | | | | | | |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 68848 | 21-225_54B1 | VH3/3-23/D1/1-1|RF2/JH4 | EVQLLES-GGGLVQPGGSLRL SCAASG-FTFS | S------YAMS | WVRQAPGK GLEWVS | VLSGS---GGSTFYADS VKG | RFTISRENSKNTLYLQMSSL RAEDTAVYYCAR | RGREYSG------VDYEDY | WGQGT LVTVS S |
| iPS:4 33993 | 21-225_47G7 | VH3/3-23/D1/1-1|RF2/JH4 | EVQLLDS-GGGLVQPGGSLRL SCAASG-FTFS | S------YAMS | WVRQAPGK GLEWVS | AISGR---GGNTFYAES VRG | RFTISRDNSKNTLYLQMNSL RAEDTAVYYCAR | IIREQ------WAFDY | WGQGT LVTVS S |
| iPS:4 34007 | 21-225_48D7 | VH3/3-23/D1/1-1|RF2/JH4 | EVQLLES-GGGLVQPGGSLRL SCAASG-FTFR | N------SAMN | WVRQAPGK GLEWVS | AISGS---GGTFYADS VKG | RFTISRDNSKNTLYLQINSL RAEDTAVYYCAR | CGREQ------WLDY | WGQGT LVTVS S |
| iPS:4 34115 | 21-225_53E4 | VH3/3-23/D1/1-1|RF2/JH4 | EVQLLES-GGGLVQPGGSLRL SCAASG-FTFS | S------YVMS | WVRQAPGK GLEWVS | GISGS---GGRTYYADS VKG | RFNISRDNSKNTLYLQMNSL RAEDTAVYYCAR | VAL------FDY | WGQGT LVTVS S |
| iPS:4 35679 | 21-225_169D10 | VH3/3-23/D1/1-1|RF2/JH4 | EVQLLES-GGGLVQSGGSLRL SCAASG-FTFS | S------YVMS | WVRQAPGK GLEWVS | AISGS---GNRIYYADS VKG | RFTISRDNSKNTLYLQMNSL RAEDTAVYYCAR | VAF------FDY | WGQGT LVTVS S |
| iPS:4 35685 | 21-225_170E1 | VH3/3-23/D1/1-1|RF2/JH4 | EVQLLES-GGGLVQPGGSLRL SCAASG-FTFS | S------YVMS | WVRQAPGK GLEWVS | AISGS---GNRIYYADS VKG | RFTISRDNSKNTLYLQMNSL RAEDTAVYYCAR | VAF------FDY | WGQGT LVTVS S |
| iPS:4 36632 | 21-225_227E4 | VH3/3-23/D1/1-1|RF2/JH4 | EGQLLES-GGGLVQPGGSLRL SCTAASG-FTFS | T------FAMT | WVRQAPGR GLEWVS | VISGR---GGSSPYADS VKG | RFTISRDNTRKNTLYLQMNSL RAEDTAVYYCAR | DQLW------FDY | WGQGT LVTVS S |
| | Germline | VH4/4-39/D4/4-11|RF2/JH5 | QLQLQES-GPGLVTPSETLSL TCTVSG-GSIS | | WIRQPPGK GLEWIG | | | | WGQGT |
| iPS:4 68856 | 21-225_77C9 | VH4/4-39/D4/4-11|RF2/JH5 | QLQLQES-GPGLVTPSETLSL TCTVSG-GSIS | RS-----SYYWG | WIRQPPGK GLEWIG | SIYY----SGSAYSNPS LKS | RVTISVDTSKNQFSLKLSSV TAADTALFYCAR | LDSNW------GLDY | WGQGT LVTVS S |
| iPS:4 34489 | 21-225_74E4 | VH4/4-39/D4/4-11|RF2/JH5 | QLQLQES-GPGLVKPSETLSL ICTVSG-GSIS | SS-----NYYWG | WIRQPPGK GLEWIG | SIYY----SGYTSYNPS LKS | RVTISVDSSKNHFSLRLSSV TAADTAVYYCAR | LDSNW------GLDY | WGQGT LVTVS S |
| iPS:4 35251 | 21-225_96A3 | VH4/4-39/D4/4-11|RF2/JH5 | QLQLQES-GPGLVKPSETLSL ICTVSG-GSIS | SS-----NYYWG | WIRQPPGK GLEWIG | SIYY----SGYTSYNPS LKS | RVTISVDSSKNHFSLRLSSV TAADTAVYYCAR | LDSNW------GLDY | WGQGT LVTVS S |
| iPS:4 37346 | 21-225_75H7 | VH4/4-39/D4/4-11|RF2/JH5 | QLQLQES-GPGLVTPSETLSL TCTVSG-GSIS | RS-----SYYWG | WIRQPPGK GLEWIG | SIYY----SGSAYSNPS LKS | RVTISVDTSKNQFSLKLSSV TAADTALFYCAR | LDSNW------GLDY | WGQGT LVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 93886 | 21-225_2G9 | VH4|4-39|D4|4-11|RF2|JH5 | QLQLQES-GPGLVKPSETLSL TCTVSG-GSIR | PN-----YYWG | WIRQPPGK GLEWIG | ISIYY----SGSTSYNPS LNS | RVTISVDTISKNQFSLKLNSV TAADTAVYYCAR | LSSNW-------DFDN | WGQGT LVTVS S |
| iPS:3 93928 | 21-225_4E10 | VH4|4-39|D4|4-11|RF2|JH5 | QLQLQES-GPGLVKPSETLSL TCTVSG-GSIS | RS-----SYYWG | WIRQPPGK GLEWIG | SVYY----SGATSYNPS LKS | RVTISVDTISKNQFSLKLNSV TAADIALYYCVR | LSSNW-------DFDY | WGQGT LPTVS S |
| Germline | | | | H_CDR1 | H_FR2 | H_CDR2 | H_FR3 | H_CDR3 | H_FR4 |
| iPS:4 68862 | 21-225_178H8 | VH1|1-02|D6|6-6|RF1|JH6 | QVQLVQS-GAEVRTPGASVKV SCKASG-YTFT | D-----YIMH | WVRQAPGQ GLEWMG | WINPN----RGGINYAQK FQG | RVTMTRDTSISTAYMELSRL RSDDTAVYYCVR | EEDRSGWY-----YYYGMDV | WGQGT TVTVS S |
| iPS:4 51112 | 21-225_53D10 | VH1|1-02|D6|6-6|RF1|JH6 | QVQLVQS-GAEVKKPGASVRV SCKASG-YIFT | G-----YYIH | WVRQAPGQ GLEWMG | WINPN----SGGINYAQK FQG | RVTMTRDTSISTAYMELIRL RSDDTAVYYCAR | ENESLATRP-----FIDYYGMDV | WGQGT TVTVS S |
| Germline | | | | H_CDR1 | H_FR2 | H_CDR2 | H_FR3 | H_CDR3 | H_FR4 |
| iPS:4 68864 | 21-225_60D6 | VH2|2-05|D6|6-6|RF2|JH4 | QITLKES-GPTLVKPTQTLTL TCTFSG-FSLS | TS-----GVGVG | WIRQPPGK ALEWLA | LIYW----KDDKRYSPS LKS | RLTITKDISKNQVVLTMTNM DPVDTATYYCAH | AVAV-------SFDY | WGQGT LVTVS S |
| iPS:4 36850 | 21-225_57D9 | VH2|2-05|D6|6-6|RF2|JH4 | QITLKES-GPMLVKPTQTLTL TCTFSG-FSLS | TS-----GVGVG | WIRQPPGK ALEWLA | LIYW----NDDKRYSPS LKS | RLTITEDTSKNQVVLTMTNM DPVDTATYYCAH | AVAV-------SFDY | WGQGT LVTVS S |
| iPS:4 36914 | 21-225_76B4 | VH2|2-05|D6|6-6|RF2|JH4 | QITLKES-GPTLVKPTQTLTL TCTFSG-FSLS | TG-----GVGVG | WIRQPPGK ALEWLA | LIYW----DDDKRYSPS LKS | RLTITKDTPKNQVVLTMTNM DPVDTATYYCAH | LIAV-------AFDY | WGQGT LVTVS S |
| iPS:4 36918 | 21-225_77A2 | VH2|2-05|D6|6-6|RF2|JH4 | QITLKES-GPTLVKPTQTLTL TCTFSG-FSLS | TS-----GVGVG | WIRQPPGK ALEWLV | FIYW----DDDKRYSPS LKS | RLTITKDTSKNQVVLTMTNM DPVDTATYYCAH | LIAV-------AFDY | WGQGT LVTVS S |
| iPS:4 36934 | 21-225_96B5 | VH2|2-05|D6|6-6|RF2|JH4 | QITLKES-GPTLVKPTQTLTL TCTFSG-FSLS | TG-----GVGVG | WIRQPPGK ALEWLA | LIYW----DDDKRYSPS LKS | RLTITKDTPKNQVVLTMTNM DPVDTATYYCAH | LIAV-------ACDY | WGQGT LVTVS S |
| iPS:4 37334 | 21-225_75F11 | VH2|2-05|D6|6-6|RF2|JH4 | QITLKES-GPTLVKPTQTLTL TCTFSG-FSLS | TG-----GVGVG | WIRQPPGK ALEWLA | LIYW----DDDKRYSPS LKS | RLTITKDTPKNQVVLTMTNM DPVDTATYYCAH | LIAV-------AFDY | WGQGT LVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 37377 | 21-225_74G9 | VH2|2-05|D6|6-6|RF2|JH4 | QITLKES-GPTLVKPTQTLTL TCTFSG-FSLS | TG----GVGVG | WIRQPPGK ALEWLA | LIYW----DDDKRYSPS LKS | RLTITKDTPKNQVLTMTNM DPVDTATYYCAH | LIAV--------AFDY | WGQGT LVTVS S |
| iPS:3 92583 | 21-225_10B10 | VH2|2-05|D6|6-6|RF2|JH4 | QITLKES-GPTLVKPTQTLTL TCTFSG-FSLS | TG----GVGVG | WIRQPPGK ALEWLV | FIYW----SDDKRYSPS LKS | RLSITKDTSKNQVVLTMTNM DPVDTATYYCAR | IAAV--------AFDY | WGQGT LVTVS S |
| iPS:3 93184 | 21-225_15H11 | VH2|2-05|D6|6-6|RF2|JH4 | QITLKES-GLTLMKFTQTLTL TCTFSG-FSLS | TG----GVGVG | WIRQPPGK ALEWLA | LIYW----HDDKRYSPS LRS | RLTITKDTSKNQVVLTMTNM DPVDTATYYCAR | IVAV--------AFDY | WGQGT LITVS S |
| iPS:3 93212 | 21-225_30H6 | VH2|2-05|D6|6-6|RF2|JH4 | QITLKES-GPTLVKPTQTLTL TCTFSG-FSLS | TG----GVGVG | WIRQPPGK ALEWLA | LIYW----HDDKRYSPS LKS | RLAITKDTSKNQVVLTITNM DPVDTATYYCAH | LIAV--------AFDY | WGQGT LVTVS S |
| iPS:3 93222 | 21-225_17F5 | VH2|2-05|D6|6-6|RF2|JH4 | QITLKES-GPSLVKPTQTLIL TCTFSG-FSLS | TS----GVGVG | WIRQPPGK ALEWLA | LIYW----DDDKRYSPS LKS | RLTITKDTSKNQVVLTMTNM DPVDTATYYCAH | IIAV--------AFDY | WGQGT LVTVS S |
| iPS:3 93224 | 21-225_31C2 | VH2|2-05|D6|6-6|RF2|JH4 | QITLKES-GPTLVKPTQTLIL TCTFSG-FSLN | TG----GVGVG | WIRQPPGK ALEWLA | LIYW----NDDERYSPS LKS | RLTITKDTSKNQVVLTMTNM DPLDTASYYCAR | LIAV--------SFDY | WGGGA LVTVS S |
| | Germline | VH1|1-02|D6|6-19|RF2|JH6 | QVQLVQS GAEVKKPGASVKV SCKASG-YTFT | G------YYMH | WVRQAPGQ GLEWMG | WINPY----SGGTNYAQK FQG | RVTMTRDTSISTAYMELSRL RSDDTAVYYCAR | DRAVAGNY----YYGMDV | WGQGT TVTVS S |
| iPS:4 68866 | 21-225_190C1 | VH1|1-02|D6|6-19|RF2|JH6 | QVQLVQS-GAEVKKPGASVKV SCKASG-YTFT | G------YYMH | WVRQAPGQ GLEWMG | WINPY----SGGTNYAQK FQG | RVTMTRDTSISTAYMELSRL RSDDTAVYYCAR | DRAVAGNY----FYYGMDV | WGQGT TVTVS S |
| iPS:4 36972 | 21-225_190C7 | VH1|1-02|D6|6-19|RF2|JH6 | QVQLVQS-GAEVKKPGASVKV SCKASG-YTFT | G------YYMH | WVRQAPGQ GLEWMG | WINPN----SGGTNYAQK FQG | RVTMTRDTSISTAYMELSRL RSDDTAVYYCAR | DRAVAGNY----FYYGMDV | WGQGT TVTVS S |
| iPS:4 37020 | 21-225_193F11 | VH1|1-02|D6|6-19|RF2|JH6 | QVQLVQS-GAEVKKPGASVKV SCKASG-YTFT | G------YYMH | WVRQAPGQ GLEWMG | WINPY----SGGTNYAQK FQG | RVTMTRDTSISTAYMELSRL RSDDTAVYYCAR | DRAVAGNY----FYYGMDV | WGQGT TVTVS S |
| iPS:4 37036 | 21-225_195H9 | VH1|1-02|D6|6-19|RF2|JH6 | QVQLVQS-GAEVKNPGASVKV SCKASG-YTFT | G------YYMH | WVRQAPGQ GLEWMG | WINPY----SGGTNYAQK FQD | RVTMTRDTSITTAYMELSRL RSDDTAVYYCAR | DRAVAGNY----FYYGMDV | WGQGT TVTVS S |
| iPS:4 37042 | 21-225_197E8 | VH1|1-02|D6|6-19|RF2|JH6 | QVQLLQS-GAEVKKPGASVRV SCKASG-YTFT | G------YYIH | WVRQAPGQ GLEWMG | WINPN----SGGTNYAQR FQG | RVTMTRDTSISTAYMELSRL RSDDTAVYYCAR | EIAVAGNY----FYYGMGV | WGQGT TVAVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:4 68868 | VH4\|4-39/D1\|1-1\|RF2/JH4 | QLQLQES-GPGLVKPSETLSL TCTVSG-GSIS | GS----SYYWG | WIRQPPGK GLEWIG | NIYY----SGSTYNPS LKS | RVTISVDTSKNQFSLKLTSV TAADTAVFYCAR | HGLLW--------SLDF | WGQGT LVTVS S |
| | Germline | | H_CDR1 | H_FR2 | H_CDR2 | H_FR3 | H_CDR3 | H_FR4 |
| iPS:4 72742 225_30D9_LC 2 | VH1\|1-02/D3\|3-22\|RF2/J H5 | QVKLVQS-GAEVKKPGASVKV SCKASG-YTFT | G-------YYLH | WVRQAPGQ GLEWMG | WINPN----SGGTNYAQK FQG | RVTMTRDTSISTAYMELSRL RSDDTAVYYCAR | VIYYGSSG-------YYNEFDN | WGQGT LVTVS S |
| iPS:4 72741 225_30D9_LC 1 | VH1\|1-02/D3\|3-22\|RF2/J H5 | QVQLVQS-GAEVKKPGASVKV SCKASG-YTFT | G-------YYLH | WVRQAPGQ GLEWMG | WINPN----SGGTNYAQK FQG | RVTMTRDTSISTAYMELSRL RSDDTAVYYCAR | VIYYGSSG-------YYNEFDN | WGQGT LVTVS S |
| iPS:4 37040 21-225_196E7 | VH1\|1-02/D3\|3-22\|RF2/J H5 | QVQLVQS-GAEVKKPGASVKV SCKVSG-YTFT | G-------YNMH | WVRQAPGQ GLEWMG | WINPN----SGGTNYAHK FQG | RVTMTRDTSISTAYMELSRL RSDDTAVYYCAR | DYYDTSG-------EGWFDP | WGQGT LVTVS S |
| iPS:4 37050 21-225_197C11 | VH1\|1-02/D3\|3-22\|RF2/J H5 | QVQLVQS-GAEVKKPGASVKV SCKVSG-YTFT | G-------YNMH | WVRQAPGQ GLEWMG | WINPN----SGGTNYAHK FQG | RVTMTRDTSISTAYMELSRL RSDDTAVYYCAR | DYYDSSG-------EGWFDP | WGQGT LVTVS S |
| iPS:3 93214 21-225_33A1 | VH1\|1-02/D3\|3-22\|RF2/J H5 | QVQLVQS-GAEVKKPGASVKV SCKASG-YTFS | G-------YYMH | WVRQAPGQ GLEWMG | WINPN----NGGTHYAQK FQG | RVTMTRDTSIRTASMELSRL RSDDTAVYYCAR | GYYYASGS-------YYNDLDP | WGQGT LVTVS S |
| | Germline | H_FR1 | H_CDR1 | H_FR2 | H_CDR2 | H_FR3 | H_CDR3 | H_FR4 |
| iPS:4 72743 21-225_68G6 | VH1\|1-02/D3\|3-22\|RF2/J H4 | QVQLVQF-GGEVKKPGSSVKV SCKASG-YTFT | G-------YYMH | WVRQAPGQ GLEWMG | SIYRN----SGGTNYAQK FQG | RVTMTRDKSISTAYMEKSRI RSDDTAVYYCAR | APYYGSGT-------YYNEFDY | WGQGT LVTVS S |
| iPS:4 36902 21-225_69B11 | VH1\|1-02/D3\|3-22\|RF2/J H4 | QVQLVQS-GAEVKKPGASVKV SCKASG-YTFT | G-------YYMH | WVRQAPGQ GLEWMG | WINPN----SGGTNYGQK FQD | RVTMTRDTSISTAFMELSRL RSDDTAAYYCAR | TYYYGSGS-------YYNGFDY | WGQGT LVTVS S |
| iPS:4 36904 21-225_71D4 | VH1\|1-02/D3\|3-22\|RF2/J H4 | QVQLVQS-GAEVKKPGASVKV SCKASG-YTFT | G-------YCMH | WVRQAPGQ GLEWMG | WINPN----SGGTNYAQK FQV | RVTMTRDTSVSTVYMDLSRL RSDDTAVYYCAR | AYYYGSGI-------YHNEFDY | WGQGS LVTVS S |

FIGURE 51 (Continued)

| | | | | | | | | | |
|---|---|---|---|---|---|---|---|---|---|
| iPS:4 36806 | 21-225_7B4 | VH1j1-02|D3|3-22|RF2|J H4 | QVQLVQS-GAEVKKPGASVKV SCKASG-YTFT | G------YYMH | WVRQAPGQ GLEWMG | WINPN----SGGTNYGQK FQG | RVTMTRDTSISTAYMELSRL RSDDTAVYYCAR | TYYYGSGS-------------YNGFDY | WGQGT LVTVS S |
| iPS:4 37034 | 21-225_195E9 | VH1j1-02|D3|3-22|RF2|J H4 | QVQLVQS-GAEVKKPGASVKV SCKASG-YTFT | G------YYMH | WVRQAPGQ GLEWMG | WINPN----SGATNYAQK FQG | RVTMTRDTSISTAYMELNRL RSDDTAVYYCAR | AYYYGSGT-------------YNEFDY | WGQGT LVTVS S |
| iPS:3 92598 | 21-225_18E10 | VH1j1-02|D3|3-22|RF2|J H4 | QVQLVQS-GAEVKKPGASVKV SCKASG-YTFT | G------YYMH | WVRQAPGQ GLEWMG | WINPN----SGGTNYAQK FQG | RVTMTRDSSINTAYMELSRL RSDDTAVYYCAR | SYYYGSGT-------------YYNEFDY | WGQGT LVTVS S |
| iPS:3 93182 | 21-225_4B3 | VH1j1-02|D3|3-22|RF2|J H4 | QVQLVQS-GAEVKKPGASVKV SCKASG-YTFT | G------YYMH | WVRQAPGQ GLEWMG | WINPN----SGTNSAQK FQG | RVTMTRDTSISTAYMELSRL RSDDTAVYYCAR | SYYYGSGS-------------YNEFDY | WGQGT LVTVS S |
| iPS:3 93200 | 21-225_35E1 | VH1j1-02|D3|3-22|RF2|J H4 | QVKLVQS-GAEVKKPGASVKV SCKASG-YTFT | G------YYMH | WVRQAPGQ GLEWMG | WINPK----SGGTNYAQK FQG | RVTMTRDTSISTVYMEPSRL RSDDTAVYYCAR | VYIHGSGS-------------YNEFDY | WGQGT LVTVS S |
| iPS:3 93206 | 21-225_13F6 | VH1j1-02|D3|3-22|RF2|J H4 | QVQLVQS-GAEVKKPGASVKV SCKASG-YTFT | G------YYMH | WVRQAPGQ GLEWMG | WINPN----SGGANYAQK FQG | RVTMTRDTSISTAYMELSRL RSDDTAVYYCAR | SPYYGSGT-------------YYNEFDY | WGQGT LVTVS S |
| iPS:3 93208 | 21-225_16F3 | VH1j1-02|D3|3-22|RF2|J H4 | QVQLVQS-GAEVKKPGASVKV SCKASG-YTFT | G------HYMH | WVRQAPGQ GLEWMG | WINPN----SGGTNYAQK FQG | RVTMTRDTSISTAYMELSRL RSDDTAVYFCAR | SYYYGSGT-------------YYNEFDY | WGQGT LVTVS S |
| iPS:3 93210 | 21-225_17D3 | VH1j1-02|D3|3-22|RF2|J H4 | QVQLVQS-GAEVKKPGASVKV SCKASG-YTFT | G------YYMH | WVRQAPGQ GLEWMG | WINPN----SGGTNYAQK FQG | RVTMTRDTSISTAYMELSRL RSDDTAVYYCAR | ANYYGSGS-------------YYNDFDY | WGQGT LVTVS S |
| iPS:3 93226 | 21-225_33E6 | VH1j1-02|D3|3-22|RF2|J H4 | QVQLVQS-GAEVKKPGASVKV SCKASG-YTFT | G------YYIH | WVRQAPGQ GLEWMG | WINPN----SGGTNYAQK FQG | RVTMTRDTSISTAYMELSRL RSDDTAVYYCAR | VYYYGSGS-------------YYNEFDY | WGQGT LVTVS S |
| iPS:3 93230 | 21-225_9G9 | VH1j1-02|D3|3-22|RF2|J H4 | QVQLVQS-GAEVKKPGASVKV SCKASG-YTFT | G------YYIH | WVRQAPGQ GLEWMG | WINPN----SGGTPYAQK FQG | RVTMTRDTSISTAYMELSRL RSDDTAVYYCAR | SYYYGSGT-------------YYNEFDY | WGQGT LVTVS S |
| iPS:3 98490 | 21-225_21D12 | VH1j1-02|D3|3-22|RF2|J H4 | QVQLVQS-GAEVKKPGASVKV SCKASG-YTFT | D------YYIH | WVRQAPGQ GLEWMG | WINPN----SGGTNKAQK FQG | RVTMTRDTSISTAYMELSRL RSDDTAVYYCAR | SYYYGSGT-------------YYNEFDY | WGQGT LVTVS S |
| iPS:4 23018 | 21-225_31D12_L C2 | VH1j1-02|D3|3-22|RF2|J H4 | QVKLVQS-GAEVKKPGASVKV SCKASG-YTFT | G------YYMH | WVRQAPGQ GLEWMG | WINPN----SGGTNYVQR FQG | RVTMTRDTSISTAYMELSRL RSDDTAVYSCAR | VYYYGSGS-------------YYNEFDY | WGQGT LVTVS S |

FIGURE 51 (Continued)

| | | | QVKLVQS-GAEVKKPGASVKVSCKASG-YITFT | G------YYMH | WVRQAPGQGLEWMG | WINPN----SGGTNYVQKFQG | RVTMTRDTSISTAYMELSRLRSEDTAVYYCAR | VYYYGSGS-------YYNEPDY | WGQGTLVTVSS |
|---|---|---|---|---|---|---|---|---|---|
| iPS:4 21-23019 | 21-225_31D12_C1 | VH1(1-02/D3(3-22)RF2/JH4 | H_FR1 | H_CDR1 | H_FR2 | H_CDR2 | H_FR3 | H_CDR3 | H_FR4 |
| | | Germline | | | | | | | |
| | VH3(3-33/D7(7-27)RF2/JH4 | | QVQLVES-GGGVVQPGRSLRLSCAASG-FTFS | S------YGMH | WVRQAPGKGLEWVA | VIWYD----GSNKYYADSVKG | RFTISRDNSKNTLYLQMNSLRAEDTAVYYCAR | ELGY-----------PDY | WGQGTLVTVSS |
| iPS:3 92920 | 21-225_29G4 | VH3(3-33/D7(7-27)RF2/JH4 | QVQLVES-GGGVVQPGRSLRLTCAASG-FTFS | D------YGIH | WVRQAPGKGLEWVA | VIWYD----ESNKYYADSMKG | RFTISRDNSKNTLYLQMNSLRAEDTAVYYCAR | ELGM-----------TGDY | WGQGTLVTVSS |
| iPS:4 33899 | 21-225_43C3 | VH3(3-33/D7(7-27)RF2/JH4 | QVQLVES-GGGVVQPGRSLRLSCAASG-FTFS | S------YGIH | WVRQAPGKGLEWVA | VIWYD----ENNKYYADSVKG | RFTISRDNSKNTLYLQMNSLRAEDTAVYYCAR | ELGF-----------SNDY | WGQGTLVTVSS |
| iPS:4 33921 | 21-225_44C3 | VH3(3-33/D7(7-27)RF2/JH4 | QVQLVES-GGGVVQPGRSLRLSCAASG-FTFS | S------YGMH | WVRQAPGKGLEWVA | VIWFE----GSNKYYADSVKG | RFTISRDNSKNTLYLQMSSLRAEDTAVYYCVR | ELGP-----------STDY | WGQGTLVTVSS |
| iPS:4 33933 | 21-225_44C8 | VH3(3-33/D7(7-27)RF2/JH4 | QVQLVES-GGGVVQPGRSLRLSCAASG-FTFN | N------YGMH | WVRQAPGKGLEWVA | VIWYE----GSNKYYADSVKG | RFTISRDNSKNTLYLQMNSLRAEDTAVYYCVR | ELGF-----------LSDY | WGQGTLVTVSS |
| iPS:4 33969 | 21-225_46F3 | VH3(3-33/D7(7-27)RF2/JH4 | QVQLVES-GGGVVQPGRSLRLSCAASG-FTFS | D------YGMH | WVRQAPGKGLEWVA | VIWFE----GSNKYYADSVKG | RFTISRDNSKNTLYVQMNSLRAEDTAVYYCVR | ELGP-----------SNDY | WGQGTLVTVSS |
| iPS:4 33975 | 21-225_46C6 | VH3(3-33/D7(7-27)RF2/JH4 | QVQLVES-GGGVVQPGRSLRLSCAASG-FTFS | S------YGIH | WVRQAPGKGLEWVA | VIWYD----ENNKYYADSVKG | RFTISRDNSKNTLYVQMNSLRAEDTAVYYCAR | ELGF-----------SNDY | WGQGTLVTVSS |
| iPS:4 33977 | 21-225_46D8 | VH3(3-33/D7(7-27)RF2/JH4 | QVQLVES-GGGVVQPGRSLRLSCAASG-FTFS | D------YGIH | WVRQAPGKGLEWVA | VIWFE----GSNKYYADSVKG | RFTISRDNSKNTLYVQMNSLRAEDTAVYYCAR | ELGP-----------SNDY | WGQGTLVTVSS |
| iPS:4 33983 | 21-225_47A1 | VH3(3-33/D7(7-27)RF2/JH4 | QVQLVES-GGGVVQPGRSLRLSCAASG-FTFS | D------YGMH | WVRQAPGKGLEWVA | VIWYD----DYNKKYADSVKG | RFTISRDNAKNTLYLQVNSLRVEDTAVYYCAT | ELGM-----------LFDY | WGQGTLVTVSS |
| iPS:4 33997 | 21-225_48C1 | VH3(3-33/D7(7-27)RF2/JH4 | QVQLVES-GGGVVQPGRSLRLSCAASG-FTFS | S------YGMH | WVRQAPGKGLEWVA | VVWYD----EINKKYADSVKG | RFTISRDNSKNTLYLQMNSLRAEDTAMYYCAR | ELGW-----------EADY | WGQGTLVTVSS |
| iPS:4 34009 | 21-225_48A9 | VH3(3-33/D7(7-27)RF2/JH4 | QVQLVES-GGGVVQPGRSLRLSCAASG-FTFS | S------YGMH | WVRQAPGKGLEWVA | VIWYE----ENNKYYADSVKG | RFTISRDNSKNTLFLQMNSLRAEDTAMFCAR | ELAW-----------YEGY | WGQGTLVTVSS |

FIGURE 51 (Continued)

| | | | | | | | | |
|---|---|---|---|---|---|---|---|---|
| iPS:4 34013 | 21-225_48D12 | VH3|3-33|D7|7-27|RF2|J H4 | QVQLVES-GGGVVQPGRSLRL SCAASG-FTFS | D------YGMH | WVRQAPGK GLEWVA | VIWYD----VSNKYYDS VKG | RFTISRDNSKNTLYLQMNSL RAEDTAVYYCAR | ELGM------R.SDY | WGQGT LVTVS S |
| iPS:4 34019 | 21-225_49A1 | VH3|3-33|D7|7-27|RF2|J H4 | QVQLVES-GGGVVQPGRSLRL SCAASG-FTFS | D------YGMH | WVRQAPGK GLEWVA | VIWYD----EDNKYYADS VKG | RFTISRDNSKNTLYLQMNSL RAEDTAVYYCAR | ELGF------LSDY | WGQGT LVTVS S |
| iPS:4 34029 | 21-225_49C6 | VH3|3-33|D7|7-27|RF2|J H4 | QVQLVES-GGGVVQPGRSLRL SCAASG-FTFS | N------YGMH | WVRQAPGK GLEWVA | VIWYD----VSNKYYDS VKG | RFTISRDNSKNTLYLQMSSL RAEDTAVYYCAR | DLGM------IEDY | WGQGT LVTVS S |
| iPS:4 34057 | 21-225_51E4 | VH3|3-33|D7|7-27|RF2|J H4 | QVQLVES-GGGVVQPGRSLRL SCAASG-FTFS | S------YGMH | WVRQAPGK GLEWVA | VIWYD----ESNKYYADS VKG | RFTISRDNSKNTLYLQMNSL RAEDTAVYYCAR | ELGF------LSDY | WGQGT LVTVS S |
| iPS:4 34071 | 21-225_51F9 | VH3|3-33|D7|7-27|RF2|J H4 | QVQLVES-GGGVVQPGRSLRL SCAASG-FTFS | D------YGMH | WVRQAPGK GLEWVA | VIWFD----GNNKYYADS VKG | RFTISRDNSKNTLYLQMNSL SAEDTAVYYCAR | ELGF------LSDY | WGQGT LVTVS S |
| iPS:4 34075 | 21-225_51B11 | VH3|3-33|D7|7-27|RF2|J H4 | QVQLVES-GGGVVQPGRSLRL SCAASG-FTFS | D------YGMH | WVRQAPGK GLEWVA | VIWFG----GNNRYYGDS VKG | RFTISRDNSKNTLYLQMNSL SAEDTAVYYCAR | ELGF------LSDY | WGQGT LVTVS S |
| iPS:4 34077 | 21-225_51F11 | VH3|3-33|D7|7-27|RF2|J H4 | QVQLVES-GGGVVQPGRSLRL SCAASG-FTFS | N------FGMH | WVRQAPGK GLEWVA | VIWYE----ESNKYYADS VKG | RFTISRDNSKNTLYLQMNSL RAEDTAVYYCAR | ELGF------LSDF | WGQGT LVTVS S |
| iPS:4 34081 | 21-225_52B2 | VH3|3-33|D7|7-27|RF2|J H4 | QVQLVES-GGGVVQPGRSLRL SCAASG-FTFS | N------YGMH | WVRQAPGK GLEWVA | VTWFD----GSNQRYADS VKG | RFTISRDISKNTLYLQMNSL SAEDTAVYYCAR | DLGM------IEDF | WGQGT LVTVS S |
| iPS:4 34091 | 21-225_52B9 | VH3|3-33|D7|7-27|RF2|J H4 | QVQLVES-GGGVVQPGRSLRL SCAASG-FTFS | D------YGMH | WVRQAPGK GLEWVA | VIWFD----GNNKYYADS VKG | RFTISRDNSKNTLYLQMNSL SAEDTAVYYCAR | ELGF------LSDY | WGQGT LVTVS S |
| iPS:4 34105 | 21-225_53D2 | VH3|3-33|D7|7-27|RF2|J H4 | QVQLVES-GGGVVQPGRSLRL SCAASG-FTFS | N------YGMH | WVWDD----GSNKYADS VKG | WVRQAPGK GLEWVT | RFTISRDNSKNTLYLQMNSL RAEDTAVYYCAR | GLGF------TGDY | WGQGA LVTVS S |
| iPS:4 34119 | 21-225_53E6 | VH3|3-33|D7|7-27|RF2|J H4 | QVQLVES-GGGVVQPGRSLRL SCTTSG-FTFS | D------YGIH | WVRQAPGK GLEWVA | VIWYD----ESNKYYADS VKG | RFAISRDNSKNTLYLQMNSL RAEDTAVYYCVR | ELGM------ISDY | WGQGT LVTVS S |
| iPS:4 34129 | 21-225_53B12 | VH3|3-33|D7|7-27|RF2|J H4 | QVQLVES-GGGVVQPGRSLRL SCAASG-FTFS | N------FGMH | WVRQAPGK GLEWVA | VVWYD----GNNRYADS VKG | RFTISRDNSKNTLYLQMHSL RAEDTAVYYCAR | ELGF------LSDF | WGQGT LVTVS S |

FIGURE 51 (Continued)

| | | | | | | | | |
|---|---|---|---|---|---|---|---|---|
| iPS:4 34131 | 21-225_54D3 | VH3l3-33lD7l7-27lRF2lJH4 | QVQLVES-GGGVVQPGRSLRL SCAASG-FTFS | N------YGMH | WVRQAPGK GLEWVA | VIWFD---- GNNKYYADS VKG | RFTISRDNSKNTLYLQMNSL RAEDTAVYYCAR | ELGF-------------LSDY | WGQGT LVTVS S |
| iPS:4 34141 | 21-225_54C6 | VH3l3-33lD7l7-27lRF2lJH4 | QVQLVES-GGGVVQPGRSLRL SCITSG-FTFS | D------YGIH | WVRQAPGK GLEWVA | VIWYD---- ENNKYYADS VKG | RFAISRDNSKNTLYLQMNSL RAEDTAVYYCVR | ELGM-------------TSDY | WGQGT LVTVS S |
| iPS:4 34143 | 21-225_54G7 | VH3l3-33lD7l7-27lRF2lJH4 | QVQLVES-GGGVVQPGRSLRL SCAASG-FTFS | N------YGMH | WVRQAPGK GLEWVA | VIWYE---- ESNKYYGDS VKG | RFTISRDNSKNTLYLQMNSL RAEDTAVYYCAR | ELGF-------------LSDY | WGQGT LVTVS S |
| iPS:4 34155 | 21-225_55B3 | VH3l3-33lD7l7-27lRF2lJH4 | QVQLVES-GGGVVQPGRSLRL SCAASG-FTFS | S------YGMH | WVRQAPGK GLEWVA | VIWYD---- GNNKYYEDS VKG | RFTISRDNSKNTLYLQMNSL RAEDTAVYYCVR | ELGF-------------LSDY | WGQGT LVTVS S |
| iPS:4 34199 | 21-225_59F11 | VH3l3-33lD7l7-27lRF2lJH4 | QVQLVES-GGGVVQPGRSLRL SCAASG-FTFS | N------YGMH | WVRQAPGK GLEWVA | VIWYD---- ESNKYYGDS VKG | RFTISRDNSKNTTLYLQMSSL RAEDTAVYYCSR | ELGM-------------NGDY | WGQGT LVTVS S |
| iPS:4 34207 | 21-225_60A3 | VH3l3-33lD7l7-27lRF2lJH4 | QVQLVES-GGGVVQPGRSLRL SCAASG-FTFS | S------YGMH | WVRQAPGK GLEWVA | VIWYE---- ESNKYYADS VKG | RFTISRDNSKNTLYLQMNSL RAEDTAVYYCAR | ELGM-------------TGDY | WGQGT LVTVS S |
| iPS:4 34253 | 21-225_62E4 | VH3l3-33lD7l7-27lRF2lJH4 | QVQLVES-GGGVVQPGRSLRL SCAASG-FTFS | D------YGMH | WVRQAPGK GLEWVA | VIWYD---- RSNKYYADS VKG | RFTISRDNSKNTLYLQMNSL RVEDTAVYYCAR | ELGF-------------SSDY | WGQGT LVTVS S |
| iPS:4 34271 | 21-225_57A4 | VH3l3-33lD7l7-27lRF2lJH4 | QVQLVES-GGGVVQPGRSLRL SCAASG-FTFS | D------YGMH | WVRQAPGK GLEWVA | VIWYA---- GSNKYYVDS VKG | RFTISRDNSKNTLYLQMNSL RAEDTAVYYCAR | ELGM-------------RSDY | WGQGT LVTVS S |
| iPS:4 34293 | 21-225_58F5 | VH3l3-33lD7l7-27lRF2lJH4 | QVQLVES-GGGVVQPGRSLRL SCVASG-FTFS | D------YGMH | WVRQAPGK GLEWVA | VIWYA---- GSNKYHVDS VKG | RFTISRDNSKNTLYLQMNSL RAEDTAVYYCAR | ELGM-------------RSDY | WGQGT LVTVS S |
| iPS:4 34337 | 21-225_64E1 | VH3l3-33lD7l7-27lRF2lJH4 | QVQLVES-GGGVVQPGRSLRL SCAASG-FTFS | D------YGMH | WVRQAPGK GLEWVA | VIWFD---- ETNKYYGDS VKG | RFTISRDNSKNTLYLQMNSL RAEDTAVYYCAR | ELGF-------------SSDY | WGQGT LVTVS S |
| iPS:4 34357 | 21-225_65C1 | VH3l3-33lD7l7-27lRF2lJH4 | QVQLVES-GGGVVQPGRSLRL SCAASG-FTFS | S------YGMH | WVRQAPGK GLEWVA | VIWFE---- GSNKHYTDS VKG | RFTISRDNSKNTLYLQMNSL RAEDTAVYYCAR | ELGF-------------SSDY | WGQGT LVTVS S |
| iPS:4 34375 | 21-225_66C7 | VH3l3-33lD7l7-27lRF2lJH4 | QVQLVES-GGGVVQPGRSLRL SCVASG-FTFS | D------YGMH | WVRQAPGK GLEWVA | VIWFE---- GSHKYYTDS VKG | RFTISRDNSKNTLYLQMNSL RAEDTAVYYCAR | ELGF-------------SSDY | WGQGT LVTVS S |

FIGURE 51 (Continued)

| | | | | | | | | |
|---|---|---|---|---|---|---|---|---|
| iPS:4 34411 | 21-225_68F11 | VH3|3-33/D7|7-27/RF2/J H4 | QVQLVES-GGGVVQPGRSLRL SCAASG-FTFS | D------YGMH | WVRQAPGK GLEWVA | VIWYD---- VSNKYYADS VKG | RFTISRDNSKNTLYLQMNSL RAEDTAVYYCVR | ELGM--------- ---------TSDC | WGQGT LVTVS S |
| iPS:4 34441 | 21-225_71A2 | VH3|3-33/D7|7-27/RF2/J H4 | QVQLVES-GGGVVQPGRSLRL SCATSG-FTFS | D------YGMH | WVRQAPGK GLEWVA | VIWYD---- ESNKYYADS VKG | RFTISRDNSKNTLYLQMNSL RAEDTAVYYCAR | ELGW--------- ---------QDDY | WGQGT LVTVS S |
| iPS:4 34447 | 21-225_71B6 | VH3|3-33/D7|7-27/RF2/J H4 | QVQLVES-GGGVVQPGRSLRL SCAASG-FTFS | N------YGMH | WVRQAPGK GLEWVA | VIWYD---- RTNKYYADS VKG | RFTISRDNSKNTLHLQMNSL RAEDTAVYYCAR | ELGM--------- ---------LSDY | WGQGT LVTVS S |
| iPS:4 34453 | 21-225_71B11 | VH3|3-33/D7|7-27/RF2/J H4 | QVQLVES-GGGVVQPGRSLRL SCAASG-FTFS | D------YGMH | WVRQAPGK GLEWVA | VIWYD---- RNNKYYGDS VKG | RFTISRDNSKNTLYLQMNSL RAEDTAVYYCAR | ELGM--------- ---------LSDY | WGQGT LVTVS S |
| iPS:4 34457 | 21-225_72G12 | VH3|3-33/D7|7-27/RF2/J H4 | QVQLVES-GGGVVQPGRSLRL SCAASG-FTFS | S------YGMH | WVRQAPDT GLEWVA | VIWFD---- ESNKYYADS VKG | RFTISRDNSKNTLYLQMNSL RAEDTAVYYCAR | ELGF--------- ---------SSDY | WGQGT LVTVS S |
| iPS:4 35311 | 21-225_146H9 | VH3|3-33/D7|7-27/RF2/J H4 | QVQLVES-GGGVVQPGRSLRL SCAASG-FSFS | S------YGMH | WVRQAPGK GLEWVA | VIWFD---- ESNKYYGDS VKG | RFTISRDNSKNTLYLQMNSL RAEDTAVYYCAR | ELGF--------- ---------LSDY | WGQGT LVTVS S |
| iPS:4 35511 | 21-225_157C3 | VH3|3-33/D7|7-27/RF2/J H4 | QVQLVES-GGGVVQPGRSLRL SCAVSG-FTFS | I------YGMH | WVRQAPGK GLEWVA | VIWYD---- VNNKYYADS VKG | RFTISRDNSKNTLYLQMNSL RAEDTAVYYCAR | ELGF--------- ---------LSDY | WGQGT LVTVS S |
| iPS:4 35533 | 21-225_157H8 | VH3|3-33/D7|7-27/RF2/J H4 | QVQLVES-GGGVVQPGRSLRL SCAASG-FTFS | S------YGMH | WVRQAPGK GLEWVA | VIWYD---- VNNKYYADS VKG | RFTISRDNSKNTLYLQMNSL RAEDTAVYYCAR | ELGF--------- ---------LSDY | WGQGT LVTVS S |
| iPS:4 35551 | 21-225_158H6 | VH3|3-33/D7|7-27/RF2/J H4 | QVQLVES-GGGVVQPGRSLRL SCAASG-FTFS | S------YGMH | WVRQAPGK GLEWVA | VIWYD---- VTNKYYADS VKG | RFTISRDNSKNTLYLQMNSL RDEDTAVYYCVR | ELGW--------- ---------AEDY | WGQGT LVTVS S |
| iPS:4 35569 | 21-225_159C5 | VH3|3-33/D7|7-27/RF2/J H4 | QVQLVES-GGGVVQPGRSLRL SCAASG-FTFS | S------YGIH | WVRQAPGK GLEWVA | VVWYD---- VNNKYYADS VKG | RFTISRDNSKNTLYLQMNSL RAEDTAVYYCAR | ELGF--------- ---------LSDY | WGQGT LVTVS S |
| iPS:4 36268 | 21-225_203B9 | VH3|3-33/D7|7-27/RF2/J H4 | QVQLVES-GGGVVQPGRSLRL SCAASG-FTLS | S------FGMH | WVRQAPGK GLEWVA | VIWYD---- VNNKYYADS VKG | RFTISRDNSKNTLYLQMNSL RPEDTAVYYCAR | ELGF--------- ---------LSDY | WGQGT LVTVS S |
| iPS:4 36328 | 21-225_207F12 | VH3|3-33/D7|7-27/RF2/J H4 | QVQLVES-GGGVVQPGRSLRL SCAASG-FTFS | N------YGMH | WVRQAPGK GLEWVA | VIWYD---- RNNKYYGDS VKG | RFTISRDNSKNTLYLQMNSL RAEDTAVYYCAR | ELGF--------- ---------LFDY | WGQGT LVTVS S |

FIGURE 51 (Continued)

| | | | | | | | | |
|---|---|---|---|---|---|---|---|---|
| iPS:4 36556 | 21-225_224D10 | VH3-33/D7/7-27/RF2/JH4 | QVQLVES-GGGLVQPGKSLRL SCAASG-FTFS | S------YGMH | WVRQAPGK GLEWVA | VIWYE----GSNKYYVDS VRG | RFTISRDNSKSTLYLQMNSL RAEDTAVYYCVR | ELGF---------QSDY | WGQGT PVTVS S |
| iPS:3 92618 | 21-225_16F10 | VH3-33/D7/7-27/RF2/JH4 | QVQLVES-GGGVVQPGRSLRL SCAASG-FTFS | D------YGMH | WVRQAPGK GLEWVA | VIWYD----GNNKYYADS VKG | RFTISRDNSKNTLYLQMNSL RAEDTAVYYCAR | ELAW---------YEDY | WGQGT LVTVS S |
| iPS:3 92626 | 21-225_18A5 | VH3-33/D7/7-27/RF2/JH4 | QVQLVES-GGGVVQPGRSLRL SYTASG-FTFS | D------YGMH | WVRQAPGK GLEWVA | VIWFD----GSNKYYADS VKG | RFTISRDNSKNTLYLQMNSL RAEDTAVYYCAR | DLGW---------TEEY | WGQGT LVTVS S |
| iPS:3 92630 | 21-225_20E5 | VH3-33/D7/7-27/RF2/JH4 | QVQLVES-GGGVVQPGRSLRL SCAASG-FTFS | D------YGMH | WVRQAPGK GLEWVA | VIWYE----ENNQYYADS VKG | RFTISRDNSKNTLYLQMNSL RAEDTAVYYCAR | ELGF---------RSDY | WGQGT LVTVS S |
| iPS:3 92640 | 21-225_18A1 | VH3-33/D7/7-27/RF2/JH4 | QVQLVES-GGGVVQPGRSLRL SCAASG-FTFS | S------YGMH | WVRQAPGK GLEWVA | VIWYE----ENNKYYVDS VKG | RFTISRDNSKSTLYLQMNSL RAEDTAVYYCVR | ELGF---------QSDY | WGQGT PVTVS S |
| iPS:3 92644 | 21-225_19E1 | VH3-33/D7/7-27/RF2/JH4 | QVQLVES-GGGVVQPGRSLRL SCAASG-FTFS | N------YGMH | WVRQAPGK GLEWVA | VIWYE----ENNQYYADS VKG | RFTISRDNSKNTLYLQMNSL RAEDTAVYYCAR | ELGF---------RSDY | WGQGT LVTVS S |
| iPS:3 92654 | 21-225_17A10 | VH3-33/D7/7-27/RF2/JH4 | QVQLVES-GGGVVQPGRSLRL SCAASG-FTFS | N------YGMH | WVRQAPAK GLEWVA | VIWFD----ENNQYYADS VKG | RFTISRDNSKNTLYLQMNSL RAEDTAVYYCAR | ELGF---------RSDY | WGQGT LVTVS S |
| iPS:3 92658 | 21-225_18E8 | VH3-33/D7/7-27/RF2/JH4 | QVQLVES-GGGVVQPGRSLRL SCAASG-FTFS | N------YGMH | WVRQAPGK GLEWMA | VIWYE----ENNKYYVDS VKG | RFTISRDNSKNTLYLQMNSL RAEDTAVYYCVR | ELGF---------RSDY | WGQGT PVTVS S |
| iPS:3 92666 | 21-225_16F11 | VH3-33/D7/7-27/RF2/JH4 | QVQMVES-GGGVVQPGRSLRL SCAASG-FTFS | S------YGMH | WVRQAPGK GLEWVA | VIWYD----ENNKYYVDS VKG | RFTISRDNSKNTLYLQMNSL RAEDTAVYYCVR | ELGF---------QSDY | WGQGT PVTVS S |
| iPS:3 92674 | 21-225_18C2 | VH3-33/D7/7-27/RF2/JH4 | QVQLVES-GGGVVQPGRSLRL SCVASG-FTFS | D------YGMH | WVRQAPGK GLEWVA | VIWYD----VTNKYYADS VKG | RFTISRDNSKNTLYLQMNSL SAEDTAVYYCAR | ELGW---------YEDY | WGQGT LVTVS S |
| iPS:3 92680 | 21-225_20A7 | VH3-33/D7/7-27/RF2/JH4 | QVQLVES-GGGVVQPGRSLRL SCAASG-FTFS | N------YGMH | WVRQAPGK GLEWVA | VIWYE----ENNQYYADS VKG | RFTISRDNSKNTLYLQMNSL RAEDTAIYYCAR | ELGF---------RSDY | WGQGT LVTVS S |
| iPS:3 92686 | 21-225_17C7 | VH3-33/D7/7-27/RF2/JH4 | QVQLVES-GGGVVQPGKSLRL SCAASG-FTFS | D------YGMH | WVRQAPGK GLEWVA | VIWFD----GSNKYYADS VKG | RFTISRDNSKNTLYLQMNSL RAEDTAVYYCAR | DLGW---------TEEY | WGQGT LVTVS S |

FIGURE 51 (Continued)

| | | | | | | | | | |
|---|---|---|---|---|---|---|---|---|---|
| iPS:3 92690 | 21-225_18F2 | VH3|3-33|D7|7-27|RF2|J H4 | QVQLVES-GGGVVQPGRSLRL SCAASG-FTFS | D------YGMH | WVRQAPGK GLEWVA | VIWFD----GSNKYYVDS VKG | RFTISRDNSKNTLYLQMNSL RVEDTAVYYCAR | DLGW--------TEEY | WGQGT LVTVS S |
| iPS:3 92716 | 21-225_17B5 | VH3|3-33|D7|7-27|RF2|J H4 | QVQLVES-GGGVVQPGRSLRL SCAASG-FTFS | D------YGMH | WVRQAPGK GLEWVA | VIWYD----ESNKHYIDS VKG | RFTISRDMSKNTLYLQMNSL RAEDTAVYYCVR | ELGF--------RFDY | WGQGT LVTVS S |
| iPS:3 92732 | 21-225_17E5 | VH3|3-33|D7|7-27|RF2|J H4 | QVQLVES-GGGVVQPGRSLRL SCAASG-FTFS | D------YGMH | WVRQAPGK GLEWVA | LIWYD----VTNKYYADS VKG | RFTISRDNSQNTLYLQINSL RAEDTAVYYCAR | ELGW--------YEDY | WGQGT LVTVS S |
| iPS:3 92744 | 21-225_20D5 | VH3|3-33|D7|7-27|RF2|J H4 | QVQLVES-GGGVVQPGRSLRL SCAASG-FTFS | S------YGMH | WVRQAPGK GLEWVA | VIWYE----ENNQYYADS VKG | RFTISRDNSKNTLYLQMNSL RAEDTAVYYCAR | ELGF--------RSDY | WGQGT LVTVS S |
| iPS:3 92758 | 21-225_21G11 | VH3|3-33|D7|7-27|RF2|J H4 | QVQLVES-GGGVVQPGRSLRL SCAASG-FTFS | D------YGMH | WVRQAPGK GLEWVA | VIWYD----VTNEYYADS VKG | RFTISRDNSKNTLYLQMNSL RAEDTAVYYCAR | ELGW--------YEDY | WGQGT LVTVS S |
| iPS:3 92772 | 21-225_20E12 | VH3|3-33|D7|7-27|RF2|J H4 | QVQLVES-GGGVVQPGRSLRL SCAASG-FTFS | S------YGMH | WVRQAPGK GLEWVA | VMWYD----ESNKHYYADS VKG | RFTISRDNSKNTLYLQMNSL RAEDTAVYYCAR | ELGF--------RFDY | WGQGT LVTVS S |
| iPS:3 92790 | 21-225_20D10 | VH3|3-33|D7|7-27|RF2|J H4 | QVQLVES-GGGVVQPGRSLRL SCAASG-FTFS | D------YGMH | WVRQAPGK GLEWVA | VIWFD----GSNKYYADS VKG | RFTISRDNSKNTLYLQMNSL RAEDTAVYYCAR | DLGW--------TEEY | WGQGT LVTVS S |
| iPS:3 92796 | 21-225_22A4 | VH3|3-33|D7|7-27|RF2|J H4 | QVQLVES-GGGVVQPGRSLRL SCAASG-FTFS | D------YGIH | WVRQAPGK GLEWVA | VIWYD----GSNKYYADS VKG | RITISRDNSKNTLYLQMNSL RAEDTAVYYCAR | DLGW--------TEEY | WGQGT LVTVS S |
| iPS:3 92810 | 21-225_20H12 | VH3|3-33|D7|7-27|RF2|J H4 | QVQLVES-GGGVVQPGRSLRL SCAASG-FTFS | N------YGMH | WVRQAPGK GLEWVA | VIWYD----ENNKYYVDS VKG | RFTISRDNSKNTLYLQMNSL RAEDTAVYYCAR | ELGF--------RSDY | WGQGT LVTVS S |
| iPS:3 92832 | 21-225_21H8 | VH3|3-33|D7|7-27|RF2|J H4 | QVQLVES-GGGVVQPGRSLRL SCAASG-FTFS | D------YGMH | WVRQAPGK GLEWVA | VIWFD----GSNKYYADS VKG | RFTISRDNSKNTLYLQMNSL RAEDTAVYYCAR | DLGW--------TEEY | WGQGT LVTVS S |
| iPS:3 92854 | 21-225_21E5 | VH3|3-33|D7|7-27|RF2|J H4 | QVQLVES-GGGVVQSGKSLRL SCSASG-FTFS | D------YGMH | WVRQAPGK GLEWVA | VIWYD----ESNKYYADS VKG | RFTISRDNSKNTLYLQMNSL RAEDTAMYYCTR | ELGF--------RSDY | WGQGT LVTVS S |
| iPS:3 92860 | 21-225_22H8 | VH3|3-33|D7|7-27|RF2|J H4 | QVQLVES-GGGVVQPGRSLRL SCAASG-FTFS | S------YGMH | WVRQAPGK GLEWVA | VIWYD----GNRKYYADS VKG | RFTISRDNSKNTLYLQMNSL RAEDTAVYYCAR | ELAW--------YEDY | WGQGT LVTVS S |

FIGURE 51 (Continued)

| | | | | | | | | | |
|---|---|---|---|---|---|---|---|---|---|
| iPS:3 92866 | 21-225_23H11 | VH3j3-33jD7j7-27jRF2jJH4 | QEQLVES-GGGVVQPGRSLRL SCAASG-FTFS | S------YGMH | WVRQAPGK GLEWVA | VIWYD----ENNKYYVDS VKG | RFTISRDNSKNTLYLQMNSL RAEDTAVYYCAR | ELGF--------RSDY | WGQGT LVTVS S |
| iPS:3 92876 | 21-225_21F7 | VH3j3-33jD7j7-27jRF2jJH4 | QVQLVES-GGGVVQPGRSLRL SCAASG-FTFS | D------YGMH | WVRQAPGK GLEWVA | VIWFD----GNNKYYVDS VKG | RFTISRDNSKNTLYLQMNSL RAEDTAVYYCAR | DLGW--------TEEY | WGQGT LVTVS S |
| iPS:3 92880 | 21-225_22F9 | VH3j3-33jD7j7-27jRF2jJH4 | QVQMVES-GGGVVQPGRSLRL SCAASG-FTFS | S------YGMH | WVRQAPGK GLEWVA | VIWYE----ENNKDYVDS VKG | RFTISRDNSKSTLYLQMNSL RAEDTAVYYCVR | ELGF--------QSDY | WGQGT PVTVS S |
| iPS:3 92894 | 21-225_21G2 | VH3j3-33jD7j7-27jRF2jJH4 | QVQLVES-GGGVVQPGRSLRL SCAASG-FTFS | D------YGMH | WVRQAPGK GLEWVA | VIWYD----VTNKYYADS VKG | RFTISRDNSKNTLYLEMNSL RAEDTAVYYCAR | ELGW--------YEDY | WGQGT LVTVS S |
| iPS:3 92900 | 21-225_22F2 | VH3j3-33jD7j7-27jRF2jJH4 | QVQLVES-GGGVVQPGRSLRL SCAASG-FTFS | D------YGMH | WVRQAPGK GLEWVA | VIWYE----GSNKYYVDS VRG | RFTISRDNSKSTLYLQMNSL RAEDTAVYYCVR | ELGF--------QSDY | WGQGT PVTVS S |
| iPS:3 92908 | 21-225_23H12 | VH3j3-33jD7j7-27jRF2jJH4 | QVQLVES-GGGVVQPGRSLRL SCVASG-FTFS | S------YGMH | WVRQAPGK GLEWVA | VIWYD----ETNKYYVDS VKG | RFTISRDNSKNTLYLQMNSL RAEDTAVYYCVR | ELAW--------YEDY | WGQGS LVTVS S |
| iPS:3 92918 | 21-225_28F5 | VH3j3-33jD7j7-27jRF2jJH4 | QVQLVES-GGGVVQPGRSLRL SCAASG-FTFS | S------YGMH | WVRQAPGK GLEWVA | VIWYE----ENNKYYADS VKG | RFTISRDNSKNTLYLQMNSL RAEDTAVYYCAR | ELGW--------YDDY | WGQGT LVTVS S |
| iPS:3 92934 | 21-225_27D5 | VH3j3-33jD7j7-27jRF2jJH4 | QVQLVES-GGGVVQPGRSLRL SCAASG-FTFS | S------YGMH | WVRQAPGK GLEWVA | VIWYD----ESNKYYGDS VKG | RFTISRDNSKNMLYLQMNSL RGEDTALYYCAR | ELGF--------LSDY | WGQGT LVTVS S |
| iPS:3 92958 | 21-225_28C7 | VH3j3-33jD7j7-27jRF2jJH4 | QVQLVES-GGGVVQPGRSLRL SCAASG-FTFS | S------YGMH | WVRQAPGK GLEWVA | VIWYD----ESNKYYADS VKG | RFTISRDNSKNTLYLQMNSL RAEDTAVYYCAR | ELGW--------YDDY | WGQGT LVTVS S |
| iPS:3 92968 | 21-225_25B6 | VH3j3-33jD7j7-27jRF2jJH4 | QVQLVES-GGGVVQPGRSLRV SCIASG-FTLR | N------YGMH | WVRQAPGK GLEWVA | VIWYE----ESNKYYTES VKG | RFTISRDNSKNTLYLQMNSL RAEDTAVYYCAR | ELGF--------LSDY | WGQGT LVTVS S |
| iPS:3 92972 | 21-225_26A2 | VH3j3-33jD7j7-27jRF2jJH4 | QVQLVES-GGGVVQPGRSLRL SCAASG-FTFS | S------YGMH | WVRQAPGK GLEWVA | VIWYE----GSNKYYVDS VKG | RFTISRDNSKNTLYLQMNSL RAEDTAVYYCAR | ELGW--------YDDN | WGQGT LVTVS S |
| iPS:3 92980 | 21-225_29H6 | VH3j3-33jD7j7-27jRF2jJH4 | QVQLVES-GGGVVQPGRSLRL SCAASG-FTFS | D------YGMH | WVRQAPGK GLEWT | VIWYN----ENNKYYADS VKG | RFTISRDNSKNTLYLQMNSL RAEDTAVYYCAR | ELGN--------TGDS | WGQGT LVTVS S |

FIGURE 51 (Continued)

| | | | | | | | | | |
|---|---|---|---|---|---|---|---|---|---|
| iPS:3 92988 | 21-225_25E6 | VH3|3-33|D7|7-27|RF2|J H4 | QVQLVES-GGGVVQPGRSLRL SCAASG-FTFS | D-------YGMH | WVRQAPGK GLEWVA | VIWYD---- ENNKYYADS VKG | RFTISRDNSKNTLYLQMNSL RAEDTALYYCAT | ELGM---------TGDS | WGQGT LVTVS S |
| iPS:3 92990 | 21-225_25H10 | VH3|3-33|D7|7-27|RF2|J H4 | QVQLVES-GGGVVQPGRSLRL SCAASG-FTFS | D-------YGMH | WVRQAPGK GLEWVA | VIWYD---- ESNKYYADS MKG | RFTISRDNSKNTLYLQMNSL RAEDTAVYYCAR | ELGM---------TGDY | WGQGT LVTVS S |
| iPS:3 93000 | 21-225_29D7 | VH3|3-33|D7|7-27|RF2|J H4 | QVQLVES-GGGVVQPGRSLRL SCAASG-FTFS | S-------YGMH | WVRQAPGK GLEWVA | VIWYD---- ESNKYYADS VKG | RFTISRDNSKNTLYLQMNSL RGEDTALYYCAR | ELGF---------LSDY | WGQGT LVTVS S |
| iPS:3 93018 | 21-225_29B8 | VH3|3-33|D7|7-27|RF2|J H4 | QVQLVES-GGGVVQPGRSLRL SCAASG-FTFS | D-------YGMH | WVRQAPGK GLEWVA | VIWYD---- ENNKYYADS VKG | RFTISRDNSKNTLYLQMNSL RAEDTAVYYCAR | ELGM---------TGDS | WGQGT LVTVS S |
| iPS:3 93030 | 21-225_25H11 | VH3|3-33|D7|7-27|RF2|J H4 | QVQLVES-GGGVVQPGRSLRL SCAASG-FTFS | D-------YGMH | WVRQAPGK GLEWVA | VIWYD---- ENNEYYADS VKG | RFTISRDNSKNTLYLQMNSL RAEDTAVYYCAR | ELGM---------TGDS | WGQGT LVTVS S |
| iPS:3 93034 | 21-225_27F2 | VH3|3-33|D7|7-27|RF2|J H4 | QEQLVES-GGGVVQPGRSLRL SCAASG-FTFS | D-------YGMH | WVRQAPGK GLEWVA | VIWYD---- ENNKYYADS VRG | RFTISRDNSKNTLYLQMNSL RAEDTAVYYCAR | ELGM---------TGDS | WGQGT LVTVS S |
| iPS:3 93048 | 21-225_27C3 | VH3|3-33|D7|7-27|RF2|J H4 | QVQLVES-GGGVVQPGRSLRL SCAASG-FTFS | D-------YGMH | WVRQAPGK GLEWVA | VIWYD---- ENNKSYADS VKG | RFTISRDNSKNTLYLQMNSL RAEDTAVYYCAR | ELGM---------TGDS | WGQGT LVTVS S |
| iPS:3 93054 | 21-225_29G8 | VH3|3-33|D7|7-27|RF2|J H4 | QVQLVES-GGGVVQPGRSLRL SCAASG-FTFS | D-------YGMH | WVRQAPGK GLEWVA | VIWYD---- ETNKYYADS VKG | RFTISRDNSKNTLYLQMNSL RAEDTAVYYCAR | ELGM---------TSDY | WGQGT LVTVS S |
| iPS:3 93812 | 21-225_6A11 | VH3|3-33|D7|7-27|RF2|J H4 | QVQLVES-GGGVVQPGRSLRL SCAASG-FTFS | D-------YGMH | WVRQAPGK GLEWVA | VIWFD---- GSNKYYADS VKG | RFTISRDNSKNTLYLQMNSL RAEDTAVYDCAR | DLGW---------TEEY | WGQGT LVTVS S |
| iPS:3 93818 | 21-225_6G12 | VH3|3-33|D7|7-27|RF2|J H4 | QVQLVES-GGGVVQPGRSLRL SCAASG-FTFS | S-------YGMH | WVRQAPGK GLEWVA | VIWYD---- RSNNYYADS VKG | RFTISRDNSKNTLYLQMNSL RAEDTAVYYCAR | ELGF---------RSDY | WGQGT LVTVS S |
| iPS:3 93820 | 21-225_8H7 | VH3|3-33|D7|7-27|RF2|J H4 | QVQLVES-GGGVVQPGRSLRL SCPASG-FTFS | D-------FGMH | WVRQAPGK GLEWVA | VIWYE---- ENNQYYADS VKG | RFTISRDNSKNTLYLQMNSL RAEDTAVYYCAR | ELGF---------RSDY | WGQGT LVTVS S |
| iPS:3 93826 | 21-225_10G5 | VH3|3-33|D7|7-27|RF2|J H4 | QVQLVES-GGGVVQPGRSLRL SCAASG-FTFS | N-------YGMH | WVRQAPGK GLEWVA | VIWYE---- ENNQYYADS VKG | RFTISRDNSKNTLYLQMNSL RAEDTAVYYCTR | ELGF---------RSDY | WGQGT LVTVS S |

FIGURE 51 (Continued)

| | | | | | | | | | |
|---|---|---|---|---|---|---|---|---|---|
| iPS:3 93828 | 21-225_10H12 | VH3J3-33|D7|7-27|RF2J H4 | QVQLVES-GGGVVQPGRSLRL SCAASG-FTFS | D------YGMH | WVRQAPGK GLEWVA | VIWYE----DNNQYYADS VKG | RFTISRDNSKNTLYLQMNSL RAEDTAVYYCAR | ELGF----------RSDY | WGQGT LVTVS S |
| iPS:3 93830 | 21-225_12A1 | VH3J3-33|D7|7-27|RF2J H4 | QVQLVES-GGGVVQPGRSLRL SCAASG-FTFS | S------YGMH | WVRQAPGK GLEWVA | VIWYE----ENNQYYADS VKG | RFTISRDNSKNTLYLQMNSL RAEDTAVYYCAR | ELGF----------RSDY | WGQGT LVTVS S |
| iPS:3 93838 | 21-225_6G2 | VH3J3-33|D7|7-27|RF2J H4 | LVQLVES-GGGVVQPGKSLRL SCAASG-FTFS | D------YGIH | WVRQAPGK GLEWVA | VIWYD----GSNKYYADS VKG | RFTISSDNSKNTLYLQMNSL RAEDTAVYYCAR | DLGW----------TEEY | WGQGT LVTVS S |
| iPS:3 93854 | 21-225_7H11 | VH3J3-33|D7|7-27|RF2J H4 | QVQLVES-GGGVVQPGRSLRL SCSASG-FTFS | D------YGMH | WVRQAPGK GLEWVA | VIWYD----ENNKYYADS VKG | RFTISRDNSKNTLYLQMNSL RAEDTAVYYCAR | ELGF----------RSDY | WGQGT LVTVS S |
| iPS:3 93866 | 21-225_14E3 | VH3J3-33|D7|7-27|RF2J H4 | QVQLVES-GGGVVQPGRSLRL SCAASG-FTFS | D------FGMH | WVRQAPGK GLEWVA | VIWYE----ENNQYYADS VKG | RFTISRDNSKNTLYLQMNSL RAEDTAVYYCAR | ELGF----------RSDY | WGQGT LVTVS S |
| iPS:3 93876 | 21-225_9A1 | VH3J3-33|D7|7-27|RF2J H4 | QVQLVES-GGGVVQPGRSLRL SCAASG-FTFS | D------YGMH | WVRQAPGK GLEWVA | VIWFD----GSNKYYADS VKG | RFTISRDNSKNTLYLQMNSL RAEDTAVYYCAR | DLGW----------TEEY | WGQGT PVTVS S |
| iPS:3 93882 | 21-225_15E3 | VH3J3-33|D7|7-27|RF2J H4 | QVQLVES-GGTVVQPGRSLRL SCAASG-FTFS | S------YGMH | WVRQAPGK GLEWVA | VIWYE----ENNKHYADS VKG | RFTISRDNSKNTLYLQMNSL RAEDTAFYYCAR | ELGF----------LSDY | WGQGT LVTVS S |
| iPS:3 93884 | 21-225_16F4 | VH3J3-33|D7|7-27|RF2J H4 | QVQLVES-GGGVVQPGRSLRL SCAASG-FTFS | N------YGMH | WVRQAPGK GLEWVA | VIWYE----GSNQYYGDS VKG | RFTISRDNSKNTLYLQMNSL RAEDTAVYYCAR | ELGF----------LSDY | WGQGT LVTVS S |
| iPS:3 93912 | 21-225_16F6 | VH3J3-33|D7|7-27|RF2J H4 | QVQLVES-GGGVVQPGRSLRL SCAASG-FTFS | N------YGMH | WVRQAPGK GLEWVA | VIWYE----GSNQYYGDS VKG | RFTISRDNSKNTLYLQMHSL RAEDTAVYYCVR | ELGF----------LSDY | WGQGT LVTVS S |
| iPS:3 93922 | 21-225_2B2 | VH3J3-33|D7|7-27|RF2J H4 | QVQLVES-GGGVVQPGRSLRL SCAASG-FTFS | S------YGMH | WVRQAPGK GLEWVA | VIWYE----ENNKYYVDS VKG | RFTISRDNSKSTLYLQMNSL RAEDTAVYYCVR | ELGF----------QSDY | WGQGT PVTVS S |
| iPS:3 93934 | 21-225_13E6 | VH3J3-33|D7|7-27|RF2J H4 | QVQLVES-GGGVVQPGRSLRL SCAASG-FTFS | N------YGMH | WVRQAPGK GLEWVA | VIWYD----ENNKYYIDS VKG | RFTISRDNSKNTLYLQMNSL RAEDTAVYYCAR | ELGF----------RSDY | WGQGT LVTVS S |
| iPS:3 93948 | 21-225_16A5 | VH3J3-33|D7|7-27|RF2J H4 | QVQLVES-GGGVVQPGRSLRL SCAASG-FTFS | D------YGMH | WVRQAPGK GLEWVA | VIWFD----GSNKYYVDS VKG | RFTISRDNSKNTLYLQMSSL RAEDTAVYYCAR | DLGW----------TEEY | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 93960 | 21-225_7G2 | VH3/3-33/D7/7-27/RF2/JH4 | QVQLVES-GGGVVQPGRSLRL SCAASG-FTFS | D------YGMH | WVRQAPGK GLEWVA | VIWYD----VTNKYYADS VKG | RFTISRDNSKNTLYLQLNSL RAEDTAVYYCAR | ELGW--------YEDY | WGQGT LVTVS S |
| iPS:3 93974 | 21-225_7C4 | VH3/3-33/D7/7-27/RF2/JH4 | QVQLVES-GGGVVQPGKSLRL SCAASG-FTFS | N------YGMH | WVRQAPGK GLEWVA | VIWYE----ENNKYYADS VKG | RFTISRDNSKNTLYLQMNSL RAEDTAVYYCAR | ELGF--------RSDY | WGQGT LVTVS S |
| iPS:3 93976 | 21-225_7E9 | VH3/3-33/D7/7-27/RF2/JH4 | QVQLVES-GGGVVQPGRSLRL SCAASG-FTFS | D------YGMH | WVRQAPGK GLEWVA | VIWYD----ENNKYYVDS VKG | RFTISRDNEKNTLYLQMNSL RAEDTAVYYCAR | ELGF--------RSDY | WGQGT LVTVS S |
| iPS:3 93994 | 21-225_8C9 | VH3/3-33/D7/7-27/RF2/JH4 | QVQLVES-GGGVVQPGRSLRL SCAASG-FTFS | S------YGMH | WVRQAPGK GLEWVA | VIWYD----ENNKYYVDS VKG | RFTISRDNSKNTLYLQMNSL RAEDTAVYYCAR | ELGF--------RSDY | WGQGT LVTVS S |
| iPS:3 93998 | 21-225_12B12 | VH3/3-33/D7/7-27/RF2/JH4 | QVQLVES-GGGVVQPGRSLRL SCAASG-FTFS | D------YGMH | WVRQAPGK GLEWMA | VIWYD----VTNKYYADS VKG | RFTISRDNSKNTLYLQMNSL RAEDTAVYYCAR | ELGW--------YEDY | WGQGT LVTVS S |
| iPS:3 94024 | 21-225_16B7 | VH3/3-33/D7/7-27/RF2/JH4 | QVQLVES-GGGVVQPGRSLRL SCAASG-FTFS | S------YGMH | WVRQAPGK GLEWVA | VIWYD----ESNKYYADS VKG | RFTISRDNSKNTLYLQMNSL RAEDTAVYYCAR | ELGF--------LSDY | WGQGT LVTVS S |
| iPS:3 94059 | 21-225_9E8 | VH3/3-33/D7/7-27/RF2/JH4 | QVQLVES-GGGVVQPGRSLRL SCEASG-FTFS | S------YGMH | WVRQAPGK GLEWVA | VIWYE----ENNQYYADS VKG | RFTISRDNSKNTLYLQMNSL RAEDTAVYYCAR | ELGF--------RSDY | WGQGT LVTVS S |
| iPS:3 94067 | 21-225_12F2 | VH3/3-33/D7/7-27/RF2/JH4 | QVQLVES-GGGVVQPGRSLRL SCAASG-FTFS | D------YGMH | WVRQAPGK GLEWVA | VIWFD----GNNKYYADS VKG | RFTISRDDSKNTLYLQMNSL RAEDTAVYYCAR | ELAW--------SRDY | WGQGT LVTVS S |
| iPS:3 94089 | 21-225_12E6 | VH3/3-33/D7/7-27/RF2/JH4 | QVQLVES-GGGVVQPGRSLRL SCAASG-FTFS | D------YGMH | WVRQAPGK GLEWVT | VIWYD----ESNKYYADS VKG | RFTISRDDSKNTLYLQMNSL RAEDTAVYYCVR | ELAW--------YEDY | WGQGT LVTVS S |
| iPS:3 94097 | 21-225_16G7 | VH3/3-33/D7/7-27/RF2/JH4 | QVQLVES-GGGVVQPGRSLRL SCAASG-FTFT | D------YGMH | WVRQAPGK GLEWVA | VIWYE----ENNKYYADS VKG | RFTISRANSKNTLYLQMNSL RAEDTAVYYCAR | ELAW--------YEDY | WGQGT LVTVS S |
| iPS:4 02219 | 21-225_1C12 | VH3/3-33/D7/7-27/RF2/JH4 | QVQLVES-GGGVVQPGRSLRL SCAASG-FTFS | N------YGMH | WVRQAPGK GLEWVA | VIWYD----ENNKYYVDS VKG | RFTISRDNSKNTLYLQMNSL RAEDTAVYYCAR | ELGF--------RSDY | WGQGT LVTVS S |
| Germline | VH3/3-33/D4/4-11/RF2/JH4 | | | | | | | |

FIGURE 51 (Continued)

| | | | | | | | | | |
|---|---|---|---|---|---|---|---|---|---|
| iPS:4 33895 | 21-225_43E1 | VH3|3-21/D4|4-11|RF2/J H4 | EVQLVES- GGGLVKPGGSLRL SCAASG-FTFS | S------YSMN | WVRQAPGK GLEWVS | AISGN- STYIYYADS LKG | RFTISRDNAKNSLFLQLNSL RAEDTAVYYCAR | DRG---------------SE | WGQGT LVTVS S |
| iPS:4 34103 | 21-225_53G1 | VH3|3-21/D4|4-11|RF2/J H4 | EVQLVES- GGGLVKPGESLRL SCAASG-FTFS | S------YSMN | WVRQAPGK GLEWVS | SISGS---- SSYIYYADS VKG | RFTMSRDNAKNSLYLQMNSL RAEDTAVYYCAR | DRG---------------ST | WGQGT LVTVS S |
| iPS:4 34179 | 21-225_56F1 | VH3|3-21/D4|4-11|RF2/J H4 | EVQLVES- GGGLVKPGGSLRL SCAASG-FTFS | S------YSMN | WVRQAPGK GLEWVS | SISSS---- STYIYYADS VKG | RFTISRDNAKNSLYLQMNSL RAEDTAVYYCAR | DRG---------------SS | WGQGT LVTVS S |
| iPS:4 34263 | 21-225_56H7 | VH3|3-21/D4|4-11|RF2/J H4 | EVQLVES- GGGLVKPGGSLRL SCAASG-FSFS | S------YSMN | WVRQAPGK GLEWVS | SISSS---- STYIYYGDS VKG | RFTISRDNAKNSLYLQMNSL RAEDTAVYYCAR | DRG---------------SS | WGQGT LVTVS S |
| iPS:4 35521 | 21-225_157H4 | VH3|3-21/D4|4-11|RF2/J H4 | EVQLVES- GGGLVKPGGSLRL SCAASG-FTFS | S------YSMN | WVRQAPGK GLEWVS | SISSS---- STYIYYADS VKG | RFTISRDNAKNSLYLQMNSL RAEDTAVYYCAR | DRG---------------SI | WGQGT LVTVS S |
| iPS:4 35527 | 21-225_157G7 | VH3|3-21/D4|4-11|RF2/J H4 | EVQLVES- GGGLVKPGGSLRL SCAASG-FTFS | S------YSMN | WVRQAPGK GLEWVS | SISGS---- STYIYYADS VKG | RFTISRDNAKNSLYLQMNSL RAEDTAVYYCAR | DRG---------------SS | WGQGT LVTVS S |
| iPS:4 35529 | 21-225_157H7 | VH3|3-21/D4|4-11|RF2/J H4 | EVQLVES- GGGLVKPGGSLRL SCAASG-FTFS | S------YSMN | WVRQAPGK GLEWVS | CISGS---- SSYIYYADS VKG | RFTMSRDNAKNSLYLQMNSL RAEDTAVYYCVR | DRG---------------GY | WGQGT LVTVS S |
| iPS:4 35547 | 21-225_158F5 | VH3|3-21/D4|4-11|RF2/J H4 | EVQLVES- GGGLVKPGGSLRF SCAASG-FTFS | S------YSMN | WVRQAPGK GLEWVS | SISGS---- STYIYYADS VKG | RFTISRDNAKNSLYLQMNSL RAEDTAVYYCAR | DRG---------------SS | WGQGT LVTVS S |
| iPS:4 35549 | 21-225_158H5 | VH3|3-21/D4|4-11|RF2/J H4 | EVQLVES- GGGLVKPGGSLRL SCAASG-FTFS | S------YSMN | WVRQAPGK GLEWVS | SISGS---- STYIYYADS VKG | RFTISRDNAKNSLHLQMNSL RAEDTAVYYCAR | DRG---------------SS | WGQGT LVTVS S |
| iPS:4 35553 | 21-225_158G8 | VH3|3-21/D4|4-11|RF2/J H4 | EVQLVTPGGSLRL SCAASG-FTFS | S------YSMN | WVRQAPGK GLEWVS | LISGS---- SSYIYYADS VKG | RFTISRDNAKNSLYLQMNSL RAEDTAVYYCAR | DRG---------------SL | WGQGT LVTVS S |
| iPS:4 35581 | 21-225_160H1 | VH3|3-21/D4|4-11|RF2/J H4 | EVQLVES- GGGLVKPGGSLRL SCAASG-FTFS | S------YRMN | WVRQAPGK GLEWVS | SISSS---- TGMYYADS VKG | RFTISRDNAKNSLYLQMNSL RAEDTAVYYCAR | DK----------------DY | WGQGT LVTVS S |
| iPS:4 35593 | 21-225_160F4 | VH3|3-21/D4|4-11|RF2/J H4 | EVQLVES- GGGLVKPGGSLRF SCAASG-FTFS | S------YSMN | WVRQAPGK GLEWVS | SISGS---- STYIYYADS VKG | RFTISRDNAKNSLYLQMNSL RAEDTAVYYCAR | DRG---------------SS | WGQGT LVTVS S |

FIGURE 51 (Continued)

| | | | | | | | | |
|---|---|---|---|---|---|---|---|---|
| iPS:4 35817 | 21-225_162F2 | VH3/3-21/D4/4-11/RF2/J H4 | EVQLVES-GGGLVKPGGSLRF SCAASG-FTFS | S------YSMN | WVRQAPGK GLEWVS | SISGS---- STYIYYADS VKG | RFTISRDNAKNSLYLQMNSL RAEDTAVYYCAR | DRG--------------SS | WGQGT LVTVS S |
| iPS:4 35621 | 21-225_162H3 | VH3/3-21/D4/4-11/RF2/J H4 | EVQLVES-GGGLVKPGGSLRF SCAASG-FTFS | S------YSMN | WVRQAPGK GLEWVS | SISGS---- STYIYYADS VKG | RFTISRDNAKNSLYLQMNSL RAEDTAVYYCAR | DRG--------------SS | WGQGT LVTVS S |
| iPS:4 35641 | 21-225_163F9 | VH3/3-21/D4/4-11/RF2/J H4 | EVQLVES-GGGLVQPGGSLRL SCAASG-FTFS | S------YSMN | WVRQAPGK GLEWVS | SISGS---- STYIYYADS VKG | RFTISRDNAKNSLYLQMNSL RAEDTAVYYCAR | DRG--------------SL | WGQGT LVTVS S |
| iPS:4 35719 | 21-225_171A11 | VH3/3-21/D4/4-11/RF2/J H4 | EVQLVES-GGGLVKPGGSLRL SCAASG-FTFS | S------YSMN | WVRQAPGK GLEWVS | SISGS---- SSYIYYADS VKG | RFTISRDSAKNSLYLQMNSL RAEDTAVYYCAR | DRG--------------SS | WGQGI LVTVS S |
| iPS:4 36856 | 21-225_58C5 | VH3/3-21/D4/4-11/RF2/J H4 | EVQLVES-GGGLVKPGGSLRL SCAASG-FTFN | S------FSLN | WVRQAPGK GLEWIS | SISGS---- SSYLYYADS VKG | RFTISRDNAKNSLYLQMNSL RAEDTAVYYCAR | TYSG----------SPDY | WGQGT LVTVS S |
| iPS:4 48904 | 21-225_65C12 | VH3/3-21/D4/4-11/RF2/J H4 | EVQLVES-GGGLVKPGGSLRL SCAASG-FTFS | S------YTMN | WVRQAPGK GLEWVS | SISSS---- SSYIYYADS VKG | RFTISRDNAKNSLYLQMNSL RAEDTAVYYCAR | DAY---------------SHI | WGQGT LVTVS S |
| iPS:4 72730 | 21-225_14B1_LC1 | VH3/3-21/D4/4-11/RF2/J H4 | EVQLVES-GGGLVKPGGSLRL SCAASG-FTFS | S------YTMN | WVRQAPGK GLEWVS | SISGS---- SSYLYYPDS VKG | RFTISRDNAKNSLYLQMNSL RAEDTAVYYCAR | DRG--------------SS | WGQGT LVTVS S |
| iPS:4 72731 | 21-225_14B1_LC2 | VH3/3-21/D4/4-11/RF2/J H4 | EVQLVEA-GGGLVKPGGSLRL SCAASG-FTFT | S------YGLN | WVRQAPGK GLEWVS | SISGS---- SSHISYADS VKG | RFTISRDNAKNSLYLQMNSL RAEDTAVYYCAR | DRG--------------SY | WGQGT LVTVS S |
| iPS:3 92726 | 21-225_20B5 | VH3/3-21/D4/4-11/RF2/J H4 | EVQLVES-GGGLVKPGGSLRL SCAASG-FTFS | S------YSMN | WVRQAPGK GLEWVS | SISGS---- SSHIYYADS VKG | RFTISRDNAKNSLYLQMNSL RAEDTAVYYCAR | DRG--------------SS | WGQGT LVTVS S |
| iPS:3 92734 | 21-225_17D8 | VH3/3-21/D4/4-11/RF2/J H4 | EVQLVES-GGGLVKPGGSLRL SCAASG-FTFS | S------YSMN | WVRQAPGK GLEWVS | SISGS---- SSHIYYADS VKG | RFTISRDNAKNSLYLQLNSL RAEDTAVYYCAR | DRG--------------SG | WGQGT LVTVS S |
| iPS:3 92768 | 21-225_20B8 | VH3/3-21/D4/4-11/RF2/J H4 | EVQLVES-GGGLVKPGGSLRL SCAASG-FTFS | S------YSMN | WVRQAPGK GLEWVS | SISGS---- SSHIYYADS VKG | RFTISRDNAKNSLYLQMNSL RAEDTAVYYCAR | DRG--------------SG | WGQGT LVTVS S |
| iPS:3 92778 | 21-225_22H3 | VH3/3-21/D4/4-11/RF2/J H4 | AVQLVES-GGGLVKPGGSLRL SCAASG-FTFS | S------YSMN | WVRQAPGK GLEWVS | SISSS---- SSYIYYADS VKG | RFTISRDNAKNSLYLQMNSL RAEDTAVFYCAR | DRG--------------SL | WGQGT LVTVS S |

FIGURE 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| iPS:3 92788 | 21-225_20C8 | VH3|3-21|D4|4-11|RF2|JH4 | EVQLVES-GGGLVKPGGSLRLSCAASG-FTFS | S------YSMN | WVRQAPGK GLEWVS | SISGS----SSYIYYADS VKA | RFTISRDNAKNSLYLQMNSL RAEDTAVYYCAR | DRG------------SL | WGQGT LVTVS S |
| iPS:3 92792 | 21-225_20G12 | VH3|3-21|D4|4-11|RF2|JH4 | EVQLVES-GGGLVKPGGSLRLSCAASG-FTFS | S------YSMN | WVRQAPGK GLEWVS | SISGS----SSYIYYADS LKG | RFTISRDNAKNSLYLQMNSL RAEDTAVYYCAR | DRG------------SY | WGQGT LVTVS S |
| iPS:3 92844 | 21-225_23E11 | VH3|3-21|D4|4-11|RF2|JH4 | EVQLVES-GGGLVKPGGSLRLSCAASG-FTFS | S------YTMN | WVRQAPGK GLEWVS | SISGS----SSYIWYVDS VKG | RFTISRDNAKNSLYLQMNSL RAEDTAVYYCAR | DRG------------SL | WGQGT LVTVS S |
| iPS:3 92848 | 21-225_20F9 | VH3|3-21|D4|4-11|RF2|JH4 | EVQLVES-GGGLVKPGGSLRLSCAASG-FTFS | S------YSMN | WVRQAPGK GLEWVS | SISGS----SSYIYYADS VKG | RFTISRDNAKNSLYLQMNSL RAEDTAVYYCAR | DRG------------SC | WGQGT LVTIS S |
| iPS:3 92850 | 21-225_20H10 | VH3|3-21|D4|4-11|RF2|JH4 | EVQLVES-GGGLVKPGGSLRLSCAASG-FTFS | I------YSMN | WVRQAPGK GLEWVS | SISSS----SSYIYYADS VKG | RFTISRDNAKNSLYLQMNSL RAEDTAIYYCAR | DRG------------SL | WGQGT LVTVS S |
| iPS:3 93006 | 21-225_31G9 | VH3|3-21|D4|4-11|RF2|JH4 | EVQLVES-GGGLVKPGGSLRLSCAASG-FTFS | S------YSMN | WVRQAPGK GLEWVS | SISSS----SSYIYYADS VKG | RFTISRDNAKNSLYLQMNSL RAEDTAVYYCAR | DRG------------SS | WGQGT LVTVS S |
| iPS:3 93022 | 21-225_30H11 | VH3|3-21|D4|4-11|RF2|JH4 | EVQLVES-GGGLVKPGGSLRLSCAASG-FTFS | S------YSMN | WVRQAPGK GLDWVS | SISGS----SSYIYYADS VKG | RFTISRDNAKNSLYLQMNSL RAEDTAVYYCAR | DRG------------SL | WGQGT LVTVS S |
| iPS:3 93130 | 21-225_33C2 | VH3|3-21|D4|4-11|RF2|JH4 | EVQLVES-GGGLVKPGGSLRLSCAASG-FTFS | S------YTMN | WVRQAPGK GLQWVS | SISGS----SSYIYYADS VKG | RFTISRDNAKNSLFLQMNSL RAEDTAIYYCAR | DRG------------GT | WGQGT LVTVS S |
| iPS:3 93906 | 21-225_13D3 | VH3|3-21|D4|4-11|RF2|JH4 | EVQLVES-GGGLVKPGGSLRLSCAASG-FTFS | S------YTMN | WVRQAPGK GLDWVS | SISGS----SSYIYYADS VKG | RFTISRDNAKNSLYLQMNSL RAEDTAVYYCAR | DRG------------SG | WGQGT LVTVS S |
| iPS:3 93982 | 21-225_6C12 | VH3|3-21|D4|4-11|RF2|JH4 | EVQLVES-GGGLVKPGGSLRLSCAASG-FTFS | S------YSMN | WVRQAPGK GLEWVS | SISGS----SSYIYYADS VKG | RFTISRDNAKNSLYLQMNSL RAEDTAVYYCAR | DRG------------SL | WGQGT LVTVS S |
| iPS:3 98478 | 21-225_17C10 | VH3|3-21|D4|4-11|RF2|JH4 | EVQLVES-GGGLVKPGGSLRLSCAASG-FTFS | S------YSMN | WVRQAPGK GLEWVS | SISGS----SSYMYYADS VKG | RFTISRDNAKNSLYLQMNGL RAEDTALYYCAR | DRG------------SS | WGQGT LVTVS S |
| VH3|3-21|D4|6|RF1|JH4 | | | H_FR1 | H_CDR1 | H_FR2 | H_CDR2 | H_FR3 | H_CDR3 | H_FR4 |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 33897 | 21-225_43C2 | VH3\|3-23\|D6\|6-6\|RF1\|JH4 | EVQLLES-GGGLVQPGGSLRL SCAASG-FTFS | S------YAMS | WVRQAPGK GLEWVS | AISGR---- GVNTFDADS VKG | RFTISRDNSKNTLYLQMNSL RAEDTAVYYCAK | ERSGS------------YFDY | WGQGT LVTVS S |
| iPS:4 33903 | 21-225_43H4 | VH3\|3-23\|D6\|6-6\|RF1\|JH4 | EVQLLES-GGGLVQPGGSLRL SCAASG-FTFS | S------YAMS | WVRQAPGK GLEWVS | AISGR---- GINTFDADS VKG | RFTISRDNSKNTLYLQMNSL RAEDTAVYYCAK | ERSGS------------YFDY | WGQGT LVTVS S |
| iPS:4 33911 | 21-225_43E8 | VH3\|3-23\|D6\|6-6\|RF1\|JH4 | EVQLLES-GGGLVQPGGSLRL SCAASG-FTFS | S------YAMS | WVRQAPGK GLEWVS | AISGR---- GINTFDADS VKG | RFTISRDNSKNTLYLQMNSL RAEDTAVYYCAK | ERSGS------------YFDY | WGQGT LVTVS S |
| iPS:4 33941 | 21-225_44D10 | VH3\|3-23\|D6\|6-6\|RF1\|JH4 | EVQLLES-GGGLVQPGGSLRL SCAASG-FTFS | S------YAMS | WVRQAPGK GLEWVS | AISGR---- GVNTFDADS VKG | RFTISRDNSKNTLYLQMNSL RAEDTAVYYCAK | ERSGS------------YFDY | WGQGT LVTVS S |
| iPS:4 33957 | 21-225_45F8 | VH3\|3-23\|D6\|6-6\|RF1\|JH4 | EVQLLES-GGGLVQPGGSLRL SCAASG-FTFS | S------YAMS | WVRQAPGK GLEWVS | AISGR---- GVNTFDADS VKG | RFTISRDNSKNTLYLQMNSL RAEDTAVYYCAK | ERSGS------------YFDY | WGQGT LVTVS S |
| iPS:4 33973 | 21-225_46A6 | VH3\|3-23\|D6\|6-6\|RF1\|JH4 | EVQLLES-GGGLVQPGGSLRL SCAASG-FTFS | S------YAMS | WVRQAPGK GLEWVS | AISGR---- GINTFDADS VKG | RFTISRDNSKNTLYLQMNSL RAEDTAVYYCAK | ERSGS------------YFDY | WGQGT LVTVS S |
| iPS:4 35715 | 21-225_171A8 | VH3\|3-23\|D6\|6-6\|RF1\|JH4 | EVQLLES-GGGLVQPGGSLRL SCAASG-FTFR | S------SAMS | WVRQAPGK GLEWVS | VISGS---- GGSTFYIDS VKG | RFTISRDNSKNTLYLQMNSL RAEDTAVYYCAK | SNSSG------------WFDY | WGQGT LVTVS S |
| iPS:4 35739 | 21-225_174G7 | VH3\|3-23\|D6\|6-6\|RF1\|JH4 | EVQLLES-GGGLVQPGGSLRL SCAASG-FTFR | S------SAMS | WVRQAPGK GLEWVS | VISGS---- GGSTFYADS VKG | RFTISRDNSKNTLYLQMNSL RAEDTAVYYCAK | SNSSG------------WFDY | WGQGT LVTVS S |
| iPS:4 35749 | 21-225_175C10 | VH3\|3-23\|D6\|6-6\|RF1\|JH4 | EVQLLES-GGGLVQPGGSLRL SCAASG-FTFS | S------YAMS | WVRQAPGK GLEWVS | SISGR---- GGSTFYADS VKG | RFTVSRDNSKNTLYLQMNSL RAEDTAVYYCAK | SNSSG------------WFDY | WGQGT LVTVS S |
| VH3\|3-21\|D7\|7-27\|RF1\|JH4 | Germline | | | | | | | | |
| iPS:4 33901 | 21-225_43A4 | VH3\|3-21\|D7\|7-27\|RF1\|JH4 | EVQLVES-GGGLVKPGGSLRL SCAASG-FTFS | S------YTMN | WVRQVPGK GLEWVS | SISGS---- STYIYADS VKG | RFTISRDDAQNSLYLQMNSL RGEDTAVYYCAR | VTS------------------FDY | WGQGA LVTVS S |
| iPS:4 33961 | 21-225_45D9 | VH3\|3-21\|D7\|7-27\|RF1\|JH4 | EVQLVES-GGGLVKPGGSLRL SCAASG-FTFS | S------YTMN | WVRQVPGK GLEWVS | SISGS---- STYIYADS VKG | RFTISRDDAQNSLYLQMNSL RGEDTAVYYCAR | VTS------------------FDY | WGQGA LVTVS S |

FIGURE 51 (Continued)

| | | | | | | | | |
|---|---|---|---|---|---|---|---|---|
| iPS.4 34135 | 21-225_54H3 | VH3/3-21/D7/7-27/RF1/J H4 | EVQLVES-GGGLVRPGGSLRL SCAASG-FTFS | S------YSMI | WVRQAPGK GLEWVS | SISGT----SSIYYADS VKG | RFTISRDNAKNSLYLQMNSL RAEDTAVYYCAG | MTT----------------VI | WGQGT LVTVS S |
| iPS.4 34331 | 21-225_63H8 | VH3/3-21/D7/7-27/RF1/J H4 | EVQLVES-GGGLVRPGGSLRL SCAASG-FTFS | S------YNMN | WVRQAPGK GLEWVS | SISGS----STYMNTDS VKG | RFTISRDNAKNSLYLQMNSL RAEDTAVYYCAR | LRN---------------FDY | WGQGT LVTVS S |
| iPS.4 35421 | 21-225_151F1 | VH3/3-21/D7/7-27/RF1/J H4 | EVQLVES-GGGLVRPGGSLRL SCAASG-YTFR | S------FSMN | WVRQAPGK GLEWVS | SISSS----SYIYYADS VKG | RFTISRDNAKNSLYLQMNSL RAEDTAVYYCAR | DTP---------------LVY | WGQGT LVTVS S |
| iPS.4 35653 | 21-225_166H12 | VH3/3-21/D7/7-27/RF1/J H4 | EVQLVES-GGALVRPGGSLRL SCAASG-FTFS | S------YSMS | WVRQAPGK GLGWVS | SISGS----SSSYYADS VKG | RFTISRDNAKNSLYLQMNSL RAEDTAVYYCAR | LTG---------------FDY | WGQGT LVTVS S |
| iPS.4 36648 | 21-225_227F11 | VH3/3-21/D7/7-27/RF1/J H4 | EVQLVES-GGGLVRPGGSLRL SCAVSG-FTFS | T------YSMN | WVRQAPGK GLEWVS | SISGS----INMYYADS VKG | RFTISRDNAKNSLYLQMNSL RAEDTAVYYCAR | LG----------------VY | WGQGT LVTVS S |
| iPS.3 92952 | 21-225_26G1 | VH3/3-21/D7/7-27/RF1/J H4 | EVQLVES-GGGLVRPGGSLRL SCAASG-FTFS | S------YGMN | WVRQAPGK GLEWVS | SISSS----SSIYYADS VKG | RFTISRDNAKNSLYLQMNSL RAEDTAVYYCAR | LTT---------------FDF | WGQGT LVTVS S |
| iPS.3 93082 | 21-225_34C11 | VH3/3-21/D7/7-27/RF1/J H4 | EVQLVES-GGGLVRPGGSLRL SCAASG-FTFS | S------YTMS | WVRQAPGK GLEWVS | SISSS----SNYIYYADS VKG | RFTISRDNAKNSLYLQMNSL RAEDTAVYYCAR | LTG---------------FDY | WGQGT LVTVS S |
| iPS.3 94061 | 21-225_12D2 | VH3/3-21/D7/7-27/RF1/J H4 | EVQLVES-GGGLVRPGGSLRL SCAASG-FTFS | S------YSMN | WVRQAPGK GLEWVS | SISGS----SSIYYADS VKG | RFTISRDNAKNSLYLQMNSL RAEDTAVYYCAR | LG----------------DY | WGQGT LVAVS S |
| iPS.3 94071 | 21-225_10C7 | VH3/3-21/D7/7-27/RF1/J H4 | EVQLVES-GGGLVRPGGSLRL SCAASG-FTFS | S------YSMN | WVRQAPGK GLEWVS | SISSS----NNYIYYADS VKG | RFTISRDNAKNSLYLQMNSL RAEDSAVYYCAR | LG----------------VY | WGQGT LVTVS S |
| iPS.3 98532 | 21-225_33B7 | VH3/3-21/D7/7-27/RF1/J H4 | EVQLVES-GGGLVRPGGSLRL SCAASG-FTFS | S------YNMN | WVRQAPGK GLEWVS | SISGS----SSIYYADS VKG | RFTISRDNAKNSLYLQMNSL RAEDTAVYYCAR | LNG---------------FDY | WGQGT LVTVS S |
| iPS.4 02225 | 21-225_2B1 | VH3/3-21/D7/7-27/RF1/J H4 | EVQLVES-GGGLVRPGGSLRL SCAASG-FTFS | S------YSMN | WVRQAPGK GLEWVS | SISSS----SSIYYADS VKG | RFTISRDNAKNSLYLQMNSL RAEDTAVYYCAR | LG----------------NY | WGQGT LVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 04090 | 21-225_8D8 | VH3\|3-21\|D7\|7-27\|RF1/J H4 | EVQLVES-GGGLVKPGGSLRLSCAASG-FTFS | S------YSMN | WVRQAPGK GLEWVS | YISSS----SSYIYYADS VKG | RFTISRDNAKNSLYLQMNSL RAEDTAVYYCAR | LG-------------------NY | WGQGT LVTVS S |
| | VH3\|3-11\|D4\|4-11\|RF2/JH4 | Germline | | | | | | | |
| iPS:4 33905 | 21-225_43E5 | VH3\|3-11\|D4\|4-11\|RF2/J H4 | QVQLVES-GGGLVKPGGSLRLSCAASG-FTFS | D------YYMN | WIRQAPGK GLEWVS | YISSS----GITKYYADS MKG | RFTISRDNAKNSLYLQMNSL RAEDTAVYYCAA | DT-------------------IY | WGQGT LVTVS S |
| iPS:4 33913 | 21-225_43H8 | VH3\|3-11\|D4\|4-11\|RF2/J H4 | QVQLVES-GGGLVKPGGSLRLSCAASG-FTFS | D------YYMN | WIRQAPGK GLEWVS | YISSS----GRTFYYADS LKKG | RFTISRDNAKNSLYLQMNSL RAEDTAVYYCAA | DT-------------------IY | WGQGT LVTVS S |
| iPS:4 33949 | 21-225_45H2 | VH3\|3-11\|D4\|4-11\|RF2/J H4 | QVQLVES-GGGLVKPGGSLRLSCAASG-FTFS | D------YYMN | WIRQAPGK GLEWVS | YISSS----GITKYYADS VKG | RFTISRDNAKNSLYLQMNSL RAEDTAVYYCAA | DT-------------------IY | WGQGT LVTVS S |
| iPS:4 33981 | 21-225_46E9 | VH3\|3-11\|D4\|4-11\|RF2/J H4 | QVQLVES-GGGLVKPGGSLRLSCAASG-FTFS | D------YYMN | WIRQAPGK GLEWVS | YINSN----GFTIYYADS VKG | RFTISRDNAKNSLYLQMNSL RAEDTAVYYCAA | DT-------------------IY | WGQGT LVTVS S |
| iPS:4 33995 | 21-225_47H7 | VH3\|3-11\|D4\|4-11\|RF2/J H4 | QVQLVES-GGGLVKPGGSLRLSCAASG-FTFS | D------YYMI | WIRQAPGK GLEWVS | YISSS----GSTIYYADS VKG | RFTISRDNAKNSLYLQMNSL RAEDTAVYYCAA | DT-------------------YI | WGQGT LVTVS S |
| iPS:4 34039 | 21-225_43B1 | VH3\|3-11\|D4\|4-11\|RF2/J H4 | QVQLVES-GGGLVKPGGSLRLSCAASG-FTFS | D------YYMN | WIRQAPGM GLEWVS | YINSN----GFTIYYADS VKG | RFTISRDNAKNSLYLQMNSL RAEDTAVYYCAA | DT-------------------IY | WGQGT RVTVS S |
| iPS:4 34275 | 21-225_57F4 | VH3\|3-11\|D4\|4-11\|RF2/J H4 | QVQLVES-GGGLVKPGGSLRLSCAASG-FIFS | D------YYMN | WVRQAFGN GLEWVS | YISSS----GKTIYYADS VKG | RFTISRDNAKNSLYLQMNSL RAEDTAVYYCAK | DM-------------------IT | WGQGT LVTVS S |
| | VH3\|3-23\|D7\|7-27\|RF1/JH3 | Germline | | | | | | | |
| iPS:4 33915 | 21-225_43H9 | VH3\|3-23\|D7\|7-27\|RF1/J H3 | EVQLLES-GGGLVKPGGSLRLSCAASG-FTFS | S------YAMS | WVRQAPGK GLEWVS | AISGS----GSNTFYADS VKG | RFTISRDNSKNTILYLHMNSL RAEDTAVYFCAK | RTPSD---------------VFDI | WGQGT MVTVS S |
| iPS:4 33925 | 21-225_44F3 | VH3\|3-23\|D7\|7-27\|RF1/J H3 | EVHLLES-GGGLVQPGGSLRLSCAASG-FIFS | S------YAMS | WVRQAPGK GLEWVS | ILSGG----GKTIYYADS VKG | RFTISRDNSKNTLFLQMNSL RAEDTAVYYCAK | RTPSD---------------AFDI | WGQGT MVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 33953 | 21-225_45H4 | VH3|3-23|D7|7-27|RF1/J H3 | EVQLLES-GGGLVQPGGSLRL SCAASG-FTFS | S------YAMS | WVRQAPGM GLEWVS | AISGS---GSNTFYYADS VKG | RFTISRDNSKNTLYLHMNSL RAEDTAVYFCAK | RTPSD--------VFDI | WGQGT MVTVS S |
| iPS:4 33959 | 21-225_45C9 | VH3|3-23|D7|7-27|RF1/J H3 | EVQLLES-GGGLVQPGGSLRL SCAASG-FTFN | S------YAMS | WVRQAPGK GLEWVS | VISGR---GGTTYYADS VKG | RFTISRDNSKNTLYLQMNSL RAEDTAVYYCAK | RTPSD--------AFDI | WGQGT MVTVS S |
| iPS:4 35379 | 21-225_149B6 | VH3|3-23|D7|7-27|RF1/J H3 | EVQLLES-GGGLVQPGGSLRL SCAASG-FTFS | S------YAMS | WVRQAPGK GLEWVS | VISGS---GGSTFYYADS VKG | RFTISRDNSKNTLFLQMNSL RAEDTAVYYCAK | RTPED--------VFDI | WGQGT MVTVS S |
| iPS:4 35787 | 21-225_180A3 | VH3|3-23|D7|7-27|RF1/J H3 | EVQLLES-GGGLEQPGGSLRL SCAASG-FTFS | S------FAMN | WVRQAPGK GLEWVS | VISGR---GGNTFYYADS VKG | RFTISRDNSKNTLFLQMNSL RAEDTAVYFCAK | RTGDD--------VFDV | WGQGT MVTVS S |
| iPS:4 35809 | 21-225_182H5 | VH3|3-23|D7|7-27|RF1/J H3 | EVQLLES-GGGLVQPGGSLRL SCAASG-FTFS | S------YAMS | WVRQAPGK GLEWVS | VISGR---GGTTFYADS VKG | RFTISRDNSKNTLYLQMNSL RAEDTAVYYCAK | RTGDD--------VFDI | WGQGT MVTVS S |
| iPS:4 35889 | 21-225_186A11 | VH3|3-23|D7|7-27|RF1/J H3 | EVQLLES-GGGLVQPGGSLRL SCAASG-FTFS | S------YAMS | WVRQAPGK GLEWVS | VISGR---GGTTFYADS VKG | RFTISRDNSKNTLYLQMNSL RAEDTAVYYCAK | RTGDD--------VFDI | WGQGT MVTVS S |
| Germline | | | | | | | | | |
| VH4|4-59|D6|6-13|RF2|JH4 | | | | | | | | | |
| iPS:4 33931 | 21-225_44F6 | VH4|4-59|D6|6-13|RF2|J H4 | QVHLQES-GPGLVKPSETLSL TCTVSG-GSIS | S------YYWS | WIRQPPGK GLENIG | YIYY---SGNTNYNPS LKS | RVTISVDTSKNQFSLKLSSV TAADTAVYYCVR | GVAL--------KNY | WGQGI LVTVS S |
| Germline | | | | | | | | | |
| VH3|3-23|D4|4-17|RF2|JH6 | | | | | | | | | |
| iPS:4 33943 | 21-225_44E10 | VH3|3-23|D4|4-17|RF2|J H6 | EVQLLES-GGGLVQSGGSLRL SCAASG-FTFS | S------YAMN | WVRQAPGK GLEWVS | GVVGS---GGRTYYADS VKG | RFTISRDNSKNTLYLQMNSL RAEDTAVYYCAK | DRGQWL------LGGMDV | WGQGT TVTVS S |
| iPS:4 33989 | 21-225_47C7 | VH3|3-23|D4|4-17|RF2|J H6 | EVQLLES-GGGLVQPGGSLRL SCAASG-FTFS | N------YAMS | WVRQAFGK GLEWVS | GISGS---GSRTYYADS VKG | RFTISRDNSKNTLFLQMNSL RAEDTAVYYCAK | DRGQWL------IGGMDV | WGQGT TVTVS S |
| iPS:4 34133 | 21-225_54G3 | VH3|3-23|D4|4-17|RF2|J H6 | EVQLLES-GGGLVQPGGSLRL SCAASG-FTFS | T------YAMS | WVRQAPGK GLEWVS | AISGS---GVNTFYADS VKG | RFTISRDNSKNTLFLQMNSL RAEDTAVYYCAK | LGRDYY-------YYGMDV | WGQGT TVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 34221 | 21-225_60A11 | VH3／3-23/D4/4-17/RF2/JH6 | EVQLLES-GGGLVQPGGSLRL SCAASG-FTFS | N------YAMT | WVRQAPGK GLEWVS | AISGS----GGNTFYADS VTG | RVTISRDNSKNTLYLQMNSL RAEDTAVYYCAK | LGKDYH------YYGMDV | WGQGT TVTVS S |
| iPS:4 34257 | 21-225_62F7 | VH3／3-23/D4/4-17/RF2/JH6 | EVQLLES-GGGLVQPGGSLRL SCAASG-FTFS | S------YVMS | WVRQAPGK GLEWVS | GISGS----GAKTYYADS VKG | RFTISRDNSKNTLYLQMNSL RAEDTAVYYCAE | LGIDYY------YGMDV | WGQGT TVTVS S |
| iPS:4 34283 | 21-225_57F8 | VH3／3-23/D4/4-17/RF2/JH6 | EVQLLES-GGGLVQPGGSLRL SCVVSG-FTFS | N------YAMS | WVRQAPGK GLEWVS | ASSGS----GGNTFYADS VTG | RVTISRDNSKNTLYLQMNSL RAEDTAVYYCAK | LGKDYH------YYGMDV | WGQGT TVTVS S |
| iPS:4 34385 | 21-225_66C10 | VH3／3-23/D4/4-17/RF2/JH6 | EVQLLES-GGGLVQPGGSLRL SCAASG-FTFS | S------YVMS | WVRQAPGK GLEWVS | GISGS----GARTYYADS VKG | RFTISRDNSKNTLYLQMNSL RAEDTAVYYCAE | LGIDYY------YGMDV | WGQGT TVTVS S |
| iPS:4 35717 | 21-225_171A9 | VH3／3-23/D4/4-17/RF2/JH6 | EVQLLES-GGGLVQPGGSLRL SCAASG-FTFS | S------YAMT | WVRQAPGK GLEWVS | AISGS----GGNTFNADS VKG | RFTISRDNSKNTLYLHMNSL RAEDTAVYYCAG | LGIDYY------YYGVDV | WGQGT TVTVS S |
| iPS:4 36528 | 21-225_224B1 | VH3／3-23/D4/4-17/RF2/JH6 | EVQVLES-GGGLVQPGGSLRL SCAASG-FTFS | S------YAMS | WVRQAPGK GLEWVS | AISGS----GGNTFYADS VKG | RFTISRDNSKNTLYLQMNSL RAEDTAVYYCAK | EGGYYY------YYGVDV | WGQGT TVTVS S |
| iPS:3 93810 | 21-225_5A4 | VH3／3-23/D4/4-17/RF2/JH6 | EVQVLES-GGGLVQPGGSLRL SCAASG-LTFS | S------SAMS | WVRQAPGK GLEWVS | AISGR----GGNTFYTDS VKG | RFTISRDNSKNTLYLQMNSL RAEDTAVYYCAK | LGKDYY------YYGMDV | WGQGT TVTVS S |
| | Germline | | H_FR1 | H_CDR1 | H_FR2 | H_CDR2 | H_FR3 | H_CDR3 | H_FR4 |
| | VH3/3-48/D5/5-24/RF3/JH6 | | | | | | | | |
| iPS:4 33945 | 21-225_44C12 | VH3／3-48/D5/5-24/RF3/JH6 | EVQLVES-GGGLVQPGGSLRL SCAASG-FTFS | S------YSVN | WVRQAPGK GLEWVS | YISSS----SSTIYYADS VKG | RFTISRDNAKNSLYLQMNSL RDEDTAVYYCAR | SGYSYAYY------YYYGMDV | WGQGT TVTVS S |
| | Germline | | H_FR1 | H_CDR1 | H_FR2 | H_CDR2 | H_FR3 | H_CDR3 | H_FR4 |
| | VH3/3-33/D6/6-13/RF2/JH4 | | | | | | | | |
| iPS:4 33947 | 21-225_44E12 | VH3／3-33/D6/6-13/RF2/JH4 | QVHLAES-GGGVVQPGRSLRL SCEASG-FTLS | S------DDTH | WVRQPPGK GLEWVA | VIWFD----EYNKYYADS VKG | RFTISRDNSKNTLYLQMNSL RAEDAAVYYCAR | DLIAAA------GTGDY | WGQGT LVTVS S |
| iPS:4 33963 | 21-225_46B1 | VH3／3-33/D6/6-13/RF2/JH4 | QVHLAES-GGGVVQPGRSLRL SCEASG-FTLS | S------DDSH | WVRQPPGK GLEWVA | VIWFD----EYKYYADS VKG | RFTISRDNSKNTLYLQMRNL RAEDAAVYYCAR | DLIAAT------GTGDY | WGQGT LVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 33987 | 21-225_47A5 | VH3/3-33/D6/6-13/RF2/JH4 | QVQLVES-GGGVVQPGRSLRL SCAASG-FTFS | D------DDTH | WVRQAPGK GLEWVA | VIWFD----GSNKYYADS VKG | RFTISRDNSKNTLVLQMNSL SAEDTAVYYCAR | DLIAAA-------GTVDY | WGQGT LVTVS S |
| iPS:4 36258 | 21-225_202F12 | VH3/3-33/D6/6-13/RF2/JH4 | QVQLVES-GGGVVQPGRSLRL SCAASG-FTFS | Y------YGMH | WVRQAPGK GLEWVA | IIWYD----GSNKFYADS VKG | RFTISRDSSKNTLVLQMNSL RAEDTAVYYCAS | NIAAAA-------PYFDY | WGQGT LVTVS S |
| iPS:3 92646 | 21-225_20G2 | VH3/3-33/D6/6-13/RF2/JH4 | QVQLVES-GGGVVQPGRSLRL SCAASG-FTLS | S------DDMH | WVRQEPGK GLEWVA | VIWFD----GSNKYYADS VKG | RFIMSRDNSKNTLYLQMNSL RAGDTAVYYCAR | DLIAAA-------GTVDY | WGQGT LVTVS S |
| iPS:3 92750 | 21-225_20A10 | VH3/3-33/D6/6-13/RF2/JH4 | QVQLVES-GGGVVQPGRSLRL SCAASG-FTLS | S------DDMH | WVRQAPGK GLEWVA | VIWFD----GSNKYYADS VKG | RFIISRDNSKNTLYLQMNSL RAEDTAMYYCAR | DLIAAA-------GTVDY | WGQGT LVTVS S |
| | Germline | | H_FR1 | H_CDR1 | H_FR2 | H_CDR2 | H_FR3 | H_CDR3 | H_FR4 |
| | VH3/3-23/D6/6-19/RF2/JH3 | | EVQLLES-GGGLVQPGGSLRL SCAASG-FTFS | S------YAMS | WVRQAPGK GLEWVS | AISGS----GGSTYYADS VKG | RFTISRDNSKNTLYLQMNSL RAEDTAVYYCAR | GTKAG------DAFDI | WGQG MVTV S |
| iPS:4 33999 | 21-225_48D1 | VH3/3-23/D6/6-19/RF2/JH3 | EVQLLES-GGGLVQPGGSLRL SCAASG-FTFS | S------YAMS | WVRQAPGK GLEWVS | VISGR----GGTFYADS VKG | RFTISRDNSKNTLYLQMNSL RAEDTAVYYCAR | RIAVAG------NEAFDI | WGQGT MVTVS S |
| iPS:4 34003 | 21-225_48C3 | VH3/3-23/D6/6-19/RF2/JH3 | EVQLLES-GGGLVQPGGSLRL SCTASG-FTFS | S------YAMS | WVRQAFGK GLEWVS | VISGR----GGTFYADS VKG | RFTISRDNSKNTLYLQMNSL RAEDTAVYYCAR | RIAVAG------NEAFDI | WGQGT MVTVS S |
| iPS:4 34037 | 21-225_49G12 | VH3/3-23/D6/6-19/RF2/JH3 | EVQLLES-GGGLVQPGGSLRL SCAASG-FTFS | S------YAMS | WVRQAPGK GLEWVS | VISGS----GGTFYADS VKG | RLTISRDNSKNTLYLQMNSL RAEDTAVYYCAR | RIAVAG------NDAFDI | WGQGT MVTVS S |
| iPS:4 34041 | 21-225_50H8 | VH3/3-23/D6/6-19/RF2/JH3 | EVQLLES-GGGLVQPGGSLRL SCAASG-FTFS | S------YAMS | WVRQAFGK GLEWVS | VISGR----GGTFYADS VKG | RFTISRDNSKNTLYLQMNSL RAEDTAVYYCAR | RIAVAG------NEAFDI | WGQGT MVTVS S |
| iPS:4 34045 | 21-225_50H10 | VH3/3-23/D6/6-19/RF2/JH3 | EGQLLES-GGGLVQPGGSLRL SCAASG-FTFS | S------YAMS | WVRQAPGK GLEWVS | VISGR----GGTFYADS VKG | RFTISRDNSKNTLYLQMNSL RAEDTAVYYCAR | RIAVAG------NEAFDI | WGQGT MVTVS S |
| iPS:4 34073 | 21-225_51H10 | VH3/3-23/D6/6-19/RF2/JH3 | EVQLLES-GGGLVQPGGSLRL SCTASG-FTFS | S------YAMS | WVRQAPGK GLEWVS | VISGS----GGTFYADS VKG | RLTISRDNSKNTLNLQMNSL RAEDTAVYYCAR | RIAVAG------NDAFDI | WGQGT MVTVS S |
| iPS:4 36212 | 21-225_200G1 | VH3/3-23/D6/6-19/RF2/JH3 | EVQLLES-GGGLVQPGGSLRL SCAASG-FTFS | S------YAMS | WVRQAPGK GLEWVS | AISGR----GGNTFYADS VRG | RFTISRDNSKNTLYLQMNSL RAEDTAVYYCAR | RIAVDG------YDAFDV | WGQGT MVTVS S |

FIGURE 51 (Continued)

| | | | | | | | | |
|---|---|---|---|---|---|---|---|---|
| iPS:3 92652 | 21-225_17C6 | VH3|3-23|D6|6-19|RF2|JH3 | EVQLLES-GGGLVQPGGSLRLSCAASE-FTFS | S-------YAMN | WVRQAPGKGLEWVS | VISGR----GGNTFYADSVKG | RFTISRDNSKNTLYLQMNSLRAEDTAVYYCAS | RLAVAG-------SEAFDI | WGQGTMVTVSS |
| iPS:3 92668 | 21-225_17B4 | VH3|3-23|D6|6-19|RF2|JH3 | EVQLLES-GGGLVQPGGSLRLSCAASE-FTFS | S-------YAMN | WVRQAPGKGLEWVS | VISGR----GGNTFYADSVKG | RFTISRDNSKNTLYLQMNSLRAEDTAVYYCAS | RLAVAG-------SEAFDI | WGQGTMVTVSS |
| iPS:3 92696 | 21-225_20A4 | VH3|3-23|D6|6-19|RF2|JH3 | EVQLLES-GGGLVQPGGSLRLSCAASG-FTFS | S-------YAMT | WVRQAPGMGLEWVS | VISGS----GGYTYNADSVKG | RFTISRDNSKNTLYLQMNSLRVEDTAVYYCAS | RLAVAG-------SEAFDI | WGQGTMVTVSS |
| iPS:3 92702 | 21-225_17F7 | VH3|3-23|D6|6-19|RF2|JH3 | EVQLLES-GGGLVQPGGSLRLSCAASE-FTFS | S-------YAMN | WVRQAPGKGLEWVS | IISGR----GGNTFYADSVKG | RFTISRDNSKNTLYLQMNSLRAEDTAVYYCAS | RLAVAG-------SEAFDI | WGQGTMVTVSS |
| iPS:3 92704 | 21-225_17F11 | VH3|3-23|D6|6-19|RF2|JH3 | EAQLLES-GGGLVQPGGSLRLSCAASG-FTFS | S-------YAMS | WVRQAPGKGLEWVS | VISGR----GGNTFYADSVKG | RFTISRDNSKNTLYLQMNSLRAEDTAVYYCAS | RLAVAG-------SEAFDI | WGQGTMVTVSS |
| iPS:3 92720 | 21-225_17A12 | VH3|3-23|D6|6-19|RF2|JH3 | EVQLLES-GGGLVQPGGSLRLSCAASE-FTFS | S-------YAMN | WVRQDPGKGLEWVS | IISGR----GGNTFYADSVKG | RFTISRDNSKNTLYLQMNSLRAEDTAVYYCAS | RIAVAG-------SEAFDI | WGQGTMVTVSS |
| iPS:3 92722 | 21-225_18E12 | VH3|3-23|D6|6-19|RF2|JH3 | EVQLLES-GGGLVQPGGSLRLSCAASE-FTFS | S-------YAMN | WVRQAPGTGLEWVS | IISGR----GGNTFYADSVKG | RFTISRDNSKNTLYLQMNSLRAEDTAVYYCAS | RLAVAG-------SEAFDI | WGQGTMVTVSS |
| iPS:3 92760 | 21-225_22G3 | VH3|3-23|D6|6-19|RF2|JH3 | EVQLLES-GGGLVQPGGSLRLSCAASE-FTFS | S-------YAMS | WVRQAPGKGLEWVS | IISGR----GVNTFYADSVKG | RFTISRDNSKNTLYLQMNSLRAEDTAVYYCAS | RLAVAG-------SEAFDI | WGQGTMVTVSS |
| iPS:3 92764 | 21-225_22G10 | VH3|3-23|D6|6-19|RF2|JH3 | EVQLLES-GGGLVQPGGSLRLSCAASE-FTFS | S-------YAMN | WVRQAPGKGLEWVS | VISGS----GGNTFYADSVKG | RFTISRDNSKNTLFLHMNSLRAEDTAVYYCAS | RMAVAG-------SEAFDI | WGQGTMVTVSS |
| iPS:3 92812 | 21-225_21F4 | VH3|3-23|D6|6-19|RF2|JH3 | EVQLLES-GGGLVQPGGSLRLSCAASE-FTFS | S-------YAMN | WVRQAPGKGLEWVS | VISGR----GGNTFYADSVKG | RFTISRDNSKNTLYLQMNSLRAEDTAVYYCAS | RLAVAG-------SEACDI | WGQGTMVTVSS |
| iPS:3 92816 | 21-225_22E4 | VH3|3-23|D6|6-19|RF2|JH3 | EVQLLES-GGGLVQPGGSLRLSCAASE-FTFS | S-------YAMS | WVRQAPGKGLEWVS | IISGR----GTNTFYADSVKG | RFTISRVNSKNTLYLQMNSLRAEDTAVYYCAS | RIAVAG-------SEAFDI | WGQGTMVTVSS |
| iPS:3 92852 | 21-225_21A2 | VH3|3-23|D6|6-19|RF2|JH3 | EVQLLES-GGGLVQPGGSLRLSCAASK-FTFS | S-------YAMS | WVRQAPGKGLEWIS | IISGR----GGNTFYADSVKG | RFTISRDNSKNTLYLQMNSLRAEDTAVYYCAS | RLAVAG-------SEAFDI | WGQGTMVTVSS |

FIGURE 51 (Continued)

| | | | | | | | | | |
|---|---|---|---|---|---|---|---|---|---|
| iPS:3 92878 | 21-225_22C5 | VH3J3-23/D6J6-19/RF2/J H3 | EVQLLES-GGGLVQVGGSLRL SCAASG-FTFS | S------YAMS | WVRQAPGM GLEWVS | IISGS---GGYTYYADS VKG | RFTISRDNSKNTLYLQMNSL RAEDTAVYYCAS | RIAVAG-------SEAFDI | WGQGT MVTVS S |
| iPS:3 92902 | 21-225_22D5 | VH3J3-23/D6J6-19/RF2/J H3 | EVQLLES-GGGLVQPGGSLRL SCAASE-FTFS | S------YAMS | WVRQAPGK GLEWVS | VISGR---GGNTFYADS VKG | RFTISRDNSKNTLYLQMNSL RAEDTAVYYCAS | RLAVAG-------SEAFDI | WGQGT MVTVS S |
| iPS:3 93824 | 21-225_10F12 | VH3J3-23/D6J6-19/RF2/J H3 | EVQLLES-GGGLVQPGGSLRL SCAASG-FTFS | S------YAMS | WVRQAPGK GLEWVS | IISGR---GGYTYYADS VKG | RFTISRDNSKNTLYLQMNSL RAEDTAVYYCAS | RVAVAG-------SEAFDI | WGQGT MVTVS S |
| iPS:3 93848 | 21-225_4H2 | VH3J3-23/D6J6-19/RF2/J H3 | EVQLLES-GGGLVQPGGSLRL SCAASE-FTFS | G------YAMN | WVRQAPGK GLEWVS | VISRS---GGNTFYADS VKG | RFTISRDNSKNTLYLQMNSL RAEDTAVYYCAS | RLAVAG-------SEAFDI | WGQGT MVTVS S |
| iPS:3 93862 | 21-225_5G2 | VH3J3-23/D6J6-19/RF2/J H3 | EVQLLES-GGGLVQPGGSLRL SCAASE-FTFS | S------YAMS | WVRQAPGM GLEWVS | IISGR---GVNTFYADS VKG | RFTISRDNSKNTLYLQMNSL RAEDTAVYYCAS | RIAVAG-------SEAFDI | WGQGT MVTVS S |
| iPS:3 93888 | 21-225_3E3 | VH3J3-23/D6J6-19/RF2/J H3 | EVQLLES-GGTLVQPGGSLRL SCAASE-FTFS | S------YVMS | WVRQAPGK GLEWVS | IISGR---GGNTFYADS VKG | RFTISRDNSKNTLYLQMNSL RAEDTALYYCAS | RLAVAG-------SEAFDI | WGQGT MVTVS S |
| iPS:3 93898 | 21-225_5F7 | VH3J3-23/D6J6-19/RF2/J H3 | EVQLLES-GGGLVQPGGSLRL SCAASE-FTFS | S------YAMS | WVRQAPGK GLEWVS | IISGR---GGNTFYADS VKG | RFTISRDNSKNTLYLQMNSL RAEDTAVYYCAS | RIAVAG-------SEAFAI | WGQGT MVTVS S |
| iPS:3 93980 | 21-225_6D3 | VH3J3-23/D6J6-19/RF2/J H3 | EVQLLES-GGGLVQPGGSLRL SCAASE-FTFS | S------YAMN | WVRQAPGK GLEWVS | VISRS---GGNTFYADS VKG | RFTISRDNSKNTLYLQMNSL RAEDTAVYYCAS | RLAVAG-------SEAFDI | WGQGT MVTVS S |
| iPS:3 94014 | 21-225_8G6 | VH3J3-23/D6J6-19/RF2/J H3 | EVQLLES-GGGLVQPGGSLRL SCVASE-FTFS | S------YVMN | WVRQAPGK GLEWVS | VISGR---GGNTFYADS VKG | RFTISRDNSKNTLYLQMNSL RAEDTAVYYCAS | RLAVAG-------SEAFDI | WGQGT MVSVS S |
| iPS:3 94022 | 21-225_16H6 | VH3J3-23/D6J6-19/RF2/J H3 | EVQLLES-GGGLVQPGGSLRL SCAASE-FTFS | S------YAMN | WVRQAPGK GLEWVS | VISRS---GGYTFYADS VKG | RFTISRDNSKNTLYLQMNSL RAEDTAVYFCAS | RLAVAG-------SEAFDI | WGQGT MVTVS S |
| iPS:3 94043 | 21-225_3B1 | VH3J3-23/D6J6-19/RF2/J H3 | EVQLLES-GGGLVQPGGSLRL SCAASE-FTFS | S------YAMN | WVRQAPGK GLEWVS | VISGR---GINTFYADS VKG | RFTISRDNSKNTLYLQMNSL RAEDTAVYYCAS | RLAVAG-------SEAFDI | WGQGT MVTVS S |
| iPS:3 94077 | 21-225_8E12 | VH3J3-23/D6J6-19/RF2/J H3 | EVQLLES-GGGLVQPGGSLRL SCAASE-FTFS | S------YAMS | WVRQAPGK GLEWVS | IISGR---GGNTFYADS VKG | RFTISRDNSKNTLYLQMNSL RAEDTAVYYCAS | RMAVAG-------SEAFDI | WGQGT MVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 94087 | VH3-23/D6(6-19)/RF2/JH3 | EVQLLES-GGGLVQPGGSLRL SCAASE-FTFS | S------YAMS | WVRQAPGK GLEWIS | YISGR----GVNTYYADS VKG | RFTISRDNSKNTLYLQMNSL RAEDTAVYYCAS | RIAVAG----------SEAFDI | WGQGT MVTVS S |
| | VH3J3-11/D6(6-6)/RF2/JH3 Germline | | | | | | | H_FR4 |
| iPS:4 34011 | VH3-11/D6(6-6)/RF2/JH3 | QVQLVES-GGGLVQPGGSLRL SCAASG-FTFS | D------YFMT | WIRQAPGK GLEWVS | YISSA----GGATYYADS VKG | RFTISRDNAKNSLYLQMNSL RAEDTAVYYCAI | AVAAP-----------GVFDI | WGQGT MVTVS S |
| | VH3J3-11/D6(6-6)/RF2/JH4 Germline | | | | | | | H_FR4 |
| iPS:4 34015 | VH3-11/D6(6-6)/RF2/JH4 | QVQLVES-GGGLVQPGGSLRL SCAASG-FTFS | D------YFMT | WIRQAPGQ GLEWVS | YISSA----GGATYYADS VKG | RFTISRDNRAKNSLFLQMNSL RAEDTAVYYCAI | AVAAP-----------GAFDI | WGQGT LVTVS S |
| iPS:4 34017 | VH3-11/D6(6-6)/RF2/JH4 | QVQLVES-GGGLVQPGGSLRL SCAASG-FTFS | D------YFMT | WIRQAPGK GLEWVS | YISSA----GGATYYADS VKG | RFTISRDNAKNSLFLQMNSL RAEDTAVYYCAI | AVAAP-----------GAFDI | WGQGT LVTVS S |
| | VH3J3-23/D6(6-13)/RF2/JH4 | | | | | | | H_FR4 |
| iPS:4 34023 | VH3-23/D6(6-13)/RF2/JH4 | EVQLLES-GGGLVQPGGSLRL SCAASG-FTFS | S------YAMS | WVRQAPGK GLEWVS | VISGS----GGSTYYADS VKG | RFTISRDNSKSTLYLQMNSL RAEDTAVYYCAS | AIAAAG----------AHYFDY | WGQGT LVTVS S |
| iPS:4 36246 | 21-225_201G6 VH3-23/D6(6-13)/RF2/JH4 | EVQLLES-GGGLVQPGGSLRL SCAASG-FTFS | S------YAMS | WVRQAPGK GLEWVS | TISGS----GVRTYYADS VKG | RFTISRDNSKNTLFLQMNSL RAEDTAVYYCAK | GGARSSG---------WFHFDY | WGQGT LVTVS S |
| iPS:4 36254 | 21-225_202C12 VH3-23/D6(6-13)/RF2/JH4 | EVQLLES-GGGLVQPGGSLRL SCAASG-FTFS | S------YAMS | WVRQAPGK GLEWVS | TISGS----GVRTYYADS VKG | RFTISRDNSKNTLFLQMNSL RAEDTAVYYCAK | GGARSSG---------WFHFDY | WGQGT LVTVS S |
| iPS:4 36304 | 21-225_201F3 VH3-23/D6(6-13)/RF2/JH4 | EVQLLES-GGGLVQPGGSQRL SCAASG-FTFS | S------YAMS | WVRQAPGK GLEWVS | TISGS----GVRTYYADS VKG | RFTISRDNSKNTLFLQMNSL RAEDTAVYYCAK | GGARSSG---------WFHFDY | WGQGT LVTVS S |
| iPS:4 36334 | 21-225_208G3 VH3-23/D6(6-13)/RF2/JH4 | EVQLLES-GGGLVQPGGSLRL SCAASG-FTFS | S------YAMS | WVRQAPGK GLEWVS | TISGS----GVRTYYADS VKG | RSTISRDNSKNTLFLQMNSL RAEDTAVYYCAK | GGARSSG---------WFHFDY | WGQGT LVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3J3-23|D6|6-19|RF2|JH5 | | | | | | | | |
| iPS:4 34027 21-225_49H5 | VH3J3-23|D6|6-19|RF2|JH5 | EVQLLES-GGGLVQPGGSLRL SCAASG-FTFS | S-------YAMT | WVRQTPGK GLEWVS | AISGS----GGNSFYADS VKG | RFTISRDNSENTLYLQMNSL RAEDTAVYYCAK | ARAVAG-------SHWFDP | WGQGT LVTVS S |
| iPS:4 34061 21-225_51C7 | VH3J3-23|D6|6-19|RF2|JH5 | EVQLLES-GGGLVQPGGSLRL SCAASG-FTIS | N-------YAMT | WVRQTPGK GLEWVS | VISAS----GGNSFYADS VKG | RFTISRDNSENTFYLQMNSL RAEDTAVYYCAK | ARAVAG-------SHWFDP | WGQGT LVTVS S |
| iPS:4 34167 21-225_50F3 | VH3J3-23|D6|6-19|RF2|JH5 | EVQLLES-GGGLVQPGGSLRL SCAASG-FTFR | T-------YAMT | WVRQAPGK GLEWVS | AISGS----GVNSFYADS VKG | RFTISRDNSENTLYLQMNSL RAEDTAVYYCAK | ARAVAG-------SHWFDP | WGQGT LVTVS S |
| iPS:4 34455 21-225_72F5 | VH3J3-23|D6|6-19|RF2|JH5 | EVQLLES-GGGLVQPGGSLRL SCAASG-FTFS | S-------YAMI | WVRQAPGK GLEWVS | TISGS----GGYIYADS VKG | RFTISRDNSKNTLYLQMNSL RAEDTAVYYCAR | RIAVTG-------TEWYDP | WGQGT LVTVS S |
| iPS:4 37232 21-225_63E1 | VH3J3-23|D6|6-19|RF2|JH5 | EVQMLES-GGGLGQSGGSLRL SCTASG-FTFT | T-------SAMS | WVRQAPGK GLEWVS | AISGS----GANTFYADS VKG | RFTVSRDNSKNTLYLQMNSL TAEDTAVYYCVK | VIAVAG-------GHFFDP | WGQGT LVTVS S |
| | Germline | H_FR1 | H_CDR1 | H_FR2 | H_CDR2 | H_FR3 | H_CDR3 | H_FR4 |
| VH3J3-21|D1|1-1|RF2|JH4 | | | | | | | | |
| iPS:4 34043 21-225_50G10 | VH3J3-21|D1|1-1|RF2|JH4 | EVQLVES-GGGLVKPGGSLRL SCAASG-FTFS | S-------YSMN | WVRQAPGK GLEWVS | SISGS----SSYIYADS VKG | RFTISRDMAKNSLYLQMNSL RAEDTAVYYCAR | VAT----------FDY | WGQGT LVTVS S |
| iPS:4 34085 21-225_52E3 | VH3J3-21|D1|1-1|RF2|JH4 | EVQLVES-GGGLVKPGGSLRL SCAASG-FTFS | S-------YKMN | WVRQAPGK GLEWVS | SISGS----NSSIYYADS VKG | RFTISRDMAENSLYLQMNSL RAEDTAVYYCAR | VSS----------NDY | WGQGT LVTVS S |
| iPS:4 34101 21-225_52H12 | VH3J3-21|D1|1-1|RF2|JH4 | EVQLVES-GGGLVKPGGSLRL SCAASG-FTFS | S-------YSMN | WVRQAPGK GLEWVS | SISGS----STYIYYADS VKG | RFTISRDNAKNSLYLQMNSL RAEDTAVYYCAR | VNS----------FDY | WGQGT LVTVS S |
| iPS:4 34187 21-225_56A5 | VH3J3-21|D1|1-1|RF2|JH4 | EVQLVES-GGGLVKPGGSLRL SCAASG-FTFS | S-------YSMN | WVRQAPGK GLEWVS | SISGS----SSYIYADS VKG | RFTISRDNAKNSLYLQMNSL RAEDTAVYYCAR | VAT----------FDY | WGQGT LVTVS S |
| iPS:4 34265 21-225_57B2 | VH3J3-21|D1|1-1|RF2|JH4 | EVQLVES-GGGLVKPGGSLRL SCAASG-FTFS | S-------YSMN | WVRQAPGK GLEWVS | SISGS----SSINYTDS VKG | RFTISRDNAKNSLYLQMNSL RAEDTAVYYCAR | VAG----------FDY | WGQGT LVTVS S |

FIGURE 51 (Continued)

| | | | | | | | | | |
|---|---|---|---|---|---|---|---|---|---|
| iPS:4 34439 | 21-225_70E12 | VH3J3-21D1J1-1IRF2JH4 | EVQLVES-GGGLVKPGGSLRL SCAASG-FTFS | S------YSMN | WVRQAPGK GLEWVS | SISGN---- STYYTDS VKG | RFTISRDNAKNSLYLQMDSL TAEDTAVYYCAR | VAA------FDC | WGQGT LVTVS S |
| iPS:4 35515 | 21-225_157E4 | VH3J3-21D1J1-1IRF2JH4 | EVQLVES-GGGLVKPGGSLRL SCAASG-FTFS | S------YTMN | WVRQAPGK GLEWVS | SISGS---- SSIYYADS VKG | RFTISRDNAKNSLYLQMNSL RAEDTAVYYCAR | VAT------FDY | WGQGT LVTVS S |
| iPS:4 35535 | 21-225_157H10 | VH3J3-21D1J1-1IRF2JH4 | EVQLVES-GGGLVKPGGSLRL SCAASG-FTFS | S------YTMN | WVRQAPGK GLEWVS | SISGS---- SSINYYADS VKG | RFTISRDNAKNSLYLQMNSL RAEDTAVYYCAR | VAH------FDY | WGQGT LVTVS S |
| iPS:4 37224 | 21-225_56H1 | VH3J3-21D1J1-1IRF2JH4 | EVQLVES-GGGLVKPGGSLRL SCAASG-FTFS | N------YRMN | WVRQGFGK GLEWIS | SISGS---- STDIYYADS VKG | RFTISRDNAKNSLYLQMNSL RAEDTAVYYCAR | VAS------FDY | WGQGT LVTVS S |
| iPS:3 92620 | 21-225_17H5 | VH3J3-21D1J1-1IRF2JH4 | EVQLVES-GGGLVKPGGSLRL SCAASG-FTFS | S------YSMN | WVRQAPGK GLEWVS | SISGS---- STYIYYADS VKG | RFTISRDNAKNSLYLQMNSL RAEDTAVYYCAR | VAS------FDY | WGQGT LVTVS S |
| iPS:3 92632 | 21-225_16A11 | VH3J3-21D1J1-1IRF2JH4 | EVQLVES-GGGLVKPGGSLRL SCAASG-FTFS | S------YSMN | WVRQAPGK GLEWVS | SISGS---- SSLIYYADS VKG | RFTISRDNAKNSLYLQMNSL RAEDTAVYYCAR | VAA------FDY | WGQGT LVTVS S |
| iPS:3 92746 | 21-225_20H7 | VH3J3-21D1J1-1IRF2JH4 | EVHLVES-GGGLVKPGGSLRL SCAASG-FTFS | S------YSMN | WVRQAPGK GLEWVS | SISGS---- SSFIYYADS VKG | RFTISRDNAKNSLYLQMNSL RAEDTAVYYCAR | VAA------LDY | WGQGT LVTVS S |
| iPS:3 92782 | 21-225_22B12 | VH3J3-21D1J1-1IRF2JH4 | EVQLVES-GGGLVKPGGSLRL SCAASG-FTFS | S------YSMN | WVRQAPGK GLEWVS | SISGS---- SSYYYADS VKG | RFTISRDNAKNSLYLQMNSL RAEDTAVYYCAR | VAA------LDS | WGQGT LVTVS S |
| iPS:3 92916 | 21-225_27C5 | VH3J3-21D1J1-1IRF2JH4 | EVQLVES-GGGLVKPGGSLRL SCAASG-FTFS | S------YSMN | WVRQAPGK GLEWVS | STSGS---- DSYYYADS VKG | RFTISRDNAKNSLYLQMNSL RAEDTAVYYCAR | VAS------FDC | WGQGT LVTVS S |
| iPS:3 92976 | 21-225_27H12 | VH3J3-21D1J1-1IRF2JH4 | EVQLVES-GGGLVKPGGSLRL SCAASG-FTFS | S------YSLN | WVRQAPGK GLEWVS | SISGS---- SSNIYYTDS VKG | RFTISRDNAKNSLYLQMNSL RAEDTAVYYCAR | VAA------FDY | WGQGT LVTVS S |
| iPS:3 93120 | 21-225_35H8 | VH3J3-21D1J1-1IRF2JH4 | EVQLVES-GGGLVKPGGSLRL SCAASG-FTFS | S------YSMN | WVRQAPGK GLEWVS | SISGT---- GSFIYYADS VKG | RFTISRDNAKKSVYLQMNSL RAEDTAVYYCAR | VSG------FDY | WGQGT LVTVS S |
| iPS:3 93836 | 21-225_15A2 | VH3J3-21D1J1-1IRF2JH4 | EVQLVES-GGGLVKPGGSLRL SCAASG-FTFS | S------YTMN | WVRQAPGK GLEWVS | SISGS---- GSYIYYADS VKG | RFTISRDNAKNSLYLQMNAL RAEDTAVYYCAR | VAS------FDY | WGQGT LVTVS S |

FIGURE 51 (Continued)

| | | | | | | | | |
|---|---|---|---|---|---|---|---|---|
| iPS:3 93894 | 21-225_5E11 | VH3/3-21/D1/1-1/RF2/JH4 | EVQLVES-GGGLVKPGGSLRL SCAASG-FTFS | S------YSMN | WVRQAPGK GLEWVS | SISGS---- STYIYYADS VKG | RFTISRDNAKNSLYLQMNSL RAEDTAVYYCAR | VAS------ | -----FDY | WGQGT LVTVS S |
| iPS:3 93896 | 21-225_2A4 | VH3/3-21/D1/1-1/RF2/JH4 | EVQLVES-GGGLVKPGGSLRL SCAASG-FTFS | S------YSMN | WVRQAPGK GLEWVS | SISGS---- STYIYYADS VKG | RFAISRDNAKNSLYLQMNSL PAEDTAVYYCAR | VAS------ | -----FDY | WGQGT LVTVS S |
| iPS:3 93914 | 21-225_16B8 | VH3/3-21/D1/1-1/RF2/JH4 | EVQLVES-GGGLVKPGGSLRL SCAASG-FTFS | S------YSMN | WVRQAPGK GLEWIS | SISGS---- STYIYYADS VKG | RFTISRDNAKNSLYLQMNSL RAEDTAVYYCAR | VAS------ | -----FDY | WGQGT LVTVS S |
| iPS:3 93944 | 21-225_14D6 | VH3/3-21/D1/1-1/RF2/JH4 | EVQLVES-GGGLVKPGGSLRL SCAASG-FTFS | S------YFMN | WVRQAPGK GLEWVS | SISGS---- GSYIYYADS VKG | RFTMSRDNAKNSLYLQMNSL RAEDTAVYYCAR | VAA------ | -----FDS | WGQGT LVTVS S |
| iPS:3 93952 | 21-225_1F1 | VH3/3-21/D1/1-1/RF2/JH4 | EVQLVES-GGGLVKPGGSLRL SCAASG-FTFS | S------YRMN | WVRQAPGK GLEWVS | SISGS---- SSYIYYADS VKG | RFTISRDNAKNSLYLQMNSL RAEDTAVYYCAR | VNL------ | -----FDY | WGQGT LVTVS S |
| iPS:3 94033 | 21-225_5F4 | VH3/3-21/D1/1-1/RF2/JH4 | EVQLVES-GGGLVKPGGSLRL SCAASG-FTFS | S------YSMN | WVRQAPGK GLEWVS | SISGS---- SSYIYYADS VKG | RFTISRDNAKNSLFLQMNSL RAEDTAVYYCAR | VNN------ | -----FDY | WGQGT LVTVS S |
| iPS:3 94069 | 21-225_16H1 | VH3/3-21/D1/1-1/RF2/JH4 | EVQLVES-GGGLVKPGGSLRL SCAASG-FTFS | S------YSMN | WVRQAPGK GLEWVS | SISGS---- STYIYYADS VKG | RFTISRDNAKNSLYLQMNSL RAEDTAVYYCAR | VAA------ | -----FDY | WGQGT LVTVS S |
| iPS:3 98482 | 21-225_17H6 | VH3/3-21/D1/1-1/RF2/JH4 | EVQLVES-GGGLVKPGGSLRL SCAASG-FTFS | S------YSMN | WVRQAPGK GLEWVS | SISGS---- SSYIYYADS VKG | RFTIFRDNAKNSLYLQMNSL RAEDTAVYYCAR | VAS------ | -----FDY | WGQGT LVTVS S |
| iPS:3 98492 | 21-225_21F12 | VH3/3-21/D1/1-1/RF2/JH4 | EVQLVES-GGGLVKPGGSLRL SCAASG-FTFS | S------YRMN | WVRQAPGK GLEWVS | SISNSY--- SSYIYYADS VKG | RFTISRDNAKNSLYLQMNSL RAEDTAVYYCAR | VAS------ | -----FDY | WGQGT LVTVS S |
| iPS:3 98500 | 21-225_23A11 | VH3/3-21/D1/1-1/RF2/JH4 | EVQLVES-GGGLVKPGGSLRL SCAASG-FTFS | S------YSMN | WIRQAPGK GLEWVS | SISGS---- STYIYYADS VKG | RIAISRDNAKNSLYLQMNSL PAEDTAVYYCAR | VAS------ | -----FDY | WGQGT LVTVS S |
| iPS:3 98526 | 21-225_32B3 | VH3/3-21/D1/1-1/RF2/JH4 | EVQLVES-GGGLVKPGGSLRL SCAASG-FTFS | S------YSMN | WVRQAPGK GLEWVS | SISGS---- STYIYYADS VKG | RFTISRDNAKNSLYLQMNSL PAEDTAVYYCAR | VAG------ | -----FDY | WGQGT LVTVS S |
| iPS:4 02221 | 21-225_2C12 | VH3/3-21/D1/1-1/RF2/JH4 | EVQLVES-GGGLVKPGGSLRL SCAASG-FTFS | S------YSMN | WVRQAPGK GLEWVS | SISGS---- SSYMYYADS VKG | RFTISRDNAKDSLYLQMNSL RAEDTAVYYCAR | VNL------ | -----FDY | WGQGT LVTVS S |

FIGURE 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| | VH1-02|D2|2-15|RF2|JH6 | | QVQLVQS-GAEVKKPGASVKVSCKASG-YTFT | | WVRQAPGQ GLEWMG | WMNPN----SGGTNSAQK FQG | RVTMTRDTSISTVYMELSRL RSDDTAVYYCAR | GGQLGGFN-------YYYGMDV | WGQGT TVTVS S |
| iPS.4 34047 | 21-225_50A12 | VH1|1-02|D2|2-15|RF2|JH6 | QVQLVQS-GAEVKKPGASVKVSCKASG-YTFT | G-----HYIN | WVRQAPGQ GPEWMA | WMNPN----SGGTNSAQK FQG | RVTMTRDTSISTVYMELSRL RSDDTAVYYCAR | GGQLGGFN-------YYYGMDV | WGQGT TVTVS S |
| iPS.4 34067 | 21-225_51H8 | VH1|1-02|D2|2-15|RF2|JH6 | QVQLVQS-GAEVKKPGASVKVSCKASG-YTFT | G-----HYMN | WVRQAPGQ GLEWMG | WMNPN----SGGSNSAQQ FQG | RVTMTRDTSISTVYMELSRL SSDDTAVYYCAR | GGQLGGFN-------FYYYGMDV | WGQGT TVTVS S |
| iPS.4 34197 | 21-225_56C7 | VH1|1-02|D2|2-15|RF2|JH6 | QVQLVQS-GAEVKKPGASVKVSCKASG-YTFT | G-----HYIN | WVRQAPGQ GLEWMA | WMNPN----SGGTNSAQK FQG | RVTMTRDTSISTVYMELSRL RSDDTAVYYCAR | GGQLGGFN-------YYYGMDV | WGQGT TVTVS S |
| | | Germline | H_FR1 | H_CDR1 | H_FR2 | H_CDR2 | H_FR3 | H_CDR3 | H_FR4 |
| | VH3-21|D2|2-15|RF3|JH6 | | EVQLVES-GGGLVQPGGSLRLSCAASG-FTFS | | WVRQAPGK GLEWVS | SISSS----SNYIYADS VKG | RFTISRDYAKNSLYLQMNSL RAEDTAVYYCAR | DRSIVVAGP-------WGYYGMDV | WGQGT TVTVS S |
| iPS.4 34049 | 21-225_50B12 | VH3|3-21|D2|2-15|RF3|JH6 | EVQLVES-GGGLVQPGGSLRLSCAASG-FTFR | S-----HSMN | WVRQAPGK GLEWVS | SISSS----SNYIYADS VKG | RFTISRDYAKNSLYLQMNSL RAEDTAVYYCAR | DRSIVVAGP-------WGYYGMDV | WGQGT TVTVS S |
| | | Germline | H_FR1 | H_CDR1 | H_FR2 | H_CDR2 | H_FR3 | H_CDR3 | H_FR4 |
| | VH3-23|D1|1-20|RF1|JH3 | | EVQLLES-GGGLVQPGGSLSLSCAASG-FTFS | | WVRQAPGK GLEWVS | AISGR----GSNTFYTDS VKG | RFTISRDNSKNTLYLQMNSL RAEDTAVYYCAR | GITGSH-------GAFDI | WGQGT MVTVS S |
| iPS.4 34055 | 21-225_51B4 | VH3|3-23|D1|1-20|RF1|JH3 | EVQLLES-GGGLVQPGGSLSLSCAASG-FTFS | S-----YVMS | WVRQAPGK GLEWVS | AISGR----GSNTFYTDS VKG | RFTISRDNSKNTLYLQMNSL RAEDTAVYYCAR | GITGSH-------GAFDI | WGQGT MVTVS S |
| | | Germline | H_FR1 | H_CDR1 | H_FR2 | H_CDR2 | H_FR3 | H_CDR3 | H_FR4 |
| | VH3-23|D7|7-27|RF1|JH4 | | EVQLLES-GGGLVQPGGSLRLSCAASG-FTFS | | WVRQAPGK GLEWVS | | RFTVSRDNSKNTLYLQMSSL RAEDTAVYYCAR | | WGQGT LVTVS S |
| iPS.4 34059 | 21-225_51C5 | VH3|3-23|D7|7-27|RF1|JH4 | EVQLLES-GGGLVQPGGSLRLSCAASG-FTFS | S-----YVMS | WVRQTPGK GLEWVS | IMSGS----GGRTYYADS VNG | RFTVSRDNSKNTLYLQMSSL RAEDTAVYYCAR | VTA-------FDY | WGQGT LVTVS S |
| iPS.4 34213 | 21-225_60A4 | VH3|3-23|D7|7-27|RF1|JH4 | EVQLLES-GGGLVQPGGSLRLSCAASG-FTFS | S-----YVMS | WVRQAPGK GLEWVS | SISGS----GGWTNYADS VKG | RFTISRDNSKNTLYLQMNSL RAEDTAVYYCAR | LTG-------FDY | WGQGT LVTVS S |
| iPS.4 34215 | 21-225_60F7 | VH3|3-23|D7|7-27|RF1|JH4 | EVQLLES-GGGLVQPGGSLRLSCAASG-FTFS | S-----YVMS | WVRQAPGK GLEWVS | GISGS----GNRTYYADS VKG | RFTISRDNSKNTLYLQMNSL RAEDSAVYYCGS | LG-------IE | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 34241 | 21-225_61E6 | VH3|3-23|D7|7-27|RF1|JH4 | EVQLLES-GGGLVQPGGSLRL SCAASG-FTFR | S------YAMS | WVRQAPGK GLEWVS | AISGS----GVNTFYADS VKG | RFTISRDNSKNTLYLQMNSL RAEDTAVYYCAK | LELG------IFDY | WGQGT LVTVS S |
| iPS:4 34281 | 21-225_57B8 | VH3|3-23|D7|7-27|RF1|JH4 | EVQLLES-GGGLVQPGGSLRL SCAASG-FTFR | S------YAMS | WVRQAPGK GLEWVS | AISGS----GVNTFYADS VKG | RFTISRDNSKNTLYLQMNSL RAEDTAVYYCAK | LELG------IFDY | WGQGT LVTVS S |
| iPS:4 34301 | 21-225_58F11 | VH3|3-23|D7|7-27|RF1|JH4 | EVQLLES-GGGLVQPGGSLRL SCAASG-FTFS | S------YAMS | WVRQAPGK GLEWVS | AISGS----GGNTFYADS VKG | RFTISRYNSKNTLYLQMNSL RAEDTAVYYCAK | FFGMVG----AGFFDY | WGQGT LVTVS S |
| iPS:4 35523 | 21-225_157G5 | VH3|3-23|D7|7-27|RF1|JH4 | EVQLLES-GGGLVQPGGSLRL SCAASG-FTFS | S------YVMS | WVQAFGK GLDWVS | AMSGS----GGRTYYADS VKG | RFTISRDNSKNTLYLQMNSL RAEDTAVYYCAK | YTW-------NGY | WGQGT LVTVS S |
| 21-35659 225_167D12 | | VH3|3-23|D7|7-27|RF1|JH4 | EVQLLES-GGGLVQPGGSLRL SCAASG-FTFS | S------YVMS | WVRQAPGK GLEWVS | AMSGS----GGRTYYADS VKG | RFTISRDNSKNTLYLQMNSL RAEDTAVYYCAK | YTW-------NGY | WGQGT LVTVS S |
| iPS:4 35765 | 21-225_177D3 | VH3|3-23|D7|7-27|RF1|JH4 | EVQLLES-GGGLVQPGGSLRL SCAASG-FTFS | S------YVMN | WVRQAPGK GLEWVS | GMSGS----GGRTYYADS VKD | RFTISRDNSKNTLSLQMNSL RAEDTAVYYCAR | VTF-------FDY | WGQGT LVTVS S |
| iPS:4 37216 | 21-225_51D5 | VH3|3-23|D7|7-27|RF1|JH4 | EVQLLES-GGGLVQPGGSLRL SCAASG-FTFS | S------YVMS | WVRQTPGK GLEWVS | TMSGS----GGRTYYADS VNG | RFTVSRDNSKNTLYLQMSSL RAEDTAVYYCAK | VTA-------FDY | WGQGT LVTVS S |
| | Germline | | H_FR1 | H_CDR1 | H_FR2 | H_CDR2 | H_FR3 | H_CDR3 | H_FR4 |
| VH3|3-21|D5|5-24|RF2|JH4 | | EVQLVES-GGGLVQPGGSLRL SCAASG-FTFS | | | | | | IFDY | |
| iPS:4 34063 | 21-225_51G7 | VH3|3-21|D5|5-24|RF2|JH4 | EVQLVES-GGGLVQPGGSLRL SCAASG-FTFS | S------YSMN | WVRQAPGK GLEWVS | SISSS----SSYIYYADS VKG | RFTISRDNAKNSLYLQMNSL RAEDTAVYYCAR | ARL-------DY | WGQGT LVTVS S |
| | Germline | | H_FR1 | H_CDR1 | H_FR2 | H_CDR2 | H_FR3 | H_CDR3 | H_FR4 |
| VH3|3-23|D7|7-27|RF3|JH4 | | EVQLLES-GGGLVQPGGSLRL SCAASG-FTFS | | | | | | FDY | |
| iPS:4 34083 | 21-225_52H2 | VH3|3-23|D7|7-27|RF3|JH4 | EVQLLES-GGGLVQPGGSLRL SCAASG-FTFS | R------NAMS | WVRQAPGM GLEWVS | AISGR----GGNTFYADS VKG | RFTVSRDNSKNTLFLQMNSL RAEDTAVYYCAK | NGREQ-----WLDY | WGQGT LVTVS S |
| VH3|3-30.3|D6|6-61|RF2|JH6 | | | H_FR1 | H_CDR1 | H_FR2 | H_CDR2 | H_FR3 | H_CDR3 | H_FR4 |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 34087 | 21-225_52F6 | VH3/3-30.3/D6/6-6/RF2/JH6 | QVQLVES-GGGVVQPGRSLRL SCAASG-FTFS | S------YGMH | WVRQAPGK GLEWVA | IISYG----GSNKYYADS VKG | RFTISRDNSKNTLYLQMNSL RAEDTAVYYCAR | RSAARP----------GYGMDV | WGQGT TVTVS S |
| iPS:4 34111 | 21-225_53H2 | VH3/3-30.3/D6/6-6/RF2/JH6 | QVQLVES-GGGVVQPGRSLRL SCAASG-FTFS | S------YGMH | WVRQAPGK GPEWVA | VISYG----GSNKYHADS VKG | RFTISRDNSKNTLYLQMNSL RAEDTAVYYCAR | RGAARP----------GYGMDV | WGQGT TVTVS S |
| iPS:4 34121 | 21-225_53F6 | VH3/3-30.3/D6/6-6/RF2/JH6 | QVQLVES-GGGVVQPGRSLRL SCAASG-FTFS | S------YGMH | WVRQAPGK GLEWVA | VISYG----GSNKYDADS VKG | RFTISRDNSKNTLYLQMTSL RAEDTAVYYCAR | RRAARP----------GYGMDV | WGQGT TVTVS S |
| iPS:4 34163 | 21-225_50H1 | VH3/3-30.3/D6/6-6/RF2/JH6 | QVQLVES-GGGVVQPGRSLRL SCAASG-FTFS | S------YGMH | WVRQAPGK GLEWVS | IISYG----GSNKYYADS VKG | RFTISRDNSKNTLYLQMTSL RAEDTAVYYCAR | RRAARP----------GYGMDV | WGQGT TVTVS S |
| iPS:3 94035 | 21-225_5G9 | VH3/3-30.3/D6/6-6/RF2/JH6 | QVQLVES-GGGVVQPGRSLRL SCAASG-FTFS | N------YGMH | WVRQAPGK GLEWVA | IISYA----GSNKYYADS VKG | RFTISRDNSKNTLYLQMNSL RAEDTAVYYCVR | RITARL----------YYGMDV | WGQGI TVTVS S |
| | Germline | | H_FR1 | H_CDR1 | H_FR2 | H_CDR2 | H_FR3 | H_CDR3 | H_FR4 |
| | VH3/3-33/D2/2-8/RF1/JH4 | | | | | | | | |
| iPS:4 34095 | 21-225_52F10 | VH3/3-33/D2/2-8/RF1/JH4 | QVQLVES-GGGVVQPGRSLRL SCAASG-FTFS | F------YGMH | WVRQAPGK GLEWVA | VIWDD----GSNKYADS VKG | RFTISRDNSKNTLFLQMNSL RAEDTAVYYCAR | DSLYSS----------SWLFDY | WGQGT LVTVS S |
| | Germline | | H_FR1 | H_CDR1 | H_FR2 | H_CDR2 | H_FR3 | H_CDR3 | H_FR4 |
| | VH3/3-23/D4/4-23/RF3/JH4 | | | | | | | | |
| iPS:4 34107 | 21-225_53E2 | VH3/3-23/D4/4-23/RF3/JH4 | EVQLLES-GGGLIQPGGSLRL SCAASG-FTFR | S------YAMS | WVRQAPGK GLEWVS | AISGS----GGNTFYADS VKG | RFTISRDNSKNTLYLQMNTL RADDTAVYYCAR | KVVDTA----------MALDY | WGQGT LVTVS S |
| iPS:4 34181 | 21-225_56B2 | VH3/3-23/D4/4-23/RF3/JH4 | EVQLLES-GGGLIQPGGSLRL SCAASG-FTFR | S------YAMS | WVRQAPGK GLEWVS | AISGS----GGNTFYADS VKG | RFTISRDNSKNTLYLQMNTL RADDTAVYYCAR | KVVDTA----------MALDY | WGQGT LVTVS S |
| | Germline | | H_FR1 | H_CDR1 | H_FR2 | H_CDR2 | H_FR3 | H_CDR3 | H_FR4 |
| | VH3/3-23/D1/1-26/RF1/JH3 | | | | | | | | |
| iPS:4 34117 | 21-225_53C6 | VH3/3-23/D1/1-26/RF1/JH3 | EVQLLES-GGGLVQPGGSLRL SCAASG-FTFS | S------YAMN | WVRQAPGK GLEWVS | AISGS----GGRTYYADS VKG | RFTISRDNSKNTLYLQMNSL RAEDTAVYYCAR | PLVGAH----------DAFEI | WGQGT MVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 92984 | 21-225_30E11 | VH3|3-23|D1|1-26|RF1/JH3 | EVQLLES-GGDMVQPGGSLRLSCAASG-FTFS | I------YAMS | WVRQAPGK GLEWVS | VISGS----GGSSFYADS VKG | RFTISRDNSKNTLYLQMNSL RAEDTAVYYCTK | DRVKAH-------DGFDI | WGQGT MVTVS S |
| iPS:3 93114 | 21-225_33G12 | VH3|3-23|D1|1-26|RF1/JH3 | EVQLLES-GGDMVQPGGSLRLSCAASG-FTFS | S------YAMS | WVRQAPGK GLEWVS | VISGS----GGSSFYADS VKG | RFTISRDNSKNTLYLQMNSL RAEDTAVYYCAK | DRVRAH-------DGFDI | WGQGT MVTVS S |
| VH3|3-33|D5|5-24|RF2/JH4 Germline | | | | | | | | | H_FR4 |
| iPS:4 34127 | 21-225_53H8 | VH3|3-33|D5|5-24|RF2/JH4 | QVQLVES-GGGLVQPGRSLRLSCAASG-FTFS | S------YGMH | WVRQAPGK GLEWVA | VIWYD----GSNKFYADS VKG | RFTISRDNSKNTLYLQMNSL RAEDTAVYYCAR | ARIG---------YFDS | WGQGT LVTVS S |
| | | H_FR1 | | H_CDR1 | H_FR2 | H_CDR2 | H_FR3 | H_CDR3 | H_FR4 |
| VH3|3-23|D4|4-17|RF2/JH4 Germline | | | | | | | | | |
| iPS:4 34147 | 21-225_55E1 | VH3|3-23|D4|4-17|RF2/JH4 | EVQLLES-GGGLVQPGGSLRLSCAASG-FTFS | S------YAMS | WVRQAPGK GLEWVS | AISGR----GGSTFYADS VKG | RFTISRDNSKNTLYLQMNSL RAEDTAVFYCAK | DHGIVG-------TIYFDY | WGQGT LVTVS S |
| iPS:4 35303 | 21-225_146A6 | VH3|3-23|D4|4-17|RF2/JH4 | EVQLLES-GGGLVQPGGSLRLSCAASG-FTFN | S------YAMN | WVRQAPGK GLEWVS | AISGS----GGNTFYADS VKG | RFTISRDNSKNTLYLQMNSL RAEDTAVYYCAK | KDNDYVW-------GSPYFDY | WGQGT LVTVS S |
| iPS:4 35335 | 21-225_147D10 | VH3|3-23|D4|4-17|RF2/JH4 | EVQLLES-GGGLVQPGGSLRLSCAASG-FTFS | S------YAMS | WVRQAPGK GLEWVS | AISGR----GGNTFYADS VKG | RFTISRDNSKNTLYLQMNSL RAEDTAVYYCAK | KDYDYVW-------GSPYFDY | WGQGT LVTVS S |
| iPS:4 35339 | 21-225_147D12 | VH3|3-23|D4|4-17|RF2/JH4 | EVQLLES-GGGLVQPGGSLRLSCAASG-FTFS | S------YAMS | WVRQAPGK GLEWVS | AISGR----GGNTFYADS VKG | RFTISRDNSKNTLYLQMNSL RAEDTAVYYCAK | KDYDYVW-------GSPYFDY | WGQGT LVTVS S |
| iPS:4 35343 | 21-225_148E2 | VH3|3-23|D4|4-17|RF2/JH4 | EVQLLES-GGGLVQPGGSLRLSCAASG-FTFS | S------YAMS | WVRQAPGK GLEWVS | AISGR----GGNTFYADS VKG | RFTISRDNSKNTLYLHMNSL RAEDTAVYYCAK | KDYDYVW-------GSPYFDY | WGQGT LVTVS S |
| iPS:4 35381 | 21-225_149C6 | VH3|3-23|D4|4-17|RF2/JH4 | EVQLLES-GGGLVQPGGSLRLSCAASG-FTFS | S------YAMS | WVRQAPGK GLEWVS | AISGR----GGNTFYADS VKG | RFTISRDNSKNTLYLQMNSL RAEDTAVYYCAK | KDYDYVW-------GSPYFDY | WGQGT LVTVS S |
| iPS:4 35391 | 21-225_149F8 | VH3|3-23|D4|4-17|RF2/JH4 | EVQLLES-GGGLVQPGGSLRLSCAASG-FTFS | S------YAMS | WVRQAPGK GLEWVS | AISGR----GGNTFYADS VKG | RFTISRDNSKNTLYLQMNSL RAEDTAVYYCAK | KDYDYVW-------GSPYFDY | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35395 | 21-225_149D11 | VH3/3-23/D4/4-17/RF2/JH4 | EVQLLES-GGGLVQPGGSLRLSCAASG-FTFS | S------YAMS | WVRQAPGK GLEWVS | AISGR----GGNTFYADS VKG | RFTISRDNSKNTLYLQMNSL RAEDTAVYYCAK | KDYDYVW------GSPYFDY | WGQGT LVTVS S |
| iPS:4 35403 | 21-225_150C5 | VH3/3-23/D4/4-17/RF2/JH4 | EVQLLES-GGGLVQPGGSLRLSCAASG-FTFS | S------YAMS | WVRQAPGK GLEWVS | AISGS----GGNTFYADS VKG | RFTISRDNSKNTLYLQMNSL RAEDTAVYYCAK | KDYDYVW------GSPYFDY | WGQGT LVTVS S |
| iPS:4 35447 | 21-225_152H7 | VH3/3-23/D4/4-17/RF2/JH4 | EVQLLES-GGGLVQPGGSLRLSCAASG-FTFN | S------YAMN | WVRQAPGK GLEWVS | AISGS----GGNTFYADS VKG | RFTISRDNSKNTLYLQMNSL RAEDTAVYYCAK | KDNDYVW------GSPYFDY | WGQGT LVTVS S |
| iPS:4 35453 | 21-225_152G10 | VH3/3-23/D4/4-17/RF2/JH4 | EVQLLES-GGGLVQPGGSLRLSCAASG-FTFS | S------YAMS | WVRQAPGK GLEWVS | AISGR----GGNTFYADS VKG | RFTISRDNSKNTLYLQMNSL RAEDTAVYYCAK | KDYDYVW------GSPYFDY | WGQGT LVTVS S |
| iPS:4 35483 | 21-225_155A4 | VH3/3-23/D4/4-17/RF2/JH4 | EVQLLES-GGGLVQPGGSLRLSCAASG-FTFS | S------YAMS | WVRQAPGK GLEWVS | AISGS----GGNTFYADS VKG | RFTISRDNSKNTLYLQMNSL RAEDTAVYYCAK | KDYDYVW------GSPYFDY | WGQGT LVTVS S |
| iPS:4 35485 | 21-225_155B4 | VH3/3-23/D4/4-17/RF2/JH4 | EVQLLES-GGGLVQPGGSLRLSCAASG-FTFS | S------YAMS | WVRQAPGK GLEWVS | AISGS----GGNTFYADS VKG | RFTISRDNSKNTLYLQMNSL RAEDTAVYYCAK | KDYDYVW------GSPYFDY | WGQGT LVTVS S |
| iPS:4 35777 | 21-225_178F7 | VH3/3-23/D4/4-17/RF2/JH4 | EVHLLES-GGGLVQPGGSLRLSCAASG-FTFS | S------YAMT | WVRQAPGK GLEWVS | VISGS----GGNTFYADS VKG | RFTISRDNSKNTLYLQMNSL RAEDTAVYYCAK | RYGD---------YFDY | WGQGT LVTVS S |
| iPS:4 35783 | 21-225_179G1 | VH3/3-23/D4/4-17/RF2/JH4 | EVQLLES-GGGLVQTGGSLRLSCAASG-FTFS | S------YAMT | WVRQAPGK GLEWVS | VISGF----GGNTFYADS VKG | RFTISRDNSKNTLYLQMNSL PAEDTAVYYCAK | RYGD---------YFDY | WGQGT LVTVS S |
| iPS:4 35833 | 21-225_190D12 | VH3/3-23/D4/4-17/RF2/JH4 | EVQLLES-GGGLVQPGGSLRLSCAASG-FTFS | S------YAMS | WVRQAPGK GLEWDS | AIIGN----GGRTFYADS VKG | RFTISRDNSKNTLYLQMNSL RAEDTAVYYCAK | DMGRIS------YGPFDY | WGQGT LVTVS S |
| iPS:4 36156 | 21-225_197C8 | VH3/3-23/D4/4-17/RF2/JH4 | EVQLLES-GGGLVQPGGSLRLSCAASG-FTFS | S------SAMT | WVRQAPGK GLEWDS | AIIGN----GGRAYYADS VKG | RFTISRDNSKNTLYLQMNSL RIEDTALYYCAK | DRGYSRIA-----VAGTFDY | WGQGT LVTVS S |
| | Germline | | H_FR1 | H_CDR1 | H_FR2 | H_CDR2 | H_FR3 | H_CDR3 | H_FR4 |
| VH3/3-23/D4/4-17/RF1/JH4 | | | | | | | | | |
| iPS:4 34157 | 21-225_55D4 | VH3/3-21/D1/1-1/RF1/JH4 | EVQLVES-GGGLVKPGGSLRLSCAASG-FTFN | S------YRMN | WVRQAPGK GLEWVS | SISSS----SNHIDYADS VKG | RFTISRDNAKNSLILQMNSL RAEDTALYYCAK | GT-----------DY | WGQGT LVSVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 34243 | 21-225_62C1 | VH3J3-21|D1|1-1|RF1/JH4 | EVQLVES-GGGLVKPGGSLRL SCAASG-FTFS | S------YSMN | WVRQAPGK GLEWVS | SISSS---SSYIYYADS VKG | RFTISRDNAKNSLYLQMNSL RAEDTAVYYCAI | FG------VD | WGQGT LVTVS S |
| iPS:4 35505 | 21-225_157C1 | VH3J3-21|D1|1-1|RF1/JH4 | EVQLVES-GGGLVKPGGSLRL SCAASG-FTFS | S------YRMN | WVRQAPGK GLEWVS | SMSNS---SSSIYYADS VKG | RFTISRDNAKNSLYLQMNSL RAEDTAVYYCAR | QAA------QDY | WGQGT LVTVS S |
| iPS:3 92966 | 21-225_32G3 | VH3J3-21|D1|1-1|RF1/JH4 | EVQLVES-GGGLVKPGGSLRL SCAASG-FTFS | S------YSMN | WVRQAPGK GLEWVS | SISGS---SSYIYYADS VKG | RFTISRDNAKNSLYLQINSL RAEDTAVYYCAR | GNIA------RDY | WGQGT LVTVS S |
| Germline VH3J3-33|D7|7-27|RF3|JH4 | | | | | | | | |
| iPS:4 34159 | 21-225_55B8 | VH3J3-33|D7|7-27|RF3|JH4 | QVQLVES-GGGVVQPGRSLRL SCAASG-FTFS | D------YGMH | WVRQAPGK GLEWVA | VIWHD---EMNKYYADS VKG | RFTISRDNSKNTLYLQMNSL RAEDTAVYYCTR | EMF------DY | WGQGT LVTVS S |
| iPS:3 93026 | 21-225_32B6 | VH3J3-33|D7|7-27|RF3|JH4 | QVQLVES-GGGVVQPGRSLRL SCAASG-FTFS | D------YGMH | WVRQAPGK GLEWVA | VIWYD---ENTKYYADS VKG | RFTISRDNSKNTLYLQMNSL RAEDTAVYYCAR | EWG------DY | WGQGT LVTVS S |
| Germline VH3J3-33|D6|6-6|RF3|JH4 | | | | | | | | |
| iPS:4 34165 | 21-225_50F2 | VH3J3-33|D6|6-6|RF3|JH4 | QVQLVES-GGGLVQPGRSLRL SCAASG-FTFS | S------YGMH | WVRQTPGK GLEWVA | VIWHD---GSNKYYADS VKG | RFTISRDNSKNTLYLQMNSL RAEDTAVYYCAR | DEQLG------TFDY | WGQGT LVTVS S |
| iPS:4 34191 | 21-225_56B6 | VH3J3-33|D6|6-6|RF3|JH4 | QVQLVES-GGGVVQPGRSLRL SCAASG-FTFS | S------YGMH | WVRQAPGK GLEWVA | VIWYD---GSNKYYVDS VKG | RFTISRDNSKNTLYLQMNSL RAEDTAVYYCAR | DEQLG------TFDY | WGQGT LVTVS S |
| Germline VH1J1-46|D4|4-17|RF2|JH6 | | | | | | | | |
| iPS:4 34171 | 21-225_50G4 | VH1J1-46|D4|4-17|RF2|JH6 | QVQLVQS-GAEVKKPGASVKV SCKASG-YTFT | S------YYIH | WVRQAPGQ GLEWMG | VINPS---NGRTSYAQK FQG | RVTMTRDTSTSTVYMELSSL RSEDTAVYYCAR | DRGDGYY------FYYGMDV | WGQGT TVTVS S |
| Germline VH3J3-30.3|D4|4-17|RF2|JH3 | | | | | | | | |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 34175 | 21-225_55A11 | VH3\|3-30.3/D4\|4-17\|RF2/JH3 | QVQLVES-GGGVVQPGRSLRL SCAASG-FTFS | S------YGMH | WVRQTPGK GLEWVA | VISYV---- GSTKYYADS VRG | RFTISRDNSKNTLYLQMNSL RTEDTAVYYCAR | GRGRYSDY------GHDAFDI | WGRGT MVTVS S |
| | Germline | VH1\|1-02\|D1\|1-1\|RF1/JH2 | | | | | | | |
| iPS:4 34193 | 21-225_56C6 | VH1\|1-02\|D1\|1-1\|RF1/JH2 | QVQLVQS-GAEVKKPGASVKV SCKASG-YTFT | D------YHMH | WVRQAPGQ GLEWMG | WINPN---- RGGTNYVQK FQG | RVAMTNDTSISTAYMELSGL DGTS--------------SFDY | | WGRGT LVTVS S |
| | Germline | VH1\|1-02\|D5\|5-24\|RF2/JH4 | | | | | | | |
| iPS:4 34195 | 21-225_56F6 | VH1\|1-02\|D5\|5-24\|RF2/JH4 | QVQLVQS-GAEVKKPGASVKV SCKASG-FTFT | D------YYMH | WVRQAPGQ GLEWMG | WINPN---- SGGTNFAQR FQG | RVTMTRDTSISTAYMELSRL RSDDTAVYYCTR | EGATRP----------TGFDY | WGRGT LVTVS S |
| | Germline | VH3\|3-33/D1\|1-1\|RF2/JH4 | | | | | | | |
| iPS:4 34203 | 21-225_60E2 | VH3\|3-33/D1\|1-1\|RF2/JH4 | QVQLVES-GGGVVQPGRSLRL SCAASG-FTFS | G------YGMH | WVRQAPGK GLEWVA | IIWYD---- ENNKYYADS VKG | RFTISRDNSKNTLYLQMSSL RAEDTAVYYCAR | DVLD------------PFDY | WGQGT LVTVS S |
| iPS:4 34229 | 21-225_61H1 | VH3\|3-33/D1\|1-1\|RF2/JH4 | QVQLVES-GGGVVQPGRSLRL SCAASG-FTFN | D------HIIH | WVRQAPGK GLEWVA | IIWYD---- ESNKYFADS VKG | RFTISRDNSKNTLYLQMNSL RAEDTAVYYCAR | DVLD------------PFDY | WGQGT LVTVS S |
| | Germline | VH1\|1-02\|D5\|5-18\|RF1/JH6 | | | | | | | |
| iPS:4 34209 | 21-225_60C3 | VH1\|1-02\|D5\|5-18\|RF3/JH6 | QVQLVQS-GAEVKKPGASVKV SCKASG-YSFT | G------HYIH | WVRQAPGQ GLEYMG | WINPN---- SGGTNYVQK FQG | RVTMTRDTSISTAIYYCSR RSDDTAIYYCSR | GGLLGATN--------YYYYGMDV | WGQGT TVTVS S |
| iPS:4 34315 | 21-225_59G7 | VH1\|1-02\|D5\|5-18\|RF3/JH6 | QVQLVQS-GAEVKKPGASVKV SCKASG-YSFT | G------HIIH | WVRQAPGQ GLEYMG | WINPN---- SGGTNYVQK FQG | RVTMTRDTSISTAIYYCSR RSDDTAIYYCSR | GGLLGATN--------YYYYGMDV | WGQGT TVTVT S |
| iPS:4 34319 | 21-225_59B9 | VH1\|1-02\|D5\|5-18\|RF3/JH6 | QVQLVQS-GPEVKKPGASVKV SCKASG-YIFT | G------NYIH | WVRQAPGQ GLEYMG | WINPN---- SGGTNFVQK FQG | RVTMTRDTSISTANMELTSL RSDDTAVYYCSR | GGLLGATY--------YYYYGMDV | WGQGT TVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 43003 | 21-225_43F11_LC_2 | VH1|1-02|D5|5-18|RF3|J H6 | QVQLVQS-GAEVKKPGASVKV SCKASG-YTFT | G------YYIH | WVRQAPGQ GLEWMG | WINPN---- SGGTNYAQK FQG | GVTMTRLISINTAYMDLSRL RSEDDTAVYYCAR | GGNYFY------NHVMDV | WGQGT PVTVS S |
| iPS:4 43005 | 21-225_43F11_LC_1 | VH1|1-02|D5|5-18|RF3|J H6 | QVQLVQS-GAEVKKPGASVKV SCKASG-YTFT | G------YYIH | WVRQAPGQ GLEWMG | WINPN---- SGGTNYAQK FQG | GVTMTRLISINTAYMDLSRL RSEDDTAVYYCAR | GGNYFY------NHVMDV | WGQGT PVTVS S |
| | Germline | | H_FR1 | H_CDR1 | H_FR2 | H_CDR2 | H_FR3 | H_CDR3 | H_FR4 |
| iPS:4 34217 | 21-225_60E8 | VH4|4-30.4|D5|5-12|RF3|J H4 | QVQLQES-GPGLVKPSAILSL TCTVSG-GSIS | R.S----SYYWG | WIRQPPGK GLEWIG | SIYY----SGSASYNPS LKS | RVTISVDTSERQFSLRLSSV TAADTAVYYCAR | LDSGW---------SFDY | WGQGT LVTVS S |
| | Germline | | H_FR1 | H_CDR1 | H_FR2 | H_CDR2 | H_FR3 | H_CDR3 | H_FR4 |
| iPS:4 34219 | 21-225_60E9 | VH3|3-23|D3|3-22|RF3|J H4 | EVQLLES-GGGLVQPGGSLRL SCAASG-FTFS | S------YAMS | WVRQAPGK GLEWVS | AISGS---- GGNTFYADS VKG | RFTISRDNSKNTLFLQMNSL RAEDTAVYYCAK | FFGIVG---------AGYFDY | WGQGT LVTVS S |
| iPS:4 34289 | 21-225_57H12 | VH3|3-23|D3|3-22|RF3|J H4 | EVQLLES-GGGLVQPGGSLRL SCAASG-LTFS | S------YAMS | WVRQPDPGK GLEWVS | AISGS---- GGNTFYADS VKG | RFTISRDNSKNTLYLQMNSL RAEDTAVYYCAK | FFGIVG---------AGYFDY | WGQGT LVTVS S |
| iPS:4 34297 | 21-225_58A10 | VH3|3-23|D3|3-22|RF3|J H4 | EVQLLES-GGGLVQPGGSLRL SCAASG-FTFR | S------YAMS | WVRQAPGK GLEWVS | AISGS---- GGNTFYADS VKG | RFTISRDNSKNTLFLQMNSL RAEDTAVYYCAK | FFGIVG---------AGYFDY | WGQGT LVTVS S |
| iPS:3 92996 | 21-225_28B1 | VH3|3-23|D3|3-22|RF3|J H4 | EVQLLES-GGGLVQPGGSLRL SCAASG-FTFS | S------YAMS | WVRQAPGK GLEWVS | AISGS---- GGNTFYADS VKG | RFTISRDNSKNTLYLQMNSL RAEDTAVYYCAK | LGRIAVT---------GPYFDY | WGQGT LVTVS S |
| | Germline | | H_FR1 | H_CDR1 | H_FR2 | H_CDR2 | H_FR3 | H_CDR3 | H_FR4 |
| iPS:4 34225 | 21-225_60E12 | VH4|4-59|D4|4-11|RF3|J H4 | QVQLQES-GPGLVKPSETLSL TCTVSG-GSIS | S------YFWS | WIRQPAGK GLEWIG | RIYT---- RGSTNNPS LKS | RVTMSVDTSKNQFSLKLSSV TAADTAVYYCAR | EGKTGG---------VSYFDY | WGQGT LVTVS S |
| iPS:4 34227 | 21-225_61A1 | VH4|4-59|D4|4-11|RF3|J H4 | QVQLQES-GPGLVKPSETLSL TCTVSG-GSIS | S------BFWS | WIRQPAGK GLEWIG | RIYI---- RGSTNNPS LKS | RVTMSVDTSKNQFSLKLSSV TAADTAVYYCAR | EGKTGG---------VSYFDY | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 21-225_57F2 34267 | VH4|4-59/D4|4-11|RF3/JH4 | QVQLQES-GPGLVKPSETLSL TCTVSG-GSIS | S------YYWS | WIRQPAGK GLEWIG | RIYT----RGSTNYNPS LKS | RVTMSIDTSKNQFSLKLSSV TAAEDTAVYYCAR | EGKTGG------VSYFDY | WGQGT LVTVS S |
| | Germline | | | | | | | |
| | VH3|3-23|D5|5-18|RF3/JH3 | | | | | | | |
| iPS:4 21-225_58F1 34239 | VH3|3-23/D5|5-18|RF3/JH3 | EVQLLES-GGGLVQPGRSLRL SCAASG-FTFS | S------YAMS | WVRQAPGK GLEWVS | AISTG----GGNTYYADS VKG | RFTISRDNSKNTLYLQMNSL RAEDTAVYYCAR | RGVYGD------FDAFDI | WGQGT MVTVS S |
| iPS:4 21-225_59B5 34309 | VH3|3-23/D5|5-18|RF3/JH3 | EVQLLES-GGGLVQPGRSLRL SCAASG-FTFS | S------YAMN | WVRQAPGK GLEWIG | AISGS----GGNTFYADS VKG | RFTISRDNSKNTLYLQMNSL RAEDTAVYYCAR | RGVYGD------YEAFDI | WGQGT MVTVS S |
| | Germline | | | | | | | |
| | VH3|3-33/D5|5-18|RF3/JH4 | | | | | | | |
| iPS:4 21-225_62H1 34245 | VH3|3-33/D5|5-18|RF1/JH4 | QVQLVES-GGGVVQPGRSLRL SCAASG-FTFS | S------YGMH | WVRQAPGQ GLEWMA | IIWYD----GSNKYYADS VKG | RFTISRDNSKNTLYLQINSL RAEDTAVYYCAR | EDPRT------SCSDY | WGQGT LVTVS S |
| iPS:4 21-225_62H8 34323 | VH3|3-33/D5|5-18|RF1/JH4 | QVQLVES-GGGVVQPGRSLRL SCAASG-FTFS | T------YGMH | WVRQAPGK GLEWVA | VIWHD----GSDKYYVDS VKG | RFTISRDNSKNTLYLQMNSL RAEDTAVYYCAR | EDPRT------SCSDY | WGQGT LVTVS S |
| iPS:4 21-225_66A9 34379 | VH3|3-33/D5|5-18|RF1/JH4 | QVQLVES-GGGVVQPGRSLRL SCAASG-FTFS | S------YGMH | WVRQAPGK GLEWVA | VIWHD----GSDKYYADS VKG | RFTISRDNSKNTLYLQMNSL RAEDTAVYYCAR | EDPRT------SCSDY | WGQGT LVTVS S |
| | Germline | | | | | | | |
| | VH3|3-33/D11-1|RF3/JH4 | | | | | | | |
| iPS:4 21-225_62D2 34247 | VH3|3-33/D11-1|RF3/JH4 | QVQLVES-GGGVVQPGRSLRL SCAASG-FTFS | S------YGMH | WVRQAPGK GLEWVA | VIWYD----GSNKYSADS VKG | RFTISRDNSKNTLDLQMNSL RAEDTAVYYCAR | DNGNW------NYLDY | WGQGT LVTVS S |
| iPS:4 21-225_52H4 36838 | VH3|3-33/D11-1|RF3/JH4 | QVQLVES-GGGVVQPGRSLRL SCAASG-FTFS | H------FGMH | WVRQAPGK GLEWVA | VIWYD----GSNKYYADS VKG | RFTISRDNSKNTLYLQMNSL RAEDTAVYYCAR | GDWNY------EGFDY | WGQGT LVTVS S |
| iPS:4 21-225_183F5 36948 | VH3|3-33/D11-1|RF3/JH4 | QVQLVES-GGGVVQPGRSLRL SCAASG-FTFS | S------YGML | WVRQAPGK GLEWVT | VIWYD----GSGKYYADS VKG | RFTISRDNSKNTLYLQMNSL RAEDTAVYYCAR | ENFW------SGDY | WGQGT LVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4|4-39|D5|5-12|RF3|JH4 | | | | | | | | |
| iPS.4 34249 | 21-225_62E2 | VH4|4-39|D5|5-12|RF3|JH4 | QLQLQES-GPGLVKPSETLSL TCIVSG-GSIS | RS----SYYWG | WIRQPPGK GLEWIG | SIYY------SGIASYNPS LKS | RVTISVDTSKMQFSLKLNSV TAIDTAVYYCAR | LSSGW------SFDY | WGQGT LVTVS S |
| iPS.4 34353 | 21-225_64B12 | VH4|4-39|D5|5-12|RF3|JH4 | QLQLQES-GPGLVKPSETLSL TCIVSG-GSIS | RS----SYYWG | WIRQPPGK GLEWIG | SIYY------SGSTYNPS LKS | RVTISVDTSKMQFSLKLSSV TAAQTAVYYCAR | LDSGW------SFDY | WGQGT LVTVS S |
| iPS.3 94073 | 21-225_15C9 | VH4|4-39|D5|5-12|RF3|JH4 | QLQLQES-GPGLVKPSETLSL TCIVSG-GSIS | RS----SYYWG | WIRQPPGK GLEWIG | NIYY------SGSTYNNPS LKS | RVTISVDTSKMQFSLKLSSV TAADTAVYYCAR | QGSGW------EVDY | WGQGT LVTVS S |
| VH1|1-02|D7|7-27|RF1|JH4 | | | | | | | | |
| iPS.4 34259 | 21-225_62G7 | VH1|1-02|D7|7-27|RF1|JH4 | QVQLVQS-GAEVKKPGASVKV SCKASG-YTFT | G------YYMH | WVRQAPGQ GLEWMG | WIKPK------SGGTNQAQK FQG | RVTMTRDTSISTAYMELSSL RSDDTAVYYCAR | APGIAAAG------TWGYFDY | WGQGT LVTVS S |
| iPS.4 34347 | 21-225_64H10 | VH1|1-02|D7|7-27|RF1|JH4 | QVQLVQS-GAEVKKPGASVKV SCKASG-YTFT | G------YYMH | WVRQAPGQ GLEWMG | WIKPN------SGGTNQAQK FQG | RVTMTRDTSISTAYMELSGL RSDDTAVYYCAR | APGTAATG------TWGYFDY | WGQGT LVTVS S |
| iPS.4 34359 | 21-225_65G3 | VH1|1-02|D7|7-27|RF1|JH4 | QVQLVQS-GAEVKKPGASVKV SCKASG-YTFT | G------YYIH | WVRQAPGQ GLEWMG | WINPN------SGGTNSAQK FQG | RVTMTRDTSISTAYMELSRL RSDDTAVYYCAR | APGKAAAG------TWGYFDY | WGQGT LVTVS S |
| iPS.4 34369 | 21-225_66B1 | VH1|1-02|D7|7-27|RF1|JH4 | QVQLVQS-GAEVKKPGASVKV SCKASG-YTFT | G------YYMH | WVRQAPGQ GLEWMG | WINPN------SGGTNNAQK FQG | RVTMTRDTSISTAYMELSRL RSDDTAVYYCAR | APGTAAAG------TWGYFDY | WGQGT LVTVS S |
| iPS.4 34373 | 21-225_66A7 | VH1|1-02|D7|7-27|RF1|JH4 | QVQLVQS-GAEVKKPGASVKV SCKASG-YTFT | G------YYMH | WVRQAPGQ GLEWMG | WIKPN------SGGTNQAQK FQG | RVTMTRDTSIGTMELSRL RSDDTAVYYCAR | APGTVAAG------TWGYFDY | WGQGT LVTVS S |
| iPS.4 34397 | 21-225_67H4 | VH1|1-02|D7|7-27|RF1|JH4 | QVQLVQS-GAEVKKPGASVKV SCKASG-YTFT | G------YYMH | WVRQAPGQ GLEWMG | WIKPN------SGGTNSAQK FQG | RVTMTRDTSISTAYMELSGL RSDDTAVYYCAR | APGTAATG------TWGYFDY | WGQGT LVTVS S |
| iPS.4 34427 | 21-225_70D6 | VH1|1-02|D7|7-27|RF1|JH4 | QVQLVQS-GAEVKKPGASVKV SCKASG-YTFT | G------YYMH | WVRQAPGQ GLEWMG | WINPN------SGGTNSAQK FQG | RVSMTRDTSIGTAYMELRGL RSDDTAEYYCAR | APGKAAAG------TWGFFDY | WGQGT LVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 34435 | 21-225_70G9 | VH1\|1-02\|D7\|7-27\|RF1\|JH4 | QVQLVQS-GAEVKKPGASVKVSCKASG-YTFT | G------YYMH | WVRQAPGQGLEWMG | WIKPN---SGGTNQAGKFQG | RVTMTRDTSISTAYMELSSLRSDDTAVYYCAR | APGIAAAG-------TWGYFDY | WGQGTLVTVSS |
| iPS:4 34437 | 21-225_70A12 | VH1\|1-02\|D7\|7-27\|RF1\|JH4 | QVQLVQS-GAEVKKPGASVKVSCKASG-YTFT | G------YYMH | WVRQAPGQGLEWMG | WIKPN---SGGTNQAGKFQG | RVTMTRDTSISTAYMELSGLRSDDTAVYYCAR | APGTAATG-------TWGYFDY | WGQGTLVTVSS |
| iPS:4 34451 | 21-225_71B7 | VH1\|1-02\|D7\|7-27\|RF1\|JH4 | QVQLVQS-GAEVKKPGASVKVSCKASG-YIFT | G------YYMH | WVRQAPGQGLEWMG | WINPN---SGGTNSAQKFQG | RVTMTRDTSIGTAYMELSGLRSDDTAVYYCAR | APGKAAAG-------TWGFFDY | WGQGTLVTVSS |
| iPS:4 34459 | 21-225_71A7 | VH1\|1-02\|D7\|7-27\|RF1\|JH4 | QVQLVQS-GAEVKKPGASVKVSCKASG-YTFT | G------YYMH | WVRQAPGQGLEWMG | WINPK---SGGTNYYGKFQG | RVTMTRDTSISTAYMELSSLRSDDTAVYYCAR | APGTAPAG-------SWGYFDY | WGQGTLVTVSS |
| iPS:4 34461 | 21-225_73A3 | VH1\|1-02\|D7\|7-27\|RF1\|JH4 | QVQLVQS-GAEVKKPGASVKVSCKASG-YTFT | G------YYMH | WVRQAPGQGLDWMG | WINPK---SGGINHYGKFQG | RVAMTRDTSISTAYMELSSLRSDDTAVYYCAR | APGTAAAG-------SWGCFDY | WGQGTLVTVSS |
| | Germline | VH3\|3-23\|D4\|4-11\|RF3\|JH4 | | | | | | | |
| iPS:4 34261 | 21-225_56F7 | VH3\|3-23\|D4\|4-11\|RF3\|JH4 | EVQLLES-GGGLVQPGGSLRLSCAASG-FTFS | S------YVLN | WVRQAPGKGLEWVS | AMSGS---GGRTYYADSVKG | RFTISRDNSKNTLYLQMNSLRAEDTAVYFCAM | TIH------------FDY | WGQGTLVTVSS |
| iPS:4 35461 | 21-225_153A1 | VH3\|3-23\|D4\|4-11\|RF3\|JH4 | EVQLLES-GGGLVQPGGSLRLSCAASG-FSFS | S------YVMS | WVRQAPGKGLEWVS | AISGS---GDRTYYADSVKG | RFTISRDNSKNTLYLQMNSLRAEDTAVYYCAR | TAT------------KDY | WGQGTLVTVSS |
| iPS:4 35509 | 21-225_157H1 | VH3\|3-23\|D4\|4-11\|RF3\|JH4 | EVQLLES-GGGLVQPGGSLRLSCAASG-FTFS | S------YAMR | WVRQAPGKGLQWVS | DISGS---GGTTYYADSVKG | RFTISRDNSKNTLYLQMNSLRAEDTAVYYCAR | TY-------------L | WGQGTLVTVSS |
| iPS:4 35747 | 21-225_175C4 | VH3\|3-23\|D4\|4-11\|RF3\|JH4 | EVQLLES-GGGLVQPGGSLRLSCAASA-FTFS | S------YVMS | WVRQAPGKGLEWVS | AISGS---GDRTYYADSVKG | RFTISRDDSNTLYLQMNSLRAEDTAVYYCAR | TAG------------FDY | WGQGTLVTVSS |
| iPS:3 92784 | 21-225_23C7 | VH3\|3-23\|D4\|4-11\|RF3\|JH4 | EVQLLES-GGGLVQPGGSLRLSCAASG-FTFS | S------YVMS | WVRQAPGKGLEWVS | AMSGS---GGSTYYVDSVKG | RFTISRDNSKNTLYLQMNSLRAEDTAVYYCAR | TGV------------FDY | WGQGTLVTVSS |
| iPS:3 92802 | 21-225_23E7 | VH3\|3-23\|D4\|4-11\|RF3\|JH4 | EVQLLES-GGGLVQPGGSLRLSCTASG-FTFS | S------YAMN | WVRQAPGKGLEWVS | AISGS---GGFTYYADSVKG | RFTISRDNSRNTLYLQMNSLRAEDTAVYYCAR | TSG------------FDY | WGQGTLVTVSS |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 92962 | 21-225_30A1 | VH3\|3-23\|D4\|4-11\|RF3\|JH4 | EVQLLES-GGGLVQPGGSLRL SCAASG-FTFS | S------YVMN | WVRQAPGK GLEWVS | AISGS----GGSTYYADS VKG | RFTISRDNSKNTLYLQMNSL RAEDTAVYYCAR | TGV--------FDY | WGQGT LVTVS S |
| iPS:3 93090 | 21-225_33A5 | VH3\|3-23\|D4\|4-11\|RF3\|JH4 | EVQLLES-GGGLVQPGGSLRL SCAASG-FTFS | S------YVIN | WVRQAPGK GLEWVS | AISGS----GVSTYYADS VKG | RFTISRDNSKNTILYLQMNSL RAEDTAVYYCAR | TSL--------FDY | WGQGT LVTVS S |
| | Germline | | H_FR1 | H_CDR1 | H_FR2 | H_CDR2 | H_FR3 | H_CDR3 | H_FR4 |
| VH3\|3-23\|D1\|1-1\|RF3\|JH4 | | | EVQLLES-GGGLVQPGGSLRL SCAASG-FTFS | | WVRQAPGK GLEWVS | GGSTYYADS VKG | RFTISRDNSKNTLYLQMNSL RAEDTAVYYCAK | SFDY | WGQGT LVTVS S |
| iPS:4 34273 | 21-225_57E4 | VH3\|3-23\|D1\|1-1\|RF3\|JH4 | EVQLLES-GGGLVQPGGSLRL SCAASG-FTFS | S------YAMS | WVRQAPGK GLEWVS | VISGS-----GGSTFYADS VKG | RFTISRDNSKNTLYLQMNSL RAEDTAVYYCAR | RDWND------VFDY | WGQGT LVTVS S |
| | Germline | | H_FR1 | H_CDR1 | H_FR2 | H_CDR2 | H_FR3 | H_CDR3 | H_FR4 |
| VH3\|3-23\|D3\|3-3\|RF3\|JH4 | | | EVQLLES-GGGLVQPGGSLRL SCAASG-FTFS | YAMS | WVRQAPGK GLEWVS | GGSTYYADS VKG | RFTISRDNSKNTLYLQMNSL RAEDTAVYYCAK | IFDY | WGQGT LVTVS S |
| iPS:4 34279 | 21-225_57F7 | VH3\|3-23\|D3\|3-3\|RF3\|JH4 | EVQLLES-GGGLVQPGGSLRL SCAASG-FTFS | S------YAMS | WVRQAPGK GLEWVS | AISGS----GGNTFYADS VKG | RFTISRDNSKNTLYLQMNSL RAEDTAVYYCAR | FFGVVG-----VGCFDY | WGQGT LVTVS S |
| iPS:4 37228 | 21-225_60C11 | VH3\|3-23\|D3\|3-3\|RF3\|JH4 | EVQLLES-GGGLVQPGGSLRL SCAASG-FPFS | S------YAMS | WVRQAPGK GLEWVS | AISGS----GGNTFYADS VKG | RFTISRDNSKNTLYLQMNSL RAEDTAVYYCAR | FFGVVG-----VGCFDY | WGQGT LVTVS S |
| | Germline | | H_FR1 | H_CDR1 | H_FR2 | H_CDR2 | H_FR3 | H_CDR3 | H_FR4 |
| VH3\|3-23\|D3\|3-22\|RF3\|JH1 | | | EVQLLES-GGGLVQPGGSLRL SCAASG-LTFS | YAMH | WVRQAPGK GLEWVA | GSNKYYADS VKG | RFTISRDNSKKTLYLQMNSL RAEDTAVYYCAK | FFGIVG-----AGFFDS | WGQGT LVTVS S |
| iPS:4 34291 | 21-225_58A4 | VH3\|3-23\|D3\|3-22\|RF3\|JH1 | EVQLLES-GGGLVQPGGSLRL SCAASG-LTFS | S------YAMS | WVRQSPGK GLEWVA | AISGS----GGNTFYGDS VKG | RFTISRDNSKKTLYLQMNSL RAEDTAVYYCAR | FFGIVG-----AGFFDS | WGQGT LVTVS S |
| | Germline | | H_FR1 | H_CDR1 | H_FR2 | H_CDR2 | H_FR3 | H_CDR3 | H_FR4 |
| VH3\|3-33\|D2\|2-15\|RF3\|JH4 | | | QVQLVES-GGGVVQPGRSLRL SCAASG-FTFS | YDIH | WVRQSPGK GLEWVA | GSKKYYADS VKG | RFTISRDNSKNTLYLQMNSL RAEDTALYYCAK | ATYFDY | WGQGT LVTVS S |
| iPS:4 34299 | 21-225_58D11 | VH3\|3-33\|D2\|2-15\|RF3\|JH4 | QVQLVES-GGGVVQPGRSLRL SCAASG-FTFS | D------YDIH | WVRQSPGK GLEWVA | VIWYD----GSKKYYADS VKG | RFTISRDNSKNTLYLQMNSL RAEDTALYYCAR | DRVT-------FDY | WGQGT LVTVS S |
| iPS:4 34871 | 21-225_85H1 | VH3\|3-33\|D2\|2-15\|RF3\|JH4 | QVQLVES-GGGVVQPGRSLRL SCAASG-FTFS | S------YGIH | WVRQAPGK GLEWVA | VIWYD----GSMKYYADS VKG | RFTISRDNSKNTLYLQMNSL RAEDTAVYYCAR | DPFIVG-----ATYFDY | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35109 | VH3/3-33/D2/2-15/RF3/JH4 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | DPFIVG-----------ATYFDY | WGQGT LVTVS S |
| iPS:4 36434_225_216B10 | VH3/3-33/D2/2-15/RF3/JH4 | QVQLVES-GGGVVQPGRSLRL SCAASG-FTFS | S------YGMH | WVRQAPGK GLEWVA | AIWYD---- GSNKYYADS VKG | RFTISRDNSKNTILYLQMNSL RAEDTAVYYCAR | DPNIVG-----------ATWFDY | WGQGT LVTVS S |
| Germline | | | | | | | | |
| VH1/1-02/D44-17/RF2/JH4 | | | | | | | | |
| iPS:4 34307 | VH1/1-02/D44-17/RF2/JH4 | QVQLVQS-GAEVKKPGASVKV SCKASG-YTFA | G------YYIH | WVRQAPGQ GLEWIG | MINPN---- SGGTNYAQK FQG | RVTMTRDTSISTAYMELSRL KFDDTAVYYCAR | DPGP-------------FIY | WGQGT LVTVS S |
| Germline | | | | | | | H_CDR3 | H_FR4 |
| VH3/3-33/D3/3-22/RF3/JH6 | | | | | | | | |
| iPS:4 34311 | VH3/3-33/D3/3-22/RF3/JH6 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | ERGIAVG-----------YYGMDV | WGQGT TVTVS S |
| Germline | | | | | | | H_CDR3 | H_FR4 |
| VH4/4-39/D1/1-26/RF3/JH4 | | | | | | | | |
| iPS:4 34313 | VH4/4-39/D1/1-26/RF3/JH4 | QLQLQES-GPGLVKPSETLSL TCTVSG-GSIS | RS----SYYWG | WIRQPPGK GLEWIG | NIYY----- SGSTYYNPS LKS | RVTISVDTSKNQFSLKLSSV TAADTAVYYCAR | HSSSW-----------SLDY | WGQGT LVTVS S |
| iPS:4 34413 | VH4/4-39/D1/1-26/RF3/JH4 | QLQLQES-GPGLVKPSETLSL TCTVSG-GSIS | RS----SYYWG | WIRQPPGK GLEWIG | NIYY----- SGSTYYIPS LKS | RVTISVDTSKNQFSLKLTSV TAADTAVYYCAR | HSTSW-----------SIDY | WGQGT LVTVS S |
| iPS:3 92628 | VH4/4-39/D1/1-26/RF3/JH4 | QLQLQES-GPGLVKPSETLSL TCTVSG-GSIS | RS----SYYWG | WIRQPPGK GLEWIG | NIYY----- SGTAYCNSS LKS | RVIISVDTSKNQFSLKLSSV TATDTAVYYCAR | HSSSM-----------SLDN | WGQGT LVTVS S |
| iPS:3 92642 | VH4/4-39/D1/1-26/RF3/JH4 | QLQLQES-GPGLVKPSETLSL TCTVSG-GSIS | RS----SYYWG | WIRQPPGK GLEWIG | NIYY----- SGTYYNPS LKS | RVIISVDTSKNQFSLKLSSV TAADTAVYYCAR | HSSSW-----------SLDD | WGQGT LVTVS S |
| iPS:3 92706 | VH4/4-39/D1/1-26/RF3/JH4 | QLQLQES-GPGLVKPSETLSL TCTVSG-GSIS | RS----SYYWG | WIRQPPGK GLEWIG | NIYY----- SGTYYIPS LKS | RVTISVDTSKNQFSLKLSSV TAADTAVYYCAR | HSTSW-----------SLDY | WGQGT LVTVS S |

FIGURE 51 (Continued)

| | | | | | | | | | |
|---|---|---|---|---|---|---|---|---|---|
| iPS:3 92800 | 21-225_22D12 | VH4|4-39|D1|1-26|RF3|J H4 | QLQLQES-GPGLVKPSETLSL TCTVSG-GSIS | RS----SYYWG | WIRQPPGK GLEWIG | NIYY---- SGTTSYNPS LKS | RVTISVDTSKNQFSLKLSSV TAADTAVFYCAR | LSSSW--------------SVDY | WGQGT LVTVS S |
| iPS:3 92820 | 21-225_23D1 | VH4|4-39|D1|1-26|RF3|J H4 | QLQLQES-GPGLVKPSETLSL TCTVSG-GSIS | RS----SYYWG | WIRQPPGK GLEWIG | SIYY---- SGSAQYNPS LKS | RVTISVDTSKNQFSLTLSSV TAADTALYYCAR | LSSSW--------------SFDY | WGQGT LVTVS S |
| iPS:3 92824 | 21-225_24E5 | VH4|4-39|D1|1-26|RF3|J H4 | QLQLQES-GPGLVKPSETLSL TCTVSG-GAIS | RS----SYYWG | WIRQPPGK GLEWIG | SIYY---- SGSANYNPS LKS | RVTISVDTSKNQFSLRLSSV TAADTAVYYCAR | LSSSW--------------SICN | WGQGT LVTVS S |
| iPS:3 92834 | 21-225_22C1 | VH4|4-39|D1|1-26|RF3|J H4 | QLQLQES-GPGLVKPSETLSL TCTVSG-GSIN | RS----SYYWG | WIRQPPGK GLEWIG | NIYY---- SGATYYNSS LKS | RVTISVDTSTNQFSLKLSSV TAADTAVYYCAR | HSGSW--------------SLDY | WGQGT LVTVS S |
| iPS:3 92870 | 21-225_20G9 | VH4|4-39|D1|1-26|RF3|J H4 | QLQLQES-GPGLVKPSETLSL TCTVSG-GSIS | RS----SYYWG | WIRQPPGK GLEWIG | SIYY---- SGSAYNPS LKS | RVTISVDTSKNQFSLKLSSV TAADTAVYYCAR | LSSSW--------------SFDY | WGQGT LVTVS S |
| iPS:3 92896 | 21-225_21G7 | VH4|4-39|D1|1-26|RF3|J H4 | QLQLQES-GPGLVKPSETLSL TCTVSG-GSIS | RS----SYYWG | WIRQPPGK GLEWIG | SIYY---- SGSYYNPS LKS | RVTISVDTSKNQFSLKLSSV TAADTAVYYCAR | HSTSW--------------SLDY | WGQGT LVTVS S |
| iPS:3 92904 | 21-225_22G9 | VH4|4-39|D1|1-26|RF3|J H4 | QLQLQES-GPGLVKPSETLSL TCTVSG-GSIS | GS----MYYWG | WIRQPPGK GQEWIG | NIYY---- SGSTYYNPS LKS | RVTISVDTSKNQFSLKLRSV TAADTAVYYCAR | HSSSW--------------SLDY | WGQGT LVTVS S |
| iPS:3 93094 | 21-225_34C4 | VH4|4-39|D1|1-26|RF3|J H4 | QLQLQES-GPGLVKPSETLSL TCTVSG-GAIS | RS----SYYWG | WIRQSPGK GLEWIG | SIYY---- SGSTYYNPS LKS | RVNISVDTSKNQVSLKLSSV TAADTAVYYCAR | LSSSW--------------SFDY | WGQGT LVTVS S |
| iPS:3 93806 | 21-225_6A6 | VH4|4-39|D1|1-26|RF3|J H4 | QLQLQES-GPGLVKPSETLSL TCTVSG-GSIS | RS----SYYWG | WIRQPPGK GLEWIG | NIYY---- SGIFYYNPS LKS | RVTISVDTSKNQFSLKLNSV TAADTAVYYCAR | HSSSW--------------SLDY | WGQGT LVTVS S |
| iPS:3 93814 | 21-225_7F4 | VH4|4-39|D1|1-26|RF3|J H4 | QLQLQES-GPGLVKPSETLSL TCTVSG-GSIS | RS----SYYWG | WIRQPPGK GLEWIG | NIYY---- SGATYYNPS LKS | RVTISVDTSKNQFSLRLSSV TAADTAVYYCAR | HSGSW--------------SLDY | WGQGT LVTVS S |
| iPS:3 93816 | 21-225_6D4 | VH4|4-39|D1|1-26|RF3|J H4 | QLQLQES-GPGLVKPSETLSL TCTVSG-GSIS | RS----SSYWG | WIRQPPGK GLEWIG | NIYY---- SGSAYYIPS LKS | RVTISVATSKNQFSLMLTSV TAADTAVYYCAR | HSSSW--------------SLDC | WGQGT LVTVS S |
| iPS:3 93880 | 21-225_15A1 | VH4|4-39|D1|1-26|RF3|J H4 | QLHLQES-GPGLVKPSETLSL TCTVSG-GSIS | RS----SYYWG | WIRQPPGK GLEWIG | SIYY---- SGSAQYNPS LKS | RVTISVDTIKNQFSLTLSSV TAADTAVYYCAR | LSSSW--------------SFDY | WGQGT LVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS.3 94002 | 21-225_15G7 | VH4|4-39/D1|1-26|RF3/JH4 | QLQLQES-GPGLVKPSETLSL TCTVSG-GSIS | RS----SYYWG | WIRQPPGK GLEWIG | SIYY----SGTYYTPS LKS | RVTISVDTSKNQFSLRLSSV TAADTASYYCAR | LSSSW-------SFDF | WGQGT LVTVS S |
| iPS.3 94053 | 21-225_11F10 | VH4|4-39/D1|1-26|RF3/JH4 | QLHLQES-GPGLVKPSETLSL TCTVSG-ASIS | RS----SYYWG | WIRQPPGK GLEWIG | SIYY----SGSAQYMPS LKS | RVTISVDTSKNQFSLTLSSV TAADTAVYYCAR | LSSSW-------SFDY | WGQGT LVTVS S |
| iPS.3 94057 | 21-225_15H1 | VH4|4-39/D1|1-26|RF3/JH4 | QLQLQES-GPGLVKPSETLSL TCTVSG-GSIS | RS----SYYWG | WIRQPPGK GLEWIG | NIYY----SGYPYYNPS LKS | RVTISVDTSKNQFSLKLSSV TAADTAVYYCAR | RSTSW-------SLDY | WGQGT LVTVS S |
| iPS.3 94063 | 21-225_16A1 | VH4|4-39/D1|1-26|RF3/JH4 | QLQLQES-GPGLVKPSETLSL ICTVSG-GSID | RS----SYYWG | WIRQPPGK GLEWIG | SIYY----SGSAYHNPS LKS | RGTISVDTSKNQFSLKLSSV TAADTAVYYCAR | LSSSW-------SFDY | WGQGT LVTVS S |
| iPS.3 94075 | 21-225_8D12 | VH4|4-39/D1|1-26|RF3/JH4 | QLQLQES-GPGLVKPSETLSL TCTVSG-GSIS | RS----SYYWG | WIRQPPGK GLEWIG | NIYY----SGYPYYNPS LKS | RVTISIDTSKNQFSLKLSSV TAADTAVYYCAR | RSTSW-------SLDY | WGQGT LVTVS S |
| VH3|3-48/D7|7-27|RF3/JH4 | Germline | | | | | | | | |
| iPS.4 34317 | 21-225_59E8 | VH3|3-48/D7|7-27|RF3/JH4 | EVQLVES-GGGLVQPGGSLRL SCAASG-FTFS | S-----YSMN | WVRQAPGK GLGWVS | TISSS----SGTIYYADS VKG | RFTISRDNAKNSLYLQMNSL RDEDTAVYYCAR | EWGMAV------AGPFDY | WGQGT LVTVS S |
| VH3|3-33/D1|1-26|RF3/JH4 | Germline | | | | | | | | |
| iPS.4 34327 | 21-225_6366 | VH3|3-33/D1|1-26|RF3/JH4 | QVQLVES-GGGVVQPGRSLRL SCAASG-FTFS | S-----YGMH | WVRQAPGK GLEWVT | VIWYD----GSNKYYADS VKG | RFTISRDNSKNTLYLQMNSL RAEDTAVYYCAR | DSLSGI------AAAFDY | WGQGT LVTVS S |
| iPS.4 37084 | 21-225_206B5 | VH3|3-33/D1|1-26|RF3/JH4 | QVQLVES-GGGVVQPGRSLRL SCAASG-FTFS | S-----YGMH | WVRQAPGK GLEWVA | VIWYD----GSNKYYADS VKG | RFTISRDNSKNTLYLQMNSL RAEDTAVYYCAR | EGGSY-------HLDY | WGQGT LVTVS S |
| iPS.4 37088 | 21-225_209H10 | VH3|3-33/D1|1-26|RF3/JH4 | QVQLVES-GGGVVQPGRSLRL SCAASG-FTFS | S-----YGMH | WVRQAPGK GLEWVA | VIWYD----GSNKYYADS VKG | RFTISRDNSKNTLYLQMNSL RAEDTAVYNCAR | EGGSY-------HLDY | WGQGT LVTVS S |
| iPS.3 92684 | 21-225_17F4 | VH3|3-33/D1|1-26|RF3/JH4 | QVQLVES-GGGVVQPGRSLRL SCAASG-FTFS | N-----YGMN | WVRQAPGK GLEWVA | VIWYD----GSNKHYADS VKG | RFTISRDNSKNTLYLQMNSL RAEDTAVYYCAS | SGSY--------FFDY | WGQGT LVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH1|1-02|D6|6-19|RF2|JH4 | | QVQLVQS-GAEVKKPGASVKV SCKASG-YTFT | ...... | ...... | ...... | RVTMTRDASINTAYMELRSL RSEDTAVYYCAR | ...... | WGQGT LVTVS S |
| iPS:4 34333 | 21-225_63C9 | VH1|1-02|D6|6-19|RF2|JH4 | QVQLVQS-GAEVKKPGASVKV SCKASG-YTFT | G------YYMH | WVRQAPGSQ GLEWMG | WINPN----SGGTNFAQK FQG | RVTMTRDASINTAYMELRSL ISDDTAVYYCAR | APGVAAAG-------SWGYFDY | WGQGT LVTVS S |
| | Germline | H_FR1 | H_CDR1 | H_FR2 | H_CDR2 | H_FR3 | H_CDR3 | H_FR4 |
| VH3|3-33|D4|4-11|RF2|JH4 | | QVQLVES-GGGVVQPGRSLRL SCAASG-FTFS | ...... | ...... | ...... | RFTISRDNSKNTLYLQMNSL RAEDTAVYYCAR | ...... | WGQGT LVTVS S |
| iPS:4 34335 | 21-225_63C10 | VH3|3-33|D4|4-11|RF2|JH4 | QVQLVES-GGGVVQPGRSLRL SCAASG-FTFS | S------YGMH | WVRQAPGK GLDWVA | VIWYD----GSNKYYADS VKG | RFTISRDNSKNTLYLQMNSL RAEDTAVYYCAR | DDPRS-------SAGDY | WGQGT LVTVS S |
| iPS:4 34429 | 21-225_70H6 | VH3|3-33|D4|4-11|RF2|JH4 | QVQLVES-GGGVVQPGRSLRL SCAASG-FTFS | S------YGMH | WVRQTPGK GLDWVA | VIWHD----GSNKYYADS VKG | RFTISRDNSKNTLYLQMNSL RAEDTAVYYCAR | DDPRS-------SAGDY | WGQGT LVTVS S |
| iPS:4 34569 | 21-225_77H5 | VH3|3-33|D4|4-11|RF2|JH4 | QVQLVES-GGGVVQPGRSLRL SCAASG-FTFS | N------YGMH | WVRQAPGK GLEWVA | VIWYD----GRNKYYADS VKG | RFTISRDNSKNTLALNYCAR | DRSILG-------ATFFDY | WGQGT LVTVS S |
| iPS:4 34629 | 21-225_74C3 | VH3|3-33|D4|4-11|RF2|JH4 | QVQLVES-GGGVVQPGRSLRL SCAASG-FTFS | S------FGMH | WARQAPGK GLEWVA | AIWYD----GSNKYCADS VKG | RFTISRDNSKNTLSLQMNSL RAEDTAVYYCAR | DRSILG-------AAFFDY | WGQGT LVTVS S |
| iPS:4 35793 | 21-225_180F8 | VH3|3-33|D4|4-11|RF2|JH4 | QVQLVES-GGGVVQPGRSLRL SCAASG-FTFS | S------YGMH | WVRQAPGK GLEWVS | VIWYD----GSDKYYEDS VKG | RFTISRDNSKNTLYLQMNSL RAEDTAVYYCAR | DHPRW-------SYGDY | WGQGT LVTVS S |
| iPS:4 36382 | 21-225_212C10 | VH3|3-33|D4|4-11|RF2|JH4 | QVQLVES-GGGVVQPGRSLRL SCAASG-FTFS | S------YGMH | WVRQAPGK GLEWVT | AIWYD----GSHYYTDS VKG | RFTISRDNSKNTLYLQMNSL RAEDTAVYYCAR | DRSIVG-------ATYFDY | WGQGT LVTVS S |
| iPS:3 92660 | 21-225_19B3 | VH3|3-33|D4|4-11|RF2|JH4 | QVQLVES-GGGVVQPGRSLRL SCAASG-FTFS | S------YDMH | WVRQAPGK GLEWVA | VIWYD----GSDKYYADS VKG | RFTISRDNSKNTLFLQMNSL RAEDTAVYYCAR | DRAYS-------SSSDY | WGQGT LVTVS S |
| iPS:3 93904 | 21-225_8H11 | VH3|3-33|D4|4-11|RF2|JH4 | QVQLVES-GGGVVQPGRSLRL SCAASG-FTFS | T------YGMH | WVRQAPGK GLEWVA | VIWYD----GSDRYSADS VKG | RFTISRDNSKNTLYLQMNSL RAEDTAVYYCAR | DRAYS-------SSSDF | WGQGT LVTVS S |
| | Germline | H_FR1 | H_CDR1 | H_FR2 | H_CDR2 | H_FR3 | H_CDR3 | H_FR4 |
| VH4|4-59|D4|4-11|RF2|JH4 | | | | | | | | |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 34341 | 21-225_64F7 | VH4|4-59/D4|4-11|RF2|JH4 | QVQLQES-GPGLVKPSETLSLTCTVSG-GSIS | S------YWMS | WIRQPAGKGLEWIG | RIYT----SGISNYNPSLKS | RVTMSVDTSKMQFSLKLSSVTAADTAVYYCAR | FSSG-------FFDY | WGQGTLVTVSS |
| | Germline | VH4|4-59/D4|4-11|RF2|JH4 | | | | | | | |
| iPS:4 34351 | 21-225_64A12 | VH3|3-33/D7|7-27|RF2|JH1 | EVQLVES-GGGLVQPGRSLRLSCAASG-FTFS | S------YGMH | WVRQAPGKGLEWVA | VIWYD----ESMKYYDSVKG | RFTISRDNSKNTLYLQMNSLRAEDTAVYYCAR | ELGF-------LSDH | WGQGTLVTVSS |
| iPS:3 92700 | 21-225_16E12 | VH3|3-33/D7|7-27|RF2|JH1 | QVQLVES-GGGLVQPGRSLRLSCAASG-FTFS | S------YGMH | WVRQAPGKGLEWVA | VIWYE----GSNKYYDSVRG | RFTISRDNSKSTLYLQMNSLRAEDTAVYYCVR | ELGF-------QSDH | WGQGPVTVSS |
| iPS:3 92710 | 21-225_19A10 | VH3|3-33/D7|7-27|RF2|JH1 | QVQLVES-GGGLVQPGRSLRLSCAASG-FTFS | N------YGMH | WVRQAPGKGLEWVA | VIWYD----ESMKYYADSVKG | RFTISRDNSKNTLYLQMNSLRAEDTAVYYCAR | ELAW-------YEDS | WGQGTLVTVSS |
| iPS:3 94093 | 21-225_9D12 | VH3|3-33/D7|7-27|RF2|JH1 | QVQLVES-GGGLVQPGRSLRLSCAASG-FTFS | D------YGMH | WVRQAPGKGLEWVA | VIWYD----GNMNYYADSVKG | RFTISRDNSKNTLYLQMNSLRAEDTAVYYCAR | ELAW-------YEDF | WGQGTLVTVSS |
| | | H_FR1 | H_CDR1 | H_FR2 | H_CDR2 | H_FR3 | H_CDR3 | H_FR4 |
| | Germline | VH3|3-23/D3|3-22|RF2|JH3 | | | | | | | |
| iPS:4 34355 | 21-225_64G12 | VH3|3-23/D3|3-22|RF2|JH3 | EVQLLES-GGGLVKPGGSLRLSCAASG-FTFS | S------RAMS | WVRQAPGKGLEWVS | VISGS----GGSTYYADSVKG | RFTISRDNSKNTLYLQMNSLRAEDTALYYCAK | RNIDD------AFDI | WGQGMVTVSS |
| | | H_FR1 | H_CDR1 | H_FR2 | H_CDR2 | H_FR3 | H_CDR3 | H_FR4 |
| | Germline | VH3|3-21/D4|4-11|RF3|JH4 | | | | | | | |
| iPS:4 34367 | 21-225_65H11 | VH3|3-21/D4|4-11|RF3|JH4 | EVQLVES-GGGLVKPGGSLRLSCAASG-FTFS | S------YRMN | WVRQAPGKGLEWVS | SISSS----NSSIYYADSVKG | RFTISRDNAKNSLYLQMNSLRAEDTAVYYCTS | IS---------GS | WGQGTLVTVSS |
| iPS:4 37220 | 21-225_55H6 | VH3|3-21/D4|4-11|RF3|JH4 | EVHLVES-GGGLVKPGGSLRLSCAASG-FTFS | S------YGMN | WVRQAPGKGLEWVS | SISGS----SGYIYYADSVKG | RFTISRDNAKNSLYLQMNSLRAEDTAVYYCAR | IGV--------FDY | WGQGTLVTVSS |
| iPS:4 02237 | 21-225_23D11 | VH3|3-21/D4|4-11|RF3|JH4 | EVQLVES-GGGLVKPGGSLRLSCAASG-FTFS | S------YMIN | WVRQAPGKGLEWVS | SISGN----SGYIYYADSVKG | RFTISRDNAKNSLYLQMNSLRAEDTAVYYCAR | TNL--------FDY | WGQGTLVTVSS |

FIGURE 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| | VH3|3-21|D4|4-11|RF3|JH3 | | EVQLVES-GGGLVKPGGSLRL SCAASG-FTFS | S------YSMN | WVRQAPGK GLEWVS | SISGT----SSYIYYADS VKG | RFTISRDNAKNSLYLQMNSL RAEDTAVYFCAR | TNA------SFTI | WGQGT MVTVS S |
| iPS:4 34383 | 21-225_66F9 | VH3|3-21|D4|4-11|RF3|JH3 | EVQLVES-GGGLVKPGGSLRL SCAASG-FTFS | S------YSMN | WVRQAPGK GLEWVS | SISGT----SSYIYYADS VKG | RFTISRDNAKNSLYLQMNGL RAEDTAVYFCAR | TNA-------FDI | WGQGT MVTVS S |
| iPS:4 34449 | 21-225_71H6 | VH3|3-21|D4|4-11|RF3|JH3 | EVQLVES-GGGLVKPGGSLRL SCAASG-FTFS | S------YSMN | WVRQAPGK GLEWVS | SISGT----SSYIYYADS VKG | RFTISRDNAKNSLYLQMNGL RAEDTAVYFCAK | TNA-------FDI | WGQGT MVTVS S |
| | VH3|3-33|D6|6-6|RF2|JH4 | | QVQLVES-GGGLVQPGRSLRL SCAASG-FTFS | Y------YGMH | WVRQAPGK GLEWVA | VIWYD----GSNKYYADS VKG | RFTISRDNSKNTLYLQMNSL RAEDTAVYYCAR | SIPXX----FDY | WGQGT LVTVS S |
| iPS:4 34399 | 21-225_67B7 | VH3|3-33|D6|6-6|RF2|JH4 | QVQLVES-GGGLVQPGRSLRL SCAASG-FTFS | N------YGMH | WVRQAPGK GLEWVA | VILYD----GSKKYYADS VKG | RFTISRDNSKNTLYLQMNSL RAEDTAVYYCAR | SIPE------FDY | WGQGT LVTVS S |
| iPS:4 34463 | 21-225_73A6 | VH3|3-33|D6|6-6|RF2|JH4 | QVQLVES-GGGLVQPGRSLRL SCAASG-FTFS | Y------YGMH | WVRQAPGK GLEWVA | VILYD----GSKKYYADS VKG | RFTISRDNSKNTLYLQMNSL RAEDTAVYYCAR | SIPD------FDY | WGQGT LVTVS S |
| | VH3|3-21|D1|1-26|RF3|JH4 | | EVQLVES-GGGLVKPGGSLRL SCAASG-FTLS | S------YSMN | WVRQAPGK GLEWVS | SISSS----SSYIYYADS VKG | RFTISRDNAKNSLYLQMNSL RAEDTAVYYCAR | SSGSY | WGQGT LVTVS S |
| iPS:4 34405 | 21-225_68E6 | VH3|3-21|D1|1-26|RF3|JH4 | EVQLVES-GGGLVKPGGSLRL SCAASG-FTLS | S------FGMN | WVRQAPGK GLEWVS | VISRS----SSHIYYADS VKG | RFTISRDNAKNSLYLQMNSL RAEDTAVYYCAV | SSGS------FFDY | WGQGT LVTVS S |
| iPS:4 35595 | 21-225_160H4 | VH3|3-21|D1|1-26|RF3|JH4 | EVQLVES-GGGLVKSGGSLRL SCAASG-FTFS | S------YRMN | WVRQAPGK GLEWVS | SISGS----SSYIDYADS VKG | RFTISRDNAKNSLYLQMNSL RAEDTAVYYCAR | KSW-------FDY | WGQGT LVTVS S |
| iPS:4 35635 | 21-225_163F1 | VH3|3-21|D1|1-26|RF3|JH4 | EVQLVDS-GGGLVKPGGSLRL SCAASG-FTFS | S------YSMN | WVRQAPGK GLEWVS | SISGS----GSTIYYADS VKG | RFTISRDNSKNTLYLQMNSL SAEDTAVYYCTL | YSS-------SHY | WGQGT LVTVS S |
| | VH3|3-30.3|D2|2-15|RF3|JH4 | | QVQLVES-GGGLVQPGRSLRL SCAASG-FTFS | S------YAMH | WVRQAPGK GLEWVA | VIWYD----GSNKYYADS VKG | RFTISRDNSKNTLYLQMISL RAEDTAVYYCAR | DIPXXXX---ATIDY | WGQGT LVTVS S |
| iPS:4 34417 | 21-225_69C8 | VH3|3-30.3|D2|2-15|RF3|JH4 | QVQLVES-GGGLVQPGRSLRL SCAASG-FTFS | N------YAMH | WVRQAPGK GLEWVA | VIWYD----GSDKYYADS VKG | RFTISRDNSKNTLYLQMISL RAEDTAVYYCAR | DIPSM-----SAGDY | WGQGT LVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3J3-33D2J3-10JRF1/JH4 | | | | | | | | |
| iPS.4 34433 | VH3J3-33D3J3-10JRF1/JH4 | QVQLVES-GGGVVQPGRSLRL SCAASG-FTFS | S------YGML | WVRQAPGK GLEWVA | IIWYD------ ESNKYYADS VKG | RFTIISRDNSKNTLYLQMNSL RAEDTAVYYCAR | DLLD------ ------PRDY | WGQGT LVTVS S |
| VH3J3-23D6J6-13JRF1/JH4 | | | | | | | | |
| iPS.4 34467 | VH3J3-23D6J6-13JRF1/JH4 | EVQLLES-GGGWVQSGGSLRL SCAASG-FTFS | S------NAMS | WVRQAPGK GLEWVS | DISRS------ SGTTFYADS VKG | RFTISRDNSKNTLYLQMNSL RAEDTAVYYCAR | WDSSSWY- ------DVTPFDY | WGQGT LVTVS S |
| VH4J4-34D4J4-17JRF2/JH4 | | | | | | | | |
| iPS.4 34471 | VH4J4-34D4J4-17JRF2/JH4 | QVQLQQW-GAGLLKPSETLSL TCAVYG-GSLS | G------SYWS | WIRQPPGK GLEWIG | EINL------ SGSTNYNPS LKS | RVTISVDTSKSQFSLTLRSV TAADTAVYYCAR | DYGG------ ------LDY | WGQGT LVTVS S |
| iPS.4 34517 | VH4J4-34D4J4-17JRF2/JH4 | QVQLQQW-GAGLLKPSETLSL TCAVYG-GSFS | G------CYWS | WIRQPPGK GLEWIG | EINH------ SGRTNYNPS LKS | RVTISVDTSENQFSLKLSSV TAADTAVYYCAR | DYGG------ ------LDY | WGQGA LVTVS S |
| iPS.4 34519 | VH4J4-34D4J4-17JRF2/JH4 | QVQLQQW-GAGLLKPSETLSL TCAVYG-GSLS | G------SYWS | WIRQPPGK GLEWIG | EINL------ SGSTNYNPS LKS | RVTISVDISKSQFSLITRSV TAADTAVYYCAR | DYGG------ ------LDY | WGQGT LVTVS S |
| iPS.4 34571 | VH4J4-34D4J4-17JRF2/JH4 | QVQLQQW-GAGLLKPSETLSL TCAVYG-GSFS | G------CYWS | WIRQPPGK GLEWIG | EINH------ SGSTNYNPS LKS | RVTISVDTSENQFSLKLSSV TAADTAVYYCAR | DYGG------ ------LDY | WGQGT LVTVS S |
| iPS.4 34637 | VH4J4-34D4J4-17JRF2/JH4 | QVQLQQW-GAGLLKPSETLSL TCAVYG-GSLS | G------SYWS | WIRQPPGK GLEWIG | EINL------ SGSTNYNPS LKS | RVTISVDTSEKQFSLITLRSV TAADTAVYYCAR | DYGG------ ------LDY | WGQGT LVTVS S |
| iPS.4 34717 | VH4J4-34D4J4-17JRF2/JH4 | QVQLQQW-GAGLLKPSETLSL TCAVYG-GSFS | G------CYWS | WIRQPPGK GLEWIG | EINH------ SGRTNYNPS LKS | RVTISVDTSEKQFSLKLSSV TAADTAVYYCAR | DYGG------ ------LDY | WGQGT LVTVS S |
| iPS.4 34735 | VH4J4-34D4J4-17JRF2/JH4 | QVQLQQW-GAGLLKPSETLSL TCAVYG-GSFS | G------CYWS | WIRQPPGK GLEWIG | EINH------ SGSTNYNPS LKS | RVTISVDTSKNQFSLKLSSV TAADTAVYYCAR | DYGG------ ------LDY | WGQGT LVTVS S |

FIGURE 51 (Continued)

| | | | | | | | | | |
|---|---|---|---|---|---|---|---|---|---|
| iPS:4 34835 | 21-225_83B6 | VH4/4-34|D4|4-17|RF2|J H4 | QVQLQQW-GAGLLKPSETLSL TCAVYG-GSFS | G------CYWS | WIRQPPGK GLEWIG | EINH----- SGRTNYNPS LKS | RVTISVDTSENQFSLKLSSV TAADTAVYYCAR | DYGG------------LDY | WGQGT LVTVS S |
| iPS:4 34849 | 21-225_83C10 | VH4/4-34|D4|4-17|RF2|J H4 | QVQLQQW-GAGLLKPSETLSL TCTVYG-GSFS | G------YYWS | WIRQPPGK GLEWIG | EINH----- SGSTNYNPS LKS | RVTISVDTSKNQFSLKLSSV TAADTAVYYCAR | DYGG------------LDY | WGQGT LVTVS S |
| iPS:4 34891 | 21-225_85G6 | VH4/4-34|D4|4-17|RF2|J H4 | QVQLQQW-GAGLLKPSETLSL TCAVYG-GSFS | D------CYWS | WIRQPPGK GLEWIG | EINH----- SGSTNYNPS LKS | RVTISVDTSENQFSLKLSSV TAADTAVYYCAR | DYGG------------LDY | WGQGT LVTVS S |
| iPS:4 35183 | 21-225_93E9 | VH4/4-34|D4|4-17|RF2|J H4 | QVQLQQW-GAGLLKPSETLSL TCAVFG-GSFS | G------CYWS | WIRQPPGK GLEWIG | EINH----- SGRTNKFSLKLSSV LKS | RVTISVDTSENKFSLKLSSV TAADTAVYYCAR | DYGG------------LDY | WGQGT LVTVS S |
| iPS:4 35331 | 21-225_147G8 | VH4/4-34|D4|4-17|RF2|J H4 | QVQLQQW-GAGLLKPSETLSL TCCVFG-GSFS | A------YYWS | WIRQPPGK GLEWIG | EINH----- SGSTNYKPS LKS | RVTISVDTSKNQFSLKLSSV TAADTAVYYCAR | DYGV------------FDY | WGQGT LVTVS S |
| iPS:4 35995 | 21-225_192F8 | VH4/4-34|D4|4-17|RF2|J H4 | QVQLQQW-GAGLLKPSETLSL TCAVYG-GSFS | G------CYWS | WIRQPPGK GLEWIG | EINQ----- SGRSNYNPS LKS | RVTISVDTSINQFSLKRSV TAADTAVYYCAR | DYGG------------FDY | WGQGT LVTVS S |
| iPS:4 36027 | 21-225_193E6 | VH4/4-34|D4|4-17|RF2|J H4 | QVQLQQW-GAGLLKPSETLSL TCAVFG-GSFS | G------PYWS | WIRQPPGK GLEWIG | ESNH----- SGRTNYNPS LKS | RVTISVDTSKNQFSLRLSSV TAADTAVYYCAR | DYGV------------LDY | WGQGT LVTVS S |
| iPS:4 36080 | 21-225_195B1 | VH4/4-34|D4|4-17|RF2|J H4 | QVQLQQW-GAGLLKPSETLSL TCAVYG-GSFS | Y------YYWS | WIRQSPGK GLEWFG | EINH----- SGSTNYNPS LKS | RVTISVDTSKNQFSLKLRSV TAADTAVYYCAR | DYGA------------FDI | WGQGT LVTVS S |
| iPS:4 36232 | 21-225_201E1 | VH4/4-34|D4|4-17|RF2|J H4 | QVQLQQW-GAGLLKPSETLSL TCAVYG-GSFS | P------YYWS | WIRQPPGK GLEWIG | EINH----- SGSTNYNPS LKS | RVTISVDTSKNQFSLKLSSV TAADTAVYYCAR | DYGG------------LDY | WGQGA LVTVS S |
| iPS:4 36238 | 21-225_201B2 | VH4/4-34|D4|4-17|RF2|J H4 | QVQLQQW-GAGLLKPSETLSL TCAVFG-GSIS | V------YYWT | WIRQPPGK GLEWIG | EVNH----- SGSTNYNPS LKS | RVTISVDTSKNQFSLKLSSV TAADTAVYYCAR | DYGV------------FDY | WGQGT LVTVS S |
| iPS:4 36256 | 21-225_202D9 | VH4/4-34|D4|4-17|RF2|J H4 | QVQLQQW-GAGLLKPSETLSL TCAVFD-GSFS | P------YYWS | WIRQPPGK GLEWIG | EINH----- SGSTNYNPS LKS | RVTISVDTSKNQFSLKLSSV TAADTAVYYCAR | DYGG------------LDY | WGQGT LVTVS S |
| iPS:4 36302 | 21-225_205G7 | VH4/4-34|D4|4-17|RF2|J H4 | QVQLQQW-GAGLLKPSETLSL TCAVYG-GSFS | V------YYWS | WIRQPPGK GLEWIG | ESNQ----- SGRTYNPS LKS | RVTISVDTSKNQFSLNLISV TAADTAVYYCAR | DYGV------------FDY | WGQGT LVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 36310 | 21-225_202D11 | VH4/4-34/D4/4-17/RF2/JH4 | QVQLQQR-GAGLLKPSETLSL TCAVYG-GSFS | G------PYWS | WIRQPPGK GLEWIG | EINH------SGSTNYNPS LKS | RVTISVDTSKNQFSLKLSSV TAADTAVYYCAR | DYGV------------LDY | WGQGT LVTVS S |
| iPS:4 36336 | 21-225_208B5 | VH4/4-34/D4/4-17/RF2/JH4 | QVQLQQW-GAGLLKPSETLSL TCAVYG-GSFS | V------YYWT | WIRQPPGK GLEWIG | EINH------SGSTNYNPS LKS | RVTISVDTSKNQFSLKLSSV TAADTAVYYCAR | DYGV------------FDY | WGQGT LVTVS S |
| iPS:4 36340 | 21-225_208A9 | VH4/4-34/D4/4-17/RF2/JH4 | QVQLQQW-GAGLLKPSEPLSL TCAVYG-GSFS | V------SYWS | WIRQPPGK GLEWIG | EINH------SGRANYNPS LKS | RVTISIDTSKNQFSLKLSSV TAADTAVYYCAR | DYGV------------LDY | WGQGT LVTVS S |
| iPS:4 37340 | 21-225_75G9 | VH4/4-34/D4/4-17/RF2/JH4 | QVQLQQW-GAGLLKPSETLSL TCAVYG-GSFS | G------CYWS | WIRQPPGK GLEWIG | EINH------SGRTNYNPS LKS | RVTISVDTSEMQFSLKLSSV TAADTAVYYCAR | DYGG------------LDY | WGQGT LVTVS S |
| iPS:4 51122 | 21-225_200A1 | VH4/4-34/D4/4-17/RF2/JH4 | QVQLQQW-GAGLLKPSETLSL TCAVYG-GSFS | V------YYWS | WIRQPPGK GLEWIG | EINH------SGSTNYNPS LKS | RVTISLDTSKNQFSLKLSSV TAADTAVYYCAR | DYGV------------FDY | WGQGT LVTVS S |
| | Germline | | H_FR1 | H_CDR1 | H_FR2 | H_CDR2 | H_FR3 | H_CDR3 | H_FR4 |
| | VH3/3-33/D2/2-15/RF3/JH1 | | | | | | | | |
| iPS:4 34485 | 21-225_76D2 | VH3/3-33/D2/2-15/RF3/JH1 | QVQLVES-GGGVVQPGRSLRL SCAASG-FTFS | S------YGMH | WVRQAPGK GLEWVA | VIWYD------GSNKYYADS VKG | RFTISRDNSKNTLFLQMNSL RAEDTAVYYCAS | DRNIVG----------ATYFES | WGQGT LVTVS S |
| iPS:4 34537 | 21-225_74E11 | VH3/3-33/D2/2-15/RF3/JH1 | QVQLVES-GGGVVQPGRSLRL SCAASG-FTFS | S------YGMH | WVRQAPGK GLEWVA | VIWYD------GSNKYYADS VKG | RFTISRDNSKNTLFLQMNSL RAEDTAVYYCAS | DRNIVG----------ATYFES | WGQGT LVTVS S |
| iPS:4 34673 | 21-225_74E3 | VH3/3-33/D2/2-15/RF3/JH1 | QVQLVES-GGGVVQPGRSLRL SCTASG-FTFS | S------YGMH | WVRQAPGK GLEWVA | VIWYD------GSNKYYADS VKG | RFTISRDNSKNTLFLQMNSL RAEDTAVYYCAS | DRNIVG----------ATYFES | WGQGT LVTVS S |
| iPS:4 35221 | 21-225_95G2 | VH3/3-33/D2/2-15/RF3/JH1 | QVQLVES-GGGVVQPGRSLRL SCTASG-FTFS | S------YGMH | WVRQAPGK GLEWVA | VIWYD------GSNKYYADS VKG | RFTISRDNSKNTLFLQMNSL RAEDTAVYYCAS | DRNIVG----------ATYFES | WGQGT LVTVS S |
| | Germline | | H_FR1 | H_CDR1 | H_FR2 | H_CDR2 | H_FR3 | H_CDR3 | H_FR4 |
| | VH4/4-39/D7/7-27/RF1/JH5 | | | | | | | | |
| iPS:4 34503 | 21-225_74D7 | VH4/4-39/D7/7-27/RF1/JH5 | QLQLQES-GPGLVKPSETLSL TCSVSG-GSIF | RS-----SYYWG | WIRQPPGK GLEWIG | GIYY------SGSTSYNPS LKS | RVTISVDTSENQFSLKLSSV TAADTAVYYCAR | LRPNW-----------DFDY | WGQGT LVTVS S |

FIGURE 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| | VH3\|3-15\|D1\|1-1\|RF2\|JH4 | | | | | | | | |
| iPS:4 34531 | 21-225_76C9 | VH3\|3-15\|D1\|1-1\|RF2\|JH4 | EVQLVES-GGGLVKPGGSLRL SCAASG-FSFS | N------AWMN | WVRQAPGK GLEWVG | RIKNKA-DGGTDFAA PVKG | RFTISRDDSKNTLYLQMNSL KTEDTAVYYCTT | VGPT--------TDY | WGQGT LVTVS S |
| iPS:4 34633 | 21-225_74G8 | VH3\|3-15\|D1\|1-1\|RF2\|JH4 | EVQLVES-GGGLVKPGGSLRL SCAASG-FTFS | N------AWMN | WVRQAPGK GLEWVG | RIKNKA-DGGTDYAA PVKG | RFTISRDDSKNTLYLQMNSL KTEDTAVYYCTT | VGAT--------TDY | WGQGT LVTVS S |
| iPS:4 34671 | 21-225_74F4 | VH3\|3-15\|D1\|1-1\|RF2\|JH4 | EVQLVES-GGGLVKPGGSLRL SCAASG-FTFS | N------AWMN | WVRQAPGK GLEWVG | RIKNKI-DGGTDFYAA PVKG | RFTISRDDSKNTLYLQMNSL KTEDTAVYYCTT | VGAT--------TDY | WGQGT LVTVS S |
| iPS:4 37383 | 21-225_74H8 | VH3\|3-15\|D1\|1-1\|RF2\|JH4 | EVHLVES-GGGLVKPGGSLRL SCAASG-FTFS | N------AWMN | WVRQAPGK GLEWVG | RIKSKT-DGGTDYAA PVKG | RFTISRDDSKNTLYLQMNSL KTEDTAVYYCTT | VGAT--------TDY | WGQGT LVTVS S |
| | | Germline | H_FR1 | H_CDR1 | H_FR2 | H_CDR2 | H_FR3 | H_CDR3 | H_FR4 |
| | VH3\|3-33\|D5\|5-18\|RF3\|JH4 | | | | | | | | |
| iPS:4 34535 | 21-225_74C8 | VH3\|3-33\|D5\|5-18\|RF3\|JH4 | QVQLVES-GGGVVQPGRSLRL SCAASG-FTFS | S------YGMH | WVRQAPGK GLEWVA | VIWYD---GSNKNYADS VKG | RFTISRDNSKNTLYLQMNSL RAEDTAVYYCAR | DGSYGY--------DGLDY | WGQGT LVTVS S |
| iPS:4 34573 | 21-225_77E6 | VH3\|3-33\|D5\|5-18\|RF3\|JH4 | QVQLVES-GGGVVQSGRSLRL SCAASG-FTFS | S------YGMH | WVRQAPGK GLEWVA | VIWYD---GSNQNYADS VKG | RFTISRDNSKNTLFLQMNSL RAEDTAVYYCAR | DGSYGY--------DGLDY | WGQGT LVTVS S |
| iPS:4 34615 | 21-225_76C5 | VH3\|3-33\|D5\|5-18\|RF3\|JH4 | QVQLVES-GGGVVQPGRSLRL SCAASG-FTFS | S------YGMH | WVRQAPGK GLEWVA | VIWYD---GSNKNYADS VKG | RFTISRDNSKNTLYLQMNSL RAEDTAVYYCAR | DGSYGY--------DGLDY | WGQGT LVTVS S |
| iPS:4 34669 | 21-225_79F4 | VH3\|3-33\|D5\|5-18\|RF3\|JH4 | QVQLVES-GGGVVQSGRSLRL SCAASG-FTFS | N------YGMH | WVRQAPGK GLEWVA | VIWYD---GSNQNYADS VKG | RFTISRDNSKNTLFLQMNSL RAEDTAVYYCAR | DGSYGY--------DGLDY | WGQGT LVTVS S |
| iPS:4 34737 | 21-225_74G6 | VH3\|3-33\|D5\|5-18\|RF3\|JH4 | QVQLVES-GGGVVQPGRSLRL SCAASG-FTFS | S------YGMH | WVRQAPGK GLEWVA | VIWYD---GSNKNYADS VKG | RFTISRDNSKNTLYLQMNSL RAEDTAVYYCAR | DGSYGY--------DGLDY | WGQGT LVTVS S |
| iPS:4 34741 | 21-225_80C11 | VH3\|3-33\|D5\|5-18\|RF3\|JH4 | QVQLVES-GGGVVQPGRSLRL SCAASG-FTFS | S------YGMH | WVRQAPGK GLEWVA | VIWYD---GSNKNYADS VKG | RFTISRDNSKNTLSLQMNSL RAEDTAVYYCAR | DGSYGY--------DGLDY | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 34867 | 21-225_79A12 | VH3J3-33/D5J5-18|RF3/JH4 | QVQLVES-GGGLVQPGRSLRL SCAASG-FTFS | S------YGMH | WVRQAPGK GLEWVA | VIWYD-GSNRNYADS VKG | RFTISRDNSKNTLYLQMNSL RAEDTAVYYCAR | DGSYGY------DGLDY | WGQGT LVAVS S |
| | Germline | VH4J4-34|D3J3-10|RF2/JH6 | | | H_FR1 | H_CDR1 | H_FR2 | H_CDR2 | H_FR3 | H_CDR3 | H_FR4 |
| iPS:4 34539 | 21-225_74A2 | VH4J4-34/D3J3-10|RF2/JH6 | QVQLVQW-GAGLLKPSETLSL TCAVYG-GSFT | D------YYWS | WIRQPPGK GLEWIG | EINH------SGDTNYNPS LKS | RVTISVDTSKNQFSLKLSSV TAADTAVYYCAR | EFPYSGSY------LYYYGMDV | WGQGT TVTVS S |
| iPS:4 37248 | 21-225_97H3 | VH4J4-34/D3J3-10|RF2/JH6 | QVQVQQW-GAGLLKPSETLSL TCAVYG-GSFT | D------YYWS | WIRQPPGK GLEWIG | EINH------SGDTNYNPS LKS | RVTISVDTSKNQFSLKLSSV TAADTAVYYCAR | EFPYSGSY------LYYYGMDV | WGQGT TVTVS S |
| iPS:4 37320 | 21-225_75A1 | VH4J4-34/D3J3-10|RF2/JH6 | QVQVQQW-GAGLLKHSETLSL TCAVYG-GSFT | D------YYWS | WIRQPFGK GLEWIG | EINH------SGDTNYNPS LKS | RVTISVDTSKNQFSLKLSSV TAADTAVYYCAR | EFPYSGSY------LYYYGMDV | WGQGT TVTVS S |
| | Germline | VH3J3-13/D3J3-9|RF1/JH6 | | | H_FR1 | H_CDR1 | H_FR2 | H_CDR2 | H_FR3 | H_CDR3 | H_FR4 |
| iPS:4 34563 | 21-225_75D8 | VH3J3-13/D3J3-9|RF1/JH6 | EVQLVES-GGGLVQPGGSLRL SCAASG-FTFS | N------YDMH | WVRQATGK GLEWVS | AIGT------AGDTYYPGS VKG | RFTISRENAKNSLYLQMNSL RAGDTAVYYCAR | VLDYGDSLG------YYYYGMDV | WGQGT TVTVS S |
| iPS:4 35009 | 21-225_89G4 | VH3J3-13/D3J3-9|RF1/JH6 | EVQLVES-GGGLVQPGGSLRL SCAASG-FTFS | S------YDMH | WVRQATGK GLEWVS | AIGT------AGDTYYPGS VKG | RFTISRENAKNSLYLQMNSL RAGDTAVYYCAR | ALDYGDSLG------YYYYGMDV | WGQGT TVTVS S |
| iPS:4 35059 | 21-225_90C11 | VH3J3-13/D3J3-9|RF1/JH6 | EVQLVES-GGGLVQPGGSLRL SCAASG-FTFS | N------YDMH | WVRQATGK GLEWVS | AIGT------AGDTYYPGS VKG | RFTISRENAKNSLYLQMNSL RAGDTAVYYCAR | VLDYGDSLG------YYYYGMDV | WGQGT TVTVS S |
| iPS:4 35103 | 21-225_92B2 | VH3J3-13/D3J3-9|RF1/JH6 | EVQLVES-GGGLVQPGGSLRL SCAASG-FTFS | N------YDMH | WVRQATGK GLEWVS | AIGT------AGDTYYPGS VKG | RFTISRENAKNSLYLQFCAR RAGDTAVYYCAR | ALDYGDSLG------YYYYGMDV | WGQGT TVTVS S |
| iPS:4 37371 | 21-225_74D8 | VH3J3-13/D3J3-9|RF1/JH6 | EVQLVES-GGGLVQPGGSLRL SCAASG-FTFS | N------YDMH | WVRQATGK GLEWVS | AIGT------AGDTYYPGS VKG | RFTISRENAKNSLYLQMNSL RAGDTAVYYCAR | VLDYGDSLG------YYYYGMDV | WGQGT TVTVS S |
| | Germline | VH1J1-08|D1J1-26|RF3/JH4 | | | H_FR1 | H_CDR1 | H_FR2 | H_CDR2 | H_FR3 | H_CDR3 | H_FR4 |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 34711 | 21-225_80H3 | VH1|1-08|D1|1-26|RF3|JH4 | QVQLVQS-GAEVKKPGASVKV SCKASG-YTLT | N------YDIN | WVRQATGQ GLEWMG | WMNPN---- SGNTGYAQK FQG | RVTMTRNTSISTAYMELSSL RSEDTAVYYCGS | TSGWN------FFDY | WGQGT LVTVS S |
| iPS:4 34901 | 21-225_85H9 | VH1|1-08|D1|1-26|RF3|JH4 | QVQLVQS-GAEVKKPGASVKV SCKASG-YTLT | N------YDIN | WVRQATGQ GLEWMG | WMNPN---- SGNTGYAQK FQG | RVTMTRNTSISTAYMELSSL RSEDTAVYYRGS | TSGWN------FFDY | WGQGT LVTVS S |
| iPS:4 35167 | 21-225_92F12 | VH1|1-08|D1|1-26|RF3|JH4 | QVQLVQS-GAEVKKPGASVKV SCKASG-YTLT | N------YDIN | WVRQATGQ GLEWMG | WMNPN---- SGNTGYAQK FQG | RVTMTRNTSISTAYMELSSL RSEDTAVYYRGS | TSGGK------FFDY | WGQGT LVTVS S |
| iPS:4 35215 | 21-225_94E12 | VH1|1-08|D1|1-26|RF3|JH4 | QVQLVQS-GAEVKKPGASVKV SCKASG-YTLT | N------YDIN | WVRQATGQ GLEWMG | WMNPN---- SGNTGYAQK FQG | RVTMTRNTSISTAYMELSSL RSEDTAVYYRGS | TSGWN------FFDY | WGQGT LVTVS S |
| iPS:4 37356 | 21-225_74B1 | VH1|1-08|D1|1-26|RF3|JH4 | QVQLVQS-GAEVKKPGASVKV SCKASG-YTLT | N------YDIN | WVRQATGQ GLEWMG | WMNPN---- SGNTGYAQK FQG | RVTMTRNTSISTAYMELSSL RSEDTAVYYCGS | TSGWN------FFDY | WGQGT LVTVS S |
| | Germline | VH1|1-08|D1|1-1|RF1|JH6 | | | | | | | |
| iPS:4 34815 | 21-225_74A11 | VH1|1-08|D1|1-1|RF1|JH6 | QVQLVQS-GAEVKKPGASVKV SCKASG-YTFT | S------YDIN | WVRQATGQ GLEWMG | WMNPN---- SGNTGYAQK FQG | RVTMTWNTSISTAYMELSSL RSEDTAVYYCAR | GFYDTLTGS------GYYYVMDV | WGQGT TVTVS S |
| iPS:4 35253 | 21-225_96A4 | VH1|1-08|D1|1-1|RF1|JH6 | QVQLVQS-GAEVKKPGASVKV SCKASG-YTFT | S------YDIN | WVRQATGH GLEWMG | WMNPN---- SGNTGYAQK FQG | RVTMTWNTSISTAYMELSSL RSEDTAVYYCAR | GFYDTLTGS------GYYYVMDV | WGQGT TVTVS S |
| | Germline | VH1|1-08|D3|3-22|RF2|JH6 | | | | | | | |
| iPS:4 34977 | 21-225_88A5 | VH1|1-08|D3|3-22|RF2|JH6 | QVQLVQS-GAEVKKPGASVKV SCKASG-YTFT | S------YDIN | WVRQATGQ GLEWMG | WMNPN---- SKNTGYAQK FQG | RVTMTWNTSIRTAYMELSSL RSEDTAVYYCAR | GFYDFLTGYS------PTYYYYDMDV | WGQGT TVTVS S |
| iPS:4 35259 | 21-225_96C6 | VH1|1-08|D3|3-22|RF2|JH6 | QVQLVQS-GAEVKKPGASVKV SCKASG-YTFT | S------YDIN | WVRQATGQ GLEWMG | WMNPN---- SKNTGYAQK FQG | RVTMTWNTSISTAYMELSSL RSEDTAVYYCAR | GGYDVLPGN------NYYEMDV | WGQGT TVTVS S |
| | Germline | VH3|3-33|D2|2-15|RF3|JH3 | | | | | | | |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 35291 | 21-225_146E1 | VH3/3-33/D2/2-15/RF3/JH3 | QVQLVES-GGGVVQPGRSLRLSCAASG-FTFS | S------YGMH | WVRQAPGK GLEWVA | IIWYD----GSNKYYADS VKG | RFTISRDNSKNTLFLQMNSL RAEDTAVYYCAR | DRLVGAT-------RDAFDI | WGQGT MVTVS S |
| iPS:4 36360 | 21-225_210H11 | VH3/3-33/D2/2-15/RF3/JH3 | QVQLVES-GGGVVQPGRSLRLSCAASG-FTFS | S------HGMH | WVRQAPGK GLEWVA | VTWYD----GSDKYYADS VKG | RFTISRDNSKNTLYLQMNSL RAEDTAVYYCAR | DRLVGAT-------YDAFDI | WGQGT MVTVS S |
| iPS:4 36370 | 21-225_211A6 | VH3/3-33/D2/2-15/RF3/JH3 | QVQLVES-GGGVVQPGRSLRLSCAASG-FTFS | S------YGMH | WVRQAPGK GLEWVA | VIWYD----GSNKYYADS VKG | RFTISRDNSKNTLYLQMNSL RAEDTAVYYCAR | DRTVGY-------DGFDI | WGQGT MVTVS S |
| iPS:4 36392 | 21-225_213B3 | VH3/3-33/D2/2-15/RF3/JH3 | QVQLVES-GGGVVQPGRSLRLSCAASG-FTFS | S------YGMH | WVRQAPGK GLEWVA | VIWYD----GSNNYADS VKG | RFTISRDNSKNTLYLQMNSL RAEDTAVYYCAR | DRTVGY-------DGFDI | WGQGT MVTVS S |
| iPS:4 36406 | 21-225_214E4 | VH3/3-33/D2/2-15/RF3/JH3 | QVQLVES-GGGVVQPGRSLRLSCAASG-FTFS | S------YGMH | WVRQAPGK GLEWVA | VIWYD----GSNNYADS VKG | RFTISRDNSKNTLYLQMNSL RAEDTAVYYCAR | DRTVGY-------DGCDI | WGQGA MVTVS S |
| iPS:4 37326 | 21-225_75C10 | VH3/3-33/D2/2-15/RF3/JH3 | QVQLVES-GGGVVQPGRSLRLSCAASG-FTFS | S------YGMH | WVRQAPGK GLEWVA | VIWYD----GSDKYYADS VKG | RFTISRDNSKNTLYLQMNSL RAEDTAVYYCAR | DRLVGAT-------VDAFDI | WGQGT MVTVS S |
| | Germline | VH4/4-39/D7/7-27/RF1/JH4 | H_FR1 | H_CDR1 | H_FR2 | H_CDR2 | H_FR3 | H_CDR3 | H_FR4 |
| iPS:4 35293 | 21-225_146F1 | VH4/4-39/D7/7-27/RF1/JH4 | QLQLQES-GPGLVKPSETLSLTCTVSG-GSIS | RS----SYYWG | WIRQPPGK GLEWIG | SIYY-----SGSTSYNPS LKS | RVTISVDTSKNQFSLKLSSV TAADTAVFYCAR | LDLLW-------SFDY | WGQGT LVTVS S |
| iPS:4 35361 | 21-225_148E11 | VH4/4-39/D7/7-27/RF1/JH4 | QLQLQES-GPGLVKPSETLSLTCTVSG-VSIS | RS----SYYWG | WIRQPPGK GLEWIG | SIYY-----SGSTSYNPS LKS | RVTISVDTSKNQFSLKLSSV TAADTAVFYCAR | LDPQW-------SFDY | WGQGT LVTVS S |
| iPS:4 35449 | 21-225_152H9 | VH4/4-39/D7/7-27/RF1/JH4 | QLQLQES-GPGLVKPSETLSLTCTVSG-GSIS | RS----SYYWG | WIRQPPGK GLEWIG | SIYY-----SGSASYNPS LKS | RVTISVDTSKNQFSLKLSSV TAADTAVFYCAR | LDLQW-------SFDF | WGQGT LVTVS S |
| iPS:4 35499 | 21-225_156G1 | VH4/4-39/D7/7-27/RF1/JH4 | QLQLQES-GPGLVKPSETLSLTCTVSG-GSIS | RS----SYYWG | WIRQPPGK GLEWIG | SIYY-----SGSTSYNPS LKS | RVTISVDTSKNQFSLKLSSV TAADTAVFYCAR | LDLQW-------SFDF | WGQGT LVTVS S |
| iPS:4 35587 | 21-225_160H3 | VH4/4-39/D7/7-27/RF1/JH4 | QLQLQES-GPGLVKPSETLSLTCTVSG-GSIS | RS----SYYWG | WIRQPPGK GLEWIG | SIYY-----SGSTSYNPS LES | RVTISVDTSKNQFSLKLSSV TAADTAVFYCAR | LSQRW-------DFDY | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 03868 | 21-225_19D11 | VH4\|4-39\|D7\|7-27\|RF1\|JH4 | QLQLQES-GPGLVKPSETLSL TCTVSG-GSIS | RS----SYYWG | WIRQPPGK GLDWIG | SIYY------SGSANYNPS LKS | RVTISVDTSKNQFSLKLSSV TAADAAVYYCAR | LDRGW-------SFDY | WGQGT LVTVS S |
| | Germline | VH3\|3-23\|D4\|4-17\|RF2\|JH5 | EVQLLES-GGGLVQPGGSLRL SCAASG-FTFS | S------YAMS | WVRQAPGK GLEWVS | AISGS------GKNTFYADS VKG | RFTISRDNSKNTLYLQMNSL RAEDTAVYYCAK | | |
| iPS:4 35295 | 21-225_146H1 | VH3\|3-23\|D4\|4-17\|RF2\|JH5 | EVQLLES-GGGLVQPGGSLRL SCAASG-FTFS | S------YAMS | WVRQAPGK GLEWVS | AISGR------GGNTFYADS VKG | RFTISRDNSKNTLYLQMNSL RAEDTAVYYCAK | RVTDYGG-------NDWFDP | WGQGT LVTVS S |
| iPS:4 35307 | 21-225_146E9 | VH3\|3-23\|D4\|4-17\|RF2\|JH5 | EVQLLES-GGGLVQPGGSLRL SCAASG-FTFS | S------YAMS | WVRQAPGK GLEWVS | AISGR------GGNTFYADS VKG | RFTISRDNSKKTLYLQMNSL RAEDTAVYYCAK | RVTDYGG-------NDWFDP | WGQGT LVTVS S |
| iPS:4 35347 | 21-225_148C4 | VH3\|3-23\|D4\|4-17\|RF2\|JH5 | EVQLLES-GGGLVQPGGSLRL SCAASG-FTFS | S------YAMN | WVRQAPGK GLEWVS | AISGS------GGNTFYADS VKG | RFTISRDNSKNTLYLQMNSL RAEDTAVYYCAK | RVTDYGG-------NDWFDP | WGQGT LVTVS S |
| iPS:4 35355 | 21-225_148H9 | VH3\|3-23\|D4\|4-17\|RF2\|JH5 | EVQLLES-GGGLVQPGGSLRL SCAASG-FTFS | S------YAMS | WVRQAPGK GLEWVS | AISGR------GGNTFYADS VKG | RFTISRDNSKNTLYLQMNSL RAEDTAVYYCAK | RVTDYGG-------NDWFDP | WGQGT LVTVS S |
| iPS:4 35371 | 21-225_149A3 | VH3\|3-23\|D4\|4-17\|RF2\|JH5 | EVQLLES-GGGLVQPGGSLRL SCAASG-FTFS | N------YAMT | WVRQAPGK GLEWVS | AISGR------GGNTFYADS VKG | RFTISRDNSKRTLNLQMSSL RAEDTAVYYCTK | RVTDYGG-------NDWFDP | WGQGT LVTVS S |
| iPS:4 35415 | 21-225_150C11 | VH3\|3-23\|D4\|4-17\|RF2\|JH5 | EVQLLES-GGGLVQPGGSLRL SCAASG-FTFS | S------YAMN | WVRQAPGK GLEWVS | AISGS------GGNTFYADS VKG | RFTISRDNSKNTLYLQMNSL RAEDTAVYYCAK | RVTDYGG-------NDWFDP | WGQGT LVTVS S |
| iPS:4 35419 | 21-225_150C12 | VH3\|3-23\|D4\|4-17\|RF2\|JH5 | EVQLLES-GGGLVQPGGSLRL SCAASG-FTFS | S------YAMS | WVRQAPGK GLEWVS | AISGR------GGNTFYADS VKG | RFTISRDNSKNTLYLQMNSL RAEDTAVYYCAK | RVTDYGG-------NDWFDP | WGQGT LVTVS S |
| iPS:4 35425 | 21-225_151B12 | VH3\|3-23\|D4\|4-17\|RF2\|JH5 | EVQLLES-GGGLVQPGGSLRL SCAASG-FTFS | S------YAMN | WVRHAPGK GLEWVS | AISGS------GKNTFYADS VKG | RFTISRDNSKNTLYLQMNSL RAEDTAVYYCAK | RVTDYGG-------NDWFDP | WGQGT LVTVS S |
| iPS:4 35431 | 21-225_152D2 | VH3\|3-23\|D4\|4-17\|RF2\|JH5 | EVQLLES-GGGLVQPGGSLRL SCAASG-FTFS | S------YAMS | WVRQAPGK GLEWVS | AISGR------GGNTFYADS VKG | RFTISRDNSKNTLYLQMNSL RAEDTAVYYCAK | RVTDYGG-------NDWFDP | WGQGT LVTVS S |
| iPS:4 35439 | 21-225_152G4 | VH3\|3-23\|D4\|4-17\|RF2\|JH5 | EVQLLES-GGGLVQPGGSLRL SCAASG-FTFS | S------YAMS | WVRQAPGK GLEWVS | AISGR------GGNTFYADS VKG | RFTISRDNSKNTLYLQMNSL RAEDTAVYYCAK | RVTDYGG-------NDWFDP | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35455 | 21-225_152B11 | VH3|3-23|D4|4-17|RF2|J H5 | EVQLLES-GGGLVQPGGSLRL SCAASG-FTFS | S-------YAMN | WVRQAPGK GLEWVS | AISGR----GGNTFYADS VKG | RFTISRDNSKNTLYLQMNSL RAEDTAVYYCAK | RVTDYGG------------NDWFDP | WGQGT LVTVS S |
| iPS:4 35487 | 21-225_155C4 | VH3|3-23|D4|4-17|RF2|J H5 | EVQLLES-GGGLVQPGGSLRL SCAASG-FTFS | S-------YAMS | WVRQAPGK GLEWVS | AISGR----GGNTFYADS VKG | RFTISRDNSKNTLYLQMNSL RAEDTAVYYCAK | RVTDYGG------------NDWFDP | WGQGT LVTVS S |
| iPS:4 35503 | 21-225_156E4 | VH3|3-23|D4|4-17|RF2|J H5 | EVQLLES-GGGLVQPGGSLRL SCAASG-FTFS | S-------YAMS | WVRQAPGK GLEWVS | AISGR----GGNTFYADS VKG | RFTISRDNSKNTLYLQMNSL RAEDTAVYYCAK | RVTDYGG------------NDWFDP | WGQGT LVTVS S |
| | Germline | | H_FR1 | H_CDR1 | H_FR2 | H_CDR2 | H_FR3 | H_CDR3 | H_FR4 |
| VH3|3-30|D3|3-22|RF3|JH5 | | | | | | | | | |
| iPS:4 35297 | 21-225_146B3 | VH3|3-30|D3|3-22|RF3|J H6 | QVQLVES-GGGLVQPGRSLRL SCAASG-FTFS | S-------YGMH | WVRQAPGK GLEWVA | VIWYD------GSYKYYADS VKG | RFTISRDNSKNTLDLQMNSL RAEDTAVYYCVK | MGIEVAVD------------YYYGMDV | WGQGT TVTVS S |
| | Germline | | H_FR1 | H_CDR1 | H_FR2 | H_CDR2 | H_FR3 | H_CDR3 | H_FR4 |
| VH4|4-30.1|D1|1-1|RF1|JH3 | | | | | | | | | |
| iPS:4 35301 | 21-225_146C4 | VH4|4-30.1|D1|1-1|RF1|JH 3 | QVQLQES-GPGLVKPSQTLSL NCTVSG-GSIS | NS-----GYYWS | WIRQHPGK GLEWIG | YSIY-----SGSTYYNPS LKS | RITISVDTGMNQFSLKLISV TAADTAVYYCAR | GKYNGN-------------HAPDI | WGQGT MVTVS S |
| | Germline | | H_FR1 | H_CDR1 | H_FR2 | H_CDR2 | H_FR3 | H_CDR3 | H_FR4 |
| VH3|3-21|D6|6-13|RF1|JH4 | | | | | | | | | |
| iPS:4 35313 | 21-225_146G11 | VH3|3-21|D6|6-13|RF1|J H4 | EVQLVES-GGGLVKPGGSLRL SCAASG-FTFS | S-------YSMN | WVRQAPGK GLEWVS | SISGS----GSYTYYADS VKG | RFTISRDNAKNSLYLQMNSL RAEDTAVYYCAR | GSSSS--------------GFEY | WGQGT LVTVS S |
| iPS:3 93808 | 21-225_1A2 | VH3|3-21|D6|6-13|RF1|J H4 | EVQLVES-GGGLVKPGGSLRL SCAASG-FTFS | S-------YTMN | WVRQAPGK GLEWVS | SISGS----SSYIYYADS VKG | RFTISRDNAKNSLYLQMNSL RAEDTAVYYCAR | GSSSS--------------GFDY | WGQGT LVTVS S |
| iPS:3 93958 | 21-225_5H2 | VH3|3-21|D6|6-13|RF1|J H4 | EVQLVES-GGGLVKPGGSLRL SCAASG-FTFS | S-------YTMN | WVRQAPGK GLEWVS | SISGS----SSYIYYADS VKG | RFTISRAWAKNSLYLQMNSL RAEDTAVYYCAR | GSSSS--------------GFDY | WGQGT LVTVS S |
| | Germline | | H_FR1 | H_CDR1 | H_FR2 | H_CDR2 | H_FR3 | H_CDR3 | H_FR4 |
| VH4|4-30.4|D5|5-18|RF2|JH5 | | | | | | | | | |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35317 | VH4|4-30.1|D5|5-18|RF3|J H6 | QVLLQES-GPGLVKPSQTLSL TCAVSG-GPIS | SG----DYYWN | WIRQRPGK GLEWIG | FIYY----TGSTYYNPS LKS | RVSISRDTSENQFSLNLSSV TAADTAVYYCAR | GGAYY3-------YYGMDV | WGQGT TVTVS S |
| | Germline VH4|4-30.1|D5|5-24|RF3|JH3 | QVQLQES-GPGLVKPSQTLSL ICTVSG-GSIS | SG----GYYWS | WIRQPPGK GLEWIG | YIYY----SGSTYYNPS LKS | RVTISVDTSKNQFSLKLSSV TAADTAVYYCAR | ARSTAY | WGQGT TVTVS S |
| iPS:4 35319 | VH4|4-30.1|D5|5-24|RF3|J H3 | QVQLQES-GPGLVKPSQTLSL ICTVSG-GSIT | NS----GYYYS | WIRQHPGK GLEWIG | YIYY----SGGTYYNPS LKS | RITISVDTSNNQFSLKLSSV TAADTAVYYCAR | GGYNWN-------HAFDF | WGQGT MVTVS S |
| iPS:4 35383 | VH4|4-30.1|D5|5-24|RF3|J H3 | QVQLQES-GPGLVKPSQTLSL NCTVSG-GSIS | NS----GYYWS | WIRQHPGK GLEWIG | YSYY----SGSTYYNPS LKS | RITISVDTSNNQFSLKLSSV TAADTAVYYCAR | GGYNWN-------HAFDI | WGQGT MVTVS S |
| iPS:4 35443 | VH4|4-30.1|D5|5-24|RF3|J H3 | QVQLQES-GPGLVKPSQTLSL NCTVSG-GSIS | NS----GYYWS | WIRQHPGK GLEWIG | YSYY----SGSTYYNPS LKS | RITISVDTSNNQFSLKLSSV TAADTAVYYCAR | GGYNWN-------HAFDI | WGQGT MVTVS S |
| iPS:4 35465 | VH4|4-30.1|D5|5-24|RF3|J H3 | QVQLQES-GPGLVKPSQTLSL NCTVSG-GSIS | NS----GYYWS | WIRQHPGK GLEWIG | YSYY----SGSTYYNPS LKS | RITISVDTSNNQFSLKLSSV TAADTAVYYCAR | GGYNWN-------HAFDI | WGQGT MVTVS S |
| iPS:4 42568 | VH4|4-30.1|D5|5-24|RF3|J H3 | QVQLQES-GPGLVKPSQTLSL NCTVSG-GSIS | NS----GYYWS | WIRQHPGK GLEWIG | YSYY----SGSTYYNPS LKS | RITISVDTSNNQFSLKLSSV TAADTAVYYCAR | GGYNWN-------HAFDI | WGQGT MVTVS S |
| | Germline VH3|3-48|D4|4-11|RF2|JH4 | | | | | | | |
| iPS:4 35333 | VH3|3-48|D4|4-11|RF2|J H4 | EVQLVES-GGGLVQPGGSLRL SCAASG-FTFS | S------YSMN | WVRQAPGK GLEWVS | SISGR----NTTIYYADS VKG | RFTISRDNAKNSLYLQMNSL RDEDTAVYYCSR | DRG-----------SC | WGQGT LVTVS S |
| iPS:4 35637 | VH3|3-48|D4|4-11|RF2|J H4 | EVQLVES-GGGLVQPGGSLRL SCAASG-FTFS | S------YSMN | WVRQAPGK GLEWVS | STSGS----STYIYYADS VKG | RFTISRDMARNLVYLQMNSL RPEDTAVYYCAR | DRG-----------SL | WGQGT LVTVS S |
| | Germline VH1|1-02|D2|2-15|RF3|JH4 | | | | | | | |
| iPS:4 35351 | VH1|1-02|D2|2-15|RF3|J H4 | QVQLVQS-GAEVKKPGASVKV SCKASG-YTFT | G------YYMH | WVRQAPGQ GLEWMG | WIHPN----NGGTNVAQT FQG | RVIMTRDTSISTVYMELSRL RSDDTAVYYCAR | DPVVVP-------AAPFDY | WGQGT LVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| | VH4J4-30.1|D5|5-12|RF3|JH6 | QVQLQES-GPGLVKPSQTLSL TCTVSG-GSIS | NG----GYYWN | WIRQHPGK GLEWIG | YIYY----SGSTYYNPS LKS | QITISVDTSKDQFSLRLSSV TAEDTAVYYCAR | YSTYDY------YYGMDV | WGQGT TVTVS S |
| iPS:4 35363 21-225_148F12 | VH4J4-30.1|D5|5-12|RF3|JH6 | QVQLQES-GPGLVKPSQTLSL TCTVSG-GSIS | NG----GYYWN | WIRQHPGK GLEWIG | YIYY----SGSTYYNPS LKS | QITISVDTSKDQFSLRLSSV TAEDTAVYYCAR | YSTYDY------YYGMDV | WGQGT TVTVS S |
| iPS:4 35377 21-225_149G5 | VH4J4-30.1|D5|5-12|RF3|JH6 | QVQLQES-GPGLVKPSQTLSL TCTVSG-GSIS | NG----GYYWN | WIRQHPGK GLEWIG | YIYY----SGSTYYNPS LKS | RVTISVDTSKDQFSLRLSSV TAAMTAVYYCAR | YSTYDY------YYGMDV | WGQGT TVTVS S |
| | VH3J3-48|D6|6-6|RF2|JH4 | | | | | | | |
| iPS:4 35409 21-225_150G8 | VH3J3-48|D6|6-6|RF2|JH4 | EVQLVES-GGGLVQPGGSLRL SCAASG-FTFS | T-----YSMT | WVRQAPGK GLDWVS | YISRS----SSTIYYADS VKG | RFSISRDNAKNSLYLQMNSL RDEDTALYYCAR | SAFS-------PFDY | WGQGT LVTVS S |
| | VH3J3-30.3|D5|5-18|RF2|JH5 | | | | | | | |
| iPS:4 35427 21-225_151C9 | VH3J3-30.3|D5|5-18|RF2|JH5 | QVQLVES-GGGVVQPGRSLRL SCAASG-FTFS | S-----YGMH | WVRQAPGK GLEWVS | VISID----GSNKYYADS VKG | RFTISRDNSKNTLYLQMNSL RAEDTAVYYCAR | GVLLWFGE---LEDDWFDP | WGQGT LVTVS S |
| | VH3J3-33|D3|3-22|RF2|JH4 | | | | | | | |
| iPS:4 35441 21-225_152F6 | VH3J3-33|D3|3-22|RF2|JH4 | QVQLVES-GGGVVQPGRSLRL SCAASG-FTFS | S-----YGMH | WVRQAPGK GLEWVA | IIWYD----GSYKYYADS VKG | RFTISRDNSKNTLYLQMNSL RAEDTAVYYCAR | EGYDFW-----SGYLGY | WGQGT LVTVS S |
| iPS:4 35457 21-225_152C11 | VH3J3-33|D3|3-22|RF2|JH4 | QVQLVES-GGGVVQPGRSLRL SCAASG-FTFR | N-----YGMH | WVRQAPGK GLEWVA | IIWYD----GSNKYYADS VKG | RFTISRDNSKNTLYLQMNSL RAEDTAVYYCAR | EAYDFW-----SGYFDY | WGQGT LVTVS S |
| iPS:4 35463 21-225_153D2 | VH3J3-33|D3|3-22|RF2|JH4 | QVQLVES-GGGVVQPGRSLRL SCAASG-FTFS | S-----YGMH | WVRQAPGK GLEWVA | IIWYD----GSYKYYADS VKG | RFTISRDNSKNTVYLQMNSL RAEDTAVYYCAR | EGYDFW-----SGYLGY | WGQGT LVTVS S |
| iPS:4 35531 21-225_157G8 | VH3J3-33|D3|3-22|RF2|JH4 | QVQLVES-GGGVVQPGRSLRL SCAASG-FTFS | N-----YGMH | WVRQAPGK GLEWVA | IIWYD----GSYKYYADS VKG | RFTISRDNSKNTLYLQMNSL RAEDTAVYYCAR | EGYDFW-----SGFFDS | WGQGT LVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 35577 | 21-225_160B1 | VH3j3-33jD3j3-22jRF2jJH4 | QVQLVES-GGGVVQPGRSLRLSCAASG-FTFS | S------YGMH | WVRQAPGK GLEWVA | VINWYD----GSYKYYADS VKG | RFTISRDNSKNTLYLQMNSL RAEDTAVYYCAR | EAYDFW------SGYYDY | WGQGT LVTVS S |
| iPS:4 35723 | 21-225_172B7 | VH3j3-33jD3j3-22jRF2jJH4 | QVQLVES-GGGVVQPGRSLRLSCAASG-FTFS | N------YGMH | WVRQAPGK GLEWVA | IIWYD----GSNKYYVDS VKG | RFTISRDNSKNTLYLQMNSL RAEDTAVYYCAR | EAYDFW------SGYWDY | WGQGT LVTVS S |
| iPS:4 35731 | 21-225_173A11 | VH3j3-33jD3j3-22jRF2jJH4 | QVQLVES-GGGVVQPGRSLRLSCAASG-FTFS | S------YGMH | WVRQAPGK GLEWVA | IIWYD----GSNKYYADS VKG | RFTISRDNSKNTLFLQMNSL RAEDTAVYYCAR | EAYDFW------SGFFDS | WGQGT LVTVS S |
| iPS:4 35781 | 21-225_178G10 | VH3j3-33jD3j3-22jRF2jJH4 | QVQLVES-GGGVVQPGRSLRLSCAASG-FTFS | T------YGMH | WVRQAPGK GLEWVA | VINWYD----GSNKYYADS VKG | RFTISRDNFKNTLYLQMNSL RAEDTAVYYCAR | ERYDFW------SGHFCY | WGQGT LVTVS S |
| iPS:4 35899 | 21-225_188G11 | VH3j3-33jD3j3-22jRF2jJH4 | QVQLVES-GGGVVQPGRSLRLSCAASG-FTFS | S------YGMH | WVRQAPGK GLEWVT | IIWYD----GSNKYYADS VKG | RFTISRDNSKNTLFLQMNSL RAEDTAVYYCAR | ERYDFW------SGHFDY | WGQGT LVTVS S |
| iPS:4 36602 | 21-225_226E7 | VH3j3-33jD3j3-22jRF2jJH4 | QVQLVES-GGGVVQPGRSLRLSCAASG-FTFS | T------YGMH | WVRQAPGK GLEWVA | IIWYD----GSNKYYADS VKG | RFTISRDNFKNTLYLQMHSL RAEDTAVYYCAR | ENYDFW------SGYYGY | WGQGT LVTVS S |
| iPS:3 92930 | 21-225_25H9 | VH3j3-33jD3j3-22jRF2jJH4 | QVQLVES-GGGVVQPGRSLRLSCAASG-FPFN | N------YGMH | WVRQAPGK GLEWVS | IIWYD----GSYKYYADS VKG | RFTISRDNSKNTLFLQMNSL RAEDTAVYYCAR | EGYDFW------SGFFDS | WGQGT LVTVS S |
| | Germline | | H_FR1 | H_CDR1 | H_FR2 | H_CDR2 | H_FR3 | H_CDR3 | H_FR4 |
| VH3j3-23jD1j1-26jRF2jJH4 | | | | | | | | | |
| iPS:4 35479 | 21-225_154E9 | VH3j3-23jD1j1-26jRF2jJH4 | EVKLLES-GGGLVQPGGSLRLSCAASG-FTFS | S------YAMS | WVRQAPGK GLEWVS | AISGR----GGNTFYADS VKG | RFTISRDNSKNTLFLQMNSL RAEDTAVYYCAR | RGFRFLE-----WLGGPDY | WGQGT LVTVS S |
| | Germline | | H_FR1 | H_CDR1 | H_FR2 | H_CDR2 | H_FR3 | H_CDR3 | H_FR4 |
| VH3j3-23jD5j5-18jRF3jJH4 | | | | | | | | | |
| iPS:4 35497 | 21-225_159H9 | VH3j3-23jD5j5-18jRF3jJH4 | EVQLLES-GGGLVQPGGSLRLSCAASG-FTFS | S------YAMH | WVRQAPGK GLEWVS | TISGR----GLSTYYADS VKG | RFTISRDNSKNTLYLQLNSL RAEDTAVYYCAR | DHDYGDY-----NIYPDY | WGQGT LVTVS S |
| | Germline | | H_FR1 | H_CDR1 | H_FR2 | H_CDR2 | H_FR3 | H_CDR3 | H_FR4 |
| VH3j3-23jD6j6-19jRF1jJH3 | | | | | | | | | |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 35513 | 21-225_157F3 | VH3J3-23/D6J6-19\|RF1/JH3 | EVQLLES-GGGLVQPGGSLRL SCAASE-FTFS | T------YAMS | WVRQAPGK GLEWVS | VISGS----GGSTYYADS VKG | RFTISRDNSKNTLYLQMNSL RAEDTAVYYCAK | RSSGW------EIDALDI | WGQGT MVTVS S |
| iPS:3 92766 | 21-225_23H4 | VH3J3-23/D6J6-19\|RF1/JH3 | EVQLLES-GGGLVQPGSLRL SCAASG-FTFS | S------YAMN | WVRQAPGK GLEWVS | VISGS----GGTYFADS VKG | RFTISRDNSKNTLYLQMNSL RAEDTAVYYCAK | RNSSGW------HDVFDI | WGQGT KVTVS S |
| iPS:3 92808 | 21-225_20F8 | VH3J3-23/D6J6-19\|RF1/JH3 | EVQLLES-GGGLVQPGSLRL SCAASG-FTFR | S------YAMS | WIRQAPGR GLEWSS | VISGS----GGSTYYADS VKG | RFTISRDNSKNTLYLQMSSL RAEDTAVYYCAK | RYNSGW------HDVFDI | WGQGT MVTVS S |
| | Germline | VH4J4-39/D2J2-21\|RF3/JH4 | QLHLQES-GPGLVKPSETLSL TCTVSG-GSIS | SG----SYYWG | WIRQPPGK GLEWIG | SIYY----SGSTYYNPS LKS | RVTISVDTSKNQFSLNLSSV TAAETAVYYCAR | HKVAG------PFDY | WGQGT LVTVS S |
| iPS:4 35525 | 21-225_157E7 | | | | | | | | |
| | Germline | | | H_CDR1 | H_FR2 | H_CDR2 | H_FR3 | H_CDR3 | H_FR4 |
| iPS:4 35543 | 21-225_158D4 | VH3J3-33/D3J3-10\|RF2/JH6 | QVQLVES-GGGVVQPGRSLRL SCAASG-FTFS | D------YYMH | WVRQAPGK GLEWVS | VIWYD----GSNKYYADS VKG | RFTISRDNSKNTLYLQMNSL RAEDTAVYYCAR | EPYTSGW------YDYGMDV | WGQGT TVTVS S |
| iPS:4 35571 | 21-225_159C8 | VH3J3-33/D3J3-10\|RF2/JH6 | QVQLVES-GGGVVQPGRSLRL SCAASG-FTFS | D------YVMQ | WVRQAPGK GLEWVA | VIWYD----GSNKYYADS VKG | RFTISRDNSKNTLYLQMNSL RAEDTAVYYCAR | EPYNSGW------YDYGMDV | WGQGT TVTVS S |
| iPS:4 35591 | 21-225_160C4 | VH3J3-33/D3J3-10\|RF2/JH6 | QVQLVES-GGGVVQPGRSLRL SCAASG-FTFS | D------YVMQ | WVRQAPGK GLEWVA | VIWYD----GSNKYYADS VKG | RFTISRDNSKNTLYLQMNSL RAEDTAVYYCAR | EPYNSGW------YDYGMDV | WGQGT TVTVS S |
| iPS:4 35615 | 21-225_161G12 | VH3J3-33/D3J3-10\|RF2/JH6 | QVQLVES-GGGVVQPGRSLRL SCAASG-FTFS | D------YYMQ | WVRQAPGK GLEWVA | IIWYD----GSNKYYADS VKG | RFTISRDNSKNTLYLQMNSL RAEDTAVYYCAR | EPYNSGW------YDYGMDV | WGQGT TVTVS S |
| iPS:4 36604 | 21-225_226F7 | VH3J3-33/D3J3-10\|RF2/JH6 | QVQLVES-GGGVVQPGRSLRL SCAASG-FTFS | S------YGMH | WVRQAPGK GLEWVA | VIWYD----GSNKYYADS VKG | RFTISRDNSKNTLYLQMNSL RAEDTAVYYCAR | ERYNSGW------YDYGLDV | WGQGT TVTVS S |
| iPS:4 51114 | 21-225_159A3 | VH3J3-33/D3J3-10\|RF2/JH6 | QVQLVES-GGGVVQPGRSLRL SCAASG-FTFS | D------YVMQ | WVRQAPGK GLEWVA | VIWYD----GSNKYYADS VKG | RFTISRDISKNTLYLQMNSL RAEDTAVYYCAR | EPYNSGW------YDYGMDV | WGQGT TVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| IPS:4 21-72732 | 225_2B10_LC1 | VH3J3-33|D3|3-10|RF2|JH6 | QVQLVES-GGGVVQPGRSLRL SCAASG-FTFS | S------YVMH | WVRQAPGK GLEWVA | VIWYD----GSNKYYADS VKV | RFTVSRDNSKNTLSLQMNSL RAEDTAVYYCAR | ERYTSGW------YDYGMDV | WGQGT TVTVS S |
| IPS:4 21-72733 | 225_2B10_LC2 | VH3J3-33|D3|3-10|RF2|JH6 | QVQLVES-GGGVVQPGRSLRL SCAASG-FTFS | S------YVMH | WVRQAPGK GLEWVA | VIWYD----GSNKYYADS VKV | RFTVSRDNSKNTLSLQMNSL RAEDTAVYYCAR | ERYTSGW------YDYGMDV | WGQGT TVTVS S |
| IPS:3 92872 | 21-225_20B11 | VH3J3-33|D3|3-10|RF2|JH6 | QVQLVES-GGGVVQPGRSLRL SCAASG-FTFS | S------YVMH | WVRQAPGK GLEWVA | VIWYD----GSNKYYADS VKV | RFTVSRDNSKNTLSLQMNSL RAEDTAVYYCAR | ERYTSGW------YDYGMDV | WGQGT TVTVS S |
| IPS:3 93966 | 21-225_7F8 | VH3J3-33|D3|3-10|RF2|JH6 | QVQLVES-GGGVVQPGRSLRL SCAASG-FTFS | S------CVMH | WVRQAPGK GLEWVA | VIWYD----GSNKYYADS VKG | RFTISRDNSKNTLYLQMNSL RAEDTAVYYCAR | ERYTSGW------HDYGMDV | WGQGT TVTVS S |
| VH3|3-23|D1|1-1|RF1|JH6 | Germline | | | | | | | H_FR4 |
| IPS:4 35559 | 21-225_158H12 | VH3J3-23|D1|1-1|RF1|JH6 | EVQLVES-GGGLVQPGGSLRL SCAASG-FTFS | S------YVMS | WVRQAPGK GLEWVS | AISGS----GGRTDYADS VKG | RFTISRDNSKNTLYLQMNSL RAEDTAVYYCAR | GGW------NHD | WGQGT TVTVS S |
| VH3|3-21|D1|1-1|RF1|JH6 | Germline | | | | | | | H_FR4 |
| IPS:4 35561 | 21-225_159F1 | VH3J3-21|D1|1-1|RF1|JH6 | QVQLVES-GGGLVKPGGSLRL SCAASG-FTFS | S------YRMN | WVRQAPGK GLEWVS | SISGS----GNYIDYADS VKG | RFTISRDNAKNSLYLQMNSL RAEDTAVYYCAR | GW------DV | WGQGT TVTVS S |
| VH1|1-08|D1|1-1|RF1|JH4 | Germline | | | | | | | H_FR4 |
| IPS:4 35563 | 21-225_159H2 | VH1|1-08|D1|1-1|RF1|JH4 | QVQLVQS-GAEVKKPGASVKV SCKASG-YTFT | S------YDIN | WVRQATGQ GLEWMG | WMNPN----SGNTGYVQK FQG | RVTMTRNTSISTAYMELSSL RSEDTAVYYCAR | KKT------GDY | WGQGT LVTVS S |
| IPS:3 92718 | 21-225_17B8 | VH1|1-08|D1|1-1|RF1|JH4 | QVQLVQS-GAEVKKPGASVKV SCKASG-YTFT | S------YAIN | WVRQATGQ GLEWMG | WMNPN----TGNTGYAQK FQG | RVTMTRNTSISTAYMELSSL RSEDTAVYFCTR | KAG------FDY | WGQGT LVTVS S |
| IPS:3 93064 | 21-225_33A9 | VH1|1-08|D1|1-1|RF1|JH4 | QVQLVQS-GAEVKKPGASVKV SCKASG-YTFT | S------YDIN | WVRQATGQ GLEWMG | WMNPN----SGNTGYAQK FQG | RVTMTRNTSISTAYMELSSL GSEDTAVYYCAR | KRA------NDY | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 93148 | 21-225_35E5 | VH1|1-08|D1|1-1|RF1|JH4 | QVQLVQS-GAEVKKPGASVKV SCKASG-YTFT | S------YDIN | WVRQATGQ GLEWMG | WMNPN---- SGNTGYAQK FQG | RVTMTRNTSISTAYMELSSL RSEDTAVYYCAR | KKS------------NDY | WGQGT LVTVS S |
| iPS:3 98530 | 21-225_32G4 | VH1|1-08|D1|1-1|RF1|JH4 | QVQLVQS-GAEVKKPGASVKV SCKASG-YTFT | S------YDIN | WVRQATGQ GLEWMG | WMNPN---- SGNTGYAQK FQG | RVTMTRNTSISTAYMELSSL RSEDTAVYYCAR | KKA------------NDY | WGQGI LVTVS S |
| | Germline | | | H_CDR1 | H_FR2 | H_CDR2 | H_FR3 | H_CDR3 | H_FR4 |
| iPS:4 35565 | 21-225_159C4 | VH3|3-30.3|D1|1-26|RF3|JH6 | QVQLVES- GGGVVQPGRSLRL SCAASG-FTFS | N------YGMH | WVRQAPGK GLEWVA | VISYS--- GNKYYADS VKG | RFTISRD(M)SKNTLYLQLNSL RAEDMAVYYCAR | RSSSWG-------GYGMDV | WGHGT TVTVS S |
| iPS:3 93892 | 21-225_6G7 | VH3|3-30.3|D1|1-26|RF3|JH6 | QVQLVES- GGGVVQPGRSLRL SCAASG-FTFS | S------YGMH | WVRQTPGK GLEWVA | IISYV--- GRNKYYADS VKG | RFTISPDNSKNTLYLQMNSL RAEDTAVYYCAR | PGNSYG-------GYGMDV | WGQGT TVTVS S |
| | Germline | | | H_CDR1 | H_FR2 | H_CDR2 | H_FR3 | H_CDR3 | H_FR4 |
| iPS:4 35579 | 21-225_160G1 | VH3|3-23|D2|2-21|RF3|JH4 | EVQLLES- GGGLVQPGGSLRL SCAASG-FTFS | S------YYMS | WVRQAPGK GLEWVS | AMSGS---- GGHYYADS VKG | RFTISRDNSKNIVYLQMNSL RAEDTAVYYCVK | HG-------------YS | WGQGT LVTVS S |
| iPS:4 35585 | 21-225_160G3 | VH3|3-23|D2|2-21|RF3|JH4 | QVQLLES- GGGLVQPGGSLRL SCAASG-FTFS | S------YVMS | WVRQTPGK GLEWVS | AMSGS---- GGHYYADS VKG | RFTISVDISKNQFSLKLNSV TAADTAIYYCVR | HG-------------YS | WGQGT LVTVS S |
| | Germline | | | H_CDR1 | H_FR2 | H_CDR2 | H_FR3 | H_CDR3 | H_FR4 |
| iPS:4 35599 225_160B10 | 21- | VH4|4-39|D1|1-1|RF3|JH5 | QLQLQES- GPGLVKPSETLSL TCTVSG-GSIS | RS-----SYWG | WIRQYPSK GLEWIG | NIYY---- SGSAYHIPS LKS | RVTISVDISKNQFSLKLNSV TAADTAVYYCAR | HDENW---------GVDY | WGQGT LVTVS S |
| iPS:4 35601 225_160G10 | 21- | VH3|3-33|D1|1-1|RF2|JH6 | QVQLVES- GGGVVQPGRSLRL SCAASG-FTFS | S------FGMH | WVRQAPGK GLEWVA | VIWYD---- GSYKYYADS VKG | RFTISRDNSKNTLYLQMNSL RAEDTAVYYCAR | VGIEVAGD-----YYFGMEV | WGQGT TVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35655 | 21-225_167E2 | VH3\|3-33\|D\|1-1\|RF2\|JH6 | QVQLVES-GGGVVQPGRSLRL SCAASG-FTFS | S------FGMH | WVRQAPGK GLEWVA | VIWYD----GTYKYYADS VKG | RFTISRDNSKNTLYLQMNSL RAEDTAVYYCAR | VGIEVAGD------YYYGMEV | WGQGT TVTVS S |
| iPS:4 35657 | 21-225_167H10 | VH3\|3-33\|D\|1-1\|RF2\|JH6 | QVQLVES-GGGVVQPGRSQRL SCAASG-FTFS | S------FGMH | WVRQAPGK GLEWVA | VIWYD----GSYRYADS VKG | RFTISRDNSKNTLYLQMNSL RAEDTAVYYCAR | VGIEVAGD------YYYGMEV | WGQGT TVTVS S |
| | Germline | | | | | | | |
| | VH3\|3-33\|D\|7-27\|RF3\|JH4 | | | H_CDR1 | H_FR2 | H_CDR2 | H_FR3 | H_CDR3 | H_FR4 |
| iPS:4 35605 | 21-225_161A4 | VH3\|3-53\|D\|7-27\|RF3\|JH4 | EVQLVES-GGGLIQPGGSLRL SCAASG-FTFS | S------NYMS | WVRQAPGK GLEWVS | VIYT------GGSTYNADS VKG | RFTISRDNSKNTLYLQMNSL RAEDTAVYYCAR | NWGMA------GPFDY | WGQGT LVTVS S |
| | Germline | | | H_CDR1 | H_FR2 | H_CDR2 | H_FR3 | H_CDR3 | H_FR4 |
| | VH3\|3-30.3\|D\|6-6\|RF1\|JH6 | | | | | | | |
| iPS:4 35607 | 21-225_161G4 | VH3\|3-30.3\|D\|6-6\|RF1\|JH6 | QVQLVES-GGGVVQPGRSLRL SCAASG-FTFS | S------YGMH | WVRQAPGK GLEWVA | VISYG----GSNKYHADS VKG | RFTISRDNSKNTLYLQMNSL RAEDTAVYYCAR | RSSSSG----------GYGMDV | WGQGT TVTVS S |
| iPS:3 93020 | 21-225_30E2 | VH3\|3-30.3\|D\|6-6\|RF1\|JH6 | QVQLVES-GGGVVQPGRSLRL SCAASG-FTFS | S------YGMH | WVRQAPGK GLEWVA | VISYG----GSNHFYAVS VKG | RFNISRDNSKNTLYLQMNSL RAEDTAVYYCAR | RGYSSG----------GYGMDV | WGQGT TVTVS S |
| iPS:3 93062 | 21-225_33H3 | VH3\|3-30.3\|D\|6-6\|RF1\|JH6 | QVQLVES-GGGVVQPGRSLRL SCAASG-FTFS | S------YGMH | WVRRAPGK GLEWVA | IISYG----GSNMFYADS VKG | RFTISRDNSKNTLYLQMNSL RAEDTAVYYCAR | RGYSSG----------GYGMDV | WGQGT TVTVS S |
| iPS:3 93138 | 21-225_35E3 | VH3\|3-30.3\|D\|6-6\|RF1\|JH6 | QVQLVES-GGGVVQPGRSLRL SCAASG-FTFS | S------YGMH | WVRQAPGK GLEWVA | VISYG----GSNKYYADS VKG | RFTISRDNSKNTLYLQMNSL RAEDTAVYYCVR | RGYSSG----------GYGMDV | WGQGT TVTVS S |
| | Germline | | | H_CDR1 | H_FR2 | H_CDR2 | H_FR3 | H_CDR3 | H_FR4 |
| | VH3\|3-30.3\|D\|6-13\|RF2\|JH6 | | | | | | | |
| iPS:4 35611 | 21-225_161F10 | VH3\|3-30.3\|D\|6-13\|RF2\|JH6 | QVQLVES-GGGVVQPGRSLRL SCAASG-FTFS | S------YGMH | WVRQAPGK GLEWVA | IISYG----GRNDFYADS VKG | RFTISRDNSKNTLYLQMNSL RAEDTAVYYCAR | RIAAAG----------HIYGMDV | WGQGT TVTVS S |
| | Germline | | | H_CDR1 | H_FR2 | H_CDR2 | H_FR3 | H_CDR3 | H_FR4 |
| | VH3\|3-33\|D\|5-18\|RF1\|JH6 | | | | | | | |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35629 | 21-225_162G6 VH3J3-33/D5J5-18\|RF1/JH6 | QVQLVES- GGGVVQPGRSLRL SCAASG-FTFN | N------YGMH | WVRQAPGK GLEWVA | VIWYD---- GSNKYYADS VKG | RFTISRDNSKNTLYLQMNSL RAEDTAVYYCAR | KGIAAVGD- ------YYYGMDV | WGQGT TVTVS S |
| | Germline VH3J3-21/D7J7-27\|RF1/JH6 | EVQLVES- GGGLVKPGGSLRL SCAASG-FTFS | S------YGMS | WVRQAPGK GLEWVS | SISGS---- SAYIYYADS VKG | RFTISRDNAKNSLYLQMNSL RAEDTAVYYCAR | | WGQGT TVTVS S |
| iPS:4 35639 | 21-225_163G6 VH3J3-21/D7J7-27\|RF1/JH6 | EVQLVES- GGGLVKPGGSLRL SCAASG-FTFS | S------YGMS | WVRQAPGK GLEWVS | SISGS---- SAYIYYADS VKG | RFTISRDNAKNSLYLQMNSL RAEDTAVYYCAR | LSG------ ---------MDV | WGQGT TVTVS S |
| | Germline VH3J3-21/D5J5-24\|RF2/JH6 | | | | | | | |
| iPS:4 35643 | 21-225_163G10 VH3J3-21/D5J5-24\|RF2/JH6 | EVQLVES- GGGLVKPGGSLRL SCAASG-FTFS | S------YGMN | WVRQAPGK GLEWVS | SISGS---- STYIYYADS VKG | RFTISRDNAKNSLYLQMNSL RAEDTAVYYCAR | ARM------ ----------DV | WGQGT TVTVS S |
| | Germline VH3J3-33/D3J3-9\|RF2/JH4 | | | | | | | |
| iPS:4 35663 | 21-225_169B1 VH3J3-33/D3J3-9\|RF2/JH4 | QVQLVES- GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | DPLRGYN-- -----DPVMDY | WGQGT LVTVS S |
| iPS:4 35669 | 21-225_169F9 VH3J3-33/D3J3-9\|RF2/JH4 | QVQLVES- GGGVVQPGRSLRL SCAASG-FTFS | T------YGMH | WVRQAPGK GLEWVS | IIWYD---- GTNKYYADS VKG | RFTISRDNSKNTLYLQLNSL RAEDTAVYYCAR | DPLRGYN-- -----DFVMDY | WGQGT LVTVS S |
| iPS:4 35693 | 21-225_170G4 VH3J3-33/D3J3-9\|RF2/JH4 | QVQLVES- GGGVVQPGRSLRL SCAASG-FTFS | T------YGMH | WVRQAPGK GLEWVS | IIWYD---- GTNKYYADS VKG | RFTISRDNSKNTLFLQINSL RAEDTAMYYCAR | DPLRGYN-- -----DPVMDY | WGQGT LVTVS S |
| iPS:4 35695 | 21-225_170D5 VH3J3-33/D3J3-9\|RF2/JH4 | QVQLVES- GGGVVQPGRSLRL SCAASG-FTFS | S------YGMH | WVRQAPGK GLEWVA | IIWYD---- GTNKYYADS VKG | RFTISRDNSKNTLYLQLNSL RAEDTAVYYCAR | DPLRGYN-- -----DPVMDY | WGQGT LVTVS S |
| iPS:4 35697 | 21-225_170G5 VH3J3-33/D3J3-9\|RF2/JH4 | QVQLVES- GGGVVQPGRSLRL SCAASG-FTFS | T------YGMH | WVRQAPGK GLEWVT | IIWYD---- GTNKYYADS VKG | RFTISRDNSKSILYLQMNSL RAEDTAVYFCAR | DPLRGYN-- -----DPVMDY | WGQGT LVTVS S |
| iPS:4 35703 | 21-225_170D11 VH3J3-33/D3J3-9\|RF2/JH4 | QVQLVES- GGGVVQPGRSLRL SCVASG-FTFS | S------YGMH | WVRQAPGK GLEWVA | IIWYD---- GTNKYYADS VKG | RFTISRDNSKNTLYLQLNSL RAEDTAVYYCAR | DPLRGYN-- -----DFVMDY | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35705 | 21-225_171C3 | VH3J3-33/D3J3-9/RF2/JH4 | QVQLVES-GGGVVQPGGSLRL SCAASG-FTFS | T------YGMH | WVRQAPGK GLEWVT | IINYD----GTNKYYADS VKG | RFTISRDNSKNTLYLQMNSL RAEDTAVYYCAR | DPLRGYN----------DPVMDY | WGQGT LVTVS S |
| iPS:4 35709 | 21-225_171A4 | VH3J3-33/D3J3-9/RF2/JH4 | QVQLVES-GGGVVQPGGSLRL SCAASG-FTFS | T------YGMH | WVRQAPGK GLEWVA | IINYD----GSNKYYADS VKG | RFTISRDNSKNTLYLQMNSL RAEDTAVYYCAR | DPLRGYN----------DPVMDY | WGQGT LVTVS S |
| iPS:4 35721 | 21-225_172B3 | VH3J3-33/D3J3-9/RF2/JH4 | QVQLVES-GGGVVQPGEPLRL SCAASG-FTFS | T------YGMH | WVRQAPGK GLEWVA | VINYD----GSNKYYADS VKG | RFTISRDNSKNTLYLQMNSL RAEDTAVYYCAR | DPLRGYN----------DPVMDY | WGQGT LVTVS S |
| iPS:4 35725 | 21-225_172G8 | VH3J3-33/D3J3-9/RF2/JH4 | QVQMVES-GGGVVQPGRSLRL SCAASG-FTFS | T------YGMH | WVRQAPGK GLEWMA | IINYD----GSNKYYADS VKG | RFTISRDNSKNTLYLQLNSL RAEDTAVYYCAR | DPLRGYN----------DPVMDY | WGQGT LVTVS S |
| iPS:4 35735 | 21-225_173H12 | VH3J3-33/D3J3-9/RF2/JH4 | QVQLVES-GGGVVQPGGSLRL SCAASG-FTFS | S------YGMH | WVRQAPGK GLEWVA | YISLS----GSTKYYADS VKG | RFTISRDNSKNTLYLQLNSL RAEDTAVYYCAR | DPLRGYN----------DPVMDY | WGQGT LVTVS S |
| iPS:4 35743 | 21-225_175G1 | VH3J3-33/D3J3-9/RF2/JH4 | QVQLVES-GGGVVQPGGSLRL SCAASG-FTFS | T------YGMH | WVRQAPGK GLEWVA | VINYD----GSNKYYADS VKG | RFTISRDNSKNTLYLQMNSL RAEDTAVYYCAR | DPLRGYN----------DPVMDY | WGQGT LVTVS S |
| iPS:4 35761 | 21-225_176B11 | VH3J3-33/D3J3-9/RF2/JH4 | QVQLVES-GGGVVQPGRSLRL SCAASG-FTFS | T------YGMH | WVRQAPGK GLEWVS | IINYD----GTNKYYADS VKG | RFTISRDNSKNTLFLQLNSL RAEDTAVYYCAR | DPLRGYN----------DPVLDY | WGQGT LVTVS S |
| iPS:4 35779 | 21-225_178B10 | VH3J3-33/D3J3-9/RF2/JH4 | QVQLVES-GGGVVQPGRSLRL SCVASG-FTSS | T------YGMH | WVRQAPGK GLEWMA | IINYD----GTNKYYADS VKG | RFTISRDNSKNTLYLQLNSL RAEDTAVYYCAR | DPLRGYN----------DPVMDY | WGQGT LVTVS S |
| Germline | | H_FR1 | H_CDR1 | H_FR2 | H_CDR2 | H_FR3 | H_CDR3 | H_FR4 |
| VH3J3-48/D2J2-15/RF3/JH6 | | | | | | | | |
| iPS:4 35667 | 21-225_169E3 | VH3J3-48/D2J2-15/RF3/JH6 | EVQLVES-GGGLVQPGGSLRL SCAASG-FTFS | G------HSMN | WVRQAPGK GLEWVS | YISLS----GSTIKYADS VKG | RFTISRDNARDSLYLQMNSL REEDTAVYYCAR | RGITVVR----------NEDGLDV | WGQGT TVTVS S |
| iPS:4 35673 | 21-225_169E6 | VH3J3-48/D2J2-15/RF3/JH6 | EVQLVES-GGGLVQPGGSLRL SCAASG-FTFS | G------HSMN | WVRQAPGK GLEWVA | YISIS----SSTIKYADS VKG | RFTISRDNARDSLYLQMNSL RIEDTAVYYCAR | RGITVVR----------NEDGLDV | WGQGT TVTVS S |
| iPS:4 35759 | 21-225_176E6 | VH3J3-48/D2J2-15/RF3/JH6 | EVQLVES-GGGLVQPGGSLRL SCAASG-FTFS | G------HSMN | WVRQAPGK GLEWVA | YISIS----GSTIKYADS VKG | RFTISRDNARDSLKLQMNSL RIEDTAVYYCAR | RGITVVR----------NEDGLDV | WGQGT TVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4-59/D3/3-9/RF1/JH6 | | | | | | | | |
| iPS:4 35675 | VH4/4-59/D3/3-9/RF1/JH6 | QVQLQES-GPGLVKPSETLSL TCTVSG-GSIS | S------YYWT | WIRQPAGK GLEWIG | RIYT------SGSTNYNPS LKS | RVTMSVDTSKNQFSLKLSSV TAADTAVYFCAK | VGRYY------YGMDV | WGQGT TVTVS S |
| iPS:4 35687 | VH4/4-59/D3/3-9/RF1/JH6 | QVQLQES-GPGLVKPSETLSL TCTVSG-GSIS | S------YYWS | WIRQPAGK GLEWIG | RIYT------SGSTNYNPS LKS | RVTMSVDTSKNQFSLKLSSV TAADTAVYYCAR | VGRYY------YGMDV | WGQGT TVTVS S |
| VH3/3-23/D4/4-23/RF2/JH4 | | | | | | | | |
| iPS:4 35711 | VH3/3-23/D4/4-23/RF2/JH4 | EVQLLES--GGGLVQPGGSLRL SCAASG-FTFS | S------CAMT | WVRQAPGK GLEWVS | AISGR---GGTPFYADS VRG | RFTISRDNSKNTLFLQMNSL RAEDTAVYYCAK | DLIGGA------TYFDY | WGQGT LVTVS S |
| iPS:4 35875 | VH3/3-23/D4/4-23/RF2/JH4 | EVQLLES--GGGLVQPGGSLRL SCAASG-FTFS | T------YAMS | WVRQAPGK GLEWVS | AISRS---GGNTHYADS VKG | RFTISRDNSKNTLYLQMNSL RAEDTAVYYCAK | DGFGGS------SYFDY | WGQGT LVTVS S |
| iPS:4 35909 | VH3/3-23/D4/4-23/RF2/JH4 | EVQLLES--GGGLVQPGGSLRL SCAASG-FTFS | S------YAMS | WVRQAPGK GLEWVS | AISGR---GGNTYYADS VKG | RFTISRDNSKNTLYLQMNSL RAEDTAVYYCAK | DGFGGS------SYFDY | WGQGT LVTVS S |
| iPS:4 36013 | VH3/3-23/D4/4-23/RF2/JH4 | EVQLLES--GGGLVQPGGSLRL SCAASG-FTFS | T------FAMS | WVRQAPGK GLEWVS | AISRS---GGNTHYADS VKG | RFTISRDNSKNTLYLQMNSL RAEDTAVYYCAK | DGFGGS------SYFDY | WGQGT LVTVS S |
| iPS:4 36100 | 21-225_195G12 | VH3/3-23/D4/4-23/RF2/JH4 | EVQLLES--GGGLVQPGGSLRL SCAASG-FTFS | T------YAMS | WVRQAPGK GLEWVS | AISRS---GGNTYYADS VKG | RFTISRDNSKNTLYLQMNSL RAEDTAVYYCAK | DGFGGS------SYFDY | WGQGT LVTVS S |
| VH3/3-30.3/D1/1-7/RF2/JH6 | | | | | | | | |
| iPS:4 35713 | VH3/3-30.3/D1/1-7/RF2/JH6 | QVQLVES--RGGVVQPGRSLRL SCAASG-FTFS | S------YGMH | WVRQAPGK GLEWVA | VISYD---GNNRHYADS VQG | RFTISRDNSKNTLSLQMNSL GAEDTAVYYCAR | DRHRLD------YYALDV | WGQGT TVTVS S |
| VH3/3-23/D5/5-24/RF3/JH3 | | | | | | | | |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 35729 | 21-225_173E7 | VH3\|3-23\|D5\|5-24\|RF3\|JH3 | EVQLLES-GGGSVQPGGSLRL SCAASG-FTFS | S------YAMS | WVRQAPGK GLEWVS | FISGS------GGNTFYADS VKG | RFTISRDNSKNTLYLQMNSL QAEDTAVYYCTK | RDTYNG-------------WDAFDI | WGQGT MVTVS S |
| iPS:4 35753 | 21-225_175G10 | VH3\|3-23\|D5\|5-24\|RF3\|JH3 | EVQLLES-GGGLVQPGGSLRL SCAASG-FTFS | S------YAMS | WVRQTPGK GLEWVS | IISGS------GGNTYADS VKG | RFTISRDNSKNTLYLQMNSL RAEDTAVYCAR | RDTWNG-------------WDAFDI | WGQGT MVTVS L |
| iPS:3 93024 | 21-225_31H9 | VH3\|3-23\|D5\|5-24\|RF3\|JH3 | EVQLLES-GGGLVQPGGSLRL SCAASG-FTFS | S------CAMN | WVRQAPGK GLEWVS | AISGS------GGSSFYADS VKG | RFTISRDNSKNTLYLQMNSL RAEDTAVYYCAK | RTPYID-----------VFDI | WGQGT MVTVS S |
| iPS:3 98474 | 21-225_17B10 | VH3\|3-23\|D5\|5-24\|RF3\|JH3 | EVQLLES-GGGLVQPGGSLRL SCAASG-FTFR | S------YAMS | WVRQAPGK GLEWVS | VISGS------GGNTYFADS VKG | RFTISRDNSKNTLYLQMDSL RAEDTAVYYCAK | RGIPFA-------------DAFDI | WGQGT MVTVS S |
| | Germline | | H_FR1 | H_CDR1 | H_FR2 | H_CDR2 | H_FR3 | H_CDR3 | H_FR4 |
| | VH1\|1-02\|D1\|1-1\|RF1\|JH3 | | | | | | | | |
| iPS:4 35745 | 21-225_175G3 | VH1\|1-02\|D1\|1-1\|RF1\|JH3 | QVQVVQS-GAEVKKPGASVKV SCKASG-YTFI | G------YPMH | WVRQAPGQ GLEWMG | WIKPK------SGGTNCAQR FQG | RVTMTRDTSITTAYMELSRL RSEDDTAVYYCVR | GGTVTT-------------WGVFDY | WGQGT MVTVS S |
| iPS:4 37270 | 21-225_178H4 | VH1\|1-02\|D1\|1-1\|RF1\|JH3 | QVQLVQS-GAEVKKPGASVKV SCKASG-YTFT | G------YFMH | WVRQAPGQ GLEWMG | WIKPK------SGGTNCAQK FQG | RVTMTRDTSISTAYMELSRL RSEDDTAVYYCVR | GGTVTT-------------WGVFDY | WGQGT MVTVS S |
| | Germline | | H_FR1 | H_CDR1 | H_FR2 | H_CDR2 | H_FR3 | H_CDR3 | H_FR4 |
| | VH3\|3-23\|D3\|3-22\|RF2\|JH4 | | | | | | | | |
| iPS:4 35769 | 21-225_177B6 | VH3\|3-23\|D3\|3-22\|RF2\|JH4 | EVQLLES-GGGLVQPGGSRRL SCAASG-FTFS | S------YAMS | WVRQAPGK GLEWVS | VISGS------GSNTYVDS VKG | RFTISRDNSKNTLMLQMNSL RAEDSAVYYCTK | GYYDSSG--------YYYPFDF | WGQGT LVTVS S |
| | Germline | | H_FR1 | H_CDR1 | H_FR2 | H_CDR2 | H_FR3 | H_CDR3 | H_FR4 |
| iPS:4 35771 | 21-225_177B11 | VH3\|3-33\|D3\|3-22\|RF2\|JH1 | QVQLVES-GGGVQPGRSLRL TCAASG-FTFS | S------YGMH | WVRQAPGK GLEWVA | IIWYD------GSYKYTDS VKG | RFTISRDNSKNTLYLQMNSL RAEDTAVYYCAR | ETYDFW-----------SGYFVF | WGQGT LVTVS S |
| | Germline VH3\|3-23\|D5\|5-24\|RF3\|JH4 | | H_FR1 | H_CDR1 | H_FR2 | H_CDR2 | H_FR3 | H_CDR3 | H_FR4 |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35775 | 21-225_178A5 | VH3/3-23|D5|5-24|RF3/JH4 | EVHLLES-GGGLVQTGGSLRL SCAASG-FTFS | S-------YAMT | WVRQAPGK GLEWVS | VISGS----GGNTFYADS VKG | RFTISRDNSKNTLYLQMNSL RAEDTAVYYCAR | RDGD-------YFDY | WGQGT LVTVS S |
| iPS:4 37214 | 21-225_48B12 | VH3/3-23|D5|5-24|RF3/JH4 | EVQLLES-GGGLVQPGGSLRL SCAASG-FTFS | S-------YAMS | WVRQAPGK GLEWVS | AISGH----GGNTFYADS VKG | RFTISRDNSKNTLYLQMNSL RAEDTAVYYCAR | RETINWN-------YEGFDY | WGQGT LVTVS S |
| iPS:3 93028 | 21-225_25D7 | VH3/3-23|D5|5-24|RF3/JH4 | EVQLLES-GGGLVQPGGSLRL SCAASG-FTFS | S-------YAMS | WVRQTPGQ GLEWVS | AISGH----GGTFYADS VKG | RFTISRDNSKNTLYLQMNSL RAEDTAVYYCAR | DGYGGN-------SFFDY | WGQGT LVTVS S |
| | Germline | VH3/3-23|D4|4-11|RF3/JH6 | | H_CDR1 | H_FR2 | H_CDR2 | H_FR3 | H_CDR3 | H_FR4 |
| iPS:4 35789 | 21-225_180C4 | VH3/3-33|D4|4-11|RF3/JH6 | QVQLVES-GGGLVQPGGSLRL SCAASG-FTFS | A-------YGMH | WVRQAPGK GLEWVT | IINYD----GSYKYYADS VKG | RFAISRDNSKNTLYLQMNSL RAEDTAVYYCAR | TGVDPWD-------YYNGMDV | WGQGT TVTVS S |
| | Germline | VH3/3-23|D2|2-8|RF1/JH3 | | H_CDR1 | H_FR2 | H_CDR2 | H_FR3 | H_CDR3 | H_FR4 |
| iPS:4 35799 | 21-225_181G3 | VH3/3-23|D2|2-8|RF1/JH3 | EVQLLES-GGGLVQPGGSLRL SCAASG-FTFS | S-------YAMS | WVRQAPGK GLEWVS | VISGS----GGNTFYGDS VKG | RFTISRDNSKNTLYLQMNSL RAEDTAIYYCAR | RETIDWG-------SDAFDI | WGQGT MVTVS S |
| | Germline | VH3/3-30.3|D5|5-18|RF2/JH6 | | H_CDR1 | H_FR2 | H_CDR2 | H_FR3 | H_CDR3 | H_FR4 |
| iPS:4 35811 | 21-225_183H6 | VH3/3-30.3|D5|5-18|RF2/JH6 | QVQLVES-GGGLVQPGRSLRL SCAASG-FTFS | S-------YGMH | WVRQAPGK GLEWVA | IISYA----GSTKFYADS VKG | RFTISRDNSKNTLYLQMNSL RAEDTAVYYCVR | RPPQWLV-------EGYGMDV | WGQGT TVTVS S |
| iPS:4 36754 | 21-225_155G3 | VH3/3-30.3|D5|5-18|RF2/JH6 | QVQLVES-GGGLVQPGGSLRL SCTASG-FTFS | S-------YGMH | WVRQAPGK GLEWVA | VISYD----GSNKYYADS VKG | RFTISRDNSKNTLYLQMNSL RAEDTAVYYCAR | DTERWLP-------YSYGMDV | WGQGT TVTVS S |
| iPS:4 48908 | 21-225_50G9 | VH3/3-30.3|D5|5-18|RF2/JH6 | QVQLVES-GGGVVQPGRSLRL SCAASG-FIFS | S-------YGMH | WVRQAPGK GLEWVA | VISQD----GIIRYYADS VKG | RFTISRDNSKNTLYLQMNSL RAEDTAVYYCAR | DVKQWLV-------RTIGMDV | WGQGT TVTVS S |
| | Germline | VH3/3-30.3|D8|6-19|RF1/JH5 | | H_CDR1 | H_FR2 | H_CDR2 | H_FR3 | H_CDR3 | H_FR4 |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS.4 21-35813 | 225_183A12 | VH3\|3-30.3/D6\|6-19\|RF1/JH5 | QVQLVES-GGGVVQPGRSLRL SCAASG-FTFS | S------YGMH | WVRQAPGK GLEWVA | VISSA---- GSNKYYADS VKG | RFTISRDNSKNTLYLQMNSL RAEDTAVYYCAR | RYSSGW------DWFDP | WGQGT LVTVS S |
| VH3\|3-27/D3\|3-10\|RF3/JH4 | Germline | | | | | | | |
| iPS.4 21-35815 | 225_190G10 | VH3\|3-21\|D3\|3-10\|RF3/J H4 | EVQLVES- GGGLVKPGGSLRL SCAASG-FTFR | D------YSMN | WVRQAPGK GLEWVS | SISSG---- SGYIYYADS VKG | RFTISRDNAKNSLYLQMNSL RAEDTAVYYCAR | ATMA------------LDY | WGQGT LVTVS S |
| iPS.4 21-225_191A5 | 35865 | VH3\|3-21\|D3\|3-10\|RF3/J H4 | EIQVVES- GGGLVKPGGSLRL SCAASG-FTFR | D------YSMN | WVRQAPGK GLEWVS | SISSG---- SGYIYYADS VKG | RFTISRDNAKNSLYLQMNSL RAEDTAVYYCAR | ATMA------------LDY | WGQGA LVTVS S |
| iPS.4 21-36047 | 225_193B10 | VH3\|3-21\|D3\|3-10\|RF3/J H4 | EVQLVES- GGGLVKPGGSLRL SCAASG-FTFR | D------YSMN | WVRQAPGK GLEWVS | SISSA---- GGYIYYADS LKG | RFTISRDNAKNSLYLQMNSL RAEDTAVYYCAR | ATMA------------LDY | WGQGT LVTVS S |
| iPS.4 21-36122 | 225_196G10 | VH3\|3-21\|D3\|3-10\|RF3/J H4 | EVQLVES- GGGLVKPGGSLRL SCAASG-FTFR | D------YSMN | WVRQAPGK GLEWVS | SISSG---- SGYIHYADS VKG | RFTISRDNAKNSLYLQMNSL RAEDTAVYYCAR | ATMA------------LDY | WGQGT LVTVS S |
| VH4\|4-59\|D4\|4-17\|RF2/JH6 | Germline | | | | | | | |
| iPS.4 21-35817 | 225_190B11 | VH4\|4-59\|D4\|4-17\|RF2/J H6 | QVQLQES- GPGLVKPSETLSL TCTVSG-GSIN | N------YYWS | WIRQPAGK GLEWIG | RIYT---- SGSTNYNPS LKS | RVTMSVDTSKNQFSLKLSSV TAADTAVYYCAR | DRGYYG------YYGMDV | WGQGT TVTVS S |
| iPS.4 21-225_190D5 | 35917 | VH4\|4-59\|D4\|4-17\|RF2/J H6 | QVQLQES- GPGLVKPSETLSL TCTVSG-GSIN | N------YYWS | WIRQPAGK GLEWIG | RIYA---- SGSTNYNPS LKS | RVTMSIDTSKNQFSLKLSSV IAADTAVYYCAR | DRGYYG------YYGMDV | WGQGT TVTIS S |
| iPS.4 21-225_194C3 | 36056 | VH4\|4-59\|D4\|4-17\|RF2/J H6 | QVQLQES- GPGLVKPSETLSL TCTVSG-GSIN | N------YYWS | WIRQPAGK GLEWIG | RIYA---- SGSTNYNPS LKS | RVTMSIDTSKNQFSLKLSSV TAADTAVYYCAR | DRGYYG------YYGMDV | WGQGT TVTIS S |
| iPS.4 21-225_200F8 | 36220 | VH4\|4-59\|D4\|4-17\|RF2/J H6 | QVQLQES- GPGLVKPSETLSL TCTVSG-GSIN | N------YYWS | WIRQPAGK GLEWIG | RIYT---- SGSTNYNPS LKS | RVTMSVDTSKNQFSLKLSSV TAADTAVYYCAR | DRGYYG------YYGMDV | WGQGT TVTVS S |
| VH3\|3-30\|D4\|4-17\|RF2/JH6 | Germline | | | | | | | |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35821 | 21-225_190E11 | VH3j3-30/D4j4-17jRF2/JH6 | QVQLVES-GGGVVQPGRSLRL SCTASG-FTFS | N------YGMH | WVRQAPGK GLEWVA | IIWFD----GSNKYYADS VKG | RFTISRDNSKNTLYLQMNSL RAEDTAVYYCAK | AQGVYY------YVMDV | WGQGT IVTVS S |
| | Germline | VH3j3-23jD5j5-12jRF1/JH5 | EVQLLES GGGLGQPGGSLRL SCAASG-FTFS | S------YAMS | WVRQAPGK GLEWVS | TISGT----GGSTYYADS VKG | RFTISRDNSKNTLYLQMNSL RAEDTAVYYCAK | EEDYYDS------SGPGFDP | H_FR4 |
| iPS:4 35823 | 21-225_190F11 | VH3j3-23jD5j5-12jRF3/JH5 | EVQLLDS-GGGLGQPGGSLRL SCAASG-FTFD | S------YAMN | WVRQAPGK GLEWVS | TISGT----GRRTYYADS VKG | RFTISRDNSKNTLYLQMNSL RAEDTAVYYCAK | EEDYYDS------SGPGFDP | WGQGT LVTVS S |
| iPS:4 35867 | 21-225_191E5 | VH3j3-23jD5j5-12jRF3/JH5 | EVQLLDS-GGGLGQPGGSLRL SCAASG-FTFD | S------YAMN | WVRQAPGK GLEWVS | TISGT----GRRTYYADS VKG | RFTISRDNSKNTLYLQMNSL RAEDTAVYYCAK | EEDYYDS------SGPGFDP | WGQGT LVTVS S |
| iPS:4 35929 | 21-225_190D9 | VH3j3-23jD5j5-12jRF3/JH5 | EVQLLDS-GGGLGQPGGSLRL SCAASG-FTFD | S------YAMS | WVRQAPGK GLEWVS | TISGT----GRRTYYADS VKG | RFTISRDNSKNTLYLQMNSL RAEDTAVYYCAK | EEDYYDS------SGPGFDP | WGQGT LVTVS S |
| iPS:4 35935 | 21-225_190H8 | VH3j3-23jD5j5-12jRF3/JH5 | GVQLLDS-GGGLGQPGGSLRL SCAASG-FTFD | S------YAMS | WVRQAPGK GLEWVS | TISGT----GRRTYYADS VKG | RFTISRDNSKNTLYLQMNSL RAEDTAVYYCAK | EEDYYDS------SGPGFDP | WGQGT LVTVS S |
| | Germline | VH4j4-39jD3j3-9jRF1/JH4 | | | | | | | |
| iPS:4 35827 | 21-225_190H11 | VH4j4-39jD3j3-9jRF1/JH4 | QLQLQES-GPGLVKPSETLSL TCTVSG-GSIR | S------YHWS | WIRQPAGK GLEWIG | LIYT----SRSTIYNPS LKS | RVTLSVDTSKNQFSLKLSSV TAADTAVYYCAR | LRYNWN------FPYFDY | WGQGT LVTVS S |
| iPS:4 35853 | 21-225_191E3 | VH4j4-39jD3j3-9jRF1/JH4 | QLQLQES-GPGLVKPSETLSL TCTVSG-GSIR | S------YHWS | WIRQPAGK GLEWIG | LIYT----SRSTNYNPS LKS | RVTMSVDTSKNQFSLKLNSV TAADTAVYYCAR | LRYNWN------FPYFDY | WGQGT LVTVS S |
| iPS:4 35871 | 21-225_191E6 | VH4j4-39jD3j3-9jRF1/JH4 | QLQLQES-GPGLVKPSETLSL TCTVSG-GSIR | S------YHWS | WIRQPAGK GLEWIG | LIYT----SRSTNYNPS LKS | RVTMSVDTSKNQFSLKLSSV TAADTAVYYCAR | LRYNWN------FPYFDF | WGQGT LVTVS S |
| iPS:4 35927 | 21-225_190E7 | VH4j4-39jD3j3-9jRF1/JH4 | QLQLQES-GPGLVKPSETLSL TCTVSG-GSIR | S------YHWS | WIRQPAGK GLEWIG | HIYT----SRSTNYNPS LKS | RVTISVDTSKNQFSLKLSSV TAADTAVYYCAR | LRYNWN------FPYFDY | WGQGT LVTVS S |
| iPS:4 35999 | 21-225_192F9 | VH4j4-39jD3j3-9jRF1/JH4 | QLQLQES-GPGLVKPSETLSL TCTVSG-GSIR | S------YHWS | WIRQPAGK GLEWIG | LIYT----SRSTNYNPS LKS | RVTMSVDTSKNQFSLKLNSV TAADTAVYYCAR | LRYNWN------FPYFDY | WGQGT LVTVS S |

FIGURE 51 (Continued)

| | | H FR1 | H CDR1 | H FR2 | H CDR2 | H FR3 | H CDR3 | H FR4 |
|---|---|---|---|---|---|---|---|---|
| iPS.4 36060 | 21-225_194F4 | VH4/4-39/D3/3-9/RF1/JH4 | QLQLQES-GPGLVKPSETLSL TCTVSG-GSIS | S------YHWS | WIRQPAGK GLEWIG | LIYT----SRSTNYNPS LKS | RVTMSVDRSKSQFSLKLSSV TAADTAVYYCAR | LRYNWN-------EPYFDY | WGQGT LVTVS S |
| iPS.4 36193 | 21-225_198A10 | VH4/4-39/D3/3-9/RF1/JH4 | QLQLQES-GPGLVKPSETLSL TCTVSG-GSIR | S------YHWS | WIRQPAGK GLEWIG | HIYT----SRSTNYNPS LKS | RVTISVDISKNQFSLKLSSV TATDTAVYYCAR | LRYNWN-------EPYFDY | WGQGT LVTVS S |
| | Germline | | H FR1 | H CDR1 | H FR2 | H CDR2 | H FR3 | H CDR3 | H FR4 |
| | VH4/4-30.1/D5/5-24/RF3/JH2 | | | | | | | | |
| iPS.4 35829 | 21-225_190B12 | VH4/4-30.1/D5/5-24/RF3/JH2 | QVQLQES-GPGLVKPSQTLSL TCTVSG-GSIS | SG----GYYWN | WIRQHPGK GLEWIG | YIYY----SGSTYYNPS LKS | RVTISVDITSKNQPFLKLNSV TAADTAVYYCAR | SGYNWD-------AGVDP | WGRGT LVTVS S |
| | Germline | | H FR1 | H CDR1 | H FR2 | H CDR2 | H FR3 | H CDR3 | H FR4 |
| | VH3/3-33/D4/4-11/RF2/JH6 | | | | | | | | |
| iPS.4 35835 | 21-225_190F12 | VH3/3-33/D4/4-11/RF2/JH6 | QVQLVES-GGGVVQPGRSLRL SCAASG-FTFR | N------YGMH | WVRQAPGK GLEWVA | VIWFD----GSNDYYADS VKG | RFTISRDNSKNTLSLQMNSL RAEDTAVYYCAR | DRSVGY-------DGLDV | WGQGT TVTVS S |
| iPS.4 35861 | 21-225_190A5 | VH3/3-33/D4/4-11/RF2/JH6 | QVQLVES-GGGVVQPGRSLRL SCAASG-FTFS | S------YGMH | WVRQAPGK GLEWVA | VIWYD----GSNKNYNPS VKG | RFTISRDNSKNTLYLQMNSL RAEDTAVYYCAR | DFSVGY-------DGMDV | WGQGT TVTVS S |
| iPS.4 35937 | 21-225_190H9 | VH3/3-33/D4/4-11/RF2/JH6 | QVQLVES-GGGVVQPGRSLRL SCAASG-FTFR | N------YGMH | WVRQAPGK GLEWVA | VIWFD----GSNDYYADS VKG | RFTISRDNSKNTLSLQMNSL RAEDTAVYYCAR | DRSVGY-------DGLDV | WGQGT TVTVS S |
| iPS.4 35977 | 21-225_192E4 | VH3/3-33/D4/4-11/RF2/JH6 | QVQLVES-GGGVVQPGRSLRL SCAASG-FTFS | S------YGMH | WVRQAPGK GLEWVA | VIWFD----GSNKNYVDS VKG | RFTISRDNSKNTLYLQMNSL RAEDTAVYYCAR | DRSVGY-------DGMDV | WGQGT TVTVS S |
| iPS.4 36001 | 21-225_192C10 | VH3/3-33/D4/4-11/RF2/JH6 | QVQLVES-GGGVVQPGRSLRL SCAASG-FTFS | N------YGMH | WVRQAPGK GLKWVA | VIWFD----GSNKNYADS VKG | RFTISRDNSKNTLYLQMNSL RAEDTAVYYCAR | DRSVGY-------DGLDV | WGQGT TVTVS S |
| iPS.4 36066 | 21-225_194B7 | VH3/3-33/D4/4-11/RF2/JH6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAVYYCAR | DRSKGY-------DGMDV | WGQGT TVTVS S |
| iPS.4 36078 | 21-225_194H12 | VH3/3-33/D4/4-11/RF2/JH6 | QVQLVES-GGGVVQPGRSLRL SCAASG-FTFR | N------YGMH | WVRQAPGK GLEWVA | VIWFD----GSNDYYADS VKG | RFTISRDNSKNTLSLQMNSL RAEDTAVYYCAR | DRSVGY-------DGLDV | WGQGT TVTVS S |

FIGURE 51 (Continued)

| | | | | | | | | |
|---|---|---|---|---|---|---|---|---|
| iPS:4 36140 | 21-225_197G3 | VH3\|3-33\|D4\|4-11\|RF2/J H6 | QVQLVES-GGGVVQPGRSLRL SCVASG-FTFS | S------RGMH | WVRQAPGK GLEWVA | VIWYD------ GSNRYADS VKG | RFTISRDNSKNTLYLQMNSL RAEDTAVYYCAR | DPSVGY------------DGMDV | WGQGT TVTVS S |
| iPS:4 36167 | 21-225_197E11 | VH3\|3-33\|D4\|4-11\|RF2/J H6 | QVQLVES-GGGVVQPGRSLRL SCAASG-FTFS | N------YGMH | WVRQAPGK GLEWVA | VIWFD------ GSNDYYADS VKG | RFTISRDNSKNTLSLQMNSL RAEDTAVYYCAR | DRSVGY------------DGLDV | WGQGT TVTVS S |
| iPS:4 36292 | 21-225_205H3 | VH3\|3-33\|D4\|4-11\|RF2/J H6 | QVQLVES-GGGVVQPGRSLRL SCAASG-FTFS | S------YGMH | WVRQAPGK GLEWVA | VIWYD------ GSNKYYADS VKG | RFTISRDNSKNTLYLQMNSL RAEDTAVYYCAR | DRSVGY------------DGTDV | WGQGT TVTVS S |
| iPS:4 36802 | 21-225_171E12 | VH3\|3-33\|D4\|4-11\|RF2/J H6 | QVQLVES-GGGVVQPGRSLRL SCAASG-FTFS | S------YGMH | WVRQAPGK GLEWVA | VIWND------ GSNRNYGDS VKG | RFTISRDNSKNTLYLQMNSL RAEDTAVYYCAR | DRTYYSGSGSP--PYYYYYGMDV | WGQGT TVTVS S |
| iPS:4 36816 | 21-225_179H5 | VH3\|3-33\|D4\|4-11\|RF2/J H6 | QVQLVES-GGGVVQPGRSLRL SCAASG-FTFS | S------YGMH | WVRQAPGK GLEWVA | VIWYD------ GSNEYYADS VKG | RFTISRDNSKNTLYLQMNSL RAEDTAVYYCAR | DIRNYY------------YGLDV | WGQGT TVTVS S |
| iPS:4 36960 | 21-225_198D2 | VH3\|3-33\|D4\|4-11\|RF2/J H6 | QVQLVES-GGGVVQPGRSLRL SCAASG-FTFR | S------YGMH | WVRQAPGK GLEWVA | VIIYD------ GSYKYYADS VKG | RFTISRDNSKNTLYLQMNSL RAEDTAVYYCAR | TYSG------------GMDV | WGQGT TVTVS S |
| iPS:4 36974 | 21-225_190H7 | VH3\|3-33\|D4\|4-11\|RF2/J H6 | QVQLVES-GGGVVQPGRSLRL SCAASG-FNFR | S------YGMH | WVRQAPGK GLEWVA | VIIYD------ GSNKYYADS VKG | RFTISRDNSKNTLYLQMNSL RAEDTAVYYCAR | TYSG------------GMDV | WGQGT TVTVS S |
| iPS:4 36982 | 21-225_190D10 | VH3\|3-33\|D4\|4-11\|RF2/J H6 | QVQLVES-GGGVVQPGRSLRL SCAASG-FTFS | S------YGMH | WVRQAPGK GLEWVA | VIIYD------ GSNKYYADS VKG | RFTISRDNSKNTLYLQMNSL RAEDTAVYYCAR | TYSG------------GMDV | WGQGT TVTVS S |
| iPS:3 37274 | 21-225_196D4 | VH3\|3-33\|D4\|4-11\|RF2/J H6 | QVQLVES-GGGVVQPGRSLRL SCAASG-FTFS | S------YGMH | WVRQAPGK GLEWVA | VIWYD------ GSNRNYADS VKG | RFTISRDNSKNTLYLQMNSL RVEDTAVYYCAR | DRSKGY------------DGMDV | WGQGT TVTVS S |
| iPS:3 92664 | 21-225_20F6 | VH3\|3-33\|D4\|4-11\|RF2/J H6 | QVQLVES-GGGVVQPGRSLRL SCAASG-FTFS | S------YGMH | WVRQAPGK GLEWGA | VIWHD------ GSNKYYADS VKG | RFTISRDNAKNTLYLQMNSL RAEDTAVYYCAR | DLSMG------------GMDV | WGQGT TVTVS S |
| iPS:3 92738 | 21-225_18G4 | VH3\|3-33\|D4\|4-11\|RF2/J H6 | QVQLVES-GGGVVQPGRSLRL SCAASG-FTFS | S------YGMH | WVRQAPGK GLEWVA | IIWYD------ GSNKYYADS VKG | RFTISRDNSKNTLYLQMNSL RAEDTAVYYCAR | DLSMG------------GMDV | WGQGT TVTVS S |
| iPS:3 92798 | 21-225_22C7 | VH3\|3-33\|D4\|4-11\|RF2/J H6 | QVQLVES-GGGVVQPGRSLRL SCAASG-FTFS | S------YGMH | WVRQAPGK GLEWGA | VIWHD------ GSNKYYADS VKG | RFTISRDNAKNTLYLQMNSL RAEDTAVYYCAR | DLSMG------------GMDV | WGQGT TVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 92956 | 21-225_27A11 | VH3|3-33|D4|4-11|RF2|JH6 | QVQLVES-GGGVVQPGRSLRLSCAASG-FTFS | S-----YGMH | WVRQAPGK GLEWVA | VIWYD----GSNKYYADS VKG | RFTISRDNSKNTLYLQMNSL RAEDTAVYHCAR | DSSPY--------GMDV | WGQGT TVTVS S |
| iPS:3 92994 | 21-225_26G11 | VH3|3-33|D4|4-11|RF2|JH6 | QVQLVES-GGGVVQPGRSLRLSCAASG-FTFS | S-----YGMH | WVRQAPGK GLEWVA | VIWYD----GSNKYYADS VKG | RFTISRDNSKNTLYLQMNSL RAEDTAVYYCAR | RYSNSW-------SGGMDV | WGQGT TVTVS S |
| iPS:3 93014 | 21-225_26D12 | VH3|3-33|D4|4-11|RF2|JH6 | QVQLVES-GGGVVQPGRSLRLSCAASG-FTFS | S-----YGMH | WVRQAPGK GLEWVA | VIWYD----GSNKYYADS VKG | RFTISRDNSKNTLYLQMNSL PAADTAVYYCAR | DSSPY--------GMDV | WGQGT TVTVS S |
| iPS:3 93152 | 21-225_25B3 | VH3|3-33|D4|4-11|RF2|JH6 | QVQLVES-GGGVVQPGRSLRLSCAASG-FTFS | S-----YGMH | WVRQAPGK GLEWVA | VIWYD----GSNKYYADS VKG | RFTISRDNSKNTLYLQMNSL RAEDTAVYYCAR | DSSPY--------GMDV | WGQGT TVTVS S |
| iPS:3 93840 | 21-225_3F8 | VH3|3-33|D4|4-11|RF2|JH6 | QVQLVES-GGGVVQPGRSLRLSCAASG-FTFS | S-----YGMH | WVRQAPGK GLEWGA | VIWHD----GSNKYYADS VKG | RFTISRDMAKNTLYLQMNSL RAEDTAVYYCAR | DLSMG--------GMDV | WGQGT TVTVS S |
| iPS:3 93930 | 21-225_7E11 | VH3|3-33|D4|4-11|RF2|JH6 | QVQLVES-GGGVVQPGRSLRLSCAASG-FTFS | S-----FGMH | WVRQAPGK GLEWVA | IIWHD----GSNKYYADS VKG | RFTISRDNSNNTLYLQMNSL RAEDTAVYYCAR | DLSMG--------GMDV | WGQGT TVTVS S |
| iPS:3 93964 | 21-225_6G1 | VH3|3-33|D4|4-11|RF2|JH6 | QVQLVES-GGGVVQPGRSLRLSCAASG-FIFS | S-----YGMH | WVRQAPGK GLEWVA | IIWHD----GSNKYYADS VKG | RFTISRDNSKNTLYLQMNSL RAEDTAMYYCAR | DLSMG--------GMDV | WGQGT TVTVS S |
| iPS:3 94012 | 21-225_15A3 | VH3|3-33|D4|4-11|RF2|JH6 | QVQLVES-GGGVVQPGRSLRLSCAASG-FTFS | S-----YGIH | WVRQAPGK GLEWVA | VIWHD----GSNKYYADS VKG | RFTISRDNSKNTLYLQMNSL RAEDTAVYYCAR | DLSMG--------GMDV | WGQGT TVTVS S |
| iPS:3 94016 | 21-225_13D4 | VH3|3-33|D4|4-11|RF2|JH6 | QVQLVES-GGGVVQPGRSLRLSCAASG-FTFS | S-----YGMH | WVRQAPGK GLEWVA | VIWHD----GSNKYYADS VKG | RFTISRDNSKNTLYLQMNSL RAEDTAVYYCAR | DLSMG--------GMDV | WGQGT TVTVS S |
| iPS:3 94083 | 21-225_16E6 | VH3|3-33|D4|4-11|RF2|JH6 | QVQLVES-GGGVVQPGRSLRLSCAASG-FTFS | S-----YGMH | WVRQAPGK GLEWVA | VIWHD----GSNKYVDS VKG | RFTISRDNSKNTLNLQMNSL RAEDTAVYYCAR | DLSMG--------GMDV | WGQGT TVTVS S |
| VH4|4-59|D3|3-9|RF1|JH4 | Germline | | | | | | | |
| iPS:4 35839 | 21-225_191B1 | VH4|4-59|D3|3-9|RF1|JH4 | QVQLQES-GPGLVKPSETLSLTCTVSG-GSIS | S-----YHWS | WIRQPAGK GLEWIG | HIYT-----SGSTRYNPS LKS | RVTMSVDTSKNQFSLKLSSV TAADTAVYYCAR | LRYNWN------FPFFDY | WGQGI LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36158 | VH4/4-59/D3J3-9|RF1/JH4 | QVHLQES-GPGLVKPSETLSL TCTVSG-GSIS | A------YSWS | WIRQPAGK GLEWIG | RLSP------GGSTNFNPS LKS | RVTMSVDTSKNQFSLRLSSV TAADTAVYYCAR | LRYNWN------FFXFDY | WGQGA LVTVS S |
| | Germline | | | | | | | H_FR4 |
| VH4/4-30.1/D3J3-22/RF2/JH6 | | GPGLVKPSQTLSL TCTVSG-GSIS | SG------ | | SGSTYNPS LKS | TAADTAVYYCAR | | |
| iPS:4 35843 | VH4/4-30.1/D3J3-22/RF2/J H6 | QVQLQES-GPGLVKPSQTLSL TCTVSG-GSIS | SG----GYYWN | WIRQHPGK GLEWIG | YIFY------SGSTYYNPS LKS | RVTISVDTSKNQFSLKLSSV TAADTAVYYCAR | GDYDGSGSY------HYYYGMDV | WGQGT TVTVS S |
| iPS:4 35847 | VH4/4-30.1/D3J3-22/RF2/J H6 | QVQLQES-GPGLVKPSQTLSL TCTVSG-GSIS | SG----DYYWN | WIRQHPGK GLEWIG | YIFY------SGSTYYNPS LKS | RVTISVDTSKNQFSLKLSSV TAADTAVYYCAR | GDYDGSGSY------HYYYGMDV | WGQGT TVTVS S |
| iPS:4 35851 | VH4/4-30.1/D3J3-22/RF2/J H6 | QVQLQES-GPGLVKPSQTLSL TCTVSG-GSIN | SG----DYYWN | WIRQHPGK GLEWIG | YIFY------SGSTYYNPS LKS | RVTISVDTSKNQFSLKLSSV TAADTAVYYCAR | GDYDGSGSY------HYYYGMDV | WGQGT TVTVS S |
| iPS:4 35905 | VH4/4-30.1/D3J3-22/RF2/J H6 | QVQLQES-GPGLVKPSQTLSL TCTVSG-GSIN | SG----GYYWN | WIRQHPGK GLEWIG | FIFY------SGSTYYNPS LKS | RVTISVDTSKNQFSLKLNSV TAADTAVYYCAR | GDYDGSGSY------HYYYGMDV | WGQGT TVTVS S |
| iPS:4 35911 | VH4/4-30.1/D3J3-22/RF2/J H6 | QVQLQES-GPGLVKPSQTLSL TCTVSG-GSIS | SG----DYYWN | WIRQHPGK GLEWIG | YIFY------SGSTYYNPS LKS | RVTISVDTSKNQFSLKLSSV TVADTAVYYCAR | GDYDGSGSY------HYYYGMDV | WGQGT TVTVS S |
| iPS:4 35913 | VH4/4-30.1/D3J3-22/RF2/J H6 | QVQLQES-GPGLVKPSQTLSL TCTVSG-GSIS | SG----VYYWS | WIRQHPGK GLEWIG | NIYY------SGSTYYNPS LKS | RIIISVDTSKNQFSLKLSSV TAADTAVYYCAR | GDYDGSGSY------HYYGLDV | WGQGT TVTVS S |
| iPS:4 35939 | VH4/4-30.1/D3J3-22/RF2/J H6 | QVQLQES-GPGLVKPSQTLSL TCTVSG-GSIN | SG----DYYWN | WIRQHPGK GLEWIG | YIFY------SGSTYYNPS LKS | RVTISVDTSKNQFSLKLSSV TAADTAVYYCAR | GDYDGSGSY------HYYYGMDV | WGQGT TVTVS S |
| iPS:4 35967 | VH4/4-30.1/D3J3-22/RF2/J H6 | QVQLQES-GPGLVKPSQTLSL TCTVSG-GSIS | SG----DYYWN | WIRQHPGK GLEWIG | FIFY------SGSTYYNPS LKS | RVTISVDTSKNQFSLKLSSV TVADTAVYYCAR | GDYDGSGSY------HHYYGMDV | WGQGT TVTVS S |
| iPS:4 35973 | VH4/4-30.1/D3J3-22/RF2/J H6 | QVQLQES-GPGLVKPSQTLSL TCTVSG-GSIS | SV----SYYWS | WIRQHPGK GLEWIG | NLYY------SGSTYYNPS LRS | RATISVDTSKNQFSLKLSSV IAADTAVYYCIR | GDYDGSGSY------HYYHGMDV | WGQGT TVTVS S |
| iPS:4 36007 225_192G12 | VH4/4-30.1/D3J3-22/RF2/J H6 | QVQLQES-GPGLVKPSQTLSL TCTVSG-GSIS | SG----VYHWS | WIRQHPGK GLEWIG | NIHY------SGSTYYNPS LKS | RVTISVDTSKNQFSLKLSSV TAADTAVYYCAR | GDYDGSGSY------HYYYGMDV | WGQGT TVTVS S |

FIGURE 51 (Continued)

| | | | | | | | | |
|---|---|---|---|---|---|---|---|---|
| iPS:4_36009 | 21-225_193A1 | VH4/4-30.1\|D3\|3-22\|RF2\|JH6 | QVQLQES-GPGLVKPSQTLSLTCTVSG-GSIS | SG----VYYWS | WIRQHPGKGLEWIG | NIYY----SGSTYYNPSLKS | RLTISADTSKNQFSLKLSSVTAADTAVYYCAR | GDYDGSGSY------HYYYGMDV | WGQGTTVTVSS |
| iPS:4_36011 | 21-225_193B1 | VH4/4-30.1\|D3\|3-22\|RF2\|JH6 | QVQLQES-GPGLVKPSQTLSLTCTVSG-GSIS | SG----VYYWS | WIRQHPGKGLEWIG | NIYY----SGSTYYNPSLKS | RVTISVDTSKNQFSLKLSSVTAADTAVYYCAR | GDYDGSGSY------HYYYGMDV | WGQGTTVTVSS |
| iPS:4_36017 | 21-225_193F3 | VH4/4-30.1\|D3\|3-22\|RF2\|JH6 | QVQLQES-GPGLVKPSQTLSLTCTVSG-GSIS | SG----DYYWN | WIRQHPGKGLEWIG | YIFY----SGSTYYNPSLKS | RVTISVDTSKNQFSLKLSSVTAADTAVYYCAR | GDYDGSGSY------HYYYGMDV | WGQGTTVTVSS |
| iPS:4_36029 | 21-225_193H6 | VH4/4-30.1\|D3\|3-22\|RF2\|JH6 | QVQLQES-GPGLVKPSQTLSLTCTVSG-GSIN | SG----DYYWN | WIRQHPGKGLEWIG | YIFY----SGSTYYNPSLKS | RVTISVDTSKNQFSLKLSSVTAADTAVYYCAR | GDYDGSGSY------HYYYGMDV | WGQGTTVTVSS |
| iPS:4_36035 | 21-225_193C8 | VH4/4-30.1\|D3\|3-22\|RF2\|JH6 | QVQLQES-GPGLVKPSQTLSLTCTVSG-GSIS | SG----DYYWN | WIRQHPGKGLEWIG | YIFY----SGSTYYNPSLKS | RVTISVDTSKNQFSLKLSSVTAADTAVYYCAR | GDYDGSGSY------HYYYGMDV | WGQGTTVTVSS |
| iPS:4_36037 | 21-225_193D8 | VH4/4-30.1\|D3\|3-22\|RF2\|JH6 | QVQLQES-GPGLVKPSQTLSLTCTVSG-GSIS | SG----GYYWN | WIRQHPGKGLEWIG | FIFY----SGSTYYNPSLKS | RVSISVDTSKNQFSLKLSSVTAADTAVYYCAR | GDYDGSGSY------HYYYGMDV | WGQGTTVTVSS |
| iPS:4_36041 | 21-225_193G8 | VH4/4-30.1\|D3\|3-22\|RF2\|JH6 | QVQLQEK-GPGLVKPSQTLSLTCTVSG-GSVS | SG----VYYWS | WIRQHPGKGLEWIG | NIYY----SGSTYNNPSLKS | RVTISVDTSKNQFSLKLNSVNVADTAVYYCAR | GDYDGSGSY------HFYYGLDV | WGHGTTVTVSS |
| iPS:4_36035 | 21-225_194E5 | VH4/4-30.1\|D3\|3-22\|RF2\|JH6 | QVQLQES-GPGLVKPSQTLSLTCTVSG-GSIS | SG----DYYWN | WIRQHPGKGLEWIG | YIFY----SGSTYYNPSLKS | RVTISVDTSKNQFSLKLSSVTAADTAVYYCAR | GDYDGSGSY------HYYYGMDV | WGQGTTVTVSS |
| iPS:4_36062 | 21-225_194E6 | VH4/4-30.1\|D3\|3-22\|RF2\|JH6 | QVQLQES-GPGLVKPSQTLSLTCTVSG-GSIS | SG----DYYWN | WIRHHPGKGLEWIG | YIFY----SGSTYYNPSLKS | RVTISVDTSKNQFSLKLSSVTAADTAVYYCAR | GDYDGSGSY------HYYYGMDV | WGQGTTVTVSS |
| iPS:4_36064 | 21-225_196H12 | VH4/4-30.1\|D3\|3-22\|RF2\|JH6 | QVQLQES-GPGLVKPSQTLSLTCTVSG-GSIS | SG----VYYWS | WIRQHPGKGLEWIG | NIFY----SGSTYYNPSLKS | RVTISIDTSKNQFSLKLSSVTAADTAVYYCAR | GDYDGSGSY------HYYYGMDV | WGQGTTVTVSS |
| iPS:4_36134_225_196H12 | 21-_196H12 | VH4/4-30.1\|D3\|3-22\|RF2\|JH6 | QVQLQES-GPGLVKPSQTLSLTCTVSG-GSIS | SG----DYYWN | WIRQHPGKGLEWIG | YIFY----SGSTYYNPSLKS | RITISIDTSKNQFSLKLSSVNVADTAVYYCAR | GDYDGSGSY------HYYYGLDV | WGQGTTVTVSS |
| iPS:4_36146 | 21-225_197F4 | VH4/4-30.1\|D3\|3-22\|RF2\|JH6 | QVQLQES-GPGLVKPSQTLSLTCTVSG-GSIS | SG----DYYWN | WIRQHPGKGLEWIG | YIFY----SGSTYYNPSLKS | RITISVDTSKNQFSLKLSSVTAADTAVYYCAR | GDYDGSGSY------HYYYGLDV | WGQGTTVTVSS |
| iPS:4_36177 | 21-225_198B1 | VH4/4-30.1\|D3\|3-22\|RF2\|JH6 | QVQLKES-GPGLVKPSQTLSLTCTVSG-GSIS | SG----DYYWN | WFRQHPGKGLEWIG | YIFH----SGSTYYNPSLKS | RVTVSVDTSKNQFSLKLSSVTAADTAVYYCAR | GDYDGSGSY------HYYYGMDV | WGRGTTVTVSS |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36179 | 21-225_198E1 | VH4/4-30.1/D3J3-22/RF2/JH6 | QVQLQES-GPGLVKPSQTLSL TCTVSG-GSIN | SG----GYYWN | WIRQHPGK GLEWIG | FIFY----- SGSTYYNPS LKS | RLSISVDTSKNQFSLKLSSV TAADTAVYYCAR | GDYDSGSY---- -----HYYYGMDV | WGQGT TVTVS S |
| iPS:4 36197 | 21-225_199C2 | VH4/4-30.1/D3J3-22/RF2/JH6 | QVQLQES-GPGLVKPSQTLSL TCTVSG-GSIS | SG----DYYWN | WIRQHPEK GLEWIG | YIFY----- SGSTYYNPS LKS | RVTISVDTSMTQFSLKLTSV TAADTAVYYCAR | GDYDGSGSY--- -----HFYYGMDV | WGQGT TVTVS S |
| iPS:4 36207 | 21-225_199C7 | VH4/4-30.1/D3J3-22/RF2/JH6 | QVQLQES-GPGLVKPSQTLSL TCTVSG-GSIN | SG----GYYWN | WIRQHPEK GLEWIG | FIFY----- SGSTYYNPS LKS | RVSISVDTSKNQFSLKLSSV TAADTAVYYCAR | GDYDGSGSY--- -----HFYYGMDV | WGQGT TVTVS S |
| iPS:4 36226 | 21-225_200F10 | VH4/4-30.1/D3J3-22/RF2/JH6 | QVQLQES-GPGLVKPSQTLSL TCTVSG-GSIS | SG----DYYWN | WLRQHPEK GLEWIG | YIFY----- SGSTYYNPS LKS | RLTISVDTSMTQFSLKLTSV TAADTAVYYCAR | GDYDGSGSY--- -----HYYYGMDV | WGQGT TVTVS S |
| Germline | | | | | H_FR1 | H_CDR1 | H_FR2 | H_CDR2 | H_FR3 | H_CDR3 | H_FR4 |
| iPS:4 35849 | 21-225_191C3 | VH4/4-30.4/D3J3-22/RF2/JH6 | QVQLQES-GPGLVKPSQTLSL TCTVSG-GSIS | SG----DYYWN | WIRQLPGK GLEWIG | YIFY----- SGSTYYNPS LKS | RLTISVDTSKNQFSLKLNSV TAADTAVYYCAR | GDYDGSGSY--- -----HFYYGMDV | WGQGT TVTVS S |
| iPS:4 36015 | 21-225_193D3 | VH4/4-30.4/D3J3-22/RF2/JH6 | QVQLQES-GPGLVKPSQTLSL TCTVSG-GSIS | SG----DYYWN | WIRQLPGK GLEWIG | YIFY----- SGSTYYNPS LKS | RLTISVDTSKNQFSLKLSSV TAADTAVYYCTR | GDYDGSGSY--- -----HFYYGMDV | WGQGT TVTVS S |
| iPS:4 36049 | 21-225_193B12 | VH4/4-30.4/D3J3-22/RF2/JH6 | QVQLQES-GPGLVKPSQTLSL TCTVSG-GSIS | SA----DYYWN | WIRQLPGK GLEWIG | YIFY----- SGSTYYNPS LKS | RLTISVDTSKNQFSLKLSSV TAADTAVYYCAR | GDYDGSGSY--- -----HFYYGMDV | WGQGT TVTVS S |
| iPS:4 36088 | 21-225_195C8 | VH4/4-30.4/D3J3-22/RF2/JH6 | QVQLQES-GPGLVKPSQTLSL TCTVSG-GSIS | SG----DYYWN | WIRQLPGK GLEWIG | YIFY----- SGSTYYNPS LKS | RLTISVDTSKNQFSLKLSSV TAADTAVYYCAR | GDYDGSGSY--- -----HFYYGMDV | WGQGT TVTVS S |
| iPS:4 36195 | 21-225_198G10 | VH4/4-30.4/D3J3-22/RF2/JH6 | QVQLQES-GPGLVKPSQTLSL TCTVSG-GSIS | SG----GYYWN | WIRQHPGK GLEWIG | YIFY----- SGSTYYNPS LKS | RLTISVDTSKNQFSLKLSSV TAADTAVYYCGR | GDYDGSGSY--- -----HFYYGMDV | WGQGT TVTVS S |
| Germline | | | | | H_FR1 | H_CDR1 | H_FR2 | H_CDR2 | H_FR3 | H_CDR3 | H_FR4 |
| iPS:4 35863 | 21-225_191H4 | VH4/4-30.1/D5J5-24/RF3/JH5 | QVQLQES-GPGLVKPSQTLSL TCTVSG-GSIS | SG----GYYWN | WIRQHPGK GLEWIG | YIFY----- SGSTYYNPS LRS | RLTISIDTSKNQFSLKLTSV TAADTAVYYCGR | SGYNWD------ ------NGVDP | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35943 | 21-225_191C9 | VH4J4-30.1/D5[5-24]RF3/JH5 | QVQLQES-GPGLVKPSQTLSL TCTVSG-GSIS | SG-----GYYWN | WIRQHPGK GLEWIG | VIYY------SGSTYYRPS LKS | RVTISVDTSKNQFSLRLNSV TAADTAVYYCAR | SGYNWD------AGVDP | WGQGT LVTVS S |
| iPS:4 36094 | 21-225_195B10 | VH4J4-30.1/D5[5-24]RF3/JH5 | QVQLQES-GPGLVKPSQTLSL TCTVSG-GSIS | NS-----GYYWS | WIRQRPGK GLEWIG | YMYY------SGSTYYRPS LKS | RVTISVDTSKNQFYLRLSAV TAADTAVYYCAR | GGYNWN------NGFDC | WGQGT LVTVS S |
| | Germline | | | | | | | H_FR4 |
| | VH4J3-33/D2[2-15]RF3/JH6 | | | H_CDR1 | H_FR2 | H_CDR2 | H_FR3 | H_CDR3 | |
| iPS:4 35869 | 21-225_190B1 | VH3J3-33/D2[2-15]RF3/JH6 | QVQLVES-GGGVVQPGRSLRL SCATSG-FTFS | S------YGMH | WVRQAPGK GLEWVA | VIWYD------GSNKNYADS VKG | RFTISRDNSKNTLYLQMNSL RAEDTAVYYCAR | DRTVGY------SGMDV | WGQGT TVTVS S |
| iPS:4 36260 | 21-225_203H1 | VH3J3-33/D2[2-15]RF3/JH6 | QVQLVES-GGGVVQPGRSLRL SCAASG-FTFS | S------YGMH | WVRQAPGK GLEWVA | VIWYD------GSNKNYADS VKG | RFTISRDNSKNTLYLQMNSL RAEDTAVYYCAR | DRTVGY------NGMDV | WGQGT TVTVS S |
| iPS:4 36490 | 21-225_221F6 | VH3J3-33/D2[2-15]RF3/JH6 | QVQLVES-GGGVVQPGRSLRL SCAASG-FTFS | S------NGMH | WVRQAPGK GLEWVA | VIWYD------GSNENYADS VKG | RFTISRDNSKNTLYLQMNSL RAEDTAVYYCAR | DRDVGY------NGMDV | WGQGT TVTVS S |
| iPS:4 36502 | 21-225_222A11 | VH3J3-33/D2[2-15]RF3/JH6 | QVQLVES-GGGVVQPGRSLRL SCAASG-FTFS | S------YGMH | WVRQAPGK GLEWVA | VIWYD------GSNKNYADS VKG | RFTISRDNSKNTLYLQMNSL RAEDTAVYYCAR | DRDVGY------NGMDV | WGQGT TVTVS S |
| iPS:4 36514 | 21-225_222D10 | VH3J3-33/D2[2-15]RF3/JH6 | QVQLVES-GGGVVQPGRSLRL SCAASG-FTFS | S------YGMH | WVRQAPGK GLEWVA | VIWYD------GSNKNYADS VKG | RFTISRDNSKNTLYLQMNSL RAEDTAVYYCAR | DRDVGY------NGMDV | WGQGT TVTVS S |
| iPS:4 36522 | 21-225_223H10 | VH3J3-33/D2[2-15]RF3/JH6 | QVQLVES-GGGVVQPGRSLRL SCAASG-FTFS | S------YGMH | WVRQAPGK GLEWVA | VIWYD------GSNKNYADS VKG | RFTISRDHSKNTLYLQMNSL RAEDTAVYYCAR | DRDVGY------NGMDV | WGQGT TVTVS S |
| | Germline | | | H_CDR1 | H_FR2 | H_CDR2 | H_FR3 | H_CDR3 | H_FR4 |
| | VH4J3-21D1[1-1]RF3/JH5 | | | | | | | | |
| iPS:4 35883 | 21-225_185A1 | VH3J3-21/D1[1-1]RF3/JH5 | EVQLVES-GGGLVKPGGSLRL SCAASG-FTFN | S------YSMN | WVRQAPGK GLEWVS | SISSS------GSYIYYADS VKG | RFTISRDNAKNSLYLQMHSL RAEDTAVYYCAR | SNL------FDC | WGQGT PVTVS S |
| | Germline | | | H_CDR1 | H_FR2 | H_CDR2 | H_FR3 | H_CDR3 | H_FR4 |
| | VH4J3-23D1[1-1]RF3/JH3 | | | | | | | | |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35895 | 21-225_188E8 VH3‐ 23D1\|1-1\|RF1\|JH 3 | EVQLLES- GGGLVQPGGSLRL SCAASG-FTFS | S------SAMN | WVRQAPGK GLEWVS | VISGS---- GGTYYADS VKG | RFTISRDNSKNTLYLQMNSL RAEDTAVYYCAK | RNTDD------AFDI | WGQGT MVTVS S |
| | VH3\|3-11\|D7\|7-27\|RF3\|JH4 Germline | | | | | | | |
| | | H_FR1 | H_CDR1 | H_FR2 | H_CDR2 | H_FR3 | H_CDR3 | H_FR4 |
| iPS:4 35903 | 21-225_190E2 VH3\|3-11\|D7\|7-27\|RF3\|J H4 | QVQLVES- GGGLVKPGGSLRL SCAASG-FTFS | D------YYMS | WIRQAPGK GLEWLS | YISSS---- GTTVFYADS VKG | RFTISRDNAKNSLYLQMNSL RAEDTAVYYCAR | EWVG------ADY | WGQGT LVTVS S |
| iPS:4 35923 | 21-225_190H6 VH3\|3-11\|D7\|7-27\|RF3\|J H4 | QVQLVES- GGGLVKPGGSLRL SCAASG-FTFS | D------YYMS | WIRQAPGK GLEWLS | YISSS---- GTTVFYADS VKG | RFTISRDNAKNSLYLQMNSL RAEDTAVYYCAR | EWVG------ADY | WGQGT LVTVS S |
| iPS:4 35953 | 21-225_191B12 VH3\|3-11\|D7\|7-27\|RF3\|J H4 | QVQLVES- GGGLVKPGGSLRL SCAASG-FTFS | D------YYMS | WIRQAPGK GLEWVS | XISSS---- GTTVFYADS VKG | RFTISRDNAKNSLYLQMNSL RAEDTAVYYCAR | EWVG------ADY | WGQGT LVTVS S |
| iPS:4 36098 | 21-225_195G11 VH3\|3-11\|D7\|7-27\|RF3\|J H4 | QVQLVES- GGGLVKPGGSLRL SCAASG-FTFS | D------YYMS | WIRQAPGK GLEWLS | YISSS---- GITMYYADS VKG | RFTISRDNAKNSLYLQMNSL RAEDTAVYYCAR | EWVG------ADY | WGQGT LVTVS S |
| iPS:4 36102 | 21-225_196B1 VH3\|3-11\|D7\|7-27\|RF3\|J H4 | QVQLVES- GGGLVKPGGSLRL SCAASG-FTFS | D------YYMS | WIRQAPGK GLEWIS | YISSS---- GTTVFYADS VKG | RFTISRDNAKNSLYLQMNSL RAEDTAVYYCAR | EWVG------ADY | WGQGT LVTVS S |
| iPS:4 36104 | 21-225_196C1 VH3\|3-11\|D7\|7-27\|RF3\|J H4 | EVQLVES- GGGLVKPGGSLRL SCAASG-FTFS | D------YYMS | WIRQAPGK GLEWLS | YISSS---- GTTVFYADS VKG | RFTISRDNAKNSLYLQMNSL RAEDTAVYYCAR | EWVG------ADY | WGQGT LVTVS S |
| | VH3\|3-23\|D6\|6-19\|RF2\|JH4 Germline | | | | | | | |
| | | H_FR1 | H_CDR1 | H_FR2 | H_CDR2 | H_FR3 | H_CDR3 | H_FR4 |
| iPS:4 35965 | 21-225_192H2 VH3\|3-23\|D6\|6-19\|RF2\|J H4 | EVQLLES- GGGLIQPGGSLRL SCAASG-FTFS | S------SAMS | WVRQAPGK GLEWVS | AISGS---- GGNTFYADS VKG | RFTISRDNSKNTLYLQMNSL RAEDTAVYYCAK | LIAVVG------SHYFDI | WGQGT LVTVS S |
| iPS:4 36160 | 21-225_197C9 VH3\|3-23\|D6\|6-19\|RF2\|J H4 | EVQLLES- GGGLAQPGGSLRL SCAASG-FTFR | S------YAMS | WVRQAPGK GLEWVS | VISGR---- GGNTYYADS VKG | RFTISRDNSKNTLYLQMNSL RAEDTAVYYCAK | GIAVAG------SHYFDY | WGQGT LVTVS S |
| iPS:3 92954 | 21-225_26A10 VH3\|3-23\|D6\|6-19\|RF2\|J H4 | EVQLLES- GGGLVQPGGSLRL SCAASG-FTFS | S------YAMS | WVRQAPGK GLEWVS | VISGS---- GVNTFYADS VKG | RFTISRDNSKNTLYLLMNSL RAEDTAVYYCAK | KIAVAG------THYFDY | WGQGT LVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4/4-30.1/D5/5-24/RF3/JH4 | | | | | | | | |
| iPS:4-35983 | VH4/4-30.1/D5/5-24/RF3/JH4 | QVQLQES-GPGLVKPSQTLSL TCTVSG-DSIN | NG----GYYWS | WIRQHPGK GLEWIG | YIFY----SGSTYYNPS LKS | RVTISVDTSKNQFSLKLNSV TAADTAVYFCAR | AGYNWD-------NGFDY | WGQGT LVTVS S |
| iPS:4-36043 | VH4/4-30.1/D5/5-24/RF3/JH4 | QVQLQES-GPGLVKPSQTLSL TCTVSG-DSIN | NG----GYYWS | WIRQHPGK GLEWIG | YIFY----SGSTYYNPS LKS | RVTISVDTSKNQFSLKLNSV TAADTAVYFCAR | AGYNWD-------NGFDY | WGQGT LVTVS S |
| iPS:4-36084 | VH4/4-30.1/D5/5-24/RF3/JH4 | QVQLQES-GPGLVKPSQTLSL TCTVSG-DSIS | SG----GYYWS | WIRQHPGK GLEWIG | YSYY----SGSTYYNPS LKS | RVTISVDMSKNQFSLKLSSV TAADTAVYYCAR | GGYNWN-------NGFDY | WGQGA LVTVS S |
| iPS:4-37138 | VH4/4-30.1/D5/5-24/RF3/JH4 | QVQLQES-GPGLVKPSQTLSL TCTVSG-GSIS | TA----FYYWS | WIRQHPGK GLEWIG | YIYF----SGSTYYNPS LKS | RVTISVDTSKNQFSLNLSSV TAADTAVYYCAR | ARGYHY------SIFDY | WGQGT LVTVS S |
| | Germline | H_FR1 | H_CDR1 | H_FR2 | H_CDR2 | H_FR3 | H_CDR3 | H_FR4 |
| VH3/3-23/D3/3-16/RF1/JH3 | | | | | | | | |
| iPS:4-36003 | VH3/3-23/D3/3-16/RF1/JH3 | EVQLLES-GGGLVQPGGSLRL SCSASG-FTFS | S-----YAMS | WVRQAPGK GLEWVS | AISGR---GGSTFYADS VKG | RFTISRDNSKNTLYLQMNSL RAEDTAVYYCAR | RLALDG-------YDAFDI | WGQGT MVTVS S |
| | Germline | H_FR1 | H_CDR1 | H_FR2 | H_CDR2 | H_FR3 | H_CDR3 | H_FR4 |
| VH3/3-23/D7/7-27/RF2/JH4 | | | | | | | | |
| iPS:4-36019 | VH3/3-23/D7/7-27/RF2/JH4 | EVQLLES-GGGLAQPGGSLRL SCAASG-FTFS | S-----YAMN | WVRQAPGK GLEWVS | AIIGN---GGRTYYADS VKG | RFSISRDNSKNTLFLQMNSL RAEDTAVYYCAR | DLGRYS------YGFFDY | WGQGT LVTVS S |
| | Germline | H_FR1 | H_CDR1 | H_FR2 | H_CDR2 | H_FR3 | H_CDR3 | H_FR4 |
| VH4/4-30.1/D1/1-1/RF1/JH6 | | | | | | | | |
| iPS:4-36025 | VH4/4-30.1/D1/1-1/RF1/JH6 | QVQLQES-GPGLVKPSQTLSL TCTVSG-GSIS | SG----GYYWS | WIRQHPGK GLEWIG | YIYY----SGSTYYNPS LKS | RVTISVDTSKNQFSLKLSSV AAADTAVYYCAR | GEYNWN-------HGMDV | WGQGT TVTVS S |
| | Germline | H_FR1 | H_CDR1 | H_FR2 | H_CDR2 | H_FR3 | H_CDR3 | H_FR4 |
| VH4/4-34/D4/4-11/RF2/JH4 | | | | | | | | |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 36033 | 21-225_193E7 | VH4|4-34|D4|4-11|RF2|JH4 | QVQLQQW-GAGLLKPSETLSL TCAVYG-GSFS | G------YFWT | WIRQPPGK GLEWIG | EINH------SGSTNYNPS LKS | RVTISVDTSKNQFSLKLSSV TAADTAVYYCAR | DYG------------ADY | WGQGT LVAVS A |
| iPS:4 36199 | 21-225_199E3 | VH4|4-34|D4|4-11|RF2|JH4 | QVQLQQW-GAGLLKPSETLSL TCAVYG-GSFS | G------YFWT | WIRQPPGK GLEWIG | EINH------SGSTNYNPS LKS | RVTISVDTSKNQFSLKLSSV TAADTAVYYCAR | DYG------------ADY | WGQGT LVAVS A |
| iPS:4 36228 | 21-225_200F12 | VH4|4-34|D4|4-11|RF2|JH4 | QVQLQQW-GAGLLKPSETLSL TCAVYG-GSFS | G------YFWT | WIRQPPGK GLEWIG | EISH------SGSTNYNPS LKS | RVTISVDTSKNQFSLKVSSV TAADTAVYYCAR | DYG------------ADY | WGQGT LVTVS S |
| iPS:4 36230 | 21-225_201A1 | VH4|4-34|D4|4-11|RF2|JH4 | QVQLQQW-GAGLLKPSETLSL TCAVYG-GSFS | G------YFWT | WIRQPPGK GLEWIG | EISH------SGRTNYNPS LKS | RVTISVDTSKNQFSLKLSSV TAADTAVYYCAR | DYG------------ADY | WGQGT LVTVS S |
| iPS:4 36242 | 21-225_201A10 | VH4|4-34|D4|4-11|RF2|JH4 | QVQLQQW-GAGLLKPSETLSL TCAVYG-GSFS | G------YFWT | WIRQPPGK GLEWIG | EISH------SGSTNYNPS LKS | RVTISVDTSKNQFSLKVNSV TAADTAVYYCAR | DYG------------ADY | WGQGT LVTVS S |
| iPS:4 36286 | 21-225_204H8 | VH4|4-34|D4|4-11|RF2|JH4 | QVQLQQW-GAGLLKPSETLFL TCAVYG-GSFS | G------YFWT | WIRQPPGK GLEWIG | EISH------SGSTYNPS LKS | RVTISVDKSKNQFSLKLSSV TAADTAVYYCAR | DYG------------ADY | WGQGT LVTVS S |
| iPS:4 36308 | 21-225_205H8 | VH4|4-34|D4|4-11|RF2|JH4 | QVQLQQW-GAGLLKPSETLSL TCAVYG-GSFS | G------YFWS | WIRQPPGK GLEWIG | EISH------SGRTNYNPS LKS | RVTISVDTSKNQFSLKVSSV TAADTAVYYCAR | DYG------------ADY | WGQGT LVTVS S |
| | Germline | VH3|3-30.3|D1|1-11|RF1|JH4 | H_FR1 | H_CDR1 | H_FR2 | H_CDR2 | H_FR3 | H_CDR3 | H_FR4 |
| iPS:4 36051 | 21-225_193G12 | VH3|3-30.3|D1|1-11|RF2|JH4 | QVQLVES-GGGVVQPGRSLRL SCGASG-FTFS | S------YAMH | WVRQAPGK GLEWVA | VIWYD------GTNKYYGDS VKG | RFTISRDNSKNTLNLQMNSL RAEDTAVYYCAR | DFIITG----ATYFDY | WGQGT LVTVS S |
| | Germline | VH3|3-33|D7|7-27|RF3|JH6 | H_FR1 | H_CDR1 | H_FR2 | H_CDR2 | H_FR3 | H_CDR3 | H_FR4 |
| iPS:4 36054 | 21-225_194C1 | VH3|3-33|D7|7-27|RF3|JH6 | QVQLVES-GGGVVQPGRSLRL SCAASG-FTFS | S------YGMH | WVRQAPGK GLEWVA | VIWYD------GSNEHYADS VKG | RFTISRDNSKNTLYLQMNSL RAEDTAVYYCAR | NRGVGY----YGLDV | WGQGT TVTVS S |
| | Germline | VH1|1-02|D5|5-19|RF3|JH1 | H_FR1 | H_CDR1 | H_FR2 | H_CDR2 | H_FR3 | H_CDR3 | H_FR4 |

FIGURE 51 (Continued)

| | | | | H_CDR1 | H_FR2 | H_CDR2 | H_FR3 | H_CDR3 | H_FR4 |
|---|---|---|---|---|---|---|---|---|---|
| iPS:4 36058 | 21-225_194A4 | VH1\|1-02\|D5\|5-18\|RF3\|JH1 | QVQLVQS-GTEVKKPGASLKV SCKASG-YTFT | V------YYLN | WVRQAPGQ GLEWMG | WINPN----SGGTNYAQK FQG | RVTMTRDTSISTAYMELSRL RSEDTAVYYCAR | GYDI----------LTG | WGQGT LVTVS S |
| | Germline | VH1\|1-02\|D1\|1-26\|RF2\|JH6 | | | | | | | H_FR4 TVTVS |
| iPS:4 36068 | 21-225_194F7 | VH1\|1-02\|D1\|1-26\|RF3\|JH6 | QVQLVQS-GAEVKKPGASVKV SCKASG-YTFT | D------YYIH | WVRQAPGQ GLEWMG | WINPN----NGGTNYAQK FQG | RVTMTRDTSISTAYMELSRL RSEDTAVYYCAR | EPLGYYGSG-------SYGAYGMDV | WGQGT TVTVS S |
| | Germline | VH4\|4-34\|D4\|4-17\|RF2\|JH3 | | | | | | | H_FR4 |
| iPS:4 36072 | 21-225_194C10 | VH4\|4-34\|D4\|4-17\|RF2\|JH3 | QVQLQQW-GAGLLKPSETLSL TCAVSG-GSFR | Y------YYWS | WIRQPPGK GLEWFG | EINH------SSTNYNPS LKS | RVTISIDTSKNQFSLKLRSV TAADTAVYYCAR | DYGA-----------FDI | WGQGT MVTVS S |
| iPS:4 36506 | 21-225_222C7 | VH4\|4-34\|D4\|4-17\|RF2\|JH3 | QVQLQQW-GAGLLKPSETLSL TCAVIG-GSFS | G------RYWS | WIRQPPGK GLEWIG | EINH------SGSANYNPS LKS | RVTISVDTSKNQFSLKLSSV TAADTAVYYCAR | DYGA-----------LDF | WGQGT MVTVS S |
| | Germline | VH3\|3-33\|D5\|5-24\|RF2\|JH6 | | | | | | | H_FR4 |
| iPS:4 36092 | 21-225_195B9 | VH3\|3-33\|D5\|5-24\|RF2\|JH6 | QVQLVES-GGGVVQPGRSLRL SCAASG-FTFS | S------YGMH | WVRQAPGK GLEWVA | VIWYD----GSNKYYADS VKG | RFTISRDNSKNTLYLQMNSL RAEDTAVYYCAR | EWLQFRY--------YYGMDV | WGQGT TVTVS S |
| iPS:4 36164 | 21-225_197G10 | VH3\|3-33\|D5\|5-24\|RF2\|JH6 | QVQLVES-GGGVVQPGRSLRL SCVASG-FTFS | S------YGMH | WVRQAPGK GLEWVA | VIWYD----GSNKYYADS VKG | RFTISRDNSKNTLYLQMNSL RAEDTAVYYCAR | EWLQFRY--------YYGIDV | WGQGT TVTVS S |
| iPS:4 36191 | 21-225_198B9 | VH3\|3-33\|D5\|5-24\|RF2\|JH6 | QVQLVES-GGGVVQPGRSLRL SCAASG-FTFS | N------YGMH | WVRQAPGK GLEWVA | IIWFD----GSNKYYVDS VKG | RFTISRDNSKNTLFLQMSSL RAEDTAVYYCAR | EWLQFRY--------YYGMDV | WGQGT TVTVS S |
| iPS:4 36205 | 21-225_199A7 | VH3\|3-33\|D5\|5-24\|RF2\|JH6 | QVQLVES-GGGVVQPGRSLRL SCAASG-FTFS | N------YGMH | WVRQAPGK GLEWVA | IIWFD----GSNKYYADS VKG | RFTISRDNSKNTLFLQMSSL RAEDTAVYYCAR | EWLQFRY--------YYGMDV | WGQGT TVTVS S |
| iPS:4 36214 | 21-225_200F6 | VH3\|3-33\|D5\|5-24\|RF2\|JH6 | QVQLVES-GGGVVQPGRSLRL SCAASG-FTFS | S------YGMH | WVRQAPGK GLEWVA | VIWYD----GSNKYYADS VKG | RFTISRDNSKNTLYLQMNSL RAEDTAVYYCTR | EWLQFRY--------YYGMDV | WGQGT TVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3-33/D6/6-19/RF2/JH6 | | QVQLVES-GGGVVQPGRSLRL SCAASG-FTFS | XXMH | WVRQAPGK GLEWVA | VIING-SSNKYYRAS RADTAVYYCAR | RFTISRDNSKNTLYLQMNSL RAEDTAVYYCAR | V*QMKKYYY YYSMDV | WGQGT TVTVS S |
| iPS:4 36106 21-225_196F2 | VH3-33/D6/6-19/RF3/JH6 | QVQLVES-GGGVVQPGRSLRL SCAASG-FTFS | S-----FGMH | WVRQAPGK GLEWVA | VILND-GSNKKCADS VKG | RCTISRDNSKNTLYLQMNSL RAEDTAVYYCAR | GQQWLV-----NGVDV | WGQGT TVTVS S |
| | Germline | H_FR1 | H_CDR1 | H_FR2 | H_CDR2 | H_FR3 | H_CDR3 | H_FR4 |
| VH3-23/D6/6-6/RF3/JH6 | | EVQLVES-GGGLVQPGGSLRL SCAASG-FTFS | XXMS | WVRQAPGK GLEWVS | AISSS-SSSYIYKAS YKG | RFTISRDNSKNTLYLQMNSL RAEDTAVYYCAK | V*QMKM YYGMDV | WGQGT TVTVS S |
| iPS:4 36110 21-225_196F4 | VH3-23/D6/6-6/RF3/JH6 | EVQLLES-GGGLVQPGGSLRF SCAASG-FTFS | S-----CAMT | WVRQAFGK GLEWVS | AISGS-GGSTYYADS VKG | RFTISRDNSKNTLYLQMNSL RAEDTAVYYCAK | VGGLTGSY-----YYYGMDV | WGQGT TVTVS S |
| | Germline | H_FR1 | H_CDR1 | H_FR2 | H_CDR2 | H_FR3 | H_CDR3 | H_FR4 |
| VH1-08/D2/2-21/RF1/JH6 | | XXXXXXX GAEVKKPGASVKV SCKASG-YTFT | XXIN | WMRQATGQ GLEWMG | XXXXXX SGNTYYAPK FQG | RVTMTRDTSISTAYMELSSL RSEDTAVYYCAY | SXXWAY-----YYYYMDV | WGQGT LVTVS S |
| iPS:4 36114 21-225_196G8 | VH1-08/D2/2-21/RF1/JH5 | QVQLVQS-GAEVKKPGASVKV SCKASG-YTFT | N-----YDIN | WMRQATGQ GLEWMG | WMHLN------SGNTGYAPK FQG | RVTMTRDTSISTAFMELSSL RSEDTAVYYCAY | SGGWY-----VFDP | WGQGT LVTVS S |
| iPS:4 36218 21-225_200G7 | VH1-08/D2/2-21/RF1/JH5 | QVQLVQS-GAEVKKPGASVKV SCKASG-YTFT | N-----YDIN | WMRQATGQ GLEWMG | WMHLN------SGNTGYAPK FQG | RVTMTRDTSISTAFMELSSL RSEDTAVYYCAY | SGGWY-----VFDP | WGQGT LVTVS S |
| | Germline | H_FR1 | H_CDR1 | H_FR2 | H_CDR2 | H_FR3 | H_CDR3 | H_FR4 |
| VH1-02/D3/3-10/RF3/JH6 | | XXXXXXX GAXVKKPGSSVKV SCKASG-YTFT | XXXXXX | WVRQAPGQ GLEWMG | WINPN-SGGTYAQK XXX | RVTMTRDTSISTAYAMELSRL SSDDTAVYYCAR | XXXXXXX-----YYYYMDV | WGQGT TVTVS S |
| iPS:4 36116 21-225_196B9 | VH1-02/D3/3-10/RF3/JH6 | QVQLVQS-GAEVKKPGASMKV SCKASG-YTFT | G-----YYMH | WVRQAPGQ GLEWMG | WINPN-SGGTNFAQK FRG | RVTMTRDTSISTAYMELSRL SSDTAVYYCAR | GGVRGVPN-----YYYVMDV | WGQGT TVTVS S |
| | Germline | H_FR1 | H_CDR1 | H_FR2 | H_CDR2 | H_FR3 | H_CDR3 | H_FR4 |
| VH4-30.1/D5/5-18/RF3/JH6 | | XXXXXXXXX GPGLVKPSOTLSL TCTVSG-GSIS | SG-----GYYWS | WIRQHPGK GLEWIG | NIYY-SSSYNNPS XXX | RVTISVDTSKNQFSLKLSSV TAADTAVYYCAR | XXXYXXXXY-----YYYYMDV | WGQGT TVTVS S |
| iPS:4 36181 21-225_198C2 | VH4-30.1/D5/5-18/RF3/JH6 | QVQLQES-GPGLVKPSQTLSL TCTVSG-GSIS | SG-----GYYWS | WIRQHPGK GLEWIG | NIYY-SGSTYYNPS LKS | RVTISVDTSKNQFSLKLSSV TAADTAVYYCAR | GDYYGSGSY-----HNYYGLDV | WGQGT TVTVS S |
| iPS:4 36210 21-225_199G11 | VH4-30.1/D5/5-18/RF3/JH6 | QVQLQES-GPGLVKPSQTLSL TCTVSG-GSIS | SG-----GYYWS | WIRQHPGK GLEWIG | NIYY-SGSTYYNPS LKS | RVTISVDTSKNQFSLKLSSV TAADTAVYYCAR | GDYYGSGSY-----HNYYGLDV | WGQGT TVTVS S |

FIGURE 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| | VH[1]-18|D3|3-3|RF2/JH6 | | | | | | | |
| iPS:4 36234 | 21-225_51E3 | VH[1]-18|D3|3-3|RF2/JH6 | QVQLVQS-GAEVKKPGASVKV SCKASG-YTFN | S------YGIS | WVRLAPGQ GLEWMG | WISAY----NGNTKNAQK FQG | RVTMTDTSTSTAYMELRSL RSDDTAVYYCAR | HDFWSGY--------YKGMDV | WGQGT TVTVS S |
| iPS:4 36830 | 21-225_51F4 | VH[1]-18|D3|3-3|RF2/JH6 | QVQLVQS-GAEVKKPGASVKV SCKASG-YTFN | S------YGIS | WVRQAPGQ GLEWMG | WISAY----NGNTKYAQK LQG | RVTMTDTSTSTAYMELRSL RSDDTAVYYCAR | HDFWSGY--------YKGMDV | WGQGT TVTVS S |
| iPS:4 36834 | 21-225_52F1 | VH[1]-18|D3|3-3|RF2/JH6 | QVQLVQS-GAEVKKPGASVKV SCKASG-YTFN | S------YGVS | WVRQAPGQ GLEWMG | WISAY----NGNRKYAQK LQG | RVSMTDTSTSTAYMELRSL RSDDTAVYYCAR | HDFWSGY--------YKGMDV | WGQGT TVTVS S |
| iPS:4 36842 | 21-225_54E9 | VH[1]-18|D3|3-3|RF2/JH6 | QVQLVQS-GAEVKKPGASVKV SCKASG-YTFN | S------YGIS | WVRLAPGQ GLEWMG | WISAY----NGNTKNAQK LQG | RVTMTDTSTSTAYMELRSL RSDDTAVYYCAR | HDFWSGY--------YKGMDV | WGQGT TVTVS S |
| iPS:4 36844 | 21-225_56G1 | VH[1]-18|D3|3-3|RF2/JH6 | QVQLVQS-GAEVKKPGASVKV SCKASG-YTFN | S------YGIS | WVRQAPGQ GLEWMG | WISAY----NGNTKYAQK FQG | RVTMTDTSTSTAYMELRSL RSDDTAVYYCAR | HDFWSGY--------YKGMDV | WGQGT TVTVS S |
| iPS:4 36846 | 21-225_56E3 | VH[1]-18|D3|3-3|RF2/JH6 | QVQLVQS-GAEVKKPGASVKV SCKASG-YTFN | S------YGFS | WVRQAPGQ GLEWMG | WISAY----NGNTKEAQK FQG | RVTMTDTSTSTAYMELRSL RADDTAVYYCAR | HDFWSGY--------YKGMDV | WGQGT TVTVS S |
| iPS:4 51104 | 21-225_49C5 | VH[1]-18|D3|3-3|RF2/JH6 | QVQLVQS-GAEVKKPGASVKV SCKASG-YTFN | S------YGIS | WVRLAPGQ GLEWMG | WISAY----NGNTKNAQK LQG | RVTMTDTSTSTAYMELRSL RSDDTAVYYCAR | HDFWSGY--------YKGMDV | WGQGT TVTVS S |
| iPS:4 51106 | 21-225_49D10 | VH[1]-18|D3|3-3|RF2/JH6 | QVQLVQS-GAEVKKPGASVKV SCKASG-YTFN | S------YGIS | WVRLAPGQ GFEWMG | WISAY----NGNTKNAQK LQG | RVTMTDTSTSTAYMELRSL RSDDTAVYYCAR | HDFWSGY--------YKGMDV | WGQGT TVTVS S |
| iPS:4 51108 | 21-225_53E8 | VH[1]-18|D3|3-3|RF2/JH6 | QVQLVQS-GAEVKKPGASVKV SCKASG-YTFN | S------YGIS | WVRQAPGQ GLEWMG | WISAY----NGNTKFAQK LQG | RVTMTDTSTSTAYMELRSL RSDDTAVYYCAR | HDFWSGY--------YKGMDV | WGQGT TVTVS S |
| | | Germline | H_FR1 | H_CDR1 | H_FR2 | H_CDR2 | H_FR3 | H_CDR3 | H_FR4 |
| | VH[6]-01|D3|3-9|RF1/JH6 | | | | | | | |
| iPS:4 36236 | 21-225_201F7 | VH[6]-01|D3|3-9|RF1/JH6 | QVQLVQS-GPGLVKPSQTLSL TCAISG-DSVS | SN----SAAWN | WIRQSPSR GLEWLG | RIYYR----SKWYNYIEV SVRS | RITINPDTSKNQFSLQLNSV TPEDTAVFFCAR | DQFYY--------GMDV | WGQGT TVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36250 | 21-225_201A4 | VH6j6-01|D3|3-9|RF1|JH6 | QVQLQQS-GPGLVKPSQTLSL TCAISG-DSVS | SN----SAAWN | WIRQSPSR GLEWLG | RTYYR---SKWYNYYEV SVKS | RITINPDTSKNQFSLQLNSV TPEDTAVYFCAR | DQRYY------GMDV | WGQGT TVTVS S |
| iPS:4 36252 | 21-225_202A8 | VH6j6-01|D3|3-9|RF1|JH6 | QVQLQQS-GPGLVKPSQTLSL TCAISG-DSVS | SN----SAAWN | WIRQSPSR GLEWLG | RTYYR---SKWYNYAV SVRS | RITINPDTSKNQFSLQLNSV TPEDTALYFCTR | DQRYY------GMDV | WGQGT PVTVS S |
| iPS:4 36278 | 21-225_201F2 | VH6j6-01|D3|3-9|RF1|JH6 | QVQLQQS-GPGLVKPSQTLSL TCAISG-DSVS | SN----SAAWN | WIRQSPSR GLEWLG | RTYYR---SKWYNYYEV SVRS | RVTINPDTSKNQFSLQLNSV TPEDTAVYFCAR | DQRYY------GMDV | WGQGT TVTVS S |
| iPS:4 36294 | 21-225_205G4 | VH6j6-01|D3|3-9|RF1|JH6 | QVQLQQS-GPGLVKPSQTLSL TCAISG-DSVS | SN----SAAWN | WIRQSPSR GLEWLG | RTYYR---SKWYNYYEV SVRS | RITINPDTSKNQFSLQFCAR TPEDTAVYFCAR | DQRYY------GMDV | WGQGT TVTVS S |
| iPS:4 36356 | 21-225_210H10 | VH6j6-01|D3|3-9|RF1|JH6 | QVQLQQS-GPGLVKPSQTLSL TCAISG-DSVS | SN----SAAWN | WIRQSPSR GLEWLG | RTYYR---SKWYNYPV SVRS | RITINPDTSKNQFSLLNSV TPEDTAVYYCAR | DQRYY------GMDV | WGQGT TVTVS S |
| | Germline VH1|1-02|D4|4-23|RF2|JH4 | | | | | | | |
| iPS:4 36240 | 21-225_201E8 | VH1|1-02|D4|4-23|RF2|JH4 | QVQLVQS-GAEVKKPGASVKV SCKASG-YTFT | G------YYMH | WVRQAPGQ GLEWMG | WIDPN---SGGTNYPQK FQG | RVTMTRDTSISTAYMELSRL RSDDTAVYYCAR | DQGYNW------NSFDY | WGQGT LVTVS S |
| iPS:4 36314 | 21-225_206G4 | VH1|1-02|D4|4-23|RF2|JH4 | QVQLVQS-GAEVKKPGASVKV SCKASG-YTFT | G------YYIH | WVRQAPGQ GLEWMG | WIDPN---SGGTNYAQK FQG | RITMTRDTSISTAYMELSRL RSDDTAVYYCAR | DQGYNW------NSFDY | WGQGT LVTVS S |
| | Germline VH1|1-02|D5|5-18|RF3|JH5 | | | | | | | |
| iPS:4 36244 | 21-225_201H10 | VH1|1-02|D5|5-18|RF3|JH5 | QVQLVQS-GAEVKKPGASVKV SCKASG-YTFT | G------YYIH | WVRQAPGQ GLEWMA | WINPN---SGGTNYAQK FQG | RVTMTRDTSITTYMELSRL RSDDTAVYYCAR | GYSYGY------NWFDP | WGQGT LVTVS S |
| iPS:4 36262 | 21-225_203E3 | VH1|1-02|D5|5-18|RF3|JH5 | QVQLVQS-GAEVKKPGASVKV SCKASG-YTFT | G------YYIH | WVRQAPGQ GLEWMA | WINPN---SGGTNYAQK FQG | RVTMTRDTSITTAYMELSRL RSDDTAVYYCAR | GYSYGY------NWFDP | WGQGT LVTVS S |
| iPS:4 36276 | 21-225_204H4 | VH1|1-02|D5|5-18|RF3|JH5 | QVQLVQS-GAEVKKPGASVKV SCKASG-YTFT | G------YYIH | WVRQAPGQ GLEWMA | WINPN---SGGTNYAQK FQG | RVTMTRDTSITTAYMELSRL RSDDTAVYYCAR | GYSYGY------NWFDP | WGQGT LVTVS S |

FIGURE 51 (Continued)

| | | | | | | | | |
|---|---|---|---|---|---|---|---|---|
| iPS:4 36312 | 21-225_206A4 | VH1|1-02|D5|5-18|RF3|JH5 | QVQLVQS-GAEVKKPGASVKVSCKASG-YTFT | G------YYIH | WVRQAPGQGLEWMA | WINPN----SGGTNYAQKFQG | RVTMTRDTSITTAYMELSRLRSDDTAVYYCAR | GYSYGY-------NWFDP | WGQGTLVTVSS |
| iPS:4 36316 | 21-225_206A5 | VH1|1-02|D5|5-18|RF3|JH5 | QVQLVQS-GAEVKKPGASVKVSCKASG-YTFT | G------YYIH | WVRQAPGQGLEWMA | WINPN----SGGTNYAQKFQG | RVTMTRDTSITTAYMELSRLRSDDTAVYYCAR | GISYGY-------NWFDP | WGQGTLVTVSS |
| iPS:4 36338 | 21-225_208E8 | VH1|1-02|D5|5-18|RF3|JH5 | QVQLVQS-GAEVKKPGASVKVSCKASG-YTFT | G------YYIH | WVRQAPGQGLEWMA | WINPN----SGGTNYAQKFQG | RVTMTRDTSITTAYMELSRLRSDDTAVYYCAR | GYSYGY-------NWFDP | WGQGTLVTVSS |
| iPS:4 36344 | 21-225_208B11 | VH1|1-02|D5|5-18|RF3|JH5 | QVQLVQS-GAEVKKPGASVKVSCKASG-YTFT | G------YYIH | WVRQAPGQGLEWMA | WINPN----SGGTNYAQKFQG | RVTMTRDTSITTAYMELSRLRSDDTAVYYCAR | GYSYGY-------NWFDP | WGQGTLVTVSS |
| iPS:4 36358 | 21-225_210D11 | VH1|1-02|D5|5-18|RF3|JH5 | QVQLVQS-GAEVKKPGASVKVSCKASG-YTFT | G------YYIH | WVRQAPGQGLEWMA | WINPN----SGGTNYAQKFQG | RVTMTRDTSITTAYMELSRLRSDDTAVYYCAR | GISYGY-------NWFDP | WGQGTLVTVSS |
| iPS:4 36408 | 21-225_214H8 | VH1|1-02|D5|5-18|RF3|JH5 | QVQLVQS-GAEVKKPGASVKVSCKASG-YTFT | G------HYIH | WVRQAPGQGLEWMG | WINSN----NGGTNYAQKFQG | RVTMTRDTSISTAYMELSRLRSDDTAVYYCAR | DGRYSYG-------YDWFDP | WGQGTLVTVSS |
| iPS:4 36424 | 21-225_215H6 | VH1|1-02|D5|5-18|RF3|JH5 | QVQLVQS-GAEVKKPGASVKVSCKASG-YTFT | G------HYIH | WVRQAPGQGLEWMG | WINPN----SGDTNYAEKFQG | RVTMTRDTSISTAYMELSRLRSDDTAVYYCAR | DGRYSYG-------HDWFDP | WGQGTLVTVSS |
| iPS:4 37092 | 21-225_210B12 | VH1|1-02|D5|5-18|RF3|JH5 | QVQLVQS-GAEVKKPGASVKISCKASG-FTFT | D------YYMN | WVRQAPGQGLEWMG | WINPN----SGGTNYAQKFQG | RVTMTRDTSISTAYMELSRLRSDDTAVYYCAR | GIDS-------FAP | WGQGTLVTVSS |
| iPS:4 37134 | 21-225_213A7 | VH1|1-02|D5|5-18|RF3|JH5 | QVQLVQS-GAEVKKPGASVKISCKASG-FTFT | D------YYMN | WVRQAPGQGLEWMG | WINPK----SGGTNYAQKFQG | RVTMTRDTSLGRAYMELSRLRSDDTAVYYCAR | GIDS-------FAP | WGQGTLVTVSS |
| iPS:4 37194 | 21-225_226B2 | VH1|1-02|D5|5-18|RF3|JH5 | QVQLVQS-GAEVKKPGASVKVSCKASG-YTFT | G------YFMH | WVRQAPGQGLEWMG | WINPN----SGDTNYAQKFQD | RVTMTRDTSLNTAYMELSRLRSDDTAIYYCAR | GTYYGSGS-------YPNELDS | WGQGTLVTVSS |
| iPS:4 37196 | 21-225_226B7 | VH1|1-02|D5|5-18|RF3|JH5 | QVQLVQS-GAEVKKPGASVKVSCKASG-YTFT | G------YYMH | WVRQAPGQGLEWMG | WINPN----SGGTNYAQKFQD | RVTMTRDTSISTAHMELSRLRSDDTAIYYCAR | GTYYGSGS-------YYNWFDS | WGQGTLVTVSS |
| iPS:4 37200 | 21-225_226A10 | VH1|1-02|D5|5-18|RF3|JH5 | QVQLVQS-GAEVKKPGASVKVSCKASG-YTFT | G------YFMH | WVRQAPGQGLEWMG | WINPN----SGDTNYAQKFQG | RVTMTRDTSLSTAYMELSRLRSDDTAIYYCAR | GTYYGSGS-------YPNELDS | WGQGTLVTVSS |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 93168 | 21-225_32B11 | VH1|1-02/D5|5-18/RF3|J H5 | QVQLVQS-GAEVKKPGASVKV SCKASG-YTFT | G------YYMH | WVRQAPGQ GLEWMG | WINPN----SDGTNYAQK FQG | RVTMTRDTSISTAYMELNRL RSDDTAVYYCAR | GFYYGSGS--------YYNDLDP | WGQGT LVTVS S |
| iPS:3 93178 | 21-225_34D7 | VH1|1-02/D5|5-18/RF3|J H5 | QVQLVQS-GAEVKKPGASVKV SCKASG-YTFT | G------YYMH | WVRQAPGQ GLEWMG | WINPN----SGGTNYAQK FQG | RVTMTRDTSISTAYMELSRL RSDDTAVYYCAR | GYYYSGGS--------YYNDLDP | WGQGT LVTVS S |
| iPS:3 98480 | 21-225_17G4 | VH1|1-02/D5|5-18/RF3|J H5 | QVQLVQS-GAEVKKPGASVKV SCKTSG-YTFT | D------YYMH | WVRQAPGQ GLEWMG | WINPN----SGGTNYEQK FQG | RVTMTRDTSISTAYMELSRL RSDDTAVYYCAS | GYSYGY---------GWFDP | WGQGT LVTVS S |
| iPS:3 98486 | 21-225_19A1 | VH1|1-02/D5|5-18/RF3|J H5 | QVQLVQS-GAEVKKPGASVKV SCKASG-YTFT | G------YYMH | WVRQAPGQ GLEWMG | WINPN----SGGTNYAQK FQG | RVTMTRDTSISTAYMELSRL RSDDTAVYYCAS | GYSYGY---------NWFDP | WGQGT LVTVS S |
| | Germline | | H_FR1 | H_CDR1 | H_FR2 | H_CDR2 | H_FR3 | H_CDR3 | H_FR4 |
| | VH1|1-08/D6|6-13/RF1|JH6 | | | | | | | | |
| iPS:3 36248 | 21-225_202A3 | VH1|1-08/D6|6-13/RF1|J H6 | QVQLEQS-GAEVKKPGASVKV SCAASG-YTFT | S------YDIN | WVRQATGQ GLEWLG | WMNPK----RGNTGYAQK FQG | RVTMRNTSISTAHMELSSL RSEDTAVYYCAR | GRYSRFDY--------YYYYDMDV | WGQGT TVTVS S |
| | Germline | | H_FR1 | H_CDR1 | H_FR2 | H_CDR2 | H_FR3 | H_CDR3 | H_FR4 |
| | VH3|3-11/D44-17/RF2|JH6 | | | | | | | | |
| iPS:4 36270 | 21-225_203F10 | VH3|3-11/D44-17/RF2|J H6 | EVQLVES-GGGLVKPGGSLRL SCAASG-FTFS | D------YYMS | WIRQAPGK GLEWVL | YISGS----GTTFYYADS VKG | RFTISRDNAKNSLYLQMNSL RAEDTAVYYCAR | DRGG-----------LDV | WGQGT TVTVS S |
| | Germline | | H_FR1 | H_CDR1 | H_FR2 | H_CDR2 | H_FR3 | H_CDR3 | H_FR4 |
| | VH3|3-23/D11-20/RF1|JH6 | | | | | | | | |
| iPS:4 36280 | 21-225_204D6 | VH3|3-23/D11-20/RF1|J H6 | EVQLVES-GGGLVQPGGSLRL SCAASG-FTFS | T------YAMS | WVRQAPGK GLEWVS | AISGS----GGSTYYADS VKG | RFTISRDNSKNTLYLQMDSL RAEDTAVYYCAK | GISGTGSY--------YYYGVDV | WGQGT TVTVS S |
| | Germline | | H_FR1 | H_CDR1 | H_FR2 | H_CDR2 | H_FR3 | H_CDR3 | H_FR4 |
| | VH3|3-33/D7|7-27/RF2|JH6 | | | | | | | | |
| iPS:4 36284 | 21-225_204G8 | VH3|3-33/D7|7-27/RF2|J H6 | QVQLVES-GGDVQPGRSLRL SCAASG-FTFS | S------YGMH | WGRQAPGK GLEWVA | VIWYD----GSNENYVAS VKG | RFTIFRDNSKNTLYLQMNSL RAEDTAVYYCAR | DLGIGY---------YGMEV | WGQGT TVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36968 | 21-225_190B10 | VH3|3-33|D7|7-27|RF2|J H6 | QVQLVES-GGGVVQPGRSLRL SCVASG-FTFS | S------YGMH | WVRQAPGK GLEWVA | VIWND------GSKKYHVDS VKG | RFTISRDNSKNTLYLQMNSL RAEDTALYYCAR | DLDKRNFPY-------YYYYGMDV | WGQGT TVTVS S |
| iPS:4 37006 | 21-225_192G2 | VH3|3-33|D7|7-27|RF2|J H6 | QVQLVES-GGGVVQPGRSLRL SCAASG-FTFS | S------YGMH | WVRQAPGK GLEWVT | VIWND------GSNKYYADS VKG | RFTISRDNSKNTLYLQMNSL RAEDTALYYCAR | DLDKRNFPY-------YYYYGMDV | WGQGT TVTVS S |
| iPS:4 37024 | 21-225_194F11 | VH3|3-33|D7|7-27|RF2|J H6 | QVQLVES-GGGVVQPGRSLRL SCAASG-FTFS | S------YGMH | WVRQAPGK GLEWVA | VIWND------GSKKYHVDS VKG | RFTISRDNSKNTLYLQMNSL RAEDTALYYCAR | DLDKRNFPY-------YYYYGMDV | WGQGT TVTVS S |
| iPS:4 37028 | 21-225_194G12 | VH3|3-33|D7|7-27|RF2|J H6 | QVQLVES-GGGVVQPGRSLRL SCAASG-FTFS | S------YGMH | WVRQAPGK GLEWVT | VIWND------GSNKYYADS VKG | RFTISRDNSKNTLYLQMNSL RAEDTALYYCAR | DLDKRNFPY-------YYYYGMDV | WGQGT TVTVS S |
| | Germline | VH4|4-34|D6|6-19|RF3|J H3 | | | H_CDR1 | H_FR2 | H_CDR2 | H_FR3 | H_CDR3 | H_FR4 |
| iPS:4 36290 | 21-225_205G3 | VH4|4-34|D6|6-19|RF3|J H3 | QVQLQQW-GAGLLKPSETLSL TCAVFG-GSFS | G------HYWS | WIRQPPGK GLEWIG | EMYH------FGMTNYNPS LKS | RVTMSVDTSKKQFSLKLSSV TAARDTAVYYCAR | VGQWL-------AFDI | WGPGT MVTVS S |
| | Germline | | | | H_CDR1 | H_FR2 | H_CDR2 | H_FR3 | H_CDR3 | H_FR4 |
| iPS:4 36306 | 21-225_201H4 | VH3|3-30.3|D4|4-17|RF2|J H1 | QVQLVES-GGGVVQPGRSLRL SCAASG-FTFS | S------YAMH | WVRQAPGK GLEWVA | AIWID------NYNADS VKG | RFTISRDNSKNTLYMQMNSL RAEDTAVYYCAR | DVGTVG-------ATYFDC | WGPGT LVTVS S |
| | Germline | VH1|1-18|D1|1-1|RF1|J H6 | | | H_CDR1 | H_FR2 | H_CDR2 | H_FR3 | H_CDR3 | H_FR4 |
| iPS:4 36362 | 21-225_210C12 | VH1|1-18|D1|1-1|RF1|J H6 | QVQLVQS-GAEVKKPGASVKV SCKASG-YTFT | N------NGIS | WVRQAPGQ GLEWMG | WINAY------NGHTNYAQK FQG | RVIMTTDTSTSTAYMELRSL RSEDTAVYYCAR | DPTVTHY-------YYYYGMDV | WGQGT TVTVS S |
| iPS:4 36374 | 21-225_211C10 | VH1|1-18|D1|1-1|RF1|J H6 | QVQLVQS-GAEVKKPGASVKV SCKASG-YTFT | R------HGIS | WVRLAPGQ GLEWMG | WISAY------NGLTNYAQK FQG | RVIMTTDTSTSTGYMELRSL RSEDTAVYYCAR | DPTVTHY-------YYYYGMDV | WGQGT TVTVS S |
| | Germline | VH3|3-33|D5|5-18|RF3|J H6 | | | H_CDR1 | H_FR2 | H_CDR2 | H_FR3 | H_CDR3 | H_FR4 |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 36366 | 21-225_211A3 | VH3│3-33│D5│5-18│RF3/J H6 | QVQLVES-GGGVVQPGRSLRL SCAVSG-ITFS | S------YGMH | WARQAPGK GLEWVA | VIWYD---GSNKNYEDS VKG | RFTISRDNSKNTLYLQMNSL RAEDTAVYYCAR | DGSYGY------DGMDV | WGQGT TVTVS S |
| iPS:4 21- 36388 225_212H11 | | VH3│3-33│D5│5-18│RF3/J H6 | QVQLVES-GGGVVQPGRSLRL SCAVSG-ITFS | S------YGMH | WARQAPGK GLEWVA | VIWYD---GSNKNYEDS VKG | RFTISRDNSKNTLYLQMNSL RAEDTAVYYCAR | DGSYGY------DGMDV | WGQGT TVTVS S |
| iPS:4 36396 | 21-225_213E5 | VH3│3-33│D5│5-18│RF3/J H6 | QVQLVES-GGGVVQPGRSLRL SCAVSG-ITFS | S------YGMH | WARQAPGK GLEWVA | VIWYD---GSNKNYEDS VKG | RFTISRDNSKNTLYLQMNSL RAEDTAVYYCAR | DGSYGY------DGMDV | WGQGT TVTVS S |
| iPS:4 21- 36454 225_217B10 | | VH3│3-33│D5│5-18│RF3/J H6 | QVQLVES-GGGVVQPGRSLRL SCAVSG-ITFS | S------YGMH | WARQAPGK GLEWVA | VIWYD---GSNKNYEDS VKG | RFTISRDNSKNTLYLQMNSL RAEDTAVYYCAR | DGSYGY------DGMDV | WGQGT TVTVS S |
| iPS:4 36668 | 21-225_147B9 | VH3│3-33│D5│5-18│RF3/J H6 | QVQLVES-GGGVVQPGRSLRL SCAVSG-FTFS | S------YGMH | WVRQAPGK GLEWVA | VIWYD---GSNKYYADS VKG | RFTISRDNSKNTLYLQMNSL RAEDTAVYYCAR | DRDYGDPPY------YYYYGMDV | WGQGT TVTVS S |
| iPS:4 21-225_148C8 36688 | | VH3│3-33│D5│5-18│RF3/J H6 | QVQLVES-GGGVVQPGRSLRL SCAASG-FTFS | S------YGMH | WVRQAPGK GLEWVA | VIWYD---GSNKYYADS VKG | RFTISRDNSKNTLYLQMNSL RAEDTAVYYCAR | DRDYGDPPY------YYYYGMDV | WGQGT TVTVS S |
| iPS:4 21- 36706 225_149A11 | | VH3│3-33│D5│5-18│RF3/J H6 | QVQLVES-GGGVVQPGRSLRL SCAASG-FTFS | S------YGMH | WVRQAPGK GLEWVA | VIWYD---GSNKYYADS VKG | RFTISRDNSKNTLYLQMNSL RAEDTAVYYCAR | DRDYGDPPY------YYYYGMDV | WGQGT TVTVS S |
| iPS:4 21- 36760 225_155E10 | | VH3│3-33│D5│5-18│RF3/J H6 | QVQLVES-GGGVVQPGRSLRL SCAASG-FTFS | S------YGMH | WVRQAPGK GLEWVA | VIWYD---GSNKYYADS VKG | RFTISRDNSKNTLYLQMNSL RAEDTAVYYCAR | DRDYGDPPY------YYYYGMDV | WGQGT TVTVS S |
| iPS:4 36966 | 21-225_190C3 | VH3│3-33│D5│5-18│RF3/J H6 | QVQLVES-GGGVVQPGRSLRL SCAASG-FTFS | S------YGMH | WVRQAPGK GLEWVA | VIWYD---GSNKYYADS VKG | RFTISRDNSKNTLYLQMNSL RAEDTAVYYCAR | WYYY------YGMDV | WGQGT TVTVS S |
| iPS:4 36976 | 21-225_190D8 | VH3│3-33│D5│5-18│RF3/J H6 | QVQLVES-GGGVVQPGRSLRL SCAASG-FTFS | S------YGLH | WVRQAPGK GLEWVA | VIWYD---GSNKYYADS VKG | RFTISRDNSKNTLYLQMNSL RAEDTAVYYCAN | WYYY------YGMDV | WGQGT TVTVS S |
| iPS:4 37168 | 21-225_218G4 | VH3│3-33│D5│5-18│RF3/J H6 | QVQLVES-GGGVVQPGRSLRL SCAASG-FTFS | S------YGLH | WVRQAPGK GLEWVA | VIWYD---GSNKYYADS VKG | RFTISRDNSKNTLYLQMNSL RVEDTAVYYCAN | WYYY------YGMDV | WGQGT TVTVS S |
| | | Germline VH3│3-33│D5│5-18│RF3/JH5 | QVQLVES-GGGVVQPGRSLRL SCAASG-FTFS | S------YGMH | WVRQAPGK GLEWVA | VIWYD---GSNKYYADS VKG | RFTISRDNSKNTLYLQMNSL RAEDTAVYYCAR | | WGQGT TVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4-36368 | 21-225_211G3 | VH3\|3-33\|D5\|5-24\|RF3/JH5 | QVQLVES-GGGVVQPGRSLRLSCAASG-FTFS | N------YGMH | WVRQAPGK GLEWVA | VIWHD---GSNKYYADSVKG | RFTISRDNSKNTLYLQMNSL RAEDTAVYYCAR | LDYSNY------GWFDP | WGQGT LVTVS S |
| iPS:4-36426 | 21-225_215C7 | VH3\|3-33\|D5\|5-24\|RF3/JH5 | QVQLVES-GGGVVQPGRSLRLSCAASG-FTFS | Y------YGMH | WVRQAPGK GLEWVA | VIWHD---GSNKYYADSVKG | RFTISRDNSKNTLYLQMNSL RAEDTAVYYCAR | LDYSNY------GWFDP | WGQGT LVTVS S |
| iPS:4-36432 | 21-225_215H12 | VH3\|3-33\|D5\|5-24\|RF3/JH5 | QVQLVES-GGGVVQPGRSLRLSCAASG-FTFS | N------YGMH | WVRQAPGK GLEWVA | VIWHD---GSNKYYADSVKG | RFTISRDNSKNTLYLQMNSL RAEDTAVYYCAR | LDYSNY------GWFDP | WGQGT LVTVS S |
| | Germline | VH1\|1-18\|D4\|4-11\|RF2/JH6 | | | H_FR2 | H_CDR2 | H_FR3 | H_CDR3 | H_FR4 |
| iPS:4-36402 | 21-225_213H12 | VH1\|1-18\|D4\|4-11\|RF2/JH6 | QVQLVQS-GAEVKKPGASVKVSCKASG-FTFT | S------YGIN | WVRQAPGQ GLEWMG | WISVH---NGNTDYAQKFQG | RVTMTDTSTSTAYMELRSL RSDDTAVYYCAR | DYYY---------GMDV | WGQGT NVTVS S |
| iPS:4-36500 | 21-225_222H3 | VH1\|1-18\|D4\|4-11\|RF2/JH6 | QVQLVQS-GAEVKKPGASVKVSCKASG-FTFT | S------YGIN | WVRQAPGQ GLEWMG | WISVY---NGNMTNYAQKLQG | RVTMTDTSTSTAYMELRSL RSDDTAVYYCAR | DYYY---------GFDV | WGQGT TVTVS S |
| iPS:4-36520 | 21-225_223G10 | VH1\|1-18\|D4\|4-11\|RF2/JH6 | QVQLVQS-GAEVKKPGASVKVSCKASG-FITFT | S------YGIN | WVRQAPGQ GLEWMG | WISVY---SGNTNYAQKLQG | RVTMTDTSTSTAYMELRSL RSDDTAVYYCAR | DYYY---------GMDV | WGQGT TVTVS S |
| | Germline | VH3\|3-48\|D2\|2-21\|RF1/JH4 | | | H_FR2 | H_CDR2 | H_FR3 | H_CDR3 | H_FR4 |
| iPS:4-36436 | 21-225_216F10 | VH3\|3-48\|D2\|2-21\|RF1/JH4 | EVQLVES-GGGLVQPGGSLRLSCAASG-FSFR | S------YSMN | WVRQAPGK GLEWVS | YITGS---SSTIYYADSVKG | RFTISRDNAKNSLYLQMNSL RDEDTAVYYCAR | SGLA---------VEDY | WGQGT LVTVS S |
| | Germline | VH3\|3-48\|D6\|6-6\|RF1/JH4 | | | H_FR2 | H_CDR2 | H_FR3 | H_CDR3 | H_FR4 |
| iPS:4-36448 | 21-225_217A3 | VH3\|3-48\|D6\|6-6\|RF1/JH4 | EVQLVES-GGGLVQPGGSLRLSCAASG-FTFS | S------YNMN | WVRQAPGK GLEWVS | YISSS---RNIYYADSVKG | RFTISREMAKNSLSLQMDSL RDEDTAVYYCAR | DGSYSSG------WYWGFDY | WGQGT LVTVS S |
| | Germline | VH4\|4-59\|D6\|6-19\|RF3/JH6 | | | H_FR2 | H_CDR2 | H_FR3 | H_CDR3 | H_FR4 |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36472 | 21-225_220E1 | VH4/4-59/D6/6-19|RF3|JH6 | QVQLQES-GPGLVKPSETLSL TCTVSG-GSIS | T------YYWS | WIRQPPGK GLEWIG | VIYY----SGTINYNPS LKS | RVTISVDTSKNQFSLKLSSV TAADTAVYYCAR | DQQWLVRGR-----DNYYYGMDV | WGQGT TVTVS S |
| | Germline | VH3|3-23|D2|2-15|RF3|JH4 | | | | | | | |
| iPS:4 36504 | 21-225_222H4 | VH3|3-23|D2|2-15|RF3|JH4 | EVQLLES-GGGLVQPGGSLRL SCAASG-FTFS | N------FAMS | WVRQAPGK GLEWVS | SIVGS----GGRTYYADS VKG | RFTISRDNSKNTLYLQMNSL RAEDTAVYYCAR | DPYRVAV------AGAFDY | WGQGT LITVS S |
| iPS:4 36510 | 21-225_222H8 | VH3|3-23|D2|2-15|RF3|JH4 | EVQLLES-GGGLVQPGGSLRL SCAASG-FTFS | N------FAMS | WVRQAPGK GLEWVS | SIVGS----GGRTYYADS VKG | RFTISRDNSKNTLYLQMNSL RAEDTAVYYCAR | DPYRVAV------AGAFDY | WGQGT LITVS S |
| | Germline | VH3|3-23|D3|3-22|RF2|JH1 | | | | | | | |
| iPS:4 36526 | 21-225_224A1 | VH3|3-23|D3|3-22|RF2|JH1 | EVQLLES-GGGLVQPGGSLRL SCAASG-FTFS | S------YAMS | WVRQAPGK GLEWVS | AISGR----GGSTYYADA VKG | RFTISRDNSKNTLYLQMNSL RAEDTAVYYCAR | GSYDSSG------YIHYLDH | WGQGT LVTVS S |
| | Germline | VH1|1-02|D4|4-23|RF2|JH6 | | | | | | | |
| iPS:4 36536 | 21-225_224G1 | VH1|1-02|D4|4-23|RF2|JH6 | QVQLVQS-GAEVKKPGASVKV SCKASG-YTFT | G------YYIH | WVRQAPGQ GLEWMG | WINPY----SGDTNYAQK FQG | RVTMTRDTSISTAYMELSRL RFDDTAVFYCAR | DWGGYSS------YYYGMDV | WGQGT TVTVS S |
| iPS:4 36548 | 21-225_224A7 | VH1|1-02|D4|4-23|RF2|JH6 | QVQLVQS-GAEVKKPGASVKV SCKASG-YTFT | G------YYIH | WVRQAPGQ GLEWMG | WINPY----SGDTNYAQK FQG | RVTMTRDTSITTAYMELSRL RFDDTAVFYCAR | DWGGYSS------YYYGMDV | WGQGT TVTVS S |
| iPS:4 36558 | 21-225_224C11 | VH1|1-02|D4|4-23|RF2|JH6 | QVQLVQS-GAEVKKPGASVKV SCKASG-YTFT | G------YYIH | WVRQAPGQ GLEWMG | WINPY----SGDTNYAQK FQG | RVTMTRDTSISTAYMELRRL RFDDTAVFYCAR | DWGGYSS------YYFGMDV | WGQGT TVTVS S |
| iPS:4 36562 | 21-225_224H11 | VH1|1-02|D4|4-23|RF2|JH6 | QVQLVQS-GAEVKKPGASVKV SCKASG-YTFT | G------YYIH | WVRQTPGQ GLEWMG | WINPY----SGDTNYAQK FQG | RVTMTRDTSISTAYMELRRL RFDDTAVFYCAR | DWGGYSS------YYYGMDV | WGQGT TVTVS S |
| iPS:4 36572 | 21-225_225G4 | VH1|1-02|D4|4-23|RF2|JH6 | QVQLVQS-GAEVKKPGASVKV SCKASG-YTFT | G------YYIH | WVRQAPGQ GLEWMG | WINPY----SGDTNYAQK FQG | RVTMTRDTSISTAYMELRRL RFDDTAVFYCAR | DWGGYSS------YYYGMDV | WGQGT TVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4_36606 | 21-225_226G8 | VH1j1-02/D4j4-23/RF2/JH6 | QVQLVQS-GAEVKKPGASVKVSCKASG-YTFT | G------YYIH | WVRQAPGQGLEWMG | WINPY----SGDTKYAQKFQG | RVTMTRDTSISTAYMELSRLRFDDTAVFYCAR | DWGGYSS-------YYYGMDV | WGQGTTVTVSS |
| iPS:4_36610 | 21-225_226F9 | VH1j1-02/D4j4-23/RF2/JH6 | QVQLVQS-GAEVKKPGASVKVSCKASG-YTFT | G------YYIH | WVRQAPGQGLEWMG | WINPY----SGDTKYAQKFQG | RVTMTRATSISTAYMELSRLRFDDTAVFYCAR | DWGGYSS-------YYYGMDV | WGQGTTVTVSS |
| iPS:4_36612 | 21-225_226H9 | VH1j1-02/D4j4-23/RF2/JH6 | QVQLVQS-GAEVKKPGASVKVSCKASG-YTFT | G------YYIH | WVRQAPGQGLEWMG | WINPY----SGDTNSAQKFQG | RVTMTRDTSISTAYMELSRLREDDTAVFYCAR | DWGGYSS-------YYYGMDV | WGQGTTVTVSS |
| iPS:4_36614 | 21-225_226F10 | VH1j1-02/D4j4-23/RF2/JH6 | QVQLVQS-GGEVKKLRASVKVSCKASG-YTFT | G------YYIH | WVRQAPGQGLEWMG | WINPY----SGDTNYAQKFQG | RVTMTRDTSVSTAYMELSRLRLDDTAVFYCAR | DWGGYSS-------YYYGMDV | WGQGTPVTVSS |
| iPS:4_36618 | 21-225_226E11 | VH1j1-02/D4j4-23/RF2/JH6 | QVQLVQS-GAEVKKPGASVKVSCKASG-YTFT | G------YYIH | WVRQAPGQGLEWMG | WINPY----SGDTNYAQKFQG | RVTMTRDTSISTAYMELSRLREDDTAVFYCAR | DWGGYSS-------YYYGMDV | WGQGTTVTVSS |
| iPS:4_36624 | 21-225_226H12 | VH1j1-02/D4j4-23/RF2/JH6 | QVQLVQS-GAEVKKPGASVKVSCKASG-YTFT | G------YYIH | WVRQAPGQGLEWMG | WINPY----SGDTNYAQKFQG | RVTMTRDTSVSTAYMELRRLREDDTAVFYCAR | DWGGYSS-------YYYGMDV | WGQGTTVTVSS |
| iPS:4_36626 | 21-225_227C1 | VH1j1-02/D4j4-23/RF2/JH6 | QVQLVQS-GAEVKKPGASVKVSCKASG-YTFT | G------YYIH | WVRQAPGQGLEWMG | WINPY----SGDTNYAQKFQG | RVTMTRDTSISTAYMELSRLREDDTAVFYCAR | DWGGYSS-------YYYGMDV | WGQGTTVTVSS |
| iPS:4_36628 | 21-225_227F2 | VH1j1-02/D4j4-23/RF2/JH6 | QVHLVQS-GAEVKKPGASVKVSCKASG-YTFT | G------YYIH | WVRQAPGQGLEWMG | WINPY----SGDTKYAQKFQG | RVTMTRDTSISTAYMELSRLREDDTAVFYCAR | DWGGYSS-------YYYGMDV | WGQGTTVTVSS |
| iPS:4_36640 | 21-225_227A8 | VH1j1-02/D4j4-23/RF2/JH6 | QVQLVQS-GAEVKKPGASVKVSCKASG-YTFT | G------YYIH | WVRQAPGQGLEWMG | WINPY----SGDTNYAQKFQG | RVTMTRDTSISTAYMELSRLREDDTAVFYCAR | DWGGYSS-------YYYGMDV | WGQGTTVTVSS |
| | Germline | | | | | | | |
| | VH4j4-39/D4j4-17/RF1/JH4 | | H_FR1 | H_CDR1 | H_FR2 | H_CDR2 | H_FR3 | H_CDR3 | H_FR4 |
| iPS:4_36538 | 21-225_224C3 | VH4j4-39/D4j4-17/RF1/JH4 | QLQLQES-GPGLVKSSETLSLTCTVSG-GSIS | RS---SYYWG | WIRQPPGKGLEWIG | NIYY----SGSTYYNPSLKS | RVTISVDTSKNQFSLKLSSVTAADTAVYYCAR | QGRDW-------GVDY | GGQGTLVTVSS |
| | Germline | | H_FR1 | H_CDR1 | H_FR2 | H_CDR2 | H_FR3 | H_CDR3 | H_FR4 |
| | VH3j3-23/D4j4-11/RF2/JH5 | | | | | | | | |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 36546 | 21-225_224D6 | VH3J3-23/D4J4-11/RF2/J H5 | EVQLVES-GGGLVQPGGSLRL SCAASG-FTFS | S------DAMS | WVRQAPGK GLEWVS | AISGS---GDNTFYADS VKG | RFTISRDNSKNTLYLQMNSL RAEDTAVYYCAK | VYSAYD------SHWFDP | WGQGT LVTVS S |
| | VH3J1-46/D6J6-6/RF2/JH6 Germline | | | | | | | | |
| iPS:4 36568 | 21-225_225B3 | VH1J1-46/D6J6-6/RF2/JH 6 | QVQLVQS-GAEVKKPGASVKV SCKASG-YTFT | S------YYMH | WVRQAPGQ GLEWMG | IINPS---GGSTSYAQK FQG | RVTMTRDTSTSTYMELSSL RSADTAVYYCAR | DLAARSYY------YYFGMDV | WGQGA TVTVS S |
| | VH4J4-30.1/D4J4-17/RF2/JH6 Germline | | | | | | | | |
| iPS:4 36580 | 21-225_225E7 | VH4J4-30.1/D4J4-17/RF2/J H6 | QVQLQES-GPGLVKPGQTLSL TCTVSG-NSIS | SG----HYWS | WIRQHPGK GLEWIG | YIYY----TGSTYYNPS LKS | RVTISVDTSKNQFSLKLSSV TAADTAVYYCAR | EAGDYG------YYGMDV | WGQGT TVTVS S |
| iPS:4 36926 | 21-225_78D10 | VH4J4-30.1/D4J4-17/RF2/J H6 | QVQLQES-GPGLVKPGQTLSL TCTVSG-GSIS | SG----GYWS | WIRQHPGK GLEWIG | YIYY----IGSVYYNPS LKS | RVTISVDTSKNQFSLKLSSV TAADTAVYYCAR | DAFDF------GMDV | WGQGT TVTVS S |
| | VH3J3-33/D4J4-17/RF2/JH1 Germline | | | | | | | | |
| iPS:4 36592 | 21-225_226B1 | VH3J3-33/D4J4-17/RF2/J H1 | EVQLVES-GGGLVQPGRSLRL SCAASG-FTFS | T------YGMH | WVRQAPGK GLEWVA | IIWYD---GGYKYYADS VKG | RFTISRDNSKNTLFLQMNSL RAEDTAVYYCAR | DHIDFW------SGILTH | WGQGT LVTVS S |
| | VH3J3-23/D7J7-27/RF1/JH6 Germline | | | | | | | | |
| iPS:4 36652 | 21-225_146B11 | VH3J3-23/D7J7-27/RF1/J H6 | EVQLLES-GGGLVQPGGSLRL SCAASG-FTFS | S------YAMS | WVRQAPGK GLEWVS | VISGG---GSSTYYADS VKG | RFTISRDNSKNTLYLQMNSL RAEDTAVYYCAK | WRGNPT------DYGMDV | WGQGT TVTVS S |
| iPS:4 36654 | 21-225_146C11 | VH3J3-23/D7J7-27/RF1/J H6 | EVQLLES-GGGLVQPGGSLRL SCAASG-FTFS | S------YAMS | WVRQAPGK GLEWVS | VISGG---GSSTYYADS VKG | RFTISRDNSKNTLYLQMNSL RAEDTAVYYCAK | WRGNPT------DYGMDV | WGQGT TVTVS S |
| iPS:4 36658 | 21-225_146A2 | VH3J3-23/D7J7-27/RF1/J H6 | EVQLLES-GGGLVQPGGSLRL SCAASG-FTFS | S------YAMS | WVRQAPGK GLEWVS | VISGG---GSSTYYADS VKG | RFTISRDNSKNTLRLQMNSL RAEDTAVYYCAK | WRGNPT------DYGMDV | WGQGT TVTVS S |

FIGURE 51 (Continued)

| | | | | | | | | | |
|---|---|---|---|---|---|---|---|---|---|
| iPS:4 36664 | 21-225_147E7 | VH3|3-23|D7|7-27|RF1|J H6 | EVQLLES- GGGLVQPGGSLRL SCAASG-FTFS | S------YAMS | WVRQAPGK GLEWVS | VISGG---- GSSTYYADS VKG | RFTLSRDNSKNTLYLQMNSL RAEDTAVYYCAK | WRGNPT------ --------DYGMDV | WGQGT TVTVS S |
| iPS:4 36676 | 21- 225_147E11 | VH3|3-23|D7|7-27|RF1|J H6 | EVQLLES- GGGLVQPGGSLRL SCAASG-FTFS | N------YVMS | WVRQAPGK GLEWVS | VISGG---- GSSTYYADS VKG | RFTISRDNSKNTLYLQMNSL RAEDTAVYYCAK | WRGNPT------ --------DYGMDV | WGQGT TVTVS S |
| iPS:4 36678 | 21- 225_147B12 | VH3|3-23|D7|7-27|RF1|J H6 | EVQLLES- GGGLVQPGGSLRL SCAASG-FTFS | S------YAMS | WVRQAPGK GLEWVS | VISGG---- GSSTYYADS VKG | RFTISRDNSKNTLYLQMNSL RAEDTAVYYCAK | WRGNPT------ --------DYGMDV | WGQGT TVTVS S |
| iPS:4 36686 | 21-225_148G6 | VH3|3-23|D7|7-27|RF1|J H6 | EVQLLES- GGGLVQPGGSLRL SCAASG-FTFS | S------YAMS | WVRQAPGK GLEWVS | VISGG---- GSSTYYADS VKG | RFTISRDNSKNMLHLQMNSL RAEDTAVYYCAK | WRGNPT------ --------DYGMDV | WGQGT TVTVS S |
| iPS:4 36694 | 21- 225_148G11 | VH3|3-23|D7|7-27|RF1|J H6 | EVQLLES- GGGLVQPGGSLRL SCAASG-FTFS | S------YPMS | WVRQAPGK GLEWVS | VISGG---- GSSAYYADS VKG | RFTISRDNSKNTLYLQMNSL RAEDTAVYYCAK | WRGNPT------ --------DYGMDV | WGQGT TVTVS S |
| iPS:4 36700 | 21-225_149C7 | VH3|3-23|D7|7-27|RF1|J H6 | EVQLLES- GGGLVQPGGSLRL SCAASG-FTFS | S------YAMS | WVRQAPGK GLEWVS | IISGG---- GSSTYYADS VKG | RFTISRDNSKNTLYLQMNSL RAEDTAVYYCAK | WRGNPT------ --------DYGMDV | WGQGT TVTVS S |
| iPS:4 36704 | 21- 225_149C10 | VH3|3-23|D7|7-27|RF1|J H6 | EVQLLES- GGGLVQPGGSLRF SCAASG-FTFS | S------HAMS | WVRQAPGK GLEWVS | VISGG---- GSSTYYADS VKG | RFTISRDNSKNTLYLQMNSL RAEDTAVYYCAK | WRGNPT------ --------DYGMDV | WGQGT TVTVS S |
| iPS:4 36710 | 21-225_150F6 | VH3|3-23|D7|7-27|RF1|J H6 | EVQLLES- GGGLVQPGGSLRL SCAASG-FTFS | S------YAMS | WVRQAPGK GLEWVS | VISGG---- GSSTYYADS VKG | RFTISRDNSKNTLYLQMNSL RAEDTAVYYCAK | WRGNPT------ --------DYGMDV | WGQGT TVTVS S |
| iPS:4 36714 | 21- 225_150H11 | VH3|3-23|D7|7-27|RF1|J H6 | EVQLLES- GGGLVQPGGSLRL SCAASG-FTFS | T------YAMS | WVRQAPGK GLEWVS | VISGG---- GSSTYYADS VKG | RFTISRDNSKNTLYLQMNSL RAEDTAVYYCAK | WRGNPT------ --------DYGMDV | WGQGT TVTVS S |
| iPS:4 36718 | 21-225_151H5 | VH3|3-23|D7|7-27|RF1|J H6 | EVQLLES- GGGLVQPGGSLRL SCAASG-FTFS | S------YAMS | WVRQAPGK GLEWVS | VISGG---- GSSTYYADS VKG | RFTISRDNSKNTLYLQMNSL RAEDTAVYYCAK | WRGNPT------ --------DYGMDV | WGQGT TVTVS S |
| iPS:4 36722 | 21-225_151H7 | VH3|3-23|D7|7-27|RF1|J H6 | EVQLLES- GGGLVQPGGSLRL SCAASG-FTFS | S------YAMS | WVRQAPGK GLEWVS | VISGG---- GSSTYYADS VKG | RFTISRDNSKNTLYLQMNSL RAEDTAVYYCAK | WRGNPT------ --------DYGMDV | WGQGT TVTVS S |
| iPS:4 36724 | 21-225_151B9 | VH3|3-23|D7|7-27|RF1|J H6 | EVQLLES- GGGLVQPGGSLRL SCAASG-FTFS | S------YAMS | WVRQAPGK GLEWVS | VISGG---- GSSTYYADS VKG | RFTISRDNSKNTLYLQMNSL RAEDTAVYYCAK | WRGNPT------ --------DYGMDV | WGQGT TVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36728 | 21-225_152G6 | VH3|3-23|D7|7-27|RF1|J H6 | EVQLLES-GGGLVQPGGSLRL SCAASG-FTFS | S------YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 36730 | 21-225_152D7 | VH3|3-23|D7|7-27|RF1|J H6 | EVQLLES-GGGLVQPGGSLRL SCAASG-FTFS | S------YAMS | WVRQAPGK GLEWVS | VISGG----GSSTYYADS VKG | RFTISRDNSKNTLYLQMNSL RAEDTAVYYCAK | WRGNPT------DSGMDV | WGQGT TVTVS S |
| iPS:4 36742 | 21-225_154C4 | VH3|3-23|D7|7-27|RF1|J H6 | EVQLLES-GGGLVQPGGSLRL SCAASG-FTFS | S------YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 36746 | 21-225_154E10 | VH3|3-23|D7|7-27|RF1|J H6 | EVQLLES-GGGLVQPGGSLRL SCAASG-FTFS | S------YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 36758 | 21-225_155C10 | VH3|3-23|D7|7-27|RF1|J H6 | EVQLLES-GGGLVQPGGSLRL SCAASG-FTFS | S------YAMS | WVRQAPGK GLEWVS | VISGG----GTTYYADS VKG | RFTISRDNSKNTLYLQMNSL RAEDTAVYYCAK | WRGNPT------DYGMDV | WGQGT TVTVS S |
| iPS:4 36938 | 21-225_146A3 | VH3|3-23|D7|7-27|RF1|J H6 | EVQLLES-GGGLVQPGGSLRL SCAASG-FTFS | S------YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 37250 | 21-225_148C6 | VH3|3-23|D7|7-27|RF1|J H6 | EVQLLES-GGGLVQPGGSLRL SCAASG-FTFS | S------YAMS | WVRQAPGK GLEWVS | VISGG----GSSTYYADS VKG | RFTISRDNSKNTLYLQMNSL RAEDTAVYYCAK | WRGNFT------DYGMDV | WGQGT TVTVS S |
| iPS:4 37252 | 21-225_148H11 | VH3|3-23|D7|7-27|RF1|J H6 | EVQLLES-GGGLVQPGGSLRL SCAASG-FTFS | S------YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 37282 | 21-225_207C9 | VH3|3-23|D7|7-27|RF1|J H6 | EVQLLES-GGGLVQPGGSLRL SCAASG-FTFS | S------YAMS | WVRQAPGK GLEWVS | AISGS----GSSTYYADS VKG | RFTISRDNSKNTLYLQMNSL RAEDTAVYYCAK | AGGTTGSY----YYNGMDV | WGQGT TVTVS S |
| Germline | VH3|3-48|D4|4-11|RF2|JH6 | | | | | | | |
| iPS:4 36660 | 21-225_146D8 | VH3|3-48|D4|4-11|RF2|J H6 | EVQLVES-GGGLVQPGGSLRL SCAASG-FTFS | N------YNMN | WVRQAPGK GLEWVS | YISRS----SNTKYYVDS VKG | RFTISRDNAKNSLYLQMNSL RDEDTAVYYCAR | DRSGSYGY----FYYYGLDV | WGQGT TVTVS S |
| iPS:4 36682 | 21-225_146A8 | VH3|3-48|D4|4-11|RF2|J H6 | EVQLVES-GGGLVQPGBSLRL SCVASG-FTFS | N------YNMN | WVRQAPGK GLEWVS | YISRG----SNTKYYADS VRG | RFTISRDNAKNSLYLQMNSL RDEDTAVYYCAR | DRSGSYGY----FYYYGLDV | WGQGT TVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36684 | 21-225_146B6 VH3\|3-48\|D4\|4-11\|RF2\|JH6 | EVQLVES-GGGLVQPGGSLRLSCAASG-FTFS | S------YNMN | WVRQAPGK GLEWVS | YISRS----SNTKHYADS VKG | RFTISRDNAKNSLYLQMDSL RDEDTAVYYCAR | DRSGSYGY-------FYYYGLDV | WGQGT TVTVS S |
| iPS:4 36696 | 21-225_149A1 VH3\|3-48\|D4\|4-11\|RF2\|JH6 | EVQLVES-GGGLVQPGGSLRLSCAASG-FTFS | S------YNMN | WVRQAPGK GLEWVS | YISRS----SNTKHYADS VKG | RFTISRDNAKNSLYLQMNSL RDEDTAVYYCAR | DRSGSYGY-------FYYYGLDV | WGQGT TVTVS S |
| iPS:4 36712 | 21-225_150F9 VH3\|3-48\|D4\|4-11\|RF2\|JH6 | EMQLVES-GGGLVQPGGSLRLSCAASG-FTFS | S------YNMN | WVRQVPGK GLEWVS | YISRS----SNTKHYADS VKG | RFTISRDNAKNSLYLQMNSL RDEDTAVYYCAR | DRSGSYGY-------FYYYGLDV | WGQGT TVTVS S |
| iPS:4 36762 | 21-225_156H2 VH3\|3-48\|D4\|4-11\|RF2\|JH6 | EVQLVES-GGGLIQPGGSLRLSCAASG-FTFS | N------YNMN | WVRQAPGK GLEWVS | YISRS----SNTKYADS VKG | RFTISRDNAKNSLYLQMNSL RDEDTAVYYCAR | DRSGSYGY-------FYYYGMDV | WGQGT TVTVS S |
| iPS:4 36820 | 21-225_179D10 VH3\|3-48\|D4\|4-11\|RF2\|JH6 | EVQLVES-GGGLVQPGGSLRFSCAASG-FTFS | S------YSMN | WVRQAPGK GLEWVA | YISSS----GSTTYYADS VQG | RFTISRDNAKNSLYLQMNSL RDEDTAVYYCAR | DSRKGF-------YYGLDV | WGQGT TVTVS S |
| iPS:4 37262 | 21-225_170E4 VH3\|3-48\|D4\|4-11\|RF2\|JH6 | EVQLVES-GGGSVQPGGSLRLSCAASG-FTFS | S------YSMN | WVRQAPGK GLEWVS | YISSS----GSTKYYADS VEG | RFTISRDNAKNSLDLQMNSL RDEDTAVYYCAR | DSRKGF-------YYGLDV | WGQGT TVTVS S |
| Germline | | H_FR1 | H_CDR1 | H_FR2 | H_CDR2 | H_FR3 | H_CDR3 | H_FR4 |
| VH1\|1-08\|D5\|5-12\|RF1\|JH6 | | | | | | | | |
| iPS:4 36662 | 21-225_147D7 VH1\|1-08\|D5\|5-12\|RF1\|JH6 | QVQLVQS-GAEVKKPGASVKVSCKASG-YTFT | S------YDIN | WVRQATGQ GLEWMG | WMNPN----SGNTGYAQK FQG | RVTMTRNTSISTAYMELRSL RSEDTAVYYCAR | ADIVLVPAAI-------PYNYYFAMDV | WGQGT TVTVS S |
| Germline | | H_FR1 | H_CDR1 | H_FR2 | H_CDR2 | H_FR3 | H_CDR3 | H_FR4 |
| VH1\|1-02\|D3\|3-3\|RF2\|JH6 | | | | | | | | |
| iPS:4 36666 | 21-225_147B8 VH1\|1-02\|D3\|3-3\|RF2\|JH6 | QVQLVQS-GAEVKKPGASVKVSCKASG-YTFT | D------YYLH | WVRQAPGQ GLEWMG | WINPN----SGDTNYAQK FQG | RVTMTRDTSISTAYMELSRL RSDDTAVYYCAR | DRDSGSGSYP-------YYYYGMDV | WGQGT TVTVS S |
| Germline | | H_FR1 | H_CDR1 | H_FR2 | H_CDR2 | H_FR3 | H_CDR3 | H_FR4 |
| VH3\|3-33\|D3\|3-3\|RF2\|JH6 | | | | | | | | |
| iPS:4 36672 | 21-225_147F9 VH3\|3-33\|D3\|3-3\|RF2\|JH6 | QVQLVES-GGGVVQPGRSLRLSCAASG-FTFS | T------YGMH | WVRQAPGK GLEWVA | VIWYG----GSDKDYADS VKG | RFTISRDISKNTLYLQMNSL RAEDTAVYYCAR | DRDYCSGGTC-------PYYYYGMDV | WGQGT TVTVS S |

FIGURE 51 (Continued)

| | | | | | | | | |
|---|---|---|---|---|---|---|---|---|
| iPS:4 36674 | 21-225_147G9 | VH3/3-33/D3/3-3/RF2/JH6 | QVQLVES-GGGVVQPGRSLRLSCAASG-FTFS | T------YGMH | WVRQAPGK GLEWVA | VIWYG---GSDKDYADS VKG | RFTISRDISKNTLYLQMNSL RAEDTAVYYCAR | DRDYCSGGSC----------PYYYYYGMDV | WGQGT TVTVS S |
| iPS:4 36690 | 21-225_148A9 | VH3/3-33/D3/3-3/RF2/JH6 | QVQLVES-GGGVVQPGRSLRLSCAASG-FTFS | T------YGMH | WVRQAPGK GLEWVA | VIWYG---GSDKDYADS VKG | RFTISRDISKNTLYLQMNSL RAEDTAVYYCAR | DRDYCSGGTC----------PYYYYYGMDV | WGQGT TVTVS S |
| iPS:4 36708 | 21-225_150D3 | VH3/3-33/D3/3-3/RF2/JH6 | QVQLVES-GGGVVQPGRSLRLSCAASG-FTFS | T------YGMH | WVRQAPGK GLEWVA | VIWYG---GSNKDYADS VKG | RFTISRDNSKNTLYLQMNSL RAEDTAVYYCAR | DRDYCSGGTC----------PYYYYYGMDV | WGQGT TVTVS S |
| iPS:4 36716 | 21-225_151F3 | VH3/3-33/D3/3-3/RF2/JH6 | QVQLVES-GGGVVQPGRSLRLSCAASG-FTFS | T------YGMH | WVRQAPGK GLEWVA | VIWYG---GSNTDYADS VKG | RFTISRDISKNTLYLQMNSL RAEDTAVYYCAR | DRDYCSGTSC----------PYYYYYGMDV | WGQGT TVTVS S |
| iPS:4 36738 | 21-225_153D9 | VH3/3-33/D3/3-3/RF2/JH6 | QVQLVES-GGGVVQPGRSLRLSCAASG-FTFS | T------YGMH | WVRQAPGK GLEWVA | VIWYG---GSNKDYADS VKG | RFTISRDISKNTLYLQMNSL RAEDTAVYYCAR | DRDYCSGGSC----------PYYYYYGMDV | WGQGT TVTVS S |
| iPS:4 36740 | 21-225_154C3 | VH3/3-33/D3/3-3/RF2/JH6 | QVQLVES-GGGVVQPGRSLRLSCAASG-FTFS | T------YGMH | WVRQAPGK GLEWVA | VVWYG---GNNKDYADS VKG | RFTISRDISKNTLYLQMNSL RAEDTAVYYCAR | DRDYCSGGSC----------PYYYYYGMDV | WGQGT TVTVS S |
| iPS:4 36748 | 21-225_154D11 | VH3/3-33/D3/3-3/RF2/JH6 | QVQLVES-GGGVVQPGRSLRLSCAASG-FNVS | T------YGMH | WVRQAPGK GLEWVA | VIWYG---GSNKDYADS VKG | RFTISRDSSKNTLYLQMNSL RAEDTAVYYCAR | DRDYCSGGSC----------PYYYYYGMDV | WGQGT TVTVS S |
| iPS:4 36764 | 21-225_158E9 | VH3/3-33/D3/3-3/RF2/JH6 | QVQLVES-GGGVVQPGRSLRLSCAASG-FTFS | S------YGMH | WVRQAPGK GLEWVA | VIWYD---GSSKYYADS VKG | RFTISRDNSKNTLYLQMNSL RAEDTAVYYCAR | DRVFCSGTSC----------PYYYYYGMDV | WGQGT TVTVS S |
| iPS:4 36774 | 21-225_161E10 | VH3/3-33/D3/3-3/RF2/JH6 | QVQLVES-GGGVVQPGRSLRLSCAASG-FTFS | S------YGMH | WVRQAPGK GLEWVA | VIWYD---GSNKYYYDS VKG | RFTISRDISKNTLYLQMNSL RAEDTAVYYCAR | DRVFCSGTSC----------PYYYYYGMDV | WGQGT TVTVS S |
| iPS:4 36916 | 21-225_74A9 | VH3/3-33/D3/3-3/RF2/JH6 | QVQLVES-GGGVVQPGRSLRLSCAASG-FTFS | S------YGMH | WVRQAPGK GLEWVA | VIWYD---GNNKSYADS VKG | RFTISRDISKNTLFLQMNSL RADDTAVYYCAR | DRDYCSGTSC----------PYYYYYGMDV | WGQGT TVTVS S |
| iPS:4 36940 | 21-225_146B8 | VH3/3-33/D3/3-3/RF2/JH6 | QVQLVES-GGGVVQPGRSLRLSCAASG-FTFS | T------YGMH | WVRQAPGK GLEWVA | VIWYD---GNDKDFADS VTG | RFTISRDISKNTLYLQMNSL RAEDTAVYYCAR | DRDYCSGGSC----------PYYYYYGMDV | WGQGT TVTVS S |
| iPS:4 37258 | 21-225_153F9 | VH3/3-33/D3/3-3/RF2/JH6 | QVHLVES-GGGVVQPGRSLRLSCAASG-FTIS | T------YGMH | WVRQGPGK GLEWVA | VIWYG---GSDTDYADS VRG | RFTISRDISKNTLYLQMNSL RAEDTAVYYCAR | DRDYCSGGNC----------PYYYYYGMDV | WGQGT TVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4-30.1/D7/7-27/RF3/JH5 | | | | | | | | |
| iPS.4-36680 225_147H12 | VH4/4-30.1/D7/7-27/RF3/JH5 | QVQLQES-GFGLVNPSQTLSL TCAVSG-GSIS | SG----YYWS | WIRQHPGK GLEWIG | YIYY------SGSTYYNPS LKS | RVTISVDTSKNQFSLKLTSV TAADTAVYYCAR | DWGGYIDS--------SGWFDP | WGQGT LVTVS S |
| iPS.4-36750 225_154G12 | VH4/4-30.1/D7/7-27/RF3/JH5 | QVQLQES-GFGLVNPSQTLSL TCGVSG-GSIS | SG----YYYWS | WIRQHPGK GLEWIG | YIYY------SGSTYYNPS LKS | RVSISLDTPKNQFSLKLTSV TAADTAVYYCAR | DWGGYIDS--------SGWFDP | WGQGT LVTVS S |
| | Germline | H_FR1 | H_CDR1 | H_FR2 | H_CDR2 | H_FR3 | H_CDR3 | H_FR4 |
| VH3/3-07/D6/6-13/RF1/JH4 | | | | | | | | |
| iPS.4-36698 21-225_149B5 | VH3/3-07/D6/6-13/RF1/JH4 | EVQLVES-GGGLVQPGGSLRL SCAASG-FTFS | G----YMMN | WVRQAPGK GLEWVA | NIKQD----GSEKYVDS VKG | RFTISRDN-AKNSLYLQMNSL RAEDTAVYYCAR | GMYSSG--------WYVFDY | WGQGT LVTVS S |
| | Germline | H_FR1 | H_CDR1 | H_FR2 | H_CDR2 | H_FR3 | H_CDR3 | H_FR4 |
| VH3/3-21/D6/6-19/RF2/JH5 | | | | | | | | |
| iPS.4-36702 21-225_149E8 | VH3/3-21/D6/6-19/RF2/JH5 | EVQLVES-GGGLVKPGGSLRL SCAASG-FTFS | S----YSMN | WVRRAPGK GLEWVS | AISST----GSYIYYADS VKG | RFTISRDNAKNSLYLQMNSL RAEDTAVYYCAR | TAVAGI--------GWFDP | WGQGT LVTVS S |
| | Germline | H_FR1 | H_CDR1 | H_FR2 | H_CDR2 | H_FR3 | H_CDR3 | H_FR4 |
| VH5/5-51/D3/3-22/RF2/JH6 | | | | | | | | |
| iPS.4-36752 21-225_155H1 | VH5/5-51/D3/3-22/RF2/JH6 | EVQLVQS-GAEVKKPGESLKI SCKGSG-YSFT | S----YMIG | WVRQMPGK GLEWMG | LIIYPG---ASDTRYSPS FQG | QVTISADKSISTAYLQWSSL KASDTAMYYCAR | QAIASRGR--------YYYGMDV | WGQGT TVTVS S |
| | Germline | H_FR1 | H_CDR1 | H_FR2 | H_CDR2 | H_FR3 | H_CDR3 | H_FR4 |
| VH3/3-33/D6/6-19/RF1/JH4 | | | | | | | | |
| iPS.4-36772 21-225_161H3 | VH3/3-33/D6/6-19/RF1/JH4 | QVQLVES-GGGVVQPGRSLRL SCAASG-FTFS | S----YGMH | WVRQAPGK GLEWVA | VIWYD----GSNKYYADS VKG | RFTISRDNSKNTLYLQMNSL RAEDTAVYYCAR | VGYSGG--------WYIFDY | WGQGT LVTVS S |
| | Germline | | | | | | | |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| VH4/4-30.1|D2|2-2|RF2/JH6 | | EVQLQES- GPGLVKPSDTLSL TCTVSG-GSIS | SG----GYYWS | WIRQHPGK GLEWIG | YIYY---- SGSPYYNPS LKS | RITISIDTSKNQFSLKLNSV TAADTAVYYCAR | SNCSSANCYT------- ------VGFYYYGMDV | WGRGT TVTVS S |
| iPS:4 36776 | 21-225_161F12 VH4|4-30.1|D2|2-2|RF2/JH6 | QVQLQES- GPGLVKPSQTLSL TCTVSG-GSIS | SG----GYYWS | WIRQHPGK GLEWIG | YIYY---- SGSPYYNPS LKS | RITISIDTSKNQFSLKLNSV TAADTAVYYCAR | SNCSSANCYT------- ------VGFYYYGLDV | WGRGT TVTVS S |
| iPS:4 36780 | 21-225_165H3 VH4|4-30.1|D2|2-2|RF2/JH6 | QVQLQES- GPGLVKPSQTLSL TCTVSG-GSIS | SG----GYYWS | WIRQHPGK GLEWIG | YIYY---- SGSPYYNPS LKS | RITISIDTSKNQFSLKLNSV TAADTAVYYCAR | SNCSSANCYT------- ------VGFYYYGMDV | WGQGT TVTVS S |
| Germline | | H_FR1 | H_CDR1 | H_FR2 | H_CDR2 | H_FR3 | H_CDR3 | H_FR4 |
| VH3|3-33|D5|5-24|RF3/JH6 | | EVQLVES- GGGVVQPGRSLRL SCAASG-FTFS | S-------NGMH | WVRQAPGK GLEWVA | VIWYD---- GSNKYYADS VKG | RFTISRDNSKNTLYLQMNSL RAEDTAVYYCAR | DQYNRNDGPP------- ------AYYYYYGLDV | WGQGT TVTVS S |
| iPS:4 36784 | 21-225_169C1 VH3|3-33|D5|5-24|RF3/JH6 | QVQLVES- GGGVVQPGRSLRL SCAASG-FTLS | S-------NGMH | WVRQAPGK GLEWVA | VIWID---- GSNKYYADS VKG | RFTISRUTSKNTLYLQMNSL RAEDTAVYYCAR | DQYNRNDGPP------- ------AYYYYYGLDV | WGQGT TVTVS S |
| iPS:4 36786 | 21-225_169A6 VH3|3-33|D5|5-24|RF3/JH6 | QVQLVES- GGGVVQPGRSLRL SCAASG-FTLS | S-------NGMH | WVRQAPGK GLEWVA | VIWID---- GSNKYYADS VKG | RFTISRDNSKNTLDLQMNSL RAEDTAVYYCAR | DQYNRNDGPP------- ------AYYYYYGLDV | WGQGT TVTVS S |
| iPS:4 36796 | 21-225_170A5 VH3|3-33|D5|5-24|RF3/JH6 | QVQLVES- GGGVVQPGRSLRL SCAASG-LTFS | N-------CGMH | WVRQAPGK GLEWVA | IIWYD---- GSNKYYADS VKG | RFTISRDNSKNTLDLQMNSL RAEDTAVYYCAR | DQYNRNDGPP------- ------AYYYYYGLDV | WGQGT TVTVS S |
| iPS:4 36812 | 21-225_175C6 VH3|3-33|D5|5-24|RF3/JH6 | QVQLVES- GGGVVQPGRSLRL SCAASG-LTFS | N-------CGMH | WVRQAPGK GLEWVA | IIWYD---- GSNKYYADS VKG | RFTVSRDNSKNTLDLQMNSL RAEDTAVYYCAR | DQYNRNDGPP------- ------AYYYYYGLDV | WGQGT TVTVS S |
| Germline | | H_FR1 | H_CDR1 | H_FR2 | H_CDR2 | H_FR3 | H_CDR3 | H_FR4 |
| VH3|3-48|D5|5-18|RF1/JH6 | | EVQLVES- GGGLVQPGGSLRL SCAASG-FTFS | S------YSMN | WVRQAPGK GLEWVS | YISSS---- SSTIFYADS VKG | RFTISRDNAKNSLYLQMNSL RDEDTAVYYCAR | GDTAMVL------- ------YYYYGMDV | WGQGT TVTVS S |
| iPS:4 36788 | 21-225_169B7 VH3|3-48|D5|5-18|RF1/JH6 | EVQLVES- GGGLVQPGGSLRL SCAASG-FTFS | S------YSLN | WVRQAPGK GLEWVS | YIGSS---- GSIIFYADS VKG | RFTISRDNAKNSLYLQMNSL RDEDTAVYYCAR | GDTAGVI------- ------YYYGMDV | WGQGT TVTVS S |
| iPS:4 36798 | 21-225_171F5 VH3|3-48|D5|5-18|RF1/JH6 | EVQLVES- GGGLVQPGGSLRL SCAASG-FTFS | S------YSLN | WVRQAPGK GLEWVS | YIGSS---- GSIIFYADS VKG | RFTISRDNAKNSLYLQMNSL RDEDTAVYYCAR | GDTAGVT------- ------YYYGMDV | WGQGT TVTVS S |
| iPS:4 36864 | 21-225_58G11 VH3|3-48|D5|5-18|RF1/JH6 | EVQLVES- GGGLVQPGGSLRL SCAASG-FTFS | S------YSMN | WVRQAPGK GLEWIS | YISTS---- SSTIFYADS VKG | RFTISRDSAKNSLYLQMNSL RDEDTAVYYCAR | GDTAMVL------- ------YYYYGMDV | WGQGT TVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36866 | 21-225_59F2 | VH3-48/D5J5-18/RF1/JH6 | EVQLVES-GGGLVQPGGSLRL SCGASG-FTFS | S-----YSMN | WVRQAPGK GLEWVS | YISGS----SNIYYTDS VKG | RFTISRDNAKNSLYLQMNSL RDECTAVYYCAR | ADTPMVL-------YFYGMDV | WGQGT TVTVS S |
| iPS:4 36872 | 21-225_60D2 | VH3-48/D5J5-18/RF1/JH6 | EVQLVES-GGGLVQPGGSLRL SCGASG-FTFS | S-----YSMN | WVRQAPGK GLEWVS | YISES----SNIYYTDS VKG | RFTISRDNAMNSLYLQMNSL RDEDTAVYYCAR | ADTPMVL-------YFYGMDV | WGQGT TVTVS S |
| | Germline | VH3-33/D5J5-24/RF1/JH6 | | | | | | | |
| iPS:4 36790 | 21-225_169G11 | VH3-33/D5J5-24/RF1/JH6 | QVQLVES-GGGVVQPGRSLRL SCAASG-FTFS | S-----YGMH | WVRQAPGK GLEWVA | IIWYD----GSNKYYADS VKG | RFTISRDNSKNTLYLQMNSL RAEDTAVYYCAR | EGATYYHGSGS-------YYPATNYGMDV | WGQGT TVTVS S |
| | Germline | VH3-33/D3J3-10/RF1/JH6 | | | | | | | |
| iPS:4 36792 | 21-225_169D12 | VH3-33/D3J3-10/RF1/JH6 | QVQLVES-GGGVVQPGRSLRL SCAASG-FTFS | S-----YGMH | WVRQAPGK GLEWVA | VIWYD----GSNKYYADS VKG | RFTISRDNSKNTLYLQMNSL RAEDTAVYYCAR | PLYDMGL-------YYYGMDV | WGQGT TVTVS S |
| | Germline | VH1-46/D7J7-27/RF3/JH4 | | | | | | | |
| iPS:4 36800 | 21-225_171D12 | VH1-46/D7J7-27/RF3/JH4 | QVQLVQS-GAEVKKPGASVKV SCKASG-YTFN | S-----YYMY | WVRQAPGQ GLEWMG | IINPS----GGSTNYAQK FQG | RVTMTRDTSTSTLYMELNSL RSEDTAVYYCAS | GME-------LNY | WGQGT LVTVS S |
| iPS:4 36804 | 21-225_172C3 | VH1-46/D7J7-27/RF3/JH4 | QVQLVQS-GAEVKKPGASVKV SCKASG-YTFS | S-----YYMY | WVRQAPGQ GLEWVG | IINPS----GGSTNYAQK FQG | RVTMTRDTSTSTLYMELNSL RSEDTAVYYCAS | GME-------LNY | WGQGT LVTVS S |
| iPS:4 36806 | 21-225_172B12 | VH1-46/D7J7-27/RF3/JH4 | QVQLVQS-GAEVKKPGASVTV SCKASG-YTFR | S-----YYMY | WVRQAPGQ GLEWVG | TINPS----GGSTDYAQK FQG | RVTMTRDTSTSTLYMELNSL RSEDTAVYYCAS | GME-------LNY | WGQGT LVTVS S |
| | Germline | VH3-30.3/D4J4-23/RF1/JH6 | | | | | | | |
| iPS:4 36808 | 21-225_173F8 | VH3-30.3/D4J4-23/RF1/JH6 | QVQLVES-GGGVVQPGRSLRL SCAASG-FTFS | S-----YGMH | WVRQAPGK GLEWVA | VISYD----GSPKYCADS VKG | RFTISRDNSKNTLFLQMNSL RAEDTAVYYCAR | DERQWLP-------APYGMDV | WGQGT TVTVS S |

FIGURE 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| | VH6|6-01|D6|6-6|RF2|JH6 | | | SN | | | | | |
| iPS:4 36810 | 21-225_175F4 | VH6|6-01|D6|6-6|RF2|JH6 | QVQLQQS-GPGLVKPSQTLSLTCAISG-DSVS | SN----SAAWN | WIRQSPSRGLEWLG | RTYYR----SKWYNAYPVSMES | RISINPDTSKMQFSLQLNSVTPEDTAVYYCAR | DKAAGRND---------FYYYGMDV | WGQGTTVTVSS |
| iPS:4 36814 | 21-225_178H10 | VH6|6-01|D6|6-6|RF2|JH6 | QVQLQQS-GFGLVKFSQTLSLTCAISG-DSVS | SN----SAAWN | WIRQSPSRGLEWLG | RTYYR----SKWYSAYPVSMES | RVSINPDTSKMQFSLQLNSVTFEDTAVYYCAR | DKAAGRND---------FYYYGMDV | WGQGTTVTVSS |
| | VH3|3-33|D1|1-1|RF3|JH6 | | | | | | | | |
| iPS:4 36818 | 21-225_179C7 | VH3|3-33|D1|1-1|RF3|JH6 | QAQLVES-GGGVVQPGRSLRLSCAASG-FTFS | N------SGMH | WVRQGPGKGLEWVA | IIIYD----GSYKYNADSVKG | RFTISRDNSKNTLYLQMNSLRAEDTAVYYCAR | DRHYDFHVP-------YYYYGMDV | WGQGTTVTVSS |
| iPS:4 37094 | 21-225_210D12 | VH3|3-33|D1|1-1|RF3|JH6 | QVQLVES-GGGVVQPGRSLRLSCAASG-FTFS | H------YGMH | WVRQAPGKGLEWVA | VIWYD----GSNKYYADSVKG | RFTISRDNSKNTLYLQMNSLRAEDTAVYYCAR | GDWNP-----------EGLDV | WGQGTTVTVSS |
| iPS:4 37096 | 21-225_210E12 | VH3|3-33|D1|1-1|RF3|JH6 | QVQLVES-GGGVVQPGRSLRLSCAASG-FTFS | N------YGMH | WVRQAPGKGLEWVA | VIWYD----GSNKYYADSVKG | RFTISRDNSKNTLYLQMNSLRAEDTAIYYCAR | GDWNP-----------EGMDV | WGQGTTVTVSS |
| iPS:4 37098 | 21-225_211C1 | VH3|3-33|D1|1-1|RF3|JH6 | QVQLVES-GGGVVQPGRSLRLSCAASG-FTFS | H------YGMH | WVRQAPGKGLEWVA | VIWYD----GSNKYYADSVKG | RFTISRDNSKNTLYLQMNTLRAEDTAIYYCAR | GDWNP-----------EGLDV | WGQGTTVTVSS |
| iPS:4 37104 | 21-225_211G5 | VH3|3-33|D1|1-1|RF3|JH6 | QVQLVES-GGGVVQPGRSLRLSCAASG-FTFS | H------YGMH | WVRQAPGKGLEWVA | VIWYD----GSNKYYADSVKG | RFTISRDNSKNTLYLQMNSLRAEDTAVYYCAR | GDWNP-----------EGLDV | WGQGTTVTVSS |
| iPS:4 37112 | 21-225_212C2 | VH3|3-33|D1|1-1|RF3|JH6 | QVQLVES-GGGVVQPGRSLRLSCAASG-FTFS | H------YGMH | WVRQAPGKGLEWVA | VIWYD----GSNKYYADSVKG | RFTISRDNSKNTLYLQMNSLRAEDTAVYYCAR | GDWNP-----------EGMDV | WGQGTTVTVSS |
| iPS:4 37114 | 21-225_212A4 | VH3|3-33|D1|1-1|RF3|JH6 | QVQLVES-GGGVVQAGRSLRLSCAASG-FTFS | N------YGMH | WVRQAPGKGLEWVA | VIWYD----GSNKYYADSVKG | RFTISRDNSKNTLYLQMNSLRAEDTAVYYCAR | GDWNP-----------EGMDV | WGQGTSVTVSS |
| iPS:4 37116 | 21-225_212F6 | VH3|3-33|D1|1-1|RF3|JH6 | QVQLVES-GGGVVQPGRSLRLSCAASG-FTFS | H------YGMH | WVRQAPGKGLEWVA | VIWYD----GSNKYYADSVKG | RFTISRDNSKNTLYLQMNSLRAEDTAVYYCAR | GDWNP-----------EGLDV | WGQGTTVTVSS |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 37118 | 21-225_212G7 VH3J3-33D1J1-1IRF3JJH6 | QVQLVES-GGGVVQPGRSLRL SCAASG-FTFS | H------YGMH | WVRQAPGK GLEWVA | VIWYD--- GSNKYADS VKG | RFTISRDNSTNTLYLQMNSL RAEDTAVYYCAR | GDWNP------EGLDV | WGQGT TVTVS S |
| iPS:4 37128 | 21-225_213G3 VH3J3-33D1J1-1IRF3JJH6 | QVQLVES-GGGVVQPGRSLRL SCAASG-FTFS | H------YGMH | WVRQAPGK GLEWVA | VIWYD--- GSNKYADS VKG | RFTISRDNSKNTLHLQMNSL RAEDTAVYYCAR | GDWNP------EGMDV | WGQGT SVTVS S |
| iPS:4 37130 | 21-225_213D5 VH3J3-33D1J1-1IRF3JJH6 | QVQLVES-GGGVVQPGRSLRL SCAASG-FTFS | H------YGMH | WVRQAPGK GLEWVA | VIWYD--- GSNKYADS VKG | RFTISRDNSKNTLFLQMNSL RVEDTAVYYCAR | GDWNP------EGMDV | WGQGT TVTVS S |
| iPS:4 37146 | 21-225_215D3 VH3J3-33D1J1-1IRF3JJH6 | QTQLVES-GGGVVQPGRSLRL SCAASG-FTFS | H------YGMH | WVRQAPGK GLEWVA | VIWYD--- GSNEYADS VKG | RFTISRDNSKNTLYLQMNSL RAEDTAVYYCAR | GDWNP------EGMDV | WGQGT TVTVS S |
| iPS:4 37150 | 21-225_216A3 VH3J3-33D1J1-1IRF3JJH6 | QVQLVES-GGGVVQPGRSLRL SCAASG-FTFS | H------YGMH | WVRQAPGK GLEWVA | VIWYD--- GSNKYADS VKG | RFTISRDNSKNTLYLQMNSL RAEDTAVYYCAR | GDWNP------EGLDV | WGQGT TVTVS S |
| iPS:4 37162 | 21-225_217B2 VH3J3-33D1J1-1IRF3JJH6 | QVHLVES-GGGVVQPGRSLRL SCAASG-FTFS | N------YGMH | WVRQAPGK GLEWVA | VIWYD--- GSNKYADS VKG | RFTISRDNSKNTLYLQMNSL RAEDTAVYYCAR | GDWNP------EGMDV | WGQGT TVTVS S |
| iPS:4 37172 | 21-225_219A7 VH3J3-33D1J1-1IRF3JJH6 | QVQLVES-GGGVVQPGRSLRL SCAASG-FTFS | H------YGMH | WVRQAPGK GLEWVA | VIWYD--- GSNKYADS VKG | RFTISRDNSKNMLYLQMNSL RAEDTAVYYCAR | GDWNP------EGMDV | WGQGT TVTVS S |
| iPS:4 37182 | 21-225_221H2 VH3J3-33D1J1-1IRF3JJH6 | QVQLVES-GGGVVQPGRSLRL SCAASG-FTFS | H------YGMH | WVRQAPGK GLEWVA | VIWYD--- GSNKYADS VKG | RFTISRDNSKNTLHLQMNSL RAEDTAVYYCAR | GDWNP------EGMDV | WGQGT TVTVS S |
| iPS:4 37184 | 21-225_221G4 VH3J3-33D1J1-1IRF3JJH6 | QVQLVES-GGGVVQPGRSLRL SCAASG-FTFS | H------YGMH | WVRQAPGK GLEWVA | VIWYD--- GSNKYADS VKG | RFTISRDNSKNTLHLQMNSL RAEDTAVYYCAR | GDWNP------EGMDV | WGQGT SVTVS S |
| iPS:4 38664 | 21-225_216G1 VH3J3-33D1J1-1IRF3JJH6 | QVQLVES-GGGVVQPGRSLRL SCAASG-FTFS | N------YGMH | WVRQAPGK GLEWVA | VIWYD--- GSNKYADS VKG | RFTISRDNSKNTLYLQMNSL RAEDTAVYYCAR | GDWNP------EGMDV | WGQGT TVTVS S |
| Germline | VH3J3-33D1J1-1IRF1JJH4 | | | | | | | |
| iPS:4 36822 | 21-225_180D4 VH3J3-33D1J1-1IRF1JJH4 | QVQLVES-GGGVVQPGRSLRL SCAASG-FTFS | N------EGMH | WVRQAPGK GLEWVA | IIWYD--- GSDKYYADS VKG | RFTISRDNSKNTLYLXLQMNTL RAEDTAVYFCAR | GGPFFST------VTMYFDY | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36828 | 21-225_181H1 VH3j3-33/D1j1-1jRF1/JH4 | QVQLVES-GGGVVQPGRSLRL SCAASG-FTFS | N------YGMH | WVRQAPGK GLEWVA | IIWYD----GSDKYYADS VKG | RFTISRDNSKNTLYLQMNTL RAEDTAVYFCAR | GGPFST------VTMYFDY | WGQGT LVTVS S |
| iPS:4 36950 | 21-225_184G4 VH3j3-33/D1j1-1jRF1/JH4 | QVQLVES-GGGVVQPGRSLRL SCAVSG-FTFS | S------YGMH | WVRQAPGK GLEWVA | IIWYD----GSNKYYADS VKG | RFTISRDNSKNTLYLQMNSL RAEDTAVYFCAR | GGPFST------VTMYFDY | WGQGT LVTVS S |
| iPS:4 36952 | 21-225_185D2 VH3j3-33/D1j1-1jRF1/JH4 | QVQLVES-GGGVVQPGRSLRL SCAASG-FTFS | N------YGMH | WVRQAPGK GLEWVA | IIWYD----GSDKYYADS VKG | RFTISRDNSKNTLYLQMNTL RAEDTAVYFCAR | GGPFST------VTMYFDY | WGQGT LVTVS S |
| | Germline | H_FR1 | H_CDR1 | H_FR2 | H_CDR2 | H_FR3 | H_CDR3 | H_FR4 |
| VH2j2-05/D6j6-18jRF2/JH3 | | | | | | | | |
| iPS:4 36824 | 21-225_180C5 VH2j2-05/D6j6-18jRF2/JH3 | QITLKES-GPTLVKPTQTLTL TCTFSG-FSLS | TS----GVGVG | WIRQPPGK ALEWLG | FISW-NDDKRYSPS LKS | SLFITKDTSKNQVVLTMTNM DPVDTATYYCAH | KAAAV-------------AFDI | WGQGT MVTVS S |
| iPS:4 36956 | 21-225_186H6 VH2j2-05/D6j6-18jRF2/JH3 | QITLKES-GPTLVKPTQTLTL TCTFSG-FSLS | TS----GVGVG | WIRQPPGK ALEWLG | FISW-NDDKRYSPS LKS | SLFITKDTSKNQVVLTMTNM DPVDTATYYCAH | KAAAV-------------AFDI | WGQGT MVTVS S |
| | Germline | H_FR1 | H_CDR1 | H_FR2 | H_CDR2 | H_FR3 | H_CDR3 | H_FR4 |
| VH1j1-08/D5j5-18jRF3/JH6 | | | | | | | | |
| iPS:4 36826 | 21-225_180G5 VH1j1-08/D5j5-18jRF3/JH6 | QVQLVQS-GAEVKKPGASVKV SCKASG-YTFT | S-------YDIN | WVRQATGQ GLEWMG | WMNEN----SGNTGYAQK FQG | RVTMTRNTISTAYMELSSL RSEDTAVYYCAR | GFYYYGSGSHV----PYHYYYGLDV | WGQGT TVTVS S |
| | Germline | H_FR1 | H_CDR1 | H_FR2 | H_CDR2 | H_FR3 | H_CDR3 | H_FR4 |
| VH6j6-01/D5j5-24jRF3/JH2 | | | | | | | | |
| iPS:4 36832 | 21-225_51D8 VH6j6-01/D5j5-24jRF3/JH2 | QVQLQQS-GPGLVKPSQTLSL TCAISG-DSVS | SN----SAAWN | WIRQSPSR GLEWLG | RTYYR---SKWYNDYAV SVKS | RITFNPDTSKNQFSLRLNSV TPEDTAVYYCAR | DRYNWNY-------FYWYFDL | WGRGT LVTVS S |
| | Germline | H_FR1 | H_CDR1 | H_FR2 | H_CDR2 | H_FR3 | H_CDR3 | H_FR4 |
| VH1j1-02/D5j5-24jRF3/JH5 | | | | | | | | |
| iPS:4 36840 | 21-225_53E9 VH1j1-02/D5j5-24jRF3/JH5 | QVQLVQS-GAEVKKPGASVKV SCKASG-NTFT | G------YYMH | WVRQAPGQ GLEWMG | WIIPN----SGDTNYAQK FQG | RVTMTRDTISTAYMELSRL RSDDTAVYYCAR | DGYSSGW-------FNWFDP | WGQGT LVTVS S |

FIGURE 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| | VH2(2-05)D7(7-27)RF1/JH4 | | QITLKES-GPTLVKPTQTLTLTCTFSG-FSLS | TS---GVGVG | WIRQPPGK ALEWLA | LIYW---HEDKRYSPS LKS | RLTITEDTSKNQVLTMTNM APVDTATYYCAH | VTGI----------EDY | WGQGT LVTVS S |
| iPS:4 36848 | 21-225_57F1 | VH2(2-05)D7(7-27)RF1/JH4 | QITLKES-GPTLVKPTQTLTL TCTFSG-FSLS | TS---GVGVG | WIRQPPGK ALEWLA | LIYW---HEDKRYSPS LKS | RLTITEDTSKNQVLTMTNM APVDTATYYCAH | VTGI----------AAPY | WGQGT LVTVS S |
| iPS:4 36852 | 21-225_57H11 | VH2(2-05)D7(7-27)RF1/JH4 | QITLKES-GPTLVKPTQTLTL TCTFSG-FSLT | TS---GVGVG | WIRQPPGK ALEWLA | LIYW---HEDKRYSPS LKS | RLTITEDTSKNQVLTMTNM APVDTATYYCAH | VTGI----------AAPY | WGQGT LVTVS S |
| iPS:4 36870 | 21-225_60B1 | VH2(2-05)D7(7-27)RF1/JH4 | QITLKES-GPTLVKPTQTLTL TCTFSG-FSLS | TS---GVGVG | WIRQPPGK ALEWLA | LIYW---HEDKRYSPS LKS | RLTITEDTSKNQVLTMTNM APVDTATYYCAH | VTYI----------AAPY | WGQGT LVTVS S |
| iPS:4 36876 | 21-225_61F5 | VH2(2-05)D7(7-27)RF1/JH4 | QITLKES-GPTLVKPTQTLTL TCTFSG-FSLS | TS---GLGVG | WIRQPPGK ALEWLA | LIYS---HEDKRYSPS LKS | RLTITEDTSKNQVLTMTNM APVDTATYYCAH | VTGI----------AAPY | WGQGT LVTVS S |
| iPS:3 92593 | 21-225_3E10 | VH2(2-05)D7(7-27)RF1/JH4 | QITLKES-GPTLVKPTQTLTL TCTFSG-FSLN | TG---GVGVG | WIRQPPGK ALEWLA | LIYW---HEDKRHSPS LKS | RLTITEDTSKNQVLTMTNM APVDTATYYCAH | LIEV----------AFDY | WGQGT LVTVS S |
| | | Germline | H_FR1 | H_CDR1 | H_FR2 | H_CDR2 | H_FR3 | H_CDR3 | H_FR4 |
| | VH2(2-05)D(6-6)RF2/JH1 | | | | | | | | |
| iPS:4 36854 | 21-225_58C1 | VH2(2-05)D(6-6)RF2/JH1 | QITLKES-GPTLVKPTQTLTL TCTFSG-FSLS | TS---GVGVG | WIRQPPGK ALEWLA | LIYW---DDDKRYSPS LKS | RLTITEDTSKNQVVLTMTNM DPVDTATYYCAH | LIAV----------AFDS | WGQGT LVTVS S |
| iPS:4 36874 | 21-225_60A12 | VH2(2-05)D(6-6)RF2/JH1 | QITLKES-GPTLVKPTQTLTL TCTFSG-FSLS | TS---GVGVG | WIRQPPGK ALEWLA | LIYW---DDDKRYSPS LKS | RLTITEDTSKNQVVLTMTNM DPVDTATYYCAH | LIAV----------AFDS | WGQGT LVTVS S |
| iPS:4 36954 | 21-225_185G7 | VH2(2-05)D(6-6)RF2/JH1 | QITLKES-GPTLVKPTQTLTL TCTFSG-FSLT | TG---GVGVG | WIRQPPGK ALEWLA | LIYW---NDDKRYSPS LKS | RLTITKDTSKNQVVLTMTNM DPVDTATYYCAH | LIAV----------AFQH | WGQGT LVTVS S |
| iPS:3 93188 | 21-225_34B9 | VH2(2-05)D(6-6)RF2/JH1 | QITLKES-GPTLVKPTQTLTL TCTFSG-FSLS | TS---GVGVG | WIRQPPGK ALEWLA | LIYW---NDDKRYSPS LKS | RLTITKDTSKNQVVLTMTNM DPVDTATYYCAH | LIAV----------TFDS | WGQGS LVTVS S |
| | | Germline | H_FR1 | H_CDR1 | H_FR2 | H_CDR2 | H_FR3 | H_CDR3 | H_FR4 |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 21-225_58E7 36858 | VH3|3-30.3/D3|3-10|RF2/JH6 | QVQLVES-GGGLVQPGRSLRL SCAASG-FTFS | F------YGMH | WVRQAPGK GLEWVA | VTSYD----GSDRYYADS VKG | RFSISRDNSKNTLLQMSSL RAEDTAMYYCAR | DDYSGGSP-----LYYGMDV | WGQGT TVTVS S |
| | Germline | | | | | | | |
| | VH3|3-07/D5|5-12|RF2/JH6 | | | | | | | |
| iPS:4 21-225_58F7 36860 | VH3|3-07/D5|5-12|RF3/J H6 | EVQLVES-GGGLVQPGGSLRL SCAASG-FTFS | S------FWMS | WVRQAPGK GLEWVA | HIKQD----GSEKYYVDS VKG | RFTISRDNAKNSLYLQMNSL RAEDTAVYYCAR | GDLPYSSG-----YYYGMDV | WGQGT TVTVS S |
| | Germline | | | | | | | |
| | VH3|3-30.3/D4|4-17|RF2/JH6 | | | | | | | |
| iPS:4 21-225_58F8 36862 | VH3|3-30.3/D4|4-17|RF2/J H6 | QVQLVES-GGGLVQPGRSLRL SCAASG-FTFS | S------YGMH | WVRQAPGK GLEWVA | VISYD----GSNKYYADS VKG | RFTISRDNSKNTLYLQMNSL RAEDTAVYYCAR | DEGKGVGGYER----GYYYYYGMDV | WGQGT TVTVS S |
| | Germline | | | | | | | |
| | VH3|3-33/D3|3-16|RF2/JH6 | | | | | | | |
| iPS:4 21-225_59B11 36868 | VH3|3-33/D3|3-16|RF2/J H6 | QVQLVES-GGGLVQPGRSLRL SCAASG-FTFS | S------YGVH | WVRQAPGK GLEWVA | AIWYD----GSNKYYADS VKG | RFTISRDNSKNTLYLLMNSL RAEDTAVYYCAR | DRDYNCSSSC-----PYYYYGMDV | WGQGT TVTVS S |
| | Germline | | | | | | | |
| | VH2|2-05/D1|1-1|RF1/JH3 | | | | | | | |
| iPS:4 21-225_62E3 36878 | VH2|2-05/D1|1-1|RF1/JH 3 | QITLKES-GPTLVKPTQTLTL TCTFSG-FSLS | TS----GVGVG | WIRQPPGK ALEWLA | LINW----NDDKRYSPS LKS | RFTITRDTSKDQVVLTMTNM DPVDTATYYCAH | KATWV-------AFDI | WGQGT MVTVS S |
| iPS:4 21-225_62E8 36880 | VH2|2-05/D1|1-1|RF1/JH 3 | QITLKES-GPTLVKPTQTLTL TCTFSG-FSLS | TS----GVGVG | WIRQPPGK ALEWLA | LINW----NDDKRYSPS LKS | RFTITRDTSKDQVVLTMTNM DPVDTATYYCAH | KATWV-------AFDI | WGQGT MVTVS S |
| iPS:4 21-225_62D10 36882 | VH2|2-05/D1|1-1|RF1/JH 3 | QITLKES-GPTLVKSTQTLTL TCTFSG-FSLS | TS----GVGVG | WIRQPPGK ALEWLA | LINW----NDDKRYSPS LKS | RFTITRDTSKDQVVLTMTNM DPVDTATYYCAH | KATWV-------AFDI | WGQGT MVTVS S |
| iPS:4 21-225_62A12 36884 | VH2|2-05/D1|1-1|RF1/JH 3 | QITLKES-GPTLVKPTQTLTL TCTFSG-FSLS | TS----GVGVG | WIRQPPGK ALEWLA | LINW----NDDKRYSPS LKS | RFTITRDTSKDQVVLTMTNM DPLDTATYYCAH | KITWV-------AFDI | WGQGT MVTVS S |

FIGURE 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 36886 | 21-225_62B12 | VH2|2-05|D1|1-1|RF1|JH3 | QITLKES-GPTLVKPTQILTL TCTFSG-FSLN | TS-----GVGVG | WIRQPPGK ALEWLA | LINW------NDDKRYSPS LKS | RFTITRDTSKDQVVLIMTNM DPVDTATYYCAH | KATWV-----------AFDI | WGQGT MVTVS S |
| iPS:4 36894 | 21-225_66G9 | VH2|2-05|D1|1-1|RF1|JH3 | QITLKES-GPTLVKPTQTLTL TCTFSG-FSLS | TS-----GVGVG | WIRQPPGK ALEWLA | LINW------NDDKRFSPS LKS | RFTITRDTSKDQVVLIMTNM DPVDTATYYCAH | KATWV-----------AFDI | WGQGT MVTVS S |
| iPS:4 36908 | 21-225_72D5 | VH2|2-05|D1|1-1|RF1|JH3 | QITLKES-GPTLVKPTQILTL TCTFSG-FSLS | TS-----GVGVG | WIRQPPGK ALEWLA | LINW------NDDKRYSPS LKS | RFTITRDTSKDQVVPIMTNM DPVDTGTYYCAH | KATWV-----------AFDI | WGQGT MVTVS S |
| iPS:4 36912 | 21-225_73C4 | VH2|2-05|D1|1-1|RF1|JH3 | QITLKES-GPTLVKPTQILTL TCTFSG-FSLS | TS-----GVGVG | WIRQPPGK ALEWLA | LINW------NDDKRYSPS LKS | RFTITRDTSKDQVVLIMTNM DPVDTATYYCAH | KTTWV-----------AFDI | WGQGT MVTVS S |
| | | Germline | H_FR1 | H_CDR1 | H_FR2 | H_CDR2 | H_FR3 | H_CDR3 | H_FR4 |
| VH3|3-48|D4|4-11|RF2|JH3 | | | | | | | | | |
| iPS:4 36888 | 21-225_63G7 | VH3|3-48|D4|4-11|RF2|JH3 | EVQLVES-GGGLVQPGGSLRL SCAASG-FTFS | S------YSMN | WVRQAPGK GLEWVS | YISSS-----TSTIYYAAS VKG | RFTISRDNAKNSLYLQMNSL RDEDTAVYYCAR | DHRYDSSG--------YYSDAFDI | WGQGT MVTVS S |
| iPS:4 36890 | 21-225_63A10 | VH3|3-48|D4|4-11|RF2|JH3 | EVQLVES-GGGLVQPGGSLRL SCAASG-FTFS | S------YSMN | WVRQAPGK GLEWVS | YISSS-----TSTIYYAAS VKG | RFTISRCNAKNSLYLQMNSL RDEDTAVYYCAR | DHRYDSSG--------YYSDAFDI | WGQGT MVTVS S |
| | | Germline | H_FR1 | H_CDR1 | H_FR2 | H_CDR2 | H_FR3 | H_CDR3 | H_FR4 |
| VH1|1-02|D3|3-22|RF2|JH3 | | | | | | | | | |
| iPS:4 36892 | 21-225_65E9 | VH1|1-02|D3|3-22|RF2|JH3 | QVQLVQS-GAEVKKPGASVKV SCKASG-YTFT | G------YYMH | WVRQAPGQ GLEWMG | WINPN-----SGGTNYAQK FQG | RVTMTRDTSISTAYMELSRL RSEDTAVYYCAR | AYYYGSGS--------YYNEFDM | WGQGT MVTVS S |
| iPS:4 36900 | 21-225_69B9 | VH1|1-02|D3|3-22|RF2|JH3 | QVQMVQS-GDEVKKPGASVKV SCKASG-YTFT | G------YHMH | WVRQAPGQ GLEWMG | WINPN-----SGGTNYAQK FQG | RVTMTRDTSISTAYMELSRM RSEDTAVYYCAR | AYYYGSGS--------YYNESDM | WGQGT MVTVS S |
| | | Germline | H_FR1 | H_CDR1 | H_FR2 | H_CDR2 | H_FR3 | H_CDR3 | H_FR4 |
| VH6|6-01|D4|4-17|RF2|JH6 | | | | | | | | | |
| iPS:4 36898 | 21-225_68D8 | VH6|6-01|D4|4-17|RF2|JH6 | QVQLQES-GPGLVKPSQTLSL TCAISG-DSVS | SN-----SAAWN | WIRQSPSR GLEWLG | RTYYR-----SECINDYAV SVQS | RITINPDTSKNQFSLHLNSV TPEDTAVYYCAR | DRGHRG----------FYGMDV | WGQGT TVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3J3-33/D7/7-27/RF1/JH3 | | QVQLVES-SGGVVQPGRSLRL SCAASG-FTFS | Y------YGMH | WVRQAPGK GLEWVA | VTTYD---GSNKYYADS VKG | RFTSSRDNSKNTLYLQMNSL RAEDTAVYHCAR | ETGTW------AFDI | WGQGT MVTVS L |
| iPS:4 36910 | 21-225_73G1 | | | | | | | |
| | Germline | H_FR1 | H_CDR1 | H_FR2 | H_CDR2 | H_FR3 | H_CDR3 | H_FR4 |
| VH4J4-30.1/D2/2-15/RF3/JH4 | | QVQLQES-GFGLVKPSQTLSL TCTVSG-GSIR | SG-----GYYWS | WIRQHPGK GLEWIG | YIYY----SGSTYYNPS LRS | RASISVDTSKNQFSLKLSSV TAADTAVYYCAR | DSPVA------GTDY | WGQGT LVTVS S |
| iPS:4 36920 | 21-225_74E5 | | | | | | | |
| iPS:4 37012 | 21-225_192G7 | VH4J4-30.1/D2/2-15/RF3/JH4 | QVQLQES-GFGLVKPSQTLSL TCTVSG-GSIS | SG-----GYYWS | WIRQHPGK GLEWIG | YIYY----RGSTYYNPS LKS | RVTISVDTSKNQFSLKLNSV TAADTAVYYCAR | DSPVT------GFDY | WGQGT LVTVS S |
| | Germline | H_FR1 | H_CDR1 | H_FR2 | H_CDR2 | H_FR3 | H_CDR3 | H_FR4 |
| iPS:4 36942 | 21-225_146H8 | VH1J1-08/D5/5-12/RF3/JH6 | QVQLVQS-GAEVKRPGASVKV SCKASG-YTFI | S------YDIN | WVRQATGQ GLEWMG | WMNPN---SGNTGYAQK FQG | RVTMIRNISKSIAIMELSSL RSEDTAVYYCAR | GDYYYDSSGHQ---PYYYYGMDV | WGQGT TVTVS S |
| | Germline | H_FR1 | H_CDR1 | H_FR2 | H_CDR2 | H_FR3 | H_CDR3 | H_FR4 |
| iPS:4 36944 | 21-225_182D12 | VH2J2-05/D6/6-6/RF3/JH4 | QITLKES-GPTLVKPTQPLTL TCTFSG-FSLS | TT-----GVGVG | WIRQPPGK ALEWLG | ILFW----NDDERYSPS LKS | RLTITHDTSKNQVVLTMTNM DPVDTAFYCAH | KSQLV------YFDY | WGQGT LVTVS S |
| | Germline | H_FR1 | H_CDR1 | H_FR2 | H_CDR2 | H_FR3 | H_CDR3 | H_FR4 |
| iPS:4 36958 | 21-225_190D1 | VH4J4-30.1/D2/2-8/RF3/JH4 | QVQLQES-GFGLVKPSQTLSL TCTVSG-GSIS | SG-----GYYWS | WIRQHPGK GLEWIG | YIYY----SGSTYYNPS LKS | RVTISVDTSKNQFSLKLSSV TAADTAVYYCAR | DSPLR------GFDY | WGQGT LVTVS S |
| | Germline | | | | | | | |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| | VH6J6-01D4J4-17/RF2/JH4 | | | | | | | |
| iPS:4 36962 | 21-225_190H1 | VH6J6-01/D4J4-17/RF2/JH4 | QVQLQQS-GPGLVKPSQTLSLTCDISG-DSVS | RK----SATWN | WIRQSPSR GLEWLG | RTYYR--SKWYNDYAV SVKS | RITINPDISKNQFSLQLNSV TPEDTAVYYCAR | DPGG----------LFDY | WGQGT LVTVS S |
| iPS:4 36978 | 21-225_190G9 | VH6J6-01/D4J4-17/RF2/JH4 | QVQLQQS-GPGLVKPSQTLSLTCAISG-DSVS | RK----SATWN | WIRQSPSR GLEWLG | RTYYR--SKWYNDYAV SVKS | RITINPDISKNQFSLQLNSV TPEDTAVYYCAR | DPGG----------LFDY | WGQGT LVTVS S |
| iPS:4 37070 | 21-225_201G11 | VH6J6-01/D4J4-17/RF2/JH4 | QVQLQQS-GPGLVKPSQTLSLTCAISG-DSVS | RI----NPTWN | WIRQSPSR GLEWLG | RTYYR--SKWYHVYAV SVKS | RITINPDISKNQFSLQLNSV TPEDTAVYYCAR | DPGG----------LFDY | WGQGT LVTVS S |
| iPS:4 37076 | 21-225_203G6 | VH6J6-01/D4J4-17/RF2/JH4 | QVQLQQS-GPGLVKPSQTLSLTCAISG-DSVS | RT----NPTWN | WIRQSPSR GLEWLG | RTYYR--SKWYHVYAL SVKS | RITITPDISKNQFSLQLNSV TPEDTAVYYCAR | DPGG----------LFDY | WGQGT LVTVS S |
| Germline | | H_FR1 | H_CDR1 | H_FR2 | H_CDR2 | H_FR3 | H_CDR3 | H_FR4 |
| | VH3J3-33D1J1-7/RF3/JH6 | | | | | | | |
| iPS:4 36964 | 21-225_190B3 | VH3J3-33/D1J1-7/RF3/JH6 | QVQLVES-GGGVVQPGRSLRLSCAASG-FTFN | N-----YGIH | WVRQAPGK GLEWVA | VIWFD---GONKYYADS VKG | RFTISRDNSKNTLYLQMNSL RAEDTAVYYCAR | DNWNYGDH--------YYIFGMDV | WGQGT TVTVS S |
| iPS:4 36970 | 21-225_190B8 | VH3J3-33/D1J1-7/RF3/JH6 | QVQLVES-GGGVVQPGRSLRLSCAASG-FTFS | S-----YGMH | WVRQAPGK GLEWVA | VIWFD---GSNKYYTDS VKG | RFTISRDNSKNTLYLQMNSL RAEDTAVYYCAR | DNWNYGDY--------YYYYGMDV | WGQGT TVTVS S |
| iPS:4 36980 | 21-225_190C10 | VH3J3-33/D1J1-7/RF3/JH6 | QVQLVES-GGGVVQPGRSLRLSCAASG-FTLS | N-----YGMH | WVRQAPGK GLEWVA | VIWFG---GDNKYYADS VRG | RFTISRDNSKNTLYLQMNSL RAEDTAVYYCAR | DNWNYGDH--------YYYYGMDV | WGQGT TVTVS S |
| iPS:4 36992 | 21-225_191B8 | VH3J3-33/D1J1-7/RF3/JH6 | QVQLVES-GGGVVQPGRSLRLSCAASG-FTLS | S-----YGMH | WVRQAPGK GLEWVA | VIWFD---GSNKYYADS VKG | RFTISRDNSKNTLYLQMNSL RAEDTAVYYCAR | DNWNYGDH--------YYYYGMDV | WGQGT TVTVS S |
| iPS:4 36994 | 21-225_191A9 | VH3J3-33/D1J1-7/RF3/JH6 | QVQLVES-GGGVVQPGRSLRLSCAASG-FTLS | N-----YGMH | WVRQAPGK GLEWVA | VIWFG---GDNKYYADS VKG | RFTISRDNSKNTLYLQMNSL RAEDTAVYYCAR | DNWNYGDH--------YYYYGMDV | WGQGT TVTVS S |
| Germline | | H_FR1 | H_CDR1 | H_FR2 | H_CDR2 | H_FR3 | H_CDR3 | H_FR4 |
| | VH4J4-30.1D4J4-11/RF2/JH6 | | | | | | | |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36984 | 21-225_190F10 | VH4J4-30.1/D4J4-11/RF2/JH6 | QVQLQES-GPGLVKPSQTLSL TCTVSG-GSIR | SG----GDYWS | WIRQHPGE GLEWIG | YIYY----SGITYYNPS LKS | RVTISVDTSKNQFSLKLSSV TAADTAVYYCAR | DSSSR-------GMDV | WGQGT TVTVS S |
| iPS:4 36988 | 21-225_191A2 | VH4J4-30.1/D4J4-11/RF2/JH6 | QVQLQES-GPGLVKPSQTLSL TCTVSG-GSIS | SG----GDYWS | WIRQHPGK GLEWIG | YIYY----SGTYYNPS LKS | RVTISVDTSKNQFSLKLSSV TAADTAVYYCAR | DSSSR-------GMDV | WGQGT TVTVS S |
| iPS:4 37014 | 21-225_192H8 | VH4J4-30.1/D4J4-11/RF2/JH6 | QVQLQES-GPGLVKPSQTLSL TCTVSG-GSIS | SG----GDYWS | WIRQHPGK GLEWIG | YIYY----SGTYYNPS LKS | RLTMSAGTSKNQFSLKLSSV TAADTAVYYCAR | DSSLY-------GMDV | WGQGT TVTVS S |
| iPS:4 37022 | 21-225_194G5 | VH4J4-30.1/D4J4-11/RF2/JH6 | QVQLQES-GPGLVKPSQTLSL TCTVSG-GSIR | SG----GDYWS | WIRQHPGE GLEWIG | YIYY----SGTYYNPS LKS | RVTISVDTSKNQFSLKLSSV TAADTAVYYCAR | DHSLN-------GMDV | WGQGT TVTVS S |
| iPS:4 37026 | 21-225_194D12 | VH4J4-30.1/D4J4-11/RF2/JH6 | QVQLQES-GPGLVKPSQTLSL TCTVSG-GSIR | SG----GDYWS | WIRQHPGK GLEWIG | YIYY----SGSTYYNPS LKS | RVTISVDTSKNQFSLKLSSV TAADTAVYYCAR | DGARH-------GMDV | WGQGT TVTVS S |
| iPS:4 37056 | 21-225_198B8 | VH4J4-30.1/D4J4-11/RF2/JH6 | QVQLQES-GPGLVKPSQTLSL TCTVSG-GSIR | SG----GDYWS | WIRQHPGK GLEWIG | YIYY----SGSTYYNPS LKS | RVTISVDTSKNQFSLKLSSV TAADTAVYYCAR | DSSSR-------GMDV | WGQGT TVTVS S |
| iPS:4 37124 | 21-225_212H12 | VH4J4-30.1/D4J4-11/RF2/JH6 | QVQLQES-GPGLVKPSQTLSL TCTVSG-GSIR | SG----GDYWS | WIRQHPGK GLEWIG | YIYY----SGSTKYNPS LKS | RVTISVDTSKNQFSLKLSSV TAADTAVYYCAR | DSSSY-------GMDV | WGQGT TVTVS S |
| iPS:4 37136 | 21-225_214H3 | VH4J4-30.1/D4J4-11/RF2/JH6 | QVQLQES-GPGLVKPSQTLSL TCTVSG-GSIR | SG----GDYWS | WIRQHPGK GLEWIG | YIYY----SGSTYYNPS LKS | RVTISGDTSKNQFSLKLSSV TAADTAVYYCAR | DSSSY-------GMDV | WGQGT TVTVS S |
| | Germline VH4J4-59/D1/1-26/RF1/JH4 | H_FR1 | H_CDR1 | H_FR2 | H_CDR2 | H_FR3 | H_CDR3 | H_FR4 |
| iPS:4 36886 | 21-225_191A1 | VH4J4-59/D1/1-26/RF1/JH4 | QVQLQES-GPGLVKPSEILSL TCTVSG-GSIR | S------YYWI | WIRQPPGK GLEWIG | YIYY----SGSTYKNPS LKS | RVTISVDTSKNQFSLKLSSV TAADTAVYYCAR | KGVGT-------IHFDY | WGQGI LVTVS S |
| iPS:4 37064 | 21-225_200G8 | VH4J4-59/D1/1-26/RF1/JH4 | QVQLQES-GPGLVKPSEILSL TCTVSG-GSIR | S------YYWS | WIRQPPGK GLEWIG | YIYY----SGSTYYNPS LKS | RVTISVDTSKNQFSLKLSSV TAADTAVYYCAR | KGVGT-------IHFDY | WGQGI LVTVS S |
| | Germline VH3J3-30/D6/6-6/RF1/JH4 | H_FR1 | H_CDR1 | H_FR2 | H_CDR2 | H_FR3 | H_CDR3 | H_FR4 |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36996 | 21-225_191B9 | VH3|3-30|D6|6-6|RF1|JH4 | QVQLVES- GGGVVQPGRSLRL SCAASG-FTFS | F------HGMH | WVRQAPGK GLEWVA | VIWYD---- GSKKYYADS VKG | RFTISRDNSKNTLHLQMNSL RAEDTAVYYCAR | EGYSSGP------ ------YRGFDN | WGQGT LVTVS S |
| iPS:4 37054 | 21-225_194G3 | VH3|3-30|D6|6-6|RF1|JH4 | QVQLVES- GGGVVQPGRSLRL SCAASG-FTFS | F------HGMH | WVRQAPGK GLEWVA | VIWYD---- GSKKYYADS VKG | RFTISRDNSKNTLHLQMNSL RAEDTAVYYCAR | EGFSSGP------ ------YRGFDN | WGQGT LVTVS S |
| | Germline VH3|3-33|D1|1-26|RF1|JH6 | | | | | | H_CDR3 | H_FR4 |
| iPS:4 37000 | 21-225_191G9 | VH3|3-33|D1|1-26|RF1|JH6 | QVQLVES- GGGVVQPGRSLRL SCAASG-FTFS | T------YGMH | WVRQAPGK GLEWVT | LIWFD---- GSNKYYADS VKG | RFTISRDNSKNTLYLQMNSL RAEDTAVYYCAR | DRVGGTSPP---- ----YYYYGMDV | WGQGT TVTVS S |
| iPS:3 93192 | 21-225_12B1 | VH3|3-33|D1|1-26|RF1|JH6 | QVQLVES- GGGVVQPGRSLRL SCAASG-FTFS | S------YGMH | WVRQAPGK GLEWVA | VIWND---- GSNKYYADS VKG | RFTISRDNSKNTLYLQMNSL RAEDTAVYYCAR | DRVAAAGTP---- ----YYYYGMDV | WGQGT TVTVS S |
| | Germline VH1|1-02|D3|3-10|RF2|JH5 | | | | | | H_CDR3 | H_FR4 |
| iPS:4 37002 | 21-225_191H9 | VH1|1-02|D3|3-10|RF2|JH5 | QVQLVQS- GAEVKKPGASVKV SCKVSG-YTFT | G------YNMH | WVRQAPGQ GLEWMG | WINPN---- SGGTNYAHK FQG | RVTMTRDTSISTAYMELSRL RSDDTAVYYCAR | DFYDSGG------ ------EGWFDP | WGQGT LVTVS S |
| | Germline VH4|4-30.4|D2|2-8|RF3|JH6 | | | | | | H_CDR3 | H_FR4 |
| iPS:4 37008 | 21-225_192E3 | VH4|4-30.4|D2|2-8|RF3|JH6 | QVQLQES- GPGLVKPSQTLSL TCTVSG-GSIS | SG----GYYWS | WIRQPPGK GLEWIG | YIYY----- TGSTYNPS LKS | RVTISVDTSKNQFSLKLSSV TAADTAVYYCAR | DDPLY-------- ----------GMDV | WGQGT TVTVS S |
| iPS:4 37048 | 21-225_197B11 | VH4|4-30.4|D2|2-8|RF3|JH6 | QVQLQES- GPGLVKPSQTLSL TCTVSG-GSIS | SG----GYYWS | WIRQPPGK GLEWIG | YIYY----- TGSTYNPS LKS | RVTISVDTSKNQFSLKLSSV TAADTAVYYCAR | DDPLY-------- ----------GMDV | WGQGT TVTVS S |
| | Germline VH4|4-59|D7|7-27|RF3|JH4 | | | | | | H_CDR3 | H_FR4 |
| iPS:4 37010 | 21-225_192G3 | VH4|4-59|D7|7-27|RF3|JH4 | QVQLQES- GPGLVKPSETLSL TCTVSG-GSIS | N------YYWS | WIRQPAGK GLEWIG | RIYS----- SGSTNYNPS LKS | RVTMSVDTSKNQFSLKLMSV TAADTAVYYCAR | GWE---------- -----------LNY | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 37016 | 21-225_193A6 VH4/4-59/D7/7-27/RF3/JH4 | QVQLQES-GPGLVKPSETLSL TCTVSG-GSIS | S------YYMS | WIRQPPGK GLEWIG | YIIY------ SGSTYNPS LKS | RVTISVDISKNQFSLKLSSV TAADTAVYYCAG | GWE----------LNY | WGQGT LVTVS S |
| | Germline VH3/3-15D4/4-17/RF2/JH4 | | | | | | | H_FR4 |
| iPS:4 37018 | 21-225_193H5 VH3/3-15D4/4-17/RF2/JH4 | EVQLVES-GGGLVKPGGSLSL SCAASG-FTFS | N------AYMT | WVRQAPGK GLEWVG | RIKSKT-DGGTTDYAA PVKG | REFTISRDGSKNTLYLQMNSL NTEDTAVYYCTT | DPGG----------IFDY | WGQGT LVTVS S |
| iPS:4 37144 | 21-225_215B3 VH3/3-15D4/4-17/RF2/JH4 | EVQLVES-GGGLVKPGGSLRL SCAASG-FTFS | N------AWMH | KVRQAPGK GLEWVG | RIKSKT-NGGTTDYAA PVKG | REFTISRDGSKNTLVLQMNSL KTEDTAVYYCTT | DPGG----------IFDY | WGQGT LVTVS S |
| | Germline VH3/3-11/D3/3-9/RF1/JH4 | | | | | | | H_FR4 |
| iPS:4 37030 | 21-225_195E3 VH3/3-11/D3/3-9/RF1/JH4 | QVQLVES-GGGLVKPGGSLRL SCAASG-FTFS | D------YYMS | WIRQAPGK GLEWVS | YIISS------ GNTIYYADS VKG | REFTISRDNAKNSLYLQMNSL RAEDTAVYYCAR | DSRYF----------DWFDY | WGQGT LVTVS S |
| | Germline VH3/3-11/D3/3-9/RF1/JH4 | | | | | | | H_FR4 |
| iPS:4 37032 | 21-225_195H6 VH4/4-59/D7/7-27/RF3/JH1 | QVQLQES-GPGLVKPSETLSL TCTVSG-GSIS | N------YYMS | WIRQPAGK GLEWIG | RIYS------ SGSTNYNPS LKS | RVSMSVDISKNQFSLKLSSV TAADTAVYYCTR | GWE----------LNN | WGQGT LVTVS S |
| | Germline VH4/4-59/D6/6-6/RF1/JH6 | | | | | | | H_FR4 |
| iPS:4 37044 | 21-225_197F9 VH4/4-59/D6/6-6/RF1/JH6 | QVQLQES-GPGLVKPSETLSL TCTVSG-GSIR | I------YYMS | WIRQPPGK GLEWIG | YVVY------ SGSTTYNPS LKS | RVTISVDTSKNQFSLKLNSV TAADTAVYYCAR | ERGSSHW-------------GDYYGMDV | WGRGT TVTVS S |
| iPS:4 37060 | 21-225_199C3 VH4/4-59/D6/6-6/RF1/JH6 | QVQLQES-GPGLVKPSETLSL TCTVSG-GSIR | I------YYMS | WIRQTPGK GLEWIG | YIVY------ SGSTTYNPS LKS | RVTISVDTSKNQFSLKLNSV TAADTAVYYCVR | ERGSSHW-------------GDYYGMDV | WGRGT TVTVS S |
| | Germline VH3/3-30/D6/6-6/RF1/JH1 | | | | | | | H_FR4 |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 37058 | 21-225_199F3 | VH3|3-30|D6|6-6|RF1|JH1 | QVQLVES-GGGVVQPGRSLRL SCAASG-FTFS | F-------YGMH | WVRQAPGK GLEWVA | VIWYD----GSSKYYADS VKG | RFTVSRDNSKNTLYLQMNSL RAEDTAVYYCAR | EGYSSGF-------YRGFAN | WGQGT LVTVS S |
| | Germline | VH4|4-30.1|D6|6-6|RF2|JH6 | | | | | | | |
| iPS:4 37062 | 21-225_200H1 | VH4|4-30.1|D6|6-6|RF2|JH6 | QVQLQES-GPGLVKPSQTLSL TCTVSG-GSIS | SG-----GDYWS | WIRQHPGK GLEWIG | YIYY----SGSTYYNPS LKS | RVTISVDTSKNQFSLKLNSV TAADTAVYYCAR | DGAAL-------GMDV | WGQGT TVTVS S |
| iPS:4 37066 | 21-225_200G9 | VH4|4-30.1|D6|6-6|RF2|JH6 | QVQLQES-GPGLVKPSQTLSL TCTVSG-GSIS | SG-----GDYWS | WIRQHPGK GLEWIG | YIYY----SGSTYYNPS LKS | RVTISVDTSKNQFSLKLNSV TAADTAVYYCAR | DGAAL-------GMDV | WGQGT TVTVS S |
| iPS:4 37068 | 21-225_200A11 | VH4|4-30.1|D6|6-6|RF2|JH6 | QVQLQES-GPGLVKPSQTLSL TCTVSG-GSIS | SG-----GDYWS | WIRQHPGK GLEWIG | YIYY----RGSTYYNPS LKS | RVTISVDTSKNQFSLKLSSV TAADTAVYYCAR | DAAAH-------GMDV | WGQGT TVTVS S |
| iPS:4 37140 | 21-225_214E12 | VH4|4-30.1|D6|6-6|RF2|JH6 | QVQLQES-GPGLVKPSQTLSL TCTVSG-GSIS | SG-----GDYWS | WIRQHPGK GLEWIG | YIYY----SGPTYYNPS LKS | RVTISVDTSKNQFSLKLSSV TAADTAVYYCAR | DGAAE-------GMDV | WGQGT TVTVS S |
| iPS:4 37158 | 21-225_216H11 | VH4|4-30.1|D6|6-6|RF2|JH6 | QVQLQES-GPGLVKPSQTLSL TCTVSG-GSIS | SG-----GDYWS | WIRQHPGK GLEWIG | YIYY----SGPTYYNPS LKS | RVTISVDTSKNQFSLKLSSV TAADTAVYYCAR | DGAAE-------GLDV | WGQGT TVTVS S |
| | Germline | VH3|3-33|D1|1-26|RF3|JH3 | | | | | | | |
| iPS:4 37074 | 21-225_203B2 | VH3|3-33|D1|1-26|RF3|JH3 | QVQLVES-GGGVVQPGRSLRL SCAASG-FTFS | N-------YGMH | WVRQAPGK GLEWVA | IIWFD----GSNEYYADS VKG | RFTISRDNSMSTLYLQMNSL RAEDTAVYYCAR | ESGGY-------ALYI | WGQGT MVTVS S |
| iPS:4 37082 | 21-225_205E12 | VH3|3-33|D1|1-26|RF3|JH3 | QVQLVES-GGGVVQPGRSLRL SCAASG-FTFS | N-------YGMH | WVRQAPGK GLEWVA | IIWFD----GSNEYYADS VKG | RFTISRDNSMSTLYLQMNSL RAEDTAVYYCAR | ESGGY-------ALYI | WGQGT MVTVS S |
| | Germline | VH3|3-48|D4|4-17|RF2|JH4 | | | | | | | |
| iPS:4 37086 | 21-225_209A8 | VH3|3-48|D4|4-17|RF2|JH4 | EVQLVES-GGGLVQPGGSLRL SCAASG-FTFR | S-------YSMN | WVRQAPGK GLEWVL | YISSS----SSIKKYADS VKG | RFTISRDNAKNSLYLQMNSL RDEDTAVYYCVR | DDGSY-------YFDY | WGQGT LVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4-4 30.1/D2/2-8/RF3/JH6 | | QVQLQES GPGLVKPSQTLSL TCTVSG-GSIS | SG----TYWS | WIRQHPGK GLEWIG | YIYY---- SGSTYNPS LKS | RVTISVDTSTNHFSLKLSSV TAADTAVYYCAR | DRPLIYYGMDV | WGQGT TVTVS S |
| iPS:4-37090 21-225_210F11 | VH4-30.1/D2[2-8]RF3/JH6 | QVQLQES- GPGLVKPSQTLSL TCTVSG-GSIS | SG----GSYWS | WIRQHPGK GLEWIG | YIYY---- IGTTYNPS LKS | RVTISVDTSTNHFSLKLSSV TAADTAVYYCAR | DRPLT-------GMDV | WGQGT TVTVS S |
| iPS:4-37106 21-225_211H7 | VH4-30.1/D2[2-8]RF3/JH6 | QVQLQES- GPGLVKPSQTLSL TCTVSG-GSIS | SG----GYYWS | WIRQHPGK GLEWIG | YIYY---- VGSTYNPS LKS | RVTISVDTSKNQFSLKLSSV TAADTAVYYCAR | DGPLS-------GMDV | WGQGT TVTVS S |
| VH3-30.3/D4[4-17]RF2/JH5 | | QVQLVES GGGVVQPGRSLRL SCAASG-FTFS | S-----YAMH | WVRQAPGK GLEWVS | VISYD--- GSNKYADS VKG | RFTISRDNSKNTLYLQMNSL RAEDTAVYYCAR | DIGDIYWFDP | WGQGT TVTVS S |
| iPS:4-37100 21-225_211H2 | VH3-30.3/D4[4-17]RF2/JH5 | QVQLVES- GGGVVQPGRSLRL SCAASG-FTFS | S-----YAMH | WVRQAPGK GLEWVA | VIWYD--- GSNKYYADS VKG | RFTIARDNSKNTLYLQMNSL RAEDTAVYYCAR | DPGSY-------GFDP | WGQGT LVTVS S |
| VH3-33/D5[5-12]RF3/JH6 | | QVQLVES GGGVVQPGRSLRL SCAASG-FTFS | N-----YGMH | WVRQAPGK GLEWVA | VIWYD--- GSNKYADS VKG | RFTISRDNSKNTLYLQMNSL RAEDTAVYYCAR | GYSGYYYY YYGMDV | WGQGT TVTVS S |
| iPS:4-37102 21-225_211E5 | VH3-33/D5[5-12]RF3/JH6 | QVQLVES- GGGVVQPGRSLRL SCAASG-FTFS | N-----YGMH | WVRQAPGK GLEWVS | IIWFD--- GSDQYYADS VKG | RFTISRDNSKNTLYLQMNSL RAEDTAVYYCAR | GLSVYY------YGMGV | WGQGT TVTVS S |
| iPS:4-37164 21-225_217C6 | VH3-33/D5[5-12]RF3/JH6 | QVQLVES- GGGVVQPGRSLRL SCAASG-FTFS | N-----YGMH | WVRQAPGK GLEWMA | IIWFD--- GSDEYYADS VKG | RFTISRDNSKNIMYLQMNSL RAEDTAVYYCAR | GLSVYY------YGMDV | WGQGT TVTVS S |
| iPS:4-37166 21-225_217G11 | VH3-33/D5[5-12]RF3/JH6 | QVQLVES- GGGVVQPGRSLRL SCAASG-FTFR | N-----YGMH | WVRQAPGK GLEWVS | IIWFD--- GSDQYYADS VKG | RFTISRDNSKNTLYLQMNSL RAEDTAVYYCAR | GLSVYY------YGMDV | WGQGT TVTVS S |
| iPS:4-37170 21-225_218E5 | VH3-33/D5[5-12]RF3/JH6 | QVQLVES- GGGVVQPGRSLRL SCAASG-FTFS | N-----YGMH | WVRQAPGK GLEWMA | IIWFD--- GSDEYYADS VKG | RFTISRDNSKNTLYLQMNSL RAEDTAVYYCAR | GLSVYY------YGMDV | WGQGT TVTVS S |
| VH4-4 30.1/D6[6-19]RF2/JH6 | | QVQLQES GPGLVKPSQTLSL TCTVSG-GSIS | SG----GSYWS | WIRQHPGK GLEWIG | YIYY---- SGSTYNPS LKS | RVTISVDTSKNQFSLKLSSV TAADTAVYYCAR | GYSGYYY YYGMDV | WGQGT TVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 37108 | 21-225_211C9 | VH4/4-30.1/D6/6-19/RF2/J H6 | QVQLQES-GPGLVKPSQTLSL TCTVSG-GSIR | SG----GDYWS | WIRQHPGK GLEWIG | YIYY----SGSTYYNPS LKS | RVTILLDTSKNQFSLKLSSV TVADTAVYYCAR | DSAVY-------NMDV | WGQGT TVTVS S |
| iPS:4 37110 | 21-225_211E9 | VH4/4-30.1/D6/6-19/RF2/J H6 | QVQLQES-GPGLVKPSQTLSL TCTVSG-GSIR | SG----GDYWS | WIRQHPGK GLEWIG | YIYY----TGSNYYNPS LKS | RVTISVDTSKNQFSLNLISV TAADTAVYYCAR | DSAVY-------GMDV | WGQGT TVTVS S |
| iPS:4 37120 | 21-225_212A9 | VH4/4-30.1/D6/6-19/RF2/J H6 | QVQLQES-GPGLVKPSQTLSL TCTVSG-GSIR | SG----GDYWS | WIRQHPGK GLEWIG | YMYY----SGSTYYNPS LKS | RVTISVDTSKNQFSLKLSSV TVADTAVYYCAR | DSAVY-------GMDV | WGQGT TVTVS S |
| iPS:4 37132 | 21-225_213F5 | VH4/4-30.1/D6/6-19/RF2/J H6 | QVQLQES-GPGLVKPSQTLSL TCTVSG-GSIR | SG----GDYWS | WIRQHPGK GLEWIG | YIYY----SGSTYYNPS LKS | RVTISLDTSKNQFSLKLSSV TVADTAVYYCAR | DSAVY-------NMDV | WGQGT TVTVS S |
| iPS:4 37142 | 21-225_215A3 | VH4/4-30.1/D6/6-19/RF2/J H6 | QVQLQES-GPGLVKPSQTLSL TCTVSG-GSIR | SG----GDYWS | WIRQHPGK GLEWIG | YIYY----TGSNYYNPS LKS | RVTISVDTSKNQFSLKVISV TAADTAVYYCAR | DSAVY-------GMDV | WGQGT TVTVS S |
| iPS:4 37148 | 21-225_215H3 | VH4/4-30.1/D6/6-19/RF2/J H6 | QVQLQES-GPGLVKPSQTLSL TCSVSG-GSIR | SG----GDYWS | WIRQHPGK GLEWIG | YMYY----SGSTYYNPS LKS | RVTISVDTSKNQFSLKLSSV TVADTAVYYCAR | DSAVY-------GMDV | WGQGT TVTVS S |
| iPS:4 37154 | 21-225_216A7 | VH4/4-30.1/D6/6-19/RF2/J H6 | QVQLQES-GPGLVKPSQTLSL TCTVSG-GSIR | SG----GDYWS | WIRQHPGK GLEWIG | YMYY----SGSTYYNPS LKS | RVTISVDTSKNQFSLKLSSV TVADTAVYYCAR | DSAVY-------GMDV | WGQGT TVTVS S |
| | Germline VH3/3-30.3/D7/7-27/RF2/JH4 | | | | H_FR1 | H_CDR1 | H_FR2 | H_CDR2 | H_FR3 | H_CDR3 | H_FR4 |
| iPS:4 37160 | 21-225_216B12 | VH3/3-30.3/D7/7-27/RF2/J H4 | QVQLVES-GGGVVQPGRSLRL SCAASG-FTFS | S------YAMH | WVRQAPGK GLEWVA | VIWYD----GSNKYADS VKG | RFTISRDNSKNTLYLQMNSL RAEDTAVYYCAR | DLGLG-------YFFDY | WGQGT LVTVS S |
| | Germline VH6/6-01/D2/2-21/RF2/JH5 | | | | H_FR1 | H_CDR1 | H_FR2 | H_CDR2 | H_FR3 | H_CDR3 | H_FR4 |
| iPS:4 37186 | 21-225_224H2 | VH6/6-01/D2/2-21/RF2/J H5 | QVQLQQS-GPGLVKPSQTLSL TCDISG-DSVS | SN----SAAWN | WIRQSPSR GLEWLG | RTYYR--SKWMDYAV SVKS | RVTINPDISKNQFSLQLNSV TPRDTAVYYCAR | EGGLGYCSST----SCYGGMFDP | WGQGT LVTVS S |
| | Germline VH1/1-02/D4/4-17/RF2/JH6 | | | | H_FR1 | H_CDR1 | H_FR2 | H_CDR2 | H_FR3 | H_CDR3 | H_FR4 |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 37188 | 21-225_224B11 | VH1|1-02|D44-17|RF2|JH6 | QVQLVQS-GAEVKKPGASVKV SCKASG-YTFT | G------YYIH | WVRQAPGQ GLEWMG | WINPK----NGGTNYAQK FQG | RVTMTRDASISTTYMELSRL RSDDTAVYYCAR | GAFDYFY------YYAMDV | WGRGT TVTVS S |
| iPS:4 37198 | 21-225_226F8 | VH1|1-02|D44-17|RF2|JH6 | QVQLVQS-GAEVKKPGASVKV SCKASG-YTFT | G------YYIH | WVRQAPGQ GLEWMG | WINPN----SGGTNYARK FQG | RVTMTRDTSISTAYMELSRL RSDDTAVYYCAR | GAFDYY------YYALDV | WGQGT TVTVS S |
| iPS:4 37202 | 21-225_227D3 | VH1|1-02|D44-17|RF2|JH6 | QVQLVQS-GAEVKKPGASVKV SCKASG-YTFT | G------YYMH | WVRQAPGQ GLERMG | WINPK----SGGTNFAQK FQG | RVTMTRDTSISTAYMELSRL RSDDTAVYYCAR | GAFDYFY------YYGMDV | WGQGT TVTVS S |
| iPS:4 37208 | 21-225_227C10 | VH1|1-02|D44-17|RF2|JH6 | QVQLVQS-GAEVKKPGASVKV SCKASG-YTFT | G------YYMH | WVRQAPGQ GLERMG | WINPK----SGGTNYAQK FQG | RVTMTRDTSISTAYMELSRL RSDDTAVYYCAR | GAFDYFY------YYGMDV | WGQGT TVTVS S |
| VH1|3-33|D2|2-21|RF2|JH6 Germline | | | | | | | | |
| iPS:4 37192 | 21-225_225E9 | VH3|3-33|D2|2-21|RF2|JH6 | QVQLVES-GGGLVQPGRSLRL SCEASG-FTFS | S------YGMH | WVRQAPGK GLEWVA | VMWYD-----GGNKDYADS VKG | RFTISRDNSKNTLYLQMNSL RAEDTAVYYCAK | DREYCTSTC------FYYYYGMDV | WGQGT TVTVS S |
| VH3|3-23|D2|2-21|RF2|JH6 Germline | | | | | | | | |
| iPS:4 37204 | 21-225_227E5 | VH3|3-23|D2|2-21|RF2|JH6 | EVQLLES-GGGLVQPEGSLRL SCAASG-FTFS | S------YAMS | WVRQAPGK GLEWVS | AISGS----GGSTYYADS VKG | RFTISRDNSKNTLCLQMNSL RAEDTAVYCAK | EYCGGDCYSP------YYYYYGMDV | WGQGT TVTVS S |
| iPS:3 93196 | 21-225_16G8 | VH3|3-23|D2|2-21|RF2|JH6 | EVQLLES-GGGLVQPEGSLRL SCAASG-FTFS | S------YAMS | WVRQAPGK GLEWVS | GISGS----GGSTYYADS VKG | RFTISRDNSKNTLCLHMNSL RAEDTAVYCAK | EYCGGDCYSP------YYYYYGMDV | WGQGT TVTVS S |
| iPS:3 93202 | 21-225_6B4 | VH3|3-23|D2|2-21|RF2|JH6 | EVQLLES-GGGLVQPEGSLRL SCAASG-FTFS | S------YAMS | WVRQAPGK GLEWVS | AISGS----GGSTYYADS VKG | RFTISRDNSKNTLCLQMNSL RAEDTAVYCAK | EYCGGDCYSP------YYYYYGMDV | WGQGT TVTVS S |
| iPS:3 93345 | 21-225_5G7 | VH3|3-23|D2|2-21|RF2|JH6 | EVQLLES-GGGLVQPEGSLRL SCAASG-FTFS | S------YAMS | WVRQAPGK GLEWVS | AISGS----GGSTYYADS VKG | RFTISRDNSKNTLCLQMNSL RAEDTAVYCAK | EYCGGDCYSP------YYYYYGMDV | WGQGT TVTVS S |
| VH2|2-05|D6|6-13|RF3|JH4 Germline | | | | | | | | |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 21-225_227E12 | VH2|2-05/D6|6-13|RF3|J H4 | QITLKES-GPTLVKPTQTLTL TCFSG-FSLS | TS---GVGVG | WIRQPPGK ALECLS | LIYW----NDDKVYSPS LKS | RLTITKYTSKNQVLTMTNM DPVDTATYCAH | RGQQL-------ALDY | WGQGT LVTVS S |
| iPS:3 21-225_18G5 92587 | VH2|2-05/D6|6-13|RF3|J H4 | QITLKES-GPTLVKPTQTLTL TCFASG-FSLS | TS---GVGVG | WIRQPPGK ALECLS | LIYW----NDDKVYSPS LKS | RLTITKYTSKNQVLTMTNM DFVDTATYCAH | RGQQL-------ALDY | WGQGT LVTVS S |
| iPS:3 21-225_23D7 98504 | VH2|2-05/D6|6-13|RF3|J H4 | QITLKES-GPTLVKPTQTLTL TCFSG-FSLS | TS---GVGVG | WIRQPPGK ALECLS | LIYW----NDDKVYSPS LKS | RLTITKYTSKNQVLTMSNM DPVDTATYCAH | RGQQL-------ALDY | WGQGT LVTVS S |
| VH3|3-21|D4|4-11|RF2|JH6 Germline | | | | | | | | |
| iPS:4 21-225_57C2 37226 | VH3|3-21|D4|4-11|RF2|J H6 | EVQLVES-GGGLVKPGGSLRL SCAASG-FTFS | S----FGMN | WVRQAPGK GLEWVS | SISSS----TGYIYNADS VKG | RFTISRDNAKNSLYLQMNSL RAEDTAVYYCAR | TYSG-------SLDV | WGQGT TVTVS S |
| VH3|3-21|D5|5-18|RF3|JH5 Germline | | | | | | | | |
| iPS:4 21-225_62H10 37230 | VH3|3-21|D5|5-18|RF3|J H5 | EVQLVES-GGGLVKPGGSLRL SCAASG-FTFS | S----YSMN | WVRQAPGK GLEWVS | SISSS----SSYIYYADS VKG | RFTISRDNAKNSLYLQMNSL RAEDTAVYYCAR | GGSR-------GFDP | WGQGT LVTVS S |
| iPS:4 21-225_72G9 48906 | VH3|3-21|D5|5-18|RF3|J H5 | EVQLVES-GGGLVKPGGSLRL SCAASG-FTFS | S----YSMN | WVRQAPGK GLEWVS | SISGS----SSYIYYADS VKG | RFTISRDNAKNSLYLQMNSL RAEDTAVYYCAR | GGSR-------GFDP | WGQGT LVTVS S |
| VH1|1-02|D11|1-26|RF1|JH4 Germline | | | | | | | | |
| iPS:4 21-225_170D1 37260 | VH1|1-02/D11|1-26|RF1|J H4 | QVQLVQS-GAEVKKPGASVKV SCKASG-YTFT | G----YFMH | WVRQAPGQ GLEWMG | WIKPK----SGGINCAQK FQG | RVTMTRDTSSSTAYMELSRL TSDDTAVYYCAR | GGATVTT----WGVEDY | WGQGT LVTVS S |
| VH3|3-33|D2|2-21|RF2|JH6 Germline | | | | | | | | |
| iPS:4 21-225_177D2 37268 | VH3|3-33|D22-21|RF2|J H6 | QVQLVES-GGGVVQPGRSLRL SCAASG-FTFS | S----YGMD | WVRQAPGK GLEWVA | IIWFD----GSNKYYADS VKG | RFTISRDNGKNTLYLQMNSL RAEDTAVYYCAR | AYCGGDCYFP-------ELHYYGMDV | WGQGT TVTVS S |

FIGURE 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| iPS:4 37294 | 21-225_216D5 | VH4/4-30.1/D4/4-17/RF2/J/H4 | QVQLQES-GPGLVKPSQTLSL TCTVSG-GSIS | SG---GYYWS | WIRQHPGK GLEWIG | YIYY----SGSTYYNPS LKS | RVTISVDTSKNQFSLKLNSV TAADTAVYFCAR | DSPDR------GFDY | WGQGT LVTVS S |
| iPS:4 37302 | 21-225_225B11 | VH3/3-30.3/D5/5-24/RF3/J/H6 | QVQLVES-GGGVVQPGRSLRL SCAASG-FTFS | S------YGMH | WVRQAPGK GLEWVT | IISY----GSNKYYADS VKG | RFTISRDNSKNTLYLQMNSL RAEDTAVYYCAR | RGYSYG------GYGMDV | WGQGT TVTVS S |
| iPS:4 51102 | 21-225_45F6 | VH3/3-30.3/D5/5-24/RF3/J/H6 | QVQLVES-GGGVVQPGRSLRL SCAASG-FTFS | I------YGLH | WVRQAPGK GLEWVA | VISYG---GSNKYYADS VKG | RFTISRDNSKNTLYLQMNNL RAEDTAVFYCAR | EDRYCSGTSC-----PYYYYYGMDV | WGQGT TVTVS S |
| iPS:3 92868 | 21-225_24D6 | VH3/3-30.3/D5/5-24/RF3/J/H6 | QVQLVES-GGGVVQPGRSLRL SCAASG-FTFS | S------YGMH | WVRQVPGK GLEWVA | IISY----GSNKSYADS VKG | RFTISRDNSKNTLYLQMNSL RAEDTAVYYCVR | RGYSYG------GYGMDV | WGQGA TVTVS S |
| iPS:3 93910 | 21-225_15F10 | VH3/3-30.3/D5/5-24/RF3/J/H6 | QVQLVES-GGGVVQPGRSLRL SCAASG-FTFS | S------YGMH | WVRQAPGK GLEWVS | VISYG---GSNNYYADS VKG | RFTISRDNSKNTLYLQMNSL RAEDTAVYYCVR | RGYSYG------GYGMDV | WGQGT TVTVS S |
| iPS:3 94000 | 21-225_11A2 | VH3/3-30.3/D5/5-24/RF3/J/H6 | QVQLVES-GGGVVQPGRSLRL SCAASG-FTFS | S------YGMH | WVRQAPGK GLEWVA | VISYG---GSNKDSADS VKG | RFTISRDNSKNTLYLQMNSL RAEDTAVYYCVR | RGYSYG------GYGMDV | WGQGT TVTVS S |
| iPS:3 94004 | 21-225_13A1 | VH3/3-30.3/D5/5-24/RF3/J/H6 | QVQLVES-GGGVVQPGRSLRL SCAASG-FTFS | S------YGMH | WVRQAPGK GLEWVA | VISYA---GTNQYYADS VKG | RFTISRDNSKNTLYLQMNSL RAEDTAVYYCVR | RGYSYG------GYGMDV | WGQGT TVTVS S |
| iPS:3 94006 | 21-225_15C2 | VH3/3-30.3/D5/5-24/RF3/J/H6 | QVQLVES-GGGVVQPGRSLRL SCAASG-FTFS | S------YGMH | WVRQAPGK GLEWVS | IISYG---GRMNHYADS VKG | RFTISRDNSKNTLYLQMNSL RAEDTAVYYCAR | RGYSYG------GYGMDV | WGQGT TVTVS S |
| iPS:3 94029 | 21-225_1B12 | VH3/3-30.3/D5/5-24/RF3/J/H6 | QVQLVES-GGGVVQPGRSLRL SCAASG-FTFS | S------YGMH | WVRQAPGK GLEWVA | IISYA---GSNKSYADS VKG | RFTISRDNSKNMLYLQMNSL RAEDTAVYYCAR | RGYSYG------GYGMDV | WGGGA TVTVS S |
| iPS:3 94047 | 21-225_5E6 | VH3/3-30.3/D5/5-24/RF3/J/H6 | QVQLVES-GGGVVQPGRSLRL SCAASG-FTFS | S------YGMH | WVRQAPGK GLEWVA | IISYV---GNNKYYADS VKG | RFTISRDNSKNTLYLQMNSL RVEDTAVYYCAR | RGYSYG------GYGMDV | WGQGT TVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 94081 | 21-225_16B3 | VH3I3-30.3/D5I5-24/RF3/JH6 | QVQLVES-GGGVVQPGRSLRL SCVASG-FTFS | S------YGMH | WVRQAPGK GLEWVA | VISYA----GINKSYADS VKG | RFTISRDNSMNTLILQMNSL RAEDTAVYYCVR | RGYSYG-------GYGMDV | WGQGA TVTVS S |
| | Germline | | | | | | | | |
| | VH4I4-61/D3I3-9/RF3/JH4 | | | | | | | | |
| iPS:4 51118 | 21-225_191C8 | VH4I4-61/D3I3-9/RF1/JH4 | QVQLQES-GPGLVKPSETLSL TCTVSS-GSVS | SG---GYMS | WIRQPPGK GLEWIG | YIYY-----SGGTYNFS LKS | RVTISVDTSKNQFSLKLTSV TVADTAVYYCAR | DTFCFDG---------CGYFFDS | WGQGT LVTVS S |
| | Germline | | | | | | | | |
| | VH2I2-05/D4I4-11/RF3/JH4 | | | | | | | | |
| iPS:3 92573 | 21-225_15G2 | VH2I2-05/D4I4-11/RF3/JH4 | QITLKES-GPTLVKPTQTLTL TCTFSG-FSLS | TS----GVGVG | WIRQPPGK ALEWLA | LIIW-----NDDKRYSFS LKS | RLTITKDTSKNQVVLTMTNM DPVDTATYYCAD | TGVSC---------CYFHY | WGQGT LVTVS S |
| | Germline | | | | | | | | |
| | VH1I1-02/D2I2-21/RF2/JH6 | | | | | | | | |
| iPS:3 92585 | 21-225_14H11 | VH1I1-02/D2I2-21/RF2/JH6 | QVQLVQS-GAEVKKPGASVKV SCQGSG-YTFT | G------HIMC | WVRQAPGQ GLEWMG | WINPN----SGGTNYAQK FQG | RVTMTRDTSISTAYMELSRL RSDDTAVYYCAA | GYCSSSSCYL------QPGYYGMDV | WGQGT TVTVS S |
| iPS:3 93186 | 21-225_27D9 | VH1I1-02/D2I2-21/RF2/JH6 | QVQLVQS-GAEVKKPGASVKV SCKASG-YTFT | G------YYMH | WVRQAPGQ GLEWMG | WINPN----SGGTKYAQK FQG | RVTMTRDTSISTAYMELNRL RSDDTAVYYCAR | ERCSTTSCYL------GITGYYGMDV | WGQGT TVTVS S |
| iPS:3 93234 | 21-225_26C10 | VH1I1-02/D2I2-21/RF2/JH6 | QVQLVQS-GAEVKKPGASVKV SCKASG-YTFT | G------YYVH | WVRQAPGQ GLEWMG | WINPN----SGGTNYAQK FQG | RVTMTRDTSISTAYMELSRL RSDDTAVYYCAR | ERCSTTSCYL------GITGYYGMDV | WGQGT TVTVS S |
| | Germline | | | | | | | | |
| | VH3I3-23/D5I5-12/RF3/JH6 | | | | | | | | |
| iPS:3 92596 | 21-225_12D8 | VH3I3-23/D5I5-12/RF3/JH6 | EVQLLES-GGGLVQPGGSLRL SCAASG-FTFS | S------YYMS | WVRQAPGK GLEWVS | TISVG----GGSTYYADS VKG | RFTISRDNSKNTLLLQMNSL RAEDTAVYYCAR | WGRGYSYE--------YYYGMDV | WGQGT TVTVS S |
| iPS:3 92942 | 21-225_30E9 | VH3I3-23/D5I5-12/RF3/JH6 | EVQLVES-GGGLVQPGGSLRL SCAASG-FTFS | S------CAMN | WVRQAPGK GLEWVS | AISGR----GGSTFYADS VKG | RFTISRDNSKNTLVLQMNSL RAEDTAVYYCAK | GELLDY----------YYYGMDV | WGQGT TVTVS S |

FIGURE 51 (Continued)

| | | | | | | | | | |
|---|---|---|---|---|---|---|---|---|---|
| iPS:3 92944 | 21-225_31H5 | VH3\|3-23\|D5\|5-12\|RF3\|JH6 | EVQLLES-GGGLVQPGGSLRL SCAASG-FTFS | S------YAMS | WVRQAPGK GLEWVS | AISGR------GGSTFHADS VKG | RFTISRDNSKNTLYLQMNSL RAEDTAVYYCVK | GELLEDY-------------YFYGMDV | WGQGT TVTVS S |
| iPS:3 92964 | 21-225_31A8 | VH3\|3-23\|D5\|5-12\|RF3\|JH6 | EVQLLES-GGGLVQPGGSLRL SCAASG-FTFS | S------YAMS | WVRQAPGK GLEWVS | AISGR------GGSTFHADS VKG | RFTISRDNSKNTLYLQMNSL RDEDTAVYYCAK | GELLEDY-------------YFYGMDV | WGQGT TVTVS S |
| iPS:3 92982 | 21-225_30D1 | VH3\|3-23\|D5\|5-12\|RF3\|JH6 | EVQLLES-GGGLVQPGGSLRL SCAASG-FTFS | S------YAMS | WVRQAPGK GLEWVS | AISGR------GGSTFHADS VKG | RFTISRDNSKNTLYLQMNSL RAEDTAVYYCVK | GELLEDY-------------YFYGLDV | WGQGT TVTVS S |
| iPS:3 92986 | 21-225_31B8 | VH3\|3-23\|D5\|5-12\|RF3\|JH6 | EVQLLES-GGGLVQPGGSLRL SCAASG-FTFS | S------YAMS | WVRQAPGK GLEWVS | AISGR------GGSTFHADS VKG | RFTISRDNSKNTLYLQLNSL RAEDTAVYYCVK | GELLEDY-------------YFYGMDV | WGQGT TVTVS S |
| iPS:3 93004 | 21-225_30G11 | VH3\|3-23\|D5\|5-12\|RF3\|JH6 | EVQLLES-GGGLVQPGGSLRL SCAASG-FTFS | S------YAMS | WVRQAPGK GLEWVS | AISGR------GGSTFHADS VKG | RFTISRDNSKNTLYLQMNSL RAEDTAVYYCVK | GELLEDY-------------YFYGMDV | WGQGT TVTVS S |
| iPS:3 93040 | 21-225_30E3 | VH3\|3-23\|D5\|5-12\|RF3\|JH6 | EVQLVES-GGGLVQPGGSLRL SCAASG-FTFS | S------YAMN | WVRQAPGK GLEWVS | AISGR------GGSTFNADS EKG | RFTISRDNSKNTLYLQMNSL RAEDTALYYCVK | GELLEDY-------------YYYGMDV | WGQGT TVTVS S |
| iPS:3 93058 | 21-225_31H3 | VH3\|3-23\|D5\|5-12\|RF3\|JH6 | EVQLVES-GGGLVQPGGSLRL SCAASG-FTFS | S------YAMN | WVRQAPGK GLEWVS | AISGR------GGSTFYADS VKG | RFTISRDNSKNTLYLQMNSL RAEDTAVYYCAK | GELLEDY-------------YYYGMDV | WGQGT TVTVS S |
| iPS:3 93060 | 21-225_32G12 | VH3\|3-23\|D5\|5-12\|RF3\|JH6 | EVQLLES-GGGLVQPGGSLRL SCAASG-FTFN | S------YAMS | WVRQAPGK GLEWVS | SISGR------GGSTFHADS VKG | RFTISRDNSKNTLYLQMNSL RAEDTAVYYCVK | GELLEDY-------------YFYGMDV | WGQGT TVTVS S |
| iPS:3 93068 | 21-225_34G9 | VH3\|3-23\|D5\|5-12\|RF3\|JH6 | EVQLLES-GGGLVQPGGSLRL SCAASG-FTFS | S------YAMS | WVRQAPGK GLEWVS | AISGR------GGSTFHADS VKG | RFTISRDNSKNTLYLQMNSL RAEDTAVYYCVK | GELLEDY-------------YFYGMDV | WGQGT TVTVS S |
| iPS:3 93072 | 21-225_36C5 | VH3\|3-23\|D5\|5-12\|RF3\|JH6 | EVQLVES-GGGLVQPGGSLRL SCAASG-FTFS | S------YAMN | WVRQAPGK GLEWVS | AISGR------GGSTFHADS VKG | RFTISRDNSKNTLYLQMNSL RAEDTAVYYCVK | GELLEDY-------------YFYGMDV | WGQGT TVTVS S |
| iPS:3 93076 | 21-225_33A4 | VH3\|3-23\|D5\|5-12\|RF3\|JH6 | EVQLLES-GGGLVQSGGSLRL SCEASG-FIFS | S------YAMN | WVRQVPGK GLEWVS | AISRR------GGSTFYADS VKG | RFTISRDNSKNTLYLQMNSL RAEDTAVYFCAK | GELLEDY-------------SYYGIDV | WGQGT TVTVS S |
| iPS:3 93102 | 21-225_33F1 | VH3\|3-23\|D5\|5-12\|RF3\|JH6 | EVQLLES-GGGLLQPGGSLRL SCAASG-FTFS | S------YAMS | WVRQAPGK GLEWVS | SISGR------GGSTFYADS VKG | RFTISRDNSKNTLYLQMNSL RAEDTAVYYCVK | GELLEDY-------------YFYGMDV | WGQGT TVTVS S |

FIGURE 51 (Continued)

| | | | | | | | | |
|---|---|---|---|---|---|---|---|---|
| iPS:3 93104 | 21-225_33A7 | VH3j3-23jD5j5-12jRF3/J H6 | EVQLLES-GGGLVQPGGSLRL SCAASG-FTFS | S------CAMS | WVRQAPGK GLEWVS | AISGR----GGSTFHADS VKG | RFTISRDNSKNTLYLQMNSL RAEDTAVYYCVK | GELLEDY-------YFYGMDV | WGQGT TVTVS S |
| iPS:3 93106 | 21-225_34A6 | VH3j3-23jD5j5-12jRF3/J H6 | EVQLLES-GGGLVQPGGSLRL SCAASG-FTFS | N------YAMN | WVRQAPGK GLEWVS | AISGR----GGSTFYADS VKG | RFTISRDNSKNTLYLQMNSL RAEDTAVYYCAK | GELLEDY-------YYFAMDV | WGQGT TVTVS S |
| iPS:3 93110 | 21-225_35B7 | VH3j3-23jD5j5-12jRF3/J H6 | EVQLLES-GGGLVQPGGSLRL SCAASG-FTFS | S------YAMS | WVRQAPGK GLEWVS | AISGR----GGSTFHADS VKG | RFTISRDNSKNTLYLQMNSL RAEDTAVYYCAK | GELLEDY-------YFYGMDV | WGQGA TVTVS S |
| iPS:3 93118 | 21-225_34H11 | VH3j3-23jD5j5-12jRF3/J H6 | EVQLLES-GGGLVQPGGSLRL SCAASG-FTFS | S------YAMN | WVRQAPGK GLEWVS | AISGR----GGSTFHADS VKG | RFTISRDNSKNTLFLQMNSL RAEDTAVYYCAK | GELLEDY-------YYYGMDV | WGQGT TVTVS S |
| iPS:3 93124 | 21-225_33G7 | VH3j3-23jD5j5-12jRF3/J H6 | EVQLLES-GGGLVQPGGSLRL SCAASG-FTFS | N------YAMN | WVRQAPGK GLEWVS | AISRR----GGSTFYADS VKG | QFTISRDNSKNTLYLQMNSL RAEDTAVYYCAK | GELLEDY-------SYYGMDV | WGQGT TVTVS S |
| iPS:3 93126 | 21-225_35D1 | VH3j3-23jD5j5-12jRF3/J H6 | EVQLLES-GGGLVQPGGSLRL SCAASG-FTFS | S------YAMS | WVRQAPGK GLEWVS | AISGR----GGSTFHADS VKG | RFTISRDNSKNTLYLQMNSL RAEDTAVYYCVK | GELLEDY-------YFYGMDV | WGQGA TVTVS S |
| iPS:3 93128 | 21-225_35F11 | VH3j3-23jD5j5-12jRF3/J H6 | EVQLLES-GGGLVQPGGSLRL SCAASG-FTFS | S------YAMS | WVRQAPGK GLEWVS | AISGR----GGSTFHADS MKG | RFTISRDNSKNTLYLQINSL RAEDTAVYYCVK | GELLEDY-------YFYGMDV | WGQGT TVTVS S |
| iPS:3 93146 | 21-225_34G8 | VH3j3-23jD5j5-12jRF3/J H6 | EVQLLES-GGGLVQPGGSLRL SCAASG-FTFS | S------YAMS | WVRQAPGK GLEWVS | AISGR----GGSTFHADS VKG | RFTISRDNSKNTLYLQMNSL RAEDTAVYYCVK | GELLEDY-------YPYGMDV | WGQGT TVTVS S |
| iPS:3 93150 | 21-225_36A5 | VH3j3-23jD5j5-12jRF3/J H6 | EVQLLES-GGGLVQPGGSLRL SCAASG-FTFS | N------YAMN | WVRQAPGK GLEWVS | AISRR----GGNTFYADS VKG | RFTISRDNSKNTLYLQMNSL RAEDTAVYYCAK | GELLEDY-------YYYAMDV | WGQGT TVTVS S |
| iPS:3 93180 | 21-225_4G12 | VH3j3-23jD5j5-12jRF3/J H6 | EVQLLES-GGGLVQPGGSLRL SCAASG-FTFN | S------YAMS | WVRQAPGK GLEWVS | TLSGR----GGSTYYADS VKG | RFTISRDNSKNTLYLQMNSL RAEDTAVYYCAK | WGRGYSYE-------YYYGMDV | WGQGT TVTVS S |
| iPS:3 93232 | 21-225_17F12 | VH3j3-23jD5j5-12jRF3/J H6 | EVQLLES-GGGLVQPGGSLRL SCAASG-FTFS | S------YAMS | WVRQAPGK GLEWVS | AISGG----GGSTYYADS VKG | RVTISRDNSKNTLYLQMNSL RAEDTAVYYCAK | WGRGYNYE-------YYYGMDV | WGQGT TVTVS S |
| iPS:3 98494 | 21-225_21H4 | VH3j3-23jD5j5-12jRF3/J H6 | EVQLLES-GGGLVQPGGSLRL SCAASG-FTFS | S------YAMS | WVRQAPGK GLEWVS | ALSGR----GGSTYYADS VKG | RFTISRDNSKNTLYLQMNSL RAEDTAVYYCAK | WGRGYSYE-------YYYGMDV | WGQGT TVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 98508 | 21-225_24B1 | VH3-23/D5/5-12/RF3/JH6 | EVQLLES-GGGLVQPGGSLRL SCAASG-FTFS | S------YAMS | WVRQAPGK GLEWVS | AISGR----GGNTYYADS VKG | RFTISRDNSKNTLYLQMNSL RAEDTAVYYCAR | WGRGYSYE--------YYYGMDV | WGQGT TVTVS S |
| iPS:3 98528 | 21-225_32G1 | VH3-23/D5/5-12/RF3/JH6 | EVQLLES-GGGLAQPGGSLRL SCAASG-FTFS | S------YAMS | WVRQAPGK GLEWVS | AISGR----GGSTFHADS VKG | RFTISRDNSKNTLYLQMNSL RAEDTAVYYCVK | GELLEDY---------YFYGMDV | WGQGT TVTVS S |
| iPS:3 98534 | 21-225_33B8 | VH3-23/D5/5-12/RF3/JH6 | EVQLLES-GGGLVQPGGSLRL SCAASG-FTFS | S------YAMS | WVRQAPGK GLEWVS | AISGR----GGSTFHADS VKG | RFTISRDNSKNTLYLQMNSL RAEDTAVYYCVK | GELLEDY---------YFYGMDV | WGQGT TVTVS S |
| iPS:3 98540 | 21-225_35A6 | VH3-23/D5/5-12/RF3/JH6 | EVQLLES-GGGLVQPGGSLRL SCAASG-FTFS | S------YAMS | WVRQAPGK GLEWVS | TISGR----GGSTFHADS VKG | RFTISRDNSKNTLYLQMNSL RAEDTAVYYCVK | GELLEDY---------YFYGMDV | WGQGT TVTVS S |
| | Germline VH4-39/D4/4-17/RF2/JH4 | | | | | | | |
| iPS:3 92622 | 21-225_17H8 | VH4-39/D4/4-17/RF2/JH4 | QLQLQES-GPGLVKPSETLSL TCTVSG-GSIS | RS----SYYWG | WIRQPPGR GLEWIG | NIYY-----GGNTYYNPS LKS | RVTISVDTSKNQFSLKLSSV TAADTAVYYCAR | HGKDW----------GLDY | WGQGT LVTVS S |
| iPS:3 92638 | 21-225_17F9 | VH4-39/D4/4-17/RF2/JH4 | QLQLQES-GPGLVKPSEFLSL TCTVSG-GSIS | RS----SYYWG | WIRQPPGK GLEWIG | NIYY-----SGSTYYNPS LKS | RVTISVDSSKNQFSLNLNSV TAADTAVYYCAR | HGKDW----------GLDY | WGQGT LVTVS S |
| iPS:3 92656 | 21-225_1F2 | VH4-39/D4/4-17/RF2/JH4 | QLQLQES-GPGLVKPSETLSL TCTVSG-GSIS | RS----SYYWG | WIRQPPGK GLEWIG | NIYY-----SGSAYNNPS LKG | RVTISVDTSKNQFSLKLNSV TAADTAVYYCGR | HGKDW----------GLDY | WGQGT LVTVS S |
| iPS:3 92794 | 21-225_21H3 | VH4-39/D4/4-17/RF2/JH4 | QLQLQES-GPGLVKPSETLSL TCTVSG-GSIS | RS----SYYWG | WIRQPPGK GLDWIG | NIYY-----SGSTYDNPS LKS | RVTISVDTSKNQFSLNLSSV TAADTAVYYCGR | HGKDW----------GLDY | WGQGT LVTVS S |
| iPS:3 92822 | 21-225_23C8 | VH4-39/D4/4-17/RF2/JH4 | QLQLQES-GPGLVKPSETLSL TCTVSG-GSIS | RS----SYYWG | WIRQPPGK GLEWIG | NIYY-----SGSTYYNPS LKS | RVTISVDTSRKNHFSLKLSSV TAADTAVYYCGR | HGKDW----------GLDY | WGQGT LVTVS S |
| iPS:3 92838 | 21-225_22G8 | VH4-39/D4/4-17/RF2/JH4 | QLQLQES-GPGLVKPSETLSL TCTVSG-GSIN | RS----SYYWG | WIRQPPGK GLEWIG | NIYY-----SGSTYYNPS VKS | RFTISVDTSKNQFSLKLSSV TAADTAVYYCAR | HGKDW----------GLDY | WGQGT LVTVS S |
| iPS:3 92858 | 21-225_22H4 | VH4-39/D4/4-17/RF2/JH4 | QLQLQES-GPGLVKPSETLSL TCTVSG-GSIS | RS----SYYWG | WIRQPPGK GLEWIG | NIYY-----SGSTYRNPS LKS | RVTISVDTSMNQFSLKLTSV TAADTAVYFCGR | HGKDW----------GLDY | WGQGT LVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 92882 | 21-225_23A3 VH4|4-39|D4|4-17|RF2|J H4 | QLQLQES-GPGLVKPSETLSL TCTVSG-GSIS | RS----SYYWG | WIRQFPGQ GLEWIG | NIYY----- SGSTYNNPS LKS | RVTISVDTSKNQFSLNLSSV TAADTAVYYCGR | HGKDW------GLDF | WGQGT LVTVS S |
| iPS:3 93804 | 21-225_5H7 VH4|4-39|D4|4-17|RF2|J H4 | QLQLQES-GPGLVKPSETLSL TCTVSG-GSIN | RS----SYYWG | WIRQPPGK GLEWIG | NIYY----- SGTYYNPS LKS | RVTISVDTSKNQFSLNLSSV TAADTAVYSCAR | HGKDW------GLDY | WGQGT LVTVS S |
| iPS:3 93832 | 21-225_14B2 VH4|4-39|D4|4-17|RF2|J H4 | QLQLQES-GPGLVKPSETLSL TCTVSG-GSIN | RS----SYYWG | WIRQPPGK GLEWIG | NIYY----- SGTYYNPS LKS | RVTISVDTSKNQFSLNLSSV TAADTAVYYCGR | HGKDW------GLDY | WGQGA LVTVS S |
| iPS:3 94037 | 21-225_4F4 VH4|4-39|D4|4-17|RF2|J H4 | QLQLQES-GPGLVKPSETLSL TCTVSG-GSIS | RS----SYYWG | WIRQPPGK GLEWIG | NIYY----- SGSTYDNPS LKS | RVTISVDTSKNQFSLKLSSV TAADTAVYYCGR | HGKDW------GLDY | WGQGT LVTVS S |
| iPS:3 94045 | 21-225_4H4 VH4|4-39|D4|4-17|RF2|J H4 | QLQLQES-GPGLVKPSETLSL TCTVSG-GSIS | RS----SYYWG | WIRQPPGK GLEWIG | NIYY----- SGNTYNNFS LKS | RVTISVDTSKNQFSLKLNSV TAADTAVYYCGR | HGKDW------GLDY | WGQGT LVTVS S |
| iPS:3 94079 | 21-225_11F5 VH4|4-39|D4|4-17|RF2|J H4 | QLQLQES-GPGLVKPSETLSL TCTVSG-GSIS | RS----SYYWG | WIRQFPGK GLEWIG | NIYY----- SGSTYNPS LKS | RVTISVDTSKNHFSLKLSSV TAADTAVYYCGR | HGKDW------GLDN | WGQGT LVTVS S |
| | Germline VH3|3-43|D4|4-11|RF2|JH5 | H_FR1 | H_CDR1 | H_FR2 | H_CDR2 | H_FR3 | H_CDR3 | H_FR4 |
| iPS:3 92624 | 21-225_17H12 VH3|3-21|D4|4-11|RF2|J H3 | EVQLVES-GGGLVKPGGSLRL SCAASG-FTFS | S------YTMN | WVRQAPGK GLEWVS | SISGS---- SSTYYADS VKG | RFTISRDNAKNSLYLQMNSL RAEDTAVYYCAR | DRG--------SI | WGQGT MVTVS S |
| iPS:3 93946 | 21-225_16A4 VH3|3-21|D4|4-11|RF2|J H3 | EVQLVES-GGGLVKPGGSLRL SCAASG-FTFS | S------YSMN | WVRQAPGK GLEWVS | SISGS---- STYKYADS VKG | RFTISRDNAKNSLYLQMNSL RTEDTAVYYCAR | DRG--------SY | WGQGT QVTVS S |
| iPS:3 94008 | 21-225_15H8 VH3|3-21|D4|4-11|RF2|J H3 | EVQLVES-GGGLVKPGGSLRL SCAASG-FTFS | S------YVMN | WVRQAPGK GLEWVS | SISGS---- STYICADS IKG | RFTISRDNAKNSLYLQMNSL RADDTAVYYCAR | DRG--------SI | WGQGT MVTVS S |
| | Germline VH6|6-01|D6|6-19|RF1|JH6 | H_FR1 | H_CDR1 | H_FR2 | H_CDR2 | H_FR3 | H_CDR3 | H_FR4 |
| iPS:3 92836 | 21-225_17A6 VH6|6-01|D6|6-19|RF1|J H6 | QVQLQQS-GPGLVKPSQTLSL TCAISG-DSVS | RN----TAAWS | WIRQSFSH GLEWIG | RTYYR---- SKWINDYAV SVKS | RVTINPDISKNQFSLQLNSV IPEDTAVYYCAR | VSSGWSHH-----YYYYGMDV | WGQGT TVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH6|6-01|D2|2-15|RF2|JH6 | | | | | | | | |
| iPS:3 92648 | VH6|6-01|D2|2-15|RF2|JH6 | QVQLQQS-GPGLVKPSQTLSL TCAISG-DSVS | RN----TAAMS | WIRQSPGR GLEWLG | RTYYR-SKWYNDYAV SVKS | RTINPDTSKNQP/SLQLNSV TPEDTAVYYCAR | VNSGWSHH-------YYYYGMDV | WGQGT TVTVS S |
| VH3|3-11|D1|1-1|RF3|JH2 | | | | | | | | |
| iPS:3 92650 | VH3|3-11|D1|1-1|RF3|JH | QVQLVES-GGGLVRPGGSLRL SCAASG-FTFS | D-------YYMS | WIRQAPGK GLEWVS | HISSS----GSTIYYADS VKG | RFTISRDNAKNSLYLQMNSL RAEDTAVYYCAR | YRNNR-------GYFDL | WGRGT LVTVS S |
| iPS:3 92728 | VH3|3-11|D1|1-1|RF3|JH 2 | QVQLVES-GGGLVKPGGSLRL SCAASG-FTFS | D-------YYMS | WIRQAPGK GLEWVS | HISSS----GSTIYYADS VKG | RFTISRDMGENSLYLQMNSL RAEDTAVYYCAR | YRNNR-------GYFDL | WGRGS LVTVS S |
| VH4|4-59|D1|1-26|RF3|JH4 | | | | | | | | |
| iPS:3 92676 | VH4|4-59|D1|1-26|RF3|JH 4 | QVQLQES-GPGLVKPSETLSL TCTVSG-GAIS | GS------SYYWG | WIRQPPGK QLEWIG | NIYY-SGSTYYNPS FKS | RVTISVDTSKNQF/SLKLSSV TAEDTAVYYCAR | ESSSW-------SLDY | WGQGT LVTVS S |
| VH3|3-23|D6|6-13|RF2|JH2 | | | | | | | | |
| iPS:3 92678 | VH3|3-23|D6|6-13|RF2|JH 2 | EVQLLES-GGGLVQPGGSLRL SCAASG-FTFS | S-------YAMN | WVRQAPGK GLEWVS | VISGS----GGSTYYADS VKG | RFTISRDNSKNTLYLQMNSL RAEDTAVYYCAR | RIAAAG-------TEYFDL | WGRGT LVTVS S |
| VH3|3-21|D5|5-24|RF3|JH4 | | | | | | | | |
| iPS:3 92682 | VH3|3-21|D5|5-24|RF3|JH 4 | EVQLVES-GGGLVKPGGSLRL SCAASG-FTFS | S-------YRMN | WFRQAPGK GLEMVS | SISGS----STGIYYADS VKG | RFTISRDNAENSLYLQMNSL RAEDTAVYYCAR | RD----------F | WGQGT LVTVS S |
| VH3|3-48|D7|7-27|RF1|JH4 | | | | | | | | |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 92692 | 21-225_18G10 | VH3\|3-48\|D7\|7-27\|RF1\|JH4 | EVQLVES-GGGLVQPGGSLRL LCAASG-ITFS | T------YSMN | WVRQAPGK GLEWVS | YISRS---SSTIDYADS VKG | RFTISRDNAKNSLYLQMNSL RDEDTAVYYCAR | GGGS----------PFDY | WGQGT LVTVS S |
| iPS:3 92708 | 21-225_18D11 | VH3\|3-48\|D7\|7-27\|RF1\|JH4 | EVQLVES-GGGLVQPGGSLRL SCAASG-FTFR | S------YSMN | WVRQAPGK GLEWLS | YISSS---SGTIYADS VKG | RFTISRDNARNSLNLQMNSL RDEDTAVYYCAR | GGGS----------PFDY | WGQGI LVTVS S |
| iPS:3 93992 | 21-225_14H8 | VH3\|3-48\|D7\|7-27\|RF1\|JH4 | EVQLVES-GGGLVQPGGSLRL SCAASG-FTFS | S------NSMN | WVRQAPGK GLEWVS | YISSS---SSTIYADS VKG | RFTIARDNAKNSLYLQMNSL RDEDTAVYYCAR | GGGS----------PFDY | WGQGT LVTVS S |
| iPS:3 94055 | 21-225_9C8 | VH3\|3-48\|D7\|7-27\|RF1\|JH4 | EVQLVES-GGGLVQPGGSLRL SCVVSG-FTFS | S------QSMN | WVRQAPGK GLEWVS | YISI---SSTIYADS VKG | RFTISRDNAKNSLYLQMNSL RDEDTAVYYCAR | GGGS----------FFDS | WGQGT LVTVS S |
| | Germline VH3\|3-30.3\|D4\|4-11\|RF2\|JH4 | | | | | | | |
| iPS:3 92694 | 21-225_19A5 | VH3\|3-30.3\|D4\|4-11\|RF2\|JH4 | QVQLVES-GGGLVQPGRSLRL SCAASG-FTFS | S------YAMH | WVRQAPGK GLEWVA | VIWFD---GSDKYADS VKG | RFTISRDNSKNTLYLQMNSL RAEDTAVYYCAR | DRAYS---------SSSDY | WGQGT LVTVS S |
| | Germline VH3\|3-23\|D1\|1-1\|RF1\|JH4 | | | | | | | |
| iPS:3 92714 | 21-225_16G12 | VH3\|3-23\|D1\|1-1\|RF1\|JH4 | EVQLVES-GGGLVQPGGSLRL SCAASG-FTFS | S------YAMT | WVRQAPGK GLEWVS | TISGR---GGHTYYADS VRG | RFAISRDSSKNTLYLQMNSL RAEDTAVYYCAR | QD------------C | WGQGT LVTVS S |
| iPS:3 92890 | 21-225_20H9 | VH3\|3-23\|D1\|1-1\|RF1\|JH4 | EVQLLES-GGGLVQPGGSLRL SCAASG-FTFS | S------YAMS | WVRQAPGK GLEWVS | AISGS---GGYTYYADS VKG | RFTISRDNSENTLYLQMNSSL RAEDTAVYYCAR | GGS-----------LFY | WGQGT LVTVS S |
| iPS:3 92892 | 21-225_20C11 | VH3\|3-23\|D1\|1-1\|RF1\|JH4 | EVQLLES-GGGLVQPGGSLRL SCAASG-FSFS | S------YAMS | WVRQAPGK GLEWVS | TISGR---GGHTYYADS VKG | RFAISRDSSKNTLYLQMNSL RAEDTAVYYCAR | QD------------C | WGQGT LVTVS S |
| iPS:3 93968 | 21-225_5A5 | VH3\|3-23\|D1\|1-1\|RF1\|JH4 | EVQLVES-GGGLVQPGGSLRL SCAASG-FTFS | S------YAMN | WVRQAPGK GLEWVS | AISGS---GGYTYYADS VKG | RFTISRDNSKNTLYLQMNSL RAEDTAVYYCAR | GGS-----------LFY | WGQGT LVTVS S |
| | Germline VH3\|3-23\|D6\|6-6\|RF1\|JH3 | | | | | | | |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 92730 | 21-225_17A1 | VH3|3-23|D6|6-6|RF1|JH3 | EVQLLES-GGGLVQPGGSLRL SCAASG-FTFS | S------YAMN | MVRQAPGK GLEWVS | VISGS---GSNTYYADS VKG | RFTISRDNSKNTLYLQMNSL RAEDTAVYYCAK | RYTSDW------HDAFDI | WGQGT MVTVS S |
| iPS:3 92736 | 21-225_17B12 | VH3|3-23|D6|6-6|RF1|JH3 | EVQLLES-GGGLVQPGGSLRL SCAASG-FTFS | S------YAMN | MVRQAPGK GLEWVS | VISGS---GGSTYYADS VKG | RFTISRDNSKNTLYLQMNTL RAEDTAVYYCAK | RYTSDW------HDAFDI | WGQGT MVTVS S |
| iPS:3 92770 | 21-225_20C10 | VH3|3-23|D6|6-6|RF1|JH3 | EVQLLES-GGGLVQPGGSLRL SCAASG-FTFS | S------YAMN | MVRQAPGK GLEWVS | VISGS---GGTTYYADS VKG | RFTISRDNSKNTLYLQMNTL RAEDTAVYYCAK | RYTSDW------HDAFDI | WGQGT MVTVS S |
| iPS:3 93878 | 21-225_7G12 | VH3|3-23|D6|6-6|RF1|JH3 | EVQLLES-GGGLVQPGGSLRL SCAASG-FTFS | S------YAMN | MVRQAPGK GLEWVS | VISGS---GGSTYYADS VKG | RFTISRDNSKNTLYLQMNTL RAEDTAVYYCAK | RYTSDW------HDAFDI | WGQGT MVTVS S |
| Germline | VH3|3-23|D7|7-27|RF3|JH5 | | EVQLVES-GGGLVKPGGSLRL SCAASG-FTFS | | | | | | |
| iPS:3 92748 | 21-225_20A8 | VH3|3-21|D7|7-27|RF3|JH5 | EVQLVES-GGGLVKPGGSLRL SCAASG-FTFS | S------YSVN | WVRQAPGK GLEWVS | SISSS---SSFLYYADS VKG | RFTISRDNAKNSVYLQMNSL RAEDTAVYYCAR | NW---------DY | WGQGT LVTVS S |
| Germline | VH3|3-30.3|D11|1-1|RF1|JH5 | | | | | | | | |
| iPS:3 92754 | 21-225_21D3 | VH3|3-30.3|D11|1-1|RF1|JH5 | QVQLVES-GGGVVQPGRSLRL SCAASG-FTFS | S------YGMH | WVRQAPGK GLEWVT | VISYD---GSNKYYADS VKG | RFTISRDNSKNTLYLQMNSL RAEDTAVYYCAR | GVWF-------GDL | WGQGT LVTVS S |
| iPS:3 92818 | 21-225_22D8 | VH3|3-30.3|D11|1-1|RF1|JH5 | QVQLVES-GGGVVQPGRSLRL SCVASG-FTFR | S------YGMH | WVRQAPGK GLEWVT | IISYD---GSNKYYADS VKG | RFTISRDNSKNTLYLQMNSL RAEDTAVYFCAR | GVWF-------GDF | WGQGT LVTVS S |
| Germline | VH3|3-23|D6|6-19|RF2|JH1 | | | | | | | | |
| iPS:3 92762 | 21-225_22G5 | VH3|3-23|D6|6-19|RF2|JH1 | EVQLLES-GGGLVQPGGSLRL SCAASG-FTFS | S------YAMN | MVRQAPGK GLEWVS | VISRS---GGYTYYADS VKG | RFTISRDNSKNTLYLQMNSL RAEDTAVYYCAS | RLAVAG-----SEAFDI | WGQGT LVTVS S |
| iPS:3 94051 | 21-225_9E5 | VH3|3-23|D6|6-19|RF2|JH1 | EVQLLES-GGGLVQPGGSLRL SCAASG-FTFS | N------YAMN | WVRQAPGK GLEWVS | AISGG---GGNTFYADS VKG | RFTISRDNSKNTLYLQMNGL RAEDTAVYYCAS | RLAVAG-----SEAFAI | WGQGT LVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4-39/D1|1-26|RF3/JH1 | | | | | | | | |
| iPS:3 92774 | 21-225_21F3 | VH4-39/D1|1-26|RF3/J H1 | QLQLQES-GPGLVKPAETLSL TCTVSG-GSIS | RS----SYYWG | WIRQPPGK VLEWIG | SIYY------SGSTYYNPS LKS | RVTISVDTSKNQFSLKLSSV TAADTAVYYCAS | LSSSW--------DFQH | WGQGT LVTVS S |
| iPS:3 93962 | 21-225_7H7 | VH4-39/D1|1-26|RF3/J H1 | QLQLQES-GPGLVRPSETLSL ICTVSG-GSIS | RS----SYYWG | WIRQPPGK GLEWIG | NIYY------SGSTYYIPS LKS | RVTISVDTSKNQFSLKLSSV TAADTAVYYCAR | HSTSW--------SLDH | WGQGT LVTVS S |
| iPS:3 94049 | 21-225_13H5 | VH4-39/D1|1-26|RF3/J H1 | QLQLQES-GPGLVKPAETLSL ICTVSG-GSIS | RS----SYYWG | WIRQPPGK GLEWIG | SIYY------SGSTYYNPS LKS | RVTISVDTSKNQFSLKLSSV TAADTAVYYCAR | LSSSW--------DFQH | WGQGT LVTVS S |
| VH3-21|D2|2-21|RF2/JH4 | | H_FR1 | H_CDR1 | H_FR2 | H_CDR2 | H_FR3 | H_CDR3 | H_FR4 |
| iPS:3 92776 | 21-225_21A12 | VH3-21|D2|2-21|RF2/J H4 | EVQLVES-GGGLVKPGGSLRL SCAASG-FTFN | S-------YSMN | WVRQAPGK GLEWVS | SISGS------SSIYYADS VKG | RFTISRDNAKNSLYLQMNSL RAEDTALYYCAR | AAG----------FDY | WGQGT LVTVS S |
| VH3-33|D6|6-19|RF2/JH6 | | H_FR1 | H_CDR1 | H_FR2 | H_CDR2 | H_FR3 | H_CDR3 | H_FR4 |
| iPS:3 92806 | 21-225_24H3 | VH3-33|D6|6-19|RF2/J H6 | QVQLVES-GGGVVQPGRSLRL SCAASG-FTFS | S-------YGMH | WVRQAPGK GLEWVA | VIWD------GSNKYYADS VKG | RFTISRDNSKNTLYLQMNSL RAEDTAVYYCAR | VAVAG--------GMDV | WGQGT TVTVS S |
| VH3-48|D7|7-27|RF2/JH4 | | H_FR1 | H_CDR1 | H_FR2 | H_CDR2 | H_FR3 | H_CDR3 | H_FR4 |
| iPS:3 92826 | 21-225_20B9 | VH3-48|D7|7-27|RF2/J H4 | EVQLVES-GGGLVQPGGSLRL SCAASG-FTFS | S-------YSMN | WVRQAPGK GLEWVS | YISSS------SSTIYYADS VKG | RFTISRDNAKNSLYLQMNSL RDEDTAVYYCAR | SLWS---------PFDY | WGQGT LVTVS S |
| VH4-59|D1|1-1|RF1/JH5 | | H_FR1 | H_CDR1 | H_FR2 | H_CDR2 | H_FR3 | H_CDR3 | H_FR4 |
| iPS:3 92830 | 21-225_21A5 | VH4-59|D1|1-1|RF1/JH 5 | QVQLQES-GPGLVRPSETLSL ICTVSG-GSIS | S-------YFWS | WIRQPAGK GLEWIG | RIYT------SGITNYNPS LKS | RVIMSVDTSKNQFSLKLSSV TAADTALYYCAR | GPTSG--------WFDP | WGQGT LVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3/3-23|D6|6-6|RF2|JH4 | | EVQLLES- GGGLVQPGGSLRL SCAASG-FTFS | YAMS | WVRQAPGK GLEWVS | AISGS- GGSTYYADS VKG | RFTISRDNSKNTLYLQMNSL RAEDTAVYYCAR | ATAAR SNFDP | WGQGT LVTVS S |
| iPS:3 92840 21-225_23G1 | VH3|3-23|D6|6-6|RF2|JH4 | EVQLLES- GGGLVQPGGSLRL SCAASG-FTFS | S-----YAMS | WVRQAPGR GLEWVS | VISGS---- GGTTYNTDS VKG | RFTISRDNSKNTLYLQMNSL RAEDTAVYYCAR | SSL------ | ------FDY | WGQGT LVTVS S |
| iPS:3 94018 21-225_15B1 | VH3|3-23|D6|6-6|RF2|JH4 | EVQLLES- GGGLVQPGGSLRL SCAASG-FTFS | S-----YVMS | WVRQAPGK GLEWVS | GISGS---- GGSTNMADS VKG | RFTISRDNSKNTLYLQMNSL RAEDTAVYYCAR | SSL------ | ------FDY | WGQGT LVTVS S |
| iPS:3 94026 21-225_16C7 | VH3|3-23|D6|6-6|RF2|JH4 | EVQLLES- GGGLVQPGGSLRL SCAASG-FTFS | S-----YVMT | WVRQAPGK GLEWVS | TISGS---- GGWTYYADS VKG | RFTISRDNSKNTLYLQMNSL RAEDTAEYYCAR | ISSL----- | ------FDY | WGQGT LVTVS S |
| | Germline | | | | | | | |
| VH3|3-23|D6|6-6|RF2|JH5 | | | | | | | | |
| iPS:3 92842 21-225_23G8 | VH3|3-23|D6|6-6|RF2|JH5 | EVQLLES- GGGLVQPGGSLRL SCAASG-FTFS | S-----YAMS | WVRQAPGK GLEWVS | AISGS---- GGSTYYADS VKG | RFTISRDNSKNTLYLQMNSL RAEDTAVYYCAV | ISSG----- | ------WFA | WGRGT LVTVS S |
| | Germline | | H_CDR1 | H_FR2 | H_CDR2 | H_FR3 | H_CDR3 | H_FR4 |
| VH3|3-23|D1|1-1|RF1|JH2 | | | | | | | | |
| iPS:3 92856 21-225_22A2 | VH3|3-23|D1|1-1|RF1|JH2 | EVQLLES- GGGLVQPGGSLRL SCAASG-FTFS | S-----YAMS | WVRQAPGK GLEWVS | GISGS---- GGNIPYADS VKG | RFTISRDISKNTLYLQMNSL RAEDTAVYYCAR | VVG------ | ------AVH | WGRGT LVTVS S |
| | Germline | H_FR1 | H_CDR1 | H_FR2 | H_CDR2 | H_FR3 | H_CDR3 | H_FR4 |
| VH4|4-30.1|D5|5-18|RF1|JH6 | | | | | | | | |
| iPS:3 92864 21-225_23B9 | VH4|4-30.1|D5|5-18|RF1|JH6 | QVQLQAS- GPGLVKPSQTLSL TCTVSD-GSIS | SG---GYWS | WIRQHPGK GLEWIG | YIYY---- SGGTYYNPS LKS | RVTSVDTSKNQFSLKLSSV TAADTAVYFCAR | EDGAFG--- | ----YYGMDV | WGQGT TVTVS S |
| | Germline | H_FR1 | H_CDR1 | H_FR2 | H_CDR2 | H_FR3 | H_CDR3 | H_FR4 |
| VH3|3-23|D2|2-2|RF2|JH3 | | | | | | | | |
| iPS:3 92874 21-225_21D2 | VH3|3-23|D2|2-2|RF2|JH3 | EVRLLES- GGGLVQPGGSLRL SCAASG-FTFN | N-----YAMS | WVRQAPGK GLEWVS | VLSGS---- GGSTFYADS VKG | RFTISRDNSKNTLYLQMSSL RAGDTAVYFCAR | YCSSARC-- | ---FYDAFDI | WGQGT MVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS.3 93940 | 21-225_16B2 | VH3|3-23|D2|2-2|RF2|JH3 | EVQLLES-GGGLVQPGGSLRL SCAASG-FTFS | S------YAMT | WVRQAPGK GPEWVS | VISGS---GGSTFYADS VKG | RFTISRDNSKNTLYLQMSL RAEDTAVYFCAR | YCSSTRC----------PYDAFDI | WGQGT MVTVS S |
| iPS.3 93956 | 21-225_4D7 | VH3|3-23|D2|2-2|RF2|JH3 | EVKLLES-GGGLVQPGGSLRL SCAASG-FTFS | S------YAMS | WVRQAPGK GLEWVS | VLSGS---GGSTFYADS VKG | RFTISRDNSKNTLYLQMSSL RAGDTAVYFCAR | YCSSARC----------PYDAFDI | WGQGT MVTVS S |
| iPS.3 98476 | 21-225_17C1 | VH3|3-23|D2|2-2|RF2|JH3 | EVQLLES-GGGLEQPGGSLRL SCAASG-FTFS | S------YAMS | WVRQAPGK GLEWVS | VISGS---GGTTFYADS VKG | RFTISRDNSKNTLYLQMSSL RAEDTAVYFCAR | YCSSTRC----------PYDAFDI | WGQGT MVTVS S |
| | Germline | | H_FR1 | H_CDR1 | H_FR2 | H_CDR2 | H_FR3 | H_CDR3 | H_FR4 |
| VH3|3-15|D1|1-1|RF3|JH4 | | | EVQLLES-GGGLVKPGGSLRL SCAASG-FTFS | | | | | | |
| iPS.3 92898 | 21-225_21H10 | VH3|3-15|D1|1-1|RF3|JH4 | EVQLVES-GGGLVKPGGSLRL SCAASG-FTFS | N------AWMN | WVRQAPGK GLEWVG | RIKSKT-DGGTTDYAA PVKG | RFTISRDDSKNTLYLQMNSL KIEDTAVYYCTT | EGWN-------------TDY | WGQGT LVTVS S |
| iPS.3 93802 | 21-225_3D12 | VH3|3-15|D1|1-1|RF3|JH4 | EVQLVES-GGGLVKPGGSLRL SCAASG-VTFS | T------AWMN | WVRQAPGK GLEWVG | RIKNKI-DGGTTDYVA PVKG | RFTISRDDSKNTLYLQMNSL KIEDTAVYYCTT | EGWN-------------TDY | WGQGT LVTVS S |
| | Germline | | H_FR1 | H_CDR1 | H_FR2 | H_CDR2 | H_FR3 | H_CDR3 | H_FR4 |
| iPS.3 92950 | 21-225_25C10 | VH3|3-48|D4|4-11|RF3|JH4 | EVQLLES-GGGLVQPGGSLRL SCAASG-FTFS | S------YRMN | WVRQAPGK GLEWVS | SISSS---SSTIYYADS VKG | RFTISRDNAKNSLYLQMNSL RDEDTAVYYCAR | TAG--------------FDY | WGQGT LVTVS S |
| | Germline | | H_FR1 | H_CDR1 | H_FR2 | H_CDR2 | H_FR3 | H_CDR3 | H_FR4 |
| iPS.3 93010 | 21-225_26E11 | VH3|3-23|D1|1-26|RF3|JH4 | EVQLLES-GGGLVQPGGSLRL SCAASG-FIFS | S------YAMS | WVRQAPGK GLEWVS | VISGG---GGTTYADS VKG | RFTISRDNSKNTLYLQMNSL RAEDTAVYYCAK | RGYSGYE------GLLYFDC | WGQGT LVTVS S |
| | Germline | | H_FR1 | H_CDR1 | H_FR2 | H_CDR2 | H_FR3 | H_CDR3 | H_FR4 |
| iPS.3 93016 | 21-225_28F11 | VH3|3-23|D3|3-3|RF3|JH3 | EVQLLES-GGGLVQPGGSLRL SCAASG-FIFS | S------YAMS | WVRQAPGK GLEWVS | VTSGS---GGTTFYADS VKG | RFTISRDNSKNTLYLQMNSL RAEDTAVYYCAK | ETQFD------------DFDI | WGQGT MVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3J3-33D2J3-22|RF2JH6 | | | | | | | | |
| iPS:3 93032 | 21-225_26F8 | VH3|3-33D|3-22|RF2|JH6 | QVQLVQS-GGGVVQPGRSLRL SCAASG-FTFS | G------YGMH | WVRQAPGK GLEWVA | IIWYD----GSNKYADS VKG | RFTISRDNSKNTLYLQMNSL RAEDTAVYYCAR | ERYDFW----SGGMDV | WGQGT TVTVS S |
| VH1|1-02D4|4-11|RF2|JH6 | | | | | | | | |
| iPS:3 93042 | 21-225_31F1 | VH1|1-02D4|4-11|RF2|JH6 | QVQLVQS-GAEVKKPGASVKV SCKASG-YTFT | D------YIMH | WVRQAPGQ GLEWMG | WINPN----SGGTNYAQK FQG | RVTMTRDTSIMTAYMELSRL RSDDTAVYYCAR | DSSNFSNW----YDYYGMDV | WGQGT TVTVS S |
| iPS:3 93108 | 21-225_34G11 | VH1|1-02D4|4-11|RF2|JH6 | QVQLVQS-GAEVKKPGASVKV SCKASG-YTFT | G------YIMH | WVRQAPGQ GLEWMG | WINPN----SGGTNYAQK FQG | RVTMTRDTSISTAYMELSRL RSDDTAVYYCAR | DISNFSSW----YDYYAMDV | WGQGT TVTVS S |
| VH1|1-18D5|5-12|RF3|JH4 | | | | | | | | |
| iPS:3 93044 | 21-225_25B8 | VH1|1-18D5|5-12|RF3|JH4 | QVQLVQS-GAEVKKPGASVKV SCKASG-YTFT | S------YGIS | WVRQAPGQ GLEWMG | WISAY----NGNTTYAQK LRG | RVTMTIDTSTAYMDLRSL RSEDTAVYYCAR | TAAGYS----SSWFDY | WGQGT LVTVS S |
| iPS:3 93050 | 21-225_28C5 | VH1|1-18D5|5-12|RF3|JH4 | QVQLVQS-GAEVKKPGASVKV SCKASG-YTFT | S------YGIS | WVRQAPGQ GLEWMG | WISAY----NGNTTYAQK LRG | RVTMTIDTSTAYMDLRSL RSEDTAVYYCAR | TAAGYS----SSWFDY | WGQGT LVTVS S |
| VH3J3-33D6|6-6|RF1|JH3 | | | | | | | | |
| iPS:3 93046 | 21-225_25A12 | VH3|3-33D|6-6|RF1|JH3 | QVQLVQS-GGGVVQPGRSLRL SCAASG-FTFS | N------CVMH | WVRQAPGK GLEWVA | VIWYD----GSNKYADS VKG | RFTISRDNSKKTLYLQMNSL RAEDTAVYYCAR | EEYSSGW----YDYGMDV | WGQGT MVTVS S |
| VH3J3-21D4|4-11|RF3|JH6 | | | | | | | | |
| iPS:3 93078 | 21-225_33H11 | VH3|3-21D|4-11|RF3|JH6 | EVQLVES-GGGLVKPGGSLRL SCAASG-FTFS | S------YSMN | WVRQAPGK GLEWVS | SISGS----SSYIYYADS VKG | RFTISRDMAKNSLYLQMSSL RAEDTAVYYCAR | TNG-----MDV | WGQGT TVTVS S |

FIGURE 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 93142 | 21-225_33A3 | VH3/3-21/D4/4-11/RF3/JH6 | EVQLVES-GGGLVKPGGSLRLSCAASG-FTFS | S------YGMN | WVRQAPGK GLEWVS | SISGS----STYIYYADS VKG | RFTISRDNAKNSLYLQMNSL RAEDTAVYYCAR | TNG---------MDV | WGQGT TVTVS S |
| | Germline | | | | | | | | |
| iPS:3 93096 | 21-225_34D11 | VH3/3-23/D6/6-19/RF2/J H6 | EVQLSES-GGGLVQPGGSLRLSCAASG-FTFS | S------IAMN | WVRQAPGK GLEWVS | AISGR----GGSIFHADS VKG | RFTISRDNSKNTLYLQMNSL RAEDTAVYCVK | GELVEDY------YYYGMDV | WGQGT TVTVS S |
| | Germline | | | | | | | | |
| iPS:3 93172 | 21-225_3B12 | VH3/3-30.3/D4/4-23/RF2/J H3 | QVQLVES-GGGVVQPGRSLRLSCAASG-FTFS | Y------YGMH | WVRQAPGK GLEWVA | VISYD----GSNKYYADS VKG | RFTISRDNSKNTLHLQMNSL RAEDTAVYYCAR | DRKGGYG------VPDAFDI | WGQGT MVTVS S |
| | Germline | | | | | | | | |
| iPS:3 93174 | 21-225_15D8 | VH3/3-30.3/D4/4-23/RF2/J H6 | QVQLVES-GGGVVQTGRSLRLSCAASG-FTFS | G------YGMH | WVRQAPGK GLEWVS | VISYD----GSNKYYADS VKG | RFTISRDNSKNTLYLQMNSL RAEDTAVYYCAR | DRVCSSTSCV------PYYDYGMDV | WGQGT TVTVS S |
| | Germline | | | | | | | | |
| iPS:3 93194 | 21-225_16D2 | VH3/3-15/D7/7-27/RF1/J H6 | EVQLVES-GGGLVKPGGSLRLSCAASG-FTFS | N------AWMN | WVRQAPGK GLEWVG | RIKSKT-DGGTTDYAA PVKG | RFTISRDDSKNTLYLQMNSL KTEDTAVYYCTT | DTGPIAARLA------YYYYYAMDV | WGQGT TVTVS S |
| iPS:3 98488 | 21-225_19F6 | VH3/3-15/D7/7-27/RF1/J H6 | EVQLVES-GGGLVKPGGSLRLSCAASG-FTFS | N------AWMN | WVRQAPGK GLEWVG | RIKSKT-DGGTTDYAA PVKG | RFTISRDDSKNTLYLQMNSL KTEDTAVYYCTT | DTGPIAARLA------YYYYYAMDV | WGHGT TVTVS S |
| iPS:3 98544 | 21-225_7C8 | VH3/3-15/D7/7-27/RF1/J H6 | EVQLVES-GGGLVKPGGSLRLSCAASG-FTFS | N------AWMN | WVRLAPGK GLEWVG | RIKSKT-DGGTTDYAA PVKG | RFTISRDESENTLYLQMNSL KTEDGVYYCST | DTGPIAARLA------YYYYYAMDV | WGQGT TVTVS S |
| iPS:4 02231 | 21-225_6D9 | VH3/3-15/D7/7-27/RF1/J H6 | EVQLVES-GGGLVKPGGSLRLSCAASG-FTFS | N------AWMN | WVRLAPGK GLEWVG | RIKSKT-DGGTTDYAA PVKG | RFTISRDDSENTLYLQMNSL KTEDTAVYYCST | DTGPIAARLA------YYYYYAMDV | WGQGT TVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3/3-23/D4/4-11/RF2/JH4 | | | | | | | | |
| iPS:3 93870 | 21-225_7B1 | VH3/3-23/D4/4-11/RF2/JH4 | EVQLLES-GGGLVQPGGSLRL SCAASG-FTFS | S------YDMS | WVRQAPGK GLEWVS | TISGS---- GGITYYADS VKG | RFTISRDNSKKTLYLQMNSL RAEDTAVYYCAR | DRG--------SY | WGQGT LVTVS S |
| VH4/4-39/D4/4-17/RF2/JH1 | | | | | | | | |
| iPS:3 93872 | 21-225_2A11 | VH4/4-39/D4/4-17/RF2/JH1 | QLQLQES-GPGLVKPSETLSL TCTVSG-GSIS | RS---SYYWG | WIRQFPGK GLEWIG | MIYY---- SGSTYYNPS VKS | RVTISVDTSKNQFSLKLSTV TAADTAVYYCAR | HGKDW-------GLED | WGQGT LVTVS S |
| VH4/4-59/D6/6-6/RF1/JH4 | | | | | | | | |
| iPS:3 93890 | 21-225_4B1 | VH4/4-59/D6/6-6/RF1/JH4 | QVQLQES-GPGLVKPSETLSL TCHVSG-DSIS | S------YSWS | WIRQPAGK GLEWIG | RIYT---- SGSTNYIPS LKS | RITMSVDTSKKQFSLKLSSV TAADTAVYYCAR | DLKSSG-----CLFFDY | WGQGT LVTVS S |
| VH3/3-33/D4/4-17/RF1/JH6 | | | | | | | | |
| iPS:3 93926 | 21-225_4G4 | VH3/3-33/D4/4-17/RF1/JH6 | QVQLVES-GGGVVQPGPGSLRL SCAASG-FTFS | S------YGNH | WVRQAPGK GLEWGA | VIWHD---- GSNKYYADS VKG | RFTISRPDNAKNTLYLQMNSL RAEDTAVYYCAR | DLRMG-------GMDV | WGQGT TVTVS S |
| VH3/3-23/D6/6-6/RF2/JH2 | | | | | | | | |
| iPS:3 93936 | 21-225_14A11 | VH3/3-23/D6/6-6/RF2/JH2 | EVQLLES-GGGLVQPGGSLRL SCAASG-FTFS | S------YAMN | WVRQAPGK GLEWVS | VISGR---- GGSTYYADS VKG | RFTISRDNSKNTLYLQMNSL RAEDTAVYYCAR | RIAAGM-----EYFDL | WGRGT LVTVS S |
| VH3/3-21/D1/1-1/RF3/JH4 | | | | | | | | |
| iPS:3 93988 | 21-225_7F10 | VH3/3-21/D1/1-1/RF3/JH4 | EVQLVES-GGGLVKPGGSLRL SCAASG-FTFS | S------YSMN | WVRQAPGK GLEWVS | SISSS---- SSTYYADS VKG | RFTISRDNAKNSLYLQMNSL RTEDTAVYYCAR | ANL--------FDY | WGQGT LVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| | VH4|4-39|D6|6-6|RF1|JH4 | | | | | | | |
| iPS.3 93990 | VH4|4-39|D6|6-6|RF1|JH4 | QLQLQES-GPGLVKPSETLSL TCTVSG-GFIS | RS---TYYWG | WIRQPPGK GLEWIG | SIYY----SGSTSYSPS LKS | RVTISVDISRNQFSLKLSSV TAADTAVYYCAR | LNSSW-------SFDY | WGQGT LVTVS S |
| | Germline | | | | | | | |
| | VH3|3-30.3|D2|2-15|RF3|JH6 | | | | | | | |
| iPS.3 94010 | VH3|3-30.3|D2|2-15|RF3|JH6 | QVQLVES-GGGVVQPGRSLRL SCAASG-FTFS | N------YGIY | WVRQAPGK GLEWVA | VISYD----GSNKYYADS VKG | RFTISRDNSKNTLYLQMNSL RAEDTAVYYCAR | DRGAVAAY----YYYGIDV | WGQGT TVTVS S |
| | Germline | | | | | | | |
| iPS.3 94065 | VH1|1-08|D2|2-21|RF1|JH4 | QVQVVQS-GAEVKKPGASVKV SCKASG-YTFT | N------YDIN | WVRQATGQ GLEWMG | WMNTN----SGNTGYAQK FQG | RVTMTRNTSISTAYMDLSSL RSEDTAVYYCAY | SHGWF-------LFDY | WGQGT LVTVS S |
| iPS.3 98506 | VH1|1-08|D2|2-21|RF1|JH4 | QVQLVQS-GAEVKKPGASVKV SCKASG-YTFT | N------YDIN | WVRQAPGK GLEWVA | WMYPN----SGNTYYAQK FQG | RVTMTMNTSISTAYMELSSL RSEDTAVYYCAI | SGGWY-------YFDY | WGQGT LVTVS S |
| iPS.3 98512 | VH1|1-08|D2|2-21|RF1|JH4 | QVQLVQS-GAEVKKPGASVKV SCKASG-YTFT | N------YDIN | WVRQATGQ GLEWMG | WMNPN----SGNTGYAQK FQG | RVTMTRNTSISTAYLELSSL RSEDTAVYYCAG | SNGWY-------YFDY | WGQGT LVTVS S |
| | Germline | | | | | | | |
| iPS.3 94091 | VH3|3-33|D7|7-27|RF2|JH3 | QVQLVES-GGGLVQPGRSLRL SCAASG-FTFS | S------YGMH | WVRQAPGK GLEWVS | VIWYE----ESNKYYVDS VRG | RFTISRDNSKSILYLQMNSL RAEDTAVYYCVR | ELGF--------QSDF | WGQGT PVTVS S |
| | Germline | | | | | | | |
| iPS.3 98472 | VH3|3-23|D4|4-23|RF2|JH6 | EVQLLES-GGGLIQPGGSLRL SCAASG-FTFS | S------YVMS | WVRQAFGK GLEWVS | IISVG----GGTTYYADS VKG | RFTISRDMSKNTLYLQMNSL RAEDTAVYYCAK | WGRGNSYE----YYYGMDV | WGQGT TVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH2|2-05|D6|6-19|RF2|JH4 | | | | | | | | |
| iPS.3 98498 | VH2|2-05|D6|6-19|RF2|JH4 | QITLKES-GPTLVKPTQTLTL TCIFSG-FSLS | TG----GVGVG | WIRQFPGK ALEWLA | LIYW----NDDKRYSPS LKS | RLTITRDISKNQVLTMINM DPVDTATYYCAR | TIAVR------GFDY | WGQGT LVTVS S |
| VH1|1-48|D5|5-24|RF2|JH4 | | | | | | | | |
| iPS.3 98536 | VH1|1-08|D5|5-24|RF2|JH4 | QVQLVQS-GAEVKKPGASVKV SCKASG-YTFT | S------YDIS | WVRLAIGQ GLEWMG | WMNPN----SGNTIGYAQK FQG | RVTMTRNTSISTAYMELSSL RSEDTAVYYCAR | KRA-------NDY | WGQGT LVTVS S |
| VH2|2-05|D6|6-6|RF1|JH4 | | | | | | | | |
| iPS.3 98546 | VH2|2-05|D6|6-6|RF1|JH4 | QITLKES-GPTLVKPTQTLTL TCIFSG-FSLT | TS----GVGVG | WIRQPPGK ALEWLA | LIYW----SDDKRYSPS LKS | RLTITKDTSKNQVLTMTNM APVDTATYYCAR | TGSSC------CYFDY | WGQGT LVTVS S |
| VH3|3-21|D1|1-1|RF2|JH6 | | | | | | | | |
| iPS.4 02229 | VH3|3-21|D1|1-1|RF2|JH6 | EVQLVES-GGGLVKPGGSLRL SCAASG-FTFS | S------YSMN | WVRQAPGK GLEWVS | SISGS----SSIYYADS VKG | RFTISRDNAKNSLYLQMNSL RAEDTAVYYCAR | VNG---------MDV | WGQGT TVTVS S |
| VH3|3-21|D4|4-11|RF3|JH5 | | | | | | | | |
| iPS.4 02233 | VH3|3-21|D4|4-11|RF3|JH5 | EVQLVES-GGGLVKPGGSLRL SCAASG-FTFS | I------YNLN | WVRQAPGK GLEWVS | SISGG----AGHIYYSDS VKG | RFTISRDNAKNSLYLQMNSL RAEDTAVYYCAR | ING--------FDF | WGQGT LVTVS S |
| VH3|3-21|D1|1-1|RF1|JH3 | | | | | | | | |
| iPS.4 02235 | VH3|3-21|D1|1-1|RF1|JH3 | EVQLVES-GGGLVKPGGSLRL SCAASG-FTFS | S------YSMN | WVRQAPGK GLEWVS | SISI----STFIYYAQS VKG | RFTISRDNAKNSLYLQMNSL RAEDTAVYYCAR | KAG--------LDI | WGQGT MVTVS S |

FIGURE 51 (Continued)

| | Germline | H_FR1 | H_CDR1 | H_FR2 | H_CDR2 | H_FR3 | H_CDR3 | H_FR4 |
|---|---|---|---|---|---|---|---|---|
| | VH3/3-23/D5/5-12/RF1/JH3 | | | | | | | |
| iPS:4 03870 | VH3/3-23/D5/5-12/RF1/JH3 | EVQLLES-GGGLVQPGGSLRL SCAASG-FTFS | S------YAMS | WVRQAPGK GLEWVS | VISGR---GGSIYYADS VKG | RFTISRDNSKNTLYLQMNSL RAEDTAVYYCAR | RGIVGA------TEAFDI | WGQGT MVTVS S |
| | VH4/4-39/D4/4-11/RF1/JH4 | | | | | | | |
| iPS:4 03872 | VH4/4-39/D4/4-11/RF1/JH4 | QLQLQES-GPGLVQPSETLSL TCTVSG-VSIS | RT---SYYWG | WLRQPPGK GLEWIG | NIYY---SGSAYNNPS LKS | RVTISVDTSKNQPSLKLSSV TAADTAVYYCGR | HGQDW------GLDY | WGQGT LVTVS S |
| | VH1/1-08/D3/3-9/RF2/JH6 | | | | | | | |
| iPS:4 37240 | VH1/1-08/D3/3-9/RF2/JH6 | QVQLVQS-GAEVKKPGASVKV SCKASG-YTFT | S------YDIN | WVRQATGQ GLEWMG | WLNPH---SGNTGYAQK FQG | RITMTWNTSIRTAYMELSSL RSEDTAVYYCAR | GFYDILTGYS------PTYYYYDMDV | WGQGT TVTVS S |
| iPS:4 34577 | VH1/1-08/D3/3-9/RF2/JH6 | QVQLVQS-GAEVKKPGASVKV SCKASG-YTFT | S------YDIN | WVRQATGQ GLEWMG | WLNPH---SGNTGYAQK FQG | RITMTWNTSIRTAYMELSSL RSEDTAVYYCAR | GFYDILTGYS------PTYYYYDMDV | WGQGT TVTVS S |
| iPS:4 34553 | VH1/1-08/D3/3-9/RF2/JH6 | QVQLVQS-GAEVKKPGASVKV SCKASG-YTFT | S------YDIN | WVRQATGQ GLEWMG | WLNPH---SGNTGYAQK FQG | RITMTWNTSIRTAYMELSSL RSEDTAVYYCAR | GFYDILTGYS------PTYYYYDMDV | WGQGT TVTVS S |
| iPS:4 34927 | VH1/1-08/D3/3-9/RF2/JH6 | QVQLVQS-GAEVKKPGASVKV SCKASG-YTFT | S------YDIN | WVRQATGQ GLEWMG | WMNPN---SGNTGYAQK FQG | RVTMTWNTSIRTAYMELSSL RSEDTAVYYCAR | GFYDILTGYS------PTYYYYDMDV | WGQGT TVTVS S |
| | VH3/3-23/D6/6-19/RF2/JH4 | | | | | | | |
| iPS:4 35477 | VH3/3-23/D6/6-19/RF2/JH4 | EVQLLES-GGGLVQPGGSLRL SCAASG-FTFS | S------YAMS | WVRQAPGK GLEWVS | AISGS---GGNTFYADS VKG | RFTISRDNSKNTLYLQMNSL RAEDTAVYYCAI | HGIAVAGT------GAHYFDY | WGQGT LATVS S |
| iPS:4 35385 | VH3/3-23/D6/6-19/RF2/JH4 | EVQLLES-GGGLVQPGGSLRL SCAASG-FTFS | S------YAMS | WVRQAPGK GLEWVS | AISGS---GGNTFYADS VKG | RFTISRDNSKNTLYLQMNSL RAEDTAVYYCAI | HGIAVAGT------GAHYFDY | WGQGT LATVS S |

Figure 52 - Table 5
Standard IgG Antibody Variable Region Consensus Protein Alignment
CDRs defined by Kabat
Alignment numbering defined by Amgen Reference (AHo)

| KAPPA_VARIABLE | | | | | | | | | |
|---|---|---|---|---|---|---|---|---|---|
| VK4|B3|H3 | Germline | K_FR1 | K_CDR1 | K_FR2 | K_CDR2 | K_FR3 | K_CDR3 | | K_FR4 |
| | | DIVMTQSPDSLA VSLGERATINC | KSS QSVLYSSNNK NYLA | WYQQKPGQ PPKLLIY | WASTRES | GVPDRFSGSG SGTDFTLTISSLQAEDVAV YYC | QQYYS | TPFT | FGQGTK VEIK |
| iPS:42 6126 | 21-225_6G6 | VK4|B3/J K3 | . . . . . . . . . . . . . . . . . . . . . . | . . . . . . . Y . . . . . . . HN | . . . . . . . N . . F | . . . . . . . | . . . . . . . . . . . N . . . . . . . . . . . . . . . . . . . . . . | . . . . D . | . . F . | . . H . . |
| iPS:41 21-225_4A2 2232 | | VK4|B3/J K3 | . . . . . . . . . . . . . . . . . . . . . . | . . . . . . . N . . . . . . I . H . | F . . . . . L . | . . . . . . . | . . . . . . . . . . . . . . . . . . . . . . . . . . . . . . . . . P . | . . . . N . | . . . V . | . G . . . |
| iPS:45 1141 | 21-225_164B11 | VK4|B3/J K3 | . . . . . . . . . . . . . . . . . . . . . . | . . . . . . . S . . . . . . L . K . | S . . . . . . . L . . . . . . | . . . . S . . | . . . . . . . . . . . . . . . . . . . . . . . . . . . . . . . . . . . | . . . . . . | . . I . P . | . . H . N . . T |
| iPS:42 3314 | 21-225_12F11 | VK4|B3/J K3 | . . . . . . . . . . . . . . . . . . . . . . | . . . . . . . Y . . . . . . . H . | . . . . . . N . . F | . . . . . . . | . . . . . . . . . . . N . . . . . . . . . . . . . . . . . . . . . . | . . . . D . | . . F . | . . . T |
| iPS:43 5327 | 21-225_147G6 | VK4|B3/J K3 | . . . . . . . . . . . . . . . . . . . . . . | . . . . . . . SN . . . . . . R . H . | . . . . . . . | . . . . A . . | . . . . . . . . . . . . . . . . . . . . . . . . . . . . . . . . . . . | . . . . T . | . . P . | . . . . . |
| iPS:43 5345 | 21-225_148G3 | VK4|B3/J K3 | . . . . . . . . . . H . . . . . . . . . . . | . . . . . . . Y . . . . . . . . . | . . . . . . . | . . . . D . . | . . . . . . . . . . . . . . . . . . . . . . . . . . . . . . . . . L . | . . . . . . | . . . L . | . . . . . |
| iPS:43 5405 | 21-225_150B7 | VK4|B3/J K3 | . . . . . . . . . . . . . . . . . . . . . . | . . . . . . H . N . . . . . . N . | . . . . . . . | . . . . K . . | . . . . . . . . . T . . . . . . . . . . . . . . . . . . . . . . . . . | . . . . . . | . . . . . | . . . . . |
| iPS:43 5433 | 21-225_152E3 | VK4|B3/J K3 | . . . . . . . . . . . . . . . . . . . . . . | . . . . . . . Y . . V . . . . H . | S . R . . . . | . . . . . . . | . . . . S . . . . . . . . . . . . . . . . . . . . . . . . . . . . A . | . . FN . . | . . P . | . . . . . |
| iPS:43 5437 | 21-225_152F4 | VK4|B3/J K3 | . . . . . . . . . . . . . . . . . . . . . . | . . . . . . . Y . . . . . . . . . | . . . . . . . | . . . . K . . | . . . . . . . . . . . V . . . . . . . . . . . . . . . . . . . . . L . | . . . S . . | . . P . | . . . N . |
| iPS:43 5649 | 21-225_165H2 | VK4|B3/J K3 | . . . . . T . . . . . . . . . . . . . . . . | . . . . . . . . T . . . . . . H . | . . . . . . . | . . . . . . . | . . . . . . . . . . . V . . M . DD . . . . . . . . . . . . . . . . R | . . . . . . | . I . P . | . . . . . |
| iPS:43 5855 | 21-225_191G3 | VK4|B3/J K3 | . . . . . P . . . . D . . . . . . . . . . . | . . . . . . . SY . . . . . . . . . | . . . . . . . | . . . . . . . | . . . . . . . . . . . . . . . . . . . . . . . . . . . . . . . . . F . | . . . . . . | . . S . P . | M . . . . |
| iPS:43 5903 | 21-225_190E2 | VK4|B3/J K3 | . . . . . . . . . . . . . . . . . . . . . . | . . . . . . . . . . . . . . . FN | . . . . N . . | . . . . . . . | . . . . . . . . . . . . . . . . . . . . . . . . . . . . . . . . M . . | . . . C . . | . . L . | . . . . . |
| iPS:43 5915 | 21-225_190H4 | VK4|B3/J K3 | AN . . . . . . . . . . . . . . . . . . . . | . . . . . . . Y . . . . . . . H . | . R . . . . . | . . . . . . . | . . . . . . . . . . . . . . . . . . . . . . . . . . . . . . . . . . . | . . . . . . | . . i . P . | . . R . |
| iPS:43 5923 | 21-225_190H6 | VK4|B3/J K3 | . . . . . . . . . . . . . . . . . . . . . . | . . . . . . . . . . . . . . . FN | N . . . . . . | . . . . . . . | . . . . . . . . . . . . . . . . . . . . . . . . . . . . . . . . . C . | . . . C . . | . . L . | . . R . |
| iPS:43 5953 | 21-225_191B12 | VK4|B3/J K3 | . . . . . . . . . . . . . . . . . . . . . . | . . . . . . . . . . . . . . . FN | . . . . N . . | . . . . . . . | . . . . . . . . . . . N . . . . . . . . . . . . . . . . . . . . . I . | . . . S . . | . . L . | . . . . . |
| iPS:43 6098 | 21-225_195G11 | VK4|B3/J K3 | . . . . . . . . . . . . . . . . . . . . . . | . . . . . . . . . . . . . . . FN | . . . . N . . | . . . . L . . | . . . . . . . . . . . . . . . . . . . . . . . . . . . . . . . . . M . . | . . . C . . | . . F . | . . R . |

FIGURE 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:43 6102 | 21-225_196B1 | VK4|B3/JK3 | .........F. | ....R....I.F. | ............. | ............. | ............. | S............. | ............. |
| iPS:43 6104 | 21-225_196C1 | VK4|B3/JK3 | ............. | ............FN | ............. | ............. | ............. | .....C....... | .....L....... |
| iPS:43 6156 | 21-225_197C8 | VK4|B3/JK3 | ........P... | ......H...... | .L.N......L.. | ............I | ..........M. | ....S.T...... | ....F....R... |
| iPS:43 6270 | 21-225_203F10 | VK4|B3/JK3 | ............. | .......FFH.... | ............. | ............. | ..........S.. | .....F....I.. | .........N... |
| iPS:43 6570 | 21-225_225F4 | VK4|B3/JK3 | ............. | ............. | ............. | ............. | .....T........ | ....F....L.... | .........T.... |
| iPS:43 6570 | 21-225_225F4 | VK4|B3/JK3 | ............. | ..N..R..S.... | .....R........ | ............. | ....CV.P...... | ..H..HN.....S.P | .....H.E...... |
| iPS:39 4065 | 21-225_11E2 | VK4|B3/JK3 | ............. | .......H..... | ............. | ............. | ............. | .....F........ | ............. |
| Germline | | K_FR1 | K_CDR1 | K_FR2 | K_CDR2 | K_FR3 | K_CDR3 | K_FR4 |
| VK1|A30|JK5 | | DIQMTQSPSSL SASVGDRVTITC | RAS_QGIR NDLG | WYQQKPGK APKRLIY | AASSLQS | GVPSRFSGSG SGTEFTLTISSLQPEDFA TYYC | LQHNS YPLT | FGQGTK LEIK |
| iPS:47 3253 | 21-225_7C3_LC1 | VK1|A30/JK5 | ............. | .......S..... | ....N.V....... | ............. | ............V | ............YL | ............. |
| iPS:47 3256 | 21-225_9F12_LC2 | VK1|A30/JK5 | ............. | ............. | .....V........ | ............. | ............. | ............YL | ............. |
| iPS:45 3449 | 21-225_208A2 | VK1|A30/JK5 | ............. | ............. | .......Q...... | ......T....... | ............. | .............P | ............. |
| iPS:43 4467 | 21-225_73H8 | VK1|A30/JK5 | ..........Y. | ....T...D.... | ............. | ..........L... | ..........S... | ....Y.......... | ............V |
| iPS:43 5045 | 21-225_90H5 | VK1|A30/JK5 | ..........R. | ............. | ............. | ............. | ............R.D | .....I......YP | ............. |
| iPS:43 5561 | 21-225_159F1 | VK1|A30/JK5 | ............. | ....RV....... | ...A.D........ | ............. | ............. | ........H..... | ............. |
| iPS:43 6328 | 21-225_207F12 | VK1|A30/JK5 | ............. | ............. | ....I.F......I | ............. | ............F | ............F | ............. |
| iPS:43 6354 | 21-225_210G10 | VK1|A30/JK5 | .........F. | .....T....... | ...Q.......... | ......T.N..... | ..........R.D | ......Y.......P | ............. |
| iPS:39 3094 | 21-225_34C4 | VK1|A30/JK5 | ............. | ............. | .T.M.......... | ......T.N..... | ............. | ........S...L | ............. |
| iPS:39 8484 | 21-225_18D4 | VK1|A30/JK5 | ............. | ............. | ....E......... | ............. | ............V | ......H.N...YL | ............. |
| Germline | | K_FR1 | K_CDR1 | K_FR2 | K_CDR2 | K_FR3 | K_CDR3 | K_FR4 |
| VK1|L5|JK3 | | DIQMTQSPSSLSASVGDRVTITC | RASQGISSYLA | WYQQKPGKAPKLLIY | AASSLQS | GVPSRFSGSGSGTDFTLTISSLQPEDFATYYC | QQANS FPFT | FGPGTK VDIK |

| | | | | | | | | | | |
|---|---|---|---|---|---|---|---|---|---|---|
| iPS:43 4167 | 21-225_50F3 | VK1L5/J K3 | | | .D | | | | T | |
| iPS:43 4189 | 21-225_56E5 | VK1L5/J K3 | | | .R | | | | | |
| iPS:43 4193 | 21-225_56C6 | VK1L5/J K3 | | | .K | S.N | | I.S | Y | |
| iPS:43 4195 | 21-225_56F6 | VK1L5/J K3 | .Y | V..D | | .R | | F | | |
| iPS:43 4273 | 21-225_57E4 | VK1L5/J K3 | .S | | .K | F.V | .G | | | |
| iPS:43 4277 | 21-225_57A7 | VK1L5/J K3 | | | .N | | | G | S | |
| iPS:43 4355 | 21-225_64G12 | VK1L5/J K3 | | | .R | .S | .N | | I | L |
| iPS:43 4389 | 21-225_66F11 | VK1L5/J K3 | | C | .E.N.T | | | .V.Y | | |
| iPS:43 4423 | 21-225_70D1 | VK1L5/J K3 | | C | .I | | | | | |
| iPS:43 5291 | 21-225_146E1 | VK1L5/J K3 | K | | .R | | | .V | | |
| iPS:43 5303 | 21-225_146A6 | VK1L5/J K3 | | .A | .N.V | | | .R | | |
| iPS:43 5335 | 21-225_147D10 | VK1L5/J K3 | | .A | .N | | | | | |
| iPS:43 5339 | 21-225_147D12 | VK1L5/J K3 | | .A | .N.T | .E | | .S | | |
| iPS:43 5343 | 21-225_148E2 | VK1L5/J K3 | | .A | .N | | | .S | | TD |
| iPS:43 5379 | 21-225_148B6 | VK1L5/J K3 | | | .I | .R | | .S | | G |
| iPS:43 5381 | 21-225_149C6 | VK1L5/J K3 | | .A | .N | | .G | .S | Y | TD |
| iPS:43 5391 | 21-225_149F8 | VK1L5/J K3 | | | .N | | | .S | NE | TD |
| iPS:43 5395 | 21-225_149D11 | VK1L5/J K3 | | .A | .N.T | | | .S | I | TD |
| iPS:43 5403 | 21-225_150C5 | VK1L5/J K3 | | .G | .N | | .G | .S | | TD |
| iPS:43 5447 | 21-225_152H7 | VK1L5/J K3 | | .A | .D | | | .S.T | NE | TD |
| iPS:43 5453 | 21-225_152G10 | VK1L5/J K3 | | .A | .N | .S | .G | .S | | TD |

FIGURE 52 (Continued)

| | | | | | | | | | | |
|---|---|---|---|---|---|---|---|---|---|---|
| iPS:43 5483 | 21-225_155A4 | VK1|L5/J K3 | . . . . . | . . . . . | . . . . . | . . . . . | . . . . . | . . . S . | . . . . . | H.TD. . . . . |
| iPS:43 5485 | 21-225_155B4 | VK1|L5/J K3 | . . A . . | . . . N . | . . . . . | . . . . . | . . . . . | . . . S . | . . . N . | H.TD. . . . . |
| iPS:43 5787 | 21-225_180A3 | VK1|L5/J K3 | . . A . . | . . . D . | . . . . . | . . . . . | . . . . . | I . . . . | . . F.H. | . . . . . . . . I . |
| iPS:43 5809 | 21-225_182H5 | VK1|L5/J K3 | . . Y . . | . . D.T . | . . . . . | . . . . . | . . . . . | I..T.V.D | . . . . . | . . . V . . . . . |
| iPS:43 5889 | 21-225_186A11 | VK1|L5/J K3 | . . . . . | . . D.T . | . . . . . | . . . . . | . . . . . | I..T.V.D | . . . . . | . . . V . H . . . |
| iPS:43 5965 | 21-225_192H2 | VK1|L5/J K3 | . . . . . | . . . I . | . . . . . | . . G . . | . . . . . | . . . . . | . . . S . | . . . . . . . . . |
| iPS:43 6106 | 21-225_196F2 | VK1|L5/J K3 | . . . . . | . . . . . | . . . . . | . . . . . | . . . . . | . . . . . | . . . T . | . . . V . . . . . |
| iPS:43 6360 | 21-225_210H11 | VK1|L5/J K3 | . . . . . | . . . I . | . . N . . | . . . . . | . . . . . | . . . R . | . . . . . | . . . K . . . . . |
| iPS:43 6488 | 21-225_221A6 | VK1|L5/J K3 | . . . . . | . . . . . | . . . . . | . . T . N | . . . . . | . . . . . | . . . . . | . . . . . . . . . |
| iPS:43 6494 | 21-225_221F12 | VK1|L5/J K3 | . . . . . | . . . . . | . . . . . | . . T . N | . . . . . | . . . . . | . . . . . | . . . . . . . . . |
| iPS:43 6496 | 21-225_222E1 | VK1|L5/J K3 | . . . . . | . . . . . | . . . . . | . . T . N | . . . . . | . . . . V | . . . R . | . . . . . . . R . |
| iPS:43 6508 | 21-225_222F7 | VK1|L5/J K3 | . . C . . | . . V . . | . . . . . | . . . . . | . . . . . | . . . . . | . . . . . | . . . . . . . . . |
| iPS:43 6516 | 21-225_222C12 | VK1|L5/J K3 | . . . . . | . . . . . | . . L.V. | . . T . N | . . . . . | . . V.R. | . . . . . | . . D . . . R . |
| iPS:43 7234 | 21-225_64E2 | VK1|L5/J K3 | . . . . . | . . R . . | . . . . . | . . . . . | . . . . . | . . . T . | . . . . . | . . . . . . . . . |
| iPS:39 2996 | 21-225_28B1 | VK1|L5/J K3 | . . . . . | . . A.N. | . . . . . | . . . F . | . . . . . | . IS . . | . . . . . | . . . S . . . . . |
| iPS:39 3010 | 21-225_25E11 | VK1|L5/J K3 | . . . . . | . . . D . | . . . . . | . . T . . | . . . . . | . . . . . | . . . . . | . . . . . . . I . |
| iPS:39 3016 | 21-225_28F11 | VK1|L5/J K3 | . . . . . | . . . N . | . . . . . | . . . . G | . . . . . | . . . . . | . . . . . | . . . . . . . . . |
| iPS:39 3024 | 21-225_31H9 | VK1|L5/J K3 | . . . . . | . . . T . | . . R . . | . . D . . | . . . . . | . . . T . | . . . . C | . . G . . . Q . . |
| iPS:39 3030 | 21-225_34F3 | VK1|L5/J K3 | . . S . . | . . . K . | . . . . . | . . T . . | . IF . . | . . . . . | . . . . . | . . . . . . . L . |
| iPS:39 3084 | 21-225_35C6 | VK1|L5/J K3 | . T . . . | . . . K . | . . P . . | . . . . . | . . . . . | . . . T . | . . . S . | . . . . . . . . . |
| iPS:39 3086 | 21-225_36H5 | VK1|L5/J K3 | . . . . . | . . . R . | . . E . . | . . R . . | . . . . . | . . I . . | . . . I . | . . . . . . . . . |

FIGURE 52 (Continued)

Table content not transcribed - dense sequence alignment figure.

| | | K_FR1 | K_CDR1 | K_FR2 | K_CDR2 | K_FR3 | K_CDR3 | K_FR4 |
|---|---|---|---|---|---|---|---|---|
| iPS:43 6616 | 21- 225_226D11 | VK4|B3/J K1 | .........  ...N.H. ...SN...V | ......... | ......... | .........R........... | .........K........... | ......... |
| iPS:43 6622 | 21- 225_226A12 | VK4|B3/J K1 | ......... | .....N... | ....T... | ......K | ......... | ......... | ......... |
| iPS:43 6638 | 21- 225_227C7 | VK4|B3/J K1 | .........R...I..SD ...N. | ....F... | ......... | ......... | ....S.P. | ......... |
| iPS:43 7356 | 21-225_74B1 | VK4|B3/J K1 | .....F.. ....T... | .......HR | ......... | ......... | .........F........... | .........S.P. | ......... |
| iPS:43 7361 | 21-225_74C1 | VK4|B3/J K1 | ....C..P. ......S... | .....Y... | ......... | ......... | ......... | .........P. | ......... |
| iPS:43 7379 | 21-225_74H2 | VK4|B3/J K1 | ......... | .....I.H. .....H... | ...H... | ......... | .........Y........... | ......... | ......... |
| iPS:44 6094 | 21-225_77E1 | VK4|B3/J K1 | ......... | .....T.H. .....T... | ...H... | ......... | .........S..G....... | ......H.L. | ....I.P. |
| iPS:45 1116 | 21- 225_164A4 | VK4|B3/J K1 | .....Y..R. .......K.. | ......... | ....V... | ....T... | .........H........... | .........F........... | .........S.L. |
| iPS:45 1124 | 21-225_74F6 | VK4|B3/J K1 | ......... | .....NI.S. ....T... | ....I... | ......... | .........V........F.. | .........F........... | ....V.L. |
| iPS:45 1127 | 21- 225_164A7 | VK4|B3/J K1 | .....C... | ......H... | ....H... | ....T... | .........S..A....Y.. | ......... | ....I.L. |
| iPS:45 1129 | 21-225_94D2 | VK4|B3/J K1 | ......... | ......H... | ....H... | ......... | .........S..G..H.... | .........H........... | ....I.P. | .......H |
| iPS:45 1133 | 21-225_95H4 | VK4|B3/J K1 | .....C... | .....Y... | ....F... | ......... | .............A....... | .........F........... | ....S.L. | .......T .......Q. |
| iPS:39 2786 | 21-225_24E1 | VK4|B3/J K1 | ......... | ....T ....N...T | ....HN R.N. | ......... | ......... | ......... | ......... |
| iPS:39 2886 | 21- 225_23A12 | VK4|B3/J K1 | ......... | .....N... | ......... | ....T... | ......... | .........D........... | .........P. | ......... |
| iPS:39 2928 | 21-225_25A4 | VK4|B3/J K1 | .....F..K. | .....R....TI.H. .H.N... | ....H... | ......... | .........E........E.. | ......... | .........P. |
| iPS:39 2960 | 21-225_29E6 | VK4|B3/J K1 | .....F... | .H.NY..T | ....H.L. | ....S... | .............E....... | ......... | ....I.P. |
| iPS:39 2992 | 21-225_26C4 | VK4|B3/J K1 | ......... | ....Y...R | ......... | ......... | ......... | ......... | ......... |
| iPS:39 3368 | 21-225_29H8 | VK4|B3/J K1 | ......... | .....R ....Y... | ......... | ......... | .............N....... | ......C... | .........P. |
| iPS:39 3942 | 21-225_11E5 | VK4|B3/J K1 | .....L... | .....N...T | ...R... | ......... | ......... | ......... | ......... |
| iPS:39 8506 | 21- 225_23G12 | VK4|B3/J K1 | ......... | .....N...I.F. | ......... | ......... | .........F........... | .........S........... | .........P. | ......F. |
| Germline | | K_FR1 | K_CDR1 | K_FR2 | K_CDR2 | K_FR3 | K_CDR3 | K_FR4 |

FIGURE 52 (Continued)

Table content not transcribed due to complexity and low legibility of the scanned sequence alignment data.

| | | L | | K | E | T.N | | V | | L.V | |
|---|---|---|---|---|---|---|---|---|---|---|---|
| iPS:43 5563 | 21-225_159H2 | VK1|O12/ JK4 | | | | | | | | | |
| iPS:43 6110 | 21-225_196F4 | VK1|O12/ JK4 | .F.I | | | | | | G | .S | .MR |
| iPS:43 6244 | 21-225_201H10 | VK1|O12/ JK4 | | .P | HN.N | .S | .G | .F | | | .F | .MR |
| iPS:43 6262 | 21-225_203E3 | VK1|O12/ JK4 | | .R | HN.N | .S | | .F | | | .F | .MR |
| iPS:43 6276 | 21-225_204H4 | VK1|O12/ JK4 | ..L | .P | HN.N | .S | | .F | | | .F | .MR |
| iPS:43 6280 | 21-225_204D6 | VK1|O12/ JK4 | .F | .R | R.VH | | G | | V | | .S | .Q |
| iPS:43 6312 | 21-225_206A4 | VK1|O12/ JK4 | .S | | .T | .V | | | | | | |
| iPS:43 6316 | 21-225_206A5 | VK1|O12/ JK4 | | .P | HN.N | .S | .R | .F | | | .F | .MR |
| iPS:43 6338 | 21-225_208E8 | VK1|O12/ JK4 | .F | .R | HN.N | .C | | .F | | | .F | .MR |
| iPS:43 6344 | 21-225_208B11 | VK1|O12/ JK4 | .F | .P | HN.N | .S | | .F | | | .F | .MR |
| iPS:43 6358 | 21-225_210D11 | VK1|O12/ JK4 | | .R | HN.N | .C | | .F | | | .F | .MR |
| iPS:43 7282 | 21-225_207C9 | VK1|O12/ JK4 | .N | | RF | .S | | | A.V | | | .MR |
| iPS:39 2636 | 21-225_17A6 | VK1|O12/ JK4 | | | .N | .H | | | | .I | | |
| iPS:39 2648 | 21-225_16D11 | VK1|O12/ JK4 | | | .T | .H | | | | HT | .S | |
| iPS:39 2664 | 21-225_20F6 | VK1|O12/ JK4 | | | .N | | | | | .H | .S | |
| iPS:39 2738 | 21-225_18G4 | VK1|O12/ JK4 | | | .T | V.H | | | | | | |
| iPS:39 2798 | 21-225_22C7 | VK1|O12/ JK4 | | | .I | | | | | .T | | |
| iPS:39 2922 | 21-225_30G4 | VK1|O12/ JK4 | | | N.I | .V | | .G | | .T | .P | |
| iPS:39 3002 | 21-225_30G1 | VK1|O12/ JK4 | .T | .P | .T.N.F | .H | .T | | | .T | .P | |
| iPS:39 3042 | 21-225_31F1 | VK1|O12/ JK4 | | | N.Y | .D | .H | I.M | .S | .L | P.Y | |
| iPS:39 3066 | 21-225_34D3 | VK1|O12/ JK4 | .H | | .R | | .S | | | | .I | .T |
| | | | | | N.Y | .D | .H | | .F | | | .R |

FIGURE 52 (Continued)

| Germline | | K_FR1 | K_CDR1 | K_FR2 | K_CDR2 | K_FR3 | K_CDR3 | K_FR4 |
|---|---|---|---|---|---|---|---|---|
| iPS:39 3082 | 21-225_34C11 | VK1|O12/ JK4 | ..F..S... | ...N.R... | D..O... | ..E.G....T. | ...F... | TC... | ... |
| iPS:39 3092 | 21-225_33C12 | VK1|O12/ JK4 | T........ | ..NF..... | ........ | ............ | ....K... | ....... | ... |
| iPS:39 3100 | 21-225_36B8 | VK1|O12/ JK4 | T........ | ....I.... | ........ | V.........G | ..N..... | ....... | ...Y..M. |
| iPS:39 3108 | 21-225_34G11 | VK1|O12/ JK4 | T........ | ...N.N... | ........ | V.......... | ........ | T.I.... | ...Y... |
| iPS:39 3122 | 21-225_33B2 | VK1|O12/ JK4 | T...K.... | ..R...... | ........ | G.......... | .....T.. | ....... | ....... |
| iPS:39 3134 | 21-225_34C2 | VK1|O12/ JK4 | TF....... | ...R.I... | ..F..... | V.......... | ......Y. | ....... | ...Y... |
| iPS:39 3136 | 21-225_34D8 | VK1|O12/ JK4 | T........ | ....I.I.. | ........ | V.......... | ........ | ....... | ...M... |
| iPS:39 3840 | 21-225_3F8 | VK1|O12/ JK4 | ..F...... | .......L. | ..R..R.T. | ....RT.....I | ........V | T...... | ...Y...R |
| iPS:39 3844 | 21-225_3G7 | VK1|O12/ JK4 | ......... | ..R...... | .QV.H.... | ............ | ........ | ....... | ....N. |
| iPS:39 3852 | 21-225_12A10 | VK1|O12/ JK4 | V........ | ....N.Y.. | .GR..R... | ....M....S. | ......A. | ....... | ....P...A. |
| iPS:39 3900 | 21-225_10E12 | VK1|O12/ JK4 | ..A...... | ....N.Y.. | ...V.H... | ....RT...T. | ......D. | ....... | ....P...D |
| iPS:39 3920 | 21-225_1H12 | VK1|O12/ JK4 | ......... | ....N.Y.. | ...E..R.. | ....E.RT... | ........N. | .N.... | ....P.. |
| iPS:39 3926 | 21-225_4G4 | VK1|O12/ JK4 | ..A...... | ....T.I.. | .......C. | ........H.. | ........ | ....... | ....P...E |
| iPS:39 3930 | 21-225_7E11 | VK1|O12/ JK4 | ......... | ....N.I.. | ....F.... | ....T...... | .......I | T...... | ....... |
| iPS:39 3932 | 21-225_10F5 | VK1|O12/ JK4 | ......... | .R..N.Y.. | ....E..RT.. | ....T...... | ....G..D. | ....... | ....P.. |
| iPS:39 3964 | 21-225_6G1 | VK1|O12/ JK4 | ......... | ....N.I.. | ....V.... | ....T...N.T | ........ | .PH.... | ....P.. |
| iPS:39 4012 | 21-225_15A3 | VK1|O12/ JK4 | ..L...... | .......F. | ....L.... | ....T...... | ........ | ....... | ....P.. |
| iPS:39 4016 | 21-225_13D4 | VK1|O12/ JK4 | ......... | ....T.I.. | ....F.... | ....T...... | .......S. | T...... | ....L.. |
| iPS:39 4083 | 21-225_16E6 | VK1|O12/ JK4 | ......... | ....N.... | ......... | ....T...... | ........ | T...... | ....... |
| iPS:39 8480 | 21-225_17G4 | VK1|O12/ JK4 | ......... | T...N.... | ......... | ....V...FP. | ........E | .NF.... | ....F... |
| iPS:39 8486 | 21-225_19A1 | VK1|O12/ JK4 | .A....... | T.HT.T... | ....F.... | ....I.N.... | F......I | ....N.. | ....F...I |

FIGURE 52 (Continued)

| | VK2\|A18\|JK4 | | | | | | | | |
|---|---|---|---|---|---|---|---|---|---|
| iPS:45 1139 | 21-225_71A6 | VK2\|A18/ JK4 | . . . . . . . . . . . . . . . . . | . . . . . . . . . | . . . . . . . | . . . . . . . . . | . . . S . . . | . SKQ . . . . | . . . F . . |
| iPS:43 3937 | 21-225_44B10 | VK2\|A18/ JK4 | H . . . . . . . . . . . . . . . . . | E . R . . . . | P . . . . . . | . . . . N . . | . . . . . . . | . . S . . . . | . . F . . . |
| iPS:43 3979 | 21-225_46B9 | VK2\|A18/ JK4 | . . . . . . . . . . . . . . . . . | . . . . . . . | P . . . . . . | . I . H . . . | . M . . . . . | . HS . Q . . | . . . Q . . |
| iPS:43 4201 | 21-225_59A12 | VK2\|A18/ JK4 | . . . . . . . . . . . . . . . . . | E . . . . . . | . . Q . G . . | . . Y . . . . | . . . V . . . | . STQ . . . | . Y . . . . |
| iPS:43 4205 | 21-225_60G2 | VK2\|A18/ JK4 | . . . S . . . . . . . . . . . . . | E . . . . . . | . P . . . . . | . . Y . . . . | . . . . . . . | . S . Q . . . | . . . . . . |
| iPS:43 4223 | 21-225_60C12 | VK2\|A18/ JK4 | . . . . . . . . . . . . . . . . . | E . . . . . . | P . F . . . . | . N . I . . . | . . . . . . . | . S . K . . . | . Y . . . . |
| iPS:43 4233 | 21-225_61B3 | VK2\|A18/ JK4 | . . . . . . . . . . . . . . . . . | E . . . . . . | P . . . . . . | . . N . . . . | . . . . . . . | . S . Q . . . | . . . . . . |
| iPS:43 4303 | 21-225_58H11 | VK2\|A18/ JK4 | . . . . . . . . . . . . . . . . . | E . . . . . . | . F . . . . . | . . Y . . . . | . . . . I . . | . S . Q . . . | . . . . . . |
| iPS:43 5349 | 21-225_148F5 | VK2\|A18/ JK4 | . . . . . . . . . . . . . . . . . | E . . . . . . | P . . . . . . | . . Y V . . . | . . . F . . . | . S . Q . . . | . . . . . . |
| iPS:43 5359 | 21-225_148H10 | VK2\|A18/ JK4 | . . . . . . . . . . . . . . . . . | E . . . . . . | P . . . . . . | . . Y . . . . | . . . . . . . | . S . Q . . . | . . . . . . |
| iPS:43 5417 | 21-225_150D11 | VK2\|A18/ JK4 | . . . . . F . . . . . . . . . . . | E . . . . . . | P . F . . . . | . . . . . . . | . . . . . . . | . . . Q . . . | . . . . . . |
| iPS:43 5469 | 21-225_153G9 | VK2\|A18/ JK4 | . . . . . . . . . . . . . . . . . | E . . . . . . | P . . . . . . | . . N . . . . | . . D . . . . | . N . K . . . | . Y . . . . |
| iPS:43 5733 | 21-225_173C11 | VK2\|A18/ JK4 | . . . . . . . . . . . . . . . . . | E . . . . . . | P . F . . . . | . . H . . . . | . . . . . . . | . S . — . . . | . . . . . . |
| iPS:43 5785 | 21-225_179C2 | VK2\|A18/ JK4 | . . . . . . . . . . . . . . . . . | . . . . . . . | P . . . . . . | . . . . . . . | . . . . . . . | . S . . . QL . . | . . . . . . |
| iPS:39 2618 | 21-225_16F10 | VK2\|A18/ JK4 | I . . . . . . . . . . . . . . . . . | . . H . N . . | P . . . . . . | . . Y . . . . | . E . . A . . | F . S . Q . . . | . . . . . . |
| iPS:39 2860 | 21-225_22H8 | VK2\|A18/ JK4 | . . . . . . . . . . . . . . . . . | . . . F . . . | P . . . H . . | . . N . . . . | . . . V . . . | . S . Q . . . | . . S . . . |
| iPS:39 2888 | 21-225_25A2 | VK2\|A18/ JK4 | . . . . N . . . . . . . . . . . . | . . . . . . . | P . . . . . . | . I . M . . . | . A . L . . . | . STQ . . . | . . F . . . |
| iPS:39 2938 | 21-225_29H4 | VK2\|A18/ JK4 | . . . . . F . . . . . . . . . . . | . . . . . . . | P . F . . . . | . . H . . . . | . . . . . . . | . S . Q . . . | . H . F . . | R . . . |
| iPS:39 2994 | 21-225_26G11 | VK2\|A18/ JK4 | . . . . . . . . . . . . . . . . . | . T . . G . . | P . H . . . . | . . N . . . . | . L . . I . . | . S . K . . . | . . . . . . |

FIGURE 52 (Continued)

| | Germline | K_FR1 | K_CDR1 | K_FR2 | K_CDR2 | K_FR3 | K_CDR3 | K_FR4 |
|---|---|---|---|---|---|---|---|---|
| iPS:39 3012 | VK2|A18/ JK4 | ..L........ | ........E........ | ....P.F.... | ....H.L.. | ............... | ...S.Q.... | ........ |
| iPS:39 3144 | VK2|A18/ JK4 | ............ | ................ | ....P...... | ....N..... | ............... | ..SK-.... | ....R... |
| | VK1|L1/JK3 | DIQMTQSPSSL SASVGDRVTITC | RAS QGIS NYLA | WYQQKPG KAPKLLIY | AASTLQS | GVPSRFSGSGS GTDFTLTISSLQPEDFAT YYC | QQYNS YPYT | FGPGTK VDIK |
| iPS:45 1143 | VK1|L1/ K3 | ....F....... | ................ | .F.....F.. | .G........ | .........K..F...... | ....SC.... | ....H... |
| iPS:46 8814 | VK1|L1/ K3 | .F.......... | ................ | ............ | .FN.H..... | ........N....R...... | ....SG.... | ....T... |
| iPS:43 3901 | VK1|L1/ K3 | ............ | ........N....... | ........N.. | ....T..... | .N......N........... | ....Y..... | ........ |
| iPS:43 3961 | VK1|L1/ K3 | ............ | ........N....... | ........N.. | .......... | .A................. | .H.Y...... | ....K... |
| iPS:43 4059 | VK1|L1/ K3 | ............ | ................ | ........E.. | .....R.... | .A......Q.......... | ....Y..... | ........ |
| iPS:43 4085 | VK1|L1/ K3 | ............ | ................ | ........N.. | .......... | .I......K.......... | ........F. | ........ |
| iPS:43 4115 | VK1|L1/ K3 | ............ | ........V....... | ............ | ....S..... | ........K.......... | ....H..... | ....L... |
| iPS:43 4213 | VK1|L1/ K3 | ............ | ................ | ............ | .......... | ........K.......... | ....K..... | ........ |
| iPS:43 4215 | VK1|L1/ K3 | ....S....... | ......V.K.V..... | ....V....... | .......... | ........T....S...... | .L.FH..... | ....M... |
| iPS:43 4261 | VK1|L1/ K3 | ..L......... | ................ | ............ | ....G..... | ........K.......... | .H........ | ....R... |
| iPS:43 4331 | VK1|L1/ K3 | ............ | ........T....... | ..T.T...... | .......... | ........K.......... | ..H....F.K | ....T... |
| iPS:43 4361 | VK1|L1/ K3 | ............ | ........D.N..... | .H........ | ....H..... | ........Q.A.......S | .....H.... | ........ |
| iPS:43 4405 | VK1|L1/ K3 | ............ | ................ | ..R....... | .......... | ........K.......... | .PL.K...L. | ....R... |
| iPS:43 5259 | VK1|L1/ K3 | ............ | ................ | ............ | ....R.V... | ........K..N...... | ....D..... | ........ |
| iPS:43 5351 | VK1|L1/ K3 | ............ | ......K......... | ....F..... | .......... | ....N.............. | .H..D....F. | ....R... |
| iPS:43 5461 | VK1|L1/ K3 | ............ | ........V....... | ............ | .....R.... | ....................I | ....H..... | ....F... |
| iPS:43 5509 | VK1|L1/ K3 | ............ | ........D.....V. | ..R........ | .......... | ........K.......... | ....H..... | ........ |

FIGURE 52 (Continued)

| | | | | | | | | |
|---|---|---|---|---|---|---|---|---|
| iPS:43_21-225_157E4 5515 | VK1|L1/J K3 | ... | ... | ...R | ...Q | ... | ...H | ... |
| iPS:43_21-225_157G5 5523 | VK1|L1/J K3 | ...F | ...N | ...E | ...N | ... | ... | ... |
| iPS:43_21-225_157H10 5535 | VK1|L1/J K3 | ... | ...T | ... | ...Q | ... | ...H | ... |
| iPS:43_21-225_158H12 5559 | VK1|L1/J K3 | ... | ...N | ... | ...K | ... | ... | ... |
| iPS:43_21-225_159H11 5575 | VK1|L1/J K3 | ... | K.V | ...S | ...K | ... | ...H | ... |
| iPS:43_21-225_160G1 5579 | VK1|L1/J K3 | ... | D.N | ...T | ...N | ... | ... | ...R |
| iPS:43_21-225_160G3 5585 | VK1|L1/J K3 | ... | D.N | ...T.R | ...S | ... | ...H | ... |
| iPS:43_21-225_163F1 5635 | VK1|L1/J K3 | ... | ...D | ...T..S | ...K | ...A | ... | ..AQ |
| iPS:43_21-225_167D12 5659 | VK1|L1/J K3 | ... | ...N | ...E | ...K | ...F | ...H | ... |
| iPS:43_21-225_169D10 5679 | VK1|L1/J K3 | ... | ...D | ... | ...K | ... | ... | ... |
| iPS:43_21-225_170E1 5685 | VK1|L1/J K3 | ...E | ... | ... | ...K | ... | ... | ... |
| iPS:43_21-225_175C4 5747 | VK1|L1/J K3 | ... | ...G | ...G | F..K | ... | ...Y | ... |
| iPS:43_21-225_177D3 5765 | VK1|L1/J K3 | ...S | ...T | ... | ...S | ...F | ...G | ... |
| iPS:43_21-225_181G2 5797 | VK1|L1/J K3 | ..I.E | ... | ..I.T | ...K | ... | R.DI | ... |
| iPS:43_21-225_190F12 5835 | VK1|L1/J K3 | ... | K..G | ... | ...K | ...D | ...SN | ... |
| iPS:43_21-225_190A5 5861 | VK1|L1/J K3 | ... | H..G | ...H | ...K | ...E | ...V | ... |
| iPS:43_21-225_190B1 5869 | VK1|L1/J K3 | ... | ...R | ...V | ...K | ...G | ...LN | ...R |
| iPS:43_21-225_184E7 5877 | VK1|L1/J K3 | ..I.E | ... | ..I.T | ...S | ...F | ...G | ... |
| iPS:43_21-225_185A1 5883 | VK1|L1/J K3 | ...R | ... | ...T..S | I..V.R | ...A | R..H | ...H |
| iPS:43_21-225_185E10 5885 | VK1|L1/J K3 | ..I.E | ... | ..I..V | ...S | ...F | ... | ... |
| iPS:43_21-225_188H5 5891 | VK1|L1/J K3 | ..I.E | ... | ...L..T | ...S | ...F | ...G | ... |

| | | | | | | | | | | |
|---|---|---|---|---|---|---|---|---|---|---|
| iPS:39 2784 | 21-225_23C7 | VK1jL1/J K3 | . . . | . . . | . . . G . | . . . | . . . | K . . . | . . . | . . . |
| iPS:39 2802 | 21-225_23E7 | VK1jL1/J K3 | . . . | . I . | . . . | . . . | . K . | . . . | FY | . N |
| iPS:39 2826 | 21-225_20B9 | VK1jL1/J K3 | . . . | . . . | . . . | . V . | . K . | . . . | . T . | . . . |
| iPS:39 2840 | 21-225_23G1 | VK1jL1/J K3 | . . . | . . . | . . . | . . . | . Q . F | . . . | . . . | . . . |
| iPS:39 2842 | 21-225_23G8 | VK1jL1/J K3 | . . . | . . . | . R . | . . . | . N . | . . . | . . . | . H . |
| iPS:39 2890 | 21-225_20H9 | VK1jL1/J K3 | . . . | . . . | . . . | . S . | . K . | . E . | . . . | . . . |
| iPS:39 2892 | 21-225_20C11 | VK1jL1/J K3 | . . . | . . . | . D . | . . . | . K . R | . . . | . H . | . . . |
| iPS:39 2950 | 21-225_25C10 | VK1jL1/J K3 | . . . | . . . | . . . | . S . | F . K . | . . . | . . . F | . V |
| iPS:39 2952 | 21-225_26G1 | VK1jL1/J K3 | . . . | . . . | . D . | . R . | . N . | . N . | . H . | . . . |
| iPS:39 2962 | 21-225_30A1 | VK1jL1/J K3 | . . . | . . . | . . . | . . . T | . K . | . . . | . . . | . . . |
| iPS:39 2976 | 21-225_27H12 | VK1jL1/J K3 | . . . | . . . | . . . | . S . G | . K . | . . . | . Y . | . N . N |
| iPS:39 3090 | 21-225_33A5 | VK1jL1/J K3 | . . . | . A . | . . . | . S . | . K . | . . . | . . . | . . . N |
| iPS:39 3120 | 21-225_35H8 | VK1jL1/J K3 | . FI . | . A . | . . . | . F . G . G | . K . | . . . F | . . . | . . . F . Q |
| iPS:39 3836 | 21-225_15A2 | VK1jL1/J K3 | . . . | . D . H . V | . N . | . F . | FP . . | . N . | . . . | . . . |
| iPS:39 3870 | 21-225_7B1 | VK1jL1/J K3 | V . . | . . . | . . . | . N . V | . . Q . I | . . . | . Y . | . V |
| iPS:39 3894 | 21-225_5E11 | VK1jL1/J K3 | . . . | . . . | . R . | . T . | . K . N . | . . . | . H . H | . . . |
| iPS:39 3896 | 21-225_2A4 | VK1jL1/J K3 | . . . | . . . | . L . N | . . . | . K . | . F . | . . . | . F . |
| iPS:39 3914 | 21-225_16B8 | VK1jL1/J K3 | . . . | . . . | . . . | . S . | . K . | . . . | . H . H | . . . |
| iPS:39 3968 | 21-225_5A5 | VK1jL1/J K3 | . . . | . Y . | . . . | . V . | . . . | . . . | . . . | . V |
| iPS:39 3992 | 21-225_14H8 | VK1jL1/J K3 | . . . | . . . | . . . | . S . | . K . | . . . | . . . | . . . |
| iPS:39 4018 | 21-225_15B1 | VK1jL1/J K3 | . . . | . . . | . . . | . . . | . N . | . . . | . H . | . N |

FIGURE 52 (Continued)

Table content not transcribed due to complexity and low legibility of sequence alignment data.

FIGURE 52 (Continued)

| | | | | | | | | | | | |
|---|---|---|---|---|---|---|---|---|---|---|---|
| iPS:43 4517 | 21-225_76A7 | VK3/A27/ JK1 | .A......... | ........... | ....P..D.. | ....R...... | ........... | ........... | ........... | .E......... | ........... |
| iPS:43 4519 | 21-225_74C7 | VK3/A27/ JK1 | ........... | ........... | .T...PN.D.. | ........... | ........... | ........... | ........... | ..ER....... | ........... |
| iPS:43 4523 | 21-225_75C3 | VK3/A27/ JK1 | ..Q........ | ........... | ....R...... | ........... | ........... | ........F.. | ........... | ..H.D....... | ........... |
| iPS:43 4531 | 21-225_76C9 | VK3/A27/ JK1 | ........... | ........... | .....S..... | ........... | ........... | ........... | ........... | ....-...... | ...RSR..... |
| iPS:43 4533 | 21-225_85F7 | VK3/A27/ JK1 | .P......... | ........... | ....NIY.... | ........... | ........... | ........... | ........... | .E......... | ........... |
| iPS:43 4547 | 21-225_74H5 | VK3/A27/ JK1 | ........... | ........... | ....N..N... | ....R...... | ........... | ........C.. | ........... | .E......... | ........... |
| iPS:43 4559 | 21-225_74D11 | VK3/A27/ JK1 | ........... | ........... | ....N...Y.. | ........... | ........... | ........... | .I.I....... | .H.DN...... | ........... |
| iPS:43 4561 | 21-225_77G1 | VK3/A27/ JK1 | ........... | Y......... | .......Y... | ........... | ........... | ........... | .A......... | .H.DN...... | ........... |
| iPS:43 4565 | 21-225_75B10 | VK3/A27/ JK1 | ........... | ........... | ....P.N..... | ........... | .T......... | ........F.. | .A......... | .ED........ | ........... |
| iPS:43 4571 | 21-225_74D2 | VK3/A27/ JK1 | ........... | ........... | ....N..D... | ........... | ........... | ........F.. | ........N.. | .E......... | ........... |
| iPS:43 4579 | 21-225_77F7 | VK3/A27/ JK1 | ........... | Y......... | .......Y... | ....I...... | ........... | ........... | .A....V.H.C | .H.DN...... | ........... |
| iPS:43 4581 | 21-225_74B12 | VK3/A27/ JK1 | ........... | Y......... | ........... | ........... | .S......... | ........... | .A......... | .H.DN...... | ........... |
| iPS:43 4585 | 21-225_75A12 | VK3/A27/ JK1 | ........... | ........... | ....R...H.. | ....K..F... | ........... | ........... | ........A.. | .H.D....... | ........... |
| iPS:43 4595 | 21-225_77A10 | VK3/A27/ JK1 | ........... | ........... | ....R....D.. | ....R...... | ........... | ........... | ........... | ........... | ........... |
| iPS:43 4611 | 21-225_77C12 | VK3/A27/ JK1 | ........... | ........... | .......F... | ........... | .T......... | ........... | ......G.... | .E......... | ........... |
| iPS:43 4633 | 21-225_74G8 | VK3/A27/ JK1 | ........... | ........... | ....A...... | ........... | ........... | ........... | ........... | ....-...... | ...NSR..... |
| iPS:43 4637 | 21-225_78E7 | VK3/A27/ JK1 | ........... | ........... | ....N..D... | ........A.. | ........... | ........F.. | ........... | ..ER....... | ........... |
| iPS:43 4657 | 21-225_79G1 | VK3/A27/ JK1 | ..S........ | ........... | ....N...Y.. | ........A.. | .S......... | ........... | .A......... | .H.DN...... | ........... |
| iPS:43 4663 | 21-225_79F3 | VK3/A27/ JK1 | ........... | Y......... | .......Y... | ........... | .S......... | ........... | .A......... | .H.DN...... | ........... |
| iPS:43 4671 | 21-225_74F4 | VK3/A27/ JK1 | ........... | ........... | ....IF..... | ....S...... | ........... | ........... | ........... | ....-...... | ....SR..... |

FIGURE 52 (Continued)

| | | | | | | | | | |
|---|---|---|---|---|---|---|---|---|---|
| iPS:43 4687 | 21-225_75A5 | VK3|A27/ JK1 | . . . . . . . . . . | . . . . . . . . . . | Y . . . . . | . . . . . . . . . | . . . . . . | A . . . . | . . . . . . | H . DN . . . |
| iPS:43 4691 | 21-225_75G7 | VK3|A27/ JK1 | . . . . . . . . . . | . . . . . . . R . . | . . . . . D . | . . . . . . R . . | . . . . . . | . . . . . | . . . . . . | . E . . . . . |
| iPS:43 4693 | 21-225_79F11 | VK3|A27/ JK1 | . . . . . . . . . . | . . . . . . . . . . | Y . . . . . | . . . . . . . . . | . . . . . . | A . . . . | . . . . . . | . HSDN . . . |
| iPS:43 4699 | 21-225_79G12 | VK3|A27/ JK1 | . . . . . . . . Y . | . . . . . . . . . . | Y . . . . . | . . . . . . . . . | . S . . . . | A . . . . | . . . C . . | . HSDN . . . |
| iPS:43 4701 | 21-225_80A1 | VK3|A27/ JK1 | . . . . . . . . RY | . . . . . . . . . . | Y . . . . . | . . . . . . . . . | . . . . . . | A . . . . | A . . . V . | . HSDN . . . |
| iPS:43 4703 | 21-225_80C1 | VK3|A27/ JK1 | . . . . . . . . . . | . . . . . . . . . . | Y . . . . . | . . . . . . . . . | . S . . . . | A . . . . | A . . . V . . C . . | . HSDN . . . |
| iPS:43 4709 | 21-225_80E3 | VK3|A27/ JK1 | . S . . . . . . . . | . . . . . . . . . . | Y . . . . . | . . . . . . . . . | . S . . . . | A . . . . | A . . . V . . C . . | . HSDN . . . |
| iPS:43 4715 | 21-225_80D5 | VK3|A27/ JK1 | . L . K . V . . . . | . . . . . . . . . . | N I Y . . . | . . . . . . . . . | . . . . . . | . . . . . | . . . T . . . . . . | . E . . . . . |
| iPS:43 4717 | 21-225_80A6 | VK3|A27/ JK1 | . . . . . I P . . . | . . . . . . . . . . | . D . G . . | . . . . . . . . . | . P . . . . | . . . . . | . . . . . . | . E . . . . . |
| iPS:43 4725 | 21-225_80H7 | VK3|A27/ JK1 | . . . . . . . . . . | . . . . . . . . . . | I N . . N . | . . . . . . . . . | . . . . . . | . . . . . | . . . . . F . | . E . . . . . |
| iPS:43 4735 | 21-225_80B10 | VK3|A27/ JK1 | . . . . . . . . . . | . . . . . . . . . . | . D . . . . | . . . . . . . . . | . P . . . . | . . . . . | . . . . . . | . E . . . . . |
| iPS:43 4743 | 21-225_74A4 | VK3|A27/ JK1 | . . . . . . . . Y . | . . . . . . . . . . | Y . . . . . | . . . . . . . . . | . S . . . . | A . . . . | . . . . . C . . | . HSDN . . . |
| iPS:43 4751 | 21-225_80H12 | VK3|A27/ JK1 | . . . . . . . . . . | . . . . . . . . . . | Y . . . . . | . . . . . . . . . | . S . . . . | A . . . . | . . . . . C . . | . HSDN . . . |
| iPS:43 4759 | 21-225_81C5 | VK3|A27/ JK1 | . S . . . . . . . . | . . . . . . . . . . | Y . . . . . | . . . . . R . . . | . S . . . . | A . . . . | A . . . V . . C . . | . HSDN . . . |
| iPS:43 4773 | 21-225_75D9 | VK3|A27/ JK1 | . . . . . . . . . . | . . . . . . . . . . | . . . . . . | . . . . . . . . . | . S . . . . | A . . . . | . . . . . . | . E . . . . . |
| iPS:43 4777 | 21-225_81C11 | VK3|A27/ JK1 | . . . . . . . . RY | . . . . . V . . . . | Y . . . . . | . . . . . . . . . | . S . . . . | . L . . . | A . . . V . . C . . | . HSDN . . . |
| iPS:43 4809 | 21-225_74F5 | VK3|A27/ JK1 | . . . . . . . . Y . | . . . . . . . . . . | Y . . . . . | . . . . . . . . . | . S . . . . | A . . . . | . . . . . C . . | . HSDN . . . |
| iPS:43 4821 | 21-225_83G1 | VK3|A27/ JK1 | . . . . . . . . RY | . . . . . . . . . . | Y . . . . . | . . . . . . . . . | . S . . . . | VL . . . | A . . . V . . . . . | . HSDN . . . |
| iPS:43 4835 | 21-225_83B6 | VK3|A27/ JK1 | . . . . . . . . . . | . . . . . . . . . . | . D . G . . | . . . . . . . . . | T P . . . . | A . . . . | . . . . . . | . E . . . . . |
| iPS:43 4839 | 21-225_83B7 | VK3|A27/ JK1 | . . . . . . . SV | . . . . . . . . . . | Y . . . . . | . . . . . . . . . | . S . . . . | A . . . . | . . . . . C . . | . HSDN . . . |
| iPS:43 4849 | 21-225_83C10 | VK3|A27/ JK1 | . . . . . . . . . . | . . . . . . . . . . | . P . H . N | . . . . . . . . . | . . . . . . | I . . . . | . . . . . . | . E . . . . . |

FIGURE 52 (Continued)

| | | | | | | | | |
|---|---|---|---|---|---|---|---|---|
| iPS:43 4869 | 21-225_84E12 | VK3|A27/JK1 | .......... | ........IN. | .......... | .......... | ....D...F. | ....E..... |
| iPS:43 4879 | 21-225_85A3 | VK3|A27/JK1 | ......F... | ....N.Y... | .......A.. | .......S.. | .A........ | .H.DN..... |
| iPS:43 4881 | 21-225_85B4 | VK3|A27/JK1 | ......F... | ......Y... | .......... | .......... | .A........ | .H.DN..... |
| iPS:43 4887 | 21-225_85D6 | VK3|A27/JK1 | ...Q..F... | ....R..... | .......... | .......... | .......... | .H.D...... |
| iPS:43 4891 | 21-225_85G6 | VK3|A27/JK1 | ...A...... | ...P.D.... | .......... | ....A..P.. | .......V.. | ....E..... |
| iPS:43 4895 | 21-225_74H7 | VK3|A27/JK1 | .L........ | ...NIY.... | .......... | .......... | .......... | ....E..... |
| iPS:43 4899 | 21-225_85B9 | VK3|A27/JK1 | ......F... | .......... | .......R.. | .......... | .......... | ....E..... |
| iPS:43 4907 | 21-225_85G10 | VK3|A27/JK1 | ......S... | ....N..... | .......... | .......... | .i.i...... | .......... |
| iPS:43 4913 | 21-225_86C1 | VK3|A27/JK1 | ......Y... | ....G..... | .......A.. | .......S.. | .A......C. | .H.DN..... |
| iPS:43 4921 | 21-225_86E4 | VK3|A27/JK1 | ......RY.. | ......Y... | .......... | .......... | .......C.. | HSDN...... |
| iPS:43 4939 | 21-225_86C11 | VK3|A27/JK1 | ......Y... | ......Y... | .......... | .......S.. | .A.L....C. | HSDN...... |
| iPS:43 4943 | 21-225_87H1 | VK3|A27/JK1 | .......... | ....D..... | .......... | ....A..T.. | .A......C. | ....E..... |
| iPS:43 4945 | 21-225_87E5 | VK3|A27/JK1 | .F....Y... | .......... | .......... | .......S.. | .......V.C. | HSDN...... |
| iPS:43 4955 | 21-225_87C9 | VK3|A27/JK1 | ...V...... | ......Y... | .......... | .......S.. | .A.....V.C. | HSDN...... |
| iPS:43 4961 | 21-225_87A12 | VK3|A27/JK1 | ......RY.. | ......Y... | .......... | .......S.. | .V.....V.C. | HSDN...... |
| iPS:43 4969 | 21-225_88H1 | VK3|A27/JK1 | ......Y... | ......Y... | .......... | .......S.. | .A.....V.C. | HSDN...... |
| iPS:43 4981 | 21-225_88E7 | VK3|A27/JK1 | .......... | ......Y... | .......... | .......S.. | .A......C. | HSDN...... |
| iPS:43 4983 | 21-225_88F7 | VK3|A27/JK1 | ......RY.. | ......Y... | .......... | .......S.. | .A.....V.C. | HSDN...... |
| iPS:43 4995 | 21-225_88G9 | VK3|A27/JK1 | ......Y... | ......Y... | .......... | .......S.. | .A.....V.C. | HSDN...... |
| iPS:43 4999 | 21-225_75A8 | VK3|A27/JK1 | ......Y... | ......Y... | .......... | .......S.. | .A......C. | HSDN...... |
| iPS:43 5013 | 21-225_89D5 | VK3|A27/JK1 | ...S..V... | ......Y... | .......... | .......S.. | .A........ | .H.DN..... |

FIGURE 52 (Continued)

| | | | | | N.. | | F... | | N.I | V... | | | E... | V. | |
|---|---|---|---|---|---|---|---|---|---|---|---|---|---|---|---|
| iPS:43 5015 | 21-225_89H5 | VK3|A27/ JK1 | . | . | . | . | . | . | . | . | . | . | . | . | . |
| iPS:43 5025 | 21-225_89E10 | VK3|A27/ JK1 | . | Y | M. | . | S. | . | V. | V. | . | . | HSDN | . |
| iPS:43 5029 | 21-225_89A11 | VK3|A27/ JK1 | S. | . | NF. | . | A.T. | . | . | . | S. | . | ..EI | . |
| iPS:43 5039 | 21-225_90G4 | VK3|A27/ JK1 | . | Y | Y. | . | S. | . | V. | ...V...C | . | . | HSDN | . |
| iPS:43 5041 | 21-225_90A5 | VK3|A27/ JK1 | . | Y | Y. | . | . | . | A. | ...V.H | . | . | H.DN | . |
| iPS:43 5043 | 21-225_90G5 | VK3|A27/ JK1 | . | Y | Y. | I. | . | . | A. | ...V.H | . | . | H.DN | . |
| iPS:43 5055 | 21-225_90F10 | VK3|A27/ JK1 | . | . | . | . | S. | . | A. | ...C | . | . | H.DN | . |
| iPS:43 5073 | 21-225_91B2 | VK3|A27/ JK1 | . | Y | Y. | . | . | . | A. | ...V...C | . | . | H.DN | . |
| iPS:43 5075 | 21-225_91B3 | VK3|A27/ JK1 | . | Y | Y. | . | S. | . | A. | ...V.H.C | . | . | HSDN | . |
| iPS:43 5077 | 21-225_91F3 | VK3|A27/ JK1 | . | Y | Y. | A. | . | . | A. | ...V...C | . | . | H.DN | . |
| iPS:43 5079 | 21-225_91B4 | VK3|A27/ JK1 | . | Y | Y. | I. | S. | . | A. | ...V...C | . | . | H.DN | . |
| iPS:43 5089 | 21-225_91E9 | VK3|A27/ JK1 | . | Y | Y. | . | . | . | A. | ...V.H.C | . | . | HSDN | . |
| iPS:43 5097 | 21-225_92B1 | VK3|A27/ JK1 | . | . | G. | R. | . | . | D. | . | . | . | E... | . |
| iPS:43 5111 | 21-225_92D6 | VK3|A27/ JK1 | . | Y | N. Y. | . | S. | . | V. | ...C | . | . | H.DN | . |
| iPS:43 5115 | 21-225_77C5 | VK3|A27/ JK1 | . | Y | Y. | . | S. | . | A. | ...C | . | . | H.DN | . |
| iPS:43 5171 | 21-225_93C2 | VK3|A27/ JK1 | . | . | . | . | . | . | A. | ...H.C | . | . | HSDN | . |
| iPS:43 5177 | 21-225_93E4 | VK3|A27/ JK1 | . | Y | Y. | . | . | . | A. | ...V...C | . | . | E... | . |
| iPS:43 5183 | 21-225_93E9 | VK3|A27/ JK1 | . | . | D. | T. | P. | . | . | . | . | . | . | . |
| iPS:43 5195 | 21-225_94D3 | VK3|A27/ JK1 | Q. | . | R. | . | . | . | . | . | . | . | H.D. | . |
| iPS:43 5217 | 21-225_94F12 | VK3|A27/ JK1 | . | Y | Y. | . | S. | . | A. | . | . | . | H.DN | NQ |
| iPS:43 5219 | 21-225_95D2 | VK3|A27/ JK1 | . | . | Y. | . | . | . | A. | ...C | . | . | H.DN | . |

FIGURE 52 (Continued)

| | | | | | | | | |
|---|---|---|---|---|---|---|---|---|
| iPS:43_5235 | 21-225_95F9 | VK3|A27/JK1 | . . . . . . . . . . . . . . Y . . | . . . . . . . . . . . . . . . . | . . . . . . . . . . . . . . . . | . . . . . A . . . . . . . . . . | . . . . . . . . . . . C . . . . | . H . DN . . . . . . . . |
| iPS:43_5237 | 21-225_95G9 | VK3|A27/JK1 | . . . . . S . . . . . . . . Y . | . . . . . . . . . . . . . . . . | . . . . . . . . . . . . . . . S | . . . . . A . . . . . . . . . . | . . . . . . . . . . . C . . . . | . H . DN . . . . . . . . |
| iPS:43_5239 | 21-225_95H10 | VK3|A27/JK1 | . . . . . S . . . I . Y . | . . . . . . . . . . . . . . . . | . . . . . . . . . . . . . . . . | . . . . . A . . . . . V . H . C | . . . . . . . . . . . . . . . . | . H . DN . . . . . . . . |
| iPS:43_5273 | 21-225_97A2 | VK3|A27/JK1 | . . . . . . . . . . . . . Y . | . . . . . . . . . . . . . . . . | . . . . . . . . . . . . . . . . | . . . . . A . . . . . . . . . . | . . . . . . . . . . . C . . . . | . HSDN . . . . . . . . |
| iPS:43_5281 | 21-225_97E5 | VK3|A27/JK1 | . . . . . S . . . . . . . Y . | . . . . . . . . . . . . . . . . | . . . . . . . . . . . . . . . . | . . . . . A . . . . . . . . . . | . . . . . . . . . . . C . . . . | . HSDN . . . . . . . . |
| iPS:43_5331 | 21-225_147G8 | VK3|A27/JK1 | . . . . . Q . . . . . . . . . . | . . . RIF . . . . . . N . . . | . I . . . . . . . . . . . . . . | . . . . . . . T . . . . . . . . | . . . . . . . I . . . . . . . . | . D . . . . . . . . . . |
| iPS:43_5815 | 21-225_190G10 | VK3|A27/JK1 | . . . . . . . . . . . . . . . . | . . . RF . . . . . . . P . . . | . . . . . . . . . . . . . . . . | . . . . . . . N . . . . . . . . | . . . . . . . . . . . . . . . . | . . . . . . . . . . . . SP . |
| iPS:43_5843 | 21-225_191F1 | VK3|A27/JK1 | . . . . . . . A . . . . . . . . | . . . . I . L . . . NF . . . | . . . . . . . . . . . . . . . . | . . . . . . . . . . . . . . . . | . . . . . . . . . . . . . . . . | . . R . . . . . . . . . |
| iPS:43_5847 | 21-225_191A3 | VK3|A27/JK1 | . . . . . . . . . . . . . . . . | . . . . IR . . . . . . . F . . | . . . . . . . . . . . . . . . . | . . . . . . . N . . . . . . . . | . . . . V . . . . . . . . . . . | . . N . . . . . . A . . |
| iPS:43_5849 | 21-225_191C3 | VK3|A27/JK1 | . . . . . . . . . . . . . . . . | . . . . IR . . . . . . . F . . | . . . . . . . . . . . . . . . . | . . . . . . . . . . . . . . . . | . . . . . . . . . . . . . . . . | . . N . . . . . . A . . |
| iPS:43_5851 | 21-225_191D3 | VK3|A27/JK1 | . . . . . S . . . . . . . . . . | . . G . . IRT . . . . Q . . | . . . . . . . . . . . . . . . . | . . . . . . . N . . . . . . . . | . . . . . . . . . . . . . . . . | . G . . . . . . . . . . |
| iPS:43_5865 | 21-225_191A5 | VK3|A27/JK1 | . . . . . . . . . . . . . . . . | . . . NF . . . . . . . . . . . | . . . . . . . . . . . . . . . . | . . . . . . . . . . . . . . . . | . . . . . . . . . . . . . . . . | . . N . . . . . . . . . |
| iPS:43_5905 | 21-225_190A3 | VK3|A27/JK1 | . . . . . M . . . . . . . . . . | . . . RF . . . . . . . . . . . | . . . . . . . . . . . . N . . . | . . . . . . . . . . . . . . . . | . . . . V . . . . . . . . . . . | . . N . . . . . . . . . |
| iPS:43_5911 | 21-225_190B4 | VK3|A27/JK1 | . . . . . . . . . . . . . . . . | . . . . NIR . . . . . . . . . | . . . . . . . . . . . . . . . . | . . . . . . . . . . . . . . . . | . . . . . . . . . . . . . . . . | . . N . . . . . . A . . |
| iPS:43_5913 | 21-225_190A7 | VK3|A27/JK1 | . . . . . . . . . . . . . . . . | . . . . IR . . . . . . . F . . | . . . . . . . . . . . . . . . . | . . . . . . . . . . . . . . . . | . . . . . . . . . . . . . . . . | . . N . . . . . . A . . |
| iPS:43_5939 | 21-225_191H7 | VK3|A27/JK1 | . . . . . . . . . . . . . . . . | . . . . R . . . . . . H . . . | . . . . . . . . . . YR . . . . | . . . . . . . . . . . . . . . . | . . . . . . . . . . . . . . . . | . . N . . . . . . . . . |
| iPS:43_5967 | 21-225_192B3 | VK3|A27/JK1 | . . . . . S . . . . . . . . . . | . . G . . IRT . . . . Q . . | . . . . . . . . . . . . . . . . | . . . . . . . . . . . . . . . . | . . . . . . . . . . . F . . . . | . . N . . . . . . . . . |
| iPS:43_5973 | 21-225_192H3 | VK3|A27/JK1 | . . . . . . . . . . . . . . . . | . . . DF . . . . . . . . . . . | . . . . . . . . . . . P . . . . | . . . . . . . . . . . . . . . . | . . . . . . . . . . . . . . . . | . . N . . . . . . . . . |
| iPS:43_5995 | 21-225_192F8 | VK3|A27/JK1 | . . . . . . . . . . . . . . . . | . . . . F . . . . . . . . . . . | . . . . . . . . . . . . . . . . | . . . . . . N . . . . . . . . . | . . . . . . . . . . . . . . . . | . . I . . . . . . . . . |
| iPS:43_6007 | 21-225_192G12 | VK3|A27/JK1 | . . . . . . . . . . . . . . . . | . . . DF . . . . . . L . . . | . . . . . . . . . . V . R . . . | . . A . . . . . . . . . . . . . | . . . . . . M . . . . . . . . . | . . E . . . . . . . . . |
| iPS:43_6009 | 21-225_193A1 | VK3|A27/JK1 | . . . . . . . . . . . . . . . . | . . . NF . . . . . . H . F . | . . . . . . . . . . . R . . . . | . . . . . . N . . . . . . . . . | . . . . . . . . . . . . . . . . | . . N . . . . . . . . . |

FIGURE 52 (Continued)

| | | | | | | | | | | |
|---|---|---|---|---|---|---|---|---|---|---|
| iPS:43 6011 | 21-225_193B1 | VK3IA27/JK1 | ......... | ......... | ....R.. | ....H.. | ....... | .N..... | ....... | ....... |
| iPS:43 6015 | 21-225_193D3 | VK3IA27/JK1 | ....D.... | ......... | NF..... | ....... | .N..... | .N..... | ....... | ....... |
| iPS:43 6017 | 21-225_193F3 | VK3IA27/JK1 | ....S.... | ......... | .F..IR. | ...Q... | ....... | F.E.... | ...F... | ...A..N |
| iPS:43 6027 | 21-225_193E6 | VK3IA27/JK1 | ....A.... | ......... | .G..IRT | ....... | ....... | ...N... | ....... | ....... |
| iPS:43 6029 | 21-225_193H6 | VK3IA27/JK1 | ....S.... | ......... | .G..DF.V | ....... | ....... | ...G... | ....... | .E..... |
| iPS:43 6035 | 21-225_193C8 | VK3IA27/JK1 | ......... | F........ | .G..IRT | ...Q... | ....... | ....... | ....... | ....... |
| iPS:43 6037 | 21-225_193D8 | VK3IA27/JK1 | ....K.... | F........ | NF..... | ....... | ....... | .N..... | ....... | .N..A.I |
| iPS:43 6041 | 21-225_193G8 | VK3IA27/JK1 | ......... | ......... | .F..IR. | ....... | ....... | .N..... | ....... | ...A..V |
| iPS:43 6047 | 21-225_193B10 | VK3IA27/JK1 | ......... | ......... | NF..RT. | ...H... | ....R.. | .N..... | ...L... | ....... |
| iPS:43 6049 | 21-225_193B12 | VK3IA27/JK1 | ......... | ......... | .F..... | ...V... | ....... | ...R... | ....... | ...SP.. |
| iPS:43 6062 | 21-225_194E5 | VK3IA27/JK1 | ....S.... | ......... | .G..IRT | ....... | ...D... | ....... | ....... | ...A... |
| iPS:43 6064 | 21-225_194E6 | VK3IA27/JK1 | ......... | ......... | NF..IR. | ....... | ....... | .N..K.. | ....... | ....... |
| iPS:43 6072 | 21-225_194C10 | VK3IA27/JK1 | ......... | ......... | NF..... | ....... | ....... | ....V.. | ....... | ....... |
| iPS:43 6080 | 21-225_195B1 | VK3IA27/JK1 | ......... | ......... | .G..P.N. | ...T... | ....... | .N..A.A. | ...A... | .E..... |
| iPS:43 6088 | 21-225_195C8 | VK3IA27/JK1 | ....S.... | ......... | .N..P.N. | ...T... | ...N... | V...A.. | ...F... | .E..... |
| iPS:43 6122 | 21-225_196G10 | VK3IA27/JK1 | ......... | L........ | .F..IR. | ....... | ....... | ...R... | ....... | ...A..L |
| iPS:43 6134 | 21-225_196H12 | VK3IA27/JK1 | ......... | F........ | .F..N.. | ...H... | ....YR. | ...N... | ....... | ...SP.. |
| iPS:43 6146 | 21-225_197F4 | VK3IA27/JK1 | ....G.... | ......... | .F..R.. | ...L... | ....... | ....... | ....... | ...A... |
| iPS:43 6177 | 21-225_198B1 | VK3IA27/JK1 | ....S.... | ......... | .F..IRT | ...Q... | ....... | .N..... | ....... | ....... |
| iPS:43 6179 | 21-225_198E1 | VK3IA27/JK1 | ......... | ......... | NF..R.. | ....... | ....F.. | .N..... | ....... | ....... |
| iPS:43 6181 | 21-225_198C2 | VK3IA27/JK1 | ....V....YSE.S | L........ | ....... | ...C... | ....P..S | .N..... | ....... | ....L.HA.. |

FIGURE 52 (Continued)

| | | | | | | | | |
|---|---|---|---|---|---|---|---|---|
| iPS:43 6195 | 21-225_198G10 | VK3|A27/ JK1 | | | | | N | |
| iPS:43 6197 | 21-225_199C2 | VK3|A27/ JK1 | | F..IR. | | | N | A |
| iPS:43 6207 | 21-225_199C7 | VK3|A27/ JK1 | | F..IR. | | N | N | A |
| iPS:43 6210 | 21-225_199G11 | VK3|A27/ JK1 | | NF..IRT | | | | H |
| iPS:43 6226 | 21-225_200F10 | VK3|A27/ JK1 | V | ..R.. | | | N | |
| iPS:43 6232 | 21-225_201E1 | VK3|A27/ JK1 | D | NIR. F.. | | | N | A |
| iPS:43 6238 | 21-225_201B2 | VK3|A27/ JK1 | | .P.IN. GF. | | MPH. | H..ET | |
| iPS:43 6256 | 21-225_202O9 | VK3|A27/ JK1 | D | N.. | R | F | EN | |
| iPS:43 6302 | 21-225_205G7 | VK3|A27/ JK1 | | G.. | S | H | ..ET | |
| iPS:43 6310 | 21-225_202D11 | VK3|A27/ JK1 | | F.. | | | E | |
| iPS:43 6336 | 21-225_208B5 | VK3|A27/ JK1 | | N.. | .R. | A..N | EN | |
| iPS:43 6340 | 21-225_208A9 | VK3|A27/ JK1 | | N.. | .R..V | F | H.EN | |
| iPS:43 6472 | 21-225_220E1 | VK3|A27/ JK1 | | N.. | .V | | H.H. | |
| iPS:43 6506 | 21-225_222C7 | VK3|A27/ JK1 | | ..I.R. H.V | N..V..T L..T | RS..M. | | |
| iPS:43 6580 | 21-225_225E7 | VK3|A27/ JK1 | | N.. Y | | A..G..TI | ..T | |
| iPS:43 7324 | 21-225_75C2 | VK3|A27/ JK1 | RY | Y | | A..C | ED | R. |
| iPS:43 7328 | 21-225_75D3 | VK3|A27/ JK1 | Y | Y | S | A..V.H.C | H.DN | |
| iPS:43 7332 | 21-225_75F3 | VK3|A27/ JK1 | Y | Y | I | A..H | H.DN | |
| iPS:43 7340 | 21-225_75G9 | VK3|A27/ JK1 | A | P..D | P | A..V..C | H.DN | |
| iPS:43 7344 | 21-225_75G12 | VK3|A27/ JK1 | | Y | S | A..V..C | E. | |
| iPS:43 7350 | 21-225_74A3 | VK3|A27/ JK1 | | Y | | A.. | HSDN | |

FIGURE 52 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:43 7369 | 21-225_74D6 | VK3/A27/ JK1 | ........ | .....Y.. | ........ | ........ | ........A....... | .H.DN... | ........ |
| iPS:43 7383 | 21-225_74H8 | VK3/A27/ JK1 | ........ | ......F. | ........ | ........ | ........ | ........ | ........ |
| iPS:45 1122 | 21-225_200A1 | VK3/A27/ JK1 | .....I..Y..... | .....N.. | ....R... | ........ | C.L.........C... | ....EI.SR. | ........S. |
| iPS:39 2864 | 21-225_23B9 | VK3/A27/ JK1 | ........ | ....N.Y. | ..T..... | ....S... | ........ | .....R.. | ........ |
| Germline | | | K_FR1 | K_CDR1 | K_FR2 | K_CDR2 | K_FR3 | K_CDR3 | K_FR4 |
| VK1/A30/JK4 | | | DIQMTQSPSSLSAS VGDRVTITC | RASQSIS SYLN | WYQQKPG KAPKLLIY | AASSLQS | GVPSRFSGSGSGTD FTLTISSLQPEDFAT YYC | QQSYSTPLT | FGGGT KVEIK |
| iPS:46 8812 | 21-225_48H4 | VK1/A30/ JK4 | ......F. | ........ | ........ | ........ | ........ | ....Y... | ........ |
| iPS:46 8824 | 21-225_73G6 | VK1/A30/ JK4 | ........ | ......RD | ........ | ........ | ........ | ........ | ........ |
| iPS:46 8818 | 21-225_190C8 | VK1/A30/ JK4 | ........ | ........ | ........ | ........ | ........E...... | ....D... | ........ |
| iPS:46 8840 | 21-225_200H9 | VK1/A30/ JK4 | ........ | ........ | ........ | ........ | ......I. | ....F... | ........ |
| iPS:46 8868 | 21-225_74A1 | VK1/A30/ JK4 | ........ | ........ | ........ | ........ | ........ | ....D... | ......A. |
| iPS:39 2920 | 21-225_29G4 | VK1/A30/ JK4 | ........ | ........ | ........ | ........ | ........ | ........ | ......T. |
| iPS:43 3899 | 21-225_43C3 | VK1/A30/ JK4 | ........ | ........ | ........ | ........ | ......G. | ....S... | .....G.T |
| iPS:43 3921 | 21-225_44C3 | VK1/A30/ JK4 | ........ | ........ | ........ | ........ | .....S.. | ........ | ........ |
| iPS:43 3947 | 21-225_44E12 | VK1/A30/ JK4 | ........ | ....T... | ........ | ........ | ........ | ........ | ........ |
| iPS:43 3963 | 21-225_46B1 | VK1/A30/ JK4 | ........ | ........ | ........ | ....G... | ........ | ........ | ........ |
| iPS:43 3969 | 21-225_46F3 | VK1/A30/ JK4 | ........ | ........ | ........ | ........ | ........ | ........ | ........ |
| iPS:43 3975 | 21-225_46C6 | VK1/A30/ JK4 | ........ | .....K.. | ........ | ........ | .....S.. | ........ | ........ |
| iPS:43 3977 | 21-225_46D8 | VK1/A30/ JK4 | ........ | .....K.. | ........ | ........ | .....S.. | ........ | ........ |
| iPS:43 3983 | 21-225_47A1 | VK1/A30/ JK4 | ........ | ......D. | ........ | ....F... | ........R....... | ........ | ......I. |
| iPS:43 3987 | 21-225_47A5 | VK1/A30/ JK4 | ........ | ........ | ........ | ........ | ........ | ........ | ........ |

FIGURE 52 (Continued)

| ID | Family | | | | | | | | | |
|---|---|---|---|---|---|---|---|---|---|---|
| iPS:43 4013 | 21-225_48D12 | VK1|A30/JK4 | . . . . . . . | . . . . . . . | . . . . . . . | . . . . . . . | . . . . . . . | I . . . . . . | . . . . . . . | . . . . . . . |
| iPS:43 4019 | 21-225_49A1 | VK1|A30/JK4 | . . . . . . . | . . D . . . . | . . . . . . . | . . . . . . . | . . . . . . . | . . . . . . . | . . . . . . . | . . . . . . . |
| iPS:43 4029 | 21-225_49C6 | VK1|A30/JK4 | . . . . . . . | . . . . . . . | . . . . . . . | . F . . . . . | . . . . . . . | . . . . . . . | . . . . . . . | . . . . . . . |
| iPS:43 4043 | 21-225_50G10 | VK1|A30/JK4 | . . . . . . . | . . N . . . . | . V . . . . . | . . . . . . . | . . . . . . . | . . . . . . . | . Y . . . . . | . . . . . . . |
| iPS:43 4077 | 21-225_51F11 | VK1|A30/JK4 | . A . . . . . | . . . . . . . | . . . . . . . | . . . . . . . | . . . . . . . | . . . . . . . | . F . . . . . | . S . . . . . |
| iPS:43 4081 | 21-225_52B2 | VK1|A30/JK4 | . . . . . . . | . . . . . . . | . R . . . . . | . F . . . . . | . . . . . . . | . . . . . . . | . R . . . . . | . . . . . . . |
| iPS:43 4105 | 21-225_53D2 | VK1|A30/JK4 | . . . . . . . | . . . . . . . | . . . . . . . | . . . . . . . | . T . . . . . | . . . . . . . | . . . . . . . | . . . . . . . |
| iPS:43 4119 | 21-225_53E6 | VK1|A30/JK4 | . A . . . . . | . . . . . . . | . N . . . . . | . . . . . . . | . . . . . . . | . F . . . . . | . R . . . . . | . . . . . . . |
| iPS:43 4141 | 21-225_54C6 | VK1|A30/JK4 | . A . . . . . | . . . . . . . | . N . . . . . | . . . . . . . | . . . . . . . | . F . . . . . | . R . . . . . | . . . . . . . |
| iPS:43 4159 | 21-225_55B8 | VK1|A30/JK4 | . S . . . . . | . A . . . . . | . H . . . . . | . FR . . . . | . . . . . . . | . . . . . . . | . . . . . . . | . G . . . . . |
| iPS:43 4179 | 21-225_56F1 | VK1|A30/JK4 | . . . . . . . | . D . . . . . | . N . . . . . | . . . . . . . | . . . . . . . | . . . . . . . | . D . . . . . | . . . . . . . |
| iPS:43 4217 | 21-225_60E8 | VK1|A30/JK4 | . F . . . . . | . . . . . . . | . F . . . . . | . . . . . . . | . . . . . . . | . . . . . . . | . . H.F . . . | . . . . . . . |
| iPS:43 4249 | 21-225_62E2 | VK1|A30/JK4 | . . . . . . . | . . . . . . . | . . . . . . . | . R . . . . . | . . . . . . . | . . . . . . . | . S . . . . . | . . . . . . . |
| iPS:43 4253 | 21-225_62E4 | VK1|A30/JK4 | . . . . . . . | . . . . . . . | . . . . . . . | . F . . . . . | . . . . . . . | . . . . . . . | . SN . . . . | . R . . . . . |
| iPS:43 4313 | 21-225_59E6 | VK1|A30/JK4 | . . . . . . . | . . . . . . . | . . . . . . . | . . . . . . . | . . . . . . . | . . . . . . . | . . . . . . . | . . . . . . . |
| iPS:43 4337 | 21-225_64E1 | VK1|A30/JK4 | . . . . . . . | . K . . . . . | . . . . . . . | . . . . . . . | . S . . . . . | . K . L . . . | . . . . . . . | . . . . . . . |
| iPS:43 4411 | 21-225_68F11 | VK1|A30/JK4 | . . . . . . . | . N . N . . . | . . . . . . . | . . . . . . . | . . . . . . . | . P . . . . . | . F . . . . . | . . . . . . . |
| iPS:43 4413 | 21-225_68D12 | VK1|A30/JK4 | . T . . . . . | . . . . . . . | . . . . . . . | . . . . . . . | . . . . . . . | . . . . . . . | . ST . . . . | . R . . . . . |
| iPS:43 4433 | 21-225_70E8 | VK1|A30/JK4 | . . . . . . . | . . . . . . . | . F . . . . . | . . . . . . . | . . . . . . . | . . . . . . . | . R . . . . . | . . . . . . . |
| iPS:43 4439 | 21-225_70E12 | VK1|A30/JK4 | . . . . . . . | . . . . . . . | . . . . . . . | . . . . . . . | . G . . . . . | . . . . . . . | . . . . . . . | . S . . . . . |
| iPS:43 4489 | 21-225_74E4 | VK1|A30/JK4 | . . . . . . . | . . . . . . . | . . . . . . . | . T . . . . . | . . . . . . . | . H . . . . . | . SN . . . . | . . . . . . . |

FIGURE 52 (Continued)

| | | | | | | | | | |
|---|---|---|---|---|---|---|---|---|---|
| iPS:43 4503 | 21-225_74D7 | VK1|A30/ JK4 | | | | | | . . . SN . . . | |
| iPS:43 5251 | 21-225_96A3 | VK1|A30/ JK4 | | | | . T . | . . . F . . . | . . . SN . . . | |
| iPS:43 5293 | 21-225_146F1 | VK1|A30/ JK4 | | | | | . . G . R . . . H . | . . . ST . | |
| iPS:43 5311 | 21-225_146H9 | VK1|A30/ JK4 | | | | | . . . G . . . | | |
| iPS:43 5313 | 21-225_146G11 | VK1|A30/ JK4 | . . D . NF | | | | | . . . D . | |
| iPS:43 5361 | 21-225_148E11 | VK1|A30/ JK4 | | | . S . | | . L . | . . . RN . | |
| iPS:43 5363 | 21-225_148F12 | VK1|A30/ JK4 | . A . | | | | . F . V . | . . . . . . I | |
| iPS:43 5367 | 21-225_149G1 | VK1|A30/ JK4 | . A . | | | . N . | . . . F . | | |
| iPS:43 5377 | 21-225_149G5 | VK1|A30/ JK4 | . A . | F . | | | | | |
| iPS:43 5397 | 21-225_149F12 | VK1|A30/ JK4 | | | | . N . | . . . . . . I . | | |
| iPS:43 5407 | 21-225_150E7 | VK1|A30/ JK4 | | | | . N . | . L . . . A . | | |
| iPS:43 5449 | 21-225_152H9 | VK1|A30/ JK4 | | F . | | . T . | . T . | | |
| iPS:43 5499 | 21-225_156G1 | VK1|A30/ JK4 | | F . | | | | | |
| iPS:43 5549 | 21-225_158H5 | VK1|A30/ JK4 | . I . . . F . F | | | R . | . . V . R . C . S . | . . . SN . . . V | . . . Q . . . S |
| iPS:43 5587 | 21-225_160H3 | VK1|A30/ JK4 | . . . . . . P . | | | . T . | . M . | . . . S . | |
| iPS:43 5599 | 21-225_160B10 | VK1|A30/ JK4 | | | . G . | . E . | . G . | . . . Y . | |
| iPS:43 5663 | 21-225_169B1 | VK1|A30/ JK4 | | | . H . | | | . . . Y . | |
| iPS:43 5669 | 21-225_169F9 | VK1|A30/ JK4 | | | . E . | . . T . | | . . . Y . | |
| iPS:43 5693 | 21-225_170G4 | VK1|A30/ JK4 | | | . H . | | | . . . Y . | |
| iPS:43 5695 | 21-225_170D5 | VK1|A30/ JK4 | | . F . | | . . . N | | . . . Y . | . . . F |
| iPS:43 5697 | 21-225_170G5 | VK1|A30/ JK4 | . T . | | . F . | . T . | | . . . Y . | |

FIGURE 52 (Continued)

| | | | | | | | | | | |
|---|---|---|---|---|---|---|---|---|---|---|
| iPS:43_5703 | 21-225_170D11 | VK1|A30/JK4 | | | . H . | . . . N | | | Y . . | | . R |
| iPS:43_5705 | 21-225_171C3 | VK1|A30/JK4 | | . T | . F . | . T . | | | Y . | . F | |
| iPS:43_5709 | 21-225_171A4 | VK1|A30/JK4 | | | . F . | . T . | | | Y . | | |
| iPS:43_5721 | 21-225_172B3 | VK1|A30/JK4 | | | . G . | . E . | | | Y . | | |
| iPS:43_5725 | 21-225_172G8 | VK1|A30/JK4 | | . V | . H . | | | . S . | H Y . | . F | |
| iPS:43_5735 | 21-225_173H12 | VK1|A30/JK4 | | | | . T . | | | . Y . | | |
| iPS:43_5743 | 21-225_175G1 | VK1|A30/JK4 | | . T | . F . | . T . | | | Y . | . F N | |
| iPS:43_5761 | 21-225_176B11 | VK1|A30/JK4 | | | | | . L | | . Y . | | |
| iPS:43_5779 | 21-225_178B10 | VK1|A30/JK4 | | | . H . | . . . N | | | H Y . | . F | |
| iPS:43_6023 | 21-225_193A5 | VK1|A30/JK4 | . I . S . | | . Y . | | . I . V | . F . E | . D . | | |
| iPS:43_6033 | 21-225_193E7 | VK1|A30/JK4 | | | . V . | . S . R | | | . KR | . F F | |
| iPS:43_6120 | 21-225_196C10 | VK1|A30/JK4 | | | | | | | . Y . | | . V |
| iPS:43_6199 | 21-225_199E3 | VK1|A30/JK4 | | | | . S . R | | | . KR | | |
| iPS:43_6228 | 21-225_200F12 | VK1|A30/JK4 | | | . R S . | . . . HT | | | . K . | | |
| iPS:43_6230 | 21-225_201A1 | VK1|A30/JK4 | | | . S . | . I . R | | . R | . K . | | |
| iPS:43_6242 | 21-225_201A10 | VK1|A30/JK4 | | | . R S . | . T . H | . V | | | | |
| iPS:43_6286 | 21-225_204H8 | VK1|A30/JK4 | | . E | . Q . | . S . | | . S A | | | |
| iPS:43_6308 | 21-225_205H8 | VK1|A30/JK4 | | . S | . L . | . F . R | | . R | . K . | | . T |
| iPS:43_6526 | 21-225_224A1 | VK1|A30/JK4 | | | | | | . H | | | . K |
| iPS:43_6528 | 21-225_224B1 | VK1|A30/JK4 | | . D | | . T . | | | | . P | |
| iPS:43_6538 | 21-225_224C3 | VK1|A30/JK4 | | | | | | | | | |

FIGURE 52 (Continued)

| | | | | | | | | |
|---|---|---|---|---|---|---|---|---|
| iPS:43 6556 | 21-225_224D10 | VK1|A30/ JK4 | . . . . . | . . . . . | . . . . . | . . . . . | . . . . . | . . . . . |
| iPS:43 7220 | 21-225_55H6 | VK1|A30/ JK4 | L . . . . | . . . . . | . . . . . | . . . . . | . RD . . | . . . . . |
| iPS:43 7346 | 21-225_75H7 | VK1|A30/ JK4 | . RY . NS | . . . . . | . . . . . | . . A . . | I . SN . | . F . . . |
| iPS:47 2730 | 21-225_14B1_L C1 | VK1|A30/ JK4 | . Y . . . | . D . DN . | . . . . . | . V . GV | . YN . . | . . . . . |
| iPS:39 2622 | 21-225_17H8 | VK1|A30/ JK4 | . . . . . | . . . . . | T . Y . . | . . . . . | . . . . . | . . . . . |
| iPS:39 2624 | 21-225_17H12 | VK1|A30/ JK4 | . . . . . | . D . . . | . . . . . | . I . . T | . Y . . . | . . . . . |
| iPS:39 2628 | 21-225_20C2 | VK1|A30/ JK4 | . . . . . | . A . N . | . . . . . | . TG . . . | . . . . . | . . . . . |
| iPS:39 2630 | 21-225_20E5 | VK1|A30/ JK4 | . Q . . . | . F . . . | . . . . . | . . . . . | . A . . . | . E . . . |
| iPS:39 2638 | 21-225_17F9 | VK1|A30/ JK4 | . . . . . | . V . . . | . . . . . | . . . . . | . . . . . | . F . . . |
| iPS:39 2640 | 21-225_18A1 | VK1|A30/ JK4 | . . . . . | . . . . . | . . . . . | . N . . . | . . . . T | . . . . . |
| iPS:39 2642 | 21-225_18C6 | VK1|A30/ JK4 | . T . . . | . . . . . | . . . . . | . . . . . | . . . . . | . . . . . |
| iPS:39 2644 | 21-225_19E1 | VK1|A30/ JK4 | . . . . . | . . . . . | . N . . . | . . . . . | . . . . . | . . . . . |
| iPS:39 2646 | 21-225_20G2 | VK1|A30/ JK4 | . . . . . | . . . . . | . F . . . | . . . . S | . . . . . | . F . . . |
| iPS:39 2654 | 21-225_17A10 | VK1|A30/ JK4 | . . . . . | . . . . . | . V . . . | . . . . . | . S . . . | . . . . . |
| iPS:39 2656 | 21-225_1F2 | VK1|A30/ JK4 | . . . . . | . . . . . | . V . . . | . I . . . | . . . . . | . . . . . |
| iPS:39 2658 | 21-225_18E8 | VK1|A30/ JK4 | . A . . . | . . . . . | . . . . . | . . . . . | . . . . . | . . . . . |
| iPS:39 2666 | 21-225_16F11 | VK1|A30/ JK4 | . . . . . | . . . . . | . V . . . | . . . . . | . . . . . | . . . . . |
| iPS:39 2676 | 21-225_19F3 | VK1|A30/ JK4 | . R . . . | . . . . . | . . . . . | . . . . . | . A . . . | . . . . . |
| iPS:39 2680 | 21-225_20A7 | VK1|A30/ JK4 | . . . . . | . . . . . | . . . . S | . . . . . | . . . . . | . . . . . |
| iPS:39 2700 | 21-225_16E12 | VK1|A30/ JK4 | . . . . . | . . . . . | . . . . . | . . . . . | . . . . . | . . . . . |
| iPS:39 2706 | 21-225_18A3 | VK1|A30/ JK4 | . . . . . | . . . . . | . V . . . | . N . . . | . S . . . | . . . . . |

FIGURE 52 (Continued)

| | | | | | | | | | | |
|---|---|---|---|---|---|---|---|---|---|---|
| iPS:39 2716 | 21-225_17B5 | VK1|A30/ JK4 | . | . | . | . | SF. | . | . | . |
| iPS:39 2744 | 21-225_20D5 | VK1|A30/ JK4 | . | . | . | . | . | . | R. | F. |
| iPS:39 2750 | 21-225_20A10 | VK1|A30/ JK4 | . | . | . | Q. | . | . | . | . |
| iPS:39 2772 | 21-225_20E12 | VK1|A30/ JK4 | . | . | . | F. | . | . | . | F. |
| iPS:39 2774 | 21-225_21F3 | VK1|A30/ JK4 | . | . | . | . | . | D. | S. | . |
| iPS:39 2780 | 21-225_22B7 | VK1|A30/ JK4 | . | . | T. | . | I. | . | T. | . |
| iPS:39 2788 | 21-225_20C8 | VK1|A30/ JK4 | . | . | . | K..N | . | . | D. | F. |
| iPS:39 2794 | 21-225_21H3 | VK1|A30/ JK4 | . | . | . | . | V.T | A.L.I | . | . |
| iPS:39 2800 | 21-225_22D12 | VK1|A30/ JK4 | . | . | . | . | . | . | ST | . |
| iPS:39 2810 | 21-225_20H12 | VK1|A30/ JK4 | . | . | . | . | . | . | . | . |
| iPS:39 2820 | 21-225_23D1 | VK1|A30/ JK4 | R. | . | . | . | V. | . | S. | . |
| iPS:39 2822 | 21-225_23G8 | VK1|A30/ JK4 | . | D. | . | R.G..N | . | . | . | . |
| iPS:39 2824 | 21-225_24E5 | VK1|A30/ JK4 | . | . | . | . | V. | VI. | SN | . |
| iPS:39 2834 | 21-225_22C1 | VK1|A30/ JK4 | F. | T. | . | . | . | . | ST | . |
| iPS:39 2838 | 21-225_22G8 | VK1|A30/ JK4 | G. | T. | N. K. | G..C | . | K. S | . | . |
| iPS:39 2850 | 21-225_20H10 | VK1|A30/ JK4 | . | . | . | . | . | . | . | . |
| iPS:39 2854 | 21-225_21E5 | VK1|A30/ JK4 | . | . | . | . | T. | . | S. | . |
| iPS:39 2858 | 21-225_22H4 | VK1|A30/ JK4 | . | . | . | . | . | . | . | . |
| iPS:39 2866 | 21-225_23H11 | VK1|A30/ JK4 | . | D. | . | . | V. | L. | R. | . |
| iPS:39 2870 | 21-225_20G9 | VK1|A30/ JK4 | . | . | . | . | . | . | ST | T. |
| iPS:39 2880 | 21-225_22F9 | VK1|A30/ JK4 | . | . | . | . | . | . | . | . |

FIGURE 52 (Continued)

| | | | | | | | | |
|---|---|---|---|---|---|---|---|---|
| iPS:39 2882 | 21-225_23A3 | VK1|A30/ JK4 | . . . . . . . | . . . . . . . | . . . . . . . | . . . . . . . | . . . . . . . | . . . . . . . |
| iPS:39 2896 | 21-225_21G7 | VK1|A30/ JK4 | . . . . . . . | . . . . . . . | . . . . . . . | . . . . . . . | . . S . . . . | . . . . . . . |
| iPS:39 2900 | 21-225_22F2 | VK1|A30/ JK4 | . . . . . . . | . . . V . . . | . . Q . . . . | . . . . . . . | . . . N . . . I.F | . . . . . . . |
| iPS:39 2904 | 21-225_22G9 | VK1|A30/ JK4 | . . . . . . . | . . . . . . . | . . . . . . . | . . . . . . . | . . . . . . . | . . A . . . . |
| iPS:39 2942 | 21-225_30E9 | VK1|A30/ JK4 | . . . . . . . | . . . D . . . | . . R . . . . | G . . . . . . | . . . . . . . | . T . . . . P. |
| iPS:39 2944 | 21-225_31H5 | VK1|A30/ JK4 | . F . SF . . . | . . . S . . . | . . . . . . . | . F . . . . . | . V . M . D . SN . | I . I I . . . P. |
| iPS:39 2964 | 21-225_31A8 | VK1|A30/ JK4 | . . . . . . . | . . . D . . . | . H . I . . . | . . . . . . . | . . . . . . . | . TI . . . . P. |
| iPS:39 2980 | 21-225_29H6 | VK1|A30/ JK4 | . . . . . . . | . . . S . . . | . T . . . . . | . . . . . . . | . . . . . . . | . . . . . . . |
| iPS:39 2982 | 21-225_30D1 | VK1|A30/ JK4 | . . . . . . . | . . . D . . . | . . E . . . . | . . . . . . . | . . . . . . . | . TI . . . . P. |
| iPS:39 2986 | 21-225_31B8 | VK1|A30/ JK4 | . . . I . . . | . . . S . . . | . . R . . . . | G . . . . . . | . . . R . . . | . II . . . . P. |
| iPS:39 2988 | 21-225_25E6 | VK1|A30/ JK4 | . . . . . . . | . . . R . . . | . . . . . . . | . . . . . . . | . . . N . . . | . . . . . . . |
| iPS:39 2990 | 21-225_25H10 | VK1|A30/ JK4 | . . . . . . . | . . . . . . . | . . . . . . . | . . . . . . . | . . . . . . . | . . . . . . . |
| iPS:39 3004 | 21-225_30G11 | VK1|A30/ JK4 | . . . . . . . | . . . D . . . | . . . . . . . | . F . . . . . | . . G . . . . F | . TI . . . . P. |
| iPS:39 3018 | 21-225_29B8 | VK1|A30/ JK4 | . . . . . . . | . . . S . . . | . . . . . . . | . . . . . . . | . . . R . . . | . . . . . . . |
| iPS:39 3030 | 21-225_25H11 | VK1|A30/ JK4 | . . . . . . . | . T . . . . . | . . . . . . . | . . . . . . . | . . . . . . . | . . . . . . . |
| iPS:39 3034 | 21-225_27F2 | VK1|A30/ JK4 | . . . . . . . | . . . D . . . | . . R . . . . | V . . . . . . | . . . . . . . | . t . . . . . |
| iPS:39 3040 | 21-225_30E3 | VK1|A30/ JK4 | . . . . . . . | . . . D . . . | . . L . . . . | . F . . . . . | . . . . . . . | . t . . . . P. |
| iPS:39 3048 | 21-225_27C3 | VK1|A30/ JK4 | . . . . . . . | . . . . . . . | . . R . . . . | . . . . . . . | . . . . . N . D . | . R . . . . . |
| iPS:39 3054 | 21-225_29G8 | VK1|A30/ JK4 | . . . . . . . | . . . . . . . | . . . . . . . | . T . . . . . | . . . . . S . | . . . . . . . |
| iPS:39 3056 | 21-225_30F3 | VK1|A30/ JK4 | . . . . . . . | . . . . . . . | . . . . . . . | . . . . . . . | . . . . . . . | . t . . . . F. |
| iPS:39 3058 | 21-225_31H3 | VK1|A30/ JK4 | . . . . . . . | . . . D . . . | . . R . . . . | . F . . . . . | . . . . . . . | . T . . . . P. |

FIGURE 52 (Continued)

| | | | | | | | | | | |
|---|---|---|---|---|---|---|---|---|---|---|
| iPS:39_3060 | 21-225_32G12 | VK1|A30/JK4 | . . . . . | . . . D . | . . . . . | . . . . . | . . . . . | . . TI . | . . . P . | . . . . . |
| iPS:39_3068 | 21-225_34G9 | VK1|A30/JK4 | . . . . . | . . S . . | . . . R . | . . . . . | . . . T . | . . TI . | . . . P . | . . . . . |
| iPS:39_3072 | 21-225_36C5 | VK1|A30/JK4 | . . . . . | . . . D . | . . . . . | . . . . . | . . T . . | . H . PI | . . . P . | . . W . . |
| iPS:39_3074 | 21-225_33B1 | VK1|A30/JK4 | . . . . . | T . . . . | . . F . . | . . . . . | . . I . . | . . . . . | . . . . . | . . . . . |
| iPS:39_3076 | 21-225_33A4 | VK1|A30/JK4 | . . . . . | . . . . V | . . E . . | . . . . . | . . . V . | . . Y . . | . . . P . | . . V . . |
| iPS:39_3096 | 21-225_34D11 | VK1|A30/JK4 | . . . . . | . . . D . | . . . . . | . . . . . | . . . . R | . . TI . | . . . P . | . . . . . |
| iPS:39_3102 | 21-225_33F1 | VK1|A30/JK4 | . . . . . | . . S . . | . . . . . | . . . . . | . . VI . | . . TI . | . . . P . | . . G . . |
| iPS:39_3104 | 21-225_33A7 | VK1|A30/JK4 | . . . . . | T . . D . | . . . . . | . . . . . | . . I . . | . . TI . | . . . P . | . . . . . |
| iPS:39_3106 | 21-225_34A6 | VK1|A30/JK4 | . . . . . | . . S . . | . . . . . | . . V . . | . . . A . | . . TI . | . . . P . | . . . . . |
| iPS:39_3110 | 21-225_35B7 | VK1|A30/JK4 | . . . I . | . . . D . | . . F . . | . . . . . | . . V . . | . . . . . | . . . . . | . . . . . |
| iPS:39_3118 | 21-225_34H11 | VK1|A30/JK4 | . . . . . | . . S . . | . . E . . | . . T . . | . . . . . | . . TI . | . . . P . | . . . . . |
| iPS:39_3124 | 21-225_33G7 | VK1|A30/JK4 | . . . . . | . . . D . | . . . . . | . . . . . | . . . . . | . . TI . | . . . P . | . . . . . |
| iPS:39_3126 | 21-225_35D1 | VK1|A30/JK4 | . . . . . | . . S . . | . . . . . | V . T . G | . . . . . | . . TV . | . . . P . | . . . . . |
| iPS:39_3128 | 21-225_35F11 | VK1|A30/JK4 | . . . . . | . . . D . | . . . . . | . . . . . | . . . . . | . . TI . | . . . P . | . . . . . |
| iPS:39_3146 | 21-225_34G8 | VK1|A30/JK4 | . . . . . | . . S . . | . . F . . | . . . . . | . . . . . | . . TI . | . . . P . | . . . . . |
| iPS:39_3150 | 21-225_36A5 | VK1|A30/JK4 | . . . . . | T . . D . | . . . . . | . . . . . | . . . . . | . . H . . | . . PK . | . . I . T |
| iPS:39_3804 | 21-225_5H7 | VK1|A30/JK4 | . . . . . | . . . . . | . . . . . | . . . . . | . . . . . | . . S . . | . . . . . | . . . . . |
| iPS:39_3806 | 21-225_6A6 | VK1|A30/JK4 | . . . . . | . . . . . | . . . . . | . . . . . | . . . . . | . . S . . | . . . . . | . . . . . |
| iPS:39_3808 | 21-225_1A2 | VK1|A30/JK4 | . . . . . | . . . . . | . . . . . | . . . . . | . . . . . | . . . H . | . . . . . | . . . . . |
| iPS:39_3814 | 21-225_7F4 | VK1|A30/JK4 | . . . . . | T . . . . | . . . . . | . . N . . | . . . . . | . . SA . | . . . . . | . . . . . |
| iPS:39_3816 | 21-225_6D4 | VK1|A30/JK4 | . . . . . | . . . A . | . . . . . | . . . . . | . . . . . | . . S . . | . . . . . | . . . . . |

| | | | | | | | | | | |
|---|---|---|---|---|---|---|---|---|---|---|
| iPS:39 3976 | 21-225_7E9 | VK1/A30/ JK4 | F | . | E | T | . | . | . | . | . |
| iPS:39 3982 | 21-225_6C12 | VK1/A30/ JK4 | . | .SN | . | . | . | . | D... | F. | . |
| iPS:39 3984 | 21-225_4F12 | VK1/A30/ JK4 | . | .G. | . | . | . | G..I | . | . | . |
| iPS:39 3990 | 21-225_11G7 | VK1/A30/ JK4 | . | . | . | . | . | . | .SN | A. | M R |
| iPS:39 3994 | 21-225_8C9 | VK1/A30/ JK4 | . | .A | . | . | . | T. | . | . | . |
| iPS:39 4002 | 21-225_15G7 | VK1/A30/ JK4 | . | .D | . | . | I. | F. | .SN | . | . |
| iPS:39 4008 | 21-225_15H8 | VK1/A30/ JK4 | . | . | F. | . | . | . | . | . | R |
| iPS:39 4020 | 21-225_15H10 | VK1/A30/ JK4 | . | . | . | . | . | S. | . | . | N |
| iPS:39 4024 | 21-225_16B7 | VK1/A30/ JK4 | . | . | . | V T | N. | . | . | . | FN |
| iPS:39 4037 | 21-225_4F4 | VK1/A30/ JK4 | F | . | . | . V | . | I. | . | . | . |
| iPS:39 4045 | 21-225_4H4 | VK1/A30/ JK4 | . | . | . | . | . | I. | . | . | . |
| iPS:39 4049 | 21-225_13H5 | VK1/A30/ JK4 | . | . | . | T. | L | . | . | . | . |
| iPS:39 4053 | 21-225_11F10 | VK1/A30/ JK4 | . | . | . | . | . | . | .S | . | . |
| iPS:39 4057 | 21-225_15H1 | VK1/A30/ JK4 | . | . | . | T | V. | . | .S | . | . |
| iPS:39 4059 | 21-225_9E8 | VK1/A30/ JK4 | F | . | . | . | . | . | . | . | . |
| iPS:39 4063 | 21-225_16A1 | VK1/A30/ JK4 | . | . | . | . | . | . | H.SN | . | E |
| iPS:39 4073 | 21-225_15C9 | VK1/A30/ JK4 | . | . | . | . | V N | . | T. | . | . |
| iPS:39 4075 | 21-225_8D12 | VK1/A30/ JK4 | . | . | . | . | . | . | .S | . | . |
| iPS:39 4079 | 21-225_11F5 | VK1/A30/ JK4 | . | . | . | V. | . | I. | . | . | . |
| iPS:39 4091 | 21-225_13H3 | VK1/A30/ JK4 | . | . | . | . | . | . | . | . | . |
| iPS:39 8528 | 21-225_32G1 | VK1/A30/ JK4 | . | .DM. S | . | . | . | . | TI | S.P | . |

| | | | | | | | | | | | | |
|---|---|---|---|---|---|---|---|---|---|---|---|---|
| iPS:43 3965 | 21-225_46F2 | VK2A18/ JK1 | . . . . . . . . | . T . . . . . . | . . . . . . . G | . . . . . . . . | . . . . . . . . | . . . . . . . . | . . . . . . . . | . . . . . . . . | S . Q . . . . . | . . . . . . . . |
| iPS:43 3985 | 21-225_47C1 | VK2A18/ JK1 | . . . . . . . . | . . . . . . T . | . . . . . . E . | . . . . . . . . | . . . . . . P . | . . V . . . . . | . . . . . . N . | . . . . L . . . | . . . . . F . . | S . Q . . . . . | . . . . . . . . |
| iPS:43 3991 | 21-225_47E7 | VK2A18/ JK1 | . . . . . . . . | . . . . . . . . | . . . . . . . . | . . . . . . . . | . . . . . . P . | . . . . . . . . | . . . . . . . . | . . . . . . . . | . . . . . . . . | STQ . . . . . . | . . . . A . . . |
| iPS:43 4345 | 21-225_64H9 | VK2A18/ JK1 | . . . . . . . E | . . . . . . . . | . . . . . . . . | . . . . . . . F | . . . . . . . . | . . . . . . P . | . . V . . . . . | . . . . . N.L.C | . . . . A . . . | . . . . . . . . | S . Q . . V . . | . . . . . . . T |
| iPS:43 5297 | 21-225_146B3 | VK2A18/ JK1 | . . . . . . . . | . . . . . . . . | . . . . . . . . | . . . . . . . . | . . . . . . . G | . . . . . . P . | . . . . . . . . | . . . . . . N . | . . . . . . . . | . . . . . L.H . | S . Q . . . . . | . . . . . . . . |
| iPS:43 5341 | 21-225_148B2 | VK2A18/ JK1 | . . . . . . . A | . . . . . . . . | . . . . . . . . | . . . . . . . . | . . . . . . . G | . . . . . . P . | . . R . . . . . | . . . . . . H . | . . . . . . . . | . . . . . . . . | S . Q . . . . . | . . . . . . . I |
| iPS:43 5357 | 21-225_148G10 | VK2A18/ JK1 | . . . . . . . . | . . . . . . . . | . . . . . . . . | . . . . . . . F | . . . . . . . G | . . . . . . P . | . . R . . . . . | . . . . . . . . | . . . . . N . | . . . . . . . . | S . Q . . . . . | . . . . . . . . |
| iPS:43 5365 | 21-225_149F1 | VK2A18/ JK1 | . . . . . . . . | . . S . . . F . | . . . . . . . . | . . . . . . . . | . . . . . . . G | . . . . . . P . | . . . . . . . . | . . . . . . . . | . . . . . . . . | . . . . . F . . | S . Q . . I . . | . . . . . . . . |
| iPS:43 5413 | 21-225_150B11 | VK2A18/ JK1 | . . . . . . . . | . . . . . . Y . | . . . . . . . . | . . F . . . . . | . . . . . . . V.G | . . . . . . P . | . . . . . . . . | . . . . . . . . | . . . . . . . . | . . . . . . . . | S . Q . . I . . | . . . . . . . . |
| iPS:43 5423 | 21-225_151G5 | VK2A18/ JK1 | . . . . . . . . | . . . . . . . . | . . . . . . . . | . . . . R . . . | . . . . . . . G | . . . . . . P . | . . . . L . . . | . . . . . . N . | . . . . . . . . | . . . . . . . . | S . Q . . V . . | . . . . . . . . |
| iPS:43 5429 | 21-225_151A10 | VK2A18/ JK1 | . . . . . . . . | . . . . . . . . | . . . . . . . . | . . . . . . . . | . . . . . . . G | . . . . . . P . | . . . . . . . . | . . . . . . H . | . . . . . . . . | . . . . . . . . | S . Q . . I . . | . . . . . . . . |
| iPS:43 5441 | 21-225_152F6 | VK2A18/ JK1 | . . . . . . . . | . . . . . . . . | . . . . . . . . | . . . . . . R.G | . . . . . . P . | . . R . . . . . | . . . . . . . . | . . . . . . . . | . . . . . . . . | . . . . . . . . | S . Q . . V . . | . . . . . . . . |
| iPS:43 5457 | 21-225_152C11 | VK2A18/ JK1 | . . . . . . . . | . . . A . . . . | . . . . . . . . | . . . . . . . T | . . . . . . . G | . . . . . . P.V.R | . . . . . . . . | . . . . . I.K.T | . . . . . N . | . . . . . . . . | S . Q . . I . . | . . . . . . . . |
| iPS:43 5463 | 21-225_153D2 | VK2A18/ JK1 | . . . . . . . . | . . . . . . . . | . . . . . . . . | . . . . . . . . | . . . . . . . G | . . . . . . P . | . . I . . . . . | . . . . . . N . | . . . . . M . | . . . . . F.F . | S . Q . . I . . | . . . . . D . . |
| iPS:43 5489 | 21-225_155A5 | VK2A18/ JK1 | . . . . . . . . | . . . . . . . . | . . . . . . . . | . . . . . . R.G | . . . . . . P . | . . R . . . . . | . . . . . . . . | . . . . . . . . | . . . . . . . . | . . . . . . F . | S . Q . . . . . | . . . . . . . . |
| iPS:43 5531 | 21-225_157G8 | VK2A18/ JK1 | . . . . . . . . | . . . . . . . . | . . . . . . . T | . . . . . . . . | . . . . . . . G | . . . . . . P.V.H | . . . . . . . . | . . . . . K.T | . . . . . N . | . . . . . . . . | S . Q . . . . . | . . . . . . . . |
| iPS:43 5577 | 21-225_160B1 | VK2A18/ JK1 | . . . . . . . . | . . . . . . . . | . . . . . . . . | . . . . . . . . | . . . . . . . G | . . . . . . P . | . . V . . . . . | . . . . . . . . | . . . . . . . . | . . . . . . . . | S . Q . . V . . | . . . . . . . . |
| iPS:43 5601 | 21-225_160G10 | VK2A18/ JK1 | . . . . . . . A | . . . . . . . . | . . . . . . . . | . . . . . . . F | . . . . . . . G | . . . . . . P.H | . . . . . . . . | . . . . . . K . | . . . . . . . . | . . . . . L . . | S . Q . . I . . | . . . . . V . . |
| iPS:43 5629 | 21-225_162H6 | VK2A18/ JK1 | . . . . . . . . | . . . . . . . . | . . . . . . . . | . . . . . . . . | . . . . . . . G | . . . . . . P . | . . . . . . . . | . . . . . . K . | . . . . . E . | . . . . . . . . | S . Q . . V . . | . . . . . . . T |
| iPS:43 5655 | 21-225_167E2 | VK2A18/ JK1 | . . . . . . . . | . . . . . . . . | . . . . . . . . | . . . . . . . . | . . . . . . . . | . . . . . . P.H | . . . . . . . . | . . . . . . K . | . . . . . . . . | . . . . . L.H . | K.S . Q . . . . | . . . . . . . . |
| iPS:43 5657 | 21-225_167H10 | VK2A18/ JK1 | . . . . . . . . | . . . . . . . . | . . . . . . . . | . . . . . . . . | . . . . . . . . | . . . . . . P.H | . . . . . . . . | . . . . . . K . | . . . . . . . . | . . . . . L.H . | S . Q . . . . . | . . . . . . . . |

FIGURE 52 (Continued)

| | | | | | | | | | | | |
|---|---|---|---|---|---|---|---|---|---|---|---|
| iPS:43 5683 | 21-225_170A1 | VK2|A18/ JK1 | E........ | ........ | ........ | .......G | ........ | ........ | ........ | ..S.Q.... | ........ |
| iPS:43 5723 | 21-225_172B7 | VK2|A18/ JK1 | ........ | ........ | ........ | ....F. | P.V..... | ........ | ........ | ..S.Q..F. | .D....R |
| iPS:43 5731 | 21-225_173A11 | VK2|A18/ JK1 | ....F... | ........ | ........ | ........ | P.V.LF | ...H.... | ........ | ..S.Q.... | ........ |
| iPS:43 5755 | 21-225_176H4 | VK2|A18/ JK1 | ........ | ........ | ........ | .......G | P....... | ...N.... | .......G | ..S.Q..V. | ........ |
| iPS:43 5771 | 21-225_177B11 | VK2|A18/ JK1 | ........ | ........ | ...R.... | ........ | P....... | ........ | ......FF | ..S.Q.... | ........ |
| iPS:43 5781 | 21-225_178G10 | VK2|A18/ JK1 | H....... | ........ | ........ | ........ | P.I..... | ...N.... | .....L.G | ....E... | ..S.Q..I. | ........ |
| iPS:43 5789 | 21-225_180C4 | VK2|A18/ JK1 | ........ | ........ | ........ | .......G | P....... | A....... | ........ | ......I | ..S.Q..V. | ........ |
| iPS:43 5795 | 21-225_181C2 | VK2|A18/ JK1 | E....... | ........ | ........ | ........ | P....H.. | ..T.N.P. | ..S..... | ........ | ..S.Q.... | ........ |
| iPS:43 5807 | 21-225_181C10 | VK2|A18/ JK1 | ........ | ........ | ........ | ........ | P....... | ...N.... | ........ | ......H. | ..S.Q..V. | ........ |
| iPS:43 5827 | 21-225_190H11 | VK2|A18/ JK1 | ..V..A.. | ........ | ...R.... | ........ | P....C.. | ..N.A.. | ........ | ........ | ..S.Q..I. | ........ |
| iPS:43 5839 | 21-225_191B1 | VK2|A18/ JK1 | ........ | ........ | R......F | ........ | P.V..... | .L.N.... | ..T..... | ........ | ..S.Q..F. | ........ |
| iPS:43 5853 | 21-225_191E3 | VK2|A18/ JK1 | ........ | ........ | ...R.... | ........ | P....C.. | ..N.A.. | ........ | ........ | SFQ..... | ...N... |
| iPS:43 5871 | 21-225_191E6 | VK2|A18/ JK1 | ........ | ........ | ...R.... | ........ | P....... | ...N.A.. | ..T..... | .......G | ..S....V. | ........ |
| iPS:43 5887 | 21-225_186F7 | VK2|A18/ JK1 | ........ | ........ | M....C | ........ | P....... | ..K..... | ..S..... | .......G | ..S.Q..I. | ........ |
| iPS:43 5899 | 21-225_188G11 | VK2|A18/ JK1 | ........ | ........ | ........ | .......G | P....... | ...N.... | ..T..... | .......G | ..S.Q..I. | ........ |
| iPS:43 5901 | 21-225_189G2 | VK2|A18/ JK1 | ........ | ........ | ...R....F | ........ | P....... | ...N.... | ........ | .......G | ..S.Q..I. | ........ |
| iPS:43 5927 | 21-225_190E7 | VK2|A18/ JK1 | ...L.... | ........ | ........ | ........ | P.V..C | ...N.... | ..T..... | ......G.I | ..S.Q.... | ........ |
| iPS:43 5999 | 21-225_192F9 | VK2|A18/ JK1 | ........ | ........ | ...R.... | ........ | ...R.C | ........ | ........ | .......G | ..S.Q..V. | ........ |
| iPS:43 6060 | 21-225_194F4 | VK2|A18/ JK1 | ........ | ........ | ...R....N | ........ | P.V..... | ...N.... | ........ | .......G | ..S.Q..I. | ........ |
| iPS:43 6158 | 21-225_197G8 | VK2|A18/ JK1 | E....... | ..I..L.. | ........ | ........ | P....... | ...N.... | ........ | ........S | ..S.Q..V. | A..S.. |
| iPS:43 6193 | 21-225_198A10 | VK2|A18/ JK1 | ........ | ........ | ...R....V | ........ | P.V..C | ...N.... | .......G | ........ | ..S.Q.... | ........ |

FIGURE 52 (Continued)

| | Germline | K_FR1 | K_CDR1 | K_FR2 | K_CDR2 | K_FR3 | K_CDR3 | K_FR4 |
|---|---|---|---|---|---|---|---|---|
| iPS:43 6536 | 21-225_224G1 | VK2|A18/ JK1 | ................ | ...G...F.S | ......P. | ....I.N. | ................ | ..STQ...... | ........ |
| iPS:43 6548 | 21-225_224A7 | VK2|A18/ JK1 | ................ | ..........F. | .F...P. | ....I.N. | ................ | ..STQ...R. | ........ |
| iPS:43 6558 | 21-225_224C11 | VK2|A18/ JK1 | .......F........ | ..........F. | ....P. | ....I.N. | ................ | ..STQ...R. | ........ |
| iPS:43 6562 | 21-225_224H11 | VK2|A18/ JK1 | ................ | ..........F. | ....P. | ....I.N. | .........I...... | ..STQ...R. | ........ |
| iPS:43 6572 | 21-225_225G4 | VK2|A18/ JK1 | ................ | ..........F. | ....P. | ....I.N. | .........I...... | ..STQ...R. | ........ |
| iPS:43 6592 | 21-225_226B1 | VK2|A18/ JK1 | ................ | ..........G. | ....P...R. N | ........ | .........I...... | ..STQ...R. | ........ |
| iPS:43 6594 | 21-225_226A5 | VK2|A18/ JK1 | ................ | ..........G. | ....P. | .....I... | .........I...... | ..S.Q...I. | ........ |
| iPS:43 6602 | 21-225_226E7 | VK2|A18/ JK1 | ................ | .............. | ....P...Q. | .....I... | .........I...... | ..S.Q...V | ........ |
| iPS:43 6606 | 21-225_226G8 | VK2|A18/ JK1 | ................ | ..........F. | ....P. | .........N. | .........I...... | ..STQ...R. | ........ |
| iPS:43 6610 | 21-225_226F9 | VK2|A18/ JK1 | ................ | .............. | ....P. | ....I.N. | .........I...... | ..STQ...R. | ........ |
| iPS:43 6612 | 21-225_226H9 | VK2|A18/ JK1 | .....L.......... | ..........F. | ....P...R. | .........N. | .........I...... | ..STQ...R. | ........ |
| iPS:43 6614 | 21-225_226F10 | VK2|A18/ JK1 | ................ | ..........F. | ....P. | ....I.N. | .........I...... | ..STQ...R. | ........ |
| iPS:43 6618 | 21-225_226E11 | VK2|A18/ JK1 | ................ | ..........KT. | ....P...H. | ........ | .........I...... | ..STQ...R. | ........ |
| iPS:43 6624 | 21-225_226H12 | VK2|A18/ JK1 | ................ | ..........F. | ....P...P. | ....I.N. | .........I...... | ..STQ...R. | ........ |
| iPS:43 6626 | 21-225_227C1 | VK2|A18/ JK1 | ................ | .............. | ....P. | ........N. | .........I...... | ..STQ...R. | ........ |
| iPS:43 6628 | 21-225_227F2 | VK2|A18/ JK1 | ................ | ..........F. | ....P. | ....I.N. | .........I...... | ..STQ...R. | ........ |
| iPS:43 6640 | 21-225_227A8 | VK2|A18/ JK1 | ................ | ..........F. | ....P. | ........N. | .........I...... | ..STQ...R. | .......R |
| iPS:39 2814 | 21-225_22A1 | VK2|A18/ JK1 | ................ | ...G.......... | ....F. | ........ | ......L..A...... | ..TL...... | ........ |
| iPS:39 2930 | 21-225_25H8 | VK2|A18/ JK1 | ................ | ..........F. | ....P. | ........N. | .........I...... | ..S.Q...... | ........ |
| iPS:39 3032 | 21-225_26F8 | VK2|A18/ JK1 | ................ | ..........G. | ....P. | ........N. | .........I...... | ..S.Q...... | ........ |
| iPS:39 3036 | 21-225_28G3 | VK2|A18/ JK1 | .E.............. | .............. | ....P. | ........N. | ........E....... | ..S.Q...I. | ......D. |

FIGURE 52 (Continued)

| VK1A30/JK1 | VK1A30/JK1 | DDDMTQSPSSL SASVGDRVTITC | RASQSI SSYLN | WYQQKPGKAPKLLIY | AASSLQS | GVPSRFSGSGSGTDFTLTISSLQPEDFATYYC | QQSY STPPT | FGQGTK |
|---|---|---|---|---|---|---|---|---|
| iPS:46 8826 | 21-225_201C5 | VK1A30/JK1 | . . . . . . . . . . . . . . . . . . . . . . | . . . H . . . . . . . | . . . . . . . . | . . . . . . . . . . . . . . . . . . . . . . . . . . . . . . . | . . . . Y . . . | . . F . R . |
| iPS:46 8842 | 21-225_50H4 | VK1A30/JK1 | . . . . . . . . . . . . . . . . . . . . . . | . . . . . . . . . . . | . . . . . . . . | . . . . . . . . . . . . . . . . . . . . . . . . . . . . . . . | . . . . . . . . | . . . . R . |
| iPS:46 8858 | 21-225_148C9 | VK1A30/JK1 | . . . . . . . . . . . . . . . . . . . . . . | . . . R . . . . . . . | . . . . . . . . | . . . . . . . . . . . . . . . . . . . . . . . . . . . . . . . | . . . . Y . . . | . . . . R . |
| iPS:46 8860 | 21-225_224E7 | VK1A30/JK1 | . . . . . . . . . . . . . . . . . . . . . . | . . . D . . . . . . . | . . . . I . . . | . . . . . . . . . . . . . . . . . . . . . . . . . . . . . . . | . . . . . . . . | . . . . R . |
| iPS:43 3919 | 21-225_44B3 | VK1A30/JK1 | . . . . . . . . . . . . . . . . . . . . . . | . . . . . . . . . . . | . . . . . . . . | . . . . . . . . . . . . . . . . . . . . . . . . . . . . . . . | . L . YN . . . | . . . . R . |
| iPS:43 3923 | 21-225_44D3 | VK1A30/JK1 | . . . . . . . . . F . . . . . . . . . . . . | . . . D . . . . . . . | . . . . . . . . | . . . . . . . . . . . . . . . . R . . R . . . . . . . . . . . | . . . . Y . . . | . . . . R . |
| iPS:43 3929 | 21-225_44D5 | VK1A30/JK1 | . . . . . . . . . . . . . . . . . . . . . . | . . . D . . . . . . . | . . T . E . . . | . . . . . . . . . . . . . . . . . . . . . . . . . . . . . . . | . . . . Y . . . | . . . F . . |
| iPS:43 3935 | 21-225_44F9 | VK1A30/JK1 | V . . . . . . . . . . . . . . . . . . . . . | . . . K . . . . . . . | . . . . . . . . | . . . . . . . . . . . . . . . . . . . . . . . . . . . . . . . | . H . YN . . . | . . . . R . |
| iPS:43 3939 | 21-225_44C10 | VK1A30/JK1 | . . . . . . . . . F . . . . . . . . . . . . | . . . . . . . . . . . | . . . . T . . . | . . . . . . . . . . . . . . . . . . . . . . . . . . . . . . . | . . . . Y . . . | . . . . R . |
| iPS:43 3951 | 21-225_45B4 | VK1A30/JK1 | . . . . . . . . . F . . . . . . . . . . . . | . . . D . . . . . . . | . . . . . . . . | . . . . . . . . . . . . . . . . . . . . . . . . . . . . . . . | . . . . Y . . . | . . . . R . |
| iPS:43 3955 | 21-225_45B8 | VK1A30/JK1 | . . . . . . . . . . . . . . . . . . . . . . | . . . D . . . . . . . | . . . . . . . . | . . . . . . . . . . . . . . . . . . . . . . . . . . . . . . . | . . . YN . . . | . . . . R . |
| iPS:43 3967 | 21-225_46C3 | VK1A30/JK1 | . . . . . . . . . F . . . . . . . . . . . . | . . . D . . . . . . . | . . . . . . . . | . . . . . . . . . . . . . . . . R . . . . . . . . . . . . . . | . . . . Y . . . | . . . . R . |
| iPS:43 3971 | 21-225_46D4 | VK1A30/JK1 | . . . . . . . . . . . . . . . . . . . . . . | T . . D . . . . . . . | . . . . V . . . | . . . . . . . . . . . . . . . . . . . . . . . . . . . . . . . | . . . . Y . . . | . . . . R . |
| iPS:43 3997 | 21-225_48C1 | VK1A30/JK1 | . . . . . . . . . . . . . . . . . . . . . . | T . . . K . . . . . . | . . . . E . . . | . . . . . . . . . . . . . . . . A . . . . . . . I . . . . . . | . . . . . . . . | . . . F . . |
| iPS:43 4001 | 21-225_48F2 | VK1A30/JK1 | . . . . . . . . . . . . . . . . . . . . . . | . . . R . . . . . . . | R . . . . . . . | . . . . . . . . . . . . . . . . . . . . . . . . . . . . . . . | . . . F . . . | . . . . . . |
| iPS:43 4009 | 21-225_48A9 | VK1A30/JK1 | . . . . . . . . . . . . . . . . . . . . . . | . . . D . . . . . . . | F . . . . . . . | . . . . . . . . . . . . . . . . . . . . . N . . . S . L . . . | . . . . QY . . | . . . . . . |
| iPS:43 4047 | 21-225_50A12 | VK1A30/JK1 | . . . . . . . . . . . . . . . . . . . . . . | . . . . . . . . . . . | T . . . . N . . | . . . . . . . . . . . . . . . . . . . . . . . . . . . . . . . | . . . . . . . . | . . . . . . |
| iPS:43 4067 | 21-225_51H8 | VK1A30/JK1 | . . . . . . . . . . . . . . . . . . . . . . | . . . . . . . . . . . | . . . . . . . . | . . . . . . . . . . . . . . . . . . . . . G . . . . . . . H . | . . . . R . . . | . . . . . . |
| iPS:43 4135 | 21-225_54H3 | VK1A30/JK1 | . . . . . . . . . . . . . . . . . . . . . . | . . . D . . . . . . . | . . . . . N . . | . . . . . . . . . . . . . . . . . . . . . . . . . . . . . . . | . . . . . . . . | . . . . . . |
| iPS:43 4197 | 21-225_56C7 | VK1A30/JK1 | . . . . . . . . . . . . . . . . . . . . . . | . . . I . . . . . . . | I . . . . N . . | . . . . . . . . . . . . . . . . . . . . . . . . . . . . . . . | . . . . Y . . . | . . . . . T |

FIGURE 52 (Continued)

| | | | | | | | | | | |
|---|---|---|---|---|---|---|---|---|---|---|
| iPS:43 4203 | 21-225_60E2 | VK1|A30/ JK1 | | K. | | | | | | |
| iPS:43 4209 | 21-225_60C3 | VK1|A30/ JK1 | | | | F. | S. | | | L. |
| iPS:43 4229 | 21-225_61H1 | VK1|A30/ JK1 | | K. | | | | | | |
| iPS:43 4241 | 21-225_61E6 | VK1|A30/ JK1 | I. | .G | | E. | | | Y. | FP. |
| iPS:43 4257 | 21-225_62F7 | VK1|A30/ JK1 | | A. | | | P. | | Y. | YP. S. |
| iPS:43 4281 | 21-225_57B8 | VK1|A30/ JK1 | I. | .G | | E. | R. | | | |
| iPS:43 4315 | 21-225_59G7 | VK1|A30/ JK1 | | | | | S. | | | |
| iPS:43 4319 | 21-225_59B9 | VK1|A30/ JK1 | | D. | H. | | | TR. | | FP. |
| iPS:43 4339 | 21-225_64AA | VK1|A30/ JK1 | | | | | | L. | | |
| iPS:43 4343 | 21-225_64C8 | VK1|A30/ JK1 | A. | A. | .C | P. | | | H Y | R. |
| iPS:43 4385 | 21-225_66C10 | VK1|A30/ JK1 | | | | | | | Y. | R. |
| iPS:43 4387 | 21-225_66D11 | VK1|A30/ JK1 | F..Q. | R. | H. | | | IS. .M.R. .C | IV | YP. S. |
| iPS:43 4441 | 21-225_71A2 | VK1|A30/ JK1 | | | | | I. FR.I | | IH | |
| iPS:43 4469 | 21-225_73C9 | VK1|A30/ JK1 | | D. | | | | | Y. | R. |
| iPS:43 5197 | 21-225_94F3 | VK1|A30/ JK1 | | | | | | | Y. | R. A. |
| iPS:43 5325 | 21-225_147H5 | VK1|A30/ JK1 | | R. | | T. N. | | V. | Y. | R. |
| iPS:43 5393 | 21-225_149D10 | VK1|A30/ JK1 | | | | | | F. | Y. | R. |
| iPS:43 5539 | 21-225_158G1 | VK1|A30/ JK1 | | K. | | | | | | |
| iPS:43 5543 | 21-225_158D4 | VK1|A30/ JK1 | | D. | N. | | | | | |
| iPS:43 5571 | 21-225_159C8 | VK1|A30/ JK1 | | K. | | | | F. | H. | R. |
| iPS:43 5573 | 21-225_159D8 | VK1|A30/ JK1 | | RD.G. | S. | | | F. | Y. | R. |

| | | | | | | | | |
|---|---|---|---|---|---|---|---|---|
| iPS:43-6412 | 21-225_214H9 | VK1|A30/JK1 | . . . . . . . . . . | . . . . . . . . . . | . . . . . . . . . . | . . . . . . . . . . | Y . . . . . . . . | . . . . . . . . . |
| iPS:43-6414 | 21-225_214G10 | VK1|A30/JK1 | . . . LC . . . PP | . . . . . . . . . . | . . . . . . . . . . | . . . . . . . . . . | . L . . . . . . . | . R . . . . . . . |
| iPS:43-6416 | 21-225_214G12 | VK1|A30/JK1 | . . . . . . . PP | . . . . . . . . . . | . . . . . . . . . . | . . . . I . . . . | VM.Y . . . . . . | . R . . . . . . . |
| iPS:43-6418 | 21-225_215E3 | VK1|A30/JK1 | . . . . . . . PP | . . . . . . . . . . | . . . . . . . . . . | . . . . I . . . . | VM . . . . . . . | . R . . . . . . . |
| iPS:43-6428 | 21-225_215E11 | VK1|A30/JK1 | . . . C . . . PP | . . . . . . . . . . | . . . . . . . . . . | . . . I . V . R . | VM.Y . . . . . . | . R . . . . . . . |
| iPS:43-6438 | 21-225_216E8 | VK1|A30/JK1 | . . . . . . . P | . . . . . . . . . . | . . . . . . . . . . | . . . I . . . . . | . M.Y . . . . . | . R . . . . . . . |
| iPS:43-6440 | 21-225_216H12 | VK1|A30/JK1 | . . . L . . . P | . . . . . . . . . . | . . . . . G . . . | . . . I . . . . . | VM . . . . . . . | . R . . . . . . . |
| iPS:43-6450 | 21-225_217E5 | VK1|A30/JK1 | . . F . . . . PP | . . . . . . . . . . | . . . . . . . . . C | . . . I . . . . . | VM . . . . . . . | . R . . . . . . . |
| iPS:43-6456 | 21-225_217G10 | VK1|A30/JK1 | . . . . . . . PP | . . . . . . . . . . | . . . . . . . . . . | . . . I . . . . . | . M.Y . . . . . | . R . . . . . . . |
| iPS:43-6458 | 21-225_217H12 | VK1|A30/JK1 | . . . C . . . PP | . . . . . . . . . . | . . . . . G . . . C | . . . I . V . R . | VM.Y . . . . . . | . R . . . . . . . |
| iPS:43-6462 | 21-225_218C4 | VK1|A30/JK1 | . F . . . . . . | . . . . . . . . . . | . . . . . . . . . . | . . . I . . . . . | VM . . . . . . . | . R . . . . . . . |
| iPS:43-6480 | 21-225_220F8 | VK1|A30/JK1 | . F . L . . . PP . R | . . . . . . . . . . | . . . . . . . . . . | . . . I . . R . . | . Y . . . . . . . | . R . . . . . . . |
| iPS:43-6534 | 21-225_224F1 | VK1|A30/JK1 | . A . . . . . . . | . . . . . . . . . . | . . . . . . . . . . | . . . . . . . . I | . Y . . . . . . . | . RA . . . . . . |
| iPS:43-6540 | 21-225_224F3 | VK1|A30/JK1 | . . . . . . . . | . . . . . G . . . . | . . . D . . . . . | . . . . . . . . . | . YN . . . . . . | . R . . . . . . . |
| iPS:43-6564 | 21-225_225A1 | VK1|A30/JK1 | . . . . . . . . | . . . . . . . . . . | . . . . . E . I . | . . . L . N . V . | . Y . . . . . . . | . RA . . . . . . |
| iPS:43-6596 | 21-225_226C6 | VK1|A30/JK1 | . . . I . . . . | . . . . . . . . . . | . . . D . . . . . | . . . I . . . . . | . YN . . . . . . | . R . . . . . . . |
| iPS:43-6604 | 21-225_226F7 | VK1|A30/JK1 | . . . . . . . . | . . . . . . . . . . | . . . . . . . . . . | . . . . . . . . D | . H.Y . . . . . | . R . . . . . . . |
| iPS:43-6620 | 21-225_226H11 | VK1|A30/JK1 | . . . . . . . . | . . . . . . . . . . | . Y . . . V . G . | . . . . . . . . A | . Y . . . . . . . | . R . . . . . . Q |
| iPS:43-7262 | 21-225_170E4 | VK1|A30/JK1 | . . . D . . . . | . . . . . . . . . . | . . . . . A . R . | . . . . . . . . . | . . . . . . . YP | . . . . . . . . D |
| iPS:43-7280 | 21-225_203C10 | VK1|A30/JK1 | . . . . . . . . | . H . . . . . . . . | . . . . . . . . . F | . . . . . . . . . | . Y . . . . . . . | . F . R . . . . . |
| iPS:43-7286 | 21-225_208F1 | VK1|A30/JK1 | . . . . . . . . | . . . . . . . . . . | . . . . . . . . . . | . . . . . . . . . | . . . . . . . . . | . . . . . . . . . |

FIGURE 52 (Continued)

| | | RF | | | | | | | V.R..C..N. | V..Y.. | |
|---|---|---|---|---|---|---|---|---|---|---|
| iPS:43 7290 | 21-225_210G6 | VK1|A30/JK1 | .F. | .H..D... | | | | | | |
| iPS:45 1114 | 21-225_159A3 | VK1|A30/JK1 | | .K.. | .N. | | .F. | | .H. | .F.R. |
| iPS:39 2626 | 21-225_18A5 | VK1|A30/JK1 | | | | | | | | |
| iPS:39 2634 | 21-225_17H3 | VK1|A30/JK1 | .F. | .S. | | | | .Q.Y. | .R. | |
| iPS:39 2674 | 21-225_18C2 | VK1|A30/JK1 | | | | .T. | .F. | | | |
| iPS:39 2686 | 21-225_17C7 | VK1|A30/JK1 | | | | | | | | .L..V. |
| iPS:39 2690 | 21-225_18F2 | VK1|A30/JK1 | | | | | | .G. | | |
| iPS:39 2710 | 21-225_19A10 | VK1|A30/JK1 | | .T. | .R. | .T..N | .R. | .N. | | .L..V. |
| iPS:39 2740 | 21-225_18H12 | VK1|A30/JK1 | | | | | | | | |
| iPS:39 2742 | 21-225_20B2 | VK1|A30/JK1 | .N. | .D. | | .T. | | .Y.N. | .R.A | .D. |
| iPS:39 2758 | 21-225_21G11 | VK1|A30/JK1 | | | | | | .N. | | .L..V. |
| iPS:39 2790 | 21-225_20D10 | VK1|A30/JK1 | .F. | | .R. | .V..Y | .Y. | .H.Q. | | |
| iPS:39 2796 | 21-225_22A4 | VK1|A30/JK1 | | | | | | | | |
| iPS:39 2832 | 21-225_21H8 | VK1|A30/JK1 | | .V. | | | | .H.Y. | .R. | |
| iPS:39 2836 | 21-225_22F4 | VK1|A30/JK1 | | .D. | .E. | .P. | .R..D. | | | |
| iPS:39 2844 | 21-225_23E11 | VK1|A30/JK1 | .L. | .G. | | .H. | | .Y. | .R. | .V. |
| iPS:39 2846 | 21-225_24B6 | VK1|A30/JK1 | | .D. | | .H. | .T. | .Y. | | |
| iPS:39 2872 | 21-225_20B11 | VK1|A30/JK1 | | | | .NF | | .N. | | |
| iPS:39 2876 | 21-225_21F7 | VK1|A30/JK1 | | .D. | | | | | | |
| iPS:39 2884 | 21-225_23A10 | VK1|A30/JK1 | | | | | .G. | .Y. | .R. | .L. |
| iPS:39 2894 | 21-225_21G2 | VK1|A30/JK1 | | | | .T..S | | | | .V. |

FIGURE 52 (Continued)

| | | | | | | | | | |
|---|---|---|---|---|---|---|---|---|---|
| iPS:39 2908 | 21-225_23F12 | VK1|A30/ JK1 | .... | .... | .... | .... | .... | .... | .... |
| iPS:39 2914 | 21-225_25D12 | VK1|A30/ JK1 | .... | .... | .... | .... | .... | Y.. | F.R. |
| iPS:39 2918 | 21-225_28F5 | VK1|A30/ JK1 | .... | .T.. | .... | .... | .... | .T.. | .... |
| iPS:39 2958 | 21-225_28C7 | VK1|A30/ JK1 | .... | .... | .I.. | .... | .... | .T.. | .V.. |
| iPS:39 2972 | 21-225_26A2 | VK1|A30/ JK1 | .... | .S.. | .T.. | ..F. | .... | .R.. | .... |
| iPS:39 3026 | 21-225_32B6 | VK1|A30/ JK1 | .... | .... | .I.. | .... | .... | .... | .... |
| iPS:39 3130 | 21-225_33C2 | VK1|A30/ JK1 | .... | .... | .V.P | ..H. | .... | .... | .... |
| iPS:39 3812 | 21-225_6A11 | VK1|A30/ JK1 | .... | .... | .... | .... | .... | .... | .... |
| iPS:39 3838 | 21-225_6G2 | VK1|A30/ JK1 | F..R.Y | .... | .Q.. | .NI.Y | .I.. | .L.. | .... |
| iPS:39 3864 | 21-225_4C5 | VK1|A30/ JK1 | ..H.HL. | .R.. | .R.. | ..G.Y | H.S. | .R.. | .... |
| iPS:39 3868 | 21-225_9C11 | VK1|A30/ JK1 | .... | .N..Y.N | .S.R.V | .N..I.H | .... | .T.L. | .... |
| iPS:39 3876 | 21-225_9A1 | VK1|A30/ JK1 | F..R. | .... | .R.. | ..I.Y | .I.. | .L.. | .... |
| iPS:39 3902 | 21-225_14E10 | VK1|A30/ JK1 | .... | .T.. | .H..Q | .... | .TA. | .Y.. | .K.. |
| iPS:39 3908 | 21-225_10E9 | VK1|A30/ JK1 | ..F. | ..D.. | .T..F | .N.. | .... | .Y.. | .R.. |
| iPS:39 3916 | 21-225_2G4 | VK1|A30/ JK1 | .... | ..S.. | .T.. | ..P.V | .... | .Y.. | .... |
| iPS:39 3948 | 21-225_16A5 | VK1|A30/ JK1 | .... | ..C. | .... | .N.Y | .... | .... | .F.R. |
| iPS:39 3960 | 21-225_7G2 | VK1|A30/ JK1 | .... | ..G. | .... | .... | .... | .Y.. | .R.. |
| iPS:39 3966 | 21-225_7F8 | VK1|A30/ JK1 | .... | .... | .T..H | .... | .L.. | .YT. | .R.. |
| iPS:39 3972 | 21-225_7C9 | VK1|A30/ JK1 | ..G. | .... | .... | .... | .... | LY.. | .R.. |
| iPS:39 3978 | 21-225_4C12 | VK1|A30/ JK1 | .... | .T..R | .T..H | .... | .L.. | .Y.. | .F.R. ..L.V |
| iPS:39 3986 | 21-225_7G4 | VK1|A30/ JK1 | .... | .... | .R.. | ..S. | .... | .HQY | .R..D. |

FIGURE 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:39 3996 | 21-225_15C11 | VK1|A30/ JK1 | ........ | ..L.Y...... | ........ | ........ | ........ | ..R... |
| iPS:39 3998 | 21-225_12B12 | VK1|A30/ JK1 | ........ | ........ | .....T.. | ........ | ......R. | ..L... |
| iPS:39 4041 | 21-225_5E5 | VK1|A30/ JK1 | ........ | ........ | ........ | ........ | ........ | .V.... |
| iPS:39 4067 | 21-225_12F2 | VK1|A30/ JK1 | ........ | ........ | ........ | ........ | .......Y.. | ......R. | ..V... |
| iPS:39 4089 | 21-225_12E6 | VK1|A30/ JK1 | ........ | ....S... | ........ | ........ | ......V... | ........ | ........ |
| iPS:39 4093 | 21-225_9D12 | VK1|A30/ JK1 | ........ | ........ | ........ | ........ | ........ | ........ | ........ |
| iPS:39 4095 | 21-225_16H4 | VK1|A30/ JK1 | ........ | ........ | ........ | ...T.... | ........ | ........ | ........ |
| iPS:39 4097 | 21-225_16G7 | VK1|A30/ JK1 | ........ | ........ | ........ | ........ | ........ | ........ | ........ |
| VK3|L2|K2 | Germline | EIVMTQSPATL SVSPGERATISC | RASQSVSSNLA | WYQQKPGQAPR LLIY | GASTRAT | GIPARFSGSGSG TEFTLTISSLQSEDFAV YYC | QQYNN WPPT | FGQGTK LEIK |
| iPS:46 8828 | 21-225_162A10 | VK3|L2/J K2 | ........ | ...T.N.. | .....S.. | ........ | .V...IN... | ........D. | ........ |
| iPS:43 4255 | 21-225_62E6 | VK3|L2/J K2 | ........ | ....N... | ......F. | ........ | .........R..F | ........D. | ...CS... |
| iPS:43 4269 | 21-225_57H3 | VK3|L2/J K2 | ........ | ........ | .....S.. | ......V. | ........N... | ........D. | ...CS... |
| iPS:43 4363 | 21-225_65A6 | VK3|L2/J K2 | .....V.F | ....S... | ........ | ........ | .F....N...W. | ........D. | ...CS... |
| iPS:43 4393 | 21-225_67C3 | VK3|L2/J K2 | ........ | ....N... | ........ | ...I.... | ........N... | ........D. | ...CS... |
| iPS:43 4425 | 21-225_70A5 | VK3|L2/J K2 | ........ | ....N... | ...L..S. | ...I.... | ...F..N....I | ........D. | ...CS..I.E. |
| iPS:43 4485 | 21-225_76D2 | VK3|L2/J K2 | .....P.. | .V..V... | ...S.... | ........ | ........V..I | ........D. | ...CS... |
| iPS:43 4537 | 21-225_74E11 | VK3|L2/J K2 | ........ | ...NS... | ...H.... | ........ | ........ | ........D. | ...CS... |
| iPS:43 4569 | 21-225_77H5 | VK3|L2/J K2 | ..V..... | ....S... | ...H.... | .....L.. | ...SF....F. | ........D. | ...CS..S. |
| iPS:43 4629 | 21-225_74C3 | VK3|L2/J K2 | ........ | ....S.A. | ........ | ........ | .....I...... | ........D. | ...CS...L. |
| iPS:43 4673 | 21-225_74E3 | VK3|L2/J K2 | .......L | ...NS.V.. | ........ | ........ | .........I | ........D. | ...CS...Q. |

| ID | Gene | | | | | | | | | |
|---|---|---|---|---|---|---|---|---|---|---|
| iPS:43 4447 | 21-225_71B6 | VK1jA30/ JK3 | .....P.. | ........ | ........ | ........ | ........ | ........ | ........ | ........ |
| iPS:43 4449 | 21-225_71H6 | VK1jA30/ JK3 | ........ | ........ | ........ | ........ | ........ | ........ | ........ | ........ |
| iPS:43 4453 | 21-225_71B11 | VK1jA30/ JK3 | ........ | ...V.... | ........ | ........ | ........ | ....Y... | ........ | ...V... |
| iPS:43 4463 | 21-225_73A6 | VK1jA30/ JK3 | ........ | ...D.... | ....F... | ........ | ....S... | ....G.T. | ........ | ...I... |
| iPS:43 4815 | 21-225_74A11 | VK1jA30/ JK3 | ........ | ...D.... | ....C... | ....N... | ........ | ........ | ....F... | ........ |
| iPS:43 4977 | 21-225_88A5 | VK1jA30/ JK3 | ........ | ........ | ........ | ........ | ........ | ........ | ....D... | ...E... |
| iPS:43 5253 | 21-225_96A4 | VK1jA30/ JK3 | ........ | ...D.... | ........ | ...G.... | ........ | ....R... | ....D... | ...R... |
| iPS:43 5511 | 21-225_157C3 | VK1jA30/ JK3 | ........ | ........ | ........ | ....V... | ........ | ....D... | ....D... | ........ |
| iPS:43 5521 | 21-225_157H4 | VK1jA30/ JK3 | ........ | ........ | ........ | ....P... | ....T... | ........ | ........ | ........ |
| iPS:43 5527 | 226_157G7 | VK1jA30/ JK3 | ....C... | ........ | ....N... | ....V... | ........ | ..V.R... | ...I.D.. | ...E... |
| iPS:43 5533 | 21-225_157H8 | VK1jA30/ JK3 | ........ | ........ | ........ | ........ | ........ | ........ | ........ | ........ |
| iPS:43 5537 | 21-225_157H12 | VK1jA30/ JK3 | ........ | ........ | ....R.H. | ....T... | ........ | ....D... | ........ | ........ |
| iPS:43 5547 | 21-225_158F5 | VK1jA30/ JK3 | ........ | ....F... | ....C.H. | ........ | ........ | ........ | ....Y... | ........ |
| iPS:43 5551 | 21-225_158H6 | VK1jA30/ JK3 | ........ | ........ | ....N... | ....T... | ........ | ........ | ........ | ...E... |
| iPS:43 5553 | 21-225_158G8 | VK1jA30/ JK3 | ........ | ....S... | ....M... | ....T... | ........ | ........ | ........ | ........ |
| iPS:43 5569 | 21-225_159C5 | VK1jA30/ JK3 | ........ | ....D... | ........ | ........ | ........ | ...I.D.. | ........ | ........ |
| iPS:43 5593 | 21-225_160F4 | VK1jA30/ JK3 | ....P... | ........ | ....N... | ....V... | ........ | ....D... | ....D... | ...E... |
| iPS:43 5609 | 21-225_161F7 | VK1jA30/ JK3 | ........ | ........ | ....E... | ........ | ..V.G.V.R.. | ....A..G | .LYIR... | ...R... |
| iPS:43 5613 | 21-225_161D11 | VK1jA30/ JK3 | ........ | ........ | ....E... | ....T... | ........ | ....A..G | ...Y.R.. | ........ |
| iPS:43 5617 | 21-225_162F2 | VK1jA30/ JK3 | ....C... | ........ | ....N... | ........ | ....V... | ..G.V.R.. | ...I.D.. | ...E... |
| iPS:43 5621 | 21-225_162H3 | VK1jA30/ JK3 | ........ | ........ | ....N... | ........ | ........ | ........ | ....D... | ...E... |

FIGURE 52 (Continued)

| | | | | | | | | | |
|---|---|---|---|---|---|---|---|---|---|
| iPS:43 5637 | 21-225_163E2 | VK1|A30/ JK3 | ......... | .D...... | ....T... | ....P... | .S...... | ........ | .D...... | ........ |
| iPS:43 5641 | 21-225_163F9 | VK1|A30/ JK3 | ......... | .D...... | ........ | ....P... | ........ | .A...... | .D...... | ....H... |
| iPS:43 5643 | 21-225_163G10 | VK1|A30/ JK3 | ......... | .D...... | ........ | ....P... | ........ | ........ | .DY..... | ........ |
| iPS:43 5719 | 21-225_171A11 | VK1|A30/ JK3 | ......... | .N...... | ........ | ........ | ........ | ........ | .DH..... | ........ |
| iPS:43 5769 | 21-225_177B6 | VK1|A30/ JK3 | ......... | .D.S.... | ........ | ........ | .N...... | ........ | .L...... | ........ |
| iPS:43 5791 | 21-225_180H7 | VK1|A30/ JK3 | ......... | ........ | ........ | ....T... | ........ | .S...... | ........ | .F...... |
| iPS:43 5805 | 21-225_181A8 | VK1|A30/ JK3 | ......... | ........ | ........ | ....T... | ........ | .D...... | ........ | .F...... |
| iPS:43 5879 | 21-225_184H10 | VK1|A30/ JK3 | ......... | ........ | ........ | ....I... | ........ | .S...... | ........ | ........ |
| iPS:43 5881 | 21-225_184D11 | VK1|A30/ JK3 | ......... | ........ | ....L... | ....I... | ........ | ........ | ........ | ........ |
| iPS:43 5921 | 21-225_190D6 | VK1|A30/ JK3 | ......... | ........ | ....L... | ........ | ........ | .P...... | .Y...... | ........ |
| iPS:43 5985 | 21-225_192F6 | VK1|A30/ JK3 | ......... | ........ | ....L... | ........ | ........ | .F...... | .Y...... | .F...... |
| iPS:43 6074 | 21-225_194F10 | VK1|A30/ JK3 | ......... | ........ | ........ | ........ | ........ | .P...... | .Y...... | ........ |
| iPS:43 6092 | 21-225_195B9 | VK1|A30/ JK3 | ......... | .K...... | ........ | ...D.... | ........ | .C...... | .YR..... | ........ |
| iPS:43 6164 | 21-225_197G10 | VK1|A30/ JK3 | ......... | .K...... | ........ | .G...... | ........ | ........ | .YR..... | ........ |
| iPS:43 6191 | 21-225_198B9 | VK1|A30/ JK3 | ......... | ........ | ........ | ........ | ........ | .V...... | .YR..... | .F...... |
| iPS:43 6205 | 21-225_199A7 | VK1|A30/ JK3 | ......... | .K...... | ........ | ........ | ........ | .V...... | .YR..... | ........ |
| iPS:43 6214 | 21-225_200F6 | VK1|A30/ JK3 | ......... | .D...... | ........ | ........ | ........ | ........ | .YR..... | ........ |
| iPS:43 6248 | 21-225_202A3 | VK1|A30/ JK3 | ...S..... | ........ | ...C.... | ........ | ........ | .H...... | .HD..... | ........ |
| iPS:43 6268 | 21-225_203B9 | VK1|A30/ JK3 | ......... | ........ | ........ | ...R.... | ........ | .I...... | ........ | ........ |
| iPS:43 6350 | 21-225_210E4 | VK1|A30/ JK3 | ......... | ........ | ........ | ...R.V.N | ........ | .H...... | ........ | ........ |
| iPS:43 6576 | 21-225_225B6 | VK1|A30/ JK3 | ...I..... | .K...M.. | ........ | ...T.... | ........ | ........ | ........ | ........ |

FIGURE 52 (Continued)

| | | | | | | | | | |
|---|---|---|---|---|---|---|---|---|---|
| iPS:43 6578 | 21-225_225D6 | VK1|A30/JK3 | . . . . . . . . . . | . . . . . . . . . . | . . . . . . . . . . | . . . . . . . . . . | . . . . . . . . . . | . T . . . . . . . . | . . . . . . . . . . |
| iPS:43 6582 | 21-225_225F8 | VK1|A30/JK3 | . . . . . . . . . . | . . . . . . . . . . | . . . . . . . . . . | . . . . . . . . . . | . . . . . . . . . . | . . . . . . . . . . | . . . . . . . . . . |
| iPS:43 6608 | 21-225_226A9 | VK1|A30/JK3 | . . . . . . . . . . | . . . . . . . . . . | . . . . . LG . . . | . . . . . . . . . . | . . . . . . . . . . | . . . . . . . . . . | . . . . . . . . . . |
| iPS:43 6630 | 21-225_227G3 | VK1|A30/JK3 | . . . . . . . . . . | . . . . . . . . D . | . . . . . . . . . . | . . . . . . . . . . | . . . . A . . . . . | . H . . . . . . . . | . . . . . . . . . . |
| iPS:43 6634 | 21-225_227H5 | VK1|A30/JK3 | . . . . . . . . . . | . . . . . . . . . . | . . . . . . . . . . | . . . . . . . . . . | . . . . . . . . . . | . . . . . . . . . . | . . . . . . . . . . |
| iPS:43 6650 | 21-225_227C12 | VK1|A30/JK3 | . . . . . . . . . . | . . . . . . H . . . | . . . . . . . . . . | . . . . . . . . . . | . . . . . . . . . . | . Y . . . . . . . . | . . . . . . . . . . |
| iPS:39 2632 | 21-225_16A11 | VK1|A30/JK3 | . S . . . S . . . . | . . . . . . . D . . | . . . . . . . RN . . | . . . . . . . . . . | . . . . . . . . . . | . . . . . . . . . . | . . . . . . . . . . |
| iPS:39 2684 | 21-225_17F4 | VK1|A30/JK3 | . . . . . . . . . . | . . . . . . . . . . | . . . . . . . . . . | . . . . . . . . . . | . . . . . . . . . . | . . . . . . . . . . | . . . . . . . . . . |
| iPS:39 2732 | 21-225_17E5 | VK1|A30/JK3 | . . . . . . . . . . | . . . . . . . . . . | . . . . . . T . . . | . . . . . . . . . . | . . . . . . . . . . | . . . . . L . . . . | . . . . V . . . . . |
| iPS:39 2778 | 21-225_22H3 | VK1|A30/JK3 | . . . . . . . . . . | . . . . . . . D . . | . . . . . . P . T . | . . . . . . . . . . | . . . . . F . . . . | . . . . . . . . . . | . . . . . . . . . . |
| iPS:39 2912 | 21-225_25A9 | VK1|A30/JK3 | . . . . . . . . . . | . . . . . . . N . . | . . . . . . . . . . | . . . . . . . . . . | . . . . . . . . . . | . D . . . . . . . . | . . . . . . . . . . |
| iPS:39 2934 | 21-225_27D5 | VK1|A30/JK3 | . . . . . . . . . . | . . . . . . . D . . | . . . . . . . . . . | . . . . . . . . . . | . . . . . . . . . . | . . . . . . . . . . | . . . . . . . . . . |
| iPS:39 2940 | 21-225_29D9 | VK1|A30/JK3 | . . . . . . . . . . | . . . . . . F . . . | . . . . . . . . . . | . . . . . . . . . . | . . . . . . . . . . | . T . . . . . . . . | . . . . . . . . . . |
| iPS:39 2948 | 21-225_25G5 | VK1|A30/JK3 | . . . . . . . . . . | . . . . . . . . . . | . . . . . . . . . . | . V . . . . . . . . | . . . . . . . . . . | . . . . . . . . . . | . . . . . . . . . . |
| iPS:39 2968 | 21-225_25B6 | VK1|A30/JK3 | . . . . . . . . . . | . . . . . . . . . . | . . . . . . R . . . | . . . . . . . . . . | . . . . . . . . . . | . . . . . . . . . . | . F . . . . . . . . |
| iPS:39 2978 | 21-225_28B8 | VK1|A30/JK3 | . . . . . . . . . . | . . . . . . . . . . | . . . . . . . . N . | . . . . . . . . . . | . . . . . . . . . . | . R . . . . . . . . | . N . . . . . . . . |
| iPS:39 2998 | 21-225_28A9 | VK1|A30/JK3 | . . . . . . . . . . | . . . . . . . . . . | . . . . . . P . . . | . . . . . . . . . . | . . . . . . . . . . | . . . . . . . . . . | . . . . . . . . . . |
| iPS:39 3000 | 21-225_29D7 | VK1|A30/JK3 | . . . . . . . . . . | . . . . . . . . . . | . . . . . . P . . . | . . . . . . . . . . | . . . . . . . . . . | . D . . . . . . . . | . . . . . . . . . . |
| iPS:39 3006 | 21-225_31G9 | VK1|A30/JK3 | . . . I . . . . . . | . . . . . . . . . . | . . . V . . . . . . | . . . . . . . . . . | . . . . . . . . . . | . D . . . . . . . . | . . . . . . . . . . |
| iPS:39 3022 | 21-225_30H11 | VK1|A30/JK3 | . . . . . . . . . . | . . . . . . . . . . | . . . . . . T . . . | . . . . . . . . . . | . . . . . . . . . . | . . H . . . . . . . | . . . . . . . . . . |
| iPS:39 3038 | 21-225_29D8 | VK1|A30/JK3 | . . . . . . . . . . | . . . . . . . . . . | . . . . . . . . . . | . . . . . . . . . . | . . . . . . . . . . | . . . . . . . . . . | . I . . . . . . . . |

FIGURE 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:39 3822 | 21-225_15B11 | VK1|A30/ JK3 | . . . . . . . . . . . . . . . . . . . . . . . | . . . . . . . . . . | . . . . . . . . . . | . . . . . . . . . . | . . . . . . . . . . . . . . . . . . | . . . . . . . . Y. . | . . . . . . |
| iPS:39 3944 | 21-225_14D6 | VK1|A30/ JK3 | . . . . . . . . . . . . . . . . . S. . . . | . . . D. . . . . H. . | . . . . H. . . . | . . . . . . . . . . | . . . . . . . . . . . . . . . . . . | . . . . . . . . . . | . . . . N. |
| iPS:39 4033 | 21-225_5F4 | VK1|A30/ JK3 | . . . . . . . . . . . . . . . . . . . . . . | . . . . H. . . | . . . . . . . . . . | . . . . . . . . . . | . . . . . . . . . . . . . . . . . . | . . . . Y.G | . . . . . |
| iPS:39 4069 | 21-225_16H1 | VK1|A30/ JK3 | . . . . . . . . . . . . . . . . . . . . . . | . . . DI. . . | . . . . . . . . . . | . . . . . N. . . | . . . . . . . . . . . . . . . . . . | . . . . YH. | . . . V. |
| iPS:40 2229 | 21-225_16H9 | VK1|A30/ JK3 | . . . . . . . . . . . . . . . . . . . . . . | . . . . Y. . . | . . . F. . . . | . . . . G. . . . | . . . . . . . . . . . . . . . . I. | . . . . YH. | . . . L. |
| | Germline | VK1|O12/JK1 | DIQMTQSPSSLSASVGDRVTITC | RAS QSIS SYLN | WYQQKPGK APKLLIY | AASSLQS | GVPSRFSGSGS GTDFTLTISSLQPEDFAT YYC | QQSYS TPYT | FGGGTK VEIK |
| iPS:46 8848 | 21-225_54B1 | VK1|O12/ JK1 | . . . . I. . . . . . . . . . . . . . . . . | . . . . N. . . | . . . F. . . . | . . . . . . . . . . | . . . . . . . . . . . . . . . . I. | . . . R. . . . | . . . . . |
| iPS:43 4239 | 21-225_58F1 | VK1|O12/ JK1 | . . . . . . . . . . . . . . . . . . . . . . | . . . NF. . . T. | . . . . . . F. | . . . . . . . . . . | . . . . . . . . . . . . . . . . . . | . . . . . TPL | . . . . . |
| iPS:43 5513 | 21-225_157F3 | VK1|O12/ JK1 | . . . . . . . . . . . . . . . . . . . . . . | . . . . N. . . | . . . L. . . . | . . . . T. . . . | . . . . . . . . . . . . . . . . . . | . . . N. TPT | . . . . . |
| iPS:43 5729 | 21-225_173E7 | VK1|O12/ JK1 | . CI. A. . Y | . . . . T. . . | . . . . . . . . . . | . . . . i. . . . | . . . . . . . . . . . . . . . . . . | . . . R. . . . | . . . . . |
| iPS:43 5753 | 21-225_175G10 | VK1|O12/ JK1 | . . . . . . . . . I. . . . . . . . . . . . | . . . T.G. . . | . . . . . . . R | . . . . H. . . . | . . . . . . . . . . . . . . . G. . . | . . . R. TPQ | . . . . . |
| iPS:43 5799 | 21-225_181G3 | VK1|O12/ JK1 | . . . . . . . . . . N. . . . . . . . . . . | . . . . N. . . | . . . A. . . . | . . . . . TLN. | . . . . . . . . . . . . . . . V. . . | . . . . . IPQ | . . . . . |
| iPS:43 5813 | 21-225_183A12 | VK1|O12/ JK1 | . . . . . . . . . . . . . C. . . . . . . . | . . . RN. . . | . . . . . . . . . . | . . . . . . V. . | . . . . . . . . . . . . . . . . F. | . . . . . SP. | . D. R |
| iPS:43 6003 | 21-225_192G10 | VK1|O12/ JK1 | . . . . . . . . . . . . . . . . . . . . . . | . . . . N. . . | . . . . . . . . . . | . . . . . E. . . | . . . . . . . . . . . . . . . . F. | . . . . . SP. | . . . . . |
| iPS:43 6212 | 21-225_200G1 | VK1|O12/ JK1 | . . . . . . . . . . . . . . . . . . . . . . | . . . . N. . . | . . . F. . . . | . . . . . E. . . | . . . . . . . . . . . . . . . . S. | . . . . . SP. | . F. . |
| iPS:39 2730 | 21-225_17A1 | VK1|O12/ JK1 | . . . . . . . . . . . . . . . . . . . . . . | . . . N.N. . . | . . G.V.F. | . . . . T. . . . | . . . . . . . . . . . . . . . . S. | . . . T. IPI | . . . . . |
| iPS:39 2736 | 21-225_17B12 | VK1|O12/ JK1 | . . . . . . . . . . S. . . . . . . . . . . | . . . N.N. . . | . G.V.L. | . . . . t. . . . | . . . . . . . . . . . . . . . . . . | . . . TT. TPT | . . . . . |
| iPS:39 2766 | 21-225_23H4 | VK1|O12/ JK1 | . . . . . . . . . . . . . . . . . . . . . . | . . . R. . . . | . . . . . . . . . . | . . . . R.S. . . | . . . . . . . . . . . . . . . . . . | . . . . . TPT | . . . . . |
| iPS:39 2770 | 21-225_20C10 | VK1|O12/ JK1 | . H. . . . . . . K.S. . . . . . . . . . . | . . . HH. . . | . . . . . . . . | . . . . T. . . . | . . . . . . . . . . . . . . . . . . | . . . T. TPT | . . . R |
| iPS:39 2808 | 21-225_20F8 | VK1|O12/ JK1 | . . . . . . . . . . . . . . . . . . . . . . | . . . R. . . . | . . . E. . . . | . . . . . . . . . . | . . . . . . . . . . . . . . . . I. | . . . N. TPT | . . . . . |

FIGURE 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:39 2954 | 21-225_26A10 | VK1|O12/JK1 | ....I.... | ....N.M.. | ....V.... | ....T.... | ......... | ....T.... | ...TPT... |
| iPS:39 3878 | 21-225_7G12 | VK1|O12/JK1 | ....S.... | .....N... | .G.V.L... | ......... | ......... | ......... | ...TPT... |
| iPS:39 8474 | 21-225_17B10 | VK1|O12/JK1 | .S......N | .....N... | .....F... | ....H.... | ....N.... | .G.N..... | ...TPT... | .N |
| | Germline VK4|B3/JK2 | K_FR1 DIVMTQSPDSL VSLGERATIN | K_CDR1 QSVLYSSRNK NYLA | K_FR2 WYQQKPGQ PPKLLIY | K_CDR2 WASTRES | K_FR3 GVPDRFSGSG SGTDFTLTIS SLQAEDVAV YYC | K_CDR3 QQYYS TPT | K_FR4 FGGG TKVE IK |
| iPS:46 8850 | 21-225_63F4 | VK4|B3/JK2 | ......... | ....S.... | ......... | ......... | ....I.... | ....T.... | ....CS |
| iPS:46 8852 | 21-225_71F3 | VK4|B3/JK2 | ...A..... | .....SN.. | ......... | ......... | ....I.... | ....T.... | ....CS |
| iPS:46 8870 | 21-225_74A8 | VK4|B3/JK2 | ......... | .SH...... | ......... | ......... | ....N.... | ......... | ....CS |
| iPS:43 4211 | 21-225_60F3 | VK4|B3/JK2 | ....T.... | ...N..... | ......... | ......... | ......... | ......... | ....CS |
| iPS:43 4235 | 21-225_61E3 | VK4|B3/JK2 | ......... | ...N...HI | ...Q..... | ....I.... | ......... | ....I.... | I.CS |
| iPS:43 4287 | 21-225_57F12 | VK4|B3/JK2 | ......... | ...Y...F. | ...T..... | ......... | ......... | ....I.... | N.CS |
| iPS:43 4305 | 21-225_59E1 | VK4|B3/JK2 | ......... | ...N..... | ...R..... | ...S..... | ......... | ...F..... | I.CS |
| iPS:43 4443 | 21-225_71G3 | VK4|B3/JK2 | .VA...... | ..N..D... | .L.....F. | ....F.... | ....F.... | ......... | ....CS |
| iPS:43 4483 | 21-225_74C12 | VK4|B3/JK2 | ......... | ..A...... | ....N.... | ......... | ......... | ......... | .... |
| iPS:43 4613 | 21-225_77D12 | VK4|B3/JK2 | ...A..... | .R.Y..... | ......... | ....D.... | ......... | ......... | ....CS |
| iPS:43 4635 | 21-225_78E6 | VK4|B3/JK2 | ......... | ..SH..... | ......... | ....I.... | ....S.... | ......... | ....CS |
| iPS:43 4679 | 21-225_79G7 | VK4|B3/JK2 | ......... | ..SH..... | ......... | ....I.... | .S.M..... | ......... | ....CS |
| iPS:43 4909 | 21-225_85C11 | VK4|B3/JK2 | ......... | ..SH.F... | ....N.... | ....FI... | .EG...A.. | ......... | ....CS |
| iPS:43 4959 | 21-225_87E10 | VK4|B3/JK2 | ....K.... | ....M.... | ...F..... | ....K.... | .S.G....T | ......... | S.CS | K. |
| iPS:43 5299 | 21-225_146D4 | VK4|B3/JK2 | ......... | ...N..... | ....V.... | ......... | ......... | ......... | ....CS |
| iPS:43 5305 | 21-225_146C9 | VK4|B3/JK2 | ......... | ....Y...H | ....V.... | ....K.... | ......... | ......... | ....CS |

FIGURE 52 (Continued)

| | | | | | | | | | |
|---|---|---|---|---|---|---|---|---|---|
| iPS:43 5309 | 21-225_146F9 | VK4|B3/J K2 | . . . . . . . . . . | . . . NI.H. . . | . Y . . . . . . . . . | . . . . . . . . . . | . T . . . . . . . . . | . T . . . . . . . . . | . . . . CS . . . . . T |
| iPS:43 5323 | 21-225_147D5 | VK4|B3/J K2 | . . . . . . . . . . | . . . . N . . . . . | . . . . . . . . . . | . . . . . . . . . . | . . . . . . . S . . | . . H . . . . . . . | . . . . CS . . . . . |
| iPS:43 5399 | 21-225_150D2 | VK4|B3/J K2 | . . . . . . . . K . | . . S.K.I . . . K | . . . . . . . . F . | . . . . . . . . K . | . . . . . . . . N . | . . F . . . . . . . | . . . . N . . . . R . |
| iPS:43 5435 | 21-225_152H3 | VK4|B3/J K2 | . . . . . . . . K . . | . . . . Y . . T. H . | . . . . . . . . . . | . . . . . . . . K . | . . . . . . . . . . | . . - . . . . . . . | . . . . CS . . . . . |
| iPS:43 5451 | 21-225_152D10 | VK4|B3/J K2 | G. . . A . . . . D . | . . . . . . . . . . | . . . . . . . . . . | . . . . . . . . . . | . . . Y . . . . . . | . . . . RSPS | . . . . . . . . . . |
| iPS:43 5459 | 21-225_152E12 | VK4|B3/J K2 | AV . . . . . . . . . | I . . . . . Y . . . | . . . . . . . . . . | . . . . . . . . . . | . . . . . . . . . . | . N- . . . . . . . . | . . G. CS . . . . . |
| iPS:43 5467 | 21-225_153B9 | VK4|B3/J K2 | G . . F . . . . . . | . . . . . . . . . . | . . H . . . . . . . | . . . . . . . F . | . . . Y.V . . . . . | . . . RSLS | . . . . . . . . . . |
| iPS:43 5471 | 21-225_153F11 | VK4|B3/J K2 | . . . . . . . . . . | . . . . YK . . . H . | . . . . . . . . N . | . . . . . . . . K . | . . . . . . . . . . | . . . . . . . . . . | . . . . CS . . . . . |
| iPS:43 5475 | 21-225_154H6 | VK4|B3/J K2 | . . . . . . . . . . | . . . . . Y . . . H . | . . . . . . . . . . | . . . . . . T. K . | . . . . . . . . . H . | . . H . . . . . . . | . . . . CS . . . . . |
| iPS:43 5491 | 21-225_155E5 | VK4|B3/J K2 | . . . . . . . . . . | . . . . . N . . . S . | . . . . . . . . . . | . . . . . . . . K . | . . . . . . . . S . | . . . . . . . . . . | . . . . CS . . . . . |
| iPS:43 5495 | 21-225_155B6 | VK4|B3/J K2 | . . . . . . . . . . | . . . . . Y . . . H . | . . . . . . . . . . | . . . . . . T. . . | . . . . . . . . . . | . . . . . . . . . . | . . . . CS . . . . . |
| iPS:43 5501 | 21-225_156H1 | VK4|B3/J K2 | . . . . . . . . . . | . . . . . N . . . . . | . . . . . . . . . . | . . . . . . . . . . | . . . . . . . . A . | . . H . . . . . . . | . . . . CS . . . . . |
| iPS:43 5589 | 21-225_160A4 | VK4|B3/J K2 | . . . . . . . . . . | . . . . . N . . . . . | . . . . . . . . . . | . . . . . . . . . . | . . . . . . . . . . | . . N . . . . . . . | . . . S. CS . . . . . |
| iPS:43 5727 | 21-225_172E11 | VK4|B3/J K2 | . . . . . . . . . . | . . . . . N . . . . . | . . . . . . . . . . | . . . . . . . . . . | . . . . . . . I . G . | . . FT . . . . . . . | . . . . CS . . . . . |
| iPS:43 6560 | 21-225_224F11 | VK4|B3/J K2 | N . . D . . . . . . | . . . . . H . . . . . | . . . M . . . . . . | . . . . . . . . . . | . . . . . . . . . . | . . T . . . . . . . | . . . . CS . . . . . |
| iPS:43 6584 | 21-225_225B9 | VK4|B3/J K2 | . . . . . . . . . . | . . . . . N . . . . . | . . . . . . . . F . | . . . . . . . . . . | . . . . . . . . . . | . HSK . . . . . . . | . . . I. GK . . . I . |
| iPS:43 6588 | 21-225_225F12 | VK4|B3/J K2 | . . . . . . . . . . | . . . . Q . . . . . | . . R . . . . . . . | . . . . . . . . . . | . . . . . . . . N . | . . I . . . . . . . | . . . . CS . . . . . Q |
| iPS:43 6590 | 21-225_225H12 | VK4|B3/J K2 | . . . . . . . . . . | . . . . . N . . . . . | . . . N . . . . . . | . . . . . . . . . . | . . . . . . . . . T . | . . I . . . . . . . | . . . . CS . . . . . |
| iPS:43 6598 | 21-225_226D6 | VK4|B3/J K2 | . . . . . . . . . . | R . . . . . . I.I . | . . M . . . . . . . | . . . . . . . . . . | . . . . . . . . . . | . . I . . . . . . . | . . . S. CS . . . . . |
| iPS:43 6636 | 21-225_227E6 | VK4|B3/J K2 | . . . . . . . . T . | . . . . . D . . . . . | . . M . . . . . . . | . . . . . . . . . . | . . . . . . . . . . | . . . . . . . . . . | . . . . CS . . . . . |

FIGURE 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:43 6644 | 21-225_227G9 | VK4jB3/J K2 | | .H. | | | | |
| iPS:43 6646 | 21-225_227D11 | VK4jB3/J K2 | ...D...... | .H. | | ....I..... | | ....A..S |
| iPS:43 7363 | 21-225_74C10 | VK4jB3/J K2 | | ..N.... | .N....... | | .N...... | .CS |
| iPS:45 1131 | 21-225_160A7 | VK4jB3/J K2 | ..L......P. | ..A........ | .SN | | | .CS |
| iPS:39 3088 | 21-225_33D1 | VK4jB3/J K2 | .........S | .H.N....... | .R..H | | ..Y..... | |
| iPS:39 4085 | 21-225_8B11 | VK4jB3/J K2 | | .I....T | .R..F. | | .L...C.... | .CS |
| iPS:39 8496 | 21-225_22D2 | VK4jB3/J K2 | .....T...... | .N.....N | | | .I...L.... | .S.CS |
| iPS:39 8512 | 21-225_25E12 | VK4jB3/J K2 | .....L...F. | .N....... | .H. | .K. | .F...... | .CS |
| iPS:39 8522 | 21-225_32A1 | VK4jB3/J K2 | M............ | ....Y..... | .H. | | ..Y...... | .CS |
| iPS:39 8524 | 21-225_32A5 | VK4jB3/J K2 | | .....Y..... | .L.. | .K. | ..T...L.... | .S.CS |
| iPS:39 8538 | 21-225_34H7 | VK4jB3/J K2 | | .....Y..... | .L.. | .K. | ..A..T..L.H | .S.CS |
| | | | | | | | .......T... | .S.CS |
| VK2jA17jJK4 | | Germline | EIVMTQSPLSLP VTPGEPASISC | RSS QSLLYS SGYNYLD | WYLQKPGQSP QRLIYL | GS NRAS | GVPDRF SGSGSG TDFTLKI SRVEAE DVG | MQGTH WPLT | FGGGTK VEIK |
| iPS:46 8854 | 21-225_72C4 | VK2jA17/ JK4 | | .........G | | .E..KW. | ............ | | |
| iPS:43 7250 | 21-225_148C6 | VK2jA17/ JK4 | | | | | .N. | | |
| iPS:43 7252 | 21-225_148H11 | VK2jA17/ JK4 | | | | .W. | ............ | .F. | |
| iPS:43 7254 | 21-225_149F2 | VK2jA17/ JK4 | ......S..Y. | .........S. | | .W. | ..V......... | | |
| iPS:43 7256 | 21-225_150F11 | VK2jA17/ JK4 | .F. | .........S. | .Y | .W. | ..V......... | .I. | |
| iPS:43 7268 | 21-225_177D2 | VK2jA17/ JK4 | | | | .W. | ............ | .I. | .P. |
| iPS:44 3005 | 21-225_43F11_LC1 | VK2jA17/ JK4 | | | | .W. | ............ | | .P. |
| iPS:39 8530 | 21-225_32G4 | VK2jA17/ JK4 | .........S | | | | ...I-.......HW.. | | |

FIGURE 52 (Continued)

| | Germline | K_FR1 | K_CDR1 | K_FR2 | K_CDR2 | K_FR3 | K_CDR3 | K_FR4 |
|---|---|---|---|---|---|---|---|---|
| VK2|A17|JK3 | | DVVMTQSPLSL PVTLGQPASIS C | RSS QSLVHSD GNTYLN | WFQQRPGQ SPRLLIY | KVSNRDS | GVPDRFSGSGS GTDFTLKISRVEAEDVGV YYC | MQGTH | FGGGTK LEIK |
| iPS:46 8856 | VK2|A17| JK3 | | V...S.S | | | | ...... R | ....... | ........ |
| iPS:39 2936 | VK2|A17| JK3 | | .....D... | ......Q. | .W.. | .........N...... | .HC.- HWLL | ...... |
| VK2|A17|JK5 | | DVVMTQSPLSL PVSPGERATLSC | RSS QSLVHSD GNTYLN | WFQQRPGQ SPRLLIY | KVSNRDS | GVPDRFSGSGS GTDFTLKISRVEAEDVGV YYC | MQGTH | FGGGTK LEIK |
| iPS:47 2741 | 21- 225_30D9_L C1 | VK2|A17| JK5 | ......F.. | | .W.. | .........L...... | L....... ...... | ....... |
| iPS:43 7294 | 21- 225_216D5 | VK2|A17| JK5 | | | .W.. | .........I...... | A-...... .HWP | ....... |
| iPS:47 2732 | 21- 225_2B10_L C1 | VK2|A17| JK5 | ......F.. | | .W.. | .........G...... | I....... .FP | ....... |
| iPS:39 8508 | 21-225_24B1 | VK2|A17| JK5 | | | .W.. | .........C...... W. | A....... .WP | ....... |
| iPS:42 3019 | 21- 225_31D12_ LC1 | VK2|A17| JK5 | ......F.. | | .W.. | .........I...... .L. | L....... .L.. | ....... |
| VK1|L5|JK1 | | DIQMTQSPSSL SASVGDRVTITC | RAS QGIS SWLA | WYQQRKP APKLLIY | AASSLQS | GVPSRFSGSGS GTDFTLTISSLQPEDFAT YYC | QQANS FPWT | FGQGTK VEIK |
| iPS:43 3897 | 21-225_43C2 | VK1|L5|J K1 | ......D... | ......R. | | ..............N | T....... | ....... |
| iPS:43 3903 | 21-225_43H4 | VK1|L5|J K1 | ......I... | | | ..............N | T....... | ....... |
| iPS:43 3911 | 21-225_43E8 | VK1|L5|J K1 | N....N... | | | | T....... | ....... |
| iPS:43 3941 | 21- 225_44D10 | VK1|L5|J K1 | ......D... | ......R. | | .........K....... | T....... | ....... |
| iPS:43 3945 | 21- 225_44C12 | VK1|L5|J K1 | ......N... | ......S. | .F.. | ..............S. | S....... | ....... |
| iPS:43 3957 | 21-225_45F8 | VK1|L5|J K1 | ......D... | ......R. | .G.. | ..............N | T....... | ....... |

FIGURE 52 (Continued)

| | | | | | | | | | |
|---|---|---|---|---|---|---|---|---|---|
| iPS:43 3973 | 21-225_46A6 | VK1|L5/J K1 | . . . N . . . N | . . . . . . . . | . . . . . V . . | . . . . . . . . | . . . . . . . . | . N . . . . . . | . T . . . . . . | . . . . . . . . |
| iPS:43 3993 | 21-225_47G7 | VK1|L5/J K1 | | . . . . N . I . | . . . . . . . . | . . . . . F . . | . . . . . . N . | . . . . . A . . | . V . . . . . . | . . . . . . . . |
| iPS:43 4007 | 21-225_48D7 | VK1|L5/J K1 | | | | | . . . . . . . S | . . . . . . . N | . . . . . . . . | . . . . . . . . | . . . . . . . . |
| iPS:43 4063 | 21-225_51G7 | VK1|L5/J K1 | | . . . . . D . . | . . . . . . . . | . . . . . V . . | A . . . . . . . | . . . . . . . . | . H . . . . . . | . . . . . . . . |
| iPS:43 4083 | 21-225_52H2 | VK1|L5/J K1 | | . . . . N . T . | . . . . . . . . | F . . . . R . . | T . . . . P . N | . . . . . . . . | . . . . . . . . | . H . . . . . V . |
| iPS:43 4133 | 21-225_54G3 | VK1|L5/J K1 | | . . . . . N . . | . . . . . . . . | . . . . . . . . | . . . . . D . . | . . . . E . . . | . . . . . C . . | . . . . . . . . |
| iPS:43 4221 | 21-225_60A11 | VK1|L5/J K1 | | . . . . . V . . | . . . . . . . . | . . . . L . . . | . . . . . T . . | . . . . . N E . | . T . . . . . . | . . . . . . . . |
| iPS:43 4283 | 21-225_57F8 | VK1|L5/J K1 | | . . . . . N . . | . . . . . . . . | . . . . . . . . | . . . . . T . . | . . . . . N E . | . . . . . . . . | . . . . . . . . |
| iPS:43 5711 | 21-225_171G4 | VK1|L5/J K1 | | . . . . . . V N . | . . . . . . . . | . . . . . . . . | . . . . . . R . D . | . . . . . . . . | . . . . . . . . | . . . . . . . . |
| iPS:43 5715 | 21-225_171A8 | VK1|L5/J K1 | A . . . . . . . . | . . . . . . . N . | . . . . . . . . | . N . M . H . . | . . . . . . F . G | A . . . . . . . . | . T . . . . . . | . . . . . . . . |
| iPS:43 5717 | 21-225_171A9 | VK1|L5/J K1 | | . . . . . D . T . | . . . . . . . . | . . . . . . . . | . . . . . D . . | . . . . . . . . | L . T . . . . . | . . . . . . . . |
| iPS:43 5739 | 21-225_174G7 | VK1|L5/J K1 | A . . . . . . . . | . . . . . . . . . . | . . . . . . . I . | . N . . . H . . | . . . . . F . G | . V . . . . . . | . T . . . . . . | . . . . . . . . |
| iPS:43 5749 | 21-225_175C10 | VK1|L5/J K1 | | . . . . . N . . | . . . . . . T . | . . . . . . . . | . . . . . . . . | . . . . . . . . | . T . . . . . . | . . . . . . . . |
| iPS:43 5775 | 21-225_178A5 | VK1|L5/J K1 | | . . . . . D . . | . . . . . . . . | . . . . . . . . | . . . . . . . . | . . F . . . N . | . . . . . . . . | . . . . . . . . |
| iPS:43 5777 | 21-225_178F7 | VK1|L5/J K1 | | . . . . M . D . T | . . . . . . . . | . . . . . S . . | . . . . . . . . | . . . . . D . . | . . . . . . C . | . . . . . . . . |
| iPS:43 5783 | 21-225_179G1 | VK1|L5/J K1 | | . . . . . D . . | . . . . . . . . | . . . . . S . . | . . . . . . . . | A . . . . . . . | . . . . . . . . | . L . . . . . . |
| iPS:43 5875 | 21-225_190B9 | VK1|L5/J K1 | | . . . . . . . N . | . . . . . . . . | . . . . . . . . | G . . . . . . V . | . . . . . G . . | . . . . . S . . | . L . . . . . . |
| iPS:43 5895 | 21-225_188E8 | VK1|L5/J K1 | | . . . . . N . D . | . . . . . . . . | . . . . . . . . | . . . . . . . N . | . . . . . . . . | . . . . . S E . | . . . . . . . . |
| iPS:43 5909 | 21-225_190H3 | VK1|L5/J K1 | | . . . . . . L N . | . . . . . . . . | . . . . L . . . | . . . . . . . . | . . . . . . . . | . . . . . . H . | . . . R . . . . |
| iPS:43 6013 | 21-225_193F2 | VK1|L5/J K1 | | . . . . . . N . . | . . . . . . . . | . . . . . . . . | G . . . . . . V . | G . . . . . . . | . . . . . S . . | . L . . . . . . |
| iPS:43 6068 | 21-225_194F7 | VK1|L5/J K1 | | . . . . . . R . . | . . . . . . . . | . . F . . . I . | . . . . . . . . | . . . . . . . . | . . . . . . . . | . . . R . . . . |

FIGURE 52 (Continued)

| | | K_FR1 | K_CDR1 | K_FR2 | K_CDR2 | K_FR3 | K_CDR3 | K_FR4 |
|---|---|---|---|---|---|---|---|---|
| | Germline | DIQMTQSPSSLSA SVGDRVTITC | RAS QSISSYLN | WYQQKPGK APKLLIY | AASSLQS | GVPSRFSGSGSGT DFTLTISSLQPEDFAT YYC | QQSYS TPPT | FGQGTK VDIK |
| iPS:43 21-225_195G12 | VK1|L5/J K1 | . . . . . . . . . . . . . . . . . . . . . . . . . . . . . . . . . . . | . . . N . . . . . . | . . . . . . . . . . . . . . . . | . . . G . . . | . . . . . . . . . . . . . . . . . . . . . . . A . . . . . . . . . . . . . . | . . . . . . . | . R . . . |
| iPS:43 21-225_196B9 | VK1|L5/J K1 | . . . . . . . . . . . . . . . . . . . . . . . . . . . . . . . . . . . | . . . N . . . . . . | . . . F . C . . . . . . . . | . . . V . . . | . . . . . . . . . . . . . . . . . . . S . . . . . . . . . . . . . . | . . GD . . . | . . NQ |
| iPS:43 21-225_197C9 | VK1|L5/J K1 | . . . . . . . . . . . . . . . . . . . . . . . . . . . . . . . . . . . | . . . NC . . . . . | . . . F . . . . . . . . . . | . . . . . . . | . . . . . . . . . . . . . . . . . . . . . . . . . . . . S . . . . . . . . . . . . . . | . . P . . . | . . FR |
| iPS:43 21-225_224D6 | VK1|L5/J K1 | . . . . . . . . . . . . . . . . . . . . . . . . . . . . . . . . . . . | . . . N . . . . . . | . . . Q . . . . . . . . . . | . . . . . . . | . . . . . . . . . . . . . . . . . . . S . . . . . . . . . . . . . . . . . | . . . . . . . | . . . . |
| iPS:43 21-225_227E4 | VK1|L5/J K1 | . . . . . L . . . . . . . . . . . . . . . . . . . . . . . . . . . . . | . . . I . . . . . . | . . . . . . . . . . . . . . . . | . . . . . . . | . . . . . . . . . . . . . . . . . . . . . . . . . . . . . . . . . . . | . . . . . . . | . . P . |
| iPS:39 21-225_17A4 | VK1|L5/J K1 | . . . . . . . . . . . . . . . . . . . . . . . . . . . . . . . . . . . | . . . N . . G . . . | . . . . F . . . . . . . . . | . . . . . . . | . . . . . . . . . . . . . . . . . . . . . . . . . . . . . . . . . . . | . . . R . . . | . . . . |
| iPS:39 21-225_20F7 | VK1|L5/J K1 | . . . . . G . . . . . . . . . . . . . . . . . . . . . . . . . . . . . | . . . . . . . . . . | . . . . . . . . . . . . . . . . | . . . . . . . | . . . . . . . . . . . . . . . . . . . . . . . . . . . . . . . . . . . | . . . . . . . | . . . . |
| iPS:39 21-225_27C5 | VK1|L5/J K1 | . . . . . . . . . . . . . . . . . . . . . . . . . . . . . . . . . . . | . . . . . . . . . . | . . . . . . . . . . . . . . . . | . . . G . . . | . . . . . . . . . . . . . . . . . . A . . . . . . . . . . . E . . . . . . | . . YD . . . | . . . . |
| iPS:39 21-225_27A11 | VK1|L5/J K1 | . . . . . . . . . . . . . . . . . . . . . . . . . . . . . . . . . . . | . . . . . . . . . . | . . . F . . . . . . . . . . | . . . G . . . | . . . . . . . . . . . . . . . . . . A . . . . . . . . . . . C . . . . . . | . . SD . . . | . . . R . |
| iPS:39 21-225_26D12 | VK1|L5/J K1 | . . . . . . . . . . . . . . . . . . . . . . . . . . . . . . . . . . . | . . . . . . . . . . | . . . . . . . . . . . . . . . . | . . . . . . . | . . . . . . . . . . . . . . . . . . A . . . . . . . . . . . C . . . . . . | . . SD . . . | . . . R . |
| iPS:39 21-225_25D7 | VK1|L5/J K1 | . . . . . . . . . . . . . . . . . . . . . . . . . . . . . . . . . . . | . . . D . F . . . . | . . . . . . . . . . . . . . . . | . . . . . . . | . . . . . . . . . . . . . . . . . . . . . . . . . . . N . . . . . . . | . . . Y . . . | . . . R . |
| iPS:39 21-225_25B3 | VK1|L5/J K1 | . . . . F . . . . . . . . . . . . . . . . . . . . . . . . . . . . . . | . . . . D . . . . . | . . . S . . . . . . . . . . | . . . G . . . | . . . V . G . . . . . . . . . . . A . . . . . . . . . . . . . . . . . . | . . SD . . . | . . . R . |
| iPS:39 21-225_5A4 | VK1|L5/J K1 | . . . . . . . . . . . . . . . . . . . . . . . . . . . . . . . . . . . | . . . T . . . . . . | . . . R . . . . . . . . . . | . . . D . . . | . . . . . . . . . . . . . . . . . . . . . . . . . . . C . . . . . . . . | . . . . . . . | . . . . |
| | | K_FR1 | K_CDR1 | K_FR2 | K_CDR2 | K_FR3 | K_CDR3 | K_FR4 |
| VK2|A19/JK3 | Germline | DIVMTQSPLSLP VTPGEPASISC | RSS QSLLHSN GYNYLD | WYLQKPGQ SPQLLIY | LGSNRAS | GVPDRFSGSGSG TDFTLKISRVEAEDVGV YYC | MQALQ TPFT | FGQGTK VEIK |
| iPS:43 21-225_44E10 | VK2|A19/JK3 | . . . . . . . . . . . . . . . . . . . . . . . . . . . . . . . . . . | . . . S . E . . . . | . . . . . . . . . . . . . . . . | . . . . . . . | . . . . . . . . . . . . . . . . . . . . . . . . . . . . . T . . . . . . | . . . T . . . | . . . . |
| iPS:43 21-225_47C7 | VK2|A19/JK3 | . . . . . . . . . . . P . . . . . . . . . . . . . . . . . . . . . . | . . . . . . . . . . | . . . S . . . . . . . . . . | . . . F . . . | . . . . . . . . . . . . . . . . . . . . . . . . . . . . . . . . . . . | . . . V . . . | . . . . |
| | | K_FR1 | K_CDR1 | K_FR2 | K_CDR2 | K_FR3 | K_CDR3 | K_FR4 |
| VK1|O12/JK3 | Germline | DIQMTQSPSSLSA SVGDRVTITC | QAS QDISN SV..N | WYQQKPGK APKLLIY | AASSLOS | GVPSRFSGSGSGT DFTFTISSLQPEDIAT YYC | QQSYS TPPT | FGQGTK VEIK |
| iPS:43 21-225_48D1 | VK1|O12/JK3 | . . . . . . . . . . . . . . . . . . . . N . . . . . . . . . . . . . . | . . . I . . . . . . | . . . . . . . . . . . . . . . . | . . . . . . . | . . . . . . . . . . . . . . . . . . A . . . . . . . . . . . S . . . . . . | . . . N . . . | . . I . |
| iPS:43 21-225_48C3 | VK1|O12/JK3 | . . . . . . . . . . . . . . . . . . . . N . . . . . . . . . . . . . . | . . . I . . . . . . | . . . . . . . . . . . . . . . . | . . . . . . . | . . . . . . . . . . . . . . . . . . A . . . . . . . . . . . S . . . . . . | . . IN . . . | . . I . |

FIGURE 52 (Continued)

| | | | | | | | | | |
|---|---|---|---|---|---|---|---|---|---|
| iPS:43 4037 | 21-225_49G12 | VK1O12/ JK3 | . . . . . . . . . . | . . . . . . . . . . S . . . . . . . . T . . M | . . . . . . . . . . . . . . . . . . . . | . . . . . . . . . . . . . . . . . . . . | . . . . . . . . . . E . A . . . . . . . | . . . . . . . . . . . . . . . . . . . . | . . . . . . . . . . . . . . . I . . . . | . . . . . . . . . . . . . . . . . . . . |
| iPS:43 4041 | 21-225_50H8 | VK1O12/ JK3 | . . . N . . . . . . | . . . . . . . . . . | . . . . . . . . . . | . . . . . . . . . . | . . . . . . . . . . | . . . N . . . . . . | . . . L . . . . . . | . . . . . . . . . . |
| iPS:43 4045 | 21-225_50H10 | VK1O12/ JK3 | . . . N . . . . . . | . . . . . . . Y . . I | . . . . . . . . . . | . . . . . . . . . . | . . . . . . . A . . | . . . N . . . . . . | . . . . . . . I . . | . . . . . . . . . . |
| iPS:43 4049 | 21-225_50B12 | VK1O12/ JK3 | . . . . . . . . . . | . . . . . . . . . . | . . . . . . . H . . R | . . . . . . . . . . | . . . . . . . E . . T | . . . . . . . I . . | . . . . . . . A . . | . . . . . . . . . . |
| iPS:43 4073 | 21-225_51H10 | VK1O12/ JK3 | . . . . . . . . . . | . . . . . . . T . . M | . . . . . . . . . . | . . . . . . . . . . | . . . . . . . E . A . | . . . . . . . . . . | . . . . . . . I . . | . . . . . . . . . . |
| iPS:43 4107 | 21-225_53E2 | VK1O12/ JK3 | . . . . . . . . . . | . . . . . . . . F . | . . . . . . . . . . | I . . . . . . . . . | . . . P . . . . . . | . . . F . . . . . . | . . . . . . . . . . | . . . . . . . . . . |
| iPS:43 4181 | 21-225_56B2 | VK1O12/ JK3 | . . . . . . . . . . | . . . . . . . H . . | . . . N . . F . . . V . | . . . . . . . . . . | . . . . . . . . . I F | . . . . . . . . . . | . . . . . . . . . . | . . . . . . . . . . |
| iPS:43 4225 | 21-225_60E12 | VK1O12/ JK3 | . . . . . . . . . . | . . . . . . . H . . | . . . N . . F . . . V . | . . . . . . . . . . | . . . . . . . . . I F | . . . F . . . . . . | . . . . . . . . . . | . . . . . . . . . . |
| iPS:43 4227 | 21-225_61A1 | VK1O12/ JK3 | . . . . . . . . . . | . . . . . . . . . . | . . . . . . . . . . | . . . . . . . . . . | . . . P . . . . . . | . . . N . . . . . . | . . . I S . . . . . | . . . . . . . . . . |
| iPS:43 4245 | 21-225_62H1 | VK1O12/ JK3 | . . . Y . . . . . . | . . . . . . . N . F | . . . V . . . . . . V F | . . . . . . . . . . | . . . . . . . . . . | . . . . . . . . . . | . . . I S . . . . . | . . . . . . . . . . |
| iPS:43 4267 | 21-225_57F2 | VK1O12/ JK3 | . . . . . . . . . . | . . . . . . . . F . | . . . . . . . . . . | . . . . . . . . . . | . . . P . . . . . . | . . . N . . . . . . | . . . . . . . . . . | . . . . . . . . . . |
| iPS:43 4323 | 21-225_62H8 | VK1O12/ JK3 | . . . . . . . . . . | . . . . . . . N . . | . . . . . . . . . . | . . . . . . . S . . | . . . . . . . L . N | . . . . . . . . . . | . . . I S . . . . . | . . . R . . . . . . |
| iPS:43 4379 | 21-225_66A9 | VK1O12/ JK3 | . . . . . . . . . . | . . G . . . I . . Y . | . . . . . . . . . . | . . . . . . . . . . | I . . . . . . . . . | . . . . . . . . . . | . . . V . . . . . . | . . . . . . . . . . |
| iPS:43 4417 | 21-225_69C8 | VK1O12/ JK3 | . . . F . . . . . . | . . . . . . . N . . | . . . F L . . . . . | . . . T . . . . . . | . . . V . . . . . . | . . . T . . . . . . | . . . . . . . . . . | . . . F . . . . . . |
| iPS:43 5545 | 21-225_158F4 | VK1O12/ JK3 | . . . . . . . . . . P | . . . . . . . K . . H | . . . . . . . . . . | . . . . . . . . . . | . . . . . . . . . . | . . . . . . . . . . | . . . I S . . . . . | . . . R . . . . . . |
| iPS:43 5793 | 21-225_180F8 | VK1O12/ JK3 | . . . G . . . . . . | . . . . . . . T . . L | . . . . . . . . . . | . . . G . . . . . . | S . . . . . . . . . | . . . . . . . . . . | . . . . . . . . . . | . . . . . . . . . . |
| iPS:43 6504 | 21-225_222H4 | VK1O12/ JK3 | . . . H . . . . . . | . . . . . . . N . . | . . . . . . . . . . | . . . T . . . . . . | . . S . . . V H R D . . I | . . . Y . F . . . . | . . . . . . . . . . | . . . R . . . . . . |
| iPS:43 6510 | 21-225_222H8 | VK1O12/ JK3 | . . . . . . . . . . | . . . . . . . N . . V | . . . . . . . . . . | . . . I . . . . . . | . . . S . . . V H R D . . I | . . . Y . F . . . . | . . . . . . . . . . | . . . R . . . . . . |
| iPS:43 7230 | 21-225_62H10 | VK1O12/ JK3 | . . . . . . . . . . | . . . . . . . . . . I | . . . . . . . . . . | . . . T . . . . . . | . . . . . . . . . . | . . . H . . . . . . | . . . F . . . . . . | . . . N . . . . . . |
| iPS:44 8906 | 21-225_72G9 | VK1O12/ JK3 | . . . . . . . . . . | . . . . . . . T . . | . . . V . . . . . . S | . . . . . . . . . . | . . . . . . . . . . F | . . . H . . . . . . | . . . F . . . . . . | . . . F . . . . . . |
| iPS:39 2652 | 21-225_17C6 | VK1O12/ JK3 | . . . . . . . . . . | . . . . . . . N . . | . . . . . . . . . . | . . . . . . . . . . | . . . . . . . . . . | . . . R . . . . . . | . . . T P F . . . . | . . . . . . . . . . |

| | | K_FR1 | K_CDR1 | K_FR2 | K_CDR2 | K_FR3 | K_CDR3 | K_FR4 |
|---|---|---|---|---|---|---|---|---|
| iPS:39 3848 | 21-225_4H2 | VK1|O12/ JK3 | ....L...... | ....I..N.... | .....V...... | ............ | ............ | ....R...TPL. | ............ |
| iPS:39 3862 | 21-225_5G2 | VK1|O12/ JK3 | ....P...... | ............ | ............ | ............ | .GCV.R...... | ............ | ............ |
| iPS:39 3888 | 21-225_3E3 | VK1|O12/ JK3 | ....F...... | ....N.I..... | R.V......... | G........... | .N.R........ | ............ | ............ |
| iPS:39 3890 | 21-225_4B1 | VK1|O12/ JK3 | ....F...... | ....R....... | .H.V........ | .T.......... | ............ | ............ | ............ |
| iPS:39 3898 | 21-225_5F7 | VK1|O12/ JK3 | ....P...... | ....HT.R.... | ............ | G........... | ....IN...... | ....N...TPL. | ............ |
| iPS:39 3904 | 21-225_8H11 | VK1|O12/ JK3 | ....F...... | ....T....... | ............ | ............ | ....TN...... | ....N...IS.. | ............ |
| iPS:39 3936 | 21-225_14A11 | VK1|O12/ JK3 | ....I...... | ....N.I..... | N.M......... | V........... | ............ | ....N...TPL. | ....V....... |
| iPS:39 3980 | 21-225_6D3 | VK1|O12/ JK3 | ............ | ....T....... | ....F....... | T....H...... | S........... | ....T...SP.. | ....A....... |
| iPS:39 4014 | 21-225_8G6 | VK1|O12/ JK3 | ............ | ....T....... | ....F....... | .N.......... | ....F....... | ....R...TPF. | ............ |
| iPS:39 4022 | 21-225_16H6 | VK1|O12/ JK3 | ............ | ............ | ....F....... | ............ | ....F....... | ....R...TPF. | ............ |
| iPS:39 4043 | 21-225_3B1 | VK1|O12/ JK3 | ............ | ....N....... | ............ | ............ | ....R....... | ....R...TPL. | ....F....... |
| iPS:39 4051 | 21-225_9E5 | VK1|O12/ JK3 | ....Q...... | ....N....... | ............ | T...N....... | ............ | ............ | ............ |
| iPS:39 4077 | 21-225_8E12 | VK1|O12/ JK3 | ............ | ....A....... | ............ | G........... | ............ | ............ | ....N....... |
| iPS:39 4087 | 21-225_11A5 | VK1|O12/ JK3 | ............ | ....N.Y..... | ............ | ............ | ............ | ....R...TPL. | ............ |
| | | ............ | ............ | ............ | ............ | ............ | ............ | ....N...TPL. | ............ |
| | Germline | K_FR1 DIVMTQTPLSLSVTPGQPASISC | K_CDR1 KSS QSLLHSD GKTYLY | K_FR2 WYLQKPGQ SPQLLIY | K_CDR2 EVS... NRFS | K_FR3 GVPDRFSGSGS GTDFTLKISRVEAEDVGV YYC | K_CDR3 MQGTH...LPLT | K_FR4 FGPGTK VDIK |
| | VK2|A18|JK3 | K_FR1 | K_CDR1 | K_FR2 | K_CDR2 | K_FR3 | K_CDR3 | K_FR4 |
| iPS:43 4053 | 21-225_51E1 | VK2|A18/ JK3 | ....M...... | ....E....... | ....R....... | ....N....... | ............ | ....E...S.Q. | ............ |
| iPS:43 4137 | 21-225_54D4 | VK2|A18/ JK3 | ....M...... | ............ | P..F.F....F. | ............ | ............ | ............ | ............ |
| iPS:43 4149 | 21-225_55H1 | VK2|A18/ JK3 | ............ | ....E....... | P..F.F....F. | ....N....... | ............ | ....E...S.Q. | ............ |
| iPS:43 5315 | 21-225_147B2 | VK2|A18/ JK3 | ............ | ....E....... | P.........F. | ....H....... | ............ | ....I...S.Q. | ............ |
| | | ............ | ............ | ............ | ....H.V..... | V........... | ....STQ..F.P. | ............ |
| | | K_FR1 | K_CDR1 | K_FR2 | K_CDR2 | K_FR3 | K_CDR3 | K_FR4 |

FIGURE 52 (Continued)

[Figure showing sequence alignment table - content not transcribed due to low resolution and complexity]

| | | | | | | | | | | |
|---|---|---|---|---|---|---|---|---|---|---|
| iPS:43 5845 | 21- 225_191G1 | VK1|L1/J K4 | . . . | . . . | . . . | . . . | . . . | K . . . | . . . | H.LT . . . |
| iPS:43 5859 | 21- 225_190E6 | VK1|L1/J K4 | . . . | T . . . G . . . | . . . | . . . | K . . . | . . . | MT . . . |
| iPS:43 5873 | 21- 225_190G4 | VK1|L1/J K4 | . . . | . . . D.G. | R . . . | . . . | K . . . N . . . | . . . | ST . . . |
| iPS:43 5933 | 21- 225_190F8 | VK1|L1/J K4 | . . . | T . . . G . . . | . . . | . . . | K . . . | . . . | MT . . . |
| iPS:43 5945 | 21- 225_191A10 | VK1|L1/J K4 | . . . | . . . K . . . | . . . | . . . | K . . . Y . . . | . . . | ST . . . |
| iPS:43 5947 | 21- 225_191E10 | VK1|L1/J K4 | . . . | . . . K . . . | . . . | . . . | K . . . N.I | . . . | ST . . . |
| iPS:43 5957 | 21- 225_191G12 | VK1|L1/J K4 | . . . | . . . G . . . | L . . . | K . . . | K . . . N . . . | . . . | IT . . . S. |
| iPS:43 5963 | 21- 225_192D2 | VK1|L1/J K4 | . . . I | . . . | . . . | . . . | K . . . | . . . | H.VT . . . N . . . |
| iPS:43 5971 | 21- 225_192D3 | VK1|L1/J K4 | . . . | . . . | . . . | . . . | K . . . | . . . | LH.LT . . . |
| iPS:43 5979 | 21- 225_192H4 | VK1|L1/J K4 | . . . | . . . D . . . | . . . | . . . | K . . . R . . . | . . . G | LH.LN . . . R |
| iPS:43 5987 | 21- 225_192G6 | VK1|L1/J K4 | . . . K | T . . . G . . . | . . . | . . . | K . . . | . . . | MT . . . |
| iPS:43 5993 | 21- 225_192C8 | VK1|L1/J K4 | . . . | . . . G . . . | L . . . | K . . . | K . . . | . . . | H.LT . . . |
| iPS:43 5997 | 21- 225_192G8 | VK1|L1/J K4 | . . . | T . . . G . . . | L . . . | . . . | K . . . | . . . | IT . . . |
| iPS:43 6005 | 21- 225_192H10 | VK1|L1/J K4 | . . . | . . . K . . . G . . . | . . . | . . . | K . . . Y . . . | . . . | ST . . . |
| iPS:43 6031 | 21- 225_193C7 | VK1|L1/J K4 | . . . | . . . K . . . G . . . | . . . | . . . | K . . . N . . . | . . . | ST . . . |
| iPS:43 6045 | 21- 225_193A10 | VK1|L1/J K4 | . . . | . . . G . . . | . . . | . . . | K . . . | . . . F | H.LT . . . |
| iPS:43 6054 | 21- 225_194C1 | VK1|L1/J K4 | . . . | . . . | . . . | . . . | K . . . | . . . | LH.LT . . . |
| iPS:43 6076 | 21- 225_194H11 | VK1|L1/J K4 | . . . | T . . . G . . . | . . . | . . . | K . . . | . . . | H.LT . . . |
| iPS:43 6086 | 21- 225_191G10 | VK1|L1/J K4 | . . . | . . . K . . . | L . . . | K . . . V | K . . . | . . . | MT . . . |
| iPS:43 6090 | 21- 225_195A9 | VK1|L1/J K4 | . . . | N . . . A . . . | . . . | . . . | K . . . | . . . | H.LT . . . |
| iPS:43 6112 | 21- 225_196C7 | VK1|L1/J K4 | . . . | . . . | . . . | . . . | K . . . | . . . | H.LT . . . |

| | | | | | | | | | |
|---|---|---|---|---|---|---|---|---|---|
| iPS:43 6396 | 21- 225_213E5 | VK1fL1/J K4 | .R...... | .A.G... | ...R... | ....... | K...... | ....... | H.SN... |
| iPS:43 6398 | 21- 225_213B8 | VK1fL1/J K4 | ....... | .KH..... | ....... | ....... | K...... | ...L... | ...SN.. |
| iPS:43 6410 | 21- 225_212E10 | VK1fL1/J K4 | ....... | ...H... | ....... | ....... | K...... | ....... | ...SN.. |
| iPS:43 6420 | 21- 225_215B5 | VK1fL1/J K4 | ....... | ...H... | ....... | ....... | K...NR.V | ....... | ..IN... |
| iPS:43 6422 | 21- 225_215D6 | VK1fL1/J K4 | ....... | ...H... | ...H... | ....... | NN..R.. | ....... | ...VT.. |
| iPS:43 6430 | 21- 225_215A12 | VK1fL1/J K4 | ...I... | T..D.G. | ....... | ....... | K...R.. | .R..... | ...VT.. |
| iPS:43 6452 | 21- 225_217G5 | VK1fL1/J K4 | ...L... | ...G... | ...R... | ....... | K..TR.. | .S..... | ...VN.. |
| iPS:43 6454 | 21- 225_217B10 | VK1fL1/J K4 | ...R... | .A.G... | ...R... | ....... | K...D.. | ....... | .HTSK.. |
| iPS:43 6464 | 21- 225_219H1 | VK1fL1/J K4 | ...Q... | ...D... | ....... | .S..... | K...V..I..R | ....... | ...S.VQ |
| iPS:43 6490 | 21- 225_221F6 | VK1fL1/J K4 | .G..... | ....... | ....... | .N..... | K...R.. | ....... | H.SN... |
| iPS:43 6502 | 21- 225_222A11 | VK1fL1/J K4 | ....... | ....... | ....... | .N..... | K...R.. | ....... | ...MT.. |
| iPS:43 6514 | 21- 225_222D10 | VK1fL1/J K4 | ....... | ....... | ....... | ....... | K...... | ....... | LY.LN.. |
| iPS:43 6522 | 21- 225_223H10 | VK1fL1/J K4 | ....... | ....... | ....... | .N..... | K...... | ....... | LH.LN.. |
| iPS:43 7258 | 21- 225_153F9 | VK1fL1/J K4 | ....... | ....... | ..S.... | .S..... | K...... | ....... | LH.LN.. |
| iPS:43 7260 | 21- 225_170D1 | VK1fL1/J K4 | ...A... | ...D... | ....... | .S..... | K...... | ....... | ....S.. |
| iPS:43 7264 | 21- 225_171H12 | VK1fL1/J K4 | ....... | ...D... | ..F.... | .F..... | .N..... | ....... | ..CD.F. |
| iPS:43 7266 | 21- 225_177A5 | VK1fL1/J K4 | ....... | ...D... | ....... | ....... | K...... | ....... | ...SD.. |
| iPS:43 7270 | 21- 225_178H4 | VK1fL1/J K4 | ...E... | ...D... | .L..... | .S..... | K...... | ....... | ...SD.. |
| iPS:43 8664 | 21- 225_216G1 | VK1fL1/J K4 | ....... | ...S... | ....... | ....... | K...... | ....... | ....S.. |
| iPS:45 1120 | 21- 225_197D3 | VK1fL1/J K4 | ....... | ...R... | ....... | ....... | K...... | ....... | LR.ET.. |
| iPS:39 2682 | 21- 225_16A12 | VK1fL1/J K4 | ....... | .A.N... | ..S.... | ....... | K...... | .E..... | ...Y... |

| | | K_FR1 | K_CDR1 | K_FR2 | K_CDR2 | K_FR3 | K_CDR3 | K_FR4 |
|---|---|---|---|---|---|---|---|---|
| iPS:43 4333 | 21-225_63C9 | VK1|L5/J K4 | | | N.. | | | I.. | A. |
| iPS:43 4347 | 21-225_64H10 | VK1|L5/J K4 | | ....L... | | | ....G....F. | I.. | |
| iPS:43 4359 | 21-225_65G3 | VK1|L5/J K4 | | | | | ..........F. | V.. | |
| iPS:43 4369 | 21-225_66B1 | VK1|L5/J K4 | | ....L... | | | | T.. | |
| iPS:43 4373 | 21-225_66A7 | VK1|L5/J K4 | | | | | | I.. | |
| iPS:43 4397 | 21-225_67H4 | VK1|L5/J K4 | | | | | | I.. | |
| iPS:43 4427 | 21-225_70D6 | VK1|L5/J K4 | | ....K... | ....N... F | | ..........N. | T.. | |
| iPS:43 4435 | 21-225_70G9 | VK1|L5/J K4 | | ....D... | ....N... | | | T.. | |
| iPS:43 4437 | 21-225_70A12 | VK1|L5/J K4 | | | ....L... | | ....V.... | I.. | |
| iPS:43 4451 | 21-225_71B7 | VK1|L5/J K4 | | | ....N.E | ...G.. | ....V.....N. | T.. | |
| iPS:43 4459 | 21-225_71A7 | VK1|L5/J K4 | | | | | | V.. | |
| iPS:43 4461 | 21-225_73A3 | ..I... | | | | | ..........E. | V.. | L. |
| iPS:43 5479 | 21-225_154E9 | VK1|L5/J K4 | ...L...Y | ....D... | ....R... | | | G.. | D. |
| iPS:43 7232 | 21-225_63E1 | VK1|L5/J K4 | .......Y | ....N... | ....V... | ..D.. | | | |
| iPS:43 7326 | 21-225_75C10 | VK1|L5/J K4 | ..I... | ....V... | | | ....L.... | K.. | |
| | Germline | | DIQMTQSPSSLS ASVGDRVTIC | RAS QSIS SYLN | WYQQKPGK APKLLIY | AASSLQS | GVPSRFSGSGS GTDFTLTISSLQPEDFAT YYC | QQSYS | FGQGTK LEIK |
| VK1|O12|JK2 | | | | | | | | | |
| iPS:43 4309 | 21-225_59B5 | VK1|O12/JK2 | | | | ...G... | | | |
| iPS:39 2874 | 21-225_21D2 | VK1|O12/JK2 | ......F | | | ..R.D.. | | T.NI TPMFS | .R. |
| iPS:39 3940 | 21-225_16B2 | VK1|O12/JK2 | GV..... | ...G... | | ....T.. | ............N. ...G... | T.NI LPFRS | |
| iPS:39 3956 | 21-225_4D7 | VK1|O12/JK2 | | ...D... | ....F.. | ..D.TT. | ..........N. | T.NT PFFRS T.NT PFFRS | |

[Figure showing sequence alignment table with columns: Germline, K_FR1, K_CDR1, K_FR2, K_CDR2, K_FR3, K_CDR3, K_FR4 for various antibody clones including iPS:43_5247 (21-225_96G1, VK3|A27/JK4), iPS:43_6368 (21-225_211G3), iPS:43_6426 (21-225_215C7), iPS:43_6432 (21-225_215H12), iPS:43_7322 (21-225_75B1), iPS:43_7377 (21-225_74G9), and further clones under VK4|B3|JK4 and VK2|A19|JK4 germline groupings.]

FIGURE 52 (Continued)

| | Germline | K_FR1 | K_CDR1 | K_FR2 | K_CDR2 | K_FR3 | K_CDR3 | K_FR4 |
|---|---|---|---|---|---|---|---|---|
| iPS:43 6246 | 21-225_201G6 | VK2|A19/ JK4 | ........... | ....N ..R..H.... | .......... | ........ | .......... | ....QTP. | ....... |
| iPS:43 6254 | 21-225_202C12 | VK2|A19/ JK4 | .....L.... | ....N ..K..H.... | .......... | ........ | .......... | ......... | ....... |
| iPS:43 6304 | 21-225_201F3 | VK2|A19/ JK4 | ........... | ....N ..R..H.... | .......... | ........ | .......... | ....QTP. | ....... |
| iPS:43 6334 | 21-225_208G3 | VK2|A19/ JK4 | .....L.... | ....N ..K..H.... | .......... | ........ | .......... | ....QTP. | ....... |
| iPS:43 7248 | 21-225_97H3 | VK2|A19/ JK4 | .....I.... | .......H... | ........R. | ........ | ......E... | ...F..... | ....... |
| iPS:43 7320 | 21-225_75A1 | VK2|A19/ JK4 | ........... | .......H... | ........R. | ........ | ......E... | ...P..F.. | ....... |
| iPS:43 7371 | 21-225_74D8 | VK2|A19/ JK4 | ........... | .S......... | ....V..... | ........ | .....S.L.. | ...H..... | ....... |
| iPS:39 2718 | 21-225_17B8 | VK2|A19/ JK4 | ........... | ..N.S....... | .......... | ....H... | ......D... | ...V..TP. | ....... |
| | Germline | K_FR1 | K_CDR1 | K_FR2 | K_CDR2 | K_FR3 | K_CDR3 | K_FR4 |
| VK3|L2/JK1 | | EIVLTQSPATL... VSPGERATL... | RAS...QSV... SNLA | WYQQKPGQG... APRLLIY | GASTRAT | GIPARFSGSGSGT EFTLTISSLEPEDFAV YYC | QQYNN... WPIT | FGQGTK VEIK |
| iPS:43 4871 | 21-225_85H1 | VK3|L2/J K1 | ........... | ....D.I. ..TY.. | .......... | ........ | ......V... | E..D...CS | ...T... |
| iPS:43 5421 | 21-225_151F1 | VK3|L2/J K1 | ....M..... | ......IN. | .......... | ........ | ..........L | ....D....WP. | ....... |
| iPS:43 5497 | 21-225_155H9 | VK3|L2/J K1 | .......V... | ......I.I | .......... | ........ | .......... | ...DD....WP. | ....... |
| iPS:43 5605 | 21-225_161A4 | VK3|L2/J K1 | ......S... | .S.....N... | .......... | ........ | D.....N... | ......... | ....... |
| iPS:45 1118 | 21-225_191C8 | VK3|L2/J K1 | ........... | ...........R. | ...R...L. | ........ | .......... | ....SFT. | ....... |
| iPS:39 2734 | 21-225_17D8 | VK3|L2/J K1 | ......S... | ........... | ..F...N.. | ........ | .......... | .......LR. | ....... |
| iPS:39 2768 | 21-225_20B8 | VK3|L2/J K1 | ........... | ........... | ..F...N.. | ......S. | .......... | .......L. | ....... |
| iPS:39 3044 | 21-225_25B8 | VK3|L2/J K1 | .......V... | ...........R. | .......... | ......S. | .......... | ....C.L. | ....... |
| iPS:39 3050 | 21-225_28C5 | VK3|L2/J K1 | ........... | ........... | ......H.. | ........ | .......... | ....WP..P | ....... |

FIGURE 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:39 3906 | 21-225_13D3 | VK3\|L2/J K1 | ...S... | ...T... | ...F...N | | | ...HD........P.. | |
| | Germline | VK3\|L3/JK5 | DIQMTQSPSSLS ASVGDRVTITC | RAS QDIS SYLA | WYQQKPG KAPKLLIY | AASSLQS | GVPSRFSGSGSGT DFTLTISSLQPEDFAT YYC | QQYNS YPYT | FGQGTK LEIK |
| iPS:43 4947 | 21-225_87B7 | VK1\|L1/J K5 | | | | | | .LL.LT.. | |
| iPS:43 5427 | 21-225_151C9 | VK1\|L1/J K5 | | ...K... | | ...D.. | ...K... | H..KH...L | |
| iPS:43 5529 | 21-225_157H7 | VK1\|L1/J K5 | | ...D.. | ...VS | ...T... | ...K... | ...H.... | |
| iPS:43 6066 | 21-225_194B7 | VK1\|L1/J K5 | | ...K... | | G...R... | ...K... | H.LN.....L | |
| iPS:43 7274 | 21-225_196D4 | VK1\|L1/J K5 | | | ...N... | | ...K... ..C. | H.LN.....L | |
| iPS:39 2748 | 21-225_20A8 | VK1\|L1/J K5 | | ...N.. ...V | | | ...P..V...S..F | ...DN.... | |
| iPS:39 3062 | 21-225_33H3 | VK1\|L1/J K5 | | Q..D.. F.N | ...R.. | D.. N.VI | F...R...F | ...H.....L | |
| iPS:39 8532 | 21-225_33B7 | VK1\|L1/J K5 | | ...D.. | ...T... ...S | | ...K...F | ...H.....L | |
| iPS:40 2221 | 21-225_2C12 | VK1\|L1/J K5 | | | ...S | ...T... | ...Q... | ...Y.... | |
| | Germline | VK4\|B3/JK5 | DIVMTQSPDSLA VSLGERATINC | KSS QSVLYSSNNKN YLA | WYQQKPG QPPKLLIY | WASTRES | GVPDRFSGSGSGT DFTLTISSLQAEDVAV YYC | QQYYS TPIT | FGQGTK LEIK |
| iPS:43 5665 | 21-225_169F2 | VK4\|B3/J K5 | | ...I | | | | ...RAP. | |
| iPS:43 5671 | 21-225_169H5 | VK4\|B3/J K5 | | ...I | | | | ...RAP. | |
| iPS:43 6554 | 21-225_224C10 | VK4\|B3/J K5 | A..... | | | | ...I.. | ...I..N.CS | |
| iPS:39 8510 | 21-225_25A3 | VK4\|B3/J K5 | | ...T | ...N | | | ...CS | |
| iPS:39 8516 | 21-225_26A9 | VK4\|B3/J K5 | | | | | | ...S.CS | |
| | Germline | | K_FR1 | K_CDR1 | K_FR2 | K_CDR2 | K_FR3 | K_CDR3 | K_FR4 |

| | VK1L5/J | HCMCDNSSGS | RAS QSIS | WYQQKPA | KAPLL | ISASSLQ | GVPSRFSGSG SGTDFTLTIS SLQPEDFATY | QQANS | FGQGTK |
|---|---|---|---|---|---|---|---|---|---|
| | | LSCRASQSIS | SWLA | APKLLIY | | S | YC | FPWT | VEIK |
| iPS:43 5477 | 21- 225_154E8 | VK1L5/J K1 | .I............ | :F:::: | :::::: | ::T::: | :::::::::: :::::::::: :::::C:::: | :::::: | ..FN |
| iPS:43 5385 | 21- 225_149G7 | VK1L5/J K1 | :::::::::::: | :F:::: | :::::: | :::::: | :::::::::: :::::::::: :::::::::: | :::::: | ..N |

LAMBDA VARIABLE

| | | Germline | L_FR1 | L_CDR1 | L_FR2 | L_CDR2 | L_FR3 | L_CDR3 | L_FR4 |
|---|---|---|---|---|---|---|---|---|---|
| | VL3r/JL2 | | SYELTQP PSVSVSPGQ TASITC | SGD KLGD KYAC | WYQQKPG QSPVLVIY | QDS KRPS | GIPERFSGSNS GNTATLTISG TQAMDEADYY C | QAWDS STAV | FGGGTK LTVL |
| iPS:45 3445 | 21- 225_148E10 | VL3r/JL 2 | :::::::::::: :::::::::::::: ::: | ::V.. ::::: | :::::: :::::: | :::::: | :::::::::: :::::::::::: :::F:: ::: | ::R::: | :N.Y.. |
| iPS:47 2742 | 21- 225_30D9_L C2 | VL3r/JL 2 | :::::::::::: :::::::::::::: ::: | ::VY. ::::: | :F:::: :::::: | :::R:: | :::::::::: :::::::::::: :::::L :::: | ::N::: | -STA.. |
| iPS:47 2743 | 21-225_68G6 | VL3r/JL 2 | ::V::::::::: :::::::::::::: ::: | ::TY. ::::: | :F:A:: :::::: | :::R:: | :::::::::: D:::::::::::: :::A.F :::: | ::N::: | -STA.. |
| iPS:43 6652 | 21- 225_146B11 | VL3r/JL 2 | :::::::::::: :::::::::::::: ::: | ::S.. ::::: | :::::: :::::: | :::::: | :::::::::: :::::::::::I :::::: :::: | :::::: | -ST... |
| iPS:43 6654 | 21- 225_146C11 | VL3r/JL 2 | :::::::::::: :::::::::::::: ::: | ::S.. ::::: | :::::: :::::: | :::::: | :::::::::: :::::::::::I :::::: :::: | :::::: | -ST... |
| iPS:43 6658 | 21- 225_146A2 | VL3r/JL 2 | :::::::::::: :::::::::::::: ::: | ::S.. ::::: | :::::: :::::: | :::::: | :::::::::: :::::::::::I :::::: :::: | :::::: | -ST... |
| iPS:43 6664 | 21- 225_147E7 | VL3r/JL 2 | :::::::::::: :::::::::::::: ::: | ::V.. ::::: | :::::: :::::: | :::::: | :::::::::: :::::::::::: :::::: :::: | ::G::: | -ST... |
| iPS:43 6666 | 21- 225_147B8 | VL3r/JL 2 | :::::::::::: :::::::::::::: ::: | ::VS. ::::: | :E:::: :::::: | :::R:: | :::::::::: :::::::::::: :::L.V :::: | L::::: | :N.... |
| iPS:43 6668 | 21- 225_147B9 | VL3r/JL 2 | :::::::::::: :::::::::::::S ::: | ::V.. ::::: | :::R:: :::::: | :::::: | :::::::::: :::::::::::: :::::: :::: | ::R::: | :F.... |
| iPS:43 6670 | 21- 225_147D9 | VL3r/JL 2 | :::::::::::: :::::::::::::: ::: | ::E.N ::::: | :::::: :::::: | :::::: | :::::::::: :::::::::::: :::::: :::: | ::R::: | :N.Y.. |
| iPS:43 6672 | 21- 225_147F9 | VL3r/JL 2 | :::::::::::: :::::::::::::: ::: | ::::: ::::: | :::::: :::::: | :::::: | :::::::::: :::::::::::I :::::: :::: | ::H::: | -ST... |
| iPS:43 6674 | 21- 225_147G9 | VL3r/JL 2 | :::::::::::: :::::::::::::: ::: | ::S.. ::::: | :::::: :::::: | :::R:: | :::::::::: :::::::::::: :::::: :::: | ::H::: | -ST... |
| iPS:43 6676 | 21- 225_147E11 | VL3r/JL 2 | :::::::::::: :::::::::::::: ::: | ::::: ::::: | :::::: :::::: | :::::: | :::::::::: :::::::::::I :::::A :::: | :::::: | -ST... |
| iPS:43 6678 | 21- 225_147B12 | VL3r/JL 2 | :::::::::::: :::::::::::::: ::: | ::::: ::::: | :::::: :::::: | :::::: | :::::::::: :::::::::::I :::::: :::: | :::::: | -ST... |
| iPS:43 6686 | 21- 225_148G6 | VL3r/JL 2 | :::::::::::: :::::::::::::S ::: | ::S.. ::::: | :::::: :::::: | :::::: | :::::::::: :::::::::::I :::::: :::: | :::::: | -ST... |

FIGURE 52 (Continued)

| ID | Region | | | | | | | | |
|---|---|---|---|---|---|---|---|---|---|
| iPS:43-6688 | 21-225_148C8 | VL3|3r/JL 2 | . . . . . . . . . . | . . . . . . . . . . | . I . . . . . . . . | . R . . . . . . . . | . T . . . . . . . . | . . L . . . . . . . | . . . . . F . . . . |
| iPS:43-6690 | 21-225_148A9 | VL3|3r/JL 2 | . . . . . . . . . . | . VS . . . . . . . | . . . . . . . . . . | . . . . . . . . . . | . . . . . . . . . . | . . H . . . . . . . | . . . -ST . . . . . |
| iPS:43-6694 | 21-225_148G11 | VL3|3r/JL 2 | . . . . . . . . . . | . . N . . . . . . . | . . . . . . . . . . | . . . . . . . . . . | . . . . . . . . . . | . . . . . . . . . . | . . . . . . . . . . |
| iPS:43-6698 | 21-225_149B5 | VL3|3r/JL 2 | . . . . . . . . . . | . F.S . . . . . . . | . Y . . . . . . . . | . . . . . . . . . . | . I . . . . . . . . | . . . . . . . . . . | . . . -ST . . . . . |
| iPS:43-6700 | 21-225_149C7 | VL3|3r/JL 2 | . . . . . . . . . . | . . V . . . . . . . | . . . . . . . . . . | . NNQ . . . . . . . | . . . . . . . . . . | . . . . . . . . . . | . . . -ST . . . . . |
| iPS:43-6704 | 21-225_149C10 | VL3|3r/JL 2 | . . N . . . . . . . | . . S . . . . . . . | . . . . . . . . . . | . . . . . . . . . . | S . . . . . . . . . | . . . . . K . . . . | . . . -ST . . . . . |
| iPS:43-6706 | 21-225_149A11 | VL3|3r/JL 2 | . . . . . . . . . . | . . . N . . . . . . | . . . . . . . . . . | . . N . . . . . . . | . . G.I . . . . . . | . I . . . . . . . . | . . . -ST . . . . . |
| iPS:43-6708 | 21-225_150D3 | VL3|3r/JL 2 | . . . . . . . . . . | . VS . . . . . . . | . . . . . . . . . . | . R . . . . . . . . | . . . . . . . . . . | . . L . . . . . . . | . . . . . F . . . . |
| iPS:43-6710 | 21-225_150F6 | VL3|3r/JL 2 | . . . . . . . . . . | . E.N . . . . . . . | . . . . . . . . . . | . N . . . . . . . . | . . . . . . . . . . | . . H . . . . . . . | . . . -ST . . . . . |
| iPS:43-6714 | 21-225_150H11 | VL3|3r/JL 2 | . . . . . . . . . . | . . S . . . . . . . | . C . . . . . . . . | . . . . . . . . . . | . I . . . . . . . . | . . . . . C . . . . | . . . -ST . . . . . |
| iPS:43-6716 | 21-225_151F3 | VL3|3r/JL 2 | . . . . . . . . . . | . . S . . . . . . . | . . . . . . . . . . | . . . . . . . . . . | . I . . . . . . . . | . . . . . F . . . . | . . . -ST . . . . . |
| iPS:43-6718 | 21-225_151H5 | VL3|3r/JL 2 | . . A . . . . . . . | . . V . . . . . . . | . . . . . . . . . . | . R . . . . . . . . | . . . . . . . . . . | . . H . . . . . . . | . . . -ST . . . . . |
| iPS:43-6722 | 21-225_151H7 | VL3|3r/JL 2 | . . . D . . . . . . | . . S . . . . . . . | . . . . . . . . . . | . . . . . . . . . . | . I . . . . . . . . | . . . . . . . . . . | . . . -ST . . . . . |
| iPS:43-6724 | 21-225_151B9 | VL3|3r/JL 2 | . . A . . . . . . . | N . . . . . . . . . | . . . . . . . . . . | . . . . . . . . . . | . I . . . . . . . . | . . . . . . . . . . | . . . -ST . . . . . |
| iPS:43-6728 | 21-225_152G6 | VL3|3r/JL 2 | . . . . . . . . . . | . . S . . . . . . . | . . . . . . . . . . | . . . . . . . . . . | . I . L . . . . . . | . . . . . G . . . . | . . . -ST . . . . . |
| iPS:43-6730 | 21-225_152D7 | VL3|3r/JL 2 | . . . . . . . . . . | . S . V . . . . . . | . . . . . . . . . . | . . . . . . . . . . | . I . . . . . . . . | . . N . . . . . . . | . . . -ST . . . . . |
| iPS:43-6736 | 21-225_153E8 | VL3|3r/JL 2 | . . . . . . . . . . | . . . N . . . . . . | . R . . . . . . . . | . N . . . . . . . . | . . . . . . . . . . | . . . . . . . . . . | . . . -ST . . . . . |
| iPS:43-6738 | 21-225_153D9 | VL3|3r/JL 2 | . . . . . . . . . . | . . V . . . . . . . | . . . . . . . . . . | . R . . . . . . . . | . T . . . . . . . . | . . H . . . . . . . | . . . -ST . . . . . |
| iPS:43-6740 | 21-225_154C3 | VL3|3r/JL 2 | . . R . . . . . . . | . . V . . . . . . . | . . . . . . . . . . | . . . . . . . . . . | . I . . . . . . . . | . . . . . Y.I . . . | . . . -ST . . . . V |
| iPS:43-6742 | 21-225_154C4 | VL3|3r/JL 2 | . . . . . . . . . . | . . N . . . . . . . | . E . . . . . . . . | K . . . . . . . . . | . I . . . . . . . . | . . N . . . . . . . | . . . -ST . . . . . |
| iPS:43-6744 | 21-225_154F4 | VL3|3r/JL 2 | . . . . . . . . . . | . . V . . . . . . . | . . . . . . . . . . | . . . . . . . . . . | . T . . . . . . . . | . . . . . G . . . . | . . . -STL . . . . |

FIGURE 52 (Continued)

| | | | | | | | | |
|---|---|---|---|---|---|---|---|---|
| iPS:43 6746 | 21- 225_154E10 | VL3j3rJ3L 2 | . | . | . | . | . | N . -ST. . |
| iPS:43 6748 | 21- 225_154D11 | VL3j3rJ3L 2 | . | . | . | . | H . -SI. . |
| iPS:43 6756 | 21- 225_146A10 | VL3j3rJ3L 2 | . | . | V. | .K. | I. | . -ST. V. |
| iPS:43 6758 | 21- 225_155C10 | VL3j3rJ3L 2 | . V | . | F. | .R. | . | . -SI. . |
| iPS:43 6760 | 21- 225_155E10 | VL3j3rJ3L 2 | . | .VS | . | . | . | . -SI. . |
| iPS:43 6764 | 21- 225_158E9 | VL3j3rJ3L 2 | .D. | . | . | .R. | I. L. | . F. . |
| iPS:43 6766 | 21- 225_158D10 | VL3j3rJ3L 2 | T | .V. | . | . | . N. | N . SF.L . |
| iPS:43 6768 | 21- 225_159H8 | VL3j3rJ3L 2 | . | .V. | . | .R. | T. L. | GN . SF. . |
| iPS:43 6770 | 21- 225_160B12 | VL3j3rJ3L 2 | .D. . .S | .V. | . | .R. | . L. | GN . SF. . |
| iPS:43 6772 | 21- 225_161H3 | VL3j3rJ3L 2 | . | .R. | F. | . | . L. | GN . SF. . |
| iPS:43 6774 | 21- 225_161E10 | VL3j3rJ3L 2 | .FD. | .V. | . | .N. | . | VN . N. . |
| iPS:43 6776 | 21- 225_161F12 | VL3j3rJ3L 2 | . | . | . | . | I. | . T. N . .SFAL . |
| iPS:43 6780 | 21- 225_165H3 | VL3j3rJ3L 2 | . | . | T. | . | . | . -TL. . |
| iPS:43 6782 | 21- 225_166G11 | VL3j3rJ3L 2 | . S | .VH | . | . | . | . -TL. . |
| iPS:43 6784 | 21- 225_169C1 | VL3j3rJ3L 2 | . | .V. | .L. | .K. | . | N . -STA. . |
| iPS:43 6786 | 21- 225_169A6 | VL3j3rJ3L 2 | . | . | .R. | I. | . | . T. -NT.i . |
| iPS:43 6788 | 21- 225_169B7 | A.D. .R. | .V. .G | . | .Y. | . | . T. -NT.L . |
| iPS:43 6790 | 21- 225_169G11 | VL3j3rJ3L 2 | . .S | . | .R. | . | K . -NT. . |
| iPS:43 6794 | 21- 225_170F1 | VL3j3rJ3L 2 | . S | . | . | . A. | N . -STA. . |
| iPS:43 6796 | 21- 225_170A5 | VL3j3rJ3L 2 | .D. | . | I. | .V. | . | N . -NTA. R. |
| iPS:43 6798 | 21- 225_171F5 | A.D. | . S | . | .R. | . | K . -NT. . |

FIGURE 52 (Continued)

| ID | Name | Type | | | | | | | | |
|---|---|---|---|---|---|---|---|---|---|---|
| iPS:43 6802 | 21-225_171E12 | VL3j3r/JL2 | . . . . . . . . . . | . . . . . . . . . . | . . . . . . . . . . | . R . | . . . . . . . . . . | I . . . . . . . . | . Y . | . . . . . . . . |
| iPS:43 6808 | 21-225_173F8 | VL3j3r/JL2 | . . . D . . . . . . | . N . . V . | . R . . S | . R . | . . . . . . . . . . | . . . . . . . . . . | -FT | . R |
| iPS:43 6812 | 21-225_175C6 | VL3j3r/JL2 | . . . . . . . . . . | . . . . . . . . . . | I . . . | . Y . | . . . . . . . . . . | N . . . . . | -STM | . . . . . . . . |
| iPS:43 6818 | 21-225_179C7 | VL3j3r/JL2 | . . . . . . T . . . | . V . . . | . R . | . . . . . . . . . . | . . . . . . . . . . | . . . . . . . . . . | . . . . . . . . . . | . . . . . . . . |
| iPS:43 6822 | 21-225_180D4 | VL3j3r/JL2 | . . . . . . . . . . | . . R . | E . . | . R . | R . . . . . | . . . . . . . . . . | N . . . . . | . . . . . . . . |
| iPS:43 6824 | 21-225_180C5 | VL3j3r/JL2 | . . . . . . . . . . | . E . . | . . . . . . . . . . | . R . | . G . . . | . . . . . . . . . . | -RK | . . . . . . . . |
| iPS:43 6826 | 21-225_180G5 | VL3j3r/JL2 | . Y . . . T . . . . | . . VS | . . . . . . . . . . | . . . . . . . . . . | . P . | I . . | -STA | . . . . . . . . |
| iPS:43 6828 | 21-225_181H1 | VL3j3r/JL2 | . . . . . . . . . . | . . . . . . . . . . | . . . . . . . . . . | E . R . | . . . . . . . . . . | . . . . . . . . . . | -TA | . . . . . . . . |
| iPS:43 6836 | 21-225_52H1 | VL3j3r/JL2 | . . . . . F . . . . | . . VS | . . . . . . . . . . | . R . | . . . . . . . . . . | . . . . . . . . . . | -RK | . . . . . . . . |
| iPS:43 6848 | 21-225_57F1 | VL3j3r/JL2 | . . . A . . . . | . E . | . . . . . . . . . . | . R . | . . . . . . . . . . | N . . . . . | -ST | . . . . . . . . |
| iPS:43 6850 | 21-225_57D9 | VL3j3r/JL2 | . . . . . . . . . . | E . . F . | S . . | . R . | . . . . . . . . . . | . . . . . . . . . . | -ST | . . . . . . . . |
| iPS:43 6852 | 21-225_57H11 | VL3j3r/JL2 | A . . . . . A . . | E . . | . . . . . . . . . . | . R . | . . . . . . . . . . | . . . . . . . . . . | -ST | . . . . . . . . |
| iPS:43 6854 | 21-225_58C1 | VL3j3r/JL2 | . . . . . N . . . | . N . | . . . . . . . . . . | . R . | . . . . . . . . . . | --SSTA | . . . . . . . . . . | . . . . . . . . |
| iPS:43 6858 | 21-225_58E7 | VL3j3r/JL2 | . S . . . . . . | . T . | . K . | . N . | . F . | NN . . . . | -YT | . A . |
| iPS:43 6860 | 21-225_58F7 | VL3j3r/JL2 | . . . . . . . . . . | . . . . . . . . . . | . . . . . . . . . . | . R . | . . . . . . . . . . | . . . . . . . . . . | -ST | . . . . . . . . |
| iPS:43 6862 | 21-225_58F8 | VL3j3r/JL2 | . . . . . . . . . . | . S . | . R . | . N . | . . . . . . . . . . | NN . . . . | -NT.M | . . . . . . . . |
| iPS:43 6864 | 21-225_58G11 | VL3j3r/JL2 | . . . . . . . . . . | . S . | . . . . . . . . . . | . R . | . . . . . . . . . . | . . . . . . . . . . | -ST | . . . . . . . . |
| iPS:43 6866 | 21-225_59F2 | VL3j3r/JL2 | . . . . . . . . . . | . . . . . . . . . . | . R . | . N . | L . . | N . . . . . | -NT | . . . . . . . . |
| iPS:43 6868 | 21-225_59B11 | VL3j3r/JL2 | . . . A . . . . | E . . | . . . . . . . . . . | . R . | . . . . . . . . . . | . . . . . . . . . . | . Y . | . . . . . . . . |
| iPS:43 6870 | 21-225_60B1 | VL3j3r/JL2 | . . . . . . . . . . | . . . . . . . . . . | . R . | . R . | . . . . . . . . . . | . . . . . . . . . . | -ST | . . . . . . . . |
| iPS:43 6872 | 21-225_60D2 | VL3j3r/JL2 | . . . . . . . . . . | . N . . S | . . . . . . . . . . | . N . | T . . | N . . . . . | -NT | . . . . . . . . |

FIGURE 52 (Continued)

| ID | Clone | Chain | | | | | | | |
|---|---|---|---|---|---|---|---|---|---|
| IPS:43 6874 | 21-225_60A12 | VL3j3r/JL2 | .... | ....N... | ...M. | .... | .... | .... | .... |
| IPS:43 6876 | 21-225_61F5 | VL3j3r/JL2 | .... | .... | .... | .... | .R. | .... | ...-SSTA |
| IPS:43 6878 | 21-225_62E3 | VL3j3r/JL2 | ..D. | .... | ..E. | .... | .... | .... | ...-ST. |
| IPS:43 6880 | 21-225_62E8 | VL3j3r/JL2 | ..D. | .... | .N. | .V. | .... | .... | ...-STA |
| IPS:43 6882 | 21-225_62D10 | VL3j3r/JL2 | ..D. | .... | .R.N. | .V. | .R. | .... | ...-STA |
| IPS:43 6884 | 21-225_62A12 | VL3j3r/JL2 | .... | .... | .S | .V. | .R. | .... | ...-STA |
| IPS:43 6886 | 21-225_62B12 | VL3j3r/JL2 | ..D. | .... | .N. | .V. | .R. | .... | ...-STA |
| IPS:43 6892 | 21-225_65E9 | VL3j3r/JL2 | .... | .... | .T. | .... | .... | .N. | ...-ST. |
| IPS:43 6894 | 21-225_66G9 | VL3j3r/JL2 | ..D. | ....T | .DY | .... | .R. | .I. | ...-NTA |
| IPS:43 6896 | 21-225_67F10 | VL3j3r/JL2 | .... | .... | .Y. W | .F | .E. R. | .N. | ...-ST. |
| IPS:43 6898 | 21-225_68D8 | VL3j3r/JL2 | .... | .... | .N. | .... | .... | .N. | ...-ST. |
| IPS:43 6900 | 21-225_68B9 | VL3j3r/JL2 | ..D. | .... | .DY | .... | .R. | .... | ...-ST. |
| IPS:43 6902 | 21-225_69B11 | VL3j3r/JL2 | .... | ....A | .W | .... | .E. R. | .N. | ...-ST. |
| IPS:43 6904 | 21-225_71D4 | VL3j3r/JL2 | .... | .... | .Y. | .V. | .R. | .VN. | ...-ST. |
| IPS:43 6906 | 21-225_72B4 | VL3j3r/JL2 | .... | .... | .W | .R. | .E. R. | .... | ...-ST. |
| IPS:43 6908 | 21-225_72D5 | VL3j3r/JL2 | ..D. | .... | .N. | .V. | .R. | .N. | ...-STA |
| IPS:43 6912 | 21-225_73C4 | VL3j3r/JL2 | ..D. | .... | .M. | .V. | .R. | .... | ...-STA |
| IPS:43 6914 | 21-225_76B4 | VL3j3r/JL2 | .P. | .N.T. | .R.T. F. | .... | .M. | .... | ...SSI. |
| IPS:43 6916 | 21-225_74A9 | VL3j3r/JL2 | .... | .... | .V. | .... | .NR. | .... | ...-SP.I |
| IPS:43 6918 | 21-225_77A2 | VL3j3r/JL2 | .... | .... | .R. | .... | .R. | .... | ...-STA |

FIGURE 52 (Continued)

| | | | | | | | | |
|---|---|---|---|---|---|---|---|---|
| iPS:43_6922 | 21-225_78E9 | VL3j3rJJL2 | E. | .N. | | S. | | -SP.I |
| iPS:43_6924 | 21-225_74B3 | VL3j3rJJL2 | | .VS | .NR. | | | -T |
| iPS:43_6928 | 21-225_79E7 | VL3j3rJJL2 | | .N. | | S. | | -SP.I |
| iPS:43_6932 | 21-225_92A4 | VL3j3rJJL2 | .N | .VS | .NR. | | | -SP.I |
| iPS:43_6934 | 21-225_96B5 | VL3j3rJJL2 | P..NT | .V. R..T F.. | .NR. | | -SST. | |
| iPS:43_6936 | 21-225_97E6 | VL3j3rJJL2 | | .N. .VS | .NR. | S. | | -P.I |
| iPS:43_6938 | 21-225_146A3 | VL3j3rJJL2 | .AM..M. | .N..R. | | I. | | -ST. |
| iPS:43_6940 | 21-225_146B8 | VL3j3rJJL2 | | .V. | .R. | | H. | -ST. |
| iPS:43_6942 | 21-225_146H8 | VL3j3rJJL2 | | | S. .K. | V. | I. | -RT. |
| iPS:43_6944 | 21-225_182D12 | VL3j3rJJL2 | | E. | .R. | | | -RTA. |
| iPS:43_6946 | 21-225_183F4 | VL3j3rJJL2 | T. | | E. .K. | | N. | |
| iPS:43_6952 | 21-225_185D2 | VL3j3rJJL2 | | H. | .R. | D. | | -RK. |
| iPS:43_6954 | 21-225_185G7 | VL3j3rJJL2 | | .FV. | | | -SST. | |
| iPS:43_6956 | 21-225_186H6 | VL3j3rJJL2 | | M.E. | .R. | | K. | -STA. |
| iPS:43_6962 | 21-225_190H1 | VL3j3rJJL2 | | .RF..Y | | | | -ST. |
| iPS:43_6978 | 21-225_190G9 | VL3j3rJJL2 | S. | .RF..Y | .N. | S. | | -ST. |
| iPS:43_7018 | 21-225_193H5 | VL3j3rJJL2 | | .RF.. | | | | -STA. |
| iPS:43_7030 | 21-225_195E3 | VL3j3rJJL2 | | .RSV. Y. | E. | | | -VT. ..R |
| iPS:43_7034 | 21-225_195E9 | VL3j3rJJL2 | | .Y | .R. | G. | .R. | -GI. I. |
| iPS:43_7070 | 21-225_201G11 | VL3j3rJJL2 | | .RF.. | | | | -ST. |

FIGURE 52 (Continued)

| | | | | | | | | |
|---|---|---|---|---|---|---|---|---|
| iPS:43 7076 | 21-225_203G6 | VL3|3r/JL 2 | ........ | ........ | RF. | ........ | ........ | ........ | ........ |
| iPS:43 7144 | 21-225_215B3 | VL3|3r/JL 2 | ........ | ........ | ..F.. | ........ | ..N.. | ..S.. | .-ST. |
| iPS:43 7186 | 21-225_224H2 | VL3|3r/JL 2 | ..S..... | ........ | ..N..V ..TY | ........ | ........ | ........ | .-SI. |
| iPS:43 7192 | 21-225_225E9 | VL3|3r/JL 2 | ....D... | ........ | ..N..N ..R.. | ..M.. | ........ | ........ | .-ST. |
| iPS:43 7194 | 21-225_226B2 | VL3|3r/JL 2 | ........ | ........ | ..T..G ..W | ..R.. | ..R.. | ..N..S.. | ..R.. |
| iPS:43 7200 | 21-225_226A10 | VL3|3r/JL 2 | ........ | ........ | ..T..G | ........ | ........ | ..S.. | -G.A. |
| iPS:43 7204 | 21-225_227E5 | VL3|3r/JL 2 | ..S..... | ........ | ..E.. | ..R.. | ........ | ..N.. | -G.A. |
| iPS:43 7210 | 21-225_227E12 | VL3|3r/JL 2 | ........ | ........ | ..V.. | ..R.. | ..K.. | ..VN.. | -NTMI |
| iPS:44 8908 | 21-225_50G9 | VL3|3r/JL 2 | ........ | ........ | ........ | ........ | ........ | ..N.. | ..SN. |
| iPS:45 1102 | 21-225_45F6 | VL3|3r/JL 2 | ........ | ........ | ..S..N ..VS | ..NR. | ..R..E | ..RN.. | -RRG. |
| iPS:45 1110 | 21-225_74C9 | VL3|3r/JL 2 | ..E..... | ........ | ..N.. | ..R.. | ........ | ..N.. | -RTM. |
| iPS:45 1112 | 21-225_53D10 | VL3|3r/JL 2 | ........ | ........ | ........ | ..R.. | ..S.. | ........ | .-P.I |
| iPS:47 2731 | 21-225_14B1_C2 | VL3|3r/JL 2 | ........ | ..F..... | ..Y.. | ........ | ........ | ..N.. | .-ST. |
| iPS:39 2583 | 21-225_10B10 | VL3|3r/JL 2 | ........ | ........ | ..N.. | ..R.. | ........ | ..N.. | .-ST. |
| iPS:39 2585 | 21-225_14H11 | VL3|3r/JL 2 | ..T..... | ........ | ..W ..V.. | ..T.. | ..T.. | ........ | ........ |
| iPS:39 2587 | 21-225_18G5 | VL3|3r/JL 2 | ........ | ..E..... | ..E.. | ........ | ........ | ........ | -SSII |
| iPS:39 2589 | 21-225_27H2 | VL3|3r/JL 2 | ........ | ........ | ..V.. | ..G.. | ..L.. | ..N.. | ..SN. |
| iPS:39 2598 | 21-225_18E10 | VL3|3r/JL 2 | ........ | ........ | ..S..R ..W | ..R.. | ........ | ........ | ..Y.. |
| iPS:39 3166 | 21-225_27G6 | VL3|3r/JL 2 | ........ | ........ | ..Y.. | ........ | ........ | ..N.. | .-ST. |
| iPS:39 3168 | 21-225_32B11 | VL3|3r/JL 2 | ..S..... | ........ | ........ | ..R.. | ..S.. | ........ | ..SY. |
| iPS:39 3172 | 21-225_3B12 | VL3|3r/JL 2 | ........ | ........ | ..E.. | ..R.. | ..K.. | ..VN.. | -NTMI |

FIGURE 52 (Continued)

| | | | | | | | | | |
|---|---|---|---|---|---|---|---|---|---|
| iPS:39 3176 | 21-225_27E7 | VL3|3r/J L 2 | . . . . . . . . . . | . . . . N . . . . . | . . . . E . . . . . | . . . . . . . . . L | . . . . . . . . . . | . . . . . . . . . . | . . . . -ST. . . . . |
| iPS:39 3178 | 21-225_34D7 | VL3|3r/J L 2 | . . . . . . . . . . | . . . . E . . . . Y | . . . . . . . . . L | . . . . . . . . . . | . . . . . . . . . . | . . . T . . . . . . | . . . . . N . . -T. |
| iPS:39 3182 | 21-225_4B3 | VL3|3r/J L 2 | . . . R . V . . . . | . . . . . . . . . . | . . . . . . . . . . | . . . . R . . . . . | . . . . . . . . . . | . . . . F . . . . . | . . . . . N . -NT.I |
| iPS:39 3184 | 21-225_15H11 | VL3|3r/J L 2 | . . . . . . . . . . | . . . . E . . . . . | . . . . . V . . . . | . . . . R . . . . . | . . . . I . . . . . | . . . . . . . . . . | . . . . . . . -STA. |
| iPS:39 3186 | 21-225_27D9 | VL3|3r/J L 2 | . . . . M . . . . . | . . . . Y . . . . . | . . . F . . . . . . | . . . . . . . . . . | . . . . . . . . . . | . . . . . . . . . . | . . . V- . . .-NNT. |
| iPS:39 3188 | 21-225_34B9 | VL3|3r/J L 2 | . . . A . . . . . . | . . . . . . . . . VS | . . . . E . . . . . | . . . . . . . . . . | . . . . . . . . . . | . . . . . . . . . . | . . . . . . . -SST. |
| iPS:39 3192 | 21-225_12B1 | VL3|3r/J L 2 | . . . . . . . . . . | . . . . . . . . . . | . . . . . . . . . . | . . . . . . . . . . | . . . . . . . . . . | . . . . . . . . . . | . . . . N . . -NT.I |
| iPS:39 3194 | 21-225_16D2 | VL3|3r/J L 2 | . . . R . V . . . . | . . . . . . . . . . | . . . . . . . . . . | . . . . R . . . . . | . . . . . . . . . . | . . . . . . . . . . | . . . . . . . . . Y. |
| iPS:39 3196 | 21-225_16G8 | VL3|3r/J L 2 | . . . . S . . . . . | . . . . . . . . . . | . . . . E . . . . . | . . . . . . . . . . | . . . . K . . . . . | . . . . . . . . . . | . . . VN . . .-NTMI |
| iPS:39 3198 | 21-225_28A11 | VL3|3r/J L 2 | . . . . . . . . . . | . . . . . . . . . . | . . . . F . . . . . | . . . . R . . . . . | . . . . . . . . . . | . . . . . . . . . . | . . . . . . . . . Y. |
| iPS:39 3200 | 21-225_35E1 | VL3|3r/J L 2 | . . . . . . . . . . | . . . . E . . . . Y | . . . . . I . . . . | . . . . . . . . . . | . . . . . . . . . . | . . . . . . . . . . | . . . . N . . -STA. |
| iPS:39 3202 | 21-225_6B4 | VL3|3r/J L 2 | . . . R . V . . . . | . . . . . . . . . . | . . . . . . . . . . | . . . . R . . . . . | . . . . . . . . . . | . . . . . . . . . . | . . . . N . . -NT.I |
| iPS:39 3206 | 21-225_13F6 | VL3|3r/J L 2 | . . . . . . . . . . | . . . . . . . . . . | . . . . . . . . . . | . . . . . . . . . . | . . . . . . . . . . | . . . . . . . . . . | . . . GN . . . . . . |
| iPS:39 3210 | 21-225_17D3 | VL3|3r/J L 2 | . . . . S . . . . . | . . . . . . . . . VY | . . . . . V . . . . | . . . . R . . . . . | . . . . . . . . . . | . . . . . . . . . . | . . . . . . . . . R. |
| iPS:39 3212 | 21-225_30H6 | VL3|3r/J L 2 | . . . . . . . . . . | . . . . N . . . . . | . . . . . . . . . . | . . . . . . . . . . | . . . . . . . . . . | . . . . . . . . . . | . . . . . . . -ITA. |
| iPS:39 3214 | 21-225_33A1 | VL3|3r/J L 2 | . . . . . . . . . . | . . . . . . . . FVY | . . . . . . . . . . | . . . . . . . . . . | . . . . . . . . . . | . . . . . . . . . . | . . . . . . . -SST. |
| iPS:39 3218 | 21-225_14G3 | VL3|3r/J L 2 | . . . . . . . . . . | . . . . . . . . . V. | . . . . . . . . . . | . . . . R . . . . . | . . . . . . . . . . | . . . . . . . . . . | . . . GN . . . . T. |
| iPS:39 3222 | 21-225_17F5 | VL3|3r/J L 2 | . . . . . . . . . . | . . . . E . . . . . | . . . . . . . . . . | . . . . R . . . . . | . . . . . . . . . . | . . . . . . . . . . | . . . . . . . -SST. |
| iPS:39 3224 | 21-225_31C2 | VL3|3r/J L 2 | . . . . . . . . . . | . . . . N . . . . . | . . . . . . . . . . | . . . . . . . . . . | . . . . . . . . . . | . . . . . . . . . . | . . . . . . . -SST. |

FIGURE 52 (Continued)

| | | Germline | L_FR1 | L_CDR1 | | L_FR2 | L_CDR2 | L_FR3 | | L_CDR3 | L_FR4 |
|---|---|---|---|---|---|---|---|---|---|---|---|
| iPS:39 3226 | 21-225_33E6 | VL3\|3r\|JL2 | . . . . . . . . . . | . . . . . . | Y . . . | F . . . . . . | . . R . | . . . . . . . . . . . . | . . . . . | . . N . . | . -STA. |
| iPS:39 3234 | 21-225_26C10 | VL3\|3r\|JL2 | . . . V . . . . . M. | . . . . . . | . V . . | . I . . . . . | . . . . | . . . . . . . . . . . . | . . . . . | V- . . . | . . . . |
| iPS:39 3345 | 21-225_5G7 | VL3\|3r\|JL2 | . . . . . . . . . . | . . . . . . | . N . . | F . . . . . . | . . . . | . . . . . . . . . . . . | . . . . . | -NNT. | . . . . |
| iPS:39 3565 | 21-225_34B11 | VL3\|3r\|JL2 | . . . . . . . . . . | . . . . . . | . W . . | . . . . . . . | . . R . | . . . . . . . . . . . . | . . . . . | . . N . | . -ST. |
| iPS:39 3950 | 21-225_3H10 | VL3\|3r\|JL2 | . . . . . . . . S . | . . . . . . | . E . . | . V . . . . . | . . M . | . . . . . . . . . . . . | . . K . . | . . N . | . -STA. |
| iPS:39 8470 | 21-225_14B7 | VL3\|3r\|JL2 | . . . . . . . . R . | . . . . . . | . N . . | . . . . . . . | . . R . | . . . . . . . . . . . . | . . . . . | VN . . | . -NTMI |
| iPS:39 8472 | 21-225_16E4 | VL3\|3r\|JL2 | P . . . . . . . . . | . . . . . . | . Y . . | . . . . . . . | . . . . | . . . . . . . . . . . . | . . . . . | NN . . | . -ST. |
| iPS:39 8488 | 21-225_19F6 | VL3\|3r\|JL2 | . . . . . . . . . . | . . . . . . | VY . . | . S . . . . . | . . R . | A . . . . . . . . . . . | . . . . . | . . . . | . -ST. |
| iPS:39 8490 | 21-225_21D12 | VL3\|3r\|JL2 | . . . V . . . . . . | . . . . . . | . Y . . | . . . . . . . | . . . . | . T . . . . . . . . . . | . . . . . | . . N . | . -NT. |
| iPS:39 8498 | 21-225_22E6 | VL3\|3r\|JL2 | . . . . . . . . . . | . . . . . . | . N . . | . . . . . . . | . . R . | . . . . . . . . . . . . | . . F . . | . . N . | . -ST. R |
| iPS:39 8504 | 21-225_23D7 | VL3\|3r\|JL2 | . . . . . . . . . . | . . . . E. | . E . . | . V . . . . . | . . . . | . . . . . . . . . . . . | . Y . T . | . . . . | . -STA. |
| iPS:39 8546 | 21-225_9H10 | VL3\|3r\|JL2 | . . . . . . . . . . | . . . . . . | . V . . | . . . . . . . | . . . . | . . . . . . . . . . . . | . . . . . | . . N . | . -SN. |
| iPS:40 2225 | 21-225_2B1 | VL3\|3r\|JL2 | . . . . . . . . . . | . . . . . . | . . . . | . . . . . . . | . . . . | . . . . . . . . . . . . | . . . . . | . . . . | . Y . . |
| iPS:40 2231 | 21-225_6D9 | VL3\|3r\|JL2 | . . . . . . . . . . | . . . . . . | . E . . | . . . . . . . | . . R . | . . . . . . . . . . . . | . . . . . | . . N . | . -NT. |
| iPS:40 4090 | 21-225_8D8 | VL3\|3r\|JL2 | . . . . . . . . . . | . . . . . . | . E . . | . V . . . . . | . . R . | . . . . . . . . . . . . | . . I . . | . -SST. | . -STA. |
| iPS:42 3018 | 21-225_31D12_LC2 | VL3\|3r\|JL2 | . . . V . . . . . . | . . . . . . | . Y . . | F . I . . . . | . . R . | . . . . . . . . . . . . | . . . . . | . . N . | . -STA. |
| | Germline | | L_FR1 QSALTQP ASVSGSPGQSII TSC | L_CDR1 TGTS SDVGGY NYVS | | L_FR2 WYQQHPGK APKLMIY | L_CDR2 VSNRPS | L_FR3 GVSNRFSGSKSG NTASLTISGLQAEDEAD YYC | | L_CDR3 SSYTSS STLWV | L_FR4 FGGGTK LTVL |
| iPS:46 8862 | 21-225_178H8 | VL2\|2a2\|JL3b | . . . . . . . S . . | . . . F . . | . . . . | V . F . . . . | . . . . | . . . . . . . . . . . . P . . . . . . . . . . | . . . . . | . YT. | . . . . |

FIGURE 52 (Continued)

| | | | | | | | | | |
|---|---|---|---|---|---|---|---|---|---|
| iPS:43 6838 | 21-225_52H4 | VL2]2a2/ JL3b | | | | | | N.....-...NIT.. | ..... |
| iPS:43 7094 | 21-225_210D12 | VL2]2a2/ JL3b | | ...V...L.. | | | | N.....-....IT.. | ..... |
| iPS:43 7096 | 21-225_210E12 | VL2]2a2/ JL3b | | | | | | G..VK-...GII.. | ....S |
| iPS:43 7098 | 21-225_211C1 | VL2]2a2/ JL3b | ...S. | ...Y.. | | | | N.....-....IT.. | ..... |
| iPS:43 7104 | 21-225_211G5 | VL2]2a2/ JL3b | | | | | | N...R-....IT.. | ..... |
| iPS:43 7112 | 21-225_212C2 | VL2]2a2/ JL3b | | | ..R. | | | ......-....IT.. | ..... |
| iPS:43 7114 | 21-225_212AA4 | VL2]2a2/ JL3b | | ...Y.. | | | | ......-....IT.. | ..... |
| iPS:43 7116 | 21-225_212F6 | VL2]2a2/ JL3b | | ..T. | | | | G..VK-...GII.. | ....S |
| iPS:43 7118 | 21-225_212G7 | VL2]2a2/ JL3b | ..T. | | | | | N.....-....IT.. | ..... |
| iPS:43 7128 | 21-225_213G3 | VL2]2a2/ JL3b | ..L. | ..S. | ..R. | ..T. | | N.....-....IT.. | ..... |
| iPS:43 7130 | 21-225_213D5 | VL2]2a2/ JL3b | | ...V.. | ..R. | | | N...R-....IT.. | ..... |
| iPS:43 7146 | 21-225_215D3 | VL2]2a2/ JL3b | | ..T. | | ..K. | | C...R-...RIT.. | ..... |
| iPS:43 7150 | 21-225_216A3 | VL2]2a2/ JL3b | | | | | | N..KR-...GSI.. | ....V |
| iPS:43 7162 | 21-225_217B2 | VL2]2a2/ JL3b | | ...L.. | | ..Y. | | N.....-....IT.. | ..... |
| | | | | | | | | G..VK-...GII.. | ....S |

FIGURE 52 (Continued)

| | | L_FR1 | L_CDR1 | L_FR2 | L_CDR2 | L_FR3 | L_CDR3 | L_FR4 |
|---|---|---|---|---|---|---|---|---|
| iPS:43 7172 | 21-225_219A7 | VL2|2a2/ JL3b | | | | | C...R- | |
| iPS:43 7182 | 21-225_221H2 | VL2|2a2/ JL3b | L........ | | ........S........ | ........R........ | N...R-...IT.. | |
| iPS:43 7184 | 21-225_221G4 | VL2|2a2/ JL3b | | | | ........R........ | N...R-...IT.. | |
| | | L_FR1 | L_CDR1 | L_FR2 | L_CDR2 | L_FR3 | L_CDR3 | L_FR4 |
| | Germline VL1|1c|JL2 | QSVLTQP PSASGTPGQRVT ISC | SGSS SNIGS NTVN | WYQQLPGT S APKLLIY | RNDQRPS | GVPDRFSGSKSG TSASLAISGLQSEDEAD YYC | AAWDDS LNGVV | FGGGTK LTVL |
| iPS:46 8864 | 21-225_60D6 | VL1|1c|JL 2 | | | | | .........V....... | |
| iPS:43 6660 | 21-225_146D8 | VL1|1c|J L2 | ........T........ | .....Y...D | | | .....SLNGP | |
| iPS:43 6680 | 21-225_147H12 | VL1|1c|J L2 | | ........YA. | | | ........E........ | ........P. |
| iPS:43 6682 | 21-225_146A8 | VL1|1c|J L2 | | .......SI. | ........R....... | ........D....... | | |
| iPS:43 6684 | 21-225_146B6 | VL1|1c|J L2 | | ........A. | | | | |
| iPS:43 6696 | 21-225_149A1 | VL1|1c|J L2 | | ........A. | | ........S........ | ........E........ | |
| iPS:43 6712 | 21-225_150F9 | VL1|1c|J L2 | | ........A.S | | ........DH. | | ........K.P. |
| iPS:43 6750 | 21-225_154G12 | VL1|1c|J L2 | | .......A.N | | | ........L........ | |
| iPS:43 6762 | 21-225_156H2 | VL1|1c|J L2 | ........V........ | | | ........S........ | | ........V........ |
| iPS:43 7044 | 21-225_197F9 | VL1|1c|J L2 | | | | ........I........ | | ........M.P. |
| iPS:43 7060 | 21-225_199C3 | VL1|1c|J L2 | | | | ........I........ | | ........P. |
| iPS:39 3180 | 21-225_4G12 | VL1|1c|J L2 | ........NM. | .....TN...Y | | | | ........LNGH........R. |
| iPS:39 3230 | 21-225_9G9 | VL1|1c|J L2 | ........NM. | .....TN...Y | | | | ........LNGH........R. |
| | Germline | L_FR1 | L_CDR1 | L_FR2 | L_CDR2 | L_FR3 | L_CDR3 | L_FR4 |

FIGURE 52 (Continued)

| VL3p/JL2 | | SYELTQP-PSVSVSPGQTAR ITC | SGD- KLGD KYAC | ALKW YQQKSGQSPV LVIY | SGD- KNNRPS | GIPDRFSGSSSG TSASLAISGLQSEDEAD YYC | YSTDSSG NHRV | FGGGTK LTVL |
|---|---|---|---|---|---|---|---|---|
| iPS:46 8866 | 21-225_190C1 | VL3p/J L2 | .................. | T............. | ..M......... | .D........ | ................P...... T.D. | N.......... |  |
| iPS:43 7214 | 21-225_48B12 | VL3p/J L2 | .................. | .............. | ............ | .S........ | ................................... | N.....SGNR. |  |
| | Germline | | L_FR1 | L_CDR1 | L_FR2 | L_CDR2 | L_FR3 | L_CDR3 | L_FR4 |
| VL1t1c/JL3b | | QSVLTQP-PSASGTPGQRVT ISC | SGSSSNIGSN TVN | WYQQLPG TAPKLLIY | SNN QRPS | GVPDRFSGSKSGTS ASLAISGLQSEDEAD YYC | AAWDDS LSGRV | FGGGTK LTVL |
| iPS:43 6234 | 21-225_51E3 | VL1t1c/J L3b | .................. | .N........ | .............. | .D........ | .............. | T............. | T |
| iPS:43 6830 | 21-225_51F4 | VL1t1c/J L3b | .................. | ....I.I | .............. | .D........ | .............. T.......... | T............. | T |
| iPS:43 6834 | 21-225_52F1 | VL1t1c/J L3b | .................. | ....I.T | .............. | .D........ | .............. | T............. | T |
| iPS:43 6842 | 21-225_54E9 | VL1t1c/J L3b | .................. | .N.....N.I.T | .............. | ..V.D..... | .............. | .V........... | T |
| iPS:43 6844 | 21-225_56G1 | VL1t1c/J L3b | .................. | ..H.I.T | .............. | .D........ | .............. | ..........I... | T |
| iPS:43 6846 | 21-225_56E3 | VL1t1c/J L3b | .................. | .....I.T | .............. | .D........ | ...........C....... | .............. | T |
| iPS:43 7010 | 21-225_192G3 | VL1t1c/J L3b | ........M......... | .............. | .............. | .P.G..K.. | .............. R........... | .............. | T |
| iPS:43 7032 | 21-225_195H6 | VL1t1c/J L3b | .................. | .H.......... | .............. | .N.....Y | .............. T........... | .T......SV.. | V |
| iPS:45 1104 | 21-225_49C5 | VL1t1c/J L3b | .................. | ....I.T | .............. | .D........ | .............. | T............. | T |
| iPS:45 1106 | 21-225_49D10 | VL1t1c/J L3b | .................. | .N....I.T | .............. | .D........ | .............. | .............. | T |
| iPS:45 1108 | 21-225_53E8 | VL1t1c/J L3b | .................. | ..C....I.T | .............. | .D........ | .............. | I............D. | T |
| | Germline | | L_FR1 | L_CDR1 | L_FR2 | L_CDR2 | L_FR3 | L_CDR3 | L_FR4 |
| VL3p/JL1 | | SYVLTQP-PSVSVSPGQTAR ITC | SGD- KLGD KYAC | WYQQKPG QAPVLVIY | QDSKRPS | GIPERFSGSNSG NTATLTISGTQAMDEAD YYC | QAWDS STVV | FGTGTK VTVL |
| iPS:43 6662 | 21-225_147D7 | VL3r/JL 1 | .................. | .F.......... | .............. | ..R...... | .............. | .R........-NTA. | .. |
| iPS:43 6720 | 21-225_151H6 | VL3r/JL 1 | .................. | .............. | .............. | ..T...... | .............. | ..........-ST. | .. |

FIGURE 52 (Continued)

[Figure content not transcribable as readable text - contains a table with antibody sequence alignments showing columns L_FR1, L_CDR1, L_FR2, L_CDR2, L_FR3, L_CDR3, L_FR4 for various iPS clone identifiers including iPS:43_6726 through iPS:44_3003, with germline references VL3|3r/JL1, VL5|5c/JL3b, VL1|1e/JL2, and VL1|6a/JL3b]

Table too complex and low-resolution to transcribe reliably.

FIGURE 52 (Continued)

| | | | | | | | | | |
|---|---|---|---|---|---|---|---|---|---|
| iPS:43 7022 | 21-225_194G5 | VL7l7a/J L2 | . . . . . | . . . . . | . . . . . | . . . . . | . . . . . | G . . . | .I. . . |
| iPS:43 7026 | 21-225_194D12 | VL7l7a/J L2 | . . . . . | .N. . . | T. . . . | . . . . . | S . . . | . . . . . | .LM. . |
| iPS:43 7040 | 21-225_196E7 | VL7l7a/J L2 | . . . . . | SF.S | .L.T | .R. . | . . . . . | .D. . | .LA. . |
| iPS:43 7048 | 21-225_197B11 | VL7l7a/J L2 | . . . . . | F..S | . . . . . | .N. . | . . . . . | . . . . . | IF. . VH.I |
| iPS:43 7050 | 21-225_197C11 | VL7l7a/J L2 | . . . . . | ..S | .A. . | .N. . | . . . . . | . . . . . | . . . . L. |
| iPS:43 7056 | 21-225_198B8 | VL7l7a/J L2 | S . . . | VL..SF. | .L. . | . . . . . | . . . . . | .D. . | IF. . VH.I |
| iPS:43 7062 | 21-225_198H1 | VL7l7a/J L2 | . . . . . | .N. . | . . . . . | H. . . | . . . . . | .D.F | M..S M. |
| iPS:43 7066 | 21-225_200G9 | VL7l7a/J L2 | . . . . . | .N..S | .L. . | R..D | . . . . . | . . . . . | .I. L. |
| iPS:43 7068 | 21-225_200A11 | VL7l7a/J L2 | . . . . . | . . . . . | . . . . . | . . . . . | .A. . | . . . . . | .I. L. |
| iPS:43 7090 | 21-225_210F11 | VL7l7a/J L2 | . . . . . | F..N | .V. | .N. . | . . . . . | .D. | . . . . HLA |
| iPS:43 7106 | 21-225_211H7 | VL7l7a/J L2 | . . . . . | F..N..S | .V. | .R. . | . . . . . | . . . . . | . . . . L. |
| iPS:43 7108 | 21-225_211C9 | VL7l7a/J L2 | . . . . . | G..S | .P. | . . . . . | . . . . . | .D. | . . . . L. |
| iPS:43 7110 | 21-225_211E9 | VL7l7a/J L2 | . . . . . | ..F | . . . . . | .N. . | G. . | .D. . T.F | . . . . LA |
| iPS:43 7120 | 21-225_212A9 | VL7l7a/J L2 | . . . . . | .N. | . . . . . | .I. . | . . . . . | . . . . . | . . . . LA |
| iPS:43 7124 | 21-225_212H12 | VL7l7a/J L2 | . . . . . | . . . . . | . . . . . | .N. . | . . . . . | .D..D | . . . . G |
| iPS:43 7132 | 21-225_213F5 | VL7l7a/J L2 | . . . . . | G..S | T.P | . . . . . | . . . . . | .D. T | .F. . H. |
| iPS:43 7136 | 21-225_214H3 | VL7l7a/J L2 | . . . . . | ..F | . . . . . | . . . . . | C. . | .D. . | . . . . LA |
| iPS:43 7140 | 21-225_214E12 | VL7l7a/J L2 | . . . . . | . . . . . | . . . . . | . . . . . | . . . . . | .D. | CD. . H. |
| iPS:43 7142 | 21-225_215A9 | VL7l7a/J L2 | . . . . . | E. . | . . . . . | . . . . . | G. . | .D. .T | . . . . L. |
| iPS:43 7148 | 21-225_215H3 | VL7l7a/J L2 | . . . . . | .N..S | . . . . . | . . . . . | CG. . | .D..D | . . . . LA A. |
| iPS:43 7154 | 21-225_216A7 | VL7l7a/J L2 | . . . . . | . . . . . | . . . . . | .N. . | C. . | .D..D | . . . . G |

FIGURE 52 (Continued)

Table illegible at available resolution.

| | | | | | | | | |
|---|---|---|---|---|---|---|---|---|
| iPS:43 4431 | 21-225_70E7 | VH1\|1-08\|D6\|6-19\|RF1/3 H4 | . . . . . . . . . . | N . . . . . | . . . . . . . . . . | . . . . . . . . . . | . . . . . . . Y | SSGWY- -V... | . . . . . |
| iPS:43 4443 | 21-225_71G3 | VH1\|1-08\|D6\|6-19\|RF1/3 H4 | . . . . . . . . . . | N . . . . . | . . . . . . . . . . | H . . . . . | . . . D.V. . . Y | SSGWY- . . . . . | . . . . . |
| iPS:43 4475 | 21-225_74F9 | VH1\|1-08\|D6\|6-19\|RF1/3 H4 | . . . . . . . . . . | N . . . . . | . . . . . . . . . . | H . . . . . . . . S | . . . . . . . S | SSGWN- . -F. . | . . . . . |
| iPS:43 4477 | 21-225_74A6 | VH1\|1-08\|D6\|6-19\|RF1/3 H4 | . . . . . . . . . . | N . . . . . | . . . . . . . . . . | . . . . . . . . . . . R. | . . . W . . . . S | SSGWY- . . . . . | . . . . . |
| iPS:43 4487 | 21-225_76G2 | VH1\|1-08\|D6\|6-19\|RF1/3 H4 | . . . . . . . . . . | N . . . . . | . . . . . . . . . . | H . . . . . | . . . . . . . G | SSGWY- . -M. . | . . . . . |
| iPS:43 4511 | 21-225_74B11 | VH1\|1-08\|D6\|6-19\|RF1/3 H4 | . . . . . R. . . | N . . . . . | . . . . . . . . . . | . . . . . . . . L. | . . . . . . F . Y | SSGWY- . . . . . | . . . . . |
| iPS:43 4549 | 21-225_76E11 | VH1\|1-08\|D6\|6-19\|RF1/3 H4 | . . . . . . . . . . | N . . . . . | . . . . . . . . S . | H . . . . . | . . . . . . . S | SSGWN- . . . . . | . . . . . |
| iPS:43 4551 | 21-225_75C4 | VH1\|1-08\|D6\|6-19\|RF1/3 H4 | . . . . . . . . . . | N . . . V . | . . . . . . . . . . | . . . . . . . . . . | . . . . . . . Y | SSGWY- . . . . . | . . . . . |
| iPS:43 4635 | 21-225_78E6 | VH1\|1-08\|D6\|6-19\|RF1/3 H4 | . . . . . . . . . . | N . . . . . | . . . . . . . . . . | H . . . . . . . . C. | . . . . . S . S | SSGWY- . -K. . | S . . . . |
| iPS:43 4649 | 21-225_78E11 | VH1\|1-08\|D6\|6-19\|RF1/3 H4 | . . . . . . . . . . | N . . . . . | . . . . . . . . S . | . . . . . . . . . . | . . . . . . . S | SSGWN- . -F. . | . . . . . |
| iPS:43 4665 | 21-225_74G4 | VH1\|1-08\|D6\|6-19\|RF1/3 H4 | . . . . . . . . . . | N . . . . . | . . . . . . . . . . | H . . . . . | . . . . . R . Y | SSGWY- . -H. . | . . . . . |
| iPS:43 4679 | 21-225_79G7 | VH1\|1-08\|D6\|6-19\|RF1/3 H4 | . . . . . . . . . . | N . . . . . | . . . . . . . . . . | H . . . . . . . . . . | . . . . . S . Y | SSGWY- . -K. . | S . . . . |

FIGURE 52 (Continued)

| | | | | | | | | |
|---|---|---|---|---|---|---|---|---|
| iPS:43 4685 | 21-225_79E9 | VH1|1-08/D6|6-19|RF1/JH4 | ......... | N....... | ......... | ......... | ......... | SSGWY- ....... | ......... |
| iPS:43 4697 | 21-225_79F12 | VH1|1-08/D6|6-19|RF1/JH4 | ......... | ......... | ......... | ..H...... | ......S.. | SSGWY- ....-F. | ....L.. |
| iPS:43 4729 | 21-225_80B12 | VH1|1-08/D6|6-19|RF1/JH4 | ....T.... | N....... | ......... | ......... | ......Y.. | SSGWY- ....... | ......... |
| iPS:43 4851 | 21-225_75A6 | VH1|1-08/D6|6-19|RF1/JH4 | ......... | N....... | ....V.... | ......... | ......Y.. | SSGWY- ..-I... | ......... |
| iPS:43 4909 | 21-225_85C11 | VH1|1-08/D6|6-19|RF1/JH4 | ......... | ......... | ....S.... | ..H...... | ......Y.. | SSGWY- ..-I... | ....S.. |
| iPS:43 4959 | 21-225_87E10 | VH1|1-08/D6|6-19|RF1/JH4 | ......... | N....... | ......... | ......... | ....S.Y.. | SSGWY- ..-K... | ......... |
| iPS:43 4965 | 21-225_88A1 | VH1|1-08/D6|6-19|RF1/JH4 | ......... | N....... | ......... | ......... | ......Y.. | SSGWY- ..-F... | ......... |
| iPS:43 4973 | 21-225_88B4 | VH1|1-08/D6|6-19|RF1/JH4 | ......... | N....... | ......... | ......... | ......Y.. | SSGWY- ....... | ......... |
| iPS:43 4997 | 21-225_88C10 | VH1|1-08/D6|6-19|RF1/JH4 | ....R.... | N....... | ....D.... | S........ | ....T.SY. | SSGWY- ....... | ......... |
| iPS:43 5053 | 21-225_75F9 | VH1|1-08/D6|6-19|RF1/JH4 | ....S.... | N....... | ....T.... | ......... | ......S.. | SSGWY- ....... | ....L.. |
| iPS:43 5113 | 21-225_92E6 | VH1|1-08/D6|6-19|RF1/JH4 | ....R.... | ......... | ....H.... | ......... | ......Y.. | SSGWY- ..-F... | ......... |
| iPS:43 5209 | 21-225_75A10 | VH1|1-08/D6|6-19|RF1/JH4 | ......... | N....... | ......... | ...M..H.. | ......Y.. | SSGWY- ....... | ......... |

FIGURE 52 (Continued)

| | | | | | | | | |
|---|---|---|---|---|---|---|---|---|
| iPS:43 5257 | 21-225_96H5 | VH1\|1-08\|D6\|6-19\|RF1\|J H4 | . . . . . . . . . . | N. . . . . . . . . | S . . . . . . . . | . H. . . . . . . | . . . . . S . . . . . . . . . Y | SSGWY- . -K. . . | . S . . . . . . . . . . . . . |
| iPS:43 5267 | 21-225_96D10 | VH1\|1-08\|D6\|6-19\|RF1\|J H4 | . . . . . R. . . . | N. . . . . . . . . | . . . . . . . . . | . H. . . . . . . | . . . . M . . . . . . . . . . H | SSGWY- . -F. . . | . . . . . . . . . . . . . . . |
| iPS:43 5299 | 21-225_146D4 | VH1\|1-08\|D6\|6-19\|RF1\|J H4 | . . . . . . . . . . | N. . . . . . . . . | . . . . . . . . . | VH. . . . . . . | . . . . . . . . . . . . . . . G | SSGWY- . . . . | . . . . . . . . . . . . . . . |
| iPS:43 5305 | 21-225_146C9 | VH1\|1-08\|D6\|6-19\|RF1\|J H4 | . . . . . . . . . . | N. . . . . . . . . | . . . . . . . . . | . H. . . . . . . | . . . . W . . . . . . . . . A . Y | SSGWY- . -S. . | . . . . . . . . . . . . . . . |
| iPS:43 5309 | 21-225_146F9 | VH1\|1-08\|D6\|6-19\|RF1\|J H4 | . . . . . . . . . . | N. . . . . . . . . | . . . . . . . . . | . H. . . . . . . | . . . . . . . . . . . . . . . S | SSGWY- . -F. . | . . . . . . . . . . . . . . . |
| iPS:43 5321 | 21-225_147E4 | VH1\|1-08\|D6\|6-19\|RF1\|J H4 | . . . . . . . . . . | N. . . . . . . . . | . . . . . . . . . | . H. . . . . . . | . . . . . G . . . . . . . . . S | SSGWY- . . . . | . . . . . . . . . . . . . . . |
| iPS:43 5323 | 21-225_147D5 | VH1\|1-08\|D6\|6-19\|RF1\|J H4 | . . . . . . . . . . | N. . . . . . . . . | . . . . . . . . . | VH. . . . . . . | . . . . . . . . . . . . . . . G | SSGWY- . -F. . | . . . . . . . . . . . . . . . |
| iPS:43 5345 | 21-225_148C3 | VH1\|1-08\|D6\|6-19\|RF1\|J H4 | . . . . . . . . . . | N. . . . . . . . . | . S . . . . . . . | . H. . . . . . . N . . . | . . . . . . . . . . . . . . . S | SSGWY- . . . . | . . . . . . . . . . . . . . . |
| iPS:43 5353 | 21-225_148F8 | VH1\|1-08\|D6\|6-19\|RF1\|J H4 | . . . . . . . . . . | N. . . . . . . . . | . . . . . . . . . | . H. . . . . . . | . . . . . . . . . . . . . . . G | SSGWY- . . . . | . . . . . . . . . . . . . . . |
| iPS:43 5369 | 21-225_149A2 | VH1\|1-08\|D6\|6-19\|RF1\|J H4 | . . . . . . . . . . | N. . . . . . . . . | . . . . . . . . . | VH. . . . . . . | . . . . . . . . . . . . . . . G | SSGWY- . . . . | . . . . . . . . . . . . . . . |
| iPS:43 5373 | 21-225_149E3 | VH1\|1-08\|D6\|6-19\|RF1\|J H4 | . . . . . . . . . . | N. . . . . . . . . | . . . . . . . . . | . H. . . . . . . | . . . . T . . . . . . . . . . Y | SSGWY- . -W. . | . . . . . . . . . . . . . . . |
| iPS:43 5375 | 21-225_149H4 | VH1\|1-08\|D6\|6-19\|RF1\|J H4 | . . . . . . . . . . | N. . . . . . . . . | . . . . . . . . . | . H. . . . . . . . D . . | . . . . . . . . . T . V . . . TF | SSGWY- . . . . | . . . . . . . . . . . . . . . |

FIGURE 52 (Continued)

| | | | | | | | |
|---|---|---|---|---|---|---|---|
| iPS:43-5399 | 21-225_150D2 | VH1|1-08/D6|6-19|RF1/JH4 | .........N..... | ............... | ........H...... | ............Y.. | SSGWY-........ |
| iPS:43-5405 | 21-225_150B7 | VH1|1-08/D6|6-19|RF1/JH4 | ......T...FP... | ............... | ........H...... | ...........L... .S | SSGWY-..-F.... |
| iPS:43-5433 | 21-225_152E3 | VH1|1-08/D6|6-19|RF1/JH4 | ............... | ............N.. | ........H...... | ............S.. | SSGWY-..-F.... |
| iPS:43-5435 | 21-225_152H3 | VH1|1-08/D6|6-19|RF1/JH4 | ..........P.... | ............N.. | ........H...... | ............Y.. | SSGWY-..-W.... |
| iPS:43-5459 | 21-225_152E12 | VH1|1-08/D6|6-19|RF1/JH4 | ............... | ............N.. | ............... | ............Y.. | SSGWY-........ |
| iPS:43-5471 | 21-225_153F11 | VH1|1-08/D6|6-19|RF1/JH4 | ....E.......... | ............N.. | ........H...... | ...........N.Y. | SSGWY-..-F..N |
| iPS:43-5475 | 21-225_154H6 | VH1|1-08/D6|6-19|RF1/JH4 | ............... | ............N.. | ........S...... R.. | ............Y.. | SSGWY-..-I.... |
| iPS:43-5481 | 21-225_154A11 | VH1|1-08/D6|6-19|RF1/JH4 | ............... | ............N.. | ............... | ............S.. | SSGWY-........ |
| iPS:43-5491 | 21-225_155E5 | VH1|1-08/D6|6-19|RF1/JH4 | ............... | ............N.. | ........H...... | ............F.. | SSGWY-........ |
| iPS:43-5495 | 21-225_155B6 | VH1|1-08/D6|6-19|RF1/JH4 | ............... | ............... | ............... | ............Y.. | SSGWY-........ |
| iPS:43-5501 | 21-225_156H1 | VH1|1-08/D6|6-19|RF1/JH4 | ............... | ............N.. | ......VH....... | ............G.. | SSGWY-........ |
| iPS:43-5557 | 21-225_158B12 | VH1|1-08/D6|6-19|RF1/JH4 | .R............. | ............N.. | ........H...... | ...........F Y.. | SSGWY-..-R.... |

FIGURE 52 (Continued)

| | | | | | | | | | |
|---|---|---|---|---|---|---|---|---|---|
| iPS:43 5589 | 21-225_160A4 | VH1J1-08/D6[6-19]RF1/JH4 | .T.......... | ..........N. | ............ | ....P....... | .H.......... | ............Y | SSGWY-......-I.... | :::: |
| iPS:43 5623 | 21-225_162D5 | VH1J1-08/D6[6-19]RF1/JH4 | .S.......... | ..........N. | ............ | ............ | .H.......... | ...D....S...F.F | SSGWY-......-F.... | :::: |
| iPS:43 5627 | 21-225_162F6 | VH1J1-08/D6[6-19]RF1/JH4 | ............ | ..R.......N. | ............ | ............ | .H.......... | .F..........Y | SSGWY-......-R.... | :::: |
| iPS:43 5649 | 21-225_165H2 | VH1J1-08/D6[6-19]RF1/JH4 | ............ | ..........H. | ....V....... | ............ | .HK......... | ......N...D.Y | SSGWY-......-M.... | :::: |
| iPS:43 5727 | 21-225_172E11 | VH1J1-08/D6[6-19]RF1/JH4 | .M.......... | ..........N. | .L.......... | ............ | .H.......... | ............Y | SSGWY-......-R.... | :::: |
| iPS:43 5751 | 21-225_175D10 | VH1J1-08/D6[6-19]RF1/JH4 | ............ | ..........N. | ............ | ............ | .H.......... | .........V..Y | SSGWY-......-..... | :::: |
| iPS:43 5773 | 21-225_177B12 | VH1J1-08/D6[6-19]RF1/JH4 | ............ | ..........N. | ............ | ............ | .H.......... | ............Y | SSGWY-.........F | :::: |
| iPS:43 5801 | 21-225_181E5 | VH1J1-08/D6[6-19]RF1/JH4 | ............ | ..........N. | ............ | ............ | .H.......... | ............S | SSGWY-......-I.... | :::: |
| iPS:43 5841 | 21-225_191D8 | VH1J1-08/D6[6-19]RF1/JH4 | ............ | ..........N. | ............ | ............ | .R.......... | ............H | SSGWY-......-..... | :::: |
| iPS:43 5855 | 21-225_191G3 | VH1J1-08/D6[6-19]RF1/JH4 | ............ | ..........N. | ............ | ............ | ............ | ............H | SSGWY-......-I.... | :::: |
| iPS:43 5915 | 21-225_190H4 | VH1J1-08/D6[6-19]RF1/JH4 | ..N......... | ..........N. | ............ | ............ | ............ | ............H | SSGWY-......-I.... | :::: |
| iPS:43 5925 | 21-225_190D7 | VH1J1-08/D6[6-19]RF1/JH4 | ............ | ..........N. | ............ | ............ | ............ | ............S | SSGWY-......-F.... | :::: |

FIGURE 52 (Continued)

| | | | | | | | | |
|---|---|---|---|---|---|---|---|---|
| iPS:43 6021 | 21-225_193G4 | VH1j1-08/D6j6-19jRF1/JH4 | . . . . . | N . . . . | . . . . . | . . N . . | . . R . . S | SSGWY- . . F . . | . . . . . |
| iPS:43 6150 | 21-225_197H4 | VH1j1-08/D6j6-19jRF1/JH4 | . . . . . | N . . . . | . H . . . | . . . . . | . . . . H | SSGWY- . . . . . | . . . . . |
| iPS:43 6154 | 21-225_197C6 | VH1j1-08/D6j6-19jRF1/JH4 | . . . . . | N . . . . | . H . . . | . . . . . | . . . . H | SSGWY- . . . . . | . . . . . |
| iPS:43 6272 | 21-225_201F5 | VH1j1-08/D6j6-19jRF1/JH4 | . . A . . | N . . . . | . H . . . | . . . . . | . . . . Y | SSGWY- . . . . . | . . . . . |
| iPS:43 6550 | 21-225_224D8 | VH1j1-08/D6j6-19jRF1/JH4 | . . . . . | N . . . . | . LY . . | . . . . . | . . . . Y | SSGWY- . . . . . | . . L . . |
| iPS:43 6554 | 21-225_224C10 | VH1j1-08/D6j6-19jRF1/JH4 | . S . . . | N . . . . | . H . . . | . . . . . | . . . . Y | SSGWY- . . K . . | . . . . . |
| iPS:43 6560 | 21-225_224F11 | VH1j1-08/D6j6-19jRF1/JH4 | . R . H . | N . . . . | . H . F . | . . . . . | . . . . Y | SSGWY- . . K . . | . . . . . |
| iPS:43 6574 | 21-225_225F5 | VH1j1-08/D6j6-19jRF1/JH4 | . . . . . | N . . . . | . H . . . | . . R . . | . . . . Y | SSGWY- . . R . . | . . . . . |
| iPS:43 6584 | 21-225_225B9 | VH1j1-08/D6j6-19jRF1/JH4 | R . . . . | N . . . . | . H . . . | . . . . . | . . N . Y | SSGWT- . . L . . | . . . . . |
| iPS:43 6586 | 21-225_225F11 | VH1j1-08/D6j6-19jRF1/JH4 | . . . . . | N . . . . | . H . . . | . A . . . | . . N . Y | SSGWY- . . R . . | . . . . . |
| iPS:43 6588 | 21-225_225F12 | VH1j1-08/D6j6-19jRF1/JH4 | . . . . . | H . . . . | . H . . . | . . . . . | . . . . Y | SSGWY- . . K . . | . . . . . |
| iPS:43 6590 | 21-225_225H12 | VH1j1-08/D6j6-19jRF1/JH4 | . . . . . | N . . . . | . H . . . | . . . . . | . . . . Y | SSGWY- . . K . . | . . . . . |

FIGURE 52 (Continued)

| | | | | | | | | |
|---|---|---|---|---|---|---|---|---|
| iPS:43 6598 | 21-225_226D6 | VH1|1-08/D6|6-19|RF1/JH4 | .......... | N........ | .H....... | .......... | SSGWY-.......... | .......... |
| iPS:43 6600 | 21-225_226F6 | VH1|1-08/D6|6-19|RF1/JH4 | .......... | N........ | .H....... | N.....Y | SSGWY-..-K... | .......... |
| iPS:43 6616 | 21-225_226D11 | VH1|1-08/D6|6-19|RF1/JH4 | ......R...S | N........ | .H....... | .......Y | SSGWY-..-R... | .......... |
| iPS:43 6622 | 21-225_226A12 | VH1|1-08/D6|6-19|RF1/JH4 | .......... | N........ | .H....... | .......Y | SSGWY-.......... | .......... |
| iPS:43 6636 | 21-225_227E6 | VH1|1-08/D6|6-19|RF1/JH4 | ...R...H | N........ | .H....... | .......Y | SSGWY-..-K... | .......... |
| iPS:43 6638 | 21-225_227C7 | VH1|1-08/D6|6-19|RF1/JH4 | .......... | N........ | .H....... | .......Y | SSGWY-..-R... | .......... |
| iPS:43 6646 | 21-225_227D11 | VH1|1-08/D6|6-19|RF1/JH4 | ...F..P | N........ | ...V..... | .......Y | SSGWY-.......... | .......... |
| iPS:44 6086 | 21-225_94D8 | VH1|1-08/D6|6-19|RF1/JH4 | .......... | N.....V | .H....... | .......Y | SSGWY-..-I... | .......... |
| iPS:45 1116 | 21-225_164A4 | VH1|1-08/D6|6-19|RF1/JH4 | ....R..... | N........ | .H....... | .....S... | SSGWY-..-F... | .......... |
| iPS:45 1124 | 21-225_74F6 | VH1|1-08/D6|6-19|RF1/JH4 | .......... | N........ | .H....... | M.....H | SSGWY-..-F... | .......... |
| iPS:45 1127 | 21-225_164A7 | VH1|1-08/D6|6-19|RF1/JH4 | .......... | N........ | .H....... | ...T...S | SSGWY-..-L... | .......... |
| iPS:45 1131 | 21-225_160A7 | VH1|1-08/D6|6-19|RF1/JH4 | .......... | N........ | .H.H..... | N.....H | SSGWY-.......... | .......... |

FIGURE 52 (Continued)

| | | | | | | | | |
|---|---|---|---|---|---|---|---|---|
| iPS:39 2786 | 21-225_24E1 | VH1f1-08/D6f6-19jRF1/JH4 | . . . . . . . . . . | . . . . . . . . . . N . . . | . . . . . . . . . . | . . . . . . . . . . H . . | . . . . . . . . . . T . . | SSGWE- . -V . . . |
| iPS:39 2886 | 21-225_23A12 | VH1f1-08/D6f6-19jRF1/JH4 | . . . . . . . . . . . P . | . . . . . . . . . . N . . . | . . . . . . . . . . | . . . . . . . . . . R . . | . . . . . . . . . . N . . G | SSGWY- . . . |
| iPS:39 2928 | 21-225_25A4 | VH1f1-08/D6f6-19jRF1/JH4 | . L . . . . . R . . | . . . . . . . . . . N . . . | . . . . . . . . . . | . . . . . . . . . . Y . . | . . . . . . . . . . S | SSGWY- . . . |
| iPS:39 2936 | 21-225_28B6 | VH1f1-08/D6f6-19jRF1/JH4 | . L . . . . . R . . | . . . . . . . . . . N . . . | . . . . . . . . . . | . . . . . . . . . . H . D | . . . . . . . . . . S | SSGWY- . . . |
| iPS:39 2960 | 21-225_29E6 | VH1f1-08/D6f6-19jRF1/JH4 | . L . . . . . R . . | . . . . . . . . . . N . . . | . . . . . . . . . . | . . . . . . . . . . H . . | . . . . . . . . . . N . . S | SSGWY- . . . |
| iPS:39 2992 | 21-225_26C4 | VH1f1-08/D6f6-19jRF1/JH4 | . . . . . . . . . . | . . . . . . . . . . N . . . | . . . . . . . . . . S . | . . . . . . . . . . F . . R . . | . . . . . . . . . . L . . S | SSGWY- . . . |
| iPS:39 3088 | 21-225_33D1 | VH1f1-08/D6f6-19jRF1/JH4 | . . . . . . . . . . | . . . . . . . . . . N . . . | . . . . . . . . . . V . | . . . . . . . . . . T . F . . R | . . . . . . . . . . A . . S | SSGWY- . -F . . |
| iPS:39 3144 | 21-225_34D2 | VH1f1-08/D6f6-19jRF1/JH4 | . . . . . . . . . . | . . . . . . . . . . N . . . | . . . . . . . . . . | . . . . . . . . . . L H . . R | . . . . . . . . . . L . . S | SSGWY- . -F . . |
| iPS:39 3368 | 21-225_29H8 | VH1f1-08/D6f6-19jRF1/JH4 | . . . . . . . . . Q . | . . . . . . . . . . N . . . | . . . . . . . . . . | . . . . . . . . . . R . . | . . . . . . . . . . A . . S | SSGWE- . . . |
| iPS:39 3942 | 21-225_11E5 | VH1f1-08/D6f6-19jRF1/JH4 | . . . . . . . . . P . | . . . . . . . . . . N . . . | . . . . . . . . . . A . | . . . . . . . . . . H . A R . . | . . . . . . . . . . T | SSGWE- . -V . . |
| iPS:39 4085 | 21-225_8B11 | VH1f1-08/D6f6-19jRF1/JH4 | . . . . . . . . . . | . . . . . . . . . . N . . . | . . . . . . . . . . | . . . . . . . . . . H . . | . . . . . . . . . . R . . Y | SSGWY- . . . |
| iPS:39 8496 | 21-225_22D2 | VH1f1-08/D6f6-19jRF1/JH4 | . . . . . . . . . I | . . . . . . . . . . N . . . | . . . . . . . . . . | . . . . . . . . . . H . D | . . . . . . . . . . Y | SSGWY- . . . |

FIGURE 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:39 8522 | 21-225_32A1 VH1|1-08/D6|6-19|RF1/JH4 | ........... | N........ | ........... | ........ | ........... | SSGMY- .... | ........ |
| iPS:39 8524 | 21-225_32A5 VH1|1-08/D6|6-19|RF1/JH4 | ........... | N........ | ........... | ..H..F.. ...R... | ........S.. | SSGMY- -F... | ........ |
| iPS:39 8538 | 21-225_34H7 VH1|1-08/D6|6-19|RF1/JH4 | ........... | N........ | ........... | ........ | ....N....SS | SSGMY- -F... | ........ |
| | Germline VH1|1-02|D1|1-1|RF1|JH4 | H_FR1 QVQLQQS GAEVKKPGASVK VSCKASG-YTFT | H_CDR1 ........YMH | H_FR2 WVRQAPGQ GLEWMG | H_CDR2 WINPN SGGTNYAQ KFQG | H_FR3 RVTMTRDTSISTAYMEL SRLRSDDTAVYYCAR | H_CDR3 ........YFDY | H_FR4 WGQGTL VTVSS |
| iPS:47 3253 | 21-225_7C3_LC1 VH1|1-02|D1|1-1|RF1/JH4 | ........N.. | D......L.. | ........ | ..H..... | ........S.. | DG.S- ...S... | ........ |
| iPS:47 3254 | 21-225_7C3_LC2 VH1|1-02|D1|1-1|RF1/JH4 | ........N.. | D......L.. | ........ | ........ | ........S.. | DG.S- ...S... | ........ |
| iPS:47 3255 | 21-225_9F12_LC1 VH1|1-02|D1|1-1|RF1/JH4 | ........A.. | D......L.. | ........ | ..H..... | .....L..F.. | DG.S- ...S... | ........ |
| iPS:47 3256 | 21-225_9F12_LC2 VH1|1-02|D1|1-1|RF1/JH4 | ........A.. | D......L.. | ........ | ..H..F.. | .....L..F.. | DG.S- ...S... | ........ |
| iPS:42 6108 | 21-225_10G6 VH1|1-02|D1|1-1|RF1/JH4 | ........... | A......H.. | ........ | NN...... | ........G.. | DV.S- ...S... | ........ |
| iPS:42 6110 | 21-225_12E9 VH1|1-02|D1|1-1|RF1/JH4 | ........... | D......L.. | ........ | VH..F.. ...D... | .......H.S.. | DG.S- ...S... | ........ |
| iPS:45 3451 | 21-225_52G11 VH1|1-02|D1|1-1|RF1/JH4 | ........... | ........ | ........ | RN...... | ........F.. | DG.S- ...S... | ........ |

FIGURE 52 (Continued)

| ID | Clone | Germline | | | | | | | |
|---|---|---|---|---|---|---|---|---|---|
| iPS:45 3453 | 21-225_53F2 | VH1\|1-02\|D1\|1-1\|RF1\|JH4 | . | . | L | . | . | . | DG.S- |
| iPS:43 4035 | 21-225_49F10 | VH1\|1-02\|D1\|1-1\|RF1\|JH4 | . | . | H | . | RN... N... | .K. | DG.S- ...S.. |
| iPS:43 4065 | 21-225_50D4 | VH1\|1-02\|D1\|1-1\|RF1\|JH4 | . | . | H | . | NNA... N... | .L. | DG.S- ...S..F |
| iPS:43 4069 | 21-225_51E9 | VH1\|1-02\|D1\|1-1\|RF1\|JH4 | . | ..R. | HI | . | MNA... S... | .L. | DG.S- ...S..F |
| iPS:43 4079 | 21-225_52B1 | VH1\|1-02\|D1\|1-1\|RF1\|JH4 | . | . | H.Q | . | TN..Q ..... | . | DG.S- ...S.. ..LD |
| iPS:43 4097 | 21-225_52H10 | VH1\|1-02\|D1\|1-1\|RF1\|JH4 | . | . | H.Q | . | ..A... N... | . | DG.S- ...S.. |
| iPS:43 4123 | 21-225_53F7 | VH1\|1-02\|D1\|1-1\|RF1\|JH4 | . | . | H | . | N..Q ..... | N.T | DG.S- ...S.. |
| iPS:43 4189 | 21-225_56E5 | VH1\|1-02\|D1\|1-1\|RF1\|JH4 | ..Q | . | H | . | NN... ..... | . R. | DG.S- ...S.. ..H |
| iPS:43 5677 | 21-225_169C10 | VH1\|1-02\|D1\|1-1\|RF1\|JH4 | . | . | F | . | NNA... R... | N.. | .G.TVAT ....WGV ..N. |
| iPS:43 5699 | 21-225_170D6 | VH1\|1-02\|D1\|1-1\|RF1\|JH4 | ..R | S | FI | V | .K... R... | N.. | .G.TVAT ....WGV ..M. |
| iPS:43 5797 | 21-225_181G2 | VH1\|1-02\|D1\|1-1\|RF1\|JH4 | ..T | S | N | . | N.S.T ..... | . | KF----- ---GD |
| iPS:43 5877 | 21-225_184E7 | VH1\|1-02\|D1\|1-1\|RF1\|JH4 | ..T | S | N | V | N.S.T ..... | . | KF----- ---GD |

FIGURE 52 (Continued)

| | | | | | | | | |
|---|---|---|---|---|---|---|---|---|
| iPS:43 5885 | 21-225_185E10 | VH1|1-02|D1|1-1|RF1|JH4 | ..T....... | ....... | S......N. | .....V...N.S..T | ........I. | ............ | KF------GD |
| iPS:43 5891 | 21-225_188H5 | VH1|1-02|D1|1-1|RF1|JH4 | ..T....... | ...R... | S......N. | .........S..T | ............ | ............ | KF------GD |
| iPS:43 5897 | 21-225_188B9 | VH1|1-02|D1|1-1|RF1|JH4 | ..T....... | ...R... | S......N. | .....V...S..T | ............ | ............ | KF------GD |
| iPS:43 6400 | 21-225_213H7 | VH1|1-02|D1|1-1|RF1|JH4 | .......... | ....... | ....H.. | .........D..K | ............ | ......D..... | EKP.S......YK |
| iPS:43 6488 | 21-225_221A6 | VH1|1-02|D1|1-1|RF1|JH4 | ..T....... | ....... | ....... | .........H.. | ...L........ | ............ | DG.S-.....S... |
| iPS:43 6496 | 21-225_222E1 | VH1|1-02|D1|1-1|RF1|JH4 | ..T....... | ....... | ....... | .........H.. | ...L........ | ............ | DG.S-.....S... |
| iPS:43 6508 | 21-225_222F7 | VH1|1-02|D1|1-1|RF1|JH4 | ..T....... | ....... | ....... | .........H.. | ...L........ | ............ | DG.S-.....S... |
| iPS:43 6516 | 21-225_222C12 | VH1|1-02|D1|1-1|RF1|JH4 | ..T....... | ....... | ....... | .........H.. | ...L........ | ............ | DG.S-.....S... |
| iPS:43 7264 | 21-225_171H12 | VH1|1-02|D1|1-1|RF1|JH4 | .......... | ...R... | ....F.. | .....K.K..S..R | .....N...... | ......N..... | .G.TVAI...WGV... |
| iPS:43 7266 | 21-225_177A5 | VH1|1-02|D1|1-1|RF1|JH4 | .......... | ...R... | ....F.. | .....K.K..S..R | ....NW...... | ......N..... | .G.TVAI...WGV... |
| iPS:39 3080 | 21-225_34F3 | VH1|1-02|D1|1-1|RF1|JH4 | .......... | ....... | ....H.. | .........K.. | ............ | ............ | DG.S-.....S... |
| iPS:39 3084 | 21-225_35C6 | VH1|1-02|D1|1-1|RF1|JH4 | .......... | ...T... | ....D.. | .....D...S.K..N | .....N...... | ............ | DG.-......S... |

| VH3-33/D6-6/RF1/JH6 | | | | | | | |
|---|---|---|---|---|---|---|---|
| iPS:42 6114 | 21-225_28H2 | VH3\|3-33/D6\|6-6\|RF1/JH6 | ..... | N......V.. | ..... | ..... | ....V..... | EY..GW--- | .......D. |
| iPS:42 6116 | 21-225_29E2 | VH3\|3-33/D6\|6-6\|RF1/JH6 | ..... | N......CV. | ..... | ..... | I......... | EY..GW--- | .......D. |
| iPS:46 8812 | 21-225_48H4 | VH3\|3-33/D6\|6-6\|RF1/JH6 | ..... | D......SL. | ..... | ....T | ..... | NY..GW--- | .......G. |
| iPS:46 8816 | 21-225_52G8 | VH3\|3-33/D6\|6-6\|RF1/JH6 | ..... | ..... | ..... | ..... | ....L..... | R....W--- SG.... | ..... |
| iPS:46 8826 | 21-225_201C5 | VH3\|3-33/D6\|6-6\|RF1/JH6 | ..... | D......V.. | ..... | ....V | ....R..... | RY..GL--- | .......D. |
| iPS:46 8842 | 21-225_50H4 | VH3\|3-33/D6\|6-6\|RF1/JH6 | ..... | ..... | A | ..... | ....D..... | LY..NW--- | .......D. |
| iPS:46 8858 | 21-225_148C9 | VH3\|3-33/D6\|6-6\|RF1/JH6 | A | D......V.. | ..... | ..... | L......... | RY..GW--- L...... | .......D. |
| iPS:46 8860 | 21-225_224E7 | VH3\|3-33/D6\|6-6\|RF1/JH6 | .S... | ..... | ..... | ..... | ..... | QY...W--- .L..... | ......DF |
| iPS:43 3917 | 21-225_43E11 | VH3\|3-33/D6\|6-6\|RF1/JH6 | .S... | D.....T... | ..... | ..... | L......... | R.VR.W--- VG..... | .......-- |
| iPS:43 3919 | 21-225_44B3 | VH3\|3-33/D6\|6-6\|RF1/JH6 | ..... | D......... | ..... | ..... | ..... | RY..GW--- | .......D. |
| iPS:43 3923 | 21-225_44D3 | VH3\|3-33/D6\|6-6\|RF1/JH6 | ..... | ......V.. | ..... | ..... | ..... | RY..GL--- | .......D. |

FIGURE 52 (Continued)

| | | | | | | | |
|---|---|---|---|---|---|---|---|
| iPS:43 3929 | 21-225_44D5 | VH3|3-33|D6|6-6|RF1/JH6 | | V.. | | | VPY...W--....D.... |
| iPS:43 3935 | 21-225_44F9 | VH3|3-33|D6|6-6|RF1/JH6 | | V.. | | | .PY...W--....D....G... |
| iPS:43 3937 | 21-225_44B10 | VH3|3-33|D6|6-6|RF1/JH6 | ...V | | | | R....W--........... VG..... |
| iPS:43 3939 | 21-225_44C10 | VH3|3-33|D6|6-6|RF1/JH6 | | D.....CV.. | | | .RY..GL--....D.... |
| iPS:43 3951 | 21-225_45B4 | VH3|3-33|D6|6-6|RF1/JH6 | | D.....CV.. | | | .RY..GL--.......... |
| iPS:43 3955 | 21-225_45B8 | VH3|3-33|D6|6-6|RF1/JH6 | | D.....CV.. | | | .RY..GL--....D.... |
| iPS:43 3967 | 21-225_46C3 | VH3|3-33|D6|6-6|RF1/JH6 | | ....V. | | | .RY..GL--....D.... |
| iPS:43 3971 | 21-225_46D4 | VH3|3-33|D6|6-6|RF1/JH6 | | | | | VPY...W--....D.... |
| iPS:43 3979 | 21-225_46B9 | VH3|3-33|D6|6-6|RF1/JH6 | ....S | D..... | T | R... I | R....W--....D.... MG..... F |
| iPS:43 3985 | 21-225_47C1 | VH3|3-33|D6|6-6|RF1/JH6 | | I | | D | R..R.W--........... VG..... |
| iPS:43 3991 | 21-225_47E7 | VH3|3-33|D6|6-6|RF1/JH6 | | N..... | | | R..R.W--....D.... |
| iPS:43 4001 | 21-225_48F2 | VH3|3-33|D6|6-6|RF1/JH6 | | ....V. | | | .RY...W--....D.... ....L.. |

FIGURE 52 (Continued)

| | | | | | | | |
|---|---|---|---|---|---|---|---|
| iPS:43 4021 | 21-225_49C1 | VH3\|3-33\|D6\|6-6\|RF1\|JH6 | ....T | : : : | : : : | : : : | R...W---<br>.SG... | : : : |
| iPS:43 4025 | 21-225_49G3 | VH3\|3-33\|D6\|6-6\|RF1\|JH6 | : : : | : : : | : : : | : : : | R...W---<br>.SG... | : : : |
| iPS:43 4031 | 21-225_49E7 | VH3\|3-33\|D6\|6-6\|RF1\|JH6 | : : : | : : : | : : : | : : : | R...W---<br>.SG... | : : : |
| iPS:43 4033 | 21-225_49F9 | VH3\|3-33\|D6\|6-6\|RF1\|JH6 | : : : | : : : | .R... | .L... | R...W---<br>.SG... | : : : |
| iPS:43 4053 | 21-225_51E1 | VH3\|3-33\|D6\|6-6\|RF1\|JH6 | : : : | : : : | .S... | .P... | R...W---<br>.SG... | : : : |
| iPS:43 4093 | 21-225_52D10 | VH3\|3-33\|D6\|6-6\|RF1\|JH6 | : : : | : : : | ..H.. | ..H.. | R...W---<br>.SG... | : : : |
| iPS:43 4137 | 21-225_54D4 | VH3\|3-33\|D6\|6-6\|RF1\|JH6 | : : : | : : : | .L... | : : : | R...W---<br>.SG... | : : : |
| iPS:43 4149 | 21-225_55H1 | VH3\|3-33\|D6\|6-6\|RF1\|JH6 | : : : | : : : | : : : | : : : | R...W---<br>.SG... | : : : |
| iPS:43 4151 | 21-225_55C2 | VH3\|3-33\|D6\|6-6\|RF1\|JH6 | : : : | : : : | .L..H | : : : | R...W---<br>.SG... | : : : |
| iPS:43 4161 | 21-225_55F9 | VH3\|3-33\|D6\|6-6\|RF1\|JH6 | : : : | : : : | ..NG. | : : : | R...W---<br>.SG... | : : : |
| iPS:43 4201 | 21-225_59A12 | VH3\|3-33\|D6\|6-6\|RF1\|JH6 | : : : | : : : | : : : | : : : | R...W---<br>.DG... | : : : |
| iPS:43 4205 | 21-225_60G2 | VH3\|3-33\|D6\|6-6\|RF1\|JH6 | : : : | : : : | : : : | : : : | R.R.W---<br>.TG... | : : : |

FIGURE 52 (Continued)

| ID | Gene | | | | | | | |
|---|---|---|---|---|---|---|---|---|
| iPS:43_4223 | VH3-33/D6-6/RF1/JH6 | . . . . . . . . . . | . . . . . . . . . . | . . . . . . . . V . | . . . . . . . . . . | . . . . . . . . . . | R . . R . W— . . . . . . . . . . TG . . . | . . . . |
| iPS:43_4231 | VH3-33/D6-6/RF1/JH6 | . . . . . . . . . . | . . . . . . . . . . | . . . . . . . . . . | . . . . . . . . . . | . . . . . . . . . . | . RY . . GW— . . . . . . . . . . . . . . D . | . . . . |
| iPS:43_4233 | VH3-33/D6-6/RF1/JH6 | . . . . . . . . . . | . . . . . . . . . . | . . . . . . . . H . | . . . . . . . . . . | . . . . . . . . . . | R . . R . W— . . . . . . . . . . AG . . . | . . . . |
| iPS:43_4303 | VH3-33/D6-6/RF1/JH6 | . . . . . . . . . . | . . . . . . D . . . | . . . . . . . . . . | . . . . . . . . . . | . . . . . . . . . . | R . . . . W— . . . . . . . . . . DG . . . | . . . . |
| iPS:43_4339 | VH3-33/D6-6/RF1/JH6 | . . . . . . . . . . | . . . . . . D . . . | . . . . . . . . . . | . . . . . . . . . . | . . . . . . . . Q . | . RY . . W— . . . . . . . . . . . . . . D . | . . . . |
| iPS:43_4343 | VH3-33/D6-6/RF1/JH6 | . . . . . . . . . G | . . . . . . . . . . | . . . . . . . . M . | . . . . . . . . . . | . . . . . . . . . . | . RY . . GW— . . . . . . . . . . . . . . D . | . . . . |
| iPS:43_4387 | VH3-33/D6-6/RF1/JH6 | . . . . . . . . . . | N . . . . . . V . . | . . . . . . . . . . | . . . . . . . . S . . . . . . L . . . | | . MY . . NW— . . . . . . . . . . . . . . D . | . . . . |
| iPS:43_4469 | VH3-33/D6-6/RF1/JH6 | . . . . . . . . . . | N . . . . . DI . . | . . . . . . . . . . | . . . . . . . . . . | . . . . . . . . F . | . RY . . W— . . . . . . . . . . . . . . FD . | . . . . |
| iPS:43_5197 | VH3-33/D6-6/RF1/JH6 | . . . . . . . . . . | . . . . . . . . . . | . . . . . . . . . . | . . . . . . . . . H | . . . . . . . . . . | . KY . . GW— . . . . . . . . . . . . . . D . | . . . . |
| iPS:43_5315 | VH3-33/D6-6/RF1/JH6 | . . . . . . . . . . | . . . . . . D . . . | . . . . . . . . . . | . . . . . . . . . . | . . . . . . . . . . | R . . . . W— . . . . . . . . . . SG . . . | . . . . |
| iPS:43_5325 | VH3-33/D6-6/RF1/JH6 | . . . . . A . . . . | . . . . . . . . . . | . . . . . . . . . . | . . . . . . . L . . . . . . S . . . | | . RY . . GW— . . . . . . . . . . . L . . . D . | . . . . |
| iPS:43_5329 | VH3-33/D6-6/RF1/JH6 | . . . . . . . . . . | . . . . . . . . . . | . . . . . . . . . . | . . . . . . . . . . | . . . . . . . . . . | R . . . . W— . . . . . . . . . . TG . . . | . . . . |

FIGURE 52 (Continued)

| | | | | | | | | |
|---|---|---|---|---|---|---|---|---|
| iPS:43 5349 | 21- 225_148F5 | VH3\|3- 33\|D6\|6- 6\|RF1/JH6 | . . . . . . | . . . . . . | . . . . . . | . . . . . . | R...W--- ....... | ....... ....... |
| iPS:43 5359 | 21- 225_148H10 | VH3\|3- 33\|D6\|6- 6\|RF1/JH6 | . . . . . . | . . . . . . | . . . . . . | . . . . . . | R...W--- SG..... | ....... ....... |
| iPS:43 5393 | 21- 225_149D10 | VH3\|3- 33\|D6\|6- 6\|RF1/JH6 | ...A... | D......V | ....G.. | ..L.... | .RY.GW--- ....... | ....D.. ....... |
| iPS:43 5401 | 21- 225_150E2 | VH3\|3- 33\|D6\|6- 6\|RF1/JH6 | . . . . . . | . . . . . . | . . . . . . | . . . . . . | .EY.W--- ....... | ....G.. ....... |
| iPS:43 5417 | 21- 225_150D11 | VH3\|3- 33\|D6\|6- 6\|RF1/JH6 | . . . . . . | .....I. | ..F.H.. | .....S..T | RF..W--- SG..... | ....... ....... |
| iPS:43 5445 | 21- 225_152F7 | VH3\|3- 33\|D6\|6- 6\|RF1/JH6 | . . . . . . | . . . . . . | . . . . . . | . . . . . . | .EY.W--- ....... | ....G.. ....... |
| iPS:43 5469 | 21- 225_153G9 | VH3\|3- 33\|D6\|6- 6\|RF1/JH6 | . . . . . . | N.....V | .C..L.F | ....F.. | R.R.W--- AG..... | .....A ....... |
| iPS:43 5573 | 21- 225_159D8 | VH3\|3- 33\|D6\|6- 6\|RF1/JH6 | . . . . . . | D.....V | . . . . . . | . . . . . . | .PY.GW--- ....... | ....D.. ....... |
| iPS:43 5681 | 21- 225_169D11 | VH3\|3- 33\|D6\|6- 6\|RF1/JH6 | . . . . . . | D.....I | ...E... | ....L.. | .RY.GW--- ....... | ....D.. ....... |
| iPS:43 5689 | 21- 225_170F3 | VH3\|3- 33\|D6\|6- 6\|RF1/JH6 | ...S... | . . . . . . | . . . . . . | . . . . . . | .TY..W--- ....... | ....D.. ....... |
| iPS:43 5733 | 21- 225_173C11 | VH3\|3- 33\|D6\|6- 6\|RF1/JH6 | . . . . . . | . . . . . . | ..L.F.. | ....H.. ....S.. | R...W--- SG..... | ....... ....... |
| iPS:43 5741 | 21- 225_174G10 | VH3\|3- 33\|D6\|6- 6\|RF1/JH6 | . . . . . . | D.....V | . . . . . . | ....L.. | .RY.GW--- ....... | ....D.. ....... |

| | | | | | | | |
|---|---|---|---|---|---|---|---|
| iPS:43-6386 | 21-225_212B11 | VH3/3-33/D6(6-6)RF1/JH6 | D........ | V.. | ..T | | .RY..GW-- | ..D |
| iPS:43-6412 | 21-225_214H9 | VH3/3-33/D6(6-6)RF1/JH6 | | V.. | ..T | ..F | .RYT..W-- | ..D |
| iPS:43-6414 | 21-225_214G10 | VH3/3-33/D6(6-6)RF1/JH6 | D........ | V.. | ..T | | .RY..GW-- | ..D |
| iPS:43-6416 | 21-225_214G12 | VH3/3-33/D6(6-6)RF1/JH6 | D........ | V.. | ..T | | .RY..GW-- | ..D |
| iPS:43-6418 | 21-225_215E3 | VH3/3-33/D6(6-6)RF1/JH6 | D........ | VI. | ..T | ..V | .RY..GW-- | ..D |
| iPS:43-6428 | 21-225_215E11 | VH3/3-33/D6(6-6)RF1/JH6 | D........ | V.. | ..T | | .RY..GW-- | ..D |
| iPS:43-6438 | 21-225_216E8 | VH3/3-33/D6(6-6)RF1/JH6 | D........ | V.. | ..T | | .RY..GW-- | ..D |
| iPS:43-6440 | 21-225_216H12 | VH3/3-33/D6(6-6)RF1/JH6 | D........ | V.. | ..T | | .RY..GW-- | ..D |
| iPS:43-6450 | 21-225_217E5 | VH3/3-33/D6(6-6)RF1/JH6 | D........ | V.. | ..T | | .RY..GW-- | ..D |
| iPS:43-6456 | 21-225_217G10 | VH3/3-33/D6(6-6)RF1/JH6 | D........ | V.. | ..T | | .RY..GW-- | ..D |
| iPS:43-6458 | 21-225_217H12 | VH3/3-33/D6(6-6)RF1/JH6 | D........ | V.. | ..T | | .RY..GW-- | ..D |
| iPS:43-6462 | 21-225_218C4 | VH3/3-33/D6(6-6)RF1/JH6 | D........ | V.. | ..T | | .RY..GW-- | ..D |

FIGURE 52 (Continued)

| | | | | | | | |
|---|---|---|---|---|---|---|---|
| iPS:43 6480 | 21-225_220F8 | VH3j3-33/D6j6-6jRF1/JH6 | D......V.. | ....T | | | .RY..GW- ....D |
| iPS:43 6534 | 21-225_224F1 | VH3j3-33/D6j6-6jRF1/JH6 | ....I | | | | .RY..NW- ....D |
| iPS:43 6540 | 21-225_224F3 | VH3j3-33/D6j6-6jRF1/JH6 | ....S.. | | | | .RY...W- ....D |
| iPS:43 6564 | 21-225_225A1 | VH3j3-33/D6j6-6jRF1/JH6 | D.....VI. | | | | .RY..GW- ....D |
| iPS:43 6596 | 21-225_226C6 | VH3j3-33/D6j6-6jRF1/JH6 | D......V.. | ....T | | | .RY...W- ....D |
| iPS:43 6620 | 21-225_226H11 | VH3j3-33/D6j6-6jRF1/JH6 | N....C. | | | | .LY...W- ....D .L.. |
| iPS:43 6744 | 21-225_154F4 | VH3j3-33/D6j6-6jRF1/JH6 | | | | | D.YC.GTSC .PYY...... |
| iPS:43 6946 | 21-225_183F4 | VH3j3-33/D6j6-6jRF1/JH6 | | | | | .RYC.GTTC ..PYY....LG |
| iPS:43 7286 | 21-225_208F1 | VH3j3-33/D6j6-6jRF1/JH6 | D......V.. | | | R.... | .RY..GL- ....D |
| iPS:43 7290 | 21-225_210G6 | VH3j3-33/D6j6-6jRF1/JH6 | D......V.. | | | R.... | .RY..GL- ....D |
| iPS:39 2634 | 21-225_17H3 | VH3j3-33/D6j6-6jRF1/JH6 | N....CV. | | | ....S... | .KY...W- ....D |
| iPS:39 2742 | 21-225_20B2 | VH3j3-33/D6j6-6jRF1/JH6 | N......VI. | | | | .KY...W- ....D |

| | Germline | H_FR1 | H_CDR1 | H_FR2 | H_CDR2 | H_FR3 | H_CDR3 | H_FR4 |
|---|---|---|---|---|---|---|---|---|
| iPS:39 3908 | VH3\|3-33\|D6\|6-6\|RF1\|JH6 | ........... | ......VI. | ........... | ........... | ........... | .KY...W-......D. | ........ |
| iPS:39 3916 | VH3\|3-33\|D6\|6-6\|RF1\|JH6 | ........... | ......V. | ........... | ........... | ........... | .KY...W-......D. | ...H.. |
| iPS:39 3950 | VH3\|3-33\|D6\|6-6\|RF1\|JH6 | ........... | ......V. | ........... | ........... | ........... | .RY..GW-......D. ...L... | ........ |
| iPS:39 3972 | VH3\|3-33\|D6\|6-6\|RF1\|JH6 | ..........L.. | N......V. | ........... | ........... | ........... | .KY...W-......D. | ........ |
| iPS:39 3978 | VH3\|3-33\|D6\|6-6\|RF1\|JH6 | ........... | ......V. | ........... | ........... | ........... | .KY...W-......D. | ...H.. |
| iPS:39 3986 | VH3\|3-33\|D6\|6-6\|RF1\|JH6 | ........N... | ......V. | ........... | ........... | ......T.... | .KY..NW-......D. | ........ |
| iPS:39 3996 | VH3\|3-33\|D6\|6-6\|RF1\|JH6 | ........... | D......V. | ........... | ........... | ........... | .KY...W-......D. ...L... | ........ |
| iPS:39 4041 | VH3\|3-33\|D6\|6-6\|RF1\|JH6 | ........... | N......V. | ........... | ........... | ......T.... | .VI..GW-......D. | ........ |
| VH3\|3-33\|D2\|2-8\|RF3\|JH4 | Germline | H_FR1 QVQLVES GGGVVQPGRSLR LSCAASGFTFS | H_CDR1 S YGMH | H_FR2 WVRQAPGK GLEWVA | H_CDR2 VISYDG SNKYYAD SVKG | H_FR3 RFTISRDNSKNTLYLQ MNSLRAEDTAVYYCAR | H_CDR3 DVWGY-----AYYFDY | H_FR4 WGQGT LVTVSS |
| iPS:42 6118 | VH3\|3-33\|D2\|2-8\|RF3\|JH4 | .......N... | ........ | ........M. | ........ | .........H.... | .ER.G---------- | ........ |
| iPS:39 3844 | VH3\|3-33\|D2\|2-8\|RF3\|JH4 | .......N... | N........ | ........ | .......H.... | .......V.. | .ER.G---------I- | ........ |

| | | | | | | | | | |
|---|---|---|---|---|---|---|---|---|---|
| iPS:43 4603 | 21-225_77D11 | VH1|1-08|D6|6-19|RF1/J H5 | | N | .VP. | | | | SSGWY- |
| iPS:43 4613 | 21-225_77D12 | VH1|1-08|D6|6-19|RF1/J H5 | | N | | .H. | N...I | SSGWY- |
| iPS:43 4617 | 21-225_74B8 | VH1|1-08|D6|6-19|RF1/J H5 | | N | | | ...L | ...I | SSGWY- |
| iPS:43 4619 | 21-225_78C1 | VH1|1-08|D6|6-19|RF1/J H5 | | N | | .H. | ...V | SSGWY- |
| iPS:43 4639 | 21-225_74B7 | VH1|1-08|D6|6-19|RF1/J H5 | ..P | N | | .H. | ...I | SSGWH- | ..A |
| iPS:43 4653 | 21-225_74B5 | VH1|1-08|D6|6-19|RF1/J H5 | | N | | | T..H..V | SSGWN- |
| iPS:43 4655 | 21-225_78H12 | VH1|1-08|D6|6-19|RF1/J H5 | ..P | N | | | ...V | SSGWH- | ..A |
| iPS:43 4675 | 21-225_79G6 | VH1|1-08|D6|6-19|RF1/J H5 | ..F | N | | | ...V | SSGWY- |
| iPS:43 4689 | 21-225_79G10 | VH1|1-08|D6|6-19|RF1/J H5 | | N | .VP. | .H..F | T..H..V | SSGWN- |
| iPS:43 4705 | 21-225_80A2 | VH1|1-08|D6|6-19|RF1/J H5 | | N | | .H. | ...I | SSGWY- |
| iPS:43 4707 | 21-225_80D3 | VH1|1-08|D6|6-19|RF1/J H5 | | N | | .H. | ...I | SSGWY- |
| iPS:43 4731 | 21-225_80E9 | VH1|1-08|D6|6-19|RF1/J H5 | | N | | .H. | ...I | SSGWY- |

FIGURE 52 (Continued)

| | | | | | | | | |
|---|---|---|---|---|---|---|---|---|
| iPS:43 4747 | 21-225_80C12 | VH1|1-08/D6|6-19|RF1/J H5 | ........ | N..... | ........ | ........ | H..... | N..... | ........ | SSGWY- | ........ |
| iPS:43 4761 | 21-225_81E5 | VH1|1-08/D6|6-19|RF1/J H5 | ........ | N..... | ........ | ........ | ........ | ........ | ........ | SSGWN- | ........ |
| iPS:43 4771 | 21-225_81F9 | VH1|1-08/D6|6-19|RF1/J H5 | ........ | N..... | ........ | ........ | H..... | N..... | T..H.. | SSGWY- | ........ |
| iPS:43 4793 | 21-225_82A5 | VH1|1-08/D6|6-19|RF1/J H5 | ........ | N..... | ........ | VP... | H..... | ........ | ........I...V | SSGWY- | ........ |
| iPS:43 4797 | 21-225_82G5 | ........ | N..... | ........ | VP... | H..... | ........ | ........I | SSGWY- | ........ |
| iPS:43 4805 | 21-225_82D9 | VH1|1-08/D6|6-19|RF1/J H5 | ........ | N..... | ........ | VP... | H..... | ........ | ........I | SSGWY- | ........ |
| iPS:43 4813 | 21-225_82C12 | VH1|1-08/D6|6-19|RF1/J H5 | ........ | N..... | ........ | ........ | H..... | N..... | ........I | SSGWY- | ........ |
| iPS:43 4825 | 21-225_83C2 | VH1|1-08/D6|6-19|RF1/J H5 | ........ | N..... | ........ | VP... | H..... | ........ | ........I | SSGWY- | ........ |
| iPS:43 4827 | 21-225_83F3 | VH1|1-08/D6|6-19|RF1/J H5 | ........ | N..... | ........ | ........ | H..... | ........ | ........I | SSGWY- | ........ |
| iPS:43 4829 | 21-225_83G3 | VH1|1-08/D6|6-19|RF1/J H5 | ........ | N..... | ........ | ........ | H..... | ........ | ........I | SSGWY- | ........ |
| iPS:43 4833 | 21-225_83C5 | VH1|1-08/D6|6-19|RF1/J H5 | ........ | ........ | ........ | ........ | ........ | ........ | ........V | SSGWY- | ........ |
| iPS:43 4841 | 21-225_83G7 | VH1|1-08/D6|6-19|RF1/J H5 | ......P | ........ | ........ | ........ | ........ | ........ | ........ | SSGWH- | ....A. |

FIGURE 52 (Continued)

| | | | | | | | | |
|---|---|---|---|---|---|---|---|---|
| iPS:43 4863 | 21-225_84G7 | VH1J1-08/D6J6-19]RF1/J H5 | ....... | N... | ....... | ...D.. | ....... | SSGWH- | ...A. |
| iPS:43 4877 | 21-225_85H2 | VH1J1-08/D6J6-19]RF1/J H5 | ....... | N... | ....... | ..H... | ...L... V | SSGWY- | ..... |
| iPS:43 4883 | 21-225_85B5 | VH1J1-08/D6J6-19]RF1/J H5 | ....... | N... | ..VP.. | ..H... | ....... V | SSGWY- | ..... |
| iPS:43 4911 | 21-225_85D11 | VH1J1-08/D6J6-19]RF1/J H5 | ....... | N... | ..VP.. | ..H... | ....... I | SSGWY- | ..... |
| iPS:43 4935 | 21-225_86E9 | VH1J1-08/D6J6-19]RF1/J H5 | ....... | N... | ....... | ....... | .S.T..H.. | SSGWS- | ..... |
| iPS:43 4957 | 21-225_87A10 | VH1J1-08/D6J6-19]RF1/J H5 | ....... | N... | ....... | ..H..N | ....... I | SSGWY- | ..L. |
| iPS:43 4971 | 21-225_88G2 | VH1J1-08/D6J6-19]RF1/J H5 | ....... | N... | ....... | ..H... | ....... I | SSGWY- | ..... |
| iPS:43 5051 | 21-225_90D9 | VH1J1-08/D6J6-19]RF1/J H5 | ....... | N... | ....... | ..H... | ....... V | SSGWH- | ..A. |
| iPS:43 5071 | 21-225_91F1 | VH1J1-08/D6J6-19]RF1/J H5 | ....... | N... | ....... | ..H... | ....... I | SSGWY- | ..... |
| iPS:43 5087 | 21-225_91G8 | VH1J1-08/D6J6-19]RF1/J H5 | ....... | N... | ....... | ..H... | ....... I | SSGWY- | ..... |
| iPS:43 5203 | 21-225_75A7 | VH1J1-08/D6J6-19]RF1/J H5 | ...P... | N... | ....... | ...D.. | ...T..H.. V | SSGWH- | ..A. |
| iPS:43 5211 | 21-225_94E11 | VH1J1-08/D6J6-19]RF1/J H5 | ....... | N... | ....... | ....... | ....... V | SSGWK- | ..... |

FIGURE 52 (Continued)

| | | | | | | | |
|---|---|---|---|---|---|---|---|
| iPS:43 5227 | 21-225_95G4 | VH1{1-08/D6[6-19]RF1/J H5 | . . . . . . | N . . . . | . . . . | T . . . H . . . V | SSGWN- |
| iPS:43 5245 | 21-225_95E12 | VH1{1-08/D6[6-19]RF1/J H5 | . . . . | N . . . . | . . . . | . . . . I . . . . | SSGWY- . . . . L |
| iPS:43 5247 | 21-225_96G1 | VH1{1-08/D6[6-19]RF1/J H5 | . . . . | N . . . . | . . H . . N . . | . . . . I . . . . | SSGWY- |
| iPS:43 5249 | 21-225_96E2 | VH1{1-08/D6[6-19]RF1/J H5 | . . . . | N . . . . | . . H . . . . | . . L . . . V | SSGWY- |
| iPS:43 5255 | 21-225_96D5 | VH1{1-08/D6[6-19]RF1/J H5 | . . . . | N . . . . | . . . . | S . T . . . H . . . V | SSGWS- |
| iPS:43 5279 | 21-225_97H4 | VH1{1-08/D6[6-19]RF1/J H5 | . . . . | N . . . . | . . H . . . . | . . . . I . . . . | SSGWY- |
| iPS:43 5327 | 21-225_147G6 | VH1{1-08/D6[6-19]RF1/J H5 | . . . . | N . . . . | . . H . . . . | . . . . Y . . . . | SSGWY- |
| iPS:43 5437 | 21-225_152F4 | VH1{1-08/D6[6-19]RF1/J H5 | . . . . | N . . . . | . . H . . D . . | . . . . Y . . . . | SSGWY- |
| iPS:43 5701 | 21-225_170F6 | VH1{1-08/D6[6-19]RF1/J H5 | . . . . | N . . . . | . . . D . . | . . . . H . . . . | SSGWY- |
| iPS:43 5737 | 21-225_174G5 | VH1{1-08/D6[6-19]RF1/J H5 | . . . . | N . . . . | . . H . . . . | . . . . A . . . . | SSGWY- |
| iPS:43 6544 | 21-225_224H5 | VH1{1-08/D6[6-19]RF1/J H5 | . . . . | N . . . . | . . . . | . . . . S . . . | SSGWN- |
| iPS:43 6570 | 21-225_225F4 | VH1{1-08/D6[6-19]RF1/J H5 | . . . . | N . . . . | . . H . . S . . | . . L . . . V . . N . . . S | SSGWY- |

| | | H_FR1 | H_CDR1 | H_FR2 | H_CDR2 | H_FR3 | H_CDR3 | H_FR4 |
|---|---|---|---|---|---|---|---|---|
| | Germline | QVQLVQS GGGVVQPGRSLR LSCAASG.FTFS | ...YGMH | WVRQAPGK GLEWVA | VIWYDGSNKYYAD SVKG | RFTISRDNSKNTLYLQM NSLRAEDTAVYYCAR | ...DYGMDV... | WGQGTT VTVSS |
| iPS:45 21-225_71A6 1139 | VH3-30.3/D5J5-18/RF3/J H4 | ...... | N......G.. | ...... | ......E.. | ...... | DHR..V...... ......RGG... | ...... |
| | Germline | QVQLVQS GGGVVQPGRSLR LSCAASG.FTFS | ...YGMH | WVRQAPGK GLEWVA | VIWYDGSNKYYAD SVKG | RFTISRDNSKNTLYLQM NSLRAEDTAVYYCAR | ...DYGMDV... | WGQGTT VTVSS |
| iPS:45 21-225_148E10 3445 | VH3-33/D4/4-23/RF2/J H6 | ...... | ...... | ...... | ....F... | ...... | .RVEG.GTP...... ....Y...... | ...... |
| iPS:43 21-225_195D9 6082 | VH3-33/D4/4-23/RF2/J H6 | ...... | H...V... | ...... | ....T... | ...... | .WF.EGN-...... | ...... |
| iPS:43 21-225_196A10 6118 | VH3-33/D4/4-23/RF2/J H6 | ...... | H...... | ...... | ....T... | ...... | .WF.EGN-...... | ...... |
| iPS:43 21-225_147D9 6670 | VH3-33/D4/4-23/RF2/J H6 | ...... | ...... | ...... | D..F.V. ...D... | ...... | .RVEG.GTP...... ....Y...... | ...... |
| iPS:43 21-225_151H6 6720 | VH3-33/D4/4-23/RF2/J H6 | ...... | D...... | ...... | ....L... | ...... | .DRSC.RTSC...... ..PYY....L... | ...I... |
| iPS:43 21-225_152G5 6726 | VH3-33/D4/4-23/RF2/J H6 | ...... | D...... | ...... | ....L... | ...... | .DRSC.RTSC...... ..FYY....L... | ...I... |

FIGURE 52 (Continued)

| | | | | | | | | | |
|---|---|---|---|---|---|---|---|---|---|
| iPS:43 6732 | 21-225_152B12 | VH3\|3-33\|D4\|4-23\|RF2\|JH6 | V........ | ........ | ........ | ........ | ........ | ........ | .DRSC.STSC...... ..PYY....L.. |
| iPS:43 6734 | 21-225_153A8 | VH3\|3-33\|D4\|4-23\|RF2\|JH6 | ........ | D....... | ........ | L....... | ........ | ........H.. | .DRSC.RTSC...... ..PYY....L.. |
| iPS:43 6736 | 21-225_153E8 | VH3\|3-33\|D4\|4-23\|RF2\|JH6 | M....... | D....... | ........ | ..F..V.. | ........ | ........ | .RVEG.GTP...... ...Y........ |
| iPS:43 6756 | 21-225_146A10 | VH3\|3-33\|D4\|4-23\|RF2\|JH6 | ....L... | N....... | ........ | ....D... | ........ | ........ | .RVFC.STSCL..... ...SYY....... |
| iPS:43 6766 | 21-225_158D10 | VH3\|3-33\|D4\|4-23\|RF2\|JH6 | E....... | G....... | MT...... | L.R..... .D.N.... | ........ | ........ | .RVSC.STSC...... ..PYY....... |
| iPS:43 6768 | 21-225_159H8 | VH3\|3-33\|D4\|4-23\|RF2\|JH6 | ........ | T....... | ........ | ........ | ........ | ........ | .RVSC.STSC...... ..PYY....... |
| iPS:43 6770 | 21-225_160B12 | VH3\|3-33\|D4\|4-23\|RF2\|JH6 | ........ | ........ | ........ | ........ | ...T..F. | ........ | .RVSC.STSC...... ..PYY....... |
| iPS:43 6782 | 21-225_166G11 | VH3\|3-33\|D4\|4-23\|RF2\|JH6 | ....N... | G....... | ........ | ........ | ...T.... | ........ | .DRYC.SPTCH..... ..PYY....L.. |
| iPS:43 6794 | 21-225_170F1 | VH3\|3-33\|D4\|4-23\|RF2\|JH6 | ........ | G......N | ........ | I....... N....... | ........ | ........ | .RVYC.STSCH..... ..PYY....A.. |
| iPS:43 6836 | 21-225_52H1 | VH3\|3-33\|D4\|4-23\|RF2\|JH6 | ........ | G....... | ........ | ........ | ...I.... | ........ | .RVSC.SSSCS..... ...YYY....... |
| iPS:43 6922 | 21-225_78E9 | VH3\|3-33\|D4\|4-23\|RF2\|JH6 | ........ | ........ | ........ | N..S.... | ........ | ........ | .RDYC.STSC...... ..PYY....... |
| iPS:43 6924 | 21-225_74B3 | VH3\|3-33\|D4\|4-23\|RF2\|JH6 | R....... | ........ | ........ | F...D... | ........ | ........ | .RDYC.STSC...... ..PYY....... |

FIGURE 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:43 6928 | 21-225_79E7 | VH3\|3-33\|D4\|4-23\|RF2\|JH6 | ........... | ........... | ........... | ........... | ........... | .RDYC.STSC...... ..PYY......... | ........... |
| iPS:43 6932 | 21-225_92A4 | VH3\|3-33\|D4\|4-23\|RF2\|JH6 | ........... | ........... | ........... | .N..S...... | ....Y...I...... | .RDYC.STSC...... ..PYY......... | ........... |
| iPS:43 6936 | 21-225_97E6 | VH3\|3-33\|D4\|4-23\|RF2\|JH6 | ........... | ........... | ........... | .N..S...... | ........I...... | .RDYC.STSC...... ..PYY......... | ........... |
| iPS:43 7190 | 21-225_225A9 | VH3\|3-33\|D4\|4-23\|RF2\|JH6 | ........G.. | T.......... | ....L...... | ........... | ........I..Q... | .NHYC.STSCS..... ..PYY..F...... | ........... |
| iPS:43 7254 | 21-225_149F2 | VH3\|3-33\|D4\|4-23\|RF2\|JH6 | ..G.A...... | R.......... | ........... | F.......... ..EN....... | ........V..R... | .RVEG.GTP....... ........Y..... | ........... |
| iPS:43 7256 | 21-225_150F11 | VH3\|3-33\|D4\|4-23\|RF2\|JH6 | ..G.A...... | R.......... | ........... | F.......... ..EN....... | ........V..R... | .RVEG.GTP....... ........Y..... | ........... |
| iPS:45 1110 | 21-225_74C9 | VH3\|3-33\|D4\|4-23\|RF2\|JH6 | ........... | ........... | ........... | .N..S...... | ........I...... | .RDYC.STSC...... ..PYY......... | ........... |
| iPS:39 2589 | 21-225_27H2 | VH3\|3-33\|D4\|4-23\|RF2\|JH6 | ........... | G.......... | ........... | ........... | ...........F... | .RVYC.STSCS..... ..PYY......... | ........... |
| iPS:39 3166 | 21-225_27G6 | VH3\|3-33\|D4\|4-23\|RF2\|JH6 | ........... | G.......... | ........... | I.......... ..K..N..... | ........... | .RVSC.STSCS..... ..PYY......... | ........... |
| iPS:39 3198 | 21-225_28A11 | VH3\|3-33\|D4\|4-23\|RF2\|JH6 | ........... | G.......... | .....L..... | L.......... ..N.T...... | ........... | .RVYC.STSCS..... ..PYY......... | ........... |
| iPS:39 3204 | 21-225_8C12 | VH3\|3-33\|D4\|4-23\|RF2\|JH6 | ........G.. | ........... | ........... | L.......... | ........... | .RVSC.SSSCY..... ..PYY......... | ........... |

| | | H_FR1 | H_CDR1 | H_FR2 | H_CDR2 | H_FR3 | H_CDR3 | H_FR4 |
|---|---|---|---|---|---|---|---|---|
| iPS:43 5665 | 21-225_169F2 | VH4\|4-59\|D7\|7-27\|RF1/JH4 | ........... | ........ | ....A.. | ..R.DT.....I | .M.I.....S.I.... | EG.VGA....TY... | ........ |
| iPS:43 5671 | 21-225_169H5 | VH4\|4-59\|D7\|7-27\|RF1/JH4 | ........... | ........ | ....A.. | ..R.DT.....I | .M.......S.I.... | EG.VGA....TY... | ........ |
| iPS:43 6354 | 21-225_210G10 | VH4\|4-59\|D7\|7-27\|RF1/JH4 | .......N..........R | ........ | ....A.. | ..R.T......D | .I.M............ | GF.D......W.... | ........ |
| | Germline | VH4\|4-34\|D4\|4-17\|RF2/JH6 | QVQLQQW...GAGLLKPSETLSLTCAVYG.GSFS | G...YWS | WIRQPPGKGLEWIG | EINHSGSTNYNPSLKS | RVTISVDTSKNQFSLKLSSVTAADTAVYYCAR | DIGDIYYYYGMDV | WGQGTTVTVSS |
| iPS:46 8810 | 21-225_74D5 | VH4\|4-34\|D4\|4-17\|RF2/JH6 | ....N...P.......... | ....C... | ........ | ....Y....R..F. | ................ | ....G........... | ........ |
| iPS:46 8832 | 21-225_76H10 | VH4\|4-34\|D4\|4-17\|RF2/JH6 | ....N...P.......... | ....C... | ........ | ....Y....R..F. | ................ | ....G........... | ........ |
| iPS:46 8834 | 21-225_94G10 | VH4\|4-34\|D4\|4-17\|RF2/JH6 | ....N...P.......... | ....C... | ....G... | ....Y....R..F. | ................ | ....G........... | ........ |
| iPS:46 8838 | 21-225_80E12 | VH4\|4-34\|D4\|4-17\|RF2/JH6 | ....N...P.......... | ....C... | ........ | ....Y....R..F. | ................ | ....G........... | ........ |
| iPS:46 8820 | 21-225_76E10 | VH4\|4-34\|D4\|4-17\|RF2/JH6 | ....N...P.......... | ....S... | ........ | ........R...... | ................ | ....G........... | ........ |
| iPS:43 4473 | 21-225_76D1 | VH4\|4-34\|D4\|4-17\|RF2/JH6 | ....S...P.......... | ....C... | ........ | ..........T.. | .T.......S..... | ....G........... | ........ |
| iPS:43 4495 | 21-225_74B2 | VH4\|4-34\|D4\|4-17\|RF2/JH6 | ........P.......... | ....P... | ........ | ............ | ................ | ....G.........L.. | ........ |

| | | | | | | | |
|---|---|---|---|---|---|---|---|
| iPS:43 4725 | 21-225_80H7 | VH4|4-34|D4|4-17|RF2|J H6 | . . . . . | . . . . . . . . . | . S . . . . | . . Q . . . . . R . . . | . . . . . . . . . | . . G . . . . . . . I . . . | . . . . |
| iPS:43 4743 | 21-225_74A4 | VH4|4-34|D4|4-17|RF2|J H6 | . . V . . . | . . H . . . . . . | . C . . . . | . . . . . . . . . | . . . . . . . . . | . . G . . . . . . . . . . | . . . . |
| iPS:43 4751 | 21-225_80H12 | VH4|4-34|D4|4-17|RF2|J H6 | . . . . . | . . H . . . . . . | . C . . . . | . . . . . . . . . | . . . . . . . . . | . . G . . . . . . . . . . | . . . . |
| iPS:43 4759 | 21-225_81C5 | VH4|4-34|D4|4-17|RF2|J H6 | . . . . . | . . H . . . . . . | . C . . . . | . . . . . . . . . | . . . . . . . . . | . . G . . . . . . . I . . . | . . . . |
| iPS:43 4773 | 21-225_75D9 | VH4|4-34|D4|4-17|RF2|J H6 | . . . . . | . . . . . . . . . | . P . . . . | . . Y . . . . . R . . . | . . N . . . . . . | . . G . . . . . . . . . . | . . . . |
| iPS:43 4777 | 21-225_81C11 | VH4|4-34|D4|4-17|RF2|J H6 | . . . . . | . . H . . . . . . | . C . . . . | . . . . . . . . . | . . . . . . . . . | . . G . . . . . . . . . . | . . . . |
| iPS:43 4809 | 21-225_74F5 | VH4|4-34|D4|4-17|RF2|J H6 | . . . . . | . . H . . . . . . | . C . . . . | . . . . . . . . . | . . . . . . . . . | . . G . . . . . . . . . . | . . . . |
| iPS:43 4821 | 21-225_83G1 | VH4|4-34|D4|4-17|RF2|J H6 | . . . . . | . . . . . . . . . | . C . . . . | . . . . . . . . . | . . . . . . . . . | . . G . . . . . . . . . . | . . . . |
| iPS:43 4839 | 21-225_83B7 | VH4|4-34|D4|4-17|RF2|J H6 | . . . . . | . . . . . . . . . | . C . . . . | . . . . . . . . . | . . . . . . . . . | . . G . . . . . . . . . . | . . . . |
| iPS:43 4869 | 21-225_84E12 | VH4|4-34|D4|4-17|RF2|J H6 | . . . . . | . . . . . . . . . | . S . . . . | . . Q . . . . . R . . . | . . . . . . . . . | . . G . . . . . . . . . . | . . . . |
| iPS:43 4879 | 21-225_85A3 | VH4|4-34|D4|4-17|RF2|J H6 | . . . . . | . . . . . . . . . | . C . . . . | . . . . . . . . . | . . . . . . . . . | . . G . . . . . . . I . . . | . . . . |
| iPS:43 4881 | 21-225_85B4 | VH4|4-34|D4|4-17|RF2|J H6 | . . . . . | . . H . . . . . . | . C . . . . | . . . . . . . . . | . . . . . . . . . | . . G . . . . . . . . . . | . . . . |

FIGURE 52 (Continued)

| | | | | | | | |
|---|---|---|---|---|---|---|---|
| iPS:43 4887 | 21-225_85D6 | VH4|4-34/D4|4-17|RF2/JH6 | .........G....P | .........C | .........Y | | .........G------ |
| iPS:43 4895 | 21-225_74H7 | VH4|4-34/D4|4-17|RF2/JH6 | .........P | .........P | .........R | | .........G------ .........L.. |
| iPS:43 4899 | 21-225_85B9 | VH4|4-34/D4|4-17|RF2/JH6 | ...N..P | .........C | .........R..F | | .........G------ |
| iPS:43 4907 | 21-225_85G10 | VH4|4-34/D4|4-17|RF2/JH6 | .........R | .........C | .........I | .........T | .........G------ |
| iPS:43 4913 | 21-225_86C1 | VH4|4-34/D4|4-17|RF2/JH6 | .........H | .........C | | .........T | .........G------ |
| iPS:43 4921 | 21-225_86E4 | VH4|4-34/D4|4-17|RF2/JH6 | .........H | .........C | | | .........G------ .........L.. |
| iPS:43 4939 | 21-225_86C11 | VH4|4-34/D4|4-17|RF2/JH6 | .........H | .........C | | | .........G------ |
| iPS:43 4943 | 21-225_87H1 | VH4|4-34/D4|4-17|RF2/JH6 | .........P | .........C | .........R | .........D | .........G------ |
| iPS:43 4945 | 21-225_87E5 | VH4|4-34/D4|4-17|RF2/JH6 | | .........C | | | .........G------ |
| iPS:43 4955 | 21-225_87C9 | VH4|4-34/D4|4-17|RF2/JH6 | .........H | .........C | | | .........G------ |
| iPS:43 4961 | 21-225_87A12 | VH4|4-34/D4|4-17|RF2/JH6 | .........H | .........C | | | .........G------ |
| iPS:43 4969 | 21-225_88H1 | VH4|4-34/D4|4-17|RF2/JH6 | .........H | .........C | | | .........G------ |

FIGURE 52 (Continued)

| | | | | | | | | |
|---|---|---|---|---|---|---|---|---|
| iPS:43 4981 | 21-225_88E7 | VH4/4-34/D4/4-17/JRF2/JH6 | ....H..... | ...C..... | ........ | ........ | ..G----- | ... |
| iPS:43 4983 | 21-225_88F7 | VH4/4-34/D4/4-17/JRF2/JH6 | ....H..... | ...C..... | ........ | ........ | ..G----- | ... |
| iPS:43 4995 | 21-225_88G9 | VH4/4-34/D4/4-17/JRF2/JH6 | ........ | ...C..... | ........ | ........ | ..G----- | ... |
| iPS:43 4999 | 21-225_75A8 | VH4/4-34/D4/4-17/JRF2/JH6 | ....H..... | ...C..... | ........ | ........ | ..G----- | ... |
| iPS:43 5013 | 21-225_89D5 | VH4/4-34/D4/4-17/JRF2/JH6 | ........ | ...C..... | ........ | ........ | ..G----- | ... |
| iPS:43 5015 | 21-225_89H5 | VH4/4-34/D4/4-17/JRF2/JH6 | ........ | ...C..... | ....Y...F. | .....A.... | ..G----- | ... |
| iPS:43 5025 | 21-225_89E10 | VH4/4-34/D4/4-17/JRF2/JH6 | ....P..... | ...C..... | ....R..S.. | ........ | ..G----- | ... |
| iPS:43 5029 | 21-225_89A11 | VH4/4-34/D4/4-17/JRF2/JH6 | ........ | ...C..... | ........ | ........ | ..G----- | ... |
| iPS:43 5039 | 21-225_90G4 | VH4/4-34/D4/4-17/JRF2/JH6 | ....H..... | ...C..... | ........ | ........ | ..G----- | ... |
| iPS:43 5041 | 21-225_90A5 | VH4/4-34/D4/4-17/JRF2/JH6 | ....H..... | ...C..... | ........ | ........ | ..G----- L | ... |
| iPS:43 5043 | 21-225_90G5 | VH4/4-34/D4/4-17/JRF2/JH6 | ....H..... | ...C..... | ........ | ........ | ..G----- | ... |
| iPS:43 5055 | 21-225_90F10 | VH4/4-34/D4/4-17/JRF2/JH6 | ....H..... | ...C..... | ........ | ........ | ..G----- | ... |

| | Germline | H_FR1 | H_CDR1 | H_FR2 | H_CDR2 | H_FR3 | H_CDR3 | H_FR4 |
|---|---|---|---|---|---|---|---|---|
| VH3|3-33|D4|4-17|RF2|H6 | | QVQLVES GGGVQPGGSL RLSCAASG FTFS | S | WVRQAPG KGLVA | VIKD SGSYR YSPKS | RFTISRDNSKNTLYLQM NSLRAEDTAVYYCAR | DYIGDYY YYYGMDV | WGQGTT VTVSS |
| iPS:46 8814 21-225_223D11 | VH3|3-33|D4|4-17|RF2|H6 | . . . . . . . . . . . . . . . . . . . . . . . . . . . . . . . | N . . . . . . . . . D | . . . . . . . . . . | . . . D . . . . . | . . . . . . . . . . . . . . . . . . . . . . . . . . . . . . . F . . . | .R.IG.- ND... | . . . . . . . . . . |
| iPS:43 4621 21-225_74D1 | VH3|3-33|D4|4-17|RF2|H6 | . . . . . . . . . . . . . . . . . . . . . . . . . . . . . . . | . . . . . . . . . . | . . . . . . . . . . | . . . . H . . . . | . . . . . . . . . . . . . . . . . . . . M . . . . . . . . . . . . . . | .E.FGEFD .....Y.N. | . . . . . . . . . . |
| iPS:43 4947 21-225_87B7 | VH3|3-33|D4|4-17|RF2|H6 | . . . . . . . . . . . . . . . . . . . . . . . . . . . . . . . | . . . . . . . . . . | . . . . . . . . . . | . . . . N . . . . | . . . . . . . . . . . . . . . . . . . . . . . . . . . . . . . . . . | .F.VG.- | . . . . . . . . . . |
| iPS:43 5819 21-225_190C11 | VH3|3-33|D4|4-17|RF2|H6 | . . . . . . . . . . . . . . . . . . . . . . . . . . . . . . . | . . . . . . . . . . | . . . . . . . . . . | . . . . N . . . . | . . . . . . . . . . . . . . . . . . . . . . . . . . . . . . . . . . | .Q.VG.- D.L.. | . . . . . . . . . . |
| iPS:43 5825 21-225_190G11 | VH3|3-33|D4|4-17|RF2|H6 | . . . . . . . . . . . . . . . . . . . . . . . . . . . . . . . | I . . . . . . . . . | . . . . . . . . . . | . . . . N . . . . | . . . . . . . . . . . . . . . . . . . . . . . . . . . . . . . . . . | .Q.VG.- D.L.. | . . . . . . . . . . |
| iPS:43 5837 21-225_198G3 | VH3|3-33|D4|4-17|RF2|H6 | . . . . . . . . . . . . . K . . . . . . . . . . . . . . . . . | T . . . . . . . . . | . . . . . . . . . . | . . T.N . . . . | . . . . . . . . . . . . . . . . . . . . . . . . . . . . C . . . . . | .Q.VG.- D.L.. | . . . . . . . . . . |
| iPS:43 5845 21-225_191G1 | VH3|3-33|D4|4-17|RF2|H6 | . . . . . . . . . . . . . . . . . . . . . . . . . . . . . . . | . . . . . . . . . . | . . . . . . . . . . | . . . . EH . . . | . . . . . . . . . . . . . . . . . . . . . . . . . . . . . . . . . . | .R.VG.- ..L.. | . . . . . . . . . . |
| iPS:43 5859 21-225_190E6 | VH3|3-33|D4|4-17|RF2|H6 | . . . . . . . . . . . . . . . . . . . . . . . . . . . . . . . | . . . . . . . . . . | . . . . . . . . . . | . . . . N . . . . | . . . . . . . . . . . . . . . . . . . . . . . . . . . . . . . . . . | .Q.VG.- D.L.. | . . . . . . . . . . |
| iPS:43 5873 21-225_190G4 | VH3|3-33|D4|4-17|RF2|H6 | . . . . . . . . . . . . . . . . . . . . . . . . . . . . . . . | . . . . . . . . . . | . . . . . . . . . . | . . . . N . . . . | . . . . . . . . . . . . . . . . . . . . M . . . . . . . . . . . . . | .Q.VG.- D.L.. | . . . . S . . . . . |
| iPS:43 5933 21-225_190F8 | VH3|3-33|D4|4-17|RF2|H6 | . . . . . . . . . . . . . . . . . . . . . . . . . . . . . . . | T . . . . . . . . . | . . . . . . . . . . | . . . . N . . . . | . . . . . . . . . . . . . . . . . . . . . . . . . . . . . . . . . . | .Q.VG.- D.L.. | . . . . . . . . . . |

FIGURE 52 (Continued)

| | | | | | | | | |
|---|---|---|---|---|---|---|---|---|
| iPS:43 5941 | 21- 225_191E8 | VH3|3- 33/D4|4- 17|RF2/J H6 | ........ | N........ | ........ I..F.. ...Q.. | ........ L........ | AR.V..- ...A... | ........ S....... |
| iPS:43 5945 | 21- 225_191A10 | VH3|3- 33/D4|4- 17|RF2/J H6 | ........ | ........ | ........ ..N..... | ........ ...M.... | .Q.VG..- ..D.L... | ........ S....... |
| iPS:43 5947 | 21- 225_191E10 | VH3|3- 33/D4|4- 17|RF2/J H6 | ........ | ........ | ........ ..N..... | ........ ...M.... | .Q.VG..- ..D.L... | ........ ........ |
| iPS:43 5957 | 21- 225_191G12 | VH3|3- 33/D4|4- 17|RF2/J H6 | ........ | ........ | ........ ..N..... | ........ ........ | .Q.VG..- ..D.L... | ........ ........ |
| iPS:43 5963 | 21- 225_192D2 | VH3|3- 33/D4|4- 17|RF2/J H6 | ........ | ........ | ........ ..N..... | ........ .E...M.. | R.VG..- ........ | ........ ........ |
| iPS:43 5971 | 21- 225_192D3 | VH3|3- 33/D4|4- 17|RF2/J H6 | ........ | ........ | ........ ..EH.... | ........ ........ | R.VG..- ...L... | ........ ........ |
| iPS:43 5979 | 21- 225_192H4 | VH3|3- 33/D4|4- 17|RF2/J H6 | ........ | ........ | .L...... .T..N... | ........ ........ | .Q.VG..- ........ | ........ ........ |
| iPS:43 5987 | 21- 225_192G6 | VH3|3- 33/D4|4- 17|RF2/J H6 | ........ | ........ | ........ ..EH.... | .M...... ........ | R.VG..- ..D.L... | ........ ........ |
| iPS:43 5993 | 21- 225_192C8 | VH3|3- 33/D4|4- 17|RF2/J H6 | ........ | ........ | ........ ..N..... | ........ ........ | .Q.VG..- ........ | ........ ........ |
| iPS:43 5997 | 21- 225_192G8 | VH3|3- 33/D4|4- 17|RF2/J H6 | ........ | ........ | ........ ........ | ........ ...M.... | .Q.VG..- ..D.L... | ........ S....... |
| iPS:43 6005 | 21- 225_192H10 | VH3|3- 33/D4|4- 17|RF2/J H6 | ........ | ........ | ........ ..N..... | ........ ........ | .Q.VG..- ..D.L... | ........ ........ |
| iPS:43 6031 | 21- 225_193C7 | VH3|3- 33/D4|4- 17|RF2/J H6 | ........ | ........ | ........ ..N..... | ........ ...M.... | .Q.VG..- ..D.L... | ........ S....... |

FIGURE 52 (Continued)

| | | | | | | | | |
|---|---|---|---|---|---|---|---|---|
| iPS:43_6045 | 21-225_193A10 | VH3\|3-33\|D4\|4-17\|RF2\|JH6 | | | ..EH.. | | | R.VG.- ..... |
| iPS:43_6076 | 21-225_194H11 | VH3\|3-33\|D4\|4-17\|RF2\|JH6 | | | ..EH.. | ...S... | | R.VG.- ..L.. |
| iPS:43_6086 | 21-225_191G10 | VH3\|3-33\|D4\|4-17\|RF2\|JH6 | | ...Q... | ...N.. | | | Q.VG.- D.L.. |
| iPS:43_6090 | 21-225_195A9 | VH3\|3-33\|D4\|4-17\|RF2\|JH6 | | | ..EH.. | | | R.VG.- ..L.. |
| iPS:43_6112 | 21-225_196C7 | VH3\|3-33\|D4\|4-17\|RF2\|JH6 | | | ..EH.. | | | R.VG.- ..L.. |
| iPS:43_6138 | 21-225_197F2 | VH3\|3-33\|D4\|4-17\|RF2\|JH6 | | | ...N.. | ...M... | ...S | Q.VG.- ..... |
| iPS:43_6152 | 21-225_197B6 | VH3\|3-33\|D4\|4-17\|RF2\|JH6 | | | ...N.. | ...M... | | Q.VG.- D.L.. |
| iPS:43_6173 | 21-225_197G12 | VH3\|3-33\|D4\|4-17\|RF2\|JH6 | ...N.. | | ...H.. | | | Q.VG.- D.L.. |
| iPS:43_6189 | 21-225_198B6 | VH3\|3-33\|D4\|4-17\|RF2\|JH6 | | | ...N.. | | | Q.VG.- ..... |
| iPS:43_6201 | 21-225_199C5 | VH3\|3-33\|D4\|4-17\|RF2\|JH6 | | | I.F..Q | ...L... | | AH.V.. ..A.. |
| iPS:43_6203 | 21-225_199A6 | VH3\|3-33\|D4\|4-17\|RF2\|JH6 | | | ...N.. | | | R.VG.- ..... |
| iPS:43_6282 | 21-225_204G6 | VH3\|3-33\|D4\|4-17\|RF2\|JH6 | ...T.. | | | | | ..... D.... |

FIGURE 52 (Continued)

| | | | | | | | | |
|---|---|---|---|---|---|---|---|---|
| iPS:43-6296 | 21-225_205F5 | VH3|3-33|D4|4-17|RF2|JH6 | | | R...... | ....EN.V. | ....TD...... | ...T.KM.F... | M.IG.- |
| iPS:43-6324 | 21-225_207G6 | VH3|3-33|D4|4-17|RF2|JH6 | | | | ....N..E | | | A.IG.- .I.. |
| iPS:43-6364 | 21-225_211A11 | VH3|3-33|D4|4-17|RF2|JH6 | ....G | | | L.F. .RM | | | R.VG.- .T.. |
| iPS:43-6372 | 21-225_211A8 | VH3|3-33|D4|4-17|RF2|JH6 | | | | ..EH | | ...K..... | H.VG.- |
| iPS:43-6376 | 21-225_212E6 | VH3|3-33|D4|4-17|RF2|JH6 | | | | ...N.V. | | | ..VG.- .T.. |
| iPS:43-6378 | 21-225_212D7 | VH3|3-33|D4|4-17|RF2|JH6 | | | | ...N. | ....S.... | ...K..... | ..VG.- .T.. |
| iPS:43-6380 | 21-225_212H9 | VH3|3-33|D4|4-17|RF2|JH6 | | R...... | | ..EH | | | H.VG.- |
| iPS:43-6384 | 21-225_212F10 | VH3|3-33|D4|4-17|RF2|JH6 | | | | ...H. | ...G... | | R.VG.- ..N..... |
| iPS:43-6390 | 21-225_213D2 | VH3|3-33|D4|4-17|RF2|JH6 | | | | ...N. | | ....S.... | ...VG.- .T.. |
| iPS:43-6394 | 21-225_213C4 | VH3|3-33|D4|4-17|RF2|JH6 | ..T. | | | ...H. | | | ..VG.- ..D..... |
| iPS:43-6398 | 21-225_213B8 | VH3|3-33|D4|4-17|RF2|JH6 | | | | ...H. | | | ..VG.- .T.. |
| iPS:43-6404 | 21-225_214C3 | VH3|3-33|D4|4-17|RF2|JH6 | ....E | | | ...N.G. | | | R.VG.- ..D.. |

FIGURE 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:43 6410 | 21-225_212E10 | VH3J3-33|D4|4-17|RF2|J H6 | ................. | ..... | ..... | ............ | ...... | ...VG.- ..T.. | ..... |
| iPS:43 6420 | 21-225_215B5 | VH3J3-33|D4|4-17|RF2|J H6 | ................. | ..... | ..... | ......N..... | ...S.. | ...VG.- ..T.. | ..... |
| iPS:43 6422 | 21-225_215D6 | VH3J3-33|D4|4-17|RF2|J H6 | ................. | ..... | ..... | ......N..... | ...... | .C.VG.- ..T.. | ..... |
| iPS:43 6430 | 21-225_215A12 | VH3J3-33|D4|4-17|RF2|J H6 | ........L........ | ..... | ..... | .........EH. | ...... | .R.VG.- ..... | ..... |
| iPS:43 6452 | 21-225_217G5 | VH3J3-33|D4|4-17|RF2|J H6 | ................. | R.... | ..... | ......N..... | ...G.. | ...VG.- ..L.. | ..... |
| iPS:43 6464 | 21-225_219H1 | VH3J3-33|D4|4-17|RF2|J H6 | ................. | ..... | ..... | .........H.. | ...... | .R.VG.- ..N... | ..... |
| iPS:45 1120 | 21-225_197D3 | VH3J3-33|D4|4-17|RF2|J H6 | ........I........ | H.... | ..... | .........EH. | ...... | .Q.VG.- ..... | ..... |
| VH3J3-33|D4|4-17|RF2|JH4 | Germline | H_FR1 QVQLVES GGGVQPGRSLR LSCAASGFTFS | H_CDR1 SYGMH | H_FR2 WVRQAPGK GLEWVA | H_CDR2 VIWYD GSNKYYA DSVKG | H_FR3 RFTISRDNSKNTLYLQM NSLRAEDTAVYYCAR | H_CDR3 DYGDY | H_FR4 WGQGTL VTVSS |
| iPS:46 8822 | 21-225_147E10 | VH3J3-33|D4|4-17|RF2|J H4 | ........K........ | M.....L | ..... | ...I......... | ...... | .HY.FW. ....SGH.. | ..... |
| iPS:43 3965 | 21-225_46F2 | VH3J3-33|D4|4-17|RF2|J H4 | ................. | ..... | ..... | ...I......... | ...... | .RY.FW. .....SG.. | ..... |
| iPS:43 4255 | 21-225_62E6 | VH3J3-33|D4|4-17|RF2|J H4 | ................. | ..... | ..... | A.........G. | V.....S.H.. | .Q.IVG. .....ATW. | ..... |

FIGURE 52 (Continued)

| | | | | | | | | |
|---|---|---|---|---|---|---|---|---|
| iPS:43 4269 | 21-225_57H3 | VH3|3-33|D4|4-17|RF2|JH4 | . . . . . | . . . . . | . . . . . | . . . . . | . . . . . | .IVG. . . . .AT. . . . |
| iPS:43 4345 | 21-225_64H9 | VH3|3-33|D4|4-17|RF2|JH4 | . . . . . | .T. . . | . . . . . | . . . . . | . . . . . | .TY.FW. . .SG.LG. |
| iPS:43 4363 | 21-225_65A6 | VH3|3-33|D4|4-17|RF2|JH4 | . . . . . | .N. . . | . . . . . | .I. . . .G | . . . . . | .Q.IVG. . . .ATW. . . |
| iPS:43 4393 | 21-225_67C3 | VH3|3-33|D4|4-17|RF2|JH4 | . . . . . | . . . . . | . . . . . | .A. . . .G | .V. . . . .S.H. | .Q.IVG. . . .ATW. . . |
| iPS:43 4425 | 21-225_70A5 | VH3|3-33|D4|4-17|RF2|JH4 | . . . . . | . . . . . | . . . . . | . . . . . | . . .S. . . .S. | .Q.IVG. . . .ATW. . . |
| iPS:43 5341 | 21-225_148B2 | VH3|3-33|D4|4-17|RF2|JH4 | . . . . . | . . . . . | . . . . . | .I. .Y . . | . . .S. | .HF.FW. . .SGH. . . |
| iPS:43 5357 | 21-225_148G10 | VH3|3-33|D4|4-17|RF2|JH4 | . . . . . | . . . . . | . . . . . | .I. .Y . . | . . .S. | .RY.FW. . .SGH. . . |
| iPS:43 5365 | 21-225_149F1 | VH3|3-33|D4|4-17|RF2|JH4 | . . . . . | . . . . . | . . . . . | .I. . . . | . . . . . | .HF.FW. . .SGH. . . |
| iPS:43 5413 | 21-225_150B11 | VH3|3-33|D4|4-17|RF2|JH4 | . . . . . | .M. . . | . . . . . | .I. . . . | . . . . . | .RY.FW. . .SGH. . . |
| iPS:43 5423 | 21-225_151G5 | VH3|3-33|D4|4-17|RF2|JH4 | . . . . . | . . .I. | . . . . . | .I. .L . . | . . . . . | .RY.FW. . .SGH. . . |
| iPS:43 5429 | 21-225_151A10 | VH3|3-33|D4|4-17|RF2|JH4 | . . . . . | .N. . . | . . . . . | .I. . . . | . . . . . | .RY.FW. . .SGH. . . |
| iPS:43 5489 | 21-225_155A5 | VH3|3-33|D4|4-17|RF2|JH4 | . . . .D | . . . . . | . . . . . | .I. .S . . | . . . .H. | .RY.FW. . .SGH. . . |

FIGURE 52 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| iPS:43 5683 | 21-225_170A1 | VH3\|3-33\|D4\|4-17\|RF2\|JH4 | | | | ..I.....Y.. | | .AH.FW.......SG....S | ....A. |
| iPS:43 5755 | 21-225_176H4 | VH3\|3-33\|D4\|4-17\|RF2\|JH4 | | | | ..I.....Y.. | ..S...... | .AH.FW......SG..A. | |
| iPS:43 5795 | 21-225_181C2 | VH3\|3-33\|D4\|4-17\|RF2\|JH4 | ...........V...... | | ....T... | ..I.....Y.. | | .HY.FW......SGH..F | |
| iPS:43 5807 | 21-225_181C10 | VH3\|3-33\|D4\|4-17\|RF2\|JH4 | | | ....M.... | ..I.....Y.. | | .HY.FW......SGH... | |
| iPS:43 5887 | 21-225_186F7 | VH3\|3-33\|D4\|4-17\|RF2\|JH4 | | ..T...... | | ..I.....Y.. | | .HY.FW......SGH... | |
| iPS:43 5901 | 21-225_189G2 | VH3\|3-33\|D4\|4-17\|RF2\|JH4 | | ..N...... | | ..I.....Y.. | | .RF.FW......SG..S. | |
| iPS:43 6594 | 21-225_226A5 | VH3\|3-33\|D4\|4-17\|RF2\|JH4 | | ..N...... | | ..I..T....T | | .EGH.FW......SGF..C | |
| iPS:39 2814 | 21-225_22A1 | VH3\|3-33\|D4\|4-17\|RF2\|JH4 | | | | ..M...... | | .G.FL......EWL... | |
| iPS:39 3036 | 21-225_28G3 | VH3\|3-33\|D4\|4-17\|RF2\|JH4 | ...........I... | ..T...... | | | | .RY.FW......SG... | |
| VH3\|3-33\|D7\|7-27\|RF1\|JH4 | | | CVQLVES GGGVQPGGSLR LSCAASG-FTFS | VGMH | WVRQAPGK GLEWVA | GSNKYIAD SVKG | RFTISRDNSKNTLYLQM NSLRAEDTAVYYCAR | LTGY ---FDY | WGQGTL VTVSS |
| iPS:46 8824 | 21-225_73G6 | VH3\|3-33\|D7\|7-27\|RF1\|JH4 | | | | ..V......G. | | .EV.M........TS... | |

FIGURE 52 (Continued)

| | | | | | | | | | |
|---|---|---|---|---|---|---|---|---|---|
| iPS:43 4169 | 21-225_50C4 | VH3j3-33jD7j7-27jRF1jJH4 | . . . . . . . . . . | D . . . . . . . . | . . . . . . . . . | . . . . E . . . . | . . . . . . . . . | . . . . . G . . . | EV.F . . . . . . . LN . . . | . . . . . . . . . I . . . . . |
| iPS:43 5045 | 21-225_90H5 | VH3j3-33jD7j7-27jRF1jJH4 | . . . . . . . . . . | D . . . . . . . . | . . . S . . . . . | . . . . ET . . . | . . . . . . . . . | . . . . . . . . . | EM.W . . . . . . . LD . . . | . . . . . . . . . . . . . . |
| iPS:43 5367 | 21-225_149G1 | VH3j3-33jD7j7-27jRF1jJH4 | . . . . . . . . . . | D . . . . . . . . | . . . . . . . . . | . . . . . T . . . | . . . . M . . . . | . . . . . V . . . | EI.F . . . . . . . SE . . . | . . . . . . . . . . . . . . |
| iPS:43 5397 | 21-225_149F12 | VH3j3-33jD7j7-27jRF1jJH4 | . . . . . . . . . . | D . . . . . . . . | . . . . . . . . . | . . . . EN . . . | . . . . F . . . . | . . . . . . . . . | EI.F . . . . . . . SE . . . | . . . . . . . . . . . . . . |
| iPS:43 5407 | 21-225_150E7 | VH3j3-33jD7j7-27jRF1jJH4 | . . . . . . . . . . | D . . . . . . . . | . . . . . . . . . | . . . . EN . . . | . . . . . . . . . | . . . . . . . . . | EI.F . . . . . . . SE . . . | . . . . . . . . . . . . . . |
| iPS:43 5609 | 21-225_161F7 | VH3j3-33jD7j7-27jRF1jJH4 | . . . . . . . . . . | D . . . . F.L . . | . . . . . . Q . . | . . . . . F . . . | . . . . F . . . . | . . . . . F . . . | EI.W . . . . . . . LS . . . | . . . . . . . . . . . . . . |
| iPS:43 5613 | 21-225_161D11 | VH3j3-33jD7j7-27jRF1jJH4 | . . . . . . . . . . | D . . . . F.L . . | . . . . . . Q . . | . . . . . F . . . | . . . . F . . . . | . . . . . F . . . | EI.W . . . . . . . LS . . . | . . . . . . . . . . . . . . |
| iPS:43 5791 | 21-225_180H7 | VH3j3-33jD7j7-27jRF1jJH4 | . . . . . . . . . . | D . . . . . . . . | . . . . . . . . . | . . . . . . . . . | . . . . . . . . . | . . . . . V . . . | EV.W . . . . . . . SD . . . | . . . . . . . . . . . . . . |
| iPS:43 5805 | 21-225_181A8 | VH3j3-33jD7j7-27jRF1jJH4 | . . . . . . . . . . | D . . . . . . . . | . . . . . . . . . | . . . . EN . . H . . . A . . | . . . . . . . . . | . . . . . . . . . | EV.W . . . . . . . SD . . . | . . . . . . . . . . . . . . |
| iPS:43 5879 | 21-225_184H10 | VH3j3-33jD7j7-27jRF1jJH4 | . . . . . . . . . . | D . . . . . . A . | . . . . . . . . . | . . . . EN . . H . . . A . . | . . . . . . . . . | . . . . . D . . . | EV.W . . . . . . . HD . . . | . . . . . . . . . . . . . . |
| iPS:43 5881 | 21-225_184D11 | VH3j3-33jD7j7-27jRF1jJH4 | . . . . . . . . . . | D . . . . . . . . | . . . . . . . . . | . . . . ET . . H . G . | . . . . . . . . . | . . . . . D . . . | EV.W . . . . . . . HD . . . | . . . . . . . . . . . . . . |
| iPS:43 6350 | 21-225_210E4 | VH3j3-33jD7j7-27jRF1jJH4 | . . . . . . . LI . | N . . . . . . . . | . . . . . . . . . | . . . . EN . . . | . . . . . V . . . | . . . . . D . S . | E.F . . . . . . . LS . . . | . . . . . . . . . . . . . . |

FIGURE 52 (Continued)

| | | | | | | | | | | |
|---|---|---|---|---|---|---|---|---|---|---|
| iPS:43 6576 | 21-225_225B6 | VH3|3-33|D7|7-27|RF1|J H4 | .R...... | ........ | D....... | ........ | EN...... | ........ | ........ | EV.F......TE... | ........ |
| iPS:43 6578 | 21-225_225D6 | VH3|3-33|D7|7-27|RF1|J H4 | ........ | ........ | N....... | ........ | EN....V. | ....T... | ......Q. | EV.F......TE... | ........ |
| iPS:43 6582 | 21-225_225F8 | VH3|3-33|D7|7-27|RF1|J H4 | ........ | ........ | ........ | ........ | EN....V. | ........ | ........ | EV.F......TE... | ........ |
| iPS:43 6608 | 21-225_226A9 | VH3|3-33|D7|7-27|RF1|J H4 | ........ | ........ | N....... | ........ | E.....T. | ........ | ....F... | EV.F......TE... | ........ |
| iPS:43 6630 | 21-225_227G3 | VH3|3-33|D7|7-27|RF1|J H4 | ........ | ........ | ........ | ........ | ....V... | ....S... | ........ | EV.F......TE... | ........ |
| iPS:43 6634 | 21-225_227H5 | VH3|3-33|D7|7-27|RF1|J H4 | ........ | ........ | ........ | ..D..... | ..E..... | ........ | ....M... | EV.F......TE... | ........ |
| iPS:43 6650 | 21-225_227C12 | VH3|3-33|D7|7-27|RF1|J H4 | ........ | ....K... | N....... | ........ | ..I..Q.. | ....S... | ........ | EV.F......TE... | ........ |
| iPS:43 7280 | 21-225_203C10 | VH3|3-33|D7|7-27|RF1|J H4 | ........ | ........ | D....... | ........ | .G.TH.T. | ........ | ........ | EV.W......LD... | ........ |
| iPS:39 2740 | 21-225_18H12 | VH3|3-33|D7|7-27|RF1|J H4 | ........ | ........ | D....... | ..M..... | VT...... | ........ | ........ | EV.W......YE... | ........ |
| iPS:39 2780 | 21-225_22B7 | VH3|3-33|D7|7-27|RF1|J H4 | ........ | ........ | ........ | ........ | EN.Q.... | ........ | ..E..... | EV.F......RS... | ........ |
| iPS:39 2912 | 21-225_25A9 | VH3|3-33|D7|7-27|RF1|J H4 | ........ | ........ | ........ | ........ | VT....TG | ........ | ........ | EI.W......LD... | ........ |
| iPS:39 2940 | 21-225_29D9 | VH3|3-33|D7|7-27|RF1|J H4 | ........ | ..K...S. | D...I... | ........ | E.N..... | ........ | ........ | EI.W......LD... | .....Q.. |

FIGURE 52 (Continued)

| | | | | | | | | |
|---|---|---|---|---|---|---|---|---|
| iPS:39 2948 | 21-225_25G5 | VH3|3-33/D7|7-27|RF1/JH4 | ......... | D........ | ........ | ....N... | .......... | EI.W......LD... |
| iPS:39 2978 | 21-225_28B8 | VH3|3-33/D7|7-27|RF1/JH4 | ......... | D........ | ......T. | AN...... | ....F....V... | EI.W......LD... |
| iPS:39 2998 | 21-225_28A9 | VH3|3-33/D7|7-27|RF1/JH4 | ......... | ......... | ........ | ....F... | ....F... | EI.W......LD... |
| iPS:39 3038 | 21-225_29D8 | VH3|3-33/D7|7-27|RF1/JH4 | ......R.. | D........ | ........ | ....F..T | ....G... | EI.W......LD... |
| iPS:39 3056 | 21-225_30F3 | VH3|3-33/D7|7-27|RF1/JH4 | ......... | ......... | ........ | .V...... | ........ | EM.W......YD... |
| iPS:39 3074 | 21-225_33B1 | VH3|3-33/D7|7-27|RF1/JH4 | ......... | D........ | ....A... | RN...... | ........ | EM.W......YD... |
| iPS:39 3822 | 21-225_15B11 | VH3|3-33/D7|7-27|RF1/JH4 | ......... | N........ | ........ | E...E..T | ....P... | EV.F......TE... |
| iPS:39 3856 | 21-225_14C2 | VH3|3-33/D7|7-27|RF1/JH4 | ......... | D........ | ........ | E.....E. | K....G.. | EV.F......RS... |
| iPS:39 3874 | 21-225_4C8 | VH3|3-33/D7|7-27|RF1/JH4 | ......... | N........ | ........ | EN.Q.... | ....T...SP. | EM.F......LS... |
| iPS:39 3984 | 21-225_4F12 | VH3|3-33/D7|7-27|RF1/JH4 | ......... | ......... | ........ | VT..K... | TP.N.GG.ENQ. | EK.G......L... |
| iPS:39 4020 | 21-225_15H10 | VH3|3-33/D7|7-27|RF1/JH4 | ......... | N........ | ........ | E.....E. | ....V... | EV.F....I.LS... |
| iPS:39 4095 | 21-225_16H4 | VH3|3-33/D7|7-27|RF1/JH4 | ......... | N........ | ........ | .V...... | M....... | EM.W......TD.C. |

FIGURE 52 (Continued)

| | Germline | H_FR1 | H_CDR1 | H_FR2 | H_CDR2 | H_FR3 | H_CDR3 | H_FR4 |
|---|---|---|---|---|---|---|---|---|
| VH1｜1-08\|D5\|5-24\|RF3\|JH6 | | QVQLVQS GAEVKKPGASVK VSCKASGYTFT | S YDIN | WVRQATGQ GLEWMG | WMNPN SGNTGYAQ KFQG | RVTMTRDTSISTAYMEL SSLRSEDTAVYYCAR | REYNYYY YYYGMDV | WGQGTT VTVSS |
| iPS:46 8818 | VH1\|1-08\|D5\|5-24\|RF3\|JH6 | . . . . . . . . . . . . . . . . . . . . . . . . . . . . . . . . . . . . . . . . | . . . . | . . . . . . . . . . . . . . | . . . . . K . . . . . . . . . R . . . . . | . . . . . . . . . . . . . . . . . . . D . . . . . . . . . . . . . . | G.P..WN- . . . . . . . . . . . . . . . . . . . . | . . . A . . . . . . . |
| iPS:43 6023 | VH1\|1-08\|D5\|5-24\|RF3\|JH6 | . . . . . . . . . . . . . . . . . . . . . . . . . . . . . . . . . I . . . . | . . . . | . . . . . . . . . . . . . . | . . . . . K . . . . . . . . . R . . . . . | . . . . . . . . . . . . . . . . . . . D . . . . . . . . . . . . . . | S.A... . . . . . . . . . . . . . . . . . . . . | . . . . . . . . . . . |
| iPS:43 6132 | VH1\|1-08\|D5\|5-24\|RF3\|JH6 | . . . . . . . . . . . . . . . . . . . . . . . . . . . . . . . . . I . . . . | . . . . | . . . . . . . . . . . . . . | . . . . . K . . . . . . . . . R . . . . . | . . . . . . . . . . . . . . . . . . . D . . . . . . . . . . . . . . | G.P..WN- . . . . . . . . . . . . . . . . . . . . | . . . A . . . . . . . |
| iPS:43 6132 225_196C12 | VH1\|1-08\|D5\|5-24\|RF3\|JH6 | . . . . . . . . . . . . . . . . . . . . . . . . . . . . . . . . . I . . . . | . . . . | . . . . . . . . . . . . . . | . . . . . . . . . . . . . . . . . . . . . | . . . . . . . . . . . . . . . . . . . . . . . . . . . . . . . . . | S.A... . . . . . . . . . . . . . . . . . . . . | . . . A . . . . . . . |
| | Germline | H_FR1 | H_CDR1 | H_FR2 | H_CDR2 | H_FR3 | H_CDR3 | H_FR4 |
| VH3\|3-33\|D2\|2-8\|RF3\|JH5 | | QVQLVES GGGVVQPGRSLR LSCAASG FTFS | S YAMH | WVRQAPG KGLEWVA | VISY GGSNKYYAD SVKG | RFTISRDNSKNTLYLQM NSLRAEDTAVYYCAR | DRILDDY ANMEDP | WGQGTL VTVSS |
| iPS:46 8828 | VH3\|3-33\|D2\|2-8\|RF3\|JH5 | . . . . . . . . . . . . . . . . . . . . . . . . . . . . . . . . . . . . . . | . C . . | . . . . . . . . . . . . . . | . . . . A . . . . . . . . . . . . . . . . | . . . . . . . . . . . . . . . . . . . . . . . . . . . F . . . . . | . KNI.G- . . . . . . . . . . . . . . . . . . . . | . . . . . . . . . . . |
| iPS:46 8828 225_162A10 | VH3\|3-33\|D2\|2-8\|RF3\|JH5 | . . . . . . . . . . . . . . . . . . . . . . . . . . . . . . . . . . . . . . | . . . . | . . . . . . . . . . . . . . | . . . . . . . . . . . . . . . . . . . . . | . . . . . . . . . . . . . . . . . . . . . . . . . . . . . . . . . | DT..F . . . . . . . . . . . . . . . . . . . . | - . . . . . . . . . . |
| | Germline | H_FR1 | H_CDR1 | H_FR2 | H_CDR2 | H_FR3 | H_CDR3 | H_FR4 |
| VH1\|1-02\|D5\|5-18\|RF3\|JH4 | | QVQLVQS GAEVKKPGASVK VSCKASG YTFT | G YYMH | WVRQAPGQ GLEWMG | WINPN SGGTNYAQ KFQG | RVTMTRDTSISTAYMEL SRLRSDDTAVYYCAR | GYSYG VFDY | WGQGTL VTVSS |
| iPS:46 8830 | VH1\|1-02\|D5\|5-18\|RF3\|JH4 | . . . . . . . . . . . . . . . . . . . . . . . . . . . . . . . . . . . . . . | . . . . | . . . . . . . . . . . . . . | . . . . . . . . . . . . . F . . . . . . . | . . . . . . . . . . . . . . . L . . . . . . . . . . . . . N . . . | KN. . . . . . . . . . . . . . . . . . . . . . . | . . . . . . . . . . . |
| iPS:43 6896 225_67F10 | VH1\|1-02\|D5\|5-18\|RF3\|JH4 | . . . . . . . . . . . . . . . . . . . . . . . . . . . . . . . . . . . . . . | . . . . | . . . . . . . . . . . . . . | . . . . . . . . . . . . . G . . . . . . . | . . . . . . . . . . . . . . . W . . . . . . . . . . . . . . . . . | . . . S . . . . . . . . . . . . . . . . . . . | . . . . . . . . . . . |
| iPS:39 3218 21-225_14G3 | VH1\|1-02\|D5\|5-18\|RF3\|JH4 | . . . . . . . . . . . . . . . . . . . . . . . . . . . . . . . . . . . . . . | . . . Y | . . . . . . . . . . . . . . | . . . . . . . . . . . . . . . . . . . . . | . . . . . . . . . . . . . . . . . . . . . . . . . . . . . . . . . | T.F. SGS. . . . . . . . . . YYNG. . . . . | . . . . . . . . . . . |
| iPS:39 3565 21-225_34B11 | VH1\|1-02\|D5\|5-18\|RF3\|JH4 | . . . . . . . . . . . . . . . . . . K . . . . . . . . . . . . . . . . . . . | . . . . | . . . . . . . . . . . . . . | . . . . . . . . . . . . . . . . . . . . . | . . . . . . . . . . . . . . . . . . . . . . . . . . . . . . . . . | S.F. SGS. . . . . . . . . . YYNE. . . . . | . . . . . . . . . . . |
| | | | | | | | V.F. SGS. . . . . . . . . . YYNE. . . . . | |

| | | H_FR1 | H_CDR1 | H_FR2 | H_CDR2 | H_FR3 | H_CDR3 | H_FR4 |
|---|---|---|---|---|---|---|---|---|
| iPS:46 8846 | 21-225_53B10 | VH3|3-21|D1|1-1|RF2/JH5 | ........ | ........ | ........ | .G....V | ........ | .NS--- | ........ |
| iPS:43 4251 | 21-225_62G3 | VH3|3-21|D1|1-1|RF2/JH5 | ........ | ........ | ........ | ........ | ........ | .NS--- ....S | ........ |
| iPS:43 4407 | 21-225_68G8 | VH3|3-21|D1|1-1|RF2/JH5 | ........ | ........ | ........ | ....G... ..M. | ........ | .NS--- ....S | ........ |
| iPS:43 5575 | 21-225_159H11 | VH3|3-21|D1|1-1|RF2/JH5 | ........ | ...I.... | ........ | ....G... | ........ | .SW--- ---A.C | ........ |
| Germline | VH3|3-23|D1|1-1|RF2/JH4 | EVQLLE SGGGLVQPGGSLR LSCAASG.FTFS | S....YAMS | WVRQAPGK.GLE WVS | AISGS GGSTYYAD SVKG | RFTISRDNSKNTLYLQM NSLRAEDTAVYYCAK | VGLER......YIDY | WGQGTL VTVSS |
| iPS:46 8848 | 21-225_54B1 | VH3|3-23|D1|1-1|RF2/JH4 | ........ | ........ | ........ | .VL..F.. | ......E........ S............R. | RGR.YSG...YD | ........ |
| iPS:43 3993 | 21-225_47G7 | VH3|3-23|D1|1-1|RF2/JH4 | ....D... | ........ | ........ | ...R.... .N.F..E ...R.... | ...............R. | IIR.Q....WA | ........ |
| iPS:43 4007 | 21-225_48D7 | VH3|3-23|D1|1-1|RF2/JH4 | ........R | .N.....S..N | ........ | ..T.F... | ...............I..R. | CGR.Q....WL | ........ |
| iPS:43 4115 | 21-225_53E4 | VH3|3-23|D1|1-1|RF2/JH4 | ........ | ........ | ........ | ....G... ....R... | ...N............ | .A---- | ........ |
| iPS:43 5679 | 21-225_169D10 | VH3|3-23|D1|1-1|RF2/JH4 | ...S.... | .....V.. | ........ | .SRI.... | ...........L...R. | .AF--- | ........ |
| iPS:43 5685 | 21-225_170E1 | VH3|3-23|D1|1-1|RF2/JH4 | ........ | .....V.. | ........ | .NRI.... | ...........L...R. | .AF--- | ........ |

FIGURE 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 6632 | 21-225_227E4 | VH3/3-23|D1|1-1|RF2|JH4 | .G........ | T......F..T | ...........R|V...R...SF | ...........T........ | D..W- | .......... |
| | Germline | VH4|4-39|D4|4-11|RF2|JH5 | H_FR1 QVQLVQS-GPGLVKPSETL SLTCTVS-GGSIS | H_CDR1 SSS___SYWG | H_FR2 WIRQPPGK GLEWIG | H_CDR2 SIYY___SGSTYYNP SLKS | H_FR3 RVTISVDTSKNQFSLKL SSVTAADTAVYYCAR | H_CDR3 _____DTSNY_____NFDP | H_FR4 WGQGTL VTVSS |
| iPS:46 8856 | 21-225_77C9 | VH4|4-39|D4|4-11|RF2|JH5 | ..T............... | ..R...... | ........... | ....A.S... | .................LF.... | LD..W.....-GL.Y | .......... |
| iPS:43 4489 | 21-225_74E4 | VH4|4-39|D4|4-11|RF2|JH5 | .........I........ | .....N... | ........... | ....Y.S... | ...........S...H..R..... | LD..W.....-GL.Y | .......... |
| iPS:43 5251 | 21-225_96A3 | VH4|4-39|D4|4-11|RF2|JH5 | .........I........ | .....N... | ........... | ....Y.S... | ...........S...H..R..... | LD..W.....-GL.Y | .......... |
| iPS:43 7346 | 21-225_75H7 | VH4|4-39|D4|4-11|RF2|JH5 | ..T............... | ..R...... | ........... | ....A.S... | .................LF.... | LD..W.....-GL.Y | .......... |
| iPS:39 3886 | 21-225_2G9 | VH4|4-39|D4|4-11|RF2|JH5 | .............R.... | PN.-..... | ........... | .....S...N | .N...................... | LS..W.....-D..N | .......... |
| iPS:39 3928 | 21-225_4E10 | VH4|4-39|D4|4-11|RF2|JH5 | .................. | ..R...... | ........... | ..V.A.S... | .N...........L..V........ | LS..W.....-D..Y | F......... |
| | Germline | VH1|1-02|D6|6-6|RF1|JH6 | H_FR1 QVQLVQS GAEVKKPGASVK VSCKASG_YTFT | H_CDR1 ___YYMH | H_FR2 WVRQAPGQ GLEWMG | H_CDR2 WINPN SGGTNYAQ KFQG | H_FR3 RVTMTRDTS ISTAYMEL SRLRSDDTAVYYCAR | H_CDR3 EISSSYY_____YYGMDV | H_FR4 WGQGTT VTVSS |
| iPS:46 8862 | 21-225_178H8 | VH1|1-02|D6|6-6|RF1|JH6 | RT................ | D........ | ........... | ....R..... | ................I....... | .EDR.GW......... | .......... |
| iPS:45 1112 | 21-225_53D10 | VH1|1-02|D6|6-6|RF1|JH6 | .........I........ | .....I... | ........... | .......... | ................I....... | .NE.LATRP...FYD....... | .......... |
| | | H_FR1 | H_CDR1 | H_FR2 | H_CDR2 | H_FR3 | H_CDR3 | H_FR4 |

FIGURE 52 (Continued)

| VH2/2-05/D6/6-6/RF2/JH4 | | QIILKES GPILNFQIII LQITES FSLS | GNQMG IS ALEWLA | WIRQPPH KGLEW | RLIIHDSKNQYLPH MQKRYSP INDPYSIYV SLKS | START |  |
|---|---|---|---|---|---|---|---|
| iPS:46 8864 | 21-225_60D6 | VH2/2-05/D6/6-6/RF2/JH4 | . . . . . . . | . . . . . . . | . K . E . . . | . . . . . . . | AV.V-...S... |
| iPS:43 6850 | 21-225_57D9 | VH2/2-05/D6/6-6/RF2/JH4 | M. . . . . . | . . . . . . . | . . . . . . . | .E. . . . . . | AV.V-...S... |
| iPS:43 6914 | 21-225_76B4 | VH2/2-05/D6/6-6/RF2/JH4 | . . . . . . . | .G. . . . . . | . . . D . . . | . . . . . . . | L.V-...A... |
| iPS:43 6918 | 21-225_77A2 | VH2/2-05/D6/6-6/RF2/JH4 | .S. . . . . . | . . . . . . . | .V. F . D . . | . . . . . . . | L.V-...A... |
| iPS:43 6934 | 21-225_96B5 | VH2/2-05/D6/6-6/RF2/JH4 | . . . . . . . | .G. . . . . . | . . . D . . . | .P. . . . . . | L.V-...AC.. |
| iPS:43 7334 | 21-225_75F11 | VH2/2-05/D6/6-6/RF2/JH4 | . . . . . . . | .G. . . . . . | . . . D . . . | .P. . . . . . | L.V-...A... |
| iPS:43 7377 | 21-225_74G9 | VH2/2-05/D6/6-6/RF2/JH4 | . . . . . . . | .G. . . . . . | . . . D . . . | .P. . . . . . | L.V-...A... |
| iPS:39 2583 | 21-225_10B10 | VH2/2-05/D6/6-6/RF2/JH4 | . . . . . . . | .G. . . . . . | . F . S . . . | .S. . . . R . | IA.V-...A... |
| iPS:39 3184 | 21-225_15H11 | VH2/2-05/D6/6-6/RF2/JH4 | .L. . . . . . M. . . | . . . . . . . | . H . . . . . . R . | . A . . . . R . | IV.V-...A... I |
| iPS:39 3212 | 21-225_30H6 | VH2/2-05/D6/6-6/RF2/JH4 | . . . . . . . | .G. . . . . . | . H . . . . . | . . . . . . . | L.V-...A... |
| iPS:39 3222 | 21-225_17F5 | VH2/2-05/D6/6-6/RF2/JH4 | .S. . . . . . | . . . . . . . | . . . D . . . | . . . S . . . | I.V-...A... |

| | | H_FR1 | H_CDR1 | H_FR2 | H_CDR2 | H_FR3 | H_CDR3 | H_FR4 |
|---|---|---|---|---|---|---|---|---|
| iPS:47 2741 | 21-225_30D9_L C1 | VH1\|1-02\|D3\|3-22\|RF2\|J H5 | ..K.......... E........... | ....L... | ........ | ........ | .......... R.S.... .........F... | V..YG..S... ......E..N | ........ ........ |
| iPS:43 7040 | 21-225_196E7 | VH1\|1-02\|D3\|3-22\|RF2\|J H5 | ............ | ....N... | ......H | ........ | ........... | D...T... .EG..... | ........ |
| iPS:43 7050 | 21-225_197C11 | VH1\|1-02\|D3\|3-22\|RF2\|J H5 | .V.......... | ....N... | ......H | ........ | ........... | D....... .EG..... | ........ |
| iPS:39 3214 | 21-225_33A1 | VH1\|1-02\|D3\|3-22\|RF2\|J H5 | ............ .S.......... | ........ | ........ | N..H.... | ........... .........F... | G..YA..S... .......DL... | ........ |
| | Germline VH1\|1-02\|D3\|3-22\|RF2\|J H4 | H_FR1 QVQLVQS GAEVKKPGASVK VSCKASG YTFT | H_CDR1 SYWMH | H_FR2 WVRQAPGQ GLEWMG | H_CDR2 WINPN SGGTNYAQ KFQG | H_FR3 RVTMTRDTSISTAYMEL SRLRSDDTAVYYCAR | H_CDR3 VYYDSSG YYYFDY | H_FR4 WGQGTL VTVSS |
| iPS:47 2743 | 21-225_68G6 | VH1\|1-02\|D3\|3-22\|RF2\|J H4 | ....F..G... ..S......... | ........ | ........ | S..YR... | .......K... .I.......... | AF.YG..T... ......NE... | ........ |
| iPS:43 6902 | 21-225_69B11 | VH1\|1-02\|D3\|3-22\|RF2\|J H4 | .....R...... | ........ | ........ | ......G. | ..........F. .......A... | T..YG..S... .......NG... | ........ |
| iPS:43 6904 | 21-225_71D4 | VH1\|1-02\|D3\|3-22\|RF2\|J H4 | ............ | ...C.... | ........ | .....D.. | ........V.V.D. | A..YG..T... ......HNE... | .....S.. |
| iPS:43 6906 | 21-225_72B4 | VH1\|1-02\|D3\|3-22\|RF2\|J H4 | ............ | ........ | ........ | ......G. | ....V........ | T..YG..S... .......NG... | ........ |
| iPS:43 7034 | 21-225_195E9 | VH1\|1-02\|D3\|3-22\|RF2\|J H4 | .V.......... | ........ | ........ | ...A.... | N............ | A..YG..T... ......NE... | ........ |
| iPS:39 2598 | 21-225_18E10 | VH1\|1-02\|D3\|3-22\|RF2\|J H4 | ............ | ........ | ........ | ........ | ..........S..N... | S..YG..S... ......NE... | ........ |

FIGURE 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:39 3182 | 21-225_4B3 | VH1{1-02/D3{3-22{RF2{J H4 | . . . . . . . . . . . . . . . . . . . . . . . . . | . . . . . . . . . . . | . . . . . . . . . . . . . . . . . | . . . . . . . . . . . . . . . . . . . | . . . . . . . . . . . . . . . . . | S...YG...S......NE... | . . . . . . |
| iPS:39 3200 | 21-225_35E1 | VH1{1-02/D3{3-22{RF2{J H4 | ...K........................ | . . . . . . . . . . . | . . . . . . . . . .S. . . . . . . | . . . . . . . . . . . . . . . . . . . | . . . . . . . . . . .V....P.... | V...HG...S......NE... | . . . . . . |
| iPS:39 3206 | 21-225_13F6 | VH1{1-02/D3{3-22{RF2{J H4 | . . . . . . . . . . . . . . . . . . . . . . . . . | . . . . . . . . . . . | . . . . . . . . . . .K. . . . . . | . . . . . . . . . . . . . . . . . . . | . . . . . . . . . . . . . .F. . . | SF.YG...T......NE... | . . . . . . |
| iPS:39 3208 | 21-225_16F3 | VH1{1-02/D3{3-22{RF2{J H4 | . . . . . . . . . . . . . . . . . . . . . . . . . | . . . . . .H. . . . . | . . . . . . . . . . . . . . . . . | . . . . . . . . . . .A. . . . . . . . | . . . . . . . . . . . . . . . . . | S...YG...S......NE... | . . . . . . |
| iPS:39 3210 | 21-225_17D3 | VH1{1-02/D3{3-22{RF2{J H4 | . . . . . . . . . . . . . . . . . . . . . . . . . | . . . . . . . . .I. . | . . . . . . . . . . . . . . . . . | . . . . . . . . . . . . . . . . . . . | . . . . . . . . . . . . . . . . . | AN..YG...S......ND... | . . . . . . |
| iPS:39 3226 | 21-225_33E6 | VH1{1-02/D3{3-22{RF2{J H4 | . . . . . . . . . . .K. . . . . . . . . . . . . . | . . . . . . . . . . . | . . . . . . . . . . . . . . . . . | . . . . . . . . . . . . . . . . . . . | . . . . . . . . . . . . . . . . . | V...YG...S......NE... | . . . . . . |
| iPS:39 3230 | 21-225_9G9 | VH1{1-02/D3{3-22{RF2{J H4 | . . . . . . . . . . . . . . . . . . . . . . . . . | D. . . . . .I. . . . . | . . . . . . . . . . . . . . . . . | . . . . . . . . . .D. . . . . . . . . | . . . . . . . . . . . . . .S. . . | S...YG...T......NE... | . . . . . . |
| iPS:39 8490 | 21-225_21D12 | VH1{1-02/D3{3-22{RF2{J H4 | . . . . . . . . . . . . . . . . . . . . . . . . . | . . . . . . . . . . . | . . . . . . . . . . . . . . . . . | . . . . . . . . . . .N. . . . . . . . | . . . . . . . . . . . . . . . . . | S...YG...T......NE... | . . . . . . |
| iPS:42 3018 | 21-225_31D12_LC2 | VH1{1-02/D3{3-22{RF2{J H4 | . . . . . . . . . . .K. . . . . . . . . . . . . . | . . . . . . . . . . . | . . . . . . . . . . . . . . . . . | . . . . . . . . . . .V. . . . . . . . | . . . . . . . . . . . . . . . . . | V...YG...S......NE... | . . . . . . |
| iPS:42 3019 | 21-225_31D12_LC1 | VH1{1-02/D3{3-22{RF2{J H4 | . . . . . . . . . . .K. . . . . . . . . . . . . . | . . . . . . . . . . . | . . . . . . . . . . . . . . . . . | . . . . . . . . . . .V. . . . . . . . | . . . . . . . . . . . . . . . . . | V...YG...S......NE... | . . . . . . |
| VH1{1-02{D3{3-22{RF2{JH4 | | QVQLVES...GGGVVQPGRSLRLSCAASG.FTFS | S...YGMH | WVRQAPGKGLEWVA | VIWYD...GSNKYYAD | SVKG | RFTISRDNSKNTLYLQMNSLRAEDTAVYYCAR | *GY* | WGQGTLVTVSS |

FIGURE 52 (Continued)

| | | | | | | | |
|---|---|---|---|---|---|---|---|
| iPS:39 2920 | 21-225_29G4 | VH3\|3-33\|D7\|7-27\|RF2\|J H4 | D........ T... | ....I........ | ....E...... .M.. | ............ | E.M......TG... |
| iPS:43 3899 | 21-225_43C3 | VH3\|3-33\|D7\|7-27\|RF2\|J H4 | ............ | ....I........ | ....EN...... | ............ | E.F......SN... |
| iPS:43 3921 | 21-225_44C3 | VH3\|3-33\|D7\|7-27\|RF2\|J H4 | ............ | ............ | ....FE...... | .......S.... | E.F......ST... |
| iPS:43 3933 | 21-225_44C8 | VH3\|3-33\|D7\|7-27\|RF2\|J H4 | ........N... | ....N........ | ....E....... | .........V.. | E.F......LS... |
| iPS:43 3969 | 21-225_46F3 | VH3\|3-33\|D7\|7-27\|RF2\|J H4 | ............ | ....I........ | ....FE...... | .........V.. | E.F......SN... |
| iPS:43 3975 | 21-225_46C6 | VH3\|3-33\|D7\|7-27\|RF2\|J H4 | ............ | ....I........ | ....EN...... | ........V.V. | E.F......SN... |
| iPS:43 3977 | 21-225_46D8 | VH3\|3-33\|D7\|7-27\|RF2\|J H4 | D........... | ............ | ....FE...... | ........V.V. | E.F......SN... |
| iPS:43 3983 | 21-225_47A1 | VH3\|3-33\|D7\|7-27\|RF2\|J H4 | D........... | ............ | ....DY....K. | .....A...V..T | E.M......L... |
| iPS:43 3997 | 21-225_48C1 | VH3\|3-33\|D7\|7-27\|RF2\|J H4 | ............ | ............ | .V. .EI....K. | .........V.. | E.W......EA... |
| iPS:43 4009 | 21-225_48A9 | VH3\|3-33\|D7\|7-27\|RF2\|J H4 | ............ | ............ | ....E....... ENK... | .......M.F. | E.AW.....YE... |
| iPS:43 4013 | 21-225_48D12 | VH3\|3-33\|D7\|7-27\|RF2\|J H4 | D........... | .....R...... | .V.V ....... | .........M.F. | E.M......RS... |
| iPS:43 4019 | 21-225_49A1 | VH3\|3-33\|D7\|7-27\|RF2\|J H4 | D........... | ............ | ....ED.....V | ............ | E.F......LS... |

FIGURE 52 (Continued)

| | | | | | | | | |
|---|---|---|---|---|---|---|---|---|
| iPS:43 4029 | 21-225_49C6 | VH3\|3-33\|D7\|7-27\|RF2/J H4 | | N..... | .... | V...K.V. ... | ...S.... | D..M.....IE. |
| iPS:43 4057 | 21-225_51E4 | VH3\|3-33\|D7\|7-27\|RF2/J H4 | | ..... | .... | ..E..... | ........ | E..F.....LS. |
| iPS:43 4071 | 21-225_51F9 | VH3\|3-33\|D7\|7-27\|RF2/J H4 | | D..... | .... | ..N..... | ...S.... | E..F.....LS. |
| iPS:43 4075 | 21-225_51B11 | VH3\|3-33\|D7\|7-27\|RF2/J H4 | | D....F | .... | .FG..G.. | ...S.... | E..F.....LS. |
| iPS:43 4077 | 21-225_51F11 | VH3\|3-33\|D7\|7-27\|RF2/J H4 | | N..... | .... | ..N..G.. | ........ | E..F.....LS.F |
| iPS:43 4081 | 21-225_52B2 | VH3\|3-33\|D7\|7-27\|RF2/J H4 | | N..... | .... | ..E..... | ........ | E..F.....LS. |
| iPS:43 4091 | 21-225_52B9 | VH3\|3-33\|D7\|7-27\|RF2/J H4 | | D..... | .... | .T.F.... QR. | ..I.S... | D..M.....IE.F |
| iPS:43 4105 | 21-225_53D2 | VH3\|3-33\|D7\|7-27\|RF2/J H4 | | N..... | ..T. | ..F..... N.. | ...S.... | E..F.....LS. |
| iPS:43 4119 | 21-225_53E6 | VH3\|3-33\|D7\|7-27\|RF2/J H4 | | D....I | .... | V.D..... | ..A..I.. | G..F.....TG. A.... |
| iPS:43 4129 | 21-225_53B12 | VH3\|3-33\|D7\|7-27\|RF2/J H4 | | N....F | ...D | ..E..G.. | H....... | E..M.....TS. |
| iPS:43 4131 | 21-225_54D3 | VH3\|3-33\|D7\|7-27\|RF2/J H4 | | D.....T | .... | .V...... N.N | ........V | E..F.....LS.F |
| iPS:43 4141 | 21-225_54C6 | VH3\|3-33\|D7\|7-27\|RF2/J H4 | | D.....T | .... | ..EN.... | ..A....V | E..M.....TS. |

FIGURE 52 (Continued)

| | | | | | | | | | |
|---|---|---|---|---|---|---|---|---|---|
| iPS:43 4143 | 21-225_54G7 | VH3｜3-33｜D7｜7-27｜RF2｜JH4 | . . . . . . . . . . | N . . . . . . . . . | . . . . . . . . . . | . . . . . . . . . . | E . . . G . . . . . | . . . . . . . . . . | E . F . . . . . LS . | . . . . . . . . . . |
| iPS:43 4155 | 21-225_55B3 | VH3｜3-33｜D7｜7-27｜RF2｜JH4 | . . . . . . . . . . | . . . . . . . . . . | . . . . . . . . . . | . . . . . . . . . . | . F . . . . . . E . N . . . . . . | . . . . . . . V . . | E . F . . . . . LS . | . . . . . . . . . . |
| iPS:43 4199 | 21-225_59F11 | VH3｜3-33｜D7｜7-27｜RF2｜JH4 | . . . . . . . . . . | N . . . . . . . . . | . . . . . . . . . . | . . . . . . . . . . | . . . . . . . . . . E . H . . . . . | . S . . . . . T . . . | E . M . . . . . NG . | . . . . . . . . . . |
| iPS:43 4207 | 21-225_60A3 | VH3｜3-33｜D7｜7-27｜RF2｜JH4 | . . . . . . . . . . | D . . . . . . . . . | . . . . . . . . . . | . . . . . . . . . . | . . . . . . . . . . E . . . . . . | . . . . . . . . . . | E . M . . . . . TG . | . . . . . . . . . . |
| iPS:43 4253 | 21-225_62E4 | VH3｜3-33｜D7｜7-27｜RF2｜JH4 | . . . . . . . . . . | . . . . . . . . . . | . . . . . . . . . . | . . . . . . . . . . | . . . . . . . . . . R . . . . . . . | . . . . . . . V . . | E . F . . . . . SS . | . . . . . . . . . . |
| iPS:43 4271 | 21-225_57A4 | VH3｜3-33｜D7｜7-27｜RF2｜JH4 | . . . . . . . . V . | D . . . . . . . . . | . . . . . . . . . . | . . . . . . . . . . | . A . . . V . . HV . . . | . . . . . . . H . . | E . M . . . . . RS . | . . . . . . . . . . |
| iPS:43 4293 | 21-225_58F5 | VH3｜3-33｜D7｜7-27｜RF2｜JH4 | . . . . . . . . V . | D . . . . . . . . . | . . . . . . . . . . | . . . . . . . . . . | . A . . . HV . . . | . . . . . . . . . . | E . M . . . . . RS . | . . . . . . . . . . |
| iPS:43 4337 | 21-225_64E1 | VH3｜3-33｜D7｜7-27｜RF2｜JH4 | . . . . . . . . V . | . . . . . . . . . . | . . . . . . . . . . | . . . . . . . . . . | . F . . . G . ET . | . . . . . . . . . . | E . F . . . . . SS . | . . . . . . . . . . |
| iPS:43 4357 | 21-225_65C1 | VH3｜3-33｜D7｜7-27｜RF2｜JH4 | . . . . . . . . . . | D . . . . . . . . . | . . . . . . . . . . | . . . . . . . . . . | . FE . . H . T . | . . . . . . . . . . | E . F . . . . . SS . | . . . . . . . . . . |
| iPS:43 4375 | 21-225_66C7 | VH3｜3-33｜D7｜7-27｜RF2｜JH4 | . . . . . . . . . . | D . . . . . . . . . | . . . . . . . . . . | . . . . . . . . . . | . FE . . H . . T . | . . . . . . . . . . | E . F . . . . . SS . | . . . . . . . . . . |
| iPS:43 4411 | 21-225_68F11 | VH3｜3-33｜D7｜7-27｜RF2｜JH4 | . . . . . . . . . . | D . . . . . . . . . | . . . . . . . . . . | . . . . . . . . . . | . . . . . V . . . | . . . . . . . V . . | E . M . . . . . TS . C | . . . . . . . . . . |
| iPS:43 4441 | 21-225_71A2 | VH3｜3-33｜D7｜7-27｜RF2｜JH4 | . . . . . . . T . . | D . . . . . . . . . | . . . . . . . . . . | . . . . . . . . . . | . E . . . . . . | . . . . . . . . . . | E . W . . . . . QD . | . . . . . . . . . . |

FIGURE 52 (Continued)

| | | | | | | | | |
|---|---|---|---|---|---|---|---|---|
| iPS:43 4447 | 21-225_71B6 | VH3|3-33/D7|7-27|RF2/J H4 | | N | | RT | E.M...LS | |
| iPS:43 4453 | 21-225_71B11 | VH3|3-33/D7|7-27|RF2/J H4 | | D | | RN...G. | E.M...LS | |
| iPS:43 4457 | 21-225_72G12 | VH3|3-33/D7|7-27|RF2/J H4 | | | DT | ..F E... | E.F...SS | |
| iPS:43 5311 | 21-225_146H9 | VH3|3-33/D7|7-27|RF2/J H4 | ..S | | | ..F E...H.G. | E.F...LS | |
| iPS:43 5511 | 21-225_157C3 | VH3|3-33/D7|7-27|RF2/J H4 | | T | | VN... | E.F...LS | |
| iPS:43 5533 | 21-225_157H8 | VH3|3-33/D7|7-27|RF2/J H4 | | | I | VN... | E.F...LS | |
| iPS:43 5551 | 21-225_158H6 | VH3|3-33/D7|7-27|RF2/J H4 | V | | | VT... ..D | ..V E.W...AE | |
| iPS:43 5569 | 21-225_159C5 | VH3|3-33/D7|7-27|RF2/J H4 | | | F | .V... VN... | E.F...LS | |
| iPS:43 6268 | 21-225_203B9 | VH3|3-33/D7|7-27|RF2/J H4 | | | | VN... ..P | E.F...LS | |
| iPS:43 6328 | 21-225_207F12 | VH3|3-33/D7|7-27|RF2/J H4 | ..L | N | | RN...G. | E.F..L. | I. |
| iPS:43 6556 | 21-225_224D10 | VH3|3-33/D7|7-27|RF2/J H4 | .K | | | E... .R. | ..S ..V E.F...QS | P. |
| iPS:39 2618 | 21-225_16F10 | VH3|3-33/D7|7-27|RF2/J H4 | | D | | ..M... | E.AW...YE | |

FIGURE 52 (Continued)

| | | | | | | | | |
|---|---|---|---|---|---|---|---|---|
| iPS:39 2626 | 21-225_18A5 | VH3\|3-33\|D7\|7-27\|RF2\|J H4 | .........YT | ......... | D.... | ......... | ......F.... | ......... | ......... | D.W.....TEE. | ......... |
| iPS:39 2630 | 21-225_20E5 | VH3\|3-33\|D7\|7-27\|RF2\|J H4 | ......... | ......... | D.... | ...EN.Q.. | ......... | ......... | E.F.....RS.. | ......... |
| iPS:39 2640 | 21-225_18A1 | VH3\|3-33\|D7\|7-27\|RF2\|J H4 | .......V. | ......... | ..... | ...EN....V | ......... | ...S..... | E.F.....QS.. | ......P.. |
| iPS:39 2644 | 21-225_19E1 | VH3\|3-33\|D7\|7-27\|RF2\|J H4 | ......... | ......... | N.... | ...EN.Q.. | ......... | ......... | E.F.....RS.. | ......... |
| iPS:39 2654 | 21-225_17A10 | VH3\|3-33\|D7\|7-27\|RF2\|J H4 | ......... | ...A..... | N.... | ...EN.Q.. | ......... | ......V.. | E.F.....RS.. | ......... |
| iPS:39 2658 | 21-225_18E8 | VH3\|3-33\|D7\|7-27\|RF2\|J H4 | ......... | ......... | N.... | ...E..... | ......... | ......... | E.F.....RS.. | ......... |
| iPS:39 2666 | 21-225_16F11 | VH3\|3-33\|D7\|7-27\|RF2\|J H4 | ......M.. | ...M..... | ..... | ...EN.Q.. | ......... | ...S..... | E.F.....QS.. | ......P.. |
| iPS:39 2674 | 21-225_18C2 | VH3\|3-33\|D7\|7-27\|RF2\|J H4 | ......V.. | ......... | D.... | ...E....V | ......... | ...I..... | E.W.....YE.. | ......... |
| iPS:39 2680 | 21-225_20A7 | VH3\|3-33\|D7\|7-27\|RF2\|J H4 | ......... | ......... | N.... | ...VT.... | ......... | ......... | E.F.....RS.. | ......... |
| iPS:39 2686 | 21-225_17C7 | VH3\|3-33\|D7\|7-27\|RF2\|J H4 | ...K..... | ......... | D.... | ...EM.Q.. | ......... | ...G..... | D.W.....TEE. | ......... |
| iPS:39 2690 | 21-225_18F2 | VH3\|3-33\|D7\|7-27\|RF2\|J H4 | ......... | ......... | D.... | ....F.... | ......... | ...V..... | D.W.....TEE. | ......... |
| iPS:39 2716 | 21-225_17B5 | VH3\|3-33\|D7\|7-27\|RF2\|J H4 | ......... | ......... | D.... | ....E.H.I | ......... | ......V.. | E.F.....R... | ......... |

FIGURE 52 (Continued)

| | | | | | | | | |
|---|---|---|---|---|---|---|---|---|
| iPS:39 2732 | 21-225_17E5 | VH3j3-33/D7j7-27jRF2/JH4 | ........ | ........D | ........ | L......G VT..... | ........Q | ........L | E..W......YE... |
| iPS:39 2744 | 21-225_20D5 | VH3j3-33/D7j7-27jRF2/JH4 | ........ | ........ | ........ | EN.Q..E | ........D | ........ | E..F......RS... |
| iPS:39 2758 | 21-225_21G11 | VH3j3-33/D7j7-27jRF2/JH4 | ........ | ........ | ......M. | VT.E.... | ........ | ........ | E..W......YE... |
| iPS:39 2772 | 21-225_20E12 | VH3j3-33/D7j7-27jRF2/JH4 | ........ | ........D | ........ | M....... E...H | ........R | ........ | E..F......R.... |
| iPS:39 2790 | 21-225_20D10 | VH3j3-33/D7j7-27jRF2/JH4 | ........ | ........D | ......I. | ..F...V. | ........D | ........ | D..W......TEE. |
| iPS:39 2796 | 21-225_22A4 | VH3j3-33/D7j7-27jRF2/JH4 | ........ | ........D | ........ | ..F..... | ......I. | ........ | D..W......TEE. |
| iPS:39 2810 | 21-225_20H12 | VH3j3-33/D7j7-27jRF2/JH4 | ........ | ........N | ........ | EN.....V | ........ | ........ | E..F......RS... |
| iPS:39 2832 | 21-225_21H8 | VH3j3-33/D7j7-27jRF2/JH4 | ......S. | ........D | ........ | ..F..... | ........ | ........ | D..W......TEE. |
| iPS:39 2854 | 21-225_21E5 | VH3j3-33/D7j7-27jRF2/JH4 | .......S | ........D | ........ | .E...... | ........ | ........ | E..F......RS... |
| iPS:39 2860 | 21-225_22H8 | VH3j3-33/D7j7-27jRF2/JH4 | ........ | ........ | ........ | ..N..... | ........ | ......M.T | E.AW......YE... |
| iPS:39 2866 | 21-225_23H11 | VH3j3-33/D7j7-27jRF2/JH4 | E....... | ........ | ........ | EN.....V | ........ | ........ | E..F......RS... |
| iPS:39 2876 | 21-225_21F7 | VH3j3-33/D7j7-27jRF2/JH4 | ........ | ........D | ........ | ..F..... ..N..V | ........ | ........ | D..W......TEE. |

| | | | | | | | |
|---|---|---|---|---|---|---|---|
| iPS:39 3000 | 21-225_29D7 | VH3\|3-33/D7\|7-27\|RF2/J H4 | . . . . . . . . . . | . . . . . . . . . . | . . . . E . . . G . | . . . . . G . . L . | E . . F . . . . . . . . . . L S . . . |
| iPS:39 3018 | 21-225_29B8 | VH3\|3-33/D7\|7-27\|RF2/J H4 | . . . . . . . D . . | . . . . . . . . . . | . . . . E N . . . . | . . . . . . . . . . | E . . M . . . . . . . T G . S . |
| iPS:39 3030 | 21-225_25H11 | VH3\|3-33/D7\|7-27\|RF2/J H4 | . . . . . . . D . . | . . . . . . . . . . | . . . . E N . E . . | . . . . . . . . . . | E . . M . . . . . . . T G . S . |
| iPS:39 3034 | 21-225_27F2 | VH3\|3-33/D7\|7-27\|RF2/J H4 | . . . . . . . D . . | . . . . E . . . . . | . . . . E N . . . V . . R . | . . . . . . . . . . | E . . M . . . . . . . T G . S . |
| iPS:39 3048 | 21-225_27C3 | VH3\|3-33/D7\|7-27\|RF2/J H4 | . . . . . . . D . . | . . . . . . . . . . | . . . . E N . S . . | . . . . . . . . . . | E . . M . . . . . . . T G . S . |
| iPS:39 3054 | 21-225_29G8 | VH3\|3-33/D7\|7-27\|RF2/J H4 | . . . . . . . D . . | . . . . . . . . . . | . . . . . E T . . . | . . . . . . . . . . | E . . M . . . . . . . T S . . . |
| iPS:39 3812 | 21-225_6A11 | VH3\|3-33/D7\|7-27\|RF2/J H4 | . . . . . . . . . . | . . . . . . . F . . | . . . . . . . F . . | . . . . . D . . . . | D . . W . . . . . . . T E E . . |
| iPS:39 3818 | 21-225_6G12 | VH3\|3-33/D7\|7-27\|RF2/J H4 | . . . . . . . D . . | . . . . . . . . . . | . . . . R . N . . . | . . . . . . . . . . | E . . F . . . . . . . R S . . . |
| iPS:39 3820 | 21-225_8H7 | VH3\|3-33/D7\|7-27\|RF2/J H4 | . . . . . . P . . . | . . . . . . . . . . | . . . . E N . E . . | . . . . . . . . . . | E . . F . . . . . . . R S . . . |
| iPS:39 3826 | 21-225_10G5 | VH3\|3-33/D7\|7-27\|RF2/J H4 | . . . . . . . N . . | . . . . . . . . . . | . . . . E N . Q . . | . . . . . . . T . . | E . . F . . . . . . . R S . . . |
| iPS:39 3828 | 21-225_10H12 | VH3\|3-33/D7\|7-27\|RF2/J H4 | . . . . . . . D . . | . . . . . . . . . . | . . . . D N . Q . . | . . . . . . . . . . | E . . F . . . . . . . R S . . . |
| iPS:39 3830 | 21-225_12A1 | VH3\|3-33/D7\|7-27\|RF2/J H4 | . . . . . . . . . . | . . . . . . . . . . | . . . . E N . Q . . | . . . . . . . . . . | E . . F . . . . . . . R S . . . |

FIGURE 52 (Continued)

| | | | | | | | | | |
|---|---|---|---|---|---|---|---|---|---|
| iPS:39 3838 | 21-225_6G2 | VH3\|3-33/D7\|7-27\|RF2/J H4 | L......K... | D........I. | ....F..... | ..........  | S......... | D..W....TEE. | .......... |
| iPS:39 3854 | 21-225_7H11 | VH3\|3-33/D7\|7-27\|RF2/J H4 | .........S | D......... | EN........ | .......... | .......... | E..F.....RS... | .......... |
| iPS:39 3866 | 21-225_14E3 | VH3\|3-33/D7\|7-27\|RF2/J H4 | .......... | D.....F... | EN.Q...E.. | .......F.. | .......... | E..F.....RS... | .......... |
| iPS:39 3876 | 21-225_9A1 | VH3\|3-33/D7\|7-27\|RF2/J H4 | ...V...... | D......... | ....F..... | .......... | .......... | D..W....TEE. | ......P... |
| iPS:39 3882 | 21-225_15E3 | VH3\|3-33/D7\|7-27\|RF2/J H4 | ......T... | .......... | EN.....E.H | .......... | .......... | E..F.....LS... | .......... |
| iPS:39 3884 | 21-225_16F4 | VH3\|3-33/D7\|7-27\|RF2/J H4 | .......... | N......... | .R.....E..Q..G | ..H....... | .......V.. | E..F.....LS... | .......... |
| iPS:39 3912 | 21-225_16F6 | VH3\|3-33/D7\|7-27\|RF2/J H4 | .......... | N......... | .......E..Q..G | ..H....... | .......V.. | E..F.....LS... | ......P... |
| iPS:39 3922 | 21-225_2B2 | VH3\|3-33/D7\|7-27\|RF2/J H4 | .......... | N......... | EN.....E..V | .......... | .S.....V.. | E..F.....QS... | .......... |
| iPS:39 3934 | 21-225_13E6 | VH3\|3-33/D7\|7-27\|RF2/J H4 | .......... | D......... | EN........I | .......... | .......... | E..F.....RS... | .......... |
| iPS:39 3948 | 21-225_16A5 | VH3\|3-33/D7\|7-27\|RF2/J H4 | .......... | D......... | ....F..V.. | ..S....... | .......... | D..W....TEE. | .......... |
| iPS:39 3960 | 21-225_7G2 | VH3\|3-33/D7\|7-27\|RF2/J H4 | .......... | .......... | ...M.VT... | .......... | .......L.. | E..W.....YE... | .......... |
| iPS:39 3974 | 21-225_7C4 | VH3\|3-33/D7\|7-27\|RF2/J H4 | ......K... | N......... | EN.Q...E.. | .......... | .......... | E..F.....RS... | .......... |

FIGURE 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:39 3976 | 21-225_7E9 | VH3|3-33|D7|7-27|RF2|JH4 | ........... | ........ | ....EN....V. | ............... | E..F......RS. | ......... |
| iPS:39 3994 | 21-225_8C9 | VH3|3-33|D7|7-27|RF2|JH4 | ........... | ........ | ....EN....V. | ............... | E..F......RS. | ......... |
| iPS:39 3998 | 21-225_12B12 | VH3|3-33|D7|7-27|RF2|JH4 | ....D...... | ........ | ...M........ | ...VT.......... | E..M......YE. | ......... |
| iPS:39 4024 | 21-225_16B7 | VH3|3-33|D7|7-27|RF2|JH4 | ......E.... | ........ | ............ | ...E........... | E..F......LS. | ......... |
| iPS:39 4059 | 21-225_9E8 | VH3|3-33|D7|7-27|RF2|JH4 | ........... | ........ | ....D....... | ...EN..Q....... | E..F......RS. | ......... |
| iPS:39 4067 | 21-225_12F2 | VH3|3-33|D7|7-27|RF2|JH4 | ........... | ........ | ....D....... | ....F........F. | E.AW......SE. | ......... |
| iPS:39 4089 | 21-225_12E6 | VH3|3-33|D7|7-27|RF2|JH4 | ........... | ........ | ...T.D...... | ....E....D..... | E.AW......YE. | ......... |
| iPS:39 4097 | 21-225_16G7 | VH3|3-33|D7|7-27|RF2|JH4 | ........... | ........ | ....D....... | ....EN.E....A.. | E.AW......YE. | ......... |
| iPS:40 2219 | 21-225_1C12 | VH3|3-33|D7|7-27|RF2|JH4 | ...N....... | ........ | ............ | ....EN....V.... | E..F......RS. | ......... |
| | Germline | VH3|3-21|D4|4-11|RF2|JH4 | EVQLVES GGGLVQPGGSLR LSCAASGFTFS | SYAMS | WVRQAPGKG LEWVS | SISGS SSSYIYYADSVKG | RFTISRDNAKNSLYLQM NSLRAEDTAVYYCAR | DYSNY | WGQGTL VTVSS |
| iPS:43 3895 | 21-225_43E1 | VH3|3-21|D4|4-11|RF2|JH4 | ........... | ........ | ............ | ....A..GN...... | .........F..L. | .RG--- ....SE |

FIGURE 52 (Continued)

| ID | Gene | | | | | | | |
|---|---|---|---|---|---|---|---|---|
| iPS:43 4103 | 21-225_53G1 | VH3|3-21|D4|4-11|RF2|J H4 | .....E.... | .......... | ....G..... | .......... | .RG---...-ST |
| iPS:43 4179 | 21-225_56F1 | VH3|3-21|D4|4-11|RF2|J H4 | ...F...... | .......... | ...T....G. | .......... | .RG---...-SS |
| iPS:43 4263 | 21-225_56H7 | VH3|3-21|D4|4-11|RF2|J H4 | ...S...... | .......... | ...T....G. | .......... | .RG---...-SS |
| iPS:43 5521 | 21-225_157H4 | VH3|3-21|D4|4-11|RF2|J H4 | .......... | .......... | ...T...... | .......... | .RG---...-SI |
| iPS:43 5527 | 21-225_157G7 | VH3|3-21|D4|4-11|RF2|J H4 | ....F..... | .......... | ....G..... | .......... | .RG---...-SS |
| iPS:43 5529 | 21-225_157H7 | VH3|3-21|D4|4-11|RF2|J H4 | ....F..... | .......... | ..C.G..M.. | .......V.. | .RG---..... |
| iPS:43 5547 | 21-225_158F5 | VH3|3-21|D4|4-11|RF2|J H4 | .......... | ....T..... | ....G..... | .......... | .RG---...-SS |
| iPS:43 5549 | 21-225_158H5 | VH3|3-21|D4|4-11|RF2|J H4 | .......... | ....R..... | ....G..... | .....H.... | .RG---...-SS |
| iPS:43 5553 | 21-225_158G8 | VH3|3-21|D4|4-11|RF2|J H4 | .......... | .......... | ...L.G.... | .......... | .RG---...-SL |
| iPS:43 5581 | 21-225_160H1 | VH3|3-21|D4|4-11|RF2|J H4 | .......... | .......... | .TG.M..... | ....F..... | .K---...... |
| iPS:43 5593 | 21-225_160F4 | VH3|3-21|D4|4-11|RF2|J H4 | ....F..... | .......... | ....G..... | .......... | .RG---...-SS |
| iPS:43 5617 | 21-225_162F2 | VH3|3-21|D4|4-11|RF2|J H4 | ....F..... | .......... | ...T...... | .......... | .RG---...-SS |

FIGURE 52 (Continued)

| | | | | | | | |
|---|---|---|---|---|---|---|---|
| iPS:43 5621 | 21-225_162H3 | VH3\|3-21\|D4\|4-11\|RF2\|JH4 | ....... | ....... | .R....... | ....G....T........ | .RG---<br>--SS |
| iPS:43 5641 | 21-225_163F9 | VH3\|3-21\|D4\|4-11\|RF2\|JH4 | ...Q... | ....... | ....... | ....G....T........ | .RG---<br>--SL |
| iPS:43 5719 | 21-225_171A11 | VH3\|3-21\|D4\|4-11\|RF2\|JH4 | ....... | ....... | ....... | ....G............ | .RG---<br>--SS |
| iPS:43 6856 | 21-225_58C5 | VH3\|3-21\|D4\|4-11\|RF2\|JH4 | ...M... | ....... | ...I... | ..Y.L....S........ | ..T.G-<br>..S... |
| iPS:44 8904 | 21-225_65C12 | VH3\|3-21\|D4\|4-11\|RF2\|JH4 | ...R... | .F.L.. | ....... | .................. | .AY---<br>--SH. |
| iPS:47 2730 | 21-225_14B1_LC1 | VH3\|3-21\|D4\|4-11\|RF2\|JH4 | ....... | ..T... | ....... | ....G....L....P... | .RG---<br>--SS |
| iPS:47 2731 | 21-225_14B1_LC2 | VH3\|3-21\|D4\|4-11\|RF2\|JH4 | ....... | ..T... | ....... | ....G....L....P... | .RG---<br>--SS |
| iPS:39 2726 | 21-225_20B5 | VH3\|3-21\|D4\|4-11\|RF2\|JH4 | .A...T | ....... | ....... | ....G............L | .RG---<br>---S. |
| iPS:39 2734 | 21-225_17D8 | VH3\|3-21\|D4\|4-11\|RF2\|JH4 | ....... | .GL... | ....... | ....G.H.S......... | .RG---<br>---SG |
| iPS:39 2768 | 21-225_20B8 | VH3\|3-21\|D4\|4-11\|RF2\|JH4 | ....... | ....... | ....... | ....G.H.......... | .RG---<br>---SG |
| iPS:39 2778 | 21-225_22H3 | VH3\|3-21\|D4\|4-11\|RF2\|JH4 | .A..... | ....... | ....... | ....G.........F... | .RG---<br>---SL |
| iPS:39 2788 | 21-225_20C8 | VH3\|3-21\|D4\|4-11\|RF2\|JH4 | ....... | ....... | ....... | ....G....A........ | .RG---<br>---SL |

FIGURE 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:39 2792 | 21-225_20G12 | VH3-21/D4/4-11/RF2/JH4 | .................... | .................... | .................... | G.... .L.. | .................... | .RG--- ...S. | .................... |
| iPS:39 2844 | 21-225_23E11 | VH3-21/D4/4-11/RF2/JH4 | .................... | ........T........... | .................... | .G.... W.V. | .................... | .RG--- ---SL | .................... |
| iPS:39 2848 | 21-225_20F9 | VH3-21/D4/4-11/RF2/JH4 | .................... | .................... | .................... | .................... | .................... | .RG--- ---SC | ......I. |
| iPS:39 2850 | 21-225_20H10 | VH3-21/D4/4-11/RF2/JH4 | .................... | ....T............... | .................... | .................... | ......I............. | .RG--- ---SL | .................... |
| iPS:39 3006 | 21-225_31G9 | VH3-21/D4/4-11/RF2/JH4 | .................... | .................... | .................... | .................... | .................... | .RG--- ---SS | .................... |
| iPS:39 3022 | 21-225_30H11 | VH3-21/D4/4-11/RF2/JH4 | .................... | .................... | .................... | .G.... | .................... | .RG--- ---SL | .................... |
| iPS:39 3130 | 21-225_33C2 | VH3-21/D4/4-11/RF2/JH4 | .................... | ....T............... | .Q.................. | .G.... | ..........F.IF...... | .RG--- ---GT | .................... |
| iPS:39 3906 | 21-225_13D3 | VH3-21/D4/4-11/RF2/JH4 | .................... | ....T............... | .D.................. | .G.... | .................... | .RG--- ---SG | .................... |
| iPS:39 3982 | 21-225_6C12 | VH3-21/D4/4-11/RF2/JH4 | .................... | .................... | .................... | .................... | .................... | .RG--- ---SL | .................... |
| iPS:39 8478 | 21-225_17C10 | VH3-21/D4/4-11/RF2/JH4 | .................... | .................... | .................... | .G.... .M.. | ........L........... | .RG--- ---SS | .................... |
| VH3-21/D6/6-6/RF1/JH4 | | SGELNS CGLVQPGGSLR LSCAASG FTFS | YAMS | WVRQAPGK GLEWVS | GISGS GGSTYYAD SVKG | RFTISRDNSRTTLYLQM NSLRAEDTAVYYCAK | EYSSS SYFDP | WGQG VTVSS |

FIGURE 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:43 3897 | 21-225_43C2 | VH3|3-23|D6|6-6|RF1/JH4 | .......... | ...... | ........ | ..R. VN.FD.. | ........ | .R.G........ | ...... |
| iPS:43 3903 | 21-225_43H4 | VH3|3-23|D6|6-6|RF1/JH4 | .......... | ...... | ........ | ..R. IN.FD.. | ........ | .R.G........ | ...... |
| iPS:43 3911 | 21-225_43E8 | VH3|3-23|D6|6-6|RF1/JH4 | .......... | ...... | ........ | ..R. IN.FD.. | ........ | .R.G........ | ...... |
| iPS:43 3941 | 21-225_44D10 | VH3|3-23|D6|6-6|RF1/JH4 | .......... | ...... | ........ | ..R. VN.FD.. | ........ | .R.G........ | ...... |
| iPS:43 3957 | 21-225_45F8 | VH3|3-23|D6|6-6|RF1/JH4 | .......... | ...... | ........ | ..R. VN.FD.. | ........ | .R.G........ | ...... |
| iPS:43 3973 | 21-225_46A6 | VH3|3-23|D6|6-6|RF1/JH4 | .......... | ...... | ........ | ..R. IN.FD.. | ........ | .R.G........ | ...... |
| iPS:43 5715 | 21-225_171A8 | VH3|3-23|D6|6-6|RF1/JH4 | .........R | ...S.. | ........ | V... F.T. | ........ | SN..G....-W | ...... |
| iPS:43 5739 | 21-225_174G7 | VH3|3-23|D6|6-6|RF1/JH4 | .........R | ...S.. | ........ | V... F.T. | ........ | SN..G....-W | ...... |
| iPS:43 5749 | 21-225_175C10 | VH3|3-23|D6|6-6|RF1/JH4 | .......... | ...... | ........ | S...R.. F.. | ...V... | SN..G....-W | ...... |
| | VH3|3-21|D7|7-27|RF1/JH4 | EVQLVES GGGLVKPGGSLR LSCAASGFTFS | VSMH | WVRQAPGKGLEWVS | SISSSSSYIYAD SVKG | RFTISRDNAKNSLYLQM NSLRAEDTAVYYCAR | LTGY ...FDY | WGQGTL VTVSS |
| iPS:43 3901 | 21-225_43A4 | VH3|3-21|D7|7-27|RF1/JH4 | .........A. | ...... | ...V... | ...T... ... | ........D.Q ........G | V.S-........ | ...A.. ...... |

FIGURE 52 (Continued)

| | | | | | | | | | |
|---|---|---|---|---|---|---|---|---|---|
| iPS:43 3961 | 21-225_45D9 | VH3{3-21\|D7\|7-27\|RF1/JH4 | . . . . . . . . . | T . . . . . . . . | . . . . . . . . . | . . . . . . . G . | . . . . . . . . . | V.S- . . . . . . . | . . . . . . . .A. |
| iPS:43 4135 | 21-225_54H3 | VH3{3-21\|D7\|7-27\|RF1/JH4 | . . . . . . . . . | . . . . . . . . I | . V . . . . . . . | . . . . . . T . . | . . . . . . . . . | M.T- . . . . . -VI | . . . . . . . . . |
| iPS:43 4331 | 21-225_63H8 | VH3{3-21\|D7\|7-27\|RF1/JH4 | . . . . . . . . . | . . . . . . . N . | . . . . . . . . . | . . . . . . .GT. | . . . . . . . G . | RN- . . . . . . . | . . . . . . . . . |
| iPS:43 5421 | 21-225_151F1 | VH3{3-21\|D7\|7-27\|RF1/JH4 | . . . . Y . R | . . . . . . . F . | . . . . . . . . . | . . T.MN T | . . . . . . . . . | D.P- . .LV. | . . . . . . . . . |
| iPS:43 5653 | 21-225_166H12 | VH3{3-21\|D7\|7-27\|RF1/JH4 | . . . . . . . .A. | . . . . . . . . S | . .G. . . . . . . | . . . . . . . Y . | . . . . . . . . . | . - . . . . . . . | . . . . . . . . . |
| iPS:43 6648 | 21-225_227F11 | VH3{3-21\|D7\|7-27\|RF1/JH4 | . . . . . . . .V | T . . . . . . . . | . . . . . . . . . | . . . . . .IN.M. | . . . . . . . S . | G--- . . . . . -V. | . . . . . . . . . |
| iPS:39 2952 | 21-225_26G1 | VH3{3-21\|D7\|7-27\|RF1/JH4 | . . . . . . . . . | . . . . . . . G . | . . . . . . . . . | . . . . . . . G . | . . . . . . . . . | . T- . . . . . . F | . . . . . . . . . |
| iPS:39 3082 | 21-225_34C11 | VH3{3-21\|D7\|7-27\|RF1/JH4 | . . . . . . . . . | . . . . . . T.S | . . . . . . . . . | . . . . . . . G . | . . . . . . . . . | . - . . . . . . . | . . . . . . . . . |
| iPS:39 4061 | 21-225_12D2 | VH3{3-21\|D7\|7-27\|RF1/JH4 | . . . . . . . . . | . . . . . . . . . | . . . . . . . . . | . M . . . . . . . | . . . . . . . S . | G--- . . . . . . . | . . . . . . . .A. |
| iPS:39 4071 | 21-225_10C7 | VH3{3-21\|D7\|7-27\|RF1/JH4 | . . . . . . . . . | . . . . . . . . . | . . . . . . . . . | . NN . . . . . . . | . . . . . . . . . | G--- . . . . . -V. | . . . . . . . . . |
| iPS:39 8532 | 21-225_33B7 | VH3{3-21\|D7\|7-27\|RF1/JH4 | . . . . . . . . . | . . . . . . . N . | . . . . . . . . . | . . . . . . . G . | . . . . . . . . . | . N- . . . . . . . | . . . . . . . . . |
| iPS:40 2225 | 21-226_2B1 | VH3{3-21\|D7\|7-27\|RF1/JH4 | . . . . . . . . . | . . . . . . . . . | . . . . . . . . . | . . . . . . . . . | . . . . . . . . . | G--- . . . . . -N. | . . . . . . . . . |

FIGURE 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:40 4090 | 21-225_8D8 | VH3|3-21|D7|7-27|RF1|J H4 | | | | | .G--- ....-N. | |
| | VH3|3-11|D4|4-11|RF2|JH4 | | | | | | | |
| iPS:43 3905 | 21-225_43E5 | VH3|3-11|D4|4-11|RF2|J H4 | ......I | | I.K.M.. | ......A | .T---...-I. | |
| iPS:43 3913 | 21-225_43H8 | VH3|3-11|D4|4-11|RF2|J H4 | ......N | | .R..F..L.. | ......A | .T---...-I. | |
| iPS:43 3949 | 21-225_45H2 | VH3|3-11|D4|4-11|RF2|J H4 | ......N | | I.K... | ......A | .T---...-I. | |
| iPS:43 3981 | 21-225_46E9 | VH3|3-11|D4|4-11|RF2|J H4 | ......N | | .N.N..F.. | ......A | .T---...-I. | |
| iPS:43 3995 | 21-225_47H7 | VH3|3-11|D4|4-11|RF2|J H4 | ......I | | .N.N..F.K.. | ......A | .T---...-V. | |
| iPS:43 4039 | 21-225_43B1 | VH3|3-11|D4|4-11|RF2|J H4 | ......N | | ..F.. | ......A | .T---...-I. | |
| iPS:43 4275 | 21-225_57F4 | VH3|3-11|D4|4-11|RF2|J H4 | .....I.. | | | | .M---...-II | ....R ... |
| | Germline | H_FR1 | H_CDR1 | H_FR2 | H_CDR2 | H_FR3 | H_CDR3 | H_FR4 |
| | VH3|3-23|D7|7-27|RF1|JH3 | | | | | | | |
| iPS:43 3915 | 21-225_43H9 | VH3|3-23|D7|7-27|RF1|J H3 | | | M | ......H ..F.. | R.PSD....V. | |

FIGURE 52 (Continued)

| | | H_FR1 | H_CDR1 | H_FR2 | H_CDR2 | H_FR3 | | H_CDR3 | H_FR4 |
|---|---|---|---|---|---|---|---|---|---|
| iPS:43 3925 | 21-225_44F3 | VH3\|3-23\|D7\|7-27\|RF1/J H3 | ........H........ | ................ | ................ | ...IL.G. .KT... | ................ | ...F.... | R.PSD.... | ............ |
| iPS:43 3953 | 21-225_45H4 | VH3\|3-23\|D7\|7-27\|RF1/J H3 | ................ | ................ | ................ | ......M .SN.F.. | ................ | .....H.. .F..... | R.PSD.... ..V..... | ............ |
| iPS:43 3959 | 21-225_45C9 | VH3\|3-23\|D7\|7-27\|RF1/J H3 | ........N....... | ................ | ................ | ........ ........ | ................ | ........ | R.PSD.... | ............ |
| iPS:43 5379 | 21-225_149B6 | VH3\|3-23\|D7\|7-27\|RF1/J H3 | ................ | ................ | ................ | V...R.. ....F... | ................ | ....F... | R.FED.... ..V..... | ............ |
| iPS:43 5787 | 21-225_180A3 | VH3\|3-23\|D7\|7-27\|RF1/J H3 | E............... | ........ F..N... | ................ | V...R.. .N.F... | ................ | ....F... | R....D... ..V.V... | ............ |
| iPS:43 5809 | 21-225_182H5 | VH3\|3-23\|D7\|7-27\|RF1/J H3 | ................ | ................ | ................ | V...R.. .T.F... | ................ | ........ | R....D... ..V..... | ............ |
| iPS:43 5889 | 21-225_186A11 | VH3\|3-23\|D7\|7-27\|RF1/J H3 | ................ | ................ | ................ | V...R.. .T.F... | ................ | ........ | R....D... ..V..... | ............ |
| Germline | | H_FR1 | H_CDR1 | H_FR2 | H_CDR2 | H_FR3 | | H_CDR3 | H_FR4 |
| | VH4\|4-59\|D6\|6-13\|RF2/JH4 | | SYMS | WIRQPPGKG LEWIG | RSIYYSG STNYNP SLKS | RVTISVDT SKNQFSLKL SSVTAADTAVYYCAR | | GYFDY | WGQGTTVTV SS |
| iPS:43 3931 | 21-225_44F6 | VH4\|4-59\|D6\|6-13\|RF2/JH4 | .......H......... | ................ | ................ | .......N........ | ................ | ...V... | .V.I-.... ...-KN.. | ..I......... |
| Germline | | H_FR1 | H_CDR1 | H_FR2 | H_CDR2 | H_FR3 | | H_CDR3 | H_FR4 |
| | VH3\|3-23\|D4\|4-17\|RF2/JH6 | | SYAMS | WVRQAPGK GLEWVS | AISGSGGSTYYAD SVKG | RFTISRDNSKNTLYLQMN SLRAEDTAVYYCAK | | XYYGMDV | WGQGTT VTVSS |
| iPS:43 3943 | 21-225_44E10 | VH3\|3-23\|D4\|4-17\|RF2/JH6 | ........S....... | ................ | ................ | .GVV............. .R. | ................ | ....I... | .R.QWL-... ...LG.... | ............ |

| | | FR1 EVQLVES GGGVVQPGGSLR LSCAASG FTFS | CDR1 SYAM S | FR2 WVRQAPGK GLEWV | CDR2 ALSGS GGSTYYAD SVKG | FR3 RFTISRDNSKNTLYLQM NSLRAEDTAVYYCAK | CDR3 GKAAL......GKTDY | FR4 WGQGT LVTVSS |
|---|---|---|---|---|---|---|---|---|
| | VH3│3-33│D6│6-13│RF2│JH4 | | H_FR1 | H_CDR1 | H_FR2 | H_CDR2 | H_FR3 | H_CDR3 | H_FR4 |
| iPS:43 3947 | 21-225_44E12 | VH3│3-33│D6│6-13│RF2│JH4 | ..H.A....E ......L... | ......DDT | ....P..... | ....F..EY ....... | ........... ........... | DLI.A...TG | ..... |
| iPS:43 3963 | 21-225_46B1 | VH3│3-33│D6│6-13│RF2│JH4 | ..H.A....E ......L... | ......DDS | ....P..... | ....F..EYT ....... | ........N.. .........A. | DLI.T...TG | ..... |
| iPS:43 3987 | 21-225_47A5 | VH3│3-33│D6│6-13│RF2│JH4 | ........... ........... | D.....DDT | .......... | ....F...... ....... | .........S. ........... | DLI.A...TV | ..... |
| iPS:43 6258 | 21-225_202F12 | VH3│3-33│D6│6-13│RF2│JH4 | ........E ........... | Y......... | .......... | ....I...... ....... | ........... .........S. | N...A..... | ..... |
| iPS:43 2646 | 21-225_20G2 | VH3│3-33│D6│6-13│RF2│JH4 | ........... ......L... | ......DD.. | ....E..... | ....F...... ....... | .IM......G. ........... | DLI.A...TV | ..... |
| iPS:39 2750 | 21-225_20A10 | VH3│3-33│D6│6-13│RF2│JH4 | ........... ......L... | ......DD.. | .......... | ....F...... ....... | ...I.....M. ........... | DLI.A...TV | ..... |
| Germline | | | EVQLVES GGGVVQPGGSLR LSCAASG FTFS | YAMS | WVRQAPGK GLEWVS | AISGS GGSTYYAD SVKG | RFTISRDNSKNTLYLQM NSLRAEDTAVYYCAK | GKAAS......DAFDI | WGQGT MVTVSS |
| | VH3│3-23│D6│6-19│RF2│JH3 | | H_FR1 | H_CDR1 | H_FR2 | H_CDR2 | H_FR3 | H_CDR3 | H_FR4 |
| iPS:43 3999 | 21-225_48D1 | VH3│3-23│D6│6-19│RF2│JH3 | .........R | .......... | .......... | V...R...F. ....... | ........... ..........R | R.......NE | ..... |
| iPS:43 4003 | 21-225_48C3 | VH3│3-23│D6│6-19│RF2│JH3 | .........R | .......... | .......... | V...R...F. ....... | ........... ..........R | R.......NE | ..... |
| iPS:43 4037 | 21-225_49G12 | VH3│3-23│D6│6-19│RF2│JH3 | .........T | .......... | .......... | V...T.F... ....... | L.......... ..........R | R.......N. | ..... |
| iPS:43 4041 | 21-225_50H8 | VH3│3-23│D6│6-19│RF2│JH3 | .........R | .......... | .......... | V...R.T.F. ....... | ........... ..........R | R.......NE | ..... |

FIGURE 52 (Continued)

| | | | | | | | | | |
|---|---|---|---|---|---|---|---|---|---|
| iPS:43 4045 | 21-225_50H10 | VH3 3-23/D6 6-19/RF2/J H3 | .G...... | ........ | ........ | V...R...F. | ........ | R....... | .NE..... |
| iPS:43 4073 | 21-225_51H10 | VH3 3-23/D6 6-19/RF2/J H3 | .......T | ........ | ........ | V...T.F. | .L...... | R....... | ..N..... |
| iPS:43 6212 | 21-225_200G1 | VH3 3-23/D6 6-19/RF2/J H3 | ........ | ........ | ........ | ........ | ........ | R...D... | .Y...V.. |
| iPS:39 2652 | 21-225_17C6 | VH3 3-23/D6 6-19/RF2/J H3 | ......E. | N....... | ........ | V...R...N.F. | ........ | RL...... | .SE..... |
| iPS:39 2668 | 21-225_17B4 | VH3 3-23/D6 6-19/RF2/J H3 | ......E. | ........ | ........ | ...R...N.F...R. | ........ | RL...... | .SE..... |
| iPS:39 2696 | 21-225_20A4 | VH3 3-23/D6 6-19/RF2/J H3 | ........ | T....... | ..G..M.. | V......Y..N. | ...V.... | R....... | .SE..... |
| iPS:39 2702 | 21-225_17F7 | VH3 3-23/D6 6-19/RF2/J H3 | ......E. | N....... | ........ | I...R...N.F. | ........ | RL...... | .SE..... |
| iPS:39 2704 | 21-225_17F11 | VH3 3-23/D6 6-19/RF2/J H3 | ..A...E. | ........ | ........ | V...R...N..S | ........ | R....... | .SE..H.. |
| iPS:39 2720 | 21-225_17A12 | VH3 3-23/D6 6-19/RF2/J H3 | I...E. | ........ | ..D..... | I...R...NAF. | ........ | RL...... | .SE..... |
| iPS:39 2722 | 21-225_18E12 | VH3 3-23/D6 6-19/RF2/J H3 | ......E. | ........ | ........ | T...R...N.F. | ........ | RL...... | .SE..... |
| iPS:39 2760 | 21-225_22G3 | VH3 3-23/D6 6-19/RF2/J H3 | ......E. | N....... | ........ | I...R...VN.F. | ........ | RL...... | .SE..... |
| iPS:39 2764 | 21-225_22G10 | VH3 3-23/D6 6-19/RF2/J H3 | .....D..T | N....... | ........ | V...R...N.F. | ..F.H... | RM...... | .SE..... |

FIGURE 52 (Continued)

| | | | | | | | | | |
|---|---|---|---|---|---|---|---|---|---|
| iPS:39 2812 | 21-225_21F4 | VH3\|3-23\|D6\|6-19\|RF2/J H3 | . . . . . | . N . . . | . . . . . | V . . R . . N . F . | . . . . . | . . . . . | RL . . . . . . . SE . C . | . . . . . |
| iPS:39 2816 | 21-225_22E4 | VH3\|3-23\|D6\|6-19\|RF2/J H3 | . . E . . | . . . . . | . . . . . | I . . R . . N . F . | . . V . . | . S . . . | R . . . . . . . . SE . . . | . . . . . |
| iPS:39 2852 | 21-225_21A2 | VH3\|3-23\|D6\|6-19\|RF2/J H3 | . . E . . | . N . . . | . . . . . | I . . R . TN . F . | . . . . . | . S . . . | RL . . . . . . . SE . . . | . . . . . |
| iPS:39 2878 | 21-225_22C5 | VH3\|3-23\|D6\|6-19\|RF2/J H3 | . . K . . | . . . . . | . M . . . | I . . . . . . Y . . | . . . . . | . S . . . | R . . . . . . . . SE . . . | . . . . . |
| iPS:39 2902 | 21-225_22D5 | VH3\|3-23\|D6\|6-19\|RF2/J H3 | . V . . . | . . . . . | . . . . . | . . . R . . N . F . | . . . . . | . S . . . | R . . . . . . . . SE . . . | . . . . . |
| iPS:39 3824 | 21-225_10F12 | VH3\|3-23\|D6\|6-19\|RF2/J H3 | . . E . . | . . . . . | . . . . . | V . . R . . N . F . | . . . . . | . S . . . | RV . . . . . . . SE . A . | . . . . . |
| iPS:39 3848 | 21-225_4H2 | VH3\|3-23\|D6\|6-19\|RF2/J H3 | . . E . . | G . . . N | . M . . . | I . . R . . N . F . | . . . . . | . S . . . | RL . . . . . . . SE . . . | . . . . . |
| iPS:39 3862 | 21-225_5G2 | VH3\|3-23\|D6\|6-19\|RF2/J H3 | T . . . . | . . . . . | . . . . . | . . Y . . | . . . . . | . S . . . | R . . . . . . . . SE . A . | . . . . . |
| iPS:39 3888 | 21-225_3E3 | VH3\|3-23\|D6\|6-19\|RF2/J H3 | . . E . . | . . . . . | . . . . . | V . . R . VN . F . | . . . . . | . L . S . | RL . . . . . . . SE . . . | . . . . . |
| iPS:39 3898 | 21-225_5F7 | VH3\|3-23\|D6\|6-19\|RF2/J H3 | . . E . . | . . . V . | . . . . . | I . . R . . N . F . | . . . . . | . F . S . | R . . . . . . . . SE . . . | . . . . . |
| iPS:39 3980 | 21-225_6D3 | VH3\|3-23\|D6\|6-19\|RF2/J H3 | . . E . . | . . . . N | . . . . . | I . . R . . . . . . | . . . . . | . . . S . | RL . . . . . . . SE . . . | . . . . . |
| iPS:39 4014 | 21-225_8G6 | VH3\|3-23\|D6\|6-19\|RF2/J H3 | . V . . . | . . . V . N | . . . . . | V . . R . . N . F . | . . . . . | . . . S . | RL . . . . . . . SE . . . | . . S . . |

FIGURE 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:39 4022 | 21-225_16H6 | VH3|3-23|D6|6-19|RF2|J H3 | ......N | ......M...... | V...R... Y... | | RL...... .SE... | |
| iPS:39 4043 | 21-225_3B1 | VH3|3-23|D6|6-19|RF2|J H3 | ......N | | V...R... IN.F... | S | RL...... .SE... | |
| iPS:39 4077 | 21-225_8E12 | VH3|3-23|D6|6-19|RF2|J H3 | ..E... | | I...R... .N.F... | S | RM...... .SE... | |
| iPS:39 4087 | 21-225_11A5 | VH3|3-23|D6|6-19|RF2|J H3 | ..D. ..E... | | V...R... I. VN.F... | S | R...... .SE... | |
| | Germline | H_FR1 QVQLVES GGGLVKPGGSLR LSCAASG.FTFS | H_CDR1 YDMS | H_FR2 WVRQAPGK GLEWVS | H_CDR2 YISSS GSTIYAD SVKG | H_FR3 RFTISRDNAKNSLYLQM NSLRAEDTAVYYCAR | H_CDR3 STAAP....... GAFDI | H_FR4 WGQGTL VTVSS |
| iPS:43 4011 | 21-225_48B10 | VH3|3-11|D6|6-6|RF2|JH 3 | | F.T | .Q...... | .A...... | ......I | AV..P...... ....GV... | |
| | Germline | H_FR1 QVQLVES GGGLVKPGGSLR LSCAASG.FTFS | H_CDR1 YINS | H_FR2 WVRQAPGK GLEWVS | H_CDR2 YISSS GSTIYAD SVKG | H_FR3 RFTISRDNAKNSLYLQM NSLRAEDTAVYYCAR | H_CDR3 STAAP....... YFDY | H_FR4 WGQGTL VTVSS |
| iPS:43 4015 | 21-225_48F12 | VH3|3-11|D6|6-6|RF2|JH 4 | | F.T | .Q...... | .A...... | ......F ......I | AV..P...... ....GA..I | |
| iPS:43 4017 | 21-225_48G12 | VH3|3-11|D6|6-6|RF2|JH 4 | | F.T | .Q...... | .A...... | ......F ......I | AV..P...... ....GA..I | |
| | Germline | H_FR1 EVQLLES GGGLVQPGGSLR LSCAASG.FTFS | H_CDR1 YAMS | H_FR2 WVRQAPGK GLEWVS | H_CDR2 AISGS GGSTYYAD SVKG | H_FR3 RFTISRDNSKNTLYLQM NSLRAEDTAVYYCAK | H_CDR3 GYAAA....... GYFDL | H_FR4 WGQGTL VTVSS |
| iPS:43 4023 | 21-225_49F1 | VH3|3-23|D6|6-13|RF2|J H4 | | S | .D...... | V...... F...... | S | A......G... ...AH... | |

| | | | | | | | | |
|---|---|---|---|---|---|---|---|---|
| iPS:39_2782 | 21-225_22B12 | VH3-21/D1|1-1|RF2/JH4 | | | | | | .AA--- ..L.S |
| iPS:39_2916 | 21-225_27C5 | VH3-21/D1|1-1|RF2/JH4 | | | .T.. D... | | | .AS--- ...C |
| iPS:39_2976 | 21-225_27H12 | VH3-21/D1|1-1|RF2/JH4 | | | .G.. .N.T | F.. | | .AS--- |
| iPS:39_3120 | 21-225_35H8 | VH3-21/D1|1-1|RF2/JH4 | | | .GT. G.F. | K.V. | | .SG--- |
| iPS:39_3836 | 21-225_15A2 | VH3-21/D1|1-1|RF2/JH4 | | .T.. | .G.. G... | .A.. | | .AS--- |
| iPS:39_3894 | 21-225_5E11 | VH3-21/D1|1-1|RF2/JH4 | | | .G.. .T.. | .F.. | | .AS--- |
| iPS:39_3896 | 21-225_2A4 | VH3-21/D1|1-1|RF2/JH4 | | | .G.. | IA.. | | .AS--- |
| iPS:39_3914 | 21-225_16B8 | VH3-21/D1|1-1|RF2/JH4 | | .T.. | .G.. .T.. | | | .AS--- |
| iPS:39_3944 | 21-225_14D6 | VH3-21/D1|1-1|RF2/JH4 | | .N.. | .G.. | M... | | .AA--- ...S |
| iPS:39_3952 | 21-225_1F1 | VH3-21/D1|1-1|RF2/JH4 | | | .G.. | | | .N--- |
| iPS:39_4033 | 21-225_5F4 | VH3-21/D1|1-1|RF2/JH4 | ...V | | .G.. | F.. | | .NN--- |
| iPS:39_4069 | 21-225_16H1 | VH3-21/D1|1-1|RF2/JH4 | | | .G.. .T.. | | | .AA--- |

| | | | H_FR1 | H_CDR1 | H_FR2 | H_CDR2 | H_FR3 | H_CDR3 | H_FR4 |
|---|---|---|---|---|---|---|---|---|---|
| iPS:43 4055 | 21-225_51B4 | VH3/3-23/D7|1-20|RF1/J H3 | ..........S... ..........R | .......V. | | ....R. .SN.F.T. | | ..SH.... ....G... | |
| | Germline | VH3/3-23/D7|7-27|RF1/JH4 | EVQLLES GGGLVQPGGSLR LSCAASGFTFS | TAMS | WVRQAPGKGLEW VSAIS | GSGGSTYYADSVKG | RFTISRDNSKNTLYLQM NSLRAEDTAVYYCAR | (shaded) | WGQGTLVTVSS |
| iPS:43 4059 | 21-225_51C5 | VH3/3-23/D7|7-27|RF1/JH4 | | ......V. | .......T | .R. ..N. | ....V. ..S......R | V.A- | |
| iPS:43 4213 | 21-225_60A4 | VH3/3-23/D7|7-27|RF1/JH4 | | ......V. | | .S. ..W.N | ....T. .........R | ..-... | |
| iPS:43 4215 | 21-225_60F7 | VH3/3-23/D7|7-27|RF1/JH4 | | ......V. | | .G. .NR. | ......S. ......GS | .G--.... ......ID | |
| iPS:43 4241 | 21-225_61E6 | VH3/3-23/D7|7-27|RF1/JH4 | ..........R | | | ..T. .VN.F. | | ELG.... ......I | |
| iPS:43 4281 | 21-225_57B8 | VH3/3-23/D7|7-27|RF1/JH4 | ..........R | | | .N.F. | | ELG.... ......I | |
| iPS:43 4301 | 21-225_58F11 | VH3/3-23/D7|7-27|RF1/JH4 | | | | .N.F. | ......Y | FF.MVG.. ....AGF | |
| iPS:43 5523 | 21-225_157G5 | VH3/3-23/D7|7-27|RF1/JH4 | | ......V. | ....D. | .M. .R. | | Y.W- ...NG. | |
| iPS:43 5659 | 21-225_167D12 | VH3/3-23/D7|7-27|RF1/JH4 | | ......V. | | .M. .R. | | Y.W- ...NG. | |
| iPS:43 5765 | 21-225_177D3 | VH3/3-23/D7|7-27|RF1/JH4 | | ......V.N | | .GM. .R. ...D | ..S. .....R | V.F- | |

| | | H_FR1 | H_CDR1 | H_FR2 | H_CDR2 | H_FR3 | H_CDR3 | H_FR4 |
|---|---|---|---|---|---|---|---|---|
| | Germline | VH3/3-33/D5/5-24/RF2/JH4 | | | | | A.IG--...S | |
| iPS:43 4127 | 21-225_53H8 | | | | | | | |
| | VH3/3-23/D4/4-17/RF2/JH4 | EVQLLES GGGLVQPGGSLR LSCAASG-FTFS | SYAMS | WVRQAPGK GLEWVS | AISGS GGSTYYAD SVKG | RFTISRDNSKNTLYLQM NSLRAEDTAVYYCAR | DYGDY | WGQGTL VTVSS |
| iPS:43 4147 | 21-225_55E1 | VH3/3-23/D4/4-17/RF2/JH4 | .......... | .......... | ..R. S..F.. | .......... F........ | .H.IVG..... ....TI | .......... |
| iPS:43 5303 | 21-225_146A6 | VH3/3-23/D4/4-17/RF2/JH4 | ..........N | .......... | ..R. N..F.. | .......... | KDN..VW..... .....GSP | .......... |
| iPS:43 5335 | 21-225_147D10 | VH3/3-23/D4/4-17/RF2/JH4 | .......... | .......... | ..R. N..F.. | .......... | KDY..VW..... .....GSP | .......... |
| iPS:43 5339 | 21-225_147D12 | VH3/3-23/D4/4-17/RF2/JH4 | .......S.. | .......... | ..R. N..F.. | .......... | KDY..VW..... .....GSP | .......... |
| iPS:43 5343 | 21-225_148E2 | VH3/3-23/D4/4-17/RF2/JH4 | .......... | .......... | ..R. N..F.. | .......H........... | KDY..VW..... .....GSP | .......... |
| iPS:43 5381 | 21-225_149C6 | VH3/3-23/D4/4-17/RF2/JH4 | .......... | .......... | ..R. N..F.. | .......... | KDY..VW..... .....GSP | .......... |
| iPS:43 5391 | 21-225_149F8 | VH3/3-23/D4/4-17/RF2/JH4 | .......... | .......... | ..R. N..F.. | .......... | KDY..VW..... .....GSP | .......... |
| iPS:43 5395 | 21-225_149D11 | VH3/3-23/D4/4-17/RF2/JH4 | .......... | .......... | ..R. N..F.. | .......R........... | KDY..VW..... .....GSP | .......... |
| iPS:43 5403 | 21-225_150C5 | VH3/3-23/D4/4-17/RF2/JH4 | .......... | .......... | ..R. N..F.. | .......... | KDY..VW..... .....GSP | .......... |

FIGURE 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:43 21-225_152H7 5447 | VH3\|3-23\|D4\|4-17\|RF2\|JH4 | ........N | ........ | ........ | ....N.F. | ........ | KDN..VW.....GSP.... | ........ |
| iPS:43 21-225_152G10 5453 | VH3\|3-23\|D4\|4-17\|RF2\|JH4 | ........N | ........ | ........ | ....N.F. | ........ | KDY..VW.....GSP.... | ........ |
| iPS:43 21-225_155A4 5483 | VH3\|3-23\|D4\|4-17\|RF2\|JH4 | ........N | ........ | ........ | ...R.N.F. | ........ | KDY..VW.....GSP.... | ........ |
| iPS:43 21-225_155B4 5485 | VH3\|3-23\|D4\|4-17\|RF2\|JH4 | ........ | ........ | ........ | ....N.F. | ........ | KDY..VW.....GSP.... | ........ |
| iPS:43 21-225_178F7 5777 | VH3\|3-23\|D4\|4-17\|RF2\|JH4 | ...H.... | .......T | ........ | ..V..... | .......R | R....... | ........ |
| iPS:43 21-225_179G1 5783 | VH3\|3-23\|D4\|4-17\|RF2\|JH4 | ...H.... | .......T | ........ | ..V..F. | .......R | R....... | ........ |
| iPS:43 21-225_190D12 5833 | VH3\|3-23\|D4\|4-17\|RF2\|JH4 | ........ | ........ | ....D... | ...I.N..R. | ........ | .M.R.S......YGP... | ........ |
| iPS:43 21-225_197C8 6156 | VH3\|3-23\|D4\|4-17\|RF2\|JH4 | ........ | .....S.T | ........ | ...I.N..RA. | .......T | .R.YSRIA.....VAGT.... | ........ |
| VH3\|3-21\|D1\|1-1\|RF1\|JH4 | | EVQLVES GGGLVQPGGSLR LSCAASG FTFS | TSMN | WVRQAPGK GLEWVS | SISSS SSYIYYAD SVKG | RFTISRDNAKNSLYLQMNSLRAEDTAVYYCAR | YFDY | WGQGTL VTVSS |
| iPS:43 21-225_55D4 4157 | VH3\|3-21\|D1\|1-1\|RF1\|JH4 | ......N.. | ........ | ........ | ..R..... | ........ | ........ | ..S..... |
| iPS:43 21-225_62C1 4243 | VH3\|3-21\|D1\|1-1\|RF1\|JH4 | ........ | ........ | ........ | .NH.D... | ........L.... | ......I..FG------VD | ........ |

FIGURE 52 (Continued)

The page contains a sequence alignment table showing antibody variable heavy chain sequences. Due to the low resolution and heavy shading, individual sequence characters cannot be reliably transcribed.

| | Germline | H_FR1 | H_CDR1 | H_FR2 | H_CDR2 | H_FR3 | H_CDR3 | H_FR4 |
|---|---|---|---|---|---|---|---|---|
| iPS:43 4247 | VH3|3-33/D1|1-1|RF3/JH4 | ......Y.... | .......... | .......... | .......S.. | .......... | D.G.W...... N.L. | .......... |
| 21-225_62D2 | | | | | | | | |
| iPS:43 6838 | VH3|3-33/D1|1-1|RF3/JH4 | .......... | H......F. | ...K...... | .......... | .......... | GD.Y...... .EG. | .......... |
| 21-225_52H4 | | | | | | | | |
| iPS:43 6948 | VH3|3-33/D1|1-1|RF3/JH4 | .......... | .........L | .......... | .....G.... T | .......... | E.FW-...... ...SG. | .......... |
| 21-225_183F5 | | | | | | | | |
| | Germline | H_FR1 | H_CDR1 | H_FR2 | H_CDR2 | H_FR3 | H_CDR3 | H_FR4 |
| VH4|4-39/D5|5-12|RF3/JH4 | | QVQLQES CGPGLVKPSETLS LTCTVSG-GSIS | SS....SYYWG | WIRQPPGK GLEWIG | SIYY SGSTNYNP SLKS | RVTISVDTSKNQFSLKL SSVTAADTAVYYCAR | CVSSYD--------YYFDY | WGQGTL VTVSS |
| iPS:43 4249 | VH4|4-39/D5|5-12|RF3/JH4 | .........I | R......... | .......... | ......IAS.. | N.....T.... | LS..W-...... | .......... |
| 21-225_62E2 | | | | | | | | |
| iPS:43 4353 | VH4|4-39/D5|5-12|RF3/JH4 | ........V. | R......... | .......... | .......S.. | .......... | LD..W-...... ..-S... | .......... |
| 21-225_64B12 | | | | | | | | |
| iPS:39 4073 | VH4|4-39/D5|5-12|RF3/JH4 | .......... | R......... | .......... | N.......N.. | .......... | QG..W-...... -EV... | .......... |
| 21-225_15C9 | | | | | | | | |
| | Germline | H_FR1 | H_CDR1 | H_FR2 | H_CDR2 | H_FR3 | H_CDR3 | H_FR4 |
| VH1|1-02|D7|7-27|RF1/JH4 | | QVQLVQS GAEVKKPGASV KVSCKASG-YTF | G------TYMH | WVRQAPGQ GLEWMG | WINPN SGGTNAL SQKFQG | RVTMTRDTSISTAYMEL SRLRSDDTAVYYCAR | LIGY-----------PDY | WGQGTL VTVSS |
| iPS:43 4259 | VH1|1-02|D7|7-27|RF1/JH4 | .......... | .......... | .......... | ....K..K... | .......S.. | AP.IAAAG....... ....TWGY... | .......... |
| 21-225_62G7 | | | | | | | | |
| iPS:43 4347 | VH1|1-02|D7|7-27|RF1/JH4 | .......... | .......... | .......... | ....K......Q | ......G... | AP.TAATG....... ....TWGY... | .......... |
| 21-225_64H10 | | | | | | | | |
| iPS:43 4359 | VH1|1-02|D7|7-27|RF1/JH4 | .......... | .......I. | .......... | .......S.. | .......... | AP.KAAAG....... ....TWGY... | .......... |
| 21-225_65G3 | | | | | | | | |

FIGURE 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43_4369 | 21-225_66B1 | VH1|1-02|D7|7-27|RF1/JH4 | ......... | ......... | ......... | ......... | AP.TAAAG......TWGY... | ... |
| iPS:43_4373 | 21-225_66A7 | VH1|1-02|D7|7-27|RF1/JH4 | ......... | ......... | ....N... | ....A......... | AP.TVAAG......TWGY... | ... |
| iPS:43_4397 | 21-225_67H4 | VH1|1-02|D7|7-27|RF1/JH4 | ......... | ......... | ..K..Q. | ......... | AP.TAATG......TWGY... | ... |
| iPS:43_4427 | 21-225_70D6 | VH1|1-02|D7|7-27|RF1/JH4 | ....I... | ......... | ..K..Q. | ..G......E. | AP.KAAAG......TWGF... | ... |
| iPS:43_4435 | 21-225_70G9 | VH1|1-02|D7|7-27|RF1/JH4 | ......... | ......... | ..K..S. | ..S..RG..... | AP.IAAAG......TWGY... | ... |
| iPS:43_4437 | 21-225_70A12 | VH1|1-02|D7|7-27|RF1/JH4 | ......... | ......... | ..K..Q. | ..S......... | AP.TAATG......TWGY... | ... |
| iPS:43_4451 | 21-225_71B7 | VH1|1-02|D7|7-27|RF1/JH4 | ......... | ......... | ..K..S. | ..G......G.. | AP.KAAAG......TWGF... | ... |
| iPS:43_4459 | 21-225_71A7 | VH1|1-02|D7|7-27|RF1/JH4 | ......... | ......... | ..K..V. | ..G......... | AP.TAPAG......SWGY... | ... |
| iPS:43_4461 | 21-225_73A3 | VH1|1-02|D7|7-27|RF1/JH4 | ......... | ...D... | ..K..HV. | ..A..S..... | AP.TAAAG......SWGC... | ... |
| Germline | VH3|3-23|D4|4-11|RF3/JH4 | EVQLLES...GGGLVQPGGSLRLSCAASG.FTFS | ...YAMS | WVRQAPGKGLEWVS | AISGS..GGSTYYAD | SVKGRFTISRDNSKNTLYLQMNSLRAEDTAVYYCAK | .TTVT | WGQGTLVTVSS |
| iPS:43_4261 | 21-225_56F7 | VH3|3-23|D4|4-11|RF3/JH4 | ......... | ...VLN | ......... | ..M... | ....F..M | .H- | ... |

FIGURE 52 (Continued)

Table too complex and low-resolution to transcribe reliably.

| | | H_FR1 | H_CDR1 | H_FR2 | H_CDR2 | H_FR3 | H_CDR3 | H_FR4 |
|---|---|---|---|---|---|---|---|---|
| iPS:43 4311 | 21-225_59H5 | VH3J3-33|D3|3-22|RF3|J H6 Germline | QLQLQES-GPGLVKPSETLS LTCTVSG.GSIS | SY.WG | WIRQPPGK.GLEWIG | SIYY SGSTYYNP SLKS | KVTISVDTSKNQFSLKL SSVTAADTAVYYCAR | VSGGSY VYFDY | WGQGT.LVTVSS |
| iPS:43 4313 | 21-225_59E6 | VH4|4-39|D1|1-26|RF3|J H4 | | R... | | N..... | ...........L............. | H.S.W....-SL.. | |
| iPS:43 4413 | 21-225_68D12 | VH4|4-39|D1|1-26|RF3|J H4 | | R... | | N...I... | .....T..................... | H.T.W....-SI.. | |
| iPS:39 2628 | 21-225_20C2 | VH4|4-39|D1|1-26|RF3|J H4 | | R... | | N.TA.C.S | .....I...T................ | H.S.W....-SL.N | |
| iPS:39 2642 | 21-225_18C6 | VH4|4-39|D1|1-26|RF3|J H4 | | R... | | N..Y.... | .....I..........L.......... | H.S.W....-SL.D | |
| iPS:39 2706 | 21-225_18A3 | VH4|4-39|D1|1-26|RF3|J H4 | F...... | R... | | N..Y..T. | ..............R............ | H.T.W....-SL.. | |
| iPS:39 2800 | 21-225_22D12 | VH4|4-39|D1|1-26|RF3|J H4 | | R... | | N..T.S. | ..............F............ | L.S.W....-SV.. | |
| iPS:39 2820 | 21-225_23D1 | VH4|4-39|D1|1-26|RF3|J H4 | | R... | | N..AQ... | ...........L............... | L.S.W....-S... | |
| iPS:39 2824 | 21-225_24E5 | VH4|4-39|D1|1-26|RF3|J H4 | A... | R... | | N..AN... | .........T................. | L.S.W....-SI.N | |
| iPS:39 2834 | 21-225_22C1 | VH4|4-39|D1|1-26|RF3|J H4 | ...N | R... | | N..A...S | .........T................. | H...W....-SL.. | |

FIGURE 52 (Continued)

| | | | | | | | | |
|---|---|---|---|---|---|---|---|---|
| iPS:39 2870 | 21-225_20G9 | VH4/4-39/D1J1-26|RF3/JH4 | . . . . . . . . . . . . | R. . . . . . . . . . | . . . . . . . . . | . AS . . . | . . . . . . . . . | R. . . . . A. . . | L.S.W . . . . . . -S . . . . |
| iPS:39 2896 | 21-225_21G7 | VH4/4-39/D1J1-26|RF3/JH4 | . . . F . . . . | R. . . . . . . . . . | . Q . . . . . . . | N . . . YS . . | . . . . . . . . . | . . . . . . . . . | H.T.W . . . . . . -SL . . . |
| iPS:39 2904 | 21-225_22G9 | VH4/4-39/D1J1-26|RF3/JH4 | . . . . . . A . . | G . . . N . . . | . . . . . . . . . | . . . . . . . . . | . . . . . . . . . | R . . . E . . . | H.S.W . . . . . . -SL . . . |
| iPS:39 3094 | 21-225_34C4 | VH4/4-39/D1J1-26|RF3/JH4 | . . . . . . . . . . . | R. . . . . . . . . . | . . . E . . . | . . A . . . | . . . . . . . . . | . . . . . V . . . | L.S.W . . . . . . -S . . . . |
| iPS:39 3806 | 21-225_6A6 | VH4/4-39/D1J1-26|RF3/JH4 | . . . . . . . . . . . | R. . . . . . . . . . | . . . . . . . . . | N . . . IP . . | . N . . . . . . | . . . . . . . . . | H.S.W . . . . . . -SL . . . |
| iPS:39 3814 | 21-225_7F4 | VH4/4-39/D1J1-26|RF3/JH4 | . . . . . . . . . . . | R. . . S. . . . . | . . . . . . . . . | N . . . A . . | T . . . . . . . | . . . . . T . . . | H.W . . . . . . -SL . . . |
| iPS:39 3816 | 21-225_6D4 | VH4/4-39/D1J1-26|RF3/JH4 | . . . H . . . | R. . . . . . . . . . | . . . . . . . . . | N . . . A . I. | . . . A . . . | . . . . . . N . | H.S.W . . . . . . -SL.C . . |
| iPS:39 3880 | 21-225_15A1 | VH4/4-39/D1J1-26|RF3/JH4 | . . . . . . . . . . . | R. . . S. . . . . | . . . . . . . . . | . Y . . T . . | T . . . . . . . | . . . . . T . . . | L.S.W . . . . . . -S . . . . |
| iPS:39 4002 | 21-225_15G7 | VH4/4-39/D1J1-26|RF3/JH4 | . . . H . . . | R. . . . . . . . . . | . . . . . . . . . | . . . AQ . . | . . . . . . . . . | . S . . . R . . | L.S.W . . . . . . -S.F . . |
| iPS:39 4053 | 21-225_11F10 | VH4/4-39/D1J1-26|RF3/JH4 | . . . . . A . . | R. . . . . . . . . . | . . . . . . . . . | . . . AQ . . | . . . . . . . . . | . . . . . T . . . | L.S.W . . . . . . -S . . . . |
| iPS:39 4057 | 21-225_15H1 | VH4/4-39/D1J1-26|RF3/JH4 | . . . F . . . | R. . . . . . . . . . | . . . . . . . . . | N . . . YP . | G . . . . . . . | . . . . . A . . | H.T.W . . . . . . -SL . . . |
| iPS:39 4063 | 21-225_16A1 | VH4/4-39/D1J1-26|RF3/JH4 | . I. . . D . . | R. . . . . . . . . . | . . . . . . . . . | . . . A.H. | . . . . . . . . . | . . . . . . . . . | L.S.W . . . . . . -S . . . . |

| | Germline | H_FR1 | H_CDR1 | H_FR2 | H_CDR2 | H_FR3 | H_CDR3 | H_FR4 |
|---|---|---|---|---|---|---|---|---|
| iPS:43 4335 | VH3\|3-33\|D4\|4-11\|RF2\|JH4 | | | | | | DPRS......SAG... | |
| iPS:43 4429 | VH3\|3-33\|D4\|4-11\|RF2\|JH4 | | | ..D... | ..H... | | DPRS......SAG... | |
| iPS:43 4569 | VH3\|3-33\|D4\|4-11\|RF2\|JH4 | | N..... | T..D.. | | | R.ILG....ATF... | |
| iPS:43 4629 | VH3\|3-33\|D4\|4-11\|RF2\|JH4 | | | | ..R... | ...L... | R.ILG....AAF... | |
| iPS:43 5793 | VH3\|3-33\|D4\|4-11\|RF2\|JH4 | | ..F... | .A.... | A..... | ...S... | HFRW.....S.G... | |
| iPS:43 6382 | VH3\|3-33\|D4\|4-11\|RF2\|JH4 | | | ...S.. | ..D..E | | R.IVG.....AT... | |
| iPS:39 2660 | VH3\|3-33\|D4\|4-11\|RF2\|JH4 | | ..D... | ...T.. | .A..H.T | | RAYS......SSS... | |
| iPS:39 3904 | VH3\|3-33\|D4\|4-11\|RF2\|JH4 | | T.....N. | | ..D.... | ...F... | RAYS......SSS.F | |
| | Germline | H_FR1 | H_CDR1 | H_FR2 | H_CDR2 | H_FR3 | H_CDR3 | H_FR4 |
| VH4\|4-59\|D4\|4-11\|RF2\|JH4 | | QVQLQES GPGLVKPSETLS LTCTVSG-GSIS | S-----YYWS | WIRQPPG KGLEWIG | YIYY SGSTNYNP SLKS | RVTISVDTSKNQFSLKL SSVTAADTAVYYCAR | -------DYSNY YFDY | WGQGTL VTVSS |
| iPS:43 4341 | VH4\|4-59\|D4\|4-11\|RF2\|JH4 | | ......F... | ....A.. | ..R.T..IS.. | ...M... | FS.G--..F.. | |
| | Germline | H_FR1 | H_CDR1 | H_FR2 | H_CDR2 | H_FR3 | H_CDR3 | H_FR4 |
| VH3\|3-33\|D7T-27\|RF2\|JH4 | | QVQLVES GGGVQPGRSLR LSCAASG-FTFS | S-----YGMH | WVRQAPG KGLEWVA | VIWYD GSNKYYAD SVKG | RFTISRDNSKNTLYLQM NSLRAEDTAVYYCAR | -------GAG- ----YFDH | WGQGTL VTVSS |

| | | H_FR1 | H_CDR1 | H_FR2 | H_CDR2 | H_FR3 | H_CDR3 | H_FR4 |
|---|---|---|---|---|---|---|---|---|
| VH3|3-33|D|3-10|RF1|JH4 | | QVQLVES GGGVVQPGR SLRLSCAASG FTFS | S YGMH | WVRQAPGKG LEWVA | VISYD GSNKYYADS VKG | RFTISRDNSKNTLYLQMN SLRAEDTAVYYCAR | XXLRFDS | WGQGTL VTVSS |
| iPS:43 4433 | VH3|3-33|D|3-10|RF1|JH4 | .................... | ........L... | ............ | ...I........E.... | .................... | D...D---..-FR... | ........ |
| | Germline | H_FR1 | H_CDR1 | H_FR2 | H_CDR2 | H_FR3 | H_CDR3 | H_FR4 |
| VH3|3-23|D|6-13|RF1|JH4 | | EVQLLES GGGLVQPGGSL RLSCAASG FTFS | S YAMS | WVRQAPGKG LEWVS | AISGS GGSTYYA DSVKG | RFTISRDNSKNTLYLQMN SLRAEDTAVYYCAR | XXYFDV | WGQGTL VTVSS |
| iPS:43 4467 | VH3|3-23|D|6-13|RF1|JH4 | .........S.......... | .......N.... | ............ | ....D..R..T.F.... | .................... | WD......Y...DVTP... | ........ |
| | Germline | H_FR1 | H_CDR1 | H_FR2 | H_CDR2 | H_FR3 | H_CDR3 | H_FR4 |
| VH4|4-34|D|4-17|RF2|JH4 | | QVQLQQW GAGLLKPSETLS LTCAVYG-GSFS | TYWS | WIRQPPGK GLEWIG | YIHY SGSTNYNP SLKS | RVTISVDTSKNQFSLKL SSVTAADTAVYYCAR | DTGDY | WGQGTL VTVSS |
| iPS:43 4471 | VH4|4-34|D|4-17|RF2|JH4 | ...................L | .....S...... | ............ | ..........L...... | .R............S..T.. | ...G-...-L.. | ........ |
| iPS:43 4517 | VH4|4-34|D|4-17|RF2|JH4 | .................... | .....C...... | ............ | ..........R...... | .................E.. | ...G-...-L.. | ....A.. |
| iPS:43 4519 | VH4|4-34|D|4-17|RF2|JH4 | .................... | .....S...... | ............ | ..........L...... | .R............S..T.. | ...G-...-L.. | ........ |
| iPS:43 4571 | VH4|4-34|D|4-17|RF2|JH4 | .................... | .....C...... | ............ | ..........R...... | .................E.. | ...G-...-L.. | ........ |
| iPS:43 4637 | VH4|4-34|D|4-17|RF2|JH4 | .................... | .....S...... | ............ | ..........L...... | .R............S..T.. | ...G-...-L.. | ........ |
| iPS:43 4717 | VH4|4-34|D|4-17|RF2|JH4 | .................... | .....C...... | ............ | ..........R...... | ................EK.. | ...G-...-L.. | ........ |
| iPS:43 4735 | VH4|4-21-225_80B10|D|4-17|RF2|JH4 | .................... | .....C...... | ............ | .................. | .................... | ...G-...-L.. | ........ |

FIGURE 52 (Continued)

| | | | | | | | | | |
|---|---|---|---|---|---|---|---|---|---|
| iPS:43 4835 | 21-225_83B6 | VH4|4-34/D4|4-17/RF2/JH4 | .................. | C................. | .................. | ......R........... | ......E........... | ...G-............-L.. | .................. |
| iPS:43 4849 | 21-225_83C10 | VH4|4-34/D4|4-17/RF2/JH4 | ................T. | .................. | .................. | ......R.F......... | ......F........... | ...G-............-L.. | .................. |
| iPS:43 4891 | 21-225_85G6 | VH4|4-34/D4|4-17/RF2/JH4 | .................. | D....C............ | .................. | ......R........... | ......E........... | ...G-............-L.. | .................. |
| iPS:43 5183 | 21-225_93E9 | VH4|4-34/D4|4-17/RF2/JH4 | ..............G... | A...C............. | .................. | ......R....K...... | ......E.K......... | ...G-............-L.. | .................. |
| iPS:43 5331 | 21-225_147G8 | VH4|4-34/D4|4-17/RF2/JH4 | .................. | .....C............ | .................. | ......Q........... | .................. | ...V-............... | .................. |
| iPS:43 5995 | 21-225_192F8 | VH4|4-34/D4|4-17/RF2/JH4 | .................. | ....P............. | ......S........... | ...RS.............R | ......T........... | .................-L.. | .................. |
| iPS:43 6027 | 21-225_193E6 | VH4|4-34/D4|4-17/RF2/JH4 | .........F........ | Y.....F........... | ...S..F........... | ......S..........R | ..............R... | ...G-............-L.. | .................. |
| iPS:43 6080 | 21-225_195B1 | VH4|4-34/D4|4-17/RF2/JH4 | ......S........... | P................. | .................. | ......R...........R | .................. | ...A-.............I. | .................. |
| iPS:43 6232 | 21-225_201E1 | VH4|4-34/D4|4-17/RF2/JH4 | FD................ | V.....T........... | .................. | ......V........... | .................. | .................... | ...A.............. |
| iPS:43 6238 | 21-225_201B2 | VH4|4-34/D4|4-17/RF2/JH4 | ..F............... | P................. | .................. | .................. | .................. | ...G-............-L.. | .................. |
| iPS:43 6256 | 21-225_202D9 | VH4|4-34/D4|4-17/RF2/JH4 | ...D.............. | .................. | .................. | .................. | .................. | ...V-............-L.. | .................. |
| iPS:43 6302 | 21-225_205G7 | VH4|4-34/D4|4-17/RF2/JH4 | .................. | V................. | .................. | S.Q....R.T........I | ..............M... | ...V-............... | .................. |

FIGURE 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:43 6310 | 21-225_202D11 | VH4/4-34/D4/4-17[RF2/J H4 | ......R....... | .............. | ............ | ............ | ............ | V-- | ..... |
| iPS:43 6336 | 21-225_208B5 | VH4/4-34/D4/4-17[RF2/J H4 | A............. | .........V...T | .............. | ............ | ............ | --L.. | ..... |
| iPS:43 6340 | 21-225_208A9 | VH4/4-34/D4/4-17[RF2/J H4 | .....F...I.... | .............. | .............. | ............ | ......I..... | V-- | ..... |
| iPS:43 6340 | 21-225_208A9 | VH4/4-34/D4/4-17[RF2/J H4 | .........P.... | .........V..S. | .............. | ...RA.. | ............ | --L.. | ..... |
| iPS:43 7340 | 21-225_75G9 | VH4/4-34/D4/4-17[RF2/J H4 | .............. | .........C.... | .............. | ...R.. | ......E..... | G-- | ..... |
| iPS:45 1122 | 21-225_200A1 | VH4/4-34/D4/4-17[RF2/J H4 | .............. | .........V.... | .............. | ............ | ......L..... | V-- | ..... |
| Germline VH3|3-33|D2|2-15[RF3/JH1 | | QVQLVES GGGVVQPGRSLR LSCAASG-FTFS | S--SYMH | WVRQAPGK GLEWVA | VISYD GSNKYYAD SVKG | RFTISRDNSKNTLYLQM NSLRAEDTAVYYCAR | DIYYYYAL TAEYFDH | WGQGTL VTVSS |
| iPS:43 4485 | 21-225_76D2 | VH3|3-33|D2|2-15[RF3/J H1 | .............. | .............. | .............. | ............ | ..........F..... S | .RNI.G---T..ES | ..... |
| iPS:43 4537 | 21-225_74E11 | VH3|3-33|D2|2-15[RF3/J H1 | .........T.... | .............. | .............. | ............ | ..........F..... S | .RNI.G---T..ES | ..... |
| iPS:43 4673 | 21-225_74E3 | VH3|3-33|D2|2-15[RF3/J H1 | .............. | .............. | .............. | ............ | ..........F..... S | .RNI.G---T..ES | ..... |
| iPS:43 5221 | 21-225_95G2 | VH3|3-33|D2|2-15[RF3/J H1 | .........T.... | .............. | .............. | ............ | ..........F..... S | .RNI.G---T..ES | ..... |
| | Germline | H_FR1 | H_CDR1 | H_FR2 | H_CDR2 | H_FR3 | H_CDR3 | H_FR4 |
| VH4|4-39|D7|7-27[RF1JH5 | | QVQLQES GPGLVKPSETLS LTCTVSGGSIS | | | | | WFDP | WGQGIL VTVSS |

| | | H_FR1 | H_CDR1 | H_FR2 | H_CDR2 | H_FR3 | H_CDR3 | H_FR4 |
|---|---|---|---|---|---|---|---|---|
| VH1 1-08/D3 3-22/RF2JH6 | | QVQLVQS... CGPSVKVSCK ASGYTFT | SYYMH | WVRQAPGQGLR WMG | IINPSGGSTSYAQ KFQG | RVTMTRDTSISTVYMEL SSLRSEDTAVYYCAR | FYDSSGYY... FDYWGQ | WGQGTL VTVSS |
| iPS:43 4977 | 21-225_88A5 | VH1 1-08/D3 3-22/RF2JH6 | | | | | ....W.....R....... | GF..FLTG.S... ..PT....D.... | ......... |
| iPS:43 5259 | 21-225_96C6 | VH1 1-08/D3 3-22/RF2JH6 | | | ..R.. | | ....W............ | GG..VLPGN- N....D.... | ......... |
| Germline | | H_FR1 | H_CDR1 | H_FR2 | H_CDR2 | H_FR3 | H_CDR3 | H_FR4 |
| VH3 3-33/D2 2-15/RF3JH3 | | QVQLVES... GGGVVQPGRSLR LSCAASGFTFS | SYGMH | WVRQAPGK GLEWVA | ISSKYIAD SYKG | RFTISRDSNKNTLYLQM NSLRAEDTAVYYCAR | ...AIDAFDI | WGQGTM VTVSS |
| iPS:43 5291 | 21-225_146E1 | VH3 3-33/D2 2-15/RF3JH3 | ........I.... | | ...I... | | ...........F.... | RL.GAT. ...-A. | ......... |
| iPS:43 6360 | 21-225_210H11 | VH3 3-33/D2 2-15/RF3JH3 | | ...H... | | ...T... ...D... | | RL.GAT. ...-- | ......... |
| iPS:43 6370 | 21-225_211A6 | VH3 3-33/D2 2-15/RF3JH3 | | | | ....N.. | ............F.... | RT.GY- ..G... | ......... |
| iPS:43 6392 | 21-225_213B3 | VH3 3-33/D2 2-15/RF3JH3 | | | | ....N.. | | RT.GY- ..G... | ......... |
| iPS:43 6406 | 21-225_214E4 | VH3 3-33/D2 2-15/RF3JH3 | | | | ..EN... | .....I........... | RT.GY- ..GC... | ....A.. |
| iPS:43 7326 | 21-225_75C10 | VH3 3-33/D2 2-15/RF3JH3 | | | | ....D.. | | RL.GAT. ...-V. | ......... |
| Germline | | H_FR1 | H_CDR1 | H_FR2 | H_CDR2 | H_FR3 | H_CDR3 | H_FR4 |
| VH4 4-39/D7 7-27/RF1JH4 | | QLQLQES GPGLVKPSETL SLTCTVSGGSIS | SSYWG | WIRQPPGKGLEWIG | SIYYSGSTY YNPSLKS | RVTISVDTSKNQFSLKLS SVTAADTAVYYCAR | DLLW | ......... |
| iPS:43 5293 | 21-225_146F1 | VH4 4-39/D7 7-27/RF1JH4 | | R..... | | ....S.. | | DLLW..... ......S... | ......... |

FIGURE 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:43 225_148E11 5361 | VH4|4-39/D7|7-27|RF1/J H4 | ........V.... | R........ | ............ | ..........S. | ............ | .DPQW........ | ....I... |
| iPS:43 225_152H9 5449 | VH4|4-39/D7|7-27|RF1/J H4 | ............ | R........ | ............ | ..........AS | ..........F. | .DLQW....S..F | ........ |
| iPS:43 225_156G1 5499 | VH4|4-39/D7|7-27|RF1/J H4 | ............ | R........ | ............ | ..........AS | ..........F. | .DLQW....S..F | ........ |
| iPS:43 225_160H3 5587 | VH4|4-39/D7|7-27|RF1/J H4 | ............ | R........ | ............ | ..........S. ..E. | ..........F. | .SQRW....D... | ........ |
| iPS:40 225_19D11 3868 | VH4|4-39/D7|7-27|RF1/J H4 | ............ | R........ | ..D......... | ..........AN | ..........A. | .DRGW....S... | ........ |
| VH3|3-23/D4|4-17|RF2/JH5 | Germline | EVQLLES GGGLVQPGGSLR LSCAASG_FTFS | SYAMS | WVRQAPGK GLEWVS | AISGS GGSTYYAD SVKG | RFTISRDNSKNTLYLQM NSLRAEDTAVYYCAK | DYGTY_____NWFDP | WGQGTL VTVSS |
| iPS:43 225_146H1 5295 | VH3|3-23/D4|4-17|RF2/J H5 | ............ | ......... | ............ | ......R. ..N.F | ............ | RVT.GG........ ......ND...... | ........ |
| iPS:43 225_146E9 5307 | VH3|3-23/D4|4-17|RF2/J H5 | ............ | ....N.... | ............ | ......R. ..N.F | ..........K. | RVT.GG........ ......ND...... | ........ |
| iPS:43 225_148C4 5347 | VH3|3-23/D4|4-17|RF2/J H5 | ............ | ......... | ............ | ......R. ..N.F | ............ | RVT.GG........ ......ND...... | ........ |
| iPS:43 225_148H9 5355 | VH3|3-23/D4|4-17|RF2/J H5 | ............ | ......... | ............ | ......R. ..N.F | ............ | RVT.GG........ ......ND...... | ........ |
| iPS:43 225_149A3 5371 | VH3|3-23/D4|4-17|RF2/J H5 | ............ | N....T... | ............ | ......R. ..N.F | ..........T. | RVT.GG........ ......ND...... | ........ |

FIGURE 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 5415 | 21-225_150C11 | VH3|3-23|D4|4-17|RF2|JH5 | ................................ | ....N........ | ..................... | ..N.F............ | .........S..........................N... | RVT..GG.........ND... | ............ |
| iPS:43 5419 | 21-225_150C12 | VH3|3-23|D4|4-17|RF2|JH5 | ................................ | ............. | ..................... | ...R...........N.F............ | ....................................... | RVT..GG.........ND... | ............ |
| iPS:43 5425 | 21-225_151B12 | VH3|3-23|D4|4-17|RF2|JH5 | ................................ | ............. | ..........H.......... | KN.F............ | ....................................... | RVT..GG.........ND... | ............ |
| iPS:43 5431 | 21-225_152D2 | VH3|3-23|D4|4-17|RF2|JH5 | ................................ | ............. | ..................... | ...R...........N.F............ | ....................................K.. | RVT..GG.........ND... | ............ |
| iPS:43 5439 | 21-225_152G4 | VH3|3-23|D4|4-17|RF2|JH5 | ................................ | ............. | ..................... | ...R...........N.F............ | ....................................... | RVT..GG.........ND... | ............ |
| iPS:43 5455 | 21-225_152B11 | VH3|3-23|D4|4-17|RF2|JH5 | ................................ | ....N........ | ..................... | ...R...........N.F............ | ....................................... | RVT..GG.........ND... | ............ |
| iPS:43 5487 | 21-225_155C4 | VH3|3-23|D4|4-17|RF2|JH5 | ................................ | ............. | ..................... | ...R...........N.F............ | ....................................... | RVT..GG.........ND... | ............ |
| iPS:43 5503 | 21-225_156E4 | VH3|3-23|D4|4-17|RF2|JH5 | ................................ | ............. | ..................... | ...R...........N.F............ | ....................................... | RVT..GG.........ND... | ............ |
| Germline VH3|3-30|D3|3-22|RF3|JH6 | | QVQLVES GGGLVQPGRSLR LSCAASG FTFS | SG---YYMS | WIRQAPGK GLEWVA | VISYD GSNKYYAD SVKG | RFTISRDNSKNTLYLQM NSLRAEDTAVYYCAR | LNMVKVI VPTYYGMDV | WGQGTT VTVSS |
| iPS:43 5297 | 21-225_146B3 | VH3|3-30|D3|3-22|RF3|JH6 | | | | ...W...........Y...... | ........................D.......V | MGIE.A.D-.........DAFDI | |
| Germline VH4|4-30.1|D11-1|RF1|JH3 | | QVQLQES GPGLVKPSQTLS LTCTVSG GSIS | SG---YYWS | WIRQHPGK GLEWIG | YIYY SGSTYYNP SLKS | RVTISVDTSKNQFSAL KLSSVTAADTAVYYCAR | GTST-----------DAFDI | WGQGTM VTVSS |

Image too low resolution to reliably transcribe the tabular sequence alignment data.

FIGURE 52 (Continued)

Table content too low-resolution to transcribe reliably.

FIGURE 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 5723 | 21-225_172B7 | VH3j3-33|D3|3-22|RF2/JH4 | ........... | ........... | ........ I ....... V. | ................ | EA..FW-SG.W... | ........ |
| iPS:43 5731 | 21-225_173A11 | VH3j3-33|D3|3-22|RF2/JH4 | ........... | ........... | ........ I ........ | ................ | EA..FW-SGF..S | ........ |
| iPS:43 5781 | 21-225_178G10 | VH3j3-33|D3|3-22|RF2/JH4 | ........... | ...T....... | ........ | ........F....... | ER..FW-SGH... | ........ |
| iPS:43 5899 | 21-225_188G1 | VH3j3-33|D3|3-22|RF2/JH4 | ........... | ........... | ........T | ........ I ....Y. | ................ | ER..FW-SGH... | ........ |
| iPS:43 6602 | 21-225_226E7 | VH3j3-33|D3|3-22|RF2/JH4 | ........... | ...T....... | ........ | ........ I ....... | ........ H....D. | EN..FW-SG.YG. | ........ |
| iPS:39 2930 | 21-225_25H9 | VH3j3-33|D3|3-22|RF2/JH4 | ........F.N | ...N....... | ........S | ........ I ....Y. | ................ | EG..FW-SGF..S | ........ |
| | Germline | | H_FR1 EVQLLES GGGLVQPGGSLR LSCAASG-FTFS | H_CDR1 S...YAMS | H_FR2 WVRQAPGK GLEWVS | H_CDR2 AISGS GGSTYYAD SVKG | H_FR3 RFTISRDNSKNTLYLQM NSLRAEDTAVYYCAK | H_CDR3 V--NLL ...SFFD | H_FR4 WGQGTL VTVSS |
| iPS:43 5479 | 21-225_154E9 | VH3j3-23|D1|1-26|RF2/JH4 | ...K....... | ........... | ........ | ........ R..... .M.F.... | ........F....... | RGFRFLE ....WLGG.... | ........ |
| | Germline | | H_FR1 EVQLLES GGGLVQPGGSLR LSCAASG-FTFS | H_CDR1 S...YAMS | H_FR2 WVRQAPGK GLEWVS | H_CDR2 AISGS GGSTYYAD SVKG | H_FR3 RFTISRDNSKNTLYLQM NSLRAEDTAVYYCAK | H_CDR3 CYSYG ----YYRD | H_FR4 WGQGTL VTVSS |
| iPS:43 5497 | 21-225_155H9 | VH3j3-23|D5|5-18|RF3/JH4 | ........... | ........... | ........ | ........T..R..... ....LG... | ................L | DHD..DY ....NI.... | ........ |
| | Germline | | H_FR1 EVQLLES GGGLVQPGGSLR LSCAASG-FTFS | H_CDR1 S...YAMS | H_FR2 WVRQAPGK GLEWVS | H_CDR2 AISGS GGSTYYAD SVKG | H_FR3 RFTISRDNSKNTLYLQM NSLRAEDTAVYYCAK | H_CDR3 GYSSGW -VDAFDI | H_FR4 WGQGTM VTVSS |

FIGURE 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 5513 | 21-225_157F3 | VH3\|3-23\|D6\|6-19\|RF1\|JH3 | .........T........... | ..........V...... | ................. | ................. | RS.GWY....E..L... | ..........K |
| iPS:39 2766 | 21-225_23H4 | VH3\|3-23\|D6\|6-19\|RF1\|JH3 | .......E...... | ........N............ | ........V.T.P... | ................. | RN......H.V.... | ........... |
| iPS:39 2808 | 21-225_20F8 | VH3\|3-23\|D6\|6-19\|RF1\|JH3 | ...........R | .....I.....R..... | .............S... | ........S........ | R.N......H.V.... | ........... |
| Germline | | QLQLQES GPGLVKPSETL SLTCTVSGGSIS H_FR1 | SS SYYWG H_CDR1 | WIRQPPGK GLEWIG H_FR2 | SIYY SGSTNYNP SLKS H_CDR2 | RVTISVDTSKNQFSLKL SSVTAADTAVYYCAR H_FR3 | RIYYYY H_CDR3 | WGQGTL VTVSS H_FR4 |
| VH4\|4-39\|D2\|2-21\|RF3\|JH4 | | | | | | | ...........AYFDI | |
| iPS:43 5525 | 21-225_157E7 | VH4\|4-39\|D2\|2-21\|RF3\|JH4 | .....H........... | ......G......... | ................. | .............N... | ........K.AG— | ........... |
| Germline | | QVQLVES GGGVVQPGRSLR LSCAASGFTFS H_FR1 | S SYGMH H_CDR1 | WVRQAPGK GLEWVA H_FR2 | VIWYD GSNKYYAD SVKG H_CDR2 | RFTISRDNSKNTLYLQM NSLRAEDTAVYYCAR H_FR3 | VYYSSSSYY YYYYGMDV H_CDR3 | WGQGTT VTVSS H_FR4 |
| iPS:43 5543 | 21-225_158D4 | VH3\|3-33\|D3\|3-10\|RF2\|JH6 | .....D......V... | ................. | ..........S....... | ................. | EP.T..W— | ........... |
| iPS:43 5571 | 21-225_159C8 | VH3\|3-33\|D3\|3-10\|RF2\|JH6 | .....D......V.Q | ................. | ................. | ................. | EP.N..W—..D..... | ........... |
| iPS:43 5591 | 21-225_160C4 | VH3\|3-33\|D3\|3-10\|RF2\|JH6 | .....D......V.Q | ................. | ................. | ................. | EP.N..W—..D..... | ........... |
| iPS:43 5615 | 21-225_161G12 | VH3\|3-33\|D3\|3-10\|RF2\|JH6 | .....D......V.Q | ................. | ................. | ................. | EP.N..W—..D..... | ........... |
| iPS:43 6604 | 21-225_226F7 | VH3\|3-33\|D3\|3-10\|RF2\|JH6 | ................. | ................. | ..........I...... | ................. | ER.N..W—..D..L.. | ........... |

FIGURE 52 (Continued)

| | | H_FR1 | H_CDR1 | H_FR2 | H_CDR2 | H_FR3 | | H_CDR3 | H_FR4 |
|---|---|---|---|---|---|---|---|---|---|
| iPS:45 1114 | 21-225_159A3 | VH3\|3-33\|D3\|3-10\|RF2\|JH6 | ........ | D........V.Q | ........ | ........ | ........ | I........ | EP.N..W---- .D... | ........ |
| iPS:47 2732 | 21-225_2B10_L_C1 | VH3\|3-33\|D3\|3-10\|RF2\|JH6 | ........ | ........ | ........V | ........ | ........ | ........S | ER.T..W---- .D... | ........ |
| iPS:47 2733 | 21-225_2B10_L_C2 | VH3\|3-33\|D3\|3-10\|RF2\|JH6 | ........ | ........V | ........ | ........ | ........V | ........S | ER.T..W---- .D... | ........ |
| iPS:39 2872 | 21-225_20B11 | VH3\|3-33\|D3\|3-10\|RF2\|JH6 | ........ | ........V | ........ | ........ | ........V | ........S | ER.T..W---- .D... | ........ |
| iPS:39 3966 | 21-225_7F8 | VH3\|3-33\|D3\|3-10\|RF2\|JH6 | ........ | ........CV. | ........ | ........ | ........V | ........N | HD... | ........ |
| VH3\|3-23\|D1\|1-1\|RF1\|JH6 | | Germline | H_FR1 EVQLLES GGGLVQPGGSLR LSCAASG_FTFS | H_CDR1 IAMS | H_FR2 WVRQAPGK GLEWVS | H_CDR2 AISGS GGSTYYAD SVKG | H_FR3 RFTISRDNSKNTLYLQM NSLRAEDTAVYYCAR | | H_CDR3 GITGIYY YYGMDV | H_FR4 WGQGT TVTVSS |
| iPS:43 5559 | 21-225_158H12 | VH3\|3-23\|D1\|1-1\|RF1\|JH6 | ........V... | ........V | ........ | ........R.D. | ........ | | .GW------ --NHD | ........ |
| VH3\|3-21\|D1\|1-1\|RF1\|JH6 | | Germline | H_FR1 EVQLLES GGGLVKPGGSLR LSCAASG_FTFS | H_CDR1 SYSMN | H_FR2 WVRQAPGK GLEWVS | H_CDR2 SISSS SSYIYYAD SVKG | H_FR3 RFTISRDNAKNSLYLQM NSLRAETTAVYYCAR | | H_CDR3 GITGIYY YYYGMDV | H_FR4 WGQGT TVTVSS |
| iPS:43 5561 | 21-225_159F1 | VH3\|3-21\|D1\|1-1\|RF1\|JH6 | ........ | ........R.. | ........ | GN..D...G | ........ | | .W------ | ........ |
| VH1\|1-08\|D1\|1-1\|RF1\|JH4 | | Germline | H_FR1 QVQLVQS GAEVKKPGASVK VSCKASG_YTFT | H_CDR1 SYDIN | H_FR2 WVRQATGQ GLEWMG | H_CDR2 WMNPN SGNTGYAQ KFQG | H_FR3 RVTMTRNTSIST AYMELSSLRSEDTAVYYCAT | | H_CDR3 STGT VFDI | H_FR4 WGQGT MVTVSS |
| iPS:43 5563 | 21-225_159H2 | VH1\|1-08\|D1\|1-1\|RF1\|JH4 | ........ | ........ | ........ | ........V | ........ | | KK.---- --G... | ........ |

| | | | | | R....... | .......Y. | .....Y. | ....N...A.HI. | N............ | HDP.W | .........-GV.Y |
|---|---|---|---|---|---|---|---|---|---|---|---|
| iPS:43 5599 | 21-225_160B10 | VH4/4-39/D1/1-1/RF3/JH5 | | | | | | | | | |
| | | Germline | H_FR1 QVQLVES GGGLVQPGGSLR LSCAASGFTFS | H_CDR1 SGWH | H_FR2 WVRQAPGK GLEWVS | H_CDR2 VIWD GSNKYYAD SVKG | H_FR3 RFTISRDNSKNTLY LQMNSLRAEDTAVYYCAR | H_CDR3 | H_FR4 WGQGTT VTVSS |
| iPS:43 5601 | 21-225_160G10 | VH3/3-33/D1/1-1/RF2/JH6 | ........F... | | | .........Y..... | | .............. | .GI.VAGD.......F..E. | |
| iPS:43 5655 | 21-225_167E2 | VH3/3-33/D1/1-1/RF2/JH6 | ........F... | | | .........TY.... | | .............. | .GI.VAGD.........E. | |
| iPS:43 5657 | 21-225_167H10 | VH3/3-33/D1/1-1/RF2/JH6 | ........Q.... | | | .........Y..H. | | .............. | .GI.VAGD.........E. | |
| | | Germline | H_FR1 EVQLVET GGGLIQPGGSLR LSCAASG-FTVS | H_CDR1 SNYMS | H_FR2 WVRQAPGK GLEWVS | H_CDR2 VYSG GSTYYAD SVKG | H_FR3 RFTISRDNSKNTLY LQMNSLRAEDTAVYYCAR | H_CDR3 NWGY | H_FR4 WGQGTT VTVSS |
| iPS:43 5605 | 21-225_161A4 | VH3/3-53/D7/7-27/RF3/JH4 | .......S...... | | | .........T..N. | | .......N...... | ......MA....GP....FDY | |
| | | Germline | H_FR1 QVQLVES GGGLVQPGGSLR LSCAASG-FTFS | H_CDR1 SYAMH | H_FR2 WVRQAPGK GLEWVA | H_CDR2 VISYD GSNKYYAD SVKG | H_FR3 RFTISRDNSKNTLY LQMNSLRAEDTAVYYCAR | H_CDR3 EYSSSSY | H_FR4 WGQGTT VTVSS |
| iPS:43 5607 | 21-225_161G4 | VH3/3-30.3/D6/6-6/RF1/JH6 | | | .........G... | .........G..H. | .............V. | RS....G--- | .G....... | |
| iPS:39 3020 | 21-225_30E2 | VH3/3-30.3/D6/6-6/RF1/JH6 | | | .........G... | .........G.F.V | .............V. | RGY...G--- | .G....... | |

| VH3|3-33|D3|3-9|RF2|JH4 | CDR1 GGTVSSNSAASG FMS | CDR2 WYDGSNKYYAD SVKG | CDR3 EFLSRGWSLLLGY RLPGDYYFDY | FW4 DPLRGYN..... -DPVM.. | Mouse ID |
|---|---|---|---|---|---|
| iPS:43 5663 21-225_169B1 | VH3|3-33|D3|3-9|RF2|JH4 | ........... | ..........R. | ...................... | DPLRGYN..... -DPVM.. | ..... ..... |
| iPS:43 5669 21-225_169F9 | VH3|3-33|D3|3-9|RF2|JH4 | ........... | ....S..... | ..I......... .T......... | ...........L. | DPLRGYN..... -DPVM.. | ..... ..... |
| iPS:43 5693 21-225_170G4 | VH3|3-33|D3|3-9|RF2|JH4 | ........T. | ....S..... | ..I......... .T......... | .........M. ......F..L. | DPLRGYN..... -DPVM.. | ..... ..... |
| iPS:43 5695 21-225_170D5 | VH3|3-33|D3|3-9|RF2|JH4 | ........... | .......... | ..I......... .T......... | ...........L. | DPLRGYN..... -DPVM.. | ..... ..... |
| iPS:43 5697 21-225_170G5 | VH3|3-33|D3|3-9|RF2|JH4 | ....G..... | ....T..... | ..I......... .T......... | .........S. ......F.... | DPLRGYN..... -DPVM.. | ..... ..... |
| iPS:43 5703 21-225_170D11 | VH3|3-33|D3|3-9|RF2|JH4 | ....G..V.. | ....T..... | ..I......... .T......... | ............ | DPLRGYN..... -DPVM.. | ..... ..... |
| iPS:43 5705 21-225_171C3 | VH3|3-33|D3|3-9|RF2|JH4 | ....G..... | ....T..... | ..I......... .T......... | ............ | DPLRGYN..... -DPVM.. | ..... ..... |
| iPS:43 5709 21-225_171A4 | VH3|3-33|D3|3-9|RF2|JH4 | ....F..... | ....T..... | ............ | ............ | DPLRGYN..... -DPVM.. | ..... ..... |
| iPS:43 5721 21-225_172B3 | VH3|3-33|D3|3-9|RF2|JH4 | ....M..... | ....M..... | ..I......... .T......... | ............ | DPLRGYN..... -DPVM.. | ..... ..... |
| iPS:43 5725 21-225_172G8 | VH3|3-33|D3|3-9|RF2|JH4 | ........... | .......... | ..I......... .T......... | ...........L. | DPLRGYN..... -DPVM.. | ..... ..... |
| iPS:43 5735 21-225_173H12 | VH3|3-33|D3|3-9|RF2|JH4 | ........... | .......... | ..I......... .T......... | ...........L. | DPLRGYN..... -DPVM.. | ..... ..... |

| | | H_FR1 | H_CDR1 | H_FR2 | H_CDR2 | H_FR3 | H_CDR3 | H_FR4 |
|---|---|---|---|---|---|---|---|---|
| iPS.39 8474 | VH3|3-23|D5|5-24|RF3|J H3 | . . . . . . . . . . . . . . . . . . . . . . . . . . . . . . . . R | | . . . . . . . . . . . . . . . . . . . | . . . . . V . . . . N . F . . . | . . . . . . . . . . . . . . . . . . . . D . . . . . . . . . . . | . GIPEA . . . . . . . . . . . . | |
| | Germline | H_FR1 | H_CDR1 | H_FR2 | H_CDR2 | H_FR3 | H_CDR3 | H_FR4 |
| | VH1|1-02|D1|1-1|RF1|JH3 | QVQLVQS GAEVKKPGASVK VSCKASG-FTFS | G------YYMH | WVRQAPGQ GLEWMG | IINPN SGGTNYAQ KFQG | RVTMTRDTSISTAYMEL SRLRSDDTAVYYCAR | GTTIT-- -----DAFDI | WGQGTL VTVSS |
| iPS.43 5745 | VH1|1-02|D1|1-1|RF1|JH3 | . . . . . . . V . . . . . . . . . . . . . . . . . . . . . . . . . | . . . . . . . F . . . | . . . . . . . . . . . | . . . K . K . . . . C . . . . | . . . . . . . . . . . . . . . . . T . . . . . . . . . . R . . . . . | . G . TVTT . . . WGV . . Y | . . . . . . . . . . . |
| iPS.43 7270 | VH1|1-02|D1|1-1|RF1|JH3 | . . . . . . . . . . . . . . . . . . . . . . . . . . . . . . . . . | . . . . . . . F . . . | . . . . . . . . . . . | . . . K . K . . . . C . . . . | . . . . . . . . . . . . . . . . . V . . . . . . . . . . . . . . . . | . G . TVTT . . . WGV . . Y | . . . . . . . . . . . |
| | Germline | H_FR1 | H_CDR1 | H_FR2 | H_CDR2 | H_FR3 | H_CDR3 | H_FR4 |
| | VH3|3-23|D3|3-22|RF2|JH4 | EVQLLES GGGLVQPGGSLR LSCAASG-FTFS | S------YAMS | WVRQAPGK GLEWVS | AISGS GGSTYYAD SVKG | RFTISRDNSKNTLYLQM NSLRAEDTAVYYCAK | VVYDSSG ------YYYYFDY | WGQGTL VTVSS |
| iPS.43 5769 | VH3|3-33|D3|3-22|RF2|JH4 | . . . . . . . . . . . . . . . . . R . . . . E . . . . . . . . . . | . . . . . . . . . . . | . . . . . . . . . . . | . . . SN . . V . . . . . . . | . . . . . . . . . . . . . . . . . S . . . . . T . . . . . . . . . . | G . . . . . . . . . P . . F | . . . . . . . . . . . |
| | Germline | H_FR1 | H_CDR1 | H_FR2 | H_CDR2 | H_FR3 | H_CDR3 | H_FR4 |
| | VH3|3-33|D3|3-22|RF2|JH1 | QVQLVES GGGLVQPGRSLR LSCAASG-FTFS | S------YGMH | WVRQAPGK GLEWVA | VIWYD GSNKYYAD SVKG | RFTISRDNSKNTLYLQM NSLRAEDTAVYYCAR | YYYDSSGY ------YYAEFQH | WGQGTL VTVSS |
| iPS.43 5771 | VH3|3-33|D3|3-22|RF2|JH1 | . . . . . . . . . . . . . . . . . . . T . . . . . . . . . . . . | . . . . . . . . . . . | . . . . . . . . . . . | . . . I . . . Y . . T . . . | . . . . . . . . . . . . . . . . . . . . . . . . . . . . . . . . . | ET . FW-- . SG . . VF | . . . . . . . . . . . |
| | Germline | H_FR1 | H_CDR1 | H_FR2 | H_CDR2 | H_FR3 | H_CDR3 | H_FR4 |
| | VH3|3-23|D5|5-24|RF3|JH4 | EVQLLES GGGLVQPGGSLR LSCAASG-FTFS | S------YAMS | WVRQAPGK GLEWVS | AISGS GGSTYYAD SVKG | RFTISRDNSKNTLYLQM NSLRAEDTAVYYCAK | RFDY-- ------YYFDY | WGQGTL VTVSS |
| iPS.43 5775 | VH3|3-23|D5|5-24|RF3|JH4 | . . . . . . . H . . . . T . . . . . . . . . . . . . . . . . . . | . . . . . . . . . . . | . . . . . . . . . . . | . . . V . . . N . F . . . | . . . . . . . . . . . . . . . . . . . . . . . . . . . . R . . . . | . . . D- . . . . . . . . | . . . . . . . . . . . |
| iPS.43 7214 | VH3|3-23|D5|5-24|RF3|JH4 | . . . . . . . . . . . . . . . . . . . . . . . . . . . . . . . . . | . . . . . N . . . . . | . . . . . . . . . . . | . . . R . . . N . F . . . | . . . . . . . . . . . . . . . . . . . . . . . . . . . . . . . . . | ET . WN . . . YEG . . . | . . . . . . . . . . . |

FIGURE 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:39 3028 | 21-225_25D7 | VH3\|3-23\|D5\|5-24\|RF3/J H4 | | ........I..Q | ......R.. .T.F.... | | DGYGGN...... ........SF.... | |
| | | Germline | QVQLVES GGGVVQPGGSLR LSCAASG-FTFS | ....YAMH | WVRQAPGK GLEWVA | VISYD GSNKYYAD SVKG | RFTISRDNSKNTLYLQM NSLRAEDTAVYYCAR | | WGQGTT VTVSS |
| VH3\|3-33\|D4\|4-11\|RF3/J H6 | | | | | | | | H_FR4 |
| iPS:43 5789 | 21-225_180C4 | VH3\|3-33\|D4\|4-11\|RF3/J H6 | A........ | ....T.. | ......I... ...Y.... | ....A.. | .G.DPWD......... .........Y.N.... | |
| | | Germline | EVQLLES GGGLVQPGGSLR LSCAASG-FTFS | ....YAMS | WVRQAPGK GLEWVS | AISGS GGSTYYAD SVKG | RFTISRDNSKNTILYLQM NSLRAEDTAVYYCAK | | WGQGTL VTVSS |
| VH3\|3-23\|D2\|2-8\|RF1/J H3 | | | | | | | | H_FR4 |
| iPS:43 5799 | 21-225_181G3 | VH3\|3-23\|D2\|2-8\|RF1/J H3 | | | ....V.. | ...N.F.G ...... | ....I.. | .ET.D.G-- S...... | |
| | | Germline | QVQLVES GGGVVQPGGSLR LSCAASG-FTFS | ....YAMH | WVRQAPGK GLEWVA | VISYD GSNKYYAD SVKG | RFTISRDNSKNTLYLQM NSLRAEDTAVYYCAR | | WGQGTT VTVSS |
| VH3\|3-30.3\|D5\|5-18\|RF2/J H6 | | | | | | | | H_FR4 |
| iPS:43 5811 | 21-225_183H6 | VH3\|3-30.3\|D5\|5-18\|RF2/J H6 | | ........G... | | ...I..A. .T.F.... | ............V.. | RPPQ..V-.... ........EG.. | |
| iPS:43 6754 | 21-225_155G3 | VH3\|3-30.3\|D5\|5-18\|RF2/J H6 | .............T | ........G... | | | | DTER..P-.... .........S.. | |
| iPS:44 8908 | 21-225_50G9 | VH3\|3-30.3\|D5\|5-18\|RF2/J H6 | | ........G... | | ....Q.. ..IIR... | | DVKQ..V-.... .........RT.. | |
| | | Germline | QVQLVES GGGVVQPGGSLR LSCAASG-FTFS | ....YAMH | WVRQAPGK GLEWVA | VISYD GSNKYYAD SVKG | RFTISRDNSKNTLYLQM NSLRAEDTAVYYCAR | GVSSGM ...YWFDP | WGQGTL VTVSS |
| VH3\|3-30.3\|D6\|6-19\|RF1/J H5 | | H_FR1 | H_CDR1 | H_FR2 | H_CDR2 | H_FR3 | H_CDR3 | H_FR4 |

| | | H_FR1 | H_CDR1 | H_FR2 | H_CDR2 | H_FR3 | H_CDR3 | H_FR4 |
|---|---|---|---|---|---|---|---|---|
| | VH3-30/D4-4-17\|RF2/JH6 | EVQLVES GGGLVQPGGSLR LSCAASG-FTFS | SSY-WMS | WVRQAPGKGLEWVS | YISGSGGSTY YADSVKG | RFTISRDNSKNTLY LQMNSLRAEDTAVY YCAR | | WGQGTT VTVSS |
| iPS:43-5821 | 21-225_190E11 | VH3-30/D4-4-17\|RF2/JH6 | N.......... | ........... | I.WF....... | ..........N..... | AQ.V..- .V... | ........ |
| Germline | | H_FR1 | H_CDR1 | H_FR2 | H_CDR2 | H_FR3 | H_CDR3 | H_FR4 |
| | VH3-23/D5-12\|RF3/JH5 | EVQLLES GGGLVQPGGSLR LSCAASG-FTFS | SYAMS | WVRQAPGKGLEWVS | AISGSGGSTY YADSVKG | RFTISRDNSKNTLY LQMNSLRAEDTAVY YCAK | | WGQGTL VTVSS |
| iPS:43-5823 | 21-225_190F11 | VH3-23/D5-12\|RF3/JH5 | ......D... G........... | ...........N | ........... | T..T..... .RR.... | .......L........ | EEDY.S. ....SGPG. | ........ |
| iPS:43-5867 | 21-225_191E5 | VH3-23/D5-12\|RF3/JH5 | ......D... G........... | ...........N | ........... | T..T..... .RR.... | ................ | EEDY.S. ....SGPG. | ........ |
| iPS:43-5929 | 21-225_190D9 | VH3-23/D5-12\|RF3/JH5 | ......D... G........... | ........... | ........... | T..T..... .RR.... | ................ | EEDY.S. ....SGPG. | ........ |
| iPS:43-5935 | 21-225_190H8 | VH3-23/D5-12\|RF3/JH5 | ......D... G........... | ........... | ........... | T..T..... .RR.... | ................ | EEDY.S. ....SGPG. | ........ |
| Germline | | H_FR1 | H_CDR1 | H_FR2 | H_CDR2 | H_FR3 | H_CDR3 | H_FR4 |
| | VH4-39/D3-9\|RF1/JH4 | QLQLQES GPGLVKPSETLS LTCTVSG-GSIS | SSYYWG | WIRQPPGKGLEWIG | SIYYSGSTYY NPSLKS | RVTISVDTSKNQF SLKLSSVTAADTA VYYCAR | | WGQGTL VTVSS |
| iPS:43-5827 | 21-225_190H11 | VH4-39/D3-9\|RF1/JH4 | ........... | ------H.S | ........A. | L..T...... R..I.. | .........L..... | LRYNWN- FP.... | ........ |
| iPS:43-5853 | 21-225_191E3 | VH4-39/D3-9\|RF1/JH4 | ...........R | ------H.S | ........A. | L..T...... R..M.. | ........M..... | LRYNWN- FP.... | ........ |
| iPS:43-5871 | 21-225_191E6 | VH4-39/D3-9\|RF1/JH4 | ...........R | ........... | ........A. | L..T...... R..M.. | .N.....M...... | LRYNWN- FP...F | ........ |
| iPS:43-5927 | 21-225_190E7 | VH4-39/D3-9\|RF1/JH4 | ...........R | ------H.S | ........A. | H..T...... R..N.. | .........T...... | LRYNWN- FP.... | ........ |

FIGURE 52 (Continued)

| | | | | | | | | | |
|---|---|---|---|---|---|---|---|---|---|
| iPS:43_5999 | 21-225_192F9 | VH4|4-39|D3|3-9|RF1|JH4 | ........H.S | ................ | ........A... | .....L..T... | ......M.... | LRYNWN-- | ..... |
| iPS:43_6060 | 21-225_194F4 | VH4|4-39|D3|3-9|RF1|JH4 | ..............R | ................ | ............ | .....R..N... | ............ | FP.... | ..... |
| iPS:43_6193 | 21-225_198A10 | VH4|4-39|D3|3-9|RF1|JH4 | ........H.S | ................ | ........A... | .....L..T... | ......M..R..S | LRYNWN-- | ..... |
| | | | | | | | | FP.... | |
| | | | ........H.S | ................ | ........A... | .....H..T... | ............T. | LRYNWN-- | |
| | | | ..............R | ................ | ............ | .....R..N... | ............ | FP.... | |
| | | | H_FR1 | H_CDR1 | H_FR2 | H_CDR2 | H_FR3 | H_CDR3 | H_FR4 |
| | | Germline | QVQLQES GPGLVKPSQTL SLTCTVSGGSIS | SG CYYWS | WIRQHPGK GLEWIG | YIYY SGSTYYNP SLKS | RVTISVDTSKNQFSLKL SSVTAADTAVYYCAR | RGYSY YYFDL | WGQGTL VTVSS |
| iPS:43_5829 | 21-225_190B12 | VH4|4-30.1|D5|5-24|RF3|JH2 | ................ | ............N.. | ................ | ................ | ..........F..... | SGYNWD--------AGV.P | ..... |
| | | | H_FR1 | H_CDR1 | H_FR2 | H_CDR2 | H_FR3 | H_CDR3 | H_FR4 |
| | | Germline | QVQLVES GGGVVQPGRSLR LSCAASG FTFS | S YGMH | WVRQAPGK GLEWVA | VIWY DGSNKYY ADSVKG | RFTISRDNSKNTLYLQM NSLRAEDTAVYYCAR | DYSNYYY YYFGMDV | WGQGTT VTVSS |
| iPS:43_5835 | 21-225_190F12 | VH3|3-33|D4|4-11|RF2|JH6 | ................ | ...N............ | ................ | ........F...... | ................S | .R.VG.-- | ..... |
| iPS:43_5861 | 21-225_190A5 | VH3|3-33|D4|4-11|RF2|JH6 | .....G.......... | ................ | ................ | ........D...... | ................ | D.L.-- | ..... |
| iPS:43_5937 | 21-225_190H9 | VH3|3-33|D4|4-11|RF2|JH6 | ................ | ...N............ | ................ | ........F...... | ................S | .F.VG.-- | ..... |
| | | | | | | | | D...-- | |
| iPS:43_5977 | 21-225_192E4 | VH3|3-33|D4|4-11|RF2|JH6 | ................ | ................ | ................ | ......N.V...... | ................ | .R.VG.-- | ..... |
| | | | | | | | | ..R...... | |
| iPS:43_6001 | 21-225_192C10 | VH3|3-33|D4|4-11|RF2|JH6 | .S.............. | ...N............ | ....K........... | ........F...... | ................S | .R.VG.-- | ..... |
| | | | | | | | | D.L.-- | |

FIGURE 52 (Continued)

| | | | | | | | | |
|---|---|---|---|---|---|---|---|---|
| iPS:43 6066 | 21-225_194B7 | VH3|3-33|D4|4-11|RF2|J H6 | . . . . . . | . . . . . . | . . . . . . | . . . . . . | . . . . . . | .R.KG.- . . . . . |
| iPS:43 6078 | 21-225_194H12 | VH3|3-33|D4|4-11|RF2|J H6 | . . . . . . | N . . . | . . . F . . . . . D . . . | . . . . S . . . . . . . | . . . . . . | .R.VG.- .D . . . . .D.L.. |
| iPS:43 6140 | 21-225_197G3 | VH3|3-33|D4|4-11|RF2|J H6 | . . . . . . .R. | . . . . . . H . . . | . . . . . . . . . | . . . . . . | . . . . . . | .P.VG.- . . . . . |
| iPS:43 6167 | 21-225_197E11 | VH3|3-33|D4|4-11|RF2|J H6 | . . . . . . .R. | N . . . | . . . F . . . . . D . . . | . . . . S . . . . . . . | . . . . . . | .R.VG.- .D.L.. |
| iPS:43 6292 | 21-225_205H3 | VH3|3-33|D4|4-11|RF2|J H6 | . . . . . . | . . . . . . | . . . . . . | . . . . . . | . . . . . . | .R.VG.- .D.T.. |
| iPS:43 6802 | 21-225_171E12 | VH3|3-33|D4|4-11|RF2|J H6 | . . . . . . | . . . . . . | . . . N . . . .G...NG. | . . . . . . | . . . . . . | RTY.SGSGSP . .PYY . . . . . |
| iPS:43 8816 | 21-225_179H5 | VH3|3-33|D4|4-11|RF2|J H6 | . . . . . . | . . . . . . | . . . . . . E . . . | . . . . . . | . . . . . . | .IR . . . . .L . . . |
| iPS:43 6960 | 21-225_198D2 | VH3|3-33|D4|4-11|RF2|J H6 | . . . . . . .R. | . . . . . . | . . . I . Y . . . | . . . . . . | . . . . . . | .T..G----- . . . . . |
| iPS:43 6974 | 21-225_190H7 | VH3|3-33|D4|4-11|RF2|J H6 | . . . N.R | . . . . . . | . . . I . Y . . . | . . . . . . | . . . . . . | .T..G----- . . . . . |
| iPS:43 6982 | 21-225_190D10 | VH3|3-33|D4|4-11|RF2|J H6 | . . . . . .R | . . . . . . | . . . I . Y . . . | . . . . . . V . . | . . . . . . | .T..G----- . . . . . |
| iPS:43 7274 | 21-225_196D4 | VH3|3-33|D4|4-11|RF2|J H6 | . . . V . . . | . . . . . . | . . . .RN . . . . | . . . . . . | . . . . . . | .R.KG.- .D . . . . |
| iPS:39 2664 | 21-225_20F6 | VH3|3-33|D4|4-11|RF2|J H6 | . . . V . . . | . . . . . . .G | . . . H . . . . . . | . . . . A . . . . . . | . . . . . . | .L.MG--- . . . . . |

FIGURE 52 (Continued)

| | | | | | | | |
|---|---|---|---|---|---|---|---|
| iPS:39 2738 | 21-225_18G4 | VH3\|3-33/D4\|4-11\|RF2/JH6 | ........ | ........ | ........ | ........ | .L.MG--- |
| iPS:39 2798 | 21-225_22C7 | VH3\|3-33/D4\|4-11\|RF2/JH6 | ........ | .G...... | ....A... | ........ | .L.MG--- |
| iPS:39 2956 | 21-225_27A11 | VH3\|3-33/D4\|4-11\|RF2/JH6 | ..I..... | ........ | ..H..... | ........ | .S.P.--- |
| iPS:39 2994 | 21-225_26G11 | VH3\|3-33/D4\|4-11\|RF2/JH6 | ........ | ........ | ........ | ........ | R...SW--- / SG... |
| iPS:39 3014 | 21-225_26D12 | VH3\|3-33/D4\|4-11\|RF2/JH6 | ........ | ........ | ..E..... | ....A... | .S.P.--- |
| iPS:39 3152 | 21-225_25B3 | VH3\|3-33/D4\|4-11\|RF2/JH6 | ........ | ........ | ........ | ........ | .S.P.--- |
| iPS:39 3840 | 21-225_3F8 | VH3\|3-33/D4\|4-11\|RF2/JH6 | ..F..... | .G...... | ..H..... | ....A... | .L.MG--- |
| iPS:39 3930 | 21-225_7E11 | VH3\|3-33/D4\|4-11\|RF2/JH6 | ..I..... | ........ | ..I.H... | ...S.N.. | .L.MG--- |
| iPS:39 3964 | 21-225_6G1 | VH3\|3-33/D4\|4-11\|RF2/JH6 | ........ | ........ | ..I..... | ....M... | .L.MG--- |
| iPS:39 4012 | 21-225_15A3 | VH3\|3-33/D4\|4-11\|RF2/JH6 | ........ | ........ | ..H..... | ........ | .L.MG--- |
| iPS:39 4016 | 21-225_13D4 | VH3\|3-33/D4\|4-11\|RF2/JH6 | ........ | ........ | ..H..... | ....N... | .L.MG--- |
| iPS:39 4083 | 21-225_16E6 | VH3\|3-33/D4\|4-11\|RF2/JH6 | ........ | ........ | ..H..V.. | ........ | .L.MG--- |

FIGURE 52 (Continued)

| | Germline | H_FR1 | H_CDR1 | H_FR2 | H_CDR2 | H_FR3 | H_CDR3 | H_FR4 |
|---|---|---|---|---|---|---|---|---|
| | VH4J4-59|D3J3-9|RF1|JH4 | QVQLQES GPGLVRPSETLS LTCTVSG GSIS | S......YYWS | WIRQPPGK GLEWIG | SGSTYYNPS LKS | RVTISVDTSKNQFSLKL SSVTAADTAVYYCAR | | WGQGTT VTVSS |
| iPS:43_225_191B1 5839 | VH4J4-59/D3J3-9|RF1/JH4 | : : : : : : : : : : : : : : : | : : H : : | : : : : A : : | : : H . T : K : | : : : : : M : : : | LRYNWN- | : : : |
| iPS:43_225_197G8 6158 | VH4J4-59/D3J3-9|RF1/JH4 | : H : : : : | A : : : : : S : : | : : : : A : : | RLSP : : G : : F : | : : : : : M : : : | LRYNWN- FP : : : | : A . |
| | VH4J4-30.1|D3J3-22|RF2/JH6 | QVQLQES GPGLVRPSQTLS LTCTVSG GSIS | SG......GYYWS | WIRQHPGK GLEWIG | SGSIYYNP SLKS | RVTISVDTSKNQFSLKL SSVTAADTAVYYCAR | YYYYGMDV | WGQGTT VTVSS |
| iPS:43_225_191F1 5843 | VH4J4-30.1/D3J3-22|RF2/JH6 | : : : : : : : : : | : : : N : : | : : : : : : | : : : F : : | : : : : : : : | GD..G..S.- : : : : : : | : : : |
| iPS:43_225_191A3 5847 | VH4J4-30.1/D3J3-22|RF2/JH6 | : : : : : : : : : | : : D : : | : : : : : : | : : : F : : | : : : : : : : | GD..G..S.- H : : : | : : : |
| iPS:43_225_191D3 5851 | VH4J4-30.1/D3J3-22|RF2/JH6 | : K : : : : : : : | : : D : : | : : : D : : | : : : F : : | : : : : : : : | GD..G..S.- H : : : | : : : |
| iPS:43_225_190A3 5905 | VH4J4-30.1/D3J3-22|RF2/JH6 | : : : : : : : : : | : : D : : | : : : : : : | F.F : : : | : : : : : : N : | GD..G..S.- H : : : | : : : |
| iPS:43_225_190B4 5911 | VH4J4-30.1/D3J3-22|RF2/JH6 | : : : : : : : : : | : : : : : | : : : : : : | : : : F : : | : : : : : : : | GD..G..S.- H : : : | : : : |
| iPS:43_225_190A7 5913 | VH4J4-30.1/D3J3-22|RF2/JH6 | : N : : : : : : : | : : V : : | : : : : : : | : : : N : : | : : : : : H : : | GD..G..S.- H...L.. | : : : |

FIGURE 52 (Continued)

| | | | | | | | |
|---|---|---|---|---|---|---|---|
| iPS:43 21-<br>5939 225_191H7 | VH4J4-<br>30.1|D3J3<br>22|RF2/J<br>H6 | ....N | ....D....N | | .F | | GD..G..S..-<br>H. |
| iPS:43 21-<br>5967 225_192B3 | VH4J4-<br>30.1|D3J3<br>22|RF2/J<br>H6 | | ...D | ..R | F.F | .V | GD..G..S..-<br>HH |
| iPS:43 21-<br>5973 225_192H3 | VH4J4-<br>30.1|D3J3<br>22|RF2/J<br>H6 | | V..S | | NL<br>..R | A<br>T | GD..G..S..-<br>H..H |
| iPS:43 21-<br>6007 225_192G12 | VH4J4-<br>30.1|D3J3<br>22|RF2/J<br>H6 | | V.H | | N.H..N | | GD..G..S..-<br>H |
| iPS:43 21-<br>6009 225_193A1 | VH4J4-<br>30.1|D3J3<br>22|RF2/J<br>H6 | | ..V | | N | L..A | GD..G..S..-<br>H |
| iPS:43 21-<br>6011 225_193B1 | VH4J4-<br>30.1|D3J3<br>22|RF2/J<br>H6 | | ..V | | N | | GD..G..S..-<br>H |
| iPS:43 21-<br>6017 225_193F3 | VH4J4-<br>30.1|D3J3<br>22|RF2/J<br>H6 | | ...D....N | | .F | | GD..G..S..-<br>H |
| iPS:43 21-<br>6029 225_193H6 | VH4J4-<br>30.1|D3J3<br>22|RF2/J<br>H6 | ....N | ...D....N | | .F | | GD..G..S..-<br>H |
| iPS:43 21-<br>6035 225_193C8 | VH4J4-<br>30.1|D3J3<br>22|RF2/J<br>H6 | | ...D....N | | .F | | GD..G..S..-<br>H |

FIGURE 52 (Continued)

| | | | | | | | | | |
|---|---|---|---|---|---|---|---|---|---|
| iPS:43 6037 | 21- 225_193D8 | VH4|4- 30.1/D3|3 , 22|RF2/J H6 | .......... ...........N | ....N ........ | ............ ............ | ...F.F. ........ | ........ ........ | S....... ........ | GD..G..S.- .......... H........ |
| iPS:43 6041 | 21- 225_193G8 | VH4|4- 30.1/D3|3 , 22|RF2/J H6 | ......K.... .......V. | ....V..... ........ | ............ ............ | .....N.. ........ | ........ ........ | N....... ........ | GD..G..S.- .......... HF...L.. |
| iPS:43 6062 | 21- 225_194E5 | VH4|4- 30.1/D3|3 , 22|RF2/J H6 | ........... ........... | ....D...N | ...H........ ............ | ...F.... ........ | ........ ........ | ........ ........ | GD..G..S.- .......... H....... |
| iPS:43 6064 | 21- 225_194E6 | VH4|4- 30.1/D3|3 , 22|RF2/J H6 | ........... ....D..N | ....D...N | ............ ............ | F.F..... ........ | ........ ........ | .....I.. ..NV.... | GD..G..S.- .......... H....... |
| iPS:43 6134 | 21- 225_196H12 | VH4|4- 30.1/D3|3 , 22|RF2/J H6 | ......N.... ........... | ....V..... | ............ ............ | .N...... ........ | ........ ........ | ..II.... ........ | GD..G..S.- .......... H....L.. |
| iPS:43 6146 | 21- 225_197F4 | VH4|4- 30.1/D3|3 , 22|RF2/J H6 | ......K.... ........... | ....D...N | ............ ............ | ...F.... ........ | .F...... ........ | ...I.... ........ | GD..G..S.- .......... H....L.. |
| iPS:43 6177 | 21- 225_198B1 | VH4|4- 30.1/D3|3 , 22|RF2/J H6 | ........N.. ........... | ........ | ............ ............ | ..FH.... ........ | ........ ........ | .....V.. ........ | GD..G..S.- .......... H....... |
| iPS:43 6179 | 21- 225_198E1 | VH4|4- 30.1/D3|3 , 22|RF2/J H6 | ........... ........... | ....D...N | .....E...... ............ | ...F.F.. ........ | ........ ........ | LS...... ........ | GD..G..S.- .......... .R...... |
| iPS:43 6197 | 21- 225_199C2 | VH4|4- 30.1/D3|3 , 22|RF2/J H6 | ........... ........... | ....D...N | .L.......... ............ | ...F.... ........ | ........ ........ | MT...... ...T.... | GD..G..S.- .......... H....... |

FIGURE 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:43-6207 21-225_199C7 | VH4/4-30.1/D3/3 22|RF2/J H6 | .......... .......... .......... | ........N | ............ | F.F........ | ........S.. | GD..G..S.- ............ | .... .... |
| iPS:43-6226 21-225_200F10 | VH4/4-30.1/D3/3 22|RF2/J H6 | ..........N .......... | ....D..N | ............ | .F......... | .I......MT. .T......... | GD..G..S.- H........... | .... .... |
| | VH4/4-30.4/D3/3 22|RF2/J H6 | SYQLQES GPGLVKPSQTLS LTCTVSG-CSIS | SG--DYMS | WIRQPPGK GLEWIG | YIYY-SGSTYYNP SLKS | RVTISVDTSKNQFSLRL SSVTAADTAVYYCAR | YYYYSSYYY YYYYGMDV | WGQGTT VTVSS |
| iPS:43-5849 21-225_191C3 | VH4/4-30.4/D3/3 22|RF2/J H6 | .......... .......... .......... | ........N | ............ | .F......... | .L.......... .N......... | GD..G..S.- HF.......... | .... .... |
| iPS:43-6015 21-225_193D3 | VH4/4-30.4/D3/3 22|RF2/J H6 | .......... .......... .......... | ........ | ............ | .F......... | .L.......... ............T | GD..G..S.- HF.......... | .... .... |
| iPS:43-6049 21-225_193B12 | VH4/4-30.4/D3/3 22|RF2/J H6 | .......... .......... .......... | ...A.... | ............ | .F......... | .L.......... ............ | GD..G..S.- HF.......... | .... .... |
| iPS:43-6088 21-225_195C8 | VH4/4-30.4/D3/3 22|RF2/J H6 | .......... .......... .......... | ........N | ............ | .F......... | .L.......... ............ | GD..G..S.- HF.......... | .... .... |
| iPS:43-6195 21-225_198G10 | VH4/4-30.4/D3/3 22|RF2/J H6 | .......... .......... .......... | ........N | ............ | .F......... | .L.......... ............ | GD..G..S.- HF.......... | .... .... |
| | Germline | H_FR1 | H_CDR1 | H_FR2 | H_CDR2 | H_FR3 | H_CDR3 | H_FR4 |
| | VH4/4-30.1/D5/5 24|RF3/JH6 | SYQLQES GPGLVKPSQTLS LTCTVSG-CSIS | SG--GYYWS | WIRQHPGK GLEWIG | YIYY-SGSTNYNP SLKS | RVTISVDTSKNQFSLKL SSVTAADTAVYYCAR | RGQYYY | NWFDP WGQGTL VTVSS |

| | | H_FR1 | H_CDR1 | H_FR2 | H_CDR2 | H_FR3 | H_CDR3 | H_FR4 |
|---|---|---|---|---|---|---|---|---|
| iPS:43_5883 | 21-225_185A1 | VH3|3-21|D1|1-1|RF3|JH5 | ..........N | ........ | ........ | ......G.. | ........H........ | S.L--- ......C | ........P |
| VH3|3-23|D1|1-1|RF1|JH3 | | Germline<br>EVQLLES...<br>GGGLVQPGGSLR<br>LSCAASG-FTFS | ........S.. | TAMS<br>WVRQAPGK<br>GLEWVS | AISGS<br>GGSTYYAD<br>SVKG | RFTISRDNSKNTLYLQM<br>NSLRAEDTAVYYCAK | GTTGT<br>GAFDI | WGQGT<br>MVTVSS |
| iPS:43_5895 | 21-225_188E8 | VH3|3-23|D1|1-1|RF1|JH3 | ........ | ....S..N | ........ | ....V........ | ........F........ | RN.DD... | ........ |
| VH3|3-11|D7|7-27|RF3|JH4 | | Germline<br>QVQLVES...<br>GGGLVKPGGSLR<br>LSCAASG-FTFS | D...YMS | WVRQAPGK<br>GLEWVS | YISSS<br>GSTIYYAD<br>SVKG | RFTISRDNAKNSLYLQM<br>NSLRAEDTAVYYCAR | SMGY<br>FDY | WGQGT<br>LVTVSS |
| iPS:43_5903 | 21-225_190E2 | VH3|3-11|D7|7-27|RF3|JH4 | ........ | ........ | ........L. | ...T.VF........ | ........ | E.VG.....A.. | ........ |
| iPS:43_5923 | 21-225_190H6 | VH3|3-11|D7|7-27|RF3|JH4 | ........ | ........ | ........L. | ...T.VF........ | ........ | E.VG.....A.. | ........ |
| iPS:43_5953 | 21-225_191B12 | VH3|3-11|D7|7-27|RF3|JH4 | ........ | ........ | ........L. | ...T.VF........ | ........ | E.VG.....A.. | ........ |
| iPS:43_6098 | 21-225_195G11 | VH3|3-11|D7|7-27|RF3|JH4 | ........ | ........ | ........I. | ...I.M........ | ........ | E.VG.....A.. | ........ |
| iPS:43_6102 | 21-225_196B1 | VH3|3-11|D7|7-27|RF3|JH4 | ........ | ........ | ........L. | ...T.VF........ | ........ | E.VG.....A.. | ........ |
| iPS:43_6104 | 21-225_196C1 | VH3|3-11|D7|7-27|RF3|JH4 | ........ | ........ | ........L. | ...T.VF........ | ........ | E.VG.....A.. | ........ |
| VH3|3-23|D6|6-19|RF2|JH4 | | Germline<br>EVQLLES...<br>GGGLVQPGGSLR<br>LSCAASG-FTFS | TAMS | WVRQAPGK<br>GLEWVS | AISGS<br>GGSTYYAD<br>SVKG | RFTISRDNSKNTLYLQM<br>NSLRAEDTAVYYCAK | GYAVA<br>GFDY | WGQGT<br>MVTVSS |

| VH3|3-23|D7|7-27|RF2|JH4 | | EVOLVED GGGLVQPGGSLR LSCAAG FTFS | | YAMS | WVRQAPGK GLEWVS | AISGS GGSTT | RFTISRDNSKNTLYLQM NSLRAEDTAVYYCAK | | WGQGTL VTVSS |
|---|---|---|---|---|---|---|---|---|---|
| | | | | N | | .I.N. | S | D.RYS | |
| iPS:43-6019 | 21-225_193C4 | VH3|3-23|D7|7-27|RF2|JH4 | A......... | | | .R... | | ------FDI | ........ |
| | Germline | H_FR1 | H_CDR1 | | H_FR2 | H_CDR2 | H_FR3 | H_CDR3 | H_FR4 |
| VH4|4-30.1|D1|1-1|RF1|JH6 | | QVQLQES GPGLVKPSQTL SLTCTVSG GSIS | | SGYWS | WIRQPPGK GLEWIG | YISYTGS TNYNPSLKS | RVTISVDTSKNQFSLKLSSVTAADTAVYYCAR | | WGQGTL VTVSS |
| iPS:43-6025 | 21-225_193B5 | VH4|4-30.1|D1|1-1|RF1|JH6 | | | | | .A... | EYNWN- | |
| | | | | | | | | H.... | |
| VH4|4-34|D4|4-11|RF2|JH4 | | QVQLQQW GAGLLKPSETLS LTCAVYG GSFS | | GYWS | WIRQPPGK GLEWIG | EINHSG STNYNPSLKS | RVTISVDTSKNQFSLKLSSVTAADTAVYYCAR | YFDY | WGQGTL VTVSS |
| | Germline | H_FR1 | H_CDR1 | | H_FR2 | H_CDR2 | H_FR3 | H_CDR3 | H_FR4 |
| iPS:43-6033 | 21-225_193E7 | VH4|4-34|D4|4-11|RF2|JH4 | | F.T | | | | .G--- | A..A |
| iPS:43-6199 | 21-225_199E3 | VH4|4-34|D4|4-11|RF2|JH4 | | F.T | | | | .-A. | |
| iPS:43-6228 | 21-225_200F12 | VH4|4-34|D4|4-11|RF2|JH4 | | F.T | | .S.. | | .G--- | |
| iPS:43-6230 | 21-225_201A1 | VH4|4-34|D4|4-11|RF2|JH4 | | F.T | | .S..R. | | .G--- | A..A |
| iPS:43-6242 | 21-225_201A10 | VH4|4-34|D4|4-11|RF2|JH4 | T........ | | | .S... | ......G........V | .G--- | |
| iPS:43-6286 | 21-225_204H8 | VH4|4-34|D4|4-11|RF2|JH4 | F.. | | V.. | .S... | ....N.......K... | .G--- | |

[Table content too small/faded to reliably transcribe]

FIGURE 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 6834 | 21-225_52F1 | VH1|1-18/D3|3-3|RF2/JH6 | ........N | ......V. | ........ | ......RK. | S........ | HDFWSGY---- ....K... | ........ |
| iPS:43 6842 | 21-225_54E9 | VH1|1-18/D3|3-3|RF2/JH6 | ........N | .....L.. | ........ | ....KN. | ........ | HDFWSGY---- ....K... | ........ |
| iPS:43 6844 | 21-225_56G1 | VH1|1-18/D3|3-3|RF2/JH6 | ........N | ........ | ........ | ...K...F. | ........ | HDFWSGY---- ....K... | ........ |
| iPS:43 6846 | 21-225_56E3 | VH1|1-18/D3|3-3|RF2/JH6 | ........N | .....F.. | ........ | ...KE..F. | ....A... | HDFWSGY---- ....K... | ........ |
| iPS:45 1104 | 21-225_49C5 | VH1|1-18/D3|3-3|RF2/JH6 | ........N | ........ | ........ | ....K. | ........ | HDFWSGY---- ....K... | ........ |
| iPS:45 1106 | 21-225_49D10 | VH1|1-18/D3|3-3|RF2/JH6 | ........N | ........ | .....L..F. | ....KN. | ........ | HDFWSGY---- ....K... | ........ |
| iPS:45 1108 | 21-225_53E8 | VH1|1-18/D3|3-3|RF2/JH6 | ........N | ........ | ........ | ....KF. | ........ | HDFWSGY---- ....K... | ........ |
| Germline | VH6|6-01|D3|3-9|RF1|JH6 | CVQLQQS GPGLVRPSQTL SLTCAISG-DSVS | SN SAAWN | WIRQSPSRYLEY GRNLG | RTYYRSKWYNDYA VSVKS | RITINPDTSKNQFSLQL RSVTPEDTAVYYCAR | VIRYFDLL YYYYGMDV | WGQGT TVTVSS |
| iPS:43 6236 | 21-225_201F7 | VH6|6-01|D3|3-9|RF1|JH6 | ........ | ........ | ........ | ....Y.E..R. | ........F... | DQ..Y---- ........ | ........ |
| iPS:43 6250 | 21-225_201A4 | VH6|6-01|D3|3-9|RF1|JH6 | ........ | ........ | ........ | ....Y.E... | ........F... | DQ..Y---- ........ | ........ |
| iPS:43 6252 | 21-225_202A8 | VH6|6-01|D3|3-9|RF1|JH6 | ........ | ........ | ........ | ....E...R. | ......L..T. | DQ..Y---- ........ | ....P.. |

| | | | | | | | |
|---|---|---|---|---|---|---|---|
| iPS:43 6316 | 21-225_206A5 | VH1|1-02|D5|5-18|RF3|JH5 | . . . . . | . I . . . | . . . A . | . . . . . | T . . . . | . . . . . | . . . . . |
| iPS:43 6338 | 21-225_208E8 | VH1|1-02|D5|5-18|RF3|JH5 | . . . . . | . I . . . | . . . A . | . . . . . | T . . . . | . . . . . | . . . . . |
| iPS:43 6344 | 21-225_208B11 | VH1|1-02|D5|5-18|RF3|JH5 | . . . . . | . I . . . | . . . A . | . . . . . | T . . . . | . . . . . | . . . . . |
| iPS:43 6358 | 21-225_210D11 | VH1|1-02|D5|5-18|RF3|JH5 | . . . . . | . I . . . | . . . A . | . . . . . | T . . . . | . . . . . | . . . . . |
| iPS:43 6408 | 21-225_214H8 | VH1|1-02|D5|5-18|RF3|JH5 | . . . . . | . H.I . | . . . . . | . S . . . | . . . . . | . . . . K | DGR.S.G......YD... |
| iPS:43 6424 | 21-225_215H6 | VH1|1-02|D5|5-18|RF3|JH5 | . . . . . | . H.I . | . . . . . | . S . . E | . . . . . | . . . . K | DGR.S.G......HD... |
| iPS:43 7092 | 21-225_210B12 | VH1|1-02|D5|5-18|RF3|JH5 | . . . t . | D . . . N | . . . . . | . K . . . | . . . . . | . . . . . | .DS-- . . . |
| iPS:43 7134 | 21-225_213A7 | VH1|1-02|D5|5-18|RF3|JH5 | . . . i..R | D . . . N | . . . . . | . N . . . | . . . . . | . . . . . | ---A. . . . |
| iPS:43 7194 | 21-225_226B2 | VH1|1-02|D5|5-18|RF3|JH5 | . . F . . | . . . . . | . . . . . | . . . . . | . . . . . | . L.R..K | .DS-- . . . |
| iPS:43 7196 | 21-225_226B7 | VH1|1-02|D5|5-18|RF3|JH5 | . . F . . | . . . . . | . . . . . | . . . D . | . . . . . | . LN . . I | TY.SGS.......YF.EL.S |
| iPS:43 7200 | 21-225_226A10 | VH1|1-02|D5|5-18|RF3|JH5 | . . . . . | . . . . . | . . . . . | . . . D . | . . . H . | . . . . . | Y..SGS......YY....S |
| iPS:43 7200 | 21-225_226A10 | VH1|1-02|D5|5-18|RF3|JH5 | . . . . . | . F . . . | . . . . . | . . . D . | . . . . . | . L . . I | TY.SGS.......YF.EL.S |
| iPS:39 3168 | 21-225_32B11 | VH1|1-02|D5|5-18|RF3|JH5 | . . . . . | . . . . . | . . . . . | . . . D . | . . . . N | . . . . . | FY.SGS.......YY.DL.. |

| VH3J3-33/D5\|5-18\|RF3/JH6 | | | | | | | | |
|---|---|---|---|---|---|---|---|---|
| iPS:43 6366 | 21-225_211A3 | VH3\|3-33/D5\|5-18\|RF3/J H6 | V...I... | | A... | | DG.... | .... |
| iPS:43 6388 | 21-225_212H11 | VH3\|3-33/D5\|5-18\|RF3/J H6 | V...I... | | A... | | D.... | .... |
| iPS:43 6396 | 21-225_213E5 | VH3\|3-33/D5\|5-18\|RF3/J H6 | V...I... | | A... | | DG.... | .... |
| iPS:43 6454 | 21-225_217B10 | VH3\|3-33/D5\|5-18\|RF3/J H6 | V...I... | | A... | | D.... | .... |
| iPS:43 6668 | 21-225_147B9 | VH3\|3-33/D5\|5-18\|RF3/J H6 | | | | ....N.E. | DG.... | .... |
| iPS:43 6688 | 21-225_148C8 | VH3\|3-33/D5\|5-18\|RF3/J H6 | | | | ....N.E. | D.... | .... |
| iPS:43 6706 | 21-225_149A11 | VH3\|3-33/D5\|5-18\|RF3/J H6 | | | | ....N.E. | D.... | .... |
| iPS:43 6760 | 21-225_155E10 | VH3\|3-33/D5\|5-18\|RF3/J H6 | | | | | DRD..DPPY.... ....Y---- | .... |
| iPS:43 6966 | 21-225_190C3 | VH3\|3-33/D5\|5-18\|RF3/J H6 | | ...L.. | | | DRD..DPPY.... ....Y---- | .... |
| iPS:43 6976 | 21-225_190D8 | VH3\|3-33/D5\|5-18\|RF3/J H6 | D. ..E | ...L.. | | ....N | DRD..DPPY.... ....Y---- | .... |
| iPS:43 7168 | 21-225_218G4 | VH3\|3-33/D5\|5-18\|RF3/J H6 | | | | ....N | DRD..DPFY.... ....Y---- | .... |
| | | | | | | ....N ....V | W.Y.Y---- | .... |
| | | | | | | | W.Y.Y---- | .... |

| ID | Germline | | | | | | | | | |
|---|---|---|---|---|---|---|---|---|---|---|
| iPS:43 6558 | VH1|1-02|D4|4-23|RF2|J H6 | . . . . . | I . . . . | . . . . . | . . Y . . D . . | . R . . . F . . . . F | . W . . Y . S-- | . . . . F . |
| iPS:43 6562 | VH1|1-02|D4|4-23|RF2|J H6 | . . . . . | I . . . . | . . T . . | . . Y . . D . . | . R . . . F . . . . F | . W . . Y . S-- | . . . . . |
| iPS:43 6572 | VH1|1-02|D4|4-23|RF2|J H6 | . . . . . | I . . . . | . . . . . | . . Y . . D . . | . R . . . F . . . . F | . W . . Y . S-- | . . . . . |
| iPS:43 6606 | VH1|1-02|D4|4-23|RF2|J H6 | . . . . . | I . . . . | . . . . . | . . Y . . D . K . | . . . . F . . . . F | . W . . Y . S-- | . . . . . |
| iPS:43 6610 | VH1|1-02|D4|4-23|RF2|J H6 | . . . . . | I . . . . | . . . . . | . . Y . . D . K . | . A . . . F . . . . F | . W . . Y . S-- | . . . . . |
| iPS:43 6612 | VH1|1-02|D4|4-23|RF2|J H6 | . . . . . | I . . . . | . . . . . | . . Y . . D . S . | . . . . F . . . . F | . W . . Y . S-- | . . . . . |
| iPS:43 6614 | VH1|1-02|D4|4-23|RF2|J H6 | . . . . G . | I . . . . | . . . . . | . . Y . . D . . | . . . . L . . . . V . F | . W . . Y . S-- | . . . . . |
| iPS:43 6618 | VH1|1-02|D4|4-23|RF2|J H6 | . L R . . . . | I . . . . | . . . . . | . . Y . . D . . | . . . . F . . . . F | . W . . Y . S-- | . . . . . |
| iPS:43 6624 | VH1|1-02|D4|4-23|RF2|J H6 | . . . . . | I . . . . | . . . . . | . . Y . . D . . | . R . . . F . . . . F | . W . . Y . S-- | . . P . . |
| iPS:43 6626 | VH1|1-02|D4|4-23|RF2|J H6 | . . . . . | T . . . . | . . . . . | . . Y . . D . . | . . . . F . . . . F | . W . . Y . S-- | . . . . . |
| iPS:43 6628 | VH1|1-02|D4|4-23|RF2|J H6 | . . . H . . | I . . . . | . . . . . | . . Y . . D . K . | . . . . F . . . . F | . W . . Y . S-- | . . . . . |
| iPS:43 6640 | VH1|1-02|D4|4-23|RF2|J H6 | . . . . . | I . . . . | . . . . . | . . Y . . D . . | . . . . F . . . . V . F | . W . . Y . S-- | . . . . . |

| | Germline | H_FR1 | H_CDR1 | H_FR2 | H_CDR2 | H_FR3 | H_CDR3 | H_FR4 |
|---|---|---|---|---|---|---|---|---|
| VH3]3-23|D7|7-27|RF1|JH6 | | EVQLLES GGGLVQPGGSLR LSCAASC FTFS | S......YAMS | WVRQAPGK GLEWVS | AISG SGGSTYYA DSVKG | RFTISRDNSKNTLY LQMNSLRAEDTAVYY CAR | WR.NPT...... IGXYY | WGQGTT VTVSS |
| iPS:43 6652 | 21-225_146B11 | VH3]3-23|D7|7-27|RF1|JH6 | . . . . . . . . . . . . | . . . . . . . | . . . . . . . . | V...G .S.... | . . . . . . . . . . . . . . . | WR.NPT...... .....D | . . . . . |
| iPS:43 6654 | 21-225_146C11 | VH3]3-23|D7|7-27|RF1|JH6 | . . . . . . I . . . | . . . . . . . | . . . . . . . . | V...G .S.... | . . . . . . . . . . . . . . . | WR.NPT...... .....D | . . . . . |
| iPS:43 6658 | 21-225_146A2 | VH3]3-23|D7|7-27|RF1|JH6 | . . . . . . . . . . . | . . . . . . . | . . . . . . . . | V...G .S.... | . . . . . . . . . . . . H . | WR.NPT...... .....D | . . . . . |
| iPS:43 6664 | 21-225_147E7 | VH3]3-23|D7|7-27|RF1|JH6 | . . . . . . . . . . . | . . . . . . . | . . . . . . . . | V...G .S.... | . . . . . L . . . . . . . . F . | WR.NPT...... .....D | . . . . . |
| iPS:43 6676 | 21-225_147E11 | VH3]3-23|D7|7-27|RF1|JH6 | . . . . . . . . . . . | N......V. | . . . . . . . . | V...G .S.... | . . . . . . . . . . . . . . . | WR.NPT...... .....D | . . . . . |
| iPS:43 6678 | 21-225_147B12 | VH3]3-23|D7|7-27|RF1|JH6 | . . . . . . . . . . . | . . . . . . . | . . . . . . . . | V...G .S.... | . . . . . . . . . . . . . . . | WR.NPT...... .....D | . . . . . |
| iPS:43 6686 | 21-225_148G6 | VH3]3-23|D7|7-27|RF1|JH6 | . . . . . . . . . . . | ...P... | . . . . . . . . | V...G .S.... | . . . . . . . . . . . . M.H . | WR.NPT...... .....D | . . . . . |
| iPS:43 6694 | 21-225_148G11 | VH3]3-23|D7|7-27|RF1|JH6 | . . . . . . . . . . . | . . . . . . . | . . . . . . . . | V...G .S.A.. | . . . . . . . . . . . . . . . | WR.NPT...... .....D | . . . . . |
| iPS:43 6700 | 21-225_149C7 | VH3]3-23|D7|7-27|RF1|JH6 | . . . . . . . . . . . | ..H.... | . . . . . . . . | V...G .S.... | . . . . . . . . . . . . . . . | WR.NPT...... .....D | . . . . . |
| iPS:43 6704 | 21-225_149C10 | VH3]3-23|D7|7-27|RF1|JH6 | . . . . . . F . . . | . . . . . . . | . . . . . . . . | V...G .S.... | . . . . . . . . . . . . . . . | WR.NPT...... .....D | . . . . . |

FIGURE 52 (Continued)

| | | | | | | | |
|---|---|---|---|---|---|---|---|
| iPS:43 6710 | 21-225_150F6 | VH3|3-23|D7|7-27|RF1|J H6 | | | V..G. .S... | WR.NPT...... .....D...... | ..... ..... |
| iPS:43 6714 | 21-225_150H11 | VH3|3-23|D7|7-27|RF1|J H6 | | T..... | I..G. .S... | WR.NPT...... .....D...... | ..... ..... |
| iPS:43 6718 | 21-225_151H5 | VH3|3-23|D7|7-27|RF1|J H6 | | | V..G. .S... | WR.NPT...... .....D...... | ..... ..... |
| iPS:43 6722 | 21-225_151H7 | VH3|3-23|D7|7-27|RF1|J H6 | | | V..G. .S... | WR.NPT...... .....D...... | ..... ..... |
| iPS:43 6724 | 21-225_151B9 | VH3|3-23|D7|7-27|RF1|J H6 | | | V..G. .S... | WR.NPT...... .....D...... | ..... ..... |
| iPS:43 6728 | 21-225_152G6 | VH3|3-23|D7|7-27|RF1|J H6 | | | V..G. .S... | WR.NPT...... .....D...... | ..... ..... |
| iPS:43 6730 | 21-225_152D7 | VH3|3-23|D7|7-27|RF1|J H6 | | | V..G. .S... | WR.NPT...... .....DS..... | ..... ..... |
| iPS:43 6742 | 21-225_154C4 | VH3|3-23|D7|7-27|RF1|J H6 | ..I... | | V..G. .S... | WR.NPT...... .....D...... | ..... ..... |
| iPS:43 6746 | 21-225_154E10 | VH3|3-23|D7|7-27|RF1|J H6 | | | V..G. .S... | WR.NPT...... .....D...... | ..... ..... |
| iPS:43 6758 | 21-225_155C10 | VH3|3-23|D7|7-27|RF1|J H6 | | | V..G. .S... | WR.NPT...... .....D...... | ..... ..... |
| iPS:43 6938 | 21-225_146A3 | VH3|3-23|D7|7-27|RF1|J H6 | | | V..G. .TT.. | WR.NPT...... .....D...... | ..... ..... |
| iPS:43 7250 | 21-225_148C6 | VH3|3-23|D7|7-27|RF1|J H6 | | | V..G. .S... | WR.NPT...... .....D...... | ..... ..... |

FIGURE 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43_7252 | 21-225_148H11 | VH3j3-23/D7j7-27jRF1/JH6 | . . . . . . . . . . . | . . . . . . . . | . . . . . . . . | V . . G . . . . S . . . . . | . . . . . . . . . . . . . . . . . . | WR.NPT. . . . . . . . . . . D . . . . . | . . . . . . . |
| iPS:43_7282 | 21-225_207C9 | VH3j3-23/D7j7-27jRF1/JH6 | . . . . . . . . . . . | . . . . . . . . | . . . . . . . . | . . . . . . . . . . . | . . . . . . . . . . . . . . . . . . | AG.TTGSY. . . . . . . . Y.N . . . . | . . . . . . . |
| Germline | | VH3j3-48jD4j4-11jRF2jH6 | | | | | | | |
| iPS:43_6660 | 21-225_146D8 | VH3j3-48/D4j4-11jRF2/JH6 | . . . . . . . . . . . | N . . . . . . . | . . . . . . . . | . . N.K . . V . . . . | . . . . . . . . . . . . . . . . . . | R.GS.GY . . . . . . . . F . . . . L . | . . . . . . . |
| iPS:43_6682 | 21-225_146A8 | VH3j3-48/D4j4-11jRF2/JH6 | . . K . . E . . . . . V | N . . . . . . . | . . . . . . . . | . . R . . N.K . . R . | . . . . . . . . . . . . . . . . . . | R.GS.GY . . . . . . . . F . . . . L . | . . . . . . . |
| iPS:43_6684 | 21-225_146B6 | VH3j3-48/D4j4-11jRF2/JH6 | . . . . . . . . . . . | . . . . . . . N | . . . . . . . . | . . R . . N.KH . . . | D . . . . . . . . . . . . . . . . . | R.GS.GY . . . . . . . . F . . . . L . | . . . . . . . |
| iPS:43_6696 | 21-225_149A1 | VH3j3-48/D4j4-11jRF2/JH6 | . . . . . . . . . . . | . . . . . . . N | . . . . . . . . | . . R . . N.KH . . . | . . . . . . . . . . . . . . . . . . | R.GS.GY . . . . . . . . F . . . . L . | . . . . . . . |
| iPS:43_6712 | 21-225_150F9 | VH3j3-48/D4j4-11jRF2/JH6 | . . M . . . . . . . . | . . . . . . . . | . . . . V . . . | . . R . . N.K . . . . | . . . . . . . . . . . . . . . . . . | R.GS.GY . . . . . . . . F . . . . L . | . . . . . . . |
| iPS:43_6762 | 21-225_156H2 | VH3j3-48/D4j4-11jRF2/JH6 | I . . . . . . . . . . | N . . . . . . . | . . . . . . . . | . . R . . N.K . . . . | . . . . . . . . . . . . . . . . . . | R.GS.GY . . . . . . . . F . . . . . . | . . . . . . . |
| iPS:43_6820 | 21-225_179D10 | VH3j3-48/D4j4-11jRF2/JH6 | . . . . . . . F . . . | . . . . . . . . | . . . . A . . . | . . G.T . . . Q . . . | . . . . . . . . . . . . R . . . . . | SRKGF- . . . . . . L . . | . . I . . . . |
| iPS:43_7262 | 21-225_170E4 | VH3j3-48/D4j4-11jRF2/JH6 | . . . . . . . S . . . | . . . . . . . . | . . . . . . . . | . . G . . K . . E . . | . . . . . . . . . . . . D . . R . . | SRKGF- . . . . . . L . . | . . . . . . . |
| Germline | | | H_FR1 | H_CDR1 | H_FR2 | H_CDR2 | H_FR3 | H_CDR3 | H_FR4 |

FIGURE 52 (Continued)

| | | | | | H_CDR1 | H_FR2 | H_CDR2 | H_FR3 | H_CDR3 | H_FR4 |
|---|---|---|---|---|---|---|---|---|---|---|
| VH1f1-08/D5f5-12jRF1/JH6 | | | | | | | | | | |
| iPS:43 6662 | 21-225_147D7 | VH1f1-08/D5f5-12jRF1/JH6 | | | | | | R. | A...LVPAAI .PYN..FA... | |
| Germline | | | | H_FR1 | H_CDR1 | H_FR2 | H_CDR2 | H_FR3 | H_CDR3 | H_FR4 |
| VH1f1-02/D3f3-3jRF2/JH6 | | | | | | | | | | |
| iPS:43 6666 | 21-225_147B8 | VH1f1-02/D3f3-3jRF2/JH6 | | | D......L. | | ..D... | | DR.SG..S.P. | |
| Germline | | | | H_FR1 | H_CDR1 | H_FR2 | H_CDR2 | H_FR3 | H_CDR3 | H_FR4 |
| VH3f3-33/D3f3-3jRF2/JH6 | | | | | | | | | | |
| iPS:43 6672 | 21-225_147F9 | VH3f3-33/D3f3-3jRF2/JH6 | | | T...... | | ..G... ..D... | I | DR.YC..GTC... ..P........ | |
| iPS:43 6674 | 21-225_147G9 | VH3f3-33/D3f3-3jRF2/JH6 | | | T...... | | ..G... ..D... | I | DR.YC..GSC... ..P........ | |
| iPS:43 6690 | 21-225_148A9 | VH3f3-33/D3f3-3jRF2/JH6 | | | T...... | | ..G... ..D... | I | DR.YC..GTC... ..P........ | |
| iPS:43 6708 | 21-225_150D3 | VH3f3-33/D3f3-3jRF2/JH6 | | | T...... | | ..G... ..D... | I | DR.YC..GTC... ..P........ | |
| iPS:43 6716 | 21-225_151F3 | VH3f3-33/D3f3-3jRF2/JH6 | | | T...... | | ..G... ..TD... | I | DR.YC..TSC... ..P........ | |
| iPS:43 6738 | 21-225_153D9 | VH3f3-33/D3f3-3jRF2/JH6 | | | T...... | ..V. | ..G... ..D... | I | DR.YC..GSC... ..P........ | |
| iPS:43 6740 | 21-225_154C3 | VH3f3-33/D3f3-3jRF2/JH6 | | | T...... | | ..V.G... ..N..D... | I | DR.YC..GSC... ..P........ | |

FIGURE 52 (Continued)

Table too complex and low-resolution to transcribe reliably.

| VH3|S 33|D|1|-1|RF3|JH6 | VH3|S 33|D|1|-1|RF3|JH6 | UPDATES CDR3 OF CDR3|JH EXTRAMIC-BONDS | CDR1 | MYRGAFK GLSSTA | VHID CGNYMD SWKG | HYDROGEN NETWORK | HYDROGEN NETWORK | RESULT TYPE |
|---|---|---|---|---|---|---|---|---|
| iPS:43 6818 | VH3|3-33/D|1|-1|RF3/JH6 | .A.......... | N......S.... | ....G....... | I.Y..... Y.N.. | | DRHY.FHVP...... ..YY............ | ........ |
| iPS:43 7094 | VH3|3-33/D|1|-1|RF3/JH6 | ............ | ............ | ............ | ............ | ............ | GD..P---- .E.L....... | ........ |
| iPS:43 7096 | VH3|3-33/D|1|-1|RF3/JH6 | ...H........ | H........... | ............ | ............ | ............ | GD..P---- .E......... | ...I.... |
| iPS:43 7098 | VH3|3-33/D|1|-1|RF3/JH6 | ............ | N........... | ............ | ............ | ...I....I... | GD..P---- .E.L....... | ........ |
| iPS:43 7104 | VH3|3-33/D|1|-1|RF3/JH6 | ............ | H........... | ............ | ............ | ............ | GD..P---- .E.L....... | ........ |
| iPS:43 7112 | VH3|3-33/D|1|-1|RF3/JH6 | ............ | H........... | ............ | ............ | ............ | GD..P---- .E.L....... | .....S.. |
| iPS:43 7114 | VH3|3-33/D|1|-1|RF3/JH6 | ...H........ .A.......... | N........... | ............ | ............ | ............ | GD..P---- .E......... | ........ |
| iPS:43 7116 | VH3|3-33/D|1|-1|RF3/JH6 | ............ | H........... | ............ | ............ | ............ | GD..P---- .E.L....... | ........ |
| iPS:43 7118 | VH3|3-33/D|1|-1|RF3/JH6 | ............ | H........... | ............ | .....C...... | ....T....... | GD..P---- .E......... | ...I.... |
| iPS:43 7128 | VH3|3-33/D|1|-1|RF3/JH6 | ............ | H........... | ............ | ............ | .H.......... | GD..P---- .E......... | ........ |
| iPS:43 7130 | VH3|3-33/D|1|-1|RF3/JH6 | ............ | H........... | ............ | ............ | ...V........ .F.......... | GD..P---- .E......... | .....S.. |

FIGURE 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:43 21-225_215D3 7146 | VH3/3-33/D1/1-1/RF3/JH6 | ....T........... | ............... | ............... | ............E.. | ............... | GD..P--- .....E.. | ............... |
| iPS:43 21-225_216A3 7150 | VH3/3-33/D1/1-1/RF3/JH6 | ............... | ............... | ............... | ............... | ............... | GD..P--- E.L... | ............... |
| iPS:43 21-225_217B2 7162 | VH3/3-33/D1/1-1/RF3/JH6 | ....H.......... | ...H........... | ............... | ............... | ............... | GD..P--- .....E.. | .....I.. |
| iPS:43 21-225_219A7 7172 | VH3/3-33/D1/1-1/RF3/JH6 | ............... | ...N........... | ............... | ............... | ...........M... | GD..P--- .....E.. | ............... |
| iPS:43 21-225_221H2 7182 | VH3/3-33/D1/1-1/RF3/JH6 | ....H...P...... | ...H........... | ............... | ............... | ............... | GD..P--- .....E.. | ............... |
| iPS:43 21-225_221G4 7184 | VH3/3-33/D1/1-1/RF3/JH6 | ............... | ...H........... | ............... | ............... | ...........H... | GD..P--- .....E.. | ....S... |
| iPS:43 21-225_216G1 8664 | VH3/3-33/D1/1-1/RF3/JH6 | ....H.......... | ...N........... | ............... | ............... | ...........H... | GD..P--- .....E.. | .....I.. |
| VH3/3-33/D1/1-1/RF1/JH4 | Germline | EVQLVES GGGLVQPGRSLR LSCAASG FTFS | SYGMH | WVRQAPGK GLEWVA | VIWYDGSNKY YADSVKG | RFTISRDNSKNTLYLQM NSLRAEDTAVYYCAR | ETDY | WGQGTL VTVSS |
| iPS:43 21-225_180D4 6822 | VH3/3-33/D1/1-1/RF1/JH4 | ............... | ...N....F...... | ............... | ......I...D... | ............... | .GPPFST. .....VTM... | ............... |
| iPS:43 21-225_181H1 6828 | VH3/3-33/D1/1-1/RF1/JH4 | ............... | ............... | ............... | ......I...D... | ....I......F... | .GPPFST. .....VTM... | ............... |
| iPS:43 21-225_184G4 6950 | VH3/3-33/D1/1-1/RF1/JH4 | ....V.......... | ............... | ............... | ......I........ | ....I......F... | .GPPFST. .....VTM... | ............... |

| | | H_FR1 | H_CDR1 | H_FR2 | H_CDR2 | H_FR3 | H_CDR3 | H_FR4 |
|---|---|---|---|---|---|---|---|---|
| VH4|4-30.1|D2|2-8|RF3|JH4 | | QVQLQES-GPGLVKPSQTLSLTCTVSGGSIS | SG--GYYWS | WIRQHPG-KGLEWIG | YIYY---SGSTYYNP SSVTRAD-TAIISVDTSKNQFSLNL SSVTRADTAVYYCAR | DIVLWVY-----AFFDI | WGQGTLVTVSS |
| iPS.43 21-6958 | VH4|4-30.1fD2|2-8|RF3|JH4 | | | | | | .SP.R---- .....-G.... | |
| | Germline | H_FR1 | H_CDR1 | H_FR2 | H_CDR2 | H_FR3 | H_CDR3 | H_FR4 |
| VH6|6-01|D4|4-17|RF2|JH4 | | QVQLQQS-GPGLVKPSQTLSLTCAISG-DSVS | SN--SAAWN | WIRQSPSRGLEWLG | RTYYR-SKWYNDYA YSVKS | RITINPDTSKNQFSLQL NSVTPEDTAVYYCAR | DYGDY-----YFDY | WGQGTLVTVSS |
| iPS.43 21-6962 | VH6|6-01|D4|4-17|RF2|JH4 | | RK......D | | K... | | .P.G- ...L... | |
| iPS.43 21-225_190H1 | VH6|6-01|D4|4-17|RF2|JH4 | | RK......T | | | I.. | .P.G- ...L... | |
| iPS.43 21-6978 | VH6|6-01|D4|4-17|RF2|JH4 | | RI...NPT.. | | HV. | | .P.G- ...L... | |
| iPS.43 21-225_190G9 | VH6|6-01|D4|4-17|RF2|JH4 | | | | | | | |
| iPS.43 21-7070 225_201G11 | VH6|6-01|D4|4-17|RF2|JH4 | | | | ...HV..L | T.. | .P.G- ...L... | |
| iPS.43 21-7076 225_203G6 | VH6|6-01|D4|4-17|RF2|JH4 | | RT...NPT.. | | | | | |
| | Germline | H_FR1 | H_CDR1 | H_FR2 | H_CDR2 | H_FR3 | H_CDR3 | H_FR4 |
| VH3|3-33|D1|1-7|RF3|JH6 | | QVQLVES-GGGVVQPGRSLRLSCAASG-FTFS | S----YGMH | WVRQAPGKGLEWVA | VIWYD-GSNKYYAD SVKG | RFTISRDNSKNTLYLQM NSLRAEDTAVYYCAR | TDNYYY-----YYYGMDV | WGQGTTVTVSS |
| iPS.43 21-6964 | VH3|3-33|D1|1-7|RF3|JH6 | | N...........I.. | | F.... D.... | | D....GDH. ...Y..F | |
| iPS.43 21-225_190B3 | VH3|3-33|D1|1-7|RF3|JH6 | | ...N | | | | | |
| iPS.43 21-6970 225_190B8 | VH3|3-33|D1|1-7|RF3|JH6 | | | | F.... ...T.. D.... | | D....GDY. ...Y... | F. |
| iPS.43 21-6980 225_190C10 | VH3|3-33|D1|1-7|RF3|JH6 | | N.......... .L | | .FG.... ..D.... ..R. | | D....GDH. ...Y... | |

FIGURE 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43-6992 | 21-225_191B8 | VH3|3-33/D1|1-7|RF3/JH6 | ........L. | .............. | ............ | ...F......... | D....GDH........Y...... | ........ |
| iPS:43-6994 | 21-225_191A9 | VH3|3-33/D1|1-7|RF3/JH6 | ........L. | .N............ | ...FG........ | ...D......... | D....GDH........Y...... | ........ |
| | Germline | | | | | | | |
| | VH4|4-30.1|D4|4-11|RF2|JH6 | | | | | | | |
| iPS:43-6984 | 21-225_190F10 | VH4|4-30.1|D4|4-11|RF2|JH6 | ...........R. | ....D..... | ..........E. | ...I........ | ............ | .S.SR--- | ........ |
| iPS:43-6988 | 21-225_191A2 | VH4|4-30.1|D4|4-11|RF2|JH6 | ...........R. | ....D..... | ..........E. | ...I........ | .....F...... | .S.SR--- | ........ |
| iPS:43-7014 | 21-225_192H8 | VH4|4-30.1|D4|4-11|RF2|JH6 | ........V.... | ....D..... | ............ | ...P........ | ....L.M.A... | .S.L.--- | ........ |
| iPS:43-7022 | 21-225_194G5 | VH4|4-30.1|D4|4-11|RF2|JH6 | ........I.... | ....D..... | ..........E. | ............ | ............ | .H.L.--- | ........ |
| iPS:43-7026 | 21-225_194D12 | VH4|4-30.1|D4|4-11|RF2|JH6 | ...........R. | ....D..... | ............ | ...I........ | ............ | .GARE--- | ........ |
| iPS:43-7056 | 21-225_198B8 | VH4|4-30.1|D4|4-11|RF2|JH6 | ............. | ....D..... | ............ | ............ | .....G...... | .S.SR--- | ........ |
| iPS:43-7124 | 21-225_212H12 | VH4|4-30.1|D4|4-11|RF2|JH6 | ...........R. | ....D..... | ............ | ............ | ............ | .S.S.--- | ........ |

FIGURE 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43_7136 | VH4|4-30.1/DA|4-11|RF2/JH6 | ........R | ........D... | | | .....G........ | .S.S.--- | |
| | Germline | H_FR1 | H_CDR1 | H_FR2 | H_CDR2 | H_FR3 | H_CDR3 | H_FR4 |
| iPS:43_6986 | VH4|4-59/D1|1-26|RF1/JH4 | ........R | ........I | | ...K.. | | KG..T......IH... | |
| iPS:43_7064 | VH4|4-59/D1|1-26|RF1/JH4 | ........R | | | ...K.. | | KG..T......IH... | |
| | Germline | H_FR1 | H_CDR1 | H_FR2 | H_CDR2 | H_FR3 | H_CDR3 | H_FR4 |
| iPS:43_6996 | VH3|3-30/D6|6-6|RF1/JH4 | F......H.. | | ...W.. | ...H.. | .GY..GF......YRG..N | | |
| iPS:43_7054 | VH3|3-30/D6|6-6|RF1/JH4 | F......H.. | | ...W.. | ...H.. | .GF..GF......YRG..N | | |
| | Germline | H_FR1 | H_CDR1 | H_FR2 | H_CDR2 | H_FR3 | H_CDR3 | H_FR4 |
| iPS:43_7000 | VH3|3-33/D1|1-26|RF1/JH6 | | ...T...... | .....T.... | ...L..F.. | | DR..G.SPP......YY... | |
| iPS:39_3192 | VH3|3-33/D1|1-26|RF1/JH6 | | | | ...N.. | | DR..A.AGTP......Y..... | |
| | Germline | H_FR1 | H_CDR1 | H_FR2 | H_CDR2 | H_FR3 | H_CDR3 | H_FR4 |

| | VH1[1-02]D2[2-2]RF2]JH6 | | | | | | | | |
|---|---|---|---|---|---|---|---|---|---|
| | | SDQLVQS CAEVKKPGASVK VSCKASG_YTFT | K------TYMH CAEYKKPGASYK | XVRQAPGQ WMKPN GLEWMG | SGGTNTQ KFQG | KVTMTRDTSISTAYMEL SSLRSDDTAVYYCAR | GYCSSSCYY YYYYGMDV | WGQGT VTVSS | |
| | | H_FR1 | H_CDR1 | H_FR2 | H_CDR2 | H_FR3 | H_CDR3 | H_FR4 | |
| iPS:39 2585 | 21-225_14H11 | VH1[1-02]D2[2-2]RF2]JH6 | .........Q G............ | ......H.C | ............... | ............ | ...................A | ...S...L ...QPG. | ............ | |
| iPS:39 3186 | 21-225_27D9 | VH1[1-02]D2[2-2]RF2]JH6 | ............ | ............ | ............... | ......K.... | ............. | ER..T...L ..GITG... | ............ | |
| iPS:39 3234 | 21-225_26C10 | VH1[1-02]D2[2-2]RF2]JH6 | ............ | ......V..... | ............... | ............ | ..N.......... | ER..T...L ..GITG... | ............ | |
| | Germline | SQVILLES CCGYWGCCSLS LSCAASG_FTFS | YAMS | WVRQAPG KGLEWVS | AISGS GGSTYYAD SVKG | RFTISRDNSKNTLYLQM NSLRAEDTAVYYCAK | YYYGMDV | WGQGT VTVSS | | |
| | | H_FR1 | H_CDR1 | H_FR2 | H_CDR2 | H_FR3 | H_CDR3 | H_FR4 | |
| iPS:39 2596 | 21-225_12D8 | VH3[3-23]D5[5-12]RF3/JH6 | ............ | ......V.. | ............... | T...VG. | ............T | WGR...S..E. | ............ | |
| iPS:39 2942 | 21-225_30E9 | VH3[3-23]D5[5-12]RF3/JH6 | ......V..... | ......C..N | ............... | ...R..F. | ............. | .ELLE..- | ............ | |
| iPS:39 2944 | 21-225_31H5 | VH3[3-23]D5[5-12]RF3/JH6 | ............ | ............ | ............... | ...R..IFH. | ............V | .ELLE..- ...F.. | ............ | |
| iPS:39 2964 | 21-225_31A8 | VH3[3-23]D5[5-12]RF3/JH6 | ............ | ............ | ............... | ...R..FH. | .......D...V | .ELLE..- ...F.. | ............ | |
| iPS:39 2982 | 21-225_30D1 | VH3[3-23]D5[5-12]RF3/JH6 | ......V..... | ............ | ............... | ...R..FH. | ............V | .ELLE..- ...F..L. | ............ | |
| iPS:39 2986 | 21-225_31B8 | VH3[3-23]D5[5-12]RF3/JH6 | ............ | ............ | ............... | ...R..FH. | .......D...V | .ELLE..- ...F.. | ............ | |
| iPS:39 3004 | 21-225_30G11 | VH3[3-23]D5[5-12]RF3/JH6 | ............ | ............ | ............... | ...R..FN. | ............T ...V | .ELLE..- ...F.. | ............ | |

| | | H_FR1 | H_CDR1 | H_FR2 | H_CDR2 | H_FR3 | H_CDR3 | H_FR4 |
|---|---|---|---|---|---|---|---|---|
| iPS:39 3126 | 21-225_35D1 | VH3/3-23/D5[5-12]RF3/J H6 | . . . . . . | . . . . . . | . . . . . . | . . . . R . . . . . . . . . . . FH . . . | . . . . . . N . . V . | . ELLE . - . . . . . . . . . F . . . . | . . A . . . . . . . . . |
| iPS:39 3128 | 21-225_35F11 | VH3/3-23/D5[5-12]RF3/J H6 | . . . . . . | . . . . . . | . . . . . . | . . . . R . . . . . . . . . . . FH . . . . . . M . . | . . . . . . . . V . | . ELLE . - . . . . . . . . . F . . . | . . . . . . . . . . . |
| iPS:39 3146 | 21-225_34G8 | VH3/3-23/D5[5-12]RF3/J H6 | . . . . . . | . . . . . . | . . . . . . | . . . . R . . . . . . . . . . . FH . . . | . . . . . I . . . V . | . ELLE . - . . . . . . . . . F . . . | . . . . . . . . . . . |
| iPS:39 3150 | 21-225_36A5 | VH3/3-23/D5[5-12]RF3/J H6 | . . . . . . . N | . . . . . N . . . | . . . . . . | . . . . RR . . . . . . . . . . N . F . . . | . . . . . . . . . V . | . ELLE . - . . . . . . . . . A . . . | . . . . . . . . . . . |
| iPS:39 3180 | 21-225_4G12 | VH3/3-23/D5[5-12]RF3/J H6 | . . . . . . | . . . . . . | . . . . . . | TL . R . . . . . . . . . . . . . . . | . S . . . S . . . . . | WGR . S . E . . . . . . . . - . . . . | . . . . . . . . . . . |
| iPS:39 3232 | 21-225_17F12 | VH3/3-23/D5[5-12]RF3/J H6 | . . . . . . | . . . . . . | . . . . . . | . . . G . . . . . . . . . . . . . . . | . . . . . V . . . . . | WGR . N . E . . . . . . . . - . . . . | . . . . . . . . . . . |
| iPS:39 8494 | 21-225_21H4 | VH3/3-23/D5[5-12]RF3/J H6 | . . . . . . | . . . . . . | . . . . . . | . L . R . . . . . . . . . . . . . . . | . . . . . . . . . . . | WGR . S . E . . . . . . . . - . . . . | . . . . . . . . . . . |
| iPS:39 8508 | 21-225_24B1 | VH3/3-23/D5[5-12]RF3/J H6 | . . . . . . | . . . . . . | . . . . . . | . . . . R . . . . . . . . . . . . . . | . . . . . . . . . . . | . ELLE . - . . . . . . . . . . . . . | . . . . . . . . . . . |
| iPS:39 8528 | 21-225_32G1 | VH3/3-23/D5[5-12]RF3/J H6 | . . A . . . | . . . . . . | . . . . . . | . . . . R . . . . . . . . . . . FH . . . | . . . . . . . . . V . | . ELLE . - . . . . . . . . . F . . . | . . . . . . . . . . . |
| iPS:39 8534 | 21-225_33B8 | VH3/3-23/D5[5-12]RF3/J H6 | . . . . . . | . . . . . . | . . . . . . | . . . . R . . . . . . . . . . . FH . . . | . . . . . . . . . V . | . ELLE . - . . . . . . . . . F . . . | . . . . . . . . . . . |
| iPS:39 8540 | 21-225_35A6 | VH3/3-23/D5[5-12]RF3/J H6 | . . . . . . | . . . . . . | . . . . . . | . T . R . . . . . . . . . . . . FH . . . | . . . . . . . . . V . | . ELLE . - . . . . . . . . . F . . . | . . . . . . . . . . . |
| Germline | | | | | | | | | |

FIGURE 52 (Continued)

| VH4/4-39/D4/4-17/RF2/JH4 | | CDR/FR SEQUENCES LICHYSG CELLS | SS | SYMT | KTROPEK KLY CDRH3 SSGYYDP SIKE | KTLEYDSNKPFIKI SSTAAVDTALKAS | ENDS XXDY | NDGE XYGS |
|---|---|---|---|---|---|---|---|---|
| iPS:39 2622 | 21-225_17H8 | VH4/4-39/D4/4-17/RF2/JH4 | .......... | R..... | ....R N...<br>...G.N.. | .......... | HGK.W......GL.. | .......... |
| iPS:39 2638 | 21-225_17F9 | VH4/4-39/D4/4-17/RF2/JH4 | .......... | R..... | ....N... | .......N<br>.......S | HGK.W......GL.. | .......... |
| iPS:39 2656 | 21-225_1F2 | VH4/4-39/D4/4-17/RF2/JH4 | .......... | R..... | ....N.A.N<br>.......G | .......... | HGK.W......GL.. | .......... |
| iPS:39 2794 | 21-225_21H3 | VH4/4-39/D4/4-17/RF2/JH4 | .......... | R..... | ....N...D<br>.......... | .......G | HGK.M......GL.. | .......... |
| iPS:39 2822 | 21-225_23C8 | VH4/4-39/D4/4-17/RF2/JH4 | .......... | R..... | ....N.T.N<br>......D... | .......H<br>.......G | HGK.W......GL.. | .......... |
| iPS:39 2838 | 21-225_22G8 | VH4/4-39/D4/4-17/RF2/JH4 | .......... | R..... | ....N...<br>.......V.. | .......F | HGK.W......GL.. | .......... |
| iPS:39 2858 | 21-225_22H4 | VH4/4-39/D4/4-17/RF2/JH4 | .......... | R..... | ....N.H.<br>.......... | .......M<br>.......F.G | HGK.W......GL.. | .......... |
| iPS:39 2882 | 21-225_23A3 | VH4/4-39/D4/4-17/RF2/JH4 | .......... | R..... | ....Q N...<br>.......... | .......S<br>.......G | HGK.W......GL.F | .......... |
| iPS:39 3804 | 21-225_5H7 | VH4/4-39/D4/4-17/RF2/JH4 | ...N...... | R..... | ....N...<br>.......... | .......N<br>.......S | HGK.W......GL.. | .......... |
| iPS:39 3832 | 21-225_14B2 | VH4/4-39/D4/4-17/RF2/JH4 | ...N...... | R..... | ....N.T.<br>.......... | .......N<br>.......S | HGK.W......GL.. | .......... |
| iPS:39 4037 | 21-225_4F4 | VH4/4-39/D4/4-17/RF2/JH4 | .R........ | R..... | ....N...D<br>.......... | .......G | HGK.W......GL.. | .....A.... |

| | | H_FR1 | H_CDR1 | H_FR2 | H_CDR2 | H_FR3 | H_CDR3 | H_FR4 |
|---|---|---|---|---|---|---|---|---|
| iPS.39 3992 | 21-225_14H8 | VH3J3-48|D7|7-27|RF1/JH4 | ........N... | | ........I-- | .........A......... | GG.S......P... | ...... |
| iPS.39 4055 | 21-225_9C8 | VH3J3-48|D7|7-27|RF1/JH4 | .......Q... V. | | | | GG.S......P...S | ...... |
| | Germline | H_FR1 | H_CDR1 | H_FR2 | H_CDR2 | H_FR3 | H_CDR3 | H_FR4 |
| VH3J3-30.3|D4|4-11|RF2|JH4 | | EVQLLES GGGLVQPGGSLR LSCAASG-FTFS | YAMS | WVRQAPGK GLEWVS | AISGS GSSTYYAD SVKG | RFTISRDNSKNTLYLQM NSLRAEDTAVYYCAK | DYSNY SFDY | WGQGTL VTVSS |
| iPS.39 2694 | 21-225_19A5 | VH3J3-30.3|D4|4-11|RF2|JH4 | | | .....WF. ... | .........D... | | RAYS....SSS. | ...... |
| | Germline | H_FR1 | H_CDR1 | H_FR2 | H_CDR2 | H_FR3 | H_CDR3 | H_FR4 |
| VH3J3-23|D1|1-1|RF1|JH4 | | EVQLLES GGGLVQPGGSLR LSCAASG-FTFS | YAMS | WVRQAPGK GLEWVS | AISGS GSSTYYAD SVKG | RFTISRDNSKNTLYLQM NSLRAEDTAVYYCAK | STTCT SFDY | WGQGTL VTVSS |
| iPS.39 2714 | 21-225_16G12 | VH3J3-23|D1|1-1|RF1|JH4 | .....S.. | ...T | | ..T..R.. .H... .R... | .........A......S... | QD------C | ...... |
| iPS.39 2890 | 21-225_20H9 | VH3J3-23|D1|1-1|RF1|JH4 | .....S.. | | | ......Y... | .........E......... | GS-----LF. | ...... |
| iPS.39 2892 | 21-225_20C11 | VH3J3-23|D1|1-1|RF1|JH4 | | | | ..T..R.. .H... .R... | .........A......S... | QD------C | ...... |
| iPS.39 3968 | 21-225_5A5 | VH3J3-23|D1|1-1|RF1|JH4 | .....W.. | ...N | | ......Y... | .................S... | GS-----LF. | ...... |
| | Germline | H_FR1 | H_CDR1 | H_FR2 | H_CDR2 | H_FR3 | H_CDR3 | H_FR4 |
| VH3J3-23|D6|6-6|RF1|JH3 | | EVQLLES GGGLVQPGGSLR LSCAASG-FTFS | YAMS | WFRQAPGK GLEWVS | AISGS GSSTYYAD SYKG | RFTISRDNSKNTLYLQM NSLRAEDTAVYYCAK | EYSSSS DAFDI | WGQGTM VTVSS |
| iPS.39 2730 | 21-225_17A1 | VH3J3-23|D6|6-6|RF1|JH3 | | ...N | | ....V.... .SN... | | R.T.DW....H... | ...... |

| | | EVQLLES-...-...-...-...-...-...-...-...-...-...GGGLVQPGGSLR LSCAASG-FTFS | S----YAMS | WVRQAPGK GLEWVS | AISGS-GGSTYYAD SVKG | RFTISRDNSKNTLYLQM NSLRAEDTAVYYCAR | GYCSSISC----YFDAFD | WGQGTL VTVSS |
|---|---|---|---|---|---|---|---|---|
| | | VH3J3-23JD2J2-2JRF2JH3 | | | | | | H_FR4 |
| iPS.39 2874 | 21-225_21D2 | VH3J3-23JD2J2-2JRF2JH3 | .K.........N | M........... | ........... | VL........F.. | .......G......F..R | YCS.ARC-.........PY. | ........... |
| iPS.39 3940 | 21-225_16B2 | VH3J3-23JD2J2-2JRF2JH3 | ........... | ........T.. | ....P...... | V.........F.. | .......S......F..R | YCS.TRC-.........PY. | ........... |
| iPS.39 3956 | 21-225_4D7 | VH3J3-23JD2J2-2JRF2JH3 | .K.........  | ........... | ........... | VL........F.. | .......S......F..R | YCS.ARC-.........PY. | ........... |
| iPS.39 8476 | 21-225_17C1 | VH3J3-23JD2J2-2JRF2JH3 | E........... | ........... | ........... | V...T.F.. | .......S......F..R | YCS.TRC-.........PY. | ........... |
| | | Germline | H_FR1 | H_CDR1 | H_FR2 | H_CDR2 | H_FR3 | H_CDR3 | H_FR4 |
| | | VH3J3-15JD1J1-1JRF3JH4 | EVQLVES-...-...-...-...-...-...-...-...-...-...GGGLVQPGGSLR LSCAASG-FTFS | N----AWMS | WVRQAPGK GLEWVG | RIKSKT-DGGTTDA APVKG | RFTISRDDSKNTLYLQM NSLKTEDTAVYYCTT | YHMAD----YFDY | WGQGTL VTVSS |
| iPS.39 2898 | 21-225_21H10 | VH3J3-15JD1J1-1JRF3JH4 | ........... | ........N.. | ........... | ........... | ........... | EG....-...-T.. | ........... |
| iPS.39 3802 | 21-225_3D12 | VH3J3-15JD1J1-1JRF3JH4 | ........V... | ........T.. | ........... | ...N.I...V | ........... | EG....-...-T.. | ........... |
| | | Germline | H_FR1 | H_CDR1 | H_FR2 | H_CDR2 | H_FR3 | H_CDR3 | H_FR4 |
| | | VH3J3-48JD4J4-11JRF3JH4 | EVQLVES-...-...-...-...-...-...-...-...-...-...GGGLVQPGGSLR LSCAASG-FTFS | S----YSMN | WVRQAPGK GLEMVS | AISGS-SSTIYYAD SVKG | RFTISRDNSKNTLYLQM NSLRDEDTAVYYCAR | YYYT----YFDY | WGQGTL VTVSS |
| iPS.39 2950 | 21-225_25C10 | VH3J3-48JD4J4-11JRF3JH4 | ........... | .R........ | ........... | ...S........ | ........... | .AG-........ | ........... |
| | | Germline | H_FR1 | H_CDR1 | H_FR2 | H_CDR2 | H_FR3 | H_CDR3 | H_FR4 |
| | | VH3J3-23JD1J1-26JRF3JH4 | EVQLVES-...-...-...-...-...-...-...-...-...-...GGGLVQPGGSLR LSCAASG-FTFS | S----YAMS | WVRQAPGK GLEMVS | AISGS-GGSTYYAD SVKG | RFTISRDNSKNTLYLQM NSLRAEDTAVYYCAR | VSSSY----YFDY | WGQGTL VTVSS |

FIGURE 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:39 3010 | VH3|3-23/D1|1-26/RF3/JH4 | | | | ...V...G... | | RGY.GYE.......<br>.....DLL...C | |
| | Germline | H_FR1 | H_CDR1 | H_FR2 | H_CDR2 | H_FR3 | H_CDR3 | H_FR4 |
| | VH3|3-23/D3|3-3|RF3/JH3 | EVQLLES-<br>GGGLVQPGSLR<br>LSCAASG-FTFS | S------YAMS | WVRQAPGK<br>GLEWVS | AISGS---<br>GGSTYYAD<br>SVKG | RFTISRDNSKNTLYLQM<br>NSLRAEDTAVYYCAR | TIPGVV | WGQGTLV<br>TVSS |
| iPS:39 3016 | VH3|3-23/D3|3-3|RF3/JH3 | | | | ...VT... | | R.Q.D---<br>-.D. | |
| | Germline | H_FR1 | H_CDR1 | H_FR2 | H_CDR2 | H_FR3 | H_CDR3 | H_FR4 |
| | VH3|3-33/D3|3-22|RF2/JH6 | QVQLVES-<br>GGGVVQPGRSLR<br>LSCAASG-FTFS | S------YGMH | WVRQAPGK<br>GLEWVA | VIWY---<br>DGSNKYYAD<br>SVKG | RFTISRDNSKNTLYLQM<br>NSLRAEDTAVYYCAR | FTDSSTY--<br>YYYGMDV | WGQGTT<br>VTVSS |
| iPS:39 3032 | 21-225_26F8 | | G...... | | ...I.... | | ER..FW----<br>SGC.... | |
| | Germline | H_FR1 | H_CDR1 | H_FR2 | H_CDR2 | H_FR3 | H_CDR3 | H_FR4 |
| | VH1|1-02/D4|4-11|RF2/JH6 | QVQLVQS-<br>GAEVKKPGASVK<br>VSCKASG-YTFT | G------YYMH | WVRQAPGQ<br>GLEWMG | WINP---<br>NSGNTNYAQ<br>KFQG | RVTMTRDTSISTAYMEL<br>SRLRSDDTAVYYCAR | DISNYYY--<br>YYYGMDV | WGQGTT<br>VTVSS |
| iPS:39 3042 | 21-225_31F1 | | D...... | | ......M... | | S..FSNW......<br>YD...... | |
| iPS:39 3108 | 21-225_34G11 | | | | | | I..FSSW......<br>YD..A... | |
| | Germline | H_FR1 | H_CDR1 | H_FR2 | H_CDR2 | H_FR3 | H_CDR3 | H_FR4 |
| | VH1|1-18/D5|5-12|RF3/JH4 | QVQLVQS-<br>GAEVKKPGASVK<br>VSCKASG-YTFT | S------YGIS | WVRQAPGQ<br>GLEWMG | WISAY<br>NGNTNYAQ<br>KLQG | RVTMTTDTSTSTVYMEL<br>RSLRSDDTAVYYCAR | GYSGYD--<br>-.YYDY | WGQGTT<br>VTVSS |
| iPS:39 3044 | 21-225_25B8 | | | | ....T.... | | TAA..S......<br>......SSW... | |
| iPS:39 3050 | 21-225_28C5 | | ..D..... | | ....T.<br>..R.... | | TAA..S......<br>......SSW... | |
| | Germline | H_FR1 | H_CDR1 | H_FR2 | H_CDR2 | H_FR3 | H_CDR3 | H_FR4 |

| | | H_FR1 | H_CDR1 | H_FR2 | H_CDR2 | H_FR3 | H_CDR3 | H_FR4 |
|---|---|---|---|---|---|---|---|---|
| iPS-40 3872 | 21-225_8F11 | VH4|4-39/D4|4-11|RF1/JH4 | ...Q......V... | RT......... | .L............ | N......A.N... | ............G. | HG.DW......GL... | ......... |
| | Germline | VH1|1-08|D3|3-9|RF2|JH6 | QVQLVQS-GAEVKKPGASVK VSCKASG-YTFT | S------YDIH | WVRQATGQ GLEWMG | WINPN----- SGGTGYAQ KFQG | RVTMTRNTSISTAYMEL SSLRSEDTAVYYCAR | YDILLGLLED-- -IYYYCMDV | WGQGT LVTVSS |
| iPS-43 7240 | 21-225_84H12 | VH1|1-08|D3|3-9|RF2|JH6 | ............ | ............ | ............ | ...L..H..... | ...I.....W....R.. | GF.........S-- .....PT.....D | ......... |
| iPS-43 4577 | 21-225_75C11 | VH1|1-08|D3|3-9|RF2|JH6 | ............ | ............ | ............ | ...L..H..... | ...I.....W....R.. | GF.........S-- .....PT.....D | ......... |
| iPS-43 4553 | 21-225_76H12 | VH1|1-08|D3|3-9|RF2|JH6 | ............ | ............ | ............ | ...L..H..... | ...I.....W....R.. | GF.........S-- .....PT.....D | ......... |
| iPS-43 4927 | 21-225_86E5 | VH1|1-08|D3|3-9|RF2|JH6 | ............ | ............ | ............ | ............ | .........W....R.. | GF.........S-- .....PT.....D | ......... |
| | Germline | VH3|3-23|D6|6-19|RF2|JH4 | EVQLLES-GGGLVQPGGSLR LSCAASG-FTFS | S------YAMS | WVRQAPGK GLEWVS | A-ISGS-- GGSTYYAD SVRG | RFTISRDNSKNTLYLQM NSLRAEDTAVYYCAR | G-AVA-- -----GYPDY | WGQGT LVTVSS |
| iPS-43 5477 | 21-225_154E8 | VH3|3-23|D6|6-19|RF2|JH4 | ............ | ............ | ..........R. | ......N.F... | .............I.... | H.........GT GAH........ | .....A... |
| iPS-43 5385 | 21-225_149G7 | VH3|3-23|D6|6-19|RF2|JH4 | ............ | ............ | ............ | ......N.F... | .............I.... | H.........GT GAH........ | .....A... |

Figure 53 (Table 6)
Standard IgG Antibody Variable Region Protein Alignment
CDRs defined by Kabat
Alignment numbering defined by Amgen Reference (AHo)

| KAPPA_VARIABLE | Germline | K_FR1 | K_CDR1 | K_FR2 | K_CDR2 | K_FR3 | K_CDR3 | K_FR4 |
|---|---|---|---|---|---|---|---|---|
| VK4|B3|J K1 | | DIVMTQSPDSLAVSLG ERATINC | KSS--- QSVLYSSHNNNY LA | WYQQKPGQPPK LLIY | W------- ASTRES | GVPDRFSGSGSG--- TEFTLTISSLQAEDVAVY YC | QQYYS--------- --------TPPT | FGQGTK VEIK |
| iPS:39 2928 | 21- 225_25A4 K1 | VK4|B3|J K1 | DIVMTQFPDSLAVSLG ERATIKC | KSS--- QSVLYSSHNNNY LA | WYQQKPGQPPK LLIY | W------- ASTRES | GVPDRFSGSGSG--- TEFTLTISSLEAEDVAVY YC | QQYYS--------- --------TPPT | FGQGTK VEIK |
| iPS:42 4419 | 21- 225_25A4 .001 | VK4|B3|J K1 | DIVMTQFPDSLAVSLG ERATIKC | KSS--- QSVLYSSHNNNY LA | WYQQKPGQPPK LLIY | W------- ASTRES | GVPDRFSGSGSG--- TEFTLTISSLEAEDVAVY YC | QQYYS--------- --------TPPT | FGQGTK VEIK |
| iPS:44 1468 | 21- 225_25A4 .001.001 | VK4|B3|J K1 | DIVMTQFPDSLAVSLG ERATIKC | KSS--- QSVLYSSHNNNY LA | WYQQKPGQPPK LLIY | W------- ASTRES | GVPDRFSGSGSG--- TEFTLTISSLEAEDVAVY YC | QQYYS--------- --------TPPT | FGQGTK VEIK |
| iPS:44 1475 | 21- 225_25A4 .001.002 | VK4|B3|J K1 | DIVMTQFPDSLAVSLG ERATIKC | KSS--- QSVLYSSHNNNY LA | WYQQKPGQPPK LLIY | W------- ASTRES | GVPDRFSGSGSG--- TEFTLTISSLEAEDVAVY YC | QQYYS--------- --------TPPT | FGQGTK VEIK |
| iPS:44 1482 | 21- 225_25A4 .001.003 | VK4|B3|J K1 | DIVMTQFPDSLAVSLG ERATIKC | KSS--- QSVLYSSHNNNY LA | WYQQKPGQPPK LLIY | W------- ASTRES | GVPDRFSGSGSG--- TEFTLTISSLEAEDVAVY YC | QQYYS--------- --------TPPT | FGQGTK VEIK |
| iPS:44 1489 | 21- 225_25A4 .001.004 | VK4|B3|J K1 | DIVMTQFPDSLAVSLG ERATIKC | KSS--- QSVLYSSHNNNY LA | WYQQKPGQPPK LLIY | W------- ASTRES | GVPDRFSGSGSG--- TEFTLTISSLEAEDVAVY YC | QQYYS--------- --------TPPT | FGQGTK VEIK |
| iPS:44 1496 | 21- 225_25A4 .001.005 | VK4|B3|J K1 | DIVMTQSPDSLAVSLG ERATIKC | KSS--- QSVLYSSHNNNY LA | WYQQKPGQPPK LLIY | W------- ASTRES | GVPDRFSGSGSG--- TEFTLTISSLQAEDVAVY YC | QQYYS--------- --------TPPT | FGQGTK VEIK |
| iPS:44 1505 | 21- 225_25A4 .001.006 | VK4|B3|J K1 | DIVMTQSPDSLAVSLG ERATIKC | KSS--- QSVLYSSHNNNY LA | WYQQKPGQPPK LLIY | W------- ASTRES | GVPDRFSGSGSG--- TEFTLTISSLQAEDVAVY YC | QQYYS--------- --------TPPT | FGQGTK VEIK |
| iPS:44 1512 | 21- 225_25A4 .001.007 | VK4|B3|J K1 | DIVMTQSPDSLAVSLG ERATIKC | KSS--- QSVLYSSHNNNY LA | WYQQKPGQPPK LLIY | W------- ASTRES | GVPDRFSGSGSG--- TEFTLTISSLQAEDVAVY YC | QQYYS--------- --------TPPT | FGQGTK VEIK |
| iPS:44 1519 | 21- 225_25A4 .001.008 | VK4|B3|J K1 | DIVMTQFPDSLAVSLG ERATIKC | KSS--- QSVLYSSHNNNY LA | WYQQKPGQPPK LLIY | W------- ASTRES | GVPDRFSGSGSG--- TEFTLTISSLQAEDVAVY YC | QQYYS--------- --------TPPT | FGQGTK VEIK |
| iPS:44 1554 | 21- 225_25A4 .001.013 | VK4|B3|J K1 | DIVMTQFPDSLAVSLG ERATIKC | KSS--- QSVLYSSHNNNY LA | WYQQKPGQPPK LLIY | W------- ASTRES | GVPDRFSGSGSG--- TEFTLTISSLEAEDVAVY YC | QQYYS--------- --------TPPT | FGQGTK VEIK |
| iPS:44 1595 | 21- 225_25A4 .001.019 | VK4|B3|J K1 | DIVMTQFPDSLAVSLG ERATINC | KSS--- QSVLYSSHNNNY LA | WYQQKPGQPPK LLIY | W------- ASTRES | GVPDRFSGSGSG--- TEFLTITSSLEAEDVAVY YC | QQYYS--------- --------TPPT | FGQGTK VEIK |

FIGURE 53 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:44 1604 | 21-225_25A4 .001.020 | VK4\|B3\|J K1 | DIVMTQSPDSLAVSLG ERATINC | KSS---QSVLYSSHNNNY LA | WYQQKPGQPPK LLIY | W-------ASTRES | GVPDRFSGSGSG---TEFTLTISSLQAEDVAVY YC | QQYYS---------TPPT | FGQGTK VEIK |
| iPS:44 1613 | 21-225_25A4 .001.021 | VK4\|B3\|J K1 | DIVMTQSPDSLAVSLG ERATINC | KSS---QSVLYSSHNNNY LA | WYQQKPGQPPK LLIY | W-------ASTRES | GVPDRFSGSGSG---TEFTLTISSLQAEDVAVY YC | QQYYS---------TPPT | FGQGTK VEIK |
| iPS:44 3006 | 21-225_25A4 .001.029 | VK4\|B3\|J K1 | DIVMTQSPDSLAVSLG ERATINC | KSS---QSVLYSSHNNNY LA | WYQQKPGQPPK LLIY | W-------ASTRES | GVPDRFSGSGSG---TEFTLTISSLQAEDVAVY YC | QQYYS---------TPPT | FGQGTK VEIK |
| iPS:44 1962 | 21-225_4A2. 001.023 | VK4\|B3\|J K1 | DIVMTQSPDSLAVSLG ERATINC | KSS---QSILHSSNNNRY LA | WFQQKPGQPPK LLIY | W-------ASTRES | GVPDRFSGSGSG---TDFTLTISSLQPEDVAVY YC | QQYYS---------TPVT | FGQGTK VEIK |
| iPS:44 1999 | 21-225_4A2. 001.028 | VK4\|B3\|J K1 | DIVMTQSPDSLAVSLG ERATINC | KSS---QSILHSSNNNRY LA | WFQQKPGQPPK LLIY | W-------ASTRES | GVPDRFSGSGSG---TDFTLTISSLQPEDVAVY YC | QQYYS---------TPVT | FGQGTK VEIK |
| iPS:44 2006 | 21-225_4A2. 001.029 | VK4\|B3\|J K1 | DIVMTQSPDSLAVSLG ERATINC | KSS---QSILHSSNNNRY LA | WFQQKPGQPPK LLIY | W-------ASTRES | GVPDRFSGSGSG---TDFTLTISSLQPEDVAVY YC | QQYYS---------TPVT | FGQGTK VEIK |
| iPS:44 2020 | 21-225_4A2. 001.031 | VK4\|B3\|J K1 | DIVMTQSPDSLAVSLG ERATINC | KSS---QSILHSSNNNRY LA | WFQQKPGQPPK LLIY | W-------ASTRES | GVPDRFSGSGSG---TDFTLTISSLQPEDVAVY YC | QQYYN---------TPVT | FGPGTK VEIK |
| Germline VK1\|L5\|J K3 | | | DIQMTQSPSSVSASVG DRVTITC | RAS---QGIS----SNLA | WYQQKPGKAPK LLIY | G-------ASSLQS | GVPSRFSGSGSG---TDFTLTISSLQPEDFAIY YC | QQANS---------FPFT | FGPGTK VDIK |
| iPS:39 3954 | 21-225_4H6 | VK1\|L5\|J K3 | DIQMTQSPSSVSASVG DRVTITC | RAS---QGIS----RWLA | WYQQKPGKAPK LLIY | G-------ASSLQS | GVPSRFSGSGSG---TDFTLTISSLQPEDFAIY YC | QQANS---------FPFT | FGPGTK VDIK |
| iPS:44 2050 | 21-225_4H6. 004 | VK1\|L5\|J K3 | DIQMTQSPSSVSASVG DRVTITC | RAS---QGIS----RWLA | WYQQKPGKAPK LLIY | G-------ASSLQS | GVPSRFSGSGSG---TDFTLTISSLQPEDFAIY YC | QQANS---------FPFT | FGPGTK VDIK |
| iPS:44 2059 | 21-225_4H6. 005 | VK1\|L5\|J K3 | DIQMTQSPSSVSASVG DRVTITC | RAS---QGIS----RWLA | WYQQKPGKAPK LLIY | G-------ASSLQS | GVPSRFSGSGSG---TDFTLTISSLQPEDFAIY YC | QQANS---------FPFT | FGQGTK VDIK |
| iPS:44 2065 | 21-225_4H6. 006 | VK1\|L5\|J K3 | DIQMTQSPSSVSASVG DRVTITC | RAS---QGIS----RWLA | WYQQKPGKAPK LLIY | G-------ASSLQS | GVPSRFSGSGSG---TDFTLTISSLQPEDFAIY YC | QQANS---------FPFT | FGQGTK VDIK |
| iPS:44 2071 | 21-225_4H6. 007 | VK1\|L5\|J K3 | DIQMTQSPSSVSASVG DRVTITC | RAS---QGIS----RWLA | WYQQKPGKAPK LLIY | G-------ASSLQS | GVPSRFSGSGSG---TDFTLTISSLQPEDFAIY YC | QQANS---------FPFT | FGQGTK VDIK |
| iPS:44 2078 | 21-225_4H6. 008 | VK1\|L5\|J K3 | DIQMTQSPSSVSASVG DRVTITC | RAS---QGIS----RWLA | WYQQKPGKAPK LLIY | G-------ASSLQS | GVPSRFSGSGSG---TDFTLTISSLQPEDFAIY YC | QQANS---------FPFT | FGPGTK VDIK |
| iPS:44 2085 | 21-225_4H6. 009 | VK1\|L5\|J K3 | DIQMTQSPSSVSASVG DRVTITC | RAS---QGIS----RWLA | WYQQKPGKAPK LLIY | G-------ASSLQS | GVPSRFSGSGSG---TDFTLTISSLQPEDFAIY YC | QQANS---------FPFT | FGQGTK VDIK |

FIGURE 53 (Continued)

| | | | FR1 | CDR1 | FR2 | CDR2 | FR3 | CDR3 | FR4 |
|---|---|---|---|---|---|---|---|---|---|
| iPS:44 2089 | 21-225_4H6.010 | VK1\|L5/J K3 | DIQMTQSPSSVSASVG DRVTITC | RAS--QGIS-----RWLA | WYQQKPGKAPK LLIY | G--------- ASSLQS | GVPSRFSGSGSG--TDFTLTISSLQPEDFATY YC | QQANS----------FPFT | FGQGTK VDIK |
| iPS:44 2093 | 21-225_4H6.011 | VK1\|L5/J K3 | DIQMTQSPSSVSASVG DRVTITC | RAS--QGIS-----RWLA | WYQQKPGKAPK LLIY | G--------- ASSLQS | GVPSRFSGSGSG--TDFTLTISSLQPEDFATY YC | QQANS----------FPFT | FGQGTK VDIK |
| iPS:44 3016 | 21-225_4H6.014 | VK1\|L5/J K3 | DIQMTQSPSSVSASVG DRVTITC | RAS--QGIS-----RWLA | WYQQKPGKAPK LLIY | G--------- ASSLQS | GVPSRFSGSGSG--TDFTLTISSLQPEDFATY YC | QQANS----------FPFT | FGPGTK VDIK |
| | Germline | K_FR1 | | K_CDR1 | K_FR2 | K_CDR2 | K_FR3 | K_CDR3 | K_FR4 |
| | VK4\|B3/J K3 | | DIVMTQSPDSLAVSLG ERATINC | KSS---QSILHSSNNNNY LA | WFQQKPGQPPK LLIY | W--------- ASTRES | GVPDRFSGSGSG--TDFTLTISSLQPEDVAVY YC | QQYT----------TPVT | FGPGTK VGIK |
| iPS:41 2232 | 21-225_4A2 | VK4\|B3/J K3 | DIVMTQSPDSLAVSLG ERATINC | KSS---QSILHSSNNNNY LA | WFQQKPGQPPK LLIY | W--------- ASTRES | GVPDRFSGSGSG--TDFTLTISSLQPEDVAVY YC | QQYN----------TPVT | FGPGTK VGIK |
| iPS:42 2894 | 21-225_4A2.001 | VK4\|B3/J K3 | DIVMTQSPDSLAVSLG ERATINC | KSS---QSILHSSNNNNY LA | WFQQKPGQPPK LLIY | W--------- ASTRES | GVPDRFSGSGSG--TDFTLTISSLQPEDVAVY YC | QQYN----------TPVT | FGPGTK VGIK |
| iPS:44 1841 | 21-225_4A2.001.001 | VK4\|B3/J K3 | DIVMTQSPDSLAVSLG ERATINC | KSS---QSILHSSNNNNY LA | WFQQKPGQPPK LLIY | W--------- ASTRES | GVPDRFSGSGSG--TDFTLTISSLQPEDVAVY YC | QQYYS---------TPVT | FGPGTK VGIK |
| iPS:44 1847 | 21-225_4A2.001.002 | VK4\|B3/J K3 | DIVMTQSPDSLAVSLG ERATINC | KSS---QSILHSSNNNNY LA | WFQQKPGQPPK LLIY | W--------- ASTRES | GVPDRFSGSGSG--TDFTLTISSLQPEDVAVY YC | QQYN----------APVT | FGPGTK VGIK |
| iPS:44 1853 | 21-225_4A2.001.003 | VK4\|B3/J K3 | DIVMTQSPDSLAVSLG ERATINC | KSS---QSILHSSNNNNY LA | WFQQKPGQPPK LLIY | W--------- ASTRES | GVPDRFSGSGSG--TDFTLTISSLQPEDVAVY YC | QQYN----------TPVT | FGPGTK VGIK |
| iPS:44 1859 | 21-225_4A2.001.004 | VK4\|B3/J K3 | DIVMTQSPDSLAVSLG ERATINC | KSS---QSILHSSNNNNY LA | WFQQKPGQPPK LLIY | W--------- ASTRES | GVPDRFSGSGSG--TDFTLTISSLQPEDVAVY YC | QQYN----------TPVT | FGPGTK VGIK |
| iPS:44 1866 | 21-225_4A2.001.005 | VK4\|B3/J K3 | DIVMTQSPDSLAVSLG ERATINC | KSS---QSILHSSNNNNY LA | WFQQKPGQPPK LLIY | W--------- ASTRES | GVPDRFSGSGSG--TDFTLTISSLQPEDVAVY YC | QQYQ----------TPVT | FGPGTK VGIK |
| iPS:44 1873 | 21-225_4A2.001.006 | VK4\|B3/J K3 | DIVMTQSPDSLAVSLG ERATINC | KSS---QSILHSSNNNNY LA | WFQQKPGQPPK LLIY | W--------- ASTRES | GVPDRFSGSGSG--TDFTLTISSLQPEDVAVY YC | QQYN----------TPVT | FGPGTK VGIK |
| iPS:44 1880 | 21-225_4A2.001.007 | VK4\|B3/J K3 | DIVMTQSPDSLAVSLG ERATINC | KSS---QSILHSSNNNNY LA | WFQQKPGQPPK LLIY | W--------- ASTRES | GVPDRFSGSGSG--TDFTLTISSLQPEDVAVY YC | QQYS----------TPVT | FGPGTK VGIK |
| iPS:44 1884 | 21-225_4A2.001.008 | VK4\|B3/J K3 | DIVMTQSPDSLAVSLG ERATINC | KSS---QSILHSSNNNNY LA | WFQQKPGQPPK LLIY | W--------- ASTRES | GVPDRFSGSGSG--TDFTLTISSLQPEDVAVY YC | QQYS----------TPVT | FGPGTK VGIK |
| iPS:44 1888 | 21-225_4A2.001.009 | VK4\|B3/J K3 | DIVMTQSPDSLAVSLG ERATINC | KSS---QSILHSSNNNNY LA | WFQQKPGQPPK LLIY | W--------- ASTRES | GVPDRFSGSGSG--TDFTLTISSLQPEDVAVY YC | QQYN----------APVT | FGPGTK VGIK |

FIGURE 53 (Continued)

| | | K_FR1 | K_CDR1 | K_FR2 | K_CDR2 | K_FR3 | K_CDR3 | K_FR4 |
|---|---|---|---|---|---|---|---|---|
| IPS:44 1892 | 21-225_4A2. 001.010 | VK4|B3/JK3 | DIVMTQSPDSLAVSLG ERATINC | KSS---QSILHSSNNNNY LA | WFQQKPGQPPK LLLY | W-------ASTRES | GVPDRFSGGSGS---TDFTLTISSLQPEDVAVY YC | QQYYQ------------TPVT | FGPGTK VGIK |
| IPS:44 1896 | 21-225_4A2. 001.011 | VK4|B3/JK3 | DIVMTQSPDSLAVSLG ERATINC | KSS---QSILHSSNNNNY LA | WFQQKPGQPPK LLLY | W-------ASTRES | GVPDRFSGGSGS---TDFTLTISSLQPEDVAVY YC | QQYYQ------------TPVT | FGPGTK VGIK |
| IPS:44 1900 | 21-225_4A2. 001.012 | VK4|B3/JK3 | DIVMTQSPDSLAVSLG ERATINC | KSS---QSILHSSNNNNY LA | WFQQKPGQPPK LLLY | W-------ASTRES | GVPDRFSGGSGS---TDFTLTISSLQPEDVAVY YC | QQYYQ------------TPVT | FGPGTK VGIK |
| IPS:44 1955 | 21-225_4A2. 001.022 | VK4|B3/JK3 | DIVMTQSPDSLAVSLG ERATINC | KSS---QSILHSSNNNNY LA | WFQQKPGQPPK LLLY | W-------ASTRES | GVPDRFSGGSGS---TDFTLTISSLQPEDVAVY YC | QQYYS------------TPVT | FGPGTK VGIK |
| IPS:44 1971 | 21-225_4A2. 001.024 | VK4|B3/JK3 | DIVMTQSPDSLAVSLG ERATINC | KSS---QSILHSSNNNNY LA | WFQQKPGQPPK LLLY | W-------ASTRES | GVPDRFSGGSGS---TDFTLTISSLQPEDVAVY YC | QQYYS------------TPVT | FGPGTK VGIK |
| Germline | | | | | | | | | |
| | VK1|A30/JK1 | | | | | | | | |
| IPS:39 4041 | 21-225_5E5 | VK1|A30/JK1 | DIQMTQSPSSLSASVG DRVTITC | RAS---QGIR----NDLG | WYQQKPGKAPK RLIY | A-------ASSLQS | GVPSRFSGGSGS---TEFTLTIISSLQPEDFATY YC | LQHYS------------YPRT | FGQGTK VEVK |
| IPS:44 2115 | 21-225_5E5. 003 | VK1|A30/JK1 | DIQMTQSPSSLSASVG DRVTITC | RAS---QGIR----NDLG | WYQQKPGKAPK RLIY | A-------ASSLQS | GVPSRFSGGSGS---TEFTLTIISSLQPEDFATY YC | LQHYS------------YPRT | FGQGTK VEVK |
| IPS:44 2122 | 21-225_5E5. 004 | VK1|A30/JK1 | DIQMTQSPSSLSASVG DRVTITC | RAS---QGIR----NDLG | WYQQKPGKAPK RLIY | A-------ASSLQS | GVPSRFSGGSGS---TEFTLTIISSLQPEDFATY YC | LQHYS------------YPRT | FGQGTK VEVK |
| IPS:44 2129 | 21-225_5E5. 005 | VK1|A30/JK1 | DIQMTQSPSSLSASVG DRVTITC | RAS---QGIR----NDLG | WYQQKPGKAPK RLIY | A-------ASSLQS | GVPSRFSGGSGS---TEFTLTIISSLQPEDFATY YC | LQHYS------------YPRT | FGQGTK VEVK |
| IPS:44 2136 | 21-225_5E5. 006 | VK1|A30/JK1 | DIQMTQSPSSLSASVG DRVTITC | RAS---QGIR----NDLG | WYQQKPGKAPK RLIY | A-------ASSLQS | GVPSRFSGGSGS---TEFTLTIISSLQPEDFATY YC | LQHYS------------YPRT | FGQGTK VEVK |
| IPS:44 2171 | 21-225_5E5. 011 | VK1|A30/JK1 | DIQMTQSPSSLSASVG DRVTITC | RAS---QGIR----NDLG | WYQQKPGKAPK RLIY | A-------ASSLQS | GVPSRFSGGSGS---TEFTLTIISSLQPEDFATY YC | LQHYS------------YPRT | FGQGTK VEVK |
| IPS:44 2178 | 21-225_5E5. 012 | VK1|A30/JK1 | DIQMTQSPSSLSASVG DRVTITC | RAS---QGIR----NDLG | WYQQKPGKAPK RLIY | A-------ASSLQS | GVPSRFSGGSGS---TEFTLTIISSLQPEDFATY YC | LQHYS------------YPRT | FGQGTK VEVK |
| IPS:44 2199 | 21-225_5E5. 015 | VK1|A30/JK1 | DIQMTQSPSSLSASVG DRVTITC | RAS---QGIR----NDLG | WYQQKPGKAPK RLIY | A-------ASSLQS | GVPSRFSGGSGS---TEFTLTIISSLQPEDFATY YC | LQHYS------------YPRT | FGQGTK VEVK |
| IPS:44 2206 | 21-225_5E5. 016 | VK1|A30/JK1 | DIQMTQSPSSLSASVG DRVTITC | RAS---QGIR----NDLG | WYQQKPGKAPK RLIY | A-------ASSLQS | GVPSRFSGGSGS---TEFTLTIISSLQPEDFATY YC | LQHYS------------YPRT | FGQGTK VEVK |

FIGURE 53 (Continued)

| | | K_FR1 | K_CDR1 | K_FR2 | K_CDR2 | K_FR3 | K_CDR3 | K_FR4 |
|---|---|---|---|---|---|---|---|---|
| iPS:44 2213 | 21-225_5E5. 017 | VK1A30/ JK1 | DIQMTQSPSSLSASVG DRVTITC | RAS--QGIR----NDLG | WYQQKPGKAPK RLIY | A------ASSLQS | GVPSRFSGSGSG--TEFTLTISSLQPEDFATY YC | LQHYS----------YPRT | FGQGTK VEVK |
| iPS:44 2220 | 21-225_5E5. 018 | VK1A30/ JK1 | DIQMTQSPSSLSASVG DRVTITC | RAS--QGIR----NDLG | WYQQKPGKAPK RLIY | A------ASSLQS | GVPSRFSGSGSG--TEFTLTISSLQPEDFATY YC | LQHYS----------YPRT | FGQGTK VEVK |
| iPS:44 2227 | 21-225_5E5. 019 | VK1A30/ JK1 | DIQMTQSPSSLSASVG DRVTITC | RAS--QGIR----NDLG | WYQQKPGKAPK RLIY | A------ASSLQS | GVPSRFSGSGSG--TEFTLTISSLQPEDFATY YC | LQHYS----------YPRT | FGQGTK VEVK |
| iPS:44 2255 | 21-225_5E5. 023 | VK1A30/ JK1 | DIQMTQSPSSLSASVG DRVTITC | RAS--QGIR----NDLG | WYQQKPGKAPK RLIY | A------ASSLQS | GVPSRFSGSGSG--TEFTLTISSLQPEDFATY YC | LQHYS----------YPRT | FGQGTK VEVK |
| iPS:44 2262 | 21-225_5E5. 024 | VK1A30/ JK1 | DIQMTQSPSSLSASVG DRVTITC | RAS--QGIR----NDLG | WYQQKPGKAPK RLIY | A------ASSLQS | GVPSRFSGSGSG--TEFTLTISSLQPEDFATY YC | LQHYS----------YPRT | FGQGTK VEVK |
| iPS:44 2269 | 21-225_5E5. 025 | VK1A30/ JK1 | DIQMTQSPSSLSASVG DRVTITC | RAS--QGIR----NDLG | WYQQKPGKAPK RLIY | A------ASSLQS | GVPSRFSGSGSG--TEFTLTISSLQPEDFATY YC | LQHYS----------YPRT | FGQGTK VEVK |
| Germline | VK1O12/ JK4 | DIQMTQSPSSLSASVG DRVTIAC | RAS--QGIS----SYLN | WYQQKPGKAPK LLIY | T------ASSLQS | GVPSRFSGSGSG--TDFTLTISSLQPEDFAIY YC | QQSYS----------TPLT | FGGGTK VEIK |
| iPS:39 3930 | 21-225_7E11 .001 | VK1O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS----------TPLT | FGGGTK VEIK |
| iPS:42 4460 | 21-225_7E11 .001 | VK1O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS----------TPLT | FGGGTK VEIK |
| iPS:44 2311 | 21-225_7E11 .001.001 | VK1O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS----------TPLT | FGGGTK VEIK |
| iPS:44 2317 | 21-225_7E11 .001.002 | VK1O12/ JK4 | DIQMTQSPSSLSASVG DRVTIAC | RAS--QNII----SYLN | WYQQKPGKAPK LLIY | T------ASSLQS | GVPSRFSGSGSG--TDFTLTISSLQPEDFAIY YC | QQTYS----------TPLT | FGGGTK VEIK |
| iPS:44 2323 | 21-225_7E11 .001.003 | VK1O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS----------TPLT | FGGGTK VEIK |
| iPS:44 2330 | 21-225_7E11 .001.004 | VK1O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS----------TPLT | FGGGTK VEIK |
| iPS:44 2337 | 21-225_7E11 .001.005 | VK1O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS----------TPLT | FGGGTK VEIK |
| iPS:44 2344 | 21-225_7E11 .001.006 | VK1O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS----------TPLT | FGGGTK VEIK |

FIGURE 53 (Continued)

| | | | | | | | | | |
|---|---|---|---|---|---|---|---|---|---|
| iPS:44 2351 | 21-225_7E11 .001.007 | VK1|O12/ JK4 | DIQMTQSPSSLSASVG DRVTIAC | RAS--QNII--- ---SYLN | WYQQKPGKAPK FLIY | T------- ASSLQS | GVPSRFSGSGSG--- TDFTLTISSLQPEDFAIY YC | QQTYS----------TPLT | FGGGTK VEIK |
| iPS:44 2358 | 21-225_7E11 .001.008 | VK1|O12/ JK4 | DIQMTQSPSSLSASVG DRVTIAC | RAS--QNII--- ---SYLN | WYQQKPGKAPK FLIY | T------- ASSLQS | GVPSRFSGSGSG--- TDFTLTISSLQPEDFAIY YC | QQTYS----------TPLT | FGGGTK VEIK |
| iPS:44 2365 | 21-225_7E11 .001.009 | VK1|O12/ JK4 | DIQMTQSPSSLSASVG DRVTIAC | RAS--QNII--- ---SYLN | WYQQKPGKAPK FLIY | T------- ASSLQS | GVPSRFSGSGSG--- TDFTLTISSLQPEDFAIY YC | QQTYS----------TPLT | FGGGTK VEIK |
| iPS:44 2372 | 21-225_7E11 .001.010 | VK1|O12/ JK4 | DIQMTQSPSSLSASVG DRVTIAC | RAS--QNII--- ---SYLN | WYQQKPGKAPK FLIY | T------- ASSLQS | GVPSRFSGSGSG--- TDFTLTISSLQPEDFAIY YC | QQTYS----------TPLT | FGGGTK VEIK |
| iPS:44 2379 | 21-225_7E11 .001.011 | VK1|O12/ JK4 | DIQMTQSPSSLSASVG DRVTIAC | RAS--QNII--- ---SYLN | WYQQKPGKAPK FLIY | T------- ASSLQS | GVPSRFSGSGSG--- TDFTLTISSLQPEDFAIY YC | QQTYS----------TPLT | FGGGTK VEIK |
| iPS:44 2386 | 21-225_7E11 .001.012 | VK1|O12/ JK4 | DIQMTQSPSSLSASVG DRVTITC | RAS--QNII--- ---SYLN | WYQQKPGKAPK FLIY | T------- ASSLQS | GVPSRFSGSGSG--- TDFTLTISSLQPEDFAIY YC | QQTYS----------TPLT | FGGGTK VEIK |
| iPS:44 2390 | 21-225_7E11 .001.013 | VK1|O12/ JK4 | DIQMTQSPSSLSASVG DRVTITC | RAS--QNII--- ---SYLN | WYQQKPGKAPK FLIY | T------- ASSLQS | GVPSRFSGSGSG--- TDFTLTISSLQPEDFAIY YC | QQTYS----------TPLT | FGGGTK VEIK |
| iPS:44 2394 | 21-225_7E11 .001.014 | VK1|O12/ JK4 | DIQMTQSPSSLSASVG DRVTITC | RAS--QNII--- ---SYLN | WYQQKPGKAPK FLIY | T------- ASSLQS | GVPSRFSGSGSG--- TDFTLTISSLQPEDFAIY YC | QQTYS----------TPLT | FGGGTK VEIK |
| iPS:44 2398 | 21-225_7E11 .001.015 | VK1|O12/ JK4 | DIQMTQSPSSLSASVG DRVTITC | RAS--QNII--- ---SYLN | WYQQKPGKAPK FLIY | T------- ASSLQS | GVPSRFSGSGSG--- TDFTLTISSLQPEDFAIY YC | QQTYS----------TPLT | FGGGTK VEIK |
| iPS:44 2402 | 21-225_7E11 .001.016 | VK1|O12/ JK4 | DIQMTQSPSSLSASVG DRVTITC | RAS--QNII--- ---SYLN | WYQQKPGKAPK FLIY | T------- ASSLQS | GVPSRFSGSGSG--- TDFTLTISSLQPEDFAIY YC | QQTYS----------TPLT | FGGGTK VEIK |
| iPS:44 2406 | 21-225_7E11 .001.017 | VK1|O12/ JK4 | DIQMTQSPSSLSASVG DRVTITC | RAS--QNII--- ---SYLN | WYQQKPGKAPK LLIY | T------- ASSLQS | GVPSRFSGSGSG--- TDFTLTISSLQPEDFAIY YC | QQTYS----------TPLT | FGGGTK VEIK |
| iPS:44 2410 | 21-225_7E11 .001.018 | VK1|O12/ JK4 | DIQMTQSPSSLSASVG DRVTITC | RAS--QNII--- ---SYLN | WYQQKPGKAPK LLIY | T------- ASSLQS | GVPSRFSGSGSG--- TDFTLTISSLQPEDFAIY YC | QQTYS----------TPLT | FGGGTK VEIK |
| iPS:44 2417 | 21-225_7E11 .001.019 | VK1|O12/ JK4 | DIQMTQSPSSLSASVG DRVTITC | RAS--QNII--- ---SYLN | WYQQKPGKAPK FLIY | T------- ASSLQS | GVPSRFSGSGSG--- TDFTLTISSLQPEDFAIY YC | QQTYS----------TPLT | FGGGTK VEIK |
| iPS:44 2431 | 21-225_7E11 .001.021 | VK1|O12/ JK4 | DIQMTQSPSSLSASVG DRVTIAC | RAS--QNII--- ---SYLN | WYQQKPGKAPK FLIY | T------- ASSLQS | GVPSRFSGSGSG--- TDFTLTISSLQPEDFAIY YC | QQTYS----------TPLT | FGGGTK VEIK |
| iPS:44 2438 | 21-225_7E11 .001.022 | VK1|O12/ JK4 | DIQMTQSPSSLSASVG DRVTITC | RAS--QNII--- ---SYLN | WYQQKPGKAPK FLIY | T------- ASSLQS | GVPSRFSGSGSG--- TDFTLTISSLQPEDFAIY YC | QQTYS----------TPLT | FGGGTK VEIK |

FIGURE 53 (Continued)

| | | | | HEAVY_VARIABLE | | | | | | | |
|---|---|---|---|---|---|---|---|---|---|---|---|
| iPS:44 3027 | 21-225_7E11 .001.023 | VK1O12/ JK4 | DIQMTQSPSSLSASVG DRVTIAC | RAS--QMI-----SYLN | WYQQKPGKAPK FLIY | T------ASSLQS | GVPSRFSGSGSG--IDFTLTISSLQPEDFAIY YC | QQTYS--------TPLT | PGGGTK VEIK | | |
| | | | Germline | H_FR1 | H_CDR1 | H_FR2 | H_CDR2 | H_FR3 | H_CDR3 | H_FR4 | | |
| | | | VH1|1-08/D6|6-19|RF1/J H4 | QVQLVQS GAEVKKPGSSVKVSCK ASG-YTFT | YDIN | WVRQATGQGLE WMG | SGNTGYAQK FQG | RVTMTRDTSISTAYMELS SLRSEDTAVYYCAS | SSGWY YFDY | WGQGTL VTVSS | | |
| iPS:39 2928 | 21-225_25A4 .001.001 | | VH1|1-08/D6|6-19|RF1/J H4 | QVLLVQS-GAEVKRPGASVKVSCK ASG-YTFT | N------YDIN | WVRQATGQGLE WMG | WMYPN-----SGNTGYAQK FQG | RVTMTRNTSISTAYMELS SLRSEDTAVYYCAS | SSGWY-------YFDY | WGQGTL VTVSS | | |
| iPS:42 4419 | 21-225_25A4 .001 | | VH1|1-08/D6|6-19|RF1/J H4 | QVLLVQS-GAEVKRPGASVKVSCK ASG-YTFT | N------YDIN | WVRQATGQGLE WMG | WMYPN-----SGNTGYAQK FQG | RVTMTRDTSISTAYMELS SLRSEDTAVYYCAS | SSGWY-------YFDY | WGQGTL VTVSS | | |
| iPS:44 1468 | 21-225_25A4 .001.001 | | VH1|1-08/D6|6-19|RF1/J H4 | QVLLVQS-GAEVKRPGASVKVSCK ASG-YTFT | N------YDIN | WVRQATGQGLE WMG | WMYPN-----SGSTGYAQK FQG | RVTMTRDTSISTAYMELS SLRSEDTAVYYCAS | SSGWY-------YFDY | WGQGTL VTVSS | | |
| iPS:44 1475 | 21-225_25A4 .001.002 | | VH1|1-08/D6|6-19|RF1/J H4 | QVLLVQS-GAEVKRPGASVKVSCK ASG-YTFT | N------YDIN | WVRQATGQGLE WMG | WMYPN-----SGNAGYAQK FQG | RVTMTRDTSISTAYMELS SLRSEDTAVYYCAS | SSGWY-------YFDY | WGQGTL VTVSS | | |
| iPS:44 1482 | 21-225_25A4 .001.003 | | VH1|1-08/D6|6-19|RF1/J H4 | QVLLVQS-GAEVKRPGASVKVSCK ASG-YTFT | N------YDIN | WVRQATGQGLE WMG | WMYPN-----SGNVGYAQK FQG | RVTMTRDTSISTAYMELS SLRSEDTAVYYCAS | SSGWY-------YFDY | WGQGTL VTVSS | | |
| iPS:44 1489 | 21-225_25A4 .001.004 | | VH1|1-08/D6|6-19|RF1/J H4 | QVLLVQS-GAEVKRPGASVKVSCK ASG-YTFT | N------YDIN | WVRQATGQGLE WMG | WMYPN-----SGQTGYAQK FQG | RVTMTRDTSISTAYMELS SLRSEDTAVYYCAS | SSGWY-------YFDY | WGQGTL VTVSS | | |
| iPS:44 1496 | 21-225_25A4 .001.005 | | VH1|1-08/D6|6-19|RF1/J H4 | QVLLVQS-GAEVKRPGASVKVSCK ASG-YTFT | N------YDIN | WVRQATGQGLE WMG | WMYPN-----SGSTGYAQK FQG | RVTMTRDTSISTAYMELS SLRSEDTAVYYCAS | SSGWY-------YFDY | WGQGTL VTVSS | | |
| iPS:44 1505 | 21-225_25A4 .001.006 | | VH1|1-08/D6|6-19|RF1/J H4 | QVQLVQS-GAEVKRPGASVKVSCK ASG-YTFT | N------YDIN | WVRQATGQGLE WMG | WMYPN-----SGNAGYAQK FQG | RVTMTRDTSISTAYMELS SLRSEDTAVYYCAS | SSGWY-------YFDY | WGQGTL VTVSS | | |
| iPS:44 1512 | 21-225_25A4 .001.007 | | VH1|1-08/D6|6-19|RF1/J H4 | QVQLVQS-GAEVKRPGASVKVSCK ASG-YTFT | N------YDIN | WVRQATGQGLE WMG | WMYPN-----SGNVGYAQK FQG | RVTMTRDTSISTAYMELS SLRSEDTAVYYCAS | SSGWY-------YFDY | WGQGTL VTVSS | | |

FIGURE 53 (Continued)

| | | | | | | | | | |
|---|---|---|---|---|---|---|---|---|---|
| iPS:44 1519 | 21-225_25A4 001.008 | VH1¦1-08¦D6¦6-19¦RF1¦J H4 | QVQLVQS-GAEVKRPGASVKVSCK ASG-YTFT | N------YDIN | WVRQATGQGLE WMG | WMYPN----SGQTGYAQK FQG | RVTMTRDTSISTAYMELS SLRSEDTAVYYCAS | SSGWY-------YFDY | WGQGTL VTVSS |
| iPS:44 1554 | 21-225_25A4 001.013 | VH1¦1-08¦D6¦6-19¦RF1¦J H4 | QVLLVQS-GAEVKRPGASVKVSCK ASG-YTFT | N------YDIN | WVRQATGQGLE WMG | WMYPN----SGSTGYAQK FQG | RVTMTRDTSISTAYMELS SLRSEDTAVYYCAS | SSGWY-------YFDY | WGQGTL VTVSS |
| iPS:44 1595 | 21-225_25A4 001.019 | VH1¦1-08¦D6¦6-19¦RF1¦J H4 | QVQLVQS-GAEVKRPGASVKVSCK ASG-YTFT | N------YDIN | WVRQAPGQGLE WMG | WMYPN----SGSTGYAQK FQG | RVTMTRDTSISTAYMELS SLRSEDTAVYYCAS | SSGWY-------YFDY | WGQGTL VTVSS |
| iPS:44 1604 | 21-225_25A4 001.020 | VH1¦1-08¦D6¦6-19¦RF1¦J H4 | QVLLVQS-GAEVKRPGASVKVSCK ASG-YTFT | N------YDIN | WVRQAPGQGLE WMG | WMYPN----SGQTGYAQK FQG | RVTMTRDTSISTAYMELS SLRSEDTAVYYCAS | SSGWY-------YFDY | WGQGTL VTVSS |
| iPS:44 1613 | 21-225_25A4 001.021 | VH1¦1-08¦D6¦6-19¦RF1¦J H4 | QVQLVQS-GAEVKRPGASVKVSCK ASG-YTFT | N------YDIN | WVRQATGQGLE WMG | WMYPN----SGNAGYAQK FQG | RVTMTRDTSISTAYMELS SLRSEDTAVYYCAS | SSGWY-------YFDY | WGQGTL VTVSS |
| iPS:44 3006 | 21-225_25A4 001.029 | VH1¦1-08¦D6¦6-19¦RF1¦J H4 | QVLLVQS-GAEVKRPGASVKVSCK ASG-YTFT | N------YDIN | WVRQATGQGLE WMG | WMYPN----SGQTGYAQK FQG | RVTMTRDTSISTAYMELS SLRSEDTAVYYCAS | SSGWY-------YFDY | WGQGTL VTVSS |
| iPS:41 2232 | 21-225_4A2 001 | VH1¦1-08¦D6¦6-19¦RF1¦J H4 | QVQLVQS-GTEVKKPGASVKVSCK ASG-YTFT | N------YDIN | WVRQATGQGLE WMG | WMHPN----SGNTGYAQK FQG | RVTLTRDTSISTAYMELS SLRSEDTAVYYCAS | SSGWY-------YFDY | WGQGTL VTVSS |
| iPS:42 2894 | 21-225_4A2 001 | VH1¦1-08¦D6¦6-19¦RF1¦J H4 | QVQLVQS-GTEVKKPGASVKVSCK ASG-YTFT | N------YDIN | WVRQATGQGLE WMG | WMHPN----SGNTGYAQK FQG | RVTLTRDTSISTAYMELS SLRSEDTAVYYCAS | SSGWY-------YFDY | WGQGTL VTVSS |
| iPS:44 1841 | 21-225_4A2 001.001 | VH1¦1-08¦D6¦6-19¦RF1¦J H4 | QVQLVQS-GTEVKKPGASVKVSCK ASG-YTFT | N------YDIN | WVRQATGQGLE WMG | WMHPN----SGNTGYAQK FQG | RVTLTRDTSISTAYMELS SLRSEDTAVYYCAS | SSGWY-------YFDY | WGQGTL VTVSS |
| iPS:44 1847 | 21-225_4A2 001.002 | VH1¦1-08¦D6¦6-19¦RF1¦J H4 | QVQLVQS-GTEVKKPGASVKVSCK ASG-YTFT | N------YDIN | WVRQATGQGLE WMG | WMHPN----SGNTGYAQK FQG | RVTLTRDTSISTAYMELS SLRSEDTAVYYCAS | SSGWY-------YFDY | WGQGTL VTVSS |
| iPS:44 1853 | 21-225_4A2 001.003 | VH1¦1-08¦D6¦6-19¦RF1¦J H4 | QVQLVQS-GTEVKKPGASVKVSCK ASG-YTFT | N------YDIN | WVRQATGQGLE WMG | WMHPN----SGNTGYAQK FQG | RVTLTRDTSISTAYMELS SLRSEDTAVYYCAS | SSGWY-------YFDY | WGQGTL VTVSS |
| iPS:44 1859 | 21-225_4A2 001.004 | VH1¦1-08¦D6¦6-19¦RF1¦J H4 | QVQLVQS-GTEVKKPGASVKVSCK ASG-YTFT | N------YDIN | WVRQATGQGLE WMG | WMHPN----SGNAGYAQK FQG | RVTLTRDTSISTAYMELS SLRSEDTAVYYCAS | SSGWY-------YFDY | WGQGTL VTVSS |

FIGURE 53 (Continued)

| | | | | | | | | |
|---|---|---|---|---|---|---|---|---|
| iPS:44 1866 | 21-225_4A2. 001.005 | VH1J1-08/D6J6-19IRF1/J H4 | QVQLVQS-GTEVKKPGASVKVSCK ASG-YTFT | N------YDIN | WVRQATGQGLE WMG | WMHPN---- SGSTGYAQK FQG | RVTLTRDTSISTAYMELS SLRSEDTAVYYCAS | SSGWY--------YFDY | WGQGTL VTVSS |
| iPS:44 1873 | 21-225_4A2. 001.006 | VH1J1-08/D6J6-19IRF1/J H4 | QVQLVQS-GTEVKKPGASVKVSCK ASG-YTFT | N------YDIN | WVRQATGQGLE WMG | WMHPN---- SGQTGYAQK FQG | RVTLTRDTSISTAYMELS SLRSEDTAVYYCAS | SSGWY--------YFDY | WGQGTL VTVSS |
| iPS:44 1880 | 21-225_4A2. 001.007 | VH1J1-08/D6J6-19IRF1/J H4 | QVQLVQS-GTEVKKPGASVKVSCK ASG-YTFT | N------YDIN | WVRQATGQGLE WMG | WMHPN---- SGQTGYAQK FQG | RVTLTRDTSISTAYMELS SLRSEDTAVYYCAS | SSGWY--------YFDY | WGQGTL VTVSS |
| iPS:44 1884 | 21-225_4A2. 001.008 | VH1J1-08/D6J6-19IRF1/J H4 | QVQLVQS-GTEVKKPGASVKVSCK ASG-YTFT | N------YDIN | WVRQATGQGLE WMG | WMHPN---- SGNAGYAQK FQG | RVTLTRDTSISTAYMELS SLRSEDTAVYYCAS | SSGWY--------YFDY | WGQGTL VTVSS |
| iPS:44 1888 | 21-225_4A2. 001.009 | VH1J1-08/D6J6-19IRF1/J H4 | QVQLVQS-GTEVKKPGASVKVSCK ASG-YTFT | N------YDIN | WVRQATGQGLE WMG | WMHPN---- SGQTGYAQK FQG | RVTLTRDTSISTAYMELS SLRSEDTAVYYCAS | SSGWY--------YFDY | WGQGTL VTVSS |
| iPS:44 1892 | 21-225_4A2. 001.010 | VH1J1-08/D6J6-19IRF1/J H4 | QVQLVQS-GTEVKKPGASVKVSCK ASG-YTFT | N------YDIN | WVRQATGQGLE WMG | WMHPN---- SGNAGYAQK FQG | RVTLTRDTSISTAYMELS SLRSEDTAVYYCAS | SSGWY--------YFDY | WGQGTL VTVSS |
| iPS:44 1896 | 21-225_4A2. 001.011 | VH1J1-08/D6J6-19IRF1/J H4 | QVQLVQS-GTEVKKPGASVKVSCK ASG-YTFT | N------YDIN | WVRQATGQGLE WMG | WMHPN---- SGQTGYAQK FQG | RVTLTRDTSISTAYMELS SLRSEDTAVYYCAS | SSGWY--------YFDY | WGQGTL VTVSS |
| iPS:44 1900 | 21-225_4A2. 001.012 | VH1J1-08/D6J6-19IRF1/J H4 | QVQLVQS-GTEVKKPGASVKVSCK ASG-YTFT | N------YDIN | WVRQATGQGLE WMG | WMHPN---- SGSTGYAQK FQG | RVTLTRDTSISTAYMELS SLRSEDTAVYYCAS | SSGWY--------YFDY | WGQGTL VTVSS |
| iPS:44 1955 | 21-225_4A2. 001.022 | VH1J1-08/D6J6-19IRF1/J H4 | QVQLVQS-GAEVKKPGASVKVSCK ASG-YTFT | N------YDIN | WVRQAPGQGLE WMG | WMHPN---- SGNTGYAQK FQG | RVTLTRDTSISTAYMELS SLRSEDTAVYYCAS | SSGWY--------YFDY | WGQGTL VTVSS |
| iPS:44 1962 | 21-225_4A2. 001.023 | VH1J1-08/D6J6-19IRF1/J H4 | QVQLVQS-GAEVKKPGASVKVSCK ASG-YTFT | N------YDIN | WVRQATGQGLE WMG | WMHPN---- SGNTGYAQK FQG | RVTLTRDTSISTAYMELS SLRSEDTAVYYCAS | SSGWY--------YFDY | WGQGTL VTVSS |
| iPS:44 1971 | 21-225_4A2. 001.024 | VH1J1-08/D6J6-19IRF1/J H4 | QVQLVQS-GAEVKKPGASVKVSCK ASG-YTFT | N------YDIN | WVRQATGQGLE WMG | WMHPN---- SGQTGYAQK FQG | RVTLTRDTSISTAYMELS SLRSEDTAVYYCAS | SSGWY--------YFDY | WGQGTL VTVSS |
| iPS:44 1999 | 21-225_4A2. 001.028 | VH1J1-08/D6J6-19IRF1/J H4 | QVQLVQS-GAEVKKPGASVKVSCK ASG-YTFT | N------YDIN | WVRQAPGQGLE WMG | WMHPN---- SGQTGYAQK FQG | RVTLTRDTSISTAYMELS SLRSEDTAVYYCAS | SSGWY--------YFDY | WGQGTL VTVSS |

FIGURE 53 (Continued)

| | | H_FR1 | H_CDR1 | H_FR2 | H_CDR2 | H_FR3 | H_CDR3 | H_FR4 |
|---|---|---|---|---|---|---|---|---|
| iPS:44 2006 | 21-225.4A2. 001.029 | VH{1-08/D{6-19}RF{1/J}H4 | QVQLVQS-GAEVKKPGASVKVSCK ASG-YTFT | N------YDIN | WVRQAPGQGLE WMG | WMHPN------SGSTGYAQK FQG | RVTLTRDTSISTAYMELS SLRSEDTAVYYCAS | SSGWY------------YFDY | WGQGTL VTVSS |
| iPS:44 2020 | 21-225.4A2. 001.031 | VH{1-08/D{6-19}RF{1/J}H4 | QVQLVQS-GGEVKKPGASVKVSCK ASG-YTFT | N------YDIN | WVRQAPGQGLE WMG | WMHPN------SGMEGIAQK FQG | RVTLTRDTSISTAYMELS SLRSEDTAVYYCAS | SSGWY------------YFDY | WGQGTL VTVSS |
| | Germline | H_FR1 | H_CDR1 | H_FR2 | H_CDR2 | H_FR3 | H_CDR3 | H_FR4 |
| | VH{1-02/D{1-1}RF{1/J}H4 | QVQLVQS-GAEVKKPGASVKVSCK ASG-YTFT | | WVRQAPGQGLE WMG | | RVTMTRDTSISTAYMELS SLRSDDTAVYYCAR | SFDY | WGQGTL VTVSS |
| iPS:39 3954 | 21-225_4H6 | VH{1-02/D{1-1}RF{1/J}4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMGLS SLRSDDTAVYYCAR | DGTS------------SFDY | WGQGTL VTVSS |
| iPS:44 2050 | 21-225_4H6. 004 | VH{1-02/D{1-1}RF{1/J}4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMELS SLRSDDTAVYYCAR | DGTS------------SFDY | WGQGTL VTVSS |
| iPS:44 2059 | 21-225_4H6. 005 | VH{1-02/D{1-1}RF{1/J}4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMELS SLRSDDTAVYYCAR | DGTS------------SFDY | WGQGTL VTVSS |
| iPS:44 2065 | 21-225_4H6. 006 | VH{1-02/D{1-1}RF{1/J}4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMELS SLRSDDTAVYYCAR | DGTS------------SFDY | WGQGTL VTVSS |
| iPS:44 2071 | 21-225_4H6. 007 | VH{1-02/D{1-1}RF{1/J}4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMELS SLRSDDTAVYYCAR | DATS------------SFDY | WGQGTL VTVSS |
| iPS:44 2078 | 21-225_4H6. 008 | VH{1-02/D{1-1}RF{1/J}4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMELS SLRSDDTAVYYCAR | SGTS------------SFDY | WGQGTL VTVSS |
| iPS:44 2085 | 21-225_4H6. 009 | VH{1-02/D{1-1}RF{1/J}4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMELS SLRSDDTAVYYCAR | SGTS------------SFDY | WGQGTL VTVSS |
| iPS:44 2089 | 21-225_4H6. 010 | VH{1-02/D{1-1}RF{1/J}4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMELS SLRSDDTAVYYCAR | DATS------------SFDY | WGQGTL VTVSS |

FIGURE 53 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:44_2093 | 21-225_4H6_011 | VH1|1-02|D1|1-1|RF1|JH4 | QVQLVQS-GAEVKKPGASVKVSCK ASG-YTFT | D------YYLH | WVRQAPSQGLE WMG | WIHPN----SGGTNYAQK FQG | RVTMTRDTSISTAYMELS SLRSDDTAVYYCAR | DATS--------SFDY | WGQGTL VTVSS |
| iPS:44_3016 | 21-225_4H6_014 | VH1|1-02|D1|1-1|RF1|JH4 | QVQLVQS-GAEVKKPGASVKVSCK ASG-YTFT | D------YYLH | WVRQAPSQGLE WMG | WIHPN----SGGTNYAQK FQG | RVTMTRDTSISTAYMGLS SLRSDDTAVYYCAR | DATS--------SFDY | WGQGTT VTVSS |
| | Germline | | H_FR1 | H_CDR1 | H_FR2 | H_CDR2 | H_FR3 | H_CDR3 | H_FR4 |
| | VH3|3-33|D6|6-6|RF1|JH6 | | QVQLVES-GGGVVQPGRSLRLSCA ASG-FTFS | S------YVMH | WVRQAPGKGLE WVA | VIWYD----GSNKYYADS VKG | RFTISRDNSKNTLYLQMN SLRAEDTAVYYCAR | EVYSSGW--------YDYCKDV | WGQGTT VTVSS |
| iPS:39_4041 | 21-225_5E5 | VH3|3-33|D6|6-6|RF1|JH6 | QVQLVES-GGGVVQPGRSLRLSCA ASG-FTFS | N------YVMH | WVRQAPGKGLE WVA | VIWYD----GSNKYYADS VKG | RFTISRDNSKNTLYLQMN SLRAEDTAVYYCTR | EVYSSGW--------YDYGMDV | WGQGTT VTVSS |
| iPS:44_2115 | 21-225_5E5_003 | VH3|3-33|D6|6-6|RF1|JH6 | QVQLVES-GGGVVQPGRSLRLSCA ASG-FTFS | N------YVMH | WVRQAPGKGLE WVA | VIWYD----ASNKYYAGS VKG | RFTISRDNSKNTLYLQMN SLRAEDTAVYYCTR | EVYSSGW--------YDYGMDV | WGQGTT VTVSS |
| iPS:44_2122 | 21-225_5E5_004 | VH3|3-33|D6|6-6|RF1|JH6 | QVQLVES-GGGVVQPGRSLRLSCA ASG-FTFS | N------YVMH | WVRQAPGKGLE WVA | VIWYD----GSNKYYADS VKG | RFTISRDNSKNTLYLQMN SLRAEDTAVYYCTR | EVYSSGW--------YDYGMDV | WGQGTT VTVSS |
| iPS:44_2129 | 21-225_5E5_005 | VH3|3-33|D6|6-6|RF1|JH6 | QVQLVES-GGGVVQPGRSLRLSCA ASG-FTFS | N------YVMH | WVRQAPGKGLE WVA | VIWYD----ASNKYYAES VKG | RFTISRDNSKNTLYLQMN SLRAEDTAVYYCTR | EVYSSGW--------YDYGMDV | WGQGTT VTVSS |
| iPS:44_2136 | 21-225_5E5_006 | VH3|3-33|D6|6-6|RF1|JH6 | QVQLVES-GGGVVQPGRSLRLSCA ASG-FTFS | N------YVMH | WVRQAPGKGLE WVA | VIWYD----GSNKYYADA VKG | RFTISRDNSKNTLYLQMN SLRAEDTAVYYCTR | EVYSSGW--------YDYGMDV | WGQGTT VTVSS |
| iPS:44_2171 | 21-225_5E5_011 | VH3|3-33|D6|6-6|RF1|JH6 | QVQLVES-GGGVVQPGRSLRLSCA ASG-FTFS | N------YVMH | WVRQAPGKGLE WVA | VIWYD----ASNKYYAES VKG | RFTISRDNSKNTLYLQMN SLRAEDTAVYYCTR | EVYSSGW--------YDYGMDV | WGQGTT VTVSS |
| iPS:44_2178 | 21-225_5E5_012 | VH3|3-33|D6|6-6|RF1|JH6 | QVQLVES-GGGVVQPGRSLRLSCA ASG-FTFS | N------YVMH | WVRQAPGKGLE WVA | VIWYD----ASNKYYADA VKG | RFTISRDNSKNTLYLQMN SLRAEDTAVYYCTR | EVYSSGW--------YDYGMDV | WGQGTT VTVSS |
| iPS:44_2199 | 21-225_5E5_015 | VH3|3-33|D6|6-6|RF1|JH6 | QVQLVES-GGGVVQPGRSLRLSCA ASG-FTFS | N------YVMH | WVRQAPGKGLE WVA | VIWYD----ASNKYYAES VKG | RFTISRDNSKNTLYLQMN SLRAEDTAVYYCTR | EVYSSGY--------YDYGMDV | WGQGTT VTVSS |

FIGURE 53 (Continued)

| | | | | | | | | | |
|---|---|---|---|---|---|---|---|---|---|
| iPS.44 2206 | 21-225_5E5.016 | VH3/3-33/D6/6-6/RF1/JH6 | QVQLVES-GGGVVQPGRSLRLSCA ASG-FTFS | N------YVMH | WVRQAPGKGLE WVA | VIWYD----ASNKYYADS VKG | RFTISRDNSKNTLYLQMN SLRAEDTAVYYCTR | EVYSSGF------------YDYGMDV | WGQGTT VTVSS |
| iPS.44 2213 | 21-225_5E5.017 | VH3/3-33/D6/6-6/RF1/JH6 | QVQLVES-GGGVVQPGRSLRLSCA ASG-FTFS | N------YVMH | WVRQAPGKGLE WVA | VIWYD----GSNKYYAES VKG | RFTISRDNSKNTLYLQMN SLRAEDTAVYYCTR | EVYSSGY------------YDYGMDV | WGQGTT VTVSS |
| iPS.44 2220 | 21-225_5E5.018 | VH3/3-33/D6/6-6/RF1/JH6 | QVQLVES-GGGVVQPGRSLRLSCA ASG-FTFS | N------YVMH | WVRQAPGKGLE WVA | VIWYD----GSNKYYADS VKG | RFTISRDNSKNTLYLQMN SLRAEDTAVYYCTR | EVYSSGY------------YDYGMDV | WGQGTT VTVSS |
| iPS.44 2227 | 21-225_5E5.019 | VH3/3-33/D6/6-6/RF1/JH6 | QVQLVES-GGGVVQPGRSLRLSCA ASG-FTFS | N------YVMH | WVRQAPGKGLE WVA | VIWYD----GSNKYYADS VKG | RFTISRDNSKNTLYLQMN SLRAEDTAVYYCTR | EVYSSGF------------YDYGMDV | WGQGTT VTVSS |
| iPS.44 2255 | 21-225_5E5.023 | VH3/3-33/D6/6-6/RF1/JH6 | QVQLVES-GGGVVQPGRSLRLSCA ASG-FTFS | N------YVMH | WVRQAPGKGLE WVA | VIWYD----ASNKYYAES VKG | RFTISRDNSKNTLYLQMN SLRAEDTAVYYCTR | EVYSSGY------------YDYGMDV | WGQGTT VTVSS |
| iPS.44 2262 | 21-225_5E5.024 | VH3/3-33/D6/6-6/RF1/JH6 | QVQLVES-GGGVVQPGRSLRLSCA ASG-FTFS | N------YVMH | WVRQAPGKGLE WVA | VIWYD----ASNKYYADA VKG | RFTISRDNSKNTLYLQMN SLRAEDTAVYYCTR | EVYSSGY------------YDYGMDV | WGQGTT VTVSS |
| | | Germline | H_FR1 | H_CDR1 | H_FR2 | H_CDR2 | H_FR3 | H_CDR3 | H_FR4 |
| | VH3/3-33/D6/6-6/RF1/JH6 | | | | | | | | WGQGTT VTVSS |
| iPS.44 2269 | 21-225_5E5.025 | VH3/3-07/D6/6-6/RF1/JH6 | EVQLVES-GGGVVQPGGSLRLSCA ASG-FTFS | N------YVMH | WVRQAPGKGLE WVA | VIWYD----GSNKYYAES VKG | RFTISRDNAKNTLYLQMN SLRAEDTAVYYCTR | EVYSSGW------------YDYGMDV | WGQGTT VTVSS |
| | | Germline | H_FR1 | H_CDR1 | H_FR2 | H_CDR2 | H_FR3 | H_CDR3 | H_FR4 |
| | VH3/3-33/D4/4-11/RF2/JH6 | | | | | | | | WGQGTT VTVSS |
| iPS.39 3930 | 21-225_7E11.001 | VH3/3-33/D4/4-11/RF2/JH6 | QVQLVES-GGGVVQPGRSLRLSCA ASG-FTFS | S------FGMH | WVRQAPGKGLE WVA | IIWHD----GSNKYYADS VKG | RFTISRDNSNNTLYLQMS SLRAEDTAVYYCAR | DLSMG------------GMDV | WGQGTT VTVSS |
| iPS.42 4460 | 21-225_7E11.001 | VH3/3-33/D4/4-11/RF2/JH6 | QVQLVES-GGGVVQPGRSLRLSCA ASG-FTFS | S------FGMH | WVRQAPGKGLE WVA | IIWHD----GSNKYYADS VKG | RFTISRDNSKNTLYLQMS SLRAEDTAVYYCAR | DLSMG------------GMDV | WGQGTT VTVSS |

FIGURE 53 (Continued)

| | | | | | | | | |
|---|---|---|---|---|---|---|---|---|
| iPS:44-2311 | 21-225_7E11.001.001 | VH3j3-33jD4j4-11jRF2jJH6 | QVQLVES-GGGVVQPGRSLRLSCA ASG-FTFS | S------FGMH | WVRQAPGKGLE WVA | IIWHD---GSNKYYADS VKG | RFTISRDNSKNTLYLQMS SLRAEDTAVYYCAR | DLSMG------GMDV | WGQGTT VTVSS |
| iPS:44-2317 | 21-225_7E11.001.002 | VH3j3-33jD4j4-11jRF2jJH6 | QVQLVES-GGGVVQPGRSLRLSCA ASG-FTFS | S------FGMH | WVRQAPGKGLE WVA | IIWHD---GSNKYYADS VKG | RFTISRDNSKNTLYLQMS SLRAEDTAVYYCAR | DLSMG------GMDV | WGQGTT VTVSS |
| iPS:44-2323 | 21-225_7E11.001.003 | VH3j3-33jD4j4-11jRF2jJH6 | QVQLVES-GGGVVQPGRSLRLSCA ASG-FTFS | S------FGMH | WVRQAPGKGLE WVA | IIWHD---GSNKYYADS VKG | RFTISRDNSKNTLYLQMS SLRAEDTAVYYCAR | DLSMG------GMDV | WGQGTT VTVSS |
| iPS:44-2330 | 21-225_7E11.001.004 | VH3j3-33jD4j4-11jRF2jJH6 | QVQLVES-GGGVVQPGRSLRLSCA ASG-FTFS | S------FGMH | WVRQAPGKGLE WVA | IIWHD---GSNKYYADS VKG | RFTISRDNSKNTLYLQMS SLRAEDTAVYYCAR | DLSMG------GMDV | WGQGTT VTVSS |
| iPS:44-2337 | 21-225_7E11.001.005 | VH3j3-33jD4j4-11jRF2jJH6 | QVQLVES-GGGVVQPGRSLRLSCA ASG-FTFS | S------FGMH | WVRQAPGKGLE WVA | IIWHE---ASNKYYADS VKG | RFTISRDNSKNTLYLQMS SLRAEDTAVYYCAR | DLSMG------GMDV | WGQGTT VTVSS |
| iPS:44-2344 | 21-225_7E11.001.006 | VH3j3-33jD4j4-11jRF2jJH6 | QVQLVES-GGGVVQPGRSLRLSCA ASG-FTFS | S------FGMH | WVRQAPGKGLE WVA | IIWHD---GSNKYYADS VKG | RFTISRDNSKNTLYLQMS SLRAEDTAVYYCAR | DLSMG------GMDV | WGQGTT VTVSS |
| iPS:44-2351 | 21-225_7E11.001.007 | VH3j3-33jD4j4-11jRF2jJH6 | QVQLVES-GGGVVQPGRSLRLSCA ASG-FTFS | S------FGMH | WVRQAPGKGLE WVA | IIWHE---GSNKYYADA VKG | RFTISRDNSKNTLYLQMS SLRAEDTAVYYCAR | DLSMG------GMDV | WGQGTT VTVSS |
| iPS:44-2358 | 21-225_7E11.001.008 | VH3j3-33jD4j4-11jRF2jJH6 | QVQLVES-GGGVVQPGRSLRLSCA ASG-FTFS | S------FGMH | WVRQAPGKGLE WVA | IIWHE---GSNKYYADA VKG | RFTISRDNSKNTLYLQMS SLRAEDTAVYYCAR | DLSMG------GMDV | WGQGTT VTVSS |
| iPS:44-2365 | 21-225_7E11.001.009 | VH3j3-33jD4j4-11jRF2jJH6 | QVQLVES-GGGVVQPGRSLRLSCA ASG-FTFS | S------FGMH | WVRQAPGKGLE WVA | IIWHE---GSNKYYAES VKG | RFTISRDNSKNTLYLQMS SLRAEDTAVYYCAR | DLSMG------GMDV | WGQGTT VTVSS |
| iPS:44-2372 | 21-225_7E11.001.010 | VH3j3-33jD4j4-11jRF2jJH6 | QVQLVES-GGGVVQPGRSLRLSCA ASG-FTFS | S------FGMH | WVRQAPGKGLE WVA | IIWHS---GSNKYYADA VKG | RFTISRDNSKNTLYLQMS SLRAEDTAVYYCAR | DLSMG------GMDV | WGQGTT VTVSS |
| iPS:44-2379 | 21-225_7E11.001.011 | VH3j3-33jD4j4-11jRF2jJH6 | QVQLVES-GGGVVQPGRSLRLSCA ASG-FTFS | S------FGMH | WVRQAPGKGLE WVA | IIWHS---GSNKYYADS VKG | RFTISRDNSKNTLYLQMS SLRAEDTAVYYCAR | DLSMG------GMDV | WGQGTT VTVSS |
| iPS:44-2386 | 21-225_7E11.001.012 | VH3j3-33jD4j4-11jRF2jJH6 | QVQLVES-GGGVVQPGRSLRLSCA ASG-FTFS | S------FGMH | WVRQAPGKGLE WVA | IIWHS---GSNKYYADS VKG | RFTISRDNSKNTLYLQMS SLRAEDTAVYYCAR | DLSMG------GMDV | WGQGTT VTVSS |

FIGURE 53 (Continued)

| | | H_FR1 | H_CDR1 | H_FR2 | H_CDR2 | H_FR3 | H_CDR3 | H_FR4 |
|---|---|---|---|---|---|---|---|---|
| iPS:44_2390 | 21-225_7E11.001_013 | VH3\|3-33\|D4\|4-11\|RF2\|JH6 | QVQLVES-GGGVVQPGRSLRLSCA ASG-FTFS | S------FGMH | WVRQAPGKGKGLE WVA | IIWHD----GSNKYYAES VKG | RFTISRDNSKNTLYLQMS SLRAEDTAVYYCAR | DLSMG------GMDV | WGQGTT VTVSS |
| iPS:44_2394 | 21-225_7E11.001_014 | VH3\|3-33\|D4\|4-11\|RF2\|JH6 | QVQLVES-GGGVVQPGRSLRLSCA ASG-FTFS | S------FGMH | WVRQAPGKGLE WVA | IIWHS----GSNKYYAES VKG | RFTISRDNSKNTLYLQMS SLRAEDTAVYYCAR | DLSMG------GMDV | WGQGTT VTVSS |
| iPS:44_2398 | 21-225_7E11.001_015 | VH3\|3-33\|D4\|4-11\|RF2\|JH6 | QVQLVES-GGGVVQPGRSLRLSCA ASG-FTFS | S------FGMH | WVRQAPGKGLE WVA | IIWHS----GSNKYYADS VKG | RFTISRDNSKNTLYLQMS SLRAEDTAVYYCAR | DLSMG------GMDV | WGQGTT VTVSS |
| iPS:44_2402 | 21-225_7E11.001_016 | VH3\|3-33\|D4\|4-11\|RF2\|JH6 | QVQLVES-GGGVVQPGRSLRLSCA ASG-FTFS | S------FGMH | WVRQAPGKGLE WVA | IIWHS----GSNKYYAES VKG | RFTISRDNSKNTLYLQMS SLRAEDTAVYYCAR | DLSMG------GMDV | WGQGTT VTVSS |
| iPS:44_2406 | 21-225_7E11.001_017 | VH3\|3-33\|D4\|4-11\|RF2\|JH6 | QVQLVES-GGGVVQPGRSLRLSCA ASG-FTFS | S------FGMH | WVRQAPGKGLE WVA | IIWHE----GSNKYYADA VKG | RFTISRDNSKNTLYLQMS SLRAEDTAVYYCAR | DLSMG------GMDV | WGQGTT VTVSS |
| iPS:44_2410 | 21-225_7E11.001_018 | VH3\|3-33\|D4\|4-11\|RF2\|JH6 | QVQLVES-GGGVVQPGRSLRLSCA ASG-FTFS | S------FGMH | WVRQAPGKGLE WVA | IIWHD----ASNKYYAES VKG | RFTISRDNSKNTLYLQMS SLRAEDTAVYYCAR | DLSMG------GMDV | WGQGTT VTVSS |
| iPS:44_3027 | 21-225_7E11.001_023 | VH3\|3-33\|D4\|4-11\|RF2\|JH6 | QVQLVES-GGGVVQPGRSLRLSCA ASG-FTFS | S------FGMH | WVRQAPGKGLE WVA | IIWHD----ASNKYYADA VKG | RFTISRDNSKNTLYLQMS SLRAEDTAVYYCAR | DLSMG------GMDV | WGQGTT VTVSS |
| Germline | VH3\|3-07\|D4\|4-11\|RF2\|JH6 | EVQLVES-GGGVVQPGGSLRLSCA ASG-FTFS | S------FGMH | WVRQAPGKGLE WVA | IIWHD----GSNKYYAES VKG | RFTISRDNAKNTLYLQMN SLRAEDTAVYYCAR | DLSMG------GMDV | WGQGTT VTVSS |
| iPS:44_2417 | 21-225_7E11.001_019 | VH3\|3-07\|D4\|4-11\|RF2\|JH6 | EVQLVES-GGGVVQPGGSLRLSCA ASG-FTFS | S------FGMH | WVRQAPGKGLE WVA | IIWHD----GSNKYYAES VKG | RFTISRDNAKNTLYLQMS SLRAEDTAVYYCAR | DLSMG------GMDV | WGQGTT VTVSS |
| iPS:44_2431 | 21-225_7E11.001_021 | VH3\|3-07\|D4\|4-11\|RF2\|JH6 | EVQLVES-GGGVVQPGGSLRLSCA ASG-FTFS | S------FGMH | WVRQAPGKGLE WVA | IIWHE----GSNKYYAES VKG | RFTISRDNAKNTLYLQMS SLRAEDTAVYYCAR | DLSMG------GMDV | WGQGTT VTVSS |
| iPS:44_2438 | 21-225_7E11.001_022 | VH3\|3-07\|D4\|4-11\|RF2\|JH6 | EVQLVES-GGGVVQPGGSLRLSCA ASG-FTFS | S------FGMH | WVRQAPGKGLE WVA | IIWHE----GSNKYYAES VKG | RFTISRDNAKNTLYLQMS SLRAEDTAVYYCAR | DLSMG------GMDV | WGQGTT VTVSS |

Figure 54 (Table 7)
Standard IgG Antibody Variable Region Consensus Protein Alignment
CDRs defined by Kabat
Alignment numbering defined by Amgen Reference (AHo)

| KAPPA VARIABLE | Germline | K_FR1 | K_CDR1 | K_FR2 | K_CDR2 | K_FR3 | K_CDR3 | K_FR4 |
|---|---|---|---|---|---|---|---|---|
| VK4jB3J K1 | | | | | | | | |
| iPS:39 2928 21-225_25A 4 | VK4jB3J K1 | .....F.....K. | .....H..... | ...L. | | | | |
| iPS:42 4419 21-225_25A 4.001 | VK4jB3J K1 | .....F.....K. | .N...H..... | ...L. | | ....E. ....E. | ....P. | |
| iPS:44 1468 21-225_25A 4.001.001 | VK4jB3J K1 | .....F.....K. | .N...H..... | ...L. | | ....E. ....E. | ....P. | |
| iPS:44 1475 21-225_25A 4.001.002 | VK4jB3J K1 | .....F.....K. | .N...H..... | ...L. | | ....E. ....E. | ....P. | |
| iPS:44 1482 21-225_25A 4.001.003 | VK4jB3J K1 | .....F.....K. | .N...H..... | ...L. | | ....E. ....E. | ....P. | |
| iPS:44 1489 21-225_25A 4.001.004 | VK4jB3J K1 | .....F.....K. | .N...H..... | ...L. | | ....E. ....E. | ....P. | |
| iPS:44 1496 21-225_25A 4.001.005 | VK4jB3J K1 | ..........K. | .N...H..... | ...L. | | ....E. | ....P. | |
| iPS:44 1505 21-225_25A 4.001.006 | VK4jB3J K1 | ..........K. | .N...H..... | ...L. | | ....E. | ....P. | |
| iPS:44 1512 21-225_25A 4.001.007 | VK4jB3J K1 | ..........K. | .N...H..... | ...L. | | ....E. | ....P. | |
| iPS:44 1519 21-225_25A 4.001.008 | VK4jB3J K1 | ..........K. | .N...H..... | ...L. | | ....E. | ....P. | |
| iPS:44 1554 21-225_25A 4.001.013 | VK4jB3J K1 | ..........K. | .N...H..... | ...L. | | ....E. | ....P. | |
| iPS:44 1595 21-225_25A 4.001.019 | VK4jB3J K1 | ..........K. | .N...H..... | ...L. | | ....E. ....E. | ....P. | |

| | | K FR1 | K CDR1 | K FR2 | K CDR2 | K FR3 | K CDR3 | K FR4 |
|---|---|---|---|---|---|---|---|---|
| iPS:44 2089 | 21-225_4H6. 010 | VK1|L5/J K3 | | .R... | | | | ...Q.. | |
| iPS:44 2093 | 21-225_4H6. 011 | VK1|L5/J K3 | | .R... | | | G.. | ...Q.. | |
| iPS:44 3016 | 21-225_4H6. 014 | VK1|L5/J K3 | | .R... | | | G.. | | |
| Germline | | K FR1 | K CDR1 | K FR2 | K CDR2 | K FR3 | K CDR3 | K FR4 |
| VK4|B3/J K3 | | | | | | | | |
| iPS:41 2232 | 21-225_4A2. 001 | VK4|B3/J K3 | ...N... | .F..L. | | ...P... | ...N......V. | ..G.. |
| iPS:42 2894 | 21-225_4A2. 001.001 | VK4|B3/J K3 | ...N...I.H. | ...L. | | ...P... | ...M......V. | ..G.. |
| iPS:44 1841 | 21-225_4A2. 001.002 | VK4|B3/J K3 | ...N...I.H. | .F..L. | | ...P... | ...M...A.V. | ..G.. |
| iPS:44 1847 | 21-225_4A2. 001.003 | VK4|B3/J K3 | ...N...I.H. | .F..L. | | ...P... | ...M......V. | ..G.. |
| iPS:44 1853 | 21-225_4A2. 001.004 | VK4|B3/J K3 | ...N...I.H. | .F..L. | | ...P... | ...Q......V. | ..G.. |
| iPS:44 1859 | 21-225_4A2. 001.005 | VK4|B3/J K3 | ...N...I.H. | .F..L. | | ...P... | ...N......V. | ..G.. |
| iPS:44 1866 | 21-225_4A2. 001.006 | VK4|B3/J K3 | ...N...I.H. | .F..L. | | ...P... | ...N......V. | ..G.. |
| iPS:44 1873 | 21-225_4A2. 001.007 | VK4|B3/J K3 | ...N...I.H. | .F..L. | | ...P... | ...N......V. | ..G.. |
| iPS:44 1880 | 21-225_4A2. 001.008 | VK4|B3/J K3 | ...N...I.H. | .F..L. | | ...P... | ......V. | ..G.. |
| iPS:44 1884 | 21-225_4A2. 001.009 | VK4|B3/J K3 | ...N...I.H. | .F..L. | | ...P... | ......V. | ..G.. |
| iPS:44 1888 | 21-225_4A2. 001.009 | VK4|B3/J K3 | ...N...I.H. | .F..L. | | ...P... | ...N...A.V. | ..G.. |

| | | | | | | | |
|---|---|---|---|---|---|---|---|
| iPS:44 2351 | 21-225_7E1 1.001.007 | VK1\|O12/ JK4 | .................... | ................ | .........N.I.......... | ....T......... | ...... | ............ |
| iPS:44 2358 | 21-225_7E1 1.001.008 | VK1\|O12/ JK4 | ...........A. | ................ | .........N.I.......... | ....T....F... | ....I..... | ....T....... |
| iPS:44 2365 | 21-225_7E1 1.001.009 | VK1\|O12/ JK4 | ...........A. | ................ | .........N.I.......... | ....T....F... | ....I..... | ....T....... |
| iPS:44 2372 | 21-225_7E1 1.001.010 | VK1\|O12/ JK4 | ...........A. | ................ | .........N.I.......... | ....T....F... | ....I..... | ....T....... |
| iPS:44 2379 | 21-225_7E1 1.001.011 | VK1\|O12/ JK4 | ...........A. | ................ | .........N.I.......... | ....T....F... | ....I..... | ....T....... |
| iPS:44 2386 | 21-225_7E1 1.001.012 | VK1\|O12/ JK4 | ................ | ................ | .........N.I.......... | ....T....F... | ....I..... | ....T....... |
| iPS:44 2390 | 21-225_7E1 1.001.013 | VK1\|O12/ JK4 | ................ | ................ | .........N.I.......... | ....T....F... | ....I..... | ....T....... |
| iPS:44 2394 | 21-225_7E1 1.001.014 | VK1\|O12/ JK4 | ................ | ................ | .........N.I.......... | ....T......... | ....I..... | ....T....... |
| iPS:44 2398 | 21-225_7E1 1.001.015 | VK1\|O12/ JK4 | ................ | ................ | .........N.I.......... | ....T....F... | ....I..... | ....T....... |
| iPS:44 2402 | 21-225_7E1 1.001.016 | VK1\|O12/ JK4 | ................ | ................ | .........N.I.......... | ....T....F... | ....I..... | ....T....... |
| iPS:44 2406 | 21-225_7E1 1.001.017 | VK1\|O12/ JK4 | ................ | ................ | ................ | ....T....F... | ....I..... | ....T....... |
| iPS:44 2410 | 21-225_7E1 1.001.018 | VK1\|O12/ JK4 | ................ | ................ | ................ | ....T....F... | ....I..... | ....T....... |
| iPS:44 2417 | 21-225_7E1 1.001.019 | VK1\|O12/ JK4 | ...........A. | ................ | ................ | ....T....F... | ....I..... | ....T....... |
| iPS:44 2431 | 21-225_7E1 1.001.021 | VK1\|O12/ JK4 | ...........A. | ................ | ................ | ....T....F... | ....I..... | ....T....... |
| iPS:44 2438 | 21-225_7E1 1.001.022 | VK1\|O12/ JK4 | ................ | ................ | ................ | ....T....F... | ....I..... | ....T....... |

FIGURE 54 (Continued)

| iPS:44 21- | VK1|O12/ | ......A........ | .......N.i..... | ........E... | .........T..... | ........I..... | .....T..... |
|---|---|---|---|---|---|---|---|
| 3027 225_7E1 1.001.023 | JK4 | | | | | | |

| HEAVY_VARIAB LE | | | | | | | | |
|---|---|---|---|---|---|---|---|---|
| | Germline | H FR1 | H CDR1 | H FR2 | H CDR2 | H FR3 | H CDR3 | H FR4 |
| VH1|1-08|D6|6-19|RF1|J H4 | | | | | | | | |
| iPS:39 21-2928 225_25A 4 | VH1|1-08/D6|6-19|RF1|J H4 | ..L........R........ | ..N........... | ........ | ..Y........ | ..........D........S.. | SSGWY-.......... | ........ |
| iPS:42 21-4419 225_25A 4.001 | VH1|1-08/D6|6-19|RF1|J H4 | ..L........R........ | ..N........... | ........ | ..Y........S.. | ..........D........S.. | SSGWY-.......... | ........ |
| iPS:44 21-1468 225_25A 4.001.001 | VH1|1-08/D6|6-19|RF1|J H4 | ..L........R........ | ..N........... | ........ | ..Y........S.. | ..........D........S.. | SSGWY-.......... | ........ |
| iPS:44 21-1475 225_25A 4.001.002 | VH1|1-08/D6|6-19|RF1|J H4 | ..L........R........ | ..N........... | ........ | ..Y........A.. | ..........D........S.. | SSGWY-.......... | ........ |
| iPS:44 21-1482 225_25A 4.001.003 | VH1|1-08/D6|6-19|RF1|J H4 | ..L........R........ | ..N........... | ........ | ..Y........V.. | ..........D........S.. | SSGWY-.......... | ........ |
| iPS:44 21-1489 225_25A 4.001.004 | VH1|1-08/D6|6-19|RF1|J H4 | ..L........R........ | ..N........... | ........ | ..Y........Q.. | ..........D........S.. | SSGWY-.......... | ........ |
| iPS:44 21-1496 225_25A 4.001.005 | VH1|1-08/D6|6-19|RF1|J H4 | ..L........R........ | ..N........... | ........ | ..Y........S.. | ..........D........S.. | SSGWY-.......... | ........ |
| iPS:44 21-1505 225_25A 4.001.006 | VH1|1-08/D6|6-19|RF1|J H4 | ..L........R........ | ..N........... | ........ | ..Y........A.. | ..........D........S.. | SSGWY-.......... | ........ |
| iPS:44 21-1512 225_25A 4.001.007 | VH1|1-08/D6|6-19|RF1|J H4 | ..L........R........ | ..N........... | ........ | ..Y........V.. | ..........D........S.. | SSGWY-.......... | ........ |

| | | H_FR1 | H_CDR1 | H_FR2 | H_CDR2 | H_FR3 | H_CDR3 | H_FR4 |
|---|---|---|---|---|---|---|---|---|
| iPS:44 2093 | VH1|1-02/D1|1-1|RF1/JH4 | ......... | D......L. | ......... | .H....... | ......S.. | DA.S- | ......... |
| iPS:44 3016 | VH1|1-02/D1|1-1|RF1/JH4 | ......... | D......L. | ......... | .H....... | ......S..........G. | DA.S- | ......... |
| Germline | VH3|3-33/D6|6-6|RF1/JH6 | | | | | | | |
| iPS:39 4041 | VH3|3-33/D6|6-6|RF1/JH6 | ......... | N......V. | ......... | ......... | ......T.. | .VY.GW- | ....D. |
| iPS:44 2115 | VH3|3-33/D6|6-6|RF1/JH6 | ......... | N......V. | ......... | ....A.... | ......T.. | .VY.GW- | ....D. |
| iPS:44 2122 | VH3|3-33/D6|6-6|RF1/JH6 | ......... | N......V. | ......... | ....E.... | ......T.. | .VY.GW- | ....D. |
| iPS:44 2129 | VH3|3-33/D6|6-6|RF1/JH6 | ......... | N......V. | ......... | ....G.... | ......T.. | .VY.GW- | ....D. |
| iPS:44 2136 | VH3|3-33/D6|6-6|RF1/JH6 | ......... | N......V. | ......... | ....A.... | ......T.. | .VY.GW- | ....D. |
| iPS:44 2171 | VH3|3-33/D6|6-6|RF1/JH6 | ......... | N......V. | ......... | ....E.A.. | ......T.. | .VY.GW- | ....D. |
| iPS:44 2178 | VH3|3-33/D6|6-6|RF1/JH6 | ......... | N......V. | ......... | ....A.A.. | ......T.. | .VY.GW- | ....D. |
| iPS:44 2199 | VH3|3-33/D6|6-6|RF1/JH6 | ......... | N......V. | ......... | ....A.... | ......T.. | .VY.G.- | ....D. |

FIGURE 54 (Continued)

| | | H_FR1 | H_CDR1 | H_FR2 | H_CDR2 | H_FR3 | H_CDR3 | H_FR4 |
|---|---|---|---|---|---|---|---|---|
| iPS.44-2206 | VH3J3-33/D6J6-6|RF1/JH6 | | N......V.. | | ......A. | ..................T. | VY..GF- | ............D. |
| iPS.44-2213 | VH3J3-33/D6J6-6|RF1/JH6 | | N......V.. | | ....E... | ..................T. | VY..G.- | ............D. |
| iPS.44-2220 | VH3J3-33/D6J6-6|RF1/JH6 | | N......V.. | | | ..................T. | VY..G.- | ............D. |
| iPS.44-2227 | VH3J3-33/D6J6-6|RF1/JH6 | | N......V.. | | | ..................T. | VY..GF- | ............D. |
| iPS.44-2255 | VH3J3-33/D6J6-6|RF1/JH6 | | N......V.. | | ......A.  ....E... | ..................T. | VY..G.- | ............D. |
| iPS.44-2262 | VH3J3-33/D6J6-6|RF1/JH6 | | N......V.. | | ......A. | ..................T. | VY..G.- | ............D. |
| Germline VH3J3-07/D6J6-6|RF1/JH6 | | H_FR1 | H_CDR1 | H_FR2 | H_CDR2 | H_FR3 | H_CDR3 | H_FR4 |
| iPS.44-2269 | VH3J3-07/D6J6-6|RF1/JH6 | | N......V.H | | V.WY.... N...AE.. | ..................T. | VY..GW- | ............D. |
| Germline VH3J3-33/D4J4-11|RF2/JH6 | | H_FR1 | H_CDR1 | H_FR2 | H_CDR2 | H_FR3 | H_CDR3 | H_FR4 |
| iPS.39-3930 | VH3J3-33/D4J4-11|RF2/JH6 | | ......F... | | ..I..H.. | ....N..........S. | L.MG-- | |
| iPS.42-4460 | VH3J3-33/D4J4-11|RF2/JH6 1.001 | | ......F... | | ..I..H.. | ................S. | L.MG-- | |

FIGURE 54 (Continued)

| | | | | | | |
|---|---|---|---|---|---|---|
| iPS:44 2311 | 21- 225_7E1 1.001.001 | VH3\|3- 33\|D4\|4- 11\|RF2/J H6 | | I..H.. | .S... | .L.MG--- |
| iPS:44 2317 | 21- 225_7E1 1.001.002 | VH3\|3- 33\|D4\|4- 11\|RF2/J H6 | ..F.. | I..H.. | .S... | .L.MG--- |
| iPS:44 2323 | 21- 225_7E1 1.001.003 | VH3\|3- 33\|D4\|4- 11\|RF2/J H6 | ..F.. | ..HS.. | .S... | .L.MG--- |
| iPS:44 2330 | 21- 225_7E1 1.001.004 | VH3\|3- 33\|D4\|4- 11\|RF2/J H6 | ..F.. | ..HE.. | .S... | .L.MG--- |
| iPS:44 2337 | 21- 225_7E1 1.001.005 | VH3\|3- 33\|D4\|4- 11\|RF2/J H6 | ..F.. | I..H..A. | .S... | .L.MG--- |
| iPS:44 2344 | 21- 225_7E1 1.001.006 | VH3\|3- 33\|D4\|4- 11\|RF2/J H6 | ..F.. | I..H..E. | .S... | .L.MG--- |
| iPS:44 2351 | 21- 225_7E1 1.001.007 | VH3\|3- 33\|D4\|4- 11\|RF2/J H6 | ..F.. | ..H...A. | .S... | .L.MG--- |
| iPS:44 2358 | 21- 225_7E1 1.001.008 | VH3\|3- 33\|D4\|4- 11\|RF2/J H6 | ..F.. | ..HE...E. | .S... | .L.MG--- |
| iPS:44 2365 | 21- 225_7E1 1.001.009 | VH3\|3- 33\|D4\|4- 11\|RF2/J H6 | ..F.. | ..HE...E. | .S... | .L.MG--- |
| iPS:44 2372 | 21- 225_7E1 1.001.010 | VH3\|3- 33\|D4\|4- 11\|RF2/J H6 | ..F.. | ..HS...E. | .S... | .L.MG--- |
| iPS:44 2379 | 21- 225_7E1 1.001.011 | VH3\|3- 33\|D4\|4- 11\|RF2/J H6 | ..F.. | ..HS...A. | .S... | .L.MG--- |
| iPS:44 2386 | 21- 225_7E1 1.001.012 | VH3\|3- 33\|D4\|4- 11\|RF2/J H6 | ..F.. | ..HS... | .S... | .L.MG--- |

Table 19A

VARIABLE HEAVY CHAIN CONSENSUS SEQUENCES

| NAME (ORIGINAL AND PATENT) | Patent SEQ ID NO. | SEQUENCE |
|---|---|---|
| VH-Consensus 1 (Table 21) (generated from 13 heavy chain sequences) | SEQ ID NO: 50352 | QVQLVQSGAEVKKPGASVKVSCKASGYTFTDYYMH WVRQAPGQGLEWMGWINPNSGGTNYAQKFQGRVT MTRDTSISTAYMELSRLRSDDTAVYYCARDGTGSFD YWGQGTLVTVSS |
| VH-Consensus 2 (Table 22) (generated from 11 heavy chain sequences) | SEQ ID NO: 50353 | QVQLVQSGAEVKKPGASVKVSCKASGYTFTGYYMH WVRQAPGQGLEWMGWINPNSGGTNYAQKFQGRVT MTRDTSISTAYMELSRLRSDDTAVYYCARSYYYGSG SYYNFPDYWGQGTLVTVSS |
| VH-Consensus 3 (Table 23) (generated from 15 heavy chain sequences) | SEQ ID NO: 50354 | QVQLVQSGAEVKKPGASVKVSCKASGYTFTNYDIN WVRQATGQGLEWMGWMHPNSGNTGYAQKFQGRV TMTRNTSISTAYMELSSLRSEDTAVYYCASSSGWYY FDYWGQGTLVTVSS |
| VH-Consensus 4 (Table 24) (generated from 23 heavy chain sequences) | SEQ ID NO: 50355 | EVQLVESGGGLVKPGGSLRLSCAASGFTFSSYSMNW VRQAPGKGHLEWVSSISGSSSYIYYADSVKGRFTISRD NAKNSLYLQMNSLRAEDTAVYYCARVASFDYWGQ GTLVTVSS |
| VH-Consensus 5 | SEQ ID NO: 50356 | EVQLVESGGGLVKPGGSLRLSCAASGFTFSSYSMNW VRQAPGKGLEWVSSISGSSSYIYYADSVKGRFTISRD NAKNSLYLQMNSLRAEDTAVYYCARDRGSLWGQG TLVTVSS |
| VH-Consensus 6 (Table 26) (generated from 11 heavy chain sequences) | SEQ ID NO: 50357 | EVQLLESGGGLVQPGGSLRLSCAASGFTFSSYVMNW VRQAPGKGLEWVSAISGSGGSTYYADSVKGRFTISR DNSKNTLYLQMNSLRAEDTAVYYCARTGVFDYWG QGTLVTVSS |
| VH-Consensus 7 (Table 27) (generated from 30 heavy chain sequences) | SEQ ID NO: 50358 | EVQLLESGGGLVQPGGSLRLSCAASGFTFSSYAMSW VRQAPGKGLEWVSAISGRGGSTFHADSVKGRFTISR DNSKNTLYLQMNSLRAEDTAVYYCVKGELLEDYYF YGMDVWGQGTTVTVSS |
| VH-Consensus 8 (Table 28) (generated from 25 heavy chain sequences) | SEQ ID NO: 50359 | EVQLLESGGGLVQPGGSLRLSCAASEFTFSSYAMXW VRQAPGKGLEWVSISGRGGNTFYADSVKGRFTISR DNSKNTLYLQMNSLRAEDTAVYYCASRLAVAGSEA FDIWGQGTMVTVSS |
| VH-Consensus 9 (Table 29) (generated from 14 heavy chain sequences) | SEQ ID NO: 50360 | QVQLVESGGGVVQPGRSLRLSCAASGFTFSSYGMH WVRQAPGKGLEWVAVIWXDGSNKYYADSVKGRFT ISRDNSKNTLYLQMNSLRAEDTAVYYCARDLSMGG MDVWGQGTTVTVSS |

FIGURE 55
(Continued)

| | | |
|---|---|---|
| VH-Consensus 10 (Table 30) (generated from 22 heavy chain sequences) | SEQ ID NO: 50361 | QVQLVESGGGVVQPGRSLRLSCAASGFTFSSYYMH WVRQAPGKGLEWVAVIWYDGSNKYYADSVKGRFT ISRDNSKNTLYLQMNSLRAEDTAVYYCAREKYSSS WYDYGMDVWGQGTTVTVSS |
| VH-Consensus 11 (Table 31) (generated from 16 heavy chain sequences) | SEQ ID NO: 50362 | QVQLVESGGGVVQPGRSLRLSCAASGFTFSDYGMH WVRQAPGKGLEWVAVIWYDESNKYYADSVKGRFTI SRDNSKNTLYLQMNSLRAEDTAVYYCAREIGWLDD YWGQGTLVTVSS |
| VH-Consensus 12 (Table 32) (generated from 71 heavy chain sequences) | SEQ ID NO: 50363 | QVQLVESGGGVVQPGRSLRLSCAASGFTFSDYGMH WVRQAPGKGLEWVAVIWYDENNKYYADSVKGRFT ISRDNSKNTLYLQMNSLRAEDTAVYYCARELGFRSD YWGQGTLVTVSS |
| VH-Consensus 13 (Table 33) (generated from 21 heavy chain sequences) | SEQ ID NO: 50364 | QLQLQESGPGLVKPSETLSLTCTVSGGSISRSSYYWG WIRQPPGKGLEWIGNIYYSGSTYYNPSLKSRVTISVD TSKNQFSLKLSSVTAADTAVYYCARHSSSWSLDYW GQGTLVTVSS |
| VH-Consensus 14 (Table 34) (generated from 13 heavy chain sequences) | SEQ ID NO: 50365 | QLQLQESGPGLVKPSETLSLTCTVSGGSISRSSYYWG WIRQPPGKGLEWIGNIYYSGSTYYNPSLKSRVTISVD TSKNQFSLKLSSVTAADTAVYYCGRHGKDWGLDY WGQGTLVTVSS |
| VH-Consensus 15 (Table 49) ) (generated from 149 heavy chain sequences) | SEQ ID NO: 50266 | QVQLVQS-GAEVKKPGASVKVSCKAASG-YTFTN---YDINWVRQATGQGLEWMGWMHPN---SGNTGYAQKFQGRVTMTRNTSISTAYMELSSLRSED TAVYYCASSSGWY---YFDYWGQGTLVTVSS |
| VH-Consensus 16 (Table 50) ) (generated from 128 heavy chain sequences) | SEQ ID NO: 50267 | QVQLVES-GGGVVQPGRSLRLSCAASG-FTFSS---YYAMHWVRQAPGKGLEWV-AYIWYD---GSNKYYADSVKGRFTISRDNSKNTLYLQMNSLRAED TAVYYCARERYSSGW---YDYGMDVWGQGTTVTVSS |
| VH-Consensus 17 (Table 51) ) (generated from 117 heavy chain sequences) | SEQ ID NO: 50268 | QVQLVES-GGGVVQPGRSLRLSCAASG-FTFSD---YGMHWVRQAPGKGLEWVAVIWYD---ENNKYYADSVKGRFTISRDNSKNTLYLQMNSLRAE DTAVYYCARELGF---SDYWGQGTLVTVSS |
| VH-Consensus 18 (Table 52) ) (generated from 91 heavy chain sequences) | SEQ ID NO: 50269 | QVQLQQW-GAGLLKPSETLSLTCAVHG-GSFSG---CYWSWIRQPPGKGLEWIGEINH---SGSTNYNPSLKSRVTISVDTSKNQFSLKLSSVTAADT AVYYCARDYGG---MDVWGQGTTVTVSS |

FIGURE 55
(Continued)

| | SEQ ID NO: | |
|---|---|---|
| VH-Consensus 19 (Table 53) (generated from 74 heavy chain sequences) | SEQ ID NO: 50270 | QVQLVQS-GAEVKKPGASVKVSCKASG-YTFTN---YDINWVRQATGQGLEWMGWMHPN---SGNTGYAQKFQGRVTMTRNTSISTAYMELSSLRSED TAVYYCAISSGWY---WFDPWGQGTLVTVSS |
| VH-Consensus 20 (Table 54) (generated from 53 heavy chain sequences) | SEQ ID NO: 50271 | QVQLVES-GGGVVQPGRSLRLSCAASG-FTFSS---YGMHWVRQAPGKGLEWVAVIWYD---GSNKNYADSVKGRFTISRDNSKNTLYLQMNSLRAED TAVYYCARDQGYGY---YGLDYWGQGTTVTVSS |
| VH-Consensus 21 (Table 55) (generated from 52 heavy chain sequences) | SEQ ID NO: 50272 | QVQLVQS-GAEVKKPGASVKVSCKASG-YTFTG---YYMHWVRQAPGQGLEWMGWINPN---SQGTNYAQKFQGRVTMTRDTSISTAYMELSRLRSDD TAVYYCARDGTS---SFDYWGQGTLVTVSS |
| VH-Consensus 22 (Table 56) (generated from 49 heavy chain sequences) | SEQ ID NO: 50273 | QVQLVES-GGGVVQPGRSLRLSCAASG-FTFSS---YGMHWVRQAPGKGLEWVAVIWHD---GSNKYYADSVKGRFTISRDNSKNTLYLQMNSLRAED TAVYYCARDL SMG---GMDVWGQGTTVTVSS |
| VH-Consensus 23 (Table 57) (generated from 37 heavy chain sequences) | SEQ ID NO: 50274 | QVQLVES-GGGVVQPGRSLRLSCAASG-FTFSD---YGMHWVRQAPGKGLEWVAVIWYD---ESNKYYADSVKGRFTISRDNSKNTLYLQMNSLRAED TAVYYCAREYGW---LDDYWGQGTLVTVSS |
| VH-Consensus 24 (Table 58) (generated from 35 heavy chain sequences) | SEQ ID NO: 50275 | EVQLVES-GGGLVKPGGSLRLSCAASG-FTFSS---YSMNWVRQAPGKGLEWVSSISGS---SSYIYYADSVKGRFTISRDNAKNSLYLQMNSLRAED TAVYYCARDRG---SSWGQGTLVTVSS |
| VH-Consensus 25 (Table 59) (generated from 32 heavy chain sequences) | SEQ ID NO: 50276 | EVQLLES-GGGLVQPGGSLRLSCAASE-FTFSS---YAMSWVRQAPGKGLEWVSVISGR---GGNTFYADSVKGRFTISRDNSKNTLYLQMNSLRAED TAVYYCASRIAVAG---SEAPDIWGQGTMVTVSS |
| VH-Consensus 26 (Table 60) (generated from 30 heavy chain sequences) | SEQ ID NO: 50277 | EVQLLES-GGGLVQPGGSLRLSCAASG-FTFSS---YAMSWVRQAPGKGLEWVSAISGR---GGSTFHADSVKGRFTISRDNSKNTLYLQMNSLRAED TAVYYCVKGELLEDY---YFYGMDYWGQGTTVTVSS |
| VH-Consensus 27 (Table 61) (generated | SEQ ID NO: 50278 | QVQLVES-GGGVVQPGRSLRLSCAASG-FTFSS---YGMHWVRQAPGKGLEWVAVIWYD--- |

FIGURE 55
(Continued)

| | | |
|---|---|---|
| from 29 heavy chain sequences) | | GSNKYADSVKGRFTISRDNSKNTLYLQMNSLRAED TAVYYCARDRVYCSSTSC--- PYYYYGMDYWGQGTTVTVSS |
| VH-Consensus 28 (Table 62) (generated from 28 heavy chain sequences) | SEQ ID NO: 50279 | EVQLVES-GGGLVRPGGSLRLSCAASG-FTFSS--- YSMNWVRQAPGKGLEWVSSISGS--- SSYIYYADSVKGRFTISRDNAKNSLYLQMNSLRAED TAVYYCARYAS--- FDYWGQGTLVTVSS |
| VH-Consensus 29 (Table 63) (generated from 26 heavy chain sequences) | SEQ ID NO: 50280 | QVQLQES-GPGLVKPSQTLSLTCTVSG-GSISSG--- DYYWNWIRQHPGKGLEWIGYIFY--- SGSTYYNPSLKSRVTISVDTSKNQFSLKLSSVTAADT AVYYCARGDYDGSGSY--- HYYGMDYWGQGTTVTVSS |
| VH-Consensus 30 (Table 64) (generated from 24 heavy chain sequences) | SEQ ID NO: 50281 | EVQLLES-GGGLVQPGGSLRLSCAASG-FTFSS--- YAMSWVRQAPGKGLEWVSYISGG--- GSSTYYADSVKGRFTISRDNSKNTLYLQMNSLRAED TAVYYCAKWRGNPI--- DYGMDYWGQGTTVTVSS |
| VH-Consensus 31 (Table 65) (generated from 24 heavy chain sequences) | SEQ ID NO: 50282 | QVQLVES-GGGVVQPGRSLRLSCAASG-FTFSS--- YGMHWVRQAPGKGLEWVAIIWYD--- GSNKYADSVKGRFTISRDNSKNTLYLQMNSLRAED TAVYYCARDHYDFW--- SGHFDYWGQGTLVTVSS |
| VH-Consensus 32 (Table 66) (generated from 24 heavy chain sequences) | SEQ ID NO: 50283 | QVQLQQW-GAGLLKPSETLSLTCAVYG-GSFSQ--- YYWSWIRQPPGKGLEWIGEINH--- SGRTNYNPSLKSRVTISVDTSKNQFSLKLSSVTAADT AVYYCARDYGG--- LDYWGQGTLVTVSS |
| VH-Consensus 33 (Table 67) (generated from 22 heavy chain sequences) | SEQ ID NO: 50284 | QLQLQES-GPGLVKPSEFLSLTCTVSG-GSISRS--- SYYWGWIRQPPGKGLEWIGNIYY--- SGSTYYNPSLKSRVTISVDTSKNQFSLKLSSVTAADT AVYYCARHSSSW--- SLDYWGQGTLVTVSS |
| VH-Consensus 34 (Table 68) (generated from 19 heavy chain sequences) | SEQ ID NO: 50285 | QVQLVQS-GAEVKKPGASVKVSCKASG-YTFTG--- YYIHWVRQAPGQGLEWMGWINPN--- SGGTNYAQKFQGRVTMTRDTSISTAYMELSRLRSDD TAVYYCARGYSYGY--- NWFDPWGQGTLVTVSS |
| VH-Consensus 35 (Table 69) (generated from 18 heavy chain sequences) | SEQ ID NO: 50286 | QVQLVES-GGGVVQPGRSLRLSCAASG-FTFSH--- YGMHWVRQAPGKGLEWVAVIWYD--- GSNKYADSVKGRFTISRDNSKNTLYLQMNSLRAED |

FIGURE 55
(Continued)

| | | |
|---|---|---|
| VH-Consensus 36 (Table 70) (generated from 17 heavy chain sequences) | SEQ ID NO: 50287 | TAVYYCARGDWNP...EGMDYWGQGTTVTVSS |
| VH-Consensus 37 (Table 71) (generated from 16 heavy chain sequences) | SEQ ID NO: 50288 | EVQLLES-GGGLVQPGGSLRLSCAASG-FTFSS--- YAMSWVRQAPGKGLEWVSAISGS--- GGNTFYADSVKGRFTISRDNSKNTLYLQMNSLRAED TAVYYCAKKDYDYW... GSPYFDYWGQGTLVTVSS |
| VH-Consensus 38 (Table 71) (generated from 16 heavy chain sequences) | SEQ ID NO: 50289 | QVQLVQS-GAEVKKPGASVKVSCKASG-YTFTG--- YYMHWVRQAPGQGLEWMGWINPN--- SGGTNYAQKFQGRVTMTRDTSISTAYMELSRLRSDD TAVYYCARSYYYGSGS--- YYNEFDYWGQGTLVTVSS |
| VH-Consensus 38 (Table 72) (generated from 14 heavy chain sequences) | SEQ ID NO: 50289 | QVQLVQS-GAEVKKPGASVKVSCKASG-YTFTG--- YYIHWVRQAPGQGLEWMGWINPY--- SGDTNYAQKFQGRVTMTRDTSISTAYMELSRLRFDD TAVFYCARDMGGYSS--- YYYGMDYWGQGTTVTVSS |
| VH-Consensus 39 (Table 73) (generated from 14 heavy chain sequences) | SEQ ID NO: 50290 | EVQLVES-GGGLVKPGGSLRLSCAASG-FTFSS--- YSMNWVRQAPGKGLEWVSSISGS--- SSYIYYADSVKGRFTISRDNAKNSLYLQMNSLRAED TAVYYCARLT... EDYWGQGTLVTVSS |
| VH-Consensus 40 (Table 74) (generated from 14 heavy chain sequences) | SEQ ID NO: 50291 | QVQLVES-GGGVVQPGRSLRLSCAASG-FTFST--- YGMHWVRQAPGKGLEWVAHWYD--- GTNKYYADSVKGRFTISRDNSKNTLYLQLNSLRAED TAVYYCARDPLRGYN--- DPVMDYWGQGTLVTVSS |
| VH-Consensus 41 (Table 75) (generated from 13 heavy chain sequences) | SEQ ID NO: 50292 | EVQLLES-GGGLVQPGGSLRLSCAASG-FTFSS--- YAMSWVRQAPGKGLEWVSAISGR--- GGNTFYADSVKGRFTISRDNSKNTLYLQMNSLRAED TAVYYCAKRVTDYGG--- NDWFDPWGQGTLVTVSS |
| VH-Consensus 42 (Table 76) (generated from 13 heavy chain sequences) | SEQ ID NO: 50293 | QVQLVES-GGGVVQPGRSLRLSCAASG-FTFST--- YGMHWVRQAPGKGLEWVAVIWYG--- GSNKDYADSVKGRFTISRDISKNTLYLQMNSLRAED TAVYYCARDRDYCSGGSC--- PYYYYGMDYWGQGTTVTVSS |
| VH-Consensus 43 (Table 77) (generated from 13 heavy chain sequences) | SEQ ID NO: 50294 | QLQLQES-GPGLVKPSETLSLTCTVSG-GSISRS--- SYYWGWIRQPPGKGLEWIGNIYY--- SGSTYNPSLKSRVTISVDTSKNQFSLKLSSVTAADT AVYYCGRHGKDW... GLDYWGQGTLVTVSS |

FIGURE 55
(Continued)

| | | |
|---|---|---|
| VH-Consensus 44 (Table 78) (generated from 12 heavy chain sequences) | SEQ ID NO: 50295 | QVQLVQS-GAEVKKPGASVKVSCKASG-YTFTG--- YYMHWVRQAPGQGLEWMGWIKPN--- SGGTNQAQKFQGRVTMTRDTSISTAYMELSGLRSDD TAVYYCARAPGTAAAG--- IWGYFDYWGQGTLVTVSS |
| VH-Consensus 45 (Table 79) (generated from 12 heavy chain sequences) | SEQ ID NO: 50296 | QITLKES-GPTLVKPTQTLTLTCTFSG-PSLSTG--- GVGVGWIRQPPGKALEWLALIYW--- DDDKRYSPSLKSRLTITKDTSKNQVVLIMTNMDPVD TATYYCAHLJAV--- AFDYWGQGTLVTVSS |
| VH-Consensus 46 (Table 80) (generated from 11 heavy chain sequences) | SEQ ID NO: 50297 | QVQLVES-GGGVVQPGRSLRLSCAASG-FTFSS--- YGMHWVRQAPGKGLEWVAHWYD--- GSYKYYADSVKGRFTISRDNSKNTLYLQMNSLRAED TAVYYCAREAYDFW--- SGYFDYWGQGTLVTVSS |
| VH-Consensus 47 (Table 81) (generated from 11 heavy chain sequences) | SEQ ID NO: 50298 | QVQLVES-GGGVVQPGRSLRLSCAASG-FTFSS--- YGMHWVRQAPGKGLEWVAVIWYD--- GSNKYYADSVKGRFTISRDNSKNTLYLQMNSLRAED TAVYYCARDRDYGD--- YGMDVWGQGTTVTVSS |
| VH-Consensus 48 (Table 82) (generated from 10 heavy chain sequences) | SEQ ID NO: 50299 | EVQLLES-GGGLVQPGGSLRLSCAASG-FTFSS--- YAMSWVRQAPGKGLEWVSAISGS--- GGNTEYADSVKGRFTISRDNSKNTLYLQMNSLRAED TAVYYCAKLGKDYY--- XYGMDVWGQGTTVTVSS |
| VH-Consensus 49 (Table 83) (generated from 10 heavy chain sequences) | SEQ ID NO: 50300 | EVQLLES-GGGLVQPCGGSLRLSCAASG-FTFSS--- YVAMSWVRQAPGKGLEWVSAMSGS--- GGRTYYADSYKGRFTISRDNSKNTLYLQMNSLRAED TAVYYCAKLTA--- FDYWGQGTLVTVSS |
| VH-Consensus 50 (Table 84) (generated from 10 heavy chain sequences) | SEQ ID NO: 50301 | QVQLVES-GGGVVQPGRSLRLSCAASG-FTFSS--- YGMHWVRQAPGKGLEWVAHSYA--- GSNKYYADSVKGRFTISRDNSKNTLYLQMNSLRAED TAVYYCVRRGYSYG--- GYGMDVWGQGTTVTVSS |
| VH-Consensus 51 (Table 85) (generated from 10 heavy chain sequences) | SEQ ID NO: 50302 | QVQLVES-GGGVVQPGRSLRLSCAASG-FTFSD--- YVMHWVRQAPGKGLEWVAYIWYD--- GSNKYYADSVKGRFTISRDNSKNTLYLQMNSLRAED TAVYYCAREPYTSGW--- YDYGMDVWGQGTTVTVSS |

FIGURE 55
(Continued)

| | | |
|---|---|---|
| VH-Consensus 52 (Table 86) (generated from 9 heavy chain sequences) | SEQ ID NO: 50303 | QVQLVQS-GAEVKKPGASVKVSCKASG-YTFNS--YG(ISWVRQAPGQGLEWMGWISAY--NGNTKYAQKLQGRVTMTTDTSTSTAYMELRSLRSD DTAVYYCARHDFWSGY--YKGMDYWGQGTTVTVSS |
| VH-Consensus 53 (Table 87) (generated from 9 heavy chain sequences) | SEQ ID NO: 50304 | EVQLLES-GGGLVQPGGSLRLSCAASG-FTFSS--YAMSWVRQAPGKGLEWVSAISGR--GG NTFDADSYKGRFTISRDNSKNTLYLQMNSLRAEDTA VYYCAKERSGS--YFDYWGQGTLVTVSS |
| VH-Consensus 54 (Table 88) (generated from 9 heavy chain sequences) | SEQ ID NO: 50305 | QVQLVES-GGGVVQPGRSLRLSCAASG-FTFSN--YGMHWVRQAPGKGLEWVAYIWHD--GSNKYYADSVKGRFTISRDNSKNTLYLQMNSLRAED TAVYYCARENSSS--YYFDYWGQGTLVTVSS |
| VH-Consensus 55 (Table 89) (generated from 8 heavy chain sequences) | SEQ ID NO: 50306 | QITLKES-GPTLVKPTQTLTLTCTFSG-FSLSTS--GVGVGWIRQPPGKALEWLALINIW--NDDKRYSPSLKSRFTITRDTSKDQVVLTMTNMDPVID TATYYCAHKATWV--AFDIWGQGTMVTVSS |
| VH-Consensus 56 (Table 90) (generated from 8 heavy chain sequences) | SEQ ID NO: 50307 | EVQLLES-GGGLVQPGGSLRLSCAASG-FTFSS--YVMNWVRQAPGKGLEWVSAISGS--GGRTYYADSVKGRFTISRDNSKNTLYLQMNSLRAED TAVYYCARIAT--EDYWGQGTLVTVSS |
| VH-Consensus 57 (Table 91) (generated from 8 heavy chain sequences) | SEQ ID NO: 50308 | EVQLLES-GGGLVQPGGSLRLSCAASG-FTFSS--YAMSWVRQAPGKGLEWVSYISGR--GGITFYADSVKGRFTISRDNSKNTLYLQMNSLRAED TAVYYCAKRTPSD--VFDIWGQGTMVTVSS |
| VH-Consensus 58 (Table 92) (generated from 8 heavy chain sequences) | SEQ ID NO: 50309 | QVQLVES-GGGVVQPGRSLRLSCAASG-FTFSS--YGMHWVRQAPGKGLEWVAYIWYD--GSNKYYADSVKGRFTISRDNSKNTLYLQMNSLRAED TAVYYCARDRPKS--SAF DYWGQGTLVTVSS |
| VH-Consensus 59 (Table 93) (generated from 8 heavy chain sequences) | SEQ ID NO: 50310 | EVQLVES-GGGLVQPGGSLRLSCAASG-FTFSS--YNMNWVRQAPGKGLEWVSYISRS--SNTKYYADSVKGRFTISRDNAKNSLYLQMNSLRDED TAVYYCARDRSGSYGY--FYYYGLDVWGQGTTVTVSS |
| VH-Consensus 60 (Table 94) (generated | SEQ ID NO: 50311 | QVQLQES-GPGLVKPSQTLSLTCTVSG-GSIRSG--GDYWSWIRQHPGKLEWIGYIYY-- |

FIGURE 55
(Continued)

| from 8 heavy chain sequences) | SGSTYYNPSLKSRVTISVDTSKNQFSLKLSSVTAADT AVYYCARDSSSY............ GMDVWGQGTTVTVSS |

FIGURE 55
(Continued)

Table 19B

VARIABLE HEAVY CDR CONSENSUS SEQUENCES 1

| NAME (ORIGINAL AND PATENT) | Patent SEQ ID NO. | CDR | Sequence |
|---|---|---|---|
| VH-CONSENSUS-1 TABLE 21 | 50381 | VH1 | DYYMH |
|  | 50382 | VH2 | WINPNNGGTNYAQKFQG |
|  | 50383 | VH3 | DGTGSFDY |
| VH-CONSENSUS-2 TABLE 22 | 50384 | VH1 | GYYMH |
|  | 50385 | VH2 | WINPNSGGTNYAQKFQG |
|  | 50386 | VH3 | SYYYGSGSYYNEFDY |
| VH-CONSENSUS-3 TABLE 23 | 50387 | VH1 | NYDIN |
|  | 50388 | VH2 | WMHPNSGNTGYAQKFQG |
|  | 50389 | VH3 | SSGWYYFDY |
| VH-CONSENSUS-4 TABLE 24 | 50390 | VH1 | SYSMN |
|  | 50391 | VH2 | SISGSSSYIYYADSVKG |
|  | 50392 | VH3 | VASFDY |
| VH-CONSENSUS-5 TABLE 25 | 50393 | VH1 | SYSMN |
|  | 50394 | VH2 | SISGSSSYIYYADSVKG |
|  | 50395 | VH3 | DRGSL |
| VH-CONSENSUS-6 TABLE 26 | 50396 | VH1 | SYYMN |
|  | 50397 | VH2 | AISGSGGSTYYADSVKG |
|  | 50398 | VH3 | TGVFDY |
| VH-CONSENSUS-7 TABLE 27 | 50399 | VH1 | SYAMS |
|  | 50400 | VH2 | AISGRGGSTFHADSVKG |
|  | 50401 | VH3 | GELLEDYYFYGMDV |
| VH-CONSENSUS-8 TABLE 28 | 50402 | VH1 | SYAMX |
|  | 50403 | VH2 | VISGRGGNTFYADSVKG |
|  | 50404 | VH3 | RLAVAGSEAFDI |
| VH-CONSENSUS-9 TABLE 29 | 50405 | VH1 | SYGMH |
|  | 50406 | VH2 | VIWXDGSNKYYADSVKG |
|  | 50407 | VH3 | DLSMGGMDV |
| VH-CONSENSUS-10 TABLE 30 | 50408 | VH1 | SYYMH |
|  | 50409 | VH2 | VIWYDGSNKYYADSVKG |
|  | 50410 | VH3 | EKYSSSWYDYGMDV |
| VH-CONSENSUS-11 TABLE 31 | 50411 | VH1 | DYGMH |
|  | 50412 | VH2 | VIWYDESNKYYADSVKG |
|  | 50413 | VH3 | EIGWLDDY |

FIGURE 55
(Continued)

| | | | |
|---|---|---|---|
| VH-CONSENSUS-12 TABLE 32 | 50414 | VH1 | DYGMH |
| | 50415 | VH2 | VIWYDENNKYYADSVKG |
| | 50416 | VH3 | ELGFRSDY |
| VH-CONSENSUS-13 TABLE 33 | 50417 | VH1 | RSSSYYWG |
| | 50418 | VH2 | NIYYSGSTYYNPSLKS |
| | 50419 | VH3 | HSSSWSLDY |
| VH-CONSENSUS-14 TABLE 34 | 50420 | VH1 | RSSSYYWG |
| | 50421 | VH2 | NIYYSGSTYYNPSLKS |
| | 50422 | VH3 | HGKDWGLDY |
| VH-CONSENSUS-15 TABLE 49 | 50468 | VH1 | NYDIN |
| | 50469 | VH2 | WMHPNSGNTGYAQKFQG |
| | 50470 | VH3 | SSGWYYFDY |
| VH-CONSENSUS-16 TABLE 50 | 50471 | VH1 | SYVMH |
| | 50472 | VH2 | VIWYDGSNKYYADSVKG |
| | 50473 | VH3 | ERYSSGWYDYGMDV |
| VH-CONSENSUS-17 TABLE 51 | 50474 | VH1 | DYGMH |
| | 50475 | VH2 | VIWYDENNKYYADSVKG |
| | 50476 | VH3 | ELGFSDY |
| VH-CONSENSUS-18 TABLE 52 | 50477 | VH1 | GCYWS |
| | 50478 | VH2 | EINHSGSTNYNPSLKS |
| | 50479 | VH3 | DYGGMDV |
| VH-CONSENSUS-19 TABLE 53 | 50480 | VH1 | NYDIN |
| | 50481 | VH2 | WMHPNSGNTGYAQKFQG |
| | 50482 | VH3 | SSGWYWFDP |
| VH-CONSENSUS-20 TABLE 54 | 50483 | VH1 | SYGMH |
| | 50484 | VH2 | VIWYDGSNKNYADSVKG |
| | 50485 | VH3 | DQGVGYYGLDV |
| VH-CONSENSUS-21 TABLE 55 | 50486 | VH1 | GYYMH |
| | 50487 | VH2 | WINPNSGGTNVAQKFQG |
| | 50488 | VH3 | DGTSSFDY |
| VH-CONSENSUS-22 TABLE 56 | 50489 | VH1 | SYGMH |
| | 50490 | VH2 | VIWHDGSNKYYADSVKG |
| | 50491 | VH3 | DLSMGGMDV |
| VH-CONSENSUS-23 TABLE 57 | 50492 | VH1 | DYGMH |
| | 50493 | VH2 | VIWYDESNKYYADSVKG |
| | 50494 | VH3 | EVGWLDDY |

FIGURE 55
(Continued)

| | | | |
|---|---|---|---|
| VH-CONSENSUS-24 TABLE 58 | 50495 | VH1 | SYSMN |
| | 50496 | VH2 | SISGSSSYIYYADSVKG |
| | 50497 | VH3 | DRGSS |
| VH-CONSENSUS-25 TABLE 59 | 50498 | VH1 | SYAMS |
| | 50499 | VH2 | VISGRGGNTFYADSVKG |
| | 50500 | VH3 | RIAVAGSEAFDI |
| VH-CONSENSUS-26 TABLE 60 | 50501 | VH1 | SYAMS |
| | 50502 | VH2 | AISGRGGSTFHADSVKG |
| | 50503 | VH3 | GELLEDYYFYGMDV |
| VH-CONSENSUS-27 TABLE 61 | 50504 | VH1 | SYGMH |
| | 50505 | VH2 | VIWYDGSNKYYADSVKG |
| | 50506 | VH3 | DRVYCSSTSCPYYYYGMDV |
| VH-CONSENSUS-28 TABLE 62 | 50507 | VH1 | SYSMN |
| | 50508 | VH2 | SISGSSSYIYYADSVKG |
| | 50509 | VH3 | VASFDY |
| VH-CONSENSUS-29 TABLE 63 | 50510 | VH1 | SGDYYWN |
| | 50511 | VH2 | YIFYSGSTYYNPSLKS |
| | 50512 | VH3 | GDYDGSGSYHYYYGMDV |
| VH-CONSENSUS-30 TABLE 64 | 50513 | VH1 | SYAMS |
| | 50514 | VH2 | VISGGGSSTYYADSVKG |
| | 50515 | VH3 | WRGNPTDYGMD |
| VH-CONSENSUS-31 TABLE 65 | 50516 | VH1 | SYGMH |
| | 50517 | VH2 | HWYDGSNKYYADSVKG |
| | 50518 | VH3 | DHYDFWSGHFDY |
| VH-CONSENSUS-32 TABLE 66 | 50519 | VH1 | GYYWS |
| | 50520 | VH2 | EINHSGRTNYNPSLKS |
| | 50521 | VH3 | DYGGLDY |
| VH-CONSENSUS-33 TABLE 67 | 50522 | VH1 | RSSYYWG |
| | 50523 | VH2 | NTYSGSTYYNPSLKS |
| | 50524 | VH3 | HSSSWSLDY |
| VH-CONSENSUS-34 TABLE 68 | 50525 | VH1 | GYYIH |
| | 50526 | VH2 | WINPNSGGTNYAQKFQG |
| | 50527 | VH3 | GYSYGYNWFDP |
| VH-CONSENSUS-35 TABLE 69 | 50528 | VH1 | HYGMH |
| | 50529 | VH2 | VIWYDGSNKYYADSVKG |
| | 50530 | VH3 | GDWNPEGMDV |

FIGURE 55
(Continued)

| | | | |
|---|---|---|---|
| VH-CONSENSUS-36 TABLE 70 | 50531 | VH1 | SYAMS |
| | 50532 | VH2 | AISGSGGNTFYADSVKG |
| | 50533 | VH3 | KDYDYVWGSPYFDY |
| VH-CONSENSUS-37 TABLE 71 | 50534 | VH1 | GYYMH |
| | 50535 | VH2 | WINPNSGGTNYAQKFQG |
| | 50536 | VH3 | SYYYGSGSYYNEFDY |
| VH-CONSENSUS-38 TABLE 72 | 50537 | VH1 | GYYIH |
| | 50538 | VH2 | WINPYSGDTNYAQKFQG |
| | 50539 | VH3 | DWGGYSSYYYGMDV |
| VH-CONSENSUS-39 TABLE 73 | 50540 | VH1 | SYSMN |
| | 50541 | VH2 | SISGSSSYTYYADSVKG |
| | 50542 | VH3 | LTFDY |
| VH-CONSENSUS-40 TABLE 74 | 50543 | VH1 | TYGMH |
| | 50544 | VH2 | IIWYDGTNKYYADSVKG |
| | 50545 | VH3 | DPLRGYNDPVMDY |
| VH-CONSENSUS-41 TABLE 75 | 50546 | VH1 | SYAMS |
| | 50547 | VH2 | AISGRGGNTFYADSVKG |
| | 50548 | VH3 | RVTDYGGNDWFDP |
| VH-CONSENSUS-42 TABLE 76 | 50549 | VH1 | ITYGMH |
| | 50550 | VH2 | VIWYGGSNKDYADSVKG |
| | 50551 | VH3 | DRDYCSGGSCPYYYYGMDV |
| VH-CONSENSUS-43 TABLE 77 | 50552 | VH1 | RSSYYWG |
| | 50553 | VH2 | NIYYSGSTYYNPSLKS |
| | 50554 | VH3 | HGKDWGLDY |
| VH-CONSENSUS-44 TABLE 78 | 50555 | VH1 | GYYMH |
| | 50556 | VH2 | WIKPNSGGTNQAQKRQG |
| | 50557 | VH3 | APGTAAAGTWGYFDY |
| VH-CONSENSUS-45 TABLE 79 | 50558 | VH1 | TGGVGVG |
| | 50559 | VH2 | LIIYWDDDKRYSPSLKS |
| | 50560 | VH3 | LLAVAFDY |
| VH-CONSENSUS-46 TABLE 80 | 50561 | VH1 | SYGMH |
| | 50562 | VH2 | IIWYDGSYKYYADSVKG |
| | 50563 | VH3 | EAYDFWSGYFDY |
| VH-CONSENSUS-47 TABLE 81 | 50564 | VH1 | SYGMH |
| | 50565 | VH2 | VIWYDGSNKYYADSVKG |
| | 50566 | VH3 | DRDYGDYGMDV |

FIGURE 55
(Continued)

| | | | |
|---|---|---|---|
| VH-CONSENSUS-48 TABLE 82 | 50567 | VH1 | SYAMS |
| | 50568 | VH2 | AISGSGGNTFYADSVKG |
| | 50569 | VH3 | LGKDYYYGMDV |
| VH-CONSENSUS-49 TABLE 83 | 50570 | VH1 | SYYMS |
| | 50571 | VH2 | AMSGSGGRTYYADSVKG |
| | 50572 | VH3 | LTAFDY |
| VH-CONSENSUS-50 TABLE 84 | 50573 | VH1 | SYGMH |
| | 50574 | VH2 | IISYAGSNKYYADSVKG |
| | 50575 | VH3 | RGYSYGGYGMDV |
| VH-CONSENSUS-51 TABLE 85 | 50576 | VH1 | DYYMH |
| | 50577 | VH2 | VIWYDGSNKYYADSVKG |
| | 50578 | VH3 | EPYTSGWYDYGMDV |
| VH-CONSENSUS-52 TABLE 86 | 50579 | VH1 | SYGIS |
| | 50580 | VH2 | WISAYNGNTKYAQKLQG |
| | 50581 | VH3 | HDFWSGYYKGMDV |
| VH-CONSENSUS-53 TABLE 87 | 50582 | VH1 | SYAMS |
| | 50583 | VH2 | AISGRGGNTFDADSVKG |
| | 50584 | VH3 | ERSGSYFDY |
| VH-CONSENSUS-54 TABLE 88 | 50585 | VH1 | NYGMH |
| | 50586 | VH2 | VIWHDGSNKYYADSVKG |
| | 50587 | VH3 | ENSSSYYFDY |
| VH-CONSENSUS-55 TABLE 89 | 50588 | VH1 | TSGVGVG |
| | 50589 | VH2 | LINWNDDKRYSPSLKS |
| | 50590 | VH3 | KATWVAFDI |
| VH-CONSENSUS-56 TABLE 90 | 50591 | VH1 | SYVMN |
| | 50592 | VH2 | AISGSGGRTYYADSVKG |
| | 50593 | VH3 | TATFDY |
| VH-CONSENSUS-57 TABLE 91 | 50594 | VH1 | SYAMS |
| | 50595 | VH2 | VISGRGGTTFYADSVKG |
| | 50596 | VH3 | KRTPSDVFDI |
| VH-CONSENSUS-58 TABLE 92 | 50597 | VH1 | SYGMH |
| | 50598 | VH2 | VIWYDGSNKYYADSVKG |
| | 50599 | VH3 | DRPRSSAFDY |
| VH-CONSENSUS-59 TABLE 93 | 50600 | VH1 | SYNMN |
| | 50601 | VH2 | YISRSSNTKYYADSVKG |
| | 50602 | VH3 | DRSGSYFYYYGLDV |
| VH-CONSENSUS-60 | 50603 | VH1 | SGGDYWS |

FIGURE 55
(Continued)

| TABLE 94 | | | |
|---|---|---|---|
| | 50604 | VH2 | YIYYSGSTYYNPSLKS |
| | 50605 | VH3 | DSSSYGMDV |

FIGURE 55
(Continued)

Table 19C

VARIABLE HEAVY CDR CONSENSUS SEQUENCES II

| NAME (ORIGINAL AND PATENT) | Patent SEQ ID NO: | SEQ ID NO: | CDR | Sequence |
|---|---|---|---|---|
| VH-CONSENSUS-15 TABLE 49 | SEQ ID NO: 50001 | | VH1 | X1 Tyr Asp X2 Asn, wherein X1 = N or H or a conservative substitution thereof, X2 = I or V or L or a conservative substitution thereof. |
| | SEQ ID NO: 50002 | | VH2 | X1 X2 X3 Pro X4 Ser X5 X6 X7 X8 X9 X10 X11 X12 Phe X13 X14 wherein X1 = W or R or a conservative substitution thereof, X2 = M or V or L or a conservative substitution thereof, X3 = H or N or Y or T or a conservative substitution thereof, X4 = N or D or H or a conservative substitution thereof, X5 = G or H or a conservative substitution thereof, X6 = N or S or Q or A or D or K or T or a conservative substitution thereof, X7 = T or A or V or E or a conservative substitution thereof, X8 = G or D or a conservative substitution thereof, X9 = Y or F or C or a conservative substitution thereof, X10 = A or P or a conservative substitution thereof, X11 = Q or K or a conservative substitution thereof, X12 = K or R or N or a conservative substitution thereof, X13 = Q or R or a conservative substitution thereof, X14 = G or V or a conservative substitution thereof. |
| | SEQ ID NO: 50003 | | VH3 | Ser Ser Gly Trp X1 X2 Phe Asp X3, wherein X1 = Y or E or N or T or a conservative substitution thereof, X2 = Y or F or K or I or R or V or L or M or W or H or S or a conservative substitution thereof, X3 = Y or F or S or N or a conservative substitution thereof. |
| VH-CONSENSUS-16 TABLE 50 | SEQ ID NO: 50004 | | VH1 | X1 X2 X3 X4 X5, wherein X1 = S or D or N or I or a conservative substitution thereof, X2 = Y or C or F or D or S or a conservative substitution thereof, X3 = V or G or I or L or a conservative substitution thereof, X4 = M or I or L or a conservative substitution thereof, X5 = H or D or a conservative substitution thereof. |
| | SEQ ID NO: 50005 | | VH2 | X1 Ile X2 Tyr Asp X3 X4 X5 Lys X6 X7 X8 X9 X10 X11 Lys Gly, wherein X1 = V or L or A or a conservative substitution thereof, X2 = W or F or a conservative substitution thereof, X3 = G or A or a conservative substitution thereof, X4 = S or R or N or a conservative substitution thereof, X5 = N or Y or G or S or a conservative substitution thereof, X6 = Y or H or a conservative substitution thereof, X7 = Y or H or N or a conservative substitution thereof, X8 = A or V or E or G or T or a conservative substitution thereof, X9 = D or E or G or a conservative substitution thereof, X10 = S or A or a conservative substitution thereof, X11 = V or M or a conservative substitution thereof. |

FIGURE 55
(Continued)

| | | | |
|---|---|---|---|
| | SEQ ID NO: 50006 | VH3 | X1 X2 X3 X4 X5 X6 X7 X8 X9 X10 X11 X12 X13 X14 X15 X16 Gly X17 X18 Val, wherein X1 = E or R or V or a conservative substitution thereof, X2 = R or Y or K or V or E or P or D or L or F or M or N or Q or T or a conservative substitution thereof, X3 = Y or S or T or V or a conservative substitution thereof, X4 = S or R or Y or P or T or G or a conservative substitution thereof, X5 = S or C or Y or a conservative substitution thereof, X6 = G or W or S or N or a conservative substitution thereof, X7 = W or Absent or L or Y or G or F or S or a conservative substitution thereof, X8 = Absent or Y or a conservative substitution thereof, X9 = Absent or A or G or T or a conservative substitution thereof, X10 = Absent or C or a conservative substitution thereof, X11 = Absent or P or a conservative substitution thereof, X12 = Absent or Y or L or a conservative substitution thereof, X13 = Absent or Y or D or a conservative substitution thereof, X14 = Y or Absent or F or H or a conservative substitution thereof, X15 = D or S or G or T or V or Y or A or F or M or a conservative substitution thereof, X16 = Y or G or F or a conservative substitution thereof, X17 = M or L or a conservative substitution thereof, X18 = D or G or a conservative substitution thereof. |
| VH-CONSENSUS-17 TABLE 53 | SEQ ID NO: 50007 | VH1 | X1 X2 Gly X3 His, wherein X1 = D or S or N or T or a conservative substitution thereof, X2 = Y or F or a conservative substitution thereof, X3 = M or I or a conservative substitution thereof. |
| | SEQ ID NO: 50008 | VH2 | X1 X2 Trp X3 X4 X5 X6 X7 X8 X9 X10 X11 X12 Ser X13 X14 Gly, wherein X1 = V or L or a conservative substitution thereof, X2 = I or V or T or M or a conservative substitution thereof, X3 = Y or F or D or a conservative substitution thereof, X4 = D or E or A or G or N or a conservative substitution thereof, X5 = E or G or V or R or D or a conservative substitution thereof, X6 = N or S or T or D or I or Y or a conservative substitution thereof, X7 = N or H or K or a conservative substitution thereof, X8 = K or Q or E or N or R or a conservative substitution thereof, X9 = Y or H or K or D or R or S or a conservative substitution thereof, X10 = Y or H or a conservative substitution thereof, X11 = A or V or G or T or I or E or a conservative substitution thereof, X12 = D or E or a conservative substitution thereof, X13 = V or M or a conservative substitution thereof, X14 = K or R or a conservative substitution thereof. |
| | SEQ ID NO: 50009 | VH3 | X1 Leu X2 X3 X4 X5 X6 X7, wherein X1 = E or D or G or a conservative substitution thereof, X2 = G or A or a conservative substitution thereof, X3 = F or W or M or a conservative substitution thereof, X4 = L or R or T or Y or S or Q or I or A or E or N or a conservative substitution |

FIGURE 55
(Continued)

| | | | |
|---|---|---|---|
| | | | thereof, X5 = S or E or G or D or F or N or A or T or a conservative substitution thereof, X6 = D or E or a conservative substitution thereof, X7 = Y or S or F or C or a conservative substitution thereof. |
| VH-CONSENSUS-18 TABLE 52 | SEQ ID NO: 50010 | VH1 | Gly X1 Tyr Trp Ser, wherein X1 = C or S or P or Y or a conservative substitution thereof. |
| | SEQ ID NO: 50011 | VH2 | Glu Ile Asn X1 X2 Gly X3 Thr X4 X5 Asn Pro Ser Leu X6 Ser, wherein X1 = H or Y or Q or a conservative substitution thereof, X2 = S or R or a conservative substitution thereof, X3 = S or R or C or I or a conservative substitution thereof, X4 = N or S or a conservative substitution thereof, X5 = Y or F or a conservative substitution thereof, X6 = K or T or a conservative substitution thereof. |
| | SEQ ID NO: 50012 | VH3 | Asp Tyr Gly Gly X1 Asp Val, wherein X1 = M or L or I or a conservative substitution thereof. |
| VH-CONSENSUS-19 TABLE 53 | SEQ ID NO: 50013 | VH1 | Asn Tyr Asp Ile Asn. |
| | SEQ ID NO: 50014 | VH2 | Trp Met X1 Pro X2 X3 X4 X5 X6 Gly X7 Ala Gln Lys Phe Gln X8, wherein X1 = H or N or Y or a conservative substitution thereof, X2 = N or D or a conservative substitution thereof, X3 = S or N or a conservative substitution thereof, X4 = G or V or a conservative substitution thereof, X5 = N or S or a conservative substitution thereof, X6 = T or I or a conservative substitution thereof, X7 = Y or F or C or a conservative substitution thereof, X8 = G or D or a conservative substitution thereof. |
| | SEQ ID NO: 50015 | VH3 | Ser Ser Gly Trp X1 X2 Phe Asp Pro, wherein X1 = Y or H or N or S or K or a conservative substitution thereof, X2 = W or R or a conservative substitution thereof. |
| VH-CONSENSUS-20 TABLE 54 | SEQ ID NO: 50016 | VH1 | X1 X2 Gly Met X3, wherein X1 = S or N or R or T or I or a conservative substitution thereof, X2 = Y or H or N or a conservative substitution thereof, X3 = H or D or a conservative substitution thereof. |
| | SEQ ID NO: 50017 | VH2 | X1 X2 Trp X3 Asp Gly X4 Asn X5 X6 X7 X8 X9 Ser Val Lys Gly, wherein X1 = V or I or a conservative substitution thereof, X2 = I or L or a conservative substitution thereof, X3 = Y or F or a conservative substitution thereof, X4 = S or T or a conservative substitution thereof, X5 = K or E or Q or D or R or a conservative substitution thereof, X6 = N or H or Y or a conservative substitution thereof, X7 = Y or H or a conservative substitution thereof, X8 = A or V or G |

FIGURE 55
(Continued)

| | | | |
|---|---|---|---|
| | SEQ ID NO: 50018 | VH3 | or a conservative substitution thereof, X9 = D or E or a conservative substitution thereof.<br>X1 X2 Gly X3 X4 X5 X6 X7 X8 X9 X10 X11 X12 X13 Asp Val, wherein X1 = D or A or a conservative substitution thereof, X2 = Q or R or Y or H or A or C or E or F or M or a conservative substitution thereof, X3 = V or I or F or a conservative substitution thereof, X4 = G or Y or a conservative substitution thereof, X5 = Y or E or a conservative substitution thereof, X6 = Absent or F or a conservative substitution thereof, X7 = Absent or D or a conservative substitution thereof, X8 = Absent or Y or a conservative substitution thereof, X9 = Absent or Y or a conservative substitution thereof, X10 = Absent or N or a conservative substitution thereof, X11 = Y or D or N or a conservative substitution thereof, X12 = G or A or D or a conservative substitution thereof, X13 = L or M or T or I or a conservative substitution thereof. |
| VH-CONSENSUS-21 TABLE 55 | SEQ ID NO: 50019 | VH1 | X1 X2 X3 X4 X5, wherein X1 = G or D or S or A or a conservative substitution thereof, X2 = Y or D or a conservative substitution thereof, X3 = Y or H or N or F or a conservative substitution thereof, X4 = M or L or I or a conservative substitution thereof, X5 = H or Q or a conservative substitution thereof. |
| | SEQ ID NO: 50020 | VH2 | Trp X1 X2 Pro X3 X4 X5 X6 X7 X8 X9 X10 Gln X11 Phe Gln X12, wherein X1 = I or V or a conservative substitution thereof, X2 = N or H or K or S or a conservative substitution thereof, X3 = N or K or a conservative substitution thereof, X4 = S or N or R or T or a conservative substitution thereof, X5 = G or N or D or a conservative substitution thereof, X6 = G or A or a conservative substitution thereof, X7 = T or S or a conservative substitution thereof, X8 = N or H or Q or I or a conservative substitution thereof, X9 = Y or S or F or a conservative substitution thereof, X10 = A or T or a conservative substitution thereof, X11 = K or R or N or E or S or a conservative substitution thereof, X12 = G or D or a conservative substitution thereof. |
| | SEQ ID NO: 50021 | VH3 | X1 X2 X3 X4 X5 X6 X7 X8 X9 X10 X11 X12 X13, wherein X1 = D or K or G or S or E or a conservative substitution thereof, X2 = G or F or A or K or V or a conservative substitution thereof, X3 = T or Absent or P or a conservative substitution thereof, X4 = S or G or Absent or T or a conservative substitution thereof, X5 = Absent or V or S or a conservative substitution thereof, X6 = Absent or A or a conservative substitution thereof, X7 = Absent or T or a conservative substitution thereof, X8 = Absent or W or a conservative substitution thereof, X9 = Absent or G or a conservative substitution thereof, X10 = S or Absent or V or Y or a conservative substitution thereof, X11 = F or |

FIGURE 55
(Continued)

| | | | |
|---|---|---|---|
| VH-CONSENSUS-22 TABLE 56 | SEQ ID NO: 50022 | VH1 | Absent or L or Y or a conservative substitution thereof, X12 = D or G or K or a conservative substitution thereof, X13 = Y or D or F or a conservative substitution thereof. |
| | SEQ ID NO: 50023 | VH2 | X1 X2 Gly X3 His, wherein X1 = S or N or a conservative substitution thereof, X2 = Y or F or H or a conservative substitution thereof, X3 = M or I or a conservative substitution thereof. |
| | | | X1 Ile X2 X3 X4 X5 X6 X7 X8 X9 X10 X11 X12 X13 Val X14 Gly, wherein X1 = V or I or a conservative substitution thereof, X2 = W or I or a conservative substitution thereof, X3 = H or Y or P or N or a conservative substitution thereof, X4 = D or S or E or a conservative substitution thereof, X5 = G or A or a conservative substitution thereof, X6 = S or G or a conservative substitution thereof, X7 = N or Y or a conservative substitution thereof, X8 = K or D or E or R or a conservative substitution thereof, X9 = Y or N or a conservative substitution thereof, X10 = Y or N or a conservative substitution thereof, X11 = A or V or G or a conservative substitution thereof, X12 = D or E or a conservative substitution thereof, X13 = S or A or a conservative substitution thereof, X14 = K or R or a conservative substitution thereof. |
| | SEQ ID NO: 50024 | VH3 | X1 X2 X3 X4 X5 X6 X7 X8 X9 X10 X11 X12 X13 X14 X15 X16 X17 Gly X18 Asp Val, wherein X1 = D or T or R or a conservative substitution thereof, X2 = L or R or Y or S or F or I or P or a conservative substitution thereof, X3 = S or R or T or a conservative substitution thereof, X4 = M or V or G or P or K or N or Y or a conservative substitution thereof, X5 = G or Y or Absent or S or a conservative substitution thereof, X6 = Absent or Y or S or W or a conservative substitution thereof, X7 = Absent or G or a conservative substitution thereof, X8 = Absent or S or a conservative substitution thereof, X9 = Absent or G or a conservative substitution thereof, X10 = Absent or S or a conservative substitution thereof, X11 = Absent or P or a conservative substitution thereof, X12 = Absent or P or a conservative substitution thereof, X13 = Absent or Y or a conservative substitution thereof, X14 = Absent or Y or a conservative substitution thereof, X15 = Absent or Y or a conservative substitution thereof, X16 = Absent or S or Y or a conservative substitution thereof, X17 = Absent or D or Y or G or a conservative substitution thereof, X18 = M or L or T or a conservative substitution thereof. |
| VH-CONSENSUS-23 TABLE 57 | SEQ ID NO: 50025 | VH1 | X1 X2 Gly X3 His, wherein X1 = D or N or S or a conservative substitution thereof, X2 = Y or P or a conservative substitution thereof, X3 = M or I or L or a conservative substitution thereof. |

FIGURE 55
(Continued)

| | | | |
|---|---|---|---|
| | SEQ ID NO: 50026 | VH2 | Val Ile Trp X1 X2 X3 X4 Asn X5 X6 Tyr X7 X8 Ser X9 Lys Gly, wherein X1 = Y or F or a conservative substitution thereof, X2 = D or E or I or V or a conservative substitution thereof, X3 = E or G or V or A or R or a conservative substitution thereof, X4 = S or N or T or G or a conservative substitution thereof, X5 = K or Q or T or N or a conservative substitution thereof, X6 = Y or H or K or a conservative substitution thereof, X7 = A or T or G or E or V or a conservative substitution thereof, X8 = D or G or a conservative substitution thereof, X9 = V or A or a conservative substitution thereof. |
| | SEQ ID NO: 50027 | VH3 | Glu X1 Gly X2 X3 X4 Asp X5, wherein X1 = V or I or M or K or T or a conservative substitution thereof, X2 = W or F or G or M or a conservative substitution thereof, X3 = L or T or S or Y or H or R or a conservative substitution thereof, X4 = D or E or S or F or N or a conservative substitution thereof, X5 = Y or C or a conservative substitution thereof. |
| VH-CONSENSUS-24 TABLE 58 | SEQ ID NO: 50028 | VH1 | X1 X2 X3 X4 Asn, wherein X1 = S or T or a conservative substitution thereof, X2 = Y or F or a conservative substitution thereof, X3 = S or T or G or R or a conservative substitution thereof, X4 = M or L or a conservative substitution thereof. |
| | SEQ ID NO: 50029 | VH2 | X1 Ile Ser X2 Ser X3 X4 X5 X6 X7 Tyr X8 Asp Ser X9 Lys X10, wherein X1 = S or A or C or L or a conservative substitution thereof, X2 = G or S or a conservative substitution thereof, X3 = S or G or T or a conservative substitution thereof, X4 = S or T or G or Y or a conservative substitution thereof, X5 = Y or H or a conservative substitution thereof, X6 = I or L or M or a conservative substitution thereof, X7 = Y or S or W or a conservative substitution thereof, X8 = A or G or P or V or a conservative substitution thereof, X9 = V or L or a conservative substitution thereof, X10 = G or A or a conservative substitution thereof. |
| | SEQ ID NO: 50030 | VH3 | X1 Arg X2 X3 X4 X5 X6 X7, wherein X1 = D or T or a conservative substitution thereof, X2 = G or Absent or S or Y or a conservative substitution thereof, X3 = Absent or G or a conservative substitution thereof, X4 = Absent or S or a conservative substitution thereof, X5 = Absent or F or S or a conservative substitution thereof, X6 = S or D or G or H or a conservative substitution thereof, X7 = S or L or Y or G or T or C or E or I or a conservative substitution thereof. |
| VH-CONSENSUS-25 TABLE 59 | SEQ ID NO: 50031 | VH1 | X1 Tyr X2 Met X3, wherein X1 = S or G or a conservative substitution thereof, X2 = A or V or a conservative substitution thereof, X3 = S or N or F or a conservative substitution thereof. |

FIGURE 55
(Continued)

| | | | |
|---|---|---|---|
| | SEQ ID NO: 50032 | VH2 | X1 Ile Ser X2 X3 Gly X4 X5 X6 X7 X8 Ala Asp Ser Val X9 Gly, wherein X1 = V or I or A or a conservative substitution thereof, X2 = G or R or a conservative substitution thereof, X3 = R or S or a conservative substitution thereof, X4 = G or V or I or T or a conservative substitution thereof, X5 = N or Y or S or T or a conservative substitution thereof, X6 = T or A or a conservative substitution thereof, X7 = F or Y or a conservative substitution thereof, X8 = Y or N or S or a conservative substitution thereof, X9 = K or R or a conservative substitution thereof. |
| | SEQ ID NO: 50033 | VH3 | Arg X1 Ala Val X2 Gly X3 X4 Ala X5 X6 X7, wherein X1 = I or L or M or V or a conservative substitution thereof, X2 = A or D or a conservative substitution thereof, X3 = S or N or Y or a conservative substitution thereof, X4 = E or D or a conservative substitution thereof, X5 = F or C or a conservative substitution thereof, X6 = D or A or H or a conservative substitution thereof, X7 = I or V or a conservative substitution thereof. |
| VH-CONSENSUS-26 TABLE 60 | SEQ ID NO: 50034 | VH1 | X1 X2 X3 Met X4, wherein X1 = S or N or a conservative substitution thereof, X2 = Y or C or a conservative substitution thereof, X3 = A or V or a conservative substitution thereof, X4 = S or N or a conservative substitution thereof. |
| | SEQ ID NO: 50035 | VH2 | X1 X2 Ser X3 X4 Gly X5 X6 X7 X8 Ala Asp Ser N9 Lys Gly, wherein X1 = A or T or S or a conservative substitution thereof, X2 = I or L or a conservative substitution thereof, X3 = G or R or V or a conservative substitution thereof, X4 = R or G or a conservative substitution thereof, X5 = S or N or a conservative substitution thereof, X6 = T or I or a conservative substitution thereof, X7 = F or Y or a conservative substitution thereof, X8 = H or Y or N or a conservative substitution thereof, X9 = V or E or M or a conservative substitution thereof. |
| | SEQ ID NO: 50036 | VH3 | X1 X2 Leu X3 X4 Tyr X5 X6 X7 X8 X9 X10 Asp Val, wherein X1 = G or W or a conservative substitution thereof, X2 = E or G or a conservative substitution thereof, X3 = E or Y or a conservative substitution thereof, X4 = D or S or N or a conservative substitution thereof, X5 = Absent or E or a conservative substitution thereof, X6 = Y or S or a conservative substitution thereof, X7 = F or Y or a conservative substitution thereof, X8 = Y or F or a conservative substitution thereof, X9 = G or A or a conservative substitution thereof, X10 = M or I or L or a conservative substitution thereof. |

FIGURE 55
(Continued)

| VH-CONSENSUS-27 TABLE 61 | SEQ ID NO: 50037 | VH1 | X1 Tyr X2 X3 X4, wherein X1 = S or G or D or R or H or T or N or a conservative substitution thereof, X2 = G or V or a conservative substitution thereof, X3 = M or L or a conservative substitution thereof, X4 = H or N or a conservative substitution thereof. |
|---|---|---|---|
| | SEQ ID NO: 50038 | VH2 | X1 X2 X3 X4 Asp Gly X5 X6 X7 X8 X9 X10 Asp Ser Val Lys X11, wherein X1 = V or L or F or I or D or a conservative substitution thereof, X2 = I or F or a conservative substitution thereof, X3 = W or R or a conservative substitution thereof, X4 = Y or F or a conservative substitution thereof, X5 = S or N or T or a conservative substitution thereof, X6 = N or E or D or K or a conservative substitution thereof, X7 = K or N or T or a conservative substitution thereof, X8 = Y or S or D or N or a conservative substitution thereof, X9 = Y or N or a conservative substitution thereof, X10 = A or V or a conservative substitution thereof, X11 = G or D or a conservative substitution thereof. |
| | SEQ ID NO: 50039 | VH3 | Asp X1 X2 X3 X4 X5 X6 X7 X8 X9 X10 X11 X12 X13 X14 X15 Tyr X16 X17 Asp Val, wherein X1 = R or D or W or N or a conservative substitution thereof, X2 = V or D or R or F or H or a conservative substitution thereof, X3 = Y or S or E or G or F or a conservative substitution thereof, X4 = C or G or E or a conservative substitution thereof, X5 = S or G or a conservative substitution thereof, X6 = S or G or R or N or a conservative substitution thereof, X7 = T or Absent or S or P or a conservative substitution thereof, X8 = S or P or Absent or T or a conservative substitution thereof, X9 = C or Absent or a conservative substitution thereof, X10 = Absent or S or H or L or Y or a conservative substitution thereof, X11 = P or Absent or S or Y or a conservative substitution thereof, X12 = Y or Absent or a conservative substitution thereof, X13 = Y or Absent or a conservative substitution thereof, X14 = Y or Absent or a conservative substitution thereof, X15 = Y or F or a conservative substitution thereof, X16 = G or A or a conservative substitution thereof, X17 = M or L or a conservative substitution thereof. |
| VH-CONSENSUS-28 TABLE 62 | SEQ ID NO: 50040 | VH1 | X1 Tyr X2 X3 Asn, wherein X1 = S or N or a conservative substitution thereof, X2 = S or T or K or N or R or a conservative substitution thereof, X3 = M or L or a conservative substitution thereof. |
| | SEQ ID NO: 50041 | VH2 | Ser X1 Ser X2 X3 X4 X5 X6 X7 X8 Tyr X9 Asp Ser Val Lys Gly, wherein X1 = I or T or a conservative substitution thereof, X2 = G or S or a conservative substitution thereof, X3 = S or G or N or T or a conservative substitution thereof, X4 = S or G or D or N or a conservative substitution thereof, X5 = S or T or a conservative substitution thereof, X6 = Y or F or D or L or N or S or a |

FIGURE 55
(Continued)

| | | | |
|---|---|---|---|
| | SEQ ID NO: 50042 | VH3 | conservative substitution thereof, X7 = I or M or T or a conservative substitution thereof, X8 = Y or N or a conservative substitution thereof, X9 = A or Y or a conservative substitution thereof. |
| | | | Val X1 X2 X3 Asp X4, wherein X1 = A or N or S or a conservative substitution thereof, X2 = S or A or G or T or L or H or N or a conservative substitution thereof, X3 = F or L or N or a conservative substitution thereof, X4 = Y or C or S or a conservative substitution thereof. |
| VH-CONSENSUS-29 TABLE 63 | SEQ ID NO: 50230 | VH1 | Ser X1 X2 Tyr X3 Trp X4, wherein X1 = G or V or a conservative substitution thereof, X2 = D or V or G or S or a conservative substitution thereof, X3 = Y or H or a conservative substitution thereof, X4 = N or S or a conservative substitution thereof. |
| | SEQ ID NO: 50231 | VH2 | X1 X2 X3 X4 Ser Gly Ser Thr Tyr X5 Asn Pro Ser Leu X6 Ser, wherein X1 = Y or N or F or a conservative substitution thereof, X2 = I or L or a conservative substitution thereof, X3 = P or Y or H or a conservative substitution thereof, X4 = Y or H or a conservative substitution thereof, X5 = Y or N or a conservative substitution thereof, X6 = K or R or a conservative substitution thereof. |
| | SEQ ID NO: 50232 | VH3 | Gly Asp Tyr Asp Ser Gly Ser Tyr His X1 Tyr X2 Gly X3 Asp Val, wherein X1 = Y or F or H or a conservative substitution thereof, X2 = Y or H or a conservative substitution thereof, X3 = M or L or a conservative substitution thereof. |
| VH-CONSENSUS-30 TABLE 64 | SEQ ID NO: 50043 | VH1 | X1 X2 X3 Met Ser, wherein X1 = S or N or T or a conservative substitution thereof, X2 = Y or H or a conservative substitution thereof, X3 = A or P or V or a conservative substitution thereof. |
| | SEQ ID NO: 50044 | VH2 | X1 Ile Ser Gly X2 Gly X3 X4 X5 Tyr Tyr Ala Asp Ser Val Lys Gly, wherein X1 = V or A or I or a conservative substitution thereof, X2 = Q or S or a conservative substitution thereof, X3 = S or G or T or a conservative substitution thereof, X4 = S or T or a conservative substitution thereof, X5 = T or A or a conservative substitution thereof. |
| | SEQ ID NO: 50045 | VH3 | X1 X2 Gly X3 X4 X5 X6 X7 X8 X9 X10 Gly Met Asp, wherein X1 = W or A or a conservative substitution thereof, X2 = R or G or a conservative substitution thereof, X3 = N or T or a conservative substitution thereof, X4 = P or T or a conservative substitution thereof, X5 = T or G or a conservative substitution thereof, X6 = Absent or S or a conservative substitution thereof, X7 = Absent or Y or a conservative substitution thereof, X8 = Absent or Y or a conservative substitution thereof, X9 = D or Y or a conservative substitution thereof. |

FIGURE 55
(Continued)

| | | | |
|---|---|---|---|
| VH-CONSENSUS-31 TABLE 65 | SEQ ID NO: 50253 | VH1 | conservative substitution thereof, X10 = Y or N or S or a conservative substitution thereof. X1 Tyr Gly X2 His, wherein X1 = S or N or T or a conservative substitution thereof, X2 = M or L or a conservative substitution thereof. |
| | SEQ ID NO: 50254 | VH2 | X1 X2 Trp Tyr Asp Gly X3 X4 Lys Tyr Tyr X5 Asp Ser Val Lys Gly, wherein X1 = I or V or A or a conservative substitution thereof, X2 = I or M or a conservative substitution thereof, X3 = S or T or a conservative substitution thereof, X4 = N or Y or S or a conservative substitution thereof, X5 = A or G or T or V or a conservative substitution thereof. |
| | SEQ ID NO: 50255 | VH3 | X1 X2 X3 X4 X5 X6 X7 X8 X9 X10 X11 X12, wherein X1 = D or E or a conservative substitution thereof, X2 = H or R or Q or A or G or T or Y or a conservative substitution thereof, X3 = Y or G or F or H or a conservative substitution thereof, X4 = D or I or F or a conservative substitution thereof, X5 = F or V or L or a conservative substitution thereof, X6 = W or G or Absent or a conservative substitution thereof, X7 = S or A or Absent or a conservative substitution thereof, X8 = G or T or E or a conservative substitution thereof, X9 = H or Y or W or F or a conservative substitution thereof, X10 = F or L or S or a conservative substitution thereof, X11 = D or A or C or G or a conservative substitution thereof, X12 = Y or F or S or a conservative substitution thereof. |
| VH-CONSENSUS-32 TABLE 66 | SEQ ID NO: 50233 | VH1 | X1 X2 X3 Trp Ser ( ) wherein X1 = G or V or P or A or D or Y or a conservative substitution thereof, X2 = Y or C or S or F or a conservative substitution thereof, X3 = Y or F or a conservative substitution thereof. |
| | SEQ ID NO: 50234 | VH2 | Glu X1 Asn X2 Ser Gly X3 X4 X5 X6 Asn Pro Ser Leu Lys Ser, wherein X1 = I or S or V or a conservative substitution thereof, X2 = H or I or Q or a conservative substitution thereof, X3 = R or S or a conservative substitution thereof, X4 = T or A or S or a conservative substitution thereof, X5 = N or T or a conservative substitution thereof, X6 = Y or F or a conservative substitution thereof. |
| | SEQ ID NO: 50235 | VH3 | Asp Tyr Gly Leu Asp Tyr. |
| VH-CONSENSUS-33 TABLE 67 | SEQ ID NO: 50046 | VH1 | X1 Ser X2 X3 Tyr Trp Gly, wherein X1 = R or G or a conservative substitution thereof, X2 = S or N or a conservative substitution thereof, X3 = Y or S or a conservative substitution thereof. |
| | SEQ ID NO: 50047 | VH2 | X1 Ile Tyr Tyr Ser Gly X2 X3 X4 X5 X6 Pro Ser Leu Lys Ser, wherein X1 = N or S or a conservative substitution thereof, X2 = S or Y or A or T or I or a conservative |

FIGURE 55
(Continued)

| | | | |
|---|---|---|---|
| | SEQ ID NO: 50048 | VH3 | substitution thereof, X3 = T or A or P or S or a conservative substitution thereof, X4 = Y or Q or S or A or N or a conservative substitution thereof, X5 = Y or C or H or a conservative substitution thereof, X6 = N or I or T or a conservative substitution thereof. |
| | SEQ ID NO: 50048 | VH3 | X1 Ser X2 Ser Trp Ser X3 Asp X4, wherein X1 = H or L or a conservative substitution thereof, X2 = S or T or G or a conservative substitution thereof, X3 = L or F or I or V or a conservative substitution thereof, X4 = Y or N or C or D or F or a conservative substitution thereof. |
| VH-CONSENSUS-34 TABLE 68 | SEQ ID NO: 50049 | VH1 | X1 X2 X3 X4 X5, wherein X1 = G or D or a conservative substitution thereof, X2 = Y or H or a conservative substitution thereof, X3 = Y or F or a conservative substitution thereof, X4 = I or M or a conservative substitution thereof, X5 = H or N or a conservative substitution thereof. |
| | SEQ ID NO: 50050 | VH2 | Trp Ile Asn X1 X2 X3 X4 X5 Thr Asn Tyr X6 X7 Lys Phe Gln X8, wherein X1 = P or S or a conservative substitution thereof, X2 = N or K or a conservative substitution thereof, X3 = S or N or a conservative substitution thereof, X4 = G or D or a conservative substitution thereof, X5 = G or D or a conservative substitution thereof, X6 = A or E or a conservative substitution thereof, X7 = Q or E or a conservative substitution thereof, X8 = G or D or a conservative substitution thereof. |
| | SEQ ID NO: 50051 | VH3 | X1 X2 X3 X4 X5 X6 X7 X8 X9 X10 X11 X12 X13 X14 X15, wherein X1 = G or D or a conservative substitution thereof, X2 = Y or G or T or F or a conservative substitution thereof, X3 = S or Y or D or R or a conservative substitution thereof, X4 = Y or S or a conservative substitution thereof, X5 = G or Absent or S or a conservative substitution thereof, X6 = Y or S or Absent or a conservative substitution thereof, X7 = Absent or G or a conservative substitution thereof, X8 = Absent or S or a conservative substitution thereof, X9 = Absent or Y or a conservative substitution thereof, X10 = Absent or Y or F or H or a conservative substitution thereof, X11 = N or Absent or D or a conservative substitution thereof, X12 = W or Absent or D or E or a conservative substitution thereof, X13 = F or L or a conservative substitution thereof, X14 = D or A or a conservative substitution thereof, X15 = P or S or a conservative substitution thereof. |
| VH-CONSENSUS-35 TABLE 69 | SEQ ID NO: 50052 | VH1 | X1 X2 Gly Met His, wherein X1 = H or N or a conservative substitution thereof, X2 = Y or S or a conservative substitution thereof. |
| | SEQ ID NO: 50053 | VH2 | X1 Ile X2 Tyr Asp Gly Ser X3 X4 X5 Tyr Ala Asp Ser Val Lys Gly, wherein X1 = V or I or a conservative substitution thereof, X2 = W or Y or a conservative substitution thereof. |

FIGURE 55
(Continued)

| | | | |
|---|---|---|---|
| | SEQ ID NO: 50054 | VH3 | X3 = N or Y or a conservative substitution thereof, X4 = K or E or a conservative substitution thereof, X5 = Y or C or N or a conservative substitution thereof. |
| | | | X1 X2 X3 X4 X5 X6 X7 X8 X9 X10 X11 X12 X13 X14 Gly X15 Asp Val, wherein X1 = G or D or a conservative substitution thereof, X2 = D or R or a conservative substitution thereof, X3 = W or H or a conservative substitution thereof, X4 = N or Y or a conservative substitution thereof, X5 = P or D or a conservative substitution thereof, X6 = Absent or F or a conservative substitution thereof, X7 = Absent or H or a conservative substitution thereof, X8 = Absent or V or a conservative substitution thereof, X9 = Absent or P or a conservative substitution thereof, X10 = Absent or Y or a conservative substitution thereof, X11 = Absent or Y or a conservative substitution thereof, X12 = Absent or Y or a conservative substitution thereof, X13 = Absent or Y or a conservative substitution thereof, X14 = E or Y or a conservative substitution thereof, X15 = M or L or a conservative substitution thereof. |
| VH-CONSENSUS-36 TABLE 70 | SEQ ID NO: 50055 | VH1 | Ser X1 Ala Met X2, wherein X1 = Y or S or a conservative substitution thereof, X2 = S or T or N or a conservative substitution thereof. |
| | SEQ ID NO: 50056 | VH2 | X1 Ile X2 Gly X3 Gly X4 X5 X6 X7 Tyr Ala Asp Ser Val Lys Gly, wherein X1 = A or V or a conservative substitution thereof, X2 = S or I or a conservative substitution thereof, X3 = S or R or N or F or a conservative substitution thereof, X4 = G or S or a conservative substitution thereof, X5 = N or R or S or a conservative substitution thereof, X6 = T or A or a conservative substitution thereof, X7 = F or Y or a conservative substitution thereof. |
| | SEQ ID NO: 50057 | VH3 | X1 X2 X3 X4 X5 X6 X7 X8 X9 X10 X11 X12 Phe Asp Tyr, wherein X1 = K or D or R or a conservative substitution thereof, X2 = D or Y or H or M or R or a conservative substitution thereof, X3 = Y or G or N or a conservative substitution thereof, X4 = D or I or R or Y or a conservative substitution thereof, X5 = Y or Absent or S or V or a conservative substitution thereof, X6 = V or Absent or G or R or S or a conservative substitution thereof, X7 = W or Absent or I or a conservative substitution thereof, X8 = Absent or A or a conservative substitution thereof, X9 = G or Absent or V or a conservative substitution thereof, X10 = S or Absent or A or T or Y or a conservative substitution thereof, X11 = P or Absent or G or I or a conservative substitution thereof, X12 = Y or F or T or a conservative substitution thereof. |

FIGURE 55
(Continued)

| VH-CONSENSUS-37 TABLE 71 | SEQ ID NO: 50058 | VH1 | X1 X2 X3 X4 His, wherein X1 = G or D or a conservative substitution thereof, X2 = Y or H or a conservative substitution thereof, X3 = Y or C or a conservative substitution thereof, X4 = M or I or a conservative substitution thereof. |
|---|---|---|---|
| | SEQ ID NO: 50059 | VH2 | X1 Ile X2 X3 X4 Ser Gly X5 X6 X7 X8 X9 Gln Lys Phe Gln X10, wherein X1 = W or S or a conservative substitution thereof, X2 = N or Y or a conservative substitution thereof, X3 = P or R or a conservative substitution thereof, X4 = N or K or a conservative substitution thereof, X5 = G or A or a conservative substitution thereof, X6 = T or A or a conservative substitution thereof, X7 = N or D or a conservative substitution thereof, X8 = Y or N or S or a conservative substitution thereof, X9 = A or G or V or a conservative substitution thereof, X10 = G or D or V or a conservative substitution thereof. |
| | SEQ ID NO: 50060 | VH3 | X1 X2 Tyr X3 Gly Ser Gly X4 Tyr X5 Asn X6 Phe Asp Tyr, wherein X1 = S or A or V or T or a conservative substitution thereof, X2 = Y or F or N or a conservative substitution thereof, X3 = Y or H or a conservative substitution thereof, X4 = S or T or a conservative substitution thereof, X5 = Y or H or a conservative substitution thereof, X6 = E or G or D or a conservative substitution thereof. |
| VH-CONSENSUS-38 TABLE 72 | SEQ ID NO: 50061 | VH1 | Gly Tyr Tyr X1 His, wherein X1 = I or T or a conservative substitution thereof. |
| | SEQ ID NO: 50062 | VH2 | Trp Ile Asn Pro Tyr Ser Gly X1 Thr X2 X3 Ala Gln Lys Phe Gln Gly, wherein X1 = D or G or a conservative substitution thereof, X2 = N or K or a conservative substitution thereof, X3 = Y or S or a conservative substitution thereof. |
| | SEQ ID NO: 50236 | VH3 | Asp Trp Gly Gly Tyr Ser Ser Tyr Tyr X1 Gly Met Asp Val, wherein X1 = Y or F or a conservative substitution thereof. |
| VH-CONSENSUS-39 TABLE 73 | SEQ ID NO: 50063 | VH1 | X1 X2 X3 Met X4, wherein X1 = S or T or a conservative substitution thereof, X2 = Y or F or a conservative substitution thereof, X3 = S or T or N or G or a conservative substitution thereof, X4 = N or S or I or a conservative substitution thereof. |
| | SEQ ID NO: 50064 | VH2 | Ser Ile Ser X1 X2 X3 X4 Tyr X5 X6 Tyr X7 Asp Ser Val Lys Gly, wherein X1 = G or S or a conservative substitution thereof, X2 = S or T or a conservative substitution thereof, X3 = S or I or N or a conservative substitution thereof, X4 = N or S or I or a conservative substitution thereof, X5 = S or N or T or Y or a conservative substitution thereof, X5 |

FIGURE 55
(Continued)

| | | | |
|---|---|---|---|
| VH-CONSENSUS-40 TABLE 74 | SEQ ID NO: 50065 | VH3 | = I or M or S or a conservative substitution thereof, X6 = Y or N or a conservative substitution thereof, X7 = A or T or a conservative substitution thereof. |
| | SEQ ID NO: 50066 | VH1 | X1 Tyr Gly Met His, wherein X1 = T or S or a conservative substitution thereof. |
| | SEQ ID NO: 50067 | VH2 | X1 Ile Trp Tyr Asp Gly X2 Asn Lys Tyr Tyr Ala Asp Ser Val X3 Gly, wherein X1 = I or V or a conservative substitution thereof, X2 = T or S or a conservative substitution thereof, X3 = K or R or a conservative substitution thereof. |
| | SEQ ID NO: 50068 | VH3 | Asp Pro Leu Arg Gly Tyr Asn Asp Pro Val X1 Asp Tyr, wherein X1 = M or L or a conservative substitution thereof. |
| VH-CONSENSUS-41 TABLE 75 | SEQ ID NO: 50069 | VH1 | X1 Tyr Ala Met X2, wherein X1 = S or N or a conservative substitution thereof, X2 = S or N or T or a conservative substitution thereof. |
| | SEQ ID NO: 50070 | VH2 | Ala Ile Ser Gly X1 Gly X2 Asn Thr Phe Tyr Ala Asp Ser Val Lys Gly, wherein X1 = R or S or a conservative substitution thereof, X2 = G or K or a conservative substitution thereof. |
| | SEQ ID NO: 50071 | VH3 | Arg Val Thr Asp Tyr Gly Gly Asn Asp Trp Phe Asp Pro. |
| VH-CONSENSUS-42 TABLE 76 | SEQ ID NO: 50072 | VH1 | X1 Tyr Gly Met His, wherein X1 = T or S or a conservative substitution thereof. |
| | SEQ ID NO: 50073 | VH2 | Val X1 Trp Tyr X2 Gly X3 X4 X5 X6 X7 X8 Asp Ser Val X9 Gly, wherein X1 = I or V or a conservative substitution thereof, X2 = G or D or a conservative substitution thereof, X3 = S or N or a conservative substitution thereof, X4 = N or D or S or a conservative substitution thereof, X5 = K or T or a conservative substitution thereof, X6 = D or Y or S or a conservative substitution thereof, X7 = Y or F or a conservative substitution thereof, X8 = A or V or a conservative substitution thereof, X9 = K or R or T or a conservative substitution thereof. |
| | SEQ ID NO: 50074 | VH3 | Asp Arg X1 X2 Cys Ser Gly X3 X4 Cys Pro Tyr Tyr Tyr Tyr Tyr Gly Met Asp Val, wherein X1 = D or V or a conservative substitution thereof, X2 = Y or F or a conservative substitution thereof, X3 = G or T or a conservative substitution thereof, X4 = S or T or N or a conservative substitution thereof. |

FIGURE 55
(Continued)

| VH-CONSENSUS-43 TABLE 77 | SEQ ID NO: 50075 | VH1 | Arg Ser Ser Tyr Tyr Trp Gly. |
|---|---|---|---|
| | SEQ ID NO: 50076 | VH2 | Asn Ile Tyr Tyr X1 Gly X2 X3 Tyr X4 Asn Pro Ser X5 Lys X6, wherein X1 = S or G or a conservative substitution thereof, X2 = S or T or N or a conservative substitution thereof, X3 = T or A or a conservative substitution thereof, X4 = Y or N or D or H or T or a conservative substitution thereof, X5 = L or V or a conservative substitution thereof, X6 = S or G or a conservative substitution thereof. |
| | SEQ ID NO: 50077 | VH3 | His Gly Lys Asp Trp Gly Leu Asp X1, wherein X1 = Y or F or N or a conservative substitution thereof. |
| VH-CONSENSUS-44 TABLE 78 | SEQ ID NO: 50078 | VH1 | Gly Tyr Tyr X1 His, wherein X1 = M or I or a conservative substitution thereof. |
| | SEQ ID NO: 50079 | VH2 | Trp Ile X1 Pro X2 Ser Gly Gly Thr Asn X3 X4 Gln Lys Phe Gln Gly, wherein X1 = K or N or a conservative substitution thereof, X2 = N or K or a conservative substitution thereof, X3 = Q or S or H or N or Y or a conservative substitution thereof, X4 = A or V or a conservative substitution thereof. |
| | SEQ ID NO: 50080 | VH3 | Ala Pro Gly X1 X2 X3 X4 Gly X5 Trp Gly X6 Phe Asp Tyr, wherein X1 = T or K or I or a conservative substitution thereof, X2 = A or V or a conservative substitution thereof, X3 = A or P or a conservative substitution thereof, X4 = A or T or a conservative substitution thereof, X5 = T or S or a conservative substitution thereof, X6 = Y or F or C or a conservative substitution thereof. |
| VH-CONSENSUS-45 TABLE 79 | SEQ ID NO: 50081 | VH1 | Thr X1 Gly Val Gly Val Gly, wherein X1 = G or S or a conservative substitution thereof. |
| | SEQ ID NO: 50082 | VH2 | X1 Ile Tyr Trp X2 Asp Asp X3 Arg Tyr Ser Pro Ser Leu X4 Ser, wherein X1 = L or F or a conservative substitution thereof, X2 = D or H or N or K or S or a conservative substitution thereof, X3 = K or E or a conservative substitution thereof, X4 = K or R or a conservative substitution thereof. |
| | SEQ ID NO: 50083 | VH3 | X1 X2 Ala Val X3 X4 Asp Tyr, wherein X1 = L or I or A or a conservative substitution thereof, X2 = I or V or A or a conservative substitution thereof, X3 = A or S or a conservative substitution thereof, X4 = F or C or a conservative substitution thereof. |
| VH-CONSENSUS-46 TABLE 80 | SEQ ID NO: 50084 | VH1 | X1 Tyr Gly Met His ( ) wherein X1 = S or N or T or a conservative substitution thereof. |

FIGURE 55
(Continued)

| | | | |
|---|---|---|---|
| | SEQ ID NO: 50085 | VH2 | X1 Ile Trp Tyr Asp Gly Ser X2 Lys Tyr Tyr X3 Asp Ser Val Lys Gly, wherein X1 = I or V or a conservative substitution thereof, X2 = Y or N or a conservative substitution thereof, X3 = A or V or a conservative substitution thereof. |
| | SEQ ID NO: 50086 | VH3 | Glu X1 Tyr Asp Phe Trp Ser Gly X2 X3 X4 X5, wherein X1 = A or G or R or N or a conservative substitution thereof, X2 = Y or F or H or a conservative substitution thereof, X3 = F or L or Y or W or a conservative substitution thereof, X4 = D or G or a conservative substitution thereof, X5 = Y or S or a conservative substitution thereof. |
| VH-CONSENSUS-47 TABLE 81 | SEQ ID NO: 50087 | VH1 | Ser Tyr Gly X1 His, wherein X1 = M or L or a conservative substitution thereof. |
| | SEQ ID NO: 50088 | VH2 | Val Ile Trp Tyr Asp Gly Ser Asn Lys X1 Tyr X2 Asp Ser Val Lys Gly, wherein X1 = Y or N or a conservative substitution thereof, X2 = A or E or a conservative substitution thereof. |
| | SEQ ID NO: 50089 | VH3 | X1 X2 X3 Tyr X4 X5 X6 X7 X8 X9 X10 X11 X12 Gly Met Asp Val, wherein X1 = D or W or a conservative substitution thereof, X2 = R or G or Y or a conservative substitution thereof, X3 = D or S or Y or a conservative substitution thereof, X4 = G or Y or a conservative substitution thereof, X5 = D or Y or a conservative substitution thereof, X6 = Absent or P or a conservative substitution thereof, X7 = Absent or P or a conservative substitution thereof, X8 = Absent or Y or a conservative substitution thereof, X9 = Absent or Y or a conservative substitution thereof, X10 = Absent or Y or a conservative substitution thereof, X11 = Absent or Y or a conservative substitution thereof, X12 = Y or D or a conservative substitution thereof. |
| VH-CONSENSUS-48 TABLE 82 | | VH1 | X1 X2 X3 Met X4 (SEQ ID NO: 50090) wherein X1 = S or N or T or a conservative substitution thereof, X2 = Y or S or a conservative substitution thereof, X3 = A or V or a conservative substitution thereof, X4 = S or T or N or a conservative substitution thereof. |
| | | VH2 | X1 X2 X3 Gly X4 Gly X5 X6 Thr X7 X8 X9 Asp Ser Val X10 Gly (SEQ ID NO: 50091) wherein X1 = A or G or a conservative substitution thereof, X2 = I or S or V or a conservative substitution thereof, X3 = S or V or a conservative substitution thereof, X4 = S or R or a conservative substitution thereof, X5 = G or A or S or V or a conservative substitution thereof, X6 = N or R or K or a conservative substitution thereof, X7 = F or Y or a conservative substitution thereof, X8 = Y or N or a |

FIGURE 55
(Continued)

| | | |
|---|---|---|
| | VH3 | conservative substitution thereof, X9 = A or T or a conservative substitution thereof, X10 = K or T or a conservative substitution thereof.<br>X1 X2 X3 X4 X5 X6 X7 X8 Gly X9 Asp Val (SEQ ID NO: 50092) wherein X1 = L or D or E or a conservative substitution thereof, X2 = G or R or a conservative substitution thereof, X3 = K or G or I or a conservative substitution thereof, X4 = D or Q or Y or a conservative substitution thereof, X5 = Y or W or a conservative substitution thereof, X6 = Y or H or L or a conservative substitution thereof, X7 = Y or Absent or I or L or a conservative substitution thereof, X8 = Y or G or a conservative substitution thereof, X9 = M or V or a conservative substitution thereof. |
| VH-CONSENSUS-49 TABLE 83 | VH1 | Ser Tyr X1 Met X2 (SEQ ID NO: 50093) wherein X1 = V or A or a conservative substitution thereof, X2 = S or N or a conservative substitution thereof. |
| | VH2 | X1 X2 Ser Gly Ser Gly X3 X4 Thr X5 Tyr Ala Asp Ser Val X6 X7 (SEQ ID NO: 50094) wherein X1 = A or G or T or S or a conservative substitution thereof, X2 = M or I or T or a conservative substitution thereof, X3 = G or N or V or a conservative substitution thereof, X4 = R or N or W or a conservative substitution thereof, X5 = Y or F or N or a conservative substitution thereof, X6 = K or N or a conservative substitution thereof, X7 = G or D or a conservative substitution thereof. |
| | VH3 | X1 X2 X3 X4 X5 X6 X7 X8 X9 X10 X11 X12 (SEQ ID NO: 50095) wherein X1 = L or V or Y or F or a conservative substitution thereof, X2 = T or E or F or G or a conservative substitution thereof, X3 = A or G or L or W or Absent or F or a conservative substitution thereof, X4 = Absent or G or M or a conservative substitution thereof, X5 = Absent or V or a conservative substitution thereof, X6 = Absent or G or a conservative substitution thereof, X7 = Absent or A or a conservative substitution thereof, X8 = Absent or G or a conservative substitution thereof, X9 = Absent or I or F or a conservative substitution thereof, X10 = F or N or Absent or a conservative substitution thereof, X11 = D or G or I or a conservative substitution thereof, X12 = Y or D or a conservative substitution thereof. |
| VH-CONSENSUS-50 TABLE 84 | VH1 | X1 Tyr Gly X2 His (SEQ ID NO: 50096) wherein X1 = S or Y or a conservative substitution thereof, X2 = M or L or a conservative substitution thereof. |
| | VH2 | X1 Ile Ser Tyr X2 Gly X3 Asn X4 X5 X6 Ala Asp Ser Val Lys Gly (SEQ ID NO: 50097) wherein X1 = I or V or a conservative substitution thereof, X2 = A or G or D or S or V or a conservative substitution thereof, X3 = S or I or N or R or T or a conservative substitution thereof, X4 = K or N |

FIGURE 55 (Continued)

| | | |
|---|---|---|
| | VH3 | or Q or a conservative substitution thereof, X5 = Y or S or D or H or a conservative substitution thereof, X6 = Y or S or a conservative substitution thereof. |
| | VH3 | X1 X2 X3 X4 X5 X6 X7 X8 X9 X10 X11 X12 X13 X14 X15 Tyr Gly Met Asp Val (SEQ ID NO: 50098) wherein X1 = R or E or a conservative substitution thereof, X2 = G or D or a conservative substitution thereof, X3 = Y or R or a conservative substitution thereof, X4 = S or Y or a conservative substitution thereof, X5 = Y or C or a conservative substitution thereof, X6 = G or S or a conservative substitution thereof, X7 = Absent or G or a conservative substitution thereof, X8 = Absent or T or a conservative substitution thereof, X9 = Absent or S or a conservative substitution thereof, X10 = Absent or C or a conservative substitution thereof, X11 = Absent or P or a conservative substitution thereof, X12 = Absent or Y or a conservative substitution thereof, X13 = Absent or Y or a conservative substitution thereof, X14 = Absent or Y or a conservative substitution thereof, X15 = G or Y or a conservative substitution thereof. |
| VH-CONSENSUS-51 TABLE 85 | VH1 | X1 X2 X3 Met X4 (SEQ ID NO: 50099) wherein X1 = D or S or a conservative substitution thereof, X2 = Y or G or a conservative substitution thereof, X3 = V or G or a conservative substitution thereof, X4 = H or Q or a conservative substitution thereof. |
| | VH2 | X1 Ile Trp Tyr Asp Gly Ser Asn Lys Tyr Ala Asp Ser Val Lys X2 (SEQ ID NO: 50100) wherein X1 = V or I or a conservative substitution thereof, X2 = G or V or a conservative substitution thereof. |
| | VH3 | Glu X1 Tyr X2 Ser Gly Trp X3 Asp Tyr Gly X4 Asp Val (SEQ ID NO: 50101) wherein X1 = P or R or a conservative substitution thereof, X2 = T or N or a conservative substitution thereof, X3 = Y or H or a conservative substitution thereof, X4 = M or L or a conservative substitution thereof. |
| VH-CONSENSUS-52 TABLE 86 | VH1 | Ser Tyr Gly X1 Ser (SEQ ID NO: 50102) wherein X4 = I or F or V or a conservative substitution thereof. |
| | VH2 | Trp Ile Ser Ala Tyr Asn Gly Asn X1 Lys X2 Ala Gln X3 X4 Gln Gly (SEQ ID NO: 50103) wherein X1 = T or R or a conservative substitution thereof, X2 = Y or N or E or F or a conservative substitution thereof, X3 = K or R or a conservative substitution thereof, X4 = L or F or a conservative substitution thereof. |
| | VH3 | His Asp Phe Trp Ser Gly Tyr Tyr Lys Gly Met Asp Val (SEQ ID NO: 50227). |

FIGURE 55
(Continued)

| | | |
|---|---|---|
| VH-CONSENSUS-53 TABLE 87 | VH1 | X1 Ser X2 Ala Met Ser (SEQ ID NO: 50104) wherein X1 = S or R or a conservative substitution thereof, X2 = Y or S or a conservative substitution thereof. |
| | VH2 | X1 Ile Ser Gly X2 Gly X3 X4 Thr Phe X5 X6 Asp Ser Val Lys Gly (SEQ ID NO: 50105) wherein X1 = A or V or S or a conservative substitution thereof, X2 = R or S or a conservative substitution thereof, X3 = G or I or V or a conservative substitution thereof, X4 = N or S or a conservative substitution thereof, X5 = D or Y or a conservative substitution thereof, X6 = A or T or a conservative substitution thereof. |
| | VH3 | X1 X2 Ser X3 X4 X5 Phe Asp Tyr (SEQ ID NO: 50106) wherein X1 = E or S or a conservative substitution thereof, X2 = R or N or a conservative substitution thereof, X3 = G or S or a conservative substitution thereof, X4 = S or G or a conservative substitution thereof, X5 = Y or W or a conservative substitution thereof. |
| VH-CONSENSUS-54 TABLE 88 | VH1 | X1 Tyr X2 Met His (SEQ ID NO: 50107) wherein X1 = S or N or Y or H or a conservative substitution thereof, X2 = V or G or a conservative substitution thereof. |
| | VH2 | X1 Ile Trp X2 Asp Gly X3 X4 X5 Tyr Tyr X6 Asp Ser Val Lys Gly (SEQ ID NO: 50108) wherein X1 = V or L or a conservative substitution thereof, X2 = H or Y or a conservative substitution thereof, X3 = S or T or a conservative substitution thereof, X4 = N or D or a conservative substitution thereof, X5 = K or A or a conservative substitution thereof, X6 = A or V or G or a conservative substitution thereof. |
| | VH3 | Glu Asn Ser Ser X1 Tyr Phe Asp Tyr Trp Gly Gln Gly Thr Leu Val Thr Val Ser Ser (SEQ ID NO: 50109) wherein X1 = Y or F or a conservative substitution thereof. |
| VH-CONSENSUS-55 TABLE 89 | VH1 | Thr Ser Gly Val Gly Val Gly (SEQ ID NO: 50110). |
| | VH2 | Leu Ile Asn Trp Asn Asp Lys Arg X1 Ser Pro Ser Leu Lys Ser (SEQ ID NO: 50111) wherein X1 = Y or F or a conservative substitution thereof. |
| | VH3 | Lys X1 Thr Trp Val Ala Phe Asp Ile (SEQ ID NO: 50112) wherein X1 = A or T or a conservative substitution thereof. |
| VH-CONSENSUS-56 TABLE 90 | VH1 | Ser Tyr X1 X2 X3 (SEQ ID NO: 50113) wherein X1 = V or A or a conservative substitution thereof, X2 = M or I or L or a conservative substitution thereof, X3 = N or S or R or a conservative substitution thereof. |
| | VH2 | X1 X2 Ser Gly Ser Gly X3 X4 Thr Tyr X5 Asp Ser Val Lys Gly (SEQ ID NO: 50114) wherein X1 = A or D or a conservative substitution thereof, X2 = I or M or a conservative substitution thereof, X3 = G or D or V or a conservative substitution thereof, X4 = R or S or F or T or a conservative substitution thereof. |

FIGURE 55
(Continued)

| | | |
|---|---|---|
| | VH3 | conservative substitution thereof, X5 = A or V or a conservative substitution thereof. Thr X1 X2 X3 X4 X5 (SEQ ID NO: 50115) wherein X1 = A or G or S or T or Y or a conservative substitution thereof, X2 = T or V or Absent or H or L or G or a conservative substitution thereof, X3 = F or Absent or K or a conservative substitution thereof, X4 = D or Absent or a conservative substitution thereof, X5 = Y or L or a conservative substitution thereof. |
| VH-CONSENSUS-57 TABLE 91 | VH1 | Ser X1 Ala Met X2 (SEQ ID NO: 50116) wherein X1 = Y or F or a conservative substitution thereof, X2 = S or N or a conservative substitution thereof. |
| | VH2 | X1 X2 Ser Gly X3 Gly X4 X5 Thr X6 Tyr Ala Asp Ser Val Lys Gly (SEQ ID NO: 50117) wherein X1 = V or A or I or a conservative substitution thereof, X2 = I or L or a conservative substitution thereof, X3 = R or S or G or a conservative substitution thereof, X4 = G or S or K or a conservative substitution thereof, X5 = T or N or S or a conservative substitution thereof, X6 = F or Y or a conservative substitution thereof. |
| | VH3 | Lys Arg Thr X1 X2 Asp X3 Phe Asp X4 (SEQ ID NO: 50118) wherein X1 = P or G or a conservative substitution thereof, X2 = S or D or E or a conservative substitution thereof, X3 = V or A or a conservative substitution thereof, X4 = I or Y or a conservative substitution thereof. |
| VH-CONSENSUS-58 TABLE 92 | VH1 | X1 X2 X3 Met His (SEQ ID NO: 50237) wherein X1 = S or N or T or a conservative substitution thereof, X2 = Y or F or a conservative substitution thereof, X3 = G or D or N or a conservative substitution thereof. |
| | VH2 | X1 Ile Trp X2 Asp Gly X3 X4 X5 Tyr X6 X7 Asp Ser Val Lys Gly (SEQ ID NO: 50238) wherein X1 = V or H or a conservative substitution thereof, X2 = Y or H or a conservative substitution thereof, X3 = S or R or a conservative substitution thereof, X4 = N or D or H or a conservative substitution thereof, X5 = K or R or a conservative substitution thereof, X6 = Y or C or S or a conservative substitution thereof, X7 = A or E or T or a conservative substitution thereof. |
| | VH3 | Asp X1 X2 X3 X4 X5 X6 X7 X8 X9 Asp X10 (SEQ ID NO: 50239) wherein X1 = R or D or H or a conservative substitution thereof, X2 = P or S or A or a conservative substitution thereof, X3 = I or R or Y or a conservative substitution thereof, X4 = S or L or V or W or a conservative substitution thereof, X5 = Absent or G or a conservative substitution thereof, X6 = Absent or A or a conservative substitution thereof, X7 = S or T or A or a conservative substitution thereof, X8 = A or F or S or Y or a conservative substitution thereof, X9 = F or G or S or a |

FIGURE 55
(Continued)

| | | |
|---|---|---|
| VH-CONSENSUS-59 TABLE 93 | | conservative substitution thereof, X10 = Y or F or a conservative substitution thereof. |
| | VH1 | X1 Tyr X2 Met Asn (SEQ ID NO: 50240) weherein X1 = S or N or a conservative substitution thereof, X2 = N or S or a conservative substitution thereof. |
| | VH2 | Tyr Ile Ser X1 Ser X2 X3 Thr X4 X5 Tyr X6 Asp Ser Val X7 Gly (SEQ ID NO: 50241) wherein X1 = R or S or a conservative substitution thereof, X2 = S or G or a conservative substitution thereof, X3 = N or S or a conservative substitution thereof, X4 = K or T or a conservative substitution thereof, X5 = Y or H or a conservative substitution thereof, X6 = A or V or a conservative substitution thereof, X7 = K or R or E or Q or a conservative substitution thereof. |
| | VH3 | Asp X1 X2 X3 X4 X5 X6 X7 X8 X9 Tyr Tyr Gly X10 Asp Val (SEQ ID NO: 50242) wherein X1 = R or S or a conservative substitution thereof, X2 = S or R or a conservative substitution thereof, X3 = G or K or a conservative substitution thereof, X4 = S or G or a conservative substitution thereof, X5 = Y or F or a conservative substitution thereof, X6 = G or Absent or a conservative substitution thereof, X7 = Y or Absent or a conservative substitution thereof, X8 = F or Absent or a conservative substitution thereof, X9 = Y or Absent or a conservative substitution thereof, X10 = L or M or a conservative substitution thereof. |
| VH-CONSENSUS-60 TABLE 94 | VH1 | Ser Gly Gly Asp Tyr Tyr Trp Ser (SEQ ID NO: 50119). |
| | VH2 | Tyr Ile Tyr Tyr Ser Gly X1 Thr Tyr Tyr Asn Pro Ser Leu Lys Ser (SEQ ID NO: 50120) wherein X1 = S or I or P or a conservative substitution thereof. |
| | VH3 | Asp X1 X2 X3 X4 Gly Met Asp Val (SEQ ID NO: 50121) wherein X1 = S or G or H or a conservative substitution thereof, X2 = S or A or a conservative substitution thereof, X3 = S or L or R or a conservative substitution thereof, X4 = Y or R or H or a conservative substitution thereof. |

FIGURE 55
(Continued)

Table 20A

VARIABLE LIGHT CDR CONSENSUS SEQUENCES I

| NAME (ORIGINAL AND PATENT) | Patent SEQ ID NO: | SEQUENCE |
|---|---|---|
| VL-Consensus-1 (Table 35) (generated from 13 light chain sequences) | SEQ ID NO: 50366 | DIQMTQSPSSVSASVGDRVTITCRASQGISRWLAWY QQKPGKAPKLLIYAASSLQSGVPSRFSGSGSGTDFTL TISSLQPEDFATYYCQQANSFPFTFGPGTKVDIKR |
| VL-Consensus-2 (Table 36) (generated from 11 light chain sequences) | SEQ ID NO: 50367 | SYELTQPPSVSVSPGGTASITCSGDKLGDKYAYWYQ QKPGQSPVLVIYQDRKRPSGIPERFSGSNSGNTATLTI SGTQAMDEADYYCQAWDNSTYVFGGGTKLTVLGG |
| VL-Consensus-3 (Table 37) (generated from 15 light chain sequences) | SEQ ID NO: 50368 | DIVMTQSPDSLAVSLGERATINCKSSQSVLYSSNNNN YLAWYQQKPGQPPKLLIYWASTRESGVPDRFSGSGS GTDFTLTISSLQAEDVAVYYCQQYYSTPFTFGQGTK VEIKR |
| VL-Consensus-4 (Table 38) (generated from 23 light chain sequences) | SEQ ID NO: 50369 | DIQMTQSPSSLSASVGDRVTITCRASQGISNYLAWFQ QKPGKAPKSLIYAASSLQSGVPSKFSGSGSGTDFTLTI SSLQPEDFATYYCQQYNSYPFTFGPGTKVDIKR |
| VL-Consensus 5 (Table 39) (generated from 17 light chain sequences) | SEQ ID NO: 50370 | DIQMTQSPSSLSASVGDRVTITCRASQGIRNNLGWY QQKPGKAPKRLIYAASSLQSGVPSRFSGSGSGTEFTL TISSLQPEDFATYYCLQYNSYPFTFGQGTKVEIKR |
| VL-Consensus 6 (Table 40) (generated from 11 light chain sequences) | SEQ ID NO: 50371 | DIQMTQSPSSLSASVGDRVTITCRASQGISNYLAWFQ QKPGKAPKSLIYAASSLQSGVPSKFSGSGSGTDFTLTI SSLQPEDFATYYCQQYNSYPEIFGPGTKVDIKR |
| VL-Consensus 7 (kappa) (Table 41) (generated from 26 light chain sequences) | SEQ ID NO: 50372 | DIQMTQSPSSLSASVGDRVTITCRASQDIRSDLGWYQ QKPGKAPKRLIYAASSLQSGVPSRFSGSGSGTEFTLTI SSLQPEDFATYYCLQHTYYPPTFGGGTKVEIKR |
| VL-Consensus-7 (lambda) (Table 41) (generated from 26 light chain sequences) | SEQ ID NO: 50373 | QSXLTQPXSXSGSPGQSITSCTGTSSDVGXXNAYSW YQQHPGKAPKLMIYEVSNRPSGVXXRFSGSKSGNTA SLTISGLQXEEDEADYYCSSYTXSXTYVFGGGTKLTV LG |
| VL-Consensus-8 (Table 42) (generated from 25 light chain sequences) | SEQ ID NO: 50374 | DIQMTQSPSSLSASVGDRVTITCRASQSISSYLNWYQ QKPGKAPKLLIYAASSLQSGVPSRFSGSGSGTDFTLTI SSLQPEDFATYYCQQSYRTPLFTFGPGTKVDIKR |

FIGURE 55
(Continued)

| Name | SEQ ID NO | Sequence |
|---|---|---|
| VL-Consensus-9 (Table 43) (generated from 14 light chain sequences) | SEQ ID NO: 50375 | DIQMTQSPSSLSASVGDRVTITCRASQSHSYLNWYQQKPGKAPKLLIYTASSLQSGVPSRFSGSGSGTDFTLTISSLQPEDFATYYCQQTYSTPLTFGGGTKVEIKR |
| VL-Consensus-10 (Table 44) (generated from 22 light chain sequences) | SEQ ID NO: 50376 | DIQMTQSPSSLSASVGDRVTITCRASQGIRNDLGWYQQKPGKAPKRLIYAASSLQSGVPSRFSGSGSGTEFTLTISSLQPEDFATYYCLQHYSYPRTFGQGTKVEIKR |
| VL-Consensus-11 (Table 45) (generated from 16 light chain sequences) | SEQ ID NO: 50377 | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGXGTKVEIKR |
| VL-Consensus-12 (Table 46) (generated from 71 light chain sequences) | SEQ ID NO: 50378 | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKR |
| VL-Consensus-13 (Table 47) (generated from 21 light chain sequences) | SEQ ID NO: 50379 | DIQMTQSPSSLSASVGDRVTITCRASQGIRNDLGWYQQKPGKAPKRLIYAASSLQSGVPSRFSGSGSGTEFTLTISSLQPEDFATYYCLQHSSYPLTFGGGTKVEIKR |
| VL-Consensus-14 (Table 48) (generated from 13 light chain sequences) | SEQ ID NO: 50380 | DIQMTQSPSSLSASVGDRVTITCRASQGIRNDLGWYQQKPGKAPKRLIYAASSLQSGVPSRFSGSGSGTEFTLTISSLQPEDFATYYCLQHSSYPLTFGGGTKVEIKR |
| VL-Consensus-15 (Table 95) (generated from 209 light chain sequences) | SEQ ID NO: 50312 | DIQMTQSPSSLSASVGDRVTITCRASQGIRDLGWYQQKPGKAPKRLIYAASSLQSGVPSRFSGSGSGTEFTLTISSLQPEDFATYYCLQHNSYPLTFGGGTKVEIKR |
| VL-Consensus-16 (Table 96) (generated from 174 light chain sequences) | SEQ ID NO: 50313 | SYELTQPPSVSVSPGQTASITCSGDKLGDKYACWYQQKPGQSPVLVIYQDRKRPSGIPERFSGSNSGNTATLTISGTQAMDEADYYCQAWDSSTVVPGGGTKLTVLG |
| VL-Consensus-17 (Table 97) (generated from 162 light chain sequences) | SEQ ID NO: 50314 | EIVLTQSPGTLSLSPGERATLSCRASQSVYSSYLAWYQQKPGQAPRLLIYGASSRATGIPDRFSGSGSGTDFTLTISRLEPDFAVYYCQQYDNSPWTFGQGTKVEIKR |
| VL-Consensus-18 (Table 98) (generated from 147 light chain sequences) | SEQ ID NO: 50315 | DIQMTQSPSSLSASVGDRVTITCRASQGIRNDLGWYQQKPGKAPKRLIYAASSLQSGVPSRFSGSGSGTEFTLTISSLQPEDFATYYCLQHYSYPRTFGQGTKVEIKR |

FIGURE 55
(Continued)

| | | |
|---|---|---|
| VL-Consensus 19 (Table 99) (generated from 132 light chain sequences) | SEQ ID NO: 50316 | DIVMTQSPDSLAVSLGERATINCKSSQSVLHSSNNN YLAWYQQKPGQPPKLLIYWASTRESGVPDRFSGSGS GTDFTLTISSLQAEDVAVYYCQQYSTPPTFGQGTK VEIKR |
| VL-Consensus 20 (Table 100) (generated from 109 light chain sequences) | SEQ ID NO: 50317 | DIQMTQSPSSLSASVGDRVTITCRASQGIRNDLGWY QQKPGKAPKRLIYAASSLQSGVPSRFSGSGSGEFTLTI SSLQPEDFATYYCLQHNSYPFTFGPGTKVDIKR |
| VL-Consensus 21 (Table 101) (generated from 92 light chain sequences) | SEQ ID NO: 50318 | DIQMTQSPSSLSASVGDRVTITCRASQGISNYLAWFQ QKPGKAPKSLIYAASSLQSGVPSKFSGSGSGTDFTLTI SSLQPEDFATYYCQQYSTYPLTFGGGTKVEIKR |
| VL-Consensus 22 (Table 102) (generated from 89 light chain sequences) | SEQ ID NO: 50319 | DIQMTQSPSSLSASVGDRVTITCRASQNHSYLNWYQ QKPGKAPKLLIYTASSLQSGVPSRFSGSGSGTDFTLTI SSLQPEDFATYYCQQSYSTPLTFGGGTKVEIKR |
| VL-Consensus 23 (Table 103) (generated from 86 light chain sequences) | SEQ ID NO: 50320 | DIQMTQSPSSLSASVGDRVTITCRASQGISNYLAWFQ QKPGKAPKSLIYAASSLQSGVPSKFSGSGSGTDFTLTI SSLQPEDFATYYCQQYNSYPFTFGPGTKVDIKR |
| VL-Consensus 24 (Table 104) (generated from 81 light chain sequences) | SEQ ID NO: 50321 | SYELTQPPSVSVSPGQTASITCSGDKLGDKYACWYQ QKPGQSPVLVIYQDRKRPSGIPERFSGSNSGNTATLTI SGTQAMDEADYCQAWDSSTYVFGGGTKLTVLG |
| VL-Consensus 25 (Table 105) (generated from 65 light chain sequences) | SEQ ID NO: 50322 | DIVMTQTPLSLSVTPGQPASISCKSSQSLLHGD- GKTYLYWYLQKPGQPPQLLIYEVSNRFSGVPDRFSG SGSGTDFTLKISRVEAEDVGVYYCMQSIQLPWTFGQ GTKVEIKR |
| VL-Consensus 26 (Table 106) (generated from 58 light chain sequences) | SEQ ID NO: 50323 | DIQMTQSPSSLSASVGDRVTITCRASQSISSYLNWYQ QKPGKAPKLLIYAASSLQSGVPSRFSGSGSGTDFTLTI SSLQPEDFATYYCQQSYSPPFTFGPGTKVDIKR |
| VL-Consensus 27 (Table 107) (generated from 47 light chain sequences) | SEQ ID NO: 50324 | DIVMTQSPDSLAVSLGERATINCKSSQSVLYSSNNNN YLAWYQQKPGQPPKLLIYWASTRESGVPDRFSGSGS GTDFTLTISSLQAEDVAVYYCQQYSTPCSFGQGTK LEIKR |
| VL-Consensus 28 (Table 108) (generated from 42 light chain sequences) | SEQ ID NO: 50325 | DIQMTQSPSSVSASVGDRVTITCRASQGISNWLAWY QQKPGKAPKLLIYAASSLQSGVPSRFSGSGSGTDFTL TISSLQPEDFATYYCQQAEPWTFGQGTKVEIKR |

FIGURE 55
(Continued)

| | SEQ ID NO: | |
|---|---|---|
| VL-Consensus 29 (Table 109) (generated from 37 light chain sequences) | SEQ ID NO: 50326 | DIVMTQSPDSLAVSLGERATINCKSSQSVLHSSNNEN YLAWYQQKPGQPPKLLIYWASTRESGVPDRFSGSGS GTDFTLTISSLQAEDVAVYYCQQYYSTPYTFGPGTK VDIKR |
| VL-Consensus 30 (Table 110) (generated from 31 light chain sequences) | SEQ ID NO: 50327 | QTVVTQEPSLTVSPGGTVTLTCASSTGAVTSG-YYPNWFQQKPGQAPRALIYSTSNKHSWTPARFSGSL LGGKAALTLSGVQPEDEAEYYCLLYYGGAQLVPGG GTKLTVLG |
| VL-Consensus 31 (Table 111) (generated from 25 light chain sequences) | SEQ ID NO: 50328 | EIVMTQSPATLSVSPGERATLSCRASQSVNSNLAWY QQKPGQAPRLLIYGASTRATGIPARFSGSGSGTEFTL TISSLQSEDFAVYYCQQYNDWPCSFGQGTKLEIKR |
| VL-Consensus 32 (Table 112) (generated from 24 light chain sequences) | SEQ ID NO: 50329 | EFMLTQSPGTLSLSPGERATLSCRASQSVSSSYLVWY QQKPGQAPRLLIYGASTRATGHPDRFSGSGSGTDFTL TISRLEPEYFAVYYCQQYGCSPLTFGGGTKVEITR |
| VL-Consensus 33 (Table 113) (generated from 21 light chain sequences) | SEQ ID NO: 50330 | DIVMTQTPLSLSVTPGQPASISCKSSQSLLHSEGKTYL YWYLQKPGQPPQLLIYEVSNRFSGVPDRFSGSGSGT DFTLKISRVEAEDVGVYYCMQSIQLPLTFGGGTKVEI KR |
| VL-Consensus 34 (Table 114) (generated from 18 light chain sequences) | SEQ ID NO: 50331 | QSALTQPASVSGSPGQSITISCTGTSSDYGGYNYVSW YQQHPGKAPKLMIYEVSNRPSGVSNRFSGSKSGNTA SLTISGLQAEDEADYYCNSYTRSITWVFGGGTKLTV LG |
| VL-Consensus 35 (Table 115) (generated from 17 light chain sequences) | SEQ ID NO: 50332 | DIQMTQSPSSLSASVGDRVTITCRASQSISNYLNWYQ QKPGKAPKLLIYAASSLQSGVPSRFSGSGSGTDFTLTI SSLQPEDFATYYCQQSYSTPTWTFGQGTKVEIKR |
| VL-Consensus 36 (Table 116) (generated from 16 light chain sequences) | SEQ ID NO: 50333 | DIQMTQSPSSVSASVGDRVTITCRASQGISSWLAWY QQKPGKAPKLLIYAASSLQSGVPSRFSGSGSGTDFTL TISSLQPEDFATYYCQQINSFPLTFGGGTKVEIKR |
| VL-Consensus 37 (Table 117) (generated from 16 light chain sequences) | SEQ ID NO: 50334 | DIQMTQSPSSLSASVGDRVTITCQASQDINNYLNWY QQKPGKAPKLLIYDASNLETGVPSRFSGSGSGTDFTF TISSLQPEDIATYYCQQYDNLPITFGQGTRLEIKR |
| VL-Consensus 38 (Table 118) (generated from 16 light chain sequences) | SEQ ID NO: 50335 | QSVLTQPPSVSAAPGQKVTISCSGSSSNIGNNYYSWY QQLPGTAPKLLIYDNNKRPSGIPDRFSGSKSGTSATL GITGLQTGDEADYYCGTWDSSLSVGVFGGGTKLTV LG |

FIGURE 55
(Continued)

| | | |
|---|---|---|
| VL-Consensus 39 (Table 119) (generated from 14 light chain sequences) | SEQ ID NO: 50336 | DIVMTQSPLSLPVTPGEPASISCRSSQSLLHSNGYNYL DWYLQKPGQSPQLLIYLGSNRASGVPDRFSGSGSGT DFTLKISRVEAEDVGVYYCMQALHPPLTFGGGTKVE IKR |
| VL-Consensus 40 (Table 120) (generated from 13 light chain sequences) | SEQ ID NO: 50337 | QSVLTQPPSASGTPGQRVTISCSGSSSNIGSNTVNWY QQLPGTAPKLLIYSNQRPSGVPDRFSGSKSGTSASL AISGLQSEDEADYYCAAWDDSLNGVYFGGGTKLTV LG |
| VL-Consensus 41 (Table 121) (generated from 11 light chain sequences) | SEQ ID NO: 50338 | QSVLTQPPSASGTPGQRVTISCSGSSSNIGSNIVTWYQ QLPGTAPKLLIYSNDQRPSGVPDRFSGSKSGTSASLAI SGLQSEDEADYYCAAWDDSLNGWVFGGGTLTVL G |
| VL-Consensus 42 (Table 122) (generated from 10 light chain sequences) | SEQ ID NO: 50339 | DIQMTQSPSSLSASVGDRVTITCRASQGIRNDLGWY QQKPGKAPKRLIYAASSLQSGVPSRFSGSGSGTEFTL TISSLQPEDFATYYCLQHNSYPITFGQGTRLEIKR |
| VL-Consensus 43 (Table 123) (generated from 10 light chain sequences) | SEQ ID NO: 50340 | DIQMTQSPSSLSASVGDRVTITCRASQSISSYLNWYQ QKPGKAPKLLIYAASSLQSGVPSRFSGSGSGTDFTLTI SSLQPEDFATYYCQQSYSIPITFGQGTRLEIKR |
| VL-Consensus 44 (Table 124) (generated from 10 light chain sequences) | SEQ ID NO: 50341 | DIVMTQTPLSLSVTPGQPASISCKSSQSLLHSEGKTYL YWYLQKPGQPPQLLIYEVSNRFSGVPDRFSGSGSGT DFTLKISRVEAEDVGVYYCMQSIQLPITFGQGTRLEI KR |
| VL-Consensus 45 (Table 125) (generated from 10 light chain sequences) | SEQ ID NO: 50342 | EIVLTQSPGTLSLFPGERATLSCRASQSVISSYLAWYQ QKPGQAPRLLIFGVSSRATGIPDRFSGSGSGTDFTLTI SRLEPEDFAVYYCQQYGIRSPFNFGPGTKVDIKR |
| VL-Consensus 46 (Table 126) (generated from 10 light chain sequences) | SEQ ID NO: 50343 | EIVMTQSPATLSVSPGERATLSCRASQSVSSNLAWY QQKPGQAPRLLIYGASTRATGIPARFSGSGSGTEFTL TISSLQSEDFAVYYCQQYNDWPWTFGQGTKVEIKR |
| VL-Consensus 47 (Table 127) (generated from 10 light chain sequences) | SEQ ID NO: 50344 | EIVLTQSPDFQSVTPKEKVTITCRASQSIGSSLHWYQ QKPDQSPKLLIKYASQSFSGVPSRFSGSGTDFTLTI NSLEAEDAATYYCHQSSSLPWTFGQGTKVEIKR |
| VL-Consensus 48 (Table 128) (generated from 9 light chain sequences) | SEQ ID NO: 50345 | DIQMTQSPSSLSASVGDRVTITCRASQGIRNDLGWY QQKPGKAPKRLIYAASSLQSGVPSRFSGSGSGTEFTL TISSLQPEDFATYYCLQHYSYPRSFGQGTKLEIKR |

FIGURE 55
(Continued)

| | SEQ ID NO: | |
|---|---|---|
| VL-Consensus 49 (Table 129) (generated from 9 light chain sequences) | SEQ ID NO: 50346 | DIQMTQSPSSLSASVGDRVTITCRASQGISNYLAWFQ QKPGKAPKSLIYAASSLQSGVPSKFSGSGSGTDFTLTI SSLQPEDFATYYCQQYLSYPLTFGQGTRLEIKR |
| VL-Consensus 50 (Table 130) (generated from 9 light sequences) | SEQ ID NO: 50347 | EIVLTQSPDFQSVTPKEKVTITCRASQSIGSSLHWYQ QKPDQSPKLLIKYASQSESGVPSRFSGSGSGTDFTLTI NSLEAEDAATYYCHQSRRLPLTFGGGTKVEIKR |
| VL-Consensus 51 (Table 131) (generated from 9 light chain sequences) | SEQ ID NO: 50348 | SSELTQDPAVSVALGQTVRITCQGDSLRPYYASWYQ QKPGQAPVLVIYGKNNRPSGIPDRFSGSSSGNTASLTI TGAQAEDEADYYCNSRDSSGNHLVVFGGGTKLTVL G |
| VL-Consensus 52 (Table 132) (generated from 8 light chain sequences) | SEQ ID NO: 50349 | DVVMTQSPLSLPVTLGQPASISCRSSQSLVYSDGNTY LNWFQQRPGQSPRRLIYKVSNWDSGVPDRFSGSGSG TDFTLKISRVEAEDVGVYYCMQGTHWPLTFGGGTK VEIKR |
| VL-Consensus 53 (Table 133) (generated from 8 light chain sequences) | SEQ ID NO: 50350 | EIVMTQSPATLSVSPGERATLSCRASQSVSRNLAWY QQKPGQAPRLLIYGASTRATGIPARFSGSGSGTEFTL TISSLQSEDFAVYYCQQYNNWPLTFGGGTKVEIKR |
| VL-Consensus 54 (Table 134) (generated from 8 light chain sequences) | SEQ ID NO: 50351 | SYELTQPLSVSVALGQTARITCGGNNIGRKNYHWYQ QKPGQAPVLVIYRDSDRPSGIPERFSGSNSGNTATLTI SRAQAGDEADYYCQYWDSSTVPGGGTKLTVLG |

FIGURE 55
(Continued)

Table 20B

VARIABLE LIGHT CDR CONSENSUS SEQUENCES

| Name (original and patent) | Patent SEQ ID NO: | CDR | Sequence |
|---|---|---|---|
| VL-Consensus-1 (Table 35) | 50423 | VL1 | RASQGISRWLA |
|  | 50424 | VL2 | AASSLQS |
|  | 50425 | VL3 | QQANSFPFT |
| VL-Consensus-2 (Table 36) | 50426 | VL1 | SGDKLGDKYAY |
|  | 50427 | VL2 | QDRKRPS |
|  | 50428 | VL3 | QAWDNSTVV |
| VL-Consensus-3 (Table 37) | 50429 | VL1 | KSSQSVLYSSNNNNYLA |
|  | 50430 | VL2 | WASTRES |
|  | 50431 | VL3 | QQYYSTPPT |
| VL-Consensus-4 (Table 38) | 50432 | VL1 | RASQGISNYLA |
|  | 50433 | VL2 | AASSLQS |
|  | 50434 | VL3 | QQYNSYPPT |
| VL-Consensus-5 (Table 39) | 50435 | VL1 | RASQGIRNNLG |
|  | 50436 | VL2 | AASSLQS |
|  | 50437 | VL3 | LQYNSYPPT |
| VL-Consensus-6 (Table 40) | 50438 | VL1 | RASQGISNYLA |
|  | 50439 | VL2 | AASSLQS |
|  | 50440 | VL3 | QQYNSYPPT |
| VL-Consensus-7κ (Table 41) | 50441 | VL1 | RASQDIRSDLG |
|  | 50442 | VL2 | AASSLQS |
|  | 50443 | VL3 | LQHTIYPPT |
| VL-Consensus-7λ (Table 41) | 50444 | VL1 | TGTSSDVGXXNXVS |
|  | 50445 | VL2 | EVSNRPS |
|  | 50446 | VL3 | SSYTXSXTVV |
| VL-Consensus-8 (Table 42) | 50447 | VL1 | RASQSISSYLN |
|  | 50448 | VL2 | AASSLQS |
|  | 50449 | VL3 | QQSYRTPLFT |
| VL-Consensus-9 (Table 43) | 50450 | VL1 | RASQSHSYLN |
|  | 50451 | VL2 | TASSLQS |
|  | 50452 | VL3 | QQTYSTPLT |

FIGURE 55
(Continued)

| | | | |
|---|---|---|---|
| VL-Consensus-10 (Table 44) | 50453 | VL1 | RASQGIRNDLG |
| | 50454 | VL2 | AASSLQS |
| | 50455 | VL3 | LQHYSYPRT |
| VL-Consensus-11 (Table 45) | 50456 | VL1 | RASQGIRNDLG |
| | 50457 | VL2 | AASSLQS |
| | 50458 | VL3 | LQHNSYPFT |
| VL-Consensus-12 (Table 46) | 50459 | VL1 | RASQGIRNDLG |
| | 50460 | VL2 | AASSLQS |
| | 50461 | VL3 | LQHNSYPLT |
| VL-Consensus-13 (Table 47) | 50462 | VL1 | RASQGIRNDLG |
| | 50463 | VL2 | AASSLQS |
| | 50464 | VL3 | LQHSSYPLT |
| VL-Consensus-14 (Table 48) | 50465 | VL1 | RASQGIRNDLG |
| | 50466 | VL2 | AASSVQS |
| | 50467 | VL3 | LQHNSYPLT |
| VL-Consensus-15 (Table 95) | 50606 | VL1 | RASQGIRNDLG |
| | 50607 | VL2 | AASSLQS |
| | 50608 | VL3 | LQHNSYPLT |
| VL-Consensus-16 (Table 96) | 50609 | VL1 | SGDKLGDKYAC |
| | 50610 | VL2 | AASSLQS |
| | 50611 | VL3 | QAWDSSTVV |
| VL-Consensus-17 (Table 97) | 50612 | VL1 | RASQSVVSSYLA |
| | 50613 | VL2 | GASSRAT |
| | 50614 | VL3 | QQYDNSPWT |
| VL-Consensus-18 (Table 98) | 50615 | VL1 | RASQGIRNDLG |
| | 50616 | VL2 | AASSLQS |
| | 50617 | VL3 | LQHYSYPRT |
| VL-Consensus-19 (Table 99) | 50618 | VL1 | KSSQSVLHSSNNNNYLA |
| | 50619 | VL2 | WASTRES |
| | 50620 | VL3 | QQYYSTPPT |
| VL-Consensus-20 (Table 100) | 50621 | VL1 | RASQGIRNDLG |
| | 50622 | VL2 | AASSLQS |
| | 50623 | VL3 | LQHNSYPFT |
| VL-Consensus-21 (Table 101) | 50624 | VL1 | RASQGISNYLA |
| | 50625 | VL2 | AASSLQS |
| | 50626 | VL3 | QQYSTYPLT |

FIGURE 55
(Continued)

| | | | |
|---|---|---|---|
| VL-Consensus-22 (Table 102) | 50627 | VL1 | RASQNIISYLN |
| | 50628 | VL2 | TASSLQS |
| | 50629 | VL3 | QQSYSTPLT |
| VL-Consensus-23 (Table 103) | 50630 | VL1 | RASQGISNYLA |
| | 50631 | VL2 | AASSLQS |
| | 50632 | VL3 | QQYNSYPFT |
| VL-Consensus-24 (Table 104) | 50633 | VL1 | RASQGISRWLA |
| | 50634 | VL2 | AASSLQS |
| | 50635 | VL3 | QQANSFPFT |
| VL-Consensus-25 (Table 105) | 50636 | VL1 | KSSQSLLHGDGKTYLY |
| | 50637 | VL2 | EVSNRFS |
| | 50638 | VL3 | MQSIQLPWT |
| VL-Consensus-26 (Table 106) | 50639 | VL1 | RASQSISSYLN |
| | 50640 | VL2 | AASSLQS |
| | 50641 | VL3 | QQSYSPPFT |
| VL-Consensus-27 (Table 107) | 50642 | VL1 | KSSQSVLYSSNNNNYLA |
| | 50643 | VL2 | WASTRES |
| | 50644 | VL3 | QQYYSTPCS |
| VL-Consensus-28 (Table 108) | 50645 | VL1 | RASQGISNWLA |
| | 50646 | VL2 | AASSLQS |
| | 50647 | VL3 | QQANSFPWT |
| VL-Consensus-29 (Table 109) | 50648 | VL1 | KSSQSVLHSSNNNNYLA |
| | 50649 | VL2 | WASTRES |
| | 50650 | VL3 | QQYYSIFVT |
| VL-Consensus-30 (Table 110) | 50651 | VL1 | ASSTGAVTSGYYPN |
| | 50652 | VL2 | STSNKHS |
| | 50653 | VL3 | LLYYGGAQLV |
| VL-Consensus-31 (Table 111) | 50654 | VL1 | RASQSVNSNLA |
| | 50655 | VL2 | GASTRAT |
| | 50656 | VL3 | QQYNDWPCS |

FIGURE 55
(Continued)

| | | | |
|---|---|---|---|
| VL-Consensus-32 (Table 112) | 50657 | VL1 | RASQSVSSSYLV |
| | 50658 | VL2 | GASTRAT |
| | 50659 | VL3 | QQYGCSPLT |
| VL-Consensus-33 (Table 113) | 50660 | VL1 | KSSQSLLHSEGKTYLY |
| | 50661 | VL2 | EVSNRFS |
| | 50662 | VL3 | MQSIQLPLT |
| VL-Consensus-34 (Table 114) | 50663 | VL1 | TGTSSDVGGYNYVS |
| | 50664 | VL2 | EVSNRPS |
| | 50665 | VL3 | NSYTRSITWV |
| VL-Consensus-35 (Table 115) | 50666 | VL1 | RASQSISNYLN |
| | 50667 | VL2 | AASSLQS |
| | 50668 | VL3 | QQSYSTPTWT |
| VL-Consensus-36 (Table 116) | 50669 | VL1 | RASQGISSWLA |
| | 50670 | VL2 | AASSLQS |
| | 50671 | VL3 | QQNSFPLT |
| VL-Consensus-37 (Table 117) | 50672 | VL1 | QASQDINNYLN |
| | 50673 | VL2 | DASNLET |
| | 50674 | VL3 | QQYDNLPIT |
| VL-Consensus-38 (Table 118) | 50675 | VL1 | SGSSSNIGNNYVS |
| | 50676 | VL2 | DNNKRP |
| | 50677 | VL3 | GTWDSSLSVGV |
| VL-Consensus-39 (Table 119) | 50678 | VL1 | RSSQSLLHSNGYNYLD |
| | 50679 | VL2 | LGSNRAS |
| | 50680 | VL3 | MQALPLT |
| VL-Consensus-40 (Table 120) | 50681 | VL1 | SGSSSNIGSNTVN |
| | 50682 | VL2 | SNNQRPS |
| | 50683 | VL3 | AAWDDSLNGVV |
| VL-Consensus-41 (Table 121) | 50684 | VL1 | SGSSSNIGSNIVT |
| | 50685 | VL2 | SNDQRPS |
| | 50686 | VL3 | AAWDDSLNGWV |

FIGURE 55
(Continued)

| | | |
|---|---|---|
| VL-Consensus-42 (Table 122) | 50687 | VL1 | RASQGIRNDLG |
| | 50688 | VL2 | AASSLQS |
| | 50689 | VL3 | LQHNSYPIT |
| VL-Consensus-43 (Table 123) | 50690 | VL1 | RASQSISSSYLN |
| | 50691 | VL2 | AASSLQS |
| | 50692 | VL3 | QQSYSIPIT |
| VL-Consensus-44 (Table 124) | 50693 | VL1 | KSSQSLLHSEGKTYLY |
| | 50694 | VL2 | EVSNRFS |
| | 50695 | VL3 | MQSIQ PIT |
| VL-Consensus-45 (Table 125) | 50696 | VL1 | RASQSVSSSYLA |
| | 50697 | VL2 | GVSSRAT |
| | 50698 | VL3 | QQYGRSPFN |
| VL-Consensus-46 (Table 126) | 50699 | VL1 | RASQSVSSNLA |
| | 50700 | VL2 | GASTRAT |
| | 50701 | VL3 | QQYNDWPWT |
| VL-Consensus-47 (Table 127) | 50702 | VL1 | RASQSIGSSLH |
| | 50703 | VL2 | YASQSFS |
| | 50704 | VL3 | HQSSSLPWT |
| VL-Consensus-48 (Table 128) | 50705 | VL1 | RASQGIRNDLG |
| | 50706 | VL2 | AASSLQS |
| | 50707 | VL3 | LQHYSYPRS |
| VL-Consensus-49 (Table 129) | 50708 | VL1 | RASQGISNYLA |
| | 50709 | VL2 | AASSLQS |
| | 50710 | VL3 | QQYLSYPIT |
| VL-Consensus-50 (Table 130) | 50711 | VL1 | RASQSIGSSLH |
| | 50712 | VL2 | YASQSFS |
| | 50713 | VL3 | HQSRRLPLT |
| VL-Consensus-51 (Table 131) | 50714 | VL1 | QGDSLRPYYAS |
| | 50715 | VL2 | GKNNRPS |

FIGURE 55
(Continued)

| | | VL3 | NSRDSSGNHLVV |
|---|---|---|---|
| VL-Consensus-52 (Table 132) | 50716 | | |
| | 50717 | VL1 | RSSQSLVYSDGNTYLN |
| | 50718 | VL2 | KVSNWDS |
| | 50719 | VL3 | MQGTHWPLT |
| VL-Consensus-53 (Table 133) | 50720 | VL1 | RASQSVSRNLA |
| | 50721 | VL2 | GASTRAT |
| | 50722 | VL3 | QQYNNWPLT |
| VL-Consensus-54 (Table 134) | 50723 | VL1 | GGNMGRKNVH |
| | 50724 | VL2 | RDSRPS |
| | 50725 | VL3 | QVWDSSTVV |

FIGURE 55
(Continued)

Table 20C

VARIABLE LIGHT CDR CONSENSUS SEQUENCES II

| NAME (ORIGINAL AND PATENT) | Patent SEQ ID NO: | CDR | Sequence |
|---|---|---|---|
| VL-CONSENSUS-15 TABLE 95 | SEQ ID NO: 50122 | VL1 | X1 X2 Ser X3 X4 X5 X6 X7 X8 X9 X10, wherein X1 = R or L or a conservative substitution thereof, X2 = A or T or a conservative substitution thereof, X3 = Q or R or a conservative substitution thereof, X4 = G or D or A or V or a conservative substitution thereof, X5 = I or M or V or a conservative substitution thereof, X6 = R or E or K or N or S or a conservative substitution thereof, X7 = N or S or D or T or K or I or a conservative substitution thereof, X8 = D or N or A or a conservative substitution thereof, X9 = L or F or V or a conservative substitution thereof, X10 = G or D or N or a conservative substitution thereof. |
| | SEQ ID NO: 50123 | VL2 | X1 X2 X3 X4 X5 X6 X7, wherein X1 = A or T or S or V or G or D or R or a conservative substitution thereof, X2 = A or T or V or E or a conservative substitution thereof, X3 = S or F or C or Y or a conservative substitution thereof, X4 = S or N or T or F or R or I or a conservative substitution thereof, X5 = L or V or F or S or a conservative substitution thereof, X6 = Q or H or E or a conservative substitution thereof, X7 = S or R or N or T or G or a conservative substitution thereof. |
| | SEQ ID NO: 50124 | VL3 | X1 X2 X3 X4 X5 X6 X7 X8 X9, wherein X1 = L or V or I or a conservative substitution thereof, X2 = Q or H or a conservative substitution thereof, X3 = H or D or Y or N or R or a conservative substitution thereof, X4 = N or S or Y or T or D or K or A or I or E or H or P or R or a conservative substitution thereof, X5 = S or I or N or R or T or D or A or L or V or a conservative substitution thereof, X6 = Y or F or H or S or a conservative substitution thereof, X7 = P or A or M or a conservative substitution thereof, X8 = L or P or F or N or V or a conservative substitution thereof, X9 = T or K or I or a conservative substitution thereof. |
| VL-CONSENSUS-16 TABLE 96 | SEQ ID NO: 50125 | VL1 | Ser Gly X1 X2 X3 Gly X4 X5 X6 X7 X8, wherein X1 = D or N or E or Y or S or a conservative substitution thereof, X2 = K or R or N or E or T or a conservative substitution thereof, X3 = L or M or S or a conservative substitution thereof, X4 = D or N or E or G or Y or T or H or V or a conservative substitution thereof, X5 = K or R or a conservative substitution thereof, X6 = Y or F or S or a conservative substitution thereof, X7 = A or V or T or D or S or a conservative substitution thereof, X8 = C or S or Y or W or H or a conservative substitution thereof. |

FIGURE 55
(Continued)

| | | | |
|---|---|---|---|
| | SEQ ID NO: 50126 | VL2 | X1 X2 X3 X4 Arg X5 X6, wherein X1 = Q or E or K or a conservative substitution thereof, X2 = D or N or a conservative substitution thereof, X3 = R or S or N or K or Y or M or T or G or I or a conservative substitution thereof, X4 = K or R or Q or a conservative substitution thereof, X5 = K or R or Q or a conservative substitution thereof, X6 = K or R or Q or a conservative substitution thereof. |
| | SEQ ID NO: 50228 | VL3 | X1 X2 X3 X4 X5 X6 X7 X8 X9 X10, wherein X1 = Q or L or K or a conservative substitution thereof, X2 = A or T or a conservative substitution thereof, X3 = W or R or a conservative substitution thereof, X4 = D or H or V or N or G or a conservative substitution thereof, X5 = S or N or Absent or I or R or K or T or a conservative substitution thereof, X6 = Absent or S or N or R or a conservative substitution thereof, X7 = S or T or N or R or G or F or I or V or Y or a conservative substitution thereof, X8 = T or S or Y or A or F or P or N or K or I or R or a conservative substitution thereof, X9 = V or A or T or M or L or G or a conservative substitution thereof, X10 = V or I or L or A or M. |
| VL-CONSENSUS-17 TABLE 97 | SEQ ID NO: 50127 | VL1 | X1 X2 X3 X4 X5 X6 X7 X8 X9 X10 Leu X11, wherein X1 = R or W or a conservative substitution thereof, X2 = A or T or a conservative substitution thereof, X3 = S or G or R or a conservative substitution thereof, X4 = Q or P or a conservative substitution thereof, X5 = S or N or I or R or a conservative substitution thereof, X6 = V or I or F or a conservative substitution thereof, X7 = Y or R or S or N or D or F or H or G or W or a conservative substitution thereof, X8 = S or T or N or G or L or R or a conservative substitution thereof, X9 = S or N or G or R or D or A or Y or a conservative substitution thereof, X10 = Y or F or H or a conservative substitution thereof, X11 = A or V or S or a conservative substitution thereof. |
| | SEQ ID NO: 50128 | VL2 | X1 X2 X3 X4 Arg X5 X6, wherein X1 = G or D or V or a conservative substitution thereof, X2 = A or T or P or V or a conservative substitution thereof, X3 = S or F or Y or A or T or a conservative substitution thereof, X4 = S or R or N or A or a conservative substitution thereof, X5 = A or S or T or a conservative substitution thereof, X6 = T or P or S or A or a conservative substitution thereof. |
| | SEQ ID NO: 50129 | VL3 | X1 X2 X3 X4 X5 X6 X7 X8 X9 X10, wherein X1 = Q or H or a conservative substitution thereof, X2 = Q or H or a conservative substitution thereof, X3 = Y or S or a conservative substitution thereof, X4 = D or E or G or H or a conservative substitution thereof, X5 = N or S or Absent or R or T or L or D or G or a conservative substitution thereof, X6 = Absent or S or a conservative substitution thereof, X7 = S or P or N or R or a conservative substitution thereof, X8 = P or S or V or a conservative substitution thereof. |

FIGURE 55
(Continued)

| | | | |
|---|---|---|---|
| VL-CONSENSUS-18 TABLE 98 | SEQ ID NO: 50130 | VL1 | Arg X1 X2 X3 X4 Ile X5 X6 X7 Leu X8, wherein X1 = A or T or a conservative substitution thereof, X2 = S or T or a conservative substitution thereof, X3 = Q or R or a conservative substitution thereof, X4 = G or D or A or N or V or a conservative substitution thereof, X5 = R or G or a conservative substitution thereof, X6 = N or K or D or H or S or G or T or a conservative substitution thereof, X7 = D or I or Y or a conservative substitution thereof, X8 = G or N or a conservative substitution thereof. |
| | | | conservative substitution thereof, X9 = W or R or a conservative substitution thereof, X10 = T or A or a conservative substitution thereof. |
| | SEQ ID NO: 50131 | VL2 | X1 X2 X3 X4 X5 X6 X7, wherein X1 = A or T or I or V or P or G or R or S or a conservative substitution thereof, X2 = A or T or S or a conservative substitution thereof, X3 = S or A or F or P or Y or a conservative substitution thereof, X4 = S or N or R or G or T or a conservative substitution thereof, X5 = L or C or F or S or a conservative substitution thereof, X6 = Q or H or E or a conservative substitution thereof, X7 = S or N or G or I or a conservative substitution thereof. |
| | SEQ ID NO: 50132 | VL3 | X1 X2 X3 X4 X5 X6 X7 X8 X9 Thr, wherein X1 = L or V or I or H or a conservative substitution thereof, X2 = Q or M or H or L or V or a conservative substitution thereof, X3 = H or Q or Y or L or S or a conservative substitution thereof, X4 = Y or N or H or S or T or a conservative substitution thereof, X5 = S or N or T or R or D or F or G or a conservative substitution thereof, X6 = Absent or Y or F or a conservative substitution thereof, X7 = Y or F or P or C or N or T or a conservative substitution thereof, X8 = P or L or a conservative substitution thereof, X9 = R or W or F or L or a conservative substitution thereof. |
| VL-CONSENSUS-19 TABLE 99 | SEQ ID NO: 50133 | VL1 | X1 X2 X3 Gln Ser X4 Leu X5 X6 X7 X8 X9 X10 X11 X12 X13 X14, wherein X1 = K or R or M or a conservative substitution thereof, X2 = S or G or R or a conservative substitution thereof, X3 = S or T or N or I or a conservative substitution thereof, X4 = V or I or A or a conservative substitution thereof, X5 = H or Y or F or S or K or D or L or M or a conservative substitution thereof, X6 = S or T or R or N or I or D or a conservative substitution thereof, X7 = S or F or P or a conservative substitution thereof, X8 = N or H or a conservative substitution thereof, X9 = N or K or S or D or H or a conservative substitution thereof, X10 = N or Y or K or H or R or A or F or W or a conservative substitution thereof, X11 = N or H or Y or a |

FIGURE 55
(Continued)

| | | | |
|---|---|---|---|
| | SEQ ID NO: 50229 | VL2 | conservative substitution thereof, X12 = Y or S or a conservative substitution thereof, X13 = L or F or a conservative substitution thereof, X14 = A or T or V or G or a conservative substitution thereof. |
| | SEQ ID NO: 50134 | VL3 | Trp X1 X2 X3 X4 X5 X6, wherein X1 = A or T or S or a conservative substitution thereof, X2 = S or F or a conservative substitution thereof, X3 = T or I or K or S or a conservative substitution thereof, X4 = R or W or I or a conservative substitution thereof, X5 = E or K or A or D or R or a conservative substitution thereof, X6 = S or T or a conservative substitution thereof. |
| | SEQ ID NO: 50134 | VL3 | X1 X2 X3 X4 X5 X6 Pro X7 X8, wherein X1 = Q or H or L or a conservative substitution thereof, X2 = Q or H or a conservative substitution thereof, X3 = Y or F or a conservative substitution thereof, X4 = Y or F or H or N or L or S or a conservative substitution thereof, X5 = S or N or R or D or L or T or C or E or K or a conservative substitution thereof, X6 = T or S or I or V or A or Y or a conservative substitution thereof, X7 = P or W or L or V or C or G or R or S or a conservative substitution thereof, X8 = T or K or S or a conservative substitution thereof. |
| VL-CONSENSUS-20 TABLE 100 | SEQ ID NO: 50135 | VL1 | Arg X1 Ser Gln X2 X3 X4 X5 X6 X7 X8, wherein X1 = A or T or a conservative substitution thereof, X2 = G or D or V or a conservative substitution thereof, X3 = I or M or a conservative substitution thereof, X4 = R or S or a conservative substitution thereof, X5 = N or K or S or D or T or a conservative substitution thereof, X6 = D or N or H or Y or V or A or I or L or a conservative substitution thereof, X7 = L or F or a conservative substitution thereof, X8 = G or D or a conservative substitution thereof. |
| | SEQ ID NO: 50136 | VL2 | X1 X2 X3 X4 X5 X6 X7, wherein X1 = A or P or T or G or I or R or V or a conservative substitution thereof, X2 = A or V or a conservative substitution thereof, X3 = S or F or T or a conservative substitution thereof, X4 = S or N or T or D or a conservative substitution thereof, X5 = L or V or a conservative substitution thereof, X6 = Q or L or a conservative substitution thereof, X7 = S or N or T or G or R or a conservative substitution thereof. |
| | SEQ ID NO: 50137 | VL3 | X1 X2 X3 X4 X5 X6 X7 X8 X9, wherein X1 = L or I or a conservative substitution thereof, X2 = Q or H or L or a conservative substitution thereof, X3 = H or Y or D or L or a conservative substitution thereof, X4 = N or Y or T or H or G or I or a conservative substitution thereof, X5 = S or R or D or T or G or N or a conservative substitution thereof, X6 = Y or F or H or a conservative substitution thereof, X7 = P or L or a |

FIGURE 55
(Continued)

| | | | |
|---|---|---|---|
| VL-CONSENSUS-21 TABLE 101 | SEQ ID NO: 50138 | VL1 | conservative substitution thereof, X8 = F or L or a conservative substitution thereof, X9 = T or K or a conservative substitution thereof. |
| | | | Arg X1 X2 Gln X3 Ile X4 X5 X6 Leu X7, wherein X1 = A or T or a conservative substitution thereof, X2 = S or N or a conservative substitution thereof, X3 = G or D or A or V or S or a conservative substitution thereof, X4 = S or G or N or R or A or F or a conservative substitution thereof, X5 = N or K or R or H or S or T or I or a conservative substitution thereof, X6 = Y or H or C or D or a conservative substitution thereof, X7 = A or D or V or I or N or a conservative substitution thereof. |
| | SEQ ID NO: 50139 | VL2 | X1 X2 X3 X4 Leu X5 X6, wherein X1 = A or K or S or T or V or D or G or a conservative substitution thereof, X2 = A or T or V or a conservative substitution thereof, X3 = S or P or a conservative substitution thereof, X4 = S or N or R or a conservative substitution thereof, X5 = Q or L or E or H or a conservative substitution thereof, X6 = S or G or N or T or a conservative substitution thereof. |
| | SEQ ID NO: 50140 | VL3 | X1 X2 X3 X4 X5 X6 Pro X7 X8, wherein X1 = Q or L or H or a conservative substitution thereof, X2 = Q or H or R or Y or a conservative substitution thereof, X3 = Y or S or C or T or a conservative substitution thereof, X4 = S or L or N or M or D or H or V or L or Y or a conservative substitution thereof, X5 = T or N or S or K or a conservative substitution thereof, X6 = Y or F or I or S or a conservative substitution thereof, X7 = L or V or F or N or a conservative substitution thereof, X8 = T or I or Q or S or a conservative substitution thereof. |
| VL-CONSENSUS-22 TABLE 102 | SEQ ID NO: 50141 | VL1 | Arg X1 X2 X3 X4 X5 X6 X7 X8 Leu X9, wherein X1 = A or T or a conservative substitution thereof, X2 = S or T or a conservative substitution thereof, X3 = Q or H or R or a conservative substitution thereof, X4 = N or S or R or T or I or a conservative substitution thereof, X5 = I or V or F or I or a conservative substitution thereof, X6 = I or S or N or Y or V or F or R or H or L or K or T or a conservative substitution thereof, X7 = S or N or D or R or K or T or a conservative substitution thereof, X8 = Y or F or a conservative substitution thereof, X9 = N or H or a conservative substitution thereof. |
| | SEQ ID NO: 50142 | VL2 | X1 X2 Ser X3 X4 X5 X6, wherein X1 = T or A or V or G or I or S or a conservative substitution thereof, X2 = A or T or a conservative substitution thereof, X3 = S or N or R or T or a conservative substitution thereof, X4 = L or F or S or a conservative substitution thereof, X5 = Q or H or E or P or a conservative substitution thereof. |

FIGURE 55
(Continued)

| | SEQ ID NO: 50143 | VL3 | X6 = S or G or T or N or R or a conservative substitution thereof. |
|---|---|---|---|
| | | | Gln X1 X2 X3 X4 X5 X6 X7 Thr, wherein X1 = Q or L or P or a conservative substitution thereof, X2 = S or T or N or P or a conservative substitution thereof, X3 = Y or H or C or D or F or N or a conservative substitution thereof, X4 = S or Absent or I or N or F or G or T or a conservative substitution thereof, X5 = T or S or P or F or N or I or L or a conservative substitution thereof, X6 = P or T or I or A or S or a conservative substitution thereof, X7 = L or P or Y or F or V or a conservative substitution thereof. |
| VL-CONSENSUS-23 TABLE 103 | SEQ ID NO: 50144 | VL1 | X1 X2 X3 X4 X5 X6 X7 X8 X9 Leu X10, wherein X1 = R or P or a conservative substitution thereof, X2 = A or T or a conservative substitution thereof, X3 = S or N or a conservative substitution thereof, X4 = Q or R or a conservative substitution thereof, X5 = G or D or V or A or a conservative substitution thereof, X6 = I or V or a conservative substitution thereof, X7 = S or N or G or R or T or a conservative substitution thereof, X8 = N or K or Y or H or I or T or a conservative substitution thereof, X9 = Y or H or a conservative substitution thereof, X10 = A or V or S or a conservative substitution thereof. |
| | SEQ ID NO: 50145 | VL2 | X1 X2 X3 X4 X5 X6 X7, wherein X1 = A or V or G or T or a conservative substitution thereof, X2 = A or S or V or a conservative substitution thereof, X3 = S or F or a conservative substitution thereof, X4 = S or G or N or T or a conservative substitution thereof, X5 = L or V or a conservative substitution thereof, X6 = Q or R or H or L or E or a conservative substitution thereof, X7 = S or G or T or a conservative substitution thereof. |
| | SEQ ID NO: 50146 | VL3 | X1 X2 X3 X4 X5 X6 Pro X7 X8, wherein X1 = Q or H or L or P or R or a conservative substitution thereof, X2 = Q or R or K or H or L or a conservative substitution thereof, X3 = Y or F or a conservative substitution thereof, X4 = N or H or D or Y or S or K or L or M or Q or a conservative substitution thereof, X5 = S or T or G or N or C or D or a conservative substitution thereof, X6 = Y or F or H or a conservative substitution thereof, X7 = F or V or L or I or a conservative substitution thereof, X8 = T or K or a conservative substitution thereof. |
| VL-CONSENSUS-24 TABLE 104 | SEQ ID NO: 50147 | VL1 | Arg X1 X2 X3 X4 X5 X6 X7 X8 X9 X10, wherein X1 = A or V or E or G or a conservative substitution thereof, X2 = S or G or a conservative substitution thereof, X3 = Q or R or a conservative substitution thereof, X4 = G or D or N or A or L or V or a |

FIGURE 55
(Continued)

| | | | |
|---|---|---|---|
| | | | conservative substitution thereof, X5 = I or V or F or a conservative substitution thereof, X6 = S or N or T or R or I or a conservative substitution thereof, X7 = R or S or N or K or T or D or I or G or a conservative substitution thereof, X8 = W or Y or a conservative substitution thereof, X9 = L or I or a conservative substitution thereof, 10 = A or T or V or a conservative substitution thereof. |
| | SEQ ID NO: 50148 | VL2 | X1 X2 X3 X4 X5 X6 X7, wherein X1 = A or G or T or D or V or a conservative substitution thereof, X2 = A or T or V or a conservative substitution thereof, X3 = S or Y or a conservative substitution thereof, X4 = S or R or N or T or G or I or a conservative substitution thereof, X5 = L or F or a conservative substitution thereof, X6 = Q or E or a conservative substitution thereof, X7 = S or G or N or D or a conservative substitution thereof. |
| | SEQ ID NO: 50149 | VL3 | X1 Gln X2 X3 X4 X5 Pro X6 Thr, wherein X1 = Q or H or a conservative substitution thereof, X2 = A or T or G or S or V or D or a conservative substitution thereof, X3 = N or D or K or S or a conservative substitution thereof, X4 = S or I or a conservative substitution thereof, X5 = F or L or I or V or a conservative substitution thereof, X6 = F or I or a conservative substitution thereof. |
| VL-CONSENSUS-25 TABLE 105 | SEQ ID NO: 50150 | VL1 | X1 Ser X2 X3 X4 Leu X5 X6 X7 X8 Gly X9 Thr X10 X11 X12, wherein X1 = K or M or R or T or a conservative substitution thereof, X2 = S or G or T or a conservative substitution thereof, X3 = Q or K or a conservative substitution thereof, X4 = S or R or N or T or a conservative substitution thereof, X5 = L or R or V or a conservative substitution thereof, X6 = H or Y or a conservative substitution thereof, X7 = G or S or a conservative substitution thereof, X8 = D or E or G or a conservative substitution thereof, X9 = K or R or a conservative substitution thereof, X10 = Y or P or a conservative substitution thereof, X11 = L or F or a conservative substitution thereof, X12 = Y or F or T or C or S or a conservative substitution thereof. |
| | SEQ ID NO: 50151 | VL2 | X1 X2 Ser X3 Arg X4 X5, wherein X1 = E or A or a conservative substitution thereof, X2 = V or I or L or T or a conservative substitution thereof, X3 = N or K or H or I or S or a conservative substitution thereof, X4 = F or I or a conservative substitution thereof, X5 = S or A or T or C or P or a conservative substitution thereof. |
| | SEQ ID NO: 50152 | VL3 | X1 Gln X2 X3 X4 X5 Pro X6 Thr, wherein X1 = M or K or a conservative substitution thereof, X2 = S or T or a conservative substitution thereof, X3 = I or T or F or L or a conservative substitution thereof, X4 = Q or H or L or a conservative substitution thereof, X5 = L or I or V or a conservative substitution thereof. |

FIGURE 55
(Continued)

| | | | |
|---|---|---|---|
| | | | F or a conservative substitution thereof, X6 = W or R or a conservative substitution thereof. |
| VL-CONSENSUS-26 TABLE 106 | SEQ ID NO: 50153 | VL1 | Arg X1 X2 X3 X4 X5 X6 X7 X8 X9 X10, wherein X1 = A or S or T or a conservative substitution thereof, X2 = S or G or I or a conservative substitution thereof, X3 = Q or H or R or a conservative substitution thereof, X4 = S or N or T or a conservative substitution thereof, X5 = I or F or a conservative substitution thereof, X6 = S or I or F or N or R or Y or T or A or G or L or a conservative substitution thereof, X7 = S or N or T or H or K or a conservative substitution thereof, X8 = Y or F or H or a conservative substitution thereof, X9 = L or V or a conservative substitution thereof, X10 = N or I or M or H or Y or a conservative substitution thereof. |
| | SEQ ID NO: 50154 | VL2 | X1 X2 X3 X4 Leu X5 X6, wherein X1 = A or G or T or V or I or a conservative substitution thereof, X2 = A or T or V or S or a conservative substitution thereof, X3 = S or F or a conservative substitution thereof, X4 = S or N or T or V or a conservative substitution thereof, X5 = Q or H or a conservative substitution thereof, X6 = S or N or G or H or I or T or a conservative substitution thereof. |
| | SEQ ID NO: 50155 | VL3 | Gln Gln X1 X2 X3 X4 X5 X6 Phe X7, wherein X1 = S or T or Y or a conservative substitution thereof, X2 = Y or N or F or H or a conservative substitution thereof, X3 = S or R or N or F or I or a conservative substitution thereof, X4 = Absent or A or S or a conservative substitution thereof, X5 = P or T or I or F or A or L or V or a conservative substitution thereof, X6 = P or L or F or S or a conservative substitution thereof, X7 = T or A or S or a conservative substitution thereof. |
| VL-CONSENSUS-27 TABLE 107 | SEQ ID NO: 50156 | VL1 | X1 Ser X2 Gln X3 X4 Leu X5 X6 Ser X7 X8 X9 X10 X11 Leu X12, wherein X1 = K or R or T or a conservative substitution thereof, X2 = S or I or a conservative substitution thereof, X3 = S or N or a conservative substitution thereof, X4 = V or I or a conservative substitution thereof, X5 = Y or H or S or F or a conservative substitution thereof, X6 = S or N or I or R or H or a conservative substitution thereof, X7 = N or H or a conservative substitution thereof, X8 = N or S or D or a conservative substitution thereof, X9 = N or Y or K or H or A or M or Q or a conservative substitution thereof, X10 = N or K or a conservative substitution thereof, X11 = Y or F or a conservative substitution thereof, X12 = A or T or D or a conservative substitution thereof. |
| | SEQ ID NO: 50157 | VL2 | Trp X1 X2 X3 Arg X4 X5, wherein X1 = A or T or G or S or a conservative substitution thereof, X2 = S or F |

FIGURE 55
(Continued)

| | | | |
|---|---|---|---|
| | SEQ ID NO: 50158 | VL3 | or a conservative substitution thereof, X3 = T or I or a conservative substitution thereof, X4 = E or K or D or a conservative substitution thereof, X5 = S or F or a conservative substitution thereof. |
| VL-CONSENSUS-28 TABLE 108 | SEQ ID NO: 50159 | VL1 | X1 X2 X3 X4 X5 X6 X7 X8 X9, wherein X1 = Q or H or a conservative substitution thereof, X2 = Q or H or a conservative substitution thereof, X3 = Y or S or a conservative substitution thereof, X4 = Y or F or K or N or a conservative substitution thereof, X5 = S or T or I or Absent or N or a conservative substitution thereof, X6 = T or S or I or R or A or G or N or a conservative substitution thereof, X7 = P or S or a conservative substitution thereof, X8 = C or Y or G or L or P or a conservative substitution thereof, X9 = S or K or N or a conservative substitution thereof. |
| | SEQ ID NO: 50159 | VL1 | Arg Ala X1 Gln X2 X3 X4 X5 X6 Leu Ala, wherein X1 = S or N or a conservative substitution thereof, X2 = G or D or F or N or V or a conservative substitution thereof, X3 = I or L or V or a conservative substitution thereof, X4 = S or N or T or I or F or G or a conservative substitution thereof, X5 = N or S or D or T or R or a conservative substitution thereof, X6 = W or C or a conservative substitution thereof. |
| | SEQ ID NO: 50160 | VL2 | X1 X2 X3 X4 Leu Gln X5, wherein X1 = A or G or D or T or S or a conservative substitution thereof, X2 = A or V or P or T or a conservative substitution thereof, X3 = S or F or a conservative substitution thereof, X4 = S or N or a conservative substitution thereof, X5 = S or G or N or a conservative substitution thereof. |
| | SEQ ID NO: 50161 | VL3 | X1 Gln X2 X3 Ser X4 Pro X5 Thr, wherein X1 = Q or L or a conservative substitution thereof, X2 = A or T or S or G or V or Y or a conservative substitution thereof, X3 = N or D or H or Y or a conservative substitution thereof, X4 = F or L or a conservative substitution thereof, X5 = W or R or P or a conservative substitution thereof. |
| VL-CONSENSUS-29 TABLE 109 | SEQ ID NO: 50162 | VL1 | Lys Ser X1 Gln X2 X3 X4 X5 X6 Ser X7 X8 X9 X10 Tyr Leu X11, wherein X1 = S or N or a conservative substitution thereof, X2 = S or R or N or a conservative substitution thereof, X3 = V or I or L or a conservative substitution thereof, X4 = L or F or a conservative substitution thereof, X5 = H or F or Y or K or S or a conservative substitution thereof, X6 = S or N or H or a conservative substitution thereof, X7 = N or H or a conservative substitution thereof, X8 = N or S or a conservative substitution thereof, X9 = N or K or Y or H or a conservative substitution thereof, X10 = N or R |

FIGURE 55
(Continued)

| | | | |
|---|---|---|---|
| | SEQ ID NO: 50163 | VL2 | or S or a conservative substitution thereof, X11 = A or T or V or a conservative substitution thereof. |
| | | | Trp Ala Ser X1 X2 X3 Ser, wherein X1 = T or A or I or S or a conservative substitution thereof, X2 = R or L or a conservative substitution thereof, X3 = E or K or D or a conservative substitution thereof. |
| | SEQ ID NO: 50164 | VL3 | X1 Gln X2 X3 X4 X5 Pro X6 Thr, wherein X1 = Q or H or a conservative substitution thereof, X2 = Y or S or a conservative substitution thereof, X3 = Y or C or F or S or H or a conservative substitution thereof, X4 = S or N or Q or D or T or a conservative substitution thereof, X5 = T or L or I or A or F or S or a conservative substitution thereof, X6 = V or F or P or a conservative substitution thereof. |
| VL-CONSENSUS-30 TABLE 110 | SEQ ID NO: 50165 | VL1 | X1 X2 X3 Thr X4 X5 Val Thr Ser X6 X7 X8 Pro X9, wherein X1 = A or V or G or a conservative substitution thereof, X2 = S or F or L or a conservative substitution thereof, X3 = S or N or a conservative substitution thereof, X4 = G or E or a conservative substitution thereof, X5 = A or S or T or a conservative substitution thereof, X6 = G or A or a conservative substitution thereof, X7 = Y or S or N or F or a conservative substitution thereof, X8 = Y or F or a conservative substitution thereof, X9 = N or S or Q or a conservative substitution thereof. |
| | SEQ ID NO: 50166 | VL2 | X1 Thr X2 Asn X3 His Ser, wherein X1 = S or H or N or a conservative substitution thereof, X2 = S or N or D or I or T or a conservative substitution thereof, X3 = K or R or a conservative substitution thereof. |
| | SEQ ID NO: 50167 | VL3 | X1 X2 X3 X4 X5 Gly X6 X7 X8 X9, wherein X1 = L or M or a conservative substitution thereof, X2 = L or I or F or a conservative substitution thereof, X3 = Y or C or F or a conservative substitution thereof, X4 = Y or C or F or S or a conservative substitution thereof, X5 = G or D or a conservative substitution thereof, X6 = A or V or a conservative substitution thereof, X7 = Q or H or a conservative substitution thereof, X8 = L or V or M or a conservative substitution thereof, X9 = V or A or I or G or M or a conservative substitution thereof. |
| VL-CONSENSUS-31 TABLE 111 | SEQ ID NO: 50168 | VL1 | Arg X1 Ser X2 X3 X4 X5 X6 X7 Leu Ala, wherein X1 = A or S or a conservative substitution thereof, X2 = Q or L or M or V or a conservative substitution thereof, X3 = S or N or D or R or T or a conservative substitution thereof, X4 = V or I or a conservative substitution thereof, X5 = N or K or S or V or A or I or L or a conservative substitution thereof, X6 = S or N or T or a conservative substitution thereof, X7 = N or S or Y or a conservative substitution thereof. |

FIGURE 55
(Continued)

| | SEQ ID NO: 50169 | VL2 | X1 X2 Ser X3 Arg Ala Thr, wherein X1 = G or I or F or V or a conservative substitution thereof, X2 = A or T or a conservative substitution thereof, X3 = T or I or a conservative substitution thereof. |
|---|---|---|---|
| | SEQ ID NO: 50170 | VL3 | Gln X1 X2 X3 X4 X5 X6 X7 Cys Ser, wherein X1 = Q or E or a conservative substitution thereof, X2 = Y or F or a conservative substitution thereof, X3 = N or Y or D or a conservative substitution thereof, X4 = D or N or a conservative substitution thereof, X5 = Absent or W or a conservative substitution thereof, X6 = W or P or a conservative substitution thereof, X7 = P or L or M or a conservative substitution thereof. |
| VL-CONSENSUS-32 TABLE 112 | SEQ ID NO: 50171 | VL1 | Arg X1 Ser X2 X3 X4 X5 X6 X7 X8 Leu X9, wherein X1 = A or S or a conservative substitution thereof, X2 = Q or E or a conservative substitution thereof, X3 = S or R or a conservative substitution thereof, X4 = V or I or a conservative substitution thereof, X5 = S or T or a conservative substitution thereof, X6 = S or T or a conservative substitution thereof, X7 = S or N or a conservative substitution thereof, X8 = Y or A or a conservative substitution thereof, X9 = V or S or a conservative substitution thereof. |
| | SEQ ID NO: 50172 | VL2 | Gly Ala Ser X1 Arg Ala X2, wherein X1 = T or S or a conservative substitution thereof, X2 = T or S or I or a conservative substitution thereof. |
| | SEQ ID NO: 50173 | VL3 | Gln Gln Tyr X1 X2 Ser X3 Leu Thr wherein X1 = G or V or a conservative substitution thereof, X2 = C or N or S or a conservative substitution thereof, X3 = P or L or a conservative substitution thereof. |
| VL-CONSENSUS-33 TABLE 113 | SEQ ID NO: 50174 | VL1 | Lys Ser Ser Gln X1 Leu X2 X3 X4 X5 Gly X6 Thr X7 Leu X8, wherein X1 = S or T or a conservative substitution thereof, X2 = L or Q or a conservative substitution thereof, X3 = H or R or a conservative substitution thereof, X4 = S or G or a conservative substitution thereof, X5 = E or D or a conservative substitution thereof, X6 = K or R or a conservative substitution thereof, X7 = Y or H or F or a conservative substitution thereof, X8 = Y or N or a conservative substitution thereof. |
| | SEQ ID NO: 50175 | VL2 | Glu X1 Ser X2 Arg X3 Ser, wherein X1 = V or I or a conservative substitution thereof, X2 = N or Y or H or a conservative substitution thereof, X3 = F or I or V or L or a conservative substitution thereof. |
| | SEQ ID NO: 50176 | VL3 | X1 X2 X3 X4 X5 X6 X7 X8 X9, wherein X1 = M or F or a conservative substitution thereof, X2 = Q or H or a conservative substitution thereof, X3 = S or G or N or a conservative substitution thereof, X4 = I or K or T or a conservative substitution thereof, X5 = Q or Absent or |

FIGURE 55
(Continued)

| | | | |
|---|---|---|---|
| | | | K or H or a conservative substitution thereof, X6 = L or Q or Y or F or H or a conservative substitution thereof, X7 = P or L or V or a conservative substitution thereof, X8 = L or F or P or a conservative substitution thereof, X9 = T or P or S or a conservative substitution thereof. |
| VL-CONSENSUS-34 TABLE 114 | SEQ ID NO: 50177 | VL1 | Thr Gly Thr Ser Asp X1 Gly X2 Tyr Asn X3 Val Ser, wherein X1 = V or I or a conservative substitution thereof, X2 = G or S or a conservative substitution thereof, X3 = Y or F or a conservative substitution thereof. |
| | SEQ ID NO: 50178 | VL2 | Glu Val X1 Asn Arg Pro Ser, wherein X1 = S or R or a conservative substitution thereof. |
| | SEQ ID NO: 50179 | VL3 | X1 Ser Tyr X2 X3 X4 X5 Thr Trp Val, wherein X1 = N or G or C or S or a conservative substitution thereof, X2 = T or V or K or a conservative substitution thereof, X3 = R or S or K or a conservative substitution thereof, X4 = S or G or N or R or a conservative substitution thereof, X5 = I or S or Y or a conservative substitution thereof. |
| VL-CONSENSUS-35 TABLE 115 | SEQ ID NO: 50180 | VL1 | Arg X1 Ser X2 X3 Ile X4 X5 X6 Leu Asn, wherein X1 = A or S or a conservative substitution thereof, X2 = Q or H or R or a conservative substitution thereof, X3 = S or N or T or H or a conservative substitution thereof, X4 = S or N or G or T or a conservative substitution thereof, X5 = N or S or R or a conservative substitution thereof, X6 = Y or F or a conservative substitution thereof. |
| | SEQ ID NO: 50181 | VL2 | X1 X2 X3 X4 Leu X5 X6, wherein X1 = A or T or S or V or a conservative substitution thereof, X2 = A or T or E or V or a conservative substitution thereof, X3 = S or L or a conservative substitution thereof, X4 = S or N or a conservative substitution thereof, X5 = Q or H or a conservative substitution thereof, X6 = S or I or a conservative substitution thereof. |
| | SEQ ID NO: 50182 | VL3 | Glu Glu X1 Tyr X2 X3 X4 X5 Trp Thr, wherein X1 = S or G or T or a conservative substitution thereof, X2 = S or T or N or R or a conservative substitution thereof, X3 = T or S or Absent or a conservative substitution thereof, X4 = P or I or a conservative substitution thereof, X5 = T or P or Q or L or a conservative substitution thereof. |
| VL-CONSENSUS-36 TABLE 116 | SEQ ID NO: 50183 | VL1 | Arg Ala Ser Gln X1 Ile Ser X2 X3 Leu Ala, wherein X1 = G or D or a conservative substitution thereof, X2 = S or N or I or K or a conservative substitution thereof, X3 = W or Y or a conservative substitution thereof. |
| | SEQ ID NO: 50184 | VL2 | Ala Ala Ser Leu Gln X1, wherein X1 = S or G or a conservative substitution thereof. |

FIGURE 55
(Continued)

| | | | |
|---|---|---|---|
| | SEQ ID NO: 50185 | VL3 | Gln Glu X1 X2 Ser Phe Pro Leu Thr, wherein X1 = I or T or V or A or G or a conservative substitution thereof, X2 = N or K or a conservative substitution thereof. |
| VL-CONSENSUS-37 TABLE 117 | SEQ ID NO: 50186 | VL1 | Gln Ala X1 Gln X2 Ile X3 X4 X5 Leu Asn, wherein X1 = S or N or a conservative substitution thereof, X2 = D or Y or a conservative substitution thereof, X3 = N or S or T or F or Y or a conservative substitution thereof, X4 = N or D or a conservative substitution thereof, X5 = Y or F or a conservative substitution thereof. |
| | SEQ ID NO: 50187 | VL2 | Asp X1 Ser X2 Leu Glu Thr, wherein X1 = A or G or a conservative substitution thereof, X2 = N or T or D or S or a conservative substitution thereof. |
| | SEQ ID NO: 50188 | VL3 | Gln Gln X1 X2 X3 X4 X5 Ile Thr, wherein X1 = Y or F or a conservative substitution thereof, X2 = D or E or a conservative substitution thereof, X3 = N or Absent or I or a conservative substitution thereof, X4 = L or N or V or a conservative substitution thereof, X5 = P or L or a conservative substitution thereof. |
| VL-CONSENSUS-38 TABLE 118 | SEQ ID NO: 50189 | VL1 | Ser Gly Ser Ser Asn X1 Gly X2 X3 X4 X5 Ser, wherein X1 = I or L or a conservative substitution thereof, X2 = N or S or a conservative substitution thereof, X3 = N or H or K or a conservative substitution thereof, X4 = Y or F or a conservative substitution thereof, X5 = V or L or a conservative substitution thereof. |
| | SEQ ID NO: 50190 | VL2 | Asp X1 X2 Lys Arg Pro Ser, wherein X1 = N or S or a conservative substitution thereof, X2 = N or Y or S or a conservative substitution thereof. |
| | SEQ ID NO: 50191 | VL3 | Gly X1 Trp Asp X2 X3 Leu X4 X5 X6 Val, wherein X1 = T or A or I or a conservative substitution thereof, X2 = S or G or I or R or a conservative substitution thereof, X3 = S or R or a conservative substitution thereof, X4 = S or N or a conservative substitution thereof, X5 = V or A or T or a conservative substitution thereof, X6 = G or V or M or a conservative substitution thereof. |
| VL-CONSENSUS-39 TABLE 119 | SEQ ID NO: 50243 | VL1 | Arg X1 Ser Gln Ser Leu X2 X3 X4 X5 X6 X7 Asn X8 Leu Asp, wherein X1 = S or Y or a conservative substitution thereof, X2 = L or V or a conservative substitution thereof, X3 = H or Y or a conservative substitution thereof, X4 = S or N or H or a conservative substitution thereof, X5 = N or S or a conservative substitution thereof, X6 = G or K or R or a conservative substitution thereof, X7 = Y or H or N or a conservative substitution thereof, X8 = Y or H or S or a conservative substitution thereof. |

FIGURE 55
(Continued)

| | SEQ ID NO: 50244 | VL2 | X1 Gly Ser X2 Arg Ala Ser, wherein X1 = L or V or a conservative substitution thereof, X2 = N or H or a conservative substitution thereof. |
|---|---|---|---|
| | SEQ ID NO: 50245 | VL3 | Met Gln X1 Leu X2 X3 X4 X5 X6 Thr, wherein X1 = A or P or T or V or a conservative substitution thereof, X2 = H or Q or Absent or a conservative substitution thereof, X3 = Absent or T or a conservative substitution thereof, X4 = P or Q or T or I or a conservative substitution thereof, X5 = P or T or a conservative substitution thereof, X6 = L or P or F or a conservative substitution thereof. |
| VL-CONSENSUS-40 TABLE 120 | SEQ ID NO: 50192 | VL1 | Ser Gly X1 X2 Ser X3 Ile Gly X4 X5 X6 X7 X8, wherein X1 = S or T or a conservative substitution thereof, X2 = S or N or a conservative substitution thereof, X3 = N or Y or a conservative substitution thereof, X4 = S or N or Y or a conservative substitution thereof, X5 = N or Y or a conservative substitution thereof, X6 = T or A or S or a conservative substitution thereof, X7 = V or I or a conservative substitution thereof, X8 = N or D or S or a conservative substitution thereof. |
| | SEQ ID NO: 50193 | VL2 | X1 X2 X3 X4 Arg Pro Ser, wherein X1 = S or I or a conservative substitution thereof, X2 = N or S or a conservative substitution thereof, X3 = N or D or S or a conservative substitution thereof, X4 = Q or H or a conservative substitution thereof. |
| | SEQ ID NO: 50194 | VL3 | X1 Ala Trp Asp Asp X2 X3 X4 X5 X6 X7 X8, wherein X1 = A or E or a conservative substitution thereof, X2 = S or Absent or a conservative substitution thereof, X3 = Absent or L or a conservative substitution thereof, X4 = L or N or M or S or a conservative substitution thereof, X5 = N or G or K or L or a conservative substitution thereof, X6 = G or H or N or a conservative substitution thereof, X7 = V or P or G or a conservative substitution thereof, X8 = V or P or a conservative substitution thereof. |
| VL-CONSENSUS-41 TABLE 121 | SEQ ID NO: 50195 | VL1 | Ser Gly Ser X1 Ser Asn Ile Gly X2 X3 X4 Val X5, wherein X1 = S or N or C or a conservative substitution thereof, X2 = S or N or a conservative substitution thereof, X3 = N or H or a conservative substitution thereof, X4 = I or T or a conservative substitution thereof, X5 = T or N or a conservative substitution thereof. |
| | SEQ ID NO: 50196 | VL2 | X1 Asn X2 Gln Arg Pro Ser, wherein X1 = S or G or N or V or a conservative substitution thereof, X2 = D or K or N or Y or a conservative substitution thereof. |
| | SEQ ID NO: 50197 | VL3 | X1 X2 Trp Asp Ser Leu X3 X4 Trp Val, wherein X1 = A or T or a conservative substitution thereof, X2 = |

FIGURE 55
(Continued)

| | | | |
|---|---|---|---|
| VL-CONSENSUS-42 TABLE 122 | SEQ ID NO: 50198 | VL1 | A or T or V or a conservative substitution thereof, X3 = N or I or S or a conservative substitution thereof, X4 = G or D or V or a conservative substitution thereof. |
| | SEQ ID NO: 50199 | VL2 | Arg X1 Ser Gln X2 X3 Arg X4 Asp Leu Gly, wherein X1 = A or T or a conservative substitution thereof, X2 = G or D or R or a conservative substitution thereof, X3 = I or V or a conservative substitution thereof, X4 = N or S or a conservative substitution thereof. |
| | SEQ ID NO: 50200 | VL3 | X1 Ala Ser X2 Leu X3 Ser, wherein X1 = A or D or I or T or a conservative substitution thereof, X2 = S or N or a conservative substitution thereof, X3 = Q or E or F or L or a conservative substitution thereof. |
| | | | X1 X2 X3 X4 X5 X6 X7 Pro X8 Thr wherein, X1 = L or I or a conservative substitution thereof, X2 = Q or H or a conservative substitution thereof, X3 = H or Y or a conservative substitution thereof, X4 = N or H or S or a conservative substitution thereof, X5 = S or N or a conservative substitution thereof, X6 = Absent or Y or a conservative substitution thereof, X7 = Y or L or F or P or a conservative substitution thereof, X8 = I or P or L or a conservative substitution thereof. |
| VL-CONSENSUS-43 TABLE 123 | SEQ ID NO: 50201 | VL1 | Arg X1 Ser Gln X2 X3 X4 X5 Tyr X6 X7, wherein X1 = A or T or a conservative substitution thereof, X2 = S or N or Y or a conservative substitution thereof, X3 = I or S or F or a conservative substitution thereof, X4 = S or F or N or R or T or a conservative substitution thereof, X5 = S or D or G or R or a conservative substitution thereof, X6 = L or S or a conservative substitution thereof, X7 = N or S or a conservative substitution thereof. |
| | SEQ ID NO: 50202 | VL2 | X1 X2 X3 X4 X5 X6 X7, wherein X1 = A or D or G or S or a conservative substitution thereof, X2 = A or T or a conservative substitution thereof, X3 = S or Y or a conservative substitution thereof, X4 = S or T or a conservative substitution thereof, X5 = L or F or a conservative substitution thereof, X6 = Q or E or K or a conservative substitution thereof, X7 = S or T or a conservative substitution thereof. |
| | SEQ ID NO: 50203 | VL3 | X1 X2 X3 X4 X5 X6 X7 X8 X9, wherein X1 = Q or H or a conservative substitution thereof, X2 = Q or E or a conservative substitution thereof, X3 = S or T or a conservative substitution thereof, X4 = Y or F or a conservative substitution thereof, X5 = S or G or N or a conservative substitution thereof, X6 = I or T or L or N or S or a conservative substitution thereof, X7 = P or S or R or T or a conservative substitution thereof, X8 = I or F or P or a conservative substitution thereof, X9 = T or A or a conservative substitution thereof. |

FIGURE 55
(Continued)

| | | | |
|---|---|---|---|
| VL-CONSENSUS-44 TABLE 124 | SEQ ID NO: 50204 | VL1 | X1 X2 X3 Gln X4 X5 X6 His X7 X8 Gly X9 Thr Tyr Leu Tyr, wherein X1 = K or R or a conservative substitution thereof, X2 = S or T or a conservative substitution thereof, X3 = S or N or a conservative substitution thereof, X4 = S or I or a conservative substitution thereof, X5 = L or F or a conservative substitution thereof, X6 = L or V or a conservative substitution thereof, X7 = S or N or R or a conservative substitution thereof, X8 = E or D or a conservative substitution thereof, X9 = K or R or a conservative substitution thereof. |
| | SEQ ID NO: 50205 | VL2 | Glu X1 Ser X2 Arg X3 Ser, wherein X1 = V or L or a conservative substitution thereof, X2 = N or K or H or a conservative substitution thereof, X3 = F or L or V or a conservative substitution thereof. |
| | SEQ ID NO: 50246 | VL3 | X1 Gln Ser X2 X3 X4 X5 Ile X6, wherein X1 = M or I or L or a conservative substitution thereof, X2 = I or M or a conservative substitution thereof, X3 = Q or Absent or L or a conservative substitution thereof, X4 = L or Y or I or Q or a conservative substitution thereof, X5 = P or L or a conservative substitution thereof, X6 = T or I or a conservative substitution thereof. |
| VL-CONSENSUS-45 TABLE 125 | SEQ ID NO: 50206 | VL1 | Arg Ala Ser X1 X2 X3 X4 X5 X6 X7 Leu Ala, wherein X1 = Q or R or a conservative substitution thereof, X2 = S or G or N or a conservative substitution thereof, X3 = V or I or a conservative substitution thereof, X4 = I or S or G or a conservative substitution thereof, X5 = S or N or a conservative substitution thereof, X6 = S or I or N or a conservative substitution thereof, X7 = Y or F or a conservative substitution thereof. |
| | SEQ ID NO: 50207 | VL2 | Gly X1 Ser X2 X1 Ala Thr, wherein X1 = V or A or T or a conservative substitution thereof, X2 = S or N or T or a conservative substitution thereof, X3 = R or W or a conservative substitution thereof. |
| | SEQ ID NO: 50208 | VL3 | X1 X2 X3 X4 X5 Ser X6 X7 Asn, wherein X1 = Q or H or a conservative substitution thereof, X2 = Q or H or a conservative substitution thereof, X3 = Y or N or a conservative substitution thereof, X4 = G or D or a conservative substitution thereof, X5 = R or Absent or N or Y or a conservative substitution thereof, X6 = P or L or M or a conservative substitution thereof, X7 = N or T or a conservative substitution thereof. |
| VL-CONSENSUS-46 TABLE 126 | SEQ ID NO: 50209 | VL1 | Arg X1 Ser Gln X2 X3 X4 X5 X6 X7 Ala, wherein X1 = A or S or a conservative substitution thereof, X2 = S or D or T or a conservative substitution thereof, X3 = V or I or a conservative substitution thereof, X4 = S or N or R or I or a conservative substitution thereof, X5 = S or |

FIGURE 55
(Continued)

| | | | |
|---|---|---|---|
| | SEQ ID NO: 50210 | VL2 | or I or T or a conservative substitution thereof, X6 = N or Y or a conservative substitution thereof, X7 = L or I or a conservative substitution thereof. |
| | | | Gly Ala Ser Thr Arg Ala X1, wherein X1 = T or S or a conservative substitution thereof. |
| | SEQ ID NO: 50211 | VL3 | Gln X1 X2 X3 X4 X5 X6 X7 X8 X9, wherein X1 = Q or E or a conservative substitution thereof, X2 = Y or S or a conservative substitution thereof, X3 = N or D or F or H or a conservative substitution thereof, X4 = D or N or Absent or T or a conservative substitution thereof, X5 = Absent or W or a conservative substitution thereof, X6 = W or P or C or N or a conservative substitution thereof, X7 = P or L or W or a conservative substitution thereof, X8 = W or L or C or P or R or a conservative substitution thereof, X9 = T or P or S or a conservative substitution thereof. |
| VL-CONSENSUS-47 TABLE 127 | SEQ ID NO: 50256 | VL1 | Arg Ala Ser Gln X1 Ile Gly X2 X3 Leu His, wherein X1 = S or N or a conservative substitution thereof, X2 = S or N or a conservative substitution thereof, X3 = S or N or T or a conservative substitution thereof. |
| | SEQ ID NO: 50257 | VL2 | X1 Ala Ser Gln Ser Phe Ser, wherein X1 = Y or S or a conservative substitution thereof. |
| | SEQ ID NO: 50258 | VL3 | X1 Gln Ser X2 Ser X3 Pro X4 Thr, wherein X1 = H or Q or a conservative substitution thereof, X2 = S or G or R or a conservative substitution thereof, X3 = L or F or a conservative substitution thereof, X4 = W or R or Q or a conservative substitution thereof. |
| VL-CONSENSUS-48 TABLE 128 | SEQ ID NO: 50247 | VL1 | Arg Ala Ser Gln X1 Ile X2 X3 Asp Leu Gly, wherein X1 = G or A or a conservative substitution thereof, X2 = R or G or a conservative substitution thereof, X3 = N or D or a conservative substitution thereof. |
| | SEQ ID NO: 50248 | VL2 | Ala X1 Ser Ser Leu Gln Ser, wherein X1 = A or T or a conservative substitution thereof. |
| | SEQ ID NO: 50249 | VL3 | Leu Gln His X1 X2 X3 Pro X4 Ser, wherein X1 = Y or N or a conservative substitution thereof, X2 = S or N or a conservative substitution thereof, X3 = Y or F or a conservative substitution thereof, X4 = R or Y or a conservative substitution thereof. |
| VL-CONSENSUS-49 TABLE 129 | SEQ ID NO: 50212 | VL1 | X1 Ala Ser Gln X2 Ile X3 X4 X5 Leu X6, wherein X1 = R or Q or a conservative substitution thereof, X2 = G or D or a conservative substitution thereof, X3 = S or N or a conservative substitution thereof, X4 = N or K or a conservative substitution thereof, X5 = Y or F or a conservative substitution thereof, X6 = A or N or V or a conservative substitution thereof. |

FIGURE 55
(Continued)

| | | | |
|---|---|---|---|
| | SEQ ID NO: 50213 | VL2 | X1 Ala X2 X3 Leu X4 X5, wherein X1 = A or D or G or T or a conservative substitution thereof, X2 = S or T or a conservative substitution thereof, X3 = S or R or N or a conservative substitution thereof, X4 = Q or H or L or V or a conservative substitution thereof, X5 = S or T or a conservative substitution thereof. |
| | SEQ ID NO: 50214 | VL3 | X1 X2 Tyr X3 X4 X5 Pro X6 Thr, wherein X1 = Q or H or L or a conservative substitution thereof, X2 = Q or H or L or a conservative substitution thereof, X3 = L or H or D or K or N or Y or a conservative substitution thereof, X4 = S or N or H or T or a conservative substitution thereof, X5 = Y or L or a conservative substitution thereof, X6 = I or L or a conservative substitution thereof. |
| VL-CONSENSUS-50 TABLE 130 | SEQ ID NO: 50215 | VL1 | X1 Ala X2 Gln Ser X3 Gly Ser Ser Leu His, wherein X1 = S or N or a conservative substitution thereof, X2 = S or N or a conservative substitution thereof, X3 = S or R or a conservative substitution thereof. |
| | SEQ ID NO: 50216 | VL2 | Tyr Ala Ser Gln Ser X1 Ser, wherein X1 = F or L or a conservative substitution thereof. |
| | SEQ ID NO: 50217 | VL3 | His Gln X1 X2 X3 Leu Pro Leu Thr, wherein X1 = S or T or a conservative substitution thereof, X2 = R or G or S or a conservative substitution thereof, X3 = R or S or T or a conservative substitution thereof. |
| VL-CONSENSUS-51 TABLE 131 | SEQ ID NO: 50218 | VL1 | Gln Gly Asp X1 Leu Arg X2 Tyr Tyr X3 X4, wherein X1 = S or T or K or a conservative substitution thereof, X2 = P or N or S or T or a conservative substitution thereof, X3 = A or V or a conservative substitution thereof, X4 = S or N or a conservative substitution thereof. |
| | SEQ ID NO: 50219 | VL2 | X1 Lys Asn X2 Arg Pro Ser, wherein X1 = G or A or T or a conservative substitution thereof, X2 = N or S or a conservative substitution thereof. |
| | SEQ ID NO: 50220 | VL3 | Asn Ser Arg Asp Ser X1 X2 X3 X4 X5 X6 X7, wherein X1 = S or C or a conservative substitution thereof, X2 = G or Absent or a conservative substitution thereof, X3 = N or G or a conservative substitution thereof, X4 = H or N or S or a conservative substitution thereof, X5 = L or H or a conservative substitution thereof, X6 = V or L or a conservative substitution thereof, X7 = V or L or a conservative substitution thereof. |
| VL-CONSENSUS-52 TABLE 132 | (SEQ ID NO: 50221) | VL1 | Arg Ser X1 Gln Ser Leu Val Tyr Ser Asp Gly Asn Thr X2 Leu Asn wherein X1 = S or G or a conservative substitution thereof, X2 = Y or S or a conservative substitution thereof. |
| | SEQ ID NO: 50222 | VL2 | X1 Val Ser X2 Trp Asp X3, wherein X1 = K or E or a conservative substitution thereof, X2 = N or K or a |

FIGURE 55
(Continued)

| | | | |
|---|---|---|---|
| | SEQ ID NO: 50223 | VL3 | conservative substitution thereof, X3 = S or Y or a conservative substitution thereof. |
| | | | Met Gln Gly X1 X2 X3 X4 X5 Thr, wherein X1 = T or I or a conservative substitution thereof, X2 = H or Absent or a conservative substitution thereof, X3 = W or H or a conservative substitution thereof, X4 = P or L or S or W or a conservative substitution thereof, X5 = L or P or a conservative substitution thereof. |
| VL-CONSENSUS-53 TABLE 133 | SEQ ID NO: 50224 | VL1 | Arg X1 Ser Gln Ser X2 X3 X4 X5 X6 Ala, wherein X1 = A or P or T or a conservative substitution thereof, X2 = V or F or a conservative substitution thereof, X3 = S or R or W or a conservative substitution thereof, X4 = R or I or S or a conservative substitution thereof, X5 = N or D or S or a conservative substitution thereof, X6 = L or V or a conservative substitution thereof. |
| | SEQ ID NO: 50225 | VL2 | X1 Ala X2 X3 Arg Ala Thr, wherein X1 = G or D or a conservative substitution thereof, X2 = S or A or a conservative substitution thereof, X3 = T or I or A or a conservative substitution thereof. |
| | SEQ ID NO: 50226 | VL3 | Gln Gln Tyr X1 X2 X3 X4 Pro Leu Thr, wherein X1 = N or Y or a conservative substitution thereof, X2 = N or T or Y or a conservative substitution thereof, X3 = Absent or W or a conservative substitution thereof, X4 = W or P or a conservative substitution thereof. |
| VL-CONSENSUS-54 TABLE 134 | SEQ ID NO: 50250 | VL1 | Gly Gly X1 Asn Ile X2 X3 X4 X5 Val His, wherein X1 = N or D or a conservative substitution thereof, X2 = G or R or a conservative substitution thereof, X3 = R or S or a conservative substitution thereof, X4 = K or R or a conservative substitution thereof, X5 = N or A or a conservative substitution thereof. |
| | SEQ ID NO: 50251 | VL2 | X1 Asp X2 X3 Arg X4 Ser, wherein X1 = R or S or a conservative substitution thereof, X2 = S or R or a conservative substitution thereof, X3 = D or N or Y or a conservative substitution thereof, X4 = P or S or a conservative substitution thereof. |
| | SEQ ID NO: 50252 | VL3 | Gln X1 Trp Asp Ser X2 X3 X4 X5 X6 Val, wherein X1 = V or D or a conservative substitution thereof, X2 = Absent or S or a conservative substitution thereof, X3 = Absent or S or a conservative substitution thereof, X4 = S or D or G or a conservative substitution thereof, X5 = T or H or a conservative substitution thereof, X6 = V or A or G or a conservative substitution thereof. |

Table 24

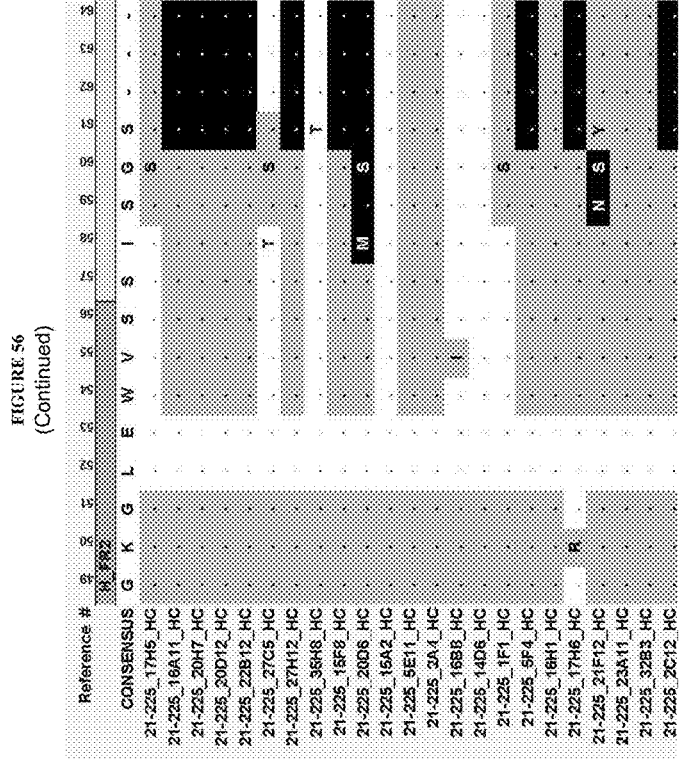

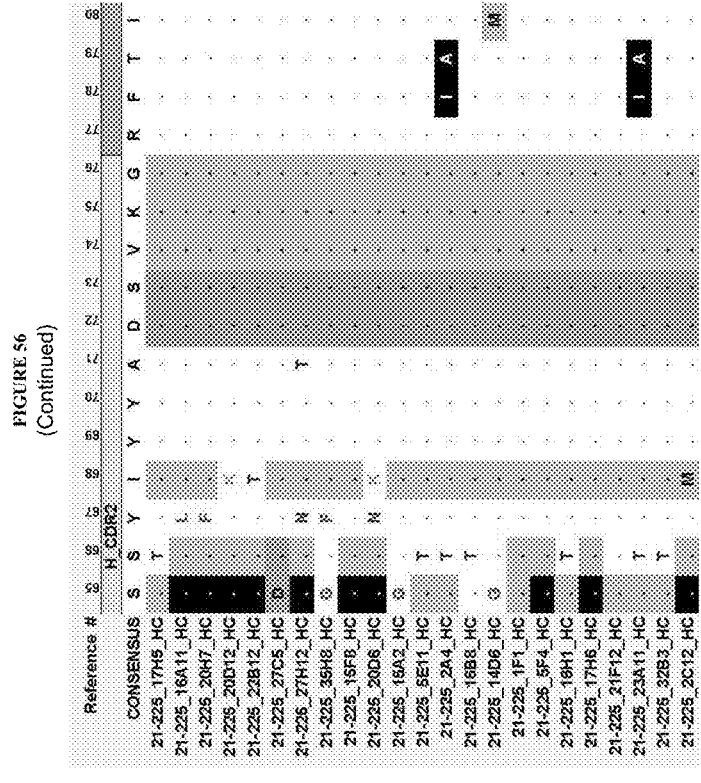

Table 26

Table 27

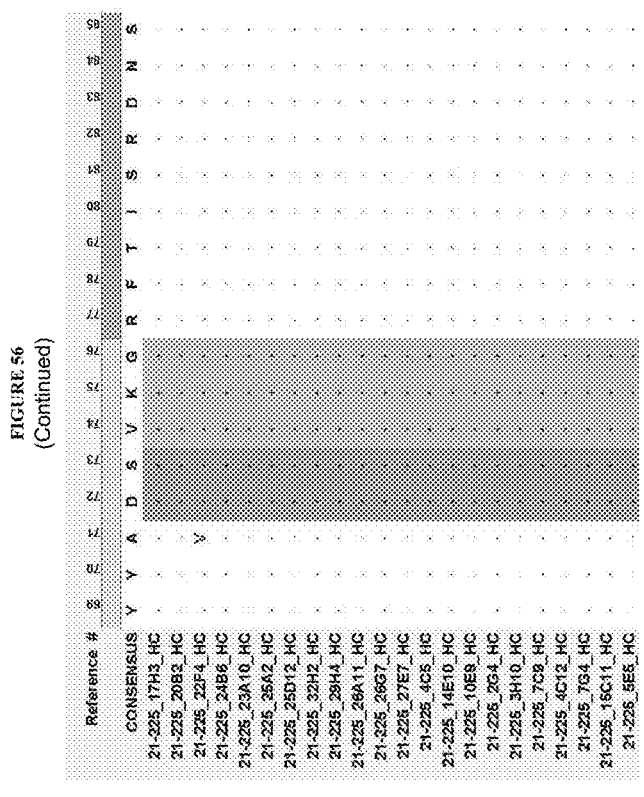

Table 31

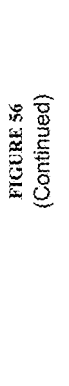
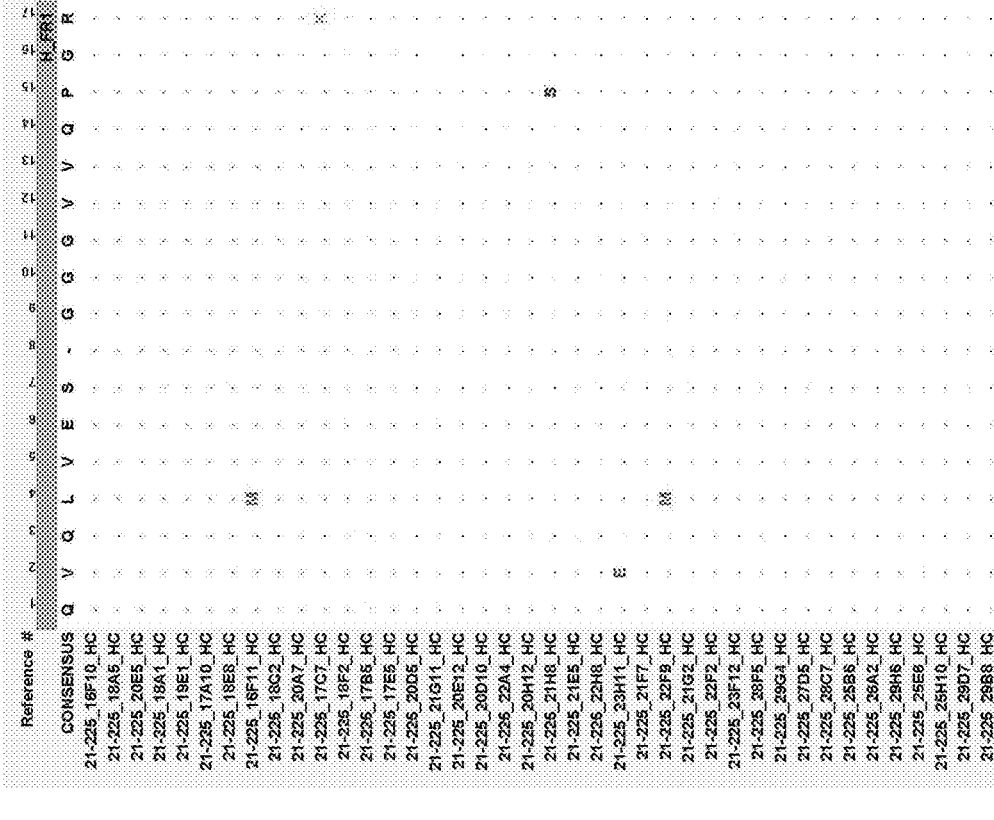
FIGURE 56 (Continued)

FIGURE 56
(Continued)

Table 33

| Reference # | Q | L | Q | L | Q | E | S | G | P | G | L | V | K | P | S | E |
|---|---|---|---|---|---|---|---|---|---|---|---|---|---|---|---|---|
| CONSENSUS | | | | | | | | | | | | | | | | |
| 21-225_20C2_HC | | | | | | | | | | | | | | F | | |
| 21-225_18C6_HC | | | | | | | | | | | | | | | | |
| 21-225_18A3_HC | | | | | | | | | | | | | | | | |
| 21-225_22D12_HC | | | | | | | | | | | | | | | | |
| 21-225_23D1_HC | | | | | | | | | | | | | | | | |
| 21-225_24E5_HC | | | | | | | | | | | | | | | | |
| 21-225_23C1_HC | | | | | | | | | | | | | | F | | |
| 21-225_20G9_HC | | | | | | | | | | | | | | | | |
| 21-225_21G7_HC | | | | | | | | | | | | | | | | |
| 21-225_22G9_HC | | | | | | | | | | | | | | | | |
| 21-225_34C4_HC | | | | | | | | | | | | | | | | |
| 21-225_2F7_HC | | | | | | | | | | | | | | | | |
| 21-225_3G4_HC | | | | | | | | | | | | | | | | |
| 21-225_7F4_HC | | | | | | | | | | | | | | | | |
| 21-225_6D4_HC | | H | | | | | | | | | | | | | | |
| 21-225_15A1_HC | | H | | | | | | | | | | | | | | |
| 21-225_15G7_HC | | | | | | | | | | | | | | | | |
| 21-225_11F10_HC | | | | | | | | | | | | | | F | | |
| 21-225_15H1_HC | | | | | | | | | | | | | | F | | |
| 21-225_16A1_HC | | | | | | | | | | | | | | | | |
| 21-225_8D12_HC | | | | | | | | | | | | | | | | |

Table 35

Table 37

FIGURE 56
(Continued)

Table 39

Table 42

Table 45

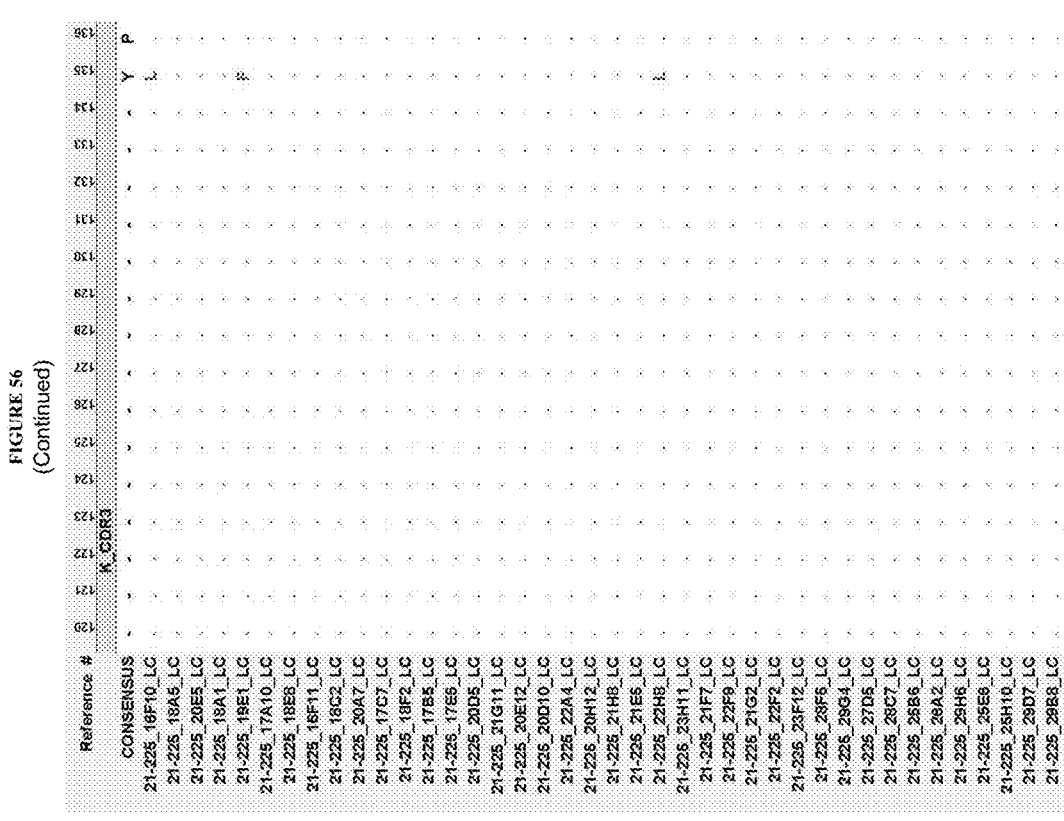

FIGURE 57

Table 49: Consensus 15-VH1l1-08/D6l6-19lRF1/JH4 (SEQ ID NO: 50266):

QVQLVQS-GAEVKKPGASVKVSCKASG-YTFTN----YDINWVRQATGQGLEWMGWMHPN---
SGNTGYAQKFQGRVTMTRNTSISTAYMELSSLRSEDTAVYYCASSSGWY---------YFDYWGQGTLVTVSS wherein:

N at position 33 can be substituted with H

I at position 41 can be substituted with V or L

W at position 57 can be substituted with R

M at position 58 can be substituted with V or L

H at position 59 can be substituted with N, Y or T

N at position 61 can be substituted with D or H

G at position 66 can be substituted with H

N at position 67 can be substituted with S, Q, A, D, K or T

T at position 68 can be substituted with A, V or E

G at position 69 can be substituted with D

Y at position 70 can be substituted with F or C

A at position 71 can be substituted with P

Q at position 72 can be substituted with K

K at position 73 can be substituted with R or N

Q at position 75 can be substituted with R

G at position 76 can be substituted with V

Y at position 113 can be substituted with E, N or T

FIGURE 57
(Continued)

Y at position 135 can be substituted with F, K, I, R, V, L, M, W, H or S

Y at position 138 can be substituted with F, S or N

Xaa Tyr Asp Xaa Asn (SEQ ID NO: 50001)

Xaa Xaa Xaa Pro Xaa Ser Xaa Xaa Xaa Xaa Xaa Xaa Xaa Xaa Phe Xaa Xaa (SEQ ID NO: 50002)

Ser Ser Gly Trp Xaa Xaa Phe Asp Xaa (SEQ ID NO: 50003)

Asn Tyr Asp Ile Asn (SEQ ID NO: 50468)

Trp Met His Pro Asn Ser Gly Asn Thr Gly Tyr Ala Gln Lys Phe Gln Gly (SEQ ID NO: 50469)

Ser Ser Gly Trp Tyr Tyr Phe Asp Tyr (SEQ ID NO: 50470)

FIGURE 57
(Continued)

Table 50. Consensus 16- VH3|3-33/D6|6-6|RF1/JH6 (SEQ ID NO: 50267):

QVQLVES-GGGVVQPGRSLRLSCAASG-FTFSS-----YVMHWVRQAPGKGLEWVAVIWYD---
GSNKYYADSVKGRFTISRDNSKNTLYLQMNSLRAEDTAVYYCARERYSSGW-----------YDYGMDVWGQGTTVTVSS wherein:

S at position 33 can be substituted with D, N or I

Y at position 39 can be substituted with C, F, D or S

V at position 40 can be substituted with G, I or L

M at position 41 can be substituted with I or L

H at position 42 can be substituted with D

V at position 57 can be substituted with L or A

W at position 59 can be substituted with F

G at position 65 can be substituted with A

S at position 66 can be substituted with R or N

N at position 67 can be substituted with Y, G or S

Y at position 69 can be substituted with H

Y at position 70 can be substituted with H or N

A at position 71 can be substituted with V, E, G or T

D at position 72 can be substituted with E or G

S at position 73 can be substituted with A

V at position 74 can be substituted with M

E at position 109 can be substituted with R or V

FIGURE 57
(Continued)

R at position 110 can be substituted with Y, K, V, E, P, D, L, F, M, N, Q or T

Y at position 111 can be substituted with S, T or V

S at position 112 can be substituted with R, Y, P, T or G

S at position 113 can be substituted with C or Y

G at position 114 can be substituted with W, S or N

W at position 115 can be substituted with null (-), L, Y, G, F or S null (-) at position 116 can be substituted with Y null (-) at position 117 can be substituted with A, G or T null (-) at position 118 can be substituted with C null (-) at position 129 can be substituted with P null (-) at position 130 can be substituted with Y or L null (-) at position 131 can be substituted with Y or D Y at position 132 can be substituted with null (-), F or H D at position 133 can be substituted with S, G, T, V, Y, A, F or M Y at position 134 can be substituted with G or F M at position 136 can be substituted with L D at position 137 can be substituted with G Xaa Xaa Xaa Xaa (SEQ ID NO: 50004)

Xaa Ile Xaa Tyr Asp Xaa Xaa Xaa Lys Xaa Xaa Xaa Xaa Xaa Xaa Lys Gly (SEQ ID NO: 50005)

FIGURE 57
(Continued)

Xaa Xaa Xaa Xaa Xaa Xaa Xaa Xaa Xaa Xaa Xaa Xaa Xaa Gly Xaa Xaa Xaa Val (SEQ ID NO: 50006)

Ser Tyr Val Met His (SEQ ID NO: 50471)

Val Ile Trp Tyr Asp Gly Ser Asn Lys Tyr Tyr Ala Asp Ser Val Lys Gly (SEQ ID NO: 50472)

Glu Arg Tyr Ser Ser Gly Trp Tyr Asp Tyr Gly Met Asp Val (SEQ ID NO: 50473)

FIGURE 57
(Continued)

| Reference # | 76 | 77 | 78 | 79 | 80 | 81 | 82 | 83 | 84 | 85 | 86 | 87 | 88 | 89 | 90 | 91 | 92 H_FR3 | 93 | 94 | 95 | 96 | 97 | 98 | 99 | 100 |
|---|---|---|---|---|---|---|---|---|---|---|---|---|---|---|---|---|---|---|---|---|---|---|---|---|---|
| CONSENSUS | G | R | F | T | I | S | R | D | N | S | K | N | T | L | Y | L | Q | M | N | S | L | R | A | E | D |
| 21-225_5E5.024_HC | . | . | . | . | . | . | . | . | . | . | . | . | . | . | . | . | . | . | . | . | . | . | . | . | . |
| 21-225_60C12_HC | . | . | . | . | . | . | . | . | . | . | . | . | . | . | . | . | . | . | . | . | . | . | . | . | . |
| 21-225_60G2_HC | . | . | . | . | . | . | . | . | . | . | . | . | . | . | . | . | . | . | . | . | . | . | . | . | . |
| 21-225_61B3_HC | . | . | . | . | . | . | . | . | . | . | . | . | . | . | . | . | . | . | . | . | . | . | . | . | . |
| 21-225_61F2_HC | . | . | . | . | . | . | . | . | . | . | . | . | . | . | . | . | . | . | . | . | . | . | . | . | . |
| 21-225_64A4_HC | . | . | . | . | . | . | . | . | . | . | Q | . | . | . | S | . | . | . | . | . | . | . | . | . | . |
| 21-225_64C8_HC | . | . | . | . | . | . | . | . | . | . | . | . | . | . | . | . | . | . | . | . | . | . | . | . | . |
| 21-225_66D11_HC | . | . | . | . | . | . | . | . | . | . | . | . | . | . | . | . | . | . | . | . | . | . | . | . | . |
| 21-225_73C9_HC | . | . | . | . | . | . | . | . | . | . | . | . | . | . | . | . | . | I | T | . | . | . | . | . | . |
| 21-225_7C9_HC | . | . | . | . | . | . | . | . | . | . | . | . | . | . | . | . | . | . | . | . | . | . | . | . | . |
| 21-225_7G4_HC | . | . | . | . | . | . | . | . | . | . | . | . | . | . | . | . | . | . | . | . | . | . | . | . | . |
| 21-225_94F3_HC | . | . | . | . | . | . | . | . | . | . | . | . | . | . | . | . | . | . | . | . | . | . | . | . | . |

FIGURE 57
(Continued)

| Reference # | 101 | 102 | 103 | 104 | 105 | 106 | 107 | 108 | 109 | 110 | 111 | 112 | 113 | 114 | 115 | 116 | 117 | 118 | 119 | 120 | 121 | 122 | 123 | 124 | 125 |
|---|---|---|---|---|---|---|---|---|---|---|---|---|---|---|---|---|---|---|---|---|---|---|---|---|---|
| | | | | | | | | | | | | | | | | | | | | | | | H_CDR3 | | |
| CONSENSUS | T | A | V | Y | Y | C | A | R | E | R | Y | S | S | G | W | | | | | | | | | | |
| 21-225_5E5.024_HC | . | . | . | . | . | . | . | . | . | Y | . | . | . | . | Y | . | . | . | . | . | . | . | . | . | . |
| 21-225_60C12_HC | . | . | . | . | . | . | . | . | W | Y | S | W | . | W | . | . | . | . | . | . | . | . | . | . | . |
| 21-225_80G2_HC | . | . | . | . | . | . | . | . | W | Y | S | W | . | W | . | . | . | . | . | . | . | . | . | . | . |
| 21-225_61B3_HC | . | . | . | . | . | . | . | . | W | Y | S | W | . | W | . | . | . | . | . | . | . | . | . | . | . |
| 21-225_61F2_HC | . | . | . | . | . | . | . | . | . | . | . | . | . | . | . | . | . | . | . | . | . | . | . | . | . |
| 21-225_64A4_HC | . | . | . | . | . | . | . | . | . | . | . | . | . | S | . | . | . | . | . | . | . | . | . | . | . |
| 21-225_64C8_HC | . | . | . | . | . | . | . | . | . | . | . | . | . | . | . | . | . | . | . | . | . | . | . | . | . |
| 21-225_66D11_HC | . | . | L | . | . | . | . | . | . | W | . | . | . | N | . | . | . | . | . | . | . | . | . | . | . |
| 21-225_73C9_HC | . | . | . | . | . | . | . | . | . | . | . | . | . | S | . | . | . | . | . | . | . | . | . | . | . |
| 21-225_7C9_HC | . | . | . | . | . | . | . | . | . | W | . | . | . | S | . | . | . | . | . | . | . | . | . | . | . |
| 21-225_7G4_HC | . | . | . | . | R | . | . | . | . | W | . | . | . | N | . | . | . | . | . | . | . | . | . | . | . |
| 21-225_94F3_HC | . | . | . | . | . | . | . | . | . | . | . | . | . | . | . | . | . | . | . | . | . | . | . | . | . |

FIGURE 57
(Continued)

Table 51. Consensus 17- VH3j3-33/D[7-27]RF2/JH4 (SEQ ID NO: 50268):

QVQLVES-GGGVVQPGRSLRLSCAASG-FTFSD----YGMHWVRQAPGKGLEWVAVIWYD---
ENNKYYADSVKGRFTISRDNSKNTLYLQMNSLRAEDTAVYYCARELGF---------SDYWGQGTLVTVSS wherein:

D at position 33 can be substituted with S, N or T

Y at position 39 can be substituted with F

M at position 41 can be substituted with I

V at position 57 can be substituted with L

I at position 58 can be substituted with V, T or M

Y at position 60 can be substituted with F or D

D at position 61 can be substituted with E, A, G or N

E at position 65 can be substituted with G, V, R or D

N at position 66 can be substituted with S, T, D, I or Y

N at position 67 can be substituted with H or K

K at position 68 can be substituted with Q, E, N or R

Y at position 69 can be substituted with H, K, D, R or S

Y at position 70 can be substituted with H

A at position 71 can be substituted with V, G, T, I or E

D at position 72 can be substituted with E

V at position 74 can be substituted with M

K at position 75 can be substituted with R

FIGURE 57
(Continued)

E at position 109 can be substituted with D or G

G at position 111 can be substituted with A

F at position 112 can be substituted with W or M

L at position 135 can be substituted with R, T, Y, S, Q, I, A, E or N

S at position 136 can be substituted with E, G, D, F, N, A or T

D at position 137 can be substituted with E

Y at position 138 can be substituted with S, F or C

Xaa Xaa Gly Xaa His (SEQ ID NO: 50007)

Xaa Xaa Trp Xaa Xaa Xaa Xaa Xaa Xaa Xaa Xaa Ser Xaa Xaa Xaa Gly (SEQ ID NO: 50008)

Xaa Leu Xaa Xaa Xaa Xaa Xaa Xaa (SEQ ID NO: 50009)

Asp Tyr Gly Met His (SEQ ID NO: 50474)

Val Ile Trp Tyr Asp Glu Asn Asn Lys Tyr Tyr Ala Asp Ser Val Lys Gly (SEQ ID NO: 50475)

Glu Leu Gly Phe Ser Asp Tyr (SEQ ID NO: 50476)

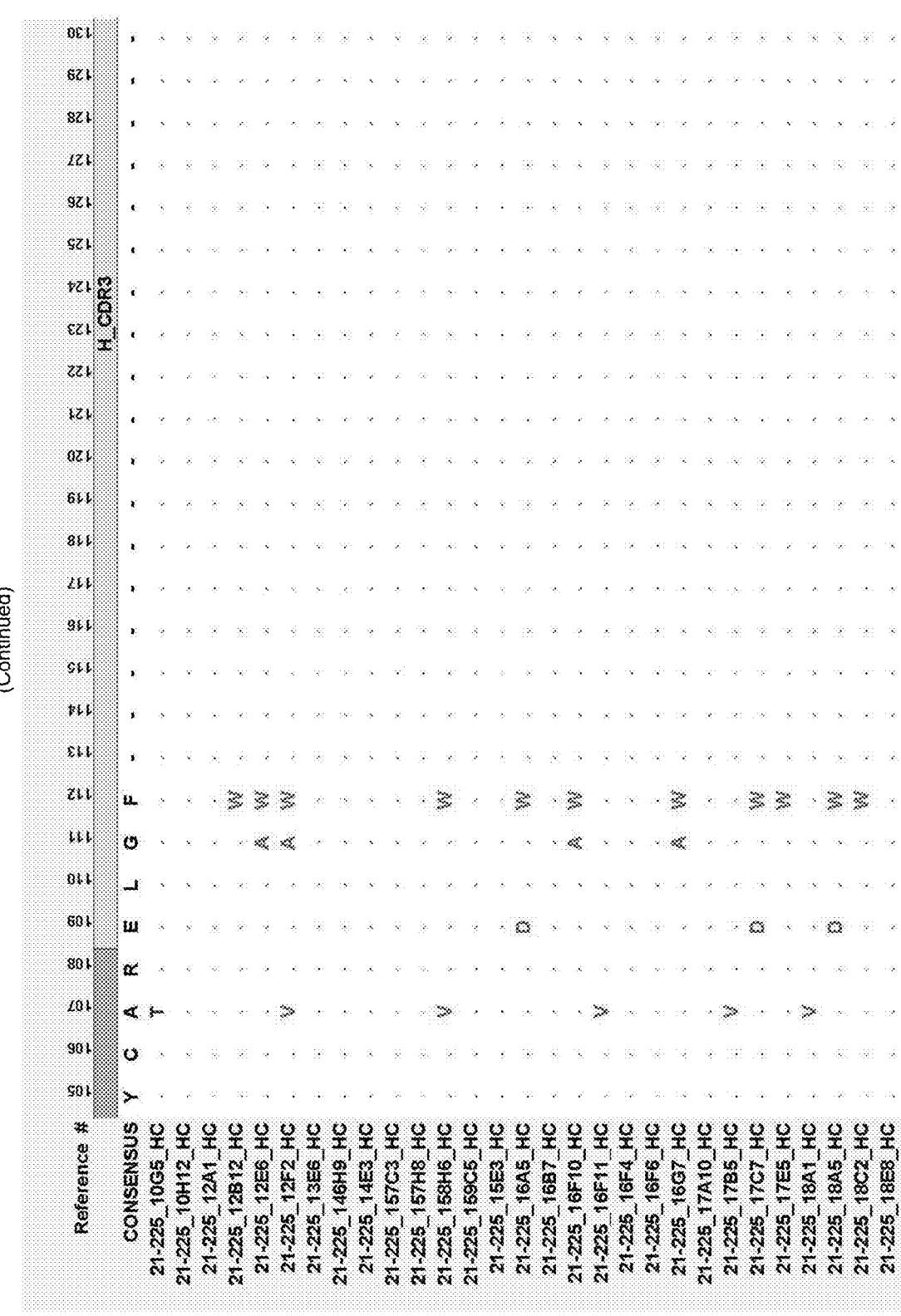

FIGURE 57
(Continued)

Table 52. Consensus 18- VH4|4-34/D4|4-17/RF2/JH6 (SEQ ID NO: 50269):
QVQLQQW-GAGLLKPSETLSLTCAVHG-GSFSG----CYWSWIRQPPGKGLEWIGEINH----SGSTNYNPSLKSRVTISVDTSKNQFSLKLSSVTAADTAVYYCARDYGG----------MDVWGQGTTVTVSS wherein:

C at position 39 can be substituted with S, P or Y

H at position 60 can be substituted with Y or Q

S at position 65 can be substituted with R

S at position 67 can be substituted with R, C, or I

N at position 69 can be substituted with S

Y at position 70 can be substituted with F

K at position 75 can be substituted with T

M at position 136 can be substituted with L or I

Gly Xaa Tyr Trp Ser (SEQ ID NO: 50010)

Glu Ile Asn Xaa Xaa Gly Xaa Thr Xaa Xaa Asn Pro Ser Leu Xaa Ser (SEQ ID NO: 50011)

Asp Tyr Gly Gly Xaa Asp Val (SEQ ID NO: 50012)

Gly Cys Tyr Trp Ser (SEQ ID NO: 50477)

Glu Ile Asn His Ser Gly Ser Thr Asn Tyr Asn Pro Ser Leu Lys Ser (SEQ ID NO: 50478)

Asp Tyr Gly Gly Met Asp Val (SEQ ID NO: 50479)

FIGURE 57
(Continued)

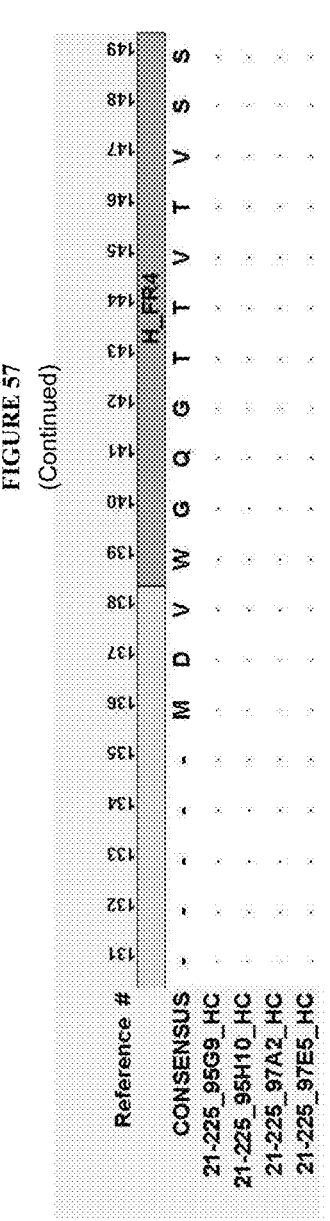

Table 53. Consensus 19-VH1l1-08/D6i6-19/RF1/JH5 (SEQ ID NO: 50270):

QVQLVQS-GAEVKKPGASVKVSCKASG-YTFTN----YDINWVRQATGQGLEWMGWMHPN---SGNTGYAQKFQGRVTMTRNTSISTAYMELSSLRSEDTAVYYCAISSGWY----------WFDPWGQGTLVTVSS wherein:

H at position 59 can be substituted with N, or Y

N at position 61 can be substituted with D

S at position 65 can be substituted with N

G at position 66 can be substituted with V

N at position 67 can be substituted with S

T at position 68 can be substituted with I

Y at position 70 can be substituted with F, or C

G at position 76 can be substituted with D

Y at position 113 can be substituted with H, N, S, or K

FIGURE 57
(Continued)

W at position 135 can be substituted with R.

Asn Tyr Asp Ile Asn (SEQ ID NO: 50013)

Trp Met Xaa Pro Xaa Xaa Xaa Xaa Gly Xaa Ala Gln Lys Phe Gln Xaa (SEQ ID NO: 50014)

Ser Ser Gly Trp Xaa Xaa Phe Asp Pro (SEQ ID NO: 50015)

Asn Tyr Asp Ile Asn (SEQ ID NO: 50480)

Trp Met His Pro Asn Ser Gly Asn Thr Gly Tyr Ala Gln Lys Phe Gln Gly (SEQ ID NO: 50481)

Ser Ser Gly Trp Tyr Trp Phe Asp Pro (SEQ ID NO: 50482)

FIGURE 57
(Continued)

Table 54. Consensus 20- VH3|3-33/D4|4-17|RF2/JH6 (SEQ ID NO: 50271):

QVQLVES-GGGVVQPGRSLRLSCAASG-FTFSS-----YGMHWVRQAPGKGLEWVAVIWYD---GSNKNYADSVKGRFTISRDNSKNTLYLQMNSLRAEDTAVYYCARDQGVGY----------YGLDVWGQGTTVTVSS wherein:

S at position 33 can be substituted with N, R, T or I

Y at position 39 can be substituted with H or N

H at position 42 can be substituted with D

V at position 57 can be substituted with I

I at position 58 can be substituted with L

Y at position 60 can be substituted with F

S at position 66 can be substituted with T

K at position 68 can be substituted with E, Q, D or R

N at position 69 can be substituted with H or Y

Y at position 70 can be substituted with H

A at position 71 can be substituted with V or G

D at position 72 can be substituted with E

D at position 109 can be substituted with A

Q at position 110 can be substituted with R, Y, H, A, C, E, F or M

V at position 112 can be substituted with I or F

G at position 113 can be substituted with Y

FIGURE 57
(Continued)

Y at position 114 can be substituted with E null (-) at position 115 can be substituted with F null (-) at position 116 can be substituted with D null (-) at position 131 can be substituted with Y null (-) at position 132 can be substituted with Y null (-) at position 133 can be substituted with N Y at position 134 can be substituted with D, or N G at position 135 can be substituted with A or D L at position 136 can be substituted with M, T or I Xaa Xaa Gly Met Xaa (SEQ ID NO: 50016)

Xaa Xaa Trp Xaa Asp Gly Xaa Asn Xaa Xaa Xaa Xaa Xaa Ser Val Lys Gly (SEQ ID NO: 50017)

Xaa Xaa Gly Xaa Xaa Xaa Xaa Xaa Xaa Xaa Xaa Xaa Xaa Asp Val (SEQ ID NO: 50018)

Ser Tyr Gly Met His (SEQ ID NO: 50483)

Val Ile Trp Tyr Asp Gly Ser Asn Lys Asn Tyr Ala Asp Ser Val Lys Gly (SEQ ID NO: 50484)

Asp Gln Gly Val Gly Tyr Tyr Gly Leu Asp Val (SEQ ID NO: 50485)

FIGURE 57
(Continued)

Table 55. Consensus 21 - VH1I1-02/DlI1-lIRF1/JH4 (SEQ ID NO: 50272):

QVQLVQS-GAEVKKPGASVKVSCKASG-YTFTG----YYMHWVRQAPGQGLEWMGWINPN---SGGTNYAQKFQGRVTMTRDTSISTAYMELSRLRSDDTAVYYCARDGTS----------SFDYWGQGTLVTVSS wherein:

G at position 33 can be substituted with D, S or A

Y at position 39 can be substituted with D

Y at position 40 can be substituted with H, N or F

M at position 41 can be substituted with L or I

H at position 42 can be substituted with Q

I at position 58 can be substituted with V

N at position 59 can be substituted with H, K or S

N at position 61 can be substituted with K

S at position 65 can be substituted with N, R or T

G at position 66 can be substituted with N or D

G at position 67 can be substituted with A

T at position 68 can be substituted with S

N at position 69 can be substituted with H, Q or I

Y at position 70 can be substituted with S or F

A at position 71 can be substituted with T

K at position 73 can be substituted with R, N, E or S

G at position 76 can be substituted with D

FIGURE 57
(Continued)

D at position 109 can be substituted with K, G, S or E

G at position 110 can be substituted with F, A, K or V

T at position 111 can be substituted with null (-)or P

S at position 112 can be substituted with G, null (-, or T null (-) at position 113 can be substituted with V or S null (-) at position 114 can be substituted with A null (-) at position 115 can be substituted with T null (-) at position 133 can be substituted with W null (-) at position 134 can be substituted with G S at position 135 can be substituted with null (-), V or Y F at position 136 can be substituted with null (-), L or Y D at position 137 can be substituted with G or K Y at position 138 can be substituted with D or F Xaa Xaa Xaa Xaa Xaa (SEQ ID NO: 50019)

Trp Xaa Xaa Pro Xaa Xaa Xaa Xaa Xaa Xaa Xaa Gln Xaa Phe Gln Xaa (SEQ ID NO: 50020)

Xaa Xaa Xaa Xaa Xaa Xaa Xaa Xaa Xaa Xaa Xaa Xaa Xaa Xaa (SEQ ID NO: 50021)

Gly Tyr Tyr Met His (SEQ ID NO: 50486)

Trp Ile Asn Pro Asn Ser Gly Gly Thr Asn Tyr Ala Gln Lys Phe Gln Gly (SEQ ID NO: 50487)

Asp Gly Thr Ser Ser Phe Asp Tyr (SEQ ID NO: 50488)

FIGURE 57
(Continued)

Table 56. Consensus 22- VH3i3-33/D4i4-11iRF2/JH6 (SEQ ID NO: 50273):

QVQLVES-GGGVVQPGRSLRLSCAASG-FTFSS----YGMHWVRQAPGKGLEWVAVIWHD--GSNKYYADSVKGRFTISRDNSKNTLYLQMNSLRAEDTAVYYCARDLSMG----------GMDVWGQGTTVTVSS wherein:

S at position 33 can be substituted with N

Y at position 39 can be substituted with F or H

M at position 41 can be substituted with I

V at position 57 can be substituted with I

W at position 59 can be substituted with I

H at position 60 can be substituted with Y, F or N

D at position 61 can be substituted with S or E

G at position 65 can be substituted with A

S at position 66 can be substituted with G

N at position 67 can be substituted with Y

K at position 68 can be substituted with D, E or R

Y at position 69 can be substituted with N

Y at position 70 can be substituted with N

A at position 71 can be substituted with V or G

D at position 72 can be substituted with E

S at position 73 can be substituted with A

K at position 75 can be substituted with R

FIGURE 57
(Continued)

D at position 109 can be substituted with T or R

L at position 110 can be substituted with R, Y, S, F, I or P

S at position 111 can be substituted with R or T

M at position 112 can be substituted with V, G, P, K, N or Y

G at position 113 can be substituted with Y, null (-) or S null (-) at position 114 can be substituted with Y, S or W null (-) at position 115 can be substituted with G null (-) at position 116 can be substituted with S null (-) at position 117 can be substituted with G null (-) at position 118 can be substituted with S null (-) at position 119 can be substituted with P null (-) at position 129 can be substituted with P null (-) at position 130 can be substituted with Y null (-) at position 131 can be substituted with Y null (-) at position 132 can be substituted with Y null (-) at position 133 can be substituted with S or Y null (-) at position 134 can be substituted with D, Y or G M at position 136 can be substituted with L or T Xaa Xaa Gly Xaa His (SEQ ID NO: 50022)

FIGURE 57
(Continued)

Xaa Ile Xaa Xaa Xaa Xaa Xaa Xaa Xaa Xaa Xaa Xaa Val Xaa Gly (SEQ ID NO: 50023)

Xaa Xaa Xaa Xaa Xaa Xaa Xaa Xaa Xaa Xaa Xaa Xaa Xaa Gly Xaa Asp Val (SEQ ID NO: 50024)

Ser Tyr Gly Met His (SEQ ID NO: 50489)

Val Ile Trp His Asp Gly Ser Asn Lys Tyr Tyr Ala Asp Ser Val Lys Gly (SEQ ID NO: 50490)

Asp Leu Ser Met Gly Gly Met Asp Val (SEQ ID NO: 50491)

Table 57. Consensus 23 – VH3|3-33/D7|7-27|RF1/JH4 (SEQ ID NO: 50274):

QVQLVES-GGGVVQPGRSLRLSCAASG-FTFSD---YGMHWVRQAPGKGLEWVAVIWYD---
ESNKYYADSVKGRFTISRDNSKNTLYLQMNSLRAEDTAVYYCAREVGW----------LDDYWGQGTLVTVSS wherein:

FIGURE 57
(Continued)

D at position 33 can be substituted with N or S

Y at position 39 can be substituted with F

M at position 41 can be substituted with I or L

Y at position 60 can be substituted with F

D at position 61 can be substituted with E, I or V

E at position 65 can be substituted with G, V, A or R

S at position 66 can be substituted with N, T or G

K at position 68 can be substituted with Q, T or N

Y at position 69 can be substituted with H or K

A at position 71 can be substituted with T, G, E or V

D at position 72 can be substituted with G

V at position 74 can be substituted with A

V at position 110 can be substituted with I, M, K or T

W at position 112 can be substituted with F, G or M

L at position 135 can be substituted with T, S, Y, H or R

D at position 136 can be substituted with E, S, F or N

Y at position 138 can be substituted with C

Xaa Xaa Gly Xaa His (SEQ ID NO: 50025)

Val Ile Trp Xaa Xaa Xaa Xaa Asn Xaa Xaa Tyr Xaa Xaa Ser Xaa Lys Gly (SEQ ID NO: 50026)

FIGURE 57
(Continued)

Glu Xaa Gly Xaa Xaa Xaa Asp Xaa (SEQ ID NO: 50027)

Asp Tyr Gly Met His (SEQ ID NO: 50492)

Val Ile Trp Tyr Asp Glu Ser Asn Lys Tyr Tyr Ala Asp Ser Val Lys Gly (SEQ ID NO: 50493)

Glu Val Gly Trp Leu Asp Asp Tyr (SEQ ID NO: 50494)

FIGURE 57
(Continued)

| Reference # | 27 G | 28 - | 29 F | 30 T | 31 F | 32 S | 33 D | 34 - | 35 - | 36 - | 37 - | 38 - | 39 Y | 40 G | 41 M | 42 H | 43 W | 44 V | 45 R | 46 Q | 47 A | 48 P | 49 G | 50 K | 51 G | 52 L |
|---|---|---|---|---|---|---|---|---|---|---|---|---|---|---|---|---|---|---|---|---|---|---|---|---|---|---|
| CONSENSUS | G | - | F | T | F | S | D | - | - | - | - | - | Y | G | M | H | W | V | R | Q | A | P | G | K | G | L |
| 21-225_29D9_HC | . | . | . | . | . | . | . | . | . | . | . | . | . | . | . | . | . | . | . | . | . | . | . | . | . | . |
| 21-225_30F3_HC | . | . | . | . | . | . | S | . | . | . | . | . | . | . | . | . | . | . | . | . | . | . | A | . | . | . |
| 21-225_33B1_HC | . | . | . | . | . | . | N | . | . | . | . | . | . | . | . | . | . | . | . | . | . | . | . | . | . | . |
| 21-225_4C8_HC | . | . | . | . | . | . | S | . | . | . | . | . | . | . | . | . | . | . | . | . | . | . | . | . | . | . |
| 21-225_4F12_HC | . | . | . | . | . | . | . | . | . | . | . | . | . | . | . | . | . | . | . | . | . | . | . | . | . | . |
| 21-225_50C4_HC | . | . | . | . | . | . | S | . | . | . | . | . | . | . | M | . | . | . | . | . | . | . | . | . | . | . |
| 21-225_73G6_HC | . | . | . | . | . | . | . | . | . | . | . | . | . | . | . | . | . | . | . | . | S | . | . | . | . | . |
| 21-225_90H5_HC | . | . | . | . | . | . | . | . | . | . | . | . | . | . | . | . | . | . | . | . | . | . | . | . | . | . |

FIGURE 57
(Continued)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | H_CDR2 | | | | | | | | | | | | |
| CONSENSUS | E | W | V | A | V | I | W | Y | D | . | . | . | E | S | N | K | Y | Y | A | D | S | V | K | G | R | F |
| 21-225_29D9_HC | . | . | . | . | . | . | . | . | . | . | . | . | . | . | . | N | . | . | . | . | . | . | . | . | . | . |
| 21-225_30F3_HC | . | . | . | . | . | . | . | . | . | . | . | . | V | N | . | . | . | . | . | . | . | . | . | . | . | . |
| 21-225_33B1_HC | . | . | . | . | . | . | . | . | E | . | . | . | X | N | . | . | . | . | . | . | . | . | . | . | . | . |
| 21-225_4C8_HC | . | . | . | . | . | . | . | . | . | . | . | . | . | T | . | Q | X | . | . | . | . | . | . | . | . | . |
| 21-225_4F12_HC | . | . | . | . | . | . | . | . | E | . | . | . | V | T | . | . | . | . | . | . | . | . | . | . | . | . |
| 21-225_50C4_HC | . | . | . | . | . | . | . | . | . | . | . | . | . | . | . | . | . | . | . | . | . | . | . | . | . | . |
| 21-225_73G6_HC | . | . | . | . | . | . | . | . | E | . | . | . | V | . | . | . | . | . | G | . | . | . | . | . | . | . |
| 21-225_90H5_HC | . | . | . | . | . | . | . | . | . | . | . | . | G | . | . | T | . | . | . | . | . | . | . | . | . | . |

FIGURE 57
(Continued)

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | | H_FR3 | | | | | | | | | | | |
| CONSENSUS | T | I | S | R | D | N | S | K | N | T | L | Y | L | Q | M | N | S | L | R | A | E | D | T | A | V | Y |
| 21-225_29D9_HC | . | . | . | . | . | . | . | . | . | . | . | . | . | . | . | . | . | . | . | . | . | . | . | . | . | . |
| 21-225_30F3_HC | . | . | . | . | . | . | . | . | . | . | . | . | . | . | . | . | . | . | . | . | . | . | . | . | . | . |
| 21-225_33B1_HC | . | . | . | . | . | . | . | . | . | . | . | . | . | . | . | . | . | . | . | . | . | . | . | . | . | . |
| 21-225_4C8_HC | . | . | . | . | . | . | . | . | . | . | . | . | . | . | . | . | . | . | T | . | . | . | . | . | . | . |
| 21-225_4F12_HC | . | . | . | . | . | . | . | . | . | . | . | . | . | . | . | . | . | . | T | P | . | N | . | . | . | . |
| 21-225_50C4_HC | . | . | . | . | . | . | . | . | . | . | . | . | . | . | . | . | . | . | . | Q | . | . | . | Q | Q | . |
| 21-225_73G6_HC | . | . | . | . | . | . | . | . | . | . | . | . | . | . | . | . | . | . | . | . | . | . | . | . | . | . |
| 21-225_90H5_HC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | . | . | . | x | L | D | D | Y | W | G | Q | G | T | L | V | T | V | S | S |
| 21-225_29D9_HC | . | . | . | . | . | . | . | . | . | . | . | . | . | Q | . | . | . | . | . |
| 21-225_30F3_HC | . | . | . | . | Y | . | . | . | . | . | . | . | . | . | . | . | . | . | . |
| 21-225_33B1_HC | . | . | . | . | Y | S | . | . | . | . | . | . | . | . | . | . | . | . | . |
| 21-225_4C8_HC | . | . | . | . | . | F | . | . | . | . | . | . | . | . | . | . | . | . | . |
| 21-225_4F12_HC | . | . | . | . | . | N | . | . | . | . | . | . | - | . | . | . | . | . | . |
| 21-225_50C4_HC | . | . | . | . | T | S | . | . | . | . | . | . | . | . | . | . | . | . | . |
| 21-225_73G8_HC | . | . | . | . | . | . | . | . | . | . | . | . | . | . | . | . | . | . | . |
| 21-225_90H5_HC | . | . | . | . | . | . | . | . | . | . | . | . | . | . | . | . | . | . | . |

FIGURE 57 (Continued)

Table 58. Consensus 24-VH3|3-21/D4|4-11|RF2/JH4 (SEQ ID NO: 50275)

EVQLVES-G*G*GLVKPGGSLRLSCAASG-FTFSS----YSMNWVRQAPGKGLEWVSSISGS---
SSYIYYADSVKGRFTISRDNAKNSLYLQMNSLRAEDTAVYYCARDRG------------SSWGQGTLVTVSS wherein:

S at position 33 can be substituted with T

Y at position 39 can be substituted with F

S at position 40 can be substituted with T, G or R

M at position 41 can be substituted with L

S at position 57 can be substituted with A, C or L

G at position 60 can be substituted with S

S at position 65 can be substituted with G or T

S at position 66 can be substituted with T, G or Y

Y at position 67 can be substituted with H

I at position 68 can be substituted with L or M

Y at position 69 can be substituted with S or W

A at position 71 can be substituted with G, P or V

V at position 74 can be substituted with L

G at position 76 can be substituted with A

D at position 109 can be substituted with T

G at position 111 can be substituted with null (-), S or Y null (-) at position 112 can be substituted with G FIGURE 57 (Continued)

null (-) at position 135 can be substituted with S null (-) at position 136 can be substituted with F or S S at position 137 can be substituted with D, G or H S at position 138 can be substituted with L, Y, G, T, C, E or I Xaa Xaa Xaa Xaa Asn (SEQ ID NO: 50028)

Xaa Ile Ser Xaa Ser Xaa Xaa Xaa Xaa Tyr Xaa Asp Ser Xaa Lys Xaa (SEQ ID NO: 50029)

Xaa Arg Xaa Xaa Xaa Xaa Xaa Xaa (SEQ ID NO: 50030)

Ser Tyr Ser Met Asn (SEQ ID NO: 50495)

Ser Ile Ser Gly Ser Ser Ser Tyr Ile Tyr Tyr Ala Asp Ser Val Lys Gly (SEQ ID NO: 50496)

Asp Arg Gly Ser Ser (SEQ ID NO: 50497)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS | E | V | Q | L | V | E | S | - | G | G | G | L | V | K | P | G | G | S | L | R | L | S | C | A | A | S |
| 21-225_13D3_HC | . | . | . | . | . | . | . | . | . | . | . | . | . | . | . | . | . | . | . | . | . | . | . | . | . | . |
| 1-225_14B1_LC1_HC | . | . | . | . | . | . | . | . | . | . | . | . | . | . | . | . | . | . | . | . | . | . | . | . | . | . |
| 1-225_14B1_LC2_HC | . | . | . | . | . | . | . | . | . | . | . | . | . | . | . | . | . | . | . | . | . | . | . | . | . | . |
| 21-225_157G7_HC | . | . | . | . | . | . | . | . | . | . | . | . | . | . | . | . | . | . | . | . | . | . | . | . | . | . |
| 21-225_157H4_HC | . | . | . | . | . | . | . | . | . | . | . | . | . | . | . | . | . | . | . | . | . | . | . | . | . | . |
| 21-225_157H7_HC | . | . | . | . | . | . | . | . | . | . | . | . | . | . | . | . | . | . | . | . | . | . | . | . | . | . |
| 21-225_158F5_HC | . | . | . | . | . | . | . | . | . | . | . | . | . | . | . | . | . | . | . | . | . | . | . | . | . | . |
| 21-225_158G8_HC | . | . | . | . | . | . | . | . | . | . | . | . | . | T | . | . | . | . | . | . | . | . | . | . | . | . |
| 21-225_158H5_HC | . | . | . | . | . | . | . | . | . | . | . | . | . | . | . | . | . | . | . | . | . | . | . | . | . | . |
| 21-225_160F4_HC | . | . | . | . | . | . | . | . | . | . | . | . | . | . | . | . | . | . | . | . | R | . | . | . | . | . |
| 21-225_160H1_HC | . | . | . | . | . | . | . | . | . | . | . | . | . | . | . | . | . | . | . | . | . | . | . | . | . | . |
| 21-225_162F2_HC | . | . | . | . | . | . | . | . | . | . | . | . | . | . | . | . | . | . | . | . | R | . | . | . | . | . |
| 21-225_162H3_HC | . | . | . | . | . | . | . | . | . | . | . | . | . | Q | . | . | . | . | . | . | . | . | . | . | . | . |
| 21-225_163F9_HC | . | . | . | . | . | . | A | . | . | . | . | . | . | . | . | . | . | . | . | . | R | . | . | . | . | . |
| 21-225_171A11_HC | . | . | . | . | . | . | . | . | . | . | . | . | . | . | . | . | . | . | . | . | R | . | . | . | . | . |
| 21-225_17C10_HC | . | . | . | . | . | . | . | . | . | . | . | . | . | . | . | . | . | . | . | . | . | . | . | . | . | . |
| 21-225_17D8_HC | . | . | . | . | . | . | . | . | . | . | . | . | . | . | . | . | . | . | . | . | . | . | . | . | . | . |
| 21-225_20B5_HC | . | . | . | . | . | . | . | . | . | . | . | . | . | . | . | . | . | . | . | . | . | . | . | . | . | . |
| 21-225_20B8_HC | . | . | . | . | . | . | . | . | . | . | . | . | . | . | . | . | . | . | . | . | . | . | . | . | . | . |
| 21-225_20C8_HC | . | . | . | . | . | . | . | . | . | . | . | . | . | . | . | . | . | . | . | . | . | . | . | . | . | . |
| 21-225_20F9_HC | . | . | . | . | . | . | . | . | . | . | . | . | . | . | . | . | . | . | . | . | . | . | . | . | . | . |
| 21-225_20G12_HC | . | . | . | . | . | . | . | . | . | . | . | . | . | . | . | . | . | . | . | . | . | . | . | . | . | . |
| 21-225_20H10_HC | . | . | . | . | . | . | . | . | . | . | . | . | . | . | . | . | . | . | . | . | . | . | . | . | . | . |
| 21-225_22H3_HC | A | . | . | . | . | . | . | . | . | . | . | . | . | . | . | . | . | . | . | . | . | . | . | . | . | . |
| 21-225_23E11_HC | . | . | . | . | . | . | . | . | . | . | . | . | . | . | . | . | . | . | . | . | . | . | . | . | . | . |
| 21-225_30H11_HC | . | . | . | . | . | . | . | . | . | . | . | . | . | . | . | . | . | . | . | . | . | . | . | . | . | . |
| 21-225_31G9_HC | . | . | . | . | . | . | . | . | . | . | . | . | . | . | . | . | . | . | . | . | . | . | . | . | . | . |
| 21-225_33C2_HC | . | . | . | . | . | . | . | . | . | . | . | . | . | . | . | . | . | . | . | . | . | . | . | . | . | . |
| 21-225_43E1_HC | . | . | . | . | . | . | . | . | . | . | . | . | . | . | . | . | . | . | . | . | . | . | . | . | . | . |

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS | E | V | Q | L | V | E | S | - | G | G | G | L | V | K | P | G | G | S | L | R | L | S | C | A | A | S |
| 21-225_53G1_HC | . | . | . | . | . | . | . | . | . | . | . | . | . | . | . | . | . | . | . | . | . | . | . | . | . | . |
| 21-225_56F1_HC | . | . | . | . | . | . | . | . | . | . | . | . | . | . | . | . | . | . | . | . | . | . | . | . | . | . |
| 21-225_56H7_HC | . | . | . | . | . | . | . | . | . | . | . | . | . | . | . | . | . | . | . | . | . | . | . | . | . | . |
| 21-225_58C5_HC | . | . | . | . | . | . | . | . | . | . | . | . | . | . | . | . | . | . | . | . | . | . | . | . | . | . |
| 21-225_65C12_HC | . | . | . | . | . | . | . | . | . | . | . | . | . | . | . | . | . | . | . | . | . | . | . | . | . | . |
| 21-225_6C12_HC | . | . | . | . | . | . | . | . | . | . | . | . | . | . | . | . | . | . | . | . | . | . | . | . | . | . |

FIGURE 57 (Continued)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
|  |  |  |  |  |  |  |  |  |  |  | H_CDR1 |  |  |  |  |  |  |  |  |  |  |  | H_FR2 |  |  |  |
| CONSENSUS | G | - | F | T | F | S | S | - | - | - | - | - | Y | S | M | N | W | V | R | Q | A | P | G | K | G | L |
| 21-225_53G1_HC | . | . | . | . | . | . | . | . | . | . | . | . | . | . | . | . | . | . | . | . | . | . | . | . | . | . |
| 21-225_56F1_HC | . | . | . | S | . | . | . | . | . | . | . | . | . | . | . | . | . | . | . | . | . | . | . | . | . | . |
| 21-225_56H7_HC | . | . | . | . | . | N | . | . | . | . | . | . | & | . | L | . | . | . | . | . | . | . | . | . | . | . |
| 21-225_58C5_HC | . | . | . | . | . | . | . | . | . | . | . | . | . | . | . | . | . | . | . | . | . | . | . | . | . | . |
| 21-225_65C12_HC | . | . | . | . | . | . | . | . | . | . | . | . | . | . | . | . | . | . | . | . | . | . | . | . | . | . |
| 21-225_6C12_HC | . | . | . | . | . | . | . | . | . | . | . | . | . | . | . | . | . | . | . | . | . | . | . | . | . | . |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
|  |  |  |  |  |  |  |  |  |  |  |  |  |  | H_CDR2 |  |  |  |  |  |  |  |  |  |  |  |  |
| CONSENSUS | E | W | V | S | S | I | S | G | S | . | . | . | S | S | Y | I | Y | Y | A | D | S | V | K | G | R | F |
| 21-225_53G1_HC | . | . | . | . | . | . | . | . | . | . | . | . | . | . | . | . | . | . | . | . | . | . | . | . | . | . |
| 21-225_56F1_HC | . | . | . | . | . | . | . | S | . | . | . | . | . | T | . | . | . | . | G | . | . | . | . | . | . | . |
| 21-225_56H7_HC | . | . | . | . | . | . | . | S | . | . | . | . | . | T | . | . | . | . | G | . | . | . | . | . | . | . |
| 21-225_58C5_HC | . | . | . | . | . | . | . | S | . | . | . | . | . | Y | . | . | . | . | . | . | . | . | . | . | . | . |
| 21-225_65C12_HC | . | . | . | . | . | . | . | S | . | . | . | . | . | . | . | L | . | . | . | . | . | . | . | . | . | . |
| 21-225_6C12_HC | . | . | . | . | . | . | . | S | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | H_FR3 | | | | | | | | | | | | |
| CONSENSUS | T | I | S | R | D | N | A | K | N | S | L | Y | L | Q | M | N | S | L | R | A | E | D | T | A | V | Y |
| 21-225_53G1_HC | . | . | . | . | . | . | . | . | . | . | . | . | . | . | . | . | . | . | . | . | . | . | . | . | . | . |
| 21-225_56F1_HC | . | . | . | . | . | . | . | . | . | . | . | . | . | . | . | . | . | . | . | . | . | . | . | . | . | . |
| 21-225_56H7_HC | . | . | . | . | . | . | . | . | . | . | . | . | . | . | . | . | . | . | . | . | . | . | . | . | . | . |
| 21-225_58C5_HC | . | . | . | . | . | S | . | . | . | . | . | . | . | . | . | . | . | . | . | . | . | . | . | . | . | . |
| 21-225_85C12_HC | . | . | . | . | . | . | . | . | . | . | . | . | . | . | . | . | . | . | . | . | . | . | . | . | . | . |
| 21-225_6C12_HC | . | . | . | . | . | . | . | . | . | . | . | . | . | . | . | . | . | . | . | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS_HC | Y | C | A | R | D | R | G | . | . | . | . | . | . | . | . | . | . | . | H_CDR3 . | . | . | . | . | . | . | . |
| 21-225_53G1_HC | . | . | . | . | . | . | . | . | . | . | . | . | . | . | . | . | . | . | . | . | . | . | . | . | . | . |
| 21-225_56F1_HC | . | . | . | . | . | . | . | . | . | . | . | . | . | . | . | . | . | . | . | . | . | . | . | . | . | . |
| 21-225_56H7_HC | . | . | . | . | T | Y | S | G | . | . | . | . | . | . | . | . | . | . | . | . | . | . | . | . | . | . |
| 21-225_58C5_HC | . | . | . | . | . | . | . | . | . | . | . | . | . | . | . | . | . | . | . | . | . | . | . | . | . | . |
| 21-225_65C12_HC | . | . | . | . | . | K | Y | . | . | . | . | . | . | . | . | . | . | . | . | . | . | . | . | . | . | . |
| 21-225_6C12_HC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | . | . | . | . | . | . | S | S | W | G | Q | G | T | L | V | T | V | S | S |
| 21-225_53G1_HC | . | . | . | . | . | . | . | T | . | . | . | . | . | . | . | . | . | . | . |
| 21-225_56F1_HC | . | . | . | . | . | . | . | . | . | . | . | . | . | . | . | . | . | . | . |
| 21-225_56H7_HC | . | . | . | . | . | . | . | . | . | . | . | . | . | . | . | . | . | . | . |
| 21-225_58C5_HC | . | . | . | . | S | F | D | Y | . | . | . | . | . | . | . | . | . | . | . |
| 21-225_66C12_HC | . | . | . | . | . | S | . | Y | . | . | . | . | . | . | . | . | . | . | . |
| 21-225_6C12_HC | . | . | . | . | . | . | . | L | . | . | . | . | . | . | . | . | . | . | . |

FIGURE 57 (Continued)

Table 59. Consensus 25-VH3|3-23/D6|6-19|RF2/JH3 (SEQ ID NO: 50276)

EVQLLES-GGGLVQPGGSLRLSCAASE-FTFSS------YAMSWVRQAPGKGLEWVSVISGR---
GGNTFYADSVKGRFTISRDNSKNTLYLQMNSLRAEDTAVYYCASRIAVAG------SEAFDIWGQGTMVTVSS wherein:

S at position 33 can be substituted with G
A at position 40 can be substituted with V
S at position 42 can be substituted with N or T
V at position 57 can be substituted with I or A
G at position 60 can be substituted with R
R at position 61 can be substituted with S
G at position 66 can be substituted with V, I or T
N at position 67 can be substituted with Y, S or T
T at position 68 can be substituted with A
F at position 69 can be substituted with Y
Y at position 70 can be substituted with N or S
K at position 75 can be substituted with R
I at position 110 can be substituted with L, M or V
A at position 113 can be substituted with D
S at position 133 can be substituted with N or Y
E at position 134 can be substituted with D
F at position 136 can be substituted with C FIGURE 57 (Continued)

D at position 137 can be substituted with A or H

I at position 138 can be substituted with V

Xaa Tyr Xaa Met Xaa (SEQ ID NO: 50031)

Xaa Ile Ser Xaa Xaa Gly Xaa Xaa Xaa Xaa Ala Asp Ser Val Xaa Gly (SEQ ID NO: 50032)

Arg Xaa Ala Val Xaa Gly Xaa Xaa Ala Xaa Xaa Xaa Xaa (SEQ ID NO: 50033)

Ser Tyr Ala Met Ser (SEQ ID NO: 50498)

Val Ile Ser Gly Arg Gly Gly Asn Thr Phe Tyr Ala Asp Ser Val Lys Gly (SEQ ID NO: 50499)

Arg Ile Ala Val Ala Gly Ser Glu Ala Phe Asp Ile (SEQ ID NO: 50500)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS | E | V | Q | L | L | E | S | - | G | G | G | L | V | Q | P | G | G | S | L | R | L | S | C | A | A | S |
| 21-225_6D3_HC | . | . | . | . | . | . | . | | . | . | . | . | . | . | . | . | . | . | . | . | . | . | . | . | . | . |
| 21-225_8E12_HC | . | . | . | . | . | . | . | | . | . | . | . | . | . | . | . | . | . | . | . | . | . | . | V | . | . |
| 21-225_8G6_HC | . | . | . | . | . | . | . | | . | . | . | . | . | . | . | . | . | . | . | . | . | . | . | . | . | . |

FIGURE 57 (Continued)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | H_CDR1 | | | | | | | | | | | H_FR2 | | | | | | | | | |
| CONSENSUS | E | . | F | T | F | S | S | . | . | . | . | . | Y | A | M | S | W | V | R | Q | A | P | G | K | G | L |
| 21-225_6D3_HC | . | . | . | . | . | . | . | . | . | . | . | . | . | . | . | N | . | . | . | . | . | . | . | . | . | . |
| 21-225_8E12_HC | . | . | . | . | . | . | . | . | . | . | . | . | . | V | . | . | . | . | . | . | . | . | . | . | . | . |
| 21-225_8G6_HC | . | . | . | . | . | . | . | . | . | . | . | . | . | . | . | N | . | . | . | . | . | . | . | . | . | . |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | H_CDR2 | | | | | | | | | | | | |
| CONSENSUS | E | W | V | S | V | I | S | G | R | - | - | - | G | G | N | T | F | Y | A | D | S | V | K | G | R | F |
| 21-225_6D3_HC | . | . | . | . | . | . | . | . | . | . | . | . | . | . | . | . | . | . | . | . | . | . | . | . | . | . |
| 21-225_8E12_HC | . | . | . | . | ~ | . | . | . | . | . | . | . | . | . | . | . | . | . | . | . | . | . | . | . | . | . |
| 21-225_8G6_HC | . | . | . | . | . | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | H_FR3 | | | | | | | | | | | | |
| CONSENSUS | T | I | S | R | D | N | S | K | N | T | L | Y | L | Q | M | N | S | L | R | A | E | D | T | A | V | Y |
| 21-225_6D3_HC | . | . | . | . | . | . | . | . | . | . | . | . | . | . | . | . | . | . | . | . | . | . | . | . | . | . |
| 21-225_8E12_HC | . | . | . | . | . | . | . | . | . | . | . | . | . | . | . | . | . | . | . | . | . | . | . | . | . | . |
| 21-225_8G6_HC | . | . | . | . | . | . | . | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| CONSENSUS | - | - | S | E | A | F | D | I | W | G | Q | G | T | M | V | T | V | S | S |
| 21-225_6D3_HC | . | . | . | . | . | . | . | . | . | . | . | . | . | . | . | . | . | . | . |
| 21-225_8E12_HC | . | . | . | . | . | . | . | . | . | . | . | . | . | . | . | . | . | . | . |
| 21-225_8G6_HC | . | . | . | . | . | . | . | . | . | . | . | . | . | . | . | S | . | . | . |

Table 60. Consensus 26- VH3|3-23/D5|5-12|RF3/JH6 (SEQ ID NO: 50277):

EVQLLES-GGGLVQPGGSLRLSCAASG-FTFSS----YAMSWVRQAPGKGLEWVSAISGR---GGSTFHADSVKGRFTISRDNSKNTLYLQMNSLRAEDTAVYYCVK<u>GELLEDY</u>---------YFYGMDVWGQGTTVTVSS wherein:

S at position 33 can be substituted with N

Y at position 39 can be substituted with C

A at position 40 can be substituted with V

S at position 42 can be substituted with N

A at position 57 can be substituted with T or S

I at position 58 can be substituted with L

G at position 60 can be substituted with R or V

R at position 61 can be substituted with G

S at position 67 can be substituted with N

T at position 68 can be substituted with I

F at position 69 can be substituted with Y

H at position 70 can be substituted with Y or N

V at position 74 can be substituted with E or M

G at position 109 can be substituted with W

E at position 110 can be substituted with G

E at position 113 can be substituted with Y

D at position 114 can be substituted with S or N

FIGURE 57 (Continued)

null (-) at position 116 can be substituted with E

Y at position 132 can be substituted with S

F at position 133 can be substituted with Y

Y at position 134 can be substituted with F

G at position 135 can be substituted with A

M at position 136 can be substituted with I or L

Xaa Xaa Xaa Met Xaa (SEQ ID NO: 50034)

Xaa Xaa Ser Xaa Xaa Gly Gly Xaa Xaa Xaa Xaa Ala Asp Ser Xaa Lys Gly (SEQ ID NO: 50035)

Xaa Xaa Leu Leu Xaa Xaa Tyr Xaa Xaa Xaa Xaa Xaa Xaa Asp Val (SEQ ID NO: 50036)

Ser Tyr Ala Met Ser (SEQ ID NO: 50501)

Ala Ile Ser Gly Arg Gly Gly Ser Thr Phe His Ala Asp Ser Val Lys Gly (SEQ ID NO: 50502)

Gly Glu Leu Glu Asp Tyr Tyr Phe Tyr Gly Met Asp Val (SEQ ID NO: 50503)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS | E | V | Q | L | L | E | S | - | G | G | G | L | V | Q | P | G | G | S | L | R | L | S | C | A | A | S |
| 21-225_4G12_HC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | | | | | H_CDR1 | | | | | | | | | | | | H_FR2 | | |
| CONSENSUS | G | - | F | T | F | S | S | - | - | - | - | - | Y | A | M | S | W | V | R | Q | A | P | G | K | G | L |
| 21-225_4G12_HC | . | . | . | . | . | . | . | . | . | . | . | . | . | . | . | . | . | . | . | . | . | . | . | . | . | . |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | H_CDR2 | | | | | | | | | | | | |
| CONSENSUS | E | W | V | S | A | I | S | G | R | . | . | . | G | G | S | T | F | Y | A | D | S | V | K | G | R | F |
| 21-225_4G12_HC | . | . | . | . | T | L | . | . | . | . | . | . | . | . | . | . | Y | Y | H | . | . | . | . | . | . | S |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| CONSENSUS | T | I | S | R | D | N | S | K | N | T | L | Y | L | Q | M | N | S | L | R | A | E | D | T | A | V | Y |
| 21-225_4G12_HC |   |   |   |   |   |   |   |   |   |   |   |   |   |   |   | S |   |   |   |   |   |   |   |   |   |   |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | H_FR4 | | | | | | | | | | |
| CONSENSUS | - | Y | F | Y | G | M | D | V | W | G | Q | G | T | T | V | T | V | S | S |
| 21-225_4G12_HC | . | . | Y | . | . | . | . | . | . | . | . | . | . | . | . | . | . | . | . |

FIGURE 57 (Continued)

Table 61. Consensus 27- VH3|3-33/D4|4-23|RF2/JH6 (SEQ ID NO: 50278):

QVQLVES-GGGVVQPGRSLRLSCAASG-FTFSS---YGMHWVRQAPGKGLEWVAVIWYD---GSNKYYADSVKGRFTISRDNSKNTLYLQMNSLRAEDTAVYYCARDRVYCSSTSC--------PYYYYGMDVWGQGTTVTVSS wherein:

S in position 33 can be substituted with G, D, R, H, T or N

G in position 40 can be substituted with V

M in position 41 can be substituted with L

H in position 42 can be substituted with N

V in position 57 can be substituted with L, F, I or D

I in position 58 can be substituted with F

W in position 59 can be substituted with R

Y in position 60 can be substituted with F

S in position 66 can be substituted with N or T

N in position 67 can be substituted with E, D or K

K in position 68 can be substituted with N or T

Y in position 69 can be substituted with S, D or N

Y in position 70 can be substituted with N

A in position 71 can be substituted with V

G in position 76 can be substituted with D

R in position 110 can be substituted with D, W or N

V in position 111 can be substituted with D, R, F or H

FIGURE 57 (Continued)

Y in position 112 can be substituted with S, E, G or F
C in position 113 can be substituted with G or E
S in position 114 can be substituted with G
S in position 115 can be substituted with G, R or N
T in position 116 can be substituted with null (-), S or P
S in position 117 can be substituted with P, null (-) or T
C in position 118 can be substituted with null (-)
null (-) in position 119 can be substituted with S, H, L or Y
P in position 129 can be substituted with null (-), S or Y
Y in position 130 can be substituted with null (-)
Y in position 131 can be substituted with null (-)
Y in position 132 can be substituted with null (-)
Y in position 134 can be substituted with F
G in position 135 can be substituted with A
M in position 136 can be substituted with L Xaa Tyr Xaa Xaa Xaa (SEQ ID NO: 50037)

Xaa Xaa Xaa Xaa Asp Gly Xaa Xaa Xaa Xaa Xaa Xaa Asp Ser Val Lys Xaa (SEQ ID NO: 50038)

Asp Xaa Xaa Xaa Xaa Xaa Xaa Xaa Xaa Xaa Xaa Xaa Xaa Xaa Xaa Xaa Tyr Xaa Xaa Asp Val (SEQ ID NO: 50039)

Ser Tyr Gly Met His (SEQ ID NO: 50504)

FIGURE 57 (Continued)

Val Ile Trp Tyr Asp Gly Ser Asn Lys Tyr Tyr Ala Asp Ser Val Lys Gly (SEQ ID NO: 50505)

Asp Arg Val Tyr Cys Ser Ser Thr Ser Cys Pro Tyr Tyr Tyr Tyr Tyr Gly Met Asp Val (SEQ ID NO: 50506)

Table 62. Consensus 28- VH3|3-21/DI|1-1|RF2/JH4 (SEQ ID NO: 50279):
EVQLVES-GGGLVKPGGSLRLSCAASG-FTFSS-----YSMNWVRQAPGKGLEWVSSISGS---
SSYIYYADSVKGRFTISRDNAKNSLYLQMNSLRAEDTAVYYCARVAS---------------FDYWGQGTLVTVSS wherein:

S at position 33 can be substituted with N

S at position 40 can be substituted with T, K, N or R

M at position 41 can be substituted with L

I at position 58 can be substituted with T

G at position 60 can be substituted with S

S at position 61 can be substituted with G, N or T

S at position 65 can be substituted with G, D or N

S at position 66 can be substituted with T

Y at position 67 can be substituted with F, D, L, N or S

I at position 68 can be substituted with M or T

Y at position 69 can be substituted with N

A at position 71 can be substituted with T

A at position 110 can be substituted with N or S

S at position 111 can be substituted with A, G, T, L, H or N

F at position 136 can be substituted with L or N

Y at position 138 can be substituted with C or S

Xaa Tyr Xaa Xaa Asn (SEQ ID NO: 50040)

FIGURE 57 (Continued)

Ser Xaa Ser Xaa Xaa Xaa Xaa Xaa Xaa Xaa Tyr Xaa Asp Ser Val Lys Gly (SEQ ID NO: 50041)

Val Xaa Xaa Xaa Asp Xaa (SEQ ID NO: 50042)

Ser Tyr Ser Met Asn (SEQ ID NO: 50507)

Ser Ile Ser Gly Ser Ser Tyr Ile Tyr Tyr Ala Asp Ser Val Lys Gly (SEQ ID NO: 50508)

Val Ala Ser Phe Asp Tyr (SEQ ID NO: 50509)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | . | . | . | . | . | F | D | Y | W | G | Q | G | T | L | V | T | V | S | S |
| 21-225_14D6_HC | . | . | . | . | . | . | . | . | . | . | . | . | . | . | . | . | . | . | . |
| 21-225_157E4_HC | . | . | . | . | . | . | . | . | . | . | . | . | . | . | . | . | . | . | . |
| 21-225_157H10_HC | . | . | . | . | . | . | . | . | . | . | . | . | . | . | . | . | . | . | . |
| 21-225_15A2_HC | . | . | . | . | . | . | . | . | . | . | . | . | . | . | . | . | . | . | . |
| 21-225_16A11_HC | . | . | . | . | . | . | . | . | . | . | . | . | . | . | . | . | . | . | . |
| 21-225_16B8_HC | . | . | . | . | . | . | . | . | . | . | . | . | . | . | . | . | . | . | . |
| 21-225_16H1_HC | . | . | . | . | . | . | . | . | . | . | . | . | . | . | . | . | . | . | . |
| 21-225_17H5_HC | . | . | . | . | . | . | . | . | . | . | . | . | . | . | . | . | . | . | . |
| 21-225_17H6_HC | . | . | . | . | . | . | . | . | . | . | . | . | . | . | . | . | . | . | . |
| 21-225_1F1_HC | . | . | . | . | . | . | . | . | . | . | . | . | . | . | . | . | . | . | . |
| 21-225_20H7_HC | . | . | . | . | . | L | . | S | . | . | . | . | . | . | . | . | . | . | . |
| 21-225_22B12_HC | . | . | . | . | . | L | . | . | . | . | . | . | . | . | . | . | . | . | . |
| 21-225_23A11_HC | . | . | . | . | . | . | . | C | . | . | . | . | . | . | . | . | . | . | . |
| 21-225_27C5_HC | . | . | . | . | . | . | . | . | . | . | . | . | . | . | . | . | . | . | . |
| 21-225_27H12_HC | . | . | . | . | . | . | . | . | . | . | . | . | . | . | . | . | . | . | . |
| 21-225_2A4_HC | . | . | . | . | . | . | . | . | . | . | . | . | . | . | . | . | . | . | . |
| 21-225_2C12_HC | . | . | . | . | . | N | . | . | . | . | . | . | . | . | . | . | . | . | . |
| 21-225_32B3_HC | . | . | . | . | . | . | . | . | . | . | . | . | . | . | . | . | . | . | . |
| 21-225_35H8_HC | . | . | . | . | . | . | . | . | . | . | . | . | . | . | . | . | . | . | . |
| 21-225_50G10_HC | . | . | . | . | . | . | . | . | . | . | . | . | . | . | . | . | . | . | . |
| 21-225_52E3_HC | . | . | . | . | . | . | . | . | . | . | . | . | . | . | . | . | . | . | . |
| 21-225_52H12_HC | . | . | . | . | . | . | . | . | . | . | . | . | . | . | . | . | . | . | . |
| 21-225_56A5_HC | . | . | . | . | . | . | . | . | . | . | . | . | . | . | . | . | . | . | . |
| 21-225_56H1_HC | . | . | . | . | . | . | . | . | . | . | . | . | . | . | . | . | . | . | . |
| 21-225_57B2_HC | . | . | . | . | . | . | . | . | . | . | . | . | . | . | . | . | . | . | . |
| 21-225_5E11_HC | . | . | . | . | . | . | . | . | . | . | . | . | . | . | . | . | . | . | . |
| 21-225_5F4_HC | . | . | . | . | . | . | . | . | . | . | . | . | . | . | . | . | . | . | . |
| 21-225_70E12_HC | . | . | . | . | . | . | . | C | . | . | . | . | . | . | . | . | . | . | . |

FIGURE 57 (Continued)

Table 63.   Consensus 29-VH4|4-30.1/D3|3-22|RF2/JH6 (SEQ ID NO: 50280):

QVQLQES-GPGLVKPSQTLSLTCTVSG-GSISSG----DYYWNWIRQHPGKGLEWIGYIFY----
SGSTYYNPSLKSRVTISVDTSKNQFSLKLSSVTAADTAVYYCARGDYDGSGSY----------HYYYGMDVWGQGTTVTVSS wherein:

G at position 34 can be substituted with V

D at position 38 can be substituted with V, G or S

Y at position 40 can be substituted with H

N at position 42 can be substituted with S

Y at position 57 can be substituted with N or F

I at position 58 can be substituted with L

F at position 59 can be substituted with Y or H

Y at position 60 can be substituted with H

Y at position 70 can be substituted with N

K at position 75 can be substituted with R

Y at position 132 can be substituted with F or H

Y at position 134 can be substituted with H

M at position 136 can be substituted with L

Ser Xaa Xaa Tyr Xaa Trp Xaa (SEQ ID NO: 50230)

Xaa Xaa Xaa Xaa Ser Gly Ser Thr Tyr Xaa Asn Pro Ser Leu Xaa Ser (SEQ ID NO: 50231)

Gly Asp Tyr Asp Gly Ser Gly Ser Tyr His Xaa Tyr Xaa Gly Xaa Asp Val (SEQ ID NO: 50232)

Ser Gly Asp Tyr Tyr Trp Asn (SEQ ID NO: 50510)

FIGURE 57 (Continued)

Tyr Ile Phe Tyr Ser Gly Ser Thr Tyr Tyr Asn Pro Ser Leu Lys Ser (SEQ ID NO: 50511)

Gly Asp Tyr Asp Gly Ser Gly Ser Tyr His Tyr Tyr Tyr Gly Met Asp Val (SEQ ID NO: 50512)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 |
|---|---|---|---|---|---|---|---|---|---|---|---|---|---|---|---|---|---|---|---|---|---|---|---|---|---|---|---|
| | | | | | | | | | | | | | | | | H_FR1 | | | | | | | | | | | |
| CONSENSUS | Q | V | Q | L | Q | E | S | - | G | P | G | L | V | K | P | S | Q | T | L | S | L | T | C | T | V | S | G |
| 21-225_190A3_HC | . | . | . | . | . | . | . | . | . | . | . | . | . | . | . | . | . | . | . | . | . | . | . | . | . | . | . |
| 21-225_190A7_HC | . | . | . | . | . | . | . | . | . | . | . | . | . | N | . | . | . | . | . | . | . | . | . | . | . | . | . |
| 21-225_190B4_HC | . | . | . | . | . | . | . | . | . | . | . | . | . | . | . | . | . | . | . | . | . | . | . | . | . | . | . |
| 21-225_191A3_HC | . | . | . | . | . | . | . | . | . | . | . | . | . | . | . | . | . | . | . | . | . | . | . | . | . | . | . |
| 21-225_191D3_HC | . | . | . | . | . | . | . | . | . | . | . | . | . | . | . | . | . | . | . | . | . | . | . | . | . | . | . |
| 21-225_191F1_HC | . | . | . | . | . | . | . | . | . | . | . | . | . | . | . | . | . | . | . | . | . | . | . | . | . | . | . |
| 21-225_191H7_HC | . | . | . | . | . | . | . | . | . | . | . | . | . | . | . | . | . | . | . | . | . | . | . | . | . | . | . |
| 21-225_192B3_HC | . | . | . | . | . | . | . | . | . | . | . | . | . | . | . | . | . | . | . | . | . | . | . | . | . | . | . |
| 21-225_192G12_HC | . | . | . | . | . | . | . | . | . | . | . | . | . | . | . | . | . | . | . | . | . | . | . | . | . | . | . |
| 21-225_192H3_HC | . | . | . | . | . | . | . | . | . | . | . | . | . | . | . | . | . | . | . | . | . | . | . | . | . | . | . |
| 21-225_193A1_HC | . | . | . | . | . | . | . | . | . | . | . | . | . | . | . | . | . | . | . | . | . | . | . | . | . | . | . |
| 21-225_193B1_HC | . | . | . | . | . | . | . | . | . | . | . | . | . | . | . | . | . | . | . | . | . | . | . | . | . | . | . |
| 21-225_193C8_HC | . | . | . | . | . | . | . | . | . | . | . | . | . | . | . | . | . | . | . | . | . | . | . | . | . | . | . |
| 21-225_193D8_HC | . | . | . | . | . | . | . | . | . | . | . | . | . | . | . | . | . | . | . | . | . | . | . | . | . | . | . |
| 21-225_193F3_HC | . | . | . | . | . | . | . | . | . | . | . | . | . | . | . | . | . | . | . | . | . | . | . | . | . | . | . |
| 21-225_193G8_HC | . | . | . | . | . | . | . | . | . | . | . | . | . | . | . | . | . | . | . | . | . | . | . | . | . | . | . |
| 21-225_193H6_HC | . | . | . | . | . | . | . | . | . | . | . | . | . | . | . | . | . | . | . | . | . | . | . | . | . | . | . |
| 21-225_194E5_HC | . | . | . | . | . | . | . | . | . | . | . | . | . | . | . | . | . | . | . | . | . | . | . | . | . | . | . |
| 21-225_194E6_HC | . | . | . | . | . | . | . | . | . | . | . | . | . | N | . | . | . | . | . | . | . | . | . | . | . | . | . |
| 21-225_196H12_HC | . | . | . | . | . | . | . | . | . | . | . | . | . | . | . | . | . | . | . | . | . | . | . | . | . | . | . |
| 21-225_197F4_HC | . | . | . | . | . | . | . | . | . | . | . | . | . | . | . | . | . | . | . | . | . | . | . | . | . | . | . |
| 21-225_198B1_HC | . | . | . | . | . | . | . | . | . | . | . | . | . | . | . | . | . | . | . | . | . | . | . | . | . | . | . |
| 21-225_198E1_HC | . | . | . | . | . | . | . | . | . | . | . | . | . | . | . | . | . | . | . | . | . | . | . | . | . | . | . |
| 21-225_199C2_HC | . | . | . | . | . | . | . | . | . | . | . | . | . | . | . | . | . | . | . | . | . | . | . | . | . | . | . |
| 21-225_199C7_HC | . | . | . | . | . | . | . | . | . | . | . | . | . | . | . | . | . | . | . | . | . | . | . | . | . | . | . |
| 21-225_200F10_HC | . | . | . | . | . | . | . | . | . | . | . | . | . | . | . | . | . | . | . | . | . | . | . | . | . | . | . |

Table 64. Consensus 30- VH3|3-23/D7|7-27|RF1/JH6 (SEQ ID NO: 50281):

EVQLLES-GGGLVQPGGSLRLSCAASG-FTFSS-----YAMSWVRQAPGKGLEWVSVISGG----GSSTYYADSVKGRFTISRDNSKNTLYLQMNSLRAEDTAVYYCAKWRGNPT-------------DYGMDVWGQGTTVTVSS wherein:

S at position 33 can be substituted with N or T
Y at position 39 can be substituted with H
A at position 40 can be substituted with P or V
V at position 57 can be substituted with A or I
G at position 61 can be substituted with S
S at position 66 can be substituted with G or T
S at position 67 can be substituted with T
T at position 68 can be substituted with A
W at position 109 can be substituted with A
R at position 110 can be substituted with G
N at position 112 can be substituted with T
P at position 113 can be substituted with T
T at position 114 can be substituted with G
null (-) at position 115 can be substituted with S
null (-) at position 116 can be substituted with Y
null (-) at position 132 can be substituted with Y
D at position 133 can be substituted with Y

FIGURE 57 (Continued)

Y at position 134 can be substituted with N or S

Xaa Xaa Xaa Met Ser (SEQ ID NO: 50043)

Xaa Ile Ser Gly Xaa Gly Xaa Xaa Xaa Tyr Tyr Ala Asp Ser Val Lys Gly (SEQ ID NO: 50044)

Xaa Xaa Gly Xaa Xaa Xaa Xaa Xaa Xaa Xaa Gly Met Asp (SEQ ID NO: 50045)

Ser Tyr Ala Met Ser (SEQ ID NO: 50513)

Val Ile Ser Gly Gly Gly Ser Ser Thr Tyr Tyr Ala Asp Ser Val Lys Gly (SEQ ID NO: 50514)

Trp Arg Gly Asn Pro Thr Asp Tyr Gly Met Asp (SEQ ID NO: 50515)

| Reference # | 105 Y | 106 C | 107 A | 108 K | 109 W | 110 R | 111 G | 112 N | 113 P | 114 T | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | A | K | W | R | G | N | P | T | | | | | | | | | H_CDR3 | | | | | | | |
| 21-225_146A2_HC | . | . | . | . | . | . | . | . | . | . | . | . | . | . | . | . | . | . | . | . | . | . | . | . | . | . |
| 21-225_146A3_HC | . | . | . | . | . | . | . | . | . | . | . | . | . | . | . | . | . | . | . | . | . | . | . | . | . | . |
| 21-225_146B11_HC | . | . | . | . | . | . | . | . | . | . | . | . | . | . | . | . | . | . | . | . | . | . | . | . | . | . |
| 21-225_146C11_HC | . | . | . | . | . | . | . | . | . | . | . | . | . | . | . | . | . | . | . | . | . | . | . | . | . | . |
| 21-225_147B12_HC | . | . | . | . | . | . | . | . | . | . | . | . | . | . | . | . | . | . | . | . | . | . | . | . | . | . |
| 21-225_147E11_HC | . | . | . | . | . | . | . | . | . | . | . | . | . | . | . | . | . | . | . | . | . | . | . | . | . | . |
| 21-225_147E7_HC | . | . | . | . | . | . | . | . | . | . | . | . | . | . | . | . | . | . | . | . | . | . | . | . | . | . |
| 21-225_148C6_HC | . | . | . | . | . | . | . | . | . | . | . | . | . | . | . | . | . | . | . | . | . | . | . | . | . | . |
| 21-225_148G11_HC | . | . | . | . | . | . | . | . | . | . | . | . | . | . | . | . | . | . | . | . | . | . | . | . | . | . |
| 21-225_148G8_HC | . | . | . | . | . | . | . | . | . | . | . | . | . | . | . | . | . | . | . | . | . | . | . | . | . | . |
| 21-225_148H11_HC | . | . | . | . | . | . | . | . | . | . | . | . | . | . | . | . | . | . | . | . | . | . | . | . | . | . |
| 21-225_149C10_HC | . | . | . | . | . | . | . | . | . | . | . | . | . | . | . | . | . | . | . | . | . | . | . | . | . | . |
| 21-225_149C7_HC | . | . | . | . | . | . | . | . | . | . | . | . | . | . | . | . | . | . | . | . | . | . | . | . | . | . |
| 21-225_150F6_HC | . | . | . | . | . | . | . | . | . | . | . | . | . | . | . | . | . | . | . | . | . | . | . | . | . | . |
| 21-225_150H11_HC | . | . | . | . | . | . | . | . | . | . | . | . | . | . | . | . | . | . | . | . | . | . | . | . | . | . |
| 21-225_151B9_HC | . | . | . | . | . | . | . | . | . | . | . | . | . | . | . | . | . | . | . | . | . | . | . | . | . | . |
| 21-225_151H5_HC | . | . | . | . | . | . | . | . | . | . | . | . | . | . | . | . | . | . | . | . | . | . | . | . | . | . |
| 21-225_151H7_HC | . | . | . | . | . | . | . | . | . | . | . | . | . | . | . | . | . | . | . | . | . | . | . | . | . | . |
| 21-225_152D7_HC | . | . | . | . | . | . | . | . | . | . | . | . | . | . | . | . | . | . | . | . | . | . | . | . | . | . |
| 21-225_152G6_HC | . | . | . | . | . | . | . | . | . | . | . | . | . | . | . | . | . | . | . | . | . | . | . | . | . | . |
| 21-225_154C4_HC | . | . | . | . | . | . | . | . | . | . | . | . | . | . | . | . | . | . | . | . | . | . | . | . | . | . |
| 21-225_154E10_HC | . | . | . | . | A | Q | . | T | T | O | S | Y | . | . | . | . | . | . | . | . | . | . | . | . | . | . |
| 21-225_155C10_HC | . | . | . | . | . | . | . | . | . | . | . | . | . | . | . | . | . | . | . | . | . | . | . | . | . | . |
| 21-225_207C9_HC | . | . | . | . | . | . | . | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 H_FR4 | 144 | 145 | 146 | 147 | 148 | 149 |
|---|---|---|---|---|---|---|---|---|---|---|---|---|---|---|---|---|---|---|---|
| CONSENSUS | - | D | Y | G | M | D | V | W | G | Q | G | T | T | V | T | V | S | S |
| 21-225_146A2_HC | . | . | . | . | . | . | . | . | . | . | . | . | . | . | . | . | . | . |
| 21-225_146A3_HC | . | . | . | . | . | . | . | . | . | . | . | . | . | . | . | . | . | . |
| 21-225_146B11_HC | . | . | . | . | . | . | . | . | . | . | . | . | . | . | . | . | . | . |
| 21-225_146C11_HC | . | . | . | . | . | . | . | . | . | . | . | . | . | . | . | . | . | . |
| 21-225_147B12_HC | . | . | . | . | . | . | . | . | . | . | . | . | . | . | . | . | . | . |
| 21-225_147E11_HC | . | . | . | . | . | . | . | . | . | . | . | . | . | . | . | . | . | . |
| 21-225_147E7_HC | . | . | . | . | . | . | . | . | . | . | . | . | . | . | . | . | . | . |
| 21-225_148C6_HC | . | . | . | . | . | . | . | . | . | . | . | . | . | . | . | . | . | . |
| 21-225_148G11_HC | . | . | . | . | . | . | . | . | . | . | . | . | . | . | . | . | . | . |
| 21-225_148G6_HC | . | . | . | . | . | . | . | . | . | . | . | . | . | . | . | . | . | . |
| 21-225_148H11_HC | . | . | . | . | . | . | . | . | . | . | . | . | . | . | . | . | . | . |
| 21-225_149C10_HC | . | . | . | . | . | . | . | . | . | . | . | . | . | . | . | . | . | . |
| 21-225_149C7_HC | . | . | . | . | . | . | . | . | . | . | . | . | . | . | . | . | . | . |
| 21-225_150F6_HC | . | . | . | . | . | . | . | . | . | . | . | . | . | . | . | . | . | . |
| 21-225_150H11_HC | . | . | . | . | . | . | . | . | . | . | . | . | . | . | . | . | . | . |
| 21-225_151B9_HC | . | . | . | . | . | . | . | . | . | . | . | . | . | . | . | . | . | . |
| 21-225_151H5_HC | . | . | . | S | . | . | . | . | . | . | . | . | . | . | . | . | . | . |
| 21-225_151H7_HC | . | . | . | . | . | . | . | . | . | . | . | . | . | . | . | . | . | . |
| 21-225_152D7_HC | . | . | . | . | . | . | . | . | . | . | . | . | . | . | . | . | . | . |
| 21-225_152G8_HC | . | . | . | . | . | . | . | . | . | . | . | . | . | . | . | . | . | . |
| 21-225_154C4_HC | . | . | . | . | . | . | . | . | . | . | . | . | . | . | . | . | . | . |
| 21-225_154E10_HC | . | Y | Y | N | . | . | . | . | . | . | . | . | . | . | . | . | . | . |
| 21-225_155C10_HC | . | . | . | . | . | . | . | . | . | . | . | . | . | . | . | . | . | . |
| 21-225_207C9_HC | . | . | . | . | . | . | . | . | . | . | . | . | . | . | . | . | . | . |

FIGURE 57 (Continued)

Table 65. Consensus 31-VH3|3-33/D4|4-17|RF2/JH4 (SEQ ID NO: 50282):

QVQLVES-GGGVVQPGRSLRLSCAASG-FTFSS----YGMHWVRQAPGKGLEWVAIIWYD---GSNKYYADSVKGRFTISRDNSKNTLYLQMNSLRAEDTAVYYCARDHYDFW-------SGHFDYWGQGTLVTVSS wherein:

S at position 33 can be substituted with N or T

M at position 41 can be substituted with L

I at position 57 can be substituted with V or A

I at position 58 can be substituted with M

S at position 66 can be substituted with T

N at position 67 can be substituted with Y or S

A at position 71 can be substituted with G, T or V

D at position 109 can be substituted with E

H at position 110 can be substituted with R, Q, A, G, T or Y

Y at position 111 can be substituted with G, F or H

D at position 112 can be substituted with I or F

F at position 113 can be substituted with V or L

W at position 114 can be substituted with G or null (-)

S at position 133 can be substituted with A or null (-)

G at position 134 can be substituted with T or E

H at position 135 can be substituted with Y, W or F

F at position 136 can be substituted with L or S

FIGURE 57 (Continued)

D at position 137 can be substituted with A, C or G
Y at position 138 can be substituted with F or S
Xaa Tyr Gly Xaa His (SEQ ID NO: 50253)

Xaa Xaa Trp Tyr Asp Gly Xaa Xaa Lys Tyr Tyr Xaa Asp Ser Val Lys Gly (SEQ ID NO: 50254)

Xaa Xaa Xaa Xaa Xaa Xaa Xaa Xaa Xaa Xaa Xaa Xaa (SEQ ID NO: 50255)

Ser Tyr Gly Met His (SEQ ID NO: 50516)

Ile Ile Trp Tyr Asp Gly Ser Asn Lys Tyr Tyr Ala Asp Ser Val Lys Gly (SEQ ID NO: 50517)

Asp His Tyr Asp Phe Trp Ser Gly His Phe Asp Tyr (SEQ ID NO: 50518)

FIGURE 57 (Continued)

Table 66. Consensus 32 - VH4|4-34/D4|4-17|RF2/JH4 (SEQ ID NO: 50283):

QVQLQQW-GAGLLKPSETLSLTCAVYG-GSFSG----YYWSWIRQPPGKGLEWIGEINH----
SGRTNYNPSLKSRVTISVDTSKNQFSLKLSSVTAADTAVYYCARDYGG----------LDYWGQGTLVTVSS wherein:

G at position 33 can be substituted with V, P, A, D or Y

Y at position 39 can be substituted with C, S or P

Y at position 40 can be substituted with F

I at position 58 can be substituted with S or V

H at position 60 can be substituted with I or Q

R at position 67 can be substituted with S

T at position 68 can be substituted with A or S

N at position 69 can be substituted with T

Y at position 70 can be substituted with F

Xaa Xaa Xaa Trp Ser (SEQ ID NO: 50233)

Glu Xaa Asn Xaa Ser Gly Xaa Xaa Xaa Xaa Asn Pro Ser Leu Lys Ser (SEQ ID NO: 50234)

Asp Tyr Gly Gly Leu Asp Tyr (SEQ ID NO: 50235)

Gly Tyr Tyr Trp Ser (SEQ ID NO: 50519)

Glu Ile Asn His Ser Gly Arg Thr Asn Tyr Asn Pro Ser Leu Lys Ser (SEQ ID NO: 50520)

Asp Tyr Gly Gly Leu Asp Tyr (SEQ ID NO: 50521)

Table 67. Consensus 33-VH4|4-39/D1|1-26|RF3/JH4 (SEQ ID NO: 50284):

QLQLQES-GPGLVKPSETLSLTCTVSG-GSISRS---SYYWGWIRQPPGKGLEWIGNIYY---
SGSTYYNPSLKSRVTISVDTSKNQFSLKLSSVTAADTAVYYCARHSSSW---------SLDYWGQGTLVTVSS wherein:

R in position 33 can be substituted with G

S in position 38 can be substituted with N

Y in position 39 can be substituted with S

N in position 57 can be substituted with S

S in position 67 can be substituted with Y, A, T or I

T in position 68 can be substituted with A, P or S

Y in position 69 can be substituted with Q, S, A or N

Y in position 70 can be substituted with C or H

N in position 71 can be substituted with I or T

H in position 109 can be substituted with L

S in position 111 can be substituted with T or G

L in position 136 can be substituted with F, I or V

Y in position 138 can be substituted with N, C, D or F

Xaa Ser Xaa Xaa Tyr Trp Gly (SEQ ID NO: 50046)

Xaa Ile Tyr Tyr Ser Gly Xaa Xaa Xaa Xaa Xaa Pro Ser Leu Lys Ser (SEQ ID NO: 50047)

Xaa Ser Xaa Ser Trp Ser Xaa Asp Xaa (SEQ ID NO: 50048)

Arg Ser Tyr Tyr Trp Gly (SEQ ID NO: 50522)

FIGURE 57 (Continued)

Asn Ile Tyr Tyr Ser Gly Ser Thr Tyr Tyr Asn Pro Ser Leu Lys Ser (SEQ ID NO: 50523)

His Ser Ser Trp Ser Leu Asp Tyr (SEQ ID NO: 50524)

Table 68. Consensus 34-VH1|1-02/D5|5-18|RF3/JH5 (SEQ ID NO: 50285):

QVQLVQS-GAEVKKPGASVKVSCKASG-YTFTG---YYIHWVRQAPGQGLEWMGWINPN---
SGGTNYAQKFQGRVTMTRDTSISTAYMELSRLRSDDTAVYYCARGYSYGY------------NWFDPWGQGTLVTVSS wherein:

G in position 33 can be substituted with D

Y in position 39 can be substituted with H

Y in position 40 can be substituted with F

I in position 41 can be substituted with M

H in position 42 can be substituted with N

P in position 60 can be substituted with S

N in position 61 can be substituted with K

S in position 65 can be substituted with N

G in position 66 can be substituted with D

G in position 67 can be substituted with D

A in position 71 can be substituted with E

Q in position 72 can be substituted with E

G in position 76 can be substituted with D

G in position 109 can be substituted with D

Y in position 110 can be substituted with G, T or F

S in position 111 can be substituted with Y, D or R

Y in position 112 can be substituted with S

FIGURE 57 (Continued)

G in position 113 can be substituted with null (-) or S

Y in position 114 can be substituted with S or null (-)

null (-) in position 115 can be substituted with G null (-) in position 116 can be substituted with S null (-) in position 132 can be substituted with Y null (-) in position 133 can be substituted with Y, F or H N in position 134 can be substituted with null (-) or D W in position 135 can be substituted with null (-), D or E F in position 136 can be substituted with L D in position 137 can be substituted with A P in position 138 can be substituted with S Xaa Xaa Xaa Xaa (SEQ ID NO: 50049)

Trp Ile Asn Xaa Xaa Xaa Xaa Thr Asn Tyr Xaa Xaa Lys Phe Gln Xaa (SEQ ID NO: 50050)

Xaa Xaa Xaa Xaa Xaa Xaa Xaa Xaa Xaa Xaa Xaa Xaa Xaa Xaa Xaa (SEQ ID NO: 50051)

Gly Tyr Ile His (SEQ ID NO: 50525)

Trp Ile Asn Pro Asn Ser Gly Gly Thr Asn Tyr Ala Gln Lys Phe Gln Gly (SEQ ID NO: 50526)

Gly Tyr Ser Tyr Gly Tyr Asn Trp Phe Asp Pro (SEQ ID NO: 50527)

Table 69. Consensus 35- VH3j3-33/D1|1-1|RF3/JH6 (SEQ ID NO: 50286):

QVQLVES-GGGVVQPGRSLRLSCAASG-FTFSH----YGMHWVRQAPGKGLEWVAVIWYD---
GSNKYYADSVKGRFTISRDNSKNTLYLQMNSLRAEDTAVYYCARGDWNP------------EGMDVWGQGTTVTVSS wherein:

H in position 33 can be substituted with N

Y in position 39 can be substituted with S

V in position 57 can be substituted with I

W in position 59 can be substituted with Y

N in position 67 can be substituted with Y

K in position 68 can be substituted with E

Y in position 70 can be substituted with C or N

G in position 109 can be substituted with D

D in position 110 can be substituted with R

W in position 111 can be substituted with H

N in position 112 can be substituted with Y

P in position 113 can be substituted with D null (-) in position 114 can be substituted with F null (-) in position 115 can be substituted with H null (-) in position 116 can be substituted with V null (-) in position 117 can be substituted with P FIGURE 57 (Continued)

null (-) in position 130 can be substituted with Y null (-) in position 131 can be substituted with Y null (-) in position 132 can be substituted with Y null (-) in position 133 can be substituted with Y E in position 134 can be substituted with Y M in position 136 can be substituted with L Xaa Xaa Gly Met His (SEQ ID NO: 50052)

Xaa Ile Xaa Tyr Asp Gly Ser Xaa Xaa Xaa Tyr Ala Asp Ser Val Lys Gly (SEQ ID NO: 50053)

Xaa Xaa Xaa Xaa Xaa Xaa Xaa Xaa Xaa Xaa Gly Xaa Xaa Asp Val (SEQ ID NO: 50054)

His Tyr Gly Met His (SEQ ID NO: 50528)

Val Ile Trp Tyr Asp Gly Ser Asn Lys Tyr Tyr Ala Asp Ser Val Lys Gly (SEQ ID NO: 50529)

Gly Asp Trp Asn Pro Glu Gly Met Asp Val (SEQ ID NO: 50530)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 |
|---|---|---|---|---|---|---|---|---|---|---|---|---|---|---|---|---|---|---|---|---|---|---|---|---|---|
| | | | | | | | | | | | | | | | | H_FR1 | | | | | | | | | |
| CONSENSUS | Q | V | Q | L | V | E | S | - | G | G | G | V | V | Q | P | G | R | S | L | R | L | S | C | A | A |
| 21-225_179C7_HC | | A | | | | | | | | | | | | | | | | | | | | | | | |
| 21-225_210D12_HC | | | | | | | | | | | | | | | | | | | | | | | | | |
| 21-225_210E12_HC | | | X | | | | | | | | | | | | | | | | | | | | | | |
| 21-225_211C1_HC | | | | | | | | | | | | | | | | | | | | | | | | | |
| 21-225_211G5_HC | | | X | | | | | | | | | | | | | | | | | | | | | | |
| 21-225_212A4_HC | | | | | | | | | | | | | | | A | | | | | | | | | | |
| 21-225_212C2_HC | | | | | | | | | | | | | | | | | | | | | | | | | |
| 21-225_212F6_HC | | | | | | | | | | | | | | | | | | | | | | | | | |
| 21-225_212G7_HC | | | | | | | | | | | | | | | | | | | | | | | | | |
| 21-225_213D5_HC | | T | | | | | | | | | | | | | | | | | | | | | | | |
| 21-225_213G3_HC | | | | | | | | | | | | | | | | | | | | | | | | | |
| 21-225_215D3_HC | | | | | | | | | | | | | | | | | | | | | | | | | |
| 21-225_216A3_HC | | | X | | | | | | | | | | | | | | | | | | | | | | |
| 21-225_216G1_HC | | | X | | | | | | | | | | | | | | | | | | | | | | |
| 21-225_217B2_HC | | | | | | | | | | | | | | | | | | | | | | | | | |
| 21-225_219A7_HC | | | | | | | | | | | | | | | | | | | | | | | | A | |
| 21-225_221G4_HC | | | | | | | | | | | | | | | | | | | | | | | | | |
| 21-225_221H2_HC | | | | | | | | | | | | | | | | | | | | | | | | | |

FIGURE 57 (Continued)

| Reference # | 26 | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 |
|---|---|---|---|---|---|---|---|---|---|---|---|---|---|---|---|---|---|---|---|---|---|---|---|---|---|
| | | | | | | | | | | | H_CDR1 | | | | | | | | | | | | | H_FR2 | |
| CONSENSUS | S | G | . | F | T | F | S | H | . | . | . | . | . | Y | G | M | H | W | V | R | Q | A | P | G | K |
| 21-225_179C7_HC | . | . | . | . | . | . | . | N | . | . | . | . | . | S | . | . | . | . | . | . | . | G | . | . | . |
| 21-225_210D12_HC | . | . | . | . | . | . | . | . | . | . | . | . | . | . | . | . | . | . | . | . | . | . | . | . | . |
| 21-225_210E12_HC | . | . | . | . | . | . | . | N | . | . | . | . | . | . | . | . | . | . | . | . | . | . | . | . | . |
| 21-225_211C1_HC | . | . | . | . | . | . | . | . | . | . | . | . | . | . | . | . | . | . | . | . | . | . | . | . | . |
| 21-225_211G5_HC | . | . | . | . | . | . | . | . | . | . | . | . | . | . | . | . | . | . | . | . | . | . | . | . | . |
| 21-225_212A4_HC | . | . | . | . | . | . | . | N | . | . | . | . | . | . | . | . | . | . | . | . | . | . | . | . | . |
| 21-225_212C2_HC | . | . | . | . | . | . | . | . | . | . | . | . | . | . | . | . | . | . | . | . | . | . | . | . | . |
| 21-225_212F6_HC | . | . | . | . | . | . | . | . | . | . | . | . | . | . | . | . | . | . | . | . | . | . | . | . | . |
| 21-225_212G7_HC | . | . | . | . | . | . | . | . | . | . | . | . | . | . | . | . | . | . | . | . | . | . | . | . | . |
| 21-225_213D5_HC | . | . | . | . | . | . | . | . | . | . | . | . | . | . | . | . | . | . | . | . | . | . | . | . | . |
| 21-225_213G3_HC | . | . | . | . | . | . | . | . | . | . | . | . | . | . | . | . | . | . | . | . | . | . | . | . | . |
| 21-225_215D3_HC | . | . | . | . | . | . | . | . | . | . | . | . | . | . | . | . | . | . | . | . | . | . | . | . | . |
| 21-225_216A3_HC | . | . | . | . | . | . | . | N | . | . | . | . | . | . | . | . | . | . | . | . | . | . | . | . | . |
| 21-225_216G1_HC | . | . | . | . | . | . | . | N | . | . | . | . | . | . | . | . | . | . | . | . | . | . | . | . | . |
| 21-225_217B2_HC | . | . | . | . | . | . | . | . | . | . | . | . | . | . | . | . | . | . | . | . | . | . | . | . | . |
| 21-225_219A7_HC | . | . | . | . | . | . | . | . | . | . | . | . | . | . | . | . | . | . | . | . | . | . | . | . | . |
| 21-225_221G4_HC | . | . | . | . | . | . | . | . | . | . | . | . | . | . | . | . | . | . | . | . | . | . | . | . | . |
| 21-225_221H2_HC | . | . | . | . | . | . | . | . | . | . | . | . | . | . | . | . | . | . | . | . | . | . | . | . | . |

| Reference # | 101 | 102 | 103 | 104 | 105 | 106 | 107 | 108 | 109 | 110 | 111 | 112 | 113 | 114 | 115 | 116 | 117 | 118 | 119 | 120 | 121 | 122 | 123 | 124 | 125 |
|---|---|---|---|---|---|---|---|---|---|---|---|---|---|---|---|---|---|---|---|---|---|---|---|---|---|
| | | | | | | | | | | | | | | | | | | | | | | | H_CDR3 | | |
| CONSENSUS | T | A | V | Y | Y | C | A | R | G | D | W | N | P | & | M | V | & | | | | | | | | |
| 21-225_179C7_HC | . | . | . | . | . | . | . | . | . | . | . | . | . | . | . | . | . | . | . | . | . | . | . | . | . |
| 21-225_210D12_HC | . | . | . | . | . | . | . | . | . | . | . | . | . | . | . | . | . | . | . | . | . | . | . | . | . |
| 21-225_210E12_HC | . | . | . | . | . | . | . | . | . | . | . | . | . | . | . | . | . | . | . | . | . | . | . | . | . |
| 21-225_211C1_HC | . | . | — | . | . | . | . | . | . | . | . | . | . | . | . | . | . | . | . | . | . | . | . | . | . |
| 21-225_211G5_HC | . | . | . | . | . | . | . | . | . | . | . | . | . | . | . | . | . | . | . | . | . | . | . | . | . |
| 21-225_212A4_HC | . | . | . | . | . | . | . | . | . | . | . | . | . | . | . | . | . | . | . | . | . | . | . | . | . |
| 21-225_212C2_HC | . | . | . | . | . | . | . | . | . | . | . | . | . | . | . | . | . | . | . | . | . | . | . | . | . |
| 21-225_212F6_HC | . | . | . | . | . | . | . | . | . | . | . | . | . | . | . | . | . | . | . | . | . | . | . | . | . |
| 21-225_212G7_HC | . | . | . | . | . | . | . | . | . | . | . | . | . | . | . | . | . | . | . | . | . | . | . | . | . |
| 21-225_213D5_HC | . | . | . | . | . | . | . | . | . | . | . | . | . | . | . | . | . | . | . | . | . | . | . | . | . |
| 21-225_213G3_HC | . | . | . | . | . | . | . | . | . | . | . | . | . | . | . | . | . | . | . | . | . | . | . | . | . |
| 21-225_215D3_HC | . | . | . | . | . | . | . | . | . | . | . | . | . | . | . | . | . | . | . | . | . | . | . | . | . |
| 21-225_216A3_HC | . | . | . | . | . | . | . | . | . | . | . | . | . | . | . | . | . | . | . | . | . | . | . | . | . |
| 21-225_216G1_HC | . | . | . | . | . | . | . | . | . | . | . | . | . | . | . | . | . | . | . | . | . | . | . | . | . |
| 21-225_217B2_HC | . | . | . | . | . | . | . | . | . | . | . | . | . | . | . | . | . | . | . | . | . | . | . | . | . |
| 21-225_219A7_HC | . | . | . | . | . | . | . | . | . | . | . | . | . | . | . | . | . | . | . | . | . | . | . | . | . |
| 21-225_221G4_HC | . | . | . | . | . | . | . | . | . | . | . | . | . | . | . | . | . | . | . | . | . | . | . | . | . |
| 21-225_221H2_HC | . | . | . | . | . | . | . | . | . | . | . | . | . | . | . | . | . | . | . | . | . | . | . | . | . |

Table 70. Consensus 36- VH|3-23/D4|4-17|RF2/JH4 (SEQ ID NO: 50287):

EVQLLES-GGGLVQPGGSLRLSCAASG-FTFSS---YAMSWVRQAPGKGLEWVSAISGS---
GGNTFYADSVKGRFTISRDNSKNTLYLQMNSLRAEDTAVYYCAKKDYDYVW----------GSPYFDYWGQGTLVTVSS wherein:

Y in position 39 can be substituted with S

S in position 42 can be substituted with T or N

A in position 57 can be substituted with V

S in position 59 can be substituted with I

R in position 61 can be substituted with S, N or F

G in position 66 can be substituted with S

N in position 67 can be substituted with R or S

T in position 68 can be substituted with A

F in position 69 can be substituted with Y

K in position 109 can be substituted with D or R

D in position 110 can be substituted with Y, H, M or R

Y in position 111 can be substituted with G or N

D in position 112 can be substituted with I, R or Y

Y in position 113 can be substituted with null (-), S or V

V in position 114 can be substituted with null (-), G, R or S

W in position 115 can be substituted with null (-) or I null (-) in position 116 can be substitute with A FIGURE 57 (Continued)

G in position 132 can be substituted with null (-) or V

S in position 133 can be substituted with null (-), A, T or Y

P in position 134 can be substituted with null (-), G or I

Y in position 135 can be substituted with F or T

Ser Xaa Ala Met Xaa (SEQ ID NO: 50055)

Xaa Ile Xaa Gly Xaa Gly Xaa Xaa Xaa Xaa Tyr Ala Asp Ser Val Lys Gly (SEQ ID NO: 50056)

Xaa Xaa Xaa Xaa Xaa Xaa Xaa Xaa Xaa Xaa Xaa Phe Asp Tyr (SEQ ID NO: 50057)

Ser Tyr Ala Met Ser (SEQ ID NO: 50531)

Ala Ile Ser Gly Ser Gly Gly Asn Thr Phe Tyr Ala Asp Ser Val Lys Gly (SEQ ID NO: 50532)

Lys Asp Tyr Asp Tyr Val Trp Gly Ser Pro Tyr Phe Asp Tyr (SEQ ID NO: 50533)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 |
|---|---|---|---|---|---|---|---|---|---|---|---|---|---|---|---|---|---|---|---|---|---|---|---|---|---|
| | | | | | | | | | | | | | | | | H_FR1 | | | | | | | | | |
| CONSENSUS | E | V | Q | L | L | E | S | . | G | G | G | L | V | Q | P | G | G | S | L | R | L | S | C | A | A |
| 21-225_146A6_HC | . | . | . | . | . | . | . | . | . | . | . | . | . | . | . | . | . | . | . | . | . | . | . | . | . |
| 21-225_147D10_HC | . | . | . | . | . | . | . | . | . | . | . | . | . | . | S | . | . | . | . | . | . | . | . | . | . |
| 21-225_147D12_HC | . | . | . | . | . | . | . | . | . | . | . | . | . | . | . | . | . | . | . | . | . | . | . | . | . |
| 21-225_148E2_HC | . | . | . | . | . | . | . | . | . | . | . | . | . | . | . | . | . | . | . | . | . | . | . | . | . |
| 21-225_149C6_HC | . | . | . | . | . | . | . | . | . | . | . | . | . | . | . | . | . | . | . | . | . | . | . | . | . |
| 21-225_149D11_HC | . | . | . | . | . | . | . | . | . | . | . | . | . | . | . | . | . | . | . | . | . | . | . | . | . |
| 21-225_149F8_HC | . | . | . | . | . | . | . | . | . | . | . | . | . | . | . | . | . | . | . | . | . | . | . | . | . |
| 21-225_150C5_HC | . | . | . | . | . | . | . | . | . | . | . | . | . | . | . | . | . | . | . | . | . | . | . | . | . |
| 21-225_152G10_HC | . | . | . | . | . | . | . | . | . | . | . | . | . | . | . | . | . | . | . | . | . | . | . | . | . |
| 21-225_152H7_HC | . | . | . | . | . | . | . | . | . | . | . | . | . | . | T | . | . | . | . | . | . | . | . | . | . |
| 21-225_155A4_HC | . | . | . | . | . | . | . | . | . | . | . | . | . | . | T | . | . | . | . | . | . | . | . | . | . |
| 21-225_155B4_HC | . | . | . | . | . | . | . | . | . | . | . | . | . | . | . | . | . | . | . | . | . | . | . | . | . |
| 21-225_178F7_HC | . | . | . | . | . | . | . | . | . | . | . | . | . | . | . | . | . | . | . | . | . | . | . | . | . |
| 21-225_179G1_HC | . | . | . | . | . | . | . | . | . | . | . | . | . | . | . | . | . | . | . | . | . | . | . | . | . |
| 21-225_190D12_HC | . | . | . | . | . | . | . | . | . | . | . | . | . | . | . | . | . | . | . | . | . | . | . | . | . |
| 21-225_197C8_HC | . | . | . | . | . | . | . | . | . | . | . | . | . | . | . | . | . | . | . | . | . | . | . | . | . |
| 21-225_55E1_HC | . | . | . | . | . | . | . | . | . | . | . | . | . | . | . | . | . | . | . | . | . | . | . | . | . |

|                          | H_CDR2 |    |    |    |    |    |    |    |    |    |    |    |    |    |    |    |    |    |    |    |    |    |    |    |    |
|--------------------------|----|----|----|----|----|----|----|----|----|----|----|----|----|----|----|----|----|----|----|----|----|----|----|----|----|
| Reference #              | 51 | 52 | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 |
| CONSENSUS                | G  | L  | E  | W  | V  | S  | A  | I  | S  | G  | -  | -  | -  | -  | G  | G  | N  | T  | F  | Y  | A  | D  | S  | V  | K  |
| 21-225_146A6_HC          | .  | .  | .  | .  | .  | .  | .  | .  | .  | .  | S  | .  | .  | .  | .  | .  | .  | .  | .  | .  | .  | .  | .  | .  | .  |
| 21-225_147D10_HC         | .  | .  | .  | .  | .  | .  | .  | .  | .  | .  | S  | .  | .  | .  | .  | .  | .  | .  | .  | .  | .  | .  | .  | .  | .  |
| 21-225_147D12_HC         | .  | .  | .  | .  | .  | .  | .  | .  | .  | .  | S  | .  | .  | .  | .  | .  | .  | .  | .  | .  | .  | .  | .  | .  | .  |
| 21-225_148E2_HC          | .  | .  | .  | .  | .  | .  | .  | .  | .  | .  | S  | .  | .  | .  | .  | .  | .  | .  | .  | .  | .  | .  | .  | .  | .  |
| 21-225_149C6_HC          | .  | .  | .  | .  | .  | .  | .  | .  | .  | .  | S  | .  | .  | .  | .  | .  | .  | .  | .  | .  | .  | .  | .  | .  | .  |
| 21-225_149D11_HC         | .  | .  | .  | .  | .  | .  | .  | .  | .  | .  | S  | .  | .  | .  | .  | .  | .  | .  | .  | .  | .  | .  | .  | .  | .  |
| 21-225_149F8_HC          | .  | .  | .  | .  | .  | .  | .  | .  | .  | .  | S  | .  | .  | .  | .  | .  | .  | .  | .  | .  | .  | .  | .  | .  | .  |
| 21-225_150C5_HC          | .  | .  | .  | .  | .  | .  | .  | .  | .  | .  | S  | .  | .  | .  | .  | .  | .  | .  | .  | .  | .  | .  | .  | .  | .  |
| 21-225_152G10_HC         | .  | .  | .  | .  | .  | .  | .  | .  | .  | .  | S  | .  | .  | .  | .  | .  | .  | .  | .  | .  | .  | .  | .  | .  | .  |
| 21-225_152H7_HC          | .  | .  | .  | .  | .  | .  | .  | .  | .  | .  | S  | .  | .  | .  | .  | .  | .  | .  | .  | .  | .  | .  | .  | .  | .  |
| 21-225_155A4_HC          | .  | .  | .  | .  | .  | .  | V  | .  | .  | .  | S  | .  | .  | .  | .  | .  | .  | .  | .  | .  | .  | .  | .  | .  | .  |
| 21-225_155B4_HC          | .  | .  | .  | .  | .  | .  | V  | .  | .  | .  | S  | .  | .  | .  | .  | .  | .  | .  | .  | .  | .  | .  | .  | .  | .  |
| 21-225_178F7_HC          | .  | .  | .  | .  | .  | .  | .  | .  | .  | .  | L  | .  | .  | .  | .  | .  | .  | .  | .  | .  | .  | .  | .  | .  | .  |
| 21-225_179G1_HC          | .  | .  | .  | .  | Q  | .  | .  | .  | -  | .  | N  | .  | .  | .  | .  | .  | .  | A  | Y  | .  | .  | .  | .  | .  | .  |
| 21-225_190D12_HC         | .  | .  | .  | .  | .  | .  | .  | .  | -  | .  | N  | .  | .  | .  | .  | .  | .  | A  | Y  | .  | .  | .  | .  | .  | .  |
| 21-225_197C8_HC          | .  | .  | .  | .  | .  | .  | .  | .  | .  | .  | .  | .  | .  | .  | .  | S  | S  | .  | .  | .  | .  | .  | .  | .  | .  |
| 21-225_55E1_HC           | .  | .  | .  | .  | .  | .  | .  | .  | .  | .  | .  | .  | .  | .  | .  | .  | S  | .  | .  | .  | .  | .  | .  | .  | .  |

Table 71. Consensus 37- VH1|1-02/D3|3-22|RF2/JH4 (SEQ ID NO: 50288):

QVQLVQS-GAEVKKPGASVKVSCKASG-YTFTG----YYMHWVRQAPGQGLEWMGWINPN---SGGTNYAQKFQGRVTMTRDTSISTAYMELSRLRSDDTAVYYCARSYYYGSGS------------YYNEFDYWGQGTLVTVSS wherein:

G in position 33 can be substituted with D

Y in position 39 can be substituted with H

Y in position 40 can be substituted with C

M in position 41 can be substituted with I

W in position 57 can be substituted with S

N in position 59 can be substituted with Y

P in position 60 can be substitute with R

N in position 61 can be substituted with K

G in position 67 can be substituted with A

T in position 68 can be substituted with A

N in position 69 can be substituted with D

Y in position 70 can be substituted with N or S

A in position 71 can be substituted with G or V

G in position 76 can be substituted with D or V

S in position 109 can be substituted with A, V or T

Y in position 110 can be substituted with F or N

Y in position 112 can be substituted with H

FIGURE 57 (Continued)

S in position 116 can be substituted with T

Y in position 133 can be substituted with H

E in position 135 can be substituted with G or D

Xaa Xaa Xaa Xaa His (SEQ ID NO: 50058)

Xaa Ile Xaa Xaa Xaa Ser Gly Xaa Xaa Xaa Xaa Gln Lys Phe Gln Xaa (SEQ ID NO: 50059)

Xaa Xaa Tyr Xaa Gly Ser Gly Xaa Tyr Xaa Asn Xaa Phe Asp Tyr (SEQ ID NO: 50060)

Gly Tyr Tyr Met His (SEQ ID NO: 50534)

Trp Ile Asn Pro Asn Ser Gly Gly Thr Asn Tyr Ala Gln Lys Phe Gln Gly (SEQ ID NO: 50535)

Ser Tyr Tyr Tyr Gly Ser Gly Ser Tyr Tyr Asn Glu Phe Asp Tyr (SEQ ID NO: 50536)

| Reference # | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 | 79 | 80 | 81 |
|---|---|---|---|---|---|---|---|---|---|---|---|---|---|---|---|---|---|---|---|---|---|---|---|---|---|---|---|
| | | | | | | | | | | | | H_CDR2 | | | | | | | | | | | | | | | |
| CONSENSUS | M | G | W | I | N | P | N | - | - | S | G | G | T | N | Y | A | Q | K | F | Q | G | R | V | T | M | T |
| 21-225_13F6_HC | . | . | . | . | . | . | . | . | . | . | . | . | . | . | . | . | . | . | . | . | . | . | . | . | . | . | . |
| 21-225_16F3_HC | . | . | . | . | . | . | . | . | . | . | . | . | . | . | . | . | . | . | . | . | . | . | . | . | . | . | . |
| 21-225_17D3_HC | . | . | . | . | . | . | . | . | . | . | . | . | . | . | . | . | . | . | . | . | . | . | . | . | . | . | . |
| 21-225_18E10_HC | . | . | . | . | . | . | . | . | . | . | . | . | A | . | . | . | . | . | . | . | . | . | . | . | . | . | . |
| 21-225_19E9_HC | . | . | . | . | . | . | . | . | . | . | . | . | . | . | N | . | . | . | . | . | . | . | . | . | . | . | . |
| 21-225_21D12_HC | . | . | . | . | . | . | . | . | . | . | . | . | . | . | . | Y | . | . | . | . | . | . | . | . | . | . | . |
| 21-225_31D12_LC1_HC | . | . | . | . | . | . | . | . | . | . | . | . | . | . | . | Y | . | . | . | . | . | . | . | . | . | . | . |
| 21-225_31D12_LC2_HC | . | . | . | . | . | . | . | . | . | . | . | . | . | . | . | . | . | . | . | . | . | . | . | . | . | . | . |
| 21-225_33E6_HC | . | . | S | . | . | . | . | . | . | . | . | . | . | . | . | . | . | . | . | . | . | . | . | . | . | . | . |
| 21-225_35E1_HC | . | . | . | . | Y | . | . | . | . | . | . | . | . | . | . | . | . | . | . | . | . | . | . | . | . | . | . |
| 21-225_4B3_HC | . | . | . | . | . | . | K | . | . | . | . | . | . | . | . | . | . | . | . | . | . | . | . | . | . | . | . |
| 21-225_68G6_HC | . | . | . | . | . | . | . | . | . | . | . | . | . | . | S | . | . | . | . | . | . | . | . | . | . | . | . |
| 21-225_69B11_HC | . | . | . | . | . | . | . | . | . | . | . | . | . | . | . | . | Q | . | . | . | . | . | . | . | . | . | . |
| 21-225_71D4_HC | . | . | . | . | . | . | . | . | . | . | . | . | . | . | . | . | Q | . | . | . | . | Q | V | . | . | . | . |
| 21-225_72B4_HC | . | . | . | . | . | . | . | . | . | . | . | . | . | D | . | . | . | . | . | . | . | . | . | . | . | . | . |
| 21-225_9G9_HC | . | . | . | . | . | . | . | . | . | . | . | . | . | . | . | . | . | . | . | . | . | . | . | . | . | . | . |

Table 72.   Consensus 38 – VH1|1-02/D4|4-23|RF2/JH6 (SEQ ID NO: 50289):

QVQLVQS-GAEVKKPGASVKVSCKASG-YTFTG----YYIHWVRQAPGQGLEWMGWINPY---
SGDTNYAQKFQGRVTMTRDTSISTAYMELSRLRFDDTAVFYCARDWGGYSS------YYYGMDVWGQGTTVTVSS wherein:

I in position 41 can be substituted with T

D in position 67 can be substituted with G

N in position 69 can be substituted with K

Y in position 70 can be substituted with S

Y in position 134 can be substituted with F

Gly Tyr Tyr Xaa His (SEQ ID NO: 50061)

Trp Ile Asn Pro Tyr Ser Gly Xaa Thr Xaa Xaa Ala Gln Lys Phe Gln Gly (SEQ ID NO: 50062)

Asp Trp Gly Gly Tyr Ser Ser Tyr Tyr Xaa Gly Met Asp Val (SEQ ID NO: 50236)

Gly Tyr Tyr Ile His (SEQ ID NO: 50537)

Trp Ile Asn Pro Tyr Ser Gly Asp Thr Asn Tyr Ala Gln Lys Phe Gln Gly (SEQ ID NO: 50538)

Asp Trp Gly Gly Tyr Ser Ser Tyr Tyr Tyr Gly Met Asp Val (SEQ ID NO: 50539)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | | | | | H_CDR1 | | | | | | | | | | | | H_FR2 | | | |
| CONSENSUS | G | - | Y | T | F | T | G | - | - | - | - | - | Y | Y | I | H | W | V | R | Q | A | P | G | Q | G | L |
| 21-225_224A7_HC | . | . | . | . | . | . | . | . | . | . | . | . | . | . | . | . | . | . | . | . | . | . | . | . | . | . |
| 21-225_224C11_HC | . | . | . | . | . | . | . | . | . | . | . | . | . | . | . | . | . | . | . | . | . | . | . | . | . | . |
| 21-225_224G1_HC | . | . | . | . | . | . | . | . | . | . | . | . | . | . | . | . | . | . | . | . | . | . | . | . | . | . |
| 21-225_224H11_HC | . | . | . | . | . | . | . | . | . | . | . | . | . | . | . | . | . | . | . | . | T | . | . | . | . | . |
| 21-225_225G4_HC | . | . | . | . | . | . | . | . | . | . | . | . | . | . | . | . | . | . | . | . | . | . | . | . | . | . |
| 21-225_226E11_HC | . | . | . | . | . | . | . | . | . | . | . | . | . | . | . | . | . | . | . | . | . | . | . | . | . | . |
| 21-225_226F10_HC | . | . | . | . | . | . | . | . | . | . | . | . | . | . | . | . | . | . | . | . | . | . | . | . | . | . |
| 21-225_226F9_HC | . | . | . | . | . | . | . | . | . | . | . | . | . | . | . | . | . | . | . | . | . | . | . | . | . | . |
| 21-225_226G8_HC | . | . | . | . | . | . | . | . | . | . | . | . | . | . | . | . | . | . | . | . | . | . | . | . | . | . |
| 21-225_226H12_HC | . | . | . | . | . | . | . | . | . | . | . | . | . | . | . | . | . | . | . | . | . | . | . | . | . | . |
| 21-225_226H9_HC | . | . | . | . | . | . | . | . | . | . | . | . | . | . | . | . | . | . | . | . | . | . | . | . | . | . |
| 21-225_227A8_HC | . | . | . | . | . | . | . | . | . | . | . | . | . | . | . | . | . | . | . | . | . | . | . | . | . | . |
| 21-225_227C1_HC | . | . | . | . | . | . | . | . | . | . | . | . | . | . | T | . | . | . | . | . | . | . | . | . | . | . |
| 21-225_227F2_HC | . | . | . | . | . | . | . | . | . | . | . | . | . | . | . | . | . | . | . | . | . | . | . | . | . | . |

FIGURE 57 (Continued)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | E | W | M | G | W | I | N | P | Y | - | - | - | S | G | D | T | N | Y | A | Q | K | F | Q | G | R | V |
| | | | | | | | | | | | | | | | H_CDR2 | | | | | | | | | | | |
| CONSENSUS | E | W | M | G | W | I | N | P | Y | - | - | - | S | G | D | T | N | Y | A | Q | K | F | Q | G | R | V |
| 21-225_224A7_HC | . | . | . | . | . | . | . | . | . | . | . | . | . | . | . | . | . | . | . | . | . | . | . | . | . | . |
| 21-225_224C11_HC | . | . | . | . | . | . | . | . | . | . | . | . | . | . | . | . | . | . | . | . | . | . | . | . | . | . |
| 21-225_224G1_HC | . | . | . | . | . | . | . | . | . | . | . | . | . | . | . | . | . | . | . | . | . | . | . | . | . | . |
| 21-225_224H11_HC | . | . | . | . | . | . | . | . | . | . | . | . | . | . | . | . | . | . | . | . | . | . | . | . | . | . |
| 21-225_225G4_HC | . | . | . | . | . | . | . | . | . | . | . | . | . | . | . | . | . | . | . | . | . | . | . | . | . | . |
| 21-225_226E11_HC | . | . | . | . | . | . | . | . | . | . | . | . | . | . | . | . | X | . | . | . | . | . | . | . | . | . |
| 21-225_226F10_HC | . | . | . | . | . | . | . | . | . | . | . | . | . | . | . | . | X | . | . | . | . | . | . | . | . | . |
| 21-225_226F9_HC | . | . | . | . | . | . | . | . | . | . | . | . | . | . | . | . | . | . | . | . | . | . | . | . | . | . |
| 21-225_226G8_HC | . | . | . | . | . | . | . | . | . | . | . | . | . | . | . | . | . | . | . | . | . | . | . | . | . | . |
| 21-225_226H12_HC | . | . | . | . | . | . | . | . | . | . | . | . | . | . | O | . | X | S | . | . | . | . | . | . | . | . |
| 21-225_226H9_HC | . | . | . | . | . | . | . | . | . | . | . | . | . | . | . | . | . | . | . | . | . | . | . | . | . | . |
| 21-225_227A8_HC | . | . | . | . | . | . | . | . | . | . | . | . | . | . | . | . | . | . | . | . | . | . | . | . | . | . |
| 21-225_227C1_HC | . | . | . | . | . | . | . | . | . | . | . | . | . | . | . | . | . | . | . | . | . | . | . | . | . | . |
| 21-225_227F2_HC | . | . | . | . | . | . | . | . | . | . | . | . | . | . | . | . | . | . | . | . | . | . | . | . | . | . |

FIGURE 57 (Continued)

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| CONSENSUS | T | M | T | R | D | T | S | I | S | T | A | Y | M | E | L | S | R | L | R | F | D | D | T | A | V | F |
| 21-225_224A7_HC | . | . | . | . | . | . | . | . | T | . | . | . | . | . | . | . | . | . | . | . | . | . | . | . | . | . |
| 21-225_224C11_HC | . | . | . | . | . | . | . | . | . | . | . | . | . | . | . | . | . | . | . | . | . | . | . | . | . | . |
| 21-225_224G1_HC | . | . | . | . | . | . | . | . | . | . | . | . | . | . | . | . | . | . | . | . | . | . | . | . | . | . |
| 21-225_224H11_HC | . | . | . | . | . | . | . | . | . | . | . | . | . | . | . | . | . | . | . | . | . | . | . | . | . | . |
| 21-225_225G4_HC | . | . | . | . | A | . | . | V | . | . | . | . | . | . | . | R | . | . | . | . | . | . | . | . | . | . |
| 21-225_226E11_HC | . | . | . | . | . | . | . | . | . | . | . | . | . | . | . | R | . | . | . | . | . | . | . | . | . | . |
| 21-225_226F10_HC | . | . | . | . | . | . | . | . | . | . | . | . | . | . | . | . | . | . | . | L | . | . | . | . | . | . |
| 21-225_226F9_HC | . | . | . | . | . | . | . | . | . | . | . | . | . | . | . | . | . | . | . | . | . | . | . | . | . | . |
| 21-225_226G8_HC | . | . | . | . | . | . | . | V | . | . | . | . | . | . | . | R | . | . | . | . | . | . | . | . | . | . |
| 21-225_226H12_HC | . | . | . | . | . | . | . | . | . | . | . | . | . | . | . | . | . | . | . | . | . | . | . | . | . | . |
| 21-225_226H9_HC | . | . | . | . | . | . | . | . | . | . | . | . | . | . | . | . | . | . | . | . | . | . | . | . | . | . |
| 21-225_227A8_HC | . | . | . | . | . | . | . | . | . | . | . | . | . | . | . | . | . | . | . | . | . | . | . | . | . | Y |
| 21-225_227C1_HC | . | . | . | . | . | . | . | . | . | . | . | . | . | . | . | . | . | . | . | . | . | . | . | . | . | . |
| 21-225_227F2_HC | . | . | . | . | . | . | . | . | . | . | . | . | . | . | . | . | . | . | . | . | . | . | . | . | . | . |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | | H_CDR3 | | | | | | | |
| CONSENSUS | Y | C | A | R | D | W | G | G | Y | S | S | . | . | . | . | . | . | . | . | . | . | . | . | . | . | . |
| 21-225_224A7_HC | . | . | . | . | . | . | . | . | . | . | . | . | . | . | . | . | . | . | . | . | . | . | . | . | . | . |
| 21-225_224C11_HC | . | . | . | . | . | . | . | . | . | . | . | . | . | . | . | . | . | . | . | . | . | . | . | . | . | . |
| 21-225_224G1_HC | . | . | . | . | . | . | . | . | . | . | . | . | . | . | . | . | . | . | . | . | . | . | . | . | . | . |
| 21-225_224H1_HC | . | . | . | . | . | . | . | . | . | . | . | . | . | . | . | . | . | . | . | . | . | . | . | . | . | . |
| 21-225_225G4_HC | . | . | . | . | . | . | . | . | . | . | . | . | . | . | . | . | . | . | . | . | . | . | . | . | . | . |
| 21-225_226E11_HC | . | . | . | . | . | . | . | . | . | . | . | . | . | . | . | . | . | . | . | . | . | . | . | . | . | . |
| 21-225_226F10_HC | . | . | . | . | . | . | . | . | . | . | . | . | . | . | . | . | . | . | . | . | . | . | . | . | . | . |
| 21-225_226F9_HC | . | . | . | . | . | . | . | . | . | . | . | . | . | . | . | . | . | . | . | . | . | . | . | . | . | . |
| 21-225_226G8_HC | . | . | . | . | . | . | . | . | . | . | . | . | . | . | . | . | . | . | . | . | . | . | . | . | . | . |
| 21-225_226H12_HC | . | . | . | . | . | . | . | . | . | . | . | . | . | . | . | . | . | . | . | . | . | . | . | . | . | . |
| 21-225_226H9_HC | . | . | . | . | . | . | . | . | . | . | . | . | . | . | . | . | . | . | . | . | . | . | . | . | . | . |
| 21-225_227A8_HC | . | . | . | . | . | . | . | . | . | . | . | . | . | . | . | . | . | . | . | . | . | . | . | . | . | . |
| 21-225_227C1_HC | . | . | . | . | . | . | . | . | . | . | . | . | . | . | . | . | . | . | . | . | . | . | . | . | . | . |
| 21-225_227F2_HC | . | . | . | . | . | . | . | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | - | Y | Y | Y | G | M | D | V | W | G | Q | G | T | T | V | T | V | S | S |
| 21-225_224A7_HC | . | . | . | . | . | . | . | . | . | . | . | . | . | . | . | . | . | . | . |
| 21-225_224C11_HC | . | . | . | X | . | . | . | . | . | . | . | . | . | . | . | . | . | . | . |
| 21-225_224G1_HC | . | . | . | . | . | . | . | . | . | . | . | . | . | . | . | . | . | . | . |
| 21-225_224H11_HC | . | . | . | . | . | . | . | . | . | . | . | . | . | . | . | . | . | . | . |
| 21-225_225G4_HC | . | . | . | . | . | . | . | . | . | . | . | . | . | . | . | . | . | . | . |
| 21-225_226E11_HC | . | . | . | . | . | . | . | . | . | . | . | . | . | A | . | . | . | . | . |
| 21-225_226F10_HC | . | . | . | . | . | . | . | . | . | . | . | . | . | . | . | . | . | . | . |
| 21-225_226F9_HC | . | . | . | . | . | . | . | . | . | . | . | . | . | . | . | . | . | . | . |
| 21-225_226G8_HC | . | . | . | . | . | . | . | . | . | . | . | . | . | . | . | . | . | . | . |
| 21-225_226H12_HC | . | . | . | . | . | . | . | . | . | . | . | . | . | . | . | . | . | . | . |
| 21-225_226H9_HC | . | . | . | . | . | . | . | . | . | . | . | . | . | . | . | . | . | . | . |
| 21-225_227A8_HC | . | . | . | . | . | . | . | . | . | . | . | . | . | . | . | . | . | . | . |
| 21-225_227C1_HC | . | . | . | . | . | . | . | . | . | . | . | . | . | . | . | . | . | . | . |
| 21-225_227F2_HC | . | . | . | . | . | . | . | . | . | . | . | . | . | . | . | . | . | . | . |

FIGURE 57 (Continued)

Table 73. Consensus 39 - VH3|3-21/D7|7-27|RF1/JH4 (SEQ ID NO: 50290):

EVQLVES-GGGLVKPGGSLRLSCAASG-FTFSS----YSMNWVRQAPGKGLEWVSSISGS---SSYIYYADSVKGRFTISRDNAKNSLYLQMNSLRAEDTAVYYCARLT----------FDYWGQGTLVTVSS wherein:

S in position 33 can be substituted with T

Y in position 39 can be substituted with F

S in position 40 can be substituted with T, N or G

N in position 42 can be substituted with S or I

G in position 60 can be substituted with S

S in position 61 can be substituted with T

S in position 65 can be substituted with I or N

S in position 66 can be substituted with N, T or Y

I in position 68 can be substituted with M or S

Y in position 69 can be substituted with N

A in position 71 can be substituted with T

Xaa Xaa Xaa Met Xaa (SEQ ID NO: 50063)

Ser Ile Ser Xaa Xaa Xaa Xaa Tyr Xaa Xaa Tyr Xaa Asp Ser Val Lys Gly (SEQ ID NO: 50064)

Leu Thr Phe Asp Tyr (SEQ ID NO: 50065)

Ser Tyr Ser Met Asn (SEQ ID NO: 50540)

Ser Ile Ser Gly Ser Ser Ser Tyr Ile Tyr Tyr Ala Asp Ser Val Lys Gly (SEQ ID NO: 50541)

Leu Thr Phe Asp Tyr (SEQ ID NO: 50542)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | | | | | H_CDR1 | | | | | | | | | | | | H_FR2 | | | |
| CONSENSUS | G | - | T | F | S | S | - | - | - | - | - | Y | S | M | N | W | V | R | Q | A | P | G | K | G | L |
| 21-225_10C7_HC | . | . | . | . | . | . | . | . | . | . | . | . | . | . | . | . | . | . | . | . | . | . | . | . | . | . |
| 21-225_12D2_HC | . | . | Y | . | . | . | . | . | . | . | . | . | . | . | . | . | . | . | . | . | . | . | . | . | . | . |
| 21-225_151F1_HC | . | . | . | . | . | S | . | . | . | . | . | R | . | . | S | . | . | . | . | . | . | . | . | . | . | . |
| 21-225_166H12_HC | . | . | . | . | . | . | T | . | . | . | . | . | . | . | . | . | . | . | . | . | . | . | . | . | . | . |
| 21-225_227F11_HC | . | . | . | . | . | . | . | . | . | . | . | . | . | . | . | . | . | . | . | . | . | . | . | . | . | . |
| 21-225_26G1_HC | . | . | . | . | . | . | . | . | . | . | . | . | G | . | . | . | . | . | . | . | . | . | . | . | . | . |
| 21-225_2B1_HC | . | . | . | . | . | . | . | . | . | . | . | . | N | . | S | . | . | . | . | . | . | . | . | . | . | . |
| 21-225_33B7_HC | . | . | . | . | . | . | . | . | . | . | . | . | T | . | . | . | . | . | . | . | . | . | . | . | . | . |
| 21-225_34C11_HC | . | . | . | . | . | . | . | . | . | . | . | . | T | . | . | . | . | . | . | . | . | . | . | . | . | . |
| 21-225_43A4_HC | . | . | . | . | . | . | . | . | . | . | . | . | . | . | - | . | . | . | . | . | V | . | . | . | . | . |
| 21-225_45D9_HC | . | . | . | . | . | . | . | . | . | . | . | . | N | . | . | . | . | . | . | . | V | . | . | . | . | . |
| 21-225_54H3_HC | . | . | . | . | . | . | . | . | . | . | . | . | . | . | . | . | . | . | . | . | . | . | . | . | . | . |
| 21-225_63H8_HC | . | . | . | . | . | . | . | . | . | . | . | . | . | . | . | . | . | . | . | . | . | . | . | . | . | . |
| 21-225_8D8_HC | . | . | . | . | . | . | . | . | . | . | . | . | . | . | . | . | . | . | . | . | . | . | . | . | . | . |

FIGURE 57 (Continued)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | | H_CDR2 | | | | | | | | | | | |
| CONSENSUS | E | W | V | S | S | I | S | G | S | . | . | . | S | S | Y | I | Y | Y | A | D | S | V | K | G | R | F |
| 21-225_10C7_HC | . | . | . | . | . | . | . | S | . | . | . | . | N | N | . | . | . | . | . | . | . | . | . | . | . | . |
| 21-225_12D2_HC | . | . | . | . | . | . | . | S | . | . | . | . | . | . | . | . | . | . | . | . | . | . | . | . | . | . |
| 21-225_151F1_HC | . | . | . | . | . | . | . | S | . | . | . | . | . | Y | . | . | . | . | . | . | . | . | . | . | . | . |
| 21-225_166H12_HC | G | . | . | . | . | . | . | . | . | . | . | . | . | . | . | S | . | . | . | . | . | . | . | . | . | . |
| 21-225_227F11_HC | . | . | . | . | . | . | . | S | . | . | . | . | . | N | . | M | . | . | . | . | . | . | . | . | . | . |
| 21-225_26G1_HC | . | . | . | . | . | . | . | S | . | . | . | . | . | . | . | . | . | . | . | . | . | . | . | . | . | . |
| 21-225_2B1_HC | . | . | . | . | . | . | . | . | . | . | . | . | . | N | . | . | . | . | . | . | . | . | . | . | . | . |
| 21-225_33B7_HC | . | . | . | . | . | . | . | . | . | . | . | . | . | T | . | . | . | . | . | . | . | . | . | . | . | . |
| 21-225_34C11_HC | . | . | . | . | . | . | . | . | T | . | . | . | . | T | . | . | . | . | . | . | . | . | . | . | . | . |
| 21-225_43A4_HC | . | . | . | . | . | . | . | . | . | . | . | . | . | . | . | . | . | . | . | . | . | . | . | . | . | . |
| 21-225_45D9_HC | . | . | . | . | . | . | . | . | . | . | . | . | . | T | . | . | N | . | . | . | . | . | . | . | . | . |
| 21-225_54H3_HC | . | . | . | . | . | . | . | . | . | . | . | . | . | . | . | M | . | . | T | . | . | . | . | . | . | . |
| 21-225_63H8_HC | . | . | . | . | . | . | . | S | . | . | . | . | . | . | . | . | . | . | . | . | . | . | . | . | . | . |
| 21-225_8D8_HC | . | . | . | . | . | . | . | . | . | . | . | . | . | . | . | . | . | . | . | . | . | . | . | . | . | . |

FIGURE 57 (Continued)

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | H_FR3 | | | | | | | | | | | | |
| CONSENSUS | T | I | S | R | D | N | A | K | N | S | L | Y | L | Q | M | N | S | L | R | A | E | D | T | A | V | Y |
| 21-225_10C7_HC | . | . | . | . | . | . | . | . | . | . | . | . | . | . | . | . | . | . | . | . | . | . | S | . | . | . |
| 21-225_12D2_HC | . | . | . | . | . | . | . | . | . | . | . | . | . | . | . | . | . | . | . | . | . | . | . | . | . | . |
| 21-225_151F1_HC | . | . | . | . | . | . | . | . | . | . | . | . | . | . | . | . | . | . | . | . | . | . | . | . | . | . |
| 21-225_166H12_HC | . | . | . | . | . | . | . | . | . | . | . | . | . | . | . | . | . | . | . | . | . | . | S | . | . | . |
| 21-225_227F11_HC | . | . | . | . | . | . | . | . | . | . | . | . | . | . | . | . | . | . | . | . | . | . | . | . | . | . |
| 21-225_26G1_HC | . | . | . | . | . | . | . | . | . | . | . | . | . | . | . | . | . | . | . | . | . | . | . | . | . | . |
| 21-225_2B1_HC | . | . | . | . | . | . | . | . | . | . | . | . | . | . | . | . | . | . | . | . | . | . | . | . | . | . |
| 21-225_33B7_HC | . | . | . | . | . | . | . | . | . | . | . | . | . | . | . | . | . | . | . | . | . | . | . | . | . | . |
| 21-225_34C11_HC | . | . | . | . | . | . | . | . | . | . | . | . | . | . | . | . | . | . | . | . | . | . | . | . | . | . |
| 21-225_43A4_HC | . | . | . | . | . | D | . | Q | . | . | . | . | . | . | . | . | . | . | . | G | . | . | . | . | . | . |
| 21-225_45D9_HC | . | . | . | . | . | D | . | Q | . | . | . | . | . | . | . | . | . | . | . | G | . | . | . | . | . | . |
| 21-225_54H3_HC | . | . | . | . | . | . | . | . | . | . | . | . | . | . | . | . | . | . | . | . | . | . | . | . | . | . |
| 21-225_63H8_HC | . | . | . | . | . | . | . | . | . | . | . | . | . | . | . | . | . | . | . | . | . | . | . | . | . | . |
| 21-225_8D8_HC | . | . | . | . | . | . | . | . | . | . | . | . | . | . | . | . | . | . | . | . | . | . | . | . | . | . |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | | H_CDR3 | | | | | | | |
| CONSENSUS | Y | C | A | R | L | T | . | . | . | . | . | . | . | . | . | . | . | . | . | . | . | . | . | . | . | . |
| 21-225_10C7_HC | . | . | . | . | . | G | . | . | . | . | . | . | . | . | . | . | . | . | . | . | . | . | . | . | . | . |
| 21-225_12D2_HC | . | . | . | . | . | G | . | . | . | . | . | . | . | . | . | . | . | . | . | . | . | . | . | . | . | . |
| 21-225_151F1_HC | . | . | . | . | D | . | P | . | . | . | . | . | . | . | . | . | . | . | . | . | . | . | . | . | . | . |
| 21-225_166H12_HC | . | . | . | . | . | . | G | . | . | . | . | . | . | . | . | . | . | . | . | . | . | . | . | . | . | . |
| 21-225_227F11_HC | . | . | . | . | . | G | . | . | . | . | . | . | . | . | . | . | . | . | . | . | . | . | . | . | . | . |
| 21-225_26G1_HC | . | . | . | . | . | . | T | . | . | . | . | . | . | . | . | . | . | . | . | . | . | . | . | . | . | . |
| 21-225_2B1_HC | . | . | . | . | . | G | . | . | . | . | . | . | . | . | . | . | . | . | . | . | . | . | . | . | . | . |
| 21-225_33B7_HC | . | . | . | . | V | N | G | . | . | . | . | . | . | . | . | . | . | . | . | . | . | . | . | . | . | . |
| 21-225_34C11_HC | . | . | . | . | V | . | S | . | . | . | . | . | . | . | . | . | . | . | . | . | . | . | . | . | . | . |
| 21-225_43A4_HC | . | . | . | G | M | . | S | . | . | . | . | . | . | . | . | . | . | . | . | . | . | . | . | . | . | . |
| 21-225_45D9_HC | . | . | . | . | . | . | T | . | . | . | . | . | . | . | . | . | . | . | . | . | . | . | . | . | . | . |
| 21-225_54H3_HC | . | . | . | . | . | E | N | . | . | . | . | . | . | . | . | . | . | . | . | . | . | . | . | . | . | . |
| 21-225_63H8_HC | . | . | . | . | . | G | . | . | . | . | . | . | . | . | . | . | . | . | . | . | . | . | . | . | . | . |
| 21-225_8D8_HC | . | . | . | . | . | . | . | . | . | . | . | . | . | . | . | . | . | . | . | . | . | . | . | . | . | . |

Table 74. Consensus 40 – VH3|3-33/D3|3-9|RF2/JH4 (SEQ ID NO: 50291):

QVQLVES-GGGVVQPGRSLRLSCAASG-FTFST---YGMHWVRQAPGKGLEWVAHWYD---
GTNKYYADSVKGRFTISRDNSKNTLYLQLNSLRAEDTAVYYCARDPLRGYN----------DPVMDYWGQGTLVTVSS wherein:

T in position 33 can be substituted with S

I in position 57 can be substituted with V

T in position 66 can be substituted with S

K in position 75 can be substituted with R

M in position 136 can be substituted with L

Xaa Tyr Gly Met His (SEQ ID NO: 50066)

Xaa Ile Trp Tyr Asp Gly Xaa Asn Lys Tyr Tyr Ala Asp Ser Val Xaa Gly (SEQ ID NO: 50067)

Asp Pro Leu Arg Gly Tyr Asn Asp Pro Val Xaa Asp Tyr (SEQ ID NO: 50068)

Thr Tyr Gly Met His (SEQ ID NO: 50543)

Ile Ile Trp Tyr Asp Gly Thr Asn Lys Tyr Tyr Ala Asp Ser Val Lys Gly (SEQ ID NO: 50544)

Asp Pro Leu Arg Gly Tyr Asn Asp Pro Val Met Asp Tyr (SEQ ID NO: 50545)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| CONSENSUS | Q | V | Q | L | V | E | S | - | G | G | G | V | V | Q | P | G | R | S | L | R | L | S | C | A | A | S |
| 21-225_169B1_HC | . | . | . | . | . | . | . | . | . | . | . | . | . | . | . | . | . | . | . | . | . | . | . | . | . | . |
| 21-225_169F9_HC | . | . | . | . | . | . | . | . | . | . | . | . | . | . | . | . | . | . | . | . | . | . | . | V | . | . |
| 21-225_170D11_HC | . | . | . | . | . | . | . | . | . | . | . | . | . | . | . | . | . | . | . | . | . | . | . | . | . | . |
| 21-225_170D5_HC | . | . | . | . | . | . | . | . | . | . | . | . | . | . | . | . | . | . | . | . | . | . | . | T | . | . |
| 21-225_170G4_HC | . | . | . | . | . | . | . | . | . | . | . | . | . | . | . | . | O | . | . | . | . | . | . | . | . | . |
| 21-225_170G5_HC | . | . | . | . | . | . | . | . | . | . | . | . | . | . | . | . | O | . | . | . | . | . | . | . | . | . |
| 21-225_171A4_HC | . | . | . | . | . | . | . | . | . | . | . | . | . | . | . | . | O | . | . | . | . | . | . | . | . | . |
| 21-225_171C3_HC | . | . | . | . | . | . | . | . | . | . | . | . | . | . | . | . | . | . | . | . | . | . | . | . | . | . |
| 21-225_172B3_HC | . | . | . | L | . | . | . | . | . | . | . | . | . | . | . | . | . | & | . | . | . | . | . | . | . | . |
| 21-225_172G8_HC | . | . | . | . | . | . | . | . | . | . | . | . | . | . | . | . | O | . | . | . | . | . | . | . | . | . |
| 21-225_173H12_HC | . | . | . | . | . | . | . | . | . | . | . | . | . | . | . | . | . | . | . | . | . | . | . | . | . | . |
| 21-225_175G1_HC | . | . | . | . | . | . | . | . | . | . | . | . | . | . | . | . | . | . | . | . | . | . | . | . | . | . |
| 21-225_178B11_HC | . | . | . | . | . | . | . | . | . | . | . | . | . | . | . | . | . | . | . | . | . | . | . | . | . | . |
| 21-225_178B10_HC | . | . | . | . | . | . | . | . | . | . | . | . | . | . | . | . | . | . | . | . | . | . | . | V | . | . |

FIGURE 57 (Continued)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | | | | | H_CDR1 | | | | | | | | | | | | H_FR2 | | | |
| CONSENSUS | G | . | F | T | . | S | T | . | . | . | . | . | Y | G | M | H | W | V | R | Q | A | P | G | K | G | L |
| 21-225_169B1_HC | . | . | . | . | . | . | S | . | . | . | . | . | . | . | . | . | . | . | . | . | . | . | . | . | . | . |
| 21-225_169F9_HC | . | . | . | . | . | . | . | . | . | . | . | . | . | . | . | . | . | . | . | . | . | . | . | . | . | . |
| 21-225_170D11_HC | . | . | . | . | . | . | S | . | . | . | . | . | . | . | . | . | . | . | . | . | . | . | . | . | . | . |
| 21-225_170D5_HC | . | . | . | . | . | . | S | . | . | . | . | . | . | . | . | . | . | . | . | . | . | . | . | . | . | . |
| 21-225_170G4_HC | . | . | . | . | . | . | . | . | . | . | . | . | . | . | . | . | . | . | . | . | . | . | . | . | . | . |
| 21-225_170G5_HC | . | . | . | . | . | . | . | . | . | . | . | . | . | . | . | . | . | . | . | . | . | . | . | . | . | . |
| 21-225_171A4_HC | . | . | . | . | . | . | . | . | . | . | . | . | . | . | . | . | . | . | . | . | . | . | . | . | . | . |
| 21-225_171C3_HC | . | . | . | . | . | . | . | . | . | . | . | . | . | . | . | . | . | . | . | . | . | . | . | . | . | . |
| 21-225_172B3_HC | . | . | . | . | . | . | S | . | . | . | . | . | . | . | . | . | . | . | . | . | . | . | . | . | . | . |
| 21-225_172G8_HC | . | . | . | . | . | . | . | . | . | . | . | . | . | . | . | . | . | . | . | . | . | . | . | . | . | . |
| 21-225_173H12_HC | . | . | . | . | . | . | . | . | . | . | . | . | . | . | . | . | . | . | . | . | . | . | . | . | . | . |
| 21-225_175G1_HC | . | . | . | . | S | . | . | . | . | . | . | . | . | . | . | . | . | . | . | . | . | . | . | . | . | . |
| 21-225_176B11_HC | . | . | . | . | . | . | . | . | . | . | . | . | . | . | . | . | . | . | . | . | . | . | . | . | . | . |
| 21-225_178B10_HC | . | . | . | . | . | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| CONSENSUS | T | I | S | R | D | N | S | K | N | T | L | Y | L | Q | L | N | S | L | R | A | E | D | T | A | V | Y |
| 21-225_169B1_HC | . | . | . | . | . | . | . | . | . | . | . | . | . | . | M | . | . | . | . | . | . | . | . | . | . | . |
| 21-225_169F9_HC | . | . | . | . | . | . | . | . | . | . | . | . | . | . | . | . | . | . | . | . | . | . | . | . | . | . |
| 21-225_170D11_HC | . | . | . | . | . | . | . | . | . | . | . | . | . | . | . | . | . | . | . | . | . | . | . | . | M | . |
| 21-225_170D5_HC | . | . | . | . | . | . | . | . | . | . | . | . | . | . | . | . | . | . | . | . | . | . | . | . | . | . |
| 21-225_170G4_HC | . | . | . | . | . | . | . | . | . | . | . | F | . | . | M | . | . | . | . | . | . | . | . | . | . | . |
| 21-225_170G5_HC | . | . | . | . | . | . | . | . | S | . | . | . | . | . | M | . | . | . | . | . | . | . | . | . | . | . |
| 21-225_171A4_HC | . | . | . | . | . | . | . | . | . | . | . | . | . | . | M | . | . | . | . | . | . | . | . | . | . | . |
| 21-225_171C3_HC | . | . | . | . | . | . | . | . | . | . | . | . | . | . | M | . | . | . | . | . | . | . | . | . | . | . |
| 21-225_172B3_HC | . | . | . | . | . | . | . | . | . | . | . | . | . | . | . | . | . | . | . | . | . | . | . | . | . | . |
| 21-225_172G8_HC | . | . | . | . | . | . | . | . | . | . | . | . | V | . | M | . | . | . | . | . | . | . | . | . | . | . |
| 21-225_173H12_HC | . | . | . | . | . | . | . | . | . | . | . | F | . | . | . | . | . | . | . | . | . | . | . | . | . | . |
| 21-225_175G1_HC | . | . | . | . | . | . | . | . | . | . | . | . | . | . | . | . | . | . | . | . | . | . | . | . | . | . |
| 21-225_176B11_HC | . | . | . | . | . | . | . | . | . | . | . | . | . | . | . | . | . | . | . | . | . | . | . | . | . | . |
| 21-225_178B10_HC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | H_FR4 | | | | | | |
| CONSENSUS | - | - | D | P | V | M | D | Y | W | G | Q | G | T | L | V | T | V | S | S |
| 21-225_169B1_HC | . | . | . | . | . | . | . | . | . | . | . | . | . | . | . | . | . | . | . |
| 21-225_169F9_HC | . | . | . | . | . | . | . | . | . | . | . | . | . | . | . | . | . | . | . |
| 21-225_170D11_HC | . | . | . | . | . | . | . | . | . | . | . | . | . | . | . | . | . | . | . |
| 21-225_170D5_HC | . | . | . | . | . | . | . | . | . | . | . | . | . | . | . | . | . | . | . |
| 21-225_170G4_HC | . | . | . | . | . | . | . | . | . | . | . | . | . | . | . | . | . | . | . |
| 21-225_170G5_HC | . | . | . | . | . | . | . | . | . | . | . | . | . | . | . | . | . | . | . |
| 21-225_171A4_HC | . | . | . | . | . | . | . | . | . | . | . | . | . | . | . | . | . | . | . |
| 21-225_171C3_HC | . | . | . | . | . | . | . | . | . | . | . | . | . | . | . | . | . | . | . |
| 21-225_172B3_HC | . | . | . | . | . | . | . | . | . | . | . | . | . | . | . | . | . | . | . |
| 21-225_172G8_HC | . | . | . | . | . | . | . | . | . | . | . | . | . | . | . | . | . | . | . |
| 21-225_173H12_HC | . | . | . | . | . | . | . | . | . | . | . | . | . | . | . | . | . | . | . |
| 21-225_175G1_HC | . | . | . | . | . | . | . | . | . | . | . | . | . | . | . | . | . | . | . |
| 21-225_176B11_HC | . | . | . | . | . | L | . | . | . | . | . | . | . | . | . | . | . | . | . |
| 21-225_178B10_HC | . | . | . | . | . | . | . | . | . | . | . | . | . | . | . | . | . | . | . |

FIGURE 57 (Continued)

Table 75. Consensus 41 – VH3|3-23/D4|4-17|RF2/JH5 (SEQ ID NO: 50292):

EVQLLES-GGGLVQPGGSLRLSCAASG-FTFSS-----YAMSWVRQAPGKGLEWVSAISGR---
GGNTFYADSVKGRFTISRDNSKNTLYLQMNSLRAEDTAVYYCAKRVTDYGG---------NDWFDPWGQGTLVTVSS wherein:

S in position 33 can be substituted with N

S in position 42 can be substituted with N or T

R in position 61 can be substituted with S

G in position 66 can be substituted with K

Xaa Tyr Ala Met Xaa (SEQ ID NO: 50069)

Ala Ile Ser Gly Xaa Gly Xaa Asn Thr Phe Tyr Ala Asp Ser Val Lys Gly (SEQ ID NO: 50070)

Arg Val Thr Asp Tyr Gly Gly Asn Asp Trp Phe Asp Pro (SEQ ID NO: 50071)

Ser Tyr Ala Met Ser (SEQ ID NO: 50546)

Ala Ile Ser Gly Arg Gly Gly Asn Thr Phe Tyr Ala Asp Ser Val Lys Gly (SEQ ID NO: 50547)

Arg Val Thr Asp Tyr Gly Gly Asn Asp Trp Phe Asp Pro (SEQ ID NO: 50548)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS_HC | E | V | Q | L | L | E | S | - | G | G | G | L | V | Q | P | G | G | S | L | R | L | S | C | A | A | S |
| 21-225_146E9_HC | . | . | . | . | . | . | . | . | . | . | . | . | . | . | . | . | . | . | . | . | . | . | . | . | . | . |
| 21-225_146H1_HC | . | . | . | . | . | . | . | . | . | . | . | . | . | . | . | . | . | . | . | . | . | . | . | . | . | . |
| 21-225_148C4_HC | . | . | . | . | . | . | . | . | . | . | . | . | . | . | . | . | . | . | . | . | . | . | . | . | . | . |
| 21-225_148H9_HC | . | . | . | . | . | . | . | . | . | . | . | . | . | . | . | . | . | . | . | . | . | . | . | . | . | . |
| 21-225_149A3_HC | . | . | . | . | . | . | . | . | . | . | . | . | . | . | . | . | . | . | . | . | . | . | . | . | . | . |
| 21-225_150C11_HC | . | . | . | . | . | . | . | . | . | . | . | . | . | . | . | . | . | . | . | . | . | . | . | . | . | . |
| 21-225_150C12_HC | . | . | . | . | . | . | . | . | . | . | . | . | . | . | . | . | . | . | . | . | . | . | . | . | . | . |
| 21-225_151B12_HC | . | . | . | . | . | . | . | . | . | . | . | . | . | . | . | . | . | . | . | . | . | . | . | . | . | . |
| 21-225_152B11_HC | . | . | . | . | . | . | . | . | . | . | . | . | . | . | . | . | . | . | . | . | . | . | . | . | . | . |
| 21-225_152D2_HC | . | . | . | . | . | . | . | . | . | . | . | . | . | . | . | . | . | . | . | . | . | . | . | . | . | . |
| 21-225_152G4_HC | . | . | . | . | . | . | . | . | . | . | . | . | . | . | . | . | . | . | . | . | . | . | . | . | . | . |
| 21-225_155C4_HC | . | . | . | . | . | . | . | . | . | . | . | . | . | . | . | . | . | . | . | . | . | . | . | . | . | . |
| 21-225_156E4_HC | . | . | . | . | . | . | . | . | . | . | . | . | . | . | . | . | . | . | . | . | . | . | . | . | . | . |

FIGURE 57 (Continued)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | | | | | H_CDR1 | | | | | | | H_FR2 | | | | | | | | |
| CONSENSUS | G | - | F | T | F | S | S | - | - | - | - | - | Y | A | M | S | W | V | R | Q | A | P | G | K | G | L |
| 21-225_146E9_HC | . | . | . | . | . | . | . | . | . | . | . | . | . | . | . | . | . | . | . | . | . | . | . | . | . | . |
| 21-225_146H1_HC | . | . | . | . | . | . | . | . | . | . | . | . | . | . | . | N | . | . | . | . | . | . | . | . | . | . |
| 21-225_148C4_HC | . | . | . | . | . | . | N | . | . | . | . | . | . | . | . | . | . | . | . | . | . | . | . | . | . | . |
| 21-225_148H9_HC | . | . | . | . | . | . | . | . | . | . | . | . | . | . | . | T | . | . | . | . | . | . | . | . | . | . |
| 21-225_149A3_HC | . | . | . | . | . | . | . | . | . | . | . | . | . | . | . | N | . | . | . | . | . | . | . | . | . | . |
| 21-225_150C11_HC | . | . | . | . | . | . | . | . | . | . | . | . | . | . | . | . | . | . | . | . | . | . | . | . | . | . |
| 21-225_150C12_HC | . | . | . | . | . | . | . | . | . | . | . | . | . | . | . | N | . | . | . | . | . | . | . | . | . | . |
| 21-225_151B12_HC | . | . | . | . | . | . | . | . | . | . | . | . | . | . | . | N | . | . | . | . | . | . | . | . | . | . |
| 21-225_152B11_HC | . | . | . | . | . | . | . | . | . | . | . | . | . | . | . | . | . | . | . | . | . | . | . | . | . | . |
| 21-225_152D2_HC | . | . | . | . | . | . | . | . | . | . | . | . | . | . | . | . | . | . | . | X | . | . | . | . | . | . |
| 21-225_152G4_HC | . | . | . | . | . | . | . | . | . | . | . | . | . | . | . | . | . | . | . | . | . | . | . | . | . | . |
| 21-225_155C4_HC | . | . | . | . | . | . | . | . | . | . | . | . | . | . | . | . | . | . | . | . | . | . | . | . | . | . |
| 21-225_156E4_HC | . | . | . | . | . | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | H_FR3 | | | | | | | | | | | | |
| CONSENSUS | T | I | S | R | D | N | S | K | N | T | L | Y | L | Q | M | N | S | L | R | A | E | D | T | A | V | Y |
| 21-225_146E9_HC | . | . | . | . | . | . | . | . | . | . | . | . | . | . | . | . | . | . | . | . | . | . | . | . | . | . |
| 21-225_146H1_HC | . | . | . | . | . | . | . | . | . | . | . | . | . | . | . | . | . | . | . | . | . | . | . | . | . | . |
| 21-225_148C4_HC | . | . | . | . | . | . | . | . | . | . | . | . | . | . | . | . | . | . | . | . | . | . | . | . | . | . |
| 21-225_148H9_HC | . | . | . | . | . | . | . | . | . | . | . | . | . | . | . | . | . | . | . | . | . | . | . | . | . | . |
| 21-225_148A3_HC | . | . | . | . | . | . | . | . | . | . | . | . | . | . | . | . | . | . | . | . | . | . | . | . | . | . |
| 21-225_150C11_HC | . | . | . | . | . | . | . | . | . | . | . | N | . | . | . | S | . | . | . | . | . | . | . | . | . | . |
| 21-225_150C12_HC | . | . | . | . | . | . | . | . | . | . | . | . | . | . | . | . | . | . | . | . | . | . | . | . | . | . |
| 21-225_151B12_HC | . | . | . | . | . | . | . | . | . | . | . | . | . | . | . | . | . | . | . | . | . | . | . | . | . | . |
| 21-225_152B11_HC | . | . | . | . | . | . | . | . | . | . | . | . | . | . | . | . | . | . | . | . | . | . | . | . | . | . |
| 21-225_152D2_HC | . | . | . | . | . | . | . | . | . | . | . | . | . | . | . | . | . | . | . | . | . | . | . | . | . | . |
| 21-225_152G4_HC | . | . | . | . | . | . | . | . | . | . | . | . | . | . | . | . | . | . | . | . | . | . | . | . | . | . |
| 21-225_155C4_HC | . | . | . | . | . | . | . | . | . | . | . | . | . | . | . | . | . | . | . | . | . | . | . | . | . | . |
| 21-225_156E4_HC | . | . | . | . | . | . | . | . | . | . | . | . | . | . | . | . | . | . | . | . | . | . | . | . | . | . |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | | | H_CDR3 | | | | | | |
| CONSENSUS | Y | C | A | K | R | V | T | D | Y | G | G | | | | | | | | | | | | | | | |
| 21-225_146E9_HC | . | . | . | . | . | . | . | . | . | . | . | . | . | . | . | . | . | . | . | . | . | . | . | . | . | . |
| 21-225_146H1_HC | . | . | . | . | . | . | . | . | . | . | . | . | . | . | . | . | . | . | . | . | . | . | . | . | . | . |
| 21-225_148C4_HC | . | . | . | . | . | . | . | . | . | . | . | . | . | . | . | . | . | . | . | . | . | . | . | . | . | . |
| 21-225_148H9_HC | . | . | T | . | . | . | . | . | . | . | . | . | . | . | . | . | . | . | . | . | . | . | . | . | . | . |
| 21-225_149A3_HC | . | . | . | . | . | . | . | . | . | . | . | . | . | . | . | . | . | . | . | . | . | . | . | . | . | . |
| 21-225_150C11_HC | . | . | . | . | . | . | . | . | . | . | . | . | . | . | . | . | . | . | . | . | . | . | . | . | . | . |
| 21-225_150C12_HC | . | . | . | . | . | . | . | . | . | . | . | . | . | . | . | . | . | . | . | . | . | . | . | . | . | . |
| 21-225_151B12_HC | . | . | . | . | . | . | . | . | . | . | . | . | . | . | . | . | . | . | . | . | . | . | . | . | . | . |
| 21-225_152B11_HC | . | . | . | . | . | . | . | . | . | . | . | . | . | . | . | . | . | . | . | . | . | . | . | . | . | . |
| 21-225_152D2_HC | . | . | . | . | . | . | . | . | . | . | . | . | . | . | . | . | . | . | . | . | . | . | . | . | . | . |
| 21-225_152G4_HC | . | . | . | . | . | . | . | . | . | . | . | . | . | . | . | . | . | . | . | . | . | . | . | . | . | . |
| 21-225_155C4_HC | . | . | . | . | . | . | . | . | . | . | . | . | . | . | . | . | . | . | . | . | . | . | . | . | . | . |
| 21-225_156E4_HC | . | . | . | . | . | . | . | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| CONSENSUS | - | - | N | D | W | F | D | P | W | G | Q | G | T | L | V | T | V | S | S |
| | | | | | | | | | | | | | | H_FR4 | | | | | |
| 21-225_146E9_HC | . | . | . | . | . | . | . | . | . | . | . | . | . | . | . | . | . | . | . |
| 21-225_146H1_HC | . | . | . | . | . | . | . | . | . | . | . | . | . | . | . | . | . | . | . |
| 21-225_148C4_HC | . | . | . | . | . | . | . | . | . | . | . | . | . | . | . | . | . | . | . |
| 21-225_148H9_HC | . | . | . | . | . | . | . | . | . | . | . | . | . | . | . | . | . | . | . |
| 21-225_149A3_HC | . | . | . | . | . | . | . | . | . | . | . | . | . | . | . | . | . | . | . |
| 21-225_150C11_HC | . | . | . | . | . | . | . | . | . | . | . | . | . | . | . | . | . | . | . |
| 21-225_150C12_HC | . | . | . | . | . | . | . | . | . | . | . | . | . | . | . | . | . | . | . |
| 21-225_151B12_HC | . | . | . | . | . | . | . | . | . | . | . | . | . | . | . | . | . | . | . |
| 21-225_152B11_HC | . | . | . | . | . | . | . | . | . | . | . | . | . | . | . | . | . | . | . |
| 21-225_152D2_HC | . | . | . | . | . | . | . | . | . | . | . | . | . | . | . | . | . | . | . |
| 21-225_152G4_HC | . | . | . | . | . | . | . | . | . | . | . | . | . | . | . | . | . | . | . |
| 21-225_155C4_HC | . | . | . | . | . | . | . | . | . | . | . | . | . | . | . | . | . | . | . |
| 21-225_156E4_HC | . | . | . | . | . | . | . | . | . | . | . | . | . | . | . | . | . | . | . |

FIGURE 57 (Continued)

Table 76. Consensus 42 - VH3|3-33/D3|3-3|RF2/JH6 (SEQ ID NO: 50293):

QVQLVES-GGGVVQPGRSLRLSCAASG-FTFST----YGMHWVRQAPGKGLEWVAVIWYG---GSNKDYADSVKGRFTISRDISKNTLYLQMNSLRAEDTAVYYCARDRDYCSGGSC------PYYYYYGMDVWGQGTTVTVSS wherein:

T in position 33 can be substituted with S

I in position 58 can be substituted with V

G in position 61 can be substituted with D

S in position 66 can be substituted with N

N in position 67 can be substituted with D or S

K in position 68 can be substituted with T

D in position 69 can be substituted with Y or S

Y in position 70 can be substituted with F

A in position 71 can be substituted with V

K in position 75 can be substituted with R or T

D in position 111 can be substituted with V

Y in position 112 can be substituted with F

G in position 116 can be substituted with T

S in position 117 can be substituted with T or N

Xaa Tyr Gly Met His (SEQ ID NO: 50072)

Val Xaa Trp Tyr Xaa Gly Xaa Xaa Xaa Xaa Xaa Asp Ser Val Xaa Gly (SEQ ID NO: 50073)

Asp Arg Xaa Xaa Cys Ser Gly Xaa Xaa Xaa Cys Pro Tyr Tyr Tyr Tyr Tyr Gly Met Asp Val (SEQ ID NO: 50074)

FIGURE 57 (Continued)

Thr Tyr Gly Met His (SEQ ID NO: 50549)

Val Ile Trp Tyr Gly Gly Ser Asn Lys Asp Tyr Ala Asp Ser Val Lys Gly (SEQ ID NO: 50550)

Asp Arg Asp Tyr Cys Ser Gly Gly Ser Cys Pro Tyr Tyr Tyr Tyr Tyr Gly Met Asp Val (SEQ ID NO: 50551)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| CONSENSUS | Q | V | Q | L | V | E | S | - | G | G | G | V | V | Q | P | G | R | S | L | R | L | S | C | A | A | S |
| 21-225_146B8_HC | . | . | . | . | . | . | . | . | . | . | . | . | . | . | . | . | . | . | . | . | . | . | . | . | . | . |
| 21-225_147F9_HC | . | . | . | . | . | . | . | . | . | . | . | . | . | . | . | . | . | . | . | . | . | . | . | . | . | . |
| 21-225_147G9_HC | . | . | . | . | . | . | . | . | . | . | . | . | . | . | . | . | . | . | . | . | . | . | . | . | . | . |
| 21-225_148A9_HC | . | . | . | . | . | . | . | . | . | . | . | . | . | . | . | . | . | . | . | . | . | . | . | . | . | . |
| 21-225_150D3_HC | . | . | . | . | . | . | . | . | . | . | . | . | . | . | . | . | . | . | . | . | . | . | . | . | . | . |
| 21-225_151F3_HC | . | . | . | . | . | . | . | . | . | . | . | . | . | . | . | . | . | . | . | . | . | . | . | . | . | . |
| 21-225_153D9_HC | . | . | . | . | . | . | . | . | . | . | . | . | . | . | . | . | . | . | . | . | . | . | . | . | . | . |
| 21-225_153F9_HC | . | . | . | . | . | . | . | . | . | . | . | . | . | . | . | . | . | . | . | . | . | . | . | . | . | . |
| 21-225_154C3_HC | . | . | . | . | . | . | . | . | . | . | . | . | . | . | . | . | . | . | . | . | . | . | . | . | . | . |
| 21-225_154D11_HC | . | . | . | . | . | . | . | . | . | . | . | . | . | . | . | . | . | . | . | . | . | . | . | . | . | . |
| 21-225_158E9_HC | . | . | . | . | . | . | . | . | . | . | . | . | . | . | . | . | . | . | . | . | . | . | . | . | . | . |
| 21-225_161E10_HC | . | . | . | . | . | . | . | . | . | . | . | . | . | . | . | . | . | . | . | . | . | . | . | . | . | . |
| 21-225_74A9_HC | . | . | . | . | . | . | . | . | . | . | . | . | . | . | . | . | . | . | . | . | . | . | . | . | . | . |

FIGURE 57 (Continued)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | | | | H_CDR1 | | | | | | | | | | | | | H_FR2 | | | |
| CONSENSUS | G | . | F | T | F | S | T | . | . | . | . | . | Y | G | M | H | W | V | R | Q | A | P | G | K | G | L |
| 21-225_146B8_HC | . | . | . | . | . | . | . | . | . | . | . | . | . | . | . | . | . | . | . | . | . | . | . | . | . | . |
| 21-225_147F9_HC | . | . | . | . | . | . | . | . | . | . | . | . | . | . | . | . | . | . | . | . | . | . | . | . | . | . |
| 21-225_147G9_HC | . | . | . | . | . | . | . | . | . | . | . | . | . | . | . | . | . | . | . | . | . | . | . | . | . | . |
| 21-225_148A9_HC | . | . | . | . | Y | . | . | . | . | . | . | . | . | . | . | . | . | . | . | . | . | . | . | . | . | . |
| 21-225_150D3_HC | . | . | . | . | I | . | . | . | . | . | . | . | . | . | . | . | . | . | . | . | . | . | . | . | . | . |
| 21-225_151F3_HC | . | . | . | . | Y | . | . | . | . | . | . | . | . | . | . | . | . | . | . | . | . | . | . | . | . | . |
| 21-225_153D9_HC | . | . | . | N | . | . | . | . | . | . | . | . | . | . | . | . | . | . | . | . | G | . | . | . | . | . |
| 21-225_153F9_HC | . | . | . | . | . | . | . | . | . | . | . | . | . | . | . | . | . | . | . | . | . | . | . | . | . | . |
| 21-225_154C3_HC | . | . | . | . | . | . | S | . | . | . | . | . | . | . | . | . | . | . | . | . | . | . | . | . | . | . |
| 21-225_154D11_HC | . | . | . | . | . | . | S | . | . | . | . | . | . | . | . | . | . | . | . | . | . | . | . | . | . | . |
| 21-225_158E9_HC | . | . | . | . | . | . | S | . | . | . | . | . | . | . | . | . | . | . | . | . | . | . | . | . | . | . |
| 21-225_161E10_HC | . | . | . | . | . | . | . | . | . | . | . | . | . | . | . | . | . | . | . | . | . | . | . | . | . | . |
| 21-225_74A9_HC | . | . | . | . | . | . | . | . | . | . | . | . | . | . | . | . | . | . | . | . | . | . | . | . | . | . |

FIGURE 57 (Continued)

| Reference # | 53 E | 54 W | 55 V | 56 A | 57 V | 58 I | 59 W | 60 Y | 61 G | 62 - | 63 - | 64 - | 65 G | 66 S | 67 N H_CDR2 | 68 K | 69 D | 70 Y | 71 A | 72 D | 73 S | 74 V | 75 K | 76 G | 77 R | 78 F |
|---|---|---|---|---|---|---|---|---|---|---|---|---|---|---|---|---|---|---|---|---|---|---|---|---|---|---|
| CONSENSUS | E | W | V | A | V | I | W | Y | G | - | - | - | G | S | N | K | D | Y | A | D | S | V | K | G | R | F |
| 21-225_146B8_HC | | | | | V | | | | | | | | | N | D | | | | | | | | T | | | |
| 21-225_147F9_HC | | | | | | | | | | | | | | | D | | | | | | | | | | | |
| 21-225_147G9_HC | | | | | | | | | | | | | | | D | | | | | | | | | | | |
| 21-225_148A9_HC | | | | | | | | | | | | | | | D | | | | | | | | | | | |
| 21-225_150D3_HC | | | | | | | | | | | | | | | | T | | | | | | | | | | |
| 21-225_151F3_HC | | | | | | | | | | | | | | | | | | | | | | | | | | |
| 21-225_153D9_HC | | | | | | V | | | | | | | | N | | | | | | | | | | | | |
| 21-225_153F8_HC | | | | | | | | | | | | | | | D | T | | | | | | | R | | | |
| 21-225_154C3_HC | | | | | | | | | | | | | | | | | | | | | | | | | | |
| 21-225_164D11_HC | | | | | | | | | Q | | | | | | O | | Y | | | | | | | | | |
| 21-225_158E9_HC | | | | | | | | | Q | | | | | N | S | | Y | | V | | | | | | | |
| 21-225_161E10_HC | | | | | | | | | Q | | | | | | | | S | | | | | | | | | |
| 21-225_74A9_HC | | | | | | | | | | | | | | | | | | | | | | | | | | |

FIGURE 57 (Continued)

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | H_FR3 | | | | | | | | | | | | |
| CONSENSUS | T | I | S | R | D | I | S | K | N | T | L | Y | L | Q | M | N | S | L | R | A | E | D | T | A | V | Y |
| 21-225_146B8_HC | . | . | . | . | . | . | . | . | . | . | . | . | . | . | . | . | . | . | . | . | . | . | . | . | . | . |
| 21-225_147F9_HC | . | . | . | . | . | . | . | . | . | . | . | . | . | . | . | . | . | . | . | . | . | . | . | . | . | . |
| 21-225_147G9_HC | . | . | . | . | . | . | . | . | . | . | . | . | . | . | . | . | . | . | . | . | . | . | . | . | . | . |
| 21-225_148A9_HC | . | . | . | . | . | . | . | . | . | . | . | . | . | . | . | . | . | . | . | . | . | . | . | . | . | . |
| 21-225_150D3_HC | . | . | . | . | . | N | . | . | . | . | . | . | . | . | . | . | . | . | . | . | . | . | . | . | . | . |
| 21-225_151F3_HC | . | . | . | . | . | . | . | . | . | . | . | . | . | . | . | . | . | . | . | . | . | . | . | . | . | . |
| 21-225_153D9_HC | . | . | . | . | . | . | . | . | . | . | . | . | . | . | . | . | . | . | . | . | . | . | . | . | . | . |
| 21-225_153F9_HC | . | . | . | . | . | . | . | . | . | . | . | . | . | . | . | . | . | . | . | . | . | . | . | . | . | . |
| 21-225_154C3_HC | . | . | . | . | . | S | . | . | . | . | . | . | . | . | . | . | . | . | . | . | . | . | . | . | . | . |
| 21-225_154D11_HC | . | . | . | . | . | N | . | . | . | . | . | . | . | . | . | . | . | . | . | . | . | . | . | . | . | . |
| 21-225_158E9_HC | . | . | . | . | . | N | . | . | . | . | . | . | . | . | . | . | . | . | . | . | . | . | . | . | . | . |
| 21-225_161E10_HC | . | . | . | . | . | . | . | . | . | . | . | . | . | . | . | . | . | . | . | . | . | . | . | . | . | . |
| 21-225_74A9_HC | . | . | . | . | . | . | . | . | . | . | . | R | . | . | . | . | . | . | . | . | D | . | . | . | . | . |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | A | R | D | R | D | Y | C | S | G | G | S | C | . | . | . | . | . | . | . | . | . | . | P | Y |
| 21-225_146B8_HC | . | . | . | . | . | . | . | . | . | . | . | . | . | . | . | . | . | . | . | . | . | . | . | . | . | . |
| 21-225_147F9_HC | . | . | . | . | . | . | . | . | . | . | . | . | T | . | . | . | . | . | . | . | . | . | . | . | . | . |
| 21-225_147G9_HC | . | . | . | . | . | . | . | . | . | . | . | . | . | . | . | . | . | . | . | . | . | . | . | . | . | . |
| 21-225_148A9_HC | . | . | . | . | . | . | . | . | . | . | . | . | T | . | . | . | . | . | . | . | . | . | . | . | . | . |
| 21-225_150D3_HC | . | . | . | . | . | . | . | . | . | . | . | . | . | . | . | . | . | . | . | . | . | . | . | . | . | . |
| 21-225_151F3_HC | . | . | . | . | . | . | . | . | . | . | . | T | . | . | . | . | . | . | . | . | . | . | . | . | . | . |
| 21-225_153D9_HC | . | . | . | . | . | . | . | . | . | . | . | . | N | . | . | . | . | . | . | . | . | . | . | . | . | . |
| 21-225_153F9_HC | . | . | . | . | . | . | . | . | . | . | . | . | . | . | . | . | . | . | . | . | . | . | . | . | . | . |
| 21-225_154C3_HC | . | . | . | . | . | . | . | . | . | . | . | . | . | . | . | . | . | . | . | . | . | . | . | . | . | . |
| 21-225_154D11_HC | . | . | . | . | . | . | > | > | . | . | . | . | . | . | . | . | . | . | . | . | . | . | . | . | . | . |
| 21-225_158E9_HC | . | . | . | . | . | . | . | . | . | . | . | . | . | . | . | . | . | . | . | . | . | . | . | . | . | . |
| 21-225_161E10_HC | . | . | . | . | . | . | . | . | . | . | . | T | T | . | . | . | . | . | . | . | . | . | . | . | . | . |
| 21-225_74A9_HC | . | . | . | . | . | . | . | . | . | . | . | T | T | . | . | . | . | . | . | . | . | . | . | . | . | . |

FIGURE 57 (Continued)

Table 77. Consensus 43 - VH4|4-39/D4|4-17|RF2/JH4 (SEQ ID NO: 50294):

QLQLQES-GPGLVKPSETLSLTCTVSG-GSISRS---SYYWGWIRQPPGKGLEWIGNIYY----
SGSTYYNPSLKSRVTISVDTSKNQFSLKLSSVTAADTAVYYCGRHGKDW--------------GLDYWGQGTLVTVSS wherein:

S in position 65 can be substituted with G

S in position 67 can be substituted with T or N

T in position 68 can be substituted with A

Y in position 70 can be substituted with N, D, H or T

L in position 74 can be substituted with V

S in position 76 can be substituted with G

Y in position 138 can be substituted with F or N

Arg Ser Tyr Tyr Trp Gly (SEQ ID NO: 50075)

Asn Ile Tyr Tyr Xaa Gly Xaa Xaa Tyr Xaa Asn Pro Ser Xaa Lys Xaa (SEQ ID NO: 50076)

His Gly Lys Asp Trp Gly Leu Asp Xaa (SEQ ID NO: 50077)

Arg Ser Tyr Tyr Trp Gly (SEQ ID NO: 50552)

Asn Ile Tyr Tyr Ser Gly Ser Thr Tyr Tyr Asn Pro Ser Leu Lys Ser (SEQ ID NO: 50553)

His Gly Lys Asp Trp Gly Leu Asp Tyr (SEQ ID NO: 50554)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | | | | | H_CDR1 | | | | | | | | | | | | | H_FR2 | | |
| CONSENSUS | G | - | G | S | I | S | R | S | - | - | S | Y | Y | W | G | W | I | R | Q | P | P | G | K | G | L |
| 21-225_11F5_HC | . | . | . | . | . | . | . | . | . | . | . | . | . | . | . | . | . | . | . | . | . | . | . | . | . | . |
| 21-225_14B2_HC | . | . | . | . | . | N | . | . | . | . | . | . | . | . | . | . | . | . | . | . | . | . | . | . | . | . |
| 21-225_17F9_HC | . | . | . | . | . | . | . | . | . | . | . | . | . | . | . | . | . | . | . | . | . | . | . | X | . | . |
| 21-225_17H8_HC | . | . | . | . | . | . | . | . | . | . | . | . | . | . | . | . | . | . | . | . | . | . | . | . | . | . |
| 21-225_1F2_HC | . | . | . | . | . | . | . | . | . | . | . | . | . | . | . | . | . | . | . | . | . | . | . | . | . | . |
| 21-225_21H3_HC | . | . | . | . | . | N | . | . | . | . | . | . | . | . | . | . | . | . | . | . | . | . | . | . | . | . |
| 21-225_22G8_HC | . | . | . | . | . | . | . | . | . | . | . | . | . | . | . | . | . | . | . | . | . | . | . | . | . | . |
| 21-225_22H4_HC | . | . | . | . | . | . | . | . | . | . | . | . | . | . | . | . | . | . | . | . | . | . | . | Q | . | . |
| 21-225_23A3_HC | . | . | . | . | . | . | . | . | . | . | . | . | . | . | . | . | . | . | . | . | . | . | . | . | . | . |
| 21-225_23C8_HC | . | . | . | . | . | N | . | . | . | . | . | . | . | . | . | . | . | . | . | . | . | . | . | X | . | . |
| 21-225_4F4_HC | . | . | . | . | . | . | . | . | . | . | . | . | . | . | . | . | . | . | . | . | . | . | . | . | . | . |
| 21-225_4H4_HC | . | . | . | . | . | . | . | . | . | . | . | . | . | . | . | . | . | . | . | . | . | . | . | . | . | . |
| 21-225_5H7_HC | . | . | . | . | . | . | . | . | . | . | . | . | . | . | . | . | . | . | . | . | . | . | . | . | . | . |

FIGURE 57 (Continued)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
|  |  |  |  |  |  |  |  |  |  |  |  |  |  | H_CDR2 |  |  |  |  |  |  |  |  |  |  |  |  |
| CONSENSUS | E | W | I | G | N | I | Y | Y | - | - | - | - | S | G | S | T | Y | Y | N | P | S | L | K | S | R | V |
| 21-225_11F5_HC | . | . | . | . | . | . | . | . | . | . | . | . | . | . | . | . | . | . | . | . | . | . | . | . | . | . |
| 21-225_14B2_HC | . | . | . | . | . | . | . | . | . | . | . | . | . | . | T | . | . | . | . | . | . | . | . | . | . | . |
| 21-225_17F9_HC | . | . | . | . | . | . | . | . | . | . | . | . | . | . | N | . | . | . | . | . | . | . | . | . | . | . |
| 21-225_17H8_HC | . | . | . | . | . | . | . | . | . | . | . | . | G | . | . | . | . | . | . | . | . | . | . | . | . | . |
| 21-225_1F2_HC | . | . | . | . | . | . | . | . | . | . | . | . | . | . | . | . | . | T | . | . | . | . | . | . | . | . |
| 21-225_21H3_HC | Q | . | . | . | . | . | . | . | . | . | . | . | . | . | . | . | . | . | . | . | . | . | . | . | . | . |
| 21-225_22G8_HC | . | . | . | . | . | . | . | . | . | . | . | . | . | . | . | A | . | D | . | . | . | . | . | G | . | A |
| 21-225_22H4_HC | . | . | . | . | . | . | . | . | . | . | . | . | . | . | T | . | . | N | . | . | . | V | . | . | . | . |
| 21-225_23A3_HC | . | . | . | . | . | . | . | . | . | . | . | . | . | . | . | . | . | D | . | . | . | . | . | . | . | . |
| 21-225_23C8_HC | . | . | . | . | . | . | . | . | . | . | . | . | . | . | N | . | . | N | . | . | . | . | . | . | . | . |
| 21-225_4F4_HC | . | . | . | . | . | . | . | . | . | . | . | . | . | . | T | . | . | D | . | . | . | . | . | . | . | . |
| 21-225_4H4_HC | . | . | . | . | . | . | . | . | . | . | . | . | . | . | . | . | . | N | . | . | . | . | . | . | . | . |
| 21-225_5H7_HC | . | . | . | . | . | . | . | . | . | . | . | . | . | . | . | . | . | . | . | . | . | . | . | . | . | . |

FIGURE 57 (Continued)

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | H_FR3 | | | | | | | | | | | | |
| CONSENSUS | T | I | S | V | D | T | S | K | N | Q | F | S | L | K | L | S | S | V | T | A | A | D | T | A | V | Y |
| 21-225_11F5_HC | . | . | . | . | . | . | . | . | . | . | . | . | . | . | . | . | . | . | . | . | . | . | . | . | . | . |
| 21-225_14B2_HC | . | . | . | . | . | S | . | . | . | . | . | . | . | N | . | N | . | . | . | . | . | . | . | . | . | . |
| 21-225_17F9_HC | . | . | . | . | . | . | . | . | . | . | . | . | . | N | . | N | . | . | . | . | . | . | . | . | . | . |
| 21-225_17H8_HC | . | . | . | . | . | . | . | . | . | . | . | . | . | . | . | . | . | . | . | . | . | . | . | . | . | . |
| 21-225_1F2_HC | . | . | . | . | . | . | . | . | . | . | . | . | . | . | . | . | . | . | . | . | . | . | . | . | . | . |
| 21-225_21H3_HC | . | . | . | . | . | . | . | . | . | . | . | . | . | . | . | . | . | . | . | . | . | . | . | . | . | . |
| 21-225_22G8_HC | . | . | . | . | . | . | . | K | . | . | . | . | . | . | . | . | . | . | . | . | . | . | . | . | . | . |
| 21-225_22H4_HC | S | . | . | . | . | . | . | . | . | . | . | . | . | N | . | T | . | . | . | . | . | . | . | . | . | . |
| 21-225_23A3_HC | . | . | . | . | . | . | . | . | . | . | . | . | . | . | . | . | . | . | . | . | . | . | . | . | . | . |
| 21-225_23C8_HC | . | . | . | . | . | . | . | . | . | . | . | . | . | . | . | . | . | . | . | . | . | . | . | . | . | . |
| 21-225_4F4_HC | . | . | . | . | . | . | . | . | . | . | . | . | . | N | . | N | . | . | . | . | . | . | . | . | . | . |
| 21-225_4H4_HC | . | . | . | . | . | . | . | . | . | . | . | . | . | . | . | . | . | . | . | . | . | . | . | . | . | . |
| 21-225_5H7_HC | . | . | . | . | . | . | . | . | . | . | . | . | . | . | . | . | . | . | . | . | . | . | . | . | . | . |

FIGURE 57 (Continued)

| Reference # | 105 Y | 106 C | 107 G | 108 R | 109 H | 110 G | 111 K | 112 D | 113 W | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | G | R | H | G | K | D | W | | | | | | | | | | H_CDR3 | | | | | | | |
| 21-225_11F5_HC | S | | | | | | | | | | | | | | | | | | | | | | | | | |
| 21-225_14B2_HC | S | | A | | | | | | | | | | | | | | | | | | | | | | | |
| 21-225_17F9_HC | | | A | | | | | | | | | | | | | | | | | | | | | | | |
| 21-225_17H8_HC | | | A | | | | | | | | | | | | | | | | | | | | | | | |
| 21-225_1F2_HC | | | | | | | | | | | | | | | | | | | | | | | | | | |
| 21-225_21H3_HC | | | | | | | | | | | | | | | | | | | | | | | | | | |
| 21-225_22G8_HC | | | A | | | | | | | | | | | | | | | | | | | | | | | |
| 21-225_22H4_HC | F | | | | | | | | | | | | | | | | | | | | | | | | | |
| 21-225_23A3_HC | | | | | | | | | | | | | | | | | | | | | | | | | | |
| 21-225_23C8_HC | | | | | | | | | | | | | | | | | | | | | | | | | | |
| 21-225_4F4_HC | | | | | | | | | | | | | | | | | | | | | | | | | | |
| 21-225_4H4_HC | | | A | | | | | | | | | | | | | | | | | | | | | | | |
| 21-225_5H7_HC | S | | | | | | | | | | | | | | | | | | | | | | | | | |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | H_FR4 | | | | | | | |
| CONSENSUS | - | - | - | - | G | L | D | Y | W | G | Q | G | T | L | V | T | V | S | S |
| 21-225_11F5_HC | . | . | . | . | . | . | . | N | . | . | . | . | . | . | . | . | . | . | . |
| 21-225_14B2_HC | . | . | . | . | . | . | . | . | . | . | . | . | A | . | . | . | . | . | . |
| 21-225_17F9_HC | . | . | . | . | . | . | . | . | . | . | . | . | . | . | . | . | . | . | . |
| 21-225_17H8_HC | . | . | . | . | . | . | . | . | . | . | . | . | . | . | . | . | . | . | . |
| 21-225_1F2_HC | . | . | . | . | . | . | . | . | . | . | . | . | . | . | . | . | . | . | . |
| 21-225_21H3_HC | . | . | . | . | . | . | . | . | . | . | . | . | . | . | . | . | . | . | . |
| 21-225_22G8_HC | . | . | . | . | . | . | . | . | . | . | . | . | . | . | . | . | . | . | . |
| 21-225_22H4_HC | . | . | . | . | . | . | . | A | . | . | . | . | . | . | . | . | . | . | . |
| 21-225_23A3_HC | . | . | . | . | . | . | . | . | . | . | . | . | . | . | . | . | . | . | . |
| 21-225_23C8_HC | . | . | . | . | . | . | . | . | . | . | . | . | . | . | . | . | . | . | . |
| 21-225_4F4_HC | . | . | . | . | . | . | . | . | . | . | . | . | . | . | . | ~ | . | . | . |
| 21-225_4H4_HC | . | . | . | . | . | . | . | . | . | . | . | . | . | . | . | . | . | . | . |
| 21-225_5H7_HC | . | . | . | . | . | . | . | . | . | . | . | . | . | . | . | . | . | . | . |

FIGURE 57 (Continued)

Table 78. Consensus 44 - VH1|1-02/D7|7-27|RF1/JH4 (SEQ ID NO: 50295):

QVQLVQS-GAEVKKPGASVKVSCKASG-YTFTG-----YYMHWVRQAPGQGLEWMGWIKPN----SGGTNQAQKFQGRVTMTRDTSISTAYMELSGLRSDDTAVYYCARAPGTAAAG--------TWGYFDYWGQGTLVTVSS wherein:

M at position 41 can be substituted with I
K in position 59 can be substituted with N
N in position 61 can be substituted with K
Q in position 70 can be substituted with S, H, N or Y
A in position 71 can be substituted with V
T in position 112 can be substituted with K or I
A in position 113 can be substituted with V
A in position 114 can be substituted with P
A in position 115 can be substituted with T
T in position 132 can be substituted with S
Y in position 135 can be substituted with F or C
Gly Tyr Tyr Xaa His (SEQ ID NO: 50078)
Trp Ile Xaa Pro Xaa Ser Gly Gly Thr Asn Xaa Xaa Gln Lys Phe Gln Gly (SEQ ID NO: 50079)
Ala Pro Gly Xaa Xaa Xaa Gly Xaa Trp Gly Xaa Xaa Phe Asp Tyr (SEQ ID NO: 50080)
Gly Tyr Tyr Met His (SEQ ID NO: 50555)
Trp Ile Lys Pro Asn Ser Gly Gly Thr Asn Gln Ala Gln Lys Phe Gln Gly (SEQ ID NO: 50556)
Ala Pro Gly Thr Ala Ala Ala Gly Thr Trp Gly Tyr Phe Asp Tyr (SEQ ID NO: 50557)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS | Q | V | Q | L | V | Q | S | - | G | A | E | V | K | K | P | G | A | S | V | K | V | S | C | K | A | S |
| 21-225_62G7_HC | . | . | . | . | . | . | . | . | . | . | . | . | . | . | . | . | . | . | . | . | . | . | . | . | . | . |
| 21-225_64H10_HC | . | . | . | . | . | . | . | . | . | . | . | . | . | . | . | . | . | . | . | . | . | . | . | . | . | . |
| 21-225_65G3_HC | . | . | . | . | . | . | . | . | . | . | . | . | . | . | . | . | . | . | . | . | . | . | . | . | . | . |
| 21-225_66A7_HC | . | . | . | . | . | . | . | . | . | . | . | . | . | . | . | . | . | . | . | . | . | . | . | . | . | . |
| 21-225_66B1_HC | . | . | . | . | . | . | . | . | . | . | . | . | . | . | . | . | . | . | . | . | . | . | . | . | . | . |
| 21-225_67H4_HC | . | . | . | . | . | . | . | . | . | . | . | . | . | . | . | . | . | . | . | . | . | . | . | . | . | . |
| 21-225_70A12_HC | . | . | . | . | . | . | . | . | . | . | . | . | . | . | . | . | . | . | . | . | . | . | . | . | . | . |
| 21-225_70D6_HC | . | . | . | . | . | . | . | . | . | . | . | . | . | . | . | . | . | . | . | . | . | . | . | . | . | . |
| 21-225_70G9_HC | . | . | . | . | . | . | . | . | . | . | . | . | . | . | . | . | . | . | . | . | . | . | . | . | . | . |
| 21-225_71A7_HC | . | . | . | . | . | . | . | . | . | . | . | . | . | . | . | . | . | . | . | . | . | . | . | . | . | . |
| 21-225_71B7_HC | . | . | . | . | . | . | . | . | . | . | . | . | . | . | . | . | . | . | . | . | . | . | . | . | . | . |
| 21-225_73A3_HC | . | . | . | . | . | . | . | . | . | . | . | . | . | . | . | . | . | . | . | . | . | . | . | . | . | . |

FIGURE 57 (Continued)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | | | | | H_CDR1 | | | | | | | | | | | | H_FR2 | | | |
| CONSENSUS | G | - | Y | T | F | T | G | - | - | - | - | - | Y | Y | M | H | W | V | R | Q | A | P | G | Q | G | L |
| 21-225_62G7_HC | . | . | . | . | . | . | . | . | . | . | . | . | . | . | . | . | . | . | . | . | . | . | . | . | . | . |
| 21-225_64H10_HC | . | . | . | . | . | . | . | . | . | . | . | . | . | . | . | . | . | . | . | . | . | . | . | . | . | . |
| 21-225_65G3_HC | . | . | . | . | . | . | . | . | . | . | . | . | . | . | ~ | . | . | . | . | . | . | . | . | . | . | . |
| 21-225_66A7_HC | . | . | . | . | . | . | . | . | . | . | . | . | . | . | . | . | . | . | . | . | . | . | . | . | . | . |
| 21-225_66B1_HC | . | . | . | . | . | . | . | . | . | . | . | . | . | . | . | . | . | . | . | . | . | . | . | . | . | . |
| 21-225_67H4_HC | . | . | . | . | . | . | . | . | . | . | . | . | . | . | . | . | . | . | . | . | . | . | . | . | . | . |
| 21-225_70A12_HC | . | . | . | . | . | . | . | . | . | . | . | . | . | . | . | . | . | . | . | . | . | . | . | . | . | . |
| 21-225_70D6_HC | . | . | . | ~ | . | . | . | . | . | . | . | . | . | . | . | . | . | . | . | . | . | . | . | . | . | . |
| 21-225_70G9_HC | . | . | . | . | . | . | . | . | . | . | . | . | . | . | . | . | . | . | . | . | . | . | . | . | . | . |
| 21-225_71A7_HC | . | . | . | ~ | . | . | . | . | . | . | . | . | . | . | . | . | . | . | . | . | . | . | . | . | . | . |
| 21-225_71B7_HC | . | . | . | . | . | . | . | . | . | . | . | . | . | . | . | . | . | . | . | . | . | . | . | . | . | . |
| 21-225_73A3_HC | . | . | . | . | . | . | . | . | . | . | . | . | . | . | . | . | . | . | . | . | . | . | . | . | . | . |

FIGURE 57 (Continued)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | H_CDR2 | | | | | | | | | | | | |
| CONSENSUS | E | W | M | G | W | I | N | P | N | - | - | - | S | G | G | T | N | Q | A | Q | K | F | Q | G | R | V |
| 21-225_62G7_HC | . | . | . | . | . | . | X | . | X | . | . | . | . | . | . | . | . | . | . | . | . | . | . | . | . | . |
| 21-225_64H10_HC | . | . | . | . | . | . | N | . | . | . | . | . | . | . | . | . | . | S | . | . | . | . | . | . | . | . |
| 21-225_65G3_HC | . | . | . | . | . | . | N | . | . | . | . | . | . | . | . | . | . | . | . | . | . | . | . | . | . | . |
| 21-225_66A7_HC | . | . | . | . | . | . | N | . | . | . | . | . | . | . | . | . | . | N | . | . | . | . | . | . | . | . |
| 21-225_66B1_HC | . | . | . | . | . | . | N | . | X | . | . | . | . | . | . | . | . | . | . | . | . | . | . | . | . | . |
| 21-225_67H4_HC | . | . | . | . | . | . | N | . | . | . | . | . | . | . | . | . | . | S | . | . | . | . | . | . | . | . |
| 21-225_70A12_HC | . | . | . | . | . | . | N | . | . | . | . | . | . | . | . | . | . | . | . | . | . | . | . | . | . | . |
| 21-225_70D6_HC | . | . | . | . | . | . | N | . | X | . | . | . | . | . | . | . | . | Y | . | . | . | . | . | . | . | . |
| 21-225_70G9_HC | . | . | . | . | . | . | N | . | X | . | . | . | . | . | . | . | . | S | V | . | . | . | . | . | . | . |
| 21-225_71A7_HC | . | . | . | . | . | . | N | . | . | . | . | . | . | . | . | . | . | . | . | . | . | . | . | . | . | . |
| 21-225_71B7_HC | . | . | . | . | . | . | . | . | . | . | . | . | . | . | . | . | . | X | . | . | . | . | . | . | . | . |
| 21-225_73A3_HC | Q | . | . | . | . | . | N | . | . | . | . | . | . | . | . | . | . | . | V | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | A | R | A | P | G | T | A | A | A | G | | | | | | | | | | | | | | |
| 21-225_62G7_HC | . | . | . | . | . | . | . | . | . | . | . | . | . | . | . | . | . | . | . | . | . | . | . | . | . | . |
| 21-225_64H10_HC | . | . | . | . | . | . | . | . | . | . | T | . | . | . | . | . | . | . | . | . | . | . | . | . | . | . |
| 21-225_65G3_HC | . | . | . | . | . | . | . | X | V | . | . | . | . | . | . | . | . | . | . | . | . | . | . | . | . | . |
| 21-225_66A7_HC | . | . | . | . | . | . | . | . | . | . | . | . | . | . | . | . | . | . | . | . | . | . | . | . | . | . |
| 21-225_66B1_HC | . | . | . | . | . | . | . | . | . | . | . | . | . | . | . | . | . | . | . | . | . | . | . | . | . | . |
| 21-225_67H4_HC | . | . | . | . | . | . | . | . | . | . | T | . | . | . | . | . | . | . | . | . | . | . | . | . | . | . |
| 21-225_70A12_HC | . | . | . | . | . | . | . | X | . | . | T | . | . | . | . | . | . | . | . | . | . | . | . | . | . | . |
| 21-225_70D6_HC | . | . | . | . | . | . | . | . | . | . | . | . | . | . | . | . | . | . | . | . | . | . | . | . | . | . |
| 21-225_70G9_HC | . | . | . | . | . | . | . | X | . | . | . | . | . | . | . | . | . | . | . | . | . | . | . | . | . | . |
| 21-225_71A7_HC | . | . | . | . | . | . | . | X | . | P | . | . | . | . | . | . | . | . | . | . | . | . | . | . | . | . |
| 21-225_71B7_HC | . | . | . | . | . | . | . | . | . | . | . | . | . | . | . | . | . | . | . | . | . | . | . | . | . | . |
| 21-225_73A3_HC | . | . | . | . | . | . | . | . | . | . | . | . | . | . | . | . | . | . | . | . | . | . | . | . | . | . |

H_CDR3

Table 79. Consensus 45 - VH2|2-05/D6|6-6|RF2/JH4 (SEQ ID NO: 50296):

QITLKES-GPTLVKPTQTLTLTCTFSG-FSLSTG---GVGVGWIRQPPGKALEWLALIYW-----
DDDKRYSPSLKSRLTITKDTSKNQVVLTMTNMDPVDTATYYCAHLIAV----------ARDYWGQGTLVTVSS wherein:

G in position 34 can be substituted with S

L in position 57 can be substituted with F

D in position 65 can be substituted with H, N, K or S

K in position 68 can be substituted with E

K in position 75 can be substituted with R

L in position 109 can be substituted with I or A

I in position 110 can be substituted with V or A

A in position 135 can be substituted with S

F in position 136 can be substituted with C

Thr Xaa Gly Val Gly Val Gly (SEQ ID NO: 50081)

Xaa Ile Tyr Trp Asp Asp Xaa Arg Tyr Ser Pro Ser Leu Xaa Ser (SEQ ID NO: 50082)

Xaa Xaa Ala Val Xaa Xaa Asp Tyr (SEQ ID NO: 50083)

Thr Gly Gly Val Gly Val Gly (SEQ ID NO: 50558)

Leu Ile Tyr Trp Asp Asp Lys Arg Tyr Ser Pro Ser Leu Lys Ser (SEQ ID NO: 50559)

Leu Ile Ala Val Ala Phe Asp Tyr (SEQ ID NO: 50560)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | H_CDR1 | | | | | | | | | | | | | | | | | H_FR2 | | | |
| CONSENSUS | G | - | F | S | L | S | T | G | - | - | G | V | G | V | G | W | I | R | Q | P | P | G | K | A | L |
| 21-225_10B10_HC | . | . | . | . | . | . | . | . | . | . | . | . | . | . | . | . | . | . | . | . | . | . | . | . | . | . |
| 21-225_15H11_HC | . | . | . | . | . | . | . | . | . | . | . | . | . | . | . | . | . | . | . | . | . | . | . | . | . | . |
| 21-225_17F5_HC | . | . | . | . | . | . | . | S | . | . | . | . | . | . | . | . | . | . | . | . | . | . | . | . | . | . |
| 21-225_30H6_HC | . | . | . | . | . | . | . | . | . | . | . | . | . | . | . | . | . | . | . | . | . | . | . | . | . | . |
| 21-225_31C2_HC | . | . | . | . | . | N | . | . | . | . | . | . | . | . | . | . | . | . | . | . | . | . | . | . | . | . |
| 21-225_57D9_HC | . | . | . | . | . | . | . | S | . | . | . | . | . | . | . | . | . | . | . | . | . | . | . | . | . | . |
| 21-225_60D6_HC | . | . | . | . | . | . | . | S | . | . | . | . | . | . | . | . | . | . | . | . | . | . | . | . | . | . |
| 21-225_74G9_HC | . | . | . | . | . | . | . | . | . | . | . | . | . | . | . | . | . | . | . | . | . | . | . | . | . | . |
| 21-225_75F11_HC | . | . | . | . | . | . | . | . | . | . | . | . | . | . | . | . | . | . | . | . | . | . | . | . | . | . |
| 21-225_76B4_HC | . | . | . | . | . | . | . | S | . | . | . | . | . | . | . | . | . | . | . | . | . | . | . | . | . | . |
| 21-225_77A2_HC | . | . | . | . | . | . | . | . | . | . | . | . | . | . | . | . | . | . | . | . | . | . | . | . | . | . |
| 21-225_96B5_HC | . | . | . | . | . | . | . | . | . | . | . | . | . | . | . | . | . | . | . | . | . | . | . | . | . | . |

FIGURE 57 (Continued)

|  | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | | H_CDR2 | | | | | | | | | | | |
| Reference # CONSENSUS | E | W | L | A | L | I | Y | W | . | . | . | . | D | D | D | K | R | Y | S | P | S | L | K | S | R | L |
| 21-225_10B10_HC | . | . | . | V | L | . | . | . | . | . | . | . | S | . | . | . | . | . | . | . | . | . | . | . | . | . |
| 21-225_15H11_HC | . | . | . | . | . | . | . | . | . | . | . | . | . | . | . | . | . | . | . | . | . | . | K | . | . | . |
| 21-225_17F5_HC | . | . | . | . | . | . | . | . | . | . | . | . | . | . | . | . | . | . | . | . | . | . | . | . | . | . |
| 21-225_30H6_HC | . | . | . | . | . | . | . | . | . | . | . | . | . | . | . | . | . | . | . | . | . | . | . | . | . | . |
| 21-225_31C2_HC | . | . | . | . | . | . | . | . | . | . | . | . | N | . | . | E | . | . | . | . | . | . | . | . | . | . |
| 21-225_57D9_HC | . | . | . | . | . | . | . | . | . | . | . | . | N | . | . | E | . | . | . | . | . | . | . | . | . | . |
| 21-225_60D6_HC | . | . | . | . | . | . | . | . | . | . | . | . | N | . | . | . | . | . | . | . | . | . | . | . | . | . |
| 21-225_74G9_HC | . | . | . | . | . | . | . | . | . | . | . | . | . | . | . | . | . | . | . | . | . | . | . | . | . | . |
| 21-225_75F11_HC | . | . | . | . | . | . | . | . | . | . | . | . | . | . | . | . | . | . | . | . | . | . | . | . | . | . |
| 21-225_76B4_HC | . | . | . | V | L | . | . | . | . | . | . | . | . | . | . | . | . | . | . | . | . | . | . | . | . | . |
| 21-225_77A2_HC | . | . | . | . | . | . | . | . | . | . | . | . | . | . | . | . | . | . | . | . | . | . | . | . | . | . |
| 21-225_96B5_HC | . | . | . | . | . | . | . | . | . | . | . | . | . | . | . | . | . | . | . | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | A | H | L | I | A | V | . | . | . | . | . | . | . | . | . | . | . | . | . | . | . | . | . | . |
| 21-225_10B10_HC | . | . | . | . | - | < | . | . | . | . | . | . | . | . | . | . | . | . | . | . | . | . | . | . | . | . |
| 21-225_15H11_HC | S | . | . | . | - | > | . | . | . | . | . | . | . | . | . | . | . | . | . | . | . | . | . | . | . | . |
| 21-225_17F5_HC | . | . | . | . | . | . | . | . | . | . | . | . | . | . | . | . | . | . | . | . | . | . | . | . | . | . |
| 21-225_30H6_HC | . | . | . | . | . | . | . | . | . | . | . | . | . | . | . | . | . | . | . | . | . | . | . | . | . | . |
| 21-225_31C2_HC | . | . | . | . | . | . | . | . | . | . | . | . | . | . | . | . | . | . | . | . | . | . | . | . | . | . |
| 21-225_57D9_HC | . | . | . | . | < | > | . | . | . | . | . | . | . | . | . | . | . | . | . | . | . | . | . | . | . | . |
| 21-225_60D6_HC | . | . | . | . | < | > | . | . | . | . | . | . | . | . | . | . | . | . | . | . | . | . | . | . | . | . |
| 21-225_74G9_HC | . | . | . | . | . | . | . | . | . | . | . | . | . | . | . | . | . | . | . | . | . | . | . | . | . | . |
| 21-225_75F11_HC | . | . | . | . | . | . | . | . | . | . | . | . | . | . | . | . | . | . | . | . | . | . | . | . | . | . |
| 21-225_76B4_HC | . | . | . | . | . | . | . | . | . | . | . | . | . | . | . | . | . | . | . | . | . | . | . | . | . | . |
| 21-225_77A2_HC | . | . | . | . | . | . | . | . | . | . | . | . | . | . | . | . | . | . | . | . | . | . | . | . | . | . |
| 21-225_96B5_HC | . | . | . | . | . | . | . | . | . | . | . | . | . | . | . | . | . | . | . | . | . | . | . | . | . | . |

H_CDR3

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| CONSENSUS | - | - | - | - | A | F | D | Y | W | G | Q | G | T | L | V | T | V | S | S |
|  |  |  |  |  |  |  |  |  |  |  |  |  |  | H_FR4 |  |  |  |  |  |
| 21-225_10B10_HC | . | . | . | . | . | . | . | . | . | . | . | . | . | . | . | . | . | . | . |
| 21-225_15H11_HC | . | . | . | . | . | . | . | . | . | . | . | . | . | . | . | . | . | . | . |
| 21-225_17F5_HC | . | . | . | . | . | . | . | . | . | . | . | . | . | . | . | . | . | . | . |
| 21-225_30H6_HC | . | . | . | . | S | . | . | . | . | . | . | . | . | . | . | . | . | . | . |
| 21-225_31C2_HC | . | . | . | . | S | . | . | . | . | . | . | . | . | . | . | . | . | . | . |
| 21-225_57D9_HC | . | . | . | . | S | . | . | . | . | . | . | . | A | . | . | . | . | . | . |
| 21-225_60D6_HC | . | . | . | . | . | . | . | . | . | . | . | . | . | . | . | . | . | . | . |
| 21-225_74G9_HC | . | . | . | . | . | . | . | . | . | . | . | . | . | . | . | . | . | . | . |
| 21-225_75F11_HC | . | . | . | . | . | . | . | . | . | . | . | . | . | . | — | . | . | . | . |
| 21-225_76B4_HC | . | . | . | . | . | . | . | . | . | . | . | . | . | . | . | . | . | . | . |
| 21-225_77A2_HC | . | . | . | . | . | G | . | . | . | . | . | . | . | . | . | . | . | . | . |
| 21-225_96B5_HC | . | . | . | . | . | . | . | . | . | . | . | . | . | . | . | . | . | . | . |

FIGURE 57 (Continued)

Table 80.  Consensus 46 - VH3j3-33/D3j3-22jRF2/JH4 (SEQ ID NO: 50297):

QVQLVES-GGGVVQPGRSLRLSCAASG-FTFSS-----YGMHWVRQAPGKGLEWVAIIWYD---GSYKYYADSVKGRFTISRDNSKNTLYLQMNSLRAEDTAVYYCAREAYDFW----------SGYFDYWGQGTLVTVSS wherein:

S at position 33 can be substituted with N or T

I at position 57 can be substituted with V

Y at position 67 can be substituted with N

A at position 71 can be substituted with V

A at position 110 can be substituted with G, R, or N

Y at position 135 can be substituted with F or H

F at position 136 can be substituted with L, Y, or W

D at position 137 can be substituted with G

Y at position 138 can be substituted with S

Xaa Tyr Gly Met His (SEQ ID NO: 50084)

Xaa Ile Trp Tyr Asp Gly Ser Xaa Lys Tyr Tyr Xaa Asp Ser Val Lys Gly (SEQ ID NO: 50085)

Glu Xaa Tyr Asp Phe Trp Ser Gly Xaa Xaa Xaa Xaa (SEQ ID NO: 50086)

Ser Tyr Gly Met His (SEQ ID NO: 50561)

Ile Ile Trp Tyr Asp Gly Ser Tyr Lys Tyr Tyr Ala Asp Ser Val Lys Gly (SEQ ID NO: 50562)

Glu Ala Tyr Asp Phe Trp Ser Gly Tyr Phe Asp Tyr (SEQ ID NO: 50563)

FIGURE 57 (Continued)

| Reference # | | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|---|
| | | | | | | | | | | | | | | | | | H_FR1 | | | | | | | | | | |
| CONSENSUS | | Q | V | Q | L | V | E | S | - | G | G | G | V | V | Q | P | G | R | S | L | R | L | S | C | A | A | S |
| 21-225_152C11_HC | | . | . | . | . | . | . | . | . | . | . | . | . | . | . | . | . | . | . | . | . | . | . | . | . | . | . |
| 21-225_152F6_HC | | . | . | . | . | . | . | . | . | . | . | . | . | . | . | . | . | . | . | . | . | . | . | . | . | . | . |
| 21-225_153D2_HC | | . | . | . | . | . | . | . | . | . | . | . | . | . | . | . | . | . | . | . | . | . | . | . | . | . | . |
| 21-225_157G8_HC | | . | . | . | . | . | . | . | . | . | . | . | . | . | . | . | . | . | . | . | . | . | . | . | . | . | . |
| 21-225_160B1_HC | | . | . | . | . | . | . | . | . | . | . | . | . | . | . | . | . | . | . | . | . | . | . | . | . | . | . |
| 21-225_172B7_HC | | . | . | . | . | . | . | . | . | . | . | . | . | . | . | . | . | . | . | . | . | . | . | . | . | . | . |
| 21-225_173A11_HC | | . | . | . | . | . | . | . | . | . | . | . | . | . | . | . | . | . | . | . | . | . | . | . | . | . | . |
| 21-225_178G10_HC | | . | . | . | . | . | . | . | . | . | . | . | . | . | . | . | . | . | . | . | . | . | . | . | . | . | . |
| 21-225_188G11_HC | | . | . | . | . | . | . | . | . | . | . | . | . | . | . | . | . | . | . | . | . | . | . | . | . | . | . |
| 21-225_226E7_HC | | . | . | . | . | . | . | . | . | . | . | . | . | . | . | . | . | . | . | . | . | . | . | . | . | . | . |
| 21-225_25H9_HC | | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | H_CDR1 | | | | | | | | | | | H_FR2 | | | | | | | | | |
| CONSENSUS | G | . | F | T | F | S | S | . | . | . | . | . | Y | G | M | H | W | V | R | Q | A | P | G | K | G | L |
| 21-225_152C11_HC | . | . | . | . | . | . | N | . | . | . | . | . | . | . | . | . | . | . | . | . | . | . | . | . | . | . |
| 21-225_152F6_HC | . | . | . | . | . | . | . | . | . | . | . | . | . | . | . | . | . | . | . | . | . | . | . | . | . | . |
| 21-225_153D2_HC | . | . | . | . | . | . | N | . | . | . | . | . | . | . | . | . | . | . | . | . | . | . | . | . | . | . |
| 21-225_157G8_HC | . | . | . | . | . | . | . | . | . | . | . | . | . | . | . | . | . | . | . | . | . | . | . | . | . | . |
| 21-225_160B1_HC | . | . | . | . | . | . | N | . | . | . | . | . | . | . | . | . | . | . | . | . | . | . | . | . | . | . |
| 21-225_172B7_HC | . | . | . | . | . | . | . | . | . | . | . | . | . | . | . | . | . | . | . | . | . | . | . | . | . | . |
| 21-225_173A11_HC | . | . | . | . | . | . | T | . | . | . | . | . | . | . | . | . | . | . | . | . | . | . | . | . | . | . |
| 21-225_178G10_HC | . | . | . | R | . | . | T | . | . | . | . | . | . | . | . | . | . | . | . | . | . | . | . | . | . | . |
| 21-225_188G11_HC | . | . | . | . | . | . | N | . | . | . | . | . | . | . | . | . | . | . | . | . | . | . | . | . | . | . |
| 21-225_226E7_HC | . | . | . | . | . | N | . | . | . | . | . | . | . | . | . | . | . | . | . | . | . | . | . | . | . | . |
| 21-225_25H9_HC | . | . | . | . | . | . | . | . | . | . | . | . | . | . | . | . | . | . | . | . | . | . | . | . | . | . |

Table 81. Consensus 47 - VH3j3-33/D5j5-18|RF3/JH6 (SEQ ID NO: 50298):

QVQLVES-GGGVVQPGRSLRLSCAASG-FTFSS---YGMHWVRQAPGKGLEWVAVIWYD--
GSNKYYADSVKGRFTISRDNSKNTLYLQMNSLRAEDTAVYYCARDRDYGD-----------YGMDVWGQGTTVTVSS wherein:

M at position 41 can be substituted with L

Y at position 69 can be substituted with N

A at position 71 can be substituted with E

D at position 109 can be substituted with W

R at position 110 can be substituted with R, G or Y

D at position 111 can be substituted with S or Y

G at position 113 can be substituted with Y

D at position 114 can be substituted with Y null (-) at position 115 can be substituted with P null (-) at position 116 can be substituted with P null (-) at position 117 can be substituted with Y null (-) at position 131 can be substituted with Y null (-) at position 132 can be substituted with Y null (-) at position 133 can be substituted with Y Y at position 134 can be substituted with D Ser Tyr Gly Xaa His (SEQ ID NO: 50087)

Val Ile Trp Tyr Asp Gly Ser Asn Lys Xaa Tyr Xaa Asp Ser Val Lys Gly (SEQ ID NO: 50088)

FIGURE 57 (Continued)

Xaa Xaa Xaa Tyr Xaa Xaa Xaa Xaa Xaa Xaa Xaa Gly Met Asp Val (SEQ ID NO: 50089)

Ser Tyr Gly Met His (SEQ ID NO: 50564)

Val Ile Trp Tyr Asp Gly Ser Asn Lys Tyr Tyr Ala Asp Ser Val Lys Gly (SEQ ID NO: 50565)

Asp Arg Asp Tyr Gly Asp Tyr Gly Met Asp Val (SEQ ID NO: 50566)

Table 82. Consensus 48 - VH3|3-23/D4|4-17|RF2/JH6 (SEQ ID NO: 50299):

EVQLLES-GGGLVQPGGSLRLSCAASG-FTFSS------YAMSWVRQAPGKGLEWVSAISGS---
GGNTFYADSVKGRFTISRDNSKNTLYLQMNSLRAEDTAVYYCAKLGKDYY----------YYGMDVWGQGTTVTVSS wherein:

S at position 33 can be substituted with N or T

Y at position 39 can be substituted with S

A at position 40 can be substituted with V

S at position 42 can be substituted with T or N

A at position 57 can be substituted with G

I at position 58 can be substituted with S or V

S at position 59 can be substituted with V

S at position 61 can be substituted with R

G at position 66 can be substituted with A, S or V

N at position 67 can be substituted with R or K

F at position 69 can be substituted with Y

Y at position 70 can be substituted with N

A at position 71 can be substituted with T

K at position 75 can be substituted with T

L at position 109 can be substituted with D or E

G at position 110 can be substituted with R

K at position 111 can be substituted with G or I

FIGURE 57 (Continued)

D at position 112 can be substituted with Q or Y

Y at position 113 can be substituted with W

Y at position 114 can be substituted with H or L

Y at position 133 can be substituted with null (-), I, or L

Y at position 134 can be substituted with G

M at position 136 can be substituted with V

Xaa Xaa Xaa Met Xaa (SEQ ID NO: 50090)

Xaa Xaa Xaa Gly Xaa Gly Xaa Xaa Thr Xaa Xaa Xaa Asp Ser Val Xaa Gly (SEQ ID NO: 50091)

Xaa Xaa Xaa Xaa Xaa Xaa Xaa Gly Xaa Asp Val (SEQ ID NO: 50092)

Ser Tyr Ala Met Ser (SEQ ID NO: 50567)

Ala Ile Ser Gly Ser Gly Gly Asn Thr Phe Tyr Ala Asp Ser Val Lys Gly (SEQ ID NO: 50568)

Leu Gly Lys Asp Tyr Tyr Tyr Tyr Gly Met Asp Val (SEQ ID NO: 50569)

Table 83. Consensus 49 - VH3|3-23/D7|7-27|RF1/JH4 (SEQ ID NO: 50300):
EVQLLES-GGGLVQPGGSLRLSCAASG-FTFSS----YVMSWVRQAPGKGLEWVSAMSGS---
GGRTYYADSVKGRFTISRDNSKNTLYLQMNSLRAEDTAVYYCAKLTA----------FDYWGQGTLVTVSS wherein:

V at position 40 can be substituted with A

S at position 42 can be substituted with N

A at position 57 can be substituted with G, T or S

M at position 58 can be substituted with I or T

G at position 66 can be substituted with N or V

R at position 67 can be substituted with N or W

Y at position 69 can be substituted with F or N

K at position 75 can be substituted with N

G at position 76 can be substituted with D

L at position 109 can be substituted with V, Y or F

T at position 110 can be substituted with E, F or G

A at position 111 can be substituted with G, L, W, null (-) or F null (-) at position 112 can be substituted with G or M null (-) at position 113 can be substituted with V null (-) at position 114 can be substituted with G null (-) at position 133 can be substituted with A null (-) at position 134 can be substituted with G FIGURE 57 (Continued)

null (-) at position 135 can be substituted with I or F

F at position 136 can be substituted with N or null (-)

D at position 137 can be substituted with G or I

Y at position 138 can be substituted with D

Ser Tyr Xaa Met Xaa (SEQ ID NO: 50093)

Xaa Xaa Ser Gly Ser Gly Xaa Xaa Thr Xaa Tyr Ala Asp Ser Val Xaa Xaa (SEQ ID NO: 50094)

Xaa Xaa Xaa Xaa Xaa Xaa Xaa Xaa Xaa Xaa Xaa Xaa (SEQ ID NO: 50095)

Ser Tyr Val Met Ser (SEQ ID NO: 50570)

Ala Met Ser Gly Ser Gly Gly Arg Thr Tyr Tyr Ala Asp Ser Val Lys Gly (SEQ ID NO: 50571)

Leu Thr Ala Phe Asp Tyr (SEQ ID NO: 50572)

Table 84. Consensus 50 - VH3|3-30.3/D5|5-24|RF3/JH6 (SEQ ID NO: 50301):

QVQLVES-GGGVVQPGRSLRLSCAASG-FTFSS-----YGMHWVRQAPGKGLEWVAIISYA---GSNKYYADSVKGRFTISRDNSKNTLYLQMNSLRAEDTAVYYCVRRGYSYG-------------GYGMDVWGQGTTVTVSS wherein:

S at position 33 can be substituted with Y

M at position 41 can be substituted with L

I at position 57 can be substituted with V

A at position 61 can be substituted with G, D, S or V

S at position 66 can be substituted with I, N, R or T

K at position 68 can be substituted with N or Q

Y at position 69 can be substituted with S, D or H

Y at position 70 can be substituted with S

R at position 109 can be substituted with E

G at position 110 can be substituted with D

Y at position 111 can be substituted with R

S at position 112 can be substituted with Y

Y at position 113 can be substituted with C

G at position 114 can be substituted with S null (-) at position 115 can be substituted with G null (-) at position 116 can be substituted with T null (-) at position 117 can be substituted with S FIGURE 57 (Continued)

null (-) at position 118 can be substituted with C null (-) at position 129 can be substituted with P null (-) at position 130 can be substituted with Y null (-) at position 131 can be substituted with Y null (-) at position 132 can be substituted with Y G at position 133 can be substituted with Y Xaa Tyr Gly Xaa His (SEQ ID NO: 50096)

Xaa Ile Ser Tyr Xaa Gly Xaa Asn Xaa Xaa Xaa Ala Asp Ser Val Lys Gly (SEQ ID NO: 50097)

Xaa Xaa Xaa Xaa Xaa Xaa Xaa Xaa Xaa Xaa Xaa Xaa Xaa Tyr Gly Met Asp Val (SEQ ID NO: 50098)

Ser Tyr Gly Met His (SEQ ID NO: 50573)

Ile Ile Ser Tyr Ala Gly Ser Asn Lys Tyr Tyr Ala Asp Ser Val Lys Gly (SEQ ID NO: 50574)

Arg Gly Tyr Ser Tyr Gly Gly Tyr Gly Met Asp Val (SEQ ID NO: 50575)

Table 85. Consensus 51 - VH3j3-33/D3j3-10jRF2/JH6 (SEQ ID NO: 50302):

QVQLVES-GGGVVQPGRSLRLSCAASG-FTFSD----YVMHWVRQAPGKGLEWVAVIWYD---GSNKYYADSVKGRFTISRDNSKNTLYLQMNSLRAEDTAVYYCAREPYTSGW------------YDYGMDVWGQGTTVTVSS wherein:

D at position 33 can be substituted with S

Y at position 39 can be substituted with C

V at position 40 can be substituted with G

H at position 42 can be substituted with Q

V at position 57 can be substituted with I

G at position 76 can be substituted with V

P at position 110 can be substituted with R

T at position 112 can be substituted with N

Y at position 132 can be substituted with H

M at position 136 can be substituted with L

Xaa Xaa Xaa Met Xaa (SEQ ID NO: 50099)

Xaa Ile Trp Tyr Asp Gly Ser Asn Lys Tyr Tyr Ala Asp Ser Val Lys Xaa (SEQ ID NO: 50100)

Glu Xaa Tyr Xaa Ser Gly Trp Xaa Asp Tyr Gly Xaa Asp Val (SEQ ID NO: 50101)

Asp Tyr Val Met His (SEQ ID NO: 50576)

Val Ile Trp Tyr Asp Gly Ser Asn Lys Tyr Tyr Ala Asp Ser Val Lys Gly (SEQ ID NO: 50577)

Glu Pro Tyr Thr Ser Gly Trp Tyr Asp Tyr Gly Met Asp Val (SEQ ID NO: 50578)

Table 86. Consensus 52 - VH1|1-18/D3|3-3|RF2/JH6 (SEQ ID NO: 50303):

QVQLVQS-GAEVKKPGASVKVSCKASG-YTFNS------YGISWVRQAPGQGLEWMGWISAY---NGNTKYAQKLQGRVTMTTDTSTSTAYMELRSLRSDDTAVYYCARHDFWSGY----------YKGMDVWGQGTTVTVSS wherein:

I in position 41 can be substituted with F or V

T in position 68 can be substituted with R

Y in position 70 can be substituted with N, E or F

K in position 73 can be substituted with R

L in position 74 can be substituted with F

Ser Tyr Gly Xaa Ser (SEQ ID NO: 50102)

Trp Ile Ser Ala Tyr Asn Gly Asn Xaa Lys Xaa Ala Gln Xaa Xaa Gln Gly (SEQ ID NO: 50103)

His Asp Phe Trp Ser Gly Tyr Gly Tyr Lys Gly Met Asp Val (SEQ ID NO: 50227)

Ser Tyr Gly Ile Ser (SEQ ID NO: 50579)

Trp Ile Ser Ala Tyr Asn Gly Asn Thr Lys Tyr Ala Gln Lys Leu Gln Gly (SEQ ID NO: 50580)

His Asp Phe Trp Ser Gly Tyr Gly Tyr Lys Gly Met Asp Val (SEQ ID NO: 50581)

Table 87. Consensus 53 - VH3|3-23/D6|6-6|RF1/JH4 (SEQ ID NO: 50304):

EVQLLES-GGGLVQPGGSLRLSCAASG-FTFSS----YAMSWVRQAPGKGLEWVSAISGR---GG
NTFDADSVKGRFTISRDNSKNTLYLQMNSLRAEDTAVYYCAKERSGS--------------YFDYWGQGTLVTVSS wherein:

Y at position 39 can be substituted with S

A at position 57 can be substituted with V or S

R at position 61 can be substituted with S

G at position 66 can be substituted with I or V

N at position 67 can be substituted with S

D at position 70 can be substituted with Y

A at position 71 can be substituted with T

E at position 109 can be substituted with S

R at position 110 can be substituted with N

G at position 112 can be substituted with S

S at position 113 can be substituted with G

Y at position 135 can be substituted with W

Xaa Xaa Ala Met Ser (SEQ ID NO: 50104)

Xaa Ile Ser Gly Xaa Gly Xaa Xaa Thr Phe Xaa Xaa Asp Ser Val Lys Gly (SEQ ID NO: 50105)

Xaa Xaa Ser Xaa Xaa Xaa Phe Asp Tyr (SEQ ID NO: 50106)

Ser Tyr Ala Met Ser (SEQ ID NO: 50582)

Ala Ile Ser Gly Arg Gly Gly Asn Thr Phe Asp Ala Asp Ser Val Lys Gly (SEQ ID NO: 50583)

FIGURE 57 (Continued)

Glu Arg Ser Gly Ser Tyr Phe Asp Tyr (SEQ ID NO: 50584)

Table 88. Consensus 54 - VH3j3-33/D6[6-6]RF1/JH4 (SEQ ID NO: 50305):

QVQLVES-GGGVVQPGRSLRLSCAASG-FTFSN----YGMHWVRQAPGKGLEWVAVIWHD---
GSNKYYADSVKGRFTISRDNSKNTLYLQMNSLRAEDTAVYYCARENSSS----------YYFDYWGQGTLVTVSS wherein:

N in position 33 can be substituted with S, Y or H

G in position 40 can be substituted with V

V in position 57 can be substituted with L

H in position 60 can be substituted with Y

S in position 66 can be substituted with T

N in position 67 can be substituted with D

K in position 68 can be substituted with A

A in position 71 can be substituted with V or G

Y in position 134 can be substituted with F

Xaa Tyr Xaa Met His (SEQ ID NO: 50107)

Xaa Ile Trp Xaa Asp Gly Xaa Xaa Xaa Tyr Xaa Asp Ser Val Lys Gly (SEQ ID NO: 50108)

Glu Asn Ser Ser Xaa Tyr Phe Asp Tyr Trp Gly Gln Gly Thr Leu Val Thr Val Ser Ser (SEQ ID NO: 50109)

Asn Tyr Gly Met His (SEQ ID NO: 50585)

Val Ile Trp His Asp Gly Ser Asn Lys Tyr Tyr Ala Asp Ser Val Lys Gly (SEQ ID NO: 50586)

Glu Asn Ser Ser Tyr Tyr Phe Asp Tyr Trp Gly Gln Gly Thr Leu Val Thr Val Ser Ser (SEQ ID NO: 50587)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | | H_FR1 | | | | | | | | | |
| CONSENSUS | Q | V | Q | L | V | E | S | - | G | G | G | V | V | Q | P | G | R | S | L | R | L | S | C | A | A | S |
| 21-225_30G1_HC | . | . | . | . | . | . | . | . | . | . | . | . | . | . | . | . | . | . | . | . | . | . | . | . | . | . |
| 21-225_30G4_HC | . | . | . | . | . | . | . | . | . | . | . | . | . | . | . | . | . | . | . | . | . | . | . | . | . | . |
| 21-225_32D6_HC | . | . | . | . | . | . | . | . | . | . | . | . | . | . | . | . | . | . | . | . | . | . | . | . | . | . |
| 21-225_33B2_HC | . | . | . | . | . | . | . | . | . | . | . | . | . | . | . | . | . | . | . | . | . | . | . | . | . | . |
| 21-225_33C12_HC | . | . | . | . | . | . | . | . | . | . | . | . | . | . | . | . | . | . | . | . | . | . | . | . | . | . |
| 21-225_34C2_HC | . | . | . | . | . | . | . | . | . | . | . | . | . | . | . | . | . | . | . | . | . | . | . | . | . | . |
| 21-225_34D3_HC | . | . | . | . | . | . | . | . | . | . | . | . | . | . | . | . | . | . | . | . | . | . | . | . | . | . |
| 21-225_34D8_HC | . | . | . | . | . | . | . | . | . | . | . | . | . | . | . | . | . | . | . | . | . | . | . | . | . | . |
| 21-225_36B8_HC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | H_CDR1 | | | | | | | | | | | H_FR2 | | | | | | | | | |
| CONSENSUS | G | - | F | T | F | S | N | - | - | - | - | - | Y | G | M | H | W | V | R | Q | A | P | G | K | G | L |
| 21-225_30G1_HC | . | . | . | . | . | . | Y | . | . | . | . | . | . | . | . | . | . | . | . | . | . | . | . | . | . | . |
| 21-225_30G4_HC | . | . | . | . | . | . | S | . | . | . | . | . | . | . | . | . | . | . | . | . | . | . | . | . | . | . |
| 21-225_32D6_HC | . | . | . | . | . | . | S | . | . | . | . | . | . | . | . | . | . | . | . | . | . | . | . | . | . | . |
| 21-225_33B2_HC | . | . | . | . | . | . | . | . | . | . | . | . | . | . | . | . | . | . | . | . | . | . | . | . | . | . |
| 21-225_33C12_HC | . | . | . | . | . | . | X | . | . | . | . | . | . | V | . | . | . | . | . | . | . | . | . | X | . | . |
| 21-225_34C2_HC | . | . | . | . | . | . | Y | . | . | . | . | . | . | . | . | . | . | . | . | . | . | . | . | . | . | . |
| 21-225_34D3_HC | . | . | . | . | . | . | . | . | . | . | . | . | . | . | . | . | . | . | . | . | . | . | . | . | . | . |
| 21-225_34D8_HC | . | . | . | . | . | . | . | . | . | . | . | . | . | . | . | . | . | . | . | . | . | . | . | . | . | . |
| 21-225_36B8_HC | . | . | . | . | . | . | . | . | . | . | . | . | . | . | . | . | . | . | . | . | . | . | . | . | . | . |

FIGURE 57 (Continued)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | | H_CDR2 | | | | | | | | | | | |
| CONSENSUS | E | W | V | A | V | I | W | H | D | . | . | . | G | S | N | K | Y | Y | A | D | S | V | K | G | R | F |
| 21-225_30G1_HC | . | . | . | . | . | . | . | . | . | . | . | . | . | . | . | . | . | . | V | . | . | . | . | . | . | . |
| 21-225_30G4_HC | . | . | . | T | . | . | . | Y | . | . | . | . | . | . | D | . | . | . | V | . | . | . | . | . | . | . |
| 21-225_32D6_HC | . | . | . | . | . | . | . | . | . | . | . | . | . | . | . | . | . | . | . | . | . | . | . | . | . | . |
| 21-225_33B2_HC | . | . | . | . | . | . | . | Y | . | . | . | . | . | . | . | . | . | . | . | . | . | . | . | . | . | . |
| 21-225_33C12_HC | . | . | . | . | L | . | . | Y | . | . | . | . | . | . | . | A | . | . | . | . | . | . | . | . | . | . |
| 21-225_34C2_HC | . | . | . | . | . | . | . | . | . | . | . | . | . | . | . | . | . | . | . | . | . | . | . | . | . | . |
| 21-225_34D3_HC | . | . | . | . | . | . | . | Y | . | . | . | . | . | . | . | . | . | . | V | . | . | . | . | . | . | . |
| 21-225_34D8_HC | . | . | . | . | . | . | . | . | . | . | . | . | . | . | . | . | . | . | . | . | . | . | . | . | . | . |
| 21-225_36B8_HC | . | . | . | . | . | . | . | . | . | . | . | . | . | . | . | . | . | . | G | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | H_FR3 | | | | | | | | | | | | |
| CONSENSUS | T | I | S | R | D | N | S | K | N | T | L | Y | L | Q | M | N | S | L | R | A | E | D | T | A | V | Y |
| 21-225_30G1_HC | . | . | . | . | . | . | . | . | . | . | . | . | . | . | . | . | . | . | . | . | . | . | . | . | . | . |
| 21-225_30G4_HC | . | . | . | . | . | . | . | . | . | . | . | . | . | . | . | . | . | . | . | . | . | . | S | . | . | . |
| 21-225_32D6_HC | . | . | . | . | . | . | . | . | . | . | . | . | . | . | . | . | . | . | . | . | . | . | . | . | . | . |
| 21-225_33B2_HC | . | . | . | . | . | . | . | . | . | . | . | . | . | . | . | . | . | . | . | . | . | . | . | . | . | . |
| 21-225_33C12_HC | . | . | . | . | . | . | . | . | . | . | . | . | . | . | . | . | . | . | . | . | . | . | . | . | . | . |
| 21-225_34C2_HC | . | . | . | . | . | . | . | . | . | . | . | . | . | . | . | . | . | . | . | . | . | . | . | . | . | . |
| 21-225_34D3_HC | . | . | . | . | . | . | . | . | . | . | . | . | . | . | . | . | . | . | . | . | . | . | . | . | . | . |
| 21-225_34D8_HC | . | . | . | . | . | . | . | . | . | . | . | . | . | . | . | . | . | . | . | . | . | . | . | . | . | . |
| 21-225_36B8_HC | . | . | . | . | . | . | . | . | . | . | . | . | . | . | . | . | . | . | . | . | . | . | . | . | . | . |

FIGURE 57 (Continued)

Table 89. Consensus 55 - VH2j2-05/DJj1-1jRF1/JH3 (SEQ ID NO: 50306):

QITLKES-GPTLVKPTQTLTLTCTFSG-FSLSTS---GVGVGWIRQPPGKALEWLALINW----
NDDKRYSPSLKSRFTITRDTSKDQVVLTMTNMDPVDTATYYCAHKATWV------------AFDIWGQGTMVTVSS wherein:

Y in position 70 can be substituted with F

A in position 110 can be substituted with T

Thr Ser Gly Val Gly Val Gly (SEQ ID NO: 50110)

Leu Ile Asn Trp Asn Asp Asp Lys Arg Xaa Ser Pro Ser Leu Lys Ser (SEQ ID NO: 50111)

Lys Xaa Thr Trp Val Ala Phe Asp Ile (SEQ ID NO: 50112)

Thr Ser Gly Val Gly Val Gly (SEQ ID NO: 50588)

Leu Ile Asn Trp Asn Asp Asp Lys Arg Tyr Ser Pro Ser Leu Lys Ser (SEQ ID NO: 50589)

Lys Ala Thr Trp Val Ala Phe Asp Ile (SEQ ID NO: 50590)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS | Q | I | T | L | K | E | S | - | G | P | T | L | V | K | P | T | Q | T | L | T | L | T | C | T | F | S |
| 21-225_62A12_HC | . | . | . | . | . | . | . | . | . | . | . | . | . | . | . | . | . | . | . | . | . | . | . | . | . | . |
| 21-225_62B12_HC | . | . | . | . | . | . | . | . | . | . | . | . | . | . | . | . | . | . | . | . | . | . | . | . | . | . |
| 21-225_62D10_HC | . | . | . | . | . | . | . | . | . | . | . | . | . | . | S | . | . | . | . | . | . | . | . | . | . | . |
| 21-225_62E3_HC | . | . | . | . | . | . | . | . | . | . | . | . | . | . | . | . | . | . | . | . | . | . | . | . | . | . |
| 21-225_62E8_HC | . | . | . | . | . | . | . | . | . | . | . | . | . | . | . | . | . | . | . | . | . | . | . | . | . | . |
| 21-225_66G9_HC | . | . | . | . | . | . | . | . | . | . | . | . | . | . | . | . | . | . | . | . | . | . | . | . | . | . |
| 21-225_72D5_HC | . | . | . | . | . | . | . | . | . | . | . | . | . | . | . | . | . | . | . | . | . | . | . | . | . | . |
| 21-225_73C4_HC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | | | | H_CDR1 | | | | | | | | | | | | | H_FR2 | | | |
| CONSENSUS | G | - | F | S | L | S | T | S | - | - | G | V | G | V | G | W | I | R | Q | P | P | G | K | G | A | L |
| 21-225_62A12_HC | . | . | . | . | . | . | . | . | . | . | . | . | . | . | . | . | . | . | . | . | . | . | . | . | . | . |
| 21-225_62B12_HC | . | . | . | . | . | N | . | . | . | . | . | . | . | . | . | . | . | . | . | . | . | . | . | . | . | . |
| 21-225_62D10_HC | . | . | . | . | . | . | . | . | . | . | . | . | . | . | . | . | . | . | . | . | . | . | . | . | . | . |
| 21-225_62E3_HC | . | . | . | . | . | . | . | . | . | . | . | . | . | . | . | . | . | . | . | . | . | . | . | . | . | . |
| 21-225_62E8_HC | . | . | . | . | . | . | . | . | . | . | . | . | . | . | . | . | . | . | . | . | . | . | . | . | . | . |
| 21-225_66G9_HC | . | . | . | . | . | . | . | . | . | . | . | . | . | . | . | . | . | . | . | . | . | . | . | . | . | . |
| 21-225_72D5_HC | . | . | . | . | . | . | . | . | . | . | . | . | . | . | . | . | . | . | . | . | . | . | . | . | . | . |
| 21-225_73C4_HC | . | . | . | . | . | . | . | . | . | . | . | . | . | . | . | . | . | . | . | . | . | . | . | . | . | . |

Table 90.  Consensus 56 - VH3|3-23/D4|4-11|RF3/JH4 (SEQ ID NO: 50307):

EVQLLES-GGGLVQPGGSLRLSCAASG-FTFSS---YVMNWVRQAPGKGLEWVSAISGS---GGRTYYADSVKGRFTISRDNSKNTLYLQMNSLRAEDTAVYYCARTAT-------------FDYWGQGTLVTVSS wherein:

V at position 40 can be substituted with A

M at position 41 can be substituted with I or L

N at position 42 can be substituted with S or R

A at position 57 can be substituted with D

I at position 58 can be substituted with M

G at position 66 can be substituted with D or V

R at position 67 can be substituted with S, F or T

A at position 71 can be substituted with V

A at position 110 can be substituted with G, S, T or Y

T at position 111 can be substituted with V, null (-), H, L or G

F at position 136 can be substituted with null (-) or K

D at position 137 can be substituted with null (-)

Y at position 138 can be substituted with L

Ser Tyr Xaa Xaa Xaa (SEQ ID NO: 50113)

Xaa Xaa Ser Gly Ser Gly Xaa Xaa Thr Tyr Tyr Xaa Asp Ser Val Lys Gly (SEQ ID NO: 50114)

Thr Xaa Xaa Xaa Xaa Xaa (SEQ ID NO: 50115)

Ser Tyr Val Met Asn (SEQ ID NO: 50591)

FIGURE 57 (Continued)

Ala Ile Ser Gly Ser Gly Gly Arg Thr Tyr Tyr Ala Asp Ser Val Lys Gly (SEQ ID NO: 50592)

Thr Ala Thr Phe Asp Tyr (SEQ ID NO: 50593)

Table 91. Consensus 57 - VH3j3-23/D7j7-27jRF1/JH3 (SEQ ID NO: 50308):

EVQLLES-GGGL VQPGGSLRLSCAASG-FTFSS----YAMSWVRQAPGKGLEWVSVISGR----
GGTTFYADSVKGRFTISRDNSKNTLYLQMNSLRAEDTAVYYCAKRTPSD----------VFDIWGQGTMVTVSS wherein:

Y at position 39 can be substituted with F

S at position 42 can be substituted with N

V at position 57 can be substituted with A or I

I at position 58 can be substituted with L

R at position 61 can be substituted with S or G

G at position 66 can be substituted with S or K

T at position 67 can be substituted with N or S

F at position 69 can be substituted with Y

P at position 111 can be substituted with G

S at position 112 can be substituted with D or E

V at position 135 can be substituted with A

I at position 138 can be substituted with V

Ser Xaa Ala Met Xaa (SEQ ID NO: 50116)

Xaa Xaa Ser Gly Xaa Gly Xaa Xaa Thr Xaa Tyr Ala Asp Ser Val Lys Gly (SEQ ID NO: 50117)

Lys Arg Thr Xaa Xaa Asp Xaa Asp Xaa Phe Asp Xaa (SEQ ID NO: 50118)

Ser Tyr Ala Met Ser (SEQ ID NO: 50594)

Val Ile Ser Gly Arg Gly Gly Thr Thr Phe Tyr Ala Asp Ser Val Lys Gly (SEQ ID NO: 50595)

FIGURE 57 (Continued)

Lys Arg Thr Pro Ser Asp Val Phe Asp Ile (SEQ ID NO: 50596)

FIGURE 57 (Continued)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | | H_CDR2 | | | | | | | | | | | |
| CONSENSUS | E | W | V | S | V | I | S | G | R | . | . | . | G | G | T | T | F | Y | A | D | S | V | K | G | R | F |
| 21-225_149B6_HC | | | | | | | | | | | | | | | | | | | | | | | | | | |
| 21-225_180A3_HC | | | | | | | | | S | | | | | | | | | | | | | | | | | |
| 21-225_182H5_HC | | | | | | | | | | | | | | | N | | | | | | | | | | | |
| 21-225_186A11_HC | | | | | A | | | | S | | | | | S | N | | Y | | | | | | | | | |
| 21-225_43H9_HC | | | | | L | L | | | Q | | | | | X | | | Y | | | | | | | | | |
| 21-225_44F3_HC | | | | | | | | | | | | | | | | | | | | | | | | | | |
| 21-225_45C9_HC | | | | | A | | | | S | | | | | S | N | | | | | | | | | | | |
| 21-225_45H4_HC | | | | | | | | | | | | | | | | | | | | | | | | | | |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | | H_FR3 | | | | | | | | | | | |
| CONSENSUS | T | I | S | R | D | N | S | K | N | T | L | Y | L | Q | M | N | S | L | R | A | E | D | T | A | V | Y |
| 21-225_149B6_HC | | | | | | | | | | | | | | | | | | | | | | | | | | |
| 21-225_180A3_HC | | | | | | | | | | | | R | | | | | | | | | | | | | | |
| 21-225_182H5_HC | | | | | | | | | | | | R | | | | | | | | | | | | | | |
| 21-225_186A11_HC | | | | | | | | | | | | | | X | | | | | | | | | | | | |
| 21-225_43H9_HC | | | | | | | | | | | | | | | | | | | | | | | | | | |
| 21-225_44F3_HC | | | | | | | | | | | | R | | | | | | | | | | | | | | |
| 21-225_45C9_HC | | | | | | | | | | | | | | X | | | | | | | | | | | | |
| 21-225_45H4_HC | | | | | | | | | | | | | | | | | | | | | | | | | | |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | | H_CDR3 | | | | | | | |
| CONSENSUS | Y | C | A | K | R | T | P | S | D | | | | | | | | | | | | | | | | | |
| 21-225_149B6_HC | R | . | . | . | . | . | . | . | . | . | . | . | . | . | . | . | . | . | . | . | . | . | . | . | . | . |
| 21-225_180A3_HC | R | . | . | . | . | . | G | D | . | . | . | . | . | . | . | . | . | . | . | . | . | . | . | . | . | . |
| 21-225_182H5_HC | . | . | . | . | . | . | G | D | . | . | . | . | . | . | . | . | . | . | . | . | . | . | . | . | . | . |
| 21-225_186A11_HC | . | . | . | . | . | . | G | D | . | . | . | . | . | . | . | . | . | . | . | . | . | . | . | . | . | . |
| 21-225_43H9_HC | . | . | . | . | . | . | . | . | . | . | . | . | . | . | . | . | . | . | . | . | . | . | . | . | . | . |
| 21-225_44F3_HC | . | . | . | . | . | . | . | . | . | . | . | . | . | . | . | . | . | . | . | . | . | . | . | . | . | . |
| 21-225_45C9_HC | . | . | . | . | . | . | . | . | . | . | . | . | . | . | . | . | . | . | . | . | . | . | . | . | . | . |
| 21-225_45H4_HC | R | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | . | . | . | . | V | F | D | I | W | G | Q | Q | G | T | M | V | T | V | S | S |
| 21-225_149B6_HC | . | . | . | . | . | . | . | . | . | . | . | . | . | . | . | . | . | . | . |
| 21-225_180A3_HC | . | . | . | . | . | . | . | . | . | . | . | . | . | . | . | . | . | . | . |
| 21-225_182H5_HC | . | . | . | . | . | . | . | V | . | . | . | . | . | . | . | . | . | . | . |
| 21-225_186A11_HC | . | . | . | . | . | . | . | . | . | . | . | . | . | . | . | . | . | . | . |
| 21-225_43H9_HC | . | . | . | . | . | . | . | . | . | . | . | . | . | . | . | . | . | . | . |
| 21-225_44F3_HC | . | . | . | . | A | . | . | . | . | . | . | . | . | . | . | . | . | . | . |
| 21-225_45C9_HC | . | . | . | . | A | . | . | . | . | . | . | . | . | . | . | . | . | . | . |
| 21-225_45H4_HC | . | . | . | . | . | . | . | . | . | . | . | . | . | . | . | . | . | . | . |

FIGURE 57 (Continued)

Table 92. Consensus 58 - VH3|3-33/D4|4-11|RF2/JH4 (SEQ ID NO: 50309):

QVQLVES-GGGVVQPGRSLRLSCAASG-FTFSS-----YGMHWVRQAPGKGLEWVAVIWYD---
GSNKYYADSVKGRFTISRDNSKNTLYLQMNSLRAEDTAVYYCARDRPRS----------SAF DYWGQGTLVTVSS wherein:

S at position 33 can be substituted with N or T

Y at position 39 can be substituted with F

G at position 40 can be substituted with D or N

V at position 57 can be substituted with A

Y at position 60 can be substituted with H

S at position 66 can be substituted with R

N at position 67 can be substituted with D or H

K at position 68 can be substituted with R

Y at position 70 can be substituted with C or S

A at position 71 can be substituted with E or T

R at position 110 can be substituted with D or H

P at position 111 can be substituted with S or A

I at position 112 can be substituted with R or Y

S at position 113 can be substituted with L, V or W

Null (-) at position 114 can be substituted with G

FIGURE 57 (Continued)

Null (-) at position 133 can be substituted with A

S at position 134 can be substituted with T or A

A at position 135 can be substituted with F, S or Y

F at position 136 can be substituted with G or S

Y at position 138 can be substituted with F

Xaa Xaa Xaa Met His (SEQ ID NO: 50237)

Xaa Ile Trp Xaa Asp Gly Xaa Xaa Xaa Tyr Xaa Xaa Asp Ser Val Lys Gly (SEQ ID NO: 50238)

Asp Xaa Xaa Xaa Xaa Xaa Xaa Xaa Xaa Xaa Asp Xaa (SEQ ID NO: 50239)

Ser Tyr Gly Met His (SEQ ID NO: 50597)

Val Ile Trp Tyr Asp Gly Ser Asn Lys Tyr Tyr Ala Asp Ser Val Lys Gly (SEQ ID NO: 50598)

Asp Arg Pro Arg Ser Ser Ala Phe Asp Tyr (SEQ ID NO: 50599)

Table 93.  Consensus 59 – VH3|3-48/D4|4-11|RF2/JH6 (SEQ ID NO: 50310):

EVQLVES-GGGLVQPGGSLRLSCAASG-FTFSS---YNMNWVRQAPGKGLEWVSYISRS---SNTKYYADSVKGRFTISRDNAKNSLYLQMNSLRDEDTAVYYCARDRSGSYGY----------FYYYGLDVWGQGTTVTVSS wherein:

S at position 33 can be substituted with N

N at position 40 can be substituted with S

R at position 60 can be substituted with S

S at position 65 can be substituted with G

N at position 66 can be substituted with S

K at position 68 can be substituted with T

Y at position 69 can be substituted with H

A at position 71 can be substituted with V

K at position 75 can be substituted with R, E or Q

R at position 110 can be substituted with S

S at position 111 can be substituted with R

G at position 112 can be substituted with K

S at position 113 can be substituted with G

Y at position 114 can be substituted with F

G at position 115 can be substituted with null (-)

Y at position 116 can be substituted with null (-)

FIGURE 57 (Continued)

F at position 131 can be substituted with null (-)

Y at position 132 can be substituted with null (-)

L at position 136 can be substituted with M

Xaa Tyr Xaa Met Asn (SEQ ID NO: 50240)

Tyr Ile Ser Xaa Ser Xaa Xaa Thr Xaa Xaa Tyr Xaa Asp Ser Val Xaa Gly (SEQ ID NO: 50241)

Asp Xaa Xaa Xaa Xaa Xaa Xaa Xaa Xaa Xaa Tyr Tyr Gly Xaa Asp Val (SEQ ID NO: 50242)

Ser Tyr Asn Met Asn (SEQ ID NO: 50600)

Tyr Ile Ser Arg Ser Ser Asn Thr Lys Tyr Tyr Ala Asp Ser Val Lys Gly (SEQ ID NO: 50601)

Asp Arg Ser Gly Ser Tyr Gly Tyr Phe Tyr Tyr Tyr Gly Leu Asp Val (SEQ ID NO: 50602)

Table 94. Consensus 60 – VH4j4-30.1/D4j4-11jRF2/JH6 (SEQ ID NO: 50311):

QVQLQES-GPGLVKPSQTLSLTCTVSG-GSIRSG---GDYWSWIRQHPGKGLEWIGYIYY----SGSTYYNPSLKSRVTISVDTSKNQFSLKLSSVTAADTAVYYCARDSSSY----------GMDVWGQGTTVTVSS wherein:

S at position 67 can be substituted with I or P

S at position 110 can be substituted with G or H

S at position 111 can be substituted with A

S at position 112 can be substituted with L or R

Y at position 113 can be substituted with R or H

Ser Gly Asp Tyr Trp Ser (SEQ ID NO: 50119)

Tyr Ile Tyr Tyr Ser Gly Xaa Thr Tyr Tyr Tyr Asn Pro Ser Leu Lys Ser (SEQ ID NO: 50120)

Asp Xaa Xaa Xaa Xaa Gly Met Asp Val (SEQ ID NO: 50121)

Ser Gly Asp Tyr Trp Ser (SEQ ID NO: 50603)

Tyr Ile Tyr Tyr Ser Gly Ser Thr Tyr Tyr Tyr Asn Pro Ser Leu Lys Ser (SEQ ID NO: 50604)

Asp Ser Ser Tyr Gly Met Asp Val (SEQ ID NO: 50605)

Table 95. Consensus 15 - VK1|A30/JK4 (SEQ ID NO: 50312):

DIQMTQSPSSLSASVGDRVTITCRAS--QGIR--------NDLGWYQQKPGKAPKRLIYA---------ASSLQSGVPSRFSGSGSG--TEFTLTISSLQPEDFATYYCLQHNS-----------------YPLTFGGGTKVEIKR wherein:

R at position 24 can be substituted with L

A at position 25 can be substituted with T

Q at position 29 can be substituted with R

G at position 30 can be substituted with D, A or V

I at position 31 can be substituted with M or V

R at position 32 can be substituted with E, K, N or S

N at position 39 can be substituted with S, D, T, K or I

D at position 40 can be substituted with N or A

L at position 41 can be substituted with F or V

G at position 42 can be substituted with D or N

A at position 58 can be substituted with T, S, V, G, D or R

A at position 67 can be substituted with T, V or E

S at position 68 can be substituted with F, C or Y

S at position 69 can be substituted with N, T, F, R or I

L at position 70 can be substituted with V, F or S

Q at position 71 can be substituted with H or E

S at position 72 can be substituted with R, N, T or G

FIGURE 57 (Continued)

L at position 107 can be substituted with V or I

Q at position 108 can be substituted with H

H at position 109 can be substituted with D, Y, N or R

N at position 110 can be substituted with S, Y, T, D, K, A, I, E, H, P or R

S at position 111 can be substituted with I, N, R, T, D, A, L or V

Y at position 135 can be substituted with F, H or S

P at position 136 can be substituted with A or M

L at position 137 can be substituted with P, F, N or V

T at position 138 can be substituted with K or I

Xaa Xaa Ser Xaa Xaa Xaa Xaa Xaa Xaa Xaa Xaa (SEQ ID NO: 50122)

Xaa Xaa Xaa Xaa Xaa Xaa Xaa Xaa (SEQ ID NO: 50123)

Xaa Xaa Xaa Xaa Xaa Xaa Xaa Xaa Xaa Xaa (SEQ ID NO: 50124)

Arg Ala Ser Gln Gly Ile Arg Asn Asp Leu Gly (SEQ ID NO: 50606)

Ala Ala Ser Ser Leu Gln Ser (SEQ ID NO: 50607)

Leu Gln His Asn Ser Tyr Pro Leu Thr (SEQ ID NO: 50608)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | L_FR1 | | | | | | | | | | | | | | |
| CONSENSUS | D | I | Q | M | T | Q | S | P | S | S | L | S | A | S | V | G | D | R | V | T | I | T | C | R | A | S |
| 21-225_8C9_LC | . | . | . | . | . | . | . | . | . | . | . | . | . | . | . | . | . | . | . | . | . | . | . | . | . | . |
| 21-225_8D12_LC | . | . | . | . | . | . | . | . | . | . | . | . | . | . | . | . | . | . | . | . | . | . | . | . | . | . |
| 21-225_8F11_LC | . | . | . | . | . | . | . | . | . | . | . | . | . | . | . | . | . | . | . | . | . | . | . | . | . | . |
| 21-225_8H7_LC | . | . | . | . | . | . | . | . | . | . | . | . | . | . | . | . | . | . | . | . | . | . | . | . | . | . |
| 21-225_96A3_LC | . | . | . | . | . | . | . | . | . | . | . | . | . | . | . | . | . | . | . | . | . | . | . | . | . | . |
| 21-225_9E8_LC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | K_CDR1 | | | | | | | | | | | | | | | K_FR2 | | | | | |
| CONSENSUS | - | - | Q | G | I | R | - | - | - | - | - | - | N | D | L | G | W | Y | Q | Q | K | P | G | K | A | P |
| 21-225_8C9_LC | . | . | . | . | . | . | . | . | . | . | . | . | . | . | . | . | . | . | . | . | . | . | . | . | . | . |
| 21-225_8D12_LC | . | . | . | A | . | . | . | . | . | . | . | . | . | . | . | . | . | . | . | . | . | . | . | . | . | . |
| 21-225_8F11_LC | . | . | . | . | . | . | . | . | . | . | . | . | S | . | . | . | . | F | . | . | . | . | . | . | . | . |
| 21-225_8H7_LC | . | . | . | . | . | . | . | . | . | . | . | . | . | . | . | D | . | . | . | . | . | . | . | . | . | . |
| 21-225_96A3_LC | . | . | . | . | . | . | . | . | . | . | . | . | . | . | . | . | . | . | . | . | . | . | . | . | . | . |
| 21-225_9E8_LC | . | . | . | . | . | . | . | . | . | . | . | . | . | . | . | . | . | . | . | . | . | . | . | . | . | . |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | K_CDR2 | | | | | | | | | | | | | |
| CONSENSUS | K | R | L | I | Y | A | . | . | . | . | . | . | . | . | A | S | S | L | Q | S | G | V | P | S | R | F |
| 21-225_8C9_LC | . | . | . | . | . | . | . | . | . | . | . | . | . | . | . | . | . | . | . | . | . | . | . | . | . | . |
| 21-225_8D12_LC | . | . | . | . | . | . | . | . | . | . | . | . | . | . | . | . | . | . | . | . | . | . | . | . | . | . |
| 21-225_8F11_LC | . | . | . | . | R | G | . | . | . | . | . | . | . | . | . | . | . | . | . | . | . | . | . | . | . | . |
| 21-225_8H7_LC | . | . | . | . | . | . | . | . | . | . | . | . | . | . | . | . | T | . | . | . | . | . | . | . | . | . |
| 21-225_96A3_LC | . | . | . | . | . | . | . | . | . | . | . | . | . | . | . | . | . | V | . | . | . | . | . | . | . | . |
| 21-225_9E8_LC | . | . | . | . | . | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| CONSENSUS | S | G | S | G | S | G | - | - | T | E | F | T | L | T | I | S | S | L | Q | P | E | D | F | A | T | Y |
| 21-225_8C9_LC | . | . | . | . | . | . | . | . | . | . | . | . | . | . | . | . | . | . | . | . | . | . | . | . | . | . |
| 21-225_8D12_LC | N | . | . | . | . | . | . | . | . | . | . | . | . | . | . | . | . | . | . | . | . | . | . | . | . | . |
| 21-225_8F11_LC | . | . | . | . | . | . | . | . | . | . | . | . | . | . | . | . | . | . | . | . | . | . | . | . | T | . |
| 21-225_8H7_LC | . | . | . | . | . | . | . | . | . | . | . | . | . | . | . | . | . | . | . | . | . | . | . | . | . | . |
| 21-225_9GA3_LC | . | . | . | . | . | . | . | . | . | . | . | . | . | . | . | . | G | . | . | . | . | . | . | . | . | . |
| 21-225_9E8_LC | . | . | . | . | . | . | . | . | . | . | . | . | . | . | . | . | . | . | . | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | |
| CONSENSUS | Y | C | L | Q | H | N | S | | | | | | | | | | | | | | | | | | | |
| 21-225_15H1_LC | | | | | | S | | | | | | | | | | | | | | | | | | | | |
| 21-225_15H10_LC | | | | | | | | | | | | | | | | | | | | | | | | | | |
| 21-225_15H8_LC | | | | | | S | N | | | | | | | | | | | | | | | | | | | |
| 21-225_160B10_LC | | | | | | S | | | | | | | | | | | | | | | | | | | | |
| 21-225_160H3_LC | | | | | | Y | | | | | | | | | | | | | | | | | | | | |
| 21-225_169B1_LC | | | | | | Y | | | | | | | | | | | | | | | | | | | | |
| 21-225_169F9_LC | | | | | | S | N | | | | | | | | | | | | | | | | | | | |
| 21-225_16A1_LC | | | | | | | | | | | | | | | | | | | | | | | | | | |
| 21-225_16B7_LC | | | | | | | | | | | | | | | | | | | | | | | | | | |
| 21-225_16E12_LC | | | | | | Y | | | | | | | | | | | | | | | | | | | | |
| 21-225_16F11_LC | | | | | | Y | | | | | | | | | | | | | | | | | | | | |
| 21-225_16F4_LC | | | | | | Y | | | | | | | | | | | | | | | | | | | | |
| 21-225_170D11_LC | | | | | | Y | | | | | | | | | | | | | | | | | | | | |
| 21-225_170D5_LC | | | | | | Y | | | | | | | | | | | | | | | | | | | | |
| 21-225_170G4_LC | | | | | | Y | | | | | | | | | | | | | | | | | | | | |
| 21-225_170G5_LC | | | | | | Y | | | | | | | | | | | | | | | | | | | | |
| 21-225_171A4_LC | | | | | | Y | | | | | | | | | | | | | | | | | | | | |
| 21-225_171C3_LC | | | | | | Y | | | | | | | | | | | | | | | | | | | | |
| 21-225_172B3_LC | | | | | | Y | | | | | | | | | | | | | | | | | | | | |
| 21-225_172G8_LC | | | | | | Y | | | | | | | | | | | | | | | | | | | | |
| 21-225_173H12_LC | | | | | | Y | | | | | | | | | | | | | | | | | | | | |
| 21-225_175G1_LC | | | | | | | | | | | | | | | | | | | | | | | | | | |
| 21-225_176B11_LC | | | | | | | | | | | | | | | | | | | | | | | | | | |
| 21-225_178B10_LC | | | | | | | | | | | | | | | | | | | | | | | | | | |
| 21-225_17A10_LC | | | | | | | | | | | | | | | | | | | | | | | | | | |
| 21-225_17B5_LC | | | | | | Y | | | | | | | | | | | | | | | | | | | | |
| 21-225_17F9_LC | | | | | | | T | | | | | | | | | | | | | | | | | | | |
| 21-225_17H12_LC | | | | | | Y | | | | | | | | | | | | | | | | | | | | |
| 21-225_17H8_LC | | | | | | | | | | | | | | | | | | | | | | | | | | |

FIGURE 57 (Continued)

| Reference # | 105 | 106 | 107 | 108 | 109 | 110 | 111 | 112-130 (K_CDR3) |
|---|---|---|---|---|---|---|---|---|
| CONSENSUS | Y | C | L | Q | H | N | S | |
| 21-225_29B8_LC | | | | | | | | |
| 21-225_29G4_LC | N | | | | | | | |
| 21-225_29G8_LC | | | | | | | | |
| 21-225_29H6_LC | | | | | | | | |
| 21-225_2A11_LC | | | | | | | | |
| 21-225_2B2_LC | X | | | | | | | |
| 21-225_2G9_LC | | | | | | | | |
| 21-225_30D1_LC | | | | | | W | | |
| 21-225_30E3_LC | | | | | | T | | |
| 21-225_30E9_LC | | | | | | T | | |
| 21-225_30F3_LC | X | | | | | | | |
| 21-225_30G11_LC | | | | | | T | | |
| 21-225_31A8_LC | | | | | | T | | |
| 21-225_31B8_LC | | | | | | T | | |
| 21-225_31H3_LC | | | | | | T | | |
| 21-225_31H5_LC | | | | | | Y | | |
| 21-225_32G1_LC | | | | | | T | | |
| 21-225_32G12_LC | | | | | | T | | |
| 21-225_33A4_LC | | | | | | T | | |
| 21-225_33A7_LC | | | | | | Y | | |
| 21-225_33B1_LC | | | | | | T | | |
| 21-225_33B8_LC | X | | | | | T | | |
| 21-225_33F1_LC | | | | | | | | |
| 21-225_33G7_LC | | | | | | T | | |
| 21-225_34A6_LC | | | | | | T | | |
| 21-225_34D11_LC | | | | | | | | |
| 21-225_34G8_LC | | | | | | | | |
| 21-225_34G9_LC | | | | | | | | |
| 21-225_34H11_LC | | | | | | | | |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | Y | C | L | Q | H | N | S | | | | | | | | | | | K_CDR3 | | | | | | | | |
| CONSENSUS | | | | | | | | | | | | | | | | | | | | | | | | | | |
| 21-225_8C9_LC | | | | | | | | | | | | | | | | | | | | | | | | | | |
| 21-225_8D12_LC | | | | | | S | | | | | | | | | | | | | | | | | | | | |
| 21-225_8F11_LC | | | | | | Y | T | | | | | | | | | | | | | | | | | | | |
| 21-225_8H7_LC | | | | | | | | | | | | | | | | | | | | | | | | | | |
| 21-225_96A3_LC | | | | | | S | N | | | | | | | | | | | | | | | | | | | |
| 21-225_9E8_LC | | | | | | | | | | | | | | | | | | | | | | | | | | |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K_FR4 | | | | | |
| CONSENSUS | - | - | - | - | Y | P | L | T | F | G | G | G | T | K | V | E | I | K | R |
| 21-225_8C9_LC | . | . | . | . | . | . | . | . | . | . | . | . | . | . | . | . | . | . | . |
| 21-225_8D12_LC | . | . | . | . | . | . | . | . | . | . | . | . | . | . | . | . | . | . | . |
| 21-225_8F11_LC | . | . | . | . | . | . | . | . | . | . | . | . | . | . | . | . | . | . | . |
| 21-225_8H7_LC | . | . | . | . | . | . | M | . | . | . | . | . | . | . | . | . | . | . | . |
| 21-225_96A3_LC | . | . | . | . | . | . | . | . | . | . | . | . | . | . | . | . | . | . | . |
| 21-225_9E8_LC | . | . | . | . | . | . | . | . | . | . | . | . | . | . | . | . | . | . | . |

FIGURE 57 (Continued)

Table 96. Consensus 16 - VL3j3r/JL2 (SEQ ID NO: 50313):

SYELTQP-PSVSVSPGQTASITCSGD---KLGD----KYACWYQQKPGQSPVLVIYQ--------DRKRPSGIPERFSGSNSG--
NTATLTISGTQAMDEADYYCQAWDS--------------STVYFGGGTKLTVLG wherein:

D at position 26 can be substituted with N, E, Y or S
K at position 30 can be substituted with R, N, E or T
L at position 31 can be substituted with M or S
D at position 33 can be substituted with N, E, G, Y, T, H or V
K at position 39 can be substituted with R
Y at position 40 can be substituted with F or S
A at position 41 can be substituted with V, T, D or S
C at position 42 can be substituted with S, Y, W or H
Q at position 58 can be substituted with E or K
D at position 67 can be substituted with N
R at position 68 can be substituted with S, N, K, Y, M, T, G or I
K at position 69 can be substituted with R or Q
P at position 71 can be substituted with S
S at position 72 can be substituted with L
Q at position 107 can be substituted with L or K
A at position 108 can be substituted with T FIGURE 57 (Continued)

W at position 109 can be substituted with R

D at position 110 can be substituted with H, V, N or G

S at position 111 can be substituted with N, null (-), I, R, K or T null (-) at position 134 can be substituted with S, N or R S at position 135 can be substituted with T, N, R, G, F, I V or Y T at position 136 can be substituted with S, Y, A, F, P, N, K, I or R V at position 137 can be substituted with A, T, M L or G V at position 138 can be substituted with I, L, A or M Ser Gly Xaa Xaa Gly Xaa Xaa Xaa Xaa Xaa (SEQ ID NO: 50125)

Xaa Xaa Xaa Arg Xaa Xaa (SEQ ID NO: 50126)

Xaa Xaa Xaa Xaa Xaa Xaa Xaa Xaa Xaa Xaa Xaa (SEQ ID NO: 50228)

Ser Gly Asp Lys Leu Gly Asp Lys Tyr Ala Cys (SEQ ID NO: 50609)

Gln Asp Arg Lys Arg Pro Ser (SEQ ID NO: 50610)

Gln Ala Trp Asp Ser Ser Thr Val Val (SEQ ID NO: 50611)

| Reference # | 136 | 137 | 138 | 139 | 140 | 141 | 142 | 143 | 144 L_FR4 | 145 | 146 | 147 | 148 | 149 |
|---|---|---|---|---|---|---|---|---|---|---|---|---|---|---|
| CONSENSUS | T | V | V | F | G | G | G | T | K | L | T | V | L | G |
| 21-225_10B10_LC | . | . | . | . | . | . | . | . | . | . | . | . | . | . |
| 21-225_12B1_LC | . | . | . | . | . | . | . | . | . | . | . | . | . | . |
| 21-225_13F6_LC | A | . | . | . | . | . | . | . | . | . | . | . | . | . |
| 21-225_146A10_LC | . | . | - | . | . | . | . | . | . | V | . | . | . | . |
| 21-225_146A2_LC | . | . | . | . | . | . | . | . | . | . | . | . | . | . |
| 21-225_146A3_LC | . | . | . | . | . | . | . | . | . | . | . | . | . | . |
| 21-225_146B11_LC | . | . | . | . | . | . | . | . | . | . | . | . | . | . |
| 21-225_146B8_LC | . | . | . | . | . | . | . | . | . | . | . | . | . | . |
| 21-225_146C11_LC | . | . | . | . | . | . | . | . | . | . | . | . | . | . |
| 21-225_146H8_LC | . | . | . | . | . | . | . | . | . | . | . | . | . | . |
| 21-225_147B12_LC | . | . | . | . | . | . | . | . | . | . | . | . | . | . |
| 21-225_147B8_LC | A | . | . | . | . | . | . | . | . | . | . | . | . | . |
| 21-225_147B9_LC | R | . | . | . | . | . | . | . | . | . | . | . | . | . |
| 21-225_147D9_LC | Y | . | . | . | . | . | . | . | . | . | . | . | . | . |
| 21-225_147E11_LC | . | . | . | . | . | . | . | . | . | . | . | . | . | . |
| 21-225_147E7_LC | . | . | . | . | . | . | . | . | . | . | . | . | . | . |
| 21-225_147F9_LC | . | . | . | . | . | . | . | . | . | . | . | . | . | . |
| 21-225_147G9_LC | . | . | . | . | . | . | . | . | . | . | . | . | . | . |
| 21-225_148A9_LC | . | . | . | . | . | . | . | . | . | . | . | . | . | . |
| 21-225_148C8_LC | R | . | . | . | . | . | . | . | . | . | . | . | . | . |
| 21-225_148E10_LC | Y | . | . | . | . | . | . | . | . | . | . | . | . | . |
| 21-225_148G11_LC | . | . | . | . | . | . | . | . | . | . | . | . | . | . |
| 21-225_148G6_LC | R | . | . | . | . | . | . | . | . | . | . | . | . | . |
| 21-225_149A11_LC | . | . | . | . | . | . | . | . | . | . | . | . | . | . |
| 21-225_149B5_LC | . | . | . | . | . | . | . | . | . | . | . | . | . | . |
| 21-225_149C10_LC | . | . | . | . | . | . | . | . | . | . | . | . | . | . |
| 21-225_149C7_LC | . | . | . | . | . | . | . | . | . | . | . | . | . | . |
| 21-225_14B1_LC2 | . | . | . | . | . | . | . | . | . | . | . | . | & | . |
| 21-225_14B7_LC | . | . | . | . | . | . | . | . | . | . | . | . | . | S |

| Reference # | 136 | 137 | 138 | 139 | 140 | 141 | 142 | 143 | 144 | 145 | 146 | 147 | 148 | 149 |
|---|---|---|---|---|---|---|---|---|---|---|---|---|---|---|
| | | | | | | | | | LFR4 | | | | | |
| CONSENSUS | T | V | V | F | G | G | G | T | K | L | T | V | L | G |
| 21-225_62B12_LC | . | A | . | . | . | . | . | . | . | . | . | . | . | * |
| 21-225_62D10_LC | . | A | . | . | . | . | . | . | . | . | . | . | . | * |
| 21-225_62E3_LC | . | A | . | . | . | . | . | . | . | . | . | . | . | * |
| 21-225_62E8_LC | . | . | . | . | . | . | . | . | . | . | . | . | . | * |
| 21-225_65E9_LC | . | A | . | . | . | . | . | . | . | . | . | . | . | . |
| 21-225_66G9_LC | . | . | . | . | . | . | . | . | . | . | . | . | . | . |
| 21-225_67F10_LC | . | . | . | . | . | . | . | . | . | . | . | . | . | . |
| 21-225_68D8_LC | . | A | . | . | . | . | . | . | . | . | . | . | . | . |
| 21-225_68G6_LC | . | . | . | . | . | . | . | . | . | . | . | . | . | . |
| 21-225_69B11_LC | . | . | . | . | . | . | . | . | . | . | . | . | . | . |
| 21-225_69B9_LC | . | . | . | . | . | . | . | . | . | . | . | . | . | . |
| 21-225_6B4_LC | S | . | . | . | . | . | . | . | . | . | . | . | . | . |
| 21-225_6D9_LC | . | T | . | . | . | . | . | . | . | . | . | . | . | . |
| 21-225_71D4_LC | . | . | . | . | . | . | . | . | . | . | . | . | . | . |
| 21-225_72B4_LC | . | A | . | . | . | . | . | . | . | . | . | . | . | * |
| 21-225_72D5_LC | . | A | . | . | . | . | . | . | . | . | . | . | . | * |
| 21-225_73C4_LC | . | . | . | . | . | . | . | . | . | . | . | . | . | . |
| 21-225_74A9_LC | P | . | . | . | . | . | . | . | . | . | . | . | . | . |
| 21-225_74B3_LC | P | . | . | . | . | . | . | . | . | . | . | . | . | . |
| 21-225_74C9_LC | S | T | . | . | . | . | . | . | . | . | . | . | . | . |
| 21-225_76B4_LC | . | A | . | . | . | . | . | . | . | . | . | . | . | . |
| 21-225_77A2_LC | P | . | . | . | . | . | . | . | . | . | . | . | . | . |
| 21-225_78E9_LC | P | A | . | . | . | . | . | . | . | . | . | . | . | . |
| 21-225_79E7_LC | . | T | . | . | . | . | . | . | . | . | . | . | . | . |
| 21-225_8D8_LC | P | . | . | . | . | . | . | . | . | . | . | . | . | S |
| 21-225_92A4_LC | S | . | . | . | . | . | . | . | . | . | . | . | . | . |
| 21-225_96B5_LC | P | . | . | . | . | . | . | . | . | . | . | . | . | . |
| 21-225_97E6_LC | P | . | . | . | . | . | . | . | . | . | . | . | . | . |
| 21-225_9H10_LC | Y | . | . | . | . | . | . | . | . | . | . | . | . | . |

FIGURE 57 (Continued)

Table 97. Consensus 17 - VK3|A27/JK1 (SEQ ID NO: 50314):

EIVLTQSPGTLSLSPGERATLSCRAS--QSVYS----SYLAWYQQKPGQAPRLLIYG--------ASSRATGIPDRFSGSGSG-
TDFTLTISRLEPEDFAVYYCQQYDN---------SPWTFGQGTKVEIKR wherein:

R at position 24 can be substituted with W

A at position 25 can be substituted with T

S at position 26 can be substituted with G or R

Q at position 29 can be substituted with P

S at position 30 can be substituted with N, I or R

V at position 31 can be substituted with I or F

Y at position 32 can be substituted with R, S, N, D, F, H, G or W

S at position33 can be substituted with T, N, G, L or R

S at position 39 can be substituted with N, G, R, D, A or Y

Y at position 40 can be substituted with F or H

A at position 42 can be substituted with V or S

G at position 58 can be substituted with D or V

A at position 67 can be substituted with T, P or V

S at position 68 can be substituted with F, Y, A or T

S at position 69 can be substituted with R, N or A

A at position 71 can be substituted with S or T

T at position 72 can be substituted with P, S or A

FIGURE 57 (Continued)

Q at position 107 can be substituted with H
Q at position 108 can be substituted with H
Y at position 109 can be substituted with S
D at position 110 can be substituted with E, G or H
N at position 111 can be substituted with S, null (-), R, T, I, D or G
null (-) at position 134 can be substituted with S
S at position 135 can be substituted with P, N or R
P at position 136 can be substituted with S or V
W at position 137 can be substituted with R
T at position 138 can be substituted with A
Xaa Xaa Xaa Xaa Xaa Xaa Xaa Xaa Xaa Xaa Leu Xaa (SEQ ID NO: 50127)
Xaa Xaa Xaa Xaa Arg Xaa Arg Xaa (SEQ ID NO: 50128)
Xaa Xaa Xaa Xaa Xaa Xaa Xaa Xaa Xaa Xaa Xaa Xaa (SEQ ID NO: 50129)
Arg Ala Ser Gln Ser Val Tyr Ser Ser Tyr Leu Ala (SEQ ID NO: 50612)
Gly Ala Ser Arg Ala Thr (SEQ ID NO: 50613)
Gln Gln Tyr Asp Asn Ser Pro Trp Thr (SEQ ID NO: 50614)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| CONSENSUS | E | I | V | L | T | Q | S | P | G | T | L | S | L | S | P | G | E | R | A | T | L | S | C | R | A | S |
| 21-225_91B4_LC | . | . | . | . | . | . | . | . | . | . | . | Y | . | . | . | . | . | . | . | . | . | . | . | . | . | . |
| 21-225_91E9_LC | . | . | . | . | . | . | . | . | . | . | . | Y | . | . | . | . | . | . | . | . | . | . | . | . | . | . |
| 21-225_91F3_LC | . | . | . | . | . | . | . | . | . | . | . | Y | . | . | . | . | . | . | . | . | . | . | . | . | . | . |
| 21-225_92B1_LC | . | . | . | . | . | . | . | . | . | . | . | Y | . | . | . | . | . | . | . | . | . | . | . | . | . | . |
| 21-225_92D6_LC | . | . | . | . | . | . | . | . | . | . | . | Y | . | . | . | . | . | . | . | . | . | . | . | . | . | . |
| 21-225_93C2_LC | . | . | . | . | . | . | . | . | . | . | . | Y | . | . | . | . | . | . | . | . | . | . | . | . | . | . |
| 21-225_93E4_LC | . | . | . | . | . | . | . | . | . | . | . | . | . | . | . | . | . | . | . | . | . | . | . | . | . | . |
| 21-225_93E9_LC | . | . | . | . | . | . | . | . | . | . | . | . | . | . | Q | . | . | . | . | . | K | . | . | . | . | . |
| 21-225_94D3_LC | . | . | . | . | . | . | . | . | . | . | . | Y | . | . | . | . | . | . | . | . | . | . | . | . | . | . |
| 21-225_94F12_LC | . | . | . | . | . | . | . | . | . | . | . | . | . | . | . | . | . | . | . | . | . | . | . | . | . | . |
| 21-225_94G10_LC | . | . | . | . | . | . | . | . | . | . | . | . | . | . | . | . | . | . | . | . | . | . | . | . | . | . |
| 21-225_95D2_LC | . | . | . | . | S | . | . | . | . | W | . | Y | . | . | S | . | . | . | . | . | . | . | . | . | . | . |
| 21-225_95F9_LC | . | . | . | . | . | . | . | . | . | . | . | Y | . | . | S | . | . | . | . | . | . | . | . | . | . | . |
| 21-225_95G9_LC | . | . | . | . | . | . | . | . | . | . | . | Y | . | . | S | . | . | . | . | . | . | . | . | . | . | . |
| 21-225_95H10_LC | . | . | . | . | . | . | . | . | . | . | . | . | . | . | . | . | . | . | . | . | . | . | . | . | . | . |
| 21-225_97A2_LC | . | . | . | . | . | . | . | . | . | . | . | . | . | . | . | . | . | . | . | . | . | . | . | . | . | . |
| 21-225_97E5_LC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | K_CDR1 | | | | | | | | | | | | | | | K_FR2 | | | | |
| CONSENSUS | - | - | Q | S | V | Y | S | - | - | - | - | - | S | Y | L | A | W | Y | Q | Q | K | P | G | Q | A | P |
| 21-225_91B4_LC | . | . | . | . | . | . | . | . | . | . | . | . | . | . | . | . | . | . | . | . | . | . | . | . | . | . |
| 21-225_91E9_LC | . | . | . | . | . | . | . | . | . | . | . | . | . | . | . | . | . | . | . | . | . | . | A | . | . | . |
| 21-225_91F3_LC | . | . | . | . | . | . | . | . | . | . | . | . | . | . | . | . | . | . | . | . | . | . | . | . | . | . |
| 21-225_92B1_LC | . | . | . | . | . | G | . | . | . | . | . | . | N | . | . | . | . | . | . | . | . | . | . | . | . | . |
| 21-225_92D6_LC | . | . | . | . | . | . | . | . | . | . | . | . | . | . | . | . | . | . | . | . | . | . | . | . | . | . |
| 21-225_93C2_LC | . | . | . | . | . | . | . | . | . | . | . | . | . | . | . | . | . | . | . | . | . | . | . | . | . | . |
| 21-225_93E4_LC | . | . | . | . | . | . | . | . | . | . | . | . | . | . | . | . | . | . | . | . | . | . | . | . | . | . |
| 21-225_93E9_LC | . | . | . | . | . | D | . | . | . | . | . | . | . | . | . | . | . | . | . | . | . | . | . | . | . | . |
| 21-225_94D3_LC | . | . | . | . | . | S | . | . | . | . | . | . | . | . | . | . | . | . | . | . | . | T | . | . | . | . |
| 21-225_94F12_LC | . | . | . | . | . | N | . | . | . | . | . | . | N | . | . | . | . | . | X | . | . | . | . | . | . | . |
| 21-225_94G10_LC | . | . | . | . | . | . | . | . | . | . | . | . | . | . | . | . | . | . | . | . | . | . | . | . | . | . |
| 21-225_95D2_LC | . | . | . | . | . | . | . | . | . | . | . | . | . | . | . | . | . | . | . | . | . | . | . | . | . | . |
| 21-225_95F9_LC | . | . | . | . | . | . | . | . | . | . | . | . | . | . | . | . | . | . | . | . | . | . | . | . | . | . |
| 21-225_95G9_LC | . | . | . | . | . | . | . | . | . | . | . | . | . | . | . | . | . | . | . | . | . | . | . | . | . | . |
| 21-225_95H10_LC | . | . | . | . | . | . | . | . | . | . | . | . | . | . | . | . | . | . | . | . | . | . | . | . | . | . |
| 21-225_97A2_LC | . | . | . | . | . | . | . | . | . | . | . | . | . | . | . | . | . | . | . | . | . | . | . | . | . | . |
| 21-225_97E5_LC | . | . | . | . | . | . | . | . | . | . | . | . | . | . | . | . | . | . | . | . | . | . | . | . | . | . |

FIGURE 57 (Continued)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | K_CDR2 | | | | | | | | | | | | | |
| CONSENSUS | R | L | L | I | Y | G | . | . | . | . | . | . | . | . | A | S | S | R | A | T | G | I | P | D | R | F |
| 21-225_74B12_LC | . | . | . | . | . | . | . | . | . | . | . | . | . | . | . | . | . | . | S | . | . | . | . | . | . | . |
| 21-225_74B2_LC | . | . | . | . | . | . | . | . | . | . | . | . | . | . | . | . | . | . | . | . | . | . | . | . | . | V |
| 21-225_74C5_LC | . | . | . | . | . | . | . | . | . | . | . | . | . | . | . | . | . | . | . | . | . | . | . | . | . | . |
| 21-225_74C7_LC | . | . | . | . | . | . | . | . | . | . | . | . | . | . | . | . | . | . | . | . | . | . | . | . | . | . |
| 21-225_74D11_LC | . | . | . | . | . | . | . | . | . | . | . | . | . | . | . | & | . | . | . | . | . | . | . | . | . | . |
| 21-225_74D2_LC | . | . | . | . | . | . | . | . | . | . | . | . | . | . | . | . | . | . | . | & | . | . | . | . | . | . |
| 21-225_74D5_LC | . | . | . | . | . | . | . | . | . | . | . | . | . | . | . | . | . | . | . | . | . | . | . | . | . | . |
| 21-225_74D6_LC | . | . | . | . | . | . | . | . | . | . | . | . | . | . | . | . | . | . | . | . | . | . | . | . | . | . |
| 21-225_74F4_LC | . | . | . | . | . | . | . | . | . | . | . | . | . | . | . | . | . | . | . | . | . | . | . | . | . | . |
| 21-225_74F5_LC | . | . | . | . | . | . | . | . | . | . | . | . | . | . | T | . | . | . | . | . | . | . | . | . | . | . |
| 21-225_74G8_LC | . | . | . | . | . | . | . | . | . | . | . | . | . | . | . | . | . | . | S | . | . | . | . | . | . | . |
| 21-225_74H5_LC | . | . | . | . | . | . | . | . | . | . | . | . | . | . | . | . | . | . | . | . | . | . | . | . | . | . |
| 21-225_74H7_LC | . | . | . | . | . | . | . | . | . | . | . | . | . | . | . | . | . | . | . | . | . | . | . | . | . | . |
| 21-225_74H8_LC | . | . | . | . | . | . | . | . | . | . | . | . | . | . | . | . | . | . | . | . | . | . | . | . | . | . |
| 21-225_75A12_LC | . | . | . | . | . | . | . | . | . | . | . | . | . | . | . | . | . | . | . | . | . | . | . | . | . | . |
| 21-225_75A5_LC | . | . | . | . | . | . | . | . | . | . | . | . | . | . | . | T | . | . | . | . | . | . | . | . | . | . |
| 21-225_75A8_LC | . | . | . | . | . | . | . | . | . | . | . | . | . | . | . | . | . | . | . | . | . | . | . | . | . | . |
| 21-225_75B10_LC | . | . | . | . | . | . | . | . | . | . | . | . | . | . | . | . | . | . | . | . | . | . | . | . | . | . |
| 21-225_75C2_LC | . | . | . | . | . | . | . | . | . | . | . | . | . | . | . | . | . | . | . | . | . | . | . | . | . | . |
| 21-225_75C3_LC | . | . | . | . | . | . | . | . | . | . | . | . | . | . | . | . | . | . | . | . | . | . | . | . | . | . |
| 21-225_75D3_LC | . | . | . | . | . | . | . | . | . | . | . | . | . | . | . | . | . | . | . | . | . | . | . | . | . | . |
| 21-225_75D9_LC | . | . | . | . | . | . | . | . | . | . | . | . | . | . | . | . | . | . | S | . | . | . | . | . | . | . |
| 21-225_75F3_LC | . | . | . | . | . | . | . | . | . | . | . | . | . | . | . | . | . | . | . | . | . | . | . | . | . | . |
| 21-225_75G12_LC | . | . | . | . | . | . | . | . | . | . | . | . | . | . | . | . | . | . | . | Q | . | . | . | . | . | . |
| 21-225_75G3_LC | . | . | . | . | . | . | . | . | . | . | . | . | . | . | . | . | . | . | . | . | . | . | . | . | . | . |
| 21-225_75G7_LC | . | . | . | . | . | . | . | . | . | . | . | . | . | . | . | . | . | . | . | . | . | . | . | . | . | . |
| 21-225_75G9_LC | . | . | . | . | . | . | . | . | . | . | . | . | . | . | . | . | . | . | . | . | . | . | . | . | . | . |
| 21-225_75H8_LC | . | . | . | . | . | . | . | . | . | . | . | . | . | . | . | . | . | . | . | . | . | . | . | . | . | . |
| 21-225_76A4_LC | . | . | . | . | . | . | . | . | . | . | . | . | . | . | . | . | . | . | . | . | . | . | . | . | . | . |

Table 98. Consensus 18 - VK1|A30/JK1 (SEQ ID NO: 50315):

DIQMTQSPSSLSASVGDRVTITCRAS--QGIR----NDLGWYQQKPGKAPKRLIYA----ASSLQSGVPSRFSGSGSG--TEFTLTISSLQPEDFATYYCLQHYS----------YPRTFGQGTKVEIKR wherein:

A at position 25 can be substituted with T

S at position 26 can be substituted with T

Q at position 29 can be substituted with R

G at position 30 can be substituted with D, A, N or V

R at position 32 can be substituted with G

N at position 39 can be substituted with K, D, H, S, G or T

D at position 40 can be substituted with I or Y

G at position 42 can be substituted with N

A at position 58 can be substituted with T, I, V, P, G, R or S

A at position 67 can be substituted with T or S

S at position 68 can be substituted with A, F, P or Y

S at position 69 can be substituted with N, R, G or T

L at position 70 can be substituted with C, F or S

Q at position 71 can be substituted with H or E

S at position 72 can be substituted with N, G or I

L at position 107 can be substituted with V, I or H

Q at position 108 can be substituted with M, H, L or V

FIGURE 57 (Continued)

H at position 109 can be substituted with Q, Y, L or S

Y at position 110 can be substituted with N, H, S or T

S at position 111 can be substituted with N, T, R, D, F or G null (-) at position 134 can be substituted with Y or F Y at position 135 can be substituted with F, P, C, N or T P at position 136 can be substituted with L R at position 137 can be substituted with W, F or L Arg Xaa Xaa Xaa Ile Xaa Xaa Xaa Leu Xaa (SEQ ID NO: 50130)

Xaa Xaa Xaa Xaa Xaa Xaa Xaa (SEQ ID NO: 50131)

Xaa Xaa Xaa Xaa Xaa Xaa Xaa Xaa Xaa Thr (SEQ ID NO: 50132)

Arg Ala Ser Gln Gly Ile Arg Asn Asp Leu Gly (SEQ ID NO: 50615)

Ala Ala Ser Ser Leu Gln Ser (SEQ ID NO: 50616)

Leu Gln His Tyr Ser Tyr Pro Arg Thr (SEQ ID NO: 50617)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | K_CDR1 | | | | | | | | | | | | | K_FR2 | | | | | | | | |
| CONSENSUS | - | - | Q | G | I | R | - | - | - | - | - | - | N | D | L | G | W | Y | Q | Q | K | P | G | K | A | P |
| 21-225_9C11_LC | . | . | . | N | . | . | . | . | . | . | . | . | . | Y | . | . | . | . | . | . | . | . | . | . | . | . |
| 21-225_9D12_LC | . | . | . | . | . | . | . | . | . | . | . | . | . | . | . | . | . | . | . | . | . | S | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | K_FR3 | | | | | | | | | | | | | | |
| CONSENSUS | S | G | S | G | S | G | . | . | . | T | E | F | T | L | T | I | S | L | Q | P | E | D | F | A | T | Y |
| 21-225_9C11_LC | . | . | . | . | . | . | . | . | . | . | . | . | . | . | . | N | . | . | . | . | . | . | . | . | . | . |
| 21-225_9D12_LC | . | . | . | . | . | . | . | . | . | . | . | . | . | . | . | . | . | . | . | . | . | . | . | . | W | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| CONSENSUS | | | | | Y | P | R | T | F | G | Q | G | T | K | V | E | I | K | R |
| 21-225_9C11_LC | | | | | T | | L | | | | | | | | | | | | |
| 21-225_9D12_LC | | | | | | | W | | | | | | | | | | | | |

K_FR4 (columns 143–149)

FIGURE 57 (Continued)

Table 99. Consensus 19 - VK4|B3/JK1 (SEQ ID NO: 50316):

DIVMTQSPDSLAVSLGERATINCKSS--QSVLHSSNNNNYLAWYQQKPGQPPKLLIYW--------ASTRESGVPDRFSGSGSG--
TDFTLTISSLQAEDVAVYYCQQYYS----------TPPTFGQGTKVEIKR wherein:

K at position 24 can be substituted with R or M

S at position 26 can be substituted with G or R

S at position 30 can be substituted with T, N or I

V at position 31 can be substituted with I or A

H at position 33 can be substituted with Y, F, S, K, D, L or M

S at position 34 can be substituted with T, R, N, I or D

S at position 35 can be substituted with F or P

N at position 36 can be substituted with H

N at position 37 can be substituted with K, S, D or H

N at position 38 can be substituted with Y, K, H, R, A, F or W

N at position 39 can be substituted with H or Y

Y at position 40 can be substituted with S

L at position 41 can be substituted with F

A at position 42 can be substituted with T, V or G

A at position 67 can be substituted with T or S

S at position 68 can be substituted with F

T at position 69 can be substituted with I, K or S

FIGURE 57 (Continued)

R at position 70 can be substituted with W or L

E at position 71 can be substituted with K, A, D or R

S at position 72 can be substituted with T

Q at position 107 can be substituted with H or L

Q at position 108 can be substituted with H

Y at position 109 can be substituted with F

Y at position 110 can be substituted with F, H, N, L or S

S at position 111 can be substituted with N, R, D, I, T, C, E or K

T at position 135 can be substituted with S, I, V, A or Y

P at position 137 can be substituted with W, L, V, C, G, R or S

T at position 138 can be substituted with K or S

Xaa Xaa Xaa Gln Ser Xaa Leu Xaa Xaa Xaa Xaa Xaa Xaa Xaa Xaa (SEQ ID NO: 50133)

Trp Xaa Xaa Xaa Xaa Xaa (SEQ ID NO: 50229)

Xaa Xaa Xaa Xaa Xaa Xaa Pro Xaa Xaa (SEQ ID NO: 50134)

Lys Ser Gln Ser Val Leu His Ser Ser Asn Asn Tyr Leu Ala (SEQ ID NO: 50618)

Trp Ala Ser Thr Arg Glu Ser (SEQ ID NO: 50619)

Gln Gln Tyr Tyr Ser Thr Pro Pro Thr (SEQ ID NO: 50620)

Table 100. Consensus 20 - VK1|A30/JK3 (SEQ ID NO: 50317):

DIQMTQSPSSLSASVGDRVTITCRAS--QGIR------NDLGWYQQKPGKAPKRLIYA--------ASSLQSGVPSRFSGSGSG--TEFTLTISSLQPEDFATYYCLQHNS----------------YPFTFGPGTKVDIKR wherein:

A at position 25 can be substituted with T

G at position 30 can be substituted with D or V

I at position 31 can be substituted with M

R at position 32 can be substituted with S

N at position 39 can be substituted with K, S, D or T

D at position 40 can be substituted with N, H, Y, V, A, I or L

L at position 41 can be substituted with F

G at position 42 can be substituted with D

A at position 58 can be substituted with P, T, G, I, R or V

A at position 67 can be substituted with V

S at position 68 can be substituted with F or T

S at position 69 can be substituted with N, T, R or D

L at position 70 can be substituted with V

Q at position 71 can be substituted with L

S at position 72 can be substituted with N, T, G or R

L at position 107 can be substituted with I

Q at position 108 can be substituted with H or L

FIGURE 57 (Continued)

H at position 109 can be substituted with Y, D or L

N at position 110 can be substituted with Y, T, H, G or I

S at position 111 can be substituted with R, D, T, G or N

Y at position 135 can be substituted with F or H

P at position 136 can be substituted with L

F at position 137 can be substituted with L

T at position 138 can be substituted with K

Arg Xaa Ser Gln Xaa Xaa Xaa Xaa Xaa Xaa Xaa Xaa (SEQ ID NO: 50135)

Xaa Xaa Xaa Xaa Xaa Xaa Xaa Xaa Xaa Xaa (SEQ ID NO: 50136)

Xaa Xaa Xaa Xaa Xaa Xaa Xaa Xaa Xaa Xaa Xaa (SEQ ID NO: 50137)

Arg Ala Ser Gln Gly Ile Arg Asn Asp Leu Gly (SEQ ID NO: 50621)

Ala Ala Ser Ser Leu Gln Ser (SEQ ID NO: 50622)

Leu Gln His Asn Ser Tyr Pro Phe Thr (SEQ ID NO: 50623)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | K_FR1 | | | | | | | | | | | | | | | |
| CONSENSUS | D | I | Q | M | T | Q | S | P | S | S | L | S | A | S | V | G | D | R | V | T | I | T | C | R | A | S |
| 21-225_58D11_LC | . | . | . | . | . | . | . | . | . | . | . | . | . | . | . | . | . | . | . | . | . | . | . | . | . | . |
| 21-225_58F5_LC | . | . | . | . | . | . | . | . | . | . | . | . | . | . | . | . | . | . | . | . | . | . | . | . | . | . |
| 21-225_59F11_LC | . | . | . | . | . | . | . | . | . | . | . | . | . | . | . | . | . | . | . | . | . | . | . | . | . | . |
| 21-225_5F4_LC | . | . | . | . | . | . | . | . | . | . | . | . | . | . | . | . | . | . | . | . | . | . | . | . | . | . |
| 21-225_60A3_LC | . | . | . | . | . | . | . | . | . | . | . | . | . | . | . | . | . | . | . | . | . | . | . | . | . | . |
| 21-225_62G3_LC | . | . | X | . | . | . | . | . | . | . | . | . | . | . | . | . | . | . | . | . | . | . | . | . | . | . |
| 21-225_64A12_LC | . | . | . | . | . | . | . | . | . | . | . | . | . | . | . | . | . | . | . | . | . | . | . | . | . | . |
| 21-225_66F9_LC | . | . | . | . | . | . | . | . | . | . | . | . | . | . | . | . | . | . | . | . | . | . | . | . | . | . |
| 21-225_67B7_LC | . | . | . | . | . | . | . | . | . | . | . | . | . | . | . | . | . | . | . | . | . | . | . | . | . | . |
| 21-225_68G8_LC | . | . | . | . | . | . | . | . | . | . | . | . | . | . | . | . | . | . | . | . | . | . | . | . | . | . |
| 21-225_71B11_LC | . | . | . | . | . | . | . | . | . | . | . | . | . | . | . | . | . | . | . | . | . | . | . | . | . | . |
| 21-225_71B6_LC | . | . | . | . | . | . | . | . | . | . | A | . | . | . | . | . | . | . | . | . | . | . | . | . | . | . |
| 21-225_71H6_LC | . | . | . | . | . | . | . | . | . | . | . | . | . | . | . | . | . | . | . | . | . | . | . | . | . | . |
| 21-225_73A6_LC | . | . | . | . | . | . | . | . | . | . | . | . | . | . | . | . | . | . | . | . | . | . | . | . | . | . |
| 21-225_74A11_LC | . | . | . | . | . | . | . | . | . | . | . | . | . | . | . | . | . | . | . | . | . | . | . | . | . | . |
| 21-225_75C11_LC | . | . | . | . | . | . | . | . | . | . | . | . | . | . | . | . | . | . | . | . | . | . | . | . | . | . |
| 21-225_76H10_LC | . | . | . | . | . | . | . | . | . | Y | Q | . | . | . | A | . | . | . | . | . | . | . | . | . | . | . |
| 21-225_78H12_LC | . | . | . | . | . | . | . | . | . | . | . | . | . | . | . | . | . | . | . | . | . | . | . | . | . | . |
| 21-225_84H12_LC | . | . | . | . | . | . | . | . | . | . | . | . | . | . | . | . | . | . | . | . | . | . | . | . | . | . |
| 21-225_86E5_LC | . | . | . | . | . | . | . | . | . | . | . | . | . | . | . | . | . | . | . | . | . | . | . | . | . | . |
| 21-225_88A5_LC | . | . | . | . | . | . | . | . | . | . | . | . | . | . | . | . | . | . | . | . | . | . | . | . | . | . |
| 21-225_96A4_LC | . | . | . | . | . | . | . | . | . | . | . | . | . | . | . | . | . | . | . | . | . | . | . | . | . | . |

Table 101. Consensus 21 - VK1|L1/JK4 (SEQ ID NO: 50318):

DIQMTQSPSSLSASVGDRVTITCRAS--QGIS------NYLAWFQQKPGKAPKSLIYA------ASSLQSGVPSKFSGSGSG--
TDFTLTISSLQPEDFATYYCQQYST-------------YPLTFGGGTKVEIKR wherein:

A at position 25 can be substituted with T

S at position 26 can be substituted with N

G at position 30 can be substituted with D, A, V or S

S at position 32 can be substituted with G, N, R, A or F

N at position 39 can be substituted with K, R, H, S, T or I

Y at position 40 can be substituted with H, C or D

A at position 42 can be substituted with D, V, I or N

A at position 58 can be substituted with K, S, T, V, D or G

A at position 67 an be substituted with T or V

S at position 68 can be substituted with P

S at position 69 can be substituted with N or R

Q at position 71 can be substituted with L, E or H

S at position 72 can be substituted with G, N or T

Q at position 107 can be substituted with L or H

Q at position 108 can be substituted with H, R or Y

Y at position 109 can be substituted with S, C or T

S at position 110 can be substituted with L, N, M, D, H, V, I or Y

FIGURE 57 (Continued)

T at position 111 can be substituted with N, S or K
Y at position 135 can be substituted with F, I or S
L at position 137 can be substituted with V, F or N
T at position 138 can be substituted with I, Q or S
Arg Xaa Xaa Gln Xaa Ile Xaa Xaa Xaa Leu Xaa (SEQ ID NO: 50138)
Xaa Xaa Xaa Xaa Leu Xaa Xaa (SEQ ID NO: 50139)
Xaa Xaa Xaa Xaa Xaa Pro Xaa Xaa (SEQ ID NO: 50140)
Arg Ala Ser Gln Gly Ile Ser Asn Tyr Leu Ala (SEQ ID NO: 50624)
Ala Ala Ser Ser Leu Gln Ser (SEQ ID NO: 50625)
Gln Gln Tyr Ser Thr Tyr Pro Leu Thr (SEQ ID NO: 50626)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | K_FR1 | | | | | | | | | | | | | | |
| CONSENSUS | D | I | Q | M | T | Q | S | P | S | S | L | S | A | S | V | G | D | R | V | T | I | T | C | R | A | S |
| 21-225_77E6_LC | . | . | . | . | . | . | . | . | . | . | . | . | . | . | . | . | . | . | . | . | . | . | . | . | . | . |
| 21-225_79A12_LC | . | . | . | . | . | . | . | . | . | . | . | . | . | . | . | . | . | . | . | . | . | . | . | . | . | . |
| 21-225_79F4_LC | . | . | . | . | . | . | . | . | . | A | . | . | . | . | . | . | . | . | . | . | . | . | . | . | . | . |
| 21-225_7F10_LC | . | . | . | . | . | . | . | . | . | . | . | . | . | . | . | . | . | . | . | . | . | . | . | . | . | . |
| 21-225_80C11_LC | . | . | . | . | . | . | . | . | . | . | . | . | . | . | . | . | . | . | . | . | . | . | . | . | . | . |

Replacement Sheet

FIGURE 57 (Continued)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | K_CDR1 | | | | | | | | | | | | | | | K_FR2 | | | | | | |
| CONSENSUS | - | - | Q | G | I | S | - | - | - | - | - | - | N | Y | L | A | W | F | Q | Q | K | P | G | K | A | P |
| 21-225_77E6_LC | . | . | . | . | . | . | . | . | . | . | . | . | . | . | . | . | . | . | . | . | . | . | . | . | . | . |
| 21-225_79A12_LC | . | . | . | V | . | . | . | . | . | . | . | . | X | . | . | . | . | . | . | . | . | . | . | . | . | . |
| 21-225_79F4_LC | . | . | . | . | . | . | . | . | . | . | . | . | X | . | . | . | . | . | . | . | . | . | . | . | . | . |
| 21-225_7F10_LC | . | . | . | O | . | O | . | . | . | . | . | . | . | . | . | . | . | . | . | . | . | . | . | . | . | . |
| 21-225_80C11_LC | . | . | . | . | . | . | . | . | . | . | . | . | X | . | . | . | . | . | . | . | . | . | . | X | . | . |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | K_CDR2 | | | | | | | | | | | | | |
| CONSENSUS | K | S | L | I | Y | A | - | - | - | - | - | - | - | - | A | S | S | L | Q | S | G | V | P | S | K | F |
| 21-225_77E6_LC | . | . | . | . | . | . | . | . | . | . | . | . | . | . | . | . | . | . | . | . | . | A | . | . | . | . |
| 21-225_79A12_LC | . | . | . | . | . | . | . | . | . | . | . | . | . | . | . | . | . | . | . | . | . | A | . | . | . | . |
| 21-225_79F4_LC | . | . | . | . | S | V | . | . | . | . | . | . | . | . | . | . | . | . | . | G | . | A | . | . | . | . |
| 21-225_7F10_LC | . | . | . | . | . | T | . | . | . | . | . | . | . | . | . | . | . | . | . | . | . | . | . | . | K | . |
| 21-225_80C11_LC | . | . | . | . | . | . | . | . | . | . | . | . | . | . | . | . | . | . | . | . | . | A | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| CONSENSUS | S | G | S | G | S | G | ' | ' | T | D | F | T | L | T | I | S | S | L | Q | P | E | D | F | A | T | Y |
| 21-225_77E6_LC | . | . | . | . | . | . | . | . | . | . | . | . | . | . | . | . | . | . | . | . | . | . | . | . | . | . |
| 21-225_79A12_LC | . | . | . | . | . | . | . | . | . | . | . | . | . | . | . | . | . | . | . | . | . | . | . | . | . | . |
| 21-225_79F4_LC | . | . | . | . | . | . | . | . | . | . | . | . | . | . | . | . | . | . | . | . | . | . | . | . | . | . |
| 21-225_7F10_LC | . | . | . | . | . | . | . | . | . | . | . | . | . | . | . | . | . | . | . | . | . | . | . | . | . | . |
| 21-225_80C11_LC | . | . | . | . | . | . | . | . | . | . | . | . | . | . | . | . | . | . | . | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | | |
| CONSENSUS | Y | C | Q | Q | Y | S | T | . | . | . | . | . | . | . | . | . | . | . | . | . | . | . | . | . | . | . |
| 21-225_77E6_LC | . | . | . | . | . | . | N | . | . | . | . | . | . | . | . | . | . | . | . | . | . | . | . | . | . | . |
| 21-225_79A12_LC | . | . | . | . | . | . | N | . | . | . | . | . | . | . | . | . | . | . | . | . | . | . | . | . | . | . |
| 21-225_79F4_LC | . | . | . | . | . | . | N | . | . | . | . | . | . | . | . | . | . | . | . | . | . | . | . | . | . | . |
| 21-225_7F10_LC | . | . | . | . | . | N | S | . | . | . | . | . | . | . | . | . | . | . | . | . | . | . | . | . | . | . |
| 21-225_80C11_LC | . | . | . | . | . | . | N | . | . | . | . | . | . | . | . | . | . | . | . | . | . | . | . | . | . | . |

FIGURE 57 (Continued)

Table 102. Consensus 22 - VK1|O12/JK4 (SEQ ID NO: 50319):

DIQMTQSPSSLSASVGDRVTITCRAS--QNII----SYLNWYQQKPGKAPKLLIYT------ASSLQSGVPSRFSGSGSG---TDFTLTISSLQPEDFATYYCQQSYS----------TPLTFGGGTKVEIKR wherein:

A at position 25 can be substituted with T

S at position 26 can be substituted with T

Q at position 29 can be substituted with H or R

N at position 30 can be substituted with S, R, T or I

I at position 31 can be substituted with V or F

I at position 32 can be substituted with S, N, Y, F, R, H, L, K or T

S at position 39 can be substituted with N, D, R, K or T

Y at position 40 can be substituted with F

N at position 42 an be substituted with H

T at position 58 can be substituted with A, V, G, I or S

A at position 67 can be substituted with T

S at position 69 can be substituted with N, R or T

L at position 70 can be substituted with F or S

Q at position 71 can be substituted with H, E or P

S at position 72 can be substituted with G, T, N or R

Q at position 108 can be substituted with L

S at position 109 can be substituted with T, N or P

FIGURE 57 (Continued)

Y at position 110 can be substituted with H, C, D, F or N

S at position 111 can be substituted with null (-), I, N, F, G or T

T at position 135 can be substituted with S, P, F, N, I or L

P at position 136 can be substituted with T, I, A or S

L at position 137 can be substituted with P, Y, F or V

Arg Xaa Xaa Xaa Xaa Xaa Xaa Xaa Leu Xaa (SEQ ID NO: 50141)

Xaa Xaa Ser Xaa Xaa Xaa Xaa Xaa (SEQ ID NO: 50142)

Gln Xaa Xaa Xaa Xaa Xaa Xaa Xaa Xaa Thr (SEQ ID NO: 50143)

Arg Ala Ser Gln Asn Ile Ile Ser Tyr Leu Asn (SEQ ID NO: 50627)

Thr Ala Ser Ser Leu Gln Ser (SEQ ID NO: 50628)

Gln Gln Ser Tyr Ser Thr Pro Leu Thr (SEQ ID NO: 50629)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | K_FR1 | | | | | | | | | | | | | | | |
| CONSENSUS | D | I | Q | M | T | Q | S | P | S | S | L | S | A | S | V | G | D | R | V | T | I | T | C | R | A | S |
| 21-225_7E11.001.022_LC | . | . | . | . | . | . | . | . | . | . | . | . | . | . | . | . | . | . | . | . | . | . | . | . | . | . |
| 21-225_7E11.001.023_LC | . | . | . | . | . | . | . | . | . | . | . | . | . | . | . | . | . | . | . | . | . | K | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | K_CDR1 | | | | | | | | | | | | | | | | | K_FR2 | | |
| CONSENSUS | - | - | Q | N | I | I | - | - | - | - | - | - | S | Y | L | N | W | Y | Q | Q | K | P | G | K | A | P |
| 21-225_7E11.001.022_LC | | | | | | | | | | | | | | | | | | | | | | | | | | |
| 21-225_7E11.001.023_LC | | | | | | | | | | | | | | | | | | | | | | | | | | |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | K_CDR2 | | | | | | | | | | | | | | |
| CONSENSUS | K | L | L | I | Y | T | . | . | . | . | . | . | . | . | A | S | S | L | Q | S | G | V | P | S | R | F |
| 21-225_7E11.001.022_LC | . | a | . | . | . | . | . | . | . | . | . | . | . | . | . | . | . | . | . | . | . | . | . | . | . | . |
| 21-225_7E11.001.023_LC | . | a | . | . | . | . | . | . | . | . | . | . | . | . | . | . | . | . | . | . | . | . | . | . | . | . |

FIGURE 57 (Continued)

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | K_FR3 | | | | | | | | | | | | | | |
| CONSENSUS | S | G | S | G | S | G | - | - | T | D | F | T | L | T | I | S | S | L | Q | P | E | D | F | A | T | Y |
| 21-226_7E11.001.022_LC | . | . | . | . | . | . | | | . | . | . | . | . | . | . | . | . | . | . | . | . | . | . | . | - | . |
| 21-225_7E11.001.023_LC | . | . | . | . | . | . | | | . | . | . | . | . | . | . | . | . | . | . | . | . | . | . | . | - | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K_FR4 | | | | | |
| CONSENSUS | - | - | - | - | T | P | L | T | F | G | G | G | T | K | V | E | I | K | R |
| 21-225_7E11.001.022_LC | . | . | . | . | . | . | . | . | . | . | . | . | . | . | . | . | . | . | . |
| 21-225_7E11.001.023_LC | . | . | . | . | . | . | . | . | . | . | . | . | . | . | . | . | . | . | . |

FIGURE 57 (Continued)

Table 103. Consensus 23 - VK1jL1/JK3 (SEQ ID NO: 50320):

DIQMTQSPSSLSASVGDRVTITCRAS-QGIS------NYLAWFQQKPGKAPKSLIYA------ASSLQSGVPSKFSGSGSG--
TDFTLTISSLQPEDFATYYCQQYNS------YPFTFGPGTKVDIKR wherein:

R at position 24 can be substituted with P

A at position 25 can be substituted with T

S at position 26 can be substituted with N

Q at position 29 can be substituted with R

G at position 30 can be substituted with D, V or A

I at position 31 can be substituted with V

S at position 32 can be substituted with N, G, R, T or K

N at position 39 can be substituted with K, Y, H, I or T

Y at position 40 can be substituted with H

A at position 42 can be substituted with V or S

A at position 58 can be substituted with V, G or T

A at position 67 can be substituted with S or V

S at position 68 can be substituted with F

S at position 69 can be substituted with G, N or T

L at position 70 can be substituted with V

Q at position 71 can be substituted with R, H, L or E

S at position 72 can be substituted with G or T

FIGURE 57 (Continued)

Q at position 107 can be substituted with H, L, P or R
Q at position 108 can be substituted with R, K, H or L
Y at position 109 can be substituted with F
N at position 110 can be substituted with H, D, Y, S, K, L, M or Q
S at position 111 can be substituted with T, G, N, C or D
Y at position 135 can be substituted with F or H
F at position 137 can be substituted with V, L or I
T at position 138 can be substituted with K
Xaa Xaa Xaa Xaa Xaa Xaa Xaa Xaa Xaa Leu Xaa (SEQ ID NO: 50144)
Xaa Xaa Xaa Xaa Xaa Xaa Xaa Xaa (SEQ ID NO: 50145)
Xaa Xaa Xaa Xaa Xaa Xaa Pro Xaa Xaa (SEQ ID NO: 50146)
Arg Ala Ser Gln Gly Ile Ser Asn Tyr Leu Ala (SEQ ID NO: 50630)
Ala Ala Ser Ser Leu Gln Ser (SEQ ID NO: 50631)
Gln Gln Tyr Asn Ser Tyr Pro Phe Thr (SEQ ID NO: 50632)

Table 104. Consensus 24 - VK1|L5/JK3 (SEQ ID NO: 50321):

DIQMTQSPSSVSASVGDRVTITCRAS--QGIS------RWLAWYQQKPGKAPKLLIYA------ASSLQSGVPSRFSGSGSG--TDFTLTISSLQPEDFATYYCQQANS----------FPFTFGPGTKVDIKR wherein:

A at position 25 can be substituted with V, E or G

S at position 26 can be substituted with G

Q at position 29 can be substituted with R

G at position 30 can be substituted with D, N, A, L or V

I at position 31 can be substituted with V or F

S at position 32 can be substituted with N, T, R or I

R at position 39 can be substituted with S, N, K, T, D, I or G

W at position 40 can be substituted with Y

L at position 41 can be substituted with I

A at position 42 can be substituted with T or V

A at position 58 can be substituted with G, T, D or V

A at position 67 can be substituted with T or V

S at position 68 can be substituted with Y

S at position 69 can be substituted with R, N, T, G or I

L at position 70 can be substituted with F

Q at position 71 can be substituted with E

FIGURE 57 (Continued)

S at position 72 can be substituted with G, N or D

Q at position 107 can be substituted with H

A at position 109 can be substituted with T, G, S, V or D

N at position 110 can be substituted with D, K or S

S at position 111 can be substituted with I

F at position 135 can be substituted with L, I or V

F at position 137 can be substituted with I

Arg Xaa Xaa Xaa Xaa Xaa Xaa Xaa Xaa Xaa Xaa (SEQ ID NO: 50147)

Xaa Xaa Xaa Xaa Xaa Xaa Xaa Xaa (SEQ ID NO: 50148)

Xaa Gln Xaa Xaa Xaa Xaa Pro Xaa Thr (SEQ ID NO: 50149)

Arg Ala Ser Gln Gly Ile Ser Arg Trp Leu Ala (SEQ ID NO: 50633)

Ala Ala Ser Leu Gln Ser (SEQ ID NO: 50634)

Gln Gln Ala Asn Ser Phe Pro Phe Thr (SEQ ID NO: 50635)

Table 105.   Consensus 25 - VK2|A18/JK1 (SEQ ID NO: 50322):

DIVMTQTPLSLSVTPGQPASISCKSS--QSLLHGD-GKTYLYWYLQKPGQPPQLLIYE--------VSNRFSGVPDRFSGSGSG--TDFTLKISRVEAEDVGVYYCMQSIQ---------LPWTFGQGTKVEIKR wherein:

K at position 24 can be substituted with M, R or T

S at position 26 can be substituted with G or T

Q at position 29 can be substituted with K

S at position 30 can be substituted with R, N or T

L at position 32 can be substituted with R or V

H at position 33 can be substituted with Y

G at position 34 can be substituted with S

D at position 35 can be substituted with E or G

K at position 38 can be substituted with R

Y at position 40 can be substituted with F

L at position 41 can be substituted with F

Y at position 42 can be substituted with F, T, C or S

E at position 58 can be substituted with A

V at position 67 can be substituted with I, L or T

N at position 69 can be substituted with K, H, I or S

F at position 71 can be substituted with L

S at position 72 can be substituted with A, T, C or P

FIGURE 57 (Continued)

M at position 107 can be substituted with K

S at position 109 can be substituted with T

I at position 110 can be substituted with T, F or L

Q at position 111 can be substituted with H

L at position 135 can be substituted with I, V or F

W at position 137 can be substituted with R

Xaa Ser Xaa Xaa Xaa Leu Xaa Xaa Xaa Gly Xaa Thr Xaa Xaa Xaa (SEQ ID NO: 50150)

Xaa Xaa Ser Xaa Arg Xaa Xaa (SEQ ID NO: 50151)

Xaa Gln Xaa Xaa Xaa Xaa Pro Xaa Thr (SEQ ID NO: 50152)

Lys Ser Ser Gln Ser Leu Leu His Gly Asp Gly Lys Thr Tyr Leu Tyr (SEQ ID NO: 50636)

Glu Val Ser Asn Arg Phe Ser (SEQ ID NO: 50637)

Met Gln Ser Ile Gln Leu Pro Trp Thr (SEQ ID NO: 50638)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | K_FR1 | | | | | | | | | | | | | | | |
| CONSENSUS | D | I | V | M | T | Q | T | P | L | S | L | S | V | T | P | G | Q | P | A | S | I | S | C | K | S | S |
| 21-225_26F8_LC | . | . | . | . | . | . | . | . | . | . | . | . | . | . | . | . | . | . | . | . | . | . | . | . | . | . |
| 21-225_28G3_LC | E | . | . | . | . | . | . | . | . | . | . | . | . | . | . | . | . | . | . | . | . | . | . | . | . | . |
| 21-225_43E11_LC | . | . | . | . | . | . | . | . | . | . | . | . | . | . | . | . | . | . | . | . | . | . | . | . | . | . |
| 21-225_46F2_LC | . | . | . | . | . | . | . | . | . | . | . | T | . | . | . | . | . | . | . | . | . | . | . | T | . | . |
| 21-225_47C1_LC | . | . | . | . | . | . | . | . | . | . | . | . | . | . | . | . | . | . | . | . | . | . | . | . | . | . |
| 21-225_47E7_LC | . | . | . | . | . | . | . | . | . | . | . | . | . | . | . | . | . | . | . | . | . | . | . | . | . | . |
| 21-225_64H9_LC | E | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | K_CDR1 | | | | | | | | | | | | | | | | | | K_FR2 | | |
| CONSENSUS | - | - | Q | S | L | L | H | G | D | - | G | K | T | Y | L | Y | W | Y | L | Q | K | P | G | Q | P | P |
| 21-225_26F8_LC | . | . | . | . | . | . | . | . | . | . | . | . | . | . | . | . | . | . | . | . | . | . | . | . | . | . |
| 21-225_28G3_LC | . | . | . | . | . | . | . | . | . | . | . | . | . | . | . | . | . | . | . | . | . | . | . | . | . | . |
| 21-225_43E11_LC | . | . | . | . | . | . | . | S | . | . | . | S | . | . | . | . | . | . | . | . | . | . | . | . | . | . |
| 21-225_46F2_LC | . | . | . | . | . | . | . | . | . | . | . | . | . | . | . | . | . | . | . | . | . | . | . | . | . | . |
| 21-225_47C1_LC | . | . | . | . | . | . | . | S | E | . | . | S | . | . | . | . | . | . | . | . | . | . | . | . | . | . |
| 21-225_47E7_LC | . | . | . | . | . | . | . | S | . | . | . | S | . | . | . | Q | . | . | . | . | . | . | . | . | . | . |
| 21-225_64H9_LC | . | . | . | . | . | . | . | . | . | . | . | . | . | . | . | . | . | . | . | . | . | . | . | . | . | . |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | K_CDR2 | | | | | | | | | | | | | |
| CONSENSUS | Q | L | L | I | Y | E | . | . | . | . | . | . | . | . | V | S | N | R | F | S | G | V | P | D | R | F |
| 21-225_26F8_LC | . | . | . | . | . | . | . | . | . | . | . | . | . | . | . | . | . | . | . | . | . | . | . | . | . | . |
| 21-225_28G3_LC | . | . | . | . | . | . | . | . | . | . | . | . | . | . | . | . | . | . | . | . | . | . | . | E | . | . |
| 21-225_43E11_LC | . | V | . | . | . | . | . | . | . | . | . | . | . | . | . | . | . | . | . | . | . | . | . | . | . | . |
| 21-225_46F2_LC | . | . | . | . | . | . | . | . | . | . | . | . | . | . | . | . | . | . | . | . | . | . | . | . | . | . |
| 21-225_47C1_LC | . | . | . | . | . | . | . | . | . | . | . | . | . | . | . | . | S | . | . | . | . | . | . | . | . | . |
| 21-225_47E7_LC | . | V | . | . | . | . | . | . | . | . | . | . | . | . | . | . | . | . | . | . | . | . | . | . | . | . |
| 21-225_64H9_LC | . | . | . | . | . | . | . | . | . | . | . | . | . | . | . | . | . | . | L | Q | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K_FR4 | | | | | |
| CONSENSUS | . | . | . | . | L | P | W | T | F | G | Q | G | T | K | V | E | I | K | R |
| 21-225_26F8_LC | . | . | . | . | . | . | . | . | . | . | . | . | . | . | . | . | . | . | . |
| 21-225_28G3_LC | . | . | . | . | — | . | . | . | . | . | . | . | . | . | . | . | . | . | . |
| 21-225_43E11_LC | . | . | . | . | . | . | . | . | . | . | . | . | . | . | . | . | . | . | . |
| 21-225_46F2_LC | . | . | . | . | . | . | . | . | . | . | . | . | . | . | . | . | . | . | . |
| 21-225_47C1_LC | . | . | . | . | . | . | . | . | . | . | . | . | . | . | . | . | . | . | . |
| 21-225_47E7_LC | . | . | . | . | W | . | . | . | . | . | . | . | . | . | A | . | . | . | . |
| 21-225_84H9_LC | . | . | . | . | . | . | . | . | . | . | . | . | . | . | . | . | . | T | . |

FIGURE 57 (Continued)

Table 106. Consensus 26 - VK1|O12/JK3 (SEQ ID NO: 50323):

DIQMTQSPSSLSASVGDRVTITCRAS--QSIS-------SYLNWYQQKPGKAPKLLIYA-------ASSLQSGVPSRFSGSGSG--TDFTLTISSLQPEDFATYYCQQSYS--------------PPFTFGPGTKVDIKR wherein:

A at position 25 can be substituted with S or T
S at position 26 can be substituted with G or I
Q at position 29 can be substituted with H or R
S at position 30 can be substituted with N or T
I at position 31 can be substituted with F
S at position 32 can be substituted with I, F, N, R, Y, T, A, G or L
S at position 39 can be substituted with N, T, H or K
Y at position 40 can be substituted with F or H
L at position 41 can be substituted with V
N at position 42 can be substituted with I, M, H or Y
A at position 58 can be substituted with G, T, V or I
A at position 67 can be substituted with T, V or S
S at position 68 can be substituted with F
S at position 69 can be substituted with N, T or V
Q at position 71 can be substituted with H
S at position 72 can be substituted with N, G, H, I or T
S at position 109 can be substituted with T or Y
Y at position 110 can be substituted with N, F or H

FIGURE 57 (Continued)

S at position 111 can be substituted with R, N, F or I null (-) at position 134 can be substituted with A or S P at position 135 can be substituted with T, I, F, A, L or V P at position 136 can be substituted with L, F, or S T at position 138 can be substituted with A or S Arg Xaa Xaa Xaa Xaa Xaa Xaa Xaa Xaa Xaa Xaa Xaa (SEQ ID NO: 50153)

Xaa Xaa Xaa Xaa Leu Xaa Xaa (SEQ ID NO: 50154)

Gln Gln Xaa Xaa Xaa Xaa Xaa Xaa Phe Xaa (SEQ ID NO: 50155)

Arg Ala Ser Gln Ser Ile Ser Ser Tyr Leu Asn (SEQ ID NO: 50639)

Ala Ala Ser Ser Leu Gln Ser (SEQ ID NO: 50640)

Gln Gln Ser Tyr Ser Pro Pro Phe Thr (SEQ ID NO: 50641)

Table 107. Consensus 27 - VK4jB3/JK2 (SEQ ID NO: 50324):

DIVMTQSPDSLAVSLGERATINCKSS--QSVLYSSNNNNYLAWYQQKPGQPPKLLIYW-------ASTRESGVPDRFSGSGSG--
TDFTLTISSLQAEDVAVYYCQQYS-------------TPCSFGQGTKLEIKR wherein:

K at position 24 can be substituted with R or T

S at position 26 can be substituted with I

S at position 30 can be substituted with N

V at position 31 can be substituted with I

Y at position 33 can be substituted with H, S or F

S at position 34 can be substituted with N, I, R or H

N at position 36 can be substituted with H

N at position 37 can be substituted with S or D

N at position 38 can be substituted with Y, K, H, A, M or Q

N at position 39 can be substituted with K

Y at position 40 can be substituted with F

A at position 42 can be substituted with T or D

A at position 67 can be substituted with T, G or S

S at position 68 can be substituted with F

T at position 69 can be substituted with I

E at position 71 can be substituted with K or D

S at position 72 can be substituted with F

Q at position 107 can be substituted with H

FIGURE 57 (Continued)

Q at position 108 can be substituted with H

Y at position 109 can be substituted with S

Y at position 110 can be substituted with F, K, or N

S at position 111 can be substituted with T, I, null (-) or N

T at position 135 can be substituted with S, L, R, A, G or N

P at position 136 can be substituted with S

C at position 137 can be substituted with Y, G, L or P

S at position 138 can be substituted with K or N

Xaa Ser Xaa Gln Xaa Xaa Leu Xaa Xaa Ser Xaa Xaa Xaa Leu Xaa (SEQ ID NO: 50156)

Trp Xaa Xaa Xaa Arg Xaa Xaa (SEQ ID NO: 50157)

Xaa Xaa Xaa Xaa Xaa Xaa Xaa Xaa Xaa Xaa (SEQ ID NO: 50158)

Lys Ser Ser Gln Ser Val Leu Tyr Ser Ser Asn Asn Asn Tyr Leu Ala (SEQ ID NO: 50642)

Trp Ala Ser Thr Arg Glu Ser (SEQ ID NO: 50643)

Gln Gln Tyr Tyr Ser Thr Pro Cys Ser (SEQ ID NO: 50644)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | K_FR1 | | | | | | | | | | | | | | | |
| CONSENSUS | D | I | V | M | T | Q | S | P | D | S | L | A | V | S | L | G | E | R | A | T | I | N | C | K | S | S |
| 21-225_33D1_LC | . | . | . | . | . | . | . | . | . | . | . | S | . | . | . | . | . | . | . | . | . | . | . | . | . | . |
| 21-225_34H7_LC | . | . | . | . | . | . | . | . | . | . | . | . | . | . | . | . | . | . | . | . | . | . | . | . | . | . |
| 21-225_57F12_LC | . | . | . | . | . | . | . | . | . | . | . | . | . | . | . | . | . | . | . | . | . | . | . | . | . | . |
| 21-225_59E1_LC | . | . | . | . | . | . | . | . | . | . | . | T | . | . | . | . | . | . | . | . | . | . | . | . | . | . |
| 21-225_60F3_LC | . | . | . | . | . | . | . | . | . | . | . | . | . | . | . | . | . | . | . | . | . | . | . | . | . | . |
| 21-225_61E3_LC | . | . | . | . | . | . | . | . | . | . | . | . | . | . | . | . | . | . | . | . | . | . | . | . | . | . |
| 21-225_63F4_LC | . | . | . | . | . | . | . | . | . | . | . | . | . | . | . | . | A | . | . | . | . | . | . | . | . | . |
| 21-225_71F3_LC | . | . | . | . | . | . | . | . | . | . | . | . | . | . | . | . | . | . | V | A | . | . | . | . | . | . |
| 21-225_71G3_LC | . | . | . | . | . | . | . | . | . | . | . | . | . | . | . | . | . | . | . | . | . | . | . | . | . | . |
| 21-225_74A8_LC | . | . | . | . | . | . | . | . | . | . | . | . | . | . | . | . | . | . | . | . | . | . | . | . | . | . |
| 21-225_74C10_LC | . | . | . | . | . | . | . | . | . | . | . | . | . | . | . | . | . | . | . | . | . | . | . | . | . | . |
| 21-225_74C12_LC | . | . | . | . | . | . | . | . | . | . | . | . | . | . | . | . | . | . | . | . | . | . | . | . | . | . |
| 21-225_77D12_LC | . | . | . | . | . | . | . | . | . | . | . | . | . | . | . | . | A | . | . | . | . | . | . | X | . | . |
| 21-225_78E6_LC | . | . | . | . | . | . | . | . | . | . | . | . | . | . | . | . | . | . | . | . | . | . | . | . | . | . |
| 21-225_79G7_LC | . | . | . | . | . | . | . | . | . | . | . | . | . | . | . | . | . | . | . | . | . | X | . | . | . | . |
| 21-225_85C11_LC | . | . | . | . | . | . | . | . | . | . | . | . | . | . | . | . | . | . | . | . | . | . | . | . | . | . |
| 21-225_87E10_LC | . | . | . | . | . | . | . | . | . | . | . | . | . | . | . | . | . | . | . | . | . | . | . | . | . | . |
| 21-225_8B11_LC | . | . | . | . | . | . | . | . | . | . | . | . | . | . | . | . | . | . | . | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | Q | Q | Y | Y | S | | | | | | | | | | | K_CDR3 | | | | | | | | |
| 21-225_33D1_LC | . | . | . | . | . | . | . | . | . | . | . | . | . | . | . | . | . | . | . | . | . | . | . | . | . | . |
| 21-225_34H7_LC | . | . | . | . | . | . | T | . | . | . | . | . | . | . | . | . | . | . | . | . | . | . | . | . | . | . |
| 21-225_57F12_LC | . | . | . | . | . | . | . | . | . | . | . | . | . | . | . | . | . | . | . | . | . | . | . | . | . | . |
| 21-225_59E1_LC | . | . | . | . | . | & | . | . | . | . | . | . | . | . | . | . | . | . | . | . | . | . | . | . | . | . |
| 21-225_60F3_LC | . | . | . | . | . | . | . | . | . | . | . | . | . | . | . | . | . | . | . | . | . | . | . | . | . | . |
| 21-225_61E3_LC | . | . | . | . | . | . | T | . | . | . | . | . | . | . | . | . | . | . | . | . | . | . | . | . | . | . |
| 21-225_63F4_LC | . | . | . | . | . | . | T | . | . | . | . | . | . | . | . | . | . | . | . | . | . | . | . | . | . | . |
| 21-225_71F3_LC | . | . | . | . | . | . | . | . | . | . | . | . | . | . | . | . | . | . | . | . | . | . | . | . | . | . |
| 21-225_71G3_LC | . | . | . | . | . | . | T | . | . | . | . | . | . | . | . | . | . | . | . | . | . | . | . | . | . | . |
| 21-225_74A8_LC | . | . | . | . | . | . | . | . | . | . | . | . | . | . | . | . | . | . | . | . | . | . | . | . | . | . |
| 21-225_74C10_LC | . | . | . | . | . | . | . | . | . | . | . | . | . | . | . | . | . | . | . | . | . | . | . | . | . | . |
| 21-225_74C12_LC | . | . | . | . | . | . | . | . | . | . | . | . | . | . | . | . | . | . | . | . | . | . | . | . | . | . |
| 21-225_77D12_LC | . | . | . | . | . | . | T | . | . | . | . | . | . | . | . | . | . | . | . | . | . | . | . | . | . | . |
| 21-225_78E6_LC | . | . | . | . | . | . | . | . | . | . | . | . | . | . | . | . | . | . | . | . | . | . | . | . | . | . |
| 21-225_79G7_LC | . | . | . | . | . | . | . | . | . | . | . | . | . | . | . | . | . | . | . | . | . | . | . | . | . | . |
| 21-225_85C11_LC | . | . | . | . | . | . | T | . | . | . | . | . | . | . | . | . | . | . | . | . | . | . | . | . | . | . |
| 21-225_87E10_LC | . | . | . | . | . | . | . | . | . | . | . | . | . | . | . | . | . | . | . | . | . | . | . | . | . | . |
| 21-225_8B11_LC | . | . | . | . | . | . | . | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 | 144 K_FR4 | 145 | 146 | 147 | 148 | 149 |
|---|---|---|---|---|---|---|---|---|---|---|---|---|---|---|---|---|---|---|---|
| CONSENSUS | . | . | . | . | T | P | C | S | F | G | Q | G | T | K | L | E | I | K | R |
| 21-225_33D1_LC | | | | | S | | | | | | | | | | | | | | |
| 21-225_34H7_LC | | | | | S | | | | | | | | | | | | | | |
| 21-225_57F12_LC | | | | | N | | | | | | | | | | | | | N | |
| 21-225_59E1_LC | | | | | I | | | | | | | | | | | | | | |
| 21-225_60F3_LC | | | | | I | | | | | | | | | | | | | N | |
| 21-225_61E3_LC | | | | | | | | | | | | | | | | | | | |
| 21-225_63F4_LC | | | | | | | | | | | | | | | | | | | |
| 21-225_71F3_LC | | | | | | | | | | | | | | | | | | | |
| 21-225_71G3_LC | | | | | | | | | | | | | | | | | | | |
| 21-225_74A8_LC | | | | | | | | | | | | | | | | | | | |
| 21-225_74C10_LC | | | | | | | | | | | | | | | | | | | |
| 21-225_74C12_LC | | | | | | | | | | | | | | | | | | | |
| 21-225_77D12_LC | | | | | | | | | | | | | | | | | | | |
| 21-225_78E6_LC | | | | | | | | | | | | | | | | | | | |
| 21-225_79G7_LC | | | | | S | | | | | | | | | | | | | | |
| 21-225_85C11_LC | | | | | | | | | | | | | | | | | | | |
| 21-225_87E10_LC | | | | | | | | | | | | | | | | X | | | |
| 21-225_8B11_LC | | | | | | | | | | | | | | | | | | | |

FIGURE 57 (Continued)

Table 108.   Consensus 28 - VK1|L5/JK1 (SEQ ID NO: 50325):

DIQMTQSPSSVSASVGDRVTITCRAS--QGIS------NWLAWYQQKPGKAPKLLIYA-------ASSLQSGVPSRFSGSGSG--TDFTLTISSLQPEDFATYYCQQANS----------------FPWTFGQGTKVEIKR wherein:

S at position 26 can be substituted with N

G at position 30 can be substituted with D, F, N or V

I at position 31 can be substituted with L or V

S at position 32 can be substituted with N, T, I, F or G

N at position 39 can be substituted with S, D, T or R

W at position 40 can be substituted with C

A at position 58 can be substituted with G, D, T or S

A at position 67 can be substituted with V, P or T

S at position 68 can be substituted with F

S at position 69 can be substituted with N

S at position 72 can be substituted with G or N

Q at position 107 can be substituted with L

A at position 109 can be substituted with T, S, G, V or Y

N at position 110 can be substituted with D, H or Y

F at position 135 can be substituted with L

W at position 137 can be substituted with R or P

Arg Ala Xaa Gln Xaa Xaa Xaa Xaa Xaa Leu Ala (SEQ ID NO: 50159)

Xaa Xaa Xaa Xaa Leu Gln Xaa (SEQ ID NO: 50160)

FIGURE 57 (Continued)

Xaa Gln Xaa Xaa Ser Xaa Pro Xaa Thr (SEQ ID NO: 50161)

Arg Ala Ser Gln Gly Ile Ser Asn Trp Leu Ala (SEQ ID NO: 50645)

Ala Ala Ser Ser Leu Gln Ser (SEQ ID NO: 50646)

Gln Gln Ala Asn Ser Phe Pro Trp Thr (SEQ ID NO: 50647)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| CONSENSUS | D | I | Q | M | T | Q | S | P | S | S | V | S | A | S | V | G | D | R | V | T | I | T | C | R | A | S |
| 21-225_43H4_LC | . | . | . | . | . | . | . | . | . | . | . | . | . | . | . | . | . | . | . | . | . | . | . | . | . | . |
| 21-225_44C12_LC | . | . | . | . | . | . | . | . | . | . | . | . | . | . | . | . | . | . | . | . | . | . | . | . | . | . |
| 21-225_44D10_LC | . | . | . | . | . | . | . | . | . | . | . | . | . | . | . | . | . | . | . | . | . | . | . | . | . | . |
| 21-225_45F8_LC | . | . | . | . | . | . | . | . | . | . | . | . | . | . | . | . | . | . | . | . | . | . | . | . | . | . |
| 21-225_46A6_LC | . | . | . | . | N | . | . | . | . | . | . | . | . | . | . | . | . | . | . | N | . | . | . | . | . | . |
| 21-225_47G7_LC | . | . | . | . | . | . | . | . | . | . | . | . | . | . | . | . | . | . | . | . | . | . | . | . | . | . |
| 21-225_48D7_LC | . | . | . | . | . | . | . | . | . | . | . | . | . | . | . | . | . | . | . | . | . | . | . | . | . | . |
| 21-225_51G7_LC | . | . | . | . | . | . | . | . | . | . | . | . | . | . | . | . | . | . | . | . | . | . | . | . | . | . |
| 21-225_52H2_LC | . | . | . | . | . | . | . | . | . | . | . | . | . | . | . | . | . | . | . | . | . | . | . | . | . | . |
| 21-225_54G3_LC | . | . | . | . | . | . | . | . | . | . | . | . | . | . | . | . | . | . | . | . | . | . | . | . | . | . |
| 21-225_57F8_LC | . | . | . | . | . | . | . | . | . | . | . | . | . | . | . | . | . | . | . | . | . | . | . | . | . | . |
| 21-225_5A4_LC | . | . | . | . | . | . | . | . | . | . | . | . | . | . | . | . | . | . | . | . | . | . | . | . | . | . |
| 21-225_60A11_LC | . | . | . | . | . | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | K_FR3 | | | | | | | | | | | | | | | |
| CONSENSUS | S | G | S | G | S | G | - | - | T | D | F | T | L | T | I | S | S | L | Q | P | E | D | F | A | T | Y |
| 21-225_43H4_LC | | | | | | | | | | | | | | | | | N | | | | | | | | | |
| 21-225_44C12_LC | | | | | | | | | | | | | | S | | | | | | | | | | | | |
| 21-225_44D10_LC | | | | | | | | | | | | | | | | | N | | | | | | | | | |
| 21-225_45F8_LC | | | | | | | | | | | | | | | | | N | | | | | | | | | |
| 21-225_46A6_LC | | | | | | | | | | | | | | | | | N | | | | | | | | | |
| 21-225_47G7_LC | | | | | | | | | | | | | | | | | | | | | | | | | | |
| 21-225_48D7_LC | | | | | | | | | | | | | | | | | | | | | A | | | | | |
| 21-225_51G7_LC | | | | | | | | | | | | | | | | | | | | | | | | | | |
| 21-225_52H2_LC | | | | N | W | | | | | | | | | | | | | | | | | | | | | |
| 21-225_54G3_LC | | | | | | W | | | | | | | | | | | | | | | | | | V | | |
| 21-225_57F8_LC | | | | W | | | | | | | | | | | | | | | | | | | | | | |
| 21-225_5A4_LC | | | | | | | | | | | | | | | | | | | | | | | | | | |
| 21-225_60A11_LC | | | | | | | | | | | | | | | | | | | | | | | | | | |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | Q | Q | A | N | S | | | | | | | | | | | K_CDR3 | | | | | | | | |
| 21-225_149G7_LC | . | . | . | . | . | . | . | . | . | . | . | . | . | . | . | . | . | . | . | . | . | . | . | . | . | . |
| 21-225_154E8_LC | C | . | . | . | . | . | . | . | . | . | . | . | . | . | . | . | . | . | . | . | . | . | . | . | . | . |
| 21-225_171A8_LC | . | . | . | . | T | . | . | . | . | . | . | . | . | . | . | . | . | . | . | . | . | . | . | . | . | . |
| 21-225_171A9_LC | . | . | . | . | T | . | . | . | . | . | . | . | . | . | . | . | . | . | . | . | . | . | . | . | . | . |
| 21-225_171G4_LC | . | . | . | . | T | . | . | . | . | . | . | . | . | . | . | . | . | . | . | . | . | . | . | . | . | . |
| 21-225_174G7_LC | . | . | . | . | T | . | . | . | . | . | . | . | . | . | . | . | . | . | . | . | . | . | . | . | . | . |
| 21-225_176C10_LC | . | . | . | . | . | . | . | . | . | . | . | . | . | . | . | . | . | . | . | . | . | . | . | . | . | . |
| 21-225_178A5_LC | C | . | . | . | . | . | . | . | . | . | . | . | . | . | . | . | . | . | . | . | . | . | . | . | . | . |
| 21-225_178F7_LC | . | . | . | . | . | . | . | . | . | . | . | . | . | . | . | . | . | . | . | . | . | . | . | . | . | . |
| 21-225_179G1_LC | . | . | . | . | . | . | . | . | . | . | . | . | . | . | . | . | . | . | . | . | . | . | . | . | . | . |
| 21-225_17A4_LC | . | . | . | . | . | . | . | . | . | . | . | . | . | . | . | . | . | . | . | . | . | . | . | . | . | . |
| 21-225_188E8_LC | S | . | . | . | . | . | . | . | . | . | . | . | . | . | . | . | . | . | . | . | . | . | . | . | . | . |
| 21-225_190B9_LC | S | . | . | . | . | . | . | . | . | . | . | . | . | . | . | . | . | . | . | . | . | . | . | . | . | . |
| 21-225_190H3_LC | S | . | . | . | G | . | . | . | . | . | . | . | . | . | . | . | . | . | . | . | . | . | . | . | . | . |
| 21-225_193F2_LC | . | . | . | . | . | . | . | . | . | . | . | . | . | . | . | . | . | . | . | . | . | . | . | . | . | . |
| 21-225_194F7_LC | S | . | . | . | . | Q | . | . | . | . | . | . | . | . | . | . | . | . | . | . | . | . | . | . | . | . |
| 21-225_195G12_LC | . | . | . | . | . | . | . | . | . | . | . | . | . | . | . | . | . | . | . | . | . | . | . | . | . | . |
| 21-225_196B9_LC | C | . | . | . | S | . | . | . | . | . | . | . | . | . | . | . | . | . | . | . | . | . | . | . | . | . |
| 21-225_197C9_LC | C | . | . | . | S | Q | . | . | . | . | . | . | . | . | . | . | . | . | . | . | . | . | . | . | . | . |
| 21-225_20F7_LC | C | . | . | . | S | Y | . | . | . | . | . | . | . | . | . | . | . | . | . | . | . | . | . | . | . | . |
| 21-225_224D6_LC | C | . | . | . | Y | D | . | . | . | . | . | . | . | . | . | . | . | . | . | . | . | . | . | . | . | . |
| 21-225_227E4_LC | . | . | . | . | T | Q | . | . | . | . | . | . | . | . | . | . | . | . | . | . | . | . | . | . | . | . |
| 21-225_25B3_LC | . | . | . | . | T | D | . | . | . | . | . | . | . | . | . | . | . | . | . | . | . | . | . | . | . | . |
| 21-225_25D7_LC | . | . | . | . | . | . | . | . | . | . | . | . | . | . | . | . | . | . | . | . | . | . | . | . | . | . |
| 21-225_26D12_LC | . | . | . | . | . | . | . | . | . | . | . | . | . | . | . | . | . | . | . | . | . | . | . | . | . | . |
| 21-225_27A11_LC | . | . | . | . | . | . | . | . | . | . | . | . | . | . | . | . | . | . | . | . | . | . | . | . | . | . |
| 21-225_27C5_LC | . | . | . | . | . | . | . | . | . | . | . | . | . | . | . | . | . | . | . | . | . | . | . | . | . | . |
| 21-225_43C2_LC | . | . | . | . | . | . | . | . | . | . | . | . | . | . | . | . | . | . | . | . | . | . | . | . | . | . |
| 21-225_43E8_LC | . | . | . | . | . | . | . | . | . | . | . | . | . | . | . | . | . | . | . | . | . | . | . | . | . | . |

FIGURE 57 (Continued)

| Reference # | 105 | 106 | 107 | 108 | 109 | 110 | 111 | 112-130 (K_CDR3) |
|---|---|---|---|---|---|---|---|---|
| CONSENSUS | Y | C | Q | Q | A | N | S | |
| 21-225_43H4_LC | . | . | . | . | T | . | . | |
| 21-225_44C12_LC | . | . | . | . | S | . | . | |
| 21-225_44D10_LC | . | . | . | . | T | . | . | |
| 21-225_45F8_LC | . | . | . | . | T | . | . | |
| 21-225_46A6_LC | . | . | . | . | V | . | . | |
| 21-225_47G7_LC | C | . | . | . | . | . | . | |
| 21-225_48D7_LC | C | . | . | . | T | . | . | |
| 21-225_51G7_LC | . | . | . | . | . | . | . | |
| 21-225_52H2_LC | C | . | . | . | . | . | . | |
| 21-225_54G3_LC | . | . | . | . | . | . | . | |
| 21-225_57F8_LC | . | . | . | . | . | . | . | |
| 21-225_5A4_LC | . | . | . | . | . | . | . | |
| 21-225_80A11_LC | . | . | . | . | . | . | . | |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| CONSENSUS | L | - | - | - | F | P | W | T | F | G | Q | G | T | K | V | E | I | K | R |
| 21-225_43H4_LC | . | . | . | . | . | . | . | . | . | . | . | . | . | . | . | . | . | . | . |
| 21-225_44C12_LC | . | . | . | . | . | . | . | . | . | . | . | . | . | . | . | . | . | . | . |
| 21-225_44D10_LC | . | . | . | . | . | . | . | . | . | . | . | . | . | . | . | . | . | . | . |
| 21-225_45F8_LC | . | . | . | . | . | . | . | . | . | . | . | . | . | . | . | . | . | . | . |
| 21-225_46A6_LC | . | . | . | . | . | . | . | . | . | . | . | . | . | . | . | . | . | . | . |
| 21-225_47G7_LC | . | . | . | . | . | . | . | . | . | . | . | . | . | . | . | . | . | . | . |
| 21-225_48D7_LC | . | . | . | . | . | . | . | . | . | . | . | . | . | . | . | . | . | . | . |
| 21-225_51G7_LC | . | . | . | . | . | . | . | . | . | . | . | . | . | . | . | . | . | . | . |
| 21-225_52H2_LC | . | . | . | . | . | . | . | . | . | . | X | . | . | . | . | . | V | . | . |
| 21-225_54G3_LC | . | . | . | . | . | . | . | . | . | . | . | . | . | . | . | . | . | . | . |
| 21-225_57F8_LC | . | . | . | . | . | . | . | . | . | . | . | . | . | . | . | . | . | . | . |
| 21-225_5A4_LC | . | . | . | . | . | . | . | . | . | . | . | . | . | . | . | . | . | . | . |
| 21-225_60A11_LC | . | . | . | . | . | . | . | . | . | . | . | . | . | . | . | . | . | . | . |

FIGURE 57 (Continued)

Table 109. Consensus 29 - VK4jB3/JK3 (SEQ ID NO: 50326):

DIVMTQSPDSLAVSLGERATINCKSS--QSVLHSSNNNNYLAWYQQKPGQPPKLLIYW-------ASTRESGVPDRFSGSGSG--TDFTLTISSLQAEDVAVYYCQQYYS----------TPVTFGPGTKVDIKR wherein:

S at position 26 can be substituted with N
S at position 30 can be substituted with R or N
V at position 31 can be substituted with I or L
L at position 32 can be substituted with F
H at position 33 can be substituted with F, Y, K or S
S at position 34 can be substituted with N or H
N at position 36 can be substituted with H
N at position 37 can be substituted with S
N at position 38 can be substituted with K, Y or H
N at position 39 can be substituted with R or S
A at position 42 can be substituted with T or V
T at position 69 can be substituted with A, I or S
R at position 70 can be substituted with L
E at position 71 can be substituted with K or D
Q at position 107 can be substituted with H
Y at position 109 can be substituted with S
Y at position 110 can be substituted with C, F, S or H
S at position 111 can be substituted with N, Q, D or T FIGURE 57 (Continued)

T at position 135 can be substituted with L, I, A, F or S

V at position 137 can be substituted with F or P

Lys Ser Xaa Gln Xaa Xaa Xaa Xaa Xaa Ser Xaa Xaa Xaa Xaa Tyr Leu Xaa (SEQ ID NO: 50162)

Trp Ala Ser Xaa Xaa Xaa Ser (SEQ ID NO: 50163)

Xaa Gln Xaa Xaa Xaa Xaa Pro Xaa Thr (SEQ ID NO: 50164)

Lys Ser Ser Gln Ser Val Leu His Ser Ser Asn Asn Asn Asn Tyr Leu Ala (SEQ ID NO: 50648)

Trp Ala Ser Thr Arg Glu Ser (SEQ ID NO: 50649)

Gln Gln Tyr Tyr Ser Thr Pro Val Thr (SEQ ID NO: 50650)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | K_FR1 | | | | | | | | | | | | | | |
| CONSENSUS | D | I | V | M | T | Q | S | P | D | S | L | A | V | S | L | G | E | R | A | T | I | N | C | K | S | S |
| 21-225_4A2.001.008_LC | . | . | . | . | . | . | . | . | . | . | . | . | . | . | . | . | . | . | . | . | . | . | . | . | . | . |
| 21-225_4A2.001.009_LC | . | . | . | . | . | . | . | . | . | . | . | . | . | . | . | . | . | . | . | . | . | . | . | . | . | . |
| 21-225_4A2.001.010_LC | . | . | . | . | . | . | . | . | . | . | . | . | . | . | . | . | . | . | . | . | . | . | . | . | . | . |
| 21-225_4A2.001.011_LC | . | . | . | . | . | . | . | . | . | . | . | . | . | . | . | . | . | . | . | . | . | . | . | . | . | . |
| 21-225_4A2.001.012_LC | . | . | . | . | . | . | . | . | . | . | . | . | . | . | . | . | . | . | . | . | . | . | . | . | . | . |
| 21-225_4A2.001.022_LC | . | . | . | . | . | . | . | . | . | . | . | . | . | . | . | . | . | . | . | . | . | . | . | . | . | . |
| 21-225_4A2.001.024_LC | . | . | . | . | . | . | . | . | . | . | . | . | . | . | . | . | . | . | . | . | . | . | . | . | . | . |
| 21-225_6G6_LC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | K_CDR1 | | | | | | | | | | | | K_FR2 | | | | | | | |
| CONSENSUS | - | - | Q | S | V | L | H | S | S | N | N | N | N | Y | L | A | W | Y | Q | Q | K | P | G | Q | P | P |
| 21-225_4A2.001.008_LC | | | | | - | | | | | | | | | | | | | F | | | | | | | | |
| 21-225_4A2.001.009_LC | | | | | - | | | | | | | | | | | | | F | | | | | | | | |
| 21-225_4A2.001.010_LC | | | | | - | | | | | | | | | | | | | F | | | | | | | | |
| 21-225_4A2.001.011_LC | | | | | - | | | | | | | | | | | | | F | | | | | | | | |
| 21-225_4A2.001.012_LC | | | | | - | | | | | | | | | | | | | F | | | | | | | | |
| 21-225_4A2.001.022_LC | | | | | - | | | | | | | | | | | | | F | | | | | | | | |
| 21-225_4A2.001.024_LC | | | | | | | | N | | | | Y | | | | | | | | | | | | | | |
| 21-225_6G6_LC | | | | | | | | | | | | | | | | | | | | | | | | | | |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | K_FR3 | | | | | | | | | | | | | | |
| CONSENSUS | S | G | S | G | S | G | - | - | T | D | F | T | L | T | I | S | S | L | Q | A | E | D | V | A | V | Y |
| 21-225_4A2.001.008_LC | . | . | . | . | . | . | . | . | . | . | . | . | . | . | . | . | . | . | . | a | . | . | . | . | . | . |
| 21-225_4A2.001.009_LC | . | . | . | . | . | . | . | . | . | . | . | . | . | . | . | . | . | . | . | a | . | . | . | . | . | . |
| 21-225_4A2.001.010_LC | . | . | . | . | . | . | . | . | . | . | . | . | . | . | . | . | . | . | . | a | . | . | . | . | . | . |
| 21-225_4A2.001.011_LC | . | . | . | . | . | . | . | . | . | . | . | . | . | . | . | . | . | . | . | a | . | . | . | . | . | . |
| 21-225_4A2.001.012_LC | . | . | . | . | . | . | . | . | . | . | . | . | . | . | . | . | . | . | . | a | . | . | . | . | . | . |
| 21-225_4A2.001.022_LC | . | . | . | . | n | . | . | . | . | . | . | . | . | . | . | . | . | . | . | a | . | . | . | . | . | . |
| 21-225_4A2.001.024_LC | . | . | . | . | . | . | . | . | . | . | . | . | . | n | . | . | . | . | . | a | . | . | . | . | . | . |
| 21-225_6G6_LC | . | . | . | . | . | . | . | . | . | . | . | . | . | . | . | . | . | . | . | . | . | . | . | . | . | . |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | | |
| CONSENSUS_LC | Y | C | Q | Q | Y | Y | S | . | . | . | . | . | . | . | . | . | . | . | . | . | . | . | . | . | . | . |
| 21-225_4A2.001.008_LC | . | . | . | . | . | . | . | . | . | . | . | . | . | . | . | . | . | . | . | . | . | . | . | . | . | . |
| 21-225_4A2.001.009_LC | . | . | . | . | . | . | N | . | . | . | . | . | . | . | . | . | . | . | . | . | . | . | . | . | . | . |
| 21-225_4A2.001.010_LC | . | . | . | . | . | . | G | . | . | . | . | . | . | . | . | . | . | . | . | . | . | . | . | . | . | . |
| 21-225_4A2.001.011_LC | . | . | . | . | . | . | G | . | . | . | . | . | . | . | . | . | . | . | . | . | . | . | . | . | . | . |
| 21-225_4A2.001.012_LC | . | . | . | . | . | . | G | . | . | . | . | . | . | . | . | . | . | . | . | . | . | . | . | . | . | . |
| 21-225_4A2.001.022_LC | . | . | . | . | . | . | . | . | . | . | . | . | . | . | . | . | . | . | . | . | . | . | . | . | . | . |
| 21-225_4A2.001.024_LC | . | . | . | . | . | . | D | . | . | . | . | . | . | . | . | . | . | . | . | . | . | . | . | . | . | . |
| 21-225_6G6_LC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| CONSENSUS | | | | | T | P | V | T | F | G | P | G | T | K | V | D | I | K | R |
| 21-225_4A2.001.008_LC | | | | | | | | | | | | | | | | Q | | | |
| 21-225_4A2.001.009_LC | | | | | A | | | | | | | | | | | Q | | | |
| 21-225_4A2.001.010_LC | | | | | | | | | | | | | | | | Q | | | |
| 21-225_4A2.001.011_LC | | | | | | | | | | | | | | | | Q | | | |
| 21-225_4A2.001.012_LC | | | | | | | | | | | | | | | | Q | | | |
| 21-225_4A2.001.022_LC | | | | | | | A | | | | | | | | | Q | | | |
| 21-225_4A2.001.024_LC | | | | | | | | | | | P | | | | | | | | |
| 21-225_6G6_LC | | | | | | | | | | | | | | | | | | | |

FIGURE 57 (Continued)

Table 110. Consensus 30 - VL7|7a/JL2 (SEQ ID NO: 50327):

QTVVTQE-PSLTVSPGGTVTLTCASST-GAVTSG----YYPNWFQQKPGQAPRALIYS--------TSNKHSWTPARFSGSLLG--
GKAALTLSGVQPEDEAEYYCLLYYG-----------GAQLVFGGGTKLTVLG wherein:

A at position 24 can be substituted with V or G
S at position 25 can be substituted with F or L
S at position 26 can be substituted with N
G at position 29 can be substituted with E
A at position 30 can be substituted with S or T
G at position 34 can be substituted with A
Y at position 39 can be substituted with S, N or F
Y at position 40 can be substituted with F
N at position 42 can be substituted with S or Q
S at position 58 can be substituted with H or N
S at position 68 can be substituted with N, D, I or T
K at position 70 can be substituted with R
L at position 107 can be substituted with M
L at position 108 can be substituted with I or F
Y at position 109 can be substituted with F
Y at position 110 can be substituted with C, F or S
G at position 111 can be substituted with D
A at position 135 can be substituted with V FIGURE 57 (Continued)

Q at position 136 can be substituted with H

L at position 137 can be substituted with V or M

V at position 138 can be substituted with A, I, G or M

Xaa Xaa Xaa Thr Xaa Xaa Val Thr Ser Xaa Xaa Xaa Pro Xaa (SEQ ID NO: 50165)

Xaa Thr Xaa Asn Xaa His Ser (SEQ ID NO: 50166)

Xaa Xaa Xaa Xaa Gly Xaa Xaa Xaa Xaa (SEQ ID NO: 50167)

Ala Ser Ser Thr Gly Ala Val Thr Ser Gly Tyr Tyr Pro Asn (SEQ ID NO: 50651)

Ser Thr Ser Asn Lys His Ser (SEQ ID NO: 50652)

Leu Leu Tyr Tyr Gly Gly Ala Gln Leu Val (SEQ ID NO: 50653)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | L_FR1 | | | | | | | | | | | | | | | |
| CONSENSUS | Q | T | V | V | T | Q | E | - | P | S | L | T | V | S | P | G | G | T | V | T | L | T | C | A | S | S |
| 21-225_74E5_LC | . | . | . | . | . | . | . | | . | . | . | . | . | . | . | . | . | . | . | . | . | . | . | . | . | . |
| 21-225_78D10_LC | . | . | . | . | . | . | . | | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| CONSENSUS | S | G | S | L | L | G | . | . | G | K | A | A | L | T | L | S | G | V | Q | P | E | D | E | A | E | Y |
| 21-225_7AE5_LC | . | . | . | . | . | . | . | . | . | . | . | . | . | . | . | . | D | . | . | . | . | . | . | . | . | . |
| 21-225_78D10_LC | . | . | . | . | . | . | . | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 L_FR4 | 144 | 145 | 146 | 147 | 148 | 149 |
|---|---|---|---|---|---|---|---|---|---|---|---|---|---|---|---|---|---|---|---|
| CONSENSUS | - | - | - | G | A | Q | L | V | F | G | G | G | T | K | L | T | V | L | G |
| 21-225_190D1_LC | . | . | . | . | . | . | . | A | . | . | . | . | . | . | . | . | . | . | . |
| 21-225_190F10_LC | . | . | . | . | . | . | . | . | . | . | . | . | . | . | . | . | . | . | . |
| 21-225_191A2_LC | . | . | . | . | . | . | . | L | . | . | . | . | . | . | . | . | . | . | S |
| 21-225_191H9_LC | . | . | . | . | V | . | V | L | . | . | . | . | . | . | . | . | . | . | . |
| 21-225_192E3_LC | . | . | . | . | . | X | V | X | . | . | . | . | . | . | . | . | . | . | . |
| 21-225_192G7_LC | . | . | . | . | . | . | V | A | . | . | . | . | . | . | . | . | . | . | . |
| 21-225_192H8_LC | . | . | . | . | . | . | . | X | . | . | . | . | . | . | . | . | . | . | . |
| 21-225_194D12_LC | . | . | . | . | . | . | . | L | . | . | . | . | . | . | . | . | . | . | . |
| 21-225_194G5_LC | . | . | . | . | V | X | V | . | . | . | . | . | . | . | . | . | . | . | . |
| 21-225_196E7_LC | . | . | . | . | V | X | V | X | . | . | . | . | . | . | . | . | . | . | . |
| 21-225_197B11_LC | . | . | . | . | . | . | . | L | . | . | . | . | . | . | . | . | . | . | . |
| 21-225_197C11_LC | . | . | . | . | . | . | . | . | . | . | . | . | . | . | . | . | . | . | . |
| 21-225_198B8_LC | . | . | . | . | . | . | . | A | . | . | . | . | . | . | . | . | . | . | . |
| 21-225_200A11_LC | . | . | . | . | . | . | . | . | . | . | . | . | . | . | . | . | . | . | . |
| 21-225_200G9_LC | . | . | . | . | . | . | . | A | . | . | . | . | . | . | . | . | . | . | . |
| 21-225_200H1_LC | . | . | . | . | . | . | . | A | . | . | . | . | . | . | . | . | . | . | S |
| 21-225_210F11_LC | . | . | . | . | . | . | . | G | . | . | . | . | . | . | . | . | . | . | . |
| 21-225_211C9_LC | . | . | . | . | . | . | . | . | . | . | . | . | . | . | . | . | . | . | . |
| 21-225_211E9_LC | . | . | . | . | . | . | . | A | . | . | . | . | . | . | . | . | . | . | . |
| 21-225_211H7_LC | . | . | . | . | . | . | V | . | . | . | . | . | . | . | . | . | . | . | . |
| 21-225_212A9_LC | . | . | . | . | . | . | V | . | . | . | . | . | . | . | . | . | . | . | . |
| 21-225_212H12_LC | . | . | . | . | . | . | . | . | . | . | . | . | . | . | . | . | . | . | . |
| 21-225_213F5_LC | . | . | . | . | . | . | . | . | . | . | . | . | . | . | . | . | . | . | . |
| 21-225_214E12_LC | . | . | . | . | . | . | V | A | . | . | . | . | . | . | . | . | . | . | S |
| 21-225_214H3_LC | . | . | . | . | . | . | . | . | . | . | . | . | . | . | . | . | A | . | . |
| 21-225_215A3_LC | . | . | . | . | . | . | . | . | . | . | . | . | . | . | . | . | . | . | . |
| 21-225_215H3_LC | . | . | . | . | . | . | V | G | . | . | . | . | . | . | . | . | . | . | S |
| 21-225_216A7_LC | . | . | . | . | . | . | V | G | . | . | . | . | . | . | . | . | . | . | S |
| 21-225_216H11_LC | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | LFR4 | | | | | |
| CONSENSUS | - | - | - | G | A | Q | L | V | F | G | G | G | T | K | L | T | V | L | G |
| 21-225_74E5_LC | | | | | | | | | | | | | | | | | | | |
| 21-225_78D10_LC | | | | | | | | | | | | | | | | | | | |

FIGURE 57 (Continued)

Table 111. Consensus 31 - VK3|L2/JK2 (SEQ ID NO: 50328):

EIVMTQSPATLSVSPGERATLSCRAS--QSVN----SNLAWYQQKPGQAPRLLIYG-------ASTRATGIPARFSGSGSG--
TEFTLTISSLQSEDFAVYYCQQYND----------------WPCSFGQGTKLEIKR wherein:

A at position 25 can be substituted with S

Q at position 29 can be substituted with L, M or V

S at position 30 can be substituted with N, D, R or T

V at position 31 can be substituted with I

N at position 32 can be substituted with K, S, V, A, I or L

S at position 39 can be substituted with N or T

N at position 40 can be substituted with S or Y

G at position 58 can be substituted with I, F or V

A at position 67 can be substituted with T

T at position 69 can be substituted with I

Q at position 108 can be substituted with E

Y at position 109 can be substituted with F

N at position 110 can be substituted with Y or D

D at position 111 can be substituted with N

Null (-) at position 134 can be substituted with W

W at position 135 can be substituted with P

P at position 136 can be substituted with L or M

FIGURE 57 (Continued)

Arg Xaa Ser Xaa Xaa Xaa Xaa Xaa Xaa Leu Ala (SEQ ID NO: 50168)

Xaa Xaa Ser Xaa Arg Ala Thr (SEQ ID NO: 50169)

Gln Xaa Xaa Xaa Xaa Xaa Xaa Xaa Cys Ser (SEQ ID NO: 50170)

Arg Ala Ser Gln Ser Val Asn Ser Asn Leu Ala (SEQ ID NO: 50654)

Gly Ala Ser Thr Arg Ala Thr (SEQ ID NO: 50655)

Gln Gln Tyr Asn Asp Trp Pro Cys Ser (SEQ ID NO: 50656)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| CONSENSUS | E | I | V | M | T | Q | S | P | A | T | L | S | V | S | P | G | E | R | A | T | L | S | C | R | A | S |
| 21-225_162A10_LC | . | . | . | . | . | . | . | . | . | . | . | . | . | . | . | . | . | . | . | . | . | . | . | . | . | . |
| 21-225_183G12_LC | . | . | . | . | . | . | . | . | . | . | . | . | . | . | . | . | . | S | . | . | . | . | . | . | S | . |
| 21-225_201A4_LC | . | . | . | . | . | . | . | . | . | . | . | . | . | . | . | . | . | . | . | . | . | . | . | . | . | . |
| 21-225_201F2_LC | . | . | . | . | . | . | . | . | . | . | . | . | . | . | . | . | . | . | . | . | . | . | . | . | . | . |
| 21-225_201F7_LC | . | . | . | . | . | . | . | . | . | . | . | . | . | . | . | . | . | . | . | . | . | . | . | . | . | . |
| 21-225_201H4_LC | . | . | . | . | . | . | . | . | . | . | . | . | . | . | . | . | . | . | . | . | . | . | . | . | . | . |
| 21-225_202A8_LC | . | . | . | . | . | . | . | . | . | . | . | . | . | . | . | . | . | . | . | . | . | . | . | . | . | . |
| 21-225_202F12_LC | . | . | . | . | . | . | . | . | . | . | . | . | . | . | . | . | . | . | . | . | . | . | . | . | . | . |
| 21-225_205G4_LC | . | . | . | . | . | . | . | . | . | . | . | . | . | . | . | . | . | . | . | . | . | . | . | . | . | . |
| 21-225_210H10_LC | . | . | . | . | . | . | . | . | . | . | . | . | . | . | . | . | . | . | . | . | . | . | . | . | . | . |
| 21-225_212C10_LC | . | . | . | . | . | . | . | . | . | . | . | . | . | . | . | . | . | . | . | . | . | . | . | . | . | . |
| 21-225_216B10_LC | . | . | . | . | . | . | W | . | . | . | . | . | . | . | . | . | . | . | . | . | . | . | . | . | . | . |
| 21-225_24H3_LC | . | . | . | . | . | . | . | . | . | . | . | . | . | . | . | . | . | . | . | . | . | . | . | . | . | . |
| 21-225_57H3_LC | . | . | . | . | . | . | . | . | . | . | . | . | . | . | . | . | . | . | . | . | . | . | . | . | . | . |
| 21-225_62E6_LC | . | . | . | . | . | . | . | . | V | . | . | R | . | . | . | . | . | . | . | . | . | . | . | . | . | . |
| 21-225_65A6_LC | . | . | . | . | . | . | . | . | . | . | . | . | . | . | . | . | . | . | . | . | . | . | . | . | . | . |
| 21-225_67C3_LC | . | . | . | . | . | . | . | . | . | . | . | . | . | . | . | . | . | . | . | . | . | . | . | . | . | . |
| 21-225_70A5_LC | . | . | . | . | . | . | . | . | . | . | . | . | . | . | . | . | . | . | . | . | . | . | . | . | . | . |
| 21-225_74C3_LC | . | . | . | . | . | . | . | . | . | . | . | . | . | . | . | . | . | . | . | . | . | . | . | . | . | . |
| 21-225_74E11_LC | . | . | . | . | . | . | . | . | . | . | . | . | L | . | . | . | . | . | . | . | . | . | . | . | . | . |
| 21-225_74E3_LC | . | . | . | . | . | . | . | . | . | . | . | . | . | . | . | . | . | . | . | . | . | . | . | . | . | . |
| 21-225_76D2_LC | . | . | . | . | . | . | . | . | . | . | R | . | . | . | . | . | . | . | . | . | . | . | . | . | . | . |
| 21-225_77H5_LC | . | . | . | . | . | . | . | . | V | . | . | . | . | . | . | . | . | . | . | . | . | . | . | . | . | . |
| 21-225_92H5_LC | . | . | . | . | . | . | . | . | . | . | . | . | . | . | . | . | . | . | . | . | . | . | . | . | . | . |
| 21-225_95G2_LC | . | . | . | . | . | . | . | . | . | . | . | . | L | . | . | . | . | . | . | . | . | . | . | . | . | . |

K_CDR3

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | Q | Q | Y | N | D | . | . | . | . | . | . | . | . | . | . | . | . | . | . | . | . | . | . | . |
| 21-225_162A10_LC | F | . | . | . | . | . | . | . | . | . | . | . | . | . | . | . | . | . | . | . | . | . | . | . | . | . |
| 21-225_193G12_LC | . | . | . | . | . | . | . | . | . | . | . | . | . | . | . | . | . | . | . | . | . | . | . | . | . | . |
| 21-225_201A4_LC | . | . | . | . | . | Y | N | . | . | . | . | . | . | . | . | . | . | . | . | . | . | . | . | . | . | . |
| 21-225_201F2_LC | . | . | . | E | F | Y | N | . | . | . | . | . | . | . | . | . | . | . | . | . | . | . | . | . | . | . |
| 21-225_201F7_LC | . | . | . | . | F | Y | N | . | . | . | . | . | . | . | . | . | . | . | . | . | . | . | . | . | . | . |
| 21-225_201H4_LC | . | . | . | . | . | . | . | . | . | . | . | . | . | . | . | . | . | . | . | . | . | . | . | . | . | . |
| 21-225_202A8_LC | . | . | . | . | . | Y | N | . | . | . | . | . | . | . | . | . | . | . | . | . | . | . | . | . | . | . |
| 21-225_202F12_LC | . | . | . | . | . | D | N | . | . | . | . | . | . | . | . | . | . | . | . | . | . | . | . | . | . | . |
| 21-225_205G4_LC | S | . | . | . | F | Y | N | . | . | . | . | . | . | . | . | . | . | . | . | . | . | . | . | . | . | . |
| 21-225_210H10_LC | S | . | . | . | . | . | . | . | . | . | . | . | . | . | . | . | . | . | . | . | . | . | . | . | . | . |
| 21-225_212C10_LC | . | . | . | . | . | . | . | . | . | . | . | . | . | . | . | . | . | . | . | . | . | . | . | . | . | . |
| 21-225_216B10_LC | . | . | . | . | . | . | N | . | . | . | . | . | . | . | . | . | . | . | . | . | . | . | . | . | . | . |
| 21-225_24H3_LC | . | . | . | . | . | . | . | . | . | . | . | . | . | . | . | . | . | . | . | . | . | . | . | . | . | . |
| 21-225_57H3_LC | . | . | . | . | . | . | . | . | . | . | . | . | . | . | . | . | . | . | . | . | . | . | . | . | . | . |
| 21-225_62E6_LC | . | . | . | . | . | . | . | . | . | . | . | . | . | . | . | . | . | . | . | . | . | . | . | . | . | . |
| 21-225_65A6_LC | . | . | . | . | . | . | . | . | . | . | . | . | . | . | . | . | . | . | . | . | . | . | . | . | . | . |
| 21-225_67C3_LC | . | . | . | . | . | . | . | . | . | . | . | . | . | . | . | . | . | . | . | . | . | . | . | . | . | . |
| 21-225_70A5_LC | . | . | . | . | . | . | . | . | . | . | . | . | . | . | . | . | . | . | . | . | . | . | . | . | . | . |
| 21-225_74C3_LC | . | . | . | . | . | . | . | . | . | . | . | . | . | . | . | . | . | . | . | . | . | . | . | . | . | . |
| 21-225_74E11_LC | . | . | . | . | . | . | . | . | . | . | . | . | . | . | . | . | . | . | . | . | . | . | . | . | . | . |
| 21-225_74E3_LC | . | . | . | . | . | . | . | . | . | . | . | . | . | . | . | . | . | . | . | . | . | . | . | . | . | . |
| 21-225_76D2_LC | . | . | . | . | . | . | . | . | . | . | . | . | . | . | . | . | . | . | . | . | . | . | . | . | . | . |
| 21-225_77H5_LC | F | . | . | E | . | . | . | . | . | . | . | . | . | . | . | . | . | . | . | . | . | . | . | . | . | . |
| 21-225_92H5_LC | . | . | . | . | . | . | . | . | . | . | . | . | . | . | . | . | . | . | . | . | . | . | . | . | . | . |
| 21-225_95G2_LC | . | . | . | . | . | . | . | . | . | . | . | . | . | . | . | . | . | . | . | . | . | . | . | . | . | . |

Table 112. Consensus 32 - VK3|A27/JK4 (SEQ ID NO: 50329):

EFMLTQSPGTLSLSPGERATLSCRAS--QSVSS-----SYLVWYQQKPGQAPRLLIYG--------ASTRATGIPDRFSGSGSG--
TDFTLTISRLEPEYFAVYYCQQYGC--------------SPLTFGGGTKVEITR wherein:

A at position 25 can be substituted with S

Q at position 29 can be substituted with E

S at position 30 can be substituted with R

V at position 31 can be substituted with I

S at position 32 can be substituted with T

S at position 33 can be substituted with T

S at position 39 can be substituted with N

Y at position 40 can be substituted with A

V at position 42 can be substituted with S

T at position 69 can be substituted with S

T at position 72 can be substituted with S or I

G at position 110 can be substituted with V

C at position 111 can be substituted with N or S

P at position 136 can be substituted with L

Arg Xaa Ser Xaa Xaa Xaa Xaa Xaa Xaa Xaa Leu Xaa (SEQ ID NO: 50171)

Gly Ala Ser Xaa Arg Ala Xaa (SEQ ID NO: 50172)

FIGURE 57 (Continued)

Gln Gln Tyr Xaa Xaa Ser Xaa Xaa Leu Thr (SEQ ID NO: 50173)

Arg Ala Ser Gln Ser Val Ser Ser Ser Tyr Leu Val (SEQ ID NO: 50657)

Gly Ala Ser Thr Arg Ala Thr (SEQ ID NO: 50658)

Gln Gln Tyr Gly Cys Ser Pro Leu Thr (SEQ ID NO: 50659)

Table 113. Consensus 33 – VK2|A18/JK4 (SEQ ID NO: 50330):

DIVMTQTPLSLSVTPGQPASISCKSS--QSLLHSE-GKTYLYWYLQKPGQPPQLLIYE--------VSNRFSGVPDRFSGSGSG--TDFTLKISRVEAEDVGVYYCMQSIQ--------------LPLTFGGGTKVEIKR wherein:

S at position 30 can be substituted with T

L at position 32 can be substituted with Q

H at position 33 can be substituted with R

S at position 34 can be substituted with G

E at position 35 can be substituted with D

K at position 38 can be substituted with R

Y at position 40 can be substituted with H or F

Y at position 42 can be substituted with N

V at position 67 can be substituted with I

N at position 69 can be substituted with Y or H

F at position 71 can be substituted with L, V or L

M at position 107 can be substituted with F

Q at position 108 can be substituted with H

S at position 109 can be substituted with G or N

I at position 110 can be substituted with K or T

Q at position 111 can be substituted with null (-), K or H

FIGURE 57 (Continued)

L at position 135 can be substituted with Q, Y, F or H

P at position 136 can be substituted with L or V

L at position 137 can be substituted with F or P

T at position 138 can be substituted with P or S

Lys Ser Ser Gln Xaa Leu Xaa Xaa Xaa Gly Xaa Thr Xaa Leu Xaa (SEQ ID NO: 50174)

Glu Xaa Ser Xaa Arg Xaa Ser (SEQ ID NO: 50175)

Xaa Xaa Xaa Xaa Xaa Xaa Xaa Xaa Xaa (SEQ ID NO: 50176)

Lys Ser Ser Gln Ser Leu Leu His Ser Glu Gly Lys Thr Tyr Leu Tyr (SEQ ID NO: 50660)

Glu Val Ser Asn Arg Phe Ser (SEQ ID NO: 50661)

Met Gln Ser Ile Gln Leu Pro Leu Thr (SEQ ID NO: 50662)

Table 114. Consensus 34 - VL2j2a2/JL3b (SEQ ID NO: 50331):

QSALTQP-ASVSGSPGQSITISCTGTS-SDVGGY----NYVSWYQQHPGKAPKLMIYE--------VSNRPSGVSNRFSGSKSG--NTASLTISGLQAEDEADYYCNSYTR-----------SITWVFGGGTKLTVLG wherein:

V at position 31 can be substituted with I

G at position 33 can be substituted with S

Y at position 40 can be substituted with F

S at position 68 can be substituted with R

N at position 107 can be substituted with G, C or S

T at position 110 can be substituted with V or K

R at position 111 can be substituted with S or K

S at position 134 can be substituted with G, N or R

I at position 135 can be substituted with S or Y

Thr Gly Thr Ser Ser Asp Xaa Gly Xaa Tyr Asn Xaa Val Ser (SEQ ID NO: 50177)

Glu Val Xaa Asn Arg Pro Ser (SEQ ID NO: 50178)

Xaa Ser Tyr Xaa Xaa Xaa Xaa Thr Trp Val (SEQ ID NO: 50179)

Thr Gly Thr Ser Ser Asp Val Gly Gly Tyr Asn Tyr Val Ser (SEQ ID NO: 50663)

Glu Val Ser Asn Arg Pro Ser (SEQ ID NO: 50664)

Asn Ser Tyr Arg Ser Ile Thr Trp Val (SEQ ID NO: 50665)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | L_CDR3 | | | | | | | | |
| CONSENSUS | Y | C | N | S | Y | T | R | . | . | . | . | . | . | . | . | . | . | . | . | . | . | . | . | . | . | . |
| 21-225_178H8_LC | . | . | S | . | . | . | S | . | . | . | . | . | . | . | . | . | . | . | . | . | . | . | . | . | . | . |
| 21-225_210D12_LC | . | . | . | . | . | . | S | . | . | . | . | . | . | . | . | . | . | . | . | . | . | . | . | . | . | . |
| 21-225_210E12_LC | . | . | D | . | . | V | . | . | . | . | . | . | . | . | . | . | . | . | . | . | . | . | . | . | . | . |
| 21-225_211C1_LC | . | . | . | . | . | . | S | . | . | . | . | . | . | . | . | . | . | . | . | . | . | . | . | . | . | . |
| 21-225_211G5_LC | . | . | D | S | . | V | . | . | . | . | . | . | . | . | . | . | . | . | . | . | . | . | . | . | . | . |
| 21-225_212A4_LC | . | . | . | . | . | . | S | . | . | . | . | . | . | . | . | . | . | . | . | . | . | . | . | . | . | . |
| 21-225_212C2_LC | . | . | . | . | . | . | S | . | . | . | . | . | . | . | . | . | . | . | . | . | . | . | . | . | . | . |
| 21-225_212F6_LC | . | . | C | . | . | . | . | . | . | . | . | . | . | . | . | . | . | . | . | . | . | . | . | . | . | . |
| 21-225_212G7_LC | . | . | . | . | . | . | . | . | . | . | . | . | . | . | . | . | . | . | . | . | . | . | . | . | . | . |
| 21-225_213D6_LC | . | . | . | . | . | V | S | . | . | . | . | . | . | . | . | . | . | . | . | . | . | . | . | . | . | . |
| 21-225_213G3_LC | . | . | . | . | . | . | S | . | . | . | . | . | . | . | . | . | . | . | . | . | . | . | . | . | . | . |
| 21-225_215D3_LC | . | . | . | . | . | . | . | . | . | . | . | . | . | . | . | . | . | . | . | . | . | . | . | . | . | . |
| 21-225_216A3_LC | . | . | D | . | . | V | S | . | . | . | . | . | . | . | . | . | . | . | . | . | . | . | . | . | . | . |
| 21-225_217B2_LC | . | . | C | . | . | . | . | . | . | . | . | . | . | . | . | . | . | . | . | . | . | . | . | . | . | . |
| 21-225_219A7_LC | . | . | . | . | . | . | . | . | . | . | . | . | . | . | . | . | . | . | . | . | . | . | . | . | . | . |
| 21-225_221G4_LC | . | . | . | . | . | . | . | . | . | . | . | . | . | . | . | . | . | . | . | . | . | . | . | . | . | . |
| 21-225_221H2_LC | . | . | . | . | . | . | . | . | . | . | . | . | . | . | . | . | . | . | . | . | . | . | . | . | . | . |
| 21-225_52H4_LC | . | . | . | . | . | . | S | . | . | . | . | . | . | . | . | . | . | . | . | . | . | . | . | . | . | . |

Table 115. Consensus 35 - VK1jO12/JK1 (SEQ ID NO: 50332):

DIQMTQSPSSLSASVGDRVTITCRAS--QSIS------NYLNWYQQKPGKAPKLLIYA------ASSLQSGVPSRFSGSGSG--
TDFTLTISSLQPEDFATYYCQQSYS----------------TPTWTFGQGTKVEIKR wherein:

A at position 25 can be substituted with S

Q at position 29 can be substituted with H or R

S at position 30 can be substituted with N, T or H

S at position 32 can be substituted with N, G or T

N at position 39 can be substituted with S or R

Y at position 40 can be substituted with F

A at position 58 can be substituted with T, S or V

A at position 67 can be substituted with T, E or V

S at position 68 can be substituted with L

S at position 69 can be substituted with N

Q at position 71 can be substituted with H

S at position 72 can be substituted with I

S at position 109 can be substituted with G or T

S at position 111 can be substituted with T, N or R

T at position 134 can be substituted with S or null (-)

P at position 135 can be substituted with I

T at position 136 can be substituted with P, Q or L

FIGURE 57 (Continued)

Arg Xaa Ser Xaa Xaa Ile Xaa Xaa Xaa Xaa Leu Asn (SEQ ID NO: 50180)

Xaa Xaa Xaa Xaa Leu Xaa Xaa (SEQ ID NO: 50181)

Gln Gln Xaa Tyr Xaa Xaa Xaa Xaa Xaa Trp Thr (SEQ ID NO: 50182)

Arg Ala Ser Gln Ser Ile Ser Asn Tyr Leu Asn (SEQ ID NO: 50666)

Ala Ala Ser Ser Leu Gln Ser (SEQ ID NO: 50667)

Gln Gln Ser Tyr Ser Thr Pro Thr Trp Thr (SEQ ID NO: 50668)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | K_CDR2 | | | | | | | | | | | | | | |
| CONSENSUS | K | L | L | I | Y | A | . | . | . | . | . | . | . | A | S | S | L | Q | S | G | V | P | S | R | F |
| 21-225_157F3_LC | . | . | . | . | . | . | . | . | . | . | . | . | . | . | . | . | . | . | . | . | . | . | . | . | . |
| 21-225_173E7_LC | . | . | . | . | . | T | . | . | . | . | . | . | . | . | . | . | . | . | . | . | . | . | . | G | . |
| 21-225_175G10_LC | . | . | . | . | F | T | . | . | . | . | . | . | . | T | . | . | . | X | . | . | . | . | . | . | . |
| 21-225_17A1_LC | . | V | . | . | F | T | . | . | . | . | . | . | . | T | . | . | . | . | . | . | . | . | . | . | . |
| 21-225_17B10_LC | . | V | . | . | L | T | . | . | . | . | . | . | . | T | . | . | . | X | . | . | . | . | . | . | . |
| 21-225_17B12_LC | . | . | . | . | . | V | . | . | . | . | . | . | . | V | L | N | . | . | . | . | . | . | . | . | . |
| 21-225_181G3_LC | N | . | . | . | . | . | . | . | . | . | . | . | . | W | . | . | . | . | . | . | . | . | . | . | . |
| 21-225_183A12_LC | . | V | . | . | L | T | . | . | . | . | . | . | . | W | . | . | . | . | . | . | . | . | . | . | . |
| 21-225_192G10_LC | . | . | . | . | Q | . | . | . | . | . | . | . | . | . | . | . | . | . | . | . | . | . | . | . | . |
| 21-225_200G1_LC | . | . | . | . | . | . | . | . | . | . | . | . | . | T | . | . | . | . | . | . | . | . | . | . | . |
| 21-225_20C10_LC | . | . | . | . | . | S | . | . | . | . | . | . | . | . | . | . | . | . | . | . | . | . | . | . | . |
| 21-225_20F8_LC | . | V | . | . | F | . | . | . | . | . | . | . | . | . | . | . | . | X | . | . | . | . | . | . | . |
| 21-225_23H4_LC | . | F | . | . | F | . | . | . | . | . | . | . | . | . | . | . | . | . | . | . | . | . | . | . | . |
| 21-225_26A10_LC | . | V | . | . | L | T | . | . | . | . | . | . | . | T | . | . | . | . | . | . | . | V | . | S | . | . |
| 21-225_54B1_LC | . | . | . | . | . | . | . | . | . | . | . | . | . | . | . | . | . | . | . | . | . | . | . | . | . |
| 21-225_58F1_LC | . | . | . | . | . | . | . | . | . | . | . | . | . | . | . | . | . | . | . | . | . | . | . | . | . |
| 21-225_7G12_LC | . | . | . | . | . | . | . | . | . | . | . | . | . | . | . | . | . | . | . | . | . | . | . | . | . |

Table 116. Consensus 36 - VK1|L5/JK4 (SEQ ID NO: 50333):

DIQMTQSPSSVSASVGDRVTITCRAS--QGIS------SWLAWYQQKPGKAPKLLIYA-------ASSLQSGVPSRFSGSGSG--TDFTLTISSLQPEDFATYYCQQINS-----------FPLTFGGGTKVEIKR wherein:

G at position 30 can be substituted with D

S at position 39 can be substituted with N, I or K

W at position 40 can be substituted with Y

S at position 72 can be substituted with G

I at position 109 can be substituted with T, V, A or G

N at position 110 can be substituted with K

Arg Ala Ser Gln Xaa Ile Ser Xaa Xaa Leu Ala (SEQ ID NO: 50183)

Ala Ala Ser Leu Gln Xaa (SEQ ID NO: 50184)

Gln Gln Xaa Xaa Ser Phe Pro Leu Thr (SEQ ID NO: 50185)

Arg Ala Ser Gln Gly Ile Ser Ser Trp Leu Ala (SEQ ID NO: 50669)

Ala Ala Ser Leu Gln Ser (SEQ ID NO: 50670)

Gln Gln Ile Asn Ser Phe Pro Leu Thr (SEQ ID NO: 50671)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | K_CDR2 | | | | | | | | | | | | | | |
| CONSENSUS | K | L | L | I | Y | A | - | - | - | - | - | - | - | A | S | S | L | Q | S | G | V | P | S | R | F |
| 21-225_154E9_LC | . | V | . | . | . | . | . | . | . | . | . | . | . | . | . | . | . | . | . | . | . | . | . | . | . |
| 21-225_62G7_LC | N | . | . | . | . | . | . | . | . | . | . | . | . | . | . | . | . | . | . | . | . | . | . | . | . |
| 21-225_63C9_LC | . | . | . | . | . | . | . | . | . | . | . | . | . | . | . | . | . | . | . | . | . | . | . | . | . |
| 21-225_63E1_LC | . | . | . | . | . | . | . | . | . | . | . | . | . | . | . | . | . | . | . | . | . | . | . | . | . |
| 21-225_64H10_LC | . | . | . | . | . | . | . | . | . | . | . | . | . | . | . | . | . | . | . | . | . | . | . | . | . |
| 21-225_65G3_LC | . | . | . | . | . | . | . | . | . | . | . | . | . | . | . | . | . | . | . | . | . | . | . | . | . |
| 21-225_66A7_LC | . | . | . | . | . | . | . | . | . | . | . | . | . | . | . | . | . | . | . | . | . | . | . | . | . |
| 21-225_66B1_LC | . | . | . | . | . | . | . | . | . | . | . | . | . | . | . | . | . | . | . | . | . | . | . | . | . |
| 21-225_67H4_LC | . | . | . | . | . | . | . | . | . | . | . | . | . | . | . | . | . | . | . | . | . | . | . | . | . |
| 21-225_70A12_LC | . | . | . | . | R | . | . | . | . | . | . | . | . | . | . | . | . | . | . | . | . | . | . | . | . |
| 21-225_70D6_LC | . | . | . | . | . | . | . | . | . | . | . | . | . | . | . | . | . | . | . | . | . | . | . | . | . |
| 21-225_70G9_LC | . | . | . | . | . | . | . | . | . | . | . | . | . | . | . | . | . | . | . | . | . | . | . | . | . |
| 21-225_71A7_LC | . | . | . | . | . | . | . | . | . | . | . | . | . | . | . | . | . | . | G | . | . | . | . | . | . |
| 21-225_71B7_LC | . | . | . | . | . | . | . | . | . | . | . | . | . | . | . | . | . | . | . | . | . | . | . | . | . |
| 21-225_73A3_LC | . | . | . | . | . | . | . | . | . | . | . | . | . | . | . | . | . | . | . | . | . | . | . | . | . |
| 21-225_75C10_LC | . | . | . | . | . | . | . | . | . | . | . | . | . | . | . | . | . | . | . | . | . | . | L | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | | |
| CONSENSUS | Y | C | Q | Q | Q | N | S | . | . | . | . | . | . | . | . | . | . | . | . | . | . | . | . | . | . | . |
| 21-225_154E9_LC | . | . | . | . | T | . | . | . | . | . | . | . | . | . | . | . | . | . | . | . | . | . | . | . | . | . |
| 21-225_62G7_LC | . | . | . | . | - | . | . | . | . | . | . | . | . | . | . | . | . | . | . | . | . | . | . | . | . | . |
| 21-225_63C9_LC | F | . | . | . | A | . | . | . | . | . | . | . | . | . | . | . | . | . | . | . | . | . | . | . | . | . |
| 21-225_63E1_LC | . | . | . | . | - | . | . | . | . | . | . | . | . | . | . | . | . | . | . | . | . | . | . | . | . | . |
| 21-225_64H10_LC | . | . | . | . | V | . | . | . | . | . | . | . | . | . | . | . | . | . | . | . | . | . | . | . | . | . |
| 21-225_65G3_LC | . | . | . | . | - | . | . | . | . | . | . | . | . | . | . | . | . | . | . | . | . | . | . | . | . | . |
| 21-225_66A7_LC | . | . | . | . | T | . | . | . | . | . | . | . | . | . | . | . | . | . | . | . | . | . | . | . | . | . |
| 21-225_66B1_LC | . | . | . | . | - | . | . | . | . | . | . | . | . | . | . | . | . | . | . | . | . | . | . | . | . | . |
| 21-225_67H4_LC | . | . | . | . | - | . | . | . | . | . | . | . | . | . | . | . | . | . | . | . | . | . | . | . | . | . |
| 21-225_70A12_LC | . | . | . | . | T | . | . | . | . | . | . | . | . | . | . | . | . | . | . | . | . | . | . | . | . | . |
| 21-225_70D6_LC | . | . | . | . | T | . | . | . | . | . | . | . | . | . | . | . | . | . | . | . | . | . | . | . | . | . |
| 21-225_70G9_LC | . | . | . | . | V | . | . | . | . | . | . | . | . | . | . | . | . | . | . | . | . | . | . | . | . | . |
| 21-225_71A7_LC | . | . | . | . | T | . | . | . | . | . | . | . | . | . | . | . | . | . | . | . | . | . | . | . | . | . |
| 21-225_71B7_LC | . | . | . | . | V | . | . | . | . | . | . | . | . | . | . | . | . | . | . | . | . | . | . | . | . | . |
| 21-225_73A3_LC | . | . | . | . | A | . | . | . | . | . | . | . | . | . | . | . | . | . | . | . | . | . | . | . | . | . |
| 21-225_75C10_LC | . | . | . | . | . | X | . | . | . | . | . | . | . | . | . | . | . | . | . | . | . | . | . | . | . | . |

Table 117. Consensus 37 - VK1|O18/JK5 (SEQ ID NO: 50334):

DIQMTQSPSSLSASVGDRVTITCQAS--QDIN------NYLNWYQQKPGKAPKLLIYD--------ASNLETGVPSRFSGSGSG--
TDFTFTISSLQPEDIATYYCQQYDN------------------LPITFGQGTRLEIKR wherein:

S at position 26 can be substituted with N

D at position 30 can be substituted with Y

N at position 32 can be substituted with S, T, F or Y

N at position 39 can be substituted with D

Y at position 40 can be substituted with F

A at position 67 can be substituted with G

N at position 69 can be substituted with T, D or S

Y at position 109 can be substituted with F

D at position 110 can be substituted with E

N at position 111 can be substituted with null (-) or I

L at position 135 can be substituted with N or V

P at position 136 can be substituted with L

Gln Ala Xaa Gln Xaa Ile Xaa Xaa Xaa Xaa Leu Asn (SEQ ID NO: 50186)

Asp Xaa Ser Xaa Leu Glu Thr (SEQ ID NO: 50187)

Gln Gln Xaa Xaa Xaa Xaa Xaa Ile Thr (SEQ ID NO: 50188)

Gln Ala Ser Gln Asp Ile Asn Asn Tyr Leu Asn (SEQ ID NO: 50672)

Asp Ala Ser Asn Leu Glu Thr (SEQ ID NO: 50673)

FIGURE 57 (Continued)

Gln Gln Tyr Asp Asn Leu Pro Ile Thr (SEQ ID NO: 50674)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | K_FR1 | | | | | | | | | | | | | | | |
| CONSENSUS | D | I | Q | M | T | Q | S | P | S | S | L | S | A | S | V | G | D | R | V | T | I | T | C | Q | A | S |
| 21-225_11A2_LC | . | . | . | . | . | . | . | . | . | . | . | . | . | . | . | . | . | . | . | . | . | . | . | . | . | . |
| 21-225_13A1_LC | . | . | . | . | . | . | . | . | . | . | . | . | . | . | . | . | . | . | . | . | . | . | . | . | . | . |
| 21-225_159C4_LC | . | . | . | . | . | . | . | . | . | . | . | . | . | . | . | . | . | . | . | . | . | . | . | . | . | . |
| 21-225_15C2_LC | . | . | . | . | . | . | . | . | . | . | . | . | . | . | . | . | . | . | . | . | . | . | . | . | . | . |
| 21-225_15F10_LC | . | . | . | . | . | . | . | . | . | . | . | . | . | . | . | . | . | . | . | . | . | . | . | . | . | N |
| 21-225_161G4_LC | . | . | . | . | . | . | . | . | . | . | . | . | . | . | ~ | . | . | . | . | . | . | . | . | . | . | . |
| 21-225_16B3_LC | . | . | . | . | . | . | . | . | . | . | . | . | . | . | . | . | . | . | . | . | . | . | . | . | . | N |
| 21-225_16F6_LC | . | . | . | . | . | . | . | . | . | . | . | . | . | . | . | . | . | . | . | . | . | . | . | . | . | . |
| 21-225_1B12_LC | . | . | . | . | . | . | . | . | . | . | . | . | . | . | . | . | . | . | . | . | . | . | . | . | . | . |
| 21-225_225B11_LC | . | . | . | . | . | . | . | . | . | . | . | . | . | . | . | . | . | . | . | . | . | . | . | . | . | . |
| 21-225_24D6_LC | . | . | . | . | . | . | . | . | . | . | . | . | . | . | . | . | . | . | . | . | . | . | . | . | . | . |
| 21-225_30E2_LC | . | . | . | . | . | . | . | . | T | . | . | . | . | . | . | . | . | . | . | . | . | . | . | . | . | . |
| 21-225_35E3_LC | . | . | . | . | . | . | . | . | . | . | . | . | . | . | . | . | . | . | . | . | . | . | . | . | . | . |
| 21-225_50G4_LC | . | . | . | . | . | . | . | . | . | . | . | . | . | . | . | . | . | . | . | . | . | . | . | . | . | . |
| 21-225_5E6_LC | . | . | . | . | . | . | . | . | . | . | . | . | . | . | . | . | . | . | . | . | . | . | . | . | . | . |
| 21-225_6G7_LC | . | . | . | . | . | . | . | . | . | . | . | . | . | . | . | . | . | . | . | . | . | . | . | . | . | . |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | K_CDR2 | | | | | | | | | | | | | | | |
| CONSENSUS | K | L | L | I | Y | D | . | . | . | . | . | . | . | . | A | S | N | L | E | T | G | V | P | S | R | F |
| 21-225_11A2_LC | . | . | . | . | . | . | . | . | . | . | . | . | . | . | . | . | . | . | . | . | . | . | . | . | . | . |
| 21-225_13A1_LC | . | . | . | . | . | . | . | . | . | . | . | . | . | . | G | . | . | . | . | . | . | . | . | . | . | . |
| 21-225_159C4_LC | . | . | . | . | . | . | . | . | . | . | . | . | . | . | . | . | T | . | . | . | . | . | . | . | . | . |
| 21-225_15C2_LC | N | . | . | . | . | . | . | . | . | . | . | . | . | . | . | . | . | . | . | . | . | . | . | . | . | . |
| 21-225_15F10_LC | N | . | . | . | . | . | . | . | . | . | . | . | . | . | . | . | . | . | . | . | . | . | . | . | . | . |
| 21-225_161G4_LC | . | . | . | . | . | . | . | . | . | . | . | . | . | . | . | . | . | . | . | . | . | . | . | . | . | . |
| 21-225_16B3_LC | . | . | . | . | S | . | . | . | . | . | . | . | . | . | . | . | . | . | . | . | . | . | . | . | . | . |
| 21-225_16F6_LC | N | . | . | . | . | . | . | . | . | . | . | . | . | . | . | . | . | . | . | . | . | . | . | . | . | . |
| 21-225_1B12_LC | . | . | . | . | S | . | . | . | . | . | . | . | . | . | . | . | . | . | . | . | . | . | . | . | . | . |
| 21-225_225B11_LC | . | . | . | . | . | . | . | . | . | . | . | . | . | . | . | . | T | . | . | . | . | . | . | . | . | . |
| 21-225_24D6_LC | . | . | . | . | . | . | . | . | . | . | . | . | . | . | . | . | Q | . | . | . | . | . | . | . | . | . |
| 21-225_30E2_LC | N | . | . | . | . | . | . | . | . | . | . | . | . | . | G | . | S | . | . | . | . | . | . | . | . | . |
| 21-225_35E3_LC | . | . | . | . | . | . | . | . | . | . | . | . | . | . | . | . | . | . | . | . | . | . | . | . | . | . |
| 21-225_50G4_LC | . | . | . | . | . | . | . | . | . | . | . | . | . | . | . | . | . | . | . | . | . | . | . | . | . | . |
| 21-225_5E6_LC | . | . | . | . | . | . | . | . | . | . | . | . | . | . | . | . | . | . | . | . | . | . | . | . | . | . |
| 21-225_6G7_LC | . | . | . | . | . | . | . | . | . | . | . | . | . | . | . | . | T | . | . | . | . | . | . | . | . | . |

Table 118. Consensus 38 - VL1|1b/JL2 (SEQ ID NO: 50335):

QSVLTQP-PSVSAAPGQKVTISCSGSS-SNIGN----NYVSWYQQLPGTAPKLLIYD-------NNKRPSGIPDRFSGSKSG--TSATLGITGLQTGDEADYYCGTWDSS------------LSVGVFGGGTKLTVLG wherein:

I at position 31 can be substituted with L

N at position 33 can be substituted with S

N at position 39 can be substituted with H or K

Y at position 40 can be substituted with F

V at position 41 can be substituted with L

N at position 67 can be substituted with S

N at position 68 can be substituted with Y or S

T at position 108 can be substituted with A or I

S at position 111 can be substituted with G, I or R

S at position 112 can be substituted with R

S at position 135 can be substituted with N

V at position 136 can be substituted with A or T

G at position 137 can be substituted with V or M

Ser Gly Ser Ser Asn Xaa Gly Xaa Xaa Xaa Xaa Ser (SEQ ID NO: 50189)

Asp Xaa Xaa Lys Arg Pro Ser (SEQ ID NO: 50190)

Gly Xaa Trp Asp Xaa Xaa Leu Xaa Xaa Xaa Val (SEQ ID NO: 50191)

Ser Gly Ser Ser Asn Ile Gly Asn Asn Tyr Val Ser (SEQ ID NO: 50675)

FIGURE 57 (Continued)

Asp Asn Asn Lys Arg Pro Ser (SEQ ID NO: 50676)

Gly Thr Trp Asp Ser Ser Leu Ser Val Gly Val (SEQ ID NO: 50677)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | L FR1 | | | | | | | | | | | | | | |
| CONSENSUS | Q | S | V | L | T | Q | P | P | S | V | S | A | A | P | G | Q | K | V | T | I | S | C | S | G | S |
| 21-225_190B10_LC | . | . | . | . | . | . | . | . | . | . | . | . | . | . | . | . | . | . | . | . | . | . | . | . | . | . |
| 21-225_190C3_LC | . | . | . | . | . | . | . | . | . | . | . | . | . | . | . | . | . | . | . | . | . | . | . | . | . | . |
| 21-225_190D10_LC | . | . | . | . | . | . | . | . | . | . | . | . | . | . | . | . | . | . | . | . | . | . | . | . | . | . |
| 21-225_190D8_LC | . | . | . | . | . | . | . | . | . | . | . | . | . | . | . | . | . | . | . | . | . | . | . | . | . | . |
| 21-225_190H7_LC | . | . | . | . | . | . | . | . | . | . | . | . | . | . | . | . | . | R | . | . | . | . | . | . | . | . |
| 21-225_191A1_LC | . | . | . | . | . | . | . | . | . | . | . | . | . | . | . | . | . | . | . | . | . | . | . | . | . | . |
| 21-225_192G2_LC | . | . | . | . | . | . | . | . | . | . | . | . | . | . | . | . | . | . | . | . | . | . | . | . | . | . |
| 21-225_194F11_LC | . | . | . | . | . | . | . | . | . | . | . | . | . | . | . | . | . | . | . | . | . | . | . | . | . | . |
| 21-225_194G12_LC | . | . | . | . | . | . | . | . | . | . | . | . | . | . | . | . | . | R | . | . | . | . | . | . | . | . |
| 21-225_197E8_LC | . | . | . | . | . | . | . | . | . | . | . | . | . | . | . | . | . | . | . | . | . | . | . | . | . | . |
| 21-225_198D2_LC | . | . | . | . | . | . | . | . | . | . | . | . | . | . | . | . | . | . | . | . | . | . | . | . | . | . |
| 21-225_200G8_LC | . | . | . | . | . | . | . | . | . | . | . | . | . | . | . | . | . | . | . | . | . | . | . | . | . | . |
| 21-225_209A8_LC | . | . | . | . | . | . | . | . | . | . | . | . | . | . | . | . | . | . | . | . | . | . | . | . | . | . |
| 21-225_214D8_LC | . | . | . | . | . | . | . | . | . | . | . | . | . | . | . | . | . | . | . | . | . | . | . | . | . | . |
| 21-225_218G4_LC | . | . | . | . | . | . | . | . | . | . | . | . | . | . | . | . | . | . | . | . | . | . | . | . | . | . |
| 21-225_58C5_LC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | L_FR4 | | | | | |
| CONSENSUS | - | - | - | L | S | V | G | V | F | G | G | G | T | K | L | T | V | L | G |
| 21-225_190B10_LC | | | | | | A | | | | | | | | | | | | | |
| 21-225_190C3_LC | | | | | N | T | V | | | | | | | | | | | | |
| 21-225_190D10_LC | | | | | N | T | V | | | | | | | | | | | | |
| 21-225_190D8_LC | | | | | N | T | | | | | | | | | | | | | |
| 21-225_190H7_LC | | | | | | A | | | | | | | | | | | | | |
| 21-225_191A1_LC | | | | | | A | | | | | | | | | | | | | |
| 21-225_192G2_LC | | | | | | | | | | | | | | | | | | | |
| 21-225_194F11_LC | | | | | N | | | | | | | | | | | | | | |
| 21-225_194G12_LC | | | | | N | T | X | | | | | | | | | | | | |
| 21-225_197E8_LC | | | | | | A | | | | | | | | | | | | | |
| 21-225_198D2_LC | | | | | | A | V | | | | | | | | | | | | |
| 21-225_200G8_LC | | | | | N | T | V | | - | | | | | | | | | | |
| 21-225_209A8_LC | | | | | | | | | | | | | T | | | | | | |
| 21-225_214D8_LC | | | | | | | | | | | | | S | | | | | | S |
| 21-225_218G4_LC | | | | | | | | | | | | | | | | | | | |
| 21-225_58C5_LC | | | | | | | | | | | | | | | | | | | |

FIGURE 57 (Continued)

Table 119. Consensus 39 - VK2|A19/JK4 (SEQ ID NO: 50336):

DIVMTQSPLSLPVTPGEPASISCRSS--QSLLHSN-GYNYLDWYLQKPGQSPQLLIYL-------GSNRASGVPDRFSGSGSG--
TDFTLKISRVEAEDVGVYYCMQALH-------------PPLTFGGGTKVEIKR wherein:

S at position 25 can be substituted with Y

L at position 32 can be substituted with V

H at position 33 can be substituted with Y

S at position 34 can be substituted with N or H

N at position 35 can be substituted with S

G at position 37 can be substituted with K or R

Y at position 38 can be substituted with H or N

Y at position 40 can be substituted with H or S

L at position 58 can be substituted with V

N at position 69 can be substituted with H

A at position 109 can be substituted with P, T or V

H at position 111 can be substituted with Q or null (-)

Null (-) at position 134 can be substituted with T

P at position 135 can be substituted with Q, T or I

P at position 136 can be substituted with T

L at position 137 can be substituted with P or F

Arg Xaa Ser Gln Ser Leu Xaa Xaa Xaa Xaa Xaa Asn Xaa Leu Asp (SEQ ID NO: 50243)

FIGURE 57 (Continued)

Xaa Gly Ser Xaa Arg Arg Ala Ser (SEQ ID NO: 50244)

Met Gln Xaa Leu Xaa Xaa Xaa Xaa Xaa Thr (SEQ ID NO: 50245)

Arg Ser Ser Gln Ser Leu Leu His Ser Asn Gly Tyr Asn Tyr Leu Asp (SEQ ID NO: 50678)

Leu Gly Ser Asn Arg Ala Ser (SEQ ID NO: 50679)

Met Gln Ala Leu His Pro Pro Leu Thr (SEQ ID NO: 50680)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| CONSENSUS | D | I | V | M | T | Q | S | P | L | S | L | P | V | T | P | G | E | P | A | S | I | S | C | R | S | S |
| 21-225_171D7_LC | . | . | . | . | . | . | . | . | . | . | . | . | . | . | . | . | . | . | . | . | . | . | . | . | . | . |
| 21-225_17B8_LC | . | . | . | . | . | . | . | . | . | . | . | . | . | . | . | . | . | . | . | . | . | . | . | . | . | . |
| 21-225_201F3_LC | . | . | . | . | . | . | . | . | . | . | . | . | . | . | . | . | . | . | . | . | . | . | . | . | . | . |
| 21-225_201G6_LC | . | . | . | . | L | . | . | . | . | . | . | . | . | . | . | . | . | . | . | . | . | . | . | . | . | . |
| 21-225_202C12_LC | . | . | . | . | L | . | . | . | . | . | . | . | . | . | . | . | . | . | . | . | . | . | . | . | . | . |
| 21-225_208G3_LC | . | . | . | . | . | . | . | . | . | . | . | . | . | . | . | . | . | . | . | . | . | . | . | . | . | . |
| 21-225_74A2_LC | . | . | . | . | . | . | . | . | . | . | . | . | . | . | . | . | . | . | . | . | . | . | . | . | . | . |
| 21-225_74D8_LC | . | . | . | . | . | . | . | . | . | . | . | . | . | . | . | . | . | . | . | . | . | . | . | . | . | . |
| 21-225_75A1_LC | . | . | . | . | . | . | . | . | . | . | . | . | . | . | . | . | . | . | . | . | . | . | . | . | . | . |
| 21-225_75D8_LC | . | . | . | . | . | . | . | . | . | . | . | . | . | . | . | . | . | . | . | . | . | . | . | . | . | . |
| 21-225_89G4_LC | . | . | . | . | . | . | . | . | . | . | . | . | . | . | . | . | . | . | . | . | . | . | . | . | . | . |
| 21-225_90C11_LC | . | . | . | . | . | . | . | . | . | . | . | . | . | . | . | . | . | . | . | . | . | . | . | . | Y | . |
| 21-225_92B2_LC | . | . | . | . | . | . | . | . | . | . | . | . | . | . | . | . | . | . | . | . | . | . | . | . | . | . |
| 21-225_97H3_LC | . | . | . | . | . | . | . | . | . | . | . | . | . | . | . | . | . | . | . | . | . | . | . | . | . | . |

FIGURE 57 (Continued)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | K_CDR1 | | | | | | | | | | | | | | | | | K_FR2 | | | |
| CONSENSUS | - | - | Q | S | L | L | H | S | N | - | G | Y | N | Y | L | D | W | Y | L | Q | K | P | G | Q | S | P |
| 21-225_171D7_LC | . | . | . | . | . | . | Y | . | . | . | . | . | . | . | . | . | . | . | . | . | . | . | . | . | . | . |
| 21-225_17B8_LC | . | . | . | . | . | . | . | × | . | . | . | N | . | S | . | . | . | . | . | . | . | T | . | . | . | . |
| 21-225_201F3_LC | . | . | . | . | . | . | . | N | . | . | × | . | . | × | . | . | . | . | . | . | . | . | . | . | . | . |
| 21-225_201G6_LC | . | . | . | . | . | . | . | N | . | . | × | . | . | × | . | . | . | . | . | . | . | . | . | . | . | . |
| 21-225_202C12_LC | . | . | . | . | . | . | . | N | . | . | × | . | . | × | . | . | . | . | . | . | . | . | . | . | . | . |
| 21-225_208G3_LC | . | . | . | . | . | . | . | N | . | . | . | . | . | . | . | . | . | . | . | . | . | . | . | . | . | . |
| 21-225_74A2_LC | . | . | . | . | . | . | . | . | . | . | . | . | . | . | . | . | . | . | . | . | . | . | . | . | . | . |
| 21-225_74D8_LC | . | . | . | . | . | V | . | . | . | . | . | . | . | . | . | . | . | . | . | . | . | . | . | . | . | . |
| 21-225_75A1_LC | . | . | . | . | . | . | . | . | . | . | . | . | . | . | . | . | . | . | . | . | . | . | . | . | . | . |
| 21-225_75D8_LC | . | . | . | . | . | . | . | . | S | . | . | . | . | . | . | . | . | . | . | × | . | . | . | . | . | . |
| 21-225_89G4_LC | . | . | . | . | . | V | . | . | S | . | . | × | . | . | . | . | . | . | . | × | . | . | . | . | . | . |
| 21-225_90C11_LC | . | . | . | . | . | V | . | . | S | . | . | . | . | . | . | . | . | . | . | . | . | . | . | . | . | . |
| 21-225_92B2_LC | . | . | . | . | . | . | . | . | S | . | . | . | . | . | . | . | . | . | . | . | . | . | . | . | . | . |
| 21-225_97H3_LC | . | . | . | . | . | . | . | . | . | . | . | × | . | . | . | . | . | . | . | × | . | . | . | . | . | . |

FIGURE 57 (Continued)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | K_CDR2 | | | | | | | | | | | | | | | |
| CONSENSUS | Q | L | L | I | Y | L | - | - | - | - | - | - | - | - | G | S | N | R | A | S | G | V | P | D | R | F |
| 21-225_17D7_LC | . | . | . | . | . | . | . | . | . | . | . | . | . | . | . | . | X | . | . | . | . | . | . | . | . | . |
| 21-225_17B8_LC | . | . | . | . | . | V | . | . | . | . | . | . | . | . | . | . | . | . | . | . | . | . | . | . | . | . |
| 21-225_201F3_LC | . | . | . | . | . | . | . | . | . | . | . | . | . | . | . | . | . | . | . | . | . | . | . | . | . | . |
| 21-225_201G6_LC | . | . | . | . | . | . | . | . | . | . | . | . | . | . | . | . | . | . | . | . | . | . | . | . | . | . |
| 21-225_202C12_LC | . | . | . | . | . | . | . | . | . | . | . | . | . | . | . | . | . | . | . | . | . | . | . | . | . | . |
| 21-225_208G3_LC | . | . | . | . | . | . | . | . | . | . | . | . | . | . | . | . | . | . | . | . | . | . | . | . | . | . |
| 21-225_74A2_LC | . | . | V | . | . | . | . | . | . | . | . | . | . | . | . | . | . | . | . | . | . | . | . | . | . | . |
| 21-225_74D8_LC | . | . | . | . | . | . | . | . | . | . | . | . | . | . | . | . | . | . | . | . | . | . | . | . | . | . |
| 21-225_75A1_LC | . | . | . | . | . | . | . | . | . | . | . | . | . | . | . | . | . | . | . | . | . | . | . | ▨ | . | . |
| 21-225_75D8_LC | . | . | . | . | . | . | . | . | . | . | . | . | . | . | . | . | . | . | . | . | . | . | . | ▨ | . | . |
| 21-225_89G4_LC | . | . | V | . | . | . | . | . | . | . | . | . | . | . | . | . | . | . | . | . | . | . | . | . | . | . |
| 21-225_90C11_LC | . | . | V | . | . | . | . | . | . | . | . | . | . | . | . | . | . | . | . | . | . | . | . | . | . | . |
| 21-225_92B2_LC | . | . | . | . | . | . | . | . | . | . | . | . | . | . | . | . | . | . | . | . | . | . | . | . | . | . |
| 21-225_97H3_LC | . | . | . | . | . | . | . | . | . | . | . | . | . | . | . | . | . | . | . | . | . | . | . | ▨ | . | . |

Table 120. Consensus 40 - VL1|1c/JL2 (SEQ ID NO: 50337):

QSVLTQP-PSASGTPGQRVTISCSGSS-SNIGS------NTVNWYQQLPGTAPKLLIYS------NNQRPSGVPDRFSGSKSG--TSASLAISGLQSEDEADYYCAAWDDS------------LNGVVFGGGTKLTVLG wherein:

S at position 26 can be substituted with T
S at position 27 can be substituted with N
N at position 30 can be substituted with Y
S at position 33 can be substituted with N
N at position 39 can be substituted with Y
T at position 40 can be substituted with A or S
V at position 41 can be substituted with I
N at position 42 can be substituted with D or S
S at position 58 can be substituted with I
N at position 67 can be substituted with S
N at position 68 can be substituted with D or S
Q at position 69 can be substituted with H
A at position 107 can be substituted with E
S at position 112 can be substituted with null (-)
null (-) at position 133 can be substituted with L
L at position 134 can be substituted with N, M or S
N at position 135 can be substituted with G, K or L FIGURE 57 (Continued)

G at position 136 can be substituted with H or N

V at position 137 can be substituted with P or G

V at position 138 can be substituted with P

Ser Gly Xaa Xaa Ser Xaa Ile Gly Xaa Xaa Xaa Xaa Xaa (SEQ ID NO: 50192)

Xaa Xaa Xaa Xaa Arg Pro Ser (SEQ ID NO: 50193)

Xaa Ala Trp Asp Asp Xaa Xaa Xaa Xaa Xaa Xaa Xaa (SEQ ID NO: 50194)

Ser Gly Ser Ser Asn Ile Gly Ser Asn Thr Val Asn (SEQ ID NO: 50681)

Ser Asn Asn Gln Arg Pro Ser (SEQ ID NO: 50682)

Ala Ala Trp Asp Asp Ser Leu Asn Gly Val Val (SEQ ID NO: 50683)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | L_CDR1 | | | | | | | | | | | | | | | | | | L_FR2 | | |
| CONSENSUS | S | X | S | N | I | G | S | X | . | X | . | X | N | T | V | N | W | Y | Q | Q | L | P | G | T | A | P |
| 21-225_146A8_LC | . | | . | . | . | . | . | | | | | | . | . | . | . | . | . | . | . | . | . | . | . | . | . |
| 21-225_146B6_LC | . | | . | Y | . | . | . | | | | | | . | . | . | . | . | . | . | . | . | . | . | . | . | . |
| 21-225_146D8_LC | . | | . | . | . | . | . | | | | | | . | A | . | . | . | . | . | . | . | . | . | . | . | . |
| 21-225_147H12_LC | . | | . | . | . | . | . | | | | | | Y | A | . | . | . | . | . | . | . | . | . | . | . | . |
| 21-225_149A1_LC | . | | . | . | . | . | . | | | | | | . | A | . | . | . | . | . | . | . | . | . | . | . | . |
| 21-225_150F9_LC | . | | . | . | . | . | . | | | | | | . | A | . | Q | . | . | . | . | . | . | . | . | . | . |
| 21-225_154G12_LC | . | | . | . | . | . | N | | | | | | . | A | . | . | . | . | . | . | . | . | . | . | . | . |
| 21-225_156H2_LC | . | | . | . | . | . | . | | | | | | . | . | . | . | . | . | . | . | . | . | . | . | . | . |
| 21-225_197F9_LC | . | | . | . | . | . | . | | | | | | . | . | . | S | . | . | . | . | . | . | . | . | . | . |
| 21-225_199C3_LC | . | | . | . | . | . | . | | | | | | . | . | . | . | . | . | . | . | . | . | . | . | . | . |
| 21-225_4G12_LC | N | | . | . | . | . | . | | | | | | Y | . | . | . | . | . | . | . | . | . | . | . | . | . |
| 21-225_60D6_LC | . | | . | . | . | . | . | | | | | | . | . | . | . | . | . | . | . | . | . | . | . | . | . |
| 21-225_9G9_LC | N | | . | . | . | . | . | | | | | | Y | . | . | . | . | . | . | . | . | . | . | . | . | . |

| Reference # | 105 Y | 106 C | 107 A | 108 A | 109 W | 110 D | 111 D | 112 S | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | A | A | W | D | D | S | | | | | | | | | | L_CDR3 | | | | | | | | |
| 21-225_146A8_LC | . | . | . | . | . | . | . | . | . | . | . | . | . | . | . | . | . | . | . | . | . | . | . | . | . | . |
| 21-225_146B6_LC | . | . | . | . | . | . | . | . | . | . | . | . | . | . | . | . | . | . | . | . | . | . | . | . | . | . |
| 21-225_146D8_LC | . | . | . | . | . | . | . | . | . | . | . | . | . | . | . | . | . | . | . | . | . | . | . | . | . | . |
| 21-225_147H12_LC | . | . | m | . | . | . | . | . | . | . | . | . | . | . | . | . | . | . | . | . | . | . | . | . | . | . |
| 21-225_149A1_LC | . | . | . | . | . | . | . | . | . | . | . | . | . | . | . | . | . | . | . | . | . | . | . | . | . | . |
| 21-225_150F9_LC | m | . | . | . | . | . | . | . | . | . | . | . | . | . | . | . | . | . | . | . | . | . | . | . | . | . |
| 21-225_154G12_LC | . | . | . | . | . | . | . | . | . | . | . | . | . | . | . | . | . | . | . | . | . | . | . | . | . | . |
| 21-225_156H2_LC | . | . | . | . | . | . | . | . | . | . | . | . | . | . | . | . | . | . | . | . | . | . | . | . | . | . |
| 21-225_197F9_LC | . | . | . | . | . | . | . | . | . | . | . | . | . | . | . | . | . | . | . | . | . | . | . | . | . | . |
| 21-225_199C3_LC | . | . | . | . | . | . | . | . | . | . | . | . | . | . | . | . | . | . | . | . | . | . | . | . | . | . |
| 21-225_4G12_LC | . | . | . | . | . | . | . | . | . | . | . | . | . | . | . | . | . | . | . | . | . | . | . | . | . | . |
| 21-225_60D6_LC | . | . | . | . | . | . | . | . | , | . | . | . | . | . | . | . | . | . | . | . | . | . | . | . | . | . |
| 21-225_9G9_LC | . | . | . | . | . | . | . | . | . | . | . | . | . | . | . | . | . | . | . | . | . | . | . | . | . | . |

FIGURE 57 (Continued)

Table 121. Consensus 41 - VLI|1c/IL3b (SEQ ID NO: 50338):

QSVLTQP-PSASGTPGQRVTISCSGSS-SNIGS-----NIVTWYQQLPGTAPKLLIYS--------NDQRPSGVPDRFSGSKSG--
TSASLAISGLQSEDEADYYCAAWDDS---------------LNGWVFGGGTTLTVLG wherein:

S at position 27 can be substituted with N or C

S at position 33 can be substituted with N

N at position 39 can be substituted with H

I at position 40 can be substituted with T

T at position 42 can be substituted with N

S at position 58 can be substituted with G, N or V

D at position 68 can be substituted with K, N or Y

A at position 107 can be substituted with T

A at position 108 can be substituted with T or V

N at position 135 can be substituted with I or S

G at position 136 can be substituted with D or V

Ser Gly Ser Xaa Ser Asn Ile Gly Xaa Xaa Xaa Val Xaa (SEQ ID NO: 50195)

Xaa Asn Xaa Gln Arg Pro Ser (SEQ ID NO: 50196)

Xaa Xaa Trp Asp Asp Ser Leu Xaa Xaa Trp Val (SEQ ID NO: 50197)

Ser Gly Ser Ser Ser Asn Ile Gly Ser Asn Ile Val Thr (SEQ ID NO: 50684)

Ser Asn Asp Gln Arg Pro Ser (SEQ ID NO: 50685)

Ala Ala Trp Asp Asp Ser Leu Asn Gly Trp Val (SEQ ID NO: 50686)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | L_CDR2 | | | | | | | | | | | | | | | | | | | | |
| CONSENSUS | K | L | L | I | Y | S | - | - | - | - | - | - | - | - | - | N | Q | R | P | S | G | V | P | D | R | F |
| 21-225_192G3_LC | . | . | . | . | . | G | . | . | . | . | . | . | . | . | . | K | . | . | . | . | * | . | . | . | . | . |
| 21-225_195H6_LC | . | . | . | . | . | N | . | . | . | . | . | . | . | . | . | Y | . | . | . | . | . | . | . | . | . | . |
| 21-225_49C5_LC | . | . | . | . | . | . | . | . | . | . | . | . | . | . | . | . | . | . | . | . | . | . | . | . | . | . |
| 21-225_49D10_LC | . | . | . | . | . | . | . | . | . | . | . | . | . | . | . | . | . | . | . | . | . | . | . | . | . | . |
| 21-225_51E3_LC | . | . | . | . | . | . | . | . | . | . | . | . | . | . | . | . | . | . | . | . | . | . | . | . | . | . |
| 21-225_51F4_LC | . | . | . | . | . | . | . | . | . | . | . | . | . | . | . | . | . | . | . | . | . | . | . | . | . | . |
| 21-225_52F1_LC | . | . | . | . | . | Y | . | . | . | . | . | . | . | . | . | . | . | . | . | . | . | . | . | . | . | . |
| 21-225_53E8_LC | . | . | . | . | . | . | . | . | . | . | . | . | . | . | . | . | . | . | . | . | . | . | . | . | . | . |
| 21-225_54E9_LC | . | . | . | . | . | . | . | . | . | . | . | . | . | . | . | N | . | . | . | . | . | . | . | . | . | . |
| 21-225_56E3_LC | . | . | . | . | . | . | . | . | . | . | . | . | . | . | . | . | . | . | . | . | . | . | . | . | . | . |
| 21-225_56G1_LC | . | . | . | . | . | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | L_FR3 | | | | | | | | | | | | | | |
| CONSENSUS | S | G | S | K | S | G | - | - | T | S | A | S | L | A | I | S | G | L | Q | S | E | D | E | A | D | Y |
| 21-225_192G3_LC | . | . | . | . | . | . | . | . | . | . | . | . | . | . | . | . | . | . | . | . | . | . | . | T | . | . |
| 21-225_195H6_LC | . | . | . | . | . | . | . | . | . | . | . | . | . | T | . | . | . | . | . | . | . | . | . | . | . | . |
| 21-225_49C5_LC | . | . | . | . | . | . | . | . | . | . | . | . | . | . | . | . | . | . | . | . | . | . | . | . | . | . |
| 21-225_49D10_LC | . | . | . | . | . | . | . | . | . | . | . | . | . | . | . | . | . | . | . | . | . | . | . | . | . | . |
| 21-225_51E3_LC | . | . | . | . | . | . | . | . | . | . | . | . | . | . | . | . | . | . | . | . | . | . | . | T | . | . |
| 21-225_51F4_LC | . | . | . | . | . | . | . | . | . | . | . | . | . | . | . | . | . | . | . | . | . | . | . | . | . | . |
| 21-225_52F1_LC | . | . | . | . | . | . | . | . | . | . | . | . | . | . | . | . | . | . | . | . | . | . | . | . | . | . |
| 21-225_53E8_LC | . | . | . | . | . | . | . | . | . | . | . | . | . | . | . | . | . | . | . | . | . | . | . | . | . | . |
| 21-225_54E9_LC | . | . | . | . | . | . | . | . | . | . | . | . | . | . | . | . | . | . | . | . | . | . | . | . | . | . |
| 21-225_56E3_LC | . | . | . | . | . | . | . | . | . | . | . | . | . | . | . | . | . | . | . | . | . | . | . | . | . | . |
| 21-225_56G1_LC | . | . | . | . | . | . | . | . | . | . | . | . | . | . | . | . | . | . | . | . | . | . | . | . | . | . |

FIGURE 57 (Continued)

Table 122.  Consensus 42 - VK1|A30/JK5 (SEQ ID NO: 50339):

DIQMTQSPSSLSASVGDRVTITCRAS--QGIR------NDLGWYQQKPGKAPKRLIYA------ASSLQSGVPSRFSGSGSG--TEFTLTISSLQPEDFATYYCLQHNS------------------YPITFGQGTRLEIKR wherein:

A at position 25 can be substituted with T
G at position 30 can be substituted with D or R
I at position 31 can be substituted with V
N at position 39 can be substituted with S
A at position 58 can be substituted with D, I or T
S at position 69 can be substituted with N
Q at position 71 can be substituted with E, F or L
L at position 107 can be substituted with I
Q at position 108 can be substituted with H
H at position 109 can be substituted with Y
N a position 110 can be substituted with H or S
S at position 111 can be substituted with N
null (-) at position 134 can be substituted with Y
Y at position 135 can be substituted with L, F or P
I at position 137 can be substituted with P or L
Arg Xaa Ser Gln Xaa Xaa Arg Xaa Asp Leu Gly (SEQ ID NO: 50198)

FIGURE 57 (Continued)

Xaa Ala Ser Xaa Leu Xaa Ser (SEQ ID NO: 50199)

Xaa Xaa Xaa Xaa Xaa Xaa Pro Xaa Thr (SEQ ID NO: 50200)

Arg Ala Ser Gln Gly Ile Arg Asn Asp Leu Gly (SEQ ID NO: 50687)

Ala Ala Ser Ser Leu Gln Ser (SEQ ID NO: 50688)

Leu Gln His Asn Ser Tyr Pro Ile Thr (SEQ ID NO: 50689)

Table 123. Consensus 43 - VK1|O12/JK5 (SEQ ID NO: 50340):

FIGURE 57 (Continued)

DIQMTQSPSSLSASVGDRVTITCRAS-QSIS-----SYLNWYQQKPGKAPKLLIYA-------ASSLQSGVPSRFSGSGSG--TDFTLTISSLQPEDFATYYCQQSYS--------------IPITFGQGTRLEIKR wherein:

A at position 25 can be substituted with T

S at position 30 can be substituted with N or Y

I at position 31 can be substituted with S or F

S at position 32 can be substituted with F, N, R or T

S at position 39 can be substituted with D, G or R

L at position 41 can be substituted with S

N at position 42 can be substituted with S

A at position 58 can be substituted with D, G or S

A at position 67 can be substituted with T

S at position 68 can be substituted with Y

S at position 69 can be substituted with T

L at position 70 can be substituted with F

Q at position 71 can be substituted with E or K

S at position 72 can be substituted with T

Q at position 107 can be substituted with H

Q at position 108 can be substituted with E

S at position 109 can be substituted with T

Y at position 110 can be substituted with F

FIGURE 57 (Continued)

S at position 111 can be substituted with G or N

I at position 135 can be substituted with T, L, N or S

P at position 136 can be substituted with S, R or T

I at position 137 can be substituted with F or P

T at position 138 can be substituted with A

Arg Xaa Ser Gln Xaa Xaa Xaa Xaa Tyr Xaa Xaa (SEQ ID NO: 50201)

Xaa Xaa Xaa Xaa Xaa Xaa Xaa Xaa (SEQ ID NO: 50202)

Xaa Xaa Xaa Xaa Xaa Xaa Xaa Xaa Xaa Xaa Xaa (SEQ ID NO: 50203)

Arg Ala Ser Gln Ser Ile Ser Ser Tyr Leu Asn (SEQ ID NO: 50690)

Ala Ala Ser Ser Leu Gln Ser (SEQ ID NO: 50691)

Gln Gln Ser Tyr Ser Ile Pro Ile Thr (SEQ ID NO: 50692)

Table 124. Consensus 44 - VK2|A18/JK5 (SEQ ID NO: 50341):

DIVMTQTPLSLSVTPGQPASISCKSS-QSLLHSE-GKTYLYWYLQKPGQPPQLLIYE-------VSNRFSGVPDRFSGSGSG--TDFTLKISRVEAEDVGVYYCMQSIQ-------------LPITFGQGTRLEIKR wherein:

K at position 24 can be substituted with R

S at position 25 can be substituted with T

S at position 26 can be substituted with N

S at position 30 can be substituted with I

L at position 31 can be substituted with F

L at position 32 can be substituted with V

S at position 34 can be substituted with N or R

E at position 35 can be substituted with D

K at position 38 can be substituted with R

V at position 67 can be substituted with L

N at position 69 can be substituted with K or H

F at position 71 can be substituted with L or V

M at position 107 can be substituted with I or L

I at position 110 can be substituted with M

Q at position 111 can be substituted with null (-) or L

L at position 135 can be substituted with Y, I or Q

FIGURE 57 (Continued)

P at position 136 can be substituted with L

T at position 138 can be substituted with I

Xaa Xaa Xaa Gln Xaa Xaa Xaa His Xaa Xaa Xaa Gly Xaa Thr Tyr Leu Tyr (SEQ ID NO: 50204)

Glu Xaa Ser Xaa Arg Xaa Ser (SEQ ID NO: 50205)

Xaa Gln Ser Xaa Xaa Xaa Xaa Ile Xaa (SEQ ID NO: 50246)

Lys Ser Ser Gln Ser Leu Leu His Ser Glu Gly Lys Thr Tyr Leu Tyr (SEQ ID NO: 50693)

Glu Val Ser Asn Arg Phe Ser (SEQ ID NO: 50694)

Met Gln Ser Ile Gln Leu Pro Ile Thr (SEQ ID NO: 50695)

Table 125.   Consensus 45 - VK3/A27/JK3 (SEQ ID NO: 50342):

EIVLTQSPGTLSLFPGERATLSCRAS--QSVIS----SYLAWYQQKPGQAPRLLIFG-------VSSRATGIPDRFSGSGSG--TDFTLTISRLEPEDFAVYYCQQYGR--------SPENFGPGTKVDIKR wherein:

Q at position 29 can be substituted with R

S at position 30 can be substituted with G or N

V at position 31 can be substituted with I

I at position 32 can be substituted with S or G

S at position 33 can be substituted with N

S at position 39 can be substituted with I or N

Y at position 40 can be substituted with F

V at position 67 can be substituted with A or T

S at position 69 can be substituted with N or T

R at position 70 can be substituted with W

Q at position 107 can be substituted with H

Q at position 108 can be substituted with H

Y at position 109 can be substituted with N

G at position 110 can be substituted with D

R at position 111 can be substituted with null (-), N or Y

P at position 136 can be substituted with L or M

FIGURE 57 (Continued)

N at position 138 can be substituted with T

Arg Ala Ser Xaa Xaa Xaa Xaa Xaa Xaa Xaa Xaa Leu Ala (SEQ ID NO: 50206)

Gly Xaa Ser Xaa Xaa Xaa Ala Thr (SEQ ID NO: 50207)

Xaa Xaa Xaa Xaa Xaa Ser Xaa Xaa Xaa Asn (SEQ ID NO: 50208)

Arg Ala Ser Gln Ser Val Ile Ser Ser Tyr Leu Ala (SEQ ID NO: 50696)

Gly Val Ser Ser Arg Ala Thr (SEQ ID NO: 50697)

Gln Gln Tyr Gly Arg Ser Pro Phe Asn (SEQ ID NO: 50698)

Table 126. Consensus 46 – VK3|L2/JK1 (SEQ ID NO: 50343):

EIVMTQSPATLSVSPGERATLSCRAS--QSVS------SNLAWYQQKPGQAPRLLIYG---------ASTRATGIPARFSGSGSG--
TEFTLTISSLQSEDFAVYYCQQYND---------WPWTFGQGTKVEIKR wherein:

A at position 25 can be substituted with S

S at position 30 can be substituted with D or T

V at position 31 can be substituted with I

S at position 32 can be substituted with N, R or I

S at position 39 can be substituted with I or T

N at position 40 can be substituted with Y

L at position 41 can be substituted with I

T at position 72 can be substituted with S

Q at position 108 can be substituted with E

Y at position 109 can be substituted with S

N at position 110 can be substituted with D, F or H

D at position 111 can be substituted with N, null (-) or T null (-) at position 134 can be substituted with W W at position 135 can be substituted with P, C or N P at position 136 can be substituted with L or W W at position 137 can be substituted with L, C, P or R FIGURE 57 (Continued)

T at position 138 can be substituted with P or S

Arg Xaa Ser Gln Xaa Xaa Xaa Xaa Xaa Xaa Xaa Ala (SEQ ID NO: 50209)

Gly Ala Ser Thr Arg Ala Xaa (SEQ ID NO: 50210)

Gln Xaa Xaa Xaa Xaa Xaa Xaa Xaa Xaa Xaa Xaa (SEQ ID NO: 50211)

Arg Ala Ser Gln Ser Val Ser Ser Asn Leu Ala (SEQ ID NO: 50699)

Gly Ala Ser Thr Arg Ala Thr (SEQ ID NO: 50700)

Gln Gln Tyr Asn Asp Trp Pro Trp Thr (SEQ ID NO: 50701)

Table 127. Consensus 47 - VK6/A26/JK1 (SEQ ID NO: 50344):

EIVLTQSPDFQSVTPKEKVTITCRAS--QSIG-------SSLHWYQQKPDQSPKLLIKY--------ASQSFSGVPSRFSGSGSG--
TDFTLTINSLEAEDAATYYCHQSSS--------------LPWTFGQGTKVEIKR wherein:

S at position 30 can be substituted with N
S at position 39 can be substituted with N
S at position 40 can be substituted with N or T
Y at position 58 can be substituted with S
H at position 107 can be substituted with Q
S at position 110 can be substituted with G or R
L at position 135 can be substituted with F
W at position 137 can be substituted with R or Q
Arg Ala Ser Gln Xaa Ile Gly Xaa Xaa Leu His (SEQ ID NO: 50256)
Xaa Ala Ser Gln Ser Phe Ser (SEQ ID NO: 50257)
Xaa Gln Ser Xaa Ser Xaa Pro Xaa Thr (SEQ ID NO: 50258)
Arg Ala Ser Gln Ser Ile Gly Ser Ser Leu His (SEQ ID NO: 50702)
Tyr Ala Ser Gln Ser Phe Ser (SEQ ID NO: 50703)
His Gln Ser Ser Leu Pro Trp Thr (SEQ ID NO: 50704)

Table 128. Consensus 48 - VK1A30/JK2 (SEQ ID NO: 50345):

DIQMTQSPSSLSASVGDRVTITCRAS--QGIR------NDLGWYQQKPGKAPKRLIYA--------ASSLQSGVPSRFSGSGSG--
TEFTLTISSLQPEDFATYYCLQHYS------------YPRSFGQGTKLEIKR wherein:

G at position 30 can be substituted with A

R at position 32 can be substituted with G

N at position 39 can be substituted with D

A at position 67 can be substituted with T

Y at position 110 can be substituted with N

S at position 111 can be substituted with N

Y at position 135 can be substituted with F

R at position 137 can be substituted with Y

Arg Ala Ser Gln Xaa Ile Xaa Xaa Asp Leu Gly (SEQ ID NO: 50247)

Ala Xaa Ser Ser Leu Gln Ser (SEQ ID NO: 50248)

Leu Gln His Xaa Xaa Xaa Xaa Pro Xaa Ser (SEQ ID NO: 50249)

Arg Ala Ser Gln Gly Ile Arg Asn Asp Leu Gly (SEQ ID NO: 50705)

Ala Ala Ser Ser Leu Gln Ser (SEQ ID NO: 50706)

Leu Gln His Tyr Ser Tyr Pro Arg Ser (SEQ ID NO: 50707)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | K_CDR2 | | | | | | | | | | | | |
| CONSENSUS | K | R | L | I | Y | A | . | . | . | . | . | . | . | . | A | S | S | L | Q | S | G | V | P | S | R | F |
| 21-225_150E2_LC | T | . | . | . | . | . | . | . | . | . | . | . | . | . | . | . | . | . | . | . | . | . | . | . | . | . |
| 21-225_152F7_LC | . | . | . | . | . | . | . | . | . | . | . | . | . | . | T | . | . | . | . | . | . | . | . | . | . | . |
| 21-225_176H12_LC | N | . | . | . | . | . | . | . | . | . | . | . | . | . | . | . | . | . | . | . | . | . | . | . | . | . |
| 21-225_177B4_LC | . | . | . | . | . | . | . | . | . | . | . | . | . | . | . | . | . | . | . | . | . | . | . | . | . | . |
| 21-225_25A12_LC | . | . | . | . | . | . | . | . | . | . | . | . | . | . | . | . | . | . | . | . | . | . | . | . | . | . |
| 21-225_26A11_LC | . | . | . | . | . | . | . | . | . | . | . | . | . | . | . | . | . | . | . | . | . | . | . | . | . | . |
| 21-225_28H2_LC | . | . | . | . | . | . | . | . | . | . | . | . | . | . | . | . | . | . | . | . | . | . | . | . | . | . |
| 21-225_29E2_LC | E | . | . | . | . | . | . | . | . | . | . | . | . | . | . | . | . | . | . | . | . | . | . | . | . | . |
| 21-225_61F2_LC | . | . | . | . | . | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | K_FR3 | | | | | | | | | | | | | | | | |
| CONSENSUS | S | G | S | G | S | G | . | . | T | E | F | T | L | T | I | S | S | L | Q | P | E | D | F | A | T | Y |
| 21-225_150E2_LC | . | . | . | . | . | . | . | . | . | . | . | . | . | . | . | . | . | . | . | . | A | . | . | . | . | . |
| 21-225_152F7_LC | . | . | . | . | . | . | . | . | . | . | . | . | . | . | . | . | . | . | . | R | . | . | . | . | . | . |
| 21-225_176H12_LC | . | . | . | . | . | . | . | . | . | . | . | . | . | . | . | . | . | . | . | . | . | . | . | . | . | . |
| 21-225_177B4_LC | . | . | . | . | . | . | . | . | . | . | . | . | . | . | . | . | . | . | . | . | . | . | . | . | . | . |
| 21-225_25A12_LC | . | . | . | . | . | . | . | . | . | . | . | — | — | . | . | . | . | . | . | . | . | . | . | . | . | . |
| 21-225_26A11_LC | . | . | . | . | . | . | . | . | . | . | . | — | — | . | . | . | . | . | . | . | . | . | . | . | . | . |
| 21-225_28H2_LC | . | . | . | . | . | . | . | . | . | . | . | — | — | . | . | . | . | . | . | . | . | . | . | . | . | . |
| 21-225_29E2_LC | . | . | . | . | . | . | . | . | . | . | . | . | . | . | . | . | . | . | . | . | . | . | . | . | . | . |
| 21-225_61F2_LC | . | . | . | . | . | . | . | . | . | . | . | . | . | . | . | . | . | . | . | . | . | . | . | . | . | . |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | | |
| CONSENSUS | Y | C | L | Q | H | Y | S | . | . | . | . | . | . | . | . | . | . | . | . | | | | | | | |
| 21-225_150E2_LC | . | . | . | . | . | . | . | | | | | | | | | | | | | | | | | | | |
| 21-225_152F7_LC | . | . | . | . | . | N | | | | | | | | | | | | | | | | | | | | |
| 21-225_176H12_LC | . | @ | . | . | . | N | | | | | | | | | | | | | | | | | | | | |
| 21-225_177B4_LC | . | . | . | . | . | . | . | | | | | | | | | | | | | | | | | | | |
| 21-225_25A12_LC | . | . | . | . | . | . | N | | | | | | | | | | | | | | | | | | | |
| 21-225_26A11_LC | . | . | . | . | . | . | N | | | | | | | | | | | | | | | | | | | |
| 21-225_28H2_LC | . | . | . | . | . | . | . | | | | | | | | | | | | | | | | | | | |
| 21-225_29E2_LC | . | . | . | . | . | . | N | | | | | | | | | | | | | | | | | | | |
| 21-225_61F2_LC | . | . | . | . | . | . | . | | | | | | | | | | | | | | | | | | | |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K_FR4 | | | | | |
| CONSENSUS | . | . | . | . | Y | P | R | S | F | G | Q | G | T | K | L | E | I | K | R |
| 21-225_150E2_LC | . | . | . | . | R | . | Y | . | . | . | . | . | . | . | . | . | . | . | . |
| 21-225_152F7_LC | . | . | . | . | R | . | Y | . | . | . | . | . | . | . | . | . | . | . | . |
| 21-225_176H12_LC | . | . | . | . | R | . | . | . | . | . | . | . | . | . | . | . | . | @ | . |
| 21-225_177B4_LC | . | . | . | . | . | . | . | . | . | . | . | . | . | . | . | . | . | . | . |
| 21-225_25A12_LC | . | . | . | . | . | . | . | . | . | . | . | . | . | . | . | . | . | . | . |
| 21-225_26A11_LC | . | . | . | . | . | . | . | . | . | . | . | . | . | . | . | . | . | . | . |
| 21-225_28H2_LC | . | . | . | . | . | . | . | . | . | . | . | . | . | . | . | . | . | . | . |
| 21-225_29E2_LC | . | . | . | . | . | . | . | . | . | . | . | . | . | . | . | . | . | . | . |
| 21-225_61F2_LC | . | . | . | . | . | . | . | . | . | . | . | . | . | . | . | . | . | . | . |

FIGURE 57 (Continued)

Table 129. Consensus 49 - VK1|L1/JK5 (SEQ ID NO: 50346):

DIQMTQSPSSLSASVGDRVTITCRAS--QGIS------NYLAWFQQKPGKAPKSLIYA------ASSLQSGVPSKFSGSGSG--TDFTLTISSLQPEDFATYYCQQYLS--------YPITFGQGTRLEIKR wherein:

R at position 24 can be substituted with Q

G at position 30 can be substituted with D

S at position 32 can be substituted with N

N at position 39 can be substituted with K

Y at position 40 can be substituted with F

A at position 42 can be substituted with N or V

A at position 58 can be substituted with D, G, or T

S at position 68 can be substituted with T

S at position 69 can be substituted with R or N

Q at position 71 can be substituted with H, L, or V

S at position 72 can be substituted with T

Q at position 107 can be substituted with H or L

Q at position 108 can be substituted with H or L

L at position 110 can be substituted with H, D, K, N, or Y

S at position 111 can be substituted with N, H, or T

Y at position 135 can be substituted with L

FIGURE 57 (Continued)

I at position 137 can be substituted with L

Xaa Ala Ser Gln Xaa Ile Xaa Xaa Xaa Xaa Leu Xaa (SEQ ID NO: 50212)

Xaa Ala Xaa Xaa Leu Xaa Xaa (SEQ ID NO: 50213)

Xaa Xaa Tyr Xaa Xaa Xaa Pro Xaa Thr (SEQ ID NO: 50214)

Arg Ala Ser Gln Gly Ile Ser Asn Tyr Leu Ala (SEQ ID NO: 50708)

Ala Ala Ser Ser Leu Gln Ser (SEQ ID NO: 50709)

Gln Gln Tyr Leu Ser Tyr Pro Ile Thr (SEQ ID NO: 50710)

Table 130.  Consensus 50 – VK6/A26/JK4 (SEQ ID NO: 50347):

EIVLTQSPDFQSVTPKEKVTITCRAS–QSIG——SSLHWYQQKPDQSPKLLIKY——–ASQSFSGVPSRFSGSGSG–TDFTLTINSLEAEDAATYYCHQSRR——————LPLIFGGGTKVEIKR wherein:

S at position 26 can be substituted with N

S at position 30 can be substituted with N

S at position 39 can be substituted with R

F at position 71 can be substituted with L

S at position 109 can be substituted with T

R at position 110 can be substituted with G or S

R at position 111 can be substituted with S or T

Xaa Ala Xaa Gln Ser Xaa Gly Ser Ser Leu His (SEQ ID NO: 50215)

Tyr Ala Ser Gln Ser Xaa Ser (SEQ ID NO: 50216)

His Gln Xaa Xaa Xaa Leu Pro Leu Thr (SEQ ID NO: 50217)

Arg Ala Ser Gln Ser Ile Gly Ser Ser Leu His (SEQ ID NO: 50711)

Tyr Ala Ser Gln Ser Phe Ser (SEQ ID NO: 50712)

His Gln Ser Arg Arg Leu Pro Leu Thr (SEQ ID NO: 50713)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | K_CDR2 | | | | | | | | | | | | | |
| CONSENSUS | K | L | L | I | Y | . | . | . | . | . | . | . | . | . | A | S | Q | S | F | S | G | V | P | S | R | F |
| 21-225_190B12_LC | . | . | . | . | . | . | . | . | . | . | . | . | . | . | . | . | . | . | . | . | . | D | . | . | . | . |
| 21-225_191C9_LC | . | . | . | . | . | . | . | . | . | . | . | . | . | . | . | . | . | . | . | . | . | D | . | . | . | . |
| 21-225_191H4_LC | . | . | . | . | . | . | . | . | . | . | . | . | . | . | . | . | . | . | L | . | . | . | . | . | . | . |
| 21-225_192E5_LC | . | . | . | . | . | . | . | . | . | . | . | . | . | . | . | . | . | . | . | . | . | . | . | . | . | . |
| 21-225_193G9_LC | . | . | . | . | . | . | . | . | . | . | . | . | . | . | . | . | . | . | . | . | . | . | . | . | . | . |
| 21-225_195B10_LC | . | . | . | . | . | . | . | . | . | . | . | . | . | . | . | . | . | . | . | . | . | . | . | . | . | . |
| 21-225_195F2_LC | . | . | . | . | . | . | . | . | . | . | . | . | . | . | . | . | . | . | . | . | . | . | . | . | . | . |
| 21-225_201E8_LC | . | . | . | . | . | . | . | . | . | . | . | . | . | . | . | . | . | . | . | . | . | . | . | . | . | . |
| 21-225_206G4_LC | . | . | . | . | . | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | K_FR3 | | | | | | | | | | | | | | | |
| CONSENSUS | S | G | S | G | S | G | . | . | T | D | F | T | L | T | I | N | S | L | E | A | E | D | A | A | T | Y |
| 21-225_190B12_LC | . | . | . | . | . | . | . | . | . | . | . | . | . | . | . | . | . | . | . | . | . | . | . | . | . | . |
| 21-225_191C9_LC | . | A | . | . | . | . | . | . | . | . | . | . | . | . | . | . | . | . | . | . | . | . | . | . | . | . |
| 21-225_191H4_LC | . | . | . | . | . | . | . | . | . | . | . | . | . | . | . | . | . | . | Q | . | . | . | . | . | . | . |
| 21-225_192E5_LC | . | . | . | . | . | . | . | . | . | . | . | . | . | . | . | . | . | . | . | . | . | . | . | . | . | . |
| 21-225_193G9_LC | . | . | . | . | . | . | . | . | . | . | . | . | . | . | . | . | . | . | . | . | . | . | . | . | . | . |
| 21-225_195B10_LC | . | . | . | . | . | . | . | . | . | . | . | . | . | . | . | . | . | . | . | . | . | . | . | . | . | . |
| 21-225_195F2_LC | . | . | . | . | . | . | . | . | . | N | . | A | . | . | . | S | . | . | . | . | . | . | . | V | . | . |
| 21-225_201E8_LC | . | . | . | . | . | . | . | . | . | . | . | . | . | . | . | . | . | . | . | . | . | . | . | . | . | . |
| 21-225_206G4_LC | . | . | . | . | . | . | . | . | . | . | . | . | . | . | . | . | . | . | . | . | . | . | . | . | . | . |

Table 131. Consensus 51 - VL3j3l/lL2 (SEQ ID NO: 50348):

SSELTQD-PAVSVALGQTVRITCQGD--SLRP----YYASWYQQKPGQAPVLVIYG------KNNRPSGIPDRFSGSSSG--
NTASLTITGAQAEDEADYYCNSRDSS-----------GNHLVVFGGGTKLTVLG wherein:

S at position 30 can be substituted with T or K

P at position 33 can be substituted with N, S, or T

A at position 41 can be substituted with V

S at position 42 can be substituted with N

G at position 58 can be substituted with A or T

N at position 69 can be substituted with S

S at position 112 can be substituted with C

G at position 133 can be substituted with null (-)

N at position 134 can be substituted with G

H at position 135 can be substituted with N or S

L at position 136 can be substituted with H

V at position 137 can be substituted with L

V at position 138 can be substituted with L

Gln Gly Asp Xaa Leu Arg Xaa Tyr Tyr Xaa Xaa (SEQ ID NO: 50218)

Xaa Lys Asn Xaa Arg Pro Ser (SEQ ID NO: 50219)

Asn Ser Arg Asp Ser Xaa Xaa Xaa Xaa Xaa Xaa Xaa (SEQ ID NO: 50220)

FIGURE 57 (Continued)

Gln Gly Asp Ser Leu Arg Pro Tyr Tyr Ala Ser (SEQ ID NO: 50714)

Gly Lys Asn Asn Arg Pro Ser (SEQ ID NO: 50715)

Asn Ser Arg Asp Ser Gly Asn His Leu Val Val (SEQ ID NO: 50716)

Table 132. Consensus 52 - VK2|A17/JK4 (SEQ ID NO: 50349):

DVVMTQSPLSLPVTLGQPASISCRSS--QSLVYSD-GNTYLNWFQQRPGQSPRRLIYK------VSNWDSGVPDRFSGSSG--TDFTLKISRVEAEDVGVYYCMQGTH--------------WPLTFGGGTKVEIKR wherein:

S at position 26 can be substituted with G

Y at position 40 can be substituted with S

K at position 58 can be substituted with E

N at position 69 can be substituted with K

S at position 72 can be substituted with Y

T at position 110 can be substituted with I

H at position 111 can be substituted with null (-)

W at position 135 can be substituted with H

P at position 136 can be substituted with L, S or W

L at position 137 can be substituted with P

Arg Ser Xaa Gln Ser Leu Val Tyr Ser Asp Gly Asn Thr Xaa Leu Asn (SEQ ID NO: 50221)

Xaa Val Ser Xaa Trp Asp Xaa (SEQ ID NO: 50222)

Met Gln Gly Xaa Xaa Xaa Xaa Xaa Xaa Thr (SEQ ID NO: 50223)

Arg Ser Ser Gln Ser Leu Val Tyr Ser Asp Gly Asn Thr Tyr Leu Asn (SEQ ID NO: 50717)

Lys Val Ser Asn Trp Asp Ser (SEQ ID NO: 50718)

Met Gln Gly Thr His Trp Pro Leu Thr (SEQ ID NO: 50719)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
|  |  |  |  |  |  |  |  |  |  |  |  | K_FR1 |  |  |  |  |  |  |  |  |  |  |  |  |  |  |
| CONSENSUS | D | V | V | M | T | Q | S | P | L | S | L | P | V | T | L | G | Q | P | A | S | I | S | C | R | S | S |
| 21-225_148C6_LC | . | . | . | . | . | . | . | . | . | . | . | . | . | . | . | . | . | . | . | . | . | . | . | . | . | . |
| 21-225_148H11_LC | . | . | . | . | . | . | . | . | . | . | . | . | . | . | . | . | . | . | . | . | . | . | . | . | . | . |
| 21-225_149F2_LC | . | . | . | . | S | . | Y | . | . | . | . | . | . | . | . | . | . | . | . | . | . | . | . | . | . | . |
| 21-225_150F11_LC | . | . | . | . | . | . | . | . | . | . | . | . | . | . | . | . | . | . | . | . | . | . | . | . | . | . |
| 21-225_177D2_LC | . | . | . | . | . | . | . | . | . | . | . | S | . | . | . | . | . | . | . | . | . | . | . | . | . | . |
| 21-225_32G4_LC | . | . | . | . | . | . | . | . | . | . | . | . | . | . | a | . | . | . | . | . | . | . | . | . | . | . |
| 21-225_43F11_LC1_LC | . | . | . | . | . | . | . | . | . | . | . | . | . | . | . | . | . | . | . | . | . | . | . | . | . | . |
| 21-225_72C4_LC | . | . | . | . | . | . | . | . | . | . | . | . | . | . | . | . | . | . | . | . | . | . | . | . | . | G |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| CONSENSUS | . | . | . | . | W | P | L | T | F | G | G | G | T | K | V | E | I | K | R |
| 21-225_148C6_LC | | | | | | S | | | | | | | | | | | | | |
| 21-225_148H11_LC | | | | | | L | | | | | | | | | | | | | |
| 21-225_149F2_LC | | | | | | | & | | | | | | | | | | | | T |
| 21-225_150F11_LC | | | | | | | & | | | | | | | | | | | | |
| 21-225_177D2_LC | | | | | W | W | | | | | | | | | | | | | |
| 21-225_32G4_LC | | | | | | | | | | | | | | | | | | | |
| 21-225_43F11_LC1_LC | | | | | | | | | | | | | | | | | | | |
| 21-225_72C4_LC | | | | | | | | | | | | | | | | | | | |

FIGURE 57 (Continued)

Table 133.  Consensus 53 – VK3jL2/JK4 (SEQ ID NO: 50350):

EIVMTQSPATLSVSPGERATLSCRAS--QSVS-----RNLAWYQQKPGQAPRLLIYG------ASTRATGIPARFSGSGSG--
TEFTLTISSLQSEDFAVYYCQQYNN------------WPLTFGGGTKVEIKR wherein:

A at position 25 can be substituted with P or T

V at position 31 can be substituted with F

S at position 32 can be substituted with R or W

R at position 39 can be substituted with I or S

N at position 40 can be substituted with D or S

L at position 41 can be substituted with V

G at position 58 can be substituted with D

S at position 68 can be substituted with A

T at position 69 can be substituted with I or A

N at position 110 can be substituted with Y

N at position 111 can be substituted with T or Y null(-) at position 134 can be substituted with W W at position 135 can be substituted with P Arg Xaa Ser Gln Ser Xaa Xaa Xaa Xaa Xaa Ala (SEQ ID NO: 50224)

Xaa Ala Xaa Arg Ala Thr (SEQ ID NO: 50225)

Gln Gln Tyr Xaa Xaa Xaa Xaa Pro Leu Thr (SEQ ID NO: 50226)

Arg Ala Ser Gln Ser Val Ser Arg Asn Leu Ala (SEQ ID NO: 50720)

FIGURE 57 (Continued)

Gly Ala Ser Thr Arg Ala Thr (SEQ ID NO: 50721)

Gln Gln Tyr Asn Asn Trp Pro Leu Thr (SEQ ID NO: 50722)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | | |
| CONSENSUS | Y | C | Q | Q | Y | N | N | | | | | | | | | | | | | | | | | | | |
| 21-225_190E11_LC | | | | | | | | | | | | | | | | | | | | | | | | | | |
| 21-225_191E8_LC | | | | | | | | | | | | | | | | | | | | | | | | | | |
| 21-225_191G11_LC | | | | | | Y | Y | | | | | | | | | | | | | | | | | | | |
| 21-225_199A6_LC | | | | | | | | | | | | | | | | | | | | | | | | | | |
| 21-225_55E1_LC | | | | | | | | | | | | | | | | | | | | | | | | | | |
| 21-225_65C12_LC | | | | | | | T | | | | | | | | | | | | | | | | | | | |
| 21-225_74D1_LC | | | | | | | | | | | | | | | | | | | | | | | | | | |
| 21-225_75F11_LC | | | | | | | | | | | | | | | | | | | | | | | | | | |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K_FR4 | | | | | |
| CONSENSUS | | | | | W | P | L | T | F | G | G | G | T | K | V | E | I | K | R |
| 21-225_190E11_LC | | | | | | | | | | | | | | | | | | | |
| 21-225_191E8_LC | | | | | | | | | | | | | | | | | | | |
| 21-225_191G11_LC | | | | | | | | | | | | | | | | | | | |
| 21-225_199A6_LC | | | | | | | | | | | | | | | | | | | |
| 21-225_55E1_LC | | | | | | | | | | | | | | | | | | | |
| 21-225_65C12_LC | | | | W | P | | | | | | | | | | | | | | |
| 21-225_74D1_LC | | | | W | P | | | | | | | | | | | | | | |
| 21-225_75F11_LC | | | | | | | | | | | | | | | | | | | |

FIGURE 57 (Continued)

Table 134. Consensus 54 - VL3|3j/JL2 (SEQ ID NO: 50351):
SYELTQP-LSVSVALGQTARITCGGN---NIGR----KNVHWYQQKPGQAPVLVIYR--------DSDRPSGIPERFSGSNSG--NTATLTISRAQAGDEADYYCQVWDS--------------STVVFGGGTKLTVLG wherein:

N at position 26 can be substituted with D
G at position 32 can be substituted with R
R at position 33 can be substituted with S
K at position 39 can be substituted with R
N at position 40 can be substituted with A
R at position 58 can be substituted with S
S at position 68 can be substituted with R
D at position 69 can be substituted with N or Y
P at position 71 can be substituted with S
V at position 108 can be substituted with D
null (-) at position 112 can be substituted with S
null (-) at position 134 can be substituted with S
S at position 135 can be substituted with D or G
T at position 136 can be substituted with H
V at position 137 can be substituted with A or G
Gly Gly Asn Ile Xaa Xaa Xaa Xaa Val His (SEQ ID NO: 50250)
Xaa Asp Xaa Xaa Arg Xaa Ser (SEQ ID NO: 50251)

FIGURE 57 (Continued)

Gln Xaa Trp Asp Ser Xaa Xaa Xaa Xaa Xaa Val (SEQ ID NO: 50252)

Gly Gly Asn Asn Ile Gly Arg Lys Asn Val His (SEQ ID NO: 50723)

Arg Asp Ser Asp Arg Pro Ser (SEQ ID NO: 50724)

Gln Val Trp Asp Ser Ser Thr Val Val (SEQ ID NO: 50725)

| Reference # | 1 | 2 | 3 | 4 | 5 | 6 | 7 | 8 | 9 | 10 | 11 | 12 L_FR1 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| CONSENSUS | S | Y | E | L | T | Q | P | L | S | V | S | V | A | L | G | Q | T | A | R | I | T | C | G | G | N |
| 21-225_203B2_LC | . | . | . | . | . | . | . | . | . | . | . | . | . | . | . | . | . | . | . | . | . | . | . | . | . | . |
| 21-225_205E12_LC | . | . | . | . | . | . | . | . | . | . | . | . | . | . | . | . | . | . | . | . | . | . | . | . | . | . |
| 21-225_206B5_LC | . | . | . | . | . | . | . | . | . | . | . | . | A | . | . | . | . | . | . | . | A | . | . | . | . | . |
| 21-225_208H10_LC | . | . | . | . | . | . | . | . | . | . | . | . | . | . | . | . | . | . | . | . | A | . | . | . | . | . |
| 21-225_211H2_LC | . | . | . | . | . | . | . | . | M | M | . | . | . | . | . | . | . | . | . | . | . | . | . | . | . | . |
| 21-225_216B12_LC | . | . | . | . | . | . | . | . | . | . | . | . | . | T | A | . | M | . | . | . | . | . | . | . | . | . |
| 21-225_3E10_LC | . | . | . | . | . | . | . | . | . | . | . | . | . | T | A | . | M | . | . | . | . | . | . | . | . | D |
| 21-225_8C12_LC | . | . | . | . | . | . | . | . | . | . | . | . | . | . | . | . | . | . | . | . | . | . | . | . | . | . |

| Reference # | 27 | 28 | 29 | 30 | 31 L_CDR1 | 32 | 33 | 34 | 35 | 36 | 37 | 38 | 39 | 40 | 41 | 42 | 43 | 44 | 45 | 46 | 47 | 48 | 49 | 50 L_FR2 | 51 | 52 |
|---|---|---|---|---|---|---|---|---|---|---|---|---|---|---|---|---|---|---|---|---|---|---|---|---|---|---|
| CONSENSUS | . | . | N | . | I | G | R | . | . | . | . | . | K | N | V | H | W | Y | Q | Q | K | P | G | Q | A | P |
| 21-225_203B2_LC | . | . | . | . | . | . | . | . | . | . | . | . | . | . | . | . | . | . | . | . | . | . | . | . | . | . |
| 21-225_205E12_LC | . | . | . | . | . | . | . | . | . | . | . | . | . | . | . | . | . | . | . | . | . | . | . | . | S | . |
| 21-225_206B5_LC | . | . | . | . | . | . | . | S | . | . | . | . | . | . | . | . | . | . | . | . | . | . | . | L | S | . |
| 21-225_208H10_LC | . | . | . | . | . | . | . | S | . | . | . | . | . | . | . | . | . | . | . | . | . | . | . | L | . | . |
| 21-225_211H2_LC | . | . | . | . | . | . | . | . | . | . | . | . | M | . | . | . | . | . | . | . | . | . | . | . | . | . |
| 21-225_216B12_LC | . | . | . | . | . | . | . | . | . | . | . | . | . | . | . | . | . | . | . | . | . | . | . | . | . | . |
| 21-225_3E10_LC | . | . | . | . | . | . | . | . | . | . | . | . | . | A | . | . | . | . | . | . | . | . | . | . | D | . |
| 21-225_8C12_LC | . | . | . | . | . | . | . | . | . | . | . | . | . | A | . | . | . | . | . | . | . | . | . | . | D | . |

Table 7.6. ASGR-1 residues identified as hits via Arg/Glu scanning mutagenesis:

| mAb | Relative Epitope Profiling Bin | ASGR1 CBD Mutations That Reduced Antibody Binding Signal (3xIQR Cutoff) |
|---|---|---|
| 4A2 | A | W195 |
| 7E11 | A | W195 |
| 56E5 | A | W195 |
| 7G4 | A | W195 R263 |
| 53F7 | A | W195 K199 E196 |
| 10G6 | A | W195 E196 |
| 26C4 | A | W195 P207 |
| 6G6 | A | |
| 29H8 | A | W195 P207 |
| 25A4 | A | |
| 32D6 | A | W195 K199 |
| 198D2 | unknown | W195 E196 H204 |
| 4B3 | A | H203 H204 |
| 50G9 | A | H203 H204 |
| 60D2 | A | H203 H204 |
| 59F2 | A | H203 H204 |
| 60E8 | A | H203 H204 P220 G251 |
| 65E9 | A.1 | H203 H204 |
| 5E5 | A | K199 W195 R263 |
| 29E2 | A | K199 R263 |
| 45B4 | A | K199 R263 |
| 6G7 | B | L184 |
| 72F5 | B.1 | L184 |
| 22G5 | B | L184 N265 P220 H215 G251 G248 R183 G246 |
| 48B12 | B | L184 |
| 151B9 | B | L184 |
| 52H2 | B | L184 P238 H247 G251 P220 |
| 149D11 | B | R170 L184 S171 |
| 175F4 | B | R183 |
| 147E9 | C | P241 D242 G251 E253 V245 |
| 61A1 | C | P241 V245 D242 E253 G251 |
| 184E7 | C | E253 P241 |
| 72G9 | C | P241 D242 E253 G251 |
| 194A4 | C | D260 |
| 60C12 | E | D260 R263 |
| 173C11 | E | D260 T259 R263 |
| 56E3 | E.1 | T259 R263 N265 D260 P241 R170 |
| 54E9 | E.1 | N265 R263 D260 P241 E239 |
| 65D5 | E | D260 H247 R263 T259 |
| 190F8 | L | R271 R274 G172 P272 V208 |
| 198G3 | L | R271 R274 G172 |
| 191G10 | L | R271 G172 R274 |
| 202A3 | unknown | R271 G172 N209 |
| 194C1 | L | R274 R271 R272 G172 V208 R170 |
| 178H4 | R | R274 R271 N265 G172 P241 L249 H247 D242 |
| 197G3 | L | R274 R271 R170 G172 D243 G248 D216 P272 S171 Q270 L249 E196 D260 H215 D225 D228 G251 E280 P207 H204 |
| 191G1 | L | R274 R238 R271 R272 G172 V208 |
| 213B3 | L | R238 R271 R274 P272 G172 |
| 218G4 | O | R274 R238 G172 R271 |
| 75G3 | M | R274 R170 G172 V208 |
| 194C10 | T | R274 R170 G172 V208 |
| 85F7 | M.1 | R274 R170 V208 G172 |
| 199A7 | N | H215 R170 R183 Q270 |
| 146B6 | P | T259 N265 P241 |
| 193E7 | Q | R263 P207 |
| 65C12 | Q | |

METHODS OF TREATING CARDIOVASCULAR DISEASE WITH AN ASGR INHIBITOR

CROSS REFERENCE TO RELATED APPLICATIONS

This application claims priority to U.S. Provisional Patent Application No. 62/319,740, filed Apr. 7, 2016, U.S. Provisional Patent Application No. 62/259,553, filed Nov. 24, 2015, and U.S. Provisional Patent Application No. 62/234,546, filed Sep. 29, 2015, which are incorporated herein by reference in their entirety.

REFERENCE TO THE SEQUENCE LISTING AND TABLES IN ELECTRONIC FORMAT

This application contains a Sequence Listing which has been submitted electronically in ASCII format and is hereby incorporated by reference in its entirety. Said ASCII copy, created on Sep. 26, 2016, is named APMOL017ASEQUENCE.txt and is 14,772,816 bytes in size, and updated by a file entitled APMOL017ASEQUENCEREPLACEMENT.txt, created on Dec. 3, 2018, which is 14,782,505 bytes in size. The present application is being filed along with a collection of Tables in electronic format. The collection of Tables is provided as four files entitled TABLE10A.txt, TABLE10B.txt, TABLE10C.txt, and TABLE10D.txt, created and last saved on Sep. 26, 2016, which are 88,431, 356,111, 699,631, and 688,275 bytes in size respectively. The information in the electronic format of the collection of Tables is incorporated herein by reference in its entirety.

ASGR function. In one embodiment, the invention comprises an isolated antigen binding protein that binds to human ASGR and inhibits ASGR binding to ligand. In another embodiment, the invention comprises an isolated antigen binding protein that binds to human ASGR-1 and inhibits ASGR-1 binding to ligand and/or ASGR-1 interaction with ASGR-2. In another embodiment, the invention comprises an isolated antigen binding protein that binds to human ASGR-2 and inhibits ASGR-2 binding to ligand and/or ASGR-2 interaction with ASGR-1. In yet another embodiment, the invention comprises an isolated antigen binding protein that binds to human ASGR-1 and human ASGR-2, and inhibits ASGR-1 and/or ASGR-2 binding to ligand. In some embodiments, the isolated binding protein binds specifically to human ASGR, ASGR-1 and/or ASGR-2.

In some aspects, the invention provides an isolated antigen binding protein, wherein the isolated antigen binding protein binds to human ASGR-1 and comprises one or more VH CDR1, VH CDR2 or VH CDR3 having an amino acid sequence identical to or comprising 1, 2, or 3 amino acid residue substitutions, deletions or insertions in each CDR relative to the VH of any of the sequences set forth in Tables 3-7. In some aspects, the invention comprises an isolated antigen binding protein, wherein the isolated antigen binding protein binds to human ASGR-1 and comprises one or more VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises one or more VH CDR1, VH

LENGTHY TABLES

The patent contains a lengthy table section. A copy of the table is available in electronic form from the USPTO web site (http://seqdata.uspto.gov/?pageRequest=docDetail&DocID=US10358497B2). An electronic copy of the table will also be available from the USPTO upon request and payment of the fee set forth in 37 CFR 1.19(b)(3).

FIELD

The field of this invention relates to compositions and methods related to ASGR inhibitors, including but not limited to anti-ASGR, anti-ASGR-1, and/or anti-ASGR-2 antigen binding proteins.

BACKGROUND OF VARIOUS EMBODIMENTS

Cardiovascular disease involving the heart or blood vessels remains a leading cause of global mortality. Cardiovascular disease includes coronary artery disease (CAD) which can lead to angina and myocardial infarction (MI), stroke, hypertensive heart disease, rheumatic heart disease, and other disorders of the cardiovascular system. Medicines for treating cardiovascular disease, and in particular coronary artery disease, have been introduced over the years (e.g., the small molecule class of drugs called statins and the recently approved Repatha®, an antibody targeting PCSK9).

SUMMARY OF VARIOUS EMBODIMENTS

In some aspects, the invention provides an isolated antigen binding protein that binds to human ASGR and inhibits CDR2 or VH CDR3 having an amino acid sequence identical to or comprising 1, 2, or 3 amino acid residue substitutions, deletions or insertions in each CDR relative to the VH of any of the sequences set forth in Tables 3-7, and one or more VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises one VH CDR1, VH CDR2 or VH CDR3 having an amino acid sequence identical to or comprising 1, 2, or 3 amino acid residue substitutions, deletions or insertions in each CDR relative to the VH of any of the sequences set forth in Tables 3-7, and one VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises two VH CDR1, VH CDR2 or VH CDR3 having an amino acid sequence identical to or comprising 1, 2, or 3 amino acid residue substitutions, deletions or insertions in each CDR relative to the VH of any of the sequences set forth in Tables 3-7, and two VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises the VH CDR1, VH CDR2 and VH CDR3 having an amino acid sequence identical to or comprising 1, 2, or 3 amino acid residue substitutions, deletions or insertions in each CDR relative to the VH of any of the sequences set forth in Tables 3-7, and the VL CDR1, VL CDR2 and VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises the VH CDR1, VH CDR2, VH CDR3, VL CDR1, VL CDR2, and VL CDR3 having an amino acid sequence identical to any of the sequences set forth in Tables 3-7. In some embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in TABLE A. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in TABLE A. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in TABLE A, and the VL CDR1, VL CDR2 and VL CDR3, having an amino acid sequence identical to or comprising 1, 2, or 3 amino acid residue substitutions, deletions or insertions in each CDR relative to the VL of any of the sequences set forth in TABLE A. In some embodiments, the isolated antigen binding protein comprises the VH CDR1, VH CDR2, VH CDR3, VL CDR1, VL CDR2, and VL CDR3 having an amino acid sequence identical to any of the sequences set forth in TABLE A. In some embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in TABLE B. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in TABLE B. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in TABLE B, and the VL CDR1, VL CDR2 and VL CDR3 having an amino acid sequence identical to or comprising 1, 2, or 3 amino acid residue substitutions, deletions or insertions in each CDR relative to the VL of any of the sequences set forth in TABLE B. In some embodiments, the isolated antigen binding protein comprises the VH CDR1, VH CDR2, VH CDR3, VL CDR1, VL CDR2, and VL CDR3 having an amino acid sequence identical to any of the sequences set forth in TABLE B. In still some embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in TABLE C. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in TABLE C. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in TABLE C, and the VL CDR1, VL CDR2 and VL CDR3, having an amino acid sequence identical to or comprising 1, 2, or 3 amino acid residue substitutions, deletions or insertions in each CDR relative to the VL of any of the sequences set forth in TABLE C. In some embodiments, the isolated antigen binding protein comprises the VH CDR1, VH CDR2, VH CDR3, VL CDR1, VL CDR2, and VL CDR3 having an amino acid sequence identical to any of the sequences set forth in TABLE C. In further embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in Table 6. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in Table 6. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in Table 6, and the VL CDR1, VL CDR2 and VL CDR3, having an amino acid sequence identical to or comprising 1, 2, or 3 amino acid residue substitutions, deletions or insertions in each CDR relative to the VL of any of the sequences set forth in Table 6. In some embodiments, the isolated antigen binding protein comprises the VH CDR1, VH CDR2, VH CDR3, VL CDR1, VL CDR2, and VL CDR3 having an amino acid sequence identical to any of the sequences set forth in Table 6.

In some aspects, the invention provides an isolated antigen binding protein, wherein the antigen binding protein specifically binds human ASGR-1 and comprises a heavy chain variable domain having at least 90% identity to any of the VH domain amino acid sequences set forth in Tables 3-7. In some aspects, the invention provides an isolated antigen binding protein, wherein the antigen binding protein specifically binds human ASGR-1 and comprises a light chain variable domain having at least 90% identity to any of the VL domain amino acid sequences set forth in Tables 3-7. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Tables 3-7, and a light chain variable domain having at least 90% identity to any of the VL domain amino acid sequences set forth in Tables 3-7. In some embodiments, the invention provides an isolated antigen binding protein, wherein the antigen binding protein specifically binds human ASGR-1 and comprises a heavy chain variable domain having any of the VH domain amino acid sequences set forth in Tables 3-7, and a light chain variable domain having any of the VL domain amino acid sequences set forth in Tables 3-7. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table A. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table A. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table A, and a light chain variable domain having at least 90% identity to any of the VL domain amino acid sequences set forth in Table A. In some embodiments, the invention provides an isolated antigen binding protein, wherein the antigen binding protein specifically binds human ASGR-1 and comprises a heavy chain variable domain having any of the VH domain amino acid sequences set forth in Table A, and a light chain variable domain having any of the VL domain amino acid sequences set forth in Table A. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table B. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table B. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table B, and a light chain variable domain having at least 90% identity to any of the VL domain amino acid sequences set forth in Table B. In some embodiments, the invention provides an isolated antigen binding protein, wherein the antigen binding protein specifically binds human ASGR-1 and comprises a heavy chain variable domain having any of the VH domain amino acid sequences set forth in Table B, and a light chain variable domain having any of the VL domain amino acid sequences set forth in Table B. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table C. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table C. In some embodiments, the invention provides an antigen binding protein, wherein the antigen binding protein specifically binds human ASGR-1 and comprises a heavy chain variable domain having at least 90% identity to any of the VH domain amino acid sequences set forth in Table C, and a light chain variable domain having at least 90% identity to any of the VL domain amino acid sequences set forth in Table C. In some embodiments, the invention provides an isolated antigen binding protein, wherein the antigen binding protein specifically binds human ASGR-1 and comprises a heavy chain variable domain having any of the VH domain amino acid sequences set forth in Table C, and a light chain variable domain having any of the VL domain amino acid sequences set forth in Table C. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table 6. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table 6. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table 6, and a light chain variable domain having at least 90% identity to any of the VL domain amino acid sequences set forth in Table 6. In some embodiments, the invention provides an isolated antigen binding protein, wherein the antigen binding protein specifically binds human ASGR-1 and comprises a heavy chain variable domain having any of the VH domain amino acid sequences set forth in Table 6, and a light chain variable domain having any of the VL domain amino acid sequences set forth in Table 6.

In some aspects, the invention provides an isolated antigen binding protein, wherein the antigen binding protein binds human ASGR-1 and comprises one or more VH CDR1, VH CDR2 or VH CDR3 having an amino acid sequence identical to or comprising no more than 18 amino acid residue substitutions, insertions or deletions in each CDR relative to the VH of any of the sequences set forth in Table 19A as depicted in FIG. 55. In some embodiments, the invention provides an isolated antigen binding protein, wherein the antigen binding protein binds human ASGR-1 and comprises one or more VH CDR1, VH CDR2 or VH CDR3 having an amino acid sequence identical to or comprising a conservative substitution of any of the amino acid sequences set forth in Tables 19B or 19C, as depicted in FIG. 55. In some aspects, the invention comprises an isolated antigen binding protein, wherein the isolated antigen binding protein binds to human ASGR-1 and comprises one or more VL CDR1, VL CDR2 or VL CDR3 having an amino acid sequence identical to or comprising no more than 14 amino acid residue substitutions, insertions or deletions in each CDR relative to the VL of any of the sequences set forth in Table 20A as depicted in FIG. 55. In some embodiments, the invention provides an isolated antigen binding protein, wherein the antigen binding protein binds human ASGR-1 and comprises one or more VL CDR1, VL CDR2 or VL CDR3 having an amino acid sequence identical to or comprising a conservative substitution of any of the amino acid sequences set forth in Tables 20B or 20C, as depicted in FIG. 55. In some embodiments, the isolated antigen binding protein comprises one or more VH CDR1, VH CDR2 or VH CDR3 having an amino acid sequence identical to or comprising no more than 18 amino acid residue substitutions, insertions or deletions in each CDR relative to the VH of any of the sequences set forth in Table 19A, as depicted in FIG. 55, and one or more VL CDR1, VL CDR2 or VL CDR3 having an amino acid sequence identical to or comprising no more than 14 amino acid residue substitutions, insertions or deletions in each CDR relative to the VL of any of the sequences set forth in Table 20A as depicted in FIG. 55. In some embodiments, the invention provides an isolated antigen binding protein, wherein the antigen binding protein binds human ASGR-1 and comprises one or more VH CDR1, VH CDR2 or VH CDR3 having an amino acid sequence identical to or comprising a conservative substitution of any of the amino acid sequences set forth in Tables 19B or 19C, as depicted in FIG. 55, and one or more VL CDR1, VL CDR2 or VL CDR3 having an amino acid sequence identical to or comprising a conservative substitution of any of the amino acid sequences set forth in Tables 20B or 20C, as depicted in FIG. 55. In some embodiments, the isolated antigen binding protein comprises one VH CDR1, VH CDR2 or VH CDR3 having an amino acid sequence identical no more than 18 amino acid residue substitutions, insertions or deletions in each CDR relative to the VH of any of the sequences set forth in Table 19A, as depicted in FIG. 55, and one VL CDR1, VL CDR2 or VL CDR3 having an amino acid sequence identical to or comprising no more than 14 amino acid residue substitutions, insertions or deletions in each CDR relative to the VL of any of the sequences set forth in Table 20A, as depicted in FIG. 55. In some embodiments, the invention provides an isolated antigen binding protein, wherein the antigen binding protein binds human ASGR-1 and comprises one VH CDR1, VH CDR2 or VH CDR3 having an amino acid sequence identical to or comprising a conservative substitution of any of the amino acid sequences set forth in Tables 19B or 19C, as depicted in FIG. 55, and one VL CDR1, VL CDR2 or VL CDR3 having an amino acid sequence identical to or comprising a conservative substitution of any of the amino acid sequences set forth in Tables 20B or 20C, as depicted in FIG. 55. In some embodiments, the isolated antigen binding protein comprises two VH CDR1, VH CDR2 or VH CDR3 having an amino acid sequence identical to or comprising up to 18 amino acid residue substitutions, insertions or deletions in each CDR relative to the VH of any of the sequences set forth in Table 19A, as depicted in FIG. 55, and two VL CDR1, VL CDR2 or VL CDR3 having an amino acid sequence identical to or comprising up to 14 amino acid residue substitutions, insertions or deletions in each CDR relative to the VL of any of the sequences set forth in Table 20A, as depicted in FIG. 55. In some embodiments, the invention provides an isolated antigen binding protein, wherein the antigen binding protein binds human ASGR-1 and comprises two VH CDR1, VH CDR2 or VH CDR3 having an amino acid sequence identical to or comprising a conservative substitution of any of the amino acid sequences set forth in Tables 19B or 19C, as depicted in FIG. 55, and two VL CDR1, VL CDR2 or VL CDR3 having an amino acid sequence identical to or comprising a conservative substitution of any of the amino acid sequences set forth in Tables 20B or 20C, as depicted in FIG. 55. In some embodiments, the isolated antigen binding protein comprises the VH CDR1, VH CDR2 and VH CDR3 having an amino acid sequence identical to or comprising up to 18 amino acid residue substitutions, insertions or deletions in each CDR relative to the VH of any of the sequences set forth in Table 19A, as depicted in FIG. 55, and the VL CDR1, VL CDR2 and VL CDR3 having an amino acid sequence identical to or comprising up to 14 amino acid residue substitutions, insertions or deletions in each CDR relative to the VL of any of the sequences set forth in Table 20A, as depicted in FIG. 55. In some embodiments, the invention provides an isolated antigen binding protein, wherein the antigen binding protein binds human ASGR-1 and comprises the VH CDR1, VH CDR2 or VH CDR3 having an amino acid sequence identical to or comprising a conservative substitution of any of the amino acid sequences set forth in Tables 19B or 19C, as depicted in FIG. 55, and the VL CDR1, VL CDR2 or VL CDR3 having an amino acid sequence identical to or comprising a conservative substitution of any of the amino acid sequences set forth in Tables 20B or 20C, as depicted in FIG. 55.

In some aspects, the invention provides an isolated antigen binding protein, wherein the antigen binding protein specifically binds human ASGR-1 and comprises a heavy chain variable domain having at least 90% identity to any of the VH domain amino acid sequences set forth in Tables 19A, as depicted in FIG. 55 or in Tables 21-34 as depicted in FIG. 56 or in Tables 49-95 as depicted in FIG. 56. In some aspects, the invention provides an isolated antigen binding protein, wherein the antigen binding protein specifically binds human ASGR-1 and comprises a light chain variable domain having at least 90% identity to any of the VL domain amino acid sequences set forth in Table 20A, as depicted in FIG. 55, or in Tables 35-48, as depicted in FIG. 56 or in Tables 96-134 as depicted in FIG. 57. In some embodiments, the antigen binding protein comprises a heavy chain variable domain having at least 90% identity to any of the VH domain amino acid sequences set forth in Tables 19A as depicted in FIG. 55, or in Tables 21-34 as depicted in FIG. 56 or in Tables 49-95 as depicted in FIG. 57, and a light chain variable domain having at least 90% identity to any of the VL domain amino acid sequences set forth in Table 20A as depicted in FIG. 55 or in Tables 35-48 as depicted in FIG. 56 or in Tables 96-134 as depicted in FIG. 57. In some embodiments, the antigen binding protein comprises a heavy chain variable domain having any of the VH domain amino acid sequences set forth in Tables 19A as depicted in FIG. 55, or in Tables 21-34 as depicted in FIG. 56 or in Tables 49-95 as depicted in FIG. 57, and a light chain variable domain having any of the VL domain amino acid sequences set forth in Table 20A as depicted in FIG. 55 or in Tables 35-48 as depicted in FIG. 56 or in Tables 96-134 as depicted in FIG. 57.

In some aspects, the invention provides an antigen binding protein that specifically binds to human ASGR-1 at an epitope that is bound by any of the antigen binding proteins disclosed herein. In some embodiments, the invention provides an isolated antigen binding protein that specifically binds to human ASGR-1 at an epitope that is bound by at least one of the antigen binding proteins set forth in Tables 2-7. In some embodiments, the invention provides an isolated antigen binding protein that specifically binds to human ASGR-1 at an epitope that is bound by at least one of the antigen binding proteins set forth in Table A. In some embodiments, the invention provides an isolated antigen binding protein that specifically binds to human ASGR-1 at an epitope that is bound by at least one of the antigen binding proteins set forth in Table B. In some embodiments, the invention provides an isolated antigen binding protein that specifically binds to human ASGR-1 at an epitope that is bound by at least one of the antigen binding proteins set forth in Table C. In some embodiments, the invention provides an isolated antigen binding protein that specifically binds to human ASGR-1 at an epitope that is bound by at least one of the antigen binding proteins set forth in Table 6.

In some aspects, the invention provides an isolated antigen binding protein that competes for binding to human ASGR-1 with any of the antigen binding proteins disclosed herein. In some embodiments, the invention provides an isolated antigen binding protein that competes for binding with any of the antigen binding proteins set forth in Tables 2-7. In some embodiments, the invention provides an isolated antigen binding protein that competes for binding with any of the antigen binding proteins set forth in Table A. In some embodiments, the invention provides an isolated antigen binding protein that competes for binding with any of the antigen binding proteins set forth in Table B. In still some embodiments, the invention provides an isolated antigen binding protein that competes for binding with any of the antigen binding proteins set forth in Table C. In yet another embodiment, the invention provides an isolated antigen binding protein that competes for binding with any of the antigen binding proteins set forth in Table 6.

In some aspects, the invention provides an isolated antigen binding protein that binds to human ASGR-1 within the carbohydrate recognition domain ("CRD") (also known as the carbohydrate binding domain or "CBD") and inhibits human ASGR-1 binding to ligand. In some embodiments, the antigen binding protein binds to human ASGR-1 within residues 148-291, or 149-291, or 150-291, or 151-291, or 152-291, or 153-291, or 154-291, or 155-291 of SEQ ID NO:5. In some embodiments, the invention comprises an isolated antigen binding protein that binds to human ASGR-1 CBD within Helix α-1. In some embodiments, the invention comprises an isolated antigen binding protein that binds to human ASGR-1 within residues 174-186 of SEQ ID NO:5. In some embodiments, the invention comprises an isolated antigen binding protein that binds to human ASGR-1 CBD within Helix α-2. In some embodiments, the invention comprises an isolated antigen binding protein that binds to human ASGR-1 CBD within residues 194-206 of SEQ ID NO:5. In some embodiments, the invention comprises an isolated antigen binding protein that binds to human ASGR-1 within residues 237-273 or residues 240-267 of SEQ ID NO:5. In some embodiments, the antigen binding protein binds to ASGR-1 having an amino acid sequence that is at least 90% identical to SEQ ID NO:5. In some embodiments, the antigen binding protein is an antibody.

In some aspects, the invention provides an isolated antigen binding protein or an antibody that binds to human ASGR-1 and inhibits human ASGR-1 function. In some embodiments, the isolated antigen binding protein or an antibody binds to human ASGR-1 and inhibits human ASGR-1 from binding to a ligand. In some embodiments, the antigen binding protein or antibody or a paratope in an antibody binds to human ASGR-1 at an epitope comprising at least one of the following amino acid residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, R274 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, F258, H257, T259, V268, R271, Y273, N209, R237, Q240, D242, W244, E253, H257, T259, N265, D266, D267, or Y273 (SEQ ID NO:5). In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252,: H161, E162, V191, V192, E197, Q198, D216, G219, K222, W223, D225, R263, W264, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, or R274 (SEQ ID NO:5). In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments when the antigen binding protein or antibody or paratope in an antibody binds to human ASGR-1 at an epitope comprising at least one of the following residues: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments, the antigen binding protein or antibody or paratope in an antibody binds to human ASGR-1 at an epitope comprising at least one of the following residues: H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, N157, R170, S171, G172, Q202, H203, H204, I205, G206, P207, V208, N209, T210, D260, R271, P272, Y273, or R274 (SEQ ID NO:5). In some embodiments, the antigen binding protein or antibody or a paratope in an antibody binds to human ASGR-1 at an epitope comprising at least one of the following amino acid residues: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, or W264 (SEQ ID NO:5). In some embodiments, the antigen binding protein or antibody or a paratope in an antibody binds to human ASGR-1 at an epitope comprising at least one of the following amino acid residues: H161, E162, W195, E196, Q198, K199, F200, Q202, H203, H204, G232, F233, K234, N235, W236, R237, P238, D261, G262, or R263 (SEQ ID NO:5). In some embodiments, the antigen binding protein or antibody or a paratope in an antibody binds to human ASGR1 at an epitope comprising at least one of the following amino acid residues: W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, or T279 (SEQ ID NO:5). In some embodiments, the antigen binding protein or antibody or a paratope in an antibody binds to human ASGR-1 at an epitope comprising at least one of the following amino acid residues: W167, S171, G172, K173, A174, A176, D177, N180, Y181, R183, L184, E185, D186, Q270, P272, or W275 (SEQ ID NO:5). In some embodiments, the antigen binding protein or antibody or a paratope in an antibody binds to human ASGR-1 at an epitope comprising at least one of the following amino acid residues: R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, or W264 (SEQ ID NO:5). In some embodiments, the antigen binding protein or antibody or a paratope in an antibody binds to human ASGR-1 at an epitope comprising at least one of the following amino acid residues: R170, W195, E196, K199, Q202, H203, H204, I205, G206, P207, V208, F233, K234, N235, W236, P238, D260, D261, G262, R263, or R274 (SEQ ID NO:5). In some embodiments, the antigen binding protein or antibody or a paratope in an antibody binds to human ASGR-1 at an epitope comprising at least one of the following amino acid residues: H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, or W264 (SEQ ID NO:5). In some embodiments, the antigen binding protein or antibody or a paratope in an antibody binds to human ASGR-1 at an epitope comprising at least one of the following amino acid residues: H161, S194, W195, E196, Q198, K199, F200, Q202, H203, F233, K234, N235, W236, R237, P238, or R263 (SEQ ID NO:5). In some embodiments, the antigen binding protein or antibody or a paratope in an antibody binds to human ASGR-1 at an epitope comprising at least one of the following amino acid residues: H161, E162, T193, S194, W195, E196, K199, Q202, T231, G232, F233, K234, N235, P238, D261, R263, R163, V192, E197, Q198, H203, P207, D228, E230, W236, R237, D260, G262, or W264 (SEQ ID NO:5). In some embodiments, the antigen binding protein or antibody or a paratope in an antibody binds to human ASGR-1 at an epitope comprising at least one of the following amino acid residues: H161, E162, T193, S194, W195, E196, K199, Q202, T231, G232, F233, K234, N235, P238, D261, or R263 (SEQ ID NO:5). In some embodiments, the antigen binding protein or antibody or a paratope in an antibody binds to human ASGR-1 at an epitope comprising at least one of the following amino acid residues: T193, S194, W195, E196, P220, W221, G226, T227, D228, Y229, E230, T231, G232, F233, K234, N235, W236, R237, P238, E239, G252, : H161, E162, V191, V192, E197, Q198, D216, G219, K222, W223, D225, R263, or W264 (SEQ ID NO:5). In some embodiments, the antigen binding protein or antibody or a paratope in an antibody binds to human ASGR-1 at an epitope comprising at least one of the following amino acid residues: T193, S194, W195, E196, P220, W221, G226, T227, D228, Y229, E230, T231, G232, F233, K234, N235, W236, R237, P238, E239, or G252 (SEQ ID NO:5). In some embodiments, the antigen binding protein or antibody or a paratope in an antibody binds to human ASGR-1 at an epitope comprising at least one of the following amino acid residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, or C269 (SEQ ID NO:5). In some embodiments, the antigen binding protein or antibody or a paratope in an antibody binds to human ASGR-1 at an epitope comprising at least one of the following amino acid residues: D216, Q217, N218, G219, P220, W221, Y229, E230, K234, W236, E239, Q240, P241, D242, D243, W244, Y245, G246, L249, G250, G251, G252, D254, or Q270 (SEQ ID NO:5). In some embodiments, the antigen binding protein or antibody or a paratope in an antibody binds to human ASGR-1 at an epitope comprising at least one of the following amino acid residues: W195, N209, N235, R237, P238, E239, Q240, D242, H257, T259, D260, D261, R263, N265, D267, R271, Y273, Q198, Q202, P207, V208, F233, W236, D243, E253, F258, G262, W264, or D266 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: W195, N209, N235, R237, P238, E239, Q240, D242, H257, T259, D260, D261, R263, N265, D267, R271, or Y273 (SEQ ID NO:5). In some embodiments, the antigen binding protein or antibody or a paratope in an antibody binds to human ASGR-1 at an epitope comprising at least one of the following amino acid residues: N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments, the antigen binding protein or antibody or a paratope in an antibody binds to human ASGR-1 at an epitope comprising at least one of the following amino acid residues: N157, R170, S171, G172, Q202, H203, H204, I205, G206, P207, V208, N209, T210, D260, R271, P272, Y273, or R274 (SEQ ID NO:5). In some embodiments, the antigen binding protein or antibody or a paratope in an antibody binds to human ASGR-1 at an epitope comprising at least one of the following amino acid residues: R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, or W275 (SEQ ID NO:5). In some embodiments, the antigen binding protein or antibody or a paratope in an antibody binds to human ASGR-1 at an epitope comprising at least one of the following amino acid residues: R170, S171, G172, A174, H204, I205, G206, P207, V208, N209, H257, D260, N265, D267, Q270, R271, P272, Y273, or R274 (SEQ ID NO:5). In some embodiments, the antigen binding protein or antibody or a paratope in an antibody binds to human ASGR-1 at an epitope comprising at least one of the following amino acid residues: R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments, the antigen binding protein or antibody or a paratope in an antibody binds to human ASGR-1 at an epitope comprising at least one of the following amino acid residues: R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5).

In some aspects, the invention provides an isolated antigen binding protein or an antibody or a paratope in an antibody that specifically binds to human ASGR-1 and inhibits human ASGR-1 function. In some embodiments, the isolated antigen binding protein or an antibody or a paratope in an antibody specifically binds to human ASGR-1 and inhibits human ASGR-1 from binding to a ligand. In some embodiments, the antigen binding protein or antibody or a paratope in an antibody specifically binds to human ASGR-1 within residues 148-291 of SEQ ID NO:5. In some embodiments when the antigen binding protein or antibody or a paratope in an antibody is bound to human ASGR-1, the antigen binding protein or antibody or a paratope in an antibody is positioned 8 angstroms or less from at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, or R274 (SEQ ID NO:5).

In some embodiments when the antigen binding protein or antibody or a paratope in an antibody is bound to human ASGR-1, the antigen binding protein or antibody or a paratope in an antibody is positioned 8 angstroms or less from at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, or Y273 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, or Y273 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, or Y273 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, or D267 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R237, Q240, D242, W244, E253, N265, D266, D267, N209, P238, E239, P241, D243, Y245, G246, H247, G252, C255, H257, T259, V268, R271, or Y273 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: R237, Q240, D242, W244, E253, N265, D266, or D267 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: N209, R237, Q240, D242, W244, E253, H257, T259, N265, D266, D267, Y273, P238, E239, P241, D243, Y245, G246, H247, G252, C255, F258, D260, R263, W264, V268, or R271 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: N209, R237, Q240, D242, W244, E253, H257, T259, N265, D266, D267, or Y273 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, or C269 (SEQ ID NO:5). In some embodiments when the antigen binding protein or antibody is bound to human ASGR-1, the antigen binding protein or antibody or a paratope in an antibody is positioned 5 angstroms or less from at least one of the following residues: D216, Q217, N218, G219, P220, W221, Y229, E230, K234, W236, E239, Q240, P241, D242, D243, W244, Y245, G246, L249, G250, G251, G252, D254, or Q270 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: W195, N209, N235, R237, P238, E239, Q240, D242, H257, T259, D260, D261, R263, N265, D267, R271, Y273, Q198, Q202, P207, V208, F233, W236, D243, E253, F258, G262, W264, or D266 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: W195, N209, N235, R237, P238, E239, Q240, D242, H257, T259, D260, D261, R263, N265, D267, R271, or Y273 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: R170, S171, G172, A174, H204, I205, G206, P207, V208, N209, H257, D260, N265, D267, Q270, R271, P272, Y273, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues of human ASGR-1 (SEQ ID NO:5): D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, N157, R170, S171, G172, Q202, H203, H204, I205, G206, P207, V208, N209, T210, D260, R271, P272, Y273, R274, V156, W158, V159, H161, W167, F168, S169, K173, (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, or W264 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues of human ASGR-1 (SEQ ID NO:5): H161, E162, W195, E196, Q198, K199, F200, Q202, H203, H204, G232, F233, K234, N235, W236, R237, P238, D261, G262, or R263 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, or T279 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: W167, S171, G172, K173, A174, A176, D177, N180, Y181, R183, L184, E185, D186, Q270, P272, or W275 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, or W264 (SEQ ID NO:5). In some embodiments when the antigen binding protein or antibody or a paratope in an antibody is bound to human ASGR-1, the antigen binding protein or a paratope in an antibody is positioned 5 angstroms or less from at least one of the following residues: R170, W195, E196, K199, Q202, H203, H204, I205, G206, P207, V208, F233, K234, N235, W236, P238, D260, D261, G262, R263, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, or W264 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: H161, S194, W195, E196, Q198, K199, F200, Q202, H203, F233, K234, N235, W236, R237, P238, or R263 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: H161, E162, T193, S194, W195, E196, K199, Q202, T231, G232, F233, K234, N235, P238, D261, R263, R163, V192, E197, Q198, H203, P207, D228, E230, W236, R237, D260, G262, or W264 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: H161, E162, T193, S194, W195, E196, K199, Q202, T231, G232, F233, K234, N235, P238, D261, or R263 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: T193, S194, W195, E196, P220, W221, G226, T227, D228, Y229, E230, T231, G232, F233, K234, N235, W236, R237, P238, E239, G252, : H161, E162, V191, V192, E197, Q198, D216, G219, K222, W223, D225, R263, or W264 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: T193, S194, W195, E196, P220, W221, G226, T227, D228, Y229, E230, T231, G232, F233, K234, N235, W236, R237, P238, E239, or G252 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270 or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: N157, R170, S171, G172, Q202, H203, H204, I205, G206, P207, V208, N209, T210, D260, R271, P272, Y273 or R274 (SEQ ID NO:5).

In some aspects, the invention comprises an isolated antigen binding protein or antibody that specifically binds to human ASGR-1 and inhibits human ASGR-1 function. In some embodiments, the isolated antigen binding protein or antibody that specifically binds to human ASGR-1 inhibits binding of human ASGR-1 binding to a ligand. In some embodiments, the antigen binding protein or antibody specifically binds to human ASGR-1 at a location that overlaps with a location where a ligand binds to human ASGR-1. In some embodiments, the location where a ligand binds to ASGR-1 includes at least one amino acid residue selected from the group consisting of: N209, R237, Q240, D242, W244, E253, H257, T259, N265, D266, D267, Y273, P238, E239, P241, D243, Y245, G246, H247, G252, C255, F258, D260, R263, W264, V268, or R271 (SEQ ID NO:5). In some embodiments, an isolated antigen binding protein or an antibody specifically binds to human ASGR-1 at a location that overlaps with a location that a ligand binds to ASGR-1. In some embodiments, the location that a ligand binds to human ASGR-1 includes at least one amino acid residue selected from the group consisting of: N209, R237, Q240, D242, W244, E253, H257, T259, N265, D266, D267, and Y273 (SEQ ID NO:5).

In some aspects, the invention comprises an isolated antigen binding protein that binds to human ASGR-1 and inhibits human ASGR, ASGR-1 and/or ASGR-2 function, wherein the antigen binding protein does not bind to a variant ASGR-1 protein, and wherein said variant ASGR-1 protein comprises a single mutation of a residue selected the group consisting of: R170, S171, G172, R183, L184, W195, E196, K199, H203, H204, P207, V208, N209, H215, D216, P220, D225, D228, R237, P238, E239, P241, D242, D243, Y245, G246, H247, G248, L249, G251, E253, T259, D260, R263, N265, Q270, R271, P272, R274, and E280 as shown in SEQ ID NO:5. In some embodiments, an isolated antigen binding protein or an antibody is contemplated. An antigen binding protein "does not bind" to a variant ASGR-1 protein when the measured reduction in antibody binding signal to a variant ASGR-1 protein (compared to that determined for binding to wild type ASGR-1) is statistically significant as measured by any number of methods known to one skilled in the art, such as the method described in Example 7E below. In some embodiments, the variant ASGR-1 protein comprises a single mutation of a residue at a position selected from the group consisting of: W195, E196, K199, H203, H204, P207, P220, G251, and R263 as shown in SEQ ID NO:5. In some embodiments, the single mutation is selected from the group consisting of H203, H204, P220, and G251. In some embodiments, the single mutation is selected from the group consisting of W195, E196 and K199. In some embodiments, the single mutation is selected from the group consisting of W195, E196 and H204. In some embodiments, the single mutation is selected from the group consisting W195, K199, and R263. In some embodiments, the single mutation is selected from the group consisting of W195 and E196. In some embodiments, the single mutation is selected from the group consisting of W195 and K199. In some embodiments, the single mutation is selected from the group consisting of W195 or P207. In some embodiments, the single mutation is selected from the group consisting of W195 and R263. In some embodiments, the single mutation is selected from the group consisting of H203 and H204. In some embodiments, the single mutation is selected from the group consisting of K199 and R263. In some embodiments, the single mutation is a mutation of residue W195. In some embodiments, the variant ASGR-1 protein comprises a single mutation of a residue selected from the group consisting of: R170, S171, R183, L184, H215, P220, P238, G246, H247, G248, G251, and N265 as shown in SEQ ID NO:5. In some embodiments, the single mutation is selected from the group consisting of R183, L184, H215, P220, G246, G248, G251, and N265. In some embodiments, the single mutation is selected from the group consisting of L184, P220, P238, H247, and G251. In some embodiments, the single mutation is selected from the group consisting of R170, S171, and L184. In some embodiments, the single mutation is a mutation of residue R183. In some embodiments, the single mutation is a mutation of residue L184. In some embodiments, the variant ASGR-1 protein comprises a single mutation of a residue at a position selected from the group consisting of: P241, D242, D243, Y245, G251, E253 and D260 as shown in SEQ ID NO:5. In some embodiments, the single mutation is selected from the group consisting of P241, D243, Y245, G251, E253 and D260. In some embodiments, the single mutation is selected from the group consisting of P241, D243, and E253. In some embodiments, the single mutation is a mutation of residue D260. In some embodiments, the variant ASGR-1 protein comprises a single mutation of a residue at a position selected from the group consisting or comprising: R170, R237, E239, P241, T259, D260, R263, and N265 as shown in SEQ ID NO:5. In some embodiments, the single mutation is selected from the group consisting of R237, D260 and R263. In some embodiments, the single mutation is selected from the group consisting of R237, T259, D260 and R263. In some embodiments, the single mutation is selected from the group consisting of R170, R237, P241, T259, D260, R263 and N265. In some embodiments, the single mutation is selected from the group consisting of R237, E239, P241, T259, D260, R263 and N265. In some embodiments, the variant ASGR-1 protein comprises a single mutation of a residue at a position selected from the group consisting or comprising: R170, S171, G172, E196, H204, P207, V208, N209, H215, D216, D225, D228, P238, P241, D242, D243, H247, G248, L249, G251, D260, R263, N265, Q270, R271, P272, R274 and E280 as shown in SEQ ID NO:5. In some embodiments, the single mutation is selected from the group consisting of R170, S171, G172, E196, H204, P207, V208, N209, H215, D216, D225, D228, P238, P241, D242, D243, H247, G248, L249, G251, D260, R263, N265, Q270, R271, P272, R274 and E280 as shown in SEQ ID NO:5. In some embodiments, the single mutation is selected from the group consisting of R170, S171, G172, E196, H204, P207, H215, D216, D225, D228, D243, G248, L249, G251, D260, Q270, R271, P272, R274 and E280. In some embodiments, the single mutation is selected from the group consisting of G172, V208, R271, P272 and R274. In some embodiments, the single mutation is selected from the group consisting of G172, R271 and R274. In some embodiments, the single mutation is selected from the group consisting of G172, N209, and R271. In some embodiments, the single mutation is selected from the group consisting of R170, G172, V208, R271 and P272. In some embodiments, the single mutation is selected from the group consisting of G172, V208, P238, R271, P272 and R274. In some embodiments, the single mutation is selected from the group consisting of G172, P238, R271, P272 and R274. In some embodiments, the variant ASGR-1 protein comprises a single mutation of a residue at a position selected from the group consisting or comprising: G172, P238, R271 and R274 as shown in SEQ ID NO:5. In some embodiments, the variant ASGR-1 protein comprises a single mutation of a residue at a position selected from the group consisting or comprising: R170, G172, V208 and R274 as shown in SEQ ID NO:5. In some embodiments, the variant ASGR-1 protein comprises a single mutation of a residue at a position selected from the group consisting or comprising: R170, R183, H215 and Q270 as shown in SEQ ID NO:5. In some embodiments, the variant ASGR-1 protein comprises a single mutation of a residue at a position selected from the group consisting or comprising: P241, T259, and N265 as shown in SEQ ID NO:5. In some embodiments, the variant ASGR-1 protein comprises a single mutation of a residue at a position selected from the group consisting or comprising: P207 and R263 as shown in SEQ ID NO:5. In some embodiments, the variant ASGR-1 protein comprises a single mutation of a residue at a position selected from the group consisting or comprising: G172, P241, D242, H247, L249, N265, R271 and P272 as shown in SEQ ID NO:5. In some embodiments, the antigen binding protein or antibody does not bind to two or more variant ASGR-1 proteins, wherein the variant ASGR-1 proteins comprise the single mutations of the group individually.

In some aspects, the invention comprises a vector comprising a nucleic acid molecule as described herein. In some embodiments, the invention comprises a host cell comprising a nucleic acid molecule as described herein.

In some aspects, the invention comprises a nucleic acid molecule encoding the antigen binding protein as described herein.

In some aspects, the invention comprises a pharmaceutical composition comprising at least one antigen binding protein described herein.

In some aspects, the invention provides a method of treating or preventing a cardiovascular disease comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the relative risk reduction of a cardiovascular event is at least about 5%, at least about 10%, at least about 15%, at least about 20%, at least about 25%, at least about 30%, at least about 35%, at least about 40%, at least about 45%, at least about 50%, at least about 55%, at least about 60% in the patient.

In some aspects, the invention provides a method of decreasing the risk of acquiring coronary artery disease or having a myocardial infarction (MI) comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the relative risk reduction of coronary artery disease or MI is at least about 5%, at least about 10%, at least about 15%, at least about 20%, at least about 25%, at least about 30%, at least about 35%, at least about 40%, at least about 45%, at least about 50%, at least about 55%, at least about 60% in the patient.

In other aspects, the invention provides a method of reducing blood LDL cholesterol levels in a patient comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, blood LDL cholesterol is reduced by at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, or at least about 90% as compared to a predose level of blood LDL cholesterol in the patient.

In still other aspects, the invention provides a method of reducing non-HDL cholesterol levels in a patient comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, non-HDL cholesterol is reduced by at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, or at least about 90% as compared to a predose level of non-HDL cholesterol in the patient.

In some aspects, the invention provides a method of increasing alkaline phosphatase ("ALP") levels in a patient comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, ALP levels are increased at least about 40%, at least about 45%, at least about 50%, at least about 55%, at least about 60%, at least about 65%, at least about 70%, at least about 75%, at least about 80%, at least about 85%, or at least about 90% as compared to a predose ALP level in the patient. In some embodiments, ALP levels are increased at least about 1.25×, 1.5×, 2×, 2.5×, 3×, 3.5×, 4×, 4.5×, and 5× over pretreatment.

In some aspects, the invention provides a method of antagonizing ASGR, ASGR-1 and/or ASGR-2 in a patient comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein.

BRIEF DESCRIPTION OF THE FIGURES

FIG. 1A. ASGR-1 sequence alignments of human (SEQ ID NO: 32699), cynomolgus monkey (cyno) (SEQ ID NO: 32700), dog (SEQ ID NO: 32701), pig (SEQ ID NO: 32702), rat (SEQ ID NO: 32703) and mouse ASGR-1 (SEQ ID NO: 32704). The boxed areas denoting different regions of ASGR-1 (i.e., cytoplasmic, transmembrane, and the carbohydrate binding domain (CBD; also called the carbohydrate recognition domain, or CRD) are representative of the approximate amino acid locations of these regions; the human Y273 amino acid is boxed.

FIG. 1B. Human ASGR-1 sequence alignments (SEQ ID NOS 32705-32710, respectively, in order of appearance).

FIG. 3. Human ASGR-1 (SEQ ID NO: 32717) vs. human ASGR-2v2 (SEQ ID NO: 32718) alignments are provided.

FIG. 5. (A) The del12 variant was typed in the indicated populations a total of 41,648 CAD cases and 247,374 controls. For each cohort, the square (diamond in the case of the combined estimate) indicates the estimated odds ratio and the line shows the 95% confidence interval. There was no evidence of heterogeneity across the eight study populations (Phet=0.96). (B) Kaplan-Meier curves for survival to first myocardial infarction in carriers and non-carriers of del12 in ASGR-1 stratified by sex. The proportion of individuals that have not had a myocardial infarction is shown on the y-axis and plotted against age on the x-axis. Males and females are represented separately and a distinction is made between del12 carriers and non-carriers in each case.

FIG. 8. RNAi in vitro data in CHO cells transfected with hASGR-1 using construct S1662. Panel A is a western blot demonstrating reduction of expression of human ASGR-1. Panel B is a graphical representation of the relative reduction in expression of human ASGR-1. Panel C demonstrates that CHO cells receiving construct S1662 displays a dramatic reduction in internalization of ligand (β-GalNAc).

FIG. 9. RNAi in vitro data in CHO cells transfected with mASGR-1 using various constructs. Panel A is a western blot demonstrating reduction of expression of mouse ASGR-1. Panel B is a graphical representation of the relative reduction in expression of mouse ASGR-1. Panel C demonstrates that CHO cells receiving the various constructs display a dramatic reduction in internalization of ligand (β-GalNAc).

FIG. 10. RNAi in vitro data in HepG2 cells using construct S1662. Panel A is a western blot demonstrating reduction of expression of human ASGR-1. Panel B is a graphical representation of the relative reduction in expression of human ASGR-1.

FIG. 11. RNAi in vitro data in CHO cells transfected with hASGR-2 using various constructs. Panel A is a western blot demonstrating reduction of expression of human ASGR-2. Panel B is a graphical representation of the relative reduction in expression of human ASGR-2 by the various constructs.

FIG. 13. RNAi in vitro data in HepG2 cells using various constructs. Panel A is a western blot demonstrating reduction of expression of human ASGR-2. Panel B is a graphical representation of the relative reduction in expression of human ASGR-2 by the various constructs.

FIG. 14. RNAi in vivo data in C57BL/6J mice using various constructs over the course of 7 days with three injections total, one injection at day 0, one injection at day 2 and one injection at day 4. Panel A is a graphical representation of quantitative per data showing the relative reduction in expression of mASGR-1 RNA in the liver. Panel B is a graphical representation of the relative reduction in expression of mASGR-2 RNA in the liver.

FIG. 16. RNAi in vivo data in C57BL/6J mice using various constructs over the course of 7 days with one injection at day 0. Panel A is a graphical representation of the relative reduction in expression of mASGR-2 in the liver. Panel B is a graphical representation of the relative reduction in expression of mASGR-1 in the liver.

FIG. 18. Panel A shows a computer representation of the crystal structure of the ASGR-1/lactose complex. Panel B is a computer representation of the observed electron density. Panel C is an enlarged view of the carbohydrate binding domain.

FIG. 19. Panel A shows a computer representation of the crystal structure of the ASGR-1/galactose complex. Panel B is a computer representation of the observed electron density. Panel C is an enlarged view of the carbohydrate binding domain.

FIG. 21. Panel A shows a computer representation of the crystal structure of the ASGR-1/GalNAc complex. Panel B is a computer representation of the observed electron density. Panel C is an enlarged view of the carbohydrate binding domain.

FIG. 22. Panel A shows a depiction of the structure of the ASGR-1 CBD and the 5E5 Fab. Panel B is an enlarged view of the ASGR-1 CBD and 5E5 Fab that represents a disordered carbohydrate binding loop with a dashed line and highlights the indirect inhibition of ASGR-1 CBD and the ligand (GalNAc) binding. Panel B also incorporates a double-headed arrow which represents a 5 angstrom distance from tip to tip.

FIG. 37. Panel A is a depiction of the structure of the ASGR-1 CBD and the 218G4 Fab; and Panel B is an enlarged view of the structure of the ASGR-1 CBD and the 218G4 Fab.

FIG. 48. A table presenting various protein sequences for human, mouse, rat, pig, dog and cynomolgus monkey ASGR, ASGR-1 and ASGR-2 (Table 1).

FIG. 49. Two tables presenting variable light and heavy chain CDR1, CDR2 and CDR3 amino acid sequences for certain antigen binding proteins of the present invention (Table 2A and Table 2B). Table 2A presents the Variable Light Chain CDR1, CDR2 and CDR3, while Table 2B presents the Variable Heavy Chain CDR1, CDR2, and CDR3. The CDR sequences in Tables 2A and 2B are wrapped due to space issues, and unless stated otherwise, should be understood to be a single amino acid sequence.

FIG. 50. A table presenting the amino acid sequences of the light and heavy chain variable domains for certain antigen binding proteins of the present invention are displayed in a table (Table 3). The amino acid sequences of the light and heavy chain variable domains in Table 3 are wrapped due to space issues, and unless stated otherwise, should be understood to be single amino acid sequences.

FIG. 51. A table presenting a protein alignment of light and heavy variable regions for certain antigen binding proteins of the present invention (Table 4). An asterisk "*" denotes a stop codon. Sequences containing a stop codon are represented as distinct sequences in the Sequence Listing, however, these sequences are related. Generally speaking, however, the amino acid sequences of the light and heavy chain variable domains in the protein alignment presented in Table 4 are wrapped due to space issues, and unless stated otherwise, like in the case of sequences with one or more stop codons, should be understood to be single amino acid sequences.

FIG. 52. A table presenting a consensus protein alignment of light and heavy variable regions for certain antigen binding proteins of the present invention (Table 5). An asterisk "*" denotes a stop codon. Sequences containing a stop codon are respresented as distinct sequences in the Sequence Listing, however, these sequences are related. Generally speaking, however, the amino acid sequences of the light and heavy chain variable domains in the consensus protein alignment presented in Table 5 are wrapped due to space issues, and unless stated otherwise, like in the case of sequences with one or more stop codons, should be understood to be single amino acid sequences.

FIG. 53. A table presenting a protein alignment of light and heavy variable regions for certain optimized antigen binding proteins of the present invention (Table 6). The amino acid sequences of the light and heavy chain variable domains in the protein alignment presented in Table 6 are wrapped due to space issues, and unless stated otherwise, should be understood to be single amino acid sequences.

FIG. 54. A table presenting a consensus protein alignment of light and heavy variable regions for certain optimized antigen binding proteins of the present invention (Table 7). The amino acid sequences of the light and heavy chain variable domains in the consensus protein alignment presented in Table 7 are wrapped due to space issues, and unless stated otherwise, should be understood to be single amino acid sequences.

FIG. 55. A group of tables presenting the consensus sequences of various heavy and light chain variable regions (Tables 19A and 20A, respectively), as well as the consensus sequences of CDRs of various heavy and light chain variable regions (Tables 19B and C and Tables 20B and 20C, respectively) for certain antigen binding proteins of the present invention.

FIG. 60. A table presenting ASGR-1 residues identified as hits via Arg/Glu scanning mutagenesis.

DETAILED DESCRIPTION OF THE VARIOUS EMBODIMENTS

Figure 2:
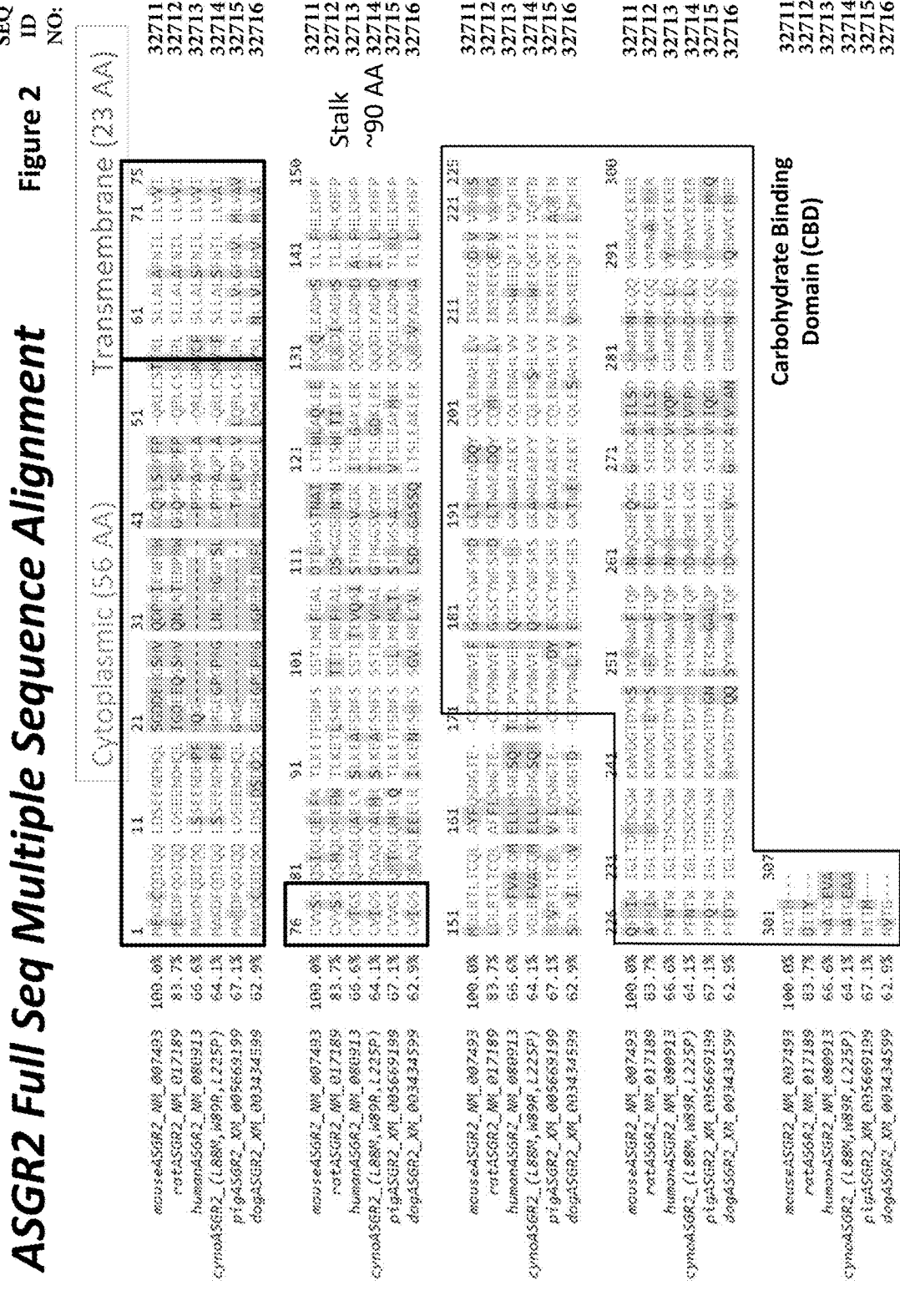
FIG. 2. ASGR-2 sequence alignments of human (SEQ ID NO: 32713), cyno (SEQ ID NO: 32714), dog (SEQ ID NO: 32716), pig (SEQ ID NO: 32715), rat (SEQ ID NO: 32712) and mouse ASGR-2 (SEQ ID NO: 32711). The boxed areas denoting different regions of ASGR-2 (i.e., cytoplasmic, transmembrane, and the carbohydrate binding domain (CBD; also called the carbohydrate recognition domain, or CRD) are representative of the approximate amino acid locations of these regions.

As shown in Example 1 below, sequence variants in ASGR-1 (which resulted in either a faster degrading ASGR1 or a loss of function ASGR1 mutation) resulted in a lowering in the level of non-HDL cholesterol in humans. This in turn resulted in a decrease in the risk of coronary artery disease experienced by these people. As loss of function mutations in ASGR-1 resulted in both the lowering of non-HDL cholesterol and the lowering of coronary artery disease, antibodies and inhibitory RNA that effectively block ASGR can be used to lower the risk of coronary artery disease.

The present invention is directed to inhibitors of ASGR, ASGR-1 and/or ASGR-2. The present invention provides antigen binding proteins that specifically bind to human ASGR, ASGR-1 and/or ASGR-2 and inhibit human ASGR, ASGR-1 and/or ASGR-2 binding to a ligand. The present invention also provides antigen binding proteins that specifically bind to other species of ASGR, ASGR-1 and/or ASGR-2. The present invention is further directed to methods of treating or preventing cardiovascular disease in a human subject comprising administering an inhibitor of ASGR, ASGR-1 and/or ASGR-2, wherein the ASGR inhibitor an antigen binding protein and/or an interfering RNA (e.g., siRNA or shRNA).

The present invention further provides compositions, kits, and methods relating to antigen binding proteins that specifically bind to human ASGR, human ASGR-1, and/or human ASGR-2. Also provided are nucleic acid molecules comprising a sequence of polynucleotides that encode all or a portion of a polypeptide that specifically binds to human ASGR, human ASGR-1, and/or human ASGR-2. The present invention further provides vectors and plasmids comprising such nucleic acids, and cells or cell lines comprising such nucleic acids and/or vectors and plasmids. The provided methods further include, for example, methods of making, identifying, or isolating antigen binding proteins that bind to human ASGR, human ASGR-1, and/or human ASGR-2, methods of determining whether an antigen binding protein binds to human ASGR, human ASGR-1, and/or human ASGR-2, methods of making compositions, such as pharmaceutical compositions, comprising an antigen binding protein that binds to human ASGR, human ASGR-1, and/or human ASGR-2, and methods for administering an antigen binding protein that binds human ASGR, human ASGR-1, and/or human ASGR-2 to a human subject.

It is to be understood that both the foregoing general description and the following detailed description are exemplary and explanatory only and are not restrictive of the invention as claimed. In this application, the use of the singular includes the plural unless specifically stated otherwise. In this application, the use of "or" means "and/or" unless stated otherwise. Furthermore, the use of the term "including", as well as other forms, such as "includes" and "included", is not limiting. Also, terms such as "element" or "component" encompass both elements and components comprising one unit and elements and components that comprise more than one subunit unless specifically stated otherwise. Also, the use of the term "portion" can include part of a moiety or the entire moiety.

Unless otherwise defined herein, scientific and technical terms used in connection with the present invention shall have the meanings that are commonly understood by those of ordinary skill in the art. Further, unless otherwise required by context, singular terms shall include pluralities and plural terms shall include the singular. Generally, nomenclatures used in connection with, and techniques of, cell and tissue culture, molecular biology, immunology, microbiology, genetics and protein and nucleic acid chemistry and hybridization described herein are those well-known and commonly used in the art. The methods and techniques of the present invention are generally performed according to conventional methods well known in the art and as described in various general and more specific references that are cited and discussed throughout the present specification unless otherwise indicated. See, e.g., Sambrook et al. Molecular Cloning: A Laboratory Manual, 2d ed., Cold Spring Harbor Laboratory Press, Cold Spring Harbor, N.Y. (1989) and Ausubel et al., Current Protocols in Molecular Biology, Greene Publishing Associates (1992), and Harlow and Lane Antibodies: A Laboratory Manual Cold Spring Harbor Laboratory Press, Cold Spring Harbor, N.Y. (1990), which are incorporated herein by reference. Enzymatic reactions and purification techniques are performed according to manufacturer's specifications, as commonly accomplished in the art or as described herein. The terminology used in connection with, and the laboratory procedures and techniques of, analytical chemistry, synthetic organic chemistry, and medicinal and pharmaceutical chemistry described herein are those well-known and commonly used in the art. Standard techniques can be used for chemical syntheses, chemical analyses, pharmaceutical preparation, formulation, and delivery, and treatment of patients.

Polynucleotide and polypeptide sequences are indicated using standard one- or three-letter abbreviations. Unless otherwise indicated, polypeptide sequences have their amino termini at the left and their carboxy termini at the right, and single-stranded nucleic acid sequences, and the top strand of double-stranded nucleic acid sequences, have their 5' termini at the left and their 3' termini at the right. A particular section of a polypeptide can be designated by amino acid residue number such as amino acids 1 to 50, or by the actual residue at that site such as asparagine to proline. A particular polypeptide or polynucleotide sequence also can be described by explaining how it differs from a reference sequence.

The following terms, unless otherwise indicated, shall be understood to have the following meanings:

The term "inhibitor" as used herein, is a compound that decreases the magnitude of at least one activity or function of a molecule compared to the magnitude of the activity or function observed in the absence of the inhibitor. In some instances, an inhibitor will substantially decrease the magnitude of at least one activity or function of a molecule compared to the magnitude of the activity or function observed in the absence of the inhibitor. In some instances, an inhibitor will completely diminish the magnitude of at least one activity or function of a molecule compared to the magnitude of the activity or function observed in the absence of the inhibitor. Certain exemplary inhibitors include, but are not limited to, proteins, peptides, antibodies, peptibodies, aptamers, antisense oligonucleotides, interfering RNA, carbohydrates or small organic molecules.

The term "isolated molecule" (where the molecule is, for example, a polypeptide, a polynucleotide, antigen binding protein or an antibody) is a molecule that by virtue of its origin or source of derivation (1) is not associated with naturally associated components that accompany it in its native state, (2) is substantially free of other molecules from the same species (3) is expressed by a cell from a different species, or (4) does not occur in nature. Thus, a molecule that is chemically synthesized, or expressed in a cellular system different from the cell from which it naturally originates, will be "isolated" from its naturally associated components. A molecule also may be rendered substantially free of naturally associated components by isolation, using purification techniques well known in the art. Molecule purity or homogeneity may be assayed by a number of means well known in the art. For example, the purity of a polypeptide sample may be assayed using polyacrylamide gel electrophoresis and staining of the gel to visualize the polypeptide using techniques well known in the art. For certain purposes, higher resolution may be provided by using HPLC or other means well known in the art for purification.

The terms "polynucleotide," "oligonucleotide" and "nucleic acid" are used interchangeably throughout and include DNA molecules (e.g., cDNA or genomic DNA), RNA molecules (e.g., mRNA), analogs of the DNA or RNA generated using nucleotide analogs (e.g., peptide nucleic acids and non-naturally occurring nucleotide analogs), and hybrids thereof. The nucleic acid molecule can be single-stranded or double-stranded. In one embodiment, the nucleic acid molecules of the invention comprise a contiguous open reading frame encoding an antibody, or a fragment, derivative, mutein, or variant thereof, of the invention.

A "vector" is a nucleic acid that can be used to introduce another nucleic acid linked to it into a cell. One type of vector is a "plasmid," which refers to a linear or circular double stranded DNA molecule into which additional nucleic acid segments can be ligated. Another type of vector is a viral vector (e.g., replication defective retroviruses, adenoviruses and adeno-associated viruses), wherein additional DNA segments can be introduced into the viral genome. Certain vectors are capable of autonomous replication in a host cell into which they are introduced (e.g., bacterial vectors comprising a bacterial origin of replication and episomal mammalian vectors). Other vectors (e.g., non-episomal mammalian vectors) are integrated into the genome of a host cell upon introduction into the host cell, and thereby are replicated along with the host genome. An "expression vector" is a type of vector that can direct the expression of a chosen polynucleotide.

A nucleotide sequence is "operably linked" to a regulatory sequence if the regulatory sequence affects the expression (e.g., the level, timing, or location of expression) of the nucleotide sequence. A "regulatory sequence" is a nucleic acid that affects the expression (e.g., the level, timing, or location of expression) of a nucleic acid to which it is operably linked. The regulatory sequence can, for example, exert its effects directly on the regulated nucleic acid, or through the action of one or more other molecules (e.g., polypeptides that bind to the regulatory sequence and/or the nucleic acid). Examples of regulatory sequences include promoters, enhancers and other expression control elements (e.g., polyadenylation signals). Further examples of regulatory sequences are described in, for example, Goeddel, 1990, Gene Expression Technology: Methods in Enzymology 185, Academic Press, San Diego, Calif. and Baron et al., 1995, Nucleic Acids Res. 23:3605-06.

A "host cell" is a cell that can be used to express a nucleic acid, e.g., a nucleic acid of the invention. A host cell can be a prokaryote, for example, E. coli, or it can be a eukaryote, for example, a single-celled eukaryote (e.g., a yeast or other fungus), a plant cell (e.g., a tobacco or tomato plant cell), an animal cell (e.g., a human cell, a monkey cell, a hamster cell, a rat cell, a mouse cell, or an insect cell) or a hybridoma. Typically, a host cell is a cultured cell that can be transformed or transfected with a polypeptide-encoding nucleic acid, which can then be expressed in the host cell. The phrase "recombinant host cell" can be used to denote a host cell that has been transformed or transfected with a nucleic acid to be expressed. A host cell also can be a cell that comprises the nucleic acid but does not express it at a desired level unless a regulatory sequence is introduced into the host cell such that it becomes operably linked with the nucleic acid. It is understood that the term host cell refers not only to the particular subject cell but to the progeny or potential progeny of such a cell. Because certain modifications may occur in succeeding generations due to, e.g., mutation or environmental influence, such progeny may not, in fact, be identical to the parent cell, but are still included within the scope of the term as used herein.

ASGR

Genomic database analysis is one manner that allows for the discovery of associations between disease states and particular targets and/or pathways. For example, genetic analysis of patients with familial hypercholesterolemia resulted in the discovery of proprotein convertase subtilisin/kexin type 9 (PCSK9) being involved with regulating serum LDL cholesterol levels and risk of developing coronary artery disease, and ultimately, in the development of the recently approved Repatha®, an anti-hPCSK9 antibody. (see, e.g., Jackson et al., U.S. Pat. No. 8,030,457). Advances in DNA sequencing technology provide the means to sequence the genomes of large numbers of individuals allowing for discovery of rare variants. deCODE Genetics (an Amgen company) has previously reported methods to analyze whole genomes of large numbers of Icelanders in order to search for associations between genetic variants and traits of interest. (Gudbjartsson et al., Nature Genetics; Vol. 47; 5; May 2015; p. 435-444).

This methodology has now been applied in the search for novel genetic variants that affect cardiovascular disease, including cholesterol levels, and the risk for developing coronary artery disease and myocardial infarction (MI). The groundbreaking analysis performed has identified novel sequence variants of the Ashwell-Morell Receptor that are implicated in cardiovascular disease.

In the present invention, whole-genome sequencing of the Icelandic population discovered a rare, 12 base pair deletion ("del12") in intron 4 of the ASGR-1 gene that is also present in other European ancestry populations. This deletion leads to a frameshift predicted to generate a truncated ASGR-1 receptor subunit that is lacking both the oligomerization and extracellular carbohydrate recognition domains (also known as "CRD," "carbohydrate binding domain" or "CBD") or may generate an unstable and rapidly degraded transcript (and therefore no protein) due to nonsense mediated decay. In the present invention, whole-genome sequencing of the Icelandic population also discovered a second rare loss of function variant in the ASGR-1 gene; namely, a 4 base pair insertion in exon 7 (c. 469-472dupAACT or "W158×"). This 4 base pair insertion in exon 7 causes a frameshift and introduces a premature stop codon at amino acid 158 out of the 291 amino acid full length protein (NP_001662.1: p.W158X). This variant is predicted to encode a protein lacking the carbohydrate recognition domain of the receptor or may generate an unstable and rapidly degraded transcript (and therefore no protein) due to nonsense mediated decay. Furthermore, the W158X variant effects all reported refseq transcripts of ASGR-1 regardless of tissue or cell type of expression. Without wishing to be bound by any particular hypothesis, the analysis indicates that del12 and W158X results in lower non-HDL cholesterol levels, protection against CAD and MI, leading to prolonged life. Additionally, the analysis indicates that del12 and W158X also associates with increased levels of circulating ALP and vitamin B12. Supporting this del12 and W158X association with increased levels of ALP are data from mice having a Y272C variant in ASGR-1, showing that these mice exhibit a phenotype of increased plasma ALP (Sabrautzki et al., Mamm. Genome, 23, 416-430, 2012). The Y272 position in mouse ASGR-1 corresponds to the Y273 position in human ASGR-1 (see FIG. 1A).

The Ashwell-Morell Receptor (AMR), originally named the hepatic asialoglycoprotein receptor, was one of the first cellular receptors to be isolated and identified. (Grewal, Methods in Enzymology, Volume 479, Chapter 13, 2010, pp. 223-241). This receptor is also known as the Ashwell Receptor, the hepatic galactose/N-acetylgalactosamine (GalNAc) receptor, or the hepatic lectin receptor. However, this receptor is now more commonly known as "ASGPR," or simply "ASGR."

ASGR is a C-type lectin that is expressed on the surface of hepatocytes and is made up of 48 kDa major subunit(s) (ASGR-1) and 40 kDa minor subunit(s) (ASGR-2). (Roggenbuck et al., Autoimmune Highlights, 2012, 3:119-125). Functional variants of ASGR are formed by the oligomerization of the ASGR-1 and ASGR-2 subunits. (Grewal). The receptor complexes can comprise homo-oligomers and hetero-oligomers of the ASGR-1 and ASGR-2 subunits, with $(ASGR-1)_2$-$(ASGR-2)_1$ trimer being the most common form and having the highest affinity to substrate. (Grewal). Other identified forms of ASGR include $(ASGR-1)_2$, $(ASGR-1)_3$, $(ASGR-1)_2$-$(ASGR-2)_2$, $(ASGR-1)_3$-$(ASGR-2)_2$. (Grewal).

The polynucleotide and polypeptide sequences for several species of ASGR-1 and ASGR-2 are known. Table 1 presents sequences for human, mouse, rat, pig, dog and cynomolgus. FIGS. 1A, 1B and 2 present sequence alignments of various species of ASGR-1 and ASGR-2, and FIG. 3 presents a sequence alignment between human ASGR-1 and human ASGR-2.

ASGR-1 is a single pass transmembrane protein and is the major subunit of ASGR. The galactose (Gal) or N-acetylgalactosamine (GalNAc) residues of glycoproteins are exposed by removal of sialic acid by sialidases, hence the term asialoglycoprotein for the ligands of ASGR. Although ASGR expression is detected in other tissues, liver is the predominant site of expression. A circulating form of the receptor, generated from ASGR-1 transcripts lacking exon two, has also been reported. (Liu J, Hu B, Yang Y, et al. A new splice variant of the major subunit of human asialoglycoprotein receptor encodes a secreted form in hepatocytes. PloS one 2010; 5:e12934). The del12 and W158X variants are predicted to truncate both the membrane bound and the circulating form of the receptor, and as mentioned above, the W158X variant may generate an unstable and rapidly degraded transcript (and therefore no protein) due to nonsense mediated decay.

The primary reported function of ASGR is to bind and internalize glycoproteins in the circulation that contain terminal galactose or N-acetylgalactosamine residues (asialoglycoproteins), resulting in the clearance of these proteins from the circulation. (Roggenbuck). Reported endogenous ligands include components of the blood coagulation system, such as platelets and Von Willebrand Factor. (Grewal).

As used herein, the terms "ASGR, ASGR-1, and/or ASGR-2 function" or "ASGR, ASGR-1, and/or ASGR-2 activity" includes any biological effect of ASGR, ASGR-1 and/or ASGR-2. In certain embodiments, ASGR function or activity includes the ability of ASGR to interact or bind to a ligand. In some embodiments, ASGR function or activity is represented by the ability of ASGR to interact or bind to sugars including but not limited to lactose, galactose, and/or GalNAc or glycoproteins displaying such sugars including but not limited to fetuin, orosomucoid and/or alkaline phosphatase. In some embodiments, ASGR function or activity includes any biological activity resulting from ASGR response. Exemplary activities include, but are not limited to, clearance of asialoglycoproteins from the circulation; clearance of IgA from circulation; removal of apoptotic cells; clearance of low density lipoprotein (LDL) and/or the disposal of cellular fibronectin (Roggenbuck).

Given the location of ASGR on the surface of liver hepatocytes and its implication in hepatocyte entry by certain viruses (Roggenbuck), the receptor has become a target of convenience for therapeutics that require delivery to the liver and internalization into the cells. Examples of these uses include the targeted delivery of doxorubicin to hepatocellular carcinoma (Wei et al., Int J Nanomedicine, 2015, 10:5123-37), gene delivery to hepatocytes (D'Souza et al., J Control Release, 2015, 203:126-39), and targeted delivery of siRNA to hepatocytes (Rajeev et al., Chembiochem, 2015, 16(6):903-8).

Although the ASGR and its ability to mediate endocytosis and degradation of desialated glycoproteins has been known for nearly 4 decades, the endogenous ligands and the physiological function of the receptor have been difficult to establish. (Weigel P H, Yik J H. Glycans as endocytosis signals: the cases of the asialoglycoprotein and hyaluronan/chondroitin sulfate receptors. Biochimica et biophysica acta 2002; 1572:341-63). It has been reported that ASGR-1−/− mice (lacking any ASGR activity) thrive normally and do not accumulate desialylated glycoproteins in their circulation although they are unable to clear exogenously added asialoglycoproteins, suggesting that under normal physiological condition ASGR is not essential for homeostasis of circulating asialoglycoproteins. (Tozawa R, Ishibashi S, Osuga J, et al. Asialoglycoprotein receptor deficiency in mice lacking the major receptor subunit. Its obligate requirement for the stable expression of oligomeric receptor. The Journal of Biological Chemistry 2001; 276:12624-8).

In contrast to the ASGR-1 knockout mice which lack an apparent phenotype, the present invention has established a clear physiological role for human ASGR-1 in cardiovascular disease, for example, but not limited to, the regulation of non-HDL levels and modulation of CAD and MI risk. The present invention has also demonstrated the association of del12 and W158X with increased levels of circulating ALP and vitamin B12. Furthermore, the present invention shows that disturbing one allele of ASGR-1 appears to have an overall beneficial effect as heterozygotes carriers of del12 live on average 1.5 years longer than non-carriers.

Surprisingly, the various embodiments provided herein demonstrate that the del12 variant and the W158 variant both have an effect on non-HDL levels that is opposite to their effect on ALP and vitamin B12 levels; decreasing non-HDL and increasing ALP and vitamin B12. While not wishing to be bound by any particular hypothesis, it is important to note that the common variant previously described that associates with ALP and LDL cholesterol also has opposing effects on these serum components; hence ASGR-1 may affect the level of these molecules through different mechanisms. It is unlikely that the ALP increase mediated by del12 or W158X reflects an underlying liver disease since other measures of liver function are not affected. Both ALP and the vitamin B12 transporter in the circulation, haptocorrin, are asialylated glycoproteins known to bind ASGR-1 and be cleared from the circulation by the receptor (Tuin A, Huizinga-Van der Vlag A, van Loenen-Weemaes A M, Meijer D K, Poelstra K. On the role and fate of LPS-dephosphorylating activity in the rat liver. American Journal of Physiology Gastrointestinal and Liver Physiology 2006; 290:G377-85; Furger E, Fedosov S N, Lildballe D L, et al. Comparison of recombinant human haptocorrin expressed in human embryonic kidney cells and native haptocorrin. PloS one 2012; 7:e37421; Burger R L, Schneider R J, Mehlman C S, Allen R H. Human plasma R-type vitamin B12-binding proteins. II. The role of transcobalamin I, transcobalamin III, and the normal granulocyte vitamin B12-binding protein in the plasma transport of vitamin B12. The Journal of Biological Chemistry 1975; 250:7707-13; Steirer L M, Park E I, Townsend R R, Baenziger J U. The asialoglycoprotein receptor regulates levels of plasma glycoproteins terminating with sialic acid alpha2,6-galactose. The Journal of Biological Chemistry 2009; 284: 3777-83). While not wishing to be bound by any particular hypothesis, the more likely reason for the increased levels of ALP and vitamin B12 in del12 carriers and in W158X carriers is decreased clearance of desialylated forms of these molecules from the circulation, due to reduced number of functional ASGR receptors in del12 carriers and in W158X carriers, suggesting a role for ASGR-1 in maintaining homeostasis of circulating ALP and vitamin B12.

While not wishing to be bound by any particular hypothesis, the decreased levels of non-HDL in del12 carriers and in W158X carriers in the face of reduced ASGR-1 function suggest that ASGR-1 affects non-HDL levels by mechanisms other than direct binding and endocytosis of cholesterol particles. In mice expressing a hypomorphic form of neuraminidase 1 (Neu1), a sialidase that cleaves the sialic acid residues thereby generating substrates for ASGR-1, the LDL receptor (LDLR) is sialylated and this form of the receptor was more stable and took up LDL cholesterol more avidly (LDL levels were decreased in these mice) than the asialylated form of the wild type LDLR (Yang A, Gyulay G, Mitchell M, White E, Trigatti B L Igdoura S A. Hypomorphic sialidase expression decreases serum cholesterol by downregulation of VLDL production in mice Journal of Lipid Research 2012; 53:2573-2585). Both ASGR and LDLR are located in clathrin-coated pits on hepatocytes and ASGR may be capable of interacting with the asialylated form of the LDLR and blocking its activity.

Two novel rare variants in ASGR-1 have been identified herein that play a role in cardiovascular disease, including, but not limited to, lowering non-HDL levels and protecting against CAD and MI. These variants disrupt ASGR-1 protein function. Accordingly, the present invention is further directed to methods of inhibiting ASGR function, methods of inhibiting ASGR-1 function and/or methods of inhibiting ASGR-2 function. The present invention is further directed to molecules (for example, but not limited to, antigen binding proteins or interfering RNA) that inhibit ASGR function, ASGR-1 function and/or ASGR-2 function.

Antigen Binding Proteins

In some embodiments, the invention comprises antigen binding proteins that bind to ASGR, ASGR-1, and/or ASGR-2 of different species, including, but not limited to, human, cynomolgus, porcine, canine, murine and rat. In some embodiments, the antigen binding proteins specifically bind to ASGR, ASGR-1, and/or ASGR-2 of different species, including, but not limited to, human, cynomolgus, porcine, canine, and murine and rat. Exemplary amino acid sequences of human, cyno, dog, pig, rat and mouse ASGR-1 and ASGR-2 are provided in FIGS. 1-3. In some embodiments, the antigen binding proteins further inhibit ASGR, ASGR-1 and/or ASGR-2 from binding to a ligand.

An "antigen binding protein" is a protein comprising an antigen binding fragment that binds to an antigen and, optionally, a scaffold or framework portion that allows the antigen binding fragment to adopt a conformation that promotes binding of the antigen binding protein to the antigen. In the instant application, the antigen is ASGR, ASGR-1 and/or ASGR-2 protein or a fragment thereof. In some embodiments, the antigen binding fragment comprises at least one CDR from an antibody that binds to the antigen, and in some embodiments comprises the heavy chain CDR3 from an antibody that binds to the antigen. In some embodiments, the antigen binding fragment comprises all three CDRs from the heavy chain of an antibody that binds to the antigen or from the light chain of an antibody that binds to the antigen. In still some embodiments, the antigen binding fragment comprises all six CDRs from an antibody that binds to the antigen (three from the heavy chain and three from the light chain). The antigen binding fragment in certain embodiments is an antibody fragment.

Nonlimiting examples of antigen binding proteins include antibodies, antibody fragments (e.g., an antigen binding fragment of an antibody), antibody derivatives, and antibody analogs. Further specific examples include, but are not limited to, a single-chain variable fragment (scFv), a nanobody (e.g. VH domain of camelid heavy chain antibodies; VHH fragment, see Cortez-Retamozo et al., Cancer Research, Vol. 64:2853-57, 2004), a Fab fragment, a Fab' fragment, a F(ab')2 fragment, a Fv fragment, a Fd fragment, and a complementarity determining region (CDR) fragment. These molecules can be derived from any mammalian source, such as human, mouse, rat, rabbit, or pig, dog, or camelid. Antibody fragments may compete for binding of a target antigen with an intact antibody and the fragments may be produced by the modification of intact antibodies (e.g. enzymatic or chemical cleavage) or synthesized de novo using recombinant DNA technologies or peptide synthesis. The antigen binding protein can comprise, for example, an alternative protein scaffold or artificial scaffold with grafted CDRs or CDR derivatives. Such scaffolds include, but are not limited to, antibody-derived scaffolds comprising mutations introduced to, for example, stabilize the three-dimensional structure of the antigen binding protein as well as wholly synthetic scaffolds comprising, for example, a biocompatible polymer. See, for example, Korndorfer et al., 2003, Proteins: Structure, Function, and Bioinformatics, Volume 53, Issue 1:121-129 (2003); Roque et al., Biotechnol. Prog. 20:639-654 (2004). In addition, peptide antibody mimetics ("PAMs") can be used, as well as scaffolds based on antibody mimetics utilizing fibronectin components as a scaffold.

An antigen binding protein can also include a protein comprising one or more antibody fragments incorporated into a single polypeptide chain or into multiple polypeptide chains. For instance, antigen binding proteins can include, but are not limited to, a diabody (see, e.g., EP 404,097; WO 93/11161; and Hollinger et al., Proc. Natl. Acad. Sci. USA, Vol. 90:6444-6448, 1993); an intrabody; a domain antibody (single VL or VH domain or two or more VH domains joined by a peptide linker; see Ward et al., Nature, Vol. 341:544-546, 1989); a maxibody (2 scFvs fused to Fc region, see Fredericks et al., Protein Engineering, Design & Selection, Vol. 17:95-106, 2004 and Powers et al., Journal of Immunological Methods, Vol. 251:123-135, 2001); a triabody; a tetrabody; a minibody (scFv fused to CH3 domain; see Olafsen et al., Protein Eng Des Sel., Vol. 17:315-23, 2004); a peptibody (one or more peptides attached to an Fc region, see WO 00/24782); a linear antibody (a pair of tandem Fd segments (VH—CH1-VH—CH1) which, together with complementary light chain polypeptides, form a pair of antigen binding regions, see Zapata et al., Protein Eng., Vol. 8:1057-1062, 1995); a small modular immunopharmaceutical (see U.S. Patent Publication No. 20030133939); and immunoglobulin fusion proteins (e.g. IgG-scFv, IgG-Fab, 2scFv-IgG, 4scFv-IgG, VH-IgG, IgG-VH, and Fab-scFv-Fc).

In certain embodiments, an antigen binding protein can have, for example, the structure of an immunoglobulin. An "immunoglobulin" is a tetrameric molecule, with each tetramer comprising two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region primarily responsible for effector function.

Within light and heavy chains, the variable (V) and constant regions (C) are joined by a "J" region of about 12 or more amino acids, with the heavy chain also including a "D" region of about 10 more amino acids. See generally, Fundamental Immunology Ch. 7 (Paul, W., ed., 2nd ed. Raven Press, N.Y. (1989)) (incorporated by reference in its entirety for all purposes). The variable regions of each light/heavy chain pair form the antibody binding site such that an intact immunoglobulin has two binding sites.

Immunoglobulin chains exhibit the same general structure of relatively conserved framework regions (FR) joined by three hypervariable regions, also called complementarity determining regions or CDRs. From N-terminus to C-terminus, both light and heavy chains comprise the domains FR1, CDR1, FR2, CDR2, FR3, CDR3 and FR4.

Human light chains are classified as kappa and lambda light chains. The term "light chain" refers to a polypeptide comprising, from amino terminus to carboxyl terminus, a single immunoglobulin light chain variable region (VL) and a single immunoglobulin light chain constant domain (CL). Heavy chains are classified as mu ($\mu$), delta ($\Delta$), gamma ($\gamma$), alpha ($\alpha$), and epsilon ($\epsilon$), and define the antibody's isotype as IgM, IgD, IgG, IgA, and IgE, respectively. The term "heavy chain" refers to a polypeptide comprising, from amino terminus to carboxyl terminus, a single immunoglobulin heavy chain variable region (VH), an immunoglobulin heavy chain constant domain 1 (CH1), an immunoglobulin hinge region, an immunoglobulin heavy chain constant domain 2 (CH2), an immunoglobulin heavy chain constant domain 3 (CH3), and optionally an immunoglobulin heavy chain constant domain 4 (CH4). The IgG-class is further divided into subclasses, namely, IgG1, IgG2, IgG3, and IgG4. The IgA-class is further divided into subclasses, namely IgA1 and IgA2. The IgM has subclasses including, but not limited to, IgM1 and IgM2. The heavy chains in IgG, IgA, and IgD antibodies have three domains (CH1, CH2, and CH3), whereas the heavy chains in IgM and IgE antibodies have four domains (CH1, CH2, CH3, and CH4). The immunoglobulin heavy chain constant domains can be from any immunoglobulin isotype, including subtypes. The antibody chains are linked together via inter-polypeptide disulfide bonds between the CL domain and the CH1 domain (i.e. between the light and heavy chain) and between the hinge regions of the antibody heavy chains.

The term "antibody" refers to an intact immunoglobulin of any isotype, and includes, for instance, chimeric, humanized, human, and bispecific antibodies. An "antibody" is a species of an antigen binding protein. An intact antibody will generally comprise at least two full-length heavy chains and two full-length light chains. Antibody sequences can be derived solely from a single species, or can be "chimeric," that is, different portions of the antibody can be derived from two different species as described further below. Unless otherwise indicated, the term "antibody" also includes antibodies comprising two substantially full-length heavy chains and two substantially full-length light chains provided the antibodies retain the same or similar binding and/or function as the antibody comprised of two full length light and heavy chains. For example, antibodies having 1, 2, 3, 4, or 5 amino acid residue substitutions, insertions or deletions at the N-terminus and/or C-terminus of the heavy and/or light chains are included in the definition provided that the antibodies retain the same or similar binding and/or function as the antibodies comprising two full length heavy chains and two full length light chains. Furthermore, unless explicitly excluded, antibodies include, for example, monoclonal antibodies, polyclonal antibodies, chimeric antibodies, humanized antibodies, human antibodies, bispecific antibodies, and synthetic antibodies. In some sections of the present disclosure, examples of antigen binding proteins are described herein in terms of the hybridoma line number as "number/letter/number" (e.g., 25A4). In these cases, the exact name denotes a specific monoclonal antibody derived from a specific hybridoma having a specific light chain variable region and heavy chain variable region. In some sections of the present disclosure, examples of antigen binding proteins are described herein in terms of "number/letter/number/"dot"/number" (e.g., 25A4.001) or number/letter/number/"dot"/number/"dot"/number (e.g., 25A4.001.001). In these cases, the name denotes a variant of a specific antibody having a light chain variable region and a heavy chain variable region that is related to, but distinct from the antibody derived from a hybridoma. That is, for example, an antigen binding protein named 25A4 is not the same as an antibody named 25A4.001 or an antibody named 25A4.001.001.

A "polyclonal antibody" refers to a population of antibodies that are typically widely varied in composition and binding specificity. A "monoclonal antibody" ("mAb") as used herein refers to one or more of a population of antibodies having identical sequences. Monoclonal antibodies bind to the antigen at a particular epitope on the antigen.

In some embodiments, the antigen binding protein is a "fragment" or "antigen binding fragment" of an antibody. As used herein and unless otherwise specified, an "antibody fragment" refers to the Fab, Fab', F(ab')2, and Fv fragments that contain at least one CDR of an immunoglobulin that is sufficient to confer specific antigen binding to ASGR, ASGR-1 and/or ASGR-2. Antibody fragments may be produced by recombinant DNA techniques or by enzymatic or chemical cleavage of intact antibodies.

A Fab fragment is a monovalent fragment having the VL, VH, CL and CH1 domains; a F(ab')2 fragment is a bivalent fragment having two Fab fragments linked by a disulfide bridge at the hinge region; a Fd fragment has the VH and CH1 domains; an Fv fragment has the VL and VH domains of a single arm of an antibody; and a dAb fragment has a VH domain, a VL domain, or an antigen-binding fragment of a VH or VL domain (U.S. Pat. Nos. 6,846,634, 6,696,245, US App. Pub. No. 05/0202512, 04/0202995, 04/0038291, 04/0009507, 03/0039958, Ward et al., Nature 341:544-546 (1989)). In certain embodiments, these antibody fragments can be incorporated into single domain antibodies, single-chain antibodies, maxibodies, minibodies, intrabodies, diabodies, triabodies, tetrabodies, v-NAR and bis-scFv (see e.g., Hollinger and Hudson, 2005, Nature Biotechnology, 23, 9, 1126-1136). Other antigen binding proteins envisioned are antibody polypeptides such as those disclosed in U.S. Pat. No. 6,703,199, including fibronectin polypeptide monobodies, the polypeptides as disclosed in U.S. Patent Publication 2005/0238646. In some embodiments, the antibodies comprise at least one CDR set forth in Tables 2 or 6 herein.

A "single-chain variable fragment" ("scFv") is a fusion protein in which a VL and a VH region are joined via a linker (e.g., a synthetic sequence of amino acid residues) to form a continuous protein chain wherein the linker is long enough to allow the protein chain to fold back on itself and form a monovalent antigen binding site (see, e.g., Bird et al., Science 242:423-26 (1988) and Huston et al., 1988, Proc. Natl. Acad. Sci. USA 85:5879-83 (1988)). For the sake of clarity, a "single-chain variable fragment" is not an antibody or an antibody fragment as defined herein. Diabodies are bivalent antibodies comprising two polypeptide chains, wherein each polypeptide chain comprises VH and VL domains joined by a linker that is too short to allow for pairing between two domains on the same chain, thus allowing each domain to pair with a complementary domain on another polypeptide chain (see, e.g., Holliger et al., 1993, Proc. Natl. Acad. Sci. USA 90:6444-48 (1993), and Poljak et al., Structure 2:1121-23 (1994)). If the two polypeptide chains of a diabody are identical, then a diabody resulting from their pairing will have two identical antigen binding sites. Polypeptide chains having different sequences can be used to make a diabody with two different antigen binding sites. Similarly, tribodies and tetrabodies are antibodies comprising three and four polypeptide chains, respectively, and forming three and four antigen binding sites, respectively, which can be the same or different.

The term "CDR" refers to the complementarity determining region (also termed "minimal recognition units" or "hypervariable region") within antibody variable sequences. The CDRs permit the antigen binding protein to specifically bind to a particular antigen of interest. There are three heavy chain variable region CDRs (CDRH1, CDRH2 and CDRH3) and three light chain variable region CDRs (CDRL1, CDRL2 and CDRL3). The CDRs in each of the two chains typically are aligned by the framework regions to form a structure that binds specifically to a specific epitope or domain on the target protein. From N-terminus to C-terminus, naturally-occurring light and heavy chain variable regions both typically conform to the following order of these elements: FR1, CDR1, FR2, CDR2, FR3, CDR3 and FR4. A numbering system has been devised for assigning numbers to amino acids that occupy positions in each of these domains. This numbering system is defined in Kabat Sequences of Proteins of Immunological Interest (1987 and 1991, NIH, Bethesda, Md.), or Chothia & Lesk, 1987, J. Mol. Biol. 196:901-917; Chothia et al., 1989, Nature 342: 878-883. Complementarity determining regions (CDRs) and framework regions (FR) of a given antibody may be identified using this system. Other numbering systems for the amino acids in immunoglobulin chains include IMGT® (the international ImMunoGeneTics information system; Lefranc et al, Dev. Comp. Immunol. 29:185-203; 2005) and AHo (Honegger and Pluckthun, J. Mol. Biol. 309(3):657-670; 2001). One or more CDRs may be incorporated into a molecule either covalently or noncovalently to make it an antigen binding protein.

In some embodiments, an antigen binding protein of the invention may incorporate the CDR(s) as part of a larger polypeptide chain, may covalently link the CDR(s) to another polypeptide chain, or may incorporate the CDR(s) noncovalently. The antigen binding molecules may comprise at least one of the CDRs described herein incorporated into a biocompatible framework structure. In one example, the biocompatible framework structure comprises a polypeptide or portion thereof that is sufficient to form a conformationally stable structural support, or framework, or scaffold, which is able to display one or more sequences of amino acids that bind to an antigen (e.g., CDRs, a variable region, etc.) in a localized surface region. Such structures can be a naturally occurring polypeptide or polypeptide "fold" (a structural motif), or can have one or more modifications, such as additions, deletions or substitutions of amino acids, relative to a naturally occurring polypeptide or fold. These scaffolds can be derived from a polypeptide of any species (or of more than one species), such as a human, other mammal, other vertebrate, invertebrate, plant, bacteria or virus.

Typically the biocompatible framework structures are based on protein scaffolds or skeletons other than immunoglobulin domains. For example, those based on fibronectin, ankyrin, lipocalin, neocarzinostain, cytochrome b, CP1 zinc finger, PST1, coiled coil, LACI-D1, Z domain and tendamistat domains may be used (See e.g., Nygren and Uhlen, 1997, Current Opinion in Structural Biology, 7, 463-469).

An antigen binding protein may have one or more binding sites. If there is more than one binding site, the binding sites may be identical to one another or may be different. For example, an antibody typically has two identical binding sites, while a "bispecific" or "bifunctional" antibody has two different binding sites. The two binding sites of a bispecific antigen binding protein or antibody will bind to two different epitopes, which can reside on the same or different protein targets.

In some embodiments, the ASGR-1 antigen binding protein is a bispecific antibody. In certain embodiments, a bispecific antibody binds to ASGR, ASGR-1 or ASGR-2 and PCSK9. In some embodiments, a bispecific antibody will bind to the ASGR-1 CBD and will inhibit ASGR-1 function, in addition to binding to PCSK9 and inhibiting the binding of PCSK9 to the LDLR. Methods of making bispecific antibodies are known in the art. One such method of making a "bispecific," or "bifunctional" antigen binding protein or antibody involves the fusion of hybridomas or linking of Fab' fragments. See, e.g., Songsivilai and Lachmann, 1990, Clin. Exp. Immunol. 79:315-321; Kostelny et al., 1992, J. Immunol. 148:1547-1553. Another method involves engineering the Fc portion of the heavy chains such as to create "knobs" and "holes" which facilitate heterodimer formation of the heavy chains when co-expressed in a cell. U.S. Pat. No. 7,695,963. Still another method also involves engineering the Fc portion of the heavy chain but uses electrostatic steering to encourage heterodimer formation while discouraging homodimer formation of the heavy chains when co-expressed in a cell. WO 09/089,004, which is incorporated herein by reference in its entirety.

The term "human antibody" includes antibodies having antibody regions such as variable and constant regions or domains which correspond substantially to human germline immunoglobulin sequences known in the art, including, for example, those described by Kabat et al. (1991) (loc. cit.). The human antibodies of the invention may include amino acid residues not encoded by human germline immunoglobulin sequences (e.g., mutations introduced by random or site-specific mutagenesis in vitro or by somatic mutation in vivo), for example in the CDRs, and in particular, in CDR3. The human antibodies can have at least one, two, three, four, five, or more positions replaced with an amino acid residue that is not encoded by the human germline immunoglobulin sequence. The definition of human antibodies as used herein also contemplates fully human antibodies, which include only non-artificially and/or genetically altered human sequences of antibodies as those can be derived by using technologies or systems known in the art, such as for example, phage display technology or transgenic mouse technology, including but not limited to the Xenomouse.

A humanized antibody has a sequence that differs from the sequence of an antibody derived from a non-human species by one or more amino acid substitutions, deletions, and/or additions, such that the humanized antibody is less likely to induce an immune response, and/or induces a less severe immune response, as compared to the non-human species antibody, when it is administered to a human subject. In one embodiment, certain amino acids in the framework and constant domains of the heavy and/or light chains of the non-human species antibody are mutated to produce the humanized antibody. In another embodiment, the constant domain(s) from a human antibody are fused to the variable domain(s) of a non-human species. In another embodiment, one or more amino acid residues in one or more CDR sequences of a non-human antibody are changed to reduce the likely immunogenicity of the non-human antibody when it is administered to a human subject, wherein the changed amino acid residues either are not critical for immunospecific binding of the antibody to its antigen, or the changes to the amino acid sequence that are made are conservative changes, such that the binding of the humanized antibody to the antigen is not significantly worse than the binding of the non-human antibody to the antigen. Examples of how to make humanized antibodies may be found in U.S. Pat. Nos. 6,054,297, 5,886,152 and 5,877,293.

The term "chimeric antibody" refers to an antibody that contains one or more regions from one antibody and one or more regions from one or more other antibodies. In one embodiment, one or more of the CDRs are derived from a human anti-ASGR, ASGR-1 or ASGR-2 antibody. In another embodiment, all of the CDRs are derived from a human anti-ASGR, ASGR-1 or ASGR-2 antibody. In another embodiment, the CDRs from more than one human anti-ASGR, ASGR-1 or ASGR-2 antibodies are mixed and matched in a chimeric antibody. For instance, a chimeric antibody may comprise a CDR1 from the light chain of a first human anti-ASGR, ASGR-1 or ASGR-2 antibody, a CDR2 and a CDR3 from the light chain of a second human anti-ASGR, ASGR-1 or ASGR-2 antibody, and the CDRs from the heavy chain from a third anti-ASGR, ASGR-1 or ASGR-2 antibody. Further, the framework regions may be derived from one of the same anti-ASGR, ASGR-1 or ASGR-2 antibodies, from one or more different antibodies, such as a human antibody, or from a humanized antibody. In one example of a chimeric antibody, a portion of the heavy and/or light chain is identical with, homologous to, or derived from an antibody from a particular species or belonging to a particular antibody class or subclass, while the remainder of the chain(s) is/are identical with, homologous to, or derived from an antibody or antibodies from another species or belonging to another antibody class or subclass. Also included are fragments of such antibodies that exhibit the desired biological activity.

A "neutralizing antigen binding protein" or "inhibitory antigen binding protein" or "antagonizing antigen binding protein" (e.g., "neutralizing antibody" or "inhibitory antibody" or "antagonizing antibody") refers to an antigen binding protein or antibody, respectively, that binds to a target molecule and reduces and/or prevents the biological effect of that target molecule. This can be done, for example, by directly blocking a site on the target molecule through which the target molecule interacts with other molecules (e.g. blocking a ligand binding site of a receptor) or by indirectly blocking a site on the target molecule through which the target molecule interacts with other molecules (such as structural or energetic alterations in the target molecule). In some embodiments, these terms can also denote an antigen binding protein or antibody that prevents the target molecule to which it is bound from performing a biological function. In assessing the binding and/or specificity of an antigen binding protein, e.g., an antibody or immunologically functional fragment thereof, an antibody or fragment can substantially inhibit binding of a target molecule to its binding partner when an excess of antibody reduces the quantity of binding partner bound to the target molecule by at least about 1-20, 20-30%, 30-40%, 40-50%, 50-60%, 60-70%, 70-80%, 80-85%, 85-90%, 90-95%, 95-97%, 97-98%, 98-99%, 99.5%, 99.9% and 100%. In some embodiments, inhibition is complete. The measurement of reduction of binding is done using various assays known to those skilled in the art, (e.g., an in vitro competitive binding assay) and performed using relevant control molecules so that actual inhibition is measured. For example, numerous competition assays are well known in the art, with nonlimiting examples being competition ELISA, use of the BiaCore® platform, the Kinexa® platform, or the like. Further examples include: solid phase direct or indirect radioimmunoassay (MA), solid phase direct or indirect enzyme immunoassay (EIA), sandwich competition assay (see, e.g., Stahli et al., 1983, Methods in Enzymology 9:242-253); solid phase direct biotin-avidin EIA (see, e.g., Kirkland et al., 1986, J. Immunol. 137:3614-3619) solid phase direct labeled assay, solid phase direct labeled sandwich assay (see, e.g., Harlow and Lane, 1988, Antibodies, A Laboratory Manual, Cold Spring Harbor Press); solid phase direct label RIA using 1-125 label (see, e.g., Morel et al., 1988, Molec. Immunol. 25:7-15); solid phase direct biotin-avidin EIA (see, e.g., Cheung, et al., 1990, Virology 176:546-552); and direct labeled RIA (Moldenhauer et al., 1990, Scand. J. Immunol. 32:7-82). Typically, such an assay involves the use of purified antigen bound to a solid surface or cells bearing either of these, an unlabelled test antigen binding protein and a labeled reference antigen binding protein. In some embodiments, in the case of ASGR, ASGR-1 and/or ASGR-2, such a neutralizing antigen binding protein or antibody can diminish the ability of ASGR, ASGR-1 and/or ASGR-2 to bind to a ligand. In some embodiments, the neutralizing ability is characterized and/or described via a competition assay. In some embodiments, the neutralizing ability is described in terms of an $IC_{50}$ or $EC_{50}$ value. The antigen binding proteins in at least Table C are strong neutralizers. In some embodiments, the antibodies or antigen binding proteins neutralize by binding to ASGR, ASGR-1 and/or ASGR-2 and preventing ASGR, ASGR-1 and/or ASGR-2 from binding to a ligand, including sugars such as lactose, galactose, and/or GalNAc or glycoproteins displaying such sugars, such as fetuin, orosomucoid and/or alkaline phosphatase (or reducing the ability of ASGR, ASGR-1 and/or ASGR-2 to bind to ligand).

Competitive inhibition can be measured by determining the amount of labelled ligand bound to the solid surface or cells in the presence of the test antigen binding protein. Usually the test antigen binding protein is present in excess. Antigen binding proteins or antibodies identified by competition assay (competing antigen binding proteins or antibodies) include antigen binding proteins binding to the same epitope as the reference antigen binding proteins and antigen binding proteins binding to an adjacent epitope sufficiently proximal to the epitope bound by the reference antigen binding protein for steric hindrance to occur. Usually, when a competing antigen binding protein is present in excess, it will inhibit (e.g., reduce) specific binding of a reference antigen binding protein to a target antigen by at least 40-45%, 45-50%, 50-55%, 55-60%, 60-65%, 65-70%, 70-75% or 75% or more. In some embodiments, binding is inhibited by at least 40%, 45%, 50%, 55%, 60%, 65%, 70%, 75%, 80%, 85%, 90%, or 95%. In some embodiments, binding is inhibited by at least 80-85%, 85-90%, 90-95%, 95-97%, or 97% or more, including up to 100% inhibition.

In some embodiments, a ligand binding assay is used where cells expressing the target protein (e.g., ASGR-1) are mixed with antigen binding proteins and incubated for a time period, then washed. These cells are then incubated with labelled ligand (e.g., β-GalNAc) for a time period and then washed and analyzed for ligand binding, where reduced ligand binding as compared to a relevant control antigen binding protein indicates inhibition of binding due to the antigen binding protein blocking or inhibiting this binding.

Another manner in which the reduction in binding can be measured is the half maximal inhibitory concentration (IC50). The IC50 measures the amount or concentration of antigen binding protein that is needed to inhibit a given attribute (e.g., ligand binding) by half. In certain embodiments, the antigen binding proteins (e.g., human antibodies) have an IC50 value of 90 nM or less, in another embodiment, an IC50 value of 80 nM or less, in another embodiment, 70 nM or less, in another embodiment, 60 nM or less, in another embodiment, 50 nM or less, in another embodiment, 40 nM or less, in another embodiment, 30 nM or less, in another embodiment 25 nM or less.

In certain embodiments, the antigen binding proteins of the invention bind to an ASGR-1 monomer. In some embodiments, the antigen binding proteins of the invention bind to an ASGR-1 oligomer. In further embodiments, the antigen binding proteins of the invention bind to an ASGR-2 monomer. In some embodiments, the antigen binding proteins of the invention bind to an ASGR-2 oligomer. In certain embodiments, the antigen binding proteins of the invention bind to both ASGR-1 monomers and ASGR-2 monomers. In certain embodiments, the antigen binding proteins of the invention bind to an ASGR oligomer comprising an (ASGR-1)$_2$-(ASGR-2)$_1$ trimer. In some embodiments, the antigen binding proteins of the invention bind to an ASGR oligomer comprising an (ASGR-1)$_2$ dimer. In further embodiments, the antigen binding proteins of the invention bind to an ASGR oligomer comprising an (ASGR-1)$_3$ trimer. In yet further embodiments, the antigen binding proteins of the invention bind to an ASGR oligomer comprising an (ASGR-1)$_2$-(ASGR-2)$_2$ tetramer. In further embodiments, the antigen binding proteins of the invention bind to an ASGR oligomer comprising an (ASGR-1)$_3$-(ASGR-2)$_2$ pentamer. In some embodiments, the antigen binding proteins of the invention bind to a multimeric complex comprising at least two subunits of ASGR-1 and/or ASGR-2.

In certain embodiments, the antigen binding proteins (e.g., antibodies, antibody fragments, etc.) bind to ASGR, ASGR-1 and/or ASGR-2 and inhibit ASGR, ASGR-1 and/or ASGR-2 from binding to a ligand, wherein the antigen binding proteins comprise specific amino acid residues at particular positions in the molecule (e.g., in the VH, VL or CDRs). These residues may be involved in the binding properties of desired molecules (e.g., part of the paratope). A "paratope" are used herein is the location in an antibody that binds to the antigen. The paratope can comprise several amino acid residues from the VH and/or VL CDRs, and also can comprise residues from the framework regions. The paratope binds to the antigen's epitope. Paratopes can be determined using methodologies similar to those described determining epitopes. Once the amino acid residues involved in the binding properties of desired molecules, are identified, this information can be used to design antigen binding proteins (e.g., antibodies, antibody fragments, etc.) that can bind to ASGR, ASGR-1 and/or ASGR-2 and inhibit ASGR function (e.g., inhibit ASGR, ASGR-1 and/or ASGR-2 from binding to ligand).

The binding site (or interface) between the representative antibodies and human ASGR-1 can be determined/defined a number of ways. For example, binding of representative antigen binding proteins (e.g., antibodies) to human ASGR-1 was analyzed in Example 10 using X-ray crystallography, and the binding site or interface was determined using distance. The crystal structure of the antibody/huASGR1 complex provides information as to which residues of representative antibodies form the interface with human ASGR-1. As mentioned above, one of ordinary skill in the art may use this information to design antigen binding proteins and antigen binding protein variants, including those that contain variable domains having 90% identity or greater, 95% identity or greater, 97% identity or greater, 99% identity or greater, or those antigen binding protein variants that contain variable domains having 20 or less, 15 or less, or 10 or less, or 5 or less insertions, deletions, and/or substitutions within the light chain and/or heavy chain variable domain of the antigen binding proteins disclosed herein. One may wish to maintain the amino acids within the interface while altering non-interface residues. Thus, in some embodiments, one may design and create antigen binding proteins and antigen binding protein variants of the antigen binding proteins disclosed herein having one or more amino acid additions, substitutions, and/or deletions within one or more CDRs that maintain binding to human ASGR-1 and inhibit ASGR, ASGR-1 and/or ASGR-2 function (e.g., inhibit ASGR, ASGR-1 and or ASGR-2 from binding to ligand).

In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13 or all amino acid residues selected from the group consisting of Q27, R30, D32, H91, Y92, S93, Y94, I2, G28, I29, L33, Q90, P95, and R96 of SEQ ID NO:25010 and/or the heavy chain variable region comprises at least 1, 2, 3, 4, 5, 6, 7, 8, 9, 10, 11, 12, 13, 14, 15, 16, 17, 18, 19, 20, 21, 22, 23 or all amino acid residues selected from the group consisting of S30, N31, W52, Y53, D54, S56, N57, Y59, Y101, S102, S103, G104, W105, Y106, D107, Y32, V33, V50, G55, K58, N74, E99, V100, and Y108 of SEQ ID NO:29016. In some embodiments, the light chain variable region comprises at least 1, 2, 3, 4, 5, 6 or all amino acid residues selected from the group consisting of Q27, R30, D32, H91, Y92, S93, and Y94 of SEQ ID NO:25010 and/or the heavy chain variable region comprises at least 1, 2, 3, 4, 5, 6, 7, 8, 9, 10, 11, 12, 13, 14, or all amino acid residues selected from the group consisting of S30, N31, W52, Y53, D54, S56, N57, Y59, Y101, S102, S103, G104, W105, Y106, and D107 of SEQ ID NO:29016. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15 or all amino acid residues selected from the group consisting of H31, S33, N34, N36, Y38, W56, Y97, Y98, I29, S32, N35, N37, Y55, T59, Q96, N99, T100 of SEQ ID NO:25164 and/or the heavy chain variable region comprises at least 1, 2, 3, 4, 5, 6, 7, 8, 9, 10, 11, 12, 13, 14, 15, 16, 17, 18, 19, 20, 21, 22, 23, 24, 25, 26 or all amino acid residues selected from the group consisting of T28, F29, T30, N31, Y32, D33, W50, H52, S55, N57, S99, S100, G101, W102, Y103, Y27, I34, N35, W47, M51, P53, N54, G56, T58, G59, Y104, D106 of SEQ ID NO:29170. In some embodiments, the light chain variable region comprises at least 1, 2, 3, 4, 5, 6, 7 or all amino acid residues selected from the group consisting H31, S33, N34, N36, Y38, W56, Y97, Y98 of SEQ ID NO:25164 and/or the heavy chain variable region comprises at least 1, 2, 3, 4, 5, 6, 7, 8, 9, 10, 11, 12, 13, 14, or all amino acid residues selected from the group consisting of T28, F29, T30, N31, Y32, D33, W50, H52, S55, N57, S99, S100, G101, W102, Y103 of SEQ ID NO:29170. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15, 16, 17, 18 or all amino acid residues selected from the group consisting of I30, Y32, T91, Y92, S93, T94, I96, I2, Q27, N28, I29, S31, L33, N34, T50, S67, Q89, Q90, P95 of SEQ ID NO:24908 and/or the heavy chain variable region comprises at least 1, 2, 3, 4, 5, 6, 7, 8, 9, 10, 11, 12, 13, 14, 15, 16, 17, 18, 19, 20, 21, 22 or all amino acid residues selected from the group consisting of S30, S31, I50, W52, H53, S56, N57, Y59, S01, M102, G103, T28, F29, F32, G33, H35, W47, I51, D54, K58, D99, L100, G104 of SEQ ID NO:28914. In some embodiments, the light chain variable region comprises at least 1, 2, 3, 4, 5, 6 or all amino acid residues selected from the group consisting I30, Y32, T91, Y92, S93, T94, I96 of SEQ ID NO:24908 and/or the heavy chain variable region comprises at least 1, 2, 3, 4, 5, 6, 7, 8, 9, 10 or all amino acid residues selected from the group consisting of S30, S31, I50, W52, H53, S56, N57, Y59, S01, M102, G103 of SEQ ID NO:28914. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15 or all amino acid residues selected from the group consisting of Y32, S91, Y92, R93, Thr94, Pro95, F97, Ile2, Q27, N28, NAG100, Ile29, S30, S31, Q90, and L96 of SEQ ID NO:24362 and/or the heavy chain variable region comprises at least 1, 2, 3, 4, 5, 6, 7, 8, 9, 10, 11, 12, 13, 14, 15, 16, 17, 18, 19, 20, 21, 22, 23, 24, 25, 26, 27 or all amino acid residues selected from the group consisting of A33, Val50, Ile51, S52, R53, S54, G55, G56, Y57, Y59, R99, A101, A103, G104, E106, S30, S31, Y32, Met34, N35, W47, S49, Thr58, R72, N74, L100, Val102, and S105 of SEQ ID NO:28368. In some embodiments, the light chain variable region comprises at least 1, 2, 3, 4, 5, 6, or all amino acid residues selected from the group consisting of Y32, S91, Y92, R93, Thr94, Pro95, and F97 of SEQ ID NO:24362, and/or the heavy chain variable region comprises at least 1, 2, 3, 4, 5, 6, 7, 8, 9, 10, 11, 12, 13, 14, or all amino acid residues selected from the group consisting of A33, Val50, Ile51, S52, R53, S54, G55, G56, Y57, Y59, R99, A101, A103, G104, and E106 of SEQ ID NO:28368. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15, 16, 17 or all amino acid residues selected from the group consisting of Q27, W32, A91, N92, S93, F94, F96, D1, I2, G28, I29, S30, R31, Y49, G50, Q89, Q90, and P95 of SEQ ID NO:24930 and/or the heavy chain variable region comprises at least 1, 2, 3, 4, 5, 6, 7, 8, 9, 10, 11, 12, 13, 14, 15, 16, 17, 18, 19, 20, 21, 22 or all amino acid residues selected from the group consisting of Y33, H35, W50, H52, S55, G57, T58, N59, D99, G100, T101, S102, D31, Y32, L34, W47, I51, N54, G56, Y60, Q65, S103, and F104 of SEQ ID NO:28936. In some embodiments, the light chain variable region comprises at least 1, 2, 3, 4, 5, 6 or all amino acid residues selected from the group consisting of Q27, W32, A91, N92, S93, F94, and F96 of SEQ ID NO:24930 and/or the heavy chain variable region comprises at least 1, 2, 3, 4, 5, 6, 7, 8, 9, 10, 11 or all amino acid residues selected from the group consisting of Y33, H35, W50, H52, S55, G57, T58, N59, D99, G100, T101, and S102 of SEQ ID NO:28936. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15, 16, 17, 18, 19 or all amino acid residue selected from the group consisting of Y32, Y49, T50, Q55, S91, H92, S93, F94, F96, S28, I29, T30, N33, L46, S53, L54, S56, Q89, Q90, and P95 of SEQ ID NO:28074 and/or the heavy chain variable region comprises at least 1, 2, 3, 4, 5, 6, 7, 8, 9, 10, 11, 12, 13, 14, 15, 16, 17, 18, 19, 20, 21, 22, 23, 24, 25, 26, 27, 28 or all amino acid residues selected from the group consisting of G26, F27, T28, S30, S31, Y32, S33, S52, G53, S54, S56, Y57, Y59, R98, G100, S101, R102, V2, F29, N35, S50, T51, S55, I58, R72, G99, G103, F104 and D105 of SEQ ID NO:32080. In some embodiments, the light chain variable region comprises at least 1, 2, 3, 4, 5, 6, 7, 8 or all amino acid residues selected from the group consisting of Y32, Y49, T50, Q55, S91, H92, S93, F94, and F96 of SEQ ID NO:28074 and/or heavy chain variable region comprises at least 1, 2, 3, 4, 5, 6, 7, 8, 9, 10, 11, 12, 13, 14, 15, 16 or all amino acid residues selected from the group consisting of G26, F27, T28, S30, S31, Y32, S33, S52, G53, S54, S56, Y57, Y59, R98, G100, S101 and R102 of SEQ ID NO:32080. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15, 16, 17, 18, 19, 20, 21 or all amino acid residues selected from the group consisting of V29, S30, I32, Y33, L47, Y50, R55, A56, T57, Y94, G28, N31, L48, I49, G51, N54, G58, I59, S68, G69, D93, and S95 of SEQ ID NO:26814 and/or the heavy chain variable region comprises at least 1, 2, 3, 4, 5, 6, 7, 8, 9, 10, 11, 12, 13, 14, 15, 16, 17, 18, 19, 20, 21, 22, 23, 24, 25 or all amino acid residues selected from the group consisting of V31, Y32, Y33, W50, N52, S55, G57, R98, G99, Y100, D101, I102, T204, V2, Y27, T30, L34, N35, P53, N54, G56, T58, N59, A97, L103, and G105 of SEQ ID NO:30820. In some embodiments, the light chain variable region comprises at least 1, 2, 3, 4, 5, 6, 7, 8, 9, or all amino acid residues selected from the group consisting of V29, S30, I32, Y33, L47, Y50, R55, A56, T57, and Y94 of SEQ ID NO:26814 and/or heavy chain variable region comprises at least 1, 2, 3, 4, 5, 6, 7, 8, 9, 10, 11, 12 or all amino acid residues selected from the group consisting of V31, Y32, Y33, W50, N52, S55, G57, R98, G99, Y100, D101, I102, and T204 of SEQ ID NO:30820. In some embodiments, the antigen binding protein or the antibody comprises a light chain variable region and/or a heavy chain variable region, wherein the light chain variable region comprises at least 1, 2, 3 or all amino acid residues selected from the group consisting of N31, Y50, V51, Q54 SEQ ID NO:27482; and/or the heavy chain variable region comprises at least 1, 2, 3, 4, 5, 6, 7, 8, 9, 10, 11, 12, 13, 14, 15, 16, 17, 18, 19, 20, 21, 22, 23, 24, 25, 26, 27 or all amino acid residues selected from the group consisting of N30, S31, Y32, S52, Y54, N55, K59, R98, D100, F101, W102, S103, G104, Y105, K107, D110, V2, Y27, T28, F29, G33, W50, A53, G56, N57, H99, Y106, or G108 of SEQ ID NO:31488. In some embodiments, the antigen binding protein or the antibody comprises a light chain variable region and/or a heavy chain variable region, wherein the heavy chain variable region comprises at least 1, 2, 3, 4, 5, 6, 7, 8, 9, 10, 11, 12, 13, 14, 15, or all amino acid residues selected from the group consisting of N30, S31, Y32, S52, Y54, N55, K59, R98, D100, F101, W102, S103, G104, Y105, K107, and D110 of SEQ ID NO:31488. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, or all amino acid residues selected from the group consisting of Y33, Y50, D51, N53, K54, S57, V34, S52, R55, P56, G58, and G65 of SEQ ID NO:27780 and/or the heavy chain variable region comprises at least 1, 2, 3, 4, 5, 6, 7, 8, 9, 10, 11, 12, 13, 14, 15, 16, 17, 18, 19, 20, 21, 22, 23, 24, 25 or all amino acid residues selected from the group consisting of Q1, V2, F27, S30, S31, Y32, Y53, D54, W99, Y100, Y101, Y102, G26, T28, F29, G33, W52, G55, R72, N74, N98, Y103, Y104, D107, and V108 of SEQ ID NO:31786. In some embodiments, the light chain variable region comprises at least 1, 2, 3, 4, 5 or all amino acid residues selected from the group consisting of Y33, Y50, D51, N53, K54 and S57 of SEQ ID NO:27780 and/or heavy chain variable region comprises at least 1, 2, 3, 4, 5, 6, 7, 8, 9, 10, 11 or all amino acid residues selected from the group consisting of Q1, V2, F27, S30, S31, Y32, Y53, D54, W99, Y100, Y101, and Y102 of SEQ ID NO:31786. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15, 16, 17, 18, 19 or all amino acid residues selected from the group consisting of H31, G32, D33, G34, K35, Y37, I97, Q98, I99, I2, Q27, S28, L29, L30, T36, E55, Q95, S96, P100, and W101 of SEQ ID NO:26536 and/or the heavy chain variable region comprises at least 1, 2, 3, 4, 5, 6, 7, 8, 9, 10, 11, 12, 13, 14, 15, 16, 17, 18, 19, 20, 21, 22, 23 or all amino acid residues selected from the group consisting of S31, W52, Y53, D54, Y57, Y59, D102, F103, W104, T28, S30, Y32, G33, W47, I50, I51, S56, K58, Y60, K65, D99, H101, S105, and G106 of SEQ ID NO:30542. In some embodiments, the light chain variable region comprises at least 1, 2, 3, 4, 5, 6, 7, 8 or all amino acid residues selected from the group consisting of H31, G32, D33, G34, K35, Y37, I97, Q98, and I99 of SEQ ID NO:26536 and/or heavy chain variable region comprises at least 1, 2, 3, 4, 5, 6, 7, 8 or all amino acid residues selected from the group consisting of S31, W52, Y53, D54, Y57, Y59, D102, F103 and W104 of SEQ ID NO:30542. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15, 16, 17, 18, 19 or all amino acid residues selected from the group consisting of N30, S31, Y33, F50, S54, S68, Y92, E93, W97, S28, V29, G32, L47, G51, A52, S53, R55, A56, G69, Q90, Q91, S94, and S95 of SEQ ID NO:26826 and/or the heavy chain variable region comprises at least 1, 2, 3, 4, 5, 6, 7, 8, 9, 10, 11, 12, 13, 14, 15, 16, 17, 18, 19, 20, 21, 22, 23, 24 or all amino acid residues selected from the group consisting of R30, Y31, Y33, E50, S54, S56, N58, D98, Y99, G100, S28, Y32, W34, S35, W47, G49, I51, S52, H53, G55, T57, R97, A101, F102 and D103 of SEQ ID NO:30832. In some embodiments, the light chain variable region comprises at least 1, 2, 3, 4, 5, 6, 7, 8 or all amino acid residues selected from the group consisting of N30, S31, Y33, F50, S54, S68, Y92, E93, and W97 of SEQ ID NO:26826 and/or heavy chain variable region comprises at least 1, 2, 3, 4, 5, 6, 7, 8, 9 or all amino acid residues selected from the group consisting of R30, Y31, Y33, E50, S54, S56, N58, D98, Y99 and G100 of SEQ ID NO:30832.

In further embodiments, consensus sequences among the antigen binding proteins of the inventions are envisioned. For example, the variable heavy chain and variable light chain regions (VH and VL) and the CDRs (HCDR1/2/3 and LCDR1/2/3) of the invention include consensus sequences derived from groups of related monoclonal antibodies. In some embodiments, the antigen binding proteins (e.g., antibodies) may be related by both sequence homology and function. As described herein, a "consensus sequence" refers to amino acid sequences having conserved amino acids common among a number of sequences and amino acids that vary within given amino acid sequences at certain positions. In some embodiments, the varied amino acid at a certain position is a substitution. In some embodiments, the varied amino acid at a certain position is a deletion. In some embodiments, the varied amino acid at a certain position is an addition or insertion. These varied amino acids will be apparent to one of skill in the art when analyzing particular antibody VH, VL and/or CDR sequences.

For example, antibody sequences were analyzed using the following methodology. The Smith-Waterman algorithm was used to align amino acid sequences against translated IMGT germline V, D and J genes. The V gene was located first, then the J gene was located in the region downstream from located V gene, and finally the D gene was located in the region between V and J regions. Note, that since D gene is a relatively short sequence that is located in the hypervariable CDR3 region, a spurious match is possible and as such, was taken into consideration.

Sequences from each group were then subjected to sequence similarity alignment interrogation using a program that employs a standard ClustalW algorithm (see, Thompson et al., 1994, Nucleic Acids Res. 22:4673-4680). In some cases, the Biosum cost matrix was used with a gap creation penalty of 50 was employed along with a gap extension penalty of 0.1. The sequence logos were generated by Geneious (v8.1.7, Biomatters) once the alignments were made and then exported as PDF images. The consensus sequences were generated in Geneious (v8.1.7, Biomatters) with a 0% threshold and exported as FASTA files. Amino acids that varied within each group were noted with the notation X within each consensus sequence. See Table 19A VH Consensus 1-14 and Table 20A VL Consensus 1-14 in FIG. 55, and Tables 21-48 in FIG. 56 for the consensus sequences resulting from this analysis. In other cases, the consensus sequences were generated in Abinitio. See Table 19A VH Consensus-15-60 and Table 20A VL Consensus 15-54 in FIG. 55, and Tables 49-134 in FIG. 57 for the consensus sequences resulting from this analysis.

Alternatively, different methods of analysis readily available to one of skill in the art can be used. For example, consensus sequences can be determined using standard phylogenic analyses of the CDRs corresponding to the VH (i.e., Variable Heavy, etc.) & VL (i.e., Variable Light, etc.) of antibodies. For example, amino acid sequences corresponding to the entire variable domains of either VH or VL can be converted to FASTA formatting for ease in processing comparative alignments and inferring phylogenies. Next, framework regions of these sequences can be replaced with an artificial linker sequence so that examination of the CDRs alone can be performed without introducing any amino acid position weighting bias due to coincident events (e.g., such as unrelated antibodies that serendipitously share a common germline framework heritage) while still keeping CDRs contiguous within the same sequence corresponding to a VH or VL. VH or VL sequences of this format can then be subjected to sequence similarity alignment interrogation using a program that employs a standard ClustalW-like algorithm (see, Thompson et al., 1994, Nucleic Acids Res. 22:4673-4680). A gap creation penalty of 8.0 can be employed along with a gap extension penalty of 2.0. This program likewise generated phylograms (phylogenic tree illustrations) based on sequence similarity alignments using either UPGMA (unweighted pair group method using arithmetic averages) or Neighbor-Joining methods (see, Saitou and Nei, 1987, Molecular Biology and Evolution 4:406-425) to construct & illustrate similarity and distinction of sequence groups via branch length comparison and grouping. The original sequence alignments generated can be employed to empirically examine and document the occurrence of amino acids tolerated at each position with a consensus group. Consensus sequences for the groups of similar sequences within each CDR can then be prepared.

In another type of approach, CDR consensus sequences can be determined for each separate CDR, independently of their contiguous context within the same sequence corresponding to a VH or VL. In this approach the consensus sequences can be determined by aligning each H-CDR1, H-CDR2, H-CDR3, L-CDR1, L-CDR2, and L-CDR3 in groups, i.e., by aligning the individual H-CDR1 sequences of the antigen binding proteins to determine a H-CDR1 consensus sequence, by aligning the individual H-CDR2 sequences of the antigen binding proteins to determine a H-CDR2 consensus sequence, by aligning the individual H-CDR3 sequences of the antigen binding proteins to determine a H-CDR3 consensus sequence, by aligning the individual L-CDR1 sequences of the antigen binding proteins to determine a L-CDR1 consensus sequence, by aligning the individual L-CDR2 sequences of the antigen binding proteins to determine a L-CDR2 consensus sequence, and by aligning the individual L-CDR3 sequences of the antigen binding proteins to determine a L-CDR3 consensus sequence. Similarities between sequences within each individual CDR sequences can be identified. Consensus sequences for the groups of similar sequences within each CDR can then be prepared.

Various embodiments of Variable Heavy chain (VH) Consensus amino acid sequences of the present invention are set forth in Table 19A of FIG. 55 (CDRs are underlined, with the first being CDR1). Various embodiments of VH CDR Consensus amino acid sequences of the present invention are set forth in Tables 19B and 19C of FIG. 55. In some cases, an "X" is present in the amino acid sequences set forth in Tables 19A and 19B which signifies that more than one amino acid (or no amino acid) may be present at this location (see FIGS. 56 and 57 for details of the consensus protein alignment). In some cases a "-" is present in Table 19A (which is the result of the consensus alignment) and signifies that no amino acid is present at the location (see FIGS. 56 and 57 for details of the consensus protein alignment). The VH Consensus sequences and the VH CDR Consensus sequences are based on analysis of 8 or more aligned VH/VH CDR antibody sequences, as described above. In some cases, the VH/VH CDR Consensus sequence is based on analysis of 25 or more, 50 or more, 75 or more, or 100 or more aligned VH antibody sequences. In one case, the VH/VH CDR Consensus sequence is based on analysis of 149 aligned VH antibody sequences.

Various embodiments of Variable Light chain (VL) Consensus amino acid sequences of the present invention are set forth in Table 20A of FIG. 55 (CDRs are underlined, with the first being CDR1). Various embodiments of VL CDR Consensus amino acid sequences of the present invention are set forth in Tables 20B and 20C of FIG. 55. As mentioned above, in some cases, an "X" is present in the amino acid sequences set forth in Tables 20A and 20B which signifies that more than one amino acid (or no amino acid) may be present at this location (see FIGS. 56 and 57 for details of the consensus protein alignment). In some cases a "-" is present in Table 20A (which is the result of the consensus alignment) and signifies that no amino acid is present at the location (see FIGS. 56 and 57 for details of the consensus protein alignment). The VL Consensus sequences and the VL CDR Consensus sequences are based on analysis of 8 or more aligned VL/VL CDR antibody sequences, as described above. In some cases, the VL/VL CDR Consensus sequence is based on analysis of 25 or more, 50 or more, 75 or more, or 100 or more, 125 or more, or 150 or more aligned VL antibody sequences. In one case, the VL/VL CDR Consensus sequence is based on analysis of 209 aligned VL antibody sequences.

As discussed above, the consensus sequences in certain embodiments can comprise substitutions, deletions, or additions/insertions at different positions in the sequence. Specific examples of these substitutions, deletions, or additions/insertions can be found in Tables 19C and 20C of FIG. 55, as well as Tables 21-48 of FIG. 56 and Tables 49-134 of FIG. 57, all of which are included herein. However, in no way should the amino acid substitutions, deletions, or additions/insertions exemplified in Tables 19A-C and 20A-C in FIG. 55 or in Tables 21-48 in FIG. 56 or in Tables 49-134 in FIG. 57 be construed to limit the invention to only those amino acid substitutions, deletions, or additions at any position in the identified consensus sequences (VH, VL and/or CDRs) with any amino acid is contemplated herein.

In certain embodiments, the antigen binding proteins of the invention comprise 3 VH CDRs and 3 VL CDRs, wherein at least one VH CDR is a VH1 CDR selected from Table 19B or Table 19C as depicted in FIG. 55. In certain embodiments, the antigen binding proteins of the invention comprise 3 VH CDRs and 3 VL CDRs, wherein at least one VH CDR is a VH2 CDR selected from Table 19B or Table 19C as depicted in FIG. 55. In certain embodiments, the antigen binding proteins of the invention comprise 3 VH CDRs and 3 VL CDRs, wherein at least one VH CDR is a VH3 CDR selected from Table 19B or Table 19C as depicted in FIG. 55. In certain embodiments, the antigen binding proteins of the invention comprise 3 VH CDRs and 3 VL CDRs, wherein the VH1 CDR, the VH2 CDR and the VH3 CDR is selected from Table 19B or Table 19C as depicted in FIG. 55.

In certain embodiments, the antigen binding proteins of the invention comprise 3 VH CDRs and 3 VL CDRs, wherein at least one VL CDR is a VL1 CDR selected from Table 20B or Table 20C as depicted in FIG. 55. In certain embodiments, the antigen binding proteins of the invention comprise 3 VH CDRs and 3 VL CDRs, wherein at least one VL CDR is a VL2 CDR selected from Table 20B or Table 20C as depicted in FIG. 55. In certain embodiments, the antigen binding proteins of the invention comprise 3 VH CDRs and 3 VL CDRs, wherein at least one VL CDR is a VL3 CDR selected from Table 20B or Table 20C as depicted in FIG. 55. In certain embodiments, the antigen binding proteins of the invention comprise 3 VH CDRs and 3 VL CDRs, wherein the VL1 CDR, the VL2 CDR and the VL3 CDR is selected from Table 20B or Table 20C as depicted in FIG. 55.

In some embodiments, antigen binding proteins comprise no more than one, two, three, four, five, or six amino acid additions, deletions or substitutions of a VH. In some embodiments, antigen binding proteins comprise no more than one, two, three, four, five, or six amino acid additions, deletions or substitutions of a VL. In further embodiments, antigen binding proteins comprise no more than one, two, three, four, five, or six amino acid additions, deletions or substitutions within a VH1 CDR. In further embodiments, antigen binding proteins comprise no more than one, two, three, four, five, or six amino acid additions, deletions or substitutions within a VH2 CDR. In further embodiments, antigen binding proteins comprise no more than one, two, three, four, five, or six amino acid additions, deletions or substitutions within a VH3 CDR. In further embodiments, antigen binding proteins comprise no more than one, two, three, four, five, or six amino acid additions, deletions or substitutions within a VL1 CDR. In further embodiments, antigen binding proteins comprise no more than one, two, three, four, five, or six amino acid additions, deletions or substitutions within a VL2 CDR. In further embodiments, antigen binding proteins comprise no more than one, two, three, four, five, or six amino acid additions, deletions or substitutions within a VL3 CDR.

In some embodiments, antigen binding proteins comprise no more than one, two, three, four, five, or six amino acid additions, deletions or substitutions of a VH consensus sequence. In some embodiments, antigen binding proteins comprise no more than one, two, three, four, five, or six amino acid additions, deletions or substitutions of a VL consensus sequence. In further embodiments, antigen binding proteins comprise no more than one, two, three, four, five, or six amino acid additions, deletions or substitutions within a VH1 CDR Consensus sequence. In further embodiments, antigen binding proteins comprise no more than one, two, three, four, five, or six amino acid additions, deletions or substitutions within a VH2 CDR Consensus sequence. In further embodiments, antigen binding proteins comprise no more than one, two, three, four, five, or six amino acid additions, deletions or substitutions within a VH3 CDR Consensus sequence. In further embodiments, antigen binding proteins comprise no more than one, two, three, four, five, or six amino acid additions, deletions or substitutions within a VL1 CDR Consensus sequence. In further embodiments, antigen binding proteins comprise no more than one, two, three, four, five, or six amino acid additions, deletions or substitutions within a VL2 CDR Consensus sequence. In further embodiments, antigen binding proteins comprise no more than one, two, three, four, five, or six amino acid additions, deletions or substitutions within a VL3 CDR Consensus sequence.

In some embodiments, framework consensus sequences are encompassed by the present invention. Examples of these framework consensus sequences and additions, deletions or substitutions are shown in Tables 21-48 in FIG. 56 and Tables 49-134 in FIG. 57 herein.

In a further embodiment, the antigen binding proteins of the invention bind to ASGR of different species, including, but not limited to, human, cynomolgus, porcine, canine, murine and rat. In some embodiments, the antigen binding proteins of the invention bind to human. In some embodiments, the antigen binding proteins of the invention bind to cynomolgus ASGR. In some embodiments, the antigen binding proteins of the invention bind to porcine ASGR. In some embodiments, the antigen binding proteins of the invention bind to canine ASGR. In some embodiments, the antigen binding proteins of the invention bind to murine ASGR. In some embodiments, the antigen binding proteins of the invention bind to rat ASGR. In some embodiments, the antigen binding proteins specifically bind to ASGR of the different species.

In some embodiments, the antigen binding proteins of the invention bind to ASGR-1 of different species, including, but not limited to, human, cynomolgus, porcine, canine, murine and rat. In some embodiments, the antigen binding proteins of the invention bind to human ASGR-1. In some embodiments, the antigen binding proteins of the invention bind to cynomolgus ASGR-1. In some embodiments, the antigen binding proteins of the invention bind to porcine ASGR-1. In some embodiments, the antigen binding proteins of the invention bind to canine ASGR-1. In some embodiments, the antigen binding proteins of the invention bind to murine ASGR-1. In some embodiments, the antigen binding proteins of the invention bind to rat ASGR-1. In some embodiments, the antigen binding proteins specifically bind to ASGR-1 of the different species.

In some embodiments, the antigen binding proteins of the invention binds to ASGR-2 of different species, including, but not limited to, human, cynomolgus, porcine, canine, murine and rat. In some embodiments, the antigen binding proteins of the invention bind to human ASGR-2. In some embodiments, the antigen binding proteins of the invention bind to cynomolgus ASGR-2. In some embodiments, the antigen binding proteins of the invention bind to porcine ASGR-2. In some embodiments, the antigen binding proteins of the invention bind to canine ASGR-2. In some embodiments, the antigen binding proteins of the invention bind to murine ASGR-2. In some embodiments, the antigen binding proteins of the invention bind to rat ASGR-2. In some embodiments, the antigen binding proteins specifically bind to ASGR-2 of the different species.

In some embodiments, the antigen binding proteins of the invention bind to ASGR, ASGR-1 and/or ASGR-2 from two or more different species, and/or bind ASGR, ASGR-1 and/or ASGR-2 from the same species. For example, but not limited to: an antibody that binds human and cynomolgus ASGR-1; an antibody that binds to human, cynomolgus and porcine ASGR-1; an antibody that binds to human, cynomolgus, rat and murine ASGR-2; an antibody that binds human ASGR-1 and human ASGR-2; an antibody that binds human and cynomolgus ASGR-1 and ASGR-2. In some embodiments, the antigen binding proteins specifically bind to ASGR, ASGR-1 and/or ASGR-2 from two or more different species and/or specifically bind ASGR, ASGR-1 and/or ASGR-2 from the same species.

As discussed herein, the ASGR receptor, and ASGR-1 and/or ASGR-2 separately, internalize into the cell upon ligand binding. Accordingly, in certain embodiments, the invention provides antigen binding proteins that inhibit or reduce internalization of ASGR, ASGR-1 and/or ASGR-2. In certain embodiments, the antigen binding proteins of the invention reduce ligand binding and also inhibit internalization of ASGR, ASGR-1 and/or ASGR-2. In some embodiments, the antigen binding proteins of the invention inhibit internalization without necessarily inhibiting ligand binding.

In some embodiments, the antigen binding proteins (e.g., antibodies) of the invention are pH and/or calcium insensitive molecules, as well as binding to ASGR, ASGR-1 and/or ASGR-2 and inhibiting the binding to a ligand. It is envisioned that these properties are desired to reduce or prevent the molecule from disassociating from the receptor during the endocytotic process in order to extend the half-life of the molecule. In some embodiments, the antigen binding proteins (e.g., antibodies) with pH-independent binding to its antigen such that the affinity for the antigen binding at physiological pH (i.e., pH 7.4) is similar to that at endosomal pH (i.e., pH 5.5-6.0). In some embodiments, the antigen binding proteins (e.g., antibodies) with calcium-independent binding to its antigen such that the affinity for the antigen binding at assay conditions (i.e., 1 mM calcium) is similar to that in the absence of exogenously added calcium. In some embodiments, the antigen binding proteins with both pH- and calcium-independent binding to its antigen such that the affinity for the antigen binding at physiologic pH and in the presence of calcium is similar to that at endosomal pH (i.e., pH 5.5-6.0) and in the absence of calcium. Any number of methods known to one skilled in the art can be used to measure pH and/or calcium insensitivity, such as the method described in Example 7C below.

ASGR-1, an asialoglycoprotein receptor, contains an N-term cytosolic domain, a transmembrane domain, a stalk region and a carbohydrate recognition domain (CRD) (alternatively known as the carbohydrate binding domain, or "CBD"). The carbohydrate recognition domain ("CRD") structure of ASGR-1 is reported in literature (M. Meier et al, JMB (2000)300, 857-865). The structure of ASGR-1 at a higher resolution than reported, and also when bound to various ligands (e.g., sugars including but not limited to lactose, galactose, and/or GalNAc or glycoproteins displaying such sugars including but not limited to fetuin, orosomucoid and/or alkaline phosphatase) is provided herein (see Example 10 and FIGS. 18-21 herein). Given the importance of this domain to the function of ASGR-1, in some embodiments, it is desirable to target this domain with the antigen binding proteins of the present invention.

Accordingly, in some embodiments, the antigen binding proteins of the invention bind to the CBD of ASGR-1. In certain embodiments, the antigen binding proteins of the invention bind to the CBD of human ASGR-1. In certain embodiments, the antigen binding proteins of the invention bind to the CBD of SEQ ID NO:5. In some embodiments, the antigen binding proteins of the invention bind to amino acid residues selected from the group consisting of 148-291, 149-291, 150-291, 151-291, 152-291, 153-291, and 154-291 of SEQ ID NO:5. In some embodiments, the invention comprises an isolated antigen binding protein that binds to human ASGR-1 CBD within Helix α-1 or Helix α-2. In some embodiments, the invention comprises an isolated antigen binding protein that binds to human ASGR-1 CBD within residues 174-186 of SEQ ID NO:5. In some embodiments, the invention comprises an isolated antigen binding protein that binds to human ASGR-1 CBD within residues 194-206 of SEQ ID NO:5. In some embodiments, the invention comprises an isolated antigen binding protein that binds to human ASGR-1 CBD at the same or overlapping binding site as where a ligand binds (e.g., sugars including but not limited to lactose, galactose, and/or GalNAc or glycoproteins displaying such sugars including but not limited to fetuin, orosomucoid and/or alkaline phosphatase or other sugars and glycoproteins capable of binding to ASGR, ASGR-1, and/or ASGR-2). In some embodiments, the invention comprises an isolated antigen binding protein that binds to human ASGR-1 CBD within residues 237-273 or residues 240-267 of SEQ ID NO:5. In some embodiments, the antigen binding proteins of the invention bind to the CBD of cynomolgus ASGR-1. In some embodiments, the antigen binding proteins of the invention bind to the CBD of porcine ASGR-1. In some embodiments, the antigen binding proteins of the invention bind to the CBD of canine ASGR-1. In some embodiments, the antigen binding proteins of the invention bind to the CBD of murine ASGR-1. In yet some embodiments, the antigen binding proteins of the invention bind to the CBD of rat ASGR-1. In yet some embodiments, the antigen binding proteins of the invention bind to the CBD of two or more different ASGR-1 species, for example, but not limited to, human ASGR-1 and cynomolgus ASGR-1, or human ASGR-1, cynomolgus ASGR-1 and canine ASGR-1, or human ASGR-1 and murine ASGR-1.

In further embodiments, the antigen binding proteins of the invention bind to ASGR-1 and inhibit binding of ligand to ASGR-1. In a specific embodiment, the ligands that are inhibited include, but are not limited to, sugars including but not limited to lactose, galactose, and/or GalNAc or glycoproteins displaying such sugars including but not limited to fetuin, orosomucoid and/or alkaline phosphatase or other sugars and glycoproteins capable of binding to ASGR, ASGR-1, and/or ASGR-2.

The tyrosine at position 272 of murine ASGR-1 (position 273 of human ASGR-1 (SEQ ID NO:5)) appears to be important for protein stability, as it displays hydrogen bonding to D266 of murine ASGR-1 and several van der Waals contacts to other residues of murine ASGR-1 (N208, W210, H256, and R270). Additionally, by analogy with other lectins, Y272 of murine ASGR-1 may play a role in carbohydrate binding and function of ASGR-1. Accordingly, in some embodiments, the antigen binding proteins of the invention bind to or interact with Y273 of human ASGR-1. In some embodiments, the antigen binding proteins of the invention bind to ASGR-1 at an epitope that comprises Y273 of human ASGR-1. In some embodiments, the antigen binding proteins of the invention bind to ASGR-1 at an epitope that results in Y273 of human ASGR-1 being unable to take part in binding ligand.

Analysis of the crystal structure of hASGR-1 revealed specific amino acids that are involved in the interaction between hASGR-1 and the ligands (e.g., sugars including but not limited to lactose, galactose, and/or GalNAc or glycoproteins displaying such sugars including but not limited to fetuin, orosomucoid and/or alkaline phosphatase). Accordingly, in further embodiments, the antigen binding proteins of the invention bind to or interact with at least one of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least one of Q240, D242, W244, E253, N265, D266, D267, N209, R237, P238, E239, P241, D243, Y245, G246, H247, G252, C255, H257, T259, D260, V268, R271, Y273, F258, R263, or W264. In further embodiments, the antigen binding proteins of the invention bind to hASGR-1 and block or reduce the binding or interaction of at least one of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., sugars including but not limited to lactose, galactose, and/or GalNAc or glycoproteins displaying such sugars including but not limited to fetuin, orosomucoid and/or alkaline phosphatase).

In further embodiments, the antigen binding proteins of the invention bind to or interact with at least one of Q240, D242, W244, E253, N265, D266, D267, R237, P238, H257, T259, or Y273. In some embodiments, the antigen binding proteins of the invention bind at an epitope comprising at least one of Q240, D242, W244, E253, N265, D266, D267, R237, P238, H257, T259, or Y273. In further embodiments, the antigen binding proteins of the invention bind to hASGR-1 and block or reduce the binding or interaction of at least one of Q240, D242, W244, E253, N265, D266, D267, R237, P238, H257, T259, or Y273 with a ligand (e.g., sugars including but not limited to lactose, galactose, and/or GalNAc or glycoproteins displaying such sugars including but not limited to fetuin, orosomucoid and/or alkaline phosphatase).

In some embodiments, the antigen binding proteins of the invention bind to or interact with at least two of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least three of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least four of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least five of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least six of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least seven of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least eight of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least nine of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least ten of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least eleven of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least twelve of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least thirteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least fourteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least fifteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least sixteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least seventeen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least eighteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least nineteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least twenty of Q240, D242, W244, E253, N265, D266, D267, N209, R237, P238, E239, P241, D243, Y245, G246, H247, G252, C255, H257, T259, D260, V268, R271, Y273, F258, R263, or W264.

In some embodiments, the antigen binding proteins of the invention bind to or interact with at least two of Q240, D242, W244, E253, N265, D266, D267, R237, P238, H257, T259, or Y273. In some embodiments, the antigen binding proteins of the invention bind to or interact with at least three of Q240, D242, W244, E253, N265, D266, D267, R237, P238, H257, T259, or Y273. In some embodiments, the antigen binding proteins of the invention bind to or interact with at least four of Q240, D242, W244, E253, N265, D266, D267, R237, P238, H257, T259, or Y273. In some embodiments, the antigen binding proteins of the invention bind to or interact with at least five of Q240, D242, W244, E253, N265, D266, D267, R237, P238, H257, T259, or Y273. In some embodiments, the antigen binding proteins of the invention bind to or interact with at least six of Q240, D242, W244, E253, N265, D266, D267, R237, P238, H257, T259, or Y273. In some embodiments, the antigen binding proteins of the invention bind to or interact with at least seven of Q240, D242, W244, E253, N265, D266, D267, R237, P238, H257, T259, or Y273. In some embodiments, the antigen binding proteins of the invention bind to or interact with at least eight of Q240, D242, W244, E253, N265, D266, D267, R237, P238, H257, T259, or Y273. In some embodiments, the antigen binding proteins of the invention bind to or interact with at least nine of Q240, D242, W244, E253, N265, D266, D267, R237, P238, H257, T259, or Y273. In some embodiments, the antigen binding proteins of the invention bind to or interact with at least ten of Q240, D242, W244, E253, N265, D266, D267, R237, P238, H257, T259, or Y273. In some embodiments, the antigen binding proteins of the invention bind to or interact with at least eleven of Q240, D242, W244, E253, N265, D266, D267, R237, P238, H257, T259, or Y273. In some embodiments, the antigen binding proteins of the invention bind to or interact with at least all of Q240, D242, W244, E253, N265, D266, D267, R237, P238, H257, T259, or Y273.

In some embodiments, the antigen binding proteins of the invention bind at an epitope comprising at least two of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least three of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least four of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least five of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least six of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least seven of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least eight of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least nine of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least ten of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least eleven of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least twelve of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least thirteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least fourteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least fifteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least sixteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least seventeen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least eighteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least nineteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least twenty of Q240, D242, W244, E253, N265, D266, D267, N209, R237, P238, E239, P241, D243, Y245, G246, H247, G252, C255, H257, T259, D260, V268, R271, Y273, F258, R263, or W264.

In some embodiments, the antigen binding proteins of the invention bind at an epitope comprising at least two of Q240, D242, W244, E253, N265, D266, D267, R237, P238, H257, T259, or Y273. In some embodiments, the antigen binding proteins of the invention bind at an epitope comprising at least three of Q240, D242, W244, E253, N265, D266, D267, R237, P238, H257, T259, or Y273. In some embodiments, the antigen binding proteins of the invention bind at an epitope comprising at least four of Q240, D242, W244, E253, N265, D266, D267, R237, P238, H257, T259, or Y273. In some embodiments, the antigen binding proteins of the invention bind at an epitope comprising at least five of Q240, D242, W244, E253, N265, D266, D267, R237, P238, H257, T259, or Y273. In some embodiments, the antigen binding proteins of the invention bind at an epitope comprising at least six of Q240, D242, W244, E253, N265, D266, D267, R237, P238, H257, T259, or Y273. In some embodiments, the antigen binding proteins of the invention bind at an epitope comprising at least seven of Q240, D242, W244, E253, N265, D266, D267, R237, P238, H257, T259, or Y273. In some embodiments, the antigen binding proteins of the invention bind at an epitope comprising at least eight of Q240, D242, W244, E253, N265, D266, D267, R237, P238, H257, T259, or Y273. In some embodiments, the antigen binding proteins of the invention bind at an epitope comprising at least nine of Q240, D242, W244, E253, N265, D266, D267, R237, P238, H257, T259, or Y273. In some embodiments, the antigen binding proteins of the invention bind at an epitope comprising at least ten of Q240, D242, W244, E253, N265, D266, D267, R237, P238, H257, T259, or Y273. In some embodiments, the antigen binding proteins of the invention bind at an epitope comprising at least eleven of Q240, D242, W244, E253, N265, D266, D267, R237, P238, H257, T259, or Y273. In some embodiments, the antigen binding proteins of the invention bind at an epitope comprising all of Q240, D242, W244, E253, N265, D266, D267, R237, P238, H257, T259, or Y273.

In further embodiments, the antigen binding proteins of the invention bind to hASGR-1 and block or reduce the binding or interaction of at least two of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., sugars including but not limited to lactose, galactose, and/or GalNAc or glycoproteins displaying such sugars including but not limited to fetuin, orosomucoid and/or alkaline phosphatase). In further embodiments, the antigen binding proteins of the invention bind to hASGR-1 and block or reduce the binding or interaction of at least three of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., sugars including but not limited to lactose, galactose, and/or GalNAc or glycoproteins displaying such sugars including but not limited to fetuin, orosomucoid and/or alkaline phosphatase). In further embodiments, the antigen binding proteins of the invention bind to hASGR-1 and block or reduce the binding or interaction of at least four of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g, sugars including but not limited to lactose, galactose, and/or GalNAc or glycoproteins displaying such sugars including but not limited to fetuin, orosomucoid and/or alkaline phosphatase). In further embodiments, the antigen binding proteins of the invention bind to hASGR-1 and block or reduce the binding or interaction of at least five of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g, sugars including but not limited to lactose, galactose, and/or GalNAc or glycoproteins displaying such sugars including but not limited to fetuin, orosomucoid and/or alkaline phosphatase). In further embodiments, the antigen binding proteins of the invention bind to hASGR-1 and block or reduce the binding or interaction of at least six of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g, sugars including but not limited to lactose, galactose, and/or GalNAc or glycoproteins displaying such sugars including but not limited to fetuin, orosomucoid and/or alkaline phosphatase). In further embodiments, the antigen binding proteins of the invention bind to hASGR-1 and block or reduce the binding or interaction of at least seven of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., sugars including but not limited to lactose, galactose, and/or GalNAc or glycoproteins displaying such sugars including but not limited to fetuin, orosomucoid and/or alkaline phosphatase). In further embodiments, the antigen binding proteins of the invention bind to hASGR-1 and block or reduce the binding or interaction of at least eight of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g, sugars including but not limited to lactose, galactose, and/or GalNAc or glycoproteins displaying such sugars including but not limited to fetuin, orosomucoid and/or alkaline phosphatase). In further embodiments, the antigen binding proteins of the invention bind to hASGR-1 and block or reduce the binding or interaction of at least nine of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least ten of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least eleven of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least twelve of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least thirteen of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least fourteen of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least fifteen of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least sixteen of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least seventeen of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least eighteen of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least nineteen of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least twenty of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc).

In further embodiments, the antigen binding proteins of the invention bind to hASGR-1 and block or reduce the binding or interaction of at least two of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least three of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least four of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least five of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least six of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least seven of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least eight of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least nine of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least ten of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least eleven of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of all of Q240, D242, W244, E253, N265, D266, D267, R237, P238, H257, T259, or Y273 with a ligand (e.g., lactose, galactose and/or GalNAc).

In order to relate unique antigen binding protein sequence features to specific functions or binding characteristics, sequences from antigen binding proteins of the invention from various characterization bins can be analyzed. For example, antigen binding proteins of the invention can be tested for their ability to bind a variety of binning probes (e.g., membrane preps from cells expressing ASGR-1 from different species or soluble huASGR-1). For each unique binding bin, the heavy and light chain sequences from each of the antigen binding proteins can be compared and claded based on, for example: 1. the unique VDJ and VJ rearrangements; 2. divergence from germline (ie. unique somatic hypermutation); and 3. relatedness to other antigen binding proteins of the same bin. Accordingly, in certain embodiments, the antigen binding proteins comprising the same or similar sequence features and patterns, will have substantially the same or similar binding characteristics. In specific embodiments, these antigen binding proteins can bind to the same or similar epitope with varying affinities.

The exemplary antigen binding proteins described herein have properties based on the epitope on ASGR, ASGR-1 and/or ASGR-2 that is bound by the antigen binding protein. The term "epitope" includes any determinant capable of being bound by an antigen binding protein, such as an antibody. An epitope is a region of an antigen that is bound by, or interacts with, an antigen binding protein that targets that antigen, and when the antigen is a protein, includes specific amino acids that directly contact, or interact with, the antigen binding protein. An epitope can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or at least 4, and more usually, at least 5 or at least 6 or at least 7, for example, about 8 to about 10 amino acids in a unique sequence.

A "conformational epitope", in contrast to a linear epitope, is a group of discontinuous amino acids (e.g., in a polypeptide, amino acid residues that are not contiguous in the polypeptide's primary sequence but that, in the context of the polypeptide's tertiary and quaternary structure, are near enough to each other to be bound by an antigen binding protein). Epitope determinants can include chemically active surface groupings of molecules such as amino acids, sugar side chains, phosphoryl or sulfonyl groups, and can have specific three dimensional structural characteristics, and/or specific charge characteristics. Generally, antigen binding proteins specific for a particular target molecule will preferentially recognize an epitope on the target molecule in a complex mixture of proteins and/or macromolecules.

Methods of characterizing the epitope bound by an antigen binding protein are well known in the art, including, but not limited to, binning (competition and/or cross-competition) (Miller et al "Epitope binning of murine monoclonal antibodies by a multiplexed pairing assay" *J Immunol Methods* (2011) 365, 118-25), peptide mapping (e.g., PEPSPOT™) (Albert et al "The B-cell Epitope of the Monoclonal Anti-Factor VIII Antibody ESH8 Characterized by Peptide Array Analysis" 2008 *Thromb Haemost* 99, 634-7), mutagenesis methods such as chimeras (Song et al "Epitope Mapping of Ibalizumab, a Humanized Anti-CD4 Monoclonal Antibody with Anti-HIV-1 Activity in Infected Patients" *J. Virol.* (2010) 84, 6935-6942), alanine scanning (Cunningham and Wells "High-resolution epitope mapping of HGH-receptor interactions by alanine-scanning mutagenesis" *Science* (1989) 244, 1081-1085), arginine scanning (Lim et al "A diversity of antibody epitopes can induce signaling through the erythropoietin receptor" *Biochemistry* (2010) 49, 3797-3804), HD exchange methods (Coates et al "Epitope mapping by amide hydrogen/deuterium exchange coupled with immobilization of antibody, on-line proteolysis, liquid chromatography and mass spectrometry" *Rapid Commun. Mass Spectrom.* (2009) 23 639-647), NMR cross saturation methods (Morgan et al "Precise epitope mapping of malaria parasite inhibitory antibodies by TROSY NMR cross-saturation" *Biochemistry* (2005) 44, 518-23), and crystallography (Gerhardt et al "Structure of IL-17A in complex with a potent, fully human neutralizing antibody" *J. Mol. Biol* (2009) 394, 905-21). The methods vary in the level of detail they provide as to the amino acids comprising the epitope.

Antigen binding proteins of the present invention include those that have an identical or overlapping epitope with an exemplary antigen binding protein described in Tables 2-7. In some embodiments, the antigen binding protein has an identical epitope as to the exemplary antigen binding proteins. In other embodiments, the antigen binding protein binds only a subset of the same amino acids as the exemplary antigen binding protein. In some embodiments, antigen binding proteins that might bind to any of the epitopes that are bound by the antibodies listed in Tables A, B, C or 6 are especially useful.

In certain embodiments, the antigen binding proteins of the present invention have an identical or overlapping epitope to the antigen binding proteins in Table 2-7 and comprise a) a light chain variable domain having at least 90% identity, at least 95% identity, or is identical to the amino acid sequence of the antigen binding proteins described in Tables 2-7; b) a heavy chain variable domain having at least 90% identity, at least 95% identity, or is identical to the amino acid sequence of the antigen binding proteins set forth in Tables 2-7; or c) the light chain variable domain of a) and the heavy chain variable domain of b).

In certain embodiments, the antigen binding protein of the present invention has an identical or overlapping epitope to the antigen binding proteins selected from the group consisting of 25A4, 4H6, 4A2, 5E5, 7E11, 54E9, 22G5, 194A4, 218G4, 176H4 and 194C10 wherein the antigen binding protein comprises a light chain variable domain having at least 90% identity, at least 95% identity, or is identical to the amino acid sequence of 25A4 and a heavy chain variable domain having at least 90% identity, at least 95% identity, or is identical to the amino acid sequence of 25A4; those comprising a light chain variable domain having at least 90% identity, at least 95% identity, or is identical to the amino acid sequence of 4H6 and a heavy chain variable domain having at least 90% identity, at least 95% identity, or is identical to the amino acid sequence of 4H6; those comprising a light chain variable domain having at least 90% identity, at least 95% identity, or is identical to the amino acid sequence of 4A2 and a heavy chain variable domain having at least 90% identity, at least 95% identity, or is identical to the amino acid sequence of 4A2; those comprising a light chain variable domain having at least 90% identity, at least 95% identity, or is identical to the amino acid sequence of 5E5 and a heavy chain variable domain having at least 90% identity, at least 95% identity, or is identical to the amino acid sequence of 5E5; those comprising a light chain variable domain having at least 90% identity, at least 95% identity, or is identical to the amino acid sequence of 7E11 and a heavy chain variable domain having at least 90% identity, at least 95% identity, or is identical to the amino acid sequence of 7E11; those comprising a light chain variable domain having at least 90% identity, at least 95% identity, or is identical to the amino acid sequence of 54E9 and a heavy chain variable domain having at least 90% identity, at least 95% identity, or is identical to the amino acid sequence of 54E9; those comprising a light chain variable domain having at least 90% identity, at least 95% identity, or is identical to the amino acid sequence of 22G5 and a heavy chain variable domain having at least 90% identity, at least 95% identity, or is identical to the amino acid sequence of 22G5; those comprising a light chain variable domain having at least 90% identity, at least 95% identity, or is identical to the amino acid sequence of 194A4 and a heavy chain variable domain having at least 90% identity, at least 95% identity, or is identical to the amino acid sequence of 194A4; those comprising a light chain variable domain having at least 90% identity, at least 95% identity, or is identical to the amino acid sequence of 218G4G4 and a heavy chain variable domain having at least 90% identity, at least 95% identity, or is identical to the amino acid sequence of 218G4; those comprising a light chain variable domain having at least 90% identity, at least 95% identity, or is identical to the amino acid sequence of 176H4 and a heavy chain variable domain having at least 90% identity, at least 95% identity, or is identical to the amino acid sequence of 176H4; those comprising a light chain variable domain having at least 90% identity, at least 95% identity, or is identical to the amino acid sequence of 194C10 and a heavy chain variable domain having at least 90% identity, at least 95% identity, or is identical to the amino acid sequence of 194C10.

In certain embodiments, the ASGR-1 antigen binding protein of the invention has an identical or overlapping epitope as the antibodies in Tables 2-7, and comprises a light chain variable domain comprising an LCDR1 having no more than three amino acid additions, deletions, or substitutions from the LCDR1 sequence set forth in Table 2; an LCDR2 having no more than three amino acid additions, deletions, or substitutions from the LCDR2 sequence set forth in Table 2; and an LCDR3 having no more than three amino acid additions, deletions, or substitutions from the LCDR3 sequence set forth in Table 2; and a heavy chain variable domain comprising a) an HCDR1 having no more than three amino acid additions, deletions, or substitutions from the HCDR1 sequence set forth in Table 2; an HCDR2 having no more than three amino acid additions, deletions, or substitutions from the HCDR2 sequence set forth in Table 2; and an HCDR3 having no more than three amino acid additions, deletions, or substitutions from the HCDR3 sequence set forth in Table 2.

In certain embodiments, the ASGR-1 antigen binding protein of the invention has an identical or overlapping epitope as the antibodies in Tables A, B, C or 6, and comprises a light chain variable domain comprising an LCDR1 having no more than three amino acid additions, deletions, or substitutions from the LCDR1 sequence set forth in Tables A, B, C or 6; an LCDR2 having no more than three amino acid additions, deletions, or substitutions from the LCDR2 sequence set forth in Tables A, B, C or 6; and an LCDR3 having no more than three amino acid additions, deletions, or substitutions from the LCDR3 sequence set forth in Tables A, B, C or 6; and a heavy chain variable domain comprising a) an HCDR1 having no more than three amino acid additions, deletions, or substitutions from the HCDR1 sequence set forth in Tables A, B, C or 6; an HCDR2 having no more than three amino acid additions, deletions, or substitutions from the HCDR2 sequence set forth in Tables A, B, C or 6; and an HCDR3 having no more than three amino acid additions, deletions, or substitutions from the HCDR3 sequence set forth in Tables A, B, C or 6.

In certain embodiments, the ASGR-1 antigen binding protein of the invention has an identical or overlapping epitope as the antibody, 25A4, and comprises a light chain variable domain comprising an LCDR1 having no more than three amino acid additions, deletions, or substitutions from the LCDR1 sequence set forth in SEQ ID NO:480; an LCDR2 having no more than three amino acid additions, deletions, or substitutions from the LCDR2 sequence set forth in SEQ ID NO:8492; and an LCDR3 having no more than three amino acid additions, deletions, or substitutions from the LCDR3 sequence set forth in SEQ ID NO:16504; and a heavy chain variable domain comprising an HCDR1 having no more than three amino acid additions, deletions, or substitutions from the HCDR1 sequence set forth in SEQ ID NO:4488; an HCDR2 having no more than three amino acid additions, deletions, or substitutions from the HCDR2 sequence set forth in SEQ ID NO:12500; and an HCDR3 having no more than three amino acid additions, deletions, or substitutions from the HCDR3 sequence set forth in SEQ ID NO:20512.

In certain embodiments, the ASGR-1 antigen binding protein of the invention has an identical or overlapping epitope as the antibody, 4H6, and comprises a light chain variable domain comprising an LCDR1 having no more than three amino acid additions, deletions, or substitutions from the LCDR1 sequence set forth in SEQ ID NO:894; an LCDR2 having no more than three amino acid additions, deletions, or substitutions from the LCDR2 sequence set forth in SEQ ID NO:8906; and an LCDR3 having no more than three amino acid additions, deletions, or substitutions from the LCDR3 sequence set forth in SEQ ID NO:16918; and a heavy chain variable domain comprising an HCDR1 having no more than three amino acid additions, deletions, or substitutions from the HCDR1 sequence set forth in SEQ ID NO:4902; an HCDR2 having no more than three amino acid additions, deletions, or substitutions from the HCDR2 sequence set forth in SEQ ID NO:12914; and an HCDR3 having no more than three amino acid additions, deletions, or substitutions from the HCDR3 sequence set forth in SEQ ID NO:20926.

In certain embodiments, the ASGR-1 antigen binding protein of the invention has an identical or overlapping epitope as the antibody, 4A2, and comprises a light chain variable domain comprising an LCDR1 having no more than three amino acid additions, deletions, or substitutions from the LCDR1 sequence set forth in SEQ ID NO:1130; an LCDR2 having no more than three amino acid additions, deletions, or substitutions from the LCDR2 sequence set forth in SEQ ID NO:9142; and an LCDR3 having no more than three amino acid additions, deletions, or substitutions from the LCDR3 sequence set forth in SEQ ID NO:17154; and a heavy chain variable domain comprising an HCDR1 having no more than three amino acid additions, deletions, or substitutions from the HCDR1 sequence set forth in SEQ ID NO:5136; an HCDR2 having no more than three amino acid additions, deletions, or substitutions from the HCDR2 sequence set forth in SEQ ID NO:13148; and an HCDR3 having no more than three amino acid additions, deletions, or substitutions from the HCDR3 sequence set forth in SEQ ID NO:21160.

In certain embodiments, the ASGR-1 antigen binding protein of the invention has an identical or overlapping epitope as the antibody, 5E5, and comprises a light chain variable domain comprising an LCDR1 having no more than three amino acid additions, deletions, or substitutions from the LCDR1 sequence set forth in SEQ ID NO:974; an LCDR2 having no more than three amino acid additions, deletions, or substitutions from the LCDR2 sequence set forth in SEQ ID NO:8986; and an LCDR3 having no more than three amino acid additions, deletions, or substitutions from the LCDR3 sequence set forth in SEQ ID NO:16998; and a heavy chain variable domain comprising an HCDR1 having no more than three amino acid additions, deletions, or substitutions from the HCDR1 sequence set forth in SEQ ID NO:4982; an HCDR2 having no more than three amino acid additions, deletions, or substitutions from the HCDR2 sequence set forth in SEQ ID NO:12994; and an HCDR3 having no more than three amino acid additions, deletions, or substitutions from the HCDR3 sequence set forth in SEQ ID NO:21006.

In certain embodiments, the ASGR-1 antigen binding protein of the invention has an identical or overlapping epitope as the antibody, 7E11, and comprises a light chain variable domain comprising an LCDR1 having no more than three amino acid additions, deletions, or substitutions from the LCDR1 sequence set forth in SEQ ID NO:872; an LCDR2 having no more than three amino acid additions, deletions, or substitutions from the LCDR2 sequence set forth in SEQ ID NO:8884; and an LCDR3 having no more than three amino acid additions, deletions, or substitutions from the LCDR3 sequence set forth in SEQ ID NO:16896; and a heavy chain variable domain comprising an HCDR1 having no more than three amino acid additions, deletions, or substitutions from the HCDR1 sequence set forth in SEQ ID NO:4880; an HCDR2 having no more than three amino acid additions, deletions, or substitutions from the HCDR2 sequence set forth in SEQ ID NO:12892; and an HCDR3 having no more than three amino acid additions, deletions, or substitutions from the HCDR3 sequence set forth in SEQ ID NO:20904.

In certain embodiments, the ASGR-1 antigen binding protein of the invention has an identical or overlapping epitope as the antibody, 54E9, and comprises a light chain variable domain comprising an LCDR1 having no more than three amino acid additions, deletions, or substitutions from the LCDR1 sequence set forth in SEQ ID NO:3448; an LCDR2 having no more than three amino acid additions, deletions, or substitutions from the LCDR2 sequence set forth in SEQ ID NO:11460; and an LCDR3 having no more than three amino acid additions, deletions, or substitutions from the LCDR3 sequence set forth in SEQ ID NO:19472; and a heavy chain variable domain comprising an HCDR1 having no more than three amino acid additions, deletions, or substitutions from the HCDR1 sequence set forth in SEQ ID NO:7452; an HCDR2 having no more than three amino acid additions, deletions, or substitutions from the HCDR2 sequence set forth in SEQ ID NO:15464; and an HCDR3 having no more than three amino acid additions, deletions, or substitutions from the HCDR3 sequence set forth in SEQ ID NO:23476.

In certain embodiments, the ASGR-1 antigen binding protein of the invention has an identical or overlapping epitope as the antibody, 22G5, and comprises a light chain variable domain comprising an LCDR1 having no more than three amino acid additions, deletions, or substitutions from the LCDR1 sequence set forth in SEQ ID NO:326; an LCDR2 having no more than three amino acid additions, deletions, or substitutions from the LCDR2 sequence set forth in SEQ ID NO:8338; and an LCDR3 having no more than three amino acid additions, deletions, or substitutions from the LCDR3 sequence set forth in SEQ ID NO:16350; and a heavy chain variable domain comprising an HCDR1 having no more than three amino acid additions, deletions, or substitutions from the HCDR1 sequence set forth in SEQ ID NO:4334; an HCDR2 having no more than three amino acid additions, deletions, or substitutions from the HCDR2 sequence set forth in SEQ ID NO:12346; and an HCDR3 having no more than three amino acid additions, deletions, or substitutions from the HCDR3 sequence set forth in SEQ ID NO:20358.

In certain embodiments, the ASGR-1 antigen binding protein of the invention has an identical or overlapping epitope as the antibody, 194A4, and comprises a light chain variable domain comprising an LCDR1 having no more than three amino acid additions, deletions, or substitutions from the LCDR1 sequence set forth in SEQ ID NO:2780; an LCDR2 having no more than three amino acid additions, deletions, or substitutions from the LCDR2 sequence set forth in SEQ ID NO:10792; and an LCDR3 having no more than three amino acid additions, deletions, or substitutions from the LCDR3 sequence set forth in SEQ ID NO:18804; and a heavy chain variable domain comprising an HCDR1 having no more than three amino acid additions, deletions, or substitutions from the HCDR1 sequence set forth in SEQ ID NO:6786; an HCDR2 having no more than three amino acid additions, deletions, or substitutions from the HCDR2 sequence set forth in SEQ ID NO:14798; and an HCDR3 having no more than three amino acid additions, deletions, or substitutions from the HCDR3 sequence set forth in SEQ ID NO:22810.

In certain embodiments, the ASGR-1 antigen binding protein of the invention has an identical or overlapping epitope as the antibody, 218G4, and comprises a light chain variable domain comprising an LCDR1 having no more than three amino acid additions, deletions, or substitutions from the LCDR1 sequence set forth in SEQ ID NO:3746; an LCDR2 having no more than three amino acid additions, deletions, or substitutions from the LCDR2 sequence set forth in SEQ ID NO:11758; and an LCDR3 having no more than three amino acid additions, deletions, or substitutions from the LCDR3 sequence set forth in SEQ ID NO:19770; and a heavy chain variable domain comprising an HCDR1 having no more than three amino acid additions, deletions, or substitutions from the HCDR1 sequence set forth in SEQ ID NO:7750; an HCDR2 having no more than three amino acid additions, deletions, or substitutions from the HCDR2 sequence set forth in SEQ ID NO:15762; and an HCDR3 having no more than three amino acid additions, deletions, or substitutions from the HCDR3 sequence set forth in SEQ ID NO:23774.

In certain embodiments, the ASGR-1 antigen binding protein of the invention has an identical or overlapping epitope as the antibody, 176H4, and comprises a light chain variable domain comprising an LCDR1 having no more than three amino acid additions, deletions, or substitutions from the LCDR1 sequence set forth in SEQ ID NO:2502; an LCDR2 having no more than three amino acid additions, deletions, or substitutions from the LCDR2 sequence set forth in SEQ ID NO:10514; and an LCDR3 having no more than three amino acid additions, deletions, or substitutions from the LCDR3 sequence set forth in SEQ ID NO:18526; and a heavy chain variable domain comprising an HCDR1 having no more than three amino acid additions, deletions, or substitutions from the HCDR1 sequence set forth in SEQ ID NO:6508; an HCDR2 having no more than three amino acid additions, deletions, or substitutions from the HCDR2 sequence set forth in SEQ ID NO:14520; and an HCDR3 having no more than three amino acid additions, deletions, or substitutions from the HCDR3 sequence set forth in SEQ ID NO:22532.

In certain embodiments, the ASGR-1 antigen binding protein of the invention has an identical or overlapping epitope as the antibody, 194C10, and comprises a light chain variable domain comprising an LCDR1 having no more than three amino acid additions, deletions, or substitutions from the LCDR1 sequence set forth in SEQ ID NO:2792; an LCDR2 having no more than three amino acid additions, deletions, or substitutions from the LCDR2 sequence set forth in SEQ ID NO:10804; and an LCDR3 having no more than three amino acid additions, deletions, or substitutions from the LCDR3 sequence set forth in SEQ ID NO:18816; and a heavy chain variable domain comprising an HCDR1 having no more than three amino acid additions, deletions, or substitutions from the HCDR1 sequence set forth in SEQ ID NO:6798; an HCDR2 having no more than three amino acid additions, deletions, or substitutions from the HCDR2 sequence set forth in SEQ ID NO:14810; and an HCDR3 having no more than three amino acid additions, deletions, or substitutions from the HCDR3 sequence set forth in SEQ ID NO:22822.

Antigen binding proteins that have an identical or overlapping epitope will often compete for binding to the antigen, ASGR, ASGR1 and/or ASGR2. Thus, in certain embodiments, an antigen binding protein (e.g., antibody or antibody fragment thereof) of the invention competes with the antigen binding proteins described in Tables 2-7. In some embodiments, an antigen binding protein (e.g., antibody or antibody fragment thereof) of the invention competes with the antigen binding proteins described in Tables A, B and C. In some embodiments, an antigen binding protein (e.g., antibody or antibody fragment thereof) of the invention competes with the antigen binding proteins described in Table 6. To "compete" or "competition" means the antigen binding proteins compete for the same epitope or binding site on a target. Such competition can be determined by an assay in which the reference antigen binding protein (e.g., antibody or antibody fragment thereof) prevents or inhibits specific binding of a test antigen binding protein. Numerous types of competitive binding assays can be used to determine if a test molecule competes with a reference molecule for binding. Examples of assays that can be employed include solid phase direct or indirect radioimmunoassay (RIA), solid phase direct or indirect enzyme immunoassay (EIA), sandwich competition assay (see, e.g., Stahli et al. (1983) *Methods in Enzymology* 9:242-253), solid phase direct biotin-avidin EIA (see, e.g., Kirkland et al., (1986) *J. Immunol.* 137:3614-3619), solid phase direct labeled assay, solid phase direct labeled sandwich assay, Luminex (Jia et al "A novel method of Multiplexed Competitive Antibody Binning for the characterization of monoclonal antibodies" *J. Immunological Methods* (2004) 288, 91-98) and surface plasmon resonance ((Song et al "Epitope Mapping of Ibalizumab, a Humanized Anti-CD4 Monoclonal Antibody with Anti-HIV-1 Activity in Infected Patients" *J. Virol.* (2010) 84, 6935-6942). An exemplary method of determining competition is described in Example 7D. Usually, when a competing antigen binding protein is present in excess, it will inhibit binding of a reference antigen binding protein to a common antigen by at least 50%, 55%, 60%, 65%, 70%, or 75%. In some instances, binding to ASGR-1 is inhibited by at least 80%, 85%, 90%, 95%, 96%, 97%, 98%, 99%, or more.

Besides competition, antigen binding proteins (e.g., antibodies or antibody fragments thereof) with identical, overlapping, or similar epitopes may be affected by mutagenesis of ASGR, ASGR-1 and/or ASGR-2 similarly. In brief, the domain(s)/region(s) containing residues that are in contact with or are buried by an antibody can be identified by mutating specific residues in ASGR, ASGR-1 and/or ASGR-2 (e.g., a wild-type antigen) and determining whether the antigen binding protein can bind the mutated or variant ASGR, ASGR-1 and/or ASGR-2 protein. By making a number of individual mutations, residues that play a direct role in binding or that are in sufficiently close proximity to the antibody such that a mutation can affect binding between the antigen binding protein and antigen can be identified. From the knowledge of these amino acids, the domain(s) or region(s) of the antigen that contain residues in contact with the antigen binding protein or covered by the antibody can be elucidated. Such a domain can include the binding epitope of an antigen binding protein. As mentioned above, one specific example of this general approach utilizes an arginine/glutamic acid scanning protocol (see, e.g., Nanevicz, T., et al., 1995, *J. Biol. Chem.*, 270:37, 21619-21625 and Zupnick, A., et al., 2006, *J. Biol. Chem.*, 281:29, 20464-20473). In general, arginine and glutamic acids are substituted (typically individually) for an amino acid in the wild-type polypeptide because these amino acids are charged and bulky and thus have the potential to disrupt binding between an antigen binding protein and an antigen in the region of the antigen where the mutation is introduced.

Arginine residues that exist in the wild-type antigen are replaced with glutamic acid. A variety of such individual mutants are obtained and the collected binding results analyzed to determine what residues affect binding. In Example 7E, scanning arginine/glutamic acid mutagenesis was performed using the human ASGR-1 CBD domain and the effect on exemplary antibodies was determined. Included with the scope of the invention are ASGR, ASGR-1 and/or ASGR-2 antigen binding proteins having characteristics such that they are affected in a similar way as an exemplary antibody to mutagenesis.

Example 7E describes one such arginine/glutamic acid scanning of ASGR-1 for ASGR-1 antigen binding proteins provided herein. A series of mutant ASGR-1 antigens were created, with each mutant antigen having a single mutation. Binding of each mutant ASGR-1 antigen with various ASGR-1 antigen binding proteins was measured and compared to the ability of the selected antigen binding proteins to bind to human ASGR-1 (SEQ ID NO:5). In certain embodiments, binding of an antigen binding protein of the present invention to ASGR-1 is inhibited by a single mutation in ASGR-1, wherein the single mutation is selected from the group consisting of R170, S171, G172, R183, L184, W195, E196, K199, H203, H204, P207, V208, N209, H215, D216, P220, D225, D228, R237, P238, E239, P241, D242, D243, Y245, G246, H247, G248, L249, G251, E253, T259, D260, R263, N265, Q270, R271, P272, R274, and E280 as shown in SEQ ID NO:5. In some embodiments, the ASGR-1 antigen binding proteins share the attributes of antibody 4A2 and their binding to ASGR-1 is inhibited a mutation of any of W195, E196, K199, H204, P207, and R263. In some embodiments, the ASGR-1 antigen binding proteins share the attributes of antibody 4B3 and their binding to ASGR-1 is inhibited by a mutation of any of H203, H204, P220, and G251. In some embodiments, the ASGR-1 antigen binding proteins share the attributes of antibody 5E5 and their binding to ASGR-1 is inhibited by a mutation of any of W195, K199, and R263. In some embodiments, the ASGR-1 antigen binding proteins share the attributes of antibody 6G7 and their binding to ASGR-1 is inhibited by a mutation of any of R183, L184, H215, P220, P238, G246, H247, G248, G251, and N265. In some embodiments, the ASGR-1 antigen binding proteins share the attributes of antibody 149D11 and their binding is inhibited by a mutation of any of R170, S171, and L184. In some embodiments, the ASGR-1 antigen binding proteins share the attributes of antibody 175F4 and their binding is inhibited by a mutation of R183. In some embodiments, the ASGR-1 antigen binding proteins share the attributes of antibody 17H6 and their binding is inhibited by a mutation of any of P241, D242, D243, Y245, G251, and E253. In some embodiments, the ASGR-1 antigen binding proteins share the attributes of antibody 194A4 and their binding is inhibited by a mutation of D260. In some embodiments, the ASGR-1 antigen binding proteins share the attributes of antibody 60C12 and their binding is inhibited by a mutation of any of R170, R237, E239, P241, T259, D260, R263, and N265. In some embodiments, the ASGR-1 antigen binding proteins share the attributes of antibody 65D5 and their binding is inhibited by a mutation of any of R237, T259, D260 and R263. In some embodiments, the ASGR-1 antigen binding proteins share the attributes of antibody 190F8 or 191G1 and their binding is inhibited by a mutation of any of R170, S171, G172, E196, H204, P207, V208, N209, H215, D216, D225, D228, P238, D243, G248, L249, G251, D260, Q270, R271, P272, R274 and E280. In some embodiments, the ASGR-1 antigen binding proteins share the attributes of antibody 199A7 and their binding is inhibited by a mutation of any of R170, R183, H215 and Q270. In some embodiments, the ASGR-1 antigen binding proteins share the attributes of antibody 146B6 and their binding is inhibited by a mutation of any of P241, T259, and N265. In some embodiments, the ASGR-1 antigen binding proteins share the attributes of antibody 193E7 and their binding is inhibited by a mutation of any of P207 and R263. In some embodiments, any of two or more, three or more, four or more, five or more, six or more, seven or more, eight or more nine or more, ten or more, or all of the single mutations of the aforementioned groups individually inhibit binding of the ASGR-1 antigen binding protein to ASGR-1.

Binding of various anti-ASGR-1 antigen binding proteins (e.g., antibodies 5E5, 22G5, 7E11, 4A2, 4H6, 72G9, 194A4, 54E9, 218G4, 176H4 and 194C10) were further analyzed using X-ray crystallography. The results from the X-ray crystallography were highly correlated with the results from the Arginine/Glutamic acid mutagenesis profiling described above and in Example 7E. The interface between an antigen binding protein and the antigen can be determined/defined a number of ways. In Examples 10B-L, the interface was determined by selecting interface residues having at least one atom within a predefined distance to its partner protein. In some embodiments, ASGR-1 residues that are within the interface with antibody, 5E5, as determined by distance of 8 Å or less are: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, or W264 (SEQ ID NO:5). In some embodiments, ASGR-1 residues that are within the interface with antibody, 5E5, as determined by distance of 5 Å or less are: H161, E162, W195, E196, Q198, K199, F200, Q202, H203, H204, G232, F233, K234, N235, W236, R237, P238, D261, G262, or R263 (SEQ ID NO:5). In certain embodiments, the ASGR-1 antigen binding protein forms an interface with ASGR-1 that overlaps with that of antibody 5E5, including those wherein any of: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, or W264 (SEQ ID NO:5) are within the interface. In certain embodiments, the ASGR-1 antigen binding protein forms an interface with ASGR-1 that overlaps with that of antibody 5E5, including those wherein any of: H161, E162, W195, E196, Q198, K199, F200, Q202, H203, H204, G232, F233, K234, N235, W236, R237, or P238 (SEQ ID NO:5) are within the interface.

In some embodiments, ASGR-1 residues that are within the interface with antibody, 22G5, as determined by distance of 8 Å or less are: W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, or T279 (SEQ ID NO:5). In some embodiments, ASGR-1 residues that are within the interface with antibody, 22G5, as determined by distance of 5 Å or less are: W167, S171, G172, K173, A174, A176, D177, N180, Y181, R183, L184, E185, D186, Q270, P272, or W275 (SEQ ID NO:5). In certain embodiments, the ASGR-1 antigen binding protein forms an interface with ASGR-1 that overlaps with that of antibody 5E5, including those wherein any of: W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, or T279 (SEQ ID NO:5) are within the interface. In certain embodiments, the ASGR-1 antigen binding protein forms an interface with ASGR-1 that overlaps with that of antibody 5E5, including those wherein any of: W167, S171, G172, K173, A174, A176, D177, N180, Y181, R183, L184, E185, D186, Q270, P272, or W275 (SEQ ID NO:5) are within the interface.

In some embodiments, ASGR-1 residues that are within the interface with antibody, 4A2, as determined by distance of 8 Å or less are: R170, W195, E196, K199, Q202, H203, H204, I205, G206, P207, V208, F233, K234, N235, W236, P238, D260, D261, G262, R263, R274, P155, N157, W158, F168, S169, R170, W175, A178, D179, C182, A187, W211, C269, R271, Y273, R274, C277, or T279 (SEQ ID NO:5). In some embodiments, ASGR-1 residues that are within the interface with antibody, 4A2, as determined by distance of 5 Å or less are: R170, W195, E196, K199, Q202, H203, H204, I205, G206, P207, V208, F233, K234, N235, W236, P238, D260, D261, G262, R263, or R274 (SEQ ID NO:5). In certain embodiments, the ASGR-1 antigen binding protein forms an interface with ASGR-1 that overlaps with that of antibody 4A2, including those wherein any of: R170, W195, E196, K199, Q202, H203, H204, I205, G206, P207, V208, F233, K234, N235, W236, P238, D260, D261, G262, R263, R274, P155, N157, W158, F168, S169, R170, W175, A178, D179, C182, A187, W211, C269, R271, Y273, R274, C277, or T279 (SEQ ID NO:5) are within the interface. In certain embodiments, the ASGR-1 antigen binding protein forms an interface with ASGR-1 that overlaps with that of antibody 4A2, including those wherein any of: R170, W195, E196, K199, Q202, H203, H204, I205, G206, P207, V208, F233, K234, N235, W236, P238, D260, D261, G262, R263, R274 (SEQ ID NO:5) are within the interface.

In some embodiments, ASGR-1 residues that are within the interface with antibody, 7E11, as determined by distance of 8 Å or less are: H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, or W264 (SEQ ID NO:5). In some embodiments, ASGR-1 residues that are within the interface with antibody, 7E11, as determined by distance of 5 Å or less are: H161, S194, W195, E196, Q198, K199, F200, Q202, H203, F233, K234, N235, W236, R237, P238, or R263 (SEQ ID NO:5). In certain embodiments, the ASGR-1 antigen binding protein forms an interface with ASGR-1 that overlaps with that of antibody 7E11, including those wherein any of: H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, or W264 (SEQ ID NO:5) are within the interface. In certain embodiments, the ASGR-1 antigen binding protein forms an interface with ASGR-1 that overlaps with that of antibody 7E11, including those wherein any of are within the surface: H161, S194, W195, E196, Q198, K199, F200, Q202, H203, F233, K234, N235, W236, R237, P238, or R263 (SEQ ID NO:5) are within the interface.

In some embodiments, ASGR-1 residues that are within the interface with antibody, 4H6, as determined by distance of 8 Å or less are: H161, E162, T193, S194, W195, E196, K199, Q202, T231, G232, F233, K234, N235, P238, D261, R263, R163, V192, E197, Q198, H203, P207, D228, E230, W236, R237, D260, G262, or W264 (SEQ ID NO:5). In some embodiments, ASGR-1 residues that are within the interface with antibody, 4H6, as determined by distance of 5 Å or less are: H161, E162, T193, S194, W195, E196, K199, Q202, T231, G232, F233, K234, N235, P238, D261, or R263 (SEQ ID NO:5). In certain embodiments, the ASGR-1 antigen binding protein forms an interface with ASGR-1 that overlaps with that of antibody 4H6, including those wherein any of: H161, E162, T193, S194, W195, E196, K199, Q202, T231, G232, F233, K234, N235, P238, D261, R263, R163, V192, E197, Q198, H203, P207, D228, E230, W236, R237, D260, G262, or W264 (SEQ ID NO:5) are within the interface. In certain embodiments, the ASGR-1 antigen binding protein forms an interface with ASGR-1 that overlaps with that of antibody 4H6, including those wherein any of are within the surface: H161, E162, T193, S194, W195, E196, K199, Q202, T231, G232, F233, K234, N235, P238, D261, or R263 (SEQ ID NO:5) are within the interface.

In some embodiments, ASGR-1 residues that are within the interface with antibody, 72G9, as determined by distance of 8 Å or less are: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, or C269 (SEQ ID NO:5). In some embodiments, ASGR-1 residues that are within the interface with antibody, 72G9, as determined by distance of 5 Å or less are: D216, Q217, N218, G219, P220, W221, Y229, E230, K234, W236, E239, Q240, P241, D242, D243, W244, Y245, G246, L249, G250, G251, G252, D254, or Q270 (SEQ ID NO:5). In certain embodiments, the ASGR-1 antigen binding protein forms an interface with ASGR-1 that overlaps with that of antibody 72G9, including those wherein any of: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269 (SEQ ID NO:5) are within the interface. In certain embodiments, the ASGR-1 antigen binding protein forms an interface with ASGR-1 that overlaps with that of antibody 72G9, including those wherein any of: D216, Q217, N218, G219, P220, W221, Y229, E230, K234, W236, E239, Q240, P241, D242, D243, W244, Y245, G246, L249, G250, G251, G252, D254, or Q270 (SEQ ID NO:5) are within the interface.

In some embodiments, ASGR-1 residues that are within the interface with antibody, 194A4, as determined by distance of 8 Å or less are: T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, or W264 (SEQ ID NO:5). In some embodiments, ASGR-1 residues that are within the interface with antibody, 194A4, as determined by distance of 5 Å or less are: T193, S194, W195, E196, P220, W221, G226, T227, D228, Y229, E230, T231, G232, F233, K234, N235, W236, R237, P238, E239, or G252 (SEQ ID NO:5). In certain embodiments, the ASGR-1 antigen binding protein forms an interface with ASGR-1 that overlaps with that of antibody 194A4, including those wherein any of: T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, or W264 (SEQ ID NO:5) are within the interface. In certain embodiments, the ASGR-1 antigen binding protein forms an interface with ASGR-1 that overlaps with that of antibody 194A4, including those wherein any of are within the surface: T193, S194, W195, E196, P220, W221, G226, T227, D228, Y229, E230, T231, G232, F233, K234, N235, W236, R237, P238, E239, or G252 (SEQ ID NO:5) within the interface.

In some embodiments, ASGR-1 residues that are within the interface with antibody, 194C10, as determined by distance of 8 Å or less are: N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270 or W275 (SEQ ID NO:5). In some embodiments, ASGR-1 residues that are within the interface with antibody, 194C10, as determined by distance of 5 Å or less are: N157, R170, S171, G172, Q202, H203, H204, I205, G206, P207, V208, N209, T210, D260, R271, P272, Y273 or R274 (SEQ ID NO:5). In certain embodiments, the ASGR-1 antigen binding protein forms an interface with ASGR-1 that overlaps with that of antibody 194C10, including those wherein any of: N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5) are within the interface. In certain embodiments, the ASGR-1 antigen binding protein forms an interface with ASGR-1 that overlaps with that of antibody 194C10, including those wherein any of: N157, R170, S171, G172, Q202, H203, H204, I205, G206, P207, V208, N209, T210, D260, R271, P272, Y273, or R274 (SEQ ID NO:5) are within the interface.

In some embodiments, ASGR-1 residues that are within the interface with antibody, 54E9, as determined by distance of 8 Å or less are: W195, N209, N235, R237, P238, E239, Q240, D242, H257, T259, D260, D261, R263, N265, D267, R271, Y273, Q198, Q202, P207, V208, F233, W236, D243, E253, F258, G262, W264, or D266 (SEQ ID NO:5). In some embodiments, ASGR-1 residues that are within the interface with antibody, 54E9, as determined by distance of 5 Å or less are: W195, N209, N235, R237, P238, E239, Q240, D242, H257, T259, D260, D261, R263, N265, D267, R271, or Y273 (SEQ ID NO:5). In certain embodiments, the ASGR-1 antigen binding protein forms an interface with ASGR-1 that overlaps with that of antibody 54E9, including those wherein any of: W195, N209, N235, R237, P238, E239, Q240, D242, H257, T259, D260, D261, R263, N265, D267, R271, Y273, Q198, Q202, P207, V208, F233, W236, D243, E253, F258, G262, W264, or D266 (SEQ ID NO:5) are within the interface. In certain embodiments, the ASGR-1 antigen binding protein forms an interface with ASGR-1 that overlaps with that of antibody 54E9, including those wherein any of: W195, N209, N235, R237, P238, E239, Q240, D242, H257, T259, D260, D261, R263, N265, D267, R271, or Y273 (SEQ ID NO:5) are within the interface.

In some embodiments, ASGR-1 residues that are within the interface with antibody, 218G4, as determined by distance of 8 Å or less are: R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, or W275 (SEQ ID NO:5). In some embodiments, ASGR-1 residues that are within the interface with antibody, 218G4, as determined by distance of 5 Å or less are: R170, S171, G172, A174, H204, I205, G206, P207, V208, N209, H257, D260, N265, D267, Q270, R271, P272, Y273, or R274 (SEQ ID NO:5). In certain embodiments, the ASGR-1 antigen binding protein forms an interface with ASGR-1 that overlaps with that of antibody 218G4, including those wherein any of: R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, or W275 (SEQ ID NO:5) are within the interface. In certain embodiments, the ASGR-1 antigen binding protein forms an interface with ASGR-1 that overlaps with that of antibody 218G4, including those wherein any of: R170, S171, G172, K173, A174, D177, P207, V208, N209, R237, Q240, W244, G246, H247, G248, L249, E253, H257, T259, D260, N265, D267, Q270, R271, P272, Y273 or R274 (SEQ ID NO:5) are within the interface.

In some embodiments, ASGR-1 residues that are within the interface with antibody, 176H4, as determined by distance of 8 Å or less are: R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments, ASGR-1 residues that are within the interface with antibody, 176H4, as determined by distance of 5 Å or less are: R170, S171, G172, K173, A174, D177, P207, V208, N209, R237, Q240, W244, G246, H247, G248, L249, E253, H257, T259, D260, N265, D267, Q270, R271, P272, Y273 or R274 (SEQ ID NO:5). In certain embodiments, the ASGR-1 antigen binding protein forms an interface with ASGR-1 that overlaps with that of antibody 176H4, including those wherein any of: R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275 (SEQ ID NO:5) are within the interface. In certain embodiments, the ASGR-1 antigen binding protein forms an interface with ASGR-1 that overlaps with that of antibody 176H4, including those wherein any of: R170, S171, G172, K173, A174, D177, P207, V208, N209, R237, Q240, W244, G246, H247, G248, L249, E253, H257, T259, D260, N265, D267, Q270, R271, P272, Y273, R274 (SEQ ID NO:5) are within the interface.

In some embodiments, the ASGR-1 residues that are involved in ligand binding are also in close proximity to the areas where antibodies 72G9, 54E9, 218G4 or 176H4 bind and can be useful for manipulating ASGR-1 binding to ligand. In some embodiments, the ASGR-1 antigen binding protein forms an interface with ASGR-1 that overlaps with that of antibody 72G9 and the ligand (e.g., GalNAc), including those wherein any of Q240, D242, W244, E239, P241, D243, Y245, G246, G252, R237, E253, P238, H247, C255, or V268 (SEQ ID NO:5) are within the interface. In some embodiments, the ASGR-1 antigen binding protein forms an interface with ASGR-1 that overlaps with that of antibody 72G9 and the ligand (e.g., GalNAc), including those wherein any of Q240, D242, or W244 (SEQ ID NO:5) are within the interface. In some embodiments, the ASGR-1 antigen binding protein forms an interface with ASGR-1 that overlaps with that of antibody 72G9 and the ligand (e.g., GalNAc), including those wherein any of Q240, D242, W244, E239, P241, D243, Y245, G246 or G252 (SEQ ID NO:5) are within the interface. In some embodiments, the ASGR-1 antigen binding protein forms an interface with ASGR-1 that overlaps with that of antibody 72G9 and the ligand (e.g., GalNAc), including those wherein any of Q240, D242, W244, R237 or E253 (SEQ ID NO:5) are within the interface. As noted in the examples below, the extent of inhibition resulting from 72G9 is lower than other direct blocking antibodies provided herein. While not intended to be limiting, this is understood to occur due to the nature of the relative orientations of the ASGR-1 protein and the antibody when bound to one another. For example, when the 72G9 antibody is bound to ASGR-1, there is still sufficient space for a ligand to reach the binding site, to some (although lesser) extent. In some embodiments, the ASGR-1 antigen binding protein forms an interface with ASGR-1 that overlaps with that of antibody 54E9 and the ligand (e.g., GalNAc), including those wherein any of N209, R237, Q240, D242, H257, T259, N265, D267, Y273, P238, E239, D260, R263, R271, E253, D266, D243, F258, or W264 (SEQ ID NO:5) are within the interface. In some embodiments, the ASGR-1 antigen binding protein forms an interface with ASGR-1 that overlaps with that of antibody 54E9 and the ligand (e.g., GalNAc), including those wherein any of N209, R237, Q240, D242, H257, T259, N265, D267, or Y273 (SEQ ID NO:5) are within the interface. In some embodiments, the ASGR-1 antigen binding protein forms an interface with ASGR-1 that overlaps with that of antibody 54E9 and the ligand (e.g., GalNAc), including those wherein any of N209, R237, Q240, D242, H257, T259, N265, D267, Y273, P238, E239, D260, R263, or R271 (SEQ ID NO:5) are within the interface. In some embodiments, the ASGR-1 antigen binding protein forms an interface with ASGR-1 that overlaps with that of antibody 54E9 and the ligand (e.g., GalNAc), including those wherein any of N209, R237, Q240, D242, H257, T259, N265, D267, Y273, E253 or D266 (SEQ ID NO:5) are within the interface. In some embodiments, the ASGR-1 antigen binding protein forms an interface with ASGR-1 that overlaps with that of antibody 218G4 and the ligand (e.g., GalNAc), including those wherein any of N209, H257, N265, D267, Y273, D260, R271, R237, T259, D266, F258 or V268 (SEQ ID NO:5) are within the interface. In some embodiments, the ASGR-1 antigen binding protein forms an interface with ASGR-1 that overlaps with that of antibody 218G4 and the ligand (e.g., GalNAc), including those wherein any of N209, H257, N265, D267, or Y273 (SEQ ID NO:5) are within the interface. In some embodiments, the ASGR-1 antigen binding protein forms an interface with ASGR-1 that overlaps with that of antibody 218G4 and the ligand (e.g., GalNAc), including those wherein any of N209, H257, N265, D267, Y273, D260 or R271 (SEQ ID NO:5) are within the interface. In some embodiments, the ASGR-1 antigen binding protein forms an interface with ASGR-1 that overlaps with that of antibody 218G4 and the ligand (e.g., GalNAc), including those wherein any of N209, H257, N265, D267, Y273. R237, T259 or D266 (SEQ ID NO:5) are within the interface. In some embodiments, the ASGR-1 antigen binding protein forms an interface with ASGR-1 that overlaps with that of antibody 176H4 and the ligand (e.g., GalNAc), including those wherein any of N209, R237, Q240, W244, E253, H257, T259, N265, D267, Y273, G246, H247, D260, R271, D266, P238, E239, Y245, F258, R263, W264, or V268 (SEQ ID NO:5) are within the interface. In some embodiments, the ASGR-1 antigen binding protein forms an interface with ASGR-1 that overlaps with that of antibody 176H4 and the ligand (e.g., GalNAc), including those wherein any of N209, R237, Q240, W244, E253, H257, T259, N265, D267, or Y273 (SEQ ID NO:5) are within the interface. In some embodiments, the ASGR-1 antigen binding protein forms an interface with ASGR-1 that overlaps with that of antibody 176H4 and the ligand (e.g., GalNAc), including those wherein any of N209, R237, Q240, W244, E253, H257, T259, N265, D267, Y273, G246, H247, D260, or R271 (SEQ ID NO:5) are within the interface. In some embodiments, the ASGR-1 antigen binding protein forms an interface with ASGR-1 that overlaps with that of antibody 176H4 and the ligand (e.g., GalNAc), including those wherein any of N209, R237, Q240, W244, E253, H257, T259, N265, D267, Y273, or D266 (SEQ ID NO:5) are within the interface.

As discussed above, the binding interaction between huASGR-1 and ligand (e.g., lactose, galactose, GalNAc), as well as the binding interaction between huASGR-1 and various embodiments of the antigen binding proteins (e.g., antibodies) of the present invention was evaluated using x-ray crystallography as described in Example 10. The binding interaction between huASGR-1 and various embodiments of the antigen binding proteins (e.g., antibodies) of the present invention was also evaluated using methodologies, including epitope binning as described in Example 7D, and arginine/glutamic acid mutational profiling as described in Example 7E. A summary of the data obtained through these methodologies is set forth in Table D below. This summary illustrates the various binding characteristics of representative antigen binding proteins (e.g., antibodies) of the present invention and their ability to directly and/or indirectly inhibit ligand binding to huASGR-1. In some embodiments, antibodies that interact with residues in common across different ligands can result in a similar form of inhibition (direct) across the various ligands. Examples of such residues are underlined and in bold in Table D.

TABLE D

Summary of Binding Characteristics of Representative Antigen Binding Proteins Derived from Examples 7 and 10.

| Ligand/mAb Name | mAb Epitope (bin) | Interaction Site (crystal structure <5 angstroms) | Interaction Site (crystal structure 5-8 angstroms) | R/E scan |
|---|---|---|---|---|
| Ligand/ Lactose | ND | Q240, D242, W244, E253, N265, D266, D267 | N209, R237, P238, E239, P241, D243, Y245, G246, H247, G252, C255, H257, T259, D260, V268, R271, Y273 | ND |
| Ligand/ Galactose | ND | R237, D240, D242, W244, E253, N265, D266, D267 | N209, P238, E239, P241, D243, Y245, G246, H247, G252, C255, H257, T259, V268, R271, Y273 | ND |
| Ligand/ GalNAc | ND | N209, R237, D240, D242, W244, E253, H257, T259, N265, D266, D267, Y273 | P238, E239, P241, D243, Y245, G246, H247, G252, C255, F258, D260, R263, W264, V268, R271 | ND |

TABLE D-continued

Summary of Binding Characteristics of Representative Antigen Binding Proteins Derived from Examples 7 and 10.

| Ligand/mAb Name | mAb Epitope (bin) | Interaction Site (crystal structure <5 angstroms) | Interaction Site (crystal structure 5-8 angstroms) | R/E scan |
|---|---|---|---|---|
| 5E5 - Interaction is representative of indirect inhibition of ligand binding | A | H161, E162, W195, E196, Q198, K199, F200, Q202, H203, H204, G232, F233, K234, N235, W236, R237, P238, D261, G262, R263 | V159, E160, R163, T193, S194, E197, V201, I205, G206, P207, Y229, E230, T231, E239, F258, T259, D260, W264 | W195, K199 |
| 4A2 - Interaction is representative of indirect inhibition of ligand binding | A | R170, W195, E196, K199, Q202, H203, H204, I205, G206, P207, V208, F233, K234, N235, W236, P238, D260, D261, G262, R263, R274 | N157, V159, F168, S169, S171, S194, Q198, F200, V201, T210, R237, E239, Q240, F258, T259, W264 | W195 |
| 7E11 - Interaction is representative of indirect inhibition of ligand binding | A | H161, S194, W195, E196, Q198, K199, F200, Q202, H203, F233, K234, N235, W236, R237, P238, R263 | E160, E162, V192, T193, E197, V201, H204, Y229, E230, T231, G232, E239, Q240, P241, D261, G262, W264 | W195 |
| 4H6 - Interaction is representative of indirect inhibition of ligand binding | A | H161, E162, T193, S194, W195, E196, K199, Q202, T231, G232, F233, K234, N235, P238, D261, R263 | R163, V192, E197, Q198, H203, P207, D228, E230, W236, R237, D260, G262, W264 | ND |
| 22G5 - Interaction is representative of indirect inhibition of ligand binding | B | W167, S171, G172, K173, A174, A176, D177, N180, Y181, R183, L184, E185, D186, Q270, P272, W275 | P155, N157, W158, F168, S169, R170, W175, A178, D179, C182, A187, W211, C269, R271, Y273, R274, C277, T279 | R183, L184, H215, P220, G246, G248, G251, N265 |
| 194A4 - Interaction is representative of indirect inhibition of ligand binding | C | T193, S194, W195, E196, P220, W221, G226, T227, D228, Y229, E230, T231, G232, F233, K234, N235, W236, R237, P238, E239, G252 | H161, E162, V191, V192, E197, Q198, D216, G219, K222, W223, D225, R263, W264 | D260 |
| 72G9 - Interaction is representative of direct inhibition of ligand binding | C | D216, Q217, N218, G219, P220, W221, Y229, E230, K234, W236, E239, Q240, P241, D242, D243, W244, Y245, G246, L249, G250, G251, G252, D254, Q270 | H215, K222, T231, G232, R237, P238, H247, G248, E253, C255, D266, V268, C269 | P241, D242, D243, Y245, G251, E253 |
| 54E9 - Interaction is representative of direct inhibition of ligand binding | E | W195, N209, N235, R237, P238, E239, Q240, D242, H257, T259, D260, D261, R263, N265, D267, R271, Y273 | Q198, Q202, P207, V208, F233, W236, D243, E253, F258, G262, W264, D266 | R237, E239, P241, T259, D260, R263, N265 |
| 218G4 - Interaction is representative of direct inhibition of ligand binding | L/O | R170, S171, G172, A174, H204, I205, G206, P207, V208, N209, H257, D260, N265, D267, Q270, R271, P272, Y273, R274 | W167, F168, S169, K173, W175, D177, Y181, Q202, H203, T210, W211, R237, F258, T259, D261, D266, V268, C269, W275 | R171, G172, P238, R274 |
| 176H4 - Interaction is representative of direct inhibition of ligand binding | L/R | R170, S171, G172, K173, A174, D177, P207, V208, N209, R237, Q240, W244, G246, H247, G248, L249, E253, H257, T259, D260, N265, D267, Q270, R271, P272, Y273, R274 | S169, W175, A176, A178, T210, W211, W236, P238, E239, D242, Y245, G250, G251, F258, D261, G262, R263, W264, D266, V268, C269, W275 | G172, P241, D242, H247, L249, N265, R271, P272 |

TABLE D-continued

Summary of Binding Characteristics of Representative Antigen Binding Proteins Derived from Examples 7 and 10.

| Ligand/mAb Name | mAb Epitope (bin) | Interaction Site (crystal structure <5 angstroms) | Interaction Site (crystal structure 5-8 angstroms) | R/E scan |
|---|---|---|---|---|
| 194C10 - Interaction is representative of direct and/or indirect inhibition of ligand binding | L/T | N157, R170, S171, G172, Q202, H203, H204, I205, G206, P207, V208, N209, T210, D260, R271, P272, Y273, R274 | V156, W158, V159, H161, W167, F168, S169, K173, K199, F200, V201, W211, R237, H257, F258, T259, D261, D267, V268, Q270, W275 | R170, G172, V208, R274 |

In some embodiments, the antibody can directly inhibit ASGR-1 CBD/Ligand binding. While described herein in greater detail, and while not intended to be limiting by theory, such an interaction can denote that the antibody interacts with the section of ASGR-1 CBD that binds to its ligand directly, such that a paratope or other section of an antigen binding protein (e.g., antibody) directly obstructs the ligand's access to the binding site in ASGR1 CBD. An antigen binding protein or antibody can be designated as a direct inhibitor when it has one or more of the characteristics of the direct inhibitors provided herein, including the examples below (such as example 10, or the crystal structures referenced therein). Some examples of direct inhibition are shown by 72G9, 54E9, 218G4 and 176H4 and are indicated in Table D. In some embodiments, a direct inhibitor can bind to one or more of residues 237-273 or residues 240-267 of SEQ ID NO:5 of ASGR-1.

In some embodiments, the antigen binding protein or antibody can indirectly inhibit ASGR-1 CBD/Ligand binding. While described herein in greater detail, and while not intended to be limiting by theory, this denotes that the antigen binding protein or antibody binds to ASGR-1 CBD, but need not directly obstruct the ligand's access to the binding site in ASGR-1 CBD. An antigen binding protein or antibody can be designated as an indirect inhibitor when it has one or more of the characteristics of the indirect inhibitors provided herein, including the examples below (such as example 10 or the crystal structures provided therein). Some examples of indirect inhibition are shown by 5E5, 4A2, 7E11, 4H6, 22G5, 194A4, and are indicated in Table D. While not limiting, it is noted that indirect inhibition can occur from a variety of interactions or rearrangements. For example, indirect inhibition may occur from a conformational rearrangement of the carbohydrate binding loop occurs which could impair the carbohydrate binding loop from binding to/interacting with ligand (i.e., carbohydrates). In some embodiments, an indirect inhibitor can bind to one or more of the residues in ASGR-1 CBD helix alpha 1 and/or helix alpha 2. In some embodiments, the antibody binds to ASGR-1 and results in the disordering of the CBD.

In some embodiments, an antigen binding protein or antibody can have characteristics of both direct and indirect inhibition and/or bind to areas on ASGR-1 CBD that are common to both types of inhibition. Of course, such an embodiment may have sufficient inhibition capability through its direct, indirect, or both direct and indirect interactions.

In some embodiments, the distinction between direct and indirect inhibition need not be made. In some embodiments, denoting that an antigen binding protein or antibody provides direct or indirect inhibition means that it provides at least that form of inhibition (e.g., ASGR-1 CBD/Ligand blocking). In some embodiments, an antigen binding protein or antibody that provides direct inhibition, may also provide indirect aspects as well (such as other conformational changes). In addition, as shown in Table D, as the interaction between ASGR-1 CBD and its ligands can vary for each of the noted three ligands, what may be a direct or indirect interaction for one ligand, need not be direct or indirect for another. While the antibodies provided herein that have the properties of direct and/or indirect inhibition will function accordingly, and the guidance provided herein allows for one to screen for and produce additional such antibodies, the fact that an antibody simply binds to ASGR-1 CBD does not necessarily mean that it will bind at the relevant locations on ASGR-1 to allow for direct or indirect inhibition.

In some embodiments, an isolated antigen binding protein that binds to human ASGR and inhibits ASGR function is provided. In one embodiment, the invention comprises an isolated antigen binding protein that binds to human ASGR and inhibits ASGR binding to ligand. In another embodiment, the invention comprises an isolated antigen binding protein that binds to human ASGR-1 and inhibits ASGR-1 binding to ligand and/or ASGR-1 interaction with ASGR-2. In another embodiment, the invention comprises an isolated antigen binding protein that binds to human ASGR-2 and inhibits ASGR-2 binding to ligand and/or ASGR-2 interaction with ASGR-1. In yet another embodiment, the invention comprises an isolated antigen binding protein that binds to human ASGR-1 and human ASGR-2, and inhibits ASGR-1 and/or ASGR-2 binding to ligand. In some embodiments, the isolated binding protein binds specifically to human ASGR, ASGR-1 and/or ASGR-2.

In some embodiments, an isolated antigen binding protein is provided, wherein the isolated antigen binding protein binds to human ASGR-1 and comprises one or more VH CDR1, VH CDR2 or VH CDR3 having an amino acid sequence identical to or comprising 1, 2, or 3 amino acid residue substitutions, deletions or insertions in each CDR relative to the VH of any of the sequences set forth in Tables 3-7. In some embodiments, the invention comprises an isolated antigen binding protein, wherein the isolated antigen binding protein binds to human ASGR-1 and comprises one or more VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises one or more VH CDR1, VH CDR2 or VH CDR3 having an amino acid sequence identical to or comprising 1, 2, or 3 amino acid residue substitutions, deletions or insertions in each CDR relative to the VH of any of the sequences set forth in Tables 3-7, and one or more VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises one VH CDR1, VH CDR2 or VH CDR3 having an amino acid sequence identical to or comprising 1, 2, or 3 amino acid residue substitutions, deletions or insertions in each CDR relative to the VH of any of the sequences set forth in Tables 3-7, and one VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises two VH CDR1, VH CDR2 or VH CDR3 having an amino acid sequence identical to or comprising 1, 2, or 3 amino acid residue substitutions, deletions or insertions in each CDR relative to the VH of any of the sequences set forth in Tables 3-7, and two VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises the VH CDR1, VH CDR2 and VH CDR3 having an amino acid sequence identical to or comprising 1, 2, or 3 amino acid residue substitutions, deletions or insertions in each CDR relative to the VH of any of the sequences set forth in Tables 3-7, and the VL CDR1, VL CDR2 and VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises the VH CDR1, VH CDR2, VH CDR3, VL CDR1, VL CDR2, and VL CDR3 having an amino acid sequence identical to any of the sequences set forth in Tables 3-7. In some embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in TABLE A. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in TABLE A. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in TABLE A, and the VL CDR1, VL CDR2 and VL CDR3, having an amino acid sequence identical to or comprising 1, 2, or 3 amino acid residue substitutions, deletions or insertions in each CDR relative to the VL of any of the sequences set forth in TABLE A. In some embodiments, the isolated antigen binding protein comprises the VH CDR1, VH CDR2, VH CDR3, VL CDR1, VL CDR2, and VL CDR3 having an amino acid sequence identical to any of the sequences set forth in TABLE A. In some embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in TABLE B. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in TABLE B. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in TABLE B, and the VL CDR1, VL CDR2 and VL CDR3 having an amino acid sequence identical to or comprising 1, 2, or 3 amino acid residue substitutions, deletions or insertions in each CDR relative to the VL of any of the sequences set forth in TABLE B. In some embodiments, the isolated antigen binding protein comprises the VH CDR1, VH CDR2, VH CDR3, VL CDR1, VL CDR2, and VL CDR3 having an amino acid sequence identical to any of the sequences set forth in TABLE B. In still some embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in TABLE C. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in TABLE C. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in TABLE C, and the VL CDR1, VL CDR2 and VL CDR3, having an amino acid sequence identical to or comprising 1, 2, or 3 amino acid residue substitutions, deletions or insertions in each CDR relative to the VL of any of the sequences set forth in TABLE C. In some embodiments, the isolated antigen binding protein comprises the VH CDR1, VH CDR2, VH CDR3, VL CDR1, VL CDR2, and VL CDR3 having an amino acid sequence identical to any of the sequences set forth in TABLE C. In further embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in Table 6. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in Table 6. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in Table 6, and the VL CDR1, VL CDR2 and VL CDR3, having an amino acid sequence identical to or comprising 1, 2, or 3 amino acid residue substitutions, deletions or insertions in each CDR relative to the VL of any of the sequences set forth in Table 6. In some embodiments, the isolated antigen binding protein comprises the VH CDR1, VH CDR2, VH CDR3, VL CDR1, VL CDR2, and VL CDR3 having an amino acid sequence identical to any of the sequences set forth in Table 6.

In some embodiments, an isolated antigen binding protein is provided, wherein the antigen binding protein specifically binds human ASGR-1 and comprises a heavy chain variable domain having at least 90% identity to any of the VH domain amino acid sequences set forth in Tables 3-7. In some aspects, the invention provides an isolated antigen binding protein, wherein the antigen binding protein specifically binds human ASGR-1 and comprises a light chain variable domain having at least 90% identity to any of the VL domain amino acid sequences set forth in Tables 3-7. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Tables 3-7, and a light chain variable domain having at least 90% identity to any of the VL domain amino acid sequences set forth in Tables 3-7. In some embodiments, the invention provides an isolated antigen binding protein, wherein the antigen binding protein specifically binds human ASGR-1 and comprises a heavy chain variable domain having any of the VH domain amino acid sequences set forth in Tables 3-7, and a light chain variable domain having any of the VL domain amino acid sequences set forth in Tables 3-7. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table A. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table A. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table A, and a light chain variable domain having at least 90% identity to any of the VL domain amino acid sequences set forth in Table A. In some embodiments, the invention provides an isolated antigen binding protein, wherein the antigen binding protein specifically binds human ASGR-1 and comprises a heavy chain variable domain having any of the VH domain amino acid sequences set forth in Table A, and a light chain variable domain having any of the VL domain amino acid sequences set forth in Table A. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table B. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table B. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table B, and a light chain variable domain having at least 90% identity to any of the VL domain amino acid sequences set forth in Table B. In some embodiments, the invention provides an isolated antigen binding protein, wherein the antigen binding protein specifically binds human ASGR-1 and comprises a heavy chain variable domain having any of the VH domain amino acid sequences set forth in Table B, and a light chain variable domain having any of the VL domain amino acid sequences set forth in Table B. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table C. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table C. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table C, and a light chain variable domain having at least 90% identity to any of the VL domain amino acid sequences set forth in Table C. In some embodiments, the invention provides an isolated antigen binding protein, wherein the antigen binding protein specifically binds human ASGR-1 and comprises a heavy chain variable domain having any of the VH domain amino acid sequences set forth in Table C, and a light chain variable domain having any of the VL domain amino acid sequences set forth in Table C. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table 6. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table 6. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table 6, and a light chain variable domain having at least 90% identity to any of the VL domain amino acid sequences set forth in Table 6. In some embodiments, the invention provides an isolated antigen binding protein, wherein the antigen binding protein specifically binds human ASGR-1 and comprises a heavy chain variable domain having any of the VH domain amino acid sequences set forth in Table 6, and a light chain variable domain having any of the VL domain amino acid sequences set forth in Table 6.

In some embodiments, an isolated antigen binding protein is provided, wherein the antigen binding protein binds human ASGR-1 and comprises one or more VH CDR1, VH CDR2 or VH CDR3 having an amino acid sequence identical to or comprising no more than 18 amino acid residue substitutions, insertions or deletions in each CDR relative to the VH of any of the sequences set forth in Table 19A as depicted in FIG. 55. In some embodiments, the invention provides an isolated antigen binding protein, wherein the antigen binding protein binds human ASGR-1 and comprises one or more VH CDR1, VH CDR2 or VH CDR3 having an amino acid sequence identical to or comprising a conservative substitution of any of the amino acid sequences set forth in Tables 19B or 19C, as depicted in FIG. 55. In some aspects, the invention comprises an isolated antigen binding protein, wherein the isolated antigen binding protein binds to human ASGR-1 and comprises one or more VL CDR1, VL CDR2 or VL CDR3 having an amino acid sequence identical to or comprising no more than 14 amino acid residue substitutions, insertions or deletions in each CDR relative to the VL of any of the sequences set forth in Table 20A as depicted in FIG. 55. In some embodiments, the invention provides an isolated antigen binding protein, wherein the antigen binding protein binds human ASGR-1 and comprises one or more VL CDR1, VL CDR2 or VL CDR3 having an amino acid sequence identical to or comprising a conservative substitution of any of the amino acid sequences set forth in Tables 20B or 20C, as depicted in FIG. 55. In some embodiments, the isolated antigen binding protein comprises one or more VH CDR1, VH CDR2 or VH CDR3 having an amino acid sequence identical to or comprising no more than 18amino acid residue substitutions, insertions or deletions in each CDR relative to the VH of any of the sequences set forth in Table 19A, as depicted in FIG. 55, and one or more VL CDR1, VL CDR2 or VL CDR3 having an amino acid sequence identical to or comprising no more than 14amino acid residue substitutions, insertions or deletions in each CDR relative to the VL of any of the sequences set forth in Table 20A as depicted in FIG. 55. In some embodiments, the invention provides an isolated antigen binding protein, wherein the antigen binding protein binds human ASGR-1 and comprises one or more VH CDR1, VH CDR2 or VH CDR3 having an amino acid sequence identical to or comprising a conservative substitution of any of the amino acid sequences set forth in Tables 19B or 19C, as depicted in FIG. 55, and one or more VL CDR1, VL CDR2 or VL CDR3 having an amino acid sequence identical to or comprising a conservative substitution of any of the amino acid sequences set forth in Tables 20B or 20C, as depicted in FIG. 55. In some embodiments, the isolated antigen binding protein comprises one VH CDR1, VH CDR2 or VH CDR3 having an amino acid sequence identical no more than 18 amino acid residue substitutions, insertions or deletions in each CDR relative to the VH of any of the sequences set forth in Table 19A, as depicted in FIG. 55, and one VL CDR1, VL CDR2 or VL CDR3 having an amino acid sequence identical to or comprising no more than 14amino acid residue substitutions, insertions or deletions in each CDR relative to the VL of any of the sequences set forth in Table 20A as depicted in FIG. 55. In some embodiments, the invention provides an isolated antigen binding protein, wherein the antigen binding protein binds human ASGR-1 and comprises one VH CDR1, VH CDR2 or VH CDR3 having an amino acid sequence identical to or comprising a conservative substitution of any of the amino acid sequences set forth in Tables 19B or 19C, as depicted in FIG. 55, and one VL CDR1, VL CDR2 or VL CDR3 having an amino acid sequence identical to or comprising a conservative substitution of any of the amino acid sequences set forth in Tables 20B or 20C, as depicted in FIG. 55. In some embodiments, the isolated antigen binding protein comprises two VH CDR1, VH CDR2 or VH CDR3 having an amino acid sequence identical to or comprising up to 18 amino acid residue substitutions, insertions or deletions in each CDR relative to the VH of any of the sequences set forth in Table 19A, as depicted in FIG. 55, and two VL CDR1, VL CDR2 or VL CDR3 having an amino acid sequence identical to or comprising up to 14amino acid residue substitutions, insertions or deletions in each CDR relative to the VL of any of the sequences set forth in Table 20A, as depicted in FIG. 55. In some embodiments, the invention provides an isolated antigen binding protein, wherein the antigen binding protein binds human ASGR-1 and comprises two VH CDR1, VH CDR2 or VH CDR3 having an amino acid sequence identical to or comprising a conservative substitution of any of the amino acid sequences set forth in Tables 19B or 19C, as depicted in FIG. 55, and two VL CDR1, VL CDR2 or VL CDR3 having an amino acid sequence identical to or comprising a conservative substitution of any of the amino acid sequences set forth in Tables 20B or 20C, as depicted in FIG. 55. In some embodiments, the isolated antigen binding protein comprises the VH CDR1, VH CDR2 and VH CDR3 having an amino acid sequence identical to or comprising up to 18amino acid residue substitutions, insertions or deletions in each CDR relative to the VH of any of the sequences set forth in Table 19A, as depicted in FIG. 55, and the VL CDR1, VL CDR2 and VL CDR3 having an amino acid sequence identical to or comprising up to 14amino acid residue substitutions, insertions or deletions in each CDR relative to the VL of any of the sequences set forth in Table 20A, as depicted in FIG. 55. In some embodiments, the invention provides an isolated antigen binding protein, wherein the antigen binding protein binds human ASGR-1 and comprises the VH CDR1, VH CDR2 or VH CDR3 having an amino acid sequence identical to or comprising a conservative substitution of any of the amino acid sequences set forth in Tables 19B or 19C, as depicted in FIG. 55, and the VL CDR1, VL CDR2 or VL CDR3 having an amino acid sequence identical to or comprising a conservative substitution of any of the amino acid sequences set forth in Tables 20B or 20C, as depicted in FIG. 55.

Figure 56:
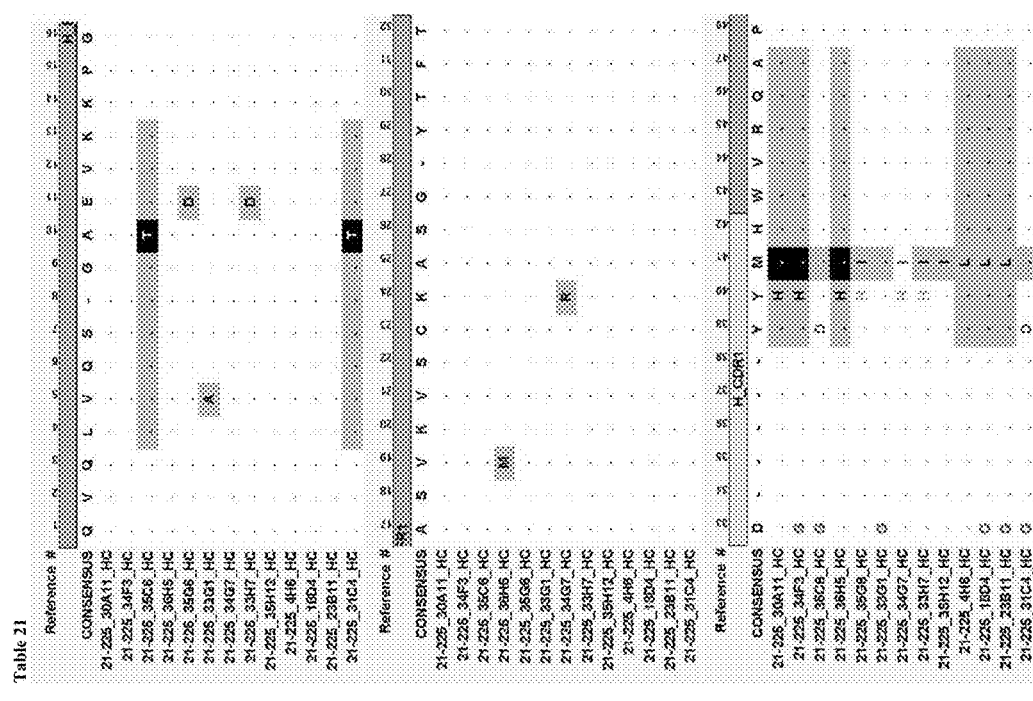
FIG. 56. A group of tables presenting the detailed consensus protein alignment of various light and heavy chain variable regions for certain antigen binding proteins of the present invention (Tables 21-48). The shading of amino acid residues in the consensus protein alignment presented in Tables 21-48 denote particular residues that one of ordinary skill in the art may wish to target for engineering.
Figure 56:
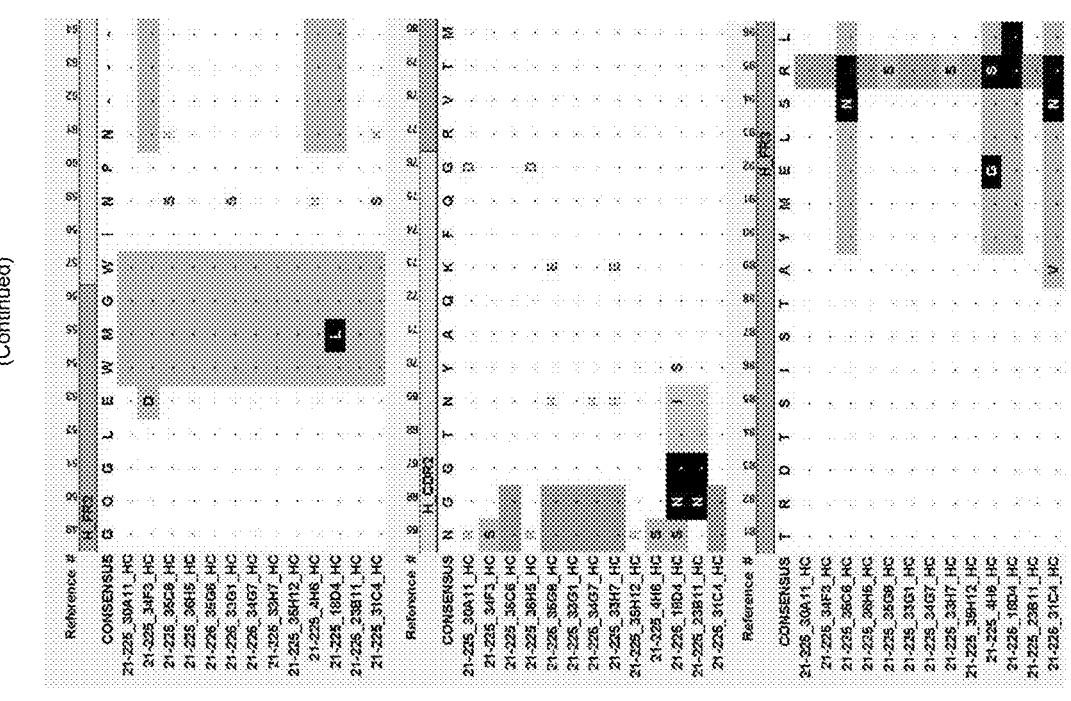
Figure 56:
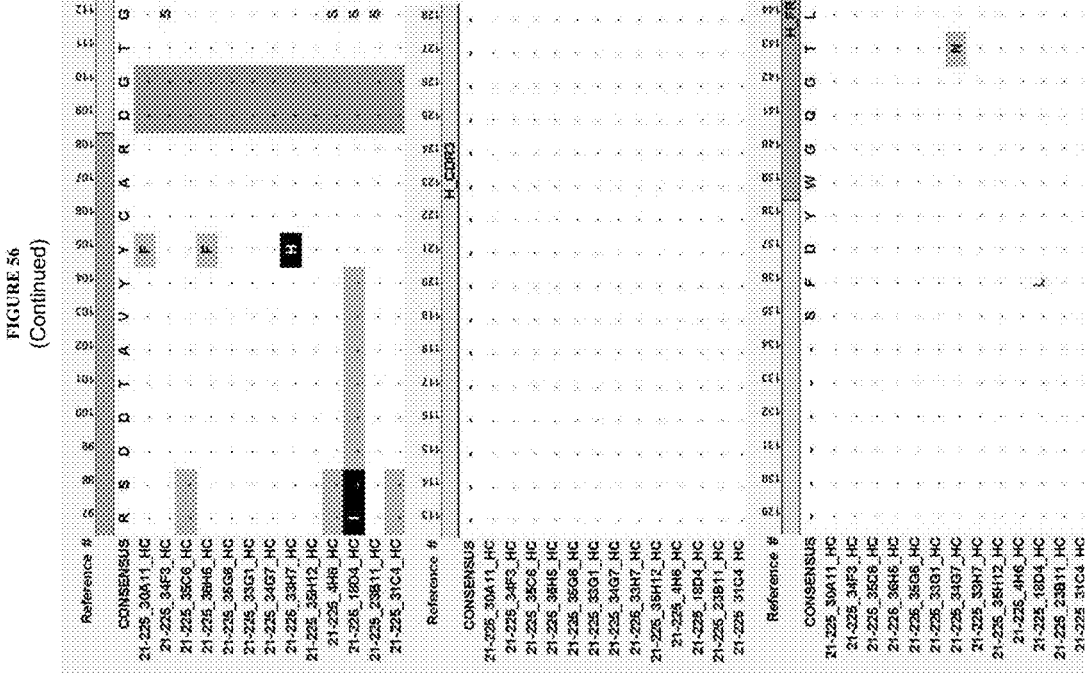
Figure 56:
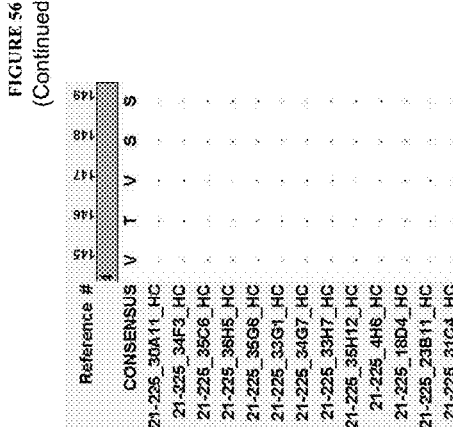
Figure 56:
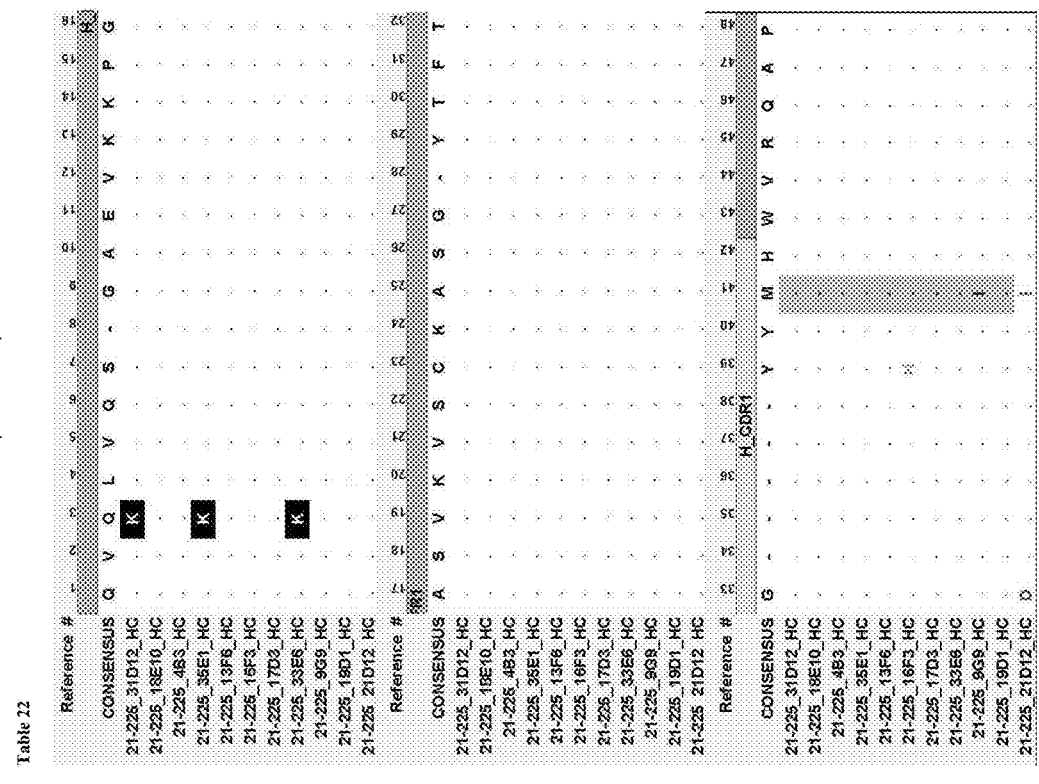
Figure 56:
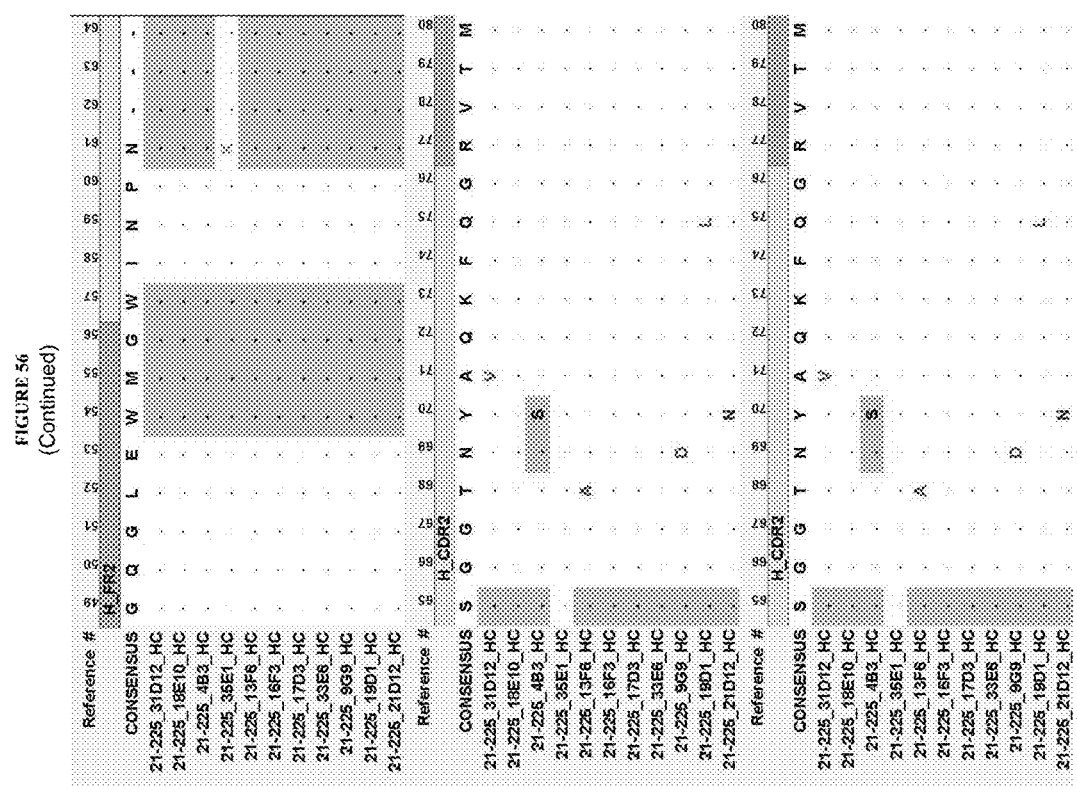
Figure 56:
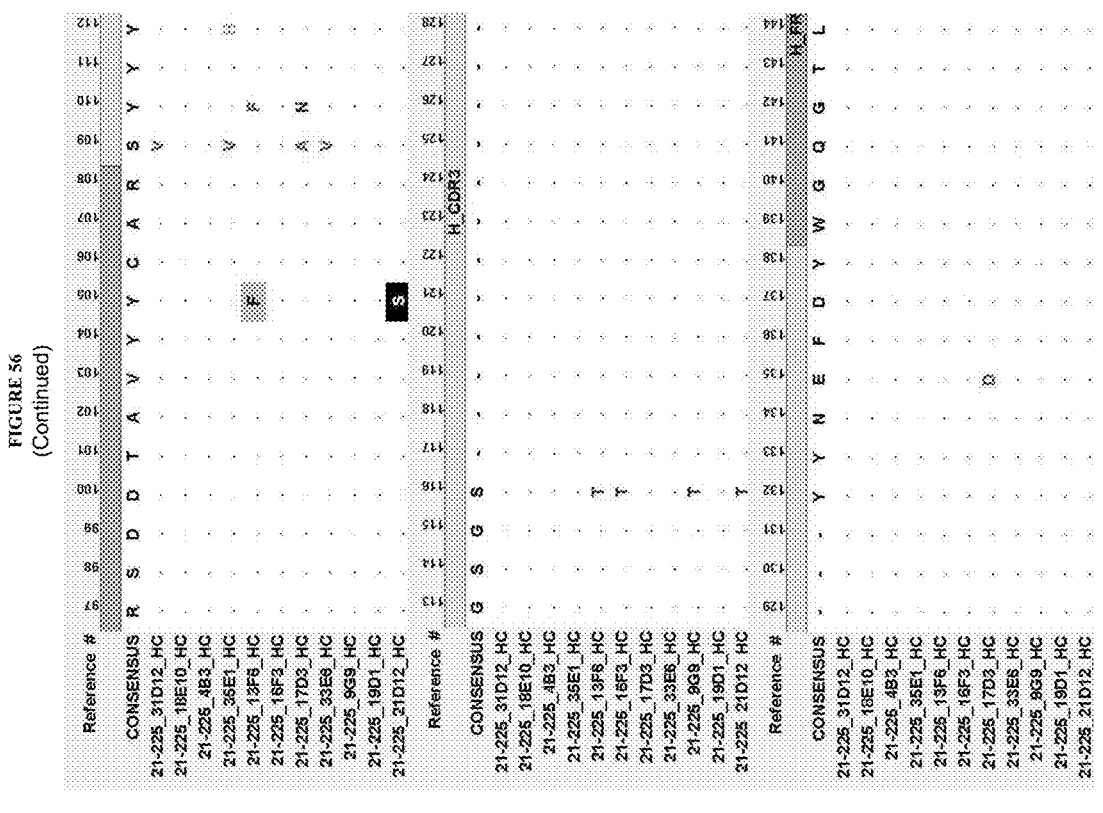
Figure 56:
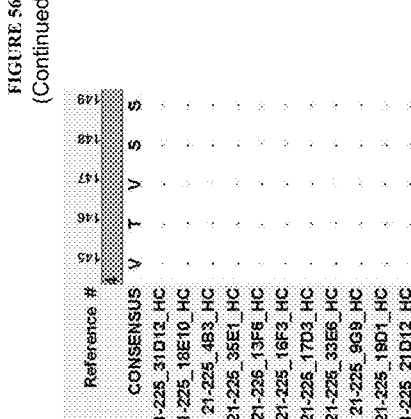
Figure 56:
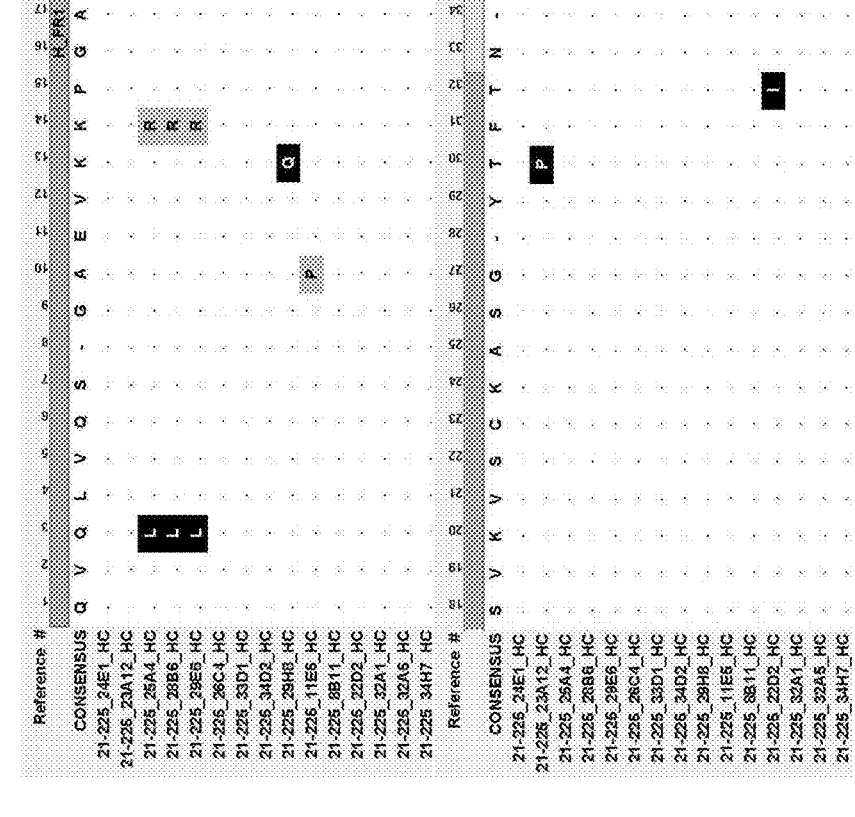
Figure 56:
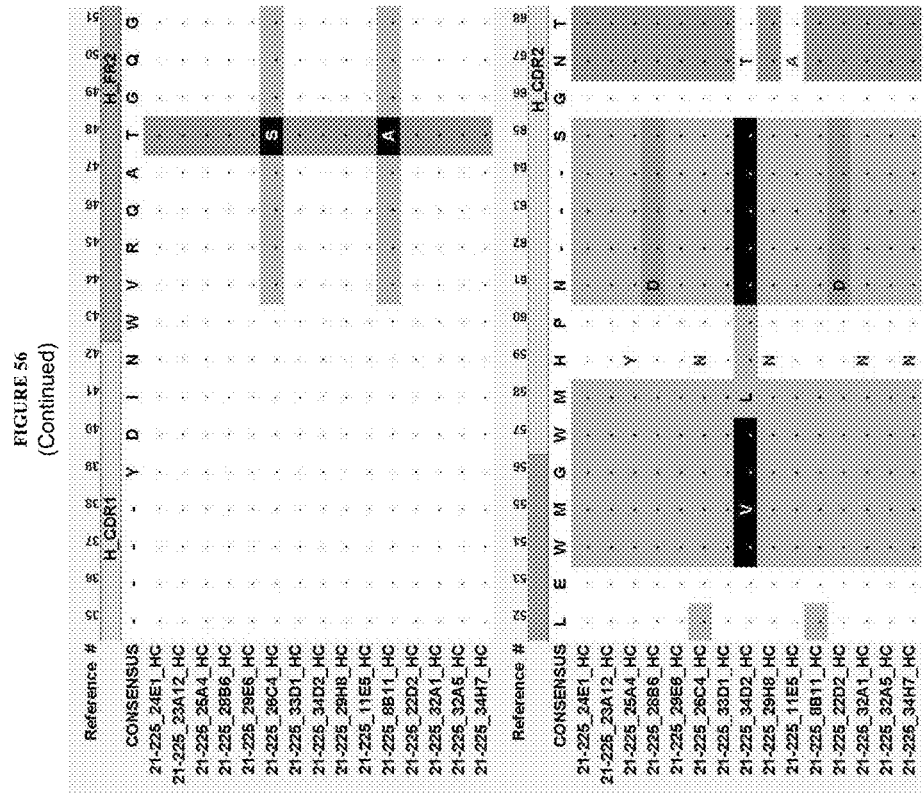
Figure 56:
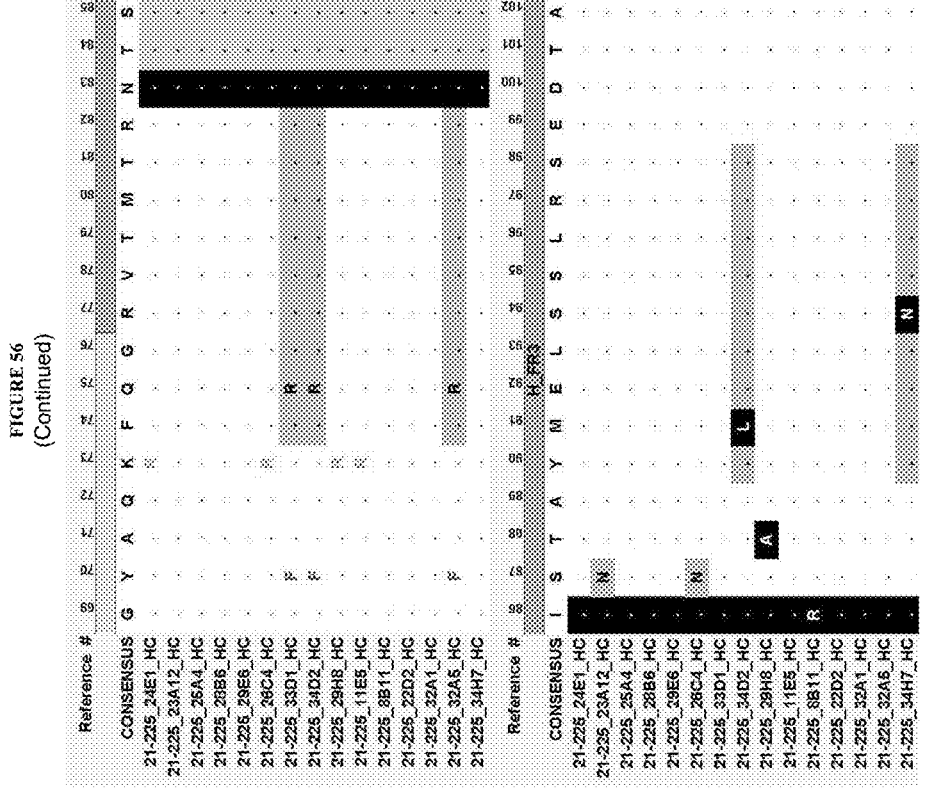
Figure 56:
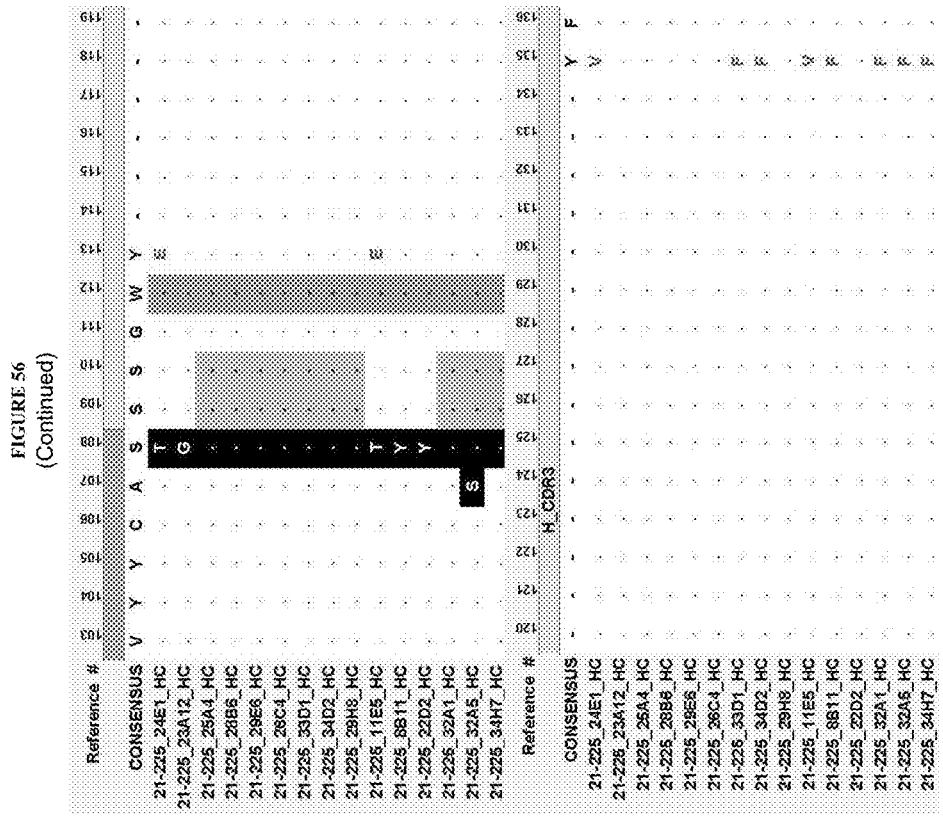
Figure 56:
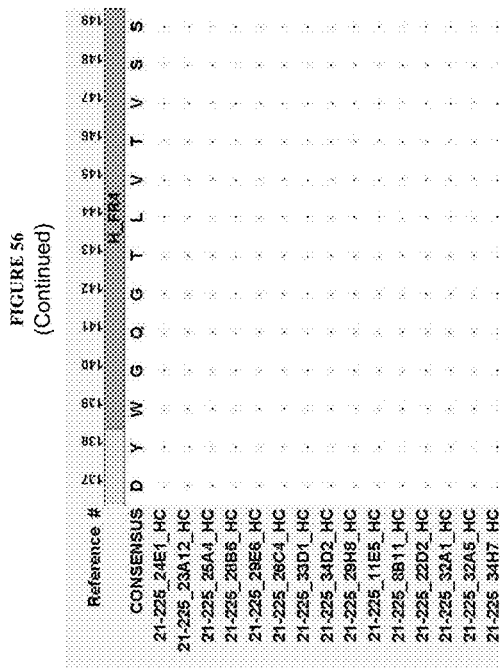
Figure 56:
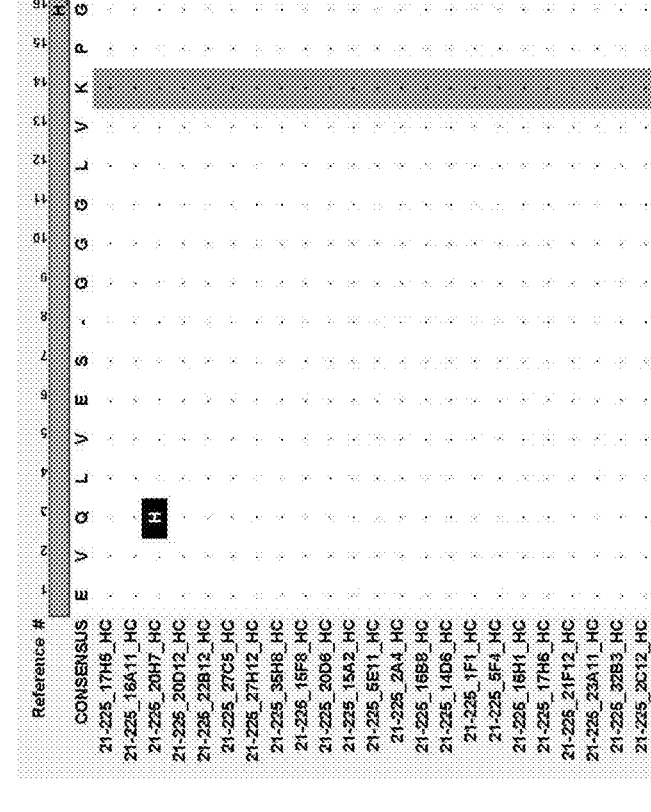
Figure 56:
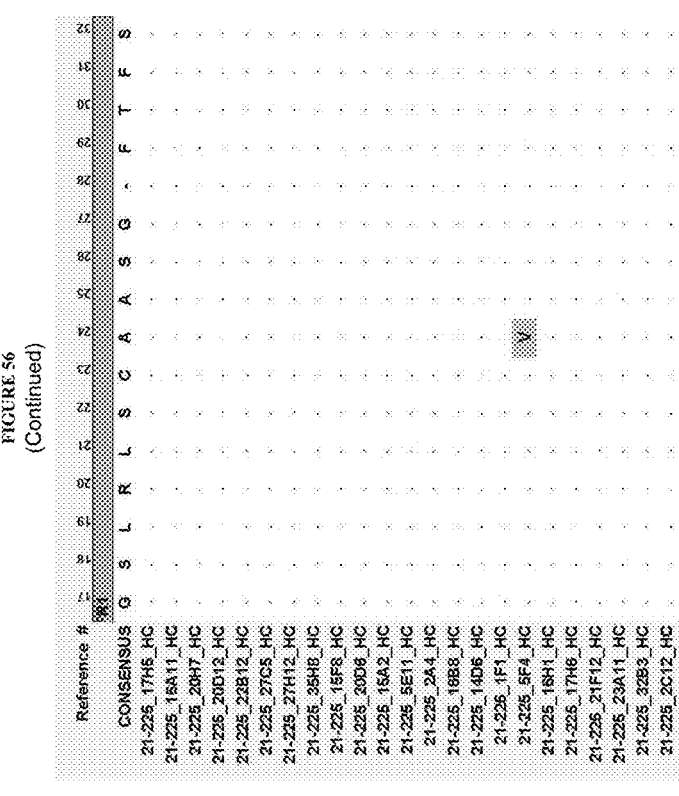
Figure 56:
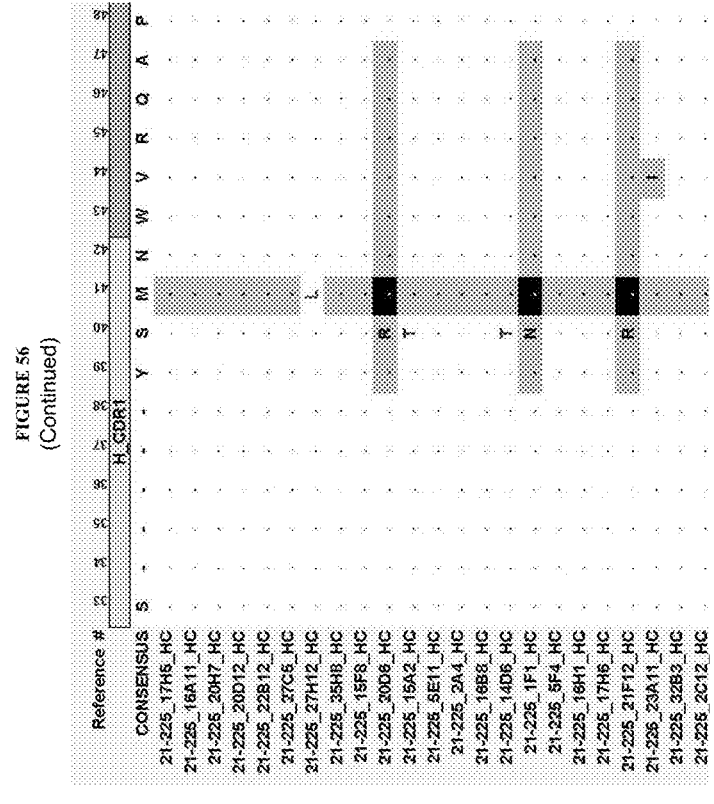
Figure 56:
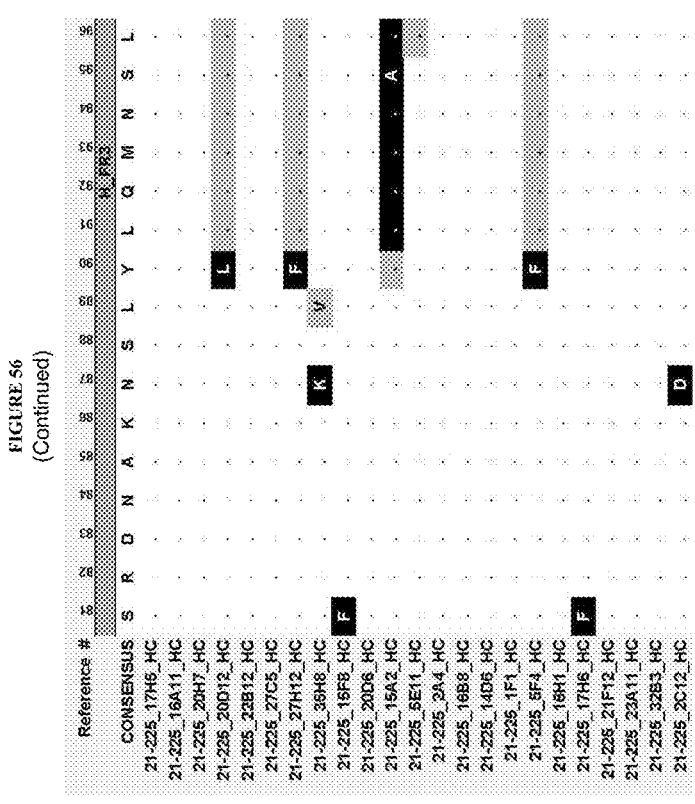
Figure 56:
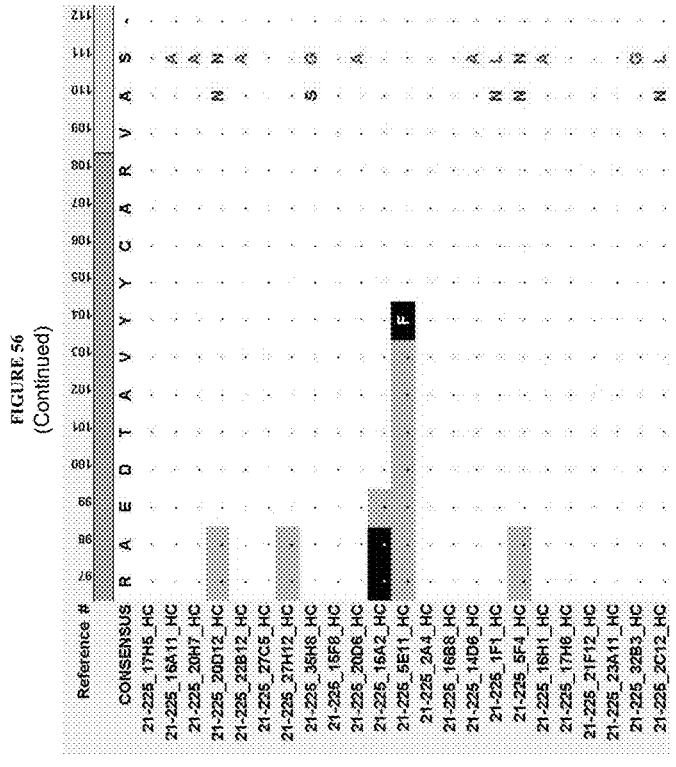
Figure 56:
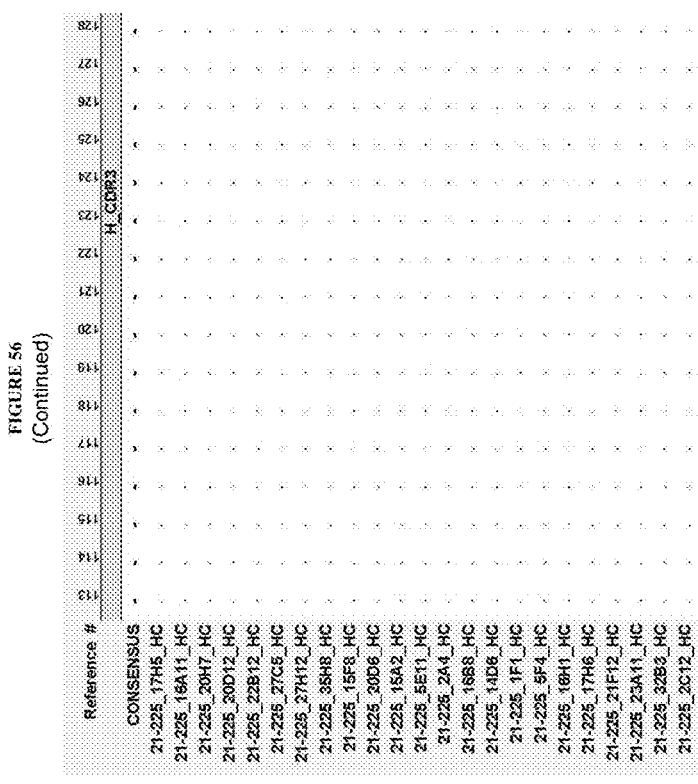
Figure 56:
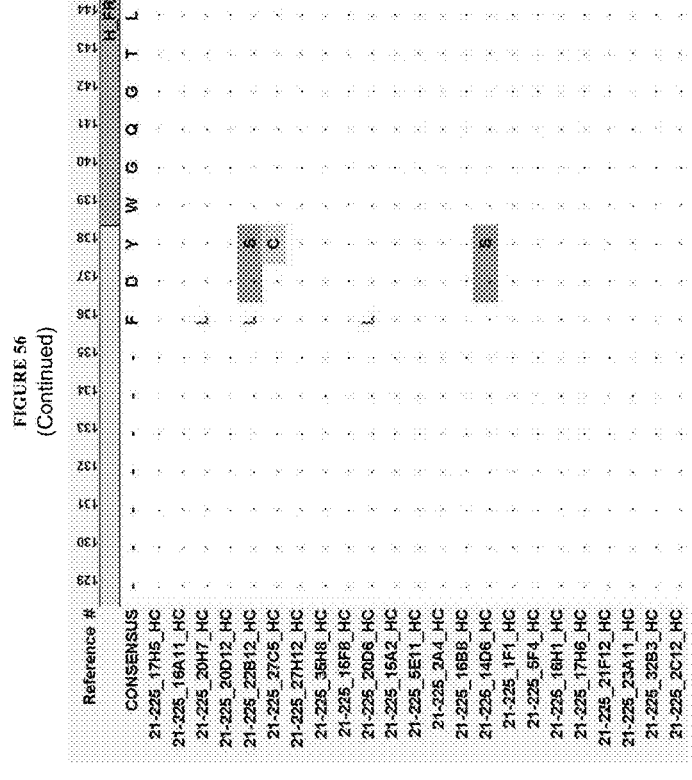
Figure 56:
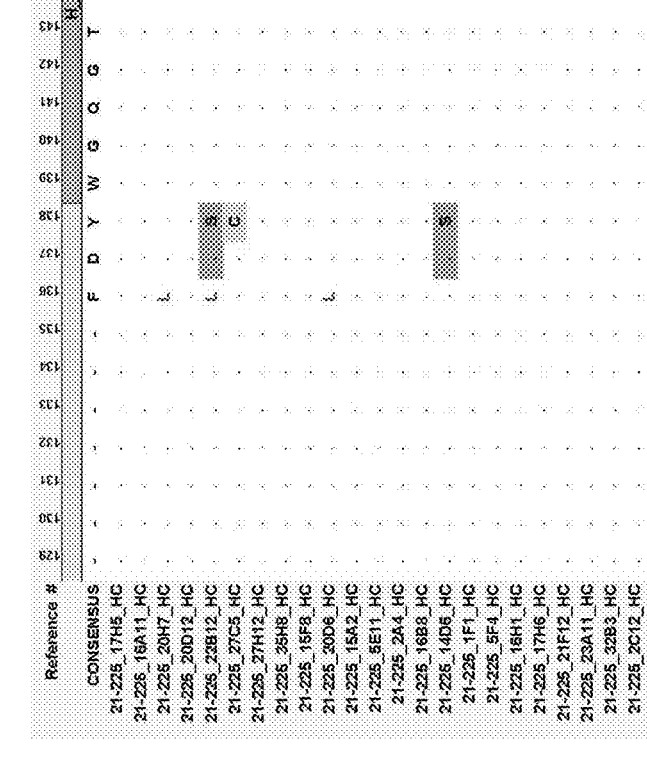
Figure 56:
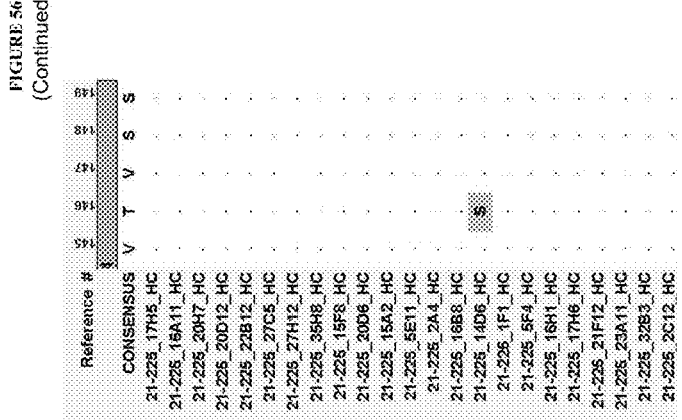
Figure 56:
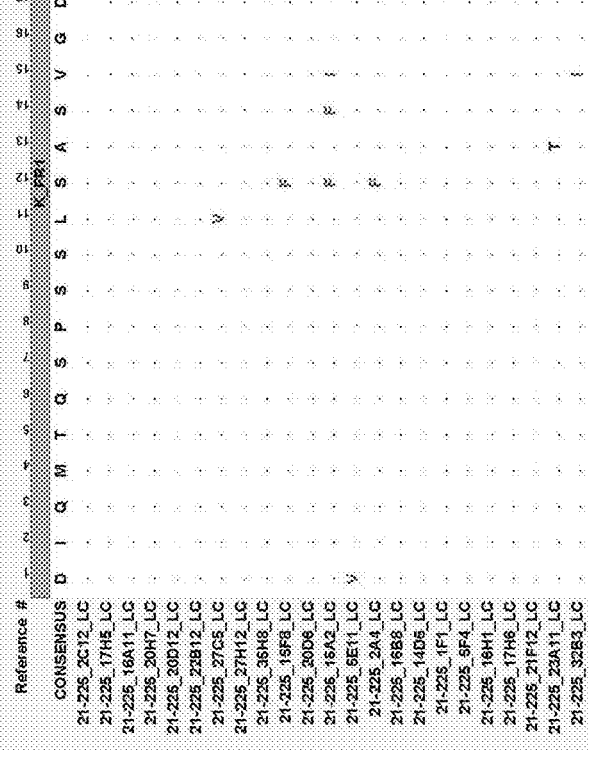
Figure 56:
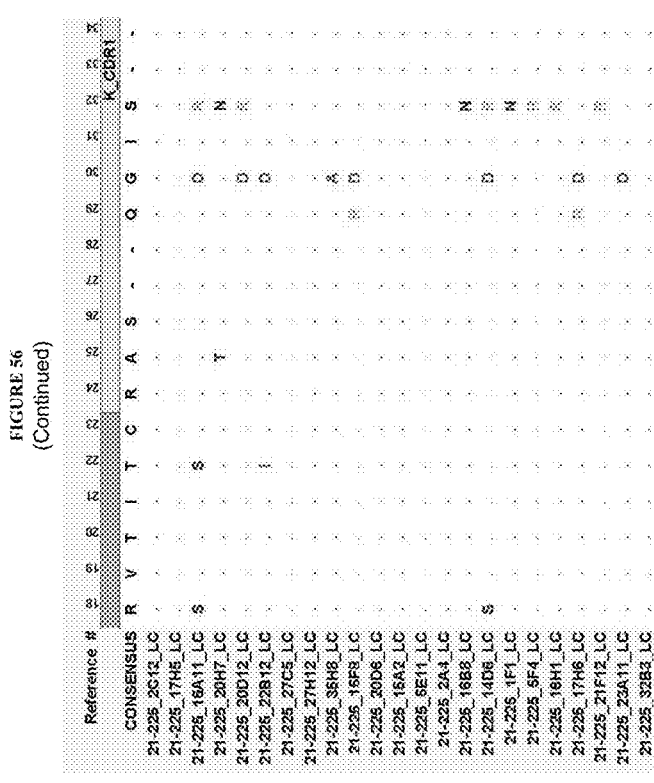
Figure 56:
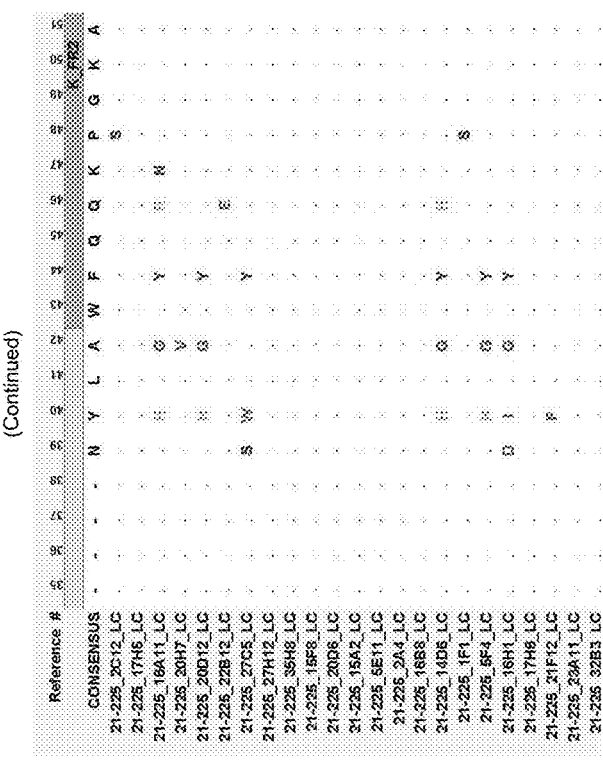
Figure 56:
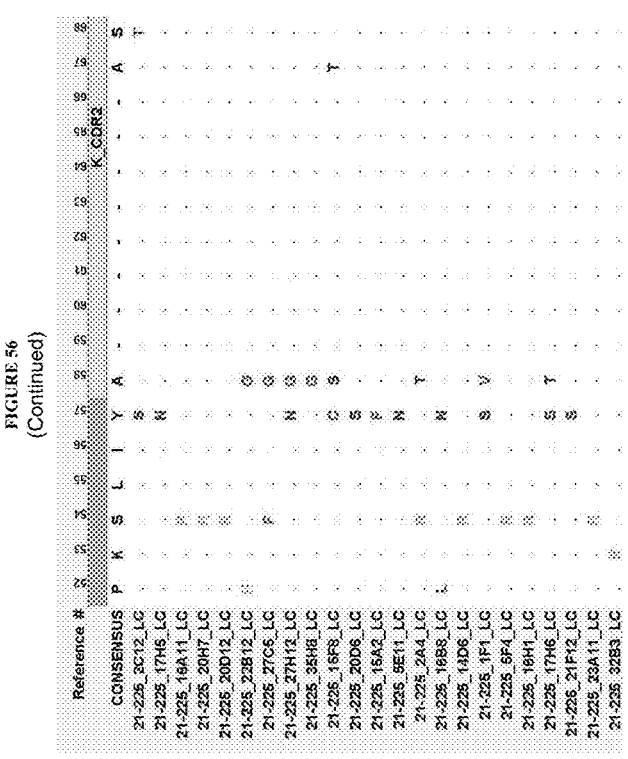
Figure 56:
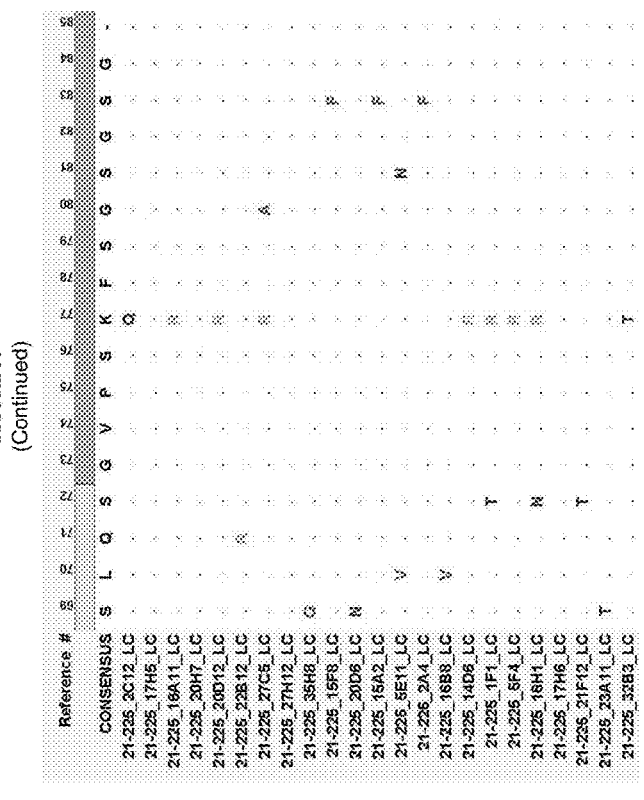
Figure 56:
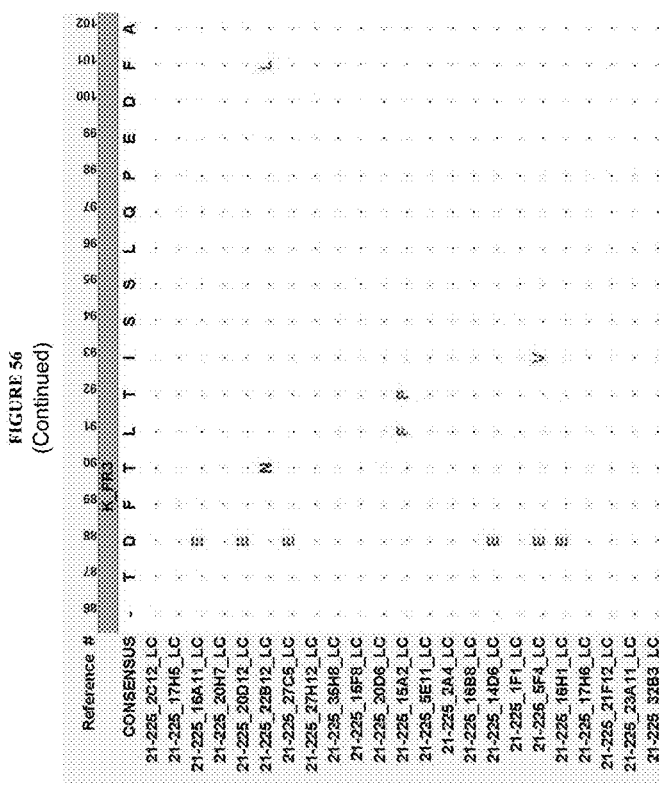
Figure 56:
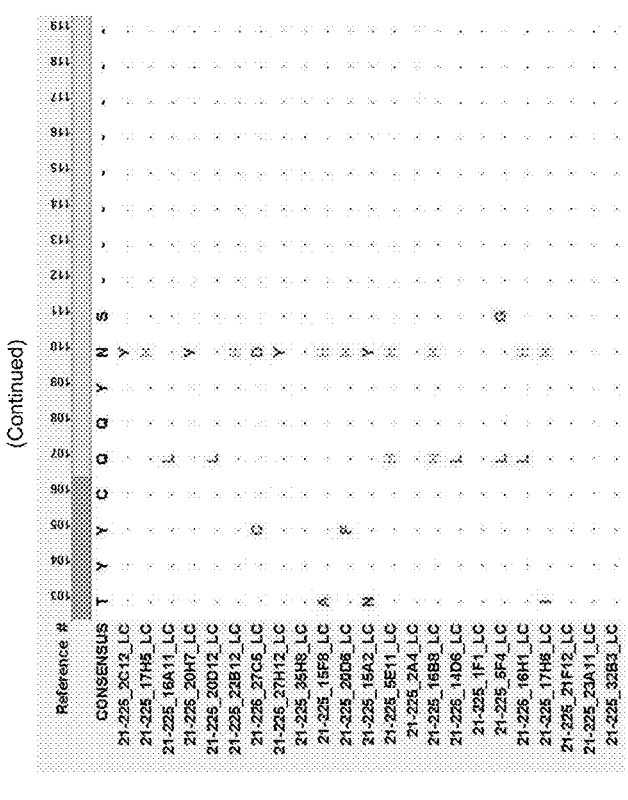
Figure 56:
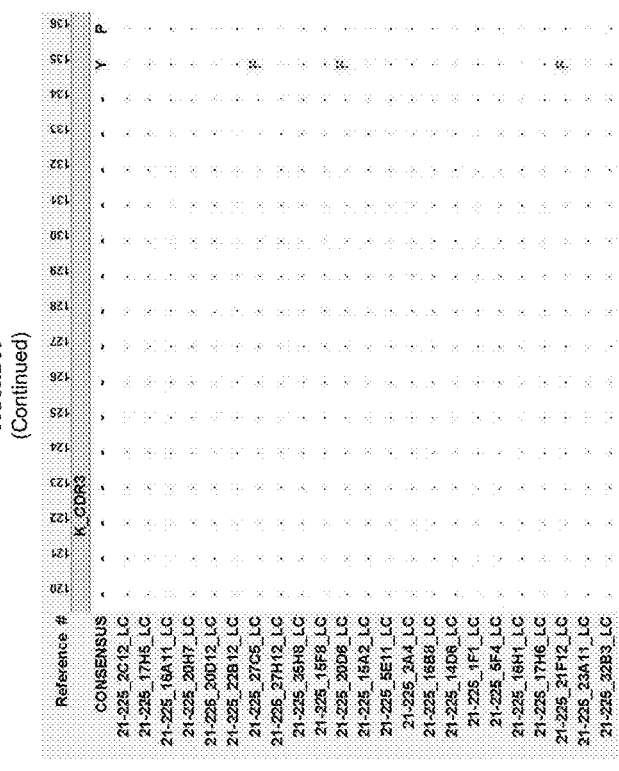
Figure 56:
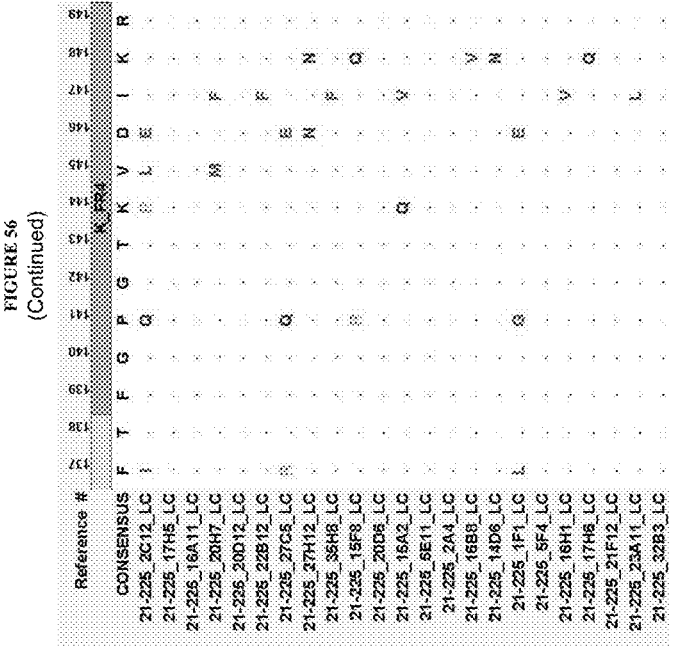
Figure 56:
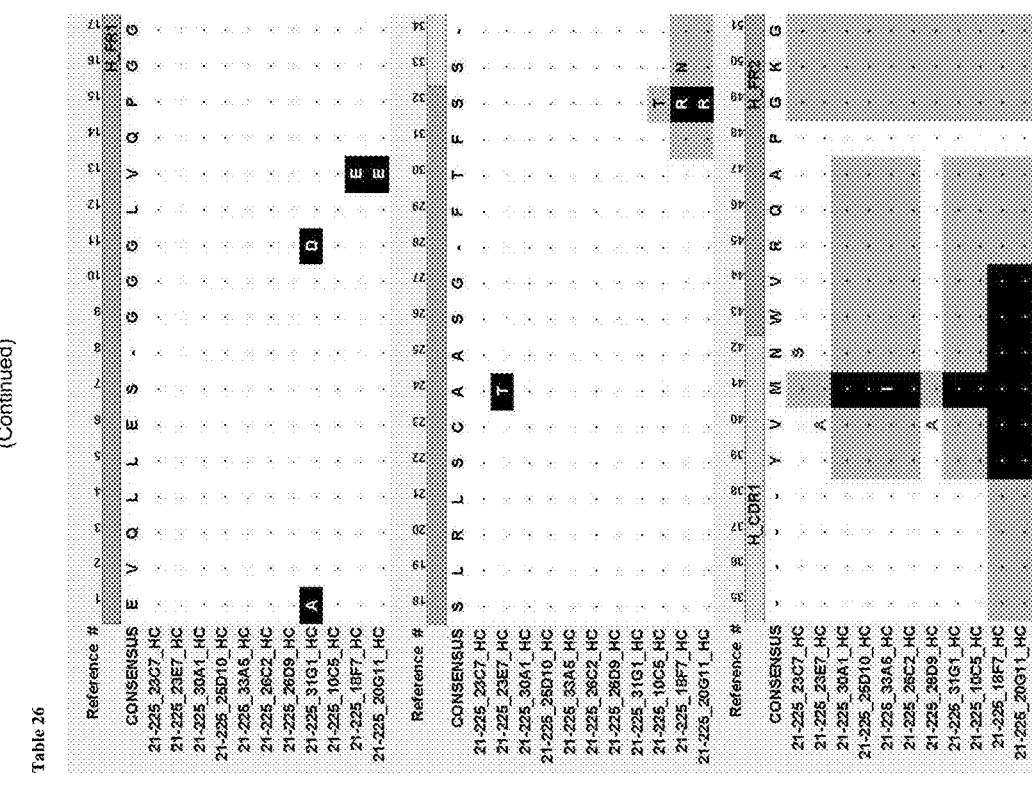
Figure 56:
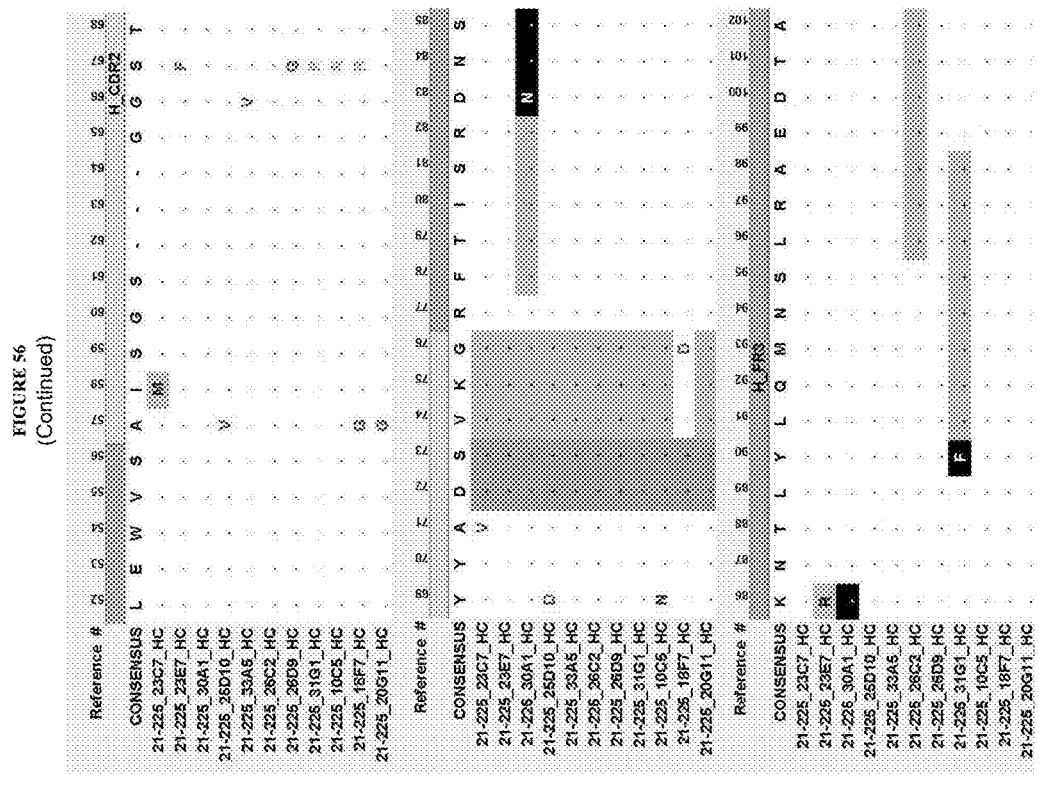
Figure 56:
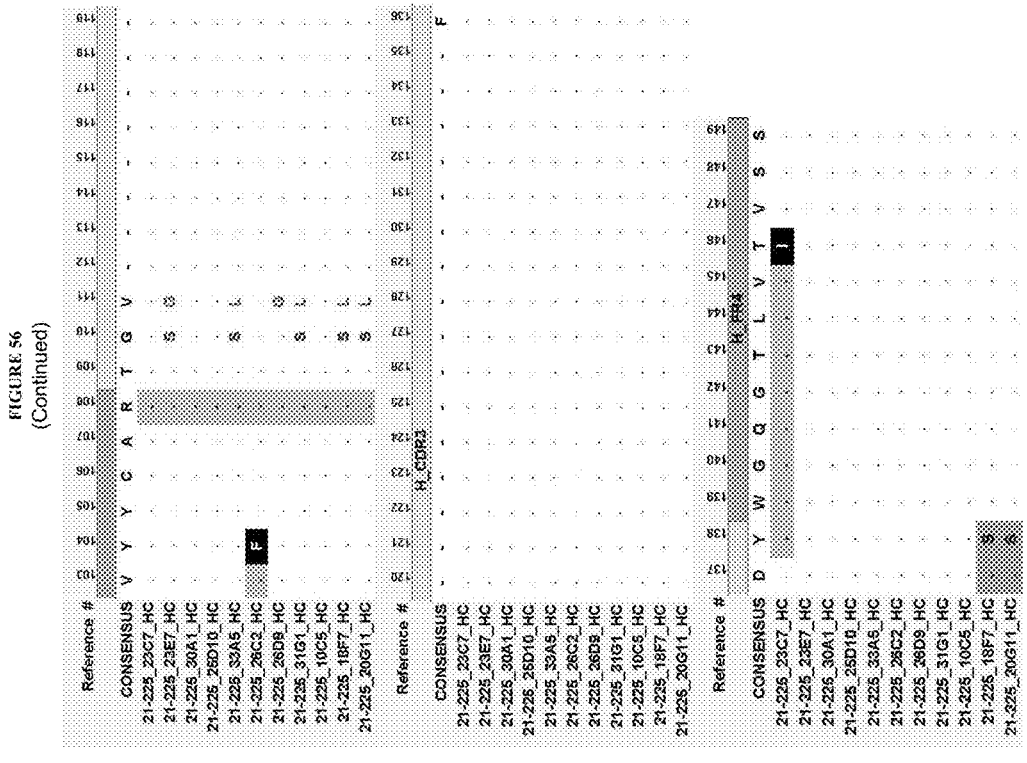
Figure 56:
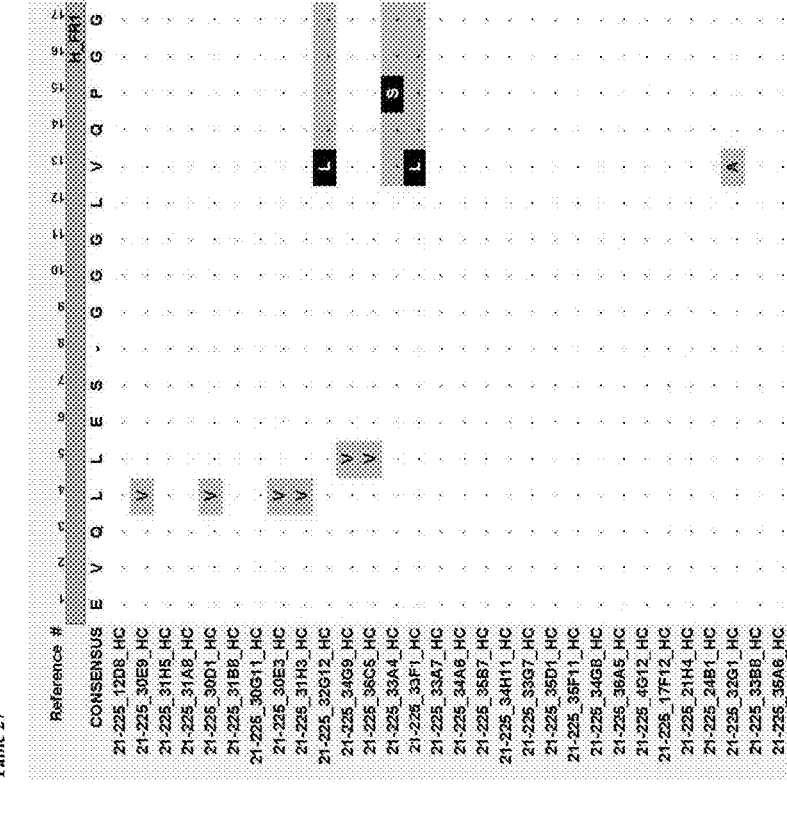
Figure 56:
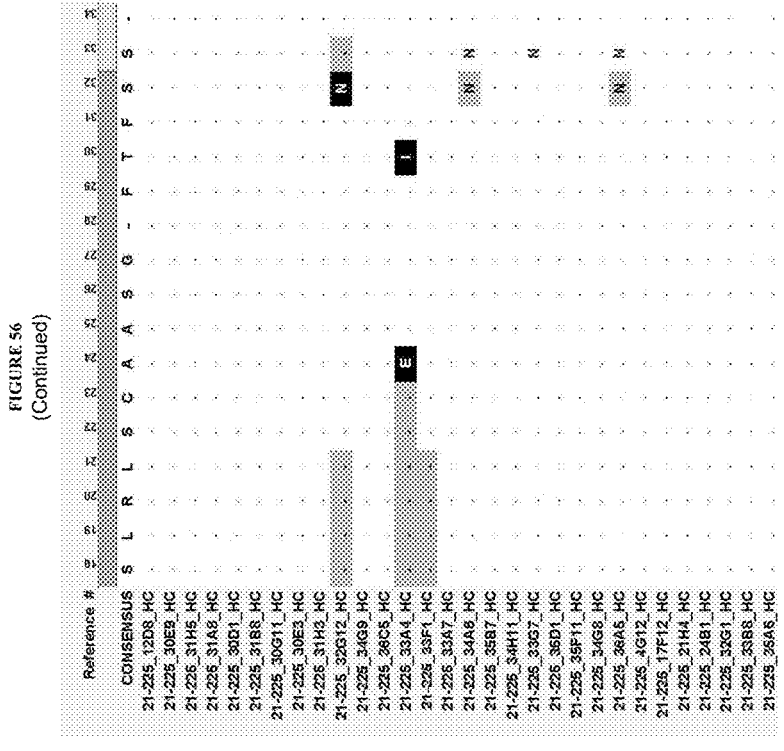
Figure 56:
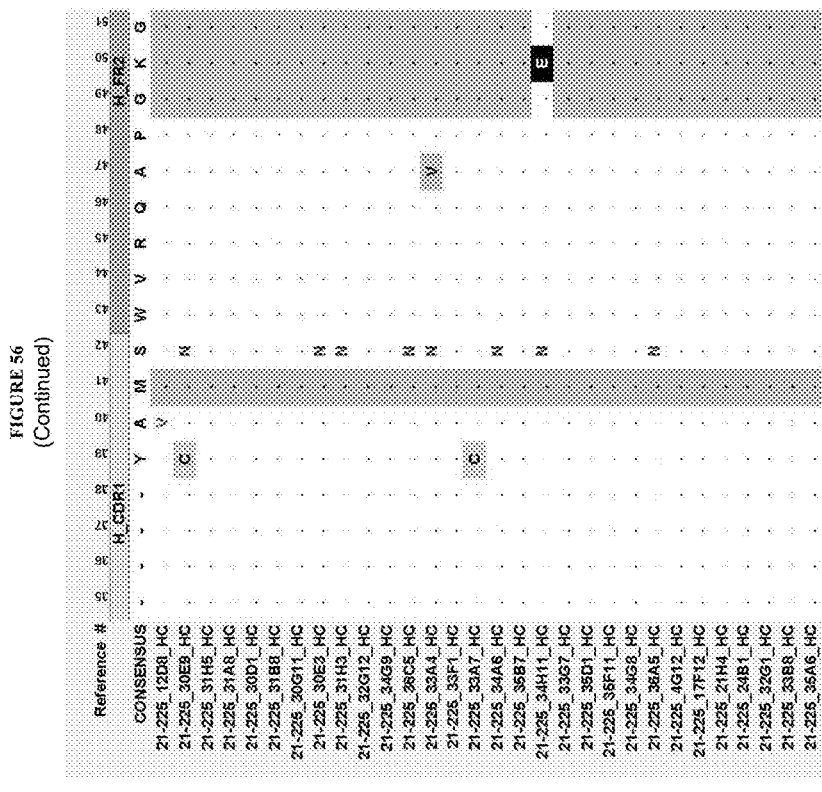
Figure 56:
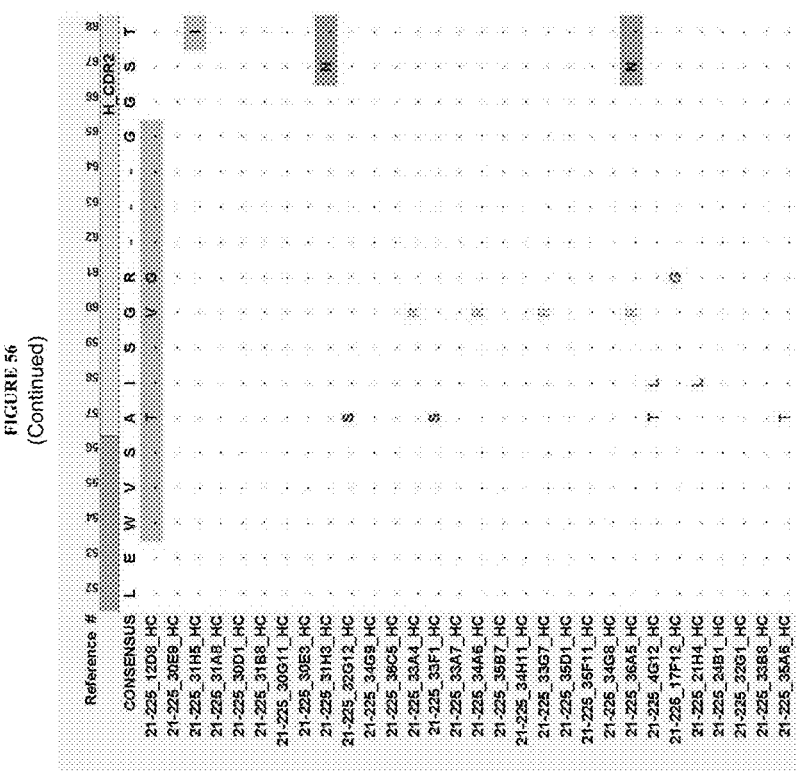
Figure 56:
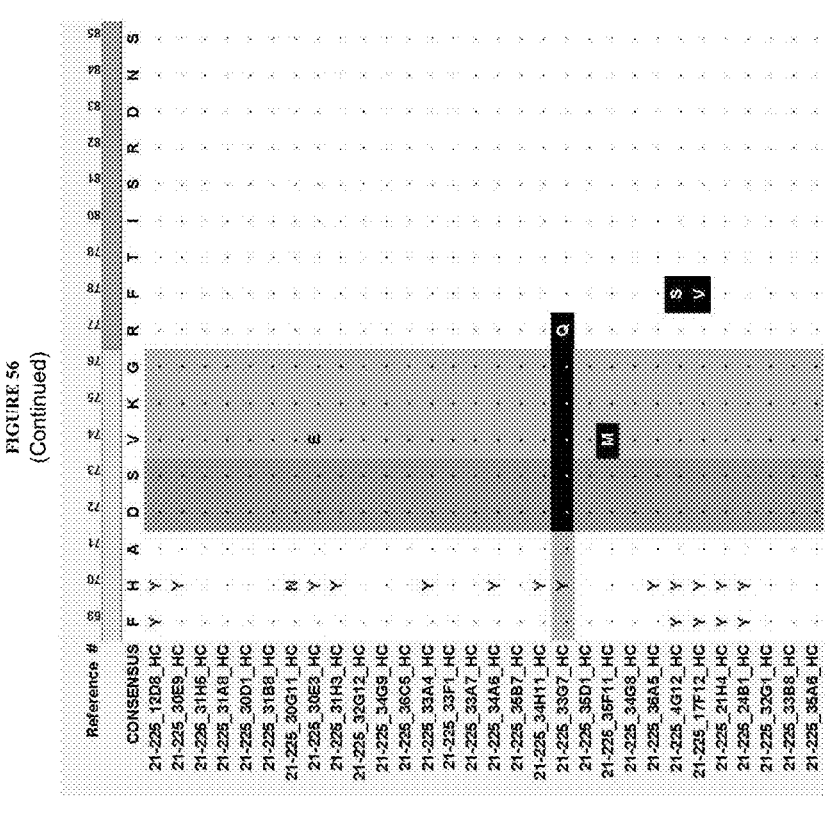
Figure 56:
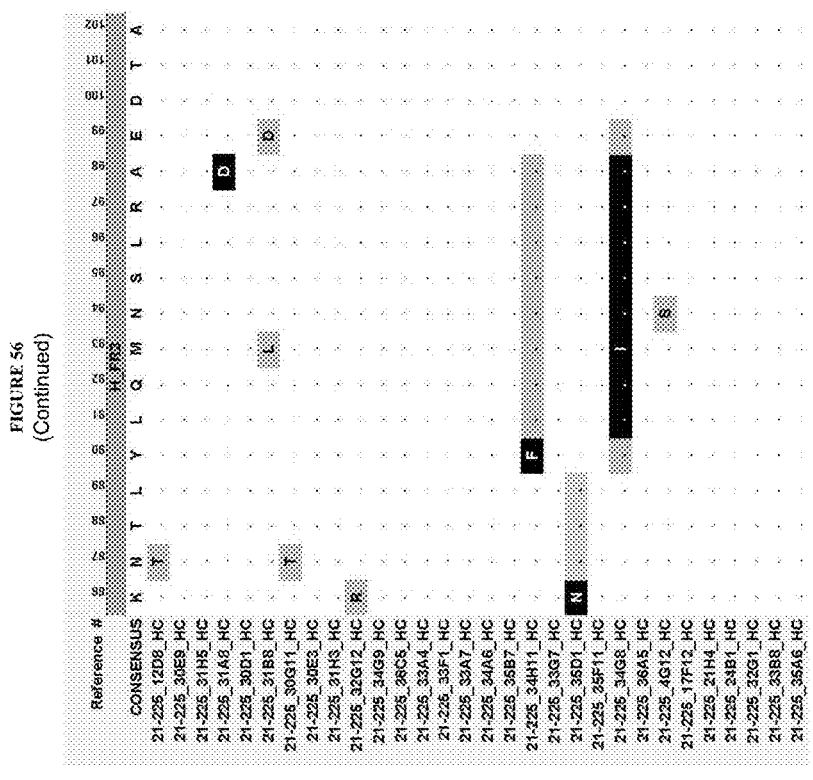
Figure 56:
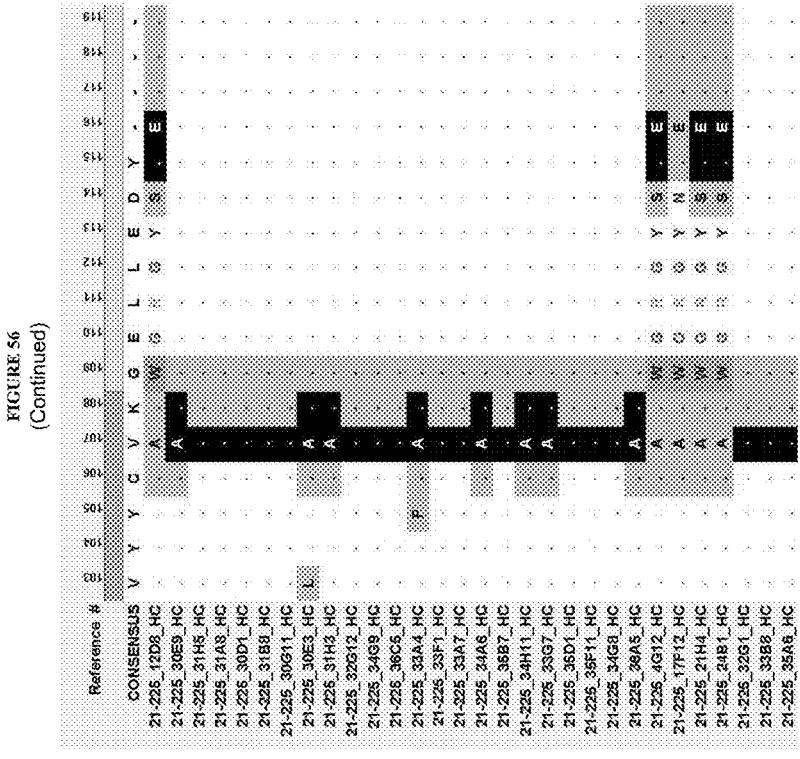
Figure 56:
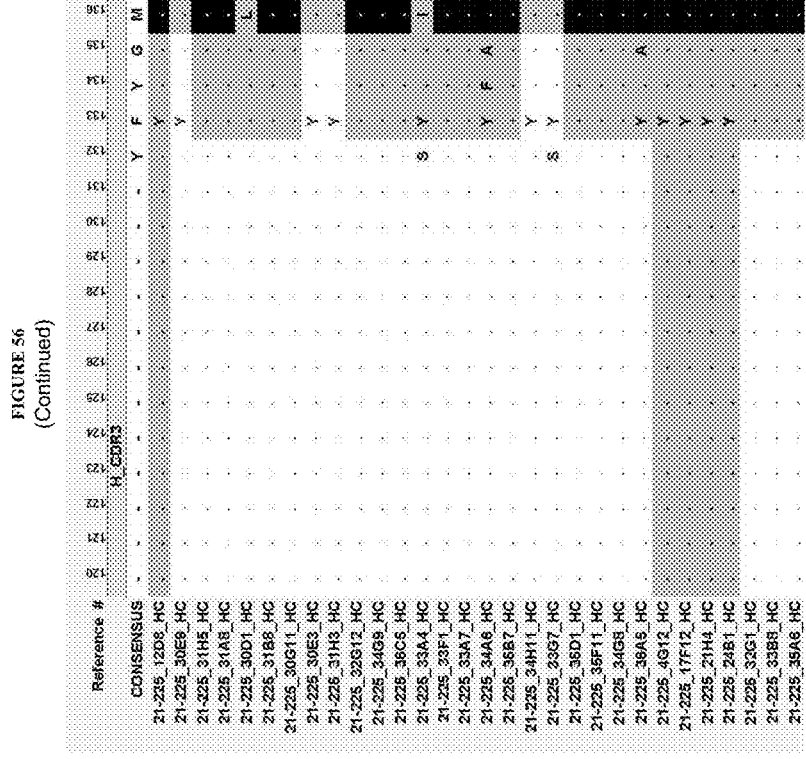
Figure 56:
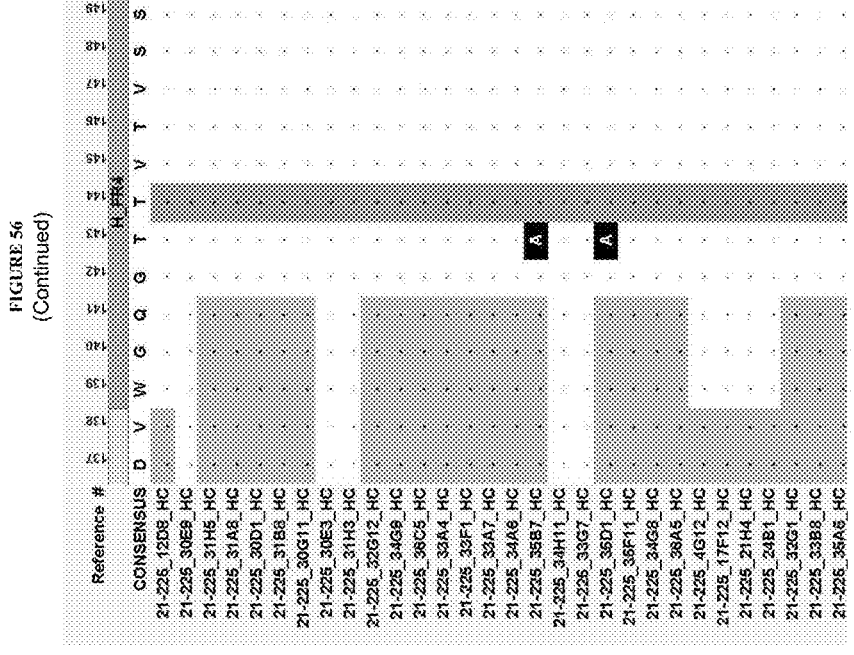
Figure 56:
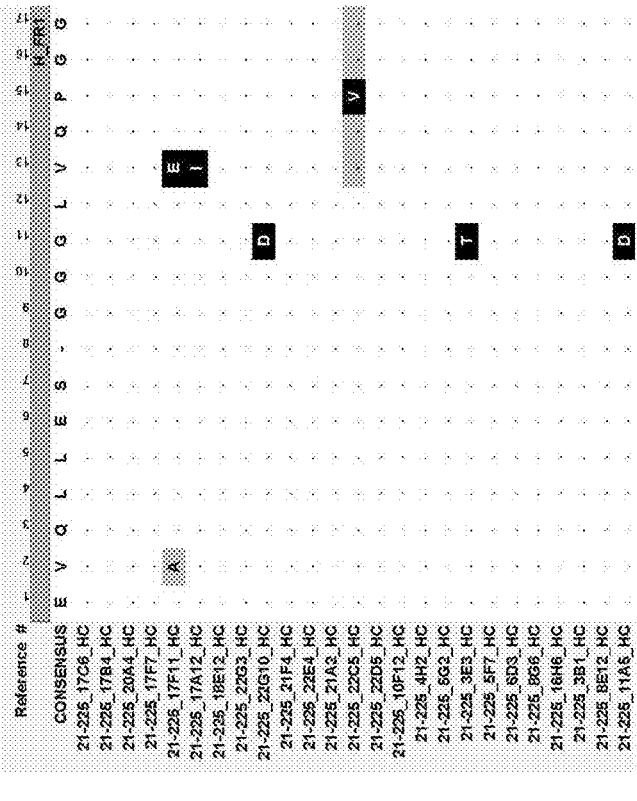
Figure 56:
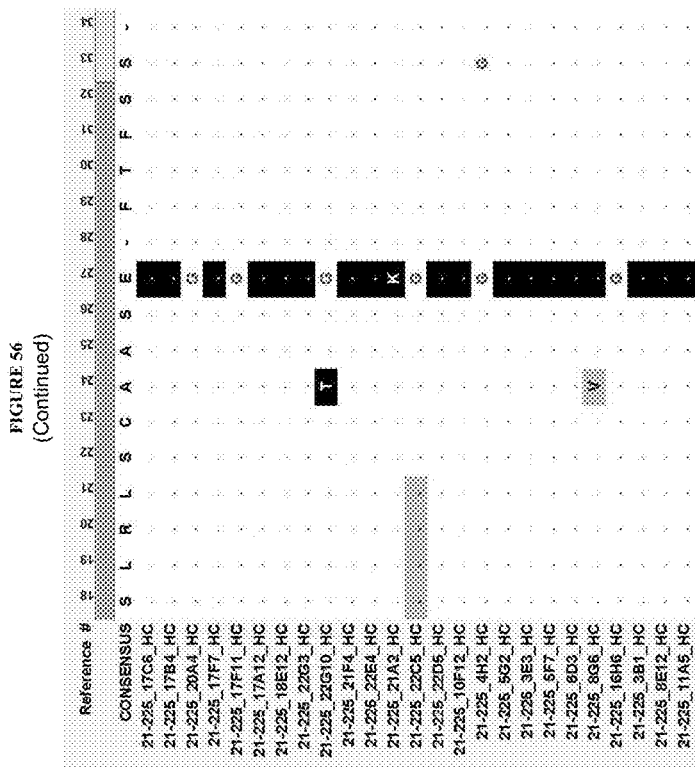
Figure 56:
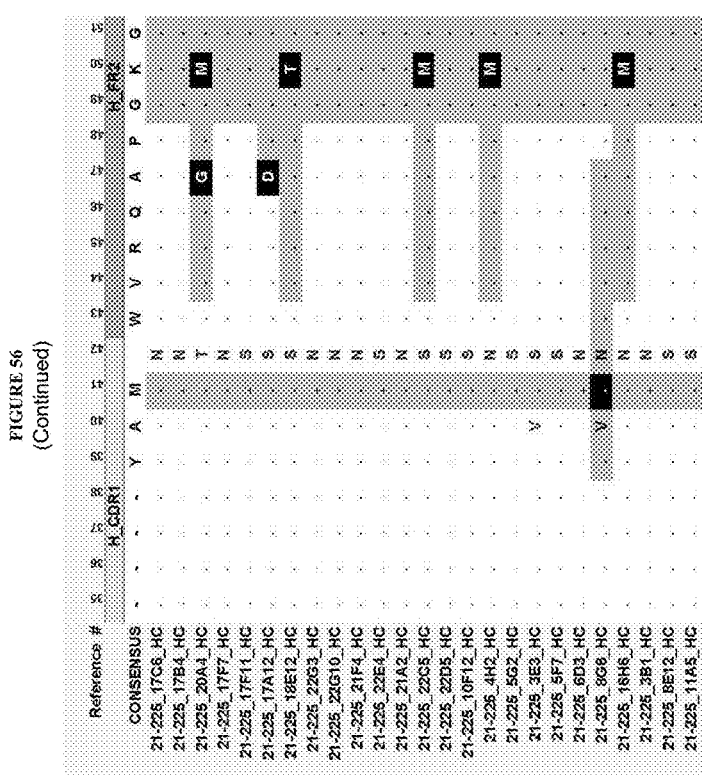
Figure 56:
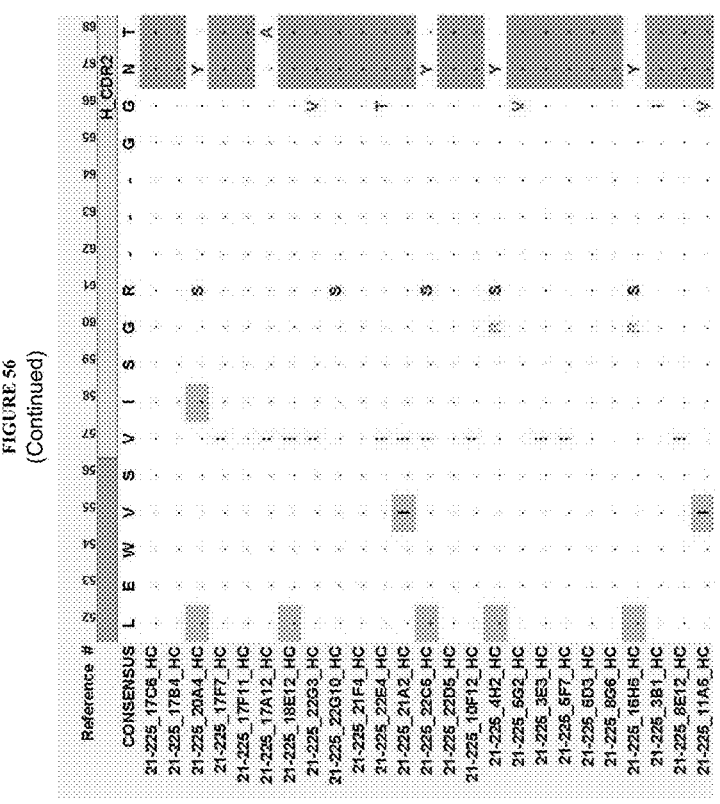
Figure 56:
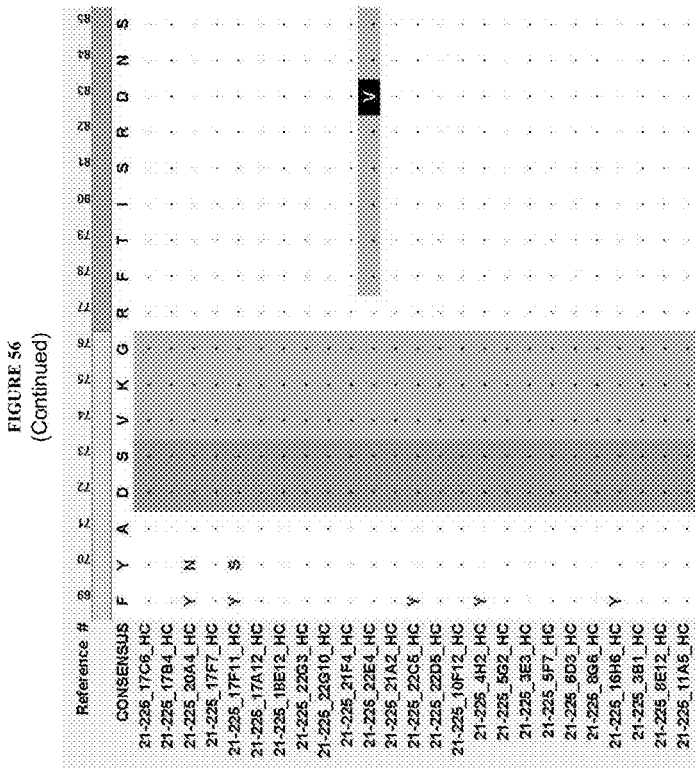
Figure 56:
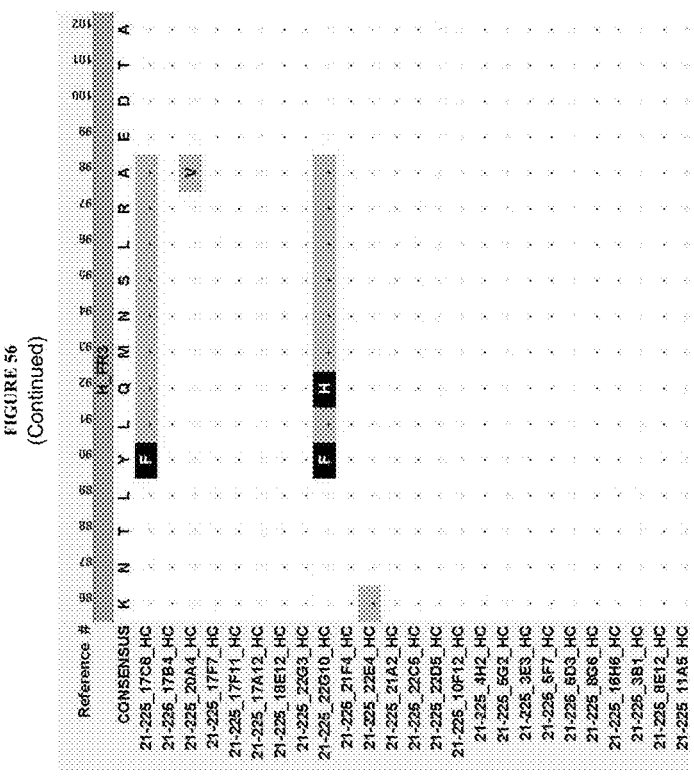
Figure 56:
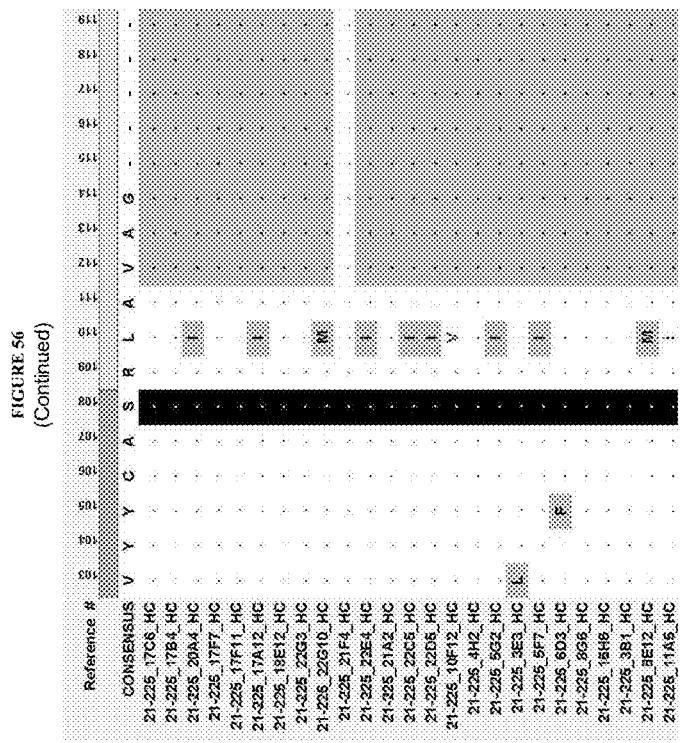
Figure 56:
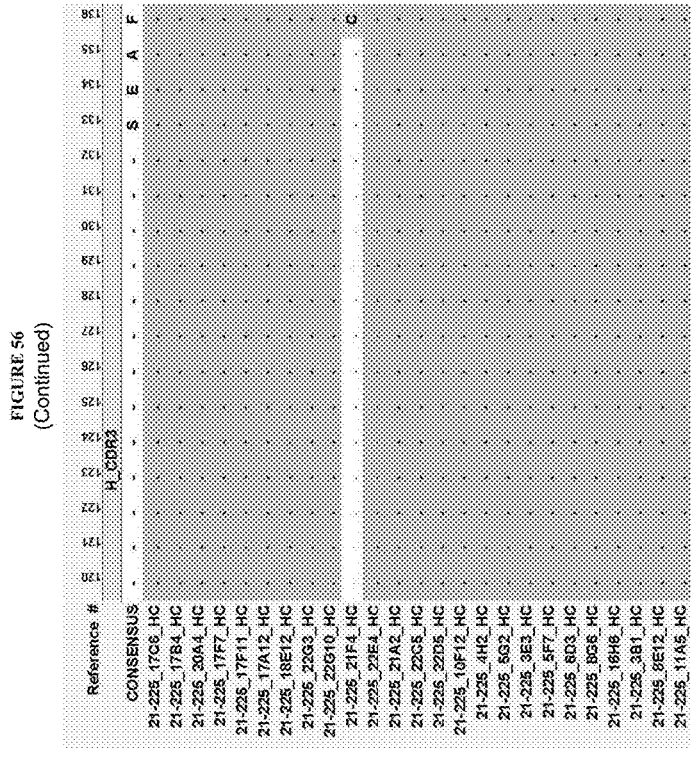
Figure 56:
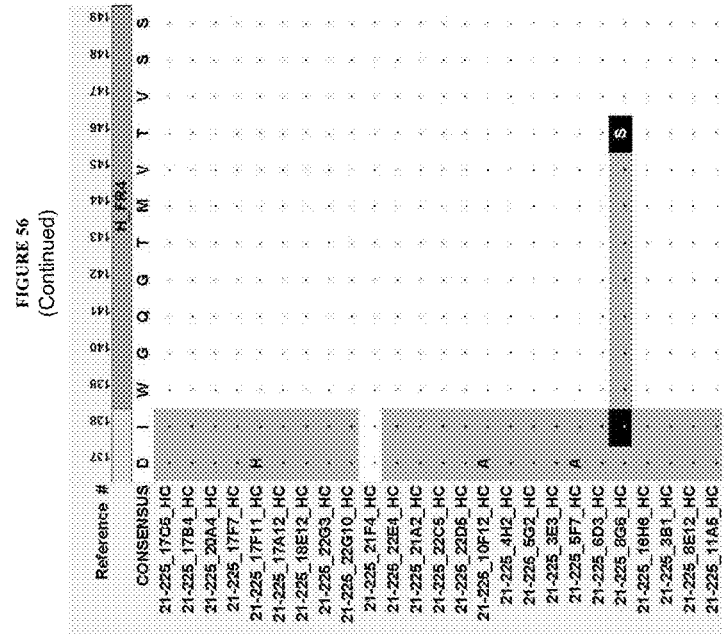
Figure 56:
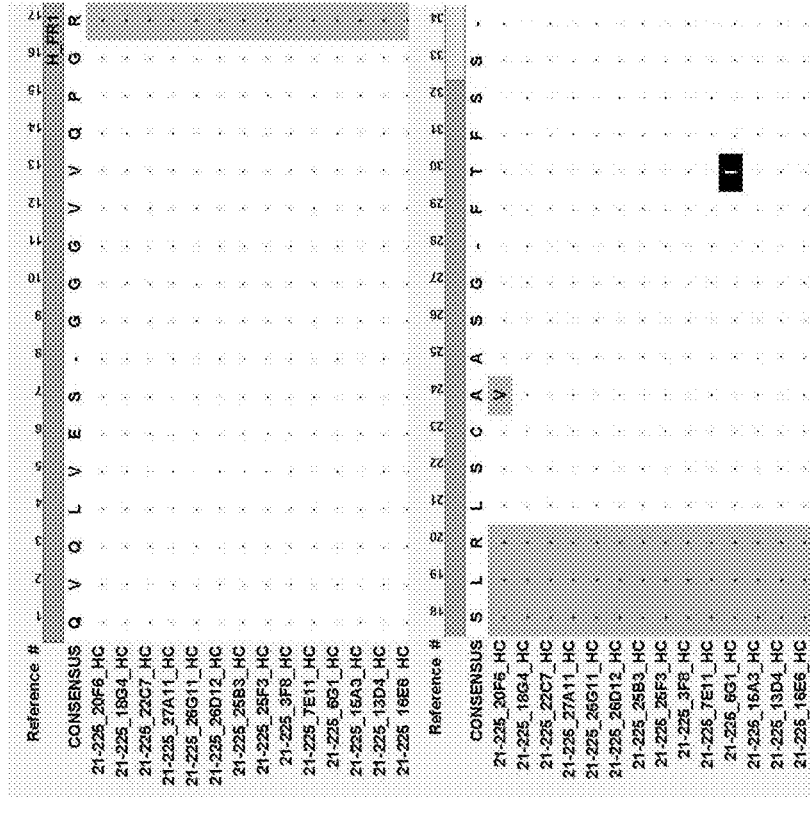
Figure 56:
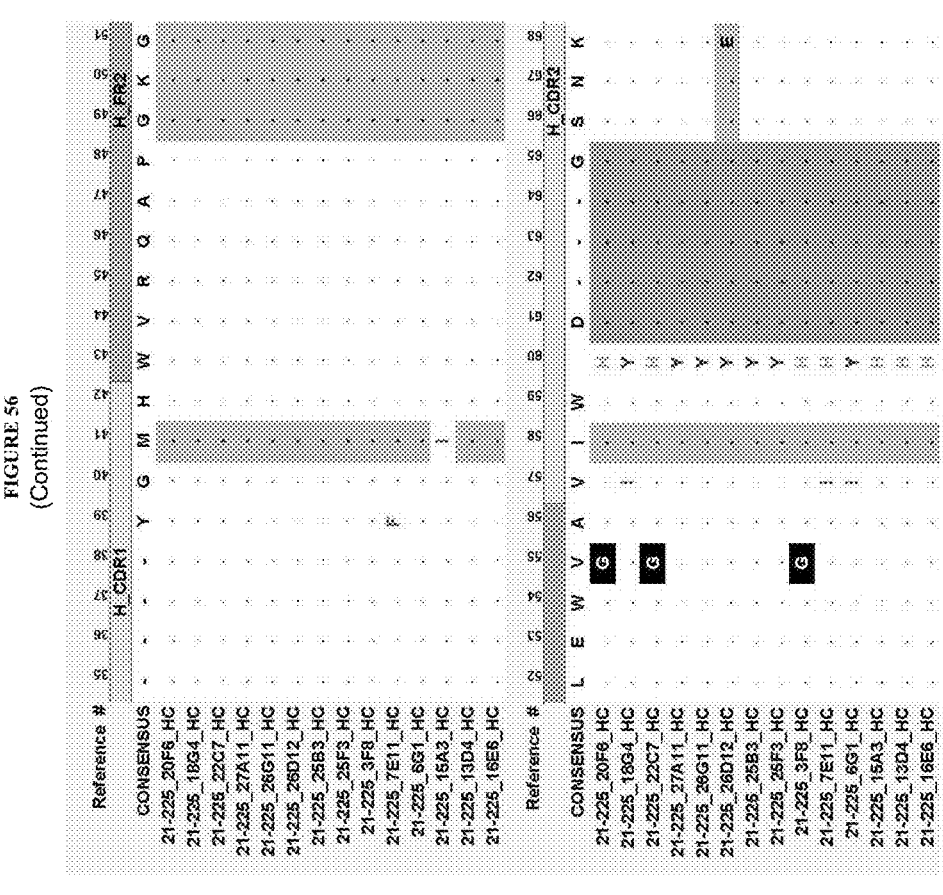
Figure 56:
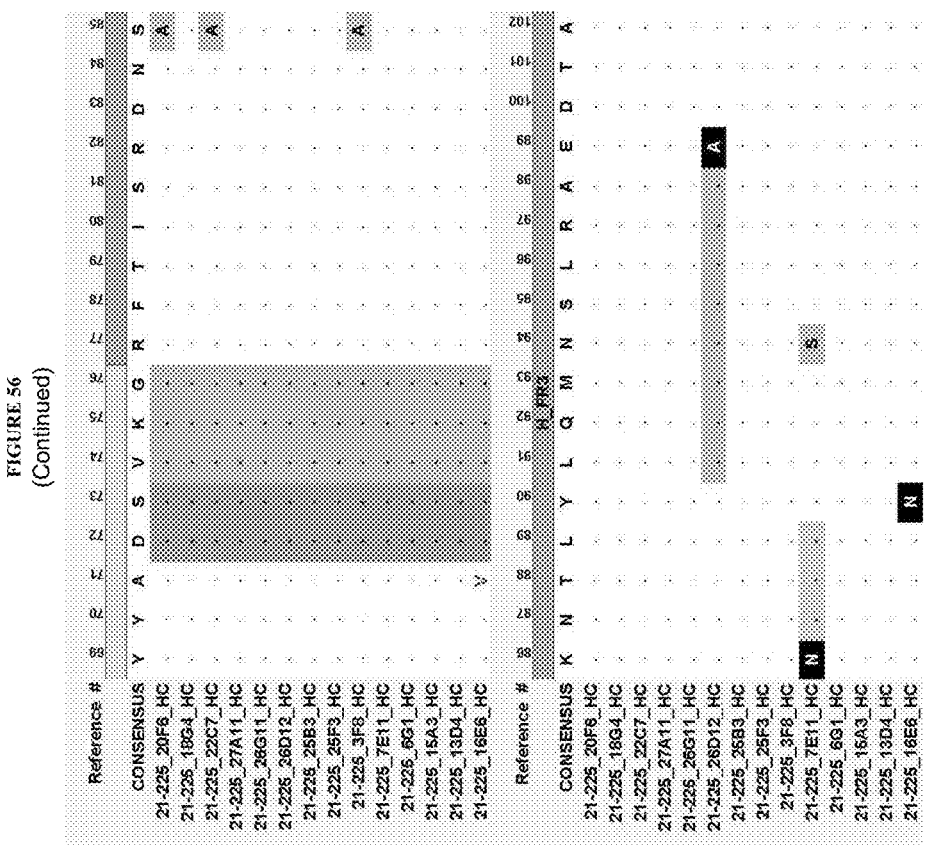
Figure 56:
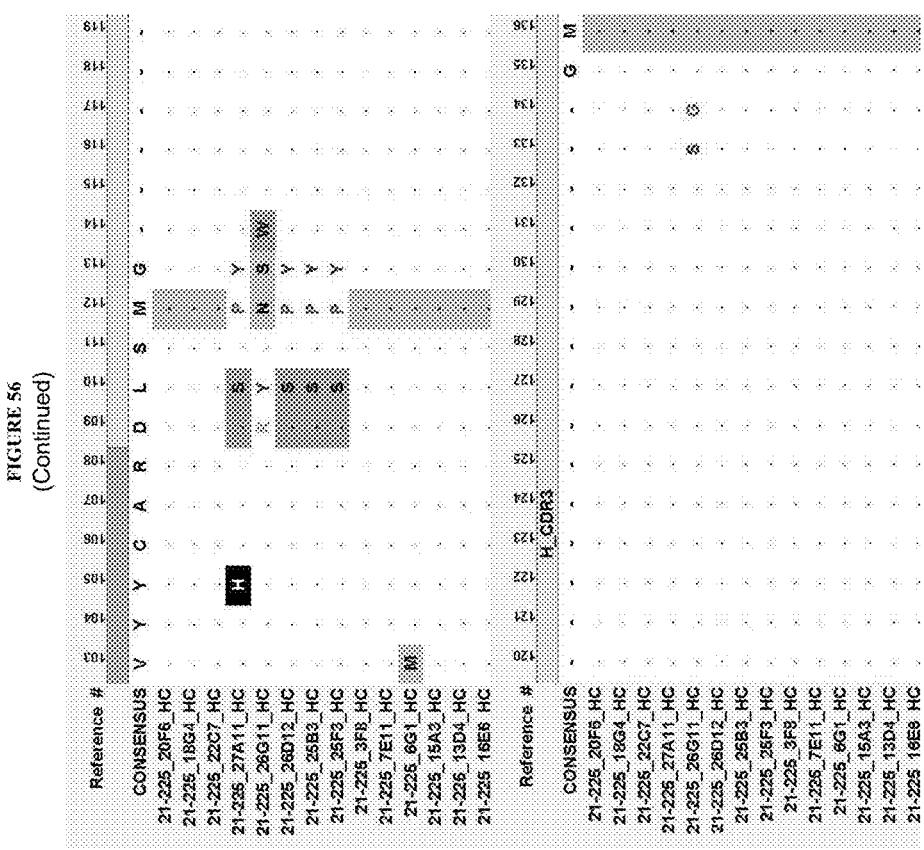
Figure 56:
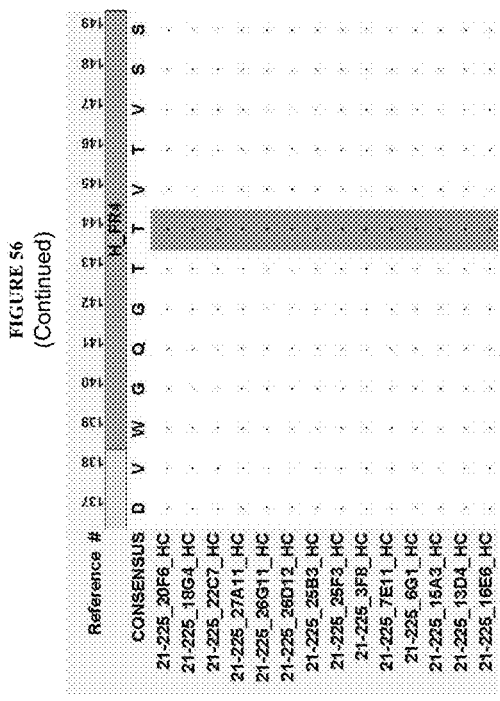
Figure 56:
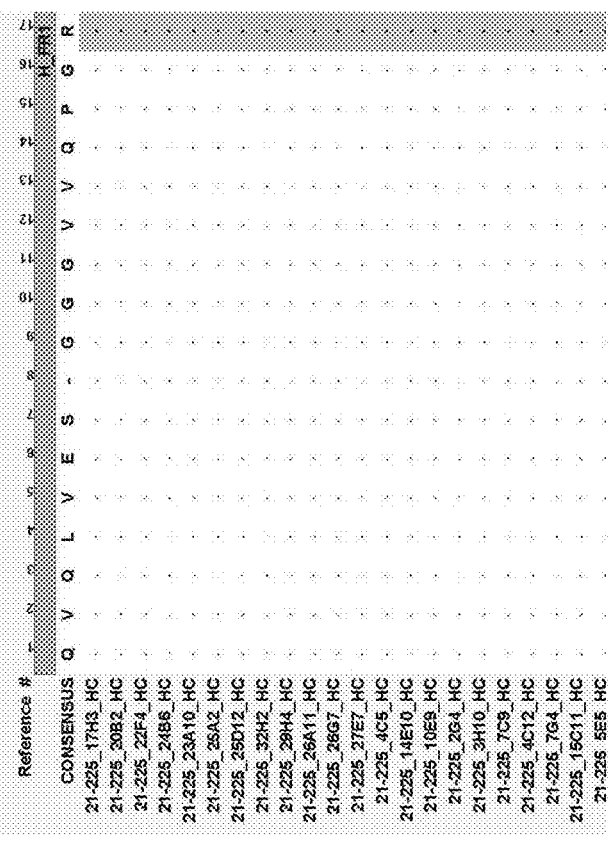
Figure 56:
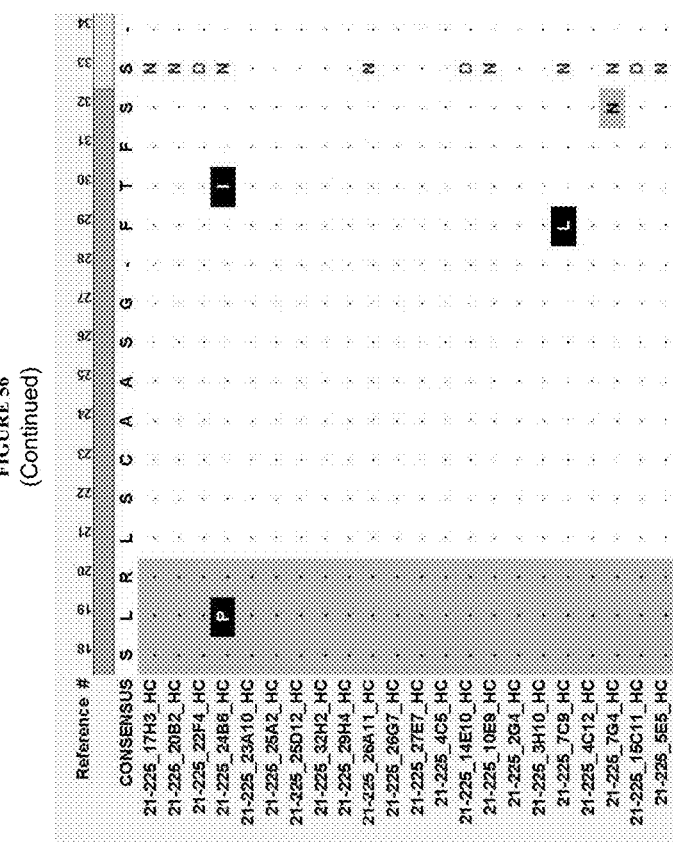
Figure 56:
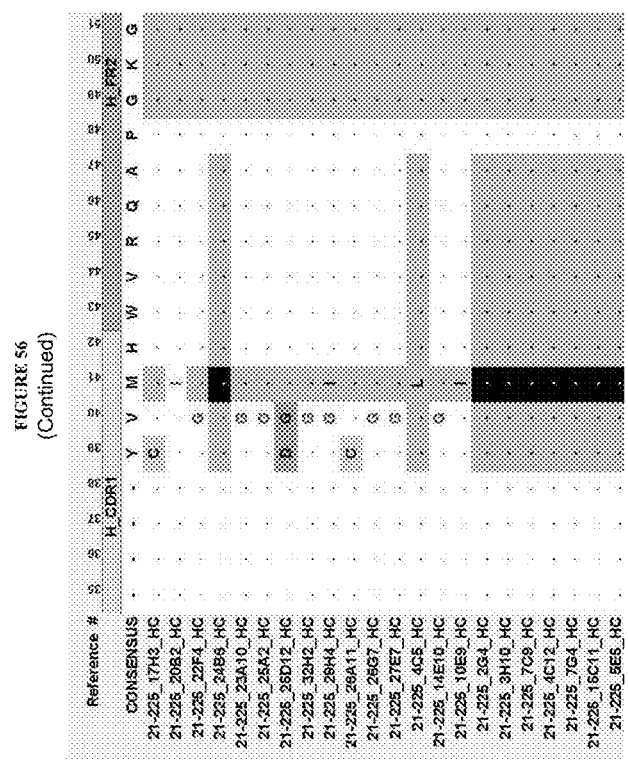
Figure 56:
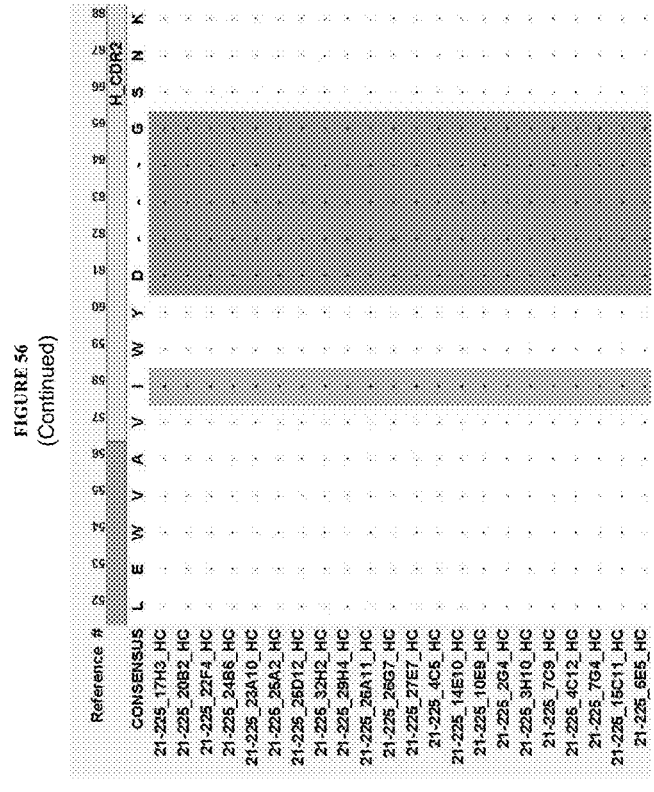
Figure 56:
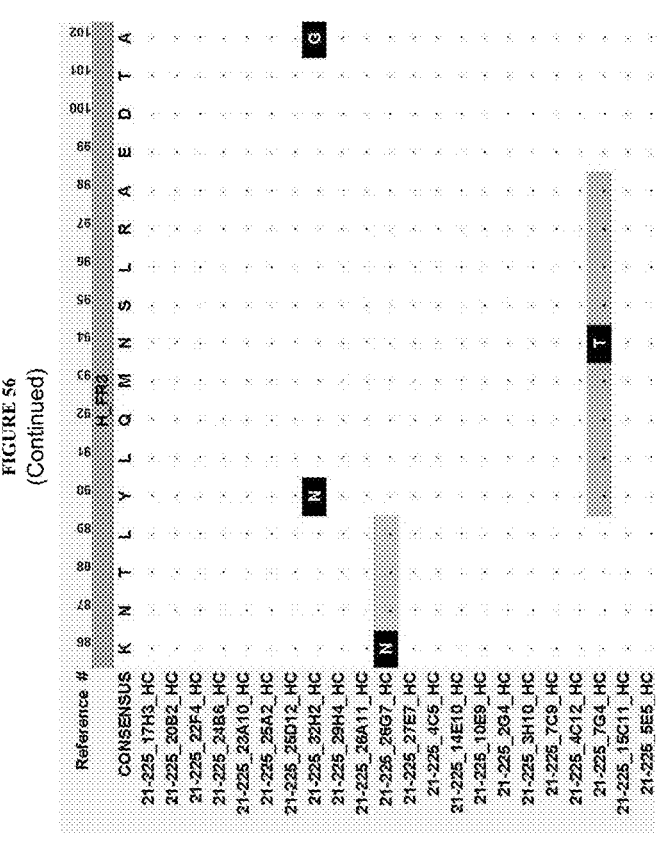
Figure 56:
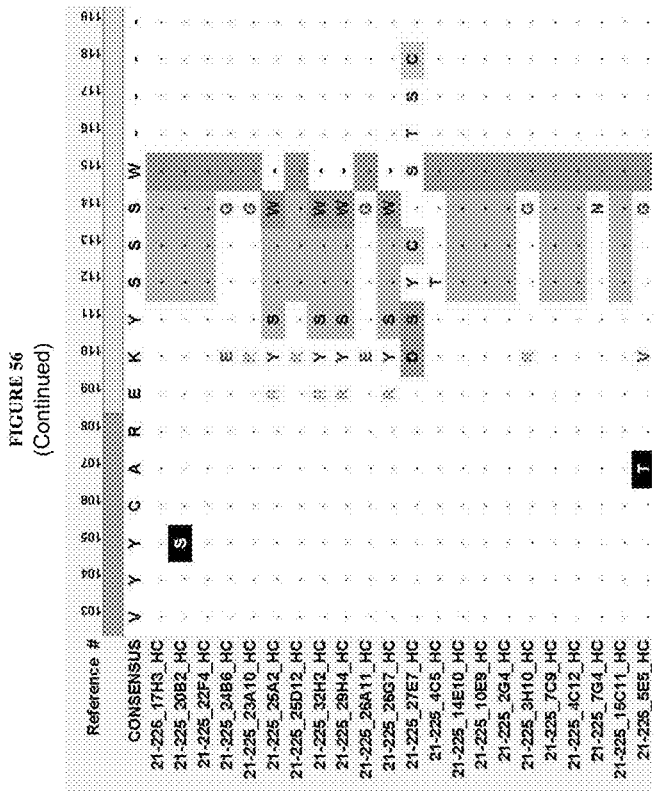
Figure 56:
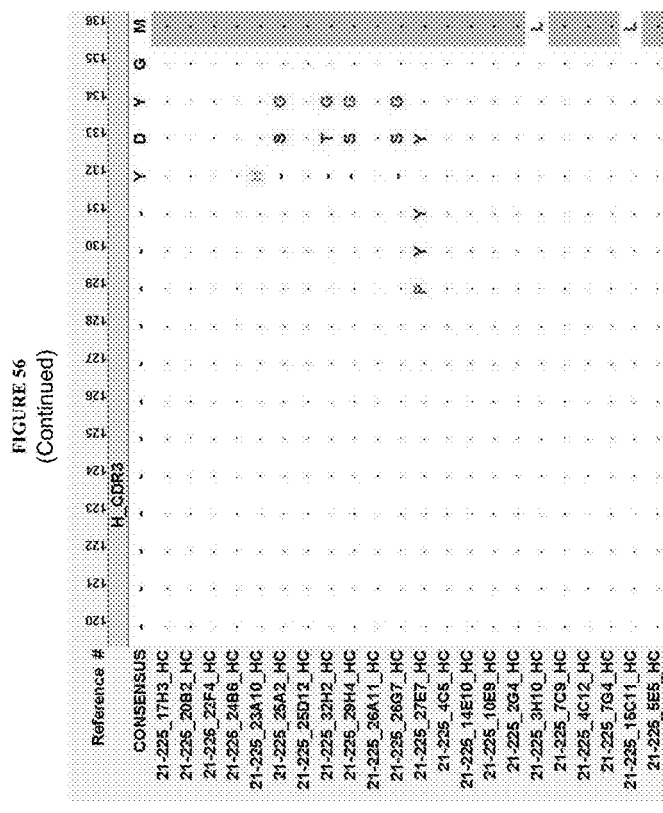
Figure 56:
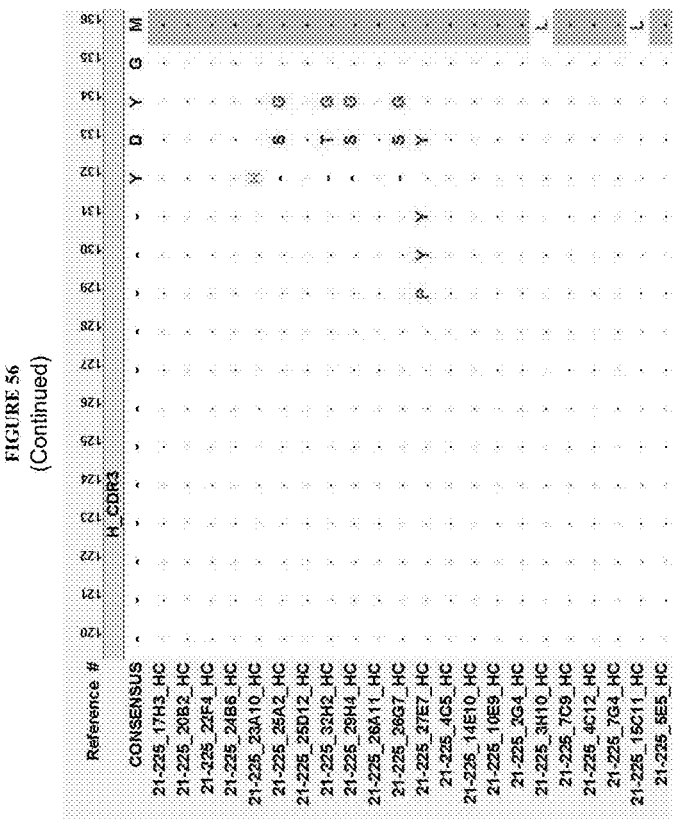
Figure 56:
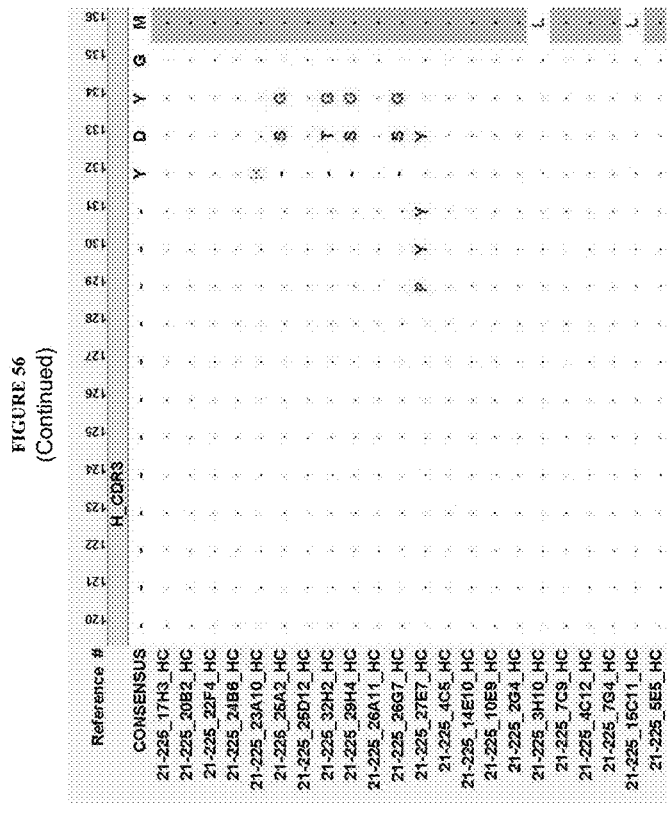
Figure 56:
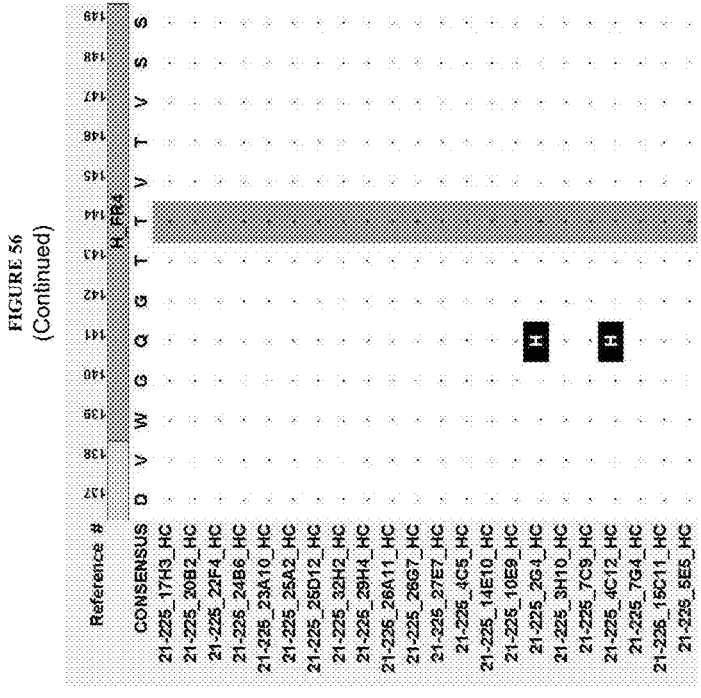
Figure 56:
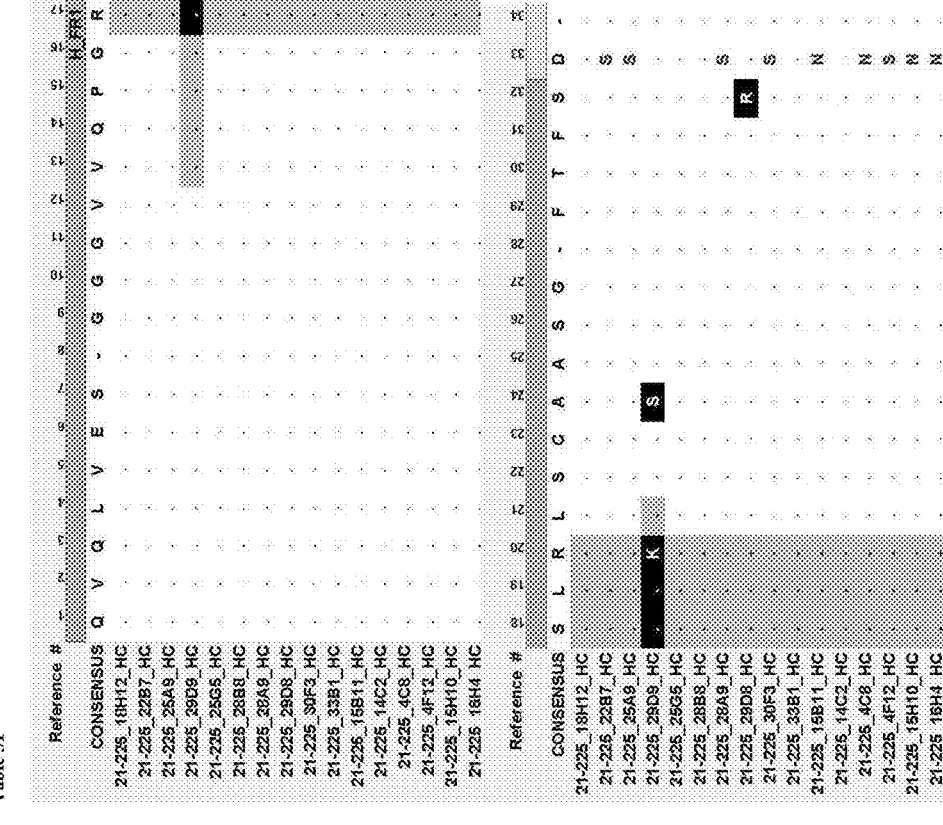
Figure 56:
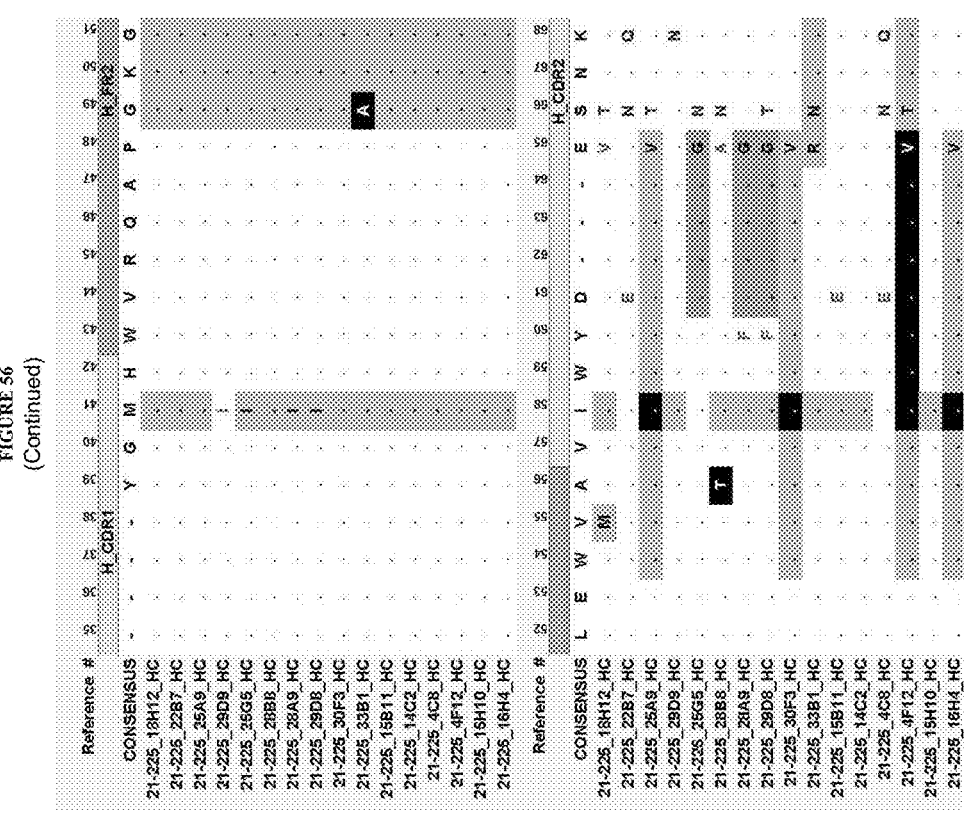
Figure 56:
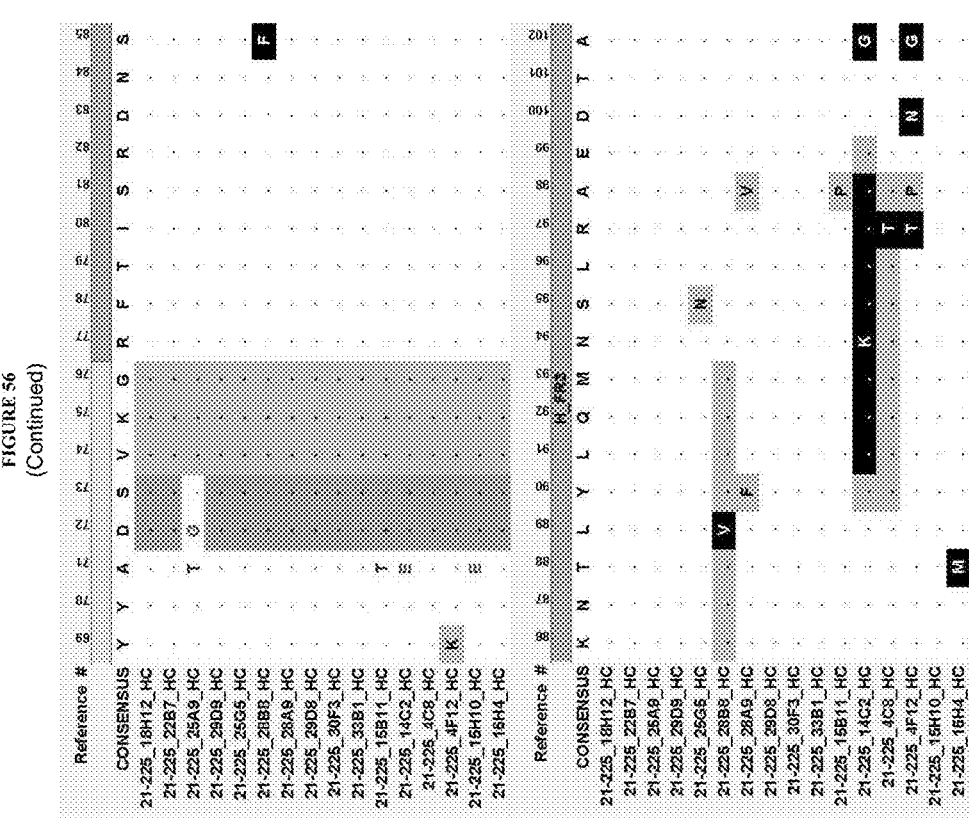
Figure 56:
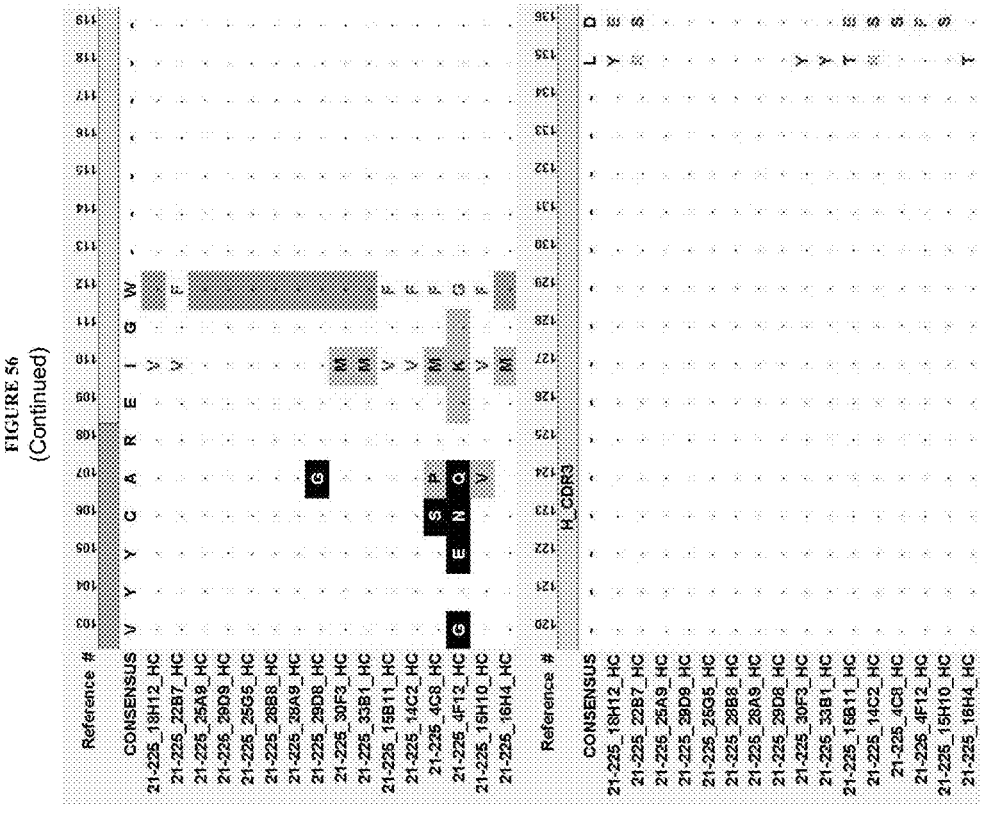
Figure 56:
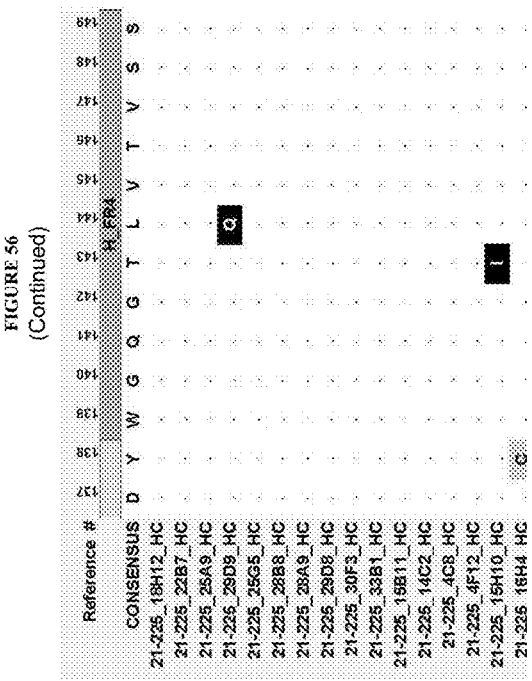
Figure 56:
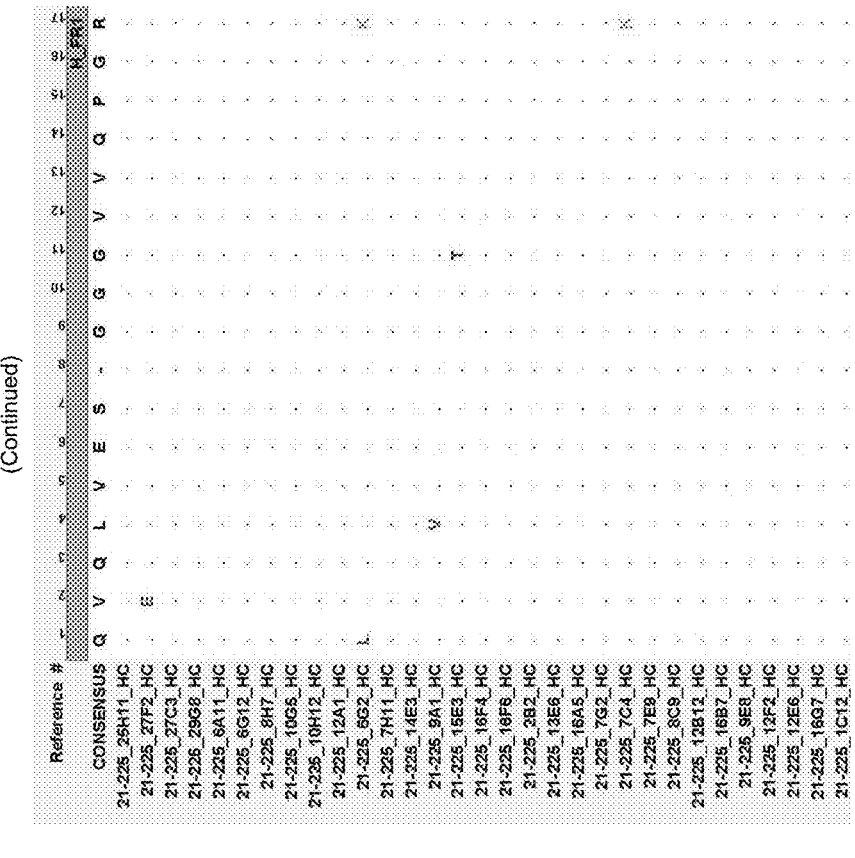
Figure 56:
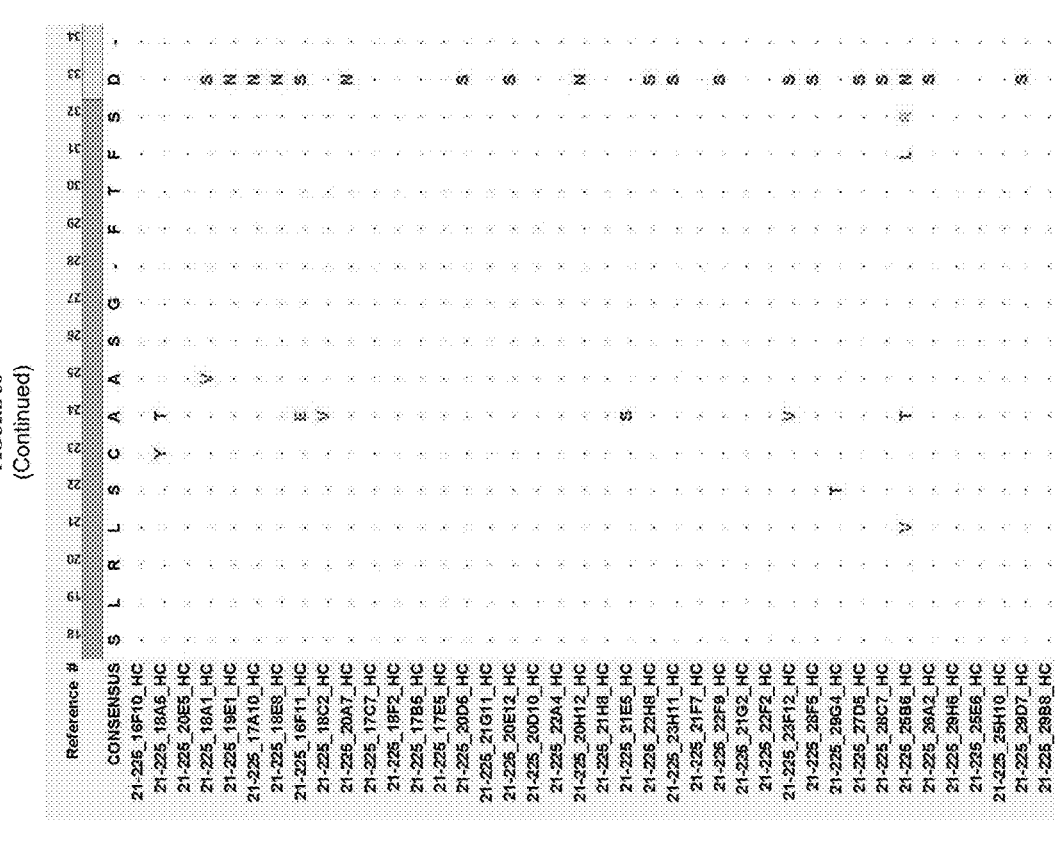
Figure 56:
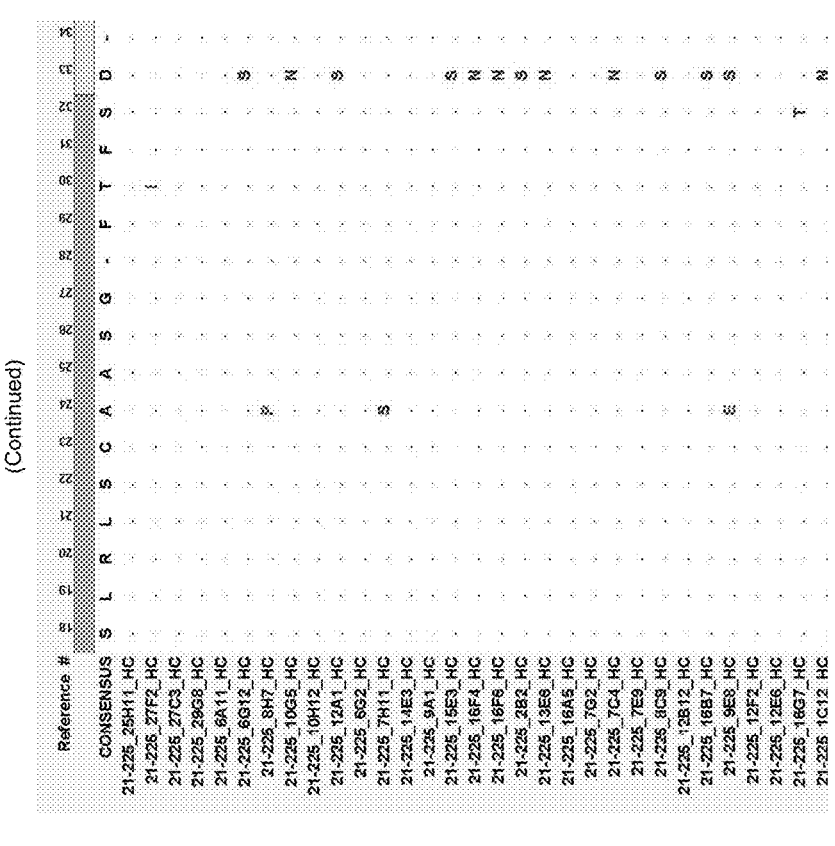
Figure 56:
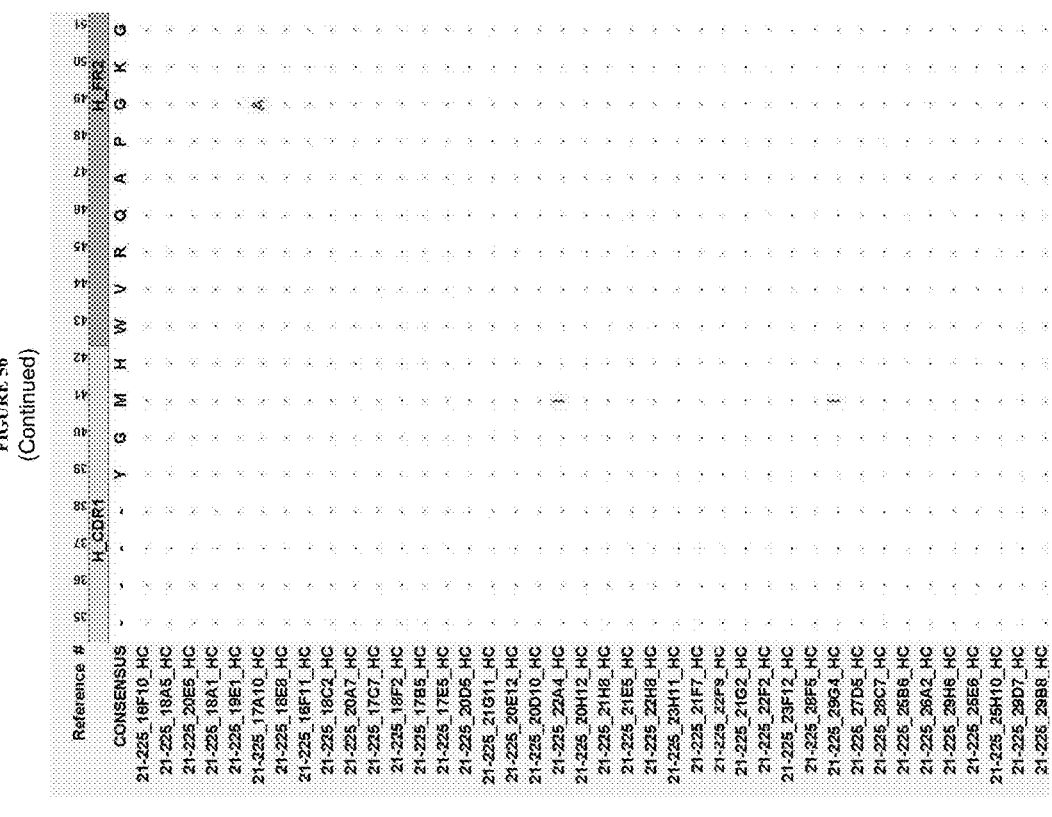
Figure 56:
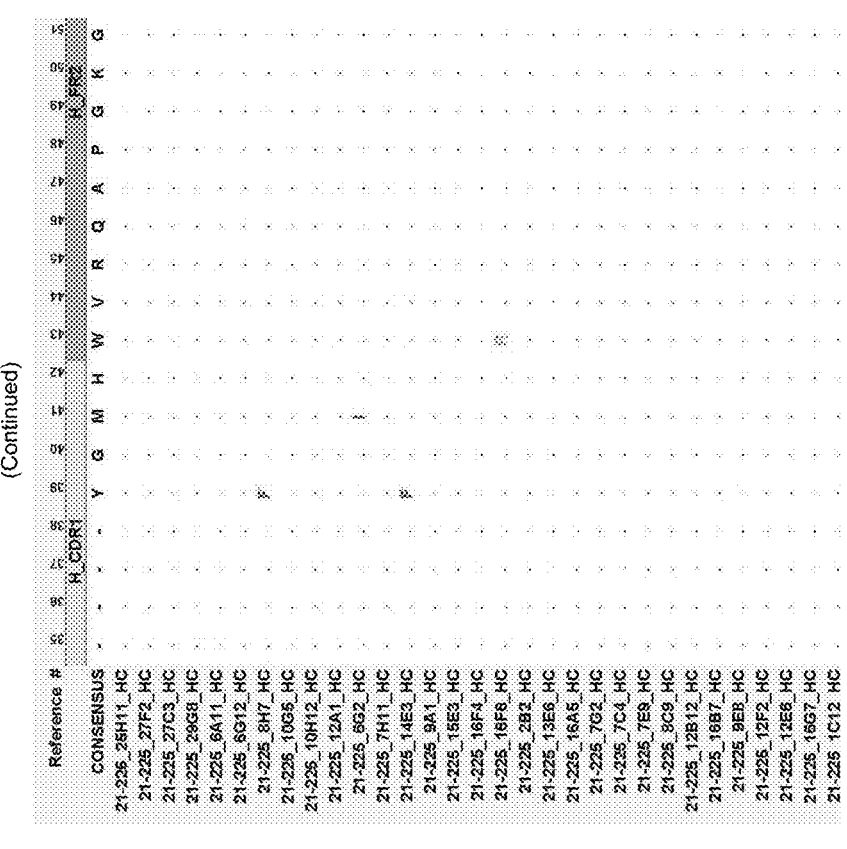
Figure 56:
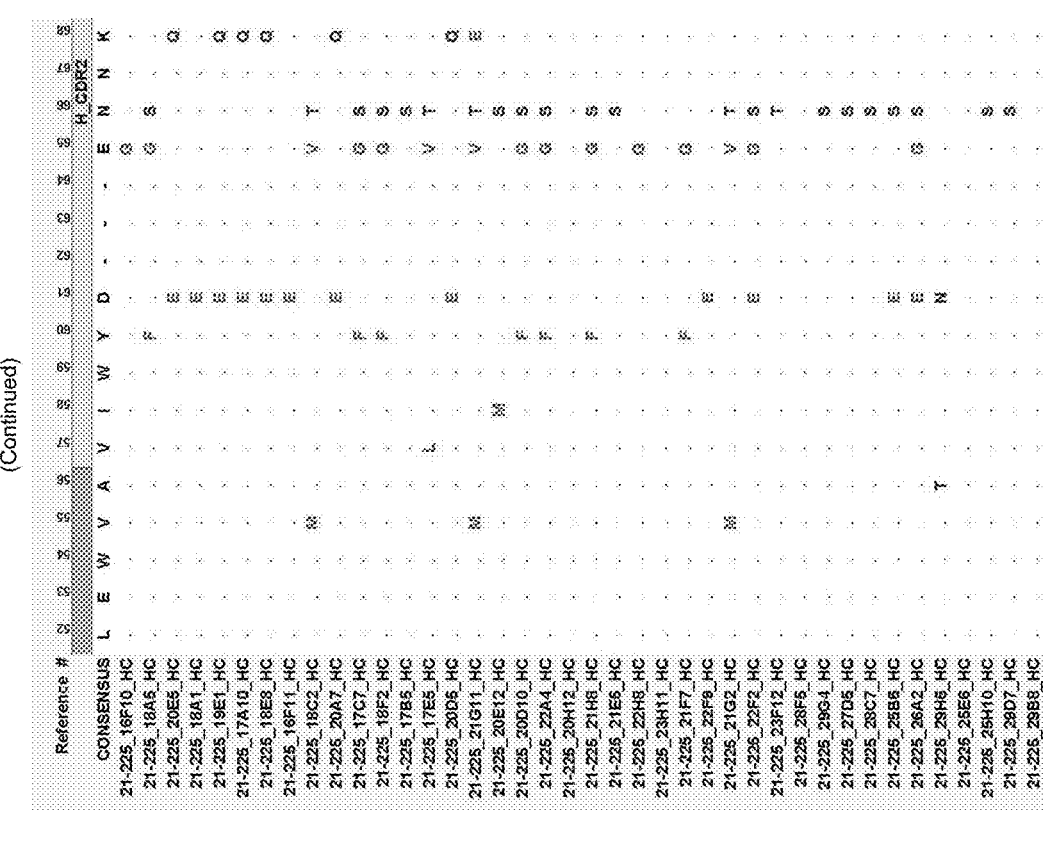
Figure 56:
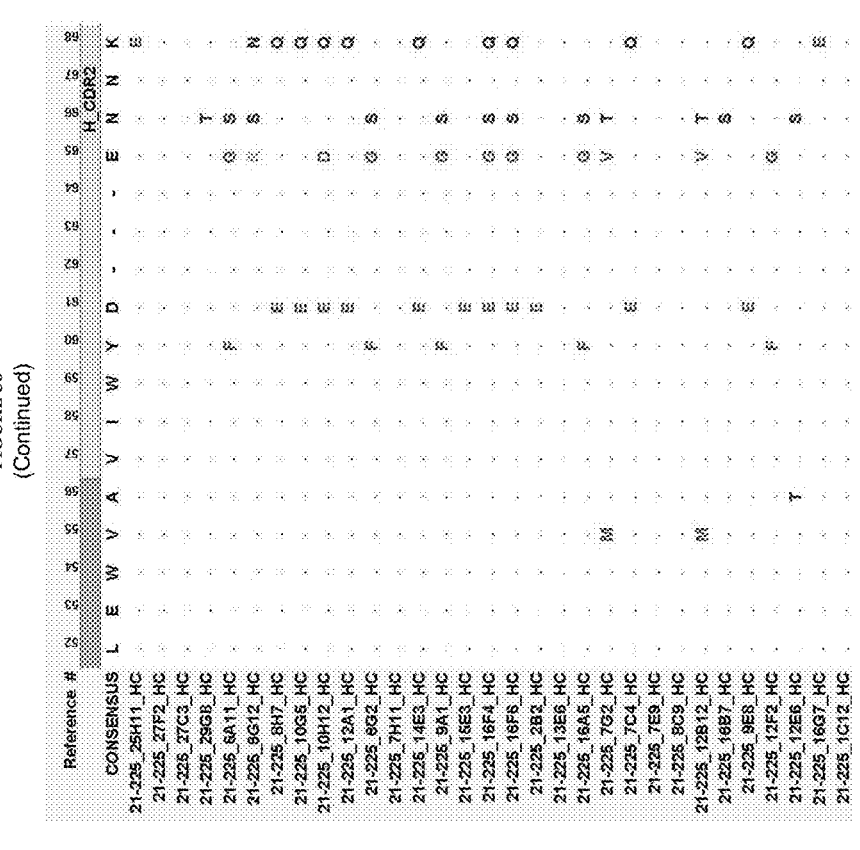
Figure 56:
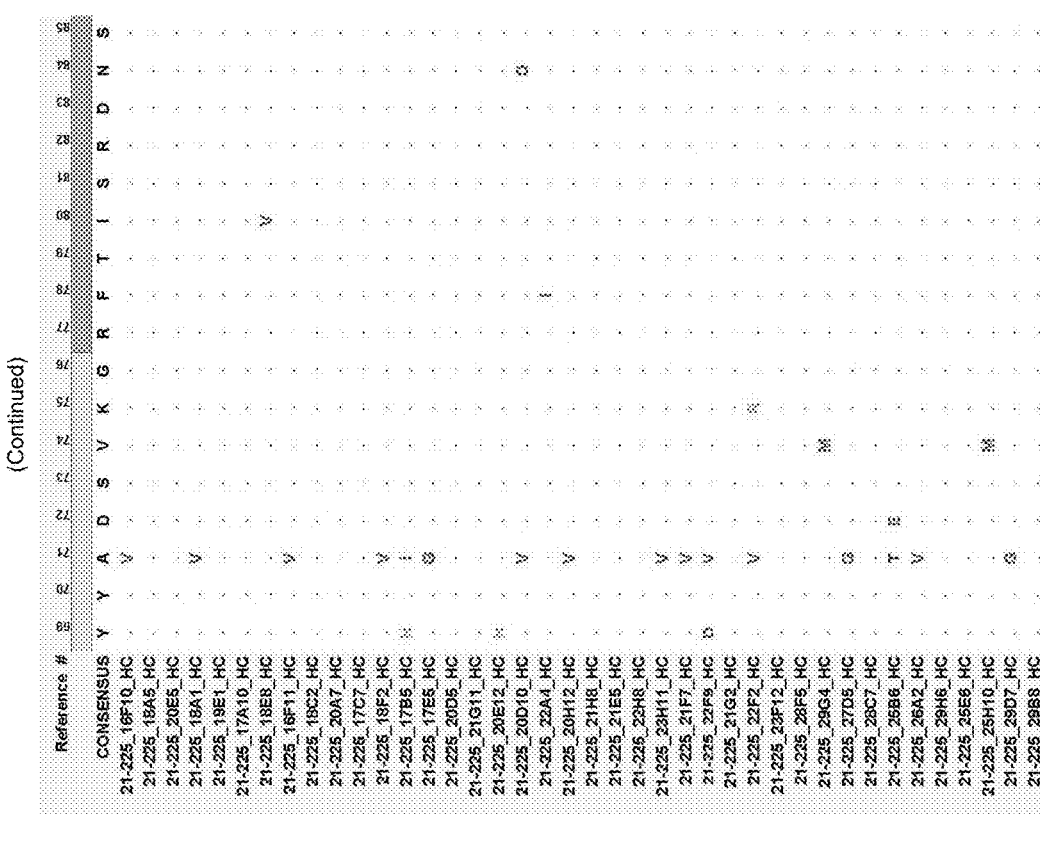
Figure 56:
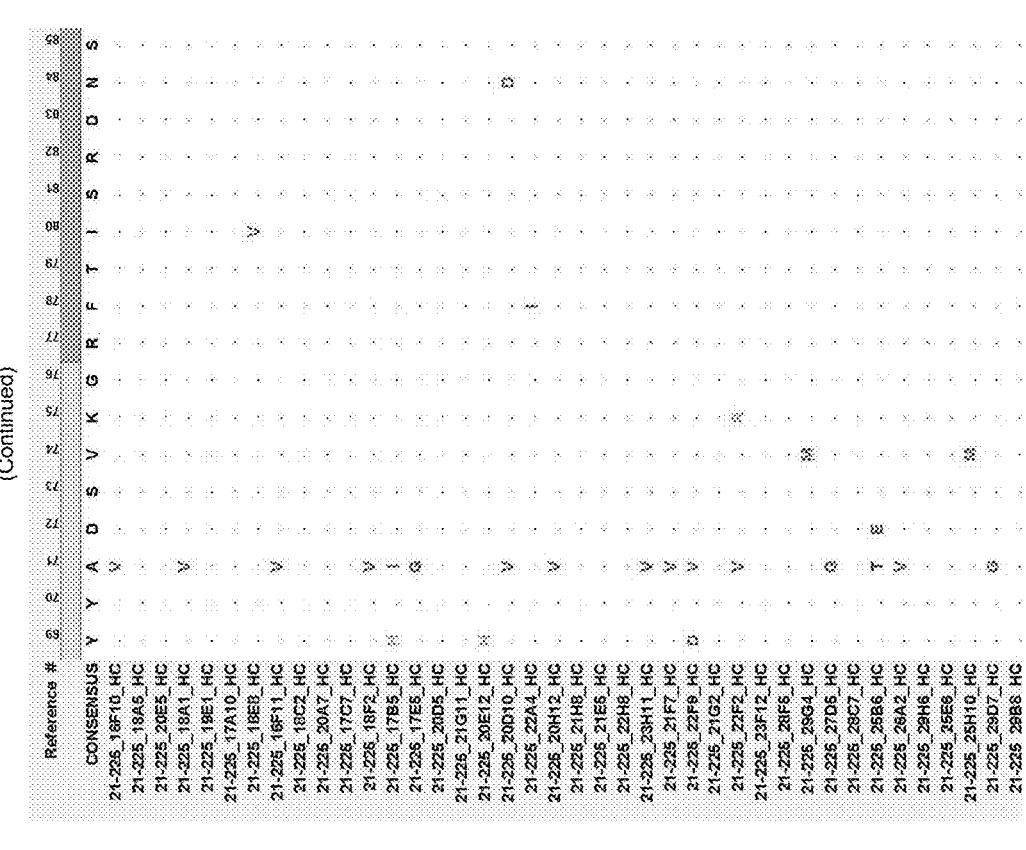
Figure 56:
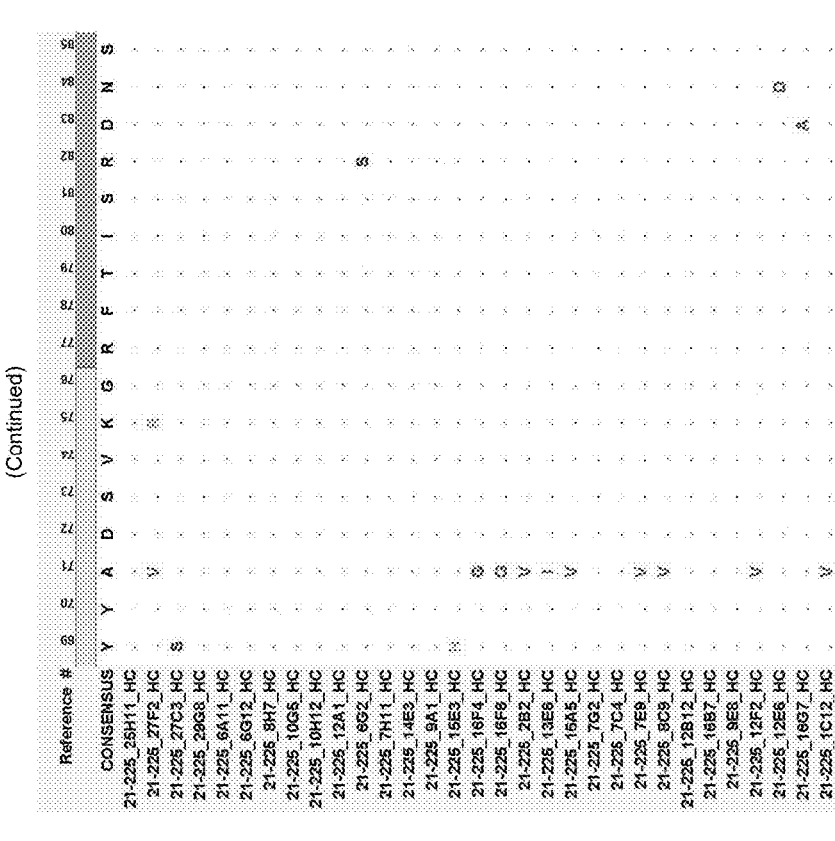
Figure 56:
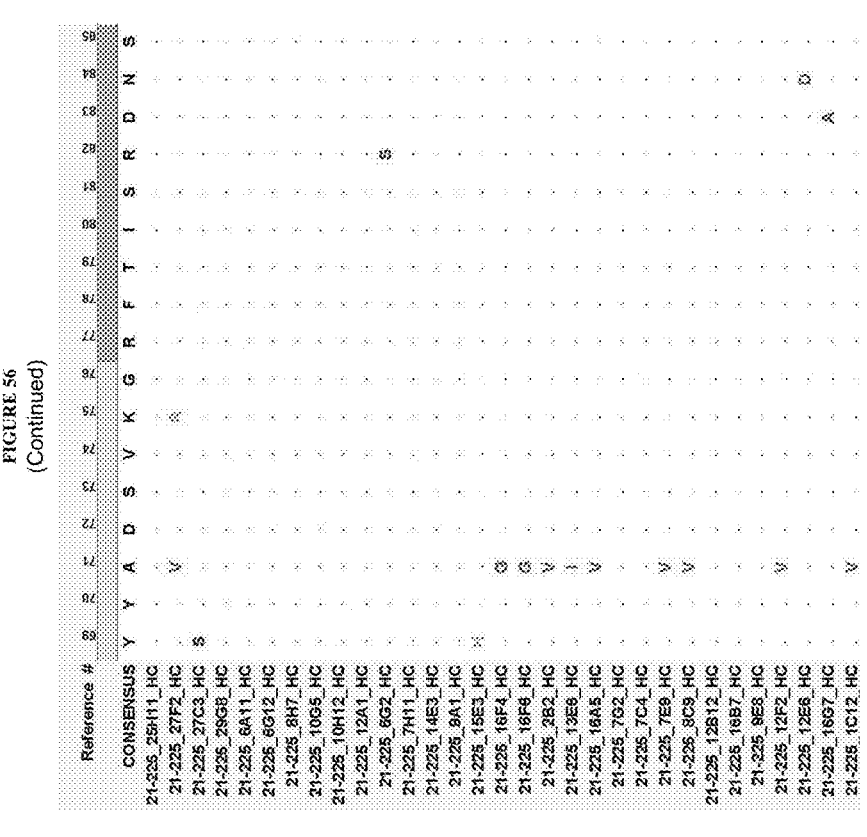
Figure 56:
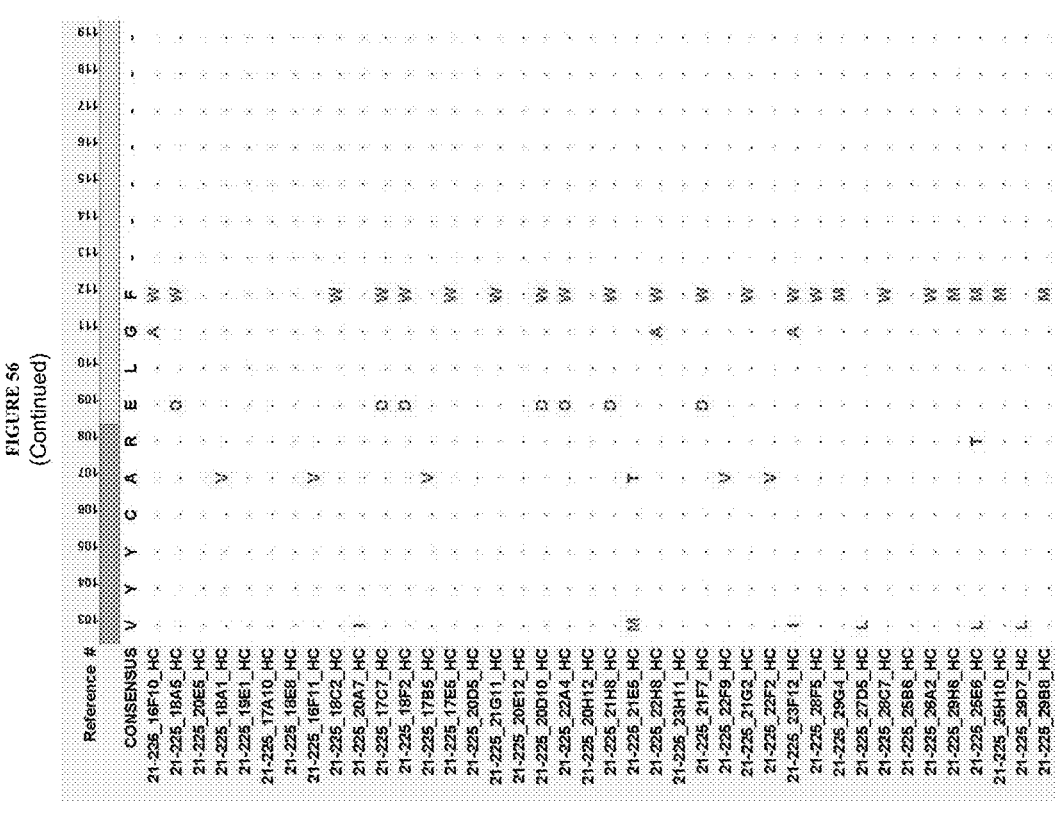
Figure 56:
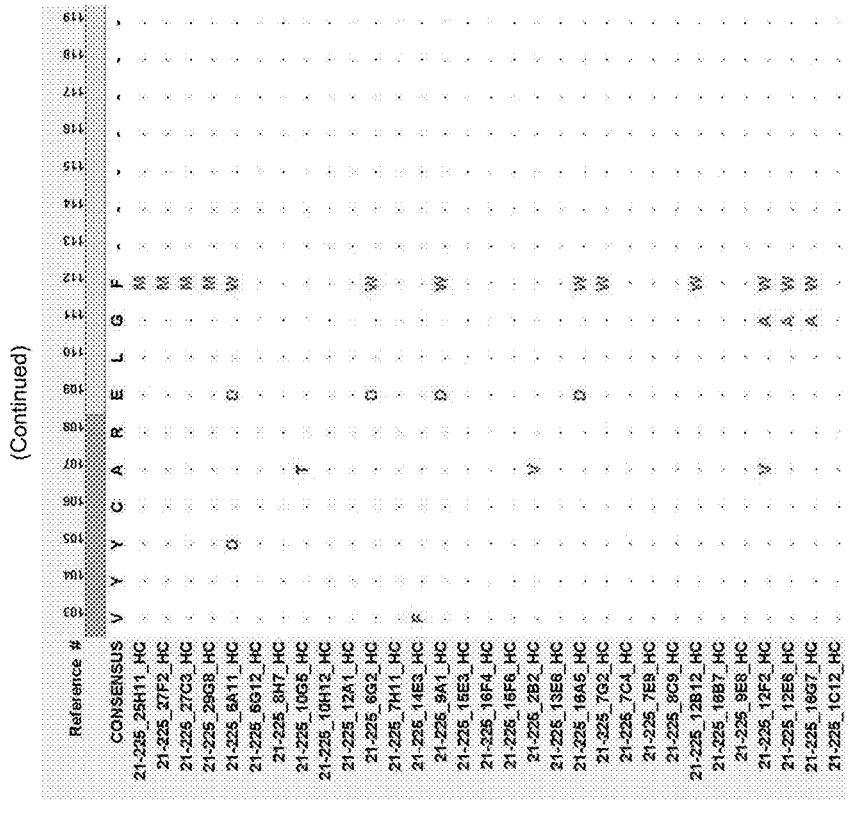
Figure 56:
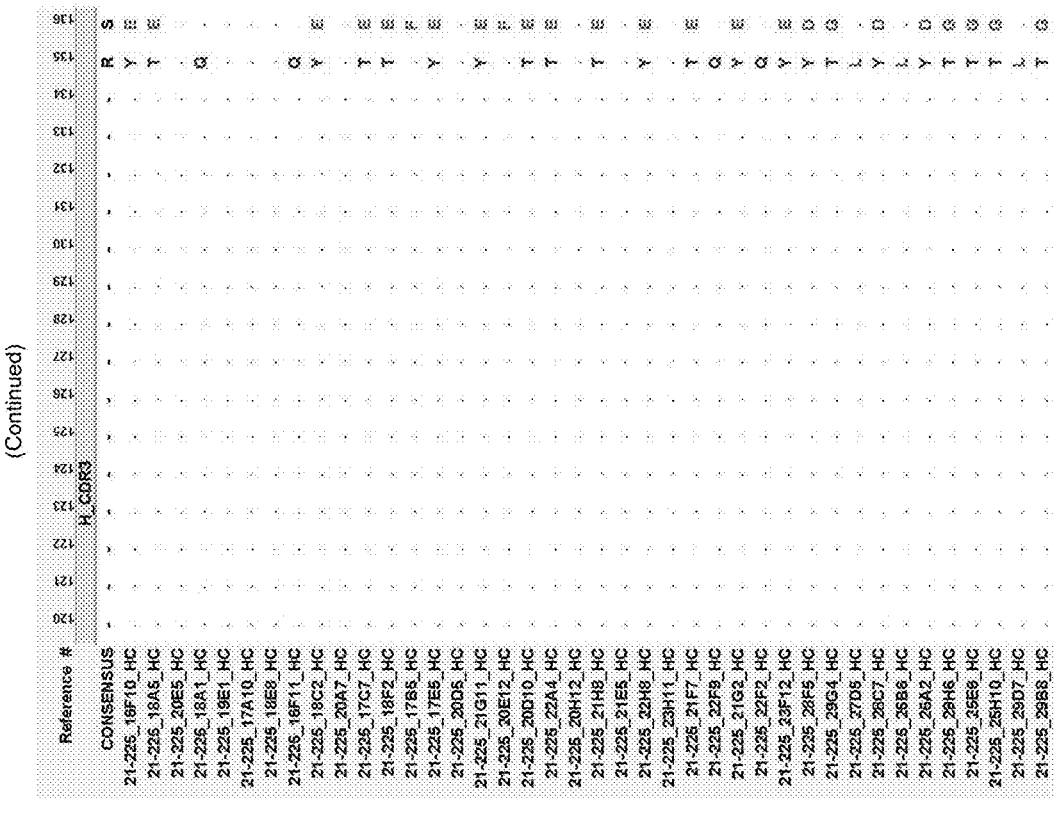
Figure 56:
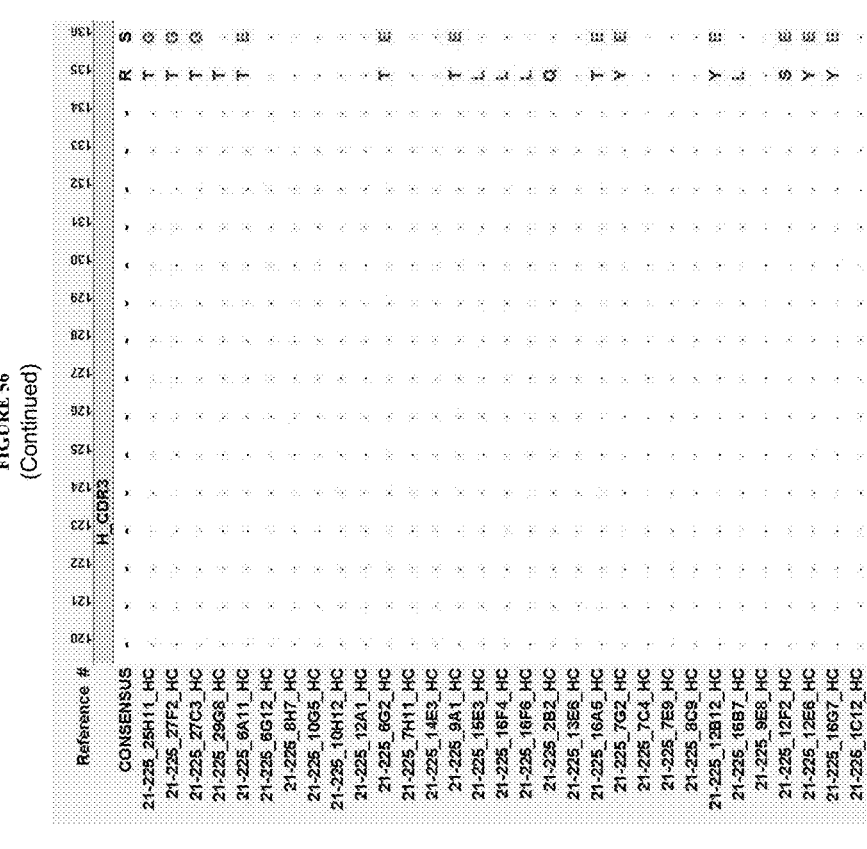
Figure 56:
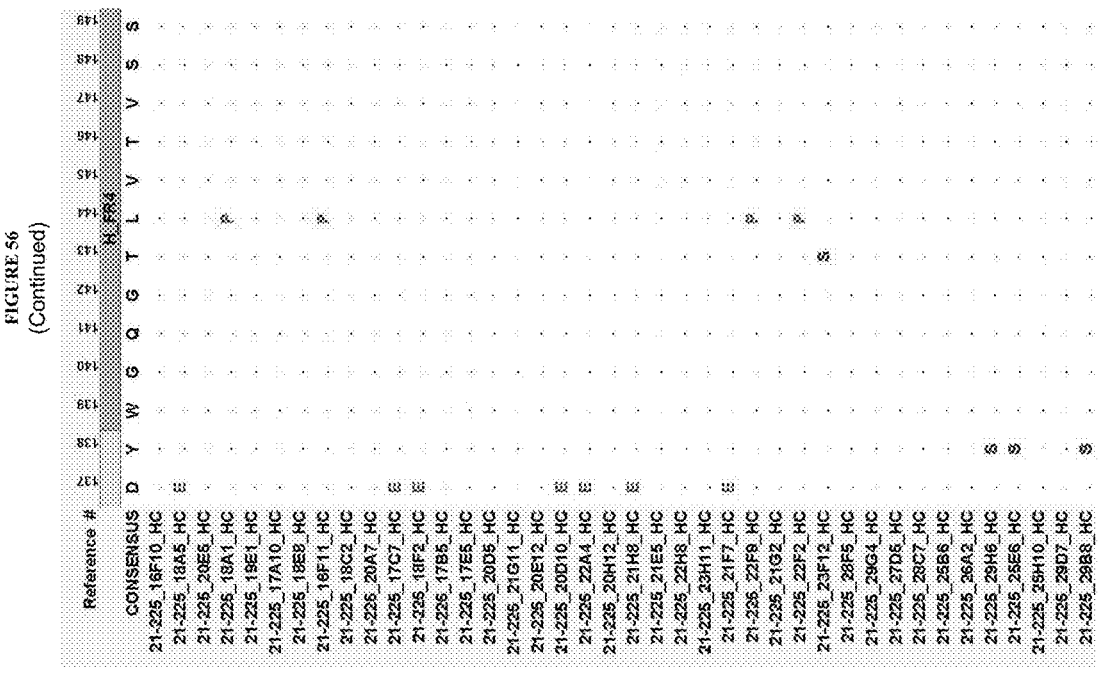
Figure 56:
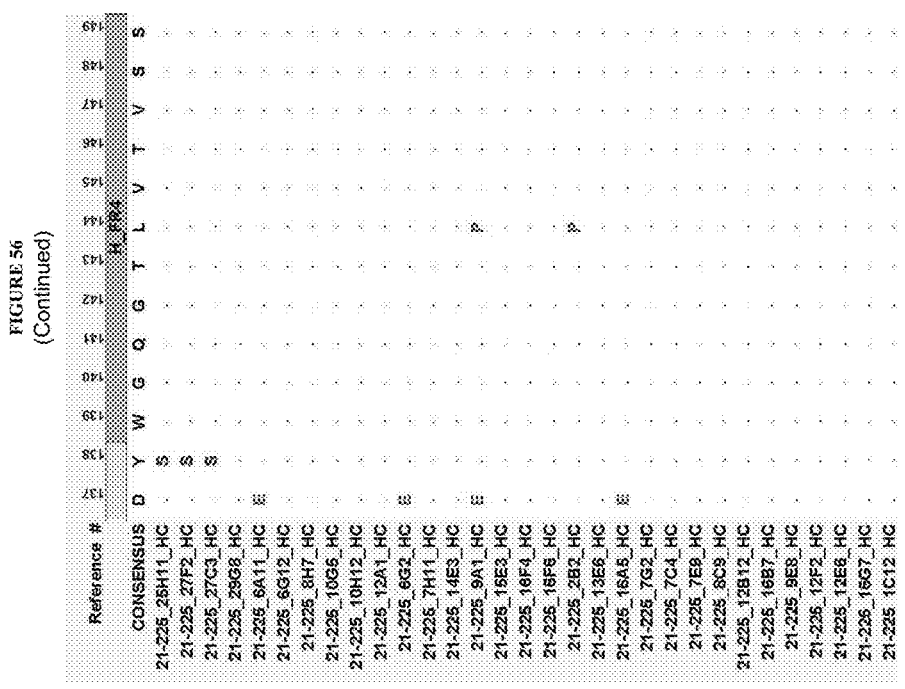
Figure 56:
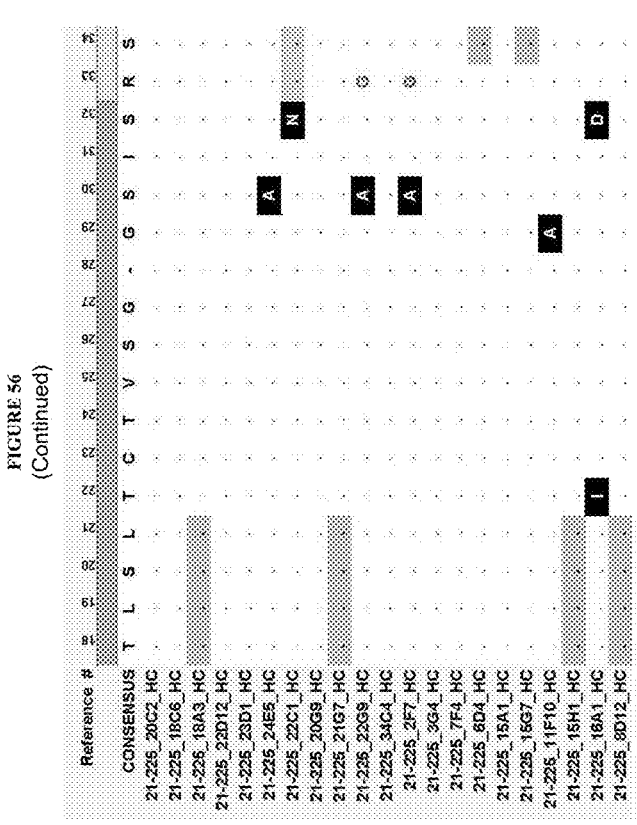
Figure 56:
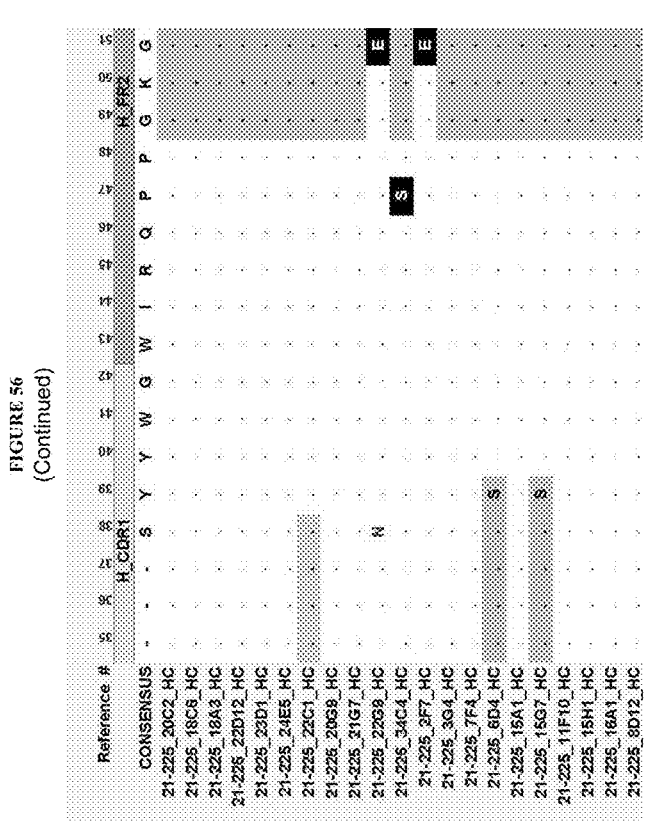
Figure 56:
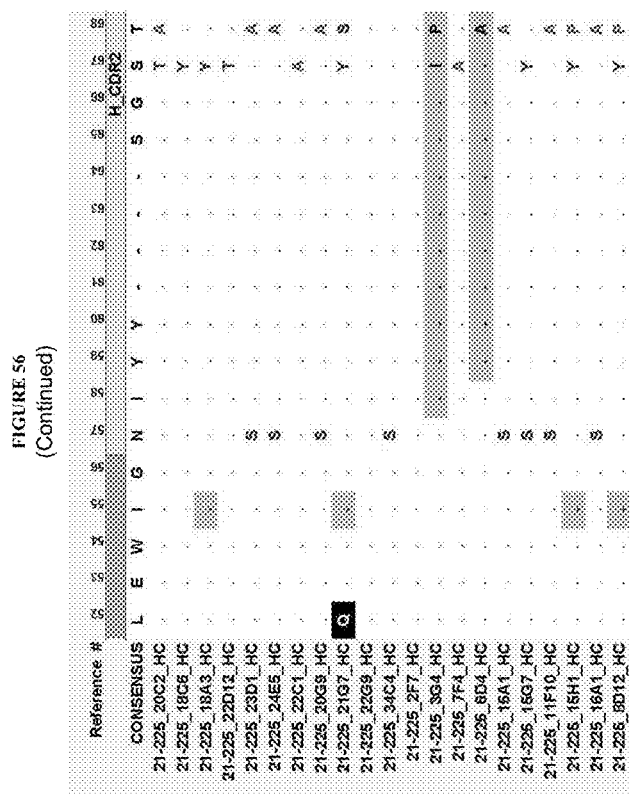
Figure 56:
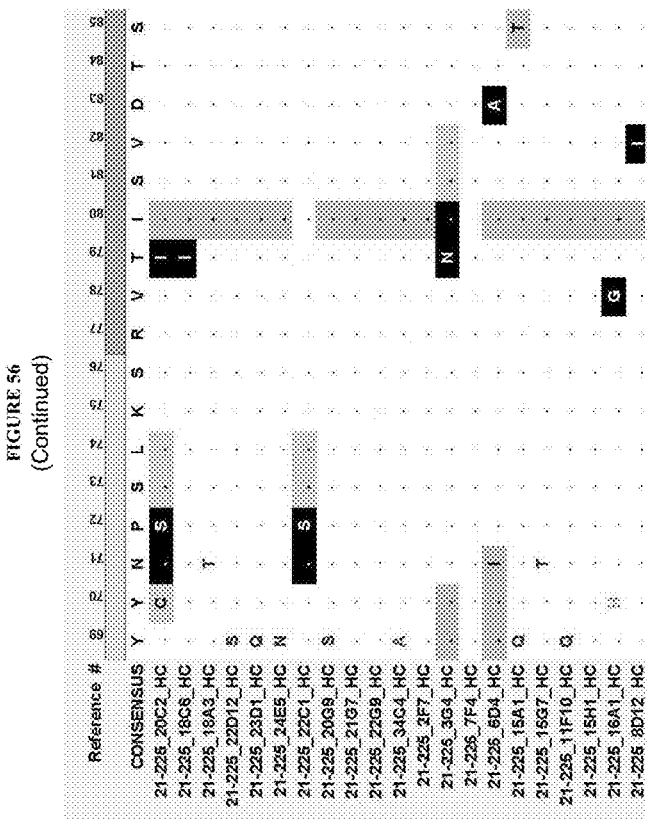
Figure 56:
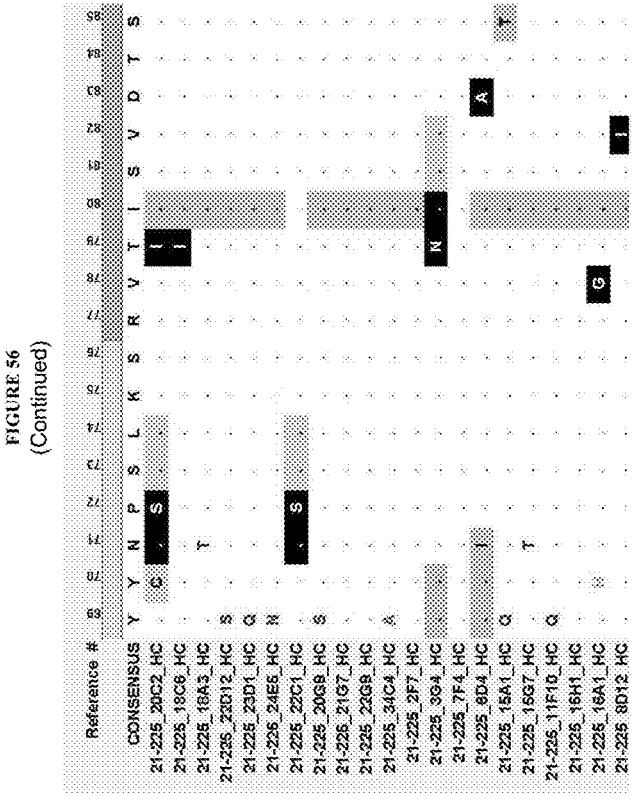
Figure 56:
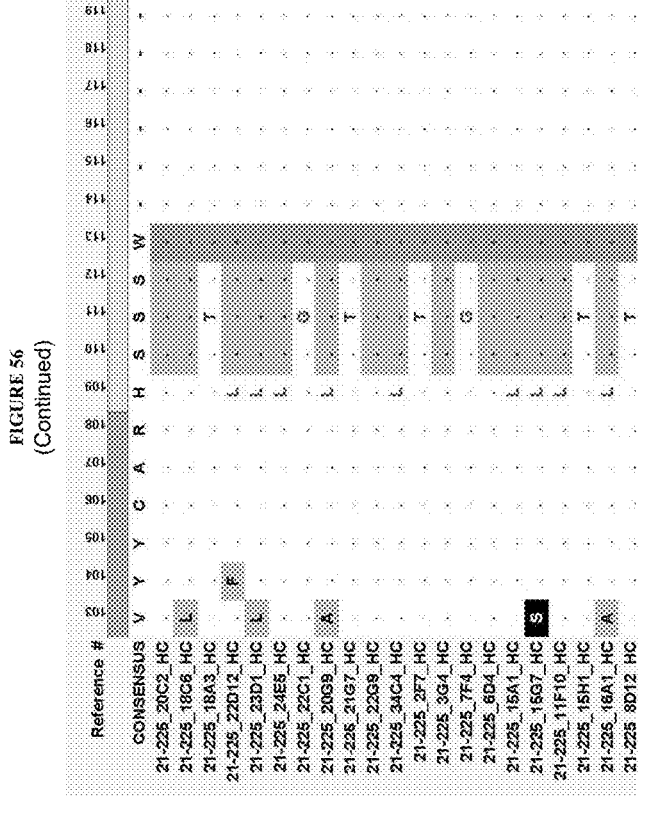
Figure 56:
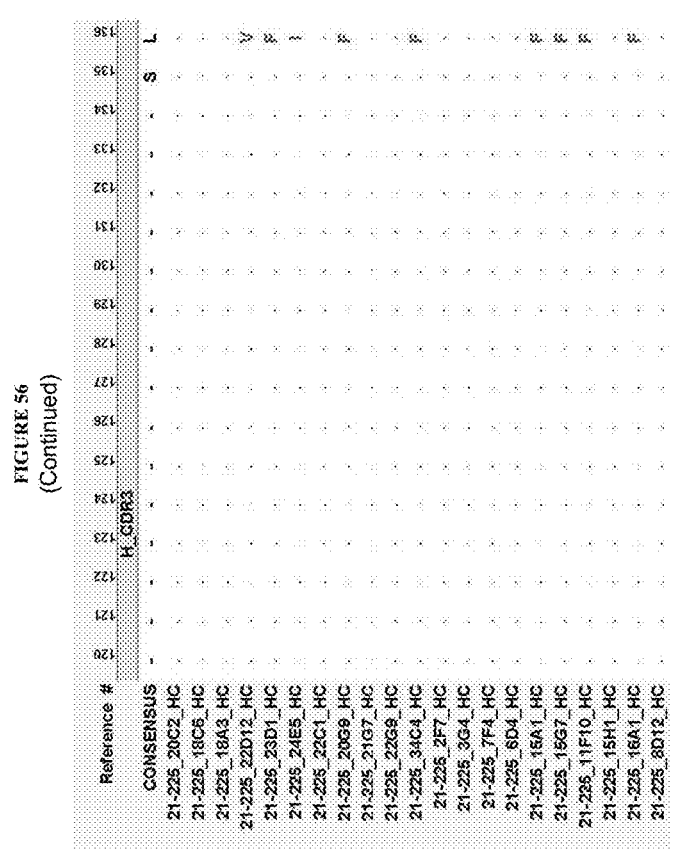
Figure 56:
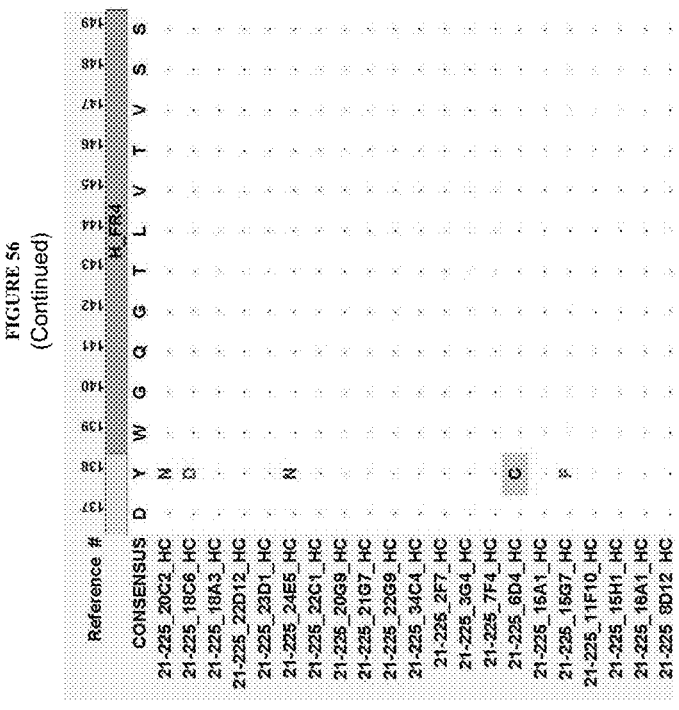
Figure 56:
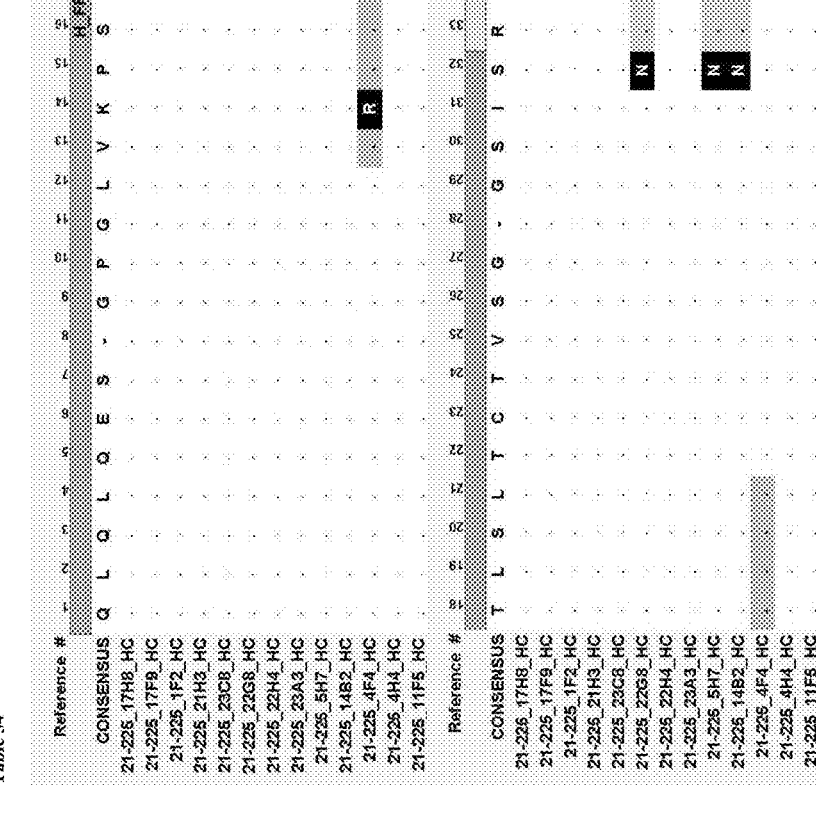
Figure 56:
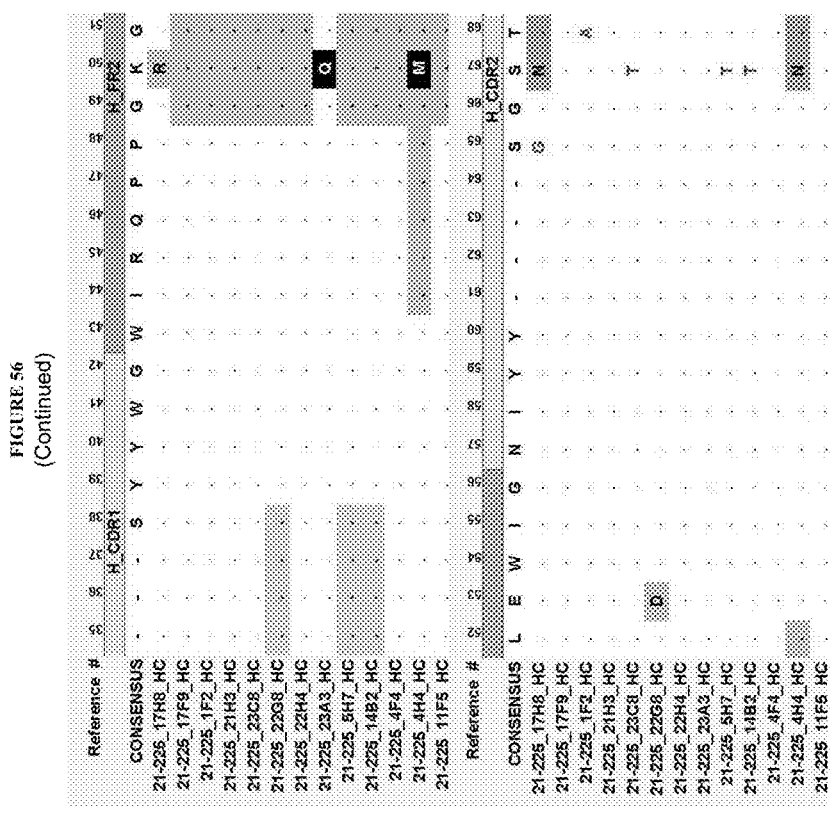
Figure 56:
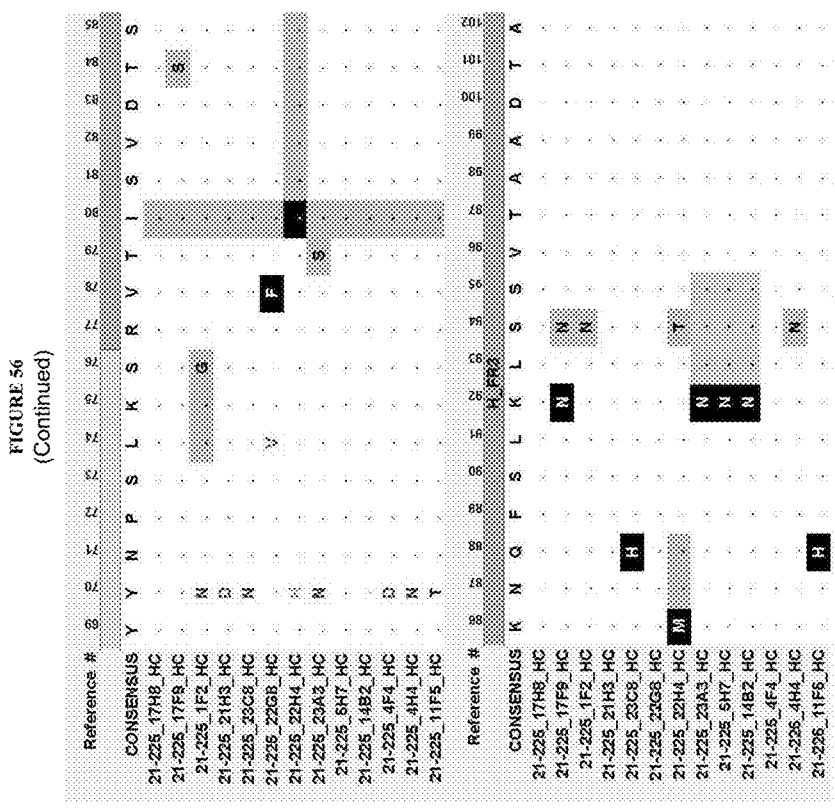
Figure 56:
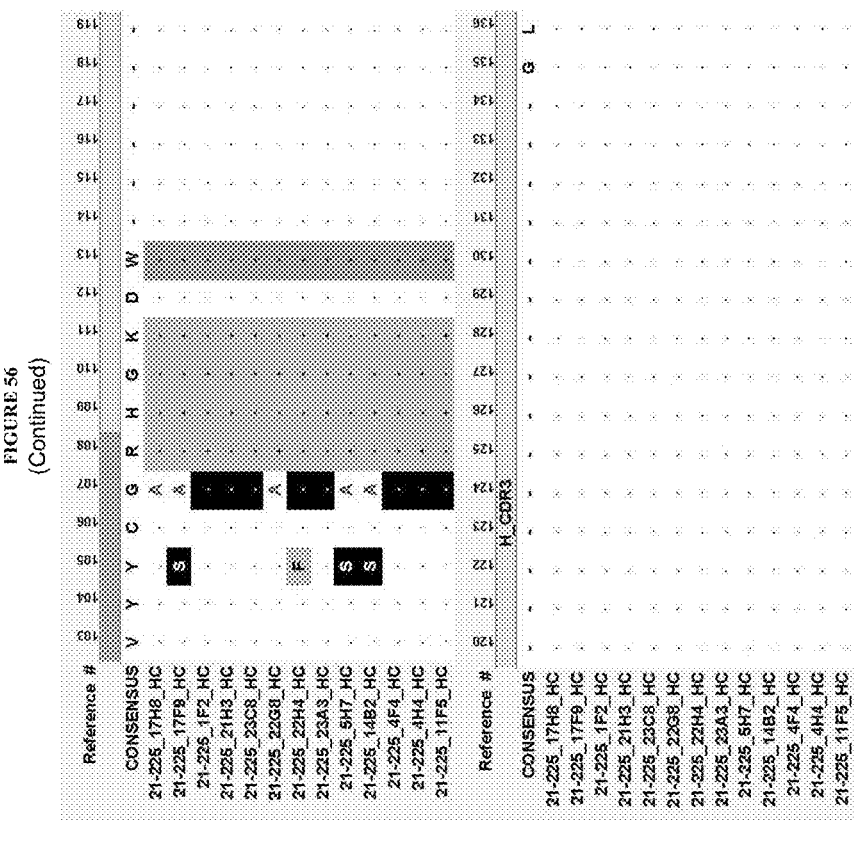
Figure 56:
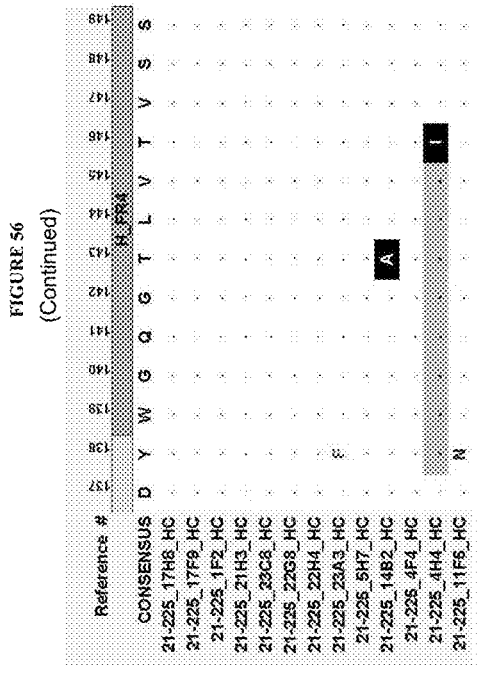
Figure 56:
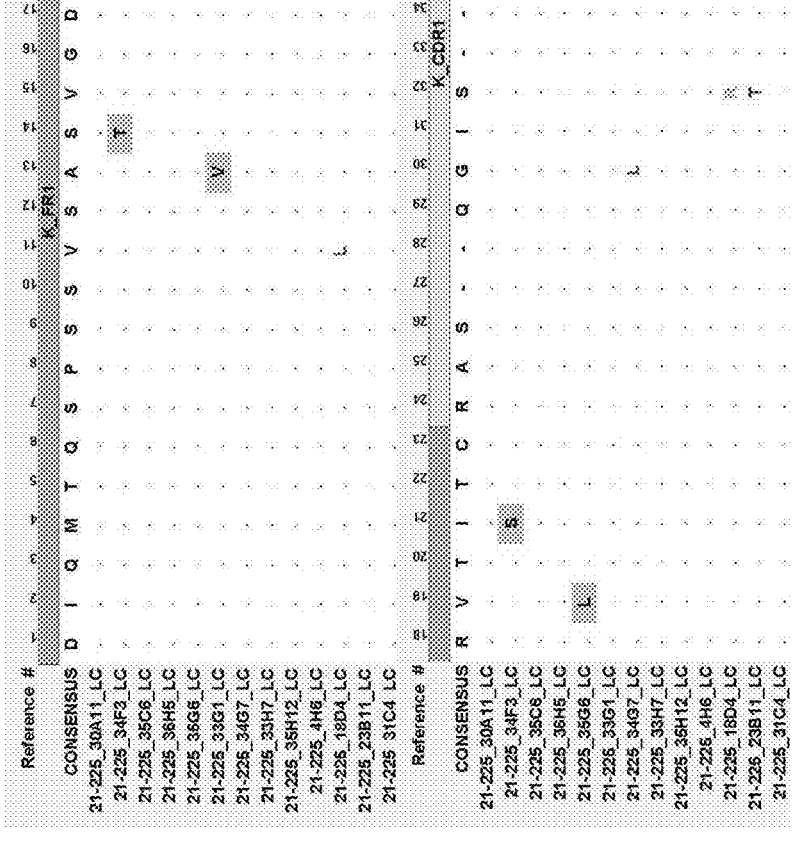
Figure 56:
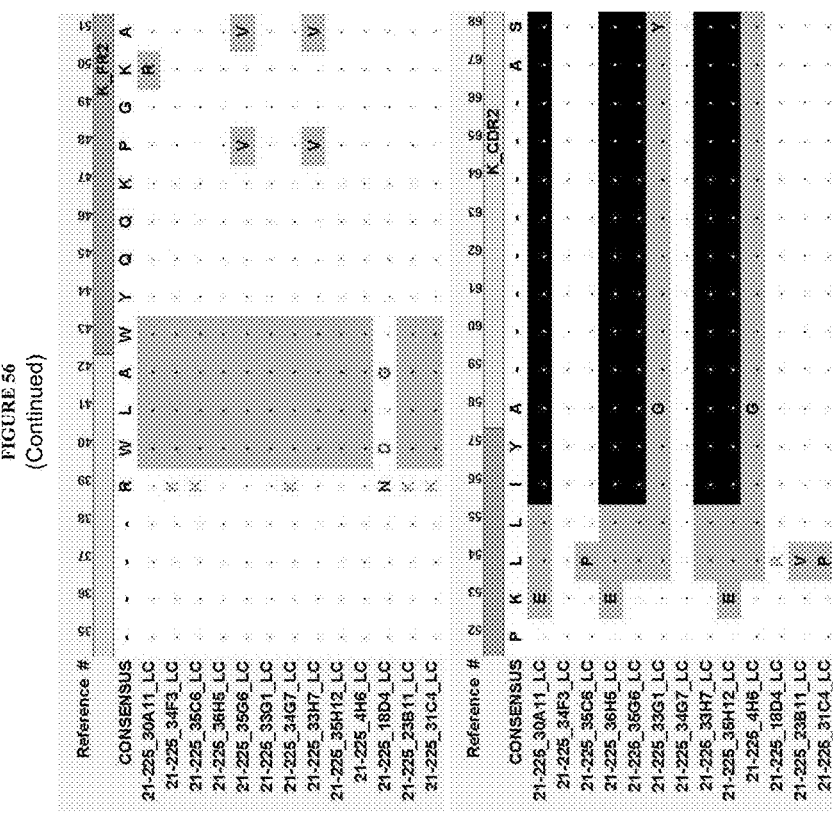
Figure 56:
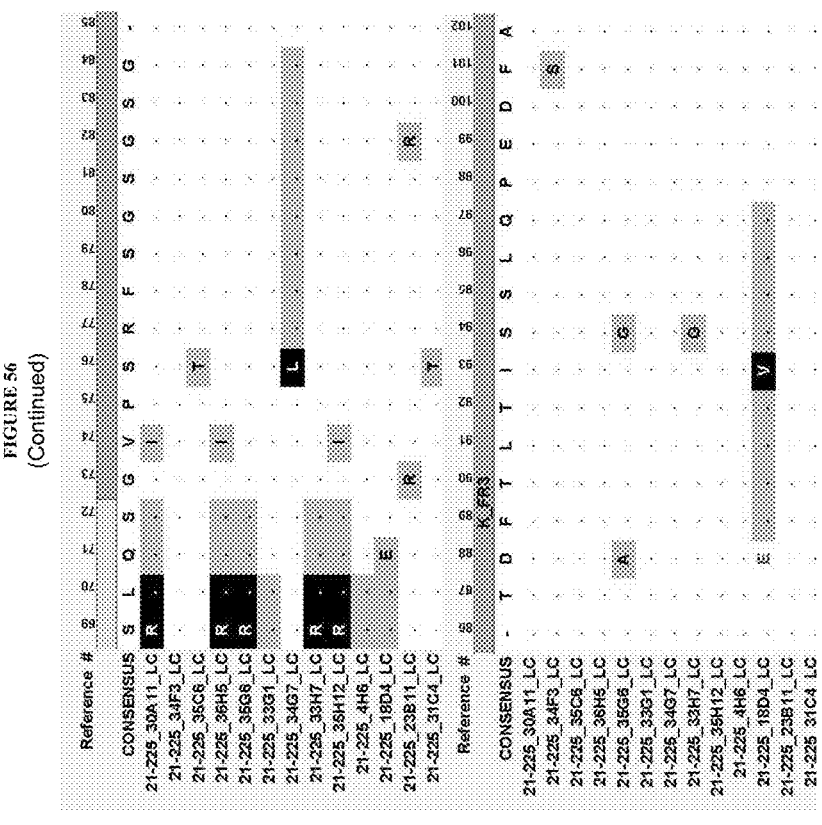
Figure 56:
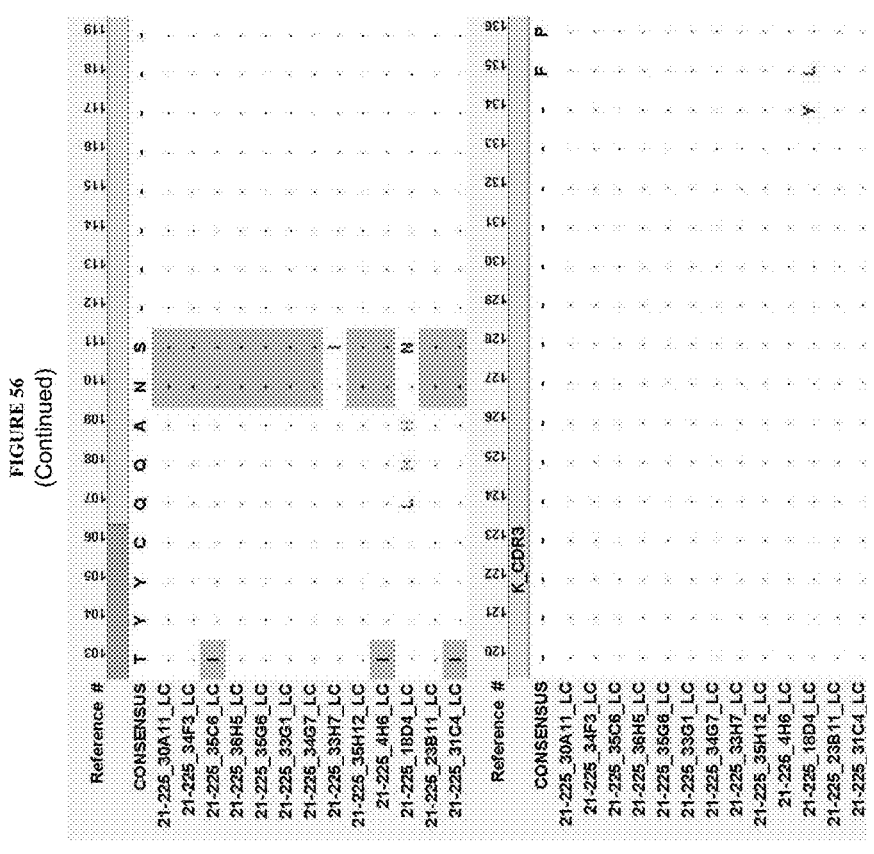
Figure 56:
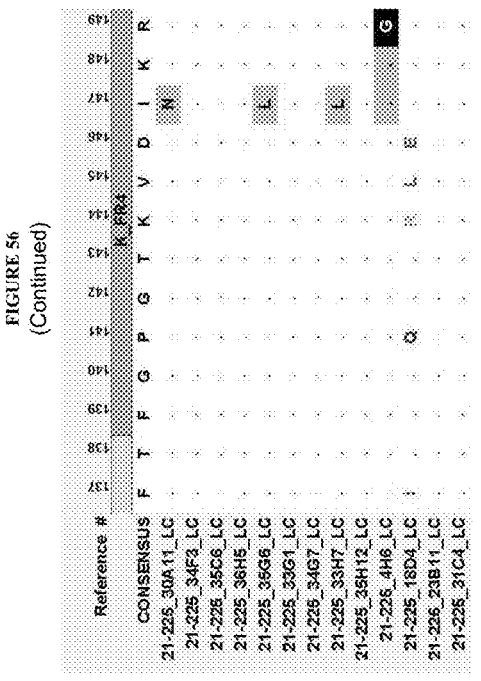
Figure 56:
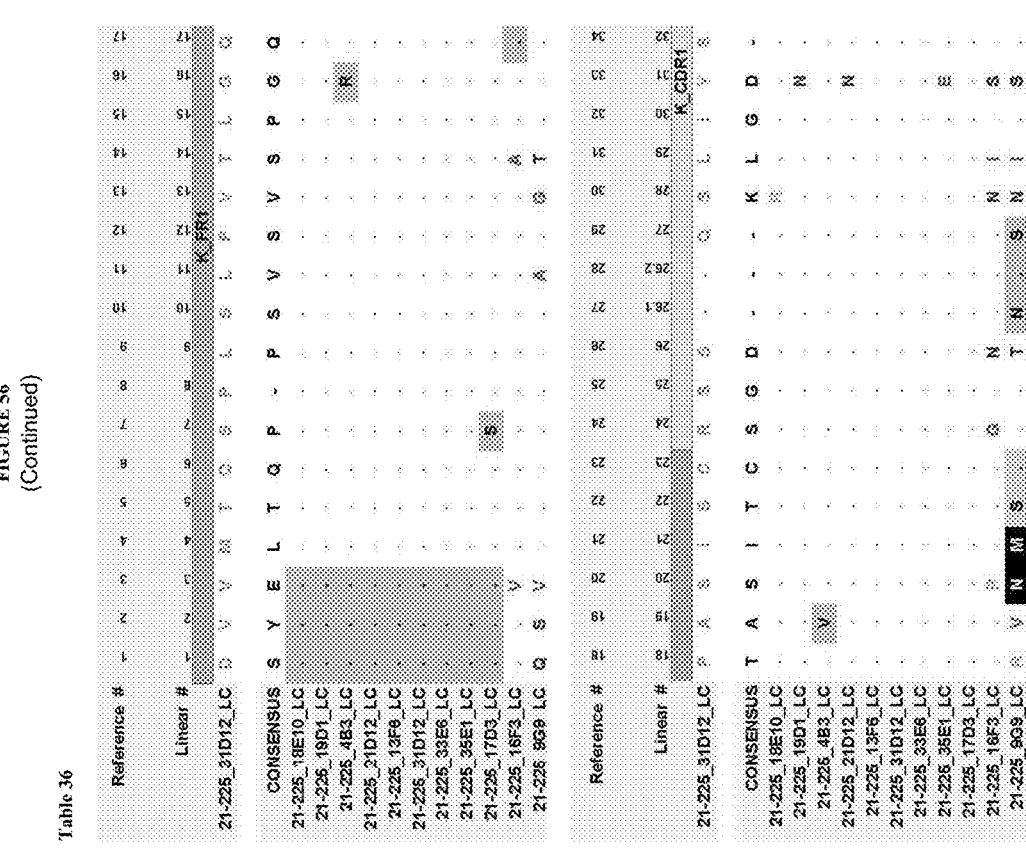
Figure 56:
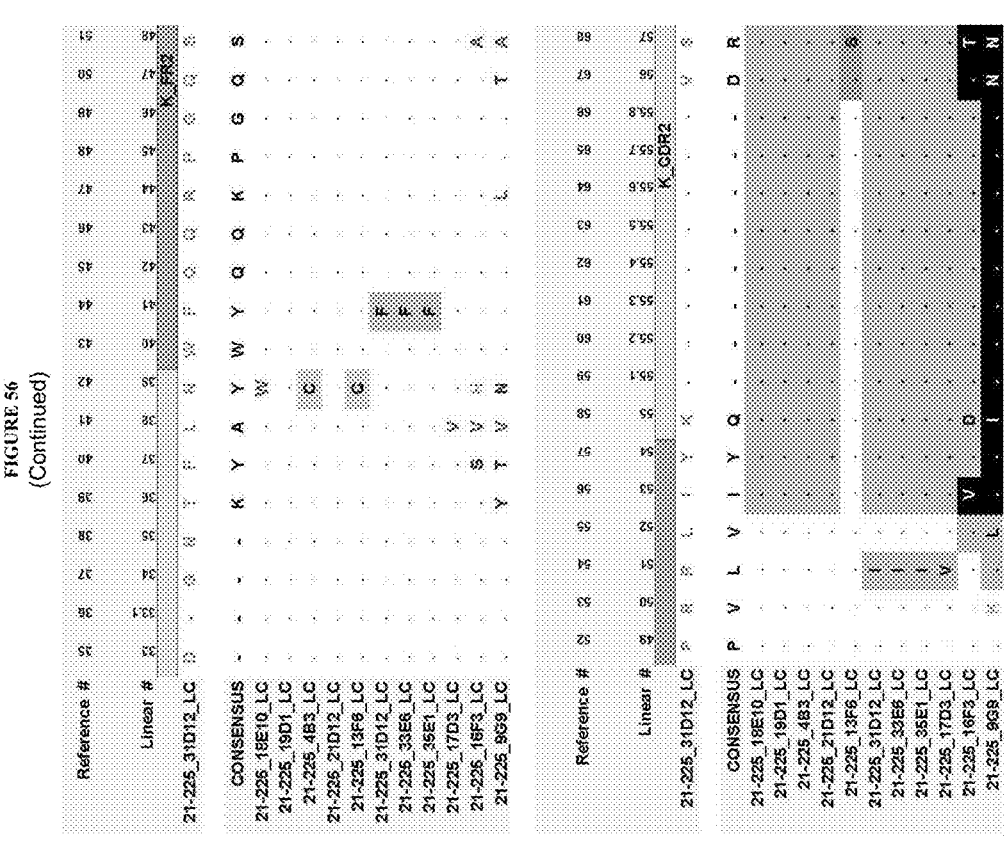
Figure 56:
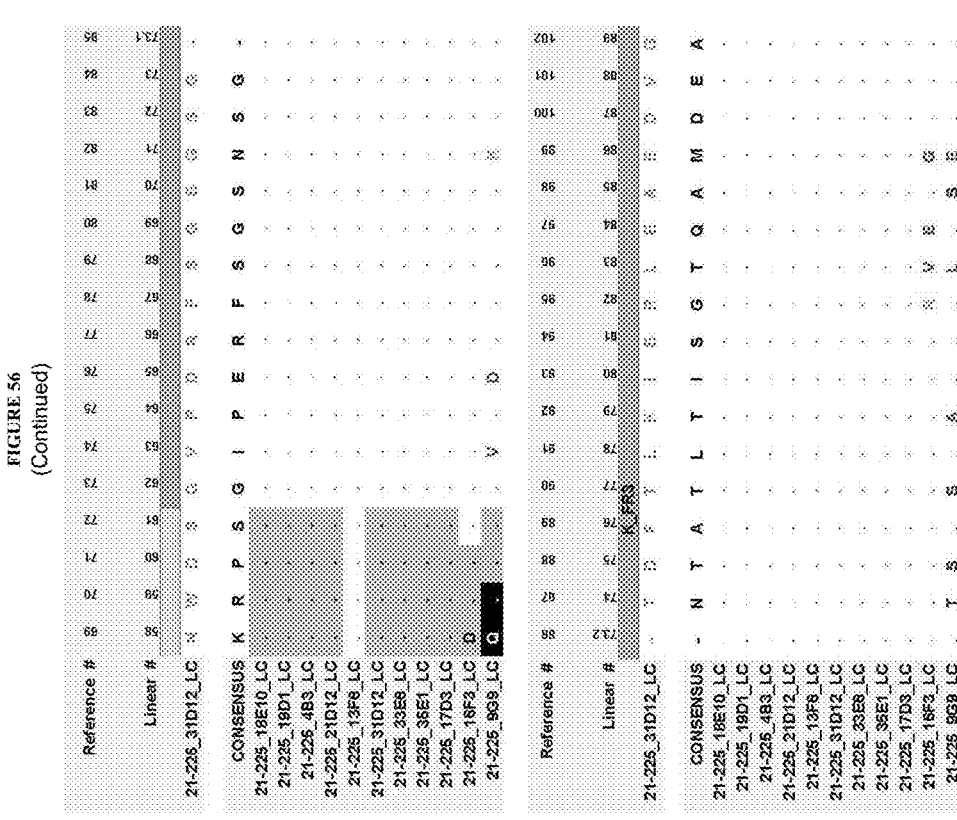
Figure 56:
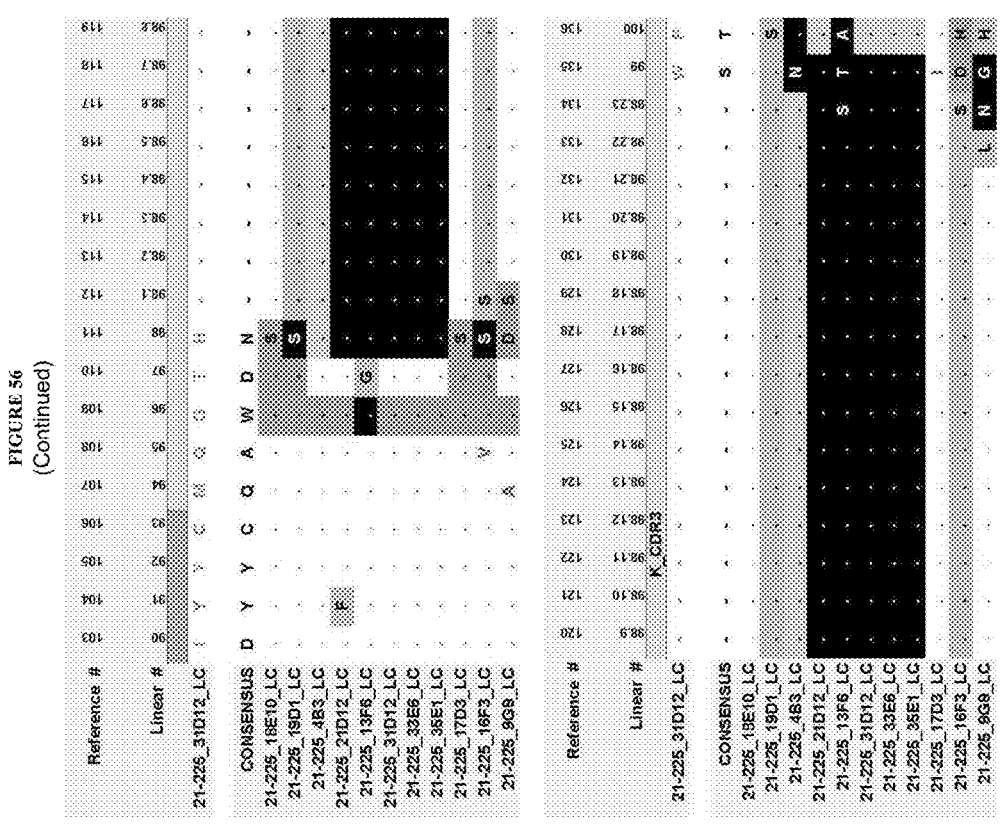
Figure 56:
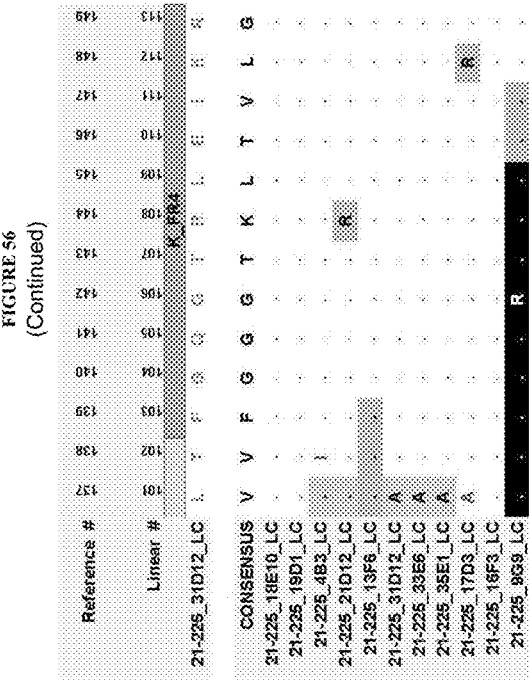
Figure 56:
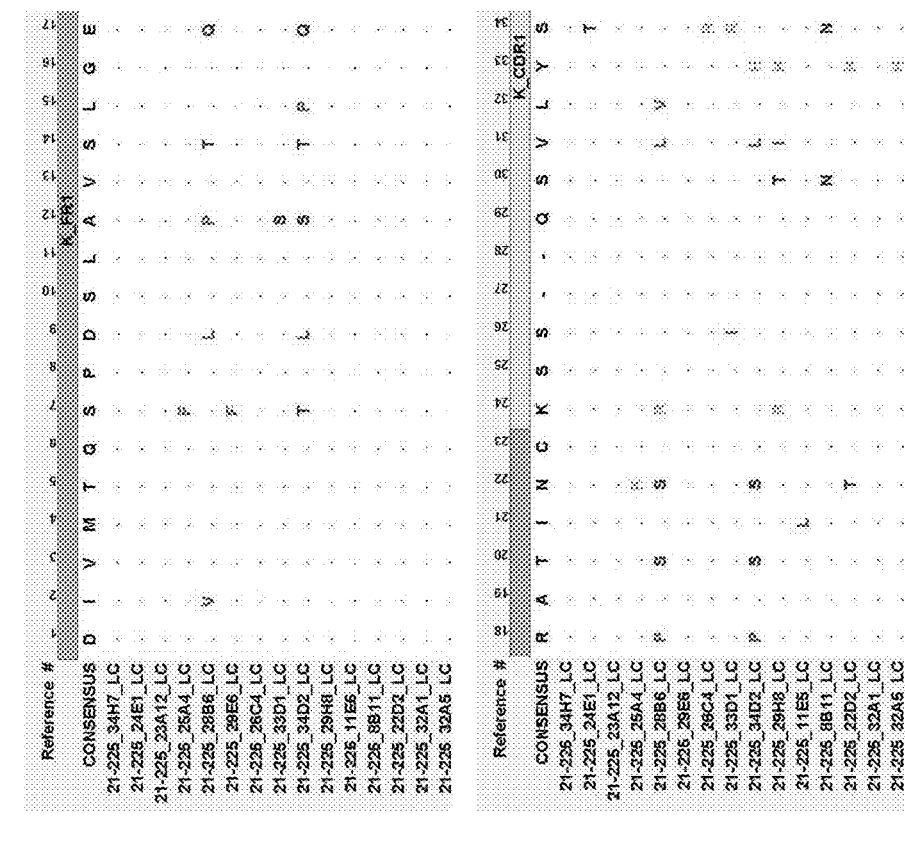
Figure 56:
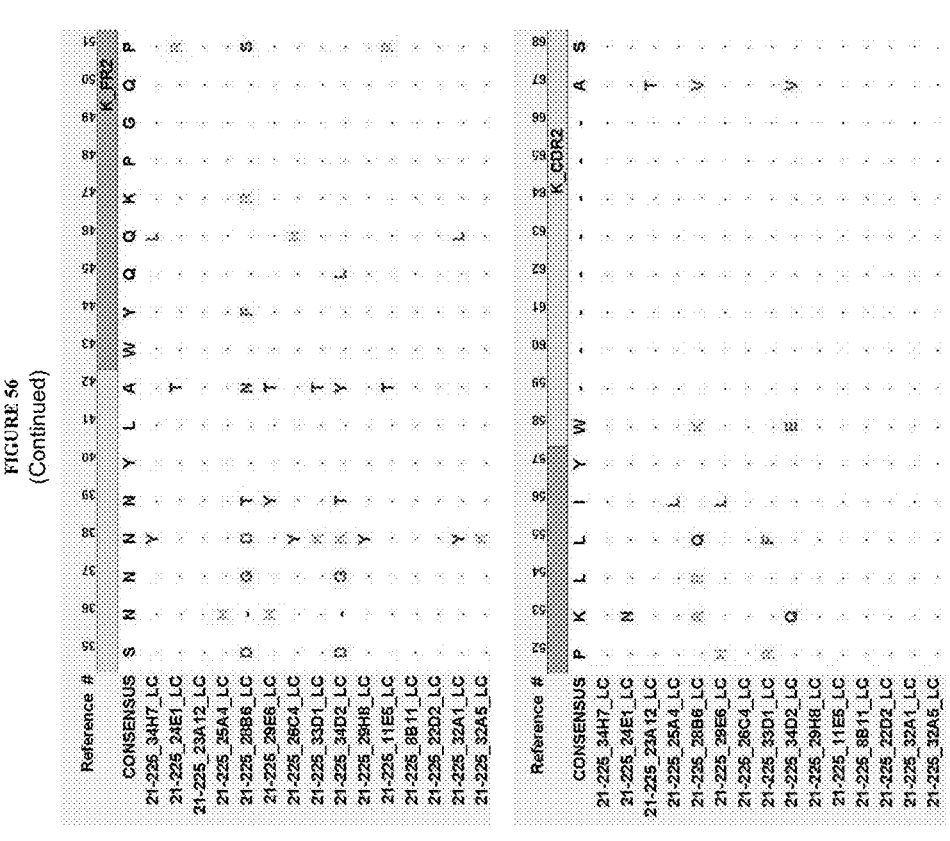
Figure 56:
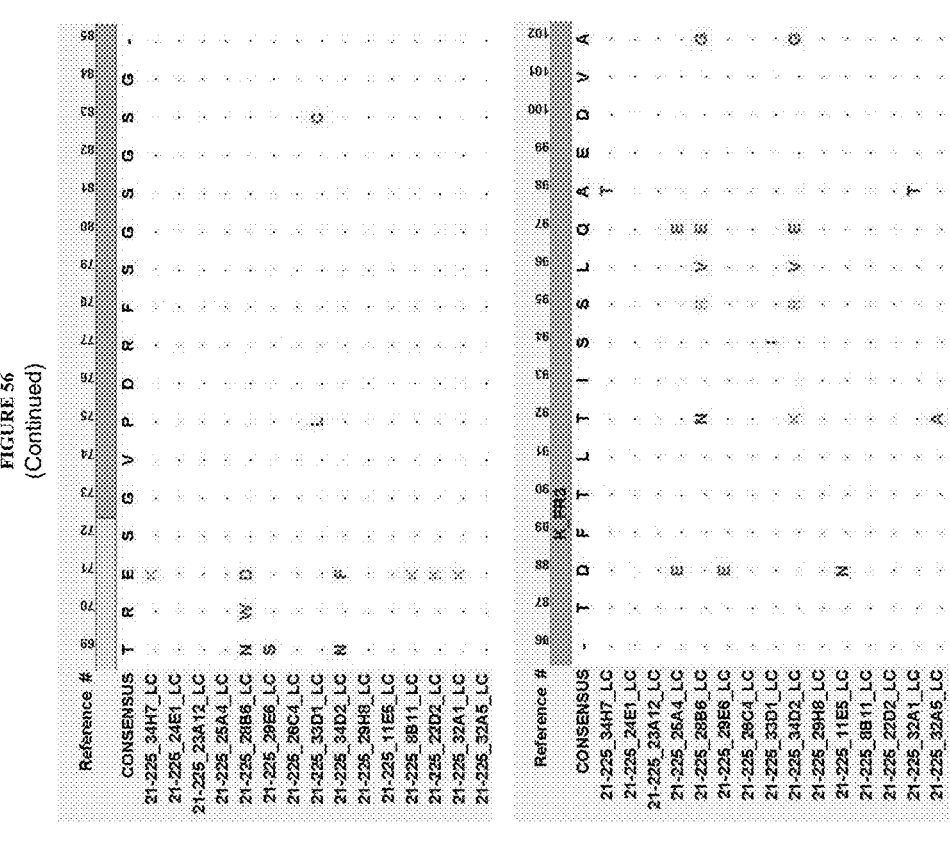
Figure 56:
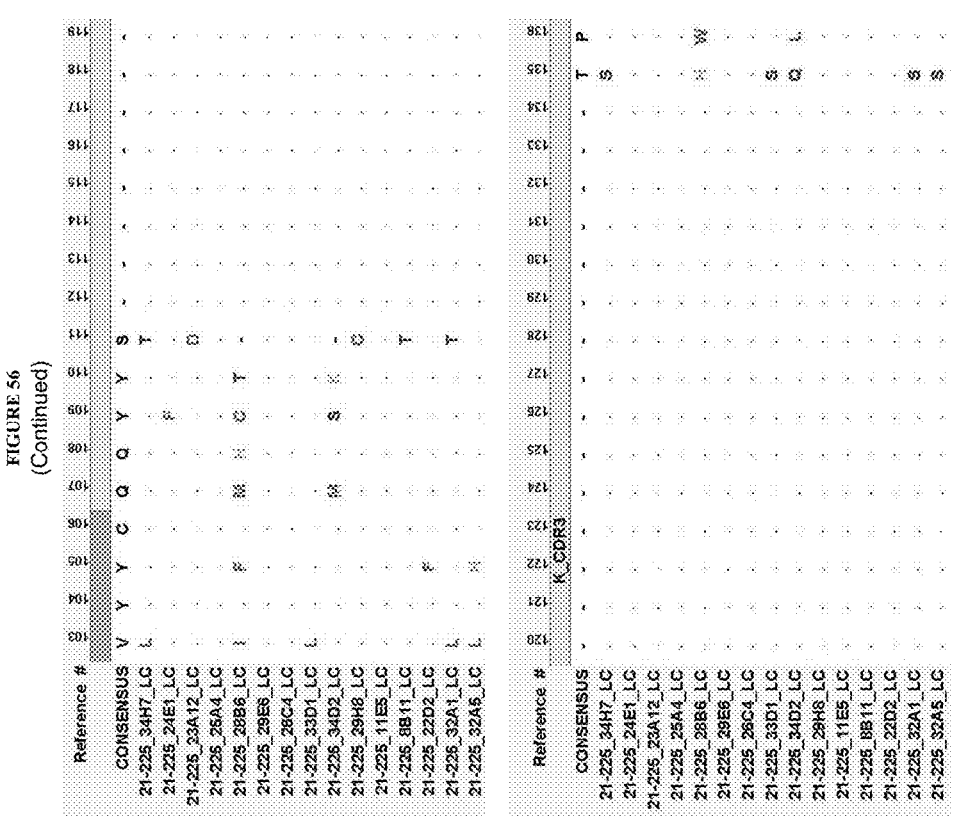
Figure 56:
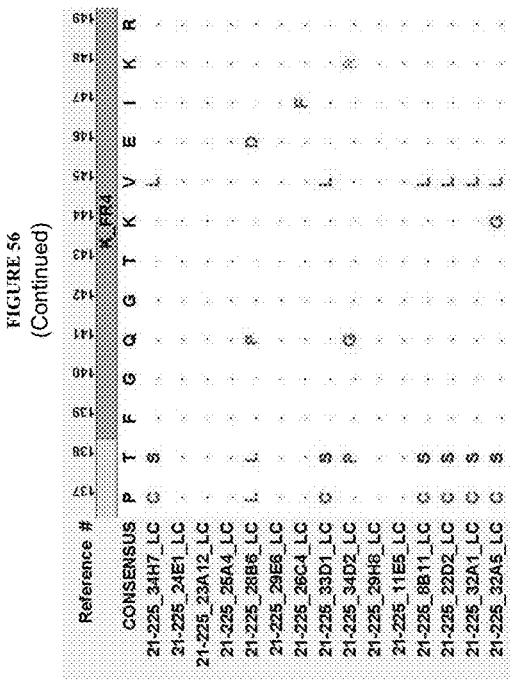
Figure 56:
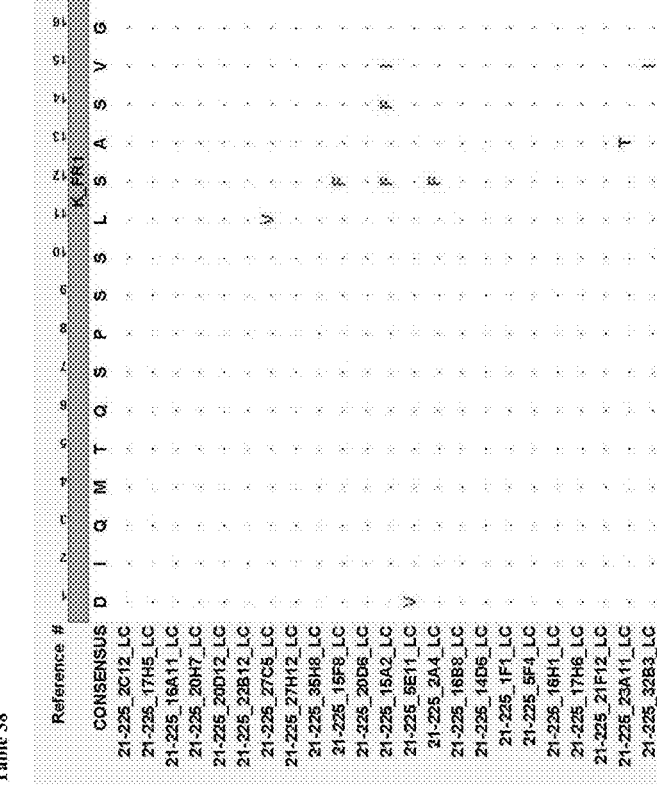
Figure 56:
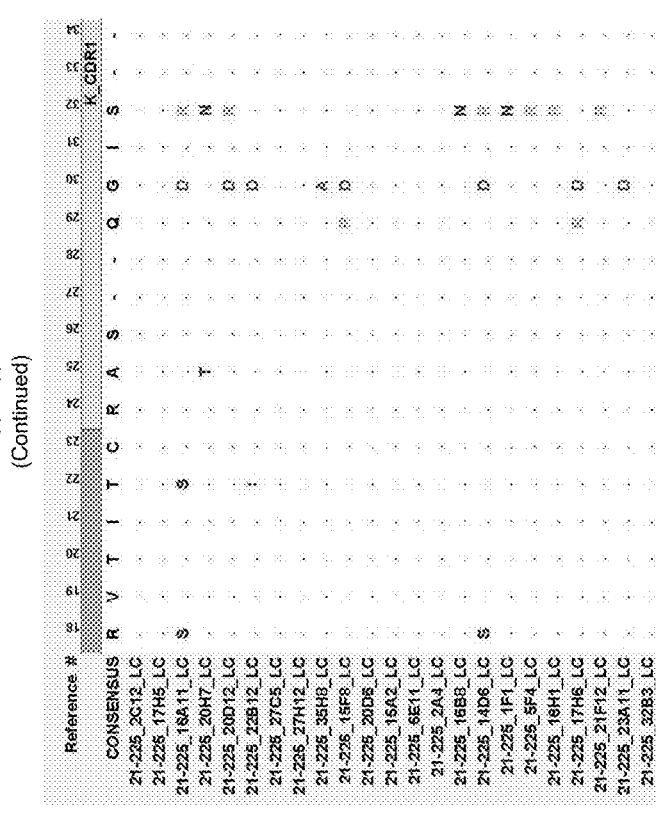
Figure 56:
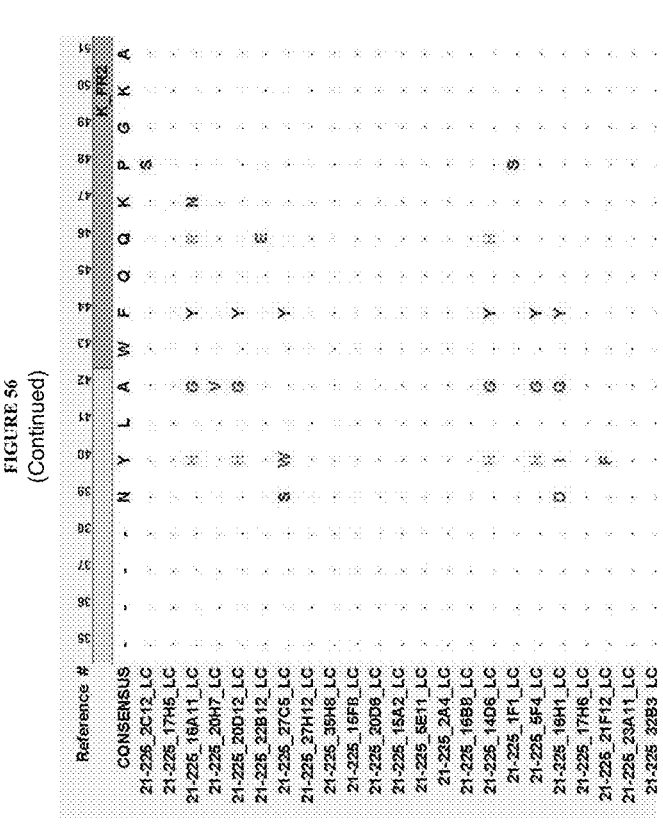
Figure 56:
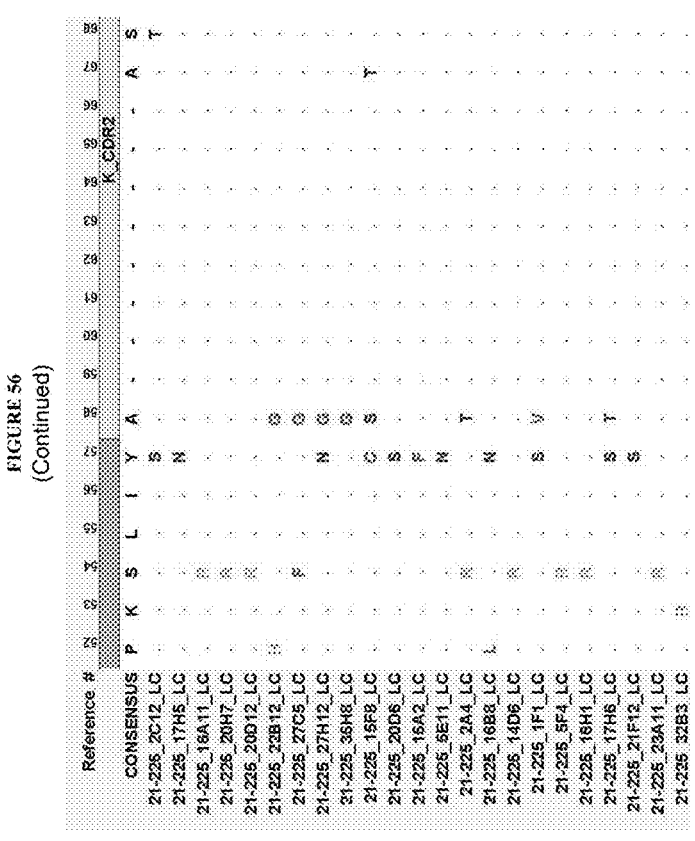
Figure 56:
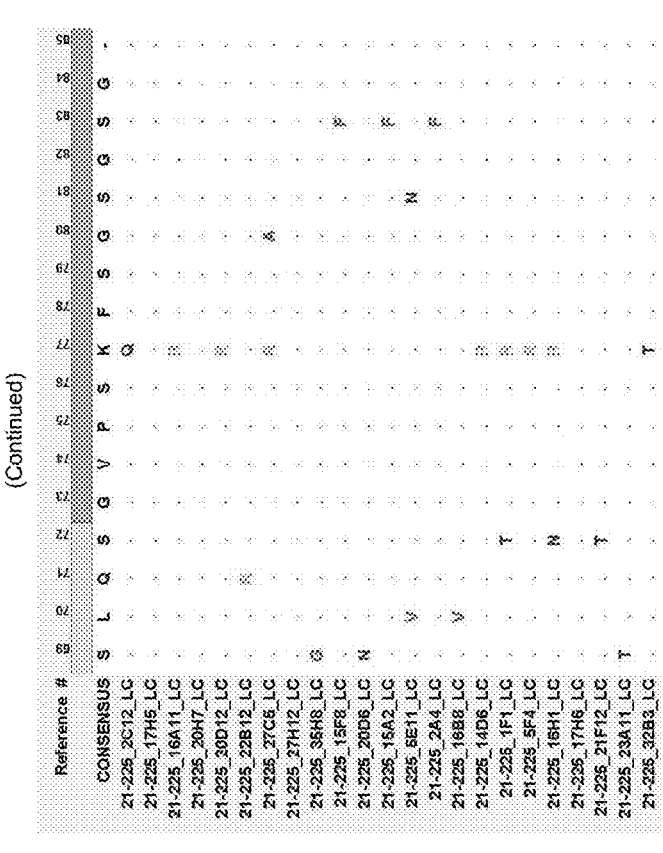
Figure 56:
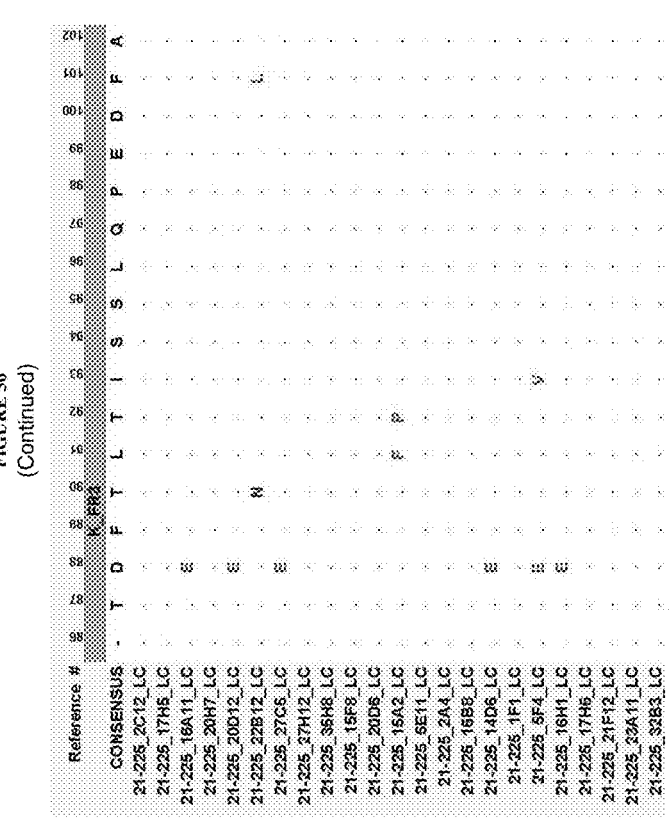
Figure 56:
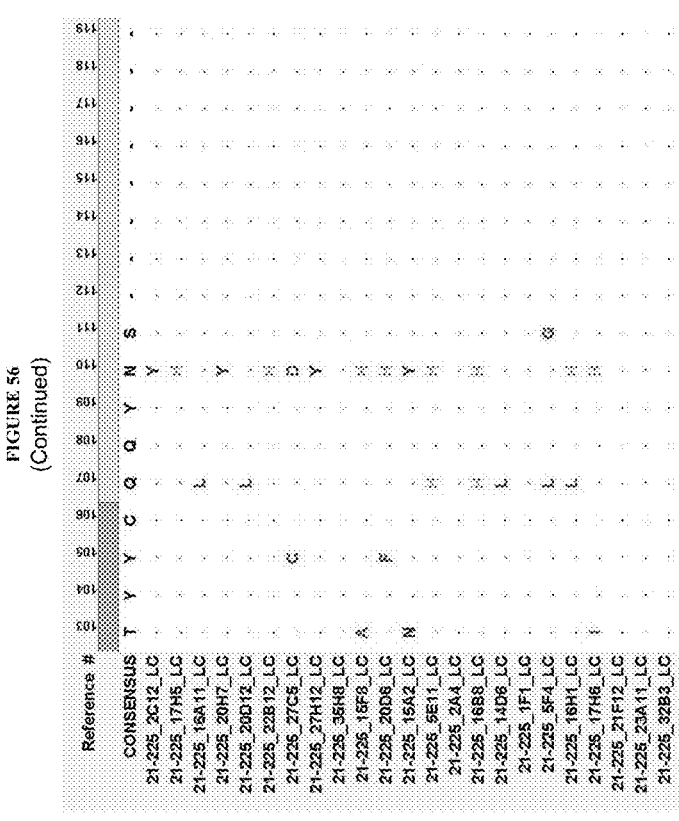
Figure 56:
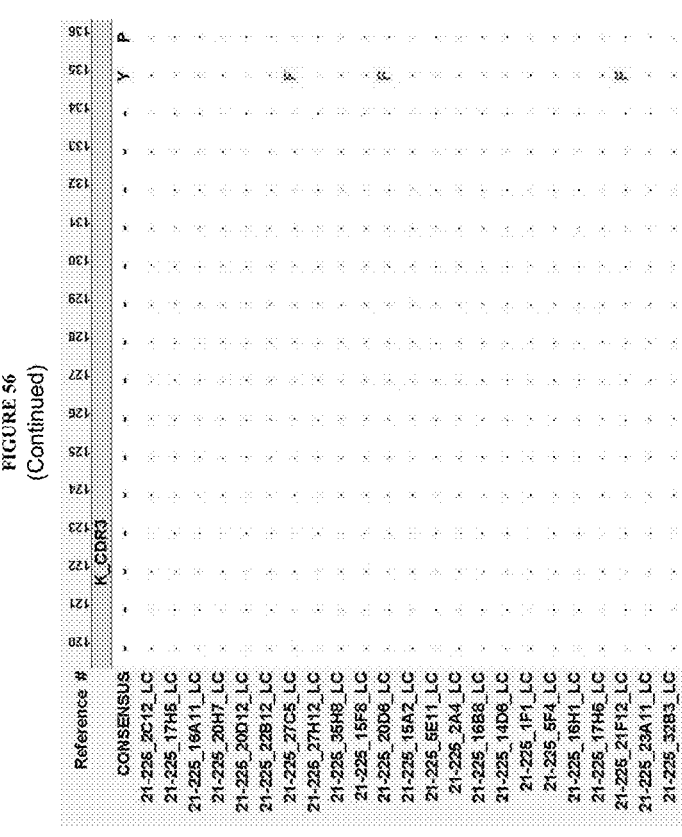
Figure 56:
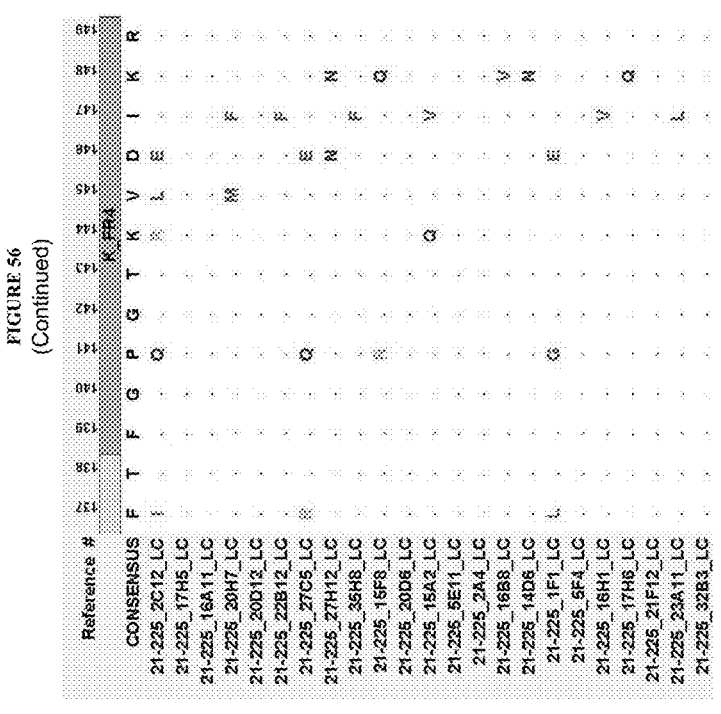
Figure 56:
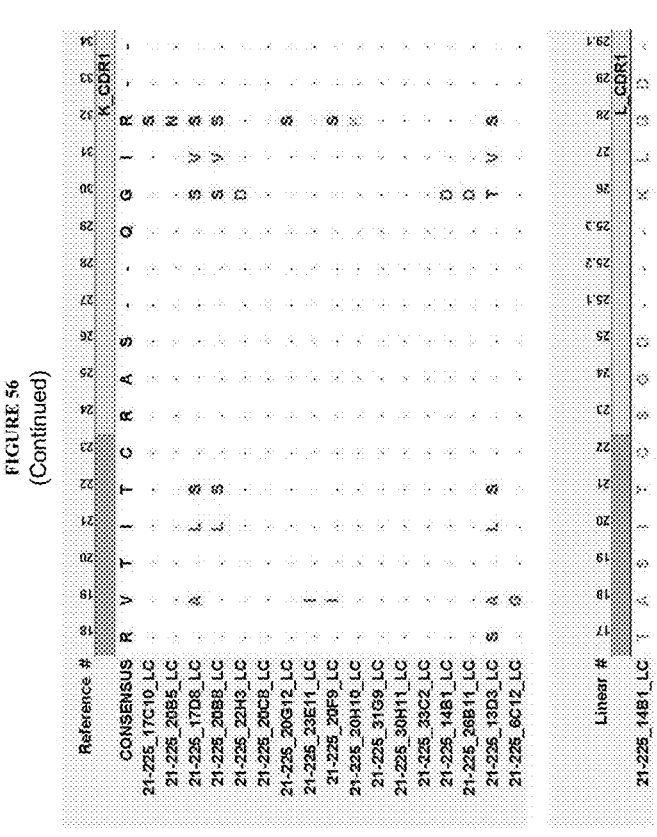
Figure 56:
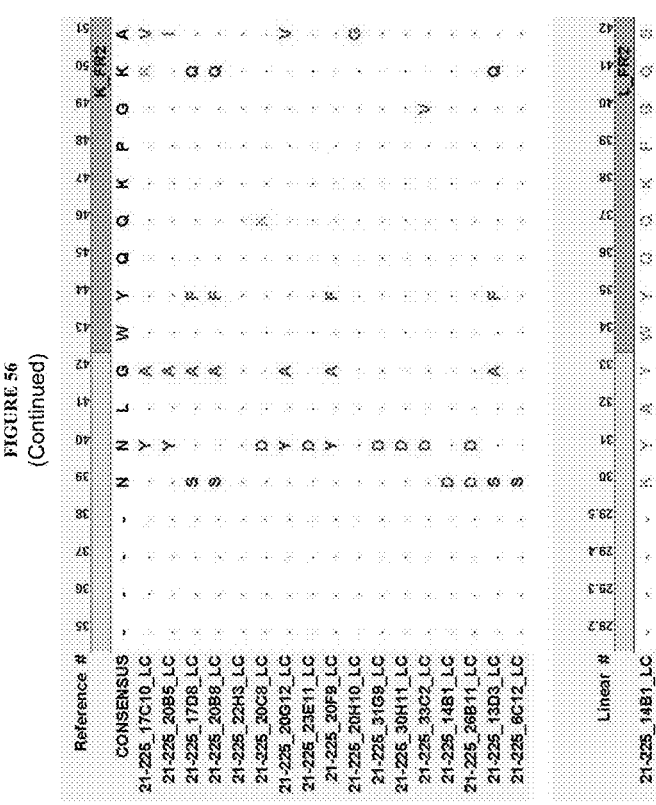
Figure 56:
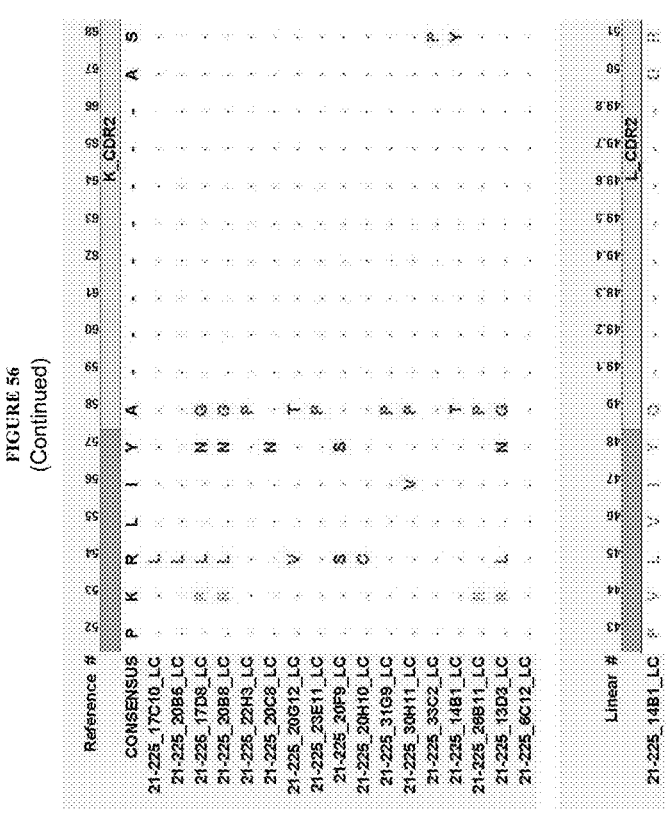
Figure 56:
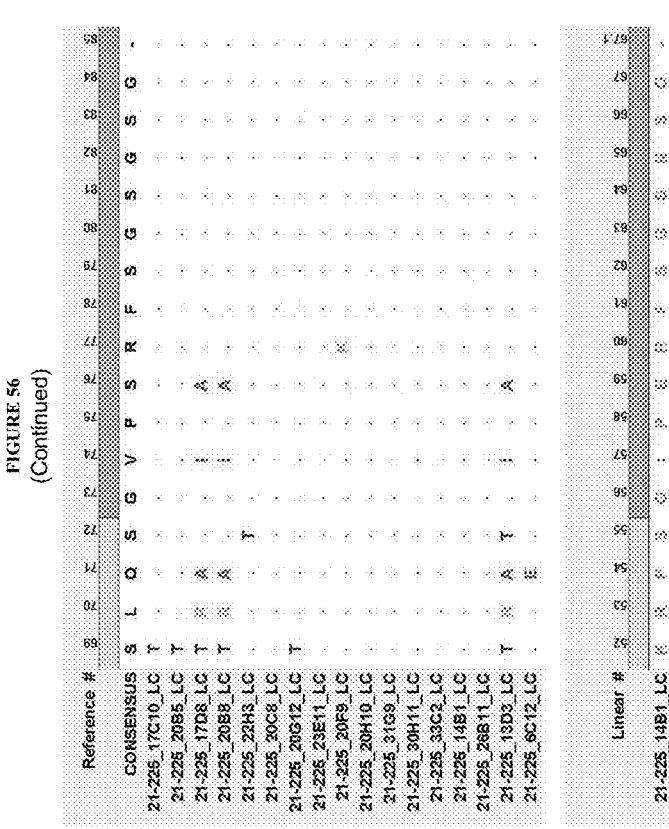
Figure 56:
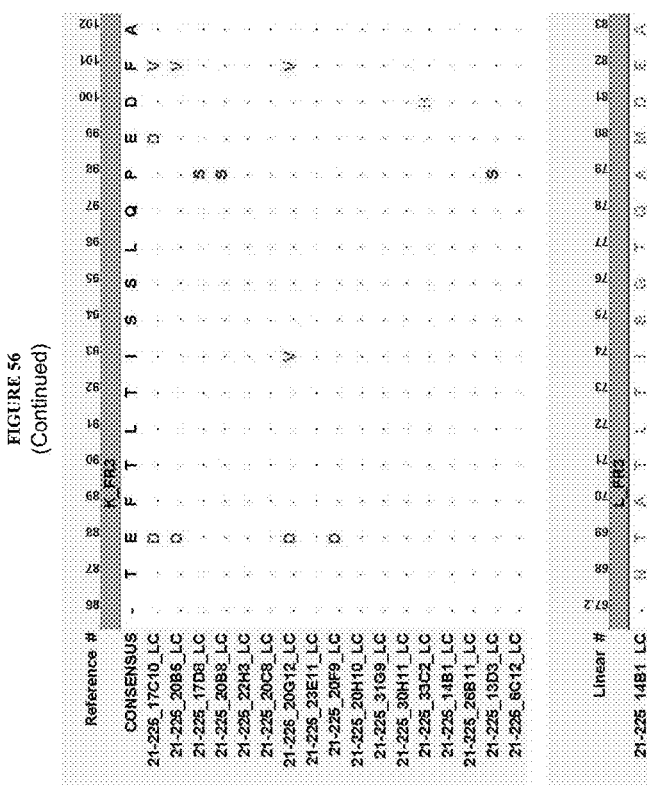
Figure 56:
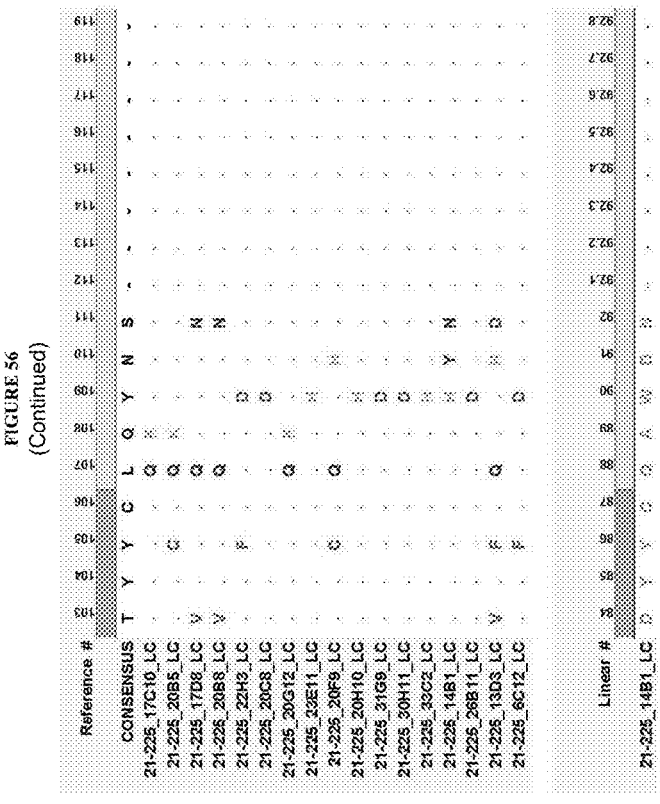
Figure 56:
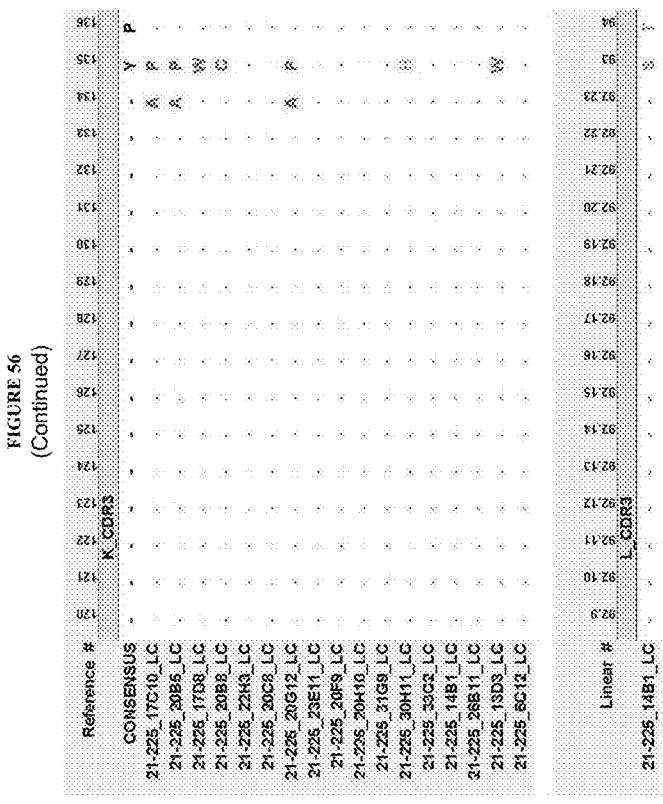
Figure 56:
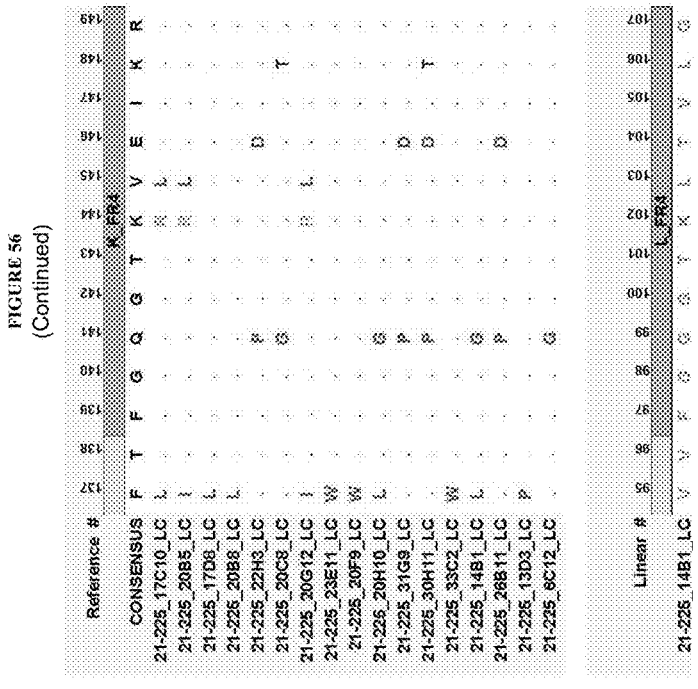
Figure 56:
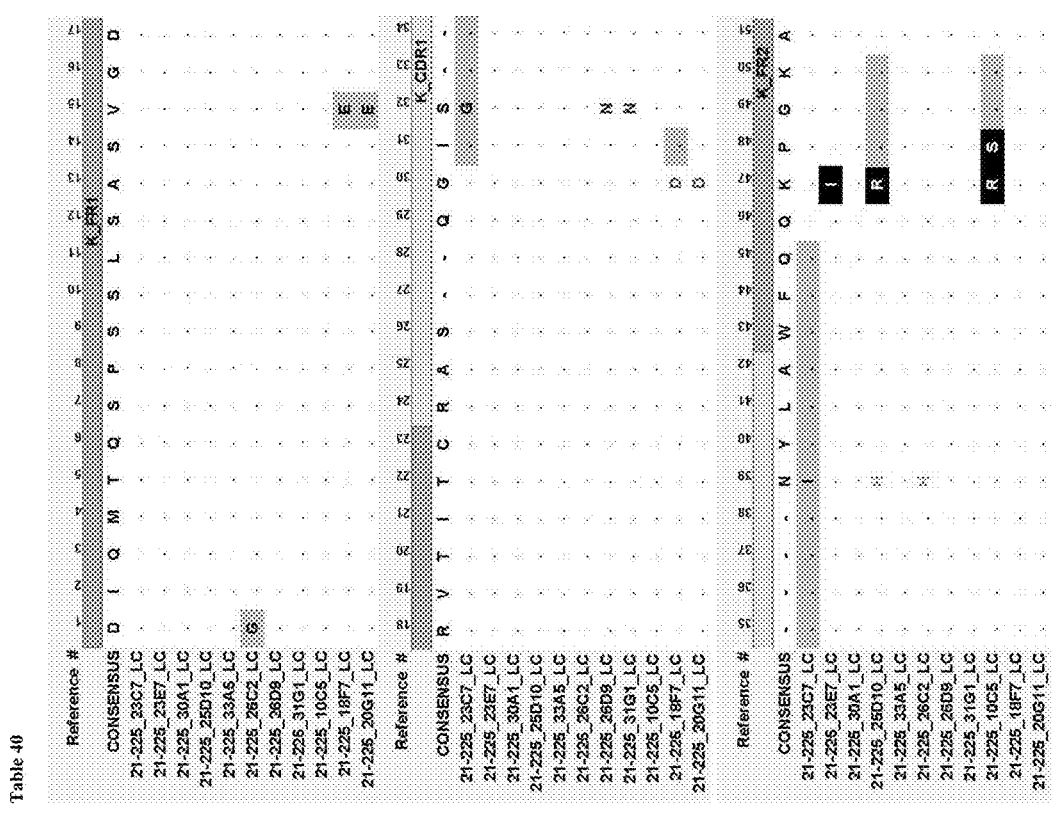
Figure 56:
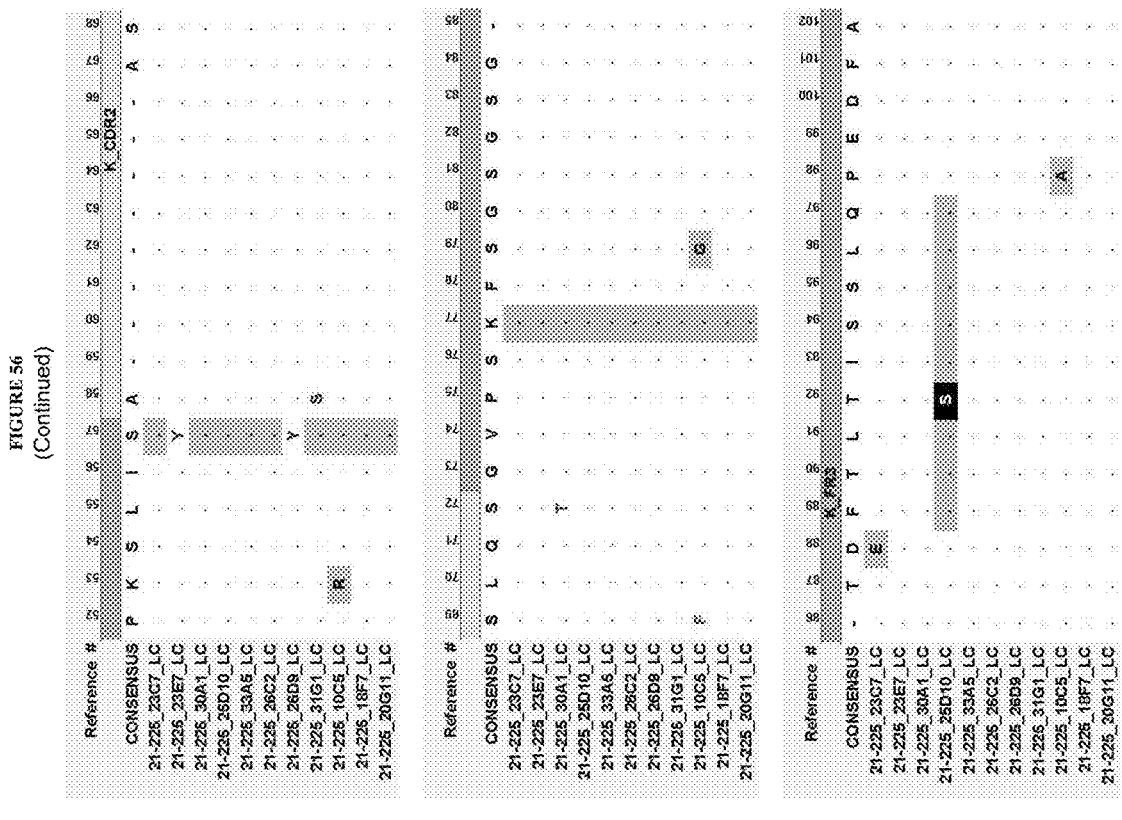
Figure 56:
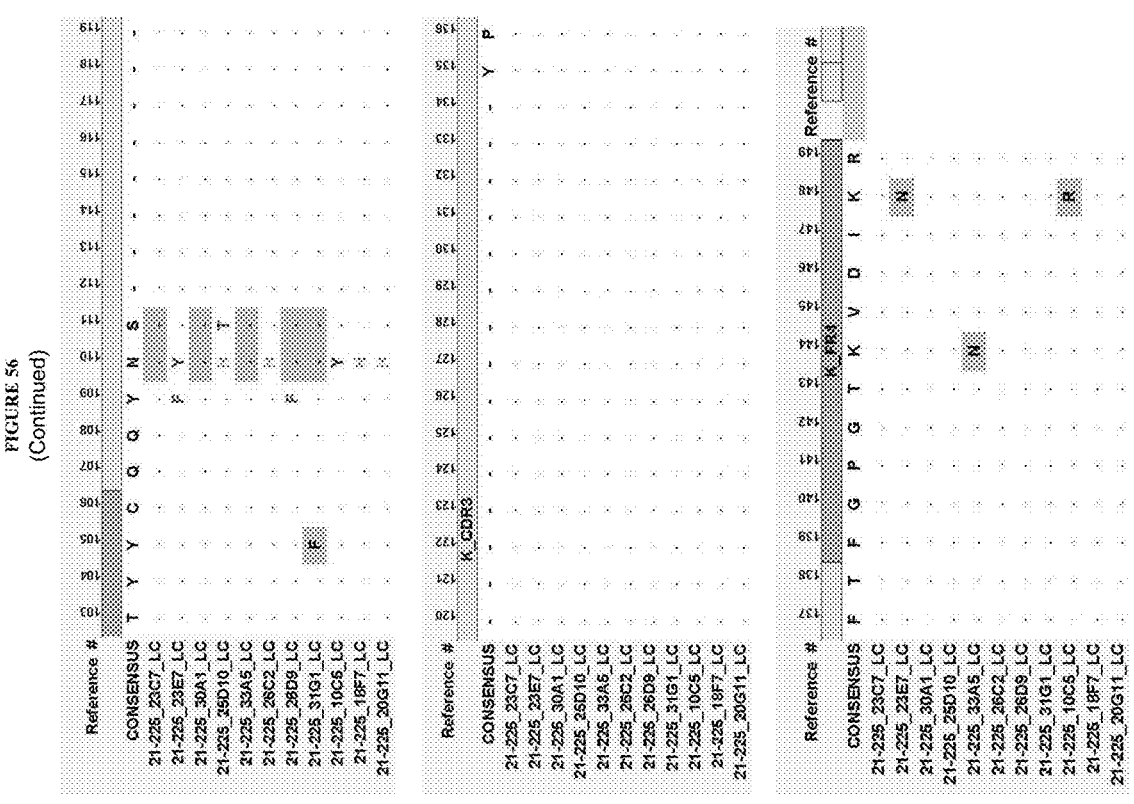
Figure 56:
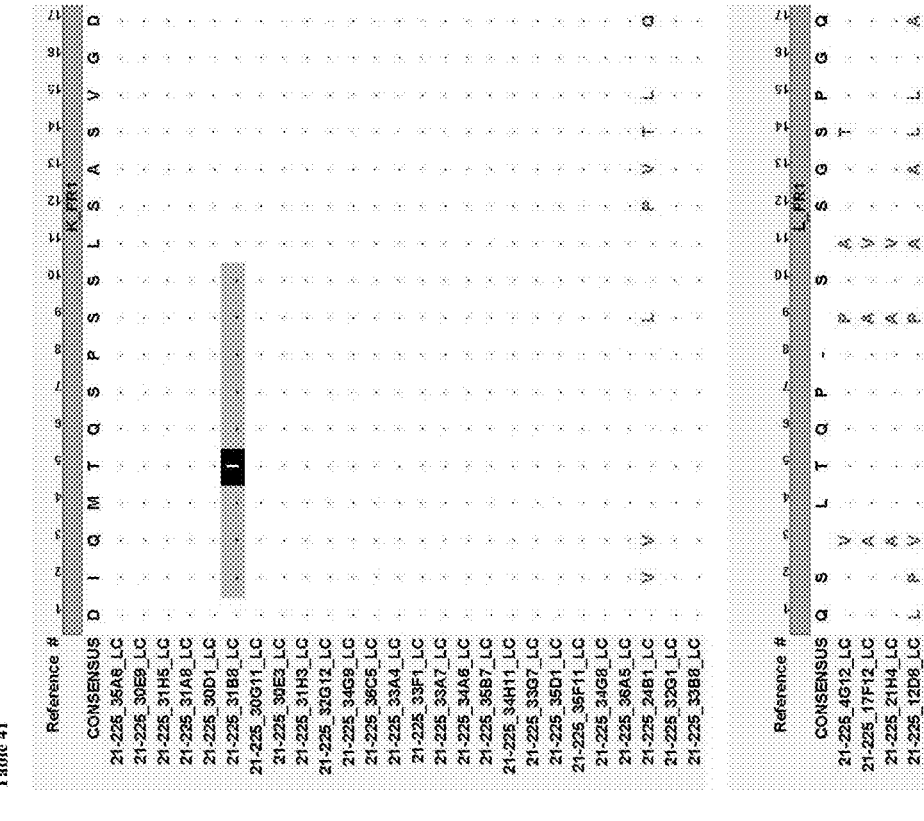
Figure 56:
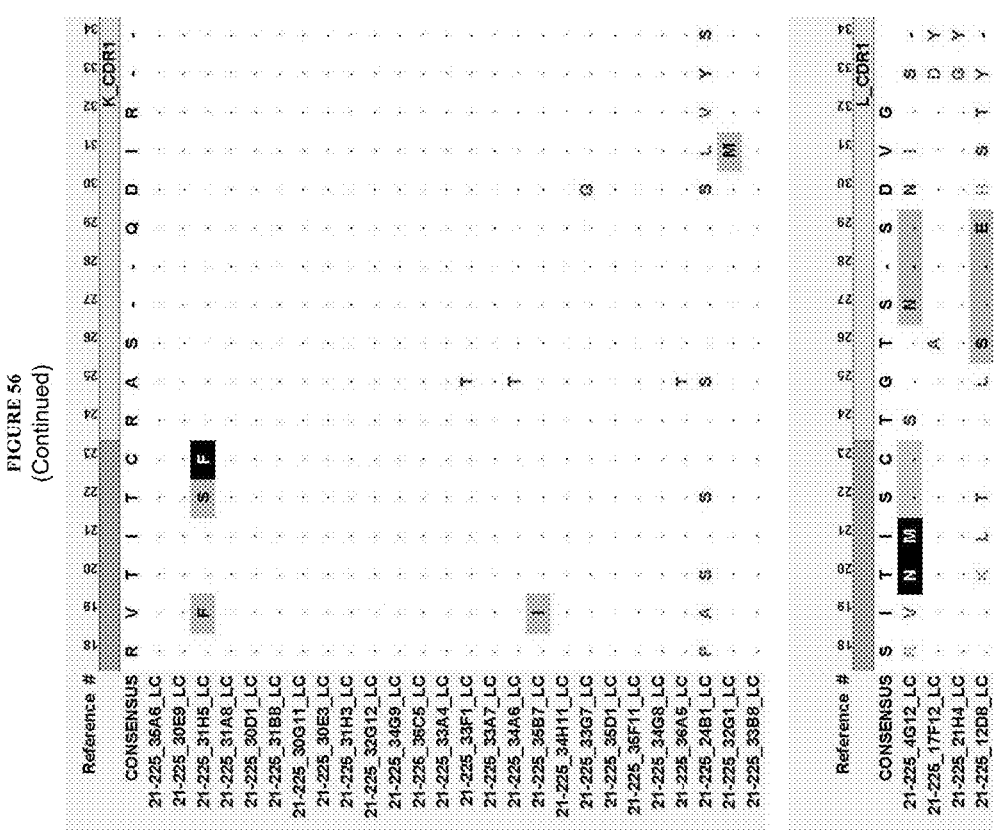
Figure 56:
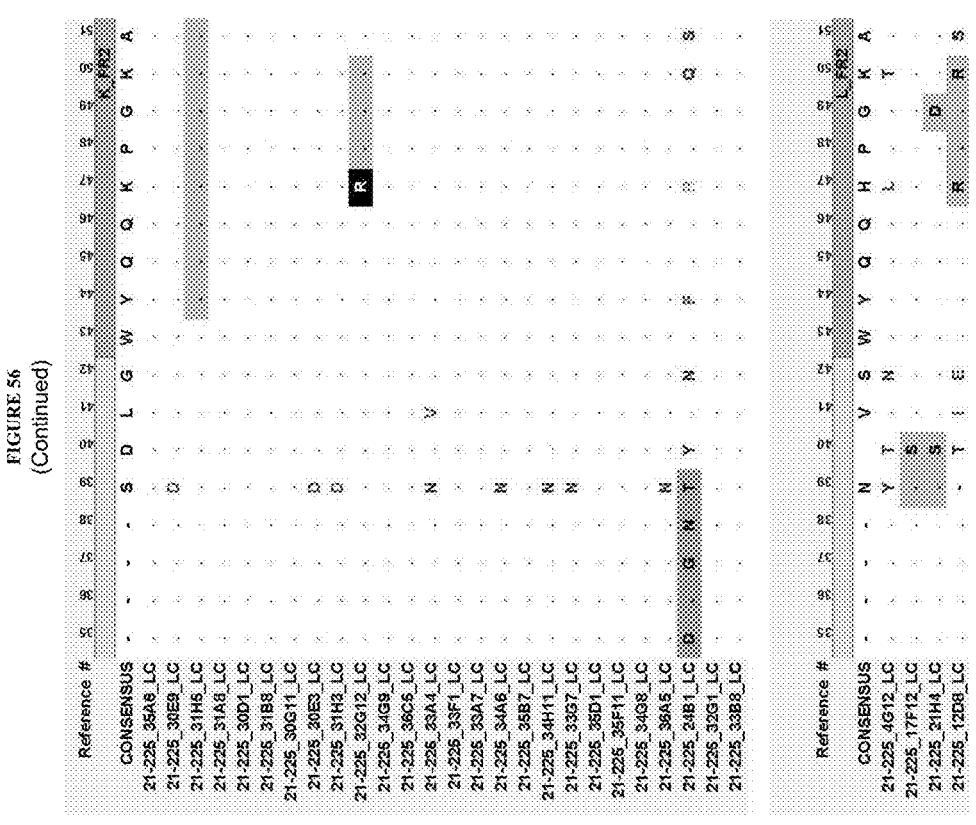
Figure 56:
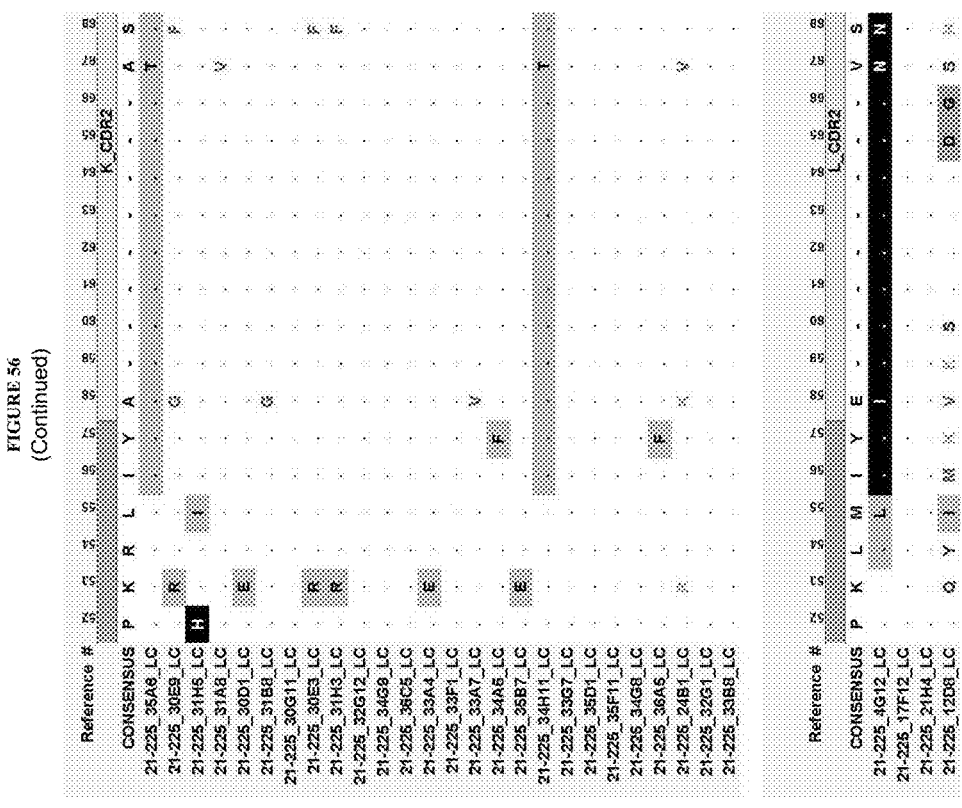
Figure 56:
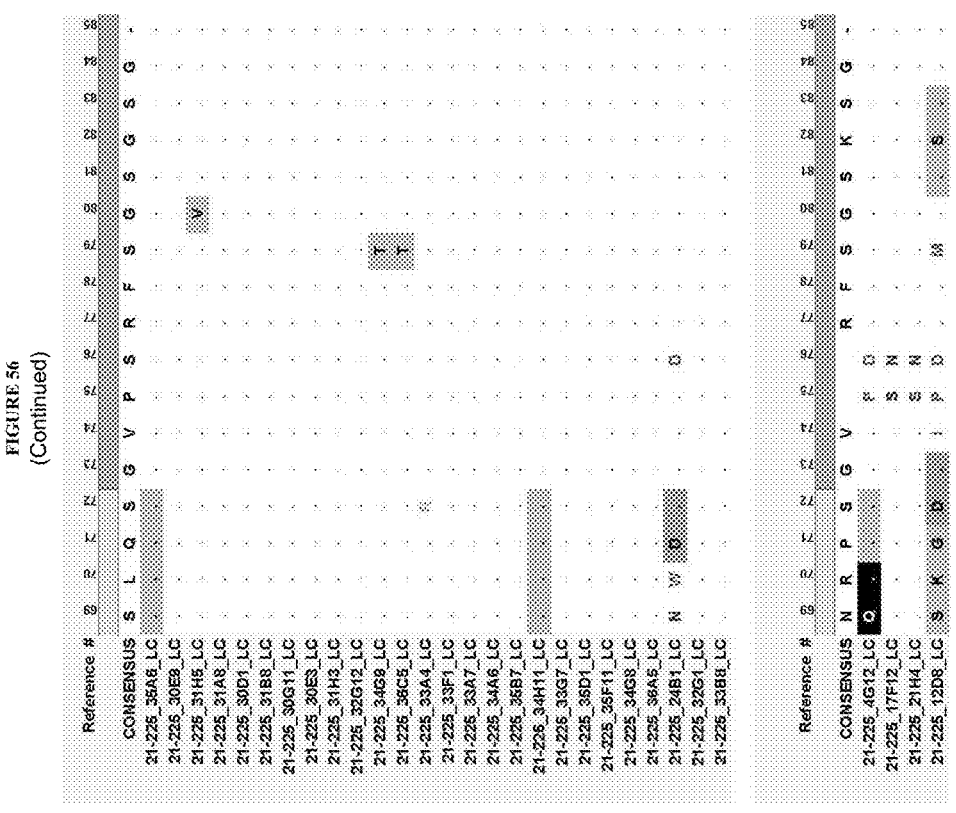
Figure 56:
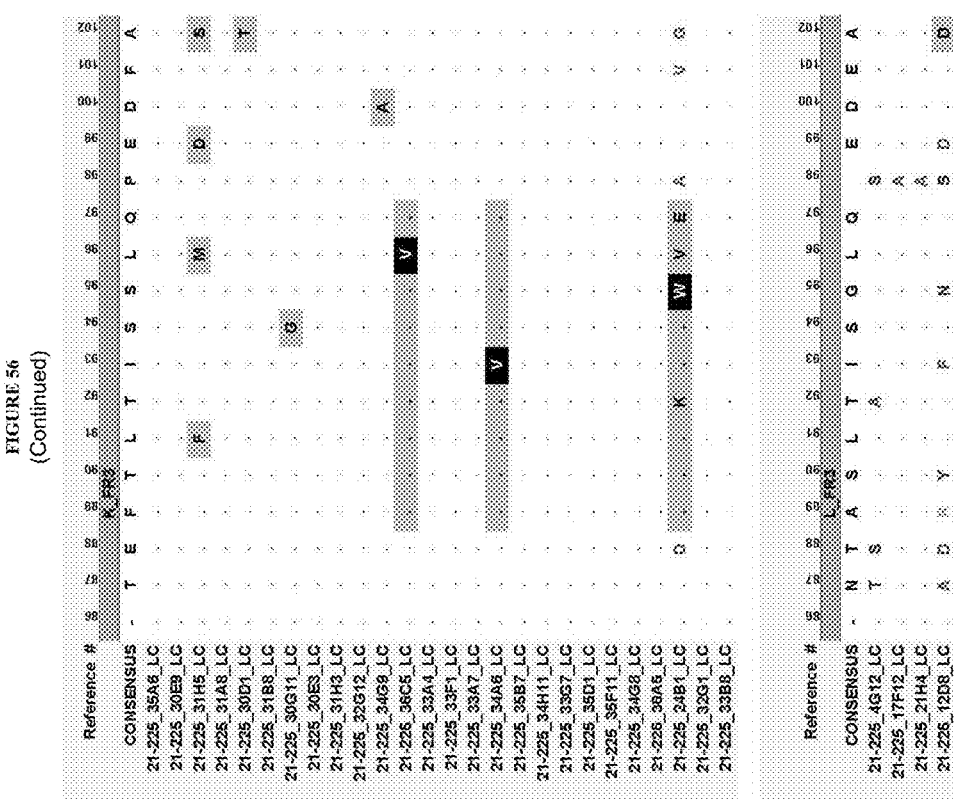
Figure 56:
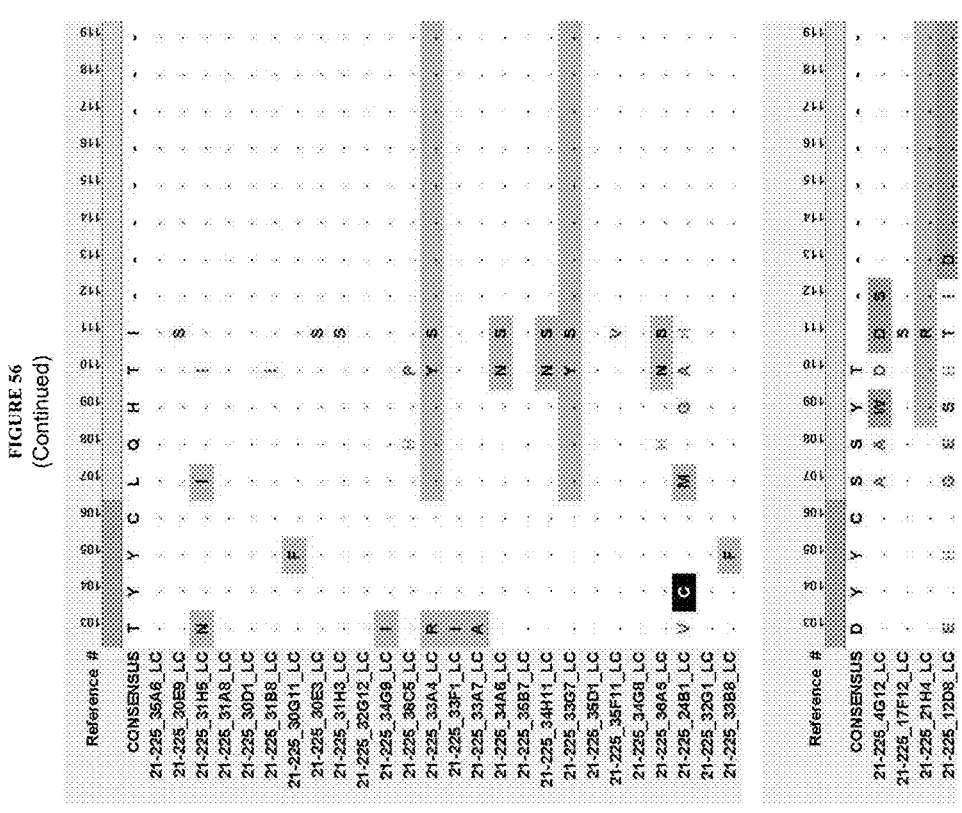
Figure 56:
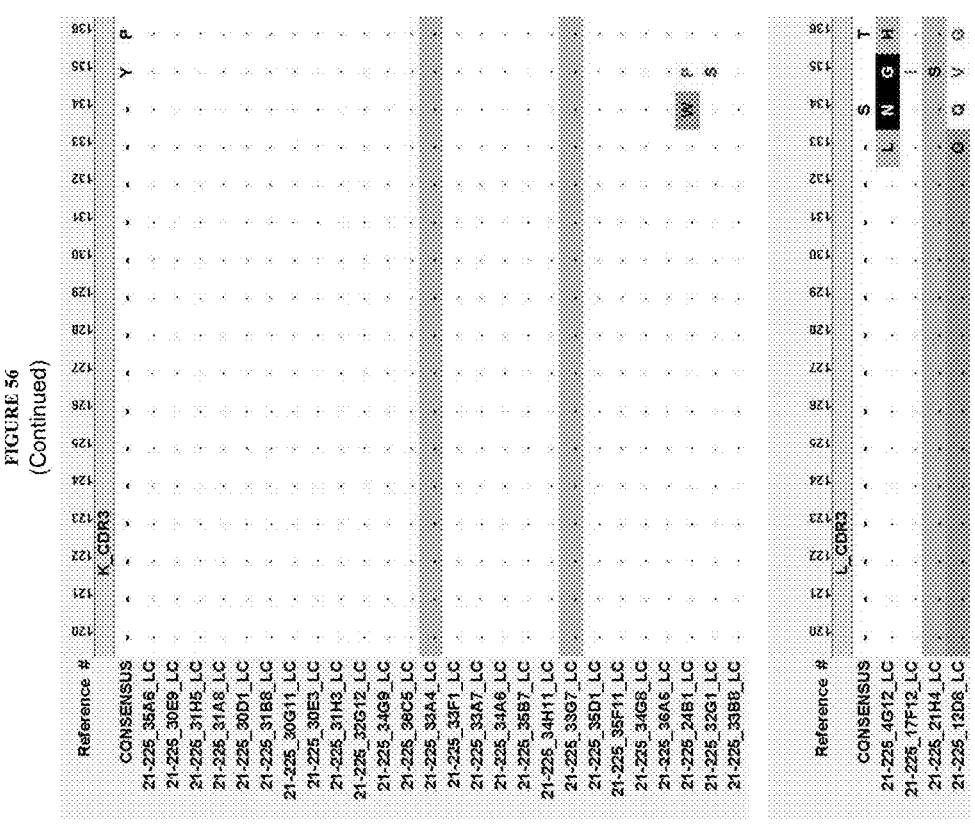
Figure 56:
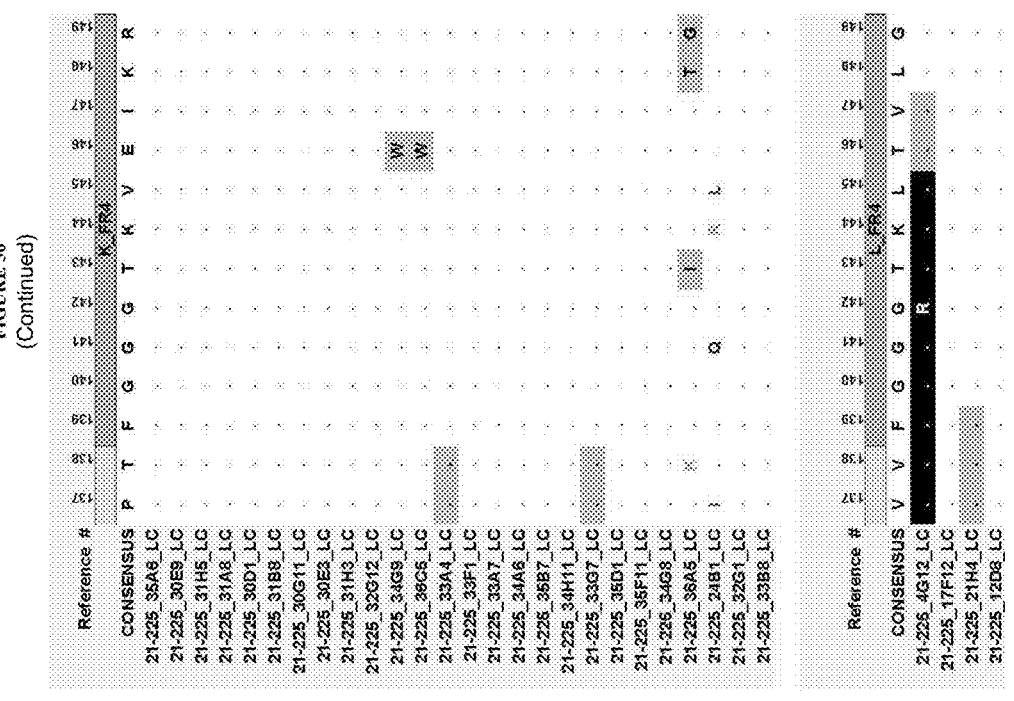
Figure 56:
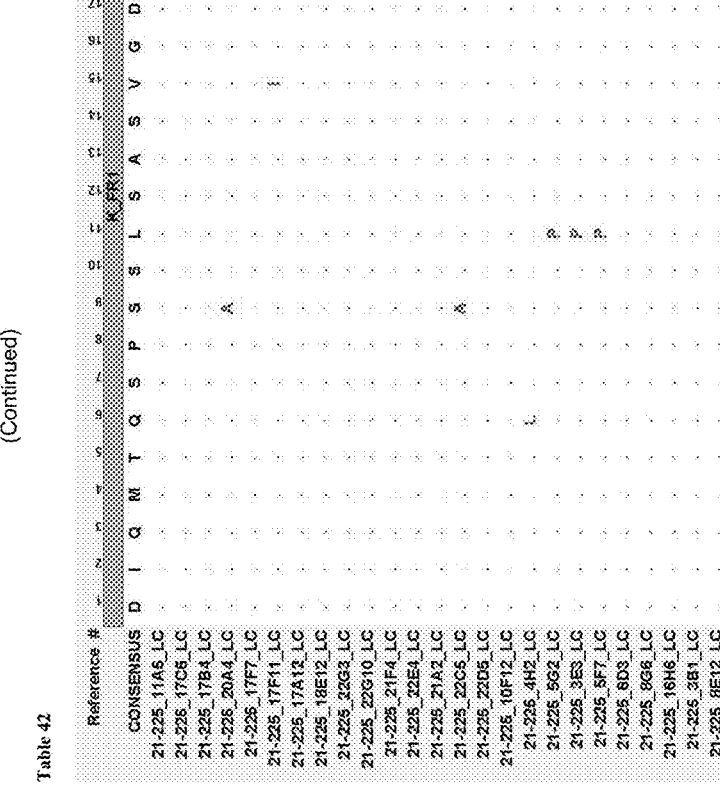
Figure 56:
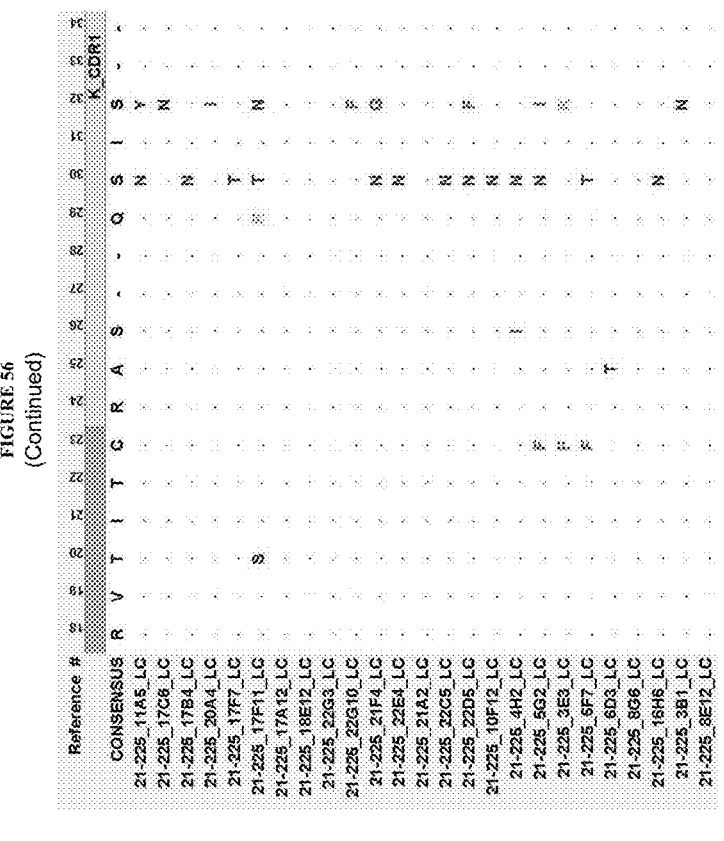
Figure 56:
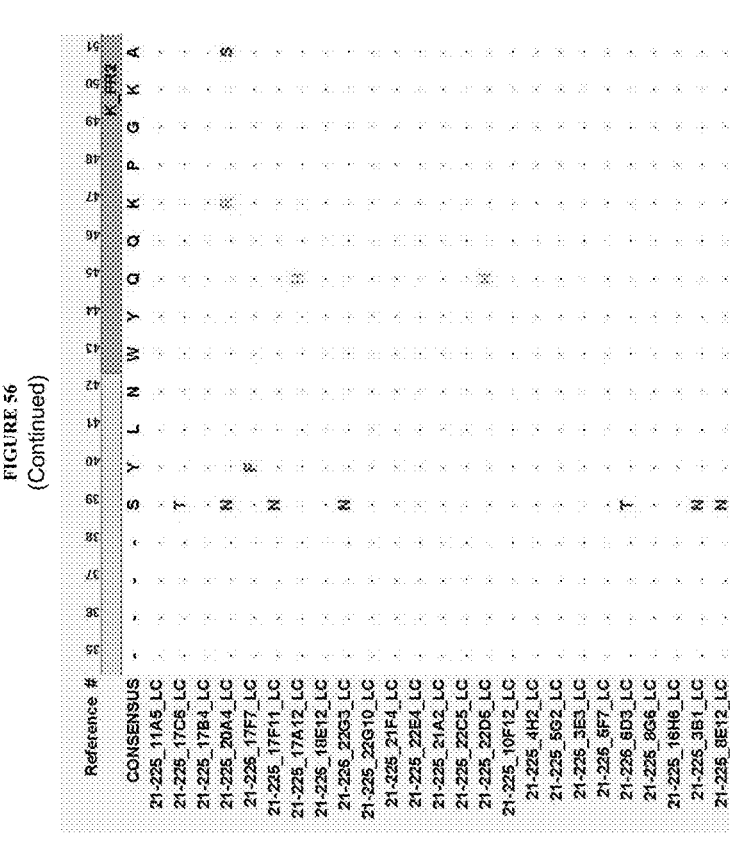
Figure 56:
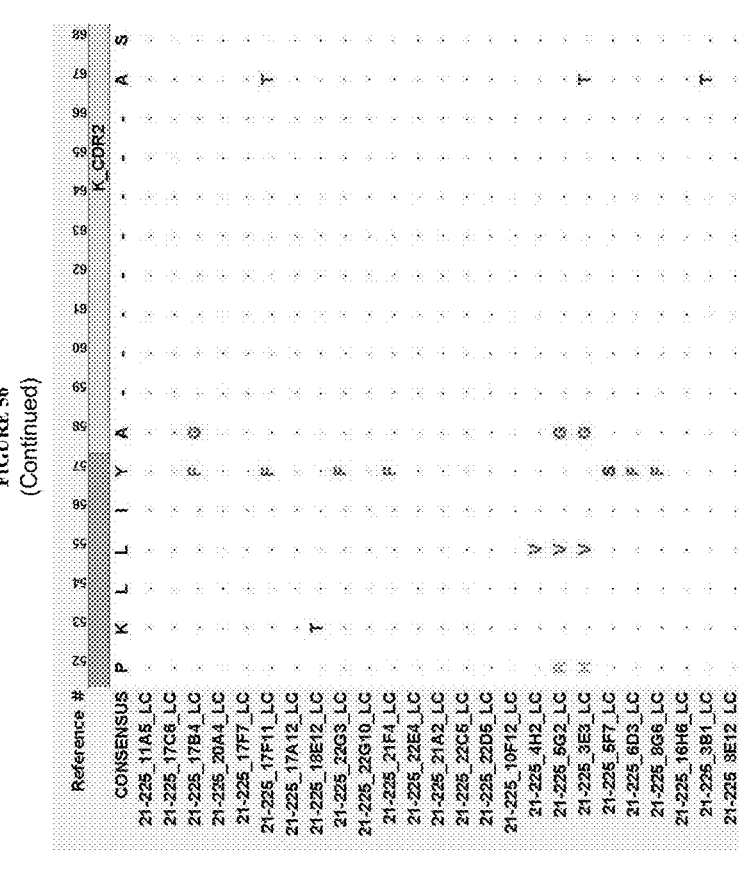
Figure 56:
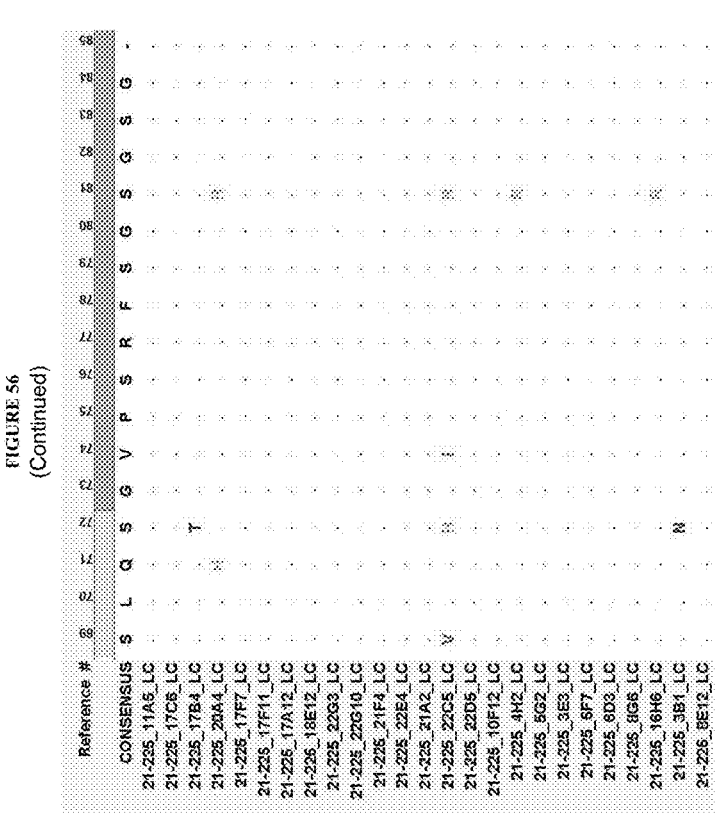
Figure 56:
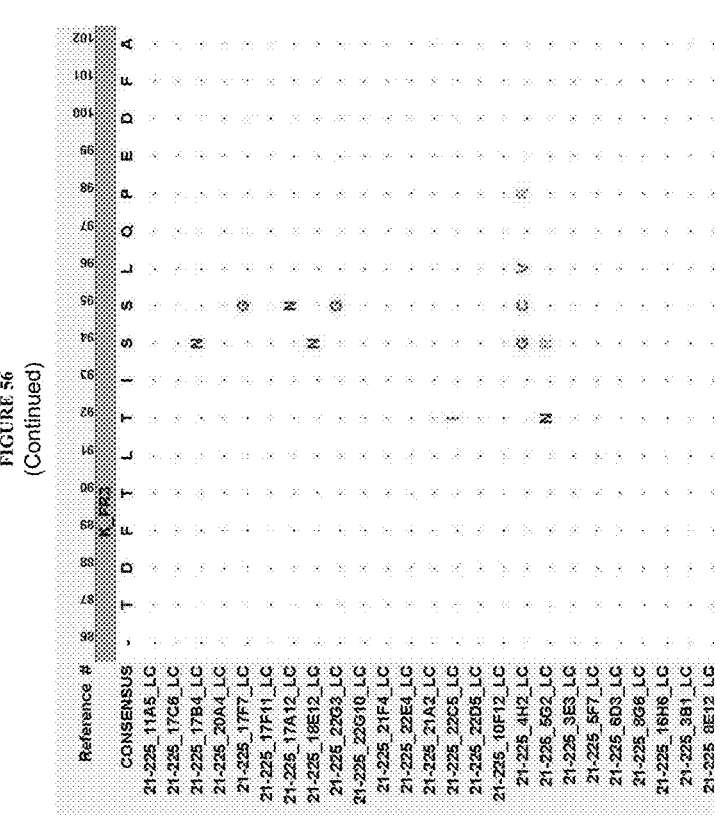
Figure 56:
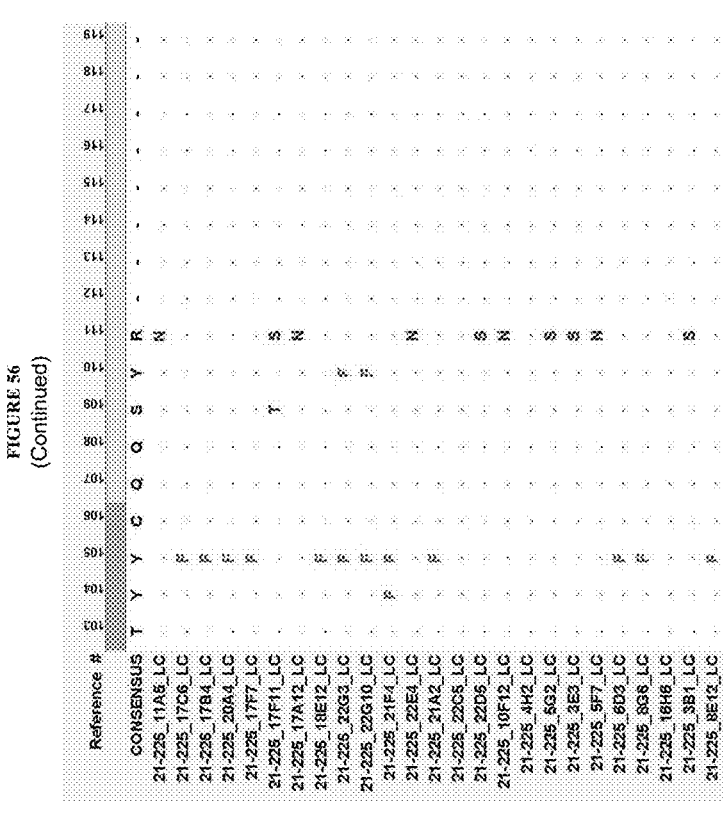
Figure 56:
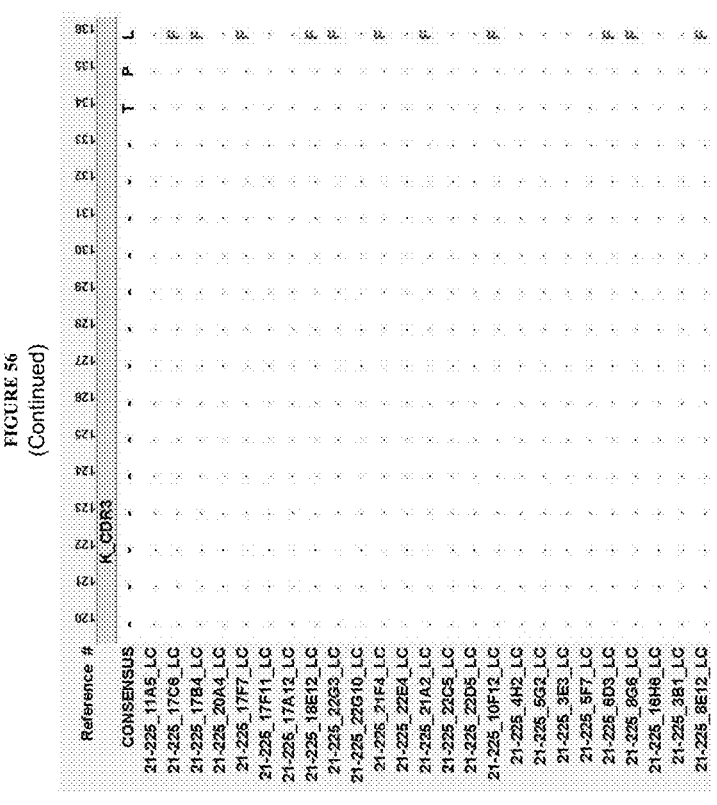
Figure 56:
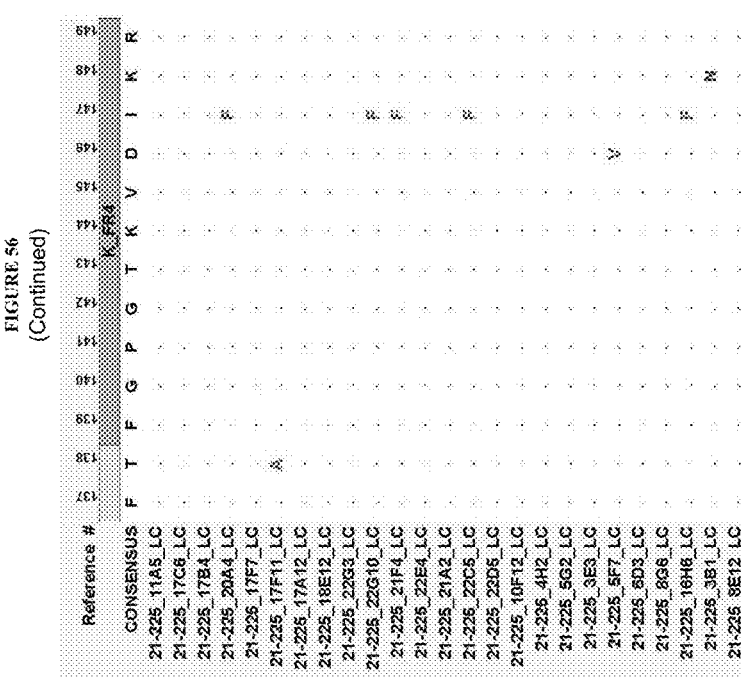
Figure 56:
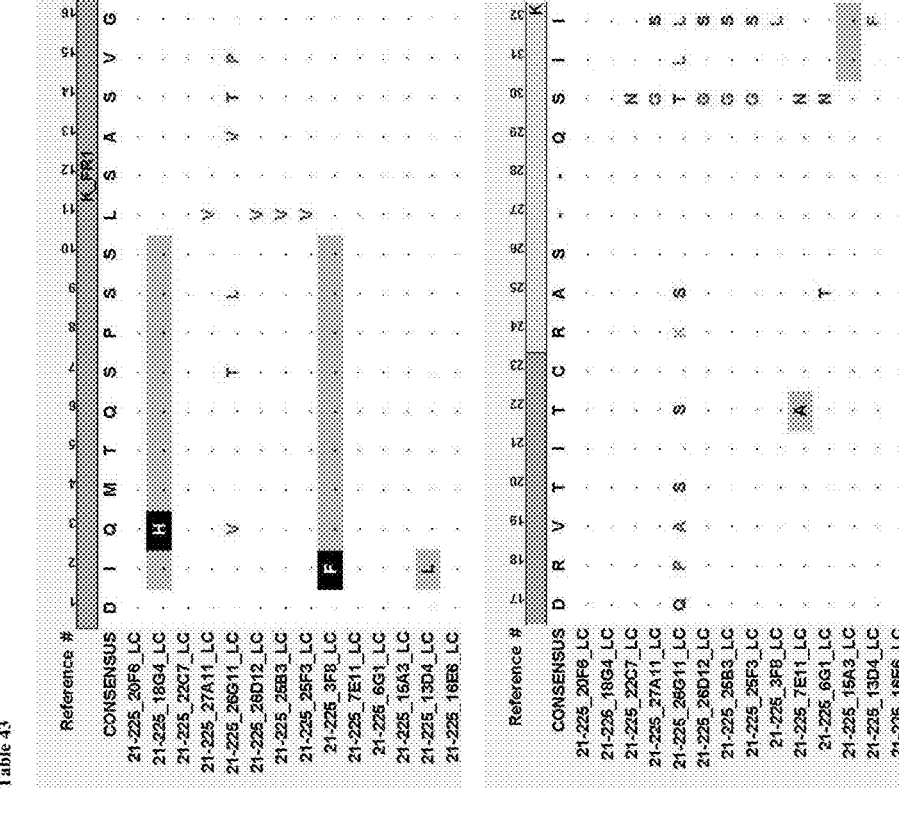
Figure 56:
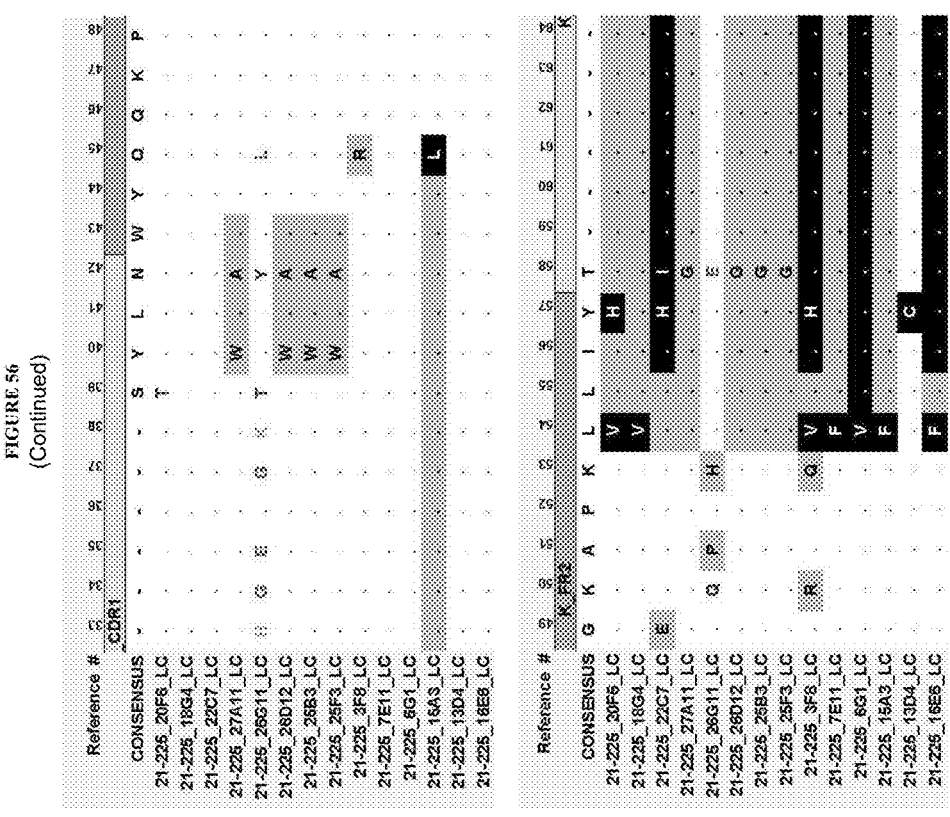
Figure 56:
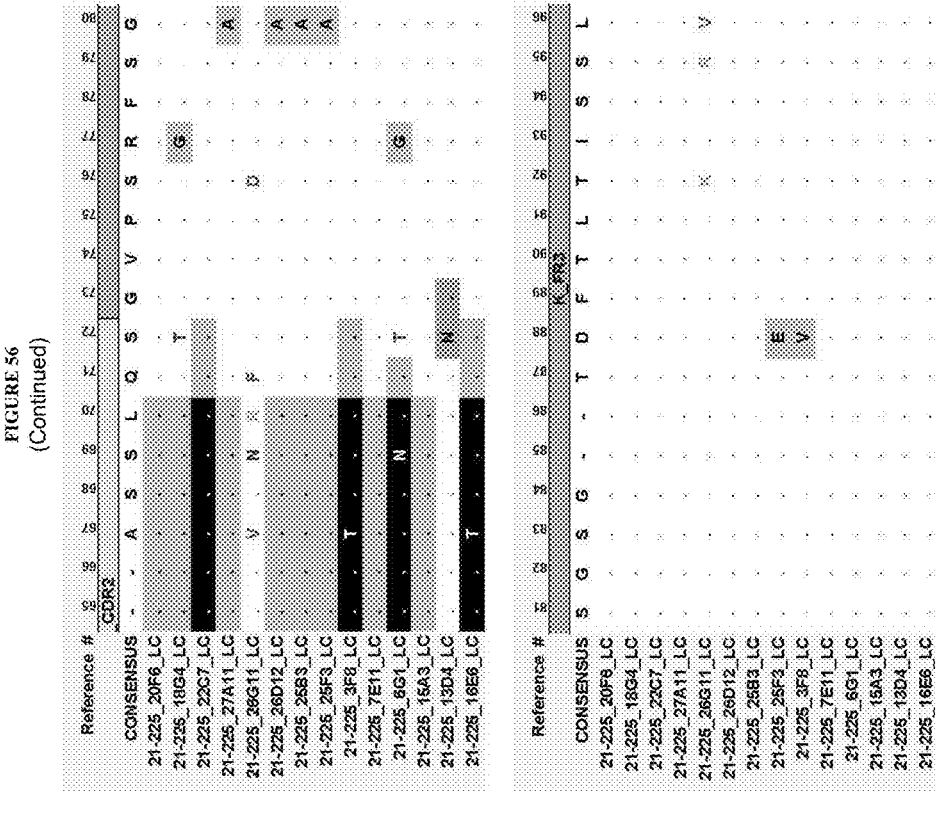
Figure 56:
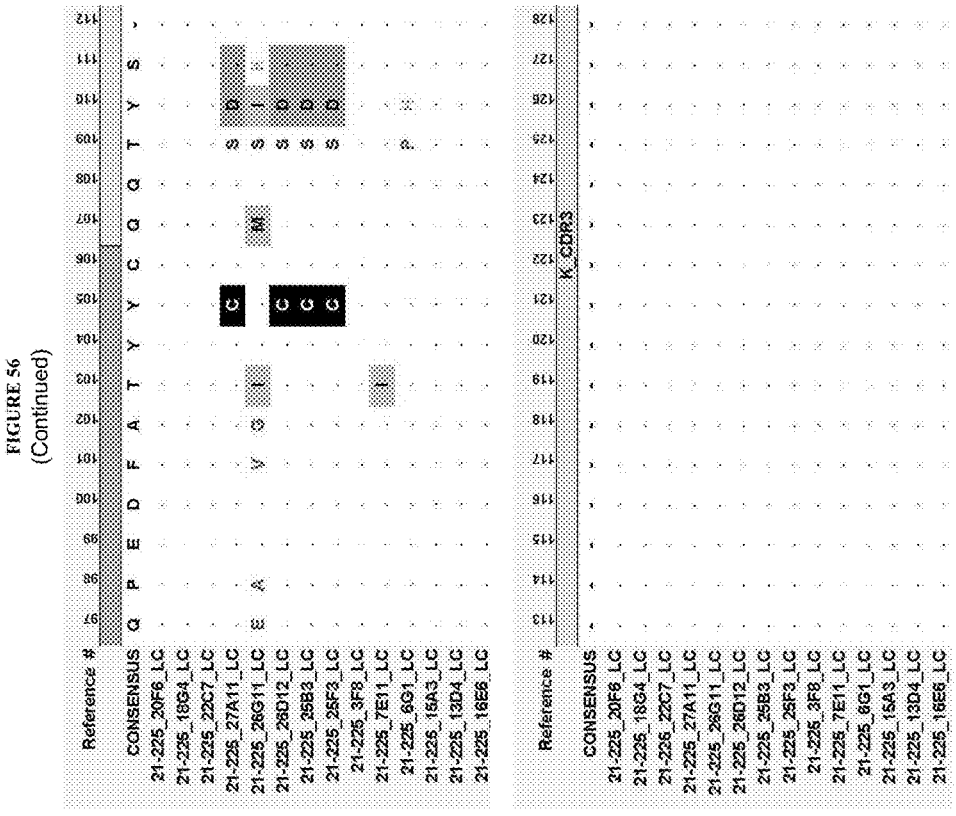
Figure 56:
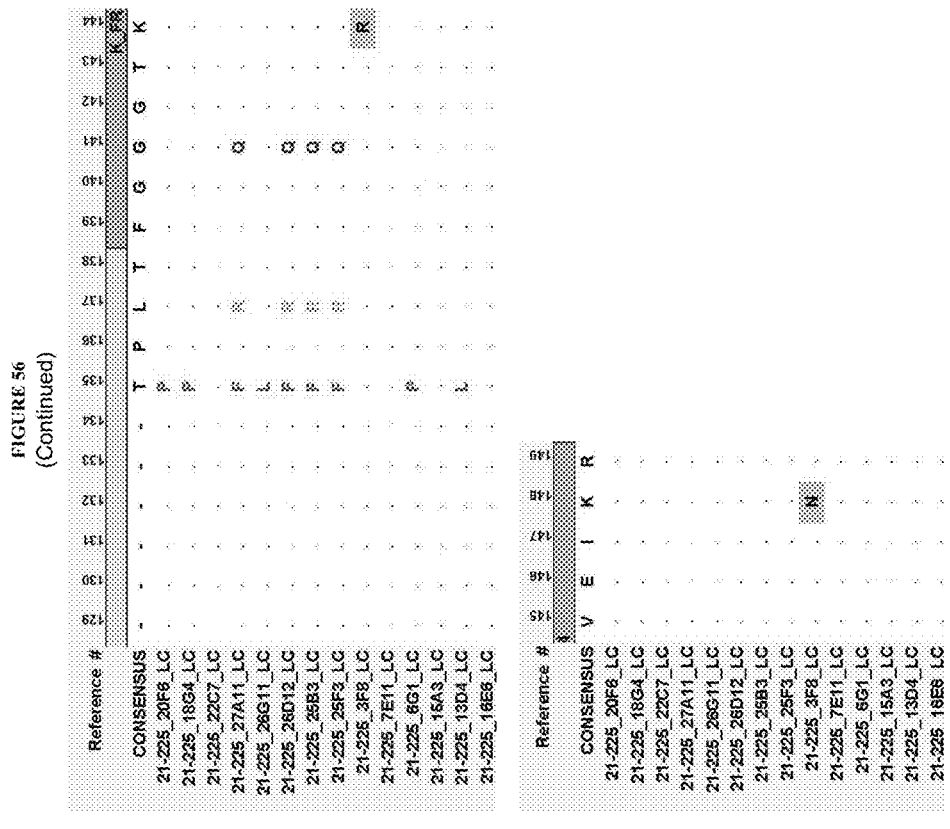
Figure 56:
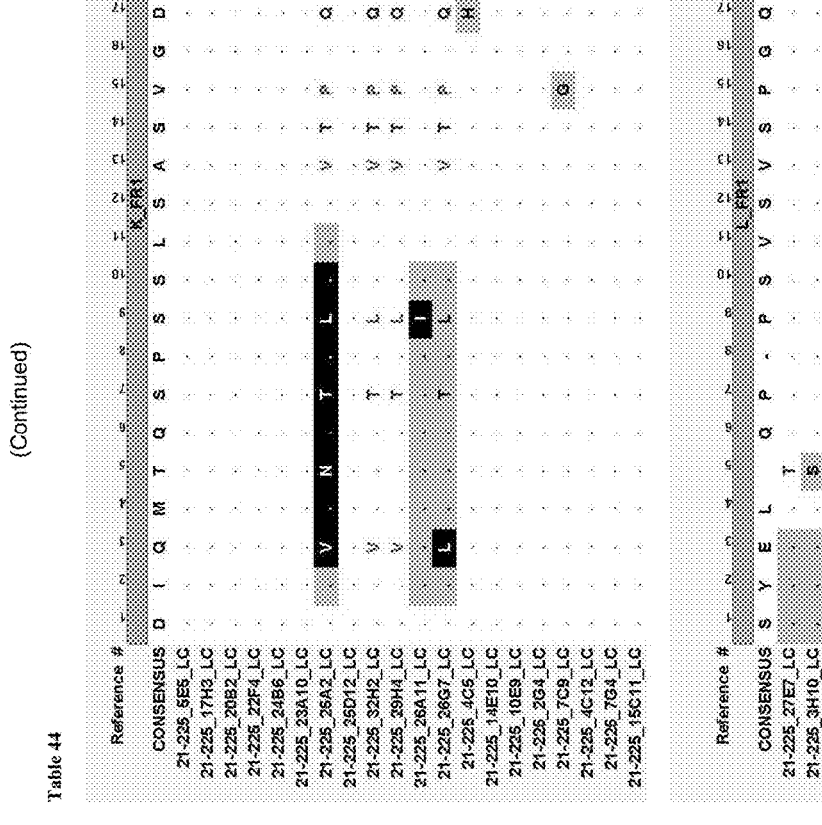
Figure 56:
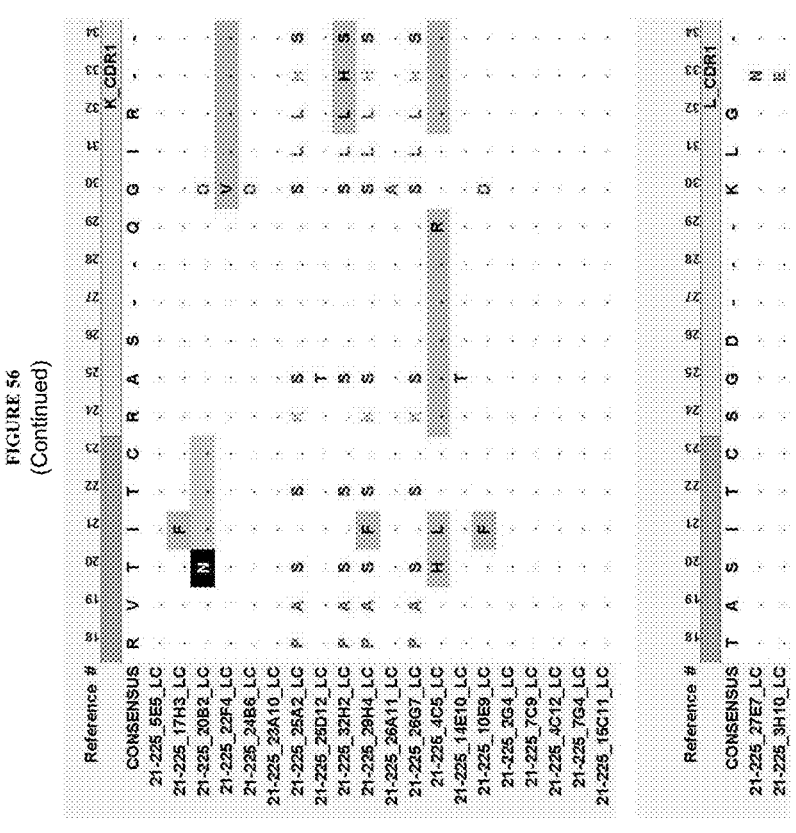
Figure 56:
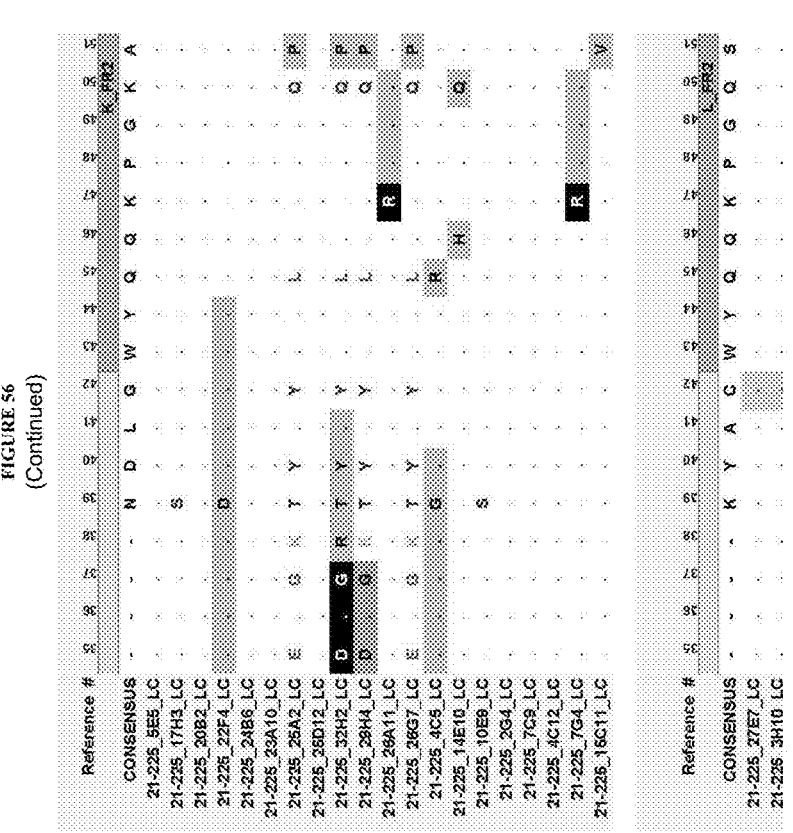
Figure 56:
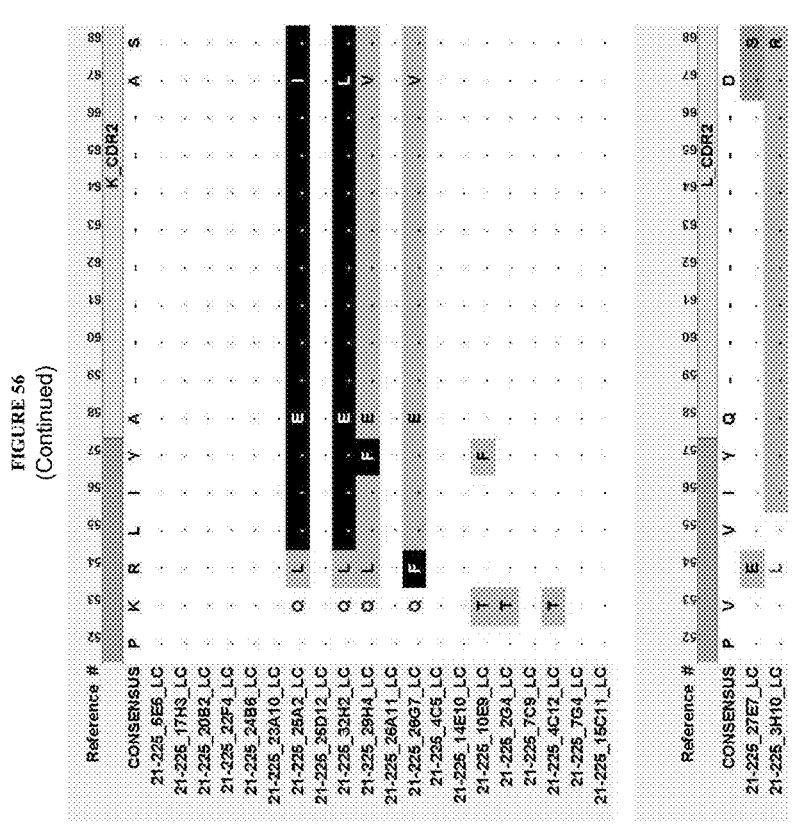
Figure 56:
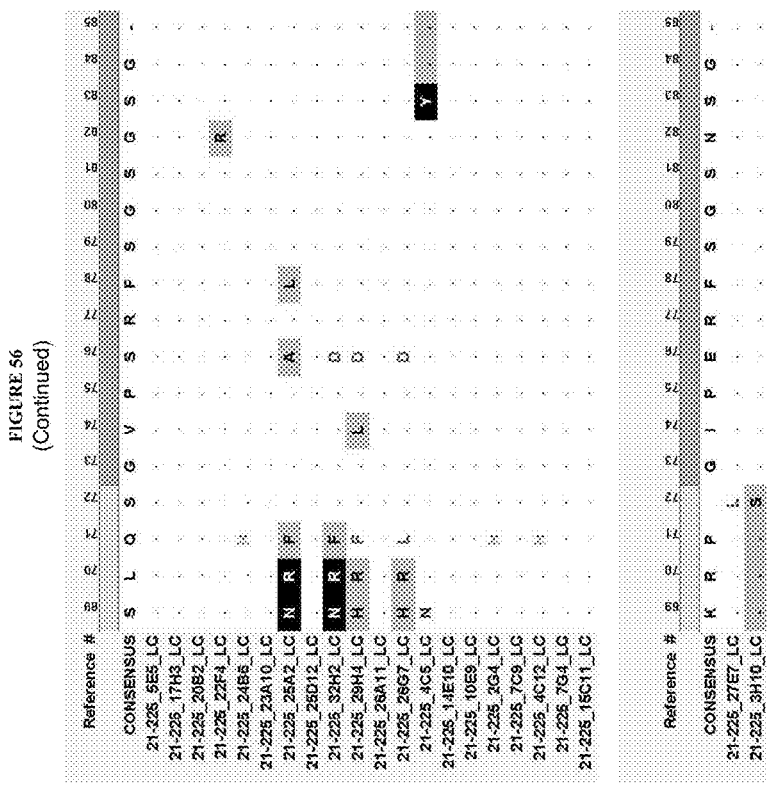
Figure 56:
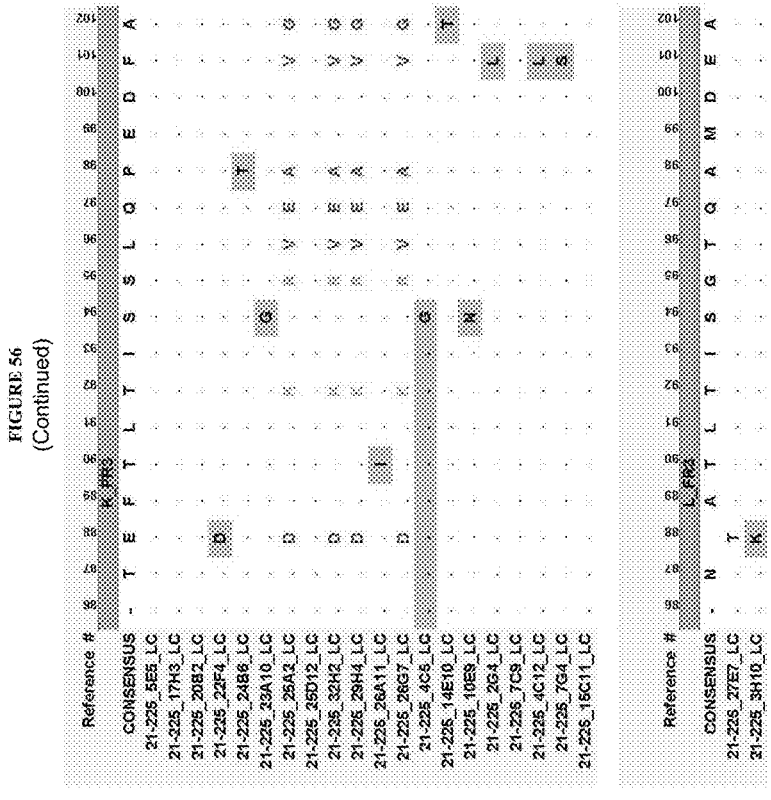
Figure 56:
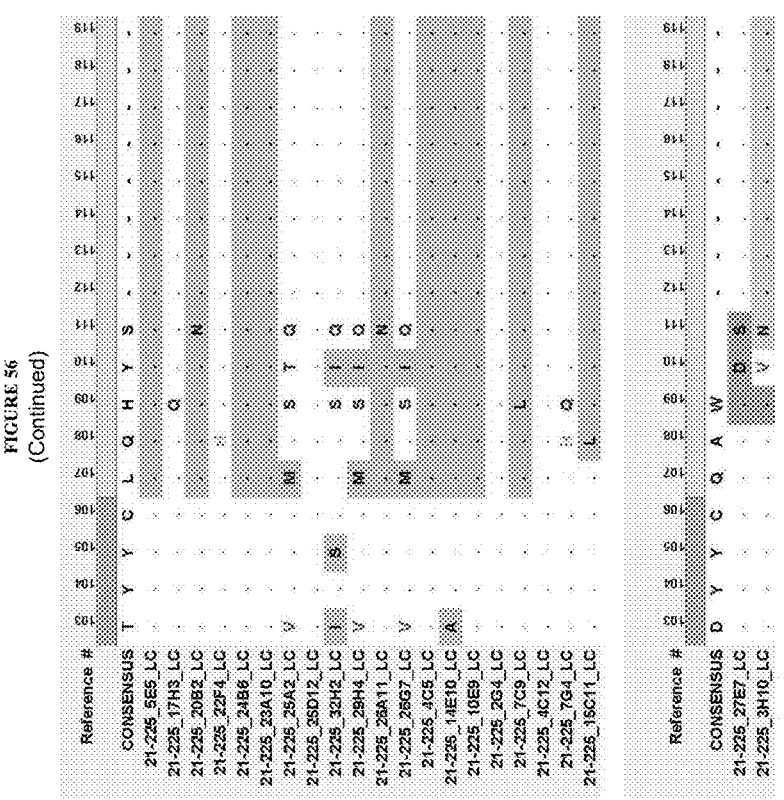
Figure 56:
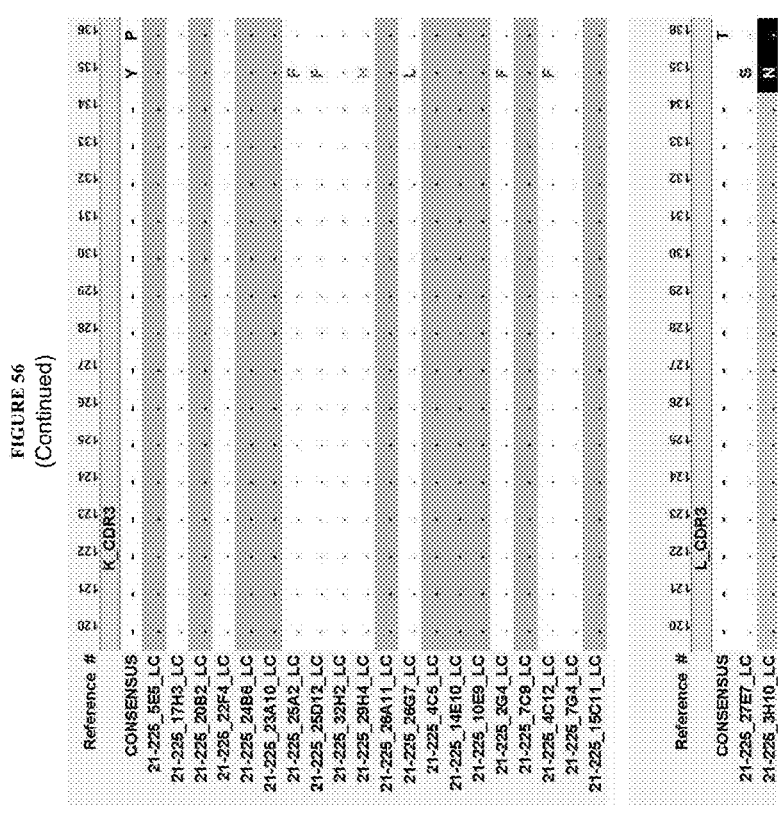
Figure 56:
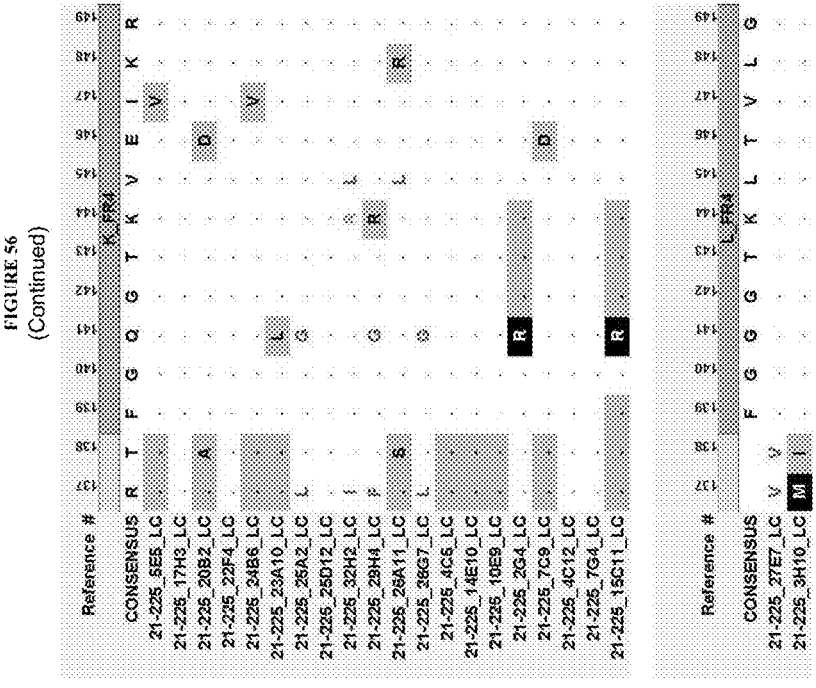
Figure 56:
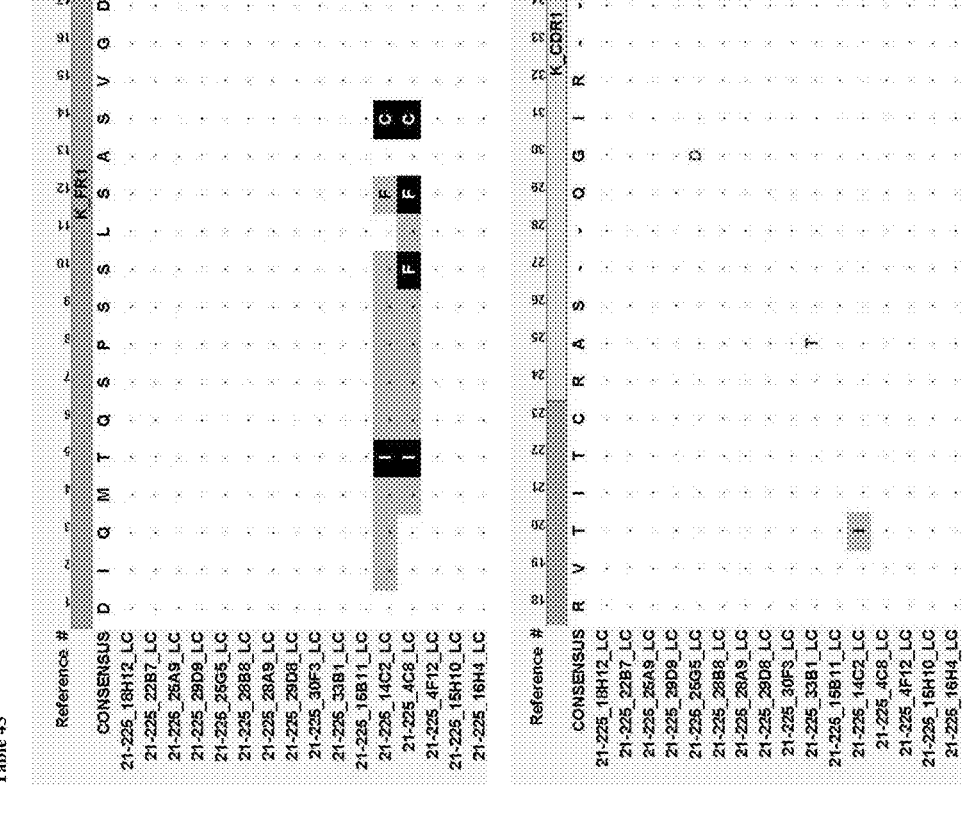
Figure 56:
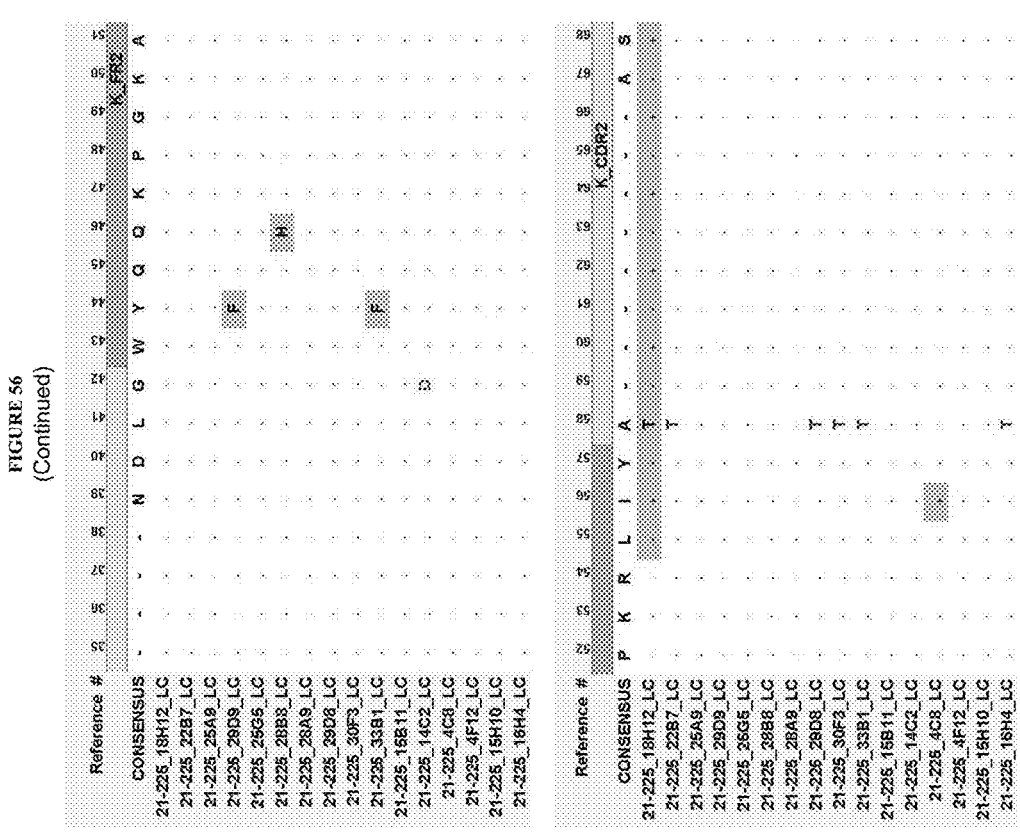
Figure 56:
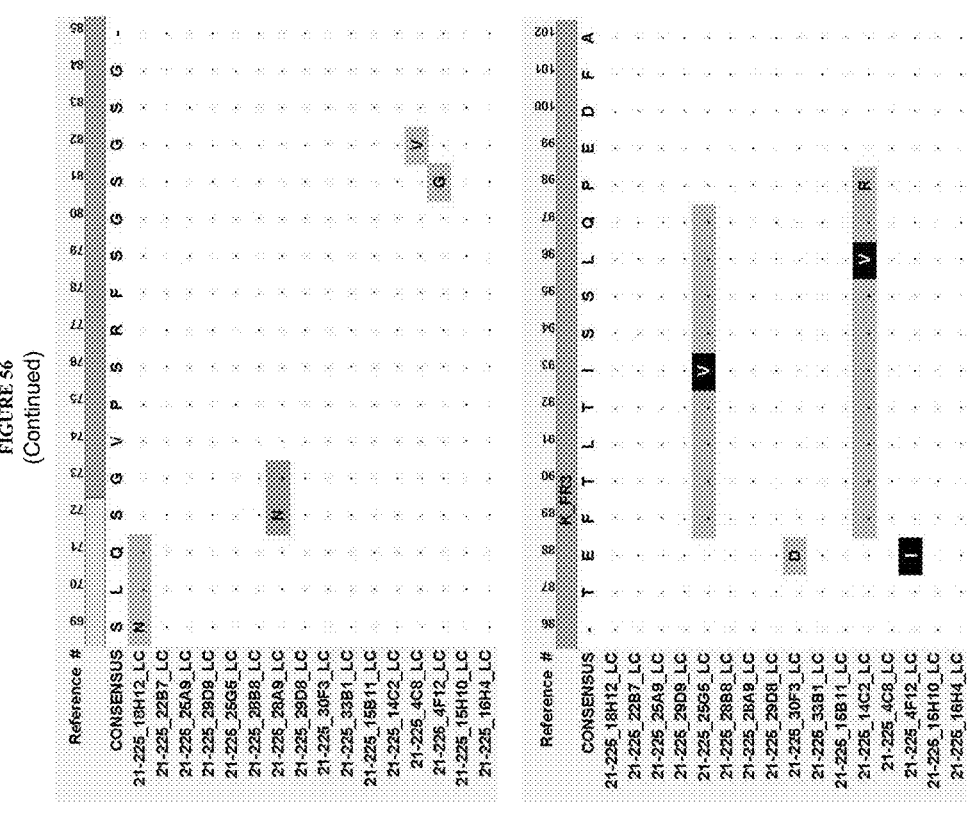
Figure 56:
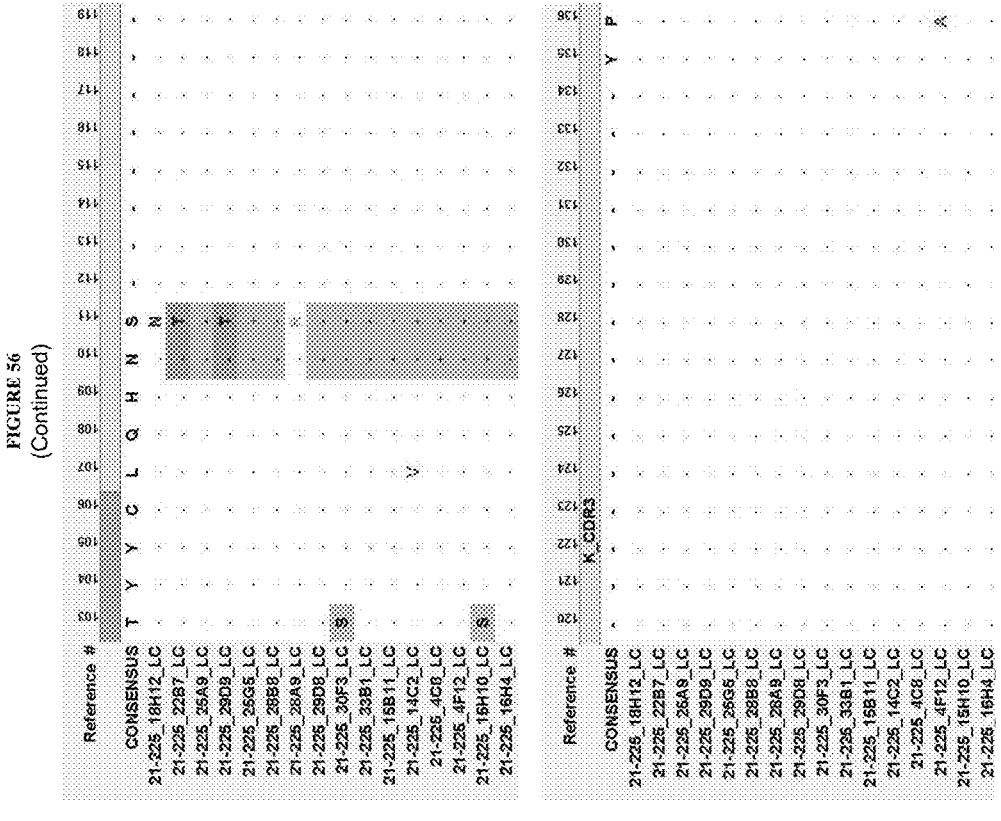
Figure 56:
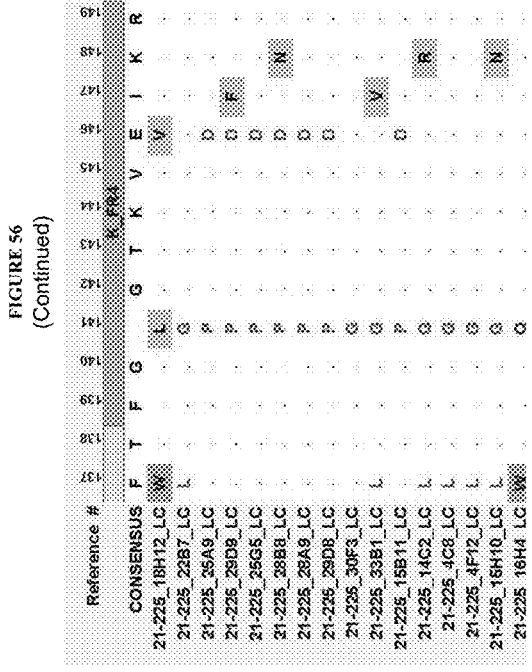
Figure 56:
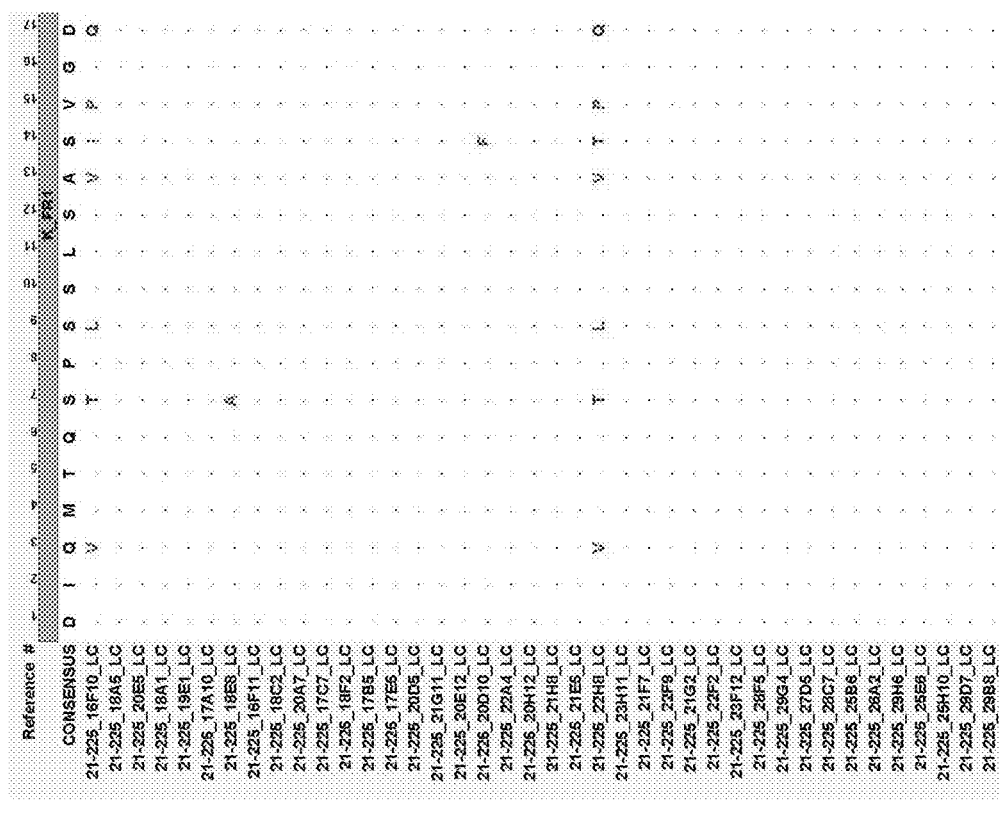
Figure 56:
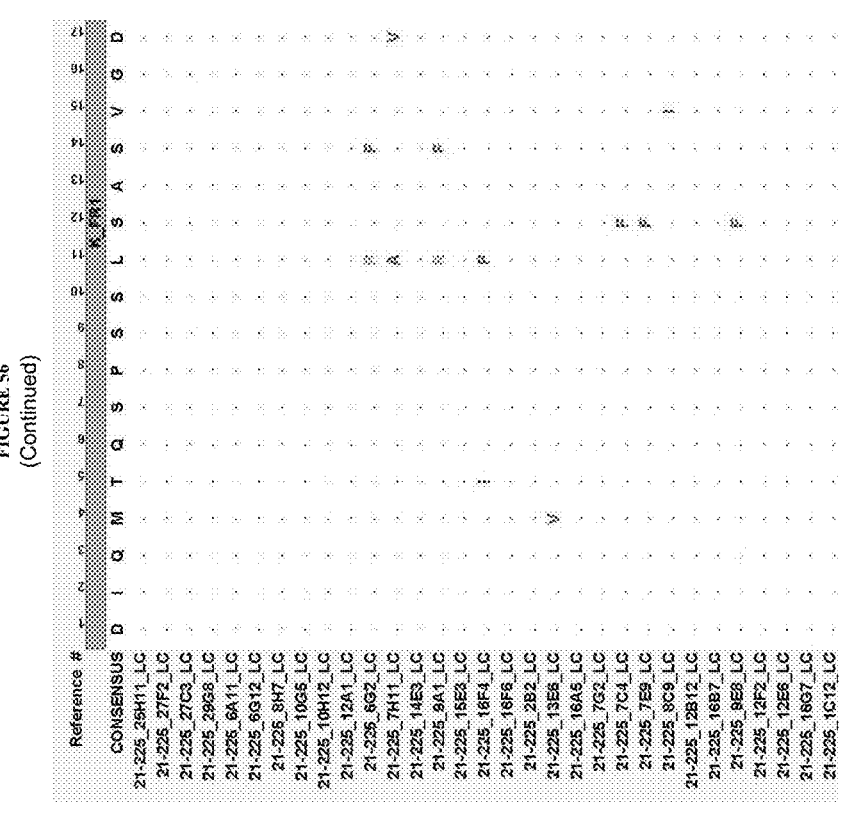
Figure 56:
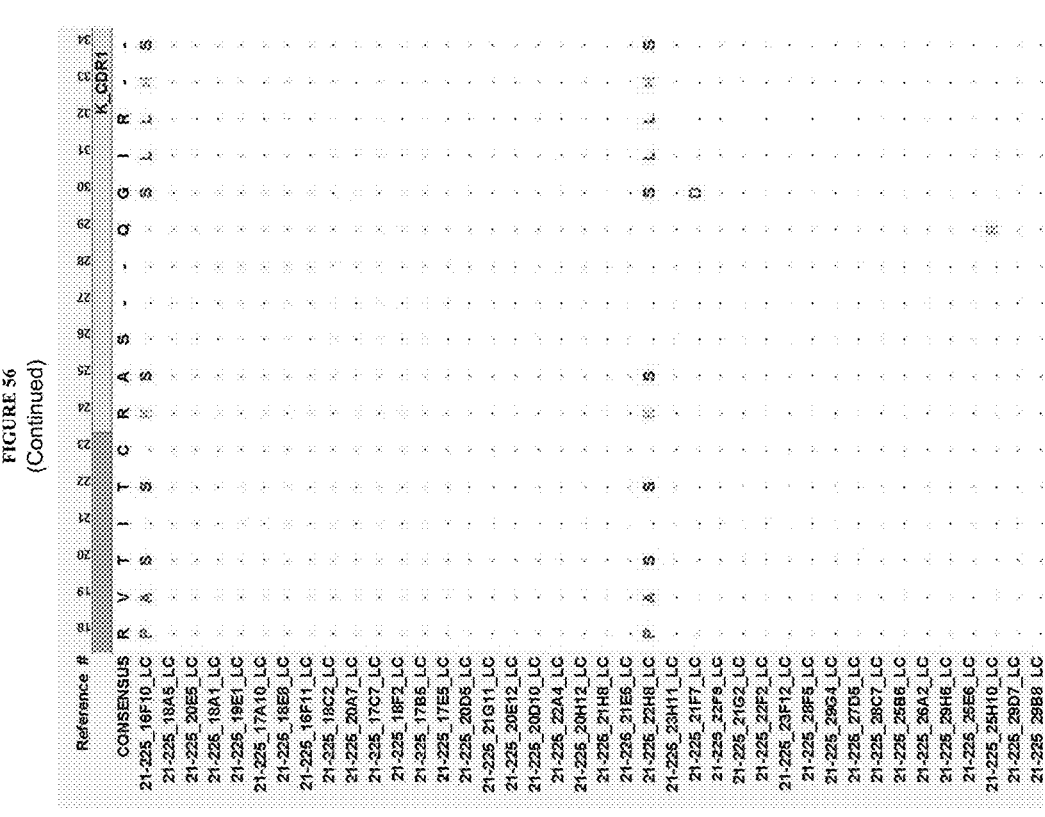
Figure 56:
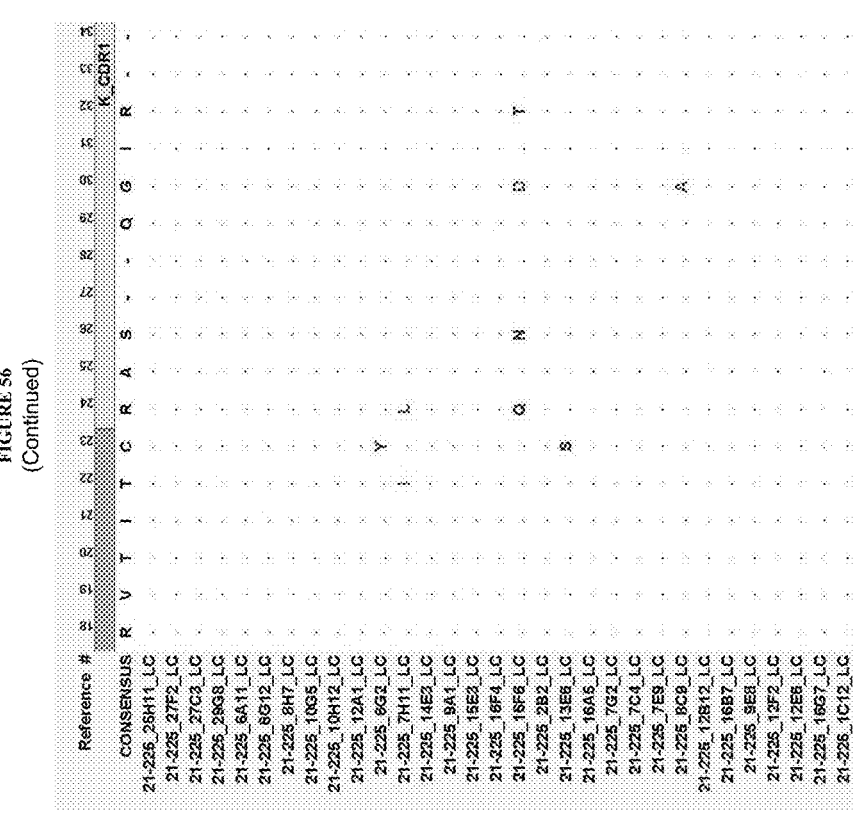
Figure 56:
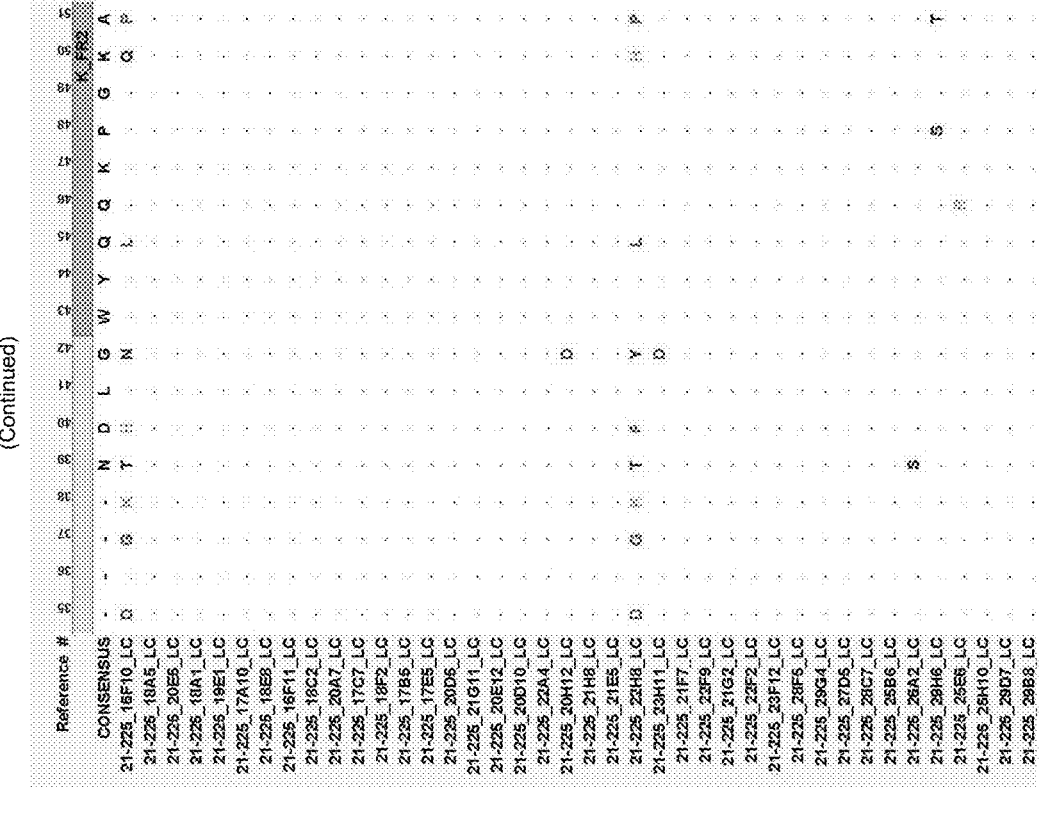
Figure 56:
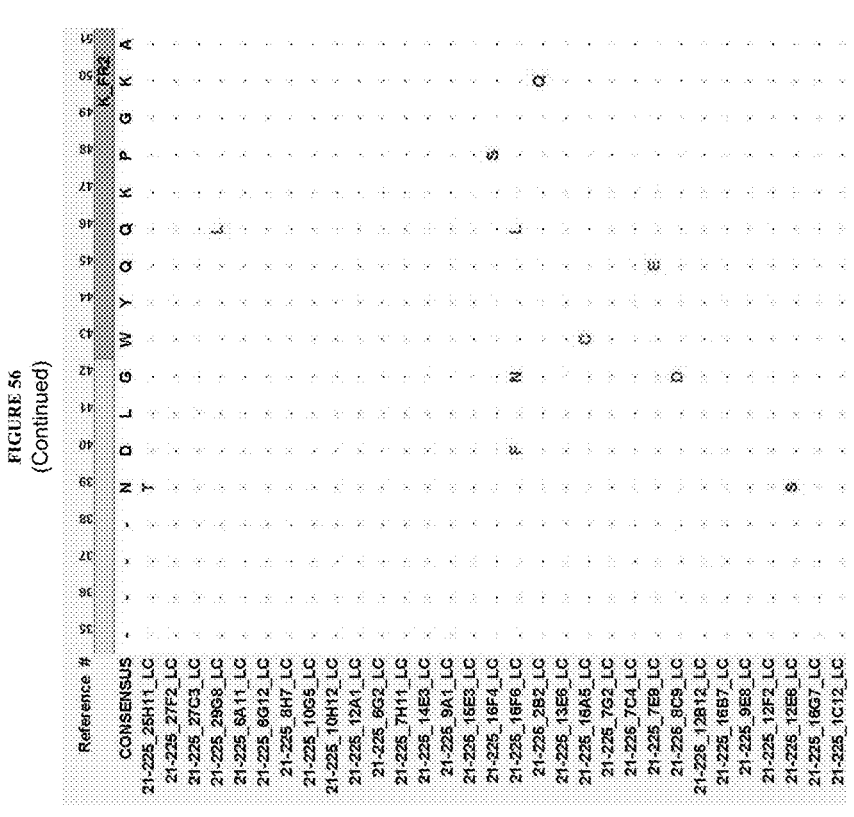
Figure 56:
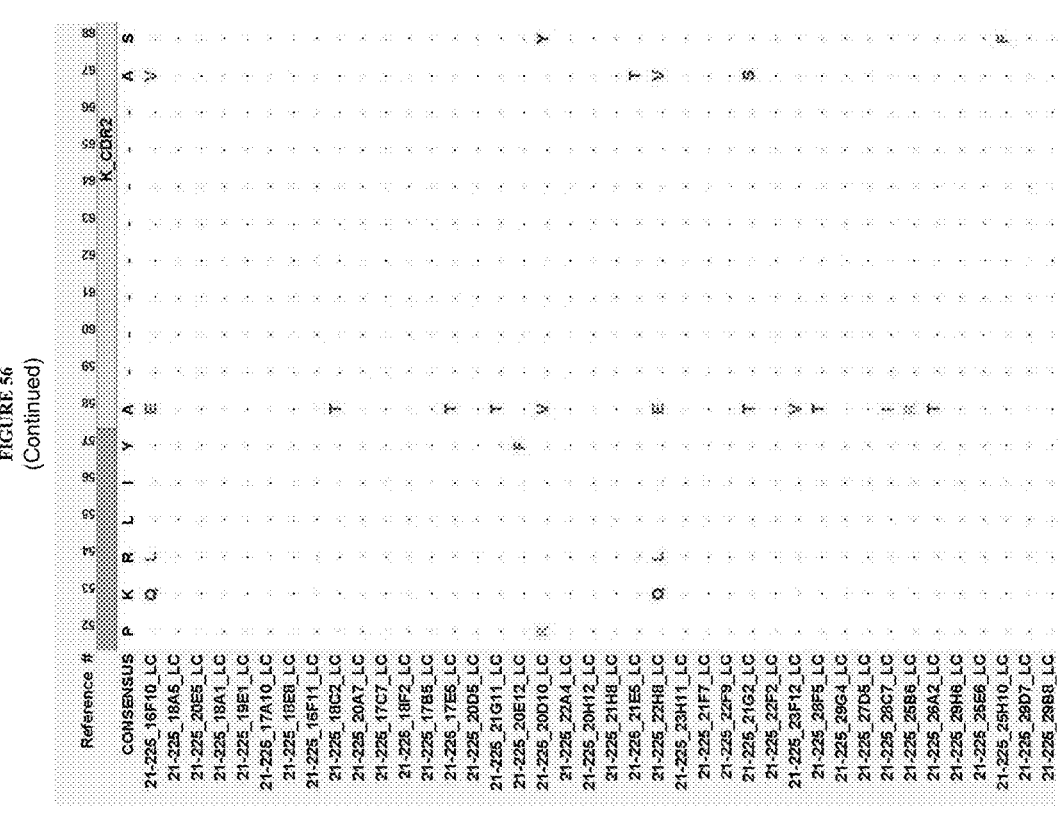
Figure 56:
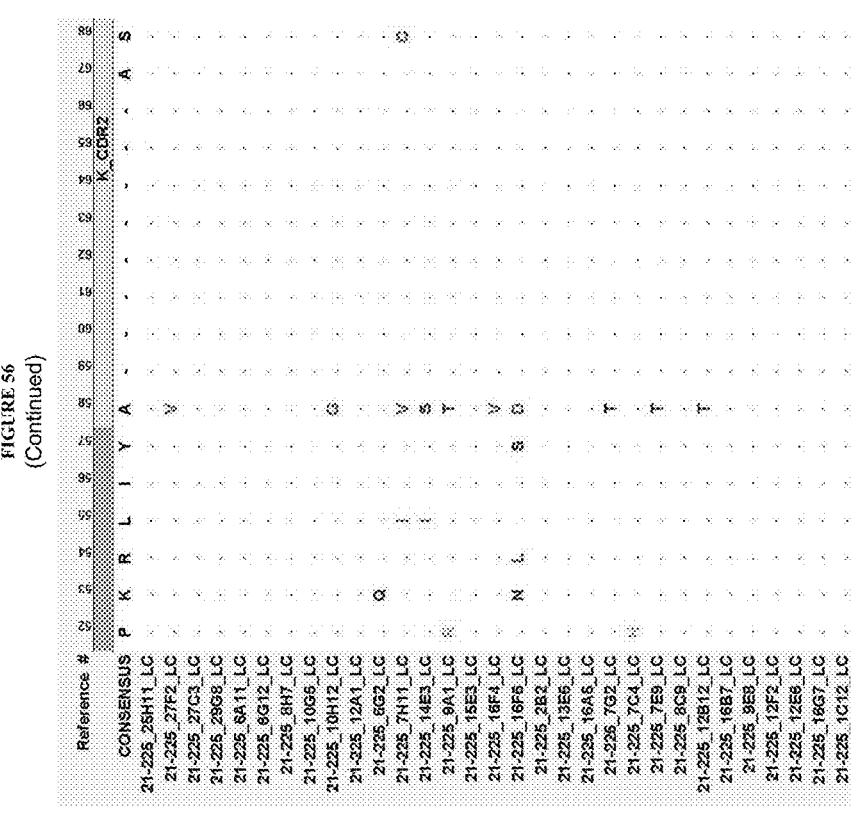
Figure 56:
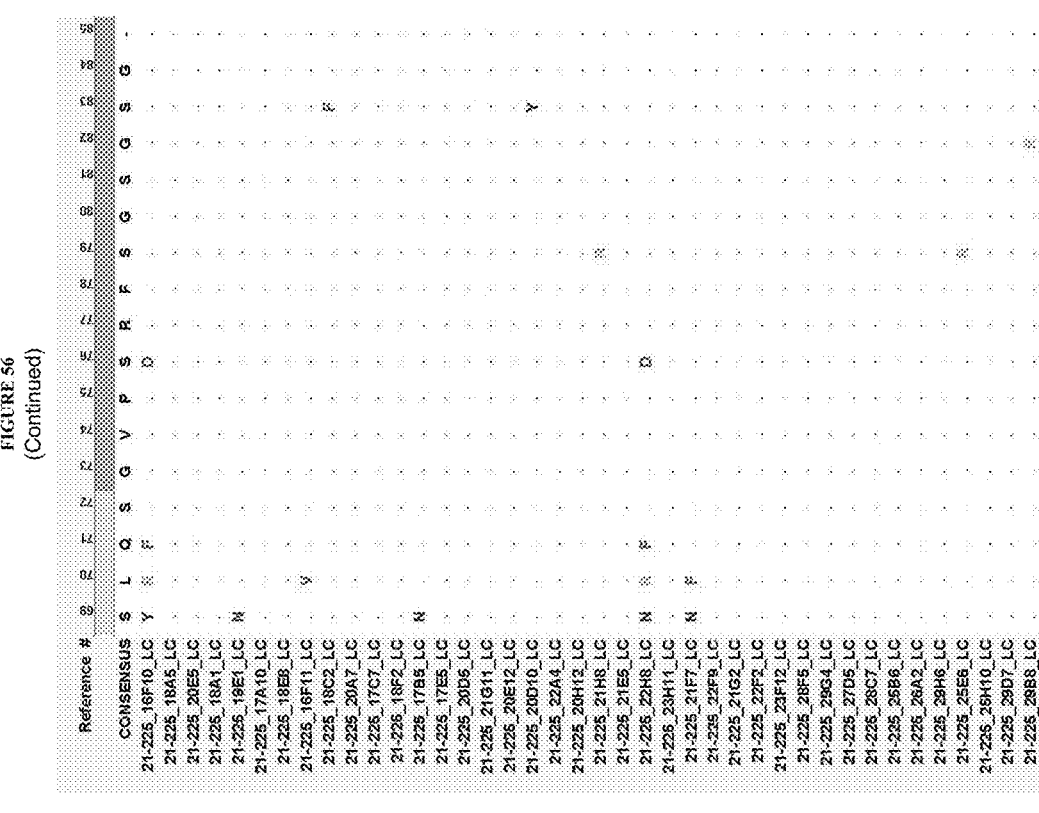
Figure 56:
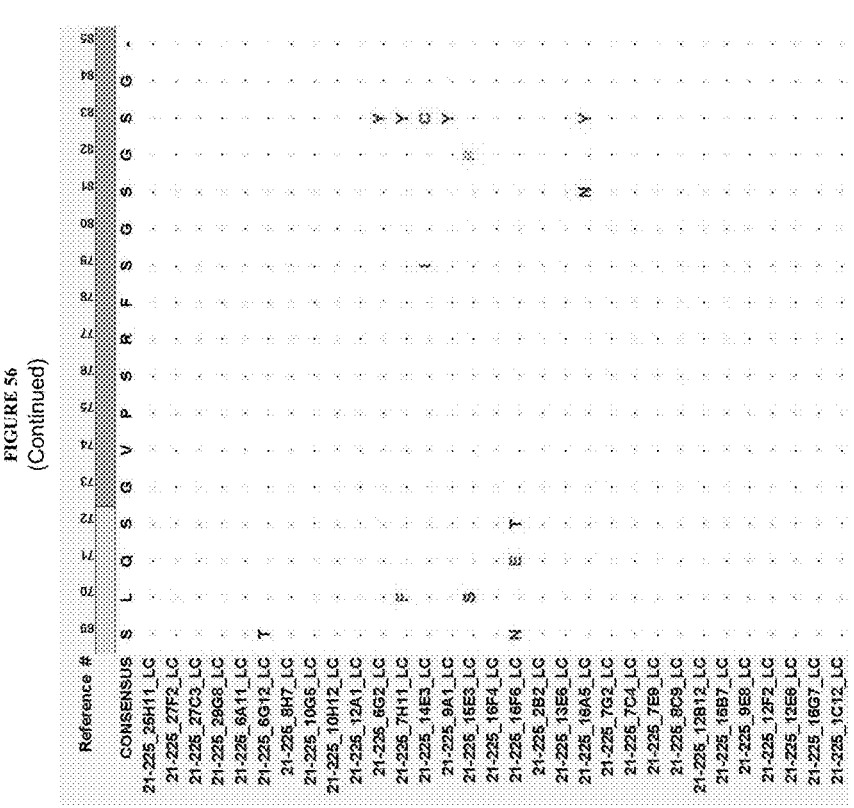
Figure 56:
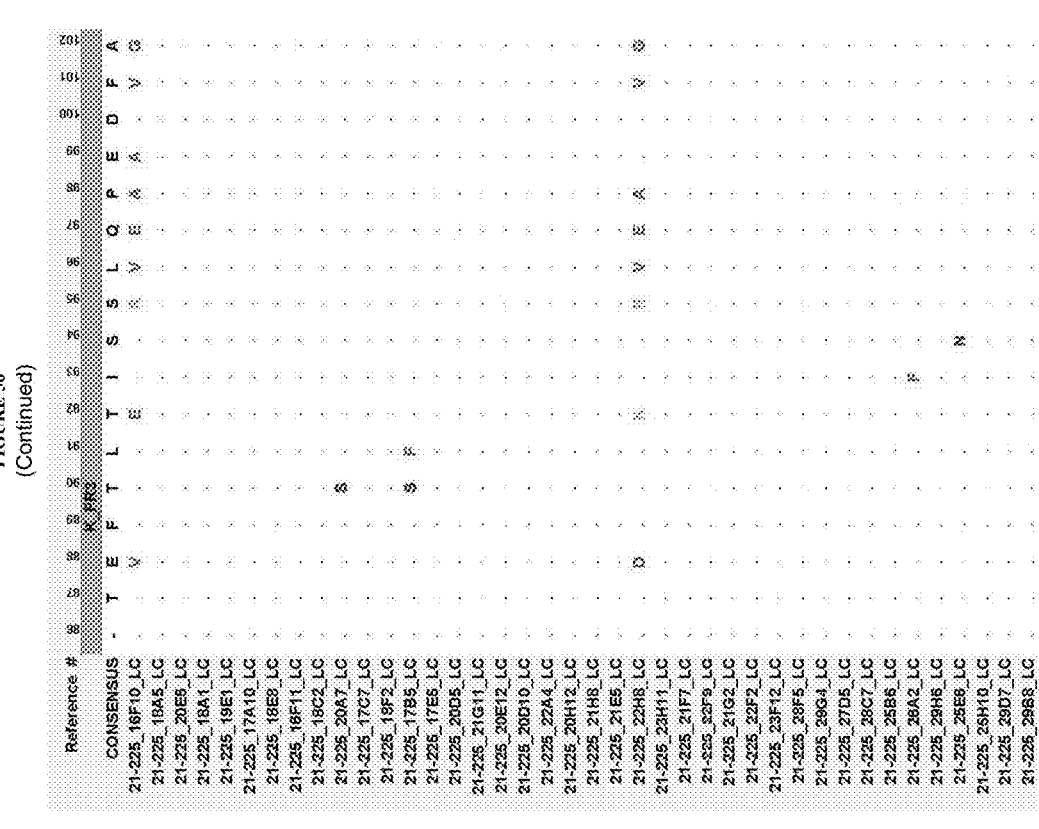
Figure 56:
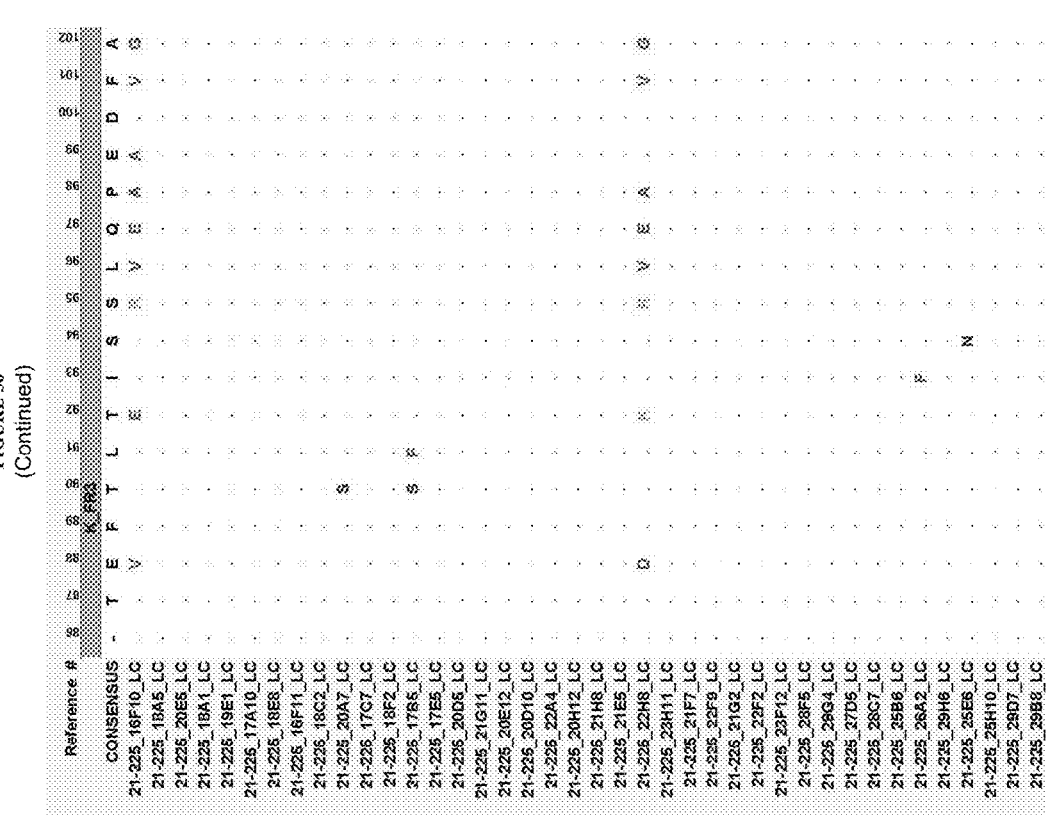
Figure 56:
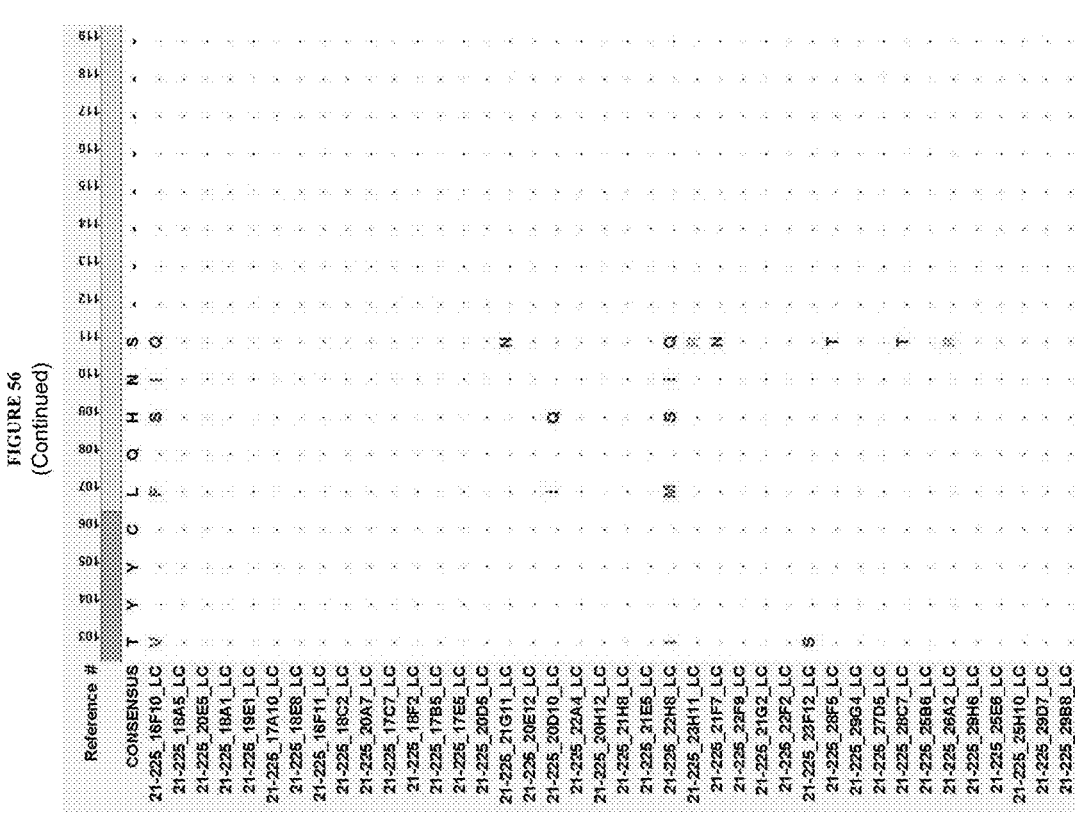
Figure 56:
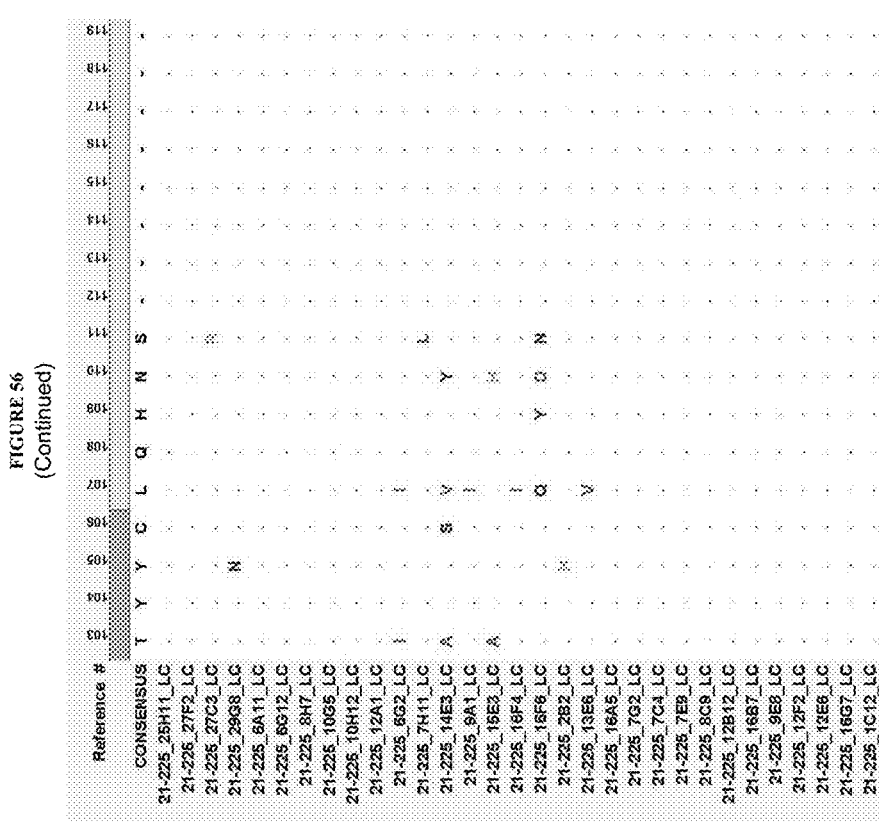
Figure 56:
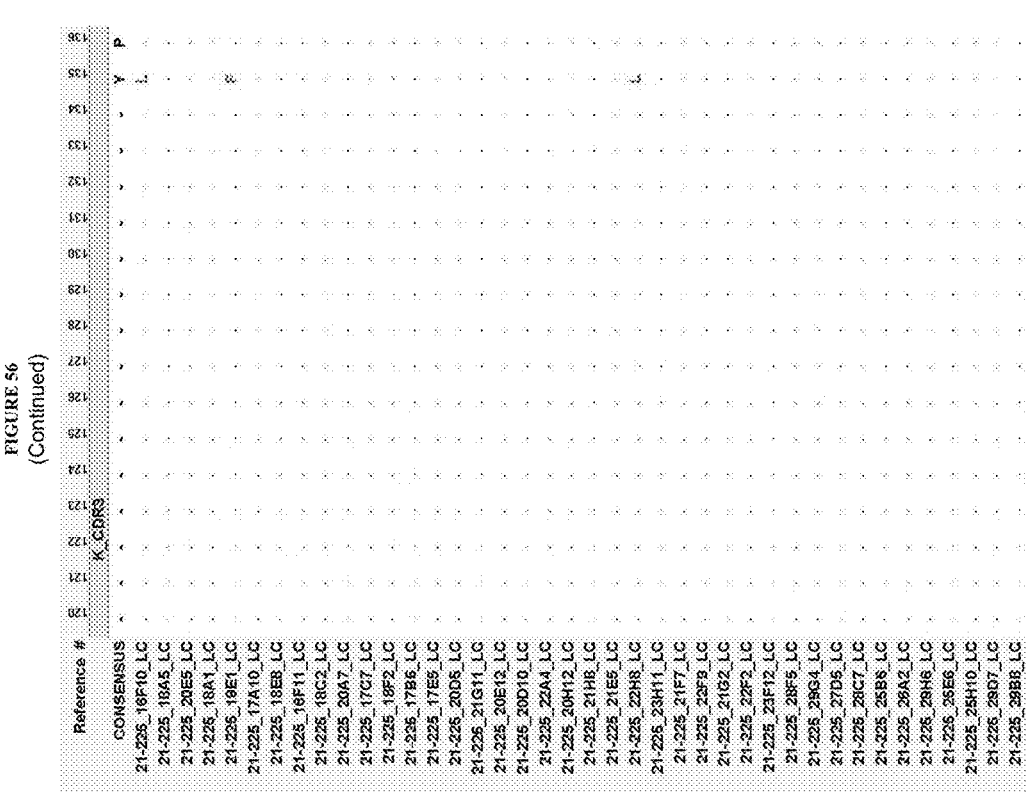
Figure 56:
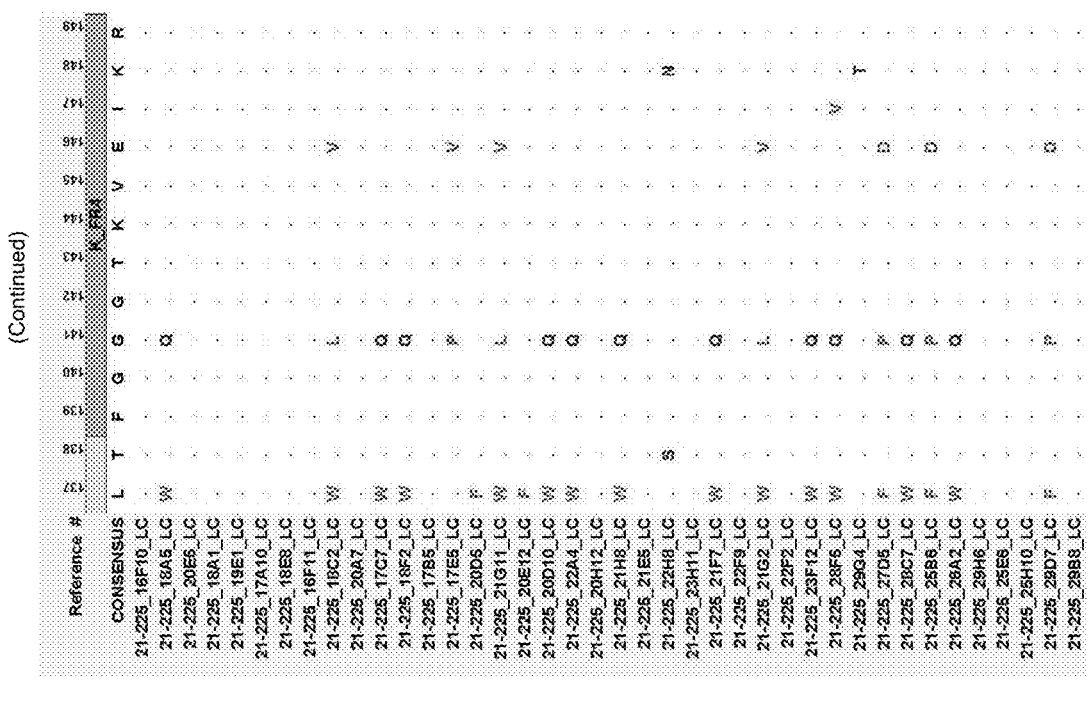
Figure 56:
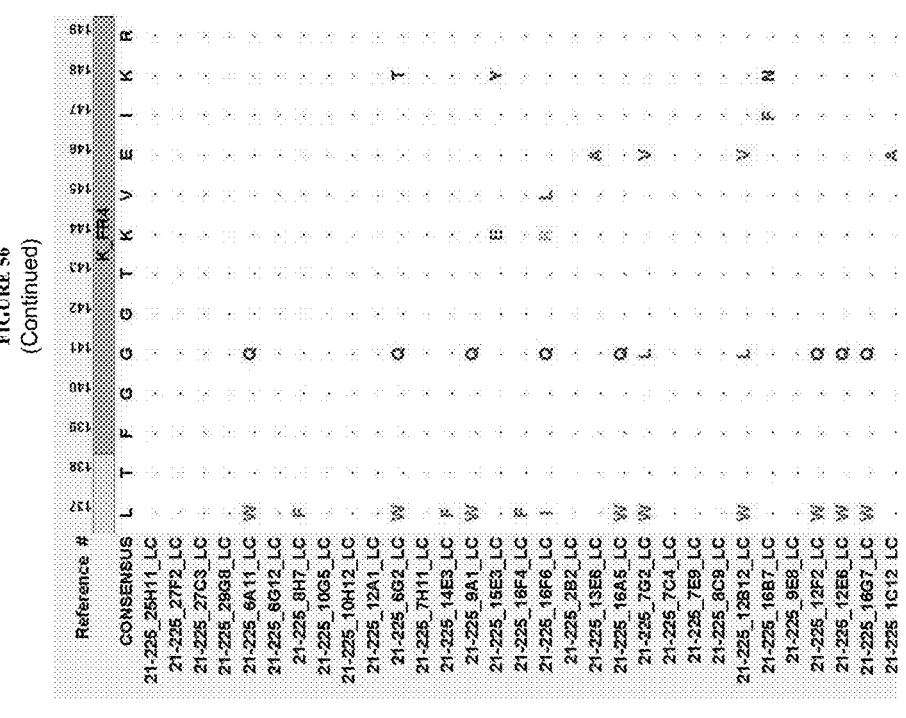
Figure 56:
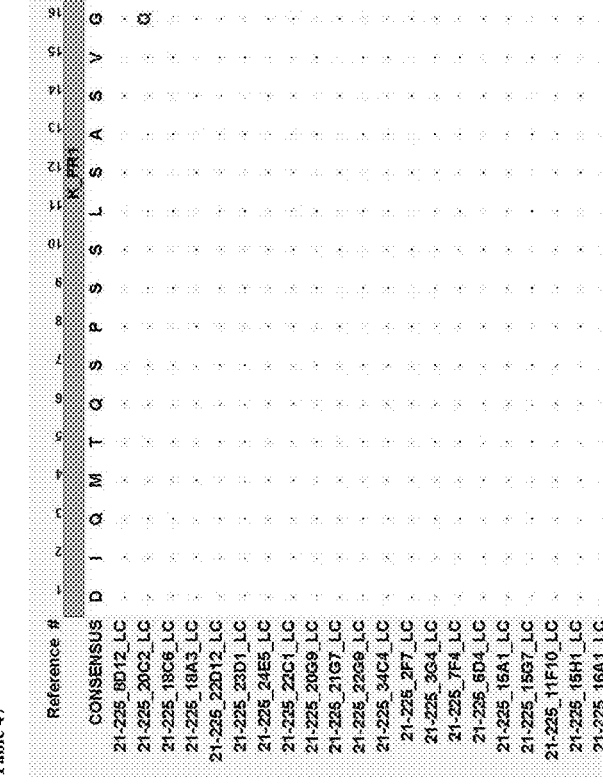
Figure 56:
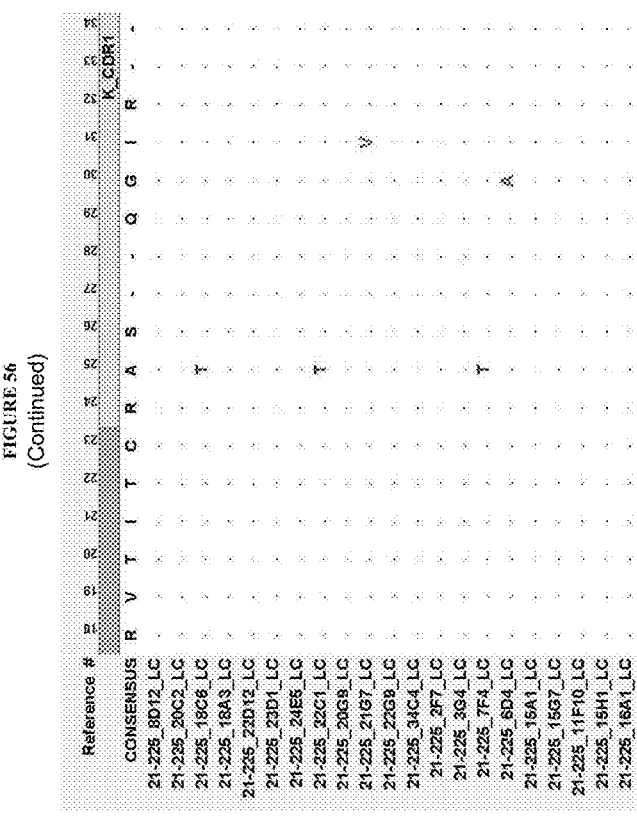
Figure 56:
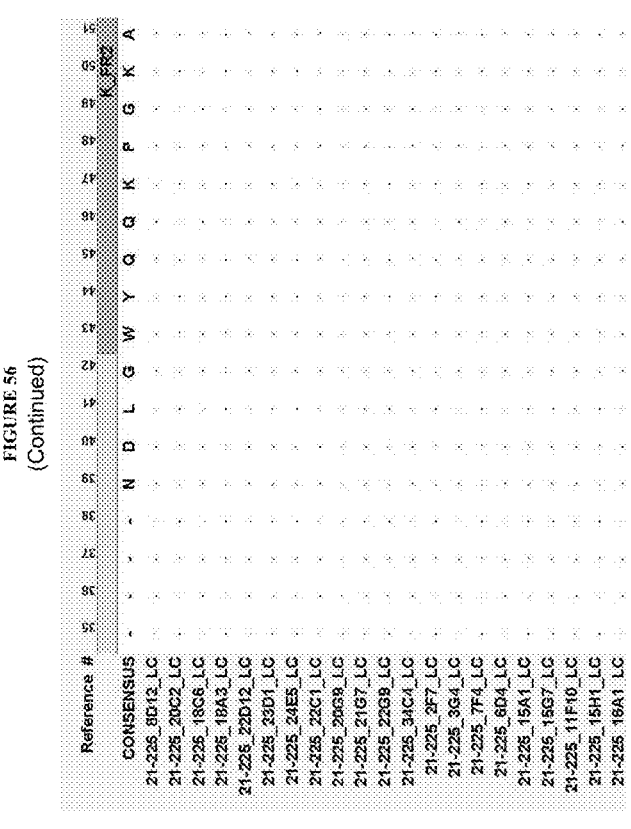
Figure 56:
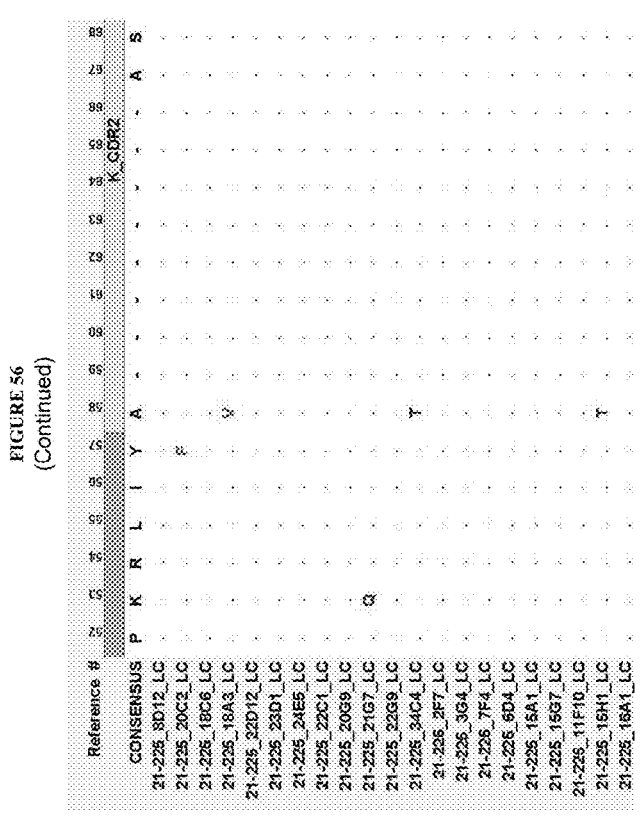
Figure 56:
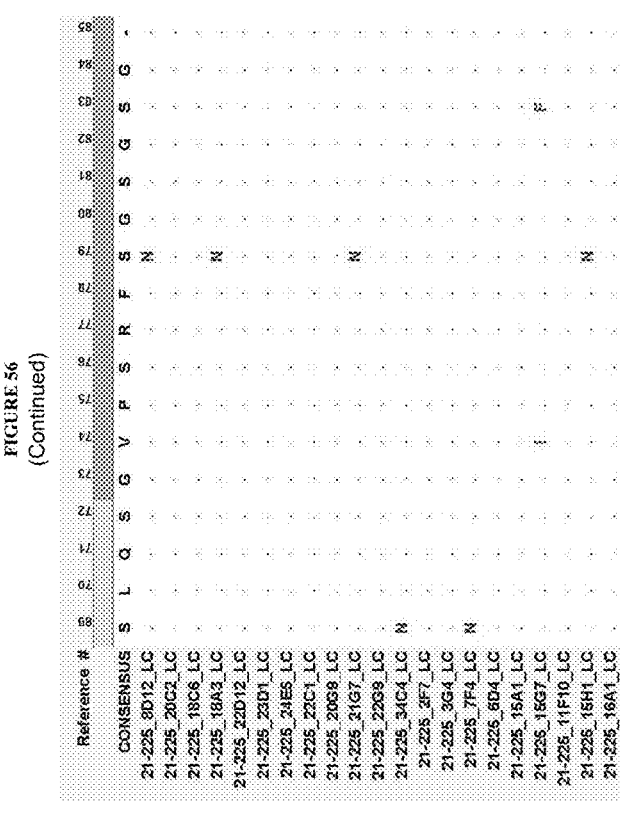
Figure 56:
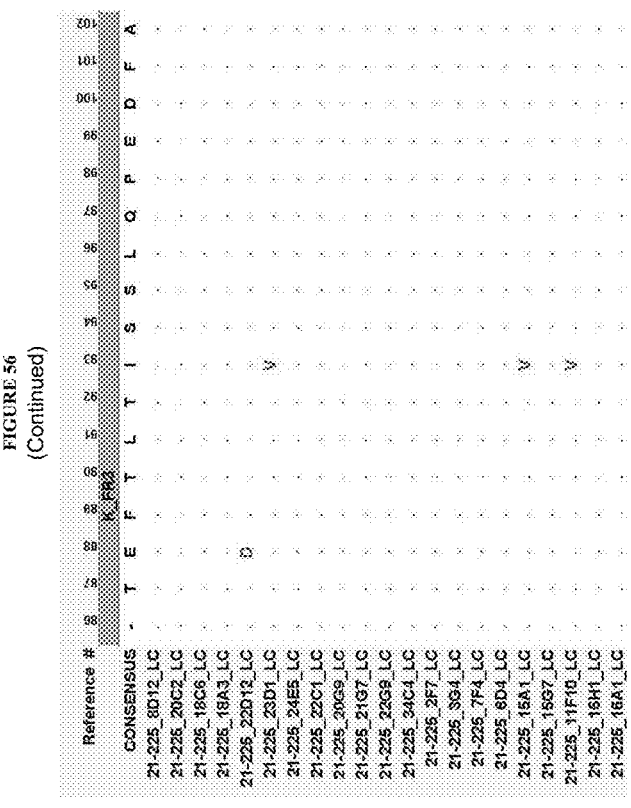
Figure 56:
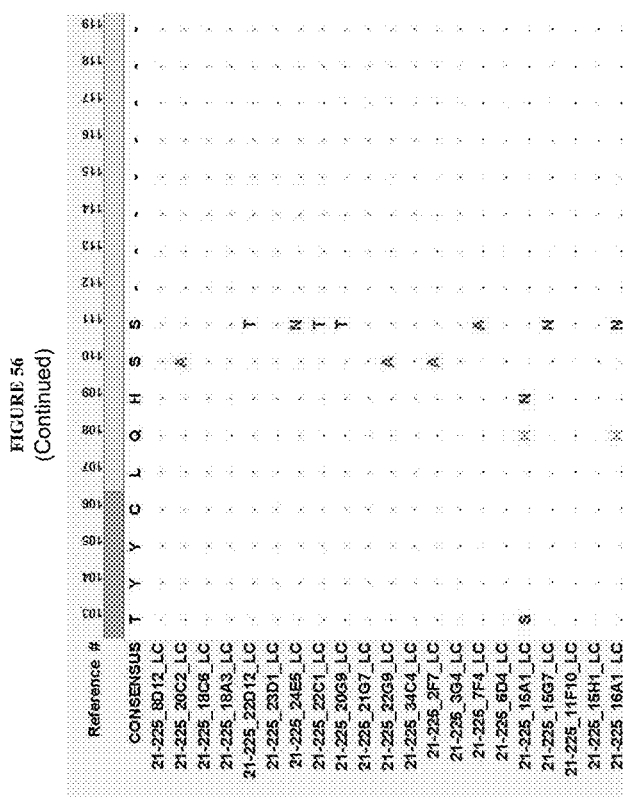
Figure 56:
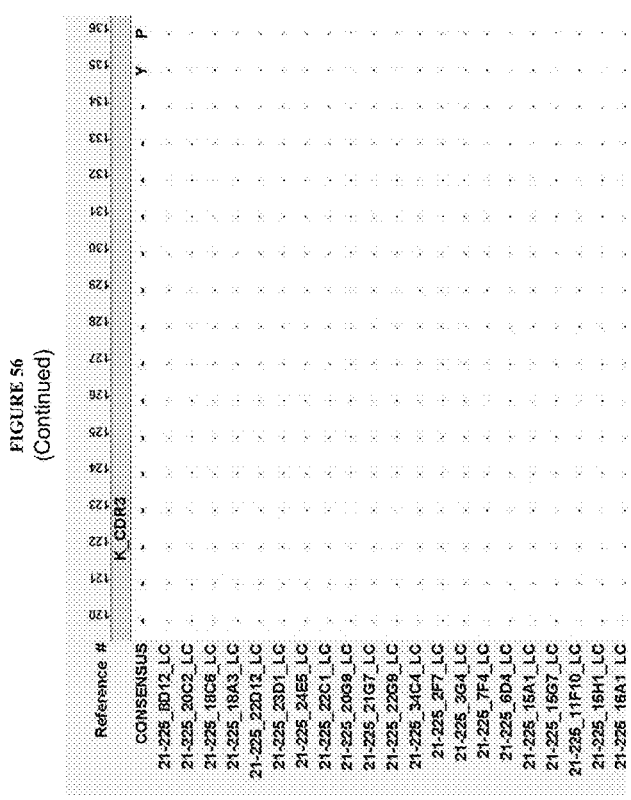
Figure 56:
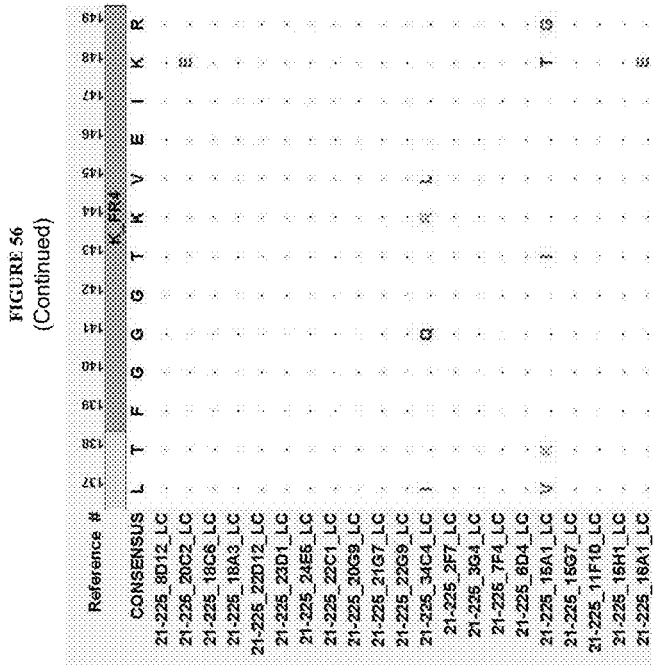
Figure 56:
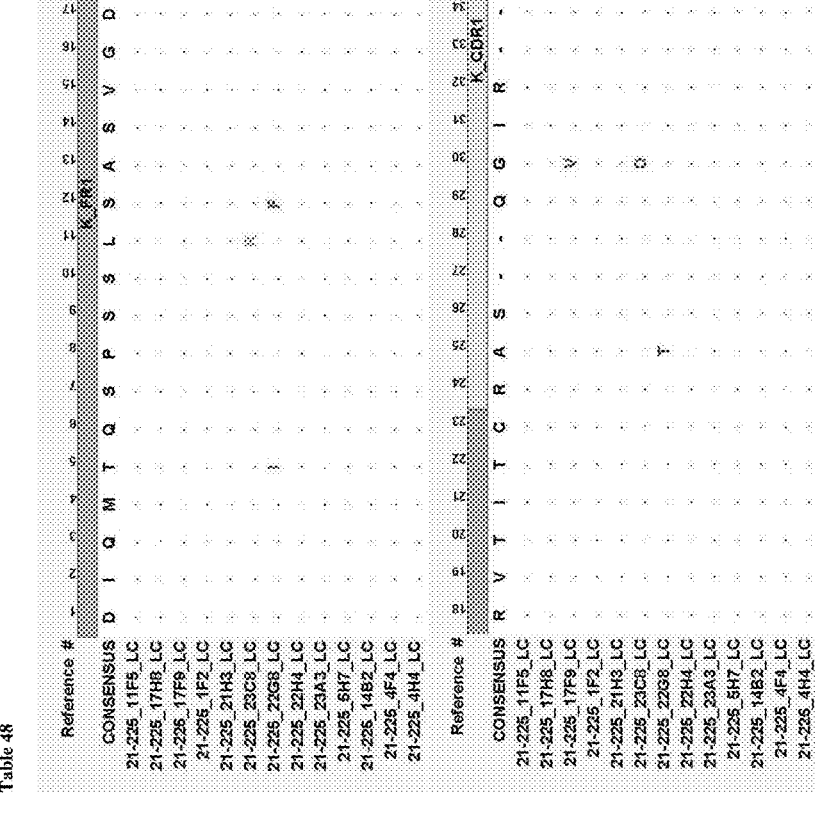
Figure 56:
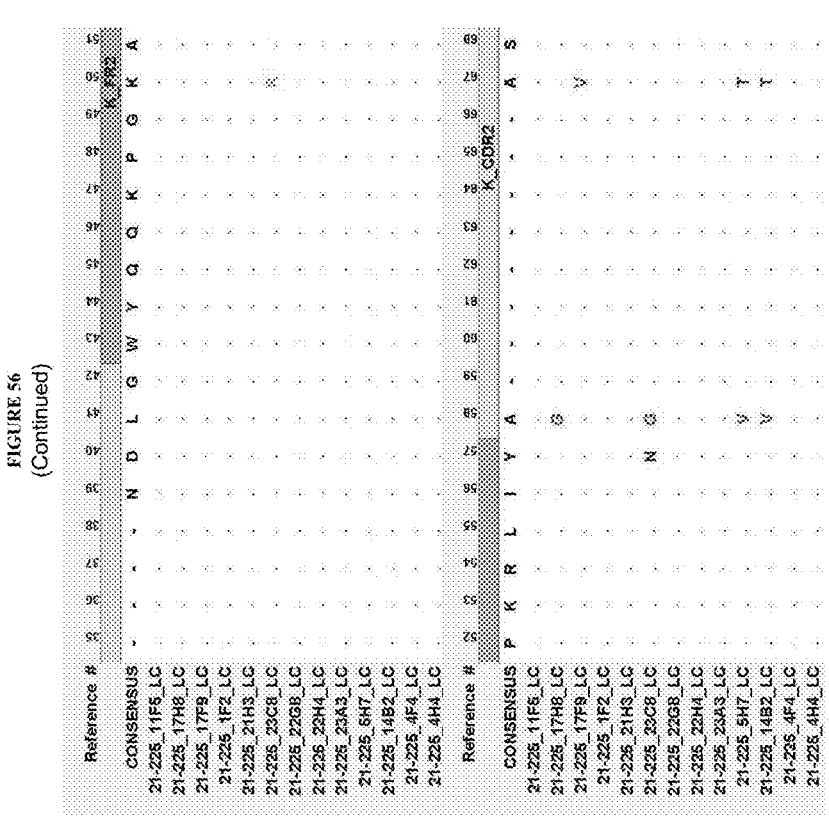
Figure 56:
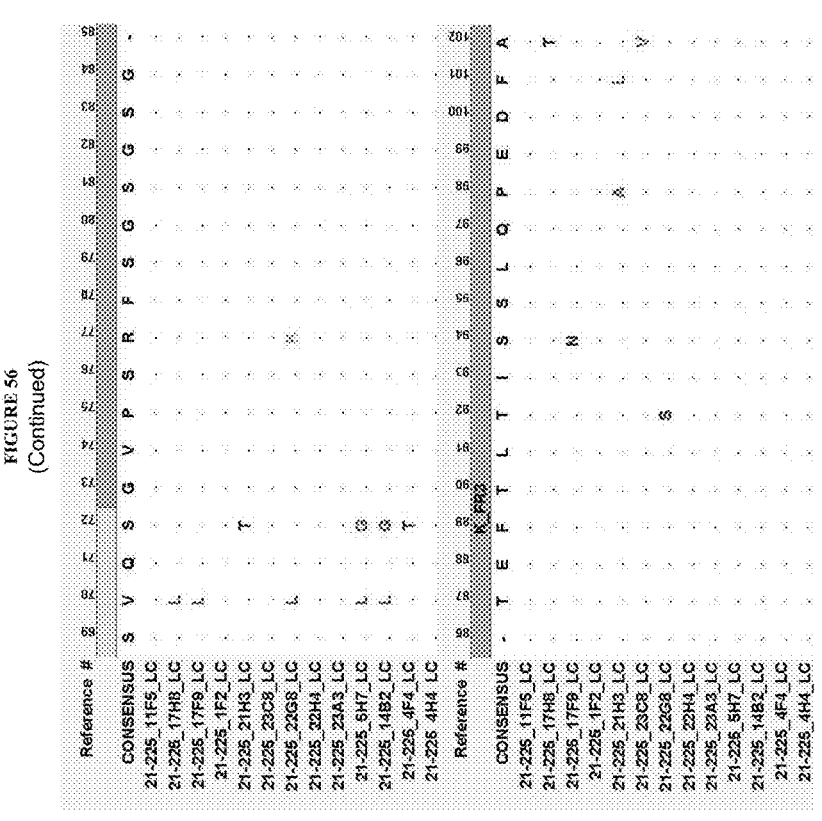
Figure 56:
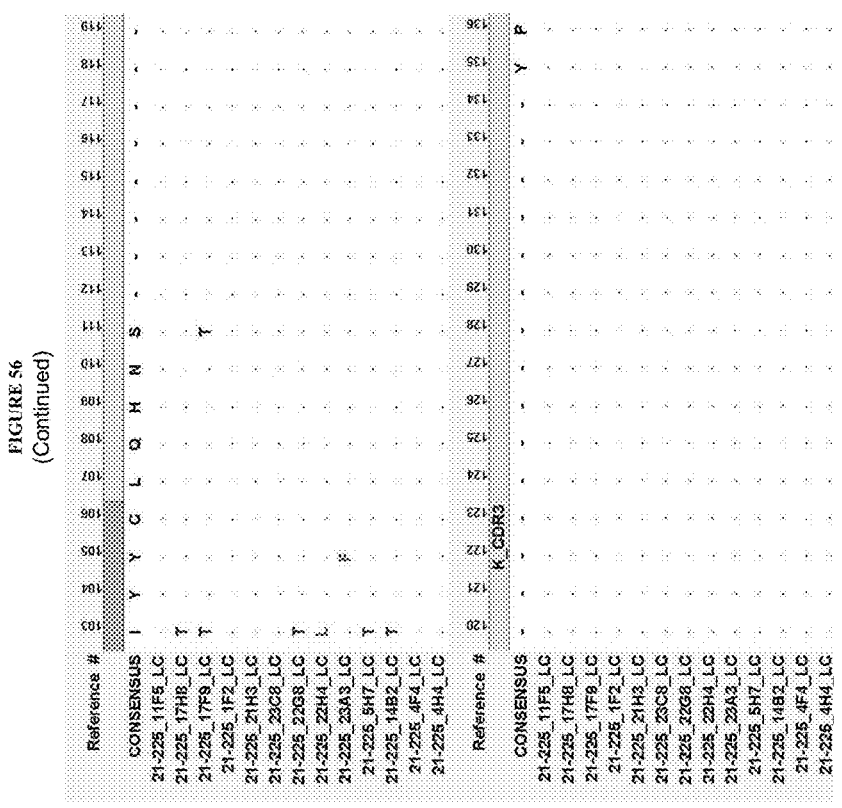
Figure 56:
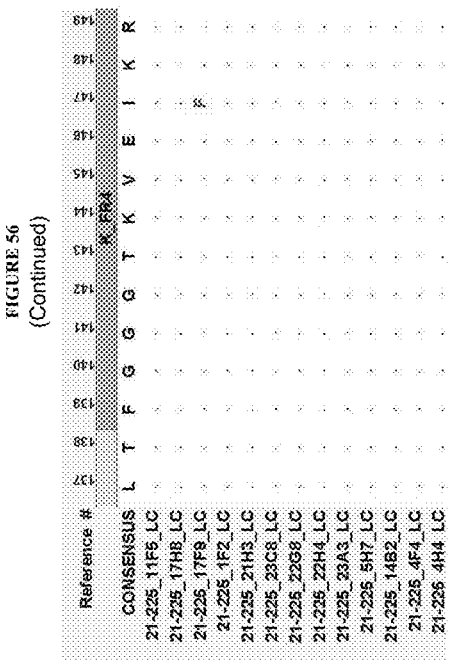
Figure 57:
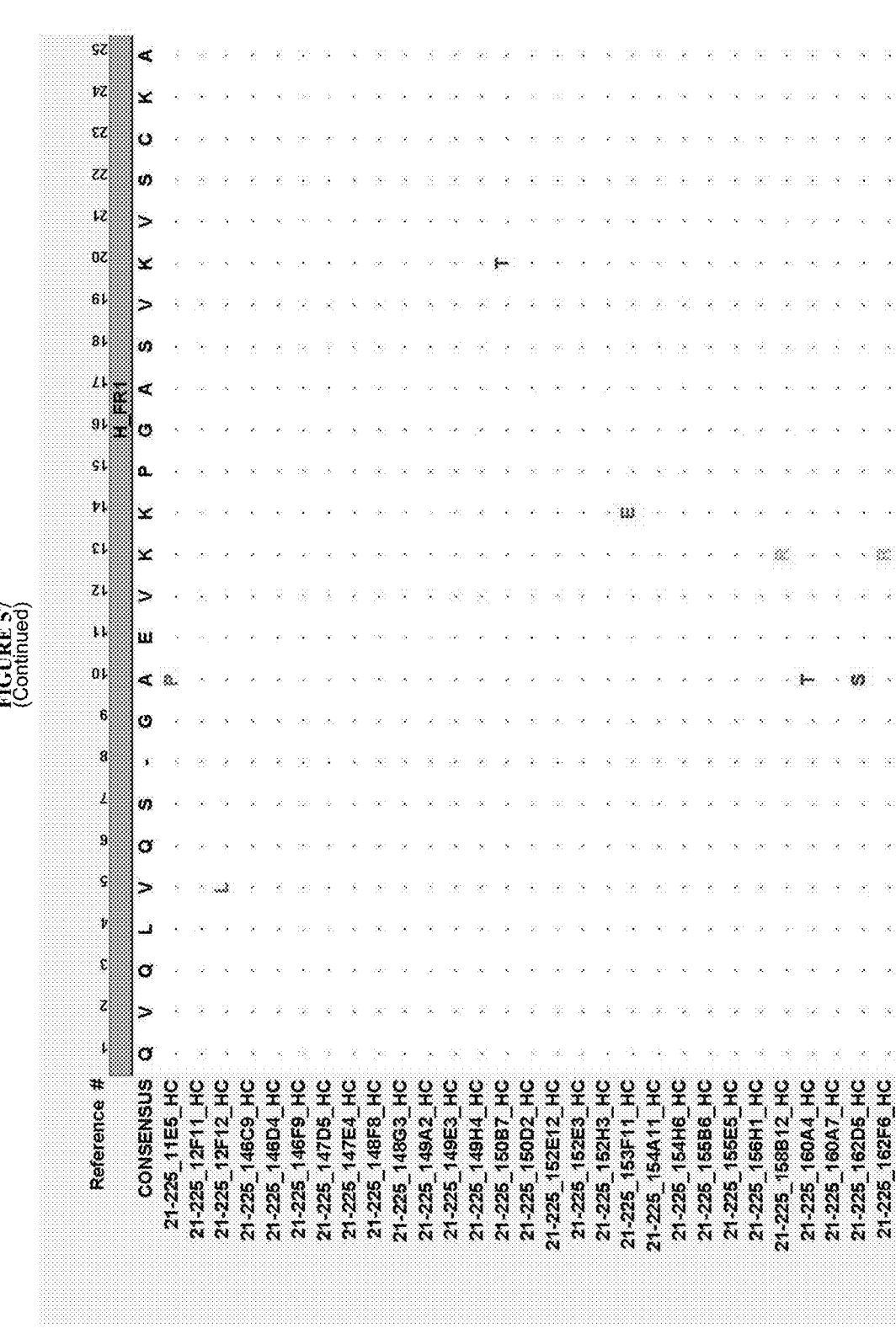
FIG. 57. A group of tables presenting the consensus protein alignment of various light and heavy chain variable regions for certain antigen binding proteins of the present invention (Tables 49-134).
Figure 57:
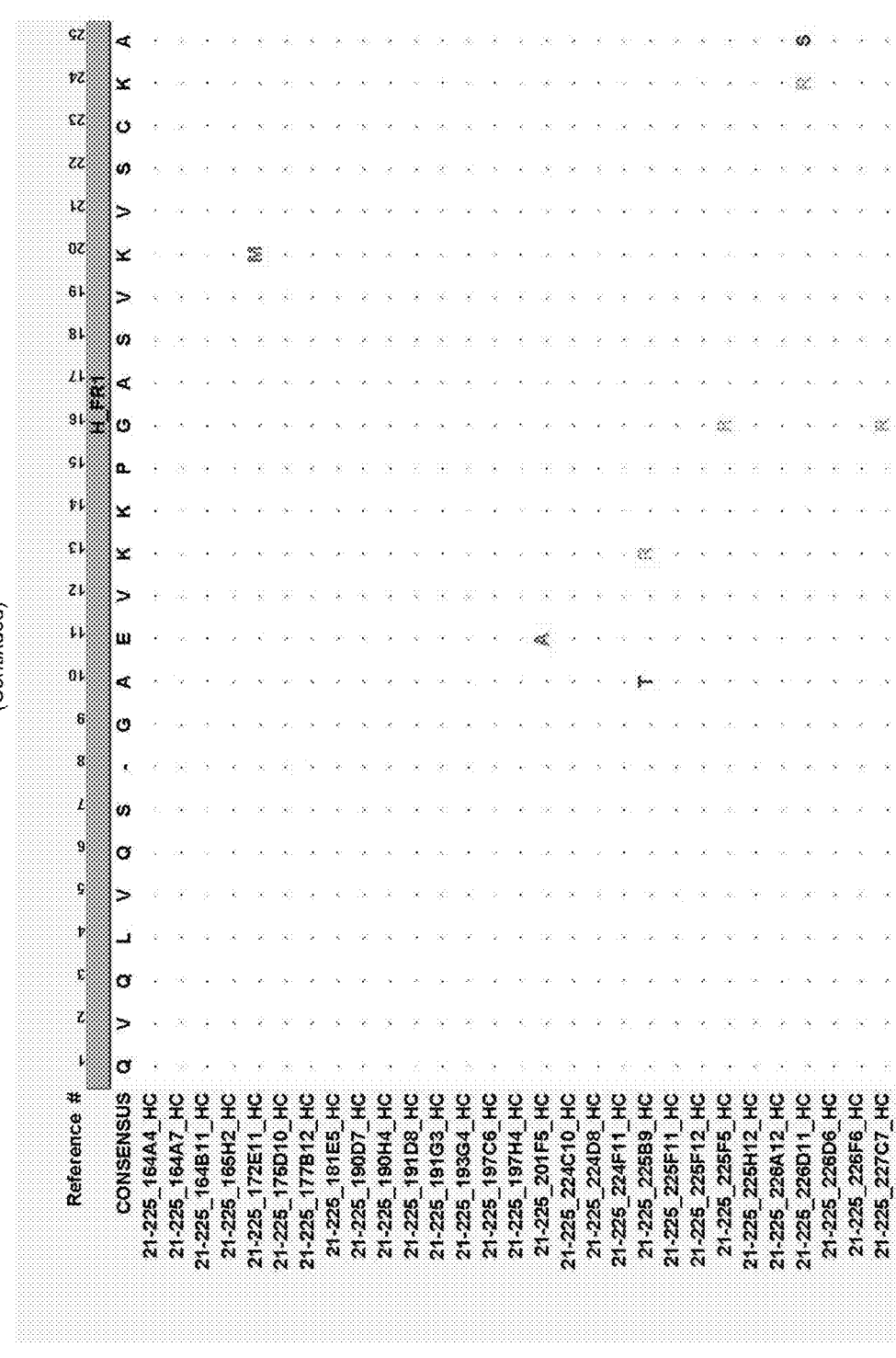
Figure 57:
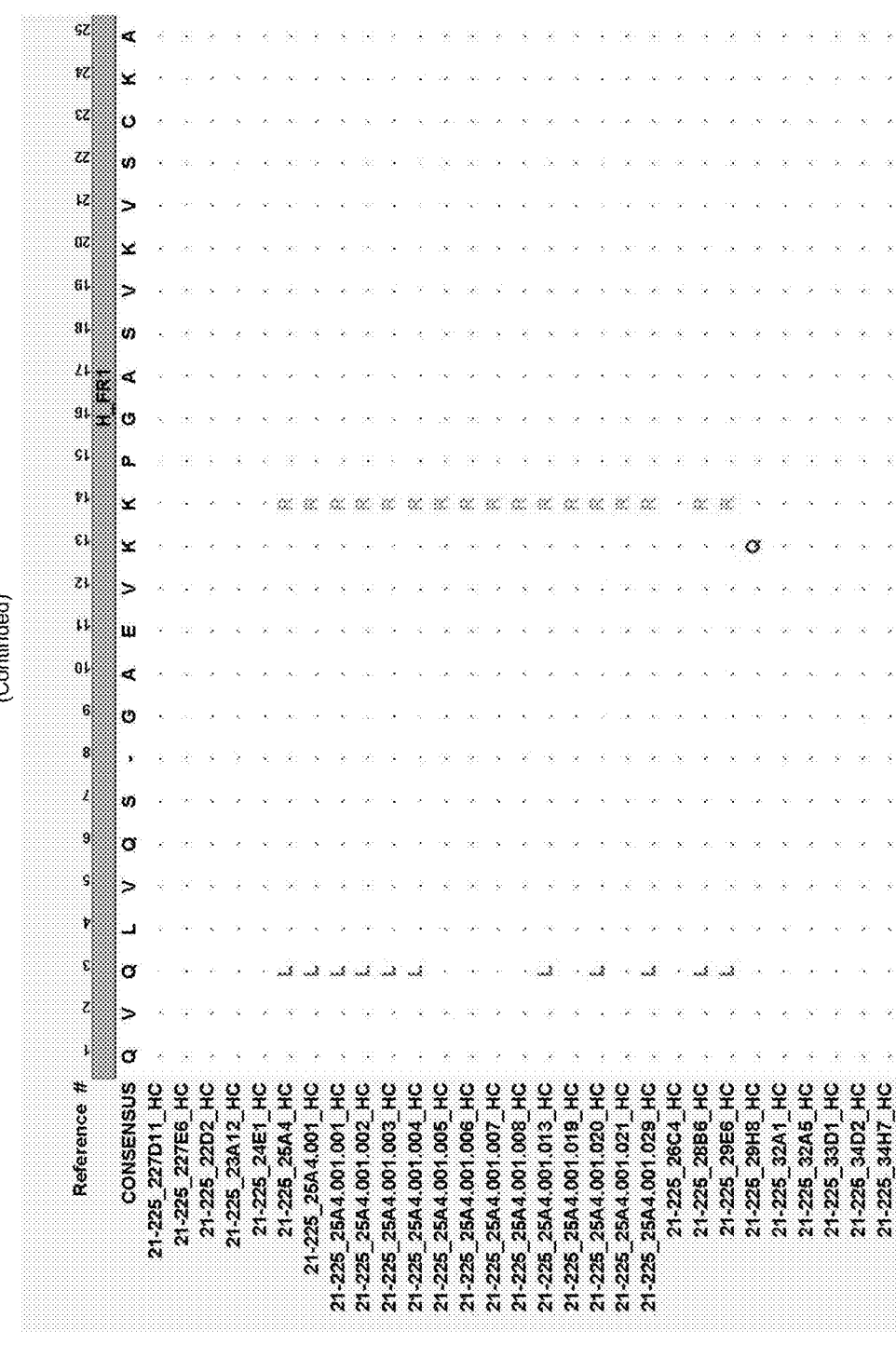
Figure 57:
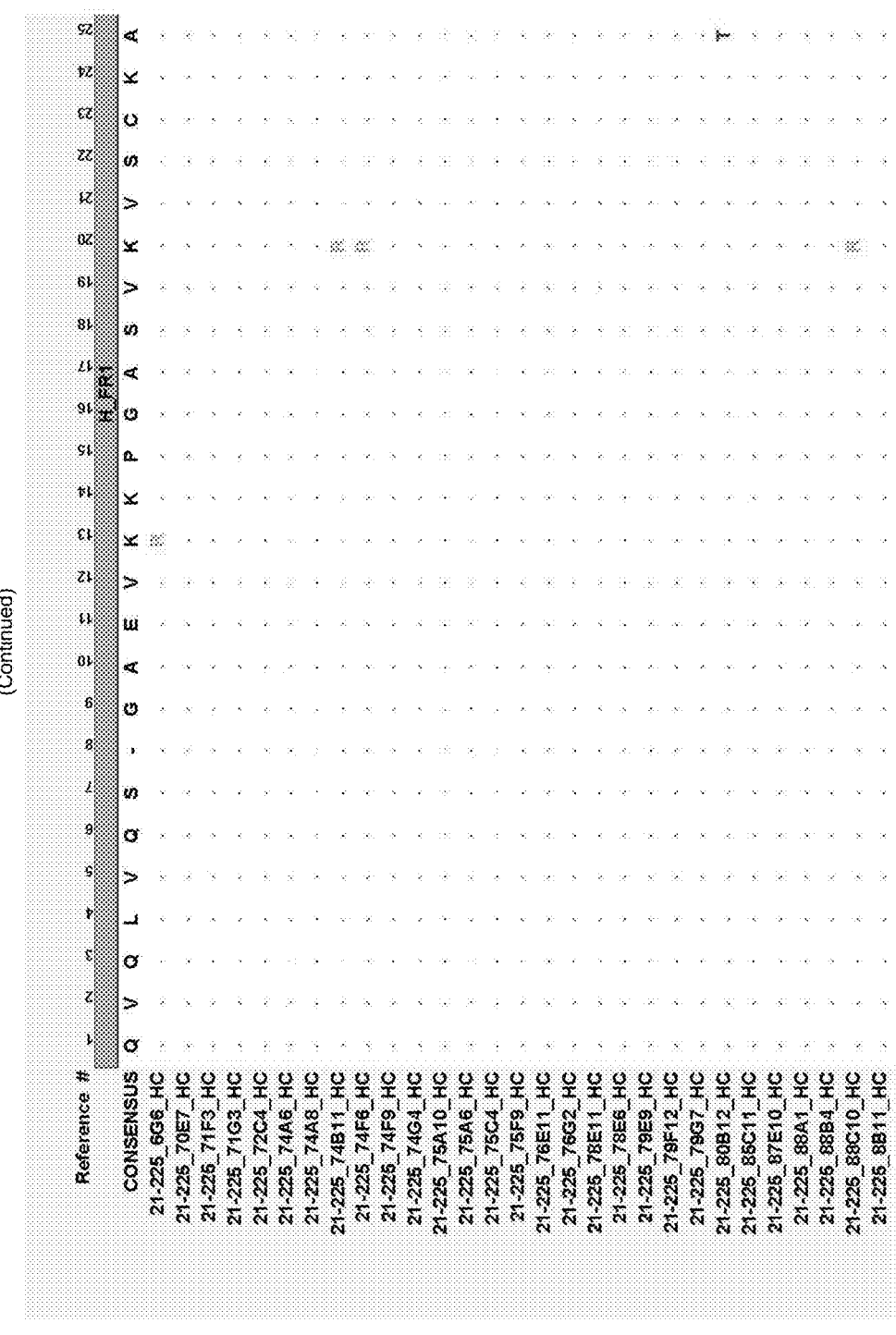
Figure 57:
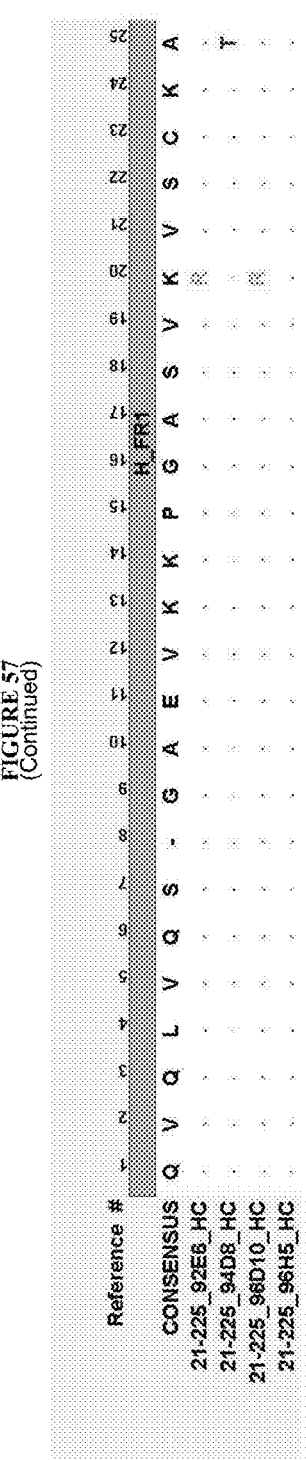
Figure 57:
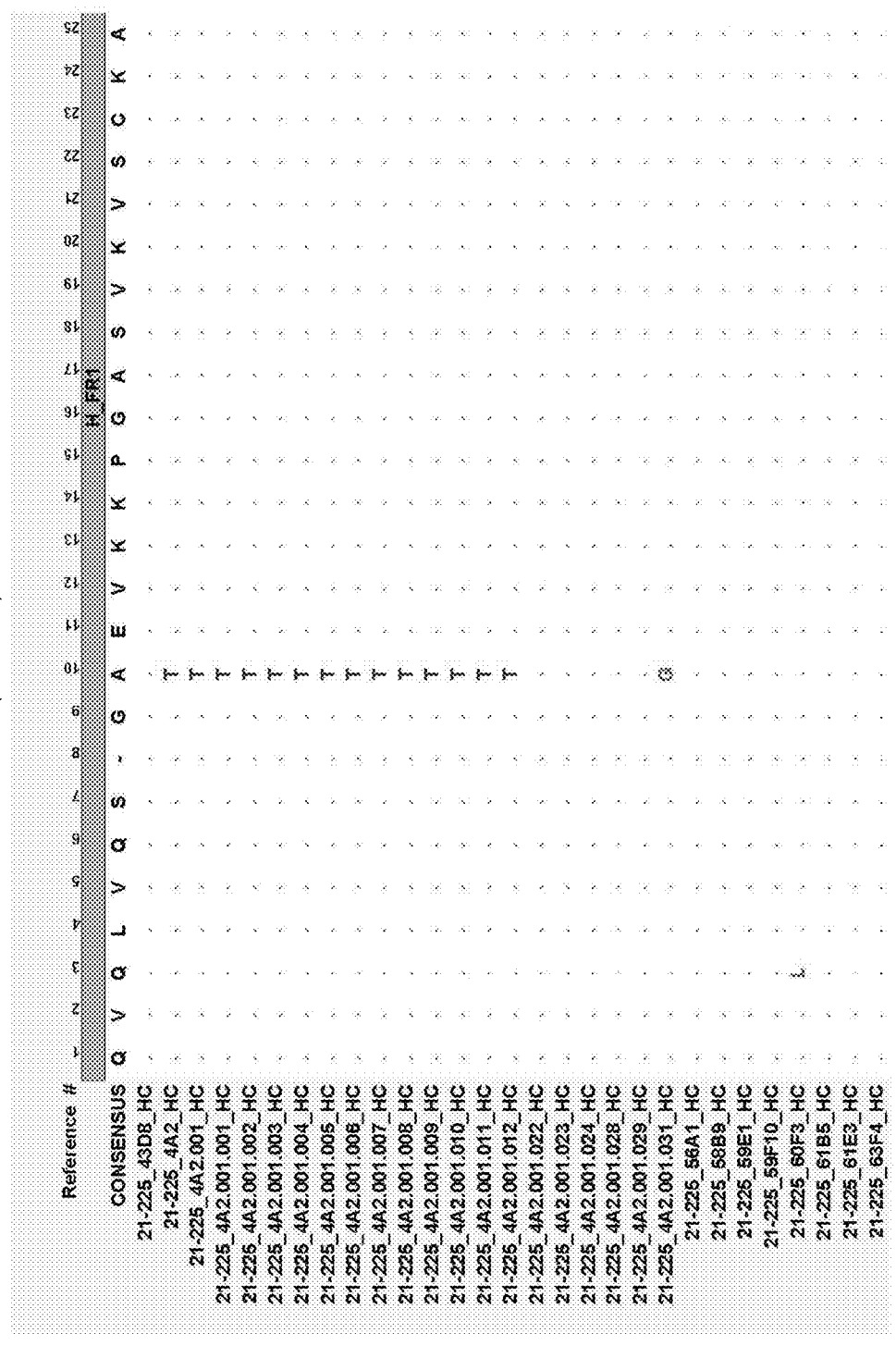
Figure 57:
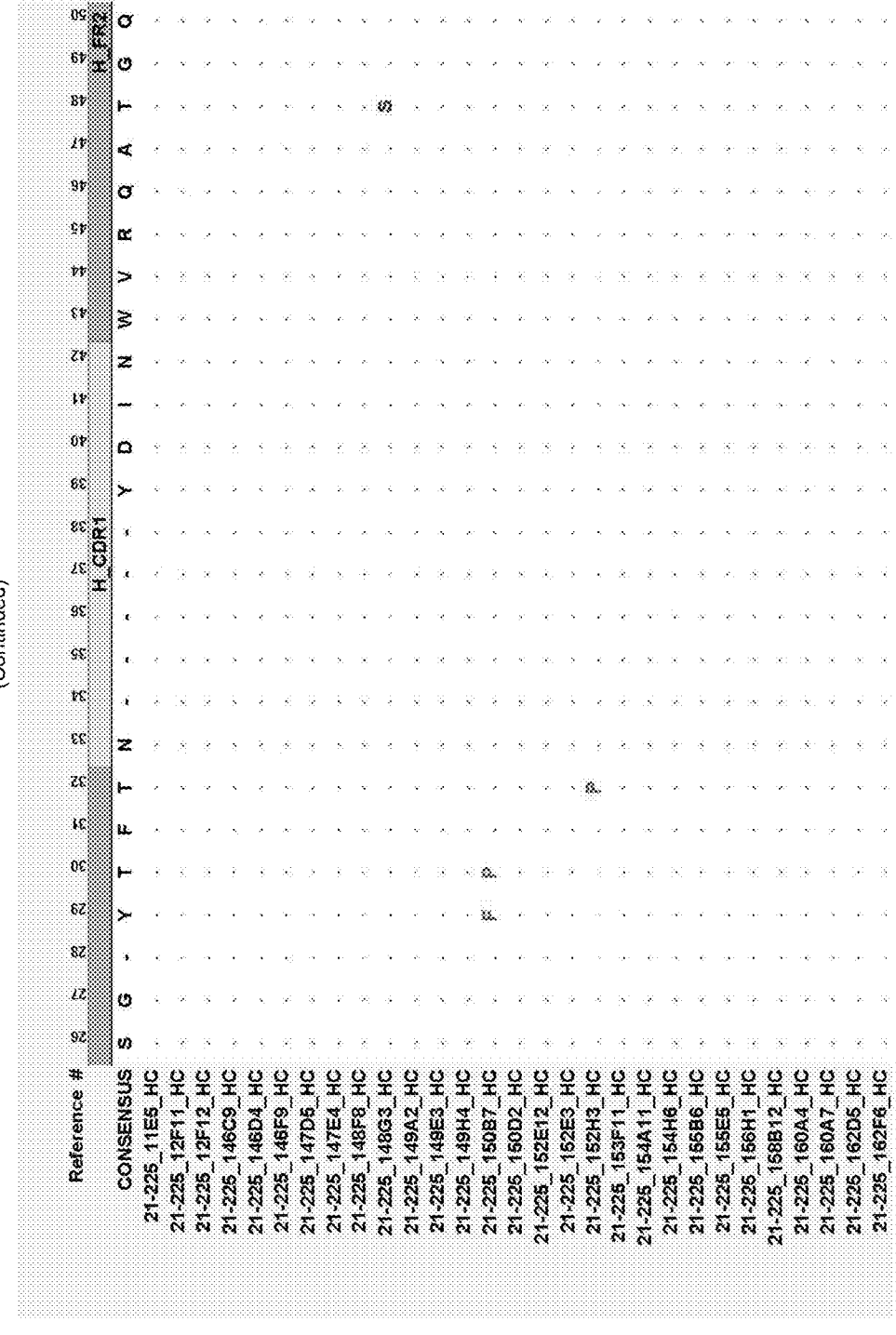
Figure 57:
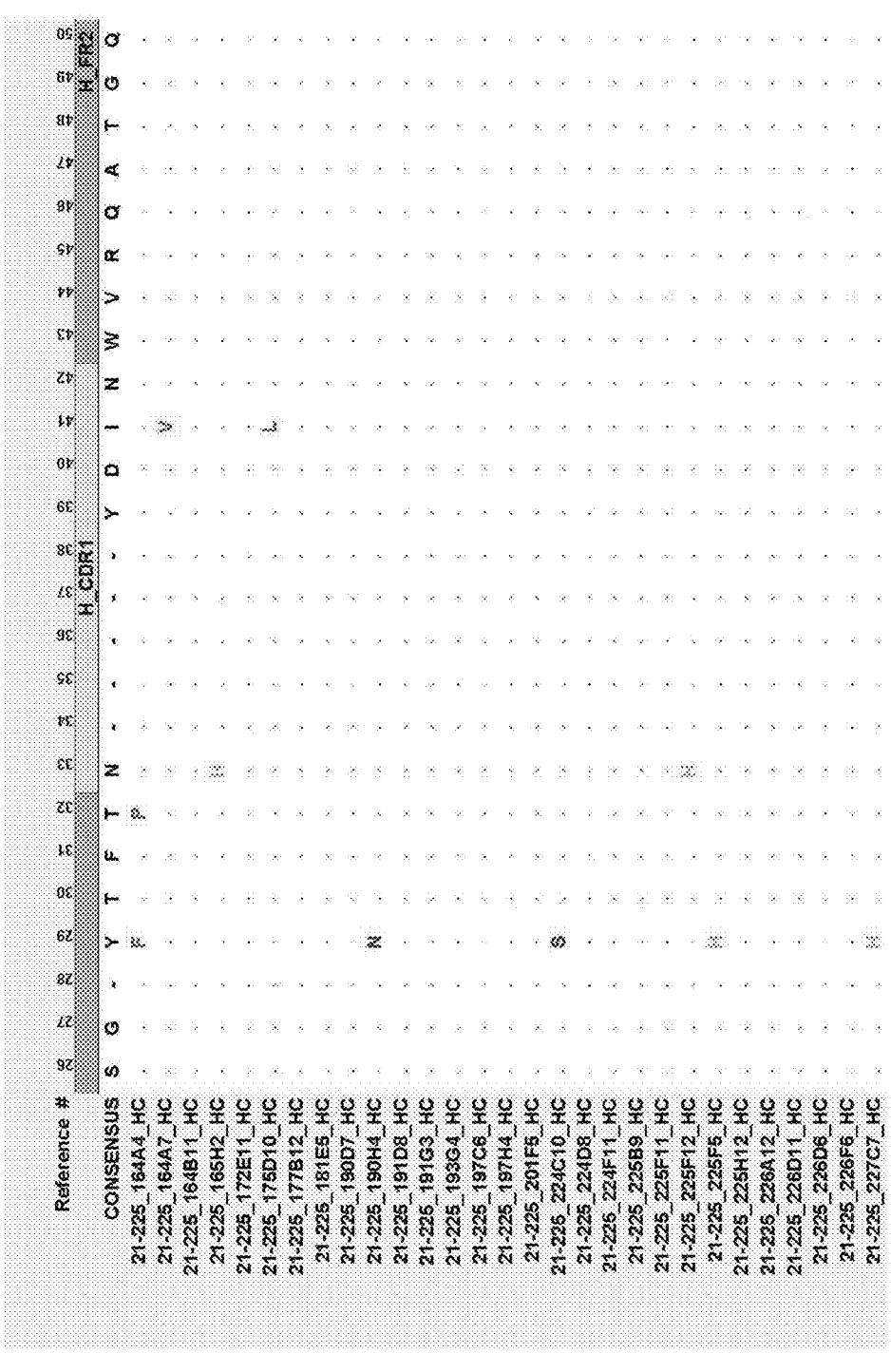
Figure 57:
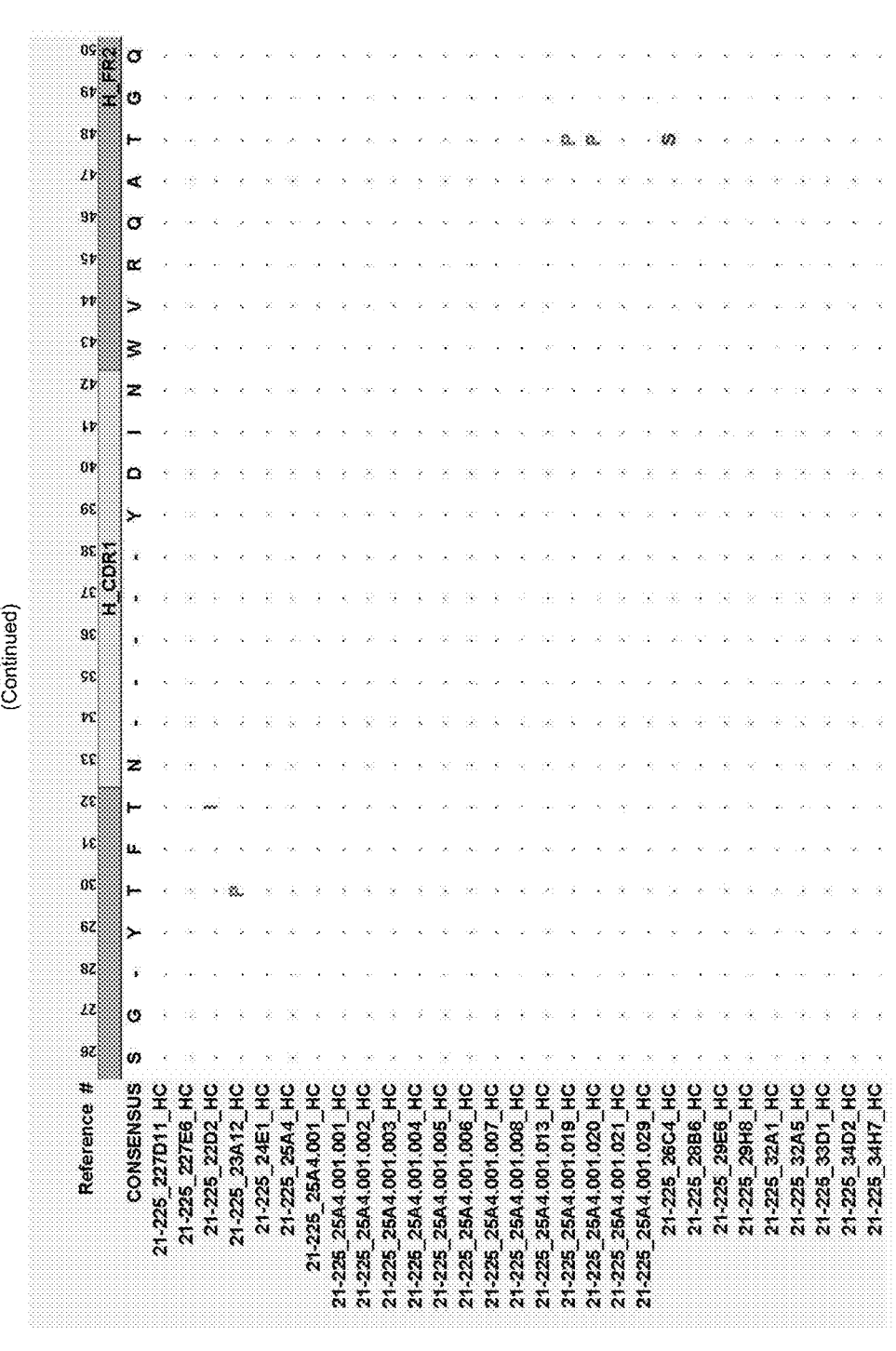
Figure 57:
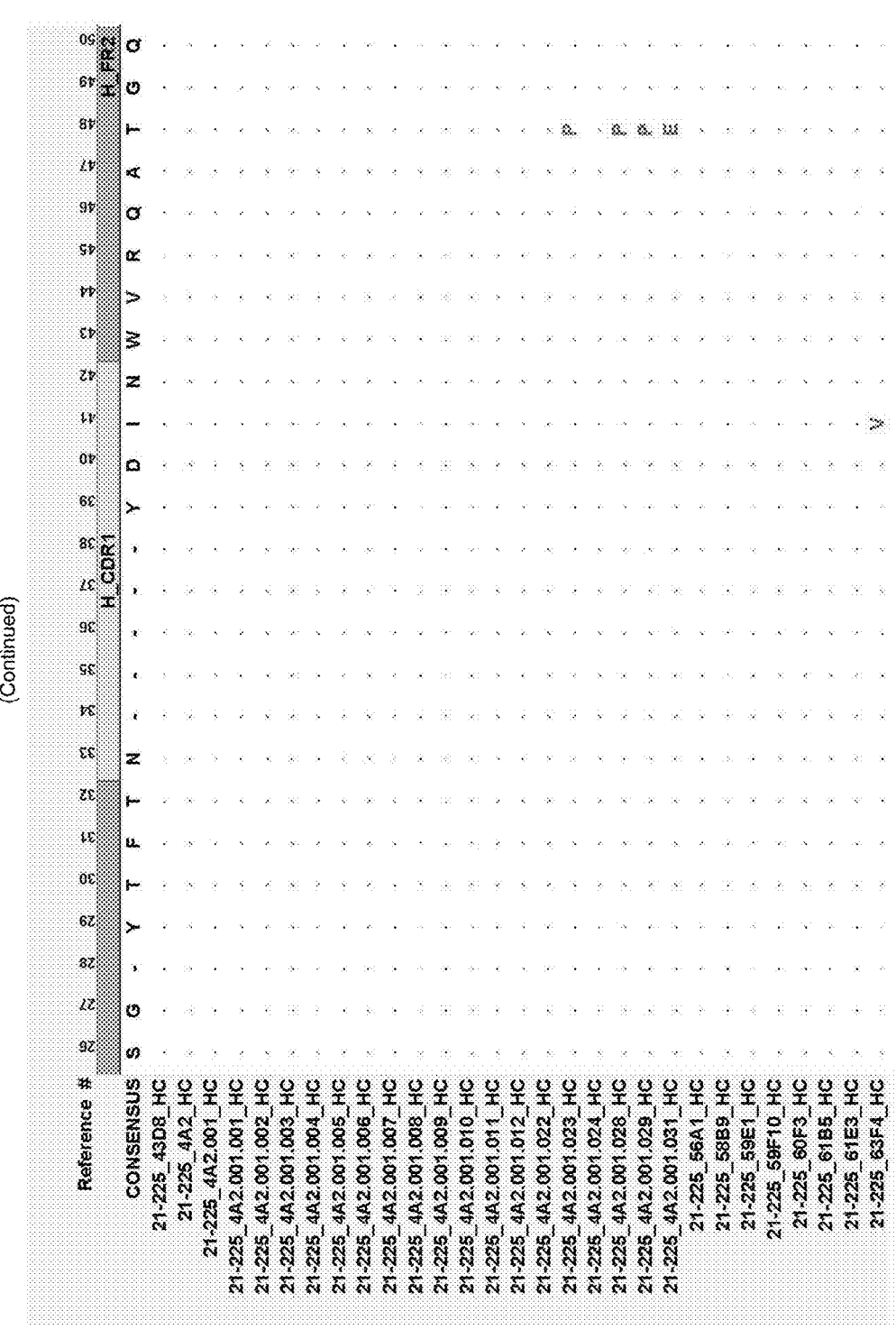
Figure 57:
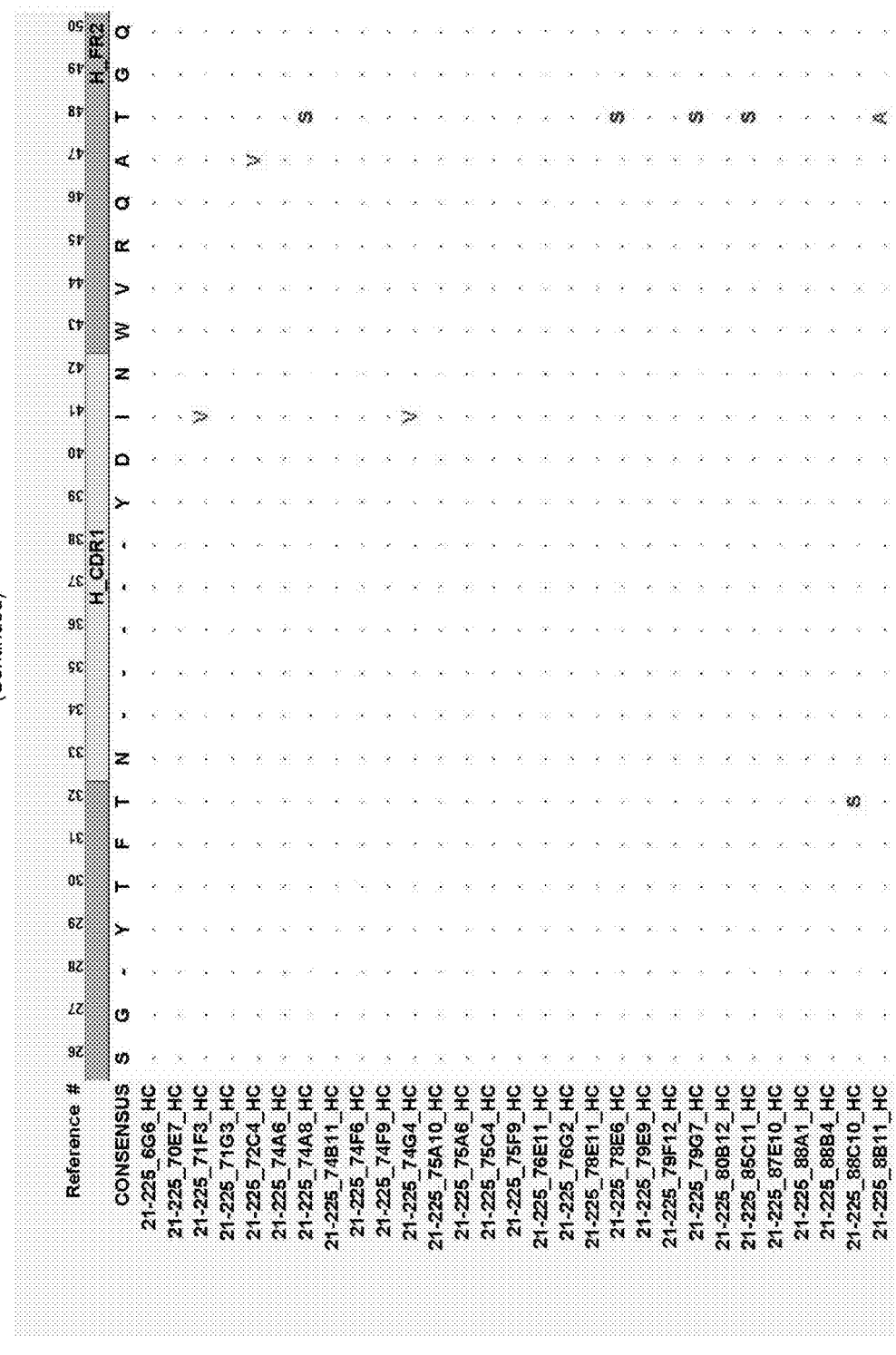
Figure 57:
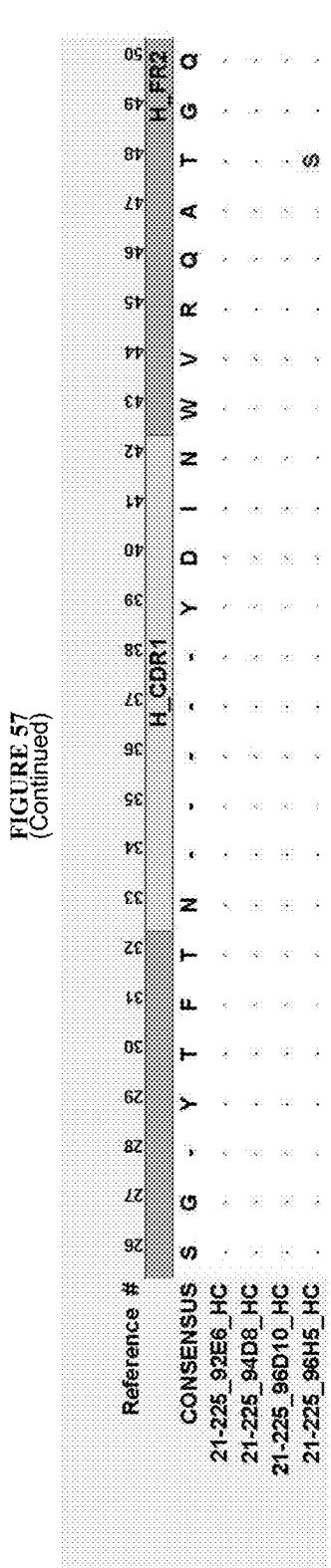
Figure 57:
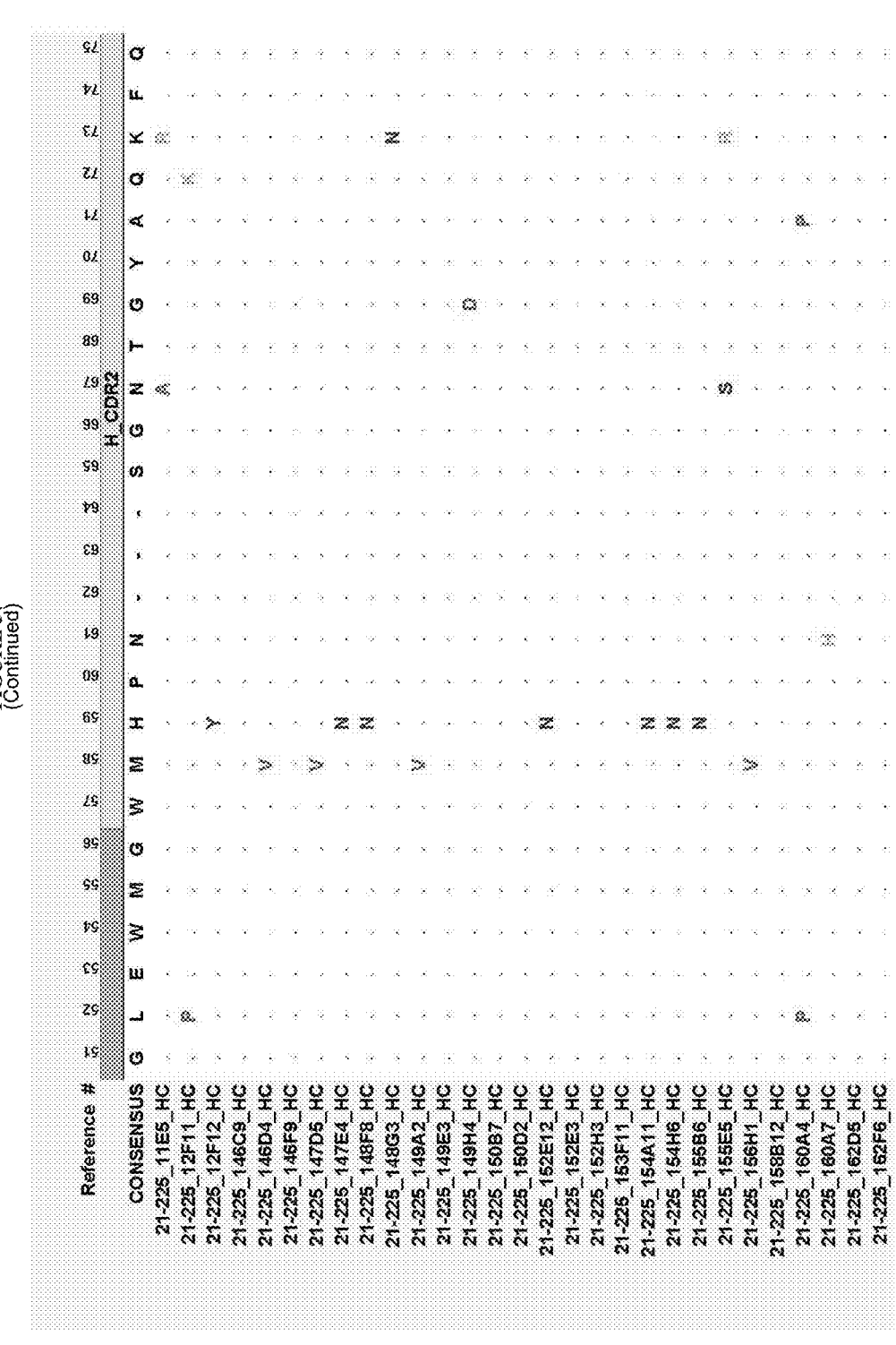
Figure 57:
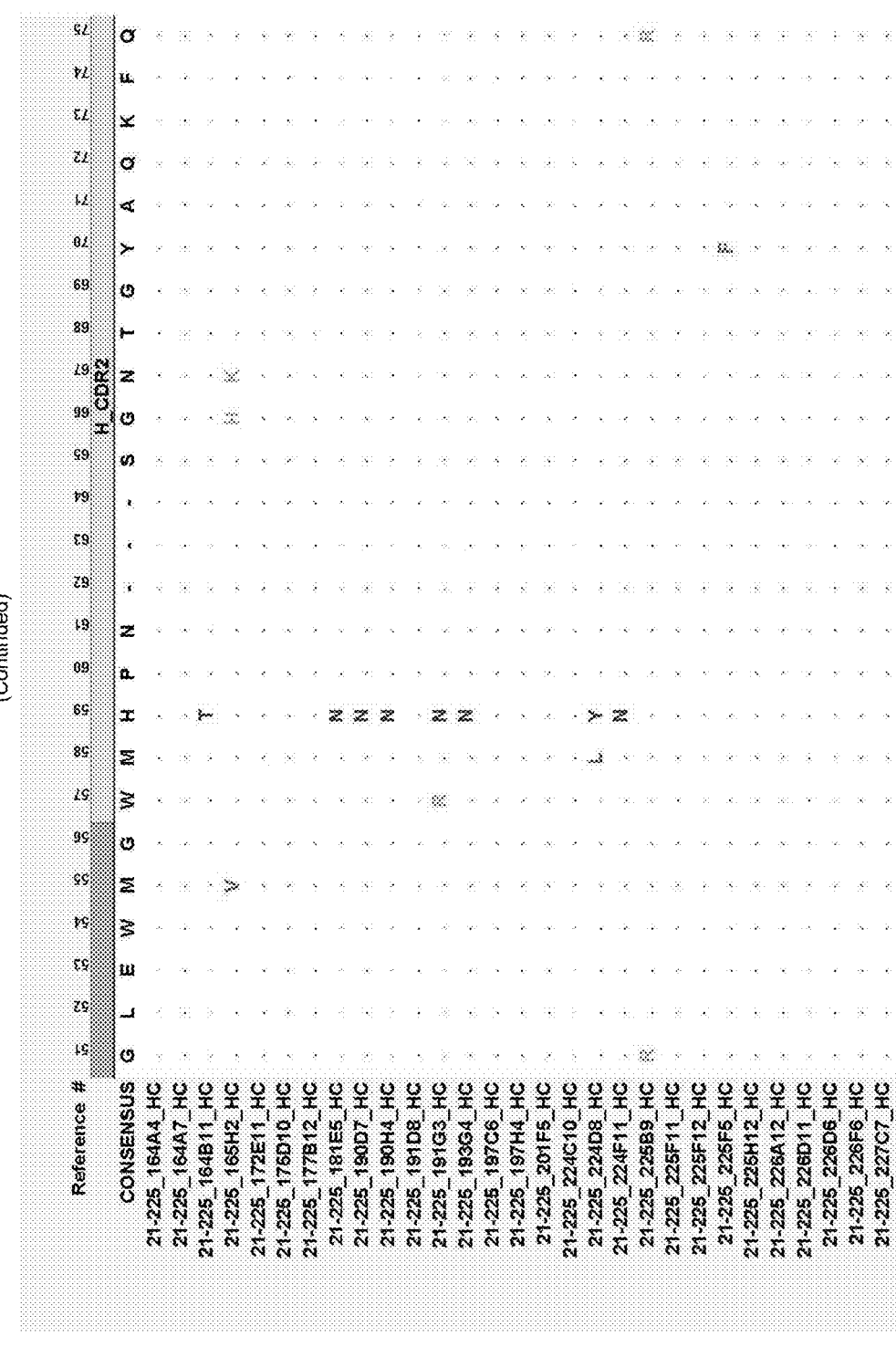
Figure 57:
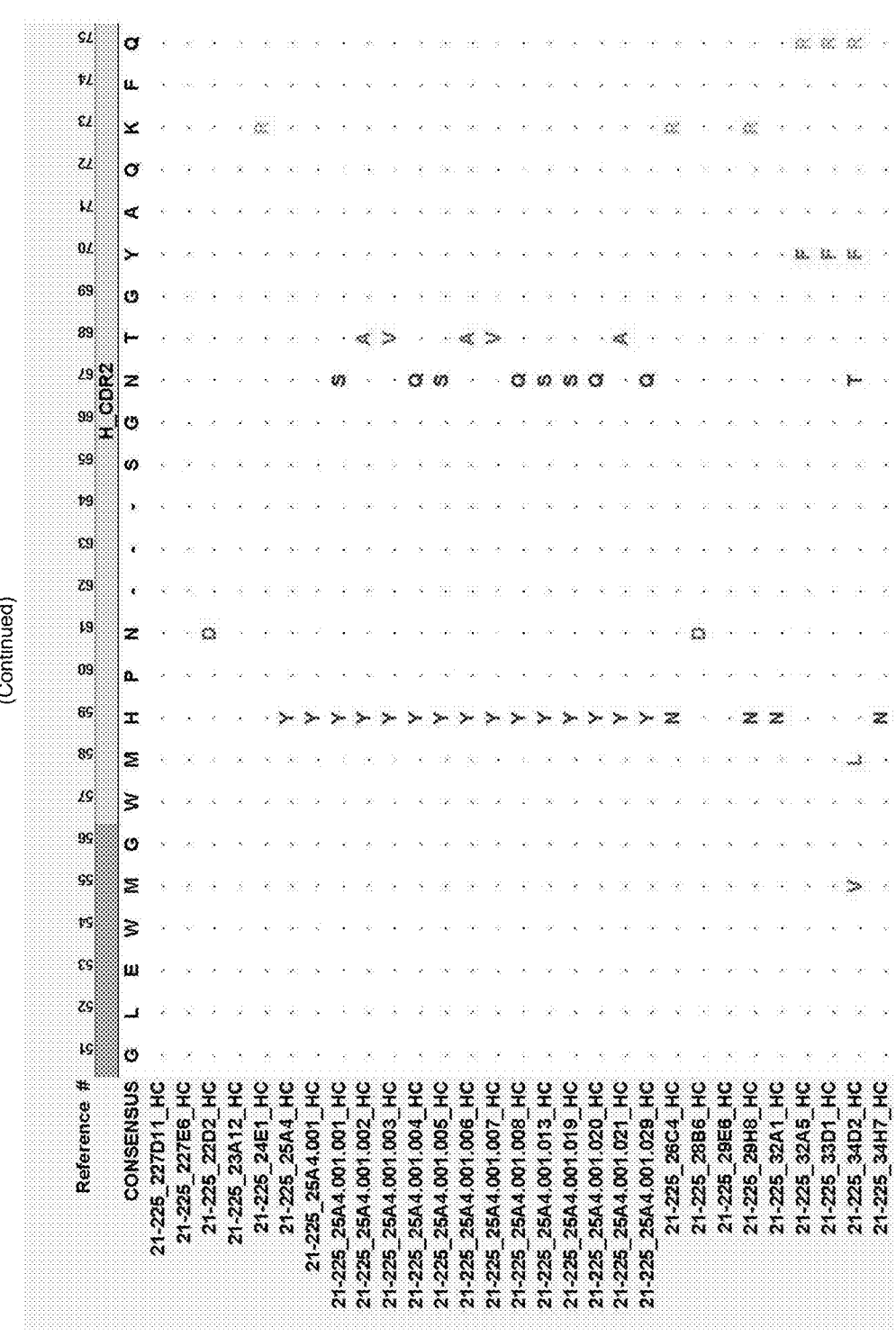
Figure 57:
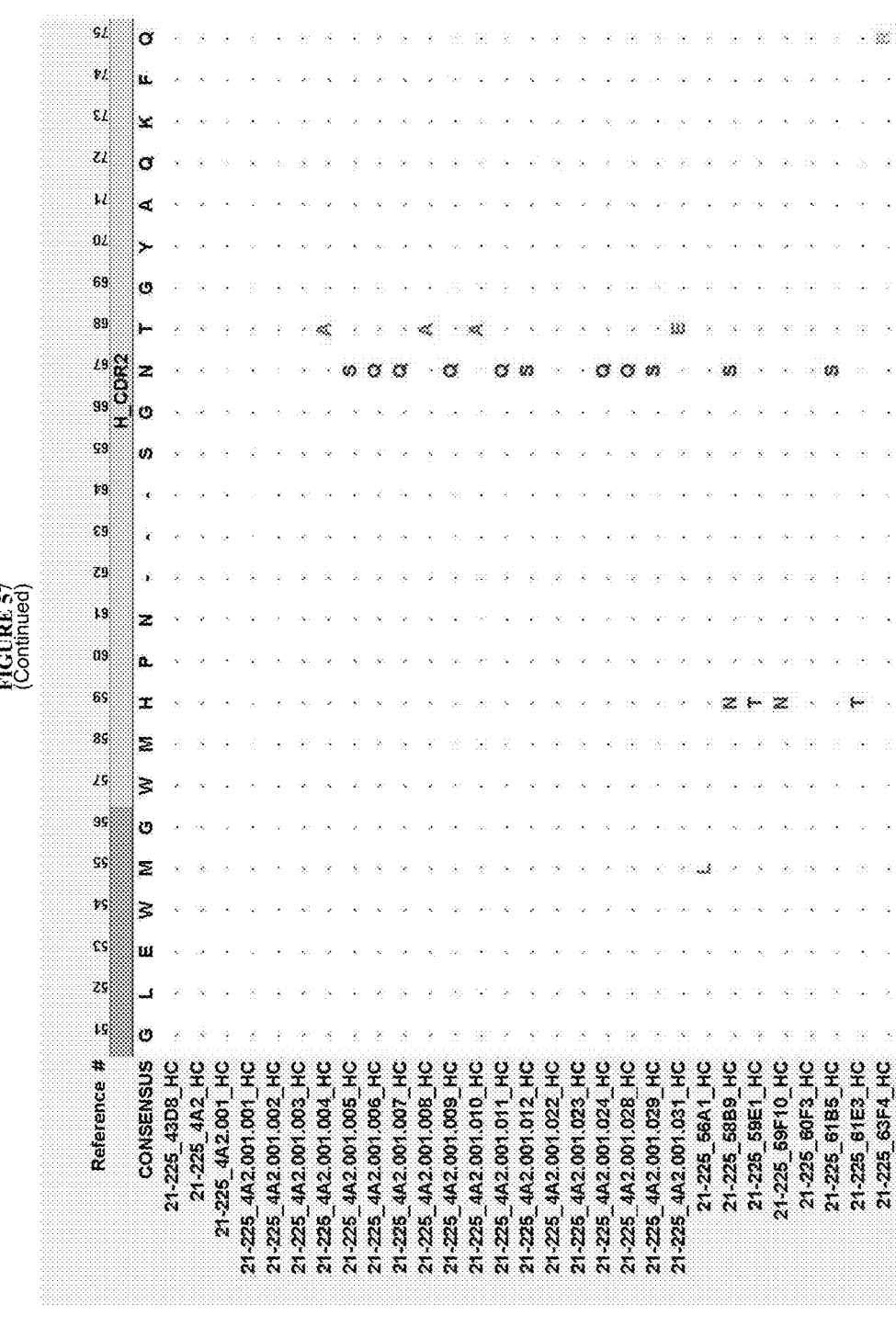
Figure 57:
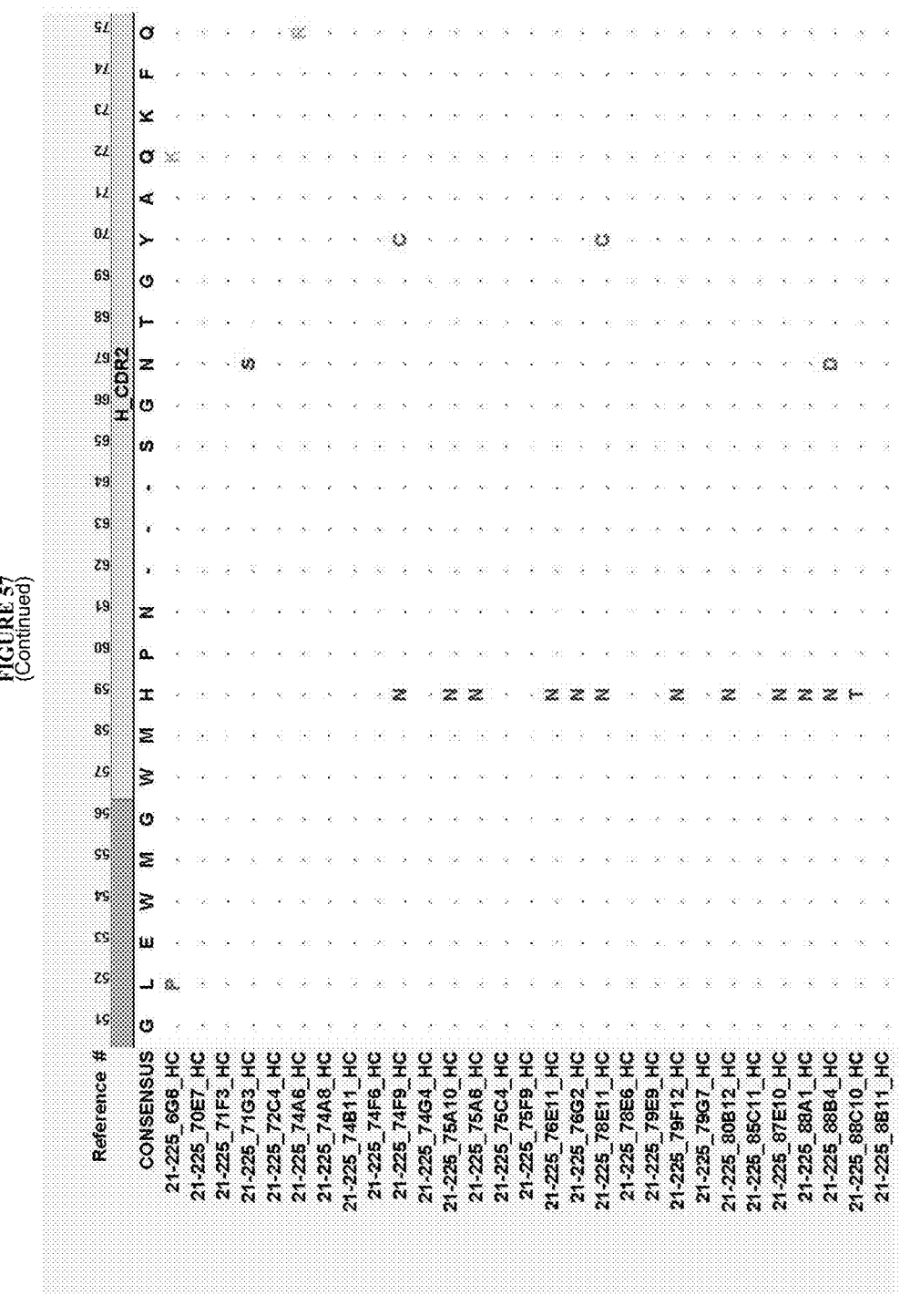
Figure 57:
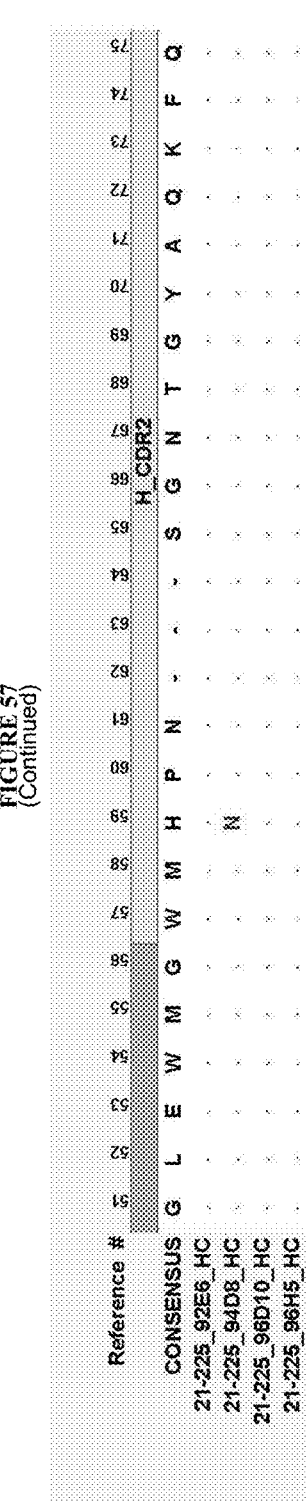
Figure 57:
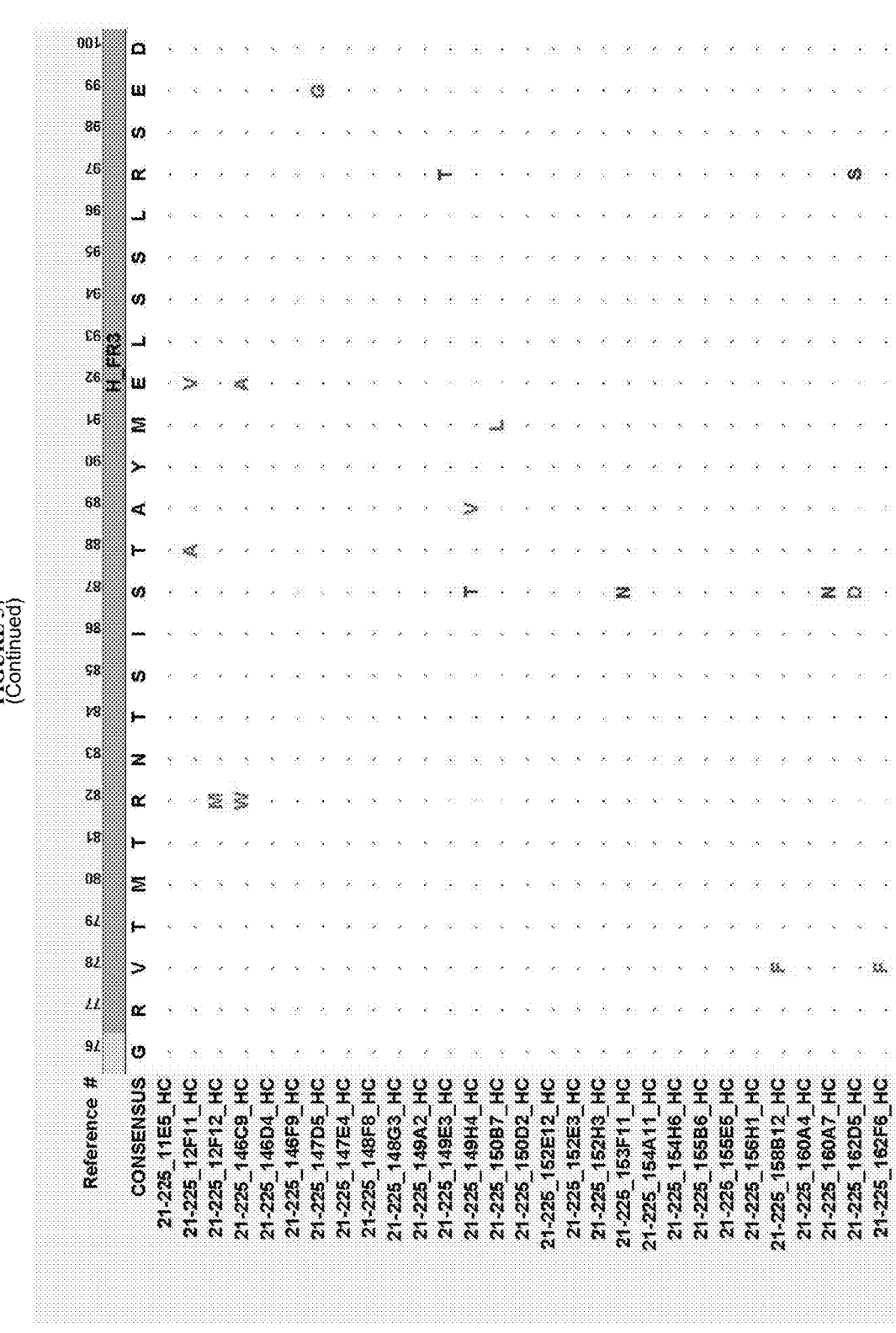
Figure 57:
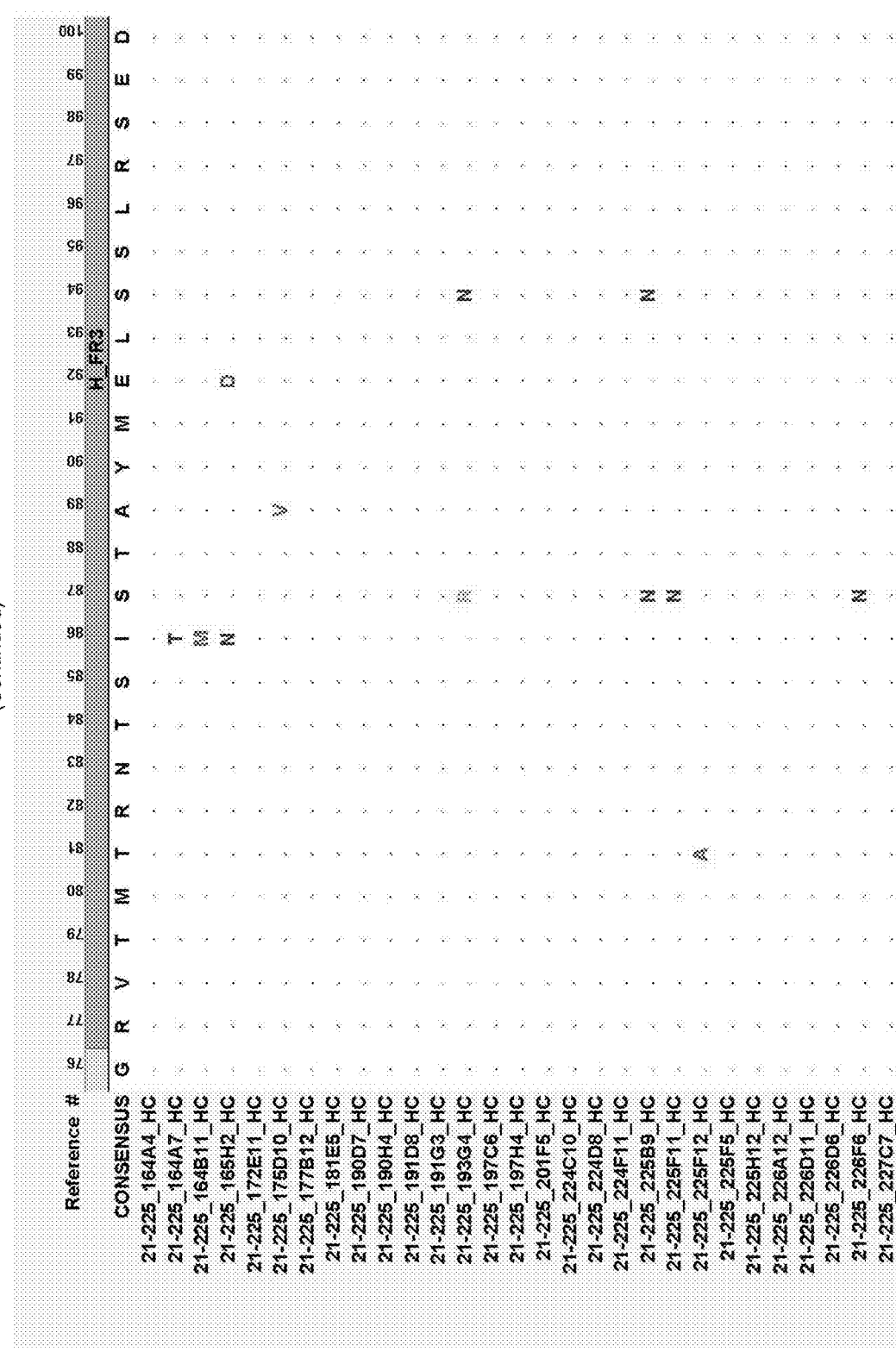
Figure 57:
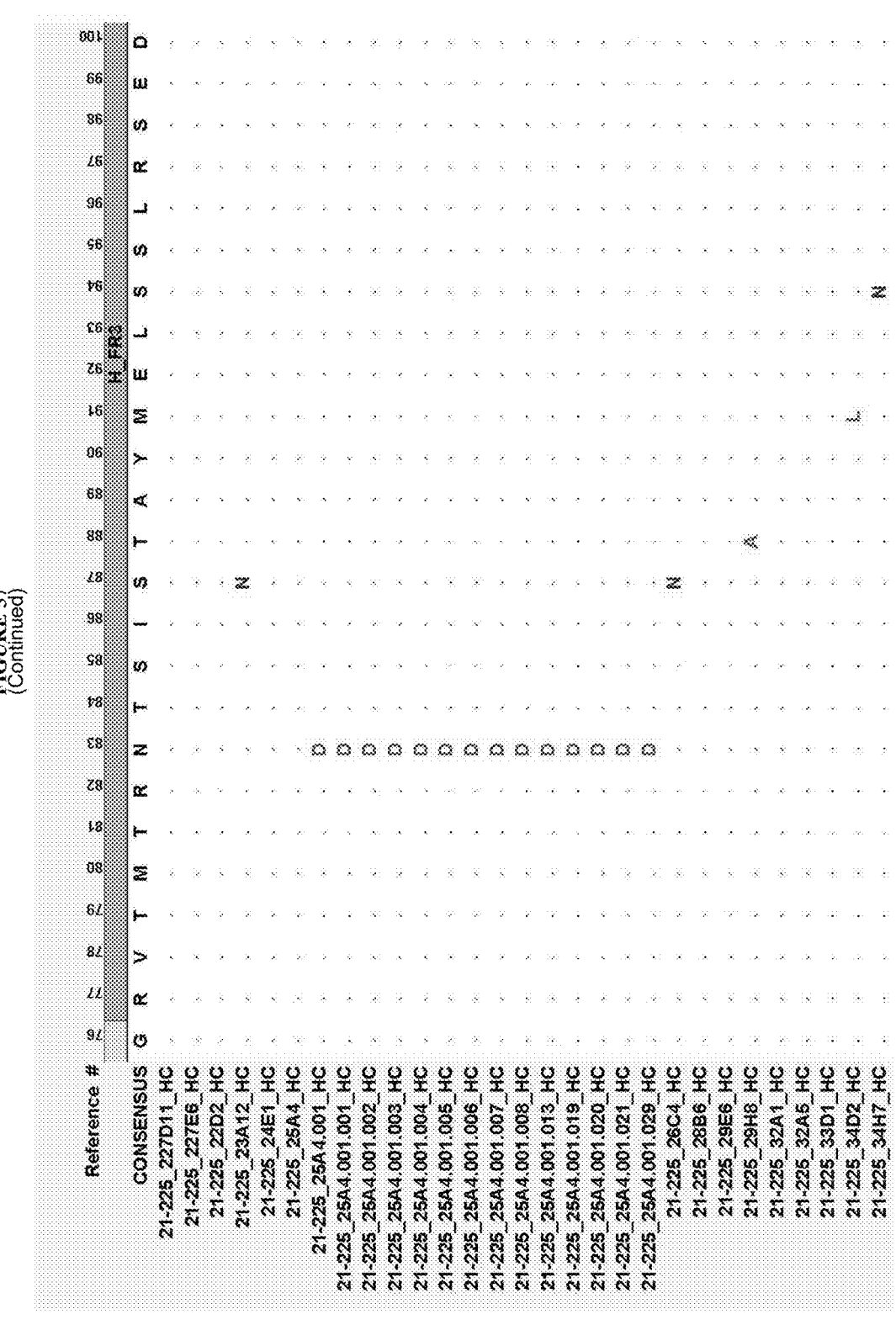
Figure 57:
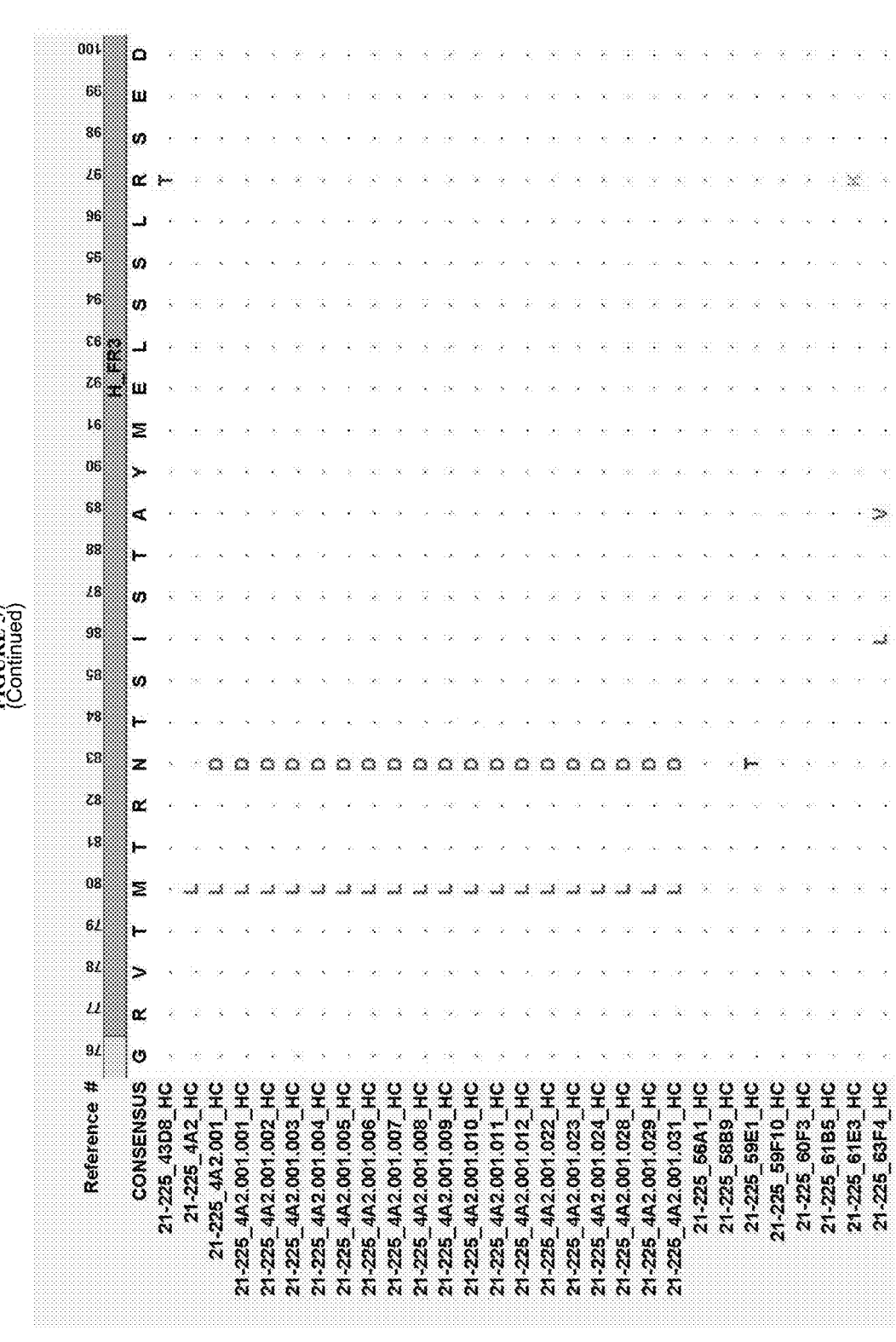
Figure 57:
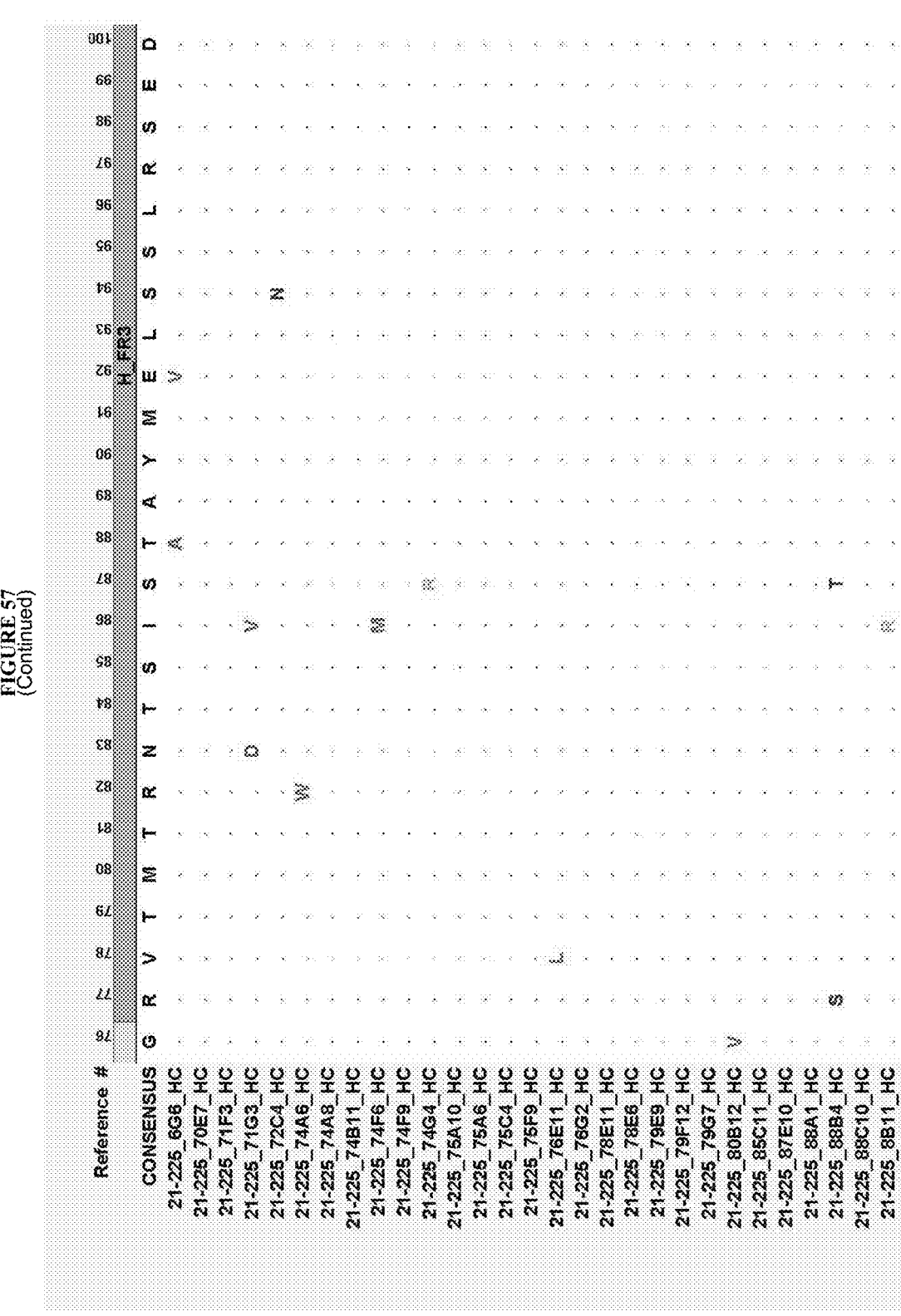
Figure 57:
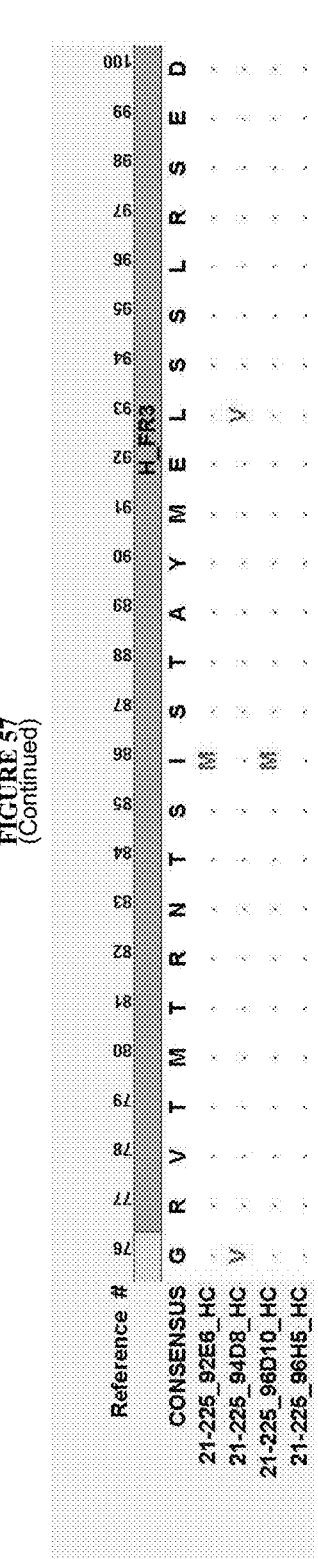
Figure 57:
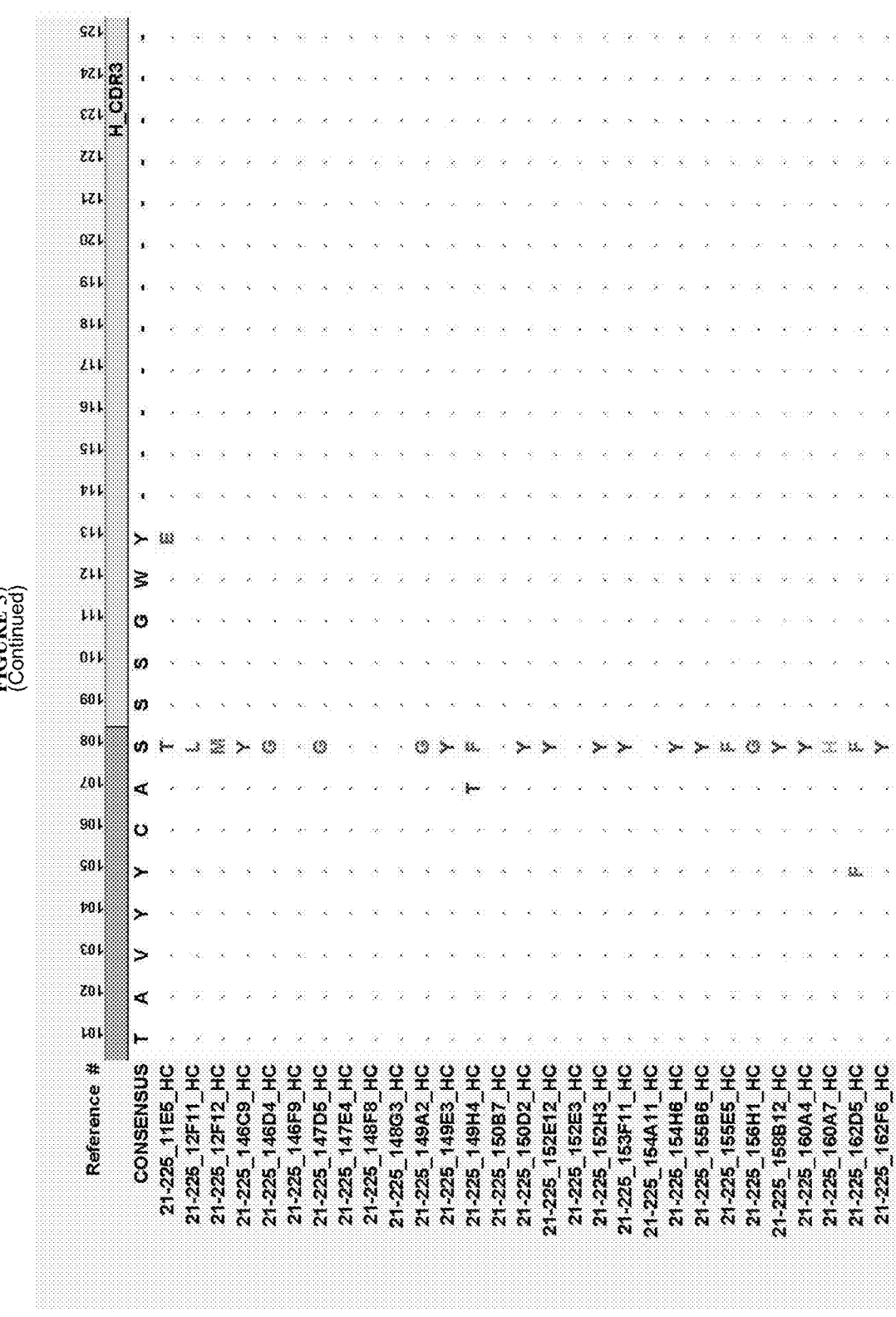
Figure 57:
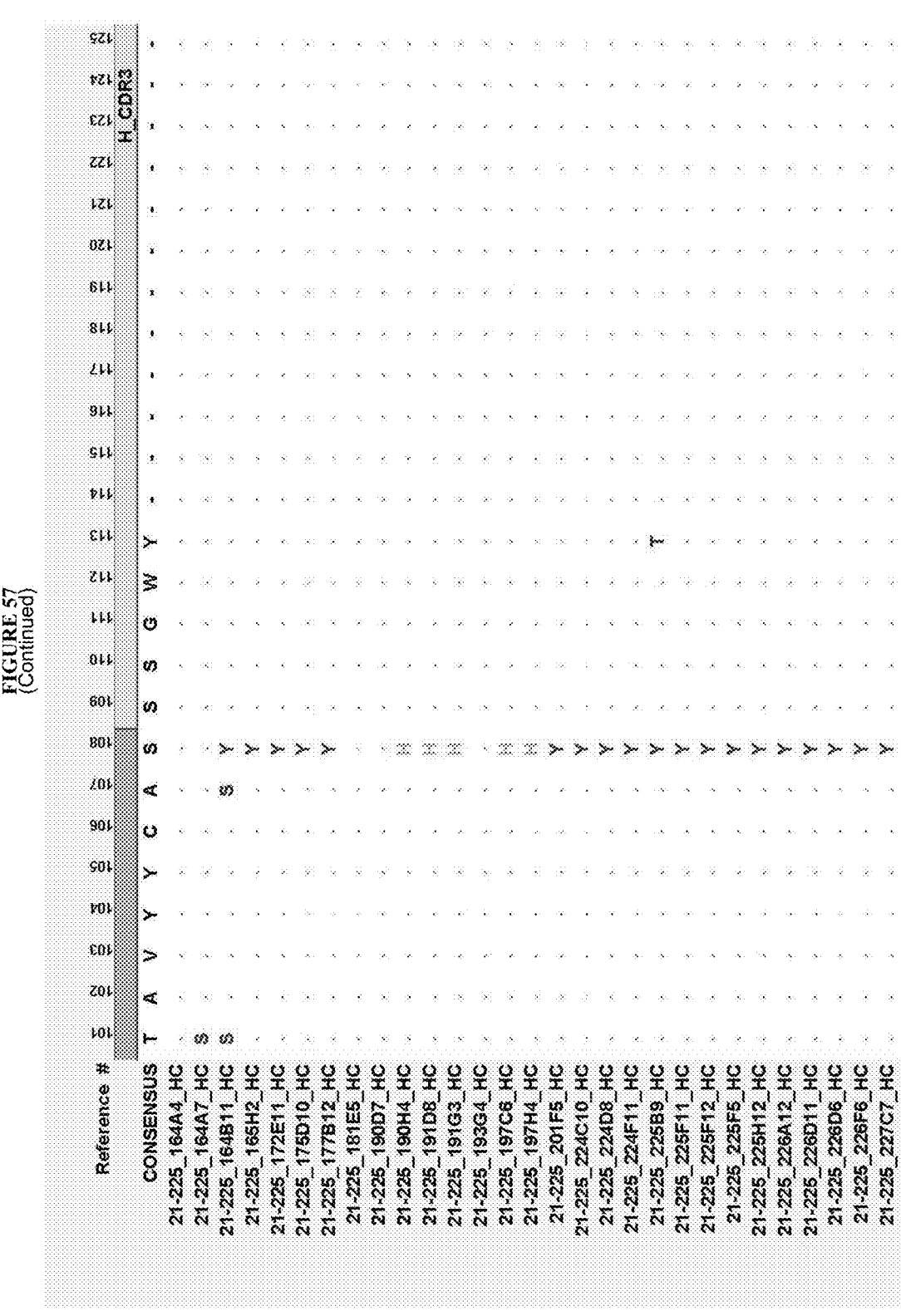
Figure 57:
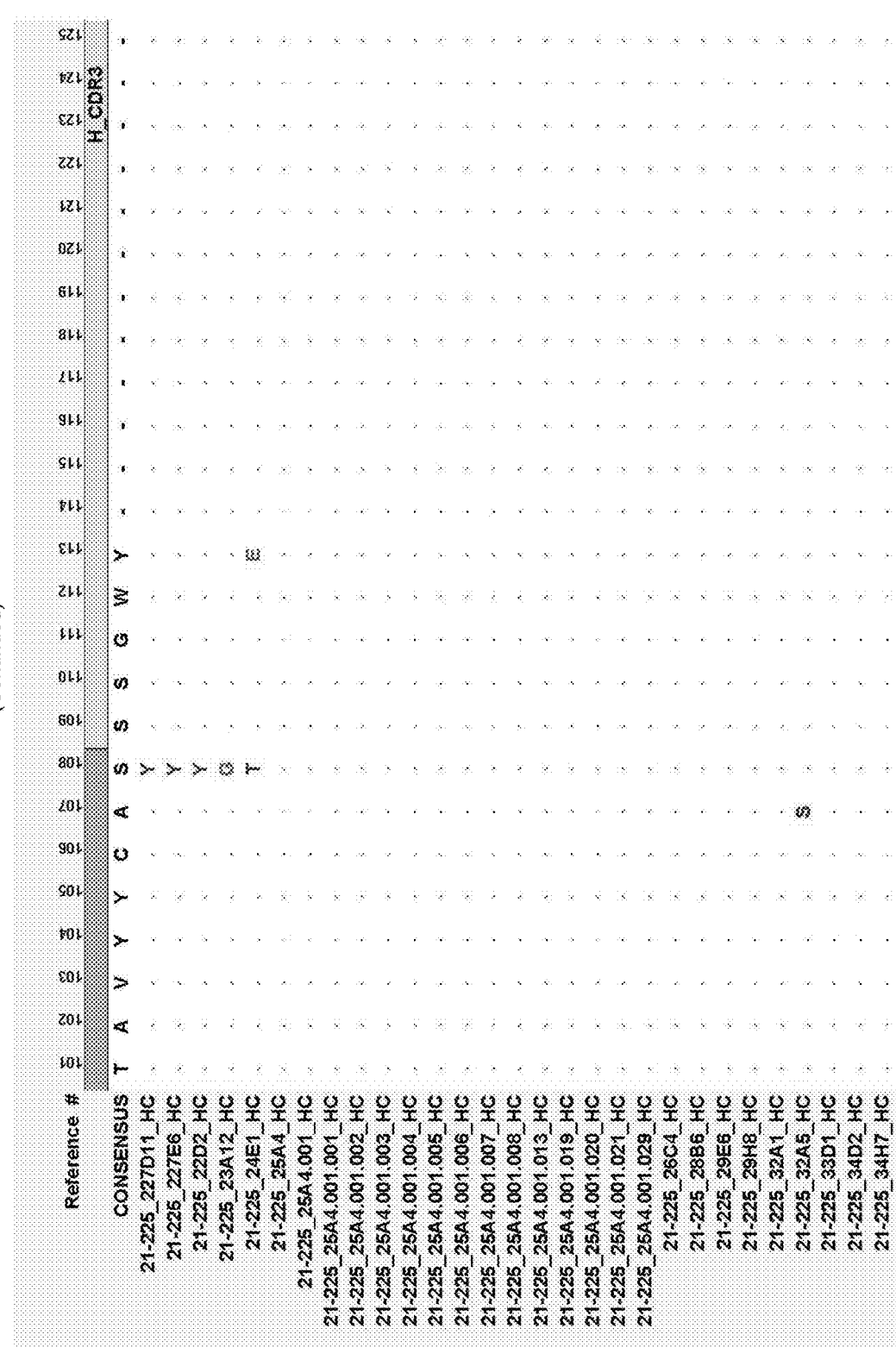
Figure 57:
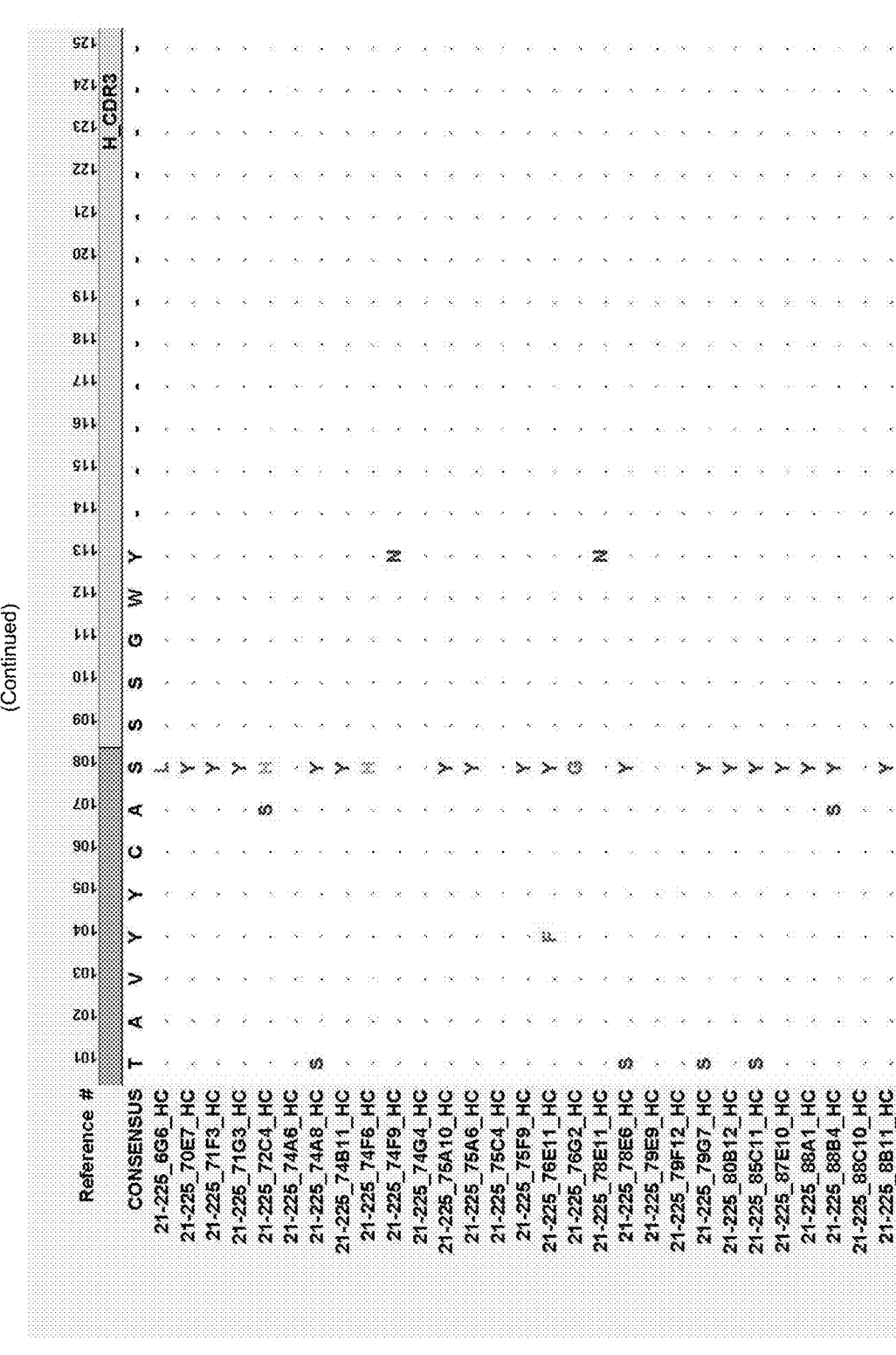
Figure 57:
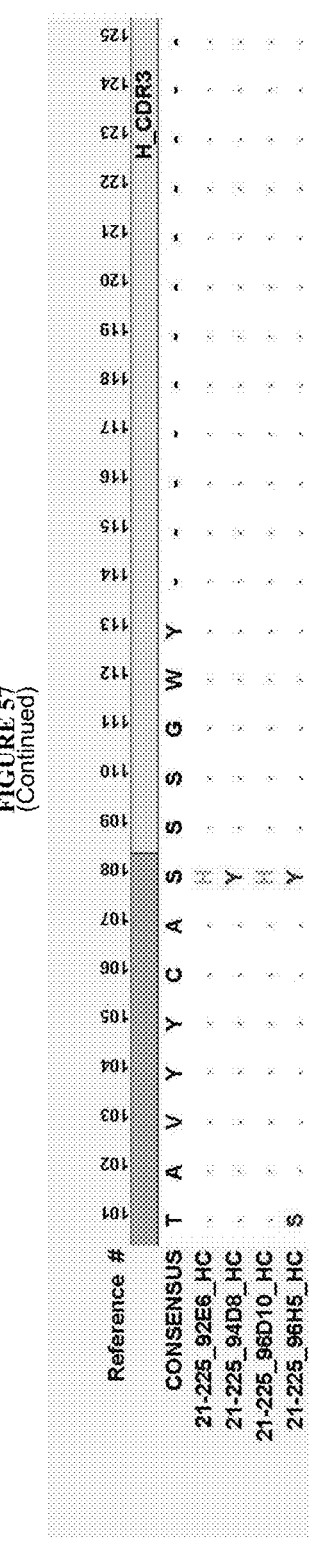
Figure 57:
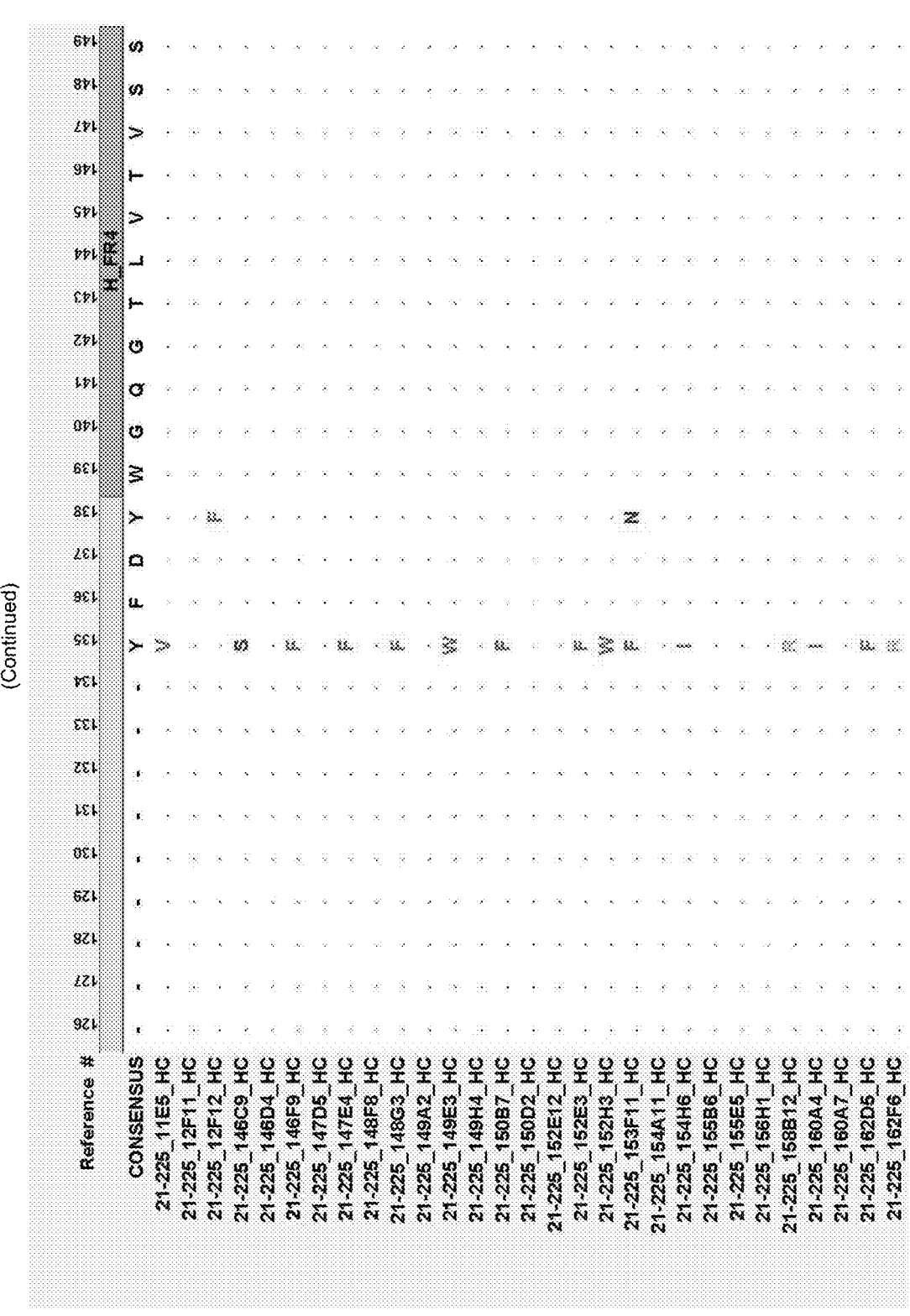
Figure 57:
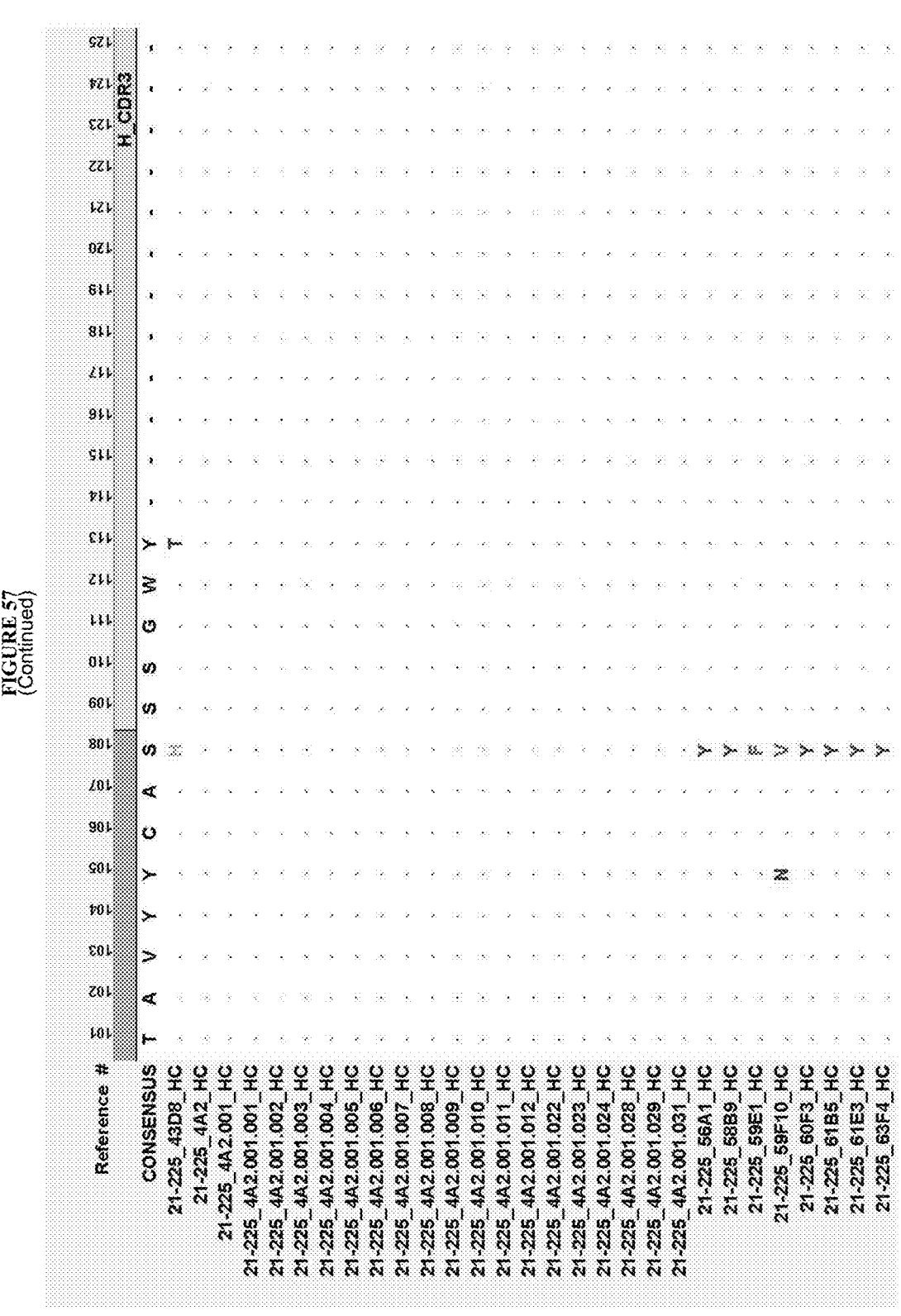
Figure 57:
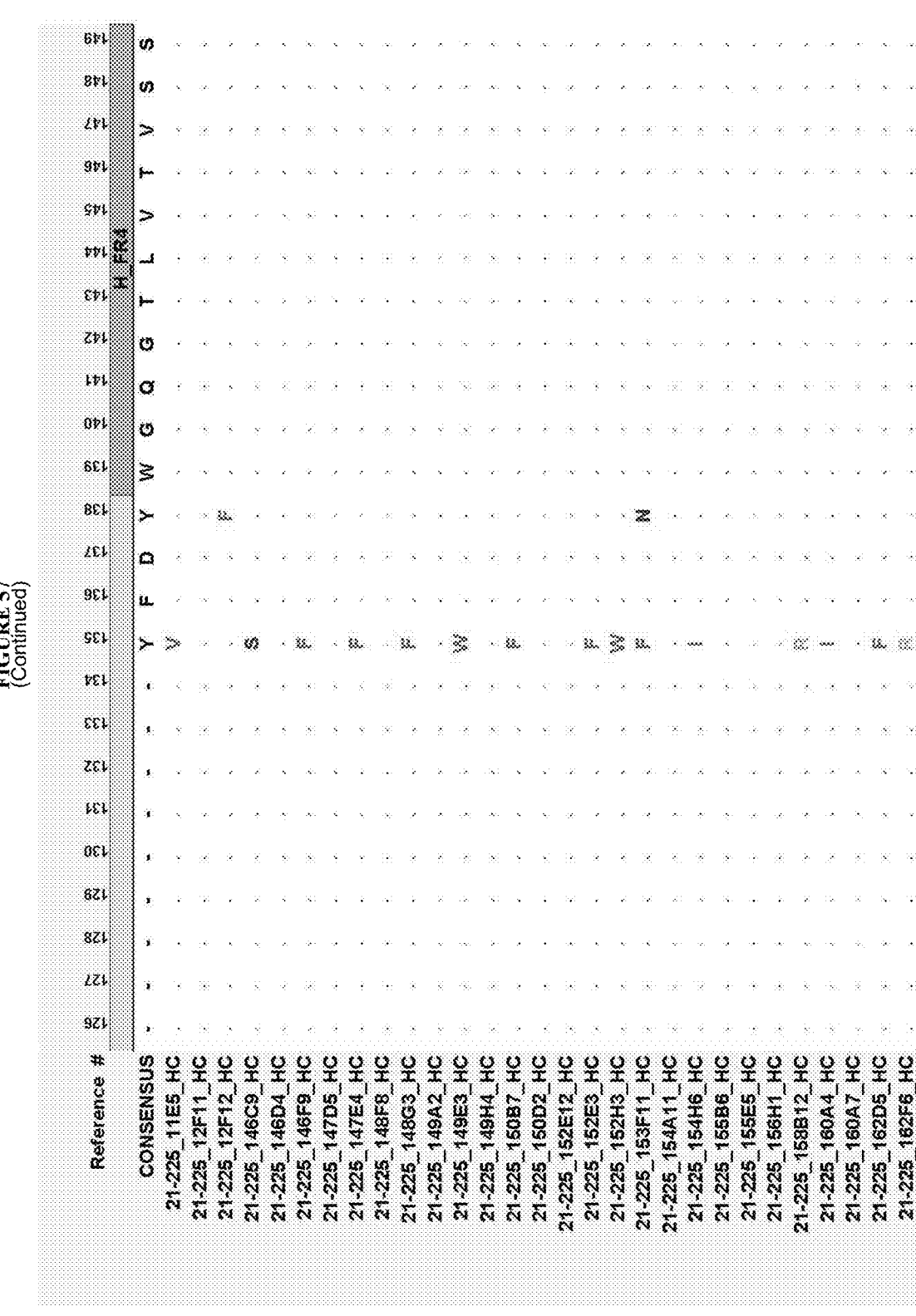
Figure 57:
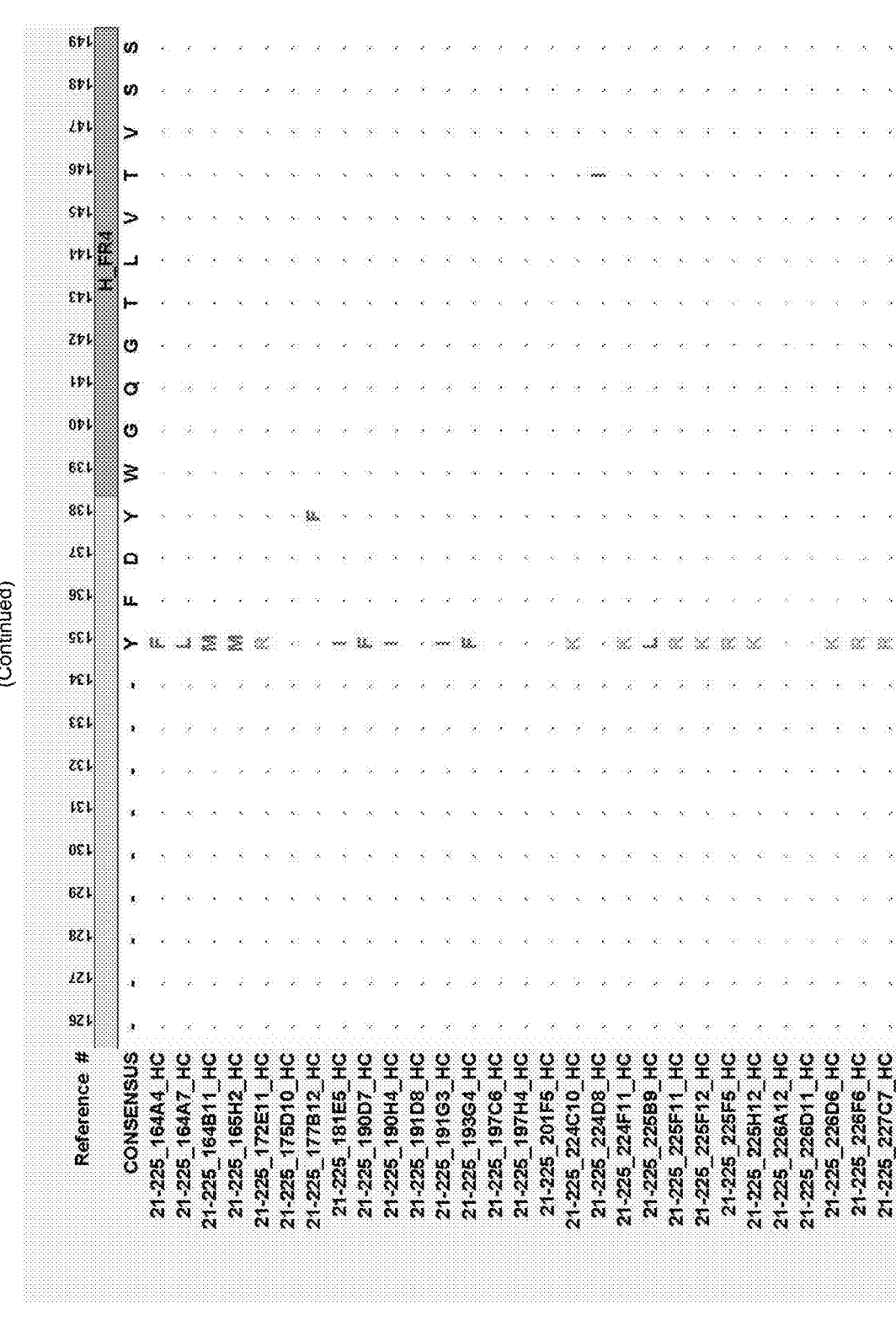
Figure 57:
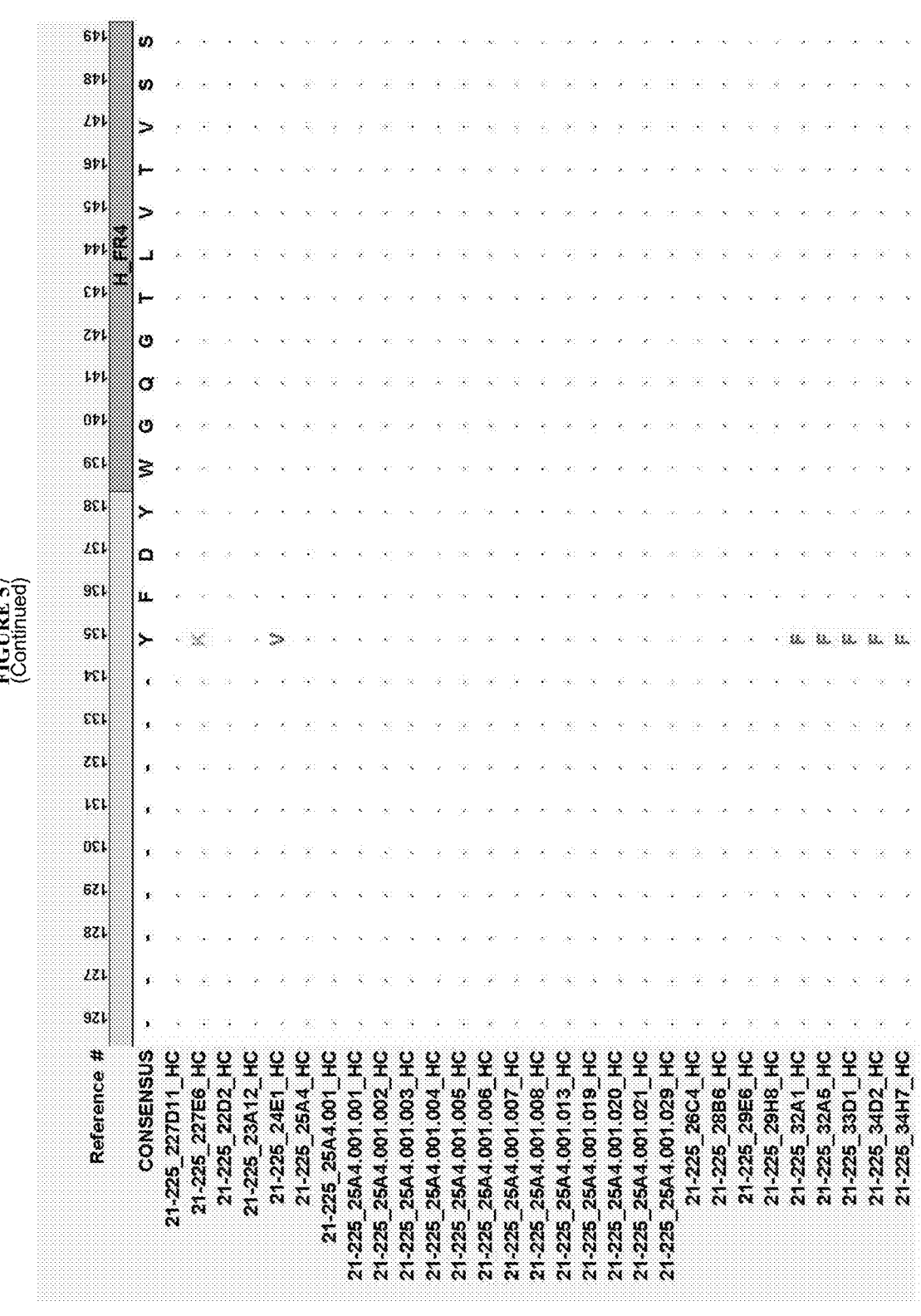
Figure 57:
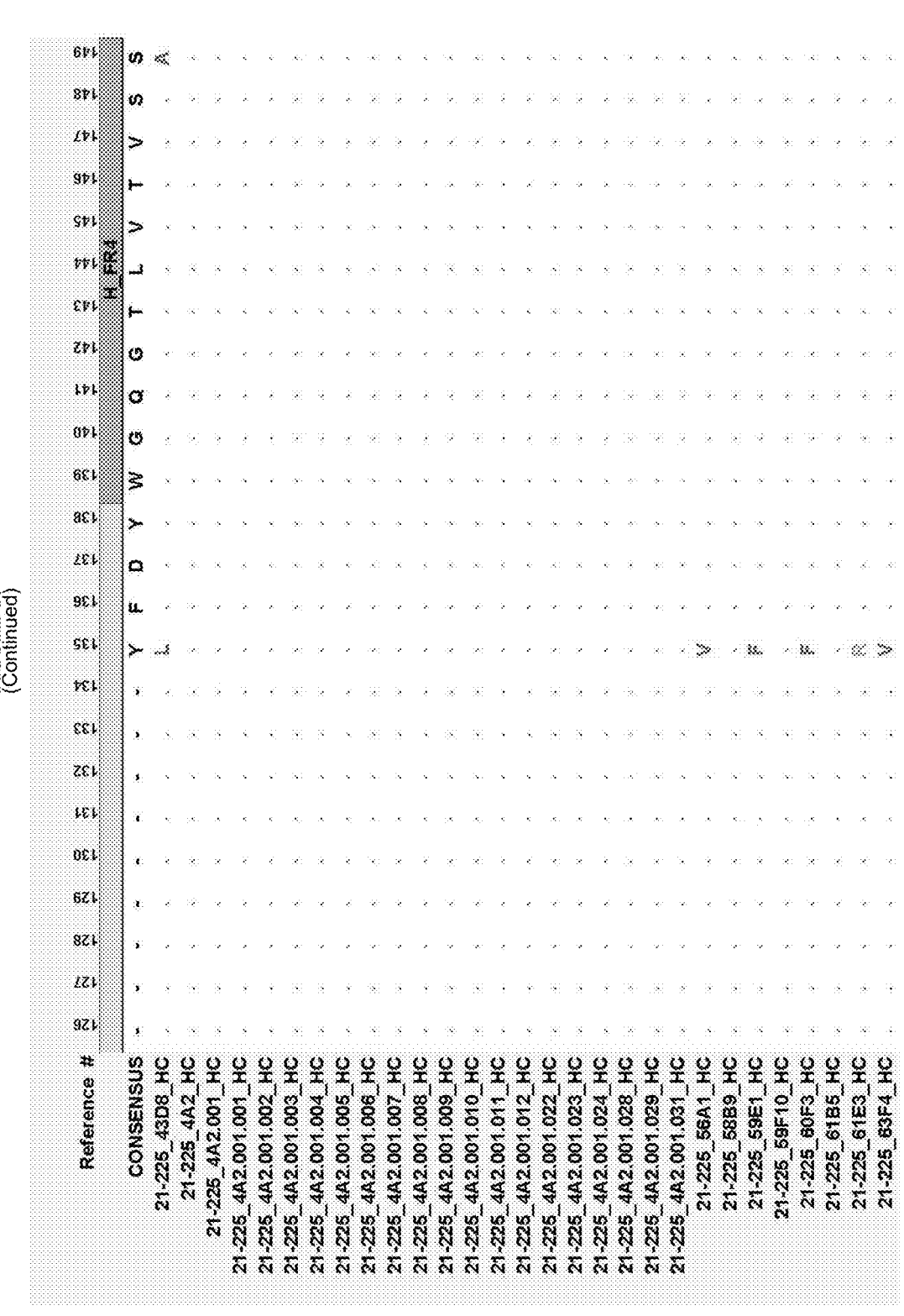
Figure 57:
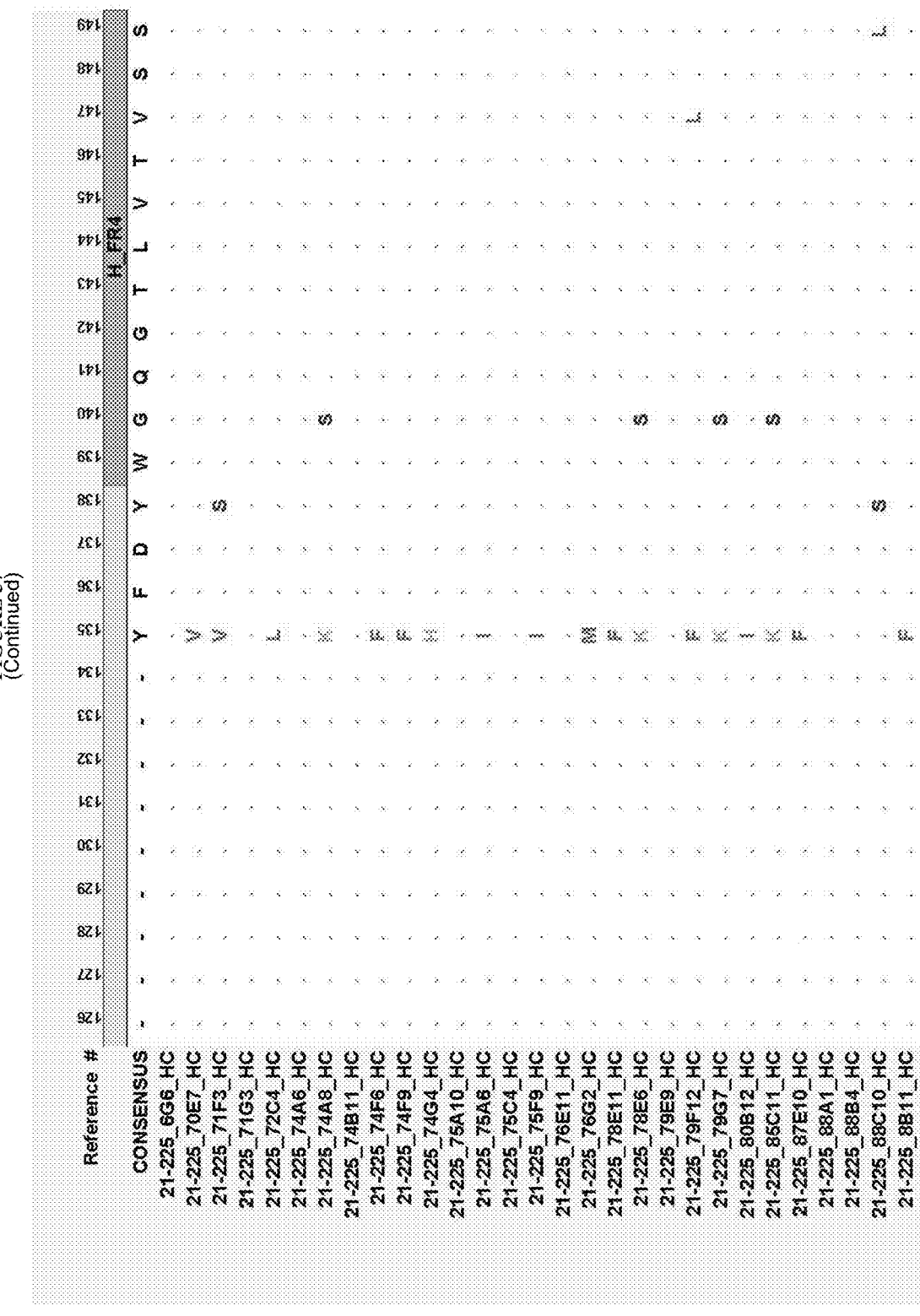
Figure 57:
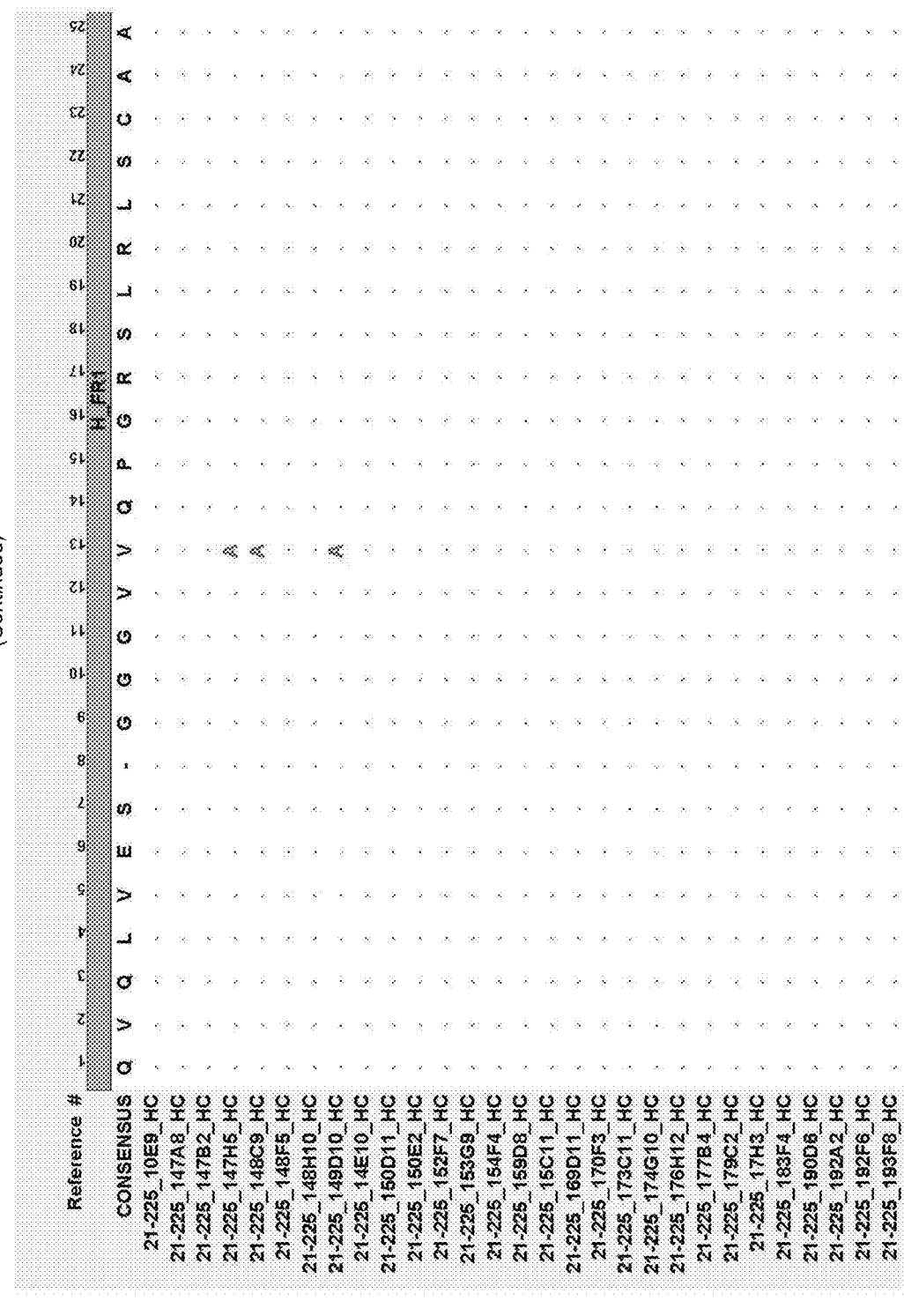
Figure 57:
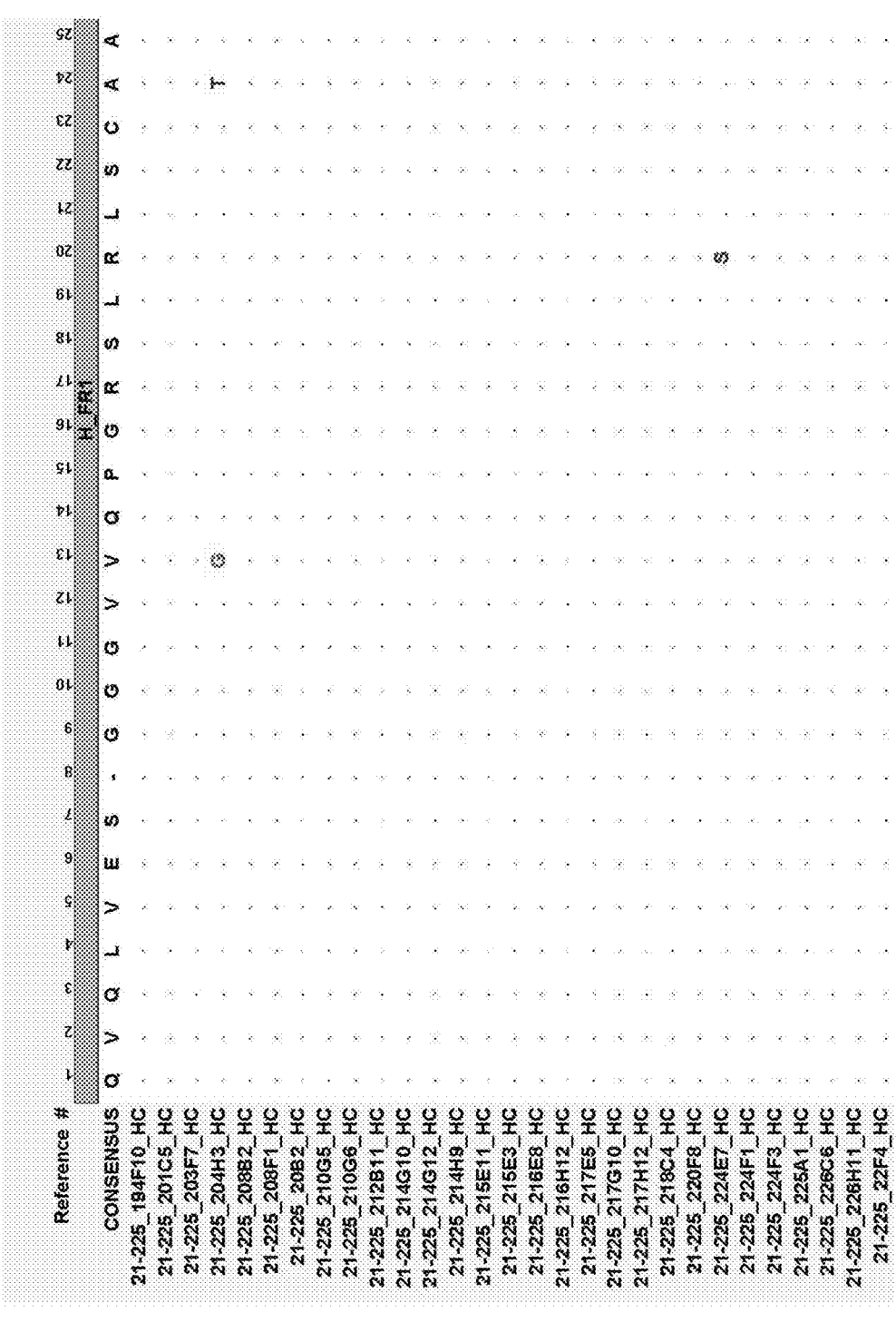
Figure 57:
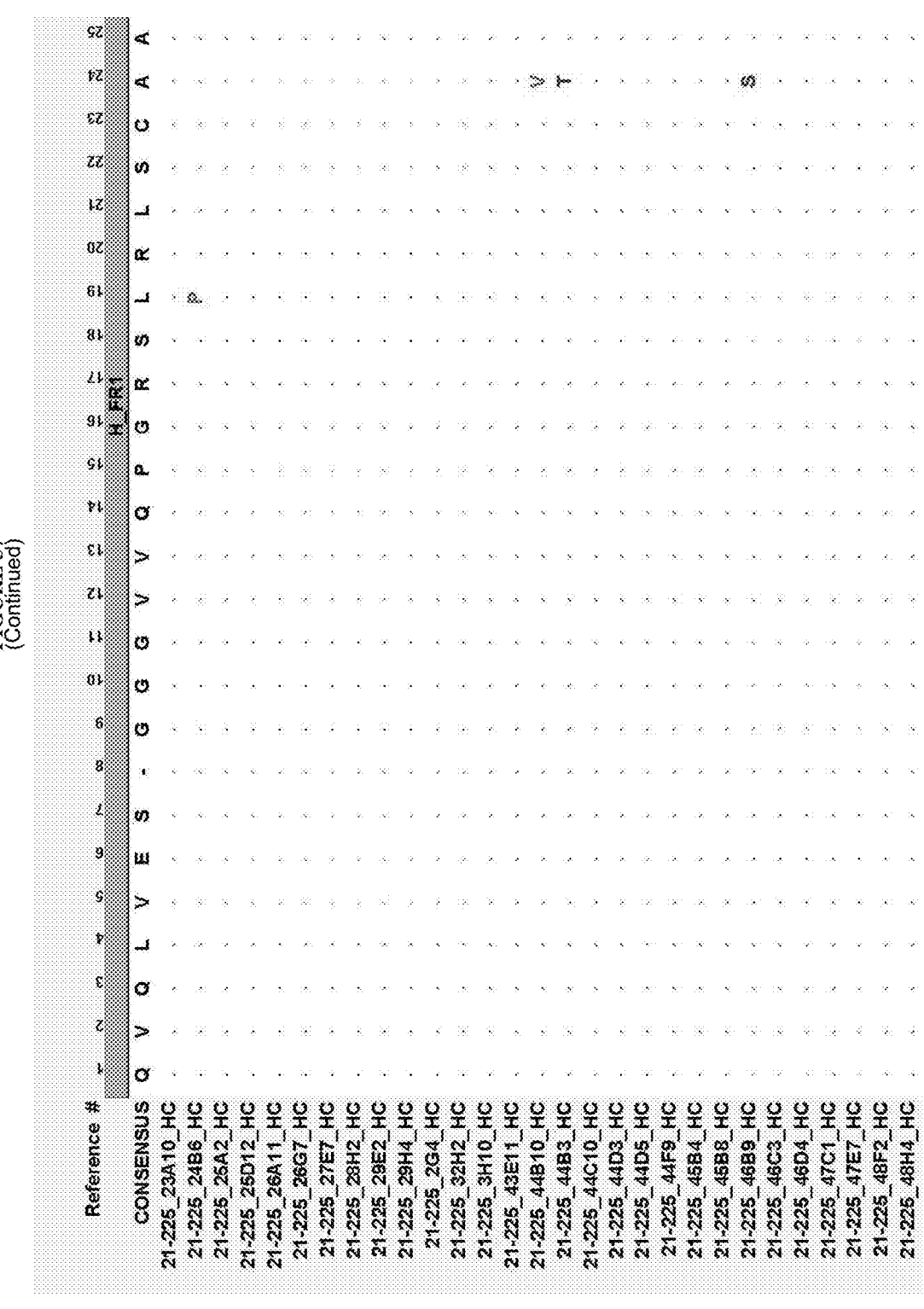
Figure 57:
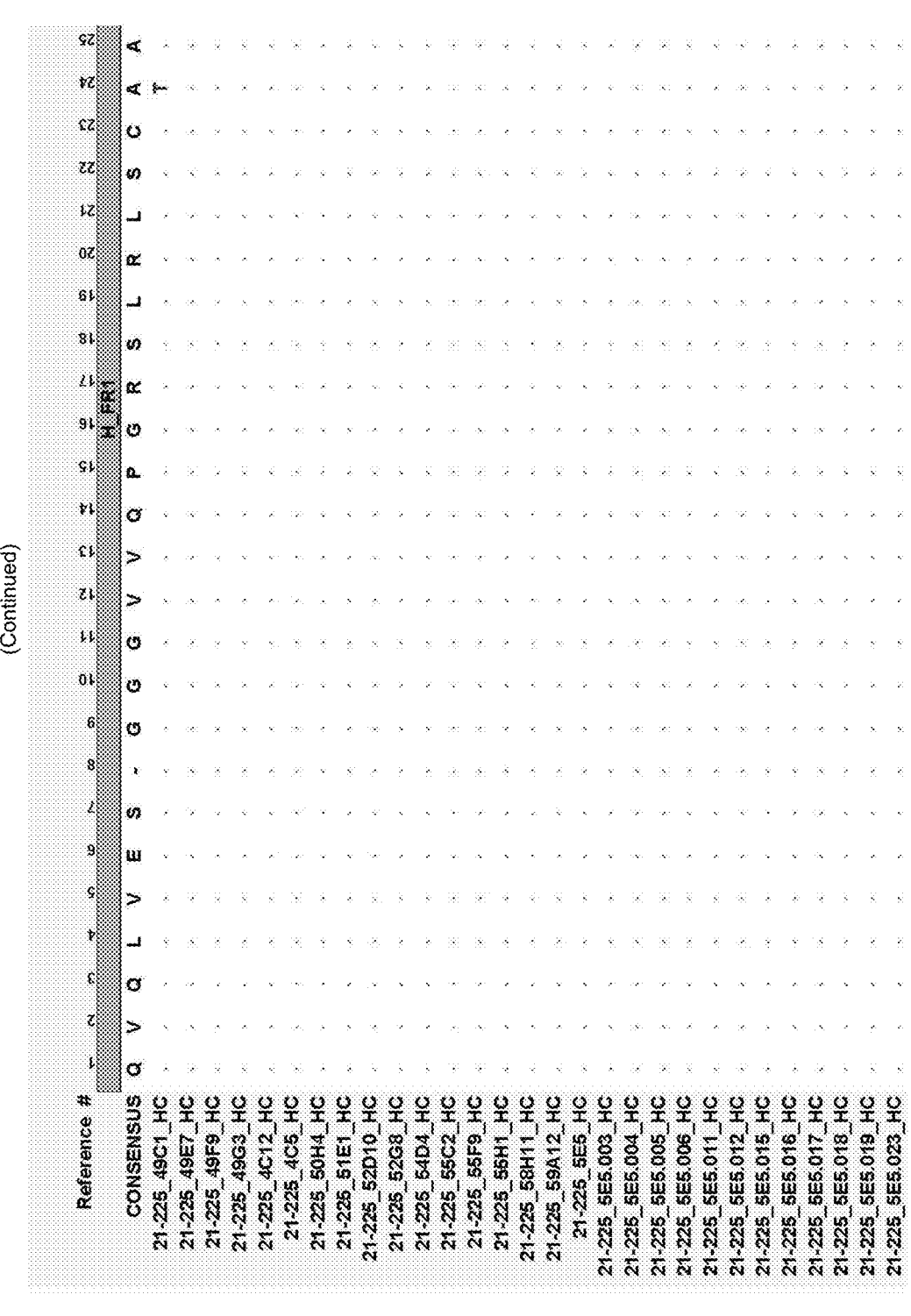
Figure 57:
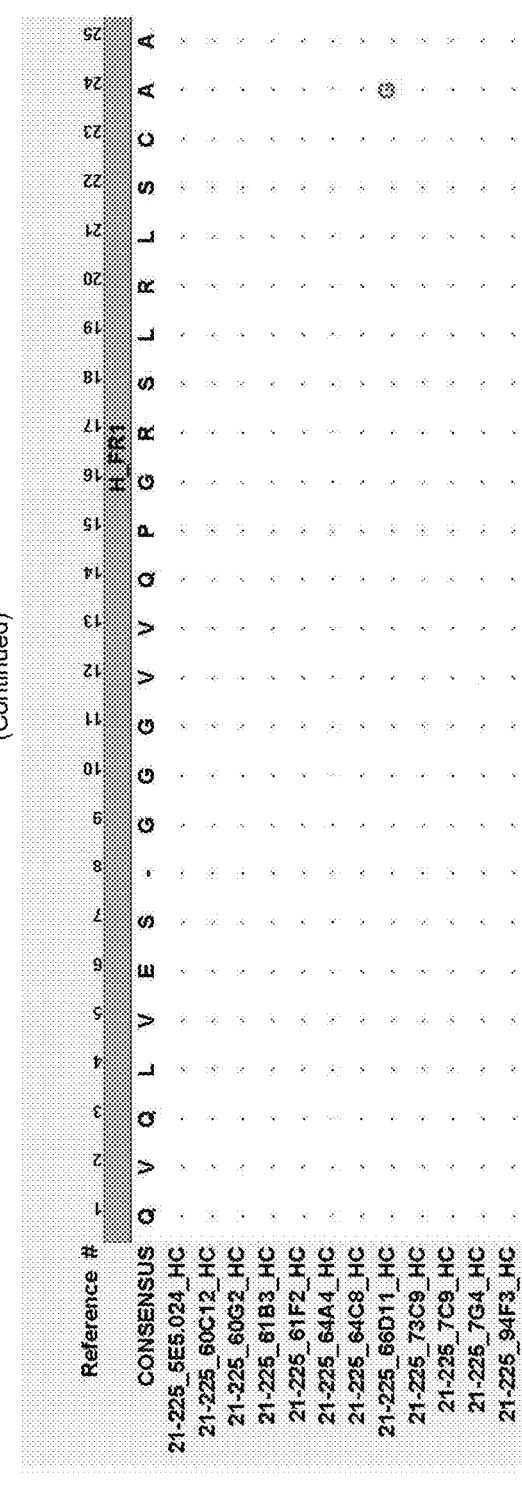
Figure 57:
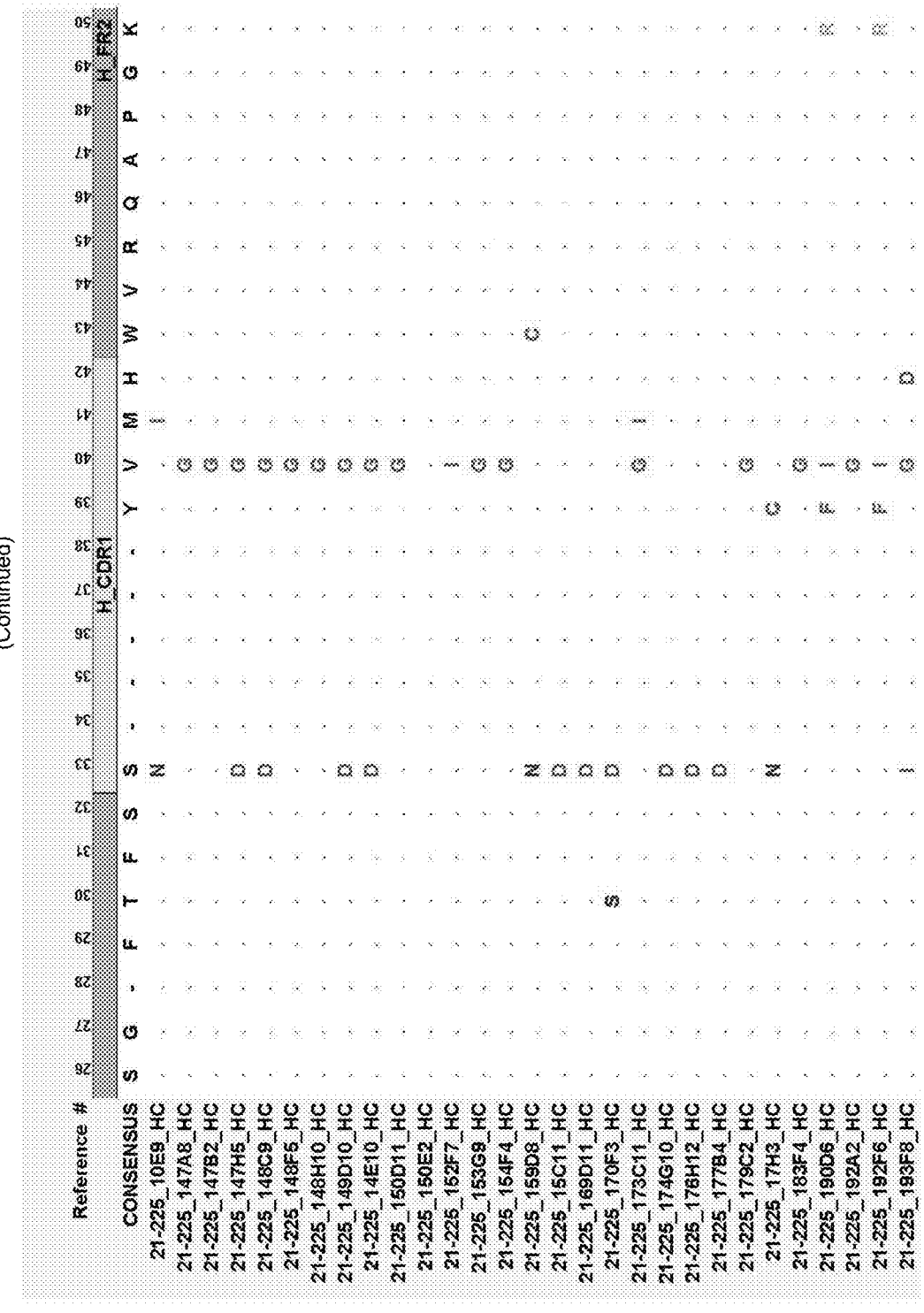
Figure 57:
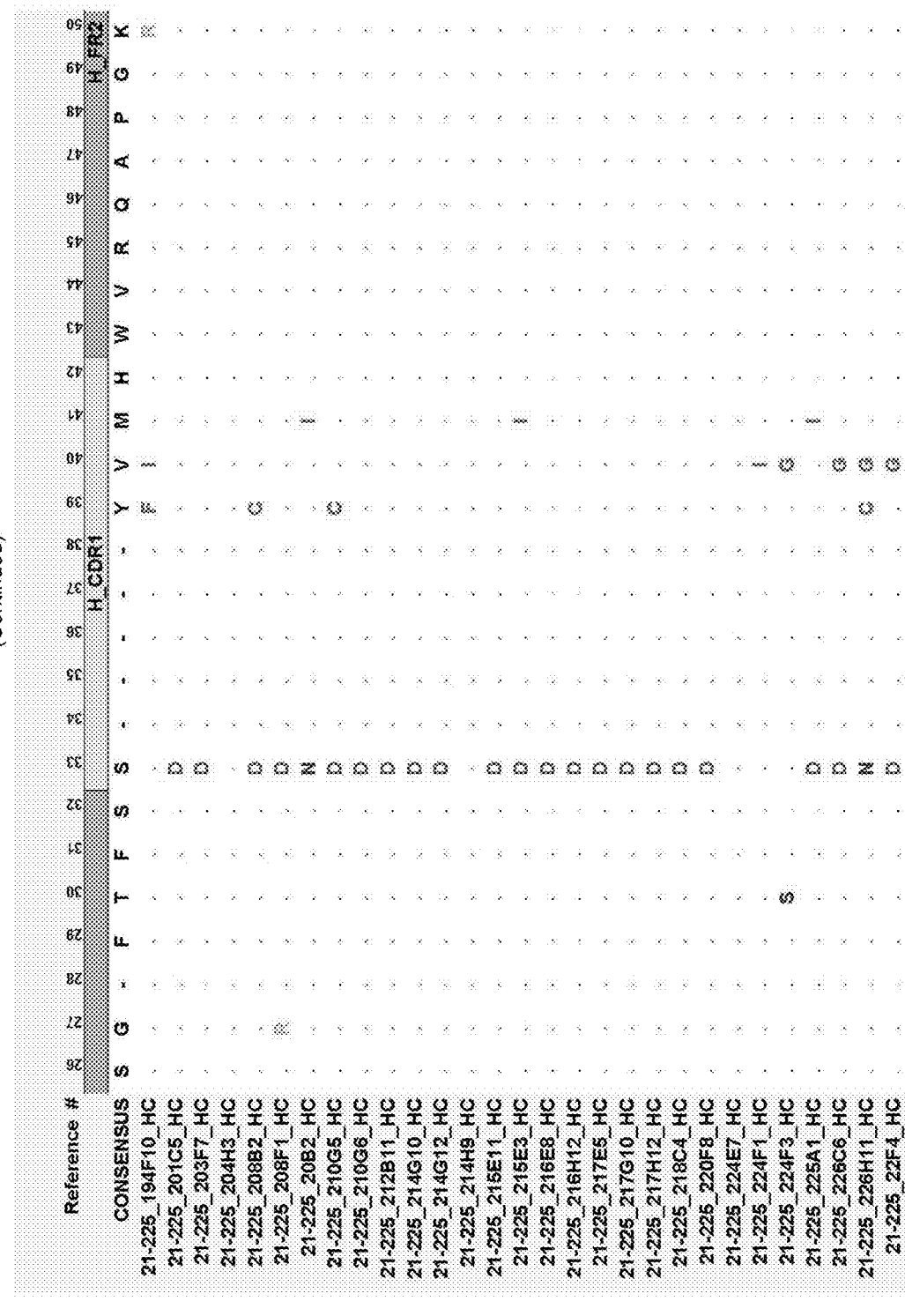
Figure 57:
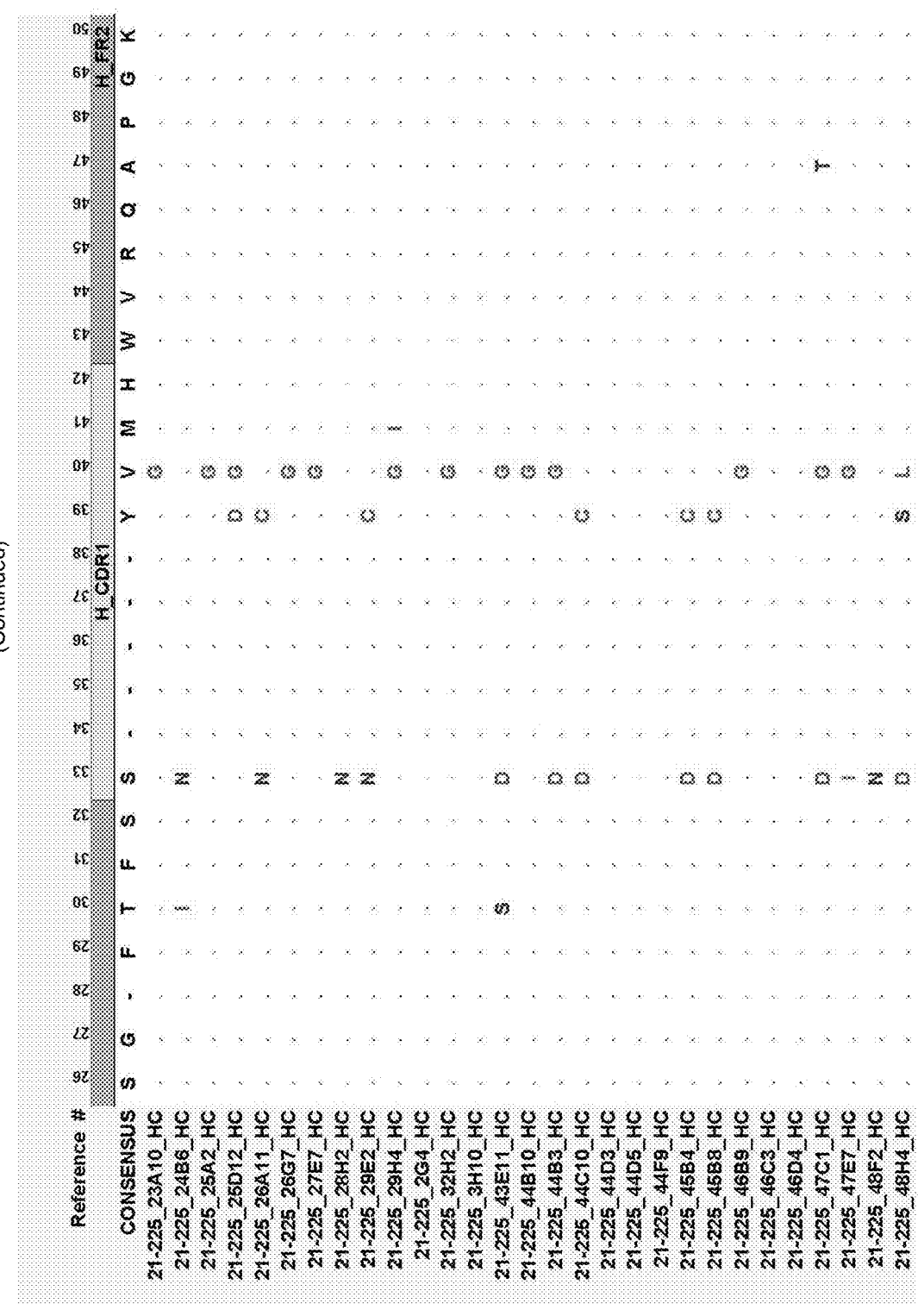
Figure 57:
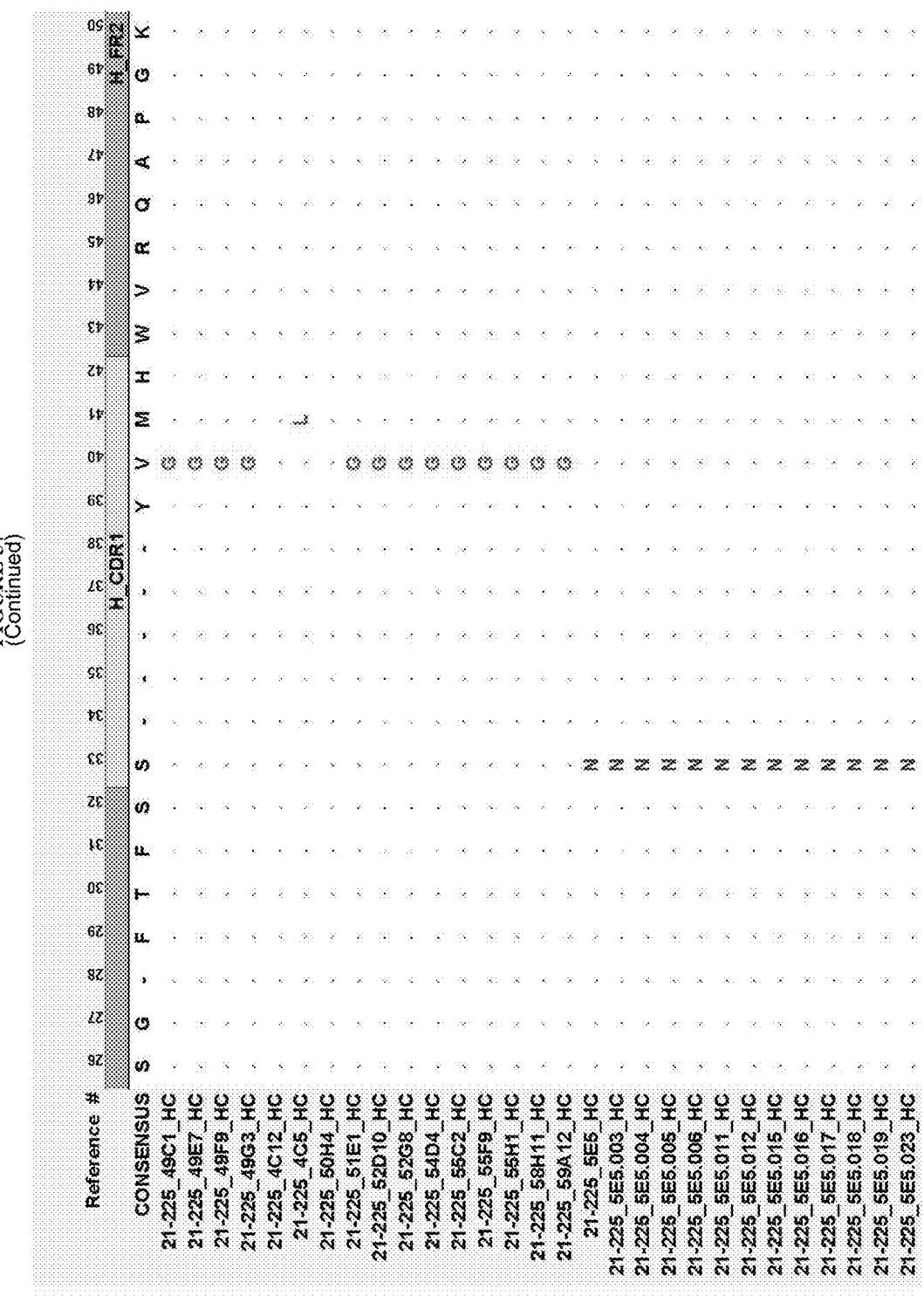
Figure 57:
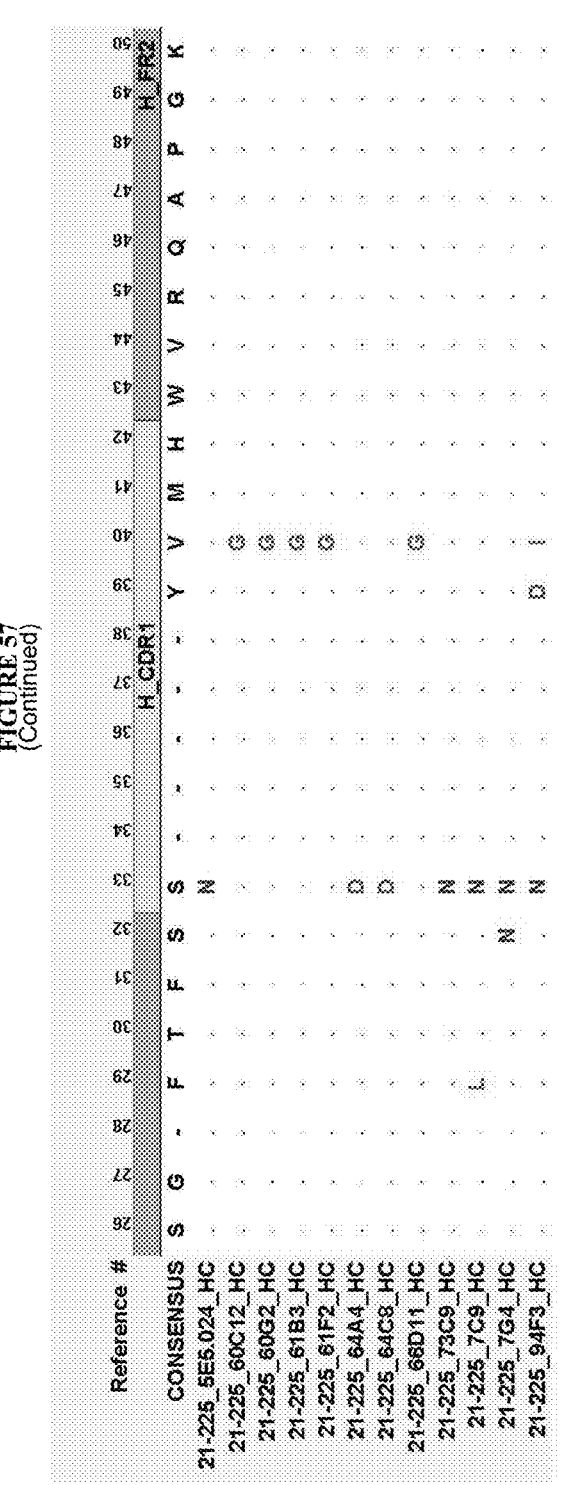
Figure 57:
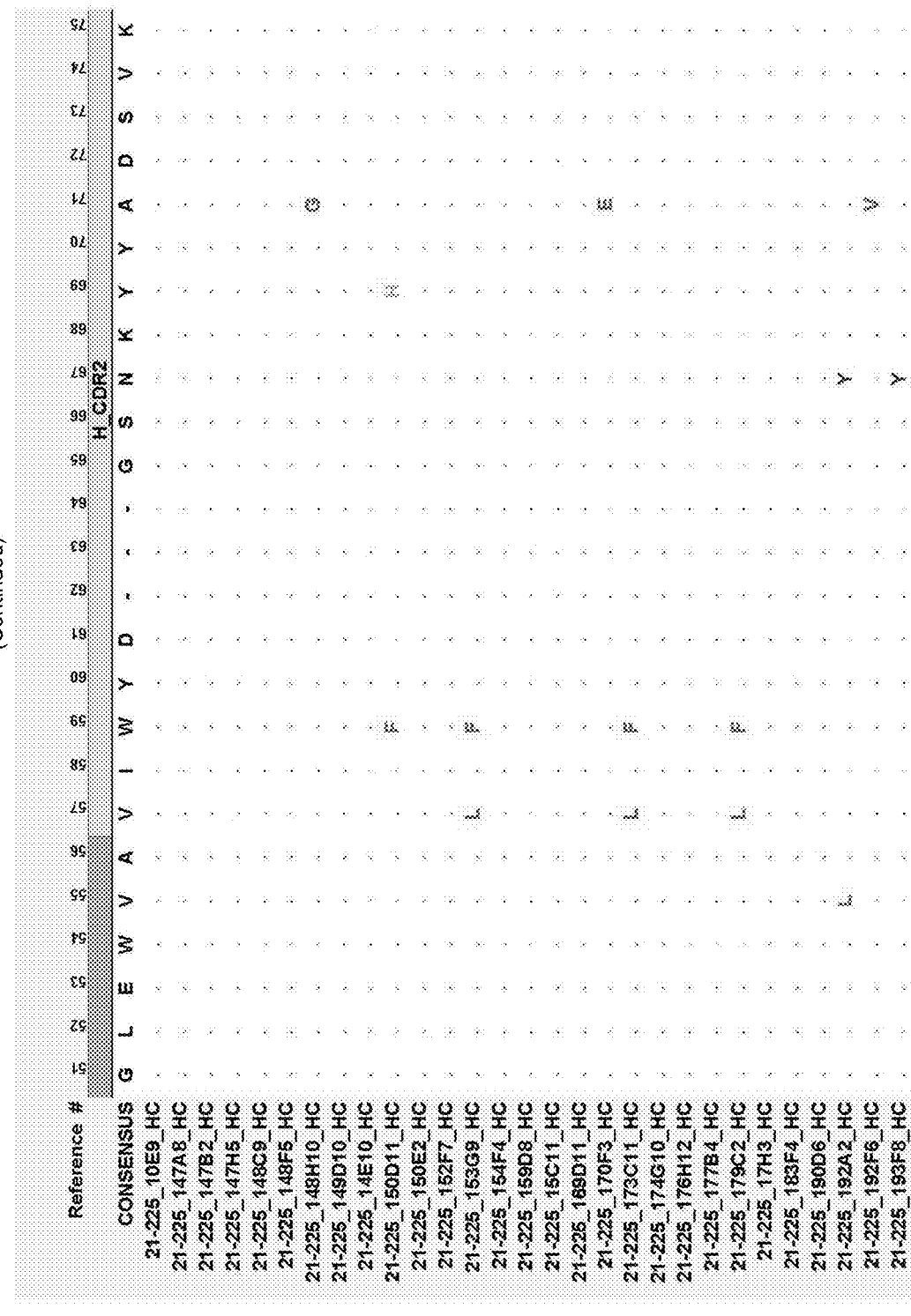
Figure 57:
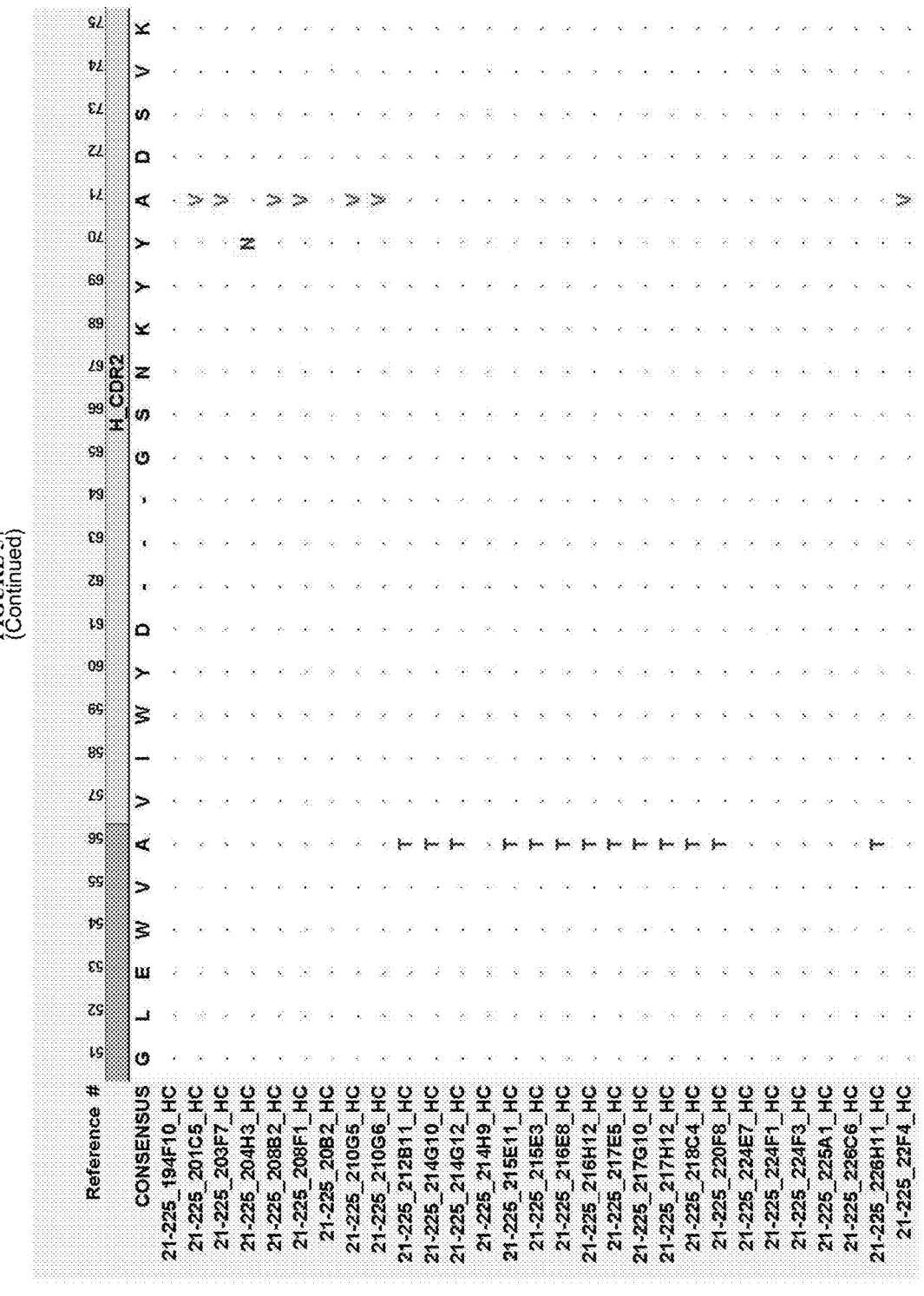
Figure 57:
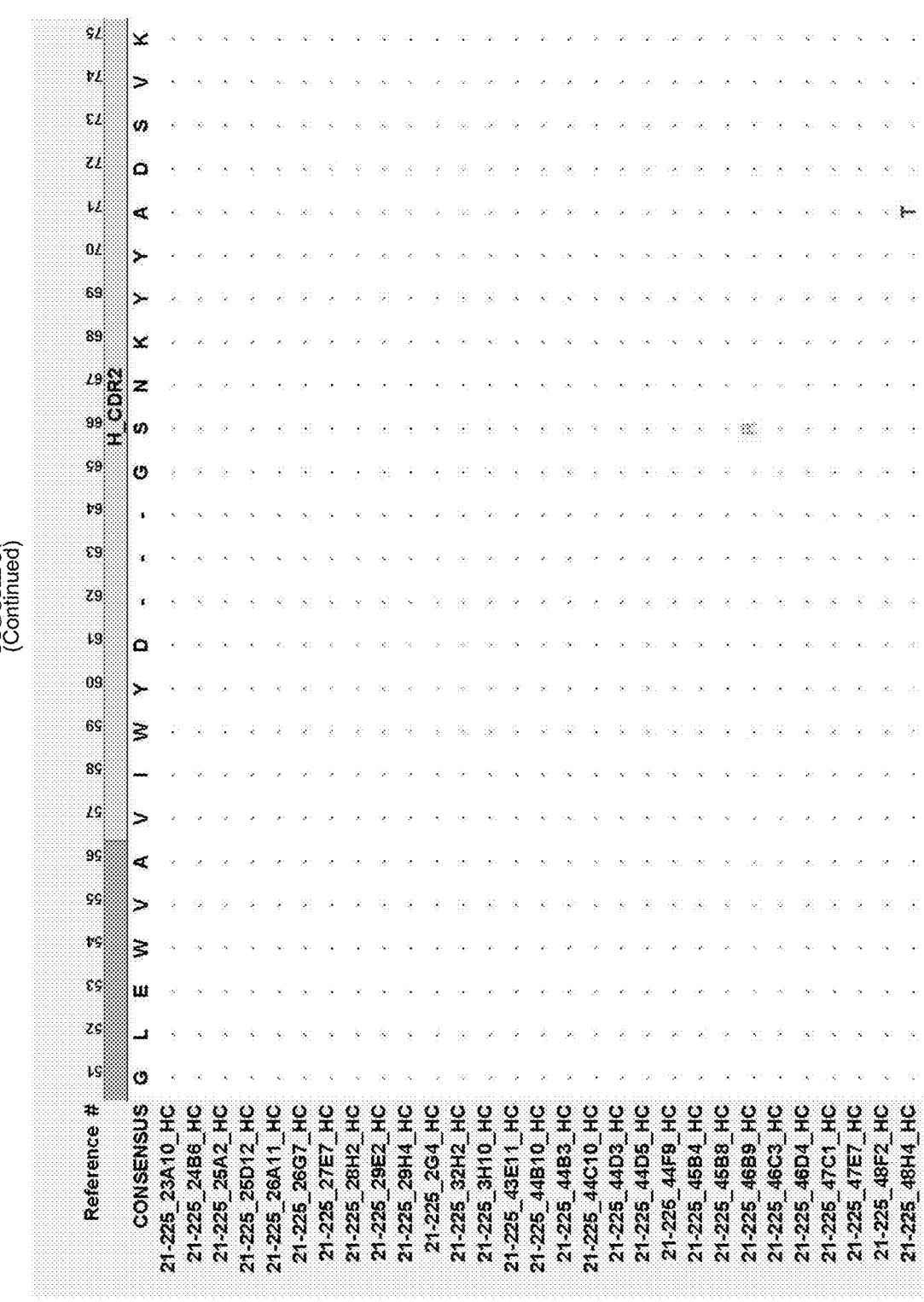
Figure 57:
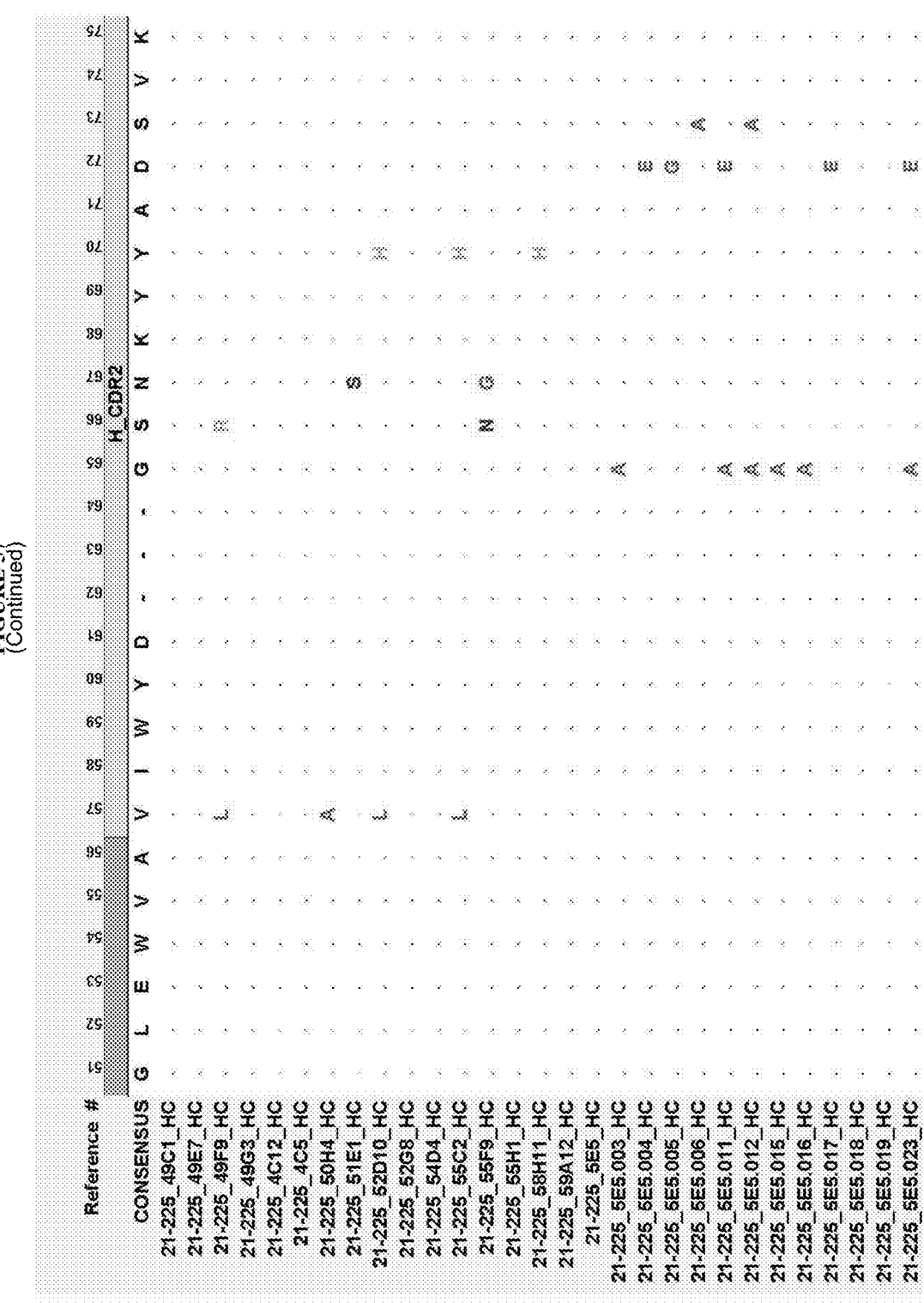
Figure 57:
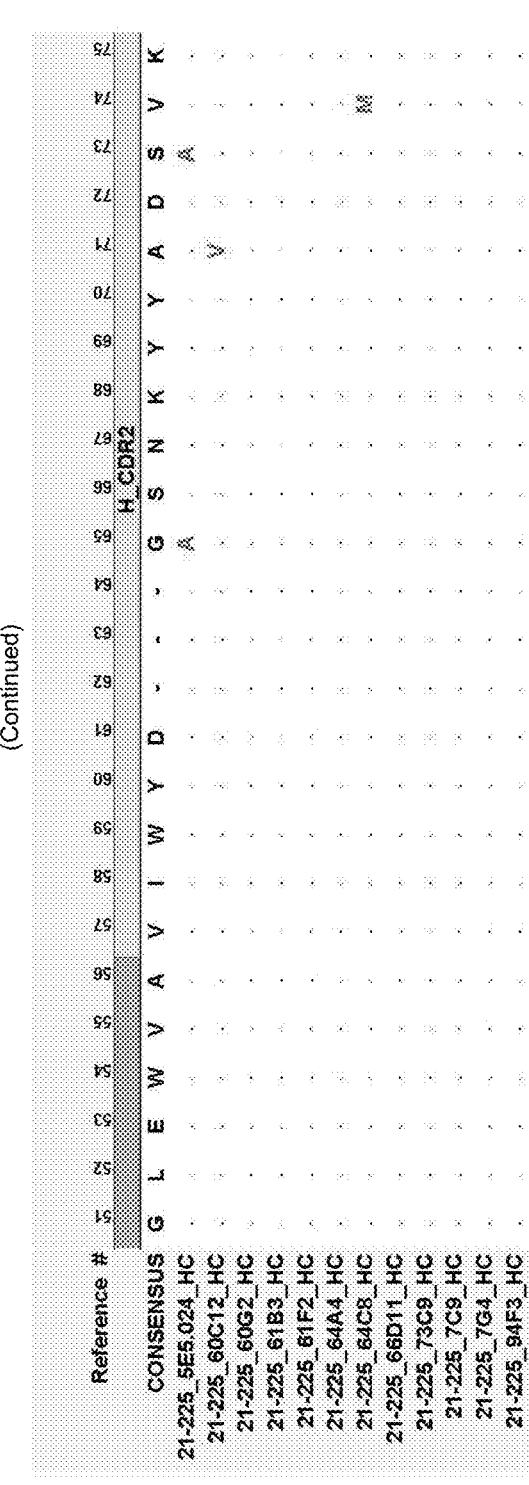
Figure 57:
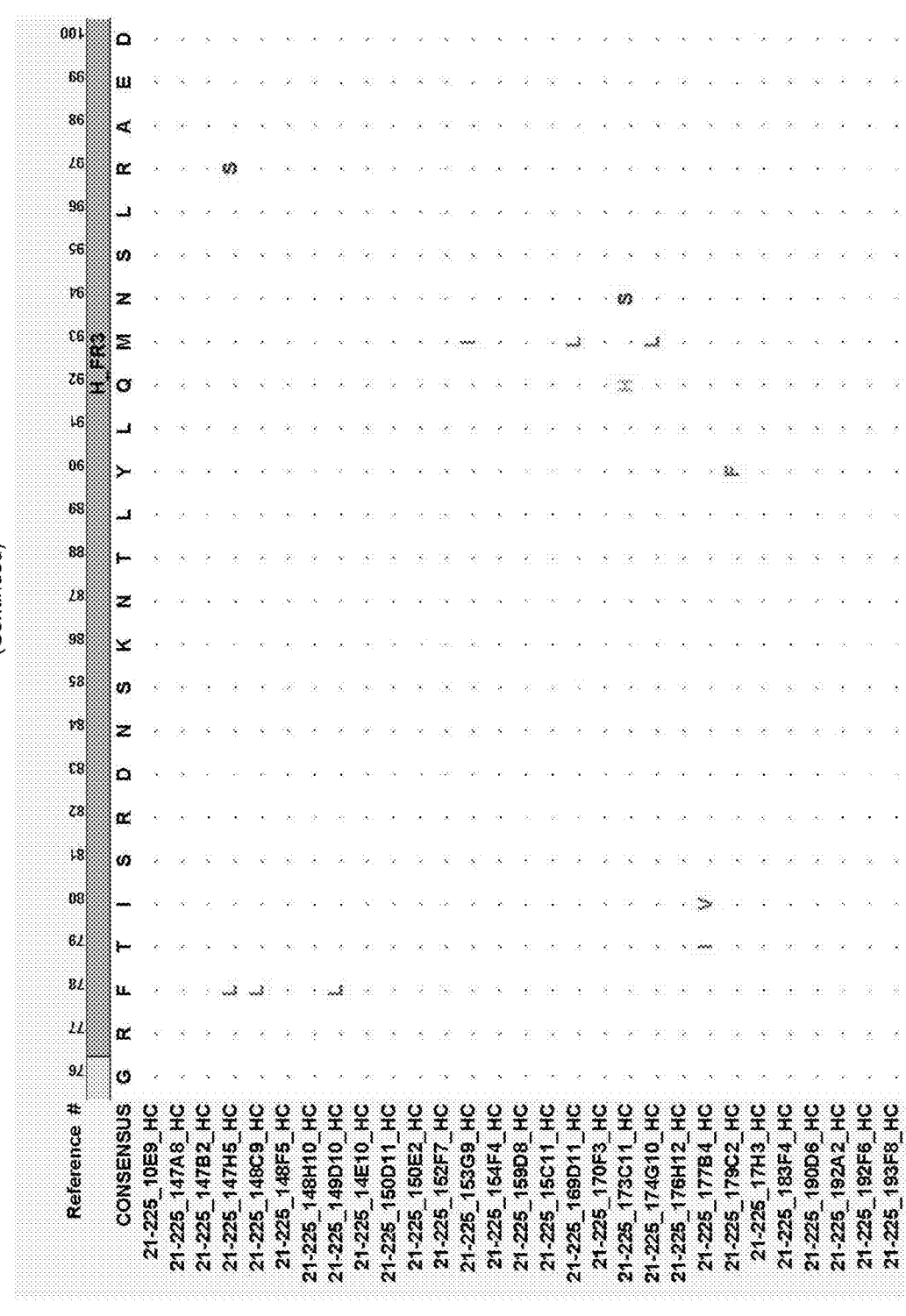
Figure 57:
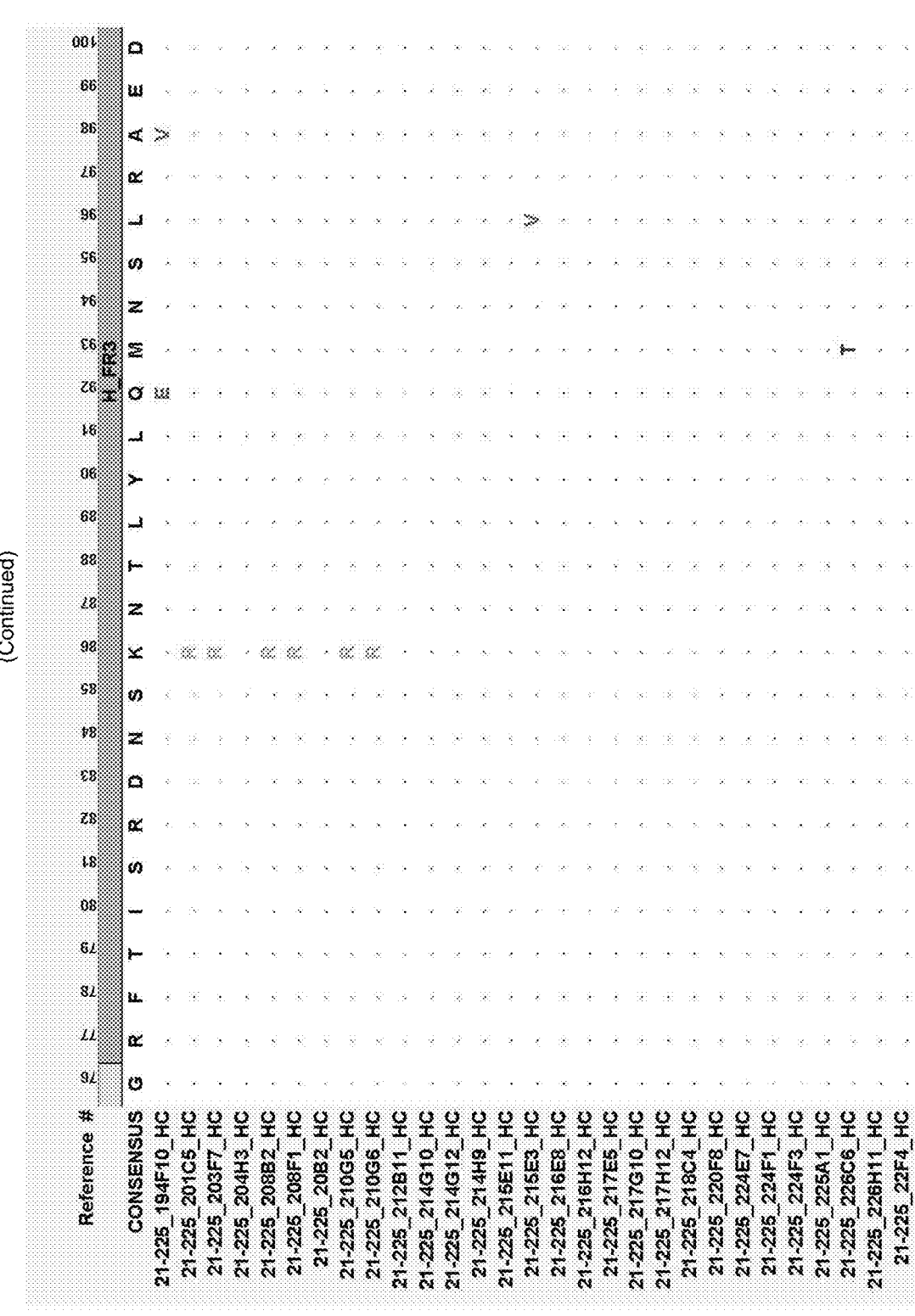
Figure 57:
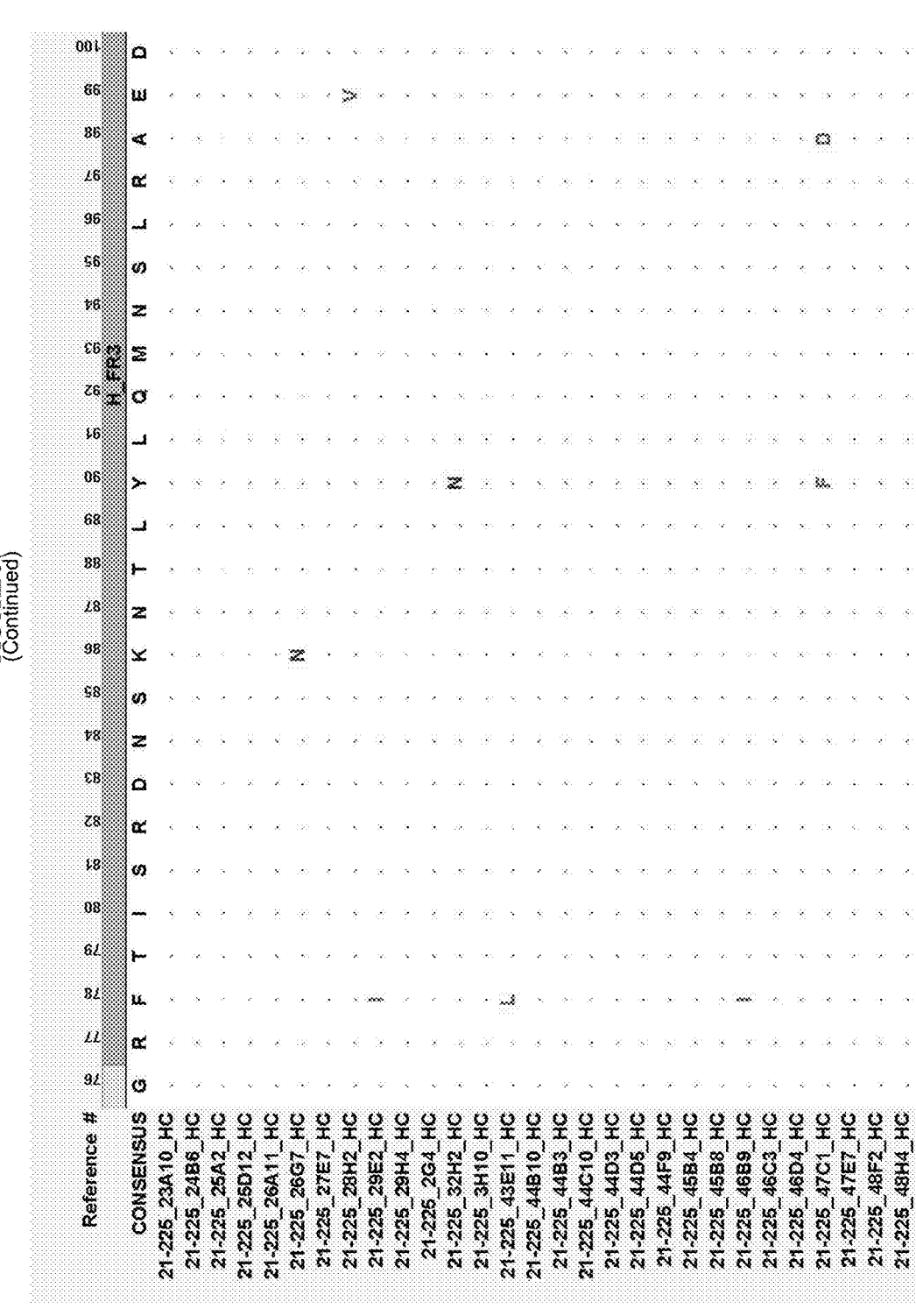
Figure 57:
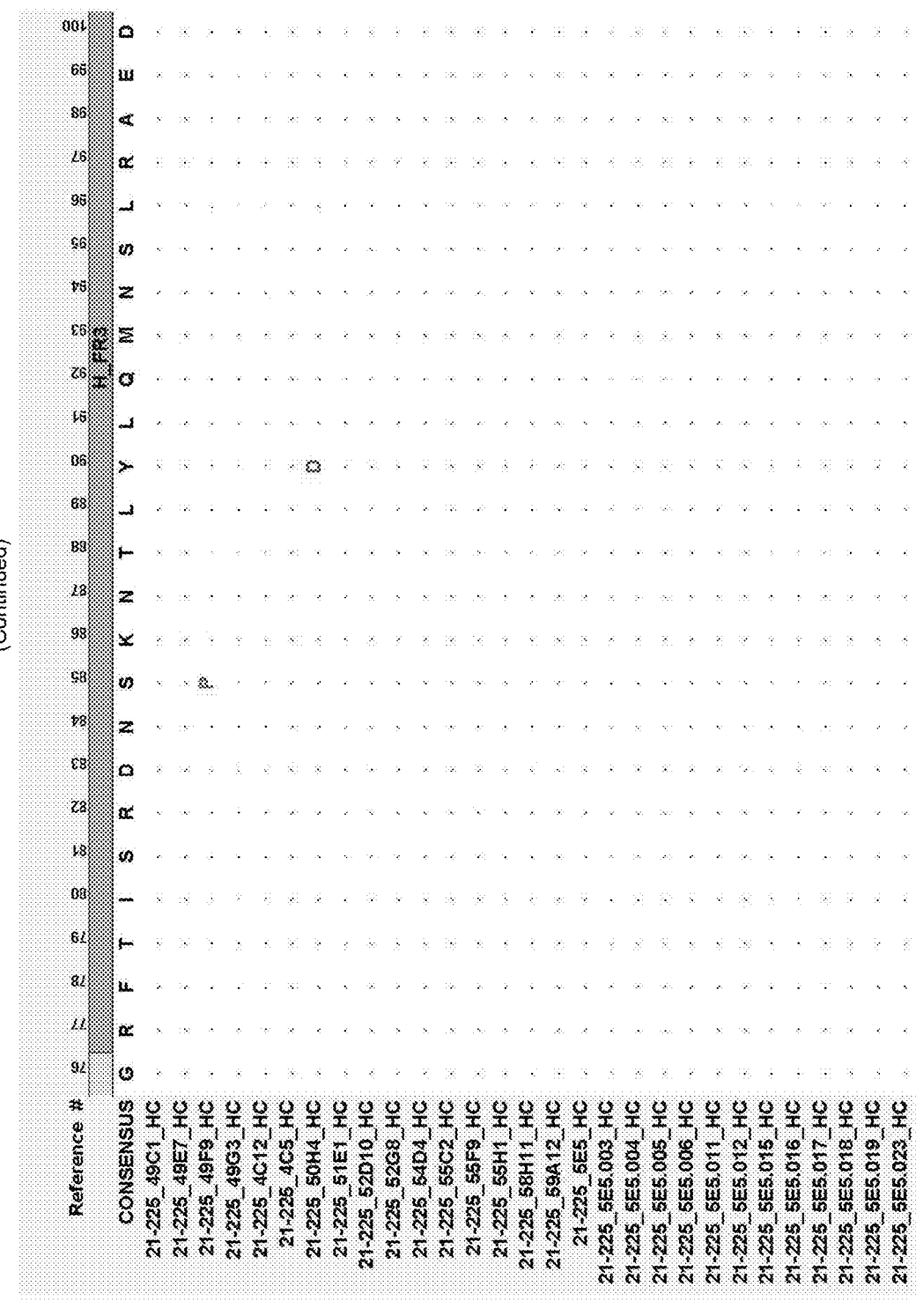
Figure 57:
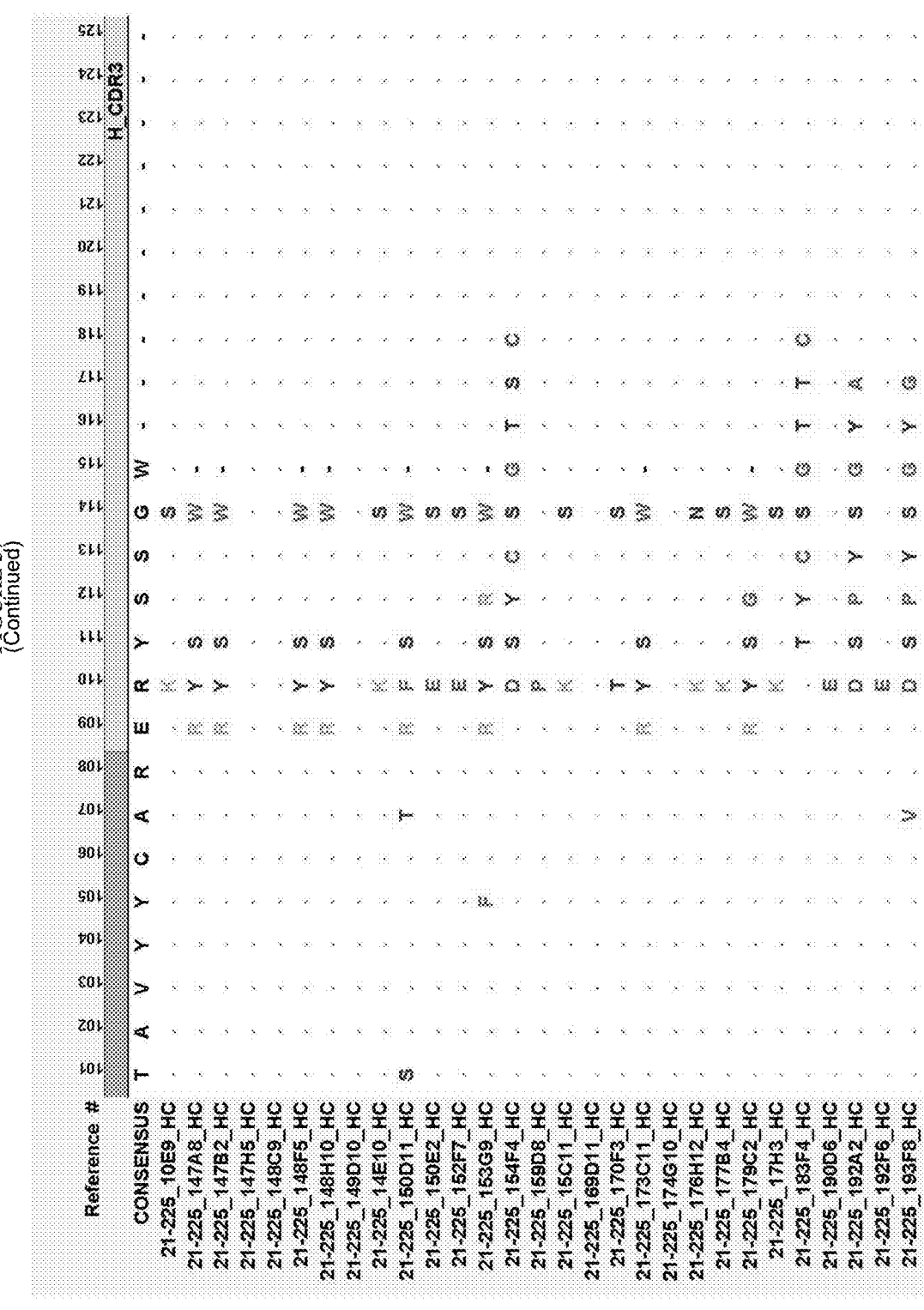
Figure 57:
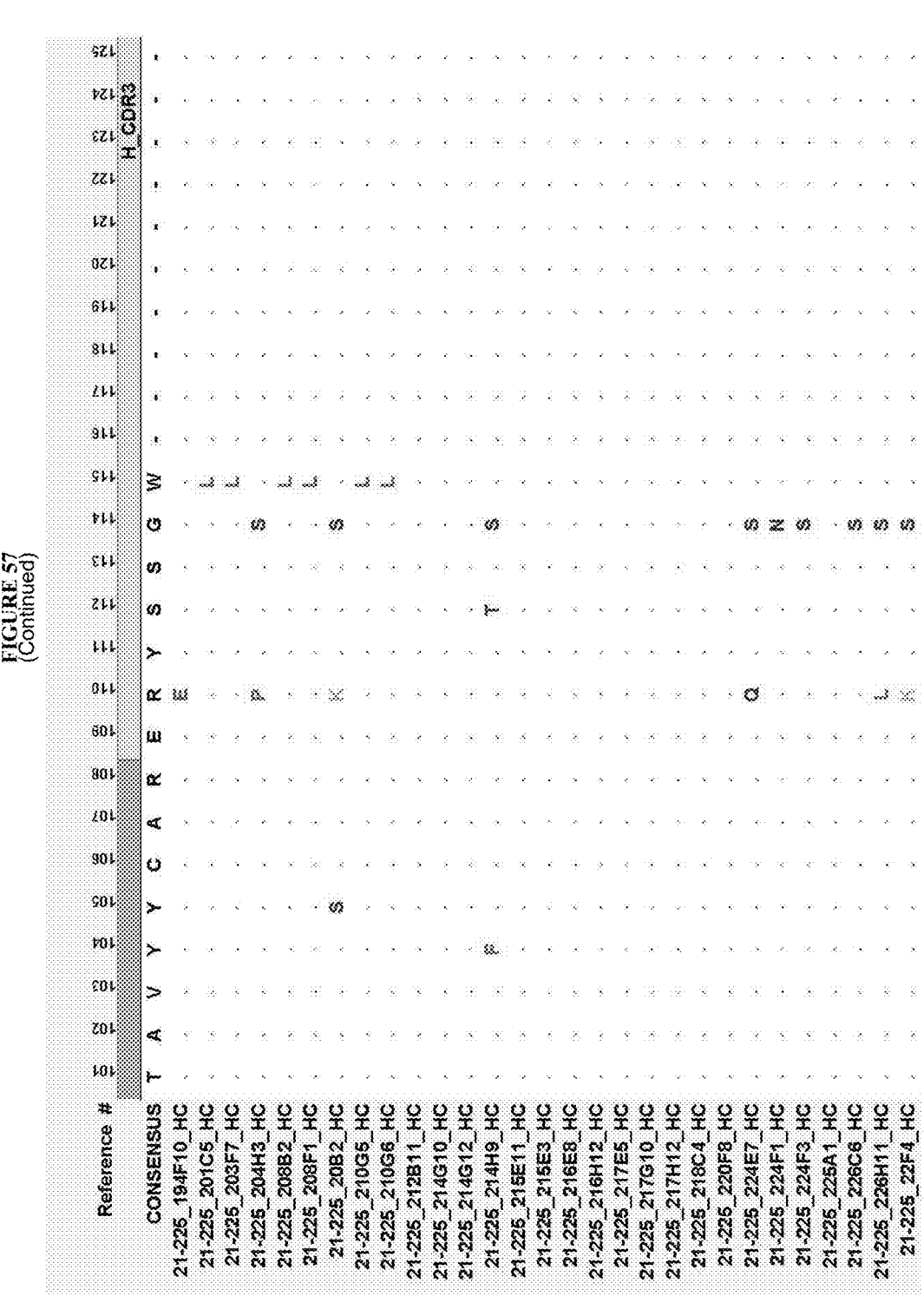
Figure 57:
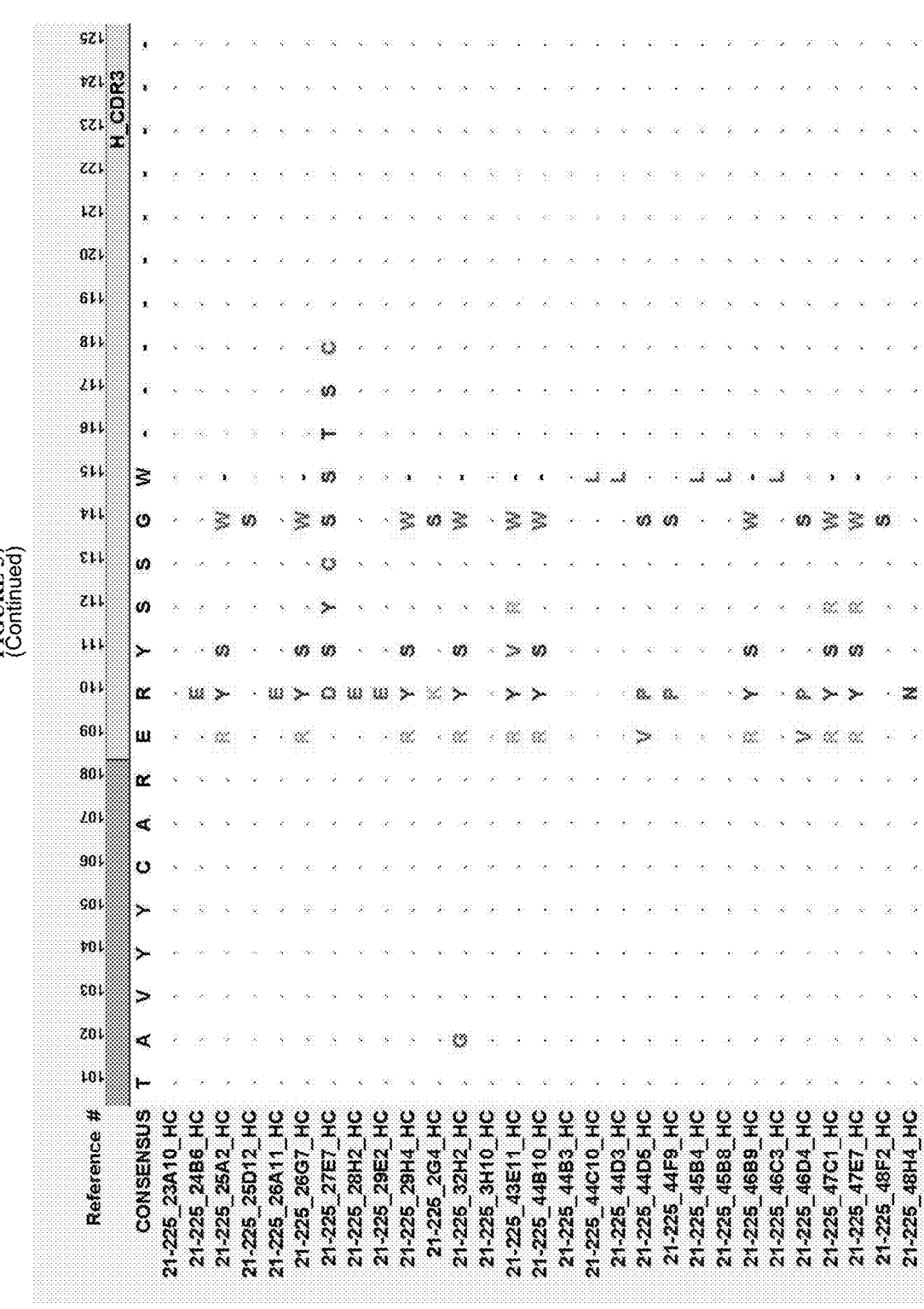
Figure 57:
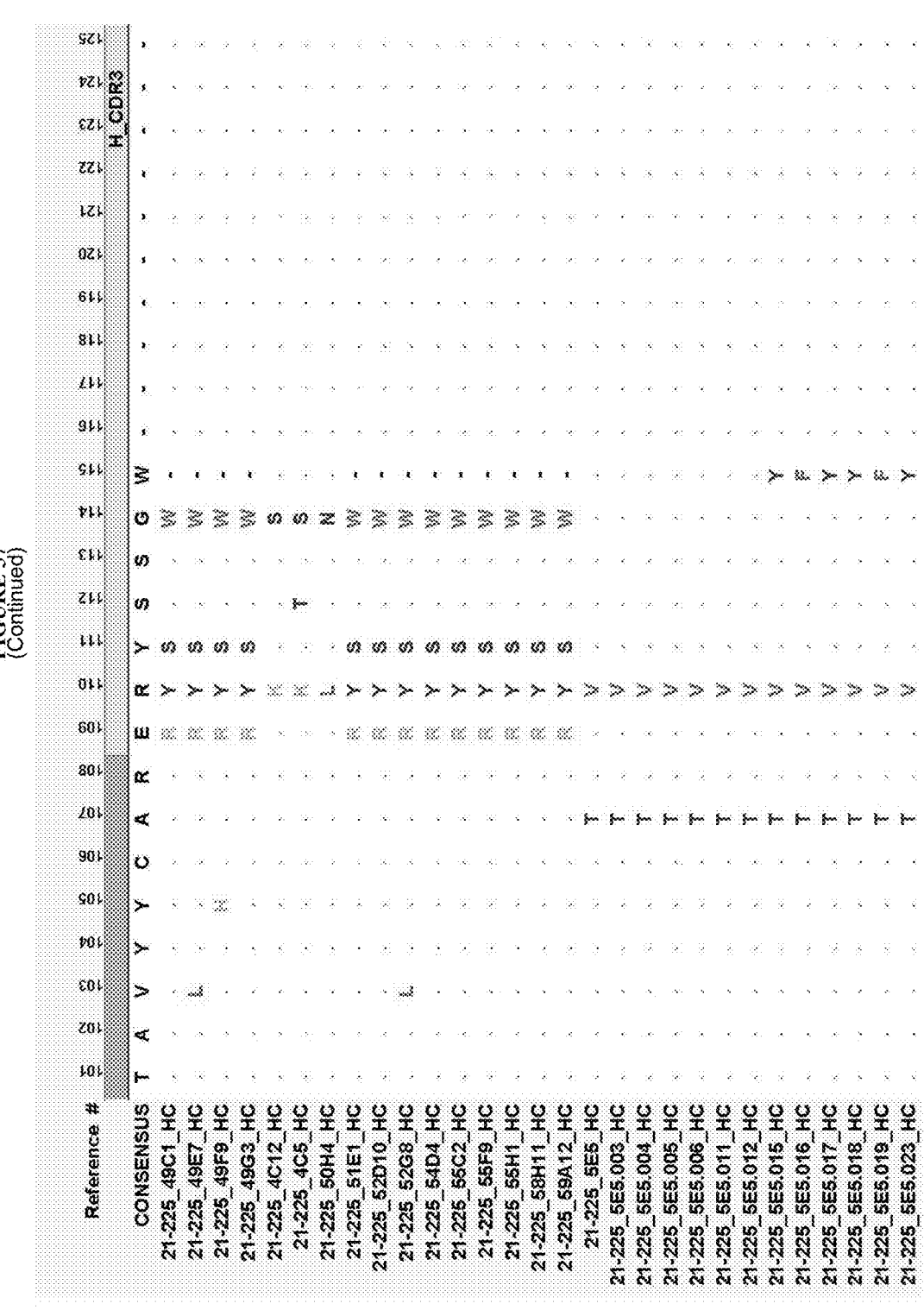
Figure 57:
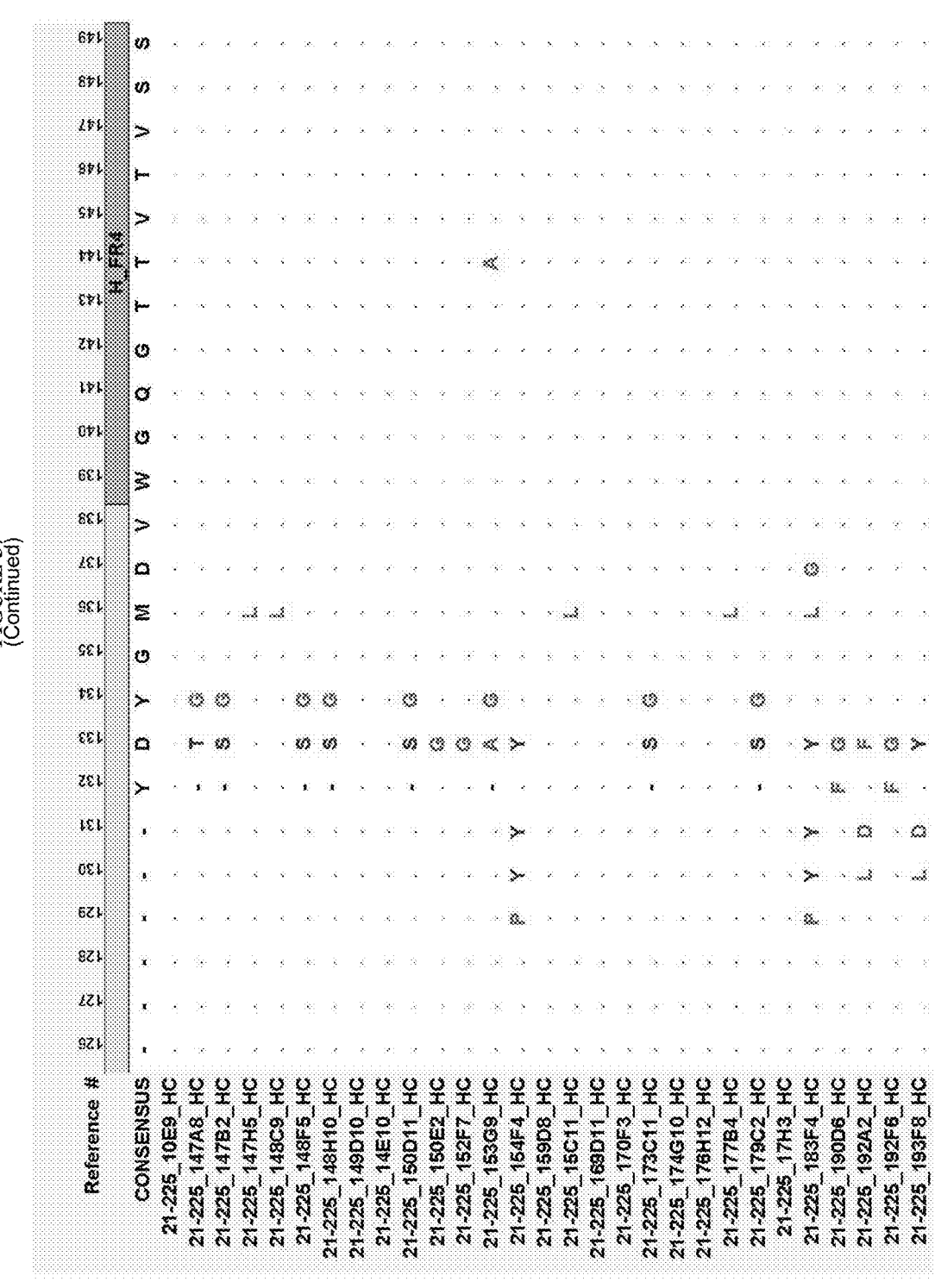
Figure 57:
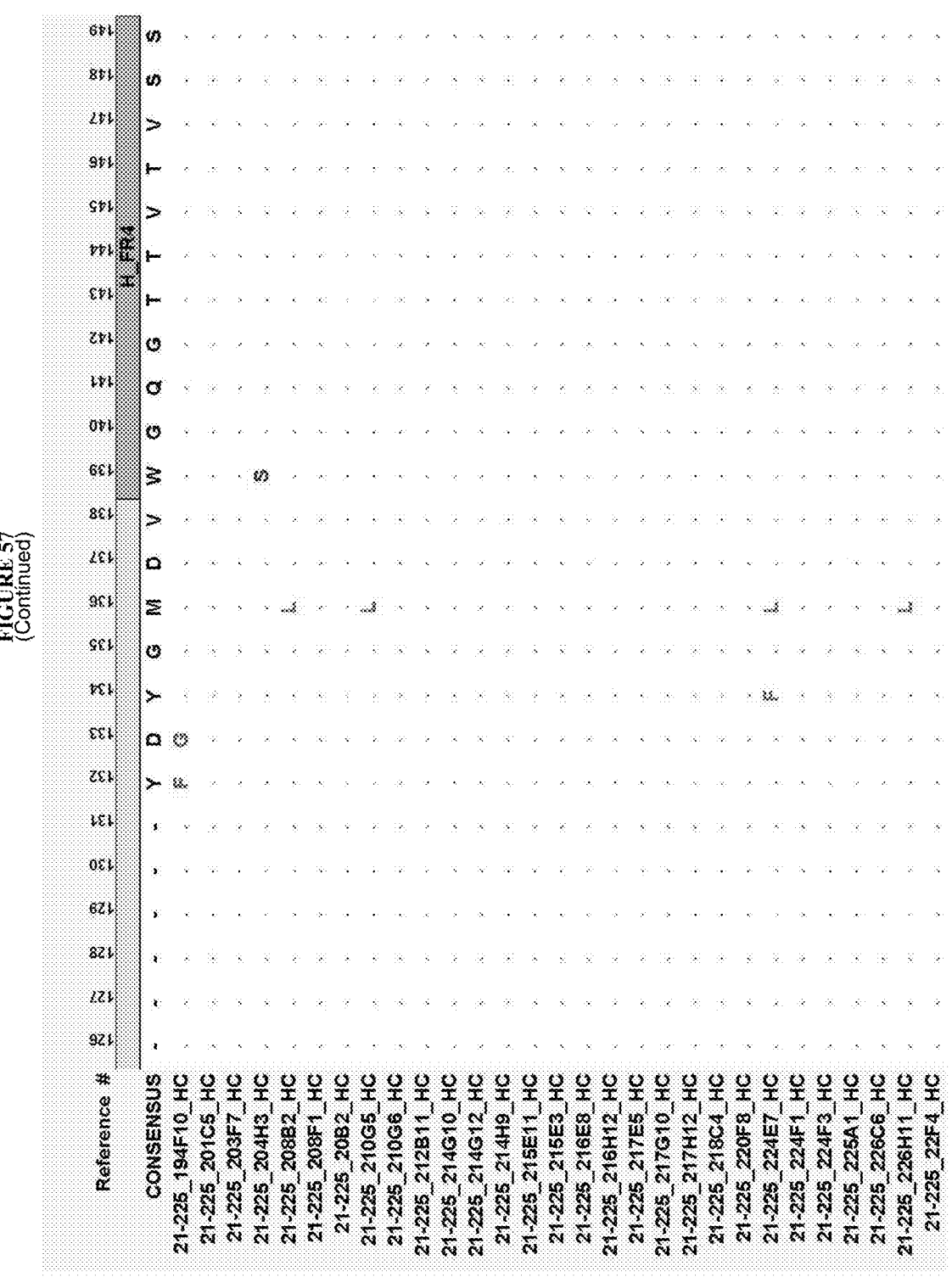
Figure 57:
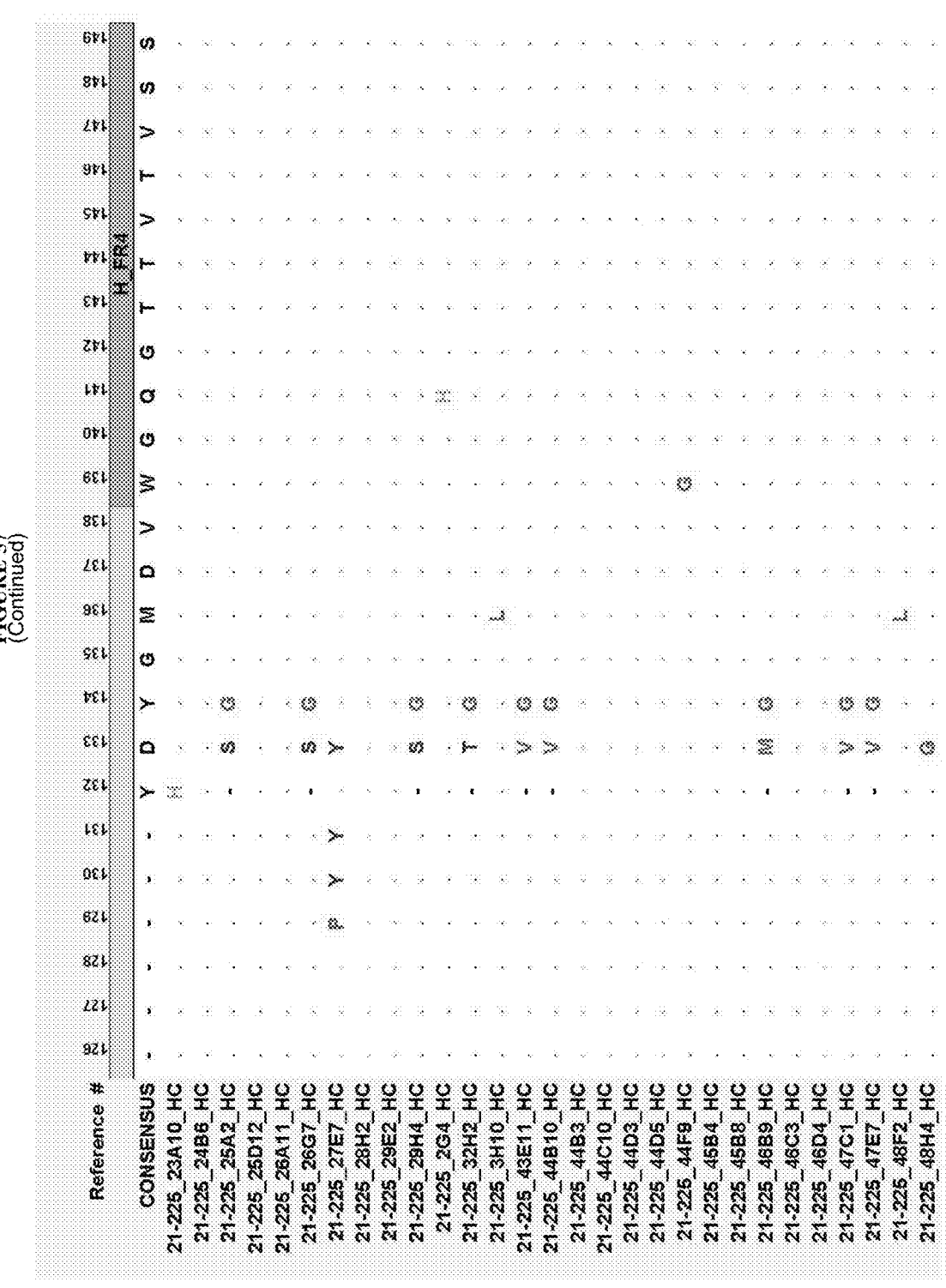
Figure 57:
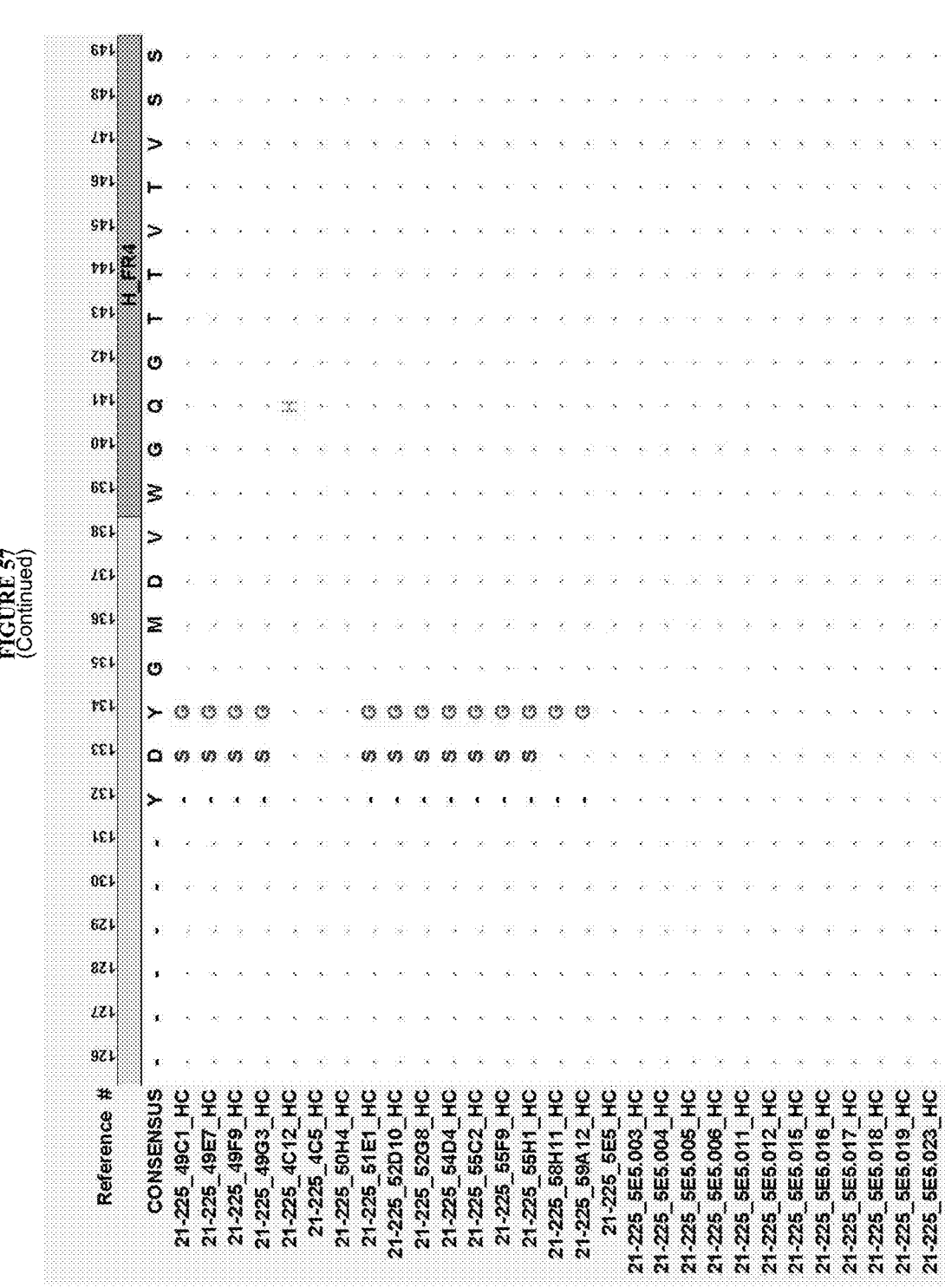
Figure 57:
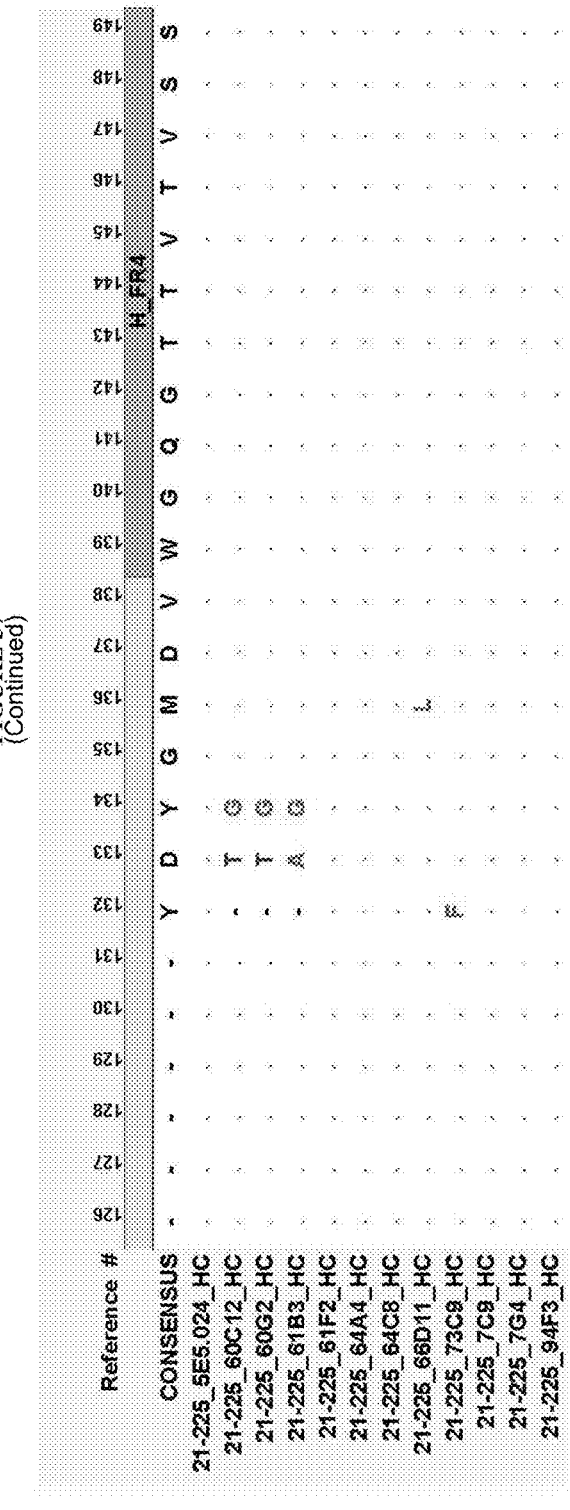
Figure 57:
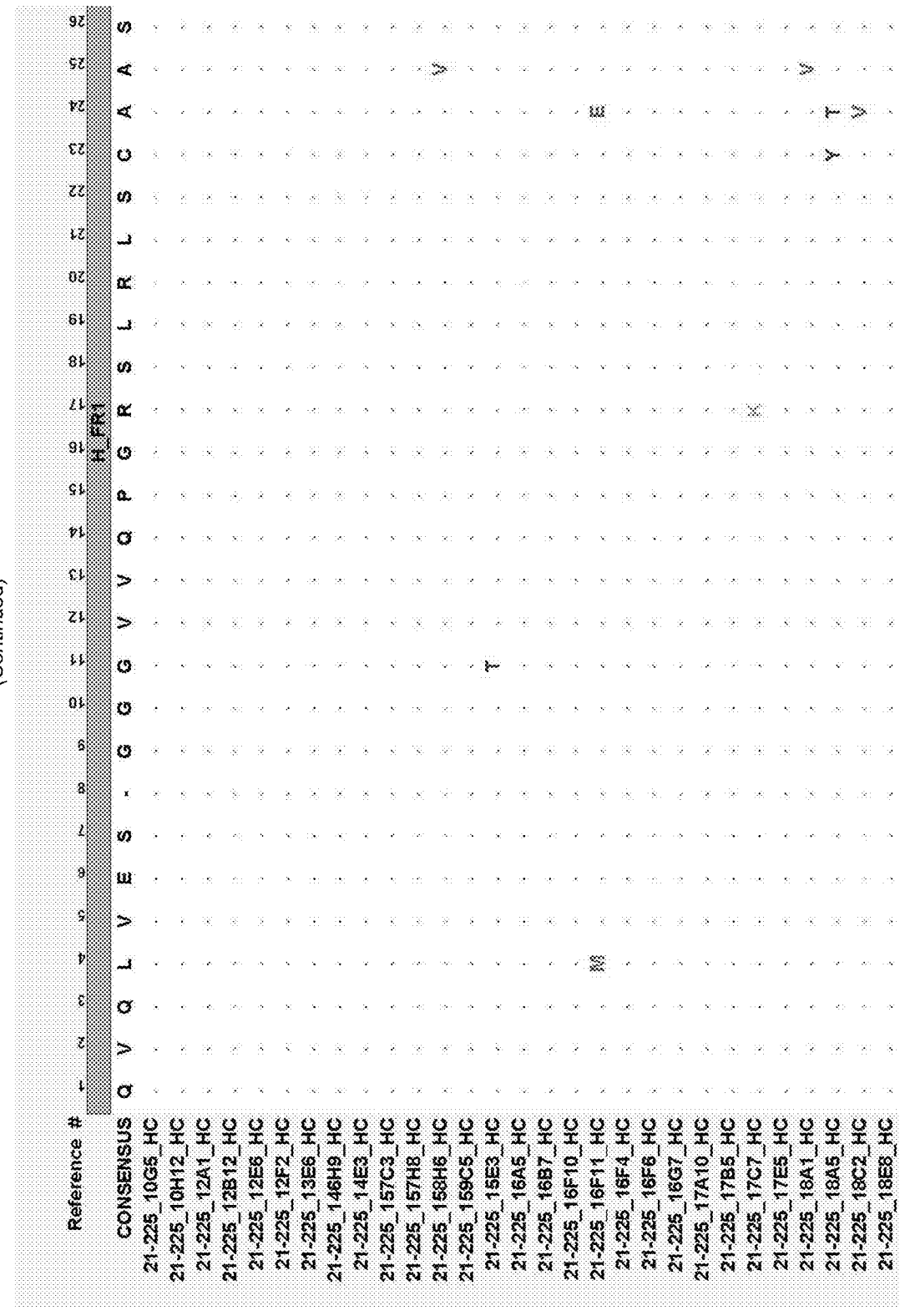
Figure 57:
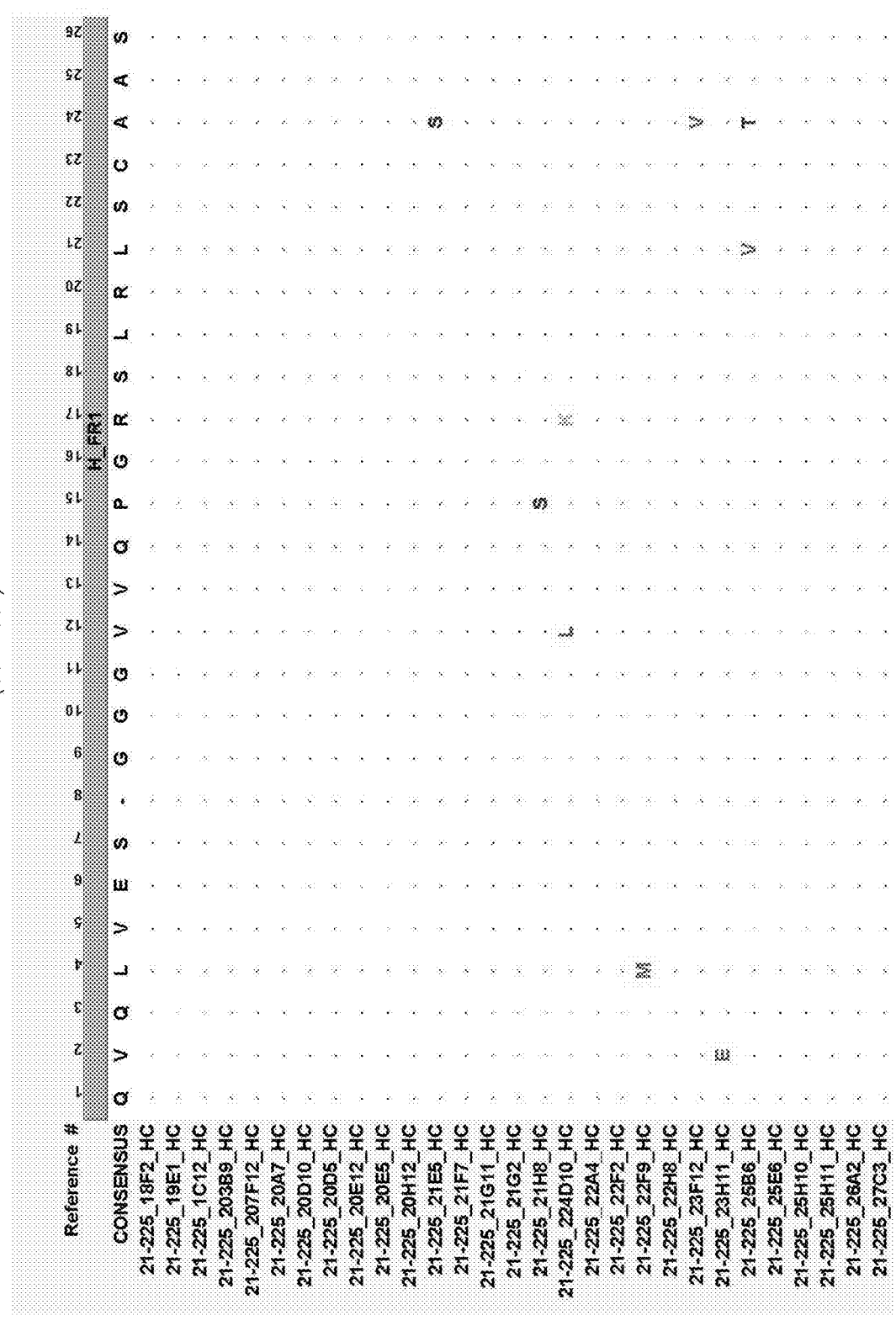
Figure 57:
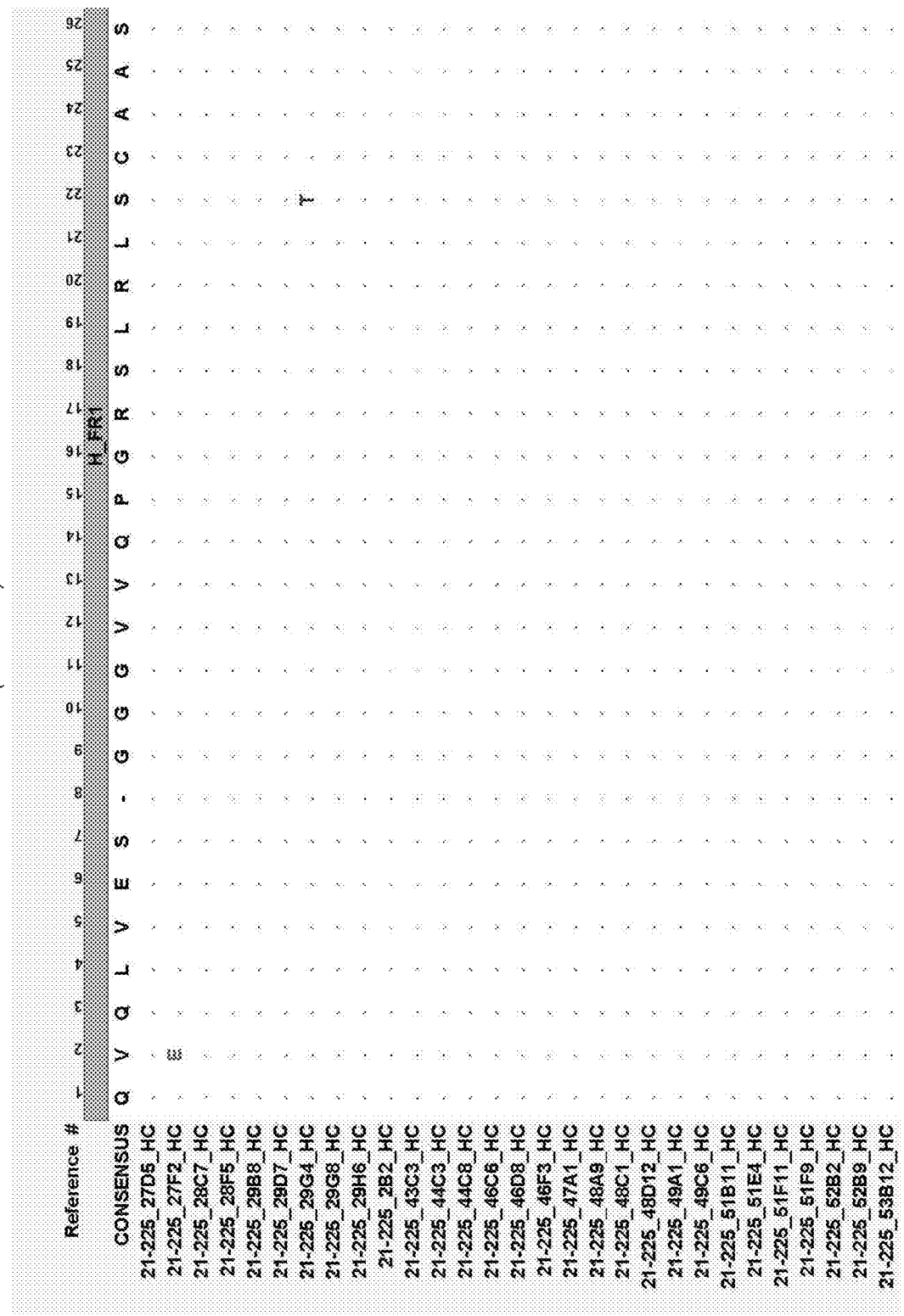
Figure 57:
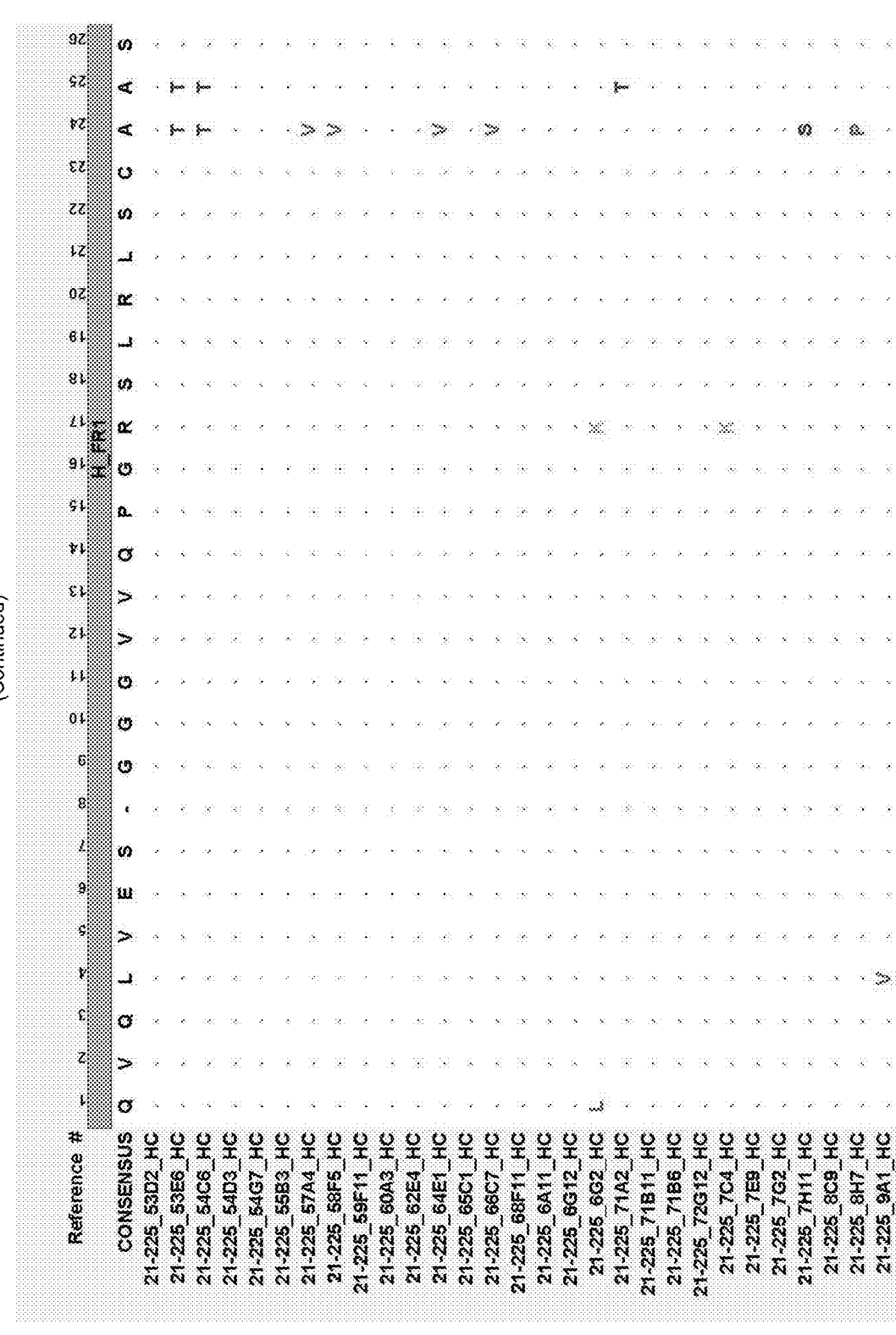
Figure 57:
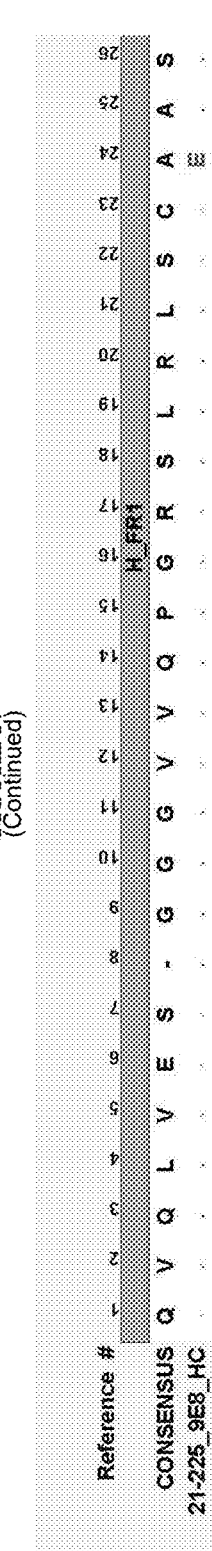
Figure 57:
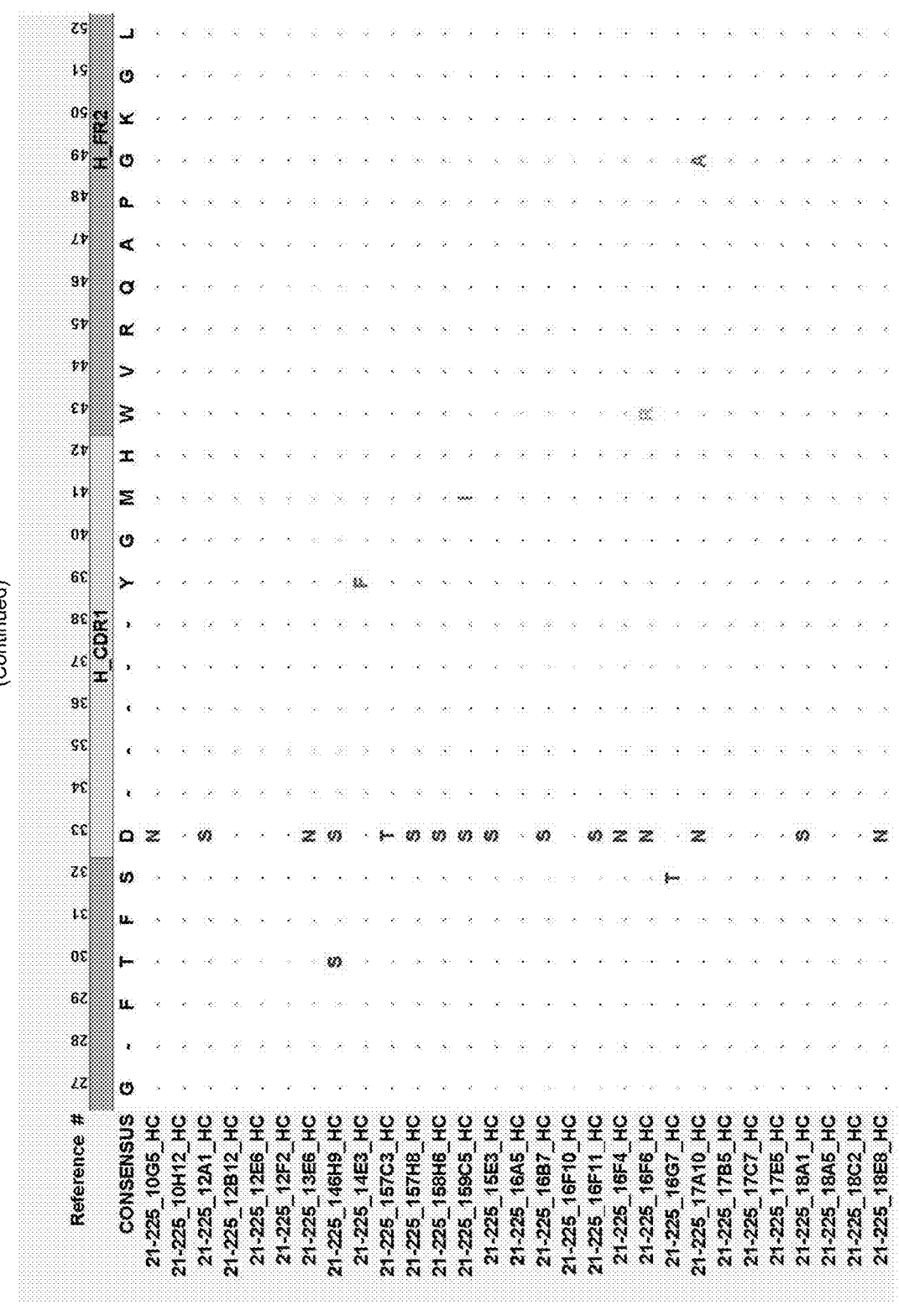
Figure 57:
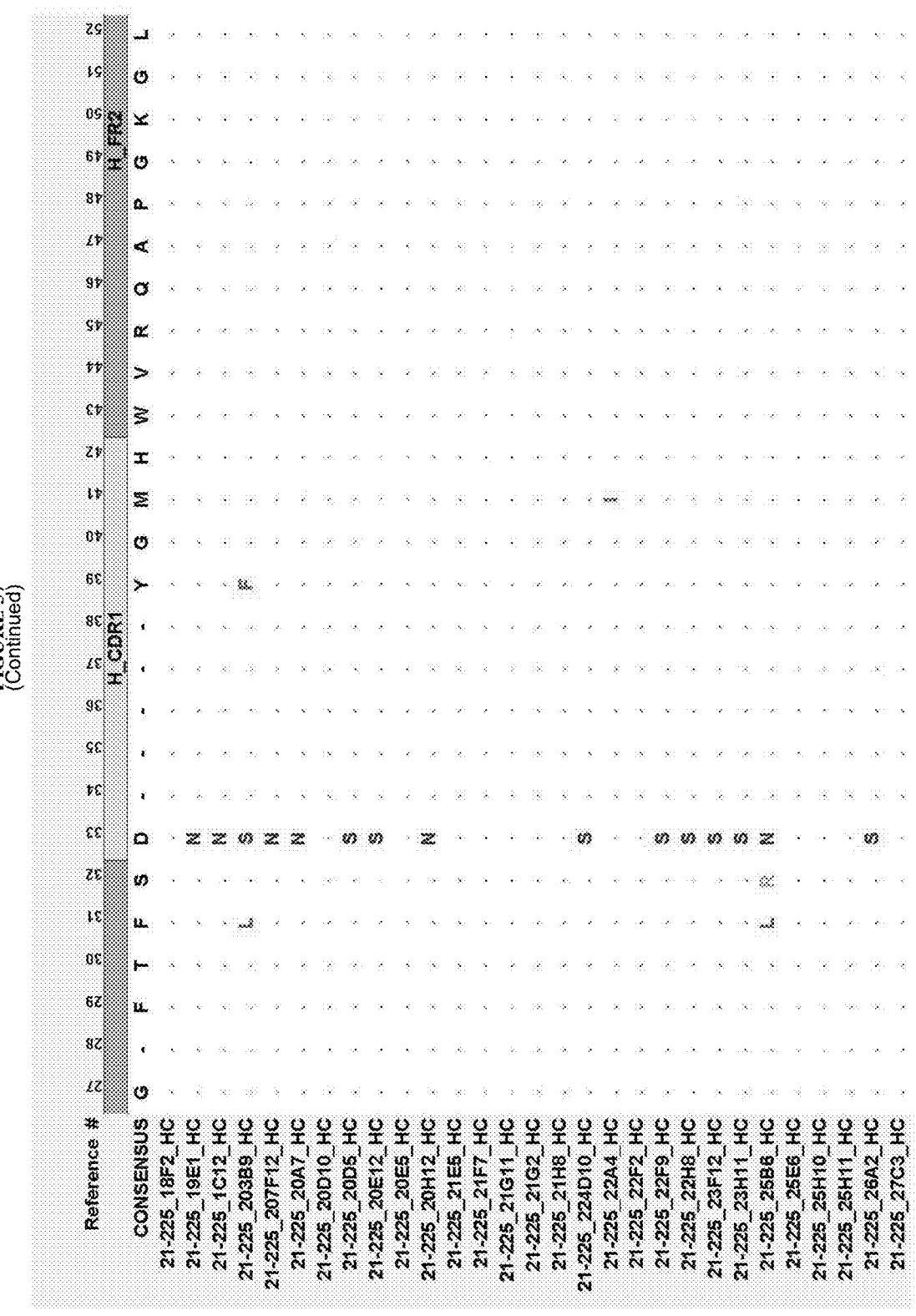
Figure 57:
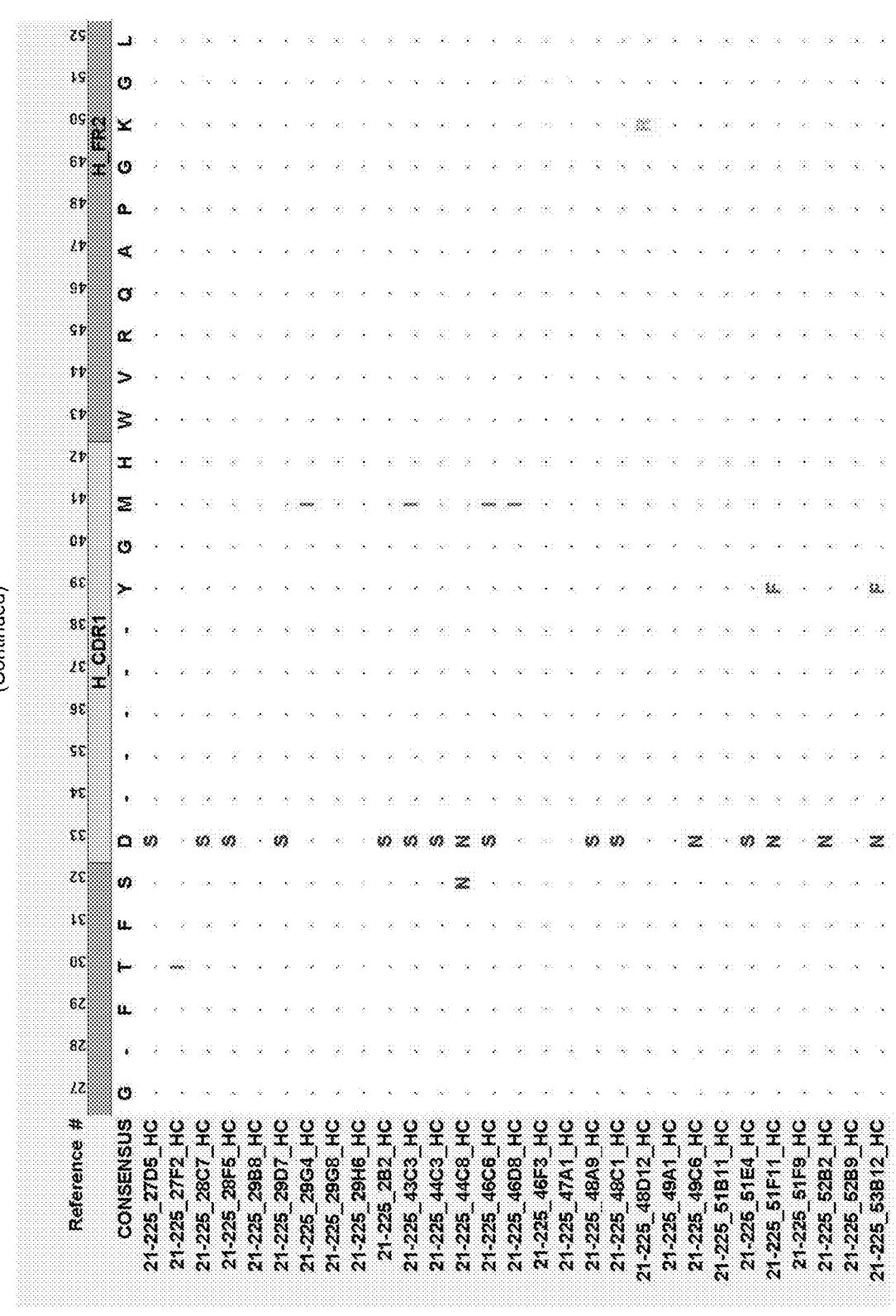
Figure 57:
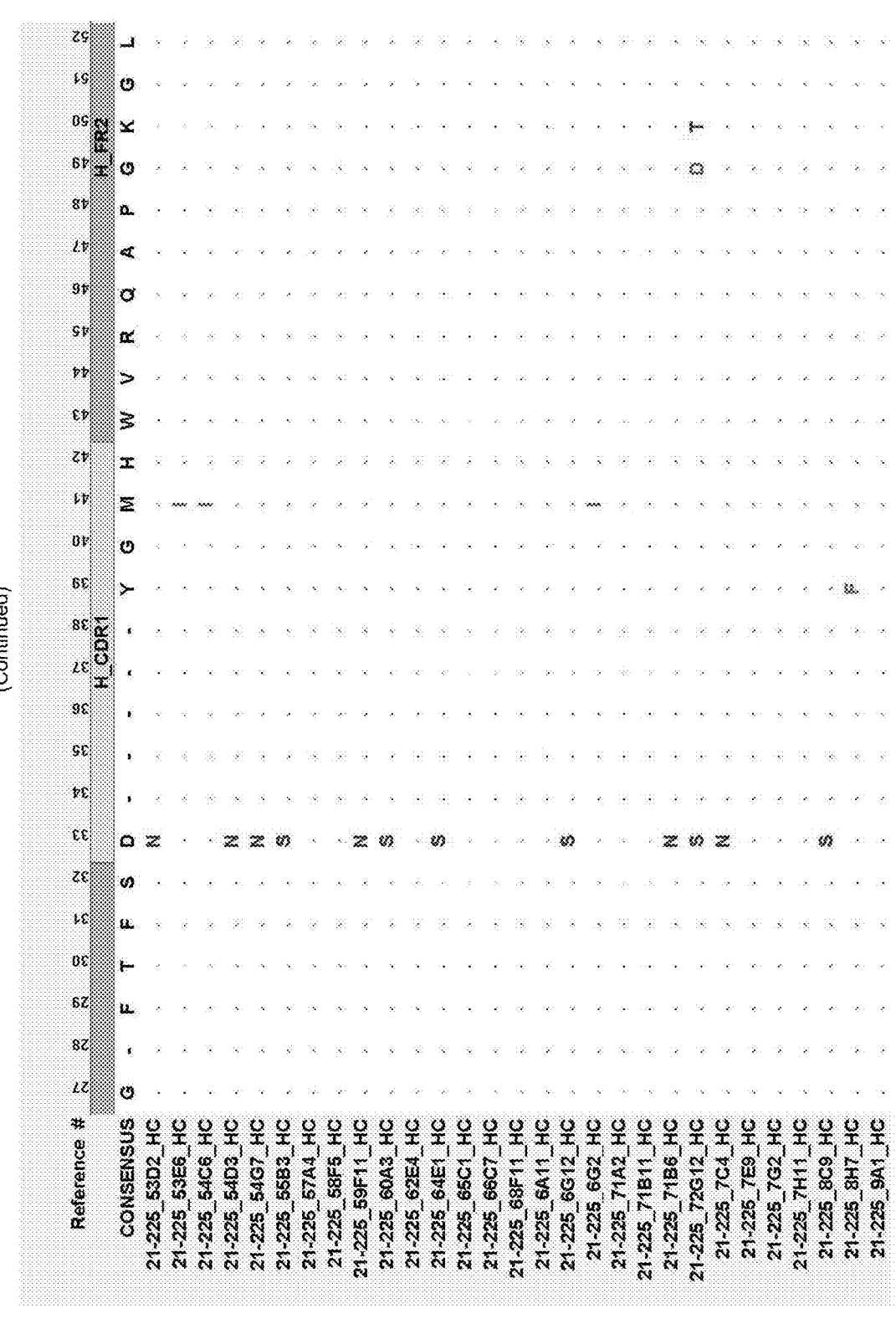
Figure 57:
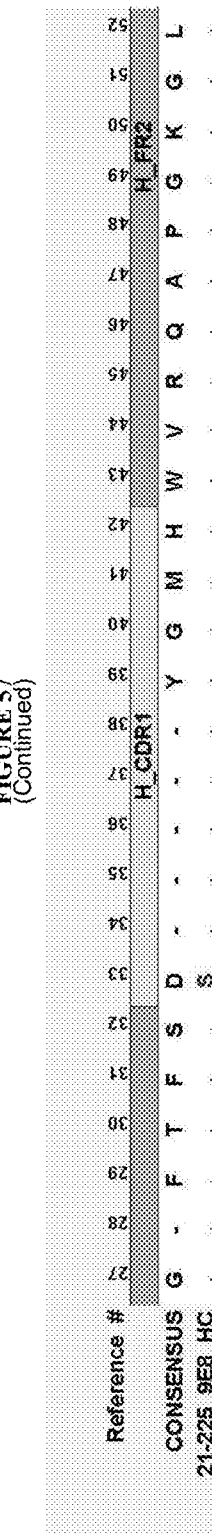
Figure 57:
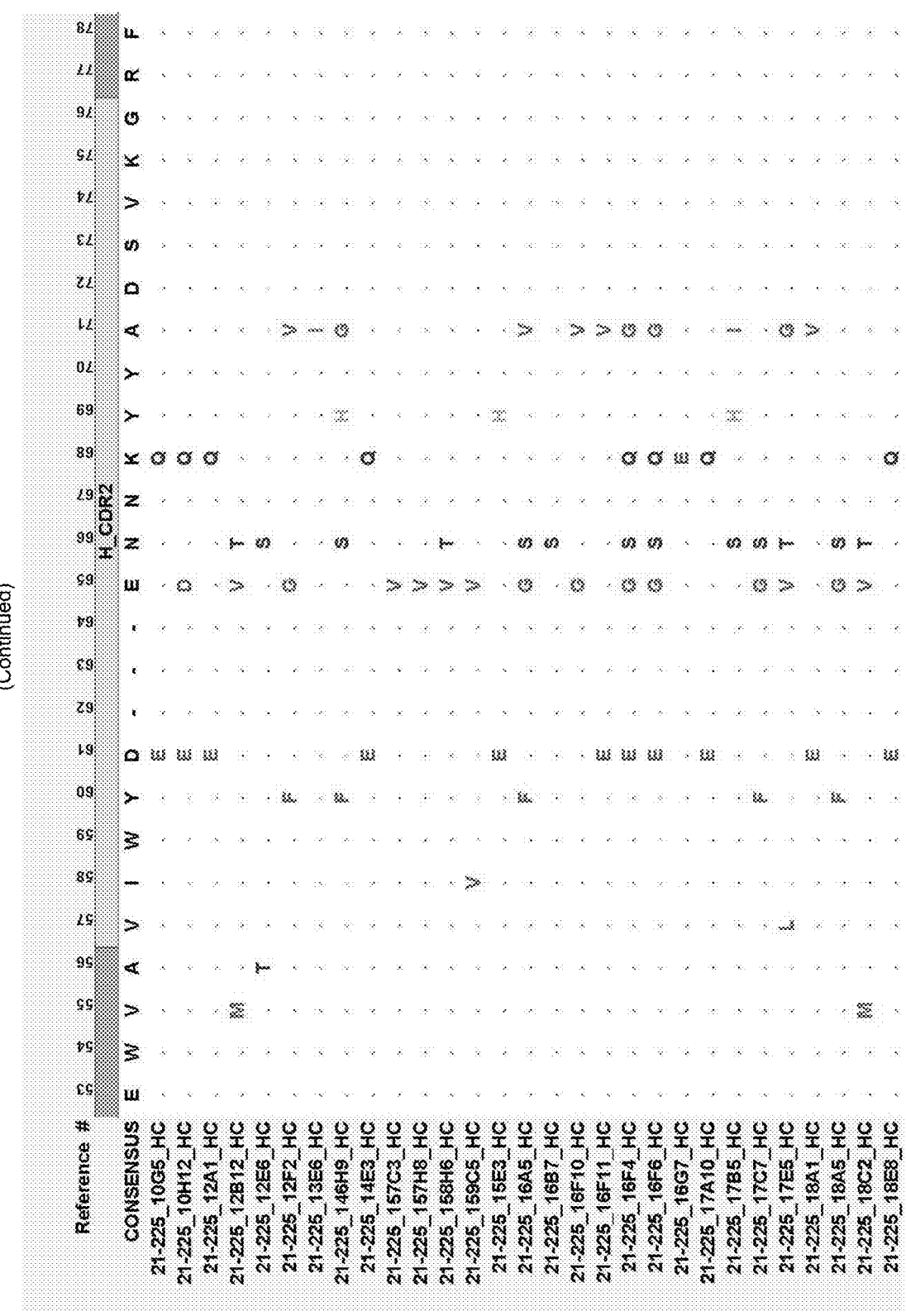
Figure 57:
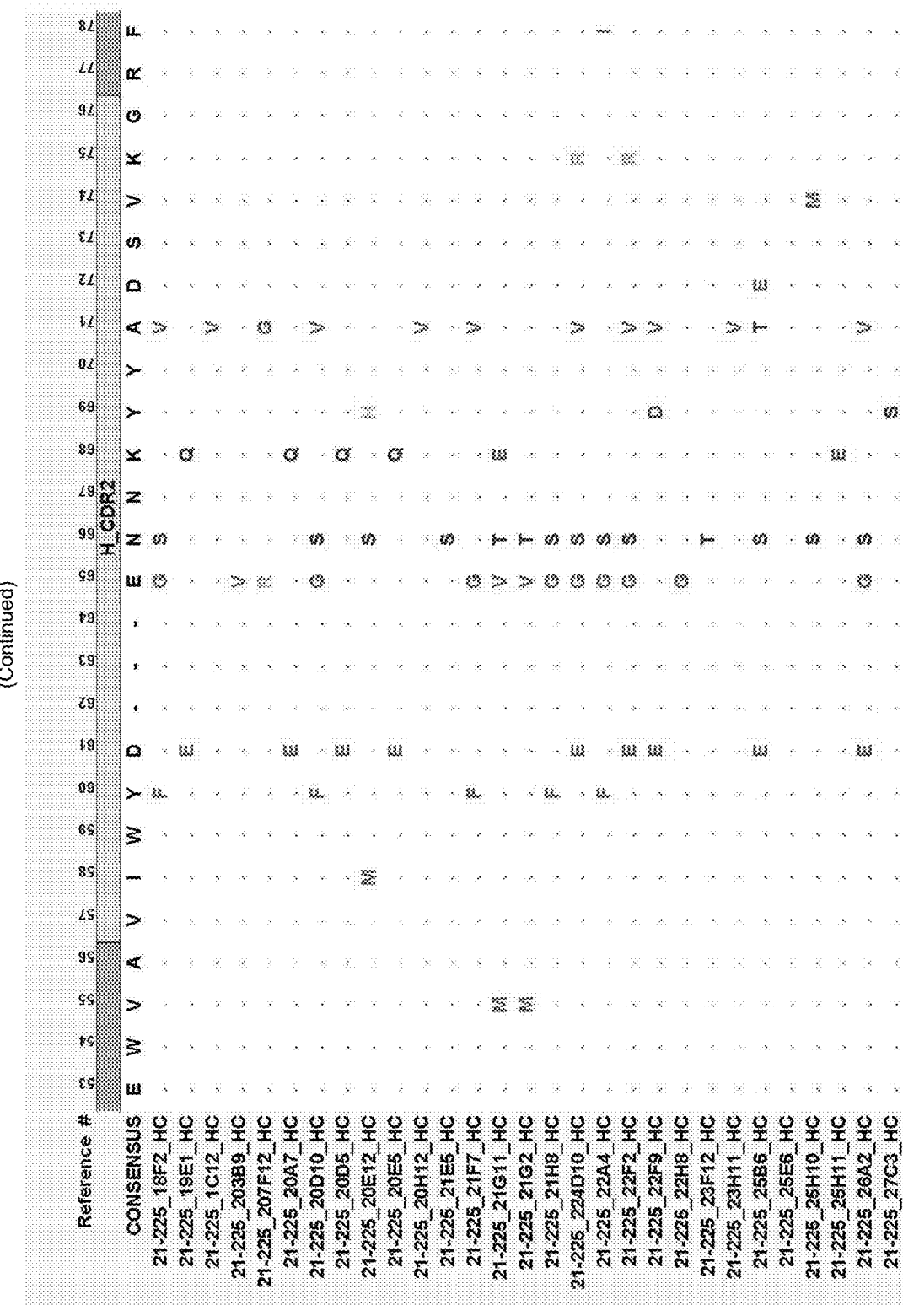
Figure 57:
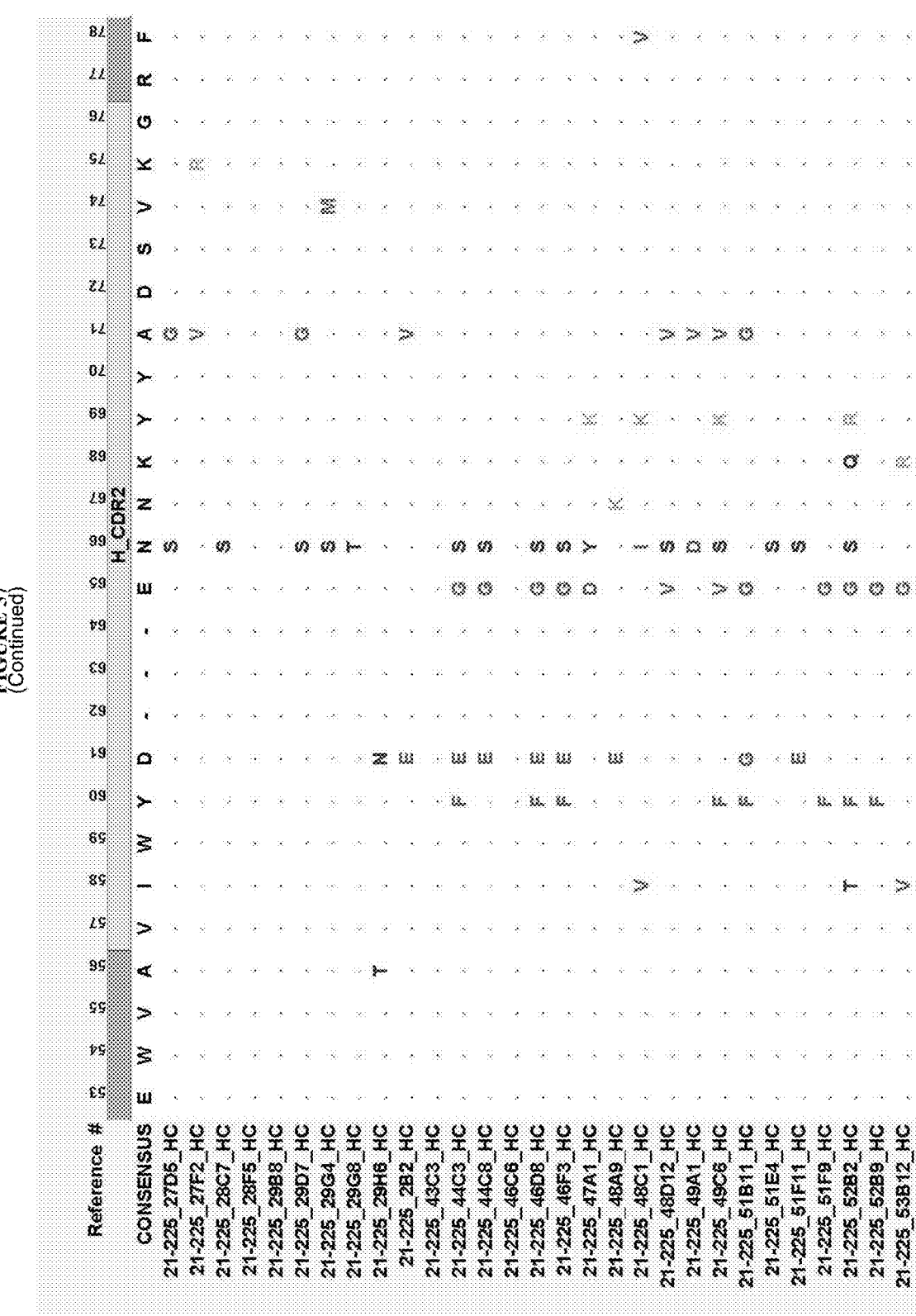
Figure 57:
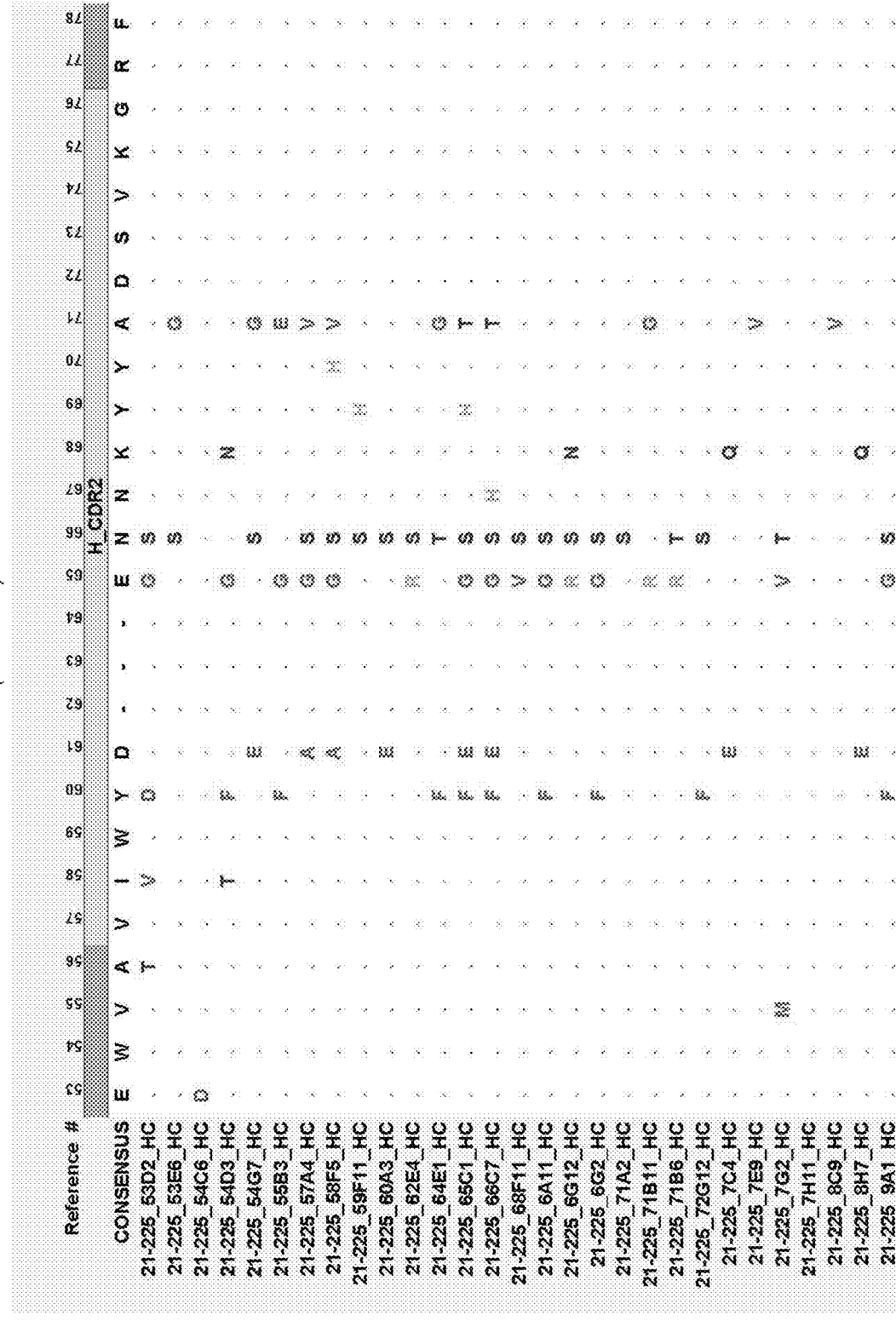
Figure 57:
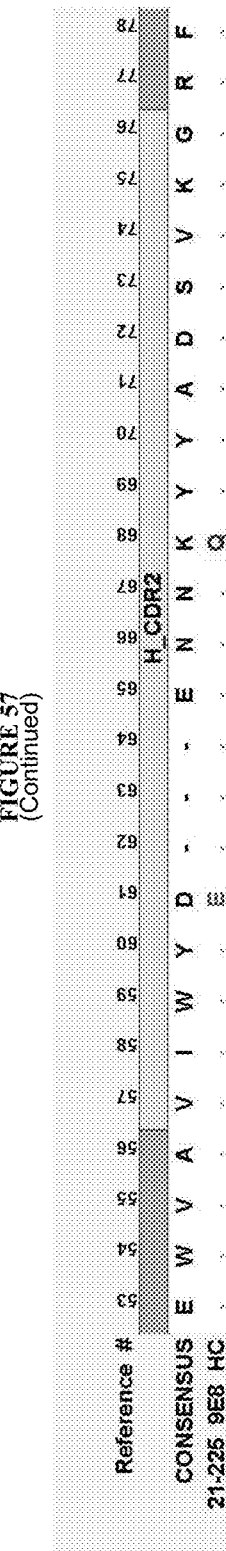
Figure 57:
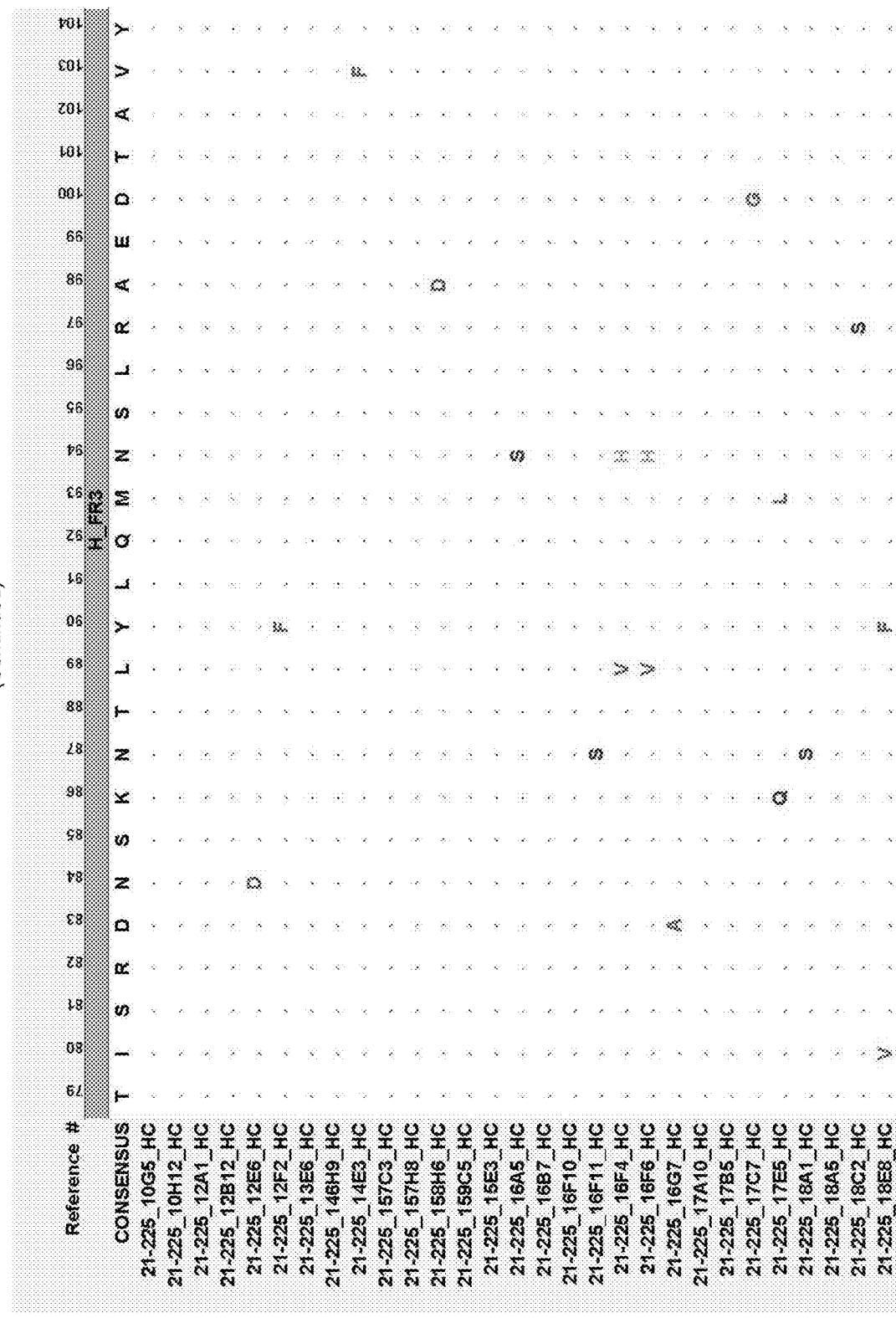
Figure 57:
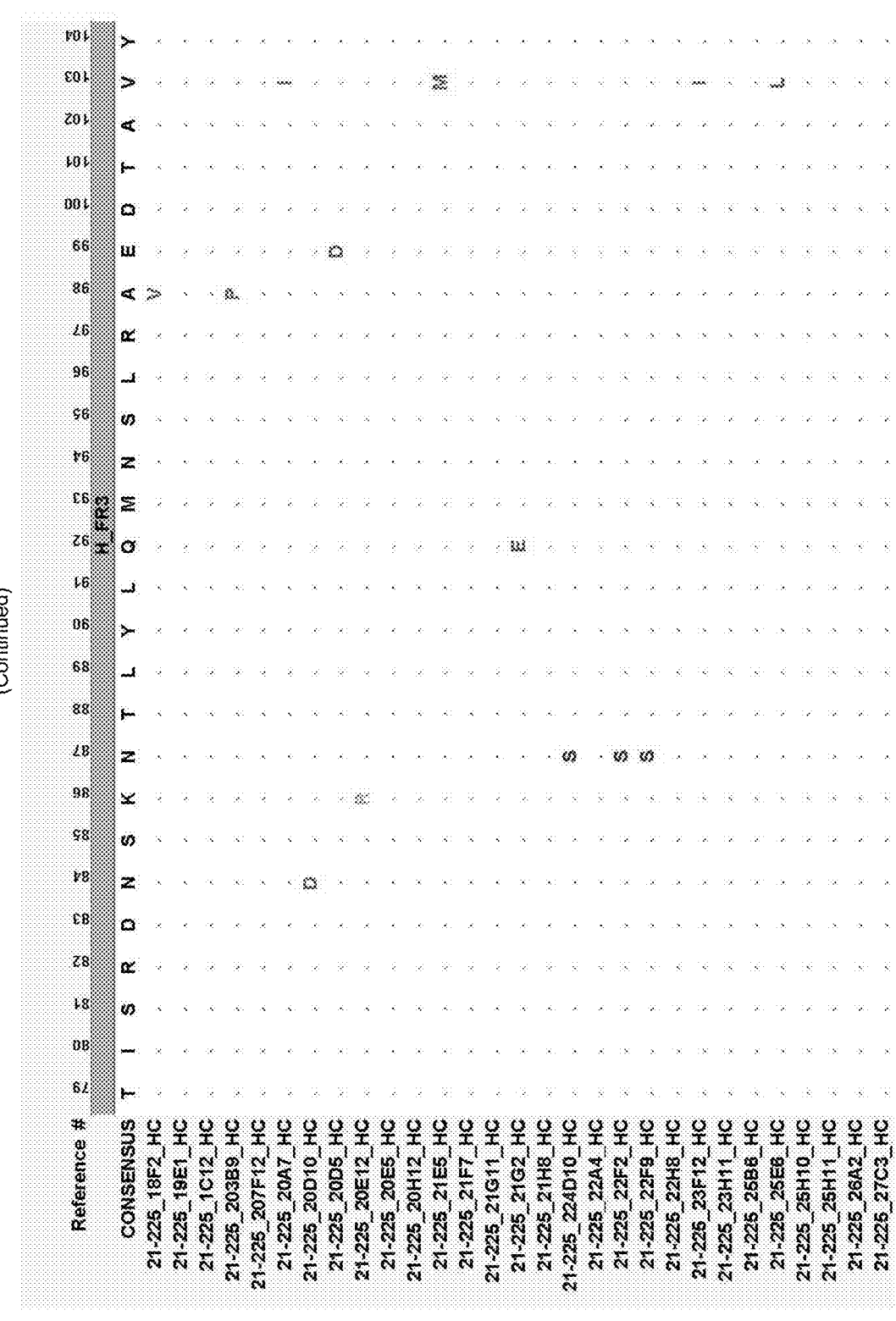
Figure 57:
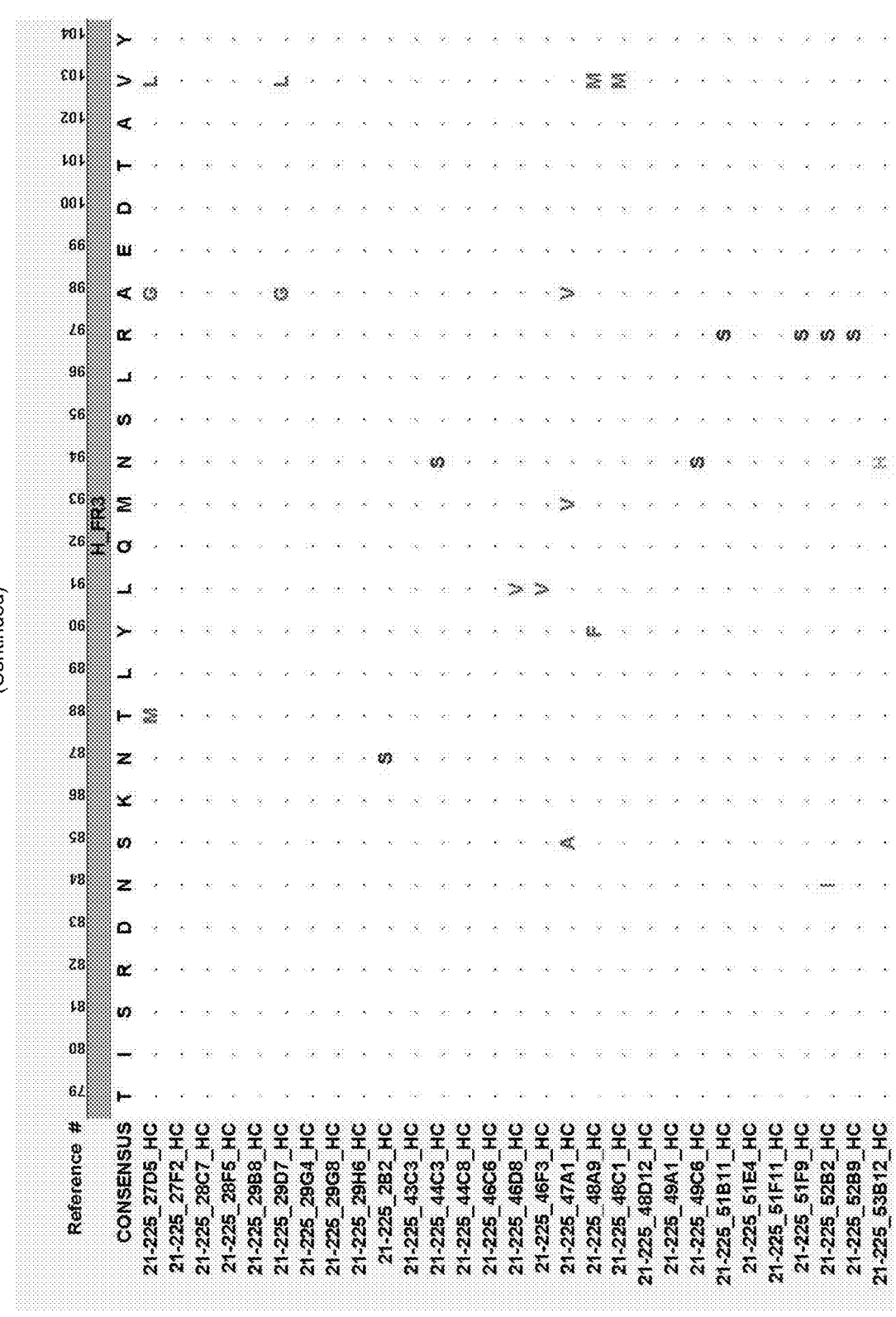
Figure 57:
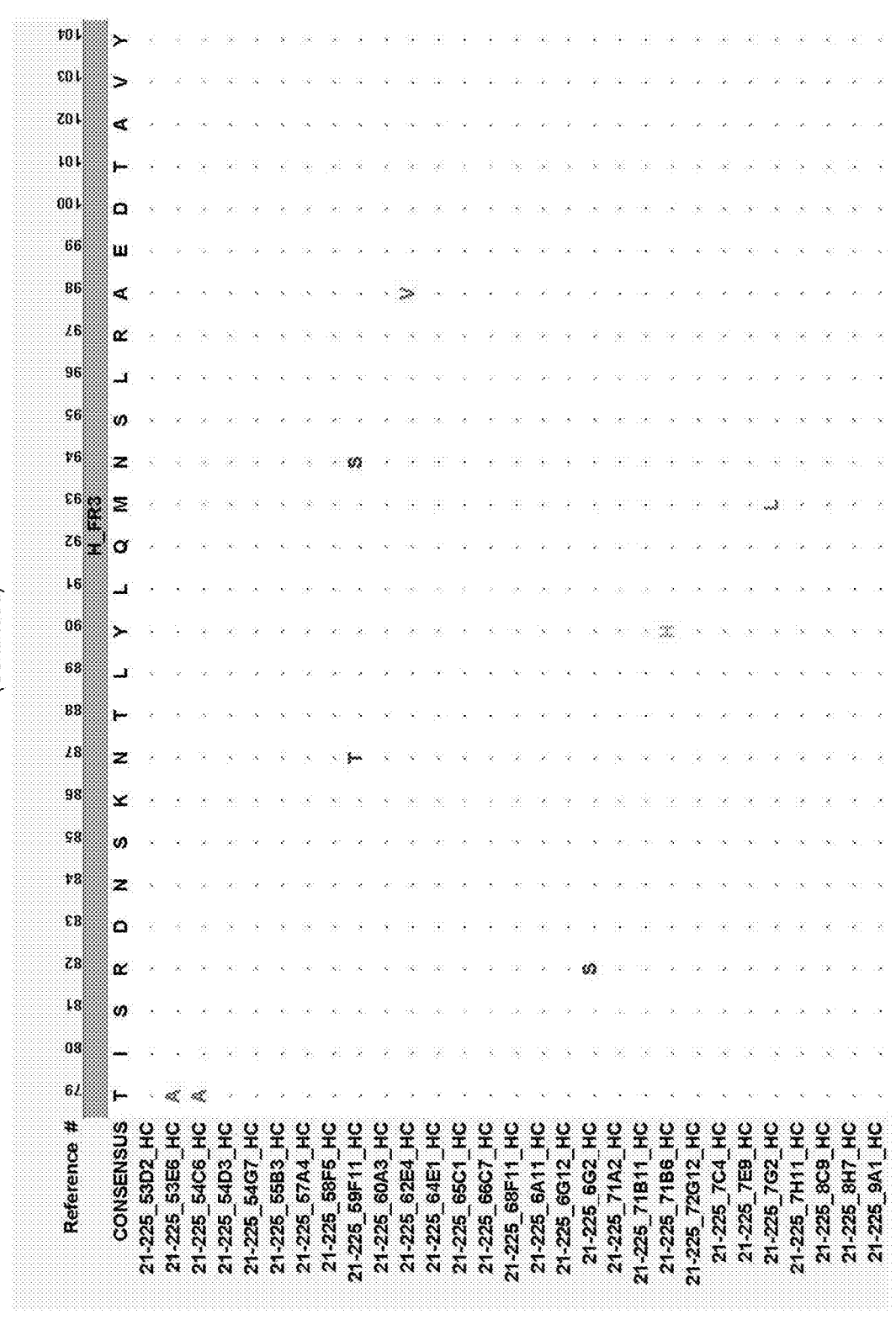
Figure 57:
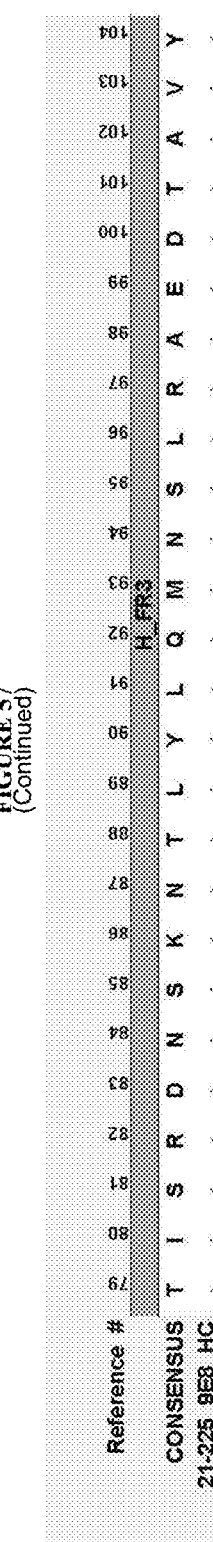
Figure 57:
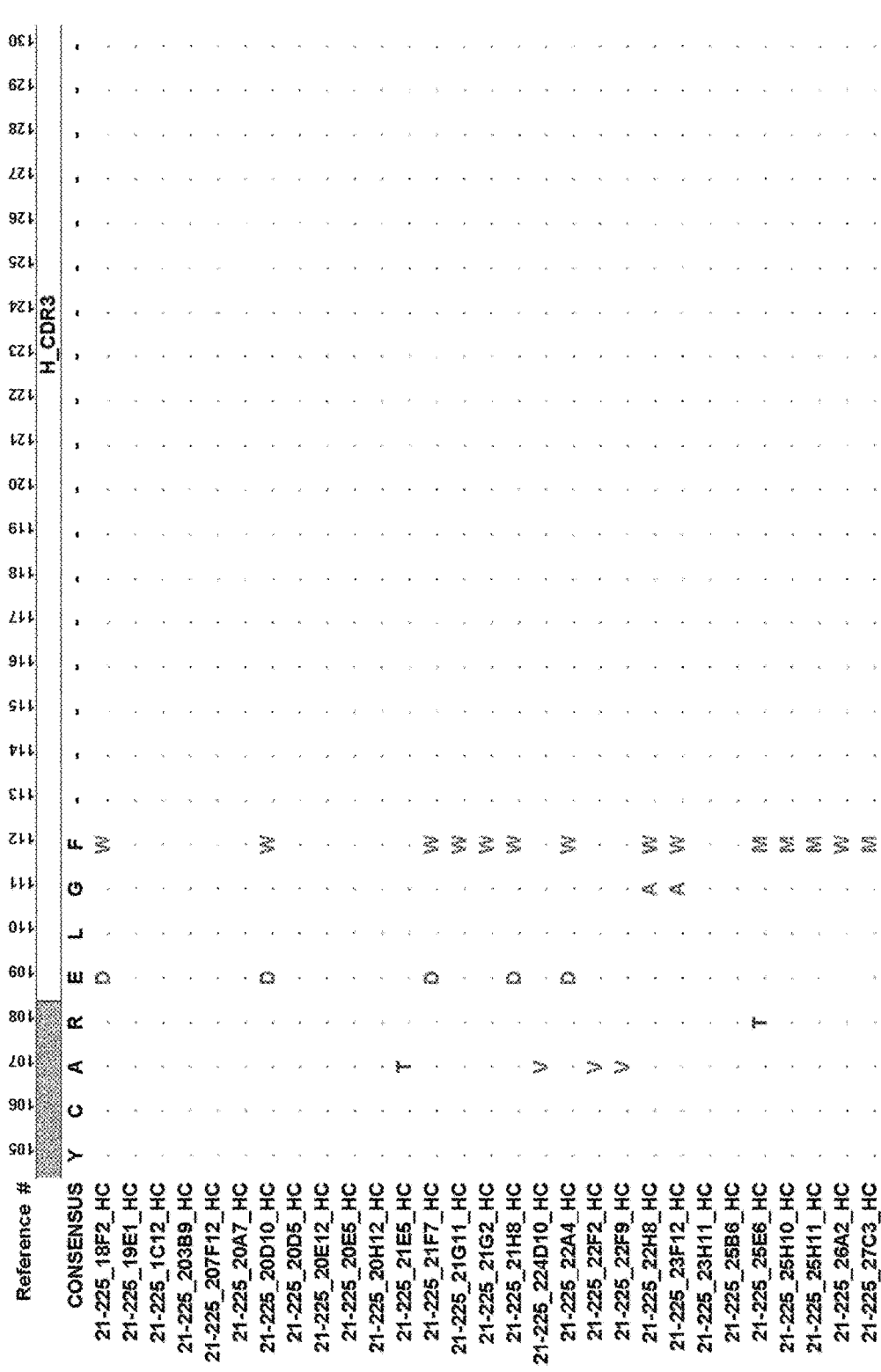
Figure 57:
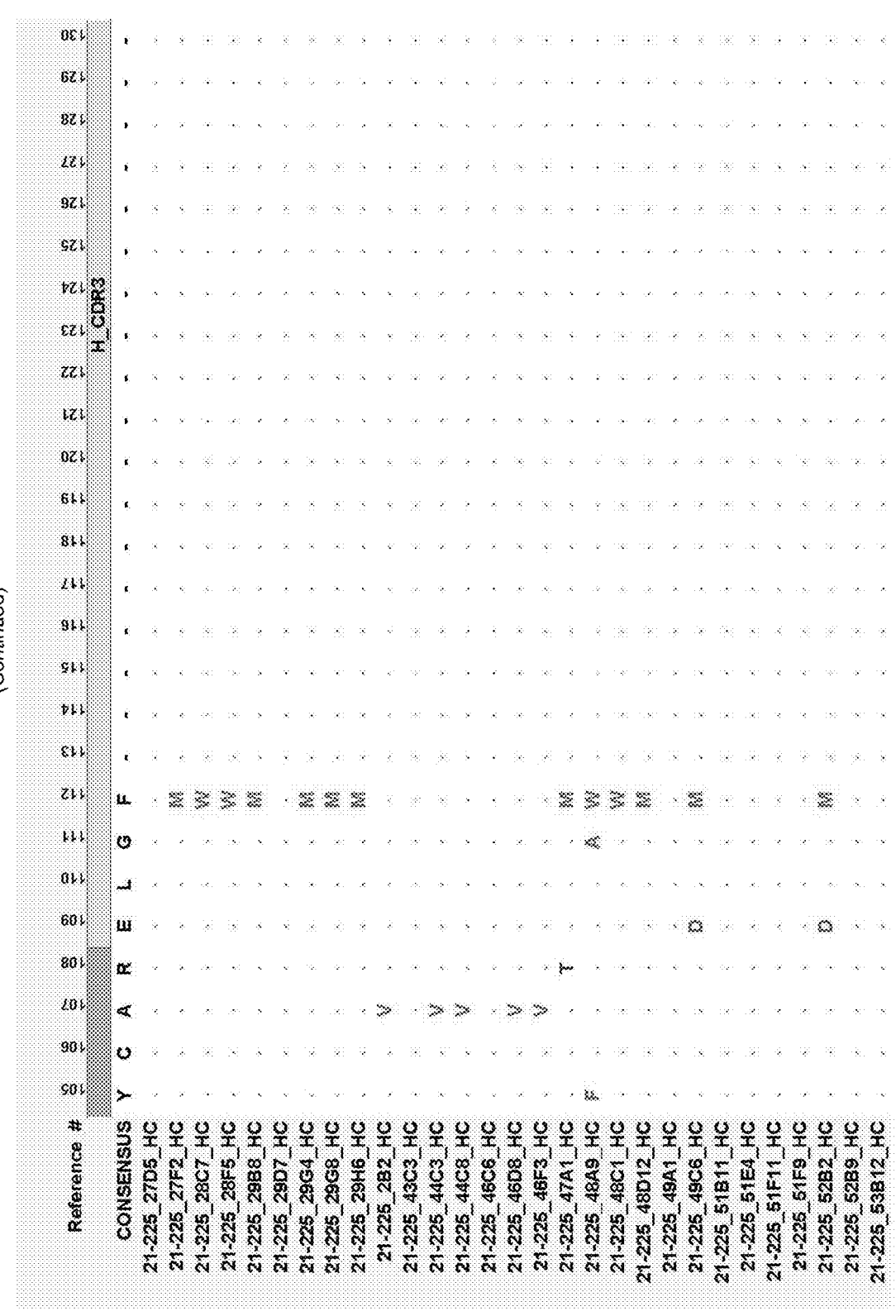
Figure 57:
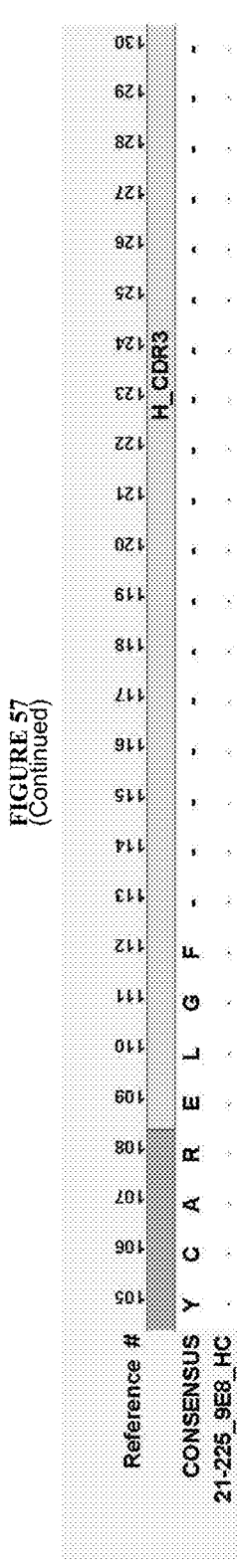
Figure 57:
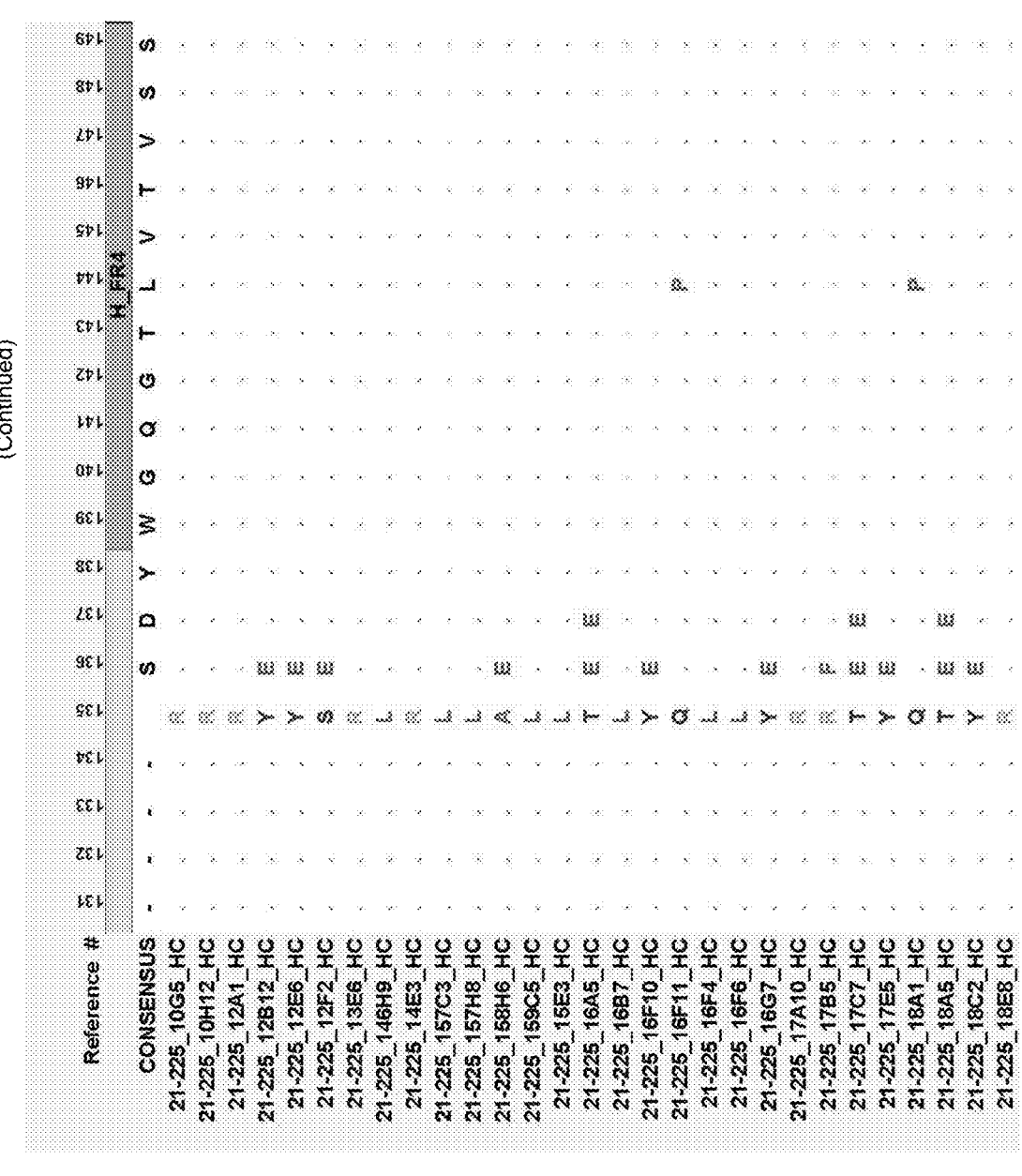
Figure 57:
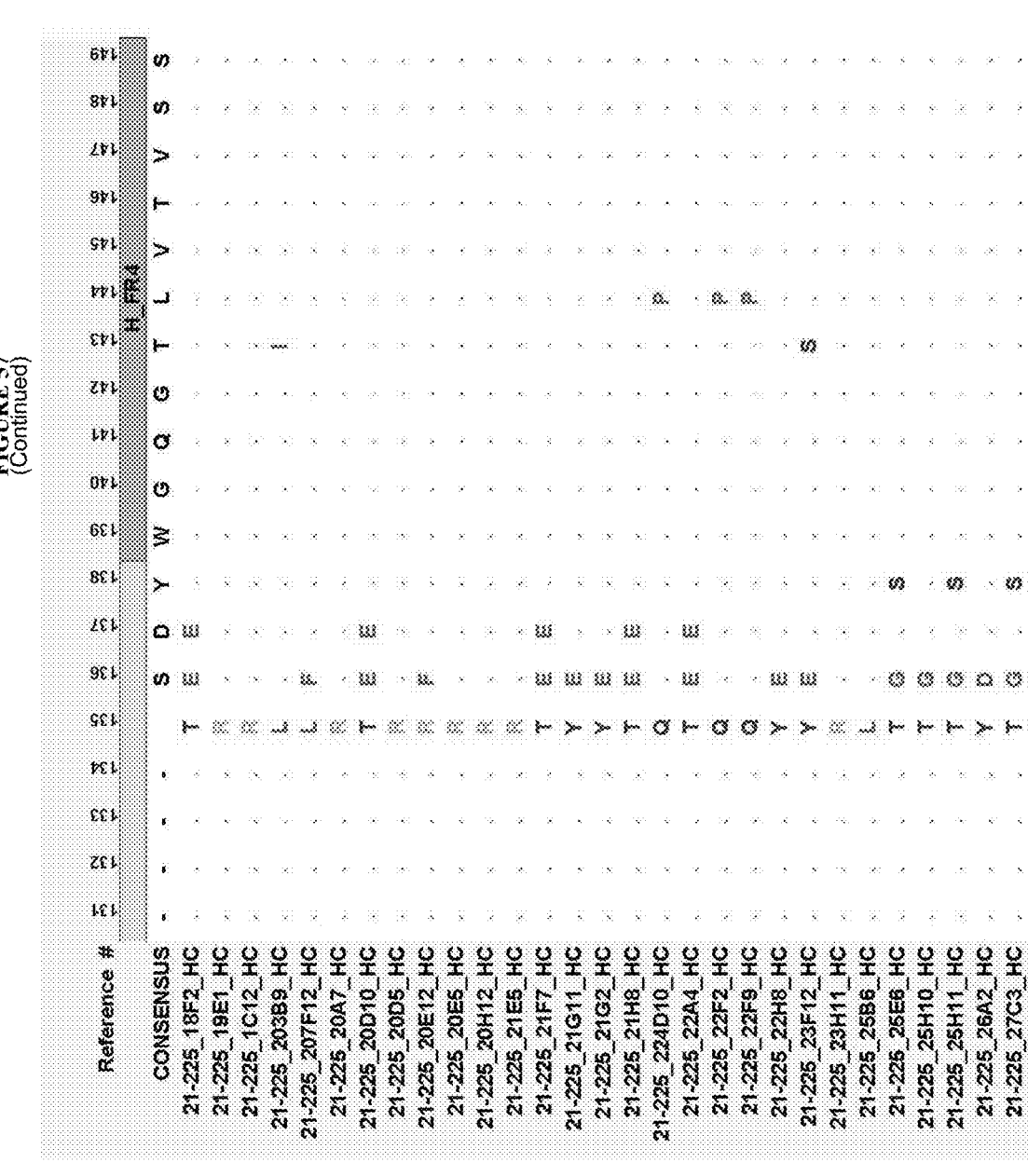
Figure 57:
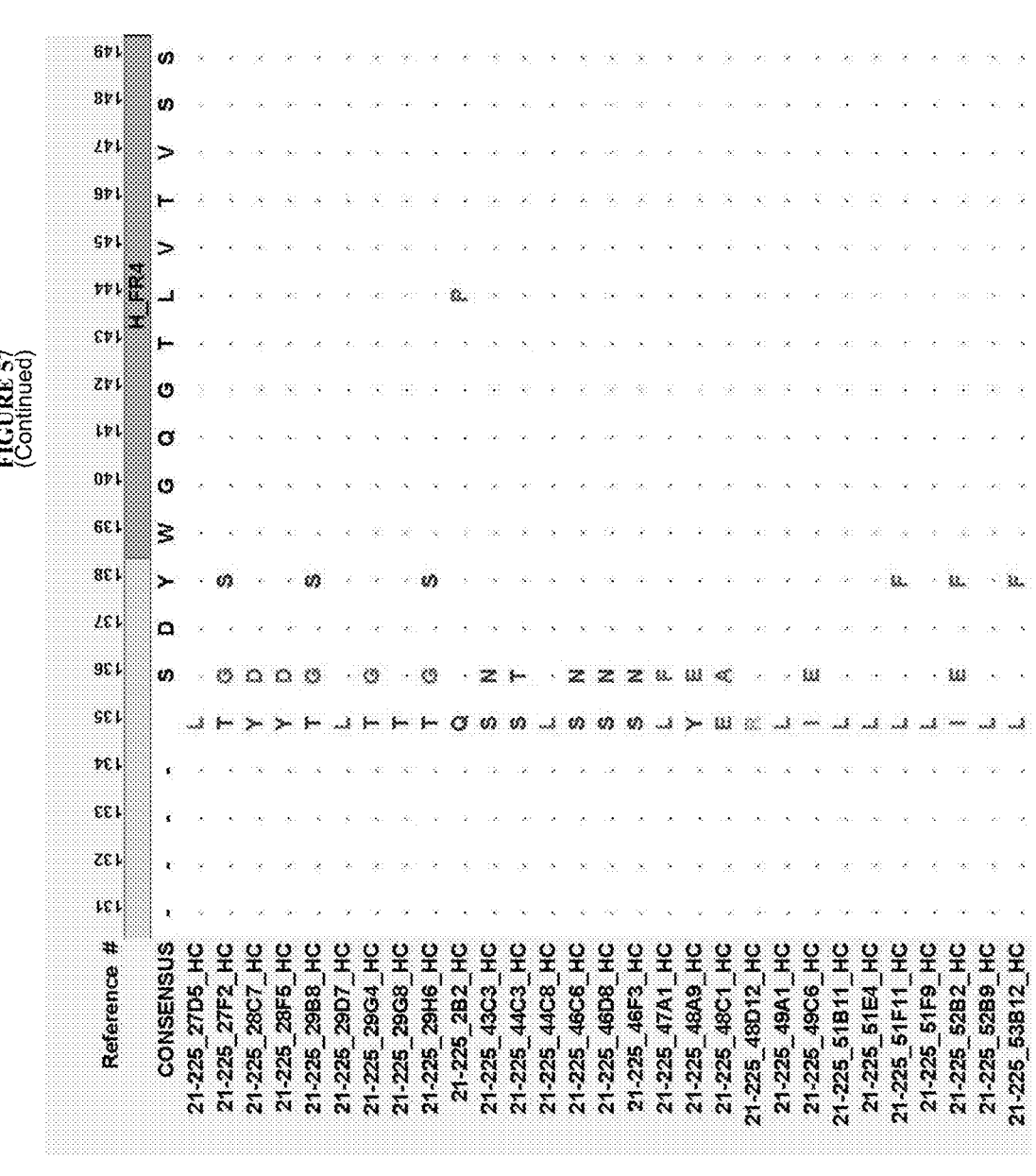
Figure 57:
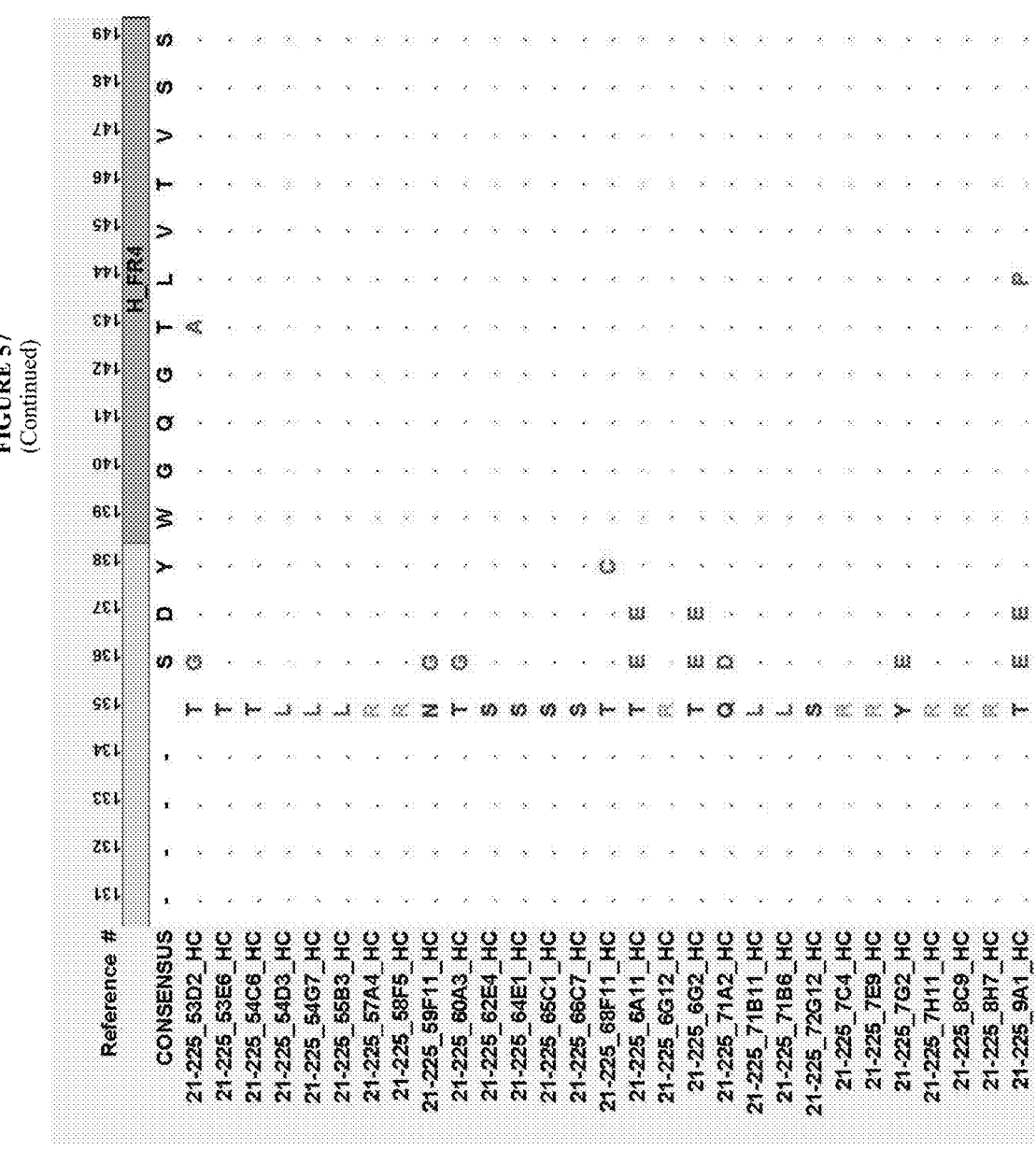
Figure 57:
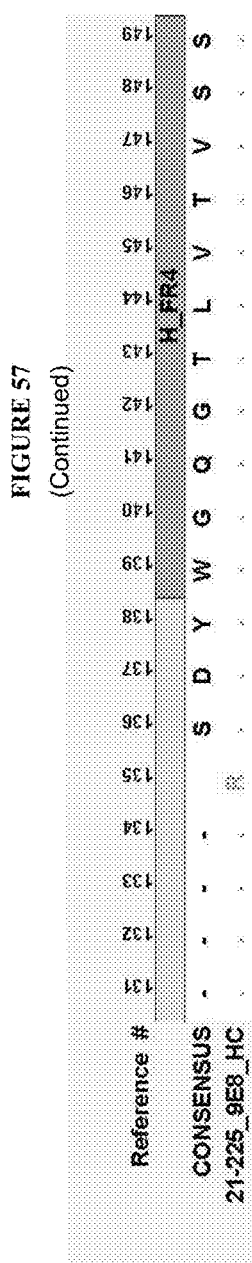
Figure 57:
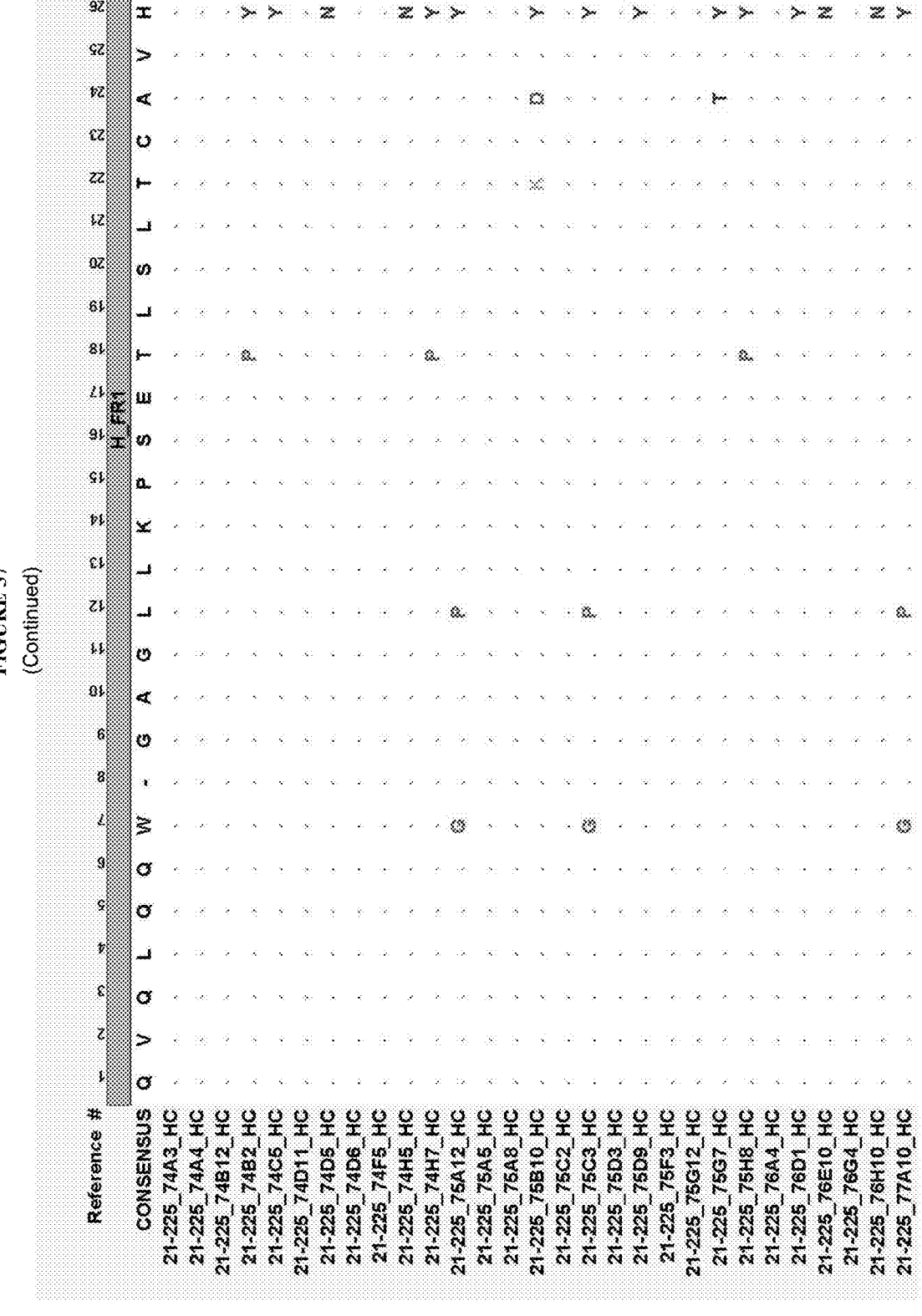
Figure 57:
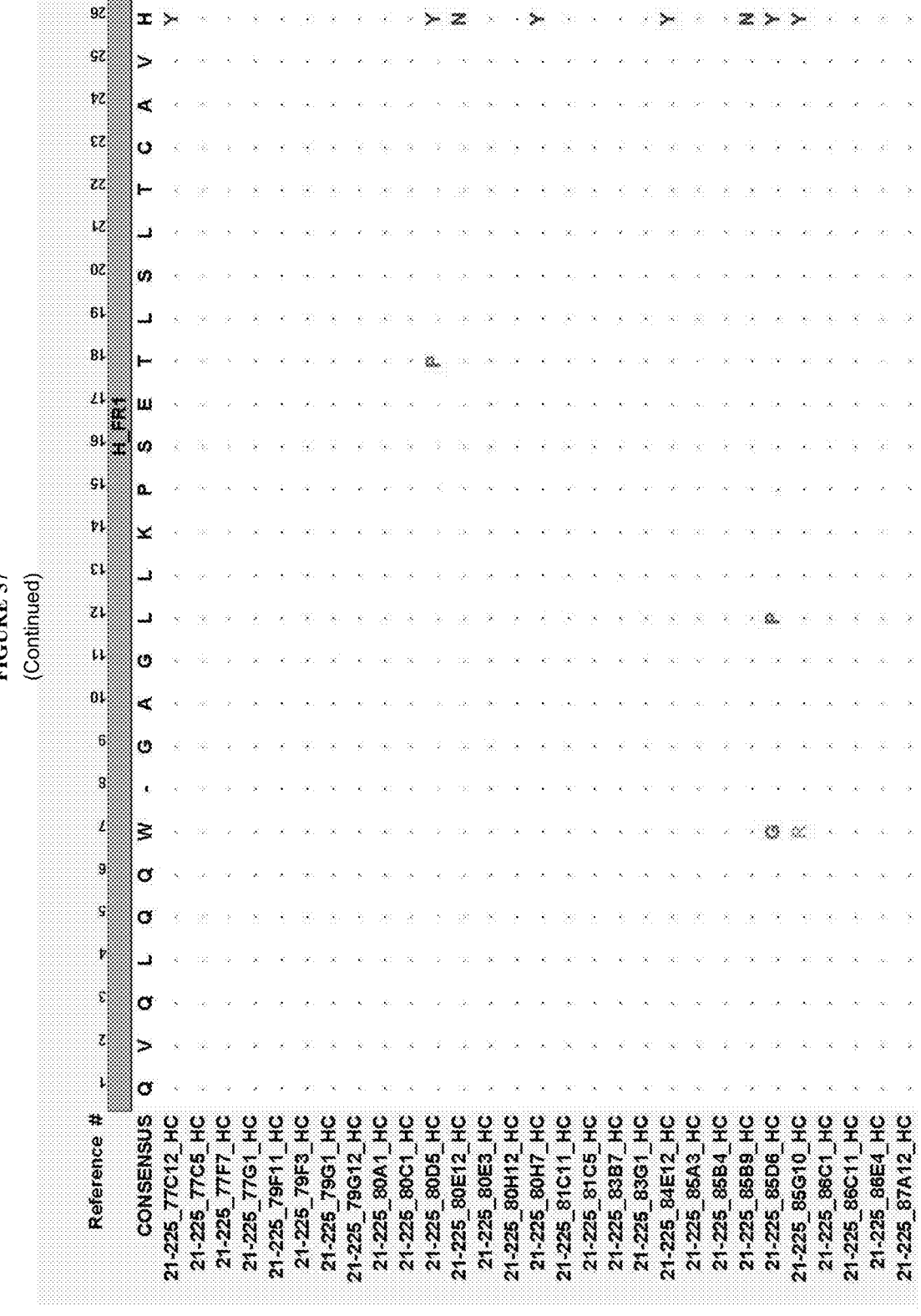
Figure 57:
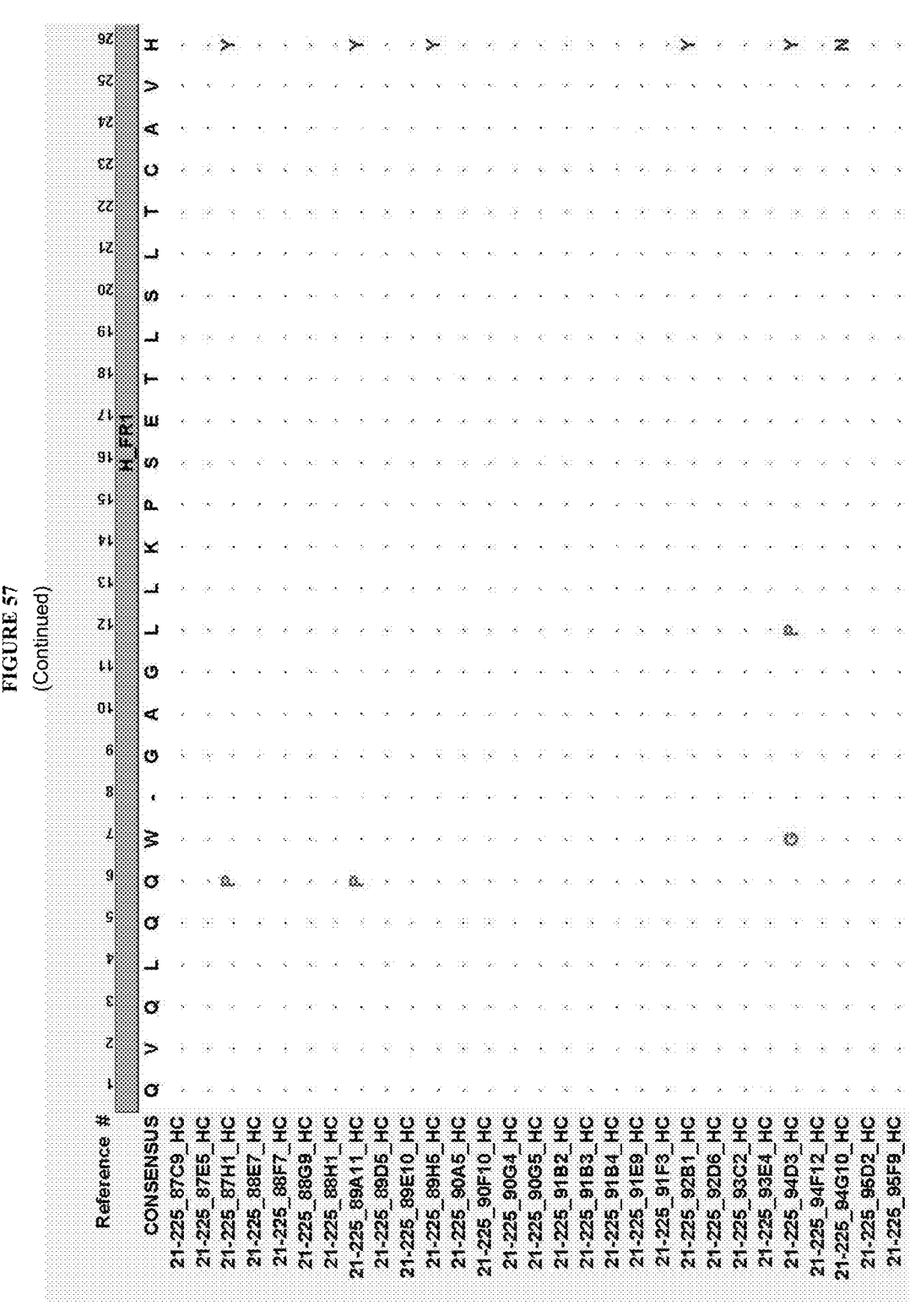
Figure 57:
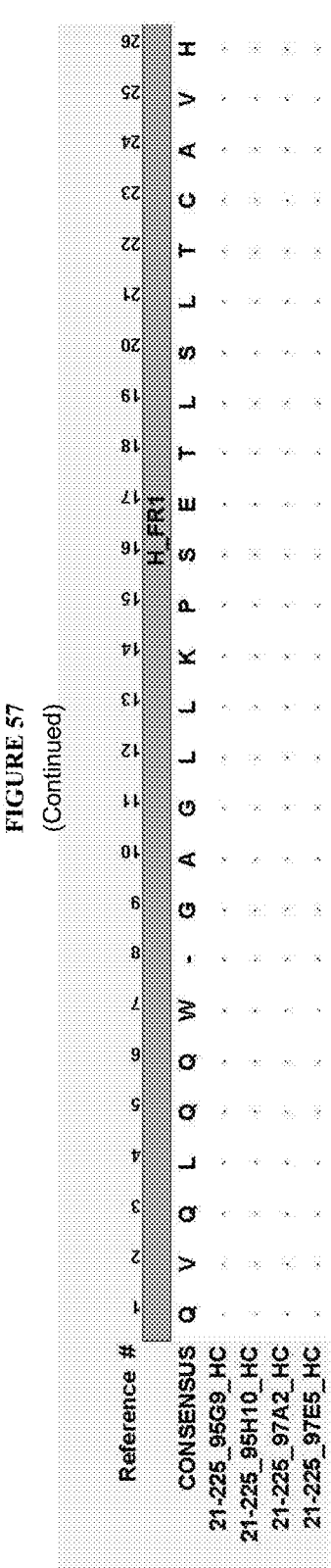
Figure 57:
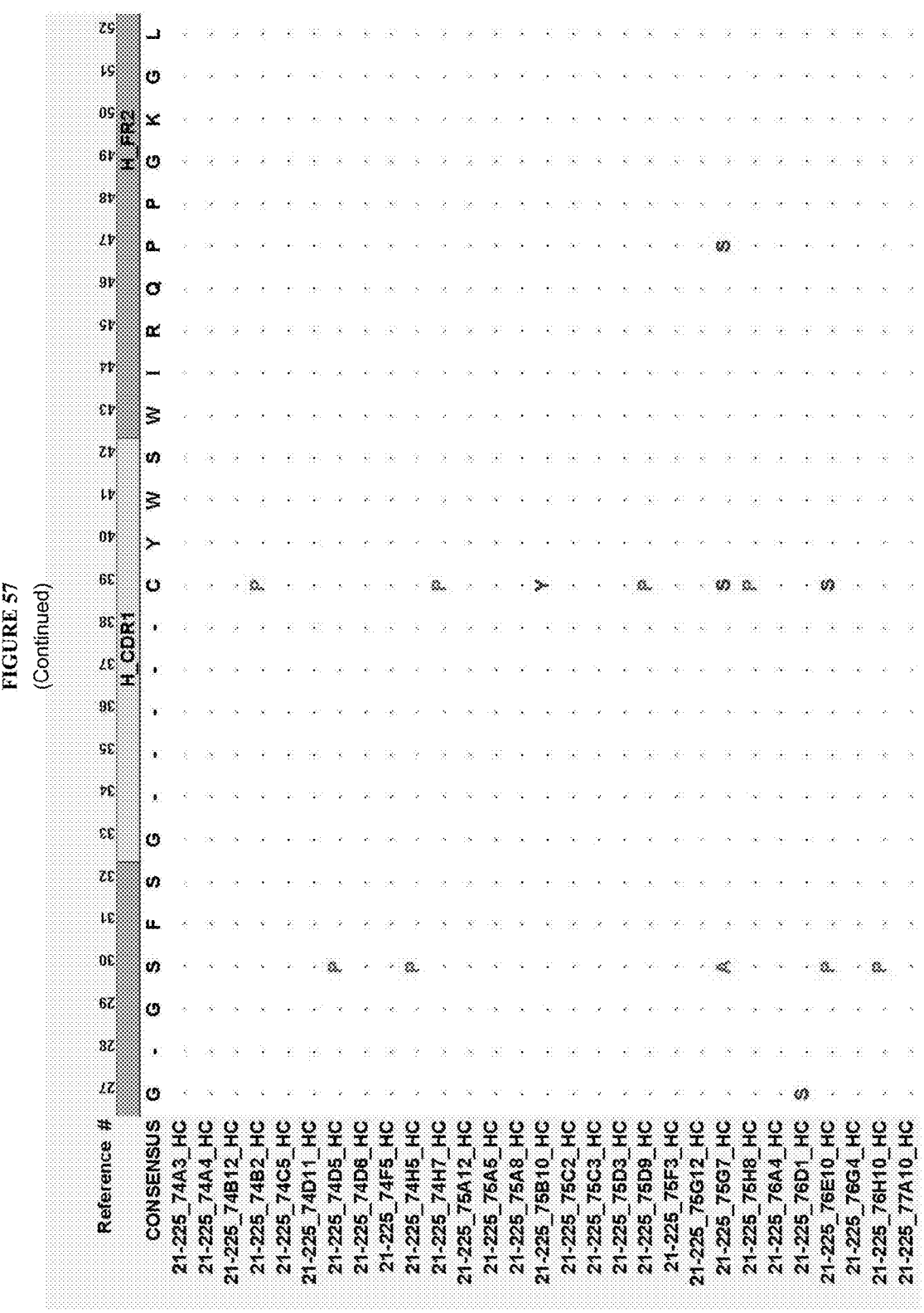
Figure 57:
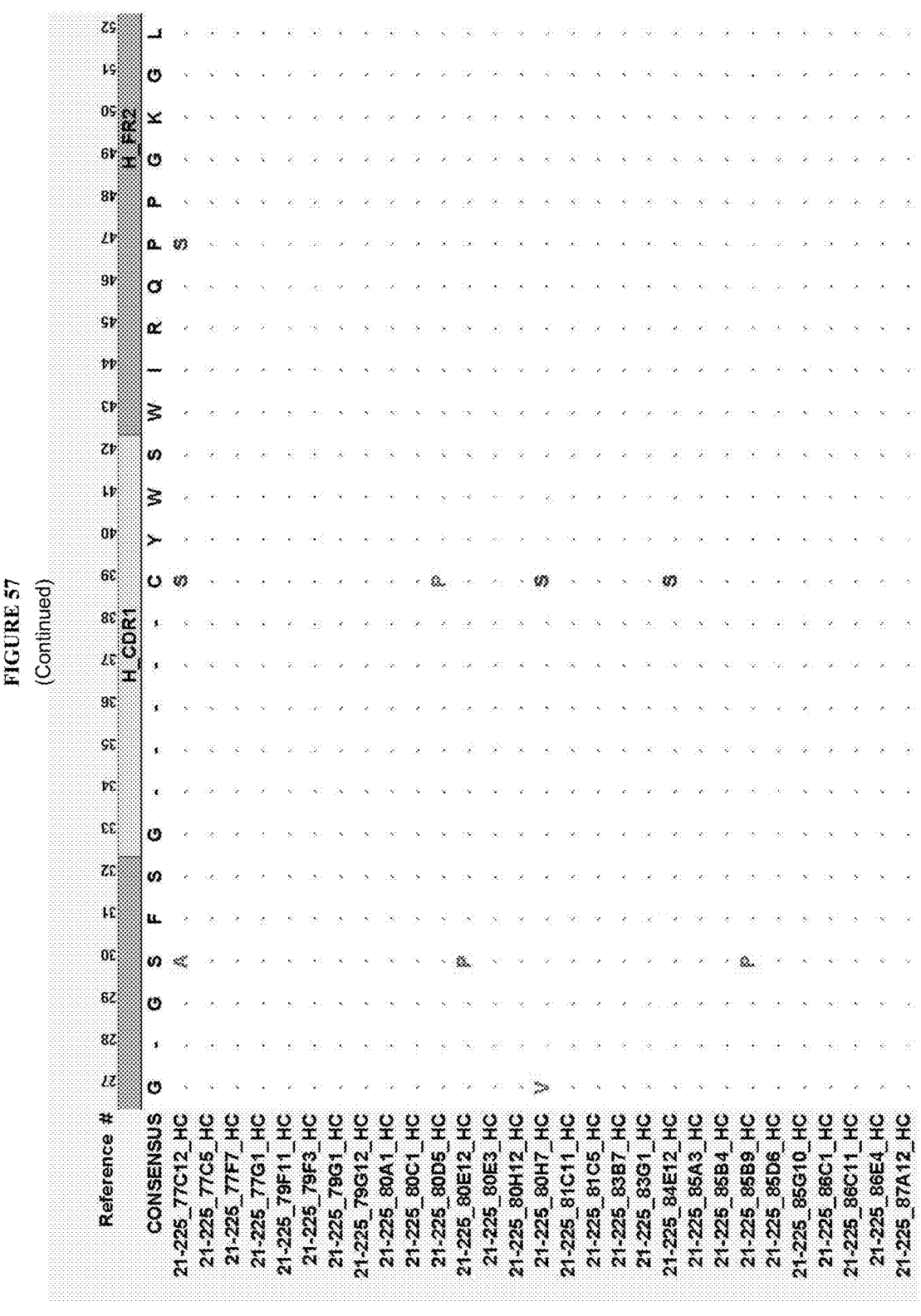
Figure 57:
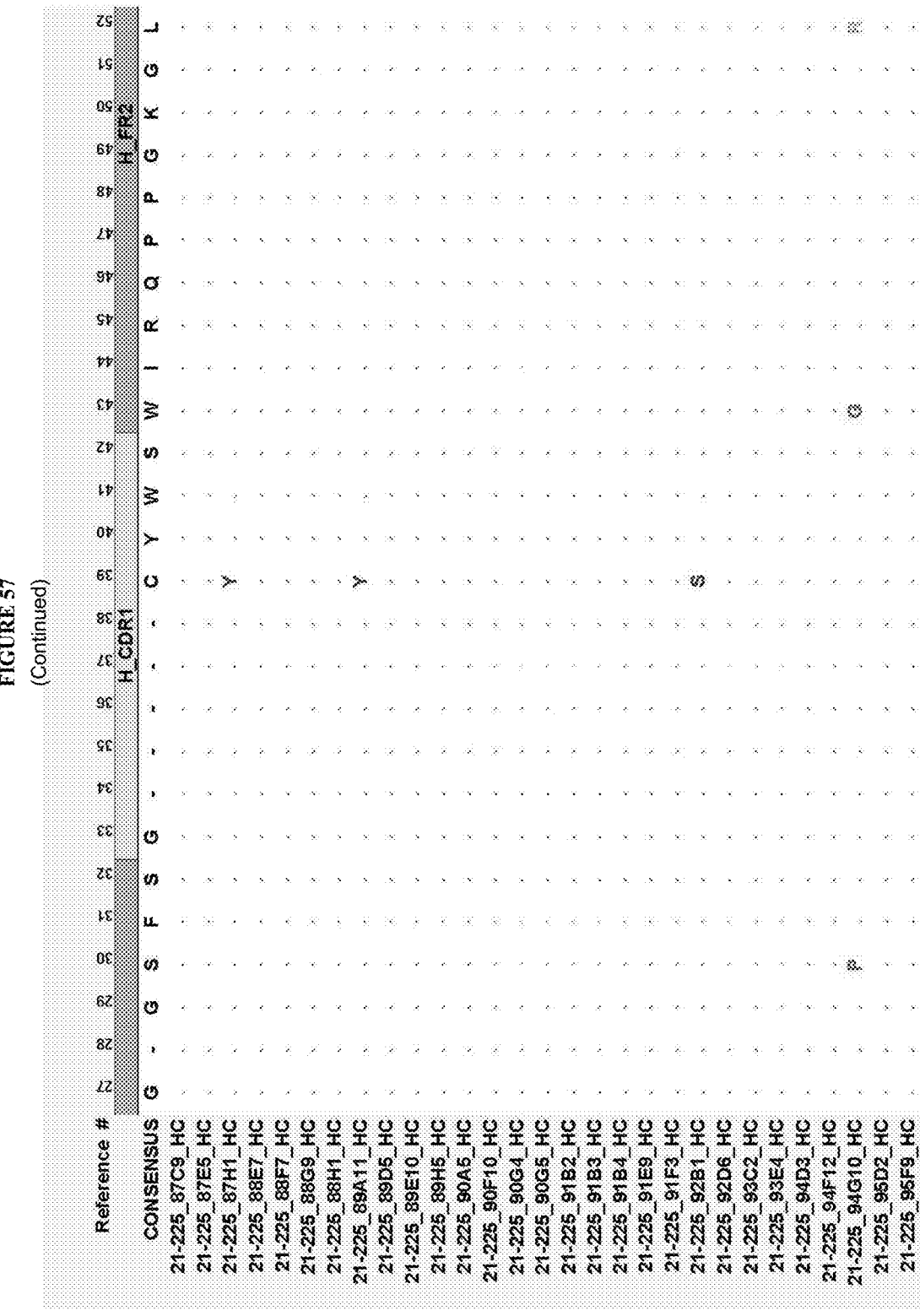
Figure 57:
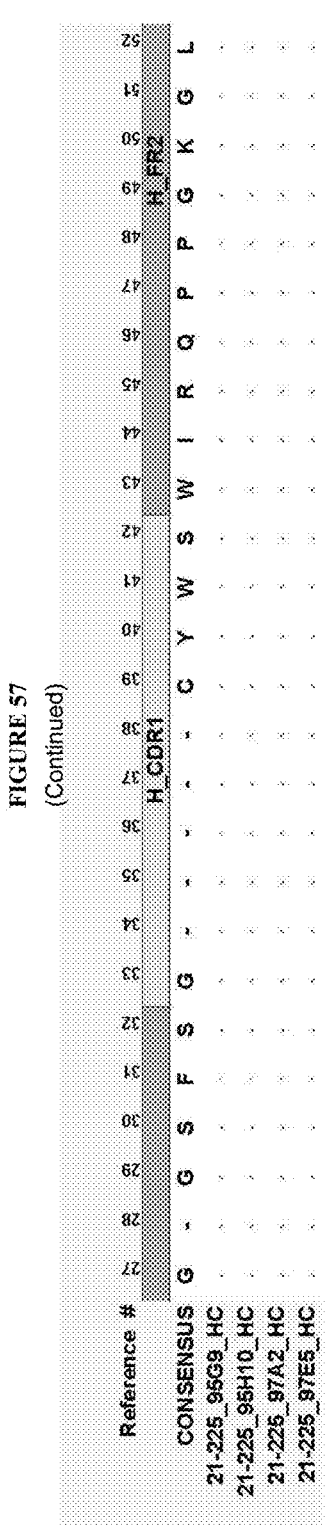
Figure 57:
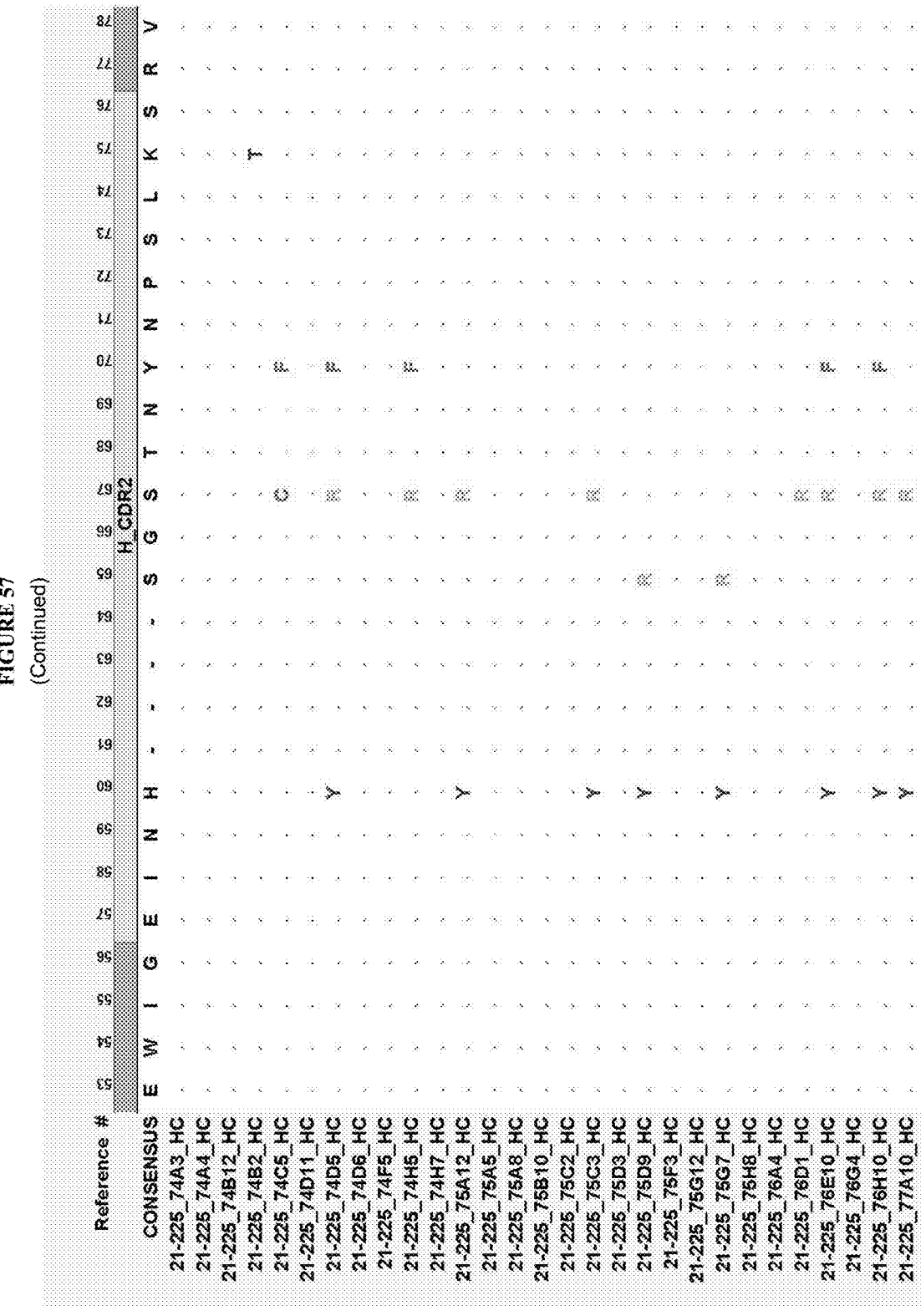
Figure 57:
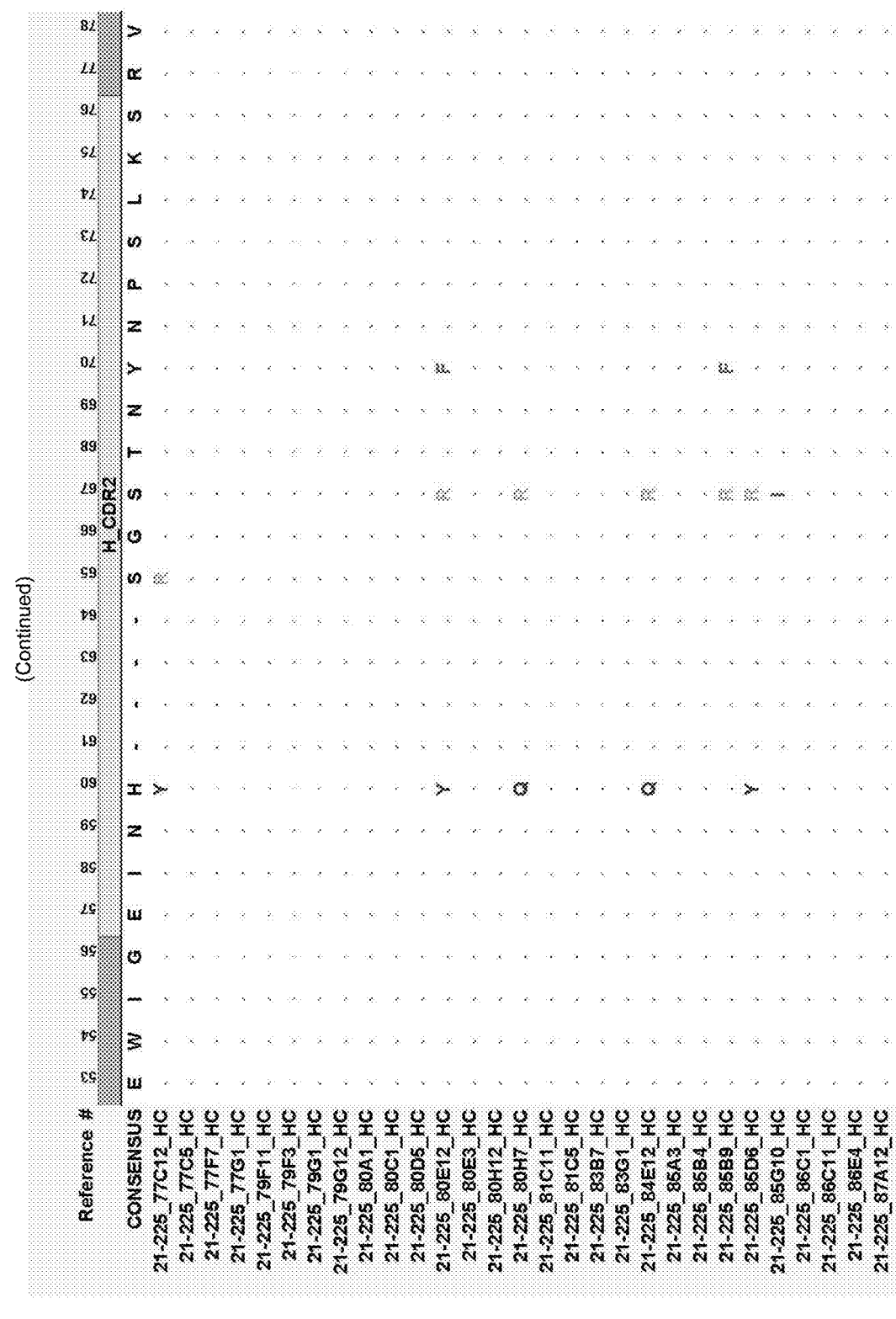
Figure 57:
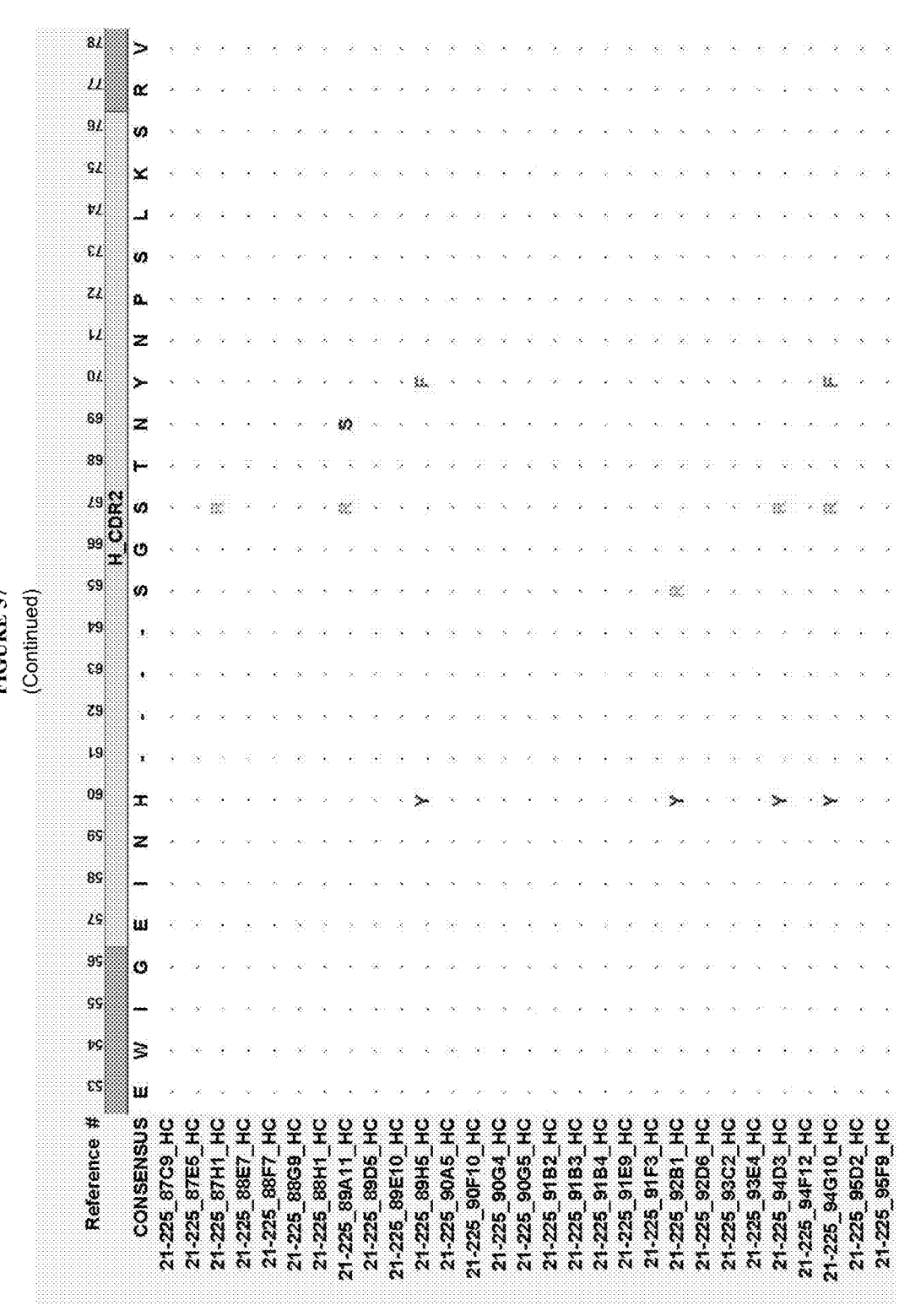
Figure 57:
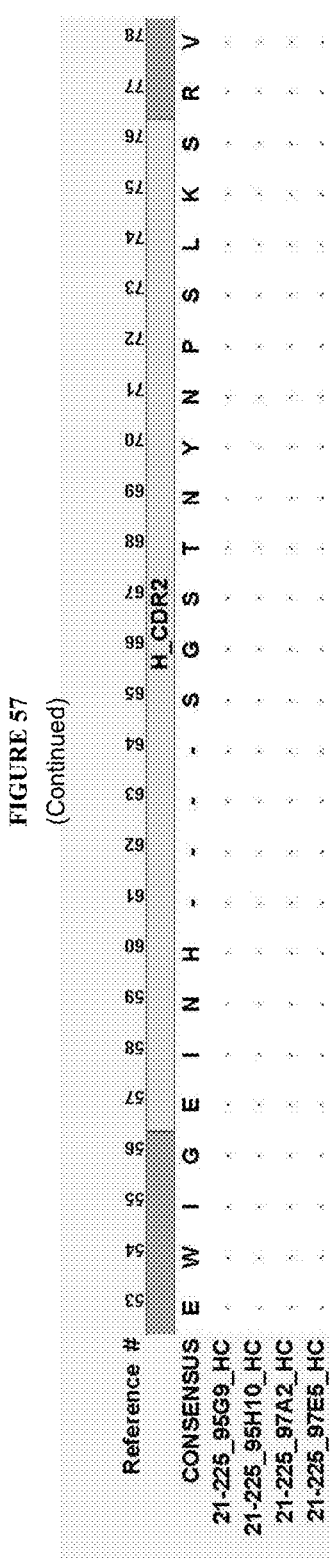
Figure 57:
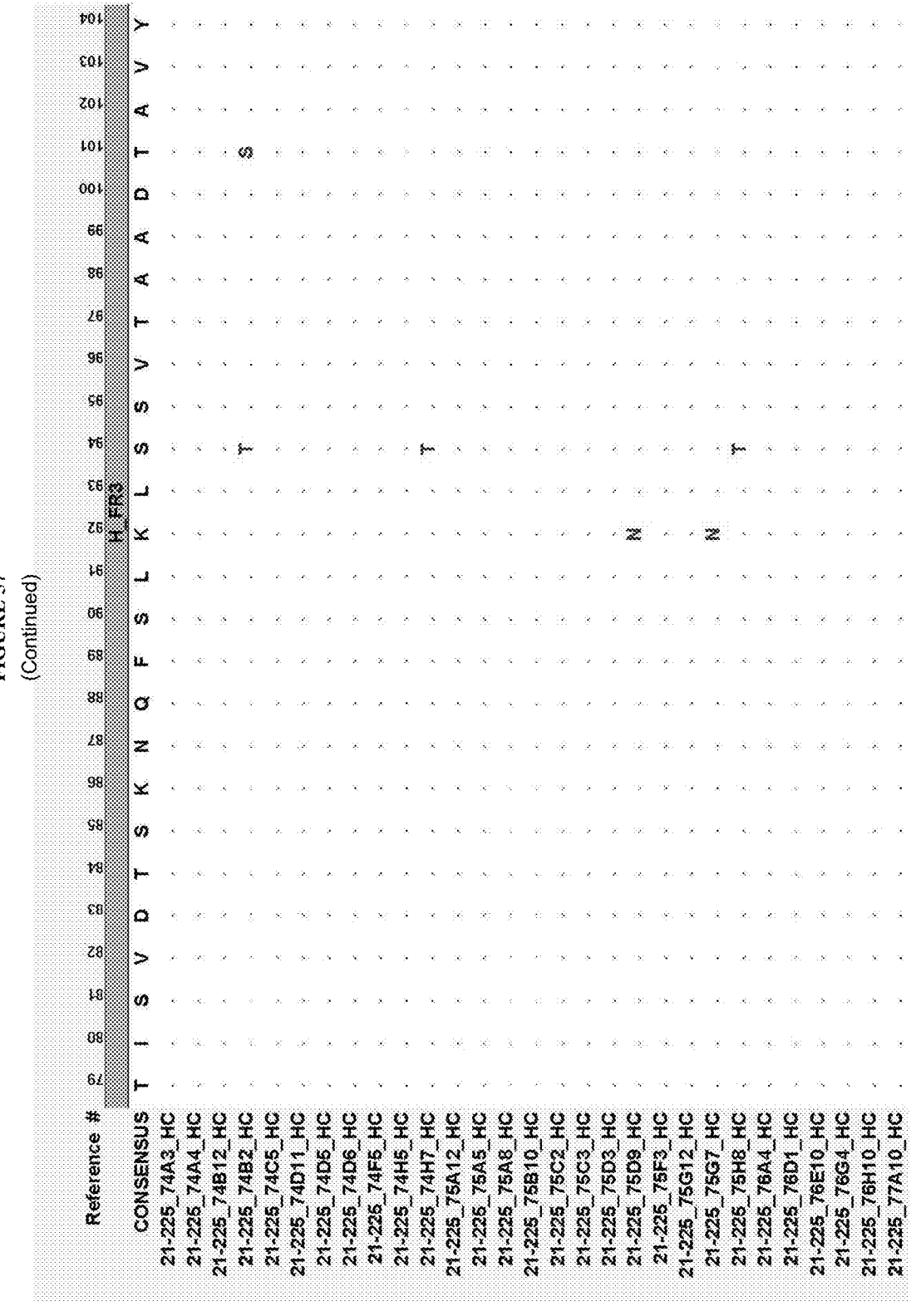
Figure 57:
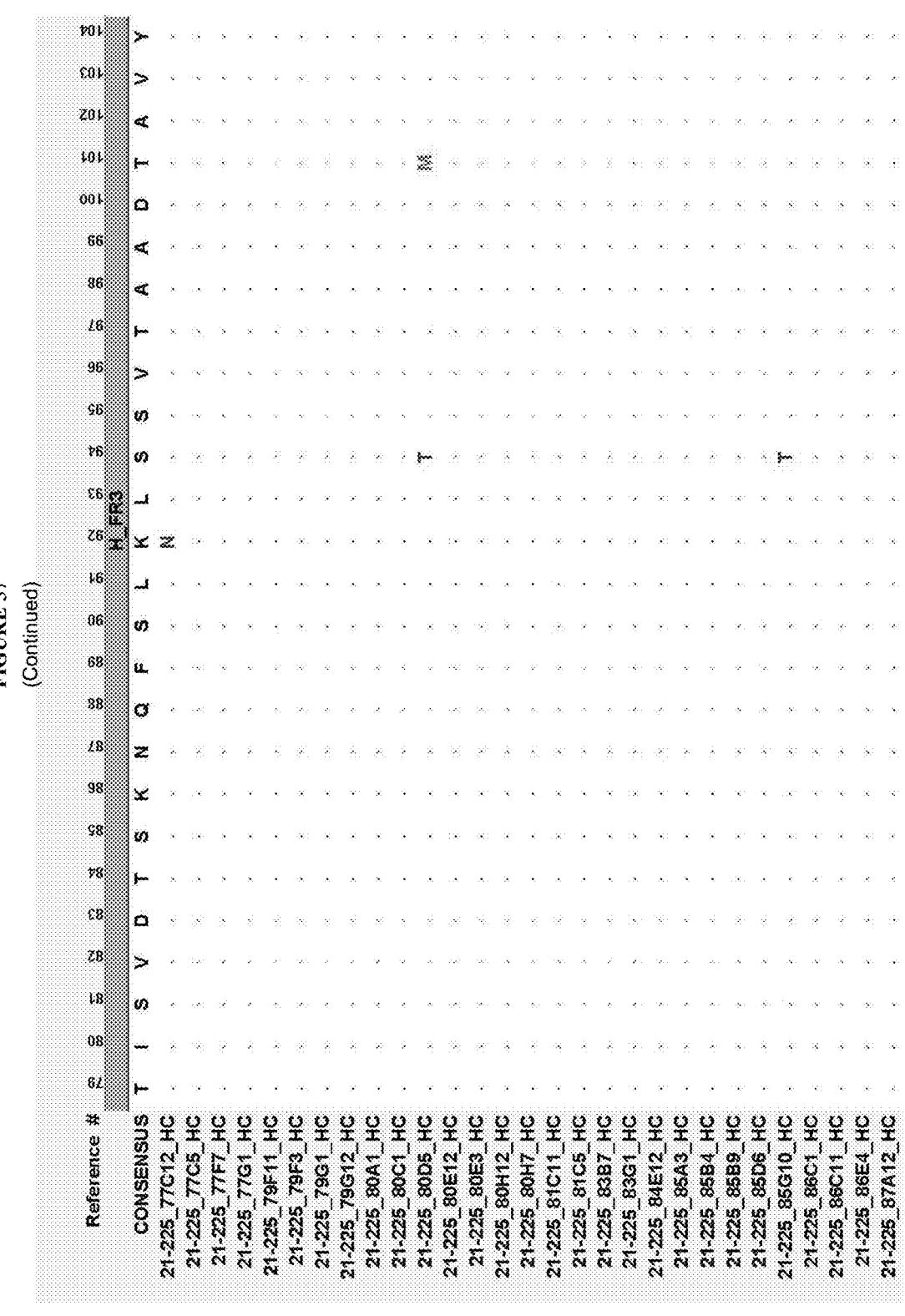
Figure 57:
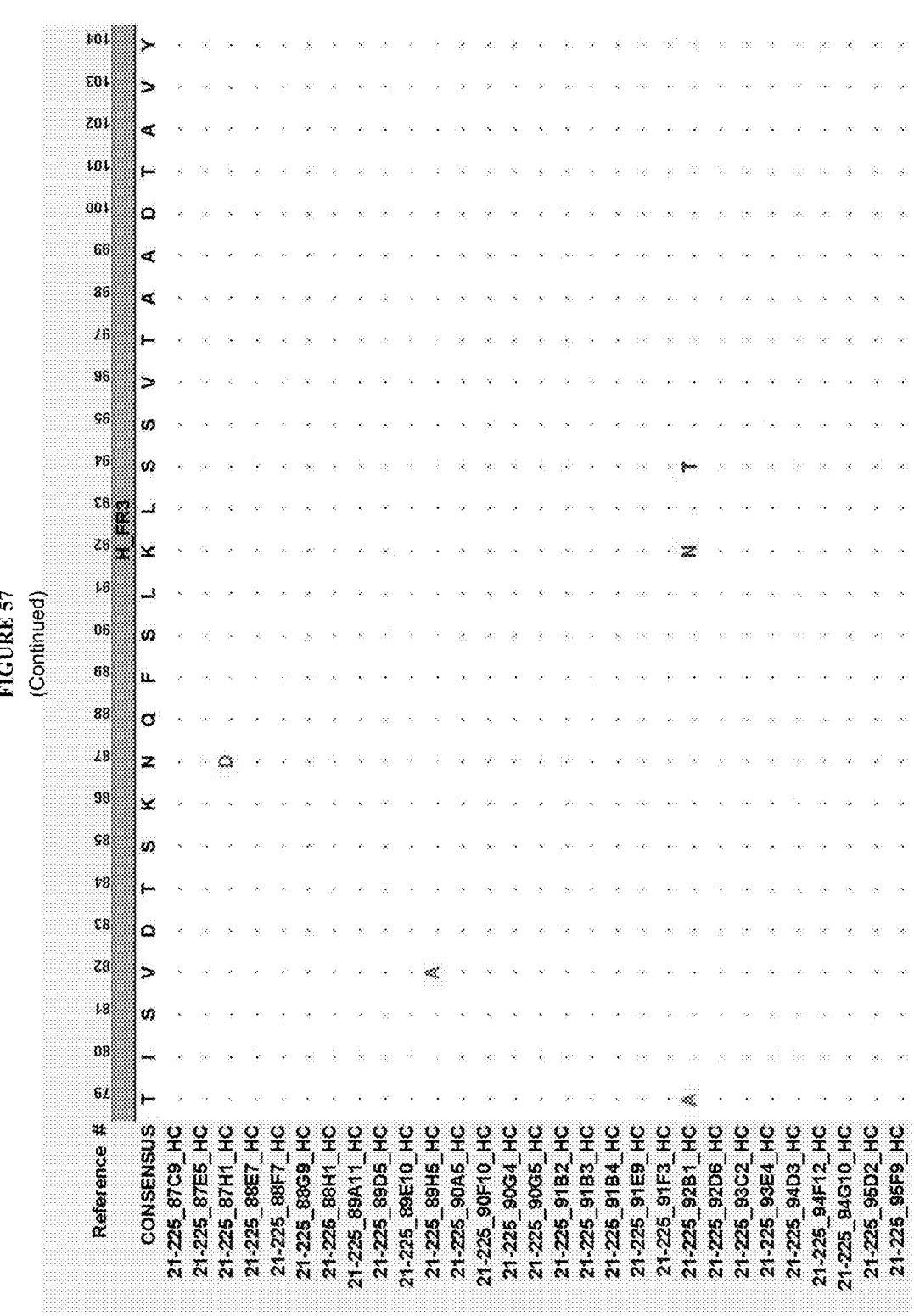
Figure 57:
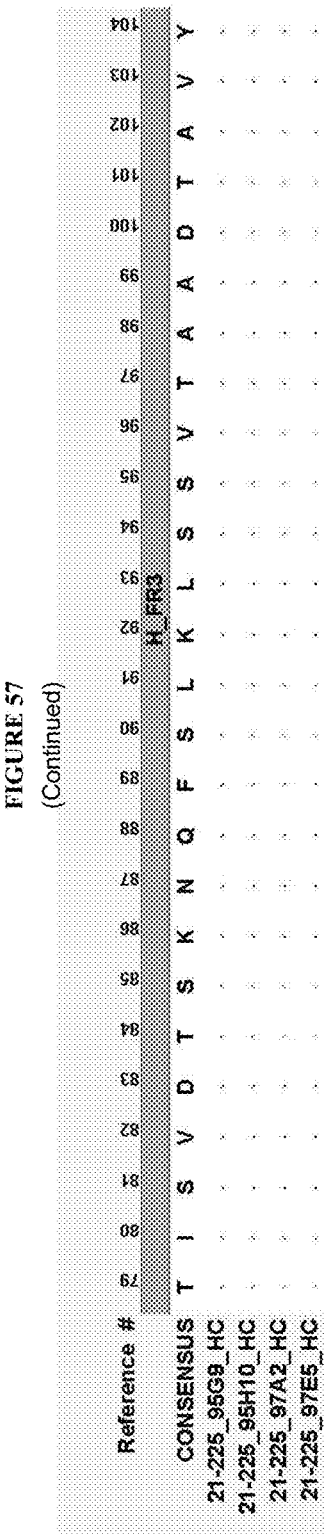
Figure 57:
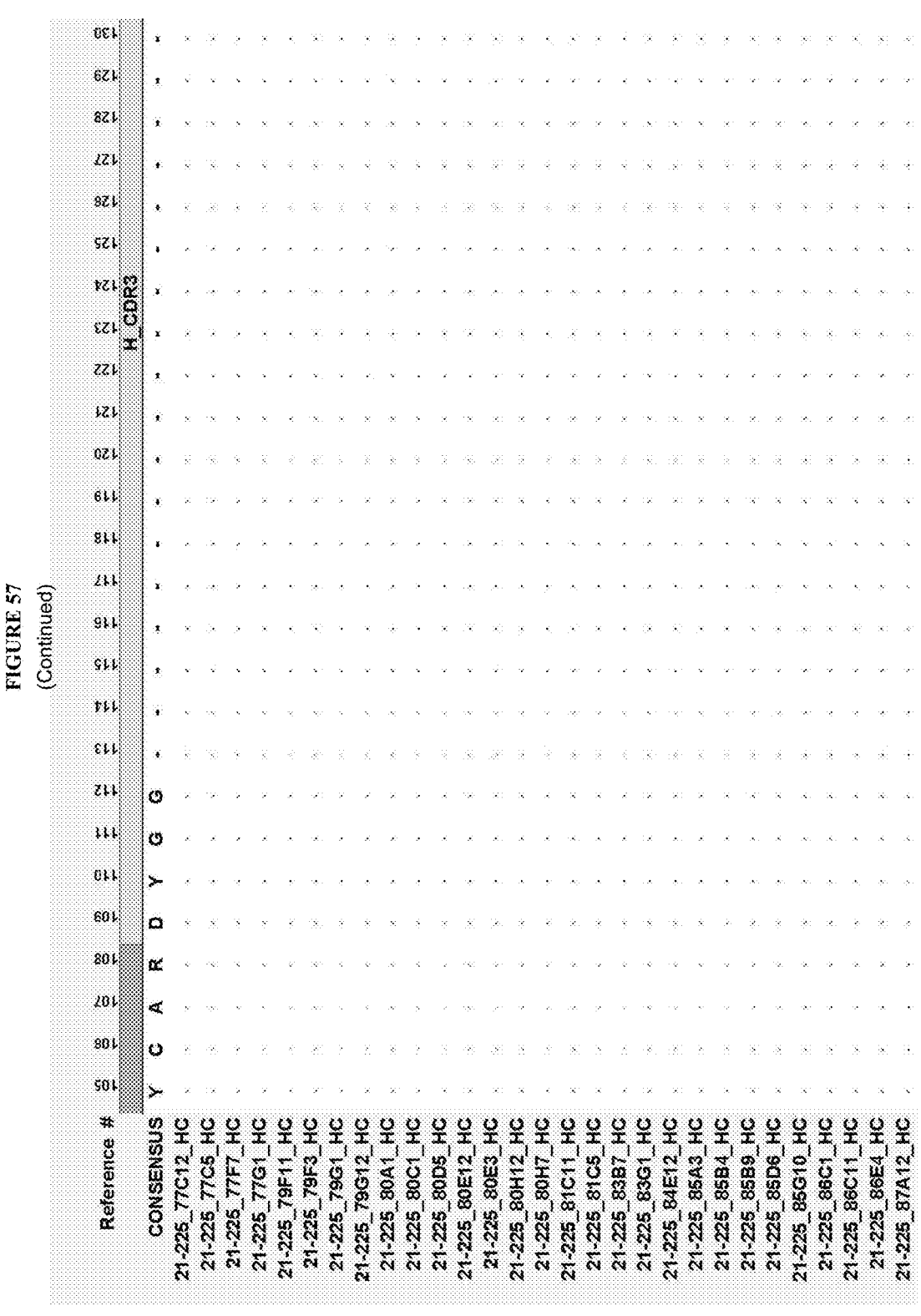
Figure 57:
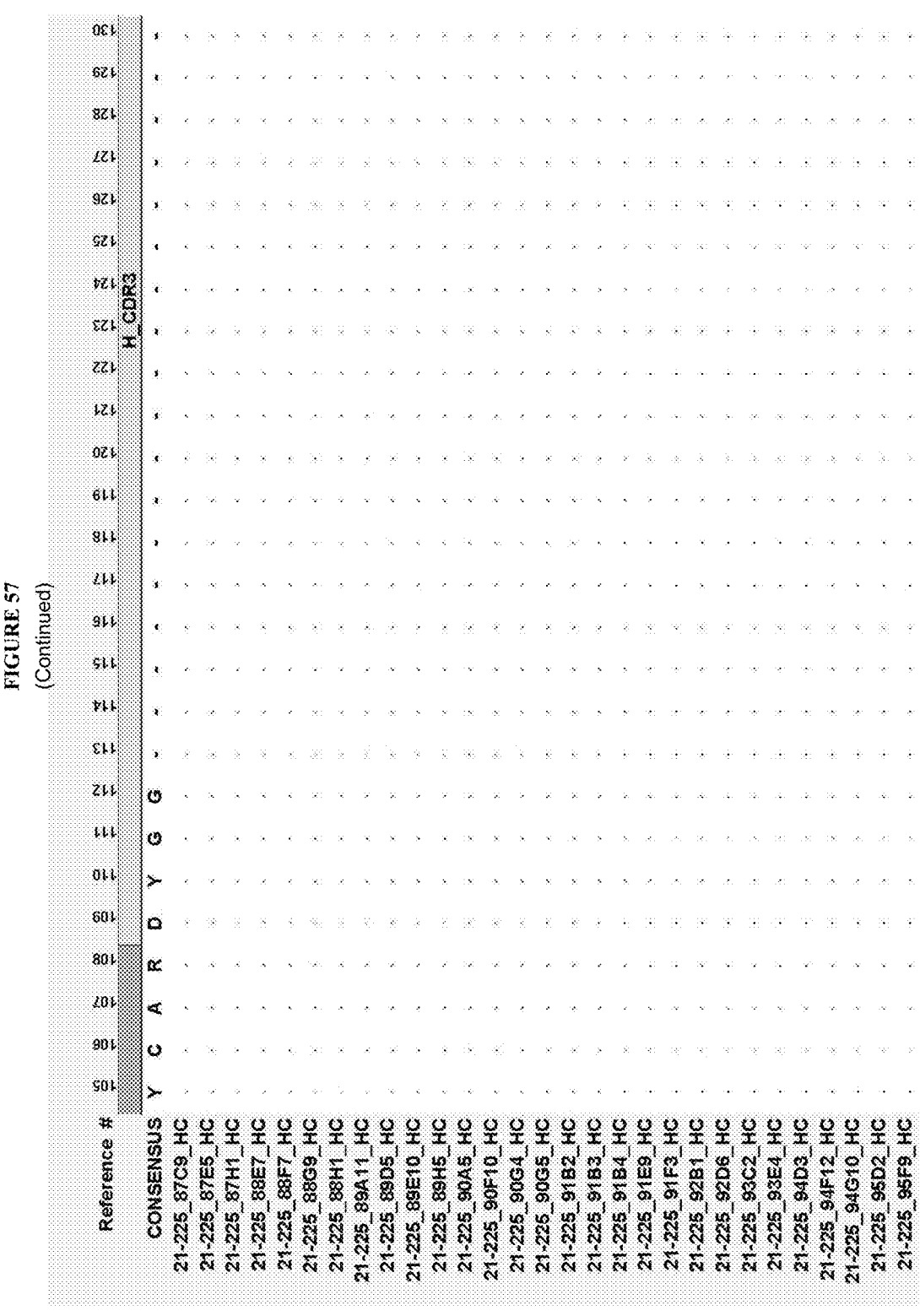
Figure 57:
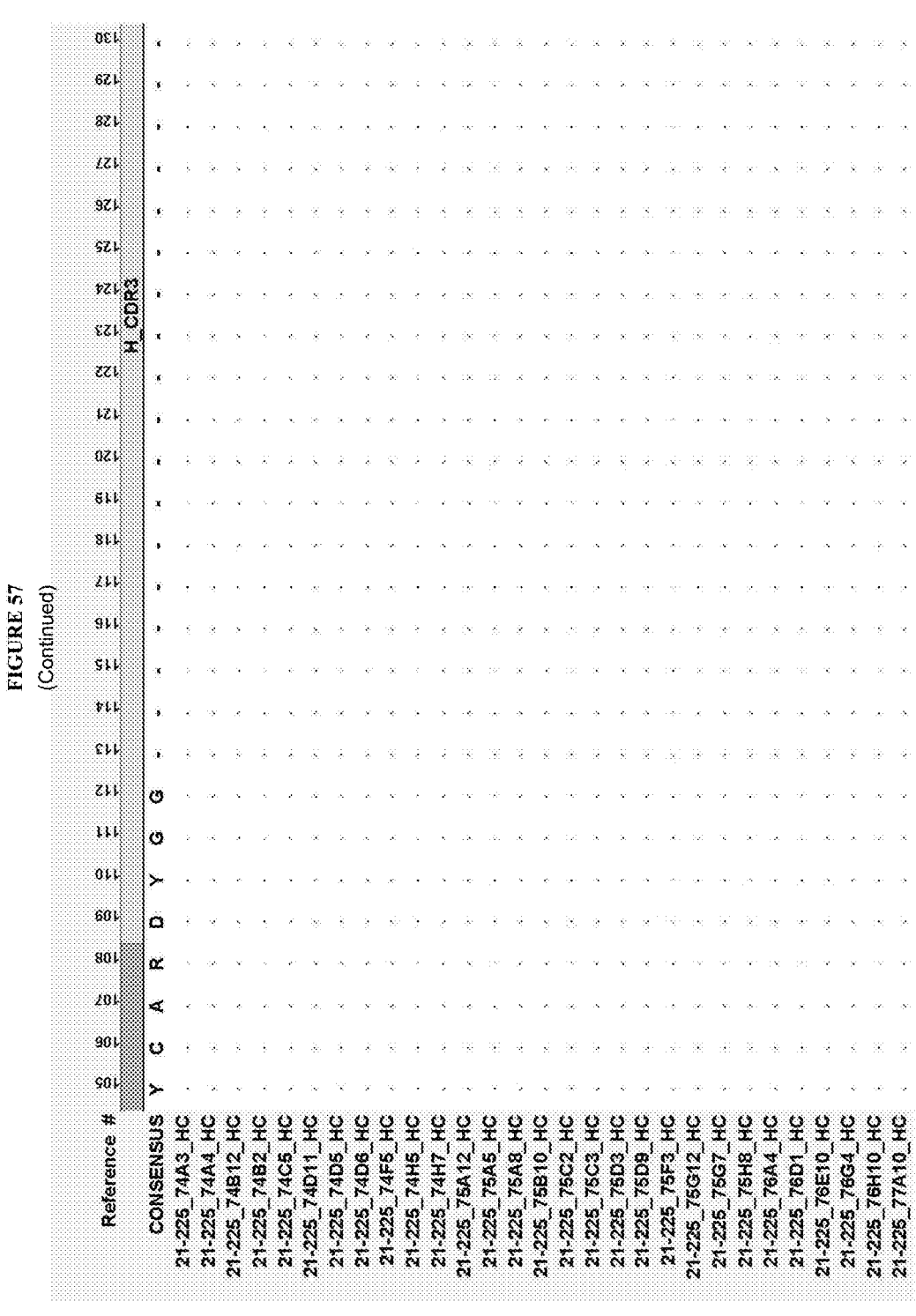
Figure 57:
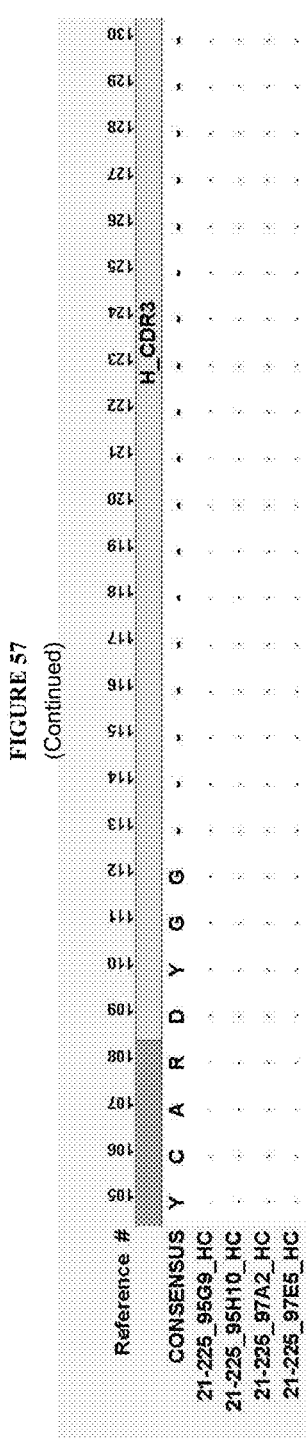
Figure 57:
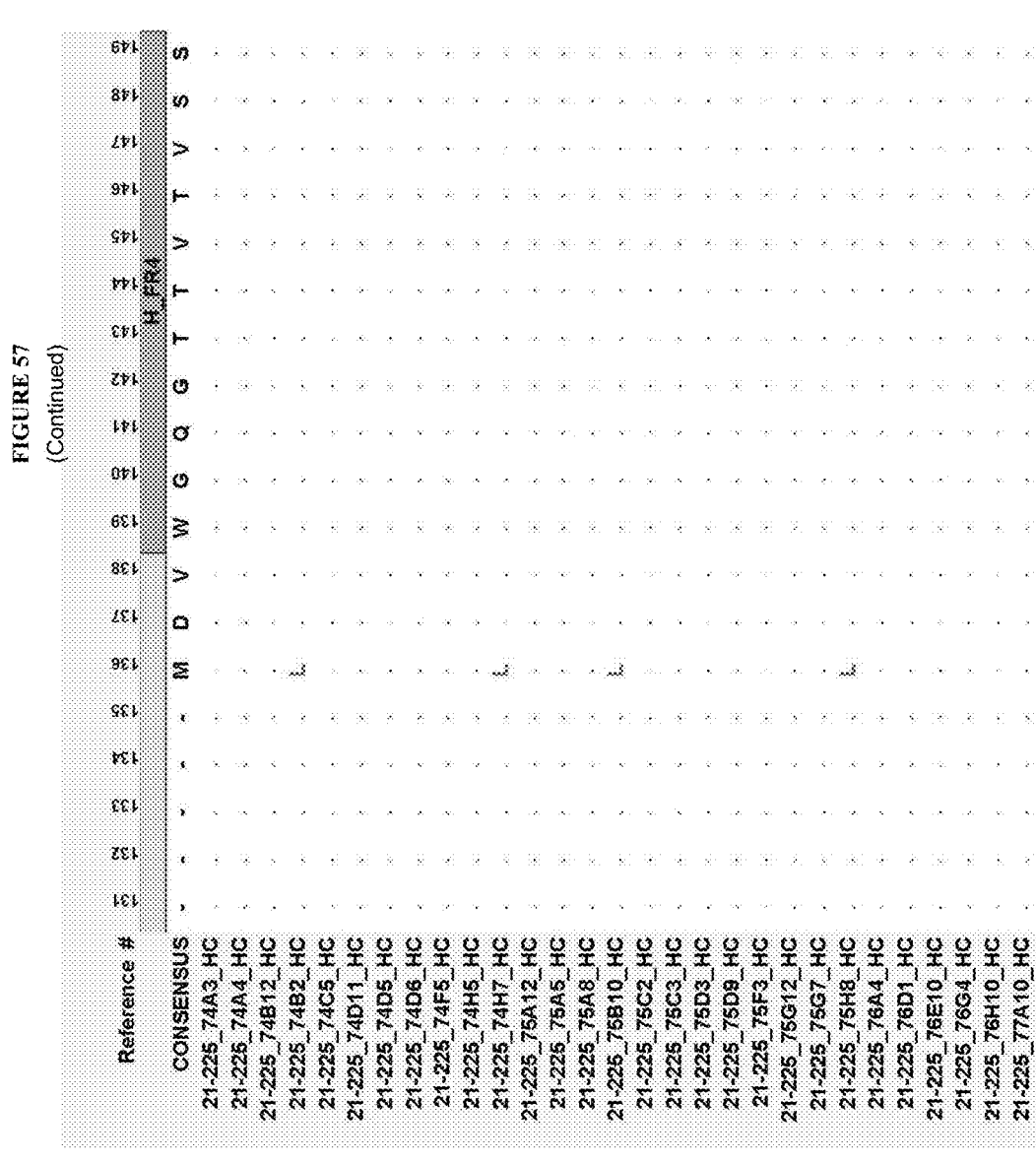
Figure 57:
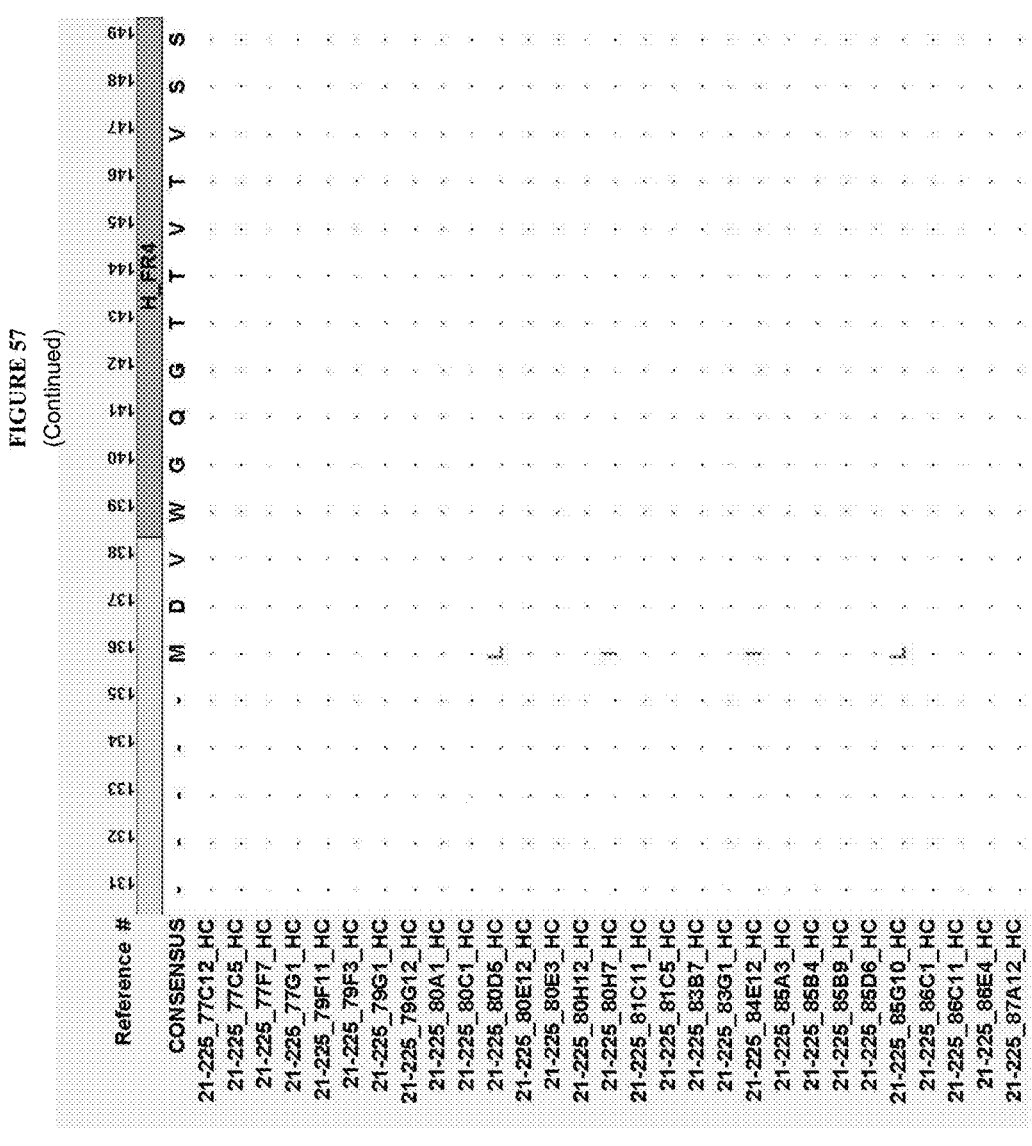
Figure 57:
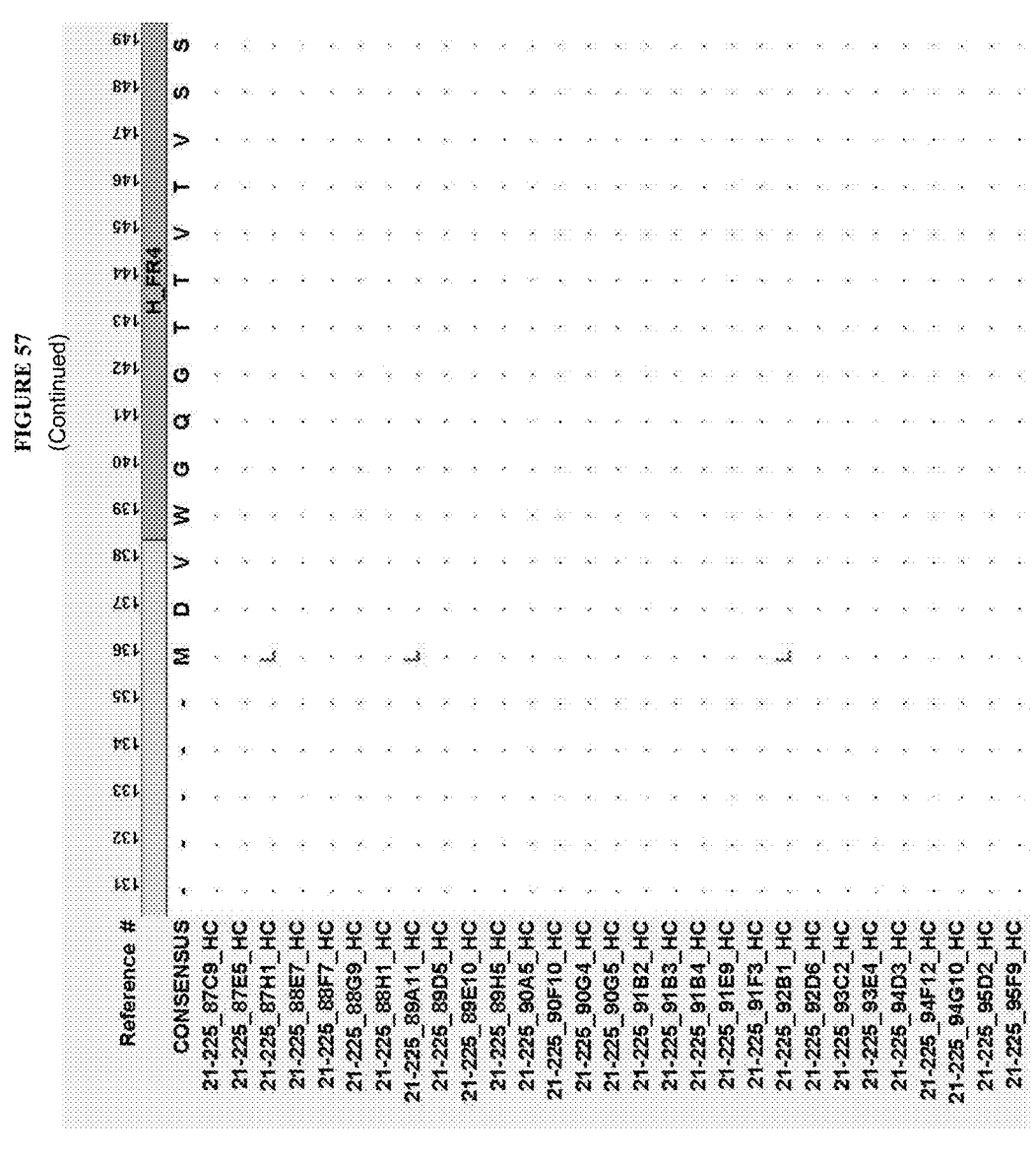
Figure 57:
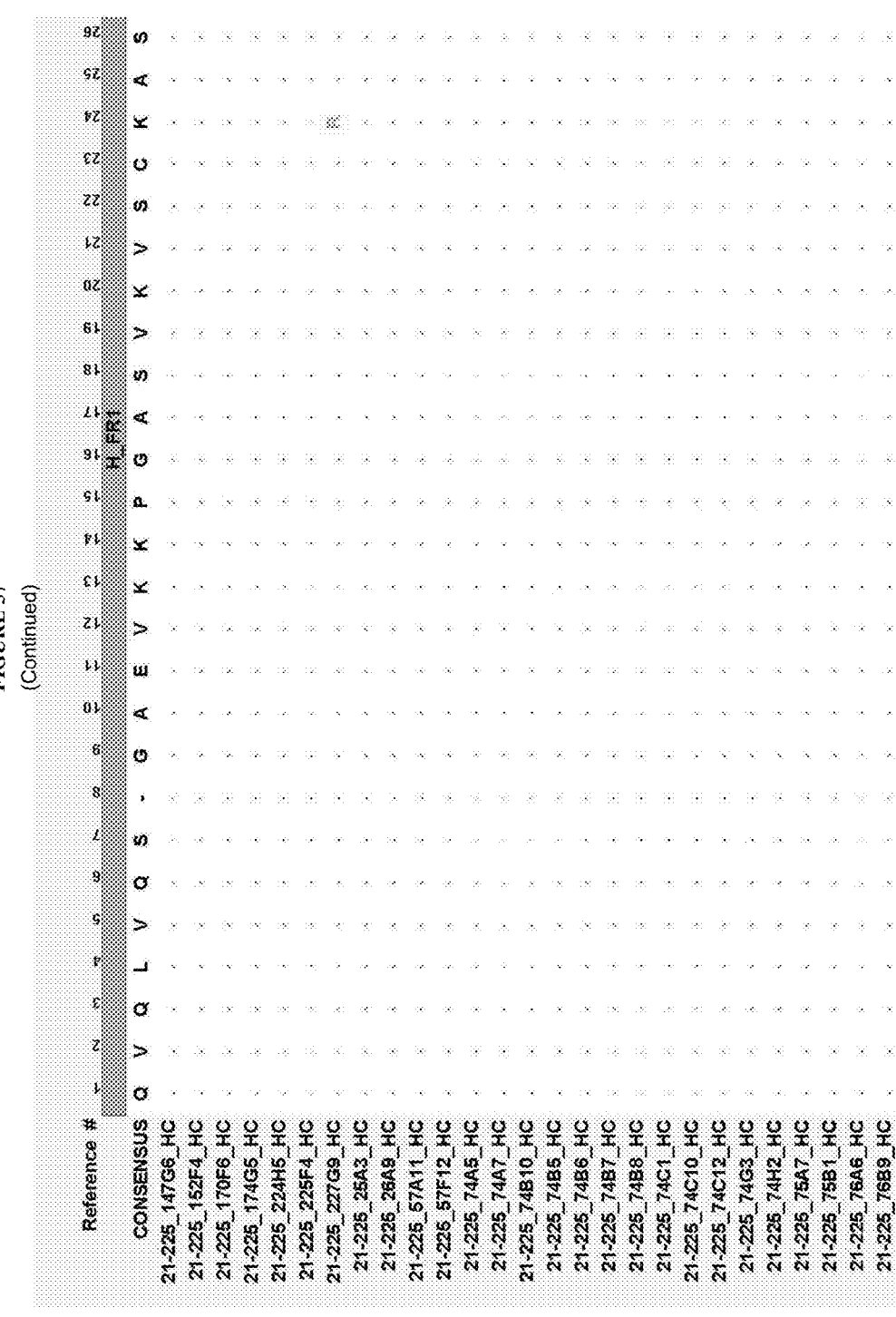
Figure 57:
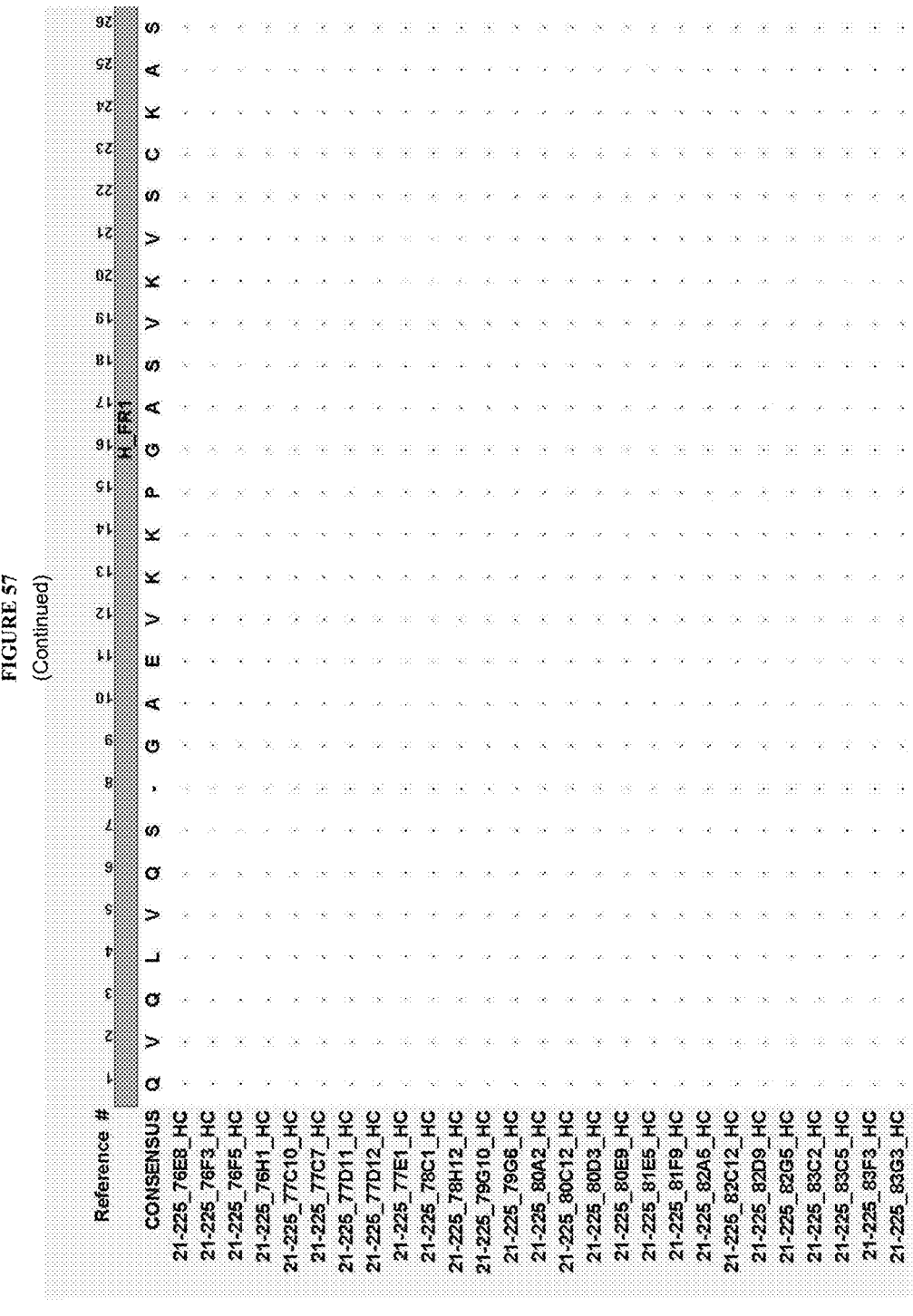
Figure 57:
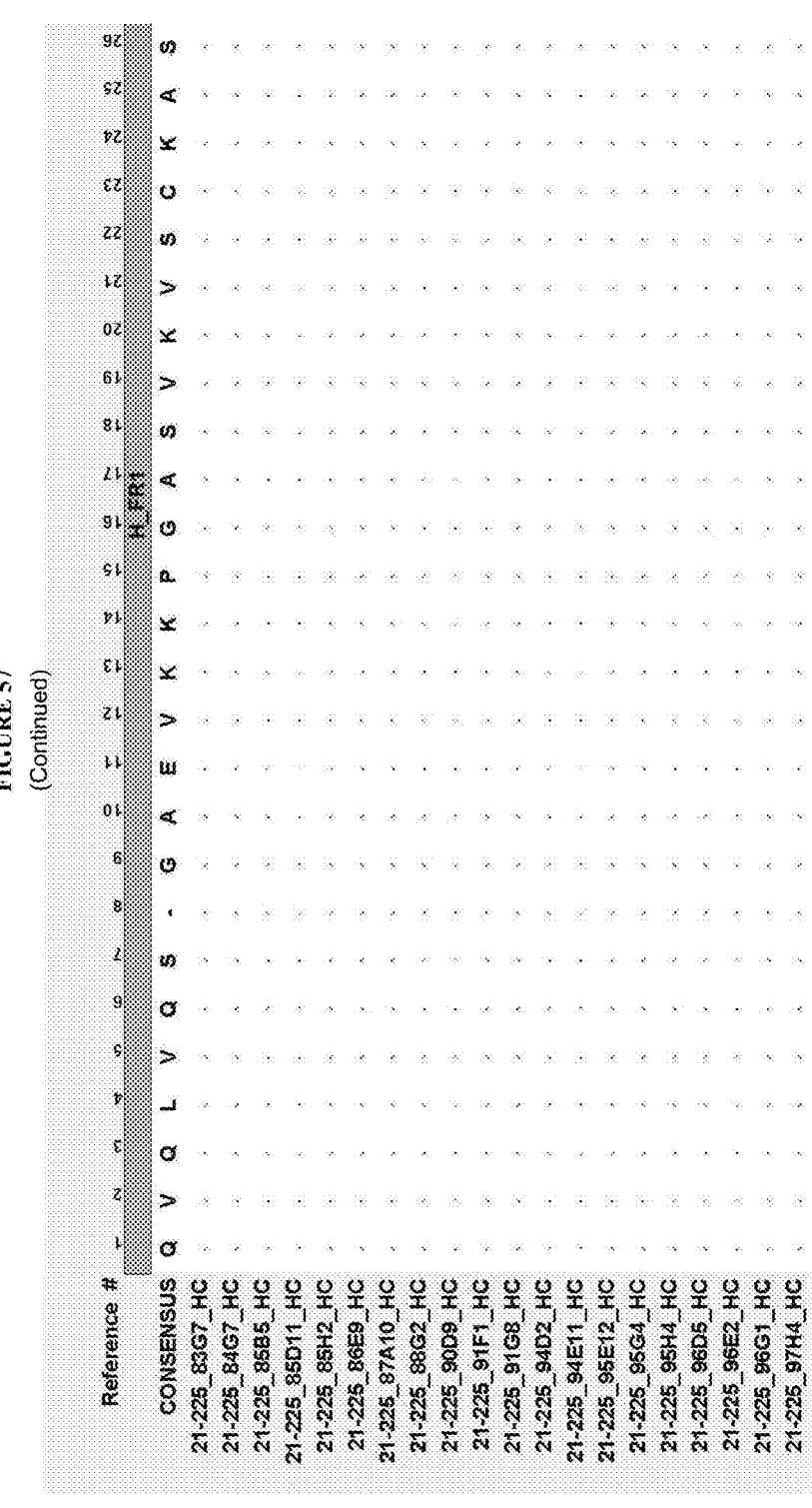
Figure 57:
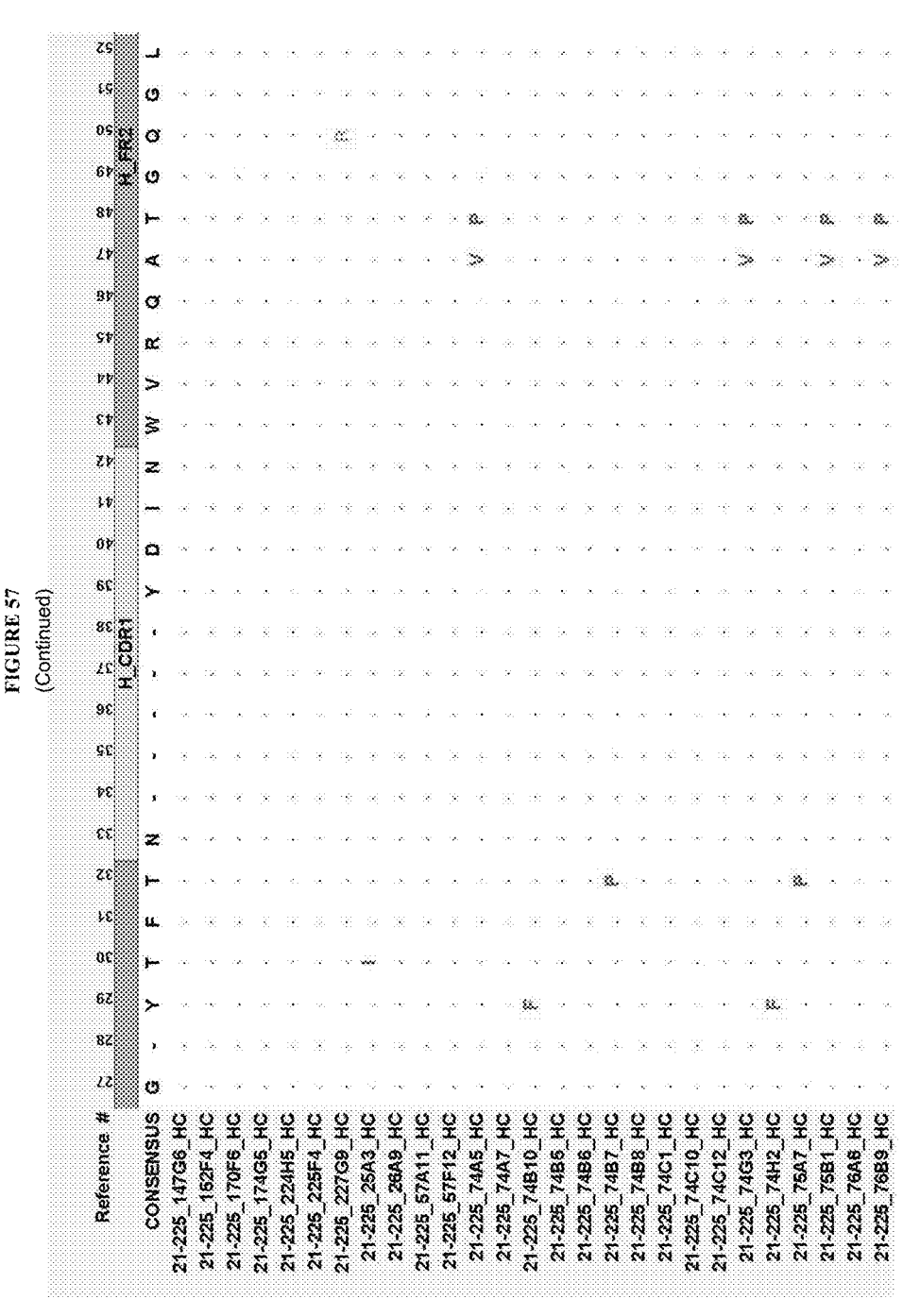
Figure 57:
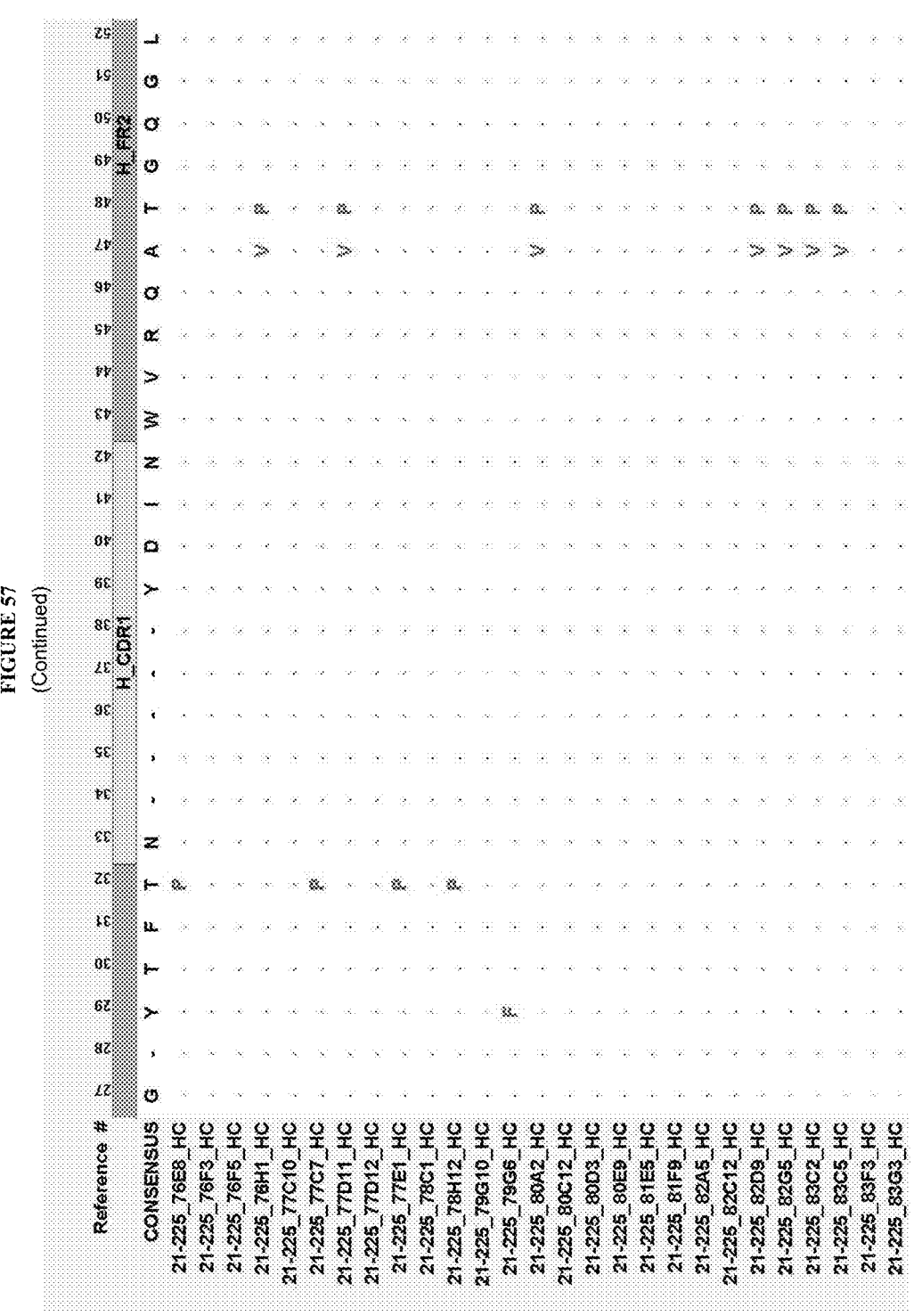
Figure 57:
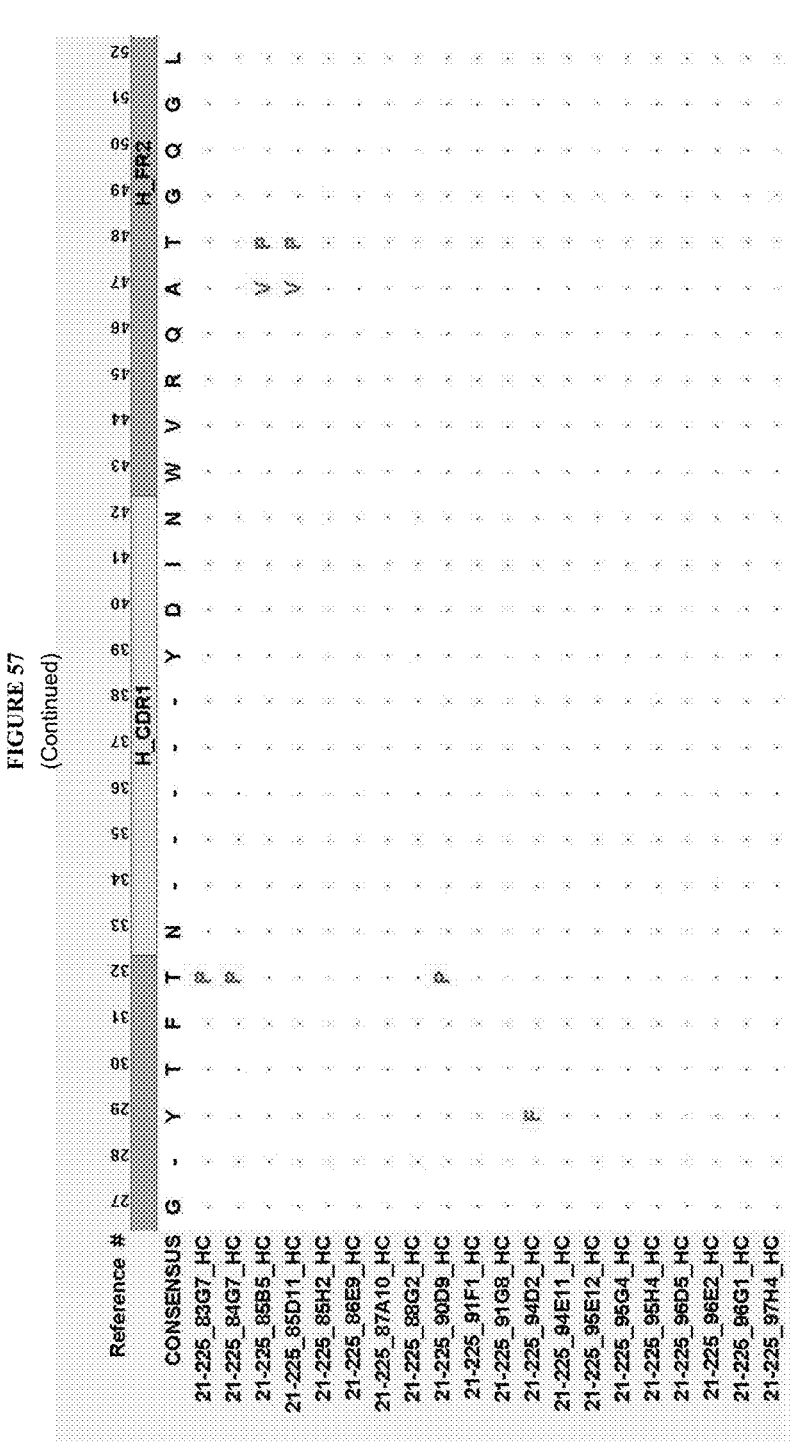
Figure 57:
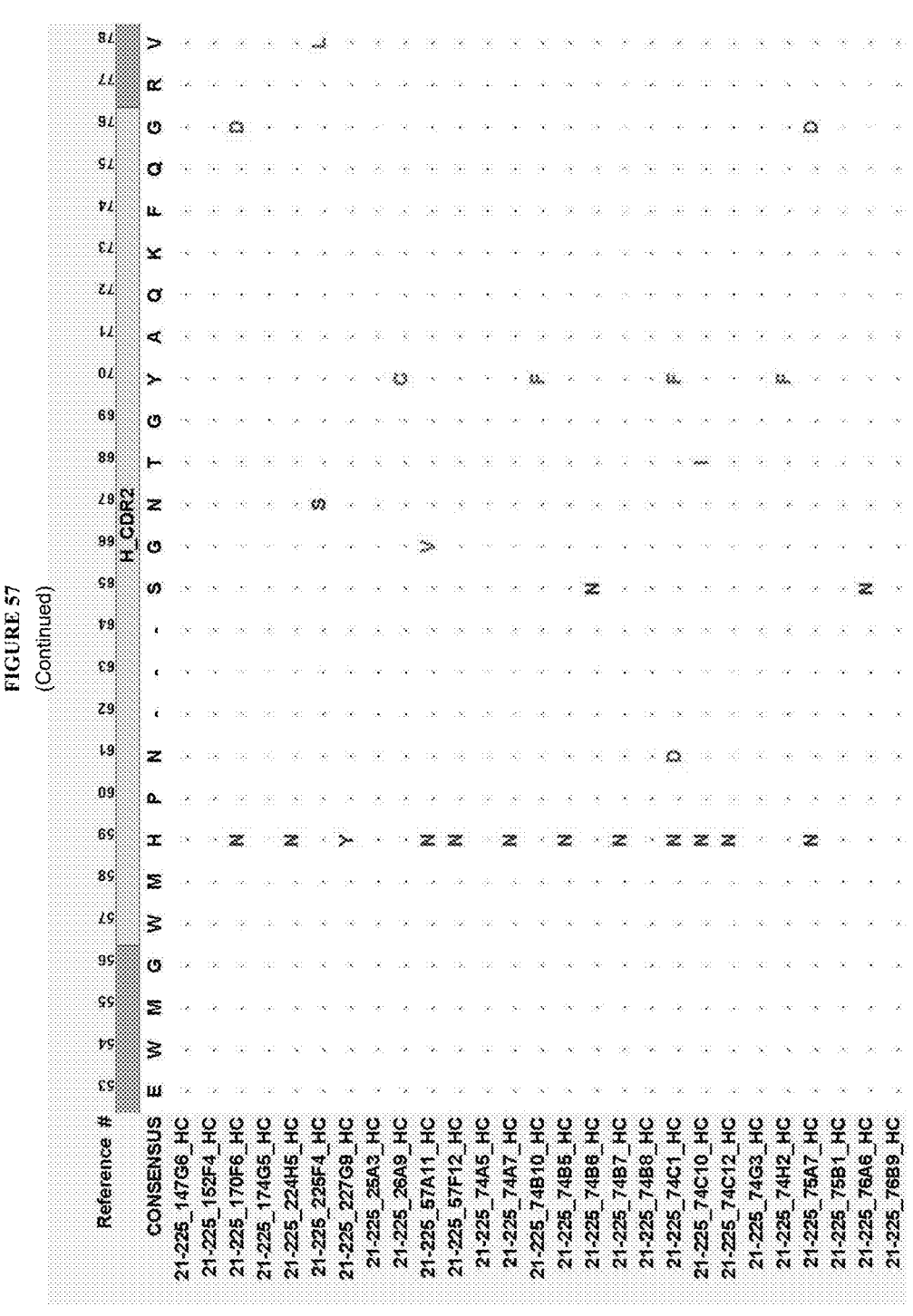
Figure 57:
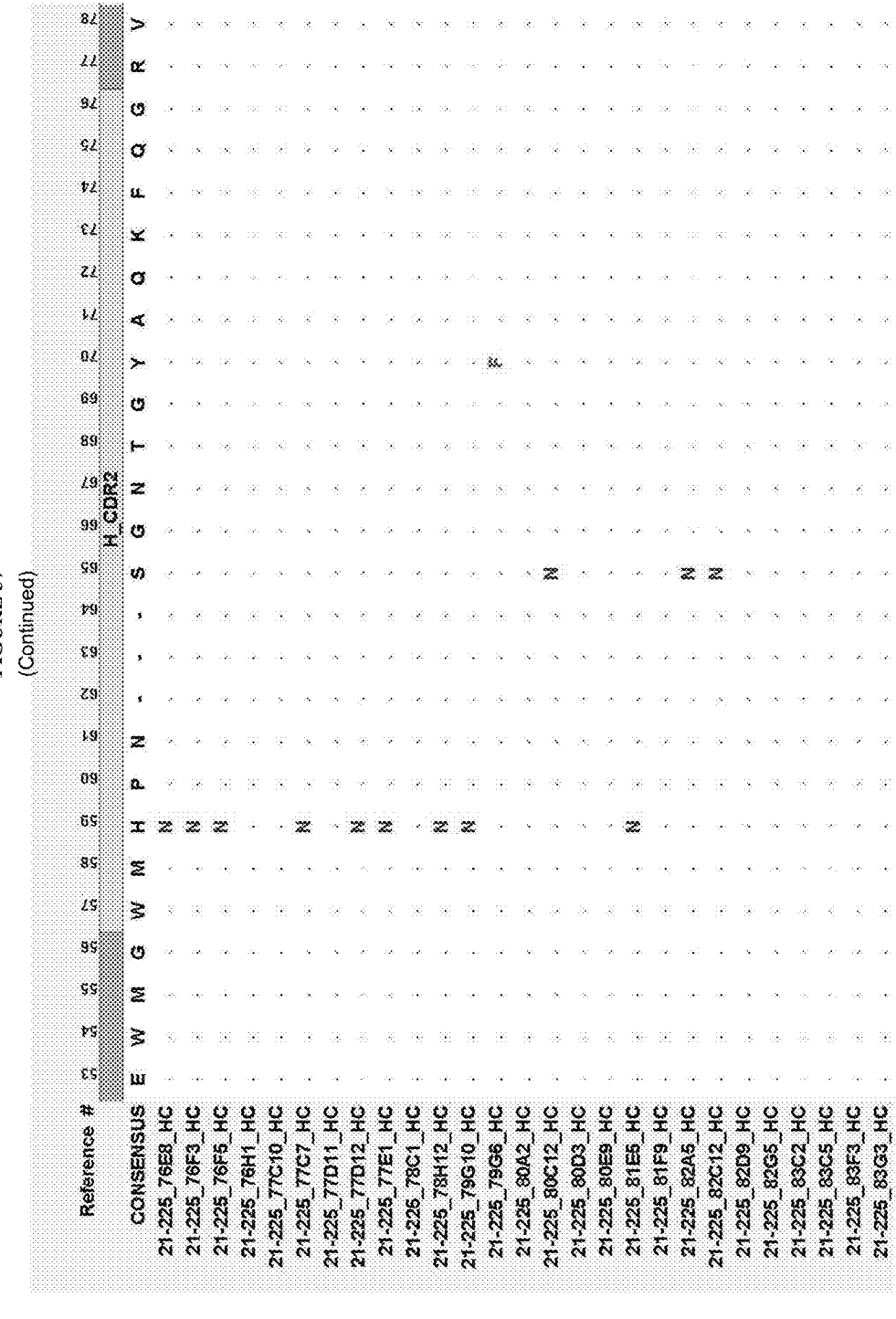
Figure 57:
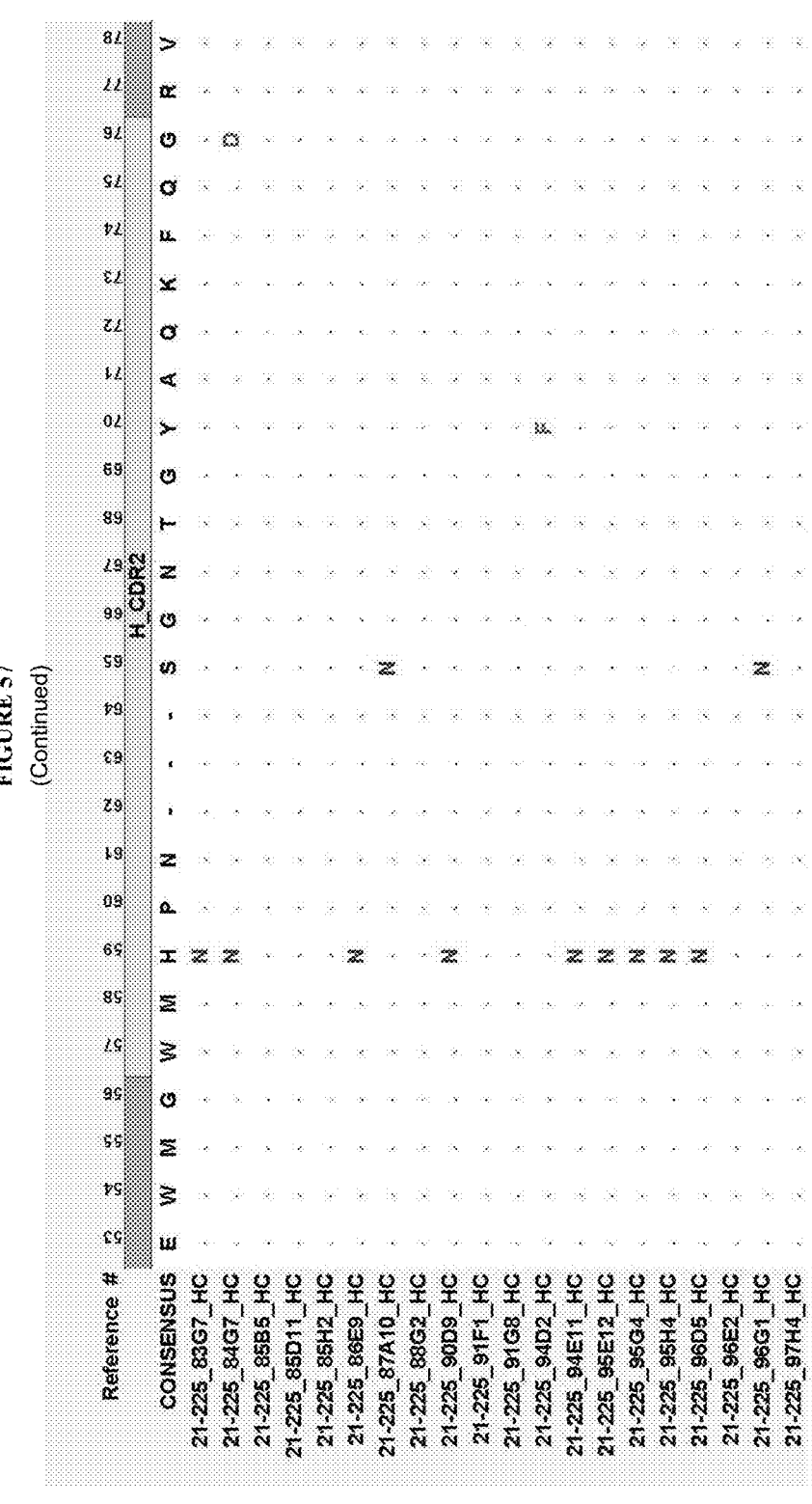
Figure 57:
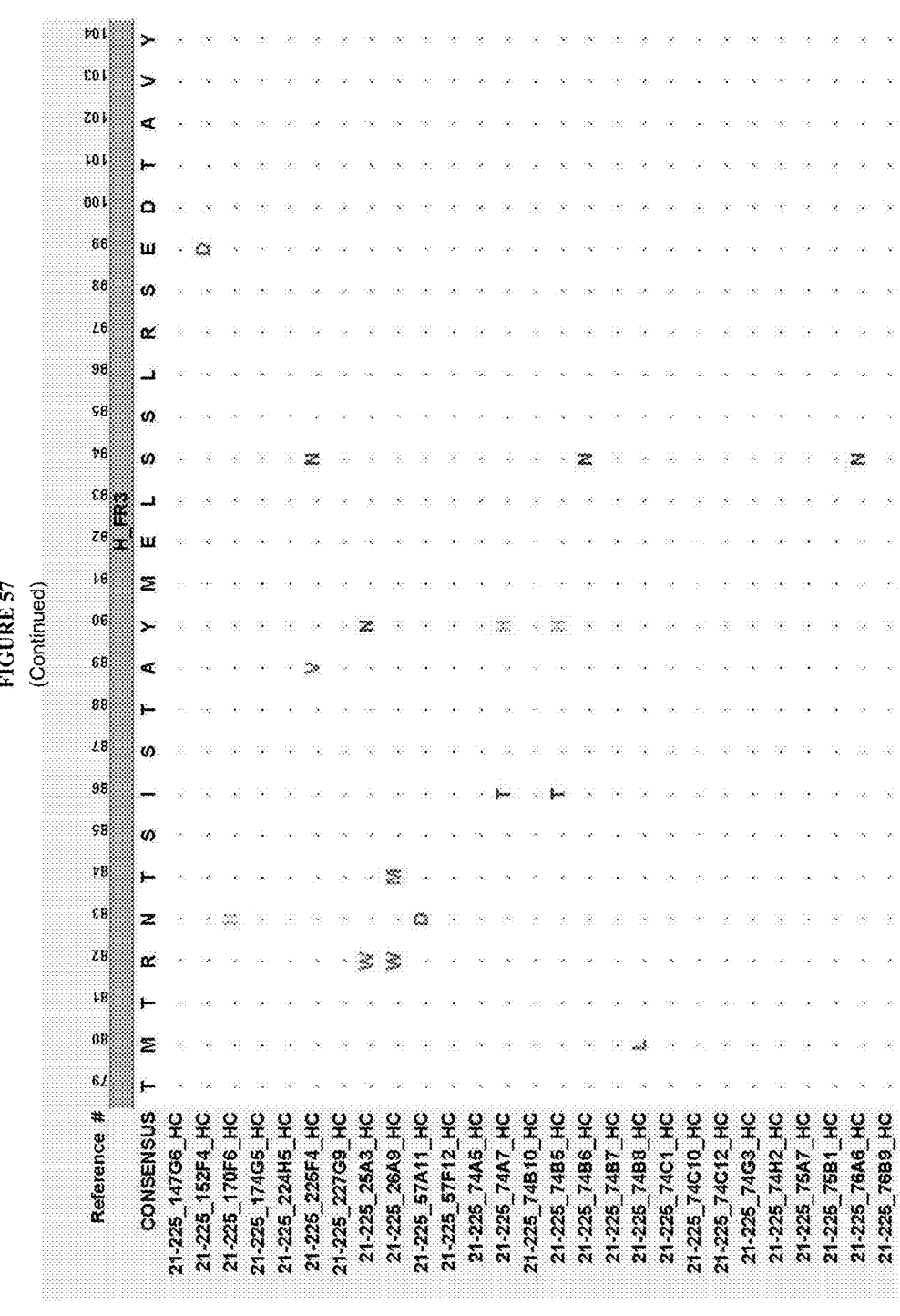
Figure 57:
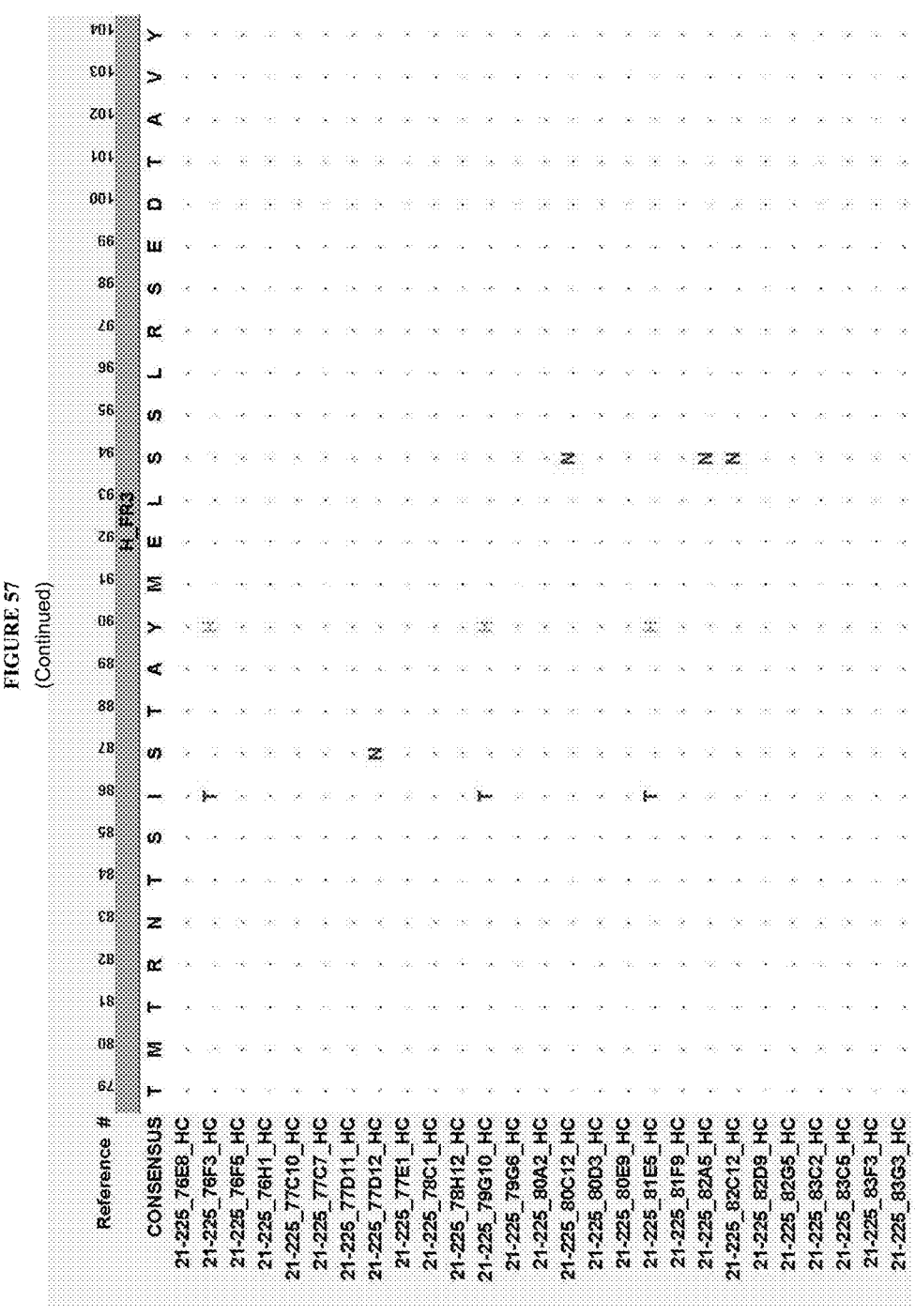
Figure 57:
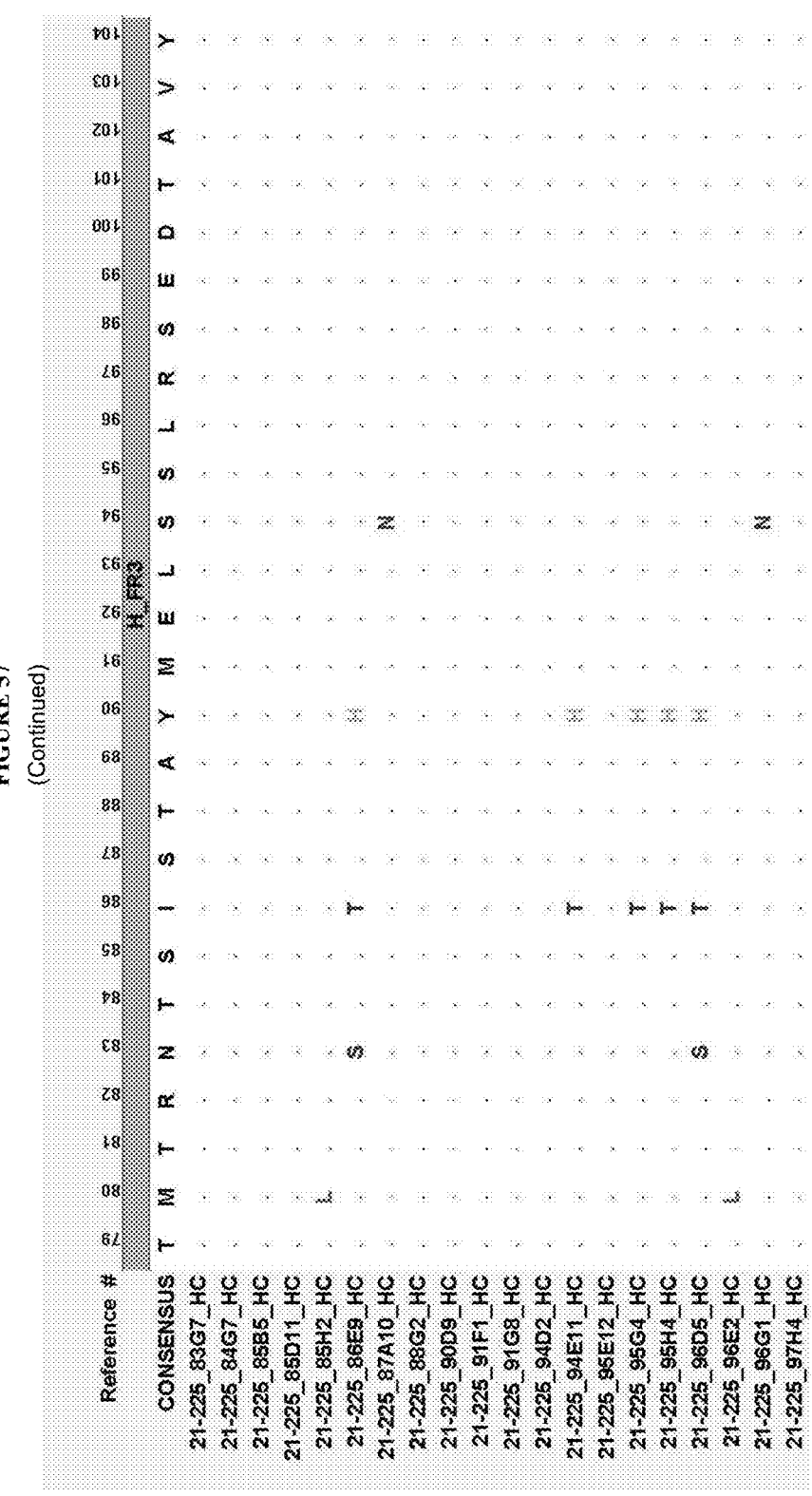
Figure 57:
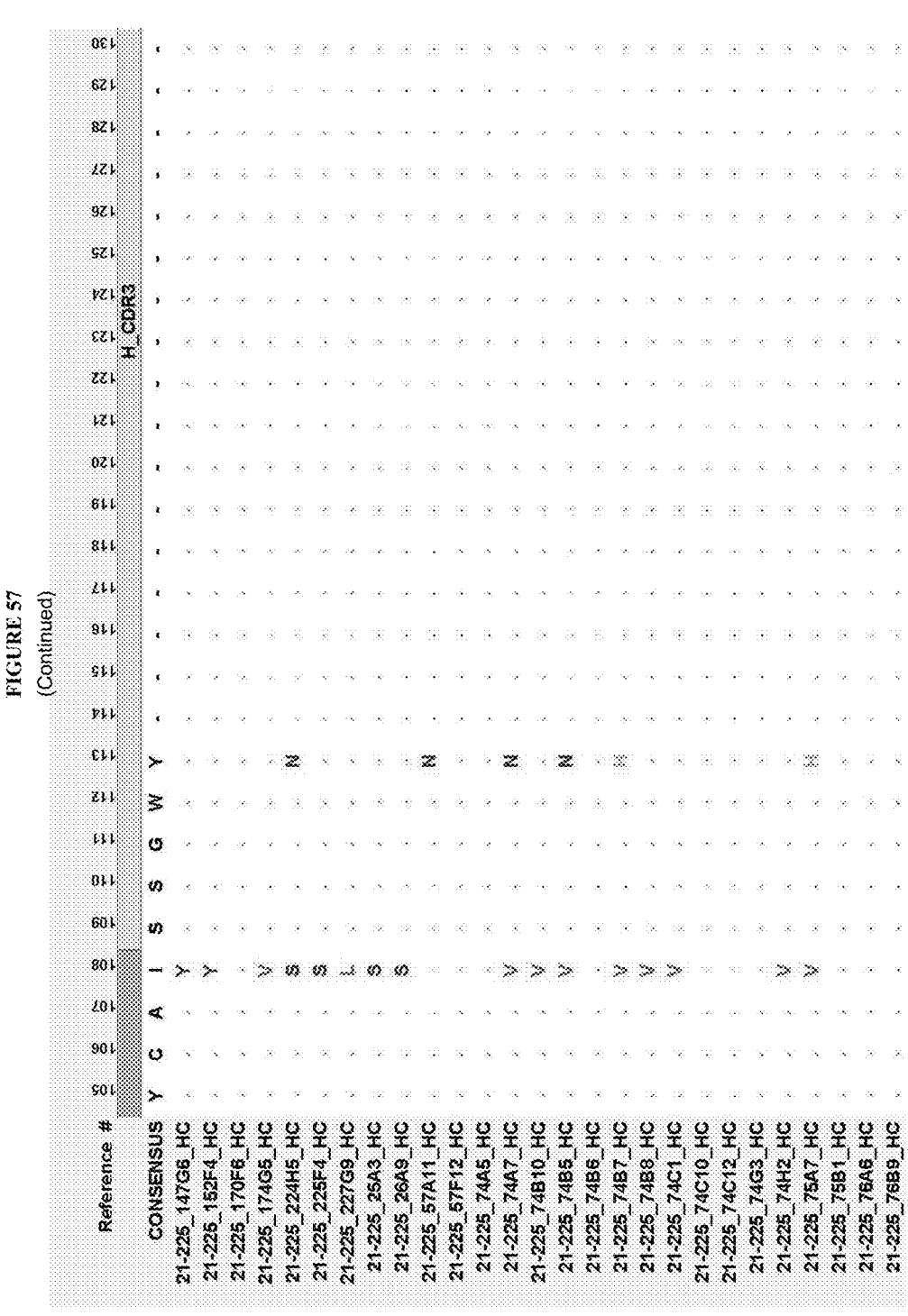
Figure 57:
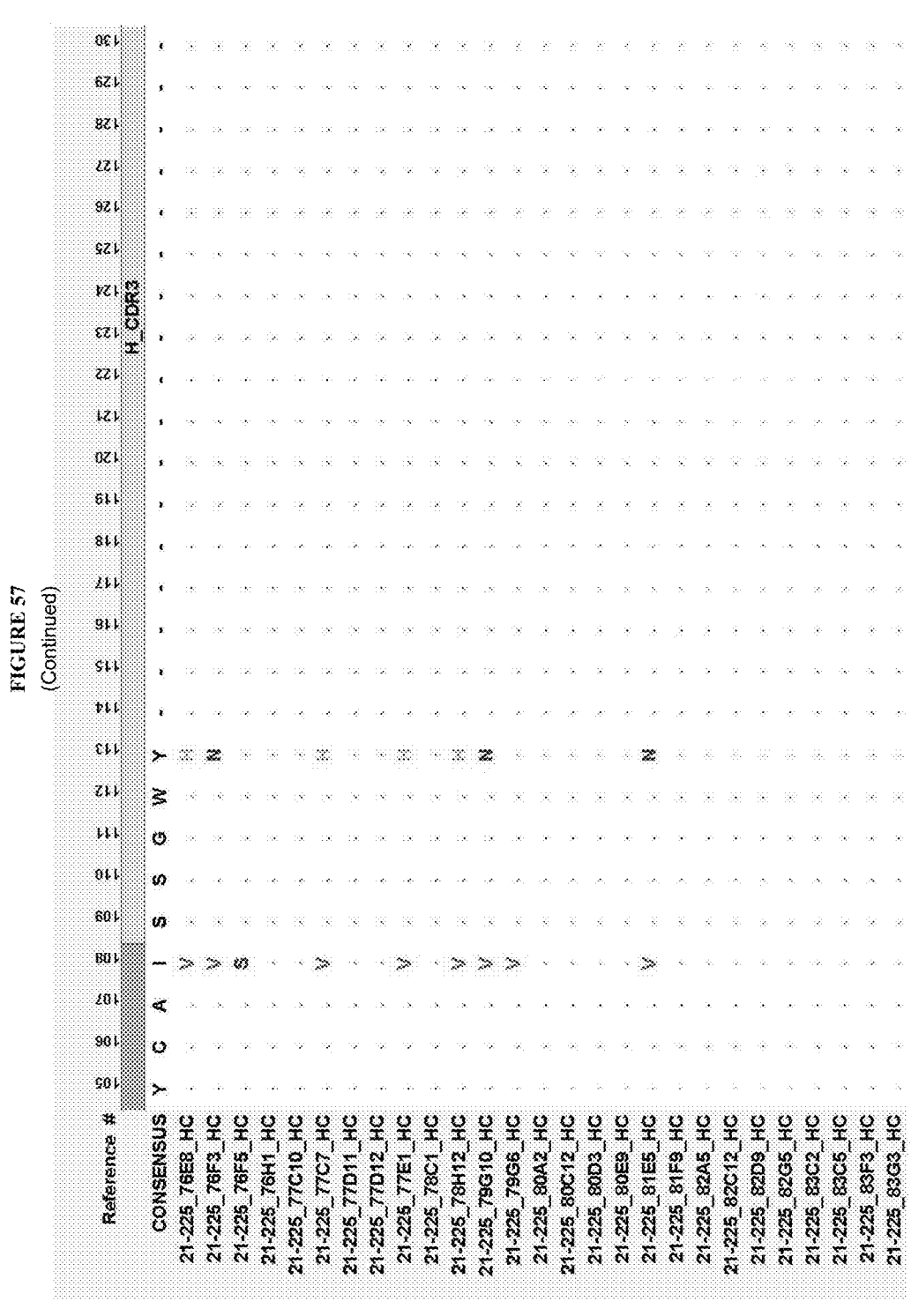
Figure 57:
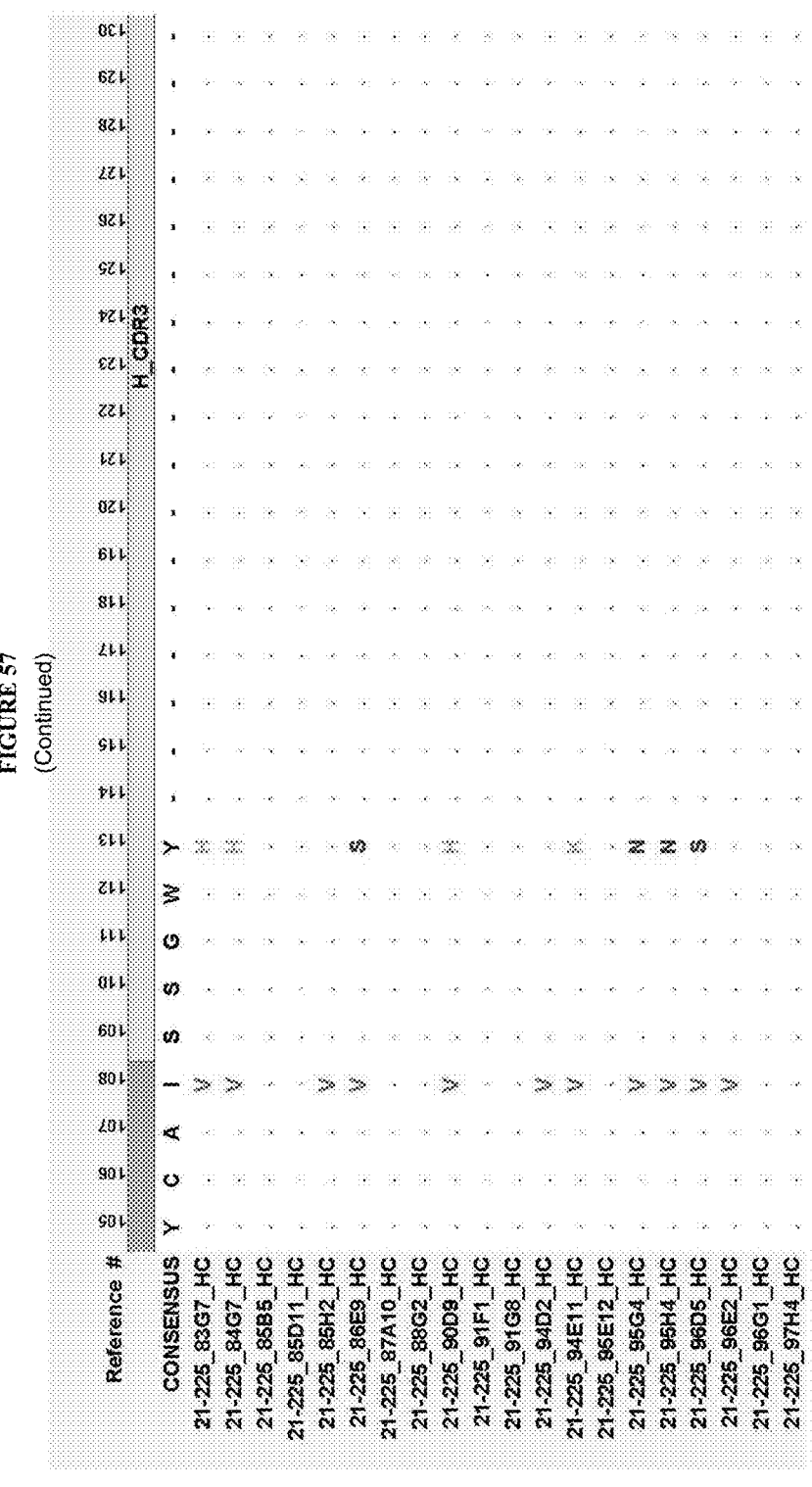
Figure 57:
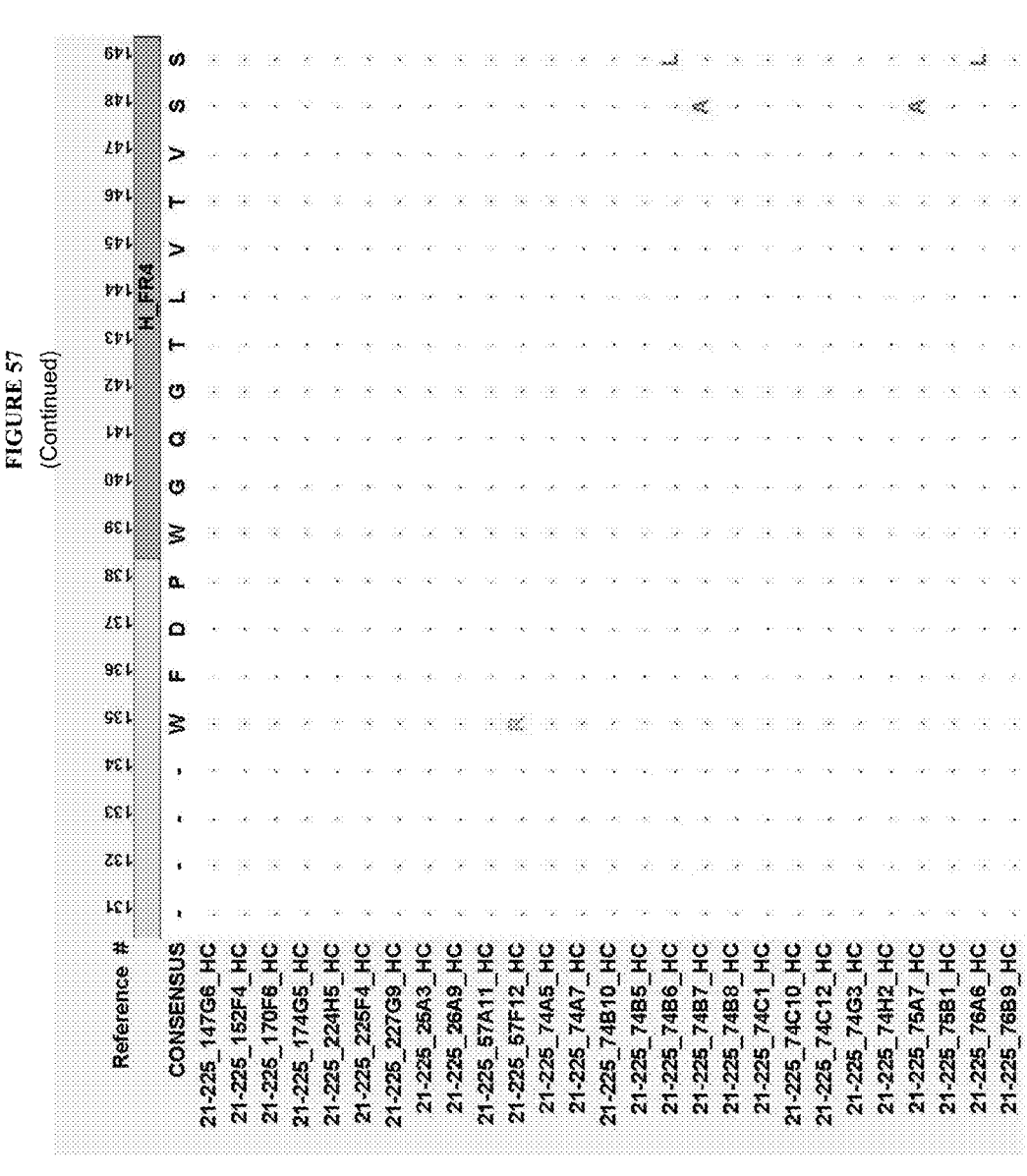
Figure 57:
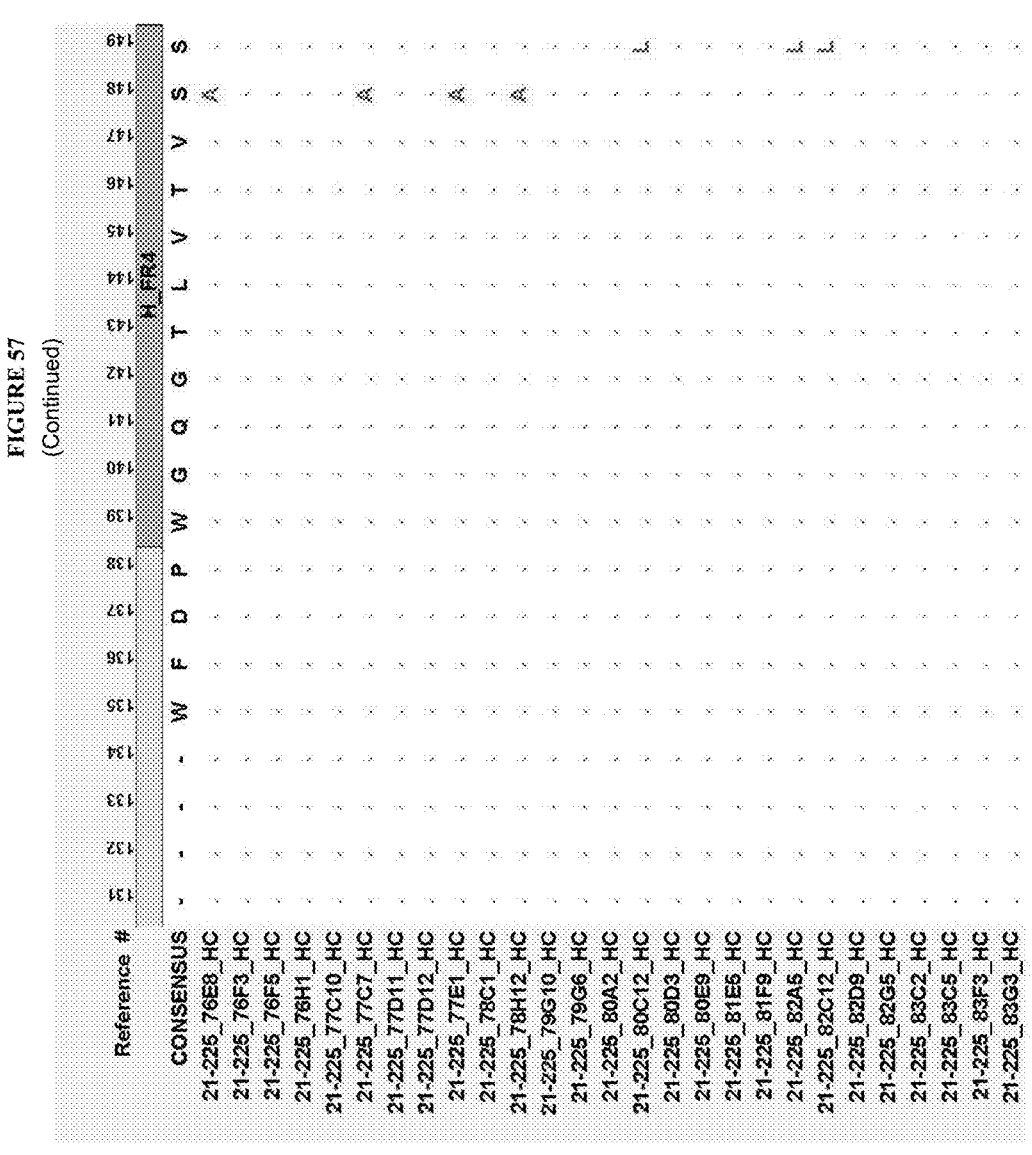
Figure 57:
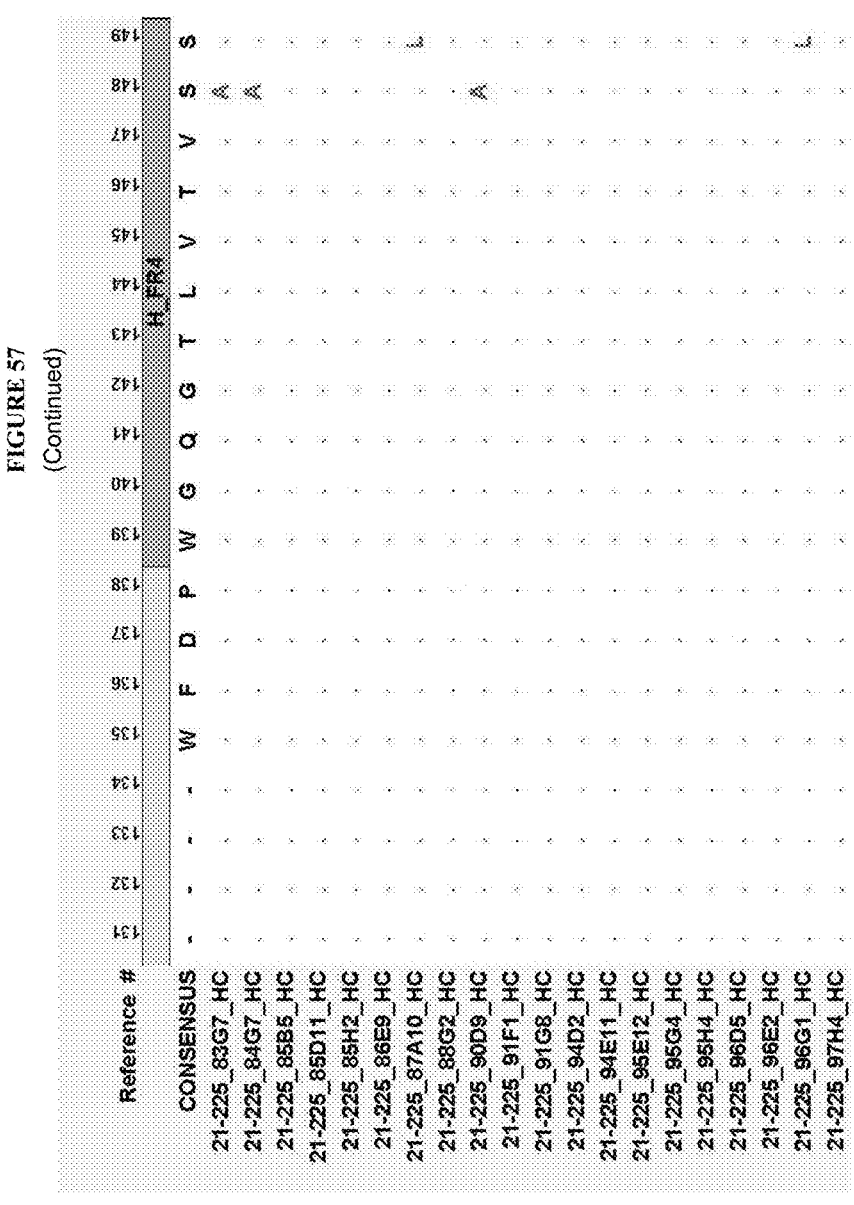
Figure 57:
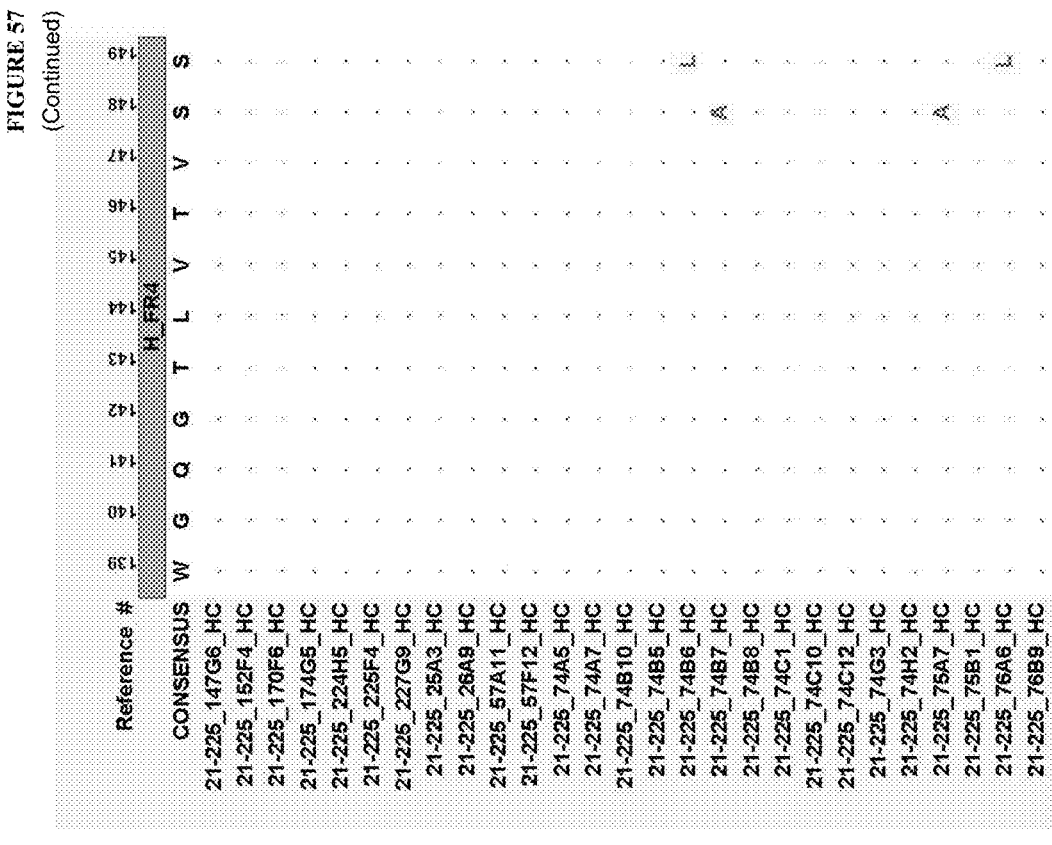
Figure 57:
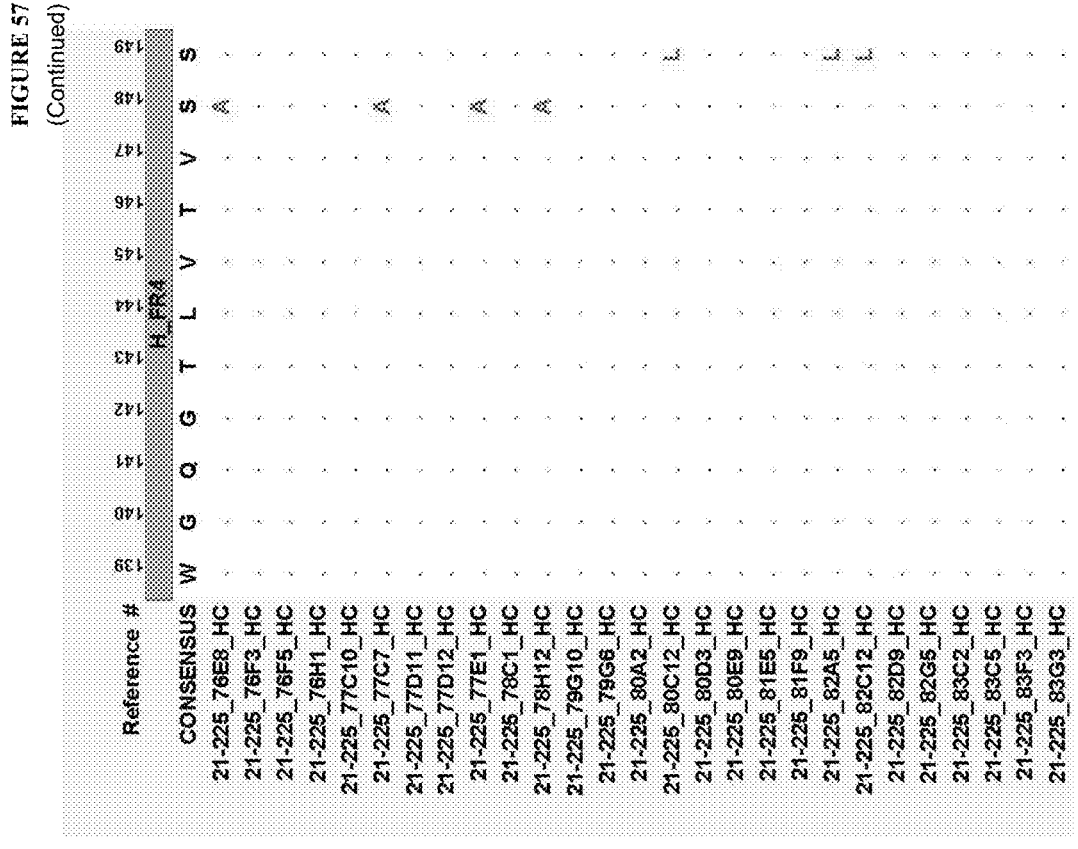
Figure 57:
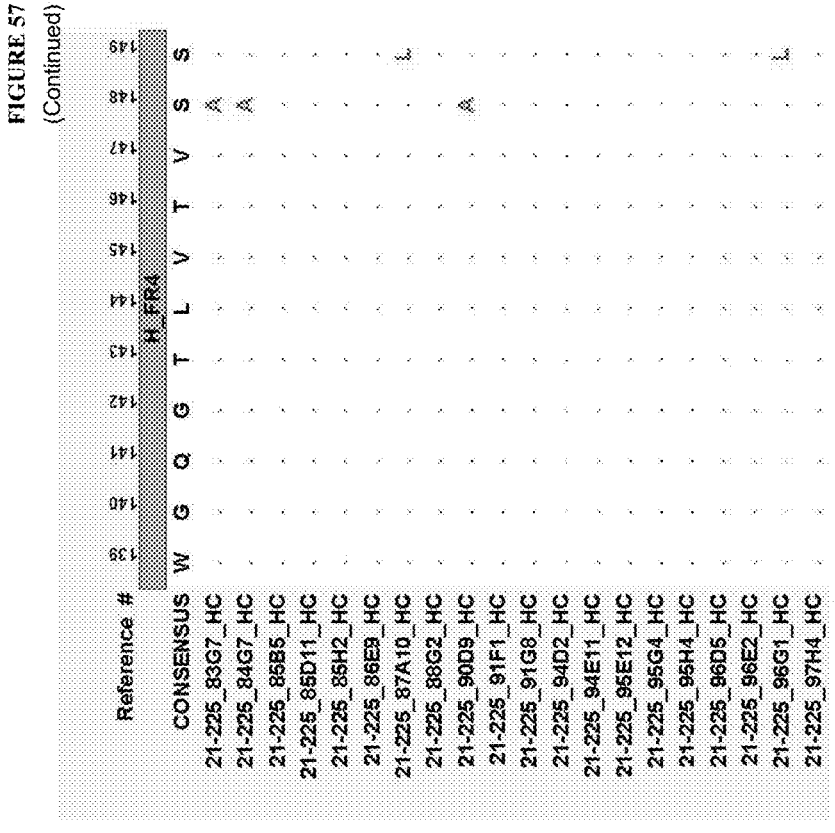
Figure 57:
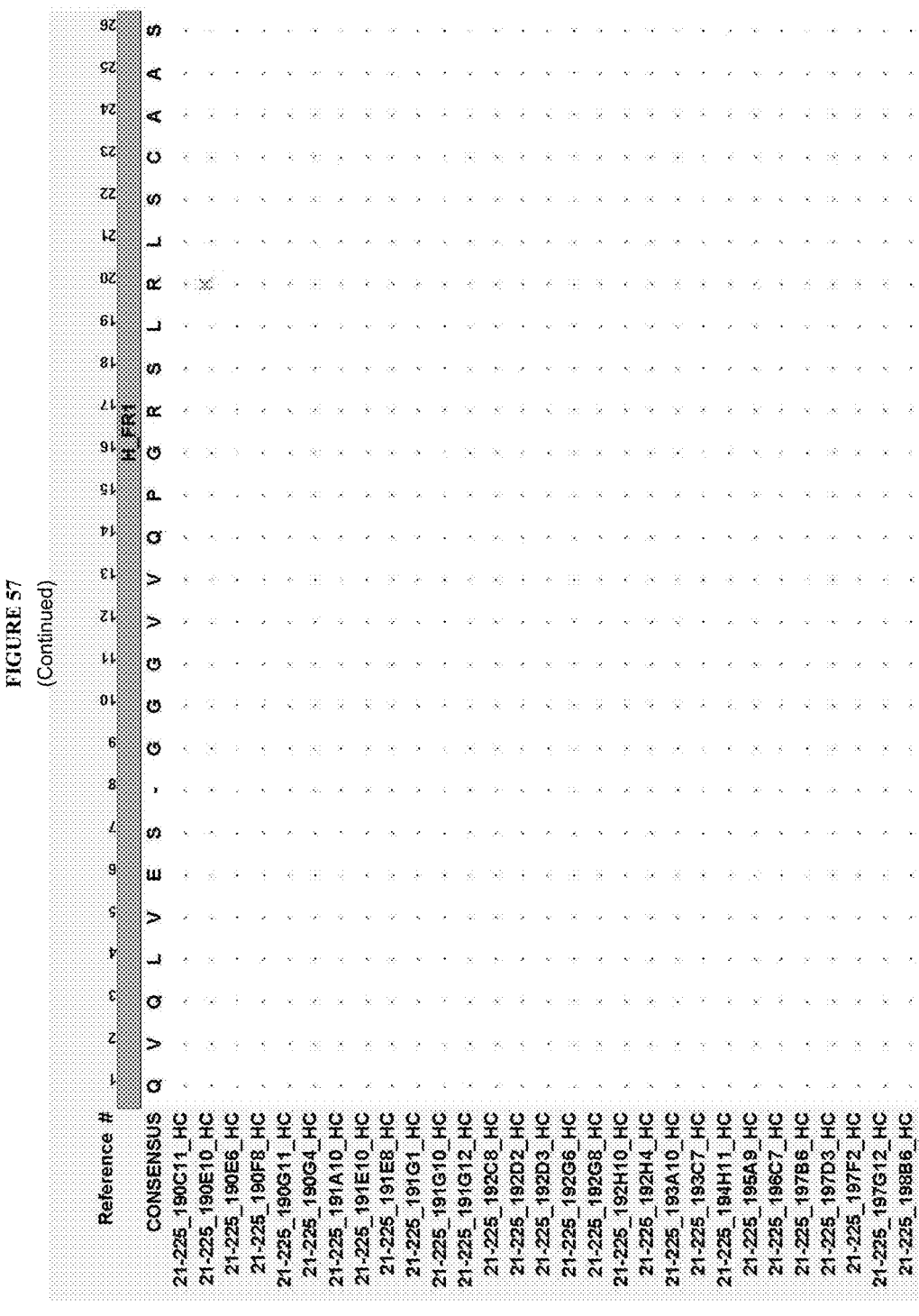
Figure 57:
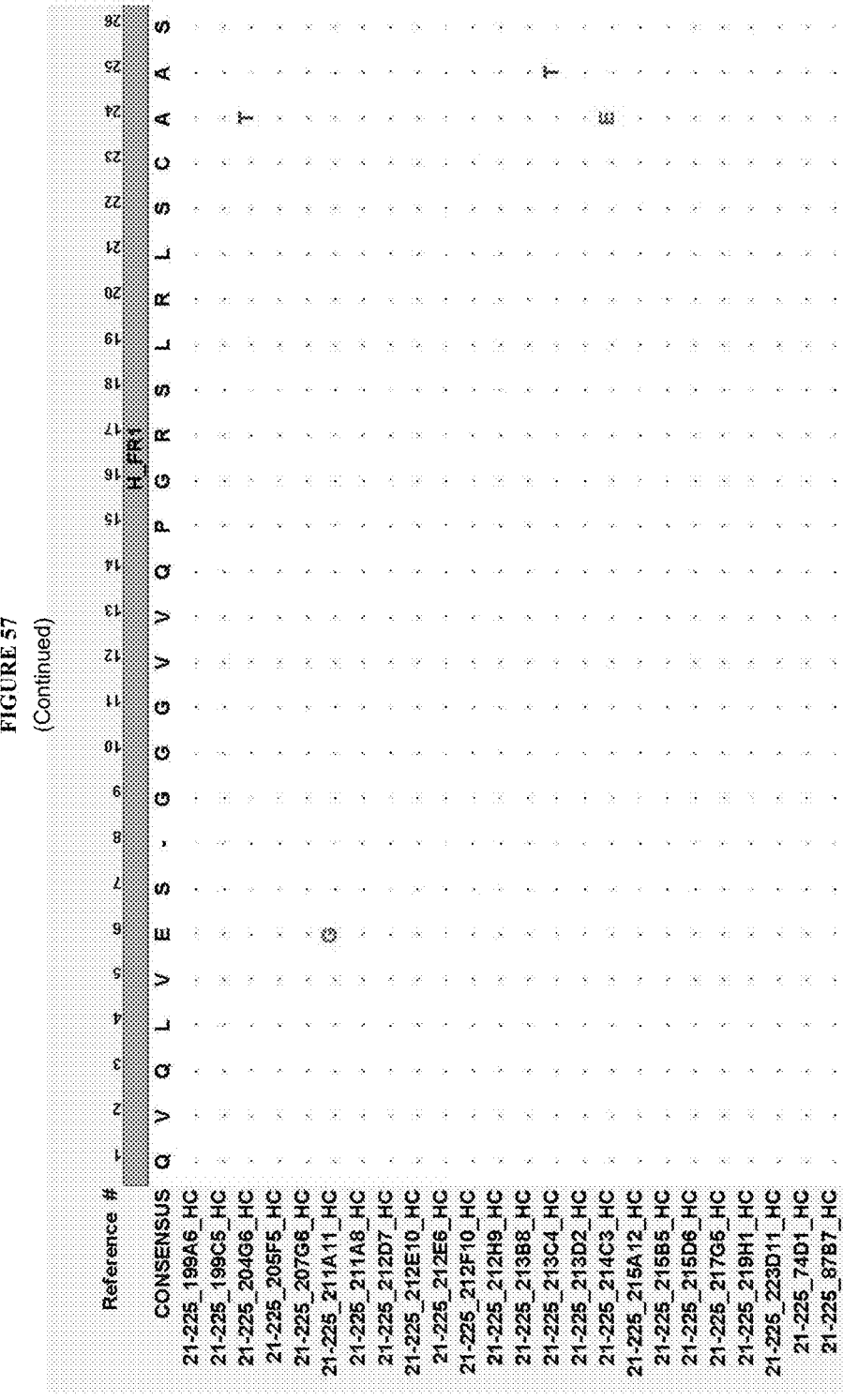
Figure 57:
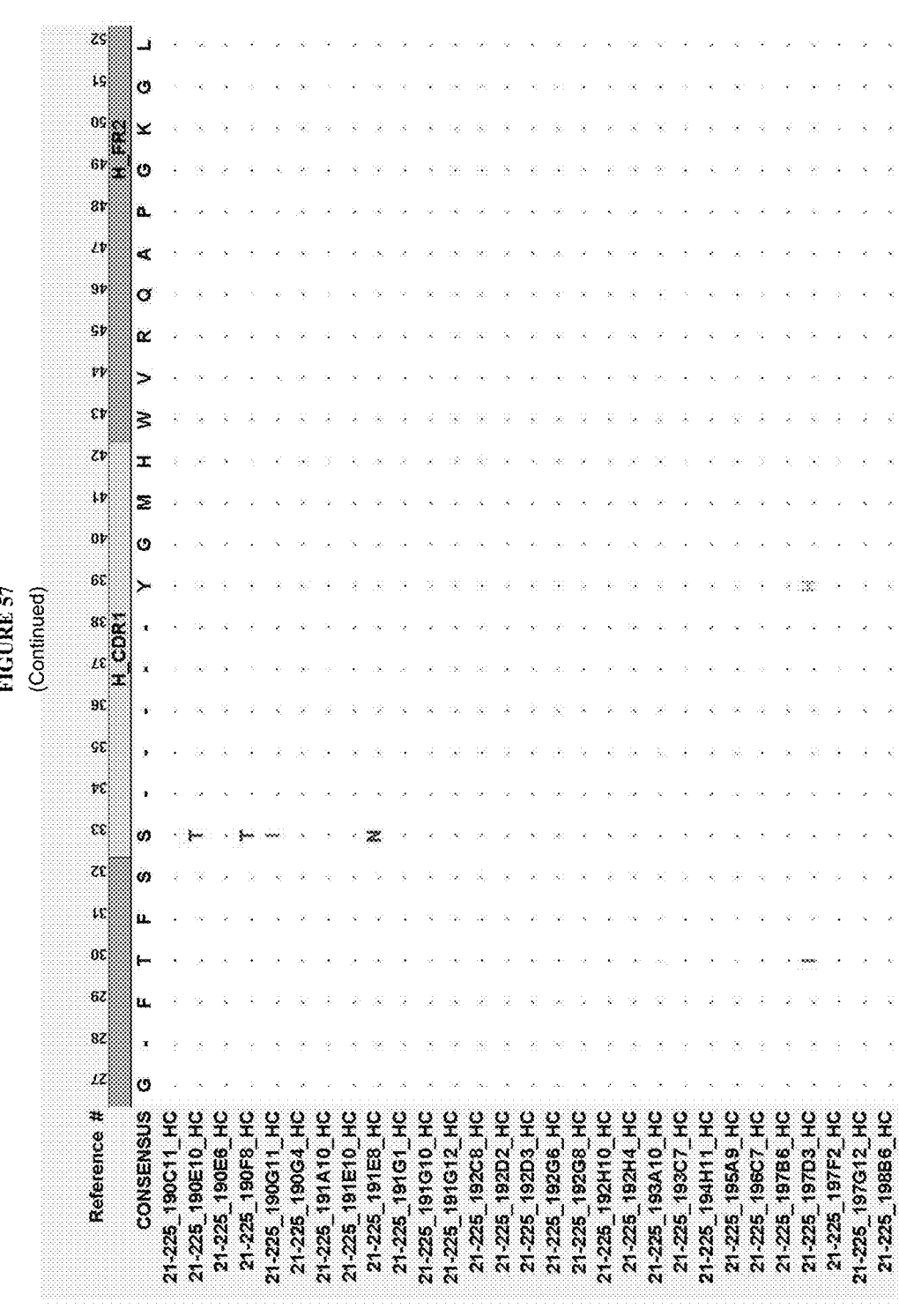
Figure 57:
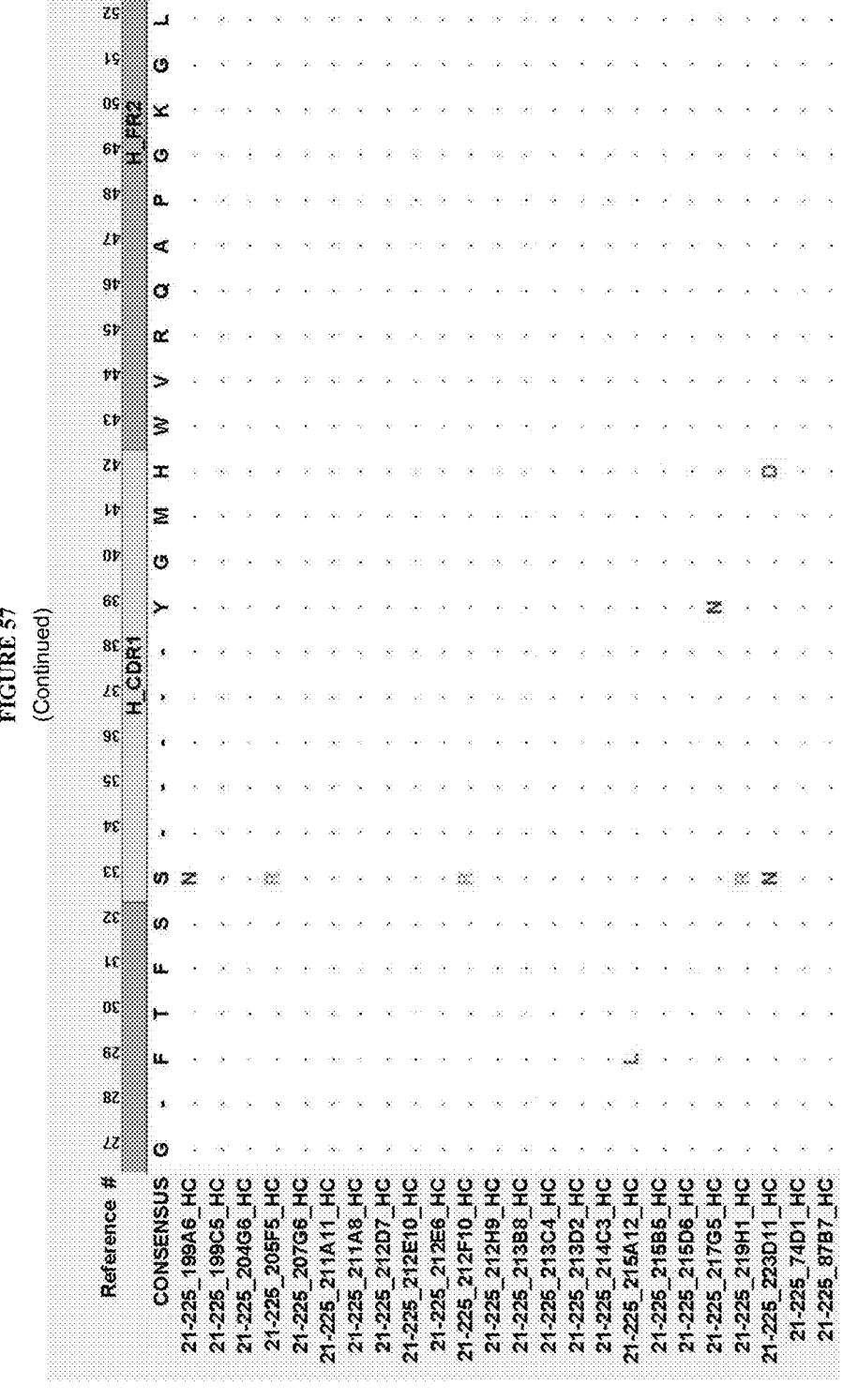
Figure 57:
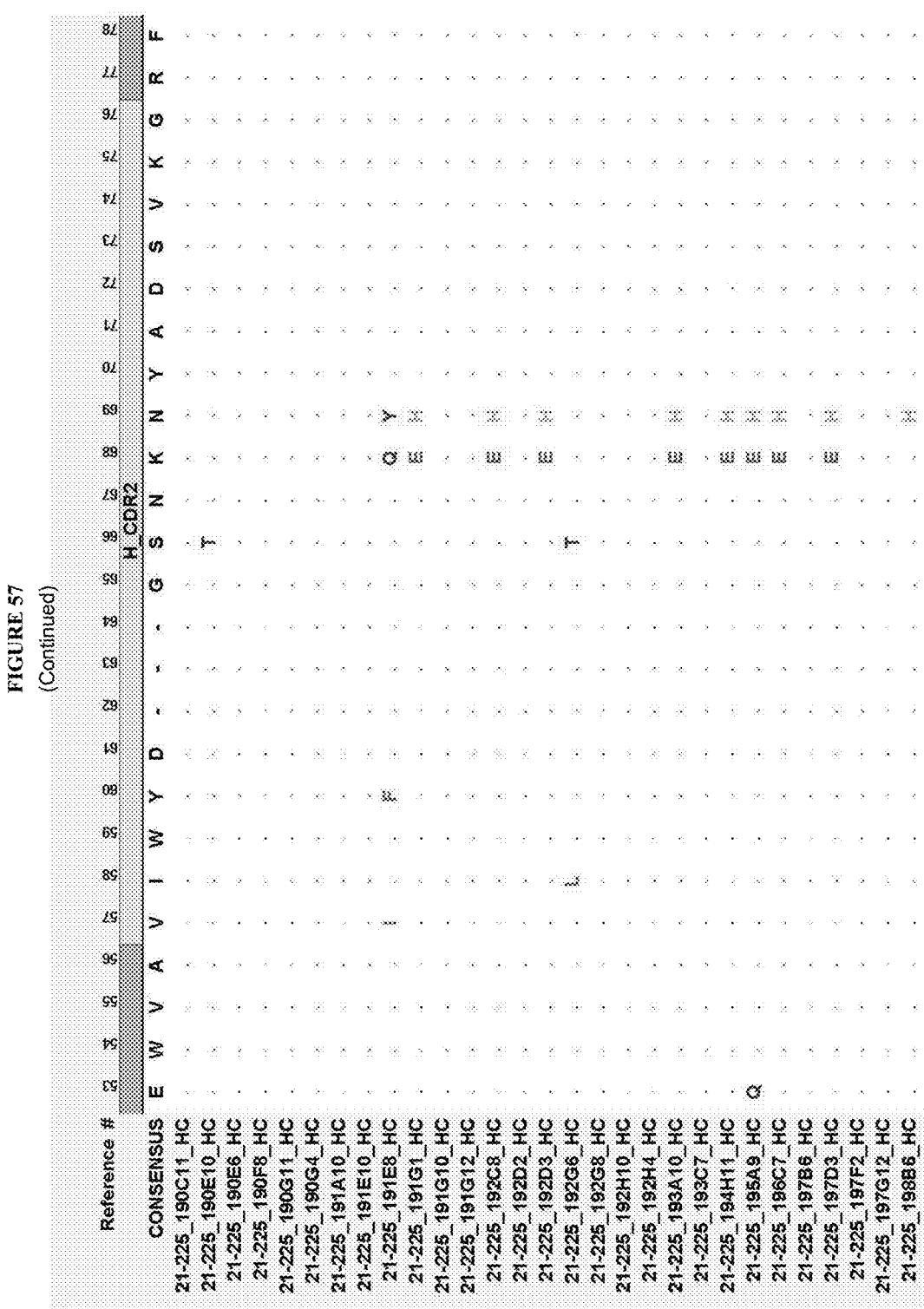
Figure 57:
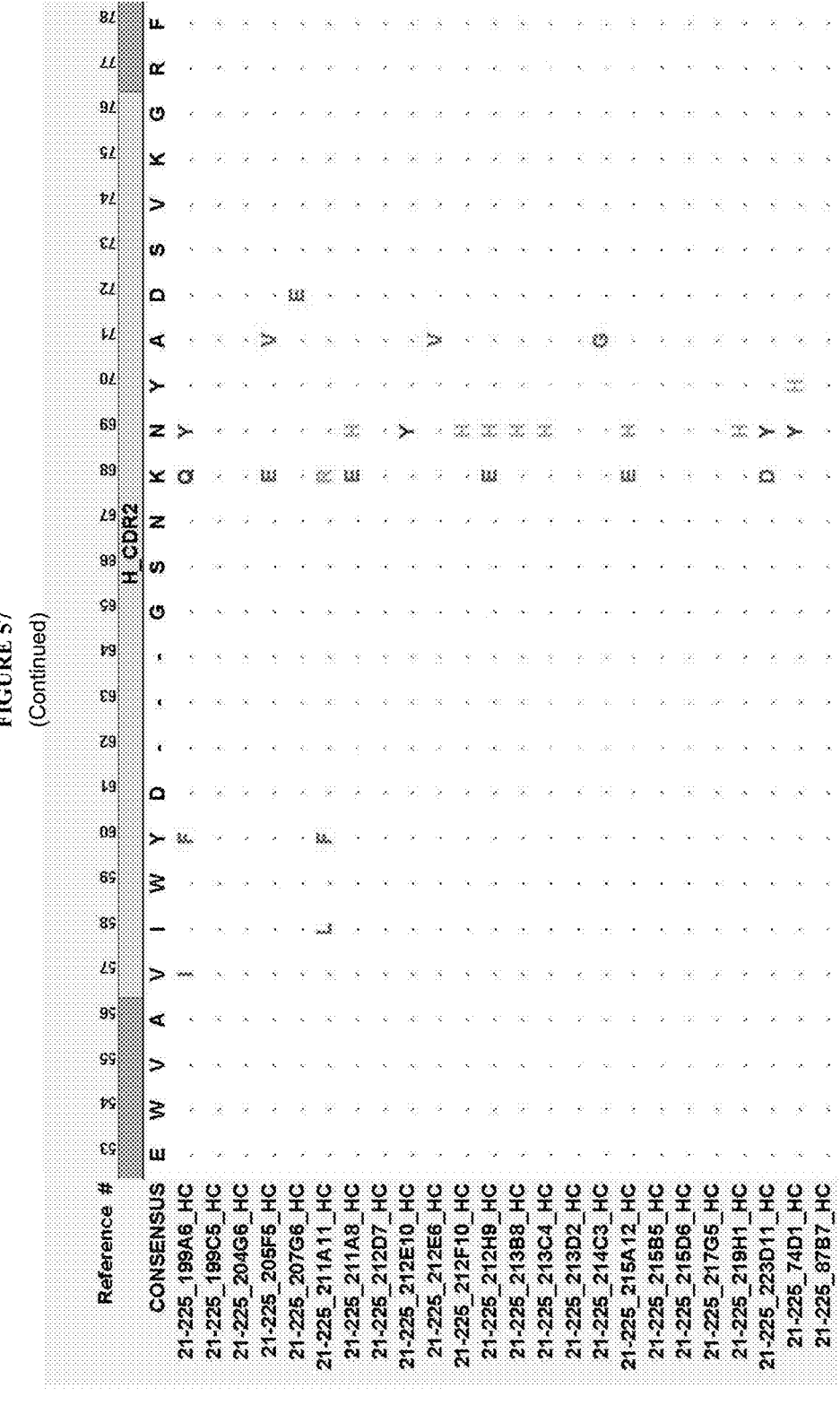
Figure 57:
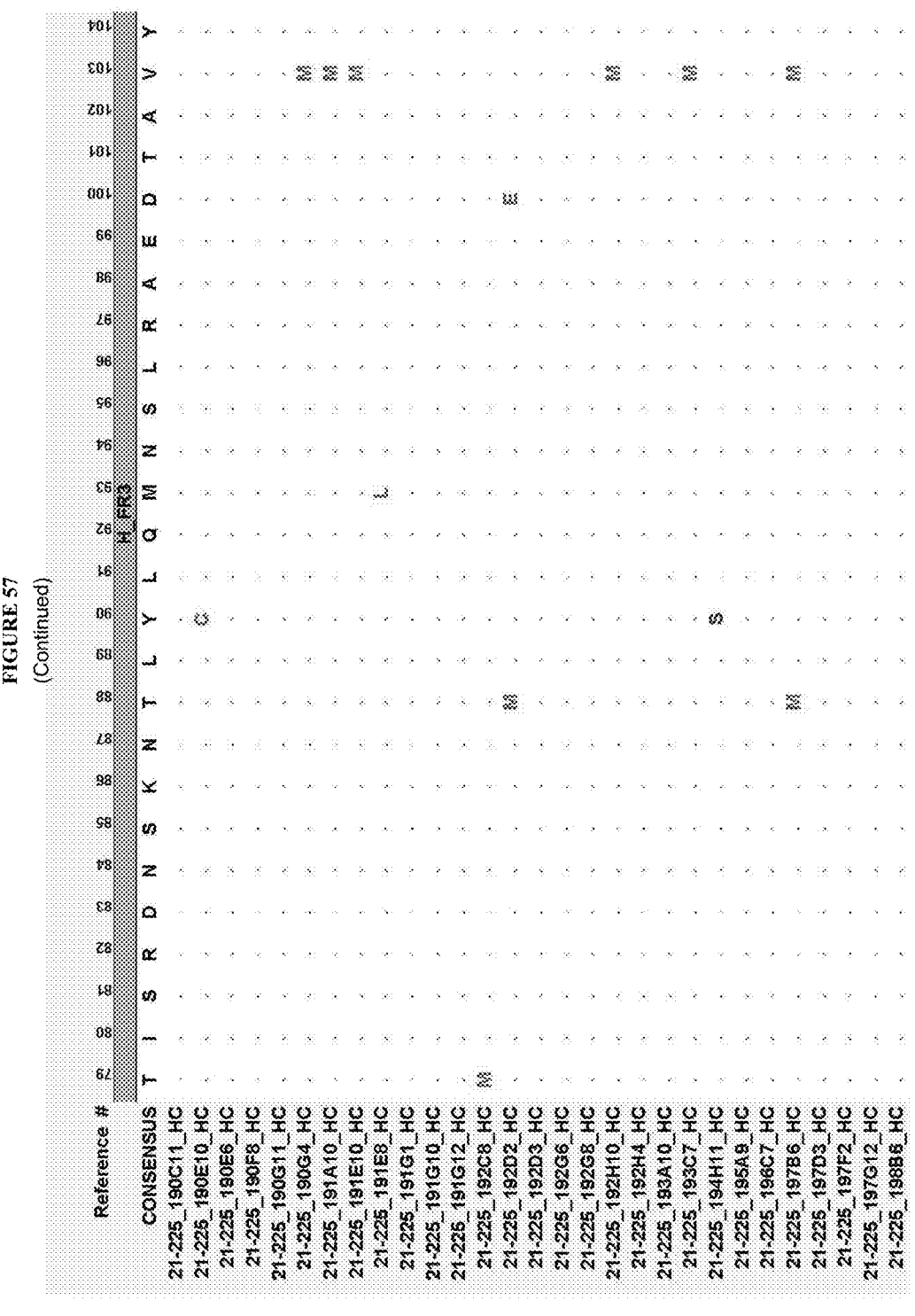
Figure 57:
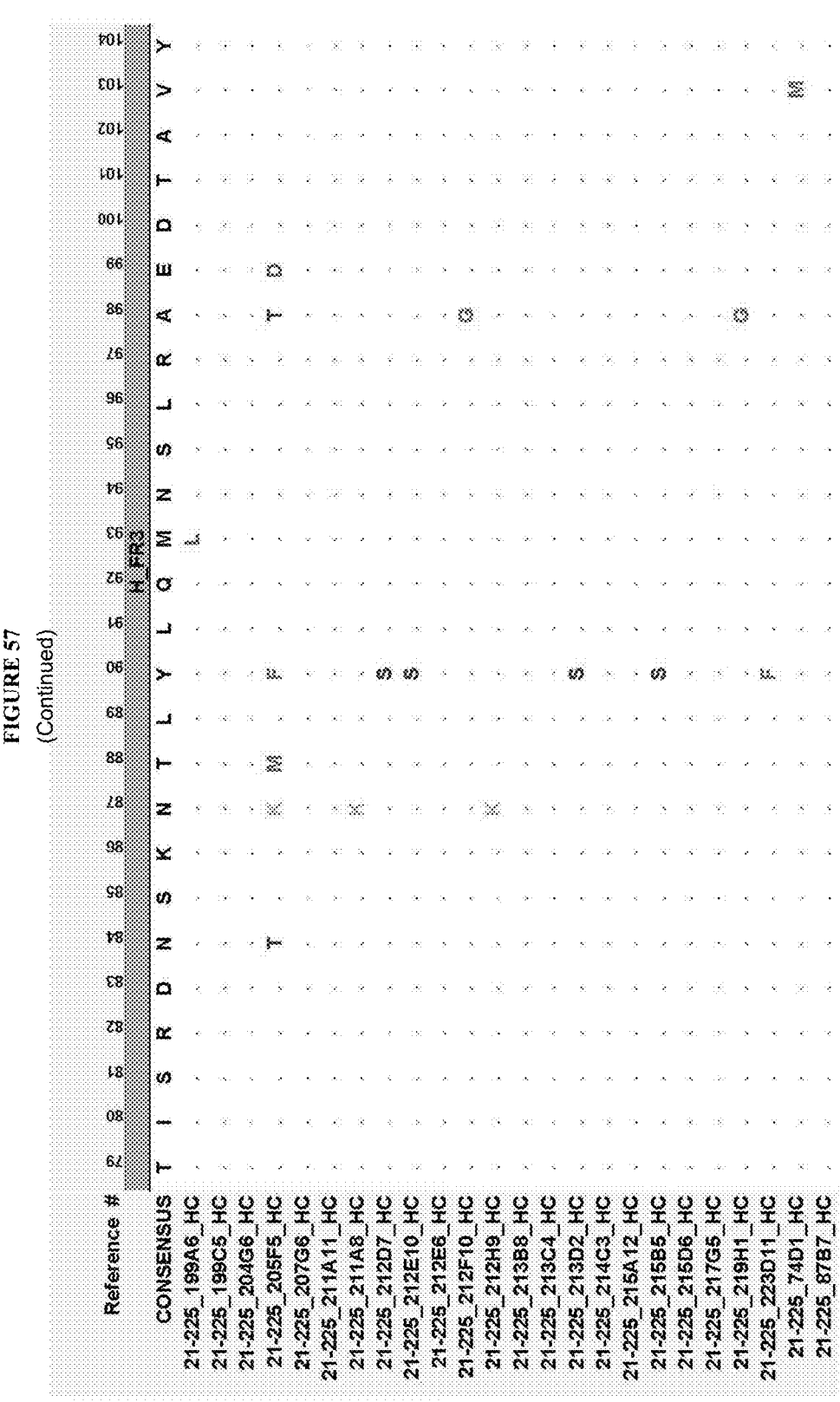
Figure 57:
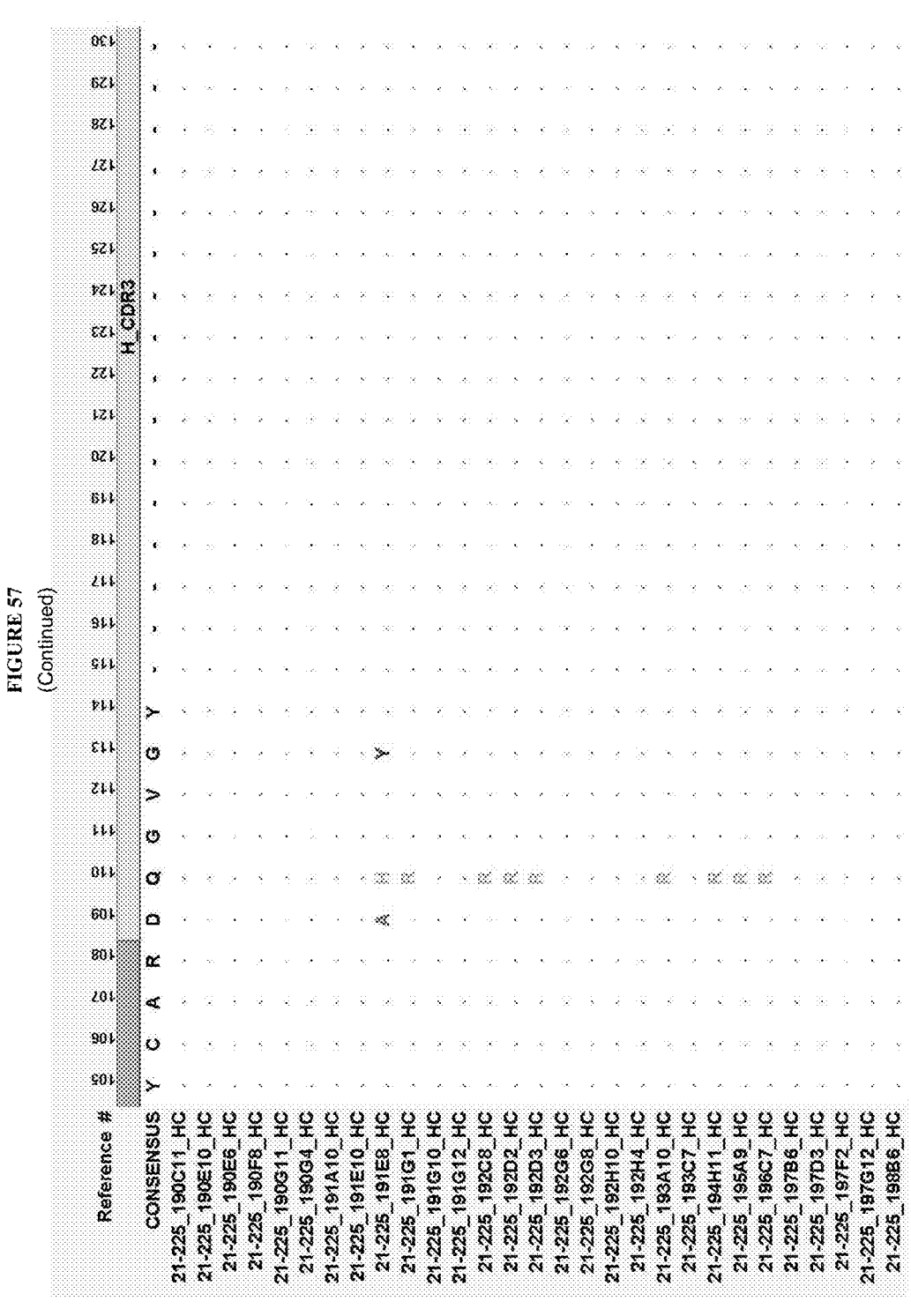
Figure 57:
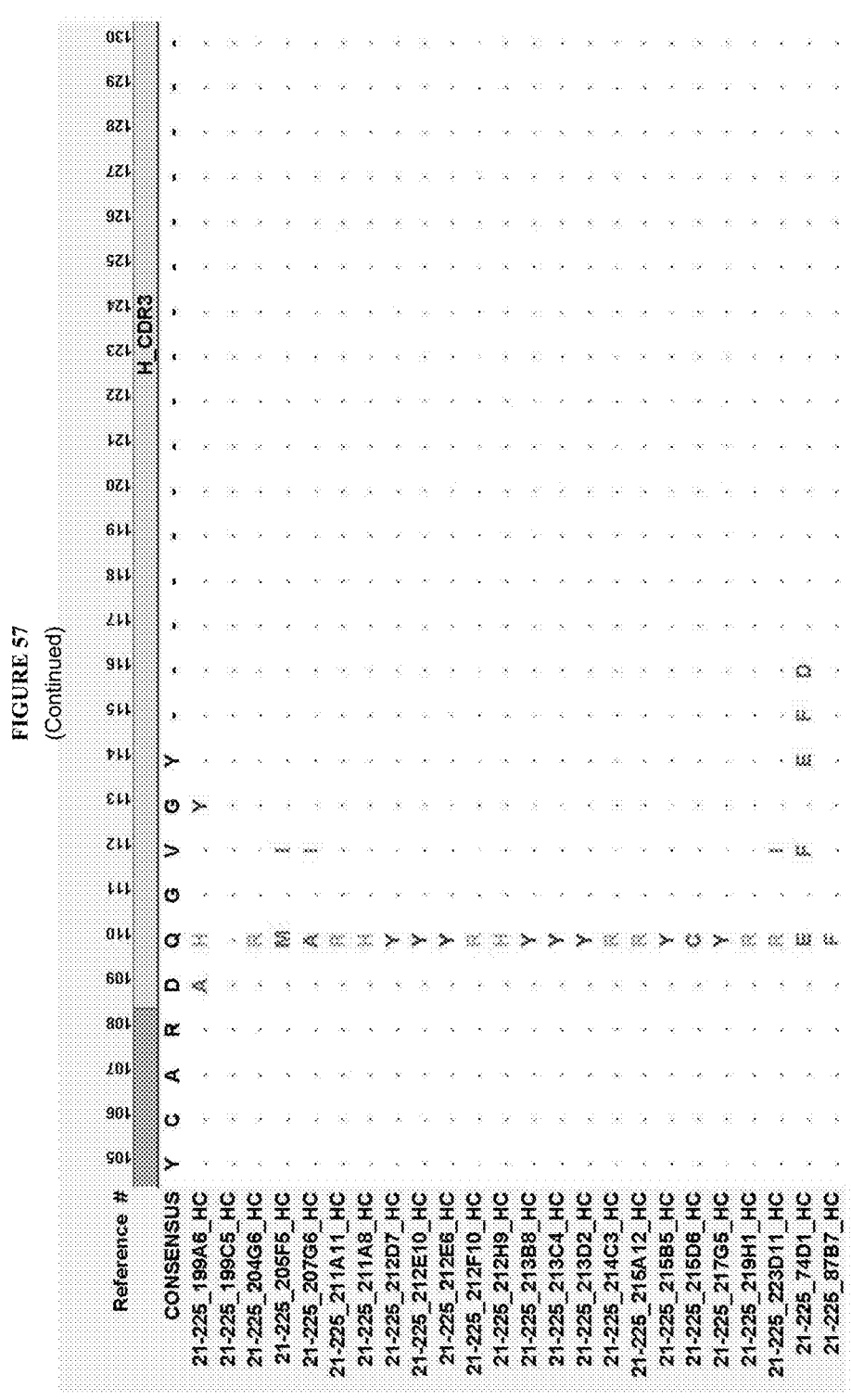
Figure 57:
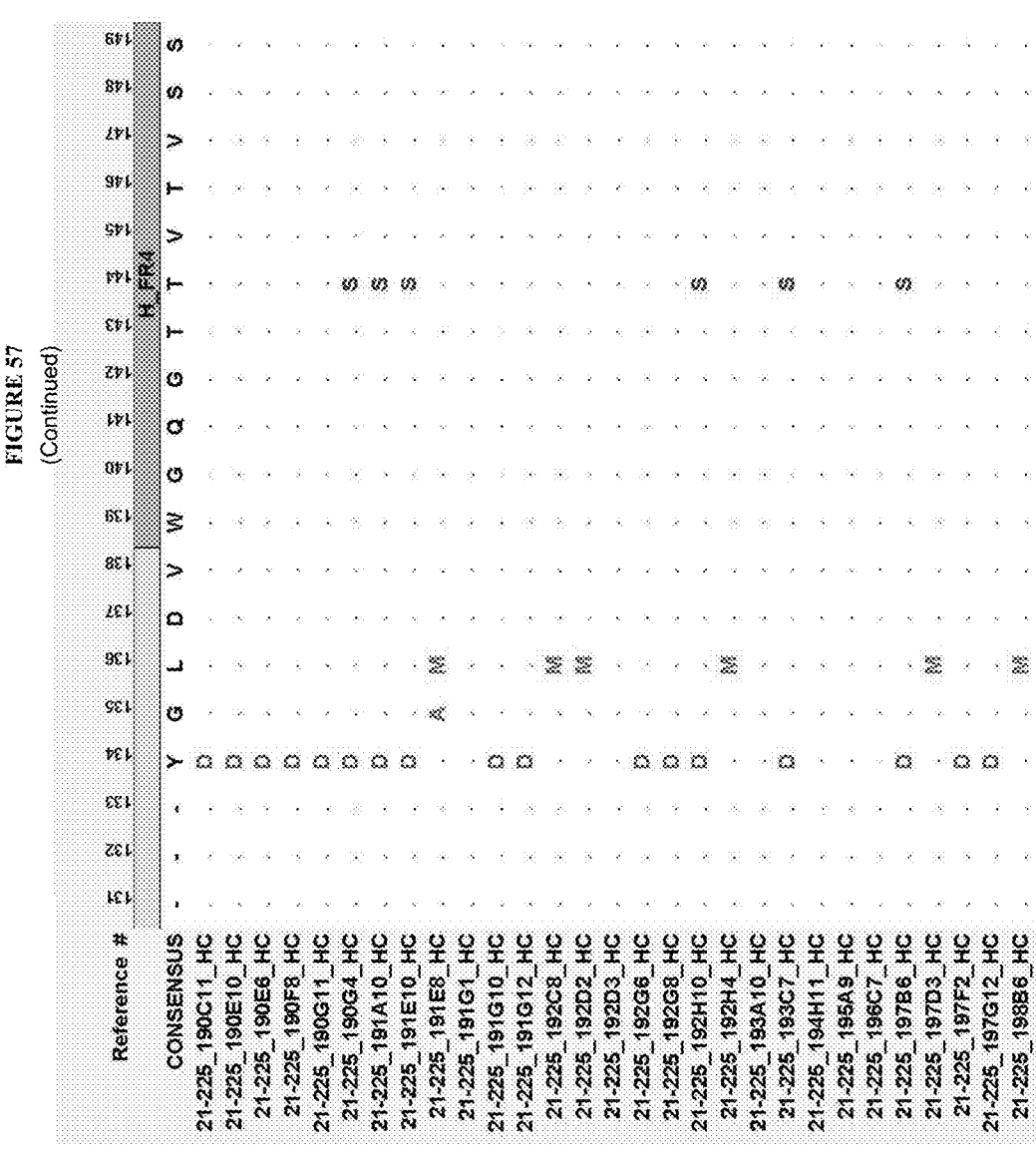
Figure 57:
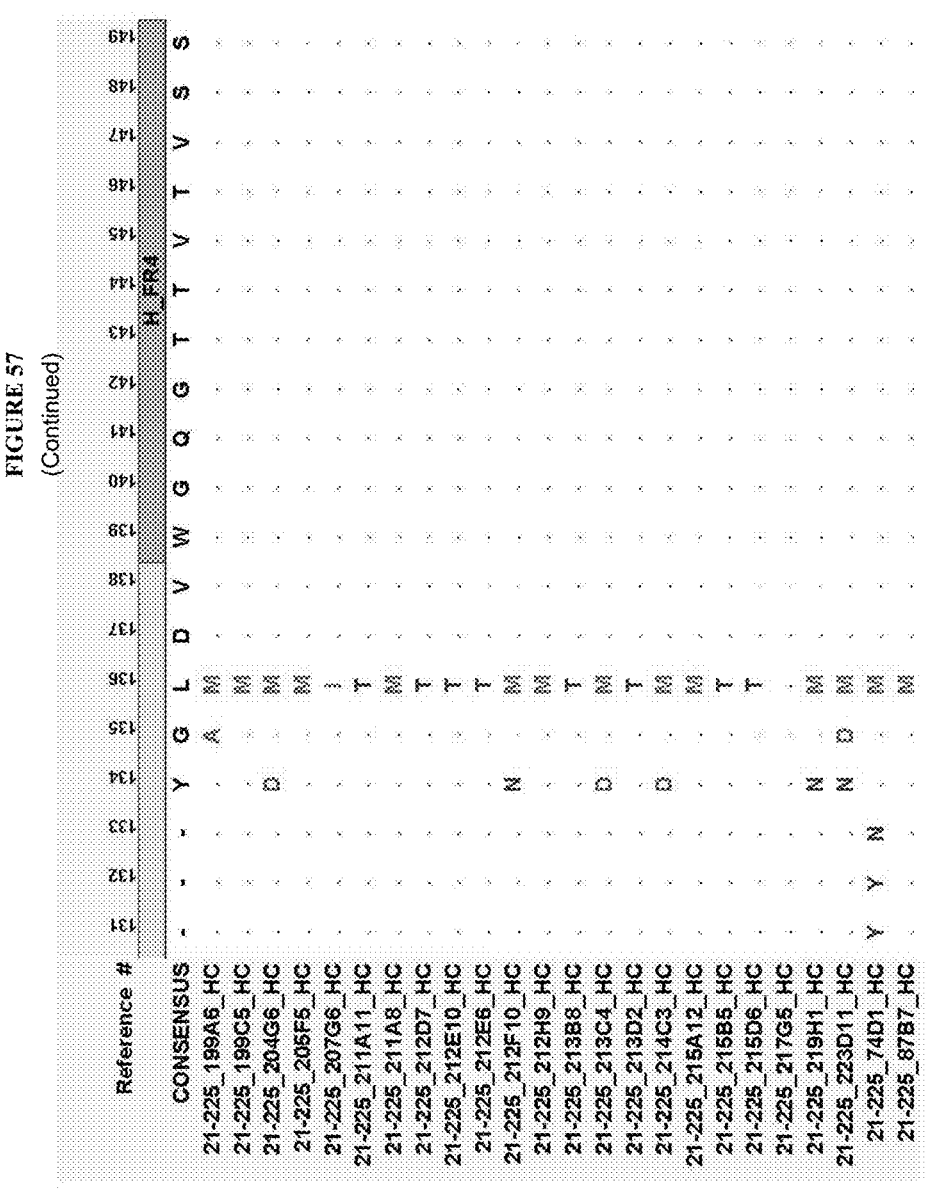
Figure 57:
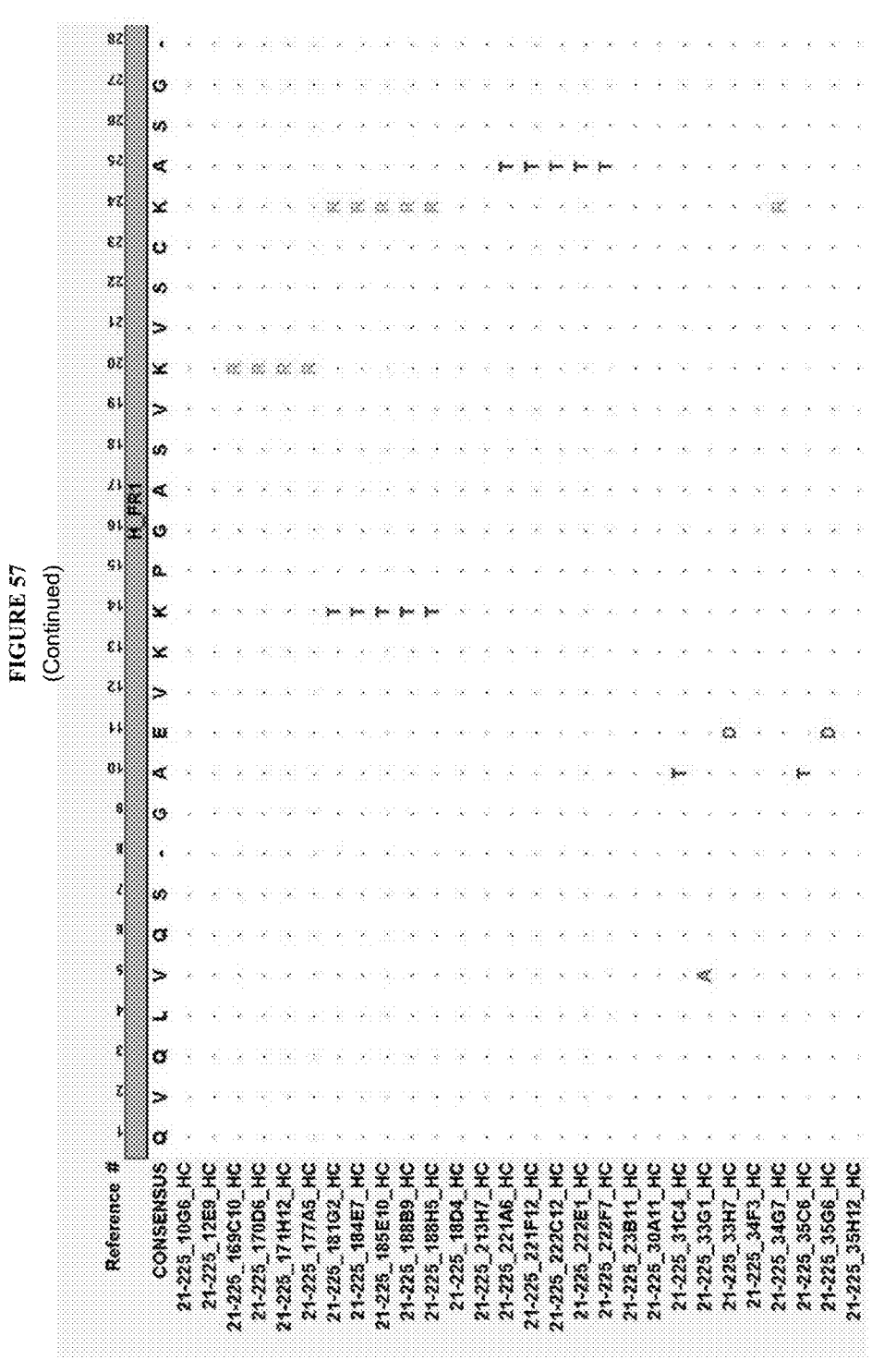
Figure 57:
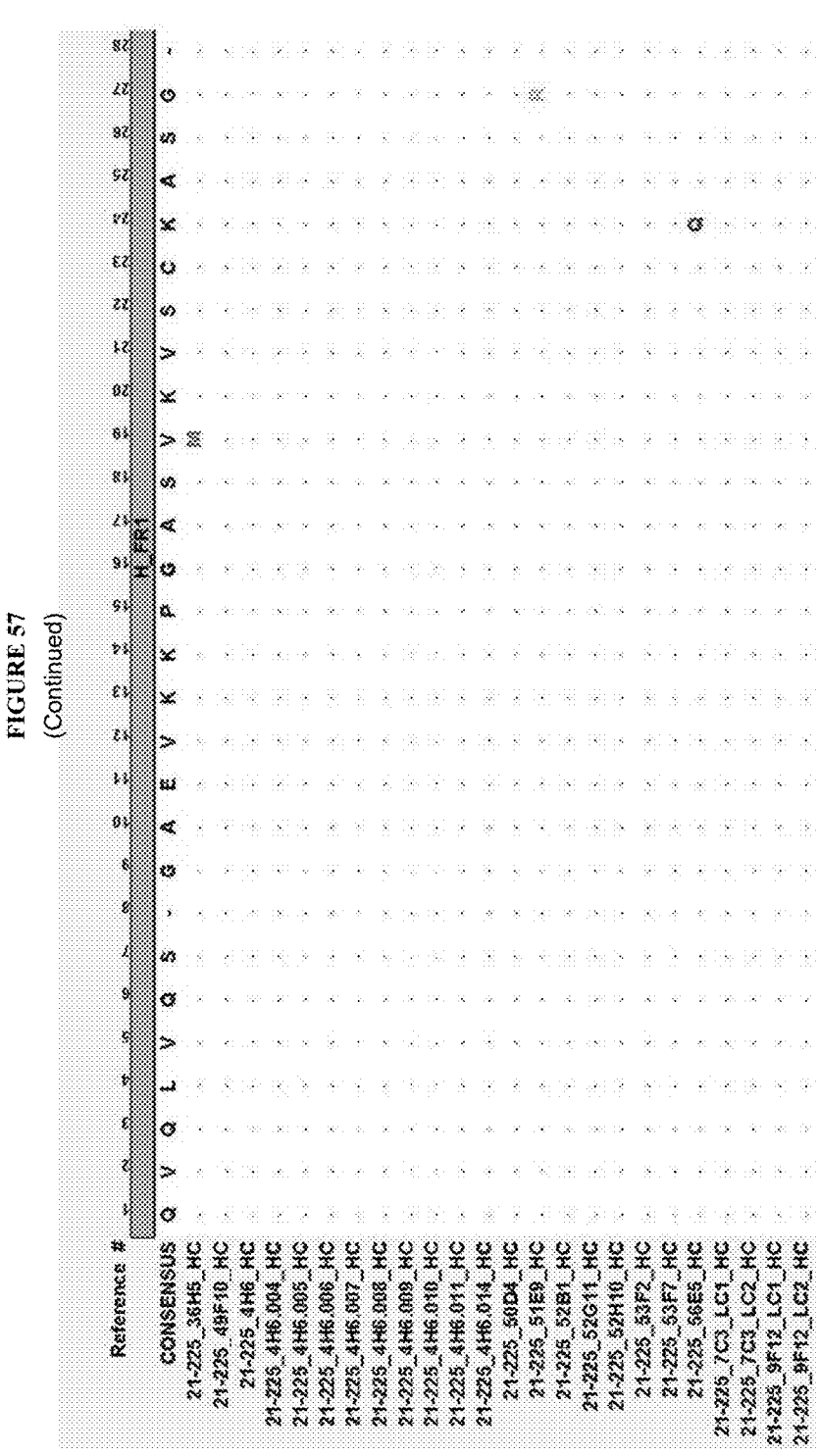
Figure 57:
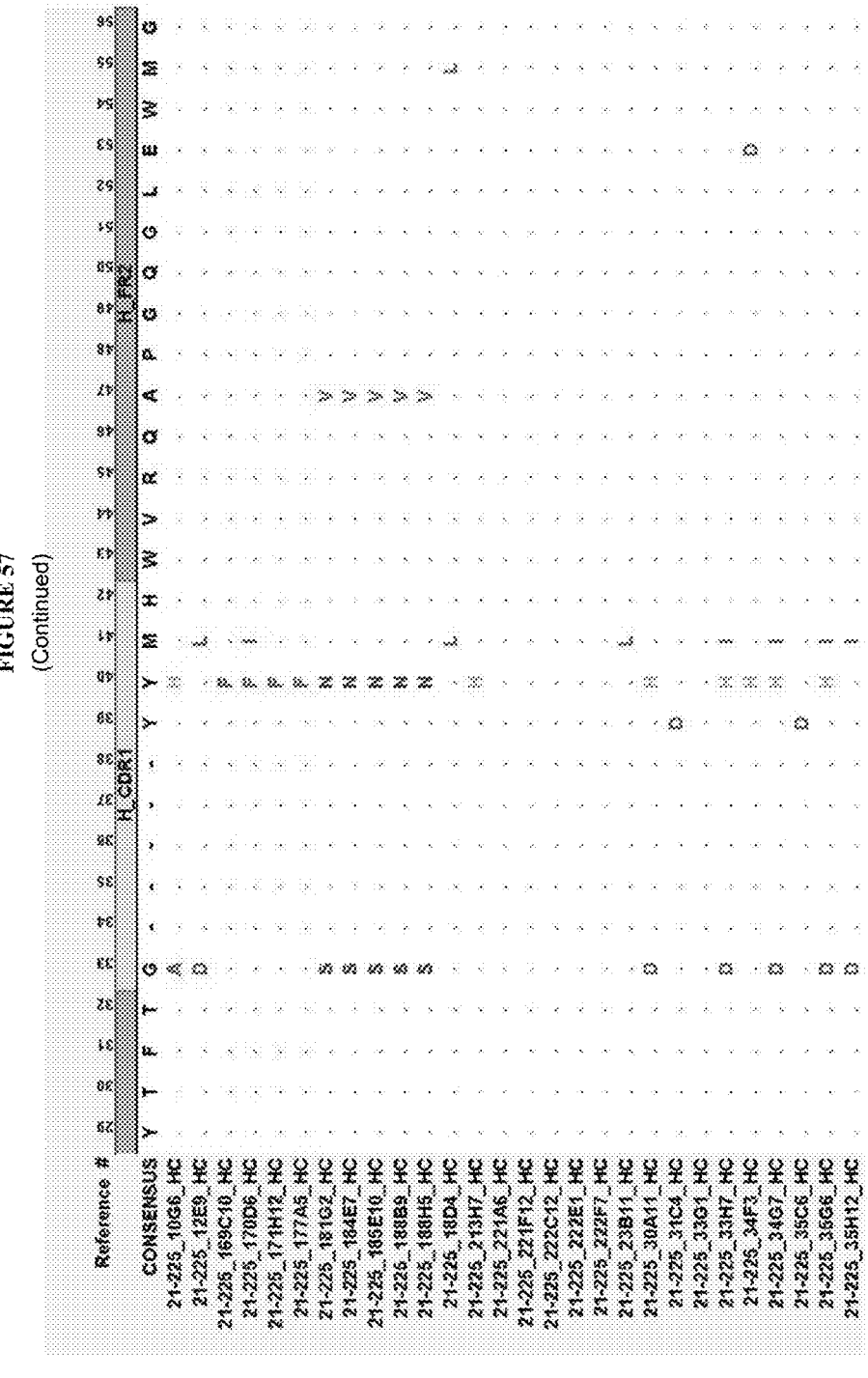
Figure 57:
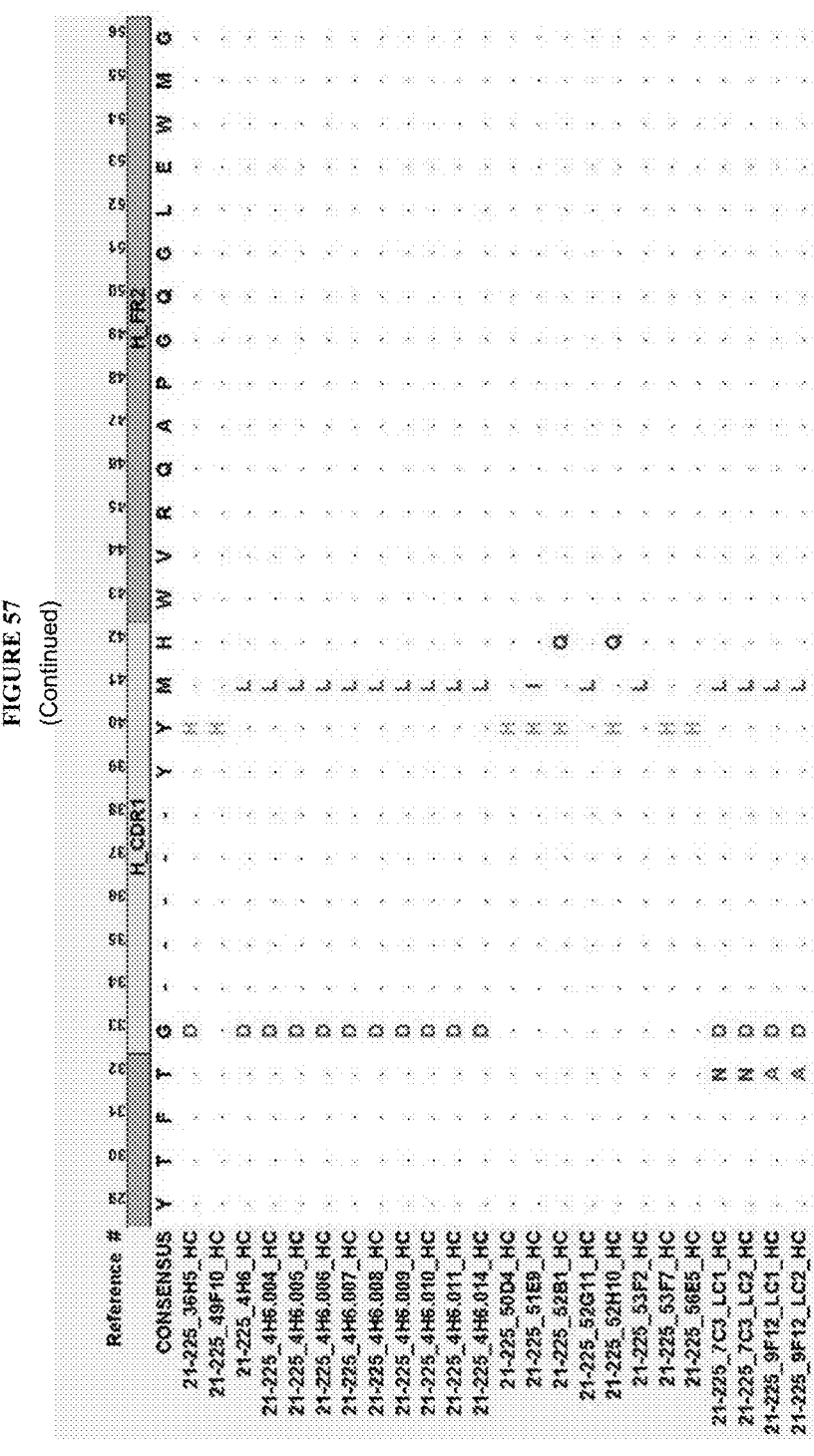
Figure 57:
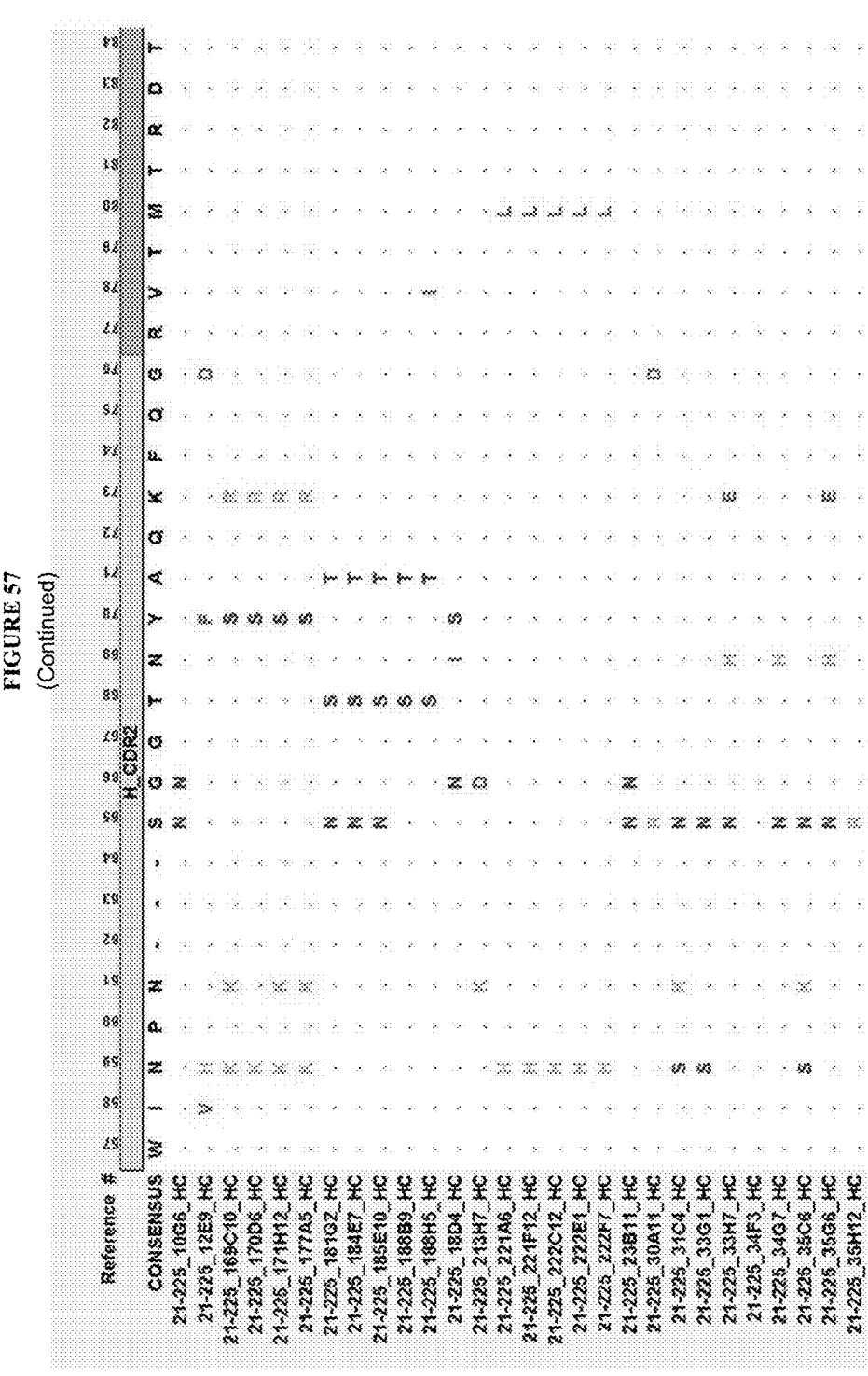
Figure 57:
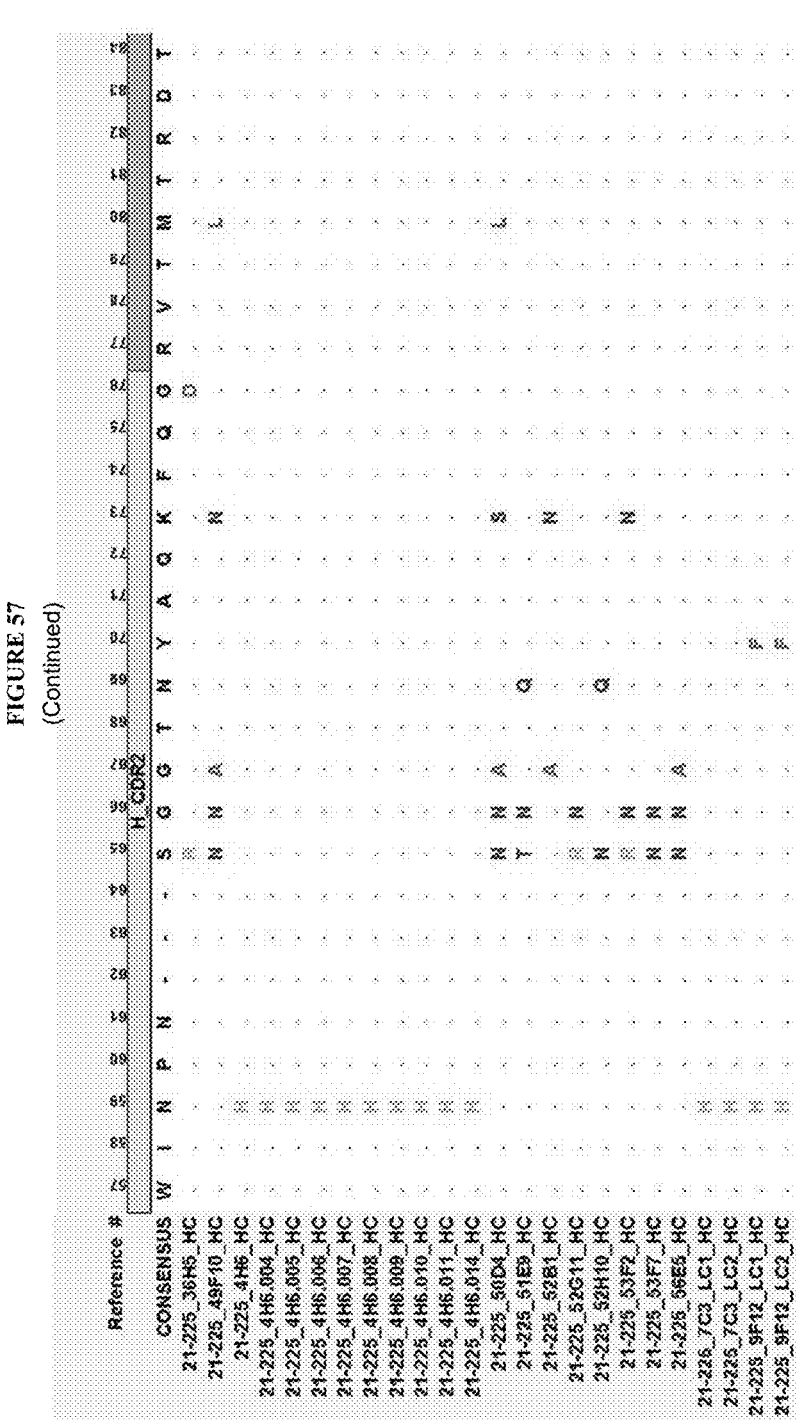
Figure 57:
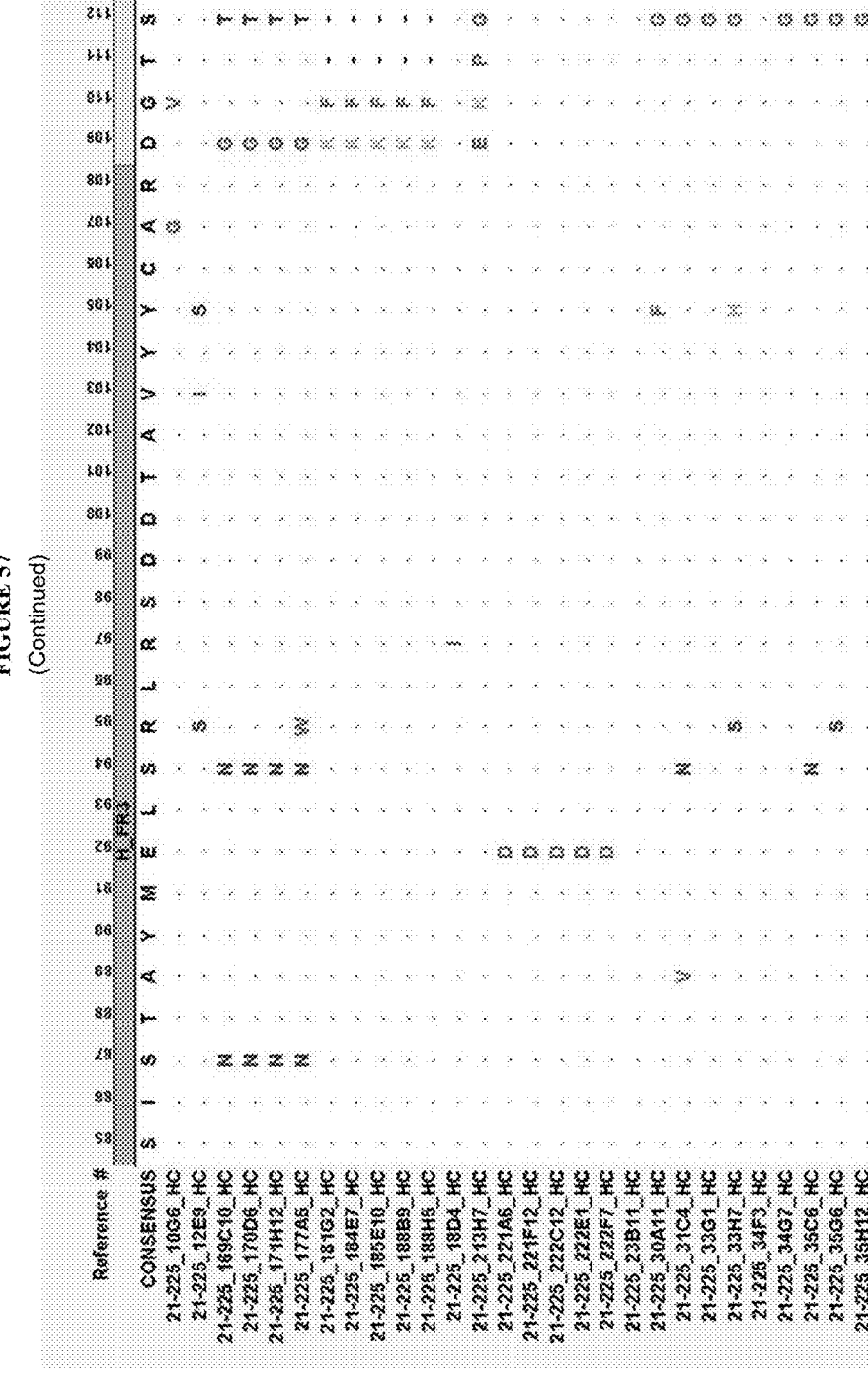
Figure 57:
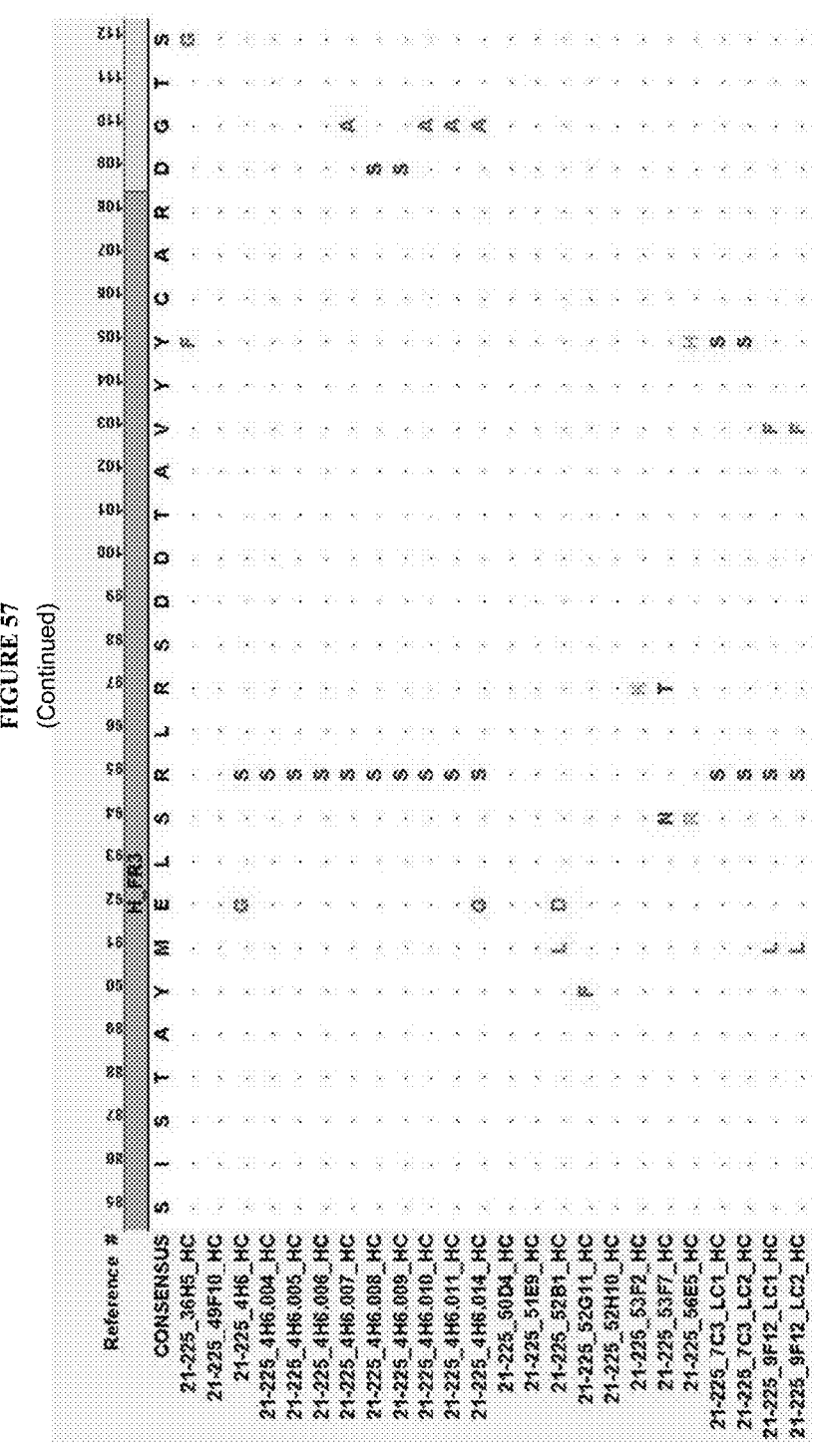
Figure 57:
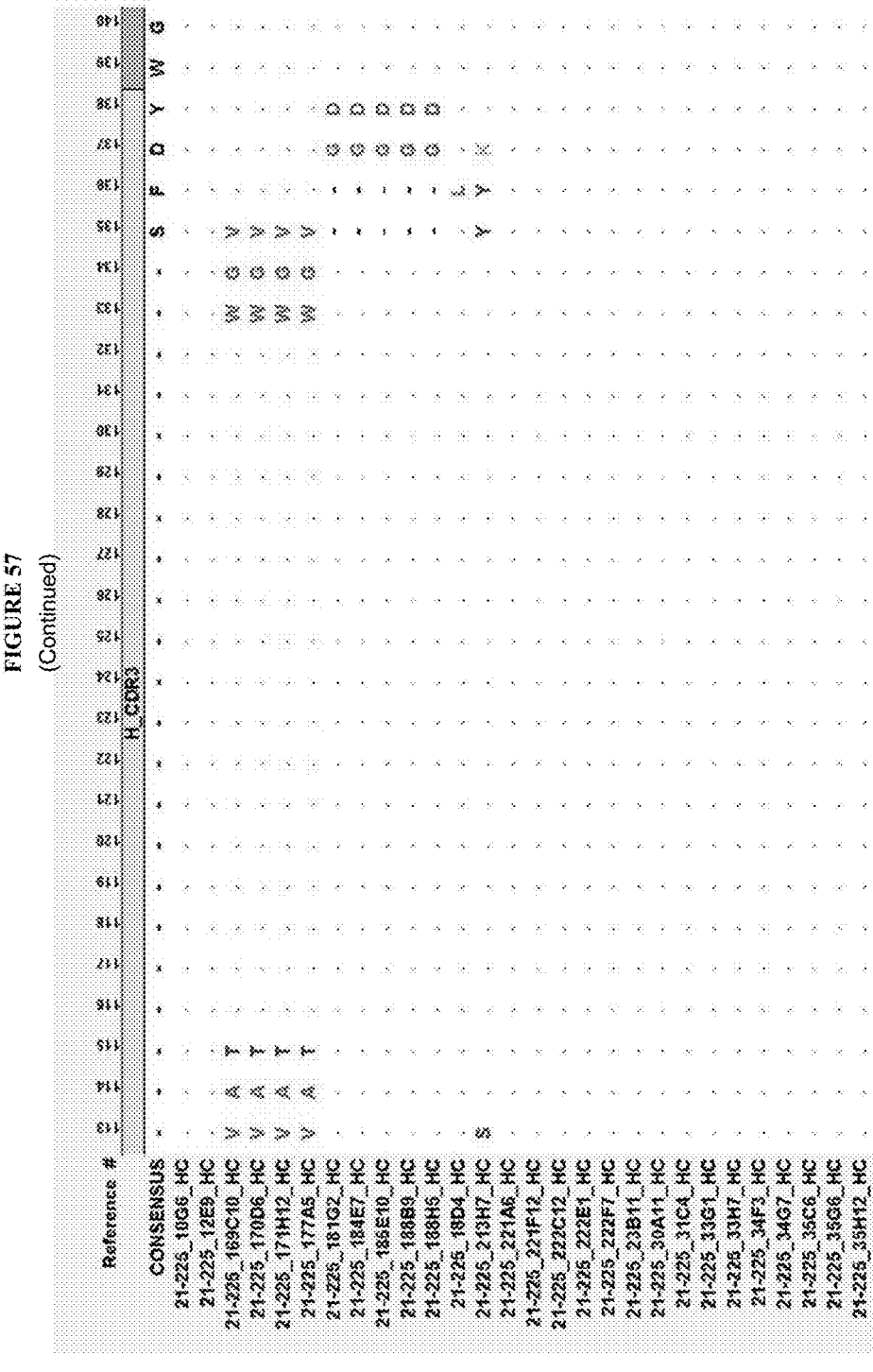
Figure 57:
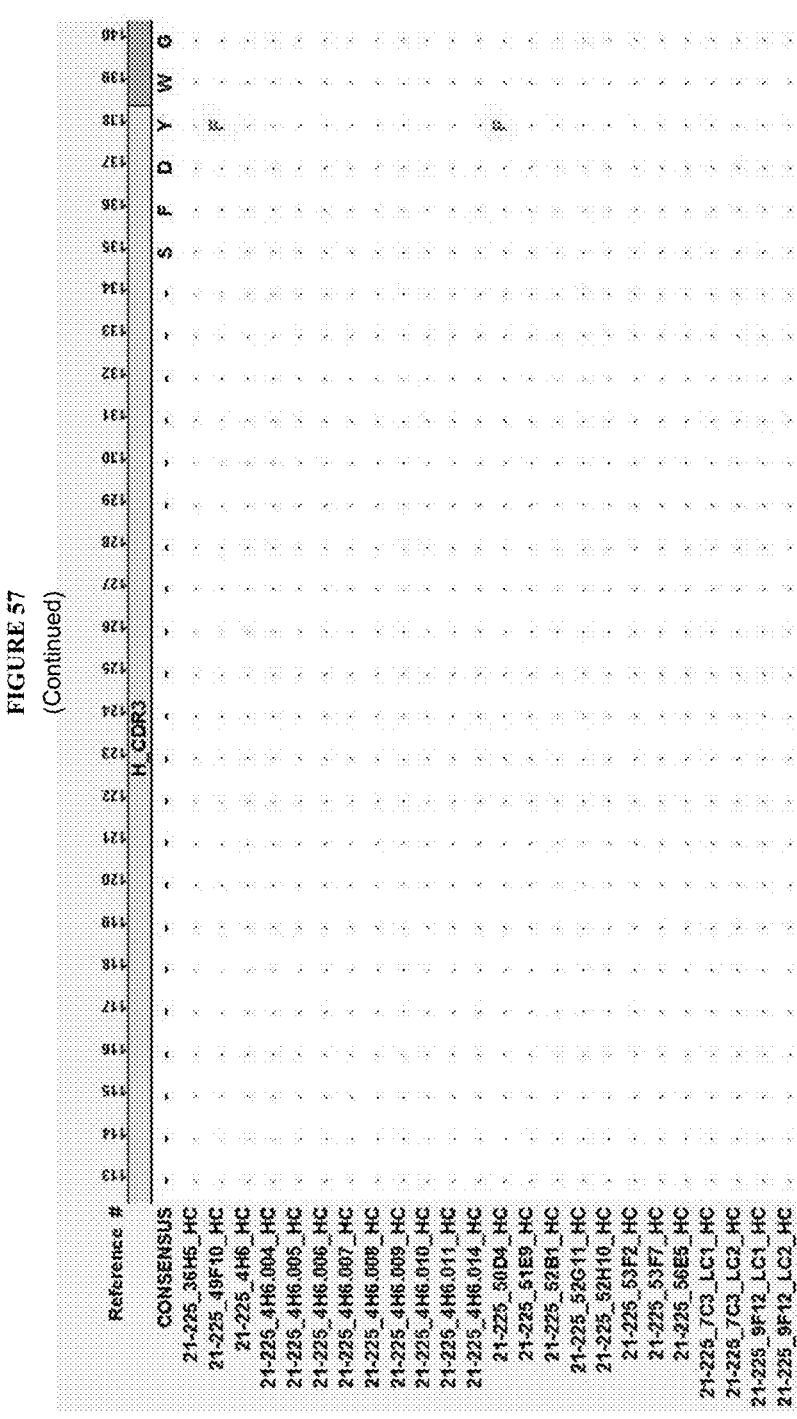
Figure 57:
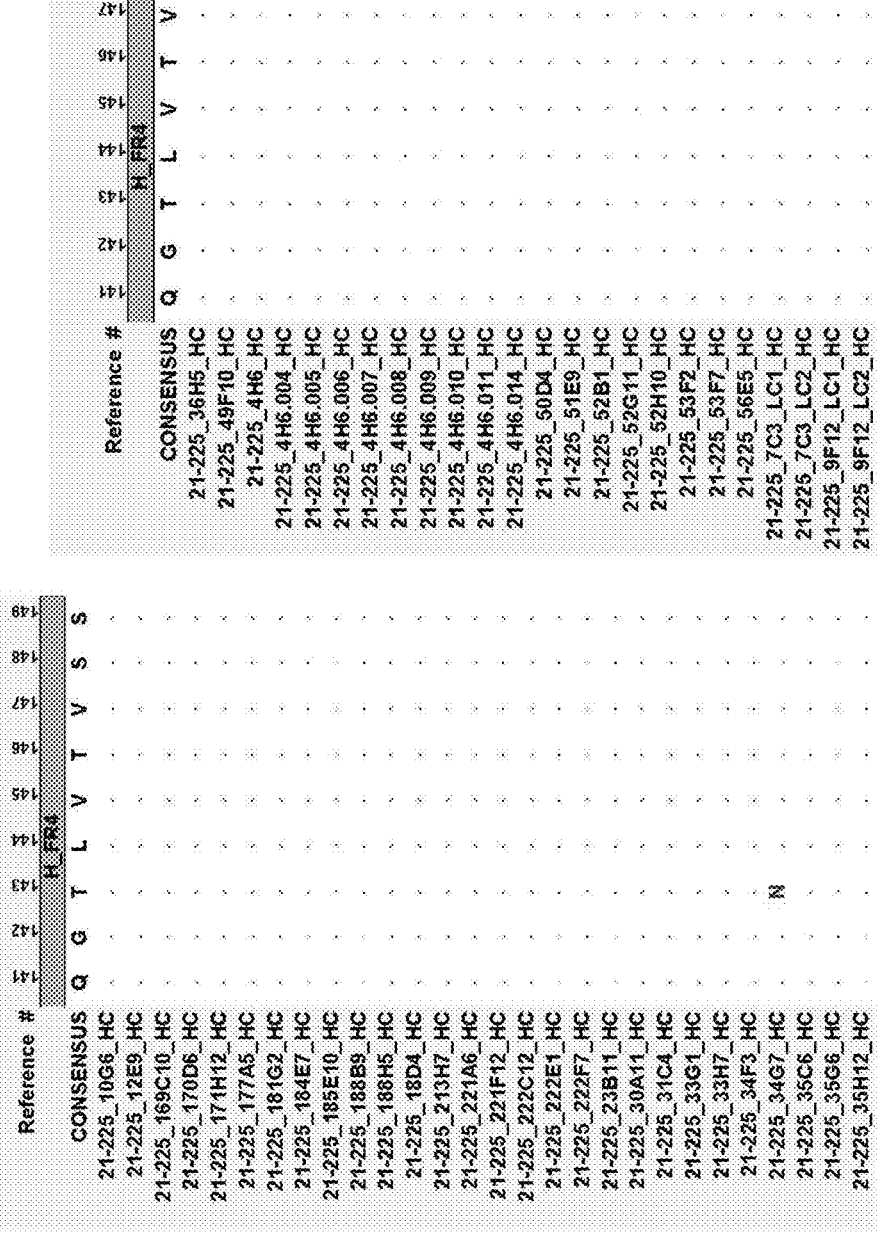
Figure 57:
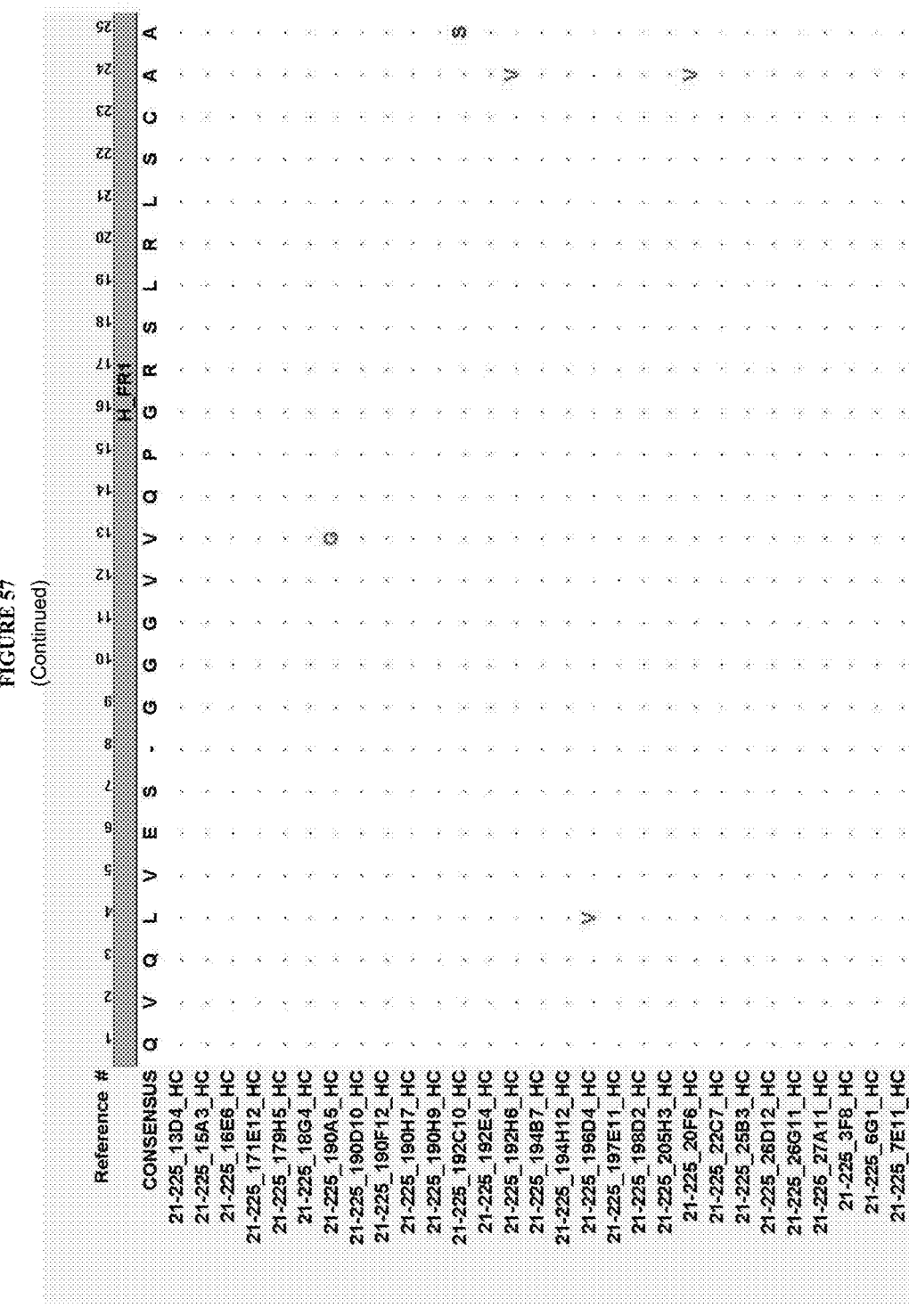
Figure 57:
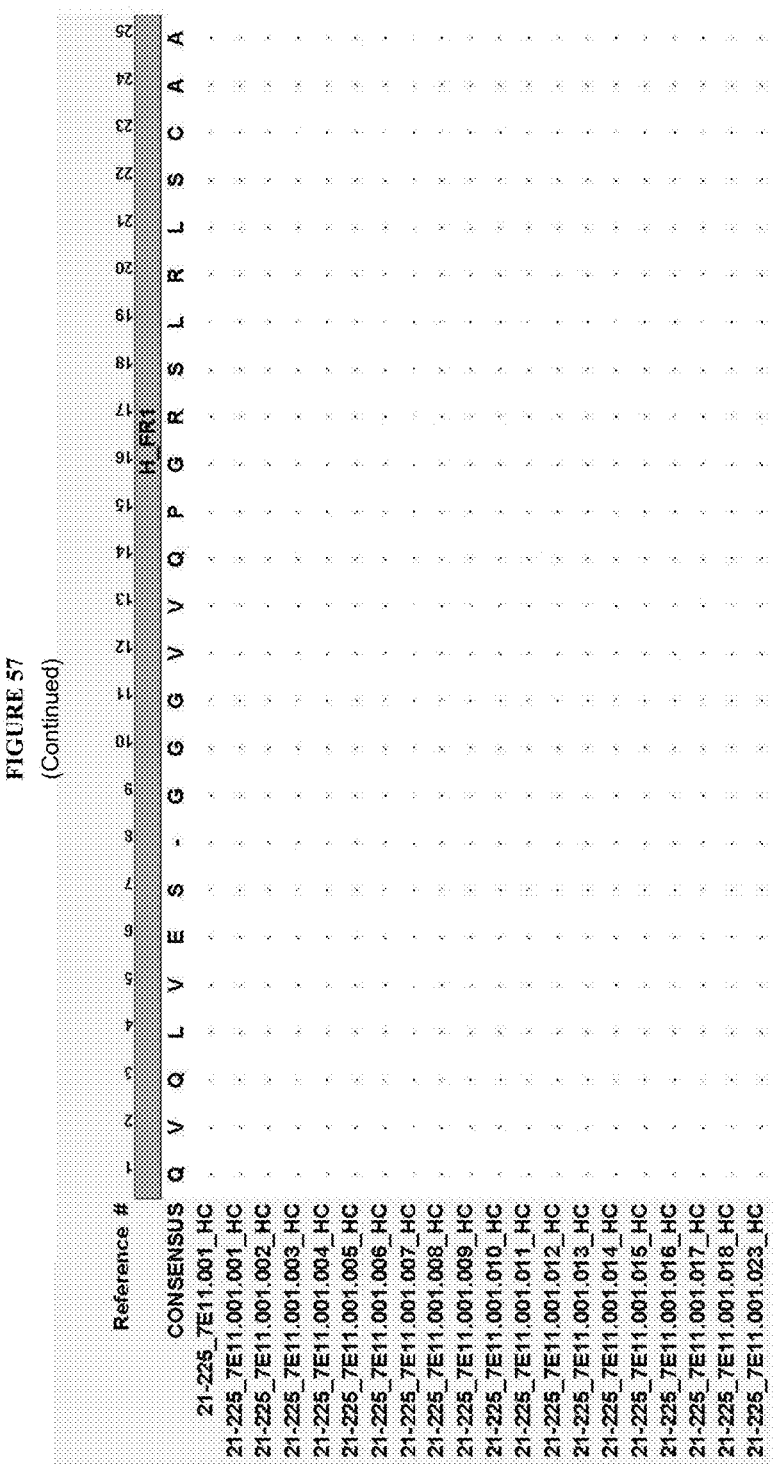
Figure 57:
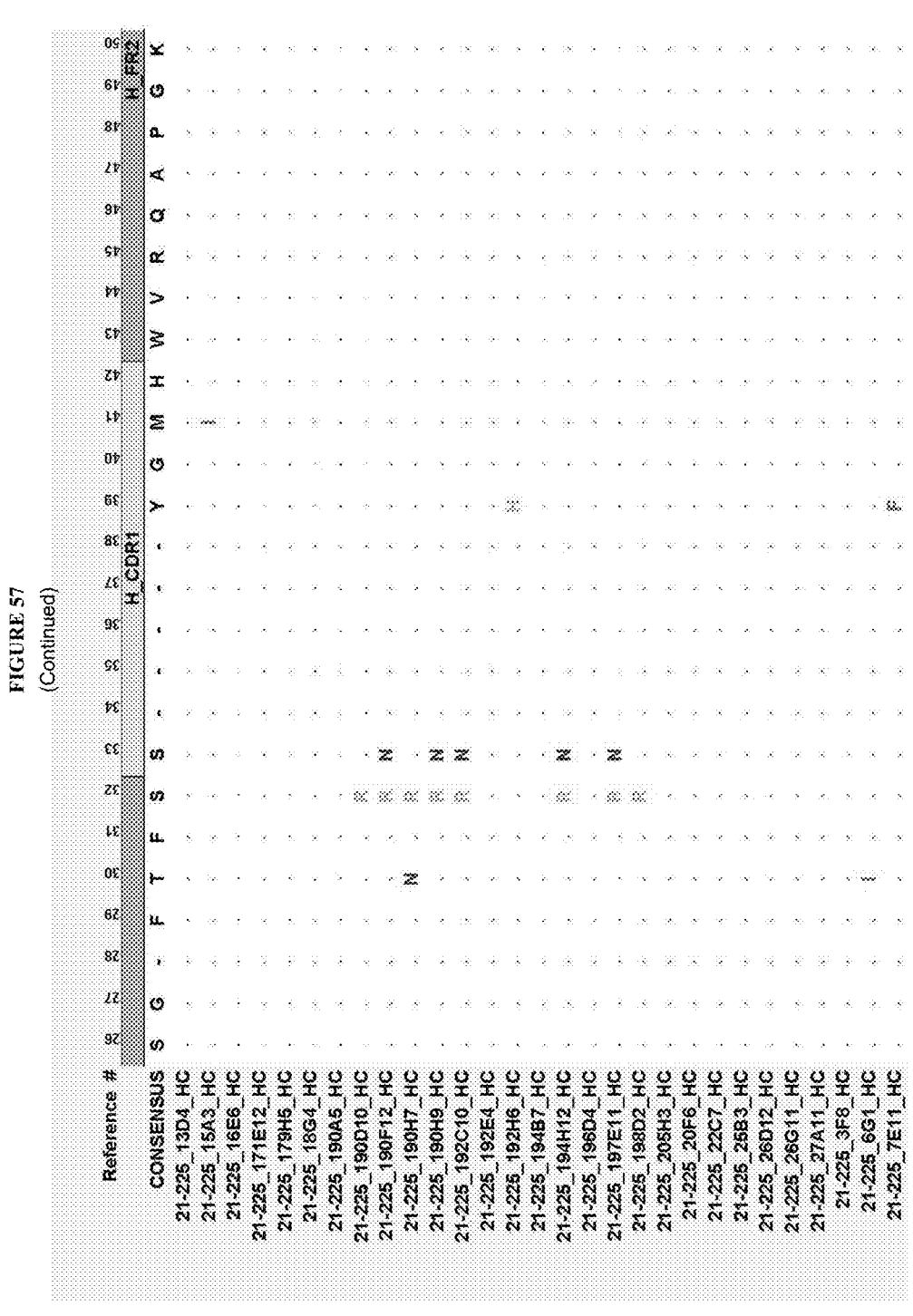
Figure 57:
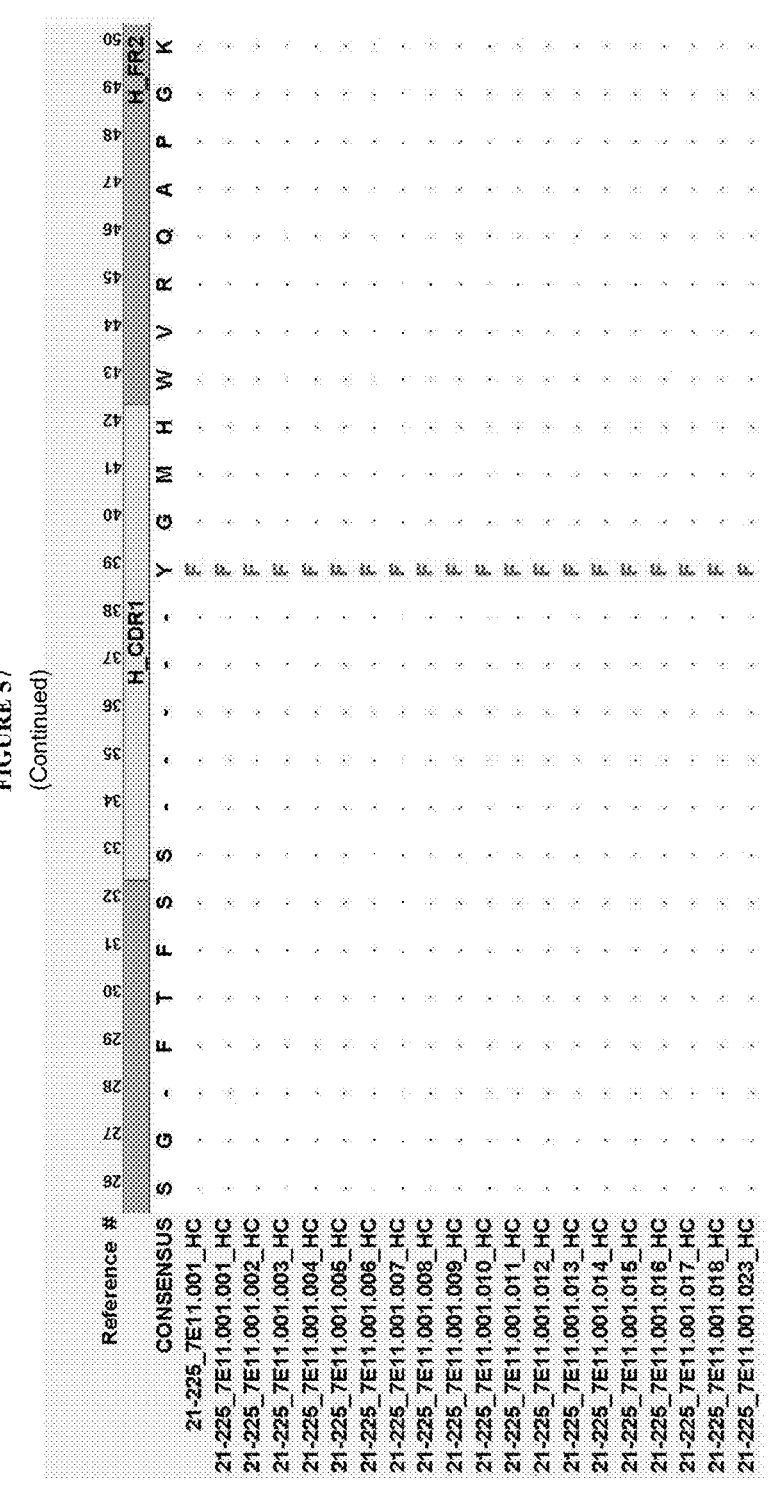
Figure 57:
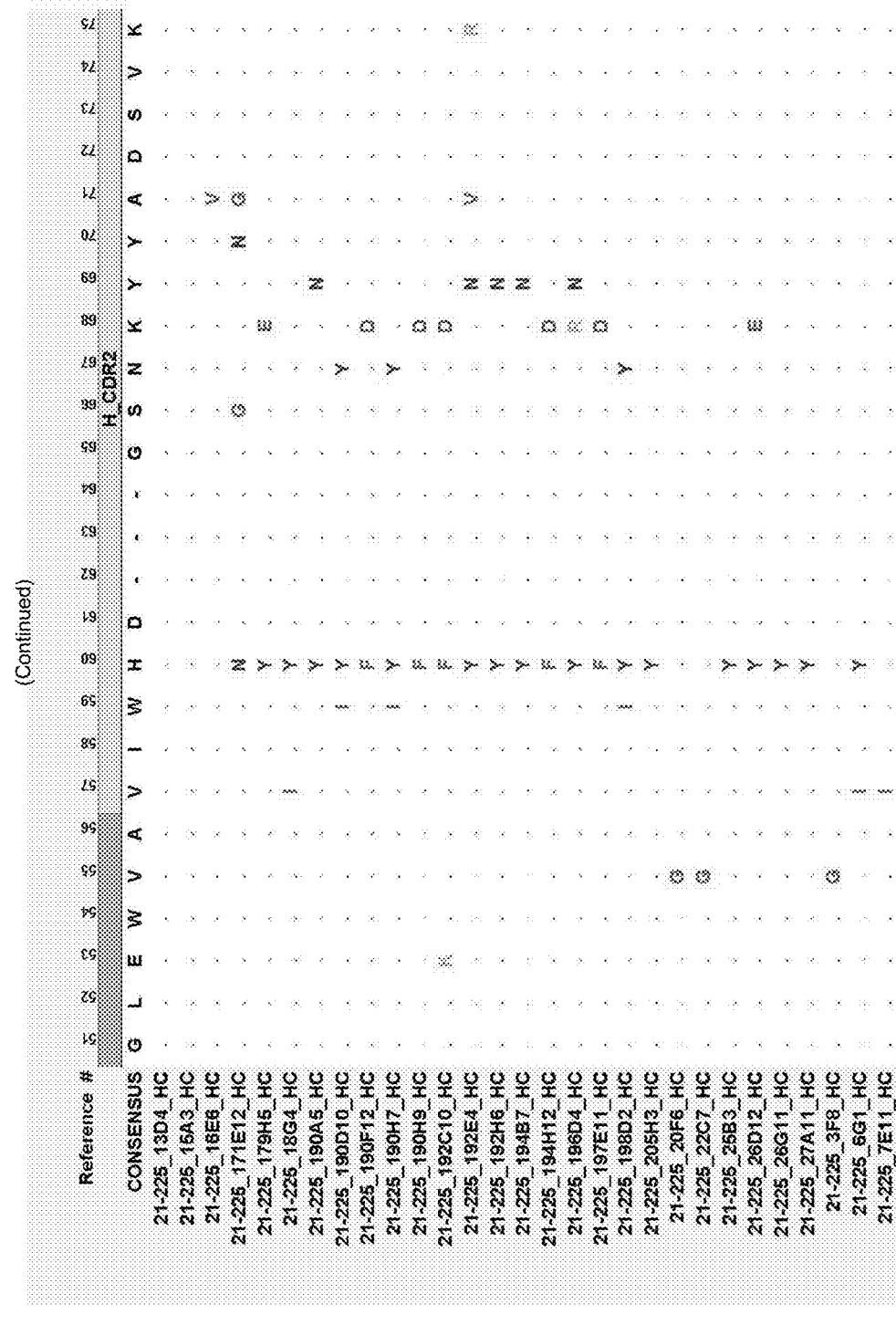
Figure 57:
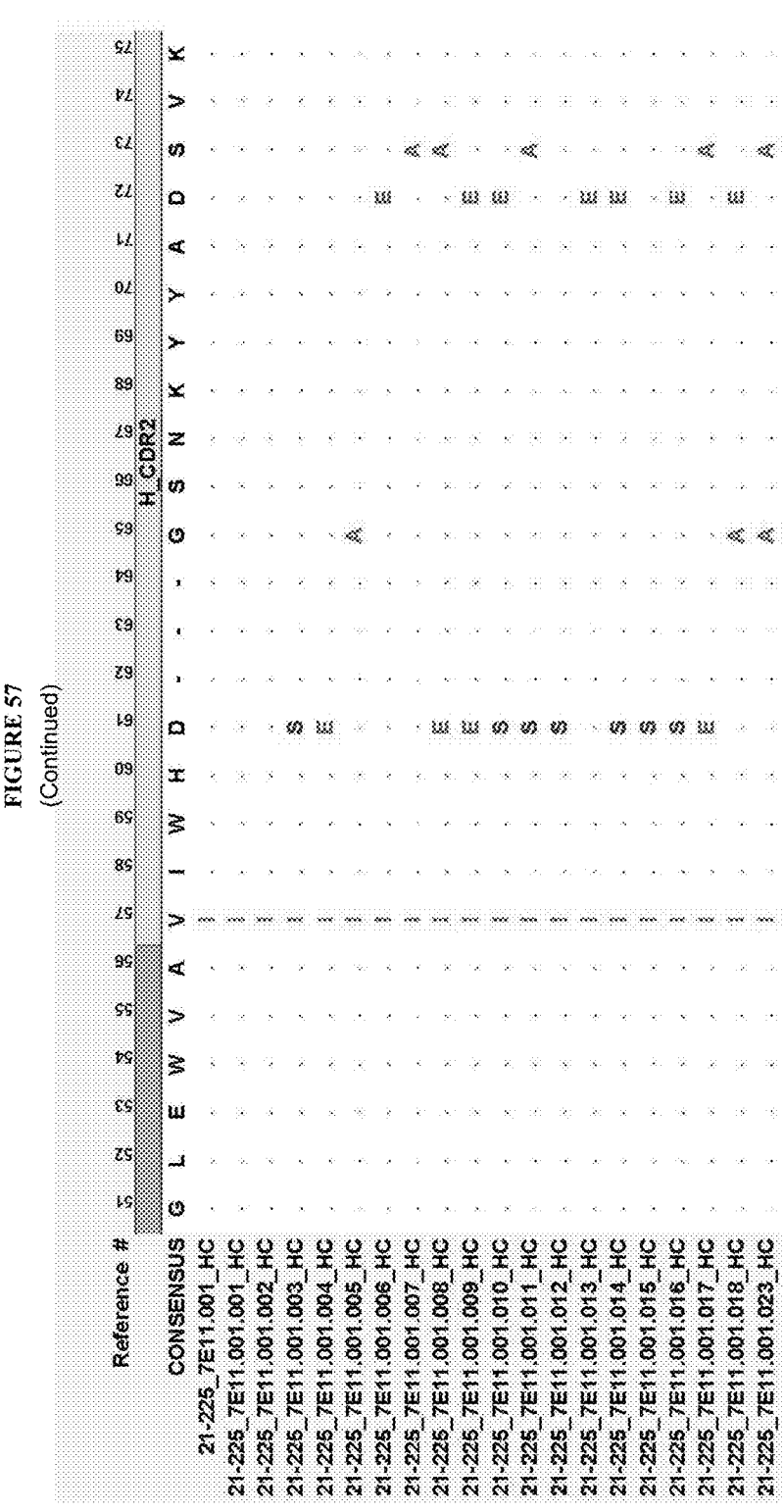
Figure 57:
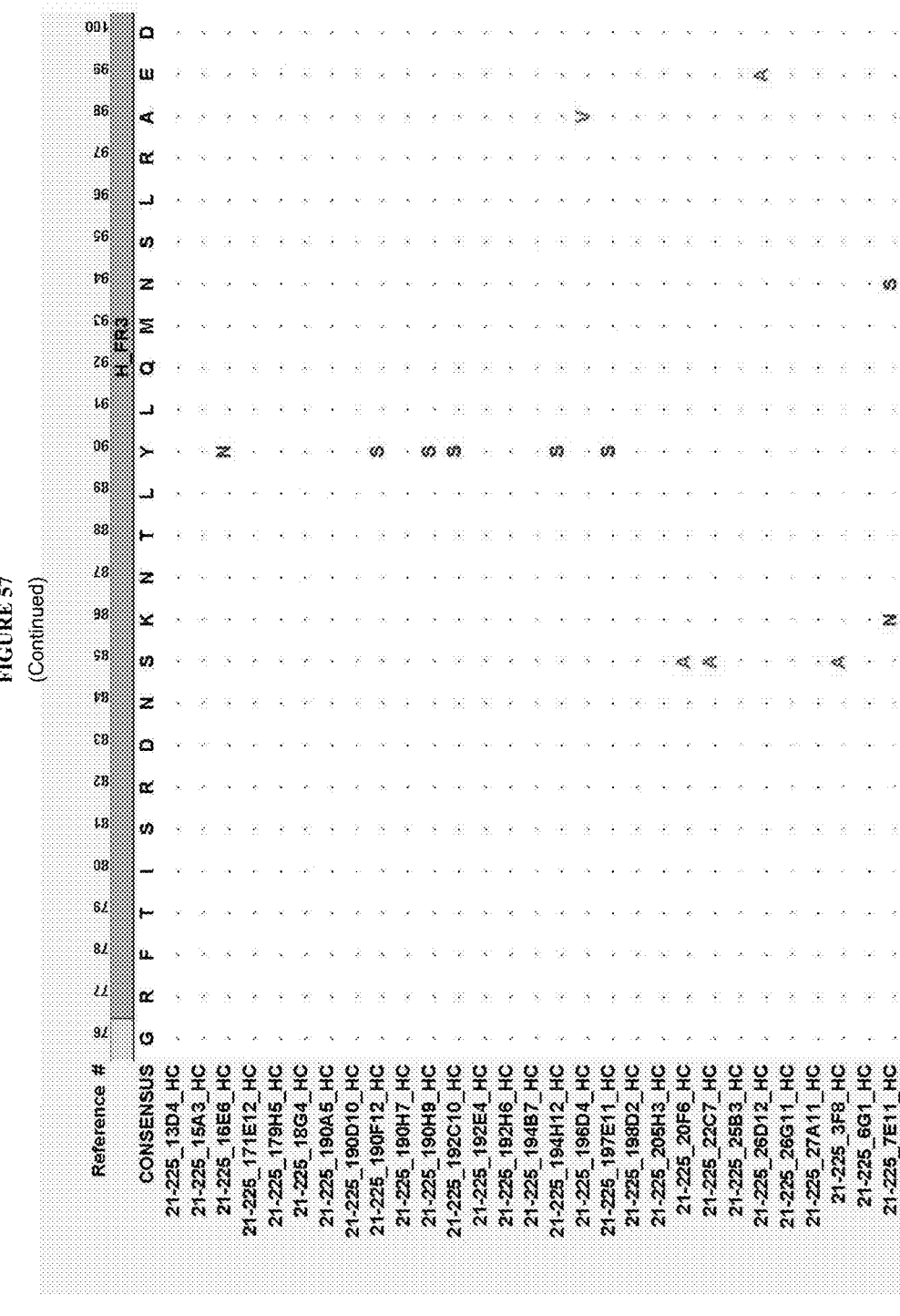
Figure 57:
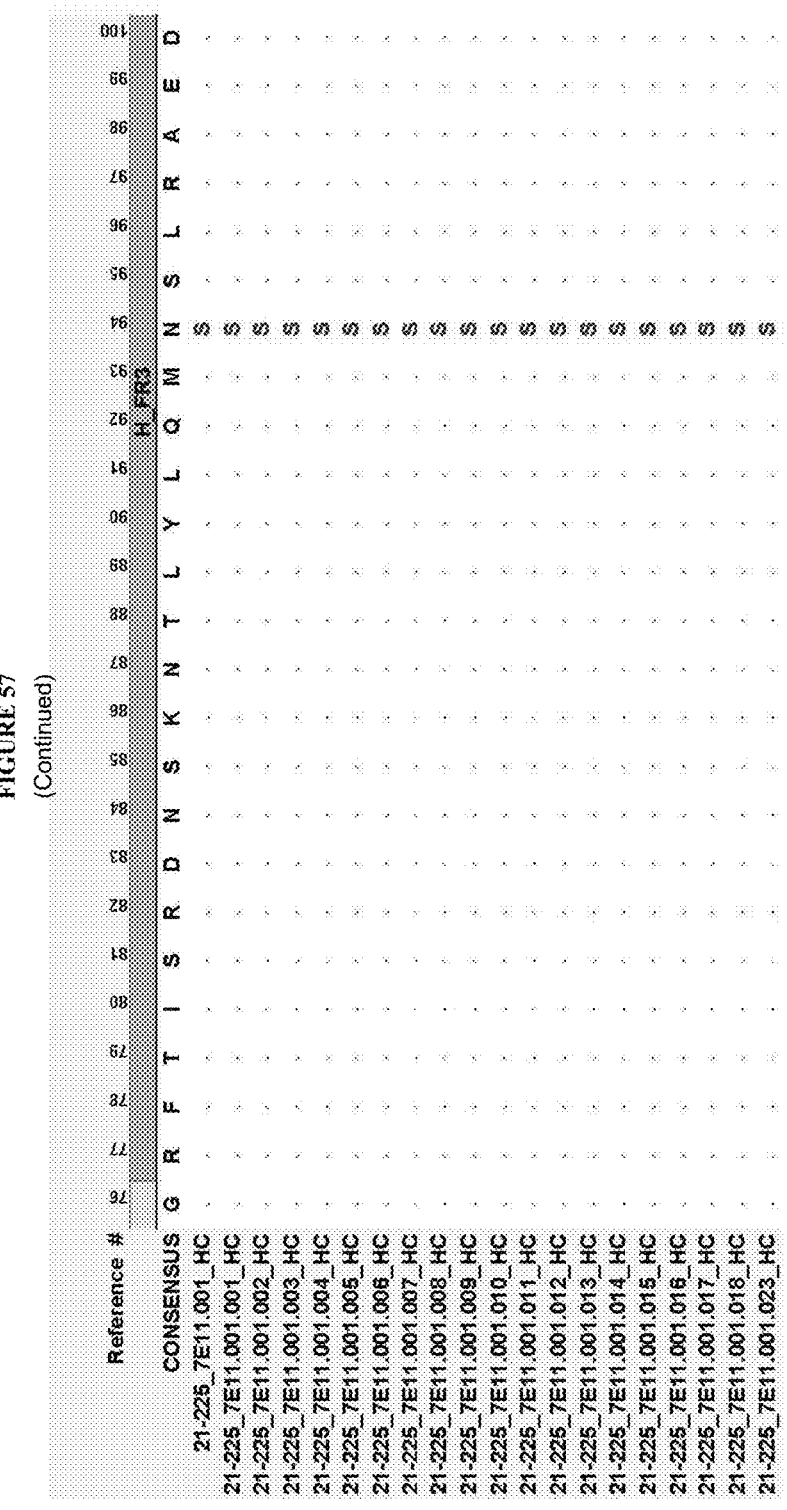
Figure 57:
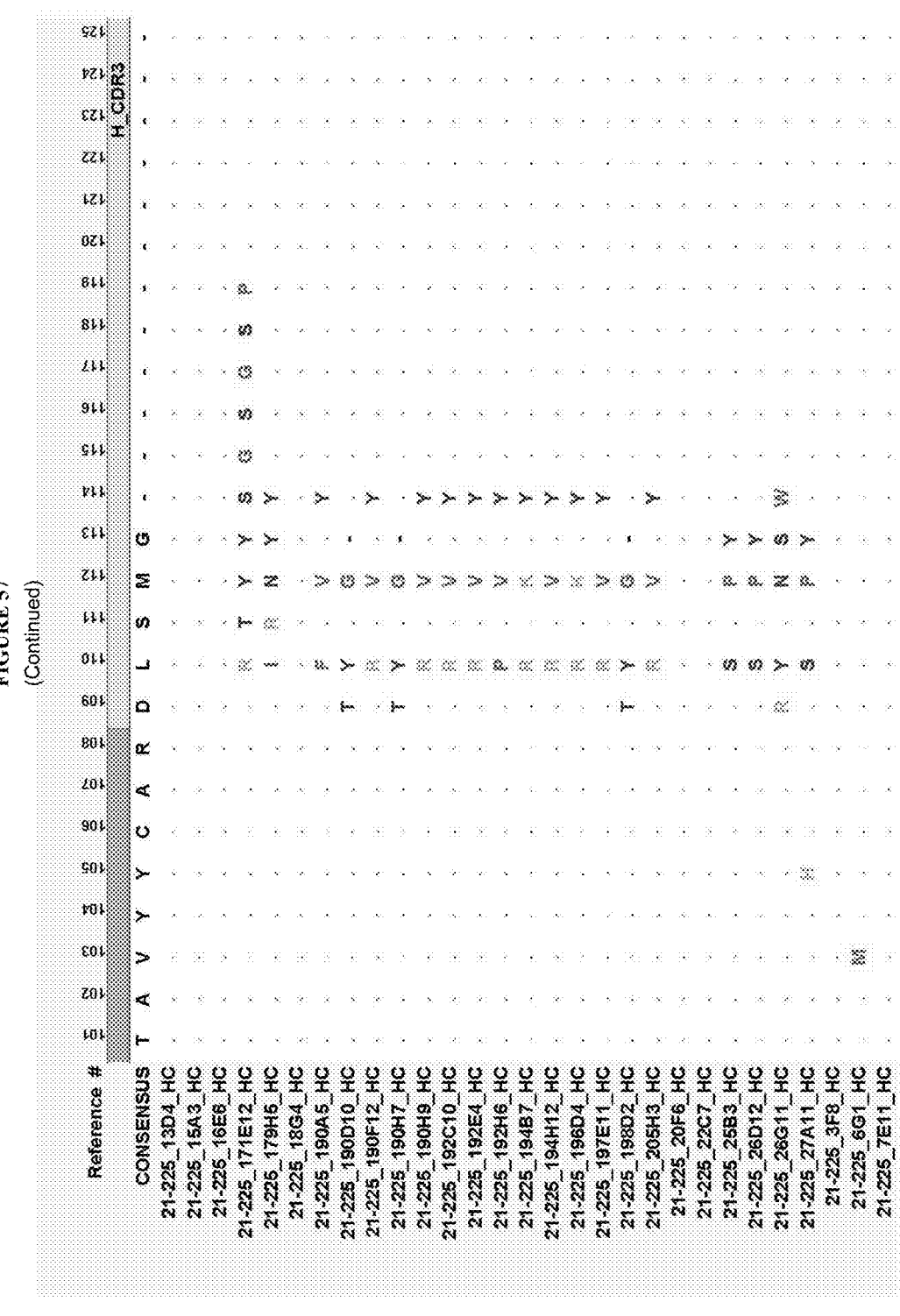
Figure 57:
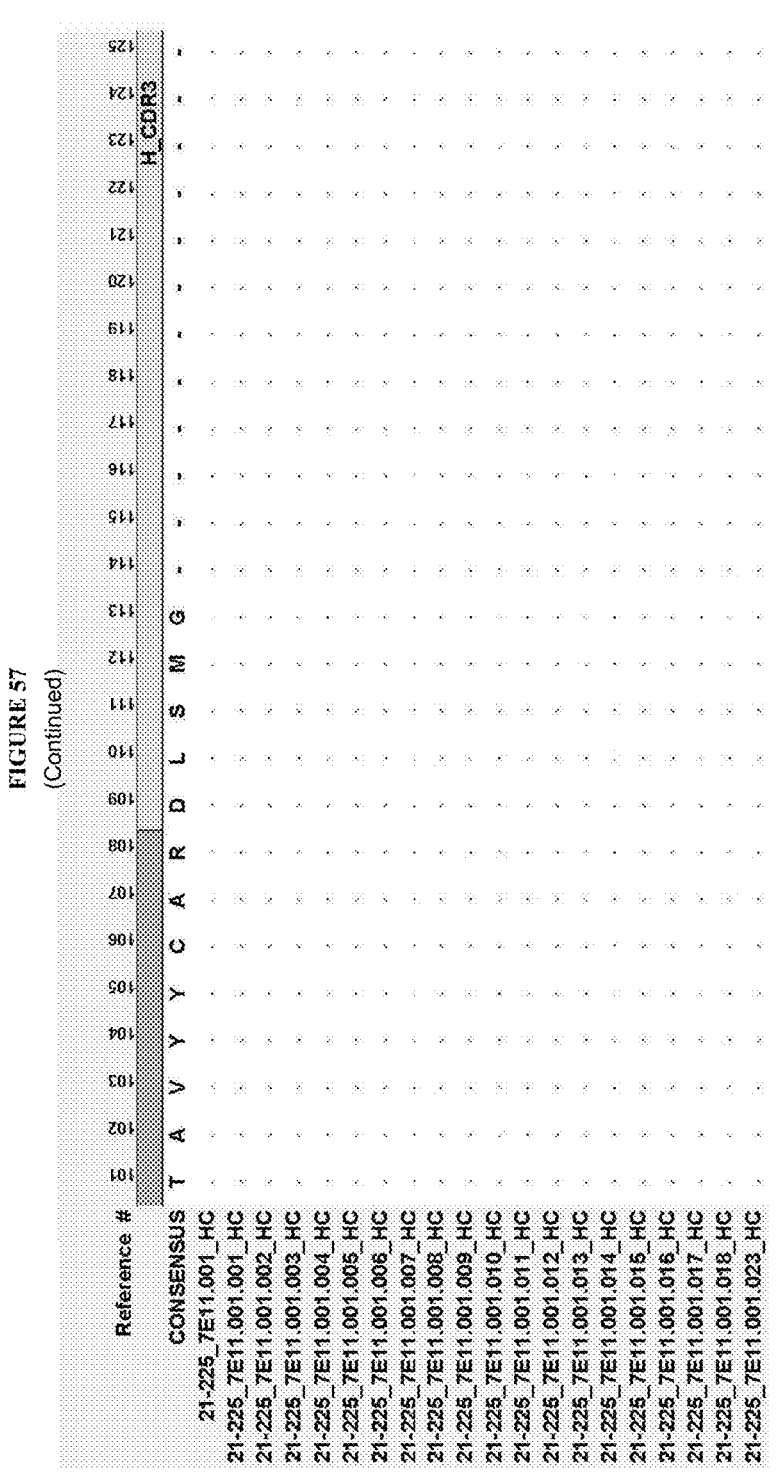
Figure 57:
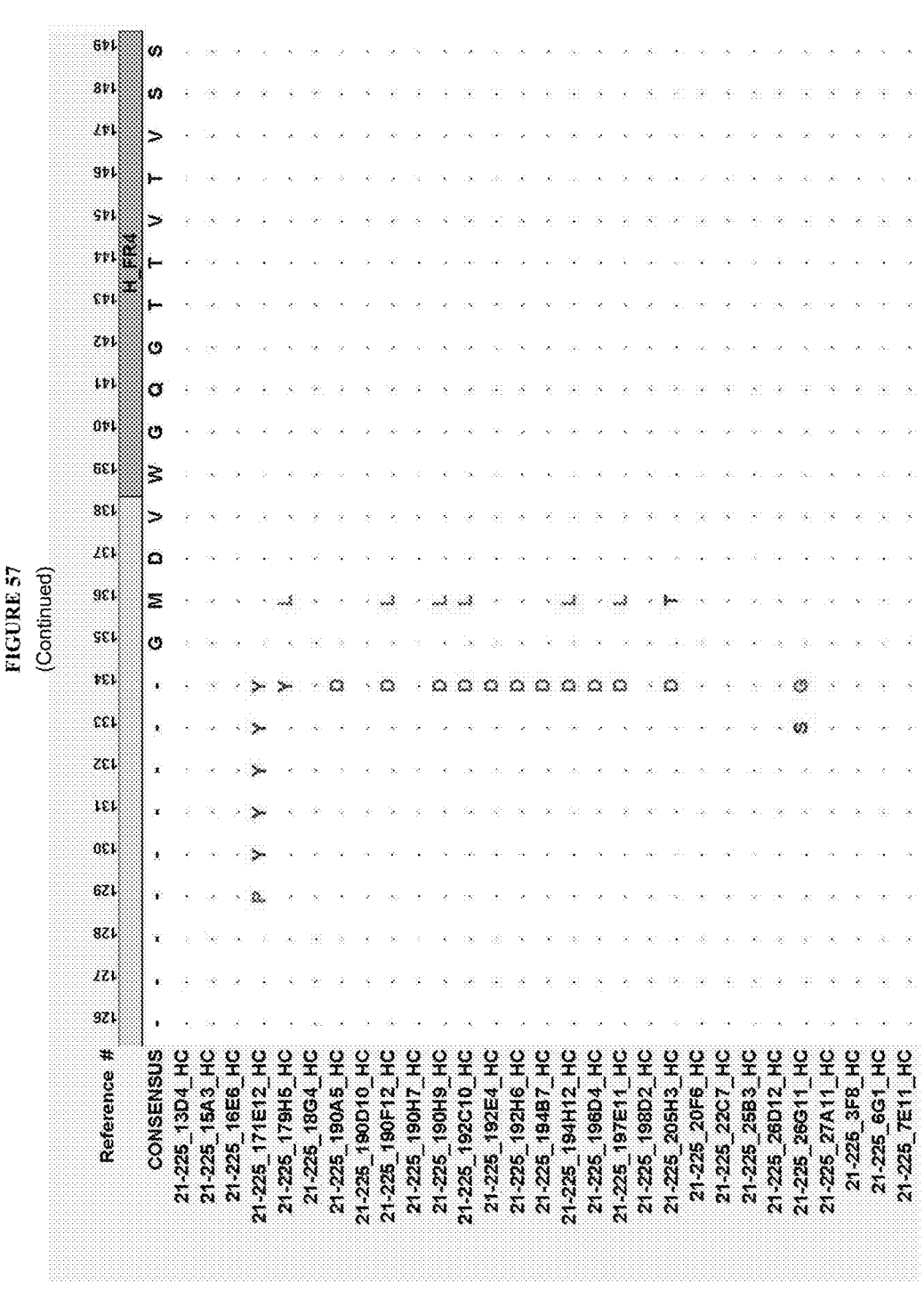
Figure 57:
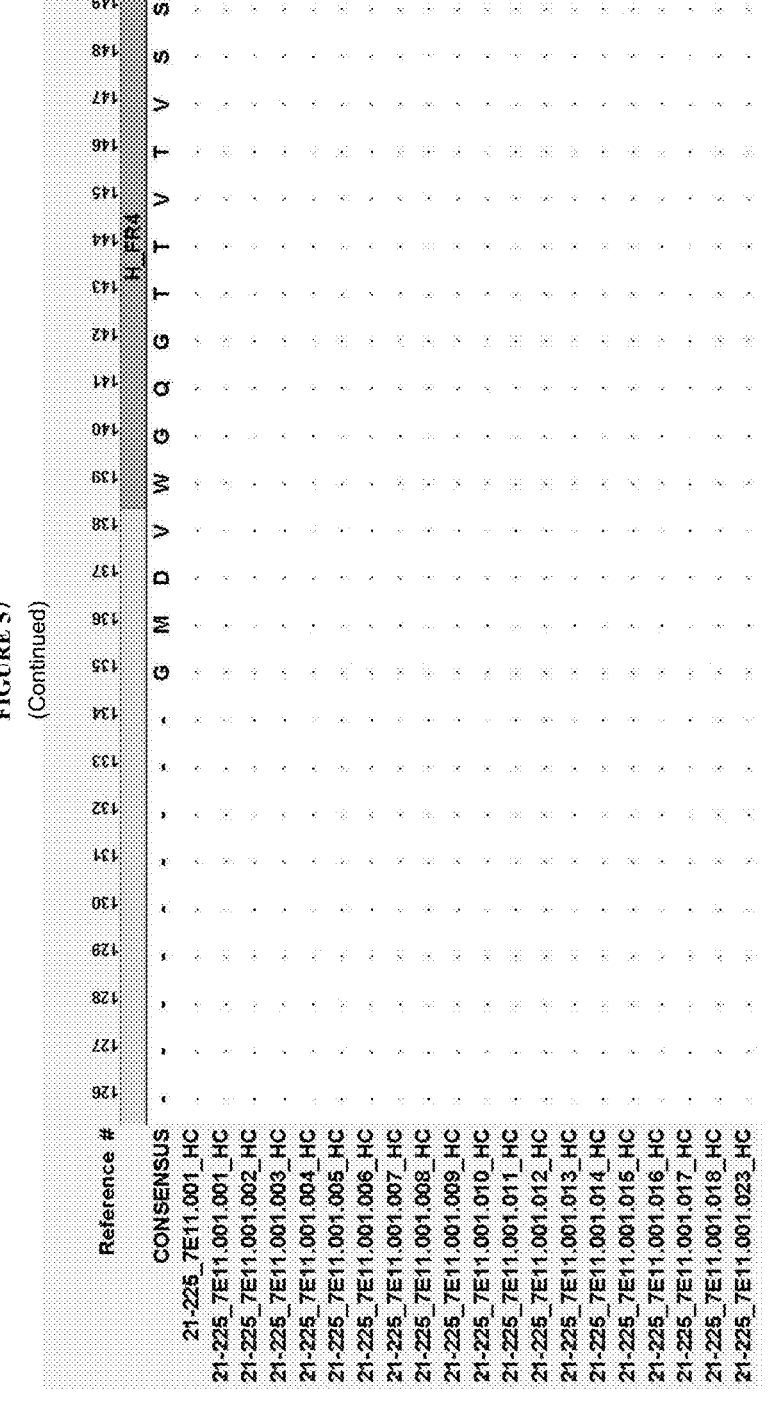
Figure 57:
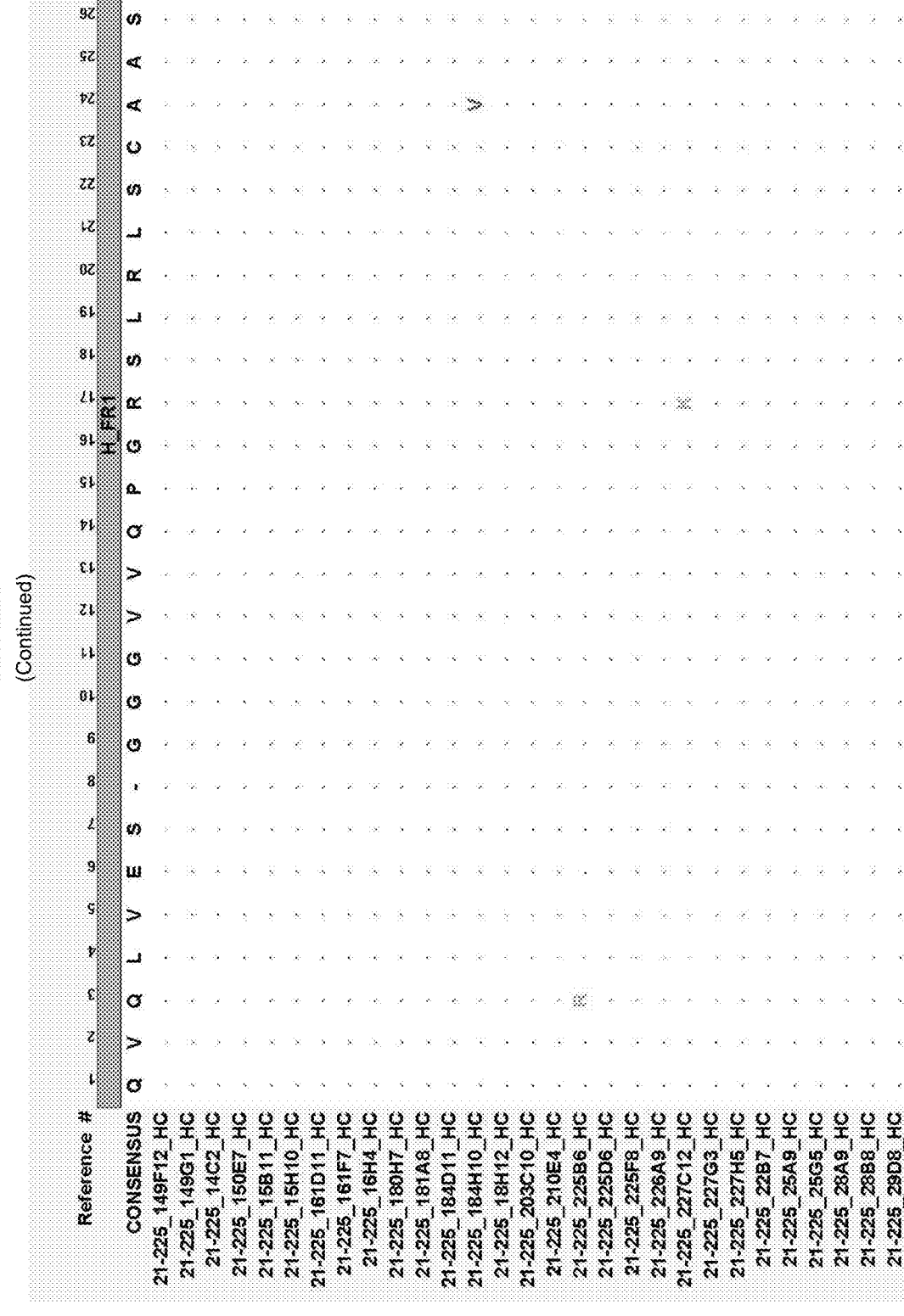
Figure 57:
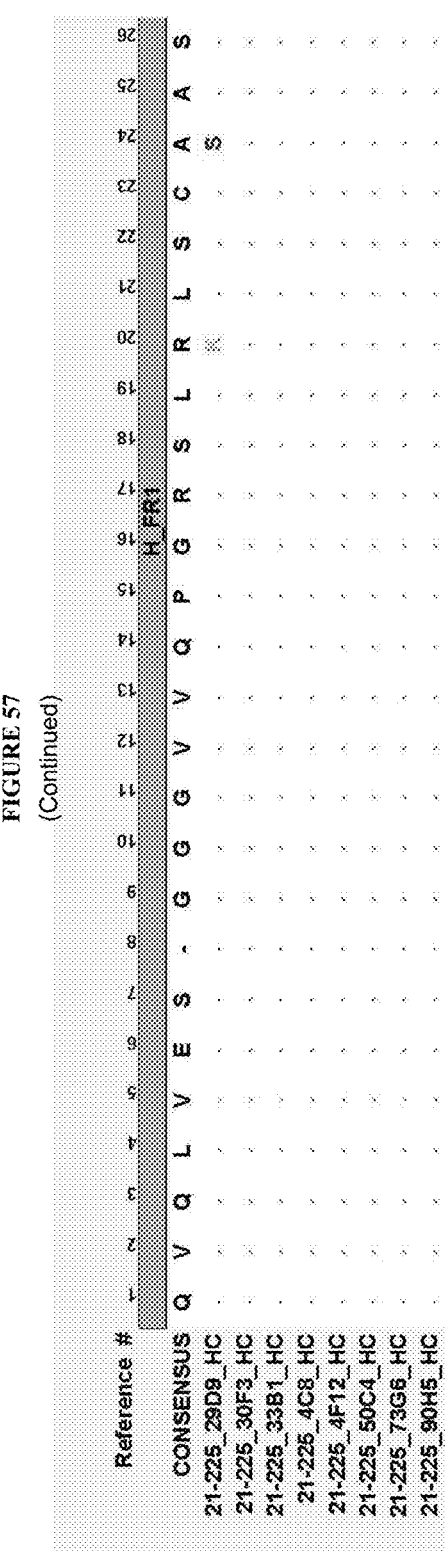
Figure 57:
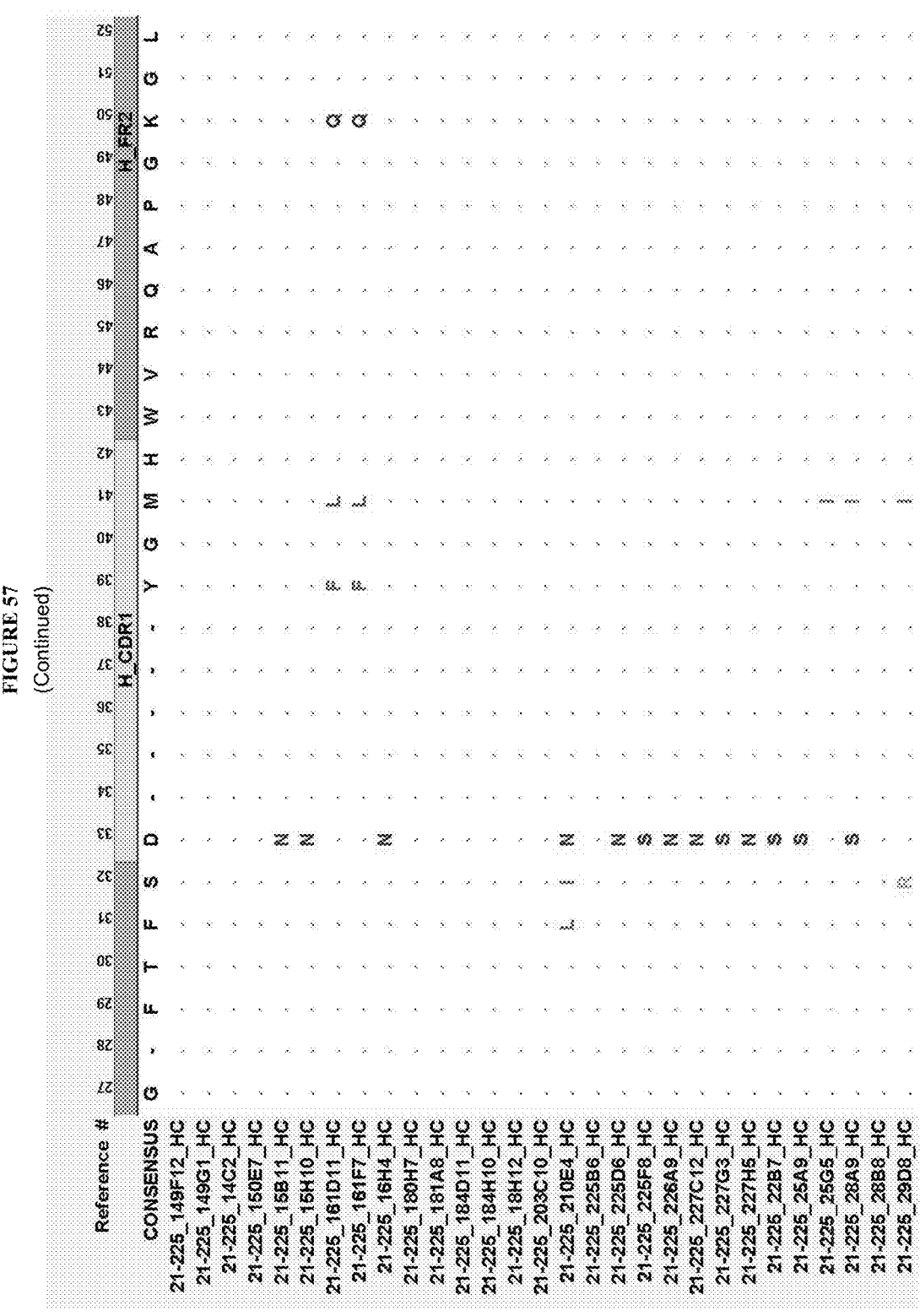
Figure 57:
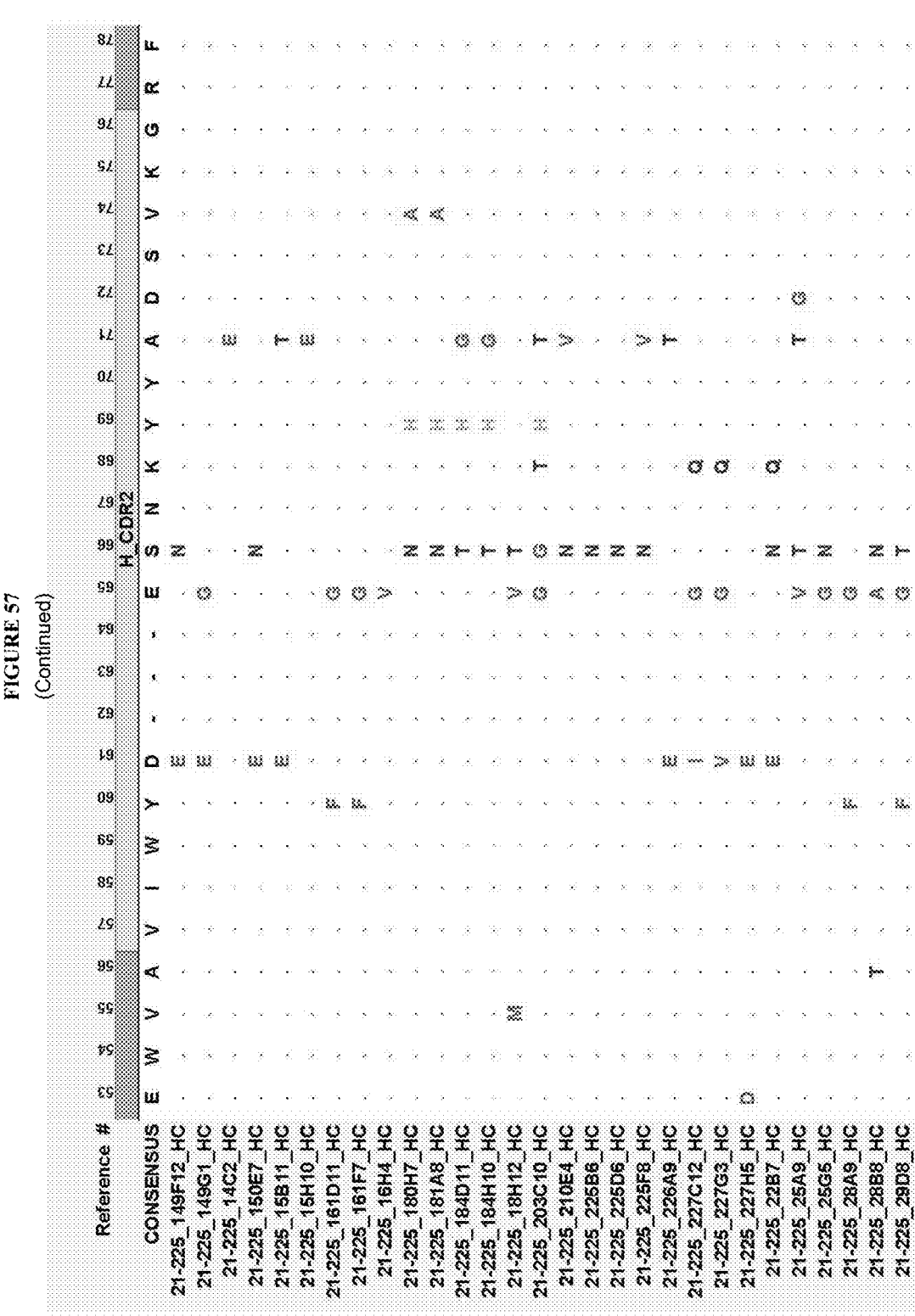
Figure 57:
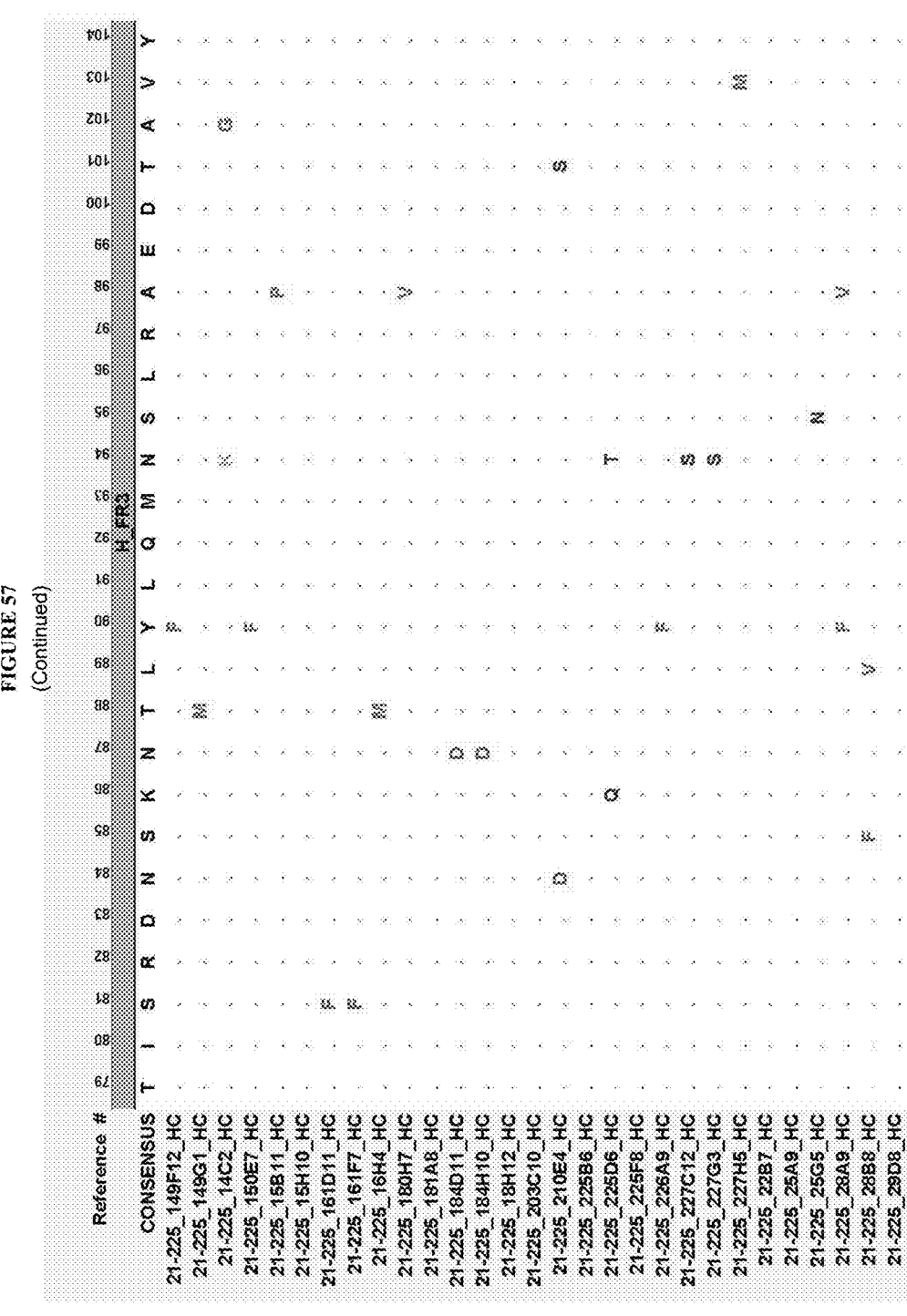
Figure 57:
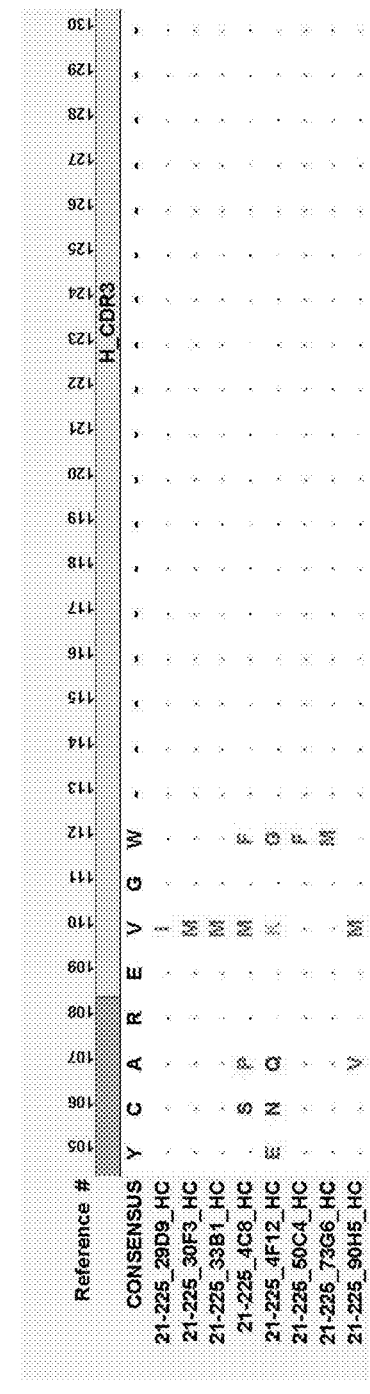
Figure 57:
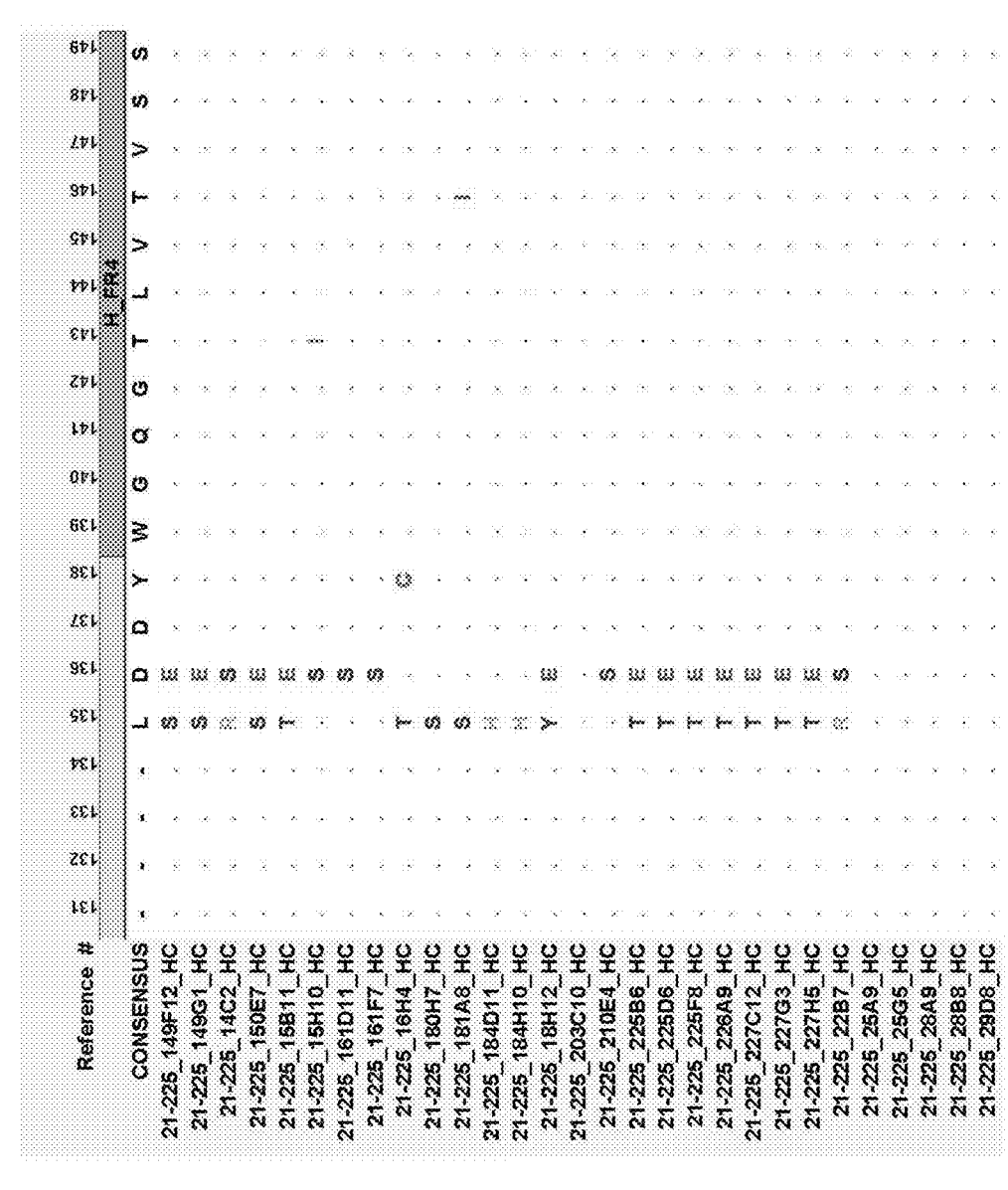
Figure 57:
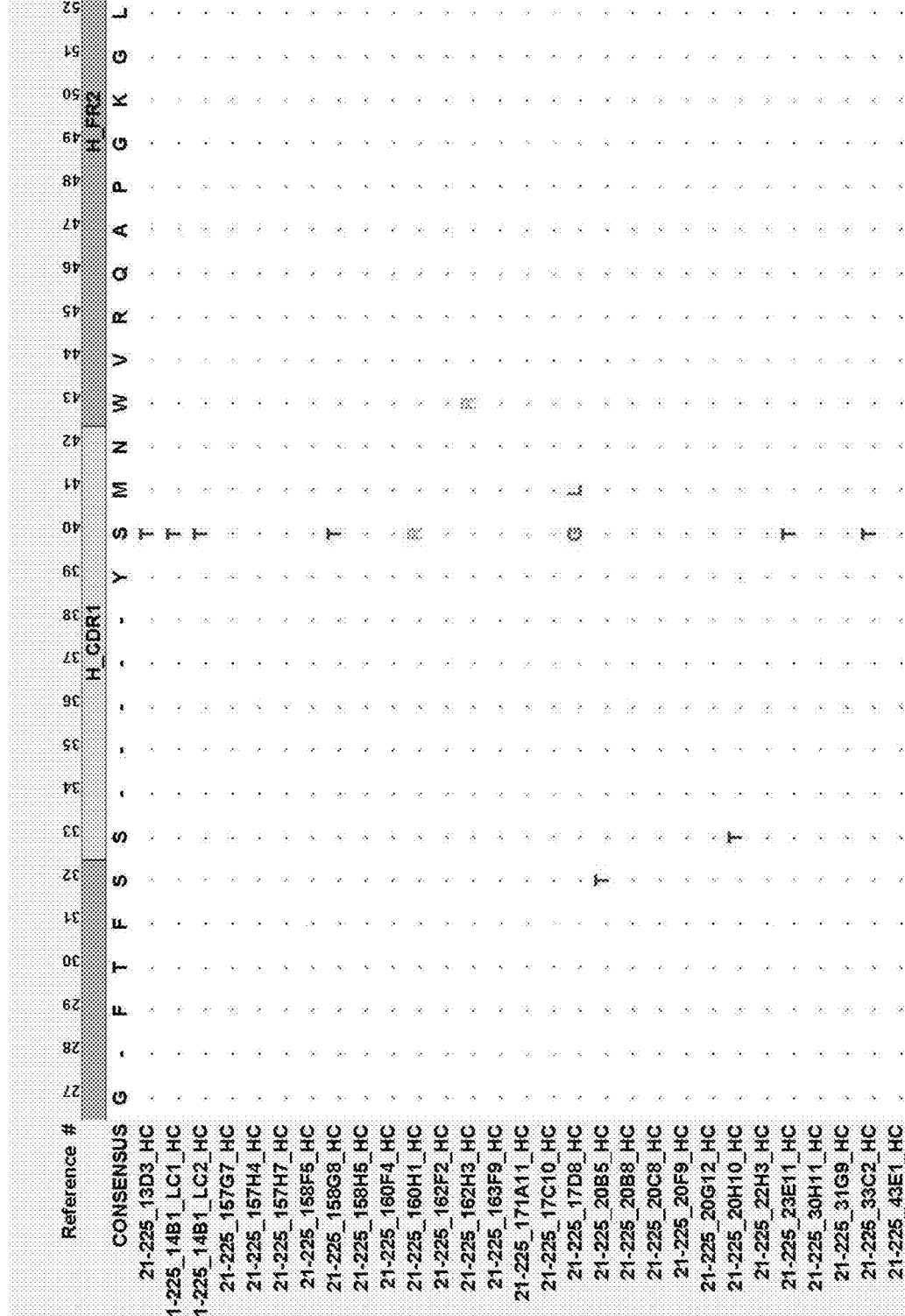
Figure 57:
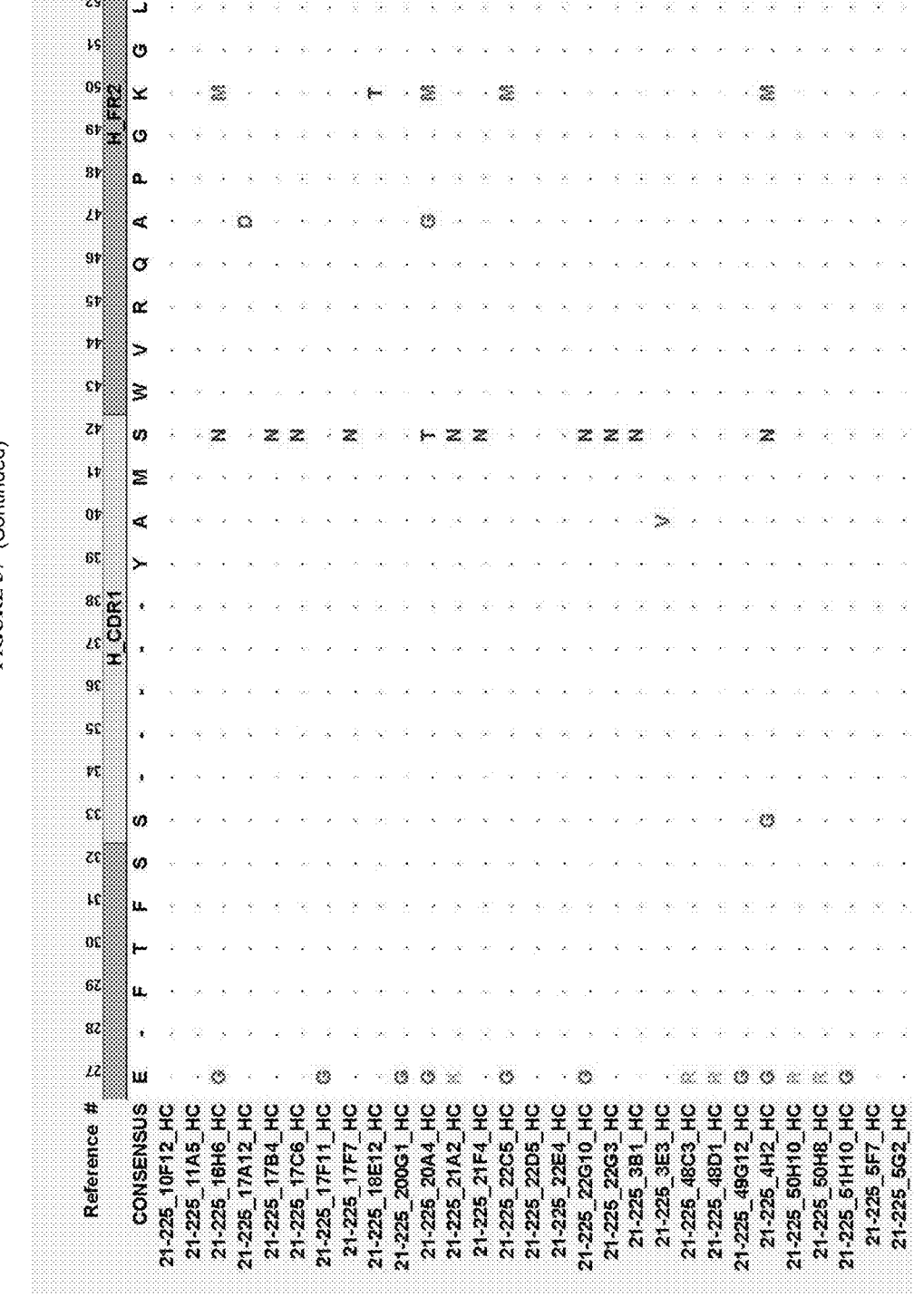
Figure 57:
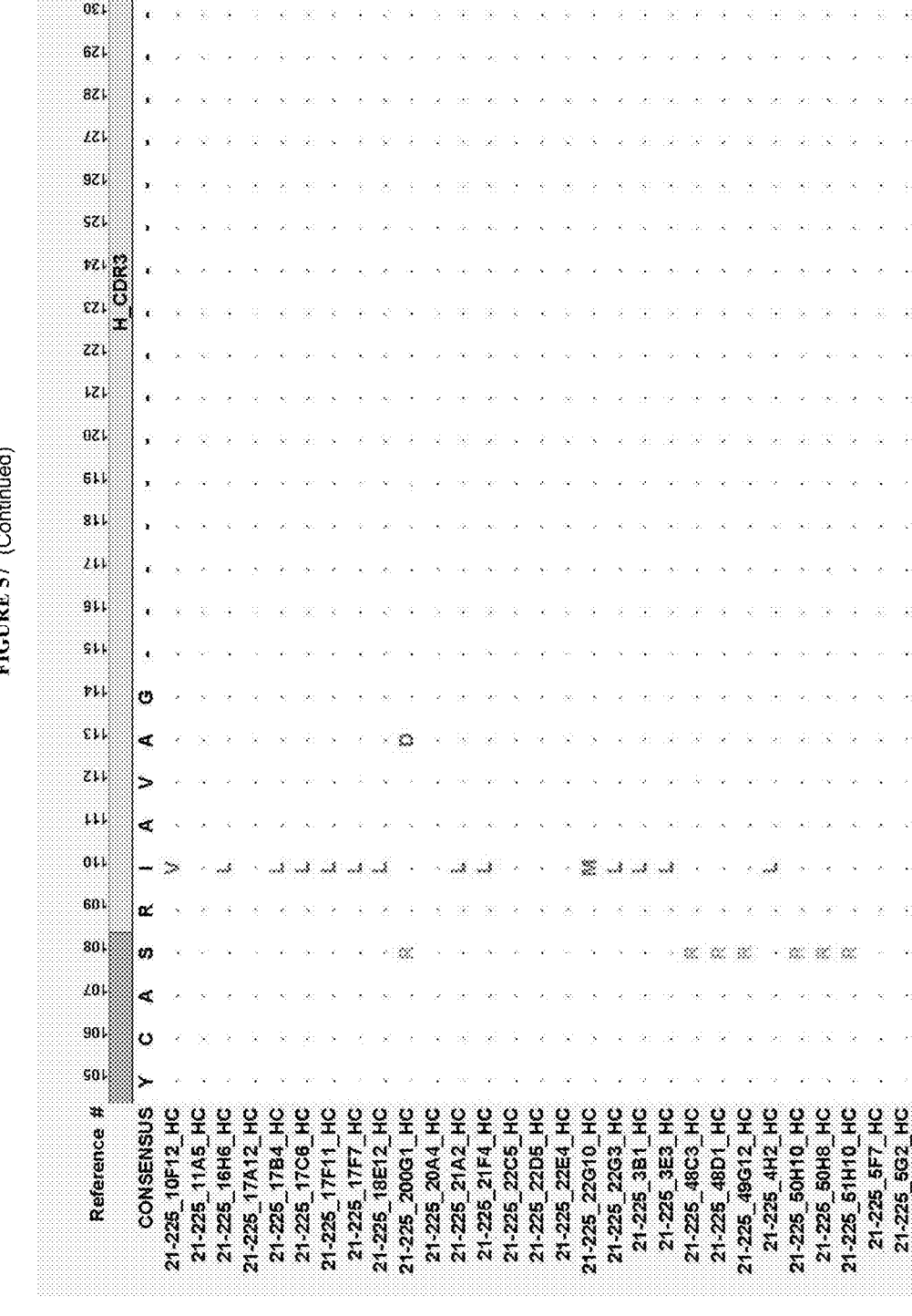
Figure 57:
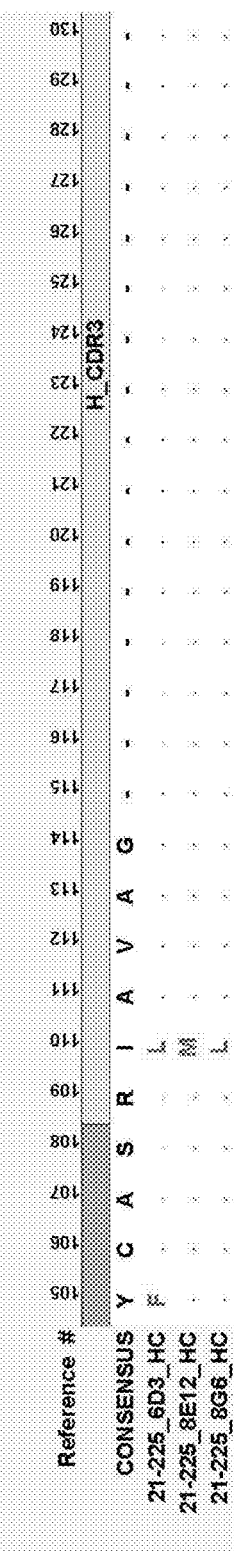
Figure 57:
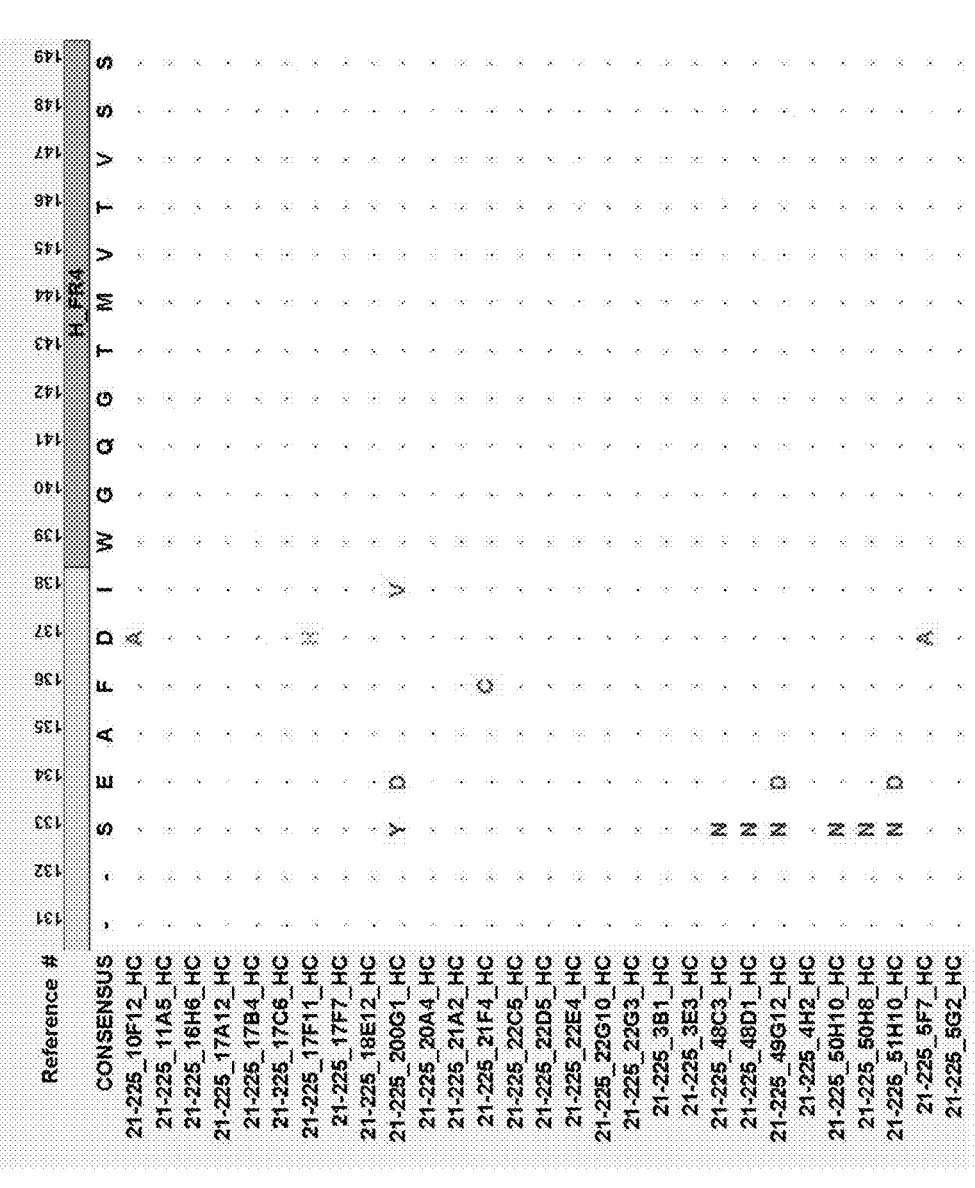
Figure 57:
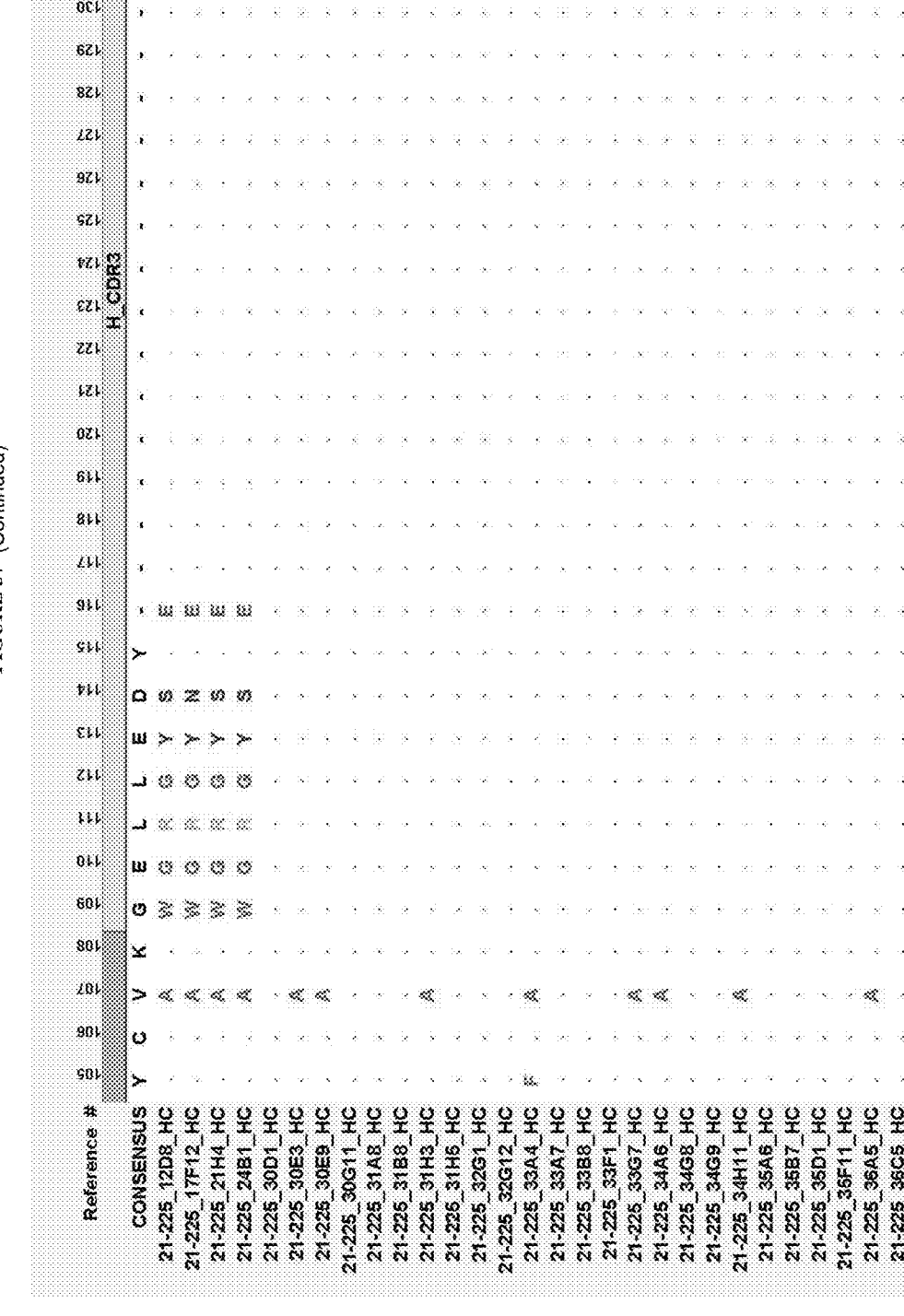
Figure 57:
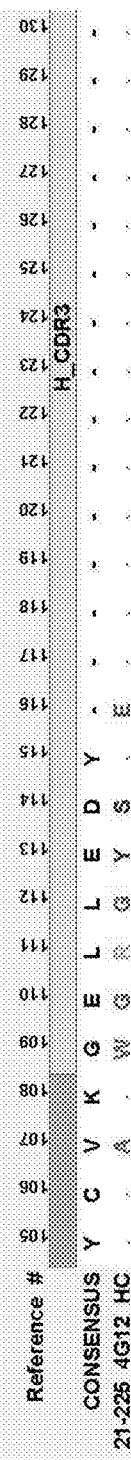
Figure 57:
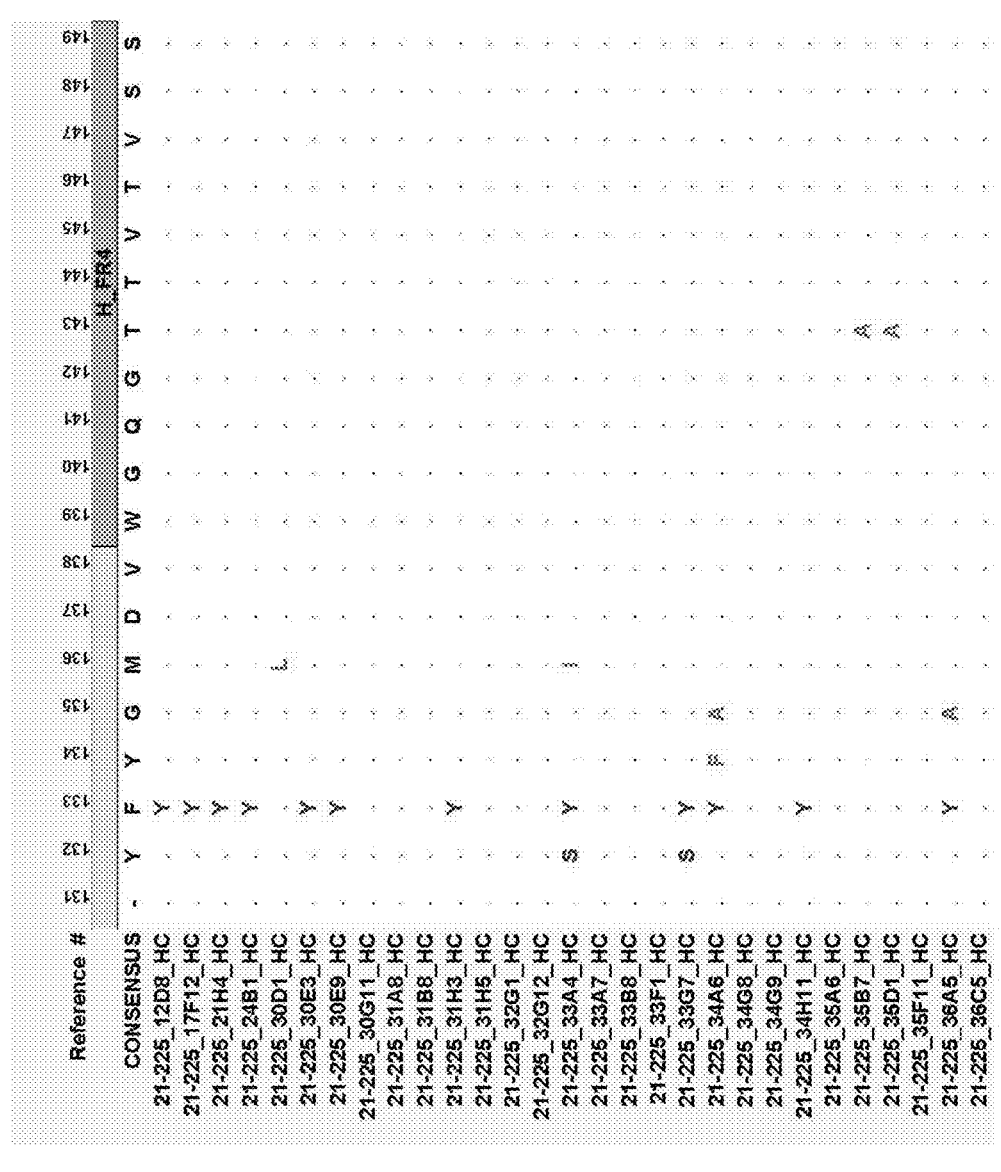
Figure 57:
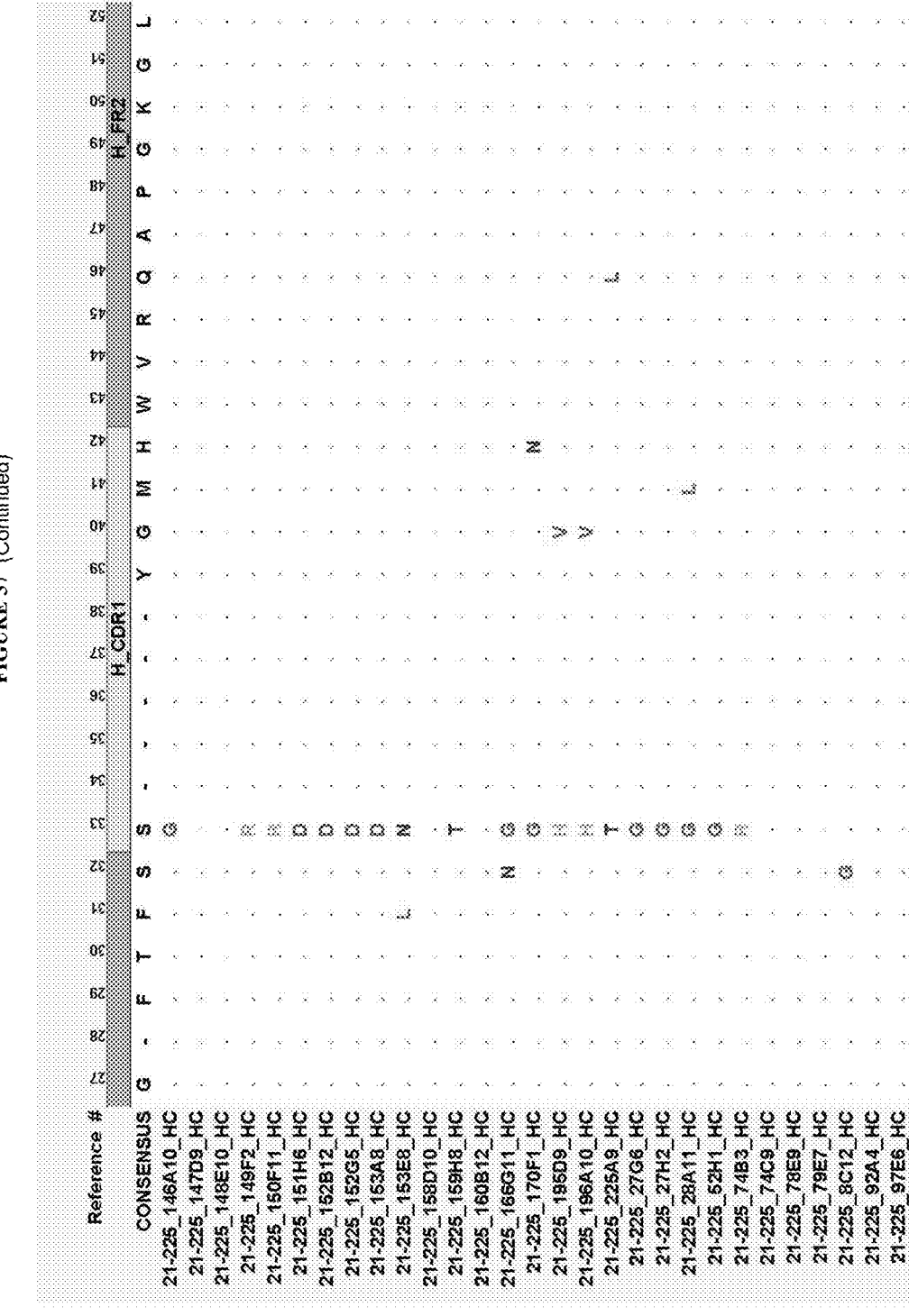
Figure 57:
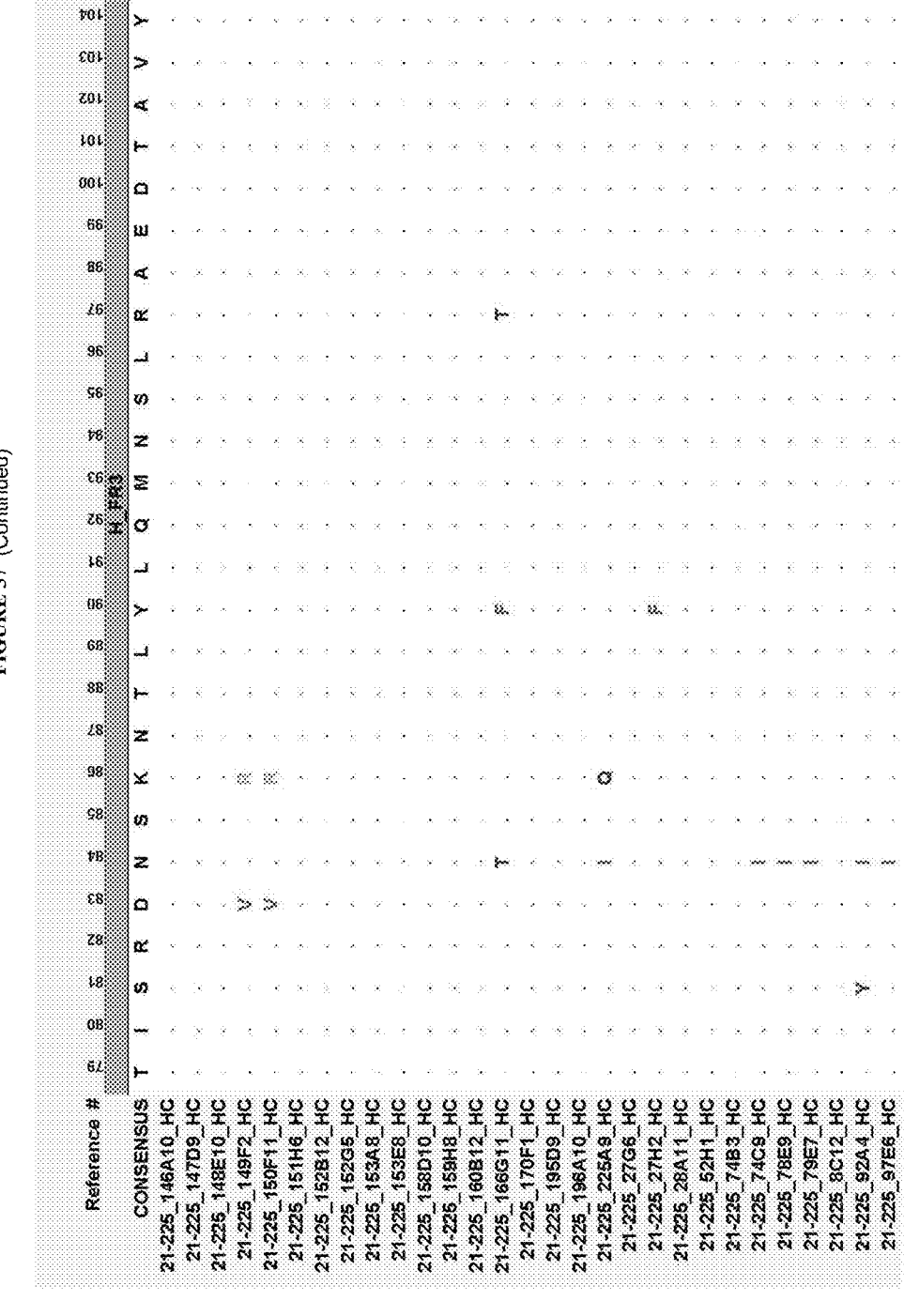
Figure 57:
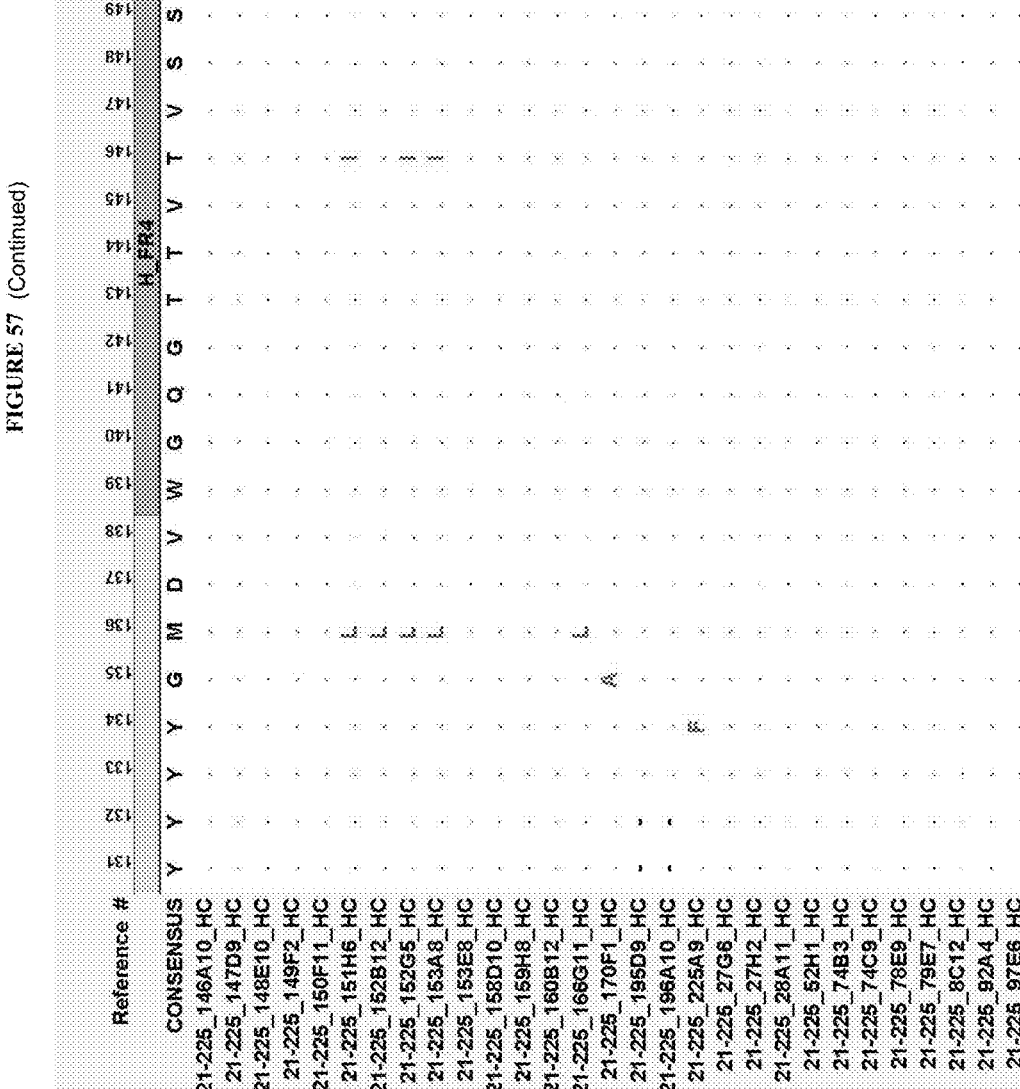
Figure 57:
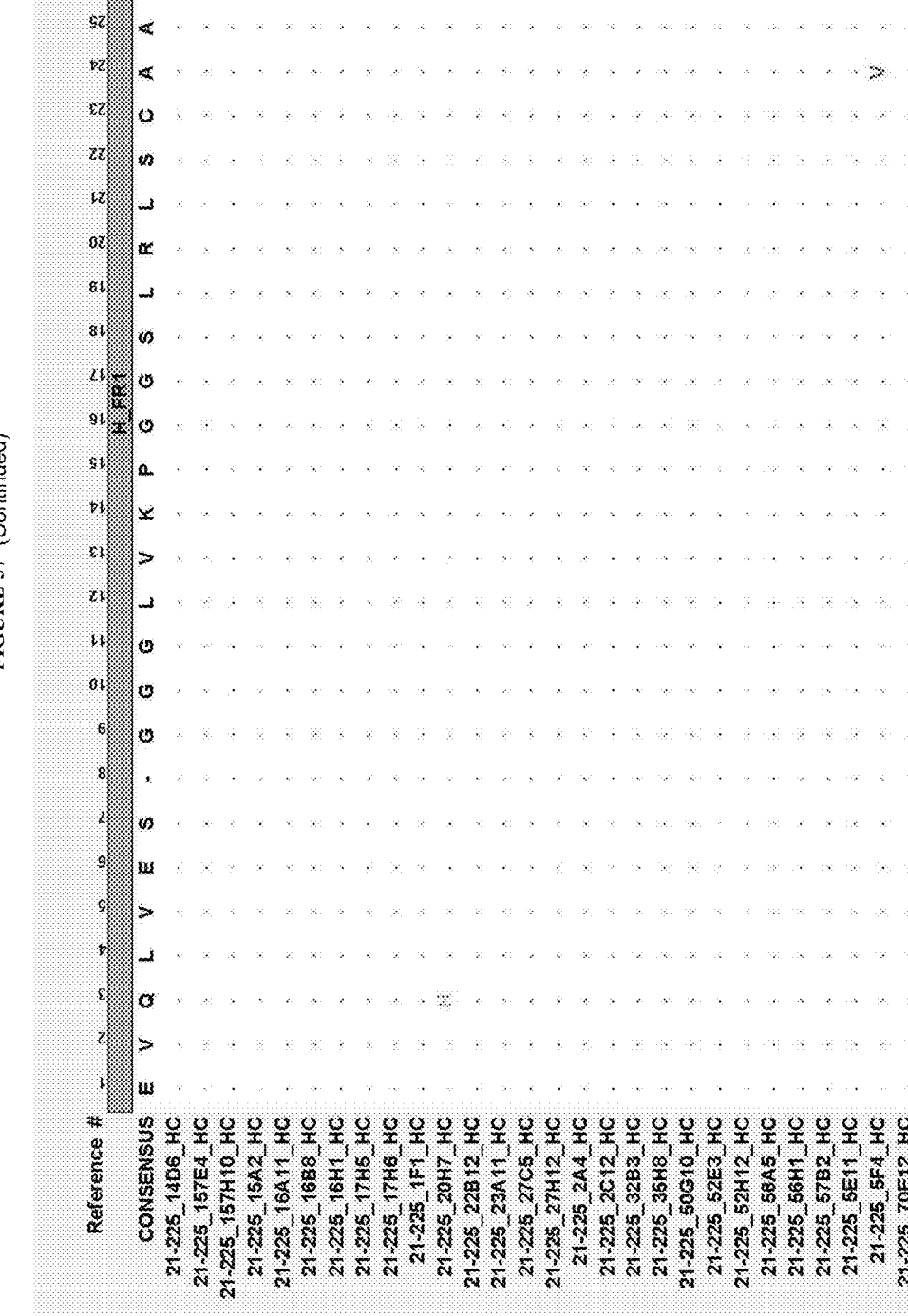
Figure 57:
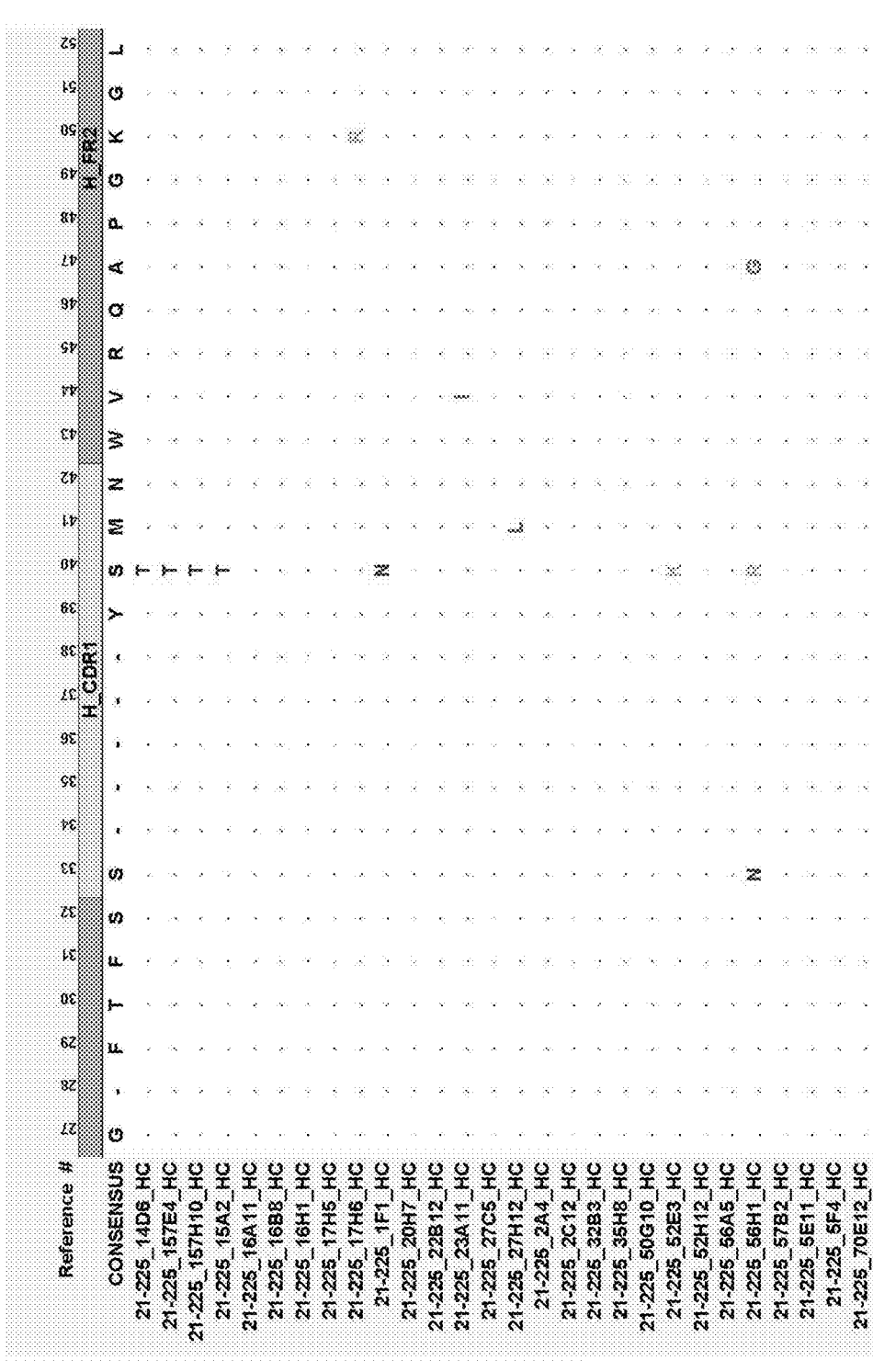
Figure 57:
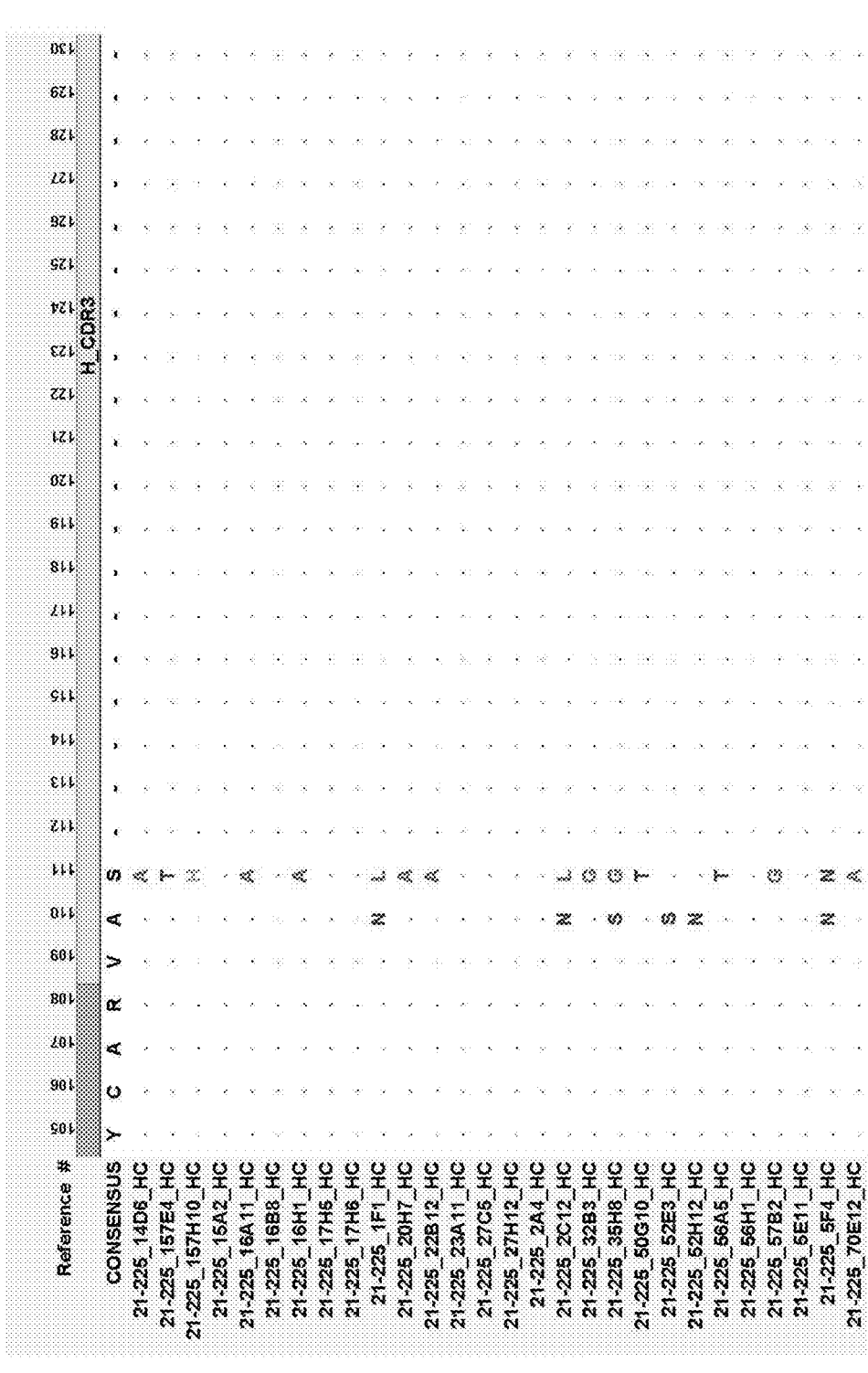
Figure 57:
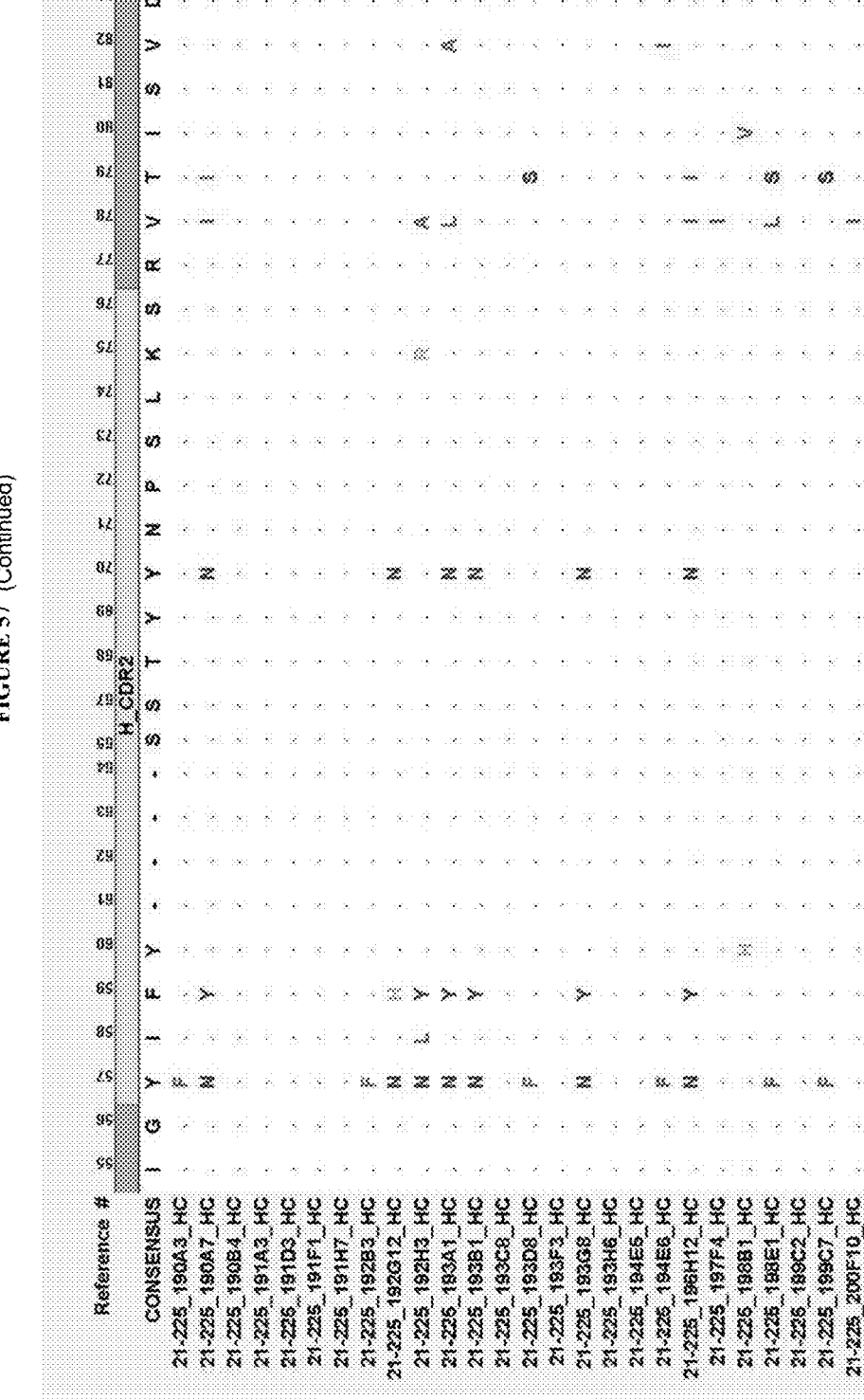
Figure 57:
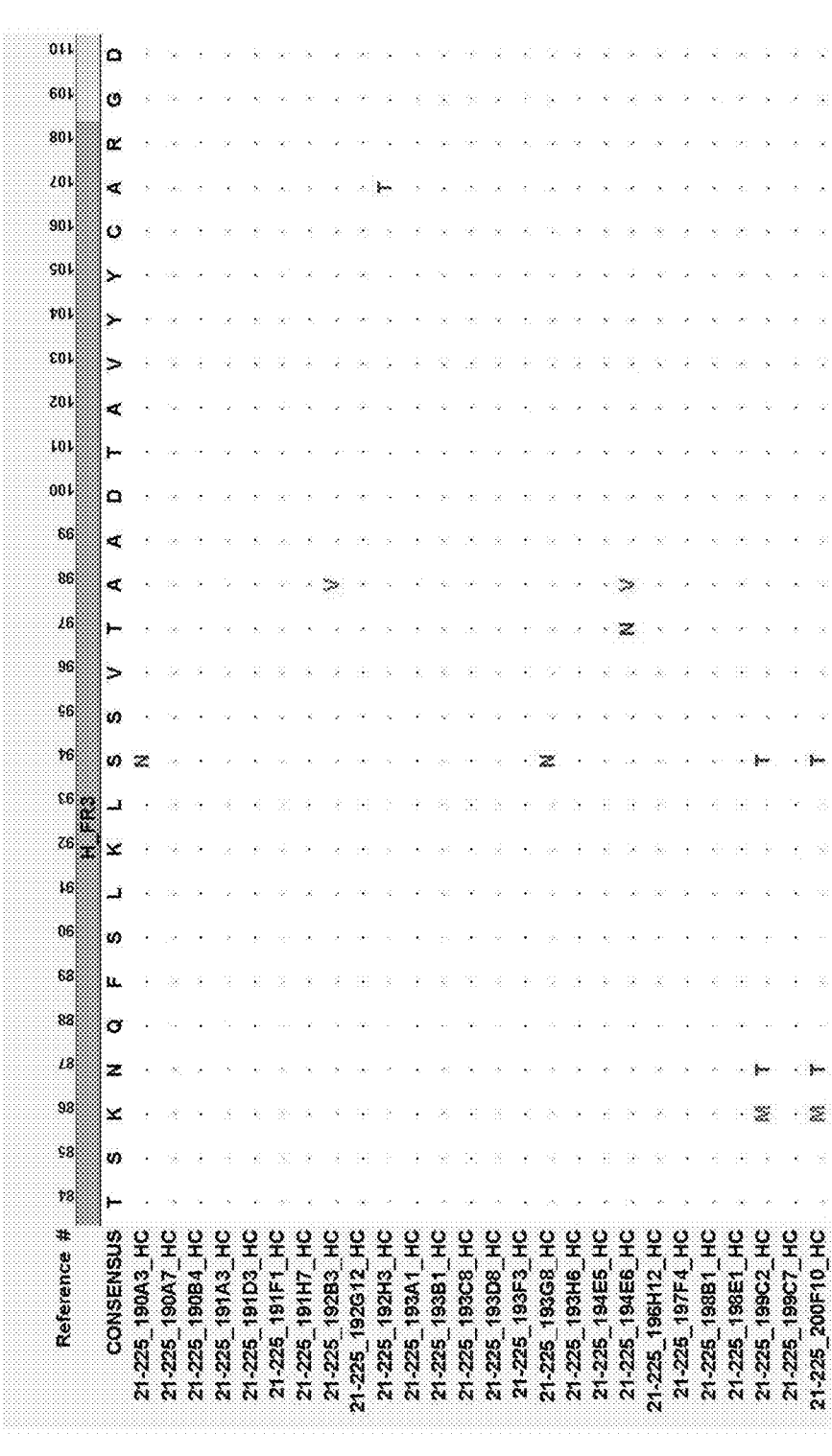
Figure 57:
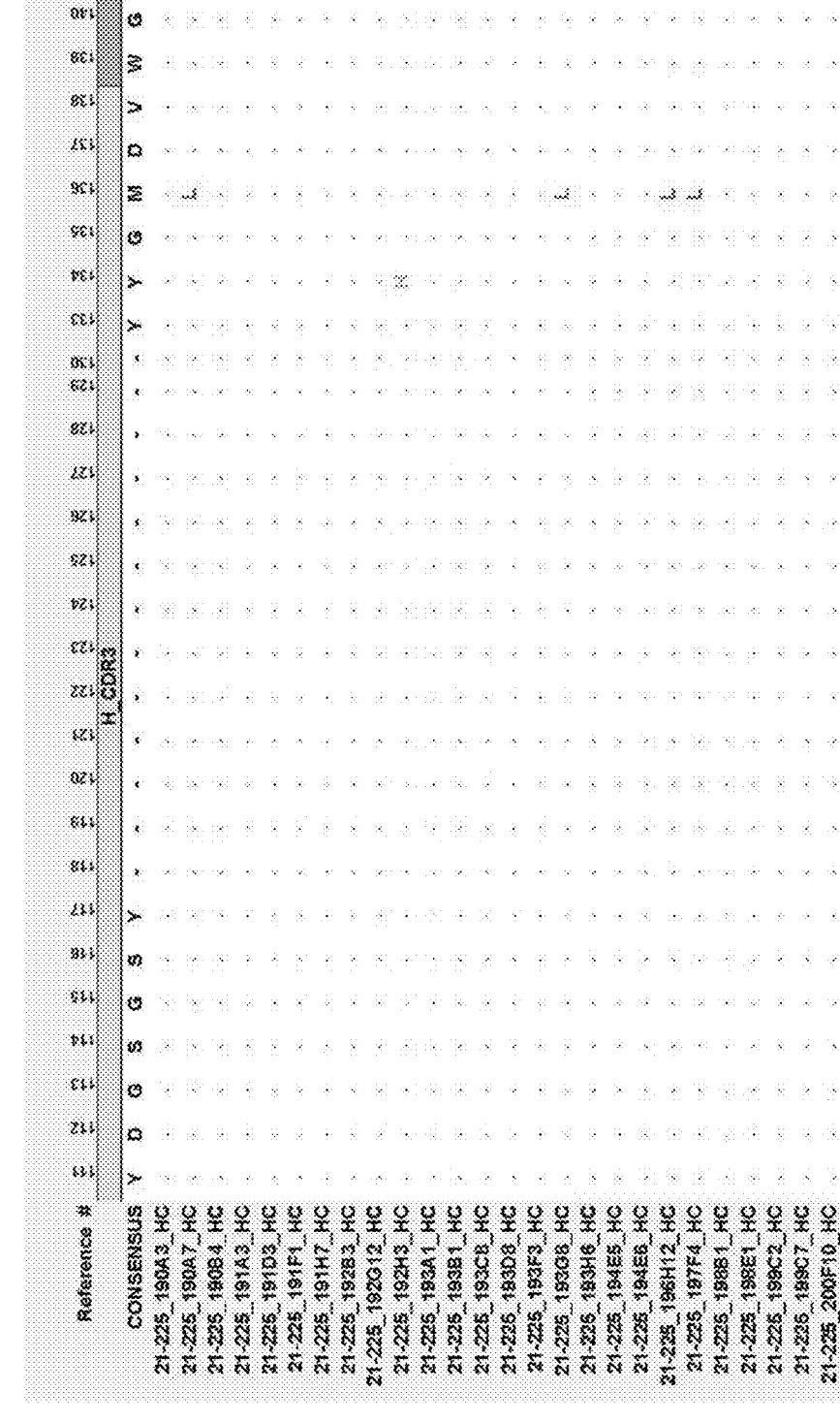
Figure 57:
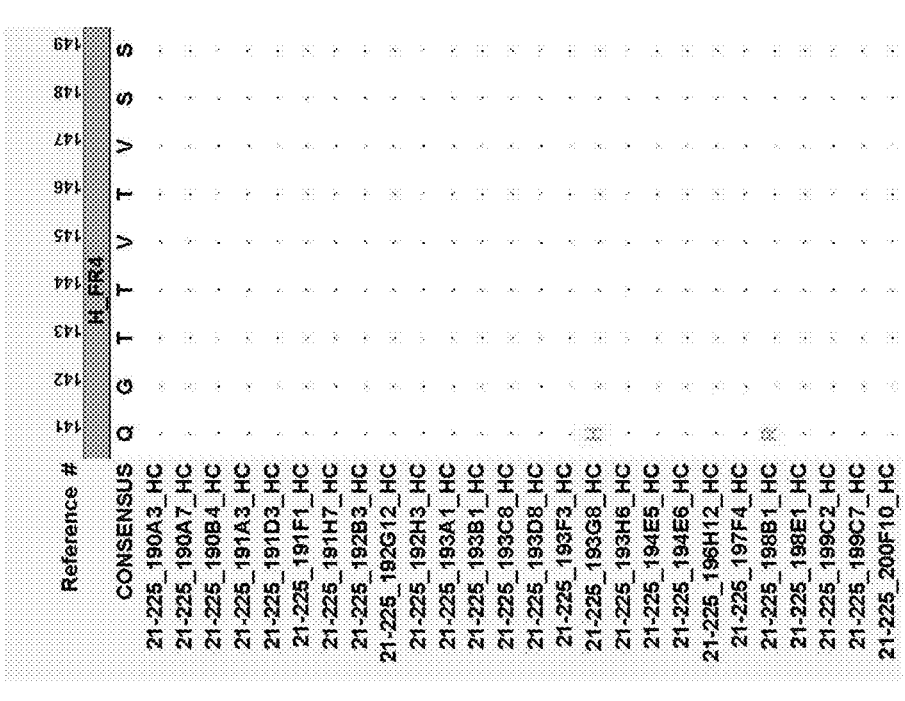
Figure 57:
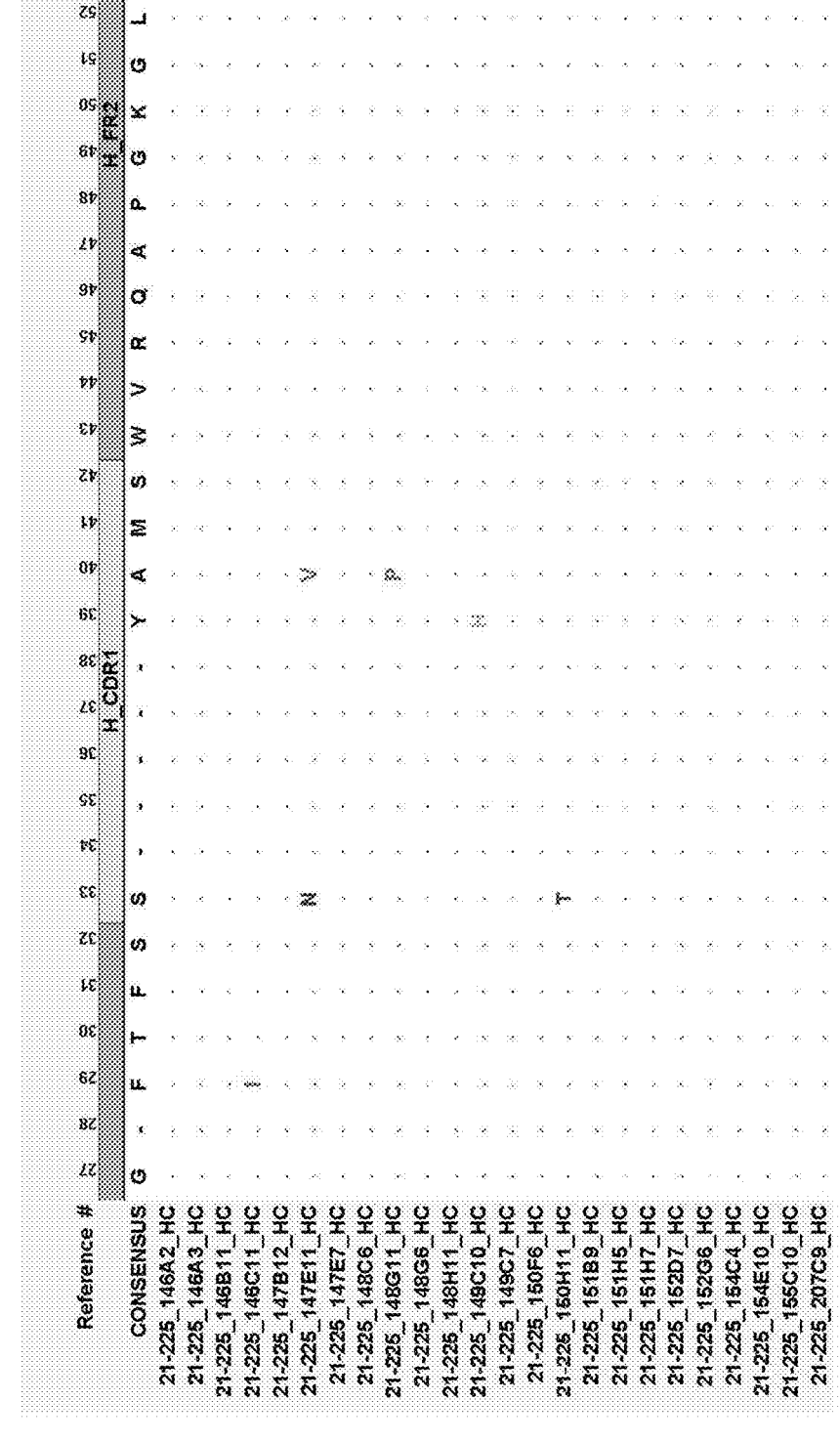
Figure 57:
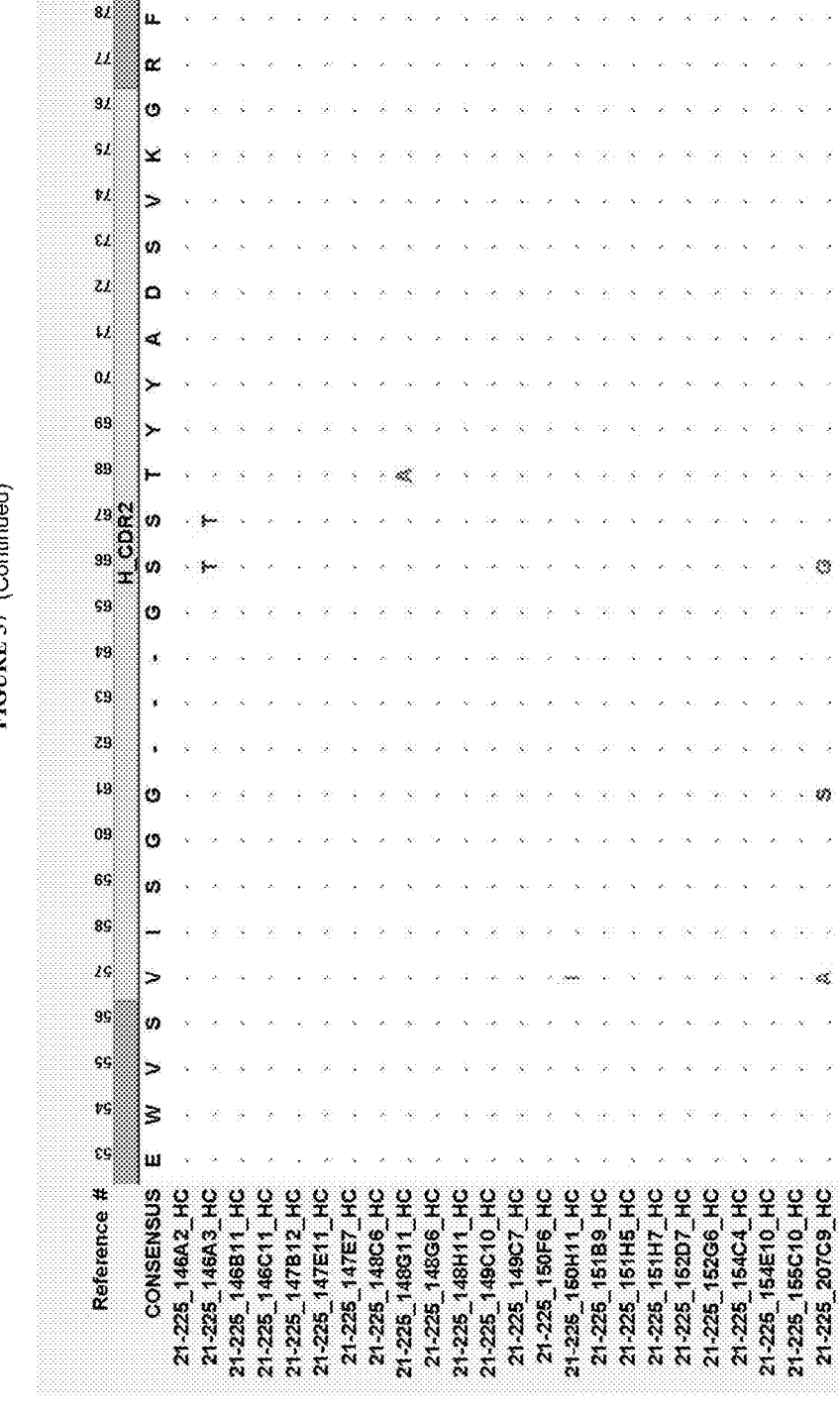
Figure 57:
Figure 57:
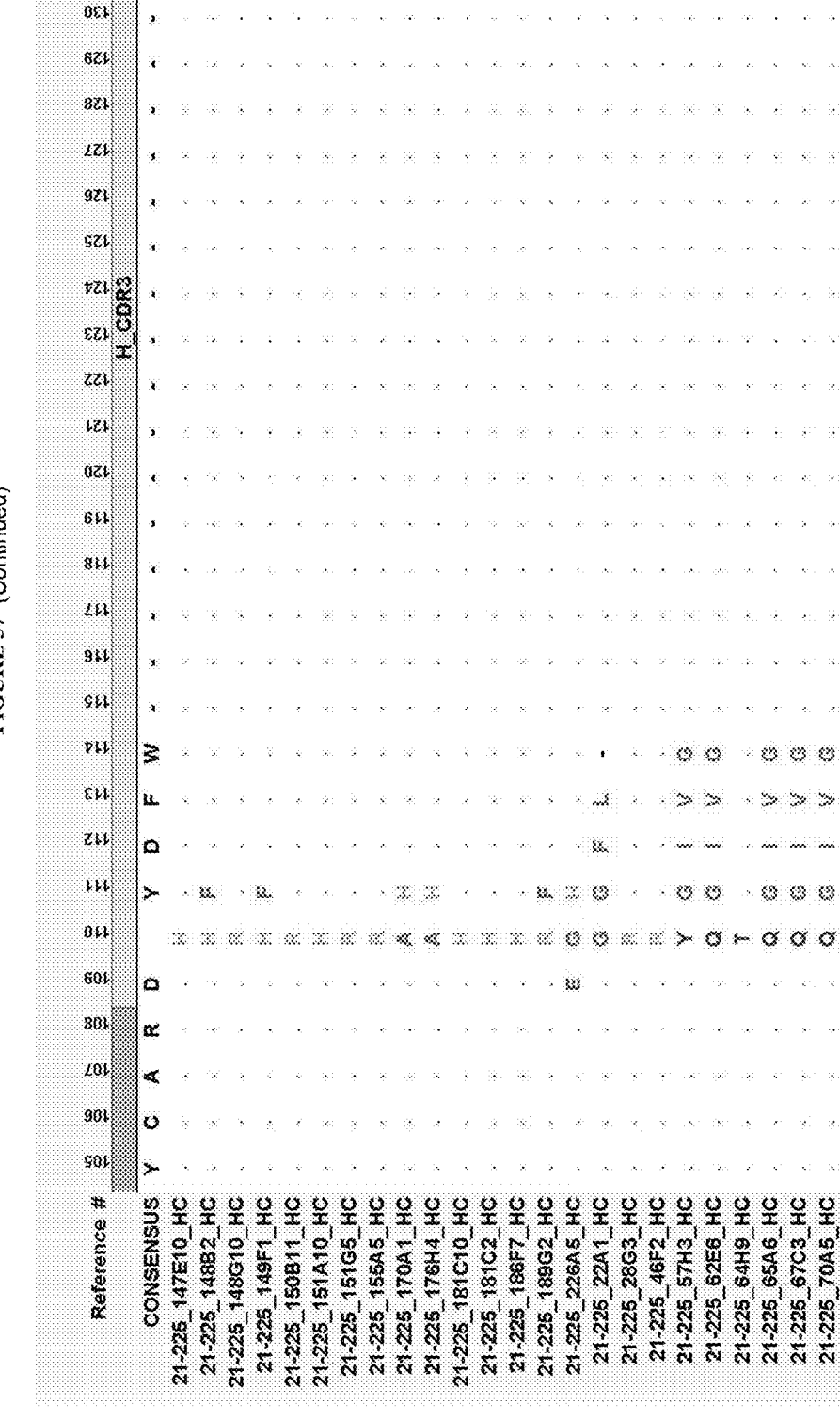
Figure 57:
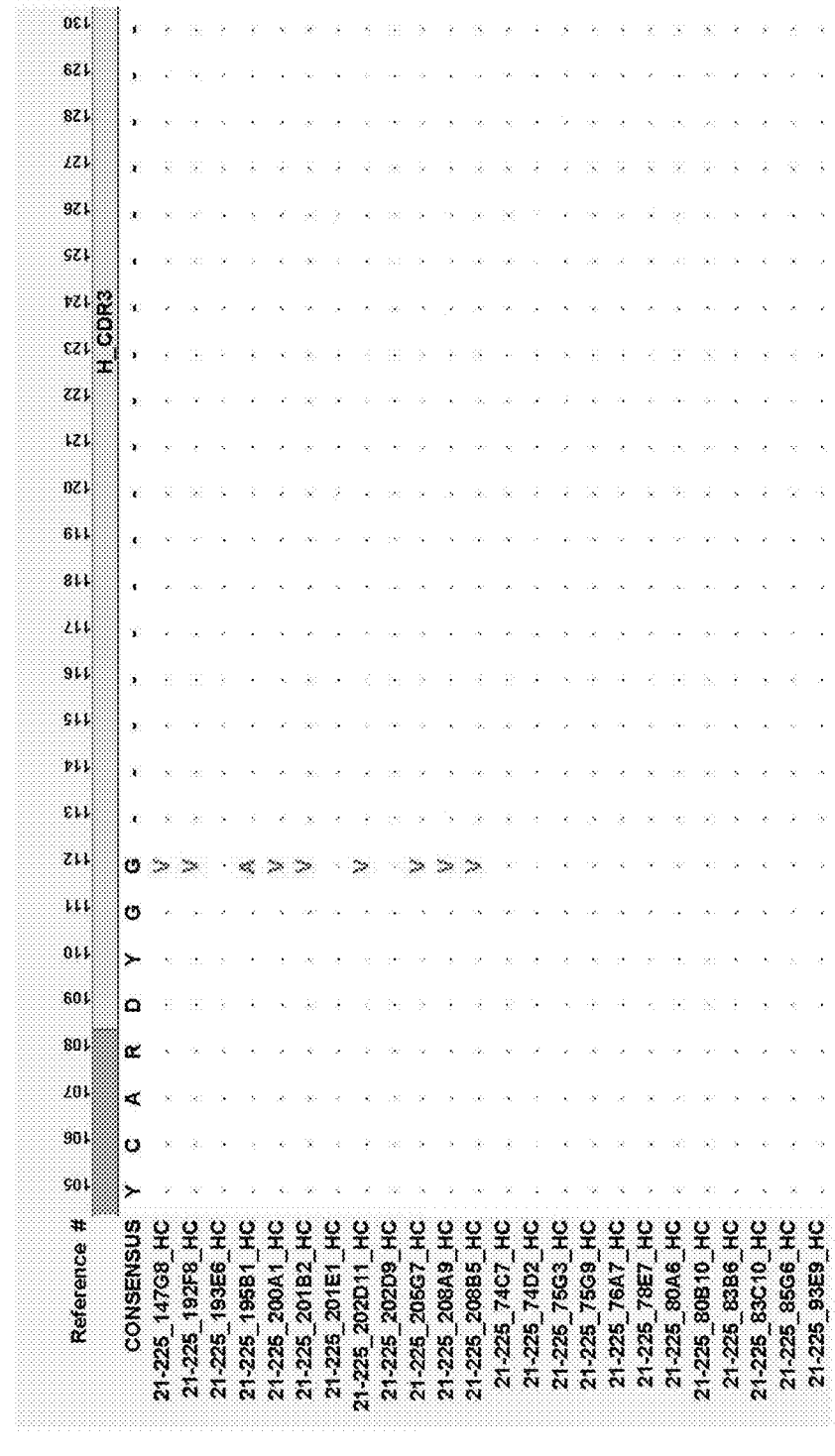
Figure 57:
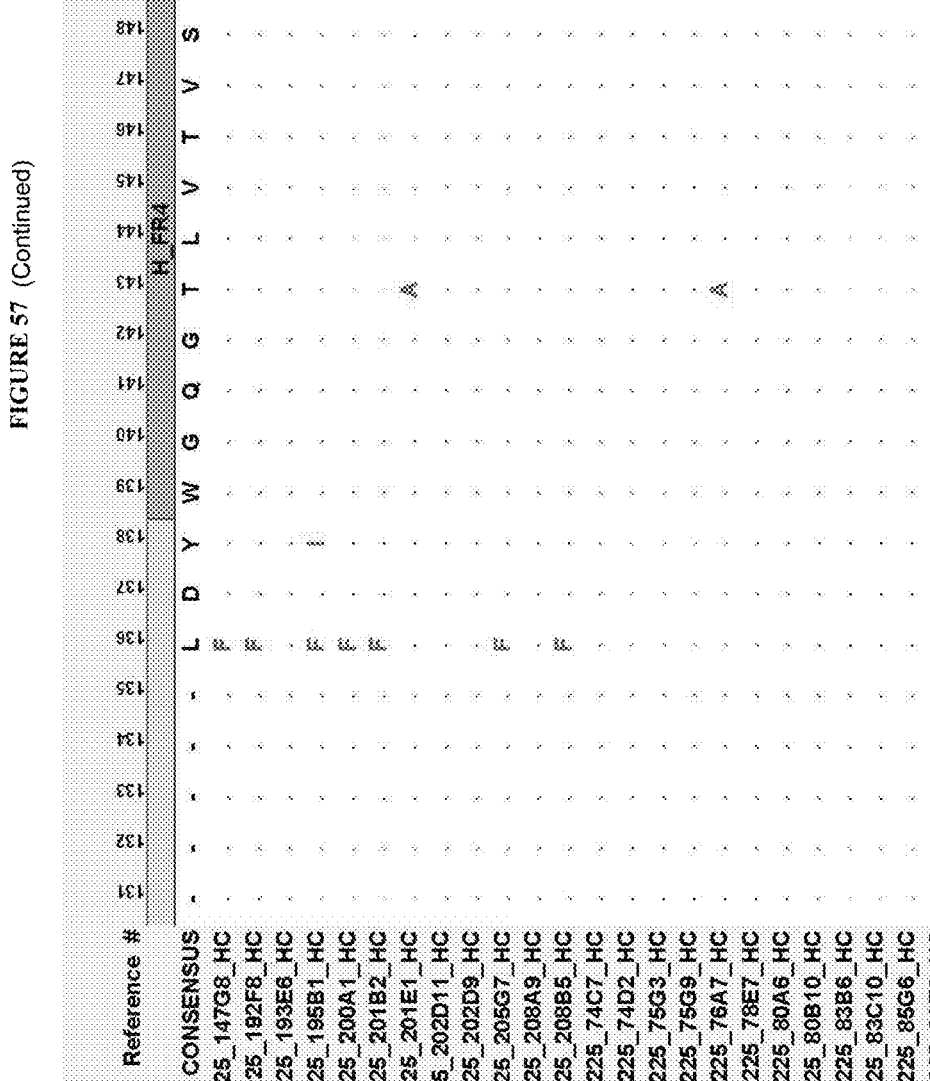
Figure 57:
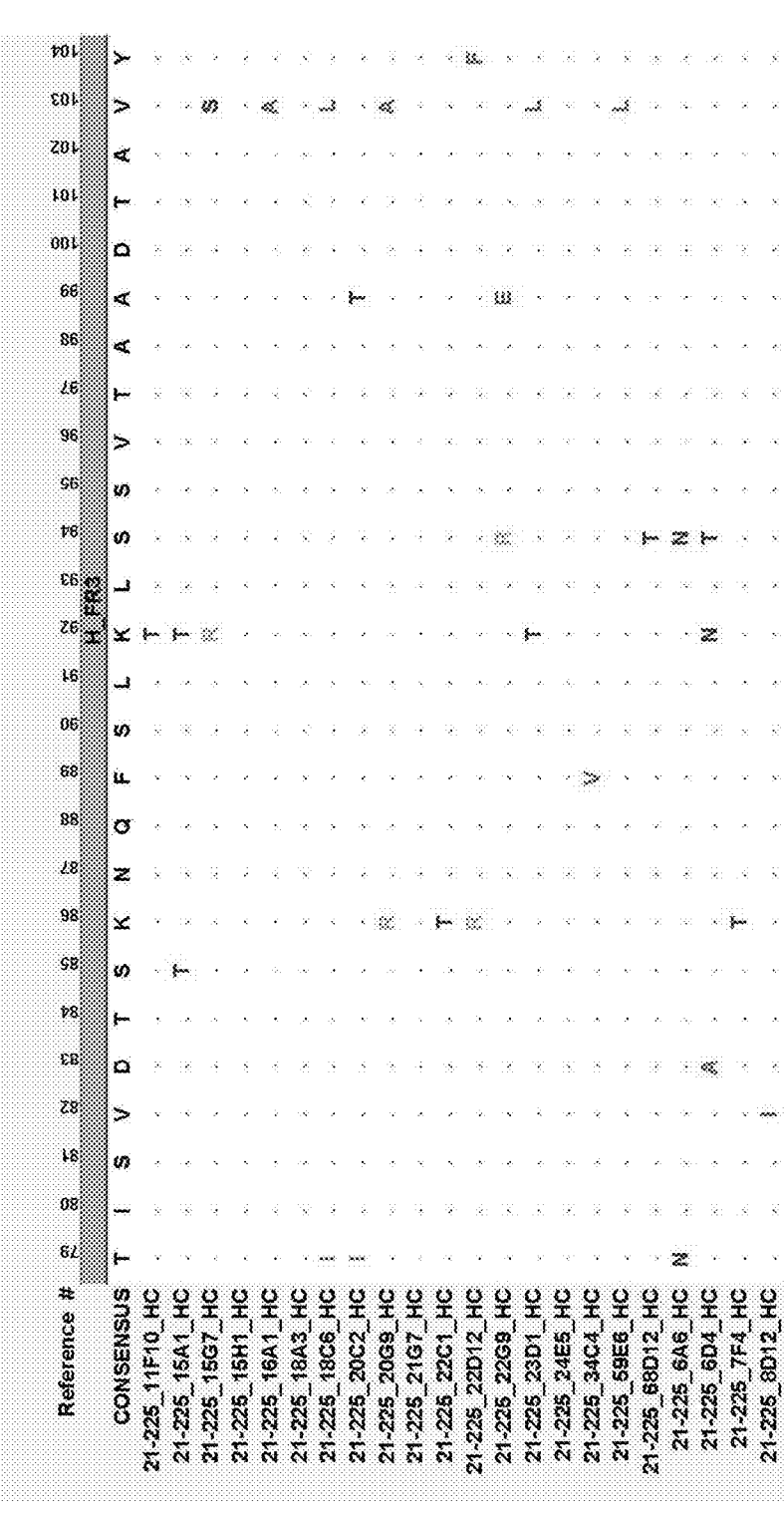
Figure 57:
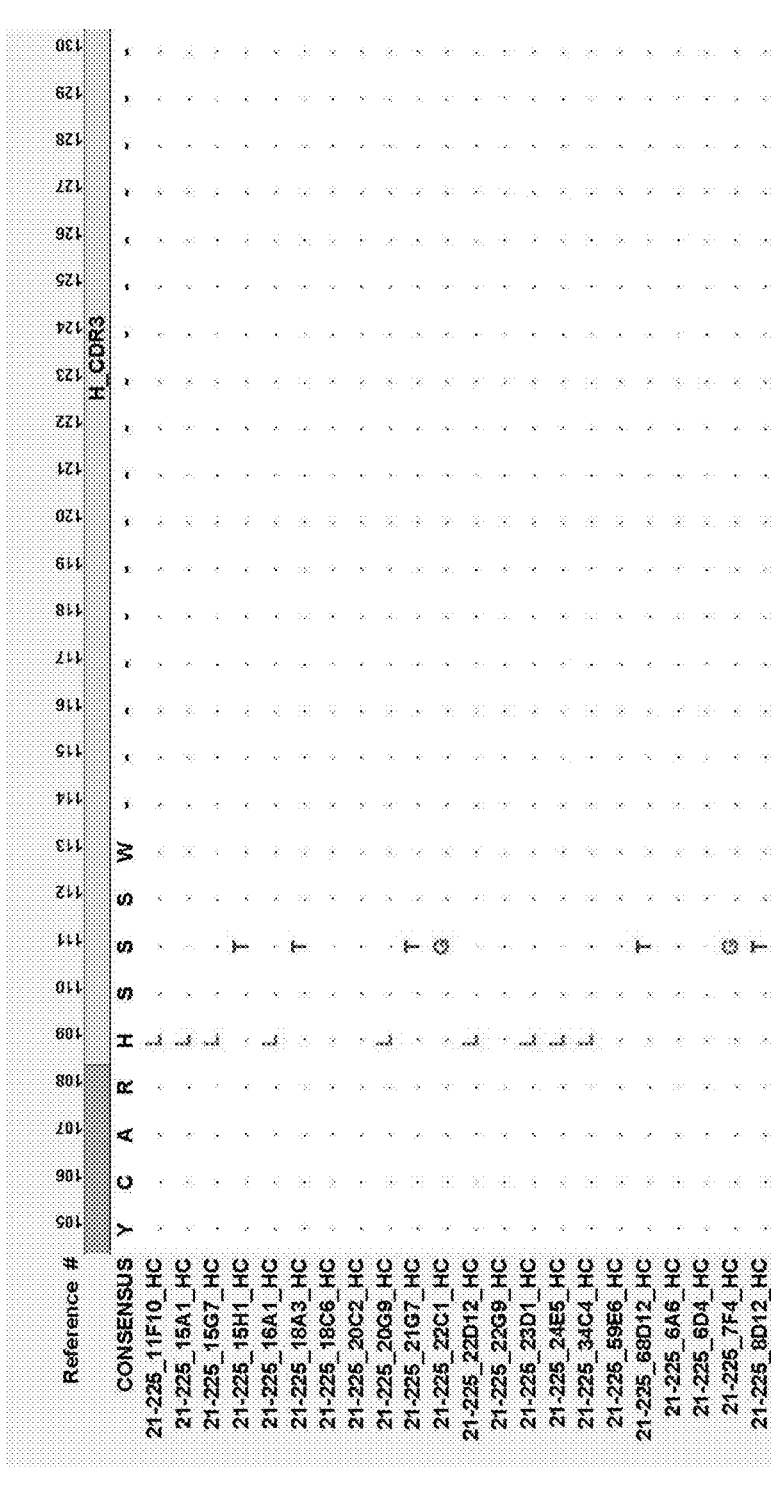
Figure 57:
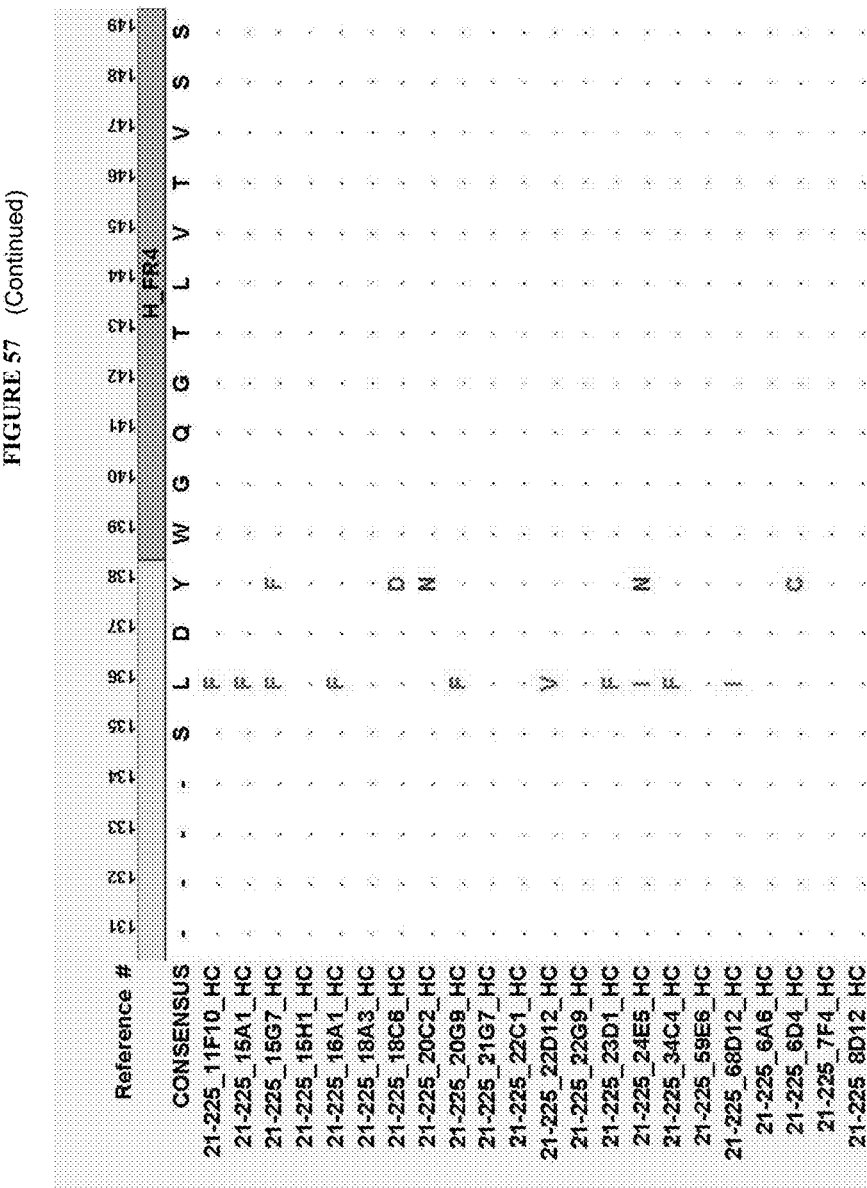
Figure 57:
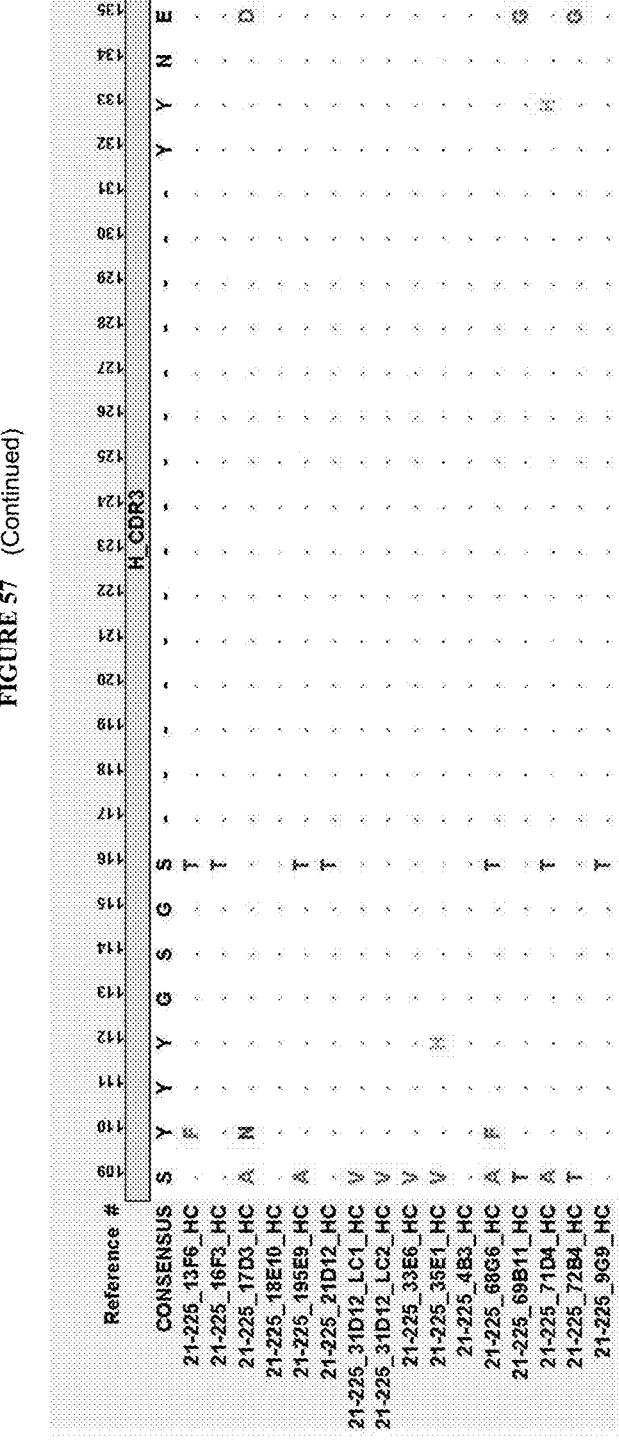
Figure 57:
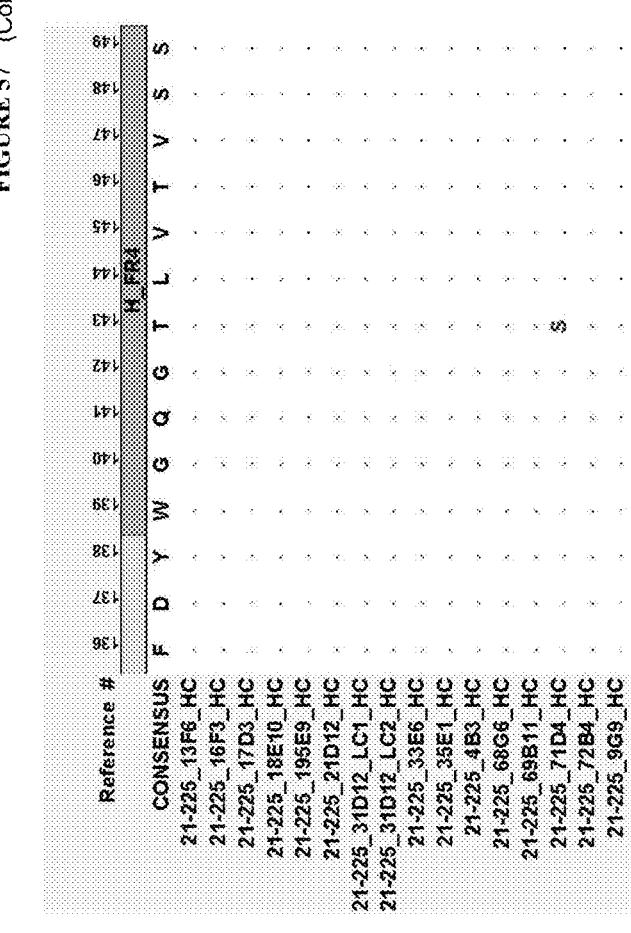
Figure 57:
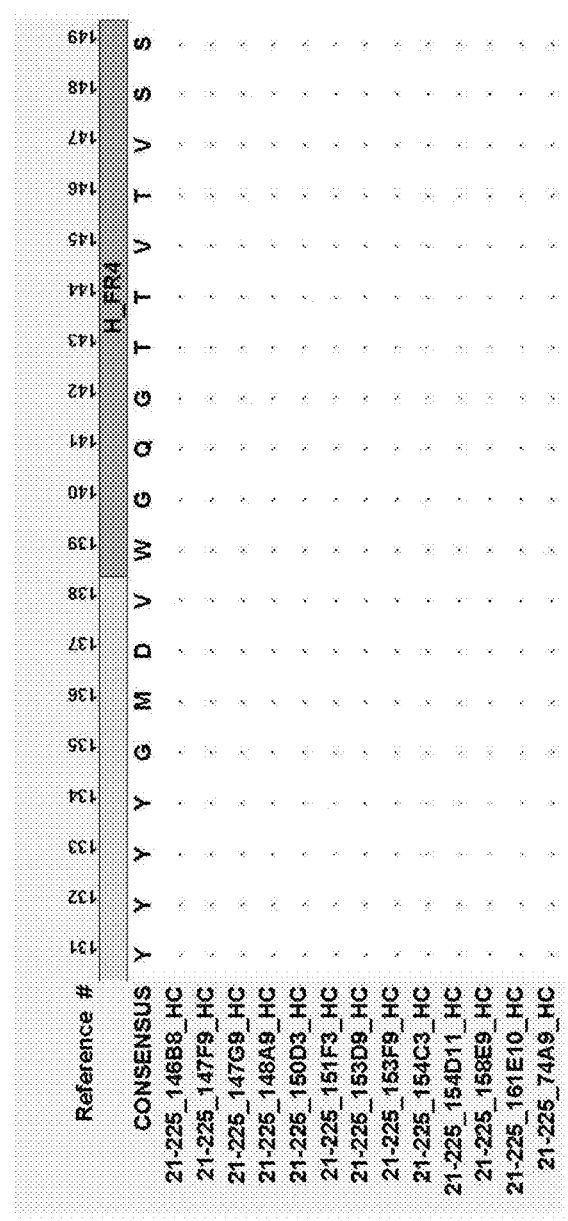
Figure 57:
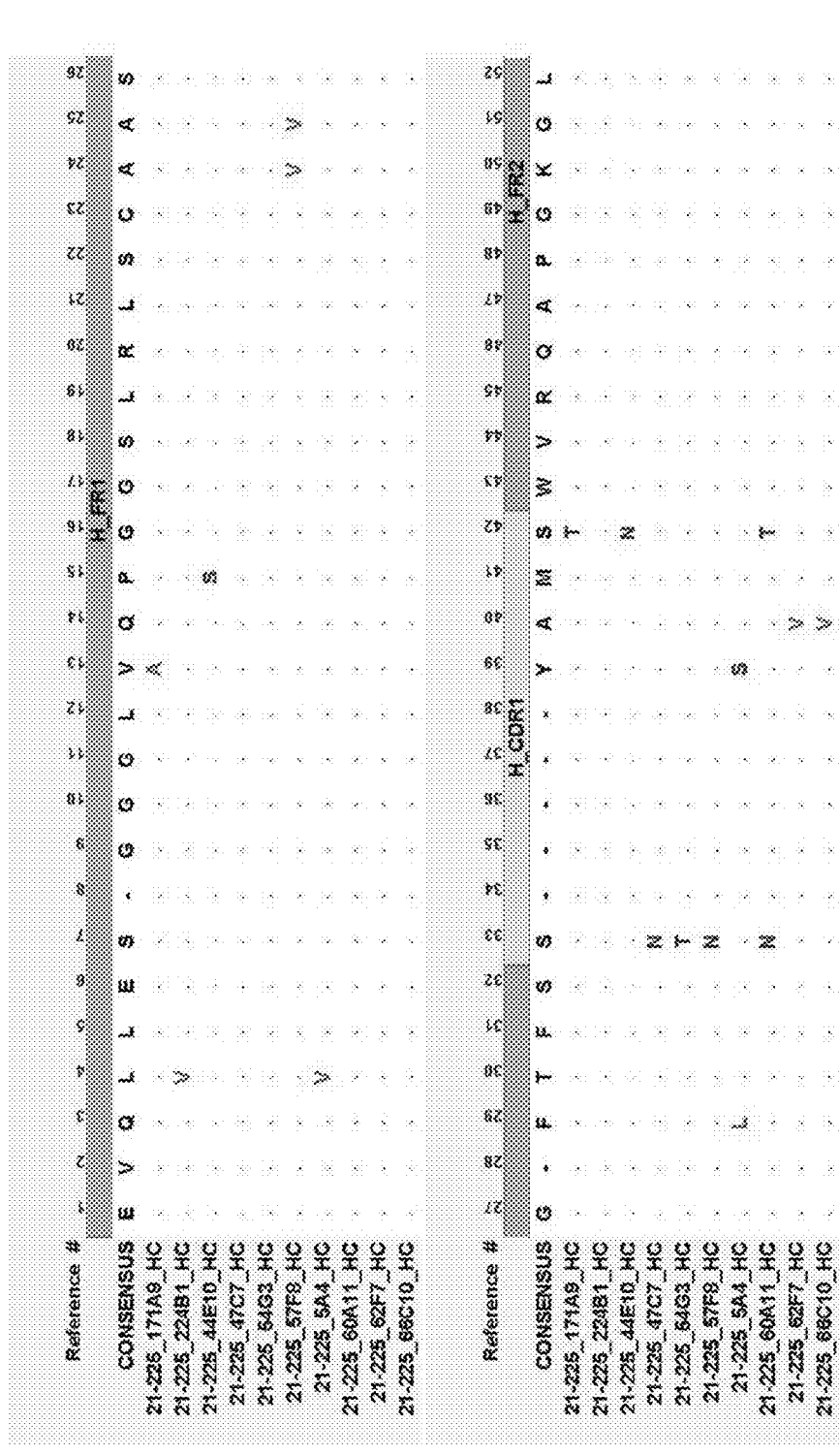
Figure 57:
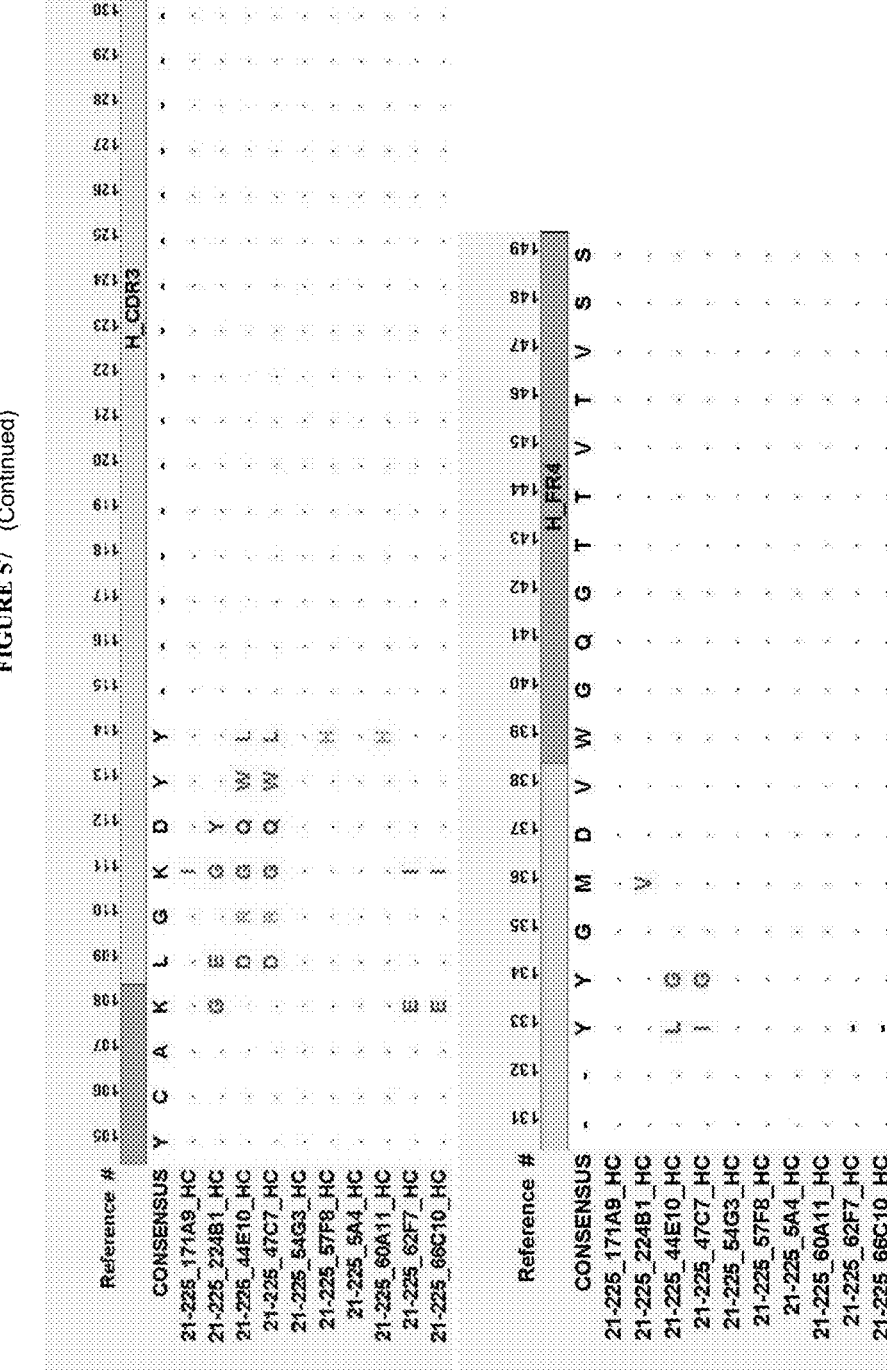
Figure 57:
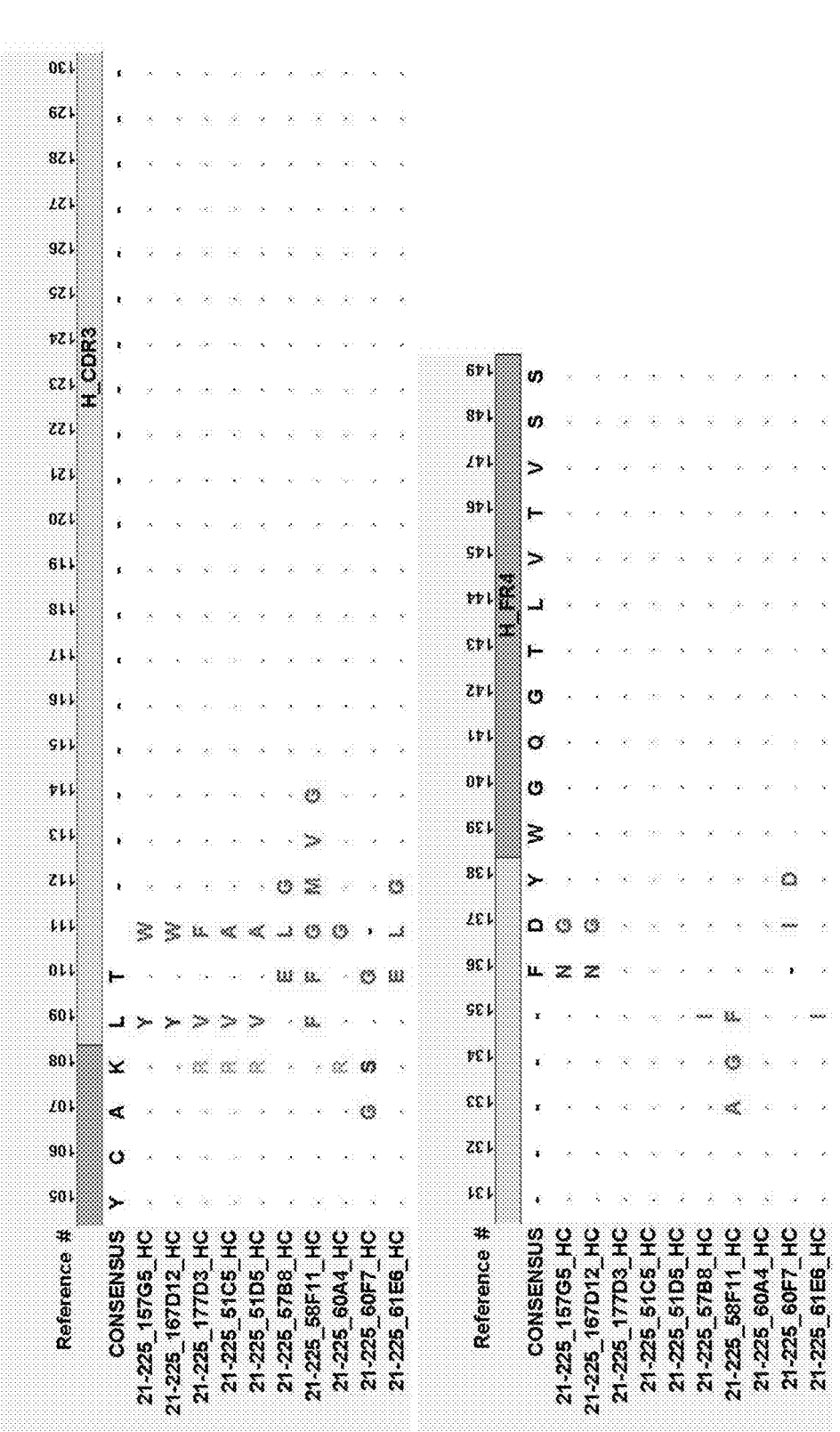
Figure 57:
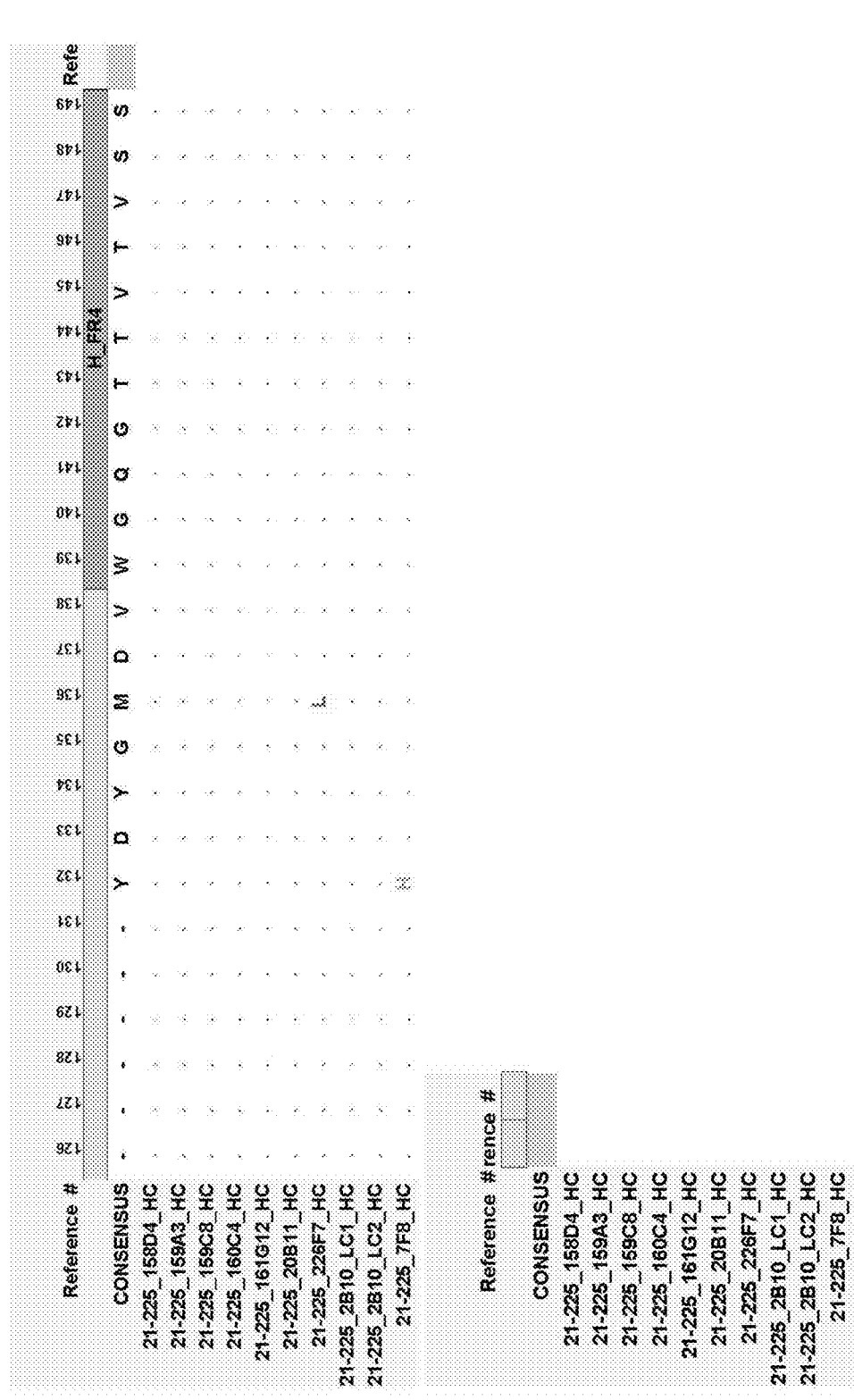
Figure 57:
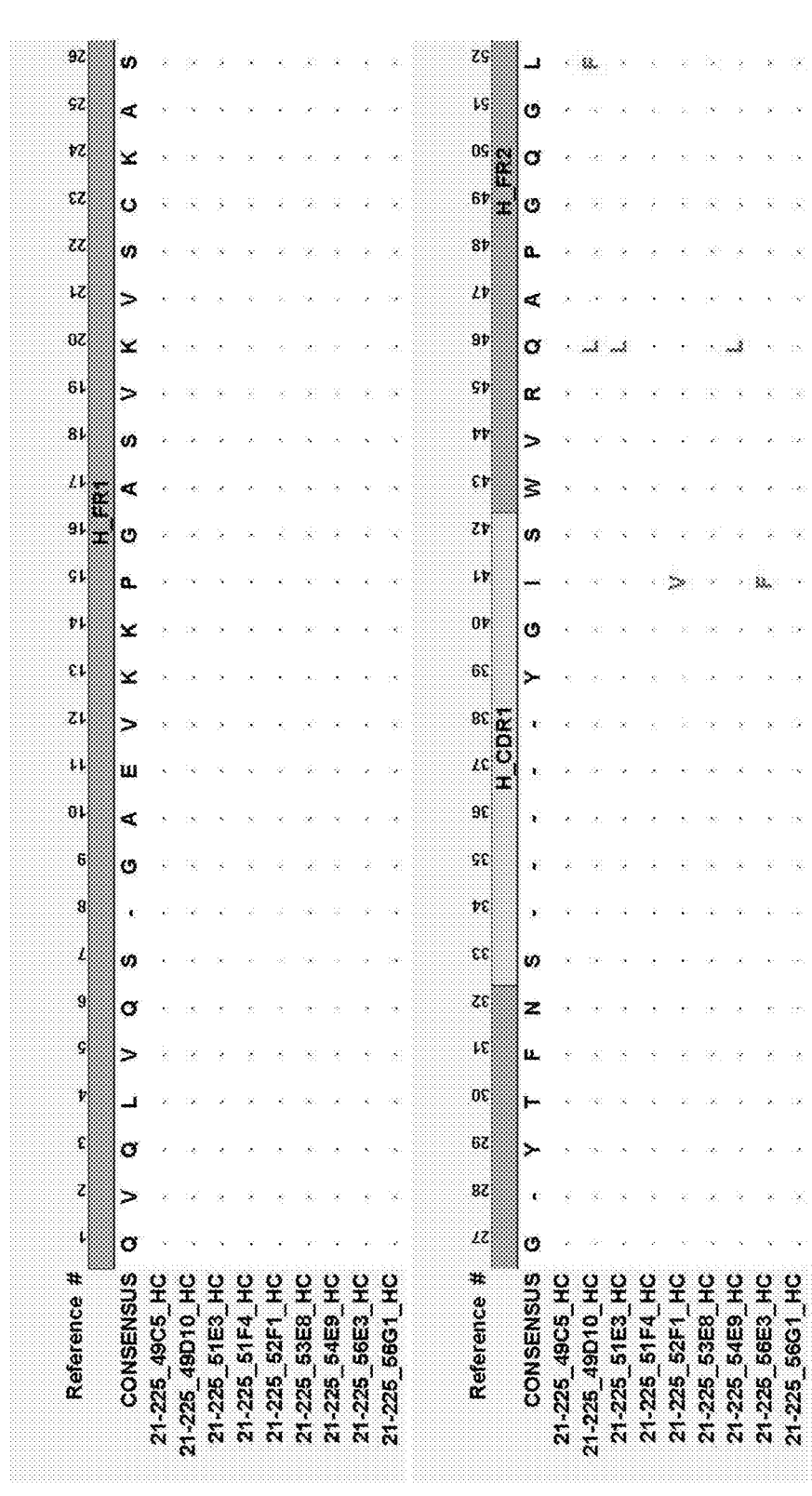
Figure 57:
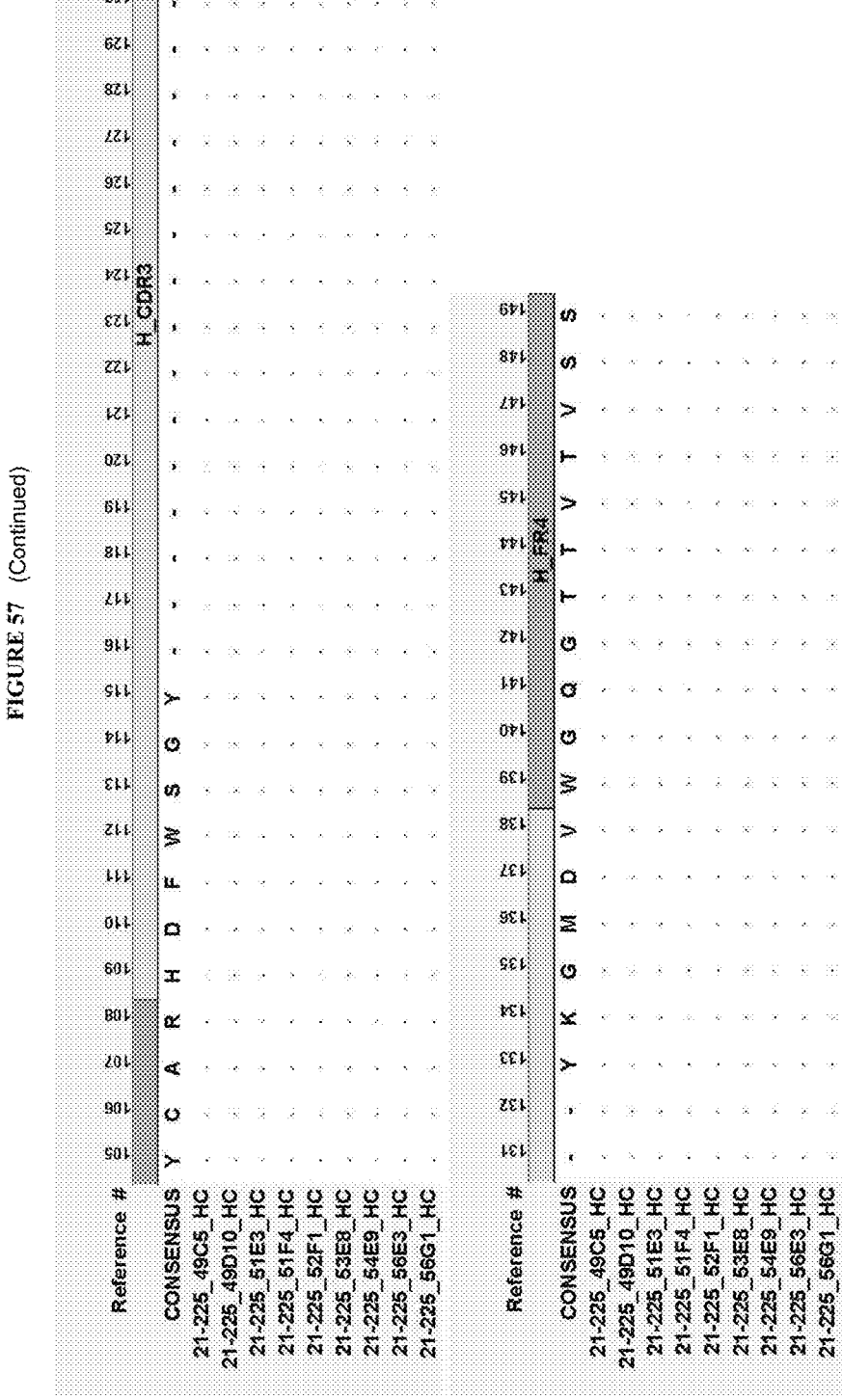
Figure 57:
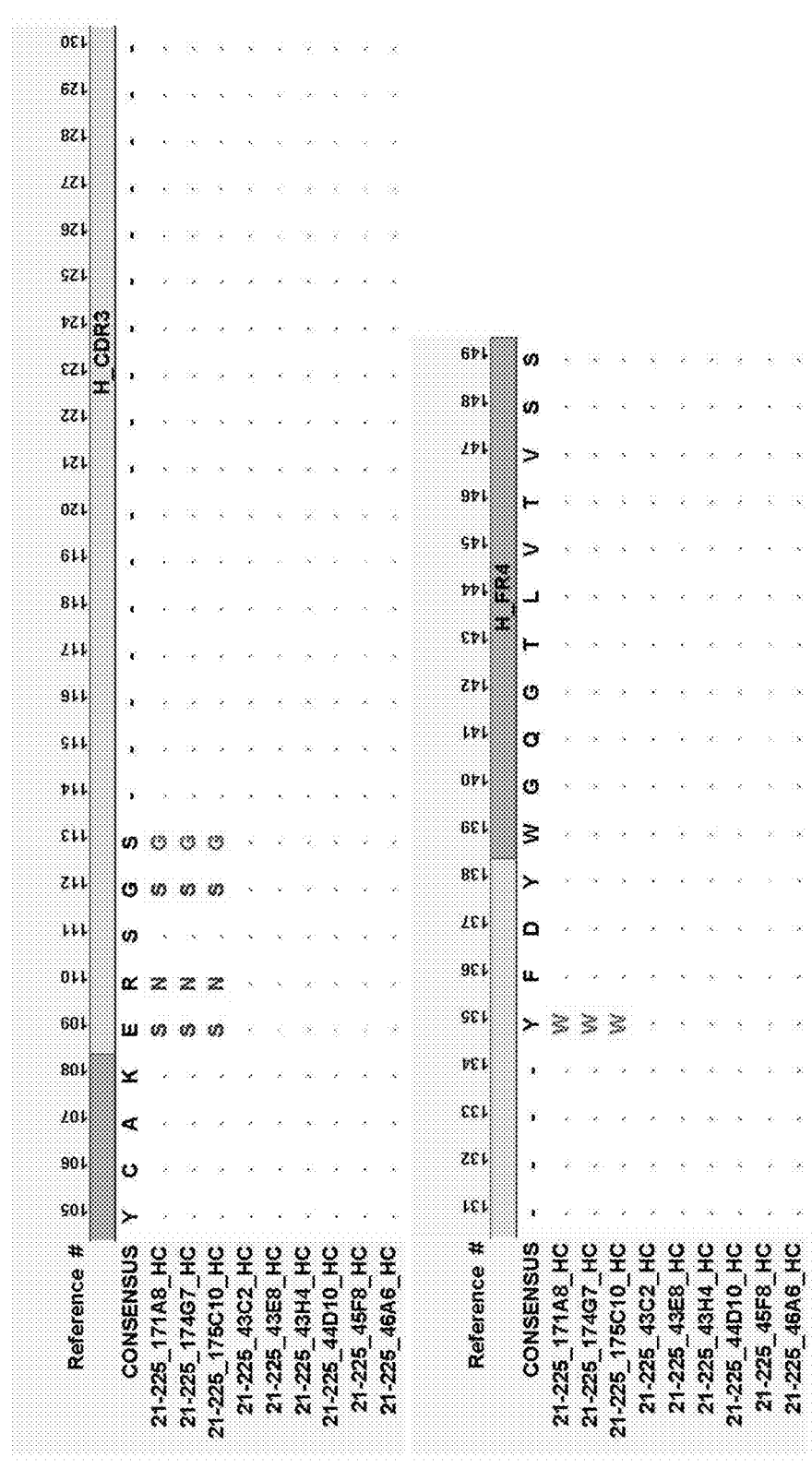
Figure 57:
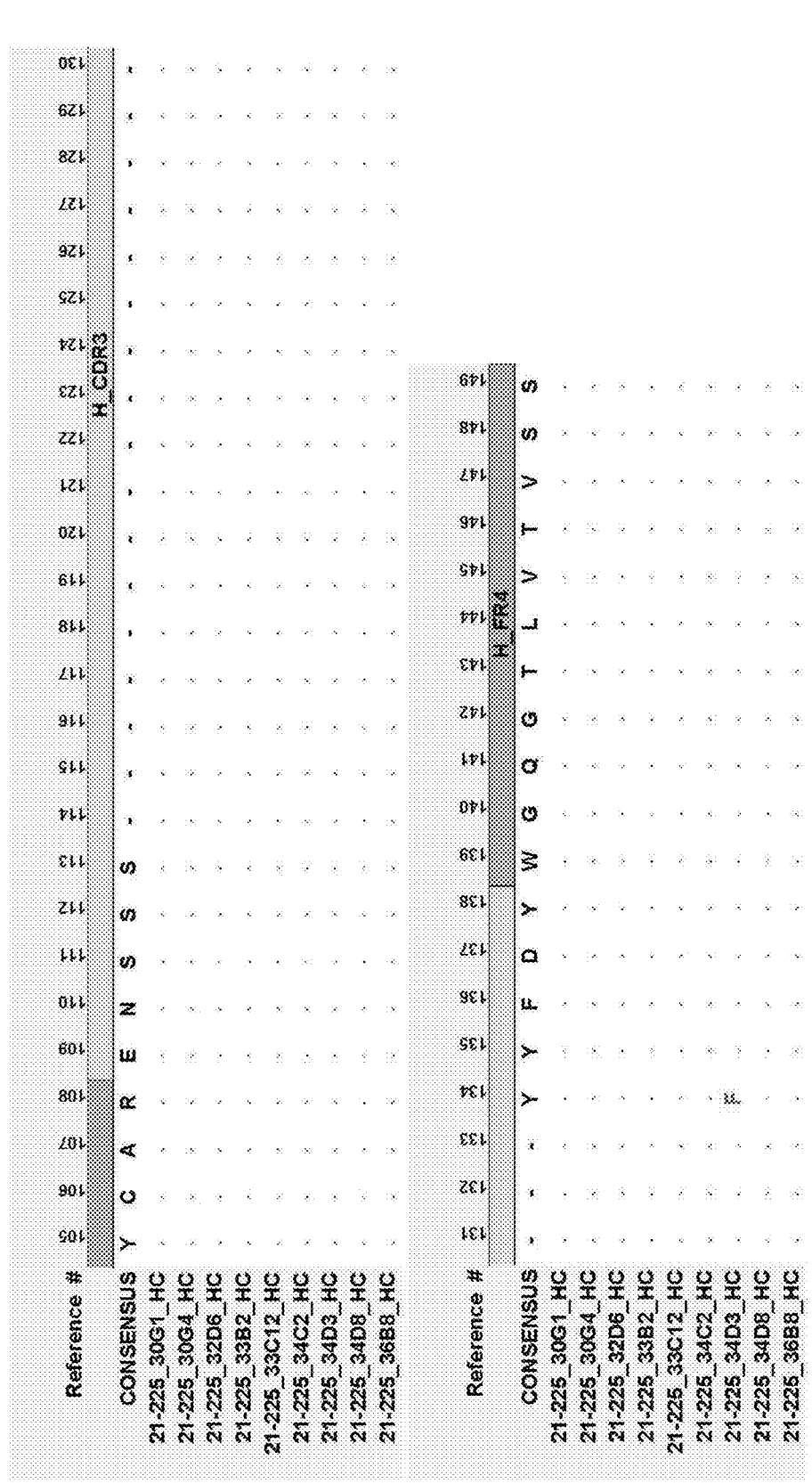
Figure 57:
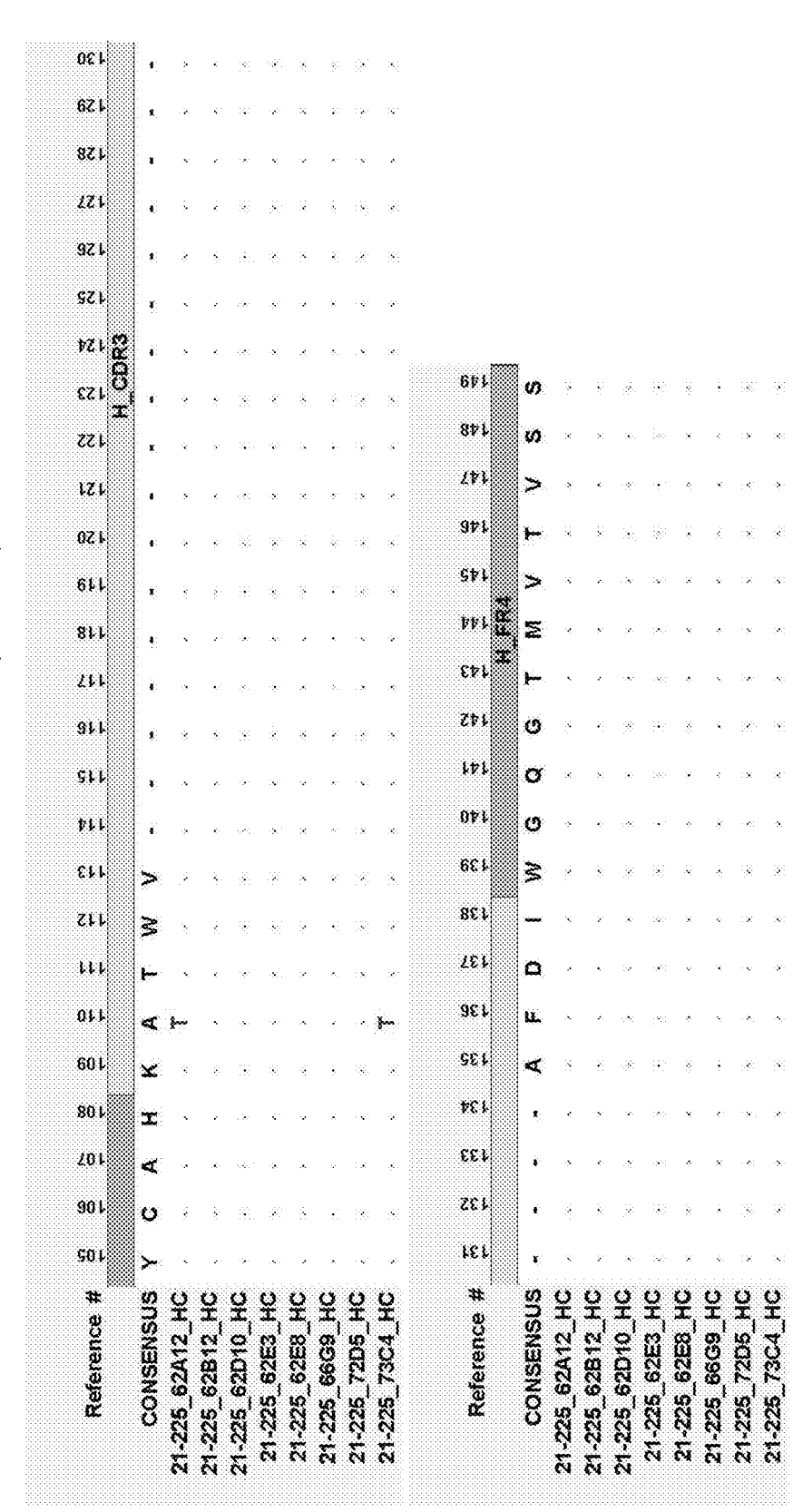
Figure 57:
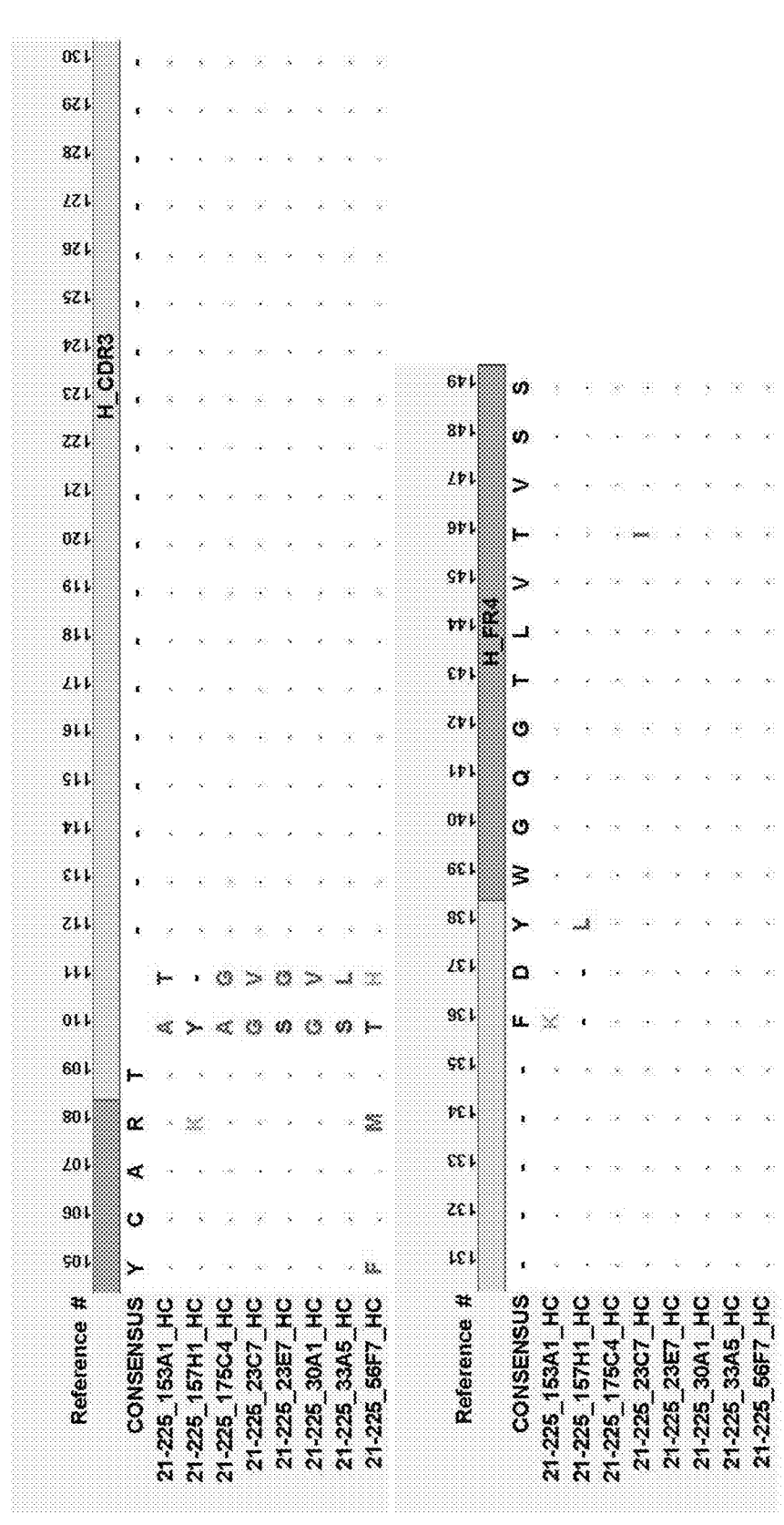
Figure 57:
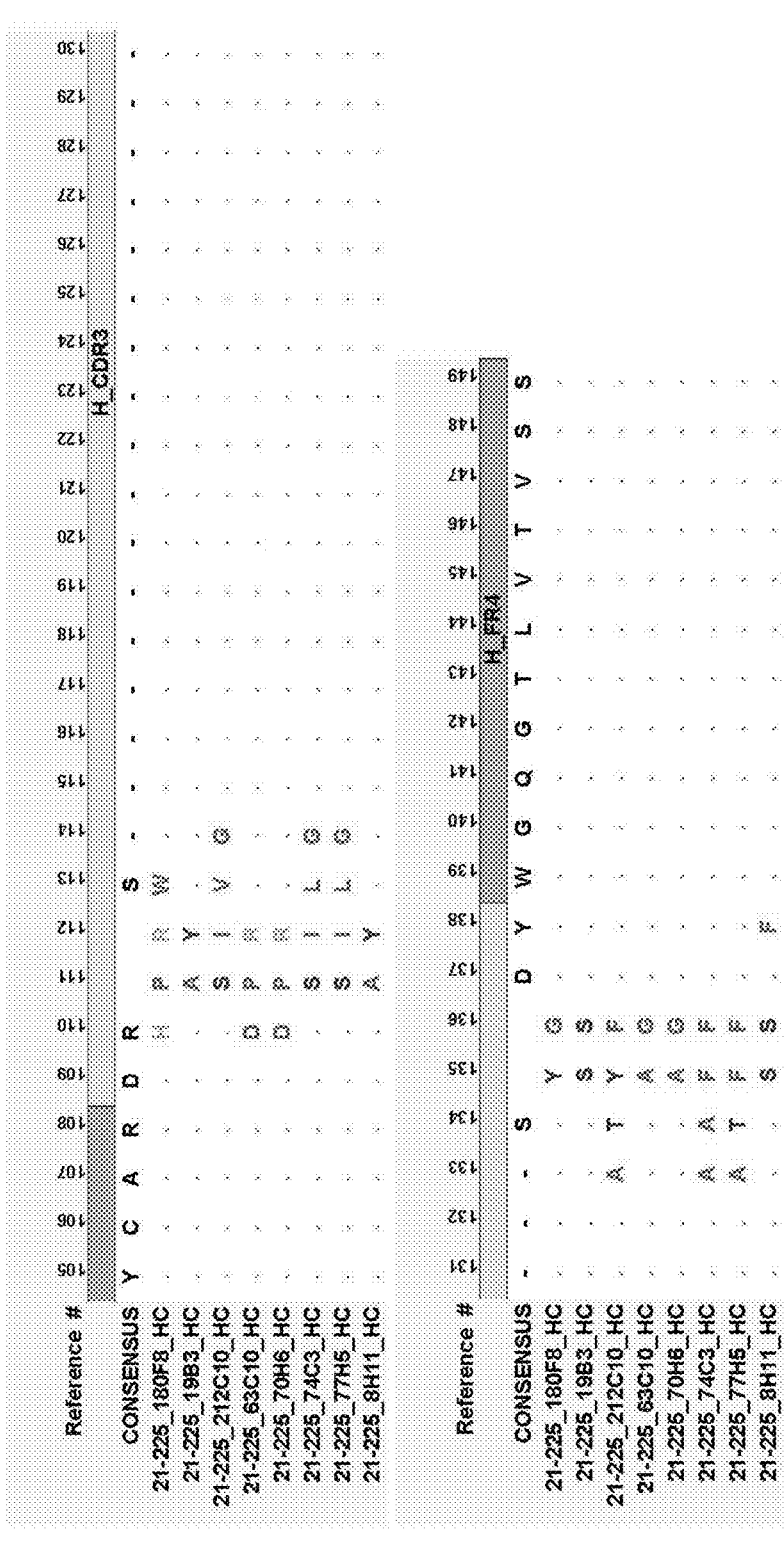
Figure 57:
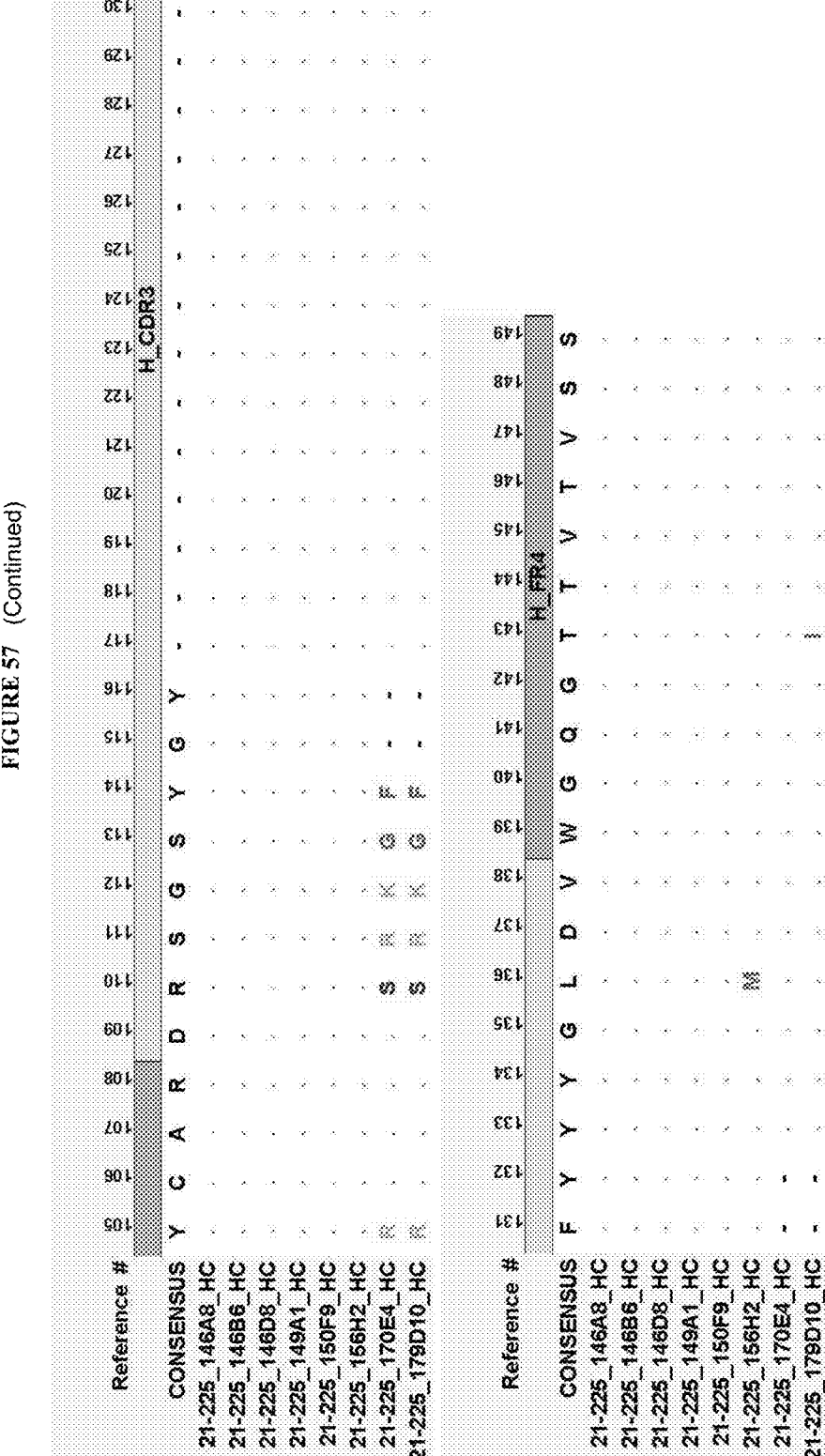
Figure 57:
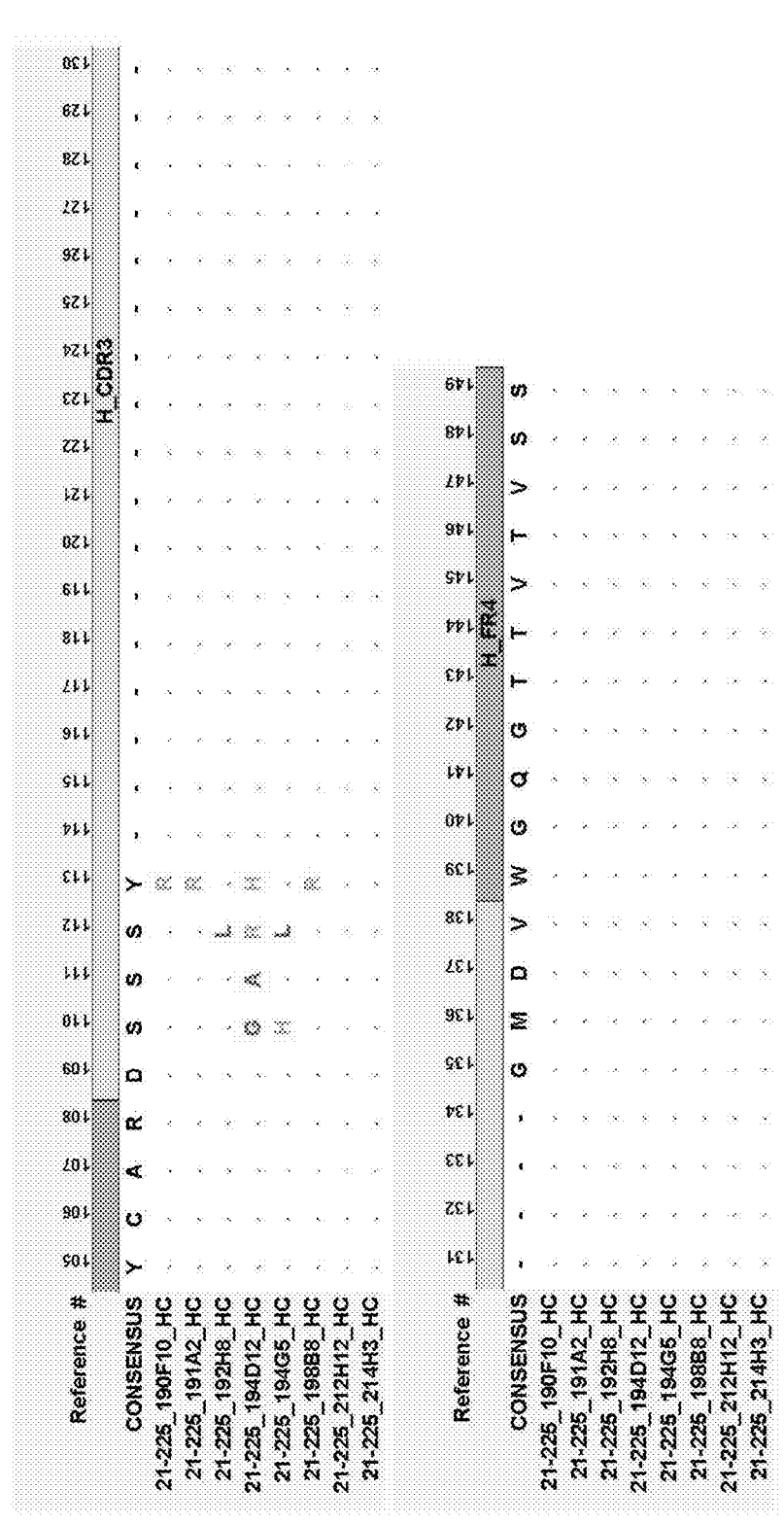
Figure 57:
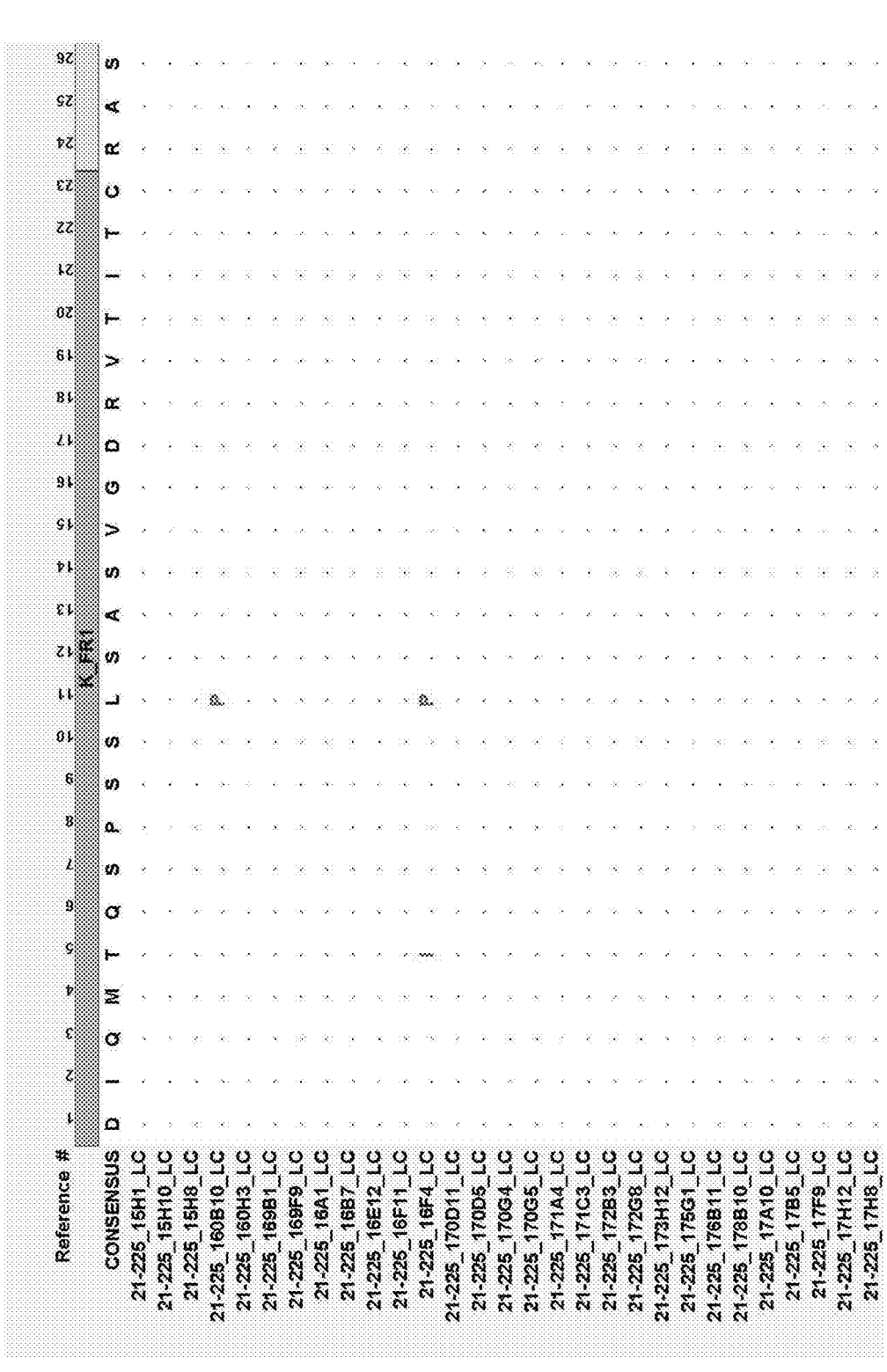
Figure 57:
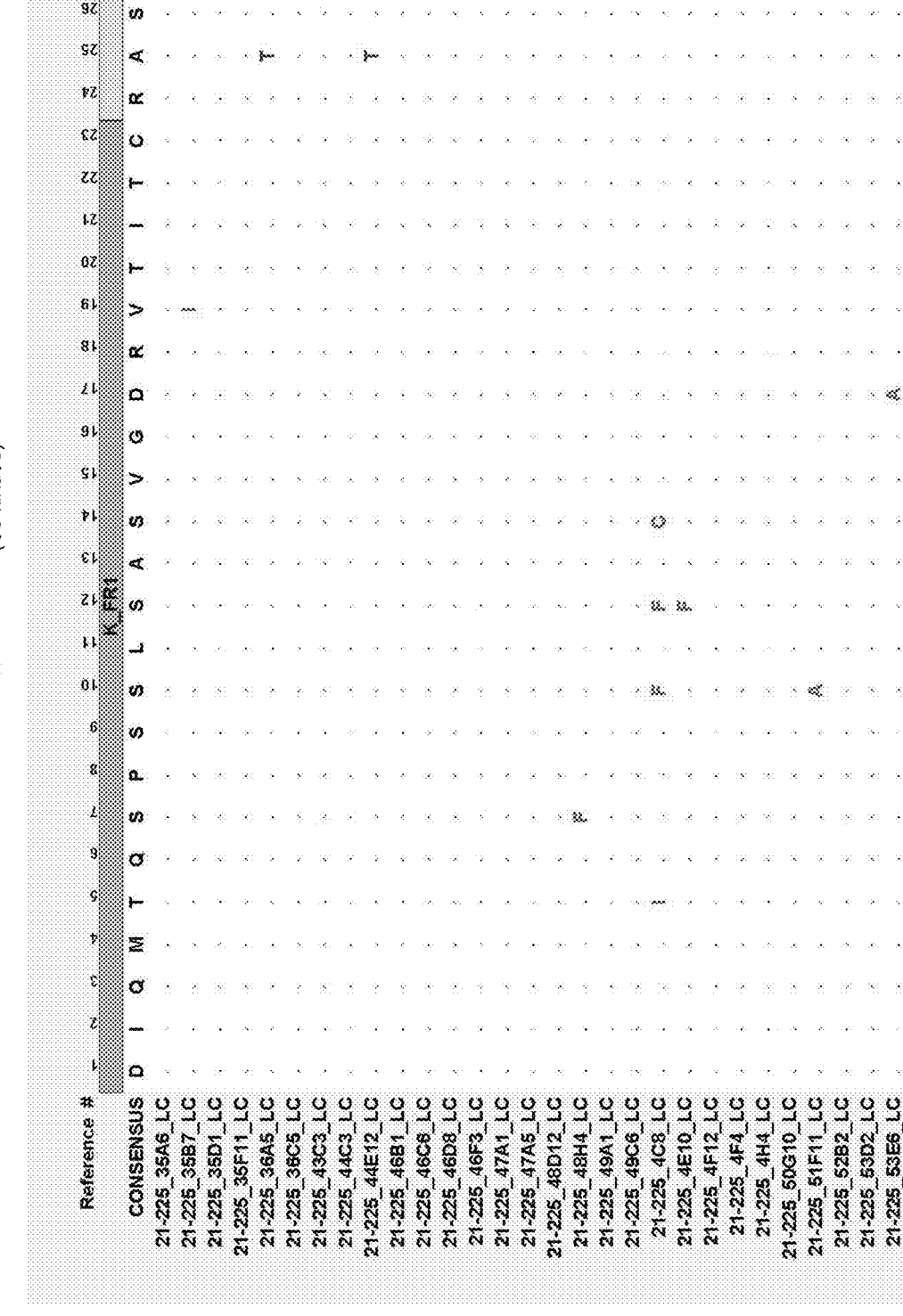
Figure 57:
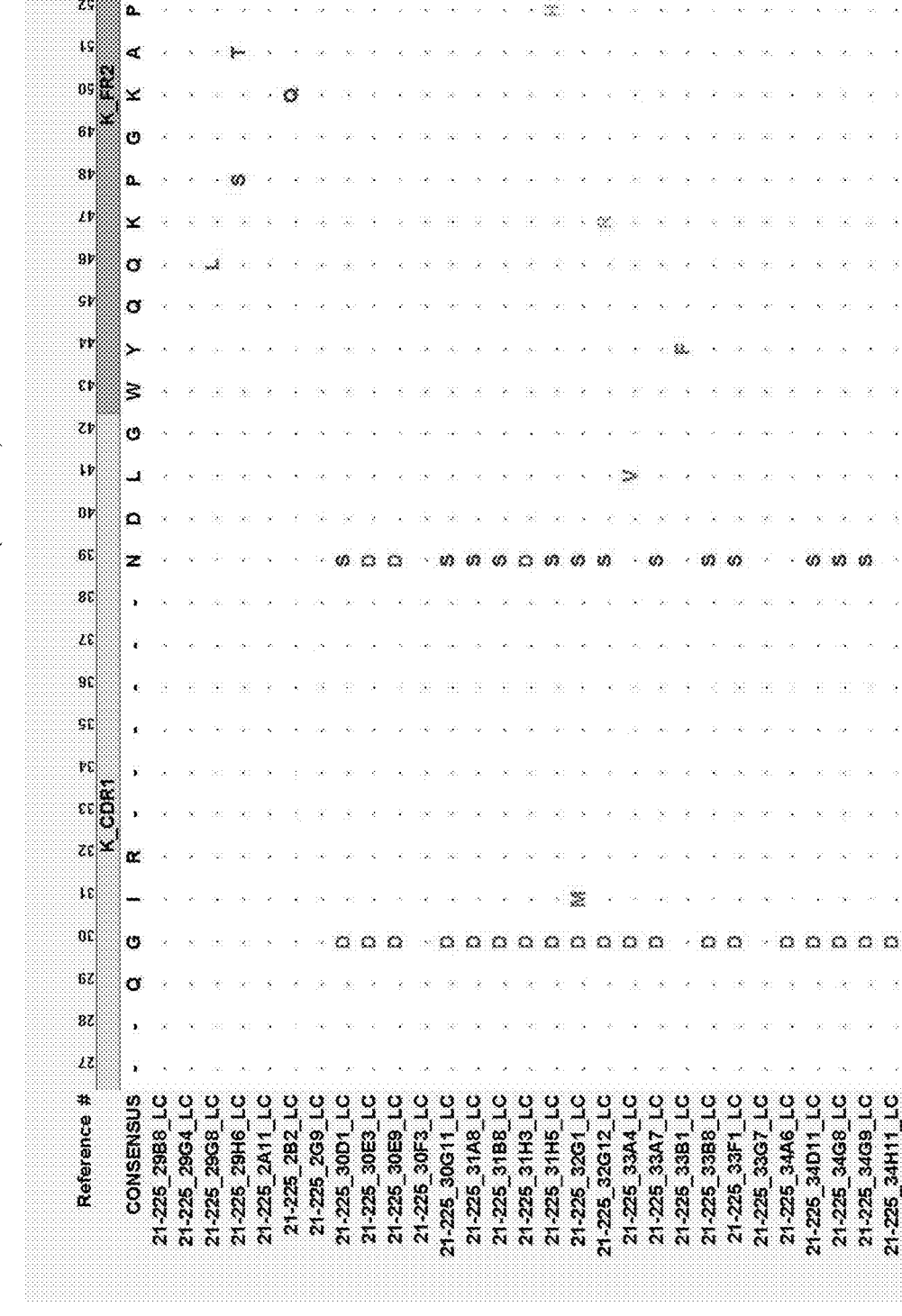
Figure 57:
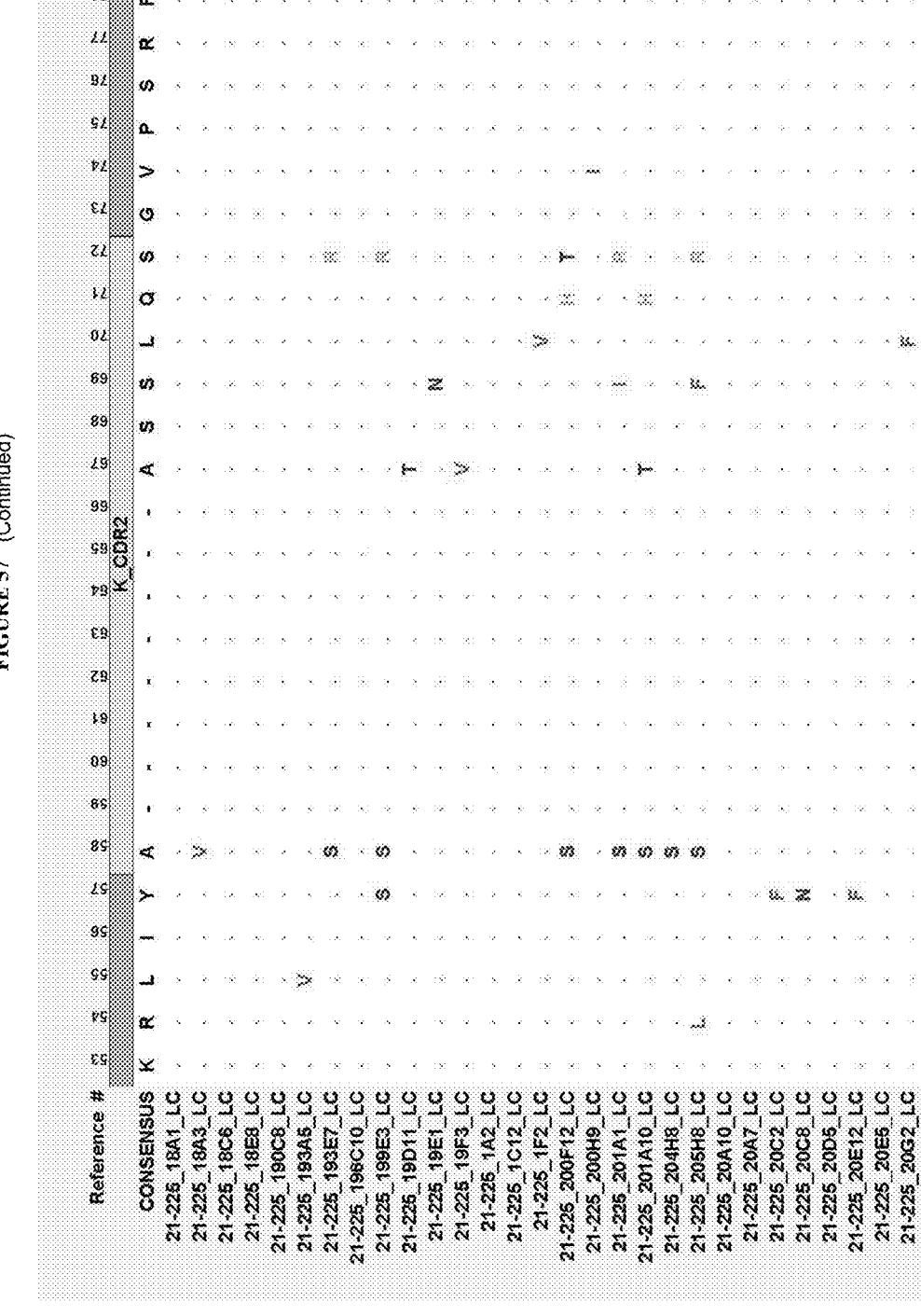
Figure 57:
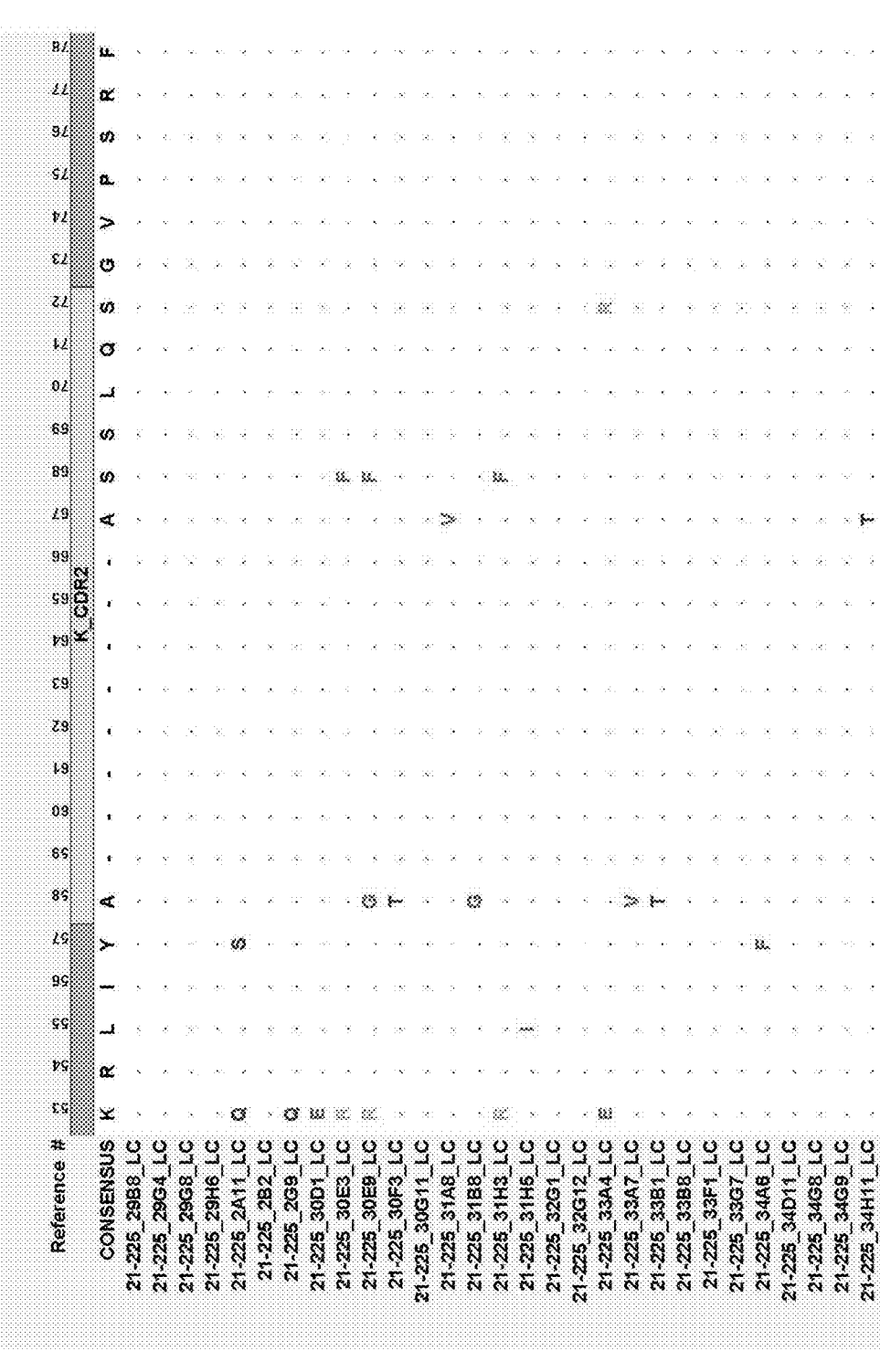
Figure 57:
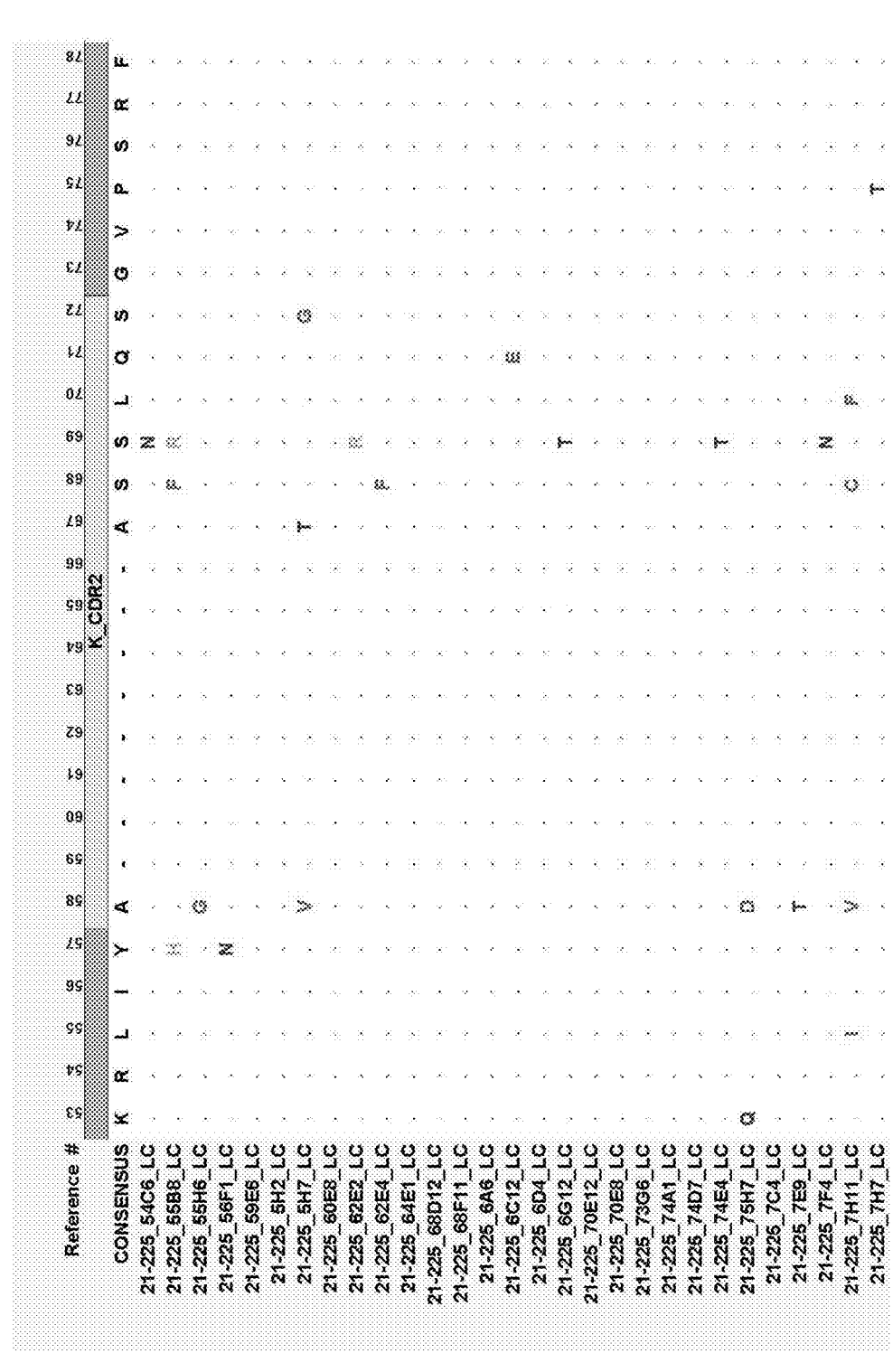
Figure 57:
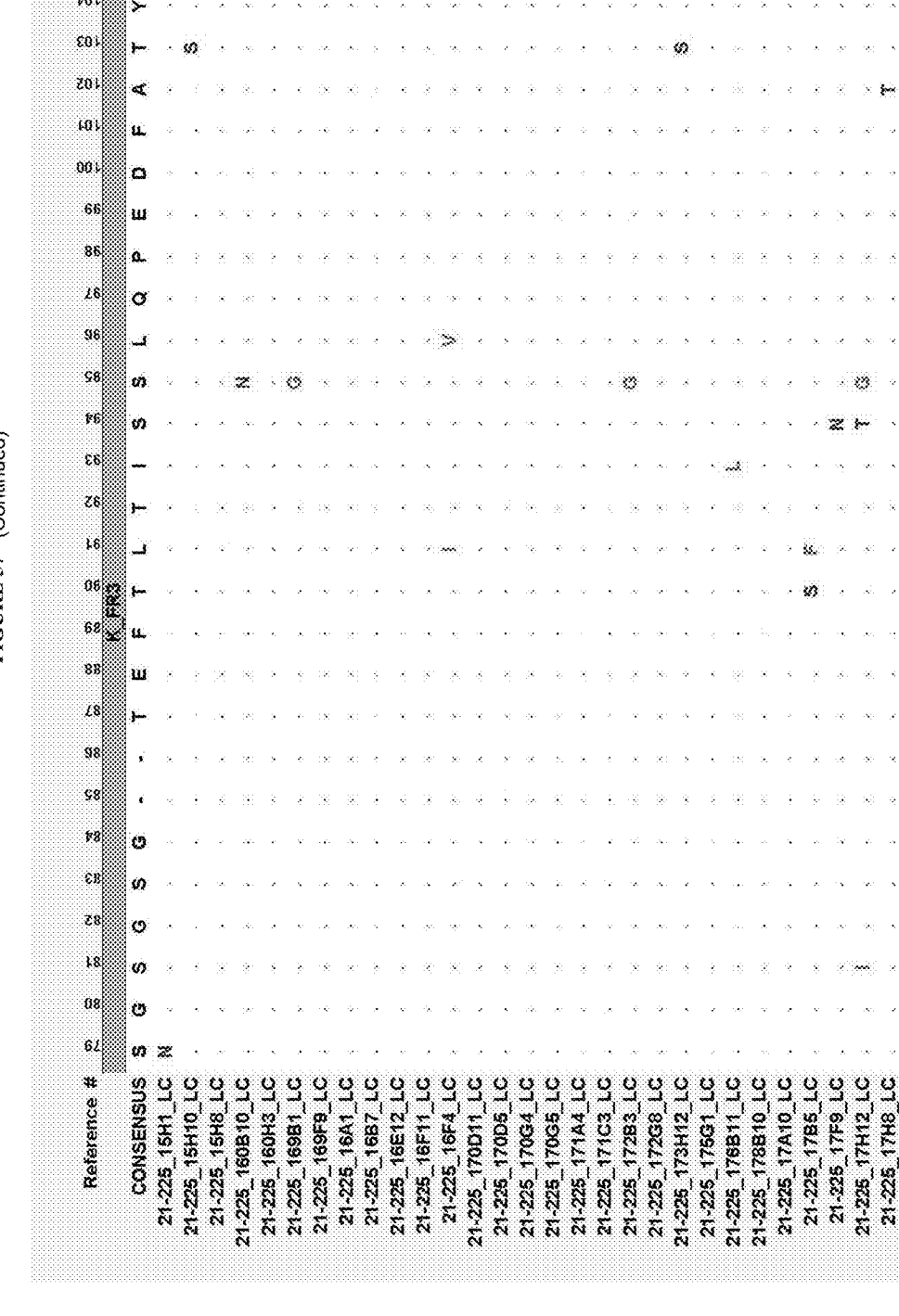
Figure 57:
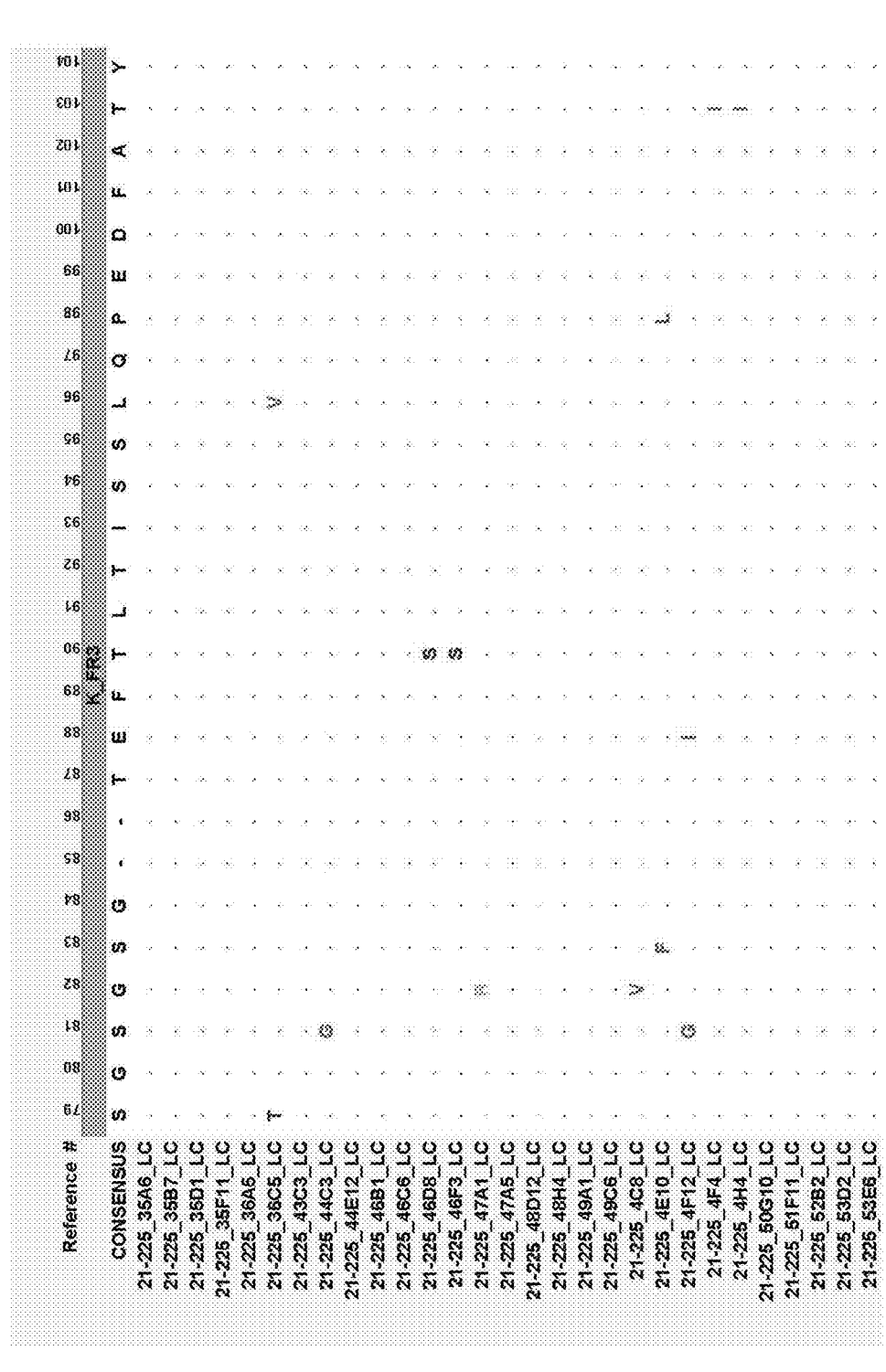
Figure 57:
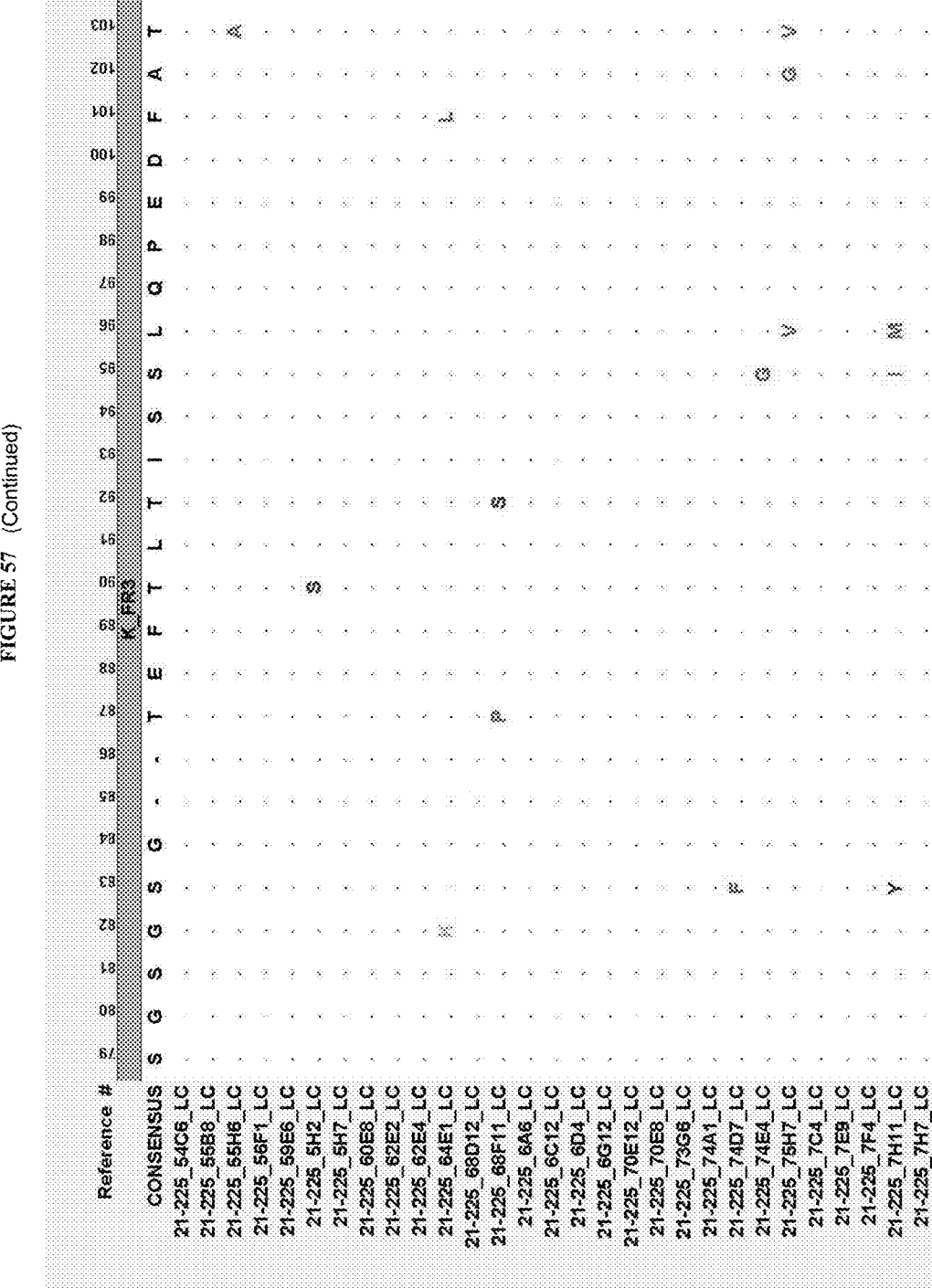
Figure 57:
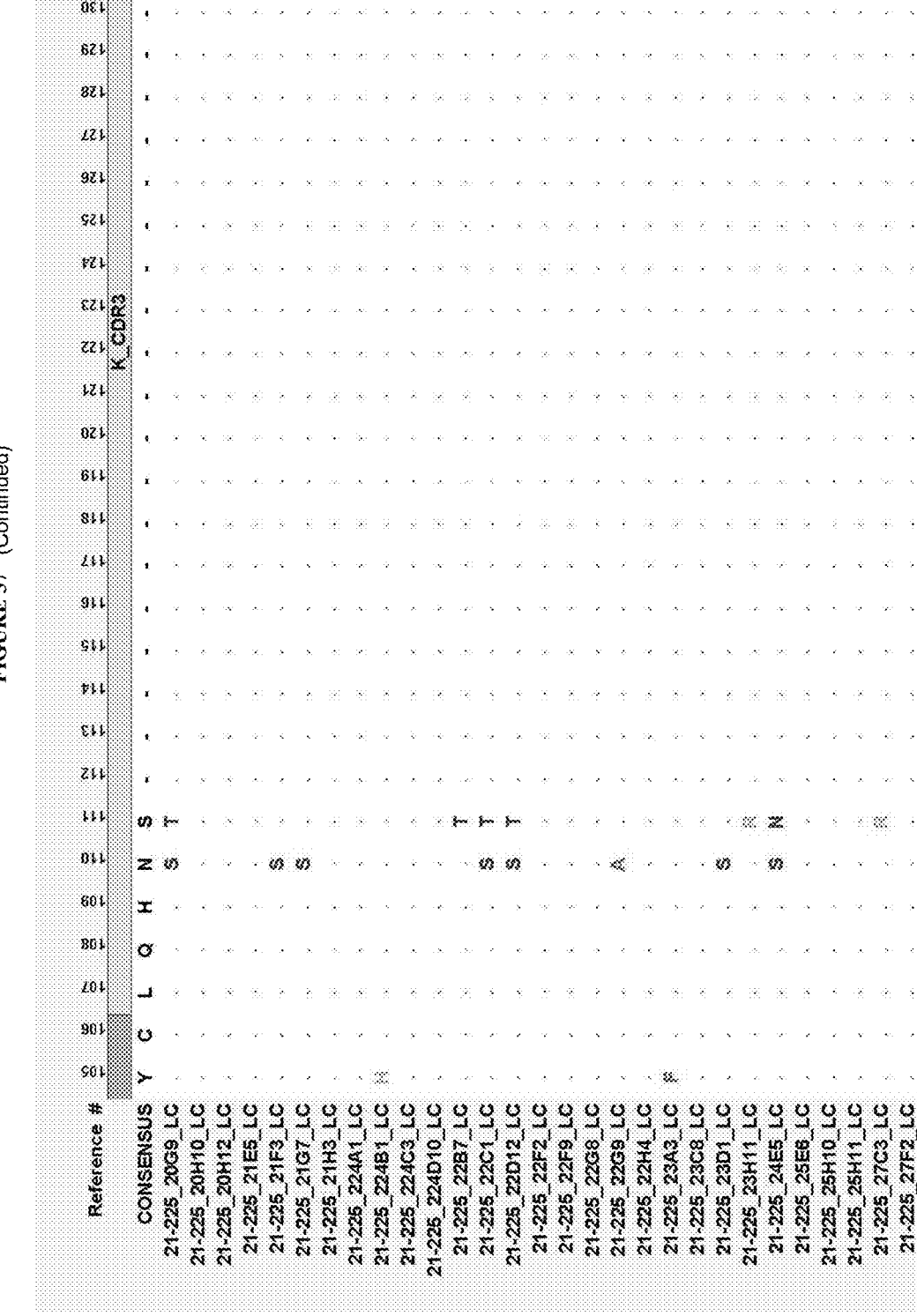
Figure 57:
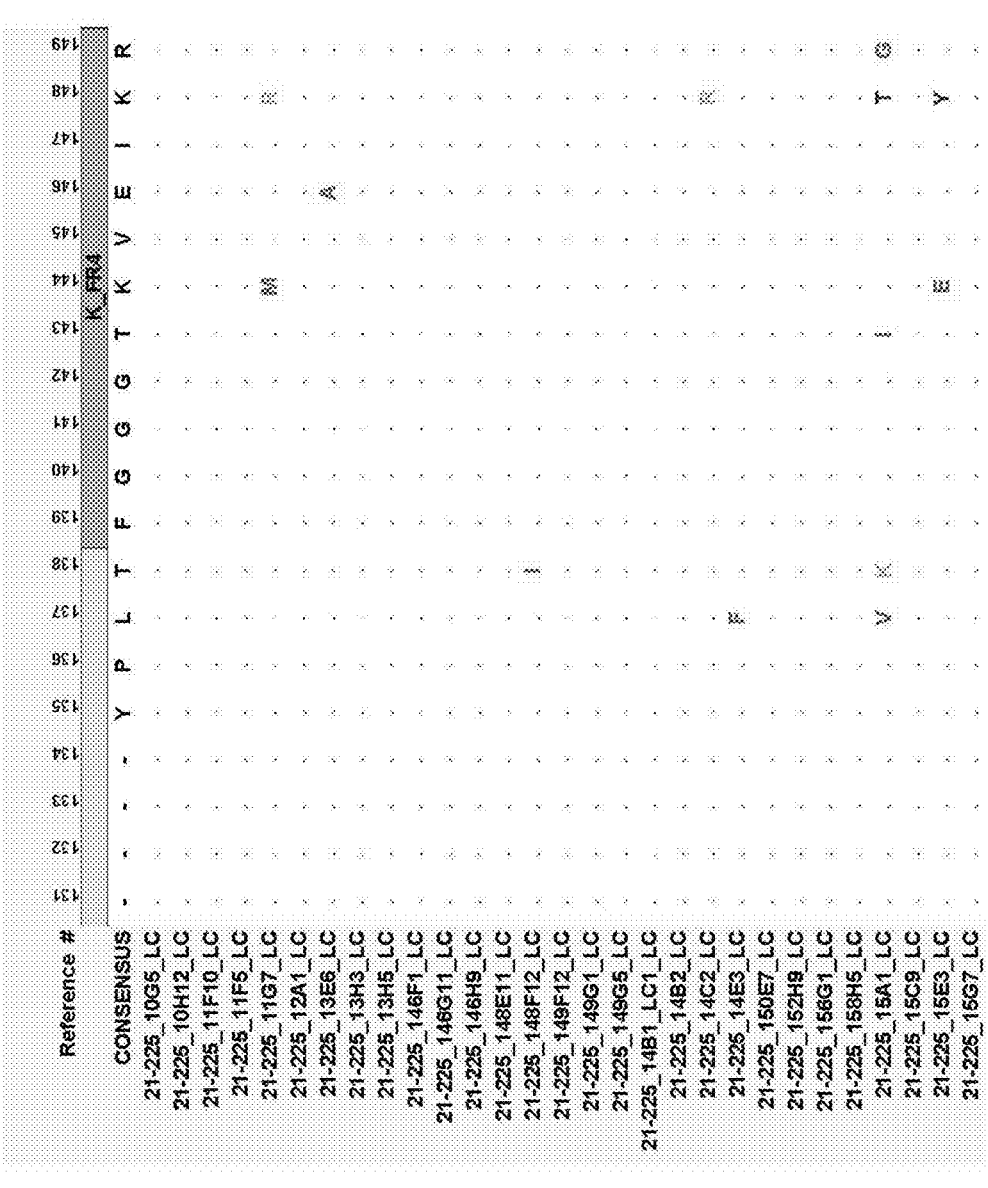
Figure 57:
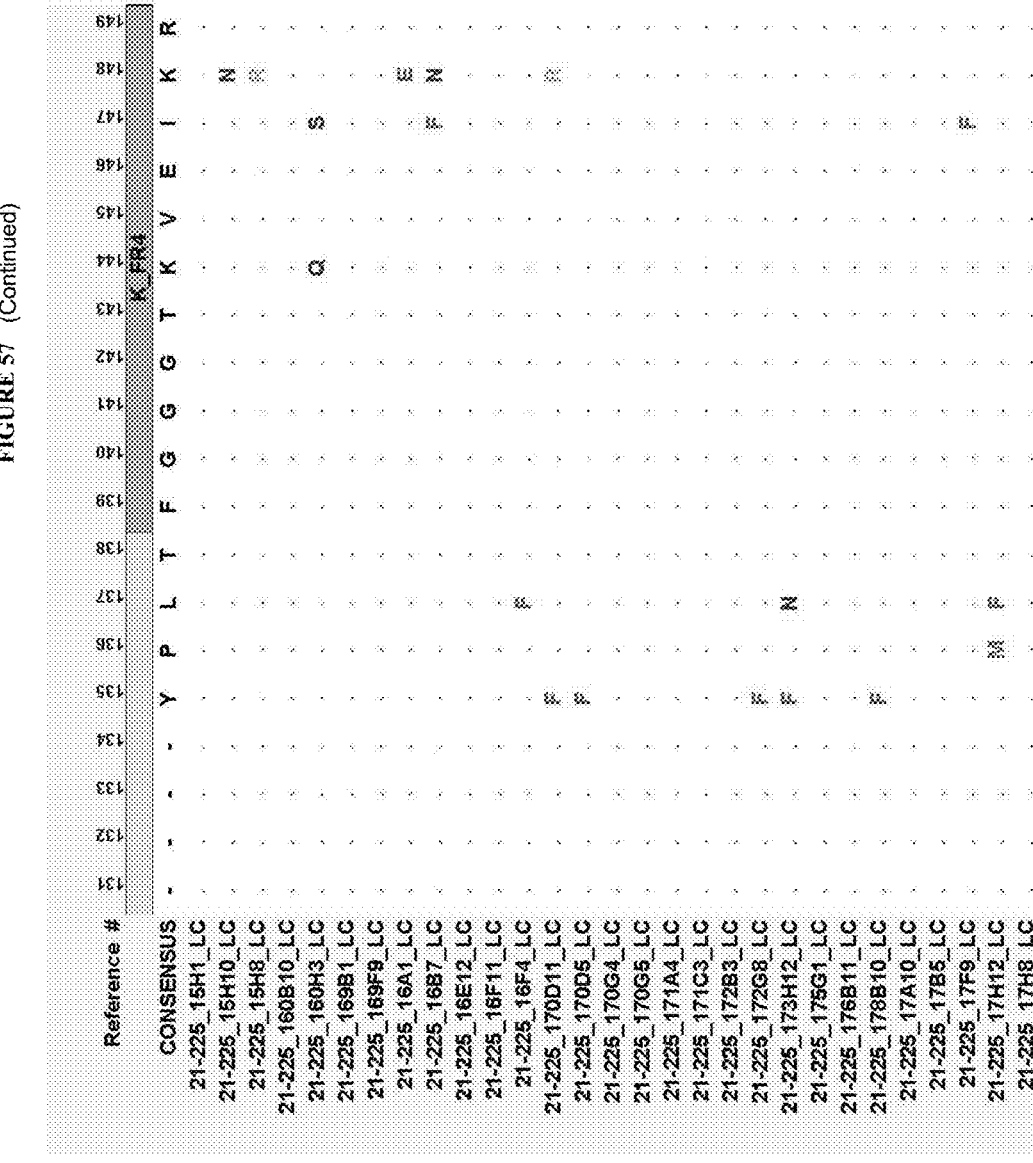
Figure 57:
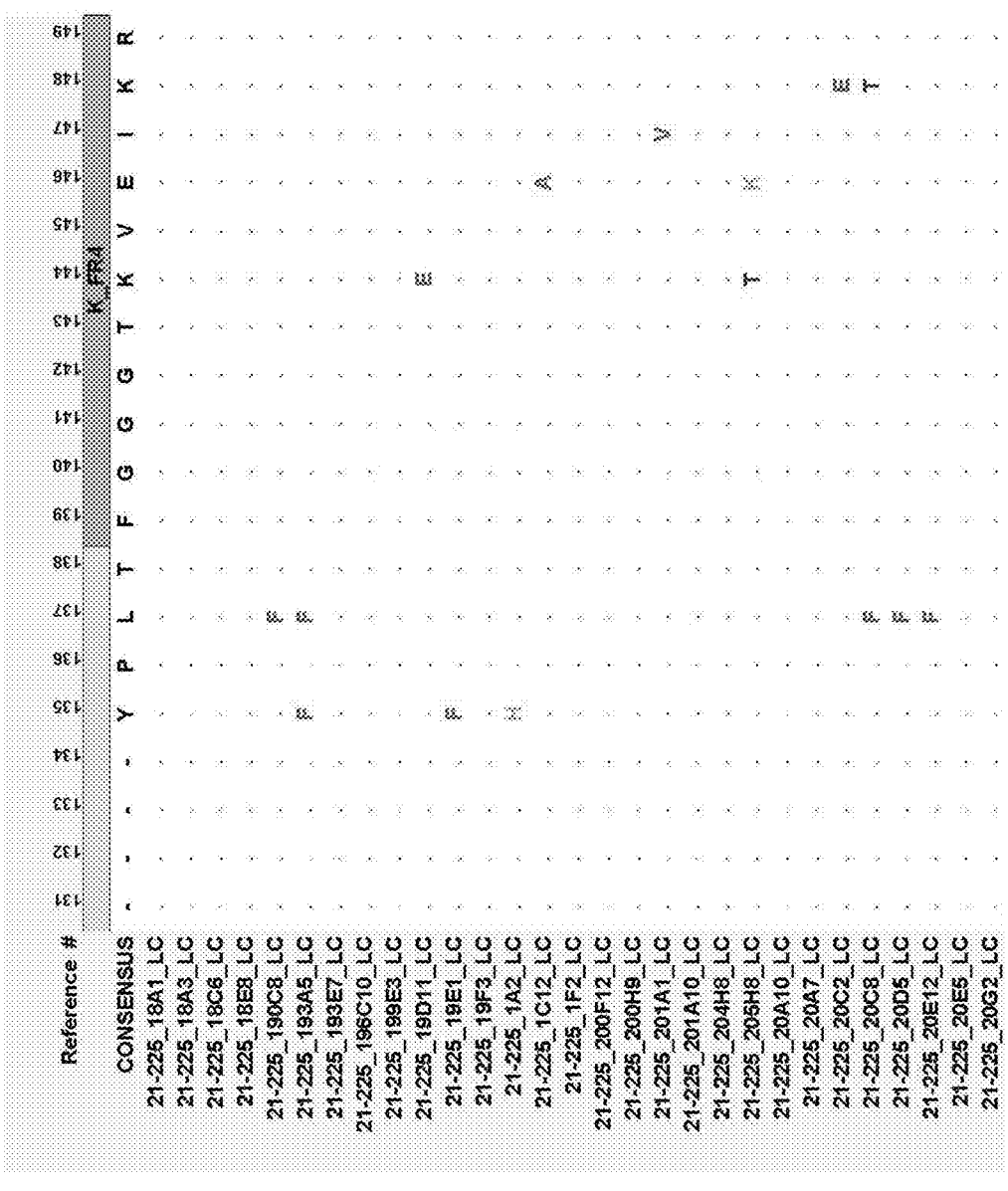
Figure 57:
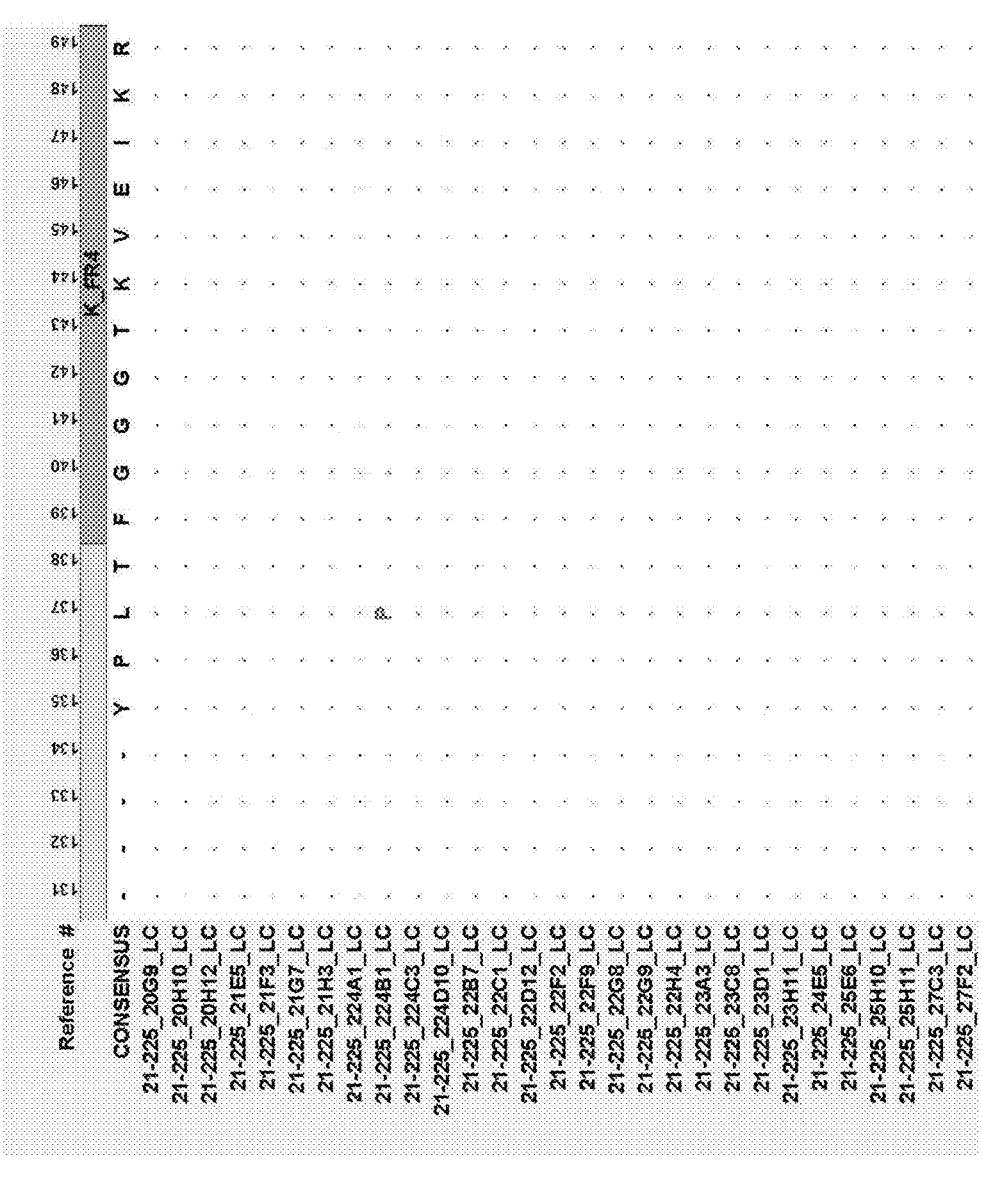
Figure 57:
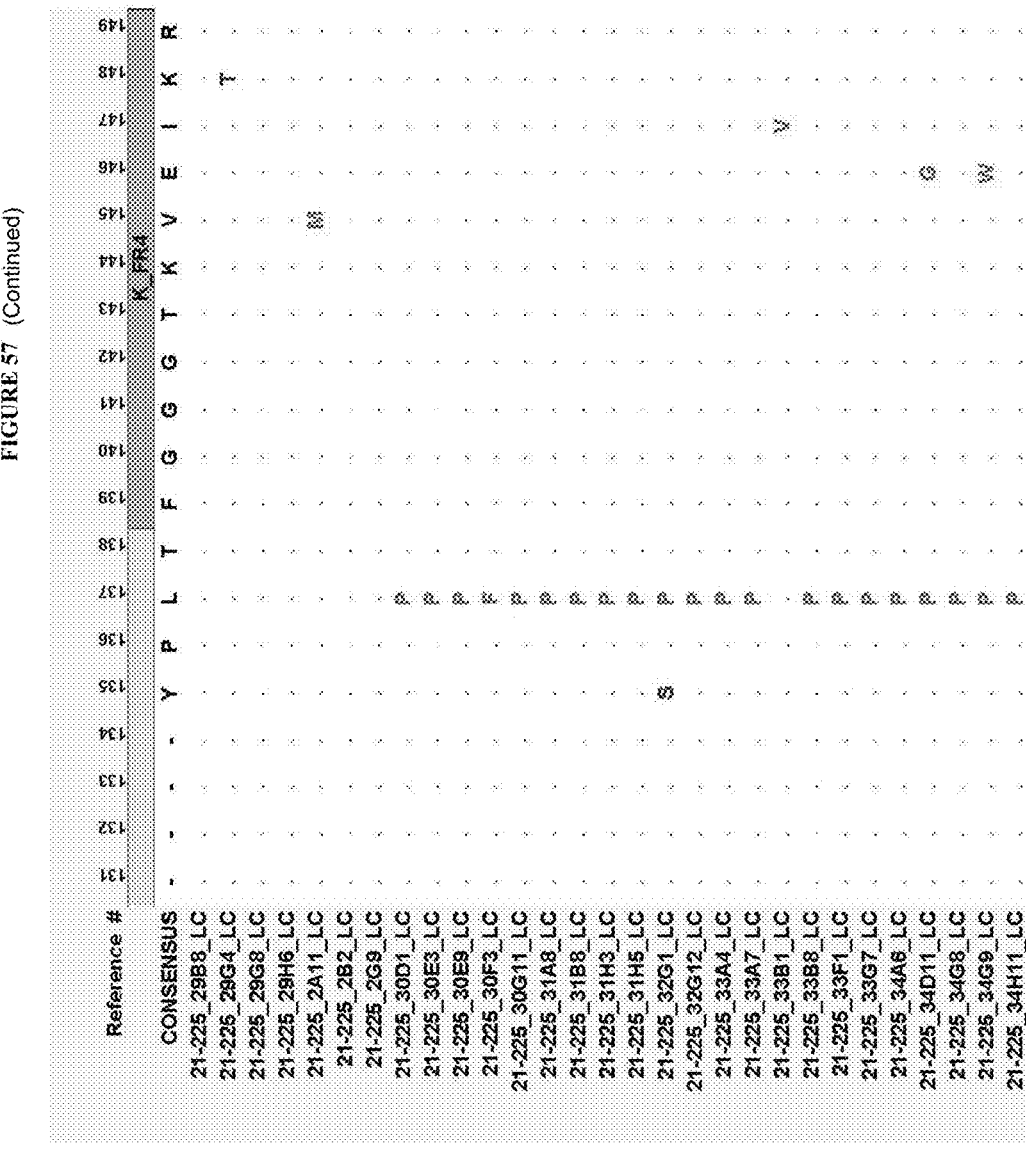
Figure 57:
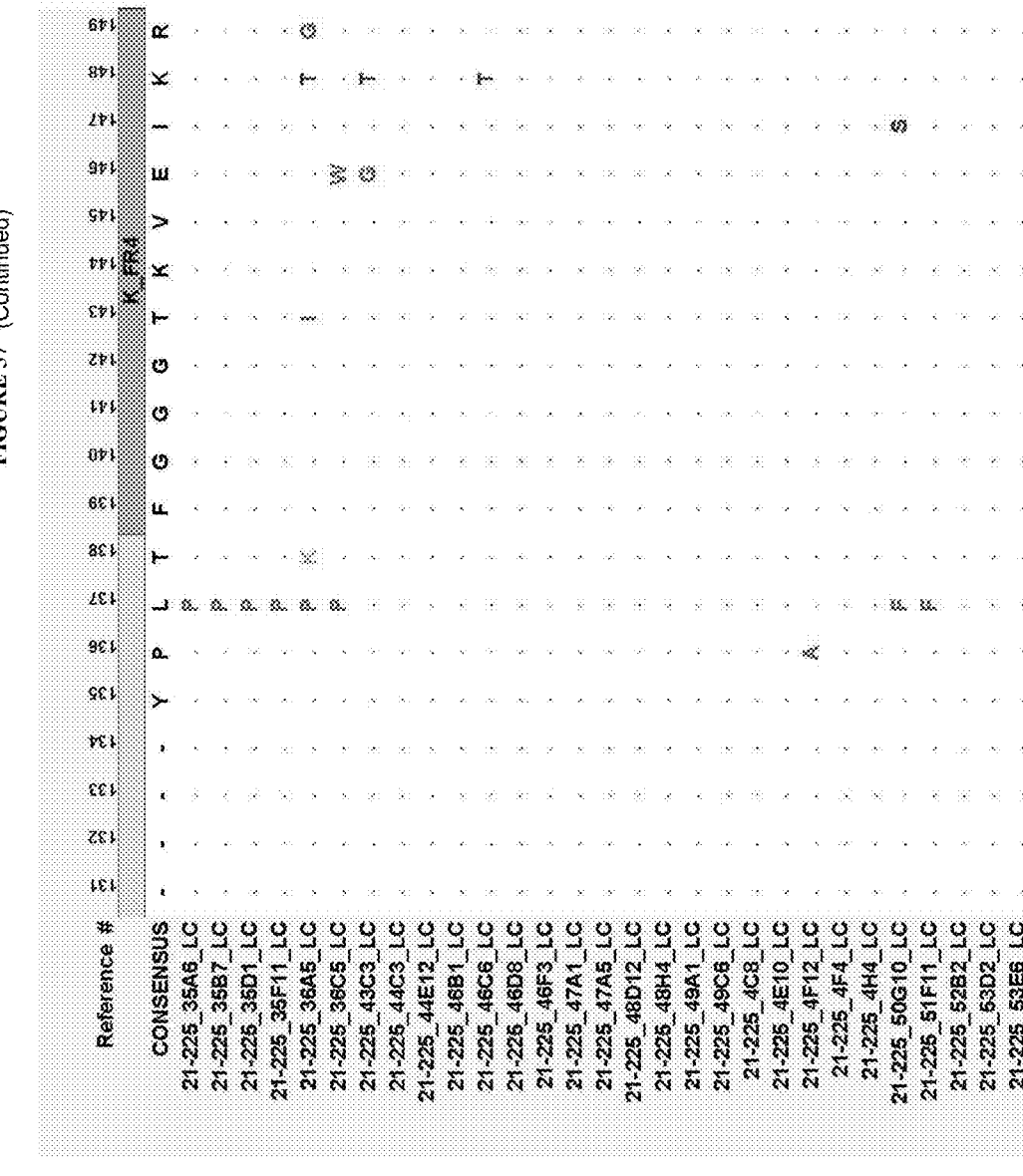
Figure 57:
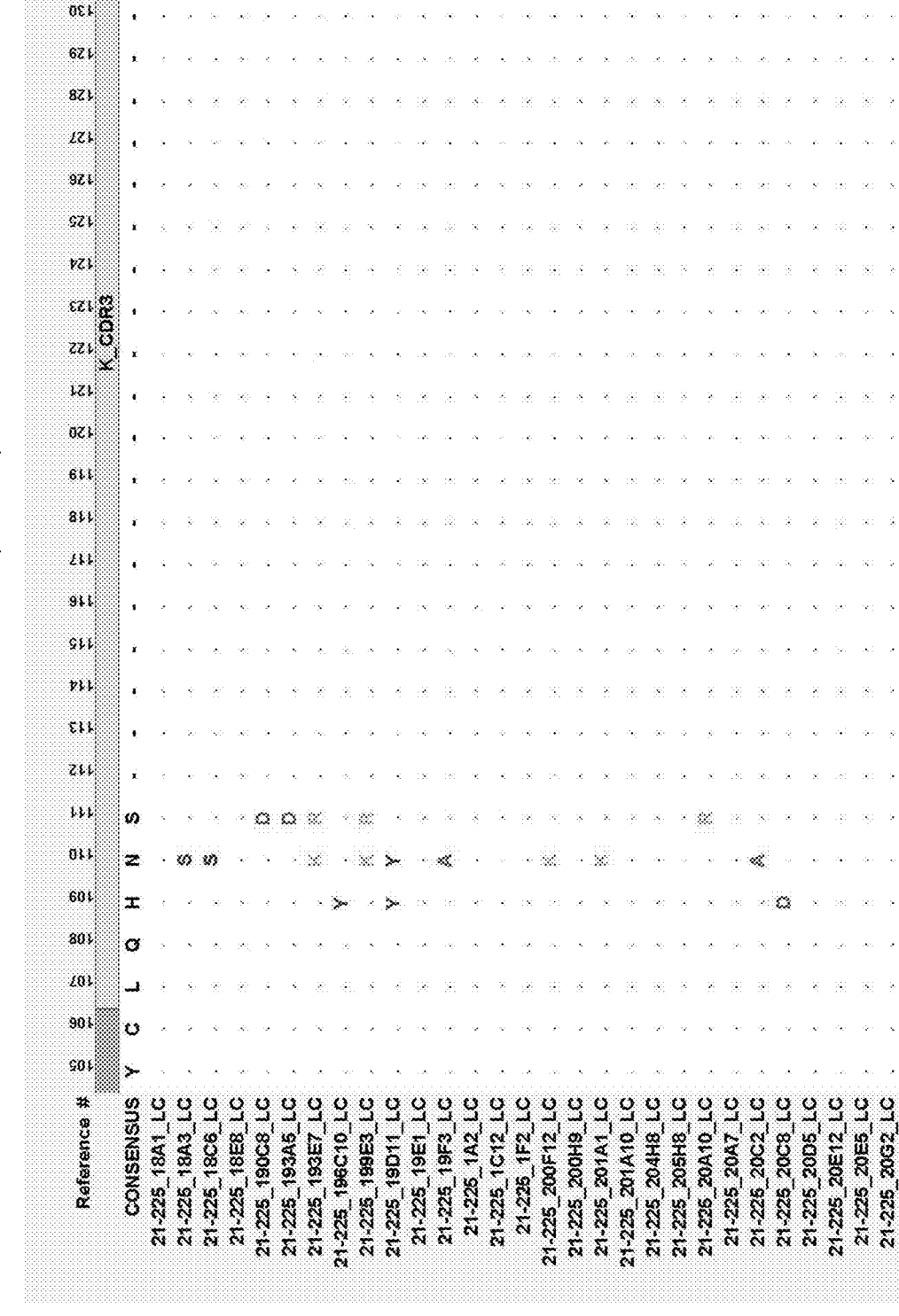
Figure 57:
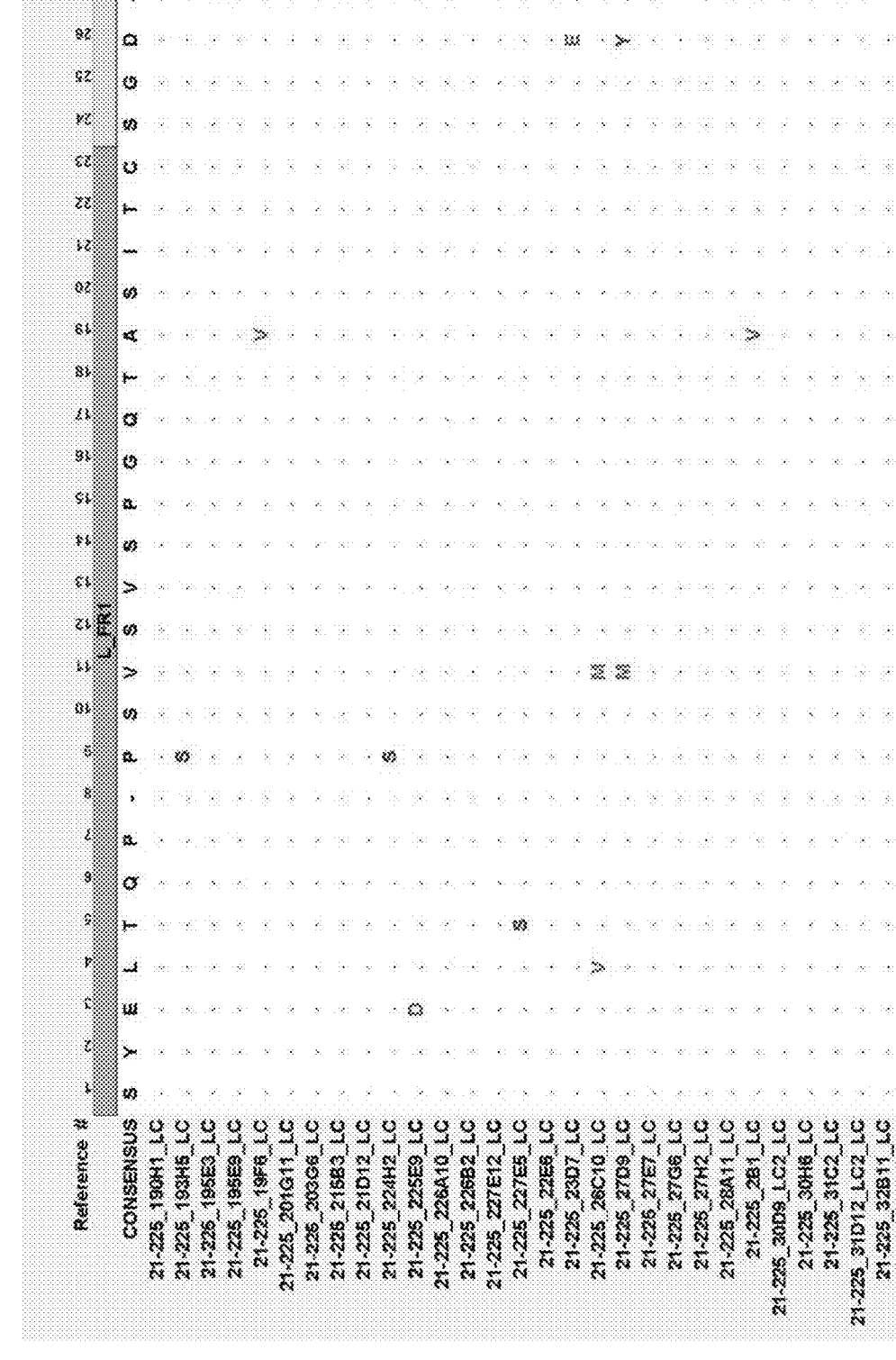
Figure 57:
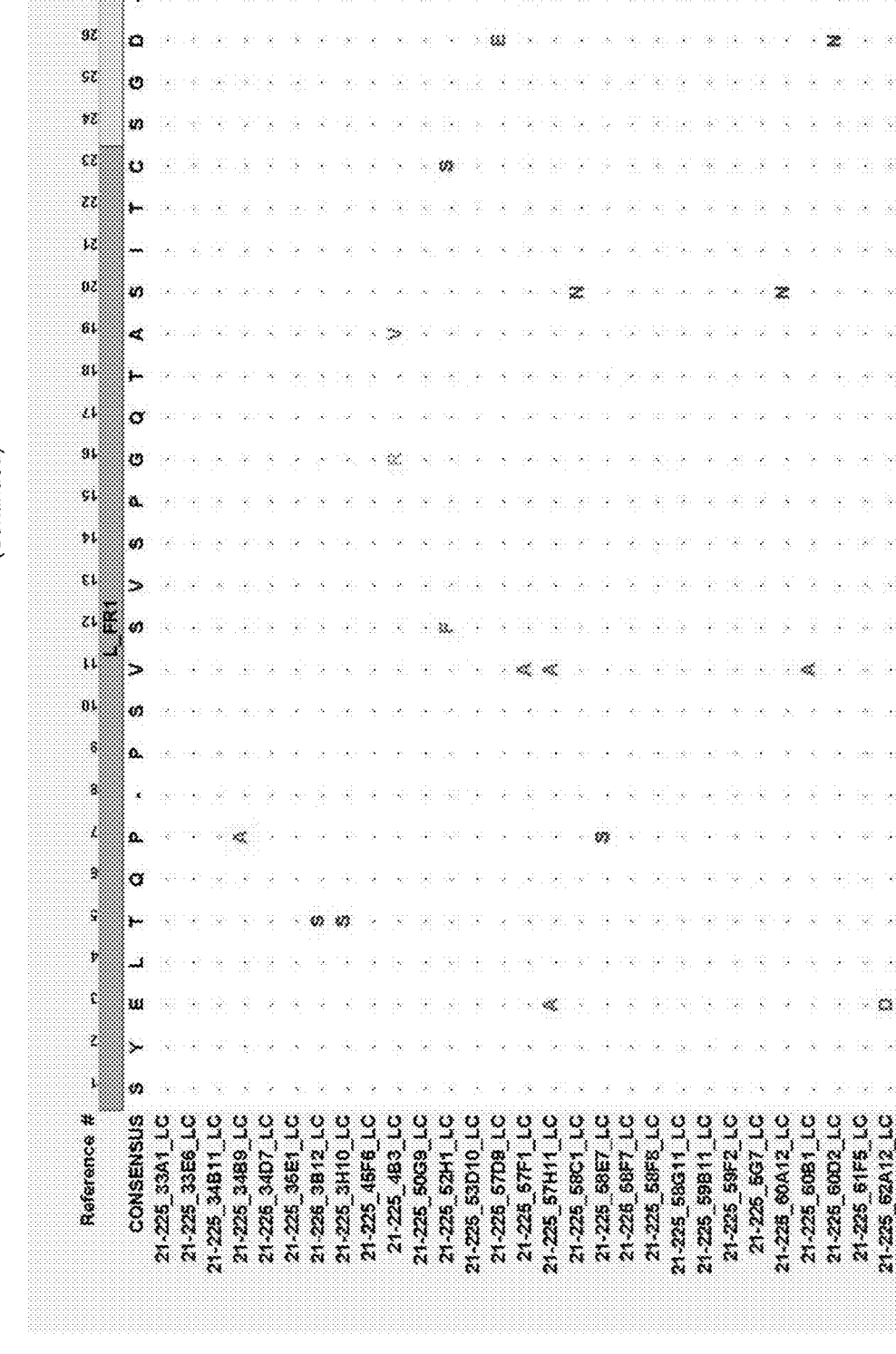
Figure 57:
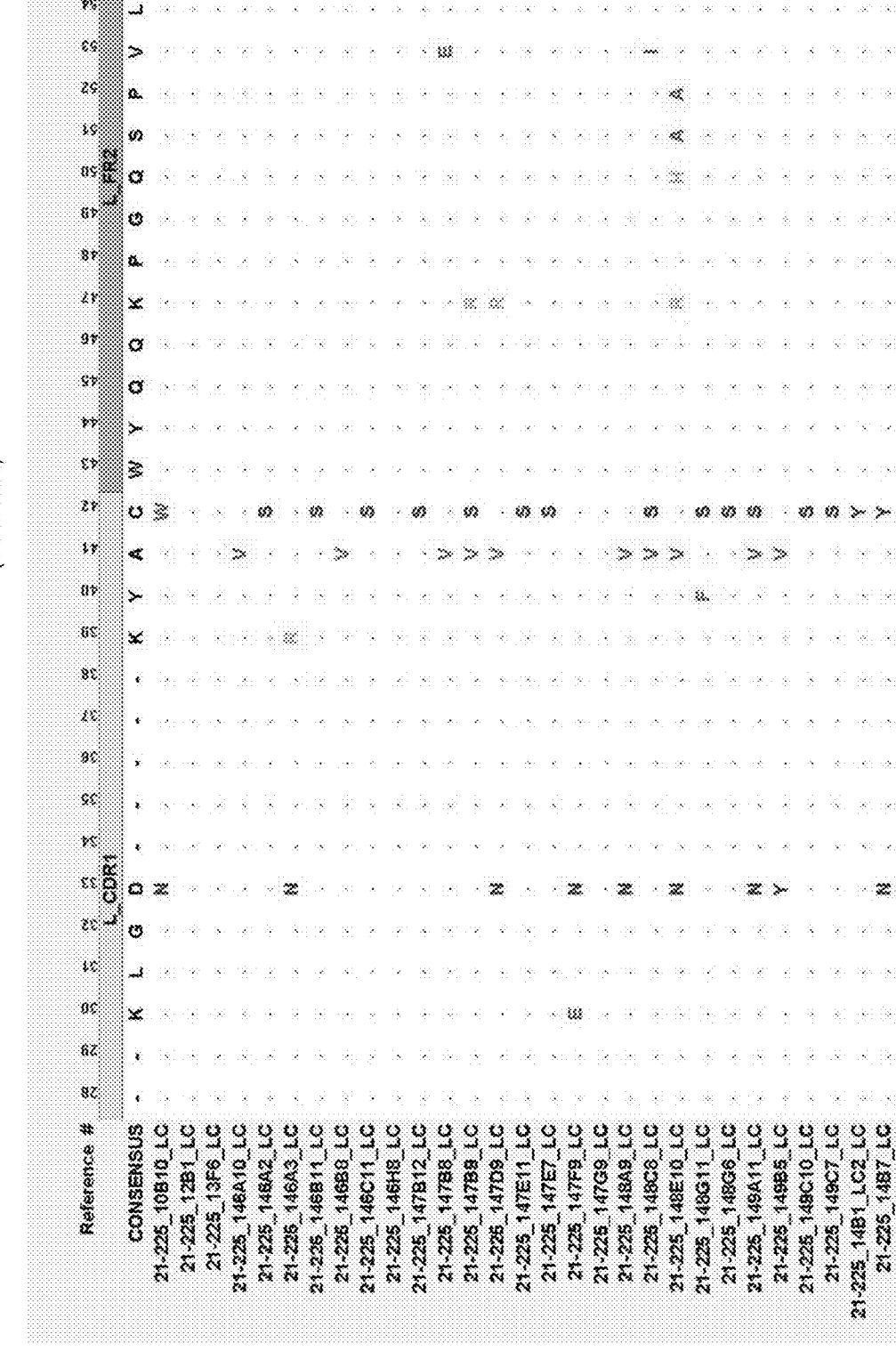
Figure 57:
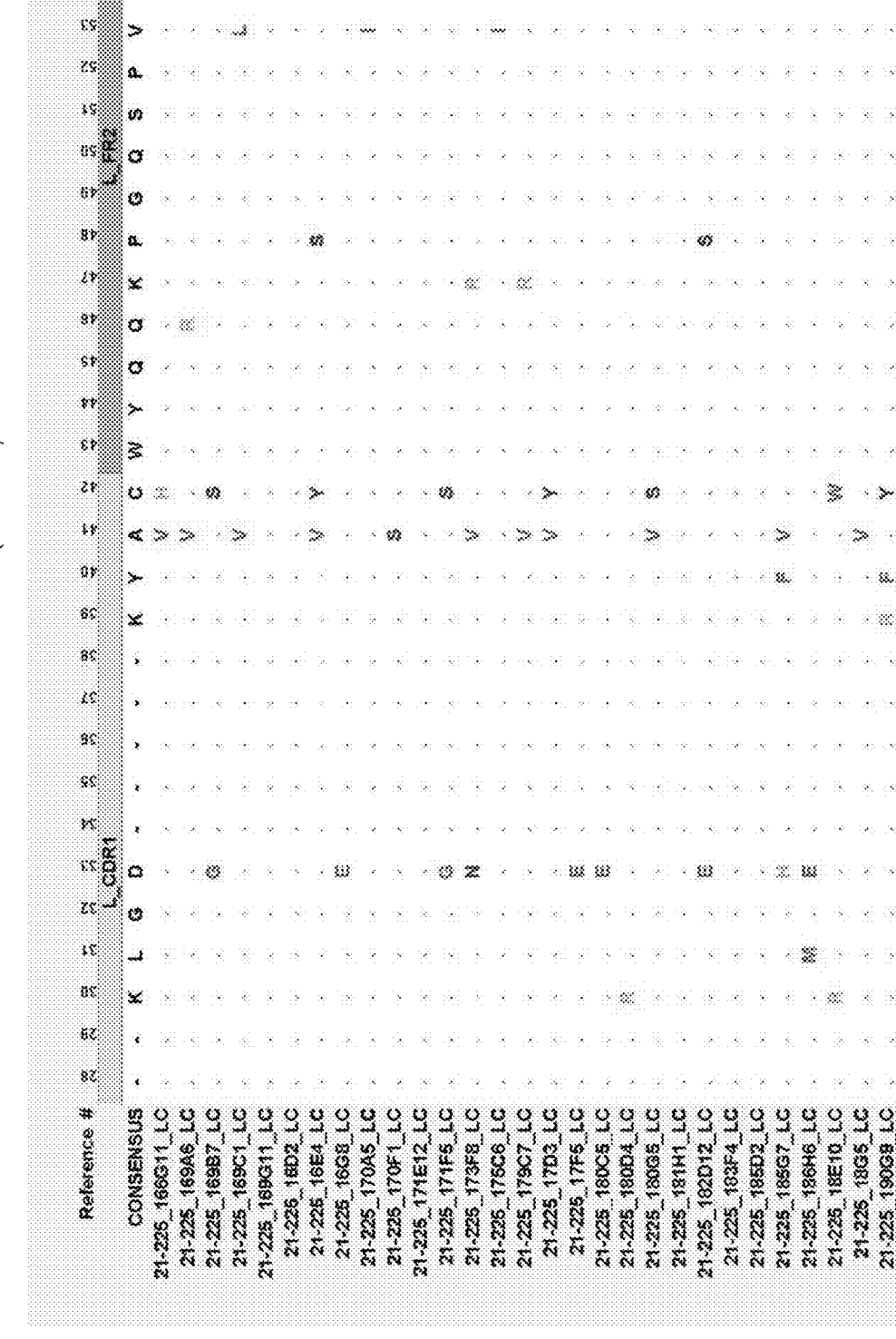
Figure 57:
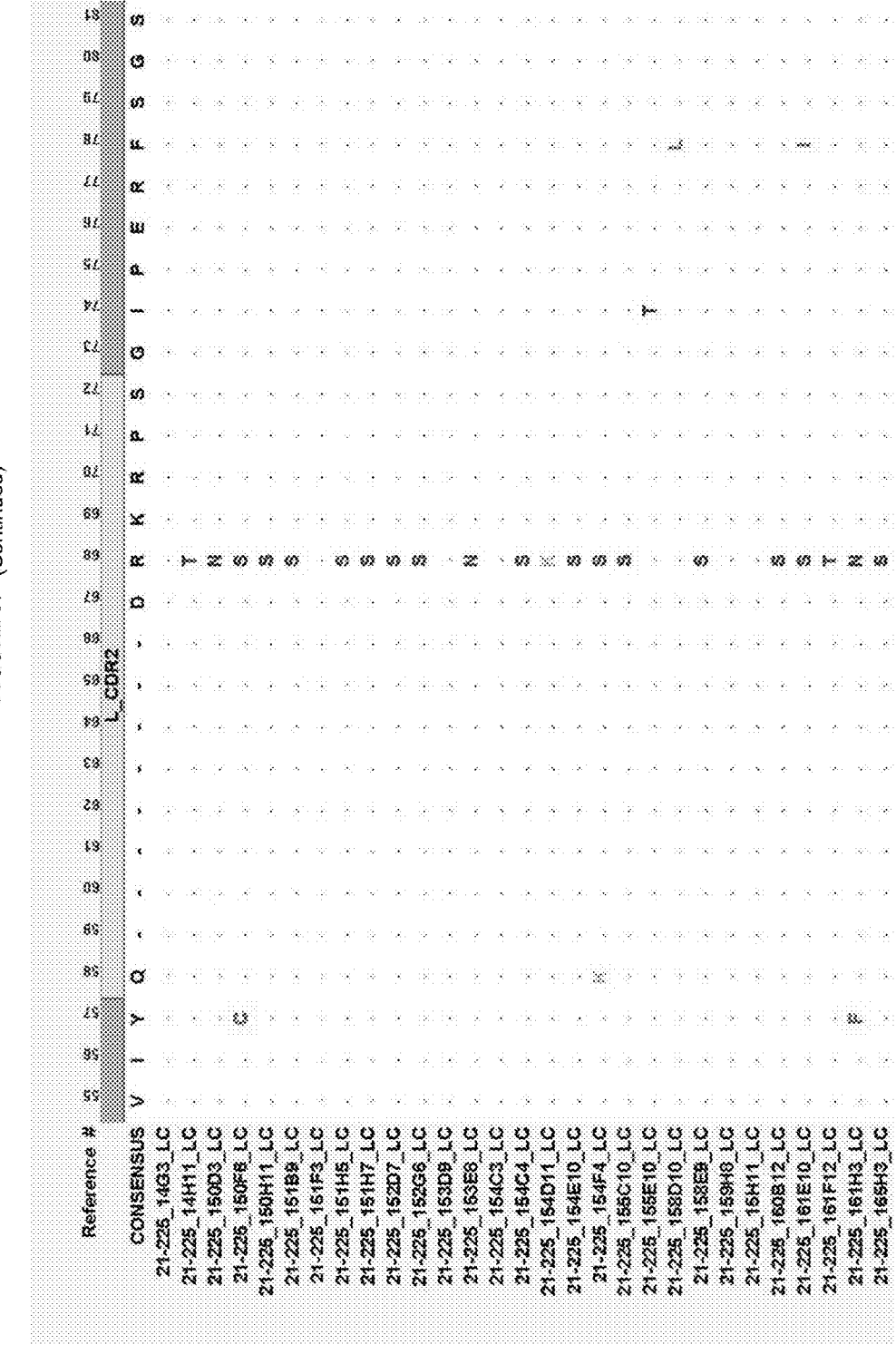
Figure 57:
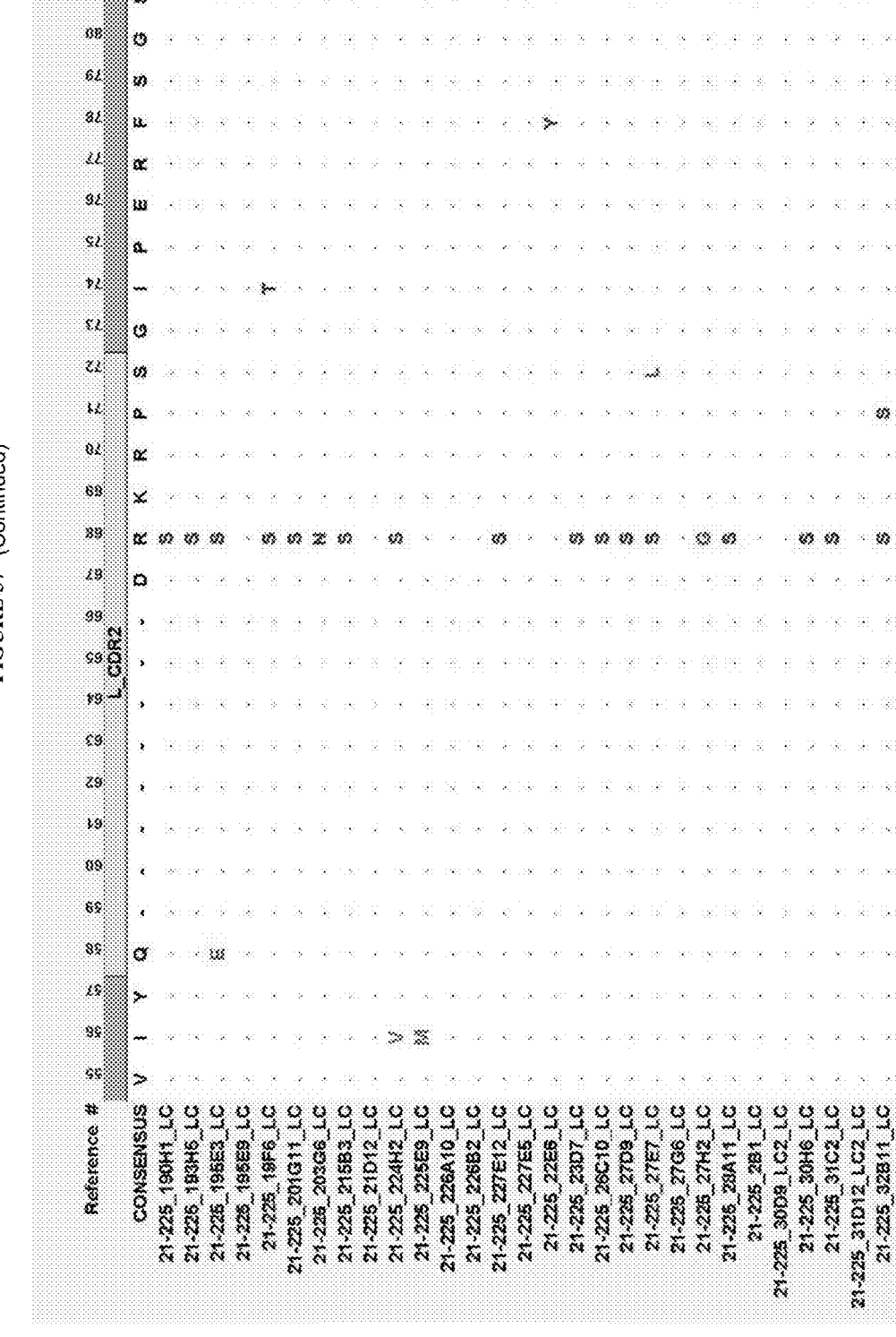
Figure 57:
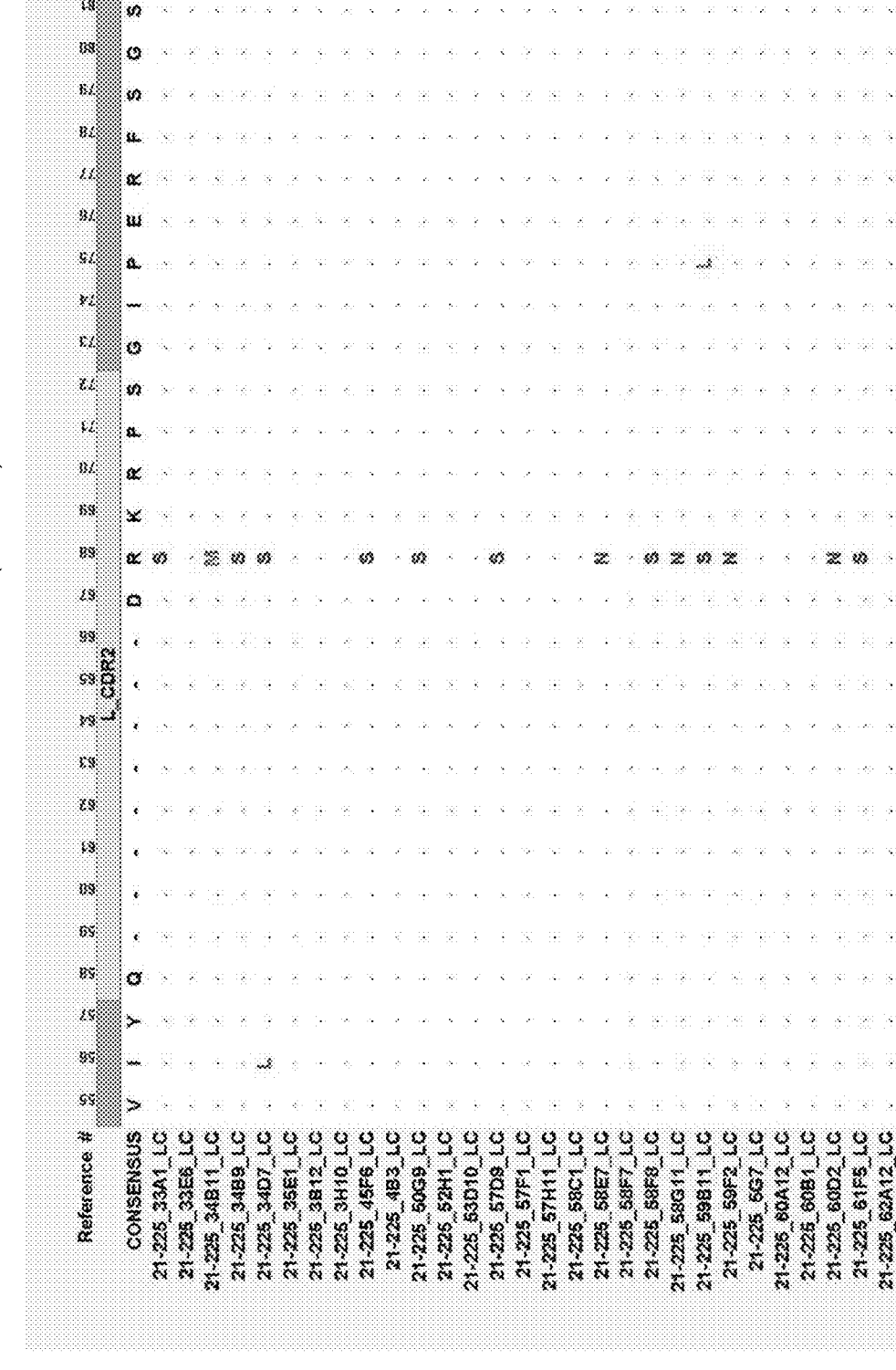
Figure 57:
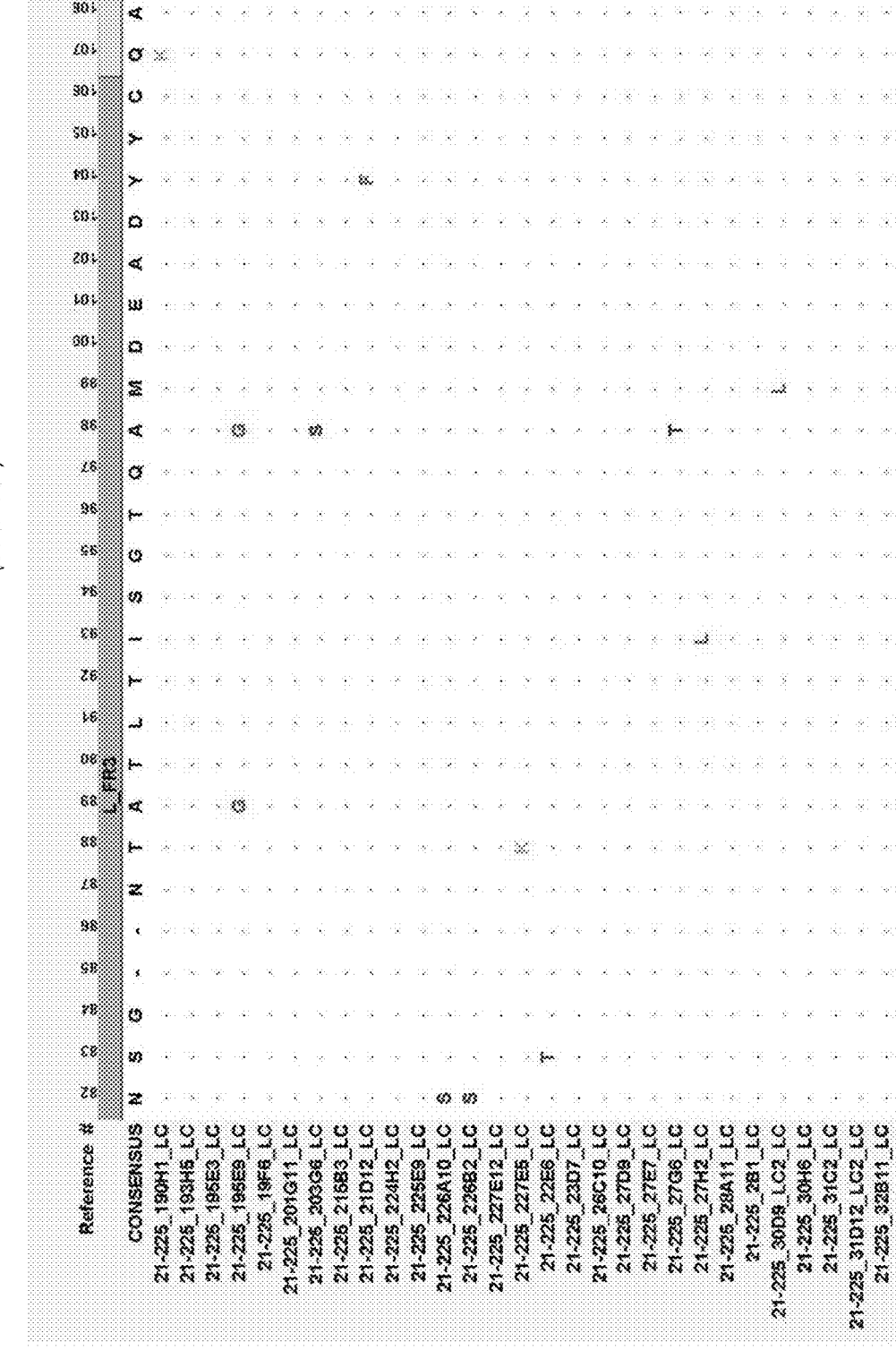
Figure 57:
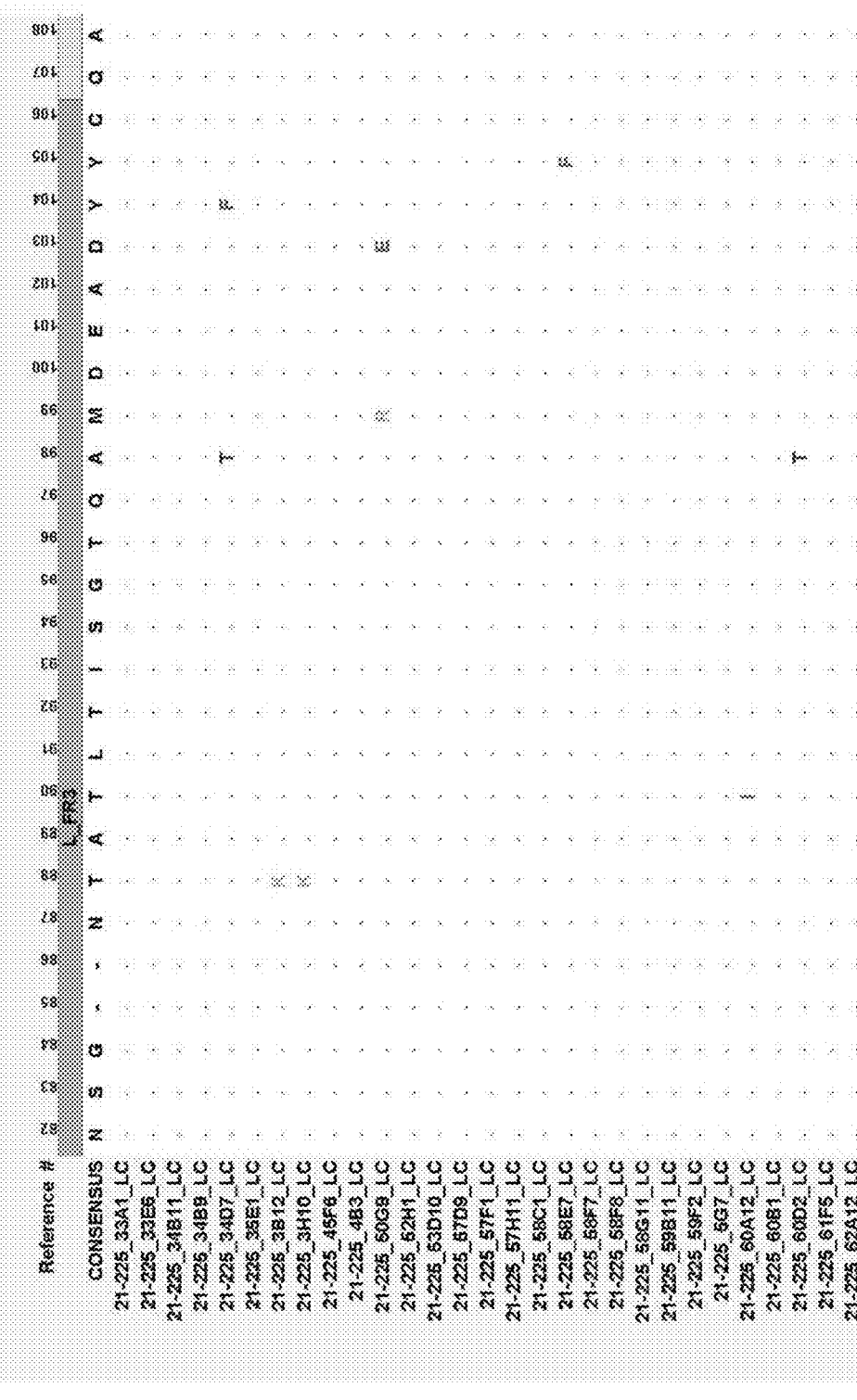
Figure 57:
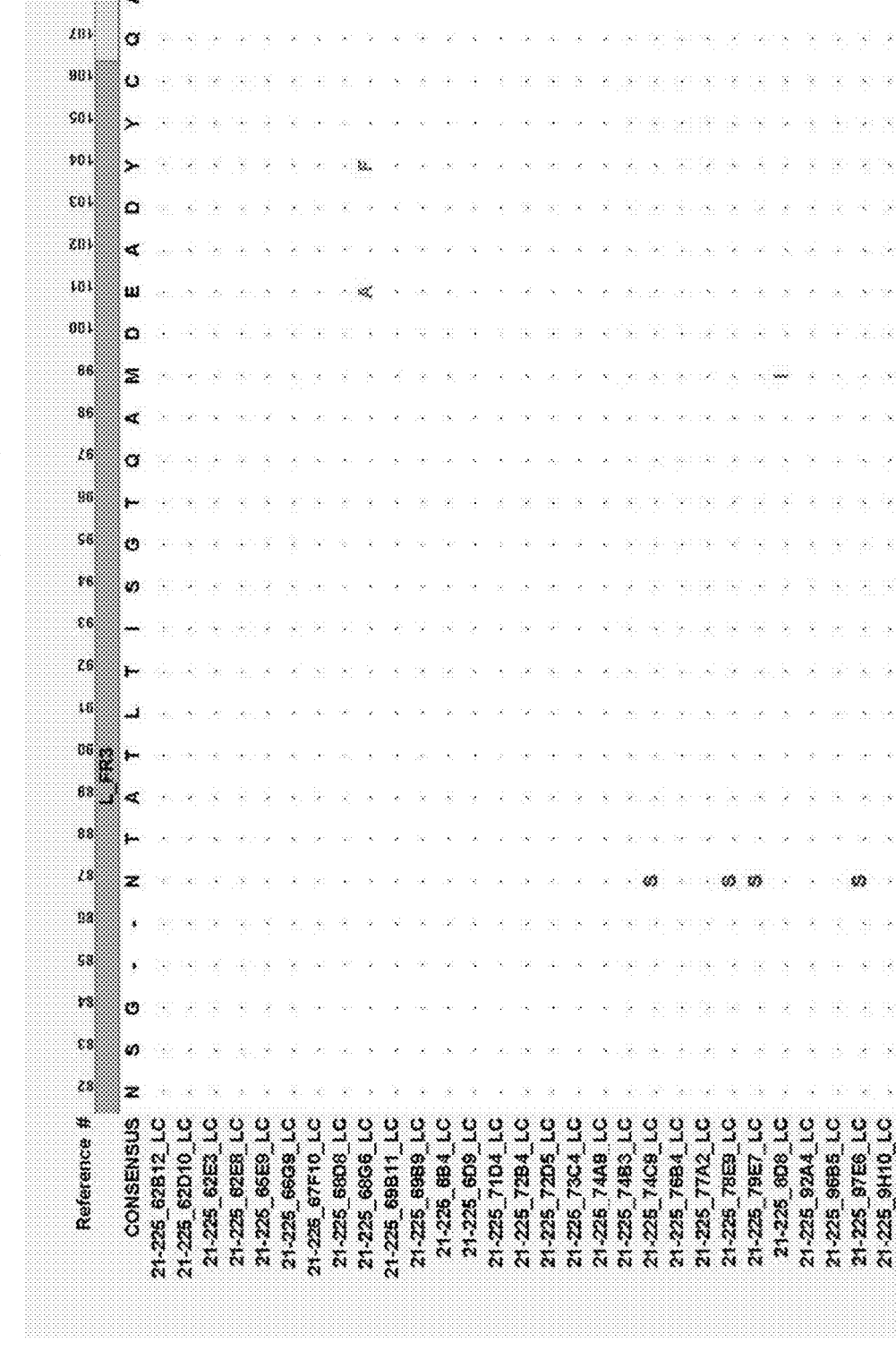
Figure 57:
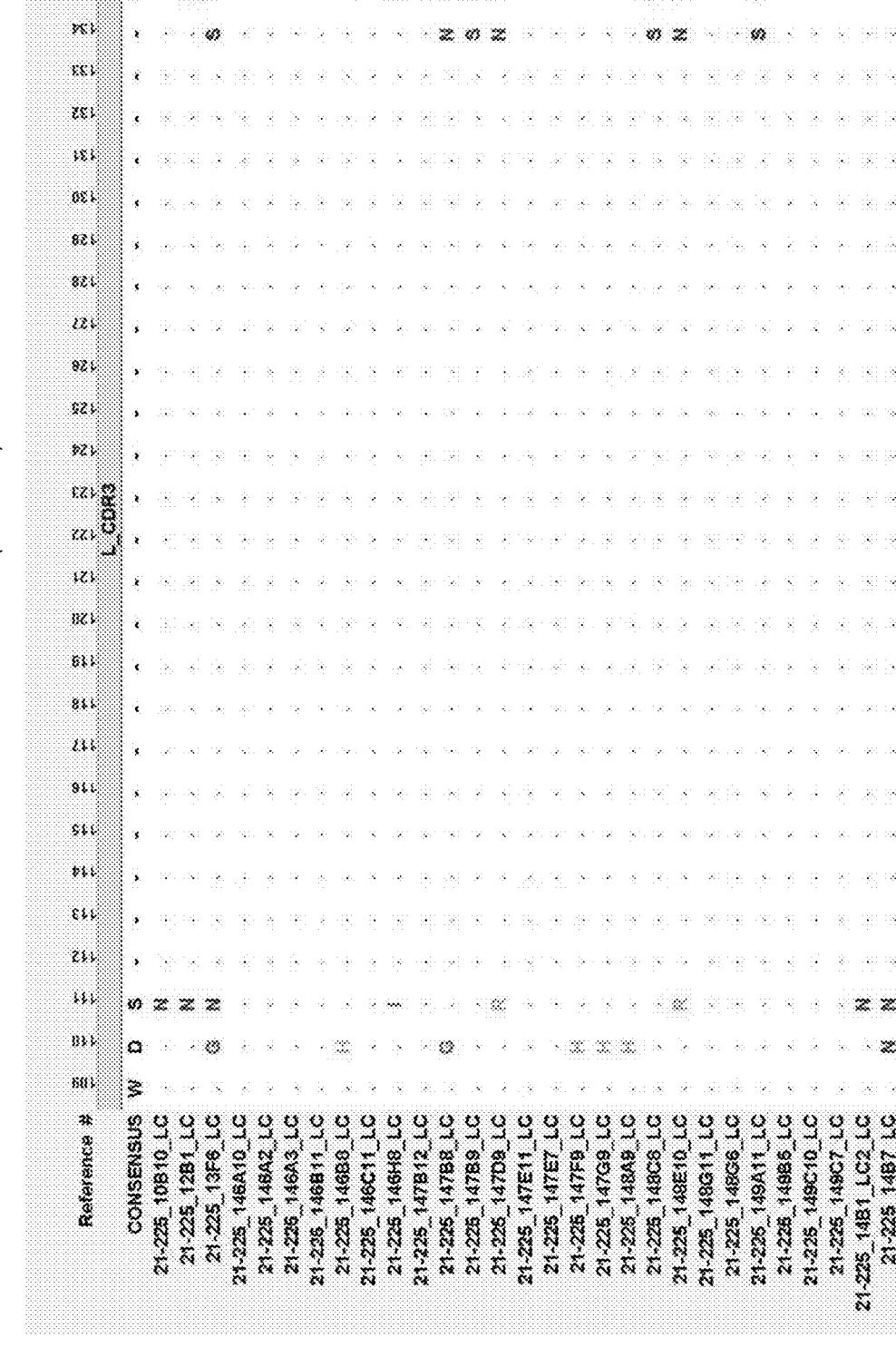
Figure 57:
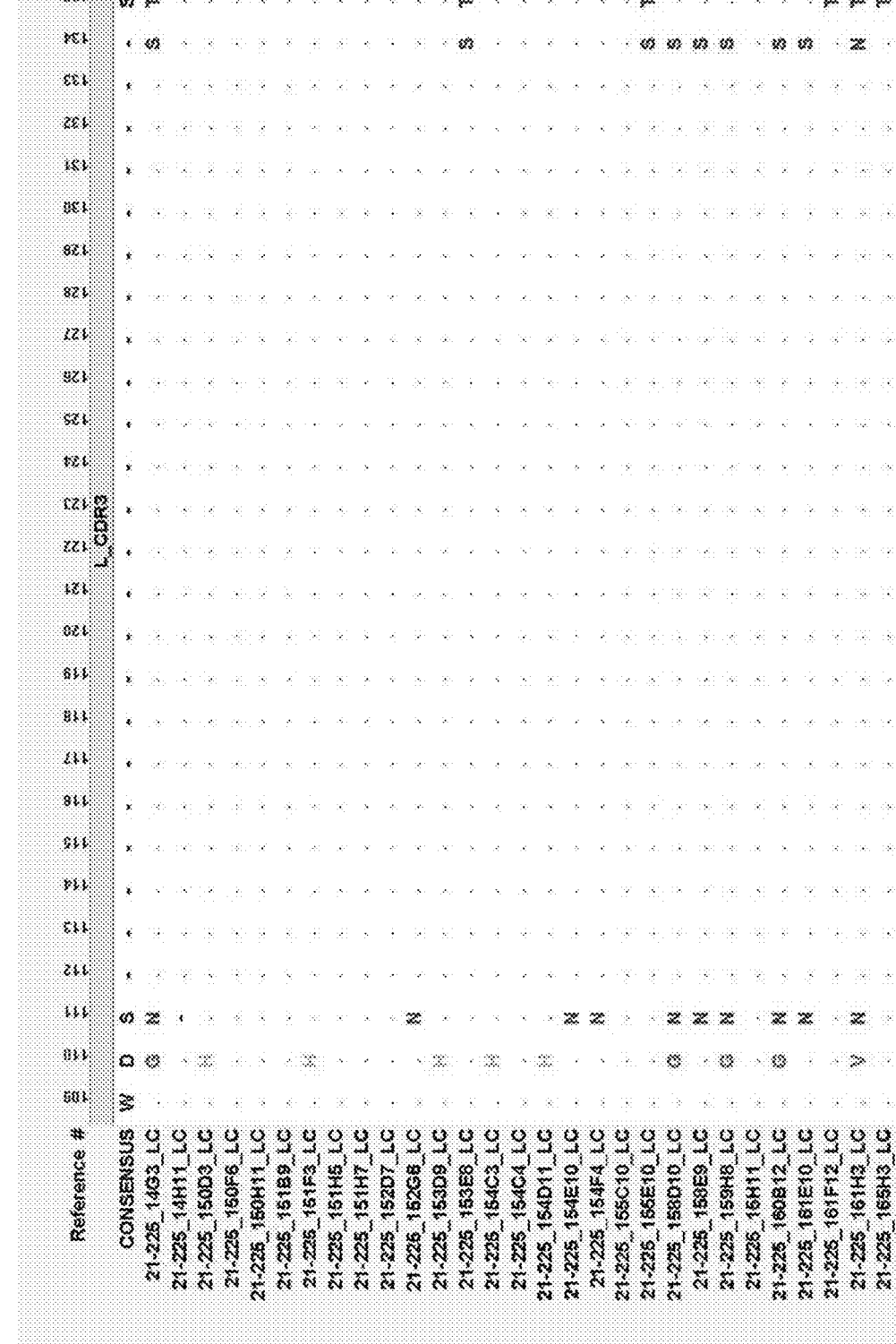
Figure 57:
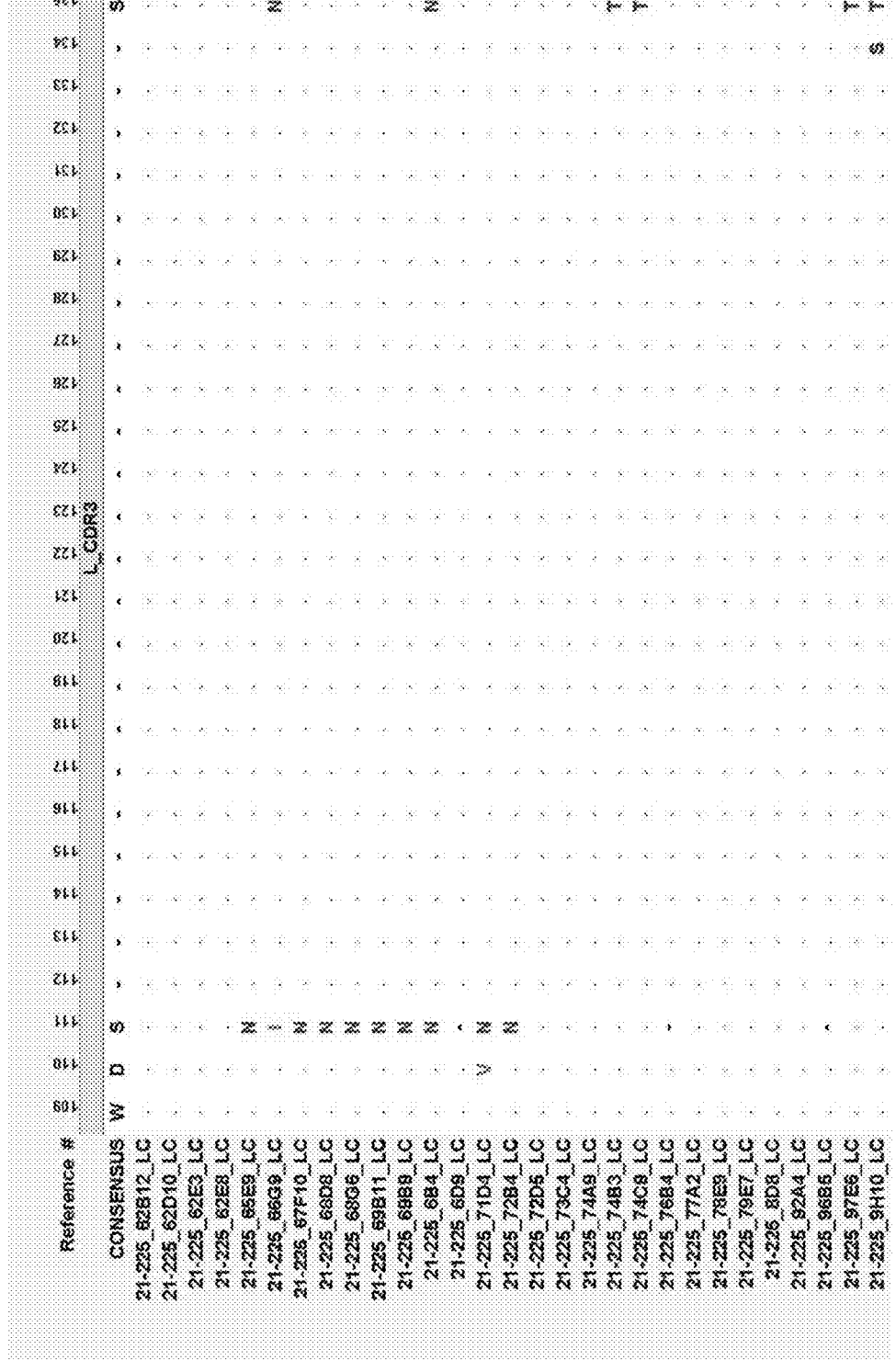
Figure 57:
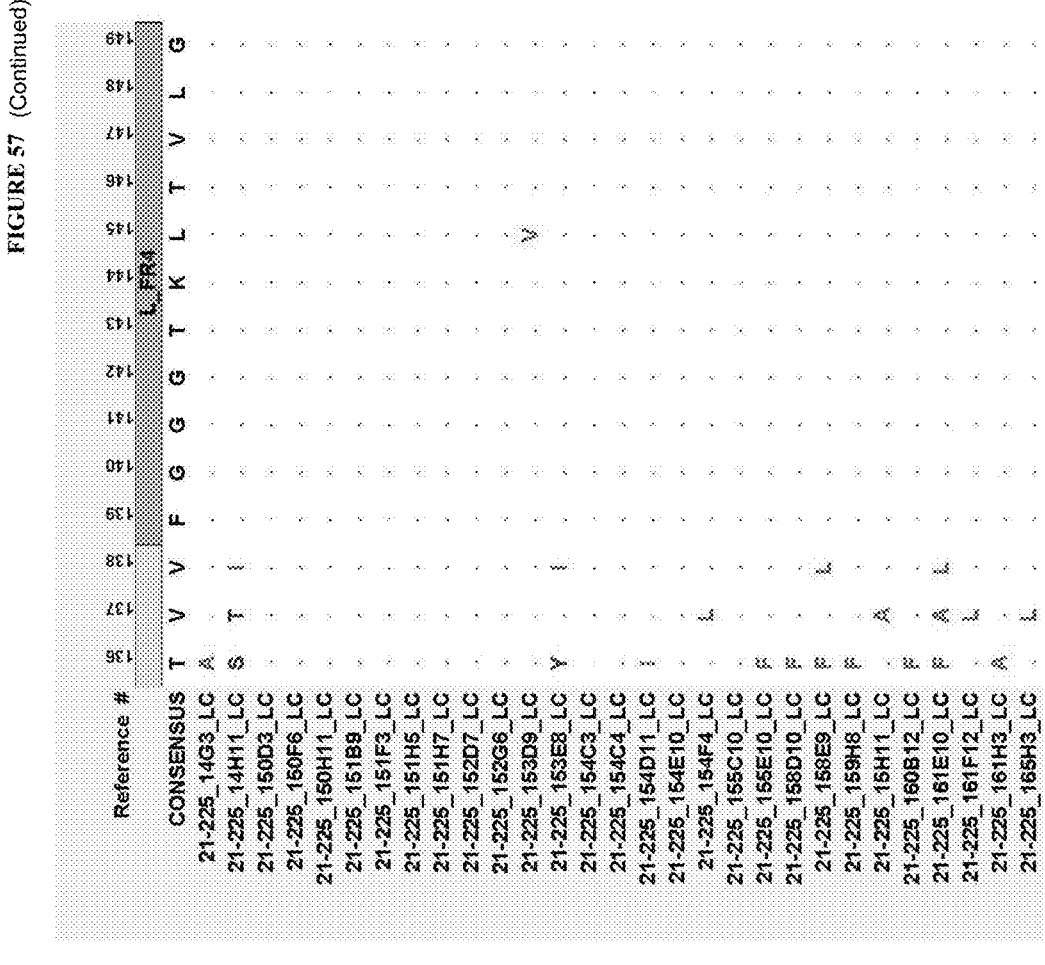
Figure 57:
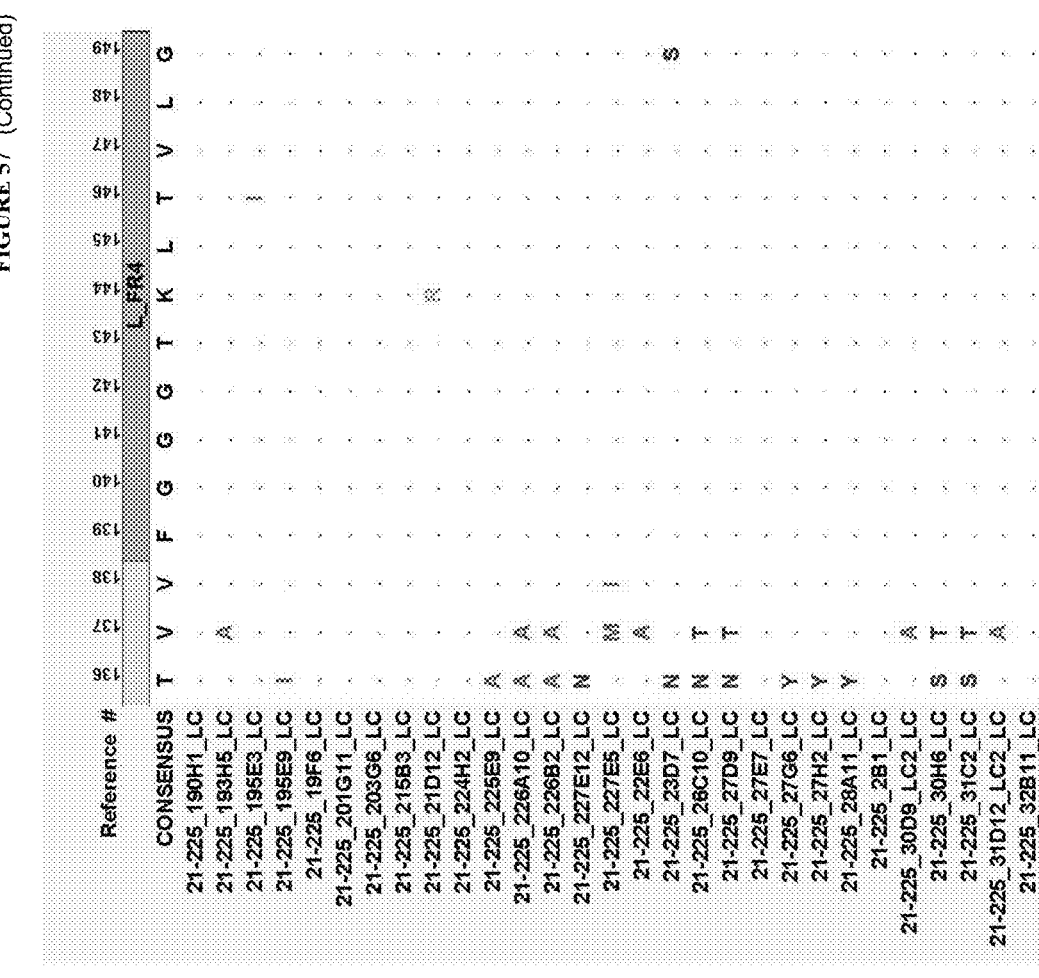
Figure 57:
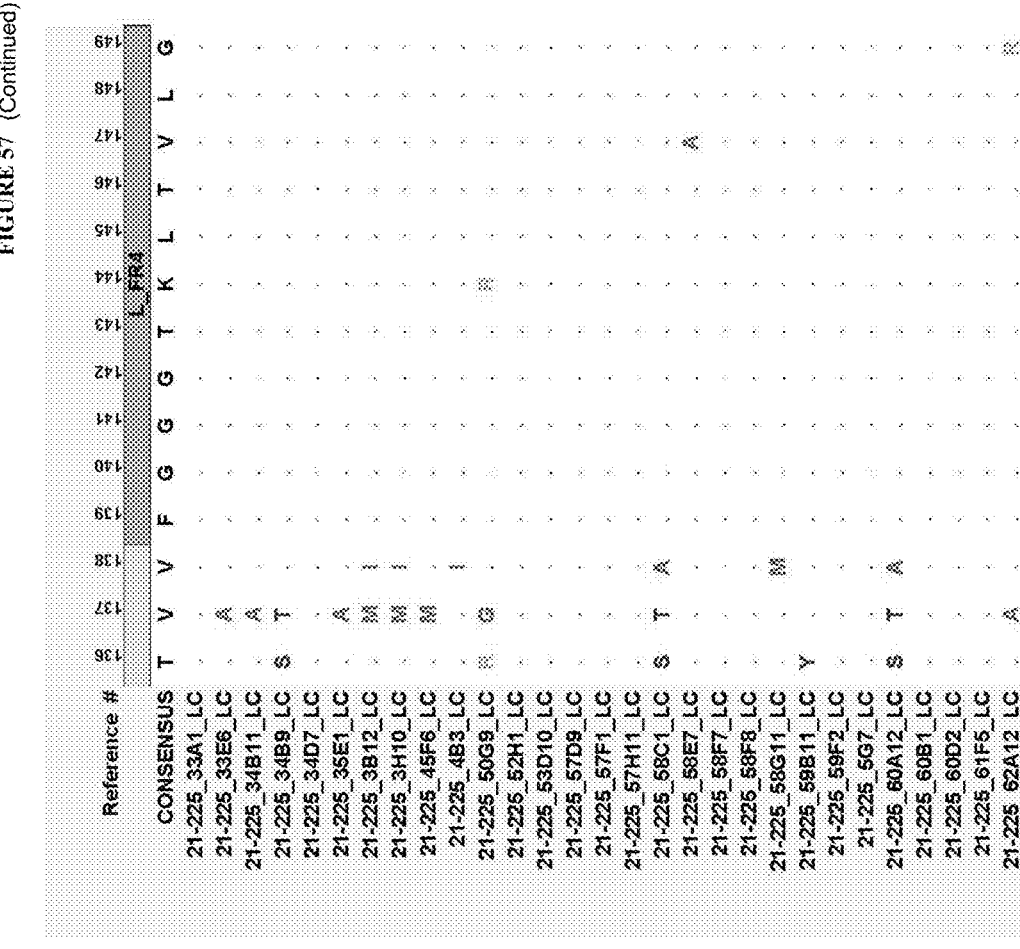
Figure 57:
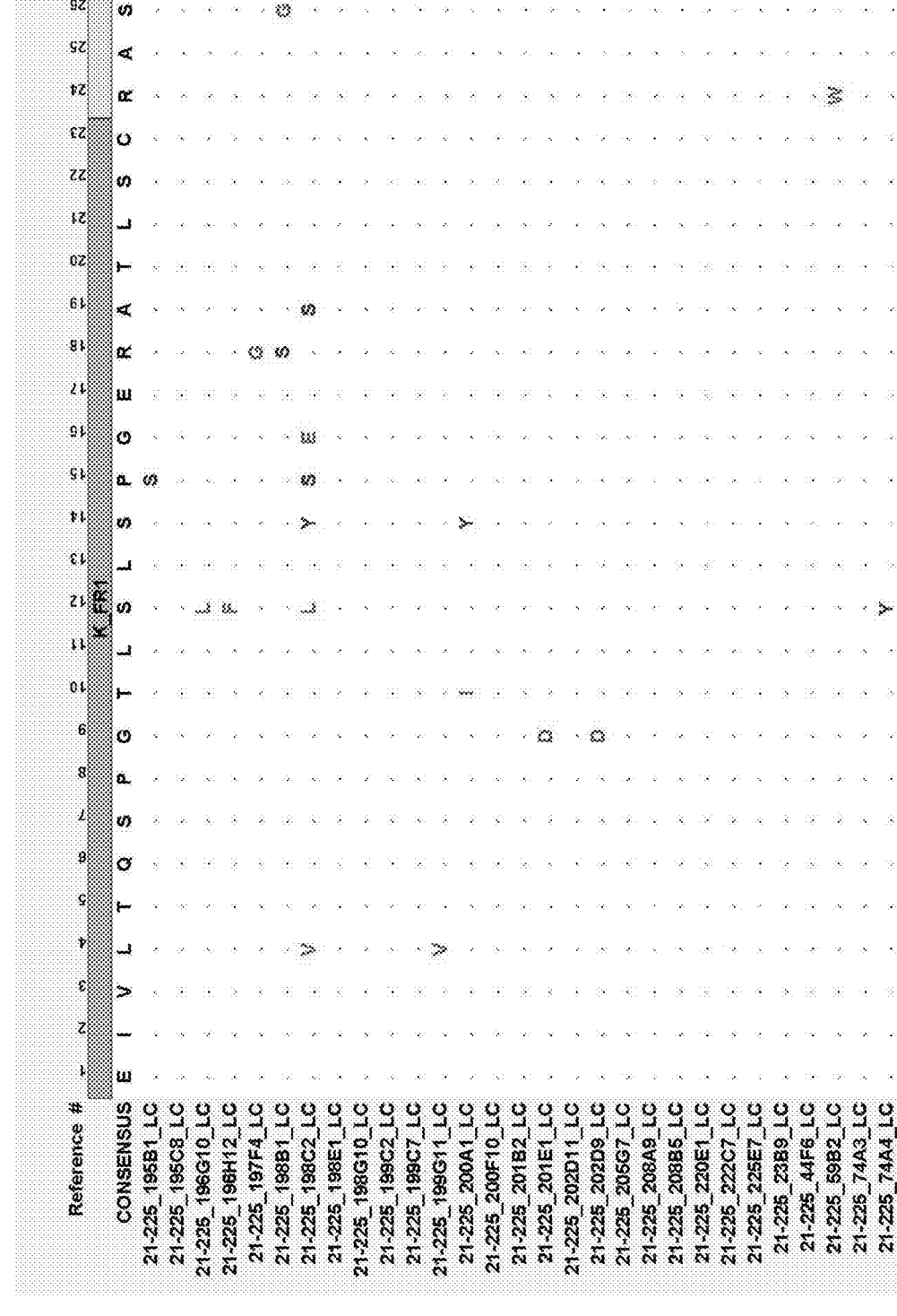
Figure 57:
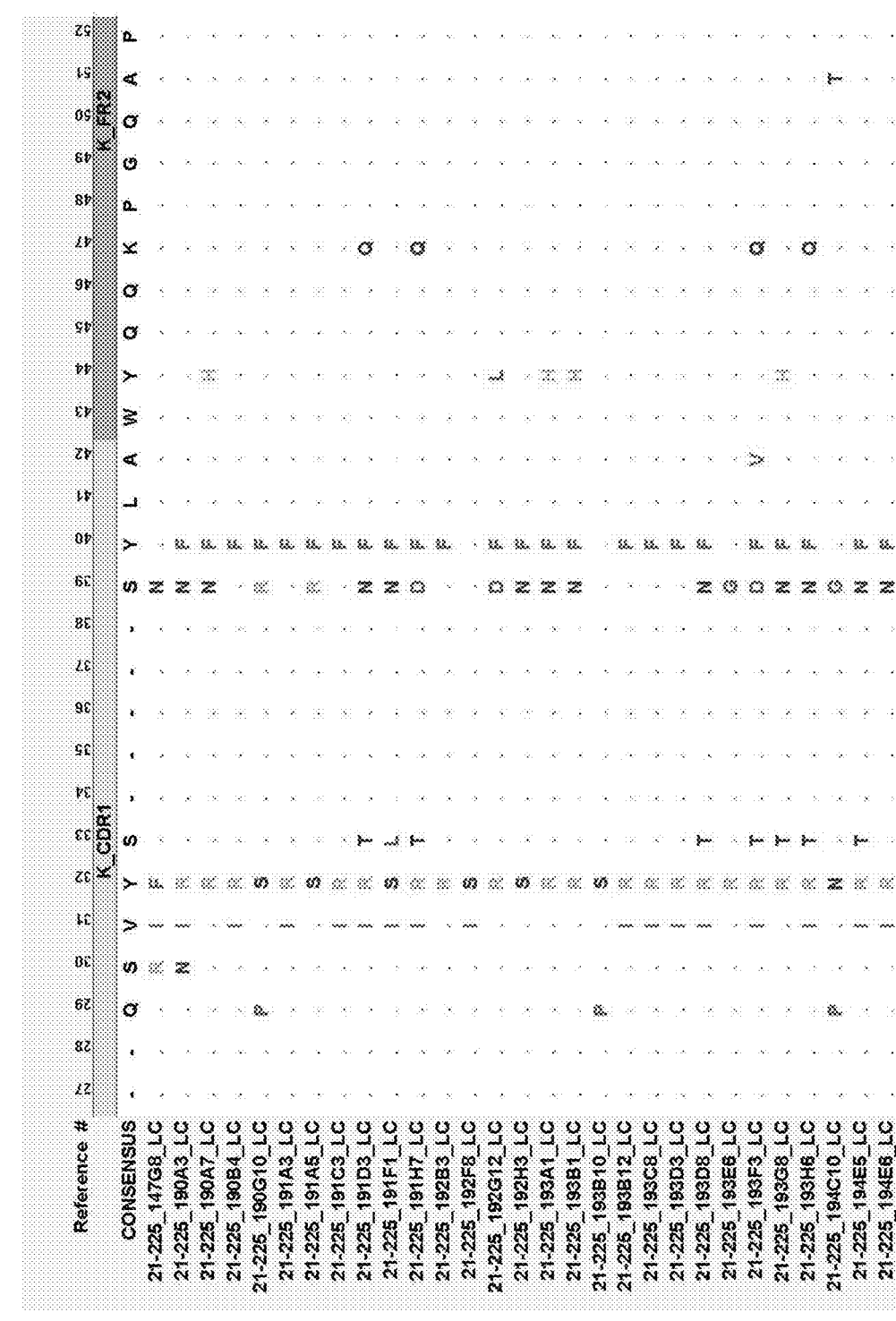
Figure 57:
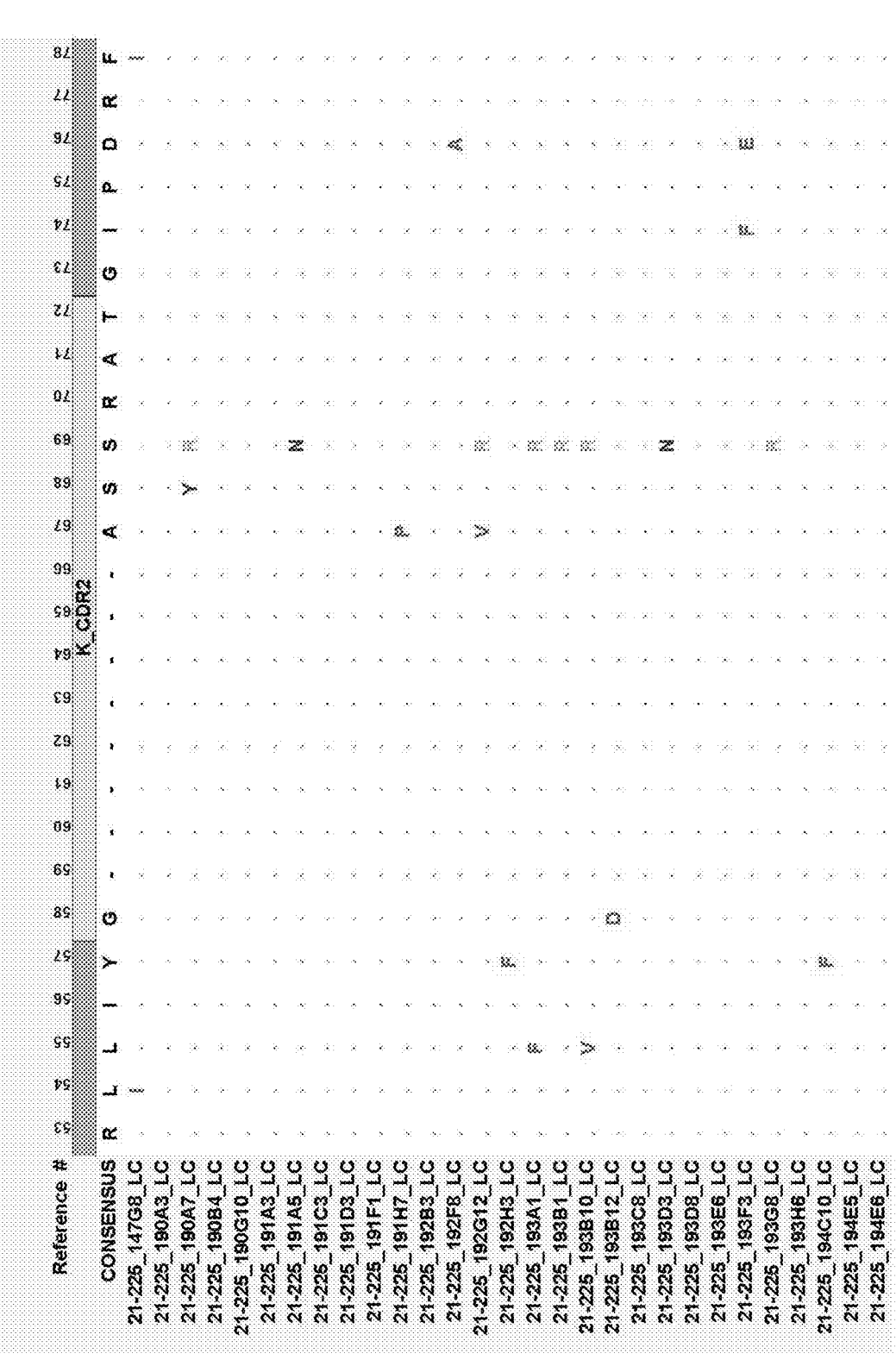
Figure 57:
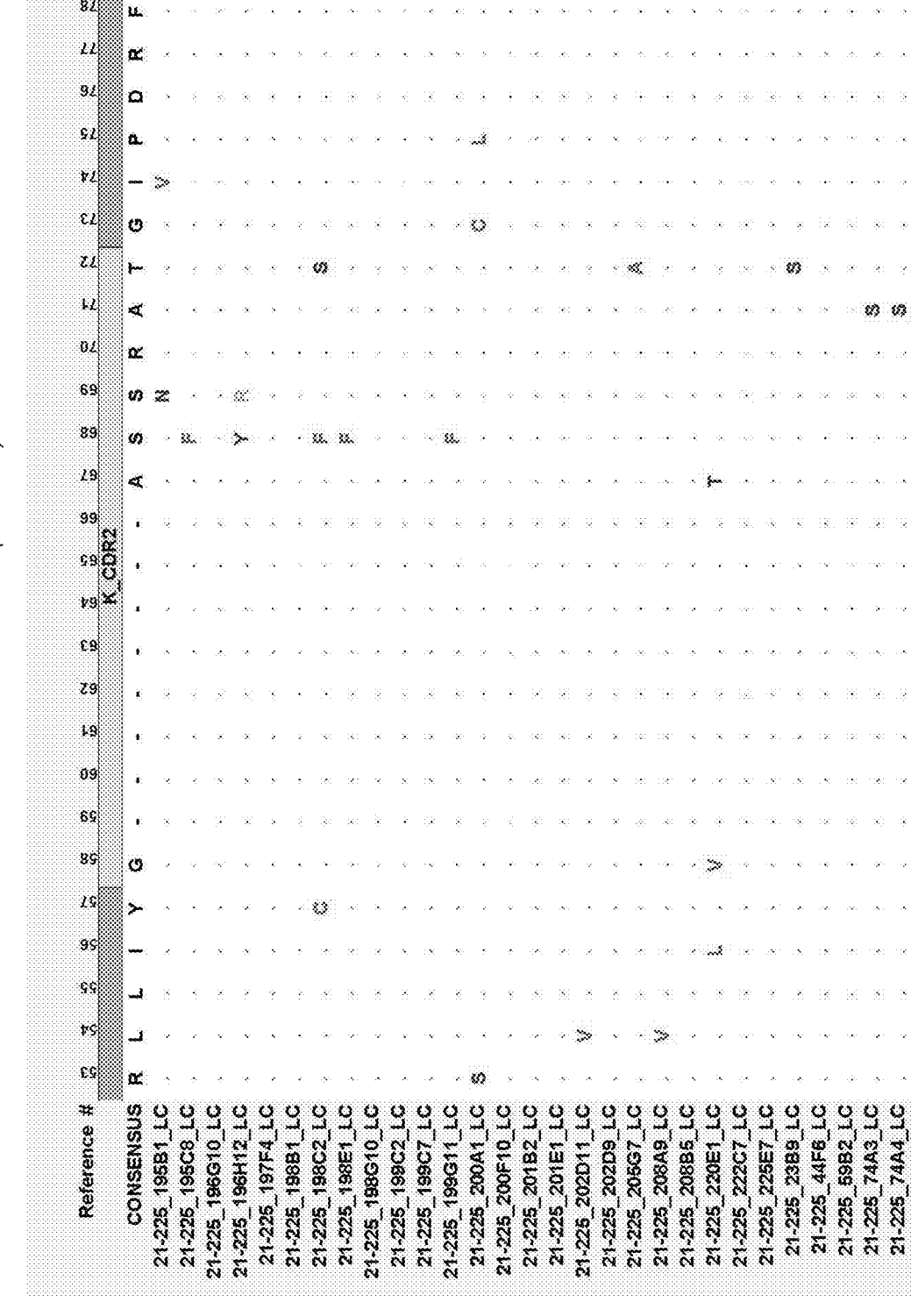
Figure 57:
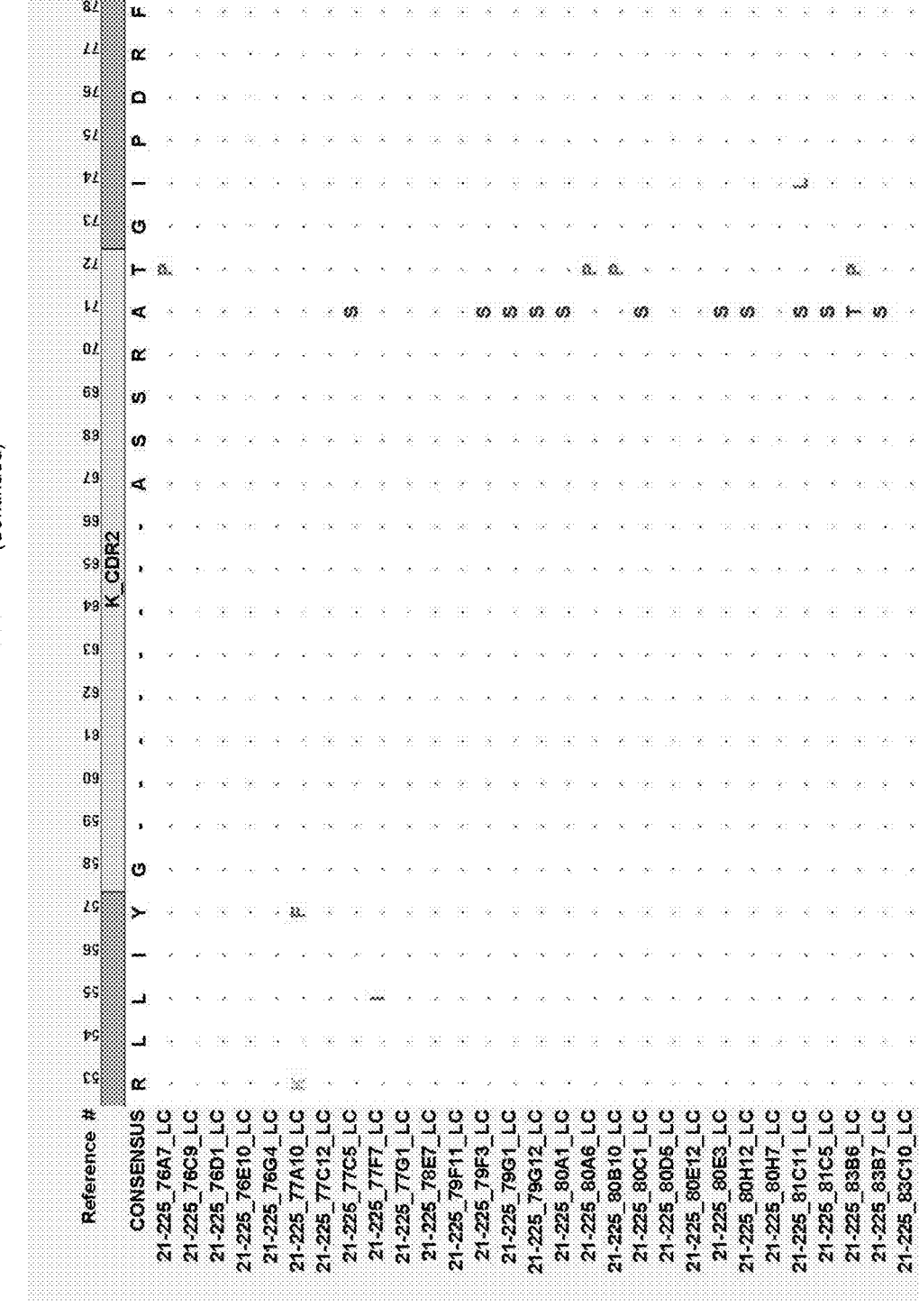
Figure 57:
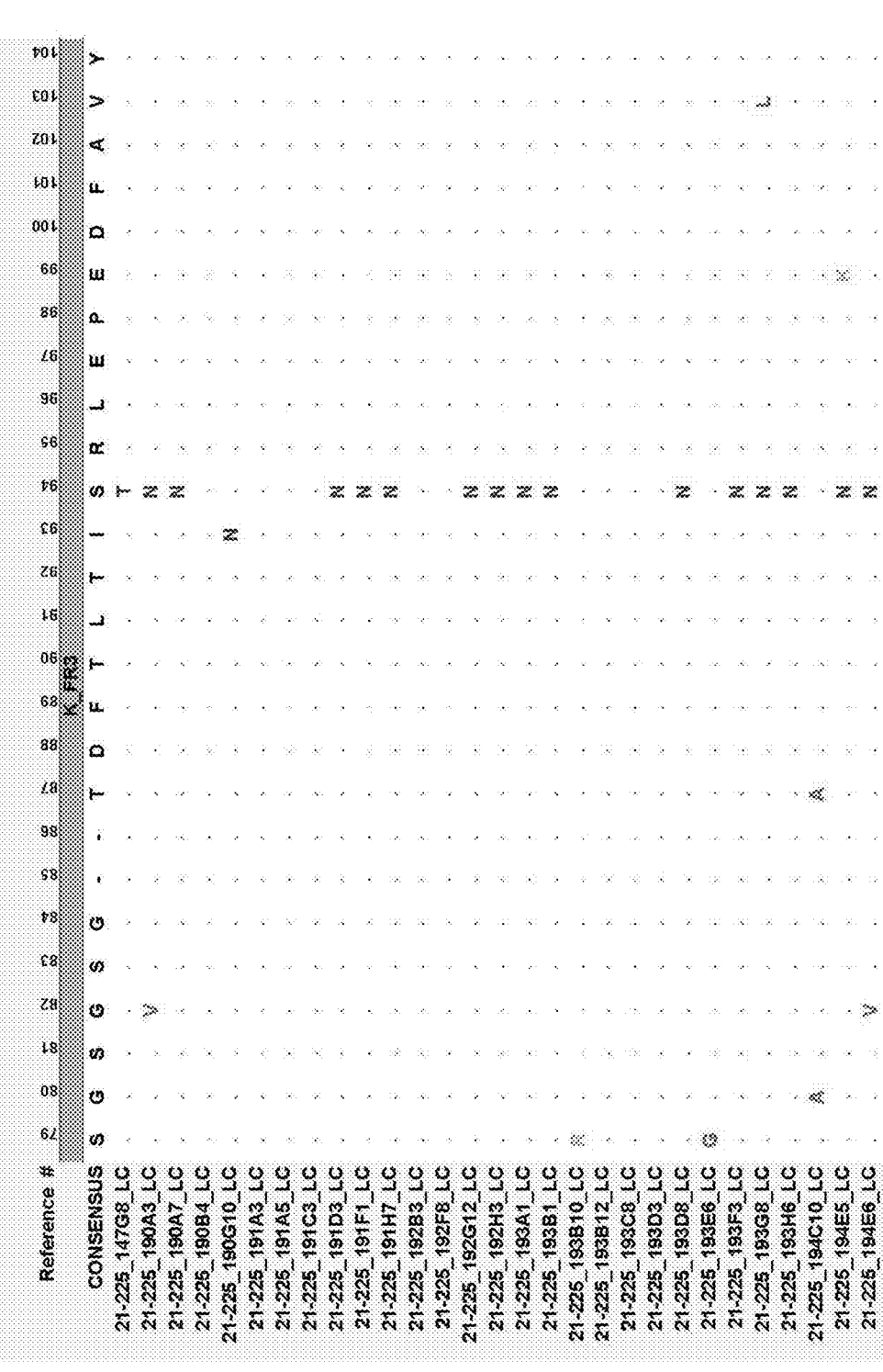
Figure 57:
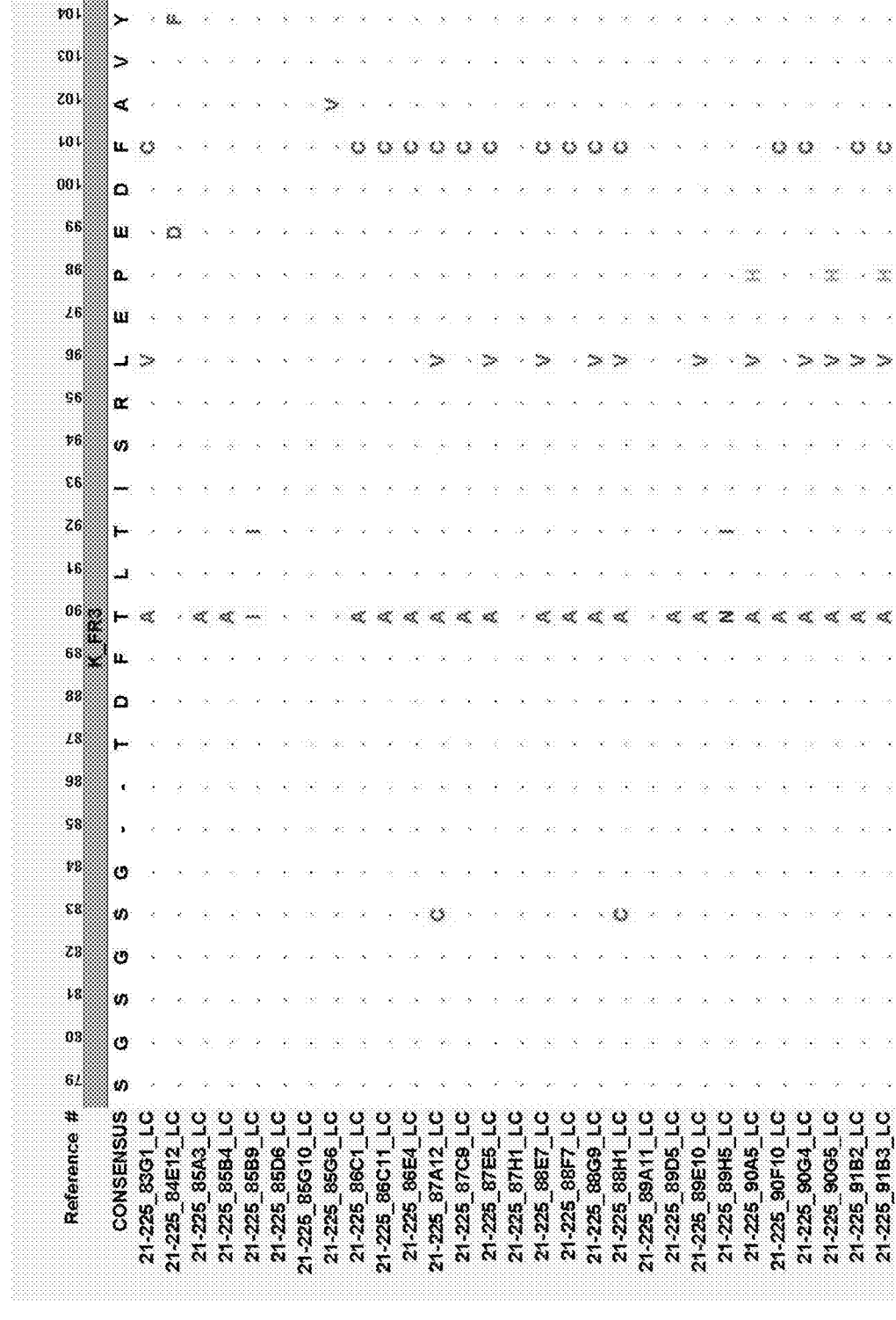
Figure 57:
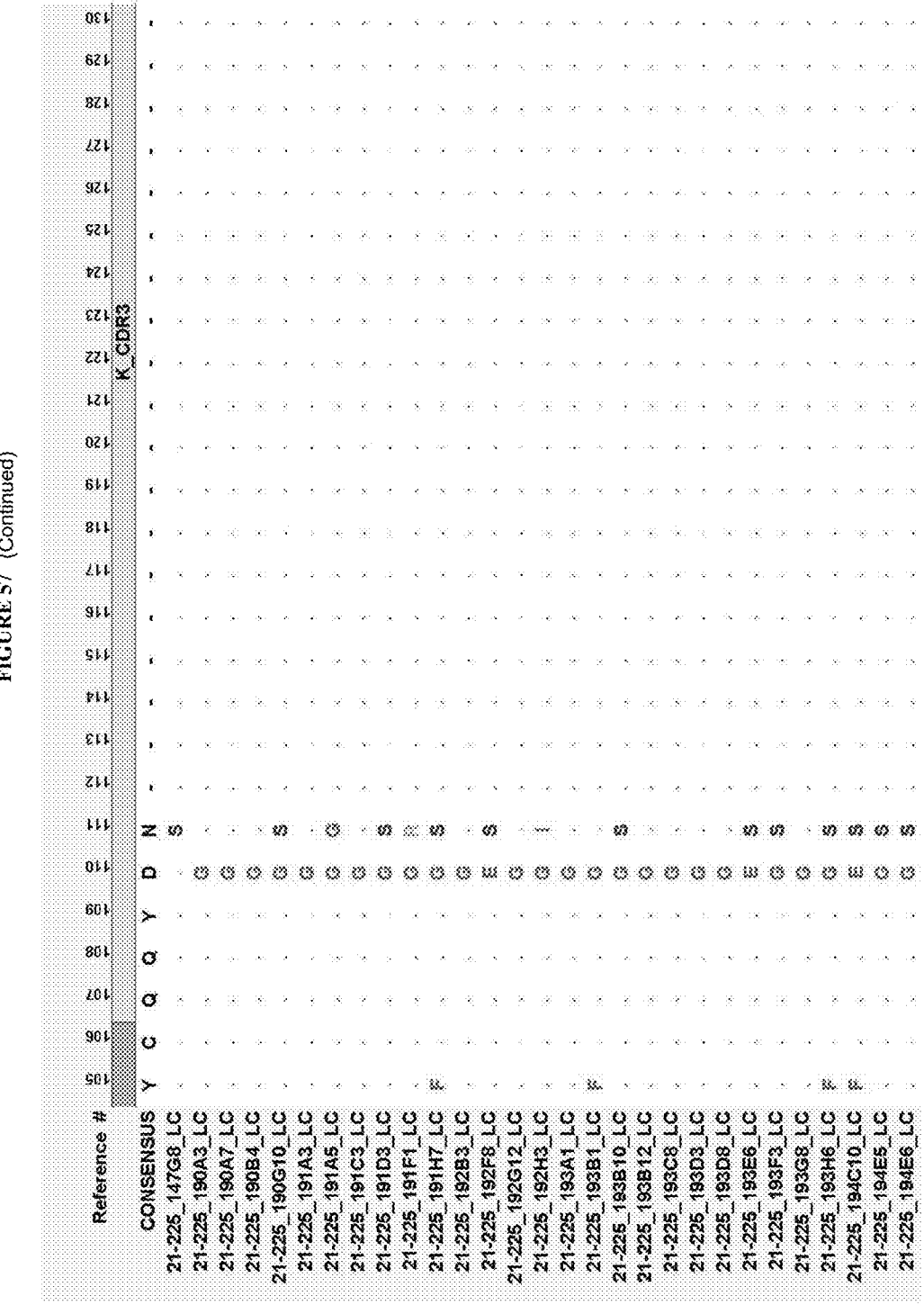
Figure 57:
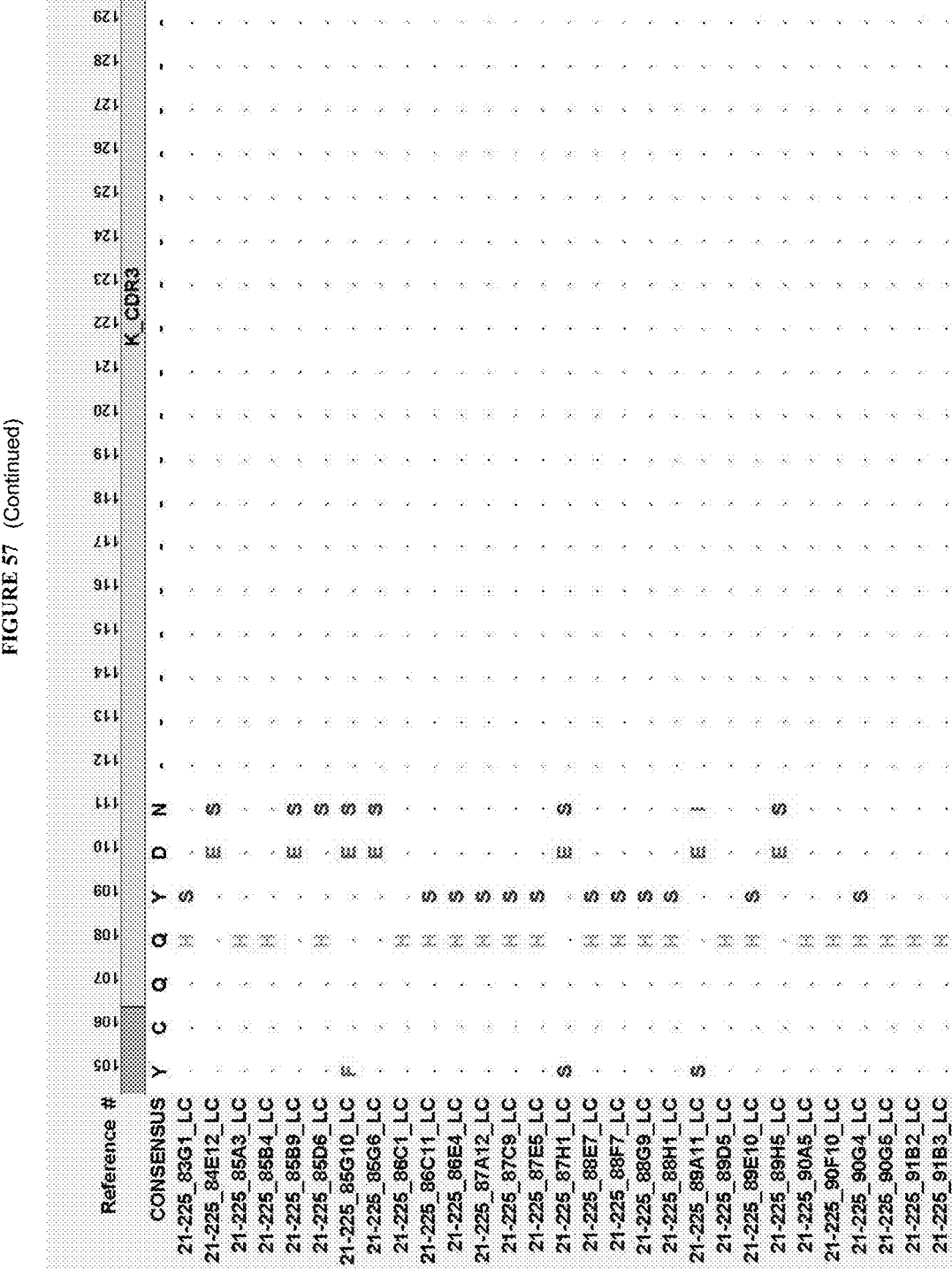
Figure 57:
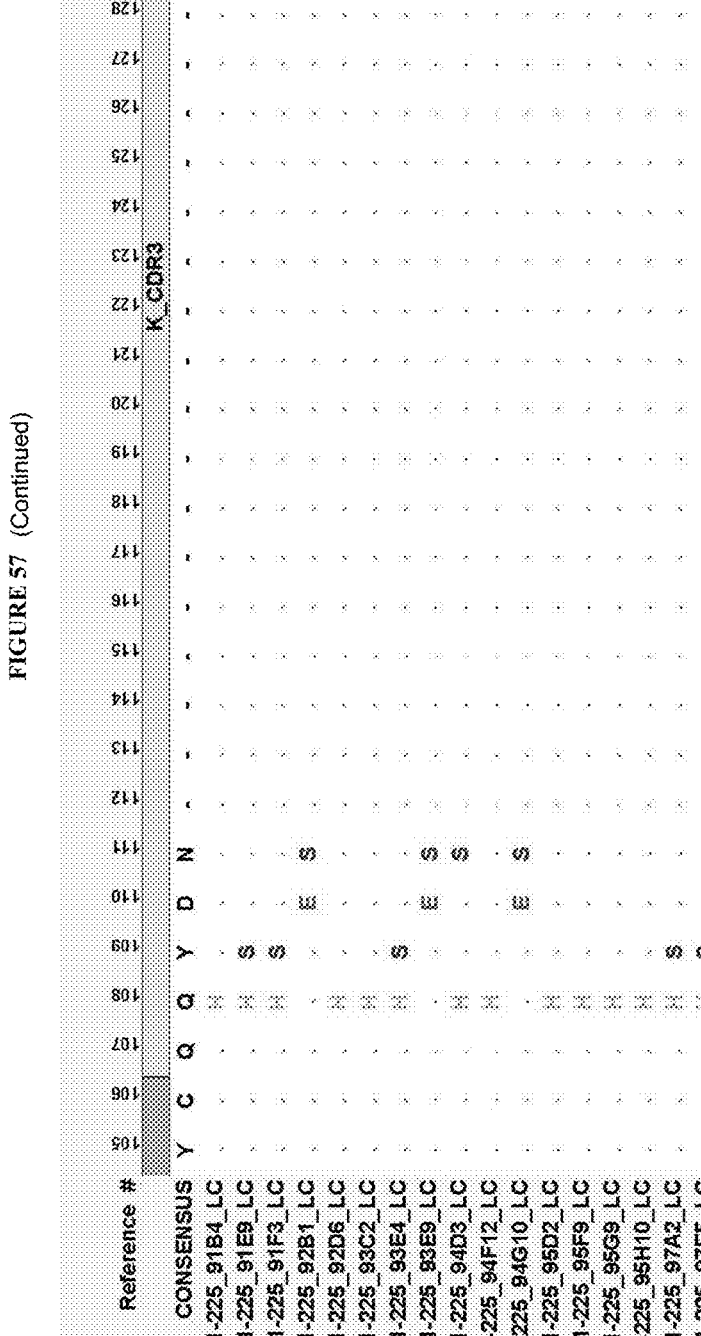
Figure 57:
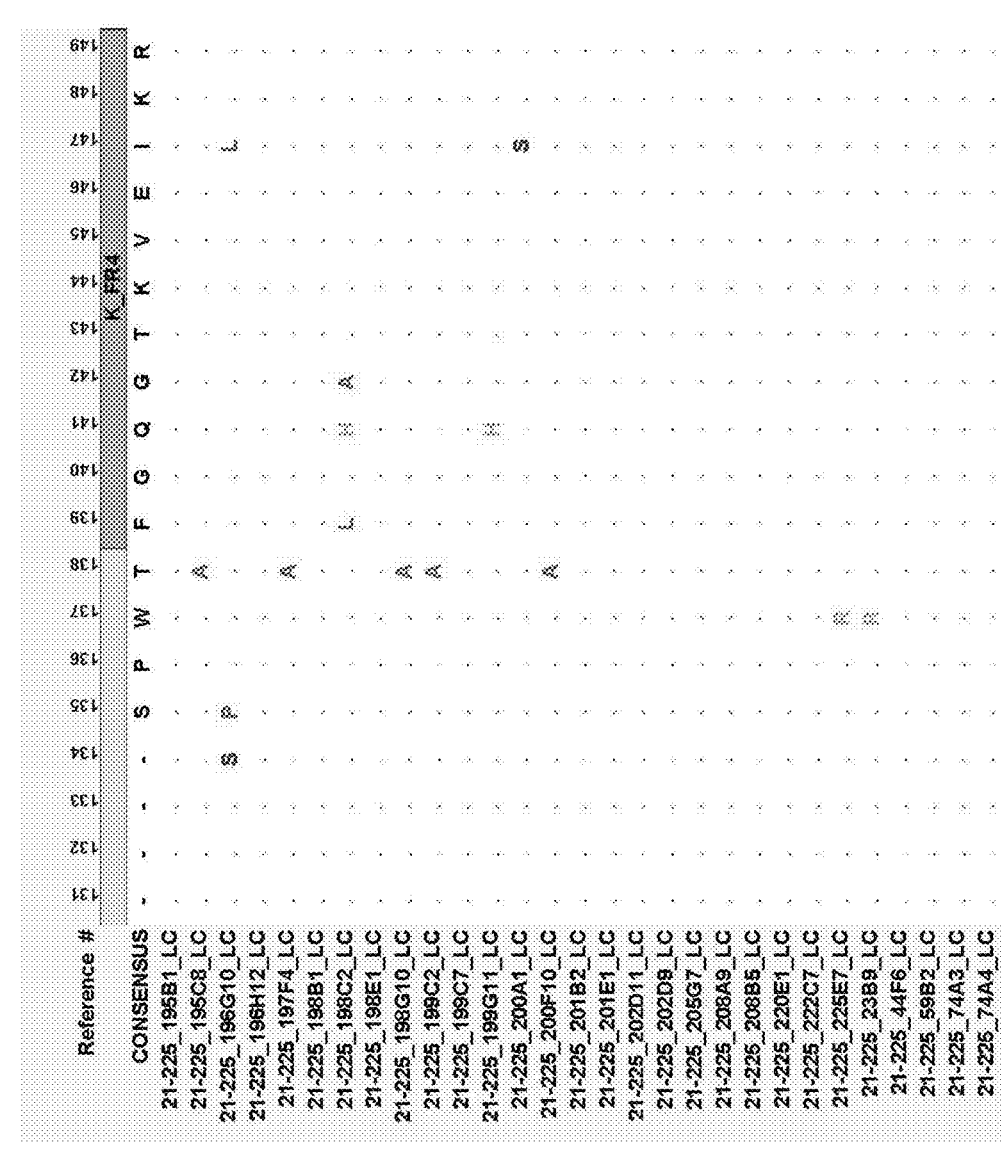
Figure 57:
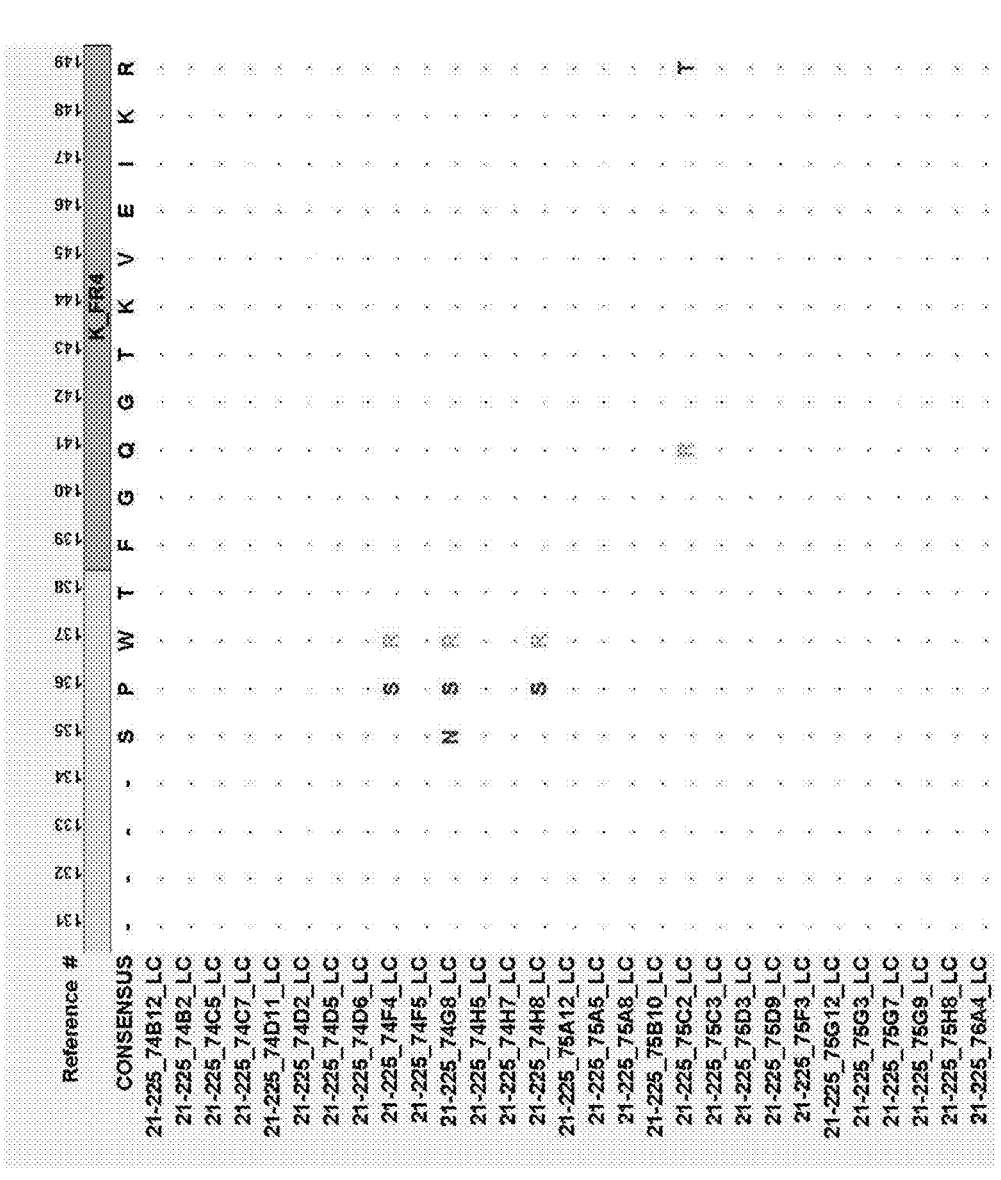
Figure 57:
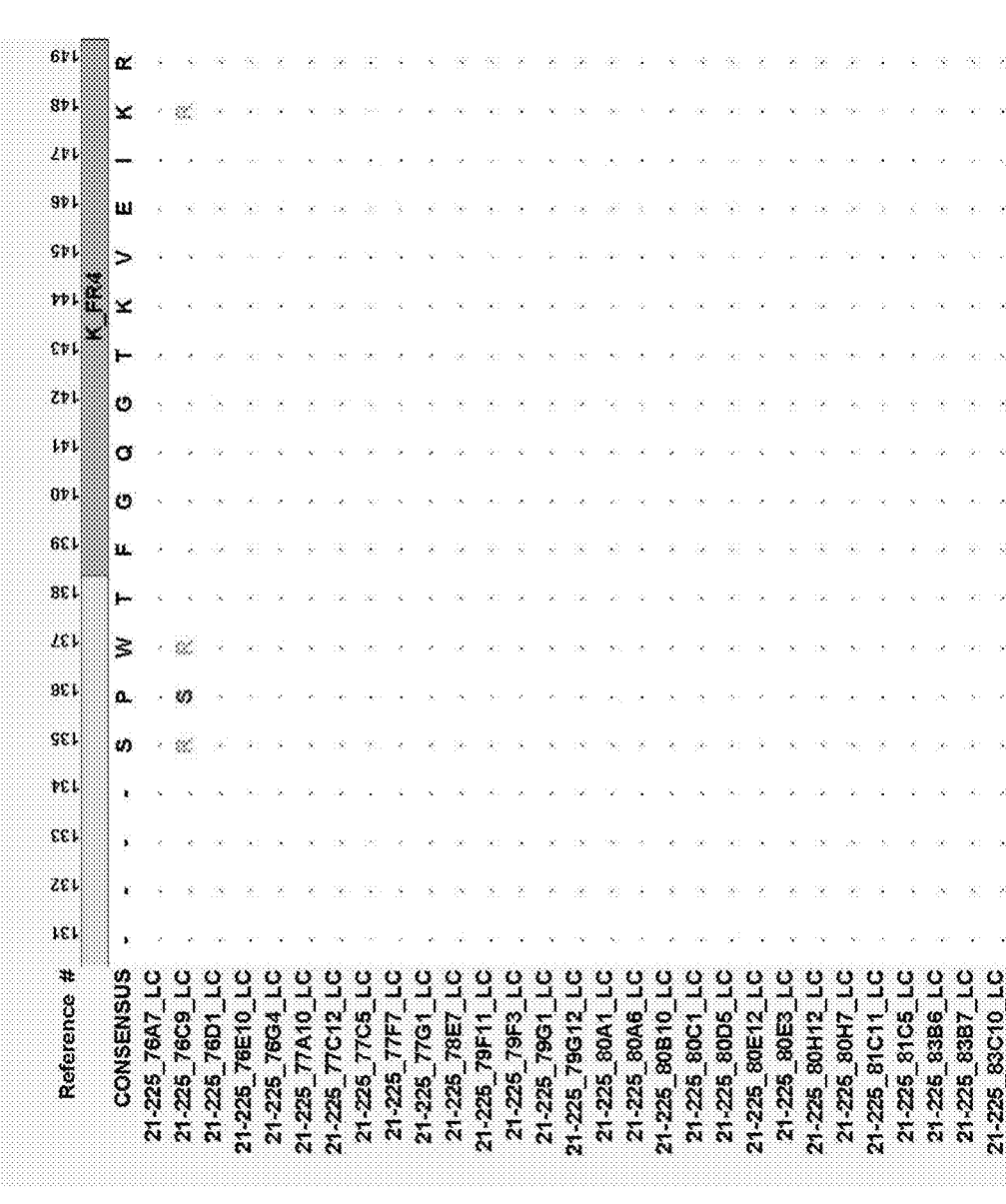
Figure 57:
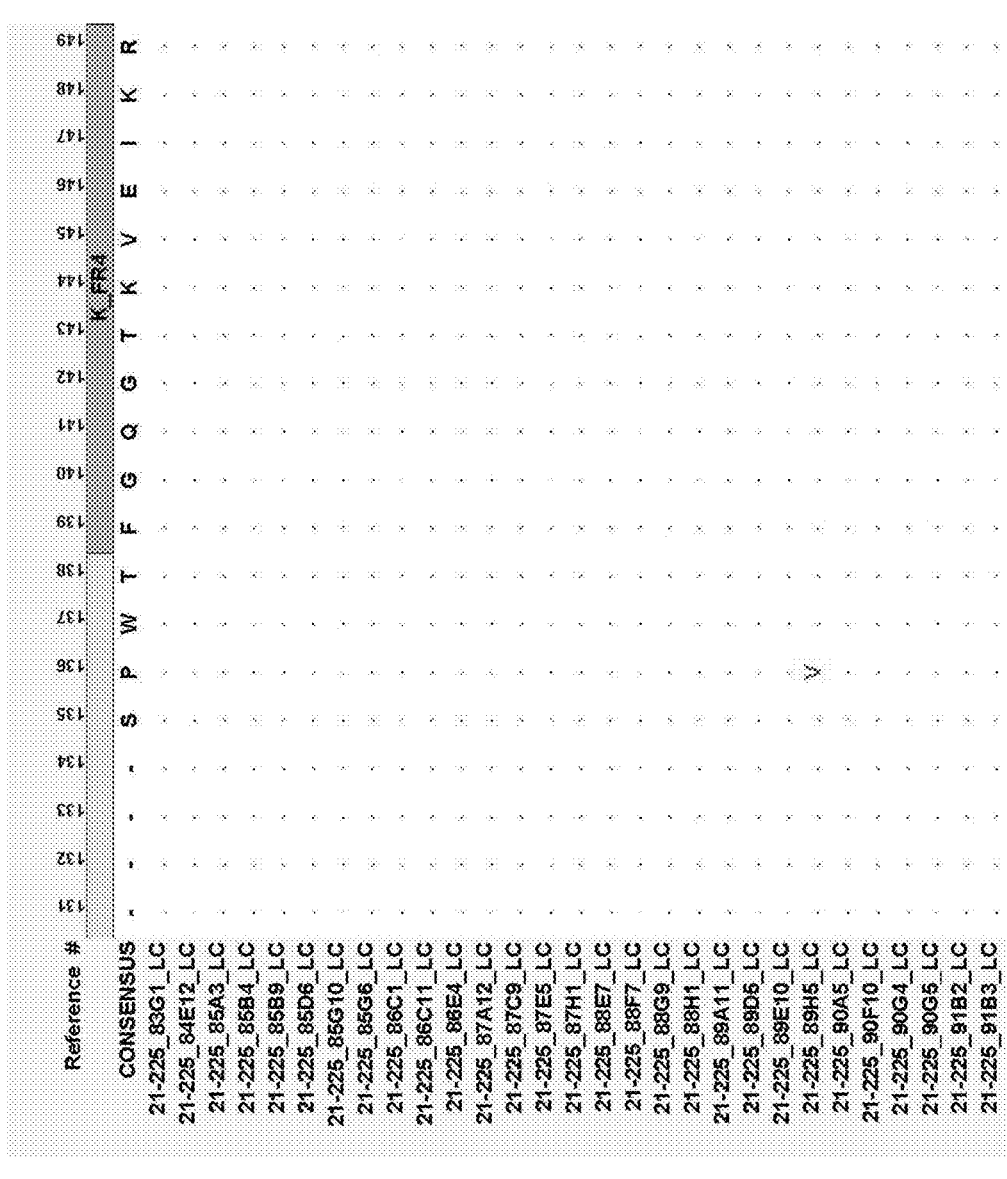
Figure 57:
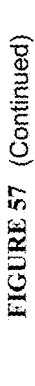
Figure 57:
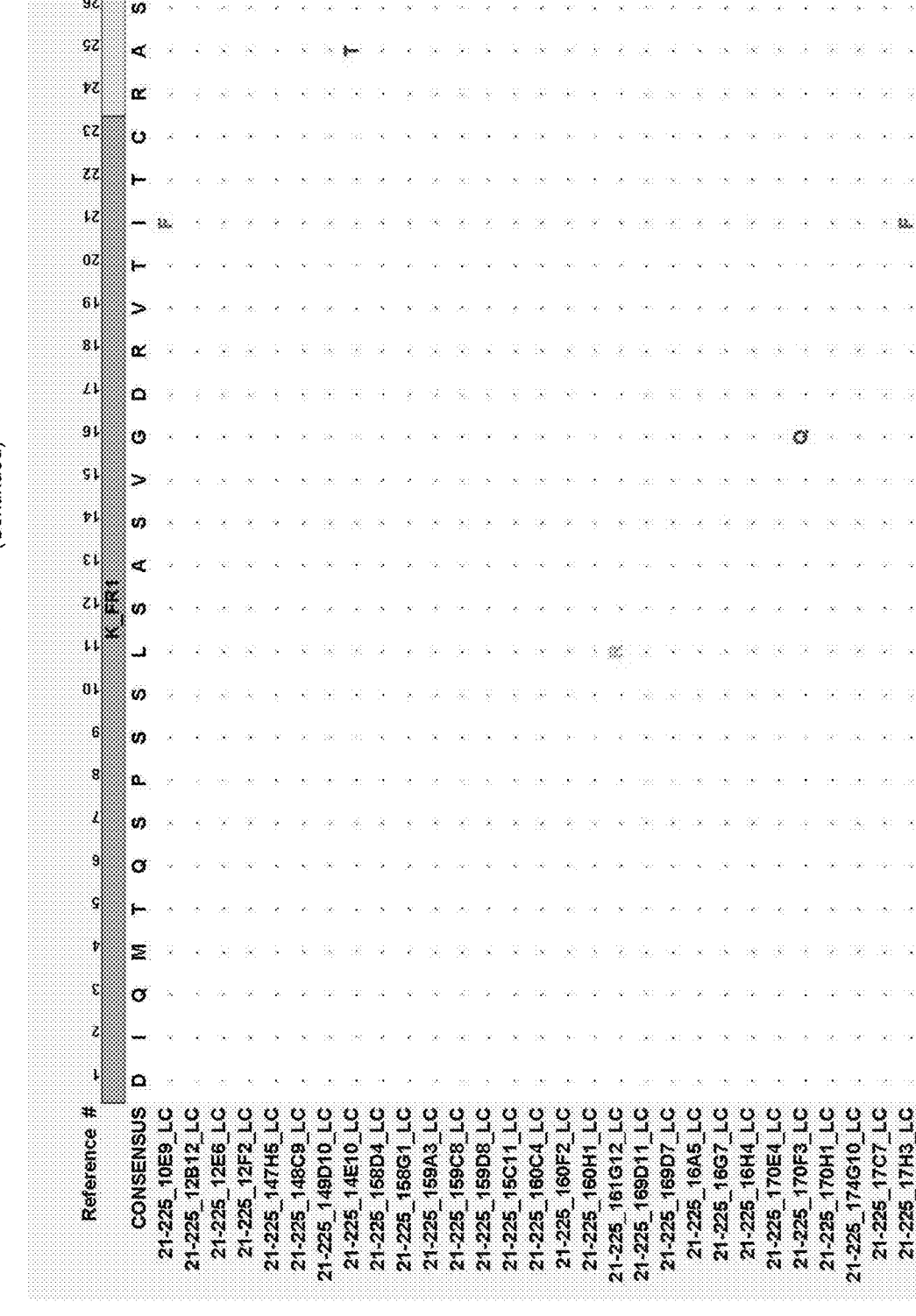
Figure 57:
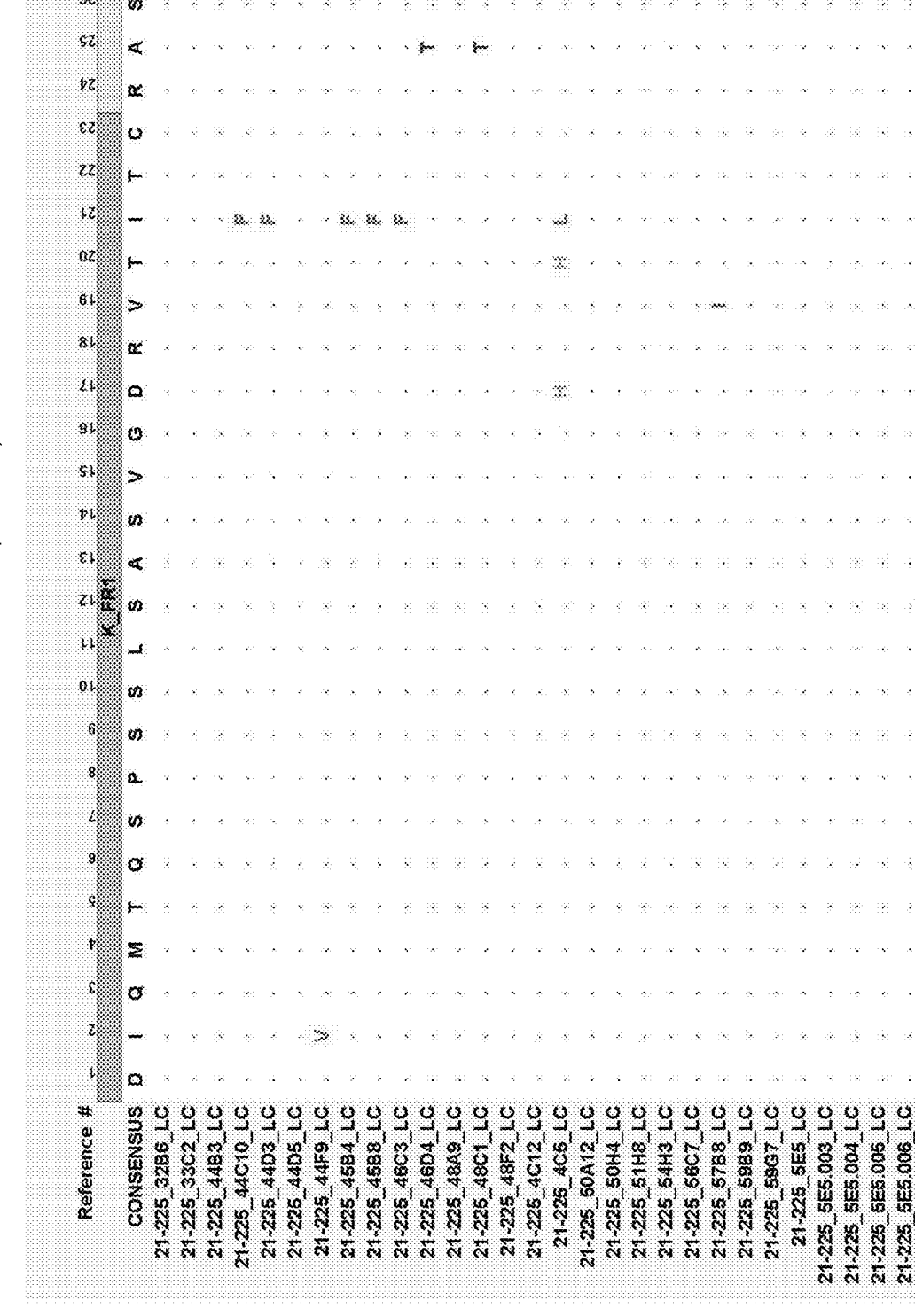
Figure 57:
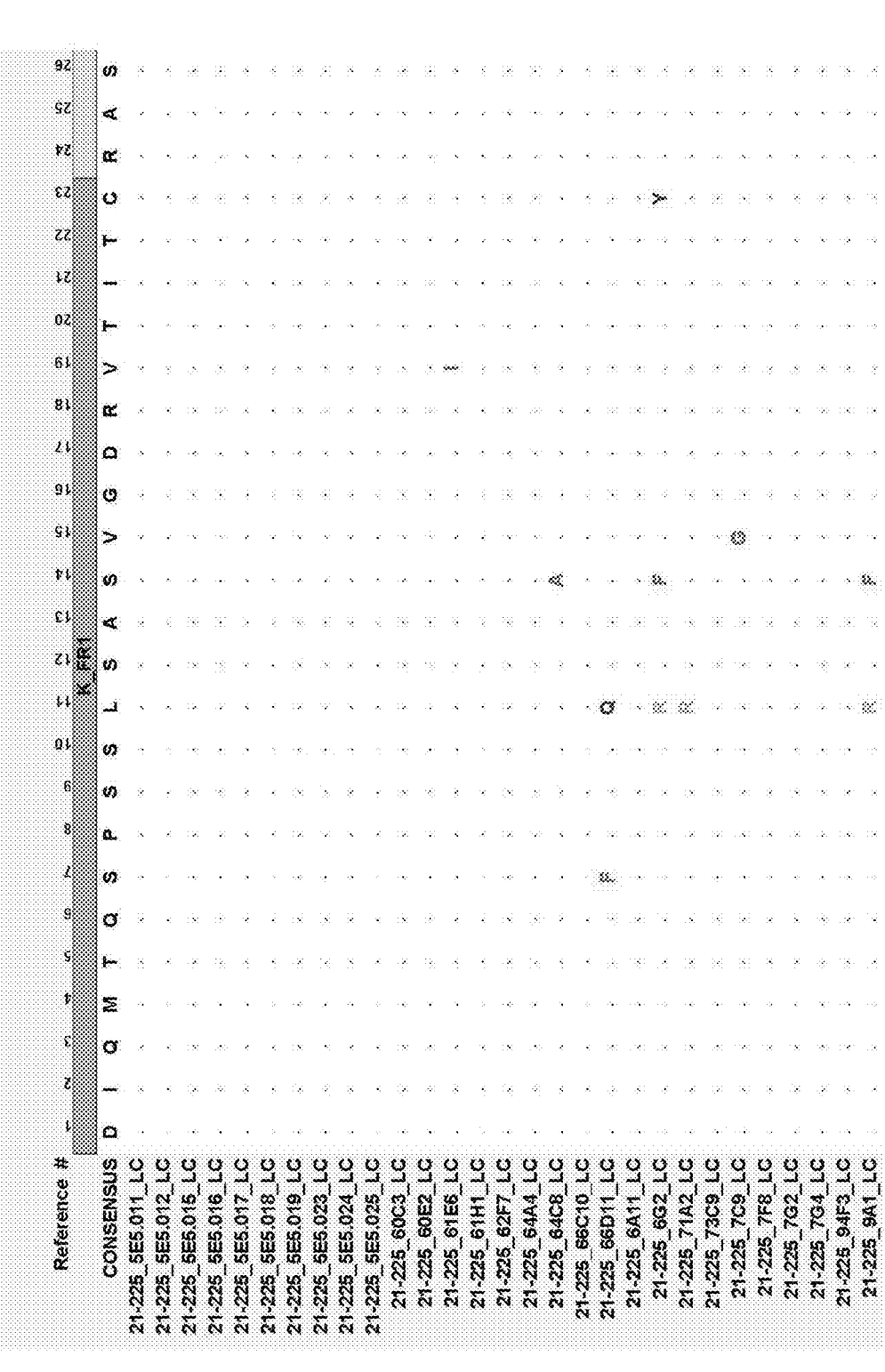
Figure 57:
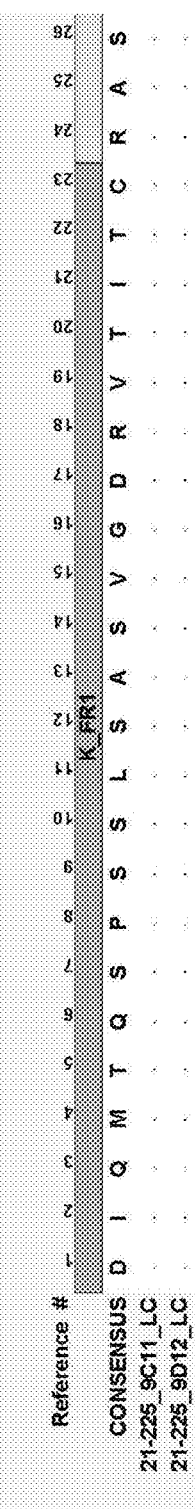
Figure 57:
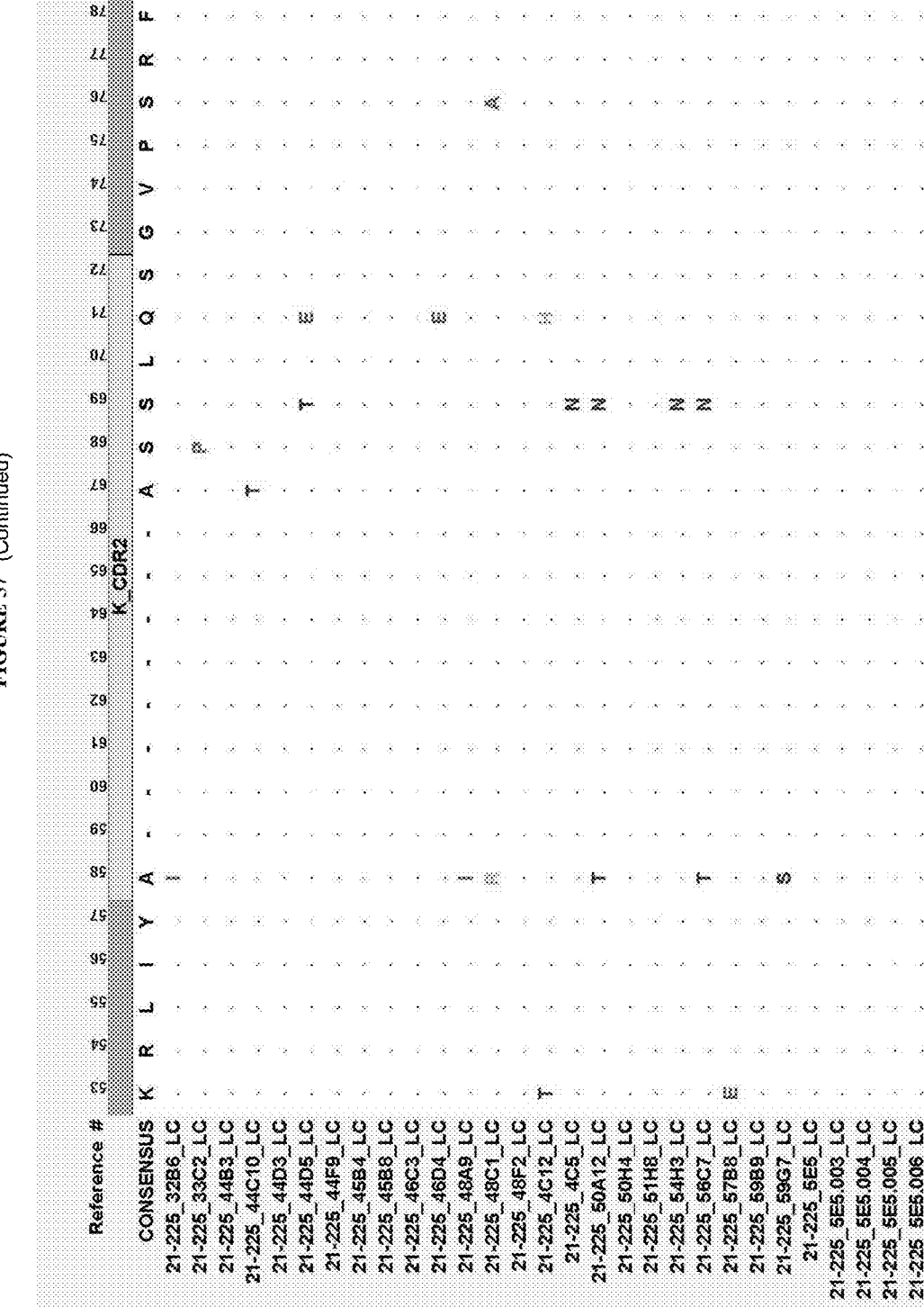
Figure 57:
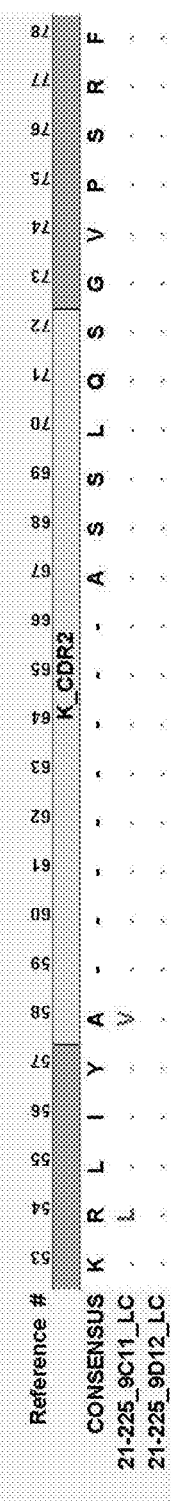
Figure 57:
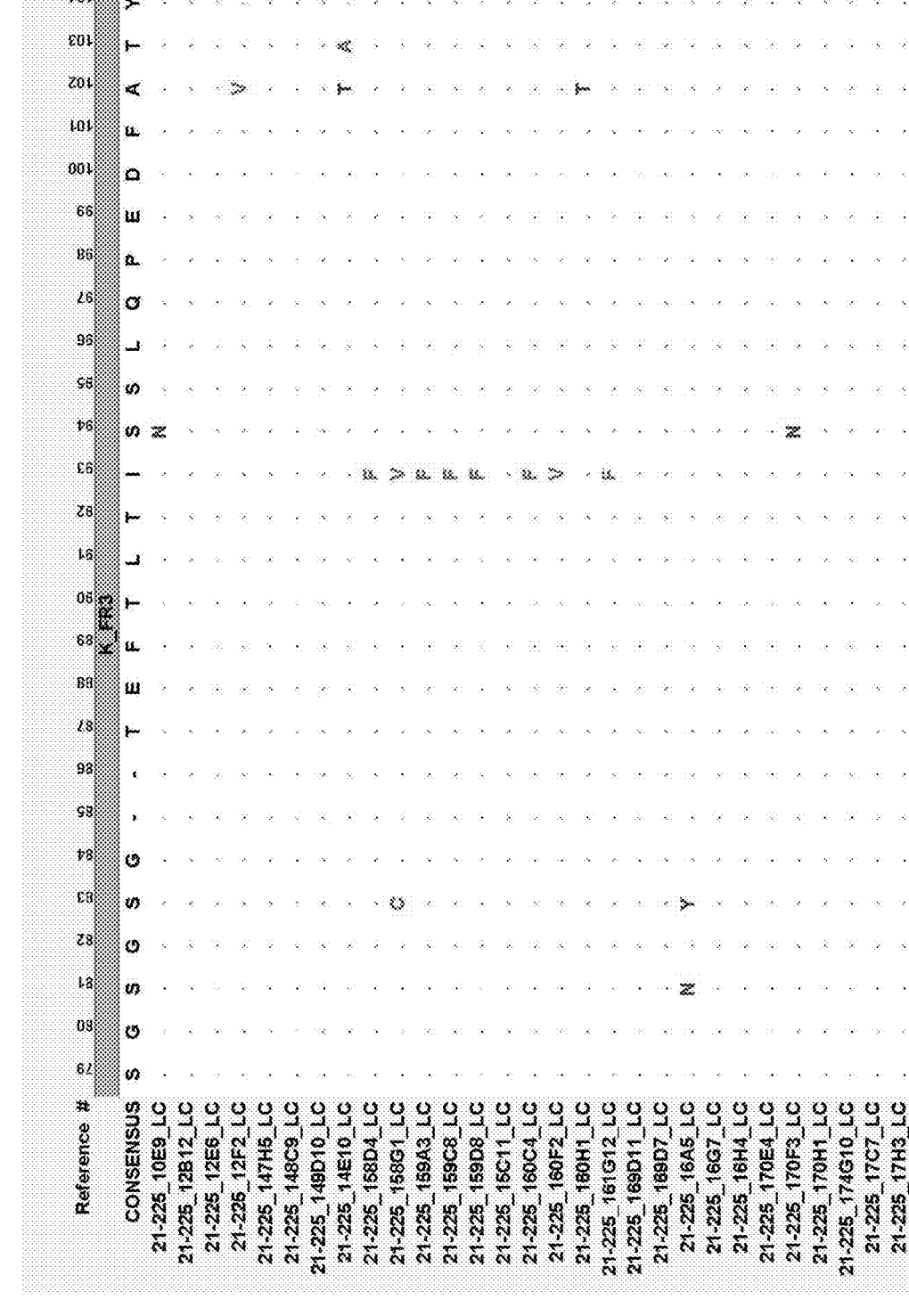
Figure 57:
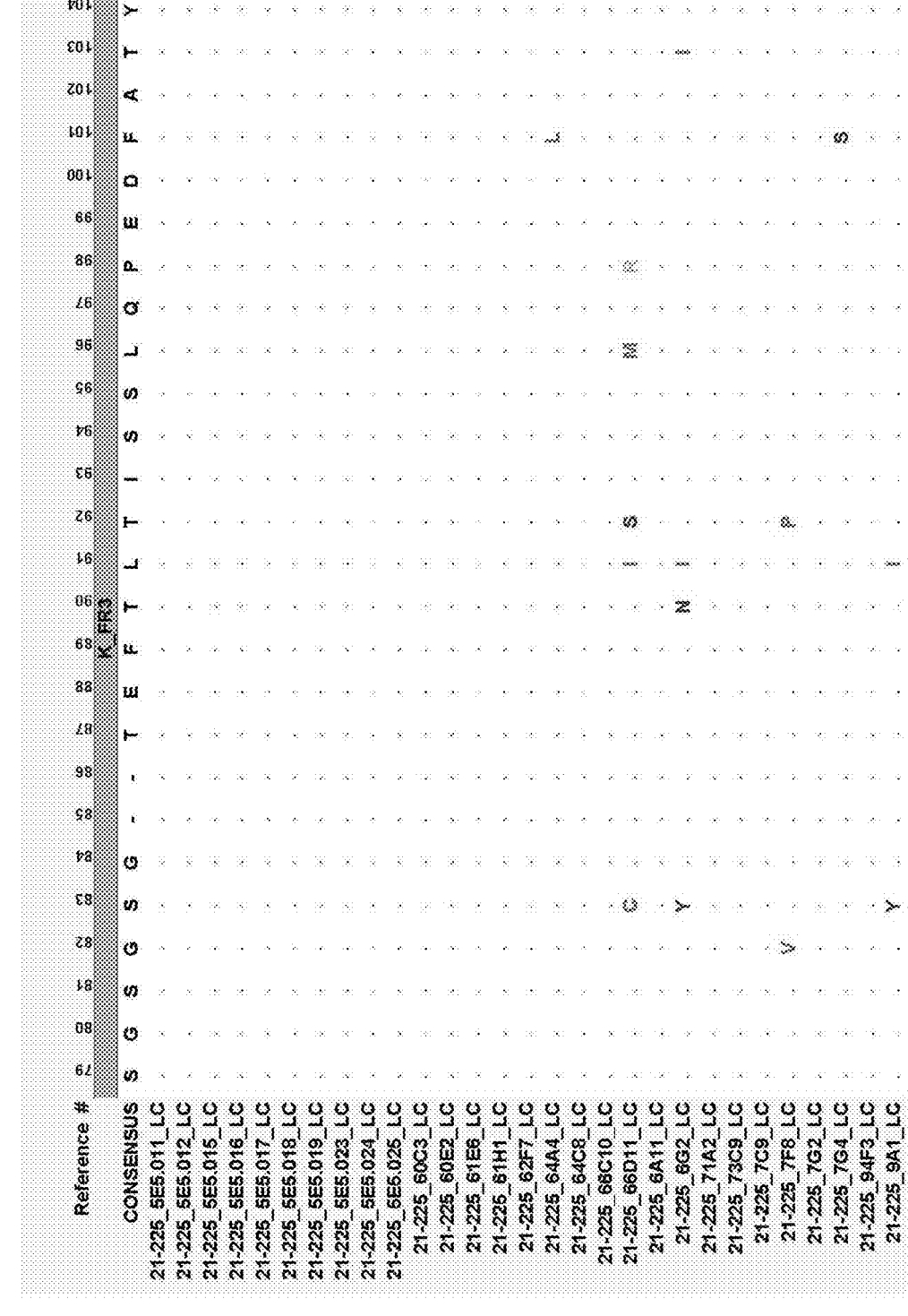
Figure 57:
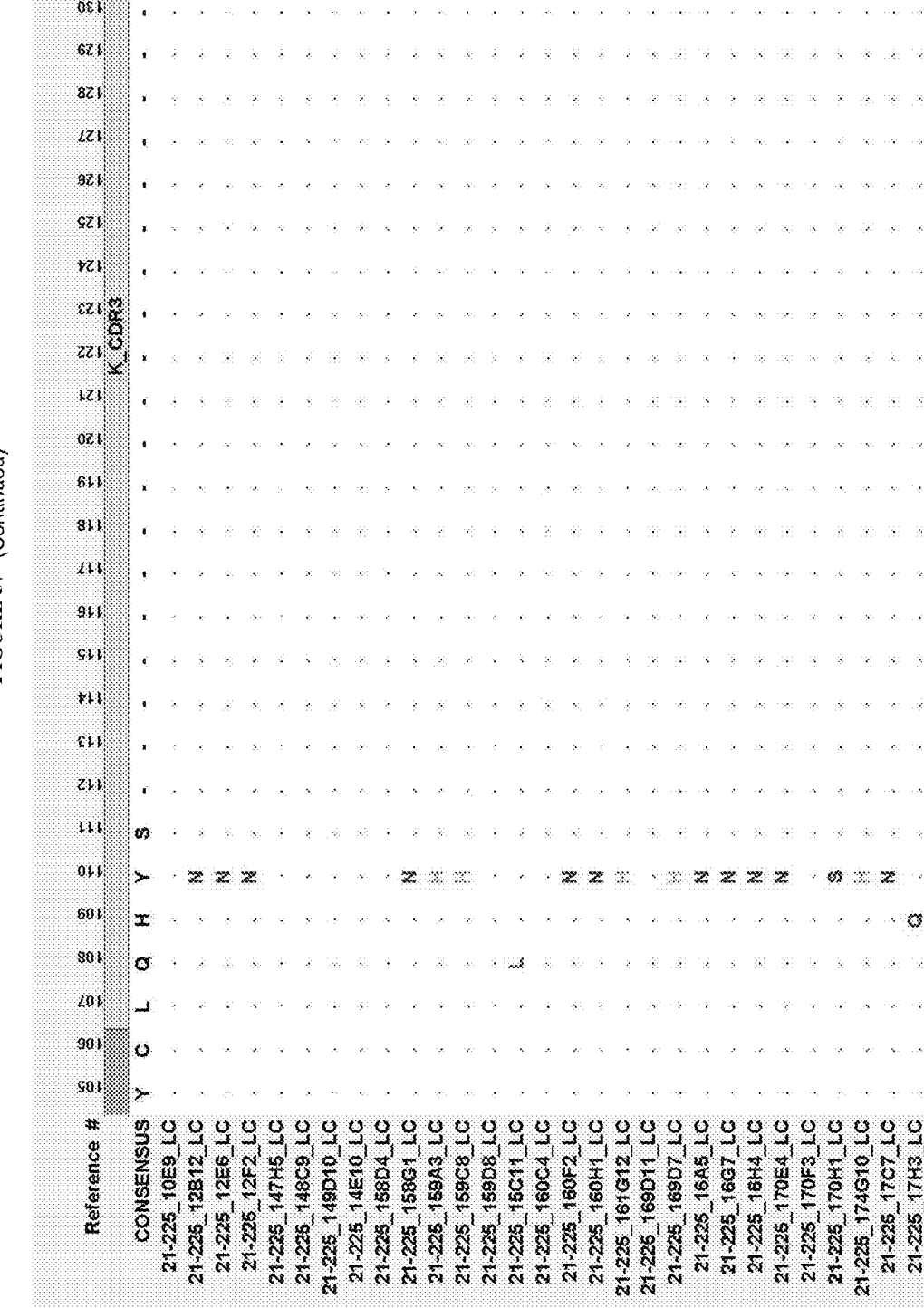
Figure 57:
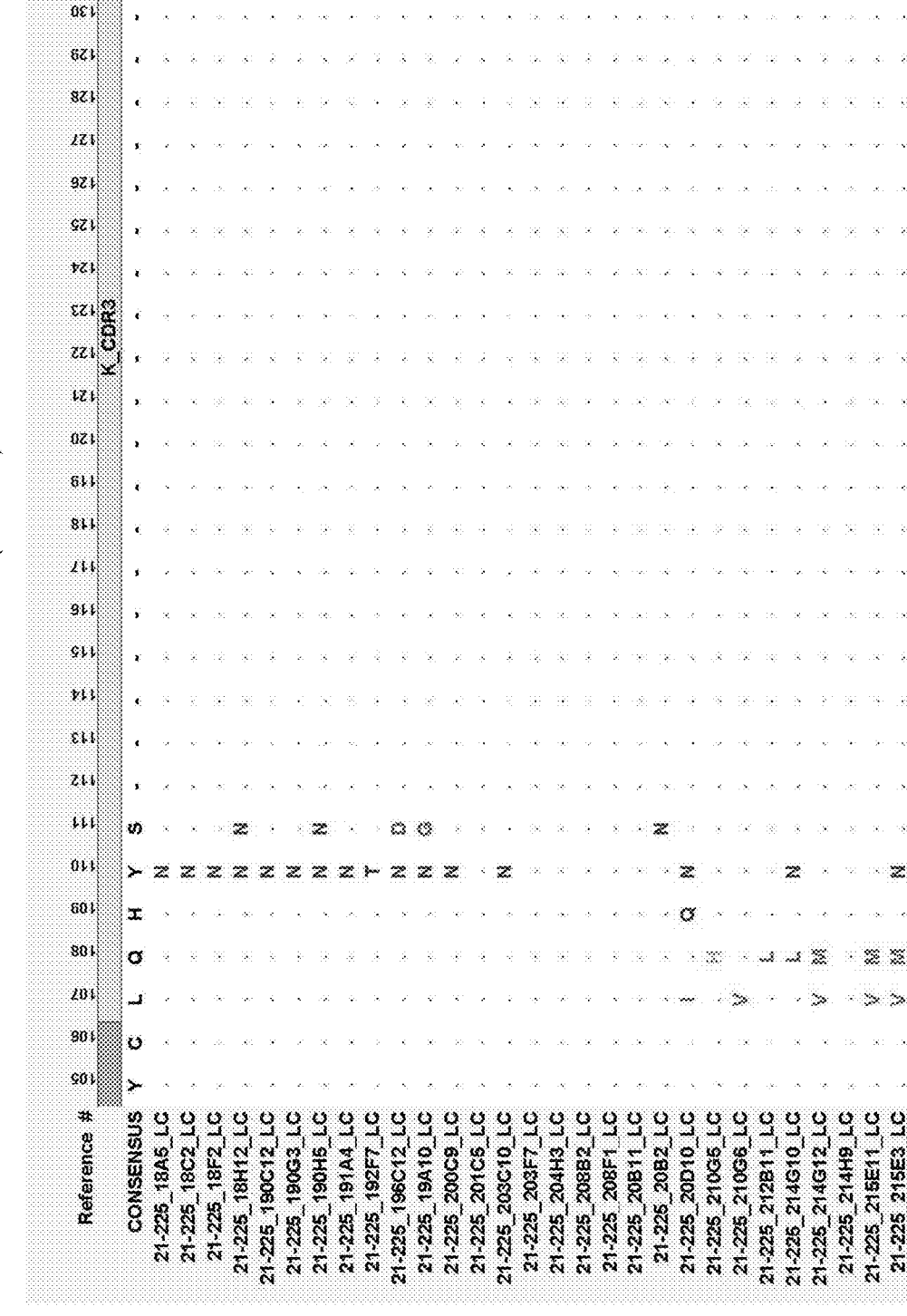
Figure 57:
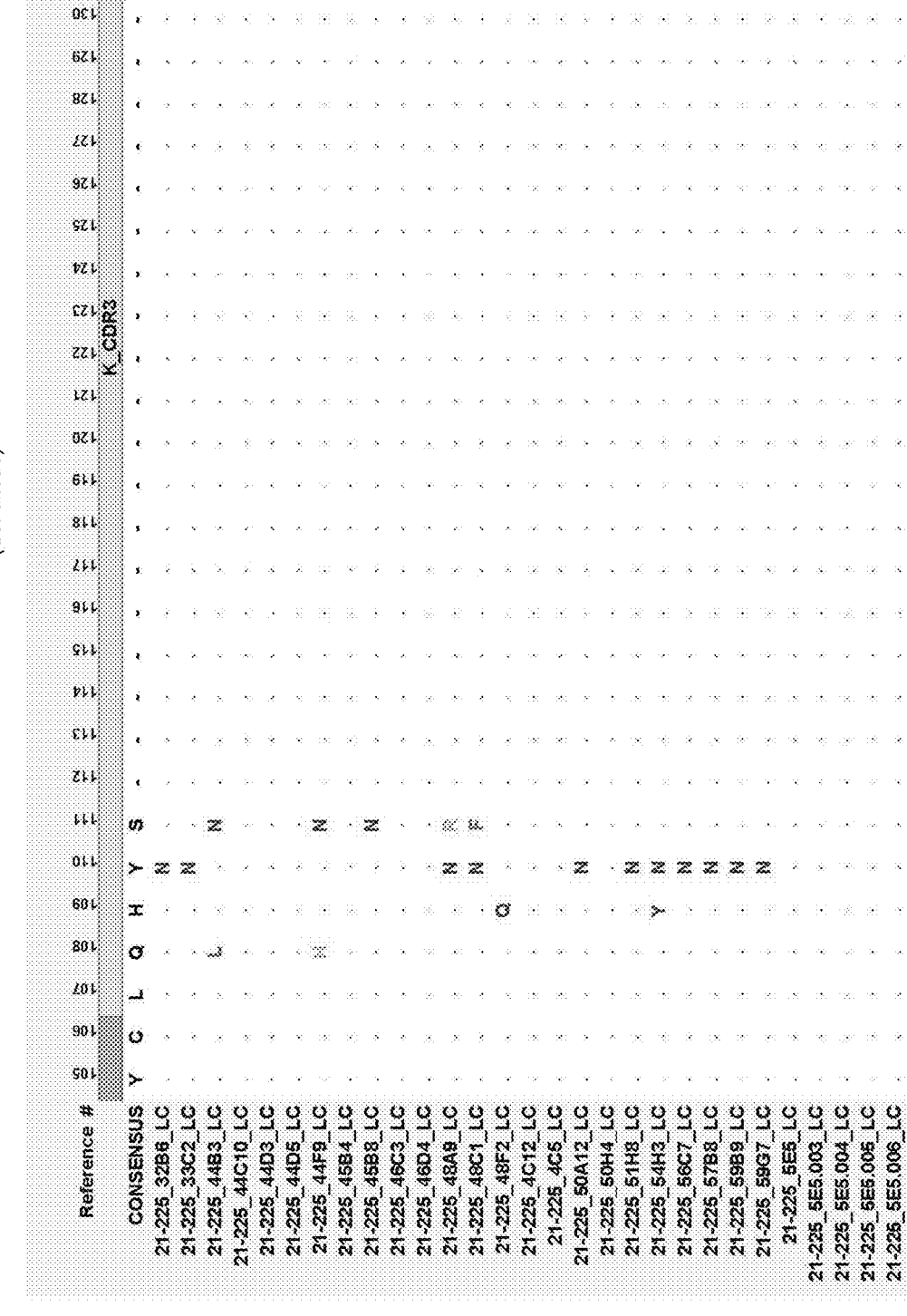
Figure 57:
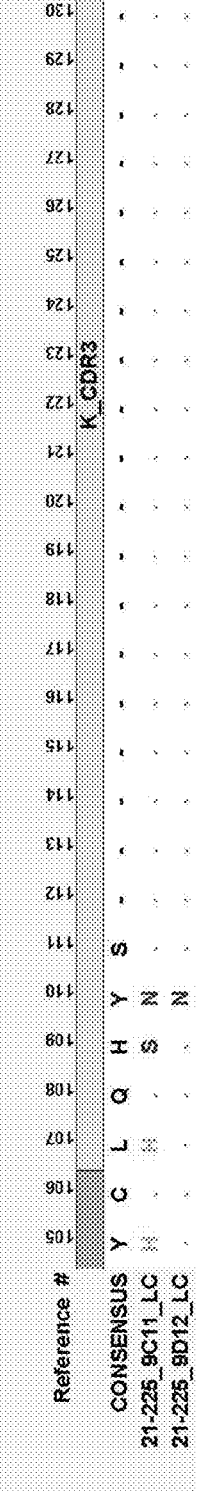
Figure 57:
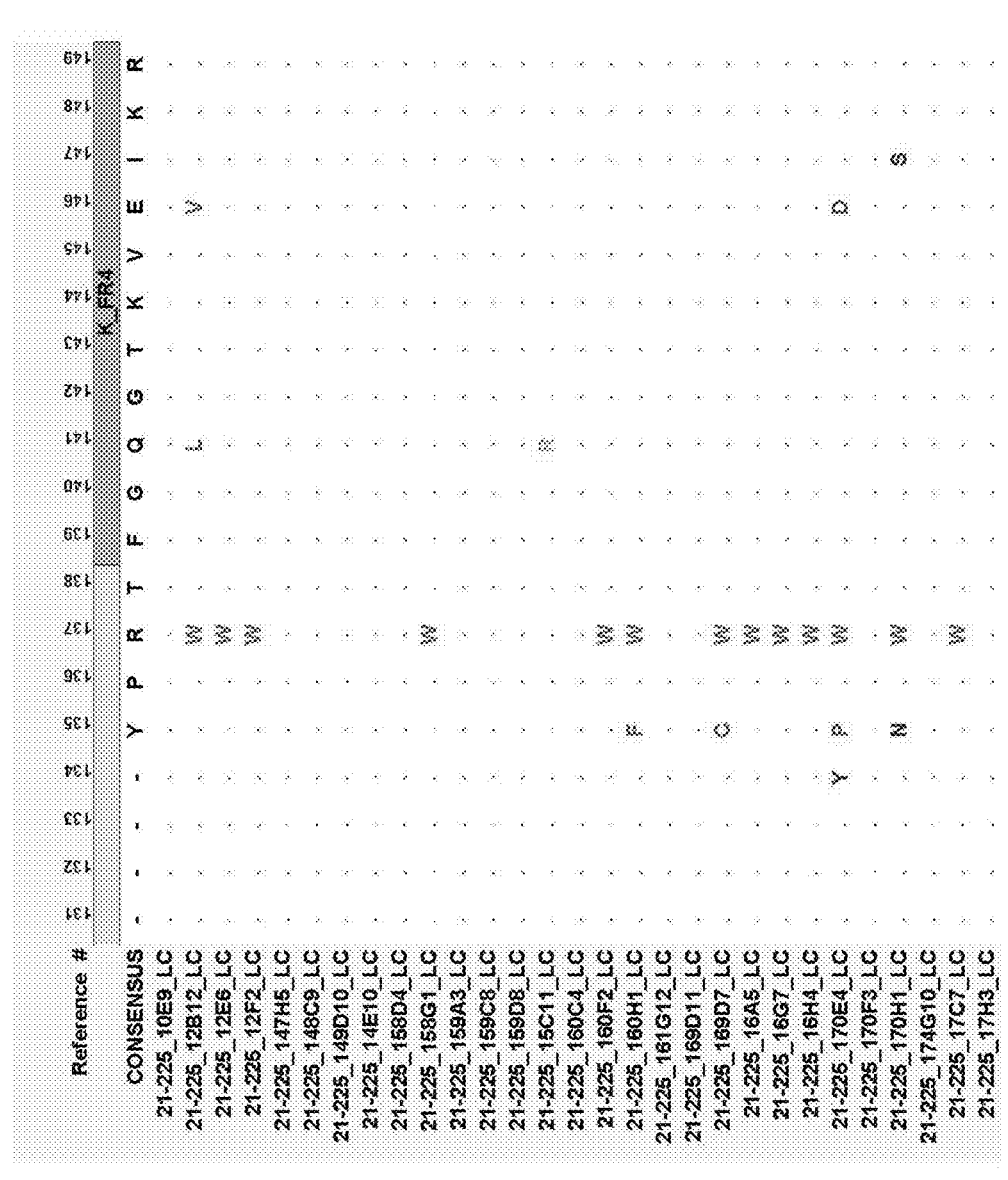
Figure 57:
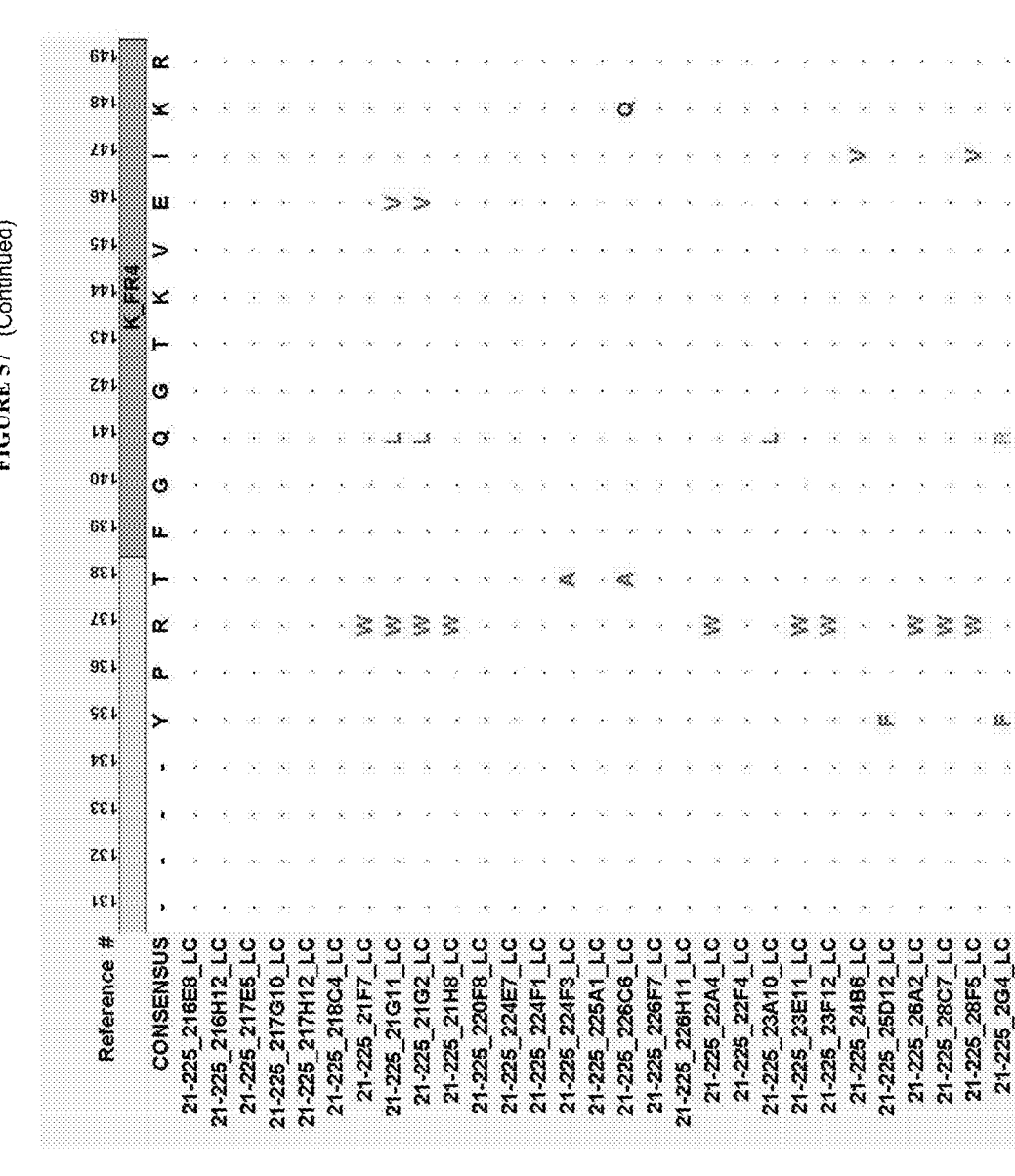
Figure 57:
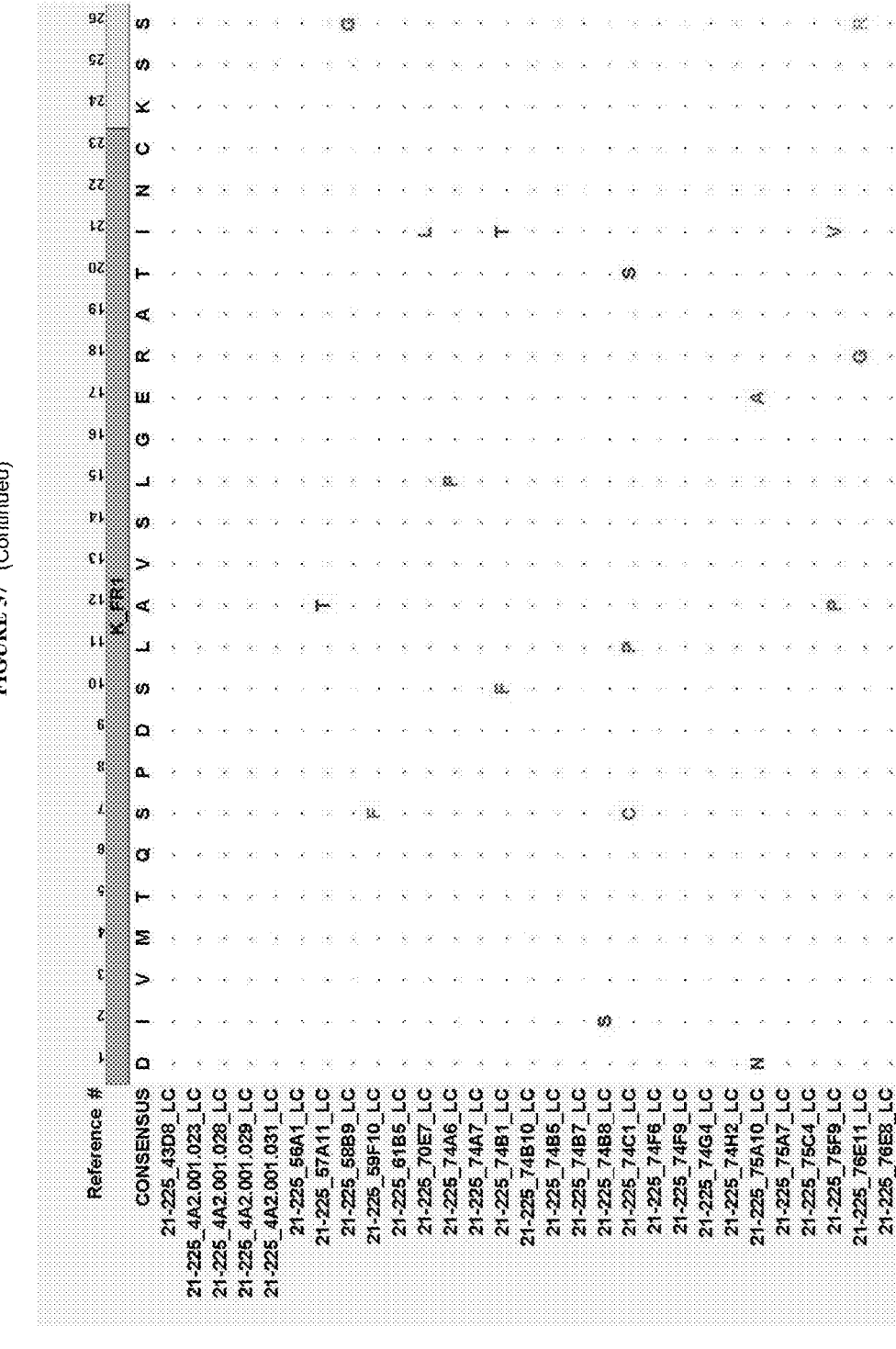
Figure 57:
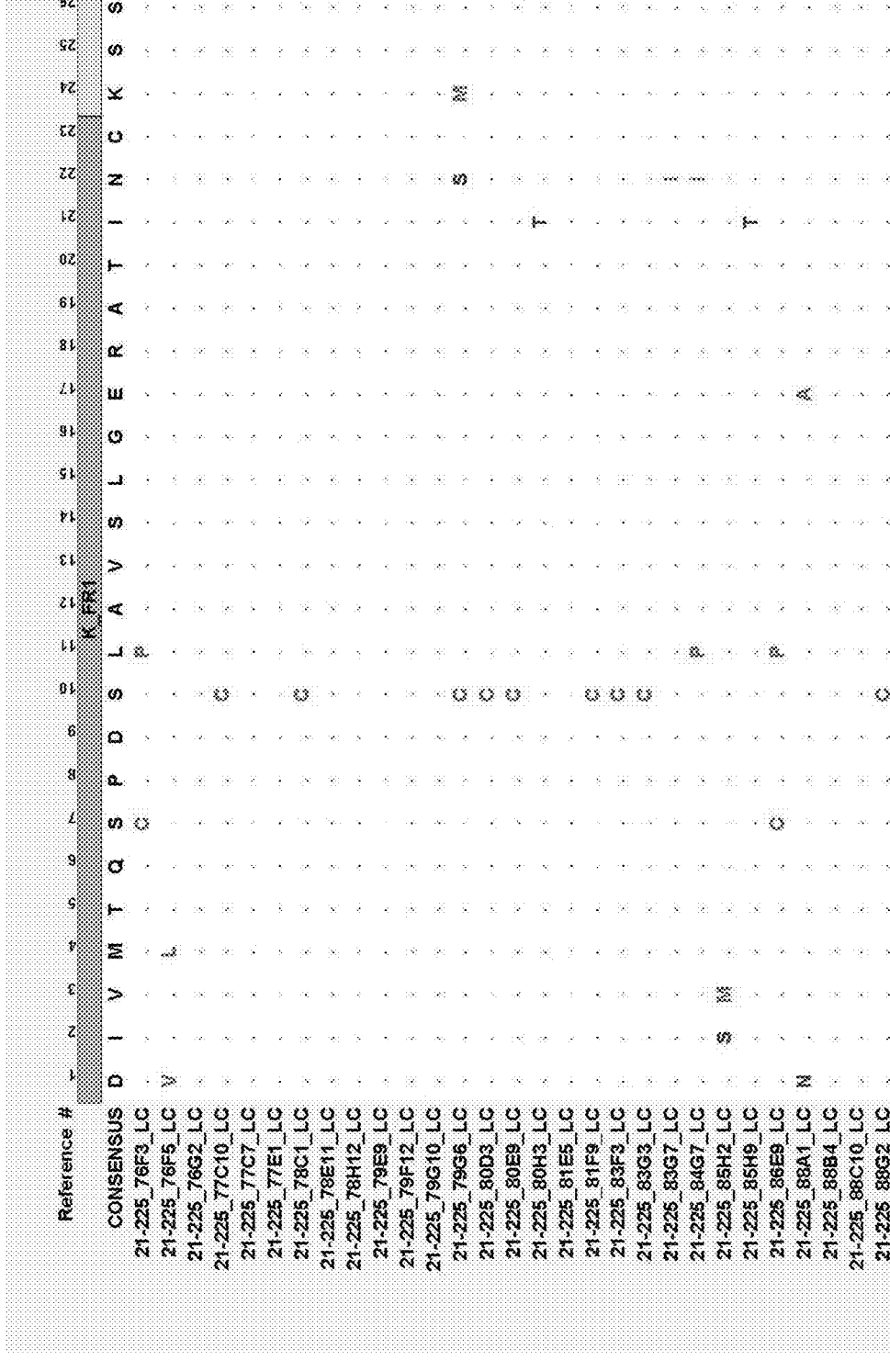
Figure 57:
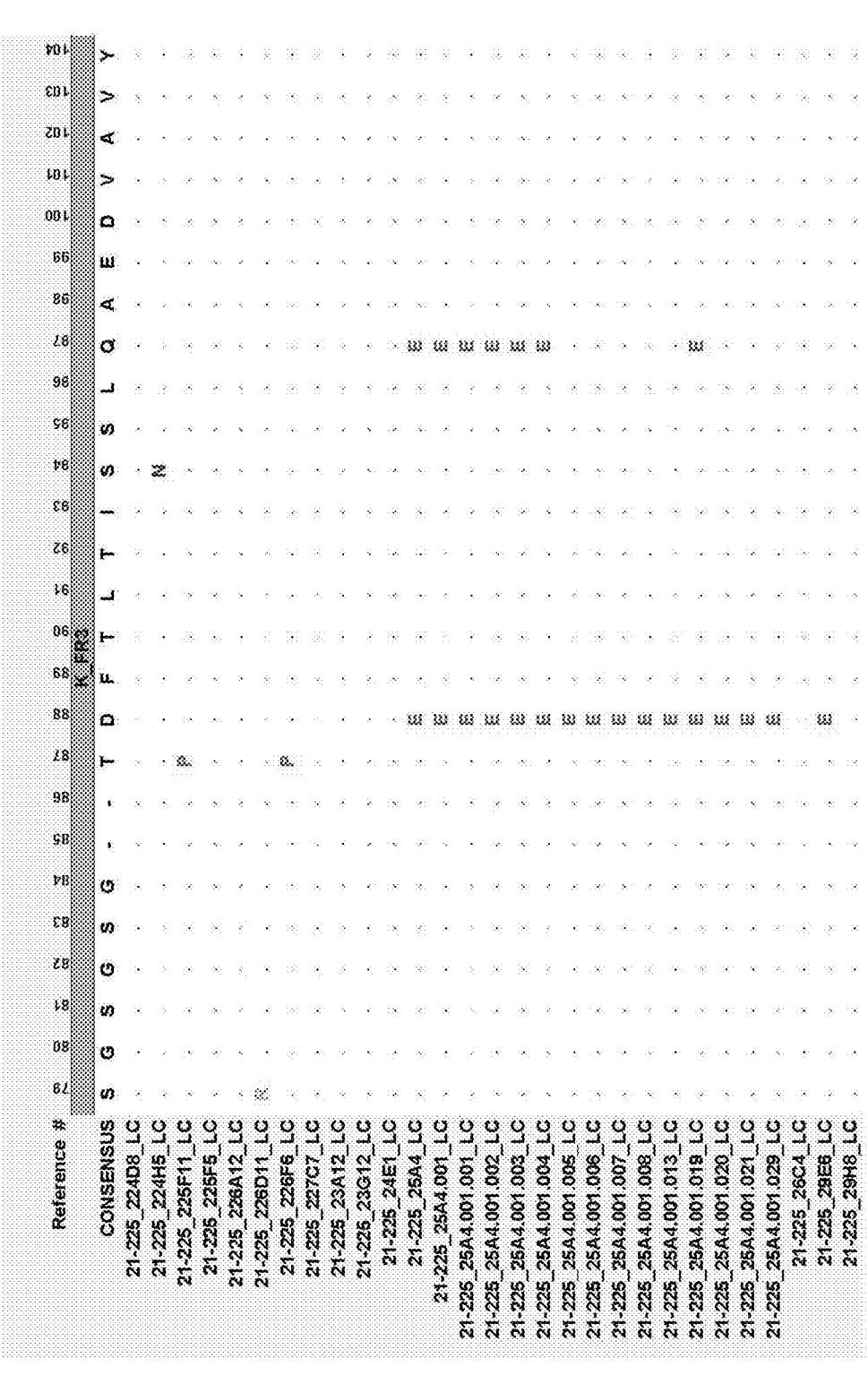
Figure 57:
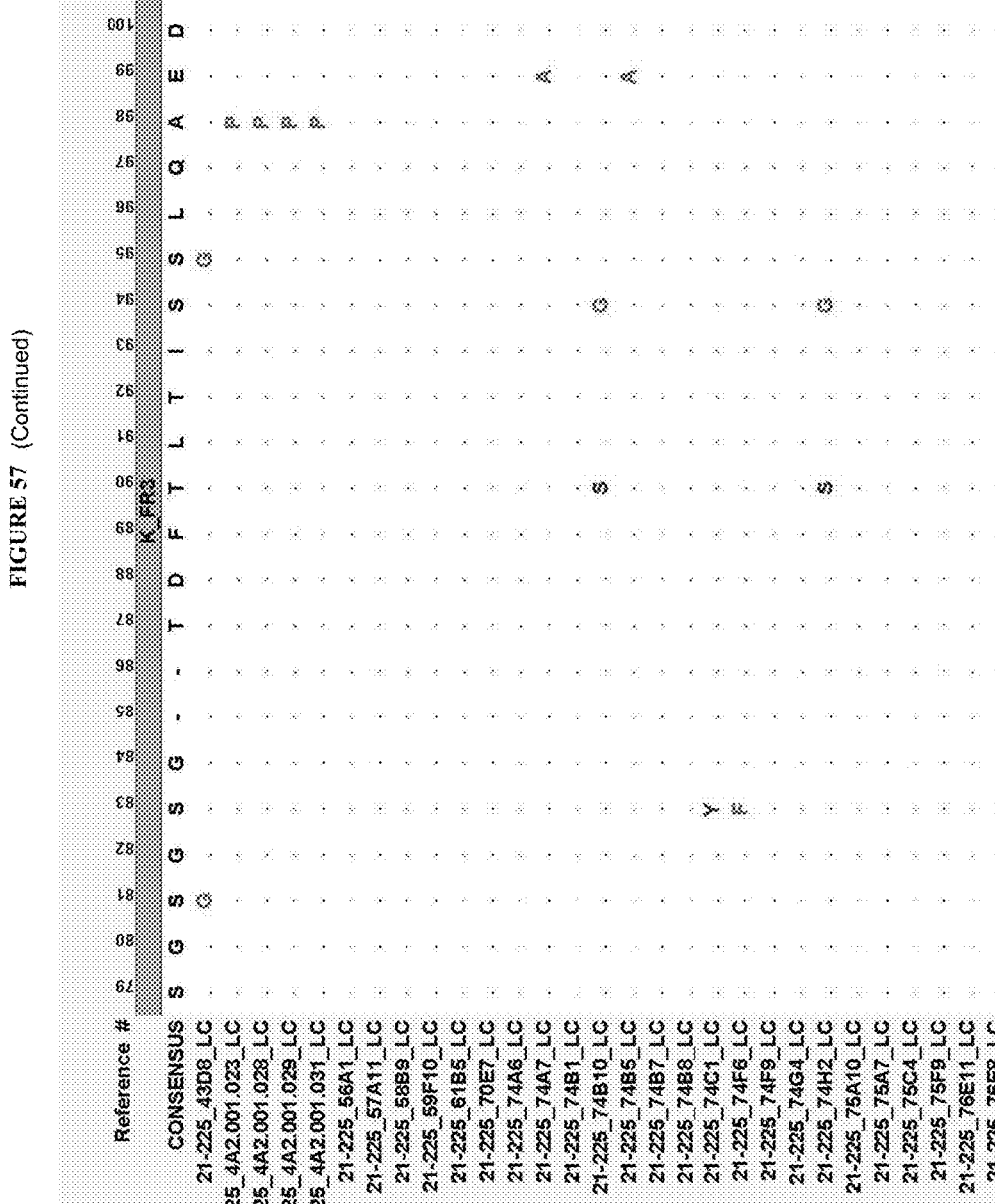
Figure 57:
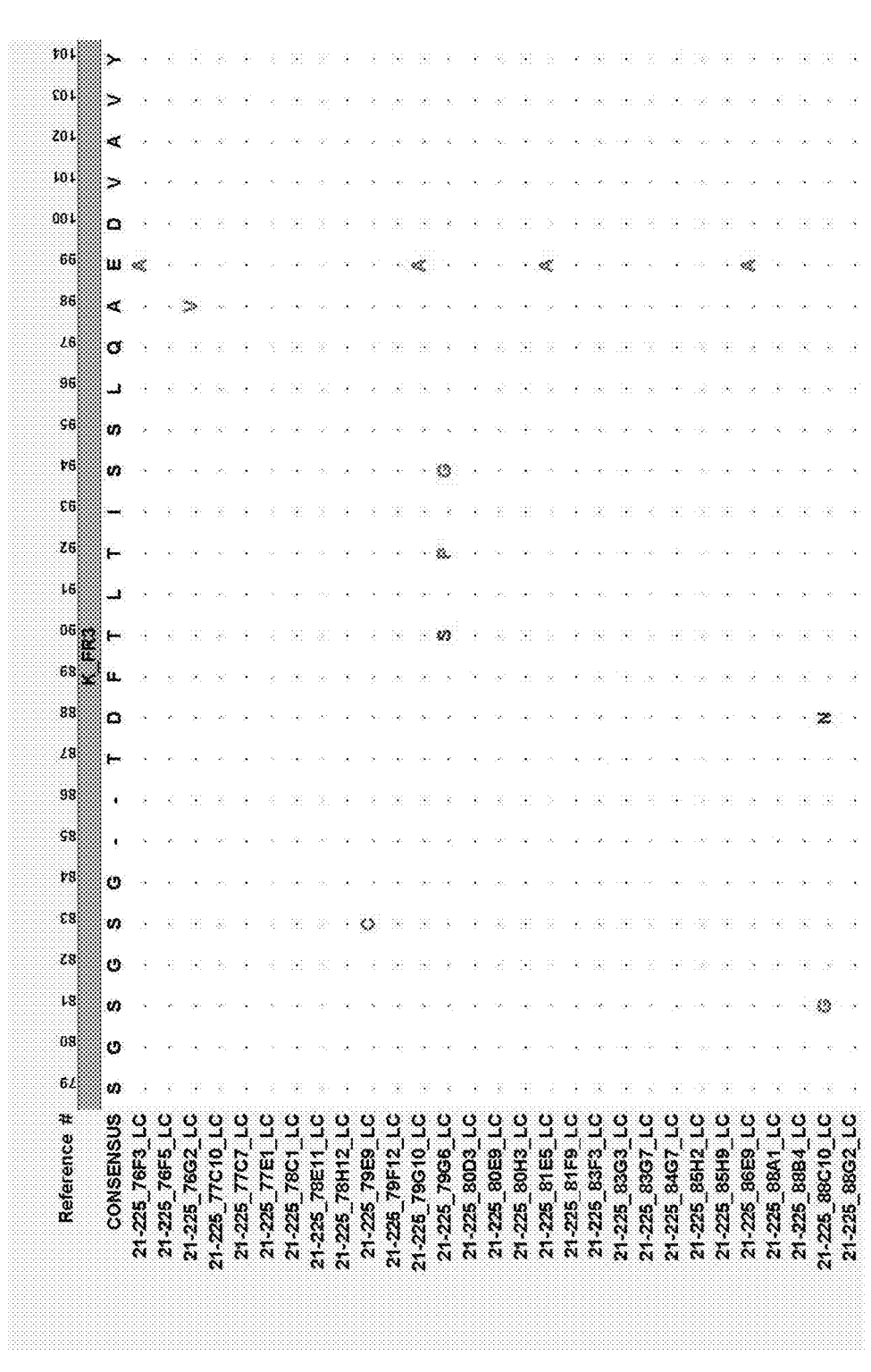
Figure 57:
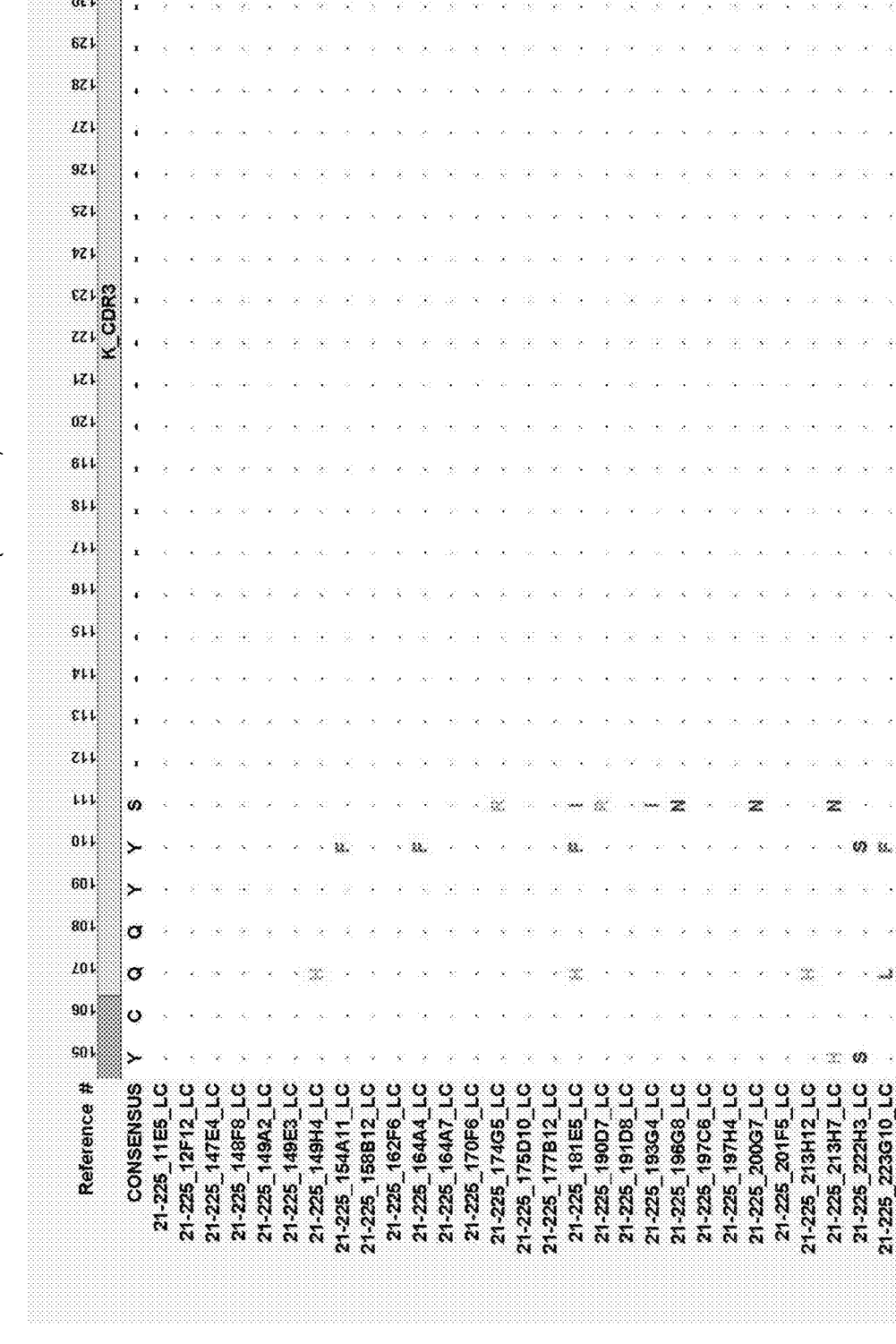
Figure 57:
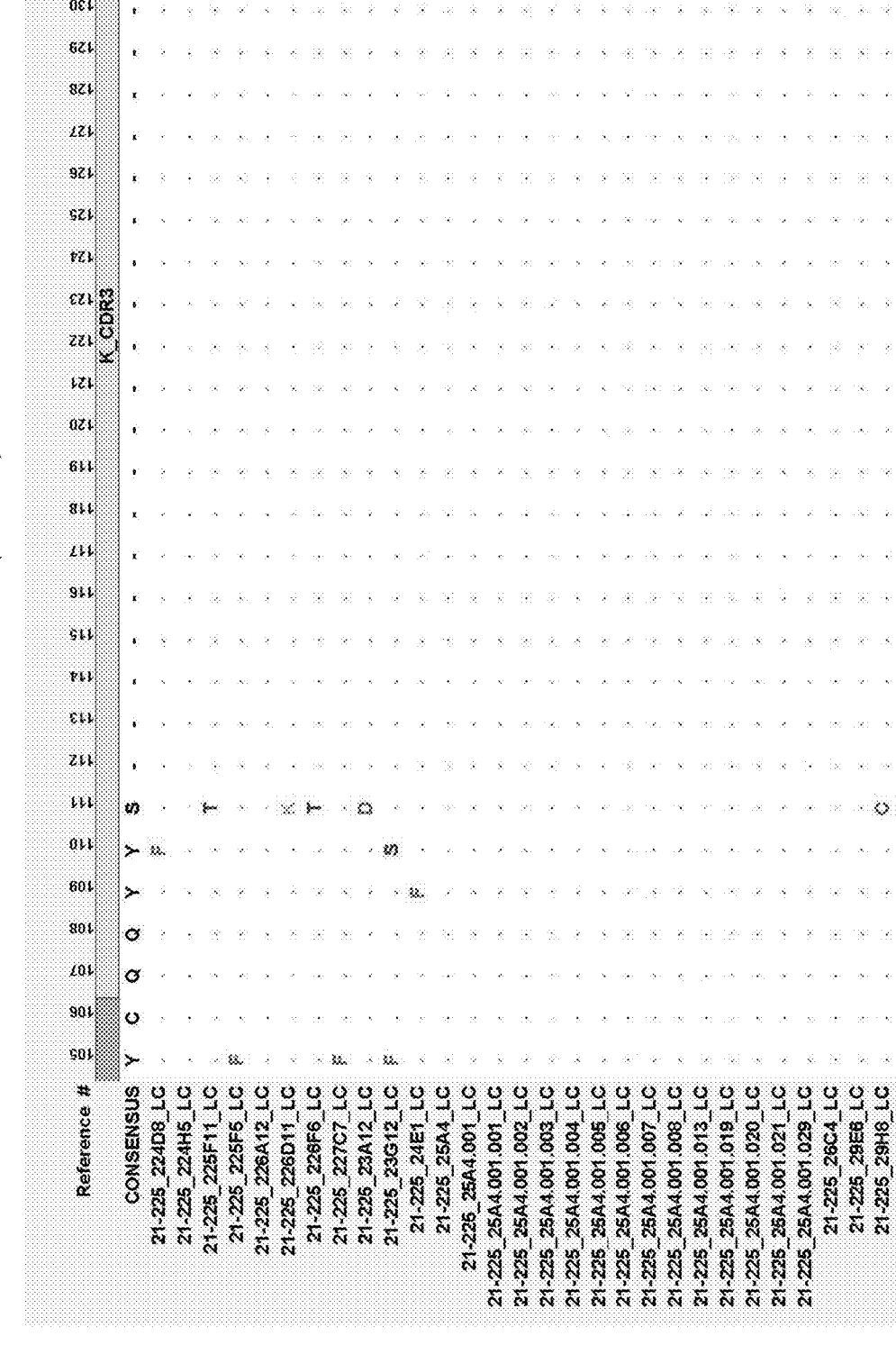
Figure 57:
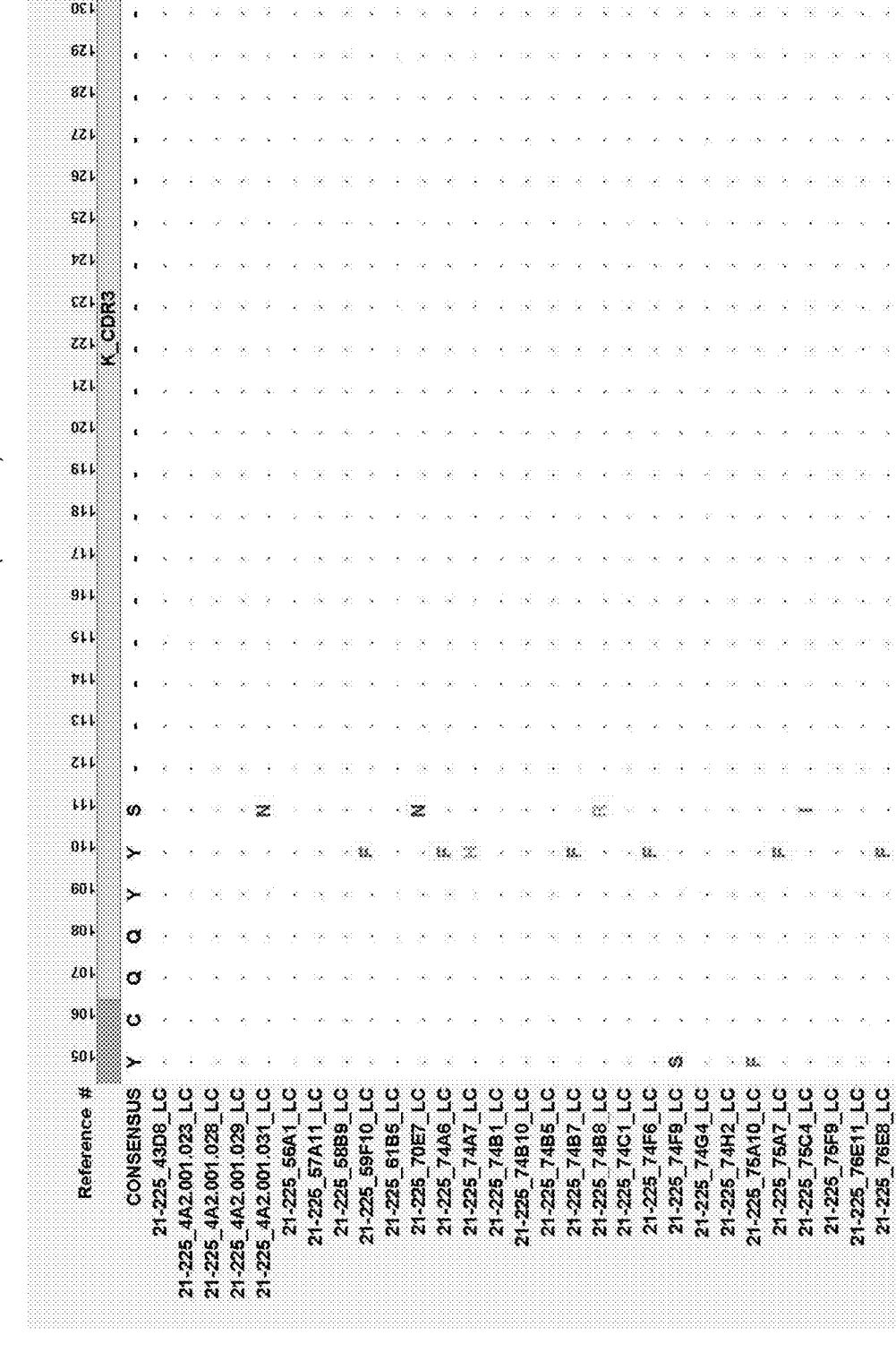
Figure 57:
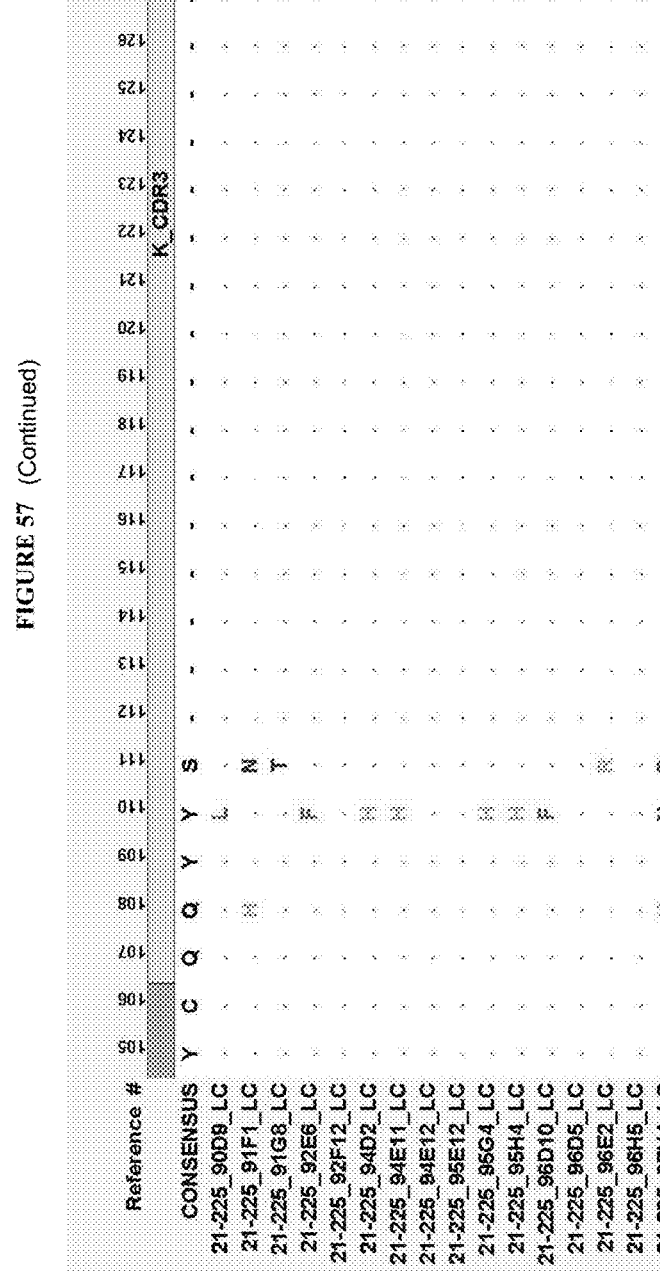
Figure 57:
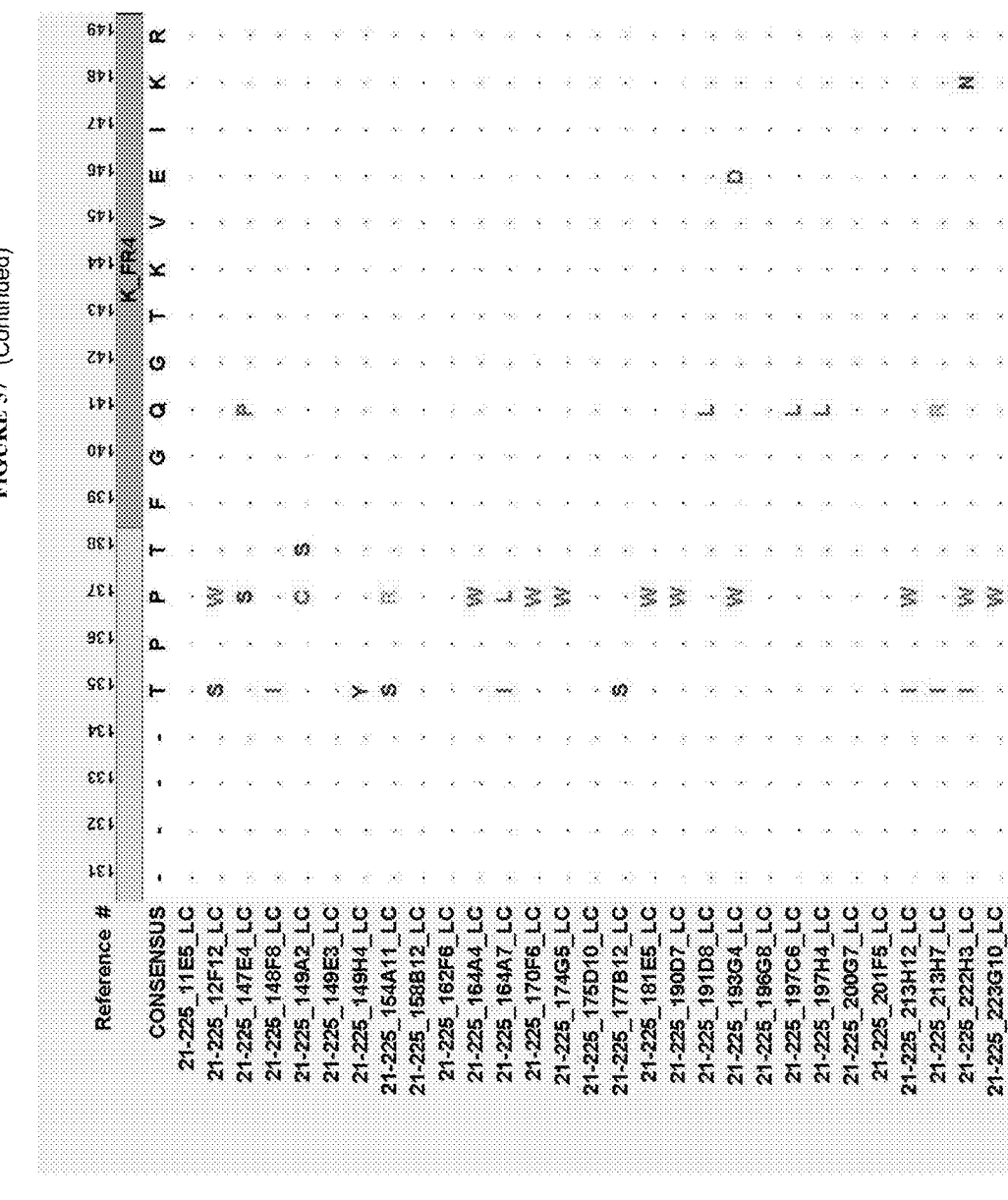
Figure 57:
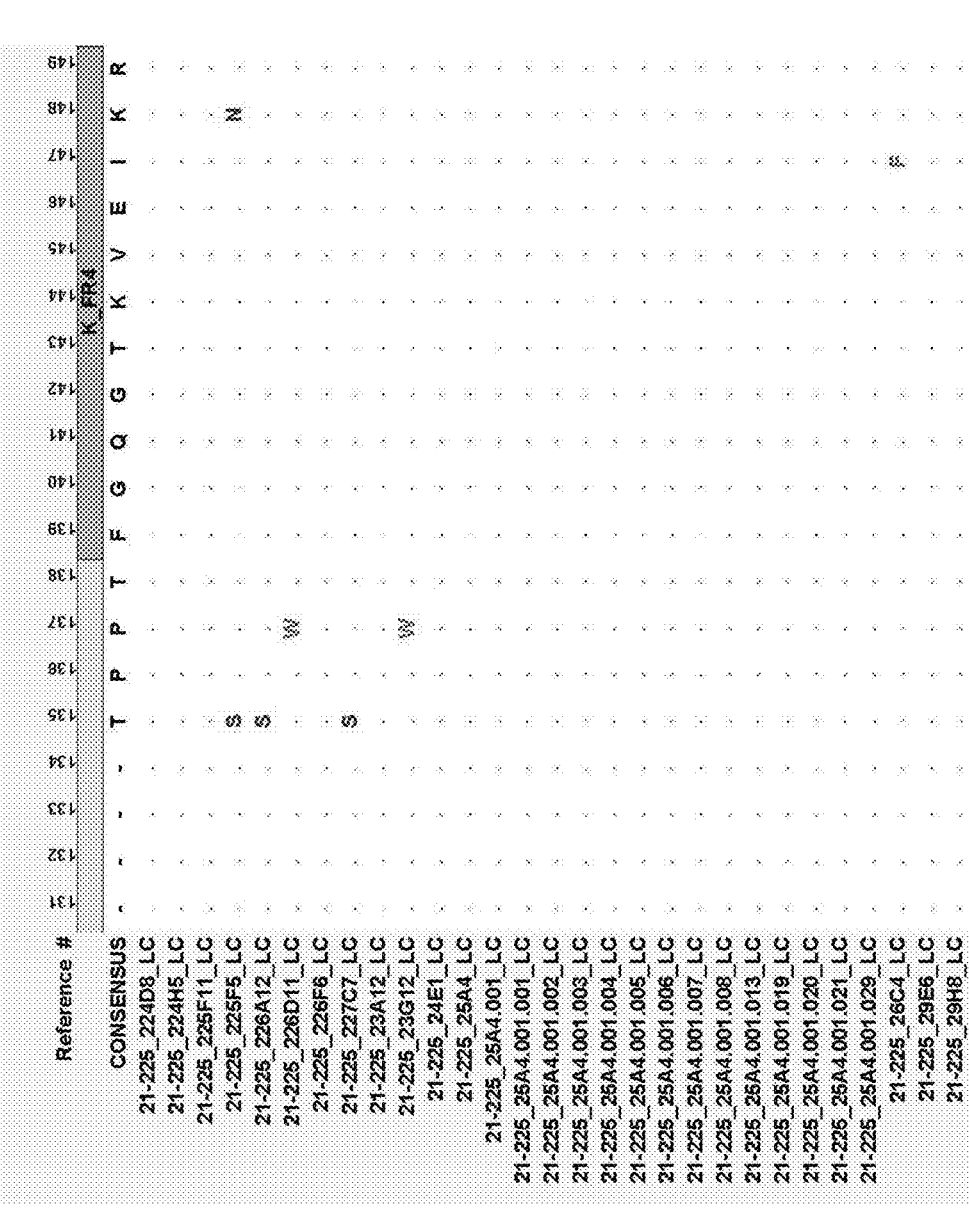
Figure 57:
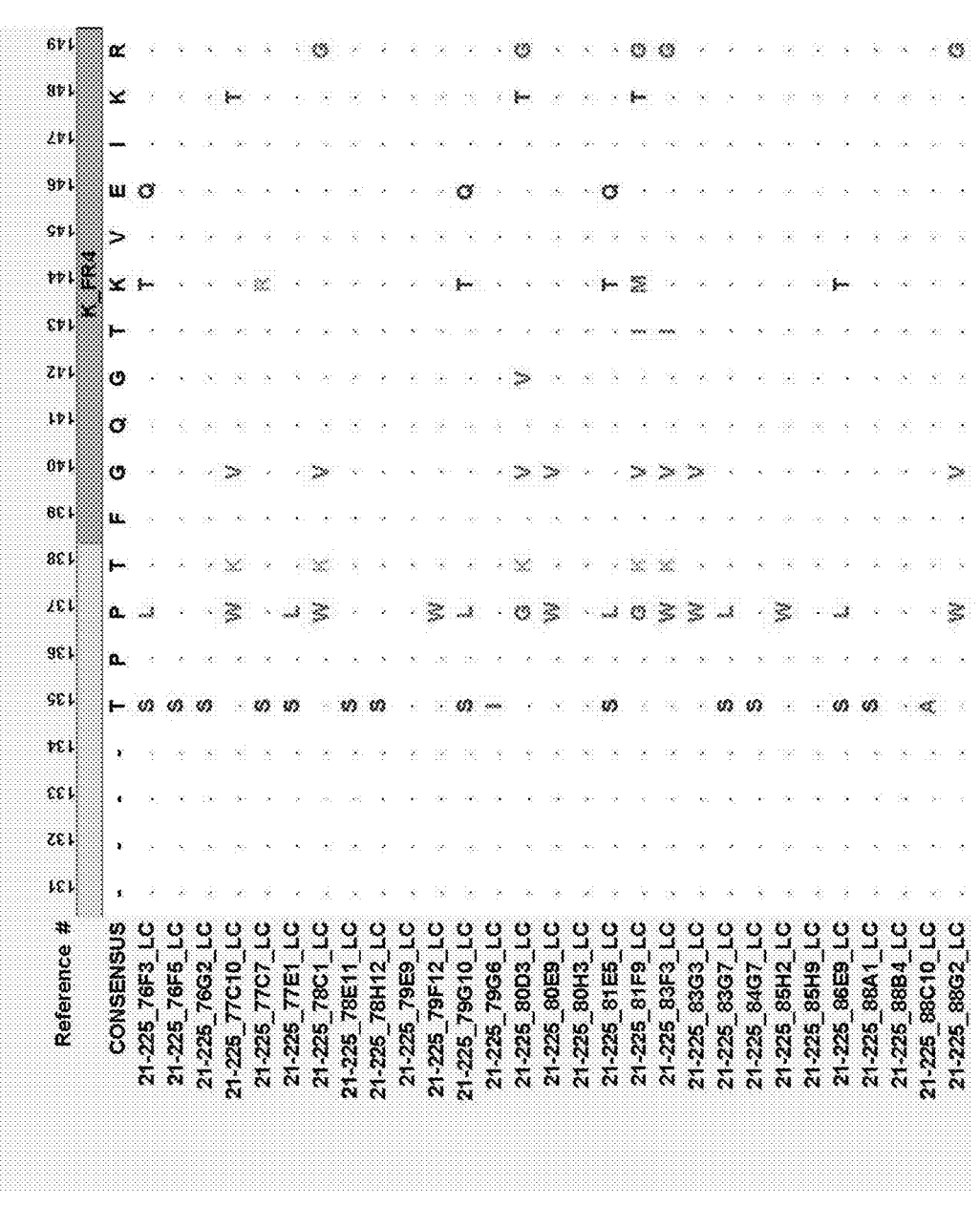
Figure 57:
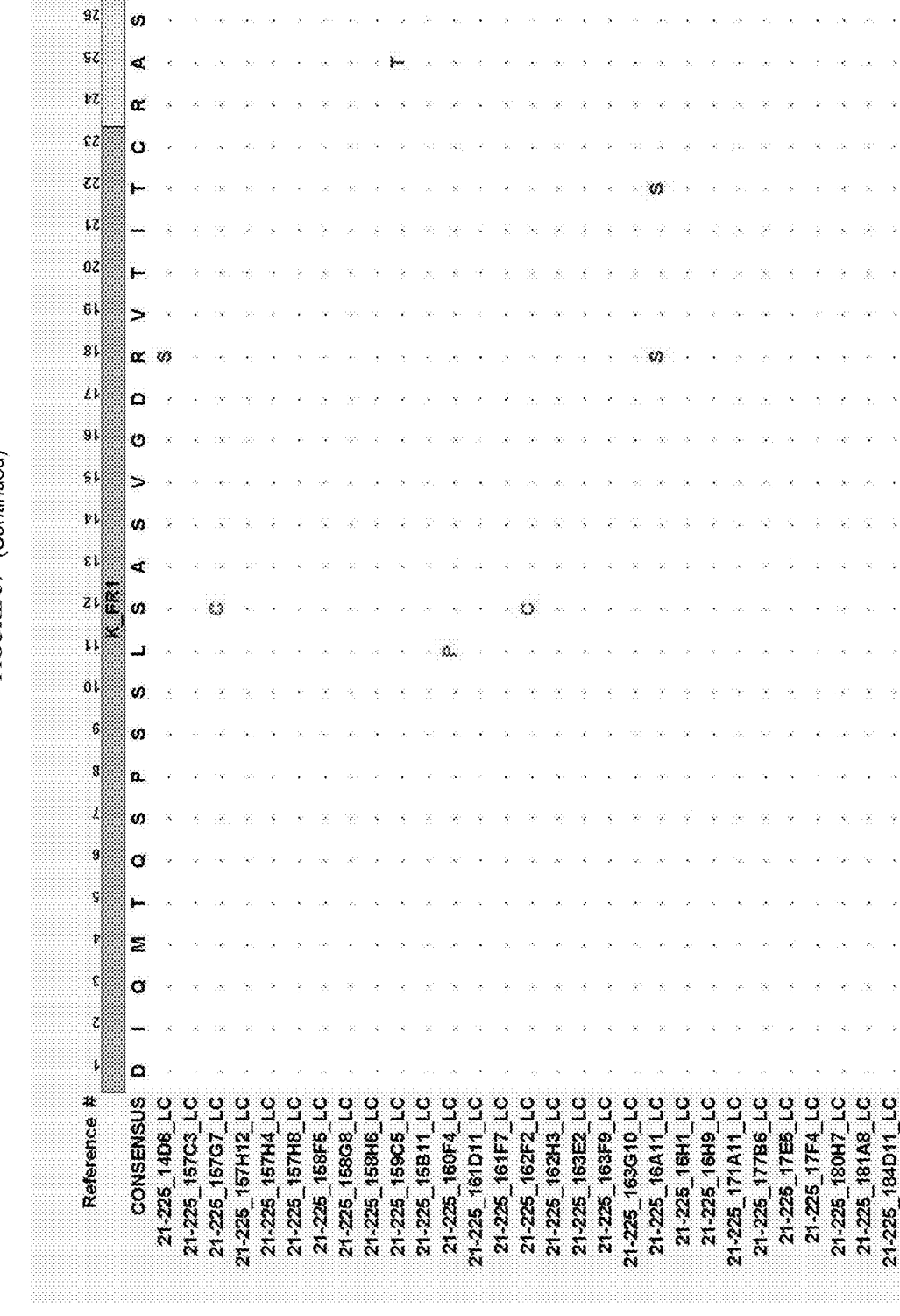
Figure 57:
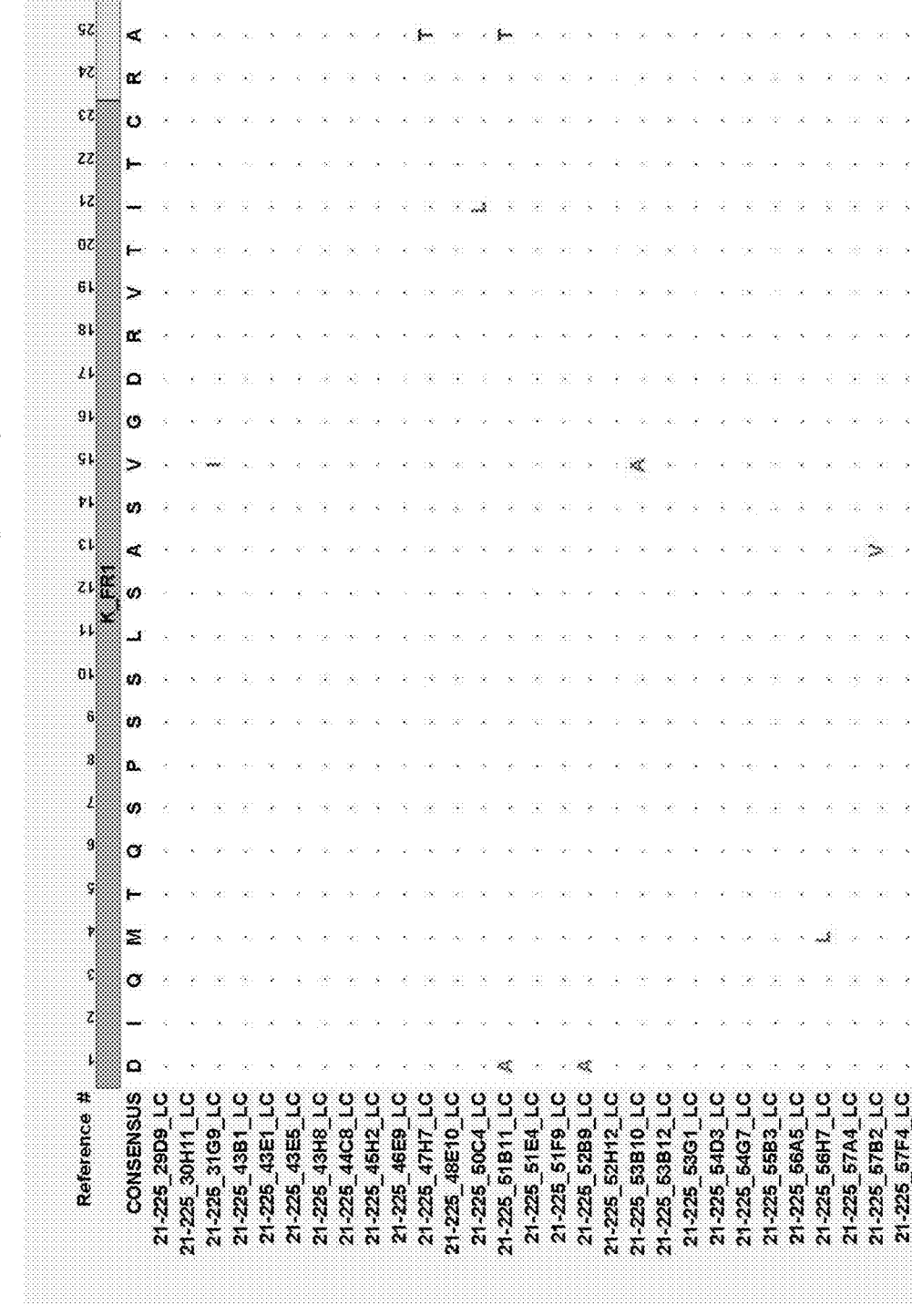
Figure 57:
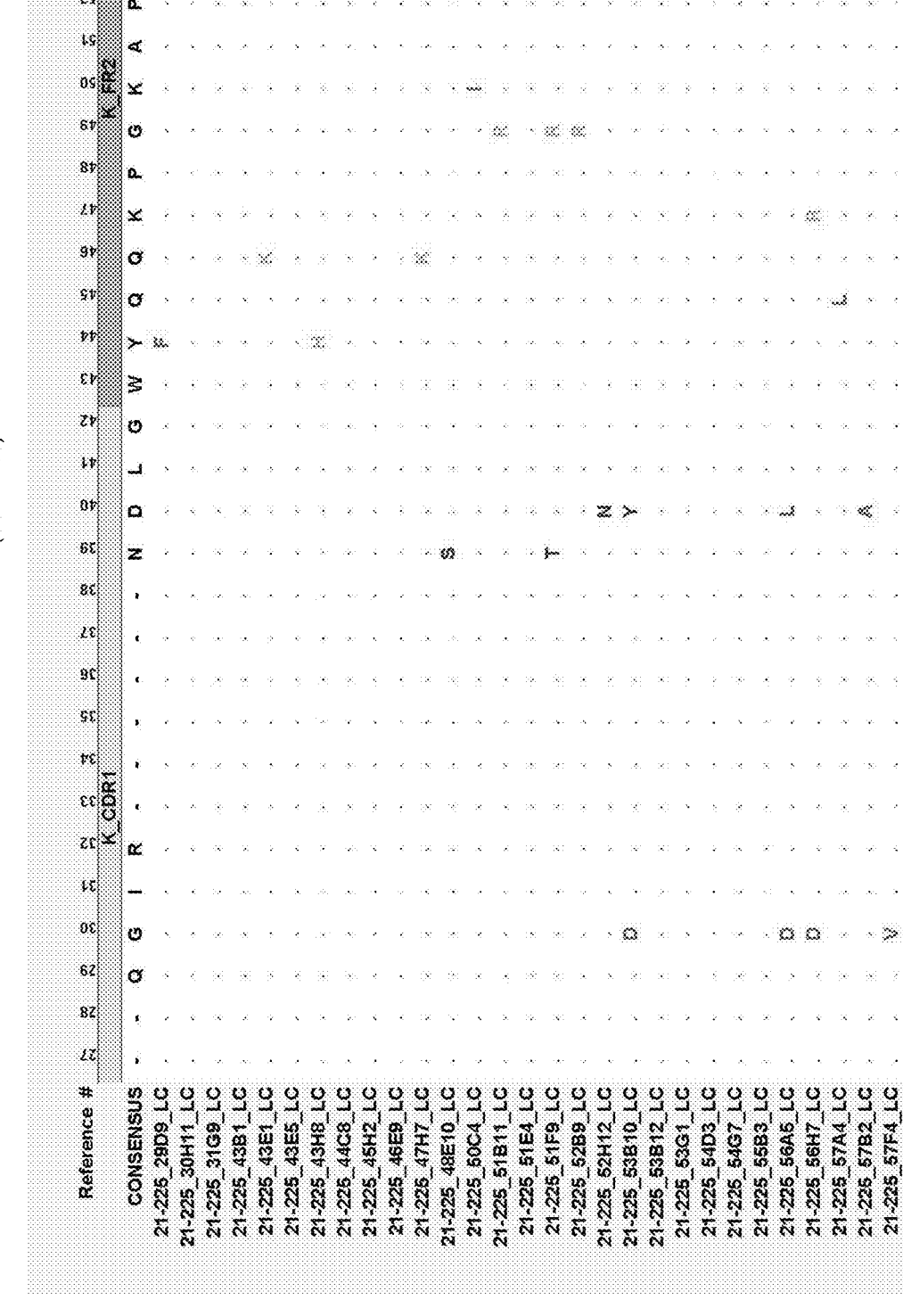
Figure 57:
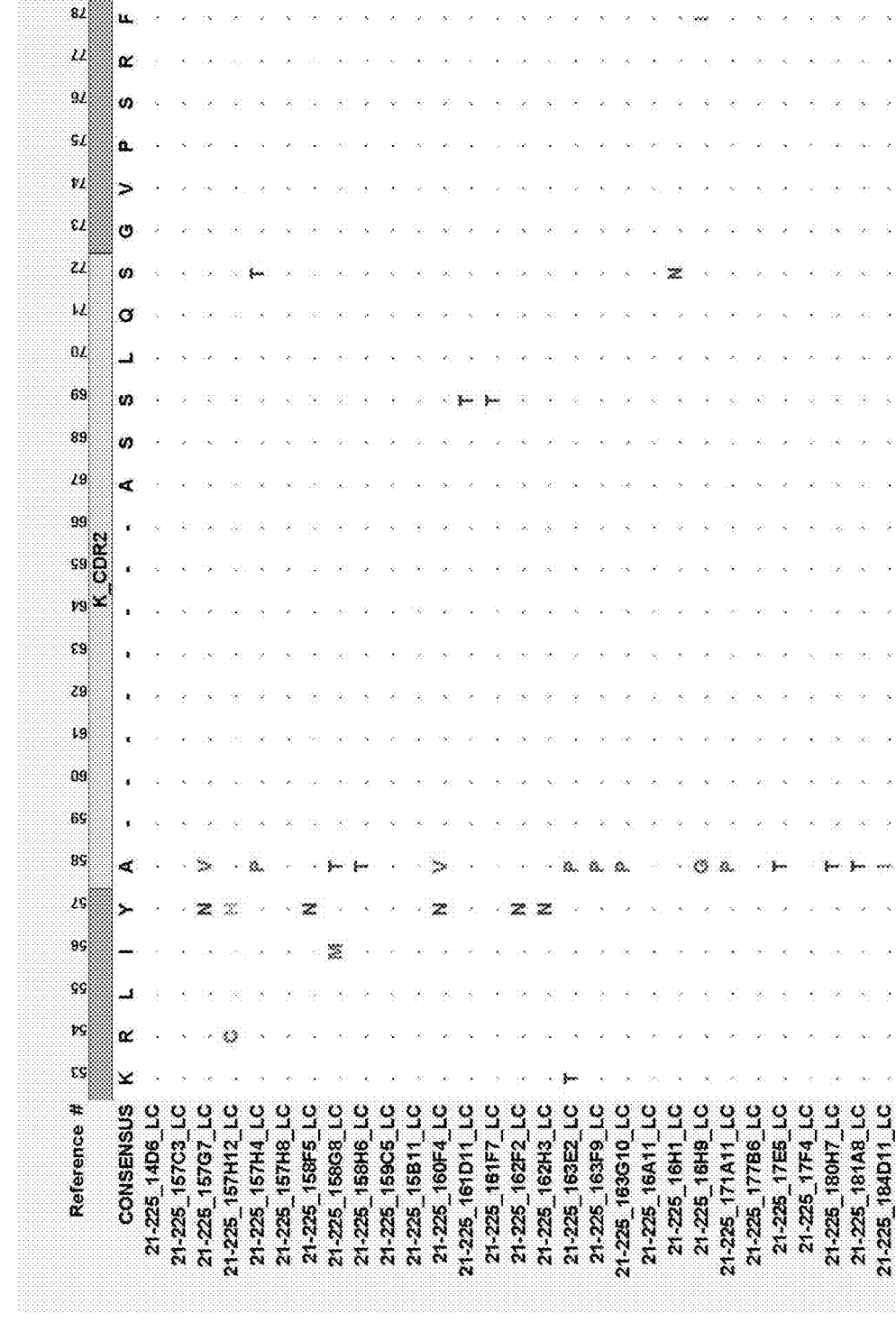
Figure 57:
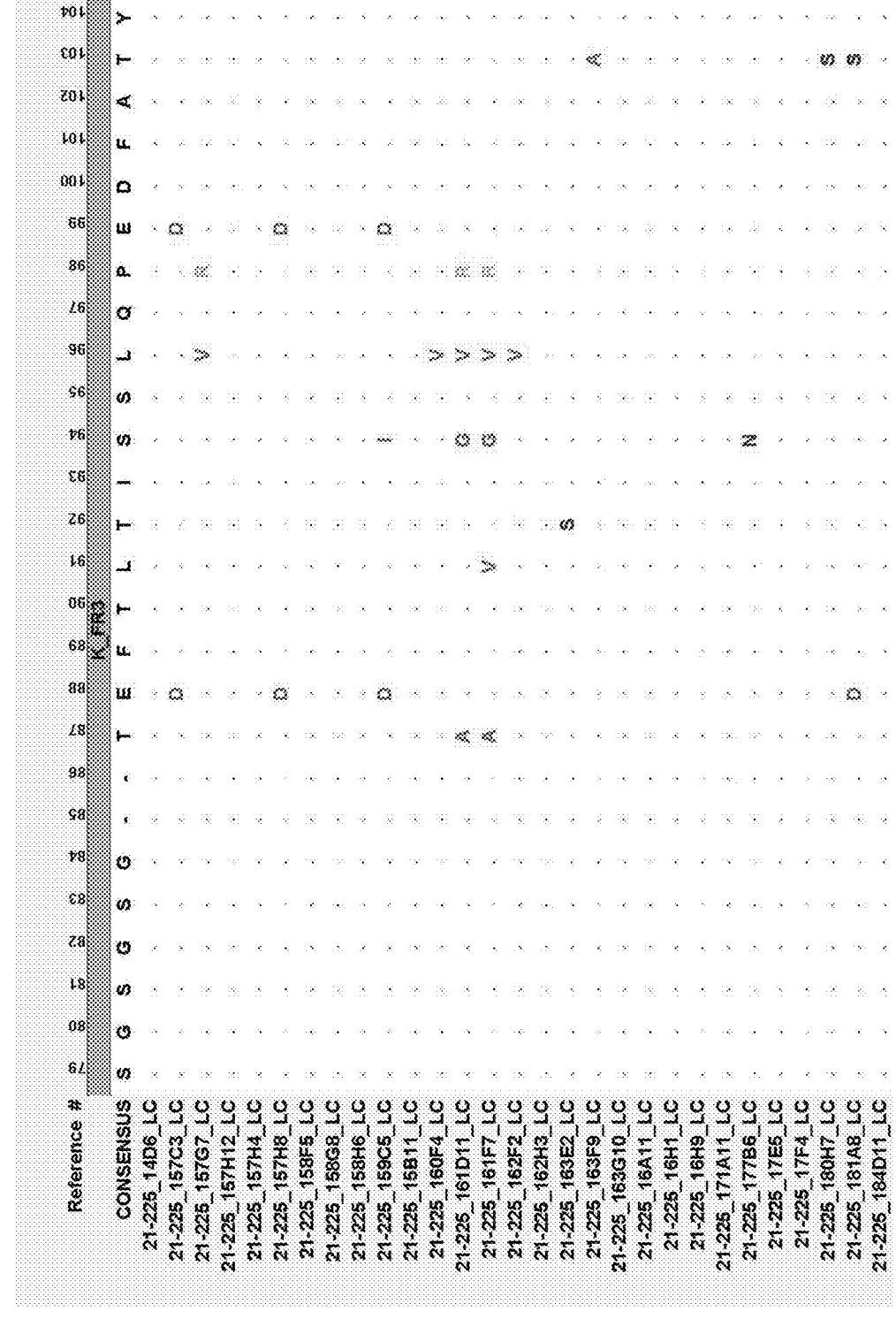
Figure 57:
Figure 57:
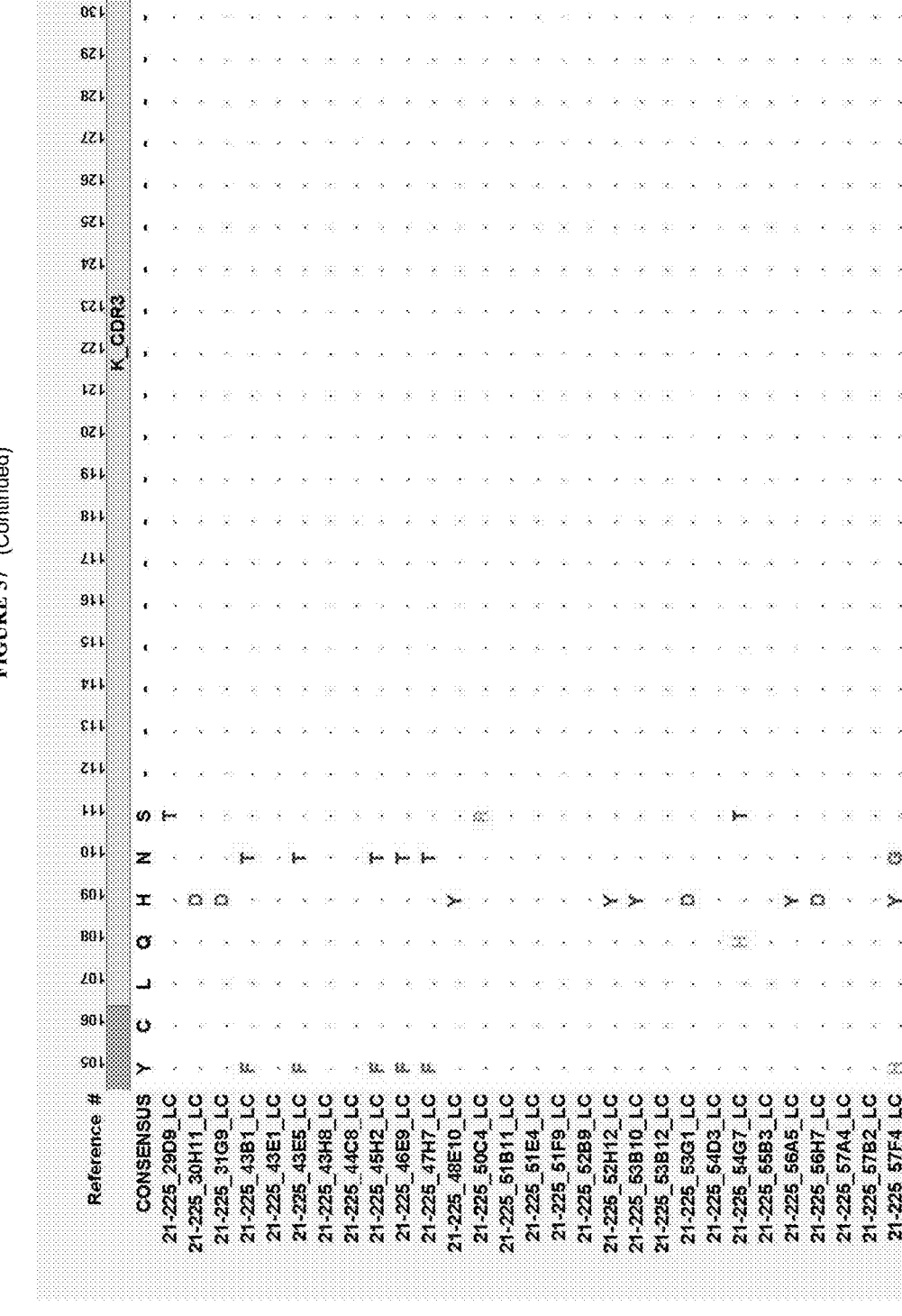
Figure 57:
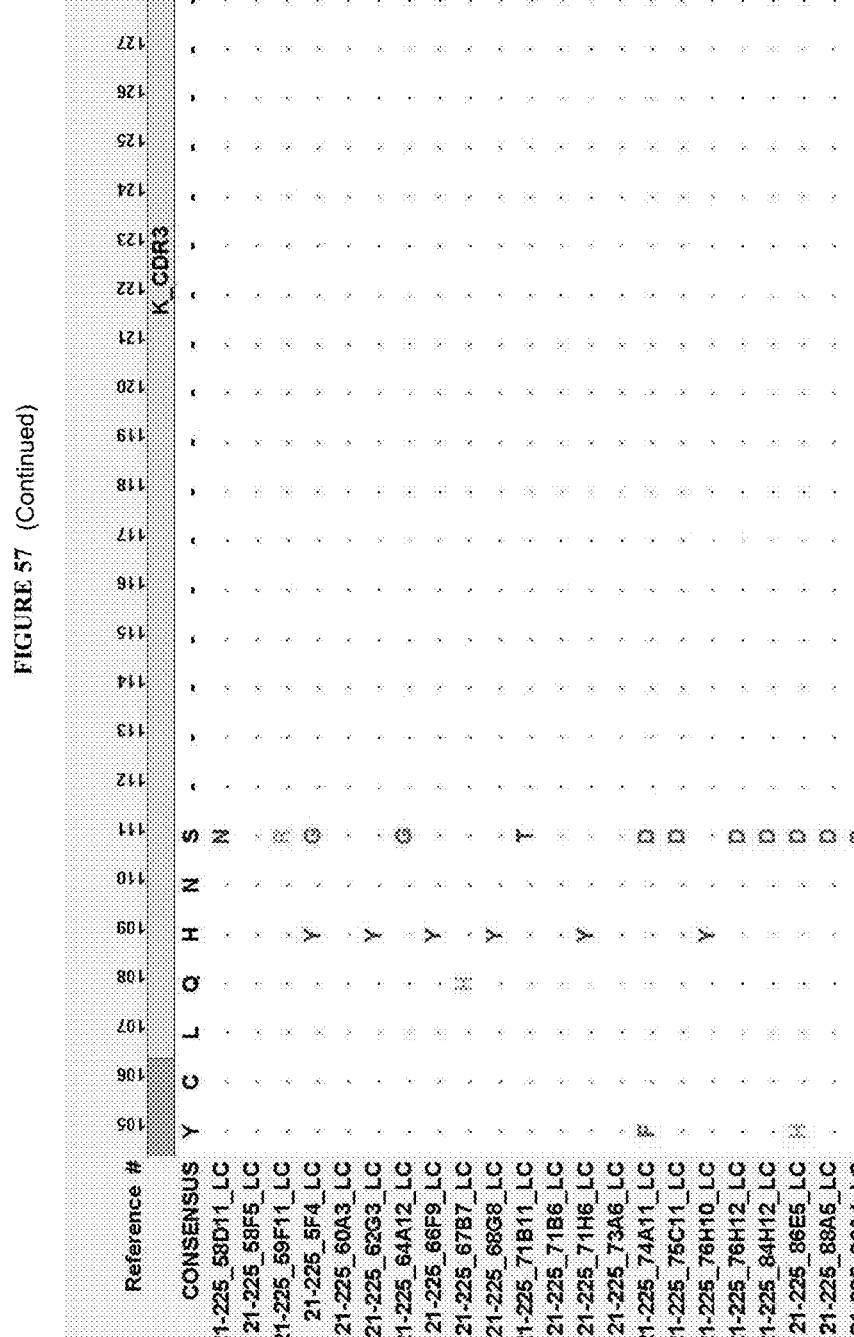
Figure 57:
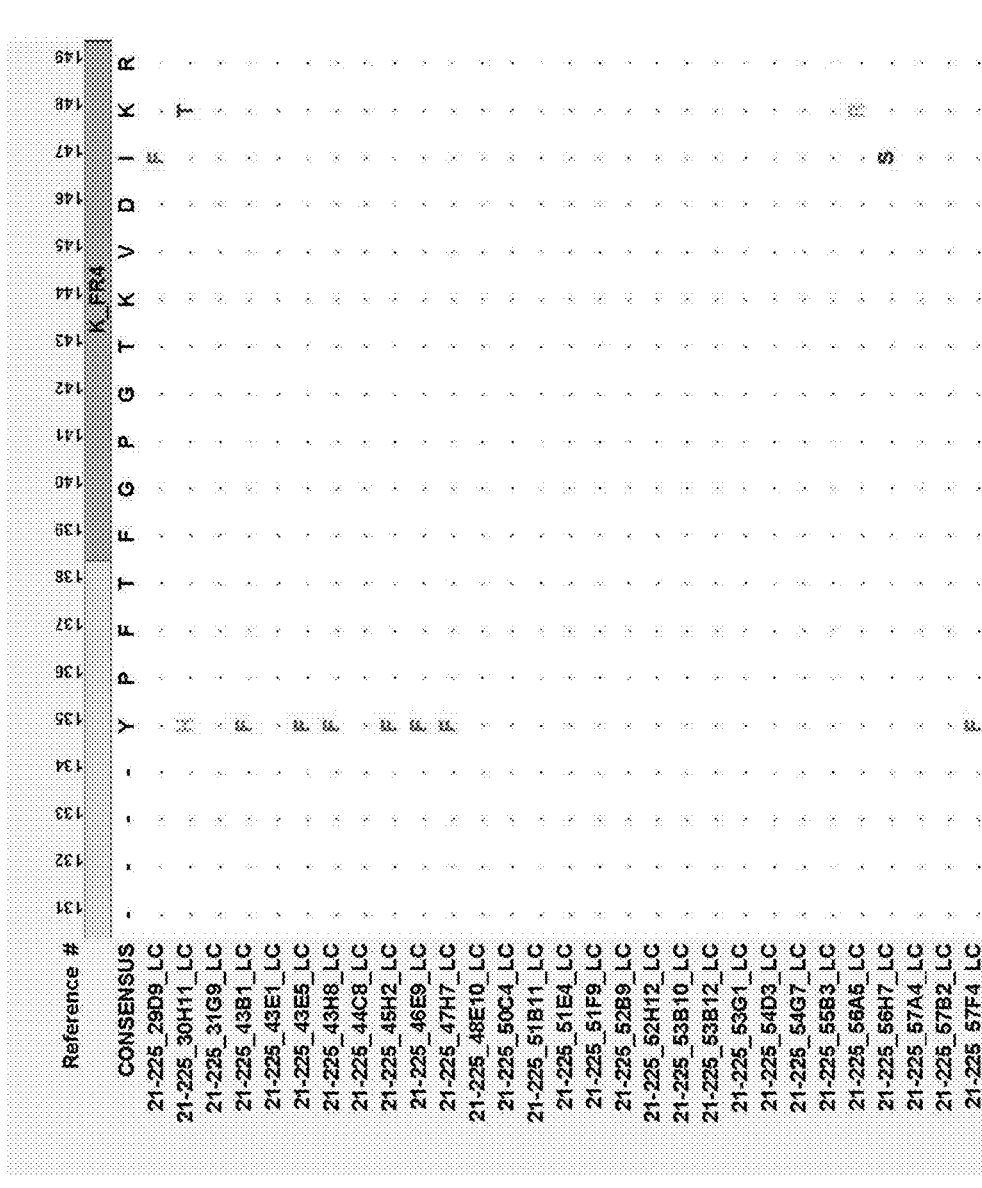
Figure 57:
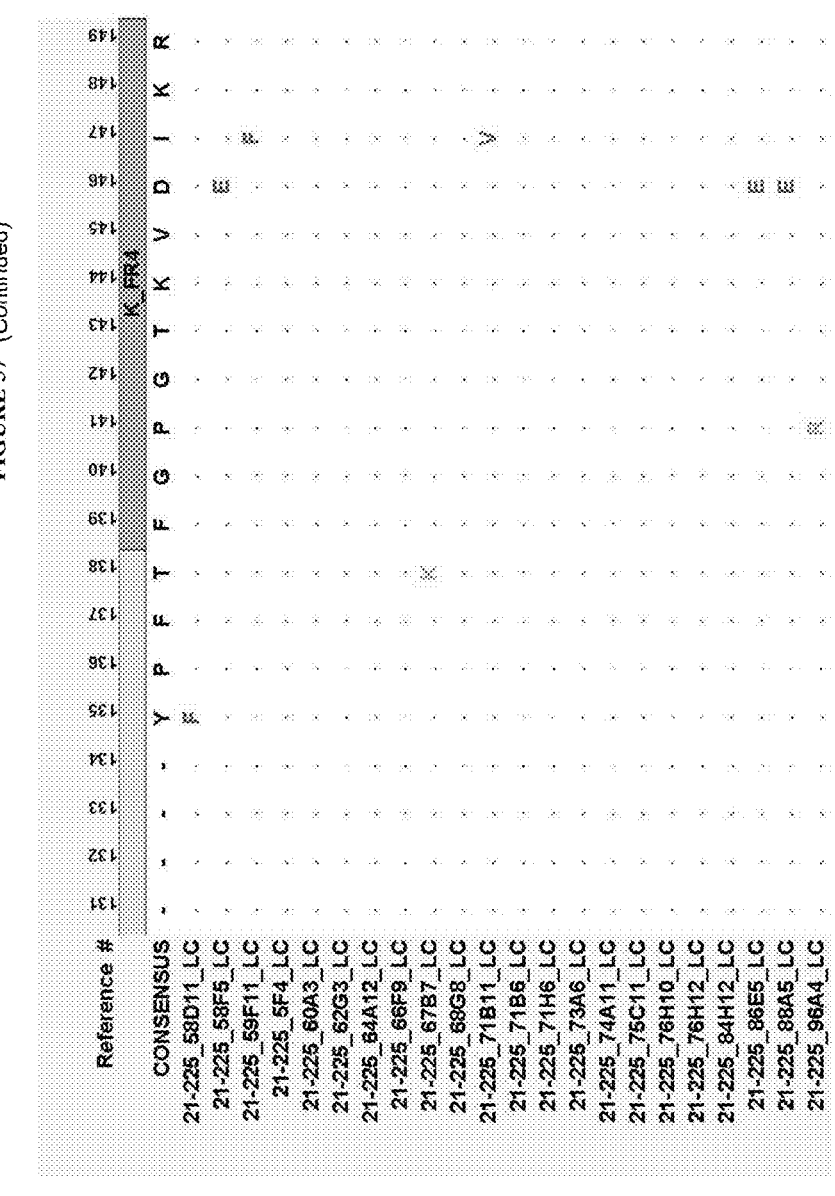
Figure 57:
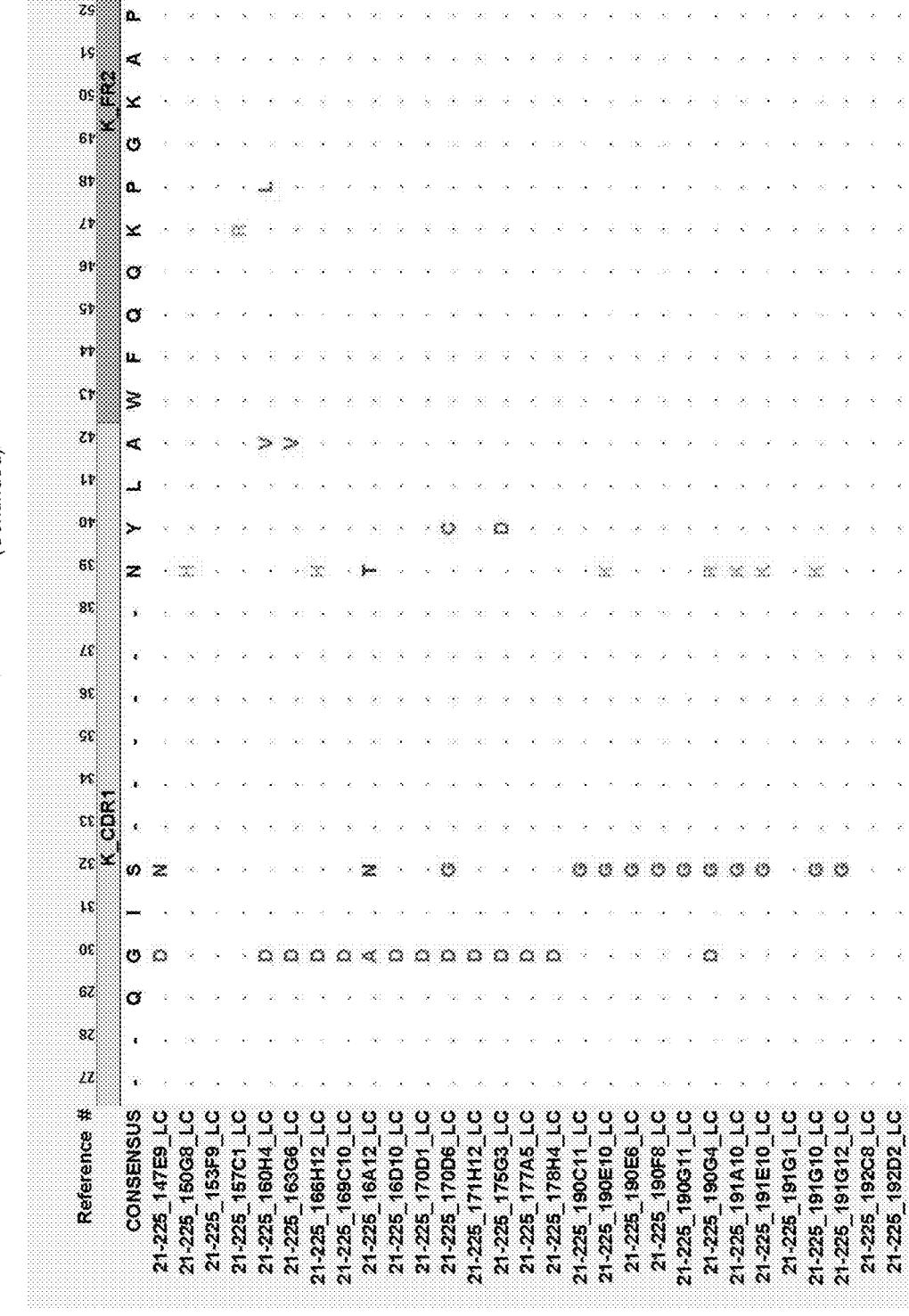
Figure 57:
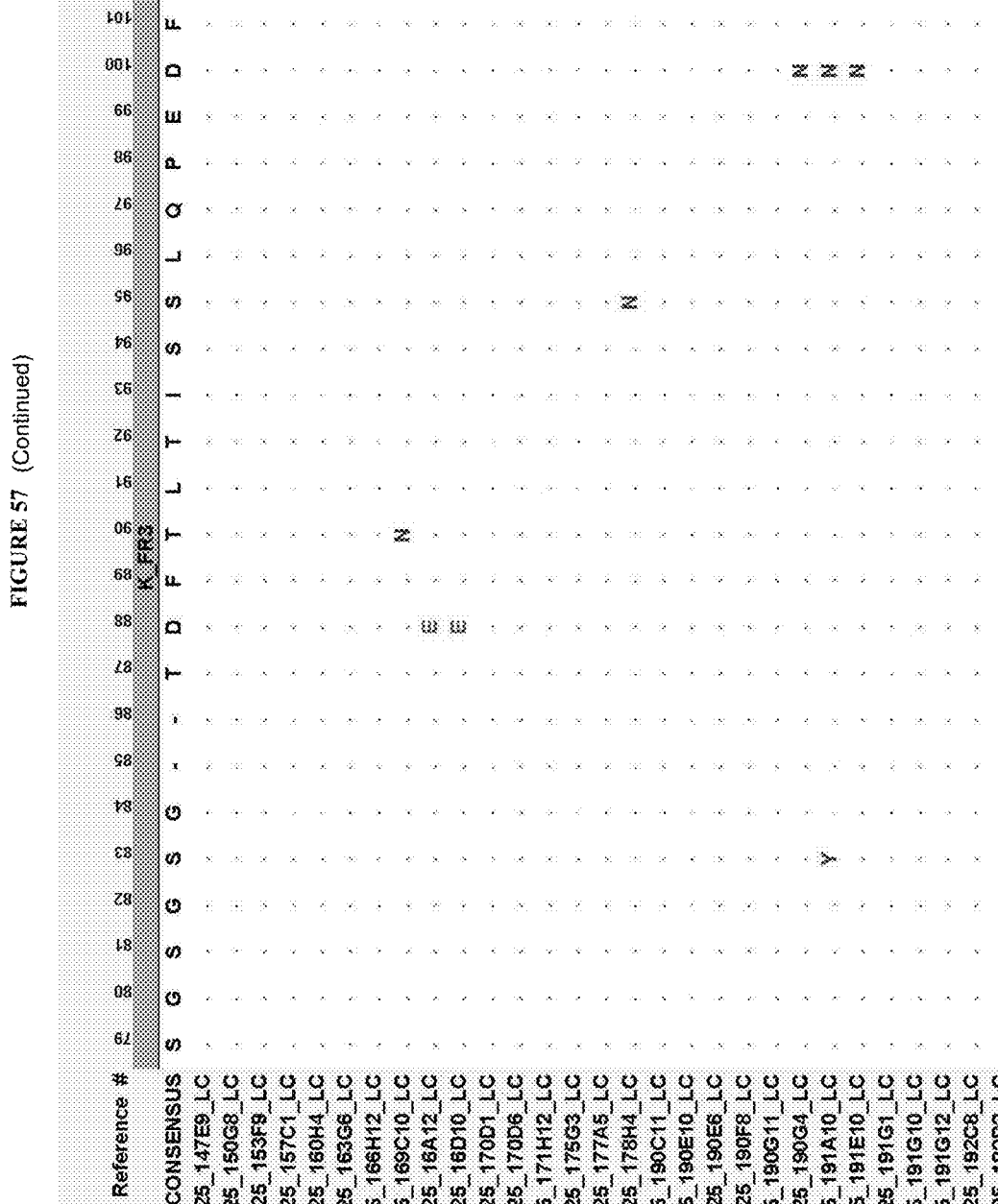
Figure 57:
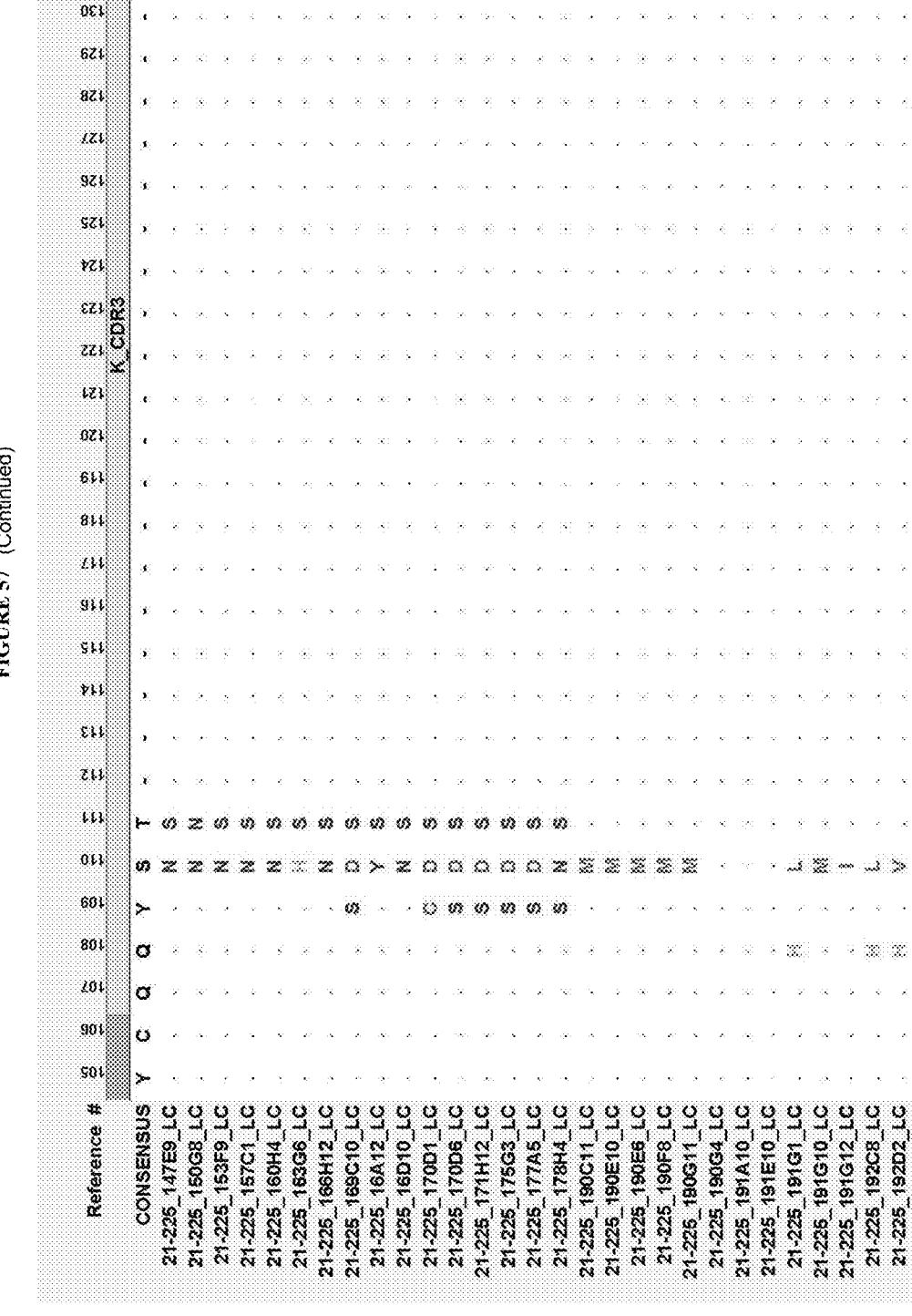
Figure 57:
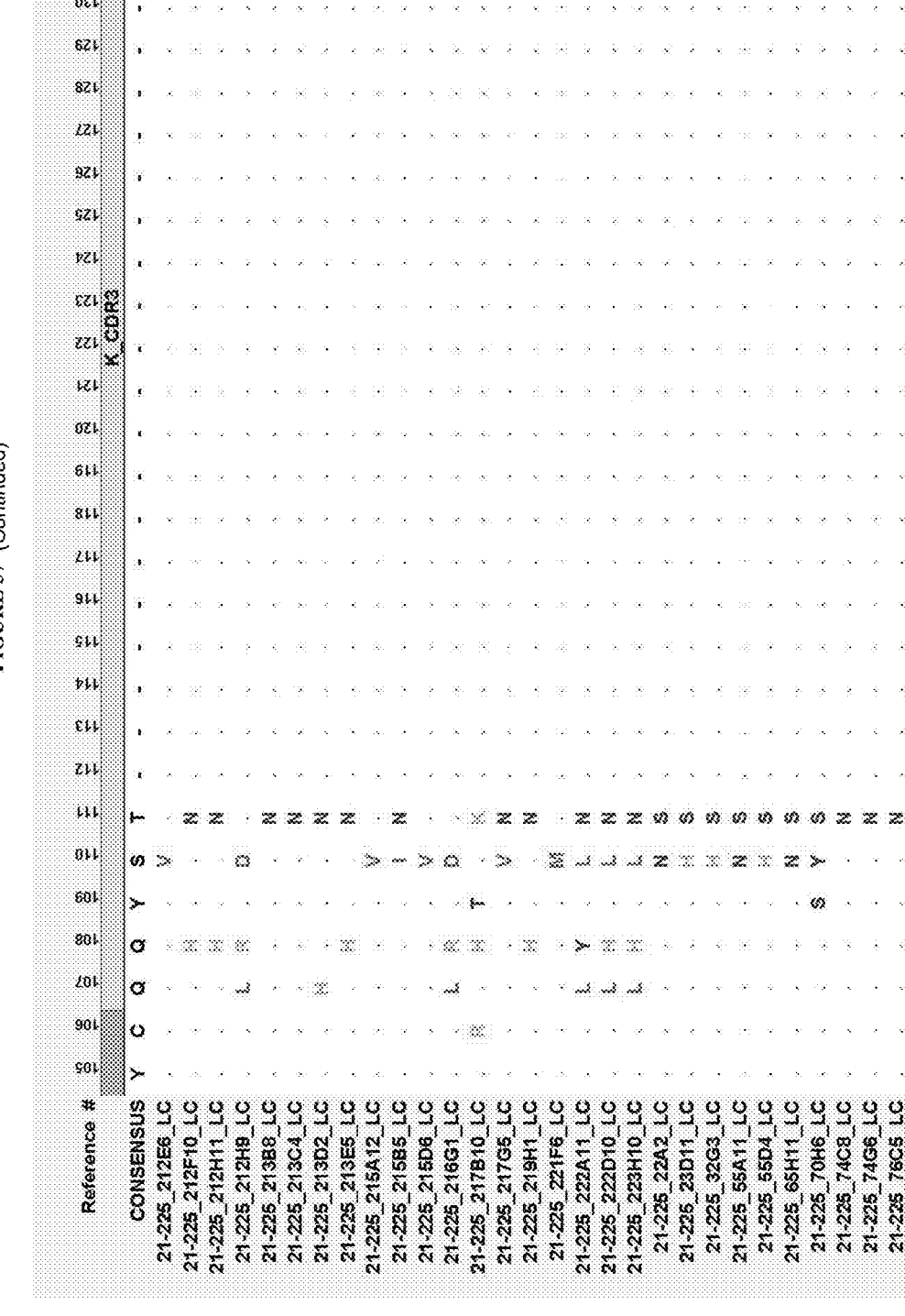
Figure 57:
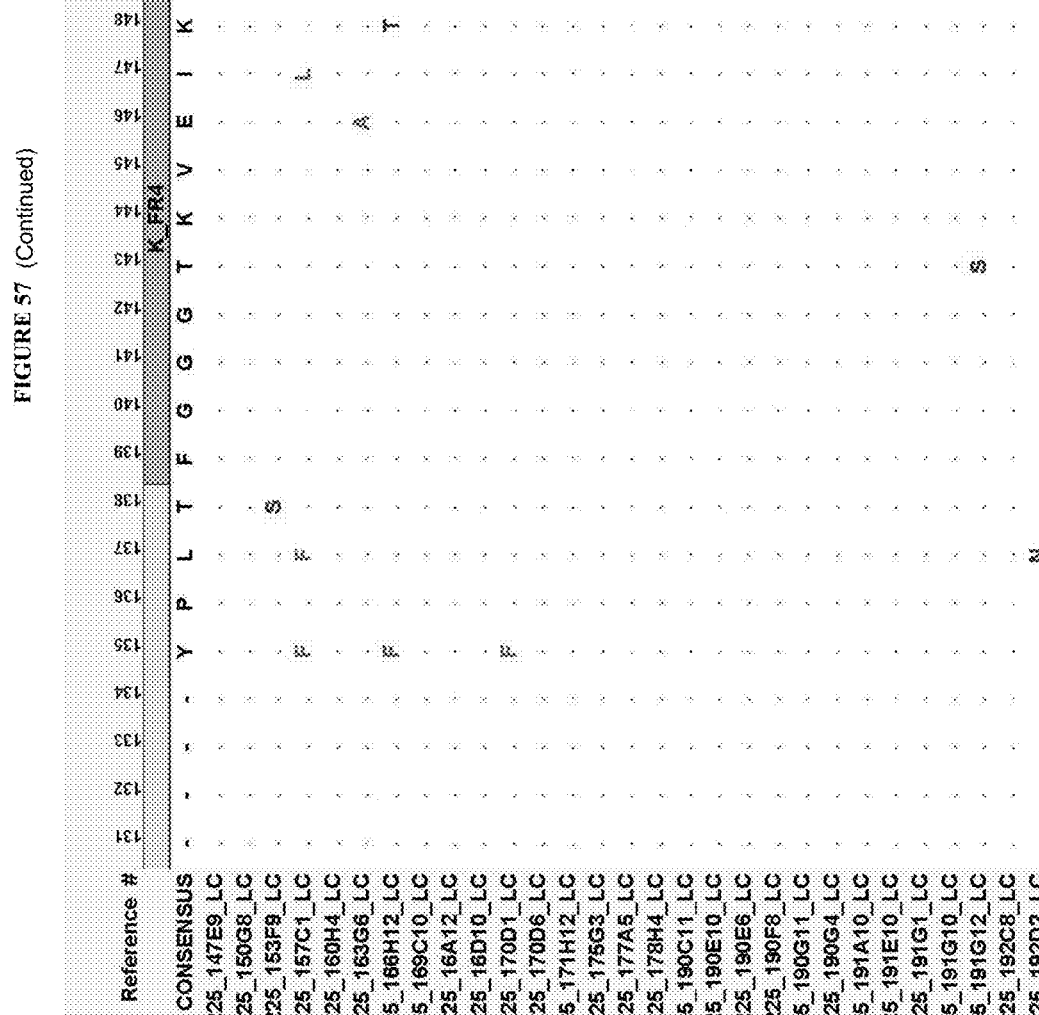
Figure 57:
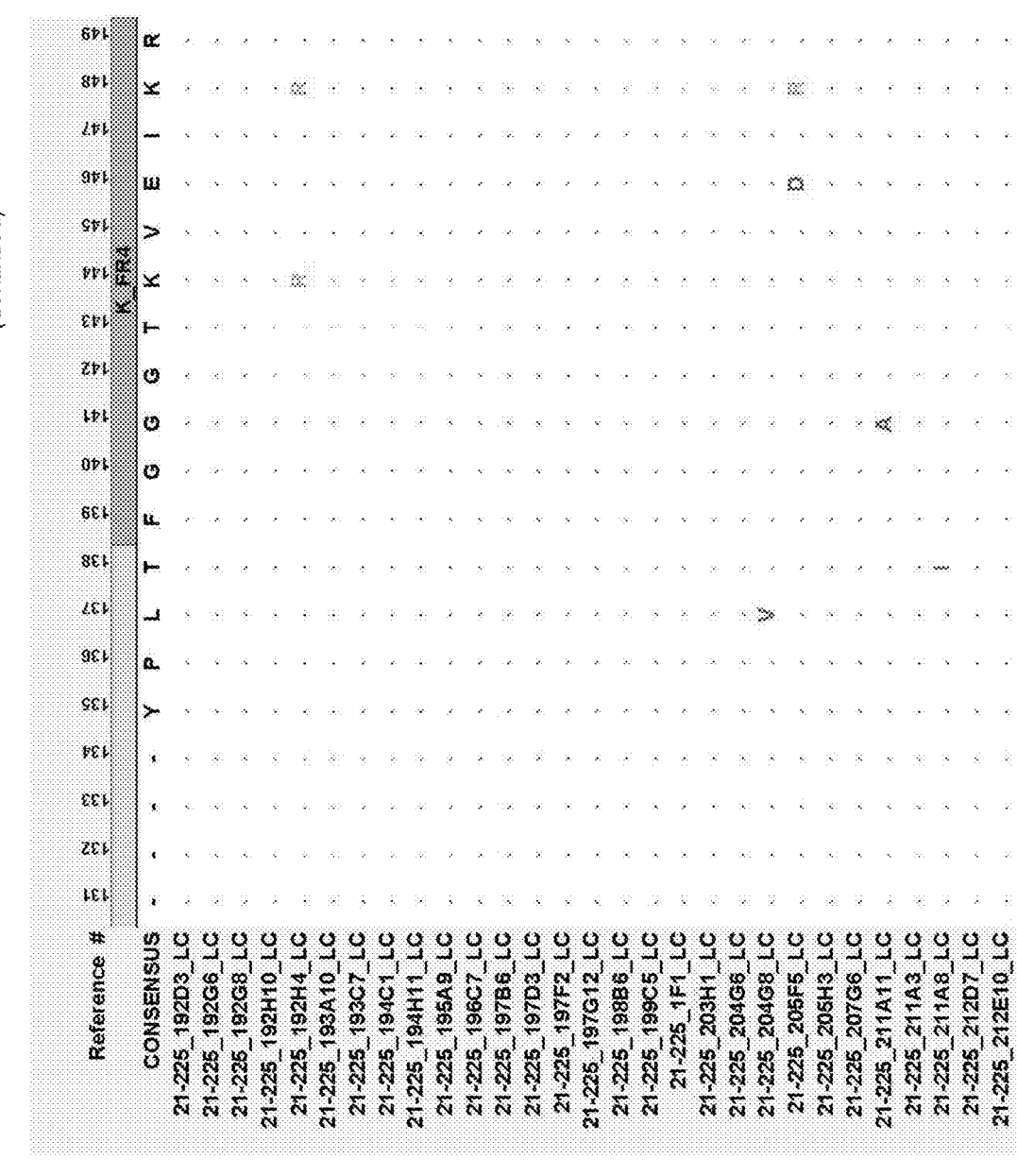
Figure 57:
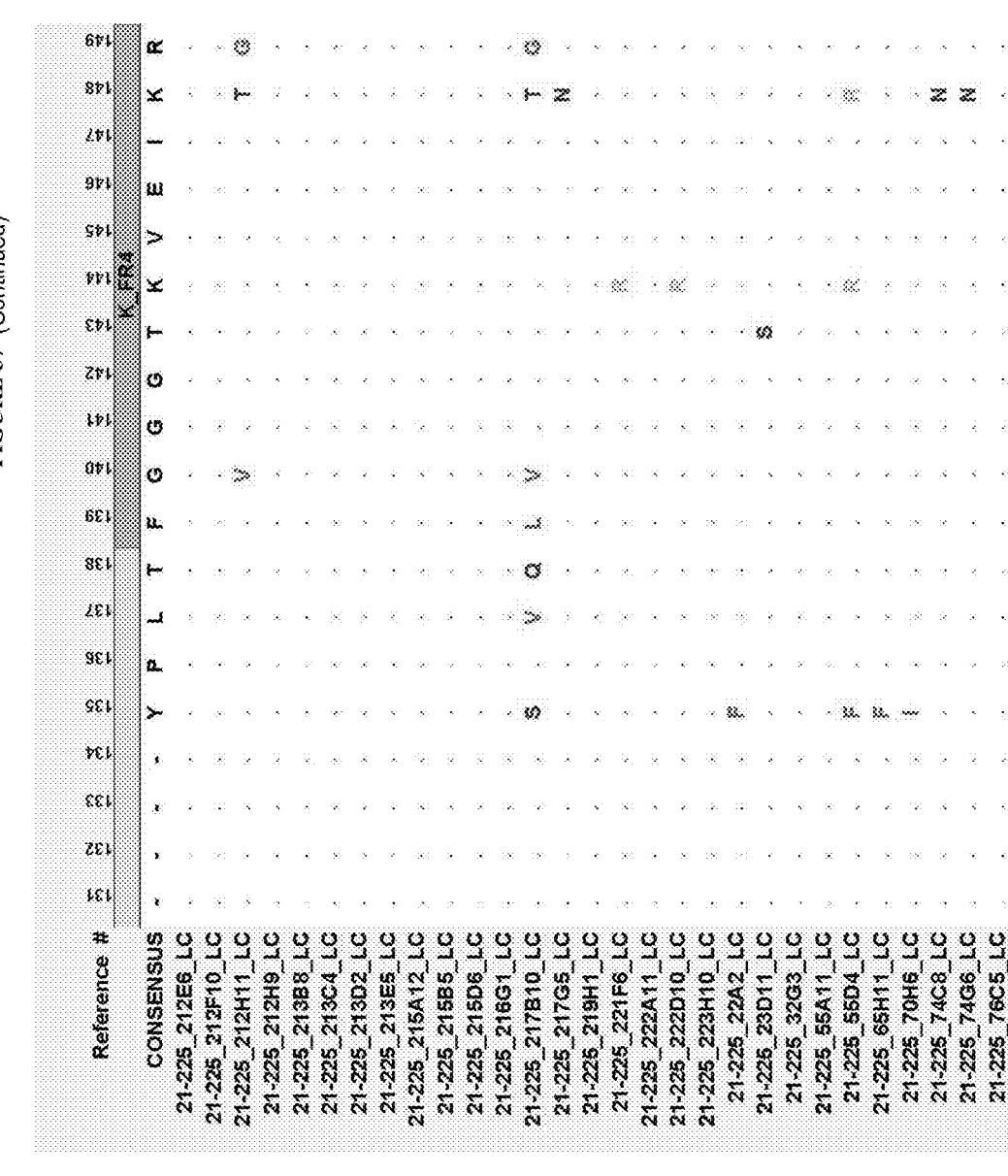
Figure 57:
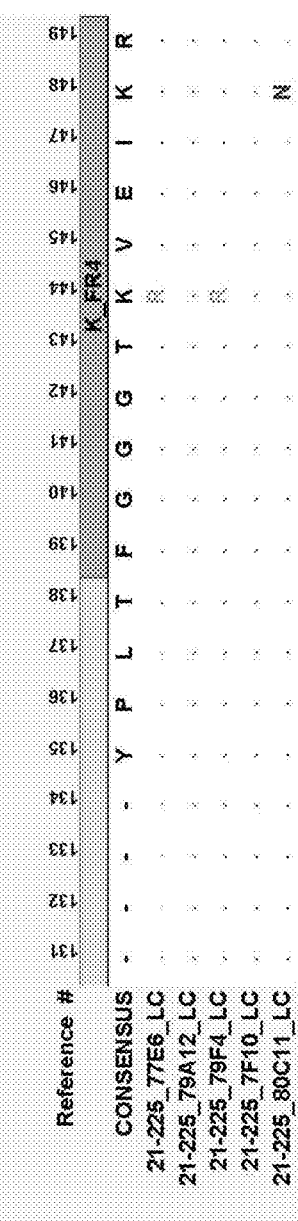
Figure 57:
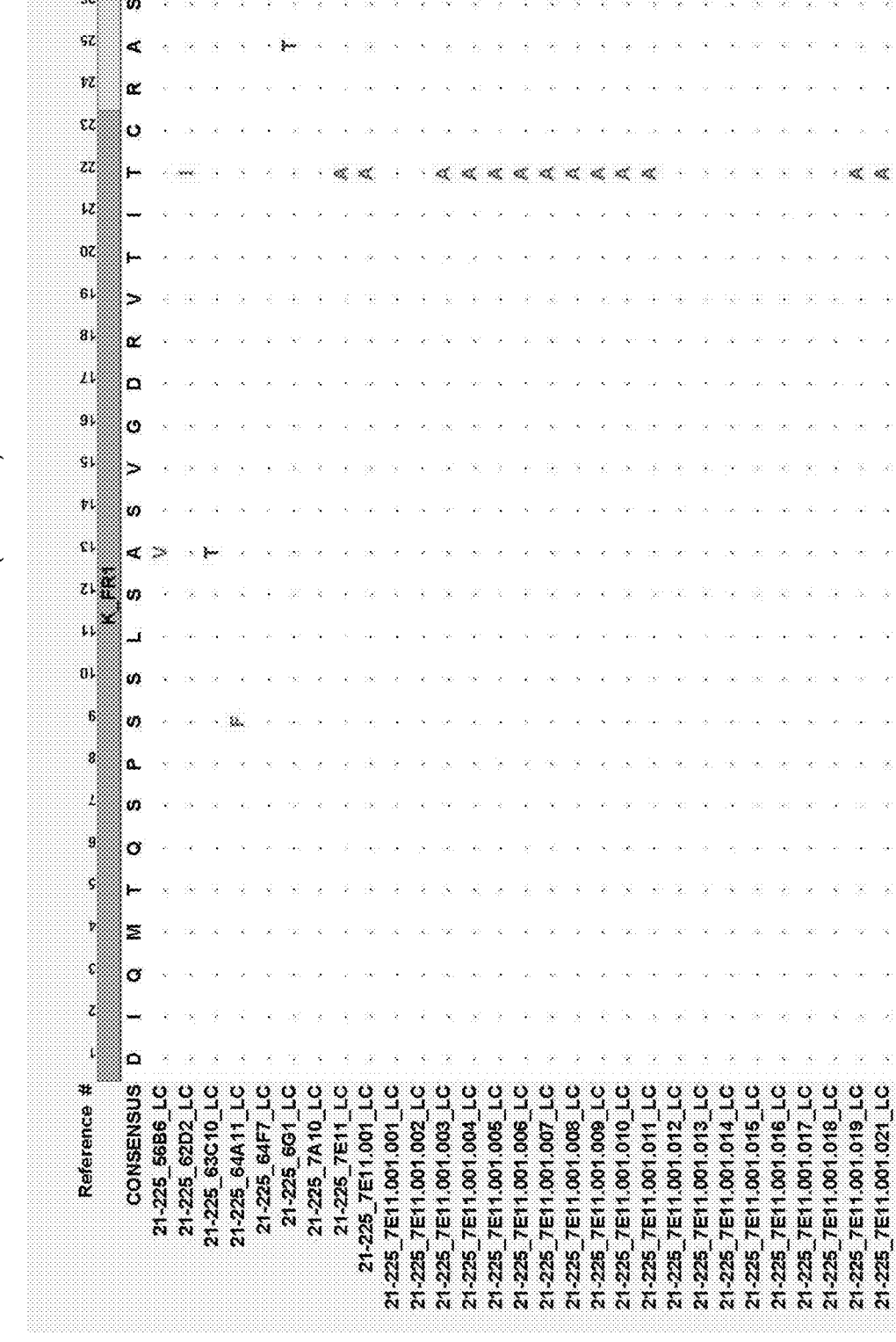
Figure 57:
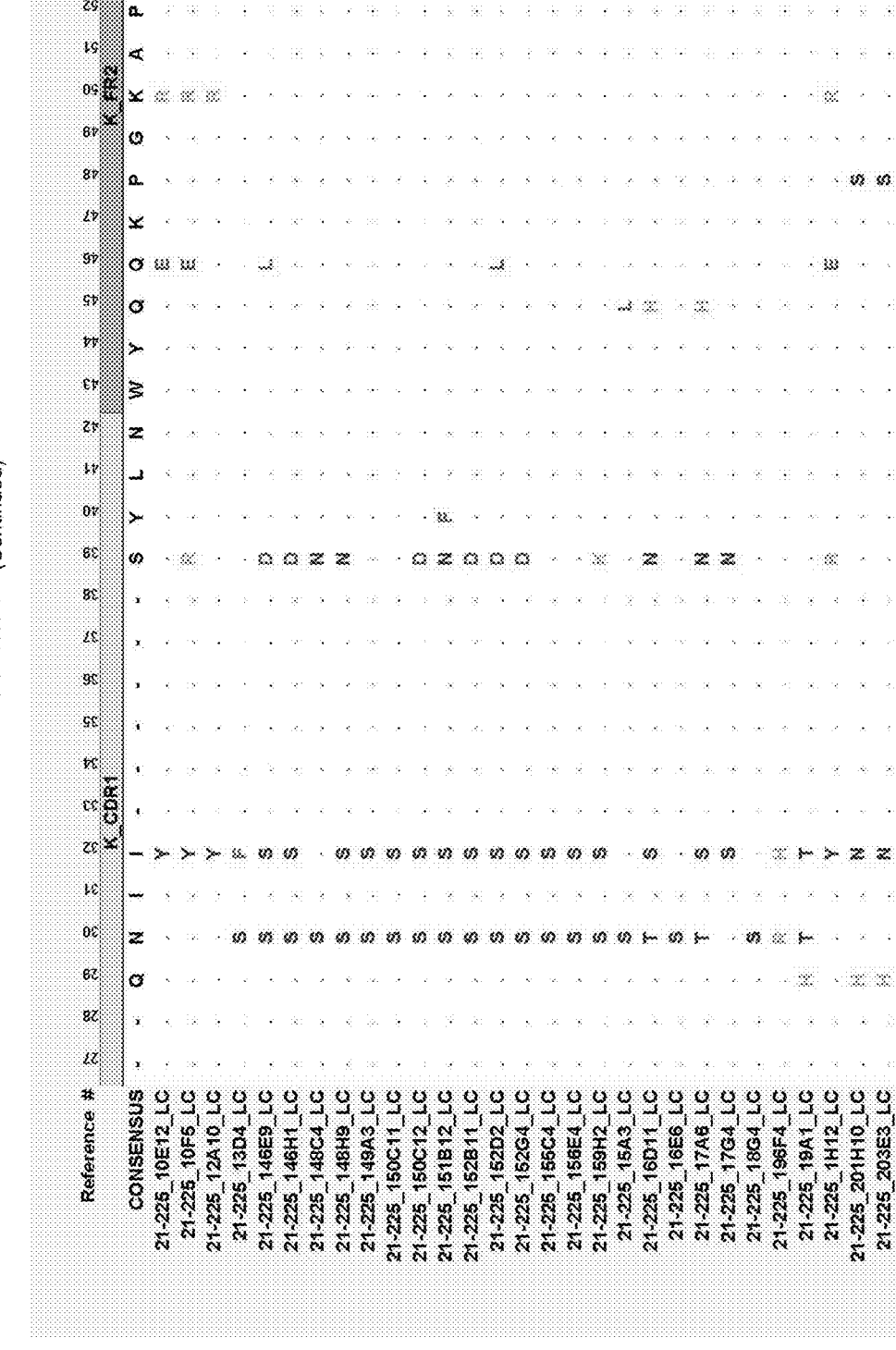
Figure 57:
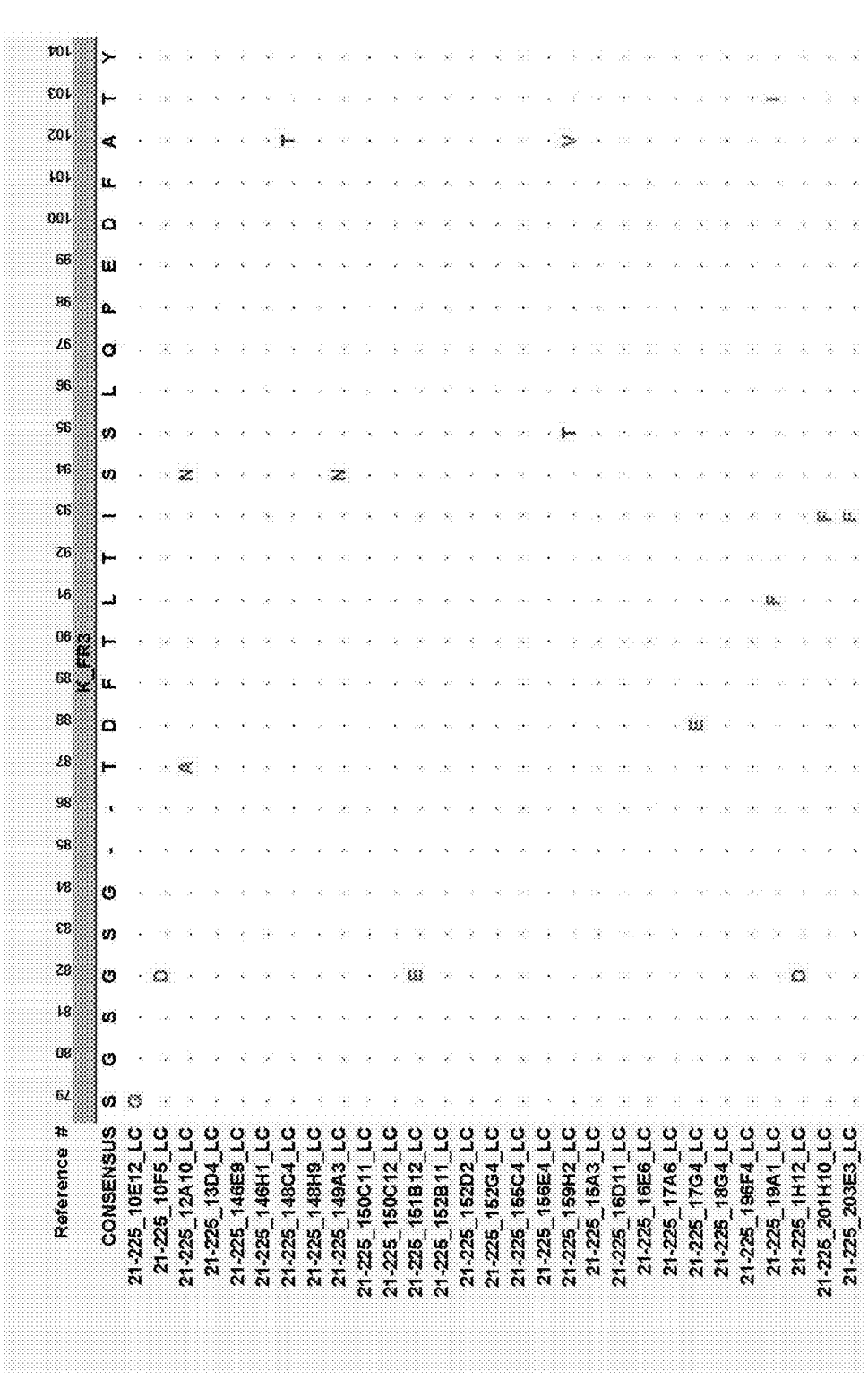
Figure 57:
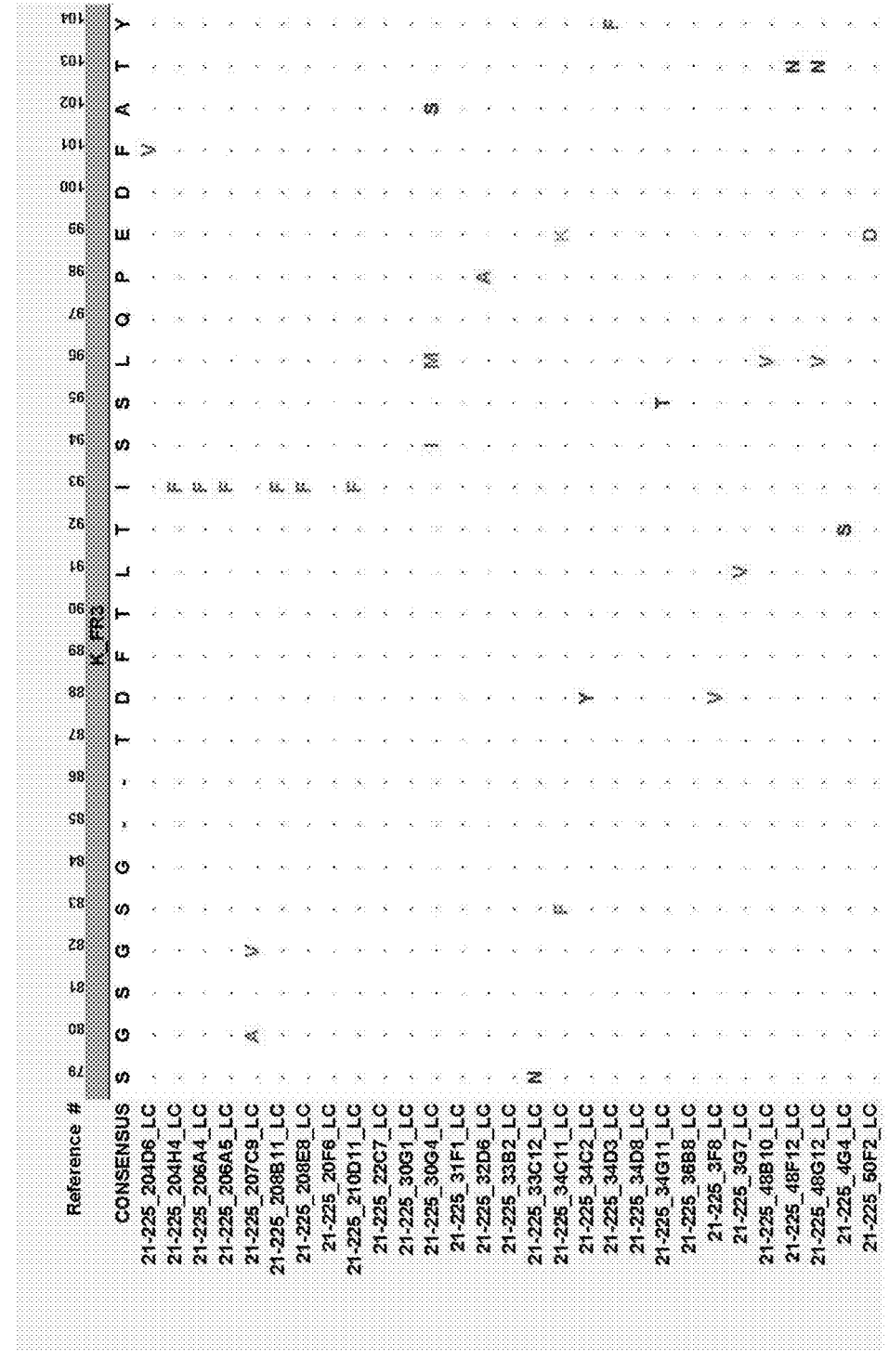
Figure 57:
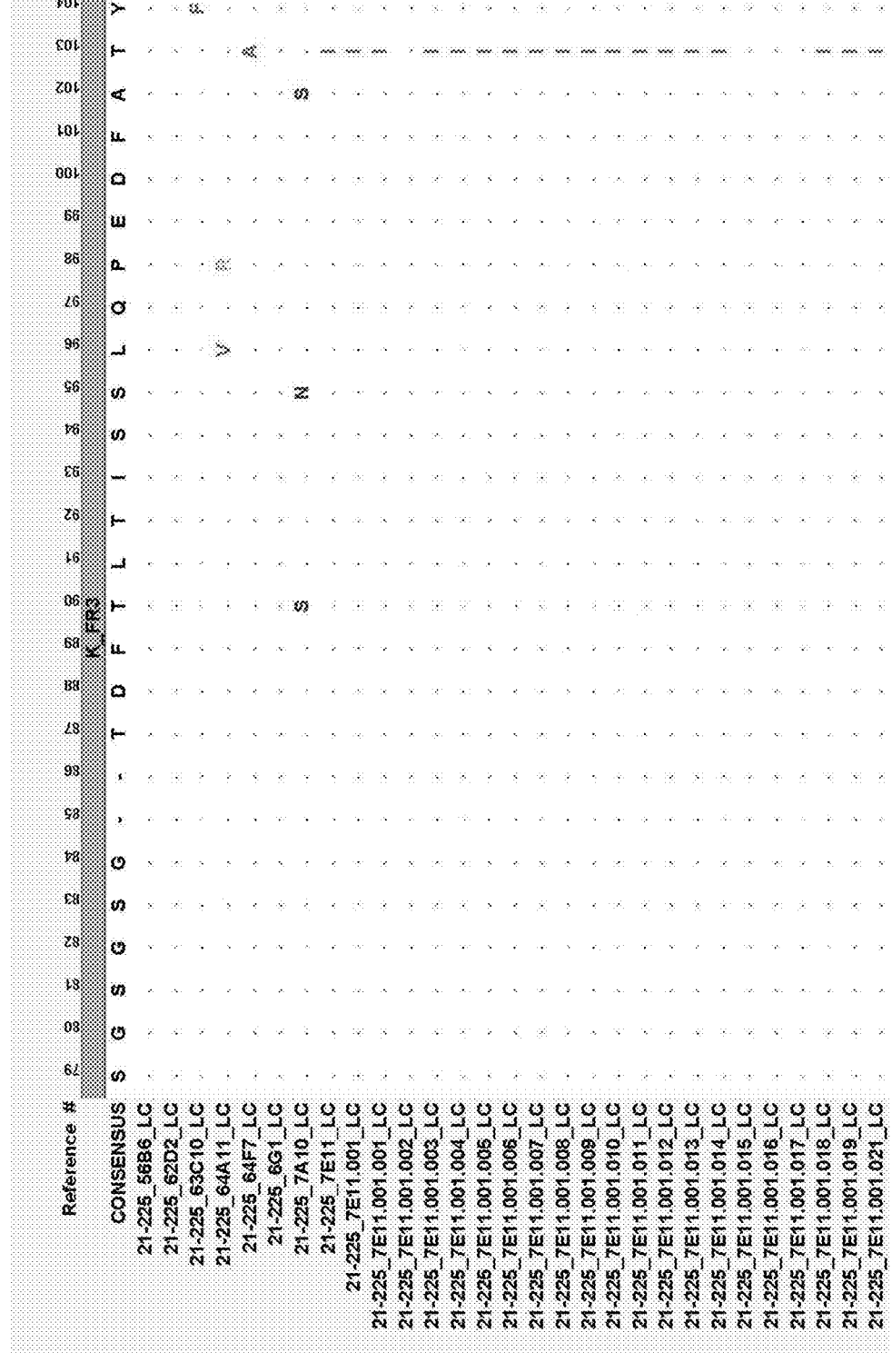
Figure 57:
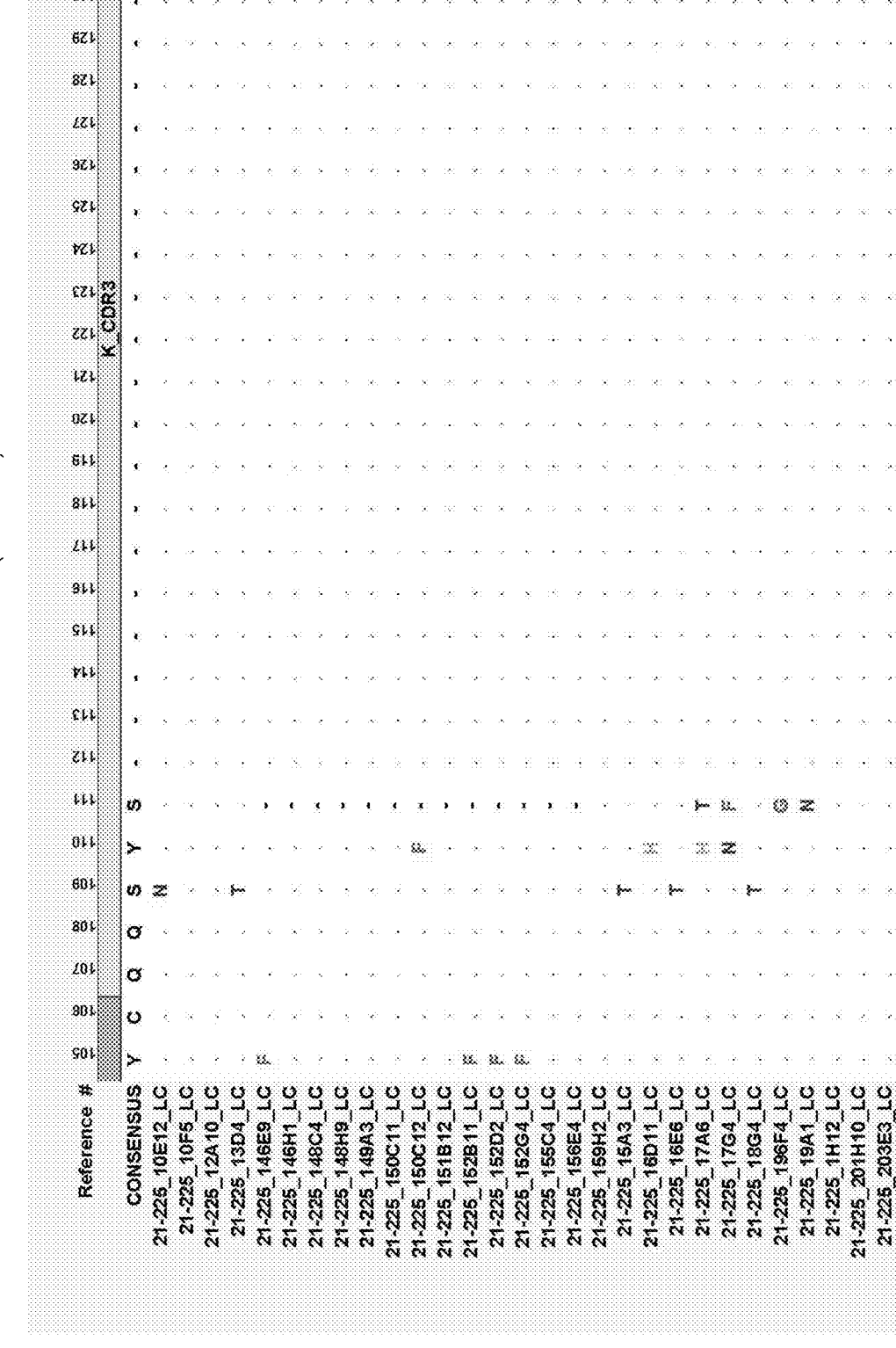
Figure 57:
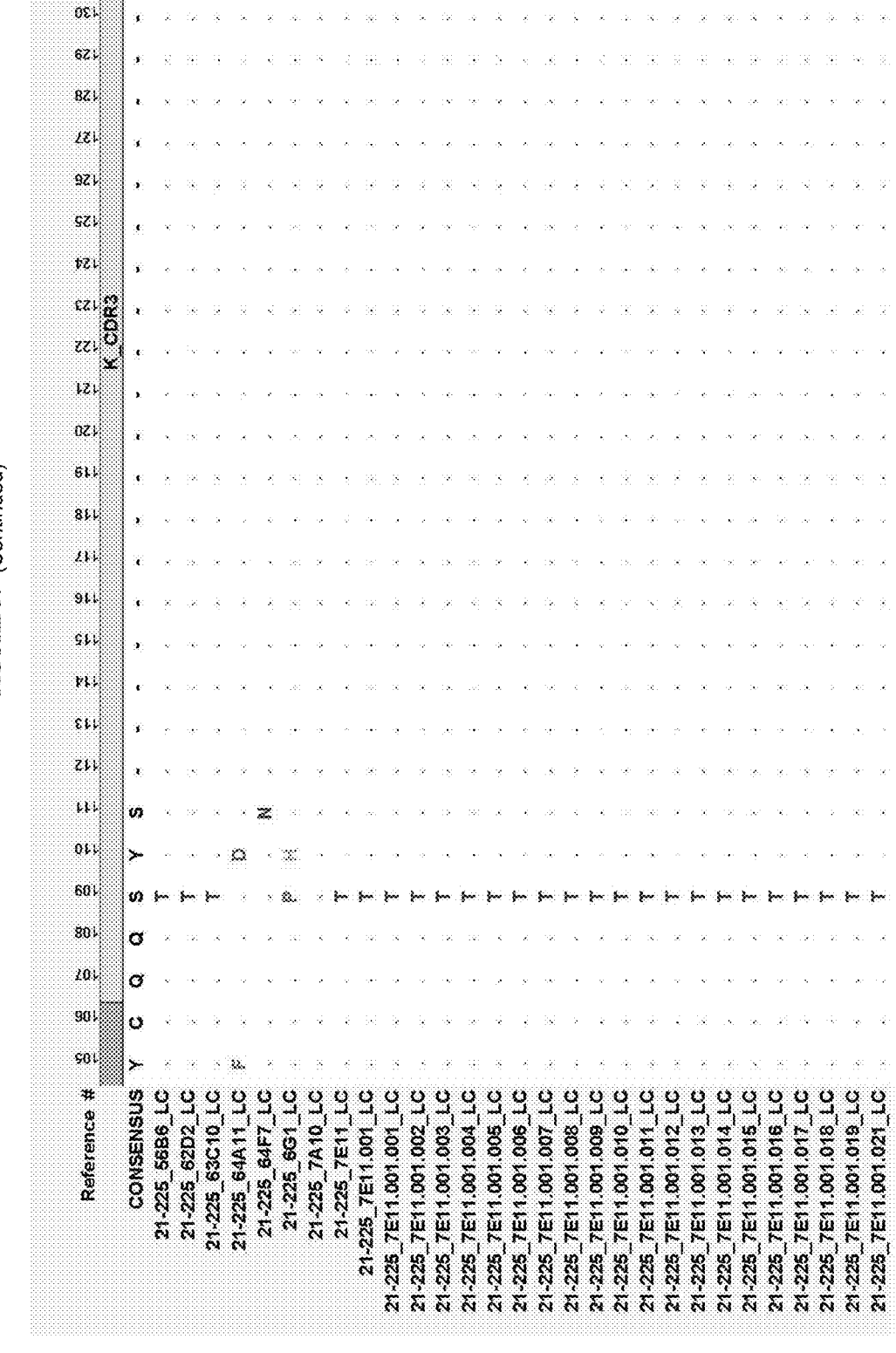
Figure 57:
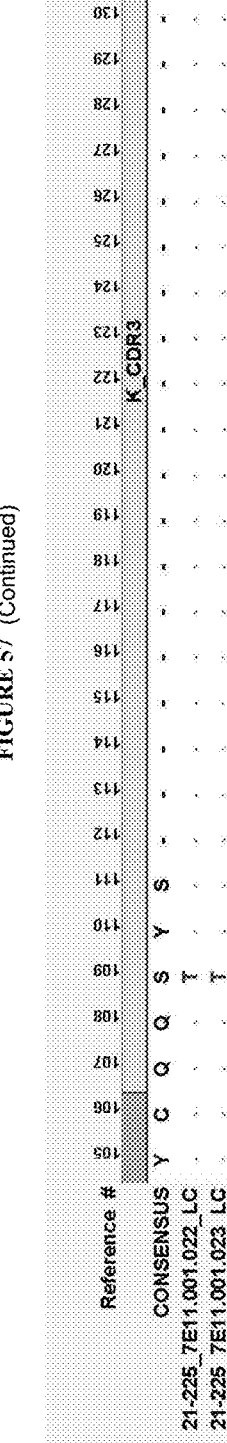
Figure 57:
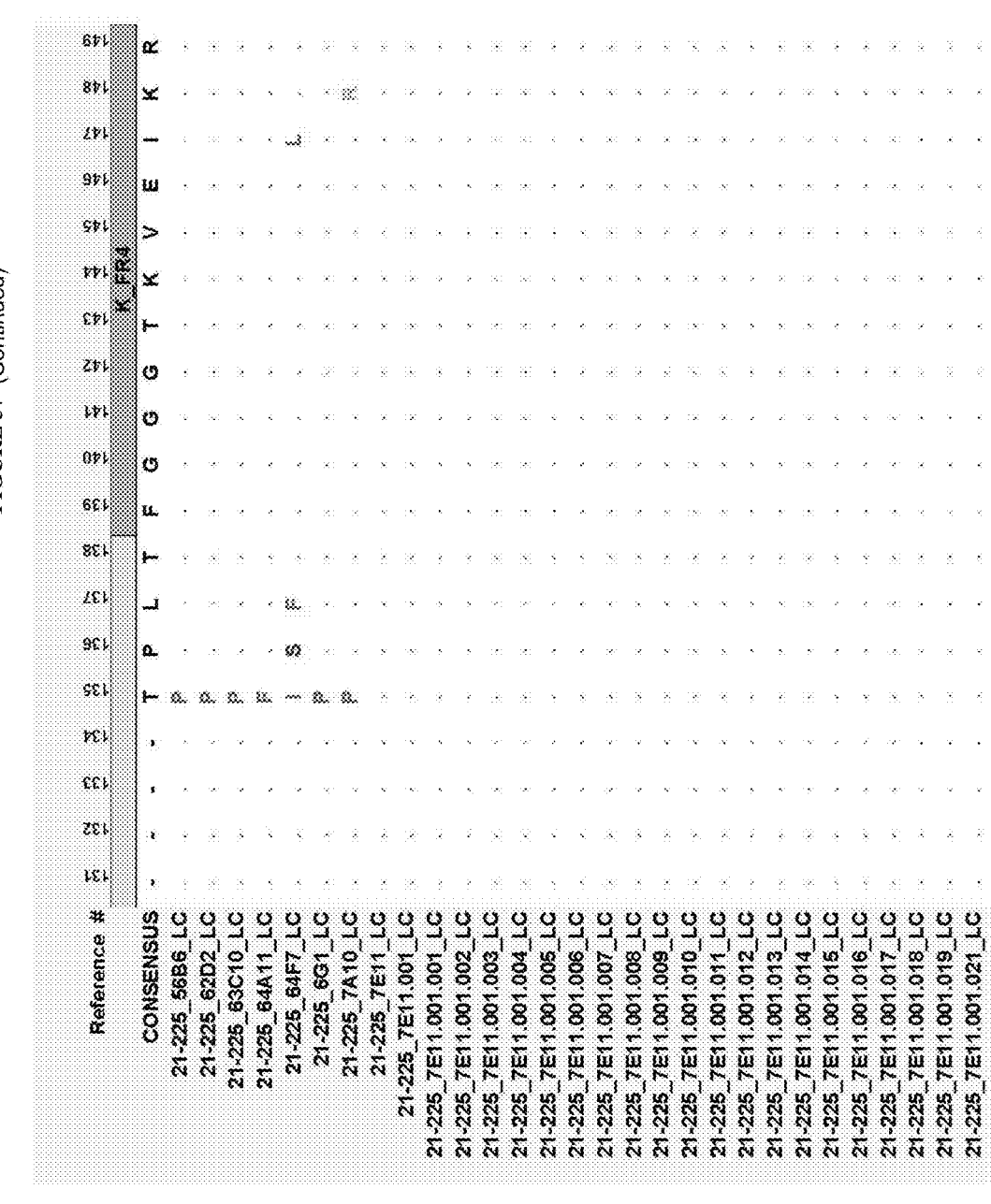
Figure 57:
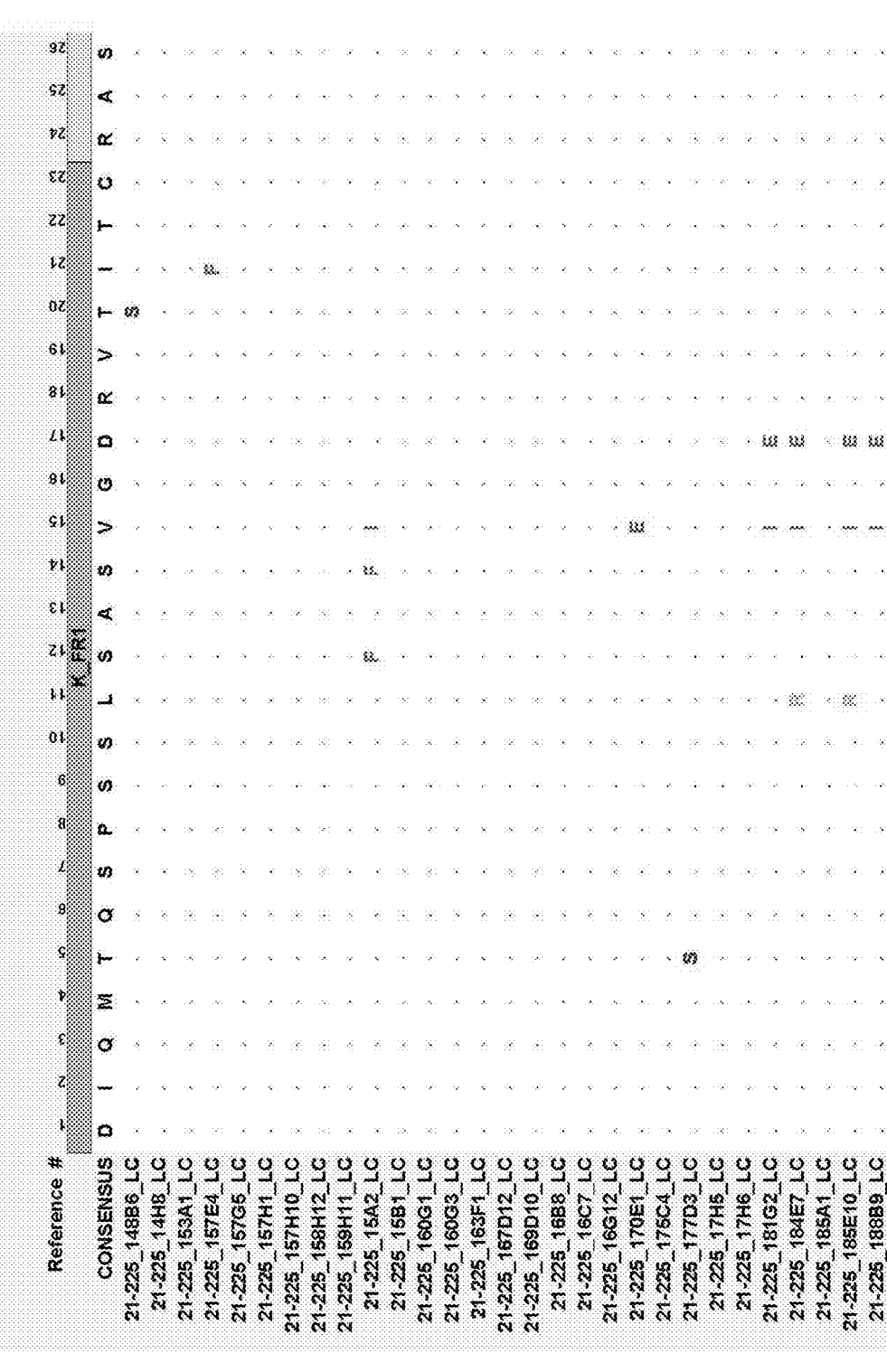
Figure 57:
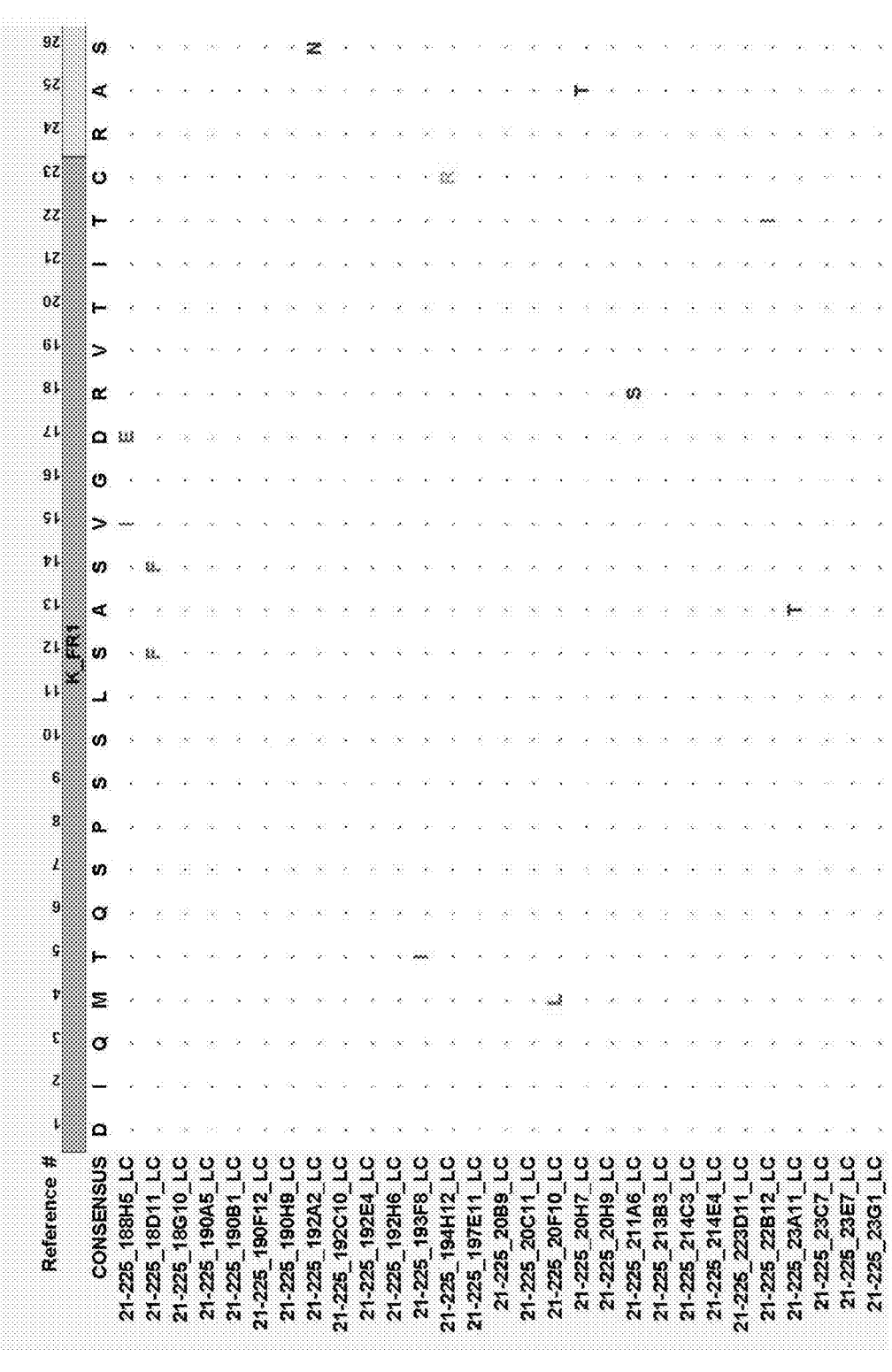
Figure 57:
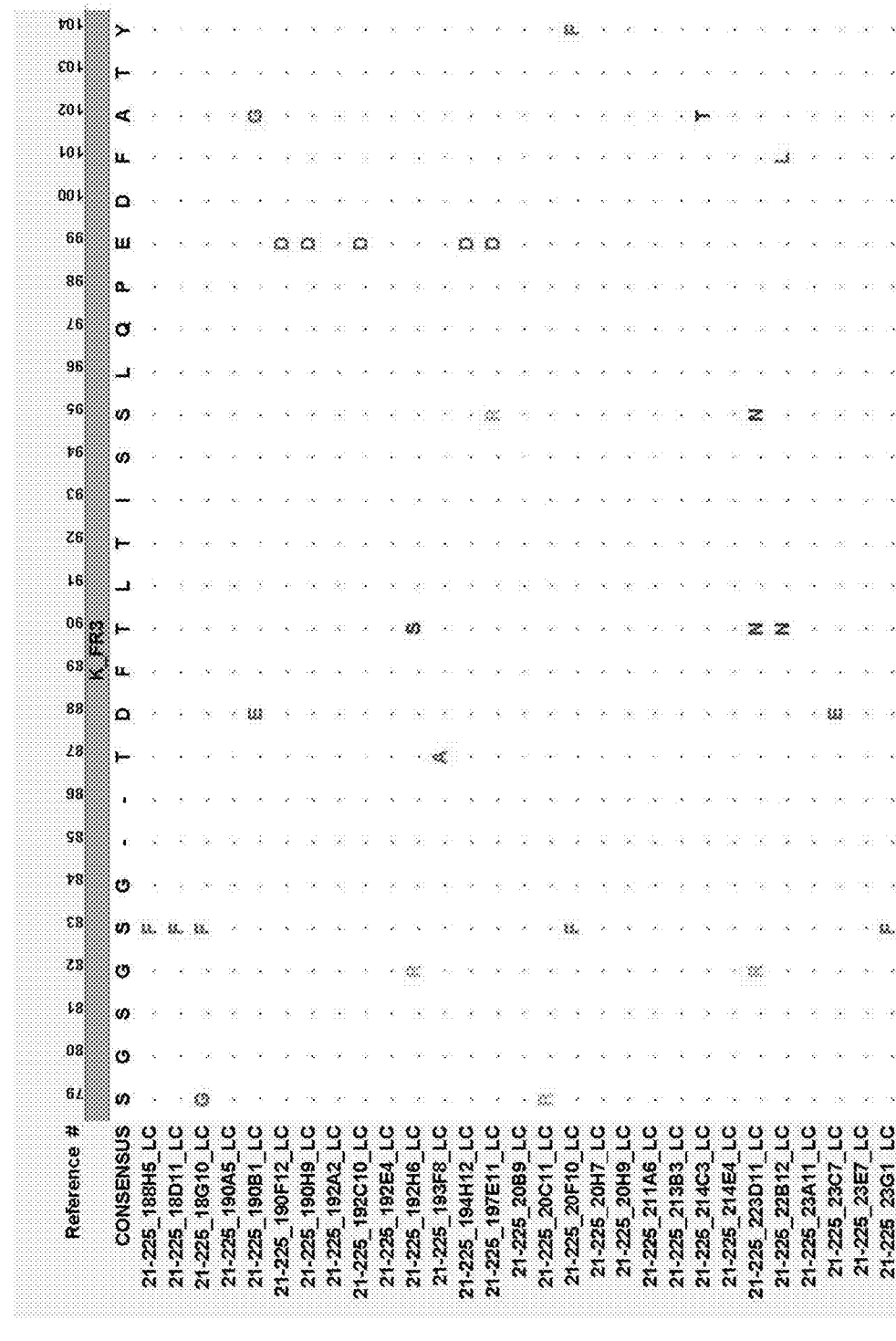
Figure 57:
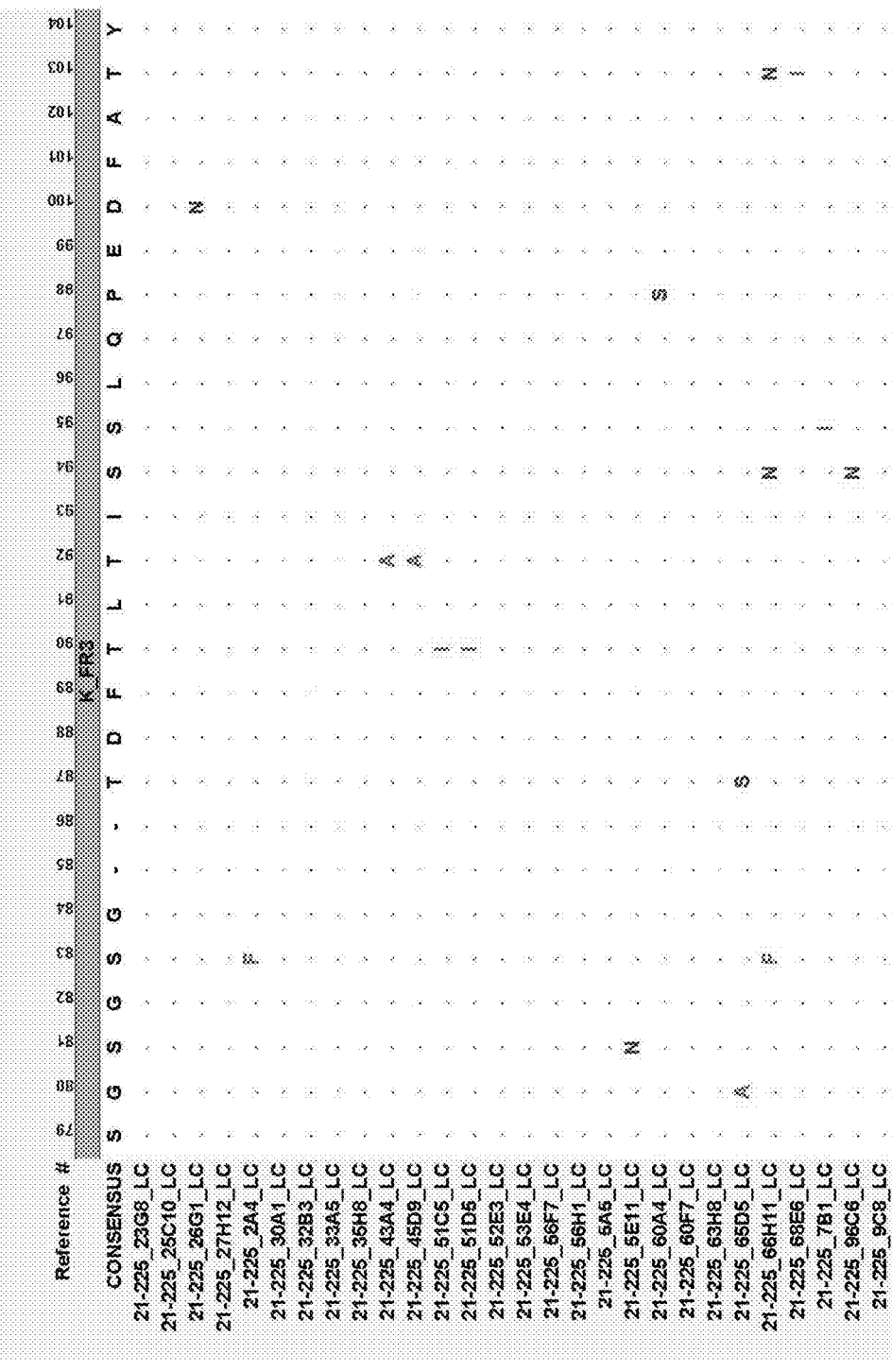
Figure 57:
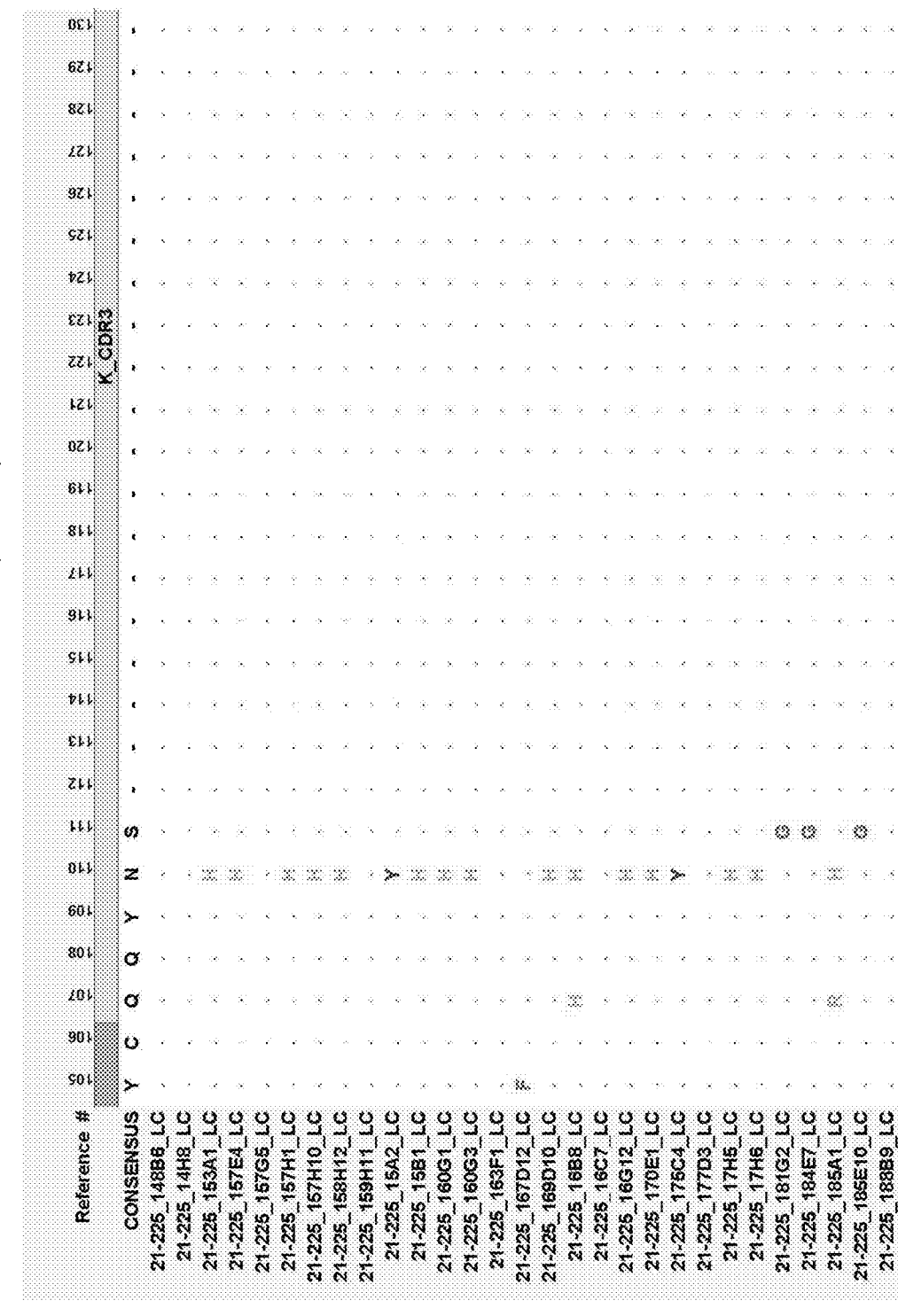
Figure 57:
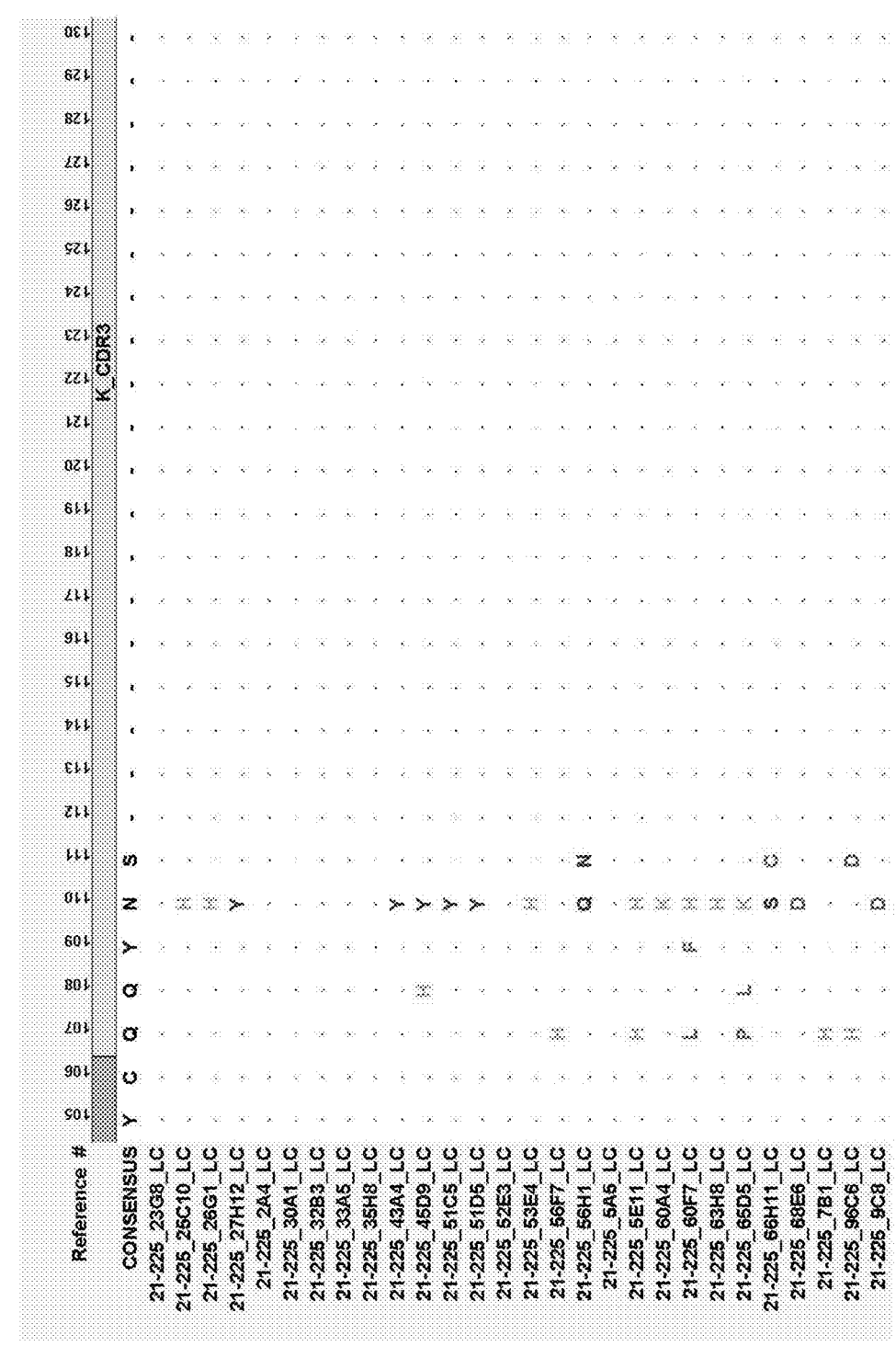
Figure 57:
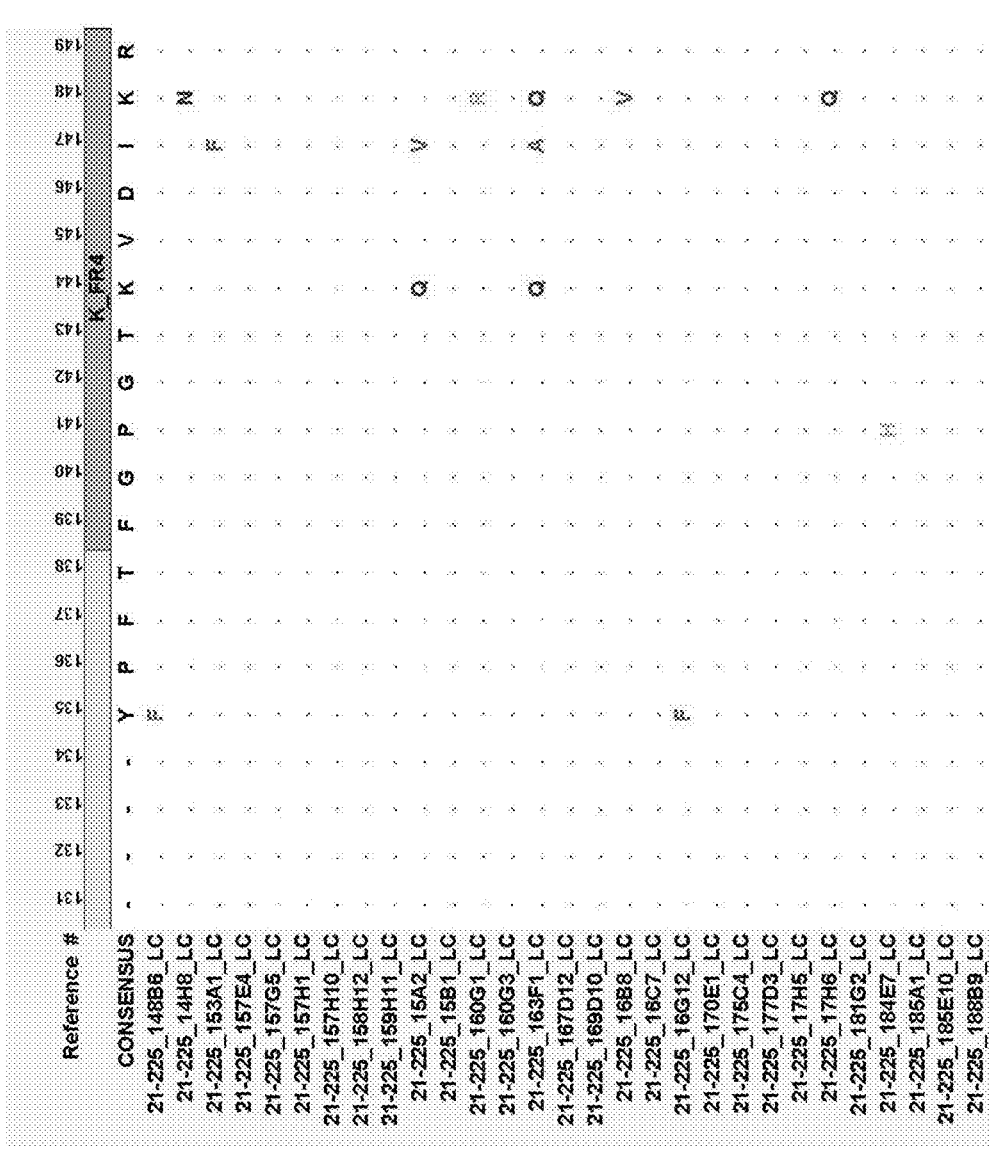
Figure 57:
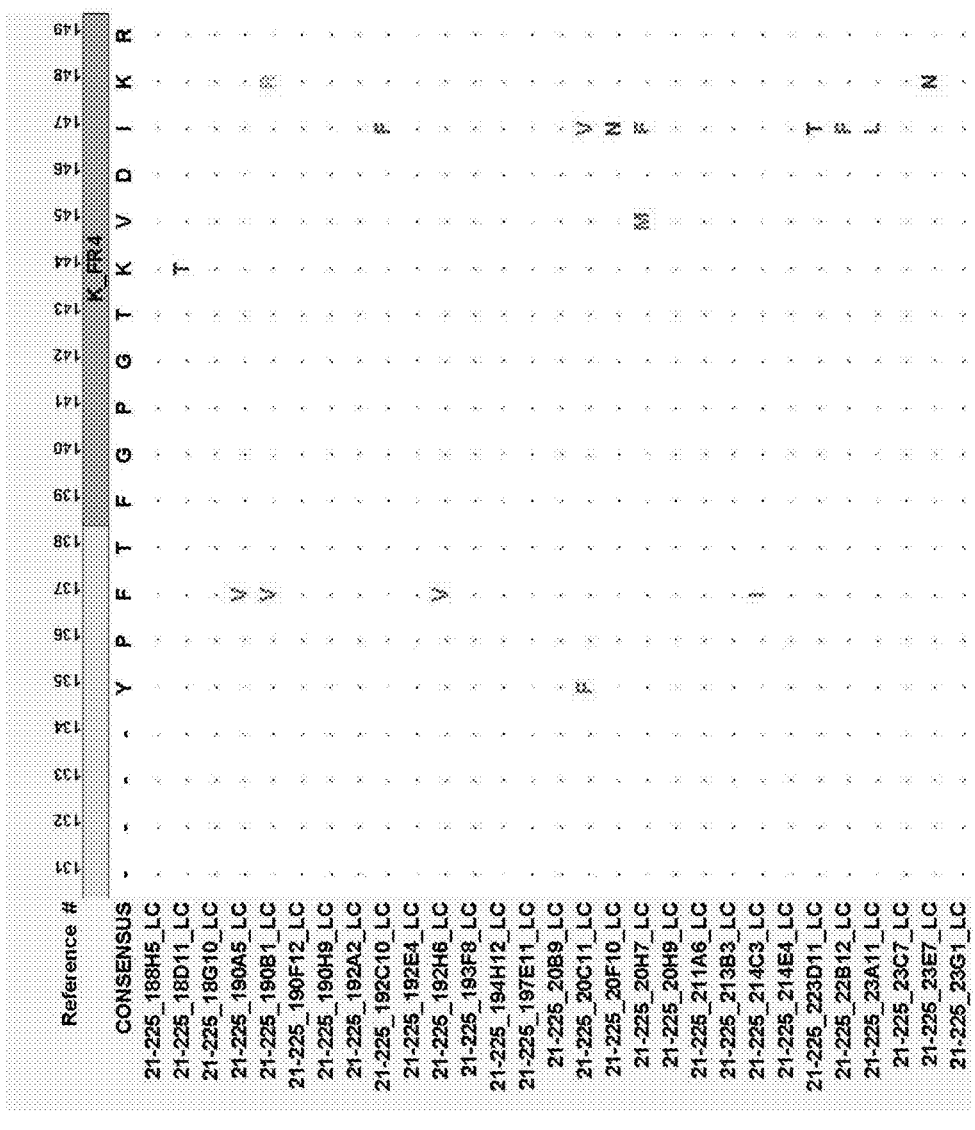
Figure 57:
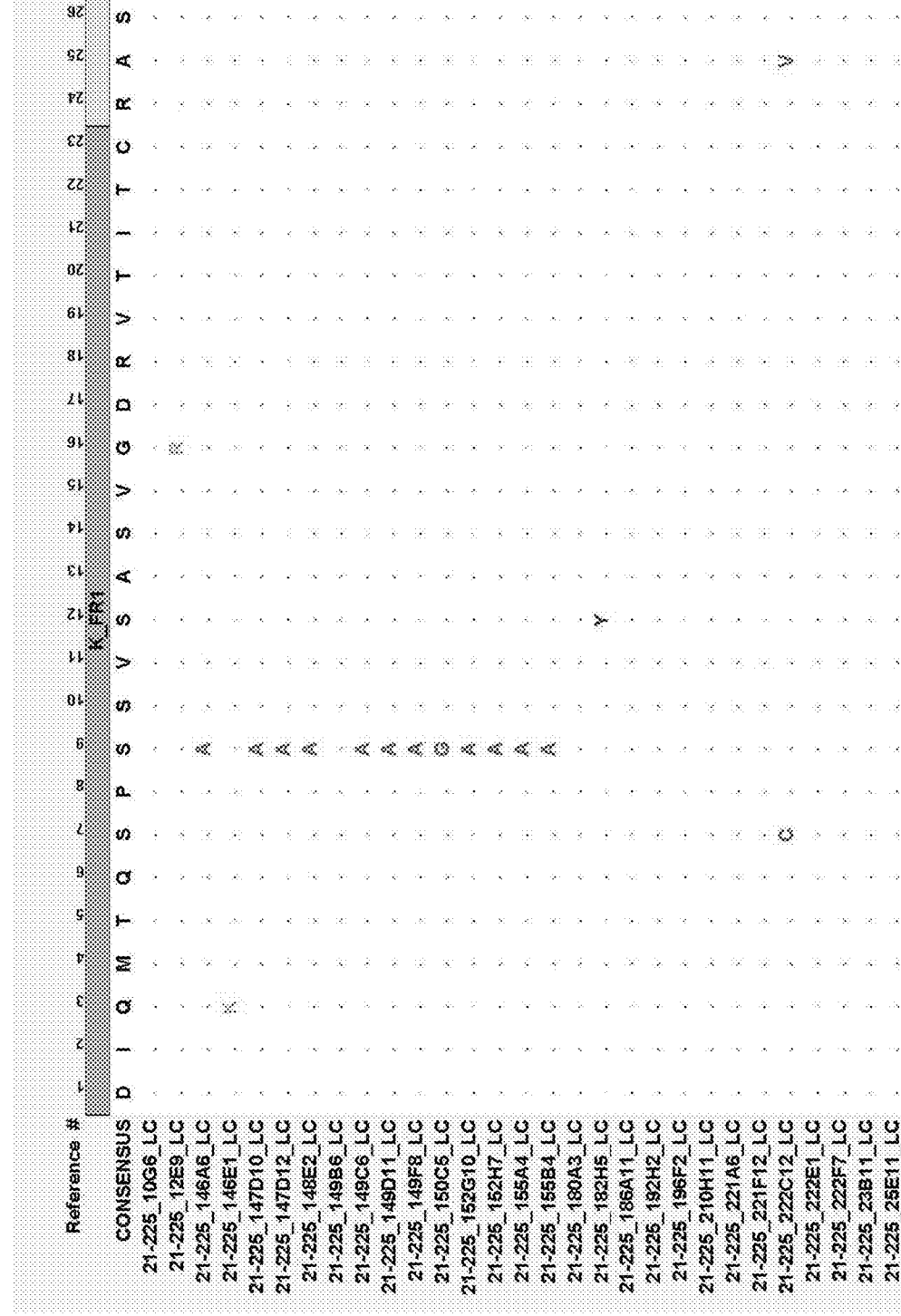
Figure 57:
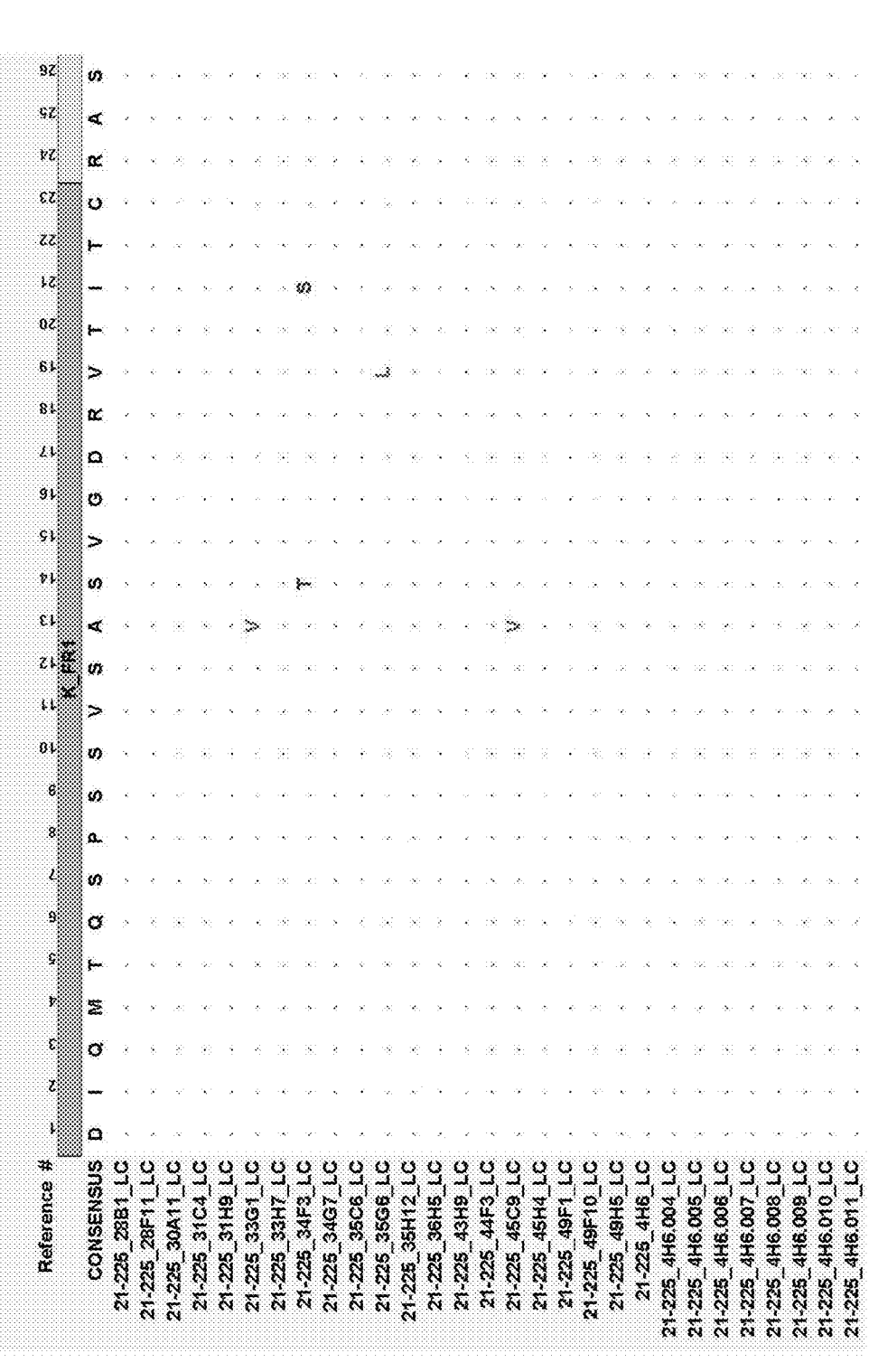
Figure 57:
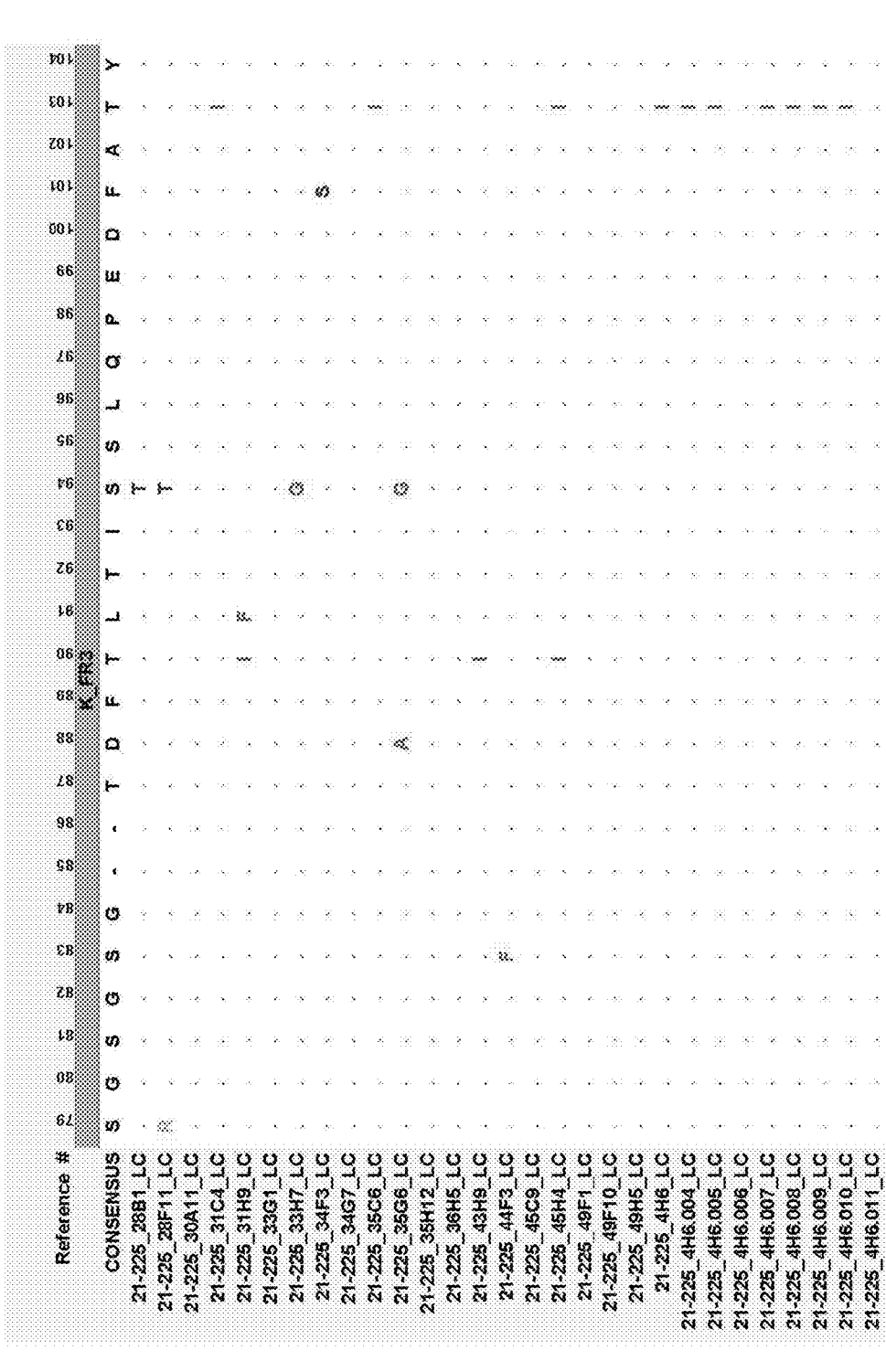
Figure 57:
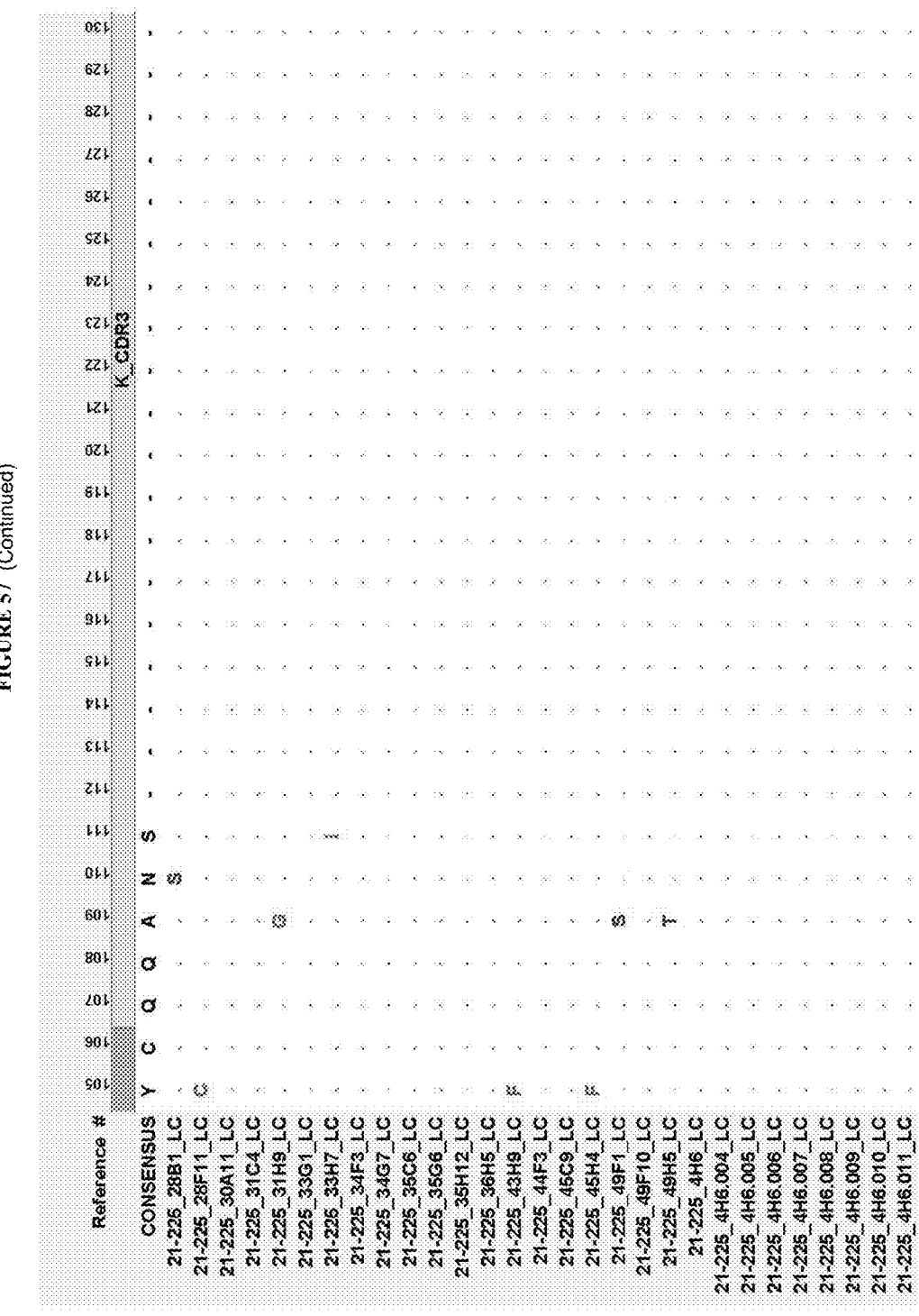
Figure 57:
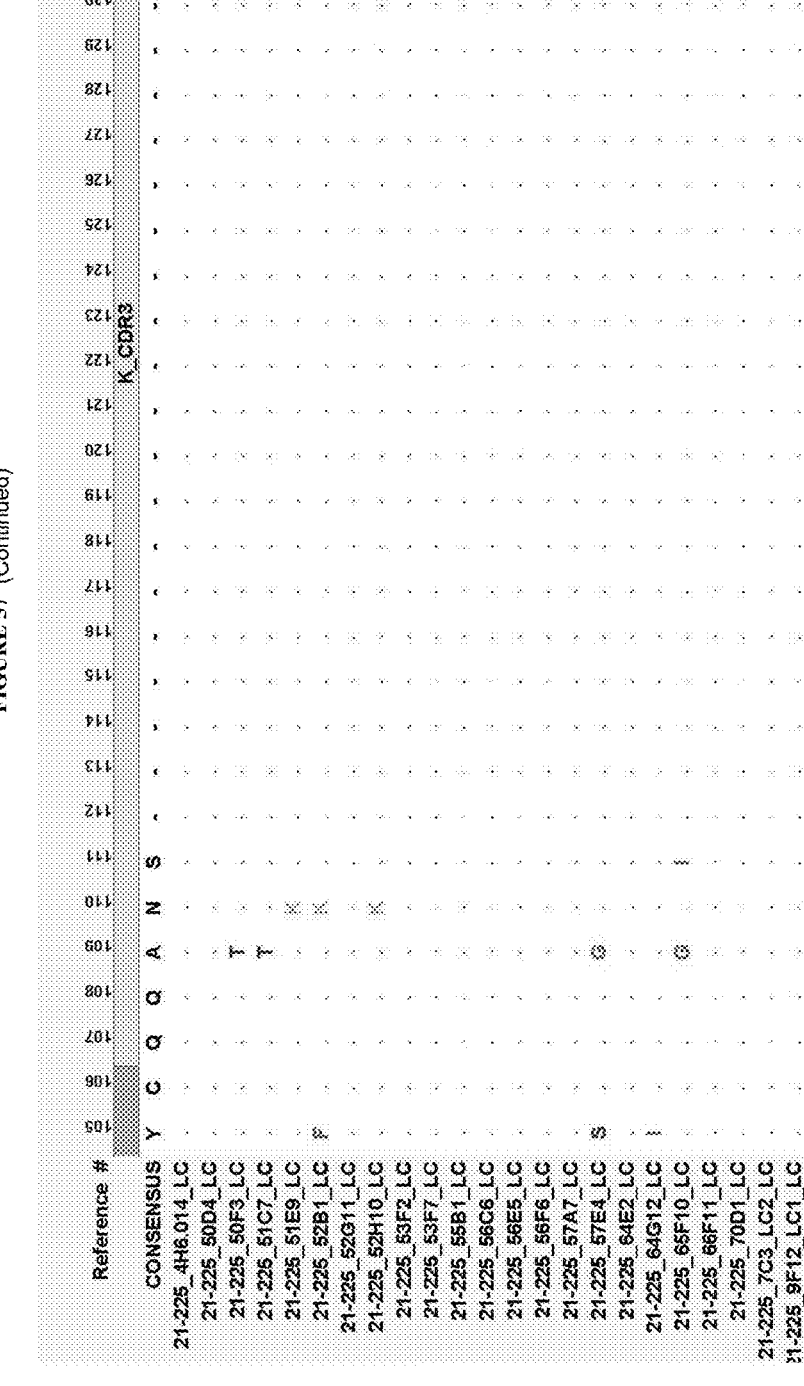
Figure 57:
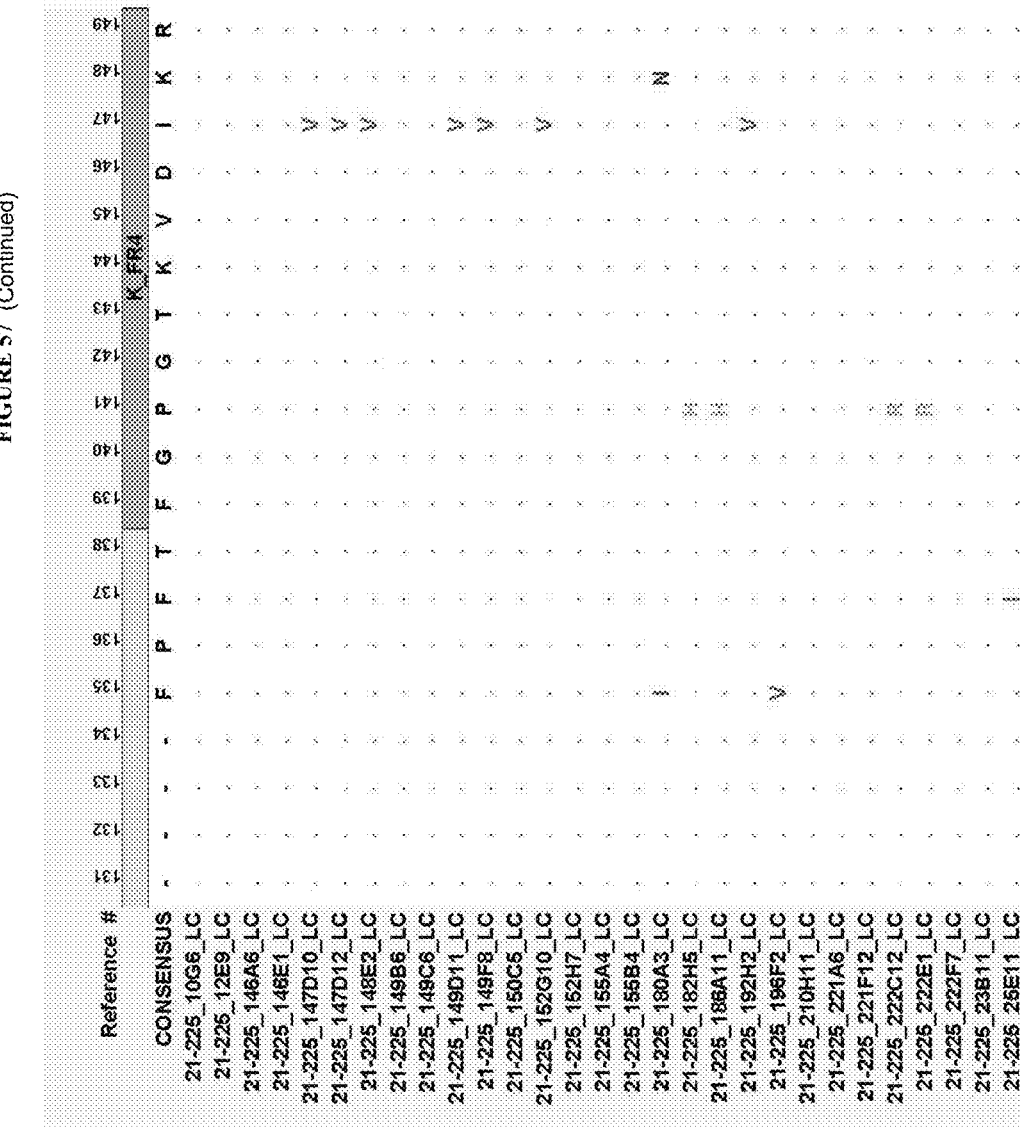
Figure 57:
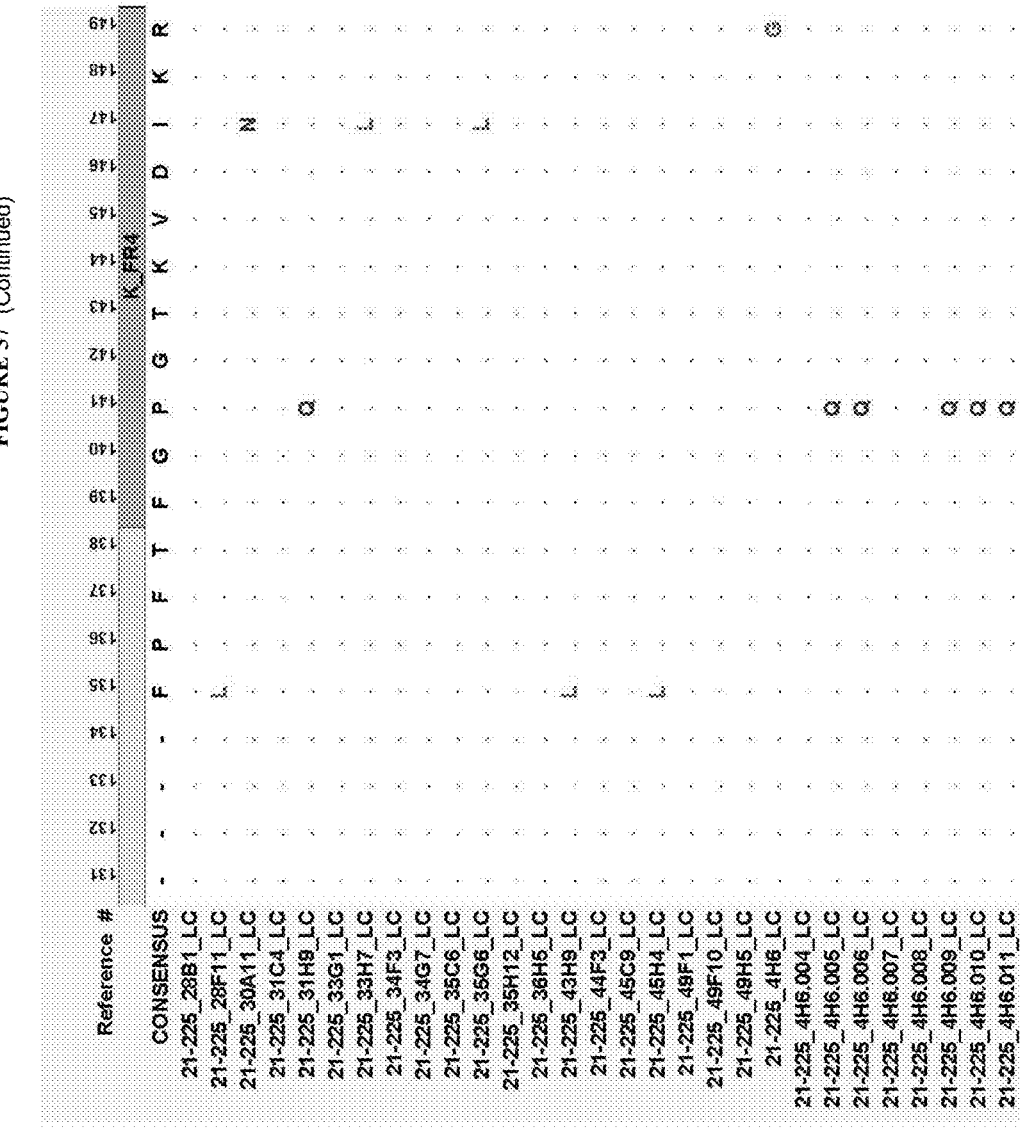
Figure 57:
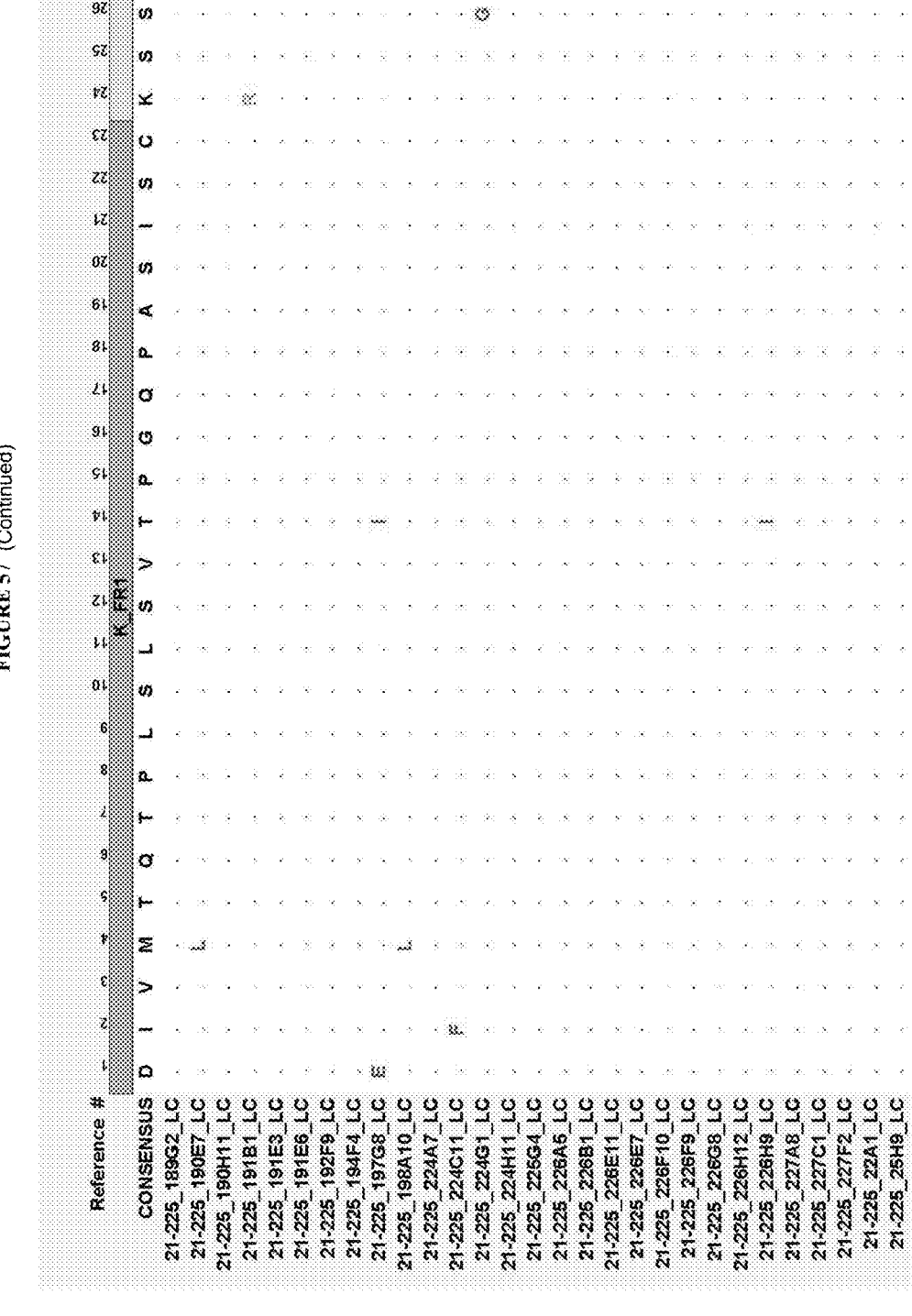
Figure 57:
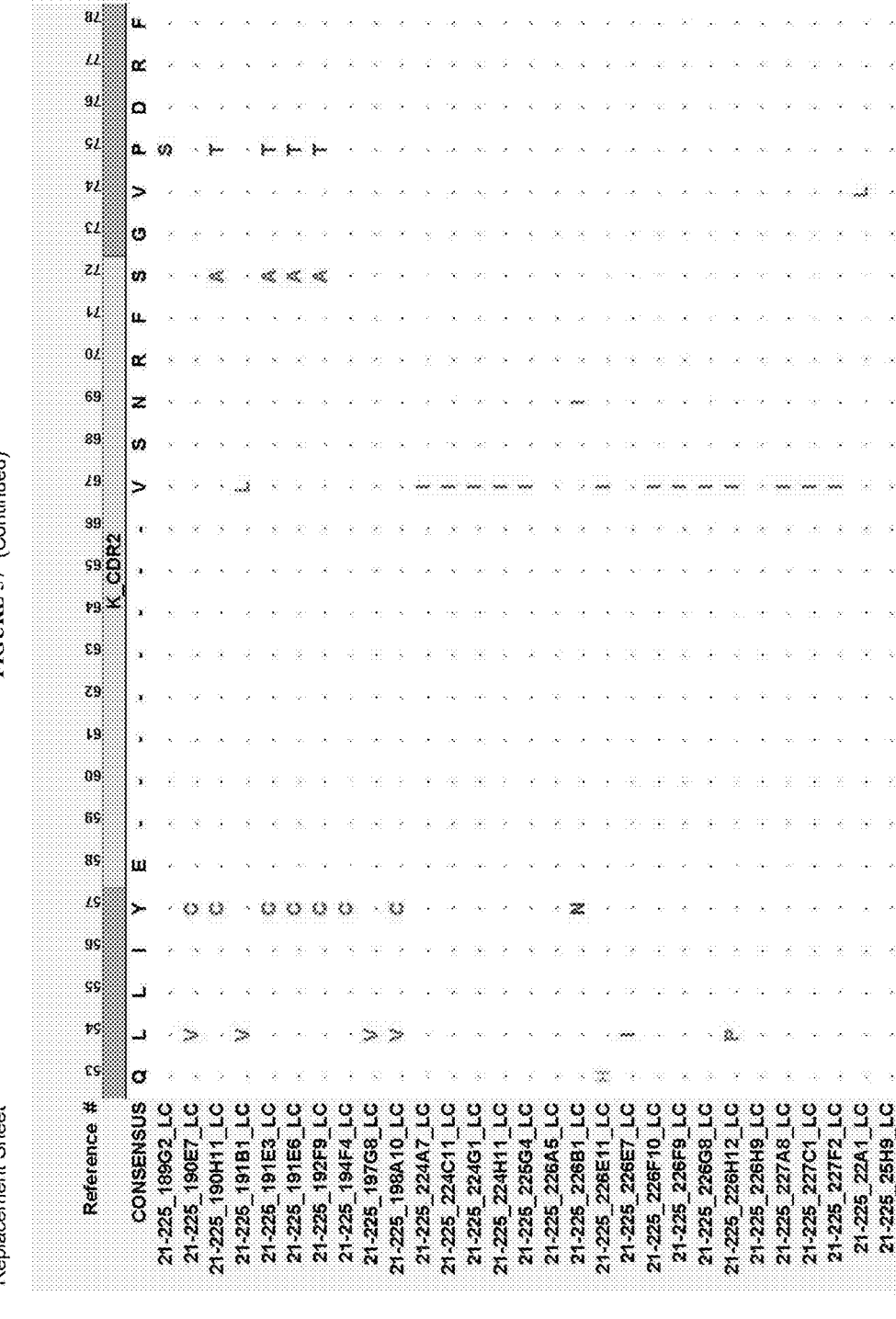
Figure 57:
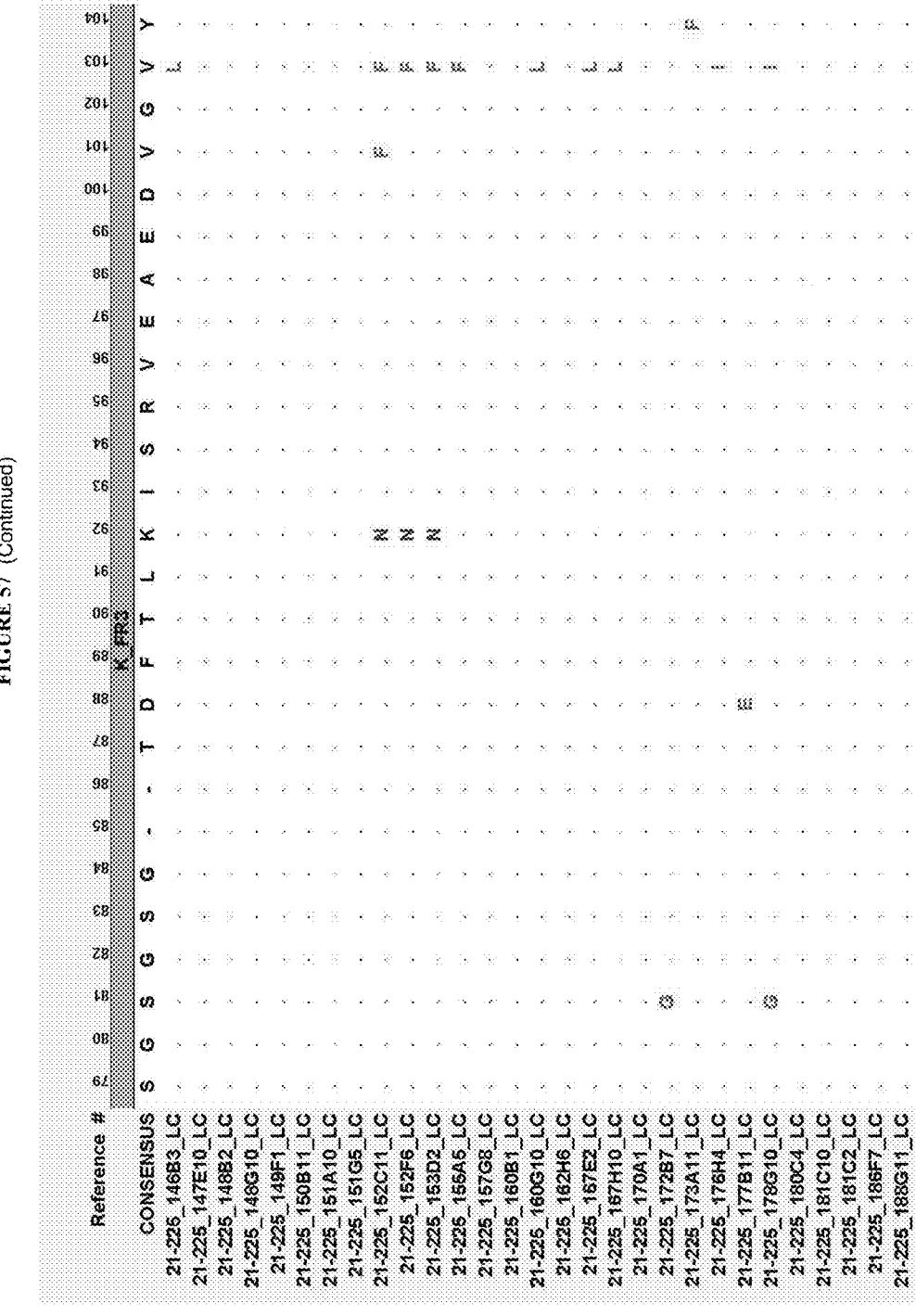
Figure 57:
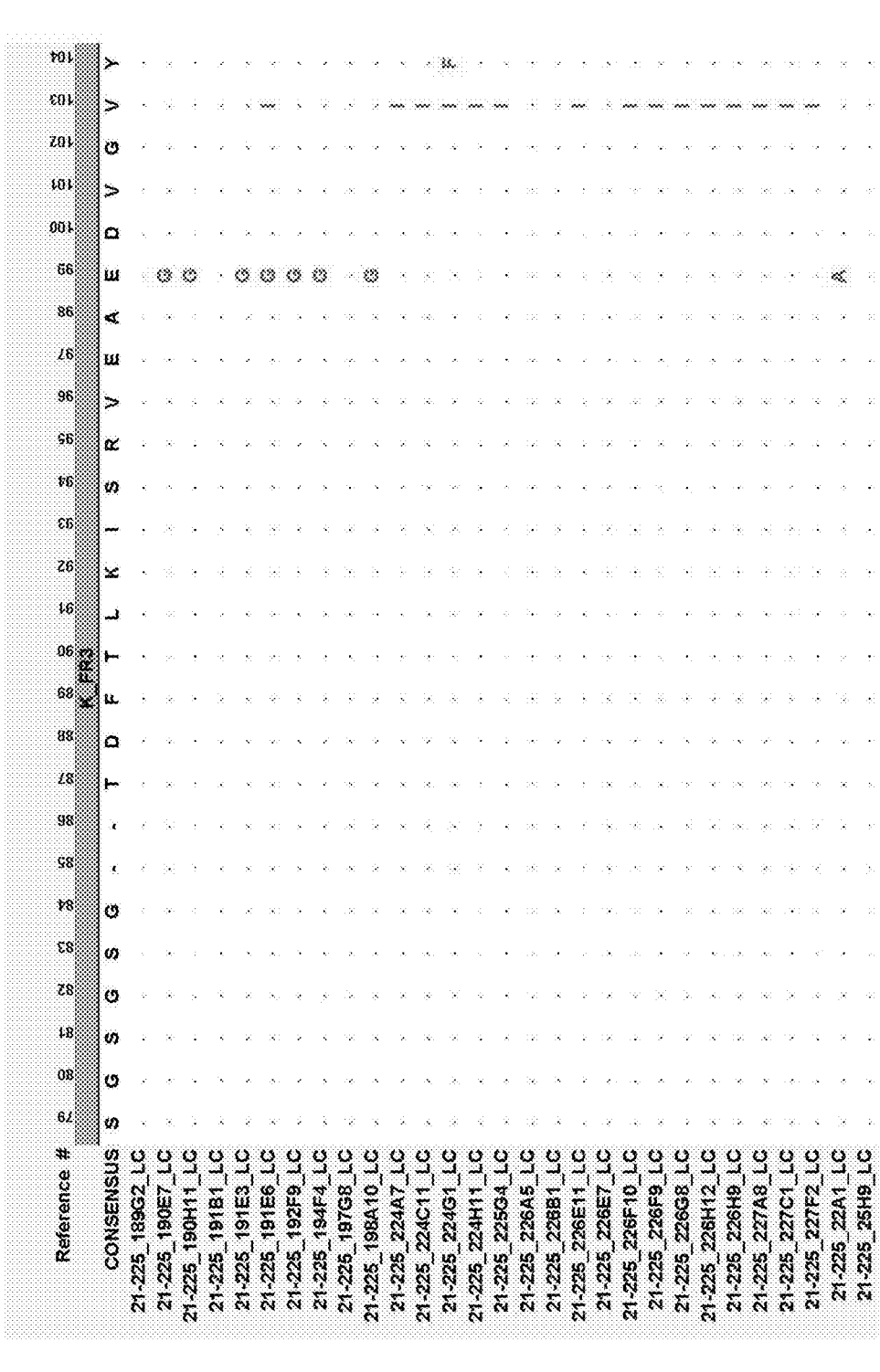
Figure 57:
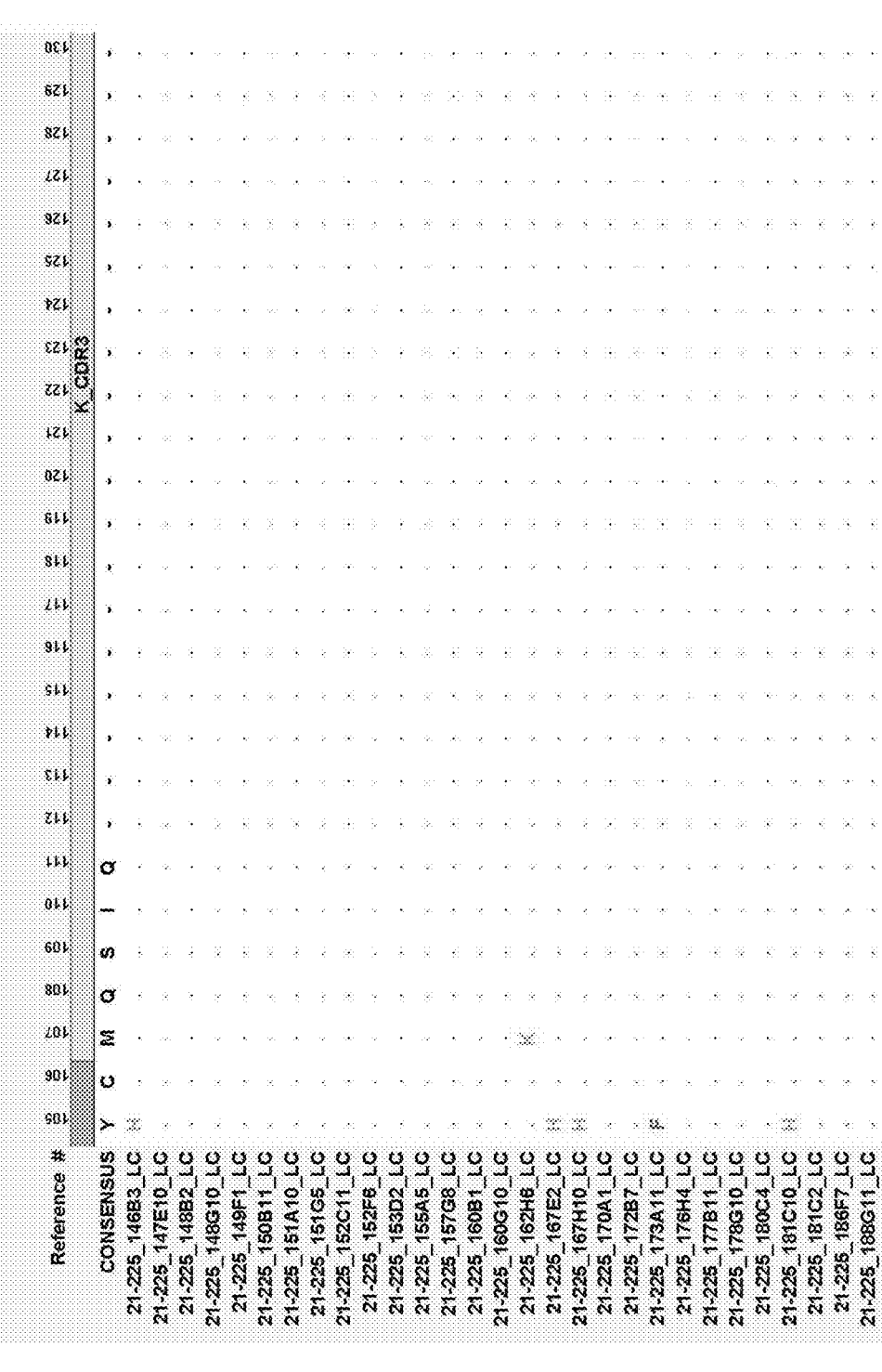
Figure 57:
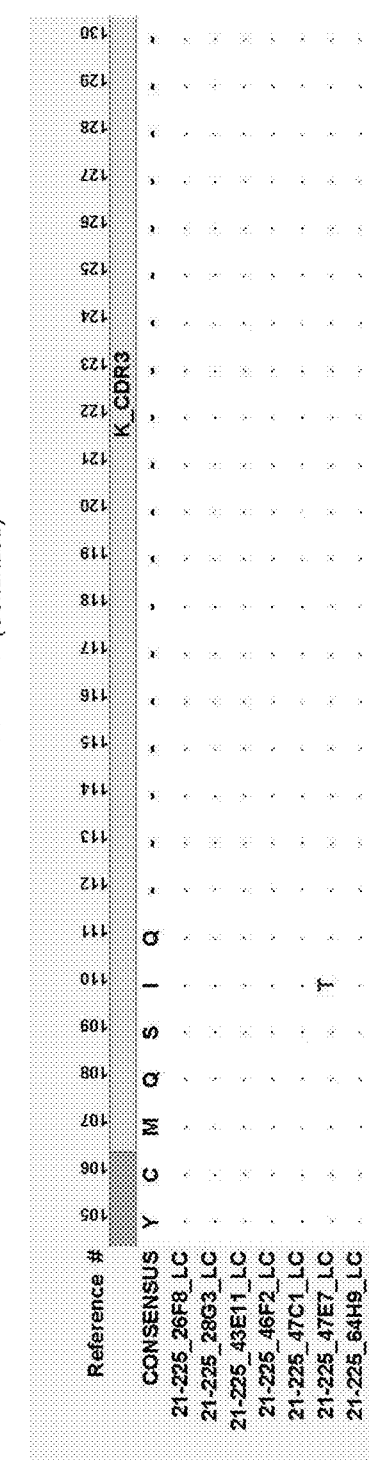
Figure 57:
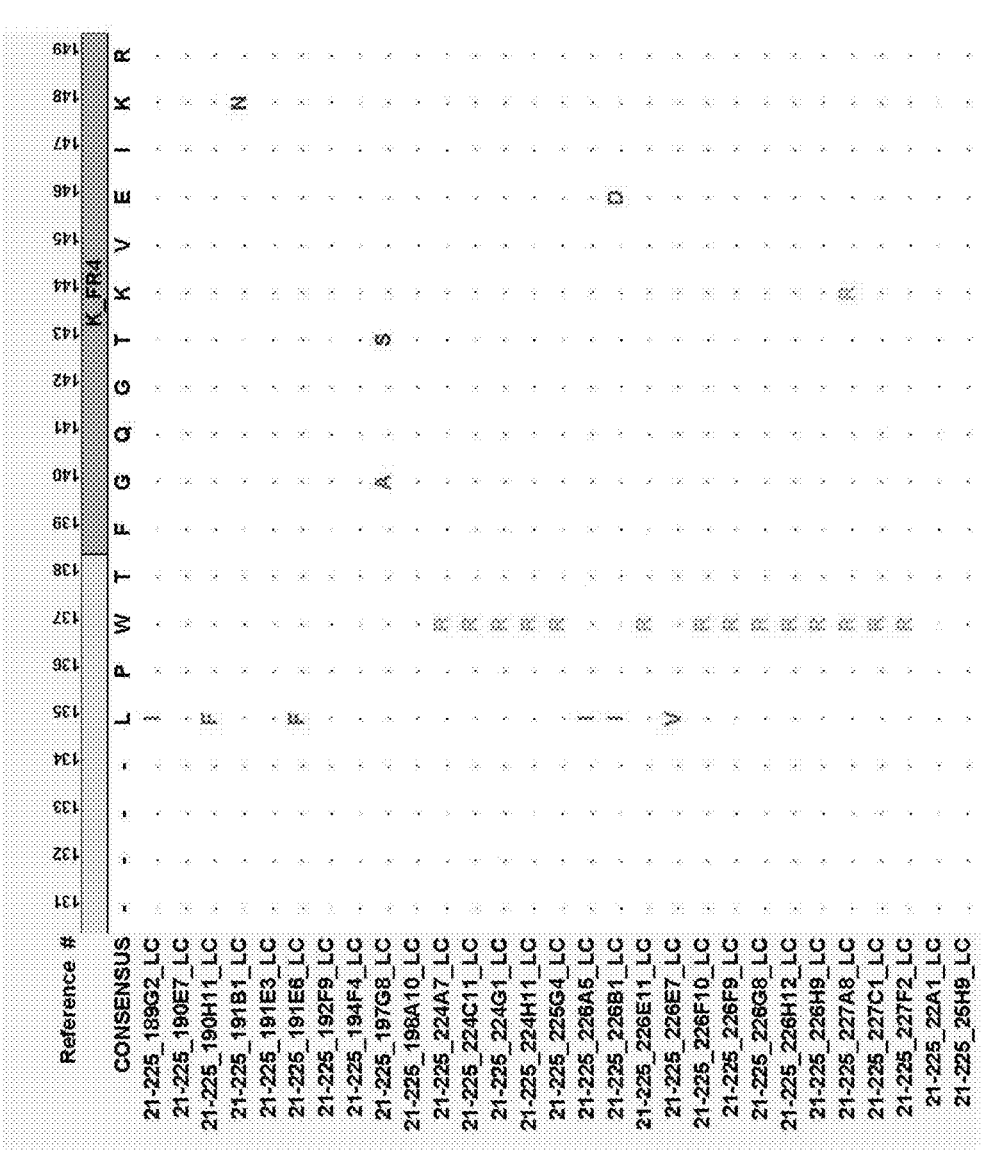
Figure 57:
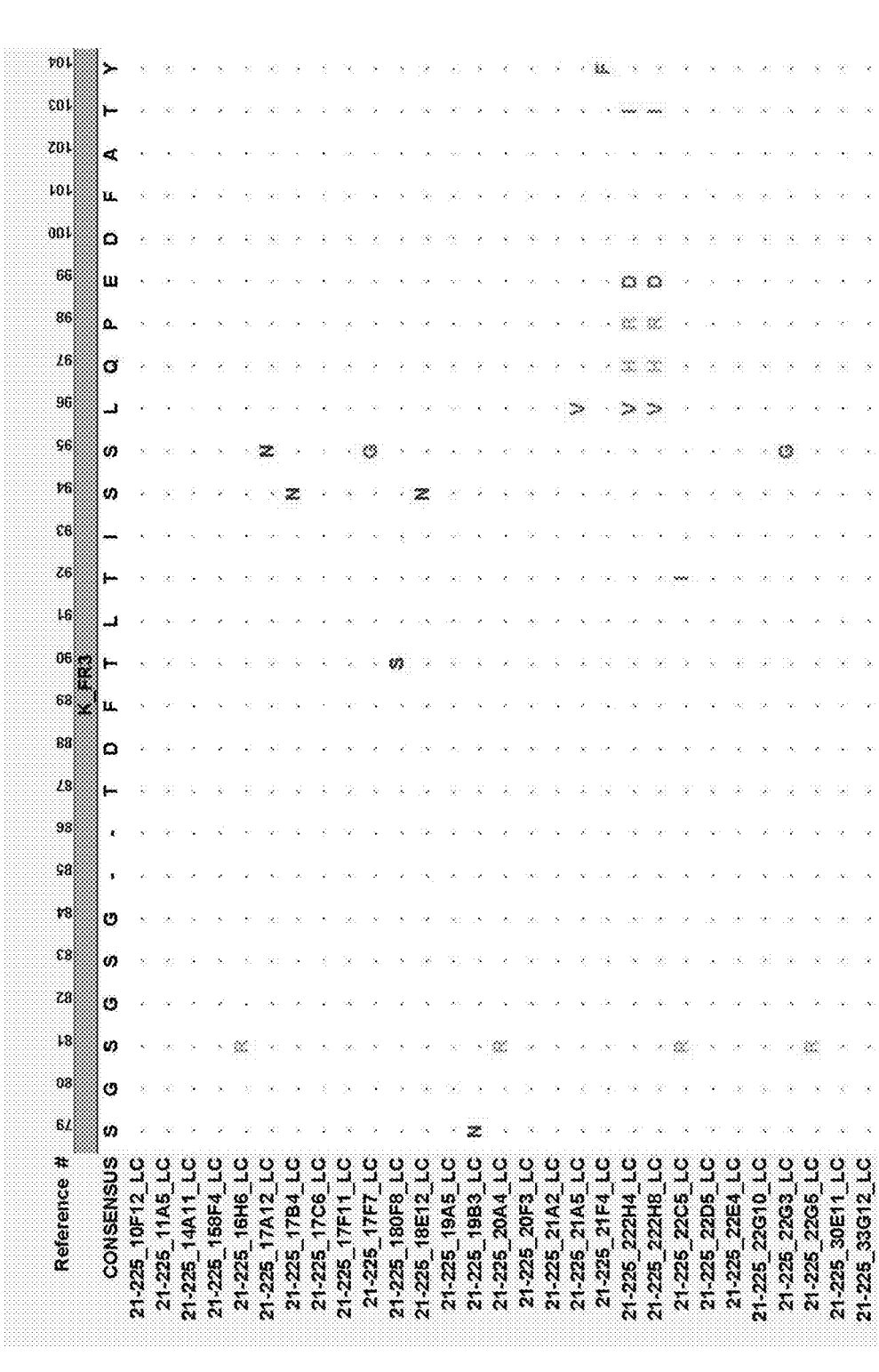
Figure 57:
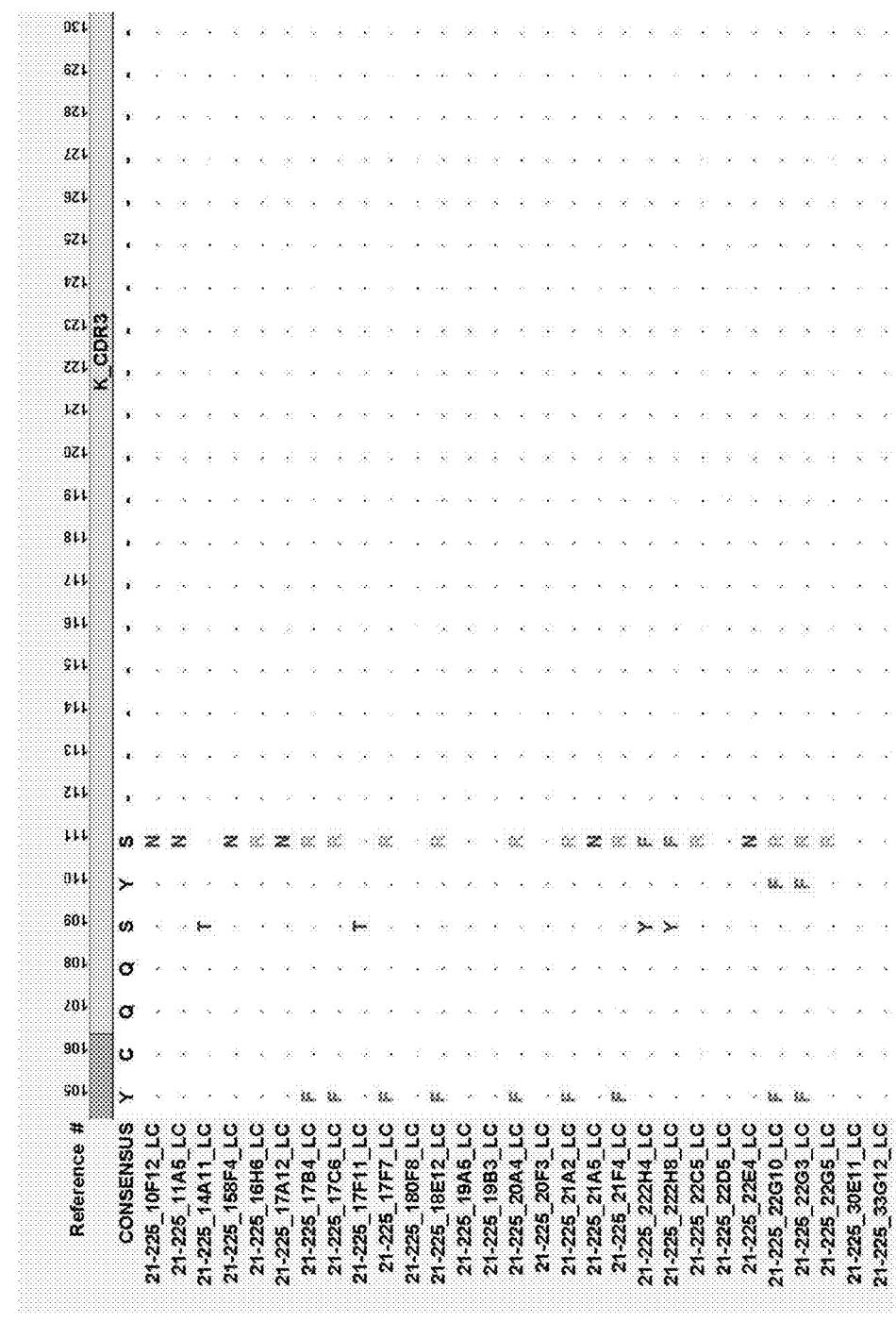
Figure 57:
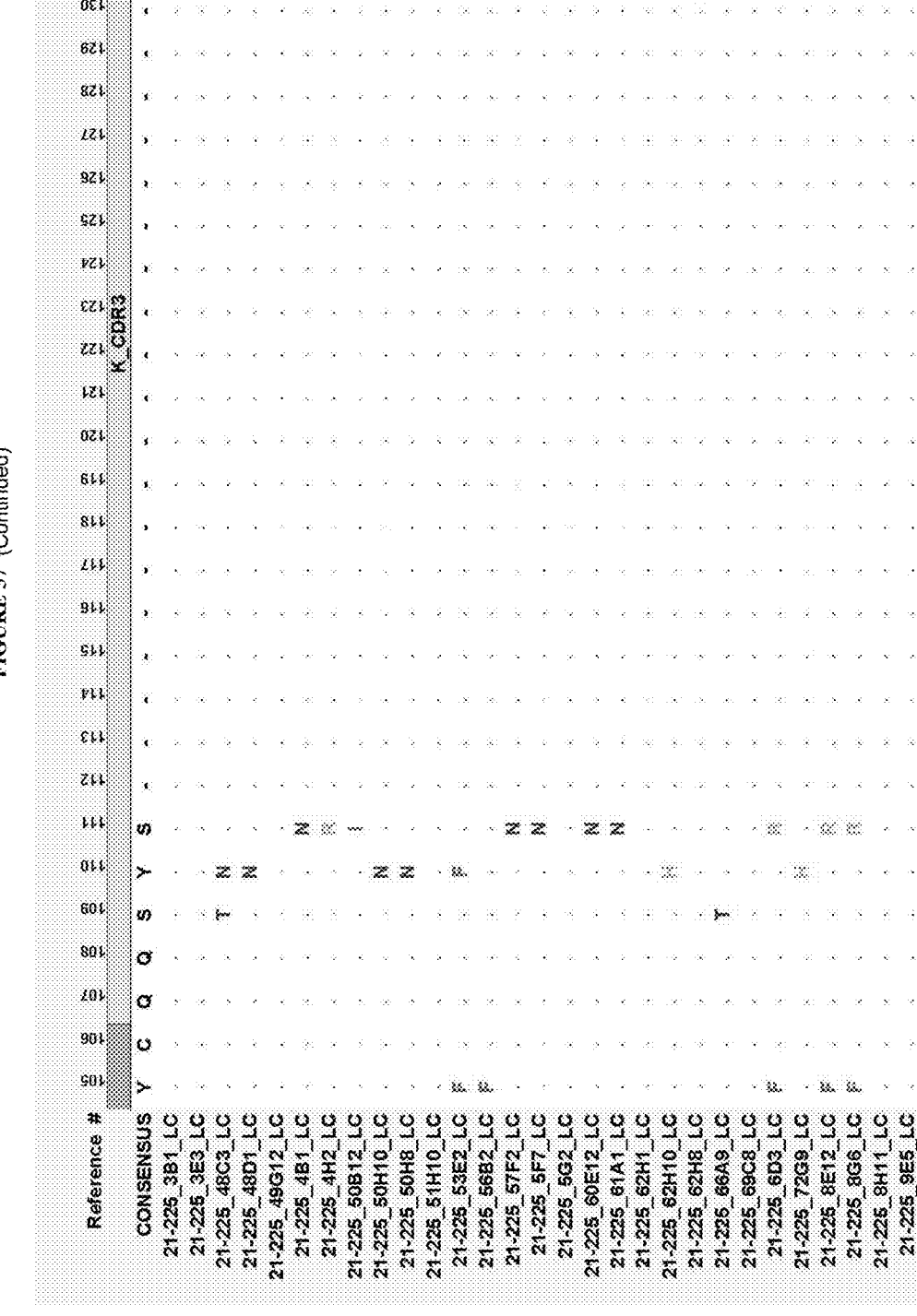
Figure 57:
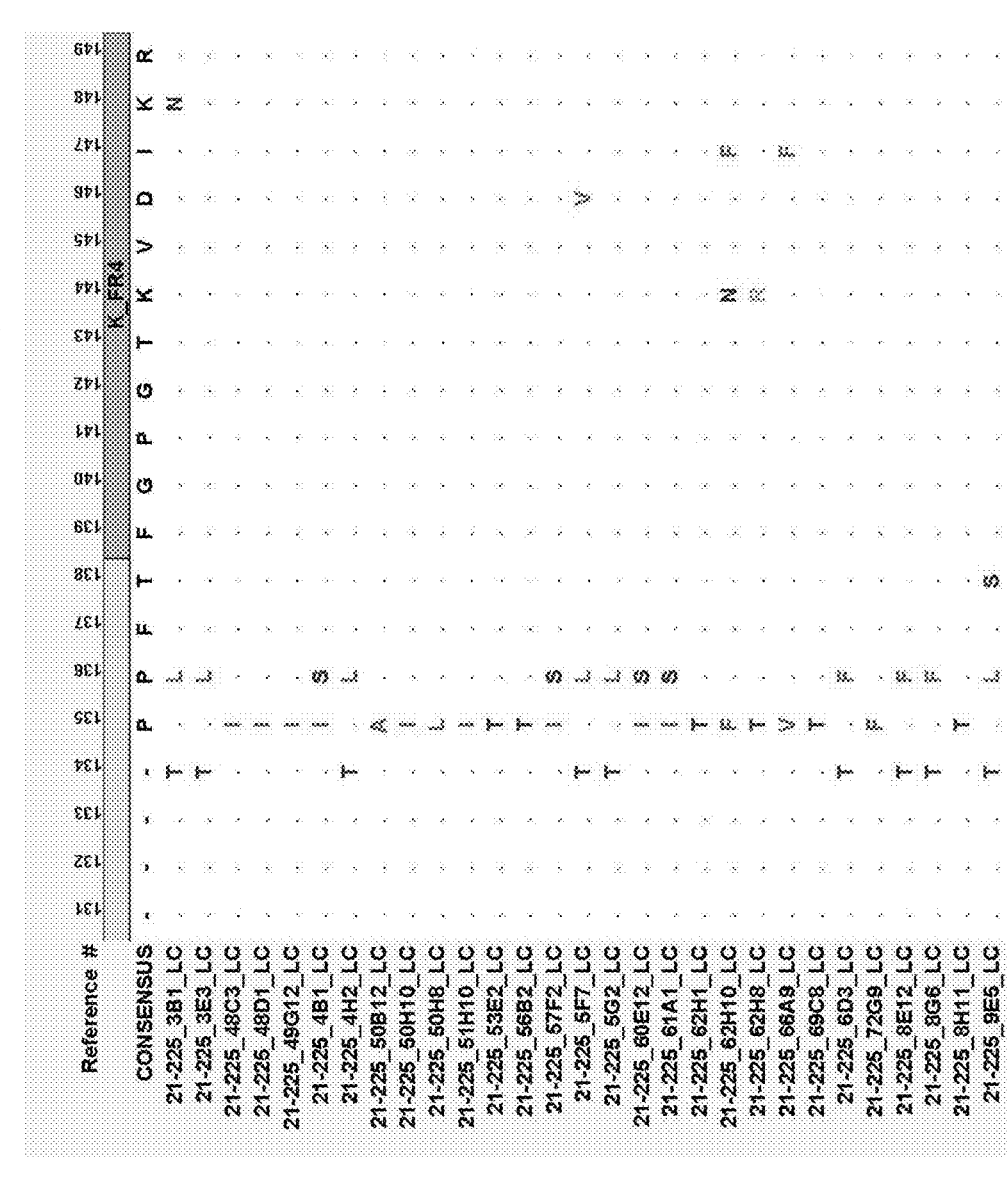
Figure 57:
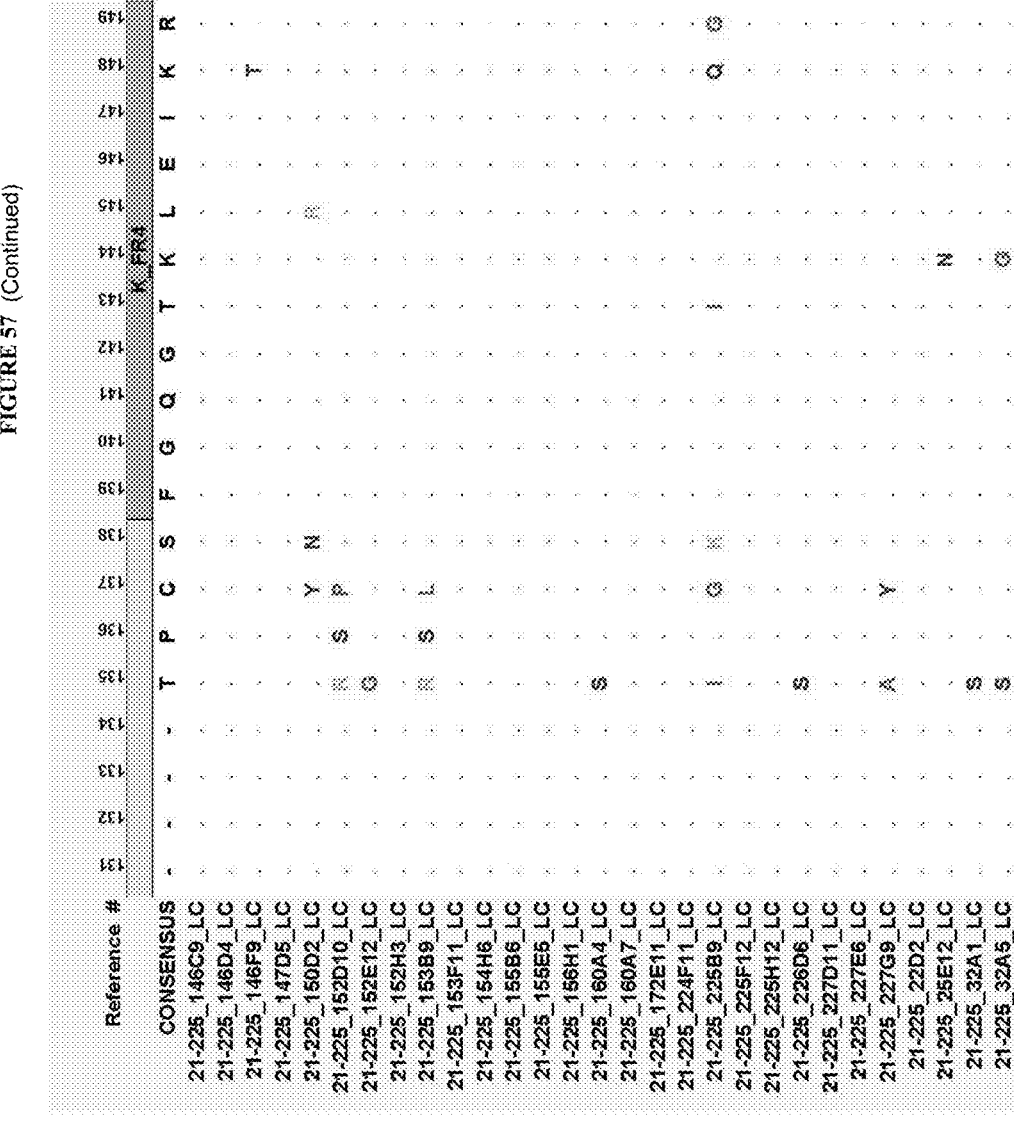
Figure 57:
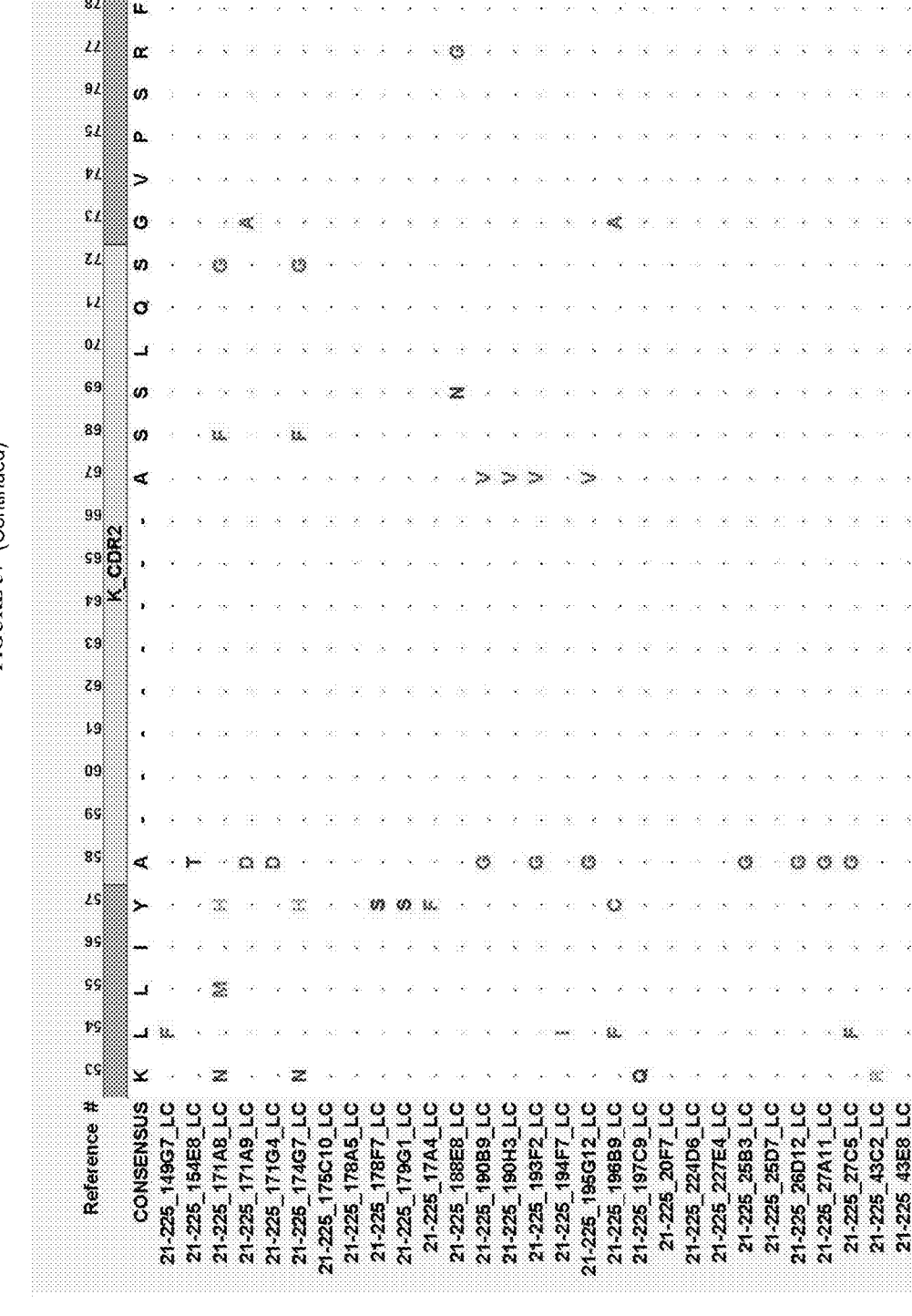
Figure 57:
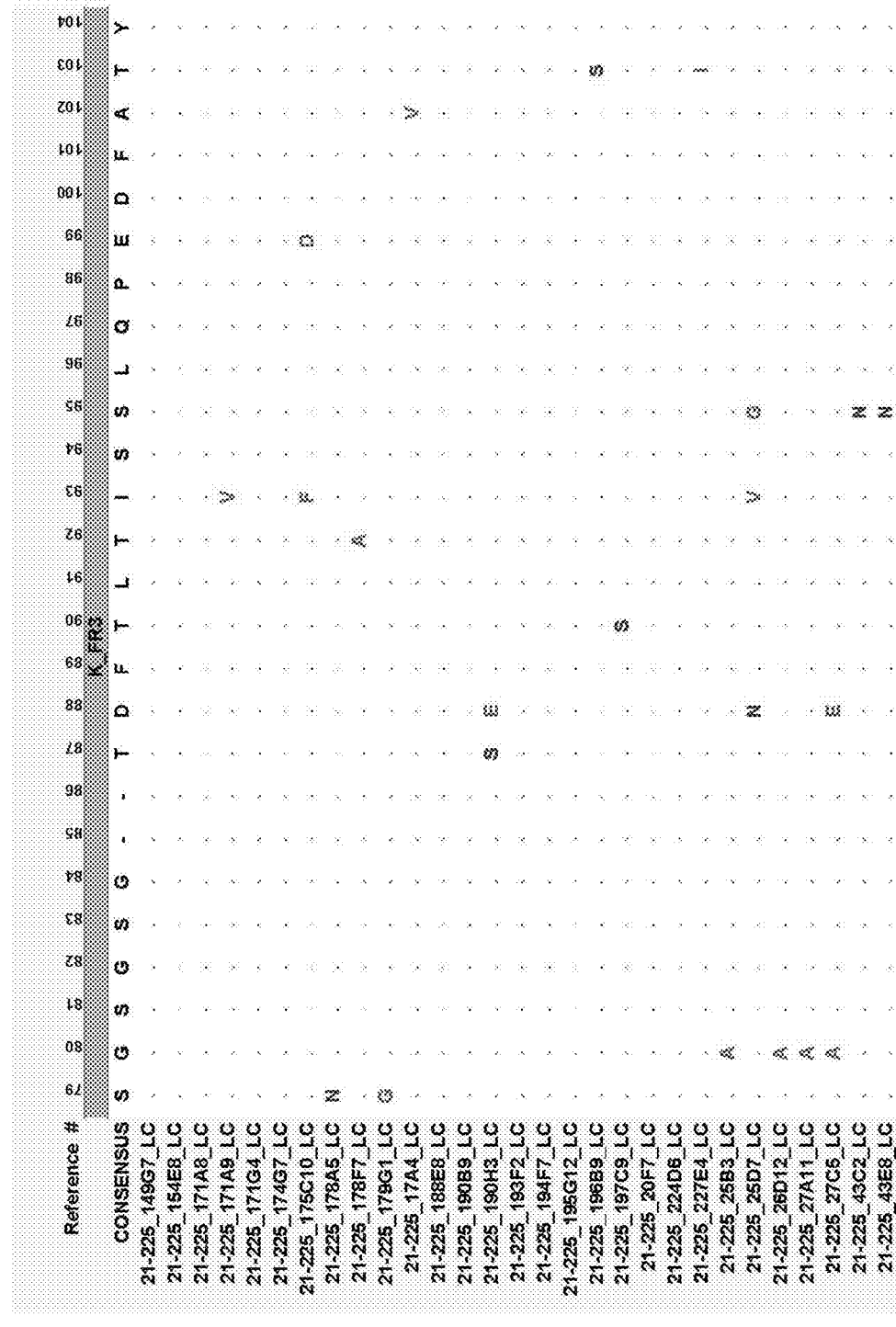
Figure 57:
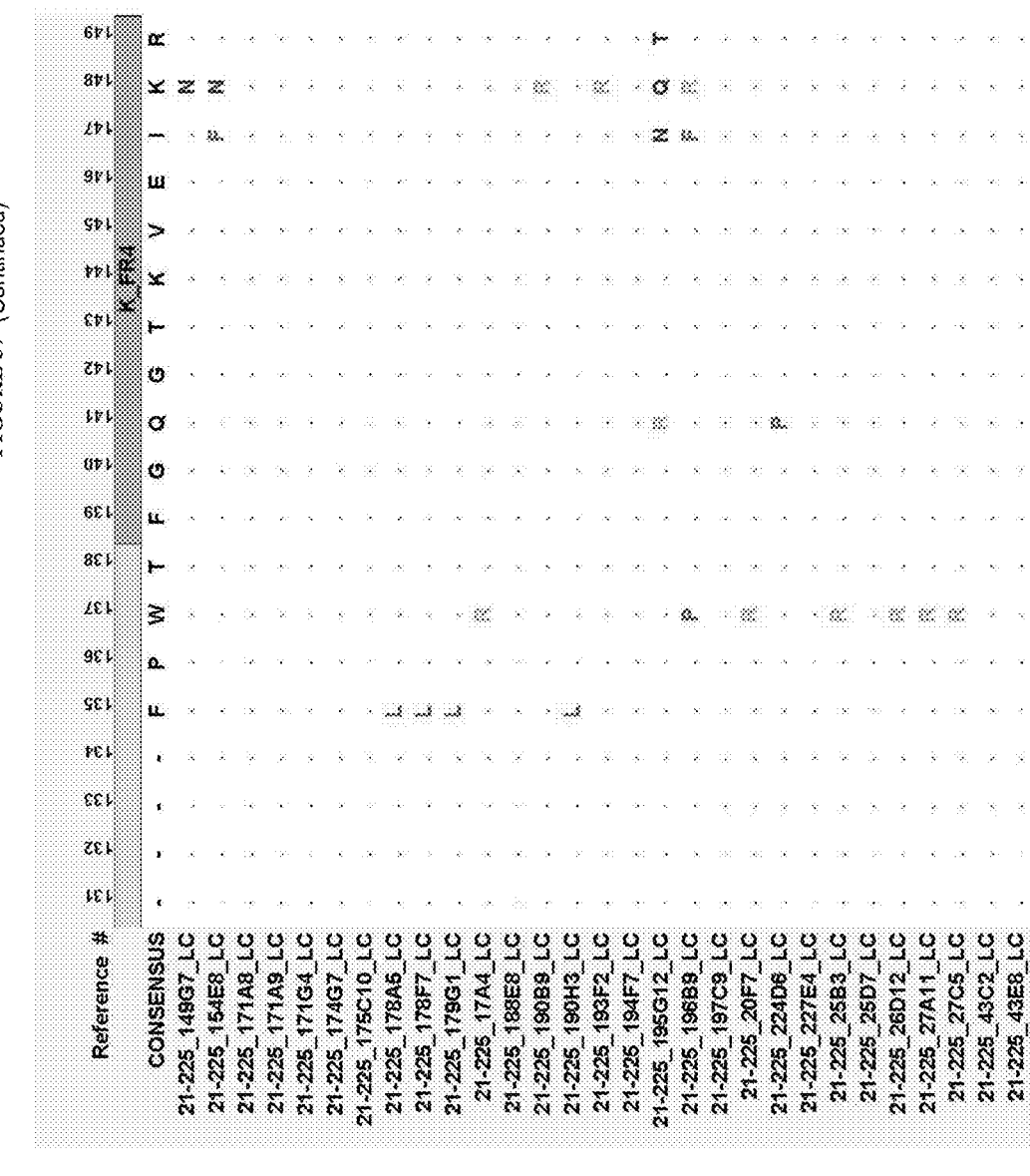
Figure 57:
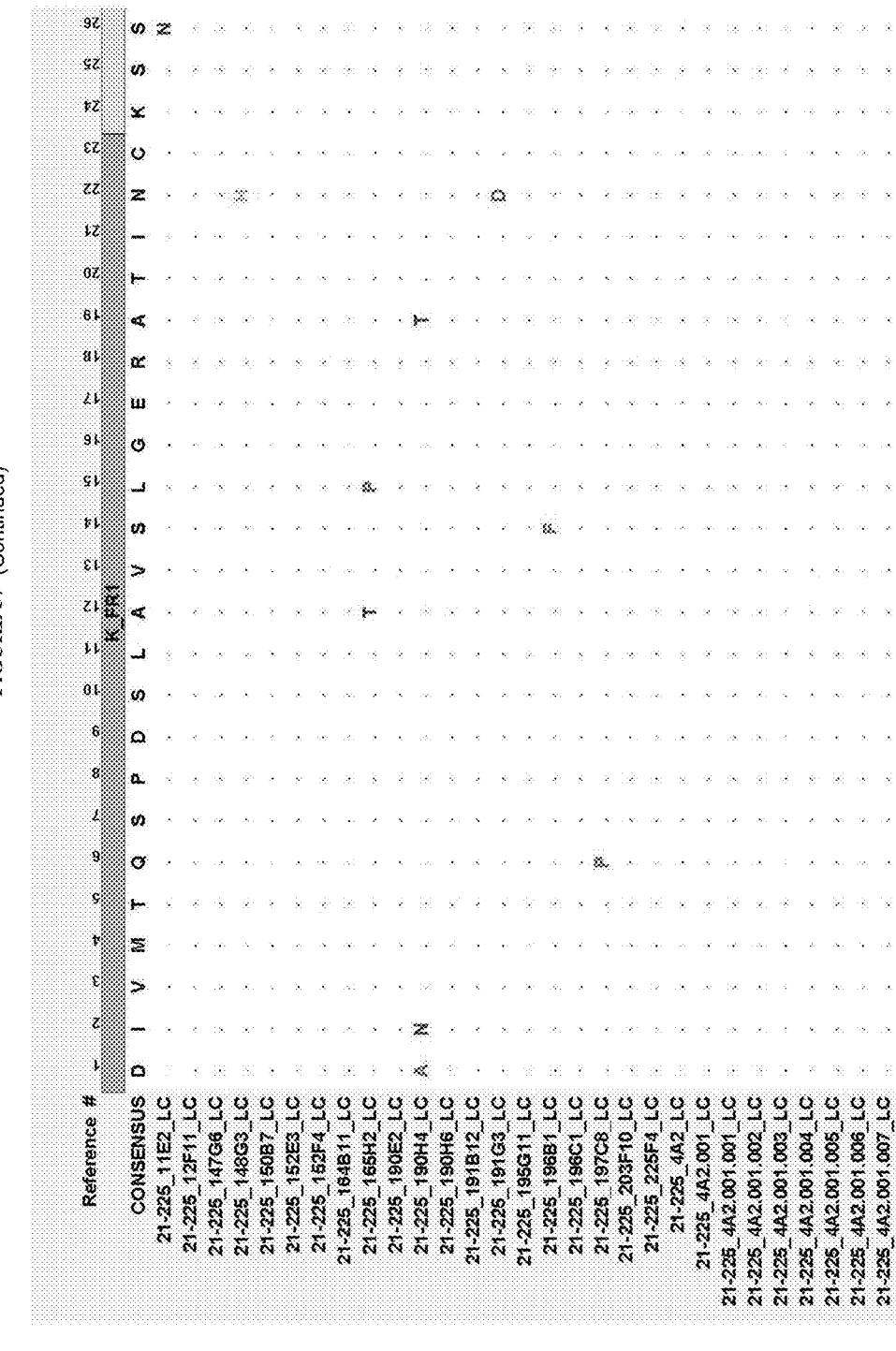
Figure 57:
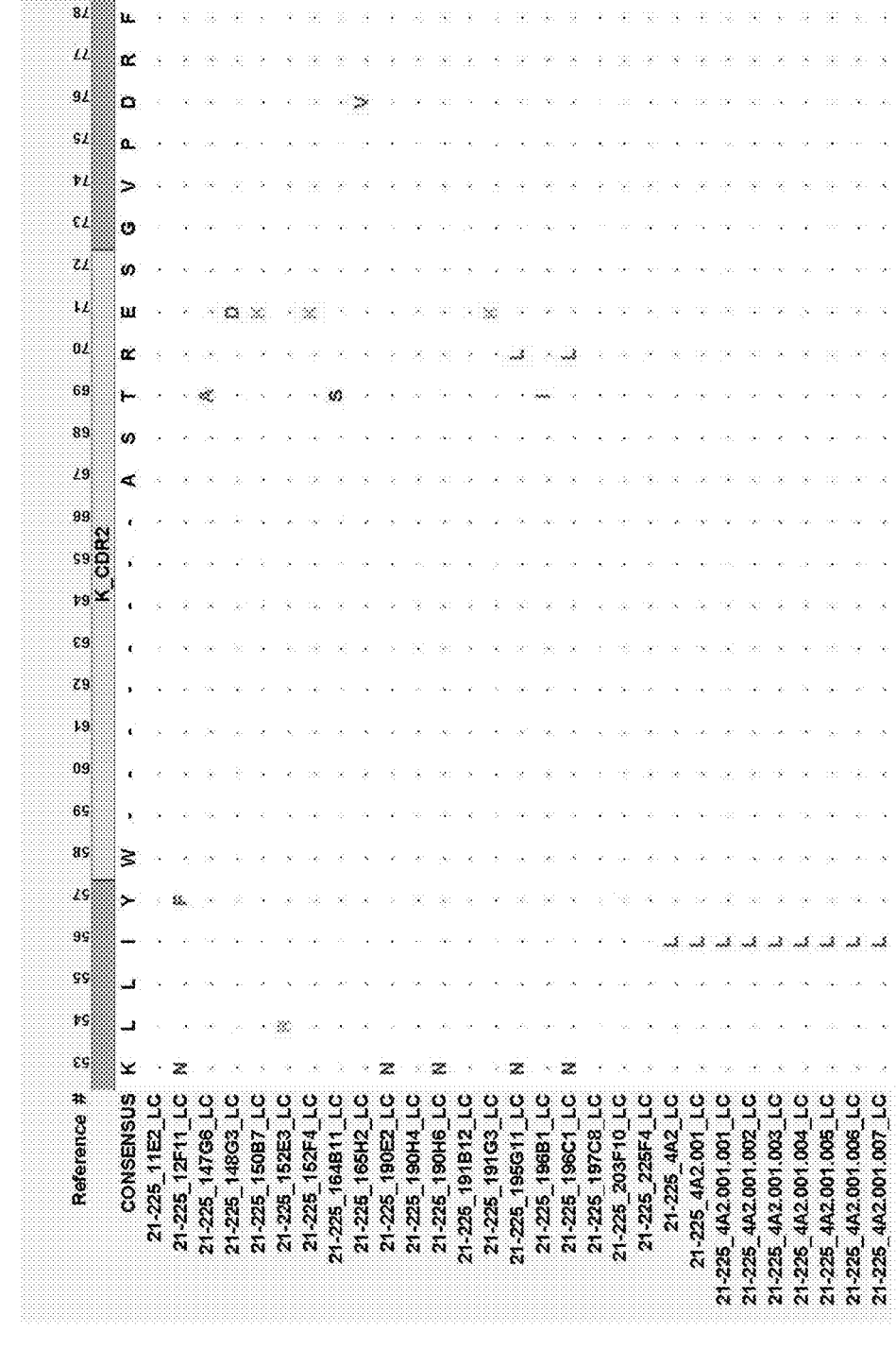
Figure 57:
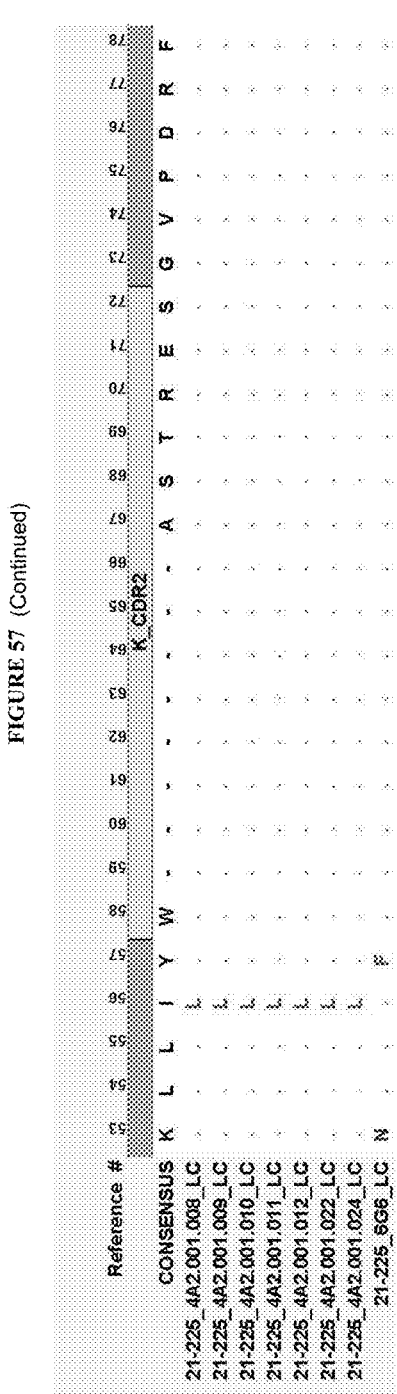
Figure 57:
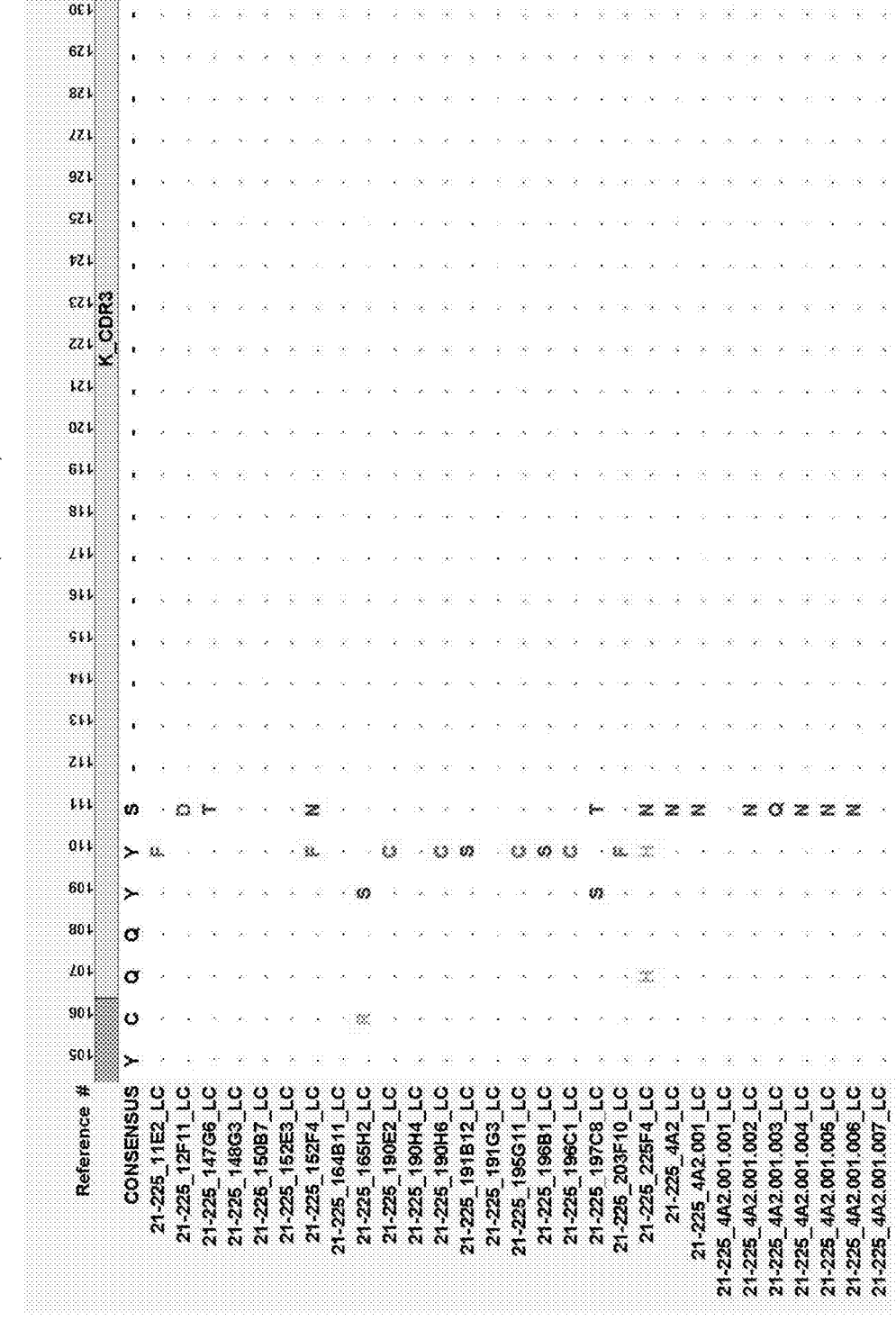
Figure 57:
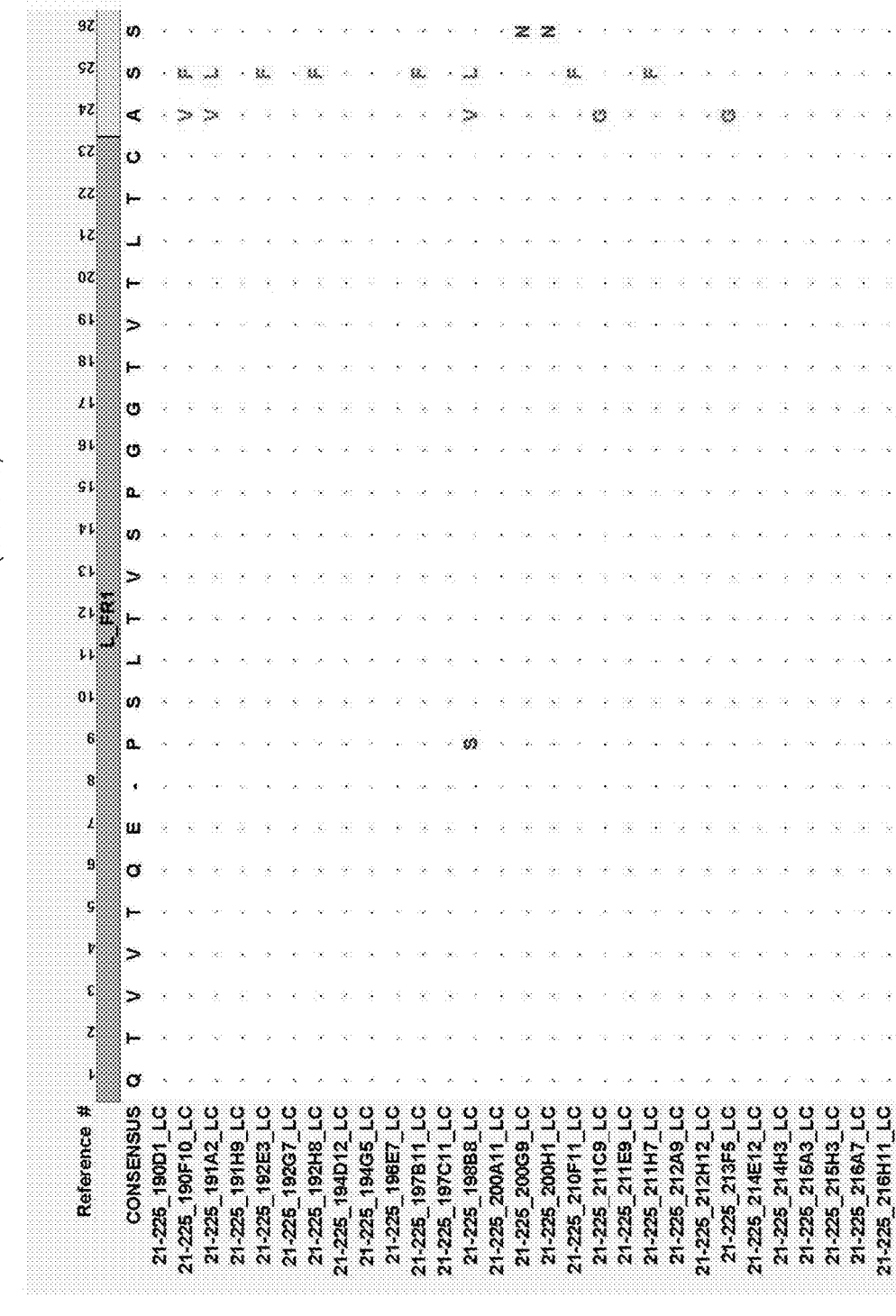
Figure 57:
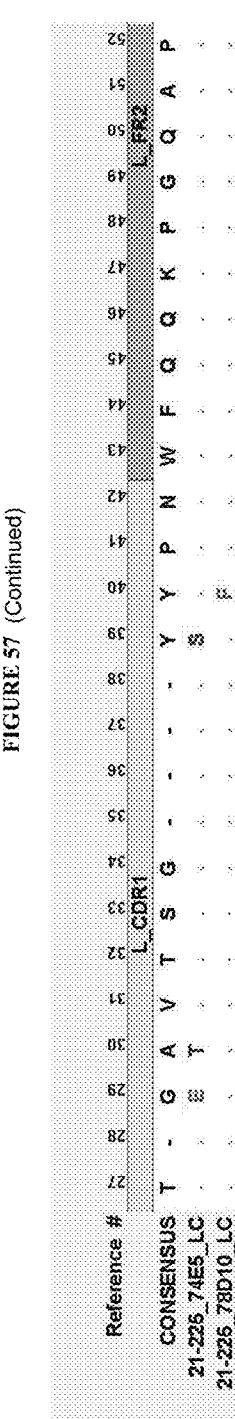
Figure 57:
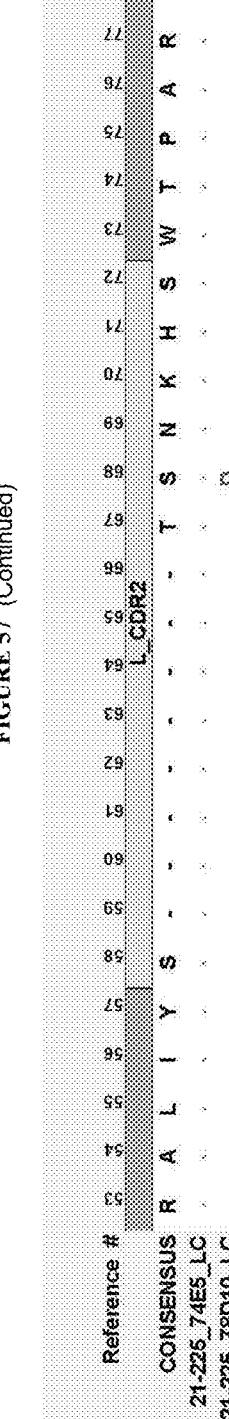
Figure 57:
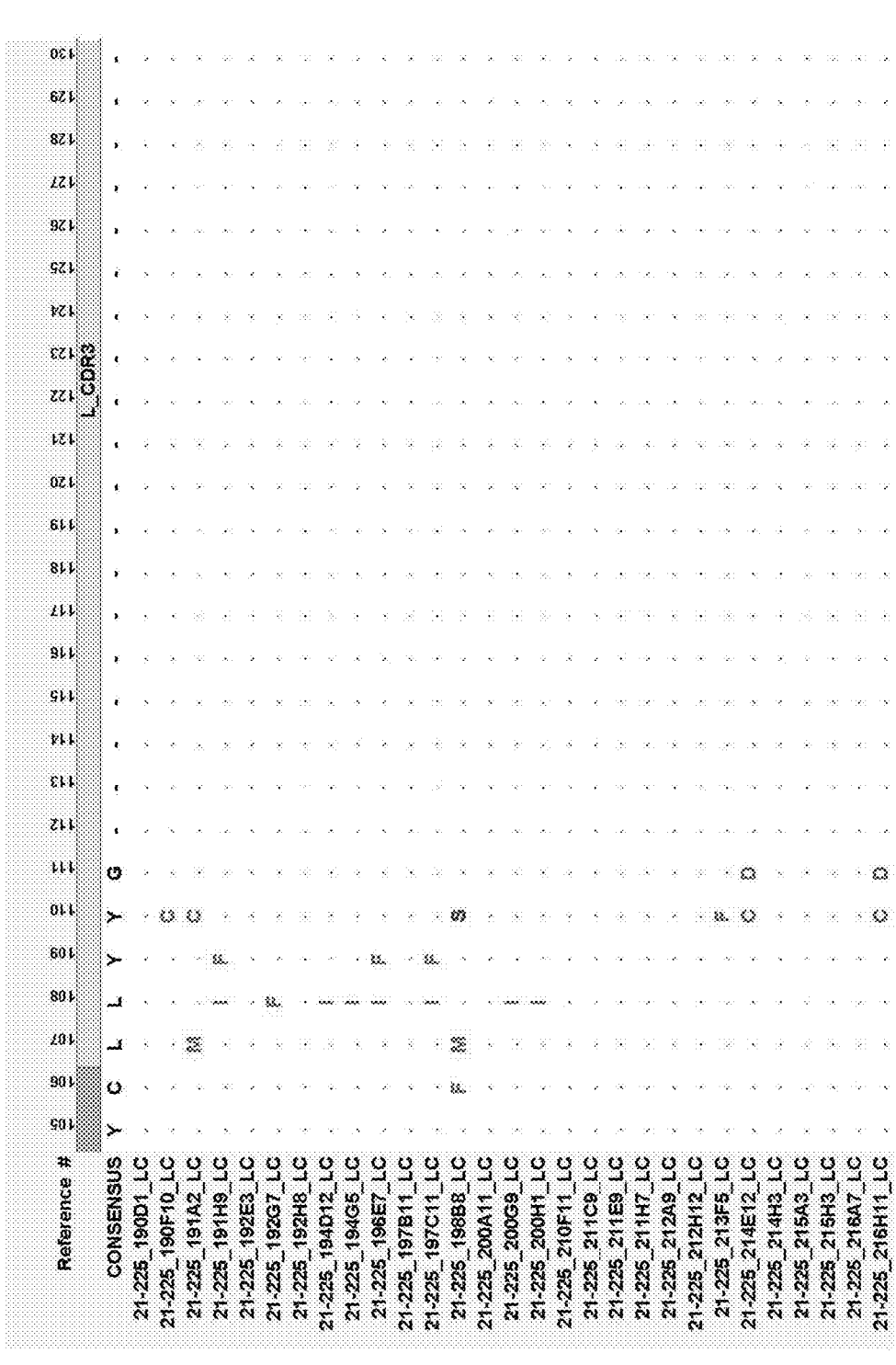
Figure 57:
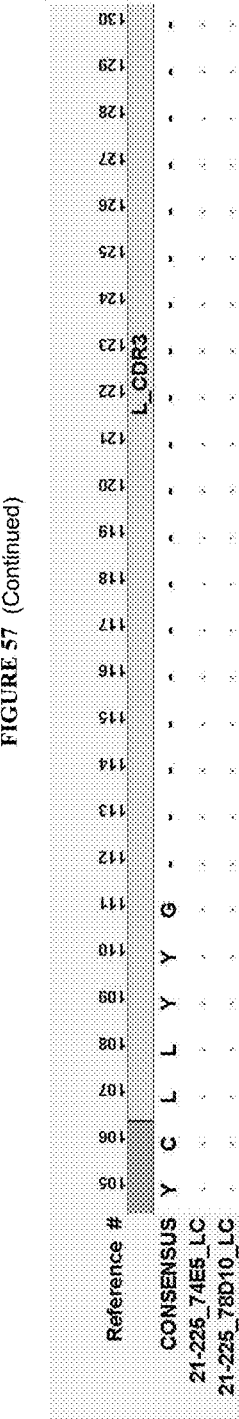
Figure 57:
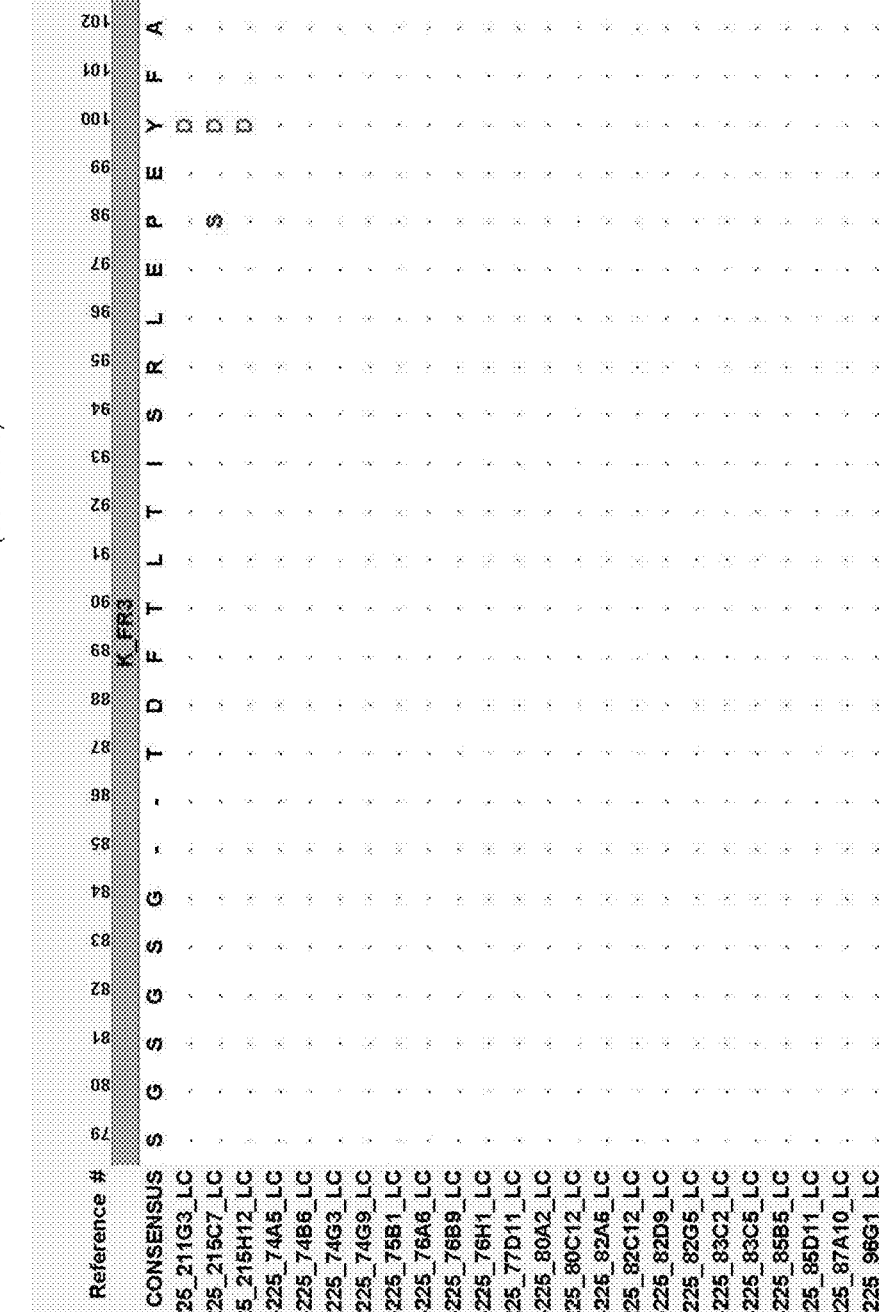
Figure 57:
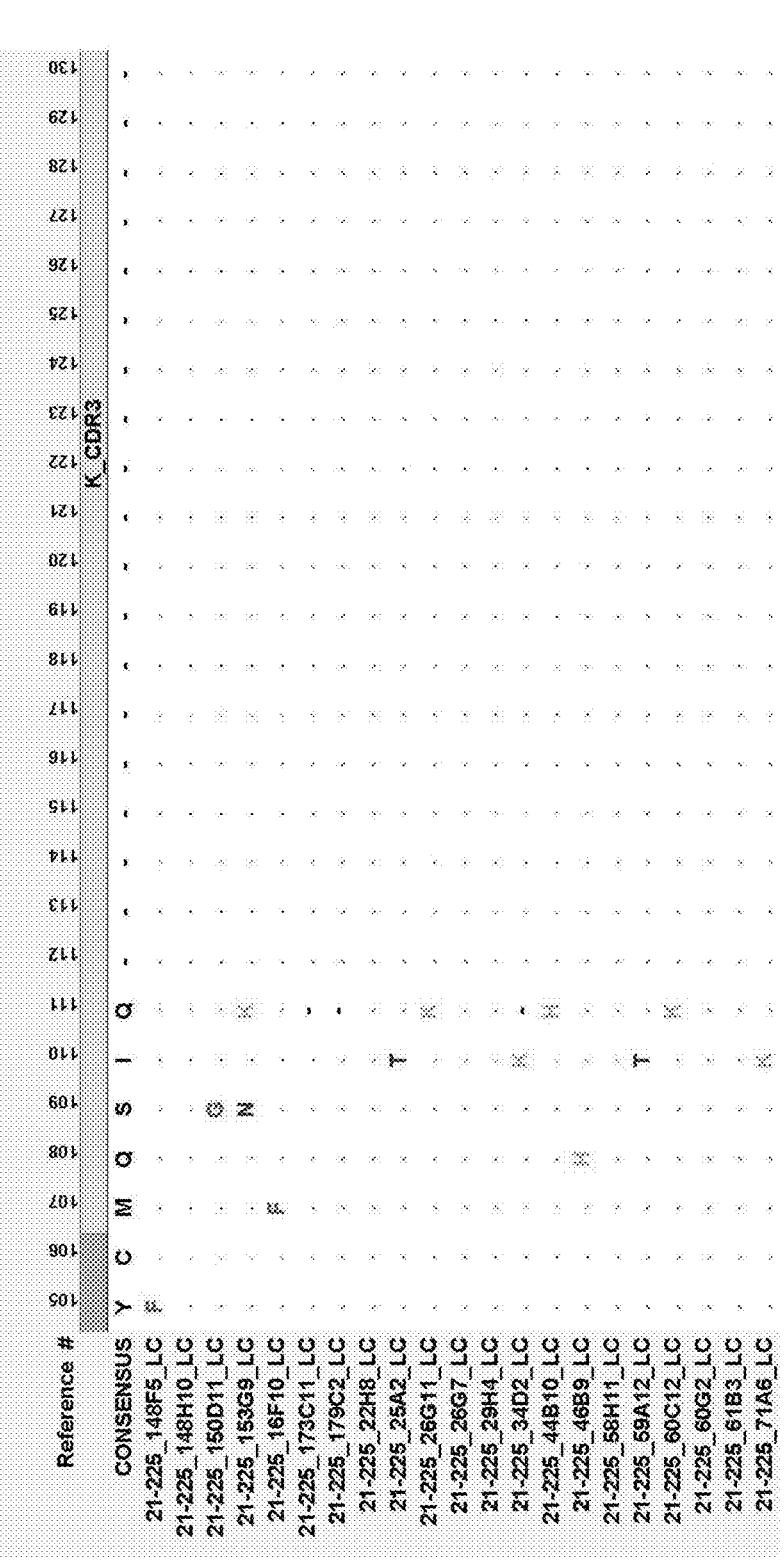
Figure 57:
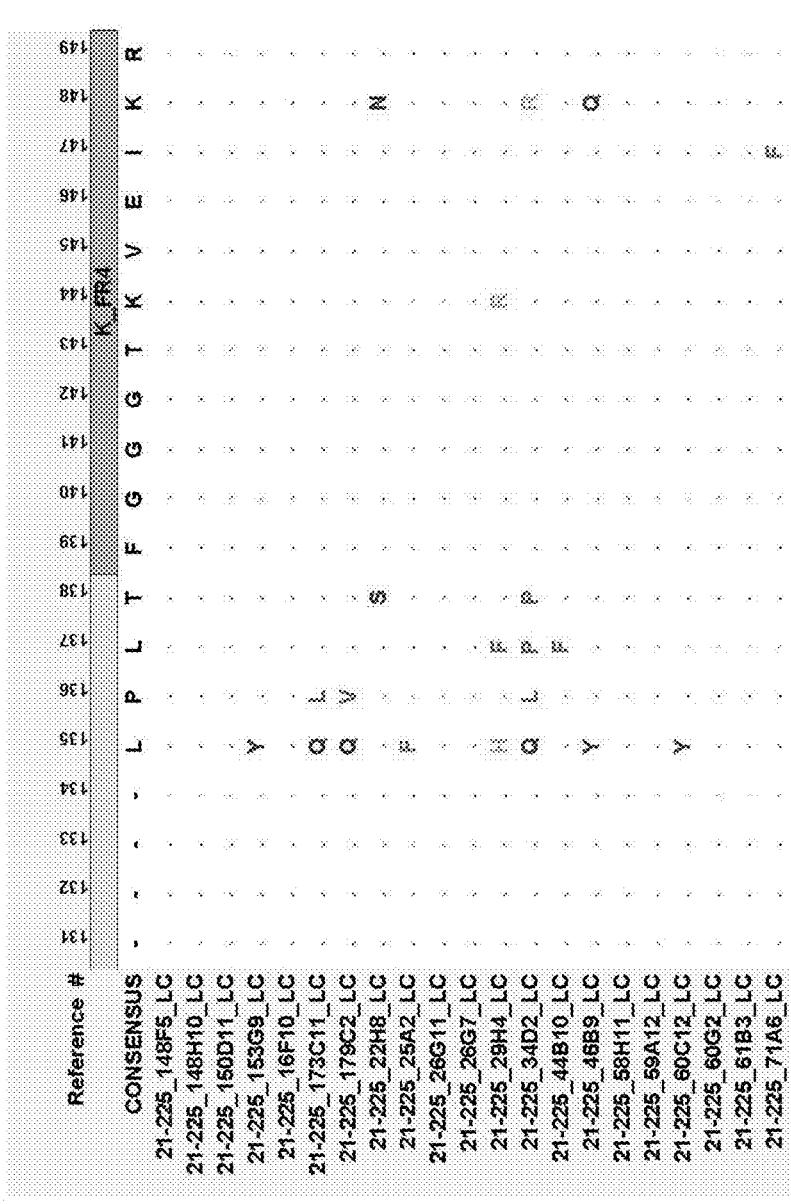
Figure 57:
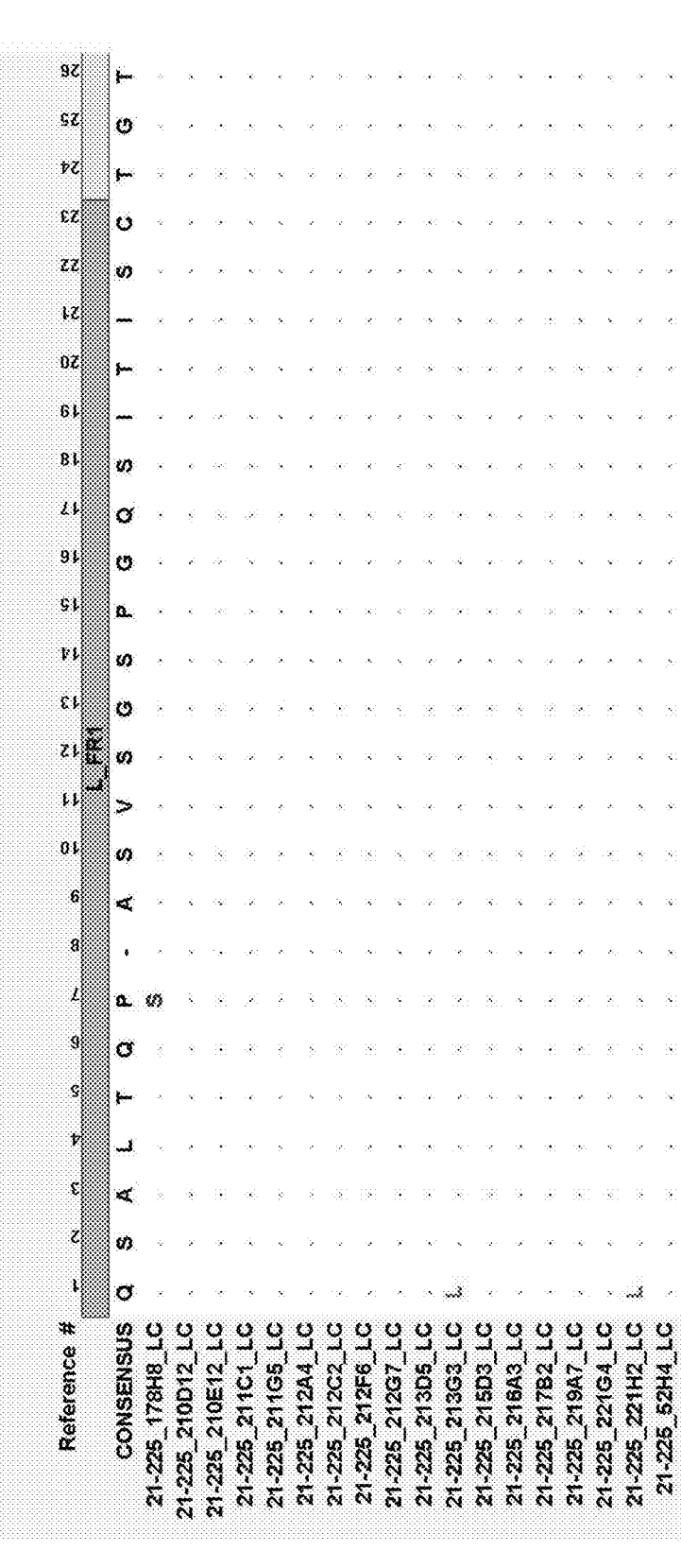
Figure 57:
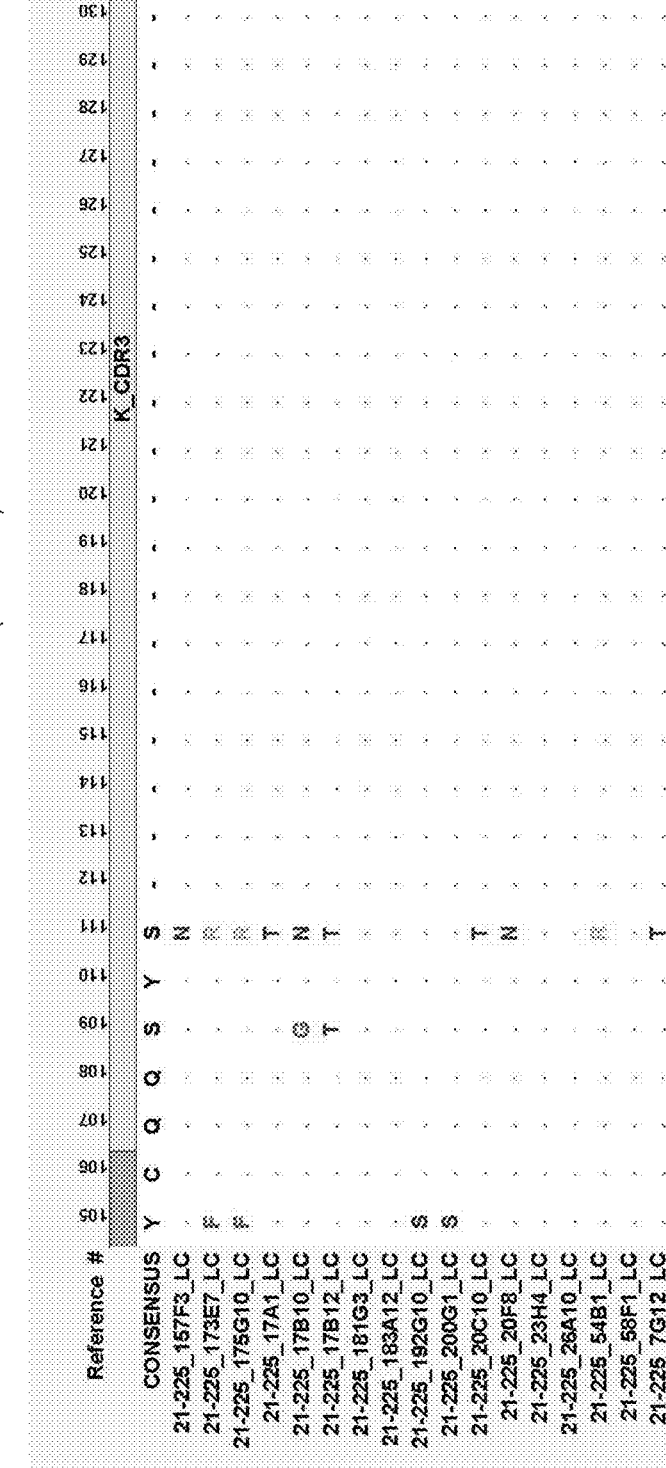
Figure 57:
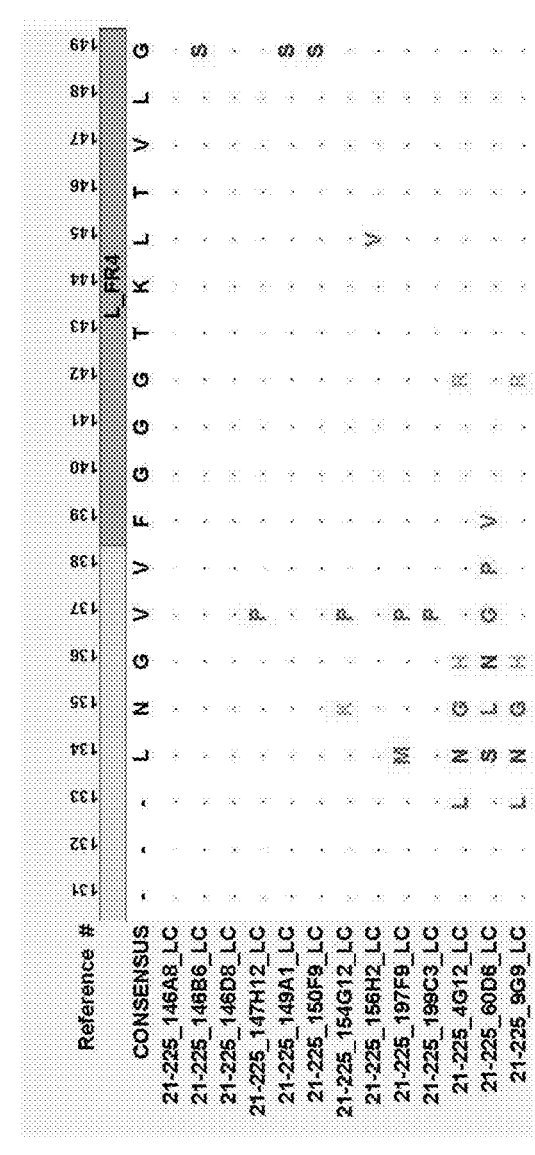
Figure 57:
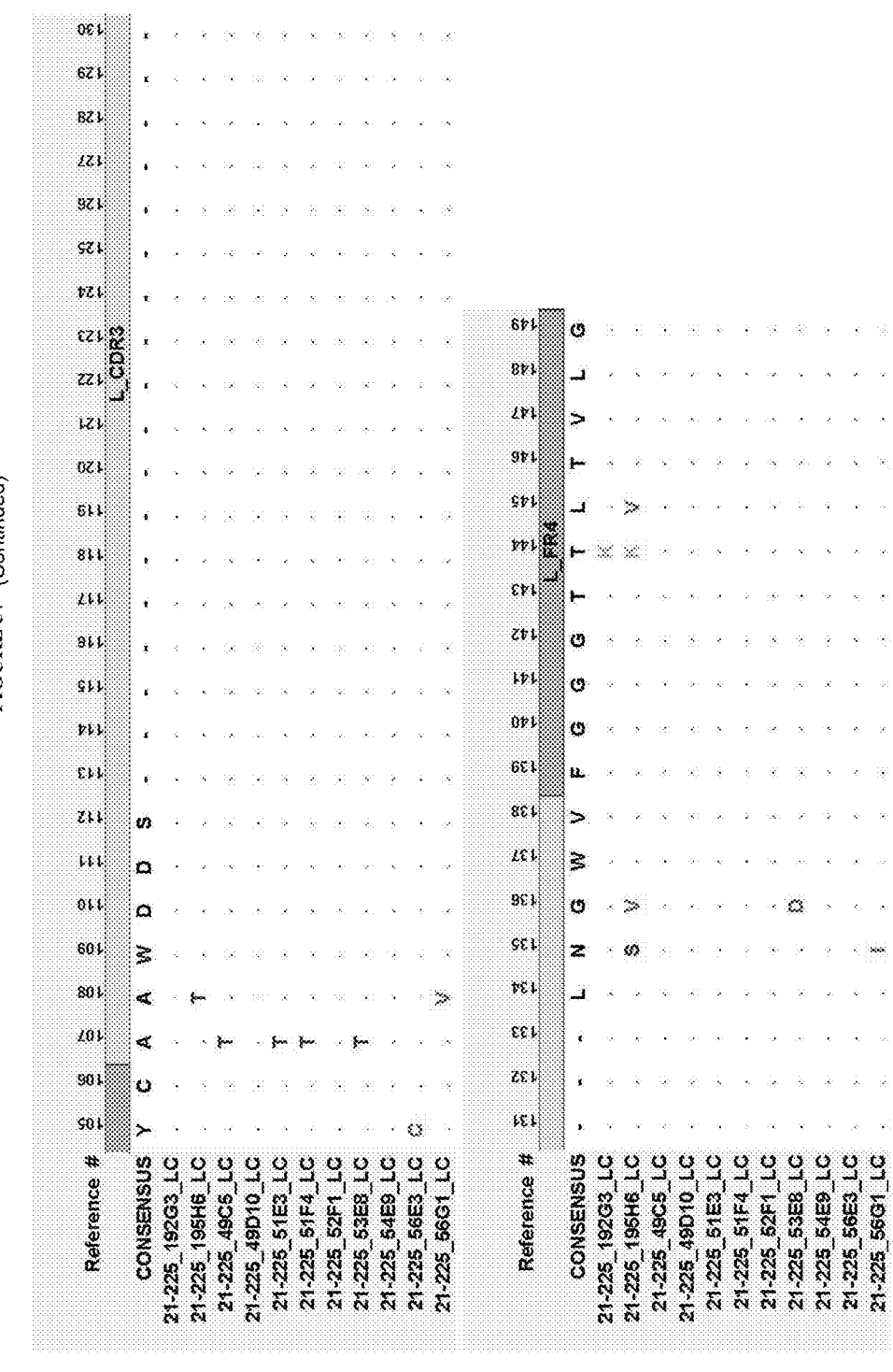
Figure 57:
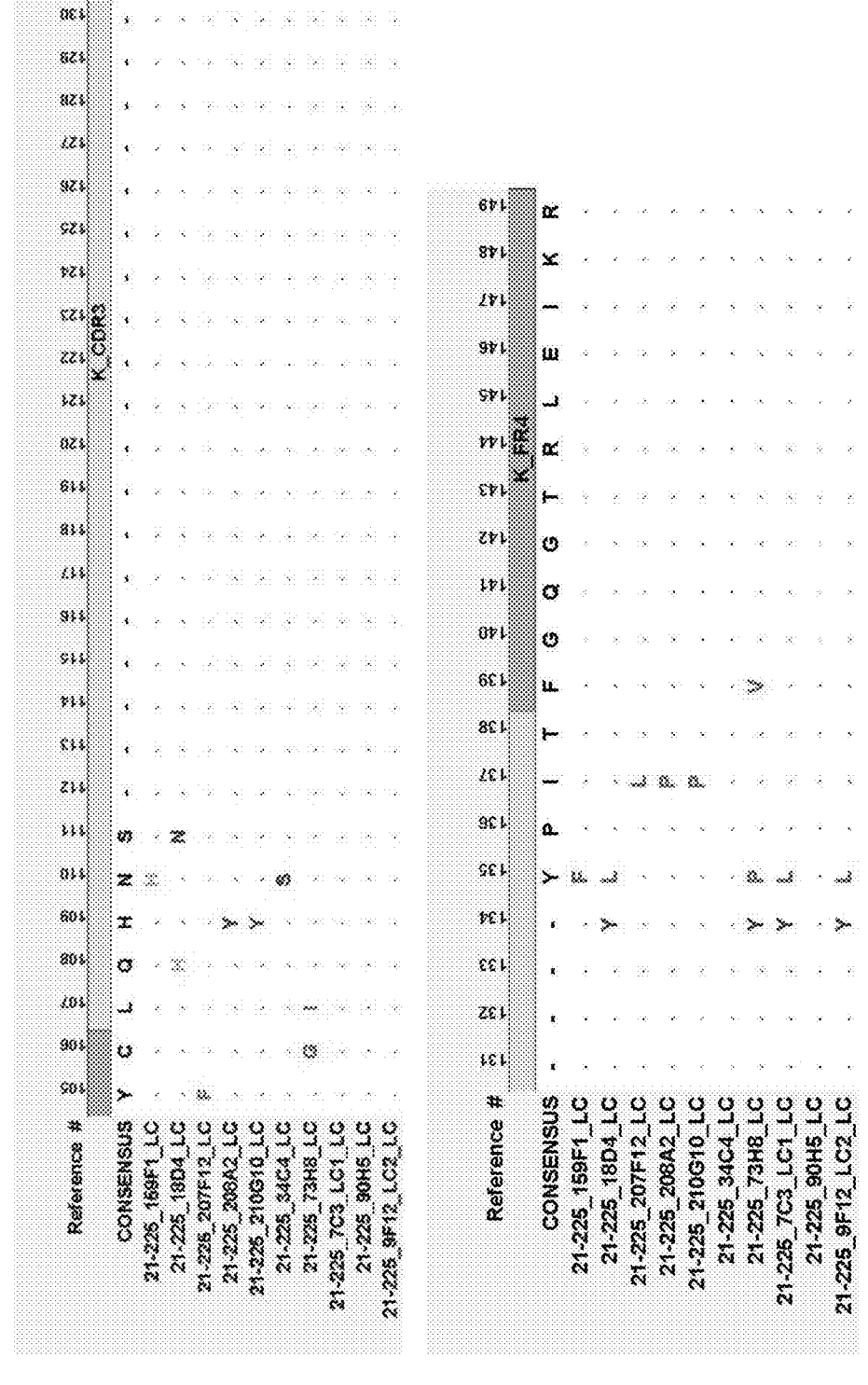
Figure 57:
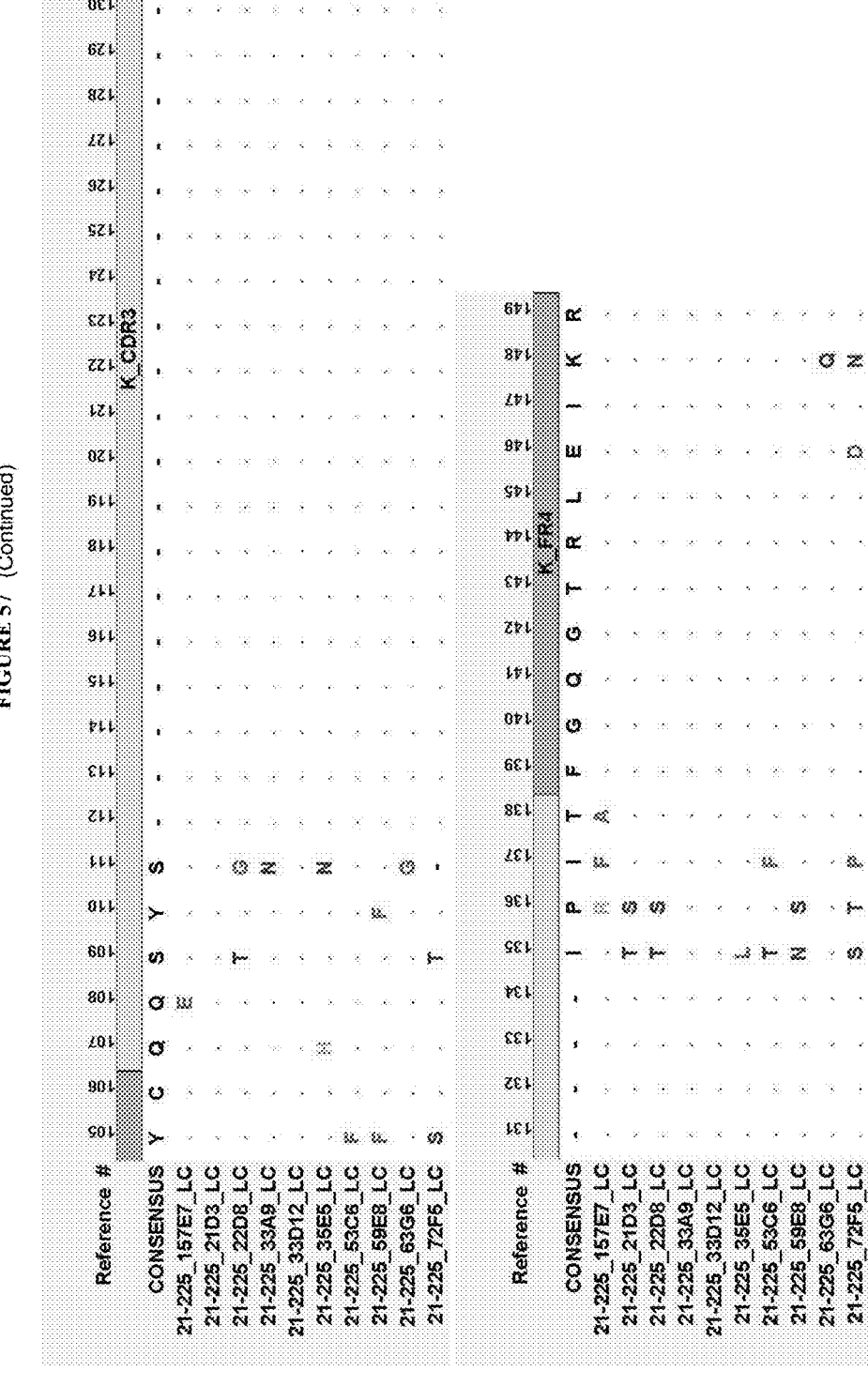
Figure 57:
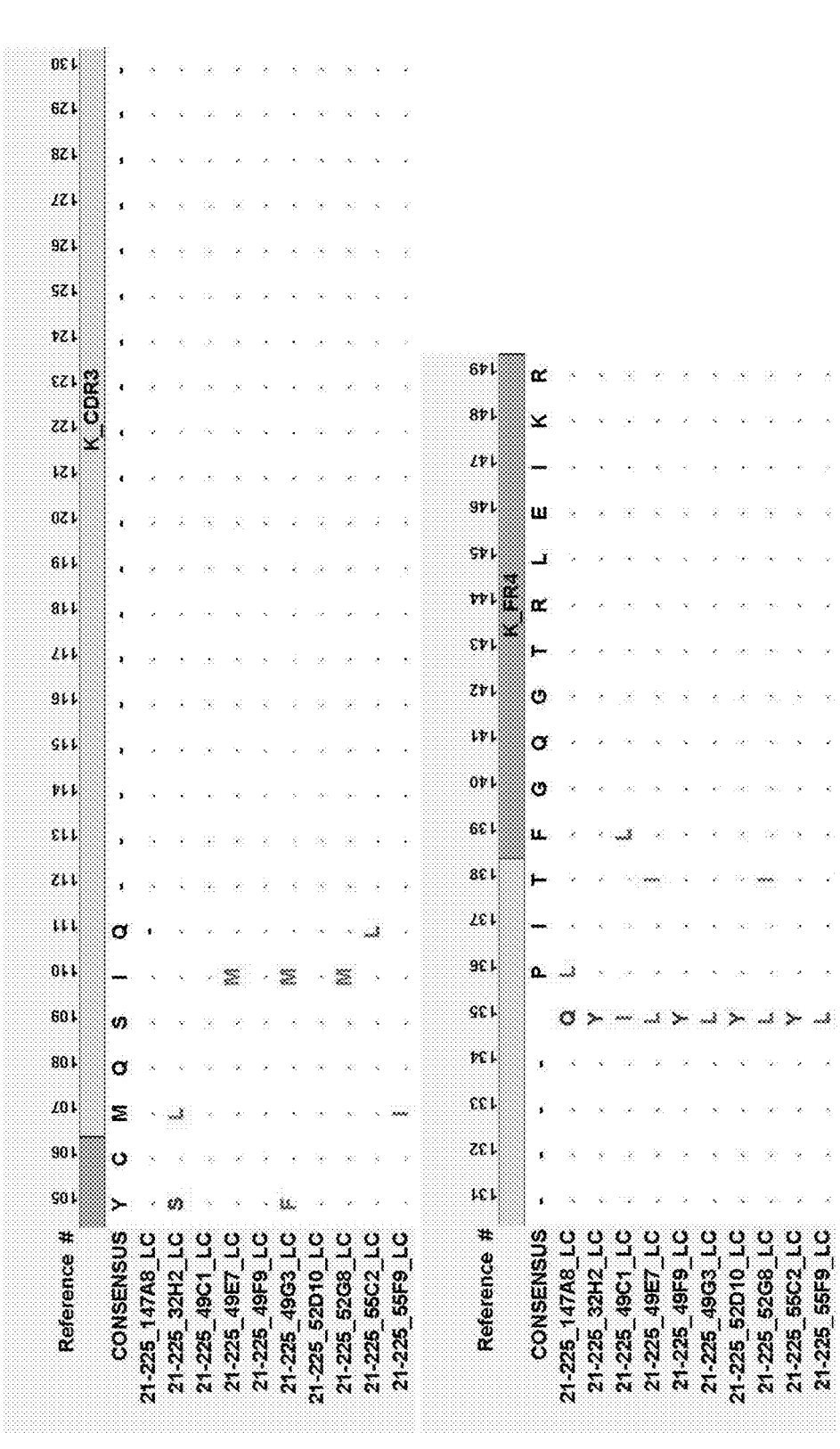
Figure 57:
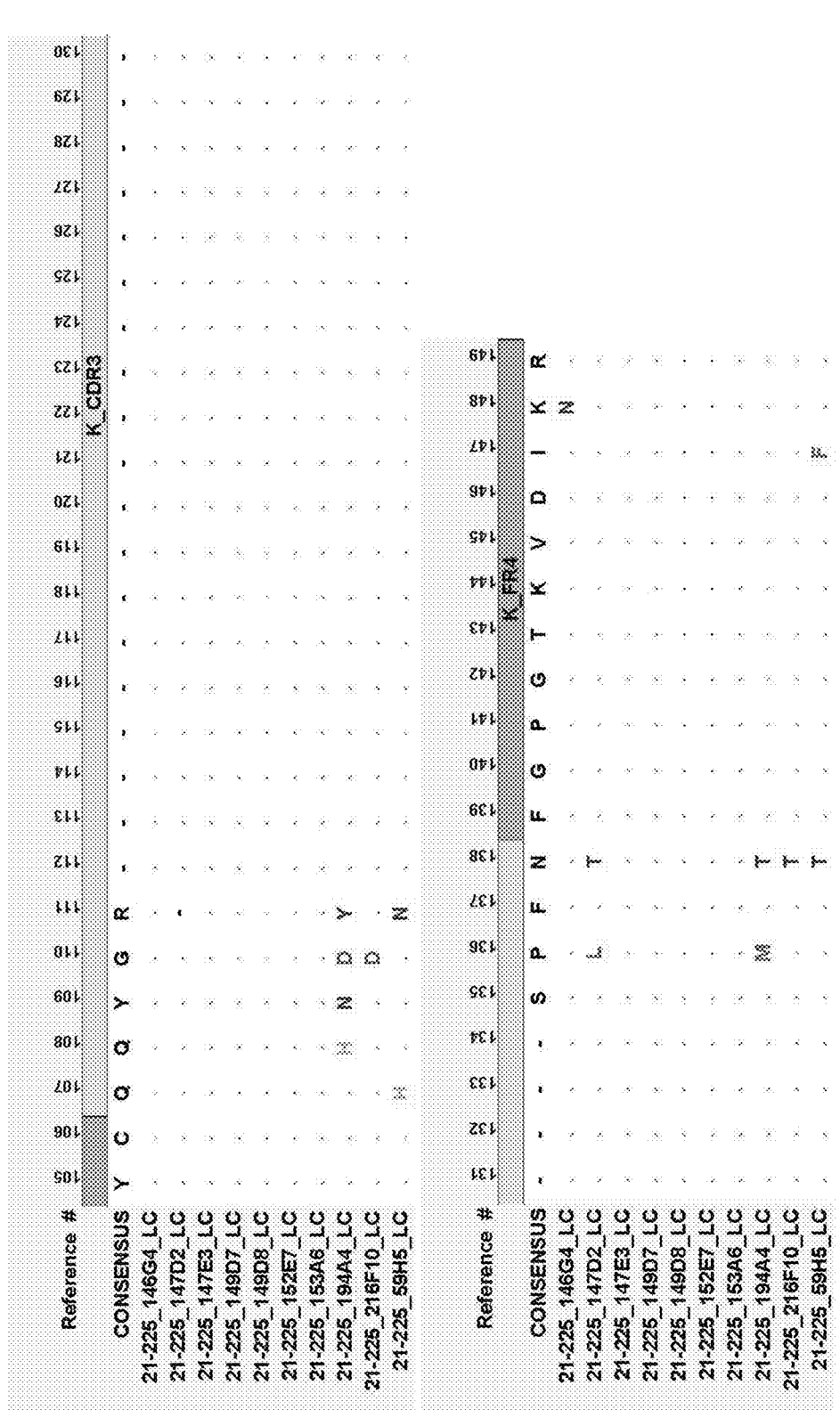
Figure 57:
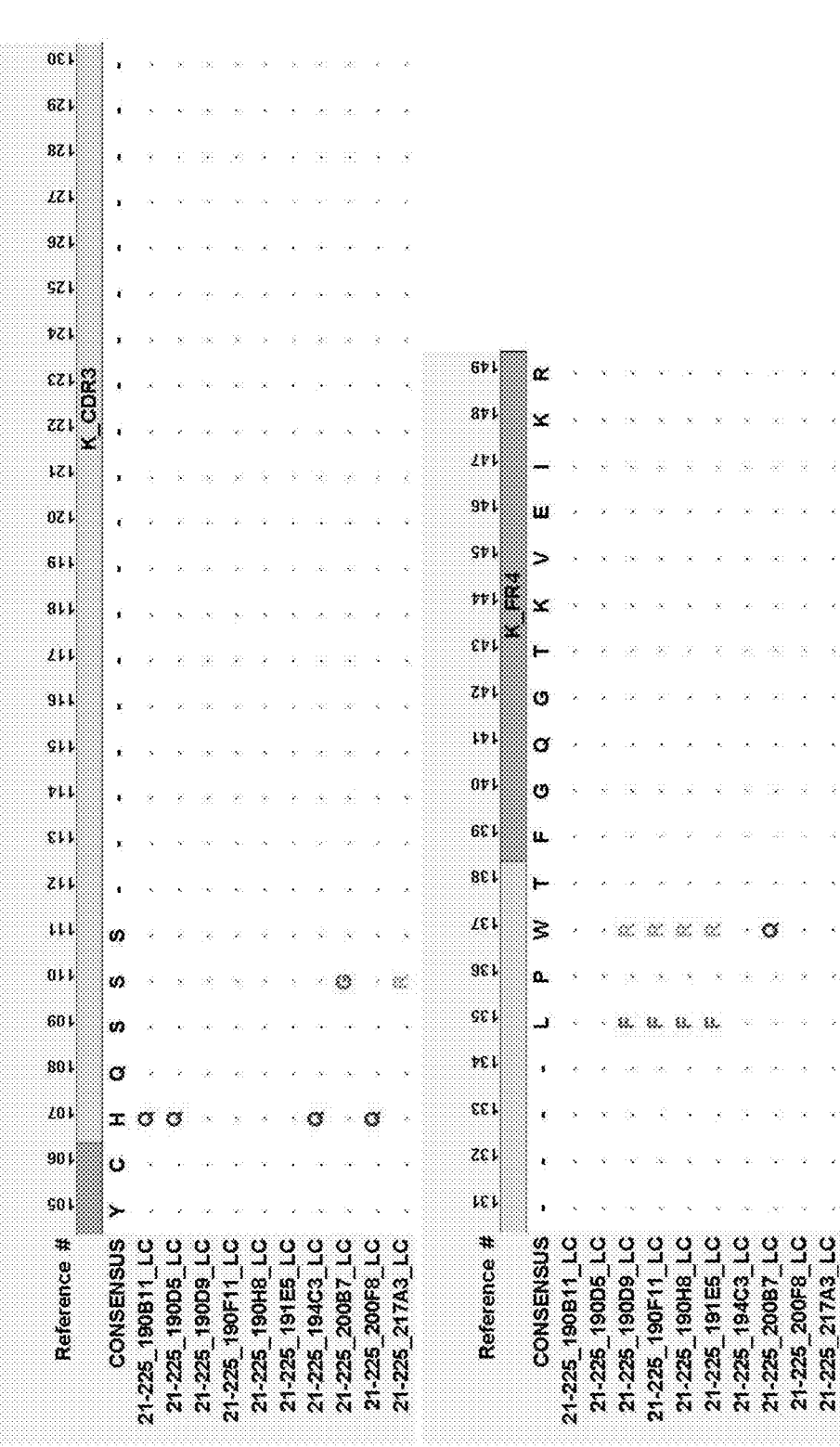
Figure 57:
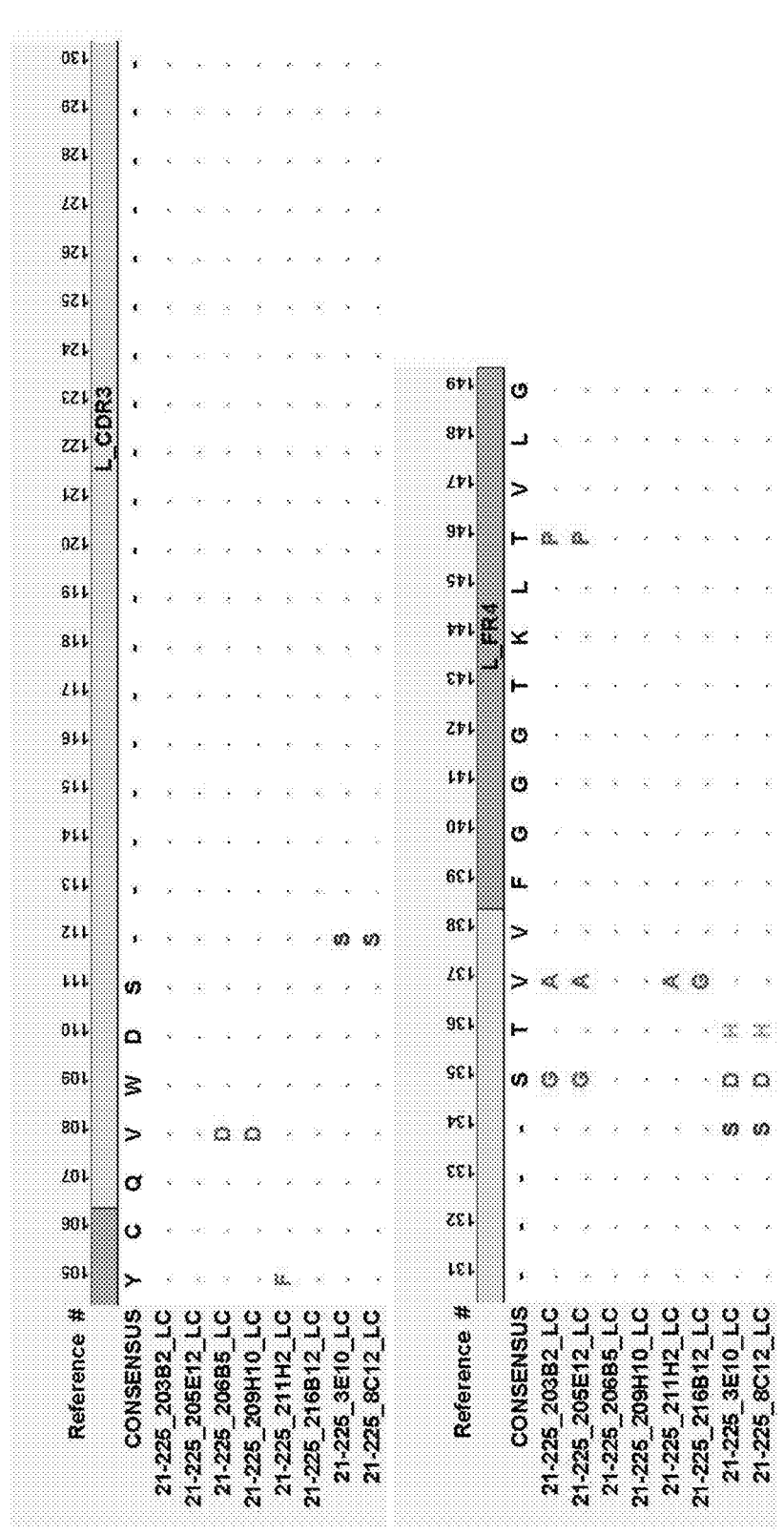

In some embodiments, an isolated antigen binding protein is provided, wherein the antigen binding protein specifically binds human ASGR-1 and comprises a heavy chain variable domain having at least 90% identity to any of the VH domain amino acid sequences set forth in Tables 19A, as depicted in FIG. 55 or in Tables 21-34 as depicted in FIG. 56 or in Tables 49-95 as depicted in FIG. 56. In some aspects, the invention provides an isolated antigen binding protein, wherein the antigen binding protein specifically binds human ASGR-1 and comprises a light chain variable domain having at least 90% identity to any of the VL domain amino acid sequences set forth in Table 20A, as depicted in FIG. 55, or in Tables 35-48, as depicted in FIG. 56 or in Tables 96-134 as depicted in FIG. 57. In some embodiments, the antigen binding protein comprises a heavy chain variable domain having at least 90% identity to any of the VH domain amino acid sequences set forth in Tables 19A as depicted in FIG. 55, or in Tables 21-34 as depicted in FIG. 56 or in Tables 49-95 as depicted in FIG. 57, and a light chain variable domain having at least 90% identity to any of the VL domain amino acid sequences set forth in Table 20A as depicted in FIG. 55 or in Tables 35-48 as depicted in FIG. 56 or in Tables 96-134 as depicted in FIG. 57. In some embodiments, the antigen binding protein comprises a heavy chain variable domain having any of the VH domain amino acid sequences set forth in Tables 19A as depicted in FIG. 55, or in Tables 21-34 as depicted in FIG. 56 or in Tables 49-95 as depicted in FIG. 57, and a light chain variable domain having any of the VL domain amino acid sequences set forth in Table 20A as depicted in FIG. 55 or in Tables 35-48 as depicted in FIG. 56 or in Tables 96-134 as depicted in FIG. 57.

In some embodiments, an antigen binding protein that specifically binds to human ASGR-1 at an epitope that is bound by any of the antigen binding proteins disclosed herein is provided. In some embodiments, the invention provides an isolated antigen binding protein that specifically binds to human ASGR-1 at an epitope that is bound by at least one of the antigen binding proteins set forth in Tables 2-7. In some embodiments, the invention provides an isolated antigen binding protein that specifically binds to human ASGR-1 at an epitope that is bound by at least one of the antigen binding proteins set forth in Table A. In some embodiments, the invention provides an isolated antigen binding protein that specifically binds to human ASGR-1 at an epitope that is bound by at least one of the antigen binding proteins set forth in Table B. In some embodiments, the invention provides an isolated antigen binding protein that specifically binds to human ASGR-1 at an epitope that is bound by at least one of the antigen binding proteins set forth in Table C. In some embodiments, the invention provides an isolated antigen binding protein that specifically binds to human ASGR-1 at an epitope that is bound by at least one of the antigen binding proteins set forth in Table 6.

In some embodiments, the invention provides an isolated antigen binding protein that competes for binding to human ASGR-1 with any of the antigen binding proteins disclosed herein. In some embodiments, the invention provides an isolated antigen binding protein that competes for binding with any of the antigen binding proteins set forth in Tables 2-7. In some embodiments, the invention provides an isolated antigen binding protein that competes for binding with any of the antigen binding proteins set forth in Table A. In some embodiments, the invention provides an isolated antigen binding protein that competes for binding with any of the antigen binding proteins set forth in Table B. In still some embodiments, the invention provides an isolated antigen binding protein that competes for binding with any of the antigen binding proteins set forth in Table C. In yet another embodiment, the invention provides an isolated antigen binding protein that competes for binding with any of the antigen binding proteins set forth in Table 6.

In some embodiments, an isolated antigen binding protein that binds to human ASGR-1 within the carbohydrate recognition domain ("CRD") (also known as the carbohydrate binding domain or "CBD") and inhibits human ASGR-1 binding to ligand is provided. In some embodiments, the antigen binding protein binds to human ASGR-1 within residues 148-291, or 149-291, or 150-291, or 151-291, or 152-291, or 153-291, or 154-291, or 155-291 of SEQ ID NO:5. In some embodiments, the invention comprises an isolated antigen binding protein that binds to human ASGR-1 CBD within Helix α-1. In some embodiments, the invention comprises an isolated antigen binding protein that binds to human ASGR-1 within residues 174-186 of SEQ ID NO:5. In some embodiments, the invention comprises an isolated antigen binding protein that binds to human ASGR-1 CBD within Helix α-2. In some embodiments, the invention comprises an isolated antigen binding protein that binds to human ASGR-1 CBD within residues 194-206 of SEQ ID NO:5. In some embodiments, the invention comprises an isolated antigen binding protein that binds to human ASGR-1 within residues 237-273 or residues 240-267 of SEQ ID NO:5. In some embodiments, the antigen binding protein binds to ASGR-1 having an amino acid sequence that is at least 90% identical to SEQ ID NO:5. In some embodiments, the antigen binding protein is an antibody.

In some embodiments, an isolated antigen binding protein or an antibody that binds to human ASGR-1 and inhibits human ASGR-1 function is provided. In some embodiments, the isolated antigen binding protein or an antibody binds to human ASGR-1 and inhibits human ASGR-1 from binding to a ligand. In some embodiments, the antigen binding protein or antibody or a paratope in an antibody binds to human ASGR-1 at an epitope comprising at least one of the following amino acid residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, R274 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, or Y273 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, or Y273 (SEQ ID NO:5). In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, : H161, E162, V191, V192, E197, Q198, D216, G219, K222, W223, D225, R263, W264, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5).

In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, or R274 (SEQ ID NO:5). In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments when the antigen binding protein or antibody or paratope in an antibody binds to human ASGR-1 at an epitope comprising at least one of the following residues: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments, the antigen binding protein or antibody or paratope in an antibody binds to human ASGR-1 at an epitope comprising at least one of the following residues: H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, N157, R170, S171, G172, Q202, H203, H204, I205, G206, P207, V208, N209, T210, D260, R271, P272, Y273, or R274 (SEQ ID NO:5). In some embodiments, the antigen binding protein or antibody or a paratope in an antibody binds to human ASGR-1 at an epitope comprising at least one of the following amino acid residues: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, or W264 (SEQ ID NO:5). In some embodiments, the antigen binding protein or antibody or a paratope in an antibody binds to human ASGR-1 at an epitope comprising at least one of the following amino acid residues: H161, E162, W195, E196, Q198, K199, F200, Q202, H203, H204, G232, F233, K234, N235, W236, R237, P238, D261, G262, or R263 (SEQ ID NO:5). In some embodiments, the antigen binding protein or antibody or a paratope in an antibody binds to human ASGR1 at an epitope comprising at least one of the following amino acid residues: W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, or T279 (SEQ ID NO:5). In some embodiments, the antigen binding protein or antibody or a paratope in an antibody binds to human ASGR-1 at an epitope comprising at least one of the following amino acid residues: W167, S171, G172, K173, A174, A176, D177, N180, Y181, R183, L184, E185, D186, Q270, P272, or W275 (SEQ ID NO:5). In some embodiments, the antigen binding protein or antibody or a paratope in an antibody binds to human ASGR-1 at an epitope comprising at least one of the following amino acid residues: R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, or W264 (SEQ ID NO:5). In some embodiments, the antigen binding protein or antibody or a paratope in an antibody binds to human ASGR-1 at an epitope comprising at least one of the following amino acid residues: R170, W195, E196, K199, Q202, H203, H204, I205, G206, P207, V208, F233, K234, N235, W236, P238, D260, D261, G262, R263, or R274 (SEQ ID NO:5). In some embodiments, the antigen binding protein or antibody or a paratope in an antibody binds to human ASGR-1 at an epitope comprising at least one of the following amino acid residues: H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, or W264 (SEQ ID NO:5). In some embodiments, the antigen binding protein or antibody or a paratope in an antibody binds to human ASGR-1 at an epitope comprising at least one of the following amino acid residues: H161, S194, W195, E196, Q198, K199, F200, Q202, H203, F233, K234, N235, W236, R237, P238, or R263 (SEQ ID NO:5). In some embodiments, the antigen binding protein or antibody or a paratope in an antibody binds to human ASGR-1 at an epitope comprising at least one of the following amino acid residues: H161, E162, T193, S194, W195, E196, K199, Q202, T231, G232, F233, K234, N235, P238, D261, R263, R163, V192, E197, Q198, H203, P207, D228, E230, W236, R237, D260, G262, or W264 (SEQ ID NO:5). In some embodiments, the antigen binding protein or antibody or a paratope in an antibody binds to human ASGR-1 at an epitope comprising at least one of the following amino acid residues: H161, E162, T193, S194, W195, E196, K199, Q202, T231, G232, F233, K234, N235, P238, D261, or R263 (SEQ ID NO:5). In some embodiments, the antigen binding protein or antibody or a paratope in an antibody binds to human ASGR-1 at an epitope comprising at least one of the following amino acid residues: T193, S194, W195, E196, P220, W221, G226, T227, D228, Y229, E230, T231, G232, F233, K234, N235, W236, R237, P238, E239, G252, : H161, E162, V191, V192, E197, Q198, D216, G219, K222, W223, D225, R263, or W264 (SEQ ID NO:5). In some embodiments, the antigen binding protein or antibody or a paratope in an antibody binds to human ASGR-1 at an epitope comprising at least one of the following amino acid residues: T193, S194, W195, E196, P220, W221, G226, T227, D228, Y229, E230, T231, G232, F233, K234, N235, W236, R237, P238, E239, or G252 (SEQ ID NO:5). In some embodiments, the antigen binding protein or antibody or a paratope in an antibody binds to human ASGR-1 at an epitope comprising at least one of the following amino acid residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, or C269 (SEQ ID NO:5). In some embodiments, the antigen binding protein or antibody or a paratope in an antibody binds to human ASGR-1 at an epitope comprising at least one of the following amino acid residues: D216, Q217, N218, G219, P220, W221, Y229, E230, K234, W236, E239, Q240, P241, D242, D243, W244, Y245, G246, L249, G250, G251, G252, D254, or Q270 (SEQ ID NO:5). In some embodiments, the antigen binding protein or antibody or a paratope in an antibody binds to human ASGR-1 at an epitope comprising at least one of the following amino acid residues: W195, N209, N235, R237, P238, E239, Q240, D242, H257, T259, D260, D261, R263, N265, D267, R271, Y273, Q198, Q202, P207, V208, F233, W236, D243, E253, F258, G262, W264, or D266 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: W195, N209, N235, R237, P238, E239, Q240, D242, H257, T259, D260, D261, R263, N265, D267, R271, or Y273 (SEQ ID NO:5). In some embodiments, the antigen binding protein or antibody or a paratope in an antibody binds to human ASGR-1 at an epitope comprising at least one of the following amino acid residues: N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments, the antigen binding protein or antibody or a paratope in an antibody binds to human ASGR-1 at an epitope comprising at least one of the following amino acid residues: N157, R170, S171, G172, Q202, H203, H204, I205, G206, P207, V208, N209, T210, D260, R271, P272, Y273, or R274 (SEQ ID NO:5). In some embodiments, the antigen binding protein or antibody or a paratope in an antibody binds to human ASGR-1 at an epitope comprising at least one of the following amino acid residues: R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, or W275 (SEQ ID NO:5). In some embodiments, the antigen binding protein or antibody or a paratope in an antibody binds to human ASGR-1 at an epitope comprising at least one of the following amino acid residues: R170, S171, G172, A174, H204, I205, G206, P207, V208, N209, H257, D260, N265, D267, Q270, R271, P272, Y273, or R274 (SEQ ID NO:5). In some embodiments, the antigen binding protein or antibody or a paratope in an antibody binds to human ASGR-1 at an epitope comprising at least one of the following amino acid residues: R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments, the antigen binding protein or antibody or a paratope in an antibody binds to human ASGR-1 at an epitope comprising at least one of the following amino acid residues: R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5).

In some embodiments, an isolated antigen binding protein or an antibody or a paratope in an antibody that specifically binds to human ASGR-1 and inhibits human ASGR-1 function is provided. In some embodiments, the isolated antigen binding protein or an antibody or a paratope in an antibody specifically binds to human ASGR-1 and inhibits human ASGR-1 from binding to a ligand. In some embodiments, the antigen binding protein or antibody or a paratope in an antibody specifically binds to human ASGR-1 within residues 148-291 of SEQ ID NO:5. In some embodiments when the antigen binding protein or antibody or a paratope in an antibody is bound to human ASGR-1, the antigen binding protein or antibody or a paratope in an antibody is positioned 8 angstroms or less from at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, E162, V191, V192, E197, Q198, D216, G219, K222, W223, D225, R263, W264, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, or R274 (SEQ ID NO:5).

In some embodiments when the antigen binding protein or antibody or a paratope in an antibody is bound to human ASGR-1, the antigen binding protein or antibody or a paratope in an antibody is positioned 8 angstroms or less from at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, R170, S171, G172, A174, H204, I205, G206, P207, V208, N209, H257, D260, N265, D267, R271, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, or Y273 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, or Y273 (SEQ ID NO:5). In some embodiments when the antigen binding protein or antibody or a paratope in an antibody is bound to human ASGR-1, the antigen binding protein or a paratope in an antibody is positioned 8 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, or Y273 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, or D267 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R237, Q240, D242, W244, E253, N265, D266, D267, N209, P238, E239, P241, D243, Y245, G246, H247, G252, C255, H257, T259, V268, R271, or Y273 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: R237, Q240, D242, W244, E253, N265, D266, or D267 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: N209, R237, Q240, D242, W244, E253, H257, T259, N265, D266, D267, Y273, P238, E239, P241, D243, Y245, G246, H247, G252, C255, F258, D260, R263, W264, V268, or R271 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: N209, R237, Q240, D242, W244, E253, N265, D266, D267, or Y273 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, or C269 (SEQ ID NO:5). In some embodiments when the antigen binding protein or antibody is bound to human ASGR-1, the antigen binding protein or antibody or a paratope in an antibody is positioned 5 angstroms or less from at least one of the following residues: D216, Q217, N218, G219, P220, W221, Y229, E230, K234, W236, E239, Q240, P241, D242, D243, W244, Y245, G246, L249, G250, G251, G252, D254, or Q270 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: W195, N209, N235, R237, P238, E239, Q240, D242, H257, T259, D260, D261, R263, N265, D267, R271, Y273, Q198, Q202, P207, V208, F233, W236, D243, E253, F258, G262, W264, or D266 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: W195, N209, N235, R237, P238, E239, Q240, D242, H257, T259, D260, D261, R263, N265, D267, R271, or Y273 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: R170, S171, G172, A174, H204, I205, G206, P207, V208, N209, H257, D260, N265, D267, Q270, R271, P272, Y273, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues of human ASGR-1 (SEQ ID NO:5): D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, W236, R237, P238, D261, R263, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, K234, N235, W236, R237, P238, R263, H161, E162, T193, S194, W195, E196, K199, Q202, T231, G232, F233, K234, N235, P238, D261, R263, N265, D267, R271, P272, Y273, R274, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, N157, R170, S171, G172, Q202, H203, H204, I205, G206, P207, V208, N209, T210, D260, R271, P272, Y273, R274, V156, W158, V159, H161, W167, F168, S169, K173, (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, or W264 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues of human ASGR-1 (SEQ ID NO:5): H161, E162, W195, E196, Q198, K199, F200, Q202, H203, H204, G232, F233, K234, N235, W236, R237, P238, D261, G262, or R263 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, or T279 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: W167, S171, G172, K173, A174, A176, D177, N180, Y181, R183, L184, E185, D186, Q270, P272, or W275 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, or W264 (SEQ ID NO:5). In some embodiments when the antigen binding protein or antibody or a paratope in an antibody is bound to human ASGR-1, the antigen binding protein or a paratope in an antibody is positioned 5 angstroms or less from at least one of the following residues: R170, W195, E196, K199, Q202, H203, H204, I205, G206, P207, V208, F233, K234, N235, W236, P238, D260, D261, G262, R263, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, or W264 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: H161, S194, W195, E196, Q198, K199, F200, Q202, H203, F233, K234, N235, W236, R237, P238, or R263 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: H161, E162, T193, S194, W195, E196, K199, Q202, T231, G232, F233, K234, N235, P238, D261, R263, R163, V192, E197, Q198, H203, P207, D228, E230, W236, R237, D260, G262, or W264 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: H161, E162, T193, S194, W195, E196, K199, Q202, T231, G232, F233, K234, N235, P238, D261, or R263 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: T193, S194, W195, E196, P220, W221, G226, T227, D228, Y229, E230, T231, G232, F233, K234, N235, W236, R237, P238, E239, G252, : H161, E162, V191, V192, E197, Q198, D216, G219, K222, W223, D225, R263, or W264 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: T193, S194, W195, E196, P220, W221, G226, T227, D228, Y229, E230, T231, G232, F233, K234, N235, W236, R237, P238, E239, or G252 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270 or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: N157, R170, S171, G172, Q202, H203, H204, I205, G206, P207, V208, N209, T210, D260, R271, P272, Y273 or R274 (SEQ ID NO:5).

In some embodiments, an isolated antigen binding protein or antibody that specifically binds to human ASGR-1 and inhibits human ASGR-1 function is provided. In some embodiments, the isolated antigen binding protein or antibody that specifically binds to human ASGR-1 inhibits binding of human ASGR-1 binding to a ligand. In some embodiments, the antigen binding protein or antibody specifically binds to human ASGR-1 at a location that overlaps with a location where a ligand binds to human ASGR-1. In some embodiments, the location where a ligand binds to ASGR-1 includes at least one amino acid residue selected from the group consisting of: N209, R237, Q240, D242, W244, E253, H257, T259, N265, D266, D267, Y273, P238, E239, P241, D243, Y245, G246, H247, G252, C255, F258, D260, R263, W264, V268, or R271 (SEQ ID NO:5). In some embodiments, an isolated antigen binding protein or an antibody specifically binds to human ASGR-1 at a location that overlaps with a location that a ligand binds to ASGR-1. In some embodiments, the location that a ligand binds to human ASGR-1 includes at least one amino acid residue selected from the group consisting of: N209, R237, Q240, D242, W244, E253, H257, T259, N265, D266, D267, and Y273 (SEQ ID NO:5).

In some embodiments, an isolated antigen binding protein that binds to human ASGR-1 and inhibits human ASGR, ASGR-1 and/or ASGR-2 function is provided, wherein the antigen binding protein does not bind to a variant ASGR-1 protein, and wherein said variant ASGR-1 protein comprises a single mutation of a residue selected the group consisting of: R170, S171, G172, R183, L184, W195, E196, K199, H203, H204, P207, V208, N209, H215, D216, P220, D225, D228, R237, P238, E239, P241, D242, D243, Y245, G246, H247, G248, L249, G251, E253, T259, D260, R263, N265, Q270, R271, P272, R274, and E280 as shown in SEQ ID NO:5. In some embodiments, an isolated antigen binding protein or an antibody is contemplated. An antigen binding protein "does not bind" to a variant ASGR-1 protein when the measured reduction in antibody binding signal to a variant ASGR-1 protein (compared to that determined for binding to wild type ASGR-1) is statistically significant as measured by any number of methods known to one skilled in the art, such as the method described in Example 7E below. In some embodiments, the variant ASGR-1 protein comprises a single mutation of a residue at a position selected from the group consisting of: W195, E196, K199, H203, H204, P207, P220, G251, and R263 as shown in SEQ ID NO:5. In some embodiments, the single mutation is selected from the group consisting of H203, H204, P220, and G251. In some embodiments, the single mutation is selected from the group consisting of W195, E196 and K199. In some embodiments, the single mutation is selected from the group consisting of W195, E196 and H204. In some embodiments, the single mutation is selected from the group consisting W195, K199, and R263. In some embodiments, the single mutation is selected from the group consisting of W195 and E196. In some embodiments, the single mutation is selected from the group consisting of W195 and K199. In some embodiments, the single mutation is selected from the group consisting of W195 or P207. In some embodiments, the single mutation is selected from the group consisting of W195 and R263. In some embodiments, the single mutation is selected from the group consisting of H203 and H204. In some embodiments, the single mutation is selected from the group consisting of K199 and R263. In some embodiments, the single mutation is a mutation of residue W195. In some embodiments, the variant ASGR-1 protein comprises a single mutation of a residue selected the group consisting of: R170, S171, R183, L184, H215, P220, P238, G246, H247, G248, G251, and N265 as shown in SEQ ID NO:5. In some embodiments, the single mutation is selected from the group consisting of R183, L184, H215, P220, G246, G248, G251, and N265. In some embodiments, the single mutation is selected from the group consisting of L184, P220, P238, H247, and G251. In some embodiments, the single mutation is selected from the group consisting of R170, S171, and L184. In some embodiments, the single mutation is a mutation of residue R183. In some embodiments, the single mutation is a mutation of residue L184. In some embodiments, the variant ASGR-1 protein comprises a single mutation of a residue at a position selected from the group consisting of: P241, D242, D243, Y245, G251, E253 and D260 as shown in SEQ ID NO:5. In some embodiments, the single mutation is selected from the group consisting of P241, D243, Y245, G251, E253 and D260. In some embodiments, the single mutation is selected from the group consisting of P241, D243, and E253. In some embodiments, the single mutation is a mutation of residue D260. In some embodiments, the variant ASGR-1 protein comprises a single mutation of a residue at a position selected from the group consisting or comprising: R170, R237, E239, P241, T259, D260, R263, and N265 as shown in SEQ ID NO:5. In some embodiments, the single mutation is selected from the group consisting of R237, D260 and R263. In some embodiments, the single mutation is selected from the group consisting of R237, T259, D260 and R263. In some embodiments, the single mutation is selected from the group consisting of R170, R237, P241, T259, D260, R263 and N265. In some embodiments, the single mutation is selected from the group consisting of R237, E239, P241, T259, D260, R263 and N265. In some embodiments, the variant ASGR-1 protein comprises a single mutation of a residue at a position selected from the group consisting or comprising: R170, S171, G172, E196, H204, P207, V208, N209, H215, D216, D225, D228, P238, P241, D242, D243, H247, G248, L249, G251, D260, R263, N265, Q270, R271, P272, R274 and E280 as shown in SEQ ID NO:5. In some embodiments, the single mutation is selected from the group consisting of R170, S171, G172, E196, H204, P207, V208, N209, H215, D216, D225, D228, P238, P241, D242, D243, H247, G248, L249, G251, D260, R263, N265, Q270, R271, P272, R274 and E280 as shown in SEQ ID NO:5. In some embodiments, the single mutation is selected from the group consisting of R170, S171, G172, E196, H204, P207, H215, D216, D225, D228, D243, G248, L249, G251, D260, Q270, R271, P272, R274 and E280. In some embodiments, the single mutation is selected from the group consisting of G172, V208, R271, P272 and R274. In some embodiments, the single mutation is selected from the group consisting of G172, R271 and R274. In some embodiments, the single mutation is selected from the group consisting of G172, N209, and R271. In some embodiments, the single mutation is selected from the group consisting of R170, G172, V208, R271 and P272. In some embodiments, the single mutation is selected from the group consisting of G172, V208, P238, R271, P272 and R274. In some embodiments, the single mutation is selected from the group consisting of G172, P238, R271, P272 and R274. In some embodiments, the variant ASGR-1 protein comprises a single mutation of a residue at a position selected from the group consisting or comprising: G172, P238, R271 and R274 as shown in SEQ ID NO:5. In some embodiments, the variant ASGR-1 protein comprises a single mutation of a residue at a position selected from the group consisting or comprising: R170, G172, V208 and R274 as shown in SEQ ID NO:5. In some embodiments, the variant ASGR-1 protein comprises a single mutation of a residue at a position selected from the group consisting or comprising: R170, R183, H215 and Q270 as shown in SEQ ID NO:5. In some embodiments, the variant ASGR-1 protein comprises a single mutation of a residue at a position selected from the group consisting or comprising: P241, T259, and N265 as shown in SEQ ID NO:5. In some embodiments, the variant ASGR-1 protein comprises a single mutation of a residue at a position selected from the group consisting or comprising: P207 and R263 as shown in SEQ ID NO:5. In some embodiments, the variant ASGR-1 protein comprises a single mutation of a residue at a position selected from the group consisting or comprising: G172, P241, D242, H247, L249, N265, R271 and P272 as shown in SEQ ID NO:5. In some embodiments, the antigen binding protein or antibody does not bind to two or more variant ASGR-1 proteins, wherein the variant ASGR-1 proteins comprise the single mutations of the group individually.

A "CDR grafted antibody" is an antibody comprising one or more CDRs derived from an antibody of a particular species or isotype and the framework of another antibody of the same or different species or isotype.

A "multi-specific antibody" is an antibody that recognizes more than one epitope on one or more antigens. A subclass of this type of antibody is a "bi-specific antibody" which recognizes two distinct epitopes on the same or different antigens.

An antigen binding protein including an antibody "specifically binds" to an antigen, such as ASGR, ASGR-1 or ASGR-2, if it binds to the antigen with a tight binding affinity as determined by a equilibrium dissociation constant ($K_D$, or corresponding $K_D$, as defined below) value of $10^{-7}$ M or less. An antigen binding protein that specifically binds to human ASGR, ASGR-1 or ASGR-2 may be able to bind to ASGR, ASGR-1 or ASGR-2 from other species as well with the same or different affinities.

Affinity can be determined using a variety of techniques known in the art, for example but not limited to, equilibrium methods (e.g., enzyme-linked immunoabsorbent assay (ELISA); KinExA, Rathanaswami et al. Analytical Biochemistry, Vol. 373:52-60, 2008; or radioimmunoassay (RIA)), or by a surface plasmon resonance assay or other mechanism of kinetics-based assay (e.g., BIACORE® analysis or Octet® analysis (forteBIO)), and other methods such as indirect binding assays, competitive binding assays fluorescence resonance energy transfer (FRET), gel electrophoresis and chromatography (e.g., gel filtration). These and other methods may utilize a label on one or more of the components being examined and/or employ a variety of detection methods including but not limited to chromogenic, fluorescent, luminescent, or isotopic labels. A detailed description of binding affinities and kinetics can be found in Paul, W. E., ed., Fundamental Immunology, 4th Ed., Lippincott-Raven, Philadelphia (1999), which focuses on antibody-immunogen interactions. One example of a competitive binding assay is a radioimmunoas say comprising the incubation of labeled antigen with the antibody of interest in the presence of increasing amounts of unlabeled antigen, and the detection of the antibody bound to the labeled antigen. The affinity of the antibody of interest for a particular antigen and the binding off-rates can be determined from the data by scatchard plot analysis. Competition with a second antibody can also be determined using radioimmunoassays. In this case, the antigen is incubated with antibody of interest conjugated to a labeled compound in the presence of increasing amounts of an unlabeled second antibody.

Further embodiments of the invention provide antigen binding molecules (e.g., antibodies) that specifically bind ASGR, ASGR-1 and/or ASGR-2 with an equilibrium dissociation constant or $K_D$ ($k_{off}/k_{on}$) of less than $10^{-7}$ M, or of less than $10^{-8}$ M, or of less than $10^{-9}$ M, or of less than $10^{-10}$ M, or of less than $10^{-11}$ M, or of less than $10^{-12}$ M, or of less than $10^{-13}$ M, or of less than $5 \times 10^{-13}$ M (lower values indicating tighter binding affinity). Yet further embodiments of the invention are antigen binding molecules that specifically bind ASGR, ASGR-1 and/or ASGR-2 with an equilibrium dissociation constant or $K_D$ ($k_{off}/k_{on}$) of less than about $10^{-7}$ M, or of less than about $10^{-8}$ M, or of less than about $10^{-9}$ M, or of less than about $10^{-10}$ M, or of less than about $10^{-11}$ M, or of less than about $10^{-12}$ M, or of less than about $10^{-13}$ M, or of less than about $5 \times 10^{-13}$ M.

In still another embodiment, an antigen binding protein of the invention (e.g., an antibody) that specifically bind ASGR, ASGR-1 and/or ASGR-2 has an equilibrium dissociation constant or $K_D$ ($k_{off}/k_{on}$) of between about $10^{-7}$ M and about $10^{-8}$ M, between about $10^{-8}$ M and about $10^{-9}$ M, between about $10^{-9}$ M and about $10^{-10}$ M, between about $10^{-10}$ M and about $10^{-11}$ M, between about $10^{-11}$ M and about $10^{-12}$ M, between about $10^{-12}$ M and about $10^{-13}$ M. In still another embodiment, an antibody of the invention that specifically bind ASGR, ASGR-1 and/or ASGR-2 has an equilibrium dissociation constant or $K_D$ ($k_{off}/k_{on}$) of between $10^{-7}$ M and $10^{-8}$ M, between $10^{-8}$ M and $10^{-9}$ M, between $10^{-9}$ M and $10^{-10}$ M, between $10^{-10}$ M and $10^{-11}$ M, between $10^{-11}$ M and $10^{-12}$ M, between $10^{-12}$ M and $10^{-13}$ M.

It will be appreciated that an antigen binding protein of the present invention (e.g., an antibody or fragments thereof) may have at least one amino acid substitution, providing that the antigen binding protein retains the same or better desired binding specificity (e.g., binding to human ASGR, human ASGR-1, and/or human ASGR-2)(See Example 14). Therefore, modifications to the antigen binding protein structures are encompassed within the scope of the invention. In one embodiment, the antigen binding protein (e.g., but not limited to, an antibody) comprises sequences that each independently differ by 5, 4, 3, 2, 1, or 0 single amino acid additions, substitutions, and/or deletions from a CDR sequence of those set forth in Table 2 herein. As used herein, a CDR sequence that differs by no more than a total of, for example, four amino acid additions, substitutions and/or deletions from a CDR sequence shown in Table 2 below refers to a sequence with 4, 3, 2, 1 or 0 single amino acid additions, substitutions, and/or deletions compared with the sequences shown in Table 2. These may include amino acid substitutions, which may be conservative or non-conservative that do not destroy the desired binding capability of an antibody. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid moieties. A conservative amino acid substitution may also involve a substitution of a native amino acid residue with a normative residue such that there is little or no effect on the polarity or charge of the amino acid residue at that position. In some embodiments, the one or more substitutions to one or more of the antibody sequences can be as follows for each noted section in the noted antibody: 1) VH1||-08/D6|6-19|RF1/JH4, 25A4 H CDR2 sequence—WMYPN---SGNTGYAQKFQG, where N at 11 can be S or Q and T at 12 can be A or V, such that the sequence can be Trp Met Tyr Pro Asn Ser Gly X1 X2 Gly Tyr Ala Gln Lys Phe Gln Gly (SEQ ID NO: 50259) wherein X1=N or S or Q or a conservative substitution thereof, X2=T or A or V or a conservative substitution thereof. 2) VH1I1-08/D6|6-19|RF1/JH4, 4A2 H CDR2 sequence—WMHPN---SGNTGYAQKFQG, where N at 11 can be S or Q, and T at 12 can be A or E, such that the sequence can be Trp Met His Pro Asn Ser Gly X1 X2 Gly Tyr Ala Gln Lys Phe Gln Gly (SEQ ID NO: 50260) wherein X1=N or S or Q or a conservative substitution thereof, X2=T or A or E or a conservative substitution thereof. 3) VK4|B3/JK3, 4A2 L CDR3 sequence—QQYYN----------------------TPVT, where N at 5 can be Q, and T at 29 can be A, such that the sequence can be Gln Gln Tyr Tyr X1 X2 Pro Val Thr (SEQ ID NO: 50261) wherein X1=N or Q or a conservative substitution thereof, X2=T or A or a conservative substitution thereof. 4) VH1||-02/D1|1-1|RF1/JH4, 4H6 H CDR3 sequence—DGTS----------------------SFDY, where D at 1 can be S, G at 2 can be A, such that the sequence can be X1 X2 Thr Ser Ser Phe Asp Tyr (SEQ ID NO: 50262) wherein X1=D or S or a conservative substitution thereof, X2=or A or a conservative substitution thereof. 5) VH3|3-33/D4|4-11|RF2/JH6 and VH3|3-07/D4|4-11|RF2/JH6, 7E11 H CDR2 sequence—

IIWHD---GSNKYYADSVKG, where D at 5 can be S or E, G at 9 can be A, D at 16 can be E, and S at 17 can be A, such that the sequence can be Ile Ile Trp His X1 X2 Ser Asn Lys Tyr Tyr Ala X3 X4 Val Lys Gly (SEQ ID NO: 50263) wherein X1=D or S or E or a conservative substitution thereof, X2=G or A or a conservative substitution thereof, X3=D or E or a conservative substitution thereof, X4=S or A or a conservative substitution thereof. 6) VH3|3-33/D6|6-6|RF1/JH6 and VH3|3-07/D6|6-6|RF1/JH6, 5E5 H CDR2 sequence VIWYD---GSNKYYADSVKG, where G at 9 can be A, D at 16 can be E or G, and S at 17 can be A, such that the sequence can be Val Ile Trp Tyr Asp X1 Ser Asn Lys Tyr Tyr Ala X2 X3 Val Lys Gly (SEQ ID NO: 50264) wherein X1=G or A or a conservative substitution thereof X2=D or E or G or a conservative substitution thereof X3=S or A or a conservative substitution thereof. 7) VH3|3-33/D6|6-6|RF1/JH6 and VH3|3-07/D6|6-6|RF1/JH6, 5E5 H CDR3 sequence EVYSSGW----------------YDYGMDV, where W at 7 can be F, such that the sequence can be Glu Val Tyr Ser Ser Gly X1 Tyr Asp Tyr Gly Met Asp Val (SEQ ID NO: 50265) wherein X1=W or F or a conservative substitution thereof.

In some embodiments, any one or more of the above CDR sequences can be combined with any one or more of the CDR sequences provided herein (e.g., Table 2 in FIG. 49, and Tables 19A-C and Tables 20A-C in FIG. 55). In some embodiments, any one or more of the above CDR sequences can be combined with any one or more CDR sequences provided herein for the designated antibody to provide an antibody of 6 CDRs (LCDR1, LCDR2, LCDR3, HCDR1, HCDR2, and HCDR3). For example, any one or more of the above CDRs can be used as one of the CDRs for the antibodies provided in Table 2 in FIG. 49 and/or Tables 19A, 19B, 19C, 20A, 20B and/or 20C in FIG. 55. In some embodiments, the variant positions provided in the above consensus sequences can be further combined as optional variations with the variations of sequence provided in Table 2 in FIG. 49, and Tables 19A-C and Tables 20A-C in FIG. 55, such that any demonstrated combination of sequences in one consensus sequence (e.g., for an antibody, such as 4A2 H CDR2 above) can be combined with all permissible options outlined for the relevant antibody in Table 2 in FIG. 49, and Tables 19A-C and Tables 20A-C in FIG. 55 (e.g., the corresponding 4A2 H CDR2), which can further be combined with any of the other 4A2 sequences in Table 2 in FIG. 49, and Tables 19A-C and Tables 20A-C in FIG. 55 (e.g., HCDR1, HCDR3, LCDR1, LCDR2, and LCDR3). Of course, 4A2 L CDR3 noted above can similarly be combined, and/or combined with the immediate combination as well. Thus, such sequences are not disclosed herein as needing to be alternative sequences, but are contemplated as additional options for the noted sequences. In some embodiments, variants of such sequences are also contemplated. Such variants can retain or have superior desired activity. Examples of such aspects are provided in Example 14 and tables 6 and 7. In some embodiments, any one or more of the FR regions in tables 6 and 7 can be combined with any one or more of the CDR sequences provided herein. In some embodiments, any one or more of the FR regions provided in Table 6 or 7 can be combined with the corresponding CDR set for the corresponding antibody (as a set of 6 CDRs). Thus, variants of antibody 4A2 are provided that include 6 CDRs (HCDR1, HCDR2, HCDR3, LCDR1, LCDR2, and LCDR3) and 8 FRs HFR1, HFR2, HFR3, HFR4, LFR1, LFR2, LFR3, and LFR4), any particular sequence of which can be from any of the designated sequences for antibody 4A2 provided herein (the present paragraph, Tables 2, 6 and/or 7, tables 19A, 19B, and 19C, 20A, 20B and 20C, etc).

Non-conservative substitutions may involve the exchange of a member of one class of amino acids or amino acid mimetics for a member from another class with different physical properties (e.g. size, polarity, hydrophobicity, charge). In certain embodiments, such substituted residues may be introduced into regions of a human antibody that are homologous with non-human antibodies, or into the non-homologous regions of the molecule.

Moreover, one skilled in the art may generate test variants containing a single amino acid substitution at each desired amino acid residue. The variants can then be screened using activity assays known to those skilled in the art. Such variants could be used to gather information about suitable variants. For example, if one discovered that a change to a particular amino acid residue resulted in destroyed, undesirably reduced, or unsuitable activity, variants with such a change may be avoided. In other words, based on information gathered from such routine experiments, one skilled in the art can readily determine the amino acids where further substitutions should be avoided either alone or in combination with other mutations.

A skilled artisan will be able to determine suitable variants of the antigen binding protein as set forth herein using well-known techniques. In certain embodiments, one skilled in the art may identify suitable areas of the molecule that may be changed without destroying activity by targeting regions not believed to be important for activity. In certain embodiments, one can identify residues and portions of the molecules that are conserved among similar polypeptides as has been describe above. In certain embodiments, even areas that may be important for biological activity or for structure may be subject to conservative amino acid substitutions without destroying the biological activity or without adversely affecting the polypeptide structure.

Additionally, one skilled in the art can review structure-function studies identifying residues in similar polypeptides that are important for activity or structure. In view of such a comparison, one can predict the importance of amino acid residues in a protein that correspond to amino acid residues which are important for activity or structure in similar proteins. One skilled in the art may opt for chemically similar amino acid substitutions for such predicted important amino acid residues.

In some embodiments, one skilled in the art may identify residues that may be changed that result in enhanced properties as desired. For example, an amino acid substitution (conservative or non-conservative) may result in enhanced binding affinity to human ASGR, human ASGR-1, and/or human ASGR-2, or enhanced binding affinity to other species of ASGR, ASGR-1, and/or ASGR-2.

One skilled in the art can also analyze the three-dimensional structure and amino acid sequence in relation to that structure in similar polypeptides. In view of such information, one skilled in the art may predict the alignment of amino acid residues of an antibody with respect to its three dimensional structure. In certain embodiments, one skilled in the art may choose not to make radical changes to amino acid residues predicted to be on the surface of the protein, since such residues may be involved in important interactions with other molecules. A number of scientific publications have been devoted to the prediction of secondary structure. See Moult J., Curr. Op. in Biotech., 7(4):422-427 (1996), Chou et al., Biochemistry, 13(2):222-245 (1974); Chou et al., Biochemistry, 113(2):211-222 (1974); Chou et al., Adv. Enzymol. Relat. Areas Mol. Biol., 47:45-148 (1978); Chou et al., Ann. Rev. Biochem., 47:251-276 and Chou et al., Biophys. J., 26:367-384 (1979). Moreover, computer programs are currently available to assist with predicting secondary structure. One method of predicting secondary structure is based upon homology modeling. For example, two polypeptides or proteins which have a sequence identity of greater than 30%, or similarity greater than 40% often have similar structural topologies. The growth of the protein structural database (PDB) has provided enhanced predictability of secondary structure, including the potential number of folds within a polypeptide's or protein's structure. See Holm et al., Nucl. Acid. Res., 27(1):244-247 (1999). Additional methods of predicting secondary structure include "threading" (Jones, D., Curr. Opin. Struct. Biol., 7(3):377-87 (1997); Sippl et al., Structure, 4(1):15-19 (1996)), "profile analysis" (Bowie et al., Science, 253:164-170 (1991); Gribskov et al., Meth. Enzym., 183:146-159 (1990); Gribskov et al., Proc. Nat. Acad. Sci., 84(13):4355-4358 (1987)), and "evolutionary linkage" (See Holm, supra (1999), and Brenner, supra (1997)).

In certain embodiments, variants of the antigen binding protein include glycosylation variants wherein the number and/or type of glycosylation site has been altered compared to the amino acid sequences of a parent polypeptide. In certain embodiments, variants comprise a greater or a lesser number of N-linked glycosylation sites than the native protein. Alternatively, substitutions which eliminate this sequence will remove an existing N-linked carbohydrate chain. Also provided is a rearrangement of N-linked carbohydrate chains wherein one or more N-linked glycosylation sites (typically those that are naturally occurring) are eliminated and one or more new N-linked sites are created. Additional antibody variants include cysteine variants wherein one or more cysteine residues are deleted from or substituted for another amino acid (e.g., serine) as compared to the parent amino acid sequence. Cysteine variants may be useful when antibodies must be refolded into a biologically active conformation such as after the isolation of insoluble inclusion bodies. Cysteine variants generally have fewer cysteine residues than the native protein, and typically have an even number to minimize interactions resulting from unpaired cysteines.

Desired amino acid substitutions (whether conservative or non-conservative) can be determined by those skilled in the art at the time such substitutions are desired. In certain embodiments, amino acid substitutions can be used to identify important residues of antibodies to the target of interest, or to increase or decrease the affinity of the antibodies to the target of interest described herein.

According to certain embodiments, desired amino acid substitutions are those which: (1) reduce susceptibility to proteolysis, (2) reduce susceptibility to oxidation, (3) alter binding affinity for forming protein complexes, (4) alter binding affinities, and/or (4) confer or modify other physiochemical or functional properties on such polypeptides. According to certain embodiments, single or multiple amino acid substitutions (in certain embodiments, conservative amino acid substitutions) may be made in the naturally-occurring sequence (in certain embodiments, in the portion of the polypeptide outside the domain(s) forming intermolecular contacts). In certain embodiments, a conservative amino acid substitution typically may not substantially change the structural characteristics of the parent sequence (e.g., a replacement amino acid should not tend to break a helix that occurs in the parent sequence, or disrupt other types of secondary structure that characterizes the parent sequence). Examples of art-recognized polypeptide secondary and tertiary structures are described in Proteins, Structures and Molecular Principles (Creighton, Ed., W. H. Freeman and Company, New York (1984)); Introduction to Protein Structure (C. Branden and J. Tooze, eds., Garland Publishing, New York, N.Y. (1991)); and Thornton et al. Nature 354:105 (1991), which are each incorporated herein by reference.

Antigen Binding Protein Sequences

The amino acid sequences of the light chain CDRs of exemplary antigen binding proteins (antibodies) and the heavy chain CDRs of exemplary antigen binding proteins (antibodies) are shown in Tables 2-7, in addition to the exemplary antigen binding proteins described above as consensus light chain CDRs and/or consensus heavy chain CDRs (see Tables 19 B and C and Tables 20 B and C in FIG. 55). Also shown are polynucleotide sequences which encode the amino acid sequences of the CDRs (Table 2). Tables 3-7 and Tables A, B and C further provide the amino acid sequences of the VH and VL of exemplary antigen binding proteins (e.g., antibodies), in addition to the exemplary antigen binding proteins described above as consensus variable light chain sequences and/or consensus variable heavy chain sequences (see Table 19A and Table 20A in FIG. 55, as well as the Tables in FIGS. 56 and 57). Table 3 further provides the polynucleotide (DNA) sequences encoding the amino acid sequences of the variable light and variable heavy domains for exemplary antibodies.

Particular embodiments of antigen binding proteins of the present invention comprise one or more amino acid sequences that are identical to the amino acid sequences of one or more of the CDRs and/or FRs (framework regions) illustrated herein in Tables 2-7, and Tables A-C below. In one embodiment, the antigen binding protein comprises a light chain CDR1 sequence illustrated herein in Table 2 in FIG. 49 and Table C below. In another embodiment, the antigen binding protein comprises a light chain CDR2 sequence illustrated herein in Table 2 in FIG. 49 and Table C below. In another embodiment, the antigen binding protein comprises a light chain CDR3 sequence illustrated in herein in Table 2 in FIG. 49 and Table C below. In another embodiment, the antigen binding protein comprises a heavy chain CDR1 sequence illustrated in herein in Table 2 in FIG. 49 and Table C below. In another embodiment, the antigen binding protein comprises a heavy chain CDR2 sequence illustrated herein in Table 2 in FIG. 49 and Table C below. In another embodiment, the antigen binding protein comprises a heavy chain CDR3 sequence illustrated herein in Table 2 in FIG. 49 and Table C below. In another embodiment, the antigen binding protein comprises a light chain FR1 sequence illustrated herein in Tables 3-7 in FIGS. 50-54, respectively. In another embodiment, the antigen binding protein comprises a light chain FR2 sequence illustrated in Tables 3-7 in FIGS. 50-54, respectively. In another embodiment, the antigen binding protein comprises a light chain FR3 sequence illustrated herein in Tables 3-7 in FIGS. 50-54, respectively. In another embodiment, the antigen binding protein comprises a light chain FR4 sequence illustrated herein in Table 3-7 in FIGS. 50-54, respectively. In another embodiment, the antigen binding protein comprises a heavy chain FR1 sequence illustrated herein in Table 3-7 in FIGS. 50-54, respectively. In another embodiment, the antigen binding protein comprises a heavy chain FR2 sequence illustrated herein in Table 3-7 in FIGS. 50-54, respectively. In another embodiment, the antigen binding protein comprises a heavy chain FR3 sequence illustrated herein in Table 3-7 in FIGS. 50-54, respectively.

In another embodiment, the antigen binding protein comprises a heavy chain FR4 sequence illustrated herein in Table 3-7 in FIGS. 50-54, respectively.

In another embodiment, at least one of the antigen binding protein's CDR3 sequences differs by no more than 6, 5, 4, 3, 2, 1 or 0 single amino acid addition, substitution, and/or deletion from a CDR3 sequence from the sequences as shown in Table 2 in FIG. 49 or Table C below. In another embodiment, the antigen binding protein's light chain CDR3 sequence differs by no more than 6, 5, 4, 3, 2, 1 or 0 single amino acid addition, substitution, and/or deletion from a light chain CDR3 sequence from the sequences as shown in Table 2 in FIG. 49 or Table C below and the antigen binding protein's heavy chain CDR3 sequence differs by no more than 6, 5, 4, 3, 2, 1 or 0 single amino acid addition, substitution, and/or deletion from a heavy chain CDR3 sequence from the sequences as shown in Table 2 in FIG. 49 or Table C below. In another embodiment, the antigen binding protein further comprises 1, 2, 3, 4, or 5 CDR sequences that each independently differs by 6, 5, 4, 3, 2, 1, or 0 single amino acid additions, substitutions, and/or deletions from a CDR sequence of the sequences shown in Table 2 in FIG. 49 or Table C below. In another embodiment, the antigen binding protein comprises the CDRs of the light chain variable region and the CDRs of the heavy chain variable region set forth in Table 2 in FIG. 49 or Table C below. In a further embodiment, the antigen binding protein comprises the CDRs of any one of the antibodies in Table 2 in FIG. 49 or Table C below. In one embodiment, the antigen binding protein is a human antibody. In another embodiment, the antigen binding protein is a humanized antibody. In certain embodiments, the VH CDRs and the VL CDRs are paired in a manner indicated in Tables 2-7 in FIGS. 49-54, respectively.

In one embodiment, the antigen binding protein (e.g., an antibody) comprises a light chain variable domain comprising a sequence of amino acids that differs from the sequence of a light chain variable domain listed in Table 3-7 in FIGS. 50-54, respectively at 15, 14, 13, 12, 11, 10, 9, 8, 7, 6, 5, 4, 3, 2, 1 or 0 residues, wherein each such sequence difference is independently either a deletion, insertion, or substitution of one amino acid residue. In another embodiment, the antigen binding protein (e.g., an antibody) comprises a heavy chain variable domain comprising a sequence of amino acids that differs from the sequence of a heavy chain variable domain listed in Table 3-7 in FIGS. 50-54, respectively at 15, 14, 13, 12, 11, 10, 9, 8, 7, 6, 5, 4, 3, 2, 1 or 0 residues, wherein each such sequence difference is independently either a deletion, insertion, or substitution of one amino acid residue. In certain embodiments, the antigen binding protein comprises a light chain variable domain and a heavy chain variable domain that are paired in a manner indicated in Tables 3-7 in FIGS. 50-54, respectively. In certain embodiments, the antigen binding protein comprises a light chain variable domain and a heavy chain variable domain that are paired in a manner indicated in Tables A-C below.

In a particular embodiment, the antigen binding protein (e.g., antibody) binds to human ASGR-1 and comprises a heavy chain variable domain containing one or more VH CDR1 (HCDR1), VH CDR2 (HCDR2) and/or VH CDR3 (HCDR3), wherein the VH CDR1 (HCDR1) has an amino acid sequence identical to, or comprising not more than 3 amino acid additions/insertions, deletions or substitutions as compared to, the amino acid sequences selected from the group consisting of SEQ ID NO:5136, SEQ ID NO:50001, SEQ ID NO:50012 and SEQ ID NO:50468; the VH CDR2 (HCDR2) has an amino acid sequence identical to, or comprising not more than 3 amino acid additions/insertions, deletions or substitutions as compared to, the amino acid sequences selected from the group consisting of SEQ ID NO:13148, SEQ ID NO:50002, SEQ ID NO:50014, and SEQ ID NO:50260; and the VH CDR3 (HCDR3) has an amino acid sequence identical to, or comprising not more than 3 amino acid additions/insertions, deletions or substitutions as compared to, the amino acid sequences selected from the group consisting of SEQ ID NO:21160, SEQ ID NO:50003, and SEQ ID NO:50470.

In a particular embodiment, the antigen binding protein (e.g., antibody) binds to human ASGR-1 and comprises a light chain variable domain containing one or more VL CDR1 (LCDR1), VL CDR2 (LCDR2) and/or VL CDR3 (LCDR3), wherein the VL CDR1 (LCDR1) has an amino acid sequence identical to, or comprising not more than 3 amino acid additions/insertions, deletions or substitutions as compared to, the amino acid sequences selected from the group consisting of SEQ ID NO:1130, SEQ ID NO:50133, SEQ ID NO:50156 and SEQ ID NO:50162; the VL CDR2 (LCDR2) has an amino acid sequence identical to, or comprising not more than 3 amino acid additions/insertions, deletions or substitutions as compared to, the amino acid sequences selected from the group consisting of SEQ ID NO:9142, SEQ ID NO:50157, SEQ ID NO:50163, SEQ ID NO:50229, SEQ ID NO:50619, SEQ ID NO:50643 and SEQ ID NO:50649; and the VL CDR3 (LCDR3) has an amino acid sequence identical to, or comprising not more than 3 amino acid additions/insertions, deletions or substitutions as compared to, the amino acid sequences selected from the group consisting of SEQ ID NO:17154, SEQ ID NO:50134, SEQ ID NO:50164, and SEQ ID NO:50261.

In a particular embodiment, the antigen binding protein (e.g., antibody) binds to human ASGR-1 and comprises A) a heavy chain variable domain containing one or more VH CDR1 (HCDR1), VH CDR2 (HCDR2) and/or VH CDR3 (HCDR3), wherein the VH CDR1 (HCDR1) has an amino acid sequence identical to, or comprising not more than 3 amino acid additions/insertions, deletions or substitutions as compared to, the amino acid sequences selected from the group consisting of SEQ ID NO:5136, SEQ ID NO:50001, SEQ ID NO:50012 and SEQ ID NO:50468; the VH CDR2 (HCDR2) has an amino acid sequence identical to, or comprising not more than 3 amino acid additions/insertions, deletions or substitutions as compared to, the amino acid sequences selected from the group consisting of SEQ ID NO:13148, SEQ ID NO:50002, SEQ ID NO:50014, and SEQ ID NO:50260; and the VH CDR3 (HCDR3) has an amino acid sequence identical to, or comprising not more than 3 amino acid additions/insertions, deletions or substitutions as compared to, the amino acid sequences selected from the group consisting of SEQ ID NO:21160, SEQ ID NO:50003, and SEQ ID NO:50470; and B) a light chain variable domain containing one or more VL CDR1 (LCDR1), VL CDR2 (LCDR2) and/or VL CDR3 (LCDR3), wherein the VL CDR1 (LCDR1) has an amino acid sequence identical to, or comprising not more than 3 amino acid additions/insertions, deletions or substitutions as compared to, the amino acid sequences selected from the group consisting of SEQ ID NO:1130, SEQ ID NO:50133, SEQ ID NO:50156 and SEQ ID NO:50162; the VL CDR2 (LCDR2) has an amino acid sequence identical to, or comprising not more than 3 amino acid additions/insertions, deletions or substitutions as compared to, the amino acid sequences selected from the group consisting of SEQ ID NO:9142, SEQ ID NO:50157, SEQ ID NO:50163, SEQ ID NO:50229, SEQ ID NO:50619, SEQ ID NO:50643 and SEQ ID NO:50649; and the VL CDR3 (LCDR3) has an amino acid sequence identical to, or comprising not more than 3 amino acid additions/insertions, deletions or substitutions as compared to, the amino acid sequences selected from the group consisting of SEQ ID NO:17154, SEQ ID NO:50134, SEQ ID NO:50164, and SEQ ID NO:50261. In one embodiment, the antigen binding protein (e.g., antibody) comprises A) a heavy chain variable domain containing a VH CDR1 (HCDR1), a VH CDR2 (HCDR2) and a VH CDR3 (HCDR3), wherein the VH CDR1 (HCDR1) has an amino acid sequence identical to, or comprising not more than 3 amino acid additions/insertions, deletions or substitutions as compared to, the amino acid sequences selected from the group consisting of SEQ ID NO:5136, SEQ ID NO:50001, SEQ ID NO:50012 and SEQ ID NO:50468; the VH CDR2 (HCDR2) has an amino acid sequence identical to, or comprising not more than 3 amino acid additions/insertions, deletions or substitutions as compared to, the amino acid sequences selected from the group consisting of SEQ ID NO:13148, SEQ ID NO:50002, SEQ ID NO:50014, and SEQ ID NO:50260; and the VH CDR3 (HCDR3) has an amino acid sequence identical to, or comprising not more than 3 amino acid additions/insertions, deletions or substitutions as compared to, the amino acid sequences selected from the group consisting of SEQ ID NO:21160, SEQ ID NO:50003, and SEQ ID NO:50470; and B) a light chain variable domain containing a VL CDR1 (LCDR1), a VL CDR2 (LCDR2) and a VL CDR3 (LCDR3), wherein the VL CDR1 (LCDR1) has an amino acid sequence identical to, or comprising not more than 3 amino acid additions/insertions, deletions or substitutions as compared to, the amino acid sequences selected from the group consisting of SEQ ID NO:1130, SEQ ID NO:50133, SEQ ID NO:50156 and SEQ ID NO:50162; the VL CDR2 (LCDR2) has an amino acid sequence identical to, or comprising not more than 3 amino acid additions/insertions, deletions or substitutions as compared to, the amino acid sequences selected from the group consisting of SEQ ID NO:9142, SEQ ID NO:50157, SEQ ID NO:50163, SEQ ID NO:50229, SEQ ID NO:50619, SEQ ID NO:50643 and SEQ ID NO:50649; and the VL CDR3 (LCDR3) has an amino acid sequence identical to, or comprising not more than 3 amino acid additions/insertions, deletions or substitutions as compared to, the amino acid sequences selected from the group consisting of SEQ ID NO:17154, SEQ ID NO:50134, SEQ ID NO:50164, and SEQ ID NO:50261. In one embodiment, the antigen binding protein comprises A) a heavy chain variable domain containing a VH CDR1 (HCDR1), a VH CDR2 (HCDR2) and a VH CDR3 (HCDR3), wherein the VH CDR1 (HCDR1) amino acid sequence is selected from the group consisting of SEQ ID NO:5136, SEQ ID NO:50001, SEQ ID NO:50012 and SEQ ID NO:50468; the VH CDR2 (HCDR2) amino acid sequence is selected from the group consisting of SEQ ID NO:13148, SEQ ID NO:50002, SEQ ID NO:50014, and SEQ ID NO:50260; and the VH CDR3 (HCDR3) amino acid sequence is selected from the group consisting of SEQ ID NO:21160, SEQ ID NO:50003, and SEQ ID NO:50470; and B) a light chain variable domain containing a VL CDR1 (LCDR1), a VL CDR2 (LCDR2) and a VL CDR3 (LCDR3), wherein the VL CDR1 (LCDR1) amino acid sequence is selected from the group consisting of SEQ ID NO:1130, SEQ ID NO:50133, SEQ ID NO:50156 and SEQ ID NO:50162; the VL CDR2 (LCDR2) amino acid sequence is selected from the group consisting of SEQ ID NO:9142, SEQ ID NO:50157, SEQ ID NO:50163, SEQ ID NO:50229, SEQ ID NO:50619, SEQ ID NO:50643 and SEQ ID NO:50649; and the VL CDR3 (LCDR3) amino acid sequence is selected from the group consisting of SEQ ID NO:17154, SEQ ID NO:50134, SEQ ID NO:50164, and SEQ ID NO:50261. In one embodiment, the antigen binding protein comprises a heavy chain variable domain and a light chain variable domain containing a VH CDR1 having the amino acid sequence set forth in SEQ ID NO:5136; a VH CDR2 having the amino acid sequence set forth in SEQ ID NO:13148; a VH CDR3 having the amino acid sequence set forth in SEQ ID NO:21160; a VL CDR1 having the amino acid sequence set forth in SEQ ID NO:1130; a VL CDR2 having the amino acid sequence set forth in SEQ ID NO:9142; and a VL CDR3 having the amino acid sequence set forth in SEQ ID NO:17154.

In a particular embodiment, the antigen binding protein (e.g., antibody) comprises a) a light chain variable domain having no more than ten or no more than five amino acid additions/insertions, deletions or substitutions from the amino acid sequence set forth in SEQ ID NO:25164 or SEQ ID NO:50326; b) a heavy chain variable domain having no more than ten or no more than five amino acid additions/insertions, deletions or substitutions from the amino acid sequence set forth in SEQ ID NO:29170 or SEQ ID NO:50266; or c) the light chain variable domain of a) and the heavy chain variable domain of b). In one embodiment, the antigen binding protein comprises a light chain variable domain having the amino acid sequence set forth in SEQ ID NO:25164 or SEQ ID NO:50326; and a heavy chain variable domain having the amino acid sequence set forth in SEQ ID NO:29170 or SEQ ID NO:50266. In one embodiment, the antigen binding protein comprises a light chain variable domain having the amino acid sequence set forth in SEQ ID NO:50326; and a heavy chain variable domain having the amino acid sequence set forth in SEQ ID NO:50266. In one embodiment, the antigen binding protein comprises a light chain variable domain having the amino acid sequence set forth in SEQ ID NO:25164; and a heavy chain variable domain having the amino acid sequence set forth in SEQ ID NO:29170.

While specific embodiments relating to the antigen binding protein identified as 4A2 are set forth above with particularity, the embodiments of the present invention are not intended to be limited in scope to this individual embodiment. The embodiments directed to 4A2 are intended merely as single illustrations of individual embodiments. It is fully anticipated that the embodiments of the present invention include antigen binding proteins comprising heavy chain variable domains containing one or more VH CDR1 (HCDR1), VH CDR2 (HCDR2) and/or VH CDR3 (HCDR3) and/or light chain variable domains containing one or more VL CDR1 (LCDR1), VL CDR2 (LCDR2) and/or VL CDR3 (LCDR3) as set forth in Tables 2-7 in FIGS. 49-57, respectively, as well as Tables 19A-C and Tables 20A-C in FIG. 55, Tables 21-134 in FIGS. 56 and 57, and Tables A, B and C.

TABLE A

Exemplary Heavy and Light Chain Variable Regions

| Ab name | SEQ ID NOs: VH/VL | Ab name | SEQ ID NOs: VH/VL | Ab name | SEQ ID NOs: VH/VL | Ab name | SEQ ID NOs: VH/VL |
|---|---|---|---|---|---|---|---|
| 10G6 | 29184/25178 | 59F2 | 31512/27506 | 147E9 | 30172/26166 | 191G10 | 30846/26840 |
| 11E2 | 29040/25034 | 5E5 | 29016/25010 | 184E7 | 30660/26654 | 191G12 | 30730/26724 |
| 11F5 | 29054/25048 | 60D2 | 31518/27512 | 194A4 | 30820/26814 | 192C10 | 30764/26758 |

TABLE A-continued

Exemplary Heavy and Light Chain Variable Regions

| | | | | | | | | |
|---|---|---|---|---|---|---|---|---|
| 12E9 | 29186/25180 | 60E8 | 29494/25488 | 208A2 | 28136/24130 | 192C8 | 30756/26750 | |
| 12F11 | 29178/25172 | 63A10 | 31536/27530 | 210F10 | 31054/27048 | 192E4 | 30744/26738 | |
| 12F12 | 29188/25182 | 63G7 | 31534/27528 | 4B1 | 28878/24872 | 192G6 | 30752/26746 | |
| 13F6 | 28772/24766 | 64B12 | 29624/25618 | 60E12 | 29502/25496 | 192G8 | 30760/26754 | |
| 148E10 | 28132/24126 | 65F10 | 28134/24128 | 61A1 | 29504/25498 | 192H10 | 30768/26762 | |
| 154F4 | 31392/27386 | 68G6 | 28224/24218 | 62H10 | 31832/27826 | 193C7 | 30794/26788 | |
| 159H8 | 31416/27410 | 6A6 | 28806/24800 | 63H8 | 29604/25598 | 194B7 | 30828/26822 | |
| 160B12 | 31418/27412 | 6D4 | 28816/24810 | 72G9 | 32080/28074 | 194C1 | 30816/26810 | |
| 175D10 | 30538/26532 | 6D9 | 29154/25148 | 8D8 | 29168/25162 | 196C7 | 30870/26864 | |
| 177D2 | 31858/27852 | 6G6 | 29198/25192 | 12D2 | 29036/25030 | 197B6 | 30894/26888 | |
| 25A4 | 28522/24516 | 70D1 | 29670/25664 | 148H10 | 30196/26190 | 197E11 | 30906/26900 | |
| 25D12 | 28510/24504 | 7A10 | 29194/25188 | 173C11 | 30520/26514 | 197F2 | 30886/26880 | |
| 26C4 | 28580/24574 | 7E11 | 28914/24908 | 179C2 | 30570/26564 | 197G3 | 30888/26882 | |
| 27E7 | 28744/24738 | 7F4 | 28814/24808 | 47C1 | 29286/25280 | 198G3 | 30620/26614 | |
| 28H2 | 29190/25184 | 7F8 | 28948/24942 | 49C1 | 29320/25314 | 213B3 | 31092/27086 | |
| 29E2 | 29192/25186 | 7G4 | 28966/24960 | 60C12 | 29500/25494 | 219H1 | 31156/27150 | |
| 29E6 | 28550/24544 | 8D12 | 29050/25044 | 60G2 | 29482/25476 | 74C8 | 29768/25762 | |
| 29H8 | 28798/24792 | 9F12LC1 | 28216/24210 | 65D5 | 29632/25626 | 74G6 | 29894/25888 | |
| 32D6 | 29196/25190 | 9F12LC2 | 28217/24211 | 66H11 | 28130/24124 | 75G3 | 29714/25708 | |
| 3G7 | 28840/24834 | 9G9 | 28790/24784 | 71A6 | 28128/24122 | 89A11 | 30028/26022 | |
| 45B4 | 29252/25246 | 65E9 | 31538/27532 | 73G1 | 31556/27550 | 74B2 | 29736/25730 | |
| 49F10 | 29334/25328 | 72B4 | 31552/27546 | 49C5 | 32086/28080 | 74H7 | 29966/25960 | |
| 4A2 | 29170/25164 | 7H7 | 28944/24938 | 49D10 | 32088/28082 | 85F7 | 29766/25760 | |
| 4B3 | 28750/24744 | 9C11 | 28856/24850 | 51E3 | 30958/26952 | 198B9 | 30918/26912 | |
| 4H6 | 28936/24930 | 12B12 | 28978/24972 | 51F4 | 31476/27470 | 199A7 | 30932/26926 | |
| 50D4 | 29362/25356 | 147D10 | 30174/26168 | 53E8 | 32090/28084 | 218G4 | 31786/27780 | |
| 50G9 | 32082/28076 | 149D11 | 30226/26220 | 54E9 | 31488/27482 | 146A8 | 31332/27326 | |
| 51E9 | 29366/25360 | 149F8 | 30222/26216 | 56E3 | 31492/27486 | 146B6 | 31334/27328 | |
| 52G11 | 28138/24132 | 151B9 | 31372/27366 | 56G1 | 31490/27484 | 149A1 | 31344/27338 | |
| 52H1 | 31482/27476 | 175F4 | 31456/27450 | 190C11 | 30602/26596 | 172B12 | 31452/27446 | |
| 53F2 | 28140/24134 | 22G5 | 28368/24362 | 190E6 | 30642/26636 | 172C3 | 31450/27444 | |
| 53F7 | 29412/25406 | 48B12 | 31820/27814 | 190F12 | 30618/26612 | 193E7 | 30796/26790 | |
| 55B1 | 29430/25424 | 52H2 | 29380/25374 | 190F8 | 30712/26706 | 199E3 | 30926/26920 | |
| 56E5 | 29466/25460 | 6G7 | 28880/24874 | 190G11 | 30608/26602 | 226F9 | 31264/27258 | |
| 65C12 | 32078/28072 | 7G2 | 28942/24936 | 190H9 | 30716/26710 | 227C1 | 31280/27274 | |

| Ab name | SEQ ID NOs: VH/VL | Ab name | SEQ ID NOs: VH/VL | Ab name | SEQ ID NOs: VH/VL |
|---|---|---|---|---|---|
| 176H4 | 30542/26536 | 72F5 | 29700/25694 | 48D7 | 29306/25300 |
| 194C10 | 30832/26826 | 191A10 | 30724/26718 | 52D10 | 29388/25382 |
| 191E10 | 30726/26720 | 191G1 | 30628/26622 | 59E6 | 29590/25584 |
| 196F4 | 30868/26862 | 227F2 | 31282/27276 | 64E2 | 31836/27830 |
| 198D2 | 31604/27598 | 31D12LC1 | 29176/25170 | 57A7 | 29554/25548 |
| 202A3 | 30972/26966 | 31D12LC2 | 29174/25168 | 58G11 | 31510/27504 |
| 204G6 | 31004/26998 | 7C3LC1 | 28212/24206 | 64G12 | 29626/25620 |
| 224G1 | 31196/27190 | 7C3LC2 | 28214/24208 | | |

TABLE B

| Ab name | SEQ ID NOs: VH/VL | Ab name | SEQ ID NOs: VH/VL | Ab name | SEQ ID NOs: VH/VL | Ab name | SEQ ID NOs: VH/VL |
|---|---|---|---|---|---|---|---|
| 175D10 | 30538/26532 | 184E7 | 30660/26654 | 192E4 | 30744/26738 | 74B2 | 29736/25730 |
| 25A4 | 28522/24516 | 194A4 | 30820/26814 | 192G6 | 30752/26746 | 74H7 | 29966/25960 |
| 26C4 | 28580/24574 | 208A2 | 28136/24130 | 192G8 | 30760/26754 | 85F7 | 29766/25760 |
| 29H8 | 28798/24792 | 210G10 | 31054/27048 | 192H10 | 30768/26762 | 218G4 | 31786/27780 |
| 49F10 | 29334/25328 | 4B1 | 28878/24872 | 193C7 | 30794/26788 | 172B12 | 31452/27446 |
| 4A2 | 29170/25164 | 72G9 | 32080/28074 | 194B7 | 30828/26822 | 172C3 | 31450/27444 |
| 4H6 | 28936/24930 | 190C11 | 30602/26596 | 194C1 | 30816/26810 | 193E7 | 30796/26790 |
| 50D4 | 29362/25356 | 190E6 | 30642/26636 | 196C7 | 30870/26864 | 199E3 | 30926/26920 |
| 51E9 | 29366/25360 | 190F12 | 30618/26612 | 197B6 | 30894/26888 | 191E10 | 30726/26720 |
| 52H1 | 31482/27476 | 190F8 | 30712/26706 | 197E11 | 30906/26900 | 196F4 | 30868/26862 |
| 55B1 | 29430/25424 | 190G11 | 30608/26602 | 197F2 | 30886/26880 | 198D2 | 31604/27598 |
| 56E5 | 29466/25460 | 190H9 | 30716/26710 | 197G3 | 30888/26882 | 202A3 | 30972/26966 |
| 64B12 | 29624/25618 | 191A10 | 30724/26718 | 198G3 | 30620/26614 | 204G6 | 31004/26998 |
| 6G6 | 29198/25192 | 191G1 | 30628/26622 | 213B3 | 31092/27086 | 10G6 | 29184/25178 |
| 7F4 | 28814/24808 | 191G10 | 30846/26840 | 219H1 | 31156/27150 | 160B12 | 31418/27412 |
| 7G4 | 28966/24960 | 191G12 | 30730/26724 | 74C8 | 29768/25762 | 177D2 | 31858/27852 |
| 149F8 | 30222/26216 | 192C10 | 30764/26758 | 74G6 | 29894/25888 | 53F7 | 29412/25406 |
| 48B12 | 31820/27814 | 192C8 | 30756/26750 | 75G3 | 29714/25708 | 63A10 | 31536/24530 |
| 7E11 | 28914/24908 | 198B9 | 30918/26912 | 146B6 | 31334/27328 | 22G5 | 28368/24362 |
| 6G7 | 28880/24874 | 199A7 | 30932/26926 | 176H4 | 30542/26536 | 5E5 | 29016/25010 |

TABLE B-continued

| Ab name | SEQ ID NOs: VH/VL | Ab name | SEQ ID NOs: VH/VL | Ab name | SEQ ID NOs: VH/VL | Ab name | SEQ ID NOs: VH/VL |
|---|---|---|---|---|---|---|---|
| 147E9 | 30172/26166 | 146A8 | 31332/27326 | 149A1 | 31344/27338 | 194C10 | 30832/26826 |
| 54E9 | 31488/27482 | 12D2 | 29036/25030 | | | | |

TABLE C

Exemplary Heavy and Light Chain Variable Regions and Heavy and Light Chain CDR1/2/3

| Ab name | VH SEQ ID NOs: | VL SEQ ID NOs: | HCDR1 SEQ ID NOs: | HCDR2 SEQ ID NOs: | HCDR3 SEQ ID NOs: | LCDR1 SEQ ID NOs: | LCDR2 SEQ ID NOs: | LCDR3 SEQ ID NOs: |
|---|---|---|---|---|---|---|---|---|
| 25A4 | 28522 or 50266 | 24516 or 50316 | 4488, 50468, 50001 or 50013 | 12500, 50002, 50014 or 50259 | 20512, 50003 or 50470 | 480, 50133 or 50162 | 8492, 50157, 50229, 50619, 50643 or 50649 | 16504, 50134, 50164 or 50620 |
| 26C4 | 28580 or 50266 | 24574 or 50316 | 4546, 50001, 50013 or 50468 | 12588 or 50002 | 20570, 50003 or 50470 | 538, 50133 or 50156 | 8550, 50157, 50163, 50229, 50619, 50643 or 50649 | 16562, 50134, 50164 or 50620 |
| 29H8 | 28798 or 50266 | 24792 or 50316 | 4764, 50001, 50013 or 50468 | 12776 or 50002 | 20788 or 50003 or 50470 | 756 or 50133 | 8768, 50157, 50163, 50229, 50619, 50643 or 50649 | 16780 or 50134 |
| 4A2 | 29170 or 50266 | 25164 or 50326 | 5136, 50001, 50013, or 50468 | 13148, 50002, 50014 or 50260 | 21160, 50003 or 50470 | 1130, 50133, 50156 or 50162 | 9142, 50157, 50163, 50229, 50619, 50643 or 50649 | 17154, 50134, 50164 or 50261 |
| 4H6 | 28936 or 50272 | 24930 or 50321 | 4902 or 50019 | 12914 or 50020 | 20926 or 50021 or 50262 | 894, 50147 or 50159 | 8096, 50148 or 50160 | 16918 or 50149 |
| 56E5 | 29466 or 50272 | 25460 or 50321 | 5432, 50019 or 50058 | 13444 or 50020 | 21456 or 50021 | 1426 or 50147 | 9438, 50123, 50131, 50136, 50139, 50142, 50145, 50148, 50154, 50160, 50181, 50184, 50199, 50202, 50213 or 50248 | 17450 or 50149 |
| 7F4 | 28814 or 50284 | 24808 or 50312 | 4780, 50046 or 50075 | 12792 or 50047 | 20804 or 50048 | 772, 50122, 50130, 50135 or 50198 | 8784, 50123, 50131, 50136, 50139, 50142, 50145, 50148, 50154, 50160, 50181, 50199 or 50213 | 16796 or 50124 |
| 7G4 | 28966 or | 24960 or | 4932, 50004, | 12944, 50005, | 20956 or 50006 | 924, 50122, | 8936, 50123, | 16948 |

TABLE C-continued

Exemplary Heavy and Light Chain Variable Regions and Heavy and Light Chain CDR1/2/3

| Ab name | VH SEQ ID NOs: | VL SEQ ID NOs: | HCDR1 SEQ ID NOs: | HCDR2 SEQ ID NOs: | HCDR3 SEQ ID NOs: | LCDR1 SEQ ID NOs: | LCDR2 SEQ ID NOs: | LCDR3 SEQ ID NOs: |
|---|---|---|---|---|---|---|---|---|
| | 50267 | 50315 | 50037 or 50107 | 50008, 50017, 50023, 50026, 50038, 50053, 50067, 50073, 50085, 50088, 50100, 50108, 50238 or 50254 | | 50130, 50135, 50198, or 50247 | 50131, 50136, 50139, 50142, 50145, 50148, 50154, 50160, 50181, 50184, 50199, 50202, 50213 or 50248 | |
| 48B12 | 31820 or 50267 | 27814 | 7784, 50034, 50055, 50093, 50113 or 50116 | 15796, 50032, 50035, 50056, 50070, 50091, 50105 or 50117 | 23808 | 3780 | 11792 or 50126 | 19804 |
| 184E7 | 30660 or 50272 | 26654 or 50320 | 6626, 50019 or 50237 | 14638 or 50020 | 22650 | 2620, 50138, 50144, 50147, 50183 or 50212 | 10632, 50123, 50131, 50136, 50139, 50142, 50145, 50148, 50154, 50160, 50181, 50184, 50199, 50202, 50213 or 50248 | 18644 or 50146 |
| 194A4 | 30820 | 26814 or 50342 | 6786 | 14798, 50020, 50050, 50059 or 50079 | 22810 | 2780 or 50206 | 10792, 50128 or 50207 | 18804 or 50208 |
| 4B1 | 28878 | 24872 or 50323 | 4844 | 12856 | 20868 | 836, 50141 or 50153 | 8848, 50123, 50131, 50136, 50139, 50142, 50145, 50148, 50154, 50160, 50181, 50184, 50199, 50202, 50213 or 50248 | 16860, 50143 or 50203 |
| 190F8 | 30712 or 50271 | 26706 or 50318 | 6678, 50007, 50016, 50037, 50066, 50072, 50084, 50237 or 50253 | 14690, 50017, 50023, 50038 or 50088 | 22702 or 50018 | 2672, 50138 or 50144 | 10684 or 50139 | 18696, 50140, or 50146 |
| 191G1 | 30628 or 50271 | 26622 or 50318 | 6594, 50004, 50007, 50016, 50022, | 14606, 50008 or 50017 | 22618 or 50018 | 2588, 50138, 50144, 50147, 50183, or | 10600, 50123, 50131, 50136, 50139, | 18612 or 50140 |

TABLE C-continued

Exemplary Heavy and Light Chain Variable Regions and Heavy and Light Chain CDR1/2/3

| Ab name | VH SEQ ID NOs: | VL SEQ ID NOs: | HCDR1 SEQ ID NOs: | HCDR2 SEQ ID NOs: | HCDR3 SEQ ID NOs: | LCDR1 SEQ ID NOs: | LCDR2 SEQ ID NOs: | LCDR3 SEQ ID NOs: |
|---|---|---|---|---|---|---|---|---|
| | | | 50025, 50037, 50066, 50072, 50084, 50087, 50096, 50099, 50107, 50237 or 50252 | | | 50212 | 50142, 50145, 50148, 50154, 50160, 50181, 50184, 50199, 50202, 50213 or 50214 | |
| 191G10 | 30846 or 50271 | 26840 or 50318 | 6812, 50004, 50007, 50016, 50022, 50025, 50037, 50066, 50072, 50084, 50087, 50096, 50099, 50107, 50237 or 50253 | 14824, 50017, 50023, 50038, or 50088 | 22836 or 50018 | 2806, 50138 or 50144 | 10818 or 50139 | 18830 or 50140 |
| 194C1 | 30816 | 26810 | 6782, 50004, 50007, 50016, 50022, 50025, 50037, 50066, 50072, 50084, 50087, 50096, 50099, 50107, 50237 or 50253 | 14794, 50008, or 50017 | 22806 | 2776, 50138, 50144, 50147, 50183 or 50212 | 10788, 50123, 50131, 50136, 50139, 50142, 50145, 50148, 50154, 50160, 50181, 50184, 50199, 50202, 50213 or 50248 | 18800 or 50140 |
| 197G3 | 30888 or 50273 | 26882 or 50320 | 6854, 50016 or 50022 | 14866, 50017, 50023, 50038, or 50088 | 22878 or 50024 | 2848, 50138 or 50144 | 10860, 50123, 50131, 50136, 50139, 50142, 50145, 50148, 50154, 50160, 50181, 50184, 50199, 50202, 50213 or 50248 | 18872 or 50140 |
| 198G3 | 30620 or 50271 | 26614 or 50318 | 6586, 50007, 50016, 50037, 50066, 50072, 50084, 50237 or 50253 | 14598, 50017, or 50038 | 22610 or 50018 | 2580 or 50138 | 10592 or 50139 | 18604 or 50140 |
| 75G3 | 29714 or 50283 | 25708 or 50314 | 5680, 50010 or 50233 | 13692 | 21704 or 50235 | 1674 or 50127 | 9686 or 50128 | 17698 or 50129 |
| 218G4 | 31786 or | 27780 or | 7750, 50004, | 15762, 50005, | 23774 | 3746 or 50189 | 11758 or 50190 | 19770 or |

TABLE C-continued

Exemplary Heavy and Light Chain Variable Regions and Heavy and Light Chain CDR1/2/3

| Ab name | VH SEQ ID NOs: | VL SEQ ID NOs: | HCDR1 SEQ ID NOs: | HCDR2 SEQ ID NOs: | HCDR3 SEQ ID NOs: | LCDR1 SEQ ID NOs: | LCDR2 SEQ ID NOs: | LCDR3 SEQ ID NOs: |
|---|---|---|---|---|---|---|---|---|
| | 50298 | 50335 | 50025, 50037, 50087, 50096 or 50253 | 50008, 50017, 50023, 50026, 50038, 50053, 50067, 50073, 50085, 50088, 50100, 50108, 50238 or 50254 | | | | 50191 |
| 193E7 | 30796 | 26790 or 50312 | 6762 | 14774, 50011, or 50234 | 22786 | 2756, 50122, 50130, 50135, 50198, or 50247 | 10768, 50123 or 50142 | 18780 or 50124 |
| 198D2 | 31604 or 50273 | 27598 or 50335 | 7568, 50004, 50007, 50016, 50022, 50025, 50037, 50066, 50072, 50084, 50087, 50096, 50099, 50107, 50237 or 50253 | 15580 or 50023 | 23592 | 3564 or 50189 | 11576 or 50190 | 19588 or 50191 |
| 202A3 | 30972 | 26966 or 50317 | 6938 | 14950 | 22962 | 2932, 50122, 50130, 50135, 50198, or 50247 | 10944, 50123, 50131, 50136, 50139, 50142, 50148, or 50213 | 18956 or 50137 |
| 7E11 | 28914 or 50273 | 24908 or 50319 | 4880, 50004, 50007, 50022, 50025 or 50037 | 12892 or 50263 or 50023 | 20904 or 50024 | 872 or 50141 or 50153 | 8884, 50123, 50131, 50136, 50139, 50142, 50145, 50148, 50154, 50160, 50181, 50199 or 50213 | 16896, or 50143 |
| 22G5 | 28368 | 24362 or 50323 | 4334, 50031, 50034, 50055, 50093, 50113 or 50116 | 12346 or 50032 | 20358 or 50033 | 326, 50141, 50153, 50180 or 50201 | 8338, 50123, 50131, 50136, 50139, 50142, 50148, 50154 or 50160 | 16350 |
| 5E5 | 29016 or 50267 | 25010 or 50315 | 4982 50004, 50037 or 50107 | 12994, 50005, 50006 or 50008, 50017, 50023, 50026, 50038, | 21006, 50265 | 974 50122, 50130, 50135, 50198, or 50247 | 8986, 50123, 50131, 50136, 50139, 50142, 50145, | 16998 or 50132 |

TABLE C-continued

Exemplary Heavy and Light Chain Variable Regions and Heavy and Light Chain CDR1/2/3

| Ab name | VH SEQ ID NOs: | VL SEQ ID NOs: | HCDR1 SEQ ID NOs: | HCDR2 SEQ ID NOs: | HCDR3 SEQ ID NOs: | LCDR1 SEQ ID NOs: | LCDR2 SEQ ID NOs: | LCDR3 SEQ ID NOs: |
|---|---|---|---|---|---|---|---|---|
| | | | | 50053, 50067, 50073, 50085, 50088, 50100, 50108, 50238, 50254 or 50264, | | | 50148, 50154, 50160, 50181, 50184, 50199, 50202, 50213 or 50248 | |
| 54E9 | 31488 or 50303 | 27482 or 50338 | 7452 or 50102 | 15464 or 50103 | 23476 or 50227 | 3448 or 50195 | 11460 or 50196 | 19472 or 50197 |
| 6G7 | 28880 | 24874 or 50334 | 4846, 50004, 50007, 50016, 50022, 50025, 50037, 50066, 50072, 50084, 50087, 50096, 50099, 50107, 50237 or 50253 | 12858 | 20870 or 50098 | 838 or 50186 | 8850 or 50187 | 16862 or 50188 |
| 176H4 | 30542 or 50282 | 26536 or 50322 | 6508, 50004, 50007, 50016, 50022, 50025, 50037, 50066, 50072, 50084, 50087, 50096, 50099, 50107, 50237 or 50253 | 14520, 50023, 50053, 50085 or 50254 | 22532, or 50255 | 2502, 50150, or 50174 | 10514, 50151, 50175 or 50205 | 18526 or 50152 |
| 194C10 | 30832 | 26826 or 50314 | 6798 or 50233 | 14810, 50011 or 50234 | 22822 | 2792 or 50146 | 10804 or 50128 | 18816 or 50129 |

In the exemplary embodiments described above, the antigen binding proteins maintain desired binding to the various desired species of ASGR, ASGR-1 and/or ASGR-2.

In another embodiment, the light-chain variable domain comprises a sequence of amino acids that is at least 70%, 75%, 80%, 85%, 90%, 91%, 92%, 93%, 94%, 95%, 96%, 97%, 98%, 99% or 100% identical to the sequence of a light chain variable domain listed above.

In another embodiment, the light chain variable domain comprises a sequence of amino acids that is encoded by a nucleotide sequence that is at least 70%, 75%, 80%, 85%, 90%, 91%, 92%, 93%, 94%, 95%, 96%, 97%, 98%, 99% or 100% identical to the polynucleotide sequence listed above. In another embodiment, the light chain variable domain comprises a sequence of amino acids that is encoded by a polynucleotide that hybridizes under moderately stringent conditions to the complement of a polynucleotide that encodes a light chain variable domain selected from the sequences listed above. In another embodiment, the light chain variable domain comprises a sequence of amino acids that is encoded by a polynucleotide that hybridizes under stringent conditions to the complement of a polynucleotide that encodes a light chain variable domain selected from the group consisting of the sequences listed above.

In another embodiment, the heavy chain variable domain comprises a sequence of amino acids that is at least 70%, 75%, 80%, 85%, 90%, 91%, 92%, 93%, 94%, 95%, 96%, 97%, 98%, 99% or 100% identical to the sequence of a heavy chain variable domain selected from the sequences listed above. In another embodiment, the heavy chain variable domain comprises a sequence of amino acids that is encoded by a nucleotide sequence that is at least 70%, 75%, 80%, 85%, 90%, 91%, 92%, 93%, 94%, 95%, 96%, 97%, 98%, 99% or 100% identical to a nucleotide sequence that encodes a heavy chain variable domain selected from the sequences listed above. In another embodiment, the heavy chain variable domain comprises a sequence of amino acids that is encoded by a polynucleotide that hybridizes under moderately stringent conditions to the complement of a polynucleotide that encodes a heavy chain variable domain selected from the sequences listed above. In another embodiment, the heavy chain variable domain comprises a sequence of amino acids that is encoded by a polynucleotide that hybridizes under stringent conditions to the complement of a polynucleotide that encodes a heavy chain variable domain selected from the sequences listed above.

In the exemplary embodiments described above, the antigen binding proteins maintain desired binding to the various desired species of ASGR, ASGR-1 and/or ASGR-2.

Antigen binding proteins of the invention (e.g., antibodies) can comprise any constant region known in the art. The light chain constant region can be, for example, a kappa- or lambda-type light chain constant region, e.g., a human kappa- or lambda-type light chain constant region. The heavy chain constant region can be, for example, an alpha-, delta-, epsilon-, gamma-, or mu-type heavy chain constant regions, e.g., a human alpha-, delta-, epsilon-, gamma-, or mu-type heavy chain constant region.

Techniques are known for deriving an antibody of a different subclass or isotype from an antibody of interest, i.e., subclass switching. Thus, IgG antibodies may be derived from an IgM antibody, for example, and vice versa. Such techniques allow the preparation of new antibodies that possess the antigen-binding properties of a given antibody (the parent antibody), but also exhibit biological properties associated with an antibody isotype or subclass different from that of the parent antibody. Recombinant DNA techniques may be employed. Cloned DNA encoding particular antibody polypeptides may be employed in such procedures, e.g., DNA encoding the constant domain of an antibody of the desired isotype. See also Lanitto et al., Methods Mol. Biol. 178:303-16 (2002).

In one embodiment, an antigen binding protein of the invention further comprises the constant light chain kappa or lambda domains or a fragment of these. Exemplary sequences of the light chain constant regions and polynucleotides encoding them are provided in Table 15 below, and are generally well known in the art. In another embodiment, an antigen binding protein of the invention further comprises a heavy chain constant domain, or a fragment thereof, such as the IgG1 or IgG2 heavy chain constant region provided in Table 15.

The antigen binding proteins (for example, antibodies) of the present invention include those having a desired isotype (for example, IgA, IgG1, IgG2, IgG3, IgG4, IgM, IgE, and IgD) as well as Fab or F(ab')$_2$ fragments thereof. Moreover, if an IgG4 is desired, it may also be desired to introduce a point mutation in the hinge region as described in Bloom et al., 1997, Protein Science 6:407, (incorporated by reference herein) to alleviate a tendency to form intra-H chain disulfide bonds that can lead to heterogeneity in the IgG4 antibodies.

Generation of Antibodies

Antibodies of the invention may be prepared by techniques that are well known to those skilled in the art. For example, by immunizing an animal (e.g., a mouse or rat or rabbit) and then by immortalizing spleen cells harvested from the animal after completion of the immunization schedule. The spleen cells can be immortalized using any technique known in the art, e.g., by fusing them with myeloma cells to produce hybridomas. See, for example, Antibodies; Harlow and Lane, Cold Spring Harbor Laboratory Press, 1$^{st}$ Edition, e.g. from 1988, or 2$^{nd}$ Edition, e.g. from 2014).

In one embodiment, a humanized monoclonal antibody comprises the variable domain of a murine antibody (or all or part of the antigen binding site thereof) and a constant domain derived from a human antibody. Alternatively, a humanized antibody fragment may comprise the antigen binding site of a murine monoclonal antibody and a variable domain fragment (lacking the antigen-binding site) derived from a human antibody. Procedures for the production of engineered monoclonal antibodies include those described in Riechmann et al., 1988, Nature 332:323, Liu et al., 1987, Proc. Nat. Acad. Sci. USA 84:3439, Larrick et al., 1989, Bio/Technology 7:934, and Winter et al., 1993, TIPS 14:139. In one embodiment, the chimeric antibody is a CDR grafted antibody. Techniques for humanizing antibodies are discussed in, e.g., U.S. Pat. Nos. 5,869,619; 5,225,539; 5,821,337; 5,859,205; 6,881,557, Padlan et al., 1995, FASEB J. 9:133-39, Tamura et al., 2000, J. Immunol. 164:1432-41, Zhang, W., et al., Molecular Immunology. 42(12):1445-1451, 2005; Hwang W. et al., Methods. 36(1):35-42, 2005; Dall'Acqua W F, et al., Methods 36(1):43-60, 2005; and Clark, M., Immunology Today. 21(8):397-402, 2000.

An antibody of the present invention may also be a fully human monoclonal antibody. Fully human monoclonal antibodies may be generated by any number of techniques with which those having ordinary skill in the art will be familiar. Such methods include, but are not limited to, Epstein Barr Virus (EBV) transformation of human peripheral blood cells (e.g., containing B lymphocytes), in vitro immunization of human B-cells, fusion of spleen cells from immunized transgenic mice carrying inserted human immunoglobulin genes, isolation from human immunoglobulin V region phage libraries, or other procedures as known in the art and based on the disclosure herein.

Procedures have been developed for generating human monoclonal antibodies in non-human animals. For example, mice in which one or more endogenous immunoglobulin genes have been inactivated by various means have been prepared. Human immunoglobulin genes have been introduced into the mice to replace the inactivated mouse genes. In this technique, elements of the human heavy and light chain locus are introduced into strains of mice derived from embryonic stem cell lines that contain targeted disruptions of the endogenous heavy chain and light chain loci (see also Bruggemann et al., Curr. Opin. Biotechnol. 8:455-58 (1997)). For example, human immunoglobulin transgenes may be mini-gene constructs, or transloci on yeast artificial chromosomes, which undergo B-cell-specific DNA rearrangement and hypermutation in the mouse lymphoid tissue. Antibodies produced in the animal incorporate human immunoglobulin polypeptide chains encoded by the human genetic material introduced into the animal. In one embodiment, a non-human animal, such as a transgenic mouse, is immunized with a suitable immunogen.

Examples of techniques for production and use of transgenic animals for the production of human or partially human antibodies are described in U.S. Pat. Nos. 5,814,318, 5,569,825, and 5,545,806, Davis et al., Production of human antibodies from transgenic mice in Lo, ed. Antibody Engineering: Methods and Protocols, Humana Press, NJ:191-200 (2003), Kellermann et al., 2002, Curr Opin Biotechnol. 13:593-97, Russel et al., 2000, Infect Immun. 68:1820-26, Gallo et al., 2000, Eur J Immun. 30:534-40, Davis et al., 1999, Cancer Metastasis Rev. 18:421-25, Green, 1999, J Immunol Methods. 231:11-23, Jakobovits, 1998, Advanced Drug Delivery Reviews 31:33-42, Green et al., 1998, J Exp Med. 188:483-95, Jakobovits A, 1998, Exp. Opin. Invest. Drugs. 7:607-14, Tsuda et al., 1997, Genomics. 42:413-21, Mendez et al., 1997, Nat Genet. 15:146-56, Jakobovits, 1994, Curr Biol. 4:761-63, Arbones et al., 1994, Immunity. 1:247-60, Green et al., 1994, Nat Genet. 7:13-21, Jakobovits et al., 1993, Nature. 362:255-58, Jakobovits et al., 1993, Proc Natl Acad Sci USA. 90:2551-55. Chen, J., M. Trounstine, F. W. Alt, F. Young, C. Kurahara, J. Loring, D. Huszar. "Immunoglobulin gene rearrangement in B-cell deficient mice generated by targeted deletion of the JH locus." International Immunology 5 (1993): 647-656, Choi et al., 1993, Nature Genetics 4: 117-23, Fishwild et al., 1996, Nature Biotechnology 14: 845-51, Harding et al., 1995, Annals of the New York Academy of Sciences, Lonberg et al., 1994, Nature 368: 856-59, Lonberg, 1994, Transgenic Approaches to Human Monoclonal Antibodies in Handbook of Experimental Pharmacology 113: 49-101, Lonberg et al., 1995, Internal Review of Immunology 13: 65-93, Neuberger, 1996, Nature Biotechnology 14: 826, Taylor et al., 1992, Nucleic Acids Research 20: 6287-95, Taylor et al., 1994, International Immunology 6: 579-91, Tomizuka et al., 1997, Nature Genetics 16: 133-43, Tomizuka et al., 2000, Proceedings of the National Academy of Sciences USA 97: 722-27, Tuaillon et al., 1993, Proceedings of the National Academy of Sciences USA 90: 3720-24, and Tuaillon et al., 1994, Journal of Immunology 152: 2912-20.; Lonberg et al., Nature 368:856, 1994; Taylor et al., Int. Immun. 6:579, 1994; U.S. Pat. No. 5,877,397; Bruggemann et al., 1997 Curr. Opin. Biotechnol. 8:455-58; Jakobovits et al., 1995 Ann. N. Y. Acad. Sci. 764:525-35. In addition, protocols involving the XenoMouse® (Abgenix, now Amgen, Inc.) are described, for example in U.S. Ser. No. 05/011,8643 and WO 05/694879, WO 98/24838, WO 00/76310, and U.S. Pat. No. 7,064,244.

Lymphoid cells from the immunized transgenic mice are fused with myeloma cells for example to produce hybridomas. Myeloma cells for use in hybridoma-producing fusion procedures preferably are non-antibody-producing, have high fusion efficiency, and enzyme deficiencies that render them incapable of growing in certain selective media which support the growth of only the desired fused cells (hybridomas). Examples of suitable cell lines for use in such fusions include Sp-20, P3-X63/Ag8, P3-X63-Ag8.653, NS1/1.Ag 41, Sp210-Ag14, FO, NSO/U, MPC-11, MPC11-X45-GTG 1.7 and S194/5XX0 Bul; examples of cell lines used in rat fusions include R210.RCY3, Y3-Ag 1.2.3, IR983F and 4B210. Other cell lines useful for cell fusions are U-266, GM1500-GRG2, LICR-LON-HMy2 and UC729-6.

The lymphoid (e.g., spleen) cells and the myeloma cells may be combined for a few minutes with a membrane fusion-promoting agent, such as polyethylene glycol or a nonionic detergent, and then plated at low density on a selective medium that supports the growth of hybridoma cells but not unfused myeloma cells. One selection media is HAT (hypoxanthine, aminopterin, thymidine). After a sufficient time, usually about one to two weeks, colonies of cells are observed. Single colonies are isolated, and antibodies produced by the cells may be tested for binding activity to, for example, human ASGR-1, using any one of a variety of immunoassays known in the art and described herein. The hybridomas are cloned (e.g., by limited dilution cloning or by soft agar plaque isolation) and positive clones that produce an antibody specific to, for example, human ASGR-1, are selected and cultured. The monoclonal antibodies from the hybridoma cultures may be isolated from the supernatants of hybridoma cultures. Thus the present invention provides hybridomas that comprise polynucleotides encoding the antigen binding proteins of the invention in the chromosomes of the cell. These hybridomas can be cultured according to methods described herein and known in the art.

Another method for generating human antibodies of the invention includes immortalizing human peripheral blood cells by EBV transformation. See, e.g., U.S. Pat. No. 4,464, 456. Such an immortalized B-cell line (or lymphoblastoid cell line) producing a monoclonal antibody that specifically binds to, for example, human ASGR-1, can be identified by immunodetection methods as provided herein, for example, an ELISA, and then isolated by standard cloning techniques. The stability of the lymphoblastoid cell line producing an antibody may be improved by fusing the transformed cell line with a murine myeloma to produce a mouse-human hybrid cell line according to methods known in the art (see, e.g., Glasky et al., Hybridoma 8:377-89 (1989)). Still another method to generate human monoclonal antibodies is in vitro immunization, which includes priming human splenic B-cells with antigen, followed by fusion of primed B-cells with a heterohybrid fusion partner. See, e.g., Boerner et al., 1991 J. Immunol. 147:86-95.

In certain embodiments, a B-cell that is producing a desired antibody is selected and the light chain and heavy chain variable regions are cloned from the B-cell according to molecular biology techniques known in the art (WO 92/02551; U.S. Pat. No. 5,627,052; Babcook et al., Proc. Natl. Acad. Sci. USA 93:7843-48 (1996)) and described herein. B-cells from an immunized animal may be isolated from the spleen, lymph node, or peripheral blood sample by selecting a cell that is producing a desired antibody. B-cells may also be isolated from humans, for example, from a peripheral blood sample. Methods for detecting single B-cells that are producing an antibody with the desired specificity are well known in the art, for example, by plaque formation, fluorescence-activated cell sorting, in vitro stimulation followed by detection of specific antibody, and the like. Methods for selection of specific antibody-producing B-cells include, for example, preparing a single cell suspension of B-cells in soft agar that contains antigen. Binding of the specific antibody produced by the B-cell to the antigen results in the formation of a complex, which may be visible as an immunoprecipitate. After the B-cells producing the desired antibody are selected, the specific antibody genes may be cloned by isolating and amplifying DNA or mRNA according to methods known in the art and described herein.

An additional method for obtaining antibodies of the invention is by phage display. See, e.g., Winter et al., 1994 Annu. Rev. Immunol. 12:433-55; Burton et al., 1994 Adv. Immunol. 57:191-280. Human or murine immunoglobulin variable region gene combinatorial libraries may be created in phage vectors that can be screened to select Ig fragments (Fab, Fv, sFv, or multimers thereof) that bind specifically to TGF-beta binding protein or variant or fragment thereof. See, e.g., U.S. Pat. No. 5,223,409; Huse et al., 1989 Science 246:1275-81; Sastry et al., Proc. Natl. Acad. Sci. USA 86:5728-32 (1989); Alting-Mees et al., Strategies in Molecular Biology 3:1-9 (1990); Kang et al., 1991 Proc. Natl. Acad. Sci. USA 88:4363-66; Hoogenboom et al., 1992 J. Molec. Biol. 227:381-388; Schlebusch et al., 1997 Hybridoma 16:47-52 and references cited therein. For example, a library containing a plurality of polynucleotide sequences encoding Ig variable region fragments may be inserted into the genome of a filamentous bacteriophage, such as M13 or a variant thereof, in frame with the sequence encoding a phage coat protein. A fusion protein may be a fusion of the coat protein with the light chain variable region domain and/or with the heavy chain variable region domain. According to certain embodiments, immunoglobulin Fab fragments may also be displayed on a phage particle (see, e.g., U.S. Pat. No. 5,698,426).

Heavy and light chain immunoglobulin cDNA expression libraries may also be prepared in lambda phage, for example, using λImmunoZap™(H) and λImmunoZap™(L) vectors (Stratagene, La Jolla, Calif.). Briefly, mRNA is isolated from a B-cell population, and used to create heavy and light chain immunoglobulin cDNA expression libraries in the λImmunoZap(H) and λImmunoZap(L) vectors. These vectors may be screened individually or co-expressed to form Fab fragments or antibodies (see Huse et al., supra; see also Sastry et al., supra). Positive plaques may subsequently be converted to a non-lytic plasmid that allows high level expression of monoclonal antibody fragments from E. coli.

In one embodiment, in a hybridoma the variable regions of a gene expressing a monoclonal antibody of interest are amplified using nucleotide primers. These primers may be synthesized by one of ordinary skill in the art, or may be purchased from commercially available sources. (See, e.g., Stratagene (La Jolla, Calif.), which sells primers for mouse and human variable regions including, among others, primers for $V_{Ha}$, $V_{Hb}$, $V_{Hc}$, $V_{Hd}$, $C_{H1}$, $V_L$ and $C_L$ regions.) These primers may be used to amplify heavy or light chain variable regions, which may then be inserted into vectors such as ImmunoZAP™H or ImmunoZAP™L (Stratagene), respectively. These vectors may then be introduced into E. coli, yeast, or mammalian-based systems for expression. Large amounts of a single-chain protein containing a fusion of the $V_H$ and $V_L$ domains may be produced using these methods (see Bird et al., Science 242:423-426, 1988).

In certain embodiments, the antigen binding proteins of the invention are obtained from transgenic animals (e.g., mice) that produce "heavy chain only" antibodies or "HCAbs." HCAbs are analogous to naturally occurring camel and llama single-chain VHH antibodies.

See, for example, U.S. Pat. Nos. 8,507,748 and 8,502,014, and U.S. Patent Application Publication Nos. US2009/0285805A1, US2009/0169548A1, US2009/0307787A1, US2011/0314563A1, US2012/0151610A1, WO2008/122886A2, and WO2009/013620A2.

Once cells producing antibodies according to the invention have been obtained using any of the above-described immunization and other techniques, the specific antibody genes may be cloned by isolating and amplifying DNA or mRNA therefrom according to standard procedures as described herein. The antibodies produced therefrom may be sequenced and the CDRs identified and the DNA coding for the CDRs may be manipulated as described previously to generate other antibodies according to the invention.

In certain embodiments, antibodies are generated by first identifying antibodies that bind to cells expressing, for example, human ASGR, human ASGR-1 and/or human ASGR-2, and/or compete for binding with the antibodies described in this application.

It will be understood by one skilled in the art that some proteins, such as antibodies, may undergo a variety of posttranslational modifications. The type and extent of these modifications often depends on the host cell line used to express the protein as well as the culture conditions. Such modifications may include variations in glycosylation, methionine oxidation, diketopiperizine formation, aspartate isomerization and asparagine deamidation. A frequent modification is the loss of a carboxy-terminal basic residue (such as lysine or arginine) due to the action of carboxypeptidases (as described in Harris, R. J. Journal of Chromatography 705:129-134, 1995).

An alternative method for production of a murine monoclonal antibody is to inject the hybridoma cells into the peritoneal cavity of a syngeneic mouse, for example, a mouse that has been treated (e.g., pristane-primed) to promote formation of ascites fluid containing the monoclonal antibody. Monoclonal antibodies can be isolated and purified by a variety of well-established techniques. Such isolation techniques include affinity chromatography with Protein-A Sepharose, size-exclusion chromatography, and ion-exchange chromatography (see, for example, Coligan at pages 2.7.1-2.7.12 and pages 2.9.1-2.9.3; Baines et al., "Purification of Immunoglobulin G (IgG)," in Methods in Molecular Biology, Vol. 10, pages 79-104 (The Humana Press, Inc. 1992)). Monoclonal antibodies may be purified by affinity chromatography using an appropriate ligand selected based on particular properties of the antibody (e.g., heavy or light chain isotype, binding specificity, etc.). Examples of a suitable ligand, immobilized on a solid support, include Protein A, Protein G, an anticonstant region (light chain or heavy chain) antibody, an anti-idiotype antibody, and a TGF-beta binding protein, or fragment or variant thereof.

Molecular evolution of the complementarity determining regions (CDRs) in the center of the antibody binding site also has been used to isolate antibodies with increased affinity, for example, those as described by Schier et al., 1996, J. Mol. Biol. 263:551. Accordingly, such techniques are useful in preparing antibodies of the invention.

Although human, partially human, or humanized antibodies will be suitable for many applications, particularly those involving administration of the antibody to a human subject, other types of antigen binding proteins will be suitable for certain applications. The non-human antibodies of the invention can be, for example, derived from any antibody-producing animal, such as mouse, rat, rabbit, goat, donkey, or non-human primate (for example, monkey such as cynomologous or rhesus monkey) or ape (e.g., chimpanzee)). Non-human antibodies of the invention can be used, for example, in in vitro and cell-culture based applications, or any other application where an immune response to the antibody of the invention does not occur, is insignificant, can be prevented, is not a concern, or is desired. An antibody from a particular species can be made by, for example, immunizing an animal of that species with the desired immunogen or using an artificial system for generating antibodies of that species (e.g., a bacterial or phage display-based system for generating antibodies of a particular species), or by converting an antibody from one species into an antibody from another species by replacing, e.g., the constant region of the antibody with a constant region from the other species, or by replacing one or more amino acid residues of the antibody so that it more closely resembles the sequence of an antibody from the other species. In one embodiment, the antibody is a chimeric antibody comprising amino acid sequences derived from antibodies from two or more different species.

Antibodies also may be prepared by any of a number of other conventional techniques. For example, they may be purified from cells that naturally express them (e.g., an antibody can be purified from a hybridoma that produces it), or produced in recombinant expression systems, using any technique known in the art. See, for example, Monoclonal Antibodies, Hybridomas: A New Dimension in Biological Analyses, Kenneth et al. (eds.), Plenum Press, New York (1980); and Antibodies: A Laboratory Manual, Harlow and Land (eds.), Cold Spring Harbor Laboratory Press, Cold Spring Harbor, N.Y., (1988).

Where it is desired to improve the affinity of antibodies according to the invention containing one or more of the above-mentioned CDRs can be obtained by a number of affinity maturation protocols including maintaining the CDRs (Yang et al., J. Mol. Biol., 254, 392-403, 1995), chain shuffling (Marks et al., Bio/Technology, 10, 779-783, 1992), use of mutation strains of E. coli. (Low et al., J. Mol. Biol., 250, 350-368, 1996), DNA shuffling (Patten et al., Curr. Opin. Biotechnol., 8, 724-733, 1997), phage display (Thompson et al., J. Mol. Biol., 256, 7-88, 1996) and additional PCR techniques (Crameri, et al., Nature, 391, 288-291, 1998). All of these methods of affinity maturation are discussed by Vaughan et al. (Nature Biotechnology, 16, 535-539, 1998).

Single chain antibodies may be formed by linking heavy and light chain variable domain (Fv region) fragments via an amino acid bridge (short peptide linker), resulting in a single polypeptide chain. Such single-chain Fvs (scFvs) have been prepared by fusing DNA encoding a peptide linker between DNAs encoding the two variable domain polypeptides ($V_L$ and $V_H$). The resulting polypeptides can fold back on themselves to form antigen-binding monomers, or they can form multimers (e.g., dimers, trimers, or tetramers), depending on the length of a flexible linker between the two variable domains (Kortt et al., 1997, Prot. Eng. 10:423; Kortt et al., 2001, Biomol. Eng. 18:95-108). By combining different $V_L$ and $V_H$-comprising polypeptides, one can form multimeric scFvs that bind to different epitopes (Kriangkum et al., 2001, Biomol. Eng. 18:31-40). Techniques developed for the production of single chain antibodies include those described in U.S. Pat. No. 4,946,778; Bird, 1988, Science 242:423; Huston et al., 1988, Proc. Natl. Acad. Sci. USA 85:5879; Ward et al., 1989, Nature 334:544, de Graaf et al., 2002, Methods Mol Biol. 178:379-87.

Antigen binding fragments derived from an antibody can also be obtained, for example, by proteolytic hydrolysis of the antibody, for example, pepsin or papain digestion of whole antibodies according to conventional methods. By way of example, antibody fragments can be produced by enzymatic cleavage of antibodies with pepsin to provide a 5S fragment termed F(ab')$_2$. This fragment can be further cleaved using a thiol reducing agent to produce 3.5S Fab' monovalent fragments. Optionally, the cleavage reaction can be performed using a blocking group for the sulfhydryl groups that result from cleavage of disulfide linkages. As an alternative, an enzymatic cleavage using papain produces two monovalent Fab fragments and an Fc fragment directly. These methods are described, for example, by Goldenberg, U.S. Pat. No. 4,331,647, Nisonoff et al., Arch. Biochem. Biophys. 89:230, 1960; Porter, Biochem. J. 73:119, 1959; Edelman et al., in Methods in Enzymology 1:422 (Academic Press 1967); and by Andrews, S. M. and Titus, J. A. in Current Protocols in Immunology (Coligan J. E., et al., eds), John Wiley & Sons, New York (2003), pages 2.8.1-2.8.10 and 2.10A. 1-2.10A. 5. Other methods for cleaving antibodies, such as separating heavy chains to form monovalent light-heavy chain fragments (Fd), further cleaving of fragments, or other enzymatic, chemical, or genetic techniques may also be used, so long as the fragments bind to the antigen that is recognized by the intact antibody.

Another exemplary form of an antigen binding protein is a peptide comprising one or more complementarity determining regions (CDRs) of an antibody. CDRs can be obtained by constructing polynucleotides that encode the CDR of interest. Such polynucleotides are prepared, for example, by using the polymerase chain reaction to synthesize the variable region using mRNA of antibody-producing cells as a template (see, for example, Larrick et al., Methods: A Companion to Methods in Enzymology 2:106, 1991; Courtenay-Luck, "Genetic Manipulation of Monoclonal Antibodies," in Monoclonal Antibodies: Production, Engineering and Clinical Application, Ritter et al. (eds.), page 166 (Cambridge University Press 1995); and Ward et al., "Genetic Manipulation and Expression of Antibodies," in Monoclonal Antibodies: Principles and Applications, Birch et al., (eds.), page 137 (Wiley-Liss, Inc. 1995)). The antibody fragment further may comprise at least one variable region domain of an antibody described herein. Thus, for example, the V region domain may be monomeric and be a $V_H$ or $V_L$ domain, which is capable of independently binding a desired target (e.g., human ASGR-1) with an affinity at least equal to $10^{-7}M$ or less as described herein.

The variable region may be any naturally occurring variable domain or an engineered version thereof. By engineered version is meant a variable region that has been created using recombinant DNA engineering techniques. Such engineered versions include those created, for example, from a specific antibody variable region by insertions, deletions, or changes in or to the amino acid sequences of the specific antibody. One of ordinary skill in the art can use any known methods for identifying amino acid residues appropriate for engineering, such as the amino acid residues depicted with shading in Tables 21-48 of FIG. 56. Additional examples include engineered variable regions containing at least one CDR and optionally one or more framework amino acids from a first antibody and the remainder of the variable region domain from a second antibody. Engineered versions of antibody variable domains may be generated by any number of techniques with which those having ordinary skill in the art will be familiar, including but not limited to the methods outlined in Example 14 below.

The variable region may be covalently attached at a C-terminal amino acid to at least one other antibody domain or a fragment thereof. Thus, for example, a VH that is present in the variable region may be linked to an immunoglobulin CH1 domain. Similarly a $V_L$ domain may be linked to a $C_K$ domain. In this way, for example, the antibody may be a Fab fragment wherein the antigen binding domain contains associated $V_H$ and $V_L$ domains covalently linked at their C-termini to a CH1 and $C_K$ domain, respectively. The CH1 domain may be extended with further amino acids, for example to provide a hinge region or a portion of a hinge region domain as found in a Fab' fragment, or to provide further domains, such as antibody CH2 and CH3 domains.

Derivatives and Variants

The nucleotide sequences of the antigen binding proteins of the present invention, encoding the corresponding amino acid sequences of the antibodies of the present invention, can be altered, for example, by random mutagenesis or by site-directed mutagenesis (e.g., oligonucleotide-directed site-specific mutagenesis) to create an altered polynucleotide comprising one or more particular nucleotide substitutions, deletions, or insertions as compared to the non-mutated polynucleotide. Examples of techniques for making such alterations are described in Walder et al., 1986, Gene 42:133; Bauer et al. 1985, Gene 37:73; Craik, BioTechniques, January 1985, 12-19; Smith et al., 1981, Genetic Engineering: Principles and Methods, Plenum Press; and U.S. Pat. Nos. 4,518,584 and 4,737,462. These and other methods can be used to make, for example, derivatives of the antigen binding proteins that have a desired property, for example, increased affinity, avidity, or specificity for a desired target, increased activity or stability in vivo or in vitro, or reduced in vivo side-effects as compared to the underivatized antibody.

Other derivatives of the antigen binding proteins within the scope of this invention include covalent or aggregative conjugates of the antigen binding proteins, with other proteins or polypeptides, such as by expression of recombinant fusion proteins comprising heterologous polypeptides fused to the N-terminus or C-terminus of a polypeptide. For example, the conjugated peptide may be a heterologous signal (or leader) polypeptide, e.g., the yeast alpha-factor leader, or a peptide such as an epitope tag. Antigen binding protein-containing fusion proteins can comprise peptides added to facilitate purification or identification of antigen binding protein (e.g., poly-His). An antigen binding protein also can be linked to the FLAG peptide as described in Hopp et al., Bio/Technology 6:1204, 1988, and U.S. Pat. No. 5,011,912. The FLAG peptide is highly antigenic and provides an epitope reversibly bound by a specific monoclonal antibody (mAb), enabling rapid assay and facile purification of expressed recombinant protein. Reagents useful for preparing fusion proteins in which the FLAG peptide is fused to a given polypeptide are commercially available (Sigma, St. Louis, Mo.).

In another embodiment, the antigen binding proteins within the scope of this invention include antibody conjugates where antibody is conjugated to a non-proteinaceous chemical (drug) to form an antibody drug conjugate (ADC). Generally the ADC comprises an antibody conjugated to a chemotherapeutic agent, e.g., a cytotoxic agent, a cytostatic agent, a toxin, or a radioactive agent. A linker molecule can be used to conjugate the drug to the antibody. A wide variety of linkers and drugs useful in ADC technology are known in the art and may be used in embodiments of the present invention. (See US20090028856; US2009/0274713; US2007/0031402; WO2005/084390; WO2009/099728; U.S. Pat. No. 5,208,020; U.S. Pat. No. 5,416,064; U.S. Pat. Nos. 5,475,092; 5,585,499; 6,436,931; 6,372,738; and 6,340,701, all incorporated herein by reference).

In another embodiment, oligomers that contain one or more antigen binding proteins may be employed in certain embodiments of the present invention. Oligomers may be in the form of covalently-linked or non-covalently-linked dimers, trimers, or higher oligomers. Oligomers comprising two or more antigen binding protein are contemplated for use, with one example being a homodimer. Other oligomers include heterodimers, homotrimers, heterotrimers, homotetramers, heterotetramers, etc.

One embodiment is directed to oligomers comprising multiple antigen binding proteins joined via covalent or non-covalent interactions between peptide moieties fused to the antigen binding proteins. Such peptides may be peptide linkers (spacers), or peptides that have the property of promoting oligomerization. Leucine zippers and certain polypeptides derived from antibodies are among the peptides that can promote oligomerization of antigen binding proteins attached thereto, as described in more detail below.

In particular embodiments, the oligomers comprise from two to four antigen binding proteins. The antigen binding proteins of the oligomer may be in any form, such as any of the forms described above, e.g., variants.

In one embodiment, an oligomer is prepared using polypeptides derived from immunoglobulins. Preparation of fusion proteins comprising certain heterologous polypeptides fused to various portions of antibody-derived polypeptides (including the Fc domain) has been described, e.g., by Ashkenazi et al., 1991, PNAS USA 88:10535; Byrn et al., 1990, Nature 344:677; and Hollenbaugh et al., 1992 "Construction of Immunoglobulin Fusion Proteins", in Current Protocols in Immunology, Suppl. 4, pages 10.19.1-10.19.11.

One embodiment of the present invention is directed to a dimer comprising two fusion proteins created by fusing an antigen binding fragment of an anti-ASGR, ASGR-1, and/or ASGR-2 antibody to the Fc region of an antibody. The dimer can be made by, for example, inserting a gene fusion encoding the fusion protein into an appropriate expression vector, expressing the gene fusion in host cells transformed with the recombinant expression vector, and allowing the expressed fusion protein to assemble much like antibody molecules, whereupon interchain disulfide bonds form between the Fc moieties to yield the dimer.

The term "Fc polypeptide" as used herein includes native and mutein forms of polypeptides derived from the Fc region of an antibody. Truncated forms of such polypeptides containing the hinge region that promotes dimerization also are included. Fusion proteins comprising Fc moieties (and oligomers formed therefrom) offer the advantage of facile purification by affinity chromatography over Protein A or Protein G columns.

One suitable Fc polypeptide, described in PCT application WO 93/10151 (hereby incorporated by reference), is a single chain polypeptide extending from the N-terminal hinge region to the native C-terminus of the Fc region of a human IgG1 antibody. Another useful Fc polypeptide is the Fc mutein described in U.S. Pat. No. 5,457,035 and in Baum et al., 1994, EMBO J. 13:3992-4001. The amino acid sequence of this mutein is identical to that of the native Fc sequence presented in WO 93/10151, except that amino acid 19 has been changed from Leu to Ala, amino acid 20 has been changed from Leu to Glu, and amino acid 22 has been changed from Gly to Ala. The mutein exhibits reduced affinity for Fc receptors.

In some embodiments, the variable portion of the heavy and/or light chains of a desired antibody may be substituted for the variable portion of an antibody heavy and/or light chain.

Alternatively, the oligomer is a fusion protein comprising multiple antigen binding proteins, with or without peptide linkers (spacer peptides). Among the suitable peptide linkers are those described in U.S. Pat. Nos. 4,751,180 and 4,935,233.

Another method for preparing oligomeric antigen binding proteins involves use of a leucine zipper. Leucine zipper domains are peptides that promote oligomerization of the proteins in which they are found. Leucine zippers were originally identified in several DNA-binding proteins (Landschulz et al., 1988, Science 240:1759), and have since been found in a variety of different proteins. Among the known leucine zippers are naturally occurring peptides and derivatives thereof that dimerize or trimerize. Examples of leucine zipper domains suitable for producing soluble oligomeric proteins are described in PCT application WO 94/10308, and the leucine zipper derived from lung surfactant protein D (SPD) described in Hoppe et al., 1994, FEBS Letters 344:191, hereby incorporated by reference. The use of a modified leucine zipper that allows for stable trimerization of a heterologous protein fused thereto is described in Fanslow et al., 1994, Semin. Immunol. 6:267-78. In one approach, recombinant fusion proteins comprising a desired antibody fragment or derivative fused to a leucine zipper peptide are expressed in suitable host cells, and the soluble oligomeric antibody fragments or derivatives that form are recovered from the culture supernatant.

In another embodiment, the antigen binding proteins (e.g., antibodies) can be conjugated to a suitable vehicle to enhance the half-life thereof. Suitable vehicles include, but are not limited to Fc, albumin, transferrin, and the like. These and other suitable vehicles are known in the art. Such conjugated CDR peptides may be in monomeric, dimeric, tetrameric, or other form. In one embodiment, one or more water-soluble polymer is bonded at one or more specific position, for example at the amino terminus, of a binding agent. In an example, an antibody derivative comprises one or more water soluble polymer attachments, including, but not limited to, polyethylene glycol, polyoxyethylene glycol, or polypropylene glycol. See, e.g., U.S. Pat. Nos. 4,640,835, 4,496,689, 4,301,144, 4,670,417, 4,791,192 and 4,179,337. In certain embodiments, a derivative comprises one or more of monomethoxy-polyethylene glycol, dextran, cellulose, or other carbohydrate based polymers, poly-(N-vinyl pyrrolidone)-polyethylene glycol, propylene glycol homopolymers, a polypropylene oxide/ethylene oxide co-polymer, polyoxyethylated polyols (e.g., glycerol) and polyvinyl alcohol, as well as mixtures of such polymers. In certain embodiments, one or more water-soluble polymer is randomly attached to one or more side chains. In certain embodiments, PEG can act to improve the therapeutic capacity for a binding agent, such as an antibody. Certain such methods are discussed, for example, in U.S. Pat. No. 6,133,426, which is hereby incorporated by reference for any purpose. In certain embodiments, antibodies of the invention may be chemically bonded with polymers, lipids, or other moieties.

Nucleic Acids Encoding Antigen Binding Proteins

In another embodiment, the present invention provides isolated nucleic acid molecules that encode the antigen binding proteins of the present invention. In addition, provided are vectors comprising the nucleic acids, cell comprising the nucleic acids, and methods of making the antigen binding proteins of the invention. The nucleic acids comprise, for example, polynucleotides that encode all or part of an antigen binding protein, for example, one or both chains of an antibody of the invention, or a fragment, derivative, mutein, or variant thereof, polynucleotides sufficient for use as hybridization probes, PCR primers or sequencing primers for identifying, analyzing, mutating or amplifying a polynucleotide encoding a polypeptide, anti-sense nucleic acids for inhibiting expression of a polynucleotide, and complementary sequences of the foregoing. The nucleic acids can be any length as appropriate for the desired use or function, and can comprise one or more additional sequences, for example, regulatory sequences, and/or be part of a larger nucleic acid, for example, a vector. The nucleic acids can be single-stranded or double-stranded and can comprise RNA and/or DNA nucleotides, and artificial variants thereof (e.g., peptide nucleic acids).

Nucleic acids encoding antibody polypeptides (e.g., heavy or light chain, variable domain only, or full length) may be isolated from B-cells of mice that have been immunized with antigen. The nucleic acid may be isolated by conventional procedures such as polymerase chain reaction (PCR).

Nucleic acid sequences encoding the variable regions of the heavy and light chain variable regions are included herein. The skilled artisan will appreciate that, due to the degeneracy of the genetic code, each of the polypeptide sequences disclosed herein is encoded by a large number of other nucleic acid sequences. The present invention provides each degenerate nucleotide sequence encoding each antigen binding protein of the invention.

The invention further provides nucleic acids that hybridize to other nucleic acids under particular hybridization conditions. Methods for hybridizing nucleic acids are well-known in the art. See, e.g., Current Protocols in Molecular Biology, John Wiley & Sons, N.Y. (1989), 6.3.1-6.3.6. As defined herein, for example, a moderately stringent hybridization condition uses a prewashing solution containing 5× sodium chloride/sodium citrate (SSC), 0.5% SDS, 1.0 mM EDTA (pH 8.0), hybridization buffer of about 50% formamide, 6×SSC, and a hybridization temperature of 55° C. (or other similar hybridization solutions, such as one containing about 50% formamide, with a hybridization temperature of 42° C.), and washing conditions of 60° C., in 0.5×SSC, 0.1% SDS. A stringent hybridization condition hybridizes in 6×SSC at 45° C., followed by one or more washes in 0.1×SSC, 0.2% SDS at 68° C. Furthermore, one of skill in the art can manipulate the hybridization and/or washing conditions to increase or decrease the stringency of hybridization such that nucleic acids comprising nucleotide sequences that are at least 65, 70, 75, 80, 85, 90, 95, 98 or 99% identical to each other typically remain hybridized to each other. The basic parameters affecting the choice of hybridization conditions and guidance for devising suitable conditions are set forth by, for example, Sambrook, Fritsch, and Maniatis (1989, Molecular Cloning: A Laboratory Manual, Cold Spring Harbor Laboratory Press, Cold Spring Harbor, N.Y., chapters 9 and 11; and Current Protocols in Molecular Biology, 1995, Ausubel et al., eds., John Wiley & Sons, Inc., sections 2.10 and 6.3-6.4), and can be readily determined by those having ordinary skill in the art based on, for example, the length and/or base composition of the DNA. Changes can be introduced by mutation into a nucleic acid, thereby leading to changes in the amino acid sequence of a polypeptide (e.g., an antigen binding protein) that it encodes. Mutations can be introduced using any technique known in the art. In one embodiment, one or more particular amino acid residues are changed using, for example, a site-directed mutagenesis protocol. In another embodiment, one or more randomly selected residues is changed using, for example, a random mutagenesis protocol. However it is made, a mutant polypeptide can be expressed and screened for a desired property.

Mutations can be introduced into a nucleic acid without significantly altering the biological activity of a polypeptide that it encodes. For example, one can make nucleotide substitutions leading to amino acid substitutions at non-essential amino acid residues. In one embodiment, a nucleotide sequence provided herein for of the antibodies of the present invention, or a desired fragment, variant, or derivative thereof, is mutated such that it encodes an amino acid sequence comprising one or more deletions or substitutions of amino acid residues that are shown herein for the light chains of the antibodies of the present invention or the heavy chains of the antibodies of the present invention to be residues where two or more sequences differ. In another embodiment, the mutagenesis inserts an amino acid adjacent to one or more amino acid residues shown herein for the light chains of the antibodies of the present invention or the heavy chains of the antibodies of the present invention to be residues where two or more sequences differ. Alternatively, one or more mutations can be introduced into a nucleic acid that selectively change the biological activity of a polypeptide that it encodes.

In another embodiment, the present invention provides vectors comprising a nucleic acid encoding a polypeptide of the invention or a portion thereof. Examples of vectors include, but are not limited to, plasmids, viral vectors, non-episomal mammalian vectors and expression vectors, for example, recombinant expression vectors.

The recombinant expression vectors of the invention can comprise a nucleic acid of the invention in a form suitable for expression of the nucleic acid in a host cell. The recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells (e.g., SV40 early gene enhancer, Rous sarcoma virus promoter and cytomegalovirus promoter), those that direct expression of the nucleotide sequence only in certain host cells (e.g., tissue-specific regulatory sequences, see Voss et al., 1986, Trends Biochem. Sci. 11:287, Maniatis et al., 1987, Science 236:1237, incorporated by reference herein in their entireties), and those that direct inducible expression of a nucleotide sequence in response to particular treatment or condition (e.g., the metallothionin promoter in mammalian cells and the tet-responsive and/or streptomycin responsive promoter in both prokaryotic and eukaryotic systems (see id.). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein.

In another embodiment, the present invention provides host cells into which a recombinant expression vector of the invention has been introduced. A host cell can be any prokaryotic cell or eukaryotic cell. Prokaryotic host cells include gram negative or gram positive organisms, for example E. coli or bacilli. Higher eukaryotic cells include insect cells, yeast cells, and established cell lines of mammalian origin. Examples of suitable mammalian host cell lines include Chinese hamster ovary (CHO) cells or their derivatives such as Veggie CHO and related cell lines which grow in serum-free media (see Rasmussen et al., 1998, Cytotechnology 28:31) or CHO strain DXB-11, which is deficient in DHFR (see Urlaub et al., 1980, Proc. Natl. Acad. Sci. USA 77:4216-20). Additional CHO cell lines include CHO-K1 (ATCC#CCL-61), EM9 (ATCC# CRL-1861), and UV20 (ATCC# CRL-1862). Additional host cells include the COS-7 line of monkey kidney cells (ATCC CRL 1651) (see Gluzman et al., 1981, Cell 23:175), L cells, C127 cells, 3T3 cells (ATCC CCL 163), AM-1/D cells (described in U.S. Pat. No. 6,210,924), HeLa cells, BHK (ATCC CRL 10) cell lines, the CV1/EBNA cell line derived from the African green monkey kidney cell line CV1 (ATCC CCL 70) (see McMahan et al., 1991, EMBO J. 10:2821), human embryonic kidney cells such as 293, 293 EBNA or MSR 293, human epidermal A431 cells, human Colo205 cells, other transformed primate cell lines, normal diploid cells, cell strains derived from in vitro culture of primary tissue, primary explants, HL-60, U937, HaK or Jurkat cells. Appropriate cloning and expression vectors for use with bacterial, fungal, yeast, and mammalian cellular hosts are described by Pouwels et al. (Cloning Vectors: A Laboratory Manual, Elsevier, New York, 1985).

Vector DNA can be introduced into prokaryotic or eukaryotic cells via conventional transformation or transfection techniques. For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Additional selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die), among other methods.

The transformed cells can be cultured under conditions that promote expression of the polypeptide, and the polypeptide recovered by conventional protein purification procedures. Polypeptides contemplated for use herein include substantially homogeneous recombinant mammalian antibody polypeptides substantially free of contaminating endogenous materials.

Cells containing the nucleic acid encoding the antigen binding proteins of the present invention also include hybridomas. The production and culturing of hybridomas are discussed in the antibody section above.

In some embodiments, a vector comprising a nucleic acid molecule as described herein is provided. In some embodiments, the invention comprises a host cell comprising a nucleic acid molecule as described herein.

In some embodiments, a nucleic acid molecule encoding the antigen binding protein as described herein is provided.

In some embodiments, a pharmaceutical composition comprising at least one antigen binding protein described herein is provided.

Antigen Binding Protein Production

The antigen binding proteins of the invention can be produced by any method known in the art for the synthesis of proteins (e.g., antibodies), in particular, by chemical synthesis or preferably, by recombinant expression techniques.

Recombinant expression of the antigen binding proteins requires construction of an expression vector containing a polynucleotide that encodes the antigen binding proteins. Once a polynucleotide encoding the antigen binding proteins molecule has been obtained, the vector for the production of the antigen binding proteins may be produced by recombinant DNA technology. An expression vector is constructed containing the antigen binding proteins coding sequences and appropriate transcriptional and translational control signals. These methods include, for example, in vitro recombinant DNA techniques, synthetic techniques, and in vivo genetic recombination.

The expression vector is transferred to a host cell by conventional techniques and the transfected cells are then cultured by conventional techniques to produce an antigen binding proteins of the invention. In one embodiment of the invention, vectors encoding both the heavy and light chains of an antibody may be co-expressed in the host cell for expression of the entire immunoglobulin molecule, as detailed below.

A variety of host-expression vector systems may be utilized to express the antigen binding proteins of the invention. Such host-expression systems represent vehicles by which the coding sequences of interest may be produced and subsequently purified, but also represent cells which may, when transformed or transfected with the appropriate nucleotide coding sequences, express an antibody molecule of the invention in situ. Bacterial cells such as E. coli, and eukaryotic cells are commonly used for the expression of a recombinant antibody molecule, especially for the expression of whole recombinant antibody molecule. For example, mammalian cells such as Chinese hamster ovary cells (CHO), in conjunction with a vector such as the major intermediate early gene promoter element from human cytomegalovirus is an effective expression system for antibodies (Foecking et al., Gene 45:101 (1986); Cockett et al., Bio/Technology 8:2 (1990)).

In addition, a host cell strain may be chosen which modulates the expression of the inserted sequences, or modifies and processes the gene product in the specific fashion desired. Such modifications (e.g., glycosylation) and processing (e.g., cleavage) of protein products may be important for the function of the protein. Different host cells have characteristic and specific mechanisms for the post-translational processing and modification of proteins and gene products. Appropriate cell lines or host systems can be chosen to ensure the correct modification and processing of the foreign protein expressed. To this end, eukaryotic host cells which possess the cellular machinery for proper processing of the primary transcript, glycosylation, and phosphorylation of the gene product may be used. Such mammalian host cells include, but are not limited to, CHO, COS, 293, 3T3, or myeloma cells.

For long-term, high-yield production of recombinant proteins, stable expression is preferred. For example, cell lines which stably express the antibody molecule may be engineered. Rather than using expression vectors which contain viral origins of replication, host cells can be transformed with DNA controlled by appropriate expression control elements (e.g., promoter, enhancer, sequences, transcription terminators, polyadenylation sites, etc.), and a selectable marker. Following the introduction of the foreign DNA, engineered cells may be allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method may advantageously be used to engineer cell lines which express the antibody molecule. Such engineered cell lines may be particularly useful in screening and evaluation of compounds that interact directly or indirectly with the antibody molecule.

A number of selection systems may be used, including but not limited to the herpes simplex virus thymidine kinase (Wigler et al., Cell 11:223 (1977)), hypoxanthine-guanine phosphoribosyltransferase (Szybalska & Szybalski, Proc. Natl. Acad. Sci. USA 48:202 (1992)), and adenine phosphoribosyltransferase (Lowy et al., Cell 22:817 (1980)) genes can be employed in tk, hgprt or aprt-cells, respectively. Also, antimetabolite resistance can be used as the basis of selection for the following genes: dhfr, which confers resistance to methotrexate (Wigler et al., Proc. Natl. Acad. Sci. USA 77:357 (1980); O'Hare et al., Proc. Natl. Acad. Sci. USA 78:1527 (1981)); gpt, which confers resistance to mycophenolic acid (Mulligan & Berg, Proc. Natl. Acad. Sci. USA 78:2072 (1981)); neo, which confers resistance to the aminoglycoside G-418 (Wu and Wu, Biotherapy 3:87-95 (1991)); and hygro, which confers resistance to hygromycin (Santerre et al., Gene 30:147 (1984)). Methods commonly known in the art of recombinant DNA technology may be routinely applied to select the desired recombinant clone, and such methods are described, for example, in Ausubel et al. (eds.), Current Protocols in Molecular Biology, John Wiley & Sons, N Y (1993); Kriegler, Gene Transfer and Expression, A Laboratory Manual, Stockton Press, N Y (1990); and in Chapters 12 and 13, Dracopoli et al. (eds), Current Protocols in Human Genetics, John Wiley & Sons, N Y (1994); Colberre-Garapin et al., J. Mol. Biol. 150:1 (1981), which are incorporated by reference herein in their entireties.

The expression levels of an antibody molecule can be increased by vector amplification (for a review, see Bebbington and Hentschel, "The use of vectors based on gene amplification for the expression of cloned genes in mammalian cells" (DNA Cloning, Vol. 3. Academic Press, New York, 1987)). When a marker in the vector system expressing antibody is amplifiable, increase in the level of inhibitor present in culture of host cell will increase the number of copies of the marker gene. Since the amplified region is associated with the antibody gene, production of the antibody will also increase (Crouse et al., Mol. Cell. Biol. 3:257 (1983)).

The host cell may be co-transfected with two expression vectors of the invention, for example, the first vector encoding an antibody heavy chain derived polypeptide and the second vector encoding an antibody light chain derived polypeptide. The two vectors may contain identical selectable markers which enable equal expression of heavy and light chain polypeptides. Alternatively, a single vector may be used which encodes, and is capable of expressing, for example, both antibody heavy and light chain polypeptides. In such situations, the light chain should be placed before the heavy chain to avoid an excess of toxic free heavy chain (Proudfoot, Nature 322:52 (1986); Kohler, Proc. Natl. Acad. Sci. USA 77:2197 (1980)). The coding sequences for the heavy and light chains may comprise cDNA or genomic DNA.

Once an antibody molecule of the invention has been produced by an animal, chemically synthesized, or recombinantly expressed, it may be purified by any method known in the art for purification of an immunoglobulin molecule, for example, by chromatography (e.g., ion exchange, affinity, particularly by affinity for the specific antigen after Protein A, and size-exclusion chromatography), centrifugation, differential solubility, or by any other standard technique for the purification of proteins. In addition, the antibodies of the present invention or fragments thereof can be fused to heterologous polypeptide sequences described herein or otherwise known in the art, to facilitate purification.

In some embodiments, the present invention encompasses antibodies recombinantly fused or chemically conjugated (including both covalently and non-covalently conjugations) to a polypeptide. Fused or conjugated antibodies of the present invention may be used for ease in purification. See e.g., Harbor et al., supra, and PCT publication WO 93/21232; EP 439,095; Naramura et al., Immunol. Lett. 39:91-99 (1994); U.S. Pat. No. 5,474,981; Gillies et al., Proc. Natl. Acad. Sci. 89:1428-1432 (1992); Fell et al., J. Immunol. 146:2446-2452 (1991).

Moreover, the antibodies or fragments thereof of the present invention can be fused to marker sequences, such as a peptide to facilitate purification. In preferred embodiments, the marker amino acid sequence is a hexa-histidine peptide, such as the tag provided in a pQE vector (QIAGEN, Inc., 9259 Eton Avenue, Chatsworth, Calif., 91311), among others, many of which are commercially available. As described in Gentz et al., Proc. Natl. Acad. Sci. USA 86:821-824 (1989), for instance, hexa-histidine provides for convenient purification of the fusion protein. Other peptide tags useful for purification include, but are not limited to, the "HA" tag, which corresponds to an epitope derived from the influenza hemagglutinin protein (Wilson et al., Cell 37:767 (1984)) and the "flag" tag.

Antibody Effector Function

In some embodiments, the present invention provides antigen binding proteins (e.g., antibodies) with altered effector function (e.g., decreasing or increasing effector function). Nonlimiting examples of methods for increasing effector function can be found in U.S. Pat. Nos. 5,624,821, 6,602,684, 7,029,872, U.S. Patent Application Publication Nos. 2006/0067930A1, 2005/0272128A1, 2005/0079605A1, 2005/0123546A1, 2004/0072290A1, 2006/0257399A1, 2004/0261148A1, 2007/0092521, 2006/0040325A1, and 2006/0039904A1, and International Patent Application Publication Nos. WO 04/029207, WO03011878, WO05044859, WO 06071856, and WO 06071280.

Methods of engineering Fc regions of antibodies so as to alter effector functions are known in the art (e.g., U.S. Patent Publication No. 20040185045 and PCT Publication No. WO 2004/016750, both to Koenig et al., which describe altering the Fc region to enhance the binding affinity for Fc gamma RIIB as compared with the binding affinity for FC gamma RIIA; see, also, PCT Publication Nos. WO 99/58572 to Armour et al., WO 99/51642 to Idusogie et al., and U.S. Pat. No. 6,395,272 to Deo et al.). Methods of modifying the Fc region to decrease binding affinity to Fc gamma RIIB are also known in the art (e.g., U.S. Patent Publication No. 20010036459 and PCT Publication No. WO 01/79299, both to Ravetch et al.). Modified antibodies having variant Fc regions with enhanced binding affinity for Fc gamma RIIIA and/or Fc gamma RIIA as compared with a wildtype Fc region have also been described (e.g., PCT Publication Nos. WO 2004/063351, to Stavenhagen et al., the disclosure of which is incorporated herein in its entirety).

Antibody effector function may also be modified through the generation of antibodies with altered glycosylation patterns. Such altered glycosylation patterns have been demonstrated to increase or decrease the ADCC ability of antibodies, as desired. Such carbohydrate modifications can be accomplished by, for example, expressing the antibody in a host cell with altered glycosylation machinery. Cells with altered glycosylation machinery have been described in the art and can be used as host cells in which to express recombinant antibodies of the invention to thereby produce an antibody with altered glycosylation.

Half-Life Alteration

In some embodiments, the present invention provides for antigen binding proteins (e.g., antibodies) which have an extended half-life in vivo. In particular, the present invention provides antigen binding proteins which have a half-life in a mammal (for example, but not limited to, a human), of greater than 3 days, greater than 7 days, greater than 10 days, greater than 15 days, greater than 25 days, greater than 30 days, greater than 35 days, greater than 40 days, greater than 45 days, greater than 2 months, greater than 3 months, greater than 4 months, or greater than 5 months.

To prolong the serum circulation of antigen binding proteins (for example, monoclonal antibodies) or antibody fragments (for example, Fab fragments) in vivo, for example, inert polymer molecules such as high molecular weight polyethyleneglycol (PEG) can be attached to the antibodies (including antibody fragments thereof) with or without a multifunctional linker either through site-specific conjugation of the PEG to the N- or C-terminus of the antibodies or via epsilon-amino groups present on lysine residues. Linear or branched polymer derivatization that results in minimal loss of biological activity will be used. The degree of conjugation can be closely monitored by SDS-PAGE and mass spectrometry to ensure proper conjugation of PEG molecules to the antigen binding proteins. Unreacted PEG can be separated from antigen binding proteins-PEG conjugates by size-exclusion or by ion-exchange chromatography. PEG-derivatized antigen binding proteins can be tested for binding activity as well as for in vivo efficacy using methods known to those of skill in the art, for example, by immunoassays described herein.

In certain embodiments, antibodies having an increased half-life in vivo can also be generated by introducing one or more amino acid modifications (i.e., substitutions, insertions or deletions) into an IgG constant domain, or FcRn binding fragment thereof (e.g., Fc or hinge Fc domain fragment). See, e.g., International Publication No. WO 98/23289; International Publication No. WO 97/34631; and U.S. Pat. No. 6,277,375, each of which is incorporated herein by reference in its entirety.

Conjugates

In some embodiments, covalent modifications of the antigen binding proteins of the invention are included within the scope of this invention. They may be made by chemical synthesis or by enzymatic or chemical cleavage of the antigen binding proteins, if applicable. Other types of covalent modifications of the antigen binding proteins are introduced into the molecule by reacting targeted amino acid residues of the antibody with an organic derivatizing agent that is capable of reacting with selected side chains or the N- or C-terminal residues.

Cysteinyl residues most commonly are reacted with alpha-haloacetates (and corresponding amines), such as chloroacetic acid or chloroacetamide, to give carboxymethyl or carboxyamidomethyl derivatives. Similarly, iodo-reagents may also be used. Cysteinyl residues also are derivatized by reaction with bromotrifluoroacetone, alpha-bromo-beta-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0.

Lysyl and amino-terminal residues are reacted with succinic or other carboxylic acid anhydrides. Derivatization with these agents has the effect of reversing the charge of the lysinyl residues. Other suitable reagents for derivatizing .alpha.-amino-containing residues and/or e-amino-containing residues include imidoesters such as methyl picolinimidate, pyridoxal phosphate, pyridoxal, chloroborohydride, trinitrobenzenesulfonic acid, 0-methylisourea, 2,4-pentanedione, and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginyl residues generally requires that the reaction be performed in alkaline conditions because of the high pKa of the guanidine functional group. Furthermore, these reagents may react with the epsilon-amino groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively. Tyrosyl residues are iodinated using $I^{125}$ or $I^{131}$ to prepare labeled proteins for use in radioimmunoassay.

Carboxyl side groups (aspartyl or glutamyl) are selectively modified by reaction with carbodiimides (R—N═C═N—R'), where R and R' are different alkyl groups, such as 1-cyclohexyl-3-(2-morpholinyl-4-ethyl)carbodiimide or 1-ethyl-3-(4-azonia-4,4-dimethylpentyl)carbodiimide. Furthermore, aspartyl and glutamyl residues are converted to asparaginyl and glutaminyl residues by reaction with ammonium ions.

Glutaminyl and asparaginyl residues are frequently deamidated to the corresponding glutamyl and aspartyl residues, respectively. These residues are deamidated under neutral or basic conditions. The deamidated form of these residues falls within the scope of this invention.

Other modifications include hydroxylation of proline and lysine, phosphorylation of hydroxyl groups of seryl or threonyl residues, methylation of the .alpha.-amino groups of lysine, arginine, and histidine side chains (T. E. Creighton, Proteins: Structure and Molecular Properties, W.H. Freeman & Co., San Francisco, pp. 79-86 (1983)), acetylation of the N-terminal amine, and amidation of any C-terminal carboxyl group.

Another type of covalent modification involves chemically or enzymatically coupling glycosides to the antibody. These procedures are advantageous in that they do not require production of the antibody in a host cell that has glycosylation capabilities for N- or O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330 published 11 Sep. 1987, and in Aplin and Wriston, CRC Crit. Rev. Biochem., pp. 259-306 (1981).

Interfering RNA

In some embodiments, the present invention provides polynucleotide compositions that target ASGR-1 and/or ASGR-2 and are useful for methods for treatment, therapy, and prophylaxis in disease related to ASGR, ASGR-1 and/or ASGR-2 expression, where reduction or inhibition of the expression or function of a selected target polynucleotide sequence is desired. Examples of polynucleotides that can be used to target ASGR-1 and/or ASGR-2 sequences and reduce ASGR-1 and/or ASGR-2 expression include, but are not limited to, antisense oligonucleotides, and RNA interference (RNAi) agents, including short or small interfering RNA (siRNA), short hairpin RNA (shRNA), and microRNA (miRNA). See, for example, U.S. Pat. Nos. 6,506,559; 8,394,628; 7,056,704; 7,078,196; 6,107,094; 5,898,031; 6,573,099; and European Patent No. 1,144,623. See also, for example, U.S. patent application publication nos. 2015/0259689; 2015/0197746; 2011/0092565; U.S. Pat. Nos. 8,877,917; 8,507,455; and 7,579,451.

In certain embodiments, a composition for inhibiting the function or expression of a target polynucleotide sequence (e.g. ASGR-1 mRNA sequence, ASGR-2 mRNA sequence) in a mammalian cell, according to this invention, comprises an agent that provides to a mammalian cell an at least partially double-stranded RNA molecule (e.g., an interfering RNA molecule). A double-stranded RNA molecule may include chemical modifications to ribonucleotides, including modifications to the ribose sugar, base, or backbone components of the ribonucleotides, such as those described herein or known in the art. Any such modifications, as used in a double-stranded RNA molecule (e.g. siRNA, shRNA, or the like), are encompassed by the term "double-stranded RNA" for the purposes of this disclosure. Thus, in general, the term "RNA" may also include RNA-DNA hybrids and polynucleotides comprising one or more modified nucleotides (e.g. nucleotides with modifications at the 2' position of the ribose ring), except where specified otherwise, e.g., where a 2'-OH group of ribose is required for a particular linkage.

In some embodiments at least 10% of a partially double-stranded RNA molecule is double-stranded. Alternatively, the double stranded portion of these RNA molecules can be at least 30% of the length of the molecule. In another embodiment, the double stranded portion of these molecules can be at least 50% of the length of the molecule. In still another embodiment, the double stranded portion of these molecules can be at least 70% of the length of the molecule. In another embodiment, the double stranded portion of these molecules can be at least 90% of the length of the molecule. In another embodiment, the molecule can be double stranded over its entire length. Alternatively, the double-stranded portion of these molecules can occur at either or both termini, or in some middle portion of the molecule, if the molecule is linear. Similarly, the double-stranded portion can be in any location if the molecule is circular. In certain embodiments of the present invention, the double-stranded portion of the RNA molecule becomes double-stranded only when the molecule is in the mammalian cell. In still other embodiment of this invention, the partially double-stranded molecule is an RNA/DNA hybrid, for example, a single strand containing RNA and DNA, prepared in vitro; or a duplex of two such single strands or portions thereof. In yet another embodiment, the RNA molecule, made in vivo or in vitro, is a duplex comprised of an RNA single strand and a DNA single strand. In some embodiments, the partially double-stranded RNA molecule comprises a polynucleotide sequence that is substantially homologous to the target polynucleotide sequence in order to effectively reduce or inhibit the function or expression thereof. The necessary homology may be suitably defined by use of a computer algorithm. As known in the art and discussed herein, "homology" or "identity" means the degree of sequence relatedness between two polypeptide or two polynucleotide sequences as determined by the identity of the match between two lengths of such sequences. Both identity and homology can be readily calculated by methods in the prior art [See also, e.g., COMPUTATIONAL MOLECULAR BIOLOGY, Lesk, A. M., ed., Oxford University Press, New York, (1988); BIOCOMPUTING: INFORMATICS AND GENOME PROJECTS, Smith, D. W., ed., Academic Press, New York, (1993); COMPUTER ANALYSIS OF SEQUENCE DATA, PART I, Griffin, A. M., and Griffin, H. G., eds., Humana Press, New Jersey, (1994); SEQUENCE ANALYSIS IN MOLECULAR BIOLOGY, von Heinje, G., Academic Press, (1987); and SEQUENCE ANALYSIS PRIMER, Gribskov, M. and Devereux, J., eds., M Stockton Press, New York, (1991)]. While there exist a number of methods to measure identity and homology between two polynucleotide sequences, the terms "identity", "similarity" and homology are well known to skilled artisans [H. Carillo and D. Lipton, SIAM J. Applied Math., 48:1073 (1988)]. Methods commonly employed to determine identity or homology between two sequences include, but are not limited to, those disclosed in Guide to Huge Computers, Martin J. Bishop, ed., Academic Press, San Diego, 1994, and H. Carillo and D. Lipton, SIAM J. Applied Math., 48:1073 (1988). Preferred methods to determine identity or homology are designed to give the largest match between the two sequences tested. Methods to determine identity and similarity are codified in computer programs. Preferred computer program to determine identity and homology between two sequences include, but are not limited to, the algorithm BESTFIT from the GCG program package [J. Devereux et al., Nucl. Acids Res., 12(1):387 (1984)], the related MACVECTOR program (Oxford), and the FASTA (Pearson) programs. For instance, searches for sequence similarities in databases between significant naturally occurring mammalian polynucleotide sequences and target polynucleotide sequences enable the design of suitable RNA molecules desired for use in the invention. The algorithm and/or the degree of homology necessary for any particular RNA molecule may be selected by one of skill in the art, depending on the identity of the target, and/or the closeness of homology of the target sequence to any naturally occurring mammalian sequence, which is desired to be left functioning normally after use of the methods of this invention.

In some embodiments, a polynucleotide composition for reducing the expression or function of ASGR-1 and/or ASGR-2 sequences is an RNAi agent comprising a double-stranded RNA molecule which comprises two antiparallel strands of contiguous nucleotides that are sufficiently complementary to each other to hybridize to form a duplex region. "Hybridize" or "hybridization" refers to the pairing of complementary polynucleotides, typically via hydrogen bonding (e.g. Watson-Crick, Hoogsteen or reversed Hoogsteen hydrogen bonding) between complementary bases in the two polynucleotides. The strand comprising a region having a sequence that is substantially complementary to a target sequence (e.g. target mRNA) is referred to as the "antisense strand." The "sense strand" refers to the strand that includes a region that is substantially complementary to a region of the antisense strand. In some embodiments, the sense strand may comprise a region that has a sequence that is substantially identical to the target sequence.

As used herein, a first sequence is "complementary" to a second sequence if a polynucleotide comprising the first sequence can hybridize to a polynucleotide comprising the second sequence to form a duplex region under certain conditions, such as physiological conditions. Other such conditions can include moderate or stringent hybridization conditions, which are known to those of skill in the art. A first sequence is considered to be fully complementary (100% complementary) to a second sequence if a polynucleotide comprising the first sequence base pairs with a polynucleotide comprising the second sequence over the entire length of one or both nucleotide sequences without any mismatches. A sequence is "substantially complementary" to a target sequence if the sequence is at least about 80%, 85%, 90%, 95%, 96%, 97%, 98%, 99% or 100% complementary to a target sequence. Percent complementarity can be calculated by dividing the number of bases in a first sequence that are complementary to bases at corresponding positions in a second or target sequence by the total length of the first sequence. A sequence may also be said to be substantially complementary to another sequence if there are no more than 5, 4, 3, or 2 mismatches over a 30 base pair duplex region when the two sequences are hybridized. Generally, if any nucleotide overhangs, as defined herein, are present, the sequence of such overhangs is not considered in determining the degree of complementarity between two sequences. By way of example, a sense strand of 21 nucleotides in length and an antisense strand of 21 nucleotides in length that hybridize to form a 19 base pair duplex region with a 2 nucleotide overhang at the 3' end of each strand would be considered to be fully complementary as the term is used herein.

In some embodiments, a region of the antisense strand comprises a sequence that is fully complementary to a region of the target RNA sequence (e.g. ASGR-1 and/or ASGR-2 mRNA). In such embodiments, the sense strand may comprise a sequence that is fully complementary to the sequence of the antisense strand. In other such embodiments, the sense strand may comprise a sequence that is substantially complementary to the sequence of the antisense strand, e.g. having 1, 2, 3, 4, or 5 mismatches in the duplex region formed by the sense and antisense strands. In certain embodiments, it is preferred that any mismatches occur within the terminal regions (e.g. within 6, 5, 4, 3, or 2 nucleotides of the 5' and/or 3' ends of the strands). In one embodiment, any mismatches in the duplex region formed from the sense and antisense strands occur within 6, 5, 4, 3, or 2 nucleotides of the 5' end of the antisense strand.

In certain embodiments, the sense strand and antisense strand of the double-stranded RNA may be two separate molecules that hybridize to form a duplex region, but are otherwise unconnected. Such double-stranded RNA molecules formed from two separate strands are referred to as "small interfering RNAs" or "short interfering RNAs" (siRNAs).

In other embodiments, the sense strand and the antisense strand that hybridize to form a duplex region may be part of a single RNA molecule, i.e. the sense and antisense strands are part of a self-complementary region of a single RNA molecule. In such cases, a single RNA molecule comprises a duplex region (also referred to as a stem region) and a loop region. The 3' end of the sense strand is connected to the 5' end of the antisense strand by a contiguous sequence of unpaired nucleotides, which will form the loop region. The loop region is typically of a sufficient length to allow the RNA molecule to fold back on itself such that the antisense strand can base pair with the sense strand to form the duplex or stem region. The loop region can comprise from about 3 to about 25, from about 5 to about 15, or from about 8 to about 12 unpaired nucleotides. Such RNA molecules with at least partially self-complementary regions are referred to as "short hairpin RNAs" (shRNAs). The length of a single, at least partially self-complementary RNA molecule can be from about 35 nucleotides to about 100 nucleotides, from about 45 nucleotides to about 85 nucleotides, or from about 50 to about 60 nucleotides and comprise a duplex region and loop region each having the lengths recited herein.

In some embodiments, the double-stranded RNA molecule comprises a sense strand and an antisense strand, wherein the antisense strand comprises a region having a sequence that is substantially or fully complementary to an ASGR-1 messenger RNA (mRNA) sequence and/or ASGR-2 mRNA sequence. As used herein, an "ASGR-1 mRNA sequence" or "ASGR-2 mRNA sequence" refers to any messenger RNA sequence, including splice variants, encoding an ASGR-1 protein or ASGR-2 protein, including ASGR-1 or ASGR-2 protein variants or isoforms from any species (e.g. mouse, rat, non-human primate, human).

The sense strand of the double-stranded RNA molecule typically comprises a sequence that is sufficiently complementary to the sequence of the antisense strand such that the two strands hybridize under physiological conditions to form a duplex region. A "duplex region" refers to the region in two complementary or substantially complementary polynucleotides that form base pairs with one another, either by Watson-Crick base pairing or other hydrogen bonding interaction, to create a duplex between the two polynucleotides. The duplex region of the RNA molecule should be of sufficient length to allow the RNA molecule to enter the RNA interference pathway, e.g. by engaging the Dicer enzyme and/or the RISC complex. For instance, in some embodiments, the duplex region is about 15 to about 30 base pairs in length. Other lengths for the duplex region within this range are also suitable, such as about 15 to about 28 base pairs, about 15 to about 26 base pairs, about 15 to about 24 base pairs, about 15 to about 22 base pairs, about 17 to about 28 base pairs, about 17 to about 26 base pairs, about 17 to about 24 base pairs, about 17 to about 23 base pairs, about 17 to about 21 base pairs, about 19 to about 25 base pairs, about 19 to about 23 base pairs, or about 19 to about 21 base pairs. In one embodiment, the duplex region is about 17 to about 24 base pairs in length. In another embodiment, the duplex region is about 19 to about 21 base pairs in length.

For embodiments in which the sense strand and antisense strand are two separate molecules (e.g. RNAi agent is a siRNA), the sense strand and antisense strand need not be the same length as the length of the duplex region. For instance, one or both strands may be longer than the duplex region and have one or more unpaired nucleotides or mismatches flanking the duplex region. Thus, in some embodiments, the double-stranded RNA molecule comprises at least one nucleotide overhang. As used herein, a "nucleotide overhang" refers to the unpaired nucleotide or nucleotides that extend beyond the duplex region at the terminal ends of the strands. Nucleotide overhangs are typically created when the 3' end of one strand extends beyond the 5' end of the other strand or when the 5' end of one strand extends beyond the 3' end of the other strand. The length of a nucleotide overhang is generally between 1 and 6 nucleotides, 1 and 5 nucleotides, 1 and 4 nucleotides, 1 and 3 nucleotides, 2 and 6 nucleotides, 2 and 5 nucleotides, or 2 and 4 nucleotides. In some embodiments, the nucleotide overhang comprises 1, 2, 3, 4, 5, or 6 nucleotides. In one particular embodiment, the nucleotide overhang comprises 1 to 4 nucleotides. In certain embodiments, the nucleotide overhang comprises 2 nucleotides. The nucleotides in the overhang can be ribonucleotides, deoxyribonucleotides, or modified nucleotides as described herein.

The nucleotide overhang can be at the 5' end or 3' end of one or both strands. For example, in one embodiment, the double-stranded RNA molecule comprises a nucleotide overhang at the 5' end and the 3' end of the antisense strand. In another embodiment, the double-stranded RNA molecule comprises a nucleotide overhang at the 5' end and the 3' end of the sense strand. In some embodiments, the double-stranded RNA molecule comprises a nucleotide overhang at the 5' end of the sense strand and the 5' end of the antisense strand. In other embodiments, the double-stranded RNA molecule comprises a nucleotide overhang at the 3' end of the sense strand and the 3' end of the antisense strand.

The double-stranded RNA molecules may comprise a single nucleotide overhang at one end of the molecule and a blunt end at the other. A "blunt end" means that the sense strand and antisense strand are fully base-paired at the end of the molecule and there are no unpaired nucleotides that extend beyond the duplex region. In some embodiments, the double-stranded RNA molecule comprises a nucleotide overhang at the 3' end of the sense strand and a blunt end at the 5' end of the sense strand and 3' end of the antisense strand. In other embodiments, the double-stranded RNA molecule comprises a nucleotide overhang at the 3' end of the antisense strand and a blunt end at the 5' end of the antisense strand and the 3' end of the sense strand. In certain embodiments, the double-stranded RNA molecule comprises a blunt end at both ends of the double-stranded RNA molecule. In such embodiments, the sense strand and antisense strand have the same length and the duplex region is the same length as the sense and antisense strands (i.e. the molecule is double-stranded over its entire length).

The sense strand and antisense strand can each independently be about 15 to about 30 nucleotides in length, about 18 to about 28 nucleotides in length, about 19 to about 27 nucleotides in length, about 19 to about 25 nucleotides in length, about 19 to about 23 nucleotides in length, about 21 to about 25 nucleotides in length, or about 21 to about 23 nucleotides in length. In certain embodiments, the sense strand and antisense strand are each about 18, about 19, about 20, about 21, about 22, about 23, about 24, or about 25 nucleotides in length. In some embodiments, the sense strand and antisense strand have the same length but form a duplex region that is shorter than the strands such that the double-stranded RNA molecule has two nucleotide overhangs. For instance, in one embodiment, the double-stranded RNA molecule comprises (i) a sense strand and an antisense strand that are each 21 nucleotides in length, (ii) a duplex region that is 19 base pairs in length, and (iii) nucleotide overhangs of 2 unpaired nucleotides at both the 3' end of the sense strand and the 3' end of the antisense strand. In another embodiment, the double-stranded RNA molecule comprises (i) a sense strand and an antisense strand that are each 23 nucleotides in length, (ii) a duplex region that is 21 base pairs in length, and (iii) nucleotide overhangs of 2 unpaired nucleotides at both the 3' end of the sense strand and the 3' end of the antisense strand. In other embodiments, the sense strand and antisense strand have the same length and form a duplex region over their entire length such that there are no nucleotide overhangs on either end of the double-stranded molecule. In one such embodiment, the double-stranded RNA molecule is blunt ended and comprises (i) a sense strand and an antisense strand, each of which is 21 nucleotides in length, and (ii) a duplex region that is 21 base pairs in length. In another such embodiment, the double-stranded RNA molecule is blunt ended and comprises (i) a sense strand and an antisense strand, each of which is 23 nucleotides in length, and (ii) a duplex region that is 23 base pairs in length.

In other embodiments, the sense strand or the antisense strand is longer than the other strand and the two strands form a duplex region having a length equal to that of the shorter strand such that the double-stranded RNA molecule comprises at least one nucleotide overhang. For example, in one embodiment, the double-stranded RNA molecule comprises (i) a sense strand that is 19 nucleotides in length, (ii) an antisense strand that is 21 nucleotides in length, (iii) a duplex region of 19 base pairs in length, and (iv) a single nucleotide overhang of 2 unpaired nucleotides at the 3' end of the antisense strand. In another embodiment, the double-stranded RNA molecule comprises (i) a sense strand that is 21 nucleotides in length, (ii) an antisense strand that is 23 nucleotides in length, (iii) a duplex region of 21 base pairs in length, and (iv) a single nucleotide overhang of 2 unpaired nucleotides at the 3' end of the antisense strand.

Off-target toxicity is a constant concern in the development of pharmaceutical products. With interfering RNA agents, the potential exists for homology with certain endogenous polynucleotide sequences that could lead to unintended toxic effects in the patient receiving the interfering RNA. Accordingly, in some embodiments, the RNA molecule comprises a polynucleotide sequence that is also substantially non-homologous to any naturally occurring, normally functioning, and essential mammalian polynucleotide sequence, so that the RNA molecule does not adversely affect the function of any essential naturally occurring mammalian polynucleotide sequence, when used in the methods of this invention. Such naturally occurring functional mammalian polynucleotide sequences include mammalian sequences that encode desired proteins, as well as mammalian sequences that are non-coding, but that provide for essential regulatory sequences in a healthy mammal. Preferably, the RNA molecule useful in the methods of the invention must be sufficiently distinct in sequence from any mammalian polynucleotide sequence expressed in the target cells (e.g. liver cells) for which the function is intended to be undisturbed after any of the methods of this invention are performed. As described for determining the homology to the target sequence above, one of skill in the art may resort to the above-identified computer algorithms to define the essential lack of homology between the RNA molecule polynucleotide sequence and the normal mammalian sequences expressed in the target cells. For example, in a specific embodiment, the homology between the sequence of an RNAi agent and the selected normal sequence expressed in the target cells is less than the homologies of the formulae described above. In some embodiments, there is almost no homology at all between the sequence of an RNAi agent and any normal mammalian sequence.

The double-stranded RNA molecules used in the methods of the invention may comprise one or more modified nucleotides. A "modified nucleotide" refers to a nucleotide that has one or more chemical modifications to the nucleoside, nucleobase, pentose ring, or phosphate group. The double-stranded RNA molecules may comprise combinations of modified nucleotides, ribonucleotides, and deoxyribonucleotides. Incorporation of modified nucleotides into one or both strands of double-stranded RNA molecules can improve the in vivo stability of the RNA molecules, e.g., by reducing the molecules' susceptibility to nucleases and other degradation processes. The potency of double-stranded RNA molecules for reducing expression of the target gene can also be enhanced by incorporation of modified nucleotides.

In certain embodiments, the modified nucleotides have a modification of the ribose sugar. These sugar modifications can include modifications at the 2' and/or 5' position of the pentose ring. A 2'-modified nucleotide refers to a nucleotide having a pentose ring with a substituent at the 2' position other than H or OH. Such 2'-modifications include, but are not limited to, 2'-O-alkyl (e.g. O—$C_1$-$C_{10}$ or O—$C_1$-$C_{10}$ substituted alkyl), 2'-O-allyl (O—$CH_2CH=CH_2$), 2'-C-allyl, 2'-fluoro, 2'-O-methyl ($OCH_3$), 2'-O-methoxyethyl (O—$(CH_2)_2OCH_3$), 2'-$OCF_3$, 2'-O$(CH_2)_2SCH_3$, 2'-O-aminoalkyl, 2'-amino (e.g. $NH_2$), 2'-O-ethylamine, and 2'-azido. Modifications at the 5' position of the pentose ring include, but are not limited to, 5'-methyl (R or S); 5'-vinyl, and 5'-methoxy.

The double-stranded RNA molecules employed in the methods of the invention may also comprise one or more modified internucleotide linkages. As used herein, the term "modified internucleotide linkage" refers to an internucleotide linkage other than the natural 3' to 5' phosphodiester linkage. In some embodiments, the modified internucleotide linkage is a phosphorous-containing internucleotide linkage, such as a phosphotriester, aminoalkylphosphotriester, an alkylphosphonate (e.g. methylphosphonate, 3'-alkylene phosphonate), a phosphinate, a phosphoramidate (e.g. 3'-amino phosphoramidate and aminoalkylphosphoramidate), a phosphorothioate (P=S), a chiral phosphorothioate, a phosphorodithioate, a thionophosphoramidate, a thionoalkylphosphonate, a thionoalkylphosphotriester, and a boranophosphate. In one embodiment, a modified internucleotide linkage is a 2' to 5' phosphodiester linkage. In other embodiments, the modified internucleotide linkage is a non-phosphorous-containing internucleotide linkage and thus can be referred to as a modified internucleoside linkage. Such non-phosphorous-containing linkages include, but are not limited to, morpholino linkages (formed in part from the sugar portion of a nucleoside); siloxane linkages (—O—Si$(H)_2$—O—); sulfide, sulfoxide and sulfone linkages; formacetyl and thioformacetyl linkages; alkene containing backbones; sulfamate backbones; methylenemethylimino (—$CH_2$—$N(CH_3)$—O—$CH_2$—) and methylenehydrazino linkages; sulfonate and sulfonamide linkages; amide linkages; and others having mixed N, O, S and $CH_2$ component parts. In one embodiment, the modified internucleoside linkage is a peptide-based linkage (e.g. aminoethylglycine) to create a peptide nucleic acid or PNA, such as those described in U.S. Pat. Nos. 5,539,082; 5,714,331; and 5,719, 262. Other suitable modified internucleotide and internucleoside linkages that may be employed in the double-stranded RNA molecules are described in U.S. Pat. No. 6,693,187, U.S. Pat. No. 9,181,551, U.S. Patent Publication No. 2016/0122761, and Deleavey and Damha, Chemistry and Biology, Vol. 19: 937-954, 2012, all of which are hereby incorporated by reference in their entireties.

Interfering RNA Delivery

The interfering RNA compounds can be administered by any method suitable for administration of nucleic acid agents, such as a DNA vaccine or gene therapy vectors. These methods include gene guns, bio injectors, and skin patches as well as needle-free methods such as the microparticle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from, for example, Alza Corporation and Nova Pharmaceuticals, Inc. Liposomal suspensions can also be used as pharmaceutically acceptable carriers. These can be prepared according to methods known to those skilled in the art, for example, as described in U.S. Pat. No. 4,522,811.

The interfering RNA molecule may be conjugated to one or more carbohydrate moieties to optimize one or more properties of the interfering RNA molecule. In many cases, the carbohydrate moiety will be attached to a modified subunit of the interfering RNA molecule or at the 5' or 3' end of one of strands of the interfering RNA molecule. E.g., the ribose sugar of one or more ribonucleotide subunits of an interfering RNA molecule can be replaced with another moiety, e.g., a non-carbohydrate (preferably cyclic) carrier to which is attached a carbohydrate moiety. A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The carbohydrate moiety may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

In some embodiments the interfering RNA molecule of the invention is conjugated to a carbohydrate moiety via a carrier, wherein the carrier can be cyclic group or acyclic group; in specific embodiments, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; preferably, the acyclic group is selected from serinol backbone or diethanolamine backbone.

Targeting the Interfering RNA

Given that ASGR, ASGR-1 and/or ASGR-2 is expressed on the surface of liver cells (e.g. hepatocytes), in certain embodiments, it is desirable to deliver the interfering RNA molecules to those liver cells so that the interfering effect can be exerted specifically within liver cells. Accordingly, in certain embodiments, the interfering RNA molecules are specifically targeted to liver cells using various methodologies known in the art and described herein. For example, in certain embodiments, antigen binding proteins (e.g. antibodies) or other targeting moieties disclosed herein below can be used to specifically target the interfering RNA molecules to the hepatocytes using various different receptors expressed on the surface of hepatocytes. In certain embodiments, the interfering RNA molecules are targeted to liver cells using the surface expressed ASGR, ASGR-1 and/or ASGR-2. In these embodiments, it is envisioned that this can result in a self-regulating system that reduces the amount of RNAi agent delivered to the liver cells as expression of ASGR, ASGR-1, and/or ASGR-2 is reduced due to the effect of the targeted interfering RNA.

A wide variety of targeting moieties can be coupled to the oligonucleotides of the present invention. In some embodiments, the targeting moieties are coupled, e.g., covalently, either directly or indirectly via an intervening tether.

In some embodiments, a targeting moiety alters the distribution, targeting or lifetime of the molecule into which it is incorporated. In preferred embodiments a targeting moiety provides an enhanced affinity for a selected target, e.g., molecule, cell or cell type, compartment, receptor e.g., a cellular or organ compartment, tissue, organ or region of the body, as, e.g., compared to a species absent such a targeting moiety. Targeting moieties providing enhanced affinity for a selected target are also termed targeting moieties.

Some targeting moieties can have endosomolytic properties. The endosomolytic targeting moieties promote the lysis of the endosome and/or transport of the composition of the invention, or its components, from the endosome to the cytoplasm of the cell. The endosomolytic targeting moietymay be a polyanionic peptide or peptidomimetic which shows pH-dependent membrane activity and fusogenicity. In one embodiment, the endosomolytic targeting moiety assumes its active conformation at endosomal pH. The "active" conformation is that conformation in which the endosomolytic targeting moietypromotes lysis of the endosome and/or transport of the composition of the invention, or its components, from the endosome to the cytoplasm of the cell. Exemplary endosomolytic targeting moietiesinclude the GALA peptide (Subbarao et al., Biochemistry, 1987, 26: 2964-2972), the EALA peptide (Vogel et al., J. Am. Chem. Soc., 1996, 118: 1581-1586), and their derivatives (Turk et al., Biochem. Biophys. Acta, 2002, 1559: 56-68). In one embodiment, the endosomolytic component may contain a chemical group (e.g., an amino acid) which will undergo a change in charge or protonation in response to a change in pH. The endosomolytic component may be linear or branched.

In certain embodiments, targeting moieties can improve transport, hybridization, and specificity properties and may also improve nuclease resistance of the resultant natural or modified oligoribonucleotide, or a polymeric molecule comprising any combination of monomers described herein and/or natural or modified ribonucleotides.

In some embodiments, targeting moieties in general can include therapeutic modifiers, e.g., for enhancing uptake; diagnostic compounds or reporter groups e.g., for monitoring distribution; cross-linking agents; and nuclease-resistance conferring moieties. General examples include lipids, steroids, vitamins, sugars, proteins, peptides, polyamines, and peptide mimics.

Targeting moieties can include a naturally occurring substance, such as a protein (e.g., human serum albumin (I), low-density lipoprotein (LDL), high-density lipoprotein (HDL), or globulin); a carbohydrate (e.g., a dextran, pullulan, chitin, chitosan, inulin, cyclodextrin or hyaluronic acid); or a lipid. The targeting moiety may also be a recombinant or synthetic molecule, such as a synthetic polymer, e.g., a synthetic polyamino acid, an oligonucleotide (e.g. an aptamer). Examples of polyamino acids include polyamino acid is a polylysine (PLL), poly L-aspartic acid, poly L-glutamic acid, styrene-maleic acid anhydride copolymer, poly (L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Targeting moieties can also include other targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Other examples of targeting moieties include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases or a chelator (e.g. EDTA), lipophilic molecules, e.g, cholesterol, cholic acid, 206 ligonucle acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Targeting moieties can be proteins, e.g., glycoproteins, or peptides, e.g., molecules having a specific affinity for a co-moiety, or antigen binding proteins, such as antibodies; e.g., an antibody, that binds to a specified cell type such as a liver hepatocyte. Targeting moieties may also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, multivalent fucose, or aptamers. The targeting moiety can be, for example, a lipopolysaccharide.

The targeting moiety can be a substance, e.g, a drug, which can increase the uptake of the interfering RNA molecule into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

The targeting moiety can increase the uptake of the interfering RNA molecule into the cell by activating an inflammatory response, for example. Exemplary targeting moieties that would have such an effect include tumor necrosis factor alpha (TNFalpha), interleukin-1 beta, or gamma interferon.

In one embodiment, the targeting moiety is a lipid or lipid-based molecule. Such a lipid or lipid-based molecule preferably binds a serum protein, e.g., human serum albumin (I). A serum protein binding targeting moiety, in certain embodiments, allows for distribution of the conjugate to a target tissue, e.g., a non-kidney target tissue of the body. For example, the target tissue can be the liver, including hepatocytes or parenchymal cells of the liver. Other molecules that can bind serum proteins can also be used as targeting moieties. For example, naproxen or aspirin can be used. A lipid or lipid-based targeting moiety can (a) increase resistance to degradation of the conjugate, (b) increase targeting or transport into a target cell or cell membrane, and/or (c) can be used to adjust binding to a serum protein.

A lipid based targeting moiety can be used to modulate, e.g., control the binding of the conjugate to a target tissue. For example, a lipid or lipid-based targeting moiety that binds to a serum protein more strongly will be less likely to be targeted to the kidney and therefore less likely to be cleared from the body. A lipid or lipid-based targeting moiety that binds to a serum protein less strongly can be used to target the conjugate to the kidney, if so desired.

In one embodiment, the lipid based targeting moiety binds human serum albumin. In a specific embodiment, it binds human serum albumin with a sufficient affinity such that the conjugate will be preferably distributed to a non-kidney tissue. In certain embodiments, it is preferred that the affinity not be so strong that the human serum albumin targeting moiety binding cannot be reversed.

In another preferred embodiment, the lipid based targeting moiety binds human serum albumin weakly or not at all, such that the conjugate will be preferably distributed to the kidney. Other moieties that target to kidney cells can also be used in place of or in addition to the lipid-based targeting moiety.

In another embodiment, the targeting moiety is for example a vitamin, e.g., a vitamin, which is taken up by a target cell, e.g., a proliferating cell. Exemplary vitamins include vitamin A, E, and K. Other exemplary vitamins include B vitamins, e.g., folic acid, B12, riboflavin, biotin, pyridoxal or other vitamins or nutrients taken up by cells. Also included are low density lipoprotein (LDL) and high-density lipoprotein (HDL).

In another embodiment, the targeting moiety is a cell-permeation agent, preferably a helical cell-permeation agent. In some embodiments, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The targeting moiety can be a peptide or peptidomimetic. A peptidomimetic (also referred to herein as an oligopeptidomimetic) is a molecule capable of folding into a defined three-dimensional structure similar to a natural peptide. The peptide or peptidomimetic moiety can be about 5-50 amino acids long, e.g., about 5, 10, 15, 20, 25, 30, 35, 40, 45, or 50 amino acids long. A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVL-LALLAP. An RFGF analogue (e.g., amino acid sequence AALLPVLLAAP) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ) and the *Drosophila* Antennapedia protein (RQIKIWFQNRRMKWKK) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). In some embodiments, the peptide or peptidomimetic tethered to an interfering RNA molecule via an incorporated monomer unit is a cell targeting peptide such as an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized. An RGD peptide can facilitate targeting of an interfering RNA molecule to cells of a variety of other tissues, including the lung, kidney, spleen, or liver (Aoki et al., Cancer Gene Therapy 8:783-787, 2001). The RGD peptide can be linear or cyclic, and can be modified, e.g., glycosylated or methylated to facilitate targeting to specific tissues. For example, a glycosylated RGD peptide can deliver an interfering RNA molecule to a cell expressing $\alpha V\beta_3$ (Haubner et al., Jour. Nucl. Med., 42:326-336, 2001). Peptides that target markers enriched in proliferating cells can be used. E.g., RGD containing peptides and peptidomimetics can target cells, in particular cells that exhibit an integrin. Thus, one could use RGD peptides, cyclic peptides containing RGD, RGD peptides that include D-amino acids, as well as synthetic RGD mimics. In addition to RGD, one can use other moieties that target the integrin ligand.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

In one embodiment, a targeting peptide can be an amphipathic α-helical peptide. Exemplary amphipathic α-helical peptides include, but are not limited to, cecropins, lycotoxins, paradaxins, buforin, CPF, bombinin-like peptide (BLP), cathelicidins, ceratotoxins, S. clava peptides, hagfish intestinal antimicrobial peptides (HFIAPs), magainines, brevinins-2, dermaseptins, melittins, pleurocidin, H.sub. 2A peptides, *Xenopus* peptides, esculentinis-1, and caerins.

Peptide and peptidomimetic targeting moietiesinclude those having naturally occurring or modified peptides, e.g., D or L peptides; α, β, or γ peptides; N-methyl peptides; azapeptides; peptides having one or more amide, i.e., peptide, linkages replaced with one or more urea, thiourea, carbamate, or sulfonyl urea linkages; or cyclic peptides.

The targeting moiety can be any moiety that is capable of targeting a specific receptor. Examples are: folate, GalNAc, galactose, mannose, mannose-6P, clusters of sugars such as GalNAc cluster, mannose cluster, galactose cluster, or an apatamer. A cluster is a combination of two or more sugar units. The targeting moieties also include integrin receptor moieties, chemokine receptor moieties, transferrin, biotin, serotonin receptor moieties, PSMA, endothelin, GCPII, somatostatin, LDL and HDL moieties. The targeting moieties can also be based on nucleic acid, e.g., an aptamer. The aptamer can be unmodified or have any combination of modifications disclosed herein.

Other exemplary endosomal release agents include imidazoles, poly or oligoimidazoles, PEIs, peptides, fusogenic peptides, polycaboxylates, polyacations, masked oligo or poly cations or anions, acetals, polyacetals, ketals/polyketyals, orthoesters, polymers with masked or unmasked cationic or anionic charges, dendrimers with masked or unmasked cationic or anionic charges.

Pharmacokinetic ("PK") modulators include lipophiles, bile acids, steroids, phospholipid analogues, peptides, protein binding agents, PEG, vitamins etc. Examplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g. oligonucleotides of about 5 bases, 10 bases, 15 bases or 20 bases, comprising multiple of phosphorothioate linkages in the backbone are also amenable to the present invention as targeting moieties (e.g. as PK modulating moieties). In addition, aptamers that bind serum components (e.g. serum proteins) are also amenable to the present invention as PK modulating moieties.

When two or more targeting moieties are present, the targeting moieties can all have same properties, all have different properties or some targeting moieties have the same properties while others have different properties. For example, a targeting moiety can have targeting properties, have endosomolytic activity and/or have PK modulating properties. In certain embodiments, all the have different properties.

In some embodiments, a targeting moiety can be conjugated to nucleobases, sugar moieties, or internucleosidic linkages of nucleic acid molecules. Conjugation to purine nucleobases or derivatives thereof can occur at any position including, endocyclic and exocyclic atoms. In some embodiments, the 2-, 6-, 7-, or 8-positions of a purine nucleobase are attached to a conjugate moiety. Conjugation to pyrimidine nucleobases or derivatives thereof can also occur at any position. In some embodiments, the 2-, 5-, and 6-positions of a pyrimidine nucleobase can be substituted with a conjugate moiety. Conjugation to sugar moieties of nucleosides can occur at any carbon atom. Example carbon atoms of a sugar moiety that can be attached to a conjugate moiety include the 2', 3', and 5' carbon atoms. The 1' position can also be attached to a conjugate moiety, such as in an abasic residue. Internucleosidic linkages can also bear conjugate moieties. For phosphorus-containing linkages (e.g., phosphodiester, phosphorothioate, phosphorodithiotate, phosphoroamidate, and the like), the conjugate moiety can be attached directly to the phosphorus atom or to an O, N, or S atom bound to the phosphorus atom. For amine- or amide-containing internucleosidic linkages (e.g., PNA), the conjugate moiety can be attached to the nitrogen atom of the amine or amide or to an adjacent carbon atom.

It is envisioned that any suitable targeting moiety in the field of RNA interference may be used, although the targeting moiety is typically a carbohydrate e.g. monosaccharide (such as GalNAc), disaccharide, trisaccharide, tetrasaccharide, polysaccharide. Linkers that conjugate the targeting moiety to the nucleic acid include those discussed herein. For example, the targeting moiety can be one or more GalNAc derivatives attached through a bivalent or trivalent branched linker.

In certain embodiments, cleavable linking groups are utilized. A cleavable linking group is one which is sufficiently stable outside the cell, but which upon entry into a target cell is cleaved to release the two parts the linker is holding together. In one embodiment, the cleavable linking group is cleaved at least 10 times or more, and in some embodiments, at least 100 times faster in the target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing the cationic lipid from the moiety inside the cell, or into the desired compartment of the cell.

A linker can include a cleavable linking group that is cleavable by a particular enzyme. The type of cleavable linking group incorporated into a linker can depend on the cell to be targeted. For example, liver targeting targeting moieties can be linked to the cationic lipids through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis. Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It may be useful to make initial evaluations in cell-free or culture conditions and to confirm by further evaluations in whole animals. In some embodiments, useful candidate compounds are cleaved at least 2, 4, 10 or 100 times faster in the cell (or under in vitro conditions selected to mimic intracellular conditions) as compared to blood or serum (or under in vitro conditions selected to mimic extracellular conditions).

In some embodiments, redox cleavable linking groups are utilized. Redox cleavable linking groups are cleaved upon reduction or oxidation. An example of reductively cleavable linking group is a disulphide linking group (—S—S—). To determine if a candidate cleavable linking group is a suitable "reductively cleavable linking group," or for example is suitable for use with a particular interfering RNA molecule and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In a specific embodiment, candidate compounds are cleaved by at most 10% in the blood. In some embodiments, useful candidate compounds are degraded at least 2, 4, 10 or 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

In yet some embodiments, phosphate-based cleavable linking groups are cleaved by agents that degrade or hydrolyze the phosphate group. An example of an agent that cleaves phosphate groups in cells are enzymes such as phosphatases in cells. Examples of phosphate-based linking groups are —O—P(O)(Ork)-O—, —O—P(S)(Ork)-O—, —O—P(S)(SRk)-O—, —S—P(O) (Ork)-O—, —O—P(O) (Ork)-S—, —S—P(O)(Ork)-S—, —O—P(S)(Ork)-S—, —S—P(S)(Ork)-O—, —O—P(O)(Rk)-O—, —O—P(S) (Rk)-O—, —S—P(O)(Rk)-O—, —S—P(S)(Rk)-O—, —S—P(O)(Rk)-S—, —O—P(S)(Rk)-S—. Specific embodiments include —O—P(O)(OH)—O—, —O—P(S) (OH)—O—, —O—P(S)(SH)—O—, —S—P(O)(OH)— O—, —O—P(O)(OH)—S—, —S—P(O)(OH)—S—, —O—P(S)(OH)—S—, —S—P(S)(OH)—O—, —O—P(O) (H)—O—, —O—P(S)(H)—O—, —S—P(O)(H)—O—, —S—P(S)(H)—O—, —S—P(O)(H)—S—, —O—P(S) (H)—S—. Another specific embodiment is —O—P(O) (OH)—O—. These candidates can be evaluated using methods analogous to those described above.

In some embodiments, acid cleavable linking groups, which are linking groups that are cleaved under acidic conditions, are envisioned. In some embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O) O, or —OC(O). A specific embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

In some embodiments, ester-based cleavable linking groups, which are cleaved by enzymes such as esterases and amidases in cells, are envisioned. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

In yet further embodiments, peptide-based cleavable linking groups, which are cleaved by enzymes such as peptidases and proteases in cells, are envisioned. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynylene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHR$^A$C(O)NHCHR$^B$C(O)—, where R$^A$ and R$^B$ are the R groups of the two adjacent amino acids. These candidates can be evaluated using methods analogous to those described above. As used herein, "carbohydrate" refers to a compound which is either a carbohydrate per se made up of one or more monosaccharide units having at least 6 carbon atoms (which may be linear, branched or cyclic) with an oxygen, nitrogen or sulfur atom bonded to each carbon atom; or a compound having as a part thereof a carbohydrate moiety made up of one or more monosaccharide units each having at least six carbon atoms (which may be linear, branched or cyclic), with an oxygen, nitrogen or sulfur atom bonded to each carbon atom. Representative carbohydrates include the sugars (mono-, di-, tri- and oligosaccharides containing from about 4-9 monosaccharide units), and polysaccharides such as starches, glycogen, cellulose and polysaccharide gums.

Synthesis of Interfering RNA

The interfering RNA molecules that can be employed in the methods of the present invention can readily be made using techniques known in the art, for example, using conventional RNA solid phase synthesis. See, for example, U.S. Pat. No. 8,877,917. The polynucleotides of the double-stranded RNA molecules can be assembled on a suitable nucleic acid synthesizer utilizing standard nucleotide or nucleoside precursors (e.g. phosphoramidites). Automated nucleic acid synthesizers are sold commercially by several vendors, including DNA/RNA synthesizers from Applied Biosystems (Foster City, Calif.), MerMade synthesizers from BioAutomation (Irving, Tex.), and OligoPilot synthesizers from GE Healthcare Life Sciences (Pittsburgh, Pa.).

The 2' silyl protecting group can be used in conjunction with acid labile dimethoxytrityl (DMT) at the 5' position of ribonucleosides to synthesize oligonucleotides via phosphoramidite chemistry. Final deprotection conditions are known not to significantly degrade RNA products. All syntheses can be conducted in any automated or manual synthesizer on large, medium, or small scale. The syntheses may also be carried out in multiple well plates or glass slides.

The 2'-O-silyl group can be removed via exposure to fluoride ions, which can include any source of fluoride ion, e.g., those salts containing fluoride ion paired with inorganic counterions e.g., cesium fluoride and potassium fluoride or those salts containing fluoride ion paired with an organic counterion, e.g., a tetraalkylammonium fluoride. A crown ether catalyst can be utilized in combination with the inorganic fluoride in the deprotection reaction. Preferred fluoride ion source are tetrabutylammonium fluoride or aminehydrofluorides (e.g., combining aqueous HF with triethylamine in a dipolar aprotic solvent, e.g., dimethylformamide).

The choice of protecting groups for use on the phosphite triesters and phosphotriesters can alter the stability of the triesters towards fluoride. Methyl protection of the phosphotriester or phosphitetriester can stabilize the linkage against fluoride ions and improve process yields.

Since ribonucleosides have a reactive 2' hydroxyl substituent, it can be desirable to protect the reactive 2' position in RNA with a protecting group that is orthogonal to a 5'-O-dimethoxytrityl protecting group, e.g., one stable to treatment with acid. Silyl protecting groups meet this criterion and can be readily removed in a final fluoride deprotection step that can result in minimal RNA degradation.

Tetrazole catalysts can be used in the standard phosphoramidite coupling reaction. Preferred catalysts include e.g., tetrazole, S-ethyl-tetrazole, p-nitrophenyltetrazole.

See also, for example, Trufert et al., Tetrahedron, 52:3005, 1996; and Manoharan, "Oligonucleotide Conjugates in Antisense Technology," in Antisense Drug Technology, ed. S. T. Crooke, Marcel Dekker, Inc., 2001. The protected monomer compounds can be separated from a reaction mixture and further purified by a method such as column chromatography, high pressure liquid chromatography, or recrystallization. As can be appreciated by the skilled artisan, further methods of synthesizing the compounds of the formulae herein will be evident to those of ordinary skill in the art. Additionally, the various synthetic steps may be performed in an alternate sequence or order to give the desired compounds. Other synthetic chemistry transformations, protecting groups (e.g., for hydroxyl, amino, etc. present on the bases) and protecting group methodologies (protection and deprotection) useful in synthesizing the compounds described herein are known in the art and include, for example, those such as described in R. Larock, Comprehensive Organic Transformations, VCH Publishers (1989); T. W. Greene and P. G. M. Wuts, Protective Groups in Organic Synthesis, 2d. Ed., John Wiley and Sons (1991); L. Fieser and M. Fieser, Fieser and Fieser's Reagents for Organic Synthesis, John Wiley and Sons (1994); and L. Paquette, ed., Encyclopedia of Reagents for Organic Synthesis, John Wiley and Sons (1995), and subsequent editions thereof.

Methods of Treatment

In further embodiments of the present invention, a method of treating a human subject, comprising administering a therapeutic dosage of the antigen binding proteins or antibodies or interfering RNA (e.g., siRNA or shRNA) of the present invention is provided. In one embodiment, the antigen binding proteins are monoclonal antibodies. In one embodiment, the antigen binding proteins are human antibodies. In another embodiment, the antigen binding proteins or antibodies are humanized antibodies. In another embodiment, interfering RNA (e.g., siRNA or shRNA) is administered. As used herein the term "subject" refers to a mammal, including humans, and can be used interchangeably with the term "patient".

Given the results of the Icelandic study presented in the examples below, there need not be any particular further manipulation downstream in a host receiving a therapy involving administering the ASGR inhibitor (e.g., antigen binding proteins or antibodies or RNAi) to the host. That is, in some embodiments, the antibody (or RNAi) need simply be one or more of the antibodies (or RNAi) described herein, which binds to (and inhibits) ASGR (such as ASGR1), and be administered in an amount, and at a frequency sufficient to reduce the risk of cardiovascular disease, myocardial infarction, or other disorders provided herein. In some embodiments, the antibody (or RNAi) is administered in an amount sufficient to result in a lowering of non-HDL cholesterol. In some embodiments, the antibody (or RNAi) is administered in an amount sufficient to result in lowering LDL cholesterol. While not intended to be limiting unless expressed otherwise, below is a description of various embodiments through which ASGR can have an impact on various disorders, and thus, how the various antibodies (or RNAi) provided herein (which can inhibit (e.g., reduce) ASGR function) can have an impact on the various disorders provided herein.

In some embodiments, the ASGR inhibitor (e.g., antigen binding proteins or antibodies or RNAi) operates through ASGR's role in platelet clearance. Inhibiting (e.g., reducing) the receptor results in a reduction in clearance of old platelets. Such older platelets do not coagulate as well as new platelets and as a result, the blood is thinner. As a result, plaques can lessen and there can be a positive impact (e.g., stroke is lessened) for the subject.

In some embodiments, the ASGR inhibitor (e.g., antigen binding proteins or antibodies or RNAi) binds to ASGR to alter inflammation. For example, reducing the ASGR-1 receptor results in a modification of the immune response. Normally, there can be an increase in proinflammatory cytokines. These proinflammatory cytokines are circulating in the native state (one where the ASGR1 receptor is not reduced). However, ALP (alkaline phosphatase) can have an anti-inflammatory role thereby reducing inflammation and coagulopathy systemically. In some embodiments, the mechanism of action involves reducing ASGR1 which increases ALP and therefore reduces inflammation.

In some embodiments, and without intending to be limited by theory (unless expressed otherwise), the ASGR inhibitor (e.g., antigen binding proteins or antibodies or RNAi) can reduce an activity due to ASGR interacting with one or more other molecules, either directly or indirectly. For example, various embodiments for various proteins are provided herein in Examples 18 and 19. As noted above, this selection of proteins can also be useful for determining the effectiveness of the ASGR inhibitor (e.g., antigen binding proteins or antibodies or RNAi) (and/or the amount of the antibody and/or identification of a subject who can respond to the therapy (or RNAi)) by monitoring one or more of these proteins as a Cardiovascular Disease marker. Thus, these markers are useful as markers and, without intending to be limited by theory, in some embodiments, one or more of the proteins disclosed below is the protein through which (directly or indirectly) ASGR1 modulation achieves its benefit for one or more of the disorders provided herein, including cardiovascular disease.

In addition to the marker proteins described in Examples 18 and 19 herein (which also allow for various mechanisms of action and monitoring the effectiveness of various ASGR inhibitors (e.g., antigen binding proteins or antibodies or RNAi) and dosage regimes), the following proteins of interest are those that interact with ASGR, and ASGR-1 in particular, directly by binding to them. Thus, these are additional interactions that can be inhibited (e.g., reduced) for various embodiments provided herein, by various ASGR inhibitors (e.g., antigen binding proteins or antibodies or RNAi). While not intending to be limited by theory (unless explicitly stated otherwise), ASGR-1's binding to one or more of the following proteins can be inhibited (e.g., reduced) by using an ASGR-1 inhibitor (e.g., antigen binding protein or antibody or RNAi) provided herein that inhibits (e.g., reduces) the noted binding. While in some embodiments, the protein interactions are contemplated as resulting mechanisms of action that occur downstream from when ASGR levels are effectively reduced by an ASGR inhibitor (e.g., antigen binding protein or antibody binding or via RNAi), the following list is a list of proteins that directly bind to ASGR1, and thus whose direct binding to ASGR-1 can be inhibited (e.g., reduced) by one or more of the antigen binding proteins or antibodies provided herein (or RNAi). In some embodiments, the ASGR-1 inhbiitor (e.g., antigen binding protein or antibody or RNAi) inhibits (e.g., reduces) ASGR-1's binding to one or more of: Alpha-2-HS-glycoprotein (aka Fetuin A) (see Tozawa et al, J Biol Chem (2001) 276:12624-12628); Asialoglycoprotein receptor 1 (see Stockert et al (1977) Science 197:667-668), Orosomucoid (aka alpha-1-acid glycoprotein) (see Tozawa et al, J Biol Chem (2001) 276:12624-12628), Alkaline phosphatase, (see Hardonk M J, Scholtens H B. Histochemistry. 1980; 69(3):289-97 and Scholtens H B, Meijer D K, Hardonk M J. Liver. 1982 March; 2(1):14-21), LDL and chylomicrons (Windler et al Biochem J (1991) 276:79-87), Fibronectin (see Rotundo et al Hepatology (1998) 28:475-485), and IgA (see Stockert et al PNAS (1982) 79:6229-6231). In some embodiments, the ASGR inhibitor (e.g., antigen binding protein or antibody or RNAi) antibody binds to ASGR and inhibits (e.g., reduces) ASGR's interaction with a molecule that has a terminal gal or galNAc, including, but not limited to protein ligands, synthetic polysaccharides, solid substrates, etc. In some embodiments, the ASGR inhibitor (e.g., antigen binding proteins or antibodies or RNAi) inhibits (e.g., reduces) ASGR1's ability to bind to an asialylated molecule. In some embodiments, the invention provides a method of treating or preventing a cardiovascular disease comprising administering to a patient in need thereof a therapeutically effective dose of an ASGR inhibitor as described herein. In some embodiments, the cardiovascular disease is coronary artery disease or myocardial infarction. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the relative risk reduction of a cardiovascular event is at least about 5%, at least about 10%, at least about 15%, at least about 20%, at least about 25%, at least about 30%, at least about 35%, at least about 40%, at least about 45%, at least about 50%, at least about 55%, at least about 60% in the patient. Some non-limiting examples of cardiovascular disease include atherosclerotic diseases, such as, for example, coronary heart disease, coronary artery disease, peripheral arterial disease, stroke (ischaemic and hemorrhagic), angina pectoris, cerebrovascular disease, acute coronary syndrome, and myocardial infarction. In some embodiments, the ASGR, ASGR-1 and/or ASGR-2 inhibitors of the present invention are useful in reducing the risk of: nonfatal heart attacks, fatal and non-fatal strokes, certain types of heart surgery, hospitalization for heart failure, chest pain in patients with heart disease, and/or cardiovascular events because of established heart disease such as prior heart attack, prior heart surgery, and/or chest pain with evidence of clogged arteries. In some embodiments, the ASGR, ASGR-1 and/or ASGR-2 inhibitors of the present invention and methods can be used to reduce the risk of recurrent cardiovascular events.

In some embodiments, the invention provides a method of decreasing the risk of acquiring coronary artery disease or having an MI comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the relative risk reduction of coronary artery disease or MI is at least about 5%, at least about 10%, at least about 15%, at least about 20%, at least about 25%, at least about 30%, at least about 35%, at least about 40%, at least about 45%, at least about 50%, at least about 55%, at least about 60% in the patient.

In some embodiments, the invention provides a method of reducing blood LDL cholesterol levels in a patient comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the blood LDL cholesterol level in the patient is reduced by at least about 15%, as compared to a predose level of blood LDL cholesterol in the patient. In some embodiments of this aspect of the invention, the blood LDL cholesterol level of said patient is lowered by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, or at least about 90% as compared to a predose level of blood LDL cholesterol in the patient.

In some embodiments, the invention provides a method of reducing non-HDL cholesterol levels in a patient comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the non-HDL cholesterol level in the patient is reduced by at least about 5%, as compared to a predose level of non-HDL cholesterol in the patient. In some embodiments of this aspect of the invention, the non-HDL cholesterol level of said patient is lowered by at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, or at least about 90% as compared to a predose level of non-HDL cholesterol in the patient.

In some embodiments, the invention provides a method of increasing ALP levels in a patient comprising administering to a patient in need thereof a therapeutically effective dose of of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the ALP level in the patient is increased by at least about 30%, as compared to a predose level of ALP in the patient. In some embodiments of this aspect of the invention, the ALP level of said patient is increased by at least about at least about 35%, at least about 40%, at least about 45%, at least about 50%, at least about 55%, at least about 60%, at least about 65%, at least about 70%, at least about 75%, at least about 80%, at least about 85%, or at least about 90% as compared to a predose ALP level in the patient. In some embodiments, ALP levels are increased at least about 1.25×1.5×, 2×, 2.5×, 3×, 3.5×, 4×, 4.5×, and 5× over pretreatment.

In some embodiments, the invention provides a method of antagonizing ASGR, ASGR-1 and/or ASGR-2 in a patient comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein.

In some embodiments, a method of treating or preventing a cardiovascular disease is provided and comprises administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the relative risk reduction of a cardiovascular event is at least about 5%, at least about 10%, at least about 15%, at least about 20%, at least about 25%, at least about 30%, at least about 35%, at least about 40%, at least about 45%, at least about 50%, at least about 55%, at least about 60% in the patient.

The term "treatment" encompasses alleviation of at least one symptom or other embodiment of a disorder, or reduction of disease severity, and the like. An antigen binding protein, in particular a human antibody according to the present invention, need not effect a complete cure, or eradicate every symptom or manifestation of a disease, to constitute a viable therapeutic agent. As is recognized in the pertinent field, drugs employed as therapeutic agents may reduce the severity of a given disease state, but need not abolish every manifestation of the disease to be regarded as useful therapeutic agents. Simply reducing the impact of a disease (for example, by reducing the number or severity of its symptoms, or by increasing the effectiveness of another treatment, or by producing another beneficial effect), or reducing the likelihood that the disease will occur or worsen in a subject, is sufficient. One embodiment of the invention is directed to a method comprising administering to a patient an antigen binding protein or interfering RNA in an amount and for a time sufficient to induce a sustained improvement over baseline of an indicator that reflects the severity of the particular disorder.

The term "prevention" encompasses prevention of at least one symptom or other embodiment of a disorder, and the like. A prophylactically administered treatment incorporating an antigen binding protein, in particular a human antibody according to the present invention, need not be completely effective in preventing the onset of a condition in order to constitute a viable prophylactic agent. Simply reducing the likelihood that the disease will occur or worsen in a subject, is sufficient.

The term "non-HDL cholesterol" encompasses all cholesterol-containing proatherogenic lipoproteins, including LDL cholesterol, very-low-density lipoprotein, intermediate-density lipoprotein, lipoprotein(a), and chylomicron. Non-HDL cholesterol levels are calculated by subtracting HDL cholesterol levels from total cholesterol levels.

As is understood in the pertinent field, pharmaceutical compositions comprising the antigen binding proteins and/or interfering RNA are administered to a subject in a manner appropriate to the indication and the composition. In one embodiment, pharmaceutical compositions comprise the human antibodies of the present invention. In another embodiment, pharmaceutical compositions comprise interfering RNA. Pharmaceutical compositions may be administered by any suitable technique, including but not limited to parenterally, topically, or by inhalation. If injected, the pharmaceutical composition can be administered, for example, via intra-articular, intravenous, intramuscular, intralesional, intraperitoneal or subcutaneous routes, by bolus injection, or continuous infusion. Delivery by inhalation includes, for example, nasal or oral inhalation, use of a nebulizer, inhalation of the antigen binding protein in aerosol form, and the like. Other alternatives include oral preparations including pills, syrups, or lozenges.

Advantageously, the antigen binding proteins or interfering RNA are administered in the form of a composition comprising one or more additional components such as a physiologically acceptable carrier, excipient or diluent. Optionally, the composition additionally comprises one or more physiologically active agents. In various particular embodiments, the composition comprises one, two, three, four, five, or six physiologically active agents in addition to one or more antigen binding proteins (e.g, human antibodies) or interfering RNA.

Kits for use by medical practitioners are provided including one or more antigen binding proteins or interfering RNA and a label or other instructions for use in treating any of the conditions discussed herein. In one embodiment, the kit includes a sterile preparation of one or more human antibodies, or one or more interfering RNA which may be in the form of a composition as disclosed herein, and may be in one or more vials.

Dosages and the frequency of administration may vary according to such factors as the route of administration, the particular antigen binding proteins or interfering RNA employed, the nature and severity of the disease to be treated, whether the condition is acute or chronic, and the size and general condition of the subject. Appropriate dosages can be determined by procedures known in the pertinent art, e.g. in clinical trials that may involve dose escalation studies.

An antigen binding protein, e.g., monoclonal antibodies, or interfering RNA may be administered, for example, once or more than once, e.g., at regular intervals over a period of time. In particular embodiments, an antigen binding protein or interfering RNA is administered over a period of at least once a month or more, e.g., for one, two, or three months or even indefinitely. For treating chronic conditions, long-term treatment is generally most effective. However, for treating acute conditions, administration for shorter periods, e.g. from one to six weeks, may be sufficient. In general, the antigen binding protein or interfering RNA is administered until the patient manifests a medically relevant degree of improvement over baseline for the chosen indicator or indicators.

One example of therapeutic regimens provided herein comprise subcutaneous injection of an antigen binding protein or interfering RNA once a week, or once every two weeks, or once every month, once every other month, once every three months, once every six months or longer, at an appropriate dosage, to treat a condition in which it is desired to target cells expressing ASGR, ASGR-1 and/or ASGR-2. Weekly or monthly administration of antigen binding protein could be continued until a desired result is achieved, e.g., the subject's symptoms subside. Treatment may resume as needed, or, alternatively, maintenance doses may be administered.

In some embodiments, one or more of the markers in Tables 18.1, 18.2, 19.3, and 19.4 can be used to determine whether or not the amount of ASGR inhibitor (e.g., antigen binding protein and/or antibody and/or RNAi) administered is sufficient for its intended therapeutic application. In some embodiments, when one or more of the alterations in protein level, for the proteins outlined in one or more of Tables 18.1, 18.2, 19.3, and 19.4 changes in response to administering the antigen binding protein, antibody and/or RNAi, the antigen binding protein, antibody and/or RNAi is having an effect in the host. In some embodiments, the amount is sufficient when it alters the level of non-HDL cholesterol to a desired amount or reduces it by a desired amount. In some embodiments, the markers used can be one or more of those in one or more of Tiers 1, 2, 3, 4, and 5 of Table 19.4. In some embodiments, the markers used can be one or more of those in one or more of Tiers 1 and 5 of Table 19.4.

Combination Therapies

Particular embodiments of methods and compositions of the invention involve the use of at least one antigen binding protein and/or interfering RNA and one or more other therapeutics useful for treating or preventing cardiovascular disease, for example. In one embodiment, antigen binding proteins and/or interfering RNA are administered alone or in combination with other agents useful for treating the condition with which the patient is afflicted. Examples of such agents include both proteinaceous and non-proteinaceous drugs. When multiple therapeutics are co-administered, dosages may be adjusted accordingly, as is recognized in the pertinent art. "Co-administration" and combination therapy are not limited to simultaneous administration, but also include treatment regimens in which an antigen binding protein is administered at least once during a course of treatment that involves administering at least one other therapeutic agent to the patient. In certain embodiments, an antigen binding protein or interfering RNA is administered prior to the administration of at least one other therapeutic agent. In certain embodiments, an antigen binding protein or interfering RNA is administered concurrent with the administration of at least one other therapeutic agent. In certain embodiments, an antigen binding protein or interfering RNA is administered subsequent to the administration of at least one other therapeutic agent.

In one embodiment, the at least one antigen binding protein or antibody and/or the interfering RNA is administered to a subject in combination with an anti-PCSK9 antibody (e.g., Repatha®, Praluent®, bococizumab). In another embodiment, the at least one antigen binding protein or antibody and/or the interfering RNA is administered to a subject in combination with at least one other cholesterol-lowering (serum and/or total body cholesterol) agent. In some embodiments, the agents that increase the expression of LDLR, have been observed to increase serum HDL levels, lower LDL levels or lower triglyceride levels. Exemplary agents include, but are not limited to, statins (e.g., atorvastatin, cerivastatin, fluvastatin, lovastatin, mevastatin, pitavastatin, pravastatin, rosuvastatin, simvastatin), Nicotinic acid (Niacin) (NIACOR, NIASPAN (slow release niacin), SLO-NIACIN (slow release niacin)), Fibric acid (LOPID (Gemfibrozil), TRICOR (fenofibrate), Bile acid sequestrants (QUESTRAN (cholestyramine), colesevelam (WELCHOL), COLESTID (colestipol)), Cholesterol absorption inhibitors (ZETIA (ezetimibe)), combining nicotinic acid with statin (ADVICOR (LOVASTATIN and NIASPAN), combining a statin with an absorption inhibitor (VYTORIN (ZOCOR and ZETIA) and/or lipid modifying agents. In some embodiments, the at least one antigen binding protein and/or interfering RNA is combined with PPAR gamma agonsits, PPAR alpha/gamma agonists, squalene synthase inhibitors, CETP inhibitors, anti-hypertensives, anti-diabetic agents (such as sulphonyl ureas, insulin, GLP-1 analogs, DDPIV inhibitors), ApoB modulators, MTP inhibitoris and/or arteriosclerosis obliterans treatments. In some embodiments, the at least one antigen binding protein and/or interfering RNA is combined with an agent that increases the level of LDLR protein in a subject, such as statins, certain cytokines like oncostatin M, estrogen, and/or certain herbal ingredients such as berberine. In some embodiments, the at least one antigen binding protein and/or interfering RNA is combined with an agent that increases serum cholesterol levels in a subject (such as certain anti-psychotic agents, certain HIV protease inhibitors, dietary factors such as high fructose, sucrose, cholesterol or certain fatty acids and certain nuclear receptor agonists and antagonists for RXR, RAR, LXR, FXR). The combination of the two can allow for the undesirable side-effects of other agents to be mitigated by the antigen binding protein or interfering RNA.

Diagnostic Uses

In one embodiment, antigen binding proteins of the invention are useful for detecting the presence of ASGR, ASGR-1 and/or ASGR-2 in a biological sample. The term "detecting" as used herein encompasses quantitative or qualitative detection. In certain embodiments, a biological sample comprises a cell or tissue. In certain embodiments, such tissues include tissues that express ASGR, ASGR-1 and/or ASGR-2 at higher levels relative to other tissues.

In one embodiment, the invention provides a method of detecting the presence of ASGR, ASGR-1 and/or ASGR-2 in a biological sample. In certain embodiments, the method comprises contacting the biological sample with an antigen binding protein of the invention under conditions permissive for binding of an antigen binding protein to ASGR, ASGR-1 and/or ASGR-2, and detecting whether a complex is formed between the antigen binding protein and ASGR, ASGR-1 and/or ASGR-2.

In one embodiment, the invention provides a method of diagnosing a disorder associated with increased or decreased expression of ASGR, ASGR-1 and/or ASGR-2. In certain embodiments, the method comprises contacting a test cell with an antigen binding protein; determining the level of expression (either quantitatively or qualitatively) of ASGR, ASGR-1 and/or ASGR-2 by the test cell by detecting binding of the antigen binding protein to ASGR, ASGR-1 and/or ASGR-2; and comparing the level of expression of ASGR, ASGR-1 and/or ASGR-2 by the test cell with the level of expression of ASGR, ASGR-1 and/or ASGR-2 by a control cell (e.g., a normal cell of the same tissue origin as the test cell or a cell that expresses ASGR, ASGR-1 and/or ASGR-2 at levels comparable to such a normal cell), wherein a higher or lower level of expression of ASGR, ASGR-1 and/or ASGR-2 by the test cell as compared to the control cell indicates the presence of a disorder associated with increased or decreased expression of ASGR, ASGR-1 and/or ASGR-2. In certain embodiments, the test cell is obtained from an individual suspected of having a disorder associated with increased or decreased expression of ASGR, ASGR-1 and/or ASGR-2.

In certain embodiments, a method of diagnosis or detection, such as those described above, comprises detecting binding of an antigen binding protein of the invention to ASGR, ASGR-1 and/or ASGR-2 expressed on the surface of a cell or in a membrane preparation obtained from a cell expressing ASGR, ASGR-1 and/or ASGR-2 on its surface. In certain embodiments, the method comprises contacting a cell with an antigen binding protein under conditions permissive for binding of an antigen binding protein of the invention to ASGR, ASGR-1 and/or ASGR-2, and detecting whether a complex is formed between the antigen binding protein of the invention and ASGR, ASGR-1 and/or ASGR-2 on the cell surface. An exemplary assay for detecting binding of an antigen binding protein of the invention to ASGR, ASGR-1 and/or ASGR-2 expressed on the surface of a cell is a "FACS" assay.

Certain other methods can be used to detect binding of antigen binding protein of the invention to ASGR, ASGR-1 and/or ASGR-2. Such methods include, but are not limited to, antigen-binding assays that are well known in the art, such as western blots, radioimmunoassays, ELISA (enzyme linked immunosorbent assay), "sandwich" immunoassays, immunoprecipitation assays, fluorescent immunoassays, protein A immunoassays, and immunohistochemistry (IHC).

In certain embodiments, antigen binding proteins of the invention are labeled. Labels include, but are not limited to, labels or moieties that are detected directly (such as fluorescent, chromophoric, electron-dense, chemiluminescent, and radioactive labels), as well as moieties, such as enzymes or ligands, that are detected indirectly, e.g., through an enzymatic reaction or molecular interaction. Exemplary labels include, but are not limited to, the radioisotopes $^{32}P$, $^{14}C$, $^{125}I$, $^{3}H$, and $^{131}I$, fluorophores such as rare earth chelates or fluorescein and its derivatives, rhodamine and its derivatives, dansyl, umbelliferone, luceriferases, e.g., firefly luciferase and bacterial luciferase (U.S. Pat. No. 4,737,456), luciferin, 2,3-dihydrophthalazinediones, horseradish peroxidase (HRP), alkaline phosphatase, beta-galactosidase, glucoamylase, lysozyme, saccharide oxidases, e.g., glucose oxidase, galactose oxidase, and glucose-6-phosphate dehydrogenase, heterocyclic oxidases such as uricase and xanthine oxidase, coupled with an enzyme that employs hydrogen peroxide to oxidize a dye precursor such as HRP, lactoperoxidase, or microperoxidase, biotin/avidin, spin labels, bacteriophage labels, stable free radicals, and the like.

In certain embodiments, antigen binding proteins of the invention are immobilized on an insoluble matrix. Immobilization entails separating the antigen binding protein of the invention from any ASGR, ASGR-1 and/or ASGR-2 that remains free in solution. This conventionally is accomplished by either insolubilizing the antigen binding protein of the invention before the assay procedure, as by adsorption to a water-insoluble matrix or surface (see, e.g., Bennich et al., U.S. Pat. No. 3,720,760), or by covalent coupling (for example, using glutaraldehyde cross-linking), or by insolubilizing the antigen binding protein of the invention after formation of a complex between the antigen binding protein of the invention and ASGR, ASGR-1 and/or ASGR-2, e.g., by immunoprecipitation.

The invention having been described, the following examples are offered by way of illustration, and not limitation.

Numerous sequences have been provided herein. Where there is a discrepancy in the sequences, the sequences in the tables presented within the figures control, unless there is an indication otherwise. If there is any unintended difference between the same consensus sequences, the consensus sequences as provided in the figures (from the tables within the figures) will control (unless indicated otherwise). For any further discrepancies (rather than just alternative sequences) the sequences within Tables 1-7 will control, unless designated otherwise. The figures contain multiple sequences, sequence alignments and sequence components of various nucleic and amino acid sequences. The present specification references this information in terms of the designated tables and/or the designated figures. Either reference (via figure or table) can be used and either designation (figure or table) will indicate the alternative designation as well, where appropriate. Thus, FIG. 48 designates Table 1, FIG. 49 designates Table 2, FIG. 50 designates Table 3, FIG. 51 designates Table 4, FIG. 52 designates Table 5, FIG. 53 designates Table 6, FIG. 54 designates Table 7, FIG. 55 designates Tables 19A, 19B, 19C, 20A, 20B, and 20C, FIG. 56 designates Tables 21-48, and FIG. 57 designates Tables 49-134, and vice versa. As such, any discussion herein in regard to the above figures or tables is interchangeable with respect to the "table" or "figure" nomenclature.

EXAMPLES

Example 1—Identification of Rare Sequence Variants that Disrupt ASGR-1 Function and Lower Non-HDL Cholesterol and Protect Against Coronary Artery Disease The level of circulating non-high density lipoprotein (non-HDL) cholesterol is heritable and strongly correlated with the risk of coronary artery disease (CAD) and myocardial infraction (MI). Whole-genome sequencing offers the potential to search for rare sequence variants that have large effects on serum lipid levels and hence the risk of cardiovascular disease, such as CAD and MI.

Methods

Study Participants:

Details of the population sample sets from Iceland, Denmark and The Netherlands, used to measure the various lipids traits (non-HDL cholesterol, HDL cholesterol, LDL cholesterol and triglycerides), alkaline phosphatase (ALP), ferritin, and vitamin B12, are outlined in Table 1.2. The dataset for ferritin is not shown. The coronary artery disease case-control sample sets that were a part of the study are outlined in Table 1.1.

Icelandic Study Population

Study participants were enrolled as part of various genetics programs at deCODE. Blood lipid levels (total cholesterol, non-high density lipoprotein cholesterol (non-HDL-C), low density lipoprotein cholesterol (LDL-C), high density lipoprotein cholesterol (HDL-C) and triglycerides), alkaline phosphatase and vitamin B12 levels were obtained from three of the largest laboratories in Iceland: 1) Landspítali—The National University Hospital of Iceland (LUH), Reykjavík (measurements performed between the years 1993 and 2012, hospitalized and ambulatory patients), 2) The Laboratory in Mjódd (RAM), Reykjavik (measurements performed between 2004 and 2012, ambulatory patients) and 3) Akureyri Hospital, The Regional Hospital in North Iceland, Akureyri (performed between 2004 and 2010, hospitalized and ambulatory patients). Information on the participants is outlined in Table 1.2. Lipid levels were adjusted for sex, year of birth and age at measurement, lipid lowering medication and measurement site, using the average of multiple measurements for an individual, and then normalized to a standard normal distribution using quantile normalization. To obtain effect estimates in mmol/L the estimates from the regression analysis were multiplied by the estimated standard deviation of lipid level in the population. Given their approximately log-normal distribution, triglyceride levels were log-transformed before adjustment and the corresponding effect estimates are presented as percentage change instead of units of mmol/L. The total number of individuals with non-HDL cholesterol, LDL cholesterol, HDL cholesterol and triglycerides in Iceland is shown in the Table 1.3 below. For each lipid, the number of chip-typed and directly imputed individuals and those with familial imputations is also shown.

TABLE 1.3

Lipid levels of Icelandic Study Participants

| | Non-HDL-C | LDL-C | HDL-C | Triglycerides |
|---|---|---|---|---|
| Total number | 119,146 | 53,841 | 119,514 | 80,111 |
| Direct imputation | 69,277 | 51,029 | 69,414 | 59,678 |
| Familial imputation | 49,869 | 2,812 | 50,100 | 20,433 |

The total number of Icelandic individuals with lipid values used in the study and the breakdown into those that were chip-typed and directly imputed (Direct imputation) and those that were first and second degree relatives of chip-typed individuals and had their genotypes inferred based on genealogy (Familial imputation).

Non-HDL cholesterol was obtained by subtracting HDL cholesterol from total cholesterol and measures the amount of cholesterol carried within all atherogenic lipoprotein particles (VLDL, IDL, LDL, chylomicrons and Lp(a)). The LDLcholesterol was calculated, using the Friedewald equation (for triglyceride levels<4.00 mmol/L) (Friedewald, W. T., Levy, R. I. & Fredrickson, D. S. Estimation of the concentration of low-density lipoprotein cholesterol in plasma, without use of the preparative ultracentrifuge. Clin. Chem. 18, 499-502 (1972)). Total cholesterol and HDL-cholesterol values are a mixture of fasting and non-fasting values, whereas triglycerides are fasting values exclusively.

Coronary artery disease (CAD) was defined as a) individuals in the MONICA registry who suffered myocardial infarction (MI) before the age of 75 in Iceland between 1981 and 2002 and satisfied the MONICA criteria (Gudbjartsson, et al., Large-scale whole-genome sequencing of the Icelandic population. Nature genetics 2015), b) subjects with CAD discharge diagnoses (ICD 9 codes 410.*, 411.*, 412.*, 414.* or ICD 10 codes I20.0, I21.*, I22.*. I23.*, I24.*, I25.*) from LUH, c) subjects diagnosed with significant angiographic CAD (see defined below) identified from a nationwide clinical registry of coronary angiography and percutaneous coronary interventions at LUH between the years 1987 and 2012, d) subjects undergoing coronary artery bypass grafting (CABG) procedures at LUH between the years 2002 and 2011 or e) cause of death or contributing cause of death listed as MI or CAD (ICD 9 or 10 codes) on death registries between the years 1996 and 2009. Coronary angiograms in the nationwide registry were evaluated by an interventional cardiologist. Patients were considered to have significant angiographic CAD if one or more of the three major epicardial coronary vessels or the left main coronary artery was found to have at least 50% stenosis by visual estimation.

Non-Icelandic Study Populations

Characteristics of the non-Icelandic sample sets are outlined in Table 1.1 and Table 1.2. All the studies outlined in Tables 1.1 and 1.2 were approved by appropriate bioethics and/or data protection authorities. For samples from the Nijmegen Biomedical Study, Netherlands, the lipid values (namely, total cholesterol, HDL-cholesterol and triglycerides) were all non-fasting values. For samples from the Danish Inter99 and Addition studies, the lipid values were all fasting values. All participating subjects donating biological samples signed informed consents. Personal identities of the phenotypes and biological samples were encrypted by a third party system provided by the Icelandic Data Protection Authority.

Data Generation and Analysis

Whole-Genome Sequencing, SNP Calling, and Imputation

The Icelandic samples were genotyped using Illumina microarrays (Samani N J et al., Genomewide association analysis of coronary artery disease. The New England journal of medicine 2007; 357:443-53). The whole-genomes of 2,636 Icelanders were sequenced using the standard TruSeq methodology (Illumina) to a mean depth of at least 10× (median 20×)(Samani N J et al., Genomewide association analysis of coronary artery disease. The New England journal of medicine 2007; 357:443-53). For improved sequencing coverage of the GC-rich intron 4 in ASGR-1 gene, the whole-genome sequence data generated for 738 Icelanders was analyzed using TruSeq PCR-free method from Illumina (mean depth of 30×). The del12 variant in intron 4 of ASGR-1 was detected in this dataset.

Single-Track Assay SNP and Microsatellite Genotyping:

We performed single SNP genotyping of rs186021206, using the Centaurus (Nanogen) platform (Gretarsdottir S, et al., Genome-wide association study identifies a sequence variant within the DAB2IP gene conferring susceptibility to abdominal aortic aneurysm. Nature genetics 2010; 42:692). The del12 variant was genotyped using a PCR based method with the following primers: forward primer (NED labelled) 5'-TTCATCTTTCTTCCCACATTGC-3' (SEQ ID NO: 32600), reverse primer 5'-GGGCCTGAGAGAGACGT-TCA-3' (SEQ ID NO: 32601). An internal size standard was added to the resulting PCR products and the fragments were separated and detected on an Applied Biosystems model 3730 sequencer, using in-house Allele Caller software.

Statistical Analyses:

Associations between imputed genotypes and serum lipids (non-HDL cholesterol, HDL cholesterol, LDL cholesterol and triglycerides), ALP, ferritin and vitamin B12 levels in the Icelandic dataset were tested using a generalized linear regression, assuming an additive genetic model (Samani N J et al., Genomewide association analysis of coronary artery disease. The New England journal of medicine 2007; 357:443-53; and Olsen M H, et al., N-terminal pro-brain natriuretic peptide, but not high sensitivity C-reactive protein, improves cardiovascular risk prediction in the general population. European heart journal 2007; 28:1374-81). For the Icelandic dataset, logistic regression was used to test for association between the del12 variant and coronary artery disease and myocardial infarction, treating the disease status as the response and the number of copies of del12 an individual carries as the explanatory variable. Coronary artery disease case-control association analysis for the non-Icelandic sample sets was done using the NEMO software (Jorgensen A B, et al., Loss-of-function mutations in APOC3 and risk of ischemic vascular disease. The New England journal of medicine 2014; 371:32-41) assuming a multiplicative risk model. Results for the Icelandic and the non-Icelandic sample sets were combined using a Mantel-Haenszel fixed effects model. To estimate the effect of the del12 variant on myocardial infarction-free survival, Kaplan-Meier curves were estimated for survival to first myocardial infarction in heterozygous carriers and non-carriers (Hoogendoorn E H, et al., Thyroid function and prevalence of anti-thyroperoxidase antibodies in a population with borderline sufficient iodine intake: influences of age and sex. Clinical chemistry 2006; 52:104-11) by dividing the corresponding chi-square statistic by 1.36 for non-HDL cholesterol, 1.57 for HDL cholesterol, 1.40 for triglycerides, 1.53 for ALP, 1.30 for vitamin B12, 1.71 for coronary artery disease and 1.48 for myocardial infarction.

To obtain a reliable imputation of the del12 variant, 3,799 Icelandic individuals were genotyped for the del12 variant and those genotypes were used as a training set for imputation of the del12 variant into the rest of the Icelandic population. The imputation information for del12 was 0.99.

The Icelandic samples were genotyped using Illumina microarrays as described above (Gudbartssoon, D F, et al., Large Scale whole-genome sequencing of the Icelandic population. Nature Genetics 2015). The whole-genomes of 2,636 Icelanders were sequenced using Illumina standard TruSeq methodology to a mean depth of at least 10× (median 20×) (Di Angelantonio E, et al., Major lipids, apolipoproteins, and risk of vascular disease. Jama 2009; 302:1993-2000). A total of 35.5 million autosomal SNPs and INDEL's were identified using the Genome Analysis Toolkit version 2.3.9. Information about haplotype sharing was used to improve variant genotyping, taking advantage of the fact that all sequenced individuals had also been chip-typed and long-range-phased. Variants were annotated using Ensembl release 72 and Variant Effect Predictor (VEP) version 2.8. Of the 35.5 million sequence variants found, 25.3 million variants passed the quality threshold and were imputed into 104,220 Icelanders who had been genotyped using Illumina chips. Additionally, using the Icelandic genealogy, genotype probabilities were calculated for 294,212 untyped individuals who are first and second degree relatives of the chip-typed individuals born after 1880 (Gudbartssoon, D F, et al., Large Scale whole-genome sequencing of the Icelandic population. Nature Genetics 2015). The informativeness of genotype imputation (imputation information) was estimated by the ratio of the variance of imputed expected allele counts and the variance of the actual allele counts:

$$\frac{\text{Var}(E(\theta \mid \text{chip data}))}{\text{Var}(\theta)},$$

where θ is the allele count. Var(E(θ|chip data)) was estimated by the observed variance of the imputed expected counts and Var(θ) was estimated by p(1−p), where p is the allele frequency.

For improved sequencing coverage of the GC-rich intron 4 in ASGR-1 gene, whole-genome sequence ("WGS") data generated for 738 Icelanders was analyzed using TruSeq PCR-free method from Illumina (mean depth of 30×). This PCR-free method gave much better coverage of GC-rich regions including the ASGR-1 intron 4. The del12 variant in intron 4 of ASGR-1 was detected in five individuals in this dataset.

To provide improved coverage of the associated region (1 Mb centered on ASGR-1), a new dataset was analyzed that included an additional 5,817 WGS individuals (on top of the 2,636 WGS Icelanders). These additional individuals were sequenced with either Illumina TruSeq PCR free or TrueSeq Nano methods. These Illumina TrueSeq methods give enhanced sequence coverage as compared to the standard Illumina TrueSeq method (median sequencing depth 32×). The identified sequence variants were imputed into 150,656 Icelandic chipped-typed individuals, and with the use of genealogy information, into primary and secondary relatives of chip-typed individuals that were un-typed. In this expanded dataset, we identified another rare (0.027%), novel variant, W158X. The W158X variant is a four by INDEL in exon 7 of ASGR-1 (NM_001671.4:c. 469_472dupAACT) that causes frameshift and introduction of premature stop codon at amino acid 158 out of the 291 amino acid full length protein (NP_001662.1:p.Trp158X). A total of 345 individuals were Sanger-sequenced based on the imputation predicted carriers and non-carriers of c. 469_472dupAACT. In this dataset, 79 c. 469_472dupAACT carriers and 270 non-carriers were identified. This genotype data was then used to re-impute the variant into the Icelandic dataset. For non-HDL cholesterol, a larger sample set (n=136,261) was used in the association analysis outlined in Tables 1.4A and 1.4B.

Associations between imputed genotypes and serum lipids (non-HDL cholesterol, HDL cholesterol, LDL cholesterol and triglycerides), ALP and vitamin B12 levels in the Icelandic dataset were tested using a generalized linear regression, assuming an additive genetic model (Gudbjartsson D F, et al., Large-scale whole-genome sequencing of the Icelandic population. Nature genetics 2015; and Steinthorsdottir V, et al., Identification of low-frequency and rare sequence variants associated with elevated or reduced risk of type 2 diabetes. Nature genetics 2014; 46:294-8). All measurements were adjusted for age, sex and measurement site, and average was taken over the available measurements after adjustment and inverse normal transformation. The lipid measurements were further adjusted for statin use. Removing individual known to take lipid lowering drugs in the Icelandic dataset did not alter the association with non-HDL cholesterol. The effect, in standardized units, changed from −0.29 (95% CI −0.38, −0.20; P=$4.0 \times 10^{-11}$) to −0.30 (−0.39, −0.21; P=$6.7 \times 10^{-11}$). This amounted to excluding 16,295 individuals, out of 119,146 individuals with non-HDL cholesterol information.

The lipid, ALP and vitamin B12 measurements from the Danish Inter99 study, ADDITION Denmark screening cohort, and the Nijmegen biomedical study, were adjusted and transformed in the same way and tested for association with allele count of del12 and rs186021206 using the linear regression implemented in the R software package. Results from the different populations were combined using the inverse variance fixed-effects method with METAL (Willer C J, et al., METAL: fast and efficient meta-analysis of genomewide association scans. Bioinformatics 2010; 26:2190-1). Effect estimates from the regression analysis are expressed in units of standard deviation (SD). To obtain effect estimates in mg/dL for non-HDL cholesterol, LDL cholesterol and HDL cholesterol, the estimates from the regression analysis were multiplied by the estimated SD of the population distributions. Triglyceride, ALP and vitamin B12 levels were log-transformed before adjustment as their distributions are approximately log-normal, and the corresponding effect estimates are presented as percentage change.

For the Icelandic dataset, logistic regression was used to test for association between the del12 variant and coronary artery disease and myocardial infarction, treating the disease status as the response and the number of copies of the deletion an individual carries as the explanatory variable. Other available individual characteristics that correlate with disease status were also included in the model as nuisance variables (Gudbjartsson D F, et al., Large-scale whole-genome sequencing of the Icelandic population. Nature genetics 2015). Coronary artery disease case-control association analysis for the non-Icelandic sample sets was done using the NEMO software (Gretarsdottir S, et al., The gene encoding phosphodiesterase 4D confers risk of ischemic stroke. Nature genetics 2003; 35:131-8) assuming a multiplicative risk model. Results for the Icelandic and the non-Icelandic sample sets were combined using a Mantel-Haenszel fixed-effects model. Heterogeneity in the effect estimate was tested assuming that the estimated odds ratios for different groups follows a log-normal distribution using a likelihood ratio test with degrees of freedom equal to the number of groups compared minus one.

To estimate the effect of the del12 variant on myocardial infarction free survival, we estimated the Kaplan-Meier curves for survival to first myocardial infarction in heterozygous carriers and non-carriers stratified by sex and tested the difference in survival between carriers and non-carriers using the Cox proportional model. The analysis was performed using the survival library in the R software package. The survival analysis was based on 87,718 chip genotyped Icelanders and 44,655 Icelandic first and second degree relatives of chip typed individuals after restricting our analysis to those who lived to be at least 40 years old. Death was treated as a censoring event.

Functional Characterization of the Del12 Variant in ASGR-1 cDNA Preparation, Amplification, Sanger Sequencing and Next Generation Sequencing:

RNA was isolated from blood samples from carriers and non-carriers of del12. Following cDNA generation, the region between exon 3 and 5 in ASGR-1 was PCR amplified and the identified PCR products (two for del12 carriers and one for non-carriers) were Sanger sequenced using standard methodology to determine the sequence difference between the identified cDNA products. To quantify the ratio between the two amplified cDNA PCR products, they were sequenced using Illumina MiSeq instrument coupled with the MiSeq v2 reagent kit.

Western Blot Analysis:

The wild type ASGR-1 cDNA and ASGR-1 cDNA with the 22 bp deletion were transiently overexpressed in HeLa cells to determine if ASGR-1 transcripts with the 22 bp deletion generated stable truncated ASGR-1 protein as evaluated by western blot analysis.

RNA was isolated from blood samples using a Qiagen RNA maxi kit. Concentration and quality of the RNA was determined using an Agilent 2100 Bioanalyzer (Agilent Technologies), all samples had RIN values over 7. Following cDNA generation, the region between exon 3 and 5 in ASGR-1 was PCR amplified using the Advantage® 2 Polymerase kit (Clontech) with the forward primer, CACTCAGGTCCTTCTGCTGTTTC (SEQ ID NO: 32602) and the reverse primer, 5'-ACCTCGCCTCCTCCTGCT-3' (SEQ ID NO: 32603). The resulting products were resolved on agarose gel and the identified PCR products (two for del12 carriers and one for non-carriers) were Sanger sequenced using standard methodology to determine the sequence difference between the identified cDNA products. To quantitate the ratio between the two amplified cDNA PCR products, they were sequenced using Illumina MiSeq instrument coupled with the MiSeq v2 reagent kit.

Transient Overexpression of Wild Type and Mutated ASGR-1 Harbouring the 22 bp Deletion at the End of Exon 4 in HeLa Cells.

Generation and Cloning of Wild Type and Mutated ASGR-1 cDNA:

cDNA of ASGR-1 was obtained by PCR on human liver marathon ready cDNA (BD biosciences Clontech). The primers used were Forward 5'GCCAGCCCTATCATGACCAA'3 (SEQ ID NO: 32604) and Reverse 5'GCAGGTCGAGGCATTGAAGA'3 (SEQ ID NO: 32605). The resulting cDNA contained all exons including the start and stop codons of ASGR-1. PCR product was run on 1.6% Agarose gel and a band of the correct size was excised out and purified using QIAquick gel extraction kit (QIAGEN 28704) following the manufacturer's protocol. For cloning of ASGR-1 cDNA into pcDNA3.1/V5-His TOPO vector (Invitrogen K4800-01), 20 of the gel extraction product was used and the manufacturer's protocol was followed resulting in pcDNA3.1_ASGR-1_WT. Transformed TOP10 chemically competent cells (Invitrogen C4040-10) were plated on LB plates containing 50 μg/ml ampicillin. Colonies were expanded in 3 ml LB medium containing 50 μg/ml ampicillin. Plasmids were purified using QIAGEN plasmid mini kit (QIAGEN 12125) following the manufacturer's protocol. The plasmid sequence was confirmed by Sanger sequencing using the following sequencing primers: T7: 5'TAATACGACTCACTATAGGG'3 (SEQ ID NO: 32606), BGH: 5'TAGAAGGCACAGTCGAGG'3 (SEQ ID NO: 32607) and ASGR-1: 5'GAGGCAATGTGGGAAGAAAGATG'3 (SEQ ID NO: 32608) Introduction of 22 bp deletion in ASGR-1:

In order to generate a cDNA representative of the del12 carrier mRNA, targeted mutagenesis was performed. The Q5 Site-directed mutagenesis kit (New England BioLabs E0554S) and the pcDNA3.1_ASGR-1_WT plasmid was used as a template. In short, a PCR reaction was performed using the following primers 5'GAGGCAATGTGGGAAGAAAGATGAAGTCG'3 (SEQ ID NO: 32609) and 5'CTGGGCCTCCGTGCTCGC'3 (SEQ ID NO: 32610), resulting in a double-stranded DNA fragment representing the entire pcDNA3.1_ASGR-1_WT plasmid lacking the 22 bp at the end of exon 4. Following the manufacturers recommendation, 1 uL of the PCR reaction was used in the KLD reaction (New England BioLabs E0554S) wherein the PCR fragment is phosphorylated, re-circularized and the non-mutated template plasmid is removed. Mutated plasmids were transformed into NEB 5-alpha Competent cells (New England BioLabs C2987H) and plated on LB plates containing 50 μg/ml ampicillin. Colonies were expanded in 3 ml LB medium containing 50 μg/ml ampicillin. Plasmids were purified using QIAGEN plasmid mini kit (QIAGEN 12125) following the manufacturer's protocol. ASGR-1_22_bp_del sequence was confirmed by Sanger sequencing.

Expression of ASGR-1 in Cultured Cells:

Two days prior to transfection, 100,000 HeLa cells (Public Health England 93021013) were seeded into each well of a 6-well plate in 3 mL of DMEM medium (11995-065, ThermoFisher) supplemented with 10% fetal calf serum (ThermoFisher 10500-064) and 50 units/mL penicillin and 50 ug/mL streptomycin (ThermoFisher 15070-063). Cells were incubated at 37° C. and 5% $CO_2$ in a humidified incubator.

The day before transfection, media was replaced with the without antibiotics. On the day of transfection, for each transfected well, 2.5 ug of plasmids containing ASGR-1_WT or ASGR-1_del22 cDNA were diluted in 125 uL Opti-Mem medium (ThermoFisher 31985-047) and 5 uL of P3000 reagent (ThermoFisher L3000-008). Next, 3.75 uL Lipofectamine 3000 (ThermoFisher L3000-008) were mixed with 125 uL of Opti-Mem. Subsequently, the diluted plasmid solution was mixed with the Lipofectamine 3000 solution at a 1:1 ratio and incubated at room temperature for 5 minutes before the addition of 250 uL of the combined solution to each transfected well.

24 hours post transfection, the spent media was replaced with fresh without antibiotics. Selected wells were supplemented with 10 uM MG132 (TOCRIS 1748) for 4.5 hours prior to harvesting of cells. 48 hours post transfection cells were harvested for analysis by washing wells 2× with PBS (ThermoFisher 14190-250) followed by an 8 minute incubation with 1 mL of 0.5 mM EDTA in PBS (ThermoFisher 15575-020). Next, the EDTA solution was aspirated and cells dislodged by pipetting of 2 mL of fresh media. 3×6-wells were pooled for each experimental condition and cells were spun down at 300×g for 5 minutes. The equivalent of 2×6-wells were lysed in 200 uL of RIPA buffer for Western blot analysis. The remainder of cells were split in two and lysed in 300 uL RLT buffer (Qiagen 74106) or 900 uL Tissue and Cell lysis solution (Epicentre MTC096H) and snap frozen on dry ice for RNA and DNA extraction respectively. Three different transient expression experiments were done and all gave the same results.

Quantitative PCR Analysis:

RNA was isolated from cells using the RNeasy Mini Kit (Qiagen 74106) according to manufacturer's recommendations, and concentration and quality was determined with Nanodrop 1000 spectrophotometer (Thermo Scientific). cDNA was synthesized using the High capacity cDNA reverse transcriptase kit (ThermoFisher). DNA was isolated from cells using the MasterPure DNA Purification Kit (Epicentre MCD85201) according to manufacturer's recommendation.

Analysis of gene expression and transfection efficiency was performed on total cDNA and DNA respectively, with real-time PCR on an ABI Prism 7900HT Sequence Detection System (ThermoFisher) using forward (AGACCTTCAGCATCTGGACAATG (SEQ ID NO: 32611)) and reverse (CGAGGTCCGGAGCAGAGA (SEQ ID NO: 32612)) primers and fluorescent labelled probe spanning exon junction 2-3 of the ASGR-1 gene (6FAM-CAGAAAAGGGC-CACCTC-MGB (SEQ ID NO: 32613) (ThermoFisher). Human betaActin assay (ThermoFisher 4326315E) was run in parallel to verify normalization of input cDNA and DNA.

Western Blot Analysis:

Cells corresponding to two wells of a 6 well plate were lysed using 200 μl of RIPA buffer with 1:100 Halt protease and phosphatase inhibitor cocktail (Thermo Scientific 78442). Lysates were kept on ice for 10 min with agitation followed by sonication for 20 sec (Branson 2510) and additional agitation on ice for 10 min. Lysates were spun down at 4° C. for 15 min at 14,000×g. Total protein amount of lysates was estimated using the Pierce BCA protein assay kit (Thermo Scientific 23227). Samples were prepared using Novex Bolt LDS sample buffer (4×) (Life technologies B0007) and Novex Bolt sample reducing agent (10×) (Life technologies B0009) and run on Novex Nupage 4-12% Bis-Tris gel (Life technologies NP0335BOX). Total protein amount per lane was 24 μg and PageRuler (Thermo scientific 26616) was used to estimate protein size. The gel was run at a constant of 200V for 50 min. Proteins were transferred to a nitrocellulose membrane (Life technologies IB23002) using iBlot2 (Life technologies). Membranes were allowed to dry and were then hydrated with MQ water before blotting. Membranes were blocked for 1 hour at room temperature using Odyssey blocking buffer PBS (Li-Cor 927-40000). Primary antibodies used were α-ASGR-1 (Sigma-Aldrich HPA011954) 1:500 (recognizes amino acid 1-41) and α-beta-actin (Abcam ab6276) 1:5000 incubated in blocking buffer with the addition of 0.1% Tween for 3 hours at room temperature. Secondary antibodies used were α-Rabbit 680RD (Li-Cor 926-68073) and α-Mouse 800CW (Li-Cor 926-32212) both 1:20,000 in PBST+0.01% SDS for 1 hour at room temperature. After washing the membrane it was allowed to dry and then scanned using the Odyssey infrared imaging system (Li-Cor Biosciences).

Other Diseases and Traits in deCODE Database:

The deCODE Genetics phenotype database contains medical information on diseases and traits obtained through collaboration with specialists in each field. This includes information on cardiovascular diseases (e.g., myocardial infarction, coronary arterial disease, peripheral arterial disease, atrial fibrillation, sick sinus syndrome and stroke), metabolic disorders (e.g., obesity, diabetes, and metabolic syndrome), psychiatric disorders (e.g., schizophrenia, bipolar disorder, anxiety and depression), addictions (e.g., nicotine, alcohol), inflammatory diseases (e.g., rheumatoid arthritis, lupus, and asthma), musculoskeletal disorders (e.g., osteoarthritis, osteoporosis), eye diseases (e.g., glaucoma), kidney diseases (e.g., kidney stones, kidney failure) and 29 types of cancer. Anthropometric measures have also been collected through several of these projects. Routinely measured traits from patient workups (e.g., sodium, potassium, bicarbonate, calcium, phosphate, creatinine, blood cell counts, hemoglobin, hematocrit, immunoglobulins, iron, vitamins, lipids, liver function tests and more) were obtained from the Landspitali University Hospital, Reykjavik, and the Icelandic Medical Center Laboratory in Mjodd (Laeknasetrid), Reykjavik. The number of independent and uncorrelated secondary traits tested for association with del12 amounts to 400.

Results

Association of Sequence Variants with Non-HDL Cholesterol Levels

Sequence variants were first identified through whole-genome sequencing ("WSG") of 2,636 Icelanders to a median depth of 20×. These variants were imputed (assisted by long-range phased haplotypes) into the genomes of 104,220 Icelanders who had been genotyped using Illumina single nucleotide polymorphism (SNP) arrays. In addition, Icelandic genealogical information was used to calculate genotype probabilities for 294,212 close relatives to those genotyped. Using these data we screened for novel rare variants that associated with non-HDL cholesterol levels (n=119,146). A set of seven correlated (pairwise $r^2>0.7$) rare non-coding SNPs on chromosome 17p13.1 associated with non-HDL cholesterol level. The seven variants span 80 kb, including the asialoglycoprotein receptor 1 and 2 (ASGR-1 and ASGR-2) genes. The strongest association was represented by rs186021206 (minor allele frequency (MAF) =0.43%) located downstream of ASGR-1 that associates with 8.9±1.5 mg/dl lowering of non-HDL cholesterol ($P=1.4\times10-9$)(Table 1.4B).

The associated region was well covered by the whole-genome sequencing except for intron 4 of ASGR-1. This intron is 79 base pairs (bp) long and very GC rich. To explore this region further 738 individuals were whole genome sequenced with PCR-free sequencing (Illumina), that gave enhanced coverage of the intron and led to the identification of a 12 bp deletion within the intron; NM_001671.4:c. 284-36_283+33delCTGGGGCTGGGG here after referred to as del12. Following direct genotyping of del12 and imputation into the Icelandic dataset, we observed that del12 (MAF=0.41%) is highly correlated with rs186021206 ($r^2=0.86$) and the six other correlated SNPs and associates even more strongly with lowering of non-HDL cholesterol levels (decrease of 10.2±1.5 mg/dl, $P=2.5\times10-10$) (Table 1.9A). Del12 also increases HDL cholesterol and decreases triglyceride (TG) levels, albeit to a much lesser degree than for non-HDL cholesterol (Tables 1.4A and 1.9B). None of the seven SNPs maintained a significant association with non-HDL cholesterol after adjusting for del12 indicating that del12 is sufficient to explain the non-HDL association.

To validate the del12 association with non-HDL cholesterol levels, del12 in samples from The Netherlands (Nijmegen Biomedical Study18) and Denmark (Danish Inter9919 and Danish Addition study20) were genotyped. Del12 associated with non-HDL cholesterol in each sample set with similar effect size as in Iceland (Table 1.2, Tables 1.4A and 1.4B and Table 1.9B). When all three datasets were combined with the Icelandic discovery data, it was established that del12 lowers non-HDL cholesterol by 11.6±1.5 mg/dl ($P=1.0\times10-16$)(Table 1.9B).

To identify additional loss of function variants in ASGR-1, an extended dataset was screened based on sequence variants identified through whole-genome sequencing ("WSG") of an additional group of 5,817 WGS Icelanders on top of the 2,636 described above. In this dataset, a rare four by insertion mutation was identified; namely, MAF=0.027%; NM_001671.4:c. 469_472dupAACT. As mentioned throughout, this frameshift mutation introduces a premature stop codon at amino acid 158 out of the 291 amino acid full length protein (NP_001662.1:p.W158X). Potential carriers and non-carriers were directly genotyped using Sanger sequencing. Those genotypes were then used to re-impute p.W158X into 150,656 Icelandic chipped typed individuals and their first and second degree relatives. In this dataset, c. 469_472dupAACT associates significantly with a decrease in non-HDL cholesterol (−21.6 mg/dL, 95% CI-34.2 to −9.6) and an increase in ALP (45.3% increase, 95% CI 20.4 to 68.2, $P=7.9\times10^{-6}$) (Table 1.8). The direction of the effects of c. 469_472dupAACT and the effect sizes are similar to that of del12 (Table 1.8). Given that a single test was performed, these results provide a significant replication of the ASGR-1 loss of function effect on non-HDL and ALP. Furthermore, since W158X is not correlated with del12 (i.e. there was no overlap between individuals carrying W158X and del12), the W158X variant provides yet further proof that the loss of function in the ASGR-1 gene is responsible for the observed changes in non-HDL, Triglycerides, Alkaline Phosphatase, Ferritin and Vitamin B12 levels. For coronary artery disease, the odds ratio for W158X (c. 469_472dupAACT) was 0.65 (95% CI 0.26 to 1.40; P=0.24). As mentioned above, the W158X (c. 469_472dupAACT) variant is independent of del12 and none of the 79 carriers found in Iceland carried del12. The variant also appears to be specific to the Icelandic population as it is not detected in large population databases such as (Exome Aggregation Consortium (ExAC), Exome Variant Server (EVS), Genomes of the Netherlands (GoNL) and dbSNP.

Figure 4:
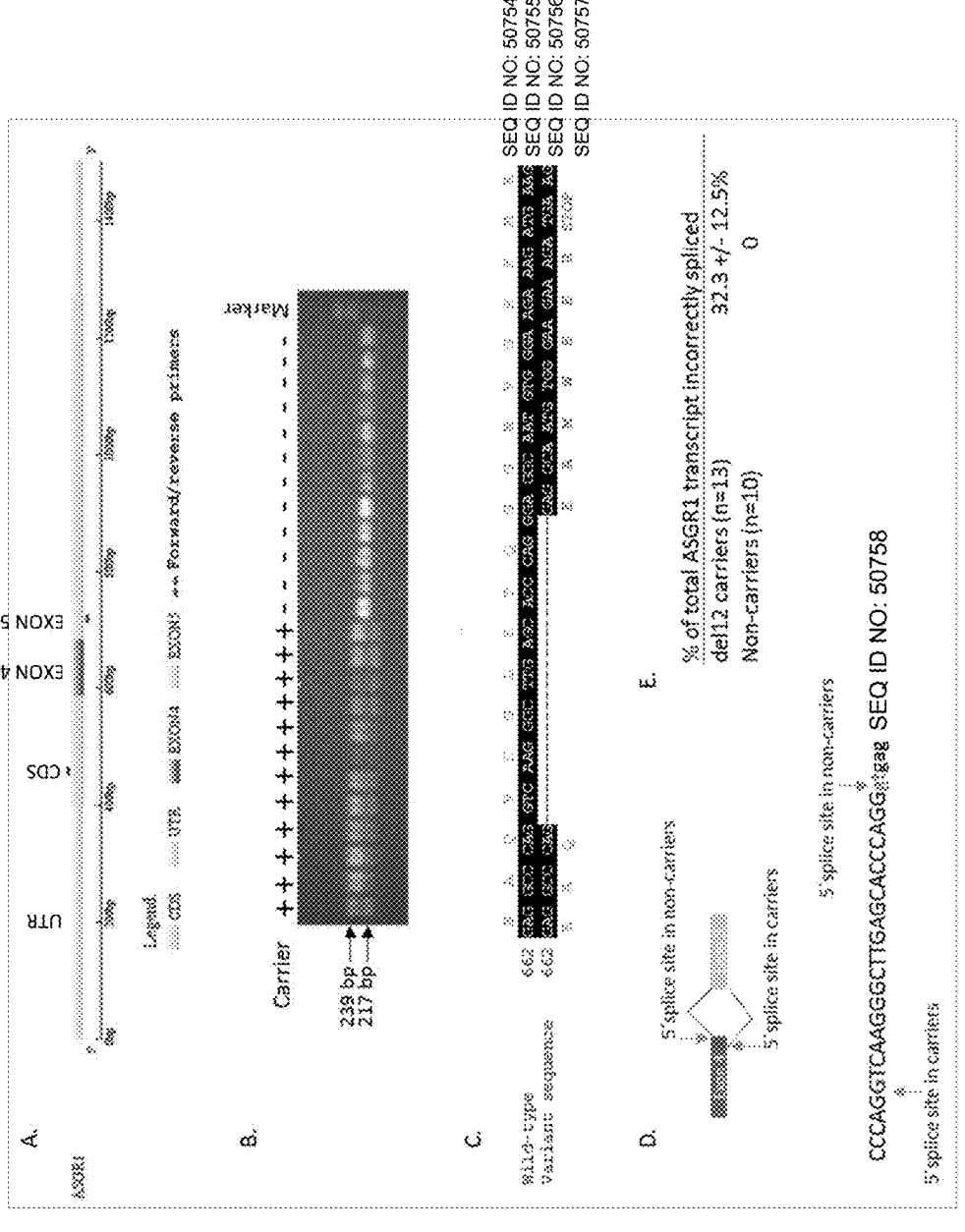
FIG. 4. The del12 variant is associated with a splicing error and frameshift in ASGR-1. (A) Overview of the structure of the ASGR-1 mRNA. Exons 4 and 5 are highlighted (the del12 variant lies within intron 4 between exons 4 and 5 in the unspliced RNA) along with the positions of the PCR primers (red arrows) used to amplify the cDNA. (B) Agarose gel showing the PCR products generated by amplifying cDNA generated from RNA isolated from the blood of del12 carriers and non-carriers. Arrows indicate both the size of the expected PCR product (239 bp) along with the size of the truncated band (217 bp) observed only in del12 heterozygote carriers. (C) Shown is the sequence difference between the full-length (239 bp) and variant (217 bp) cDNA fragments based on Sanger sequencing. The variant sequence in del12 carriers lacks 22 bp at the end of exon 4 compared to the wild-type sequence that results in frameshift and introduction of a stop codon. (D) Diagrammatic representation of the splicing defect observed in del12 carriers. The sequence around the exon 4-intron 4 boundary (exon 4 sequence in capital letters and intron 4 sequence in small letters) is shown along with the 5'splice site in non-carriers and the cryptic 5' splice site activated in del12 carriers. (E) Quantification of the full-length (239 bp) and variant (217 bp) cDNA fragments from heterozygote del12 carriers and non-carriers by direct digital counting of sequencing reads generated following sequencing of the amplified cDNA product from carriers and non-carriers of del12 using the Illumina TruSeq method. The percentage of incorrectly spliced ASGR-1 transcript is shown. Note that the incorrectly spliced form was completely undetectable in non-carriers.

Del12 within Intron 4 of ASGR-1 Causes a Splicing Error Resulting in a Frameshift Since del12 is located in intron 4 of ASGR-1, we examined its effect on splicing between exons 4 and 5. The region between exon 3 and 5 in cDNA generated from blood samples from 12 non-carriers and 12 heterozygous carriers of del12 was PCR amplified (FIG. 4). The PCR products were resolved by gel electrophoresis demonstrating a band of 239 bp in non-carrier. In del12 carriers, however, a smaller 217 bp band was noted in addition to the expected 239 bp PCR product (FIG. 4B). Upon Sanger sequencing of the cDNA products we identified in the 217 bp cDNA fragment a 22 bp deletion at the end of exon 4 (FIG. 4C). The deletion of these 22 bp from the ASGR-1 transcript appears to be driven by a pseudo 5'-splice site in exon 4 (FIG. 4D). It causes a frameshift in carriers such that, if translated, the resulting protein would lack both the oligomerization and carbohydrate recognition domains. To quantify this splicing defect we used the Illumina TruSeq method for direct digital counting of sequencing reads that were generated by sequencing the two cDNA products found in del12 carriers. On average, 32±13% of the total ASGR-1 transcripts were accounted for by the incorrectly spliced isoform (FIG. 4E). This form could not be detected in non-carriers (FIG. 4E). Together, these data identify ASGR-1 as the target gene for the non-HDL association at this locus and are consistent with the associated mutation, del12, disrupting the function of the ASGR-1 protein. ASGR-1 is the major subunit of the hepatic asioaloglycoprotein receptor (ASGR) known to recognize and mediate the endocytosis and degradation of a wide variety of desialylated glycoproteins that contain terminal galactose (Gal) or N-acetylgalactosamine (Gal-NAc) residues on their N-linked carbohydrate chains (Morell A G, Gregoriadis G, Scheinberg I H, Hickman J, Ashwell G. The role of sialic acid in determining the survival of glycoproteins in the circulation. The Journal of biological chemistry 1971; 246: 1461-7; Van Den Hamer C J, Morell A G, Scheinberg I H, Hickman J, Ashwell G. Physical and chemical studies on ceruloplasmin. IX. The role of galactosyl residues in the clearance of ceruloplasmin from the circulation. The Journal of biological chemistry 1970; 245:4397-402; Ashwell G, Harford J. Carbohydrate-specific receptors of the liver. Annual review of biochemistry 1982; 51:531-54; Weigel P H. Galactosyl and N-acetylgalactosaminyl homeostasis: a function for mammalian asialoglycoprotein receptors. BioEssays: news and reviews in molecular, cellular and developmental biology 1994; 16:519-24).

The Del12 Variant in ASGR-1 and Risk of Coronary Artery Disease

Given the effect of del12 on non-HDL cholesterol levels, its impact on risk of CAD in 33,090 cases and 236,254 controls from Iceland and 8,558 cases and 11,120 controls from the USA, the UK, New Zealand and Denmark was assessed. It was found that carriers of del12 have a lower risk of CAD than non-carriers (odds ratio 0.66; 95% confidence interval [CI] 0.55 to 0.79; P=6.3×10-6) (FIG. 5A). There was no evidence of heterogeneity across the eight study populations (Phet=0.96). Del12 also decreases risk of MI in Iceland (hazard ratio 0.64; 95% CI, 0.64 to 0.80; P=8.5× 10-5) (FIG. 5B). In addition, del12 carriers have a 1.5 years longer lifespan than non-carriers (95% CI, 0.2 to 2.8 years; P=0.020).

Figure 6:
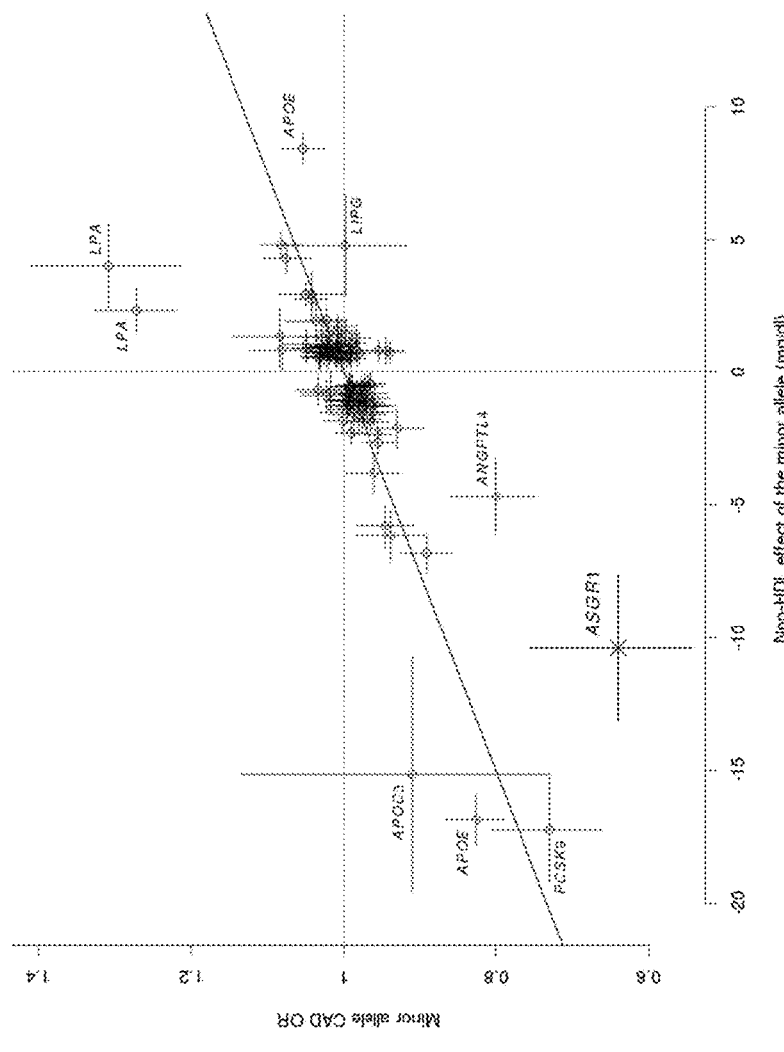
FIG. 6. Comparison of relationship between CAD and non-HDL cholesterol levels between previously identified sequence variants and del12 in ASGR-1. Based on the Icelandic population, the estimated odds ratio (OR) of the minor allele for coronary artery disease (CAD, 41,648 cases and 247,374 controls) as a function of the estimated effect of the minor allele on non-HDL cholesterol levels (N=119, 146). A full list of the sequence variants included is provided in Table 1.7. The error bars represent 95% confidence intervals. The del12 variant in ASGR-1 is shown. The line indicates the best linear regression fit through the origin.

There is a strong positive correlation between the effect of sequence variants on non-HDL cholesterol levels and risk of CAD (Haddad L, Day I N, Hunt S, Williams R R, Humphries S E, Hopkins P N. Evidence for a third genetic locus causing familial hypercholesterolemia. A non-LDLR, non-APOB kindred. Journal of lipid research 1999; 40:1113-22; Timms K M, Wagner S, Samuels M E, et al. A mutation in PCSK9 causing autosomal-dominant hypercholesterolemia in a Utah pedigree. Human genetics 2004; 114:349-53; Varret M, Rabes J P, Saint-Jore B, et al. A third major locus for autosomal dominant hypercholesterolemia maps to 1p34.1-p32. American journal of human genetics 1999; 64:1378-87; Hunt S C, Hopkins P N, Bulka K, et al. Genetic localization to chromosome 1p32 of the third locus for familial hypercholesterolemia in a Utah kindred. Arterioscler Thromb Vasc Biol 2000; 20:1089-93; Do R, Willer C J, Schmidt E M, et al. Common variants associated with plasma triglycerides and risk for coronary artery disease. Nature genetics 2013; 45:1345-52) (FIG. 6, Table 1.5). However, several published variants, deviate from the overall trend. For example, LPA and ANGPTL4 variants have a substantially greater effect on CAD than their non-HDL effects would predict while the effect of the APOE variants is weaker than predicted by the non-HDL effect. Del12 in ASGR-1 is another example of a variant whose effect on CAD is stronger than predicted by the effect non-HDL cholesterol effect (FIG. 6, Table 1.5).

Association of Del12 with Serum Levels of Alp and Vitamin B12

To determine the overall effect of del12 in ASGR-1, its effect on a variety of human diseases and other traits in the Icelandic dataset was screened. A highly significant association of del12 with higher levels of circulating alkaline phosphatase (ALP) (33.6±2.8 U/L increase, P=3.6×10-63) and vitamin B12 (58.4±8.3 pmol/L increase, P=3.1×10-12) was observed (Tables 8A and 8B and Table 18). An increase in ALP levels may reflect liver disease, however, there was no increase in del12 carriers in serum gamma glutamyl transferase (GGT), bilirubin, alanine aminotransferase or other measures of liver function that commonly parallel changes in ALP in liver disease (Table 1.6).

The del12 association with higher levels of ALP and vitamin B12 in individuals from the Danish Inter99 study with comparable effect sizes (P=9.9×10-69 for ALP and P=9.9×10-14 for vitamin B12) was replicated (Table 1.10).

A common variant upstream of ASGR-1 (rs314253; MAF=35.1%) has been reported to associate modestly with both LDL cholesterol and ALP levels (Chambers J C, Zhang W, Sehmi J, et al. Genome-wide association study identifies loci influencing concentrations of liver enzymes in plasma. Nature genetics 2011; 43:1131-8; Willer C J, Schmidt E M, Sengupta S, et al. Discovery and refinement of loci associated with lipid levels. Nature genetics 2013; 45:1274-83). This common variant association is replicated in the data of the present invention (strongest association for both ALP and non-HDL with the correlated rs56093546; MAF=21.6%) and that its associations with ALP and non-HDL are independent of the rare signal represented by del12 (r2<0.001, Table 1.5) as demonstrated. As for del12, this common variant has opposite effects on ALP and non-HDL; the allele that increases ALP decreases non-HDL (see Chambers; Willer) (Table 1.7).

TABLE 1.1

| Study | Design | Definition of CAD and MI cases | Assertainment of controls | Reference |
|---|---|---|---|---|
| Iceland | Case/control | CAD and MI cases were defined by: a) discharge diagnoses (ICD 9 codes 410.*, 411.*, 412.*, 414.* or ICD 10 codes I20.0, I21.*, I22.*, I23.*, I24.*, I25.*) from LUH, b) significant angiographic CAD (≥50% stenosis of the major coronary vessels), c) undergone coronary revascularisation (CABG) d) MI or CAD (ICD 9 or 10 codes) listed in death registries, or e) MI before the age of 75 from MONICA registry | Study participants from various deCODE genetics programs without known CVD. | Helgadottir A, Thorleifsson G, Manolescu A, et al. A common variant on chromosome 9p21 affects the risk of myocardial infarction. Science (New York, NY) 2007; 316: 1491-3. |
| UK 1 - Leicester MI Study | Case/control | Cases included MI patients admitted to the coronary care units of the Leicester Royal Infirmary, Leicester and the Royal Hallamshire Hospital, Sheffield and satisfied the WHO criteria for acute MI. | Controls included adult visitors of individuals with non-cardiovascular disease from each hospital or individuals from three primary care practices located in the same geographical area. Individuals who reported a history of CAD were excluded. | Helgadottir A, Manolescu A, Thorleifsson G, et al. The gene encoding 5-lipoxygenase activating protein confers risk of myocardial infarction and stroke. Nature genetics 2004; 36: 233-9. |
| UK2 - BHF Family Heart Study | Case/control | The British Heart Foundation Family Heart Study (BHF-FHS) CAD cases were index cases from families of European ancestry with a strong familial history of defined CAD recruited from throughout the United Kingdom. CAD was defined as a validated history of myocardial infarction or coronary revascularisation (PTCA or CABG) before the 66th birthday. | Controls were blood donors recruited by the United Kingdom Blood Service (UKBS) as part of the Wellcome Trust Case Control Consortium Study. | Genome-wide association study of 14,000 cases of seven common diseases and 3,000 shared controls. Nature 2007; 447: 661-78, and Samani N J, Erdmann J, Hall AS, et al. Genomewide association analysis of coronary artery disease. The New England journal of medicine 2007; 357: 443-53. |
| Emory (Atlanta, Georgia, USA) | Case/control | Cases were identified from subjects undergoing cardiac catheterization at the Emory University Hospital. CAD cases included those that had at least one significant stenosis (≥50%) in any of the major coronary arteries on angiography, or those without significant stenosis but had history of MI, CABG, | Controls included individuals undergoing cardiac catheterization with no or minimal CAD (<20% stenosis) and had no prior history of MI or CAD. Additional controls were recruited from the Grady Memorial Hospitals and Clinical Registry in Neurology (CRIN) and included individuals with non-vascular neurological | Helgadottir A, et al. (2007) |

TABLE 1.1-continued

| Study | Design | Definition of CAD and MI cases | Assertainment of controls | Reference |
|---|---|---|---|---|
| | | or PCI. | diseases (mainly Parkinson's and Alzheimer's diseases), their spouses, unrelated friends and community volunteers; excluding those with a known history of CAD. | |
| Duke (Durham, North Carolina, USA) | Case/control | Participants were enrolled at Duke University Medical Center through the cardiac catheterization laboratories. MI cases included those with self-reported history of MI (corroborated by review of medical records), or those who suffered an MI during the study follow-up period. | Controls included those with no history of MI prior or subsequent to the index cardiac catheterization and no PCI or CABG ejection fraction on left ventriculogram greater than 40%, and stenosis less than 50% on coronary angiography. | Helgadottir A, et al. (2007) |
| UPenn (Philadelphia, Pennsylvania, USA) | Case/control | The study participants were enrolled at the University of Pennsylvania Medical Center and included subjects undergoing cardiac catheterization. CAD cases included those that had at least one significant stenosis (≥50%) in any of the major coronary arteries on angiography, or those without significant stenosis but had history of MI, CABG, or PCI. | Controls included individuals without significant luminal stenosis on coronary angiography (luminal stenosis less than 50%). | Helgadottir A, et al. (2007) |
| New Zealand | Case/control | a) Significant angiographic CAD (≥50% stenosis of the major coronary vessels), b) CABG-procedures c) MI or CAD (ICD 9 or 10 codes) in a clinical registry. | Study participants without known CAD and ultrasound screened for carotid artery disease and abdominal aortic aneurysm, with ankle brachial index to exclude peripheral artery disease. | Gretarsdottir S, Baas A F, Thorleifsson G, et al. Genome-wide association study identifies a sequence variant within the DAB2IP gene conferring susceptibility to abdominal aortic aneurysm. Nature genetics 2010; 42: 692-7. |
| Denmark 1 (Gentofte cadlab) | Case/control | Cases were identified from subject investigated by coronary artery angiography because of suspected ischemic heart disease, valvular heart disease or cardiomyopathy. CAD cases included those that had at least one significant stenosis (≥50%) in any of the major coronary arteries on angiography | Individuals in Monica10 and Inter99 studies without CAD diagnosis based on information from the Danish National Patient Registry and the Danish Register of Causes of Death. | |
| Denmark 2 (Monica10) | Case/control | Monica10 is a population based study. Participants were recruited from the Danish Central Personal Register as random | Individuals in Monica10 and Inter99 studies without CAD diagnosis based on information from the Danish National | Olsen M H, Hansen T W, Christensen M K, et al. N-terminal |

TABLE 1.1-continued

| Study | Design | Definition of CAD and MI cases | Assertainment of controls | Reference |
|---|---|---|---|---|
| | | samples of the population in the southern part of the former Copenhagen County. Cardiovascular events were defined as first ever non-fatal or fatal CVD (ICD-8: 390-448/ICD-10: I00-I79). Assessment of the cardiovascular endpoints was based on data from the Danish National Patient Registry and the Danish Register of Causes of Death. | Patient Registry and the Danish Register of Causes of Death. | pro-brain natriuretic peptide, but not high sensitivity C-reactive protein, improves cardiovascular risk prediction in the general population. European heart journal 2007; 28: 1374-81. |
| Denmark 3 (Inter99) | Case/control | The Inter99 study is a population-based randomized controlled trial (CT00289237, ClinicalTrials.gov) investigating the effects of lifestyle intervention on cardiovascular disease. Cardiovascular events were defined as first ever non-fatal or fatal CVD (ICD-8: 390-448/ICD-10: I00-I79). Assessment of the cardiovascular endpoints was based on data from the Danish National Patient Registry and the Danish Register of Causes of Death. | Individuals in Monica10 and Inter99 studies without CAD diagnosis based on information from the Danish National Patient Registry and the Danish Register of Causes of Death. | 14. Jorgensen A B, Frikke-Schmidt R, Nordestgaard B G, Tybjaerg-Hansen A. Loss-of-function mutations in APOC3 and risk of ischemic vascular disease. The New England journal of medicine 2014; 371: 32-41. |
| Sweden | Case/Control | Ischemic stroke patients from the clinic at Karolinska Univerity Hospital, Stockholm. The ischemic stroke diagnosis was based on clinical findings and brain imaging (CT or MRI). | Population-based controls, either healthy blood donors or healthy volunteers recruited at the Karolinska Hospital | Gretarsdottir et al (2008) Traylor et al (2012) |
| South Germany | Case/Control | Ischemic stroke patients recruited at the stroke unit of the Department of Neurology, Klinikum Grosshadern, University of Munich. Diagnoses were based on clinical findings and imaging evidence (either CT or MRI), and were clinically confirmed by neurologists. | Gender and age matched individuals without history of cardiovascular disease selected from the KORA S4 Study | Traylor et al (2008) Gschwendtner et al (2009) Wichmann et al (2005) |
| West Germany | Case/Control | Ischemic stroke patients recruited through hospitls participating in the regional Westphalian Stroke Register. Diagnoses were based on clinical findings and imaging evidence (either CT or MRI), and were clinically confirmed by neurologists. | Population controls with a self-reported history of stroke from the population based Dortmund Health Study | Traylor et al (2008) Berger et al (2007) |
| United Kingdom | Case/Control | Ischemic stroke patients recruited through a cerebrovascular service clinic. All cases were phenotyped by one experienced stroke neurologist with review of original brain imaging with CT or MRI. | Community controls, age and gender matched and free of symptomatic cerebrovascular disease were recruited from the same geographic area as the patients. | Traylor et al (2008) Gschwendtner et al (2009) |

TABLE 1.2

Characteristics of Participants in the Discovery and Replication Studies of the association of del12 Variant with Plasma Lipid, Alkaline Phosphatase, and Vitamin B12 levels

| Trait[a] | Iceland | Nijmegen Biomedical Study (Netherlands)[c] | Inter99 study (Denmark)[d] | Addition Study (Denmark)[e] |
|---|---|---|---|---|
| Ancestry | Caucasian | Caucasian | Caucasian | Caucasian |
| N[b] | 194,958 | 5,645 | 7,633 | 9,689 |
| Mean age (SD), yrs | 58.2 (40.6-75.8) | 55.8 (38.0-73.6) | 48.5 (36.1-55.5) | 59.9 (53.1-66.7) |
| Gender, % female | 53.4% | 53.6% | 49.9% | 46.4% |
| Non-HDL cholesterol (SD), mg/dL | 154.7 (109.1-200.3) | 170.7 (129.4-212.0) | 161.6 (117.5-205.7) | 164.7 (124.0-205.4) |
| LDL cholesterol (SD), mg/dL | 133.0 (91.6-174.4) | 138.6 (102.2-175.0) | 137.2 (99.7-174.7) | 139.3 (101.9-176.1) |
| HDL cholesterol (SD), mg/dL | 54.7 (37.7-71.7) | 52.6 (39.2-66.0) | 54.2 (38.4-70.0) | 60.0 (43.6-76.4) |
| Total Cholesterol (SD), mg/dL | 208.0 (162.6-253.4) | 223.4 (180.9-265.9) | 215.8 (173.6-258.0) | 224.7 (183.9-265.5) |
| Triglycerides (SD), mg/dL | 133.6 (67.6-190.5) | 155.8 (94.5-256.8) | 105.8 (60.8-183.9) | 117.4 (73.5-187.3) |
| Alkaline phosphatase (SD), IU/l | 87.1 (53.5-141.7) | na | 41.3 (30.7-55.6) | na |
| Vitamin B12 (SD), pmol/l | 398 (256-618) | na | 398 (286-554) | na |

[a]The average values (where available) for each of the traits listed is shown (±one SD).
[b]Number of individuals with measurements for at least one of the traits.
[c]Wetzels et al (2007)[5],
[d]Jörgensen et al (2003)[6],
[e]Lauritzen et al (2000)[7].

TABLE 1.4A

Association of del12 with Non-HDL Cholesterol, LDL Cholesterol, HDL Cholesterol, Triglyceride, ALP and Vitamin B12 in Iceland, Denmark and The Netherlands

| | Study population (n) | del12 freq. (%) | Effect (95% CI)[a] | P value | Population mean value[e] (±1SD) |
|---|---|---|---|---|---|
| | Non-HDL cholesterol | | mg/dL | | mg/dL |
| Discovery | Iceland (119,146) | 0.41 | −13.6 (−17.7, −9.4) | $2.5 \times 10^{-10}$ | 154.7 (109.1-200.3) |
| Replication | Denmark A[b] (6,182) | 0.22 | −21.3 (−36.8, −5.9) | 0.0069 | 161.6 (117.5-205.7) |
| Replication | Denmark B[c] (9,656) | 0.32 | −22.2 (−32.8, −11.7) | $3.8 \times 10^{-5}$ | 164.7 (124.0-205.4) |
| Replication | The Netherlands[d] (5,537) | 0.50 | −17.0 (−28.3, −5.7) | 0.0032 | 170.7 (129.4-212.0) |
| | Combined | | −15.3 (−18.9, −11.7) | $1.0 \times 10^{-16}$ | |
| | LDL cholesterol | | mg/dL | | |
| Discovery | Iceland (53,841) | 0.41 | −9.5 (−14.0, −5.1) | $2.8 \times 10^{-5}$ | 133.0 (91.6-174.4) |
| Replication | Denmark A (6,098) | 0.22 | −22.1 (−35.5, −8.7) | 0.0012 | 137.2 (99.7-174.7) |
| Replication | Denmark B (8,080) | 0.32 | −19.0 (−29.2, −8.8) | 0.00026 | 139.3 (101.9-176.1) |
| Replication | The Netherlands (5,523) | 0.50 | −16.0 (−26.1, −6.0) | 0.0018 | 138.6 (102.2-175.0) |
| | Combined | | −12.5 (−16.2, −8.8) | $3.9 \times 10^{-11}$ | |
| | HDL cholesterol | | mg/dL | | mg/dL |
| Discovery | Iceland (119,514) | 0.41 | 2.4 (0.7, 4.1) | 0.0058 | 54.7 (37.7-71.7) |
| Replication | Denmark A (6,182) | 0.22 | 4.6 (−0.8, 9.9) | 0.096 | 54.2 (38.4-70.0) |
| Replication | Denmark B (9,656) | 0.32 | 2.4 (−1.8, 6.7) | 0.26 | 60.0 (43.6-76.4) |
| Replication | The Netherlands (5,537) | 0.50 | 2.4 (−1.3, 6.0) | 0.20 | 52.6 (39.2-66.0) |
| | Combined | | 2.5 (1.1, 4.0) | 0.00039 | |
| | Triglyceride | | % change | | mg/dL |
| Discovery | Iceland (80,011) | 0.41 | −6.1 (−10.8, −1.5) | 0.012 | 133.6 (67.6-190.5) |
| Replication | Denmark A (6,182) | 0.22 | −6.0 (−25.2, 11.4) | 0.53 | 105.8 (60.8-183.9) |
| Replication | Denmark B (8,163) | 0.32 | −8.9 (−21.0, 2.3) | 0.15 | 117.4 (73.5-187.3) |
| Replication | The Netherlands (5,537) | 0.50 | −4.4 (−17.9, 8.2) | 0.52 | 155.8 (94.5-256.8) |
| | Combined | | −6.3 (−10.3, −2.3) | 0.0032 | |
| | ALP | | % change | | U/L |
| Discovery | Iceland (126,060) | 0.41 | 50.1 (42.9, 57.2) | $3.6 \times 10^{-63}$ | 87.1 (53.5-141.7) |
| Replication | Denmark A[c] (5,829) | 0.22 | 29.1 (14.8, 42.5) | $3.1 \times 10^{-6}$ | 41.3 (30.7-55.6) |

TABLE 1.4A-continued

Association of del12 with Non-HDL Cholesterol, LDL Cholesterol, HDL Cholesterol, Triglyceride, ALP and Vitamin B12 in Iceland, Denmark and The Netherlands

| | Study population (n) | | Effect (95% CI)[a] | P value | Population mean value[e] (±1SD) |
|---|---|---|---|---|---|
| | Combined | | 46.5 (40.1, 52.7) | $5.6 \times 10^{-69}$ | |
| | Vitamin B12 | | % change | | pmol/L |
| Discovery | Iceland (97,910) | 0.41 | 16.6 (11.5, 21.5) | $3.1 \times 10^{-12}$ | 398 (256-618) |
| Replication | Denmark A[c] (5,826) | 0.22 | 18.6 (3.9, 32.4) | 0.0053 | 398 (286-554) |
| | Combined | | 16.8 (12.0, 21.5) | $8.3 \times 10^{-14}$ | |

[a]Effect estimates and 95% confidence intervals (95% CI) in mg/dL for the non-HDL cholesterol and HDL cholesterol and as percentage change for triglyceride, ALP and vitamin B12.
[b]The Danish Inter99 study (Jørgensen et al. 2003).
[c]The Danish Addition study (van den Donk et al. 2011).
[d]The Nijmegen Biomedical Study (Hoogendoorn et al. 2006).
[e]For triglyceride, ALP and vitamin B12, the population mean and the SD are calculated for log-transformed values and transformed back to original units. To convert the values for non-HDL and HDL cholesterol to millimoles per liter, multiply by 0.02586. To convert triglyceride to mmol/L, multiply by 0.01129.

TABLE 1.4B

Association of del12 and rs186021206 with Cholesterols, Triglyceride, Alkaline Phosphatase and Vitamin B12 Measurements in Iceland, Denmark and the Netherlands.

| | rs186021206 | | | | del12 | | |
|---|---|---|---|---|---|---|---|
| Trait/Cohort (n)[a] | Effect[b] | Effect (95% CI)[c] | P | $P_{adj}$[d] | Effect[b] | Effect (95% CI)[c] | P |
| Non-HDL cholesterol | SD | mg/dL | | | | mg/dL | |
| Iceland (119,146) | −0.28 | −12.9 (−17.1, −8.7) | $1.4 \times 10^{-9}$ | 0.39 | −0.30 | −13.6 (−17.7, −9.4) | $2.5 \times 10^{-10}$ |
| Denmark A (6,182) | −0.38 | −16.7 (−27.9, −5.4) | 0.0038 | 0.64 | −0.48 | −21.3 (−36.8, −5.9) | 0.0069 |
| Denmark B (9,656) | −0.32 | −13.1 (−21.0, −5.3) | 0.0011 | 0.74 | −0.55 | −22.2 (−32.8, −11.7) | $3.8 \times 10^{-5}$ |
| The Netherlands (5,537) | −0.23 | −9.7 (−19.9, 0.5) | 0.062 | 0.19 | −0.41 | −17.0 (−28.3, −5.7) | 0.0032 |
| Combined | −0.29 | −12.9 (−16.3, −9.6) | $2.0 \times 10^{-14}$ | 0.24 | −0.34 | −15.3 (−18.9, −11.7) | $1.0 \times 10^{-16}$ |
| LDL cholesterol | | mg/dL | | | | mg/dL | |
| Iceland (53,841) | −0.22 | −9.2 (−13.6, −4.7) | $5.5 \times 10^{-5}$ | 0.78 | −0.23 | −9.5 (−14.0, −5.1) | $2.8 \times 10^{-5}$ |
| Denmark A (6,098) | −0.43 | −16.1 (−25.8, −6.3) | 0.0012 | 0.56 | −0.59 | −22.1 (−35.5, −8.7) | 0.0012 |
| Denmark B (8,080) | −0.34 | −12.5 (−20.3, −4.7) | 0.0016 | 0.86 | −0.51 | −19.0 (−29.2, −8.8) | 0.00026 |
| The Netherlands (5,523) | −0.36 | −13.2 (−22.3, −4.2) | 0.0041 | 0.81 | −0.44 | −16.0 (−26.1, −6.0) | 0.0018 |
| Combined | −0.28 | −11.1 (−14.5, −7.8) | $1.0 \times 10^{-10}$ | 0.70 | −0.31 | −12.5 (−16.2, −8.8) | $3.9 \times 10^{-11}$ |
| Total cholesterol | | mg/dL | | | | mg/dL | |
| Iceland (125,381) | −0.22 | −9.9 (−14.0, −5.7) | $3.1 \times 10^{-6}$ | 0.78 | −0.23 | −10.5 (−14.7, −6.4) | $6.5 \times 10^{-7}$ |
| Denmark A (6,182) | −0.32 | −13.5 (−24.2, −2.8) | 0.014 | 0.54 | −0.33 | −14.0 (−28.7, 0.8) | 0.063 |
| Denmark B (9,656) | −0.30 | −12.0 (−19.9, −4.2) | 0.0027 | 0.97 | −0.47 | −19.2 (−29.8, −8.6) | 0.00040 |
| The Netherlands (5,537) | −0.21 | −9.0 (−19.5, 1.5) | 0.0927 | 0.48 | −0.33 | −14.1 (−25.7, −2.5) | 0.018 |
| Combined | −0.24 | −10.5 (−13.8, −7.2) | $5.1 \times 10^{-10}$ | 0.68 | −0.27 | −12.0 (−15.6, −8.5) | $5.6 \times 10^{-11}$ |
| HDL cholesterol | | mg/dL | | | | mg/dL | |
| Iceland (119,514) | 0.13 | 2.2 (0.5, 3.9) | 0.011 | 0.0055 | 0.14 | 2.4 (0.7, 4.1) | 0.0058 |
| Denmark A (6,182) | 0.15 | 2.4 (−1.5, 6.4) | 0.22 | 0.84 | 0.29 | 4.6 (−0.8, 9.9) | 0.096 |
| Denmark B (9,656) | 0.03 | 0.4 (−2.7, 3.6) | 0.79 | 0.32 | 0.15 | 2.4 (−1.8, 6.7) | 0.26 |
| The Netherlands (5,537) | 0.02 | 0.2 (−3.1, 3.5) | 0.9 | 0.043 | 0.18 | 2.4 (−1.3, 6.0) | 0.20 |
| Combined | 0.10 | 1.6 (0.4, 2.9) | 0.01 | 0.001 | 0.15 | 2.5 (1.1, 4.0) | 0.00039 |

TABLE 1.4B-continued

Association of del12 and rs186021206 with Cholesterols, Triglyceride, Alkaline Phosphatase and Vitamin B12 Measurements in Iceland, Denmark and the Netherlands.

| Trait/Cohort (n)[a] | rs186021206 | | | | del12 | | |
|---|---|---|---|---|---|---|---|
| | Effect[b] | Effect (95% CI)[c] | P | $P_{adj}$[d] | Effect[b] | Effect (95% CI)[c] | P |
| Triglyceride | | % change | | | | % change | |
| Iceland (80,011) | −0.11 | −5.4 (−10.1, −0.8) | 0.027 | 0.13 | −0.12 | −6.1 (−10.8, −1.5) | 0.012 |
| Denmark A (6,182) | −0.26 | −13.4 (−26.1, −1.6) | 0.046 | 0.11 | −0.11 | −6.0 (−25.2, 11.4) | 0.53 |
| Denmark B (8,163) | −0.03 | −1.3 (−11.2, 8.0) | 0.79 | 0.099 | −0.2 | −8.9 (−21.0, 2.3) | 0.15 |
| The Netherlands (5,537) | 0.13 | 6.5 (−7.0, 19.1) | 0.32 | 0.0057 | −0.09 | −4.4 (−17.9, 8.2) | 0.52 |
| Combined | −0.09 | −4.2 (−7.9, −0.6) | 0.028 | 0.0066 | −0.13 | −6.3 (−10.3, −2.3) | 0.003 |
| ALP | | % change | | | | % change | |
| Iceland (126,060) | 0.82 | 48.9 (41.8, 55.8) | $1.2 \times 10^{-61}$ | 0.10 | 0.84 | 50.1 (42.9, 57.2) | $3.6 \times 10^{-63}$ |
| Denmark A (6,035) | 0.70 | 23.0 (13.2, 32.4) | $2.2 \times 10^{-7}$ | 0.092 | 0.86 | 29.1 (14.8, 42.5) | $3.1 \times 10^{-6}$ |
| Combined | 0.80 | 41.5 (35.9, 47.0) | $1.9 \times 10^{-67}$ | 0.026 | 0.84 | 46.5 (40.1, 52.7) | $5.6 \times 10^{-69}$ |
| Vitamin B12 | | % change | | | | % change | |
| Iceland (97,910) | 0.33 | 15.8 (10.8, 20.7) | $2.0 \times 10^{-11}$ | 0.15 | 0.35 | 16.6 (11.5, 21.5) | $3.1 \times 10^{-12}$ |
| Denmark A (6,032) | 0.49 | 17.6 (7.2, 27.7) | 0.00027 | 0.011 | 0.52 | 18.6 (3.9, 32.4) | 0.0053 |
| Combined | 0.35 | 16.1 (11.6, 20.6) | $4.3 \times 10^{-14}$ | 0.84 | 0.36 | 16.8 (12.0, 21.5) | $8.3 \times 10^{-14}$ |

[a]Number of individuals with trait value and genotypes.
[b]Effect estimates from the regression in units of standard deviations (SD) of the distributions of the adjusted values.
[c]Effect estimates and 95% confidence intervals (95% CI) in mg/dL for the cholesterol, and as percentage change for triglyceride, ALP and vitamin B12.
[d]P-values adjusted for the effect of del12. "The Netherlands", The Nijmegen Biomedical Study[15]; "Denmark A", The Danish Inter99 study[6]; "Denmark B", The Danish Addition study[16].

TABLE 1.5

The association of published lipid variants with non-HDL cholesterol levels and coronary artery disease in Iceland.

| Chr | Build 36 position Position (hg18) | MAF | Info | Non-HDL) (mg/dL) Effect | SE | Coronary artery disease OR | 95% CI | |
|---|---|---|---|---|---|---|---|---|
| 1 | 25,641,524 | 0.47184 | 0.996 | 0.7 | 0.2 | 0.99 | 0.97 | 1.02 |
| 1 | 55,278,235 | 0.01173 | 0.986 | −17.2 | 1.0 | 0.73 | 0.66 | 0.81 |
| 1 | 62,725,961 | 0.21814 | 0.996 | 1.6 | 0.3 | 1.01 | 0.98 | 1.03 |
| 1 | 62,906,518 | 0.33844 | 0.998 | −2.3 | 0.2 | 0.99 | 0.97 | 1.01 |
| 1 | 92,766,395 | 0.19052 | 0.999 | 0.8 | 0.3 | 0.99 | 0.97 | 1.02 |
| 1 | 109,620,053 | 0.20789 | 0.999 | 4.8 | 0.3 | 1.08 | 1.06 | 1.11 |
| 1 | 110,000,250 | 0.41287 | 0.995 | 1.0 | 0.2 | 1.01 | 0.99 | 1.03 |
| 1 | 149,225,460 | 0.15162 | 0.997 | −0.7 | 0.3 | 1.03 | 1.00 | 1.06 |
| 1 | 154,967,275 | 0.28892 | 0.998 | −0.5 | 0.2 | 0.99 | 0.97 | 1.02 |
| 1 | 219,036,651 | 0.28689 | 0.994 | 0.9 | 0.2 | 1.01 | 0.98 | 1.03 |
| 1 | 228,362,314 | 0.39128 | 0.999 | −1.1 | 0.2 | 0.99 | 0.97 | 1.01 |
| 1 | 232,915,962 | 0.4424 | 0.999 | 1.2 | 0.2 | 1.00 | 0.98 | 1.03 |
| 2 | 21,087,477 | 0.04518 | 0.999 | −6.1 | 0.5 | 0.94 | 0.89 | 0.99 |
| 2 | 21,117,405 | 0.3491 | 0.997 | 2.9 | 0.2 | 1.05 | 1.03 | 1.07 |
| 2 | 21,139,562 | 0.1408 | 0.999 | 4.3 | 0.3 | 1.08 | 1.04 | 1.11 |
| 2 | 27,584,444 | 0.34466 | 0.998 | −1.8 | 0.2 | 1.00 | 0.98 | 1.03 |
| 2 | 27,584,716 | 0.20151 | 0.995 | −1.4 | 0.3 | 1.00 | 0.97 | 1.02 |
| 2 | 43,927,385 | 0.27892 | 0.999 | −2.6 | 0.2 | 0.95 | 0.93 | 0.98 |
| 2 | 43,953,086 | 0.19027 | 0.997 | −1.5 | 0.3 | 0.96 | 0.94 | 0.99 |
| 2 | 63,003,061 | 0.32014 | 0.997 | 0.9 | 0.2 | 1.02 | 1.00 | 1.05 |
| 2 | 118,293,189 | 0.07895 | 0.998 | −0.8 | 0.4 | 1.02 | 0.98 | 1.06 |
| 2 | 121,025,958 | 0.41077 | 0.994 | 0.6 | 0.2 | 1.03 | 1.01 | 1.06 |
| 2 | 169,538,401 | 0.37685 | 0.999 | −0.5 | 0.2 | 0.99 | 0.97 | 1.01 |
| 2 | 216,012,629 | 0.32322 | 0.998 | 0.8 | 0.2 | 0.95 | 0.93 | 0.97 |
| 3 | 12,271,469 | 0.3667 | 0.998 | −1.2 | 0.2 | 0.99 | 0.97 | 1.02 |
| 3 | 32,508,014 | 0.07924 | 0.997 | −1.6 | 0.4 | 0.98 | 0.94 | 1.02 |
| 3 | 133,691,893 | 0.11977 | 0.998 | −1.1 | 0.3 | 0.99 | 0.96 | 1.03 |
| 3 | 172,209,912 | 0.07646 | 0.999 | 0.8 | 0.4 | 1.08 | 1.04 | 1.12 |
| 4 | 3,442,937 | 0.40281 | 0.991 | 0.7 | 0.2 | 1.03 | 1.00 | 1.05 |
| 4 | 25,672,088 | 0.14802 | 0.993 | 0.9 | 0.3 | 1.04 | 1.01 | 1.07 |
| 4 | 88,249,285 | 0.40279 | 0.999 | 0.7 | 0.2 | 1.00 | 0.98 | 1.02 |
| 4 | 100,233,828 | 0.42298 | 0.998 | 0.5 | 0.2 | 1.01 | 0.99 | 1.03 |
| 5 | 74,661,243 | 0.35407 | 0.999 | 2.8 | 0.2 | 1.04 | 1.02 | 1.06 |
| 5 | 122,883,315 | 0.47211 | 0.995 | 0.5 | 0.2 | 1.00 | 0.98 | 1.02 |
| 5 | 156,322,875 | 0.35741 | 0.998 | 1.7 | 0.2 | 1.01 | 0.99 | 1.03 |
| 6 | 16,217,142 | 0.46163 | 0.995 | −0.8 | 0.2 | 0.99 | 0.97 | 1.01 |
| 6 | 26,201,120 | 0.06713 | 1.000 | −1.5 | 0.4 | 0.99 | 0.95 | 1.03 |
| 6 | 31,373,469 | 0.29084 | 0.993 | 0.8 | 0.2 | 1.02 | 1.00 | 1.04 |
| 6 | 43,865,874 | 0.47286 | 0.993 | 0.9 | 0.2 | 1.02 | 1.00 | 1.04 |
| 6 | 100,706,818 | 0.19956 | 0.998 | −1.0 | 0.3 | 1.00 | 0.97 | 1.02 |
| 6 | 116,444,196 | 0.40848 | 0.998 | −0.6 | 0.2 | 0.98 | 0.96 | 1.01 |
| 6 | 127,494,332 | 0.47183 | 0.999 | 0.9 | 0.2 | 1.01 | 0.99 | 1.03 |
| 6 | 139,873,450 | 0.42692 | 0.999 | −0.7 | 0.2 | 0.98 | 0.96 | 1.00 |
| 6 | 160,881,127 | 0.01773 | 1.000 | 4.0 | 0.8 | 1.31 | 1.21 | 1.41 |
| 6 | 160,930,108 | 0.06104 | 0.984 | 2.3 | 0.4 | 1.27 | 1.22 | 1.33 |
| 7 | 21,573,877 | 0.22512 | 0.992 | 1.5 | 0.3 | 1.00 | 0.98 | 1.02 |

TABLE 1.5-continued

The association of published lipid variants with non-HDL cholesterol levels and coronary artery disease in Iceland.

| | Build 36 position | | | Non-HDL) (mg/dL) | | Coronary artery disease | 95% CI | |
|---|---|---|---|---|---|---|---|---|
| Chr | (hg18) | MAF | Info | Effect | SE | OR | | |
| 7 | 25,958,351 | 0.14423 | 0.993 | 0.9 | 0.3 | 1.05 | 1.02 | 1.08 |
| 7 | 44,548,856 | 0.2013 | 0.990 | 2.0 | 0.3 | 1.02 | 1.00 | 1.05 |
| 7 | 44,567,220 | 0.42549 | 0.998 | -1.2 | 0.2 | 0.97 | 0.95 | 0.99 |
| 7 | 72,620,810 | 0.11552 | 0.998 | -0.9 | 0.3 | 1.02 | 0.99 | 1.06 |
| 7 | 72,697,942 | 0.46468 | 0.997 | 0.5 | 0.2 | 0.99 | 0.97 | 1.01 |
| 7 | 130,095,474 | 0.44163 | 0.998 | -0.5 | 0.2 | 0.96 | 0.94 | 0.98 |
| 8 | 9,221,641 | 0.07554 | 0.997 | 1.9 | 0.4 | 1.04 | 1.00 | 1.08 |
| 8 | 18,316,718 | 0.18705 | 0.996 | -1.3 | 0.3 | 0.96 | 0.94 | 0.99 |
| 8 | 19,888,502 | 0.08181 | 0.996 | -2.1 | 0.4 | 0.93 | 0.89 | 0.97 |
| 8 | 19,910,123 | 0.45471 | 0.996 | -1.0 | 0.2 | 0.96 | 0.94 | 0.98 |
| 8 | 55,584,167 | 0.24432 | 1.000 | 1.0 | 0.2 | 1.02 | 0.99 | 1.04 |
| 8 | 59,548,473 | 0.31037 | 0.998 | -1.4 | 0.2 | 0.99 | 0.97 | 1.01 |
| 8 | 116,733,072 | 0.26318 | 0.999 | -1.1 | 0.2 | 1.00 | 0.97 | 1.02 |
| 8 | 126,543,488 | 0.22755 | 0.997 | -1.9 | 0.3 | 0.96 | 0.94 | 0.99 |
| 8 | 126,551,803 | 0.49199 | 0.999 | -2.3 | 0.2 | 0.95 | 0.93 | 0.97 |
| 8 | 145,094,645 | 0.385 | 0.990 | 0.7 | 0.2 | 0.98 | 0.96 | 1.00 |
| 9 | 2,630,759 | 0.09898 | 0.998 | -1.3 | 0.4 | 0.97 | 0.94 | 1.01 |
| 9 | 16,894,846 | 0.31865 | 0.998 | -0.5 | 0.2 | 0.97 | 0.95 | 0.99 |
| 9 | 106,704,122 | 0.25781 | 0.999 | -1.1 | 0.2 | 0.97 | 0.95 | 0.99 |
| 9 | 106,724,051 | 0.28833 | 0.997 | -0.6 | 0.2 | 0.99 | 0.97 | 1.02 |
| 9 | 135,122,694 | 0.38646 | 0.997 | -0.9 | 0.2 | 0.99 | 0.97 | 1.01 |
| 9 | 135,143,989 | 0.15248 | 0.995 | 1.0 | 0.3 | 1.05 | 1.02 | 1.08 |
| 10 | 94,829,632 | 0.42892 | 0.993 | -0.6 | 0.2 | 0.99 | 0.97 | 1.01 |
| 11 | 18,612,847 | 0.30731 | 0.998 | 0.8 | 0.2 | 1.02 | 1.00 | 1.04 |
| 11 | 61,305,450 | 0.27208 | 0.991 | 0.8 | 0.2 | 1.01 | 0.99 | 1.04 |
| 11 | 61,354,548 | 0.38782 | 0.998 | -1.1 | 0.2 | 1.00 | 0.98 | 1.02 |
| 11 | 116,144,314 | 0.06787 | 0.999 | -5.8 | 0.4 | 0.94 | 0.91 | 0.98 |
| 11 | 116,159,645 | 0.46743 | 0.999 | -0.5 | 0.2 | 0.97 | 0.95 | 0.99 |
| 11 | 116,206,564 | 0.00228 | 0.979 | -15.1 | 2.3 | 0.91 | 0.73 | 1.14 |
| 11 | 122,039,714 | 0.40275 | 0.996 | 0.6 | 0.2 | 1.01 | 0.99 | 1.03 |
| 11 | 125,749,162 | 0.10572 | 0.999 | 0.7 | 0.3 | 1.02 | 0.99 | 1.06 |
| 12 | 110,492,139 | 0.38236 | 0.999 | 0.8 | 0.2 | 0.94 | 0.92 | 0.96 |
| 12 | 110,794,963 | 0.2284 | 0.999 | 0.8 | 0.3 | 0.94 | 0.92 | 0.97 |
| 12 | 119,901,033 | 0.30901 | 0.994 | 0.9 | 0.2 | 1.03 | 1.01 | 1.05 |
| 13 | 31,851,388 | 0.44766 | 0.999 | -0.7 | 0.2 | 0.99 | 0.97 | 1.01 |
| 14 | 23,953,727 | 0.49889 | 0.995 | 0.8 | 0.2 | 0.98 | 0.96 | 1.01 |
| 15 | 56,518,445 | 0.19278 | 0.999 | -0.6 | 0.3 | 0.99 | 0.97 | 1.02 |
| 16 | 55,542,640 | 0.38939 | 0.991 | -1.8 | 0.2 | 0.97 | 0.95 | 0.99 |
| 16 | 55,572,592 | 0.06047 | 0.997 | 2.9 | 0.5 | 1.04 | 1.00 | 1.09 |
| 16 | 66,485,543 | 0.10432 | 1.000 | -0.8 | 0.3 | 0.97 | 0.94 | 1.01 |
| 16 | 70,665,594 | 0.14755 | 0.997 | 1.3 | 0.3 | 1.03 | 1.00 | 1.06 |
| 17 | 7,032,374 | 0.35058 | 0.996 | -1.0 | 0.2 | 0.98 | 0.96 | 1.00 |
| 17 | 8,101,874 | 0.49481 | 0.998 | -0.4 | 0.2 | 0.96 | 0.94 | 0.98 |
| 17 | 39,281,652 | 0.03364 | 0.989 | 1.3 | 0.6 | 1.08 | 1.02 | 1.15 |
| 17 | 42,746,803 | 0.28266 | 0.998 | 0.6 | 0.2 | 1.02 | 1.00 | 1.04 |
| 17 | 64,394,061 | 0.32561 | 0.995 | 0.5 | 0.2 | 1.03 | 1.01 | 1.05 |
| 18 | 45,363,953 | 0.01171 | 0.999 | 4.8 | 1.0 | 1.00 | 0.91 | 1.09 |
| 19 | 8,335,323 | 0.02392 | 0.965 | -4.7 | 0.7 | 0.80 | 0.74 | 0.86 |
| 19 | 11,063,306 | 0.0888 | 0.995 | -6.8 | 0.4 | 0.89 | 0.86 | 0.92 |
| 19 | 11,088,602 | 0.45236 | 0.997 | 1.4 | 0.2 | 1.02 | 1.00 | 1.04 |
| 19 | 19,268,718 | 0.07838 | 0.997 | -3.8 | 0.4 | 0.96 | 0.92 | 1.00 |
| 19 | 50,103,781 | 0.16819 | 0.980 | 8.4 | 0.3 | 1.05 | 1.02 | 1.08 |
| 19 | 50,103,919 | 0.05236 | 0.968 | -16.9 | 0.5 | 0.83 | 0.79 | 0.87 |
| 19 | 53,898,229 | 0.39118 | 0.997 | 1.1 | 0.2 | 1.00 | 0.98 | 1.03 |
| 19 | 57,016,028 | 0.27115 | 0.999 | 0.6 | 0.2 | 1.03 | 1.01 | 1.06 |
| 19 | 59,489,660 | 0.21613 | 0.990 | -0.6 | 0.3 | 0.99 | 0.96 | 1.02 |
| 20 | 12,910,718 | 0.45731 | 0.998 | 0.4 | 0.2 | 1.00 | 0.98 | 1.03 |
| 20 | 17,793,921 | 0.15541 | 0.991 | 0.8 | 0.3 | 0.98 | 0.95 | 1.01 |
| 20 | 38,613,850 | 0.34358 | 0.997 | -1.1 | 0.2 | 0.98 | 0.96 | 1.00 |
| 20 | 39,157,752 | 0.45945 | 0.997 | 1.1 | 0.2 | 0.99 | 0.97 | 1.01 |
| 20 | 42,475,778 | 0.04599 | 0.993 | -1.3 | 0.5 | 0.98 | 0.93 | 1.03 |
| 20 | 44,018,827 | 0.21978 | 0.998 | 1.3 | 0.3 | 0.98 | 0.96 | 1.01 |

Shown are the build 36 positions (hg18), minor allele frequency (MAF), imputation information, the non-HDL effect in mg/dL and the standard error of the estimate (SE), and the OR for coronary artery disease and 95% CI for the minor allele.

TABLE 1.6

Association of del12 with various measures of liver function in Iceland

| Phenotype | n[a] | Effect[b] | Effect (95% CI)[c] | P | Mean (±1 SD)[d] |
|---|---|---|---|---|---|
| | | | % change | | |
| Alanine Transaminase | 144,402 | 0.087 | 5.8 (-0.4, 12.2) | 0.065 | 28.7 (15.0-54.8) units/L |
| Alkaline Phosphatase | 126,060 | 0.840 | 50.1 (42.9, 57.2) | $3.6 \times 10^{-63}$ | 87.1 (53.5-141.7) units/L |
| Aspartate Transaminase | 144,931 | 0.072 | 4.1 (-2.9, 11.4) | 0.095 | 28.1 (14.2-55.6) units/L |
| Bilirubin | 94,805 | 0.054 | 3.7 (-2.6, 10.4) | 0.25 | 9.1 (4.6-18.0) μm/L |
| Gamma Glutamyl Transpeptidase | 138,844 | 0.113 | 10.3 (1.7, 19.2) | 0.015 | 30.9 (13.1-72.9) units/L |
| | | | g/L | | |
| Albumin | 78,555 | -0.109 | -0.72 (-1.37, 0.06) | 0.033 | 39.5 (33.0-46.0) g/L |

[a]Number of individuals used in the association analysis for each of the traits.
[b]Effect estimate, in units of standard deviation, from regression of adjusted trait values on the expected genotype count of del12.
[c]Effect estimates and 95% CI in original units. For traits with log-normal distribution the effects are presented as percentage change with 95% CI.
[d]Mean trait values, ±one SD, in the Icelandic population. For traits with log-normal distribution the mean and SD is calculated for log-transformed trait values and transformed back to original units.

TABLE 1.7

Common Variants at the ASGR-1 Locus Associated with Non-HDL Cholesterol and Alkaline Phosphatase in Iceland

|  | rs314253 | rs56093546 | del12 |
|---|---|---|---|
| Chromosome position | 17:7032374 | 17:7004539 | 17:7020979 |
| MAF (%) | 35.06 | 21.63 | 0.43 |
| Effect[a] on non-HDL cholesterol | −0.03 | −0.04 | −0.30 |
| (P value) | ($5.9 \times 10^{-6}$) | ($2.0 \times 10^{-6}$) | ($2.5 \times 10^{-10}$) |
| Adjusted for rs314253 (P) | — | 0.022 | $7.9 \times 10^{-11}$ |
| Adjusted for rs56093546 (P) | 0.0068 | — | $7.2 \times 10^{-11}$ |
| Adjusted for del12 (P) | $6.4 \times 10^{-7}$ | $1.7 \times 10^{-6}$ | — |
| Effect[a] on ALP | 0.050 | 0.068 | 0.82 |
| (P value) | ($3.9 \times 10^{-21}$) | ($7.4 \times 10^{-28}$) | ($3.6 \times 10^{-63}$) |
| Adjusted for rs314253 (P) | — | $5.7 \times 10^{-12}$ | $4.1 \times 10^{-66}$ |
| Adjusted for rs56093546 (P) | 0.000042 | — | $2.0 \times 10^{-66}$ |
| Adjusted for del12 (P) | $4.2 \times 10^{-24}$ | $4.0 \times 10^{-31}$ | — |
| $r^2$, D' (relative to rs314253) | — | 0.29, 0.76 | 0.001, 0.60 |
| $r^2$, D' (relative to rs56093546) | 0.29, 0.76 | — | 0.001, 1.00 |

[a]Effect estimates from the regression in units of standard deviations of the distributions of the adjusted values.
The association of rs314253 with LDL cholesterol was reported in Willer et al 2013 and with ALP in Chambers et al., 2011.

TABLE 1.8

Association of p.w158X and del12 with Cholesterols, Triglyceride, Alkaline Phosphatase, Vitamin B12 and CAD in an extended Icelandic dataset

| Trait/(n)[a] | p.W158X | | | del12 | | |
|---|---|---|---|---|---|---|
|  | Effect[b] | Effect (95% CI)[c] | P | Effect[b] | Effect (95% CI)[c] | P |
| Non-HDL cholesterol | SD | mg/dL |  | SD | mg/dL |  |
| (136,261) | −0.45 | −21.6 (−34.2, −9.6) | 0.00057 | −0.29 | −13.3 (−17.2, −9.3) | $4.0 \times 10^{-11}$ |
| LDL cholesterol |  | mg/dL |  |  | mg/dL |  |
| (53,932) | −0.38 | −15.9 (−32.7, 0.9) | 0.064 | −0.23 | −9.7 (−14.1, −5.1) | $2.8 \times 10^{-5}$ |
| Total cholesterol |  | mg/dL |  |  | mg/dL |  |
| (131,879) | −0.30 | −13.5 (−29.3, 2.2) | 0.091 | −0.23 | −10.4 (−14.2, −6.5) | $1.4 \times 10^{-7}$ |
| HDL cholesterol |  | mg/dL |  |  | mg/dL |  |
| (124,437) | 0.14 | 2.4 (−3.9, 8.7) | 0.45 | 0.15 | 2.5 (1.0, 4.0) | 0.0016 |
| Triglyceride |  | % change |  |  | % change |  |
| (82,569) | −0.17 | −8.4 (−25.5, 7.2) | 0.33 | −0.12 | −6.0 (−10.4, −1.8) | 0.0075 |
| ALP |  | % change |  |  | % change |  |
| (131,966) | 0.77 | 45.3 (20.4, 68.2) | $7.9 \times 10^{-6}$ | 0.80 | 47.7 (2.2, 87.1) | $5.6 \times 10^{-76}$ |
| Vitamin B12 |  | % change |  |  | % change |  |
| (102,624) | 0.26 | 15.6 (−4.3, 34.0) | 0.084 | 0.33 | 17.5 (3.1, 30.9) | $5.6 \times 10^{-16}$ |
| CAD |  | OR | P |  | OR | P |
| (35,134/275,567) |  | 0.61 (0.26, 1.40) | 0.24 |  | 0.66 (0.54, 0.81) | $4.5 \times 10^{-5}$ |

[a]Number of individuals with trait value and genotypes.
[b]Effect estimates from the regression in units of standard deviations (SD) of the distributions of the adjusted values.
[c]Effect estimates and 95% confidence intervals (95% CI) in mg/dL for the cholesterols, and as percentage change for triglyceride, ALP and vitamin B12.
[d]P-values adjusted for the effect of del12. This analysis was done on an updated Icelandic dataset that includes 8,453 WGS individuals and imputation into 150,656 Icelandic individuals. For none-HDL cholesterol association analysis an updated sample set was used that contained 136,261 Icelanders.

TABLE 1.9A

Correlation and conditional analysis for del12 and the seven other SNPs that show the strongest association at 17p13.1 with non-HDL cholesterol in Iceland

| Variant | Pos | EA | OA | EA. freq (%) | $r^{2\,d}$ | Effect[c] | P | $P_{adjdel12}$[a] | $P_{adjSNP}$[b] |
|---|---|---|---|---|---|---|---|---|---|
| chr17: 6930020:S | 6930020 | T | C | 0.39 | 0.85 | −0.243 | $5.2 \times 10^{-7}$ | 0.10 | 2.8E−05 |
| rs188743906 | 6931736 | T | C | 0.39 | 0.85 | −0.243 | $5.2 \times 10^{-7}$ | 0.18 | 2.9E−05 |
| rs150983647 | 6942021 | T | C | 0.44 | 0.76 | −0.232 | $5.3 \times 10^{-7}$ | 0.39 | 7.6E−05 |

TABLE 1.9A-continued

Correlation and conditional analysis for del12 and the seven other SNPs that show the strongest association at 17p13.1 with non-HDL cholesterol in Iceland

| Variant | Pos | EA | OA | EA. freq (%) | $r^{2\ d}$ | Effect[c] | P | $P_{adjdel12}$[a] | $P_{adjSNP}$[b] |
|---|---|---|---|---|---|---|---|---|---|
| | | | | | | non-HDL | | | |
| chr17: 6944653:S | 6944653 | A | G | 0.39 | 0.85 | −0.242 | $5.9 \times 10^{-7}$ | 0.10 | 2.3E−05 |
| rs146261845 | 6952978 | T | C | 0.40 | 0.75 | −0.259 | $1.1 \times 10^{-7}$ | 0.88 | 0.00053 |
| chr17: 6961021:S | 6961021 | C | T | 0.39 | 0.85 | −0.250 | $2.2 \times 10^{-7}$ | 0.18 | 0.00010 |
| rs186021206 | 7010136 | A | G | 0.43 | 0.86 | −0.283 | $1.4 \times 10^{-9}$ | 0.39 | 0.067 |
| del12 | 7020979 | del12 | — | 0.41 | | −0.297 | $2.5 \times 10^{-10}$ | — | — |

[a]P-value for correlation between the SNP and the trait, tested conditional on the association of the trait with del12.
[b]P-value for the correlation between the trait and del12, tested conditional on the association of the trait with the SNP.
[c]Effect estimated in units of standardized trait values.
[d]Correlation $r^2$ between del12 and sequencing genotypes of the SNPs in 2,128 Icelandic individuals. Shown are the build 36 positions (hg18).

TABLE 1.9B

Association of del12 with Non-HDL Cholesterol, HDL Cholesterol and Triglyceride Measurements, in Iceland, Denmark and the Netherlands

| | Study population (n) | Change[a] ± SE | P value | Mean value[b] in non-carriers (SD) |
|---|---|---|---|---|
| | Non-HDL cholesterol | mg/dl | | mg/dl |
| Discovery | Iceland (119,146) | −10.4 ± 1.5 | $2.5 \times 10^{-10}$ | 156.8 (38.2) |
| Replication | The Netherlands[c] (5,156) | −15.4 ± 5.4 | 0.0032 | 170.7 (41.3) |
| Replication | Denmark A[d] (5,968) | −17.4 ± 8.1 | 0.0069 | 158.3 (42.9) |
| Replication | Denmark B[e] (8,822) | −21.6 ± 5.4 | $3.8 \times 10^{-5}$ | 164.5 (40.5) |
| | Combined | −11.6 ± 1.5 | $1.0 \times 10^{-16}$ | |
| | HDL cholesterol | mg/dl | | mg/dl |
| Discovery | Iceland (119,514) | 0 ± 0.4 | 0.0058 | 55.2 (15.8) |
| Replication | The Netherlands (5,537) | 2.7 ± 1.5 | 0.20 | 52.2 (13.1) |
| Replication | Denmark A (6,182) | 1.2 ± 2.7 | 0.096 | 55.2 (15.4) |
| Replication | Denmark B (9,656) | 1.5 ± 1.2 | 0.26 | 59.9 (16.2) |
| | Combined | 0 ± 0.4 | 0.00039 | |
| | Triglyceride - mg/dl | mg/dl | | mg/dl |
| Discovery | Iceland (80,011) | −1.2 ± 1.5 | 0.012 | 130.9 (75.2) |
| Replication | The Netherlands (5,537) | −0.4 ± 5.8 | 0.52 | 176.9 (121.2) |
| Replication | Denmark A (6,182) | 8.1 ± 6.9 | 0.53 | 116.8 (84.0) |
| Replication | Denmark B (8,163) | −3.5 ± 2.3 | 0.15 | 131.8 (118.5) |
| | Combined | −1.5 ± 1.2 | 0.0030 | |

[a]Effect size, ±standard error, represents the difference in mean values between heterozygote carriers and non-carriers of the variants after adjusting for age, sex and, for Iceland, site and statin use.
[b]Calculated based on unadjusted values.
[c]The Nijmegen Biomedical Study (Wetzels et al. 2007).
[d]The Danish Inter99 study (Jørgensen et al. 2003).
[e]The Danish Addition study (Lauritzen et al. 2000). To convert the values for non-HDL cholesterol to millimoles per liter, multiply by 0.02586

TABLE 1.10

Association of del12 with Alkaline Phosphatase and Vitamin B12 Serum Measurements in Iceland and Denmark

| | Study population (n) | Change[a] ± SE | P value | Mean value[b] in non-carriers (SD) |
|---|---|---|---|---|
| | ALP | U/L | | U/L |
| Discovery | Iceland (126,060) | +33.6 ± 2.8 | $3.6 \times 10^{-63}$ | 92.8 (64.0) |
| Replication | Denmark A (5,829) | +15.8 ± 2.6 | $1.7 \times 10^{-6}$ | 42.9 (13.5) |
| | Combined | +24.1 ± 1.9 | $9.9 \times 10^{-69}$ | |
| | Vitamin B12 | pmol/L | | pmol/L |
| Discovery | Iceland (97,910) | +58.4 ± 8.3 | $3.1 \times 10^{-12}$ | 439.0 (171.0) |
| Replication | Denmark A (5,826) | +75.9 ± 29.2 | 0.0069 | 420.0 (146.0) |

TABLE 1.10-continued

Association of del12 with Alkaline Phosphatase and Vitamin B12 Serum Measurements in Iceland and Denmark

| Study population (n) | Change[a] ± SE | P value | Mean value[b] in non-carriers (SD) |
|---|---|---|---|
| Combined | +59.7 ± 7.9 | 9.9 × 10⁻¹⁴ | |

[a]Effect size, ±standard error, represents the difference in mean values between heterozygote carriers and non-carriers of the variants after adjusting for age, sex and, for Iceland, site and statin use.
[b]Calculated based on unadjusted values.
[c]The Nijmegen Biomedical Study (Wetzels et al. 2007).
[d]The Danish Inter99 study (Jørgensen et al. 2003).
[e]The Danish Addition study (Lauritzen et al. 2000). To convert the values for non-HDL cholesterol to millimoles per liter, multiply by 0.02586

Example 2—ALP Data from ASGR-1 Knockout Mice

Figure 7:
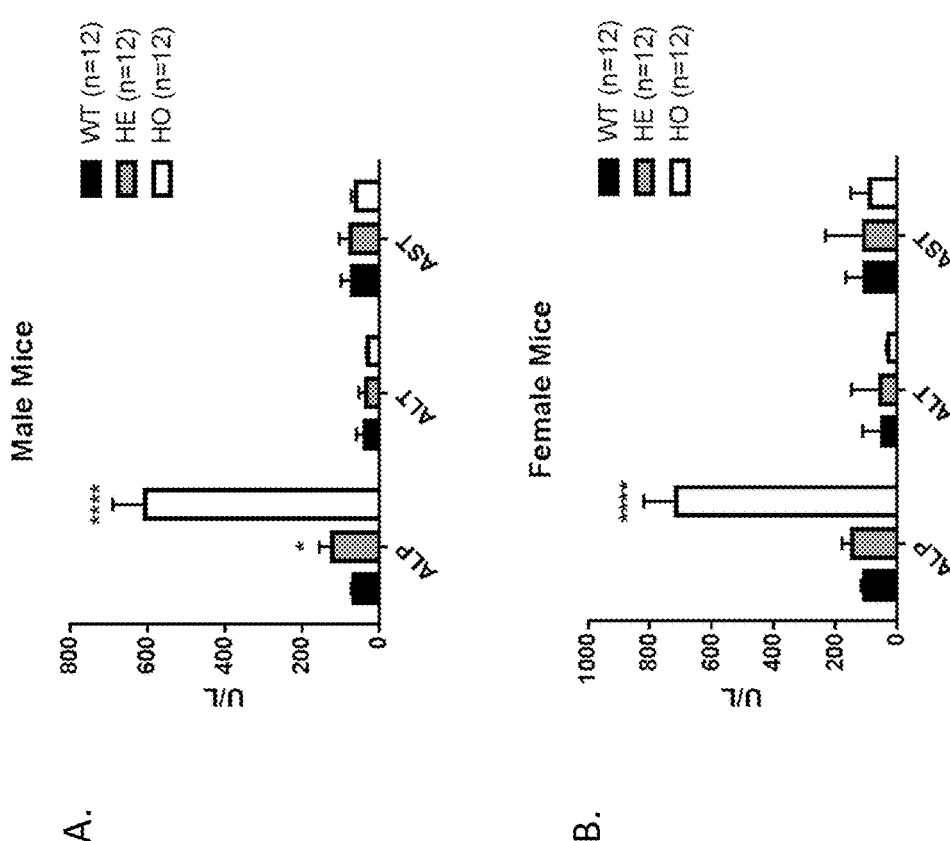
FIG. 7. Analysis of serum ALP, ALT, and AST from ASGR-1 knockout mice is provided. Panel A is data from the male mice studied and Panel B is data from the female mice.
Figure 12:
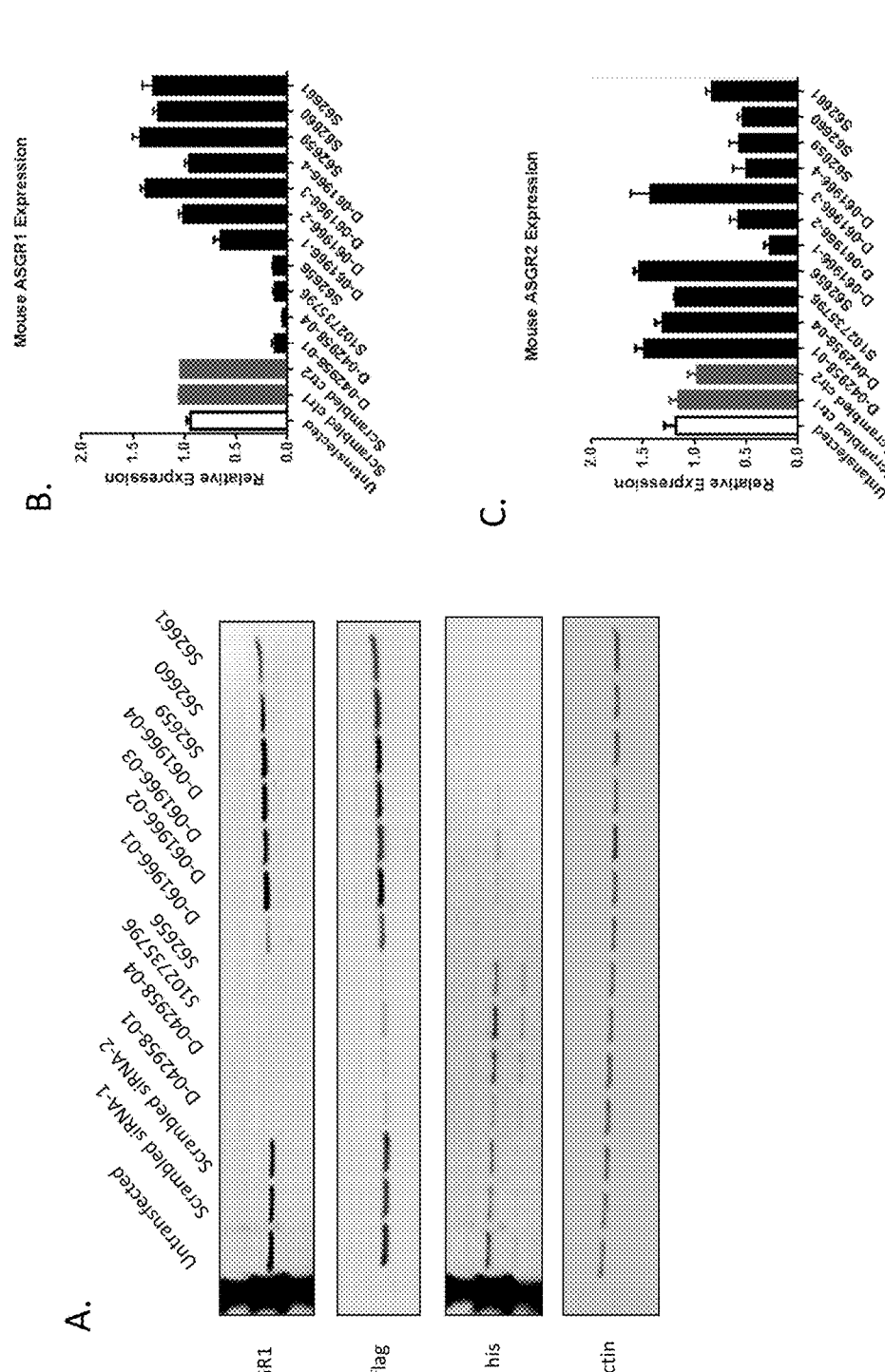
FIG. 12. RNAi in vitro data in CHO cells transfected with mASGR-1 and mASGR-2 using various other constructs. Panel A is a western blot demonstrating reduction of expression of mouse ASGR-1 (anti-mouse ASGR-1 or anti-flag) or mouse ASGR-2 (anti-his). Panel B is a graphical representation of the relative reduction in expression of mouse ASGR-1 by the various constructs. Panel C is a graphical representation of the relative reduction in expression of mouse ASGR-2 by the various constructs.
Figure 15:
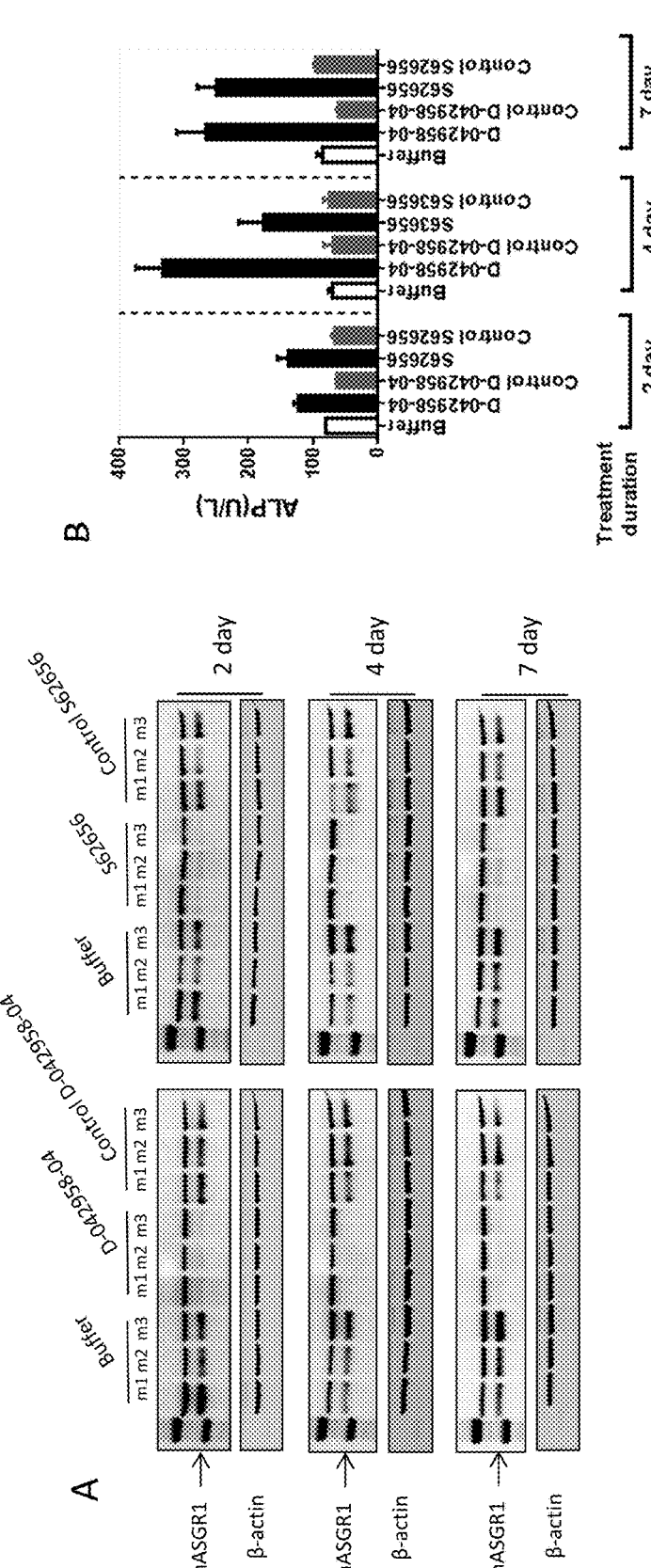
FIG. 15. RNAi in vivo data in C57BL/6J mice using various constructs over the course of 7 days with three injections total, one injection at day 0, one injection at day 2, and one injection at day 4. Panel A is a western blot demonstrating reduction of expression of mouse ASGR-1 protein. Panel B is a graphical representation of the relative increase of serum ALP activity.
Figure 17:
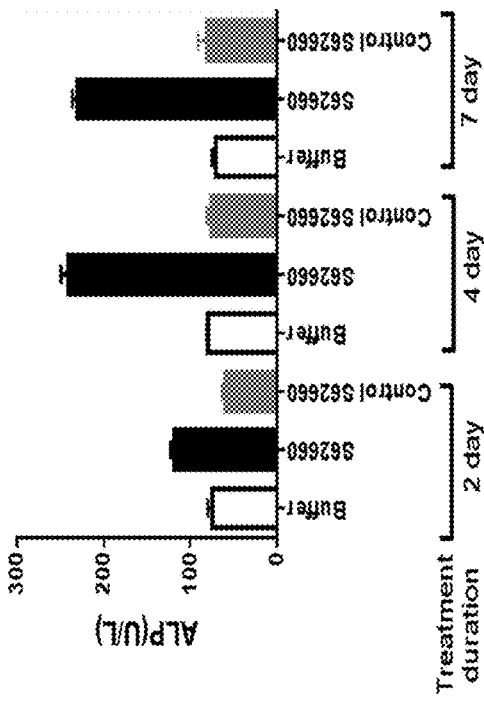
FIG. 17. RNAi in vivo data in C57BL/6J mice using various ASGR-2 constructs over the course of 7 days with one injection at day 0. The figure is a graphical representation of the relative increase in serum ALP activity.
Figure 20:
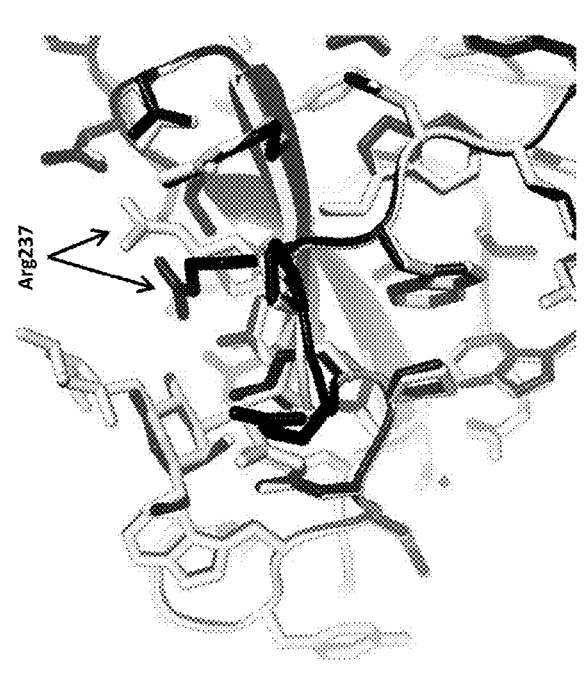
FIG. 20. A computer representation of the crystal structure of an enlarged view of the conformational difference of R237 between the ASGR-1/lactose (white) complex and ASGR-1/galactose (black) complex.

ASGR-1 KO mice (strain B6.129S4-ASGR-1$^{tm1Sau}$/SaubJxmJ) were obtained from Jackson Labs and maintained on a chow diet. Serum was collected from male and female animals after a 4 hr fast and tested in an Olympus AU640 Clinical Chemistry Analyzer. Compared to wild-type mice, serum ALP is elevated in ASGR-1 knockout mice (*, $p<0.05$; ****, $p<0.0001$, one-way ANOVA with Dunnett test). Levels of alanine transaminase (ALT) and aspartate transaminase (AST) were not significantly different between the groups. These data are summarized in FIG. 7 herein. WT=wild-type; HE=heterozygous; HO=homozygous.

Example 3—RNAi

Material and Methods siRNA Constucts

TABLE 3.1

| Vendor | Vendor catalog# | Primary Gene Target | Target Sequence | SEQ ID NO: | matched control | SEQ ID NO: |
|---|---|---|---|---|---|---|
| Fisher/Ambion | S1662 | hASGR-1 | ACUUCACAGCGAGCACGGA | 32614 | ACUUCACACGCAGCACGGA | 32632 |
| GE/Dharmacon | D-011215-01 | hASGR-2 | GCCAAGGACUUUCAAGAUA | 32615 | GCCAAGGAGAAUCAAGAUA | 32633 |
| GE/Dharmacon | D-011215-03 | hASGR-2 | UGACGGAGGUCCAGGCAAU | 32616 | UGACGGAGCAGCAGGCAAU | 32634 |
| GE/Dharmacon | D-011215-04 | hASGR-2 | AGUGAUGGCUCUUGGAAAU | 32617 | AGUGAUGGGAGUUGGAAAU | 32635 |
| Fisher/Ambion | S1665 | hASGR-2 | GACUAUAGGCACAACUACA | 32618 | GACUAUAGCGUCAACUACA | 32636 |
| Fisher/Ambion | S194296 | hASGR-2 | CUGUGUGACUGGGUCCCAA | 32619 | CUGUGUGAGACGGUCCCAA | 32637 |
| Fisher/Ambion | S194297 | hASGR-2 | CACCUCUGGCUAACCCAUA | 32620 | CACCUCUGCGAAACCCAUA | 32638 |
| GE/Dharmacon | D-042958-01 | mASGR-1 | GAGACAGGCUUCCAGAAUU | 32621 | GAGACAGGGAACCAGAAUU | 32639 |
| GE/Dharmacon | D-042958-04 | mASGR-1 | UGAAGUUAGUGGAGUCGAA | 32622 | UGAAGUUACACGAGUCGAA | 32640 |
| Fisher/Ambion | S62656 | mASGR-1 | AGAUCACUCCAGUUUGCUA | 32623 | AGAUCACUGGUGUUUGCUA | 32641 |
| Qiagen | S102735796 | mASGR-1 | CCAUCAUGACAAAGGAUUA | 32624 | CCAUCAUGUGUAAGGAUUA | 32642 |
| GE/Dharmacon | D-061966-01 | mASGR-2 | GGAUGGAACUGAUUAUAGA | 32625 | GGAUGGAAGACAUUAUAGA | 32643 |
| GE/Dharmacon | D-061966-02 | mASGR-2 | GGAAUGGGCCUUCACUCA | 32626 | GGAAUGGCGGUUCACUCA | 32644 |
| GE/Dharmacon | D-061966-03 | mASGR-2 | GACGGAACAUCACCCACUA | 32627 | GACGGAACUAGACCCACUA | 32645 |

TABLE 3.1-continued

| Vendor | Vendor catalog# | Primary Gene Target | Target Sequence | SEQ ID NO: | matched control | SEQ ID NO: |
|---|---|---|---|---|---|---|
| GE/Dharmacon | D-061966-04 | mASGR-2 | GGAUAGGUCUUACCGACAG | 32628 | GGAUAGGUGAAACCGACAG | 32646 |
| GE/Dharmacon | S62659 | mASGR-2 | GCAGGAUCCUAGGAUAGAA | 32629 | GCAGGAUCGAUGGAUAGAA | 32647 |
| Fisher/Ambion | S62660 | mASGR-2 | ACAUUGCUCUUUCACCUGA | 32630 | ACAUUGCUGAAUCACCUGA | 32648 |
| Fisher/Ambion | S62661 | mASGR-2 | GAAGAGUUUCGGACCCUGA | 32631 | GAAGAGUUAGCGACCCUGA | 32649 |

Expression Analysis

RNA was isolated from the HepG2, CHOs stable cell lines, or liver tissues treated with scrambled siRNA, matched control siRNA or siRNAs against hASGR-1, hASGR-2, mASGR-1 or mASGR-2 using the Qiacube and standard Qiagen RNA isolation protocol. The RNA was DNase treated using the RQ1 DNase kit (Promega). Quantitative PCR was performed according to the manufacturer's protocol on the Quantstudio 7 using the indicated primer probe set (hASGR-1: Hs01005019_m1; hASGR-2: Hs00910102_m1; mASGR-1: Mm01245581_m1, mASGR-2:Mm00431863_m1) from Applied Biosystems. 50 ng RNA/well was used and normalized with 18S internal control.

siRNA Transfection

Cells were transfected with 10 nM indicated scrambled siRNA, matched control siRNA or siRNAs against hASGR-1, hASGR-2, mASGR-1 or mASGR-2 siRNA for 3-4 days, using Lipofectamine RNAMAX (Thermo Scientific) following manufacturer's RNAi reverse transfection protocol. Transfection was done in 96 well Screenstar microplates (Greiner bio-one) for internalization assay as well as in 96 well clear tissue culture plates (Corning) for QPCR and Western blotting.

Western Blotting

Cells were lysed in RIPA buffer containing inhibitors 3-4 days after siRNA transfection. Cell lysates were passed through a 21 gauge syringe five times and then centrifuged at 13000 rpm at 4 C for 15 mins. Supernatants were collected and protein concentrations were determined. If needed, 30 ug of protein was deglycosylated using the deglycosylation kit (Genzyme). 10 ug-30 ug of total protein was loaded in each well. The gel was transferred onto a nitrocellulose membrane and the membrane was blocked with 5% blocking buffer for 1 hr at RT. Membrane was then probed with anti-mASGR-1 (1:1000, R &D), hASGR-1 (1:1000, ProteinTech), hASGR-2 (1:1000, Abcam), anti-flag (1:5000, Sigma), anti-his (1:1000, Cell signaling) and mouse anti β-actin (1:5000, Thermo Fisher or Cell signaling) o/n at 4 C. The membrane was further probed with anti-mouse and anti-rat secondary antibodies to detection the indicated bands.

Ligand Internalization Assay

CHO stable cell lines were treated with scrambled siRNA, matched control siRNA or siRNAs against hASGR-1, hASGR-2, mASGR-1 or mASGR-2 siRNA for 3-4 days and plated in 96-well plate. Biotin-GalNAc-PAA was incubated and strepavidin-Alexa488 was further added to cells. Draq5 was used to counterstain cells (for both cytoplasm and nuclei). Cells were scanned with Operetta Image System and data analyzed by Columbus.

Animal Study

All animal housing conditions and research protocols were approved by the Amgen Institutional Animal Care and Use Committee (IACUC). Mice were housed in a specified-pathogen free, AAALAC, Intl-accredited facility in ventilated microisolators. Procedures and housing rooms are positively pressured and regulated on a 12:12 dark:light cycle. All animals received reverse-osmosis purified water ad libitum via an automatic watering system. 10-12 week old C57BL/6J animals (The Jackson Laboratory) were singly housed and were fed standard chow (2020× Teklad global soy protein-free extruded rodent diet; Harlan).

siRNAs modified for in vivo studies were formulated with Invivofectamine 3.0 (Thermo Scientific) following the manufacturer's protocol. In brief, siRNAs were pre-mixed with complex buffer (provided by manufacturer) and Invivofectamine 3.0, and then incubated at 50° C. for 30 minute and further diluted by PBS before injection.

Mice were i.v. injected with buffer, indicated siRNA and matched control siRNA at 1-2 mg/kg body weight in 0.25 ml buffer at indicated time. Liver total RNA from harvested animals was processed for qPCR analysis.

Data from these studies is provided in FIGS. 8-17 herein.

Example 4—Y272C Mutant Data

Stable pools of Chinese hamster ovary (CHO) cells expressing C-terminal FLAG epitope-tagged murine wild-type or Y272C ASGR-1 were generated by established methods using puromycin selection. Cell surface expression of ASGR-1 was confirmed by FACS using anti-FLAG antibody both during selection process and at the time of the experiment. Ligand binding was assessed by FACS using β-GalNAc-PAA-biotin (Glycotech Corporation) and streptavidin-phycoerythrin (PE). Briefly, ligand was added to 100 ul cells ($1\times10^6$ cells) in Dulbeco's Modified Eagle Medium (DMEM) without phenol red plus 2% bovine serum albumin (BSA) and incubated on ice for 60 minutes. Cells were then washed 3× with DMEM without phenol red plus 2% BSA. Streptavidin-PE was then added at 1 µg/ml for 20 minutes on ice followed by 3 more washes in DMEM without phenol red plus 2% BSA, at which point the cells were resuspended in 0.5 ml DMEM without phenol red plus 2% BSA and 5 ul of 0.1 mM SyTOx Blue viability dye and analyzed on a BD LSR II (BD Biosciences). Data are presented as Median Fluorescence Intensity as shown in Table 4.1, below.

TABLE 4.1

ASGR-1 Y272C has reduced ligand binding compared to wild-type ASGR-1

| | β-GalNAc-PAA-biotin, ug/ml | | | Anti-FLAG antibody |
|---|---|---|---|---|
| | 0 | 0.1 | 0.3 | |
| Parental | 5.23 | 5.52 | 5.57 | 7.3 |
| WT | 4.87 | 763.51 | 1394.86 | 3959.65 |
| Y272C | 5.28 | 5.47 | 6.10 | 973.38 |

Example 5—Generation of Antibodies

Molecular Cloning of ASGR-1 and ASGR-2 Sequences

For production of recombinant ASGR-1 and ASGR-2 vectors, cDNA sequences were synthesized, obtained from a commercial source or compiled from RNA sequencing data (Amgen). Human, mouse and rat ASGR cDNA clones were from obtained commercially (OriGene Technologies, Inc.). All other ASGR cDNAs were synthesized (Integrated DNA Technologies, Inc.). GenBank accession numbers are as follows: human ASGR-1 (NM_001671.4), human ASGR-2 (NM_080913.3), mouse ASGR-1 (BC022106.1), mouse ASGR-2 (BC011197.1), rat ASGR-1 (NM_012503), rat ASGR-2 (NM_017189), pig ASGR-1 (NM_001244458), pig ASGR-2 (XM_005669199), dog ASGR-1 (XM_546579), dog ASGR-2 (XM_003434599), cynomolgus monkey ASGR-1 (XP_005582755). Since the NCBI entry for cynomologus ASGR-2 was a partial amino acid sequence (NCBI protein accession # EHH57653), the complete nucleotide sequence was compiled through the analysis of the cyno genome (genome build *Macaca_fascicularis*_5.0; GenBank accession number GCA_000364345.1; Washington University) and RNA sequencing data (Amgen) from cyno liver, heart and skin tissue. For transient or stable mammalian expression, cDNAs were cloned into pTT5 (National Research Council of Canada), pSLX235a (SureTech) or pJiFl (Boyce Lab, Massachusetts General Hospital, U.S. Pat. No. 7,192,933). For individual recombinant protein production in mammalian cells, most sequences were tagged at their C-termini with a 6×His purification tag. For complexes of huASGR-1 and huASGR-2, huASGR-2 was expressed without the 6×His tag. For recombinant expression in *E. coli*, sequences were cloned into pET21a (Novagen, EMD Millipore). The amino acid sequences of the resultant ASGR proteins are shown in Table 1.

Expression and Purification of Recombinant Proteins
Generation of Stable CHO—S Cell Pools for Recombinant Protein Expression CHO—S(Invitrogen, Carlsbad, Calif.) cells were transfected with the pSLX235a vector encoding ASGR-1 or ASGR-2 using Lipfectamine LTX according to the manufacturer's recommendations (ThermoFisher Scientific). Stable pools were selected using 10 ug/ml puromycin (single selections) or 10 ug/ml puromycin and 400 ug/ml hygromycin (double selections) and by culturing the cells in fresh media every 2 days. Stable pools were then used for recombinant protein production.

Recombinant Protein Production and Purification from CHO—S Cell Stable Pools

Cells from the selected stable pools were expanded in growth medium. When sufficient cell numbers had been obtained, cultures were seeded in 2 L conical flasks in a volume of 1 L of growth medium at a viable cell density of $8 \times 10^5$ cells/ml. Cells were then cultured in suspension at 37° C., in 5% $CO_2$ for three days, after which the temperature was dropped to 31° C. for the final 7 days of production. Centrifugation was used to pellet the cells, and the resulting supernatant was filtered to generate conditioned medium.

Individual recombinant proteins were purified via the 6×His tag using Ni-Excel resin (GE Healthcare). Briefly, 1.4 L of conditioned medium was loaded onto 3×5 ml Ni-Excel Hi-trap columns and then washed with 10 column volumes of wash buffer (25 mM HEPES, pH7.6, 250 mM NaCl, 1 mM $CaCl_2$, 50 mM imidazole). Protein was eluted from the columns with 7 column volumes of elution buffer (25 mM HEPES, pH7.6, 250 mM NaCl, 1 mM $CaCl_2$, 400 mM imidazole). The eluted fractions were loaded onto a HiLoad Superdex 200 column via 2×10 ml injections and eluted with 25 mM HEPES, pH 7.6; 150 mM NaCl, 1 mM $CaCl_2$. The final fractions were collected based on their expected molecular weight. The identity of the proteins in each eluted peak was confirmed by LC-TOF-MS after deglycosylation (with N-glycanase, O-glycanase and sialidase) and reduction. ASGR-1/ASGR-2 complexes were purified by pre-incubating the ASGR-1-6×His Tag conditioned medium with ASGR-2-no 6×His Tag conditioned medium. These conditions permitted association of both proteins giving a complex that could be purified via the standard two-step Ni-Excel/SEC method.

Recombinant Protein Production and Purification from *E. coli*

*E. coli* codon optimized sequences were cloned into the pET21a expression plasmid. Plasmids were transformed into *E. coli* strain BL21(DE3) Star (ThermoFisher Scientific Inc.) and individual clones were selected using carbinicillin. For expression, cells were grown in 1 L TB growth medium (supplemented with carbinicillin) in a 4 L flask at 37° C. with shaking. When an optical density of 2 was achieved, protein expression was induced by the addition of 1 mM IPTG (final concentration). After 4 hours of induction at 37° C., the cell paste was harvested by centrifugation (recovering between 7 and 14 g cell paste/L culture). Protein localization into the insoluble fraction was confirmed by SDS-PAGE.

Inclusion bodies were recovered from the cell paste and solubilized in 6M guanidinium containin 10 mM DTT. Successful protein refolding was established by screening a matrix of 32 conditions that included a variety of buffers, pHs, denaturants, stabilizing agents and reducing agents. The refolding procedure was initiated by rapidly diluting the dissolved inclusion bodies at a ratio of 1:15 into the appropriate refold buffer, maintaining approximately 1 mg of protein per condition. The samples were then incubated at 4° C. for 60 hours. The resulting batches were analysed by SDS-PAGE and Ion Exchange chromatography to identify the optimal refolding conditions. For the ASGR-1 CBD (148-291), the final refold conditions were: pH 9.5, 2.5M urea, 20% glycerol, 4 mM cysteine and 4 mM cystamine.

Generation of Anti-ASGR Immune Responses
Mouse Strains

Fully human antibodies to human ASGR were generated by immunizing XENOMOUSE® transgenic mice (U.S. Pat. Nos. 6,114,598; 6,162,963; 6,833,268; 7,049,426; 7,064,244, which are incorporated herein by references in their entirety; Green et al., 1994, *Nature Genetics* 7:13-21; Mendez et al., 1997, *Nature Genetics* 15:146-156; Green and Jakobovitis, 1998, *J. Ex. Med,* 188:483-495; Kellerman and Green, *Current Opinion in Biotechnology* 13, 593-597, 2002). Animals from the XMG2-K, XMG2-KL, XMG4-K and XMG4-KL XENOMOUSE® strains were used for all immunizations.

Mouse anti-human ASGR antibodies were generated by immunizing BALB/c, C57BL/6 and CD-1 mice (Charles River Laboratories, San Diego, Calif.) as well as B6.12954-ASGR-1$^{tm1.Sau}$/SaubJxmJ (ASGR-1 KO mice) and C57BL6×129 F1 mice (Jackson Laboratory, Sacramento, Calif.).

Fully human, heavy chain only antibodies (HCAbs) were generated by immunizing the VH4 and 8V3 strains of transgenic Harbour mice (Janssens et al. 2006, *PNAS* 103: 15130-15135; Harbour Biologics, Rotterdam, Netherlands). Rat anti-mouse ASGR antibodies were generated using Brown Norway Rats (Charles River Laboratories, San Diego, Calif.).

Immunizations

Multiple immunogens and routes of immunization were used to generate anti-human ASGR immune responses. For genetic immunizations, mice were immunized 12-14 times over 6-8 weeks using the Helios Gene Gun system according to the manufacturer's instructions (BioRad, Hercules, Calif.). Briefly, expression vectors encoding wild type human or mouse ASGR-1 (or both huASGR-1+huASGR-2, muASGR-1+muASGR-2) were coated onto gold beads (BioRad, Hercules, Calif.) and delivered to the epidermis of a shaved mouse or rat abdomen. For cell-based immunizations, mice and rats were immunized with CHO-s cells (Invitrogen, Carlsbad, Calif.) or 293-6E cells (National Resource Council of Canada) transiently transfected with expression vectors encoding human or mouse ASGR-1 (or both huASGR-1+huASGR-2, muASGR-1+muASGR-2). Animals were immunized with cells mixed with Alum prepared from aluminum potassium sulfate (EMD Chemicals Inc., Gibbstown, N.J.) and CpG-ODN (Eurofins MWG Operon LLC, Huntsville, Ala.) 10 times over 6 weeks using a protocol that alternated between sub-cutaneous and intra-peritoneal injections. The initial boost was comprised of $4\times10^6$ cells while subsequent boosts contained $2\times10^6$ cells. For soluble protein immunizations, mice were immunized with a variety of human ASGR recombinant proteins representing the complete extracellular domain (ECD), the carbohydrate binding domain (CBD) or the complex of ASGR-1 and ASGR-2 ECDs (Table 5.1). Animals were immunized with recombinant protein (or recombinant protein conjugated to KLH using standard methods) mixed with Alum and CpG-ODN, Complete Freund's Adjuvant (Sigma), or MPL+Adjuvant (Sigma) 10 times over 4-6 weeks using sub-cutaneous injections. The initial boost was comprised of 10 µg while subsequent boosts contained 5-10 µg. Human ASGR-1-specific serum titers were monitored by live-cell FACS analysis on an Accuri flow cytometer (BD Biosciences). Animals with the highest antigen-specific serum titers were sacrificed and used for hybridoma generation (Kohler and Milstein, 1975).

TABLE 5.1

Soluble, Recombinant Protein Antigens Used for Immunizations

| Recombinant Protein Immunogen | Source |
|---|---|
| huASGR-1 (Cat#: C428) ECD-KLH conjugate | Novoprotein |
| huASGR-1 (64-291) ECD-KLH conjugate | Amgen |
| huASGR-1 (64-291) ECD | Amgen |
| huASGR-1 (154-291) CBD | Amgen |
| huASGR-1(64-291)/huASGR-2 (61-287) ECD Complex | Amgen |
| huASGR-1(64-291)/huASGR-2 (61-287) ECD Complex-KLH conjugate | Amgen |
| muASGR-1 (63-284) | Amgen |

Preparation of Monoclonal Antibodies

Hybridoma Generation

Animals exhibiting suitable serum titers were identified and lymphocytes were obtained from spleen and/or draining lymphnodes. Pooled lymphocytes (from each immunization cohort) were dissociated from lymphoid tissue by grinding in a suitable medium (for example, Dulbecco's Modified Eagle Medium (DMEM); Invitrogen, Carlsbad, Calif.). B cells were selected and/or expanded using standard methods, and fused with a suitable fusion partner using techniques that were known in the art.

Antigen Enrichment of Hybridoma Pools

Fused hybridoma pools from each immune tissue harvest were used as a source of material for FACS-based enrichments using a variety of probes. To enrich for hybridomas expressing antibodies specific to native (full length, on-cell) human, cyno, mouse, rat, dog, or pig ASGR-1 (and native human ASGR-2) membranes were prepared from 293T cells transiently expressing the relevant ASGR cDNA construct. 24 hours after transfection using 293-fectin (ThermoFisher Scientific Inc.), cells were biotinylated with E-Z link NHS-LC-LC-Biotin according to the manufacturer's recommendation (ThermoFisher Scientific Inc.). After biotinylation, cells were homogenized with a needle and syringe to form membrane fragments and referred to as "membrane preps". The biotinylated membrane preps were then used to detect hybridomas expressing surface antibodies specific to the target of interest via standard biotin-streptavidin chemistry. To enrich for hybridomas capable of binding to the recombinant ASGR-1 ECD or CBD, soluble, 6×His-tagged ASGR-1 proteins were used (Amgen).

To enrich hybridoma pools for the antigen of interest, they were first incubated with the appropriate membrane prep or soluble probe. For soluble forms of ASGR-1, the recombinant protein probes were added to the hybridomas and allowed to bind. Excess probe was then washed away and the antigen-specific hybridomas were identified by simultaneous detection of surface IgG (with an Alexa 488 conjugated secondary antibody (Jackson ImmunoResearch) (Gt anti-mouse Fc for wild type mouse hybridomas and Gt anti-human Fc for transgenic mouse hybridomas)) and the soluble ASGR-1 probe via its 6×His tag (using an Amgen-derived anti-6×His monoclonal antibody conjugated to Alexa 647 via an Alexa 647 labeling kit (ThermoFisher Scientific Inc). Hybridomas expressing surface IgG and binding antigen were detected by FACS analysis on an Accuri flow cytometer. Dual positive events were sorted as single cells into 384-well plates on a FACS Aria cell sorter (BD Biosciences). For native forms of ASGR-1, biotinylated membrane preps were prepared as described from 293T cells transiently expressing the appropriate antigen. After washing away unbound probe, dual positive hybridomas expressing cell surface IgG and binding antigen were detected using an Alexa 488 conjugated secondary antibody (to detect IgG) and streptavidin conjugated to Alexa 647 (Jackson ImmunoResearch) to detect antigen. These events were sorted as single cells into 384-well plates on a FACS Aria cell sorter. After several days of culture, the hybridoma supernatants containing monoclonal antibodies were collected and used in the screening assays described in the examples below.

Example 6: Identification of ASGR-1 Specific Antibodies

The following Table 6.1 summarizes the approximate numbers of antibodies assayed:

TABLE 6.1

Summary of the identification and selection of huASGR-1 binding, ligand blocking antibodies.

| ASGR-1 Screen | Number of Antibodies |
|---|---|
| huASGR-1 Binders | 15731 |
| huASGR-1-Ligand Blockers (>60%) | 5306 |
| Sequences Unique huASGR-1-Ligand Blockers | 2603 (disclosed in Table 3) |
| huASGR-1-Ligand Blockers (>50%) | 172 (disclosed in Table 3) |

Example 6-A: Initial Selection of ASGR-1 Specific Binding Antibodies

Hybridoma supernatants (monoclonal antibodies) were screened for binding to human ASGR-1 transiently expressed on Human Embryonic Kidney (HEK) 293 cells using the Cell Insight™ High Content Imaging Platform (ThermoFisher Scientific). Human ASGR-1 was transiently expressed on host HEK 293 cells by transfection using human ASGR-1 DNA, Gibco™ Opti-MEM® media and 293Fectin™ reagents following the protocol set out by the manufacturer. Transfected HEK 293 cells expressing the human ASGR-1, hybridoma supernatant or control samples, Alexa Fluor® 488 IgG Fc fragment-specific detection antibody and Hoechst 33342 stain were mixed and incubated for 3 hours at room temperature. Samples were then washed and analyzed on the CellInsight™ system. Supernatants were counter-screened against HEK 293 cells transfected with empty parental vector (referred to as mock). Analysis was done using irrelevant IgG antibody supernatant sample signal; hybridoma supernatant samples showing two times or greater signal over irrelevant IgG antibody sample were considered to be exhibiting ASGR-1-specific binding profiles and selected for further characterization. See Table 6.1.

Example 6-B: Identification of ASGR-1 Receptor-Ligand Blocking Antibodies

ASGR-1-binding hybridoma supernatants were tested for their ability to block ASGR-1 from binding ligand. Competitive binding assays were performed on the antigen specific hybridoma supernatant samples using FACS on either HEK 293 cells transiently expressing human ASGR-1 or CHO—S cells stably expressing Human ASGR-1 as follows. HEK 293 cells or CHO—S cells expressing human ASGR-1 were mixed with the antibody sample (hybridoma supernatants specific for ASGR-1) and incubated for 1 hour at 4° C., and then washed twice. Cells with bound sample were then incubated with precomplexed β-GalNAc-PAA-Biotin (GlycoTech, Gaithersburg, Md.)/Alexa Fluor® 647-Streptavidin for 45 minutes at 4° C. The concentration of β-GalNAc-PAA-Biotin was used at the binding EC50 concentration on the specific cell line. The concentration of Alexa Fluor® 647 Streptavidin was used at a 2:1 molar ratio to β-GalNAc-PAA-Biotin. The 7-AAD cell viability stain was then added and the cells incubated for a further 15 minutes at 4° C., washed twice and resuspended in FACS buffer. Where tolerated by cell viability, FACS buffer supplemented with 1 mM Calcium Chloride was used in all steps. Samples were analyzed using a BD Accuri™ Flow Cytometer and an Intellicyt HyperCyt Autosampler. Analysis was done using irrelevant (non-ASGR-1 specific) IgG antibody supernatant control signal on both mock transfected HEK 293 cells and Human ASGR-1 transfected HEK 293 cells to determine maximum and minimum β-GalNAc-PAA-Biotin binding signal. Using these maximum and minimum binding signals, the % β-GalNAc-PAA-Biotin binding inhibition was determined. ASGR-1 antibodies having the ability to reduce ligand binding ≥60% were identified (Table 6.1), and sequenced using methods available to those skilled in the art. The sequences of unique ASGR-1-specific, ligand blocking antibodies are displayed in Table 2-7 herein.

The unique ASGR-1-specific, ligand blocking antibodies were then tested for their ability to block the GalNAc ligand under more stringent conditions using a single, known antibody concentration (5 ug/ml). The receptor-ligand blocking assays were performed using 293T cells transiently expressing ASGR-1 or CHOs cells that had been stably transfected with ASGR-1. ASGR-1 antibodies having the ability to reduce ligand binding ≥50% were identified. See Table 6.1.

Example 7: Antibody Characterization Assays

A. ASGR-1 Species Cross Reactivity, ASGR-2 Selectivity Assays and Hepatoma (HEPG2) Binding Assays Human ASGR-1-specific, ligand competing antibody samples were tested for binding to ASGR-1 from other species (cynomologus monkey ASGR-1, mouse ASGR-1, rat ASGR-1, dog ASGR-1, and pig ASGR-1) as well as to human ASGR-2 in FACS binding assays at normalized antibody concentrations. For cell-based assays, HEK 293 cells expressing the appropriate antigen of interest were mixed with antibody sample or controls, incubated for 1 hour at 4° C., and then washed twice. Cells with bound antibody were then incubated with Alexa Fluor® 647 IgG Fc fragment-specific detection antibody and 7-AAD viability stain for 15 minutes at 4° C., washed once and resuspended in FACS buffer. Samples were analyzed using a BD Accuri™ Flow Cytometer and an Intellicyt HyperCyt Autosampler. As a negative control, supernatants and controls were also screened against HEK 293 cells transfected with empty parental vector. Analysis was done using irrelevant (non-ASGR-1 specific) IgG antibody supernatant sample signal; hybridoma supernatant samples showing at least two times the signal over irrelevant IgG antibody sample were considered to be exhibiting ASGR-1-species specific binding profiles. For membrane-prep binding assays, ASGR-1 species specific membrane preps were used to coat LumAvidin® microspheres (beads) and tested for binding to selected hybridoma supernatants or controls. Briefly, ASGR-1 species specific membrane preps were incubated with streptavidin-coated LumAvidin® beads for 45 minutes in the dark at room temperature and washed twice. Beads were resuspended in FACS buffer containing Stabilguard®. Antigen-bound beads were then incubated with normalized antibody sample for 1 hour in the dark at room temperature, washed twice, incubated with Alexa Fluor® 488 IgG Fc fragment-specific detection antibody for 15 minutes in the dark at room temperature, washed once and finally resuspended in FACS buffer. Samples were analyzed using an Intellicyt iQue™ Screener Platform. FACS buffer supplemented with 1 mM Calcium Chloride was used in all steps. As a negative control, supernatants and controls were also screened against a non-ASGR-1 antigen membrane prep coated on the LumAvidin® beads. Analysis was done using irrelevant (non-ASGR-1 specific) IgG antibody supernatant sample signal; hybridoma supernatant samples showing at least two times the signal over irrelevant IgG antibody sample were considered to be exhibiting specific binding profiles. See Table 7.1.

Human ASGR-1-specific, ligand competing hybridoma supernatant samples were screened for binding to the human hepatocellular carcinoma cell line HepG2 (ATCC HB-8065) at normalized antibody concentrations. For FACS binding assays, HepG2 cells were mixed with normalized antibody samples or controls, incubated for 1 hour at 4° C., and washed twice. Cells with bound antibody were then incubated with Alexa Fluor® 647 IgG Fc fragment-specific detection antibody and 7-AAD viability stain for 15 minutes at 4° C., washed once and resuspended in FACS buffer. Samples were analyzed using a BD Accuri™ Flow Cytometer and an Intellicyt HyperCyt Autosampler. For high content imaging binding assays, HepG2 cells were mixed with normalized antibody samples or controls, incubated for 1 hour at room temperature and washed twice. Cells with bound antibody were then incubated with Alexa Fluor® 488 IgG Fc fragment-specific detection antibody and Hoechst 33342 stain for 30 minutes at room temperature, washed twice and analyzed on the CellInsight™ system. Where tolerated by cell viability, FACS buffer supplemented with 1 mM Calcium Chloride was used in all steps. Analysis was done using irrelevant (non-ASGR-1 specific) IgG antibody supernatant sample signal; hybridoma supernatant samples showing two times or greater signal over irrelevant IgG antibody sample were considered to be exhibiting HepG2 ASGR-1 specific binding profiles. See Table 7.1.

B. Relative Binding Affinities for ASGR-Specific mAbs

To assess antibody and antigen interaction strength (relative binding affinity), ASGR-1 specific, ligand competing antibody hybridoma supernatants were tested in a limiting antigen binding assay. Titrated amounts of recombinant, soluble ASGR-1 biotinylated protein was incubated with streptavidin-coated LumAvidin Beads® for 45 minutes in the dark at room temperature and washed twice. Beads were resuspended in FACS buffer containing Stabilguard® and 0.05% Sodium Azide. Antigen-bound beads were then incubated with normalized hybridoma supernatant sample or controls for 18 hours in the dark at room temperature, washed twice, incubated with Alexa Fluor® 488 IgG fragment-specific detection antibody for 15 minutes in the dark at room temperature, washed once and finally resuspended in FACS buffer. Samples were analyzed using an Intellicyt iQue™ Screener Platform. FACS buffer supplemented with 1 mM Calcium Chloride was used in all steps. Analysis was done using irrelevant (non-ASGR-1 specific) IgG antibody supernatant sample signal; hybridoma supernatant samples showing at least two times or greater signal over irrelevant IgG antibody sample were considered to be exhibiting ASGR-1 specific binding profiles. In this assay method, the antibody binding signal correlates with antibody affinity. Antibody binding data for a representative antigen coating concentration that fell in the linear range of the instrument signal detection is shown in Table 7.2. The degree of antibody binding to the target (ASGR-1) correlates with the measured fluorescent intensity and thus allows a relative comparison of affinities across the panel.

TABLE 7.1

Summary of the binding specificities of the selected human ASGR-1 binding antibodies.

Binding Data Summary

| mAb | Human ASGR-1 | Cyno ASGR-1 | Mouse ASGR-1 | Rat ASGR-1 | Dog ASGR-1 | Pig ASGR-1 | HEPG2 Cells | Human ASGR-2 |
|---|---|---|---|---|---|---|---|---|
| 25A4 | Y | Y | N | Y | N | Y | Y | N |
| 26C4 | Y | Y | N | Y | N | Y | Y | N |
| 29H8 | Y | Y | N | Y | N | Y | Y | N |
| 4A2 | Y | Y | N | Y | N | Y | Y | N |
| 4H6 | Y | Y | Y | Y | N | Y | Y | N |
| 56E5 | Y | Y | N | N | N | Y | Y | N |
| 7F4 | Y | Y | N | no data | Y | Y | Y | Y |
| 7G4 | Y | Y | N | N | N | Y | Y | N |
| 48B12 | Y | Y | N | N | N | Y | Y | N |
| 184E7 | Y | Y | Y | Y | Y | Y | Y | N |
| 194A4 | Y | Y | N | Y | Y | Y | Y | N |
| 4B1 | Y | Y | Y | Y | Y | Y | Y | N |
| 72G9 | Y | Y | Y | Y | Y | Y | Y | N |
| 190F8 | Y | Y | N | N | Y | Y | Y | N |
| 191G1 | Y | Y | N | N | Y | Y | Y | N |
| 191G10 | Y | Y | N | N | Y | Y | Y | N |
| 194C1 | Y | Y | N | N | Y | Y | Y | N |
| 197G3 | Y | Y | N | N | Y | Y | Y | N |
| 198G3 | Y | Y | N | N | Y | Y | Y | N |
| 75G3 | Y | Y | N | N | Y | Y | Y | N |
| 218G4 | Y | Y | N | N | Y | Y | Y | N |
| 193E7 | Y | Y | N | N | Y | N | Y | N |
| 198D2 | Y | Y | N | Y | N | Y | Y | N |
| 202A3 | Y | Y | N | N | Y | Y | Y | N |
| 7E11 | Y | Y | N | N | N | Y | Y | N |
| 22G5 | Y | Y | N | N | N | N | Y | N |
| 5E5 | Y | Y | N | Y | N | N | Y | N |
| 54E9 | Y | Y | N | N | Y | N | Y | N |
| 6G7 | Y | Y | N | Y | N | N | Y | Y |
| 176H4 | Y | Y | N | N | Y | Y | Y | N |
| 194C10 | Y | Y | N | N | Y | Y | Y | N |
| 12D2 | Y | Y | Y | Y | Y | Y | Y | N |

TABLE 7.2

Limited Antigen Binding Assay to Assess Relative Affinities of selected mAbs

| mAb | Soluble ASGR-1 2.5 ng/mL (FACS Geomean) | mAb | Soluble ASGR-1 2.5 ng/mL (FACS Geomean) | mAb | Soluble ASGR-1 2.5 ng/mL (FACS Geomean) | mAb | Soluble ASGR-1 2.5 ng/mL (FACS Geomean) |
|---|---|---|---|---|---|---|---|
| 25A4 | 17952 | 48B12 | 26989 | 194C1 | 16937 | 7E11 | 4662 |
| 26C4 | 12007 | 184E7 | 40198 | 197G3 | 17708 | 22G5 | 1078 |
| 29H8 | 12179 | 194A4 | 38934 | 198G3 | 25969 | 5E5 | 3278 |
| 4A2 | 16604 | 4B1 | 10060 | 75G3 | 35840 | 54E9 | 6487 |
| 4H6 | 2990 | 72G9 | 34014 | 218G4 | 15105 | 6G7 | 2290 |
| 56E5 | 22648 | 190F8 | 13899 | 193E7 | 18315 | 176H4 | 29444 |
| 7F4 | 4910 | 191G1 | 9546 | 198D2 | 1872 | 194C10 | 21854 |
| 7G4 | 6795 | 191G10 | 24154 | 202A3 | 2152 | 12D2 | 105 |

C. pH and Calcium Sensitivity

This Example characterizes ASGR-1 antibodies based on the effect of pH and/or calcium on their ability to bind the target. For this example, a label-free, kinetic antibody-ASGR-1 binding assay was employed to assess the sensitivity of the antibodies to changes in pH and calcium. Briefly, the ASGR-1-specific, ligand-competing antibodies were first immobilized and then allowed to bind recombinant, soluble huASGR-1 under physiological conditions (ie. pH 7.4, 1 mM CaCl2). The amount of binding was determined and set to 100%. In order to determine if the antibody-ASGR-1 interaction was sensitive to changes in pH or Ca, the assay buffer was then changed to conditions lacking calcium, a reduced pH (pH 5.6) or both lacking calcium and reduced pH (pH 5.6), and dissociation of ASGR-1 from the mAbs monitored. The amount of ASGR-1 remaining bound under each condition was assessed and expressed as a percent of the starting signal. If a >10% difference in ASGR-1 binding signal was calculated (when compared to that measured under physiological conditions), a particular antibody was classified as being sensitive to that condition. Using this method, the selected antibodies were classified into 5 categories:

1. affected by the removal of calcium
2. unaffected by the removal of calcium or drop in pH
3. affected when both calcium is removed and pH is dropped
4. affected by calcium removal, pH drop and both combined
5. affected by the drop in pH The relative dissociation of ASGR-1 from antibodies was measured using a label-free assay on an OctetHTX instrument (Fortebio). Antibody samples were captured on anti-HuFc kinetic biosensors (ForteBio cat #18-5064) at 5 ug/mL in assay buffer (10 mM Tris, 0.1% Triton, 150 mM NaCl, 1 mg/mL BSA, 1 mM CaCl2, pH7.4) for three minutes. A one minute baseline stabilization step was performed in assay buffer. Soluble ASGR-1 (Amgen) at 6 ug/ml in assay buffer was added and association to the antibodies was monitored for two minutes. Subsequent dissociation of ASGR-1 from the antibodies was performed by incubating the ASGR-1-mAb complexes for 10 minutes under each of the following conditions:

| | |
|---|---|
| pH 7.4 + calcium | 10 mM Tris, 0.1% Triton, 150 mM NaCl, 1 mg/mL BSA, pH 7.4, 1 mM CaCl2 |
| pH 7.4 − calcium | 10 mM Tris, 0.1% Triton, 150 mM NaCl, 1 mg/mL BSA, pH 7.4 |
| pH 5.6 + calcium | 10 mM Tris, 0.1% Triton, 150 mM NaCl, 1 mg/mL BSA, pH 5.6, 1 mM CaCl2 |
| pH 5.6 − calcium | 10 mM Tris, 0.1% Triton, 150 mM NaCl, 1 mg/mL BSA, pH 5.6 |

The binding signal at the end of the 2 minute association phase for each dissociation experiment was set to 100% and used to represent the maximal level of ASGR-1 binding. After 1 minute of dissociation, the percentage of ASGR-1 remaining bound was calculated. The lower the percent remaining at a given time point indicates increased levels of dissociation in response to the test conditions (ie. different pH and/or calcium concentrations). The change in the percentage of ASGR-1 remaining bound in response to each test condition relative to the percent remaining in the control conditions (ie. pH 7.4+calcium) was determined. Cut-offs for an antibody to be categorized as being sensitive to a particular condition were set to >10% (ie. if >10% of the ASGR-1 dissociates from the antibody under a particular test condition compared to control condition, it was deemed sensitive to that condition). The analysis was done using the 1 minute dissociation time point (except for mAb 149A1 which was binned based on the 4 minute dissociation time point). Using this analysis, the ASGR-1-binding, receptor-ligand blocking antibodies were separated into groups according to their dissociation profiles in response to pH and calcium (Table 7.3). Antibodies belonging to each category were observed.

TABLE 7.3 pH and Calcium Sensitivity of ASGR-1-mAb Interactions
pH and Calcium Sensitivity Determination
(% Change Compared to pH 7.4 + Calcium)

| mAb | pH 7.4 minus Calcium | pH 5.6 plus Calcium | pH 5.6 minus Calcium | Calcium sensitive | pH sensitive | pH and calcium sensitive | pH bin |
|---|---|---|---|---|---|---|---|
| 10G6 | 7% | 4% | 15% | N | N | Y | 3 |
| 148E10 | 7% | 19% | 33% | N | Y | Y | 5 |
| 154F4 | 10% | 41% | 67% | N | Y | Y | 5 |

TABLE 7.3-continued pH and Calcium Sensitivity of ASGR-1-mAb Interactions
pH and Calcium Sensitivity Determination
(% Change Compared to pH 7.4 + Calcium)

| mAb | pH 7.4 minus Calcium | pH 5.6 plus Calcium | pH 5.6 minus Calcium | Calcium sensitive | pH sensitive | pH and calcium sensitive | pH bin |
|---|---|---|---|---|---|---|---|
| 159H8 | 6% | 10% | 26% | N | Y | Y | 5 |
| 160B12 | 6% | 8% | 22% | N | N | Y | 3 |
| 175D10 | 4% | −3% | 2% | N | N | N | 2 |
| 177D2 | 3% | 2% | 10% | N | N | Y | 3 |
| 25A4 | 2% | −3% | −1% | N | N | N | 2 |
| 26C4 | 3% | 2% | 2% | N | N | N | 2 |
| 27E7 | 20% | 35% | 46% | Y | Y | Y | 4 |
| 29E2 | 5% | 25% | 38% | N | Y | Y | 5 |
| 29H8 | 2% | −2% | 2% | N | N | N | 2 |
| 31D12 | 10% | 27% | 34% | Y | Y | Y | 4 |
| 32D6 | 26% | 33% | 55% | Y | Y | Y | 4 |
| 45B4 | 4% | 10% | 23% | N | Y | Y | 5 |
| 49F10 | 4% | −2% | 8% | N | N | N | 2 |
| 4A2 | 1% | −3% | 1% | N | N | N | 2 |
| 4B3 | 12% | 33% | 45% | Y | Y | Y | 4 |
| 4H6 | 5% | −1% | 2% | N | N | N | 2 |
| 50D4 | 6% | 0% | 9% | N | N | N | 2 |
| 50G9 | 37% | 62% | 44% | Y | Y | Y | 4 |
| 51E9 | 3% | −5% | 2% | N | N | N | 2 |
| 52G11 | 15% | 1% | 13% | Y | N | Y | 1 |
| 52H1 | 5% | −1% | 10% | N | N | N | 2 |
| 53F2 | 15% | 1% | 13% | Y | N | Y | 1 |
| 53F7 | 9% | 3% | 13% | N | N | Y | 3 |
| 55B1 | 5% | −2% | 4% | N | N | N | 2 |
| 56E5 | 1% | −6% | −1% | N | N | N | 2 |
| 57A7 | 13% | 13% | 29% | Y | Y | Y | 4 |
| 58G11 | 38% | 12% | 51% | Y | Y | Y | 4 |
| 59F2 | 48% | 52% | 74% | Y | Y | Y | 4 |
| 5E5 | 7% | 18% | 42% | N | Y | Y | 5 |
| 60D2 | 20% | 42% | 49% | Y | Y | Y | 4 |
| 60E8 | 3% | 11% | 18% | N | Y | Y | 5 |
| 63A10 | 8% | 3% | 47% | N | N | Y | 3 |
| 63G7 | 20% | 15% | 59% | Y | Y | Y | 4 |
| 64B12 | 6% | 6% | 7% | N | N | N | 2 |
| 65F10 | 25% | 18% | 37% | Y | Y | Y | 4 |
| 68G6 | 22% | 39% | 47% | Y | Y | Y | 4 |
| 6D9 | 14% | 25% | 42% | Y | Y | Y | 4 |
| 6G6 | 1% | −3% | 0% | N | N | N | 2 |
| 70D1 | 17% | 12% | 29% | Y | Y | Y | 4 |
| 7E11 | 9% | 5% | 14% | N | N | Y | 3 |
| 7F4 | 4% | 6% | 9% | N | N | N | 2 |
| 7G4 | 2% | 1% | 7% | N | N | N | 2 |
| 9G9 | 25% | 38% | 55% | Y | Y | Y | 4 |
| 65E9 | 22% | 30% | 35% | Y | Y | Y | 4 |
| 72B4 | 32% | 26% | 43% | Y | Y | Y | 4 |
| 147D10 | 13% | 4% | 11% | Y | N | Y | 1 |
| 149D11 | 11% | 3% | 11% | Y | N | Y | 1 |
| 149F8 | 1% | −8% | −1% | N | N | N | 2 |
| 22G5 | 40% | 35% | No Data | Y | Y | No Data | 4* |
| 48B12 | 4% | −6% | 0% | N | N | N | 2 |
| 52H2 | 26% | 11% | 32% | Y | Y | Y | 4 |
| 6G7 | 8% | 4% | 16% | N | N | Y | 3 |
| 64G12 | 24% | 10% | 24% | Y | N | Y | 1 |
| 72F5 | 64% | 20% | 30% | Y | Y | Y | 4 |
| 147E9 | 5% | −4% | 20% | N | N | Y | 3 |
| 184E7 | 1% | −9% | −3% | N | N | N | 2 |
| 194A4 | −1% | −7% | −3% | N | N | N | 2 |
| 208A2 | −4% | −10% | −5% | N | N | N | 2 |
| 210G10 | −3% | −10% | −5% | N | N | N | 2 |
| 4B1 | 6% | −5% | −2% | N | N | N | 2 |
| 62H10 | 13% | −2% | 14% | Y | N | Y | 1 |
| 72G9 | 1% | −7% | −1% | N | N | N | 2 |
| 148H10 | 45% | 10% | 47% | Y | N | Y | 1 |
| 173C11 | 17% | 0% | 29% | Y | N | Y | 1 |
| 179C2 | 25% | 0% | 45% | Y | N | Y | 1 |
| 47C1 | 13% | −1% | 10% | Y | N | Y | 1 |
| 49C1 | 72% | 23% | 64% | Y | Y | Y | 4 |
| 60C12 | 14% | −3% | 12% | Y | N | Y | 1 |
| 60G2 | 36% | 7% | 31% | Y | N | Y | 1 |
| 65D5 | 34% | 7% | 61% | Y | N | Y | 1 |
| 66H11 | 81% | 36% | 52% | Y | Y | Y | 4 |
| 73G1 | 100% | 33% | 62% | Y | Y | Y | 4 |

TABLE 7.3-continued pH and Calcium Sensitivity of ASGR-1-mAb Interactions
pH and Calcium Sensitivity Determination
(% Change Compared to pH 7.4 + Calcium)

| mAb | pH 7.4 minus Calcium | pH 5.6 plus Calcium | pH 5.6 minus Calcium | Calcium sensitive | pH sensitive | pH and calcium sensitive | pH bin |
|---|---|---|---|---|---|---|---|
| 51E3 | 65% | 16% | 42% | Y | Y | Y | 4 |
| 53E8 | 68% | 20% | 64% | Y | Y | Y | 4 |
| 54E9 | 79% | 24% | 75% | Y | Y | Y | 4 |
| 56E3 | 75% | 21% | 16% | Y | Y | Y | 4 |
| 190C11 | −1% | −6% | −6% | N | N | N | 2 |
| 190E6 | −1% | −12% | −6% | N | N | N | 2 |
| 190F12 | −1% | −6% | −6% | N | N | N | 2 |
| 190F8 | −1% | −5% | −5% | N | N | N | 2 |
| 190G11 | −2% | −8% | −5% | N | N | N | 2 |
| 190H9 | −1% | −6% | −7% | N | N | N | 2 |
| 191A10 | 0% | −5% | −5% | N | N | N | 2 |
| 191G1 | −10% | −15% | −11% | N | N | N | 2 |
| 191G10 | 0% | −5% | −5% | N | N | N | 2 |
| 191G12 | −2% | −5% | −6% | N | N | N | 2 |
| 192C10 | −1% | −6% | −6% | N | N | N | 2 |
| 192C8 | −9% | −14% | −14% | N | N | N | 2 |
| 192E4 | −2% | −9% | −8% | N | N | N | 2 |
| 192G6 | −1% | −6% | −6% | N | N | N | 2 |
| 192G8 | −1% | −5% | −6% | N | N | N | 2 |
| 192H10 | 0% | −5% | −4% | N | N | N | 2 |
| 193C7 | −1% | −8% | −8% | N | N | N | 2 |
| 194B7 | 1% | −4% | −4% | N | N | N | 2 |
| 194C1 | −7% | −12% | −8% | N | N | N | 2 |
| 196C7 | −8% | −12% | −12% | N | N | N | 2 |
| 197B6 | −1% | −8% | −7% | N | N | N | 2 |
| 197E11 | −1% | −5% | −4% | N | N | N | 2 |
| 197F2 | 0% | −6% | −6% | N | N | N | 2 |
| 197G3 | 2% | −3% | −3% | N | N | N | 2 |
| 198G3 | −1% | −4% | −4% | N | N | N | 2 |
| 213B3 | −1% | −7% | −3% | N | N | N | 2 |
| 219H1 | 2% | −3% | 1% | N | N | N | 2 |
| 74C8 | 1% | −7% | −3% | N | N | N | 2 |
| 74G6 | 1% | −9% | −4% | N | N | N | 2 |
| 75G3 | −1% | −1% | 2% | N | N | N | 2 |
| 74B2 | 8% | −9% | −5% | N | N | N | 2 |
| 74H7 | 1% | −2% | 1% | N | N | N | 2 |
| 85F7 | 2% | −2% | 2% | N | N | N | 2 |
| 198B9 | 3% | 2% | 11% | N | N | Y | 3 |
| 199A7 | 1% | 1% | 10% | N | N | Y | 3 |
| 218G4 | 1% | −4% | 0% | N | N | N | 2 |
| 146A8 | 2% | −9% | 25% | N | N | Y | 3 |
| 146B6 | 2% | −5% | 13% | N | N | Y | 3 |
| 149A1 | 2% | −7% | 9% | N | N | Y | 3* |
| 172B12 | −14% | −27% | −13% | N | N | N | 2 |
| 172C3 | −9% | −26% | 0% | N | N | N | 2 |
| 193E7 | −9% | −9% | −4% | N | N | N | 2 |
| 199E3 | −5% | −4% | −4% | N | N | N | 2 |
| 226F9 | 100% | 51% | 77% | Y | Y | Y | 4 |
| 227C1 | 100% | 54% | 73% | Y | Y | Y | 4 |
| 227F2 | 80% | 50% | 100% | Y | Y | Y | 4 |
| 65C12 | 13% | 0% | 23% | Y | N | Y | 1 |
| 176H4 | 2% | −4% | 26% | N | N | Y | 3 |
| 194C10 | 2% | 10% | 16% | N | Y | Y | 5 |
| 191E10 | −1% | −9% | −9% | N | N | N | 2 |
| 196F4 | −8% | −5% | −6% | N | N | N | 2 |
| 198D2 | −8% | −30% | −28% | N | N | N | 2 |
| 202A3 | −21% | −22% | −23% | N | N | N | 2 |
| 204G6 | −5% | −11% | −10% | N | N | N | 2 |
| 224G1 | 77% | 41% | 65% | Y | Y | Y | 4 |
| 52D10 | 21% | 3% | 45% | Y | N | Y | 1 |
| 64E2 | 48% | 29% | 49% | Y | Y | Y | 4 |

*No actual data; bin predicted on the totality of information regarding the antibody.

D. Relative Epitope Binning/Profiling

A common way to characterize epitopes is through competition experiments. Antibodies that compete with each other can be thought of as binding the same or overlapping site on the target. This example describes a method of determining competition for binding to hASGR-1 and the results of the method when applied to a number of antibodies described herein.

Binning experiments can be conducted in a number of ways, and the method employed may have an effect on the assay results. Common to these methods is that ASGR-1 is typically bound by one reference antibody and probed by another. If the reference antibody prevents the binding of the probe antibody then the antibodies are said to be in the same bin. The order in which the antibodies are employed is important. If antibody A is employed as the reference antibody and blocks the binding of antibody B the converse is not always true: antibody B used as the reference antibody will not necessarily block antibody A. There are a number of factors in play here: the binding of an antibody can cause conformational changes in the target which prevent the binding of the second antibody, or epitopes which overlap but do not completely occlude each other may allow for the second antibody to still have enough high-affinity interactions with the target to allow binding. In general, if competition is observed in either order the antibodies are said to bin together, and if both antibodies can block each other then it is likely that the epitopes overlap more completely.

For this example, a modified antibody-antibody competition assay was used to determine the relative epitope binning profiles of the ASGR-1 specific, ligand blocking antibodies in a high throughput manner. Briefly, individual antibodies were tested for their ability to compete for binding with a panel of reference antibodies chosen based on their different binding characteristics (eg. species cross reactivity, HEPG2 binding, etc.) and primary sequences. The pattern of competition/binding of each test antibody with the reference antibody panel was then determined and compared to those produced from the other test antibodies. The degree of correlation between the individual test antibody competition/binding profiles was then compared. Antibodies that showed similar competition/binding profiles were binned (grouped) together (eg. Binning Profile A, B, etc.).

Biotinylated recombinant soluble human ASGR-1 protein was coupled to streptavidin coated, uniquely barcoded LumAvidin Beads® (LumAvidin Microspheres, Cat#L101-LXXX-01; Luminex Corp., Austin, Tex., U.S.A.) for 45 minutes in the dark at room temperature and washed twice. The reference antibody hybridoma supernatant samples were incubated with the antigen-coated beads for 1 hour in the dark at room temperature and washed three times. Beads were resuspended in FACS buffer containing Stabilguard®. The antigen-coated, reference antibody-bound beads were pooled and then divided into individual sample wells containing a normalized (2.5 ug/ml) test antibody (hybridoma supernatant) sample (or negative control), incubated for 1 hour in the dark at room temperature and washed twice. The samples were then incubated with Alexa Fluor® 488 IgG fragment-specific detection antibody for 15 minutes in the dark at room temperature, washed once and resuspended in FACS buffer. FACS buffer supplemented with 1 mM Calcium Chloride was used in all steps. Samples were analyzed using an Intellicyt iQue™ Screener Platform.

To determine the antibody competition/binding profiles of the individual test antibodies, the reference-only antibody binding signal was subtracted from the reference plus test antibody signal for each competition/binding reaction (ie. across the entire reference antibody set). An individual antibody binding profile was defined as the collection of net binding values for each competition/binding reaction. The degree of similarity between individual profiles was then assessed by calculating the coefficient of determination between each of the test antibody profiles. Test antibodies showing high degrees of similarity ($R^2 \geq 0.8$) to each other were then grouped into common binning profiles. Separate binning profiles were only defined if there were two or more samples with a high degree of correlation. If individual unique antibody binning profiles were observed (ie. they displayed a low degree of similarity to other test antibody binding profiles), the bin was classified as unknown. Using this method, the ASGR-1-binding, receptor-ligand blocking antibodies were sub-divided into 14 unique binning profiles (A, B, C, D, E, L, M, N, O, P, Q, R, T and unknown) (Table 7.4). Antibodies that displayed a unique binning profile (as defined above) but shared a relatively high degree of similarity to another profile ($R^2=0.6$-$0.8$) were categorized as a sub-bin (ie. A. 1, A. 2, etc.) of that profile.

TABLE 7.4

Relative Epitope Binning/Profiling of ASGR-1 Specific Receptor-Ligand Blocking mAbs

| mAb | Epitope BIN | mAb | Epitope BIN | mAb | Epitope BIN | mAb | Epitope BIN |
|---|---|---|---|---|---|---|---|
| 10G6 | A | 52H1 | A | 9C11 | A.3 | 60G2 | E |
| 11E2 | A | 53F2 | A | 12B12 | B | 65D5 | E |
| 11F5 | A | 53F7 | A | 147D10 | B | 66H11 | E |
| 12E9 | A | 55B1 | A | 149D11 | B | 71A6 | E |
| 12F11 | A | 56E5 | A | 149F8 | B | 73G1 | E |
| 12F12 | A | 57A7 | A | 151B9 | B | 49C5 | E.1 |
| 13F6 | A | 58G11 | A | 175F4 | B | 49D10 | E.1 |
| 148E10 | A | 59F2 | A | 22G5 | B | 51E3 | E.1 |
| 154F4 | A | 5E5 | A | 48B12 | B | 51F4 | E.1 |
| 159H8 | A | 60D2 | A | 52H2 | B | 53E8 | E.1 |
| 160B12 | A | 60E8 | A | 6G7 | B | 54E9 | E.1 |
| 175D10 | A | 63A10 | A | 7G2 | B | 56E3 | E.1 |
| 177D2 | A | 63G7 | A | 64G12 | B.1 | 56G1 | E.1 |
| 25A4 | A | 64B12 | A | 72F5 | B.1 | 190C11 | L |
| 25D12 | A | 65F10 | A | 147E9 | C | 190E6 | L |
| 26C4 | A | 68G6 | A | 184E7 | C | 190F12 | L |
| 27E7 | A | 6A6 | A | 194A4 | C | 190F8 | L |
| 28H2 | A | 6D4 | A | 208A2 | C | 190G11 | L |
| 29E2 | A | 6D9 | A | 210G10 | C | 190H9 | L |
| 29E6 | A | 6G6 | A | 4B1 | C | 191A10 | L |
| 29H8 | A | 70D1 | A | 60E12 | C | 191G1 | L |
| 31D12 | A | 7A10 | A | 61A1 | C | 191G10 | L |
| 32D6 | A | 7C3 | A | 62H10 | C | 191G12 | L |
| 3G7 | A | 7E11 | A | 63H8 | C | 192C10 | L |
| 45B4 | A | 7F4 | A | 72G9 | C | 192C8 | L |
| 49F10 | A | 7F8 | A | 8D8 | D.1 | 192E4 | L |
| 4A2 | A | 7G4 | A | 12D2 | E | 192G6 | L |
| 4B3 | A | 8D12 | A | 148H10 | E | 192G8 | L |
| 4H6 | A | 9F12 | A | 173C11 | E | 192H10 | L |
| 50D4 | A | 9G9 | A | 179C2 | E | 193C7 | L |
| 50G9 | A | 65E9 | A.1 | 47C1 | E | 194B7 | L |
| 51E9 | A | 72B4 | A.1 | 49C1 | E | 194C1 | L |
| 52G11 | A | 7H7 | A.2 | 60C12 | E | 196C7 | L |
| 197B6 | L | 197F2 | L | 198G3 | L | 219H1 | L |
| 197E11 | L | 197G3 | L | 213B3 | L | 74C8 | L |
| 74G6 | L | 74H7 | M.1 | 218G4 | O | 172B12 | Q |
| 75G3 | M | 85F7 | M.1 | 146A8 | P | 172C3 | Q |
| 89A11 | M | 198B9 | N | 146B6 | P | 193E7 | Q |
| 74B2 | M.1 | 199A7 | N | 149A1 | P | 199E3 | Q |
| 226F9 | Q | 227F2 | Q | 176H4 | R | | |
| 227C1 | Q | 65C12 | Q | 194C10 | T | | |

E. Epitope Mapping—Arginine/Glutamic Acid Mutational Profiling

This Example characterizes ASGR-1 antibodies based on the effect of mutagenesis of ASGR-1 on their ability to bind the target. Previous data indicated that the ASGR-1 CBD is primarily responsible for antibody binding for the panel of antibodies. As such, only the ASGR-1 CBD was considered structurally in the context of the full length ASGR-1 in the design of mutation sites.

Arginine/Glutamic acid mutational mapping was used to characterize epitopes bound by human ASGR-1-specific, ligand blocking antibodies. Briefly, 144 individual point mutations were made across the CBD domain of human ASGR-1 protein (SEQ ID NO:5) starting at position 148. Ninety-one constructs, representing surface residues (modelled using the ASGR-1 crystal structure in the PyMOL Molecular Graphics System (Version 1.8; Schrödinger, LLC.)) and therefore potentially accessible for antibody binding, were selected for these assays. Mutant hASGR-1 variants were constructed such that non-arginine residues were changed to arginine and where wild type arginine residues were mutated to glutamic acid. Each mutant hASGR-1 sequence was then cloned into a mammalian expression vector and used to transiently transfect CHOs cells. The ability of human ASGR-1-specific, ligand competing antibodies to bind to the mutant hASGR-1 proteins was assessed by FACS as described above.

Antibodies were tested for binding to the individual mutant and wild type ASGR-1 constructs using normalized antibody concentrations (5 ug/ml). CHO—S cells transiently expressing the appropriate mutated or non-mutated antigen of interest were mixed with antibody sample or controls, incubated for 1 hour at 4° C., and then washed twice. Cells with bound antibody were then incubated with Alexa Fluor® 647 IgG Fc fragment-specific detection antibody and 7-AAD viability stain for 15 minutes at 4° C., washed once and resuspended in FACS buffer. Samples were analyzed using a BD Accuri™ Flow Cytometer and an Intellicyt HyperCyt Autosampler. As a negative control, supernatants and controls were also screened against CHO—S cells transfected with empty parental vector (referred to as mock). In order to exclude mutants that were poorly expressed or produced mis-folded antigen, only constructs that yielded a binding data average of at least 25% or greater compared to the average binding observed on wildtype hASGR-1 was used for further analysis. Because mutant hASGR-1 expression levels varied relative to each other, sample binding data for each construct was normalized for expression by dividing the binding data from an antibody not affected by the mutations (e.g., 65C12) by the binding values of each test antibody on a given mutant construct. Also, because the antibody binding affinities varied amongst the samples, the expression corrected data (above) was further normalized by comparing test antibody binding on each mutant construct to wild type hASGR-1. Identification of specific mutations that affected test antibody binding was performed by an interquartile range (IQR) analysis to determine statistical outliers. A mutation was identified as a "hit" if the calculated values were ≥3× the IQR (above the $3^{rd}$ quartile/upper fence) for a given mutant construct. Although IQR analysis was used here to determine significance and identify hits, one skilled in the art will recognize that a number of methods could be employed in order to normalize the data (eg. using epitope-tagged constructs or other ASGR-1-binding antibodies directed against non-CBD epitopes). Any statistically significant reduction in antibody binding signal to a mutant construct (compared to that determined for binding to wild type ASGR-1) determined by these methods could be used for hit identification.

For illustrative purposes, Table 7.5 shows the IQR analysis with a single mutant construct (i.e., H203).

TABLE 7.5

| | IQR analysis (representative data for construct H203) | | | | | | | |
|---|---|---|---|---|---|---|---|---|
| | FACS Binding Geomean | | Expression Normalization to mAb 65C12 | | Antibody Binding Normalization to wt ASGR1 Binding | | >Q3 + 3xIQR Gating | |
| mAb | wt ASGR1 | H203 | wt ASGR1 | H203 | wt ASGR1 | H203 | wt ASGR1 | H203 |
| 4A2 | 41104 | 18946 | 1.3644 | 1.3597 | 1.0000 | 0.9966 | 1.0000 | 0.9966 |
| 7E11 | 45453 | 14714 | 1.2338 | 1.7509 | 1.0000 | 1.4191 | 1.0000 | 1.4191 |
| 56E5 | 42617 | 20345 | 1.3159 | 1.2662 | 1.0000 | 0.9622 | 1.0000 | 0.9622 |
| 7G4 | 48526 | 18542 | 1.1557 | 1.3893 | 1.0000 | 1.2022 | 1.0000 | 1.2022 |
| 53F7 | 43474 | 18081 | 1.2900 | 1.4248 | 1.0000 | 1.1045 | 1.0000 | 1.1045 |
| 10G6 | 43059 | 18213 | 1.3024 | 1.4145 | 1.0000 | 1.0860 | 1.0000 | 1.0860 |
| 26C4 | 45991 | 13484 | 1.2194 | 1.9105 | 1.0000 | 1.5668 | 1.0000 | 1.5668 |
| 6G6 | 47628 | 20505 | 1.1775 | 1.2564 | 1.0000 | 1.0670 | 1.0000 | 1.0670 |
| 29H8 | 40927 | 13217 | 1.3702 | 1.9491 | 1.0000 | 1.4225 | 1.0000 | 1.4225 |
| 25A4 | 55579 | 20036 | 1.0090 | 1.2858 | 1.0000 | 1.2743 | 1.0000 | 1.2743 |
| 32D6 | 36128 | 13465 | 1.5522 | 1.9132 | 1.0000 | 1.2325 | 1.0000 | 1.2325 |
| 198D2 | 16882 | 7138 | 3.3219 | 3.6090 | 1.0000 | 1.0864 | 1.0000 | 1.0864 |
| 4B3 | 35561 | 1696 | 1.5770 | 15.1900 | 1.0000 | 9.6323 | 1.0000 | 9.6323 |
| 50G9 | 37326 | 1506 | 1.5024 | 17.1095 | 1.0000 | 11.3879 | 1.0000 | 11.3879 |
| 60D2 | 29631 | 1368 | 1.8926 | 18.8256 | 1.0000 | 9.9467 | 1.0000 | 9.9467 |
| 59F2 | 27915 | 1346 | 2.0089 | 19.1372 | 1.0000 | 9.5260 | 1.0000 | 9.5260 |
| 60E8 | 38653 | 1518 | 1.4509 | 16.9692 | 1.0000 | 11.6960 | 1.0000 | 11.6960 |
| 65E9 | 29613 | 1471 | 1.8938 | 17.5097 | 1.0000 | 9.2460 | 1.0000 | 9.2460 |
| 5E5 | 40651 | 12616 | 1.3796 | 2.0420 | 1.0000 | 1.4802 | 1.0000 | 1.4802 |
| 29E2 | 25781 | 15058 | 2.1752 | 1.7108 | 1.0000 | 0.7865 | 1.0000 | 0.7865 |
| 45B4 | 30350 | 14012 | 1.8478 | 1.8385 | 1.0000 | 0.9950 | 1.0000 | 0.9950 |
| 6G7 | 38643 | 15089 | 1.4512 | 1.7073 | 1.0000 | 1.1764 | 1.0000 | 1.1764 |
| 72F5 | 27993 | 10499 | 2.0034 | 2.4537 | 1.0000 | 1.2248 | 1.0000 | 1.2248 |
| 22G5 | 45048 | 15060 | 1.2449 | 1.7105 | 1.0000 | 1.3740 | 1.0000 | 1.3740 |
| 48B12 | 52493 | 20467 | 1.0683 | 1.2587 | 1.0000 | 1.1782 | 1.0000 | 1.1782 |
| 151B9 | 23527 | 9738 | 2.3837 | 2.6454 | 1.0000 | 1.1098 | 1.0000 | 1.1098 |
| 52H2 | 47957 | 18609 | 1.1694 | 1.3843 | 1.0000 | 1.1838 | 1.0000 | 1.1838 |
| 149D11 | 23601 | 8866 | 2.3761 | 2.9055 | 1.0000 | 1.2228 | 1.0000 | 1.2228 |
| 175F4 | 33619 | 14804 | 1.6681 | 1.7401 | 1.0000 | 1.0432 | 1.0000 | 1.0432 |
| 147E9 | 40166 | 21513 | 1.3962 | 1.1975 | 1.0000 | 0.8577 | 1.0000 | 0.8577 |
| 61A1 | 39965 | 20142 | 1.4032 | 1.2790 | 1.0000 | 0.9115 | 1.0000 | 0.9115 |
| 184E7 | 42704 | 18354 | 1.3132 | 1.4036 | 1.0000 | 1.0688 | 1.0000 | 1.0688 |
| 72G9 | 36507 | 18778 | 1.5361 | 1.3719 | 1.0000 | 0.8931 | 1.0000 | 0.8931 |
| 194A4 | 16291 | 12149 | 3.4424 | 2.1204 | 1.0000 | 0.6160 | 1.0000 | 0.6160 |

TABLE 7.5-continued

IQR analysis (representative data for construct H203)

| mAb | FACS Binding Geomean | | Expression Normalization to mAb 65C12 | | Antibody Binding Normalization to wt ASGR1 Binding | | >Q3 + 3xIQR Gating | |
|---|---|---|---|---|---|---|---|---|
| | wt ASGR1 | H203 | wt ASGR1 | H203 | wt ASGR1 | H203 | wt ASGR1 | H203 |
| 60C12 | 31286 | 19812 | 1.7925 | 1.3003 | 1.0000 | 0.7254 | 1.0000 | 0.7254 |
| 173C11 | 28526 | 13861 | 1.9659 | 1.8586 | 1.0000 | 0.9454 | 1.0000 | 0.9454 |
| 56E3 | 33876 | 20425 | 1.6555 | 1.2613 | 1.0000 | 0.7619 | 1.0000 | 0.7619 |
| 54E9 | 38589 | 15344 | 1.4533 | 1.6789 | 1.0000 | 1.1552 | 1.0000 | 1.1552 |
| 65D5 | 41007 | 20291 | 1.3676 | 1.2696 | 1.0000 | 0.9283 | 1.0000 | 0.9283 |
| 190F8 | 36503 | 15073 | 1.5363 | 1.7091 | 1.0000 | 1.1125 | 1.0000 | 1.1125 |
| 198G3 | 21467 | 13143 | 2.6124 | 1.9600 | 1.0000 | 0.7503 | 1.0000 | 0.7503 |
| 191G10 | 33829 | 17045 | 1.6578 | 1.5114 | 1.0000 | 0.9117 | 1.0000 | 0.9117 |
| 202A3 | 24848 | 12497 | 2.2570 | 2.0614 | 1.0000 | 0.9134 | 1.0000 | 0.9134 |
| 194C1 | 20860 | 11044 | 2.6884 | 2.3325 | 1.0000 | 0.8676 | 1.0000 | 0.8676 |
| 176H4 | 33506 | 10237 | 1.6737 | 2.5166 | 1.0000 | 1.5036 | 1.0000 | 1.5036 |
| 197G3 | 13308 | 3503 | 4.2141 | 7.3547 | 1.0000 | 1.7453 | 1.0000 | 1.7453 |
| 191G1 | 25298 | 10876 | 2.2168 | 2.3687 | 1.0000 | 1.0685 | 1.0000 | 1.0685 |
| 213B3 | 15070 | 12846 | 3.7212 | 2.0054 | 1.0000 | 0.5389 | 1.0000 | 0.5389 |
| 218G4 | 12212 | 7933 | 4.5923 | 3.2472 | 1.0000 | 0.7071 | 1.0000 | 0.7071 |
| 75G3 | 37223 | 14472 | 1.5066 | 1.7801 | 1.0000 | 1.1815 | 1.0000 | 1.1815 |
| 194C10 | 28138 | 13217 | 1.9930 | 1.9491 | 1.0000 | 0.9780 | 1.0000 | 0.9780 |
| 85F7 | 32968 | 16509 | 1.7010 | 1.5605 | 1.0000 | 0.9174 | 1.0000 | 0.9174 |
| 199A7 | 17005 | 9455 | 3.2978 | 2.7247 | 1.0000 | 0.8262 | 1.0000 | 0.8262 |
| 146B6 | 24138 | 14412 | 2.3233 | 1.7875 | 1.0000 | 0.7694 | 1.0000 | 0.7694 |
| 193E7 | 35508 | 13783 | 1.5794 | 1.8691 | 1.0000 | 1.1835 | 1.0000 | 1.1835 |
| 65C12 | 56080 | 25761 | 1.0000 | 1.0000 | 1.0000 | 1.0000 | 1.0000 | 1.0000 |

The bolded, underlined, and italicized values for antibodies 4B3, 50G9, 60D2, 59F2, 60E8, and 65E9 in Table 7.5 represent the statistically significant hits (i.e., ≥3× the IQR) whose binding was affected by mutations H203.

A summary of the hASGR-1 residues important for binding of the representative antibodies is shown in (FIG. 60, labeled as Table 7.6 in the figure). In addition, this analysis revealed that the mutation of some ASGR-1 residues had more dramatic effects on a given antibody binding than others. This likely reflects the relative contribution or importance that these residues have in mediating interactions with specific test antibodies. The degree by which each mutation impacted the ability of a test antibody to bind was determined by calculating the magnitude of an individual binding data point above the upper gate determined by each IQR analysis. The relative impact of each mutation on the binding of a given test antibody was then ranked using this method and displayed as a heatmap in FIG. 60. Dark grey shading indicates the data point deviated dramatically from the upper gate (ie. a large effect on antibody binding), while light grey/white shading indicates the data point was very close to the cut offs (ie. 3× the IQR) (FIG. 60). When aligned with the relative epitope profiling bin assignments (Example 7D above), this analysis reveals a set of core ASGR-1 amino acid positions that, when mutated, disrupt test antibody binding. As such, these positions are likely part of the ASGR-1 epitopes bound by the selected antibodies. These amino acid residues either directly contact or are involved in the interaction with the antibody, or are in close enough proximity that, when mutated, interfere with antibody binding. Amino acid positions identified as statistically significant hits, but barely made the cut offs, and map to surface ASGR-1 locations distinct from the main epitope bins (FIG. 47) may represent residues that, when mutated, disrupt the conformation of ASGR-1 such that an antibody that binds to a distinct epitope is affected (ie. an indirect effect). mAb 197G3 is an example of an antibody displaying a range of binding sensitivities in this assay, yet the most important residues (R274 and R271) can be identified by rank ordering them as described.

In order to compare the mutational hit patterns of the individual test antibodies with each other, the coefficient of determination between the test antibodies was determined. The expression and antibody binding normalized data set was used to generate binding profiles for each test antibody across the mutant panel. The resulting profiles for each individual test antibody were then compared for their degree of similarity to all of the other test antibodies. The coefficient of determination ($R^2$) for each combination was determined and converted into a heat map in order to visualize the resulting patterns (FIG. 46). For simplicity, a representative antibody from each unique mutational profile (Reference Antibody) is shown in FIG. 46. This analysis revealed 7 predominant hit patterns or mutational clusters. Test antibodies affected by the 7 predominant mutational clusters correspond to those from competition/binding binning profiles A, B, C, E and L (3 distinct hit/mutational clusters of bin A antibodies and 1 distinct hit/mutational cluster of bin B, bin C, bin E and bin L antibodies). The remaining antibodies, categorized as displaying separate binning profiles (compared to bins A, B, C, E and L), are affected by distinct mutations in ASGR-1, but also include residues that partially overlap with test antibodies belonging to the predominant bins.

This data indicates the selected antibodies bind to epitopes that partially overlap with the 7 predominant epitope regions. The residues important for the binding of antibodies belonging to the 7 predominant epitope regions were then mapped onto a computer representation of the surface of the ASGR-1 structure using the PyMOL Molecular Graphics System (Version 1.8; Schrödinger, LLC.) (FIG. 47). A residue on the surface of ASGR-1 was considered part of the same epitope region if at least one antibody from a distinct binning profile (ie. A, B, C, E and L) was identified as being sensitive to mutation. For example, the predominant epitope region for antibodies belonging to binning profile C includes hASGR-1 residues P241, D242, D243, Y245, G251 and E253 (SEQ ID NO:5). The binding of antibody 147E9 is affected by mutation of all of these residues, while antibody 184E7 is only disrupted by mutation of P241, D243 and E253. Thus, the predominant epitope region of ASGR-1 bound by antibodies belonging to binning profile C is defined as including one or more of (but not limited to) P241, D242, D243, Y245, G251 and E253 (SEQ ID NO:5). Also, note that the antibody 194A4 was classified as belonging to Bin C as determined in Example 7D, however, the results of this arginine/glutamic acid mutational profiling (as well as the results from crystal structure analysis of the ASGR-1 CBD/194A4 complex described in Example 10H) suggests that the relative epitope profiling may have been inaccurate.

Figure 46:
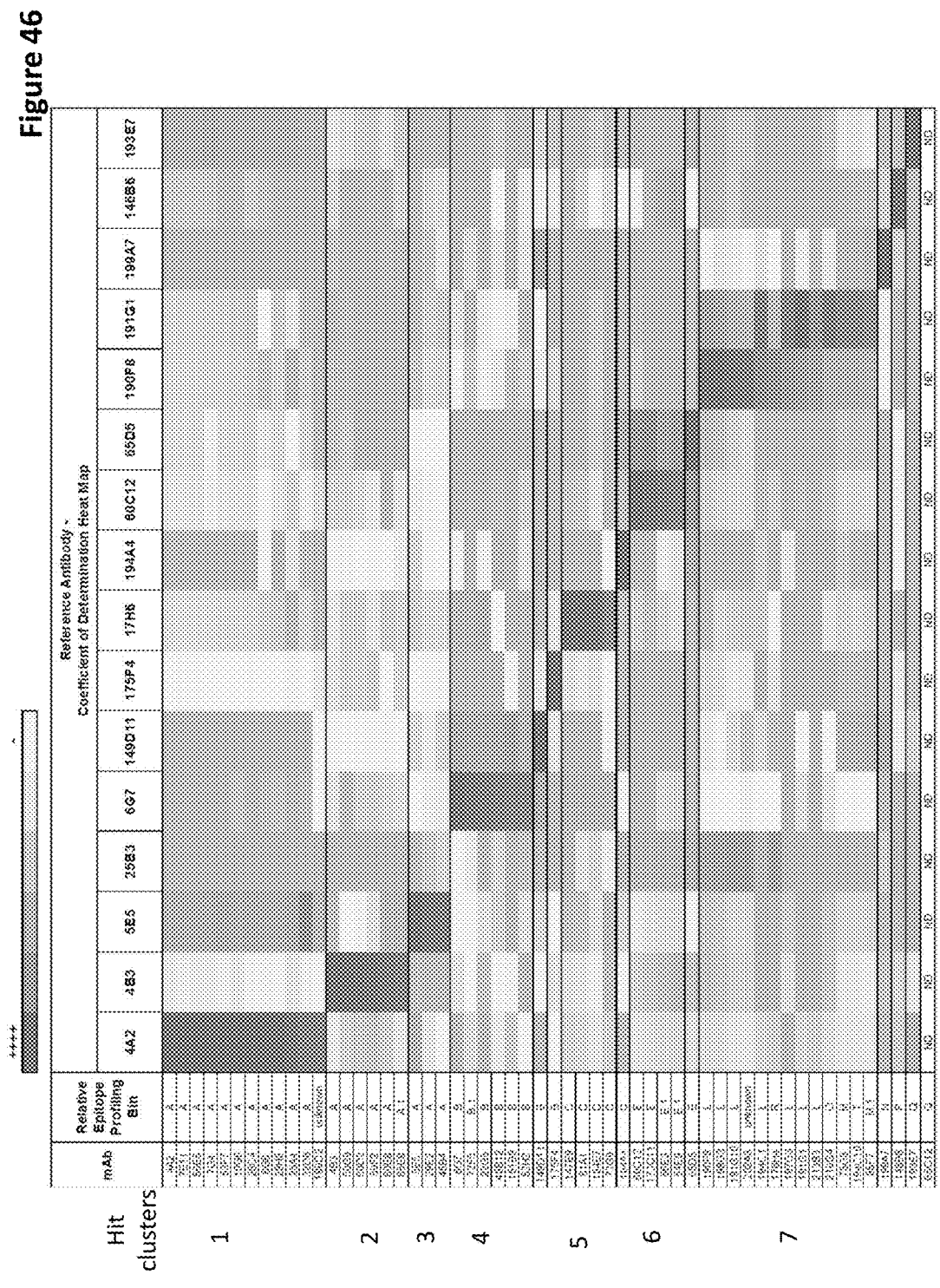
FIG. 46. A coefficient of determination heat map representing the coefficient of determination profiles of test ASGR-1 ligand blocking antibody-reference antibody combinations from an Arginine/Glutamic Acid scanning mutagenesis (Example 7E). Dark shading represents highly similar data, while light shading represents highly dissimilar data. The relative epitope profiling (antibody competition/binding) bin assignments are also indicated.
Figure 47:
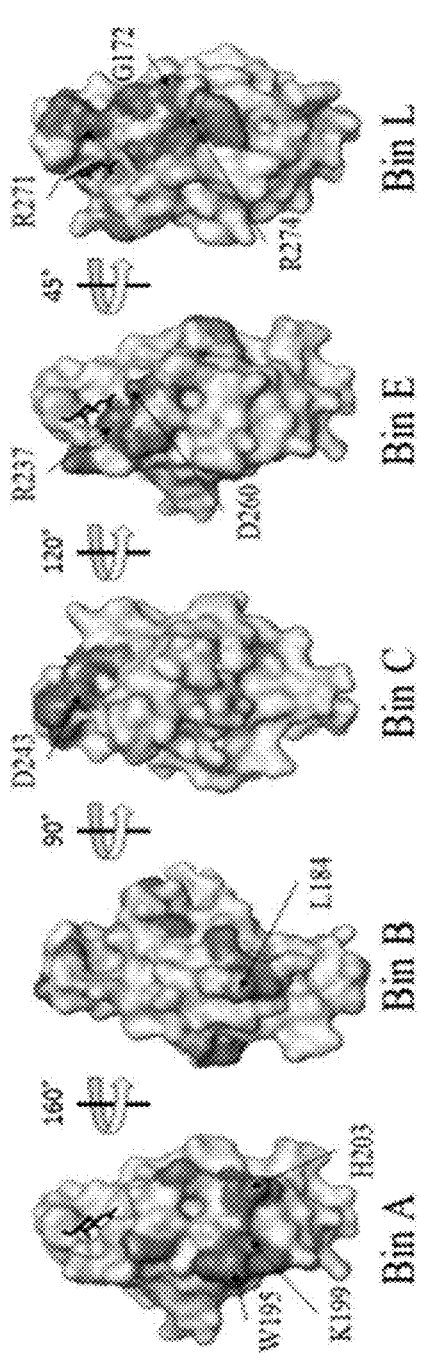
FIG. 47. A computer representation showing alternative views of the ASGR-1 CBD protein and the surface locations of amino acid residues identified as being important for antibody binding via Arginine/Glutamic Acid scanning mutagenesis (Example 7E). The relative epitope profiling (antibody competition/binding) bin assignments are also indicated. Ligand (GalNAc) is shown as a stick representation (black). The ASGR-1 CBD is shown as a surface representation (light grey). The positions of amino acids identified by Arg/Glu mutational scanning are indicated (dark grey surface). The relative positions of key amino acids in each bin are shown for reference only.

Antibodies belonging to binning profile A were further sub-divided into 3 distinct mutational clusters. These clusters mapped to ASGR-1 surface positions that overlap with, or are in extremely close physical proximity to, each other consistent with a common binning profile. Antibodies that displayed binning profiles distinct from the 5 major bins (i.e., A, B, C, E and L) also showed distinct patterns of mutations that affected their binding (FIG. 46). Some binning profiles (R, O, M, M. 1 and T) share significant overlap with antibodies from binning profile L, and can be considered sub-bins of this profile. Taken together, this data indicates that antibodies capable of blocking ASGR-1-ligand interactions bind to 5 major epitope regions. In addition, blocking antibodies were identified that bind to partially overlapping epitopes of these major regions.

Example 8: ASGR Internalization Assay

To determine whether the antibodies bind and also prevent internalization of ASGR-1 into cells expressing ASGR-1, an in vitro internalization assay is performed of various antibody samples.
Human ASGR-1 Internalization Cellular Imaging Assay Protocol
Reagents:
U2OS (Human Osteosarcoma) cell line
McCoy's 5A Medium: Gibco, #16600-082
MEM NEAA (100×): Gibco, #11140-050
Penicillin-Streptomycin (10,000 U/ml, 100×) Gibco, #15140-122
L-Glutamine (100×): Gibco, #25030-081
Fetal Bovine Serum: Gibco, #16000-044
DPBS (without Ca and Mg): Gibco, #14190-136
DPBS (with Ca and Mg): Gibco, #14040-133
Cell Dissociation Buffer: Gibco, #13151-014
1 Liter Filter: Corning, #430517
Hepes Buffer (1M): Gibco, #15630-080
BacMam Virus—huASGR-1: GS: SNAP26f
β-GalNAc-PAA-Biotin: GlycoTech, #01-011
SNAP-Surface Alexa Fluor 546: New England Biolabs, #S9132S
Streptavidin-Alexa Fluor 633: Life Technologies, #S21375
Hoechst 33342: Invitrogen, #H3570
Pitstop2: abcam Biochemical, #ab120687
Pitstop2—negative control: abcam Biochemical, #ab120688
Paraformaldehyde (8% Aqueous Solution): Electron Microscopy Sciences, #157-8-100
Imaging plate—96 well Optical Bottom: Thermo Scientific Nunc, #165305
Operetta High Content Imager: Perkin Elmer U2OS Complete Growth Medium:
McCoy's 5A with 10% FBS, 1×MEM NEAA, 1XL-Glutamine, and 1× Penicillin-Streptomycin
Medium was filtered before use on cells
U2OS Cell Plating and Culturing:
U2OS cells were grown to 75-85% confluence in T175 before plating into a 96 well plate.
1. The U2OS culture medium was aspirated off the cells in the T175 flask
2. Cells were washed with 10 mls of DPBS and aspirated off
3. 3 mls of Cell Dissociation Buffer was added to the cells and incubated for 5 minutes inside a cell incubator (37° C., 5% CO2) to detach the cells from the T175 flask.
4. The detached cells were diluted with 7 mls of the growth medium
5. 1 ml of cells were used to count the number of cells available to plate
6. The cells were diluted in growth medium to give a final concentration of 28,000 cells/well and BacMam virus (huASGR-1: GS: SNAP26f) was also added to the cells at this time with the desired concentration (MOI).
7. The cells were mixed together with the BacMam virus for 1-2 minutes and then plated on the 96 well imaging plate at a volume of 100 ul/well.
8. The plate was placed inside an incubator (37° C., 5% CO2) for 16-20 hours before treatment.
Treatment of Cells (16-20 Hours Incubation)
1. The next day, the medium on the 96 well plate was dumped out and washed once with DPBS.
2. McCoy's 5A Medium plus 10 mM of Hepes buffer (assay buffer) was added to the cells (100 ul) for 1 hour inside the incubator.
3. After the 1 hour incubation, the medium was dumped out and washed once with DPBS containing Ca and Mg.
4. Pitstop2 and Pitstop2 negative control were prepared in assay buffer at 20 uM.
5. Volume of 100 ul per well of the inhibitors were added to the U2OS cells for 15 minutes inside the incubator.
6. GalNAc-biotin (100 nM) and strepavidin-Alexa633 (100 nM) were pre-mixed in assay buffer and incubated for 10 minutes at room temperature.
7. SNAP-Surface Alexa Fluor 546 (2.5 uM) was prepared in assay buffer.
8. After the 15 minutes incubation, both GalNAc-biotin-strepavidin-Alexa633 and SNAP-Surface Alexa Fluor 546 were directly added (10 ul) to the medium containing Pitstop2 inhibitors for 30 minutes inside the incubator.
9. After the 30 minutes incubation, medium was dumped out and the cells were washed once with DPBS.
10. The cells were fixed by adding 50 ul of 4% Paraformaldehyde (8% paraformaldehyde was diluted with DPBS) containing Hoechst dye (1:5000 dilution) to the cells for 10 minutes at room temperature.
11. After 10 minutes incubation, the cells were washed twice with DPBS and 100 ul of DPBS was added to each well.
12. The plate was imaged on the Operetta instrument with three channels measuring the different fluorescence dyes.
1) Hoechst was measured using filters in the range of excitation: 360-400 nm and emission: 410-480 nm
2) GalNAc-biotin-strepavidin-Alexa633 was measured using filters in the range of excitation: 600-630 nm and emission: 640-680 nm
3) SNAP-Surface Alexa Fluor 546 was measured using filters in the range of excitation: 520-550 nm and emission: 560-630

13. Harmony 3.5 software (Perkin Elmer) was used to identify and quantify internalized spots for fluorescence dyes added in the assay.

This internalization assay can be performed to assay the antigen binding proteins of the invention to determine how much they reduce or inhibit internalization of ASGR, ASGR-1, and/or ASGR-2.

Example 9: Additional Ligand Blocking Assays

Preparation of Desialated Protein Ligands (Asialofetuin and Orosomucoid)

A. Asialofetuin

Bovine fetuin (AHSG) was obtained commercially (Sigma) and purified using a CaptoQ Impres (GE Healthcare Life Sciences) matrix. Briefly, the material was loaded in 25 mM TRIS pH 7.9 at up to 17 mg/ml resin, resolved in 20 mM BisTRIS (pH6.5) with a gradient of sodium chloride. The main peak was gradient pooled (~0.15M NaCl final) and resolved on a SuperDex200 SEC (GE Healthcare Life Sciences) in Hepes-buffered saline (pH 7.9). The purified AHSG was then concentrated and incubated with Innolink Biotin 354S (EMD Millipore) according to the manufacturer's instructions. The biotinylated protein was then desalted by gel filtration and concentrated once again.

The purified, biotinylated protein was subsequently desialated by incubation with *C. perfringens* neuraminidase (Sigma; 1 unit/10 mg protein for 12 hours at 37° C. in 50 mM sodium phosphate, 9 mM HEPES, 0.12M NaCl, pH6). The resulting material was harvested and digested for an additional 3 hours with *A. ureafaciens* neuraminidase (QAbio; 0.5 units/10 mg protein at 37° C.). The digested sample was diluted 3 fold with 20 mM HEPES containing 0.15M NaCl (pH 7.5) (HBS) to neutral pH and applied to a monomeric Avidin agarose (Pierce) HR16/10 column, run at 60 cm/hour. The loaded column was held for 15 minutes then washed with four column volumes of HBS. The biotinylated, desialated protein was finally eluted with three column volumes of HBS containing 2 mM Biotin plus an additional two column volumes of 0.1M Glycine-HCl (pH 2.8), which was immediately neutralized during collection with 50 mM TRIS Base). Protein-containing fractions from both types of elutions were identified, pooled, concentrated, dialyzed extensively against 10 mM HEPES, 0.14M NaCl (pH 7.5), re-concentrated and finally filtered sterilized. The purified lots were then analyzed by SDS-PAGE and mass spectrometry prior to use in the described assays.

B. Orosomucoid

Bovine orosomucoid (AGP) was obtained commercially (Sigma) and purified over SuperDex200 resin equilibrated in HBS (pH7.9) by size exclusion chromatography. The front of the main AGP peak was combined from 3 individual runs to generate hyperglycosylated AGP, with the remainder of the main peaks (from the 3 combined runs) to generate hypoglycosylated AGP. For biotinylation, the purified AGP was concentrated to 5 mg/ml and incubated with Innolink Biotin 354S as described. The biotinylated protein was then desalted by gel filtration and concentrated.

After biotinylation, the protein was desialated by incubating it for 18 hours at 37° C. with one unit of *C. perfringens* neuraminidase (Sigma) per 10 mg protein in 50 mM sodium phosphate, 9 mM HEPES, 0.12M NaCl (pH6). The resulting material was harvested and digested for an additional 6 hours at 37° C. with 0.5 units *A. ureafaciens* neuraminidase (QAbio) per 10 mg protein. The sample was diluted 3 fold with HBS to achieve a neutral pH and applied to a monomeric Avidin agarose (Pierce) HR16/10 column, run at 60 cm/hour. The loaded column was held for 15 minutes and then washed with four column volumes of HBS. The biotinylated, desialated protein was subsequently eluted with three column volumes of HBS containing 2 mM Biotin, plus two column volumes 0.1M Glycine-HCl (pH 2.8), which was immediately neutralized during collection with 50 mM TRIS Base. Protein-containing fractions from both types of elutions were identified, pooled, concentrated, dialyzed extensively against 10 mM HEPES, 0.14M NaCl (pH 7.5), re-concentrated and finally filtered sterilized. The purified lots were then analyzed by SDS-PAGE and mass spectrometry prior to use in the described assays.

These ligands can be used in additional ligand binding assays to determine antigen binding protein inhibition of ligand binding to ASGR, ASGR-1 and/or ASGR-2.

Example 10: Crystal Stucture Analysis of Interaction Between Ligands and ASGR-1 and Antibodies and ASGR-1

A. Crystal Structures of ASGR-1 Carbohydrate Binding Domain with Ligand Bound

Introduction

The crystal structure of ligand free ASGR-1 CBD (carbohydrate binding domain) has been previously described (1). Protein expression of ASGR-1 CBD (SEQ ID NO:5), purification and crystallization was performed similar to the published method, however the structures described here differ from the published crystal structure. Analysis of these structures shows extra N- and C-terminal amino acids compared to the published structure, how various ligands interact with the ASGR-1 carbohydrate binding domain, and possible selectivity determinants between ASGR-1/ASGR-2 for various saccharides.

Results

Lactose Binds in the Carbohydrate Binding Pocket of ASGR-1

Protein crystals of the ASGR-1/Lactose complex were grown and the crystal structure was determined at 2.05 Å. Although a method similar to that of the published structure was followed, clear electron density is present for the lactose disaccharide in the carbohydrate binding pocket. See FIGS. 18A and 18B. In this structure, the galactose ring of the lactose disaccharide sits on top of the calcium ion at the carbohydrate binding domain and forms the majority of the contacts with the ASGR-1 protein. Hydrogen bonds are formed between lactose and ASGR-1 amino acids Q240, D242, E253, and N265. Additionally, van der Waals interactions are formed with at least W244 (SEQ ID NO:5). See FIG. 18C.

Analysis of the crystal structure identifies specific amino acids involved in the interaction between ASGR-1 and lactose. Interacting with at least these amino acids by an alternate molecule can completely or partially affect the interaction between ASGR-1 and lactose.

ASGR-1/Lactose Analysis (Distances Below were Calculated with PyMOL):

Amino acids with at least one non-hydrogen atom 4.5 Å or less to the bound lactose molecule were identified and include: Q240, D242, W244, E253, N265, D266, D267 (SEQ ID NO:5).

Amino acids with at least one non-hydrogen atom 5 Å or less to the bound lactose molecule were identified and include: Q240, D242, W244, E253, N265, D266, D267 (SEQ ID NO:5).

Amino acids with at least one non-hydrogen atom 5-8 Å from the bound lactose molecule were identified and include: N209, R237, P238, E239, P241, D243, Y245, G246, H247, G252, C255, H257, T259, D260, V268, R271, Y273 (SEQ ID NO:5).

Galactose Binds in the Carbohydrate Binding Pocket of ASGR-1 Similar to Lactose

Protein crystals of the ASGR-1/Galactose complex were grown and the crystal structure was determined at 2.4 Å. Although a method similar to that of the published structure was followed, clear electron density is present for the galactose saccharide in the carbohydrate binding domain. See FIGS. 19A and 19B.

In this structure, galactose sits on top of the calcium ion at the carbohydrate binding site and forms contacts with the ASGR-1 protein. Hydrogen bonds are formed between galactose and ASGR-1 amino acids Q240, D242, E253, and N265 (SEQ ID NO:5). Additionally, van der Waals interactions are formed with at least W244. See FIG. 19C.

Analysis of the crystal structure identifies specific amino acids involved in the interaction between ASGR-1 and galactose. Interacting with at least these amino acids by an alternate molecule may completely or partially affect the interaction between ASGR-1 and galactose. Distances below were calculated with PyMOL.

ASGR-1/Galactose Analysis (Distances Below were Calculated with PyMOL):

Amino acids with at least one non-hydrogen atom 4.5 Å or less to the bound galactose molecule were identified and include: R237, Q240, D242, W244, E253, N265, D266, D267 (SEQ ID NO:5). Amino acids with at least one non-hydrogen atom 5 Å or less to the bound lactose molecule were identified and include: R237, Q240, D242, W244, E253, N265, D266, D267 (SEQ ID NO:5).

Amino acids with at least one non-hydrogen atom 5-8 Å from the bound lactose molecule were identified and include: N209, P238, E239, P241, D243, Y245, G246, H247, G252, C255, H257, T259, V268, R271, Y273 (SEQ ID NO:5).

When comparing the ASGR-1/Lactose and ASGR-1/Galactose structures, the galactose rings of each saccharide superimpose very well. One difference in the proteins in the two structures is the conformation of R237, an amino acid in close proximity to the carbohydrate binding site. In the superimposition shown in FIG. 20, the ASGR-1/Lactose structure is shown in white and the ASGR-1/Galactose structure is shown in black.

N-Acetyl-D-Galactosamine (GalNAc) Binds in the Carbohydrate Binding Pocket of ASGR-1 Similar to Galactose, Buts Forms Additional Interactions Protein crystals of the ASGR-1/GalNAc complex were grown and the crystal structure was determined at 2.2 Å. Although a method similar to that of the published structure was followed, clear electron density is present for the GalNAc saccharide in the carbohydrate binding pocket. See FIG. 21A and FIG. 21B.

In this structure, GalNAc sits on top of the calcium ion at the carbohydrate binding site and forms contacts with the ASGR-1 protein. Hydrogen bonds are formed between GalNAc and ASGR-1 amino acids Q240, D242, E253, and N265. Additionally, van der Waals interactions are formed with at least W244. In this structure, R237 is in a similar conformation as observed in the galactose complex. However, in this case hydrogen bonds are formed between R237 and the acetyl of GalNAc. These additional interactions with R237 help explain both the observed tighter binding of GalNAc (than galactose) to ASGR-1, and the tighter binding to GalNAc to ASGR-1 (than ASGR-2, in which this amino acid is Ala rather than Arg). See FIG. 21C ASGR-1/GalNAc Analysis (Distances were Calculated with PyMOL):

Analysis of the crystal structure identifies specific amino acids involved in the interaction between ASGR-1 and GalNAc. Interacting with at least one of these amino acids by an alternate molecule may completely or partially inhibit the interaction between ASGR-1 and GalNAc.

Amino acids with at least one atom 4.5 Å or less to the bound GalNAc molecule were identified and include: N209, R237, Q240, D242, W244W244, E253, H257, T259, N265, D266, D267, Y273 (SEQ ID NO:5). Amino acids with at least one non-hydrogen atom 5 Å or less to the bound lactose molecule were identified and include: N209, R237, Q240, D242, W244, E253, H257, T259, N265, D266, D267, Y273 (SEQ ID NO:5).

Amino acids with at least one non-hydrogen atom 5-8 Å from the bound lactose molecule were identified and include: P238, E239, P241, D243, Y245, G246, H247, G252, C255, F258, D260, R263, W264, V268, R271 (SEQ ID NO:5).

The coordinates for the ASGR-1 CBD/GalNAc crystal structure complex are presented in Table 10.1.

Methods

ASGR-1 Expression and Purification

For all crystallography experiments in Example 12, Human ASGR-1 CBD protein (SEQ ID NO:5) was expressed in E. coli and refolded and purified.

ASGR-1 Crystallization

Purified human ASGR-1 CBD (148-291) protein was concentrated to 8-12 mg/ml. ASGR-1/carbohydrate complex crystals grow in 0.1 M sodium cacodylate pH 6.8, 0.08 M ammonium sulfate, 21-23% PEG 8000 in the presence of 20 mM ligand (lactose, galactose or GalNAc).

Data Collection and Structure Determination

Datasets for ASGR-1 CBD complexes were collected on a Rigaku FR-E X-ray source (ASGR-1/Lactose and ASGR-1/Galactose) or at Berkeley Advanced Light Source beamline 5.0.2 (ASGR-1/GalNAc). All datasets were processed with iMosflm(2) and scaled with AIMLESS(3) from the CCP4 program suite(4).

ASGR-1/Lactose crystals grow in the C2 space group with unit cell dimensions a=113.5, b=32.3, c=40.4 Å, β=92.3° with one complex molecule per asymmetric unit, and diffract to 2.05 Å resolution. The ASGR-1 structure was solved by molecular replacement with the program PHASER(5) using the published ASGR-1 structure(1) as the starting search model. The structure was improved with multiple rounds of model building with Coot(6) and refinement with PHENIX(7). The refined structure has R=18.9 and $R_{free}$=24.4.

ASGR-1/Galactose crystals grow in the C2 space group with unit cell dimensions a=113.1, b=32.7, c=40.7 Å, β=91.6° with one complex molecule per asymmetric unit, and diffract to 2.4 Å resolution. The ASGR-1/Lactose structure was used as the starting molecule for molecular replacement, and model building and refinement were performed as described for the ASGR-1/Lactose complex to R=15.8 and $R_{free}$=22.9.

ASGR-1/GalNAc crystals grow in the C2 space group with unit cell dimensions a=112.7, b=32.3, c=40.5 Å, β=91.7° with one complex molecule per asymmetric unit, and diffract to 2.2 Å resolution. The ASGR-1/Lactose structure was used as the starting molecule for molecular replacement, and model building and refinement were performed as described for the ASGR-1/Lactose complex to R=16.5 and $R_{free}$=23.0.

Structure analysis and distance calculations were performed with the program PyMOL(8).

References

1. Meier, M., Bider, M. D., Malashkevich, V. N., Spiess, M., and Burkhard, P. (2000) Crystal structure of the carbohydrate recognition domain of the H1 subunit of the asialoglycoprotein receptor. Journal of molecular biology 300, 857-865
2. Battye, T. G., Kontogiannis, L., Johnson, O., Powell, H. R., and Leslie, A. G. (2011) iMOSFLM: a new graphical interface for diffraction-image processing with MOSFLM. Acta crystallographica 67, 271-281
3. Evans, P. (2006) Scaling and assessment of data quality. Acta crystallographica 62, 72-82
4. CCP4. (1994) The CCP4 suite: programs for protein crystallography. Acta crystallographica 50, 760-763
5. McCoy, A. J., Grosse-Kunstleve, R. W., Adams, P. D., Winn, M. D., Storoni, L. C., and Read, R. J. (2007) Phaser crystallographic software. Journal of applied crystallography 40, 658-674
6. Emsley, P., Lohkamp, B., Scott, W. G., and Cowtan, K. (2010) Features and development of Coot. Acta crystallographica 66, 486-501
7. Adams, P. D., Afonine, P. V., Bunkoczi, G., Chen, V. B., Davis, I. W., Echols, N., Headd, J. J., Hung, L. W., Kapral, G. J., Grosse-Kunstleve, R. W., McCoy, A. J., Moriarty, N. W., Oeffner, R., Read, R. J., Richardson, D. C., Richardson, J. S., Terwilliger, T. C., and Zwart, P. H. (2010) PHENIX: a comprehensive Python-based system for macromolecular structure solution. Acta crystallographica 66, 213-221
8. DeLano, W. L. (2002) The PyMOL Molecular Graphics System. Palo Alto B. Crystal Structure of ASGR-1 Carbohydrate Binding Domain (CBD) with 5E5

The present example presents the crystal structure of the ASGR-1 CBD bound to the Fab fragment of 5E5, determined to 1.95 Å resolution (the conditions for which are described in the below). This structure, depicted in FIGS. 22A&B, shows that when 5E5 binds to/interacts with ASGR-1, a conformational rearrangement of the carbohydrate binding loop occurs, impairing the carbohydrate binding loop from binding to/interacting with ligand (i.e., carbohydrates). This demonstrates that the 5E5 Fab indirectly inhibits the ASGR-1 CBD/Ligand binding.

The depicted structure also allows one to identify specific core ASGR amino acid residues for the interaction interface of 5E5 with ASGR-1. This was defined as residues that are within 5 Å of the 5E5 protein. The core residues are as follows: H161, E162, W195, E196, Q198, K199, F200, Q202, H203, H204, G232, F233, K234, N235, W236, R237, P238, D261, G262, R263 (SEQ ID NO:5).

The structures were also used to identify boundary ASGR-1 amino acid residues for the interaction interface with 5E5. These residues were ASGR-1 residues that were from 5-8 Å of the 5E5 protein. The boundary residues are as follows: V159, E160, R163, T193, S194, E197, V201, I205, G206, P207, Y229, E230, T231, E239, F258, T259, D260, W264 (SEQ ID NO:5).

Specific core 5E5 amino acid residues of the interaction interface with ASGR-1 were defined as 5E5 residues that are within 5 Å of the ASGR-1 protein. The core 5E5 Heavy Chain residues include: S30, N31, W52, Y53, D54, S56, N57, Y59, Y101, S102, S103, G104, W105, Y106, D107; and the core 5E5 Light Chain residues include: 5E5 Light Chain: Q27, R30, D32, H91, Y92, S93, Y94.

Boundary 5E5 amino acid residues of the interaction interface with ASGR-1 were defined as 5E5 residues that are 5-8 Å from the ASGR-1 protein. The boundary 5E5 Heavy Chain residues include: Y32, V33, V50, G55, K58, N74, E99, V100, Y108; and the boundary 5E5 Light Chain residues include: I2, G28, I29, L33, Q90, P95, R96.

Methods

Expression and Purification of Protein Samples

The 5E5 Fab fragment was generated by cleaving the 5E5 mAb with caspase 3. Post caspase cleavage, the Fab was isolated by purification on a MonoS ion exchange column. Ni Sepharose Excel subtraction was then performed to ensure the Fc domain was removed from the sample.

5E5 mAb Heavy Chain (SEQ ID NO: 32695):
QVQLVESGGGVVQPGRSLRLSCAASGFTFSNYVMHWVRQAPGKGLEWVA
VIWYDGSNKYYADSVKGRFTISRDNSKNTLYLQMNSLRAEDTAVYYCTR
EVYSSGWYDYGMDVWGQGTTVTVSSASTKGPSVFPLAPSSKSTSGGTAA
LGCLVKDYFPEPVTVSWNSGALTSGVHTFPAVLQSSGLYSLSSVVTVPS
SSLGTQTYICNVNHKPSNTKVDKKVEPKSCGSDEVDGGDKTHTCPPCPA
PELLGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIA
VEWESNGQPENNYKTTPPVLDSDGSFFLYSKLTVDKSRWQQGNVFSCSV
MHEALHNHYTQKSLSLSPGHHHHHH 5E5 mAb Light Chain (SEQ ID NO: 32696):
DIQMTQSPSSLSASVGDRVTITCRASQGIRNDLGWYQQKPGKAPKRLIY
AASSLQSGVPSRFSGSGSGTEFTLTISSLQPEDFATYYCLQHYSYPRTF
GQGTKVEVKRTVAAPSVFIFPPSDEQLKSGTASVVCLLNNFYPREAKVQ
WKVDNALQSGNSQESVTEQDSKDSTYSLSSTLTLSKADYEKHKVYACEV
THQGLSSPVTKSFNRGEC 5E5 Fab Heavy Chain (Post Cleavage) (SEQ ID NO: 32697):
QVQLVESGGGVVQPGRSLRLSCAASGFTFSNYVMHWVRQAPGKGLEWVA
VIWYDGSNKYYADSVKGRFTISRDNSKNTLYLQMNSLRAEDTAVYYCTR
EVYSSGWYDYGMDVWGQGTTVTVSSASTKGPSVFPLAPSSKSTSGGTAA
LGCLVKDYFPEPVTVSWNSGALTSGVHTFPAVLQSSGLYSLSSVVTVPS
SSLGTQTYICNVNHKPSNTKVDKKVEPKSCGSDEVD 5E5 Fab Light Chain (Post Cleavage) (SEQ ID NO: 32698):
DIQMTQSPSSLSASVGDRVTITCRASQGIRNDLGWYQQKPGKAPKRLIY
AASSLQSGVPSRFSGSGSGTEFTLTISSLQPEDFATYYCLQHYSYPRTF
GQGTKVEVKRTVAAPSVFIFPPSDEQLKSGTASVVCLLNNFYPREAKVQ
WKVDNALQSGNSQESVTEQDSKDSTYSLSSTLTLSKADYEKHKVYACEV
THQGLSSPVTKSFNRGEC Complex Formation and Crystallization The ASGR-1 CBD/5E5 Fab complex was made by mixing a molar excess of ASGR-1 CBD with 5E5 Fab. The complex was separated from excess ASGR-1 by purification on a size exclusion chromatography column. The ASGR-1 CBD/5E5 Fab complex was concentrated to 10 mg/ml and crystallizes in 0.1 M Tris pH 8.5, 12% PEG 4000.

Data Collection and Structure Determination

The dataset for the ASGR-1 CBD/5E5 Fab complex crystal was collected on beamline 5.0.2 at the Berkeley synchrotron and processed with Mosflm[1]/Aimless[2].

ASGR-1 CBD/5E5 Fab complex crystals grow in the $P2_1$ space group with unit cell dimensions a=62.93, b=41.75, c=118.89 Å and β=97.16 with one complex molecule per asymmetric unit, and diffract to 1.95 Å resolution. The ASGR-1 CBD/5E5 Fab complex structure was solved by molecular replacement with the program Molrep[2]. The structure was improved with multiple rounds of model building with Coot[3] and refinement with Phenix[4], to a final R=25.9/$R_{free}$=30.5. While the electron density for the ASGR-1 CBD and 5E5 Fab variable domain (along with the corresponding interface) is quite good, the electron density for the 5E5 constant domain is poor (most likely due to poor packing within the crystal lattice). This likely explains the higher R/$R_{free}$ observed from this structure refinement.

Core interaction interface amino acids were determined as being all amino acid residues with at least one non-hydrogen atom less than or equal to 5 Å from the partner protein. 5 Å was chosen as the core region cutoff distance to allow for atoms within a van der Waals radius plus a possible water-mediated hydrogen bond. Boundary interaction interface amino acids were determined as all amino acid residues with at least one non-hydrogen atom less than or equal to 8 Å from the partner protein but not included in the core interaction list. Less than or equal to 8 Å was chosen as the boundary region cutoff distance to allow for the length of an extended arginine amino acid. Amino acids that met these distance criteria were calculated with the program PyMOL[5].

References

1. Battye, T. G., Kontogiannis, L., Johnson, O., Powell, H. R. & Leslie, A. G. iMOSFLM: a new graphical interface for diffraction-image processing with MOSFLM. *Acta Crystallogr D Biol Crystallogr* 67, 271-81 (2011).
2. CCP4. The CCP4 suite: programs for protein crystallography. *Acta Crystallogr D Biol Crystallogr* 50, 760-3 (1994).
3. Emsley, P., Lohkamp, B., Scott, W. G. & Cowtan, K. Features and development of Coot. *Acta Crystallogr D Biol Crystallogr* 66, 486-501 (2010).
4. Adams, P. D. et al. PHENIX: a comprehensive Python-based system for macromolecular structure solution. *Acta Crystallogr D Biol Crystallogr* 66, 213-21 (2010).
5. DeLano, W. L. The PyMOL Molecular Graphics System. (Palo Alto, 2002).

C. Crystal Structure of ASGR-1 Carbohydrate Binding Domain (CBD) with 22G5

Figure 23:
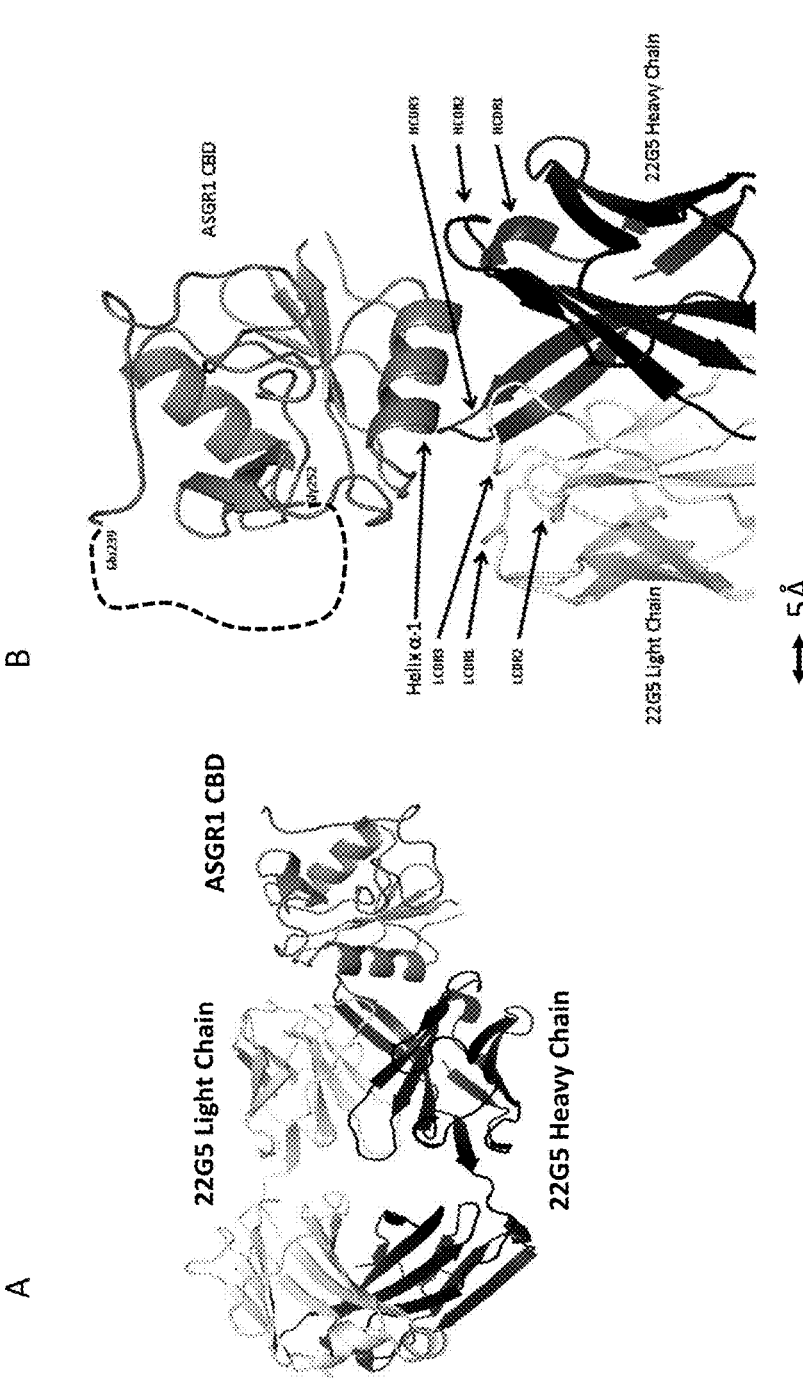
FIG. 23. Panel A shows a depiction of the structure of the ASGR-1 CB and the 22G5 Fab. Panel B is an enlarged view of the ASGR-1 CBD and 22G5 Fab that represents a disordered carbohydrate binding loop with a dashed line and highlights the indirect inhibition of ASGR-1 CBD and the ligand (GalNAc) binding. Panel B also incorporates a double-headed arrow which represents a 5 angstrom distance from tip to tip.

The present example presents the crystal structure of the ASGR-1 CBD bound to the Fab fragment of 22G5, determined to 2.1 Å resolution (the conditions of which are described above in B). This structure, depicted in FIGS. 23A&B, shows that when 22G5 binds to/interacts with ASGR-1, a conformational rearrangement of the carbohydrate binding loop occurs, impairing the carbohydrate binding loop from binding to/interacting with ligand (i.e., carbohydrates). This demonstrates that the 22G5 Fab indirectly inhibits the ASGR-1 CBD/Ligand binding.

The depicted structure also allows one to identify specific core ASGR amino acid residues for the interaction interface of 22G5 with ASGR-1. This was defined as residues that are within 5 Å of the 22G5 protein. The core residues are as follows: W167, S171, G172, K173, A174, A176, D177, N180, Y181, R183, L184, E185, D186, Q270, P272, W275 (SEQ ID N0:5).

The structures were also used to identify boundary ASGR-1 amino acid residues for the interaction interface with 22G5. These residues were ASGR-1 residues that were from 5-8 Å of the 22G5 protein. The boundary residues are as follows: P155, N157, W158, F168, S169, R170, W175, A178, D179, C182, A187, W211, C269, R271, Y273, R274, C277, T279 (SEQ ID N0:5).

Specific core 22G5 amino acid residues of the interaction interface with ASGR-1 were defined as 22G5 residues that are within 5 Å of the ASGR-1 protein. The core 22G5 Heavy Chain residues include: A33, V50, I51, S52, R53, S54, G55, G56, Y57, Y59, R99, A101, A103, G104, E106; and the core 22G5 Light Chain residues include: 22G5 Light Chain: Y32, S91, Y92, R93, Thr94, Pro95, F97.

Boundary 22G5 amino acid residues of the interaction interface with ASGR-1 were defined as 22G5 residues that are 5-8 Å from the ASGR-1 protein. The boundary 22G5 Heavy Chain residues include: S30, S31, Y32, M34, N35, W47, S49, T58, R72, N74, L100, V102, S105; and the boundary 22G5 Light Chain residues include: I2, Q27, N28, NAG100, I29, S30, S31, Q90, L96.

Methods:

The same methods were followed as described above in Example 10B except for the following changes:

The 22G5 Fab fragment was generated by cleaving the 22G5-IgG4 mAb with papain;

The ASGR-1 CBD/22G5 Fab complex was concentrated to 8 mg/ml and crystallized in 0.1 Bis-Tris pH 6.5, 0.2 sodium malonate, 20% PEG 3350;

The dataset was processed with XDS/Aimless;

ASGR-1 CBD/22G5 Fab complex crystals grow in the P212121 space group with unit cell dimensions a=46.04, b=80.34, c=169.14 Å with one complex molecule per asymmetric unit, and diffract to 2.1 Å resolution; and The structure was improved with multiple rounds of model building with Coot3 and refinement with Phenix4, to a final R=17.8/Rfree=22.5.

D. Crystal Structure of ASGR-1 Carbohydrate Binding Domain (CBD) with 4A2

Figure 24:
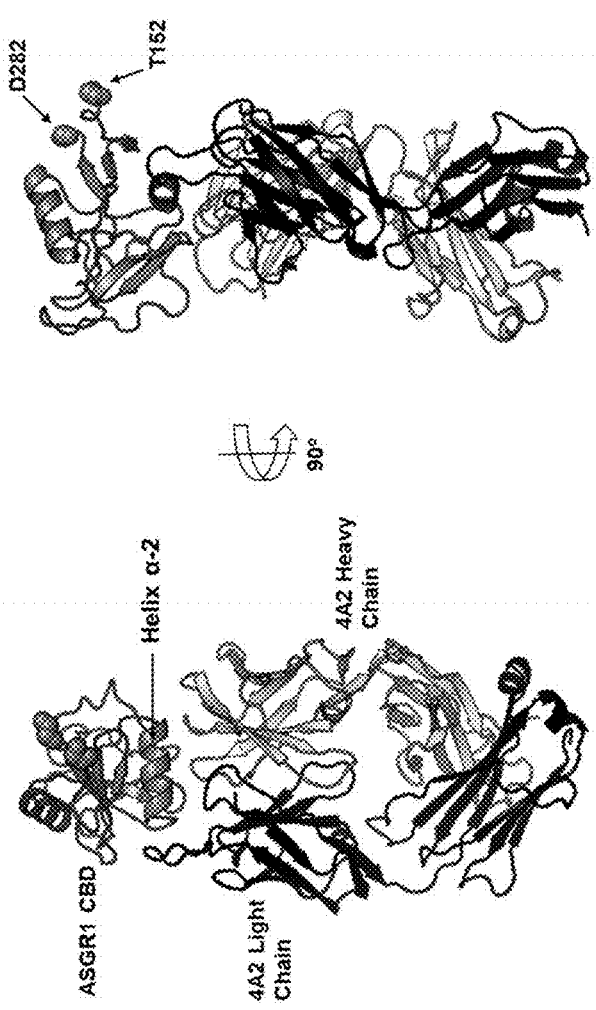
FIG. 24. A depiction of the structure of the ASGR-1 CBD and the 4A2 Fab.
Figure 25:
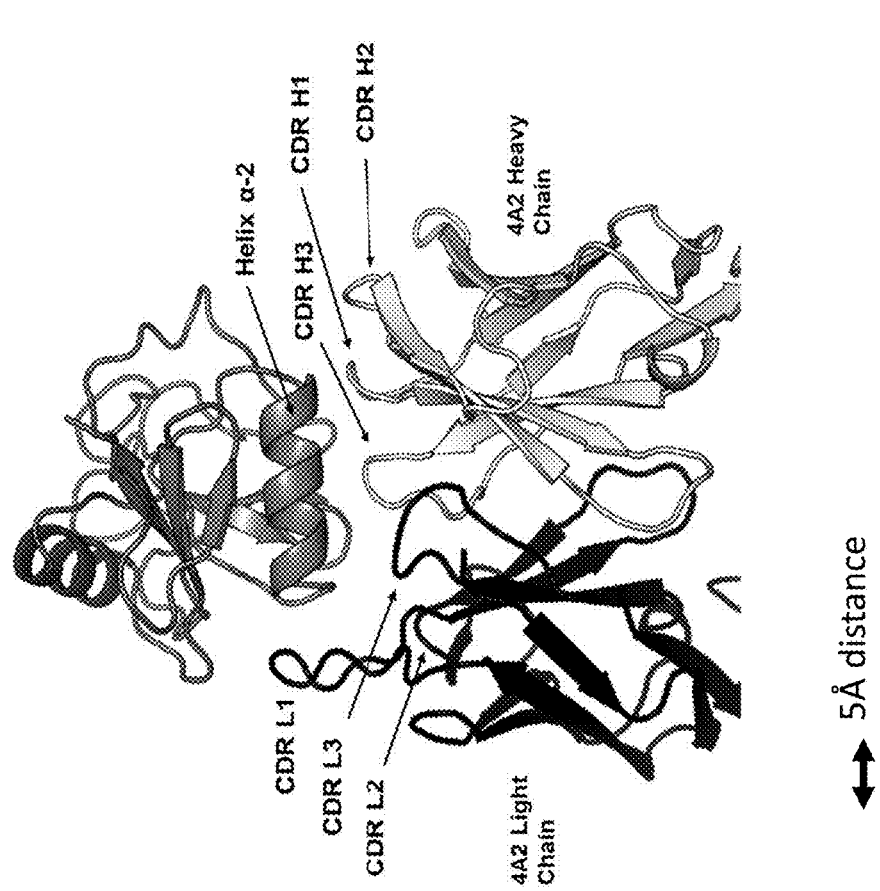
FIG. 25. An enlarged view of the structure of the ASGR-1 CBD and the 4A2 Fab that shows the CDRs of the 4A2 Fab that interact with ASGR-1 CBD Helix alpha-2 and highlights the indirect inhibition of ASGR-1 CBD and the ligand (GalNAc) binding. The figure incorporates a double-headed arrow which represents a 5 angstrom distance from tip to tip.
Figure 26:
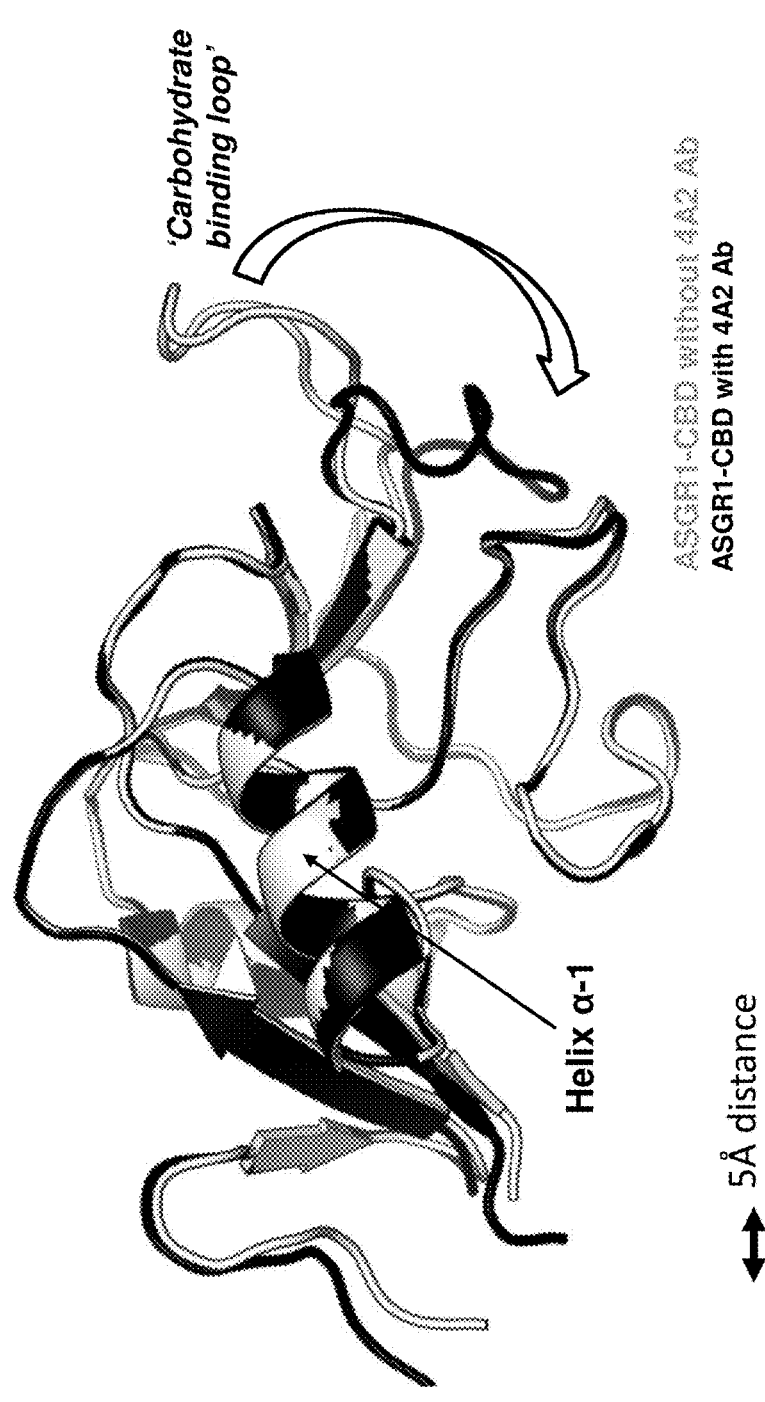
FIG. 26. An enlarged view of the structure of the ASGR-1 CBD and the carbohydrate binding loop with and without and the 4A2 Fab that includes a double-headed arrow which represents a 5 angstrom distance from tip to tip.

The present example presents the crystal structure of the ASGR-1 CBD bound to the Fab fragment of 4A2, determined to 2.15 Å resolution (the conditions of which are described above in section B of this Example). This structure, depicted in FIGS. 24, 25 and 26, shows that when 4A2 binds to/interacts with ASGR-1, a conformational rearrangement of the carbohydrate binding loop occurs, impairing the carbohydrate binding loop from binding to/interacting with ligand (i.e., carbohydrates). This demonstrates that the 4A2 Fab indirectly inhibits the ASGR-1 CBD/Ligand binding.

The depicted structure also allows one to identify specific core ASGR amino acid residues for the interaction interface of 4A2 with ASGR-1. This was defined as residues that are within 5 Å of the 4A2 protein. The core residues are as follows: R170, W195, E196, K199, Q202, H203, H204, I205, G206, P207, V208, F233, K234, N235, W236, P238, D260, D261, G262, R263, R274 (SEQ ID NO:5).

The structures were also used to identify boundary ASGR-1 amino acid residues for the interaction interface with 4A2. These residues were ASGR-1 residues that were from 5-8 Å of the 4A2 protein. The boundary residues are as follows: N157, V159, F168, S169, S171, S194, Q198, F200, V201, T210, R237, E239, Q240, F258, T259, W264 (SEQ ID NO:5).

Specific core 4A2 amino acid residues of the interaction interface with ASGR-1 were defined as 4A2 residues that are within 5 Å of the ASGR-1 protein. The core 4A2 Heavy Chain residues include: T28, F29, T30, N31, Y32, D33, W50, H52, S55, N57, S99, S100, G101, W102, Y103; and the core 4A2 Light Chain residues include: 4A2 Light Chain: H31, S33, N34, N36, Y38, W56, Y97, Y98.

Boundary 4A2 amino acid residues of the interaction interface with ASGR-1 were defined as 4A2 residues that are 5-8 Å from the ASGR-1 protein. The boundary 4A2 Heavy Chain residues include: Y27, I34, N35, W47, M51, P53, N54, G56, T58, G59, Y104, D106; and the boundary 4A2 Light Chain residues include: I29, S32, N35, N37, Y55, T59, Q96, N99, T100.

The coordinates for the ASGR-1 CBD/4A2 crystal structure complex are presented in Table 10.2.

Methods:

The same methods were followed as described above in part B of this Example except for the following changes:

1. For this antibody only, a double stop codon was inserted at the end of CH1 domain that allowed for expression of a 4A2 Fab. The Fab purification was carried out via an affinity and a cation exchanger column. The final sequence of 4A2 Fab is:

```
Heavy Chain (SEQ ID NO: 32650):
QVQLVQSGTEVKKPGASVKVSCKASGYTFTNYDINWVRQATGQGLEWMGW

MHPNSGNTGYAQKFQGRVTLTRDTSISTAYMELSSLRSEDTAVYYCASSS

GWYYFDYWGQGTLVTVSSASTKGPSVFPLAPSSKSTSGGTAALGCLVKDY

FPEPVTVSWNSGALTSGVHTFPAVLQSSGLYSLSSVVTVPSSSLGTQTYI

CNVNHKPSNTKVDKKVEPKSCGSDEVDGGD

Light Chain (SEQ ID NO: 32651):
DIVMTQSPDSLAVSLGERATINCKSSQSILHSSNNNNYLAWFQQKPGQPP

KLLLYWASTRESGVPDRFSGSGSGTDFTLTISSLQPEDVAVYYCQQYYNT

PVTFGPGTKVGIKRTVAAPSVFIFPPSDEQLKSGTASVVCLLNNFYPREA

KVQWKVDNALQSGNSQESVTEQDSKDSTYSLSSTLTLSKADYEKHKVYAC

EVTHQGLSSPVTKSFNRGEC
```

1. The ASGR-1 CBD/4A2 Fab complex was concentrated to 20 mg/ml and crystallized in 0.2 M Tri-Lithium citrate and 20% PEG3350;

2. The ASGR-1 CBD/4A2 Fab complex crystals grow in the $P2_12_12_1$ space group with unit cell dimensions a=63.42, b=76.37, c=156.67 Å with one complex molecule per asymmetric unit, and diffract to 2.15 Å resolution; and 3. The structure was improved with multiple rounds of model building with Coot[3] and refinement with Phenix[4], to a final R=17.9/$R_{free}$=21.8.

Crystal Structure of ASGR-1 Carbohydrate Binding Domain (CBD) with 7E11

Figure 27:
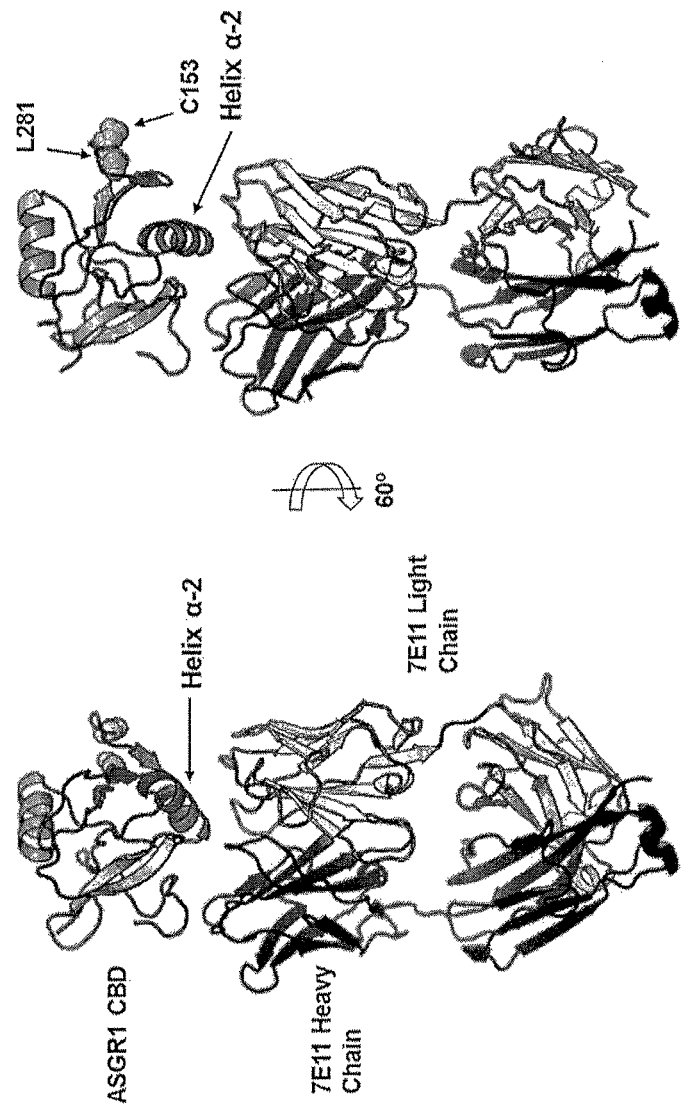
FIG. 27. A depiction of the structure of ASGR-1 CBD and the 7E11 Fab.
Figure 28:
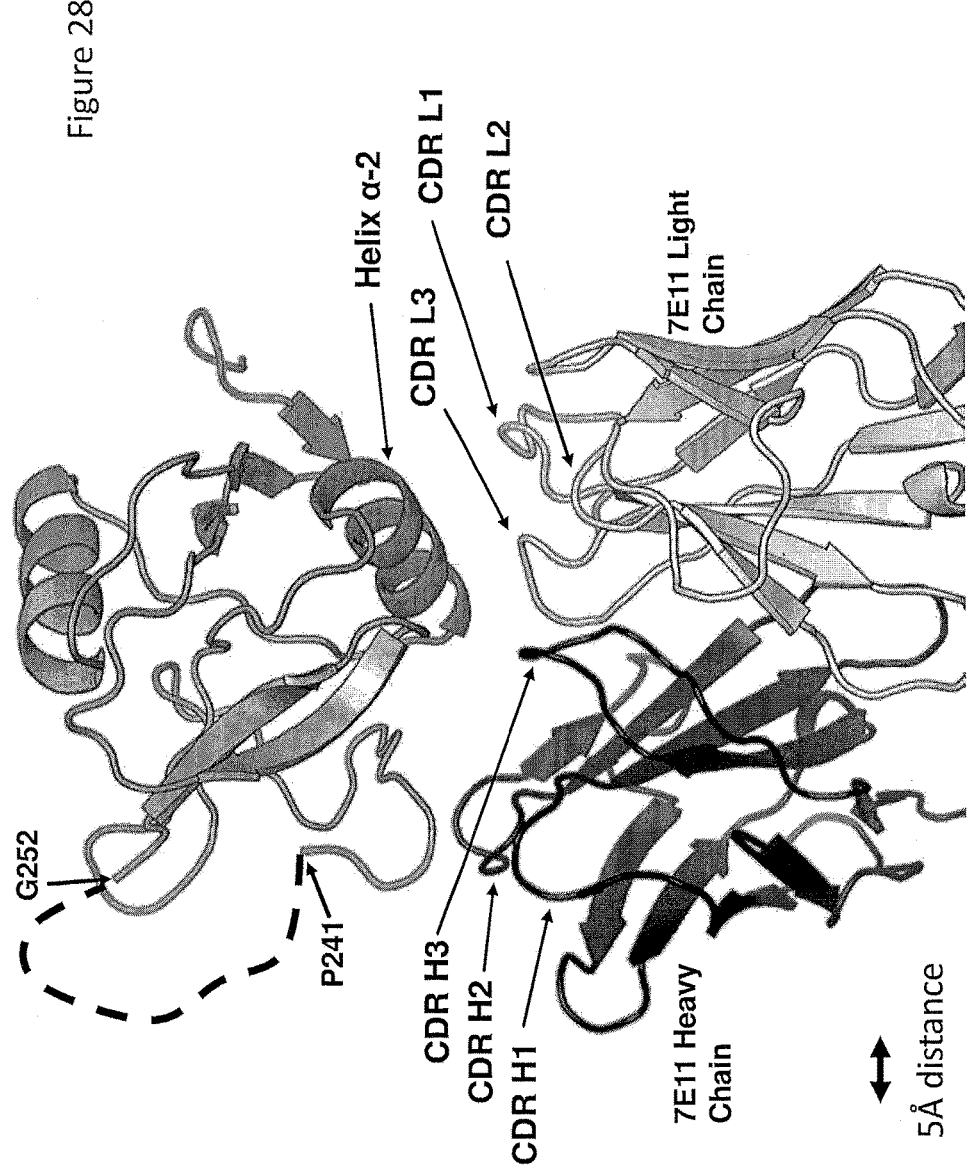
FIG. 28. An enlarged view of the structure of the ASGR-1 CBD and the 7E11 Fab. The figure represents a disordered carbohydrate binding loop with a dashed line and highlights the indirect inhibition of ASGR-1 CBD and the ligand (GalNAc) binding. The figure incorporates a double-headed arrow which represents a 5 angstrom distance from tip to tip.

The present example presents the crystal structure of the ASGR-1 CBD bound to the Fab fragment of 7E11, determined to 2.0 Å resolution (the conditions of which are described above in section B of this Example). This structure, depicted in FIGS. 27 and 28, shows that when 7E11 binds to/interacts with ASGR-1, a conformational rearrangement of the carbohydrate binding loop occurs, impairing the carbohydrate binding loop from binding to/interacting with ligand (i.e., carbohydrates). This demonstrates that the 7E11 Fab indirectly inhibits the ASGR-1 CBD/Ligand binding.

The depicted structure also allows one to identify specific core ASGR amino acid residues for the interaction interface of 7E11 with ASGR-1. This was defined as residues that are within 5 Å of the 7E11 protein. The core residues are as follows: H161, S194, W195, E196, Q198, K199, F200, Q202, H203, F233, K234, N235, W236, R237, P238, R263 (SEQ ID NO:5).

The structures were also used to identify boundary ASGR-1 amino acid residues for the interaction interface with 7E11. These residues were ASGR-1 residues that were from 5-8 Å of the 7E11 protein. The boundary residues are as follows: E160, E162, V192, T193, E197, V201, H204, Y229, E230, T231, G232, E239, Q240, P241, D261, G262, W264 (SEQ ID NO:5).

Specific core 7E11 amino acid residues of the interaction interface with ASGR-1 were defined as 7E11 residues that are within 5 Å of the ASGR-1 protein. The core 7E11 Heavy Chain residues include: S30, S31, I50, W52, H53, S56, N57, Y59, S01, M102, G103; and the core 7E11 Light Chain residues include: I30, Y32, T91, Y92, S93, T94, I96.

Boundary 7E11 amino acid residues of the interaction interface with ASGR-1 were defined as 7E11 residues that are 5-8 Å from the ASGR-1 protein. The boundary 7E11 Heavy Chain residues include: T28, F29, F32, G33, H35, W47, I51, D54, K58, D99, L100, G104; and the boundary 7E11 Light Chain residues include: I2, Q27, N28, I29, S31, L33, N34, T50, S67, Q89, Q90, P95.

Methods:

The same methods were followed as described above in part B of this example except for the following changes:

The 7E11 Fab fragment was generated by cleaving the 7E11 mAb with caspase 3:

```
7E11 mAb Heavy Chain (SEQ ID NO: 32652):
QVQLVESGGGVVQPGRSLRLSCAASGFTFSSFGMHWVRQAPGKGLEW

VAIIWHDGSNKYYADSVKGRFTISRDNSNNTLYLQMSSLRAEDTAVYY

CARDLSMGGMDVWGQGTTVTVSSASTKGPSVFPLAPSSKSTSGGTAAL

GCLVKDYFPEPVTVSWNSGALTSGVHTFPAVLQSSGLYSLSSVVTVPS

SSLGTQTYICNVNHKPSNTKVDKKVEPKSCGSDEVDGGDKTHTCPPCP

APELLGGPSVFLFPPKPKDTLMISRTPEVTCVVVDVSHEDPEVKFNWY

VDGVEVHNAKTKPREEQYNSTYRVVSVLTVLHQDWLNGKEYKCKVSNK

ALPAPIEKTISKAKGQPREPQVYTLPPSREEMTKNQVSLTCLVKGFYP

SDIAVEWESNGQPENNYKTTPPVLDSDGSFFLYSKLTVDKSRWQQGNV

FSCS VMHEALHNHYTQKSLSLSPGHHHHHH

7E11 mAb Light Chain (SEQ ID NO: 32653):
DIQMTQSPSSLSASVGDRVTIACRASQNIISYLNWYQQKPGKAPKFLI

YTASSLQSGVPSRFSGSGSGTDFTLTISSLQPEDFAIYYCQQTYSTPL

TFGGGTKVEIKRTVAAPSVFIFPPSDEQLKSGTASVVCLLNNFYPREA

KVQWKVDNALQSGNSQESVTEQDSKDSTYSLSSTLTLSKADYEKHKVY

ACEVTHQGLSSPVTKSFNRGEC

7E11 Fab Heavy Chain (Post-Cleavage) (SEQ ID NO:
32654):
QVQLVESGGGVVQPGRSLRLSCAASGFTFSSFGMHWVRQAPGKGLEWVAI

IWHDGSNKYYADSVKGRFTISRDNSNNTLYLQMSSLRAEDTAVYYCARDL

SMGGMDVWGQGTTVTVSSASTKGPSVFPLAPSSKSTSGGTAALGCLVKDY

FPEPVTVSWNSGALTSGVHTFPAVLQSSGLYSLSSVVTVPSSSLGTQTYI

CNVNHKPSNTKVDKKVEPKSCGSDEVD
```

-continued

7E11 Fab Light Chain (Post-Cleavage) (SEQ ID NO: 32655):
DIQMTQSPSSLSASVGDRVTIACRASQNIISYLNWYQQKPGKAPKFLIYT

ASSLQSGVPSRFSGSGSGTDFTLTISSLQPEDFAIYYCQQTYSTPLTFGG

GTKVEIKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC

1. The ASGR-1 CBD/7E11 Fab complex was concentrated to 20 mg/ml and crystallized in 0.2 M Potassium Phosphate monobasic and 20% PEG3350;
2. The ASGR-1 CBD/7E11 Fab complex crystals grow in the P6222 space group with unit cell dimensions a=105.75, b=105.75, c=193.75 Å and γ=120.0° with one complex molecule per asymmetric unit, and diffract to 2.0 Å resolution;
3. The dataset was processed with XDS/CCP4;
4. The ASGR-1 CBD/7E11 Fab complex structure was solved by molecular replacement with the program Phaser; and
5. The structure was improved with multiple rounds of model building with Coot[3] and refinement with Phenix[4], to a final R=21.4/$R_{free}$=26.9.

E. Crystal Structure of ASGR-1 Carbohydrate Binding Domain (CBD) with 4H6

Figure 29:
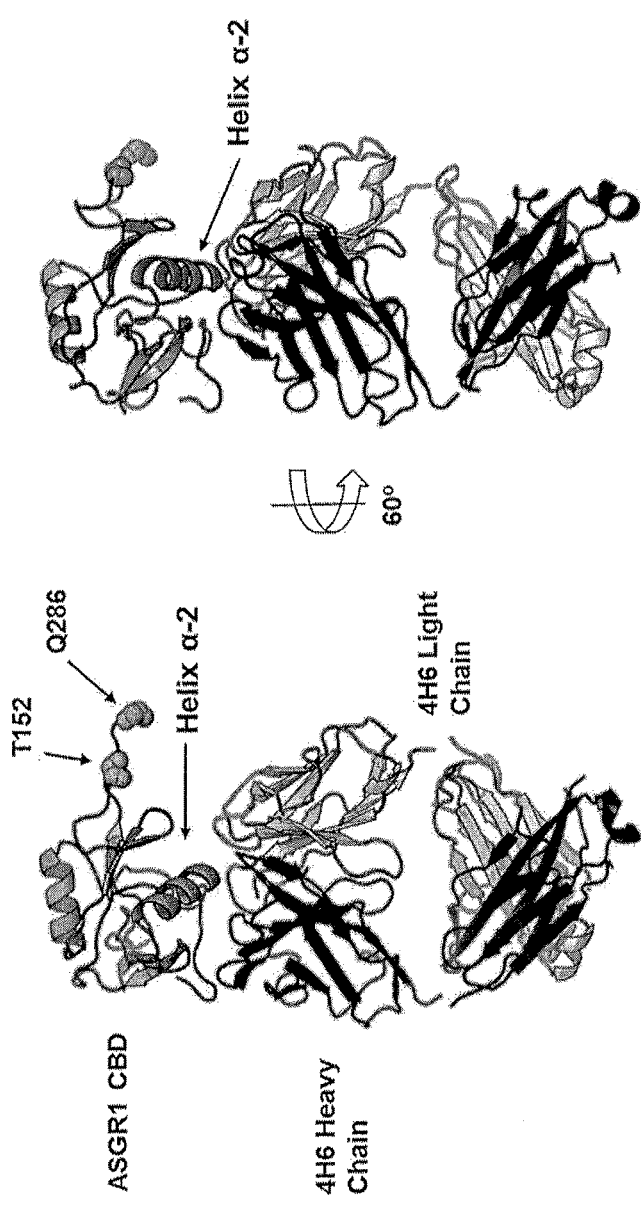
FIG. 29. A depiction of the structure of the ASGR-1 CBD and the 4H6 Fab.
Figure 30:
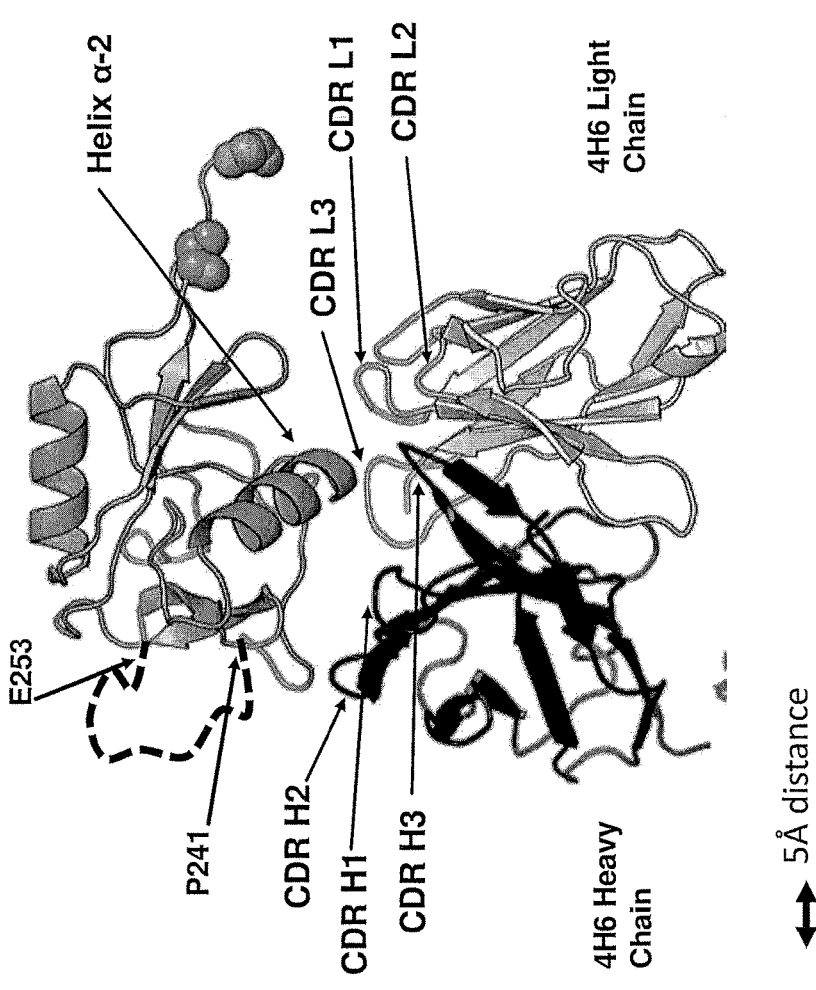
FIG. 30. An enlarged view of structure of the ASGR-1 CBD and the 4H6 Fab. The figure represents a disordered carbohydrate binding loop with a dashed line and highlights the indirect inhibition of ASGR-1 CBD and the ligand (GalNAc) binding. The figure incorporates a double-headed arrow which represents a 5 angstrom distance from tip to tip.

The present example presents the crystal structure of the ASGR-1 CBD bound to the Fab fragment of 4H6, determined to 2.6 Å resolution (the conditions of which are described above in section B of this Example). This structure, depicted in FIGS. 29 and 30, shows that when 4H6 binds to/interacts with ASGR-1, a conformational rearrangement of the carbohydrate binding loop occurs, impairing the carbohydrate binding loop from binding to/interacting with ligand (i.e., carbohydrates). This demonstrates that the 4H6 Fab indirectly inhibits the ASGR-1 CBD/Ligand binding.

The depicted structure also allows one to identify specific core ASGR amino acid residues for the interaction interface of 4H6 with ASGR-1. This was defined as residues that are within 5 Å of the 4H6 protein. The core residues are as follows: H161, E162, T193, S194, W195, E196, K199, Q202, T231, G232, F233, K234, N235, P238, D261, R263 (SEQ ID NO:5).

The structures were also used to identify boundary ASGR-1 amino acid residues for the interaction interface with 4H6. These residues were ASGR-1 residues that were from 5-8 Å of the 4H6 protein. The boundary residues are as follows: R163, V192, E197, Q198, H203, P207, D228, E230, W236, R237, D260, G262, W264 (SEQ ID NO:5).

Specific core 4H6 amino acid residues of the interaction interface with ASGR-1 were defined as 4H6 residues that are within 5 Å of the ASGR-1 protein. The core 4H6 Heavy Chain residues include: Y33, H35, W50, H52, S55, G57, T58, N59, D99, G100, T101, S102; and the core 4H6 Light Chain residues include: Q27, W32, A91, N92, S93, F94, F96.

Boundary 4H6 amino acid residues of the interaction interface with ASGR-1 were defined as 4H6 residues that are 5-8 Å from the ASGR-1 protein. The boundary 4H6 Heavy Chain residues include: D31, Y32, L34, W47, I51, N54, G56, Y60, Q65, S103, F104; and the boundary 4H6 Light Chain residues include: D1, I2, G28, I29, S30, R31, Y49, G50, Q89, Q90, P95.

Methods:

The same methods were followed as described above in part B of this example except for the following changes:

1. The 4H6 Fab fragment was generated by cleaving the 4H6 mAb with caspase 3.

4H6 mAb Heavy Chain (SEQ ID NO: 32656):
QVQLVQSGAEVKKPGASVKVSCKASGYTFTDYYLHWVRQAPGQGLEWMGW

IHPNSGGTNYAQKFQGRVTMTRDTSISTAYMGLSSLRSDDTAVYYCARDG

TSSFDYWGQGTLVTVSSASTKGPSVFPLAPSSKSTSGGTAALGCLVKDYF

PEPVTVSWNSGALTSGVHTFPAVLQSSGLYSLSSVVTVPSSSLGTQTYIC

NVNHKPSNTKVDKKVEPKSCGSDEVDGGDKTHTCPPCPAPELLGGPSVFL

FPPKPKDTLMISRTPEVTCVVVDVSHEDPEVKFNWYVDGVEVHNAKTKPR

EEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYK

TTPPVLDSDGSFFLYSKLTVDKSRWQQGNVFSCSVMHEALHNHYTQKSLS

LSPGHHHHHH

4H6 mAb Light Chain (SEQ ID NO: 32657):
DIQMTQSPSSVSASVGDRVTITCRASQGISRWLAWYQQKPGKAPKLLIYG

ASSLQSGVPSRFSGSGSGTDFTLTISSLQPEDFAIYYCQQANSFPFTFGP

GTKVDIKGTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC

4H6 Fab Heavy Chain (Post-Cleavage) (SEQ ID NO: 32658):
QVQLVQSGAEVKKPGASVKVSCKASGYTFTDYYLHWVRQAPGQGLEWMGW

IHPNSGGTNYAQKFQGRVTMTRDTSISTAYMGLSSLRSDDTAVYYCARDG

TSSFDYWGQGTLVTVSSASTKGPSVFPLAPSSKSTSGGTAALGCLVKDYF

PEPVTVSWNSGALTSGVHTFPAVLQSSGLYSLSSVVTVPSSSLGTQTYIC

NVNHKPSNTKVDKKVEPKSCGSDEVD

4H6 Fab Light Chain (Post-Cleavage) (SEQ ID NO: 32659):
DIQMTQSPSSVSASVGDRVTITCRASQGISRWLAWYQQKPGKAPKLLIYG

ASSLQSGVPSRFSGSGSGTDFTLTISSLQPEDFAIYYCQQANSFPFTFGP

GTKVDIKGTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC

2. The ASGR-1 CBD/4H6 Fab complex was concentrated to 20 mg/ml and crystallized in 0.2M Sodium fluoride, 0.1 M Bis Tris propane pH8.5, 20% PEG3350;
3. The dataset was collected on beamline ID22 at the APS synchrotron and processed with HKL2000/CCP4;
4. The ASGR-1 CBD/4H6 Fab complex crystals grow in the P12$_1$1 space group with unit cell dimensions a=57.20, b=43.58, c=131.65 Å and β=90.7° with one complex molecule per asymmetric unit, and diffract to 2.6 Å resolution;
5. The ASGR-1 CBD/4H6 Fab complex structure was solved by molecular replacement with the program Phaser; and
6. The structure was improved with multiple rounds of model building with Coot[3] and refinement with Phenix[4], to a final R=17.9/$R_{free}$=22.5.

F. Crystal Structure of ASGR-1 Carbohydrate Binding Domain (CBD) with 72G9

Figure 31:
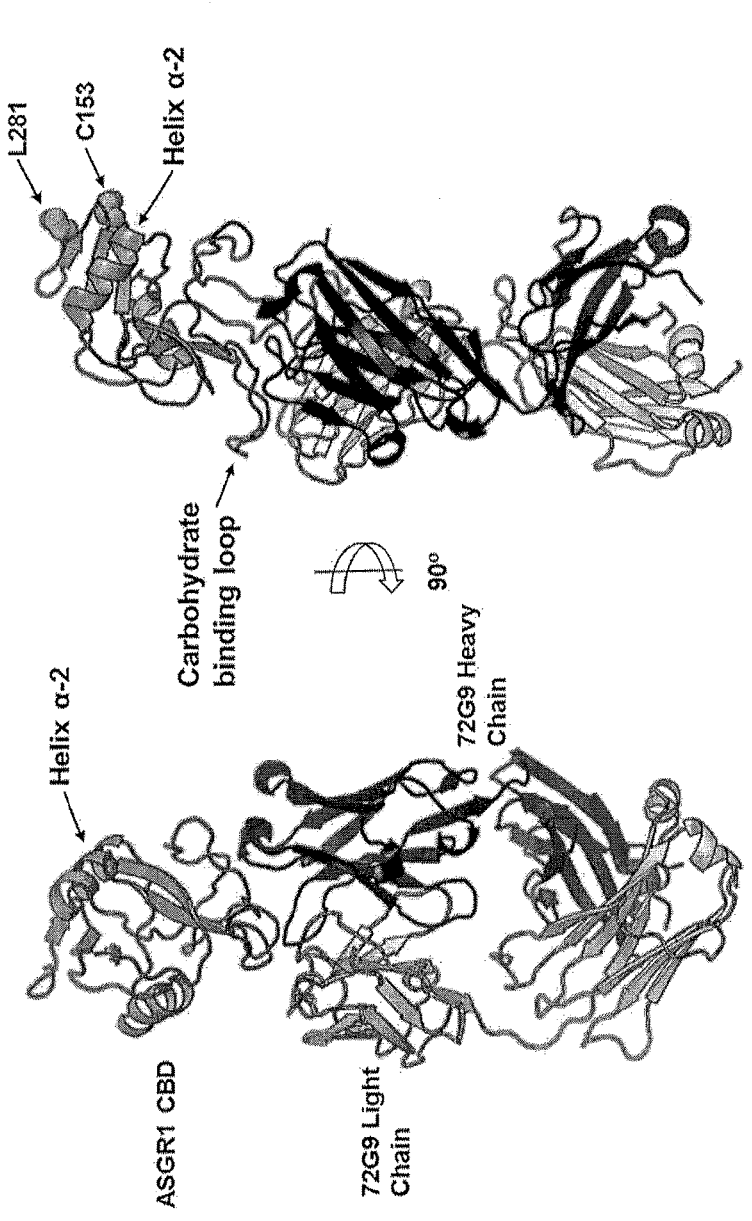
FIG. 31. A depiction of the structure of the ASGR-1 CBD and the 72G9 Fab.
Figure 32:
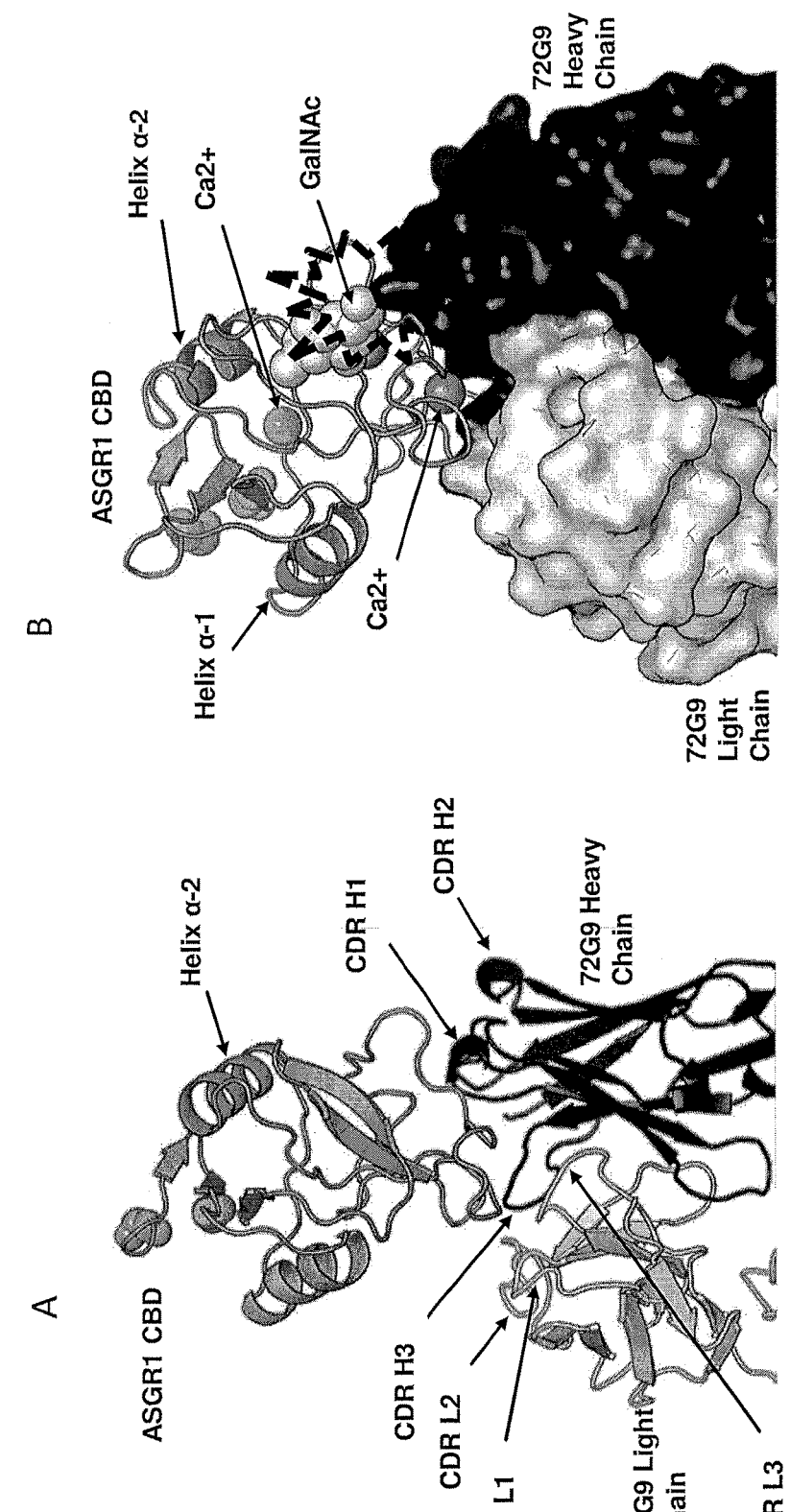
FIG. 32. Panel A is an enlarged view of the structure of ASGR-1 CBD and the 72G9 Fab; and Panel B is a depiction of the structure of the ASGR-1 CBD and the 72G9 Fab that also overlays the structure of ASGR-1 CBD and the ligand and highlights the direct inhibition of ASGR-1 CBD and the ligand (GalNAc) binding.

The present example presents the crystal structure of the ASGR-1 CBD bound to the Fab fragment of 72G9, determined to 2.55 Å resolution (the conditions of which are described above in section B of this Example). This structure, depicted in FIGS. 31 and 32A and 32B, shows that when 72G9 binds to/interacts with ASGR-1, the CDR H2 loop of the Fab fragment appears to directly block the ligand (i.e., carbohydrate) binding/interacting to ASGR-1 CBD. This demonstrates that the 72G9 Fab directly inhibits the ASGR-1 CBD/Ligand binding.

The deicted structure also allows one to identify specific core ASGR amino acid residues for the interaction interface of 72G9 with ASGR-1. This was defined as residues that are within 5 Å of the 72G9 protein. The core residues are as follows: D216, Q217, N218, G219, P220, W221, Y229, E230, K234, W236, E239, Q240, P241, D242, D243, W244, Y245, G246, L249, G250, G251, G252, D254, Q270 ((SEQ ID NO:5).

The structures were also used to identify boundary ASGR-1 amino acid residues for the interaction interface with 72G9. These residues were ASGR-1 residues that were from 5-8 Å of the 72G9 protein. The boundary residues are as follows: H215, K222, T231, G232, R237, P238, H247, G248, E253, C255, D266, V268, C269 (SEQ ID NO:5).

Specific core 72G9 amino acid residues of the interaction interface with ASGR-1 were defined as 72G9 residues that are within 5 Å of the ASGR-1 protein. The core 72G9 Heavy Chain residues include: G26, F27, T28, S30, S31, Y32, S33, S52, G53, S54, S56, Y57, Y59, R98, G100, S101, R102; and the core 72G9 Light Chain residues include: Y32, Y49, T50, Q55, S91, H92, S93, F94, F96.

Boundary 72G9 amino acid residues of the interaction interface with ASGR-1 were defined as 72G9 residues that are 5-8 Å from the ASGR-1 protein. The boundary 72G9 Heavy Chain residues include: V2, F29, N35, S50, T51, S55, I58, R72, G99, G103, F104, D105; and the boundary 72G9 Light Chain residues include: S28, I29, T30, N33, L46, S53, L54, S56, Q89, Q90, P95.

Methods:

The same methods were followed as described above in part B of this example except for the following changes:

1. The 72G9 Fab fragment was generated by cleaving the 72G9 mAb with caspase 3.

72G9 mAb Heavy Chain (SEQ ID NO: 32660):
EVQLVESGGGLVKPGGSLRLSCAASGFTFSSYSMNWVRQAPGKGLEWVSS

ISGSSSYIYYADSVKGRFTISRDNAKNSLYLQMNSLRAEDTAVYFCARGG

SRGFDPWGQGTLVTVSSASTKGPSVFPLAPSSKSTSGGTAALGCLVKDYF

PEPVTVSWNSGALTSGVHTFPAVLQSSGLYSLSSVVTVPSSSLGTQTYIC

NVNHKPSNTKVDKKVEPKSCGSDEVDGGDKTHTCPPCPAPELLGGPSVFL

FPPKPKDTLMISRTPEVTCVVVDVSHEDPEVKFNWYVDGVEVHNAKTKPR

EEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYK

TTPPVLDSDGSFFLYSKLTVDKSRWQQGNVFSCSVMHEALHNHYTQKSLS

LSPGHHHHHH

72G9 mAb Light Chain (SEQ ID NO: 32661):
DIQMTQSPSSLSASVGDRVTITCRASQSITSYLNWYQQKPGKAPKLLIYT

ASSLQSGVPSRFSGSGSGTDFTLTISSLQPEDFATYYCQQSHSFPFTFGP

GTKVDIKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC

72G9 Fab Heavy Chain (Post-Cleavage) (SEQ ID NO: 32662):
EVQLVESGGGLVKPGGSLRLSCAASGFTFSSYSMNWVRQAPGKGLEWVSS

ISGSSSYIYYADSVKGRFTISRDNAKNSLYLQMNSLRAEDTAVYFCARGG

SRGFDPWGQGTLVTVSSASTKGPSVFPLAPSSKSTSGGTAALGCLVKDYF

PEPVTVSWNSGALTSGVHTFPAVLQSSGLYSLSSVVTVPSSSLGTQTYIC

NVNHKPSNTKVDKKVEPKSCGS DEVD

72G9 Fab Light Chain (Post-Cleavage) (SEQ ID NO: 32663):
DIQMTQSPSSLSASVGDRVTITCRASQSITSYLNWYQQKPGKAPKLLIYT

ASSLQSGVPSRFSGSGSGTDFTLTISSLQPEDFATYYCQQSHSFPFTFGP

GTKVDIKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC

2. The 72G9 Fab/ASGR-1 CBD complex was concentrated to 0.2 M Magnesium Sulfate heptahydrate, 20% PEG3350;

3. The ASGR-1 CBD/72G9 Fab complex crystals grew in the P2$_1$ space group with unit cell dimensions a=100.98, b=64.95, c=100.68 Å and β=96.43° with one complex molecule per asymmetric unit, and diffract to 2.55 Å resolution;

4. The dataset was processed with XDS/CCP4;

5. The ASGR-1 CBD/72G9 Fab complex structure was solved by molecular replacement with the program Phaser; and 6. The structure was improved with multiple rounds of model building with Coot[3] and refinement with Phenix[4], to a final R=20.4/R$_{free}$=23.4.

G. Crystal Structure of ASGR-1 Carbohydrate Binding Domain (CBD) with 194A4

Figure 33:
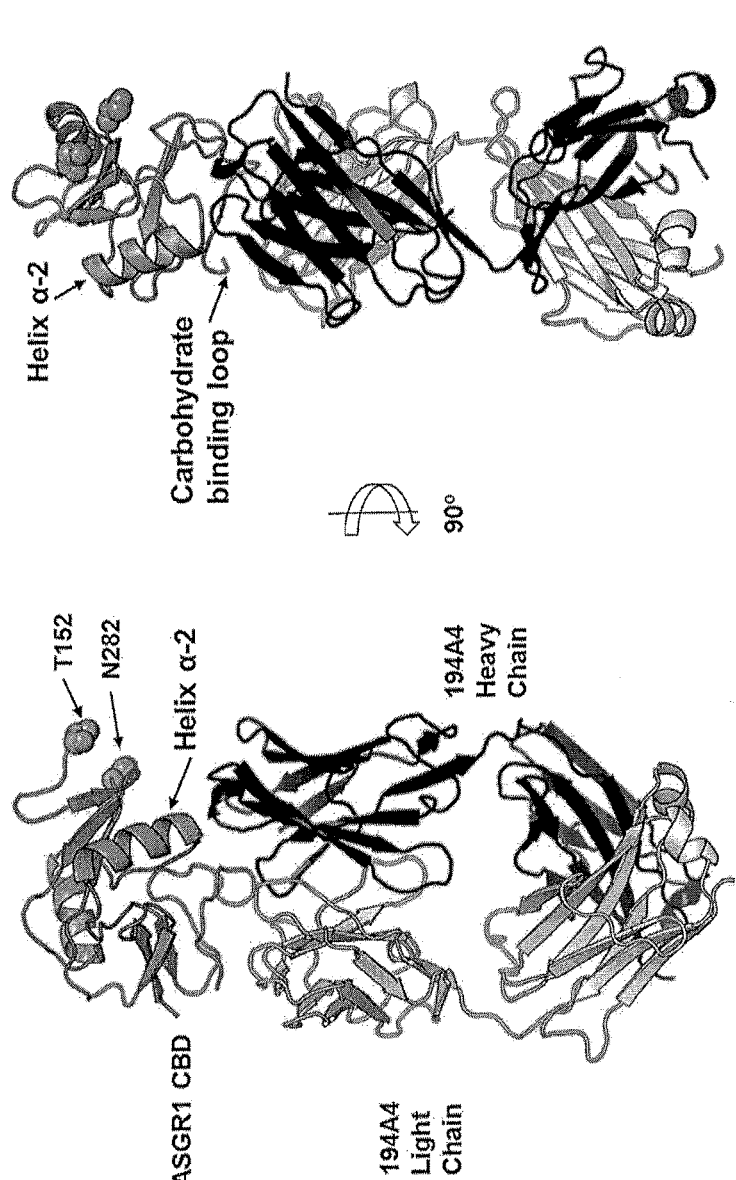
FIG. 33. A depiction of the structure of the ASGR-1 CBD and the 194A4 Fab.
Figure 34:
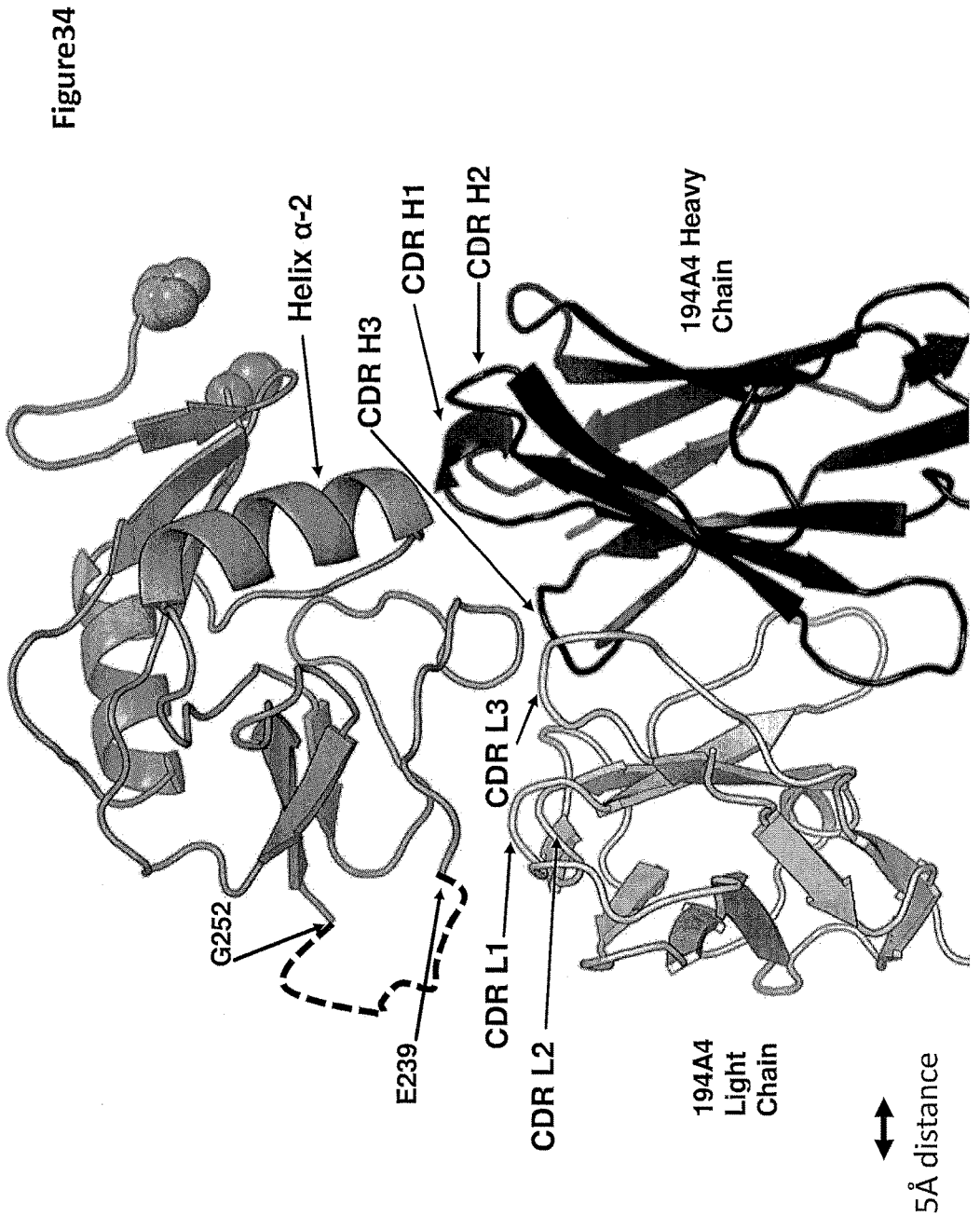
FIG. 34. An enlarged view of the structure of the ASGR-1 CBD and the 194A4 Fab. The figure represents a disordered carbohydrate binding loop with a dashed line and highlights the indirect inhibition of ASGR-1 CBD and the ligand (GalNAc) binding. The figure incorporates a double-headed arrow which represents a 5 angstrom distance from tip to tip.

The present example presents the crystal structure of the ASGR-1 CBD bound to the Fab fragment of 194A4, determined to 2.6 Å resolution (the conditions of which are described above in section B of this Example). This structure, depicted in FIGS. 33 and 34, shows that when 194A4 binds to/interacts with ASGR-1, a conformational rearrangement of the carbohydrate binding loop occurs, impairing the carbohydrate binding loop from binding to/interacting with ligand (i.e., carbohydrates). This demonstrates that the 194A4 Fab indirectly inhibits the ASGR-1 CBD/Ligand binding.

The depicted structure also allows one to identify specific core ASGR amino acid residues for the interaction interface of 194A4 with ASGR-1. This was defined as residues that are within 5 Å of the 194A4 protein. The core residues are as follows: T193, S194, W195, E196, P220, W221, G226, T227, D228, Y229, E230, T231, G232, F233, K234, N235, W236, R237, P238, E239, G252 (SEQ ID NO:5).

The structures were also used to identify boundary ASGR-1 amino acid residues for the interaction interface with 194A4. These residues were ASGR-1 residues that were from 5-8 Å of the 194A4 protein. The boundary residues are as follows: H161, E162, V191, V192, E197, Q198, D216, G219, K222, W223, D225, R263, W264 (SEQ ID NO:5).

Specific core 194A4 amino acid residues of the interaction interface with ASGR-1 were defined as 194A4 residues that are within 5 Å of the ASGR-1 protein. The core 194A4 Heavy Chain residues include: V31, Y32, Y33, W50, N52, S55, G57, R98, G99, Y100, D101, I102, T204; and the core 194A4 Light Chain residues include: V29, S30, I32, Y33, L47, Y50, R55, A56, T57, Y94.

Boundary 194A4 amino acid residues of the interaction interface with ASGR-1 were defined as 194A4 residues that are 5-8 Å from the ASGR-1 protein. The boundary 194A4 Heavy Chain residues include: V2, Y27, T30, L34, N35, P53, N54, G56, T58, N59, A97, L103, G105; and the boundary 194A4 Light Chain residues include: G28, N31, L48, I49, G51, N54, G58, I59, S68, G69, D93, S95.

Methods:

The same methods were followed as described above in part B of this example except for the following changes:

1. The 194A4 Fab fragment was generated by cleaving the 194A4 mAb with caspase 3.

```
194A4 mAb Heavy Chain (SEQ ID NO: 32664):
QVQLVQSGTEVKKPGASLKVSCKASGYTFTVYYLNWVRQAPGQGLEWMGW

INPNSGGTNYAQKFQGRVTMTRDTSISTAYMELSRLRSDDTAVYYCARGY

DILTGWGQGTLVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKKVEPKSCGSDEVDGGDKTHTCPPCPAPELLGGPSVFLF

PPKPKDTLMISRTPEVTCVVVDVSHEDPEVKFNWYVDGVEVHNAKTKPRE

EQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKT

TPPVLDSDGSFFLYSKLTVDKSRWQQGNVFSCSVMHEALHNHYTQKSLSL

SPGHHHHHH

194A4 mAb Light Chain (SEQ ID NO: 32665):
EIVLTQSPGTLSLSPGERATLSCRASRGVSNIYLAWYQQKPGQAPRLLIY

GASNRATGIPDRFSGSGSGTDFTLTISRLEPEDFAVYYCQHNDYSMFTFG

PGTKVDIKRTVAAPSVFIFPPSDEQLKSGTASVVCLLNNFYPREAKVQWK

VDNALQSGNSQESVTEQDSKDSTYSLSSTLTLSKADYEKHKVYACEVTHQ

GLSSPVTKSFNRGEC

194A4 Fab Heavy Chain (Post-Cleavage) (SEQ ID NO: 32666):
QVQLVQSGTEVKKPGASLKVSCKASGYTFTVYYLNWVRQAPGQGLEWMGW

INPNSGGTNYAQKFQGRVTMTRDTSISTAYMELSRLRSDDTAVYYCARGY

DILTGWGQGTLVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKKVEPKSCGSDEVD

194A4 Fab Light Chain (Post-Cleavage) (SEQ ID NO: 32667):
EIVLTQSPGTLSLSPGERATLSCRASRGVSNIYLAWYQQKPGQAPRLLIY

GASNRATGIPDRFSGSGSGTDFTLTISRLEPEDFAVYYCQHNDYSMFTFG

PGTKVDIKRTVAAPSVFIFPPSDEQLKSGTASVVCLLNNFYPREAKVQWK

VDNALQSGNSQESVTEQDSKDSTYSLSSTLTLSKADYEKHKVYACEVTHQ

GLSSPVTKSFNRGEC
```

2. The 194A4 Fab/ASGR-1 CBD complex was concentrated to 13.1 mg/mL and crystallized with 0.2 M Sodium chloride, 0.1M MES pH6.0, 20% PEG2000 MME;

3. The dataset was processed with XDS/CCP4;

4. The 194A4 Fab/ASGR-1 CBD complex crystals grow in the $P2_12_12_1$ space group with unit cell dimensions a=52.23, b=66.40, c=177.75 Å with one complex molecule per asymmetric unit, and diffract to 2.6 Å resolution;

5. The ASGR-1 CBD/194A4 Fab complex structure was solved by molecular replacement with the program Phaser; and 6. The structure was improved with multiple rounds of model building with Coot[3] and refinement with Phenix[4], to a final R=20.1/$R_{free}$=24.6.

H. Crystal Structure of ASGR-1 Carbohydrate Binding Domain (CBD) with 54E9

Figure 35:
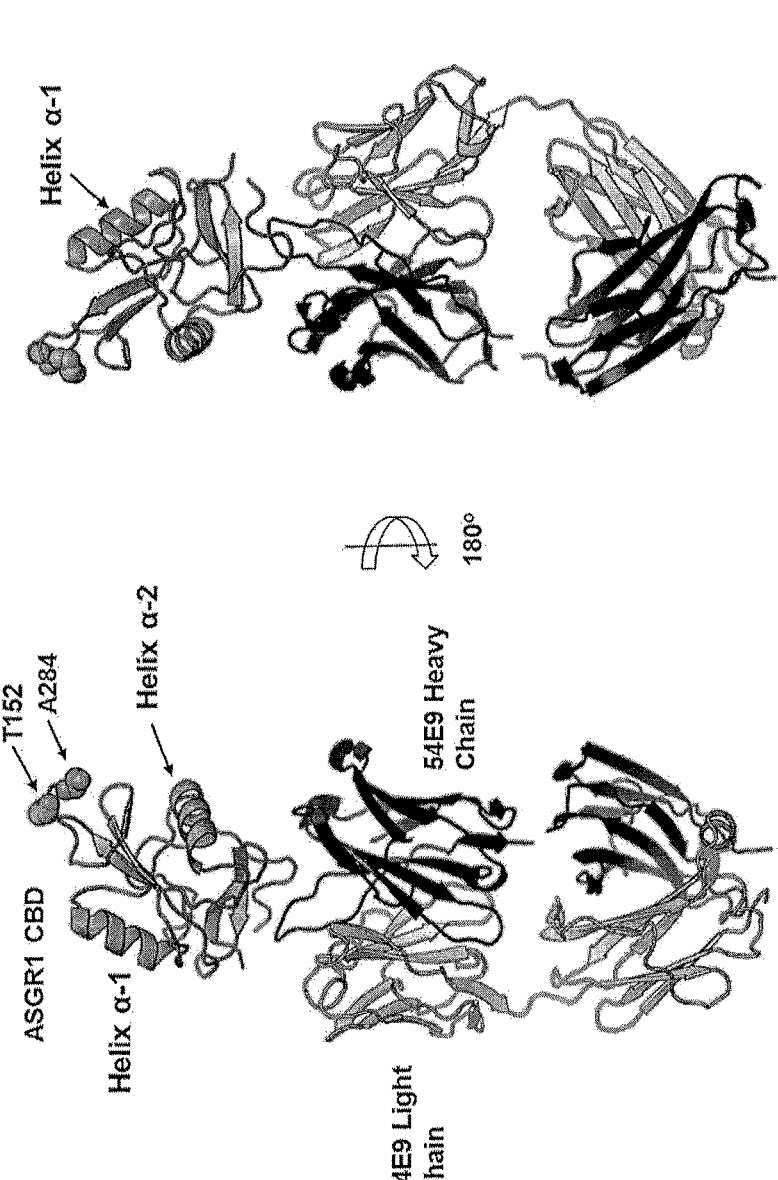
FIG. 35. A depiction of the structure of the ASGR-1 CBD and the 54E9 Fab.
Figure 36:
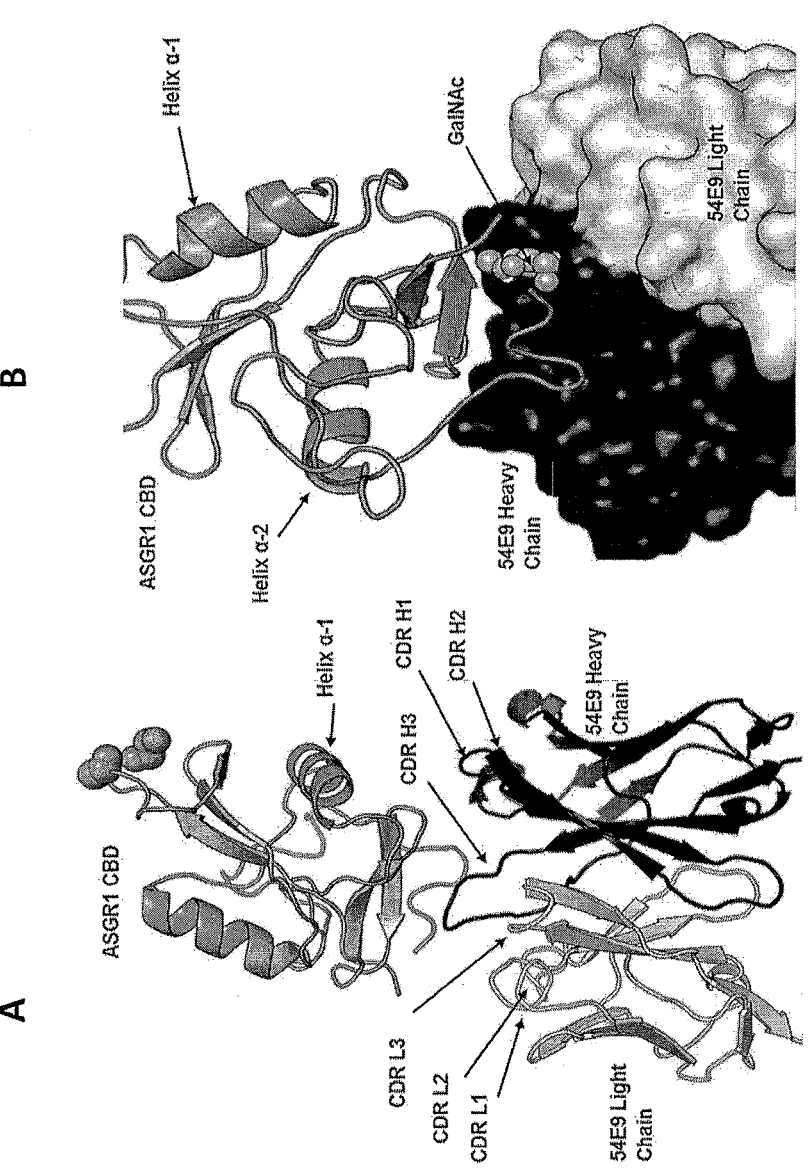
FIG. 36. Panel A is an enlarged view of the structure of the ASGR-1 CBD and the 54E9 Fab; and Panel B is a depiction of the structure of the ASGR-1 CBD and the 54E9 Fab that also overlays the structure of ASGR-1 CBD and the ligand and highlights the direct inhibition of ASGR-1 CBD and the ligand (GalNAc) binding.

The present example presents the crystal structure of the ASGR-1 CBD bound to the Fab fragment of 54E9, determined to 2.6 Å resolution (the conditions of which are described above in section B of this Example). This structure, depicted in FIG. 35 and FIG. 36A and FIG. 36B, shows that when 54E9 binds to/interacts with ASGR-1, the CDR H3 loop of the Fab fragment appears to directly block the ligand (i.e., carbohydrate) from binding/interacting to ASGR-1 CBD. This demonstrates that the 54E9 Fab directly inhibits the ASGR-1 CBD/Ligand binding.

The depicted structure also allows one to identify specific core ASGR amino acid residues for the interaction interface of 54E9 with ASGR-1. This was defined as residues that are within 5 Å of the 54E9 protein. The core residues are as follows: W195, N209, N235, R237, P238, E239, Q240, D242, H257, T259, D260, D261, R263, N265, D267, R271, Y273 (SEQ ID NO:5).

The structures were also used to identify boundary ASGR-1 amino acid residues for the interaction interface with 54E9. These residues were ASGR-1 residues that were from 5-8 Å of the 54E9 protein. The boundary residues are as follows: Q198, Q202, P207, V208, F233, W236, D243, E253, F258, G262, W264, D266 (SEQ ID NO:5).

Specific core 54E9 amino acid residues of the interaction interface with ASGR-1 were defined as 54E9 residues that are within 5 Å of the ASGR-1 protein. The core 54E9 Heavy Chain residues include: N30, S31, Y32, S52, Y54, N55, K59, R98, D100, F101, W102, S103, G104, Y105, K107, D110; and the core 54E9 Light Chain residues include: none.

Boundary 54E9 amino acid residues of the interaction interface with ASGR-1 were defined as 54E9 residues that are 5-8 Å from the ASGR-1 protein. The boundary 54E9 Heavy Chain residues include: V2, Y27, T28, F29, G33, W50, A53, G56, N57, H99, Y106, G108; and the boundary 54E9 Light Chain residues include: N31, Y50, V51, Q54.

Methods:

The same methods were followed as described above in part B of this example except for the following changes:

1. The 54E9 Fab fragment was generated by cleaving the 54E9 mAb with caspase 3.

```
54E9 mAb Heavy Chain (SEQ ID NO: 32668):
QVQLVQSGAEVKKPGASVKVSCKASGYTFNSYGISWVRLAPGQGLEWMGW

ISAYNGNTKNAQKLQGRVTMTTDTSTSTAYMELRSLRSDDTAVYYCARHD

FWSGYYKGMDVWGQGTTVTVSSASTKGPSVFPLAPSSKSTSGGTAALGCL

VKDYFPEPVTVSWNSGALTSGVHTFPAVLQSSGLYSLSSVVTVPSSSLGT
```

-continued

QTYICNVNHKPSNTKVDKKVEPKSCGSDEVDGGDKTHTCPPCPAPELLGG

PSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTIS

KAKGQPREPQVYTLPPSREEMTKNQVSLTCLVKGFYPSDIAVEWESNGQP

ENNYKTTPPVLDSDGSFFLYSKLTVDKSRWQQGNVFSCSVMHEALHNHYT

QKSLSLSPGHHHHHH

54E9 mAb Light Chain (SEQ ID NO: 32669):
QSVLTQPPSASGTPGQRVTISCSGSNSNIGNNIVTWYQQLPGTAPKLLIY

VNDQRPSGVPDRFSGSKSGTSASLAISGLQSEDEADYYCAAWDDSLNGWV

FGGGTTLTVLGQPKAAPSVTLFPPSSEELQANKATLVCLISDFYPGAVTV

AWKADSSPVKAGVETTTPSKQSNNKYAASSYLSLTPEQWKSHRSYSCQVT

HEGSTVEKTVAPTECS

54E9 Fab Heavy Chain (Post-Cleavage) (SEQ ID NO: 32670):
QVQLVQSGAEVKKPGASVKVSCKASGYTFNSYGISWVRLAPGQGLEWMGW

ISAYNGNTKNAQKLQGRVTMTTDTSTSTAYMELRSLRSDDTAVYYCARHD

FWSGYYKGMDVWGQGTTVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKKVEP

KSCGSDEVD

54E9 Fab Light Chain (Post-Cleavage) (SEQ ID NO: 32671):
QSVLTQPPSASGTPGQRVTISCSGSNSNIGNNIVTWYQQLPGTAPKLLIY

VNDQRPSGVPDRFSGSKSGTSASLAISGLQSEDEADYYCAAWDDSLNGWV

FGGGTTLTVLGQPKAAPSVTLFPPSSEELQANKATLVCLISDFYPGAVTV

AWKADSSPVKAGVETTTPSKQSNNKYAASSYLSLTPEQWKSHRSYSCQVT

HEGSTVEKTVAPTECS

1. The 54E9 Fab/ASGR-1 CBD complex was concentrated to 14.8 mg/mL and crystallized with 0.2 M Magnesium Chloride hexahydrate, 20% PEG3350;
2. The dataset was processed with XDS/CCP4;
3. The 54E9 Fab/ASGR-1 CBD complex crystals grow in the 12 space group with unit cell dimensions a=64.66, b=41.65, c=224.59 Å and β=97.60° with one complex molecule per asymmetric unit, and diffract to 2.6 Å resolution;
4. The 54E9 Fab/ASGR-1 CBD complex structure was solved by molecular replacement with the program Phaser; and
5. The structure was improved with multiple rounds of model building with Coot[3] and refinement with Phenix[4], to a final R=19.1/$R_{free}$=25.9

I. Crystal Structure of ASGR-1 Carbohydrate Binding Domain (CBD) with 218G4

Figure 38:
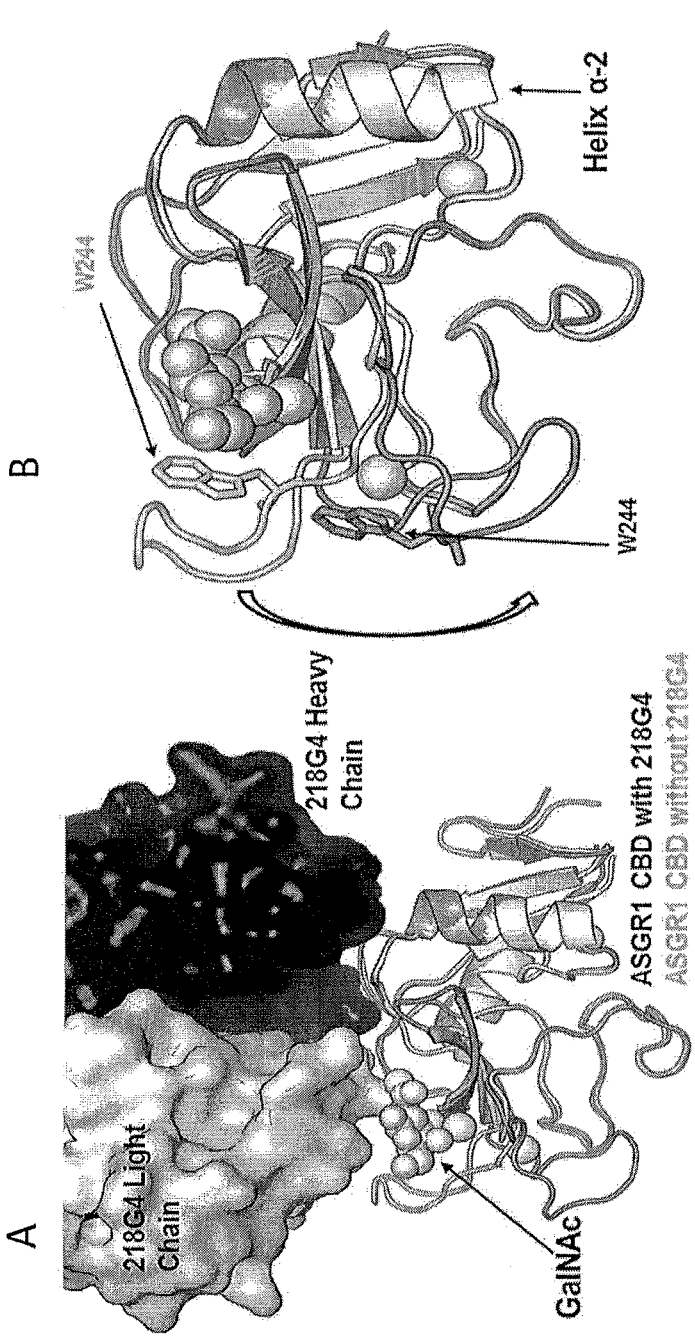
FIG. 38. Panels A and B are enlarged views of the structure of ASGR-1 CBD and the 218G4 Fab that also overlays the structure of ASGR-1 CBD and the ligand. These figures highlight the direct inhibition of ASGR-1 CBD and the ligand (GalNAc) binding when the 218G4 Fab is present.

The present example presents the crystal structure of the ASGR-1 CBD bound to the Fab fragment of 218G4, determined to 2.4 Å resolution (the conditions of which are described above in section B of this Example). This structure, depicted in FIGS. 37 and 38, shows that when 218G4 binds to/interacts with ASGR-1, it impairs its ability to bind to ligand (e.g., carbohydrate). This demonstrates that the 218G4 Fab directly inhibits the ASGR-1 CBD/Ligand binding.

The depicted structure also allows one to identify specific core ASGR amino acid residues for the interaction interface of 218G4 with ASGR-1. This was defined as residues that are within 5 Å of the 218G4 protein. The core residues are as follows: R170, S171, G172, A174, H204, I205, G206, P207, V208, N209, H257, D260, N265, D267, Q270, R271, P272, Y273, R274 (SEQ ID NO:5).

The structures were also used to identify boundary ASGR-1 amino acid residues for the interaction interface with 218G4. These residues were ASGR-1 residues that were from 5-8 Å of the 218G4 protein. The boundary residues are as follows: W167, F168, S169, K173, W175, D177, Y181, Q202, H203, T210, W211, R237, F258, T259, D261, D266, V268, C269, W275 (SEQ ID NO:5).

Specific core 218G4 amino acid residues of the interaction interface with ASGR-1 were defined as 218G4 residues that are within 5 Å of the ASGR-1 protein. The core 218G4 Heavy Chain residues include: Q1, V2, F27, S30, S31, Y32, Y53, D54, W99, Y100, Y101, Y102; and the core 218G4 Light Chain residues include: Y33, Y50, D51, N53, K54, S57.

Boundary 218G4 amino acid residues of the interaction interface with ASGR-1 were defined as 218G4 residues that are 5-8 Å from the ASGR-1 protein. The boundary 218G4 Heavy Chain residues include: G26, T28, F29, G33, W52, G55, R72, N74, N98, Y103, Y104, D107, V108; and the boundary 218G4 Light Chain residues include: V34, S52, R55, P56, G58, G65.

The coordinates for the ASGR-1 CBD/GalNAc crystal structure complex are presented in Table 10.3.

Methods:

The same methods were followed as described above in part B of this example except for the following changes:
1. The 218G4 Fab fragment was generated by cleaving the 218G4 mAb with caspase 3.

218G4 mAb Heavy Chain (SEQ ID NO: 32672):
QVQLVESGGGVVQPGRSLRLSCAASGFTFSSYGLHWVRQAPGKGLEWVAV

IWYDGSNKYYADSVKGRFTISRDNSKNTLYLQMNSLRVEDTAVYYCANWY

YYYYGMDVWGQGTTVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKKVEPKSCGSDEVDGGDKTHTCPPCPAPELLGGPSV

FLFPPKPKDTLMISRTPEVTCVVVDVSHEDPEVKFNWYVDGVEVHNAKTK

PREEQYNSTYRVVSVLTVLHQDWLNGKEYKCKVSNKALPAPIEKTISKAK

GQPREPQVYTLPPSREEMTKNQVSLTCLVKGFYPSDIAVEWESNGQPENN

YKTTPPVLDSDGSFFLYSKLTVDKSRWQQGNVFSCSVMHEALHNHYTQKS

LSLSPGHHHHHH

218G4 mAb Light Chain (SEQ ID NO: 32673):
QSVLTQPPSVSAAPGQKVTISCSGSSSNIGNNYVSWYQQLPGTAPKLLLY

DSNKRPSGIPARFSGSKSGTSATLGITGLQTGDEADYYCGTWDSSLNTVV

FGGGTKLTVLSQPKAAPSVTLFPPSSEELQANKATLVCLISDFYPGAVTV

AWKADSSPVKAGVETTTPSKQSNNKYAASSYLSLTPEQWKSHRSYSCQVT

HEGSTVEKTVAPTECS

218G4 Fab Heavy Chain (Post-Cleavage)(SEQ ID NO: 32674):
QVQLVESGGGVVQPGRSLRLSCAASGFTFSSYGLHWVRQAPGKGLEWVAV

```
-continued
IWYDGSNKYYADSVKGRFTISRDNSKNTLYLQMNSLRVEDTAVYYCANWY

YYYYGMDVWGQGTTVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKKVEPKSCGSDEVD

218G4 Fab Light Chain (Post-Cleavage):
Same sequence as 218G4 mAb Light chain
```

1. The 218G4 Fab/ASGR-1 CBD complex was concentrated to 16.4 mg/mL and crystallized with 0.1M Tris pH8 and 1.6M Lithium Sulfate;
2. The dataset was collected from a single crystal on beamline ID22 at the Argonne National Laboratory and processed with XDS/CCP4;
3. The 218G4 Fab/ASGR-1 CBD complex crystals grow in the C222 space group with unit cell dimensions a=137.24, b=245.26, c=118.91 Å with two complex molecules per asymmetric unit and diffract to 2.6 Å resolution;
4. The 218G4 Fab/ASGR-1 CBD complex structure was solved by molecular replacement with the program Phaser; and
5. The structure was improved with multiple rounds of model building with Coot[3] and refinement with Phenix[4], to a final $R_{factor}$=18.4/$R_{free}$=21.6

J. Crystal Structure of ASGR-1 Carbohydrate Binding Domain (CBD) with 176H4

Figure 39:
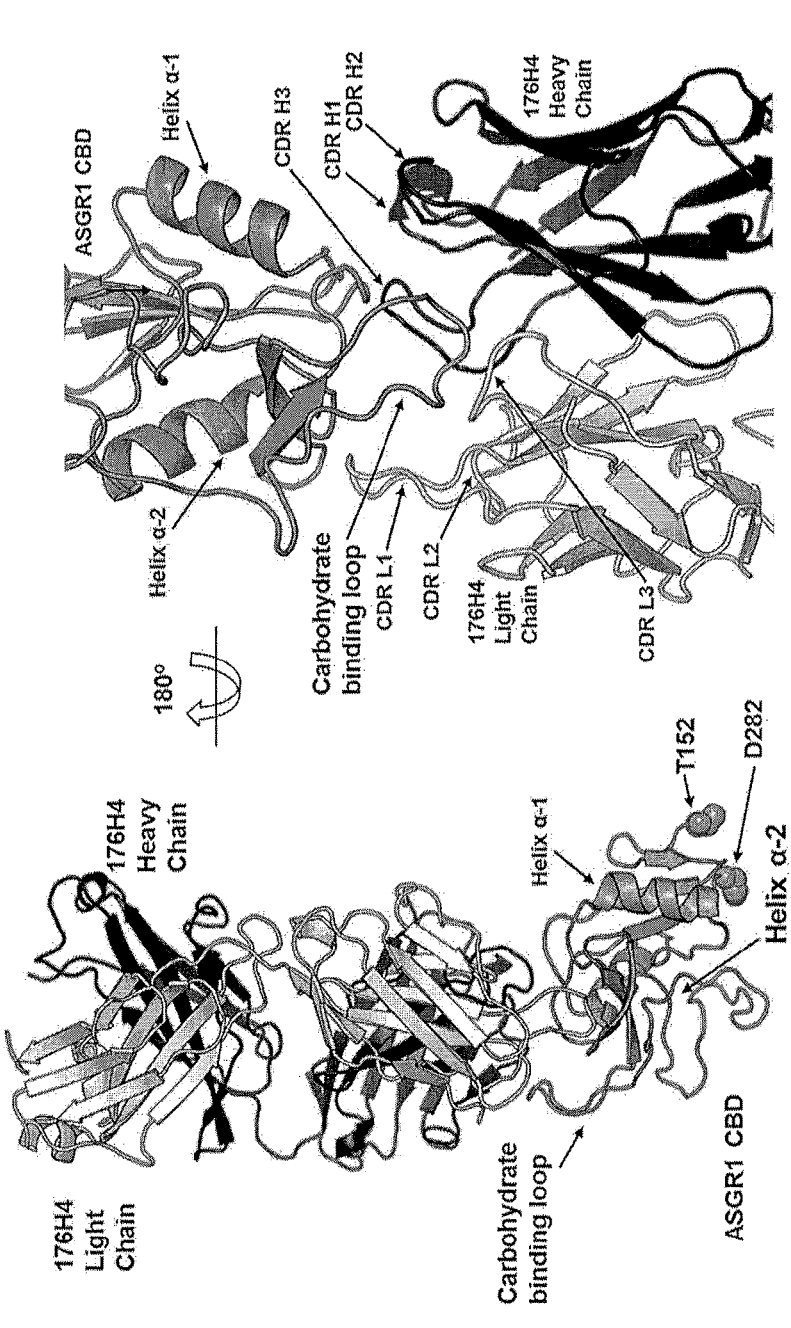
FIG. 39. A depiction of the structure of the ASGR-1 CBD and the 176H4 Fab.
Figure 40:
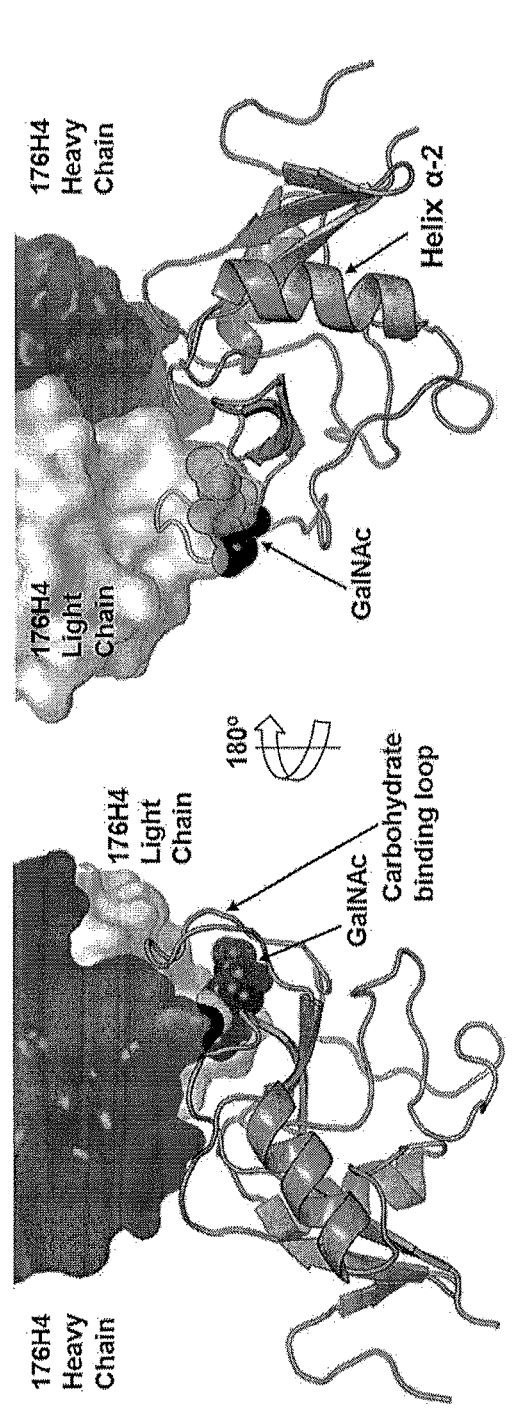
FIG. 40. An enlarged view of the structure of the ASGR-1 CBD and the 176H4 Fab that also overlays the structure of ASGR-1 CBD and the ligand. This figure highlight the direct inhibition of ASGR-1 CBD and the ligand (GalNAc) binding when the 176H4 Fab is present.

The present example presents the crystal structure of the ASGR-1 CBD bound to the Fab fragment of 176H5, determined to 2.3 Å resolution (the conditions of which are described above in section B of this Example). This structure, depicted in FIGS. 39 and 40, show that when 176H4 binds to/interacts with ASGR-1, it appears to block ligand (e.g., carbohydrate) binding by ASGR-1 CBD, with the paratope of the 176H4 antibody located directly on top of the carbohydrate binding pocket. This demonstrates that the 174H4 Fab directly inhibits the ASGR-1 CBD/Ligand binding.

The depicted structure also allows one to identify specific core ASGR amino acid residues for the interaction interface of 176H4 with ASGR-1. This was defined as residues that are within 5 Å of the 176H4 protein. The core residues are as follows: R170, S171, G172, K173, A174, D177, P207, V208, N209, R237, Q240, W244, G246, H247, G248, L249, E253, H257, T259, D260, N265, D267, Q270, R271, P272, Y273, R274 (SEQ ID NO:5).

The structures were also used to identify boundary ASGR-1 amino acid residues for the interaction interface with 176H4. These residues were ASGR-1 residues that were from 5-8 Å of the 176H4 protein. The boundary residues are as follows: S169, W175, A176, A178, T210, W211, W236, P238, E239, D242, Y245, G250, G251, F258, D261, G262, R263, W264, D266, V268, C269, W275 (SEQ ID NO:5).

Specific core 176H4 amino acid residues of the interaction interface with ASGR-1 were defined as 176H4 residues that are within 5 Å of the ASGR-1 protein. The core 176H4 Heavy Chain residues include: S31, W52, Y53, D54, Y57, Y59, D102, F103, W104; and the core 176H4 Light Chain residues include: H31, G32, D33, G34, K35, Y37, I97, Q98, I99.

Boundary 176H4 amino acid residues of the interaction interface with ASGR-1 were defined as 176H4 residues that are 5-8 Å from the ASGR-1 protein. The boundary 176H4 Heavy Chain residues include: T28, S30, Y32, G33, W47, I50, I51, S56, K58, Y60, K65, D99, H101, S105, G106; and the boundary 176H4 Light Chain residues include: I2, Q27, S28, L29, L30, T36, E55, Q95, S96, P100, W101.

Methods:

The same methods were followed as described above in part B of this example except for the following changes:
1. The 176H4 Fab fragment was generated by cleaving the 176H4 mAb with caspase 3.

```
176H4 mAb Heavy Chain (SEQ ID NO: 32675):
QVQLVESGGGVVQPGRSLRLSCAASGFTFSSYGMHWVRQAPGKGLEWVAI

IWYDGSYKYYADSVKGRFTISRDNSKNTLYLQMSSLRAEDTAVYYCARDA

HDFWSGYFAYWGQGALVTVSSASTKGPSVFPLAPSSKSTSGGTAALGCLV

KDYFPEPVTVSWNSGALTSGVHTFPAVLQSSGLYSLSSVVTVPSSSLGTQ

TYICNVNHKPSNTKVDKKVEPKSCGSDEVDGGDKTHTCPPCPAPELLGGP

SVFLFPPKPKDTLMISRTPEVTCVVVDVSHEDPEVKFNWYVDGVEVHNAK

TKPREEQYNSTYRVVSVLTVLHQDWLNGKEYKCKVSNKALPAPIEKTISK

AKGQPREPQVYTLPPSREEMTKNQVSLTCLVKGFYPSDIAVEWESNGQPE

NNYKTTPPVLDSDGSFFLYSKLTVDKSRWQQGNVFSCSVMHEALHNHYTQ

KSLSLSPGHHHHHH

176H4 mAb Light Chain (SEQ ID NO: 32676):
DIVMTQTPLSLSVTPGQPASISCKSSQSLLHGDGKTYLYWYLQKPGQPPQ

LLIYEVSNRFSGVPDRFSGSGSGTDFTLKISRVEAEDVGIYYCMQSIQIP

WTFGQGTRVEIKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC

176H4 Fab Heavy Chain (Post-Cleavage) (SEQ ID NO:
32677):
QVQLVESGGGVVQPGRSLRLSCAASGFTFSSYGMHWVRQAPGKGLEWVAI

IWYDGSYKYYADSVKGRFTISRDNSKNTLYLQMSSLRAEDTAVYYCARDA

HDFWSGYFAYWGQGALVTVSSASTKGPSVFPLAPSSKSTSGGTAALGCLV

KDYFPEPVTVSWNSGALTSGVHTFPAVLQSSGLYSLSSVVTVPSSSLGTQ

TYICNVNHKPSNTKVDKKVEPKSCGSDEVD

176H4 Fab Light Chain (Post-Cleavage):
Same sequence as 176H4 mAb Light chain
```

1. The 176H4 Fab/ASGR-1 CBD complex was concentrated to 14.9 mg/mL and crystallized 1 with 0.2 M Sodium Nitrate, 20% PEG3350;
2. The dataset was collected from a single crystal on beamline ID22 at the Argonne National Laboratory and processed with XDS/CCP4;
3. The 176H4 Fab/ASGR-1 CBD complex crystals grow in the I121 space group with unit cell dimensions a=68.31, b=126.31, c=134.13 Å and β=101.6° with two complex molecules per asymmetric unit, and diffract to 2.3 Å resolution;
4. The 176H4 Fab/ASGR-1 CBD complex structure was solved by molecular replacement with the program Phaser; and
5. The structure was improved with multiple rounds of model building with Coot[3] and refinement with Phenix[4], to a final $R_{factor}$=17.9/$R_{free}$=23.3

K. Crystal Structure of ASGR-1 Carbohydrate Binding Domain (CBD) with 194C10

Figure 41:
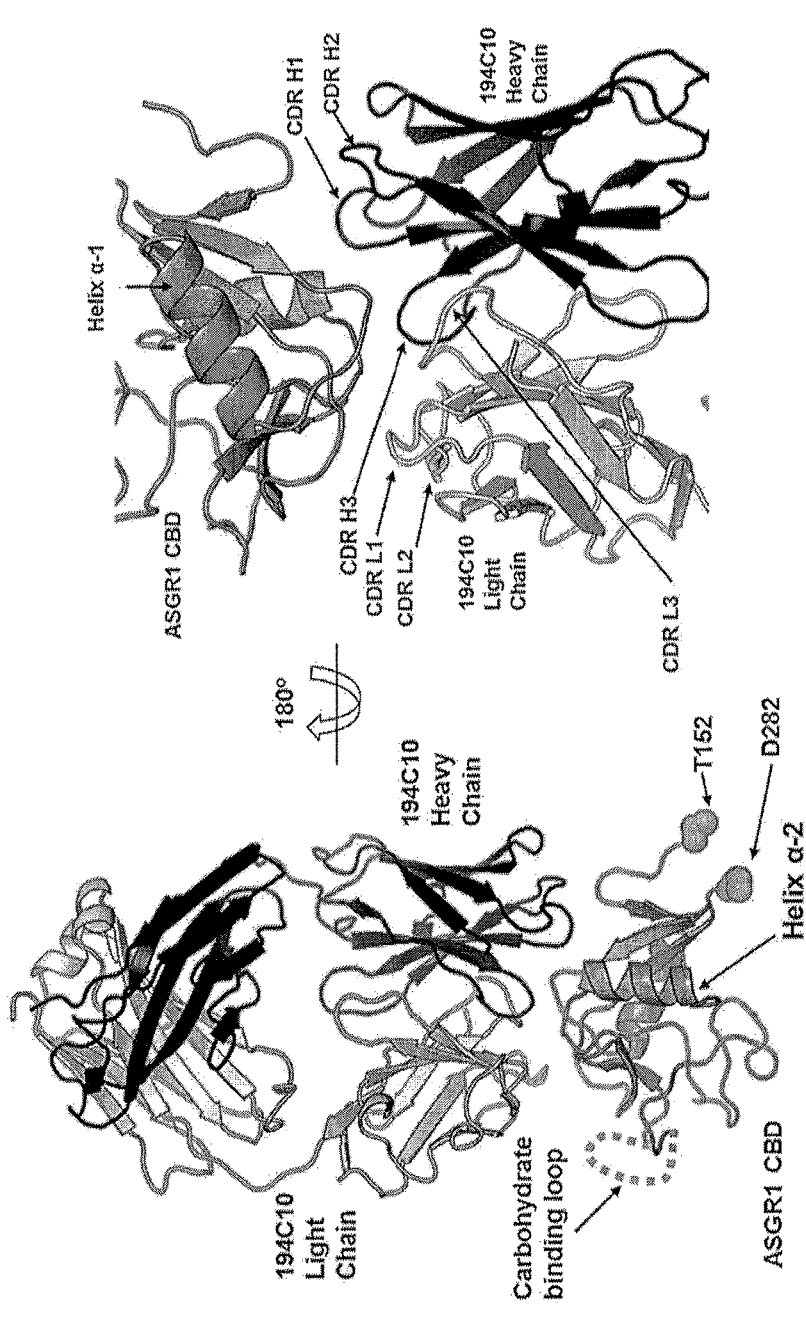
FIG. 41. A depiction of the structure of the ASGR-1 CBD and the 194C10 Fab. This figure depicts represents a disordered carbohydrate binding loop with a dashed line and highlights possible indirect inhibition of ASGR-1 CBD and the ligand (GalNAc) binding.
Figure 42:
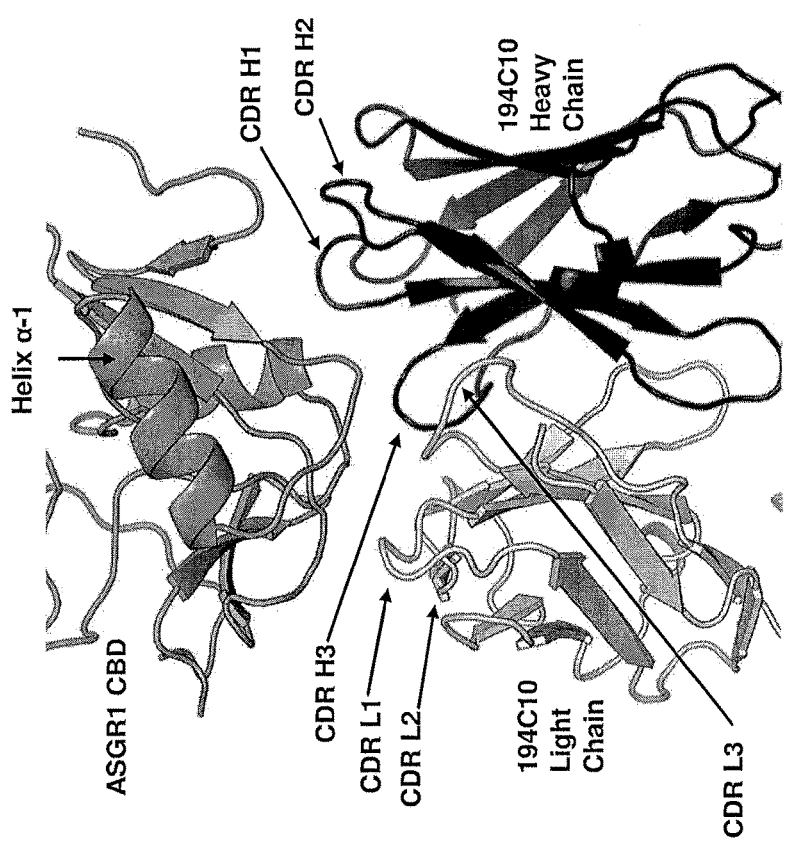
FIG. 42. An enlarged view of the structure of the ASGR-1 CBD and the 194C10 Fab. This figure shows the CDRs of the 194C10 that interact with the ASGR-1 CBD and highlights that there may be direct inhibition of the ASGR-1 CBD and the ligand (GalNAc) binding.

The present example presents the crystal structure of the ASGR-1 CBD bound to the Fab fragment of 194C10, determined to 2.6 Å resolution (the conditions of which are described above in section B of this Example). This structure, depicted in FIGS. 41 and 42, shows that when 194C10 binds to/interacts with ASGR-1, it likely induces a conformational rearrangement of the carbohydrate binding loop, impairing ASGR-1 CBD from binding to ligand (e.g., carbohydrate), as well as possibly blocking the ligand (e.g., carbohydrate) binding by ASGR-1 CBD, with the paratope of the 194C10 Fab. These data indicate that the 174H4 Fab may directly and/or indirectly inhibit the ASGR-1 CBD/ Ligand binding.

The depicted structure also allows one to identify specific core ASGR amino acid residues for the interaction interface of 194C10 with ASGR-1. This was defined as residues that are within 5 Å of the 194C10 protein. The core residues are as follows: N157, R170, S171, G172, Q202, H203, H204, I205, G206, P207, V208, N209, T210, D260, R271, P272, Y273, R274 (SEQ ID NO:5).

The structures were also used to identify boundary ASGR-1 amino acid residues for the interaction interface with 194C10. These residues were ASGR-1 residues that were from 5-8 Å of the 194C10 protein. The boundary residues are as follows: V156, W158, V159, H161, W167, F168, S169, K173, K199, F200, V201, W211, R237, H257, F258, T259, D261, D267, V268, Q270, W275 (SEQ ID NO:5).

Specific core 194C10 amino acid residues of the interaction interface with ASGR-1 were defined as 194C10 residues that are within 5 Å of the ASGR-1 protein. The core 194C10 Heavy Chain residues include: R30, Y31, Y33, E50, S54, S56, N58, D98, Y99, G100; and the core 194C10 Light Chain residues include: N30, S31, Y33, F50, S54, S68, Y92, E93, W97.

Boundary 194C10 amino acid residues of the interaction interface with ASGR-1 were defined as 194C10 residues that are 5-8 Å from the ASGR-1 protein. The boundary 194C10 Heavy Chain residues include: S28, Y32, W34, S35, W47, G49, I51, S52, H53, G55, T57, R97, A101, F102, D103; and the boundary 194C10 Light Chain residues include: S28, V29, G32, L47, G51, A52, S53, R55, A56, G69, Q90, Q91, S94, S95.

The coordinates for the ASGR-1 CBD/GalNAc crystal structure complex are presented in Table 10.4.

Methods:

The same methods were followed as described above in part B of this example except for the following changes:

1. 194C10 Fab fragment was generated by cleaving the 194C10 mAb with caspase 3.

```
194C10 mAb Heavy Chain (SEQ ID NO: 32678):
QVQLQQWGAGLLKPSETLSLTCAVSGGSFRYYYWSWIRQPPGKGLEWFGE

INHAGSTNYNPSLKSRVTISIDTSKNQFSLKLRSVTAADTAVYYCARDYG

AFDIWGQGTMVTVSSASTKGPSVFPLAPSSKSTSGGTAALGCLVKDYFPE

PVTVSWNSGALTSGVHTFPAVLQSSGLYSLSSVVTVPSSSLGTQTYICNV

NHKPSNTKVDKKVEPKSCG

194C10 mAb Light Chain (SEQ ID NO: 32679):
EIVLTQSPGTLSLSPGERATLSCRASPSVNSGYLAWYQQKPGQTPRLLIF

GASSRATGIPDRFSASGSGADFTLTISRLEPEDFAVYFCQQYESSPWTFG

QGTKVEIKRTVAAPSVFIFPPSDEQLKSGTASVVCLLNNFYPREAKVQWK

VDNALQSGNSQESVTEQDSKDSTYSLSSTLTLSKADYEKHKVYACEVTHQ

GLSSPVTKSFNRGEC*
```

```
194C10 Fab Heavy Chain (Post-Cleavage) (SEQ ID NO:
32680):
QVQLQQWGAGLLKPSETLSLTCAVSGGSFRYYYWSWIRQPPGKGLEWFGE

INHAGSTNYNPSLKSRVTISIDTSKNQFSLKLRSVTAADTAVYYCARDYG

AFDIWGQGTMVTVSSASTKGPSVFPLAPSSKSTSGGTAALGCLVKDYFPE

PVTVSWNSGALTSGVHTFPAVLQSSGLYSLSSVVTVPSSSLGTQTYICNV

NHKPSNTKVDKKVEPKSCGSDEVD

194C10 Fab Light Chain (Post-Cleavage):
```

Same sequence as 194C10 mAb Light chain

1. The 194C10 Fab/ASGR-1 CBD complex was concentrated to 13.6 mg/mL and crystallized with 0.2 M Ammonium Sulfate, 0.1 M Tris pH7.5, 20% PEG5000MME;

2. The dataset was collected from a single crystal on beamline ID22 at the Argonne National Laboratory and processed with XDS/CCP4;

3. The 194C10 Fab/ASGR-1 CBD complex crystals grow in the P12$_1$1 space group with unit cell dimensions a=65.62, b=130.44, c=85.93 Å and β=111.6° with two complex molecules per asymmetric unit, and diffract to 2.6 Å resolution;

4. The 194C10 Fab/ASGR-1 CBD complex structure was solved by molecular replacement with the program Phaser; and 5. The structure was improved with multiple rounds of model building with Coot[3] and refinement with Phenix[4], to a final $R_{factor}$=17.1/$R_{free}$=22.8.

L. Interaction Between GalNAc, ASGR-1 and Certain Antibodies

The structure of the 72G9/ASGR-1 complex (Item G above) was overlaid on the ASGR-1/ligand (GalNac) structure (Item A above) and the result of this combination is depicted in FIG. 31B. The structure of the 54E9/ASGR-1 complex (Item I above) was also overlaid on the ASGR-1/ ligand (GalNac) structure (Item A above) and the result of this combination is depicted in FIG. 35B. The structure of the 218G4/ASGR-1 complex (Item J above) was overlaid on the ASGR-1/ligand (GalNAc) structure (Item A above) and the result of this combination is depicted in FIG. 38. The structure of the 176H4/ASGR-1 complex (Item K above) was overlaid on the ASGR-1/ligand (GalNAc) structure (Item A above) and the result of this combination is depicted in FIG. 40. These figures demonstrate areas on ASGR-1 which can be usefully targeted to inhibit ASGR-1 interaction with a ligand, e.g., GalNac. These figures show that 72G9, 54E9, 218G4 and 176H4 directly interact with a subset of amino acid residues that are specifically involved in binding to the ligand (e.g., GalNAc).

As noted above, analysis of the crystal structures identified specific amino acids involved in the interaction between ASGR-1 and the partner proteins (the core and boundary regions of the interface on the ASGR-1 surface) and the spatial requirements of these partner proteins to interact with ASGR-1. The structures suggest ways to inhibit the interaction between ASGR-1 and a ligand, GalNAc. First, as noted above, binding an agent to ASGR-1 where it shares residues in common with the binding site of a ligand such as GalNAc would inhibit the interaction between ASGR-1 and the ligand. Second, an agent that binds outside of the residues in common can sterically interfere with the ligand that are either N- or C-terminal to the ligand to prevent the interaction between ASGR-1 and a ligand.

In some embodiments, the residues that are involved in both ligand binding and are close to the areas where the above noted antigen binding proteins bind are especially useful for manipulating ASGR-1 binding to ligand. For example, amino acid residues from interfaces in common in both the core region and boundary region for the different binding partners are listed in Table 10.5 below.

TABLE 10.5

| Parameters | Amino acid position(s) |
|---|---|
| 72G9/GalNAc both under 5 Å | Q240, D242, W244 |
| 72G9 under 5 Å/GalNAc 5-8 Å | E239, P241, D243, Y245, G246, G252 |
| 72G9 at 5-8 Å/GalNAc under 5 Å | R237, E253 |
| 72G9/GalNAc both at 5-8 Å | P238, H247, C255, V268 |
| 54E9/GalNAc both under 5 Å | N209, R237, Q240, D242, H257, T259, N265, D267, Y273 |
| 54E9 under 5 Å/GalNAc 5-8 Å | P238, E239, D260, R263, R271 |
| 54E9 at 5-8 Å/GalNAc under 5 Å | E253, D266 |
| 54E9/GalNAc both at 5-8 Å | D243, F258, W264 |
| 218G4/GalNAc both under 5 Å | N209, H257, N265, D267, Y273 |
| 218G4 under 5 Å/GalNAc 5-8 Å | D260, R271 |
| 218G4 at 5-8 Å/GalNAc under 5 Å | R237, T259, D266 |
| 218G4/GalNAc both at 5-8 Å | F258, V268 |
| 176H4/GalNAc both under 5 Å | N209, R237, Q240, W244, E253, H257, T259, N265, D267, Y273 |
| 176H4 under 5 Å/GalNAc 5-8 Å | G246, H247, D260, R271 |
| 176H4 at 5-8 Å/GalNAc under 5 Å | D266 |
| 176H4/GalNAc both at 5-8 Å | P238, E239, Y245, F258, R263, W264, V268 |

As will be appreciated by one of skill in the art, in some embodiments, the antigen binding proteins bind to and/or block at least one of the above noted residues.

Antigen binding proteins and molecules that interact with the relevant areas or residues of the structure of ASGR-1 (including those areas or residues within 15, 15-8, 8, 8-5, 5, or fewer angstroms from where ligands, such as GalNAc, or the antibodies, interact with ASGR-1) depicted in the figures (e.g., FIGS. 19-42) and/or their corresponding positions on the structures from the coordinates are also contemplated.

Example 11: Determination of the Binding Affinity of ASGR-1 Specific Antibodies To quantitate the binding affinity of specific antibodies for ASGR-1 (either purified from hybridoma supernatants or made recombinantly), association and dissociation rates can be measured using a ForteBio Octet instrument. The antibodies were covalently coupled to AR2G tips to load levels close to 2 nm and then bound to the soluble human ASGR-1 carbohydrate binding domain (CBD; amino acid residues 154-281; N-terminal 6×His tag) in a 3-fold serial dilution series starting typically at 30 nM with either 3-point or 6-point dilution series. Experimental kinetic results were globally fit to a 1:1 binding model in order to determine the association and dissociation rate constants as well as the equilibrium dissociation constant. Association and dissociation times were chosen to ensure that curvature was present during association curves and measured dissociation levels dropped at least 5% from starting levels. All Octet buffers contained 10 mM Tris (pH7.5), 150 mM NaCl, 1 mM $CaCl_2$, 0.10 mg/ml BSA and 0.13% Triton X-100. Octet assays were run at 27° C. Because this assay only measures binding to the ASGR-1 CBD, antibodies that recognize epitopes partially or entirely outside the CBD and/or recognize ASGR-1 in the context of a native ASGR complex, for example, as could occur on cell membranes, may not score as positive in this assay. Data provided for representative antibodies in TABLE 11.1.

TABLE 11.1

| Ab name | Octet binding $K_D$ (nM) | Ab name | Octet binding $K_D$ (nM) |
|---|---|---|---|
| 4H6 | 4.8 | 194A4 | 0.7 |
| 4B1 | >30 | 194C1 | 1.3 |
| 4A2 | 0.06 | 194C10 | 4 |
| 5E5 | 7.6 | 197G3 | 0.8 |
| 6G7 | 2.0 | 198D2 | >30 |
| 7G4 | 0.9 | 198G3 | 0.04 |
| 7F4 | 1.2 | 202A3 | >30 |
| 7E11 | 1.6 | 218G4 | 2.6 |
| 12D2 | >30 | 4A2.001 | 0.06 |
| 22G5 | 1.4 | 4A2.001.003 | 0.04 |
| 25A4 | 0.03 | 4A2.001.004 | 0.03 |
| 26C4 | 0.4 | 4A2.001.005 | 0.02 |
| 29H8 | 1.0 | 4A2.001.010 | 0.04 |
| 48B12 | 0.3 | 4A2.001.012 | 0.04 |
| 54E9 | >30 | 25A4.001 | 0.06 |
| 56E5 | 0.5 | 25A4.001.021 | 0.04 |
| 72G9 | 0.5 | 4H6.009 | 0.28 |
| 75G3 | 1.0 | 7E11.001 | 0.71 |
| 176H4 | 0.8 | 7E11.001.005 | 0.42 |
| 184E7 | 0.3 | 7E11.001.007 | 0.62 |
| 190F8 | 0.6 | 5E5.016 | 1.46 |
| 191G1 | 2.4 | 5E5.019 | 1.80 |
| 191G10 | 0.5 | 5E5.005 | 2.00 |
| 193E7 | 3.5 | | |

Example 12: CHO—S:huASGR-1 Cell Binding Assay

CHO—S stable high-expressing cell line were developed for both human ASGR-1 as well as mouse ASGR-1. A typical 384 well plate multiplex flow cytometery-based cell binding method is described as followed: Parental CHO—S cells and CHO—S:huASGR-1 cells were respectively labeled using a CellTrace CFSE Cell Proliferation Kit (ThermoFisher Catalog #C34554) and CellTrace Violet Cell Proliferation Kit (ThermoFisher Catalog#C34557) CHO—S:muASGR-1 were not labeled. 20 ul of cells at 4 C were added to duplicate wells of the 384 well plate. The cells were equally mixed from all three cell lines (30K cells/well). Then 20 ul of the ASGR-1 antibodies (either purified from hybridoma supernatants or made recombinantly) were added in an 11-point dose response using a 1:2 fold serial dilution starting at 100 nM. The cells and antibodies were incubated for 30 min at 4 C and then spun down and washed twice with FACS buffer containing 1 mM CaCl2. 30 ul of anti-huIgG-APC secondary antibodies were then added at a 1:1000 dilution) for 30 min at 4 C and then washed once with the same buffer. 60 ul of PI (1:1000) was added and then the cells were read by a core flow cytometry facility. The cells were gated first for live cells, then for single cells and finally for the cell dyes to separate the mixed cells into the three different cell populations. Histograms of signal vs count representing the binding profile of each antibody at each antibody concentration were automatically analyzed for the median of the binding signal and then a binding graph was made with log 10 antibody concentration in nM on the X axis with standard deviation of the median signals from the duplicate wells on the Y-axis. The binding curves were fit with a standard four parameter sigmoidal binding curve and EC50's reported for all graphs with full curves. Data provided for representative antibodies in TABLE12.1.

TABLE 12.1

| Ab name | Cell binding EC50 (nM) | Ab name | Cell binding EC50 (nM) |
|---|---|---|---|
| 4H6 | 1.70 | 56E5 | 1.1 |
| 4B1 | 4.1 | 72G9 | 0.41 |
| 4A2 | 0.82 | 75G3 | 1 |
| 4A2.001 | 1.8 | 176H4 | 1 |
| 5E5 | 3.80 | 184E7 | 1 |
| 6G7 | 0.6 | 190F8 | 9 |
| 7G4 | 0.69 | 191G1 | 0.16 |
| 7F4 | 5.40 | 191G10 | 0.31 |
| 7E11 | 1.40 | 193E7 | 0.13 |
| 7E11.001 | 3.2 | 194A4 | 25 |
| 12D2 | 3.2 | 194C1 | 0.11 |
| 22G5 | 7.2 | 194C10 | 0.56 |
| 25A4 | 1.6 | 197G3 | 0.25 |
| 25A4.001 | 1.2 | 198D2 | 0.14 |
| 26C4 | 11 | 198G3 | 0.21 |
| 29H8 | 1.9 | 202A3 | 0.8 |
| 48B12 | 38 | 218G4 | 2.2 |
| 54E9 | 5 | | |

Figure 43:
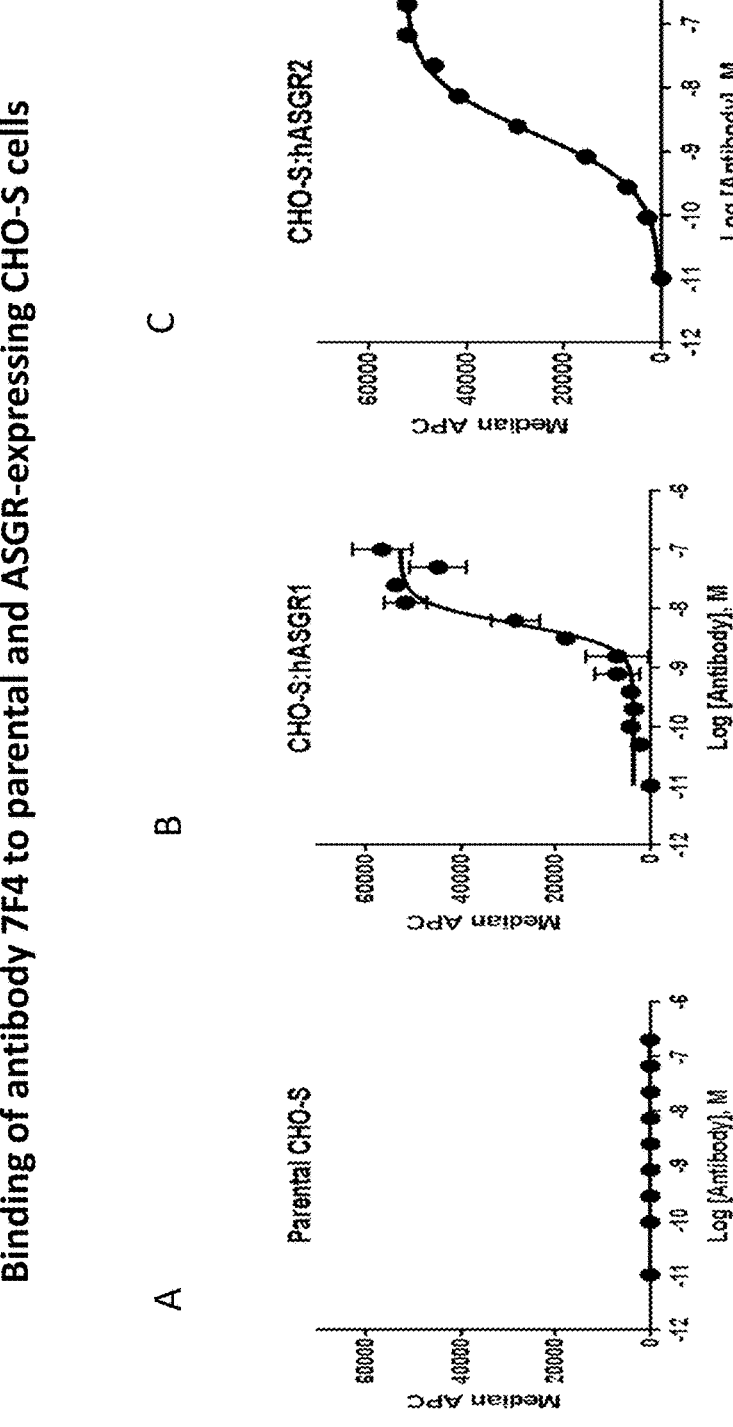
FIG. 43. Panels A-C are graphical representations showing antibody binding results from human ASGR-1 and human ASGR-2 expressing cells.
Figure 44:
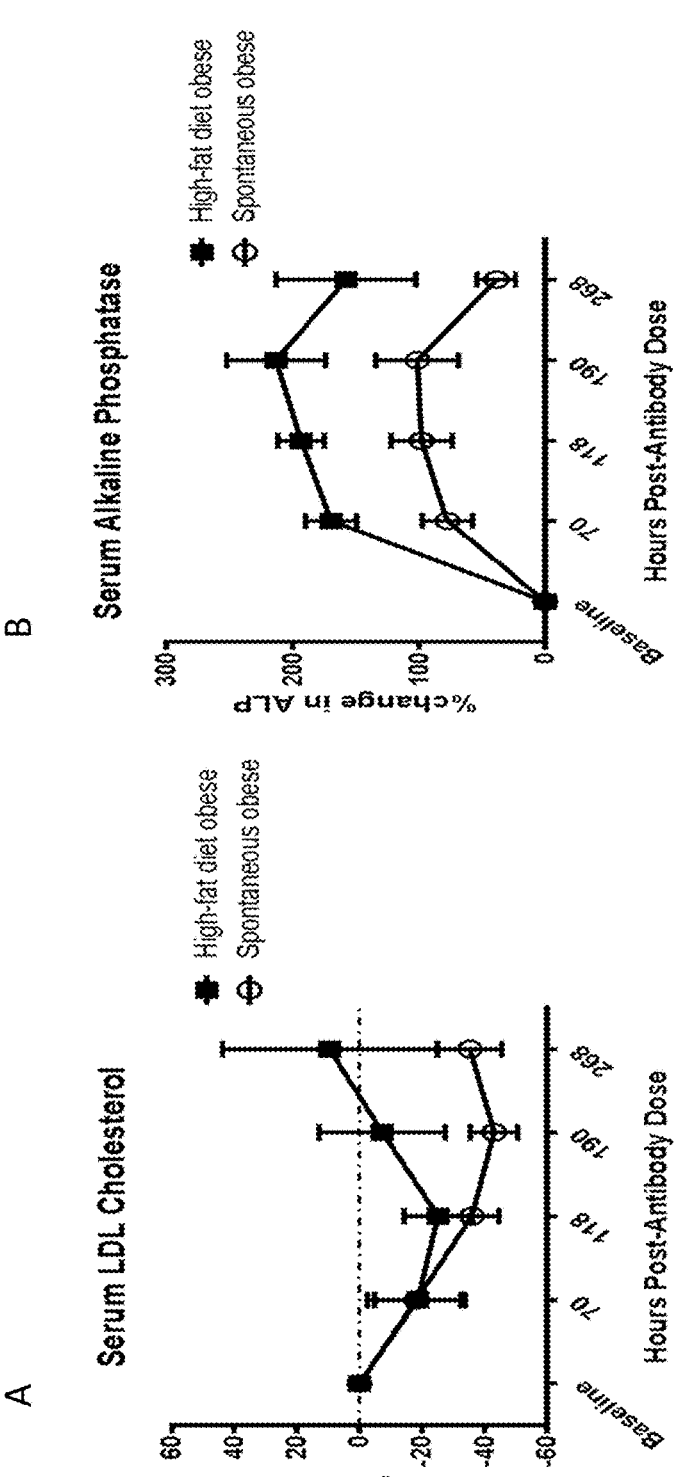
FIG. 44. Panel A is a graphical representation of the effect of ASGR-1 antibody, 4A2, on serum LDL cholesterol levels in obese cynomologous monkeys. Panel B is a graphical representation of the effect of ASGR-1 antibody, 4A2, on serum alkaline phosphatase levels in obese cynomologous monkeys. Data is expressed in the % change from baseline.
Figure 45:
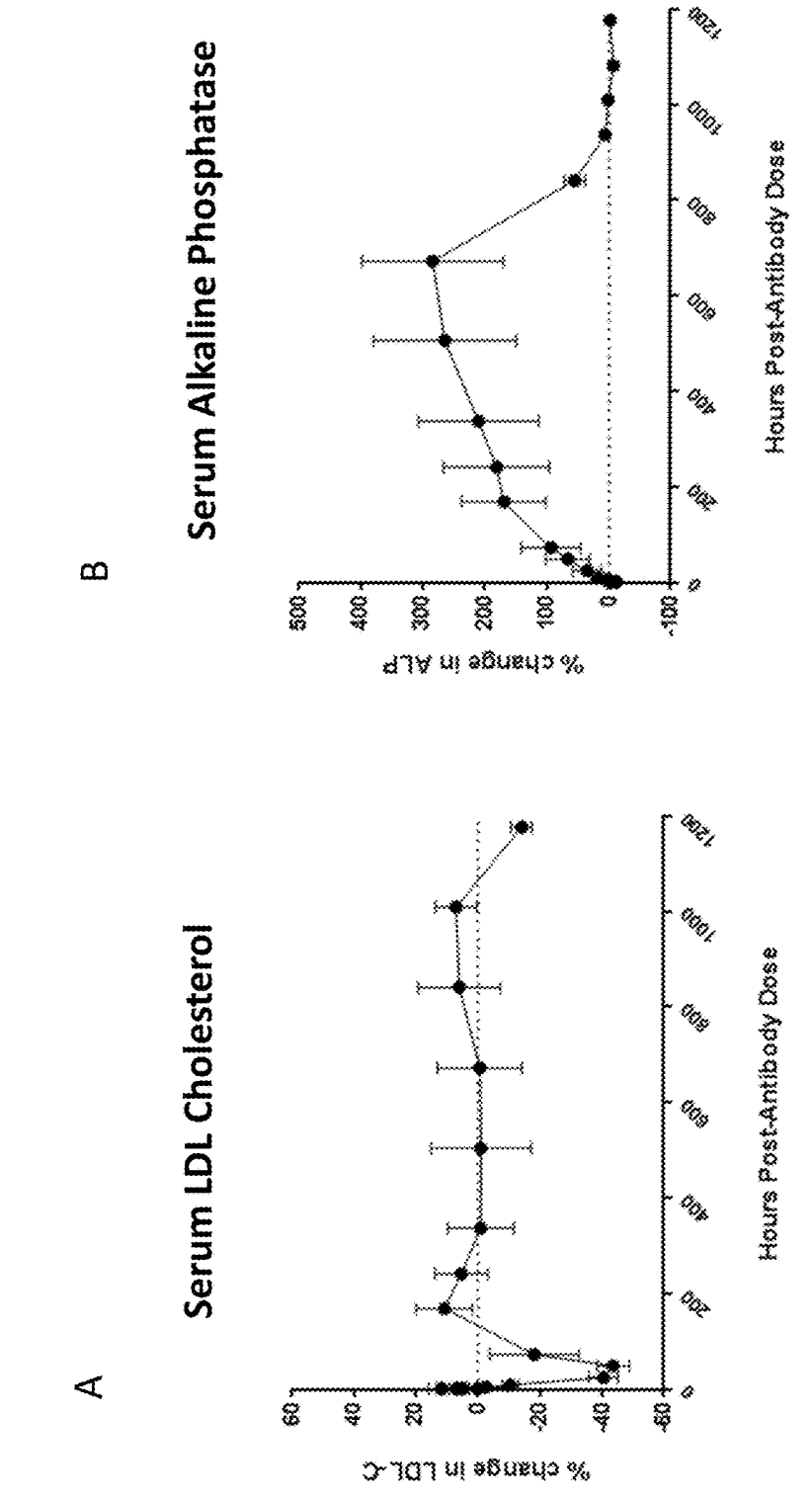
FIG. 45. Panel A is a graphical representation of the effect of ASGR-1 antibody, 4A2, on serum LDL cholesterol levels in normal cynomologous monkeys. Panel B is a graphical representation of the effect of ASGR-1 antibody, 4A2, on serum alkaline phosphatase levels in normal cynomologous monkeys. Data is expressed in the % change from baseline.

For human ASGR-2, CHO—S stable cells expressing C-terminal His-tagged human ASGR-2 were resuspended in cold flow buffer (10 mM Tris, pH 7.5, 137 mM NaCl, 1 mM CaCl2 and 2% fetal bovine serum) and 1.5×10e6 cells per well were added to a 96-well, v-bottom plate in a volume of 80 ul. 80 ul of antibody at 400 nM was then added to each well. After incubation on ice for 30 min, the cells were centrifuged at 1400 rpm for 3 min and then washed twice in cold flow buffer. The cells were then resuspended in 120 ul of anti-human IgG-APC (diluted 1:1000 in flow buffer) and incubated on ice for 30 minutes, centrifuged and washed twice as before, and resuspended in 200 ul cold flow buffer, and then analyzed on a BD-LSR II flow cytometer. Data provided for antibody 7F4 in FIG. 43.

Example 13: CHO—S:huASGR-1 Ligand Blocking Assay

All ASGR-1 antibodies that bound either human or mouse ASGR-1 stable CHO—S cells were then tested for ligand blocking using both a protein ligand and a synthetic sugar ligand. The method in brief is as follows: first, 20 ul of either CHO-Shuman or mouse ASGR-1 cells were added to wells of a 384 well plate (30 k cells/well) followed by spin and discarding the supernatant. Second, 10 ul of the antibodies (either purified from hybridoma supernatants or made recombinantly) were added in duplicate to the cells in a dilution series (200 nM top concentration, 1:2 serial dilution, 11 point curve) and were incubated for 30 min at 4 C. Third, 10 ul of the minimally biotinylated ligands were added at 2× their binding EC05, so that the wells contained a final 20 ul volume with Ab starting at 100 nM and the ligand at their EC50. After 30 min incubation at 4 C, the plate was spun and washed twice with FACS buffer+1 mM CaCl2 followed by the detection streptavidin-AF647 at 1:1000 dilution. After 30 min at 4 C, the cells were spun and washed once and then 60 ul PI added at 1:1000 dilution and the plates delivered to a core flow cytometry facility. The plates were read and processed similarly to the cell binding method except the signal now represents an inhibition curve and typically decreases a function of increasing antibody concentration. IC50 nM potency and % Inhibition were reported. The desialylated, biotinylated asialofetuin (see Example 9A) and biotinylated GALNAc-PAA (Fisher #NC9024754) were used as ligands with measured binding EC50s of 10.7 and 5.4 nM. Differences in the ability of antibodies to block these two ligands could occur as a result of differences in, for example, avidity stemming from differences in the number and/or orientation of the ASGR binding terminal sugar residues of each ligand, steric hindrance between antibody and each ligand, and/or changes in the conformation of ASGR induced by antibody binding that selectively alters the binding of each ligand. Data provided for representative antibodies in TABLE 13.1.

TABLE 13.1

| | Ligand Blocking | | | |
|---|---|---|---|---|
| | bn-GalNAc-PAA | | bn-asialofetuin | |
| Ab name | IC50 (nM) | % Inhibition | IC50 (nM) | % Inhibition |
| 4H6 | 8.1 | 20% | 12 | 85% |
| 4B1 | 42 | 36% | 64 | 75% |
| 4A2 | 54 | 70% | 11 | 99% |
| 4A2.001 | 28 | 75 | 12 | 99 |
| 5E5 | >200 | 0% | 16 | 95% |
| 6G7 | >200 | 0% | 11 | 99% |
| 7G4 | 20 | −30% | 14 | 96% |
| 7F4 | 0.24 | 30% | 2.6 | 99% |
| 7E11 | 40 | 37% | 13 | 99% |
| 7E11.001 | >100 | 50 | 13 | 99 |
| 12D2 | 2.1 | 10% | 10 | 20% |
| 22G5 | 11 | 93% | 3.4 | 99% |
| 25A4 | 40 | 77% | 11 | 99% |
| 25A4.001 | 31 | 68 | 8.1 | 99 |
| 26C4 | 36 | 83% | 6.6 | 99% |
| 29H8 | 17 | 99% | 7 | 99% |
| 48B12 | 86 | 94% | 19 | 99% |
| 54E9 | 100 | 19% | 50 | 75% |
| 56E5 | 45 | 99% | 23 | 99% |
| 72G9 | 24 | 20% | 53 | 20% |
| 75G3 | 115 | 99% | 29 | 99% |
| 176H4 | 73 | 79% | 59 | 99% |
| 184E7 | 10 | 99% | 23 | 99% |
| 190F8 | 44 | 83% | 34 | 98% |
| 191G1 | 62 | 78% | 24 | 99% |
| 191G10 | 56 | 99% | 27 | 99% |
| 193E7 | 33 | 60% | 30 | 99% |
| 194A4 | 48 | 60% | 57 | 99% |
| 194C1 | 72 | 89% | 34 | 99% |
| 194C10 | 87 | 99% | 30 | 99% |
| 197G3 | 15 | 74% | 29 | 90% |
| 198D2 | 55 | 99% | 22 | 99% |
| 198G3 | 5 | 81% | 26 | 99% |
| 202A3 | 32 | 96% | 16 | 98% |
| 218G4 | 71 | 99% | 28 | 99% |

Example 14: ASGR-1 Specific Antibody Optimization (Chemical Degradation Site Engineering)

Variable domain sequence motifs having a high risk of sidechain degradation were engineered out of ASGR-1 specific antibodies. See for example, ASGR-1 specific antibody sequences in Tables 6 and 7.

Certain high risk motifs included: (1) CDR 'NG' and 'NT' sequences prone to asparagine deamidation, (2) CDR 'DG,' 'DH', 'DS,' and 'DT' sequences prone to aspartic acid isomerization, (3) and CDR3 tryptohphans prone to oxidation. Bioinformatics and structural analyses were used to identify substitutions likely to retain binding affinity to the ASGR-1 CBD. Typically, substitution identities were derived from germline sequences or from sequence-related ASGR-1 CBD-binding mAbs. These substitutions were then modeled into a homology model of the unbound mAb using the software MOE (CCG)[1] to predict structural fitness. For cases in which the bioinformatics or structural analyses did not provide a clear substitution identity, residue types chemically similar to the parent residue were identified.

Variable domain sequence motifs violating multiple sequence alignment-based pair-wise residue covariance trends[2] were also engineered out of ASGR-1 specific antibodies. Substitution identities for covariance violators were identified using a hybrid bioinformatics/structural approach similar to that used to remediate degradation sites.

1. *Molecular Operating Environment* (*MOE*), 2013.08; Chemical Computing Group, Inc., 1010 Sherbooke St. West, Suit #910, Montreal, QC, Canada, H3A 2R7, 2016.
2. Kannan, G. *Method of Correlated Mutational Analysis to Improve Therapeutic Antibodies*. US Patent Application PCT/US2012/028596 filed Mar. 9, 2012.

Example 15: Epitope Mapping Using Peptide Arrays

Custom peptide microarrays were obtained commercially (PEPperPRINT GmbH). For epitope mapping using linear arrays, the antigen (ASGR-1) was translated into 291 different overlapping 15 amino acid (aa) peptides printed in duplicate (582 peptide spots per array copy). For epitope mapping using cyclized arrays, the antigen (ASGR-1) was translated into 888 different overlapping 7 aa, 10 aa and 13 aa peptides printed in duplicate (1,776 peptide spots per array copy). Peptide cyclization was accomplished using N- to C-terminal thioether formation with and without an additional scaffold for varying conformational restriction. Each PEPperCHIP® Peptide array is framed by Flag (DYKDDDDKAS) and HA (YPYDVPDYAG) control peptides. Assay buffer was PBS-T (PBS, pH7.4, 0.05% Tween 20), blocking buffer was Rockland Blocking Buffer (Rockland Immunochemicals), staining buffer was assay buffer+ 10% Rockland Blocking buffer. Secondary antibody was goat anti-human IRDye680LT (Li-Cor). Control antibodies were anti-FLAG M2 DyLight800, anti-HA DyLight680. Arrays were scanned on Li-Cor Odyssey with an offset of 0.65 mm, 21 um resolution.

Array staining and detection was per manufacturer's instructions. Briefly, arrays were pre-stained with secondary antibodies for 30 minutes, washed and scanned to detect background binding. Arrays were then stained with commercially available primary antibodies overnight, followed by washing and 30 minute incubation with labeled secondary antibodies. Arrays were scanned to detect binding of anti-ASGR-1 antibodies. Finally, arrays were stained with control antibodies for 45 minutes prior to washing and scanning to detect control peptides.

Antigen binding proteins with desired binding properties can be identified using this assay.

Example 16: In Vivo Studies

RNAi constructs that reduce expression of ASGR-1 and/or ASGR-2 and/or antigen binding proteins, such as monoclonal antibodies, that inhibit ligand binding to ASGR, ASGR-1, and/or ASGR-2 in vitro can be administered in vivo to a relevant animal model and levels and/or activity of endogenous blood proteins like alkaline phosphatase measured. In addition, the clearance of exogenously administered ASGR ligands (for example asialoglycoproteins, certain non-asialylated proteins, synthetic ligands, etc.) can be inhibited by pre-treatment with RNAi or a co- or pre-administered antibody.

Additionally, physiologic effects of the antigen binding proteins or RNAi can be evaluated in relevant animal models of cardiovascular disease using readouts including blood pressure, primary and secondary hemostasis, heart function and morphology, endothelial function, LDL cholesterol levels, non-HDL cholesterol levels, inflammation, and atherosclerosis.

Example 17: Effect of ASGR-1 Antibody 4A2 on Serum LDL Cholesterol and Alkaline Phosphatase in Normal and Obese Cynomolgus Monkeys The purpose of the study was to evaluate the LDL cholesterol (LDL-C)-lowering activity of anti-ASGR inhibitors. In general, cynomolgus monkeys do not have high levels of total cholesterol, HDL-C or LDL-C. Therefore, both normal and dyslipidemic models were utilized in this example. In the dyslipidemic model, monkeys were selected if their LDL levels were at least 100 mg/dL (normal is 40-60 mg/dL), and if there body mass index was over 41 $kg/m^2$ (normal is below 35 $kg/m^2$). Animals that met these criterea on standard diet were classified as spontaneously obese dylipidemic. Other animals were fed a high-fat diet (HFD; 4.15 kcal/gm, 32% fat) prior to inclusion in the study and were classified as HFD obese dyslipidemic.

Naive male spontaneous obese dyslipidemic and HFD obese dyslipidemic cynolgous monkeys were given a single subcutaneous injection of anti-ASGR-1 antibody 4A2.001 (IgG1z-SEFL2) (10 mg/kg in 10 mM sodium acetate, 9% sucrose, 0.01% polysorbate-80, pH 5.2). Naïve male and female normal cynomolgus monkeys were given a single intravenous injection of anti-ASGR-1 antibody 4A2.001 (IgG1z-SEFL2)(100 mg/kg in 10 mM sodium acetate, 9% sucrose, 0.01% polysorbate-80, pH 5.2). Blood was collected from overnight fasted animals to monitor LDL-C and alkaline phosphatase (ALP) levels post-antibody injection. Blood was collected 70, 118, 190 and 268 hours post-injection (dyslipidemic models) and at 0.05, 0.25, 0.5, 1, 4, 8, 24, 48, 72, 168, 240, 336, 504, 672, 840, 1008, and 1176 hours post-injection (normal). LDL-C decrease (%) and ALP increase (%) were the main endpoints of the study and were measured on Roche C311 and C501 chemistry analyzers. Baseline levels of LDL-C and ALP were established from blood collected 7 days prior to antibody administration.

Dyslipidemic Model:
Species: *Macaca fascicularis*
Weight Range: >7.0 kg
BMI Range: >41 $kg/m^2$
Age range: 12-17 years
Time on HFD: 6 months
Source: KBI monkey colony
Number and Sex: 3 male spontaneous obese monkeys and 3 male HFD induced obese monkeys (BMI>41, LDL>80 mg/dL)). Animals were selected from a larger pool based on similar baseline LDL and ALP levels Normal Model:
Species: *Macaca fascicularis*
Weight Range: 2.6-4.2 kg
Age range: 2.5-4 years
Number and Sex: 2 male and 1 female fed normal laboratory diet Data for this study is provided in FIG. 44 (dyslipidemic model) and FIG. 45 (normal model).

Example 18: Proteomic Profiling of Serum Samples from Human ASGR1 Carriers and Controls Introduction As described above in Example 1, ASGR1 loss-of-function (LOF) was found to be associated with a beneficial phenotype (protected from coronary artery disease, lower LDL cholesterol and longer life span) in human.[1]. To understand the mechanism of action underlying this association and find potential biomarkers, proteomic measurement of human serum samples were performed and compared to changes in circulating protein levels between the ASGR1 LOF variant carriers and controls.

Materials and Methods

Sample Collection and Proteomic Profiling

A total of 333 human serum samples were acquired from the deCODE Icelandic population study, including 100 ASGR1 del12 heterozygous carriers (cases group) and 233 non-carriers (controls group). The Case/Control Groups are well matched by sex, age and collection time/freezer storage time. 150 ul serum samples were shipped to SomaLogic Inc, where 1310 proteins were measured by the SOMAscan Assay 1.3 k. The 1310 proteins were SOMAmer® Reagents Generated to Human Proteins, the complete list of tested proteins are summarized in the SOMAscan Assay 1.3K Content, Rev 1 (Effective: Sep. 21, 2015) which is incorporated by reference herein in its entirety.

The SOMAscan assay measured serum protein concentration using a Slow Off-rate Modified DNA Aptamer (SOMAmer)-based capture array. Each of the 1310 proteins is bond by its respective fluorescently labeled SOMAmer in the assay and their concentrations are reflected by the respective SOMAmer's relative fluorescence units (RFU).

Data Analysis

2 Samples were removed due to low volume that did not meet Somascan requirements and 13 samples were removed because they had been treated with EDTA. The RFU data of each measured protein was log transformed, then centered and scaled to calculate standardized RFU values for this protein. Principle components (PCs) were derived from 1310 standardized RFU values by principle components analysis. An outlier removal based on Hotellings T2 distribution of PC1 and PC2 was applied and excluded another 8 samples from further analysis.

After QC, the remaining 93 ASGR1 Del12 heterozygous Carriers (cases group) and 217 samples without the Del12 allele (controls group) and their standardized RFU values of each protein were analyzed by a linear model adjusting for Age, Sex, FreezerTime and the first 10 PCs, $$Y_i = \beta_0 + \beta_1 G_i + \beta_2 AGE_i + \beta_3 SEX_i + \beta_4 FT_i + \beta_5 PC1_i + \ldots + \beta_{15} PC10_i + \varepsilon_i$$

where Yi is the standardized RFU value for the i th sample for a particular protein, Gi is the Del12 genotype the i th sample and β1 capture the estimates of the mean difference between human samples with Del12 and without Del12. Since 1310 tests were performed for the proteins on Somascan platform, we calculated the significant threshold by Bonferroni method ($0.05/1310=3.82\times10^{-5}$) assuming these are independent tests. However, the Bonferroni correction is likely too stringent because proteins are often correlated with each other therefore these tests are not independent. Thus a realistic threshold of significance ($5.19\times10^{-5}$) was obtained by performing 100,000 permutations using the method by Sham and Purcell 2014[3].

Results and Discussion

Using the permutation threshold, 41 Proteins were identified to have significant serum levels between human ASGR1 del12 carriers and non-carriers ($P<5.19\times10^{-5}$). Of those, 26 show significant increase in the carriers (Table 18.1) and 15 decrease significantly in the carriers (Table 18.2). These changes are likely to mediate the beneficial effects resulting from ASGR1 loss of function seen in the del12 carriers. The levels of these proteins in blood can serve as biomarkers for ASGR1 loss of function and be used to assess ASGR1-targeted therapy during drug development.

TABLE 18.1

Proteins with significant increase in serum of ASGR1 del12 carriers.

| p value | Estimate (SD) | Gene | Full Name |
|---|---|---|---|
| 3.71E−54 | 1.34 | TNFSF8 | Tumor necrosis factor ligand superfamily member 8 |
| 1.33E−52 | 1.45 | CD163 | Scavenger receptor cysteine-rich type 1 protein M130 |
| 2.07E−25 | 1.09 | CSF1R | Macrophage colony-stimulating factor 1 receptor |
| 1.44E−24 | 1.16 | LYVE1 | Lymphatic vessel endothelial hyaluronic acid receptor 1 |
| 1.03E−22 | 0.65 | IL6ST | Interleukin-6 receptor subunit beta |
| 4.56E−15 | 0.67 | IL18BP | Interleukin-18-binding protein |
| 1.16E−12 | 0.74 | CD300C | CMRF35-like molecule 6 |
| 2.47E−12 | 0.59 | TYRO3 | Tyrosine-protein kinase receptor TYRO3 |
| 8.85E−12 | 0.80 | LRP8 | Low-density lipoprotein receptor-related protein 8 |
| 1.76E−09 | 0.66 | IL1RL1 | Interleukin-1 receptor-like 1 |
| 2.62E−09 | 0.61 | ISLR2 | Immunoglobulin superfamily containing leucine-rich repeat protein 2 |
| 4.01E−09 | 0.55 | SIGLEC7 | Sialic acid-binding Ig-like lectin 7 |
| 4.47E−09 | 0.48 | NRXN3 | Neurexin-3-beta |
| 1.03E−07 | 0.58 | PLAU | Urokinase-type plasminogen activator |
| 2.96E−07 | 0.37 | CD55 | Complement decay-accelerating factor |
| 8.27E−07 | 0.53 | CD48 | CD48 antigen |
| 1.22E−06 | 0.31 | TNFRSF21 | Tumor necrosis factor receptor superfamily member 21 |
| 1.62E−06 | 0.36 | MRC2 | C-type mannose receptor 2 |
| 3.82E−06 | 0.57 | KLK13 | Kallikrein-13 |
| 4.95E−06 | 0.33 | IGF1R | Insulin-like growth factor 1 receptor |
| 1.46E−05 | 0.45 | ANGPT2 | Angiopoietin-2 |
| 2.02E−05 | 0.39 | CNTN4 | Contactin-4 |
| 2.57E−05 | 0.47 | FCGR3B | Low affinity immunoglobulin gamma Fc region receptor III-B |
| 2.93E−05 | 0.38 | C1S | Complement C1s subcomponent |
| 3.92E−05 | 0.40 | LY9 | T-lymphocyte surface antigen Ly-9 |
| 4.48E−05 | 0.46 | CD200R1 | Cell surface glycoprotein CD200 receptor 1 |

TABLE 18.2

Proteins with significant decrease in serum of ASGR1 del12 carriers.

| p value | Estimate (SD) | Gene | Target Full Name |
|---|---|---|---|
| 1.08E−09 | −0.52 | CD93 | Complement component C1q receptor |
| 6.32E−09 | −0.50 | IDS | Iduronate 2-sulfatase |
| 1.56E−07 | −0.34 | RGMB | RGM domain family member B |
| 2.91E−07 | −0.44 | TGFBI | Transforming growth factor-beta-induced protein ig-h3 |
| 5.56E−07 | −0.48 | LUM | Lumican |
| 6.67E−07 | −0.46 | MMP2 | 72 kDa type IV collagenase |
| 1.36E−06 | −0.38 | FLRT2 | Leucine-rich repeat transmembrane protein FLRT2 |
| 2.18E−06 | −0.48 | AHSG | Alpha-2-HS-glycoprotein |
| 2.44E−06 | −0.37 | CSH1 CSH2 | Chorionic somatomammotropin hormone |
| 3.16E−06 | −0.54 | ESM1 | Endothelial cell-specific molecule 1 |
| 1.36E−05 | −0.52 | AFM | Afamin |
| 1.67E−05 | −0.48 | TNFRSF17 | Tumor necrosis factor receptor |

TABLE 18.2-continued

Proteins with significant decrease
in serum of ASGR1 del12 carriers.

| p value | Estimate (SD) | Gene | Target Full Name |
|---|---|---|---|
| | | | superfamily member 17 |
| 2.68E−05 | −0.46 | OMD | Osteomodulin |
| 4.69E−05 | −0.23 | GDI2 | Rab GDP dissociation inhibitor beta |
| 5.09E−05 | −0.45 | SPOCK2 | Testican-2 |

References

1 See also, Nioi, P. et al. Variant ASGR1 Associated with a Reduced Risk of Coronary Artery Disease. *The New England journal of medicine* 374, 2131-2141, doi: 10.1056/NEJMoa1508419 (2016).

2 Gold, L. et al. Aptamer-based multiplexed proteomic technology for biomarker discovery. *PLoS One* 5, e15004, doi:10.1371/journal.pone. 0015004 (2010).

3 Sham, P. C. & Purcell, S. M. Statistical power and significance testing in large-scale genetic studies. *Nature reviews. Genetics* 15, 335-346, doi:10.1038/nrg3706 (2014).

Example 19: Proteomic Profiling of Serum Samples from ASGR1 Cyno PK-PD Study

Introduction

As described above in Example 1, ASGR1 loss-of-function (LOF) was found to be associated with a beneficial phenotype (protected from coronary artery disease, lower LDL cholesterol and longer life span) in human[1]. Certain ASGR-1 antigen binding proteins disclosed herein were found to mimic the LOF effects, and can be useful in the treatment of coronary artery disease. In brief, cynomolgus monkeys were treated with certain ASGR-1 specific, ligand blocking antibodies in order to study the PK-PD profile of these antibodies. Moreover, a dose-dependent elevation of alkaline phosphatase (ALP) levels was observed in the Ab-treated cynos, which resembles the ALP elevation seen in human ASGR1 LOF carriers. In addition to ALP, proteomic profiling in human serum identified 41 proteins that potentially underlie the beneficial effects caused by ASGR1 LOF as described above in Example 18. To compare effects of anti-ASGR1 antibody treatment with the human ASGR1 LOF and identify comparable signatures in cynomolgus monkey, proteomic measurement of the serum samples from this study was conducted. The list of proteins with altered levels in the antibody-treated animals is compared to the ones identified in human LOF carriers.

Materials and Methods

Sample Selection and Proteomic Profiling 6 animal groups with 3 animals in each group were selected for proteomic profiling. The 6 groups include 5 antibody-treated groups (mAb1/25A4, mAb2/4A2, mAb3/7E11, mAb4/5E5 and mAb8/4H6) and a vehicle control group (mAb6). The animals were dosed once at 100 mg/kg. Serum samples from time points 0, 168, 336, 504, 672 and 1176 hours were collected for each animal (Table 19.1 & 19.2). The only exception is group mAb8/4H6, where time point 1008 hour is used instead of 1176 hour. 120 ul serum samples were shipped to SomaLogic Inc, where 1310 proteins (see table 18.0) were measured by the SOMAscan Assay 1.3 k.

The SOMAscan assay measures serum protein concentration using a Slow Off-rate Modified DNA Aptamer (SOMAmer)-based capture array. Each of the 1310 proteins is bond by its respective fluorescently labeled SOMAmer in the assay and their concentrations are reflected by the respective SOMAmer's relative fluorescence units (RFU).

TABLE 19.1

Serum sample selection.

| | | Time points | | | | | |
|---|---|---|---|---|---|---|---|
| Animal group | Animal Number | D0 0 hr | D8 168 hr | D15 336 hr | D22 504 hr | D29 672 hr | D50 1176 hr |
| 25A4 | 701, 702, 703 | ✓ | ✓ | ✓ | ✓ | ✓ | ✓ |
| 4A2 | 704, 705, 706 | ✓ | ✓ | ✓ | ✓ | ✓ | ✓ |
| 7E11 | 707, 708, 711 | ✓ | ✓ | ✓ | ✓ | ✓ | ✓ |
| 5E5 | 709, 710, 712 | ✓ | ✓ | ✓ | ✓ | ✓ | ✓ |
| SEFL2-control | 716, 717, 718 | ✓ | ✓ | ✓ | ✓ | ✓ | ✓ |
| 4H6 | 204, 205, 206 | ✓ | ✓ | ✓ | ✓ | ✓ | ✓* |

*4H6 was collected at D43 (1008 hr).

TABLE 19.2

List of all sample groups by treatment and time points.

| Sample group | Treatment (e.g., drug, vehicle, etc.) | Time point | # of Samples in Group | Subject ID |
|---|---|---|---|---|
| 25A4_D0 | mAb1 | 0 Hr | 3 | 701, 702, 703 |
| 25A4_D8 | mAb1 | 168 Hr | 3 | 701, 702, 703 |
| 25A4_D15 | mAb1 | 336 Hr | 3 | 701, 702, 703 |
| 25A4_D22 | mAb1 | 504 Hr | 3 | 701, 702, 703 |
| 25A4_D29 | mAb1 | 672 Hr | 3 | 701, 702, 703 |
| 25A4_D50 | mAb1 | 1176 Hr | 3 | 701, 702, 703 |
| 4A2_D0 | mAb2 | 0 Hr | 3 | 704, 705, 706 |
| 4A2_D8 | mAb2 | 168 Hr | 3 | 704, 705, 706 |
| 4A2_D15 | mAb2 | 336 Hr | 3 | 704, 705, 706 |
| 4A2_D22 | mAb2 | 504 Hr | 3 | 704, 705, 706 |
| 4A2_D29 | mAb2 | 672 Hr | 3 | 704, 705, 706 |
| 4A2_D50 | mAb2 | 1176 Hr | 3 | 704, 705, 706 |
| 7E11_D0 | mAb3 | 0 Hr | 3 | 707, 708, 711 |
| 7E11_D8 | mAb3 | 168 Hr | 3 | 707, 708, 711 |
| 7E11_D15 | mAb3 | 336 Hr | 3 | 707, 708, 711 |
| 7E11_D22 | mAb3 | 504 Hr | 3 | 707, 708, 711 |
| 7E11_D29 | mAb3 | 672 Hr | 3 | 707, 708, 711 |
| 7E11_D50 | mAb3 | 1176 Hr | 3 | 707, 708, 711 |
| 5E5_D0 | mAb4 | 0 Hr | 3 | 709, 710, 712 |
| 5E5_D8 | mAb4 | 168 Hr | 3 | 709, 710, 712 |
| 5E5_D15 | mAb4 | 336 Hr | 3 | 709, 710, 712 |
| 5E5_D22 | mAb4 | 504 Hr | 3 | 709, 710, 712 |
| 5E5_D29 | mAb4 | 672 Hr | 3 | 709, 710, 712 |
| 5E5_D50 | mAb4 | 1176 Hr | 3 | 709, 710, 712 |
| CTL_D0 | mAb6 | 0 Hr | 3 | 716, 717, 718 |
| CTL_D8 | mAb6 | 168 Hr | 3 | 716, 717, 718 |

TABLE 19.2-continued

List of all sample groups by treatment and time points.

| Sample group | Treatment (e.g., drug, vehicle, etc.) | Time point | # of Samples in Group | Subject ID |
|---|---|---|---|---|
| CTL_D15 | mAb6 | 336 Hr | 3 | 716, 717, 718 |
| CTL_D22 | mAb6 | 504 Hr | 3 | 716, 717, 718 |
| CTL_D29 | mAb6 | 672 Hr | 3 | 716, 717, 718 |
| CTL_D50 | mAb6 | 1176 Hr | 3 | 716, 717, 718 |
| 4H6_D0 | mAb8 | 0 Hr | 3 | 204, 205, 206 |
| 4H6_D8 | mAb8 | 168 Hr | 3 | 204, 205, 206 |
| 4H6_D15 | mAb8 | 336 Hr | 3 | 204, 205, 206 |
| 4H6_D22 | mAb8 | 504 Hr | 3 | 204, 205, 206 |
| 4H6_D29 | mAb8 | 672 Hr | 3 | 204, 205, 206 |
| 4H6_D43 | mAb8 | 1008 Hr | 3 | 204, 205, 206 |

Data Analysis

Figure 58:
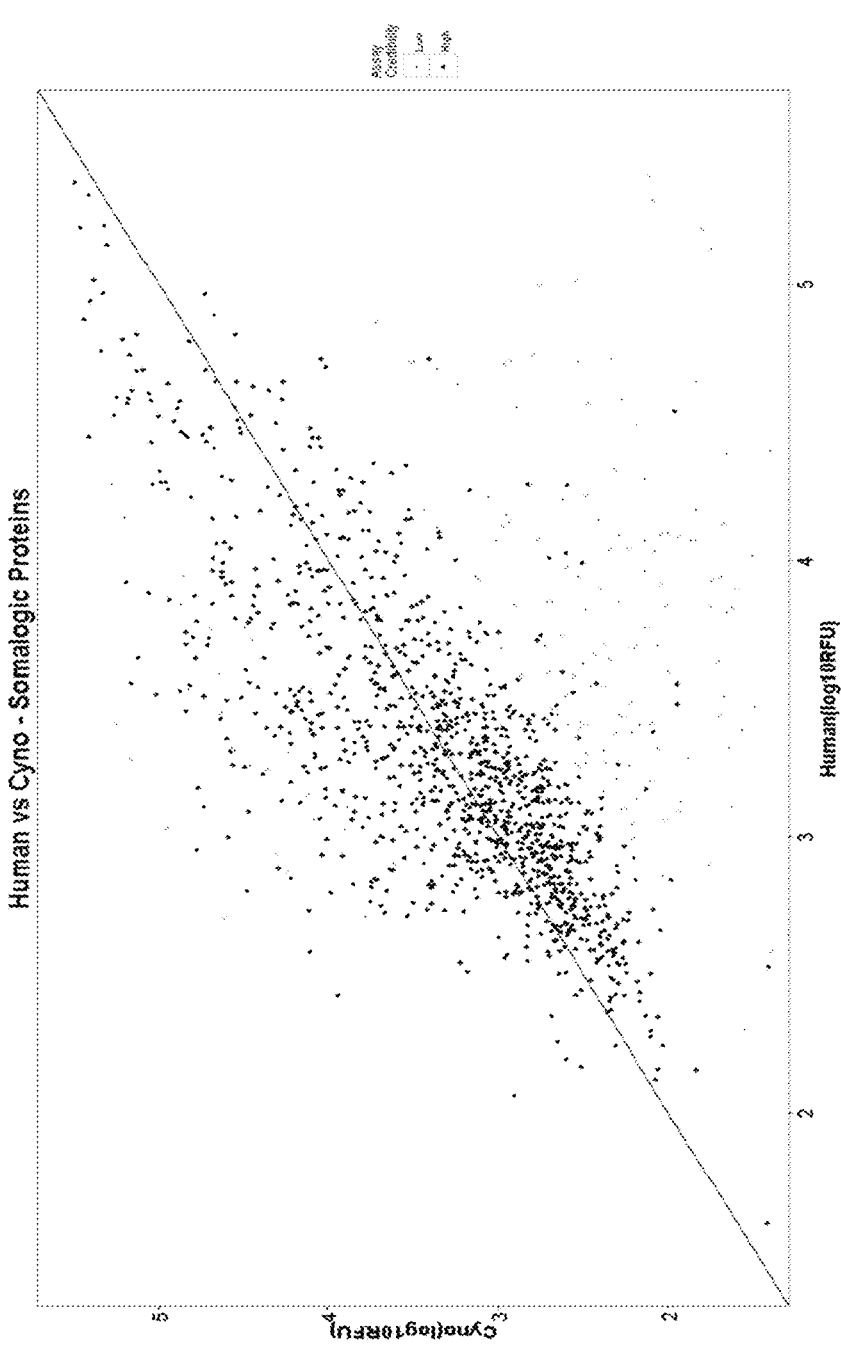
FIG. 58. A graph depicting the credibility of protein measurements in cynomolgus monkey. Log 10 RFU of mean protein levels in the two species are plotted and the ones with low credibility (light dots) and high credibility (darker dots) are marked.
Figure 59:
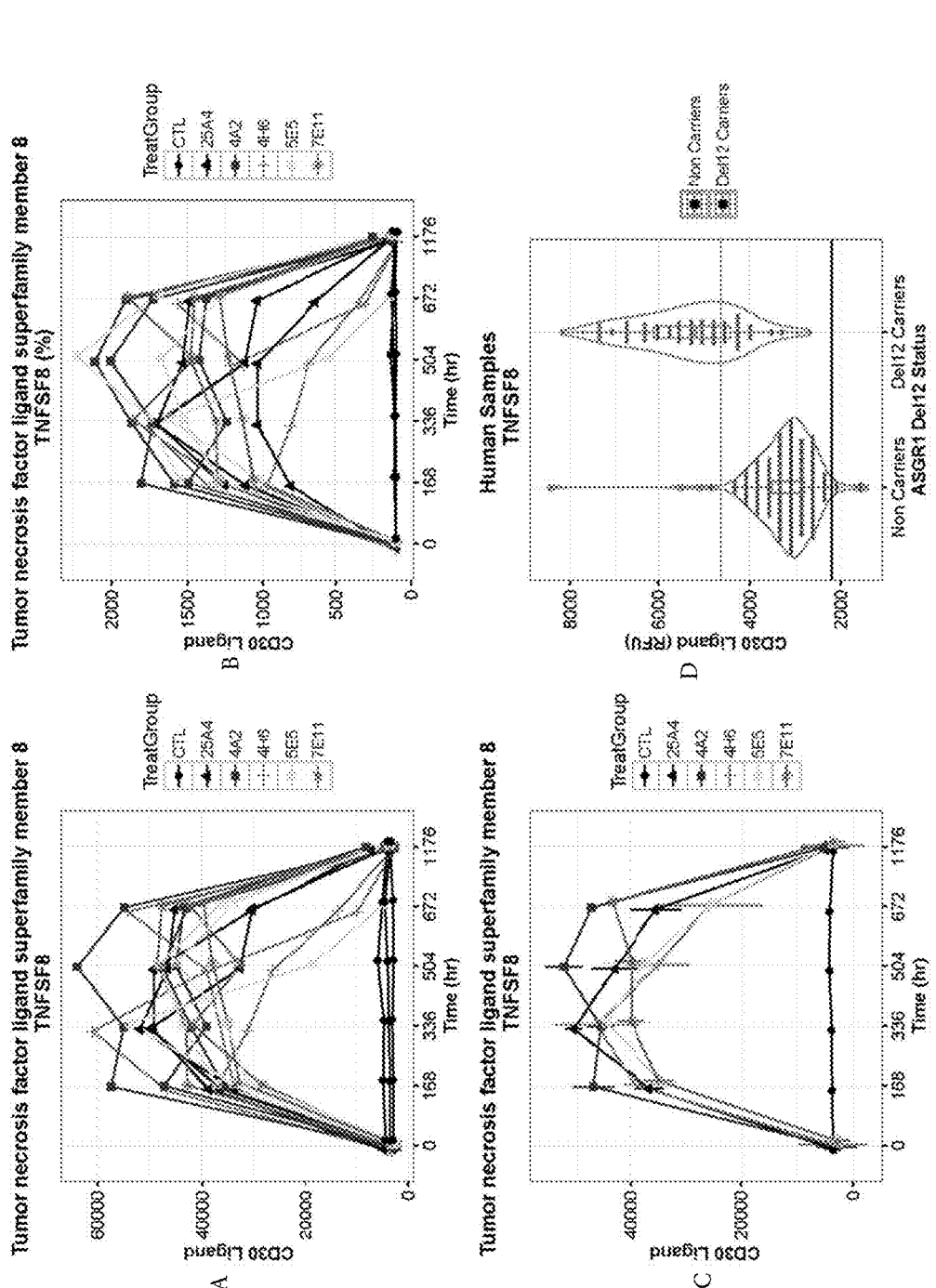
FIG. 59. Serum protein analysis of cynomolgus monkey treated with anti-ASGR-1 antibodies. Panel A is a graph depicting TNFSF8 protein levels in individual animals of different treatment group across the time points. Panel B is a graph depicting normalized TNFSF8 protein levels (percent of time point 0) in individual animals of different treatment groups across the time points. Panel C is a graph depicting TNFSF8 protein levels in each treatment group (n=3, error bar represents the SEM), and Panel D is a graph depicting the distribution of TNFSF8 protein levels in human ASGR1 del12 carriers and non-carriers.

As the SOMAscan assay was developed for humans, some proteins in cynomolgus monkey may not be recognized by the SOMAmer reagents. As a result, SOMAscan measurements of these proteins would have low credibility and may not reflect the true protein levels. A simple criterion was defined to determine the credibility of the measurements, assuming the serum levels of a given protein are in relatively close range in human and cynomolgus monkey. The mean and range of each protein level in human are calculated based on the 217 human control samples from the human proteomic study described in Example 18. The mean and range of each protein level in cynomolgus monkey are calculated based on a total of 48 samples including measurements of all time points for the SEFL-2 control group and the pre-treatment (D0) and washout period (D50) measurements of all the other groups. A protein measurement would be assigned low credibility if (1) its range in cynomolgus monkey is not overlapping with human; and (2) there is a 5 fold difference between the mean level of this protein in human and cynomolgus monkey. A total of 162 proteins were determined as low-credibility by these criteria and were excluded (FIG. 58, which depicts a summary of the credibility of protein measurements in cynomolgus monkey). In FIG. 58, log 10 RFU of mean protein levels in the two species are plotted and the ones with low credibility (light shading) and high credibility (black) are marked.

One sample in the 4H6 group was removed due to low volume that did not meet the requirements for the SOMAscan assay. No outliers were found in the principle components analysis. A linear mixed model adjusting for potential confounding factors was used to test whether the ASGR1 antibody treatment changes each protein level differently from the control group over time points, $$Y_{ti}=\beta_0+\beta_1 \text{TREATGROUP}_i+\beta_2 \text{TIME}_{ti}+\beta_3(\text{TREATGROUP}_i)(\text{TIME}_{ti})+\beta_4 \text{COV}_{ti}+\ldots+\beta_{m+4}\text{COV}_{ti}+b_{0i}+\varepsilon_{ti}$$

which is determined by the p-value for $\beta_3$ (i.e., treatment by time interaction; mean difference in slopes between treatment conditions). The random effect $b_{0i}$ captures individual animal heterogeneity. The TREATGROUP is coded as (25A4=4A2=7E11=5E5=4H6=1; SELF-2=0) and TIME is coded as (D8=D15=D22=D29=1; D0=D50=0) to test for the ASGR1 antibodies effect after treatment comparing to pre-treatment and washout period. Since multiple tests were performed for the proteins on SOMAscan platform, a Bonferroni corrected significant threshold ($5\times10^{-5}$) was used.

Results and Discussion 33 proteins were identified to have significant serum level changes after ASGR1 antibody treatment (Table 19.3; P<5× 10$^{-5}$). Interestingly, all the 33 proteins show increased levels (1.36~10.18 fold) after ASGR1 antibody treatment.

TABLE 19.3

Proteins with significant changes after ASGR1 antibody treatment in Cynomolgus monkey.

| P-value | Estimated Fold Change | Gene | Full Name |
|---|---|---|---|
| 1.87E−13 | 10.18 | TNFSF8 | Tumor necrosis factor ligand superfamily member 8 |
| 1.01E−06 | 8.56 | ASGR1 | Asialoglycoprotein receptor 1 |
| 1.35E−10 | 3.93 | ADGRE2 | Adhesion G protein-coupled receptor E2 |
| 2.74E−11 | 2.86 | CD86 | T-lymphocyte activation antigen CD86 |
| 1.46E−11 | 2.81 | TNFRSF21 | Tumor necrosis factor receptor superfamily member 21 |
| 7.48E−10 | 2.57 | L1CAM | Neural cell adhesion molecule L1 |
| 6.09E−12 | 2.42 | PLXNC1 | Plexin-C1 |
| 1.22E−07 | 2.11 | MRC2 | C-type mannose receptor 2 |
| 1.18E−06 | 2.10 | AMIGO2 | Amphoterin-induced protein 2 |
| 2.28E−11 | 2.02 | ANGPT2 | Angiopoietin-2 |
| 6.68E−09 | 1.99 | INSR | Insulin receptor |
| 1.02E−10 | 1.93 | IL17RA | Interleukin-17 receptor A |
| 7.12E−12 | 1.90 | NRXN3 | Neurexin-3-beta |
| 5.95E−06 | 1.85 | GPNMB | Transmembrane glycoprotein NMB |
| 2.03E−06 | 1.74 | IGF1R | Insulin-like growth factor 1 receptor |
| 3.91E−09 | 1.73 | PLAUR | Urokinase plasminogen activator surface receptor |
| 3.58E−09 | 1.69 | FGFR1 | Fibroblast growth factor receptor 1 |
| 1.26E−06 | 1.60 | LRP8 | Low-density lipoprotein receptor-related protein 8 |
| 3.87E−09 | 1.55 | LYPD3 | Ly6/PLAUR domain-containing protein 3 |
| 3.17E−06 | 1.55 | GRN | Granulins |
| 4.27E−05 | 1.54 | CNTN4 | Contactin-4 |
| 4.59E−07 | 1.54 | KDR | Vascular endothelial growth factor receptor 2 |
| 4.99E−06 | 1.53 | IL12RB2 | Interleukin-12 receptor subunit beta-2 |
| 5.85E−06 | 1.52 | ROBO3 | Roundabout homolog 3 |
| 1.44E−06 | 1.50 | ALCAM | CD 166 antigen |
| 3.83E−05 | 1.46 | TYRO3 | Tyrosine-protein kinase receptor TYRO3 |
| 3.09E−05 | 1.45 | CADM1 | Cell adhesion molecule 1 |
| 1.53E−08 | 1.44 | JAG1 | Protein jagged-1 |
| 2.58E−09 | 1.43 | ISLR2 | Immunoglobulin superfamily containing leucine-rich repeat protein 2 |
| 3.11E−05 | 1.39 | SET | Protein SET |
| 4.64E−05 | 1.38 | IL20RA | Interleukin-20 receptor subunit alpha |
| 2.15E−06 | 1.36 | KLRK1 | NKG2-D type II integral membrane protein |
| 2.39E−05 | 1.36 | GFRA2 | GDNF family receptor alpha-2 |

To compare results from this study with the human proteomic study, a list of proteins made by the 33 proteins in Table 19.3 and the top 41 proteins identified in human was compiled. This results in a list of 64 proteins total. The estimates of protein level change and p-value of the changes in the studies were compared (Table 19.4). Based on concordance of change in the cyno (in response to ASGR1 antibody treatment) and human (in response to ASGR1 LOF) studies, the proteins are classified into 5 tiers. Tier 1 includes 10 proteins that pass the stringent Bonferroni corrected significance level ($p<5\times10^{-5}$) in both studies with the same direction of changes. The number of proteins supported by strong evidence in both studies are much higher than the number one would expect by chance ($p=1.58\times10^{-8}$; Fisher's exact test). It indicates that ASGR1 Ab treatment can induce a serum protein levels change in cyno that is similar to the effect of del12 LOF variant in Human. Therefore, these proteins are the core biomarkers. For example, the strongest biomarker TNFSF8 had more than 10 fold increase after ASGR1 Antibody treatment (FIGS. 59A-59D, which depict the results of serum protein levels of TNFSF8 in cyno and human studies).

Tier 2 contains 12 proteins with strong evidence ($p<5\times 10^{-5}$) in the cyno study and suggestive evidence ($p<0.05$) in human with the same direction of changes. Both Tier 1 and 2 proteins have increased levels in both studies. Tier 3 includes 11 proteins that are found significant only in the cyno study but not human. These proteins are likely to be biomarkers specific for the drug modality or for cynomolgus monkeys. For example, the soluble secreted form of ASGR1 increased more than 10 fold after antibody treatment but no significant difference was observed in human between the ASGR1 del12 carriers and non-carriers. Tier 4 contains 17 proteins with significant evidence ($p<5\times 10^{-5}$) in the human study but not supported by the cyno study. Majority of the proteins in Tier 4 has decrease levels in human del12 carriers. This observation may indicate a difference between antibody treatment and constitutive gene LOF. It could also possibly be due to species difference or simply caused by lower statistical power in the cyno study.

Lastly, there are 14 proteins with significant changes in human classified as Tier 5 because they were excluded in the cyno study due to the low credibility of their SOMAmer reagents.

In summary, the two studies show high degree of concordance between the antibody treatment in cynomolgus monkey and ASGR1 LOF in humans, with 10 proteins (Tier 1) showing very significant changes in the same direction in both studies. The ASGR-1 antibody treatment is working well as a way of mimicking the effects of ASGR1 LOF in humans and can be useful in the treatment of coronary artery disease.

TABLE 19.4

Five tiers of protein biomarkers and comparison of the estimates of protein level change and p-value between the two studies.

| Target Full Name | Gene | human Estimate (SD) | P-value | Cyno Estimate log2FC | P-value | Tier |
|---|---|---|---|---|---|---|
| Tumor necrosis factor ligand superfamily member 8 | TNFSF8 | 1.34 | 3.7E−54 | 3.35 | 1.87E−13 | 1 |
| Tumor necrosis factor receptor superfamily member 21 | TNFRSF21 | 0.31 | 1.2E−06 | 1.49 | 1.46E−11 | 1 |
| C-type mannose receptor 2 | MRC2 | 0.36 | 1.6E−06 | 1.08 | 1.22E−07 | 1 |
| Angiopoietin-2 | ANGPT2 | 0.45 | 1.5E−05 | 1.01 | 2.28E−11 | 1 |
| Neurexin-3-beta | NRXN3 | 0.48 | 4.5E−09 | 0.93 | 7.12E−12 | 1 |
| Insulin-like growth factor 1 receptor | IGF1R | 0.33 | 5.0E−06 | 0.80 | 2.03E−06 | 1 |
| Low-density lipoprotein receptor-related protein 8 | LRP8 | 0.80 | 8.9E−12 | 0.68 | 1.26E−06 | 1 |
| Contactin-4 | CNTN4 | 0.39 | 2.0E−05 | 0.63 | 4.27E−05 | 1 |
| Tyrosine-protein kinase receptor TYRO3 | TYRO3 | 0.59 | 2.5E−12 | 0.55 | 3.83E−05 | 1 |
| Immunoglobulin superfamily containing leucine-rich repeat protein 2 | ISLR2 | 0.61 | 2.6E−09 | 0.52 | 2.58E−09 | 1 |
| T-lymphocyte activation antigen CD86 | CD86 | 0.39 | 2.1E−03 | 1.52 | 2.74E−11 | 2 |
| Neural cell adhesion molecule L1 | L1CAM | 0.30 | 5.5E−03 | 1.36 | 7.48E−10 | 2 |
| Plexin-C1 | PLXNC1 | 0.40 | 1.0E−04 | 1.28 | 6.09E−12 | 2 |
| Amphoterin-induced protein 2 | AMIGO2 | 0.44 | 1.9E−04 | 1.07 | 1.18E−06 | 2 |
| Interleukin-17 receptor A | IL17RA | 0.29 | 0.03 | 0.95 | 1.02E−10 | 2 |
| Urokinase plasminogen activator surface receptor | PLAUR | 0.35 | 3.3E−04 | 0.79 | 3.91E−09 | 2 |
| Fibroblast growth factor receptor 1 | FGFR1 | 0.30 | 2.3E−03 | 0.75 | 3.58E−09 | 2 |
| Granulins | GRN | 0.27 | 5.7E−03 | 0.63 | 3.17E−06 | 2 |
| CD166 antigen | ALCAM | 0.20 | 9.1E−03 | 0.58 | 1.44E−06 | 2 |
| Protein jagged-1 | JAG1 | 0.17 | 0.01 | 0.53 | 1.53E−08 | 2 |
| Protein SET | SET | 0.28 | 2.1E−03 | 0.47 | 3.11E−05 | 2 |
| GDNF family receptor alpha-2 | GFRA2 | 0.39 | 9.2E−05 | 0.44 | 2.39E−05 | 2 |
| Asialoglycoprotein receptor 1 | ASGR1 | 0.00 | 0.99 | 3.10 | 1.01E−06 | 3 |
| Adhesion G protein-coupled receptor E2 | ADGRE2 | 0.04 | 0.70 | 1.97 | 1.35E−10 | 3 |
| Insulin receptor | INSR | 0.20 | 0.06 | 1.00 | 6.68E−09 | 3 |
| Transmembrane glycoprotein NMB | GPNMB | −0.22 | 0.01 | 0.89 | 5.95E−06 | 3 |
| Ly6/PLAUR domain-containing protein 3 | LYPD3 | −0.06 | 0.26 | 0.63 | 3.87E−09 | 3 |
| Vascular endothelial growth factor receptor 2 | KDR | 0.19 | 0.09 | 0.63 | 4.59E−07 | 3 |
| Interleukin-12 receptor subunit beta-2 | IL12RB2 | 0.11 | 0.38 | 0.61 | 4.99E−06 | 3 |
| Roundabout homolog 3 | ROB03 | 0.08 | 0.55 | 0.61 | 5.85E−06 | 3 |
| Cell adhesion molecule 1 | CADM1 | −0.17 | 0.02 | 0.53 | 3.09E−05 | 3 |
| Interleukin-20 receptor subunit alpha | IL20RA | 0.05 | 0.69 | 0.47 | 4.64E−05 | 3 |
| NKG2-D type II integral membrane protein | KLRK1 | −0.14 | 0.25 | 0.44 | 2.15E−06 | 3 |
| Lymphatic vessel endothelial hyaluronic acid receptor 1 | LYVE1 | 1.16 | 1.44E−24 | 0.00 | 0.96 | 4 |
| CMRF35-like molecule 6 | CD300C | 0.74 | 1.16E−12 | 0.03 | 0.39 | 4 |
| Interleukin-1 receptor-like 1 | IL1RL1 | 0.66 | 1.76E−09 | 0.75 | 0.10 | 4 |
| Kallikrein-13 | KLK13 | 0.57 | 3.82E−06 | 0.08 | 0.42 | 4 |
| CD48 antigen | CD48 | 0.53 | 8.27E−07 | −0.06 | 0.81 | 4 |
| Rab GDP dissociation inhibitor beta | GDI2 | −0.23 | 4.69E−05 | −0.27 | 0.09 | 4 |
| Chorionic somatomammotropin hormone | CSH1 CSH2 | −0.37 | 2.44E−06 | 0.19 | 9.4E−03 | 4 |
| Leucine-rich repeat transmembrane protein FLRT2 | FLRT2 | −0.38 | 1.36E−06 | 0.30 | 0.03 | 4 |
| Transforming growth factor-beta-induced protein ig-h3 | TGFBI | −0.44 | 2.91E−07 | 0.13 | 0.46 | 4 |
| Testican-2 | SPOCK2 | −0.45 | 5.09E−05 | 0.10 | 0.96 | 4 |
| 72 kDa type IV collagenase | MMP2 | −0.46 | 6.67E−07 | 0.13 | 0.48 | 4 |

TABLE 19.4-continued

Five tiers of protein biomarkers and comparison of the estimates
of protein level change and p-value between the two studies.

| | | human | | Cyno | | |
|---|---|---|---|---|---|---|
| Target Full Name | Gene | Estimate (SD) | P-value | Estimate log2FC | P-value | Tier |
| Osteomodulin | OMD | −0.46 | 2.68E−05 | 0.12 | 0.78 | 4 |
| Alpha-2-HS-glycoprotein | AHSG | −0.48 | 2.18E−06 | 0.00 | 0.97 | 4 |
| Iduronate 2-sulfatase | IDS | −0.50 | 6.32E−09 | 0.05 | 0.33 | 4 |
| Complement component C1q receptor | CD93 | −0.52 | 1.08E−09 | 0.19 | 0.15 | 4 |
| Afamin | AFM | −0.52 | 1.36E−05 | 0.02 | 0.94 | 4 |
| Endothelial cell-specific molecule 1 | ESM1 | −0.54 | 3.16E−06 | 0.09 | 0.56 | 4 |
| Scavenger receptor cysteine-rich type 1 protein M130 | CD163 | 1.45 | 1.33E−52 | NA | NA | 5 |
| Macrophage colony-stimulating factor 1 receptor | CSF1R | 1.09 | 2.07E−25 | NA | NA | 5 |
| Interleukin-18-binding protein | IL18BP | 0.67 | 4.56E−15 | NA | NA | 5 |
| Interleukin-6 receptor subunit beta | IL6ST | 0.65 | 1.03E−22 | NA | NA | 5 |
| Urokinase-type plasminogen activator | PLAU | 0.58 | 1.03E−07 | NA | NA | 5 |
| Sialic acid-binding Ig-like lectin 7 | SIGLEC7 | 0.55 | 4.01E−09 | NA | NA | 5 |
| Low affinity immunoglobulin gamma Fc region receptor III-B | FCGR3B | 0.47 | 2.57E−05 | NA | NA | 5 |
| Cell surface glycoprotein CD200 receptor 1 | CD200R1 | 0.46 | 4.48E−05 | NA | NA | 5 |
| T-lymphocyte surface antigen Ly-9 | LY9 | 0.40 | 3.92E−05 | NA | NA | 5 |
| Complement C1s subcomponent | C1S | 0.38 | 2.93E−05 | NA | NA | 5 |
| Complement decay-accelerating factor | CD55 | 0.37 | 2.96E−07 | NA | NA | 5 |
| RGM domain family member B | RGMB | −0.34 | 1.56E−07 | NA | NA | 5 |
| Lumican | LUM | −0.48 | 5.56E−07 | NA | NA | 5 |
| Tumor necrosis factor receptor superfamily member 17 | TNFRSF17 | −0.48 | 1.67E−05 | NA | NA | 5 |

References
1 See also, Nioi, P. et al. Variant ASGR1 Associated with a Reduced Risk of Coronary Artery Disease. *The New England journal of medicine* 374, 2131-2141, doi: 10.1056/NEJMoa1508419 (2016).
2 Gold, L. et al. Aptamer-based multiplexed proteomic technology for biomarker discovery. *PLoS One* 5, e15004, doi:10.1371/journal.pone. 0015004 (2010).

Example 20: Method of Reducing a Risk of Cardiovascular Disease

A subject at risk of cardiovascular disease is identified. One or more antibodies as provided herein (see Example 7, as well as Tables A, B and C) and/or RNAi constructs that reduce expression of ASGR-1 and/or ASGR-2 (as outlined in Example 3), are administered to a subject at risk of cardiovascular disease. The antibody and/or RNAi construct reduces the level of expression of ASGR, ASGR-1 and/or ASGR-2. Subsequent rounds of antibodies and/or RNAi are administered to the subject. One or more of the markers in Example 19 (e.g., Tier 1) is monitored to make certain that an adequate amount of the antibody and/or RNAi construct is administered and is functioning as desired. The risk that the subject will experience cardio vascular disease is decreased.

Additionally, as a further option, physiologic effects of the antibody and/or RNAi can be evaluated in relevant animal models of cardiovascular disease using readouts including blood pressure, primary and secondary hemostasis, heart function and morphology, endothelial function, LDL cholesterol levels, non-HDL cholesterol levels, inflammation, and/or atherosclerosis.

Example 21: Method of Reducing a Risk of Myocardial Infarction or Coronary Artery Disease A subject at risk of a myocardial infarction or coronary artery disease is identified. One or more antibodies as provided herein (see Example 7, as well as Tables A, B and C) and/or RNAi constructs that reduce expression of ASGR-1 and/or ASGR-2 (as outlined in Example 3), are administered to a subject at risk of a myocardial infarction or coronary artery disease. The antibody and/or RNAi construct reduces the level of expression of ASGR, ASGR-1 and/or ASGR-2. Subsequent rounds of antibodies and/or RNAi are administered to the subject. One or more of the markers in Example 19 (e.g., Tier 1) is monitored to make certain that an adequate amount of the antibody and/or RNAi construct is administered and is functioning as desired. The risk that the subject will experience a myocardial infarction or coronary artery disease is decreased.

Additionally, as a further option, physiologic effects of the antibody and/or RNAi can be evaluated in relevant animal models of myocardial infarction or coronary artery disease using readouts including blood pressure, primary and secondary hemostasis, heart function and morphology, endothelial function, LDL cholesterol levels, non-HDL cholesterol levels, inflammation, and/or atherosclerosis.

Example 22: Method of Reducing LDL Cholesterol

A subject having a LDL cholesterol level to be lowered is identified. One or more antibodies as provided herein (see Example 7, as well as Tables A, B and C) and/or RNAi constructs that reduce expression of ASGR-1 and/or ASGR-2 (as outlined in Example 3), are administered to the subject. The antibody and/or RNAi construct reduces the level of expression of ASGR, ASGR-1 and/or ASGR-2. Subsequent rounds of antibodies and/or RNAi are administered to the subject. One or more of the markers in Example 19 (e.g., tier 1) is monitored to make certain that an adequate amount of the antibody and/or RNAi construct is administered and is functioning as desired. The level of LDL cholesterol in the subject is thereby reduced.

Example 23: Method of Reducing Non-HDL Cholesterol

A subject having a non-HDL cholesterol level to be lowered is identified. One or more antibodies as provided herein (see Example 7, as well as Tables A, B and C) and/or RNAi constructs that reduce expression of ASGR-1 and/or ASGR-2 (as outlined in Example 3), are administered to the subject. The antibody and/or RNAi construct reduces the level of expression of ASGR, ASGR-1 and/or ASGR-2. Subsequent rounds of antibodies and/or RNAi are administered to the subject. One or more of the markers in Example 19 (e.g., Tier 1) is monitored to make certain that an adequate amount of the antibody and/or RNAi construct is administered and is functioning as desired. The level of non-HDL cholesterol in the subject is thereby reduced.

Example 24: Method of Increasing ALP Levels

One or more antibodies as provided herein (see Example 7, as well as Tables A, B, and C) and/or RNAi constructs that reduce expression of ASGR-1 and/or ASGR-2 (as outlined in Example 3), are administered to the subject. The antibody and/or RNAi construct reduces the level of expression of ASGR, ASGR-1 and/or ASGR-2. Subsequent rounds of antibodies and/or RNAi are administered to the subject. One or more of the markers in Example 19 (e.g., Tier 1) is monitored to make certain that an adequate amount of the antibody and/or RNAi construct is administered and is functioning as desired. The level of ALP in the subject is thereby increased.

Example 25: Method of Monitoring the Effectiveness of an ASGR-1 Therapy

One or more antibodies as provided herein (see Example 7, as well as Tables A, B and C) and/or RNAi constructs that reduce expression of ASGR-1 and/or ASGR-2 (as outlined in Example 3), are administered to the subject. One or more of the markers in Example 19 is monitored to make certain that an adequate amount of the antibody and/or RNAi construct is administered and is functioning as desired. When the marker level changes in a similar manner to those changes noted in Example 19 (e.g., Tier 1), it is evidence that the amount of the one or more antibody and/or RNAi is effective. Additionally, as a further option, the effectiveness of this biochemical change can be observed by its physiologic effects from the antibody and/or RNAi, which can be evaluated using readouts including blood pressure, primary and secondary hemostasis, heart function and morphology, endothelial function, LDL cholesterol levels, non-HDL cholesterol levels, inflammation, and/or atherosclerosis.

TABLE 10.1

| ATOM | 1 | O | THR | A | 151 | −35.000 | −25.802 | 13.973 | 1.00 | 41.82 | O |
|---|---|---|---|---|---|---|---|---|---|---|---|
| ATOM | 2 | N | THR | A | 151 | −34.909 | −27.403 | 11.804 | 1.00 | 40.99 | N |
| ATOM | 3 | CA | THR | A | 151 | −34.274 | −27.888 | 13.020 | 1.00 | 40.74 | C |
| ATOM | 4 | C | THR | A | 151 | −34.232 | −26.755 | 14.051 | 1.00 | 40.85 | C |
| ATOM | 5 | CB | THR | A | 151 | −32.835 | −28.381 | 12.758 | 1.00 | 37.81 | C |
| ATOM | 6 | OG1 | THR | A | 151 | −32.738 | −28.919 | 11.438 | 1.00 | 46.22 | O |
| ATOM | 7 | CG2 | THR | A | 151 | −32.470 | −29.491 | 13.725 | 1.00 | 44.52 | C |
| ATOM | 8 | O | CYS | A | 152 | −30.928 | −26.774 | 16.222 | 1.00 | 27.69 | O |
| ATOM | 9 | N | CYS | A | 152 | −33.315 | −26.861 | 15.005 | 1.00 | 43.00 | N |
| ATOM | 10 | CA | CYS | A | 152 | −33.119 | −25.852 | 16.027 | 1.00 | 32.33 | C |
| ATOM | 11 | C | CYS | A | 152 | −31.621 | −25.772 | 16.312 | 1.00 | 30.92 | C |
| ATOM | 12 | CB | CYS | A | 152 | −33.900 | −26.213 | 17.289 | 1.00 | 36.97 | C |
| ATOM | 13 | SG | CYS | A | 152 | −34.435 | −24.804 | 18.287 | 1.00 | 47.04 | S |
| ATOM | 14 | N | CYS | A | 153 | −31.104 | −24.590 | 16.620 | 1.00 | 26.78 | N |
| ATOM | 15 | CA | CYS | A | 153 | −29.716 | −24.493 | 17.055 | 1.00 | 24.74 | C |
| ATOM | 16 | C | CYS | A | 153 | −29.577 | −25.058 | 18.464 | 1.00 | 26.56 | C |
| ATOM | 17 | O | CYS | A | 153 | −30.538 | −25.026 | 19.235 | 1.00 | 25.88 | O |
| ATOM | 18 | CB | CYS | A | 153 | −29.243 | −23.040 | 17.017 | 1.00 | 21.46 | C |
| ATOM | 19 | SG | CYS | A | 153 | −29.368 | −22.304 | 15.376 | 1.00 | 33.20 | S |
| ATOM | 20 | N | PRO | A | 154 | −28.379 | −25.571 | 18.813 | 1.00 | 26.96 | N |
| ATOM | 21 | CA | PRO | A | 154 | −28.146 | −26.019 | 20.190 | 1.00 | 20.79 | C |
| ATOM | 22 | C | PRO | A | 154 | −28.236 | −24.848 | 21.163 | 1.00 | 22.57 | C |
| ATOM | 23 | O | PRO | A | 154 | −28.081 | −23.710 | 20.737 | 1.00 | 22.50 | O |
| ATOM | 24 | CB | PRO | A | 154 | −26.715 | −26.585 | 20.147 | 1.00 | 20.99 | C |
| ATOM | 25 | CG | PRO | A | 154 | −26.432 | −26.822 | 18.709 | 1.00 | 21.42 | C |
| ATOM | 26 | CD | PRO | A | 154 | −27.183 | −25.760 | 17.974 | 1.00 | 19.94 | C |
| ATOM | 27 | N | VAL | A | 155 | −28.499 | −25.124 | 22.438 | 1.00 | 21.58 | N |
| ATOM | 28 | CA | VAL | A | 155 | −28.490 | −24.090 | 23.462 | 1.00 | 20.72 | C |
| ATOM | 29 | C | VAL | A | 155 | −27.187 | −23.287 | 23.412 | 1.00 | 25.13 | C |
| ATOM | 30 | O | VAL | A | 155 | −26.109 | −23.865 | 23.218 | 1.00 | 27.20 | O |
| ATOM | 31 | CB | VAL | A | 155 | −28.664 | −24.704 | 24.884 | 1.00 | 23.97 | C |
| ATOM | 32 | CG1 | VAL | A | 155 | −28.384 | −23.669 | 25.957 | 1.00 | 27.90 | C |
| ATOM | 33 | CG2 | VAL | A | 155 | −30.062 | −25.267 | 25.061 | 1.00 | 25.53 | C |
| ATOM | 34 | N | ASN | A | 156 | −27.299 | −21.968 | 23.586 | 1.00 | 20.81 | N |
| ATOM | 35 | CA | ASN | A | 156 | −26.158 | −21.050 | 23.634 | 1.00 | 24.68 | C |
| ATOM | 36 | C | ASN | A | 156 | −25.568 | −20.824 | 22.253 | 1.00 | 25.74 | C |
| ATOM | 37 | O | ASN | A | 156 | −24.518 | −20.206 | 22.106 | 1.00 | 25.52 | O |
| ATOM | 38 | CB | ASN | A | 156 | −25.070 | −21.552 | 24.603 | 1.00 | 30.21 | C |
| ATOM | 39 | CG | ASN | A | 156 | −25.565 | −21.628 | 26.041 | 1.00 | 38.75 | C |
| ATOM | 40 | OD1 | ASN | A | 156 | −26.494 | −20.908 | 26.430 | 1.00 | 35.88 | O |
| ATOM | 41 | ND2 | ASN | A | 156 | −24.953 | −22.502 | 26.835 | 1.00 | 33.84 | N |
| ATOM | 42 | N | TRP | A | 157 | −26.247 | −21.340 | 21.237 | 1.00 | 24.43 | N |
| ATOM | 43 | CA | TRP | A | 157 | −25.928 | −20.981 | 19.866 | 1.00 | 23.93 | C |
| ATOM | 44 | C | TRP | A | 157 | −26.920 | −19.930 | 19.389 | 1.00 | 26.16 | C |
| ATOM | 45 | O | TRP | A | 157 | −28.032 | −19.841 | 19.904 | 1.00 | 28.51 | O |
| ATOM | 46 | CB | TRP | A | 157 | −25.965 | −22.202 | 18.965 | 1.00 | 22.94 | C |
| ATOM | 47 | CG | TRP | A | 157 | −24.818 | −23.129 | 19.174 | 1.00 | 24.76 | C |

TABLE 10.1-continued

| | | | | | | | | | |
|---|---|---|---|---|---|---|---|---|---|
| ATOM | 48 | CD1 | TRP | A | 157 | −24.459 | −23.752 | 20.336 | 1.00 20.94 C |
| ATOM | 49 | CD2 | TRP | A | 157 | −23.887 | −23.562 | 18.180 | 1.00 19.03 C |
| ATOM | 50 | NE1 | TRP | A | 157 | −23.355 | −24.540 | 20.126 | 1.00 23.79 N |
| ATOM | 51 | CE2 | TRP | A | 157 | −22.983 | −24.440 | 18.809 | 1.00 21.53 C |
| ATOM | 52 | CE3 | TRP | A | 157 | −23.717 | −23.273 | 16.828 | 1.00 15.83 C |
| ATOM | 53 | CZ2 | TRP | A | 157 | −21.927 | −25.043 | 18.124 | 1.00 16.56 C |
| ATOM | 54 | CZ3 | TRP | A | 157 | −22.667 | −23.866 | 16.152 | 1.00 18.56 C |
| ATOM | 55 | CH2 | TRP | A | 157 | −21.790 | −24.746 | 16.798 | 1.00 13.77 C |
| ATOM | 56 | N | VAL | A | 158 | −26.520 | −19.120 | 18.420 | 1.00 25.61 N |
| ATOM | 57 | CA | VAL | A | 158 | −27.394 | −18.058 | 17.951 | 1.00 23.85 C |
| ATOM | 58 | C | VAL | A | 158 | −27.857 | −18.367 | 16.536 | 1.00 26.75 C |
| ATOM | 59 | O | VAL | A | 158 | −27.048 | −18.589 | 15.642 | 1.00 24.47 O |
| ATOM | 60 | CB | VAL | A | 158 | −26.698 | −16.690 | 17.998 | 1.00 26.10 C |
| ATOM | 61 | CG1 | VAL | A | 158 | −27.691 | −15.587 | 17.690 | 1.00 21.15 C |
| ATOM | 62 | CG2 | VAL | A | 158 | −26.076 | −16.469 | 19.368 | 1.00 27.52 C |
| ATOM | 63 | N | GLU | A | 159 | −29.170 | −18.411 | 16.351 | 1.00 30.02 N |
| ATOM | 64 | CA | GLU | A | 159 | −29.751 | −18.659 | 15.043 | 1.00 28.56 C |
| ATOM | 65 | C | GLU | A | 159 | −29.824 | −17.359 | 14.272 | 1.00 25.78 C |
| ATOM | 66 | O | GLU | A | 159 | −30.140 | −16.313 | 14.840 | 1.00 24.18 O |
| ATOM | 67 | CB | GLU | A | 159 | −31.145 | −19.279 | 15.182 | 1.00 24.88 C |
| ATOM | 68 | CG | GLU | A | 159 | −31.764 | −19.742 | 13.875 | 1.00 35.35 C |
| ATOM | 69 | CD | GLU | A | 159 | −33.213 | −20.190 | 14.052 | 1.00 41.67 C |
| ATOM | 70 | OE1 | GLU | A | 159 | −34.123 | −19.392 | 13.733 | 1.00 44.61 O |
| ATOM | 71 | OE2 | GLU | A | 159 | −33.441 | −21.333 | 14.516 | 1.00 36.73 O |
| ATOM | 72 | N | HIS | A | 160 | −29.542 | −17.432 | 12.977 | 1.00 25.27 N |
| ATOM | 73 | CA | HIS | A | 160 | −29.577 | −16.257 | 12.118 | 1.00 31.03 C |
| ATOM | 74 | C | HIS | A | 160 | −29.525 | −16.672 | 10.656 | 1.00 30.42 C |
| ATOM | 75 | O | HIS | A | 160 | −28.530 | −17.261 | 10.205 | 1.00 26.33 O |
| ATOM | 76 | CB | HIS | A | 160 | −28.411 | −15.317 | 12.426 | 1.00 29.99 C |
| ATOM | 77 | CG | HIS | A | 160 | −28.320 | −14.150 | 11.493 | 1.00 28.06 C |
| ATOM | 78 | ND1 | HIS | A | 160 | −29.043 | −12.991 | 11.679 | 1.00 33.48 N |
| ATOM | 79 | CD2 | HIS | A | 160 | −27.605 | −13.970 | 10.359 | 1.00 29.69 C |
| ATOM | 80 | CE1 | HIS | A | 160 | −28.770 | −12.143 | 10.703 | 1.00 30.20 C |
| ATOM | 81 | NE2 | HIS | A | 160 | −27.903 | −12.713 | 9.887 | 1.00 29.37 N |
| ATOM | 82 | N | GLU | A | 161 | −30.593 | −16.361 | 9.925 | 1.00 29.26 N |
| ATOM | 83 | CA | GLU | A | 161 | −30.696 | −16.730 | 8.520 | 1.00 30.40 C |
| ATOM | 84 | C | GLU | A | 161 | −30.349 | −18.188 | 8.278 | 1.00 30.86 C |
| ATOM | 85 | O | GLU | A | 161 | −29.548 | −18.493 | 7.393 | 1.00 34.60 O |
| ATOM | 86 | CB | GLU | A | 161 | −29.788 | −15.852 | 7.659 | 1.00 35.54 C |
| ATOM | 87 | CG | GLU | A | 161 | −30.197 | −14.386 | 7.604 | 1.00 41.66 C |
| ATOM | 88 | CD | GLU | A | 161 | −31.526 | −14.165 | 6.901 | 1.00 42.46 C |
| ATOM | 89 | OE1 | GLU | A | 161 | −32.027 | −15.108 | 6.252 | 1.00 47.99 O |
| ATOM | 90 | OE2 | GLU | A | 161 | −32.070 | −13.043 | 7.001 | 1.00 40.82 O |
| ATOM | 91 | N | ARG | A | 162 | −30.928 | −19.068 | 9.092 | 1.00 24.36 N |
| ATOM | 92 | CA | ARG | A | 162 | −30.792 | −20.516 | 8.931 | 1.00 31.86 C |
| ATOM | 93 | C | ARG | A | 162 | −29.374 | −21.045 | 9.202 | 1.00 30.42 C |
| ATOM | 94 | O | ARG | A | 162 | −29.030 | −22.166 | 8.814 | 1.00 31.05 O |
| ATOM | 95 | CB | ARG | A | 162 | −31.250 | −20.930 | 7.528 | 1.00 38.14 C |
| ATOM | 96 | CG | ARG | A | 162 | −32.267 | −22.051 | 7.540 | 1.00 48.13 C |
| ATOM | 97 | CD | ARG | A | 162 | −33.076 | −22.071 | 6.261 | 1.00 59.39 C |
| ATOM | 98 | NE | ARG | A | 162 | −33.517 | −23.423 | 5.921 | 1.00 73.66 N |
| ATOM | 99 | CZ | ARG | A | 162 | −34.365 | −23.702 | 4.937 | 1.00 64.55 C |
| ATOM | 100 | NH1 | ARG | A | 162 | −34.866 | −22.720 | 4.200 | 1.00 53.99 N |
| ATOM | 101 | NH2 | ARG | A | 162 | −34.711 | −24.960 | 4.694 | 1.00 63.33 N |
| ATOM | 102 | N | SER | A | 163 | −28.556 | −20.240 | 9.869 | 1.00 24.82 N |
| ATOM | 103 | CA | SER | A | 163 | −27.287 | −20.728 | 10.379 | 1.00 27.06 C |
| ATOM | 104 | C | SER | A | 163 | −27.270 | −20.611 | 11.897 | 1.00 28.98 C |
| ATOM | 105 | O | SER | A | 163 | −27.914 | −19.730 | 12.474 | 1.00 28.00 O |
| ATOM | 106 | CB | SER | A | 163 | −26.110 | −19.963 | 9.768 | 1.00 26.42 C |
| ATOM | 107 | OG | SER | A | 163 | −25.629 | −20.605 | 8.596 | 1.00 27.29 O |
| ATOM | 108 | N | CYS | A | 164 | −26.548 | −21.522 | 12.537 | 1.00 26.62 N |
| ATOM | 109 | CA | CYS | A | 164 | −26.342 | −21.469 | 13.975 | 1.00 23.71 C |
| ATOM | 110 | C | CYS | A | 164 | −24.920 | −20.996 | 14.249 | 1.00 23.70 C |
| ATOM | 111 | O | CYS | A | 164 | −23.980 | −21.412 | 13.579 | 1.00 20.95 O |
| ATOM | 112 | CB | CYS | A | 164 | −26.591 | −22.838 | 14.601 | 1.00 25.60 C |
| ATOM | 113 | SG | CYS | A | 164 | −28.228 | −23.515 | 14.210 | 1.00 29.69 S |
| ATOM | 114 | N | TYR | A | 165 | −24.766 | −20.116 | 15.227 | 1.00 23.47 N |
| ATOM | 115 | CA | TYR | A | 165 | −23.469 | −19.539 | 15.507 | 1.00 21.97 C |
| ATOM | 116 | C | TYR | A | 165 | −23.139 | −19.708 | 16.970 | 1.00 22.33 C |
| ATOM | 117 | O | TYR | A | 165 | −23.970 | −19.473 | 17.835 | 1.00 21.92 O |
| ATOM | 118 | CB | TYR | A | 165 | −23.434 | −18.055 | 15.141 | 1.00 17.23 C |
| ATOM | 119 | CG | TYR | A | 165 | −23.665 | −17.761 | 13.679 | 1.00 18.76 C |
| ATOM | 120 | CD1 | TYR | A | 165 | −24.949 | −17.615 | 13.174 | 1.00 22.13 C |
| ATOM | 121 | CD2 | TYR | A | 165 | −22.601 | −17.602 | 12.813 | 1.00 21.90 C |
| ATOM | 122 | CE1 | TYR | A | 165 | −25.169 | −17.327 | 11.833 | 1.00 25.39 C |
| ATOM | 123 | CE2 | TYR | A | 165 | −22.808 | −17.317 | 11.470 | 1.00 23.30 C |
| ATOM | 124 | CZ | TYR | A | 165 | −24.096 | −17.177 | 10.990 | 1.00 24.28 C |
| ATOM | 125 | OH | TYR | A | 165 | −24.295 | −16.900 | 9.663 | 1.00 25.37 O |
| ATOM | 126 | N | TRP | A | 166 | −21.913 | −20.111 | 17.243 | 1.00 17.81 N |
| ATOM | 127 | CA | TRP | A | 166 | −21.436 | −20.129 | 18.601 | 1.00 20.06 C |

TABLE 10.1-continued

| | | | | | | | | | | |
|---|---|---|---|---|---|---|---|---|---|---|
| ATOM | 128 | C | TRP | A | 166 | −20.213 | −19.213 | 18.680 | 1.00 | 18.56 C |
| ATOM | 129 | O | TRP | A | 166 | −19.289 | −19.307 | 17.870 | 1.00 | 18.84 O |
| ATOM | 130 | CB | TRP | A | 166 | −21.117 | −21.554 | 19.040 | 1.00 | 18.95 C |
| ATOM | 131 | CG | TRP | A | 166 | −20.709 | −21.665 | 20.486 | 1.00 | 22.40 C |
| ATOM | 132 | CD1 | TRP | A | 166 | −21.533 | −21.745 | 21.563 | 1.00 | 21.92 C |
| ATOM | 133 | CD2 | TRP | A | 166 | −19.369 | −21.697 | 21.001 | 1.00 | 22.78 C |
| ATOM | 134 | NE1 | TRP | A | 166 | −20.797 | −21.831 | 22.717 | 1.00 | 26.27 N |
| ATOM | 135 | CE2 | TRP | A | 166 | −19.464 | −21.805 | 22.400 | 1.00 | 22.51 C |
| ATOM | 136 | CE3 | TRP | A | 166 | −18.098 | −21.648 | 20.408 | 1.00 | 20.00 C |
| ATOM | 137 | CZ2 | TRP | A | 166 | −18.343 | −21.869 | 23.221 | 1.00 | 19.21 C |
| ATOM | 138 | CZ3 | TRP | A | 166 | −16.989 | −21.716 | 21.214 | 1.00 | 19.92 C |
| ATOM | 139 | CH2 | TRP | A | 166 | −17.116 | −21.820 | 22.616 | 1.00 | 20.77 C |
| ATOM | 140 | N | PHE | A | 167 | −20.233 | −18.308 | 19.648 | 1.00 | 20.52 N |
| ATOM | 141 | CA | PHE | A | 167 | −19.189 | −17.304 | 19.803 | 1.00 | 17.05 C |
| ATOM | 142 | C | PHE | A | 167 | −18.367 | −17.589 | 21.039 | 1.00 | 23.11 C |
| ATOM | 143 | O | PHE | A | 167 | −18.847 | −17.397 | 22.149 | 1.00 | 20.92 O |
| ATOM | 144 | CB | PHE | A | 167 | −19.794 | −15.905 | 19.894 | 1.00 | 17.09 C |
| ATOM | 145 | CG | PHE | A | 167 | −20.649 | −15.533 | 18.712 | 1.00 | 19.67 C |
| ATOM | 146 | CD1 | PHE | A | 167 | −22.012 | −15.806 | 18.710 | 1.00 | 20.06 C |
| ATOM | 147 | CD2 | PHE | A | 167 | −20.087 | −14.907 | 17.598 | 1.00 | 18.66 C |
| ATOM | 148 | CE1 | PHE | A | 167 | −22.807 | −15.457 | 17.615 | 1.00 | 21.81 C |
| ATOM | 149 | CE2 | PHE | A | 167 | −20.860 | −14.555 | 16.501 | 1.00 | 14.19 C |
| ATOM | 150 | CZ | PHE | A | 167 | −22.230 | −14.836 | 16.502 | 1.00 | 20.28 C |
| ATOM | 151 | N | SER | A | 168 | −17.127 | −18.039 | 20.853 | 1.00 | 20.07 N |
| ATOM | 152 | CA | SER | A | 168 | −16.296 | −18.360 | 22.000 | 1.00 | 19.88 C |
| ATOM | 153 | C | SER | A | 168 | −16.073 | −17.121 | 22.847 | 1.00 | 23.65 C |
| ATOM | 154 | O | SER | A | 168 | −16.105 | −15.992 | 22.331 | 1.00 | 22.61 O |
| ATOM | 155 | CB | SER | A | 168 | −14.950 | −18.952 | 21.570 | 1.00 | 13.34 C |
| ATOM | 156 | OG | SER | A | 168 | −14.018 | −17.940 | 21.262 | 1.00 | 16.40 O |
| ATOM | 157 | N | ARG | A | 169 | −15.877 | −17.339 | 24.149 | 1.00 | 18.01 N |
| ATOM | 158 | CA | ARG | A | 169 | −15.443 | −16.284 | 25.038 | 1.00 | 22.03 C |
| ATOM | 159 | C | ARG | A | 169 | −14.033 | −16.614 | 25.568 | 1.00 | 21.36 C |
| ATOM | 160 | O | ARG | A | 169 | −13.617 | −16.124 | 26.615 | 1.00 | 24.92 O |
| ATOM | 161 | CB | ARG | A | 169 | −16.447 | −16.082 | 26.182 | 1.00 | 26.09 C |
| ATOM | 162 | CG | ARG | A | 169 | −17.858 | −15.584 | 25.733 | 1.00 | 33.24 C |
| ATOM | 163 | CD | ARG | A | 169 | −17.799 | −14.586 | 24.532 | 1.00 | 35.48 C |
| ATOM | 164 | NE | ARG | A | 169 | −19.120 | −14.199 | 24.007 | 1.00 | 41.60 N |
| ATOM | 165 | CZ | ARG | A | 169 | −19.315 | −13.401 | 22.953 | 1.00 | 38.23 C |
| ATOM | 166 | NH1 | ARG | A | 169 | −18.279 | −12.905 | 22.281 | 1.00 | 28.72 N |
| ATOM | 167 | NH2 | ARG | A | 169 | −20.550 | −13.100 | 22.559 | 1.00 | 36.96 N |
| ATOM | 168 | N | SER | A | 170 | −13.303 | −17.438 | 24.823 | 1.00 | 16.23 N |
| ATOM | 169 | CA | SER | A | 170 | −11.877 | −17.660 | 25.065 | 1.00 | 16.00 C |
| ATOM | 170 | C | SER | A | 170 | −11.094 | −17.698 | 23.742 | 1.00 | 17.67 C |
| ATOM | 171 | O | SER | A | 170 | −11.662 | −17.537 | 22.663 | 1.00 | 16.96 O |
| ATOM | 172 | CB | SER | A | 170 | −11.652 | −18.958 | 25.851 | 1.00 | 17.57 C |
| ATOM | 173 | OG | SER | A | 170 | −12.101 | −20.084 | 25.121 | 1.00 | 18.85 O |
| ATOM | 174 | N | GLY | A | 171 | −9.783 | −17.916 | 23.824 | 1.00 | 19.23 N |
| ATOM | 175 | CA | GLY | A | 171 | −8.947 | −17.854 | 22.645 | 1.00 | 12.77 C |
| ATOM | 176 | C | GLY | A | 171 | −8.169 | −19.115 | 22.334 | 1.00 | 16.65 C |
| ATOM | 177 | O | GLY | A | 171 | −7.701 | −19.820 | 23.236 | 1.00 | 16.99 O |
| ATOM | 178 | N | LYS | A | 172 | −8.037 | −19.389 | 21.039 | 1.00 | 15.85 N |
| ATOM | 179 | CA | LYS | A | 172 | −7.313 | −20.542 | 20.533 | 1.00 | 13.77 C |
| ATOM | 180 | C | LYS | A | 172 | −6.509 | −20.164 | 19.309 | 1.00 | 17.02 C |
| ATOM | 181 | O | LYS | A | 172 | −6.873 | −19.224 | 18.576 | 1.00 | 17.20 O |
| ATOM | 182 | CB | LYS | A | 172 | −8.262 | −21.678 | 20.148 | 1.00 | 16.06 C |
| ATOM | 183 | CG | LYS | A | 172 | −8.818 | −22.506 | 21.281 | 1.00 | 17.04 C |
| ATOM | 184 | CD | LYS | A | 172 | −9.638 | −23.666 | 20.687 | 1.00 | 17.13 C |
| ATOM | 185 | CE | LYS | A | 172 | −10.400 | −24.441 | 21.766 | 1.00 | 16.06 C |
| ATOM | 186 | NZ | LYS | A | 172 | −9.439 | −25.070 | 22.711 | 1.00 | 20.45 N |
| ATOM | 187 | N | ALA | A | 173 | −5.427 | −20.902 | 19.074 | 1.00 | 13.08 N |
| ATOM | 188 | CA | ALA | A | 173 | −4.750 | −20.834 | 17.792 | 1.00 | 14.02 C |
| ATOM | 189 | C | ALA | A | 173 | −5.758 | −21.289 | 16.754 | 1.00 | 16.04 C |
| ATOM | 190 | O | ALA | A | 173 | −6.675 | −22.056 | 17.064 | 1.00 | 15.29 O |
| ATOM | 191 | CB | ALA | A | 173 | −3.482 | −21.720 | 17.766 | 1.00 | 14.17 C |
| ATOM | 192 | N | TRP | A | 174 | −5.591 | −20.827 | 15.522 | 1.00 | 16.89 N |
| ATOM | 193 | CA | TRP | A | 174 | −6.571 | −21.098 | 14.492 | 1.00 | 15.29 C |
| ATOM | 194 | C | TRP | A | 174 | −6.839 | −22.598 | 14.329 | 1.00 | 17.24 C |
| ATOM | 195 | O | TRP | A | 174 | −8.000 | −23.030 | 14.334 | 1.00 | 17.21 O |
| ATOM | 196 | CB | TRP | A | 174 | −6.111 | −20.486 | 13.185 | 1.00 | 15.83 C |
| ATOM | 197 | CG | TRP | A | 174 | −7.133 | −20.523 | 12.123 | 1.00 | 17.80 C |
| ATOM | 198 | CD1 | TRP | A | 174 | −8.015 | −19.532 | 11.795 | 1.00 | 14.69 C |
| ATOM | 199 | CD2 | TRP | A | 174 | −7.375 | −21.598 | 11.217 | 1.00 | 17.89 C |
| ATOM | 200 | NE1 | TRP | A | 174 | −8.784 | −19.926 | 10.732 | 1.00 | 13.89 N |
| ATOM | 201 | CE2 | TRP | A | 174 | −8.416 | −21.193 | 10.361 | 1.00 | 17.17 C |
| ATOM | 202 | CE3 | TRP | A | 174 | −6.803 | −22.865 | 11.036 | 1.00 | 20.13 C |
| ATOM | 203 | CZ2 | TRP | A | 174 | −8.911 | −22.013 | 9.353 | 1.00 | 17.46 C |
| ATOM | 204 | CZ3 | TRP | A | 174 | −7.294 | −23.675 | 10.039 | 1.00 | 18.74 C |
| ATOM | 205 | CH2 | TRP | A | 174 | −8.338 | −23.246 | 9.208 | 1.00 | 21.31 C |
| ATOM | 206 | N | ALA | A | 175 | −5.781 | −23.395 | 14.229 | 1.00 | 14.70 N |
| ATOM | 207 | CA | ALA | A | 175 | −5.950 | −24.829 | 13.999 | 1.00 | 16.88 C |

TABLE 10.1-continued

| | | | | | | | | | | |
|---|---|---|---|---|---|---|---|---|---|---|
| ATOM | 208 | C | ALA | A | 175 | −6.707 | −25.488 | 15.138 | 1.00 | 18.55 C |
| ATOM | 209 | O | ALA | A | 175 | −7.444 | −26.448 | 14.921 | 1.00 | 18.63 O |
| ATOM | 210 | CB | ALA | A | 175 | −4.595 | −25.512 | 13.803 | 1.00 | 20.43 C |
| ATOM | 211 | N | ASP | A | 176 | −6.530 | −24.982 | 16.355 | 1.00 | 15.66 N |
| ATOM | 212 | CA | ASP | A | 176 | −7.267 | −25.535 | 17.479 | 1.00 | 14.07 C |
| ATOM | 213 | C | ASP | A | 176 | −8.717 | −25.047 | 17.471 | 1.00 | 17.62 C |
| ATOM | 214 | O | ASP | A | 176 | −9.621 | −25.790 | 17.834 | 1.00 | 19.92 O |
| ATOM | 215 | CB | ASP | A | 176 | −6.566 | −25.191 | 18.784 | 1.00 | 17.82 C |
| ATOM | 216 | CG | ASP | A | 176 | −5.169 | −25.805 | 18.865 | 1.00 | 32.45 C |
| ATOM | 217 | OD2 | ASP | A | 176 | −4.231 | −25.127 | 19.349 | 1.00 | 29.94 O |
| ATOM | 218 | OD1 | ASP | A | 176 | −5.003 | −26.959 | 18.405 | 1.00 | 34.43 O |
| ATOM | 219 | N | ALA | A | 177 | −8.951 | −23.811 | 17.036 | 1.00 | 15.88 N |
| ATOM | 220 | CA | ALA | A | 177 | −10.324 | −23.342 | 16.867 | 1.00 | 15.36 C |
| ATOM | 221 | C | ALA | A | 177 | −11.000 | −24.134 | 15.765 | 1.00 | 14.26 C |
| ATOM | 222 | O | ALA | A | 177 | −12.176 | −24.472 | 15.856 | 1.00 | 17.76 O |
| ATOM | 223 | CB | ALA | A | 177 | −10.355 | −21.866 | 16.550 | 1.00 | 12.43 C |
| ATOM | 224 | N | ASP | A | 178 | −10.250 | −24.417 | 14.710 | 1.00 | 17.91 N |
| ATOM | 225 | CA | ASP | A | 178 | −10.776 | −25.168 | 13.575 | 1.00 | 18.45 C |
| ATOM | 226 | C | ASP | A | 178 | −11.241 | −26.540 | 14.045 | 1.00 | 20.72 C |
| ATOM | 227 | O | ASP | A | 178 | −12.390 | −26.930 | 13.819 | 1.00 | 17.75 O |
| ATOM | 228 | CB | ASP | A | 178 | −9.714 | −25.301 | 12.493 | 1.00 | 18.31 C |
| ATOM | 229 | CG | ASP | A | 178 | −10.161 | −26.169 | 11.346 | 1.00 | 24.63 C |
| ATOM | 230 | OD1 | ASP | A | 178 | −11.279 | −25.949 | 10.829 | 1.00 | 26.01 O |
| ATOM | 231 | OD2 | ASP | A | 178 | −9.388 | −27.067 | 10.960 | 1.00 | 28.35 O |
| ATOM | 232 | N | ASN | A | 179 | −10.343 | −27.251 | 14.729 | 1.00 | 18.35 N |
| ATOM | 233 | CA | ASN | A | 179 | −10.668 | −28.541 | 15.329 | 1.00 | 20.73 C |
| ATOM | 234 | C | ASN | A | 179 | −11.839 | −28.466 | 16.310 | 1.00 | 21.76 C |
| ATOM | 235 | O | ASN | A | 179 | −12.689 | −29.359 | 16.343 | 1.00 | 22.85 O |
| ATOM | 236 | CB | ASN | A | 179 | −9.443 | −29.130 | 16.037 | 1.00 | 19.26 C |
| ATOM | 237 | CG | ASN | A | 179 | −9.756 | −30.435 | 16.752 | 1.00 | 24.98 C |
| ATOM | 238 | OD1 | ASN | A | 179 | −9.955 | −30.455 | 17.961 | 1.00 | 27.04 O |
| ATOM | 239 | ND2 | ASN | A | 179 | −9.814 | −31.528 | 16.002 | 1.00 | 24.23 N |
| ATOM | 240 | N | TYR | A | 180 | −11.897 | −27.407 | 17.110 | 1.00 | 17.86 N |
| ATOM | 241 | CA | TYR | A | 180 | −13.001 | −27.265 | 18.054 | 1.00 | 16.79 C |
| ATOM | 242 | C | TYR | A | 180 | −14.342 | −27.266 | 17.313 | 1.00 | 19.82 C |
| ATOM | 243 | O | TYR | A | 180 | −15.287 | −27.948 | 17.709 | 1.00 | 19.73 O |
| ATOM | 244 | CB | TYR | A | 180 | −12.861 | −25.985 | 18.891 | 1.00 | 16.59 C |
| ATOM | 245 | CG | TYR | A | 180 | −14.056 | −25.719 | 19.810 | 1.00 | 19.48 C |
| ATOM | 246 | CD2 | TYR | A | 180 | −13.996 | −26.024 | 21.162 | 1.00 | 24.26 C |
| ATOM | 247 | CD1 | TYR | A | 180 | −15.245 | −25.156 | 19.316 | 1.00 | 18.40 C |
| ATOM | 248 | CE2 | TYR | A | 180 | −15.089 | −25.789 | 22.008 | 1.00 | 20.67 C |
| ATOM | 249 | CE1 | TYR | A | 180 | −16.328 | −24.922 | 20.135 | 1.00 | 16.82 C |
| ATOM | 250 | CZ | TYR | A | 180 | −16.243 | −25.239 | 21.483 | 1.00 | 23.60 C |
| ATOM | 251 | OH | TYR | A | 180 | −17.312 | −25.009 | 22.311 | 1.00 | 27.99 O |
| ATOM | 252 | N | CYS | A | 181 | −14.416 | −26.480 | 16.247 | 1.00 | 21.68 N |
| ATOM | 253 | CA | CYS | A | 181 | −15.634 | −26.361 | 15.468 | 1.00 | 21.18 C |
| ATOM | 254 | C | CYS | A | 181 | −16.005 | −27.691 | 14.816 | 1.00 | 22.39 C |
| ATOM | 255 | O | CYS | A | 181 | −17.173 | −28.054 | 14.738 | 1.00 | 17.23 O |
| ATOM | 256 | CB | CYS | A | 181 | −15.479 | −25.268 | 14.414 | 1.00 | 17.00 C |
| ATOM | 257 | SG | CYS | A | 181 | −15.347 | −23.612 | 15.108 | 1.00 | 21.92 S |
| ATOM | 258 | N | ARG | A | 182 | −15.008 | −28.435 | 14.366 | 1.00 | 22.70 N |
| ATOM | 259 | CA | ARG | A | 182 | −15.309 | −29.699 | 13.720 | 1.00 | 25.40 C |
| ATOM | 260 | C | ARG | A | 182 | −15.881 | −30.687 | 14.737 | 1.00 | 22.32 C |
| ATOM | 261 | O | ARG | A | 182 | −16.756 | −31.489 | 14.417 | 1.00 | 21.62 O |
| ATOM | 262 | CB | ARG | A | 182 | −14.064 | −30.255 | 13.031 | 1.00 | 22.43 C |
| ATOM | 263 | CG | ARG | A | 182 | −13.757 | −29.535 | 11.727 | 1.00 | 27.35 C |
| ATOM | 264 | CD | ARG | A | 182 | −12.390 | −29.887 | 11.188 | 1.00 | 27.56 C |
| ATOM | 265 | NE | ARG | A | 182 | −11.981 | −28.956 | 10.139 | 1.00 | 34.68 N |
| ATOM | 266 | CZ | ARG | A | 182 | −12.311 | −29.080 | 8.851 | 1.00 | 37.24 C |
| ATOM | 267 | NH1 | ARG | A | 182 | −13.062 | −30.100 | 8.446 | 1.00 | 30.09 N |
| ATOM | 268 | NH2 | ARG | A | 182 | −11.900 | −28.176 | 7.966 | 1.00 | 33.00 N |
| ATOM | 269 | N | LEU | A | 183 | −15.415 | −30.609 | 15.975 | 1.00 | 22.21 N |
| ATOM | 270 | CA | LEU | A | 183 | −15.858 | −31.565 | 16.980 | 1.00 | 20.10 C |
| ATOM | 271 | C | LEU | A | 183 | −17.289 | −31.265 | 17.408 | 1.00 | 22.94 C |
| ATOM | 272 | O | LEU | A | 183 | −17.907 | −32.076 | 18.096 | 1.00 | 23.53 O |
| ATOM | 273 | CB | LEU | A | 183 | −14.918 | −31.577 | 18.182 | 1.00 | 19.03 C |
| ATOM | 274 | CG | LEU | A | 183 | −13.826 | −32.651 | 18.153 | 1.00 | 24.47 C |
| ATOM | 275 | CD1 | LEU | A | 183 | −13.119 | −32.696 | 16.809 | 1.00 | 24.47 C |
| ATOM | 276 | CD2 | LEU | A | 183 | −12.816 | −32.407 | 19.258 | 1.00 | 24.08 C |
| ATOM | 277 | N | GLU | A | 184 | −17.809 | −30.113 | 16.977 | 1.00 | 23.63 N |
| ATOM | 278 | CA | GLU | A | 184 | −19.222 | −29.762 | 17.156 | 1.00 | 23.88 C |
| ATOM | 279 | C | GLU | A | 184 | −20.075 | −29.971 | 15.910 | 1.00 | 22.40 C |
| ATOM | 280 | O | GLU | A | 184 | −21.110 | −29.330 | 15.791 | 1.00 | 22.93 O |
| ATOM | 281 | CB | GLU | A | 184 | −19.372 | −28.292 | 17.560 | 1.00 | 23.75 C |
| ATOM | 282 | CG | GLU | A | 184 | −18.635 | −27.890 | 18.806 | 1.00 | 26.06 C |
| ATOM | 283 | CD | GLU | A | 184 | −19.139 | −28.631 | 20.019 | 1.00 | 33.11 C |
| ATOM | 284 | OE1 | GLU | A | 184 | −20.363 | −28.913 | 20.075 | 1.00 | 34.32 O |
| ATOM | 285 | OE2 | GLU | A | 184 | −18.305 | −28.946 | 20.899 | 1.00 | 34.75 O |
| ATOM | 286 | N | ASP | A | 185 | −19.651 | −30.834 | 14.989 | 1.00 | 21.89 N |
| ATOM | 287 | CA | ASP | A | 185 | −20.270 | −30.908 | 13.664 | 1.00 | 25.50 C |

TABLE 10.1-continued

| | | | | | | | | | |
|---|---|---|---|---|---|---|---|---|---|
| ATOM | 288 | C | ASP | A | 185 | −20.452 | −29.523 | 13.066 | 1.00 | 22.06 C |
| ATOM | 289 | O | ASP | A | 185 | −21.511 | −29.206 | 12.547 | 1.00 | 21.39 O |
| ATOM | 290 | CB | ASP | A | 185 | −21.637 | −31.606 | 13.701 | 1.00 | 40.42 C |
| ATOM | 291 | CG | ASP | A | 185 | −21.531 | −33.104 | 13.910 | 1.00 | 51.64 C |
| ATOM | 292 | OD1 | ASP | A | 185 | −20.401 | −33.647 | 13.831 | 1.00 | 55.89 O |
| ATOM | 293 | OD2 | ASP | A | 185 | −22.589 | −33.745 | 14.116 | 1.00 | 52.07 O |
| ATOM | 294 | N | ALA | A | 186 | −19.419 | −28.693 | 13.152 | 1.00 | 25.31 N |
| ATOM | 295 | CA | ALA | A | 186 | −19.521 | −27.315 | 12.702 | 1.00 | 21.25 C |
| ATOM | 296 | C | ALA | A | 186 | −18.262 | −26.920 | 11.989 | 1.00 | 18.66 C |
| ATOM | 297 | O | ALA | A | 186 | −17.353 | −27.723 | 11.805 | 1.00 | 20.79 O |
| ATOM | 298 | CB | ALA | A | 186 | −19.779 | −26.377 | 13.882 | 1.00 | 18.33 C |
| ATOM | 299 | N | HIS | A | 187 | −18.199 | −25.658 | 11.603 | 1.00 | 18.96 N |
| ATOM | 300 | CA | HIS | A | 187 | −17.012 | −25.135 | 10.969 | 1.00 | 17.14 C |
| ATOM | 301 | C | HIS | A | 187 | −16.810 | −23.710 | 11.439 | 1.00 | 17.01 C |
| ATOM | 302 | O | HIS | A | 187 | −17.776 | −23.033 | 11.778 | 1.00 | 19.70 O |
| ATOM | 303 | CB | HIS | A | 187 | −17.156 | −25.191 | 9.450 | 1.00 | 15.59 C |
| ATOM | 304 | CG | HIS | A | 187 | −18.323 | −24.414 | 8.940 | 1.00 | 15.47 C |
| ATOM | 305 | ND1 | HIS | A | 187 | −18.281 | −23.048 | 8.761 | 1.00 | 15.92 N |
| ATOM | 306 | CD2 | HIS | A | 187 | −19.578 | −24.800 | 8.606 | 1.00 | 18.70 C |
| ATOM | 307 | CE1 | HIS | A | 187 | −19.456 | −22.628 | 8.323 | 1.00 | 18.66 C |
| ATOM | 308 | NE2 | HIS | A | 187 | −20.261 | −23.671 | 8.223 | 1.00 | 21.90 N |
| ATOM | 309 | N | LEU | A | 188 | −15.560 | −23.264 | 11.480 | 1.00 | 16.40 N |
| ATOM | 310 | CA | LEU | A | 188 | −15.256 | −21.859 | 11.698 | 1.00 | 14.33 C |
| ATOM | 311 | C | LEU | A | 188 | −16.058 | −20.996 | 10.738 | 1.00 | 16.82 C |
| ATOM | 312 | O | LEU | A | 188 | −16.141 | −21.289 | 9.527 | 1.00 | 15.26 O |
| ATOM | 313 | CB | LEU | A | 188 | −13.761 | −21.602 | 11.512 | 1.00 | 13.49 C |
| ATOM | 314 | CG | LEU | A | 188 | −12.853 | −21.922 | 12.696 | 1.00 | 16.50 C |
| ATOM | 315 | CD1 | LEU | A | 188 | −11.390 | −21.816 | 12.290 | 1.00 | 18.24 C |
| ATOM | 316 | CD2 | LEU | A | 188 | −13.163 | −20.975 | 13.841 | 1.00 | 15.22 C |
| ATOM | 317 | N | VAL | A | 189 | −16.613 | −19.915 | 11.271 | 1.00 | 15.19 N |
| ATOM | 318 | CA | VAL | A | 189 | −17.596 | −19.127 | 10.543 | 1.00 | 13.95 C |
| ATOM | 319 | C | VAL | A | 189 | −17.130 | −18.784 | 9.129 | 1.00 | 14.59 C |
| ATOM | 320 | O | VAL | A | 189 | −15.970 | −18.432 | 8.894 | 1.00 | 13.02 O |
| ATOM | 321 | CB | VAL | A | 189 | −17.957 | −17.836 | 11.316 | 1.00 | 15.19 C |
| ATOM | 322 | CG1 | VAL | A | 189 | −16.788 | −16.866 | 11.361 | 1.00 | 13.58 C |
| ATOM | 323 | CG2 | VAL | A | 189 | −19.191 | −17.168 | 10.700 | 1.00 | 19.68 C |
| ATOM | 324 | N | VAL | A | 190 | −18.041 | −18.966 | 8.183 | 1.00 | 16.77 N |
| ATOM | 325 | CA | VAL | A | 190 | −17.814 | −18.617 | 6.786 | 1.00 | 18.83 C |
| ATOM | 326 | C | VAL | A | 190 | −18.720 | −17.429 | 6.469 | 1.00 | 18.58 C |
| ATOM | 327 | O | VAL | A | 190 | −19.925 | −17.526 | 6.604 | 1.00 | 17.97 O |
| ATOM | 328 | CB | VAL | A | 190 | −18.113 | −19.808 | 5.843 | 1.00 | 19.02 C |
| ATOM | 329 | CG1 | VAL | A | 190 | −18.145 | −19.357 | 4.367 | 1.00 | 16.14 C |
| ATOM | 330 | CG2 | VAL | A | 190 | −17.092 | −20.917 | 6.052 | 1.00 | 17.67 C |
| ATOM | 331 | N | VAL | A | 191 | −18.146 | −16.297 | 6.086 | 1.00 | 16.96 N |
| ATOM | 332 | CA | VAL | A | 191 | −18.956 | −15.094 | 5.909 | 1.00 | 16.61 C |
| ATOM | 333 | C | VAL | A | 191 | −19.163 | −14.813 | 4.424 | 1.00 | 21.27 C |
| ATOM | 334 | O | VAL | A | 191 | −18.196 | −14.541 | 3.705 | 1.00 | 19.05 O |
| ATOM | 335 | CB | VAL | A | 191 | −18.302 | −13.887 | 6.589 | 1.00 | 19.68 C |
| ATOM | 336 | CG1 | VAL | A | 191 | −19.161 | −12.637 | 6.414 | 1.00 | 16.81 C |
| ATOM | 337 | CG2 | VAL | A | 191 | −18.073 | −14.187 | 8.076 | 1.00 | 17.57 C |
| ATOM | 338 | N | THR | A | 192 | −20.410 | −14.895 | 3.960 | 1.00 | 17.29 N |
| ATOM | 339 | CA | THR | A | 192 | −20.686 | −14.767 | 2.523 | 1.00 | 21.54 C |
| ATOM | 340 | C | THR | A | 192 | −21.558 | −13.571 | 2.143 | 1.00 | 21.36 C |
| ATOM | 341 | O | THR | A | 192 | −21.854 | −13.372 | 0.976 | 1.00 | 21.17 O |
| ATOM | 342 | CB | THR | A | 192 | −21.344 | −16.046 | 1.963 | 1.00 | 19.51 C |
| ATOM | 343 | OG1 | THR | A | 192 | −22.486 | −16.392 | 2.755 | 1.00 | 23.52 O |
| ATOM | 344 | CG2 | THR | A | 192 | −20.354 | −17.193 | 2.007 | 1.00 | 19.60 C |
| ATOM | 345 | N | SER | A | 193 | −21.938 | −12.744 | 3.107 | 1.00 | 18.59 N |
| ATOM | 346 | CA | SER | A | 193 | −22.678 | −11.549 | 2.755 | 1.00 | 21.89 C |
| ATOM | 347 | C | SER | A | 193 | −22.432 | −10.451 | 3.763 | 1.00 | 26.64 C |
| ATOM | 348 | O | SER | A | 193 | −21.913 | −10.693 | 4.856 | 1.00 | 19.28 O |
| ATOM | 349 | CB | SER | A | 193 | −24.172 | −11.847 | 2.681 | 1.00 | 23.78 C |
| ATOM | 350 | OG | SER | A | 193 | −24.655 | −12.141 | 3.986 | 1.00 | 23.32 O |
| ATOM | 351 | N | TRP | A | 194 | −22.825 | −9.241 | 3.378 | 1.00 | 27.24 N |
| ATOM | 352 | CA | TRP | A | 194 | −22.794 | −8.087 | 4.260 | 1.00 | 24.77 C |
| ATOM | 353 | C | TRP | A | 194 | −23.633 | −8.331 | 5.504 | 1.00 | 25.57 C |
| ATOM | 354 | O | TRP | A | 194 | −23.199 | −8.061 | 6.624 | 1.00 | 26.59 O |
| ATOM | 355 | CB | TRP | A | 194 | −23.295 | −6.845 | 3.519 | 1.00 | 28.68 C |
| ATOM | 356 | CG | TRP | A | 194 | −23.125 | −5.572 | 4.283 | 1.00 | 38.36 C |
| ATOM | 357 | CD1 | TRP | A | 194 | −24.116 | −4.747 | 4.741 | 1.00 | 37.90 C |
| ATOM | 358 | CD2 | TRP | A | 194 | −21.884 | −4.976 | 4.696 | 1.00 | 44.56 C |
| ATOM | 359 | NE1 | TRP | A | 194 | −23.569 | −3.668 | 5.400 | 1.00 | 43.45 N |
| ATOM | 360 | CE2 | TRP | A | 194 | −22.202 | −3.785 | 5.388 | 1.00 | 46.98 C |
| ATOM | 361 | CE3 | TRP | A | 194 | −20.538 | −5.334 | 4.546 | 1.00 | 36.22 C |
| ATOM | 362 | CZ2 | TRP | A | 194 | −21.219 | −2.949 | 5.932 | 1.00 | 52.52 C |
| ATOM | 363 | CZ3 | TRP | A | 194 | −19.560 | −4.503 | 5.089 | 1.00 | 42.44 C |
| ATOM | 364 | CH2 | TRP | A | 194 | −19.908 | −3.325 | 5.773 | 1.00 | 54.05 C |
| ATOM | 365 | N | GLU | A | 195 | −24.848 | −8.824 | 5.293 | 1.00 | 26.92 N |
| ATOM | 366 | CA | GLU | A | 195 | −25.764 | −9.112 | 6.385 | 1.00 | 23.47 C |
| ATOM | 367 | C | GLU | A | 195 | −25.105 | −9.996 | 7.433 | 1.00 | 23.12 C |

TABLE 10.1-continued

| | | | | | | | | | | |
|---|---|---|---|---|---|---|---|---|---|---|
| ATOM | 368 | O | GLU | A | 195 | −25.175 | −9.715 | 8.632 | 1.00 | 28.18 O |
| ATOM | 369 | CB | GLU | A | 195 | −27.037 | −9.781 | 5.846 | 1.00 | 30.26 C |
| ATOM | 370 | CG | GLU | A | 195 | −27.820 | −10.627 | 6.876 | 1.00 | 40.78 C |
| ATOM | 371 | CD | GLU | A | 195 | −27.676 | −12.144 | 6.673 | 1.00 | 40.62 C |
| ATOM | 372 | OE1 | GLU | A | 195 | −27.945 | −12.645 | 5.559 | 1.00 | 43.62 O |
| ATOM | 373 | OE2 | GLU | A | 195 | −27.294 | −12.841 | 7.634 | 1.00 | 42.10 O |
| ATOM | 374 | N | GLU | A | 196 | −24.454 | −11.059 | 6.975 | 1.00 | 20.16 N |
| ATOM | 375 | CA | GLU | A | 196 | −23.824 | −12.005 | 7.884 | 1.00 | 25.02 C |
| ATOM | 376 | C | GLU | A | 196 | −22.610 | −11.407 | 8.600 | 1.00 | 21.89 C |
| ATOM | 377 | O | GLU | A | 196 | −22.377 | −11.689 | 9.775 | 1.00 | 18.44 O |
| ATOM | 378 | CB | GLU | A | 196 | −23.416 | −13.265 | 7.136 | 1.00 | 20.96 C |
| ATOM | 379 | CG | GLU | A | 196 | −22.822 | −14.312 | 8.049 | 1.00 | 22.24 C |
| ATOM | 380 | CD | GLU | A | 196 | −22.589 | −15.613 | 7.337 | 1.00 | 22.15 C |
| ATOM | 381 | OE1 | GLU | A | 196 | −22.492 | −15.604 | 6.093 | 1.00 | 19.92 O |
| ATOM | 382 | OE2 | GLU | A | 196 | −22.506 | −16.645 | 8.028 | 1.00 | 24.74 O |
| ATOM | 383 | N | GLN | A | 197 | −21.851 | −10.584 | 7.881 | 1.00 | 18.28 N |
| ATOM | 384 | CA | GLN | A | 197 | −20.751 | −9.817 | 8.456 | 1.00 | 18.47 C |
| ATOM | 385 | C | GLN | A | 197 | −21.217 | −8.914 | 9.600 | 1.00 | 24.91 C |
| ATOM | 386 | O | GLN | A | 197 | −20.639 | −8.924 | 10.694 | 1.00 | 18.25 O |
| ATOM | 387 | CB | GLN | A | 197 | −20.084 | −8.973 | 7.373 | 1.00 | 18.68 C |
| ATOM | 388 | CG | GLN | A | 197 | −19.167 | −7.888 | 7.890 | 1.00 | 23.19 C |
| ATOM | 389 | CD | GLN | A | 197 | −17.832 | −8.428 | 8.348 | 1.00 | 19.88 C |
| ATOM | 390 | OE1 | GLN | A | 197 | −17.290 | −9.361 | 7.758 | 1.00 | 19.94 O |
| ATOM | 391 | NE2 | GLN | A | 197 | −17.289 | −7.840 | 9.406 | 1.00 | 20.73 N |
| ATOM | 392 | N | LYS | A | 198 | −22.253 | −8.118 | 9.334 | 1.00 | 26.27 N |
| ATOM | 393 | CA | LYS | A | 198 | −22.775 | −7.197 | 10.330 | 1.00 | 20.44 C |
| ATOM | 394 | C | LYS | A | 198 | −23.308 | −7.995 | 11.495 | 1.00 | 18.19 C |
| ATOM | 395 | O | LYS | A | 198 | −23.199 | −7.578 | 12.637 | 1.00 | 20.09 O |
| ATOM | 396 | CB | LYS | A | 198 | −23.886 | −6.312 | 9.757 | 1.00 | 26.97 C |
| ATOM | 397 | CG | LYS | A | 198 | −23.441 | −5.226 | 8.806 | 1.00 | 32.65 C |
| ATOM | 398 | CD | LYS | A | 198 | −24.652 | −4.387 | 8.368 | 1.00 | 47.94 C |
| ATOM | 399 | CE | LYS | A | 198 | −25.404 | −3.782 | 9.568 | 1.00 | 44.86 C |
| ATOM | 400 | NZ | LYS | A | 198 | −26.475 | −2.822 | 9.154 | 1.00 | 46.87 N |
| ATOM | 401 | N | PHE | A | 199 | −23.903 | −9.142 | 11.196 | 1.00 | 16.78 N |
| ATOM | 402 | CA | PHE | A | 199 | −24.438 | −9.981 | 12.248 | 1.00 | 18.71 C |
| ATOM | 403 | C | PHE | A | 199 | −23.319 | −10.480 | 13.161 | 1.00 | 19.39 C |
| ATOM | 404 | O | PHE | A | 199 | −23.448 | −10.481 | 14.383 | 1.00 | 19.46 O |
| ATOM | 405 | CB | PHE | A | 199 | −25.204 | −11.163 | 11.669 | 1.00 | 15.44 C |
| ATOM | 406 | CG | PHE | A | 199 | −25.498 | −12.218 | 12.675 | 1.00 | 18.84 C |
| ATOM | 407 | CD2 | PHE | A | 199 | −24.739 | −13.374 | 12.732 | 1.00 | 22.90 C |
| ATOM | 408 | CD1 | PHE | A | 199 | −26.510 | −12.045 | 13.596 | 1.00 | 23.16 C |
| ATOM | 409 | CE2 | PHE | A | 199 | −24.998 | −14.339 | 13.686 | 1.00 | 25.42 C |
| ATOM | 410 | CE1 | PHE | A | 199 | −26.775 | −13.011 | 14.557 | 1.00 | 24.25 C |
| ATOM | 411 | CZ | PHE | A | 199 | −26.023 | −14.155 | 14.603 | 1.00 | 20.45 C |
| ATOM | 412 | N | VAL | A | 200 | −22.220 | −10.923 | 12.568 | 1.00 | 20.88 N |
| ATOM | 413 | CA | VAL | A | 200 | −21.127 | −11.461 | 13.366 | 1.00 | 19.97 C |
| ATOM | 414 | C | VAL | A | 200 | −20.361 | −10.342 | 14.096 | 1.00 | 19.76 C |
| ATOM | 415 | O | VAL | A | 200 | −20.037 | −10.494 | 15.267 | 1.00 | 18.57 O |
| ATOM | 416 | CB | VAL | A | 200 | −20.201 | −12.301 | 12.496 | 1.00 | 20.92 C |
| ATOM | 417 | CG1 | VAL | A | 200 | −18.898 | −12.658 | 13.243 | 1.00 | 18.59 C |
| ATOM | 418 | CG2 | VAL | A | 200 | −20.942 | −13.551 | 12.046 | 1.00 | 16.54 C |
| ATOM | 419 | N | GLN | A | 201 | −20.126 | −9.211 | 13.430 | 1.00 | 19.23 N |
| ATOM | 420 | CA | GLN | A | 201 | −19.564 | −8.024 | 14.096 | 1.00 | 22.96 C |
| ATOM | 421 | C | GLN | A | 201 | −20.288 | −7.714 | 15.403 | 1.00 | 25.56 C |
| ATOM | 422 | O | GLN | A | 201 | −19.649 | −7.493 | 16.437 | 1.00 | 22.68 O |
| ATOM | 423 | CB | GLN | A | 201 | −19.648 | −6.781 | 13.199 | 1.00 | 23.94 C |
| ATOM | 424 | CG | GLN | A | 201 | −18.493 | −6.549 | 12.235 | 1.00 | 24.31 C |
| ATOM | 425 | CD | GLN | A | 201 | −18.865 | −5.570 | 11.096 | 1.00 | 31.70 C |
| ATOM | 426 | OE1 | GLN | A | 201 | −18.274 | −5.595 | 10.007 | 1.00 | 25.36 O |
| ATOM | 427 | NE2 | GLN | A | 201 | −19.856 | −4.718 | 11.349 | 1.00 | 28.05 N |
| ATOM | 428 | N | HIS | A | 202 | −21.625 | −7.687 | 15.349 | 1.00 | 19.95 N |
| ATOM | 429 | CA | HIS | A | 202 | −22.415 | −7.330 | 16.514 | 1.00 | 20.60 C |
| ATOM | 430 | C | HIS | A | 202 | −22.126 | −8.228 | 17.715 | 1.00 | 23.45 C |
| ATOM | 431 | O | HIS | A | 202 | −21.915 | −7.742 | 18.822 | 1.00 | 26.55 O |
| ATOM | 432 | CB | HIS | A | 202 | −23.906 | −7.382 | 16.207 | 1.00 | 22.12 C |
| ATOM | 433 | CG | HIS | A | 202 | −24.758 | −7.236 | 17.425 | 1.00 | 21.72 C |
| ATOM | 434 | ND1 | HIS | A | 202 | −25.123 | −6.010 | 17.931 | 1.00 | 25.57 N |
| ATOM | 435 | CD2 | HIS | A | 202 | −25.276 | −8.160 | 18.267 | 1.00 | 25.38 C |
| ATOM | 436 | CE1 | HIS | A | 202 | −25.846 | −6.183 | 19.022 | 1.00 | 23.46 C |
| ATOM | 437 | NE2 | HIS | A | 202 | −25.958 | −7.481 | 19.244 | 1.00 | 23.52 N |
| ATOM | 438 | N | HIS | A | 203 | −22.128 | −9.537 | 17.495 | 1.00 | 22.74 N |
| ATOM | 439 | CA | HIS | A | 203 | −21.920 | −10.478 | 18.584 | 1.00 | 21.81 C |
| ATOM | 440 | C | HIS | A | 203 | −20.469 | −10.633 | 19.043 | 1.00 | 21.12 C |
| ATOM | 441 | O | HIS | A | 203 | −20.243 | −11.066 | 20.168 | 1.00 | 31.14 O |
| ATOM | 442 | CB | HIS | A | 203 | −22.455 | −11.849 | 18.201 | 1.00 | 19.70 C |
| ATOM | 443 | CG | HIS | A | 203 | −23.947 | −11.937 | 18.209 | 1.00 | 27.48 C |
| ATOM | 444 | ND1 | HIS | A | 203 | −24.669 | −12.220 | 19.349 | 1.00 | 27.80 N |
| ATOM | 445 | CD2 | HIS | A | 203 | −24.855 | −11.767 | 17.220 | 1.00 | 22.28 C |
| ATOM | 446 | CE1 | HIS | A | 203 | −25.958 | −12.223 | 19.061 | 1.00 | 21.84 C |
| ATOM | 447 | NE2 | HIS | A | 203 | −26.097 | −11.945 | 17.777 | 1.00 | 20.85 N |

TABLE 10.1-continued

| ATOM | 448 | N | ILE | A | 204 | −19.487 | −10.319 | 18.206 | 1.00 | 19.01 | N |
|---|---|---|---|---|---|---|---|---|---|---|---|
| ATOM | 449 | CA | ILE | A | 204 | −18.102 | −10.491 | 18.664 | 1.00 | 24.65 | C |
| ATOM | 450 | C | ILE | A | 204 | −17.506 | −9.213 | 19.247 | 1.00 | 23.37 | C |
| ATOM | 451 | O | ILE | A | 204 | −16.502 | −9.262 | 19.956 | 1.00 | 29.46 | O |
| ATOM | 452 | CB | ILE | A | 204 | −17.156 | −10.992 | 17.550 | 1.00 | 19.60 | C |
| ATOM | 453 | CG1 | ILE | A | 204 | −17.032 | −9.970 | 16.421 | 1.00 | 22.94 | C |
| ATOM | 454 | CG2 | ILE | A | 204 | −17.581 | −12.351 | 17.037 | 1.00 | 18.69 | C |
| ATOM | 455 | CD1 | ILE | A | 204 | −15.981 | −10.357 | 15.400 | 1.00 | 18.85 | C |
| ATOM | 456 | N | GLY | A | 205 | −18.118 | −8.075 | 18.954 | 1.00 | 21.26 | N |
| ATOM | 457 | CA | GLY | A | 205 | −17.663 | −6.811 | 19.504 | 1.00 | 22.73 | C |
| ATOM | 458 | C | GLY | A | 205 | −16.273 | −6.438 | 19.025 | 1.00 | 24.53 | C |
| ATOM | 459 | O | GLY | A | 205 | −15.782 | −6.990 | 18.041 | 1.00 | 29.29 | O |
| ATOM | 460 | N | PRO | A | 206 | −15.614 | −5.508 | 19.729 | 1.00 | 27.53 | N |
| ATOM | 461 | CA | PRO | A | 206 | −14.313 | −5.000 | 19.264 | 1.00 | 25.17 | C |
| ATOM | 462 | C | PRO | A | 206 | −13.141 | −5.982 | 19.496 | 1.00 | 23.26 | C |
| ATOM | 463 | O | PRO | A | 206 | −12.078 | −5.584 | 19.979 | 1.00 | 27.76 | O |
| ATOM | 464 | CB | PRO | A | 206 | −14.137 | −3.729 | 20.092 | 1.00 | 24.03 | C |
| ATOM | 465 | CG | PRO | A | 206 | −14.809 | −4.066 | 21.394 | 1.00 | 21.52 | C |
| ATOM | 466 | CD | PRO | A | 206 | −16.016 | −4.911 | 21.018 | 1.00 | 22.26 | C |
| ATOM | 467 | N | VAL | A | 207 | −13.325 | −7.240 | 19.114 | 1.00 | 21.78 | N |
| ATOM | 468 | CA | VAL | A | 207 | −12.381 | −8.298 | 19.464 | 1.00 | 22.06 | C |
| ATOM | 469 | C | VAL | A | 207 | −11.844 | −9.063 | 18.248 | 1.00 | 21.75 | C |
| ATOM | 470 | O | VAL | A | 207 | −12.602 | −9.464 | 17.361 | 1.00 | 16.31 | O |
| ATOM | 471 | CB | VAL | A | 207 | −13.044 | −9.308 | 20.425 | 1.00 | 18.92 | C |
| ATOM | 472 | CG1 | VAL | A | 207 | −12.057 | −10.360 | 20.865 | 1.00 | 16.73 | C |
| ATOM | 473 | CG2 | VAL | A | 207 | −13.637 | −8.587 | 21.612 | 1.00 | 15.45 | C |
| ATOM | 474 | N | ASN | A | 208 | −10.532 | −9.277 | 18.220 | 1.00 | 20.49 | N |
| ATOM | 475 | CA | ASN | A | 208 | −9.922 | −10.105 | 17.191 | 1.00 | 18.16 | C |
| ATOM | 476 | C | ASN | A | 208 | −10.499 | −11.507 | 17.256 | 1.00 | 15.84 | C |
| ATOM | 477 | O | ASN | A | 208 | −10.423 | −12.147 | 18.294 | 1.00 | 16.63 | O |
| ATOM | 478 | CB | ASN | A | 208 | −8.413 | −10.156 | 17.367 | 1.00 | 16.49 | C |
| ATOM | 479 | CG | ASN | A | 208 | −7.741 | −8.839 | 17.055 | 1.00 | 18.40 | C |
| ATOM | 480 | OD1 | ASN | A | 208 | −6.915 | −8.354 | 17.828 | 1.00 | 21.56 | O |
| ATOM | 481 | ND2 | ASN | A | 208 | −8.067 | −8.269 | 15.912 | 1.00 | 15.53 | N |
| ATOM | 482 | N | THR | A | 209 | −11.073 | −11.982 | 16.157 | 1.00 | 14.76 | N |
| ATOM | 483 | CA | THR | A | 209 | −11.804 | −13.251 | 16.157 | 1.00 | 13.30 | C |
| ATOM | 484 | C | THR | A | 209 | −11.524 | −14.065 | 14.892 | 1.00 | 14.80 | C |
| ATOM | 485 | O | THR | A | 209 | −11.708 | −13.581 | 13.778 | 1.00 | 13.11 | O |
| ATOM | 486 | CB | THR | A | 209 | −13.330 | −13.001 | 16.288 | 1.00 | 15.05 | C |
| ATOM | 487 | OG1 | THR | A | 209 | −13.573 | −12.186 | 17.436 | 1.00 | 17.23 | O |
| ATOM | 488 | CG2 | THR | A | 209 | −14.102 | −14.310 | 16.450 | 1.00 | 12.52 | C |
| ATOM | 489 | N | TRP | A | 210 | −11.075 | −15.300 | 15.058 | 1.00 | 12.28 | N |
| ATOM | 490 | CA | TRP | A | 210 | −10.804 | −16.146 | 13.905 | 1.00 | 13.62 | C |
| ATOM | 491 | C | TRP | A | 210 | −12.057 | −16.440 | 13.089 | 1.00 | 15.28 | C |
| ATOM | 492 | O | TRP | A | 210 | −13.124 | −16.679 | 13.649 | 1.00 | 14.02 | O |
| ATOM | 493 | CB | TRP | A | 210 | −10.197 | −17.482 | 14.330 | 1.00 | 13.45 | C |
| ATOM | 494 | CG | TRP | A | 210 | −8.783 | −17.472 | 14.852 | 1.00 | 12.79 | C |
| ATOM | 495 | CD1 | TRP | A | 210 | −8.352 | −18.038 | 16.003 | 1.00 | 14.29 | C |
| ATOM | 496 | CD2 | TRP | A | 210 | −7.619 | −16.907 | 14.223 | 1.00 | 12.57 | C |
| ATOM | 497 | NE1 | TRP | A | 210 | −6.992 | −17.868 | 16.141 | 1.00 | 14.57 | N |
| ATOM | 498 | CE2 | TRP | A | 210 | −6.521 | −17.177 | 15.057 | 1.00 | 12.81 | C |
| ATOM | 499 | CE3 | TRP | A | 210 | −7.401 | −16.202 | 13.033 | 1.00 | 13.91 | C |
| ATOM | 500 | CZ2 | TRP | A | 210 | −5.225 | −16.755 | 14.754 | 1.00 | 15.48 | C |
| ATOM | 501 | CZ3 | TRP | A | 210 | −6.107 | −15.791 | 12.729 | 1.00 | 15.74 | C |
| ATOM | 502 | CH2 | TRP | A | 210 | −5.038 | −16.076 | 13.582 | 1.00 | 14.80 | C |
| ATOM | 503 | N | MET | A | 211 | −11.917 | −16.443 | 11.763 | 1.00 | 14.46 | N |
| ATOM | 504 | CA | MET | A | 211 | −12.972 | −16.939 | 10.897 | 1.00 | 13.94 | C |
| ATOM | 505 | C | MET | A | 211 | −12.389 | −18.101 | 10.107 | 1.00 | 18.15 | C |
| ATOM | 506 | O | MET | A | 211 | −11.183 | −18.368 | 10.203 | 1.00 | 14.39 | O |
| ATOM | 507 | CB | MET | A | 211 | −13.511 | −15.843 | 9.973 | 1.00 | 14.29 | C |
| ATOM | 508 | CG | MET | A | 211 | −12.639 | −15.552 | 8.758 | 1.00 | 15.21 | C |
| ATOM | 509 | SD | MET | A | 211 | −13.121 | −14.063 | 7.849 | 1.00 | 15.99 | S |
| ATOM | 510 | CE | MET | A | 211 | −12.617 | −12.803 | 9.002 | 1.00 | 13.06 | C |
| ATOM | 511 | N | GLY | A | 212 | −13.234 | −18.800 | 9.348 | 1.00 | 16.19 | N |
| ATOM | 512 | CA | GLY | A | 212 | −12.811 | −20.001 | 8.645 | 1.00 | 14.73 | C |
| ATOM | 513 | C | GLY | A | 212 | −12.179 | −19.746 | 7.292 | 1.00 | 14.61 | C |
| ATOM | 514 | O | GLY | A | 212 | −12.524 | −20.367 | 6.306 | 1.00 | 14.25 | O |
| ATOM | 515 | N | LEU | A | 213 | −11.231 | −18.824 | 7.260 | 1.00 | 15.62 | N |
| ATOM | 516 | CA | LEU | A | 213 | −10.589 | −18.426 | 6.023 | 1.00 | 13.96 | C |
| ATOM | 517 | C | LEU | A | 213 | −9.080 | −18.461 | 6.261 | 1.00 | 16.13 | C |
| ATOM | 518 | O | LEU | A | 213 | −8.604 | −17.950 | 7.283 | 1.00 | 13.92 | O |
| ATOM | 519 | CB | LEU | A | 213 | −11.069 | −17.041 | 5.609 | 1.00 | 12.59 | C |
| ATOM | 520 | CG | LEU | A | 213 | −10.425 | −16.377 | 4.404 | 1.00 | 13.49 | C |
| ATOM | 521 | CD1 | LEU | A | 213 | −10.715 | −17.173 | 3.139 | 1.00 | 12.34 | C |
| ATOM | 522 | CD2 | LEU | A | 213 | −10.899 | −14.942 | 4.283 | 1.00 | 13.03 | C |
| ATOM | 523 | N | HIS | A | 214 | −8.348 | −19.107 | 5.356 | 1.00 | 14.35 | N |
| ATOM | 524 | CA | HIS | A | 214 | −6.894 | −19.291 | 5.509 | 1.00 | 16.41 | C |
| ATOM | 525 | C | HIS | A | 214 | −6.244 | −19.539 | 4.160 | 1.00 | 18.20 | C |
| ATOM | 526 | O | HIS | A | 214 | −6.940 | −19.874 | 3.207 | 1.00 | 16.31 | O |
| ATOM | 527 | CB | HIS | A | 214 | −6.577 | −20.464 | 6.440 | 1.00 | 13.36 | C |

TABLE 10.1-continued

| | | | | | | | | | |
|---|---|---|---|---|---|---|---|---|---|
| ATOM | 528 | CG | HIS | A | 214 | −6.949 | −21.797 | 5.874 | 1.00 17.43 C |
| ATOM | 529 | ND1 | HIS | A | 214 | −6.016 | −22.687 | 5.391 | 1.00 23.48 N |
| ATOM | 530 | CD2 | HIS | A | 214 | −8.158 | −22.382 | 5.690 | 1.00 19.34 C |
| ATOM | 531 | CE1 | HIS | A | 214 | −6.630 | −23.772 | 4.949 | 1.00 21.50 C |
| ATOM | 532 | NE2 | HIS | A | 214 | −7.930 | −23.613 | 5.122 | 1.00 22.11 N |
| ATOM | 533 | N | ASP | A | 215 | −4.920 | −19.376 | 4.079 | 1.00 18.22 N |
| ATOM | 534 | CA | ASP | A | 215 | −4.188 | −19.750 | 2.867 | 1.00 17.30 C |
| ATOM | 535 | C | ASP | A | 215 | −2.925 | −20.539 | 3.240 | 1.00 19.55 C |
| ATOM | 536 | O | ASP | A | 215 | −1.834 | −20.316 | 2.712 | 1.00 19.31 O |
| ATOM | 537 | CB | ASP | A | 215 | −3.849 | −18.504 | 2.029 | 1.00 14.78 C |
| ATOM | 538 | CG | ASP | A | 215 | −2.730 | −17.641 | 2.638 | 1.00 17.69 C |
| ATOM | 539 | OD1 | ASP | A | 215 | −2.483 | −17.688 | 3.869 | 1.00 15.15 O |
| ATOM | 540 | OD2 | ASP | A | 215 | −2.095 | −16.899 | 1.866 | 1.00 17.44 O |
| ATOM | 541 | N | GLN | A | 216 | −3.078 | −21.470 | 4.167 | 1.00 21.06 N |
| ATOM | 542 | CA | GLN | A | 216 | −1.934 | −22.227 | 4.657 | 1.00 24.33 C |
| ATOM | 543 | C | GLN | A | 216 | −1.340 | −23.160 | 3.607 | 1.00 21.68 C |
| ATOM | 544 | O | GLN | A | 216 | −0.150 | −23.452 | 3.649 | 1.00 24.43 O |
| ATOM | 545 | CB | GLN | A | 216 | −2.333 | −23.029 | 5.886 | 1.00 23.90 C |
| ATOM | 546 | CG | GLN | A | 216 | −2.684 | −22.189 | 7.079 | 1.00 20.99 C |
| ATOM | 547 | CD | GLN | A | 216 | −3.202 | −23.036 | 8.215 | 1.00 30.17 C |
| ATOM | 548 | OE1 | GLN | A | 216 | −4.266 | −23.648 | 8.110 | 1.00 26.71 O |
| ATOM | 549 | NE2 | GLN | A | 216 | −2.440 | −23.098 | 9.305 | 1.00 40.70 N |
| ATOM | 550 | N | ASN | A | 217 | −2.162 | −23.621 | 2.668 | 1.00 23.32 N |
| ATOM | 551 | CA | ASN | A | 217 | −1.685 | −24.532 | 1.629 | 1.00 20.04 C |
| ATOM | 552 | C | ASN | A | 217 | −1.612 | −23.852 | 0.283 | 1.00 24.86 C |
| ATOM | 553 | O | ASN | A | 217 | −1.540 | −24.510 | −0.756 | 1.00 27.21 O |
| ATOM | 554 | CB | ASN | A | 217 | −2.588 | −25.759 | 1.517 | 1.00 28.11 C |
| ATOM | 555 | CG | ASN | A | 217 | −2.888 | −26.378 | 2.852 | 1.00 32.30 C |
| ATOM | 556 | OD1 | ASN | A | 217 | −4.055 | −26.547 | 3.218 | 1.00 38.88 O |
| ATOM | 557 | ND2 | ASN | A | 217 | −1.841 | −26.715 | 3.600 | 1.00 27.42 N |
| ATOM | 558 | N | GLY | A | 218 | −1.658 | −22.529 | 0.295 | 1.00 22.21 N |
| ATOM | 559 | CA | GLY | A | 218 | −1.460 | −21.777 | −0.918 | 1.00 20.14 C |
| ATOM | 560 | C | GLY | A | 218 | −2.428 | −20.632 | −1.068 | 1.00 22.88 C |
| ATOM | 561 | O | GLY | A | 218 | −2.165 | −19.536 | −0.571 | 1.00 23.78 O |
| ATOM | 562 | N | PRO | A | 219 | −3.534 | −20.871 | −1.791 | 1.00 26.59 N |
| ATOM | 563 | CA | PRO | A | 219 | −4.537 | −19.838 | −2.062 | 1.00 23.67 C |
| ATOM | 564 | C | PRO | A | 219 | −5.541 | −19.712 | −0.933 | 1.00 20.80 C |
| ATOM | 565 | O | PRO | A | 219 | −5.700 | −20.647 | −0.143 | 1.00 21.41 O |
| ATOM | 566 | CB | PRO | A | 219 | −5.216 | −20.342 | −3.341 | 1.00 21.68 C |
| ATOM | 567 | CG | PRO | A | 219 | −5.134 | −21.823 | −3.228 | 1.00 22.20 C |
| ATOM | 568 | CD | PRO | A | 219 | −3.775 | −22.087 | −2.592 | 1.00 27.98 C |
| ATOM | 569 | N | TRP | A | 220 | −6.210 | −18.564 | −0.867 | 1.00 19.23 N |
| ATOM | 570 | CA | TRP | A | 220 | −7.281 | −18.357 | 0.093 | 1.00 20.89 C |
| ATOM | 571 | C | TRP | A | 220 | −8.394 | −19.370 | −0.119 | 1.00 18.11 C |
| ATOM | 572 | O | TRP | A | 220 | −8.890 | −19.549 | −1.237 | 1.00 16.24 O |
| ATOM | 573 | CB | TRP | A | 220 | −7.818 | −16.924 | 0.000 | 1.00 20.98 C |
| ATOM | 574 | CG | TRP | A | 220 | −6.855 | −15.955 | 0.591 | 1.00 19.44 C |
| ATOM | 575 | CD1 | TRP | A | 220 | −6.071 | −15.058 | −0.079 | 1.00 22.05 C |
| ATOM | 576 | CD2 | TRP | A | 220 | −6.519 | −15.825 | 1.977 | 1.00 16.53 C |
| ATOM | 577 | NE1 | TRP | A | 220 | −5.286 | −14.361 | 0.811 | 1.00 14.72 N |
| ATOM | 578 | CE2 | TRP | A | 220 | −5.539 | −14.815 | 2.077 | 1.00 13.97 C |
| ATOM | 579 | CE3 | TRP | A | 220 | −6.958 | −16.456 | 3.143 | 1.00 12.82 C |
| ATOM | 580 | CZ2 | TRP | A | 220 | −4.997 | −14.422 | 3.295 | 1.00 16.02 C |
| ATOM | 581 | CZ3 | TRP | A | 220 | −6.422 | −16.062 | 4.347 | 1.00 15.01 C |
| ATOM | 582 | CH2 | TRP | A | 220 | −5.449 | −15.060 | 4.418 | 1.00 18.72 C |
| ATOM | 583 | N | LYS | A | 221 | −8.744 | −20.038 | 0.979 | 1.00 18.43 N |
| ATOM | 584 | CA | LYS | A | 221 | −9.784 | −21.059 | 1.030 | 1.00 20.12 C |
| ATOM | 585 | C | LYS | A | 221 | −10.651 | −20.866 | 2.269 | 1.00 17.14 C |
| ATOM | 586 | O | LYS | A | 221 | −10.133 | −20.648 | 3.354 | 1.00 17.85 O |
| ATOM | 587 | CB | LYS | A | 221 | −9.169 | −22.463 | 1.059 | 1.00 22.71 C |
| ATOM | 588 | CG | LYS | A | 221 | −8.599 | −22.928 | −0.263 | 1.00 30.31 C |
| ATOM | 589 | CD | LYS | A | 221 | −7.862 | −24.250 | −0.113 | 1.00 39.91 C |
| ATOM | 590 | CE | LYS | A | 221 | −7.419 | −24.776 | −1.471 | 1.00 44.01 C |
| ATOM | 591 | NZ | LYS | A | 221 | −6.601 | −26.016 | −1.336 | 1.00 58.69 N |
| ATOM | 592 | N | TRP | A | 222 | −11.965 | −20.938 | 2.096 | 1.00 20.05 N |
| ATOM | 593 | CA | TRP | A | 222 | −12.893 | −21.059 | 3.220 | 1.00 18.07 C |
| ATOM | 594 | C | TRP | A | 222 | −12.973 | −22.520 | 3.658 | 1.00 15.25 C |
| ATOM | 595 | O | TRP | A | 222 | −12.883 | −23.404 | 2.821 | 1.00 22.45 O |
| ATOM | 596 | CB | TRP | A | 222 | −14.280 | −20.553 | 2.827 | 1.00 18.47 C |
| ATOM | 597 | CG | TRP | A | 222 | −14.383 | −19.074 | 2.639 | 1.00 15.11 C |
| ATOM | 598 | CD1 | TRP | A | 222 | −14.384 | −18.397 | 1.458 | 1.00 15.59 C |
| ATOM | 599 | CD2 | TRP | A | 222 | −14.536 | −18.090 | 3.667 | 1.00 12.30 C |
| ATOM | 600 | NE1 | TRP | A | 222 | −14.525 | −17.045 | 1.686 | 1.00 17.01 N |
| ATOM | 601 | CE2 | TRP | A | 222 | −14.621 | −16.834 | 3.037 | 1.00 14.83 C |
| ATOM | 602 | CE3 | TRP | A | 222 | −14.607 | −18.148 | 5.058 | 1.00 15.63 C |
| ATOM | 603 | CZ2 | TRP | A | 222 | −14.774 | −15.651 | 3.749 | 1.00 14.19 C |
| ATOM | 604 | CZ3 | TRP | A | 222 | −14.750 | −16.975 | 5.761 | 1.00 14.82 C |
| ATOM | 605 | CH2 | TRP | A | 222 | −14.833 | −15.741 | 5.103 | 1.00 16.93 C |
| ATOM | 606 | N | VAL | A | 223 | −13.160 | −22.781 | 4.948 | 1.00 18.67 N |
| ATOM | 607 | CA | VAL | A | 223 | −13.104 | −24.154 | 5.453 | 1.00 21.37 C |

TABLE 10.1-continued

| | | | | | | | | | | |
|---|---|---|---|---|---|---|---|---|---|---|
| ATOM | 608 | C | VAL | A | 223 | −14.214 | −25.092 | 4.955 | 1.00 | 19.54 C |
| ATOM | 609 | O | VAL | A | 223 | −14.002 | −26.293 | 4.883 | 1.00 | 26.83 O |
| ATOM | 610 | CB | VAL | A | 223 | −13.127 | −24.195 | 7.000 | 1.00 | 20.27 C |
| ATOM | 611 | CG1 | VAL | A | 223 | −11.823 | −23.684 | 7.550 | 1.00 | 16.93 C |
| ATOM | 612 | CG2 | VAL | A | 223 | −14.323 | −23.424 | 7.546 | 1.00 | 13.22 C |
| ATOM | 613 | N | ASP | A | 224 | −15.391 | −24.575 | 4.627 | 1.00 | 20.49 N |
| ATOM | 614 | CA | ASP | A | 224 | −16.455 | −25.453 | 4.129 | 1.00 | 28.05 C |
| ATOM | 615 | C | ASP | A | 224 | −16.450 | −25.610 | 2.592 | 1.00 | 31.47 C |
| ATOM | 616 | O | ASP | A | 224 | −17.344 | −26.231 | 2.017 | 1.00 | 34.41 O |
| ATOM | 617 | CB | ASP | A | 224 | −17.832 | −24.956 | 4.606 | 1.00 | 26.17 C |
| ATOM | 618 | CG | ASP | A | 224 | −18.313 | −23.720 | 3.861 | 1.00 | 30.40 C |
| ATOM | 619 | OD1 | ASP | A | 224 | −17.480 | −22.971 | 3.288 | 1.00 | 27.86 O |
| ATOM | 620 | OD2 | ASP | A | 224 | −19.548 | −23.486 | 3.866 | 1.00 | 41.83 O |
| ATOM | 621 | N | GLY | A | 225 | −15.442 | −25.060 | 1.930 | 1.00 | 26.37 N |
| ATOM | 622 | CA | GLY | A | 225 | −15.325 | −25.234 | 0.495 | 1.00 | 24.35 C |
| ATOM | 623 | C | GLY | A | 225 | −15.828 | −24.060 | −0.325 | 1.00 | 26.11 C |
| ATOM | 624 | O | GLY | A | 225 | −15.605 | −24.021 | −1.532 | 1.00 | 30.45 O |
| ATOM | 625 | N | THR | A | 226 | −16.512 | −23.114 | 0.322 | 1.00 | 28.38 N |
| ATOM | 626 | CA | THR | A | 226 | −16.991 | −21.894 | −0.346 | 1.00 | 26.57 C |
| ATOM | 627 | C | THR | A | 226 | −15.853 | −21.219 | −1.107 | 1.00 | 27.23 C |
| ATOM | 628 | O | THR | A | 226 | −14.732 | −21.105 | −0.602 | 1.00 | 25.68 O |
| ATOM | 629 | CB | THR | A | 226 | −17.587 | −20.886 | 0.669 | 1.00 | 26.04 C |
| ATOM | 630 | OG1 | THR | A | 226 | −18.644 | −21.511 | 1.408 | 1.00 | 31.78 O |
| ATOM | 631 | CG2 | THR | A | 226 | −18.109 | −19.649 | −0.025 | 1.00 | 22.83 C |
| ATOM | 632 | N | ASP | A | 227 | −16.131 | −20.791 | −2.331 | 1.00 | 25.74 N |
| ATOM | 633 | CA | ASP | A | 227 | −15.101 | −20.198 | −3.157 | 1.00 | 24.58 C |
| ATOM | 634 | C | ASP | A | 227 | −14.769 | −18.774 | −2.724 | 1.00 | 27.29 C |
| ATOM | 635 | O | ASP | A | 227 | −15.658 | −17.943 | −2.523 | 1.00 | 23.84 O |
| ATOM | 636 | CB | ASP | A | 227 | −15.523 | −20.199 | −4.625 | 1.00 | 31.00 C |
| ATOM | 637 | CG | ASP | A | 227 | −14.712 | −19.226 | −5.447 | 1.00 | 33.32 C |
| ATOM | 638 | OD1 | ASP | A | 227 | −13.509 | −19.502 | −5.653 | 1.00 | 36.87 O |
| ATOM | 639 | OD2 | ASP | A | 227 | −15.261 | −18.175 | −5.849 | 1.00 | 32.69 O |
| ATOM | 640 | N | TYR | A | 228 | −13.480 | −18.485 | −2.609 | 1.00 | 25.74 N |
| ATOM | 641 | CA | TYR | A | 228 | −13.055 | −17.195 | −2.090 | 1.00 | 22.35 C |
| ATOM | 642 | C | TYR | A | 228 | −13.186 | −16.074 | −3.109 | 1.00 | 22.96 C |
| ATOM | 643 | O | TYR | A | 228 | −13.706 | −15.006 | −2.779 | 1.00 | 21.88 O |
| ATOM | 644 | CB | TYR | A | 228 | −11.610 | −17.272 | −1.590 | 1.00 | 17.43 C |
| ATOM | 645 | CG | TYR | A | 228 | −10.989 | −15.928 | −1.261 | 1.00 | 18.06 C |
| ATOM | 646 | CD2 | TYR | A | 228 | −10.176 | −15.269 | −2.181 | 1.00 | 19.30 C |
| ATOM | 647 | CD1 | TYR | A | 228 | −11.208 | −15.316 | −0.019 | 1.00 | 18.53 C |
| ATOM | 648 | CE2 | TYR | A | 228 | −9.602 | −14.021 | −1.886 | 1.00 | 18.76 C |
| ATOM | 649 | CE1 | TYR | A | 228 | −10.630 | −14.081 | 0.293 | 1.00 | 15.99 C |
| ATOM | 650 | CZ | TYR | A | 228 | −9.826 | −13.436 | −0.643 | 1.00 | 20.11 C |
| ATOM | 651 | OH | TYR | A | 228 | −9.245 | −12.212 | −0.342 | 1.00 | 16.25 O |
| ATOM | 652 | N | GLU | A | 229 | −12.717 | −16.293 | −4.339 | 1.00 | 24.84 N |
| ATOM | 653 | CA | GLU | A | 229 | −12.560 | −15.153 | −5.244 | 1.00 | 26.92 C |
| ATOM | 654 | C | GLU | A | 229 | −13.890 | −14.532 | −5.653 | 1.00 | 27.92 C |
| ATOM | 655 | O | GLU | A | 229 | −13.958 | −13.314 | −5.816 | 1.00 | 23.76 O |
| ATOM | 656 | CB | GLU | A | 229 | −11.744 | −15.529 | −6.482 | 1.00 | 31.64 C |
| ATOM | 657 | CG | GLU | A | 229 | −12.229 | −16.734 | −7.265 | 1.00 | 42.79 C |
| ATOM | 658 | CD | GLU | A | 229 | −11.112 | −17.346 | −8.115 | 1.00 | 43.21 C |
| ATOM | 659 | OE1 | GLU | A | 229 | −10.142 | −16.627 | −8.448 | 1.00 | 39.47 O |
| ATOM | 660 | OE2 | GLU | A | 229 | −11.196 | −18.552 | −8.440 | 1.00 | 52.24 O |
| ATOM | 661 | N | THR | A | 230 | −14.945 | −15.341 | −5.782 | 1.00 | 26.03 N |
| ATOM | 662 | CA | THR | A | 230 | −16.276 | −14.802 | −6.087 | 1.00 | 26.83 C |
| ATOM | 663 | C | THR | A | 230 | −17.120 | −14.519 | −4.847 | 1.00 | 30.75 C |
| ATOM | 664 | O | THR | A | 230 | −18.233 | −14.006 | −4.945 | 1.00 | 30.18 O |
| ATOM | 665 | CB | THR | A | 230 | −17.090 | −15.754 | −6.977 | 1.00 | 27.80 C |
| ATOM | 666 | OG1 | THR | A | 230 | −17.113 | −17.052 | −6.378 | 1.00 | 25.69 O |
| ATOM | 667 | CG2 | THR | A | 230 | −16.472 | −15.855 | −8.362 | 1.00 | 25.73 C |
| ATOM | 668 | N | GLY | A | 231 | −16.610 | −14.872 | −3.678 | 1.00 | 25.26 N |
| ATOM | 669 | CA | GLY | A | 231 | −17.362 | −14.653 | −2.463 | 1.00 | 27.26 C |
| ATOM | 670 | C | GLY | A | 231 | −17.154 | −13.274 | −1.878 | 1.00 | 26.63 C |
| ATOM | 671 | O | GLY | A | 231 | −16.290 | −12.519 | −2.321 | 1.00 | 25.15 O |
| ATOM | 672 | N | PHE | A | 232 | −17.973 | −12.959 | −0.882 | 1.00 | 23.85 N |
| ATOM | 673 | CA | PHE | A | 232 | −17.839 | −11.763 | −0.056 | 1.00 | 25.36 C |
| ATOM | 674 | C | PHE | A | 232 | −16.433 | −11.627 | 0.530 | 1.00 | 22.51 C |
| ATOM | 675 | O | PHE | A | 232 | −15.815 | −12.623 | 0.898 | 1.00 | 24.64 O |
| ATOM | 676 | CB | PHE | A | 232 | −18.875 | −11.820 | 1.062 | 1.00 | 23.46 C |
| ATOM | 677 | CG | PHE | A | 232 | −18.859 | −10.645 | 1.971 | 1.00 | 24.65 C |
| ATOM | 678 | CD1 | PHE | A | 232 | −19.395 | −9.429 | 1.564 | 1.00 | 19.49 C |
| ATOM | 679 | CD2 | PHE | A | 232 | −18.354 | −10.760 | 3.254 | 1.00 | 17.94 C |
| ATOM | 680 | CE1 | PHE | A | 232 | −19.391 | −8.337 | 2.414 | 1.00 | 21.52 C |
| ATOM | 681 | CE2 | PHE | A | 232 | −18.350 | −9.671 | 4.102 | 1.00 | 20.16 C |
| ATOM | 682 | CZ | PHE | A | 232 | −18.870 | −8.457 | 3.678 | 1.00 | 22.04 C |
| ATOM | 683 | N | LYS | A | 233 | −15.923 | −10.400 | 0.576 | 1.00 | 24.28 N |
| ATOM | 684 | CA | LYS | A | 233 | −14.642 | −10.099 | 1.224 | 1.00 | 22.92 C |
| ATOM | 685 | C | LYS | A | 233 | −14.782 | −8.799 | 1.978 | 1.00 | 22.84 C |
| ATOM | 686 | O | LYS | A | 233 | −15.471 | −7.891 | 1.516 | 1.00 | 22.56 O |
| ATOM | 687 | CB | LYS | A | 233 | −13.495 | −9.991 | 0.212 | 1.00 | 17.41 C |

TABLE 10.1-continued

| | | | | | | | | | | |
|---|---|---|---|---|---|---|---|---|---|---|
| ATOM | 688 | CG | LYS | A | 233 | −13.227 | −11.274 | −0.560 | 1.00 | 20.00 C |
| ATOM | 689 | CD | LYS | A | 233 | −12.285 | −11.032 | −1.710 | 1.00 | 21.13 C |
| ATOM | 690 | CE | LYS | A | 233 | −12.419 | −12.105 | −2.767 | 1.00 | 26.26 C |
| ATOM | 691 | NZ | LYS | A | 233 | −13.753 | −12.082 | −3.453 | 1.00 | 23.06 N |
| ATOM | 692 | N | ASN | A | 234 | −14.132 | −8.705 | 3.134 | 1.00 | 17.57 N |
| ATOM | 693 | CA | ASN | A | 234 | −14.165 | −7.467 | 3.910 | 1.00 | 21.38 C |
| ATOM | 694 | C | ASN | A | 234 | −12.791 | −7.112 | 4.486 | 1.00 | 19.87 C |
| ATOM | 695 | O | ASN | A | 234 | −12.683 | −6.685 | 5.629 | 1.00 | 23.24 O |
| ATOM | 696 | CB | ASN | A | 234 | −15.212 | −7.571 | 5.033 | 1.00 | 18.47 C |
| ATOM | 697 | CG | ASN | A | 234 | −15.554 | −6.222 | 5.643 | 1.00 | 19.07 C |
| ATOM | 698 | OD1 | ASN | A | 234 | −15.762 | −6.106 | 6.848 | 1.00 | 22.84 O |
| ATOM | 699 | ND2 | ASN | A | 234 | −15.579 | −5.191 | 4.817 | 1.00 | 21.10 N |
| ATOM | 700 | N | TRP | A | 235 | −11.742 | −7.311 | 3.697 | 1.00 | 19.16 N |
| ATOM | 701 | CA | TRP | A | 235 | −10.390 | −6.975 | 4.135 | 1.00 | 22.32 C |
| ATOM | 702 | C | TRP | A | 235 | −10.264 | −5.498 | 4.467 | 1.00 | 20.90 C |
| ATOM | 703 | O | TRP | A | 235 | −10.730 | −4.642 | 3.719 | 1.00 | 27.44 O |
| ATOM | 704 | CB | TRP | A | 235 | −9.354 | −7.319 | 3.063 | 1.00 | 20.49 C |
| ATOM | 705 | CG | TRP | A | 235 | −9.281 | −8.753 | 2.684 | 1.00 | 20.76 C |
| ATOM | 706 | CD1 | TRP | A | 235 | −9.712 | −9.314 | 1.523 | 1.00 | 19.71 C |
| ATOM | 707 | CD2 | TRP | A | 235 | −8.736 | −9.816 | 3.467 | 1.00 | 18.48 C |
| ATOM | 708 | NE1 | TRP | A | 235 | −9.475 | −10.663 | 1.532 | 1.00 | 18.33 N |
| ATOM | 709 | CE2 | TRP | A | 235 | −8.869 | −10.998 | 2.713 | 1.00 | 17.93 C |
| ATOM | 710 | CE3 | TRP | A | 235 | −8.135 | −9.883 | 4.730 | 1.00 | 17.04 C |
| ATOM | 711 | CZ2 | TRP | A | 235 | −8.427 | −12.236 | 3.180 | 1.00 | 18.19 C |
| ATOM | 712 | CZ3 | TRP | A | 235 | −7.703 | −11.102 | 5.193 | 1.00 | 14.22 C |
| ATOM | 713 | CH2 | TRP | A | 235 | −7.855 | −12.269 | 4.423 | 1.00 | 16.87 C |
| ATOM | 714 | N | ARG | A | 236 | −9.630 | −5.198 | 5.585 | 1.00 | 23.85 N |
| ATOM | 715 | CA | ARG | A | 236 | −9.169 | −3.842 | 5.826 | 1.00 | 25.84 C |
| ATOM | 716 | C | ARG | A | 236 | −8.260 | −3.466 | 4.669 | 1.00 | 25.73 C |
| ATOM | 717 | O | ARG | A | 236 | −7.521 | −4.318 | 4.166 | 1.00 | 27.18 O |
| ATOM | 718 | CB | ARG | A | 236 | −8.428 | −3.743 | 7.159 | 1.00 | 24.94 C |
| ATOM | 719 | CG | ARG | A | 236 | −8.108 | −2.312 | 7.586 | 1.00 | 32.25 C |
| ATOM | 720 | CD | ARG | A | 236 | −7.436 | −2.288 | 8.947 | 1.00 | 30.42 C |
| ATOM | 721 | NE | ARG | A | 236 | −6.217 | −3.084 | 8.934 | 1.00 | 38.54 N |
| ATOM | 722 | CZ | ARG | A | 236 | −5.711 | −3.700 | 10.000 | 1.00 | 39.09 C |
| ATOM | 723 | NH1 | ARG | A | 236 | −6.327 | −3.608 | 11.176 | 1.00 | 39.28 N |
| ATOM | 724 | NH2 | ARG | A | 236 | −4.588 | −4.409 | 9.889 | 1.00 | 27.72 N |
| ATOM | 725 | N | PRO | A | 237 | −8.333 | −2.210 | 4.212 | 1.00 | 25.65 N |
| ATOM | 726 | CA | PRO | A | 237 | −7.412 | −1.747 | 3.167 | 1.00 | 31.88 C |
| ATOM | 727 | C | PRO | A | 237 | −5.951 | −2.048 | 3.497 | 1.00 | 27.32 C |
| ATOM | 728 | O | PRO | A | 237 | −5.531 | −1.839 | 4.638 | 1.00 | 28.86 O |
| ATOM | 729 | CB | PRO | A | 237 | −7.678 | −0.242 | 3.122 | 1.00 | 33.60 C |
| ATOM | 730 | CG | PRO | A | 237 | −9.149 | −0.156 | 3.436 | 1.00 | 32.49 C |
| ATOM | 731 | CD | PRO | A | 237 | −9.367 | −1.203 | 4.515 | 1.00 | 29.17 C |
| ATOM | 732 | N | GLU | A | 238 | −5.231 | −2.563 | 2.501 | 1.00 | 21.38 N |
| ATOM | 733 | CA | GLU | A | 238 | −3.843 | −3.022 | 2.608 | 1.00 | 23.04 C |
| ATOM | 734 | C | GLU | A | 238 | −3.741 | −4.424 | 3.231 | 1.00 | 19.36 C |
| ATOM | 735 | O | GLU | A | 238 | −2.648 | −4.901 | 3.526 | 1.00 | 20.85 O |
| ATOM | 736 | CB | GLU | A | 238 | −2.978 | −2.022 | 3.397 | 1.00 | 26.89 C |
| ATOM | 737 | CG | GLU | A | 238 | −2.828 | −0.651 | 2.740 | 1.00 | 31.80 C |
| ATOM | 738 | CD | GLU | A | 238 | −2.337 | 0.424 | 3.713 | 1.00 | 51.15 C |
| ATOM | 739 | OE1 | GLU | A | 238 | −2.205 | 0.128 | 4.926 | 1.00 | 50.89 O |
| ATOM | 740 | OE2 | GLU | A | 238 | −2.101 | 1.573 | 3.269 | 1.00 | 56.05 O |
| ATOM | 741 | N | GLN | A | 239 | −4.872 | −5.089 | 3.427 | 1.00 | 20.11 N |
| ATOM | 742 | CA | GLN | A | 239 | −4.840 | −6.495 | 3.825 | 1.00 | 21.60 C |
| ATOM | 743 | C | GLN | A | 239 | −5.501 | −7.317 | 2.736 | 1.00 | 19.53 C |
| ATOM | 744 | O | GLN | A | 239 | −6.332 | −6.792 | 2.011 | 1.00 | 21.20 O |
| ATOM | 745 | CB | GLN | A | 239 | −5.543 | −6.726 | 5.166 | 1.00 | 17.31 C |
| ATOM | 746 | CG | GLN | A | 239 | −5.020 | −5.893 | 6.310 | 1.00 | 21.03 C |
| ATOM | 747 | CD | GLN | A | 239 | −3.565 | −6.156 | 6.618 | 1.00 | 18.65 C |
| ATOM | 748 | OE1 | GLN | A | 239 | −3.045 | −7.232 | 6.343 | 1.00 | 17.67 O |
| ATOM | 749 | NE2 | GLN | A | 239 | −2.897 | −5.165 | 7.184 | 1.00 | 18.18 N |
| ATOM | 750 | N | PRO | A | 240 | −5.132 | −8.601 | 2.601 | 1.00 | 16.46 N |
| ATOM | 751 | CA | PRO | A | 240 | −4.108 | −9.345 | 3.337 | 1.00 | 20.08 C |
| ATOM | 752 | C | PRO | A | 240 | −2.696 | −8.938 | 2.901 | 1.00 | 19.97 C |
| ATOM | 753 | O | PRO | A | 240 | −2.486 | −8.679 | 1.708 | 1.00 | 19.33 O |
| ATOM | 754 | CB | PRO | A | 240 | −4.412 | −10.806 | 2.966 | 1.00 | 15.73 C |
| ATOM | 755 | CG | PRO | A | 240 | −4.999 | −10.714 | 1.622 | 1.00 | 20.40 C |
| ATOM | 756 | CD | PRO | A | 240 | −5.783 | −9.438 | 1.580 | 1.00 | 18.17 C |
| ATOM | 757 | N | ASP | A | 241 | −1.744 | −8.882 | 3.830 | 1.00 | 16.04 N |
| ATOM | 758 | CA | ASP | A | 241 | −0.399 | −8.446 | 3.472 | 1.00 | 12.88 C |
| ATOM | 759 | C | ASP | A | 241 | 0.663 | −9.491 | 3.732 | 1.00 | 12.48 C |
| ATOM | 760 | O | ASP | A | 241 | 1.842 | −9.234 | 3.490 | 1.00 | 15.24 O |
| ATOM | 761 | CB | ASP | A | 241 | −0.035 | −7.164 | 4.212 | 1.00 | 15.52 C |
| ATOM | 762 | CG | ASP | A | 241 | −0.053 | −7.332 | 5.733 | 1.00 | 19.38 C |
| ATOM | 763 | OD1 | ASP | A | 241 | −0.451 | −8.416 | 6.231 | 1.00 | 19.33 O |
| ATOM | 764 | OD2 | ASP | A | 241 | 0.293 | −6.358 | 6.430 | 1.00 | 17.43 O |
| ATOM | 765 | N | ASP | A | 242 | 0.249 | −10.652 | 4.237 | 1.00 | 17.41 N |
| ATOM | 766 | CA | ASP | A | 242 | 1.166 | −11.774 | 4.527 | 1.00 | 16.54 C |
| ATOM | 767 | C | ASP | A | 242 | 2.465 | −11.313 | 5.190 | 1.00 | 16.20 C |

TABLE 10.1-continued

| | | | | | | | | | | |
|---|---|---|---|---|---|---|---|---|---|---|
| ATOM | 768 | O | ASP | A | 242 | 3.572 | −11.552 | 4.700 | 1.00 | 18.85 O |
| ATOM | 769 | CB | ASP | A | 242 | 1.487 | −12.530 | 3.261 | 1.00 | 16.74 C |
| ATOM | 770 | CG | ASP | A | 242 | 2.053 | −13.888 | 3.538 | 1.00 | 21.40 C |
| ATOM | 771 | OD1 | ASP | A | 242 | 1.481 | −14.576 | 4.413 | 1.00 | 17.68 O |
| ATOM | 772 | OD2 | ASP | A | 242 | 3.066 | −14.253 | 2.887 | 1.00 | 16.85 O |
| ATOM | 773 | N | TRP | A | 243 | 2.301 | −10.617 | 6.299 | 1.00 | 15.83 N |
| ATOM | 774 | CA | TRP | A | 243 | 3.382 | −9.929 | 6.960 | 1.00 | 16.80 C |
| ATOM | 775 | C | TRP | A | 243 | 4.390 | −10.913 | 7.545 | 1.00 | 16.03 C |
| ATOM | 776 | O | TRP | A | 243 | 4.020 | −11.905 | 8.153 | 1.00 | 15.06 O |
| ATOM | 777 | CB | TRP | A | 243 | 2.799 | −9.041 | 8.043 | 1.00 | 19.08 C |
| ATOM | 778 | CG | TRP | A | 243 | 3.727 | −8.029 | 8.570 | 1.00 | 24.75 C |
| ATOM | 779 | CD1 | TRP | A | 243 | 4.591 | −7.248 | 7.857 | 1.00 | 21.85 C |
| ATOM | 780 | CD2 | TRP | A | 243 | 3.888 | −7.665 | 9.942 | 1.00 | 19.00 C |
| ATOM | 781 | NE1 | TRP | A | 243 | 5.274 | −6.417 | 8.707 | 1.00 | 20.11 N |
| ATOM | 782 | CE2 | TRP | A | 243 | 4.858 | −6.653 | 9.993 | 1.00 | 17.79 C |
| ATOM | 783 | CE3 | TRP | A | 243 | 3.296 | −8.092 | 11.133 | 1.00 | 19.98 C |
| ATOM | 784 | CZ2 | TRP | A | 243 | 5.259 | −6.067 | 11.189 | 1.00 | 19.26 C |
| ATOM | 785 | CZ3 | TRP | A | 243 | 3.697 | −7.508 | 12.321 | 1.00 | 19.32 C |
| ATOM | 786 | CH2 | TRP | A | 243 | 4.666 | −6.508 | 12.338 | 1.00 | 14.64 C |
| ATOM | 787 | N | TYR | A | 244 | 5.671 | −10.643 | 7.350 | 1.00 | 19.42 N |
| ATOM | 788 | CA | TYR | A | 244 | 6.694 | −11.486 | 7.945 | 1.00 | 20.57 C |
| ATOM | 789 | C | TYR | A | 244 | 7.295 | −10.760 | 9.140 | 1.00 | 19.06 C |
| ATOM | 790 | O | TYR | A | 244 | 8.022 | −11.353 | 9.930 | 1.00 | 17.76 O |
| ATOM | 791 | CB | TYR | A | 244 | 7.784 | −11.833 | 6.932 | 1.00 | 18.60 C |
| ATOM | 792 | CG | TYR | A | 244 | 7.501 | −13.035 | 6.056 | 1.00 | 24.25 C |
| ATOM | 793 | CD1 | TYR | A | 244 | 6.568 | −12.970 | 5.020 | 1.00 | 17.33 C |
| ATOM | 794 | CD2 | TYR | A | 244 | 8.189 | −14.228 | 6.244 | 1.00 | 24.36 C |
| ATOM | 795 | CE1 | TYR | A | 244 | 6.321 | −14.070 | 4.203 | 1.00 | 18.22 C |
| ATOM | 796 | CE2 | TYR | A | 244 | 7.945 | −15.342 | 5.436 | 1.00 | 21.75 C |
| ATOM | 797 | CZ | TYR | A | 244 | 7.016 | −15.257 | 4.415 | 1.00 | 19.74 C |
| ATOM | 798 | OH | TYR | A | 244 | 6.776 | −16.367 | 3.620 | 1.00 | 14.89 O |
| ATOM | 799 | N | GLY | A | 245 | 6.958 | −9.478 | 9.265 | 1.00 | 19.02 N |
| ATOM | 800 | CA | GLY | A | 245 | 7.658 | −8.568 | 10.152 | 1.00 | 20.36 C |
| ATOM | 801 | C | GLY | A | 245 | 7.367 | −8.768 | 11.621 | 1.00 | 19.87 C |
| ATOM | 802 | O | GLY | A | 245 | 7.941 | −8.086 | 12.475 | 1.00 | 21.29 O |
| ATOM | 803 | N | HIS | A | 246 | 6.463 | −9.696 | 11.910 | 1.00 | 19.33 N |
| ATOM | 804 | CA | HIS | A | 246 | 6.150 | −10.062 | 13.277 | 1.00 | 17.48 C |
| ATOM | 805 | C | HIS | A | 246 | 7.284 | −10.899 | 13.844 | 1.00 | 18.02 C |
| ATOM | 806 | O | HIS | A | 246 | 7.418 | −11.015 | 15.053 | 1.00 | 22.65 O |
| ATOM | 807 | CB | HIS | A | 246 | 4.825 | −10.823 | 13.340 | 1.00 | 15.31 C |
| ATOM | 808 | CG | HIS | A | 246 | 4.719 | −11.907 | 12.316 | 1.00 | 19.52 C |
| ATOM | 809 | ND1 | HIS | A | 246 | 5.326 | −13.134 | 12.467 | 1.00 | 16.40 N |
| ATOM | 810 | CD2 | HIS | A | 246 | 4.101 | −11.937 | 11.112 | 1.00 | 16.23 C |
| ATOM | 811 | CE1 | HIS | A | 246 | 5.085 | −13.875 | 11.400 | 1.00 | 17.63 C |
| ATOM | 812 | NE2 | HIS | A | 246 | 4.343 | −13.172 | 10.564 | 1.00 | 16.33 N |
| ATOM | 813 | N | GLY | A | 247 | 8.098 | −11.482 | 12.968 | 1.00 | 18.78 N |
| ATOM | 814 | CA | GLY | A | 247 | 9.295 | −12.193 | 13.394 | 1.00 | 17.32 C |
| ATOM | 815 | C | GLY | A | 247 | 9.030 | −13.544 | 14.022 | 1.00 | 19.13 C |
| ATOM | 816 | O | GLY | A | 247 | 9.904 | −14.116 | 14.677 | 1.00 | 21.71 O |
| ATOM | 817 | N | LEU | A | 248 | 7.828 | −14.074 | 13.811 | 1.00 | 20.58 N |
| ATOM | 818 | CA | LEU | A | 248 | 7.427 | −15.330 | 14.447 | 1.00 | 17.12 C |
| ATOM | 819 | C | LEU | A | 248 | 7.676 | −16.527 | 13.537 | 1.00 | 14.44 C |
| ATOM | 820 | O | LEU | A | 248 | 7.656 | −17.670 | 13.977 | 1.00 | 17.33 O |
| ATOM | 821 | CB | LEU | A | 248 | 5.951 | −15.270 | 14.852 | 1.00 | 19.74 C |
| ATOM | 822 | CG | LEU | A | 248 | 5.635 | −14.119 | 15.804 | 1.00 | 17.23 C |
| ATOM | 823 | CD1 | LEU | A | 248 | 4.193 | −14.202 | 16.254 | 1.00 | 17.05 C |
| ATOM | 824 | CD2 | LEU | A | 248 | 6.599 | −14.120 | 17.007 | 1.00 | 16.08 C |
| ATOM | 825 | N | GLY | A | 249 | 7.920 | −16.261 | 12.263 | 1.00 | 17.53 N |
| ATOM | 826 | CA | GLY | A | 249 | 8.159 | −17.332 | 11.315 | 1.00 | 16.74 C |
| ATOM | 827 | C | GLY | A | 249 | 7.032 | −17.381 | 10.316 | 1.00 | 15.59 C |
| ATOM | 828 | O | GLY | A | 249 | 5.874 | −17.344 | 10.708 | 1.00 | 17.37 O |
| ATOM | 829 | N | GLY | A | 250 | 7.370 | −17.451 | 9.029 | 1.00 | 14.92 N |
| ATOM | 830 | CA | GLY | A | 250 | 6.370 | −17.435 | 7.982 | 1.00 | 19.03 C |
| ATOM | 831 | C | GLY | A | 250 | 5.672 | −16.090 | 7.891 | 1.00 | 20.35 C |
| ATOM | 832 | O | GLY | A | 250 | 6.054 | −15.119 | 8.549 | 1.00 | 18.82 O |
| ATOM | 833 | N | GLY | A | 251 | 4.646 | −16.022 | 7.057 | 1.00 | 21.60 N |
| ATOM | 834 | CA | GLY | A | 251 | 3.910 | −14.787 | 6.880 | 1.00 | 17.04 C |
| ATOM | 835 | C | GLY | A | 251 | 2.691 | −14.851 | 7.752 | 1.00 | 16.59 C |
| ATOM | 836 | O | GLY | A | 251 | 2.778 | −15.115 | 8.952 | 1.00 | 22.55 O |
| ATOM | 837 | N | GLU | A | 252 | 1.539 | −14.636 | 7.137 | 1.00 | 16.53 N |
| ATOM | 838 | CA | GLU | A | 252 | 0.272 | −14.664 | 7.846 | 1.00 | 15.39 C |
| ATOM | 839 | C | GLU | A | 252 | −0.760 | −15.400 | 7.016 | 1.00 | 17.17 C |
| ATOM | 840 | O | GLU | A | 252 | −1.021 | −15.027 | 5.864 | 1.00 | 14.07 O |
| ATOM | 841 | CB | GLU | A | 252 | −0.201 | −13.253 | 8.143 | 1.00 | 15.30 C |
| ATOM | 842 | CG | GLU | A | 252 | 0.748 | −12.448 | 8.970 | 1.00 | 16.44 C |
| ATOM | 843 | CD | GLU | A | 252 | 0.242 | −11.045 | 9.189 | 1.00 | 18.48 C |
| ATOM | 844 | OE1 | GLU | A | 252 | 0.261 | −10.579 | 10.340 | 1.00 | 16.20 O |
| ATOM | 845 | OE2 | GLU | A | 252 | −0.159 | −10.400 | 8.200 | 1.00 | 15.99 O |
| ATOM | 846 | N | ASP | A | 253 | −1.355 | −16.437 | 7.590 | 1.00 | 15.10 N |
| ATOM | 847 | CA | ASP | A | 253 | −2.163 | −17.337 | 6.787 | 1.00 | 16.04 C |

TABLE 10.1-continued

| | | | | | | | | | |
|---|---|---|---|---|---|---|---|---|---|
| ATOM | 848 | C | ASP | A | 253 | −3.600 | −17.499 | 7.243 | 1.00 15.46 C |
| ATOM | 849 | O | ASP | A | 253 | −4.310 | −18.320 | 6.713 | 1.00 17.45 O |
| ATOM | 850 | CB | ASP | A | 253 | −1.519 | −18.719 | 6.745 | 1.00 15.26 C |
| ATOM | 851 | CG | ASP | A | 253 | −0.090 | −18.683 | 6.258 | 1.00 18.84 C |
| ATOM | 852 | OD1 | ASP | A | 253 | 0.337 | −17.664 | 5.670 | 1.00 19.76 O |
| ATOM | 853 | OD2 | ASP | A | 253 | 0.605 | −19.703 | 6.423 | 1.00 24.71 O |
| ATOM | 854 | N | CYS | A | 254 | −4.029 | −16.745 | 8.238 | 1.00 15.58 N |
| ATOM | 855 | CA | CYS | A | 254 | −5.321 | −17.012 | 8.818 | 1.00 13.38 C |
| ATOM | 856 | C | CYS | A | 254 | −6.083 | −15.715 | 9.012 | 1.00 17.24 C |
| ATOM | 857 | O | CYS | A | 254 | −5.577 | −14.778 | 9.643 | 1.00 17.90 O |
| ATOM | 858 | CB | CYS | A | 254 | −5.161 | −17.762 | 10.147 | 1.00 17.64 C |
| ATOM | 859 | SG | CYS | A | 254 | −4.659 | −19.487 | 9.965 | 1.00 15.82 S |
| ATOM | 860 | N | ALA | A | 255 | −7.298 | −15.672 | 8.474 | 1.00 10.34 N |
| ATOM | 861 | CA | ALA | A | 255 | −8.134 | −14.474 | 8.555 | 1.00 15.36 C |
| ATOM | 862 | C | ALA | A | 255 | −8.863 | −14.334 | 9.886 | 1.00 16.38 C |
| ATOM | 863 | O | ALA | A | 255 | −9.420 | −15.293 | 10.424 | 1.00 15.65 O |
| ATOM | 864 | CB | ALA | A | 255 | −9.153 | −14.460 | 7.430 | 1.00 13.09 C |
| ATOM | 865 | N | HIS | A | 256 | −8.886 | −13.116 | 10.401 | 1.00 15.41 N |
| ATOM | 866 | CA | HIS | A | 256 | −9.712 | −12.834 | 11.552 | 1.00 16.09 C |
| ATOM | 867 | C | HIS | A | 256 | −10.427 | −11.512 | 11.367 | 1.00 14.49 C |
| ATOM | 868 | O | HIS | A | 256 | −9.986 | −10.664 | 10.599 | 1.00 17.03 O |
| ATOM | 869 | CB | HIS | A | 256 | −8.874 | −12.816 | 12.841 | 1.00 11.61 C |
| ATOM | 870 | CG | HIS | A | 256 | −7.844 | −11.733 | 12.885 | 1.00 15.00 C |
| ATOM | 871 | ND1 | HIS | A | 256 | −7.979 | −10.609 | 13.673 | 1.00 13.69 N |
| ATOM | 872 | CD2 | HIS | A | 256 | −6.657 | −11.605 | 12.245 | 1.00 13.08 C |
| ATOM | 873 | CE1 | HIS | A | 256 | −6.915 | −9.840 | 13.522 | 1.00 15.34 C |
| ATOM | 874 | NE2 | HIS | A | 256 | −6.098 | −10.423 | 12.661 | 1.00 15.12 N |
| ATOM | 875 | N | PHE | A | 257 | −11.543 | −11.357 | 12.065 | 1.00 16.75 N |
| ATOM | 876 | CA | PHE | A | 257 | −12.147 | −10.057 | 12.229 | 1.00 14.34 C |
| ATOM | 877 | C | PHE | A | 257 | −11.246 | −9.225 | 13.119 | 1.00 16.09 C |
| ATOM | 878 | O | PHE | A | 257 | −10.752 | −9.703 | 14.142 | 1.00 16.99 O |
| ATOM | 879 | CB | PHE | A | 257 | −13.541 | −10.159 | 12.844 | 1.00 13.50 C |
| ATOM | 880 | CG | PHE | A | 257 | −14.430 | −11.166 | 12.176 | 1.00 21.06 C |
| ATOM | 881 | CD2 | PHE | A | 257 | −14.462 | −12.477 | 12.618 | 1.00 16.97 C |
| ATOM | 882 | CD1 | PHE | A | 257 | −15.233 | −10.803 | 11.098 | 1.00 18.50 C |
| ATOM | 883 | CE2 | PHE | A | 257 | −15.277 | −13.410 | 12.003 | 1.00 17.90 C |
| ATOM | 884 | CE1 | PHE | A | 257 | −16.049 | −11.729 | 10.487 | 1.00 16.37 C |
| ATOM | 885 | CZ | PHE | A | 257 | −16.066 | −13.029 | 10.928 | 1.00 14.28 C |
| ATOM | 886 | N | THR | A | 258 | −11.039 | −7.979 | 12.734 | 1.00 15.18 N |
| ATOM | 887 | CA | THR | A | 258 | −10.337 | −7.053 | 13.597 | 1.00 19.93 C |
| ATOM | 888 | C | THR | A | 258 | −11.351 | −6.356 | 14.465 | 1.00 22.34 C |
| ATOM | 889 | O | THR | A | 258 | −12.557 | −6.616 | 14.356 | 1.00 28.29 O |
| ATOM | 890 | CB | THR | A | 258 | −9.553 | −6.014 | 12.814 | 1.00 18.33 C |
| ATOM | 891 | OG1 | THR | A | 258 | −10.468 | −5.213 | 12.058 | 1.00 17.14 O |
| ATOM | 892 | CG2 | THR | A | 258 | −8.569 | −6.692 | 11.876 | 1.00 19.40 C |
| ATOM | 893 | N | ASP | A | 259 | −10.869 | −5.459 | 15.316 | 1.00 20.10 N |
| ATOM | 894 | CA | ASP | A | 259 | −11.735 | −4.749 | 16.250 | 1.00 23.59 C |
| ATOM | 895 | C | ASP | A | 259 | −12.909 | −4.037 | 15.572 | 1.00 23.64 C |
| ATOM | 896 | O | ASP | A | 259 | −13.984 | −3.947 | 16.148 | 1.00 24.14 O |
| ATOM | 897 | CB | ASP | A | 259 | −10.911 | −3.747 | 17.079 | 1.00 22.86 C |
| ATOM | 898 | CG | ASP | A | 259 | −10.205 | −2.685 | 16.223 | 1.00 30.45 C |
| ATOM | 899 | OD1 | ASP | A | 259 | −10.086 | −2.851 | 14.987 | 1.00 32.11 O |
| ATOM | 900 | OD2 | ASP | A | 259 | −9.736 | −1.679 | 16.808 | 1.00 36.17 O |
| ATOM | 901 | N | ASP | A | 260 | −12.710 | −3.542 | 14.351 | 1.00 27.68 N |
| ATOM | 902 | CA | ASP | A | 260 | −13.762 | −2.778 | 13.673 | 1.00 24.53 C |
| ATOM | 903 | C | ASP | A | 260 | −14.544 | −3.664 | 12.716 | 1.00 23.69 C |
| ATOM | 904 | O | ASP | A | 260 | −15.474 | −3.208 | 12.055 | 1.00 27.59 O |
| ATOM | 905 | CB | ASP | A | 260 | −13.177 | −1.551 | 12.934 | 1.00 23.65 C |
| ATOM | 906 | CG | ASP | A | 260 | −12.279 | −1.920 | 11.738 | 1.00 31.18 C |
| ATOM | 907 | OD1 | ASP | A | 260 | −12.578 | −2.896 | 11.008 | 1.00 25.05 O |
| ATOM | 908 | OD2 | ASP | A | 260 | −11.267 | −1.206 | 11.514 | 1.00 30.59 O |
| ATOM | 909 | N | GLY | A | 261 | −14.138 | −4.927 | 12.617 | 1.00 24.03 N |
| ATOM | 910 | CA | GLY | A | 261 | −14.898 | −5.908 | 11.863 | 1.00 18.76 C |
| ATOM | 911 | C | GLY | A | 261 | −14.236 | −6.262 | 10.550 | 1.00 17.99 C |
| ATOM | 912 | O | GLY | A | 261 | −14.459 | −7.331 | 10.004 | 1.00 13.89 O |
| ATOM | 913 | N | ARG | A | 262 | −13.392 | −5.373 | 10.048 | 1.00 19.30 N |
| ATOM | 914 | CA | ARG | A | 262 | −12.709 | −5.649 | 8.791 | 1.00 19.10 C |
| ATOM | 915 | C | ARG | A | 262 | −11.659 | −6.749 | 8.989 | 1.00 19.94 C |
| ATOM | 916 | O | ARG | A | 262 | −11.216 | −7.016 | 10.120 | 1.00 12.26 O |
| ATOM | 917 | CB | ARG | A | 262 | −12.115 | −4.356 | 8.232 | 1.00 20.66 C |
| ATOM | 918 | CG | ARG | A | 262 | −13.219 | −3.351 | 7.897 | 1.00 25.30 C |
| ATOM | 919 | CD | ARG | A | 262 | −12.667 | −2.017 | 7.453 | 1.00 28.34 C |
| ATOM | 920 | NE | ARG | A | 262 | −11.765 | −1.459 | 8.449 | 1.00 25.73 N |
| ATOM | 921 | CZ | ARG | A | 262 | −11.035 | −0.367 | 8.254 | 1.00 29.19 C |
| ATOM | 922 | NH1 | ARG | A | 262 | −11.114 | 0.278 | 7.100 | 1.00 24.96 N |
| ATOM | 923 | NH2 | ARG | A | 262 | −10.229 | 0.079 | 9.208 | 1.00 29.61 N |
| ATOM | 924 | N | TRP | A | 263 | −11.307 | −7.432 | 7.903 | 1.00 14.26 N |
| ATOM | 925 | CA | TRP | A | 263 | −10.517 | −8.648 | 8.041 | 1.00 16.50 C |
| ATOM | 926 | C | TRP | A | 263 | −9.043 | −8.337 | 8.000 | 1.00 15.53 C |
| ATOM | 927 | O | TRP | A | 263 | −8.627 | −7.337 | 7.443 | 1.00 16.65 O |

TABLE 10.1-continued

| | | | | | | | | | |
|---|---|---|---|---|---|---|---|---|---|
| ATOM | 928 | CB | TRP | A | 263 | −10.851 | −9.661 | 6.946 | 1.00 13.91 C |
| ATOM | 929 | CG | TRP | A | 263 | −12.290 | −10.013 | 6.862 | 1.00 16.25 C |
| ATOM | 930 | CD1 | TRP | A | 263 | −13.273 | −9.643 | 7.721 | 1.00 13.40 C |
| ATOM | 931 | CD2 | TRP | A | 263 | −12.918 | −10.804 | 5.846 | 1.00 17.03 C |
| ATOM | 932 | NE1 | TRP | A | 263 | −14.473 | −10.156 | 7.314 | 1.00 15.19 N |
| ATOM | 933 | CE2 | TRP | A | 263 | −14.284 | −10.870 | 6.160 | 1.00 14.98 C |
| ATOM | 934 | CE3 | TRP | A | 263 | −12.456 | −11.455 | 4.697 | 1.00 13.09 C |
| ATOM | 935 | CZ2 | TRP | A | 263 | −15.196 | −11.577 | 5.378 | 1.00 19.78 C |
| ATOM | 936 | CZ3 | TRP | A | 263 | −13.360 | −12.154 | 3.922 | 1.00 16.68 C |
| ATOM | 937 | CH2 | TRP | A | 263 | −14.716 | −12.206 | 4.261 | 1.00 16.08 C |
| ATOM | 938 | N | ASN | A | 264 | −8.262 | −9.226 | 8.588 | 1.00 15.51 N |
| ATOM | 939 | CA | ASN | A | 264 | −6.816 | −9.162 | 8.521 | 1.00 14.14 C |
| ATOM | 940 | C | ASN | A | 264 | −6.313 | −10.573 | 8.398 | 1.00 14.75 C |
| ATOM | 941 | O | ASN | A | 264 | −6.994 | −11.503 | 8.817 | 1.00 18.31 O |
| ATOM | 942 | CB | ASN | A | 264 | −6.239 | −8.490 | 9.768 | 1.00 17.34 C |
| ATOM | 943 | CG | ASN | A | 264 | −4.721 | −8.499 | 9.794 | 1.00 18.04 C |
| ATOM | 944 | OD1 | ASN | A | 264 | −4.070 | −8.128 | 8.820 | 1.00 13.84 O |
| ATOM | 945 | ND2 | ASN | A | 264 | −4.151 | −8.917 | 10.923 | 1.00 16.66 N |
| ATOM | 946 | N | ASP | A | 265 | −5.146 | −10.757 | 7.795 | 1.00 18.48 N |
| ATOM | 947 | CA | ASP | A | 265 | −4.527 | −12.072 | 7.800 | 1.00 18.19 C |
| ATOM | 948 | C | ASP | A | 265 | −3.499 | −11.991 | 8.902 | 1.00 17.54 C |
| ATOM | 949 | O | ASP | A | 265 | −2.811 | −10.980 | 9.030 | 1.00 18.38 O |
| ATOM | 950 | CB | ASP | A | 265 | −3.912 | −12.455 | 6.438 | 1.00 15.50 C |
| ATOM | 951 | CG | ASP | A | 265 | −2.875 | −11.458 | 5.943 | 1.00 16.55 C |
| ATOM | 952 | OD1 | ASP | A | 265 | −2.920 | −10.277 | 6.358 | 1.00 15.74 O |
| ATOM | 953 | OD2 | ASP | A | 265 | −2.022 | −11.858 | 5.106 | 1.00 16.21 O |
| ATOM | 954 | N | ASP | A | 266 | −3.449 | −13.013 | 9.745 | 1.00 15.99 N |
| ATOM | 955 | CA | ASP | A | 266 | −2.527 | −12.977 | 10.867 | 1.00 16.72 C |
| ATOM | 956 | C | ASP | A | 266 | −1.843 | −14.321 | 11.085 | 1.00 19.73 C |
| ATOM | 957 | O | ASP | A | 266 | −2.100 | −15.292 | 10.371 | 1.00 18.63 O |
| ATOM | 958 | CB | ASP | A | 266 | −3.244 | −12.542 | 12.139 | 1.00 15.67 C |
| ATOM | 959 | CG | ASP | A | 266 | −2.356 | −11.743 | 13.041 | 1.00 20.35 C |
| ATOM | 960 | OD2 | ASP | A | 266 | −2.877 | −10.827 | 13.717 | 1.00 20.40 O |
| ATOM | 961 | OD1 | ASP | A | 266 | −1.130 | −12.024 | 13.055 | 1.00 18.05 O |
| ATOM | 962 | N | VAL | A | 267 | −0.951 | −14.365 | 12.069 | 1.00 21.31 N |
| ATOM | 963 | CA | VAL | A | 267 | −0.236 | −15.588 | 12.357 | 1.00 20.03 C |
| ATOM | 964 | C | VAL | A | 267 | −1.206 | −16.604 | 12.957 | 1.00 17.18 C |
| ATOM | 965 | O | VAL | A | 267 | −1.904 | −16.301 | 13.923 | 1.00 19.78 O |
| ATOM | 966 | CB | VAL | A | 267 | 0.935 | −15.327 | 13.302 | 1.00 18.16 C |
| ATOM | 967 | CG1 | VAL | A | 267 | 1.670 | −16.609 | 13.576 | 1.00 19.68 C |
| ATOM | 968 | CG2 | VAL | A | 267 | 1.862 | −14.301 | 12.685 | 1.00 15.95 C |
| ATOM | 969 | N | CYS | A | 268 | −1.246 | −17.803 | 12.383 | 1.00 12.37 N |
| ATOM | 970 | CA | CYS | A | 268 | −2.213 | −18.818 | 12.785 | 1.00 14.68 C |
| ATOM | 971 | C | CYS | A | 268 | −2.031 | −19.284 | 14.238 | 1.00 14.79 C |
| ATOM | 972 | O | CYS | A | 268 | −2.960 | −19.800 | 14.855 | 1.00 17.64 O |
| ATOM | 973 | CB | CYS | A | 268 | −2.140 | −20.010 | 11.832 | 1.00 15.66 C |
| ATOM | 974 | SG | CYS | A | 268 | −2.628 | −19.567 | 10.101 | 1.00 27.47 S |
| ATOM | 975 | N | GLN | A | 269 | −0.851 | −19.069 | 14.786 | 1.00 13.72 N |
| ATOM | 976 | CA | GLN | A | 269 | −0.559 | −19.493 | 16.149 | 1.00 16.48 C |
| ATOM | 977 | C | GLN | A | 269 | −1.136 | −18.565 | 17.190 | 1.00 15.79 C |
| ATOM | 978 | O | GLN | A | 269 | −1.204 | −18.920 | 18.376 | 1.00 17.70 O |
| ATOM | 979 | CB | GLN | A | 269 | 0.934 | −19.562 | 16.397 | 1.00 17.79 C |
| ATOM | 980 | CG | GLN | A | 269 | 1.752 | −20.417 | 15.507 | 1.00 20.66 C |
| ATOM | 981 | CD | GLN | A | 269 | 3.240 | −20.205 | 15.825 | 1.00 31.48 C |
| ATOM | 982 | OE1 | GLN | A | 269 | 3.870 | −19.269 | 15.315 | 1.00 28.23 O |
| ATOM | 983 | NE2 | GLN | A | 269 | 3.786 | −21.039 | 16.708 | 1.00 24.46 N |
| ATOM | 984 | N | ARG | A | 270 | −1.501 | −17.358 | 16.781 | 1.00 13.72 N |
| ATOM | 985 | CA | ARG | A | 270 | −2.043 | −16.420 | 17.759 | 1.00 14.78 C |
| ATOM | 986 | C | ARG | A | 270 | −3.318 | −16.974 | 18.307 | 1.00 13.79 C |
| ATOM | 987 | O | ARG | A | 270 | −4.116 | −17.542 | 17.558 | 1.00 16.01 O |
| ATOM | 988 | CB | ARG | A | 270 | −2.301 | −15.045 | 17.162 | 1.00 13.63 C |
| ATOM | 989 | CG | ARG | A | 270 | −1.059 | −14.369 | 16.672 | 1.00 17.92 C |
| ATOM | 990 | CD | ARG | A | 270 | −1.316 | −12.904 | 16.442 | 1.00 15.26 C |
| ATOM | 991 | NE | ARG | A | 270 | −0.240 | −12.295 | 15.678 | 1.00 18.21 N |
| ATOM | 992 | CZ | ARG | A | 270 | 0.907 | −11.880 | 16.206 | 1.00 17.13 C |
| ATOM | 993 | NH1 | ARG | A | 270 | 1.137 | −12.008 | 17.513 | 1.00 15.71 N |
| ATOM | 994 | NH2 | ARG | A | 270 | 1.814 | −11.320 | 15.426 | 1.00 12.96 N |
| ATOM | 995 | N | PRO | A | 271 | −3.503 | −16.833 | 19.623 | 1.00 14.36 N |
| ATOM | 996 | CA | PRO | A | 271 | −4.769 | −17.166 | 20.253 | 1.00 12.34 C |
| ATOM | 997 | C | PRO | A | 271 | −5.760 | −15.999 | 20.077 | 1.00 13.26 C |
| ATOM | 998 | O | PRO | A | 271 | −5.535 | −14.874 | 20.507 | 1.00 14.69 O |
| ATOM | 999 | CB | PRO | A | 271 | −4.381 | −17.391 | 21.727 | 1.00 15.38 C |
| ATOM | 1000 | CG | PRO | A | 271 | −3.151 | −16.556 | 21.928 | 1.00 15.88 C |
| ATOM | 1001 | CD | PRO | A | 271 | −2.502 | −16.336 | 20.593 | 1.00 15.31 C |
| ATOM | 1002 | N | TYR | A | 272 | −6.855 | −16.285 | 19.400 | 1.00 13.29 N |
| ATOM | 1003 | CA | TYR | A | 272 | −7.918 | −15.315 | 19.193 | 1.00 16.14 C |
| ATOM | 1004 | C | TYR | A | 272 | −9.201 | −16.027 | 19.549 | 1.00 13.34 C |
| ATOM | 1005 | O | TYR | A | 272 | −9.224 | −17.253 | 19.601 | 1.00 12.02 O |
| ATOM | 1006 | CB | TYR | A | 272 | −7.982 | −14.830 | 17.736 | 1.00 11.47 C |
| ATOM | 1007 | CG | TYR | A | 272 | −6.967 | −13.776 | 17.310 | 1.00 13.69 C |

TABLE 10.1-continued

| | | | | | | | | | | |
|---|---|---|---|---|---|---|---|---|---|---|
| ATOM | 1008 | CD1 | TYR | A | 272 | −6.439 | −12.872 | 18.213 | 1.00 | 9.93 C |
| ATOM | 1009 | CD2 | TYR | A | 272 | −6.574 | −13.673 | 15.969 | 1.00 | 12.95 C |
| ATOM | 1010 | CE1 | TYR | A | 272 | −5.538 | −11.914 | 17.807 | 1.00 | 11.19 C |
| ATOM | 1011 | CE2 | TYR | A | 272 | −5.684 | −12.723 | 15.561 | 1.00 | 9.94 C |
| ATOM | 1012 | CZ | TYR | A | 272 | −5.164 | −11.845 | 16.484 | 1.00 | 14.00 C |
| ATOM | 1013 | OH | TYR | A | 272 | −4.257 | −10.893 | 16.080 | 1.00 | 17.41 O |
| ATOM | 1014 | N | ARG | A | 273 | −10.271 | −15.272 | 19.765 | 1.00 | 12.95 N |
| ATOM | 1015 | CA | ARG | A | 273 | −11.572 | −15.885 | 19.870 | 1.00 | 12.35 C |
| ATOM | 1016 | C | ARG | A | 273 | −11.927 | −16.389 | 18.493 | 1.00 | 14.06 C |
| ATOM | 1017 | O | ARG | A | 273 | −11.229 | −16.088 | 17.517 | 1.00 | 14.38 O |
| ATOM | 1018 | CB | ARG | A | 273 | −12.611 | −14.905 | 20.397 | 1.00 | 14.33 C |
| ATOM | 1019 | CG | ARG | A | 273 | −12.364 | −14.520 | 21.841 | 1.00 | 12.78 C |
| ATOM | 1020 | CD | ARG | A | 273 | −13.449 | −13.645 | 22.401 | 1.00 | 17.64 C |
| ATOM | 1021 | NE | ARG | A | 273 | −13.276 | −13.515 | 23.840 | 1.00 | 21.61 N |
| ATOM | 1022 | CZ | ARG | A | 273 | −14.015 | −12.742 | 24.625 | 1.00 | 24.75 C |
| ATOM | 1023 | NH1 | ARG | A | 273 | −14.997 | −12.010 | 24.109 | 1.00 | 30.00 N |
| ATOM | 1024 | NH2 | ARG | A | 273 | −13.763 | −12.702 | 25.930 | 1.00 | 20.72 N |
| ATOM | 1025 | N | TRP | A | 274 | −12.986 | −17.183 | 18.411 | 1.00 | 13.15 N |
| ATOM | 1026 | CA | TRP | A | 274 | −13.420 | −17.706 | 17.130 | 1.00 | 13.83 C |
| ATOM | 1027 | C | TRP | A | 274 | −14.926 | −17.845 | 17.166 | 1.00 | 15.15 C |
| ATOM | 1028 | O | TRP | A | 274 | −15.525 | −17.760 | 18.227 | 1.00 | 14.10 O |
| ATOM | 1029 | CB | TRP | A | 274 | −12.758 | −19.043 | 16.833 | 1.00 | 12.63 C |
| ATOM | 1030 | CG | TRP | A | 274 | −13.207 | −20.135 | 17.726 | 1.00 | 16.63 C |
| ATOM | 1031 | CD1 | TRP | A | 274 | −14.106 | −21.107 | 17.428 | 1.00 | 18.08 C |
| ATOM | 1032 | CD2 | TRP | A | 274 | −12.780 | −20.377 | 19.080 | 1.00 | 14.16 C |
| ATOM | 1033 | NE1 | TRP | A | 274 | −14.265 | −21.951 | 18.507 | 1.00 | 15.30 N |
| ATOM | 1034 | CE2 | TRP | A | 274 | −13.463 | −21.521 | 19.533 | 1.00 | 15.80 C |
| ATOM | 1035 | CE3 | TRP | A | 274 | −11.874 | −19.744 | 19.944 | 1.00 | 16.39 C |
| ATOM | 1036 | CZ2 | TRP | A | 274 | −13.282 | −22.046 | 20.822 | 1.00 | 16.41 C |
| ATOM | 1037 | CZ3 | TRP | A | 274 | −11.700 | −20.261 | 21.226 | 1.00 | 17.93 C |
| ATOM | 1038 | CH2 | TRP | A | 274 | −12.407 | −21.401 | 21.651 | 1.00 | 14.81 C |
| ATOM | 1039 | N | VAL | A | 275 | −15.532 | −18.025 | 16.003 | 1.00 | 13.91 N |
| ATOM | 1040 | CA | VAL | A | 275 | −16.954 | −18.282 | 15.911 | 1.00 | 14.90 C |
| ATOM | 1041 | C | VAL | A | 275 | −17.157 | −19.604 | 15.214 | 1.00 | 17.68 C |
| ATOM | 1042 | O | VAL | A | 275 | −16.570 | −19.843 | 14.160 | 1.00 | 16.82 O |
| ATOM | 1043 | CB | VAL | A | 275 | −17.690 | −17.199 | 15.126 | 1.00 | 15.04 C |
| ATOM | 1044 | CG1 | VAL | A | 275 | −19.194 | −17.473 | 15.122 | 1.00 | 14.67 C |
| ATOM | 1045 | CG2 | VAL | A | 275 | −17.359 | −15.825 | 15.676 | 1.00 | 12.68 C |
| ATOM | 1046 | N | CYS | A | 276 | −17.993 | −20.463 | 15.791 | 1.00 | 18.92 N |
| ATOM | 1047 | CA | CYS | A | 276 | −18.396 | −21.676 | 15.095 | 1.00 | 20.03 C |
| ATOM | 1048 | C | CYS | A | 276 | −19.725 | −21.444 | 14.397 | 1.00 | 19.45 C |
| ATOM | 1049 | O | CYS | A | 276 | −20.581 | −20.714 | 14.896 | 1.00 | 17.29 O |
| ATOM | 1050 | CB | CYS | A | 276 | −18.493 | −22.859 | 16.055 | 1.00 | 22.59 C |
| ATOM | 1051 | SG | CYS | A | 276 | −16.895 | −23.523 | 16.446 | 1.00 | 31.78 S |
| ATOM | 1052 | N | GLU | A | 277 | −19.865 | −22.050 | 13.225 | 1.00 | 18.94 N |
| ATOM | 1053 | CA | GLU | A | 277 | −21.077 | −21.941 | 12.437 | 1.00 | 21.40 C |
| ATOM | 1054 | C | GLU | A | 277 | −21.492 | −23.299 | 11.919 | 1.00 | 19.98 C |
| ATOM | 1055 | O | GLU | A | 277 | −20.668 | −24.086 | 11.467 | 1.00 | 20.59 O |
| ATOM | 1056 | CB | GLU | A | 277 | −20.887 | −20.988 | 11.263 | 1.00 | 17.46 C |
| ATOM | 1057 | CG | GLU | A | 277 | −22.187 | −20.673 | 10.536 | 1.00 | 21.39 C |
| ATOM | 1058 | CD | GLU | A | 277 | −21.972 | −20.063 | 9.154 | 1.00 | 22.43 C |
| ATOM | 1059 | OE1 | GLU | A | 277 | −20.817 | −20.032 | 8.682 | 1.00 | 21.58 O |
| ATOM | 1060 | OE2 | GLU | A | 277 | −22.962 | −19.607 | 8.540 | 1.00 | 22.39 O |
| ATOM | 1061 | N | THR | A | 278 | −22.778 | −23.572 | 11.998 | 1.00 | 19.21 N |
| ATOM | 1062 | CA | THR | A | 278 | −23.351 | −24.710 | 11.309 | 1.00 | 24.97 C |
| ATOM | 1063 | C | THR | A | 278 | −24.612 | −24.250 | 10.581 | 1.00 | 25.29 C |
| ATOM | 1064 | O | THR | A | 278 | −25.166 | −23.196 | 10.887 | 1.00 | 24.46 O |
| ATOM | 1065 | CB | THR | A | 278 | −23.688 | −25.846 | 12.267 | 1.00 | 25.96 C |
| ATOM | 1066 | OG1 | THR | A | 278 | −23.799 | −27.063 | 11.527 | 1.00 | 36.51 O |
| ATOM | 1067 | CG2 | THR | A | 278 | −24.996 | −25.566 | 12.973 | 1.00 | 23.69 C |
| ATOM | 1068 | N | GLU | A | 279 | −25.065 | −25.033 | 9.613 | 1.00 | 29.02 N |
| ATOM | 1069 | CA | GLU | A | 279 | −26.228 | −24.630 | 8.841 | 1.00 | 31.70 C |
| ATOM | 1070 | C | GLU | A | 279 | −27.438 | −25.498 | 9.167 | 1.00 | 29.56 C |
| ATOM | 1071 | O | GLU | A | 279 | −27.299 | −26.687 | 9.406 | 1.00 | 29.11 O |
| ATOM | 1072 | CB | GLU | A | 279 | −25.911 | −24.678 | 7.347 | 1.00 | 28.64 C |
| ATOM | 1073 | CG | GLU | A | 279 | −24.969 | −23.568 | 6.885 | 1.00 | 27.57 C |
| ATOM | 1074 | CD | GLU | A | 279 | −23.497 | −23.939 | 7.011 | 1.00 | 31.65 C |
| ATOM | 1075 | OE1 | GLU | A | 279 | −22.662 | −23.026 | 7.182 | 1.00 | 30.86 O |
| ATOM | 1076 | OE2 | GLU | A | 279 | −23.166 | −25.139 | 6.923 | 1.00 | 32.59 O |
| ATOM | 1077 | N | LEU | A | 280 | −28.617 | −24.885 | 9.219 | 1.00 | 34.32 N |
| ATOM | 1078 | CA | LEU | A | 280 | −29.855 | −25.649 | 9.304 | 1.00 | 35.91 C |
| ATOM | 1079 | C | LEU | A | 280 | −30.265 | −26.069 | 7.893 | 1.00 | 40.23 C |
| ATOM | 1080 | O | LEU | A | 280 | −30.735 | −27.187 | 7.666 | 1.00 | 43.65 O |
| ATOM | 1081 | CB | LEU | A | 280 | −30.974 | −24.837 | 9.959 | 1.00 | 37.40 C |
| ATOM | 1082 | CG | LEU | A | 280 | −30.811 | −24.359 | 11.398 | 1.00 | 33.17 C |
| ATOM | 1083 | CD1 | LEU | A | 280 | −32.064 | −23.616 | 11.839 | 1.00 | 39.13 C |
| ATOM | 1084 | CD2 | LEU | A | 280 | −30.516 | −25.518 | 12.322 | 1.00 | 36.44 C |
| ATOM | 1085 | OXT | LEU | A | 280 | −30.126 | −25.285 | 6.942 | 1.00 | 35.92 O |
| HETATM | 1086 | CA | CA | A | 1001 | −0.390 | −15.928 | 3.667 | 1.00 | 18.60 Ca |
| HETATM | 1087 | CA | CA | A | 1002 | −1.936 | −8.931 | 8.005 | 1.00 | 15.61 Ca |

TABLE 10.1-continued

| | | | | | | | | | | |
|---|---|---|---|---|---|---|---|---|---|---|
| HETATM | 1088 | CA | CA | A | 1003 | −22.072 | −18.548 | 6.675 | 1.00 | 20.87 Ca |
| HETATM | 1089 | CL | CL | A | 1004 | −0.586 | −12.976 | 20.217 | 1.00 | 15.82 Cl |
| HETATM | 1090 | CL | CL | A | 1005 | −16.511 | −11.093 | 27.288 | 1.00 | 51.09 Cl |
| TER | | | | | | | | | | |
| HETATM | 1091 | C1 | NGA | D | 1 | −0.855 | −5.202 | 11.893 | 1.00 | 29.65 C |
| HETATM | 1092 | C2 | NGA | D | 1 | −1.637 | −6.424 | 11.455 | 1.00 | 25.74 C |
| HETATM | 1093 | C3 | NGA | D | 1 | −0.719 | −7.433 | 10.877 | 1.00 | 19.12 C |
| HETATM | 1094 | C4 | NGA | D | 1 | 0.140 | −6.858 | 9.782 | 1.00 | 26.89 C |
| HETATM | 1095 | C5 | NGA | D | 1 | 0.800 | −5.564 | 10.227 | 1.00 | 27.00 C |
| HETATM | 1096 | C6 | NGA | D | 1 | 1.564 | −4.950 | 9.107 | 1.00 | 23.07 C |
| HETATM | 1097 | C7 | NGA | D | 1 | −3.674 | −6.716 | 12.908 | 1.00 | 23.79 C |
| HETATM | 1098 | C8 | NGA | D | 1 | −4.345 | −7.353 | 14.124 | 1.00 | 17.91 C |
| HETATM | 1099 | N2 | NGA | D | 1 | −2.306 | −7.017 | 12.612 | 1.00 | 24.92 N |
| HETATM | 1100 | O1 | NGA | D | 1 | −1.657 | −4.257 | 12.478 | 1.00 | 40.15 O |
| HETATM | 1101 | O3 | NGA | D | 1 | −1.485 | −8.575 | 10.399 | 1.00 | 17.51 O |
| HETATM | 1102 | O4 | NGA | D | 1 | −0.627 | −6.578 | 8.599 | 1.00 | 18.77 O |
| HETATM | 1103 | O5 | NGA | D | 1 | −0.199 | −4.606 | 10.704 | 1.00 | 21.93 O |
| HETATM | 1104 | O6 | NGA | D | 1 | 2.201 | −3.801 | 9.619 | 1.00 | 23.93 O |
| HETATM | 1105 | O7 | NGA | D | 1 | −4.290 | −5.954 | 12.181 | 1.00 | 26.58 O |
| TER | | | | | | | | | | |
| END | | | | | | | | | | |

TABLE 10.2

| | | | | | | | | | | |
|---|---|---|---|---|---|---|---|---|---|---|
| ATOM | 1 | N | GLN | A | 1 | 4.287 | −11.302 | 31.298 | 1.00 | 52.13 N |
| ATOM | 2 | CA | GLN | A | 1 | 2.840 | −11.140 | 31.183 | 1.00 | 68.91 C |
| ATOM | 3 | C | GLN | A | 1 | 2.320 | −11.699 | 29.861 | 1.00 | 58.31 C |
| ATOM | 4 | O | GLN | A | 1 | 3.071 | −11.816 | 28.894 | 1.00 | 49.26 O |
| ATOM | 5 | CB | GLN | A | 1 | 2.457 | −9.664 | 31.320 | 1.00 | 75.74 C |
| ATOM | 6 | CG | GLN | A | 1 | 2.710 | −9.088 | 32.707 | 1.00 | 88.73 C |
| ATOM | 7 | CD | GLN | A | 1 | 1.879 | −9.771 | 33.783 | 1.00 | 100.20 C |
| ATOM | 8 | NE2 | GLN | A | 1 | 2.448 | −9.903 | 34.978 | 1.00 | 94.67 N |
| ATOM | 9 | OE1 | GLN | A | 1 | 0.742 | −10.179 | 33.539 | 1.00 | 98.51 O |
| ATOM | 10 | N | VAL | A | 2 | 1.035 | −12.043 | 29.824 | 1.00 | 56.43 N |
| ATOM | 11 | CA | VAL | A | 2 | 0.425 | −12.599 | 28.617 | 1.00 | 47.45 C |
| ATOM | 12 | C | VAL | A | 2 | 0.210 | −11.533 | 27.541 | 1.00 | 49.76 C |
| ATOM | 13 | O | VAL | A | 2 | −0.422 | −10.506 | 27.790 | 1.00 | 52.22 O |
| ATOM | 14 | CB | VAL | A | 2 | −0.928 | −13.275 | 28.926 | 1.00 | 51.59 C |
| ATOM | 15 | CG1 | VAL | A | 2 | −1.627 | −13.682 | 27.636 | 1.00 | 51.80 C |
| ATOM | 16 | CG2 | VAL | A | 2 | −0.727 | −14.481 | 29.825 | 1.00 | 44.15 C |
| ATOM | 17 | N | GLN | A | 3 | 0.740 | −11.785 | 26.348 | 1.00 | 39.57 N |
| ATOM | 18 | CA | GLN | A | 3 | 0.582 | −10.876 | 25.219 | 1.00 | 41.94 C |
| ATOM | 19 | C | GLN | A | 3 | 0.085 | −11.615 | 23.981 | 1.00 | 38.69 C |
| ATOM | 20 | O | GLN | A | 3 | 0.586 | −12.691 | 23.649 | 1.00 | 39.97 O |
| ATOM | 21 | CB | GLN | A | 3 | 1.903 | −10.176 | 24.891 | 1.00 | 40.78 C |
| ATOM | 22 | CG | GLN | A | 3 | 2.450 | −9.275 | 25.980 | 1.00 | 61.11 C |
| ATOM | 23 | CD | GLN | A | 3 | 3.756 | −8.612 | 25.570 | 1.00 | 71.25 C |
| ATOM | 24 | NE2 | GLN | A | 3 | 4.265 | −7.724 | 26.417 | 1.00 | 63.18 N |
| ATOM | 25 | OE1 | GLN | A | 3 | 4.299 | −8.899 | 24.502 | 1.00 | 74.87 O |
| ATOM | 26 | N | LEU | A | 4 | −0.896 | −11.035 | 23.298 | 1.00 | 33.31 N |
| ATOM | 27 | CA | LEU | A | 4 | −1.361 | −11.577 | 22.025 | 1.00 | 32.23 C |
| ATOM | 28 | C | LEU | A | 4 | −1.077 | −10.581 | 20.903 | 1.00 | 34.08 C |
| ATOM | 29 | O | LEU | A | 4 | −1.523 | −9.436 | 20.954 | 1.00 | 35.79 O |
| ATOM | 30 | CB | LEU | A | 4 | −2.854 | −11.904 | 22.076 | 1.00 | 24.96 C |
| ATOM | 31 | CG | LEU | A | 4 | −3.339 | −12.906 | 23.123 | 1.00 | 35.14 C |
| ATOM | 32 | CD1 | LEU | A | 4 | −4.849 | −13.045 | 23.036 | 1.00 | 33.63 C |
| ATOM | 33 | CD2 | LEU | A | 4 | −2.665 | −14.259 | 22.950 | 1.00 | 36.57 C |
| ATOM | 34 | N | VAL | A | 5 | −0.333 | −11.023 | 19.894 | 1.00 | 34.68 N |
| ATOM | 35 | CA | VAL | A | 5 | 0.072 | −10.150 | 18.794 | 1.00 | 31.10 C |
| ATOM | 36 | C | VAL | A | 5 | −0.418 | −10.708 | 17.466 | 1.00 | 27.37 C |
| ATOM | 37 | O | VAL | A | 5 | −0.029 | −11.804 | 17.061 | 1.00 | 33.78 O |
| ATOM | 38 | CB | VAL | A | 5 | 1.603 | −9.971 | 18.747 | 1.00 | 33.23 C |
| ATOM | 39 | CG1 | VAL | A | 5 | 2.000 | −9.098 | 17.564 | 1.00 | 39.33 C |
| ATOM | 40 | CG2 | VAL | A | 5 | 2.107 | −9.365 | 20.052 | 1.00 | 30.20 C |
| ATOM | 41 | N | GLN | A | 6 | −1.280 | −9.951 | 16.792 | 1.00 | 27.57 N |
| ATOM | 42 | CA | GLN | A | 6 | −1.882 | −10.411 | 15.545 | 1.00 | 31.03 C |
| ATOM | 43 | C | GLN | A | 6 | −1.155 | −9.849 | 14.333 | 1.00 | 32.02 C |
| ATOM | 44 | O | GLN | A | 6 | −0.447 | −8.847 | 14.431 | 1.00 | 31.18 O |
| ATOM | 45 | CB | GLN | A | 6 | −3.362 | −10.026 | 15.492 | 1.00 | 23.97 C |
| ATOM | 46 | CG | GLN | A | 6 | −4.154 | −10.551 | 16.674 | 1.00 | 31.59 C |
| ATOM | 47 | CD | GLN | A | 6 | −5.613 | −10.158 | 16.634 | 1.00 | 31.89 C |
| ATOM | 48 | NE2 | GLN | A | 6 | −6.203 | −10.163 | 15.438 | 1.00 | 30.10 N |
| ATOM | 49 | OE1 | GLN | A | 6 | −6.210 | −9.863 | 17.669 | 1.00 | 28.34 O |
| ATOM | 50 | N | SER | A | 7 | −1.343 | −10.498 | 13.190 | 1.00 | 28.18 N |
| ATOM | 51 | CA | SER | A | 7 | −0.769 | −10.018 | 11.941 | 1.00 | 37.96 C |
| ATOM | 52 | C | SER | A | 7 | −1.529 | −8.784 | 11.456 | 1.00 | 36.31 C |
| ATOM | 53 | O | SER | A | 7 | −2.504 | −8.356 | 12.088 | 1.00 | 29.94 O |

TABLE 10.2-continued

| | | | | | | | | | | |
|---|---|---|---|---|---|---|---|---|---|---|
| ATOM | 54 | CB | SER | A | 7 | −0.782 | −11.125 | 10.884 | 1.00 | 31.07 | C |
| ATOM | 55 | OG | SER | A | 7 | −2.003 | −11.840 | 10.917 | 1.00 | 34.72 | O |
| ATOM | 56 | N | GLY | A | 8 | −1.084 | −8.220 | 10.336 | 1.00 | 37.68 | N |
| ATOM | 57 | CA | GLY | A | 8 | −1.579 | −6.932 | 9.880 | 1.00 | 34.93 | C |
| ATOM | 58 | C | GLY | A | 8 | −2.778 | −6.994 | 8.957 | 1.00 | 39.24 | C |
| ATOM | 59 | O | GLY | A | 8 | −3.278 | −8.071 | 8.641 | 1.00 | 43.54 | O |
| ATOM | 60 | N | THR | A | 9 | −3.221 | −5.818 | 8.519 | 1.00 | 33.12 | N |
| ATOM | 61 | CA | THR | A | 9 | −4.417 | −5.660 | 7.698 | 1.00 | 34.90 | C |
| ATOM | 62 | C | THR | A | 9 | −4.411 | −6.499 | 6.424 | 1.00 | 34.53 | C |
| ATOM | 63 | O | THR | A | 9 | −3.369 | −6.699 | 5.809 | 1.00 | 36.17 | O |
| ATOM | 64 | CB | THR | A | 9 | −4.612 | −4.186 | 7.290 | 1.00 | 34.99 | C |
| ATOM | 65 | OG1 | THR | A | 9 | −4.305 | −3.333 | 8.400 | 1.00 | 54.03 | O |
| ATOM | 66 | CG2 | THR | A | 9 | −6.032 | −3.948 | 6.877 | 1.00 | 25.09 | C |
| ATOM | 67 | N | GLU | A | 10 | −5.591 | −6.977 | 6.042 | 1.00 | 38.28 | N |
| ATOM | 68 | CA | GLU | A | 10 | −5.770 | −7.781 | 4.840 | 1.00 | 36.11 | C |
| ATOM | 69 | C | GLU | A | 10 | −6.846 | −7.183 | 3.942 | 1.00 | 42.38 | C |
| ATOM | 70 | O | GLU | A | 10 | −7.825 | −6.614 | 4.433 | 1.00 | 36.65 | O |
| ATOM | 71 | CB | GLU | A | 10 | −6.156 | −9.217 | 5.204 | 1.00 | 41.15 | C |
| ATOM | 72 | CG | GLU | A | 10 | −5.177 | −9.938 | 6.112 | 1.00 | 45.12 | C |
| ATOM | 73 | CD | GLU | A | 10 | −4.128 | −10.719 | 5.342 | 1.00 | 54.57 | C |
| ATOM | 74 | OE1 | GLU | A | 10 | −3.998 | −10.501 | 4.118 | 1.00 | 60.79 | O |
| ATOM | 75 | OE2 | GLU | A | 10 | −3.438 | −11.556 | 5.963 | 1.00 | 51.03 | O |
| ATOM | 76 | N | VAL | A | 11 | −6.659 | −7.314 | 2.630 | 1.00 | 33.01 | N |
| ATOM | 77 | CA | VAL | A | 11 | −7.690 | −6.970 | 1.654 | 1.00 | 35.41 | C |
| ATOM | 78 | C | VAL | A | 11 | −7.886 | −8.152 | 0.709 | 1.00 | 37.75 | C |
| ATOM | 79 | O | VAL | A | 11 | −6.920 | −8.678 | 0.153 | 1.00 | 40.66 | O |
| ATOM | 80 | CB | VAL | A | 11 | −7.331 | −5.718 | 0.826 | 1.00 | 41.44 | C |
| ATOM | 81 | CG1 | VAL | A | 11 | −8.587 | −5.137 | 0.181 | 1.00 | 34.49 | C |
| ATOM | 82 | CG2 | VAL | A | 11 | −6.642 | −4.681 | 1.692 | 1.00 | 43.75 | C |
| ATOM | 83 | N | LYS | A | 12 | −9.133 | −8.572 | 0.535 | 1.00 | 35.34 | N |
| ATOM | 84 | CA | LYS | A | 12 | −9.430 | −9.745 | −0.276 | 1.00 | 34.88 | C |
| ATOM | 85 | C | LYS | A | 12 | −10.619 | −9.497 | −1.196 | 1.00 | 41.54 | C |
| ATOM | 86 | O | LYS | A | 12 | −11.503 | −8.701 | −0.881 | 1.00 | 37.51 | O |
| ATOM | 87 | CB | LYS | A | 12 | −9.716 | −10.958 | 0.618 | 1.00 | 37.30 | C |
| ATOM | 88 | CG | LYS | A | 12 | −8.570 | −11.375 | 1.529 | 1.00 | 31.97 | C |
| ATOM | 89 | CD | LYS | A | 12 | −7.396 | −11.926 | 0.737 | 1.00 | 39.11 | C |
| ATOM | 90 | CE | LYS | A | 12 | −6.276 | −12.372 | 1.664 | 1.00 | 40.25 | C |
| ATOM | 91 | NZ | LYS | A | 12 | −5.084 | −12.848 | 0.910 | 1.00 | 43.21 | N |
| ATOM | 92 | N | LYS | A | 13 | −10.641 | −10.186 | −2.332 | 1.00 | 40.85 | N |
| ATOM | 93 | CA | LYS | A | 13 | −11.800 | −10.147 | −3.217 | 1.00 | 46.07 | C |
| ATOM | 94 | C | LYS | A | 13 | −12.873 | −11.095 | −2.687 | 1.00 | 41.63 | C |
| ATOM | 95 | O | LYS | A | 13 | −12.557 | −12.058 | −1.991 | 1.00 | 42.80 | O |
| ATOM | 96 | CB | LYS | A | 13 | −11.401 | −10.525 | −4.646 | 1.00 | 44.49 | C |
| ATOM | 97 | CG | LYS | A | 13 | −10.368 | −9.597 | −5.262 | 1.00 | 51.17 | C |
| ATOM | 98 | CD | LYS | A | 13 | −10.037 | −10.015 | −6.686 | 1.00 | 69.57 | C |
| ATOM | 99 | CE | LYS | A | 13 | −9.093 | −9.026 | −7.351 | 1.00 | 76.15 | C |
| ATOM | 100 | NZ | LYS | A | 13 | −8.805 | −9.405 | −8.763 | 1.00 | 81.80 | N |
| ATOM | 101 | N | PRO | A | 14 | −14.149 | −10.815 | −2.992 | 1.00 | 40.61 | N |
| ATOM | 102 | CA | PRO | A | 14 | −15.210 | −11.741 | −2.581 | 1.00 | 42.09 | C |
| ATOM | 103 | C | PRO | A | 14 | −14.959 | −13.147 | −3.124 | 1.00 | 43.49 | C |
| ATOM | 104 | O | PRO | A | 14 | −14.532 | −13.286 | −4.268 | 1.00 | 43.97 | O |
| ATOM | 105 | CB | PRO | A | 14 | −16.474 | −11.125 | −3.191 | 1.00 | 41.78 | C |
| ATOM | 106 | CG | PRO | A | 14 | −16.153 | −9.669 | −3.327 | 1.00 | 42.84 | C |
| ATOM | 107 | CD | PRO | A | 14 | −14.683 | −9.605 | −3.641 | 1.00 | 40.32 | C |
| ATOM | 108 | N | GLY | A | 15 | −15.191 | −14.166 | −2.302 | 1.00 | 44.15 | N |
| ATOM | 109 | CA | GLY | A | 15 | −14.989 | −15.542 | −2.716 | 1.00 | 39.13 | C |
| ATOM | 110 | C | GLY | A | 15 | −13.611 | −16.090 | −2.391 | 1.00 | 48.08 | C |
| ATOM | 111 | O | GLY | A | 15 | −13.385 | −17.297 | −2.469 | 1.00 | 45.50 | O |
| ATOM | 112 | N | ALA | A | 16 | −12.683 | −15.208 | −2.028 | 1.00 | 41.49 | N |
| ATOM | 113 | CA | ALA | A | 16 | −11.334 | −15.636 | −1.665 | 1.00 | 40.38 | C |
| ATOM | 114 | C | ALA | A | 16 | −11.263 | −16.095 | −0.209 | 1.00 | 44.65 | C |
| ATOM | 115 | O | ALA | A | 16 | −12.281 | −16.184 | 0.478 | 1.00 | 39.46 | O |
| ATOM | 116 | CB | ALA | A | 16 | −10.340 | −14.512 | −1.908 | 1.00 | 42.69 | C |
| ATOM | 117 | N | SER | A | 17 | −10.052 | −16.383 | 0.257 | 1.00 | 41.27 | N |
| ATOM | 118 | C | SER | A | 17 | −8.822 | −15.906 | 2.328 | 1.00 | 41.94 | C |
| ATOM | 119 | O | SER | A | 17 | −7.925 | −15.363 | 1.688 | 1.00 | 46.41 | O |
| ATOM | 120 | CA | ASER | A | 17 | −9.841 | −16.800 | 1.638 | 0.70 | 41.50 | C |
| ATOM | 121 | CB | ASER | A | 17 | −9.382 | −18.258 | 1.699 | 0.70 | 42.17 | C |
| ATOM | 122 | OG | ASER | A | 17 | −10.402 | −19.130 | 1.247 | 0.70 | 48.56 | O |
| ATOM | 123 | CA | BSER | A | 17 | −9.844 | −16.800 | 1.638 | 0.30 | 41.51 | C |
| ATOM | 124 | CB | BSER | A | 17 | −9.387 | −18.259 | 1.703 | 0.30 | 42.20 | C |
| ATOM | 125 | OG | BSER | A | 17 | −8.050 | −18.394 | 1.253 | 0.30 | 38.89 | O |
| ATOM | 126 | N | VAL | A | 18 | −8.963 | −15.760 | 3.639 | 1.00 | 40.15 | N |
| ATOM | 127 | CA | VAL | A | 18 | −8.023 | −14.966 | 4.414 | 1.00 | 37.97 | C |
| ATOM | 128 | C | VAL | A | 18 | −7.539 | −15.771 | 5.615 | 1.00 | 36.78 | C |
| ATOM | 129 | O | VAL | A | 18 | −8.313 | −16.499 | 6.237 | 1.00 | 43.11 | O |
| ATOM | 130 | CB | VAL | A | 18 | −8.657 | −13.636 | 4.879 | 1.00 | 39.97 | C |
| ATOM | 131 | CG1 | VAL | A | 18 | −9.911 | −13.893 | 5.706 | 1.00 | 34.36 | C |
| ATOM | 132 | CG2 | VAL | A | 18 | −7.651 | −12.802 | 5.661 | 1.00 | 41.62 | C |
| ATOM | 133 | N | LYS | A | 19 | −6.251 | −15.664 | 5.921 | 1.00 | 39.92 | N |

TABLE 10.2-continued

| | | | | | | | | | | |
|---|---|---|---|---|---|---|---|---|---|---|
| ATOM | 134 | CA | LYS | A | 19 | −5.706 | −16.304 | 7.110 | 1.00 | 40.61 | C |
| ATOM | 135 | C | LYS | A | 19 | −5.015 | −15.279 | 8.012 | 1.00 | 41.01 | C |
| ATOM | 136 | O | LYS | A | 19 | −4.067 | −14.610 | 7.599 | 1.00 | 42.89 | O |
| ATOM | 137 | CB | LYS | A | 19 | −4.737 | −17.424 | 6.731 | 1.00 | 38.22 | C |
| ATOM | 138 | CG | LYS | A | 19 | −4.105 | −18.105 | 7.932 | 1.00 | 35.23 | C |
| ATOM | 139 | CD | LYS | A | 19 | −3.153 | −19.219 | 7.527 | 1.00 | 37.78 | C |
| ATOM | 140 | CE | LYS | A | 19 | −3.892 | −20.532 | 7.324 | 1.00 | 52.29 | C |
| ATOM | 141 | NZ | LYS | A | 19 | −2.953 | −21.693 | 7.310 | 1.00 | 57.68 | N |
| ATOM | 142 | N | VAL | A | 20 | −5.511 | −15.165 | 9.241 | 1.00 | 38.03 | N |
| ATOM | 143 | CA | VAL | A | 20 | −4.982 | −14.234 | 10.235 | 1.00 | 34.63 | C |
| ATOM | 144 | C | VAL | A | 20 | −4.240 | −15.005 | 11.332 | 1.00 | 39.64 | C |
| ATOM | 145 | O | VAL | A | 20 | −4.658 | −16.099 | 11.720 | 1.00 | 36.81 | O |
| ATOM | 146 | CB | VAL | A | 20 | −6.115 | −13.388 | 10.867 | 1.00 | 33.08 | C |
| ATOM | 147 | CG1 | VAL | A | 20 | −5.553 | −12.359 | 11.839 | 1.00 | 39.43 | C |
| ATOM | 148 | CG2 | VAL | A | 20 | −6.941 | −12.707 | 9.784 | 1.00 | 38.82 | C |
| ATOM | 149 | N | SER | A | 21 | −3.144 | −14.439 | 11.832 | 1.00 | 30.21 | N |
| ATOM | 150 | CA | SER | A | 21 | −2.338 | −15.124 | 12.838 | 1.00 | 32.22 | C |
| ATOM | 151 | C | SER | A | 21 | −2.354 | −14.384 | 14.168 | 1.00 | 34.12 | C |
| ATOM | 152 | O | SER | A | 21 | −2.566 | −13.176 | 14.218 | 1.00 | 32.94 | O |
| ATOM | 153 | CB | SER | A | 21 | −0.892 | −15.289 | 12.354 | 1.00 | 32.38 | C |
| ATOM | 154 | OG | SER | A | 21 | −0.205 | −14.046 | 12.353 | 1.00 | 35.31 | O |
| ATOM | 155 | N | CYS | A | 22 | −2.116 | −15.123 | 15.244 | 1.00 | 36.35 | N |
| ATOM | 156 | CA | CYS | A | 22 | −2.109 | −14.565 | 16.587 | 1.00 | 33.43 | C |
| ATOM | 157 | C | CYS | A | 22 | −0.985 | −15.204 | 17.401 | 1.00 | 38.78 | C |
| ATOM | 158 | O | CYS | A | 22 | −1.059 | −16.380 | 17.757 | 1.00 | 39.38 | O |
| ATOM | 159 | CB | CYS | A | 22 | −3.468 | −14.791 | 17.260 | 1.00 | 38.36 | C |
| ATOM | 160 | SG | CYS | A | 22 | −3.592 | −14.210 | 18.969 | 1.00 | 47.87 | S |
| ATOM | 161 | N | LYS | A | 23 | 0.064 | −14.440 | 17.681 | 1.00 | 37.86 | N |
| ATOM | 162 | CA | LYS | A | 23 | 1.207 | −14.980 | 18.410 | 1.00 | 40.02 | C |
| ATOM | 163 | C | LYS | A | 23 | 1.019 | −14.817 | 19.912 | 1.00 | 36.84 | C |
| ATOM | 164 | O | LYS | A | 23 | 0.925 | −13.697 | 20.415 | 1.00 | 38.22 | O |
| ATOM | 165 | CB | LYS | A | 23 | 2.506 | −14.303 | 17.966 | 1.00 | 40.53 | C |
| ATOM | 166 | CG | LYS | A | 23 | 3.763 | −15.022 | 18.446 | 1.00 | 49.89 | C |
| ATOM | 167 | CD | LYS | A | 23 | 5.015 | −14.206 | 18.167 | 1.00 | 49.82 | C |
| ATOM | 168 | CE | LYS | A | 23 | 6.195 | −15.104 | 17.823 | 1.00 | 63.34 | C |
| ATOM | 169 | NZ | LYS | A | 23 | 6.392 | −16.183 | 18.827 | 1.00 | 59.88 | N |
| ATOM | 170 | N | ALA | A | 24 | 0.960 | −15.940 | 20.621 | 1.00 | 39.67 | N |
| ATOM | 171 | CA | ALA | A | 24 | 0.756 | −15.929 | 22.066 | 1.00 | 44.74 | C |
| ATOM | 172 | C | ALA | A | 24 | 2.070 | −16.103 | 22.819 | 1.00 | 52.29 | C |
| ATOM | 173 | O | ALA | A | 24 | 2.952 | −16.844 | 22.390 | 1.00 | 57.40 | O |
| ATOM | 174 | CB | ALA | A | 24 | −0.227 | −17.014 | 22.468 | 1.00 | 43.19 | C |
| ATOM | 175 | N | SER | A | 25 | 2.193 | −15.416 | 23.949 | 1.00 | 49.70 | N |
| ATOM | 176 | CA | SER | A | 25 | 3.390 | −15.511 | 24.771 | 1.00 | 51.40 | C |
| ATOM | 177 | C | SER | A | 25 | 3.108 | −15.073 | 26.206 | 1.00 | 52.18 | C |
| ATOM | 178 | O | SER | A | 25 | 2.195 | −14.282 | 26.449 | 1.00 | 44.33 | O |
| ATOM | 179 | CB | SER | A | 25 | 4.513 | −14.665 | 24.171 | 1.00 | 54.47 | C |
| ATOM | 180 | OG | SER | A | 25 | 4.108 | −13.314 | 24.022 | 1.00 | 61.15 | O |
| ATOM | 181 | N | GLY | A | 26 | 3.887 | −15.597 | 27.149 | 1.00 | 43.62 | N |
| ATOM | 182 | CA | GLY | A | 26 | 3.797 | −15.182 | 28.539 | 1.00 | 42.96 | C |
| ATOM | 183 | C | GLY | A | 26 | 2.914 | −16.042 | 29.429 | 1.00 | 47.24 | C |
| ATOM | 184 | O | GLY | A | 26 | 2.711 | −15.718 | 30.599 | 1.00 | 47.28 | O |
| ATOM | 185 | N | TYR | A | 27 | 2.388 | −17.136 | 28.889 | 1.00 | 41.19 | N |
| ATOM | 186 | CA | TYR | A | 27 | 1.504 | −18.006 | 29.657 | 1.00 | 39.91 | C |
| ATOM | 187 | C | TYR | A | 27 | 2.259 | −18.809 | 30.704 | 1.00 | 53.27 | C |
| ATOM | 188 | O | TYR | A | 27 | 3.307 | −19.393 | 30.423 | 1.00 | 48.93 | O |
| ATOM | 189 | CB | TYR | A | 27 | 0.740 | −18.956 | 28.733 | 1.00 | 48.01 | C |
| ATOM | 190 | CG | TYR | A | 27 | −0.376 | −18.280 | 27.978 | 1.00 | 52.64 | C |
| ATOM | 191 | CD2 | TYR | A | 27 | −0.151 | −17.727 | 26.726 | 1.00 | 45.16 | C |
| ATOM | 192 | CD1 | TYR | A | 27 | −1.655 | −18.180 | 28.526 | 1.00 | 47.65 | C |
| ATOM | 193 | CE2 | TYR | A | 27 | −1.163 | −17.099 | 26.032 | 1.00 | 50.12 | C |
| ATOM | 194 | CE1 | TYR | A | 27 | −2.678 | −17.555 | 27.837 | 1.00 | 41.89 | C |
| ATOM | 195 | CZ | TYR | A | 27 | −2.422 | −17.015 | 26.590 | 1.00 | 49.26 | C |
| ATOM | 196 | OH | TYR | A | 27 | −3.417 | −16.385 | 25.887 | 1.00 | 50.17 | O |
| ATOM | 197 | N | THR | A | 28 | 1.705 | −18.844 | 31.910 | 1.00 | 55.54 | N |
| ATOM | 198 | CA | THR | A | 28 | 2.345 | −19.511 | 33.035 | 1.00 | 52.97 | C |
| ATOM | 199 | C | THR | A | 28 | 1.695 | −20.867 | 33.330 | 1.00 | 58.74 | C |
| ATOM | 200 | O | THR | A | 28 | 2.080 | −21.560 | 34.275 | 1.00 | 53.17 | O |
| ATOM | 201 | CB | THR | A | 28 | 2.301 | −18.622 | 34.297 | 1.00 | 45.57 | C |
| ATOM | 202 | CG2 | THR | A | 28 | 0.870 | −18.237 | 34.629 | 1.00 | 50.36 | C |
| ATOM | 203 | OG1 | THR | A | 28 | 2.873 | −19.326 | 35.405 | 1.00 | 80.42 | O |
| ATOM | 204 | O | PHE | A | 29 | −0.347 | −22.422 | 30.294 | 1.00 | 42.50 | O |
| ATOM | 205 | N | PHE | A | 29 | 0.711 | −21.242 | 32.516 | 1.00 | 52.37 | N |
| ATOM | 206 | CA | PHE | A | 29 | 0.048 | −22.536 | 32.661 | 1.00 | 40.27 | C |
| ATOM | 207 | C | PHE | A | 29 | −0.288 | −23.133 | 31.297 | 1.00 | 41.00 | C |
| ATOM | 208 | CB | PHE | A | 29 | −1.216 | −22.409 | 33.519 | 1.00 | 44.95 | C |
| ATOM | 209 | CG | PHE | A | 29 | −2.147 | −21.312 | 33.081 | 1.00 | 42.97 | C |
| ATOM | 210 | CD2 | PHE | A | 29 | −2.146 | −20.087 | 33.728 | 1.00 | 44.83 | C |
| ATOM | 211 | CD1 | PHE | A | 29 | −3.034 | −21.512 | 32.034 | 1.00 | 41.74 | C |
| ATOM | 212 | CE2 | PHE | A | 29 | −3.005 | −19.077 | 33.334 | 1.00 | 49.55 | C |
| ATOM | 213 | CE1 | PHE | A | 29 | −3.893 | −20.508 | 31.635 | 1.00 | 43.96 | C |

TABLE 10.2-continued

| ATOM | 214 | CZ | PHE | A | 29 | −3.879 | −19.287 | 32.286 | 1.00 | 50.75 | C |
|---|---|---|---|---|---|---|---|---|---|---|---|
| ATOM | 215 | O | THR | A | 30 | −1.919 | −25.101 | 28.021 | 1.00 | 42.53 | O |
| ATOM | 216 | N | THR | A | 30 | −0.530 | −24.439 | 31.272 | 1.00 | 40.36 | N |
| ATOM | 217 | CA | THR | A | 30 | −0.586 | −25.179 | 30.016 | 1.00 | 42.39 | C |
| ATOM | 218 | C | THR | A | 30 | −1.914 | −25.074 | 29.255 | 1.00 | 42.49 | C |
| ATOM | 219 | CB | THR | A | 30 | −0.281 | −26.682 | 30.251 | 1.00 | 43.93 | C |
| ATOM | 220 | OG1 | THR | A | 30 | −1.295 | −27.254 | 31.083 | 1.00 | 62.78 | O |
| ATOM | 221 | CG2 | THR | A | 30 | 1.071 | −26.857 | 30.923 | 1.00 | 45.80 | C |
| ATOM | 222 | O | ASN | A | 31 | −5.415 | −23.080 | 30.210 | 1.00 | 32.62 | O |
| ATOM | 223 | N | ASN | A | 31 | −3.035 | −24.959 | 29.965 | 1.00 | 33.58 | N |
| ATOM | 224 | CA | ASN | A | 31 | −4.334 | −25.021 | 29.288 | 1.00 | 29.92 | C |
| ATOM | 225 | C | ASN | A | 31 | −5.085 | −23.699 | 29.201 | 1.00 | 35.69 | C |
| ATOM | 226 | CB | ASN | A | 31 | −5.230 | −26.055 | 29.963 | 1.00 | 36.07 | C |
| ATOM | 227 | CG | ASN | A | 31 | −4.646 | −27.449 | 29.903 | 1.00 | 37.13 | C |
| ATOM | 228 | OD1 | ASN | A | 31 | −4.449 | −28.006 | 28.821 | 1.00 | 32.81 | O |
| ATOM | 229 | ND2 | ASN | A | 31 | −4.361 | −28.018 | 31.066 | 1.00 | 28.91 | N |
| ATOM | 230 | N | TYR | A | 32 | −5.354 | −23.289 | 27.968 | 1.00 | 31.28 | N |
| ATOM | 231 | CA | TYR | A | 32 | −6.159 | −22.112 | 27.677 | 1.00 | 34.89 | C |
| ATOM | 232 | C | TYR | A | 32 | −6.695 | −22.261 | 26.258 | 1.00 | 37.67 | C |
| ATOM | 233 | O | TYR | A | 32 | −6.197 | −23.085 | 25.491 | 1.00 | 29.11 | O |
| ATOM | 234 | CB | TYR | A | 32 | −5.339 | −20.825 | 27.826 | 1.00 | 30.61 | C |
| ATOM | 235 | CG | TYR | A | 32 | −4.090 | −20.799 | 26.970 | 1.00 | 42.67 | C |
| ATOM | 236 | CD1 | TYR | A | 32 | −2.900 | −21.355 | 27.425 | 1.00 | 39.54 | C |
| ATOM | 237 | CD2 | TYR | A | 32 | −4.101 | −20.225 | 25.704 | 1.00 | 38.42 | C |
| ATOM | 238 | CE1 | TYR | A | 32 | −1.758 | −21.341 | 26.643 | 1.00 | 41.78 | C |
| ATOM | 239 | CE2 | TYR | A | 32 | −2.962 | −20.206 | 24.921 | 1.00 | 42.06 | C |
| ATOM | 240 | CZ | TYR | A | 32 | −1.797 | −20.765 | 25.393 | 1.00 | 47.23 | C |
| ATOM | 241 | OH | TYR | A | 32 | −0.666 | −20.741 | 24.609 | 1.00 | 56.16 | O |
| ATOM | 242 | N | ASP | A | 33 | −7.716 | −21.482 | 25.919 | 1.00 | 30.49 | N |
| ATOM | 243 | CA | ASP | A | 33 | −8.271 | −21.484 | 24.570 | 1.00 | 29.65 | C |
| ATOM | 244 | C | ASP | A | 33 | −7.998 | −20.161 | 23.883 | 1.00 | 31.10 | C |
| ATOM | 245 | O | ASP | A | 33 | −8.062 | −19.113 | 24.513 | 1.00 | 28.34 | O |
| ATOM | 246 | CB | ASP | A | 33 | −9.779 | −21.734 | 24.591 | 1.00 | 29.08 | C |
| ATOM | 247 | CG | ASP | A | 33 | −10.139 | −23.124 | 25.082 | 1.00 | 34.81 | C |
| ATOM | 248 | OD1 | ASP | A | 33 | −9.427 | −24.090 | 24.729 | 1.00 | 31.12 | O |
| ATOM | 249 | OD2 | ASP | A | 33 | −11.145 | −23.247 | 25.814 | 1.00 | 30.55 | O |
| ATOM | 250 | N | ILE | A | 34 | −7.685 | −20.204 | 22.593 | 1.00 | 28.80 | N |
| ATOM | 251 | CA | ILE | A | 34 | −7.698 | −18.989 | 21.801 | 1.00 | 29.45 | C |
| ATOM | 252 | C | ILE | A | 34 | −9.070 | −18.897 | 21.155 | 1.00 | 28.08 | C |
| ATOM | 253 | O | ILE | A | 34 | −9.518 | −19.838 | 20.500 | 1.00 | 32.08 | O |
| ATOM | 254 | CB | ILE | A | 34 | −6.587 | −18.954 | 20.729 | 1.00 | 34.02 | C |
| ATOM | 255 | CG1 | ILE | A | 34 | −5.301 | −18.380 | 21.315 | 1.00 | 40.10 | C |
| ATOM | 256 | CG2 | ILE | A | 34 | −6.981 | −18.048 | 19.581 | 1.00 | 33.89 | C |
| ATOM | 257 | CD1 | ILE | A | 34 | −4.555 | −19.327 | 22.160 | 1.00 | 37.52 | C |
| ATOM | 258 | N | ASN | A | 35 | −9.743 | −17.774 | 21.381 | 1.00 | 23.45 | N |
| ATOM | 259 | CA | ASN | A | 35 | −11.044 | −17.502 | 20.786 | 1.00 | 28.14 | C |
| ATOM | 260 | C | ASN | A | 35 | −10.911 | −16.447 | 19.693 | 1.00 | 30.81 | C |
| ATOM | 261 | O | ASN | A | 35 | −10.013 | −15.607 | 19.733 | 1.00 | 33.76 | O |
| ATOM | 262 | CB | ASN | A | 35 | −12.045 | −17.023 | 21.849 | 1.00 | 30.44 | C |
| ATOM | 263 | CG | ASN | A | 35 | −12.218 | −18.015 | 22.989 | 1.00 | 30.22 | C |
| ATOM | 264 | OD1 | ASN | A | 35 | −13.183 | −18.779 | 23.018 | 1.00 | 29.29 | O |
| ATOM | 265 | ND2 | ASN | A | 35 | −11.293 | −17.995 | 23.943 | 1.00 | 26.20 | N |
| ATOM | 266 | N | TRP | A | 36 | −11.802 | −16.482 | 18.715 | 1.00 | 28.47 | N |
| ATOM | 267 | CA | TRP | A | 36 | −11.807 | −15.447 | 17.697 | 1.00 | 32.59 | C |
| ATOM | 268 | C | TRP | A | 36 | −13.139 | −14.720 | 17.718 | 1.00 | 32.65 | C |
| ATOM | 269 | O | TRP | A | 36 | −14.202 | −15.337 | 17.703 | 1.00 | 30.35 | O |
| ATOM | 270 | CB | TRP | A | 36 | −11.509 | −16.038 | 16.318 | 1.00 | 30.51 | C |
| ATOM | 271 | CG | TRP | A | 36 | −10.106 | −16.553 | 16.242 | 1.00 | 27.75 | C |
| ATOM | 272 | CD1 | TRP | A | 36 | −9.665 | −17.781 | 16.637 | 1.00 | 28.80 | C |
| ATOM | 273 | CD2 | TRP | A | 36 | −8.951 | −15.840 | 15.779 | 1.00 | 33.27 | C |
| ATOM | 274 | CE2 | TRP | A | 36 | −7.847 | −16.707 | 15.906 | 1.00 | 31.39 | C |
| ATOM | 275 | CE3 | TRP | A | 36 | −8.745 | −14.557 | 15.260 | 1.00 | 31.98 | C |
| ATOM | 276 | NE1 | TRP | A | 36 | −8.309 | −17.884 | 16.434 | 1.00 | 36.72 | N |
| ATOM | 277 | CZ2 | TRP | A | 36 | −6.554 | −16.334 | 15.535 | 1.00 | 38.10 | C |
| ATOM | 278 | CZ3 | TRP | A | 36 | −7.457 | −14.186 | 14.890 | 1.00 | 30.43 | C |
| ATOM | 279 | CH2 | TRP | A | 36 | −6.380 | −15.071 | 15.030 | 1.00 | 33.42 | C |
| ATOM | 280 | N | VAL | A | 37 | −13.053 | −13.397 | 17.790 | 1.00 | 27.11 | N |
| ATOM | 281 | CA | VAL | A | 37 | −14.207 | −12.528 | 17.936 | 1.00 | 30.57 | C |
| ATOM | 282 | C | VAL | A | 37 | −14.076 | −11.410 | 16.914 | 1.00 | 33.89 | C |
| ATOM | 283 | O | VAL | A | 37 | −13.032 | −10.759 | 16.846 | 1.00 | 33.58 | O |
| ATOM | 284 | CB | VAL | A | 37 | −14.301 | −11.929 | 19.370 | 1.00 | 25.89 | C |
| ATOM | 285 | CG1 | VAL | A | 37 | −15.467 | −10.957 | 19.478 | 1.00 | 27.13 | C |
| ATOM | 286 | CG2 | VAL | A | 37 | −14.423 | −13.031 | 20.417 | 1.00 | 26.86 | C |
| ATOM | 287 | N | ARG | A | 38 | −15.116 | −11.188 | 16.115 | 1.00 | 29.31 | N |
| ATOM | 288 | CA | ARG | A | 38 | −15.054 | −10.150 | 15.088 | 1.00 | 28.87 | C |
| ATOM | 289 | C | ARG | A | 38 | −16.002 | −8.995 | 15.395 | 1.00 | 32.02 | C |
| ATOM | 290 | O | ARG | A | 38 | −17.005 | −9.163 | 16.089 | 1.00 | 30.64 | O |
| ATOM | 291 | CB | ARG | A | 38 | −15.367 | −10.732 | 13.708 | 1.00 | 35.52 | C |
| ATOM | 292 | CG | ARG | A | 38 | −16.652 | −11.529 | 13.656 | 1.00 | 39.93 | C |
| ATOM | 293 | CD | ARG | A | 38 | −17.550 | −11.096 | 12.506 | 1.00 | 43.60 | C |

TABLE 10.2-continued

| | | | | | | | | | | | |
|---|---|---|---|---|---|---|---|---|---|---|---|
| ATOM | 294 | NE | ARG | A | 38 | −17.164 | −11.681 | 11.229 | 1.00 | 44.71 | N |
| ATOM | 295 | CZ | ARG | A | 38 | −18.023 | −12.119 | 10.311 | 1.00 | 45.96 | C |
| ATOM | 296 | NH1 | ARG | A | 38 | −19.329 | −12.055 | 10.529 | 1.00 | 39.60 | N |
| ATOM | 297 | NH2 | ARG | A | 38 | −17.572 | −12.626 | 9.170 | 1.00 | 33.94 | N |
| ATOM | 298 | N | GLN | A | 39 | −15.669 | −7.821 | 14.871 | 1.00 | 30.63 | N |
| ATOM | 299 | CA | GLN | A | 39 | −16.452 | −6.618 | 15.103 | 1.00 | 28.53 | C |
| ATOM | 300 | C | GLN | A | 39 | −16.568 | −5.795 | 13.825 | 1.00 | 31.84 | C |
| ATOM | 301 | O | GLN | A | 39 | −15.569 | −5.314 | 13.294 | 1.00 | 29.51 | O |
| ATOM | 302 | CB | GLN | A | 39 | −15.819 | −5.775 | 16.219 | 1.00 | 30.14 | C |
| ATOM | 303 | CG | GLN | A | 39 | −16.516 | −4.444 | 16.478 | 1.00 | 28.25 | C |
| ATOM | 304 | CD | GLN | A | 39 | −16.024 | −3.781 | 17.751 | 1.00 | 39.30 | C |
| ATOM | 305 | NE2 | GLN | A | 39 | −16.896 | −3.689 | 18.751 | 1.00 | 30.37 | N |
| ATOM | 306 | OE1 | GLN | A | 39 | −14.870 | −3.368 | 17.839 | 1.00 | 39.08 | O |
| ATOM | 307 | N | ALA | A | 40 | −17.788 | −5.637 | 13.330 | 1.00 | 37.04 | N |
| ATOM | 308 | CA | ALA | A | 40 | −18.016 | −4.815 | 12.149 | 1.00 | 44.35 | C |
| ATOM | 309 | C | ALA | A | 40 | −18.259 | −3.363 | 12.548 | 1.00 | 49.15 | C |
| ATOM | 310 | O | ALA | A | 40 | −18.880 | −3.094 | 13.579 | 1.00 | 49.51 | O |
| ATOM | 311 | CB | ALA | A | 40 | −19.190 | −5.352 | 11.341 | 1.00 | 36.53 | C |
| ATOM | 312 | N | THR | A | 41 | −17.768 | −2.444 | 11.715 | 1.00 | 55.43 | N |
| ATOM | 313 | CA | THR | A | 41 | −17.923 | −0.987 | 11.865 | 1.00 | 45.13 | C |
| ATOM | 314 | C | THR | A | 41 | −17.917 | −0.449 | 13.304 | 1.00 | 61.05 | C |
| ATOM | 315 | O | THR | A | 41 | −18.779 | 0.345 | 13.688 | 1.00 | 60.70 | O |
| ATOM | 316 | CB | THR | A | 41 | −19.224 | −0.480 | 11.157 | 1.00 | 56.54 | C |
| ATOM | 317 | OG1 | THR | A | 41 | −19.398 | 0.918 | 11.416 | 1.00 | 74.65 | O |
| ATOM | 318 | CG2 | THR | A | 41 | −20.475 | −1.233 | 11.611 | 1.00 | 50.35 | C |
| ATOM | 319 | N | GLY | A | 42 | −16.931 | −0.880 | 14.088 | 1.00 | 60.31 | N |
| ATOM | 320 | CA | GLY | A | 42 | −16.677 | −0.311 | 15.402 | 1.00 | 50.20 | C |
| ATOM | 321 | C | GLY | A | 42 | −17.674 | −0.603 | 16.515 | 1.00 | 58.90 | C |
| ATOM | 322 | O | GLY | A | 42 | −17.496 | −0.125 | 17.638 | 1.00 | 64.22 | O |
| ATOM | 323 | N | GLN | A | 43 | −18.718 | −1.377 | 16.225 | 1.00 | 61.17 | N |
| ATOM | 324 | CA | GLN | A | 43 | −19.700 | −1.716 | 17.255 | 1.00 | 58.73 | C |
| ATOM | 325 | C | GLN | A | 43 | −20.368 | −3.072 | 17.007 | 1.00 | 47.27 | C |
| ATOM | 326 | O | GLN | A | 43 | −20.811 | −3.369 | 15.897 | 1.00 | 54.96 | O |
| ATOM | 327 | CB | GLN | A | 43 | −20.761 | −0.613 | 17.362 | 1.00 | 57.68 | C |
| ATOM | 328 | CG | GLN | A | 43 | −21.613 | −0.690 | 18.627 | 1.00 | 55.99 | C |
| ATOM | 329 | CD | GLN | A | 43 | −22.130 | 0.669 | 19.075 | 1.00 | 60.55 | C |
| ATOM | 330 | NE2 | GLN | A | 43 | −21.668 | 1.727 | 18.416 | 1.00 | 61.26 | N |
| ATOM | 331 | OE1 | GLN | A | 43 | −22.929 | 0.765 | 20.007 | 1.00 | 62.03 | O |
| ATOM | 332 | N | GLY | A | 44 | −20.438 | −3.885 | 18.059 | 1.00 | 52.11 | N |
| ATOM | 333 | CA | GLY | A | 44 | −21.017 | −5.215 | 17.978 | 1.00 | 38.87 | C |
| ATOM | 334 | C | GLY | A | 44 | −19.946 | −6.290 | 17.933 | 1.00 | 40.89 | C |
| ATOM | 335 | O | GLY | A | 44 | −19.033 | −6.225 | 17.115 | 1.00 | 48.89 | O |
| ATOM | 336 | N | LEU | A | 45 | −20.051 | −7.281 | 18.811 | 1.00 | 28.02 | N |
| ATOM | 337 | CA | LEU | A | 45 | −19.065 | −8.355 | 18.862 | 1.00 | 32.48 | C |
| ATOM | 338 | C | LEU | A | 45 | −19.726 | −9.703 | 18.639 | 1.00 | 29.29 | C |
| ATOM | 339 | O | LEU | A | 45 | −20.768 | −9.993 | 19.226 | 1.00 | 35.37 | O |
| ATOM | 340 | CB | LEU | A | 45 | −18.331 | −8.345 | 20.209 | 1.00 | 30.66 | C |
| ATOM | 341 | CG | LEU | A | 45 | −17.553 | −7.072 | 20.561 | 1.00 | 31.07 | C |
| ATOM | 342 | CD1 | LEU | A | 45 | −17.379 | −6.937 | 22.068 | 1.00 | 32.58 | C |
| ATOM | 343 | CD2 | LEU | A | 45 | −16.198 | −7.075 | 19.873 | 1.00 | 29.40 | C |
| ATOM | 344 | N | GLU | A | 46 | −19.140 | −10.533 | 17.785 | 1.00 | 29.17 | N |
| ATOM | 345 | CA | GLU | A | 46 | −19.639 | −11.895 | 17.673 | 1.00 | 35.62 | C |
| ATOM | 346 | C | GLU | A | 46 | −18.513 | −12.920 | 17.699 | 1.00 | 35.22 | C |
| ATOM | 347 | O | GLU | A | 46 | −17.496 | −12.798 | 17.009 | 1.00 | 32.17 | O |
| ATOM | 348 | CB | GLU | A | 46 | −20.511 | −12.072 | 16.421 | 1.00 | 37.90 | C |
| ATOM | 349 | CG | GLU | A | 46 | −19.828 | −11.914 | 15.092 | 1.00 | 47.11 | C |
| ATOM | 350 | CD | GLU | A | 46 | −20.765 | −12.211 | 13.925 | 1.00 | 55.52 | C |
| ATOM | 351 | OE1 | GLU | A | 46 | −21.675 | −13.052 | 14.087 | 1.00 | 54.51 | O |
| ATOM | 352 | OE2 | GLU | A | 46 | −20.601 | −11.595 | 12.850 | 1.00 | 58.10 | O |
| ATOM | 353 | N | TRP | A | 47 | −18.732 | −13.926 | 18.536 | 1.00 | 32.28 | N |
| ATOM | 354 | CA | TRP | A | 47 | −17.800 | −15.012 | 18.788 | 1.00 | 36.07 | C |
| ATOM | 355 | C | TRP | A | 47 | −17.838 | −16.016 | 17.641 | 1.00 | 34.08 | C |
| ATOM | 356 | O | TRP | A | 47 | −18.910 | −16.392 | 17.169 | 1.00 | 29.79 | O |
| ATOM | 357 | CB | TRP | A | 47 | −18.166 | −15.664 | 20.121 | 1.00 | 25.80 | C |
| ATOM | 358 | CG | TRP | A | 47 | −17.311 | −16.791 | 20.594 | 1.00 | 33.81 | C |
| ATOM | 359 | CD1 | TRP | A | 47 | −16.096 | −16.703 | 21.210 | 1.00 | 32.06 | C |
| ATOM | 360 | CD2 | TRP | A | 47 | −17.644 | −18.182 | 20.562 | 1.00 | 33.38 | C |
| ATOM | 361 | CE2 | TRP | A | 47 | −16.572 | −18.882 | 21.149 | 1.00 | 34.18 | C |
| ATOM | 362 | CE3 | TRP | A | 47 | −18.740 | −18.904 | 20.079 | 1.00 | 35.50 | C |
| ATOM | 363 | NE1 | TRP | A | 47 | −15.638 | −17.957 | 21.536 | 1.00 | 29.56 | N |
| ATOM | 364 | CZ2 | TRP | A | 47 | −16.565 | −20.271 | 21.268 | 1.00 | 31.56 | C |
| ATOM | 365 | CZ3 | TRP | A | 47 | −18.729 | −20.282 | 20.196 | 1.00 | 42.35 | C |
| ATOM | 366 | CH2 | TRP | A | 47 | −17.647 | −20.950 | 20.787 | 1.00 | 34.97 | C |
| ATOM | 367 | N | MET | A | 48 | −16.668 | −16.437 | 17.179 | 1.00 | 32.09 | N |
| ATOM | 368 | CA | MET | A | 48 | −16.596 | −17.326 | 16.028 | 1.00 | 30.89 | C |
| ATOM | 369 | C | MET | A | 48 | −16.261 | −18.755 | 16.429 | 1.00 | 29.94 | C |
| ATOM | 370 | O | MET | A | 48 | −16.653 | −19.705 | 15.757 | 1.00 | 33.43 | O |
| ATOM | 371 | CB | MET | A | 48 | −15.558 | −16.823 | 15.028 | 1.00 | 28.48 | C |
| ATOM | 372 | CG | MET | A | 48 | −15.790 | −15.409 | 14.538 | 1.00 | 33.13 | C |
| ATOM | 373 | SD | MET | A | 48 | −14.488 | −14.924 | 13.396 | 1.00 | 37.93 | S |

TABLE 10.2-continued

| ATOM | 374 | CE | MET | A | 48 | −14.665 | −16.165 | 12.119 | 1.00 | 39.94 | C |
|---|---|---|---|---|---|---|---|---|---|---|---|
| ATOM | 375 | N | GLY | A | 49 | −15.511 | −18.908 | 17.511 | 1.00 | 33.42 | N |
| ATOM | 376 | CA | GLY | A | 49 | −15.128 | −20.234 | 17.955 | 1.00 | 33.05 | C |
| ATOM | 377 | C | GLY | A | 49 | −13.878 | −20.244 | 18.806 | 1.00 | 34.29 | C |
| ATOM | 378 | O | GLY | A | 49 | −13.256 | −19.202 | 19.031 | 1.00 | 34.24 | O |
| ATOM | 379 | N | TRP | A | 50 | −13.509 | −21.429 | 19.279 | 1.00 | 30.14 | N |
| ATOM | 380 | CA | TRP | A | 50 | −12.368 | −21.562 | 20.176 | 1.00 | 27.60 | C |
| ATOM | 381 | C | TRP | A | 50 | −11.393 | −22.619 | 19.679 | 1.00 | 36.00 | C |
| ATOM | 382 | O | TRP | A | 50 | −11.758 | −23.513 | 18.915 | 1.00 | 26.22 | O |
| ATOM | 383 | CB | TRP | A | 50 | −12.833 | −21.906 | 21.595 | 1.00 | 27.32 | C |
| ATOM | 384 | CG | TRP | A | 50 | −13.525 | −23.240 | 21.714 | 1.00 | 31.33 | C |
| ATOM | 385 | CD1 | TRP | A | 50 | −14.867 | −23.479 | 21.627 | 1.00 | 31.09 | C |
| ATOM | 386 | CD2 | TRP | A | 50 | −12.907 | −24.513 | 21.952 | 1.00 | 32.23 | C |
| ATOM | 387 | CE2 | TRP | A | 50 | −13.936 | −25.476 | 21.994 | 1.00 | 36.04 | C |
| ATOM | 388 | CE3 | TRP | A | 50 | −11.583 | −24.932 | 22.133 | 1.00 | 35.42 | C |
| ATOM | 389 | NE1 | TRP | A | 50 | −15.122 | −24.819 | 21.791 | 1.00 | 30.64 | N |
| ATOM | 390 | CZ2 | TRP | A | 50 | −13.684 | −26.834 | 22.208 | 1.00 | 34.17 | C |
| ATOM | 391 | CZ3 | TRP | A | 50 | −11.334 | −26.282 | 22.347 | 1.00 | 33.78 | C |
| ATOM | 392 | CH2 | TRP | A | 50 | −12.379 | −27.215 | 22.381 | 1.00 | 34.68 | C |
| ATOM | 393 | N | MET | A | 51 | −10.147 | −22.507 | 20.120 | 1.00 | 29.16 | N |
| ATOM | 394 | CA | MET | A | 51 | −9.148 | −23.507 | 19.807 | 1.00 | 28.07 | C |
| ATOM | 395 | C | MET | A | 51 | −8.191 | −23.679 | 20.975 | 1.00 | 31.55 | C |
| ATOM | 396 | O | MET | A | 51 | −7.728 | −22.696 | 21.553 | 1.00 | 33.21 | O |
| ATOM | 397 | CB | MET | A | 51 | −8.374 | −23.130 | 18.549 | 1.00 | 31.45 | C |
| ATOM | 398 | CG | MET | A | 51 | −7.420 | −24.221 | 18.093 | 1.00 | 37.56 | C |
| ATOM | 399 | SD | MET | A | 51 | −5.818 | −23.586 | 17.594 | 1.00 | 57.24 | S |
| ATOM | 400 | CE | MET | A | 51 | −5.222 | −22.920 | 19.142 | 1.00 | 46.36 | C |
| ATOM | 401 | N | HIS | A | 52 | −7.902 | −24.935 | 21.305 | 1.00 | 27.88 | N |
| ATOM | 402 | CA | HIS | A | 52 | −6.991 | −25.294 | 22.391 | 1.00 | 35.15 | C |
| ATOM | 403 | C | HIS | A | 52 | −5.615 | −25.621 | 21.816 | 1.00 | 35.88 | C |
| ATOM | 404 | O | HIS | A | 52 | −5.449 | −26.650 | 21.169 | 1.00 | 39.53 | O |
| ATOM | 405 | CB | HIS | A | 52 | −7.557 | −26.491 | 23.173 | 1.00 | 31.19 | C |
| ATOM | 406 | CG | HIS | A | 52 | −6.737 | −26.899 | 24.362 | 1.00 | 32.88 | C |
| ATOM | 407 | CD2 | HIS | A | 52 | −6.353 | −26.213 | 25.462 | 1.00 | 35.83 | C |
| ATOM | 408 | ND1 | HIS | A | 52 | −6.248 | −28.180 | 24.520 | 1.00 | 33.47 | N |
| ATOM | 409 | CE1 | HIS | A | 52 | −5.585 | −28.258 | 25.660 | 1.00 | 32.93 | C |
| ATOM | 410 | NE2 | HIS | A | 52 | −5.631 | −27.080 | 26.252 | 1.00 | 33.96 | N |
| ATOM | 411 | N | PRO | A | 53 | −4.629 | −24.737 | 22.035 | 1.00 | 36.74 | N |
| ATOM | 412 | CA | PRO | A | 53 | −3.284 | −24.901 | 21.465 | 1.00 | 41.48 | C |
| ATOM | 413 | C | PRO | A | 53 | −2.619 | −26.232 | 21.802 | 1.00 | 43.82 | C |
| ATOM | 414 | O | PRO | A | 53 | −1.959 | −26.811 | 20.941 | 1.00 | 42.27 | O |
| ATOM | 415 | CB | PRO | A | 53 | −2.497 | −23.744 | 22.088 | 1.00 | 37.52 | C |
| ATOM | 416 | CG | PRO | A | 53 | −3.521 | −22.710 | 22.372 | 1.00 | 42.21 | C |
| ATOM | 417 | CD | PRO | A | 53 | −4.768 | −23.456 | 22.751 | 1.00 | 37.85 | C |
| ATOM | 418 | N | ASN | A | 54 | −2.795 | −26.709 | 23.029 | 1.00 | 40.74 | N |
| ATOM | 419 | CA | ASN | A | 54 | −2.088 | −27.903 | 23.482 | 1.00 | 40.42 | C |
| ATOM | 420 | C | ASN | A | 54 | −2.575 | −29.192 | 22.814 | 1.00 | 44.96 | C |
| ATOM | 421 | O | ASN | A | 54 | −1.848 | −30.184 | 22.781 | 1.00 | 53.00 | O |
| ATOM | 422 | CB | ASN | A | 54 | −2.201 | −28.035 | 25.003 | 1.00 | 41.59 | C |
| ATOM | 423 | CG | ASN | A | 54 | −0.988 | −28.704 | 25.620 | 1.00 | 48.60 | C |
| ATOM | 424 | ND2 | ASN | A | 54 | −1.220 | −29.565 | 26.607 | 1.00 | 49.53 | N |
| ATOM | 425 | OD1 | ASN | A | 54 | 0.146 | −28.456 | 25.208 | 1.00 | 54.90 | O |
| ATOM | 426 | N | SER | A | 55 | −3.792 | −29.179 | 22.276 | 1.00 | 41.51 | N |
| ATOM | 427 | CA | SER | A | 55 | −4.354 | −30.372 | 21.641 | 1.00 | 39.42 | C |
| ATOM | 428 | C | SER | A | 55 | −4.800 | −30.137 | 20.196 | 1.00 | 45.89 | C |
| ATOM | 429 | O | SER | A | 55 | −4.958 | −31.083 | 19.428 | 1.00 | 45.29 | O |
| ATOM | 430 | CB | SER | A | 55 | −5.544 | −30.886 | 22.444 | 1.00 | 40.90 | C |
| ATOM | 431 | OG | SER | A | 55 | −6.661 | −30.030 | 22.269 | 1.00 | 41.20 | O |
| ATOM | 432 | N | GLY | A | 56 | −5.020 | −28.878 | 19.831 | 1.00 | 39.03 | N |
| ATOM | 433 | CA | GLY | A | 56 | −5.491 | −28.550 | 18.497 | 1.00 | 34.31 | C |
| ATOM | 434 | C | GLY | A | 56 | −6.992 | −28.707 | 18.348 | 1.00 | 33.47 | C |
| ATOM | 435 | O | GLY | A | 56 | −7.551 | −28.402 | 17.298 | 1.00 | 35.63 | O |
| ATOM | 436 | N | ASN | A | 57 | −7.649 | −29.185 | 19.401 | 1.00 | 32.07 | N |
| ATOM | 437 | CA | ASN | A | 57 | −9.099 | −29.323 | 19.384 | 1.00 | 35.35 | C |
| ATOM | 438 | C | ASN | A | 57 | −9.792 | −27.972 | 19.257 | 1.00 | 35.99 | C |
| ATOM | 439 | O | ASN | A | 57 | −9.298 | −26.956 | 19.753 | 1.00 | 31.96 | O |
| ATOM | 440 | CB | ASN | A | 57 | −9.585 | −30.042 | 20.638 | 1.00 | 36.70 | C |
| ATOM | 441 | CG | ASN | A | 57 | −9.149 | −31.490 | 20.679 | 1.00 | 51.73 | C |
| ATOM | 442 | OD1 | ASN | A | 57 | −8.193 | −31.882 | 20.005 | 1.00 | 51.72 | O |
| ATOM | 443 | ND2 | ASN | A | 57 | −9.851 | −32.297 | 21.467 | 1.00 | 40.02 | N |
| ATOM | 444 | N | THR | A | 58 | −10.938 | −27.966 | 18.585 | 1.00 | 32.70 | N |
| ATOM | 445 | CA | THR | A | 58 | −11.657 | −26.728 | 18.315 | 1.00 | 34.35 | C |
| ATOM | 446 | C | THR | A | 58 | −13.149 | −26.874 | 18.543 | 1.00 | 36.07 | C |
| ATOM | 447 | O | THR | A | 58 | −13.664 | −27.985 | 18.682 | 1.00 | 35.59 | O |
| ATOM | 448 | CB | THR | A | 58 | −11.463 | −26.251 | 16.859 | 1.00 | 35.50 | C |
| ATOM | 449 | CG2 | THR | A | 58 | −9.986 | −26.209 | 16.474 | 1.00 | 29.82 | C |
| ATOM | 450 | OG1 | THR | A | 58 | −12.167 | −27.132 | 15.976 | 1.00 | 34.89 | O |
| ATOM | 451 | N | GLY | A | 59 | −13.833 | −25.735 | 18.563 | 1.00 | 34.36 | N |
| ATOM | 452 | CA | GLY | A | 59 | −15.283 | −25.682 | 18.542 | 1.00 | 31.26 | C |
| ATOM | 453 | C | GLY | A | 59 | −15.712 | −24.404 | 17.843 | 1.00 | 36.02 | C |

TABLE 10.2-continued

| | | | | | | | | | | |
|---|---|---|---|---|---|---|---|---|---|---|
| ATOM | 454 | O | GLY | A | 59 | −15.268 | −23.319 | 18.214 | 1.00 | 34.77 | O |
| ATOM | 455 | N | TYR | A | 60 | −16.561 | −24.528 | 16.826 | 1.00 | 38.85 | N |
| ATOM | 456 | CA | TYR | A | 60 | −17.004 | −23.374 | 16.045 | 1.00 | 36.79 | C |
| ATOM | 457 | C | TYR | A | 60 | −18.467 | −23.041 | 16.310 | 1.00 | 43.76 | C |
| ATOM | 458 | O | TYR | A | 60 | −19.269 | −23.933 | 16.581 | 1.00 | 40.31 | O |
| ATOM | 459 | CB | TYR | A | 60 | −16.818 | −23.630 | 14.546 | 1.00 | 40.99 | C |
| ATOM | 460 | CG | TYR | A | 60 | −15.446 | −24.123 | 14.157 | 1.00 | 40.11 | C |
| ATOM | 461 | CD1 | TYR | A | 60 | −14.305 | −23.583 | 14.729 | 1.00 | 37.87 | C |
| ATOM | 462 | CD2 | TYR | A | 60 | −15.292 | −25.132 | 13.213 | 1.00 | 40.09 | C |
| ATOM | 463 | CE1 | TYR | A | 60 | −13.050 | −24.031 | 14.374 | 1.00 | 39.91 | C |
| ATOM | 464 | CE2 | TYR | A | 60 | −14.037 | −25.587 | 12.851 | 1.00 | 40.87 | C |
| ATOM | 465 | CZ | TYR | A | 60 | −12.920 | −25.030 | 13.436 | 1.00 | 42.40 | C |
| ATOM | 466 | OH | TYR | A | 60 | −11.666 | −25.467 | 13.091 | 1.00 | 41.60 | O |
| ATOM | 467 | N | ALA | A | 61 | −18.816 | −21.760 | 16.223 | 1.00 | 32.46 | N |
| ATOM | 468 | CA | ALA | A | 61 | −20.219 | −21.370 | 16.223 | 1.00 | 39.25 | C |
| ATOM | 469 | C | ALA | A | 61 | −20.873 | −21.880 | 14.940 | 1.00 | 40.91 | C |
| ATOM | 470 | O | ALA | A | 61 | −20.228 | −21.916 | 13.891 | 1.00 | 43.24 | O |
| ATOM | 471 | CB | ALA | A | 61 | −20.363 | −19.856 | 16.343 | 1.00 | 34.62 | C |
| ATOM | 472 | N | GLN | A | 62 | −22.140 | −22.280 | 15.030 | 1.00 | 45.76 | N |
| ATOM | 473 | CA | GLN | A | 62 | −22.878 | −22.825 | 13.887 | 1.00 | 53.88 | C |
| ATOM | 474 | C | GLN | A | 62 | −22.795 | −21.937 | 12.646 | 1.00 | 47.20 | C |
| ATOM | 475 | O | GLN | A | 62 | −22.716 | −22.431 | 11.522 | 1.00 | 48.71 | O |
| ATOM | 476 | CB | GLN | A | 62 | −24.349 | −23.042 | 14.258 | 1.00 | 52.36 | C |
| ATOM | 477 | CG | GLN | A | 62 | −24.596 | −24.209 | 15.206 | 1.00 | 79.57 | C |
| ATOM | 478 | CD | GLN | A | 62 | −24.422 | −25.562 | 14.534 | 1.00 | 86.89 | C |
| ATOM | 479 | NE2 | GLN | A | 62 | −24.222 | −26.603 | 15.339 | 1.00 | 75.39 | N |
| ATOM | 480 | OE1 | GLN | A | 62 | −24.468 | −25.670 | 13.306 | 1.00 | 81.01 | O |
| ATOM | 481 | N | LYS | A | 63 | −22.804 | −20.626 | 12.865 | 1.00 | 48.15 | N |
| ATOM | 482 | CA | LYS | A | 63 | −22.788 | −19.644 | 11.787 | 1.00 | 42.61 | C |
| ATOM | 483 | C | LYS | A | 63 | −21.524 | −19.723 | 10.919 | 1.00 | 43.90 | C |
| ATOM | 484 | O | LYS | A | 63 | −21.540 | −19.325 | 9.756 | 1.00 | 41.77 | O |
| ATOM | 485 | CB | LYS | A | 63 | −22.936 | −18.235 | 12.377 | 1.00 | 45.82 | C |
| ATOM | 486 | CG | LYS | A | 63 | −23.079 | −17.120 | 11.353 | 1.00 | 50.01 | C |
| ATOM | 487 | CD | LYS | A | 63 | −23.154 | −15.753 | 12.024 | 1.00 | 52.82 | C |
| ATOM | 488 | CE | LYS | A | 63 | −23.046 | −14.631 | 10.996 | 1.00 | 50.15 | C |
| ATOM | 489 | NZ | LYS | A | 63 | −23.127 | −13.283 | 11.624 | 1.00 | 61.30 | N |
| ATOM | 490 | N | PHE | A | 64 | −20.435 | −20.246 | 11.478 | 1.00 | 41.78 | N |
| ATOM | 491 | CA | PHE | A | 64 | −19.156 | −20.267 | 10.768 | 1.00 | 39.68 | C |
| ATOM | 492 | C | PHE | A | 64 | −18.656 | −21.675 | 10.456 | 1.00 | 44.13 | C |
| ATOM | 493 | O | PHE | A | 64 | −17.611 | −21.836 | 9.821 | 1.00 | 46.68 | O |
| ATOM | 494 | CB | PHE | A | 64 | −18.094 | −19.513 | 11.574 | 1.00 | 35.08 | C |
| ATOM | 495 | CG | PHE | A | 64 | −18.454 | −18.086 | 11.848 | 1.00 | 41.60 | C |
| ATOM | 496 | CD1 | PHE | A | 64 | −18.254 | −17.109 | 10.885 | 1.00 | 42.81 | C |
| ATOM | 497 | CD2 | PHE | A | 64 | −19.008 | −17.720 | 13.062 | 1.00 | 34.34 | C |
| ATOM | 498 | CE1 | PHE | A | 64 | −18.593 | −15.790 | 11.135 | 1.00 | 34.56 | C |
| ATOM | 499 | CE2 | PHE | A | 64 | −19.350 | −16.405 | 13.313 | 1.00 | 40.22 | C |
| ATOM | 500 | CZ | PHE | A | 64 | −19.142 | −15.441 | 12.348 | 1.00 | 32.48 | C |
| ATOM | 501 | N | GLN | A | 65 | −19.389 | −22.689 | 10.907 | 1.00 | 49.73 | N |
| ATOM | 502 | CA | GLN | A | 65 | −19.066 | −24.069 | 10.552 | 1.00 | 46.28 | C |
| ATOM | 503 | C | GLN | A | 65 | −19.116 | −24.231 | 9.040 | 1.00 | 44.61 | C |
| ATOM | 504 | O | GLN | A | 65 | −20.120 | −23.905 | 8.408 | 1.00 | 45.36 | O |
| ATOM | 505 | CB | GLN | A | 65 | −20.024 | −25.051 | 11.229 | 1.00 | 47.60 | C |
| ATOM | 506 | CG | GLN | A | 65 | −19.573 | −25.483 | 12.619 | 1.00 | 59.40 | C |
| ATOM | 507 | CD | GLN | A | 65 | −20.692 | −26.096 | 13.442 | 1.00 | 69.19 | C |
| ATOM | 508 | NE2 | GLN | A | 65 | −20.460 | −26.234 | 14.745 | 1.00 | 55.87 | N |
| ATOM | 509 | OE1 | GLN | A | 65 | −21.754 | −26.434 | 12.916 | 1.00 | 71.81 | O |
| ATOM | 510 | N | GLY | A | 66 | −18.019 | −24.711 | 8.464 | 1.00 | 39.34 | N |
| ATOM | 511 | CA | GLY | A | 66 | −17.919 | −24.856 | 7.026 | 1.00 | 46.10 | C |
| ATOM | 512 | C | GLY | A | 66 | −17.130 | −23.748 | 6.349 | 1.00 | 56.88 | C |
| ATOM | 513 | O | GLY | A | 66 | −16.677 | −23.912 | 5.214 | 1.00 | 58.19 | O |
| ATOM | 514 | N | ARG | A | 67 | −16.966 | −22.617 | 7.031 | 1.00 | 44.44 | N |
| ATOM | 515 | CA | ARG | A | 67 | −16.192 | −21.511 | 6.470 | 1.00 | 43.73 | C |
| ATOM | 516 | C | ARG | A | 67 | −14.935 | −21.213 | 7.280 | 1.00 | 45.38 | C |
| ATOM | 517 | O | ARG | A | 67 | −13.937 | −20.745 | 6.732 | 1.00 | 45.99 | O |
| ATOM | 518 | CB | ARG | A | 67 | −17.045 | −20.244 | 6.368 | 1.00 | 47.99 | C |
| ATOM | 519 | CG | ARG | A | 67 | −18.207 | −20.359 | 5.406 | 1.00 | 47.03 | C |
| ATOM | 520 | CD | ARG | A | 67 | −18.570 | −19.011 | 4.793 | 1.00 | 47.09 | C |
| ATOM | 521 | NE | ARG | A | 67 | −19.006 | −18.032 | 5.783 | 1.00 | 50.09 | N |
| ATOM | 522 | CZ | ARG | A | 67 | −18.526 | −16.794 | 5.866 | 1.00 | 49.71 | C |
| ATOM | 523 | NH1 | ARG | A | 67 | −17.590 | −16.383 | 5.020 | 1.00 | 46.73 | N |
| ATOM | 524 | NH2 | ARG | A | 67 | −18.983 | −15.964 | 6.794 | 1.00 | 47.52 | N |
| ATOM | 525 | N | VAL | A | 68 | −14.979 | −21.480 | 8.582 | 1.00 | 39.50 | N |
| ATOM | 526 | CA | VAL | A | 68 | −13.848 | −21.157 | 9.443 | 1.00 | 35.99 | C |
| ATOM | 527 | C | VAL | A | 68 | −12.994 | −22.390 | 9.737 | 1.00 | 39.26 | C |
| ATOM | 528 | O | VAL | A | 68 | −13.491 | −23.514 | 9.795 | 1.00 | 40.40 | O |
| ATOM | 529 | CB | VAL | A | 68 | −14.314 | −20.511 | 10.777 | 1.00 | 43.31 | C |
| ATOM | 530 | CG1 | VAL | A | 68 | −14.925 | −21.554 | 11.709 | 1.00 | 44.00 | C |
| ATOM | 531 | CG2 | VAL | A | 68 | −13.155 | −19.793 | 11.461 | 1.00 | 36.66 | C |
| ATOM | 532 | N | THR | A | 69 | −11.694 | −22.167 | 9.893 | 1.00 | 34.83 | N |
| ATOM | 533 | CA | THR | A | 69 | −10.772 | −23.220 | 10.282 | 1.00 | 37.94 | C |

TABLE 10.2-continued

| | | | | | | | | | | |
|---|---|---|---|---|---|---|---|---|---|---|
| ATOM | 534 | C | THR | A | 69 | −9.749 | −22.651 | 11.247 | 1.00 | 36.48 | C |
| ATOM | 535 | O | THR | A | 69 | −9.020 | −21.722 | 10.905 | 1.00 | 39.14 | O |
| ATOM | 536 | CB | THR | A | 69 | −10.049 | −23.833 | 9.069 | 1.00 | 38.15 | C |
| ATOM | 537 | CG2 | THR | A | 69 | −9.167 | −24.998 | 9.508 | 1.00 | 36.65 | C |
| ATOM | 538 | OG1 | THR | A | 69 | −11.015 | −24.297 | 8.120 | 1.00 | 40.71 | O |
| ATOM | 539 | N | LEU | A | 70 | −9.705 | −23.202 | 12.454 | 1.00 | 32.50 | N |
| ATOM | 540 | CA | LEU | A | 70 | −8.759 | −22.746 | 13.463 | 1.00 | 32.88 | C |
| ATOM | 541 | C | LEU | A | 70 | −7.647 | −23.769 | 13.633 | 1.00 | 41.47 | C |
| ATOM | 542 | O | LEU | A | 70 | −7.911 | −24.942 | 13.900 | 1.00 | 41.36 | O |
| ATOM | 543 | CB | LEU | A | 70 | −9.465 | −22.501 | 14.797 | 1.00 | 32.92 | C |
| ATOM | 544 | CG | LEU | A | 70 | −10.682 | −21.573 | 14.763 | 1.00 | 41.37 | C |
| ATOM | 545 | CD1 | LEU | A | 70 | −11.203 | −21.301 | 16.178 | 1.00 | 36.02 | C |
| ATOM | 546 | CD2 | LEU | A | 70 | −10.360 | −20.271 | 14.047 | 1.00 | 32.82 | C |
| ATOM | 547 | N | THR | A | 71 | −6.405 | −23.324 | 13.465 | 1.00 | 33.46 | N |
| ATOM | 548 | CA | THR | A | 71 | −5.250 | −24.204 | 13.587 | 1.00 | 35.36 | C |
| ATOM | 549 | C | THR | A | 71 | −4.166 | −23.523 | 14.409 | 1.00 | 39.68 | C |
| ATOM | 550 | O | THR | A | 71 | −4.299 | −22.357 | 14.775 | 1.00 | 38.29 | O |
| ATOM | 551 | CB | THR | A | 71 | −4.684 | −24.607 | 12.203 | 1.00 | 40.98 | C |
| ATOM | 552 | CG2 | THR | A | 71 | −5.679 | −25.475 | 11.451 | 1.00 | 37.98 | C |
| ATOM | 553 | OG1 | THR | A | 71 | −4.413 | −23.432 | 11.427 | 1.00 | 44.28 | O |
| ATOM | 554 | N | ARG | A | 72 | −3.097 | −24.250 | 14.713 | 1.00 | 41.13 | N |
| ATOM | 555 | CA | ARG | A | 72 | −1.996 | −23.659 | 15.460 | 1.00 | 41.98 | C |
| ATOM | 556 | C | ARG | A | 72 | −0.644 | −24.252 | 15.077 | 1.00 | 44.70 | C |
| ATOM | 557 | O | ARG | A | 72 | −0.566 | −25.292 | 14.429 | 1.00 | 41.56 | O |
| ATOM | 558 | CB | ARG | A | 72 | −2.231 | −23.811 | 16.970 | 1.00 | 44.74 | C |
| ATOM | 559 | CG | ARG | A | 72 | −2.599 | −25.216 | 17.439 | 1.00 | 46.36 | C |
| ATOM | 560 | CD | ARG | A | 72 | −1.366 | −26.056 | 17.691 | 1.00 | 52.55 | C |
| ATOM | 561 | NE | ARG | A | 72 | −1.653 | −27.299 | 18.401 | 1.00 | 45.44 | N |
| ATOM | 562 | CZ | ARG | A | 72 | −2.105 | −28.406 | 17.824 | 1.00 | 51.24 | C |
| ATOM | 563 | NH1 | ARG | A | 72 | −2.353 | −28.429 | 16.522 | 1.00 | 53.24 | N |
| ATOM | 564 | NH2 | ARG | A | 72 | −2.319 | −29.492 | 18.553 | 1.00 | 55.87 | N |
| ATOM | 565 | N | ASP | A | 73 | 0.413 | −23.563 | 15.488 | 1.00 | 44.00 | N |
| ATOM | 566 | CA | ASP | A | 73 | 1.779 | −24.033 | 15.331 | 1.00 | 45.95 | C |
| ATOM | 567 | C | ASP | A | 73 | 2.510 | −23.807 | 16.652 | 1.00 | 45.15 | C |
| ATOM | 568 | O | ASP | A | 73 | 3.010 | −22.710 | 16.916 | 1.00 | 46.41 | O |
| ATOM | 569 | CB | ASP | A | 73 | 2.473 | −23.305 | 14.175 | 1.00 | 52.61 | C |
| ATOM | 570 | CG | ASP | A | 73 | 3.922 | −23.728 | 13.995 | 1.00 | 58.41 | C |
| ATOM | 571 | OD1 | ASP | A | 73 | 4.345 | −24.730 | 14.609 | 1.00 | 57.08 | O |
| ATOM | 572 | OD2 | ASP | A | 73 | 4.639 | −23.059 | 13.220 | 1.00 | 60.43 | O |
| ATOM | 573 | N | THR | A | 74 | 2.560 | −24.847 | 17.480 | 1.00 | 46.17 | N |
| ATOM | 574 | CA | THR | A | 74 | 3.082 | −24.726 | 18.841 | 1.00 | 48.47 | C |
| ATOM | 575 | C | THR | A | 74 | 4.559 | −24.346 | 18.884 | 1.00 | 46.89 | C |
| ATOM | 576 | O | THR | A | 74 | 5.012 | −23.723 | 19.842 | 1.00 | 53.90 | O |
| ATOM | 577 | CB | THR | A | 74 | 2.888 | −26.035 | 19.636 | 1.00 | 54.20 | C |
| ATOM | 578 | CG2 | THR | A | 74 | 1.439 | −26.185 | 20.072 | 1.00 | 48.42 | C |
| ATOM | 579 | OG1 | THR | A | 74 | 3.250 | −27.155 | 18.817 | 1.00 | 60.06 | O |
| ATOM | 580 | N | SER | A | 75 | 5.303 | −24.710 | 17.845 | 1.00 | 51.70 | N |
| ATOM | 581 | CA | SER | A | 75 | 6.737 | −24.436 | 17.801 | 1.00 | 54.91 | C |
| ATOM | 582 | C | SER | A | 75 | 7.036 | −22.937 | 17.815 | 1.00 | 55.26 | C |
| ATOM | 583 | O | SER | A | 75 | 8.114 | −22.515 | 18.237 | 1.00 | 49.86 | O |
| ATOM | 584 | CB | SER | A | 75 | 7.365 | −25.088 | 16.568 | 1.00 | 55.81 | C |
| ATOM | 585 | OG | SER | A | 75 | 6.713 | −24.668 | 15.382 | 1.00 | 60.43 | O |
| ATOM | 586 | N | ILE | A | 76 | 6.077 | −22.136 | 17.359 | 1.00 | 52.63 | N |
| ATOM | 587 | CA | ILE | A | 76 | 6.224 | −20.684 | 17.386 | 1.00 | 47.56 | C |
| ATOM | 588 | C | ILE | A | 76 | 5.090 | −20.021 | 18.170 | 1.00 | 50.56 | C |
| ATOM | 589 | O | ILE | A | 76 | 4.920 | −18.802 | 18.109 | 1.00 | 52.59 | O |
| ATOM | 590 | CB | ILE | A | 76 | 6.271 | −20.093 | 15.962 | 1.00 | 50.46 | C |
| ATOM | 591 | CG1 | ILE | A | 76 | 5.040 | −20.521 | 15.163 | 1.00 | 47.49 | C |
| ATOM | 592 | CG2 | ILE | A | 76 | 7.536 | −20.531 | 15.248 | 1.00 | 46.69 | C |
| ATOM | 593 | CD1 | ILE | A | 76 | 4.922 | −19.840 | 13.817 | 1.00 | 48.75 | C |
| ATOM | 594 | N | SER | A | 77 | 4.324 | −20.834 | 18.896 | 1.00 | 49.81 | N |
| ATOM | 595 | CA | SER | A | 77 | 3.229 | −20.357 | 19.744 | 1.00 | 45.00 | C |
| ATOM | 596 | C | SER | A | 77 | 2.246 | −19.470 | 18.988 | 1.00 | 46.19 | C |
| ATOM | 597 | O | SER | A | 77 | 1.894 | −18.387 | 19.456 | 1.00 | 40.30 | O |
| ATOM | 598 | CB | SER | A | 77 | 3.781 | −19.591 | 20.951 | 1.00 | 43.85 | C |
| ATOM | 599 | OG | SER | A | 77 | 4.716 | −20.370 | 21.673 | 1.00 | 63.87 | O |
| ATOM | 600 | N | THR | A | 78 | 1.800 | −19.925 | 17.822 | 1.00 | 39.04 | N |
| ATOM | 601 | CA | THR | A | 78 | 0.956 | −19.090 | 16.979 | 1.00 | 37.69 | C |
| ATOM | 602 | C | THR | A | 78 | −0.337 | −19.788 | 16.575 | 1.00 | 37.97 | C |
| ATOM | 603 | O | THR | A | 78 | −0.325 | −20.930 | 16.115 | 1.00 | 39.48 | O |
| ATOM | 604 | CB | THR | A | 78 | 1.718 | −18.641 | 15.712 | 1.00 | 38.64 | C |
| ATOM | 605 | CG2 | THR | A | 78 | 0.810 | −17.840 | 14.787 | 1.00 | 38.64 | C |
| ATOM | 606 | OG1 | THR | A | 78 | 2.828 | −17.822 | 16.094 | 1.00 | 35.01 | O |
| ATOM | 607 | N | ALA | A | 79 | −1.454 | −19.093 | 16.765 | 1.00 | 33.81 | N |
| ATOM | 608 | CA | ALA | A | 79 | −2.756 | −19.592 | 16.336 | 1.00 | 34.16 | C |
| ATOM | 609 | C | ALA | A | 79 | −3.165 | −18.934 | 15.023 | 1.00 | 34.47 | C |
| ATOM | 610 | O | ALA | A | 79 | −2.748 | −17.815 | 14.720 | 1.00 | 33.95 | O |
| ATOM | 611 | CB | ALA | A | 79 | −3.805 | −19.340 | 17.403 | 1.00 | 24.34 | C |
| ATOM | 612 | N | TYR | A | 80 | −3.990 | −19.631 | 14.252 | 1.00 | 31.73 | N |
| ATOM | 613 | CA | TYR | A | 80 | −4.432 | −19.135 | 12.958 | 1.00 | 37.57 | C |

TABLE 10.2-continued

| | | | | | | | | | | |
|---|---|---|---|---|---|---|---|---|---|---|
| ATOM | 614 | C | TYR | A | 80 | −5.942 | −19.198 | 12.810 | 1.00 | 39.18 | C |
| ATOM | 615 | O | TYR | A | 80 | −6.598 | −20.132 | 13.278 | 1.00 | 37.02 | O |
| ATOM | 616 | CB | TYR | A | 80 | −3.786 | −19.929 | 11.819 | 1.00 | 36.79 | C |
| ATOM | 617 | CG | TYR | A | 80 | −2.281 | −19.862 | 11.797 | 1.00 | 40.36 | C |
| ATOM | 618 | CD1 | TYR | A | 80 | −1.621 | −18.821 | 11.158 | 1.00 | 37.20 | C |
| ATOM | 619 | CD2 | TYR | A | 80 | −1.517 | −20.847 | 12.413 | 1.00 | 38.74 | C |
| ATOM | 620 | CE1 | TYR | A | 80 | −0.238 | −18.761 | 11.135 | 1.00 | 37.53 | C |
| ATOM | 621 | CE2 | TYR | A | 80 | −0.140 | −20.797 | 12.395 | 1.00 | 37.97 | C |
| ATOM | 622 | CZ | TYR | A | 80 | 0.497 | −19.755 | 11.756 | 1.00 | 43.48 | C |
| ATOM | 623 | OH | TYR | A | 80 | 1.872 | −19.708 | 11.742 | 1.00 | 41.36 | O |
| ATOM | 624 | N | MET | A | 81 | −6.486 | −18.195 | 12.141 | 1.00 | 31.97 | N |
| ATOM | 625 | CA | MET | A | 81 | −7.895 | −18.185 | 11.803 | 1.00 | 37.08 | C |
| ATOM | 626 | C | MET | A | 81 | −7.999 | −18.062 | 10.297 | 1.00 | 34.14 | C |
| ATOM | 627 | O | MET | A | 81 | −7.505 | −17.096 | 9.717 | 1.00 | 38.01 | O |
| ATOM | 628 | CB | MET | A | 81 | −8.619 | −17.036 | 12.509 | 1.00 | 39.39 | C |
| ATOM | 629 | CG | MET | A | 81 | −10.137 | −17.099 | 12.445 | 1.00 | 43.17 | C |
| ATOM | 630 | SD | MET | A | 81 | −10.835 | −16.468 | 10.907 | 1.00 | 56.54 | S |
| ATOM | 631 | CE | MET | A | 81 | −10.224 | −14.782 | 10.930 | 1.00 | 40.20 | C |
| ATOM | 632 | N | GLU | A | 82 | −8.606 | −19.054 | 9.659 | 1.00 | 36.27 | N |
| ATOM | 633 | CA | GLU | A | 82 | −8.825 | −18.989 | 8.222 | 1.00 | 37.25 | C |
| ATOM | 634 | C | GLU | A | 82 | −10.310 | −18.963 | 7.908 | 1.00 | 38.89 | C |
| ATOM | 635 | O | GLU | A | 82 | −11.064 | −19.831 | 8.343 | 1.00 | 42.10 | O |
| ATOM | 636 | CB | GLU | A | 82 | −8.159 | −20.161 | 7.504 | 1.00 | 34.97 | C |
| ATOM | 637 | CG | GLU | A | 82 | −8.406 | −20.149 | 6.003 | 1.00 | 48.29 | C |
| ATOM | 638 | CD | GLU | A | 82 | −7.374 | −20.946 | 5.228 | 1.00 | 61.14 | C |
| ATOM | 639 | OE1 | GLU | A | 82 | −6.617 | −21.717 | 5.858 | 1.00 | 70.53 | O |
| ATOM | 640 | OE2 | GLU | A | 82 | −7.313 | −20.793 | 3.989 | 1.00 | 62.98 | O |
| ATOM | 641 | N | LEU | A | 83 | −10.726 | −17.946 | 7.161 | 1.00 | 41.14 | N |
| ATOM | 642 | CA | LEU | A | 83 | −12.118 | −17.807 | 6.766 | 1.00 | 40.75 | C |
| ATOM | 643 | C | LEU | A | 83 | −12.204 | −17.828 | 5.246 | 1.00 | 42.77 | C |
| ATOM | 644 | O | LEU | A | 83 | −11.572 | −17.017 | 4.569 | 1.00 | 46.85 | O |
| ATOM | 645 | CB | LEU | A | 83 | −12.716 | −16.519 | 7.336 | 1.00 | 38.47 | C |
| ATOM | 646 | CG | LEU | A | 83 | −14.233 | −16.359 | 7.216 | 1.00 | 41.96 | C |
| ATOM | 647 | CD1 | LEU | A | 83 | −14.956 | −17.499 | 7.919 | 1.00 | 40.57 | C |
| ATOM | 648 | CD2 | LEU | A | 83 | −14.677 | −15.015 | 7.776 | 1.00 | 38.68 | C |
| ATOM | 649 | N | SER | A | 84 | −12.974 | −18.769 | 4.711 | 1.00 | 41.64 | N |
| ATOM | 650 | CA | SER | A | 84 | −13.079 | −18.936 | 3.267 | 1.00 | 42.87 | C |
| ATOM | 651 | C | SER | A | 84 | −14.426 | −18.442 | 2.740 | 1.00 | 44.92 | C |
| ATOM | 652 | O | SER | A | 84 | −15.304 | −18.067 | 3.522 | 1.00 | 44.37 | O |
| ATOM | 653 | CB | SER | A | 84 | −12.868 | −20.402 | 2.888 | 1.00 | 39.46 | C |
| ATOM | 654 | OG | SER | A | 84 | −13.903 | −21.211 | 3.416 | 1.00 | 44.27 | O |
| ATOM | 655 | N | SER | A | 85 | −14.572 | −18.454 | 1.414 | 1.00 | 47.43 | N |
| ATOM | 656 | CA | SER | A | 85 | −15.769 | −17.960 | 0.732 | 1.00 | 41.86 | C |
| ATOM | 657 | C | SER | A | 85 | −16.189 | −16.591 | 1.245 | 1.00 | 43.45 | C |
| ATOM | 658 | O | SER | A | 85 | −17.337 | −16.392 | 1.652 | 1.00 | 44.70 | O |
| ATOM | 659 | CB | SER | A | 85 | −16.922 | −18.952 | 0.882 | 1.00 | 45.07 | C |
| ATOM | 660 | OG | SER | A | 85 | −16.674 | −20.125 | 0.128 | 1.00 | 51.48 | O |
| ATOM | 661 | N | LEU | A | 86 | −15.249 | −15.650 | 1.223 | 1.00 | 43.44 | N |
| ATOM | 662 | CA | LEU | A | 86 | −15.457 | −14.338 | 1.826 | 1.00 | 41.57 | C |
| ATOM | 663 | C | LEU | A | 86 | −16.526 | −13.526 | 1.104 | 1.00 | 46.59 | C |
| ATOM | 664 | O | LEU | A | 86 | −16.551 | −13.456 | −0.128 | 1.00 | 40.39 | O |
| ATOM | 665 | CB | LEU | A | 86 | −14.142 | −13.557 | 1.858 | 1.00 | 40.33 | C |
| ATOM | 666 | CG | LEU | A | 86 | −13.076 | −14.119 | 2.800 | 1.00 | 41.08 | C |
| ATOM | 667 | CD1 | LEU | A | 86 | −11.732 | −13.444 | 2.573 | 1.00 | 39.92 | C |
| ATOM | 668 | CD2 | LEU | A | 86 | −13.527 | −13.966 | 4.241 | 1.00 | 33.71 | C |
| ATOM | 669 | N | ARG | A | 87 | −17.420 | −12.933 | 1.888 | 1.00 | 37.30 | N |
| ATOM | 670 | CA | ARG | A | 87 | −18.411 | −12.002 | 1.371 | 1.00 | 42.71 | C |
| ATOM | 671 | C | ARG | A | 87 | −18.086 | −10.616 | 1.905 | 1.00 | 44.74 | C |
| ATOM | 672 | O | ARG | A | 87 | −17.304 | −10.483 | 2.846 | 1.00 | 42.11 | O |
| ATOM | 673 | CB | ARG | A | 87 | −19.828 | −12.418 | 1.774 | 1.00 | 47.73 | C |
| ATOM | 674 | CG | ARG | A | 87 | −20.231 | −13.806 | 1.298 | 1.00 | 57.87 | C |
| ATOM | 675 | CD | ARG | A | 87 | −21.702 | −14.088 | 1.577 | 1.00 | 78.50 | C |
| ATOM | 676 | NE | ARG | A | 87 | −22.154 | −15.318 | 0.928 | 1.00 | 98.72 | N |
| ATOM | 677 | CZ | ARG | A | 87 | −23.391 | −15.800 | 1.009 | 1.00 | 102.44 | C |
| ATOM | 678 | NH1 | ARG | A | 87 | −24.311 | −15.158 | 1.716 | 1.00 | 100.96 | N |
| ATOM | 679 | NH2 | ARG | A | 87 | −23.708 | −16.927 | 0.384 | 1.00 | 94.73 | N |
| ATOM | 680 | N | SER | A | 88 | −18.682 | −9.586 | 1.315 | 1.00 | 48.46 | N |
| ATOM | 681 | CA | SER | A | 88 | −18.426 | −8.221 | 1.759 | 1.00 | 47.83 | C |
| ATOM | 682 | C | SER | A | 88 | −18.871 | −8.035 | 3.212 | 1.00 | 43.27 | C |
| ATOM | 683 | O | SER | A | 88 | −18.315 | −7.210 | 3.935 | 1.00 | 45.67 | O |
| ATOM | 684 | CB | SER | A | 88 | −19.126 | −7.209 | 0.843 | 1.00 | 46.62 | C |
| ATOM | 685 | OG | SER | A | 88 | −20.530 | −7.399 | 0.826 | 1.00 | 56.66 | O |
| ATOM | 686 | N | GLU | A | 89 | −19.857 | −8.823 | 3.638 | 1.00 | 43.65 | N |
| ATOM | 687 | CA | GLU | A | 89 | −20.347 | −8.780 | 5.012 | 1.00 | 42.47 | C |
| ATOM | 688 | C | GLU | A | 89 | −19.332 | −9.323 | 6.015 | 1.00 | 42.20 | C |
| ATOM | 689 | O | GLU | A | 89 | −19.508 | −9.163 | 7.224 | 1.00 | 44.31 | O |
| ATOM | 690 | CB | GLU | A | 89 | −21.658 | −9.562 | 5.146 | 1.00 | 48.07 | C |
| ATOM | 691 | CG | GLU | A | 89 | −22.881 | −8.844 | 4.594 | 1.00 | 69.24 | C |
| ATOM | 692 | CD | GLU | A | 89 | −22.970 | −8.904 | 3.079 | 1.00 | 77.53 | C |
| ATOM | 693 | OE1 | GLU | A | 89 | −22.301 | −9.773 | 2.476 | 1.00 | 65.90 | O |

TABLE 10.2-continued

| | | | | | | | | | | |
|---|---|---|---|---|---|---|---|---|---|---|
| ATOM | 694 | OE2 | GLU | A | 89 | −23.710 | −8.081 | 2.493 | 1.00 | 76.65 | O |
| ATOM | 695 | N | ASP | A | 90 | −18.279 | −9.969 | 5.519 | 1.00 | 36.36 | N |
| ATOM | 696 | CA | ASP | A | 90 | −17.213 | −10.463 | 6.388 | 1.00 | 34.38 | C |
| ATOM | 697 | C | ASP | A | 90 | −16.197 | −9.364 | 6.709 | 1.00 | 39.43 | C |
| ATOM | 698 | O | ASP | A | 90 | −15.250 | −9.589 | 7.463 | 1.00 | 38.18 | O |
| ATOM | 699 | CB | ASP | A | 90 | −16.494 | −11.658 | 5.751 | 1.00 | 38.88 | C |
| ATOM | 700 | CG | ASP | A | 90 | −17.361 | −12.903 | 5.681 | 1.00 | 42.31 | C |
| ATOM | 701 | OD1 | ASP | A | 90 | −18.157 | −13.146 | 6.616 | 1.00 | 37.56 | O |
| ATOM | 702 | OD2 | ASP | A | 90 | −17.237 | −13.646 | 4.683 | 1.00 | 47.30 | O |
| ATOM | 703 | N | THR | A | 91 | −16.389 | −8.183 | 6.127 | 1.00 | 34.63 | N |
| ATOM | 704 | CA | THR | A | 91 | −15.525 | −7.042 | 6.418 | 1.00 | 35.67 | C |
| ATOM | 705 | C | THR | A | 91 | −15.661 | −6.663 | 7.887 | 1.00 | 34.77 | C |
| ATOM | 706 | O | THR | A | 91 | −16.743 | −6.285 | 8.340 | 1.00 | 34.99 | O |
| ATOM | 707 | CB | THR | A | 91 | −15.858 | −5.818 | 5.532 | 1.00 | 37.50 | C |
| ATOM | 708 | CG2 | THR | A | 91 | −15.075 | −4.591 | 5.994 | 1.00 | 34.40 | C |
| ATOM | 709 | OG1 | THR | A | 91 | −15.529 | −6.104 | 4.164 | 1.00 | 40.03 | O |
| ATOM | 710 | N | ALA | A | 92 | −14.562 | −6.772 | 8.626 | 1.00 | 29.62 | N |
| ATOM | 711 | CA | ALA | A | 92 | −14.588 | −6.570 | 10.070 | 1.00 | 32.67 | C |
| ATOM | 712 | C | ALA | A | 92 | −13.190 | −6.544 | 10.665 | 1.00 | 27.73 | C |
| ATOM | 713 | O | ALA | A | 92 | −12.209 | −6.882 | 10.001 | 1.00 | 29.29 | O |
| ATOM | 714 | CB | ALA | A | 92 | −15.416 | −7.671 | 10.746 | 1.00 | 33.43 | C |
| ATOM | 715 | N | VAL | A | 93 | −13.112 | −6.143 | 11.929 | 1.00 | 30.17 | N |
| ATOM | 716 | CA | VAL | A | 93 | −11.897 | −6.308 | 12.704 | 1.00 | 26.67 | C |
| ATOM | 717 | C | VAL | A | 93 | −11.959 | −7.652 | 13.424 | 1.00 | 29.85 | C |
| ATOM | 718 | O | VAL | A | 93 | −12.911 | −7.934 | 14.154 | 1.00 | 32.54 | O |
| ATOM | 719 | CB | VAL | A | 93 | −11.705 | −5.169 | 13.726 | 1.00 | 31.84 | C |
| ATOM | 720 | CG1 | VAL | A | 93 | −10.539 | −5.475 | 14.653 | 1.00 | 24.37 | C |
| ATOM | 721 | CG2 | VAL | A | 93 | −11.487 | −3.842 | 13.009 | 1.00 | 25.26 | C |
| ATOM | 722 | N | TYR | A | 94 | −10.948 | −8.484 | 13.207 | 1.00 | 26.52 | N |
| ATOM | 723 | CA | TYR | A | 94 | −10.911 | −9.806 | 13.816 | 1.00 | 31.35 | C |
| ATOM | 724 | C | TYR | A | 94 | −9.961 | −9.826 | 15.005 | 1.00 | 33.59 | C |
| ATOM | 725 | O | TYR | A | 94 | −8.769 | −9.546 | 14.867 | 1.00 | 31.79 | O |
| ATOM | 726 | CB | TYR | A | 94 | −10.518 | −10.861 | 12.774 | 1.00 | 25.00 | C |
| ATOM | 727 | CG | TYR | A | 94 | −11.629 | −11.105 | 11.781 | 1.00 | 27.22 | C |
| ATOM | 728 | CD1 | TYR | A | 94 | −11.863 | −10.216 | 10.739 | 1.00 | 30.50 | C |
| ATOM | 729 | CD2 | TYR | A | 94 | −12.469 | −12.207 | 11.906 | 1.00 | 23.97 | C |
| ATOM | 730 | CE1 | TYR | A | 94 | −12.893 | −10.423 | 9.842 | 1.00 | 27.95 | C |
| ATOM | 731 | CE2 | TYR | A | 94 | −13.492 | −12.423 | 11.022 | 1.00 | 26.58 | C |
| ATOM | 732 | CZ | TYR | A | 94 | −13.703 | −11.527 | 9.989 | 1.00 | 32.87 | C |
| ATOM | 733 | OH | TYR | A | 94 | −14.730 | −11.739 | 9.104 | 1.00 | 30.47 | O |
| ATOM | 734 | N | TYR | A | 95 | −10.511 | −10.135 | 16.177 | 1.00 | 24.85 | N |
| ATOM | 735 | CA | TYR | A | 95 | −9.731 | −10.215 | 17.406 | 1.00 | 28.45 | C |
| ATOM | 736 | C | TYR | A | 95 | −9.474 | −11.661 | 17.805 | 1.00 | 27.62 | C |
| ATOM | 737 | O | TYR | A | 95 | −10.356 | −12.508 | 17.688 | 1.00 | 28.27 | O |
| ATOM | 738 | CB | TYR | A | 95 | −10.450 | −9.512 | 18.564 | 1.00 | 24.54 | C |
| ATOM | 739 | CG | TYR | A | 95 | −10.626 | −8.019 | 18.419 | 1.00 | 26.81 | C |
| ATOM | 740 | CD1 | TYR | A | 95 | −9.580 | −7.148 | 18.692 | 1.00 | 27.26 | C |
| ATOM | 741 | CD2 | TYR | A | 95 | −11.847 | −7.481 | 18.036 | 1.00 | 28.58 | C |
| ATOM | 742 | CE1 | TYR | A | 95 | −9.737 | −5.778 | 18.571 | 1.00 | 27.06 | C |
| ATOM | 743 | CE2 | TYR | A | 95 | −12.017 | −6.113 | 17.913 | 1.00 | 27.13 | C |
| ATOM | 744 | CZ | TYR | A | 95 | −10.960 | −5.269 | 18.184 | 1.00 | 27.27 | C |
| ATOM | 745 | OH | TYR | A | 95 | −11.125 | −3.911 | 18.060 | 1.00 | 31.79 | O |
| ATOM | 746 | N | CYS | A | 96 | −8.274 | −11.945 | 18.289 | 1.00 | 23.92 | N |
| ATOM | 747 | CA | CYS | A | 96 | −8.073 | −13.182 | 19.025 | 1.00 | 30.30 | C |
| ATOM | 748 | C | CYS | A | 96 | −8.115 | −12.829 | 20.505 | 1.00 | 27.04 | C |
| ATOM | 749 | O | CYS | A | 96 | −7.708 | −11.736 | 20.899 | 1.00 | 28.05 | O |
| ATOM | 750 | CB | CYS | A | 96 | −6.758 | −13.877 | 18.645 | 1.00 | 33.84 | C |
| ATOM | 751 | SG | CYS | A | 96 | −5.246 | −13.010 | 19.099 | 1.00 | 48.82 | S |
| ATOM | 752 | N | ALA | A | 97 | −8.634 | −13.742 | 21.316 | 1.00 | 28.58 | N |
| ATOM | 753 | CA | ALA | A | 97 | −8.783 | −13.497 | 22.743 | 1.00 | 26.57 | C |
| ATOM | 754 | C | ALA | A | 97 | −8.768 | −14.816 | 23.507 | 1.00 | 32.11 | C |
| ATOM | 755 | O | ALA | A | 97 | −9.409 | −15.780 | 23.091 | 1.00 | 30.87 | O |
| ATOM | 756 | CB | ALA | A | 97 | −10.065 | −12.736 | 23.016 | 1.00 | 26.61 | C |
| ATOM | 757 | N | SER | A | 98 | −8.042 | −14.864 | 24.621 | 1.00 | 27.25 | N |
| ATOM | 758 | CA | SER | A | 98 | −7.888 | −16.121 | 25.348 | 1.00 | 32.20 | C |
| ATOM | 759 | C | SER | A | 98 | −8.839 | −16.275 | 26.532 | 1.00 | 29.23 | C |
| ATOM | 760 | O | SER | A | 98 | −9.249 | −15.294 | 27.153 | 1.00 | 25.23 | O |
| ATOM | 761 | CB | SER | A | 98 | −6.453 | −16.280 | 25.845 | 1.00 | 33.45 | C |
| ATOM | 762 | OG | SER | A | 98 | −6.155 | −15.337 | 26.856 | 1.00 | 45.41 | O |
| ATOM | 763 | N | SER | A | 99 | −9.169 | −17.528 | 26.833 | 1.00 | 29.87 | N |
| ATOM | 764 | CA | SER | A | 99 | −9.971 | −17.885 | 28.001 | 1.00 | 30.05 | C |
| ATOM | 765 | C | SER | A | 99 | −9.348 | −19.099 | 28.689 | 1.00 | 35.19 | C |
| ATOM | 766 | O | SER | A | 99 | −8.528 | −19.794 | 28.086 | 1.00 | 30.60 | O |
| ATOM | 767 | CB | SER | A | 99 | −11.417 | −18.171 | 27.596 | 1.00 | 26.53 | C |
| ATOM | 768 | OG | SER | A | 99 | −11.485 | −19.129 | 26.552 | 1.00 | 29.62 | O |
| ATOM | 769 | N | SER | A | 100 | −9.738 | −19.355 | 29.938 | 1.00 | 33.90 | N |
| ATOM | 770 | CA | SER | A | 100 | −9.099 | −20.396 | 30.749 | 1.00 | 39.84 | C |
| ATOM | 771 | C | SER | A | 100 | −10.060 | −21.427 | 31.338 | 1.00 | 33.23 | C |
| ATOM | 772 | O | SER | A | 100 | −9.932 | −21.793 | 32.506 | 1.00 | 40.18 | O |
| ATOM | 773 | CB | SER | A | 100 | −8.319 | −19.758 | 31.900 | 1.00 | 32.53 | C |

TABLE 10.2-continued

| | | | | | | | | | | |
|---|---|---|---|---|---|---|---|---|---|---|
| ATOM | 774 | OG | SER | A | 100 | −7.194 | −19.048 | 31.424 | 1.00 | 49.78 | O |
| ATOM | 775 | O | GLY | A | 101 | −14.315 | −23.137 | 30.676 | 1.00 | 40.43 | O |
| ATOM | 776 | N | GLY | A | 101 | −11.017 | −21.899 | 30.547 | 1.00 | 31.28 | N |
| ATOM | 777 | CA | GLY | A | 101 | −11.974 | −22.868 | 31.048 | 1.00 | 28.36 | C |
| ATOM | 778 | C | GLY | A | 101 | −13.406 | −22.374 | 30.999 | 1.00 | 32.57 | C |
| ATOM | 779 | O | TRP | A | 102 | −13.530 | −18.918 | 29.800 | 1.00 | 32.97 | O |
| ATOM | 780 | N | TRP | A | 102 | −13.617 | −21.110 | 31.357 | 1.00 | 23.41 | N |
| ATOM | 781 | CA | TRP | A | 102 | −14.879 | −20.435 | 31.059 | 1.00 | 26.91 | C |
| ATOM | 782 | C | TRP | A | 102 | −14.626 | −19.471 | 29.916 | 1.00 | 30.14 | C |
| ATOM | 783 | CB | TRP | A | 102 | −15.432 | −19.683 | 32.271 | 1.00 | 27.64 | C |
| ATOM | 784 | CG | TRP | A | 102 | −15.721 | −20.553 | 33.447 | 1.00 | 28.49 | C |
| ATOM | 785 | CD1 | TRP | A | 102 | −16.761 | −21.428 | 33.587 | 1.00 | 25.22 | C |
| ATOM | 786 | CD2 | TRP | A | 102 | −14.972 | −20.618 | 34.664 | 1.00 | 25.37 | C |
| ATOM | 787 | NE1 | TRP | A | 102 | −16.701 | −22.038 | 34.818 | 1.00 | 26.75 | N |
| ATOM | 788 | CE2 | TRP | A | 102 | −15.611 | −21.559 | 35.498 | 1.00 | 23.51 | C |
| ATOM | 789 | CE3 | TRP | A | 102 | −13.819 | −19.977 | 35.128 | 1.00 | 23.78 | C |
| ATOM | 790 | CZ2 | TRP | A | 102 | −15.134 | −21.874 | 36.772 | 1.00 | 27.12 | C |
| ATOM | 791 | CZ3 | TRP | A | 102 | −13.346 | −20.291 | 36.396 | 1.00 | 31.84 | C |
| ATOM | 792 | CH2 | TRP | A | 102 | −14.003 | −21.232 | 37.202 | 1.00 | 24.60 | C |
| ATOM | 793 | O | TYR | A | 103 | −16.560 | −16.374 | 27.434 | 1.00 | 35.87 | O |
| ATOM | 794 | N | TYR | A | 103 | −15.628 | −19.268 | 29.071 | 1.00 | 23.62 | N |
| ATOM | 795 | CA | TYR | A | 103 | −15.441 | −18.444 | 27.884 | 1.00 | 33.88 | C |
| ATOM | 796 | C | TYR | A | 103 | −15.723 | −16.960 | 28.117 | 1.00 | 34.03 | C |
| ATOM | 797 | CB | TYR | A | 103 | −16.321 | −18.949 | 26.742 | 1.00 | 27.85 | C |
| ATOM | 798 | CG | TYR | A | 103 | −15.988 | −20.342 | 26.265 | 1.00 | 32.69 | C |
| ATOM | 799 | CD1 | TYR | A | 103 | −14.804 | −20.601 | 25.588 | 1.00 | 31.32 | C |
| ATOM | 800 | CD2 | TYR | A | 103 | −16.866 | −21.396 | 26.478 | 1.00 | 31.92 | C |
| ATOM | 801 | CE1 | TYR | A | 103 | −14.498 | −21.879 | 25.143 | 1.00 | 32.07 | C |
| ATOM | 802 | CE2 | TYR | A | 103 | −16.571 | −22.673 | 26.036 | 1.00 | 31.82 | C |
| ATOM | 803 | CZ | TYR | A | 103 | −15.385 | −22.908 | 25.370 | 1.00 | 34.61 | C |
| ATOM | 804 | OH | TYR | A | 103 | −15.090 | −24.176 | 24.931 | 1.00 | 37.00 | O |
| ATOM | 805 | N | TYR | A | 104 | −15.035 | −16.359 | 29.085 | 1.00 | 30.47 | N |
| ATOM | 806 | CA | TYR | A | 104 | −14.929 | −14.904 | 29.133 | 1.00 | 34.52 | C |
| ATOM | 807 | C | TYR | A | 104 | −13.452 | −14.557 | 28.940 | 1.00 | 37.81 | C |
| ATOM | 808 | O | TYR | A | 104 | −12.571 | −15.311 | 29.359 | 1.00 | 33.63 | O |
| ATOM | 809 | CB | TYR | A | 104 | −15.488 | −14.328 | 30.439 | 1.00 | 28.01 | C |
| ATOM | 810 | CG | TYR | A | 104 | −14.762 | −14.755 | 31.690 | 1.00 | 29.48 | C |
| ATOM | 811 | CD2 | TYR | A | 104 | −15.209 | −15.837 | 32.442 | 1.00 | 31.05 | C |
| ATOM | 812 | CD1 | TYR | A | 104 | −13.639 | −14.068 | 32.132 | 1.00 | 33.84 | C |
| ATOM | 813 | CE2 | TYR | A | 104 | −14.547 | −16.227 | 33.600 | 1.00 | 31.77 | C |
| ATOM | 814 | CE1 | TYR | A | 104 | −12.968 | −14.452 | 33.282 | 1.00 | 38.93 | C |
| ATOM | 815 | CZ | TYR | A | 104 | −13.424 | −15.530 | 34.009 | 1.00 | 35.52 | C |
| ATOM | 816 | OH | TYR | A | 104 | −12.751 | −15.905 | 35.147 | 1.00 | 47.88 | O |
| ATOM | 817 | N | PHE | A | 105 | −13.180 | −13.423 | 28.308 | 1.00 | 34.39 | N |
| ATOM | 818 | CA | PHE | A | 105 | −11.862 | −13.201 | 27.718 | 1.00 | 31.85 | C |
| ATOM | 819 | C | PHE | A | 105 | −11.046 | −12.124 | 28.419 | 1.00 | 31.30 | C |
| ATOM | 820 | O | PHE | A | 105 | −11.367 | −10.938 | 28.347 | 1.00 | 33.02 | O |
| ATOM | 821 | CB | PHE | A | 105 | −12.046 | −12.872 | 26.240 | 1.00 | 27.43 | C |
| ATOM | 822 | CG | PHE | A | 105 | −13.093 | −13.719 | 25.583 | 1.00 | 32.14 | C |
| ATOM | 823 | CD1 | PHE | A | 105 | −12.894 | −15.083 | 25.423 | 1.00 | 32.34 | C |
| ATOM | 824 | CD2 | PHE | A | 105 | −14.292 | −13.168 | 25.166 | 1.00 | 33.77 | C |
| ATOM | 825 | CE1 | PHE | A | 105 | −13.866 | −15.879 | 24.840 | 1.00 | 28.51 | C |
| ATOM | 826 | CE2 | PHE | A | 105 | −15.267 | −13.959 | 24.577 | 1.00 | 36.93 | C |
| ATOM | 827 | CZ | PHE | A | 105 | −15.052 | −15.317 | 24.413 | 1.00 | 31.65 | C |
| ATOM | 828 | N | ASP | A | 106 | −9.981 | −12.543 | 29.097 | 1.00 | 31.31 | N |
| ATOM | 829 | CA | ASP | A | 106 | −9.205 | −11.614 | 29.914 | 1.00 | 33.51 | C |
| ATOM | 830 | C | ASP | A | 106 | −8.015 | −11.014 | 29.167 | 1.00 | 32.69 | C |
| ATOM | 831 | O | ASP | A | 106 | −7.485 | −9.983 | 29.578 | 1.00 | 38.29 | O |
| ATOM | 832 | CB | ASP | A | 106 | −8.734 | −12.298 | 31.206 | 1.00 | 37.27 | C |
| ATOM | 833 | CG | ASP | A | 106 | −8.078 | −13.645 | 30.962 | 1.00 | 44.11 | C |
| ATOM | 834 | OD1 | ASP | A | 106 | −8.298 | −14.243 | 29.886 | 1.00 | 44.95 | O |
| ATOM | 835 | OD2 | ASP | A | 106 | −7.347 | −14.114 | 31.860 | 1.00 | 39.24 | O |
| ATOM | 836 | N | TYR | A | 107 | −7.604 | −11.645 | 28.069 | 1.00 | 33.81 | N |
| ATOM | 837 | CA | TYR | A | 107 | −6.550 | −11.085 | 27.220 | 1.00 | 31.46 | C |
| ATOM | 838 | C | TYR | A | 107 | −6.967 | −11.061 | 25.752 | 1.00 | 27.21 | C |
| ATOM | 839 | O | TYR | A | 107 | −7.565 | −12.015 | 25.256 | 1.00 | 27.70 | O |
| ATOM | 840 | CB | TYR | A | 107 | −5.250 | −11.870 | 27.388 | 1.00 | 34.62 | C |
| ATOM | 841 | CG | TYR | A | 107 | −4.719 | −11.830 | 28.802 | 1.00 | 39.20 | C |
| ATOM | 842 | CD1 | TYR | A | 107 | −4.065 | −10.705 | 29.284 | 1.00 | 44.79 | C |
| ATOM | 843 | CD2 | TYR | A | 107 | −4.882 | −12.912 | 29.659 | 1.00 | 42.77 | C |
| ATOM | 844 | CE1 | TYR | A | 107 | −3.584 | −10.658 | 30.583 | 1.00 | 57.22 | C |
| ATOM | 845 | CE2 | TYR | A | 107 | −4.403 | −12.875 | 30.957 | 1.00 | 50.96 | C |
| ATOM | 846 | CZ | TYR | A | 107 | −3.758 | −11.746 | 31.414 | 1.00 | 48.15 | C |
| ATOM | 847 | OH | TYR | A | 107 | −3.279 | −11.702 | 32.703 | 1.00 | 71.00 | O |
| ATOM | 848 | N | TRP | A | 108 | −6.638 | −9.967 | 25.066 | 1.00 | 27.81 | N |
| ATOM | 849 | CA | TRP | A | 108 | −7.055 | −9.741 | 23.679 | 1.00 | 21.18 | C |
| ATOM | 850 | C | TRP | A | 108 | −5.892 | −9.324 | 22.782 | 1.00 | 26.32 | C |
| ATOM | 851 | O | TRP | A | 108 | −4.984 | −8.615 | 23.218 | 1.00 | 29.92 | O |
| ATOM | 852 | CB | TRP | A | 108 | −8.132 | −8.654 | 23.610 | 1.00 | 21.90 | C |
| ATOM | 853 | CG | TRP | A | 108 | −9.444 | −9.007 | 24.233 | 1.00 | 27.98 | C |

TABLE 10.2-continued

| | | | | | | | | | | | |
|---|---|---|---|---|---|---|---|---|---|---|---|
| ATOM | 854 | CD1 | TRP | A | 108 | −9.700 | −9.207 | 25.560 | 1.00 | 27.08 | C |
| ATOM | 855 | CD2 | TRP | A | 108 | −10.693 | −9.171 | 23.554 | 1.00 | 27.01 | C |
| ATOM | 856 | CE2 | TRP | A | 108 | −11.663 | −9.484 | 24.530 | 1.00 | 25.58 | C |
| ATOM | 857 | CE3 | TRP | A | 108 | −11.085 | −9.093 | 22.212 | 1.00 | 25.64 | C |
| ATOM | 858 | NE1 | TRP | A | 108 | −11.032 | −9.500 | 25.746 | 1.00 | 24.70 | N |
| ATOM | 859 | CZ2 | TRP | A | 108 | −12.999 | −9.715 | 24.208 | 1.00 | 25.47 | C |
| ATOM | 860 | CZ3 | TRP | A | 108 | −12.414 | −9.322 | 21.893 | 1.00 | 32.29 | C |
| ATOM | 861 | CH2 | TRP | A | 108 | −13.355 | −9.630 | 22.889 | 1.00 | 32.24 | C |
| ATOM | 862 | N | GLY | A | 109 | −5.928 | −9.748 | 21.523 | 1.00 | 27.02 | N |
| ATOM | 863 | CA | GLY | A | 109 | −5.002 | −9.227 | 20.531 | 1.00 | 28.74 | C |
| ATOM | 864 | C | GLY | A | 109 | −5.415 | −7.812 | 20.159 | 1.00 | 31.88 | C |
| ATOM | 865 | O | GLY | A | 109 | −6.476 | −7.346 | 20.584 | 1.00 | 26.79 | O |
| ATOM | 866 | N | GLN | A | 110 | −4.595 | −7.120 | 19.373 | 1.00 | 28.50 | N |
| ATOM | 867 | CA | GLN | A | 110 | −4.878 | −5.721 | 19.055 | 1.00 | 29.47 | C |
| ATOM | 868 | C | GLN | A | 110 | −5.904 | −5.611 | 17.928 | 1.00 | 30.21 | C |
| ATOM | 869 | O | GLN | A | 110 | −6.432 | −4.532 | 17.659 | 1.00 | 36.00 | O |
| ATOM | 870 | CB | GLN | A | 110 | −3.591 | −4.966 | 18.683 | 1.00 | 23.57 | C |
| ATOM | 871 | CG | GLN | A | 110 | −3.125 | −5.156 | 17.239 | 1.00 | 29.23 | C |
| ATOM | 872 | CD | GLN | A | 110 | −2.309 | −6.419 | 17.032 | 1.00 | 33.10 | C |
| ATOM | 873 | NE2 | GLN | A | 110 | −1.568 | −6.467 | 15.929 | 1.00 | 31.73 | N |
| ATOM | 874 | OE1 | GLN | A | 110 | −2.343 | −7.342 | 17.850 | 1.00 | 35.23 | O |
| ATOM | 875 | N | GLY | A | 111 | −6.192 | −6.733 | 17.277 | 1.00 | 31.62 | N |
| ATOM | 876 | CA | GLY | A | 111 | −7.188 | −6.760 | 16.225 | 1.00 | 31.32 | C |
| ATOM | 877 | C | GLY | A | 111 | −6.604 | −6.675 | 14.831 | 1.00 | 34.22 | C |
| ATOM | 878 | O | GLY | A | 111 | −5.561 | −6.059 | 14.612 | 1.00 | 31.13 | O |
| ATOM | 879 | N | THR | A | 112 | −7.291 | −7.299 | 13.882 | 1.00 | 29.50 | N |
| ATOM | 880 | CA | THR | A | 112 | −6.858 | −7.300 | 12.494 | 1.00 | 30.89 | C |
| ATOM | 881 | C | THR | A | 112 | −8.008 | −6.901 | 11.587 | 1.00 | 30.69 | C |
| ATOM | 882 | O | THR | A | 112 | −9.035 | −7.577 | 11.551 | 1.00 | 28.68 | O |
| ATOM | 883 | CB | THR | A | 112 | −6.334 | −8.683 | 12.064 | 1.00 | 34.70 | C |
| ATOM | 884 | CG2 | THR | A | 112 | −5.960 | −8.683 | 10.584 | 1.00 | 33.17 | C |
| ATOM | 885 | OG1 | THR | A | 112 | −5.182 | −9.025 | 12.846 | 1.00 | 39.75 | O |
| ATOM | 886 | N | LEU | A | 113 | −7.842 | −5.804 | 10.859 | 1.00 | 28.77 | N |
| ATOM | 887 | CA | LEU | A | 113 | −8.868 | −5.372 | 9.917 | 1.00 | 26.18 | C |
| ATOM | 888 | C | LEU | A | 113 | −8.801 | −6.203 | 8.635 | 1.00 | 32.80 | C |
| ATOM | 889 | O | LEU | A | 113 | −7.769 | −6.263 | 7.968 | 1.00 | 31.11 | O |
| ATOM | 890 | CB | LEU | A | 113 | −8.721 | −3.883 | 9.587 | 1.00 | 26.67 | C |
| ATOM | 891 | CG | LEU | A | 113 | −9.680 | −3.339 | 8.518 | 1.00 | 32.26 | C |
| ATOM | 892 | CD1 | LEU | A | 113 | −11.139 | −3.581 | 8.899 | 1.00 | 29.02 | C |
| ATOM | 893 | CD2 | LEU | A | 113 | −9.437 | −1.855 | 8.262 | 1.00 | 32.24 | C |
| ATOM | 894 | N | VAL | A | 114 | −9.904 | −6.859 | 8.305 | 1.00 | 28.44 | N |
| ATOM | 895 | CA | VAL | A | 114 | −10.009 | −7.566 | 7.036 | 1.00 | 30.93 | C |
| ATOM | 896 | C | VAL | A | 114 | −11.076 | −6.899 | 6.188 | 1.00 | 30.62 | C |
| ATOM | 897 | O | VAL | A | 114 | −12.233 | −6.788 | 6.601 | 1.00 | 29.64 | O |
| ATOM | 898 | CB | VAL | A | 114 | −10.353 | −9.058 | 7.225 | 1.00 | 31.72 | C |
| ATOM | 899 | CG1 | VAL | A | 114 | −10.535 | −9.740 | 5.869 | 1.00 | 33.33 | C |
| ATOM | 900 | CG2 | VAL | A | 114 | −9.265 | −9.750 | 8.042 | 1.00 | 32.90 | C |
| ATOM | 901 | N | THR | A | 115 | −10.676 | −6.436 | 5.009 | 1.00 | 35.29 | N |
| ATOM | 902 | CA | THR | A | 115 | −11.604 | −5.788 | 4.100 | 1.00 | 34.33 | C |
| ATOM | 903 | C | THR | A | 115 | −11.863 | −6.700 | 2.912 | 1.00 | 36.39 | C |
| ATOM | 904 | O | THR | A | 115 | −10.929 | −7.156 | 2.251 | 1.00 | 35.90 | O |
| ATOM | 905 | CB | THR | A | 115 | −11.068 | −4.426 | 3.610 | 1.00 | 36.40 | C |
| ATOM | 906 | CG2 | THR | A | 115 | −12.038 | −3.785 | 2.628 | 1.00 | 34.46 | C |
| ATOM | 907 | OG1 | THR | A | 115 | −10.890 | −3.552 | 4.730 | 1.00 | 37.23 | O |
| ATOM | 908 | N | VAL | A | 116 | −13.136 | −6.976 | 2.657 | 1.00 | 39.45 | N |
| ATOM | 909 | CA | VAL | A | 116 | −13.527 | −7.775 | 1.504 | 1.00 | 34.84 | C |
| ATOM | 910 | C | VAL | A | 116 | −14.212 | −6.875 | 0.490 | 1.00 | 38.13 | C |
| ATOM | 911 | O | VAL | A | 116 | −15.289 | −6.339 | 0.755 | 1.00 | 35.45 | O |
| ATOM | 912 | CB | VAL | A | 116 | −14.475 | −8.932 | 1.886 | 1.00 | 39.24 | C |
| ATOM | 913 | CG1 | VAL | A | 116 | −14.679 | −9.864 | 0.693 | 1.00 | 39.66 | C |
| ATOM | 914 | CG2 | VAL | A | 116 | −13.924 | −9.705 | 3.075 | 1.00 | 38.07 | C |
| ATOM | 915 | N | SER | A | 117 | −13.589 | −6.706 | −0.671 | 1.00 | 34.44 | N |
| ATOM | 916 | CA | SER | A | 117 | −14.126 | −5.795 | −1.671 | 1.00 | 40.89 | C |
| ATOM | 917 | C | SER | A | 117 | −13.687 | −6.131 | −3.091 | 1.00 | 40.89 | C |
| ATOM | 918 | O | SER | A | 117 | −12.598 | −6.661 | −3.313 | 1.00 | 38.45 | O |
| ATOM | 919 | CB | SER | A | 117 | −13.716 | −4.359 | −1.345 | 1.00 | 34.47 | C |
| ATOM | 920 | OG | SER | A | 117 | −14.224 | −3.460 | −2.318 | 1.00 | 43.36 | O |
| ATOM | 921 | O | SER | A | 118 | −12.636 | −4.911 | −6.922 | 1.00 | 43.31 | O |
| ATOM | 922 | N | SER | A | 118 | −14.546 | −5.795 | −4.047 | 1.00 | 42.01 | N |
| ATOM | 923 | CA | SER | A | 118 | −14.232 | −5.940 | −5.462 | 1.00 | 52.20 | C |
| ATOM | 924 | C | SER | A | 118 | −13.391 | −4.770 | −5.963 | 1.00 | 47.46 | C |
| ATOM | 925 | CB | SER | A | 118 | −15.516 | −6.046 | −6.287 | 1.00 | 44.49 | C |
| ATOM | 926 | OG | SER | A | 118 | −16.364 | −7.057 | −5.772 | 1.00 | 64.31 | O |
| ATOM | 927 | O | ALA | A | 119 | −10.794 | −3.378 | −5.023 | 1.00 | 46.60 | O |
| ATOM | 928 | N | ALA | A | 119 | −13.530 | −3.617 | −5.311 | 1.00 | 44.58 | N |
| ATOM | 929 | CA | ALA | A | 119 | −12.862 | −2.393 | −5.753 | 1.00 | 40.93 | C |
| ATOM | 930 | C | ALA | A | 119 | −11.342 | −2.520 | −5.714 | 1.00 | 45.33 | C |
| ATOM | 931 | CB | ALA | A | 119 | −13.312 | −1.211 | −4.908 | 1.00 | 36.58 | C |
| ATOM | 932 | N | SER | A | 120 | −10.666 | −1.656 | −6.462 | 1.00 | 46.47 | N |
| ATOM | 933 | CA | SER | A | 120 | −9.215 | −1.709 | −6.568 | 1.00 | 45.38 | C |

TABLE 10.2-continued

| | | | | | | | | | | |
|---|---|---|---|---|---|---|---|---|---|---|
| ATOM | 934 | C | SER | A | 120 | −8.519 | −1.011 | −5.404 | 1.00 | 40.94 | C |
| ATOM | 935 | O | SER | A | 120 | −8.988 | 0.011 | −4.907 | 1.00 | 41.57 | O |
| ATOM | 936 | CB | SER | A | 120 | −8.765 | −1.087 | −7.888 | 1.00 | 48.55 | C |
| ATOM | 937 | OG | SER | A | 120 | −9.353 | −1.760 | −8.986 | 1.00 | 60.18 | O |
| ATOM | 938 | N | THR | A | 121 | −7.396 | −1.579 | −4.977 | 1.00 | 34.74 | N |
| ATOM | 939 | CA | THR | A | 121 | −6.548 | −0.974 | −3.960 | 1.00 | 32.02 | C |
| ATOM | 940 | C | THR | A | 121 | −5.820 | 0.246 | −4.520 | 1.00 | 36.76 | C |
| ATOM | 941 | O | THR | A | 121 | −5.170 | 0.163 | −5.560 | 1.00 | 38.97 | O |
| ATOM | 942 | CB | THR | A | 121 | −5.515 | −1.984 | −3.424 | 1.00 | 34.58 | C |
| ATOM | 943 | CG2 | THR | A | 121 | −4.467 | −1.287 | −2.564 | 1.00 | 34.08 | C |
| ATOM | 944 | OG1 | THR | A | 121 | −6.183 | −2.982 | −2.643 | 1.00 | 35.30 | O |
| ATOM | 945 | N | LYS | A | 122 | −5.925 | 1.374 | −3.822 | 1.00 | 38.80 | N |
| ATOM | 946 | CA | LYS | A | 122 | −5.311 | 2.619 | −4.276 | 1.00 | 33.51 | C |
| ATOM | 947 | C | LYS | A | 122 | −4.612 | 3.348 | −3.137 | 1.00 | 34.96 | C |
| ATOM | 948 | O | LYS | A | 122 | −5.217 | 3.618 | −2.103 | 1.00 | 36.45 | O |
| ATOM | 949 | CB | LYS | A | 122 | −6.364 | 3.533 | −4.907 | 1.00 | 31.35 | C |
| ATOM | 950 | CG | LYS | A | 122 | −5.799 | 4.818 | −5.474 | 1.00 | 41.47 | C |
| ATOM | 951 | CD | LYS | A | 122 | −6.894 | 5.726 | −6.013 | 1.00 | 44.52 | C |
| ATOM | 952 | CE | LYS | A | 122 | −6.300 | 6.975 | −6.653 | 1.00 | 45.34 | C |
| ATOM | 953 | NZ | LYS | A | 122 | −5.380 | 7.695 | −5.723 | 1.00 | 52.67 | N |
| ATOM | 954 | N | GLY | A | 123 | −3.336 | 3.665 | −3.328 | 1.00 | 34.17 | N |
| ATOM | 955 | CA | GLY | A | 123 | −2.581 | 4.418 | −2.344 | 1.00 | 31.92 | C |
| ATOM | 956 | C | GLY | A | 123 | −2.957 | 5.889 | −2.359 | 1.00 | 38.36 | C |
| ATOM | 957 | O | GLY | A | 123 | −3.423 | 6.403 | −3.375 | 1.00 | 39.10 | O |
| ATOM | 958 | N | PRO | A | 124 | −2.747 | 6.578 | −1.228 | 1.00 | 35.34 | N |
| ATOM | 959 | CA | PRO | A | 124 | −3.181 | 7.963 | −1.024 | 1.00 | 33.85 | C |
| ATOM | 960 | C | PRO | A | 124 | −2.245 | 9.021 | −1.600 | 1.00 | 38.95 | C |
| ATOM | 961 | O | PRO | A | 124 | −1.036 | 8.809 | −1.689 | 1.00 | 33.76 | O |
| ATOM | 962 | CB | PRO | A | 124 | −3.209 | 8.084 | 0.497 | 1.00 | 31.61 | C |
| ATOM | 963 | CG | PRO | A | 124 | −2.100 | 7.184 | 0.944 | 1.00 | 31.80 | C |
| ATOM | 964 | CD | PRO | A | 124 | −2.095 | 6.024 | −0.026 | 1.00 | 35.65 | C |
| ATOM | 965 | N | SER | A | 125 | −2.817 | 10.160 | −1.974 | 1.00 | 31.51 | N |
| ATOM | 966 | CA | SER | A | 125 | −2.038 | 11.366 | −2.216 | 1.00 | 34.17 | C |
| ATOM | 967 | C | SER | A | 125 | −2.015 | 12.176 | −0.926 | 1.00 | 32.77 | C |
| ATOM | 968 | O | SER | A | 125 | −3.041 | 12.315 | −0.261 | 1.00 | 38.58 | O |
| ATOM | 969 | CB | SER | A | 125 | −2.631 | 12.189 | −3.362 | 1.00 | 40.17 | C |
| ATOM | 970 | OG | SER | A | 125 | −2.812 | 11.397 | −4.524 | 1.00 | 45.30 | O |
| ATOM | 971 | N | VAL | A | 126 | −0.851 | 12.695 | −0.557 | 1.00 | 28.64 | N |
| ATOM | 972 | CA | VAL | A | 126 | −0.734 | 13.466 | 0.674 | 1.00 | 28.98 | C |
| ATOM | 973 | C | VAL | A | 126 | −0.444 | 14.927 | 0.363 | 1.00 | 33.93 | C |
| ATOM | 974 | O | VAL | A | 126 | 0.556 | 15.244 | −0.279 | 1.00 | 37.76 | O |
| ATOM | 975 | CB | VAL | A | 126 | 0.367 | 12.905 | 1.593 | 1.00 | 28.89 | C |
| ATOM | 976 | CG1 | VAL | A | 126 | 0.374 | 13.641 | 2.930 | 1.00 | 28.32 | C |
| ATOM | 977 | CG2 | VAL | A | 126 | 0.169 | 11.413 | 1.797 | 1.00 | 24.48 | C |
| ATOM | 978 | N | PHE | A | 127 | −1.325 | 15.809 | 0.825 | 1.00 | 29.15 | N |
| ATOM | 979 | CA | PHE | A | 127 | −1.212 | 17.236 | 0.557 | 1.00 | 31.17 | C |
| ATOM | 980 | C | PHE | A | 127 | −1.034 | 18.028 | 1.850 | 1.00 | 38.80 | C |
| ATOM | 981 | O | PHE | A | 127 | −1.578 | 17.657 | 2.892 | 1.00 | 31.26 | O |
| ATOM | 982 | CB | PHE | A | 127 | −2.448 | 17.739 | −0.198 | 1.00 | 29.74 | C |
| ATOM | 983 | CG | PHE | A | 127 | −2.709 | 17.013 | −1.484 | 1.00 | 32.93 | C |
| ATOM | 984 | CD1 | PHE | A | 127 | −1.798 | 17.076 | −2.529 | 1.00 | 36.91 | C |
| ATOM | 985 | CD2 | PHE | A | 127 | −3.869 | 16.275 | −1.657 | 1.00 | 33.66 | C |
| ATOM | 986 | CE1 | PHE | A | 127 | −2.033 | 16.407 | −3.718 | 1.00 | 30.94 | C |
| ATOM | 987 | CE2 | PHE | A | 127 | −4.114 | 15.605 | −2.848 | 1.00 | 38.29 | C |
| ATOM | 988 | CZ | PHE | A | 127 | −3.194 | 15.670 | −3.878 | 1.00 | 33.93 | C |
| ATOM | 989 | N | PRO | A | 128 | −0.278 | 19.134 | 1.785 | 1.00 | 38.69 | N |
| ATOM | 990 | CA | PRO | A | 128 | −0.029 | 19.931 | 2.990 | 1.00 | 31.44 | C |
| ATOM | 991 | C | PRO | A | 128 | −1.230 | 20.772 | 3.410 | 1.00 | 34.99 | C |
| ATOM | 992 | O | PRO | A | 128 | −1.930 | 21.318 | 2.562 | 1.00 | 36.42 | O |
| ATOM | 993 | CB | PRO | A | 128 | 1.136 | 20.832 | 2.575 | 1.00 | 35.21 | C |
| ATOM | 994 | CG | PRO | A | 128 | 0.966 | 20.997 | 1.104 | 1.00 | 31.99 | C |
| ATOM | 995 | CD | PRO | A | 128 | 0.395 | 19.694 | 0.598 | 1.00 | 31.14 | C |
| ATOM | 996 | N | LEU | A | 129 | −1.470 | 20.845 | 4.714 | 1.00 | 31.68 | N |
| ATOM | 997 | CA | LEU | A | 129 | −2.354 | 21.853 | 5.280 | 1.00 | 32.81 | C |
| ATOM | 998 | C | LEU | A | 129 | −1.451 | 22.903 | 5.908 | 1.00 | 29.54 | C |
| ATOM | 999 | O | LEU | A | 129 | −1.054 | 22.777 | 7.063 | 1.00 | 28.79 | O |
| ATOM | 1000 | CB | LEU | A | 129 | −3.309 | 21.249 | 6.314 | 1.00 | 28.35 | C |
| ATOM | 1001 | CG | LEU | A | 129 | −4.272 | 20.181 | 5.787 | 1.00 | 32.12 | C |
| ATOM | 1002 | CD1 | LEU | A | 129 | −5.104 | 19.577 | 6.917 | 1.00 | 27.87 | C |
| ATOM | 1003 | CD2 | LEU | A | 129 | −5.170 | 20.762 | 4.700 | 1.00 | 27.99 | C |
| ATOM | 1004 | N | ALA | A | 130 | −1.106 | 23.923 | 5.130 | 1.00 | 30.89 | N |
| ATOM | 1005 | CA | ALA | A | 130 | −0.044 | 24.853 | 5.509 | 1.00 | 38.77 | C |
| ATOM | 1006 | C | ALA | A | 130 | −0.484 | 25.820 | 6.595 | 1.00 | 37.50 | C |
| ATOM | 1007 | O | ALA | A | 130 | −1.576 | 26.378 | 6.524 | 1.00 | 41.37 | O |
| ATOM | 1008 | CB | ALA | A | 130 | 0.445 | 25.624 | 4.286 | 1.00 | 37.41 | C |
| ATOM | 1009 | N | PRO | A | 131 | 0.381 | 26.031 | 7.599 | 1.00 | 45.74 | N |
| ATOM | 1010 | CA | PRO | A | 131 | 0.059 | 26.928 | 8.714 | 1.00 | 46.02 | C |
| ATOM | 1011 | C | PRO | A | 131 | −0.111 | 28.370 | 8.245 | 1.00 | 52.71 | C |
| ATOM | 1012 | O | PRO | A | 131 | 0.650 | 28.845 | 7.397 | 1.00 | 47.91 | O |
| ATOM | 1013 | CB | PRO | A | 131 | 1.264 | 26.778 | 9.647 | 1.00 | 40.81 | C |

TABLE 10.2-continued

| ATOM | 1014 | CG  | PRO | A | 131 | 2.376  | 26.354 | 8.764  | 1.00 | 45.92  | C |
|------|------|-----|-----|---|-----|--------|--------|--------|------|--------|---|
| ATOM | 1015 | CD  | PRO | A | 131 | 1.751  | 25.499 | 7.694  | 1.00 | 43.34  | C |
| ATOM | 1016 | N   | SER | A | 132 | −1.117 | 29.043 | 8.793  | 1.00 | 55.56  | N |
| ATOM | 1017 | CA  | SER | A | 132 | −1.473 | 30.396 | 8.380  | 1.00 | 71.89  | C |
| ATOM | 1018 | C   | SER | A | 132 | −0.309 | 31.371 | 8.517  | 1.00 | 74.46  | C |
| ATOM | 1019 | O   | SER | A | 132 | 0.408  | 31.364 | 9.518  | 1.00 | 79.24  | O |
| ATOM | 1020 | CB  | SER | A | 132 | −2.670 | 30.896 | 9.198  | 1.00 | 76.95  | C |
| ATOM | 1021 | OG  | SER | A | 132 | −3.053 | 32.204 | 8.811  | 1.00 | 77.97  | O |
| ATOM | 1022 | N   | SER | A | 133 | −0.120 | 32.201 | 7.496  | 1.00 | 80.68  | N |
| ATOM | 1023 | CA  | SER | A | 133 | 0.838  | 33.296 | 7.575  | 1.00 | 89.81  | C |
| ATOM | 1024 | C   | SER | A | 133 | 0.309  | 34.331 | 8.560  | 1.00 | 95.47  | C |
| ATOM | 1025 | O   | SER | A | 133 | 1.072  | 35.087 | 9.166  | 1.00 | 92.23  | O |
| ATOM | 1026 | CB  | SER | A | 133 | 1.075  | 33.922 | 6.198  | 1.00 | 81.20  | C |
| ATOM | 1027 | OG  | SER | A | 133 | −0.144 | 34.340 | 5.609  | 1.00 | 74.80  | O |
| ATOM | 1028 | N   | LYS | A | 134 | −1.012 | 34.343 | 8.717  | 1.00 | 93.18  | N |
| ATOM | 1029 | CA  | LYS | A | 134 | −1.678 | 35.224 | 9.665  | 1.00 | 90.77  | C |
| ATOM | 1030 | C   | LYS | A | 134 | −1.923 | 34.525 | 11.001 | 1.00 | 94.50  | C |
| ATOM | 1031 | O   | LYS | A | 134 | −2.896 | 34.825 | 11.696 | 1.00 | 94.00  | O |
| ATOM | 1032 | CB  | LYS | A | 134 | −3.003 | 35.729 | 9.089  | 1.00 | 86.16  | C |
| ATOM | 1033 | CG  | LYS | A | 134 | −2.852 | 36.635 | 7.879  | 1.00 | 83.75  | C |
| ATOM | 1034 | CD  | LYS | A | 134 | −4.135 | 37.409 | 7.614  | 1.00 | 91.56  | C |
| ATOM | 1035 | CE  | LYS | A | 134 | −3.926 | 38.492 | 6.567  | 1.00 | 95.47  | C |
| ATOM | 1036 | NZ  | LYS | A | 134 | −5.110 | 39.389 | 6.446  | 1.00 | 88.66  | N |
| ATOM | 1037 | N   | SER | A | 135 | −1.045 | 33.588 | 11.353 | 1.00 | 96.11  | N |
| ATOM | 1038 | CA  | SER | A | 135 | −1.111 | 32.936 | 12.658 | 1.00 | 97.73  | C |
| ATOM | 1039 | C   | SER | A | 135 | −0.885 | 33.973 | 13.753 | 1.00 | 102.54 | C |
| ATOM | 1040 | O   | SER | A | 135 | −0.148 | 34.941 | 13.555 | 1.00 | 102.52 | O |
| ATOM | 1041 | CB  | SER | A | 135 | −0.077 | 31.810 | 12.768 | 1.00 | 83.08  | C |
| ATOM | 1042 | OG  | SER | A | 135 | −0.335 | 30.775 | 11.834 | 1.00 | 78.24  | O |
| ATOM | 1043 | N   | THR | A | 136 | −1.524 | 33.775 | 14.901 | 1.00 | 102.47 | N |
| ATOM | 1044 | CA  | THR | A | 136 | −1.399 | 34.717 | 16.009 | 1.00 | 105.40 | C |
| ATOM | 1045 | C   | THR | A | 136 | 0.030  | 34.741 | 16.550 | 1.00 | 104.11 | C |
| ATOM | 1046 | O   | THR | A | 136 | 0.518  | 33.744 | 17.085 | 1.00 | 99.44  | O |
| ATOM | 1047 | CB  | THR | A | 136 | −2.377 | 34.379 | 17.154 | 1.00 | 99.90  | C |
| ATOM | 1048 | CG2 | THR | A | 136 | −3.817 | 34.548 | 16.692 | 1.00 | 100.80 | C |
| ATOM | 1049 | OG1 | THR | A | 136 | −2.173 | 33.027 | 17.582 | 1.00 | 97.52  | O |
| ATOM | 1050 | N   | SER | A | 137 | 0.696  | 35.883 | 16.395 | 1.00 | 105.35 | N |
| ATOM | 1051 | CA  | SER | A | 137 | 2.071  | 36.049 | 16.858 | 1.00 | 104.45 | C |
| ATOM | 1052 | C   | SER | A | 137 | 2.168  | 35.866 | 18.370 | 1.00 | 102.60 | C |
| ATOM | 1053 | O   | SER | A | 137 | 1.517  | 36.580 | 19.135 | 1.00 | 98.58  | O |
| ATOM | 1054 | CB  | SER | A | 137 | 2.610  | 37.424 | 16.456 | 1.00 | 105.78 | C |
| ATOM | 1055 | OG  | SER | A | 137 | 2.624  | 37.578 | 15.047 | 1.00 | 96.80  | O |
| ATOM | 1056 | N   | GLY | A | 138 | 2.981  | 34.902 | 18.790 | 1.00 | 97.35  | N |
| ATOM | 1057 | CA  | GLY | A | 138 | 3.115  | 34.571 | 20.197 | 1.00 | 98.58  | C |
| ATOM | 1058 | C   | GLY | A | 138 | 1.978  | 33.692 | 20.685 | 1.00 | 99.72  | C |
| ATOM | 1059 | O   | GLY | A | 138 | 1.816  | 33.480 | 21.888 | 1.00 | 98.83  | O |
| ATOM | 1060 | N   | GLY | A | 139 | 1.188  | 33.180 | 19.744 | 1.00 | 93.81  | N |
| ATOM | 1061 | CA  | GLY | A | 139 | 0.044  | 32.348 | 20.066 | 1.00 | 77.07  | C |
| ATOM | 1062 | C   | GLY | A | 139 | 0.181  | 30.926 | 19.557 | 1.00 | 70.80  | C |
| ATOM | 1063 | O   | GLY | A | 139 | 1.247  | 30.316 | 19.662 | 1.00 | 65.42  | O |
| ATOM | 1064 | N   | THR | A | 140 | −0.904 | 30.398 | 18.998 | 1.00 | 65.95  | N |
| ATOM | 1065 | CA  | THR | A | 140 | −0.941 | 29.012 | 18.541 | 1.00 | 60.59  | C |
| ATOM | 1066 | C   | THR | A | 140 | −1.281 | 28.906 | 17.053 | 1.00 | 54.28  | C |
| ATOM | 1067 | O   | THR | A | 140 | −2.238 | 29.520 | 16.580 | 1.00 | 54.41  | O |
| ATOM | 1068 | CB  | THR | A | 140 | −1.963 | 28.189 | 19.360 | 1.00 | 57.65  | C |
| ATOM | 1069 | CG2 | THR | A | 140 | −2.218 | 26.832 | 18.719 | 1.00 | 45.39  | C |
| ATOM | 1070 | OG1 | THR | A | 140 | −1.463 | 27.993 | 20.689 | 1.00 | 65.11  | O |
| ATOM | 1071 | N   | ALA | A | 141 | −0.488 | 28.129 | 16.321 | 1.00 | 41.19  | N |
| ATOM | 1072 | CA  | ALA | A | 141 | −0.767 | 27.862 | 14.914 | 1.00 | 47.82  | C |
| ATOM | 1073 | C   | ALA | A | 141 | −1.193 | 26.410 | 14.708 | 1.00 | 39.86  | C |
| ATOM | 1074 | O   | ALA | A | 141 | −0.881 | 25.541 | 15.521 | 1.00 | 42.63  | O |
| ATOM | 1075 | CB  | ALA | A | 141 | 0.447  | 28.181 | 14.059 | 1.00 | 33.31  | C |
| ATOM | 1076 | N   | ALA | A | 142 | −1.911 | 26.151 | 13.621 | 1.00 | 35.54  | N |
| ATOM | 1077 | CA  | ALA | A | 142 | −2.279 | 24.787 | 13.265 | 1.00 | 32.56  | C |
| ATOM | 1078 | C   | ALA | A | 142 | −1.747 | 24.446 | 11.885 | 1.00 | 30.50  | C |
| ATOM | 1079 | O   | ALA | A | 142 | −1.761 | 25.276 | 10.978 | 1.00 | 39.38  | O |
| ATOM | 1080 | CB  | ALA | A | 142 | −3.791 | 24.600 | 13.317 | 1.00 | 33.11  | C |
| ATOM | 1081 | N   | LEU | A | 143 | −1.267 | 23.220 | 11.735 | 1.00 | 29.03  | N |
| ATOM | 1082 | CA  | LEU | A | 143 | −0.827 | 22.726 | 10.447 | 1.00 | 27.15  | C |
| ATOM | 1083 | C   | LEU | A | 143 | −1.214 | 21.263 | 10.343 | 1.00 | 29.85  | C |
| ATOM | 1084 | O   | LEU | A | 143 | −1.577 | 20.643 | 11.340 | 1.00 | 30.37  | O |
| ATOM | 1085 | CB  | LEU | A | 143 | 0.681  | 22.922 | 10.267 | 1.00 | 31.63  | C |
| ATOM | 1086 | CG  | LEU | A | 143 | 1.648  | 22.236 | 11.232 | 1.00 | 36.90  | C |
| ATOM | 1087 | CD1 | LEU | A | 143 | 2.145  | 20.915 | 10.665 | 1.00 | 35.87  | C |
| ATOM | 1088 | CD2 | LEU | A | 143 | 2.817  | 23.154 | 11.551 | 1.00 | 37.42  | C |
| ATOM | 1089 | N   | GLY | A | 144 | −1.155 | 20.708 | 9.140  | 1.00 | 25.86  | N |
| ATOM | 1090 | CA  | GLY | A | 144 | −1.542 | 19.327 | 8.968  | 1.00 | 28.52  | C |
| ATOM | 1091 | C   | GLY | A | 144 | −1.254 | 18.715 | 7.615  | 1.00 | 24.81  | C |
| ATOM | 1092 | O   | GLY | A | 144 | −0.577 | 19.300 | 6.774  | 1.00 | 28.21  | O |
| ATOM | 1093 | N   | CYS | A | 145 | −1.779 | 17.511 | 7.428  | 1.00 | 23.50  | N |

TABLE 10.2-continued

| | | | | | | | | | | |
|---|---|---|---|---|---|---|---|---|---|---|
| ATOM | 1094 | CA | CYS | A | 145 | −1.680 | 16.777 | 6.178 | 1.00 | 26.22 | C |
| ATOM | 1095 | C | CYS | A | 145 | −3.059 | 16.307 | 5.759 | 1.00 | 29.48 | C |
| ATOM | 1096 | O | CYS | A | 145 | −3.828 | 15.820 | 6.587 | 1.00 | 28.29 | O |
| ATOM | 1097 | CB | CYS | A | 145 | −0.745 | 15.567 | 6.317 | 1.00 | 32.48 | C |
| ATOM | 1098 | SG | CYS | A | 145 | 1.014 | 15.968 | 6.295 | 1.00 | 53.28 | S |
| ATOM | 1099 | N | LEU | A | 146 | −3.364 | 16.447 | 4.475 | 1.00 | 31.34 | N |
| ATOM | 1100 | CA | LEU | A | 146 | −4.579 | 15.883 | 3.911 | 1.00 | 25.63 | C |
| ATOM | 1101 | C | LEU | A | 146 | −4.235 | 14.603 | 3.157 | 1.00 | 30.29 | C |
| ATOM | 1102 | O | LEU | A | 146 | −3.490 | 14.627 | 2.177 | 1.00 | 34.41 | O |
| ATOM | 1103 | CB | LEU | A | 146 | −5.265 | 16.895 | 2.991 | 1.00 | 30.65 | C |
| ATOM | 1104 | CG | LEU | A | 146 | −6.575 | 16.493 | 2.311 | 1.00 | 36.27 | C |
| ATOM | 1105 | CD1 | LEU | A | 146 | −7.664 | 16.170 | 3.329 | 1.00 | 29.24 | C |
| ATOM | 1106 | CD2 | LEU | A | 146 | −7.027 | 17.607 | 1.378 | 1.00 | 36.45 | C |
| ATOM | 1107 | N | VAL | A | 147 | −4.772 | 13.485 | 3.628 | 1.00 | 30.39 | N |
| ATOM | 1108 | CA | VAL | A | 147 | −4.504 | 12.182 | 3.033 | 1.00 | 27.86 | C |
| ATOM | 1109 | C | VAL | A | 147 | −5.700 | 11.750 | 2.184 | 1.00 | 27.94 | C |
| ATOM | 1110 | O | VAL | A | 147 | −6.718 | 11.321 | 2.711 | 1.00 | 33.43 | O |
| ATOM | 1111 | CB | VAL | A | 147 | −4.209 | 11.143 | 4.123 | 1.00 | 30.05 | C |
| ATOM | 1112 | CG1 | VAL | A | 147 | −3.807 | 9.811 | 3.509 | 1.00 | 31.17 | C |
| ATOM | 1113 | CG2 | VAL | A | 147 | −3.116 | 11.661 | 5.053 | 1.00 | 29.02 | C |
| ATOM | 1114 | N | LYS | A | 148 | −5.579 | 11.870 | 0.866 | 1.00 | 32.05 | N |
| ATOM | 1115 | CA | LYS | A | 148 | −6.760 | 11.820 | 0.010 | 1.00 | 38.00 | C |
| ATOM | 1116 | C | LYS | A | 148 | −6.740 | 10.696 | −1.026 | 1.00 | 35.47 | C |
| ATOM | 1117 | O | LYS | A | 148 | −5.685 | 10.328 | −1.539 | 1.00 | 38.98 | O |
| ATOM | 1118 | CB | LYS | A | 148 | −6.935 | 13.172 | −0.697 | 1.00 | 39.17 | C |
| ATOM | 1119 | CG | LYS | A | 148 | −8.280 | 13.343 | −1.383 | 1.00 | 47.97 | C |
| ATOM | 1120 | CD | LYS | A | 148 | −8.527 | 14.785 | −1.779 | 1.00 | 41.88 | C |
| ATOM | 1121 | CE | LYS | A | 148 | −9.901 | 14.951 | −2.417 | 1.00 | 51.38 | C |
| ATOM | 1122 | NZ | LYS | A | 148 | −10.035 | 14.191 | −3.688 | 1.00 | 52.46 | N |
| ATOM | 1123 | N | ASP | A | 149 | −7.929 | 10.160 | −1.309 | 1.00 | 39.61 | N |
| ATOM | 1124 | CA | ASP | A | 149 | −8.162 | 9.206 | −2.398 | 1.00 | 36.49 | C |
| ATOM | 1125 | C | ASP | A | 149 | −7.423 | 7.886 | −2.225 | 1.00 | 40.38 | C |
| ATOM | 1126 | O | ASP | A | 149 | −6.620 | 7.499 | −3.076 | 1.00 | 38.28 | O |
| ATOM | 1127 | CB | ASP | A | 149 | −7.779 | 9.829 | −3.748 | 1.00 | 35.81 | C |
| ATOM | 1128 | CG | ASP | A | 149 | −8.690 | 10.975 | −4.139 | 1.00 | 44.23 | C |
| ATOM | 1129 | OD1 | ASP | A | 149 | −9.834 | 11.014 | −3.642 | 1.00 | 45.39 | O |
| ATOM | 1130 | OD2 | ASP | A | 149 | −8.265 | 11.835 | −4.940 | 1.00 | 51.78 | O |
| ATOM | 1131 | N | TYR | A | 150 | −7.702 | 7.185 | −1.133 | 1.00 | 28.61 | N |
| ATOM | 1132 | CA | TYR | A | 150 | −7.115 | 5.872 | −0.950 | 1.00 | 31.03 | C |
| ATOM | 1133 | C | TYR | A | 150 | −8.197 | 4.827 | −0.728 | 1.00 | 38.37 | C |
| ATOM | 1134 | O | TYR | A | 150 | −9.354 | 5.159 | −0.456 | 1.00 | 36.04 | O |
| ATOM | 1135 | CB | TYR | A | 150 | −6.113 | 5.872 | 0.212 | 1.00 | 29.48 | C |
| ATOM | 1136 | CG | TYR | A | 150 | −6.713 | 6.143 | 1.571 | 1.00 | 32.63 | C |
| ATOM | 1137 | CD1 | TYR | A | 150 | −6.837 | 7.439 | 2.051 | 1.00 | 31.16 | C |
| ATOM | 1138 | CD2 | TYR | A | 150 | −7.145 | 5.100 | 2.380 | 1.00 | 34.56 | C |
| ATOM | 1139 | CE1 | TYR | A | 150 | −7.381 | 7.689 | 3.295 | 1.00 | 26.37 | C |
| ATOM | 1140 | CE2 | TYR | A | 150 | −7.691 | 5.340 | 3.625 | 1.00 | 30.49 | C |
| ATOM | 1141 | CZ | TYR | A | 150 | −7.804 | 6.633 | 4.079 | 1.00 | 32.92 | C |
| ATOM | 1142 | OH | TYR | A | 150 | −8.347 | 6.865 | 5.322 | 1.00 | 33.53 | O |
| ATOM | 1143 | N | PHE | A | 151 | −7.807 | 3.565 | −0.866 | 1.00 | 30.04 | N |
| ATOM | 1144 | CA | PHE | A | 151 | −8.699 | 2.437 | −0.650 | 1.00 | 32.42 | C |
| ATOM | 1145 | C | PHE | A | 151 | −7.861 | 1.173 | −0.518 | 1.00 | 32.34 | C |
| ATOM | 1146 | O | PHE | A | 151 | −6.895 | 0.992 | −1.258 | 1.00 | 38.41 | O |
| ATOM | 1147 | CB | PHE | A | 151 | −9.708 | 2.298 | −1.799 | 1.00 | 32.75 | C |
| ATOM | 1148 | CG | PHE | A | 151 | −10.788 | 1.287 | −1.535 | 1.00 | 35.46 | C |
| ATOM | 1149 | CD2 | PHE | A | 151 | −11.978 | 1.669 | −0.936 | 1.00 | 38.75 | C |
| ATOM | 1150 | CD1 | PHE | A | 151 | −10.605 | −0.047 | −1.863 | 1.00 | 36.37 | C |
| ATOM | 1151 | CE2 | PHE | A | 151 | −12.969 | 0.743 | −0.676 | 1.00 | 37.03 | C |
| ATOM | 1152 | CE1 | PHE | A | 151 | −11.595 | −0.981 | −1.605 | 1.00 | 36.99 | C |
| ATOM | 1153 | CZ | PHE | A | 151 | −12.777 | −0.584 | −1.013 | 1.00 | 38.87 | C |
| ATOM | 1154 | N | PRO | A | 152 | −8.207 | 0.307 | 0.446 | 1.00 | 36.93 | N |
| ATOM | 1155 | CA | PRO | A | 152 | −9.241 | 0.535 | 1.456 | 1.00 | 33.39 | C |
| ATOM | 1156 | C | PRO | A | 152 | −8.638 | 1.119 | 2.726 | 1.00 | 36.06 | C |
| ATOM | 1157 | O | PRO | A | 152 | −7.493 | 1.579 | 2.706 | 1.00 | 30.72 | O |
| ATOM | 1158 | CB | PRO | A | 152 | −9.775 | −0.869 | 1.707 | 1.00 | 35.39 | C |
| ATOM | 1159 | CG | PRO | A | 152 | −8.534 | −1.711 | 1.609 | 1.00 | 34.66 | C |
| ATOM | 1160 | CD | PRO | A | 152 | −7.652 | −1.056 | 0.552 | 1.00 | 34.24 | C |
| ATOM | 1161 | N | GLU | A | 153 | −9.400 | 1.095 | 3.816 | 1.00 | 31.54 | N |
| ATOM | 1162 | CA | GLU | A | 153 | −8.855 | 1.413 | 5.132 | 1.00 | 35.20 | C |
| ATOM | 1163 | C | GLU | A | 153 | −7.853 | 0.323 | 5.528 | 1.00 | 30.90 | C |
| ATOM | 1164 | O | GLU | A | 153 | −7.918 | −0.790 | 5.012 | 1.00 | 30.88 | O |
| ATOM | 1165 | CB | GLU | A | 153 | −9.979 | 1.531 | 6.170 | 1.00 | 34.19 | C |
| ATOM | 1166 | CG | GLU | A | 153 | −10.884 | 2.735 | 5.978 | 1.00 | 30.47 | C |
| ATOM | 1167 | CD | GLU | A | 153 | −10.607 | 3.838 | 6.980 | 1.00 | 49.19 | C |
| ATOM | 1168 | OE1 | GLU | A | 153 | −11.550 | 4.226 | 7.705 | 1.00 | 56.79 | O |
| ATOM | 1169 | OE2 | GLU | A | 153 | −9.452 | 4.323 | 7.042 | 1.00 | 53.78 | O |
| ATOM | 1170 | N | PRO | A | 154 | −6.923 | 0.634 | 6.444 | 1.00 | 31.40 | N |
| ATOM | 1171 | CA | PRO | A | 154 | −6.719 | 1.915 | 7.118 | 1.00 | 33.58 | C |
| ATOM | 1172 | C | PRO | A | 154 | −5.436 | 2.624 | 6.692 | 1.00 | 34.09 | C |
| ATOM | 1173 | O | PRO | A | 154 | −4.576 | 2.024 | 6.047 | 1.00 | 33.03 | O |

TABLE 10.2-continued

| | | | | | | | | | | |
|---|---|---|---|---|---|---|---|---|---|---|
| ATOM | 1174 | CB | PRO | A | 154 | −6.614 | 1.494 | 8.576 | 1.00 | 27.86 | C |
| ATOM | 1175 | CG | PRO | A | 154 | −5.808 | 0.210 | 8.476 | 1.00 | 30.94 | C |
| ATOM | 1176 | CD | PRO | A | 154 | −6.178 | −0.435 | 7.133 | 1.00 | 33.22 | C |
| ATOM | 1177 | N | VAL | A | 155 | −5.306 | 3.892 | 7.059 | 1.00 | 34.38 | N |
| ATOM | 1178 | CA | VAL | A | 155 | −4.006 | 4.540 | 7.013 | 1.00 | 35.85 | C |
| ATOM | 1179 | C | VAL | A | 155 | −3.648 | 4.982 | 8.420 | 1.00 | 35.04 | C |
| ATOM | 1180 | O | VAL | A | 155 | −4.525 | 5.310 | 9.219 | 1.00 | 34.51 | O |
| ATOM | 1181 | CB | VAL | A | 155 | −3.966 | 5.755 | 6.060 | 1.00 | 36.38 | C |
| ATOM | 1182 | CG1 | VAL | A | 155 | −4.367 | 5.351 | 4.656 | 1.00 | 37.19 | C |
| ATOM | 1183 | CG2 | VAL | A | 155 | −4.850 | 6.870 | 6.572 | 1.00 | 41.10 | C |
| ATOM | 1184 | N | THR | A | 156 | −2.358 | 4.966 | 8.730 | 1.00 | 32.78 | N |
| ATOM | 1185 | CA | THR | A | 156 | −1.887 | 5.503 | 9.994 | 1.00 | 29.21 | C |
| ATOM | 1186 | C | THR | A | 156 | −1.074 | 6.759 | 9.733 | 1.00 | 35.34 | C |
| ATOM | 1187 | O | THR | A | 156 | −0.448 | 6.916 | 8.675 | 1.00 | 29.04 | O |
| ATOM | 1188 | CB | THR | A | 156 | −1.034 | 4.487 | 10.785 | 1.00 | 34.00 | C |
| ATOM | 1189 | CG2 | THR | A | 156 | −1.843 | 3.230 | 11.088 | 1.00 | 33.80 | C |
| ATOM | 1190 | OG1 | THR | A | 156 | 0.132 | 4.140 | 10.028 | 1.00 | 35.62 | O |
| ATOM | 1191 | N | VAL | A | 157 | −1.099 | 7.665 | 10.700 | 1.00 | 27.89 | N |
| ATOM | 1192 | CA | VAL | A | 157 | −0.375 | 8.916 | 10.582 | 1.00 | 33.47 | C |
| ATOM | 1193 | C | VAL | A | 157 | 0.370 | 9.197 | 11.867 | 1.00 | 28.46 | C |
| ATOM | 1194 | O | VAL | A | 157 | −0.216 | 9.168 | 12.949 | 1.00 | 36.97 | O |
| ATOM | 1195 | CB | VAL | A | 157 | −1.319 | 10.100 | 10.276 | 1.00 | 28.34 | C |
| ATOM | 1196 | CG1 | VAL | A | 157 | −0.523 | 11.395 | 10.154 | 1.00 | 28.04 | C |
| ATOM | 1197 | CG2 | VAL | A | 157 | −2.120 | 9.833 | 9.011 | 1.00 | 26.05 | C |
| ATOM | 1198 | N | SER | A | 158 | 1.665 | 9.455 | 11.752 | 1.00 | 30.73 | N |
| ATOM | 1199 | CA | SER | A | 158 | 2.429 | 9.964 | 12.880 | 1.00 | 36.51 | C |
| ATOM | 1200 | C | SER | A | 158 | 3.087 | 11.267 | 12.461 | 1.00 | 32.08 | C |
| ATOM | 1201 | O | SER | A | 158 | 3.162 | 11.571 | 11.270 | 1.00 | 30.98 | O |
| ATOM | 1202 | CB | SER | A | 158 | 3.476 | 8.951 | 13.347 | 1.00 | 35.17 | C |
| ATOM | 1203 | OG | SER | A | 158 | 4.538 | 8.848 | 12.419 | 1.00 | 40.81 | O |
| ATOM | 1204 | N | TRP | A | 159 | 3.546 | 12.040 | 13.440 | 1.00 | 27.85 | N |
| ATOM | 1205 | CA | TRP | A | 159 | 4.263 | 13.276 | 13.166 | 1.00 | 30.67 | C |
| ATOM | 1206 | C | TRP | A | 159 | 5.684 | 13.207 | 13.707 | 1.00 | 31.39 | C |
| ATOM | 1207 | O | TRP | A | 159 | 5.900 | 12.792 | 14.845 | 1.00 | 30.84 | O |
| ATOM | 1208 | CB | TRP | A | 159 | 3.519 | 14.470 | 13.761 | 1.00 | 28.15 | C |
| ATOM | 1209 | CG | TRP | A | 159 | 2.278 | 14.795 | 13.004 | 1.00 | 35.31 | C |
| ATOM | 1210 | CD1 | TRP | A | 159 | 1.049 | 14.237 | 13.170 | 1.00 | 31.91 | C |
| ATOM | 1211 | CD2 | TRP | A | 159 | 2.149 | 15.745 | 11.942 | 1.00 | 33.46 | C |
| ATOM | 1212 | CE2 | TRP | A | 159 | 0.807 | 15.716 | 11.518 | 1.00 | 32.34 | C |
| ATOM | 1213 | CE3 | TRP | A | 159 | 3.038 | 16.620 | 11.310 | 1.00 | 33.99 | C |
| ATOM | 1214 | NE1 | TRP | A | 159 | 0.157 | 14.784 | 12.283 | 1.00 | 31.36 | N |
| ATOM | 1215 | CZ2 | TRP | A | 159 | 0.331 | 16.526 | 10.489 | 1.00 | 30.53 | C |
| ATOM | 1216 | CZ3 | TRP | A | 159 | 2.565 | 17.423 | 10.289 | 1.00 | 30.89 | C |
| ATOM | 1217 | CH2 | TRP | A | 159 | 1.223 | 17.372 | 9.890 | 1.00 | 33.28 | C |
| ATOM | 1218 | N | ASN | A | 160 | 6.639 | 13.617 | 12.875 | 1.00 | 26.79 | N |
| ATOM | 1219 | CA | ASN | A | 160 | 8.061 | 13.584 | 13.208 | 1.00 | 28.03 | C |
| ATOM | 1220 | C | ASN | A | 160 | 8.491 | 12.236 | 13.778 | 1.00 | 33.44 | C |
| ATOM | 1221 | O | ASN | A | 160 | 9.200 | 12.171 | 14.784 | 1.00 | 32.52 | O |
| ATOM | 1222 | CB | ASN | A | 160 | 8.405 | 14.708 | 14.185 | 1.00 | 27.50 | C |
| ATOM | 1223 | CG | ASN | A | 160 | 8.269 | 16.078 | 13.559 | 1.00 | 30.24 | C |
| ATOM | 1224 | ND2 | ASN | A | 160 | 8.292 | 17.119 | 14.385 | 1.00 | 34.83 | N |
| ATOM | 1225 | OD1 | ASN | A | 160 | 8.153 | 16.199 | 12.342 | 1.00 | 37.06 | O |
| ATOM | 1226 | N | SER | A | 161 | 8.026 | 11.168 | 13.135 | 1.00 | 32.54 | N |
| ATOM | 1227 | CA | SER | A | 161 | 8.394 | 9.801 | 13.492 | 1.00 | 38.63 | C |
| ATOM | 1228 | C | SER | A | 161 | 7.988 | 9.425 | 14.916 | 1.00 | 37.84 | C |
| ATOM | 1229 | O | SER | A | 161 | 8.601 | 8.556 | 15.530 | 1.00 | 36.85 | O |
| ATOM | 1230 | CB | SER | A | 161 | 9.901 | 9.598 | 13.310 | 1.00 | 33.00 | C |
| ATOM | 1231 | OG | SER | A | 161 | 10.292 | 9.901 | 11.983 | 1.00 | 36.60 | O |
| ATOM | 1232 | N | GLY | A | 162 | 6.951 | 10.074 | 15.434 | 1.00 | 33.46 | N |
| ATOM | 1233 | CA | GLY | A | 162 | 6.456 | 9.771 | 16.764 | 1.00 | 33.72 | C |
| ATOM | 1234 | C | GLY | A | 162 | 7.005 | 10.686 | 17.843 | 1.00 | 35.30 | C |
| ATOM | 1235 | O | GLY | A | 162 | 6.639 | 10.568 | 19.011 | 1.00 | 42.69 | O |
| ATOM | 1236 | N | ALA | A | 163 | 7.885 | 11.602 | 17.457 | 1.00 | 37.22 | N |
| ATOM | 1237 | CA | ALA | A | 163 | 8.439 | 12.561 | 18.405 | 1.00 | 36.88 | C |
| ATOM | 1238 | C | ALA | A | 163 | 7.428 | 13.661 | 18.725 | 1.00 | 41.59 | C |
| ATOM | 1239 | O | ALA | A | 163 | 7.524 | 14.318 | 19.762 | 1.00 | 40.49 | O |
| ATOM | 1240 | CB | ALA | A | 163 | 9.725 | 13.165 | 17.865 | 1.00 | 30.59 | C |
| ATOM | 1241 | N | LEU | A | 164 | 6.460 | 13.858 | 17.833 | 1.00 | 36.52 | N |
| ATOM | 1242 | CA | LEU | A | 164 | 5.423 | 14.863 | 18.052 | 1.00 | 35.71 | C |
| ATOM | 1243 | C | LEU | A | 164 | 4.089 | 14.180 | 18.333 | 1.00 | 36.12 | C |
| ATOM | 1244 | O | LEU | A | 164 | 3.517 | 13.513 | 17.468 | 1.00 | 35.37 | O |
| ATOM | 1245 | CB | LEU | A | 164 | 5.316 | 15.802 | 16.849 | 1.00 | 30.79 | C |
| ATOM | 1246 | CG | LEU | A | 164 | 4.328 | 16.965 | 16.961 | 1.00 | 36.59 | C |
| ATOM | 1247 | CD1 | LEU | A | 164 | 4.537 | 17.756 | 18.256 | 1.00 | 36.35 | C |
| ATOM | 1248 | CD2 | LEU | A | 164 | 4.450 | 17.875 | 15.752 | 1.00 | 33.18 | C |
| ATOM | 1249 | N | THR | A | 165 | 3.601 | 14.359 | 19.555 | 1.00 | 33.05 | N |
| ATOM | 1250 | CA | THR | A | 165 | 2.442 | 13.623 | 20.048 | 1.00 | 39.48 | C |
| ATOM | 1251 | C | THR | A | 165 | 1.347 | 14.555 | 20.562 | 1.00 | 39.43 | C |
| ATOM | 1252 | O | THR | A | 165 | 0.164 | 14.353 | 20.285 | 1.00 | 39.07 | O |
| ATOM | 1253 | CB | THR | A | 165 | 2.864 | 12.646 | 21.174 | 1.00 | 34.92 | C |

TABLE 10.2-continued

| | | | | | | | | | | |
|---|---|---|---|---|---|---|---|---|---|---|
| ATOM | 1254 | CG2 | THR | A | 165 | 1.693 | 12.309 | 22.089 | 1.00 | 52.65 | C |
| ATOM | 1255 | OG1 | THR | A | 165 | 3.367 | 11.442 | 20.588 | 1.00 | 50.23 | O |
| ATOM | 1256 | N | SER | A | 166 | 1.750 | 15.577 | 21.308 | 1.00 | 33.38 | N |
| ATOM | 1257 | CA | SER | A | 166 | 0.804 | 16.495 | 21.930 | 1.00 | 35.48 | C |
| ATOM | 1258 | C | SER | A | 166 | 0.202 | 17.452 | 20.915 | 1.00 | 34.11 | C |
| ATOM | 1259 | O | SER | A | 166 | 0.920 | 18.061 | 20.123 | 1.00 | 37.38 | O |
| ATOM | 1260 | CB | SER | A | 166 | 1.487 | 17.285 | 23.047 | 1.00 | 37.23 | C |
| ATOM | 1261 | OG | SER | A | 166 | 2.094 | 16.406 | 23.982 | 1.00 | 58.12 | O |
| ATOM | 1262 | N | GLY | A | 167 | −1.120 | 17.583 | 20.945 | 1.00 | 36.94 | N |
| ATOM | 1263 | CA | GLY | A | 167 | −1.809 | 18.532 | 20.090 | 1.00 | 35.05 | C |
| ATOM | 1264 | C | GLY | A | 167 | −2.196 | 17.943 | 18.750 | 1.00 | 38.60 | C |
| ATOM | 1265 | O | GLY | A | 167 | −2.701 | 18.650 | 17.879 | 1.00 | 38.31 | O |
| ATOM | 1266 | N | VAL | A | 168 | −1.965 | 16.643 | 18.586 | 1.00 | 35.11 | N |
| ATOM | 1267 | CA | VAL | A | 168 | −2.262 | 15.968 | 17.328 | 1.00 | 34.52 | C |
| ATOM | 1268 | C | VAL | A | 168 | −3.690 | 15.438 | 17.297 | 1.00 | 33.72 | C |
| ATOM | 1269 | O | VAL | A | 168 | −4.145 | 14.801 | 18.242 | 1.00 | 33.06 | O |
| ATOM | 1270 | CB | VAL | A | 168 | −1.295 | 14.792 | 17.074 | 1.00 | 34.33 | C |
| ATOM | 1271 | CG1 | VAL | A | 168 | −1.662 | 14.059 | 15.783 | 1.00 | 32.11 | C |
| ATOM | 1272 | CG2 | VAL | A | 168 | 0.141 | 15.285 | 17.027 | 1.00 | 30.55 | C |
| ATOM | 1273 | N | HIS | A | 169 | −4.392 | 15.712 | 16.203 | 1.00 | 34.59 | N |
| ATOM | 1274 | CA | HIS | A | 169 | −5.693 | 15.108 | 15.953 | 1.00 | 33.15 | C |
| ATOM | 1275 | C | HIS | A | 169 | −5.701 | 14.463 | 14.577 | 1.00 | 34.43 | C |
| ATOM | 1276 | O | HIS | A | 169 | −5.556 | 15.147 | 13.561 | 1.00 | 32.61 | O |
| ATOM | 1277 | CB | HIS | A | 169 | −6.822 | 16.140 | 16.039 | 1.00 | 33.41 | C |
| ATOM | 1278 | CG | HIS | A | 169 | −7.036 | 16.702 | 17.409 | 1.00 | 38.03 | C |
| ATOM | 1279 | CD2 | HIS | A | 169 | −6.891 | 17.961 | 17.887 | 1.00 | 35.39 | C |
| ATOM | 1280 | ND1 | HIS | A | 169 | −7.482 | 15.940 | 18.467 | 1.00 | 45.83 | N |
| ATOM | 1281 | CE1 | HIS | A | 169 | −7.592 | 16.702 | 19.541 | 1.00 | 37.15 | C |
| ATOM | 1282 | NE2 | HIS | A | 169 | −7.240 | 17.933 | 19.215 | 1.00 | 39.39 | N |
| ATOM | 1283 | N | THR | A | 170 | −5.857 | 13.145 | 14.551 | 1.00 | 33.36 | N |
| ATOM | 1284 | CA | THR | A | 170 | −6.059 | 12.424 | 13.304 | 1.00 | 31.63 | C |
| ATOM | 1285 | C | THR | A | 170 | −7.525 | 12.030 | 13.217 | 1.00 | 32.95 | C |
| ATOM | 1286 | O | THR | A | 170 | −8.032 | 11.288 | 14.056 | 1.00 | 37.08 | O |
| ATOM | 1287 | CB | THR | A | 170 | −5.168 | 11.178 | 13.200 | 1.00 | 35.35 | C |
| ATOM | 1288 | CG2 | THR | A | 170 | −5.437 | 10.439 | 11.895 | 1.00 | 29.64 | C |
| ATOM | 1289 | OG1 | THR | A | 170 | −3.792 | 11.576 | 13.246 | 1.00 | 35.66 | O |
| ATOM | 1290 | N | PHE | A | 171 | −8.202 | 12.553 | 12.204 | 1.00 | 30.34 | N |
| ATOM | 1291 | CA | PHE | A | 171 | −9.641 | 12.398 | 12.076 | 1.00 | 30.60 | C |
| ATOM | 1292 | C | PHE | A | 171 | −10.036 | 11.082 | 11.422 | 1.00 | 29.79 | C |
| ATOM | 1293 | O | PHE | A | 171 | −9.297 | 10.551 | 10.597 | 1.00 | 31.35 | O |
| ATOM | 1294 | CB | PHE | A | 171 | −10.214 | 13.574 | 11.286 | 1.00 | 23.31 | C |
| ATOM | 1295 | CG | PHE | A | 171 | −10.141 | 14.874 | 12.024 | 1.00 | 25.50 | C |
| ATOM | 1296 | CD2 | PHE | A | 171 | −11.197 | 15.295 | 12.810 | 1.00 | 29.91 | C |
| ATOM | 1297 | CD1 | PHE | A | 171 | −9.004 | 15.662 | 11.957 | 1.00 | 31.55 | C |
| ATOM | 1298 | CE2 | PHE | A | 171 | −11.133 | 16.488 | 13.502 | 1.00 | 30.68 | C |
| ATOM | 1299 | CE1 | PHE | A | 171 | −8.931 | 16.856 | 12.647 | 1.00 | 36.15 | C |
| ATOM | 1300 | CZ | PHE | A | 171 | −10.001 | 17.269 | 13.422 | 1.00 | 30.59 | C |
| ATOM | 1301 | N | PRO | A | 172 | −11.204 | 10.546 | 11.805 | 1.00 | 35.35 | N |
| ATOM | 1302 | CA | PRO | A | 172 | −11.781 | 9.388 | 11.117 | 1.00 | 36.50 | C |
| ATOM | 1303 | C | PRO | A | 172 | −11.928 | 9.670 | 9.627 | 1.00 | 36.86 | C |
| ATOM | 1304 | O | PRO | A | 172 | −12.265 | 10.794 | 9.253 | 1.00 | 33.48 | O |
| ATOM | 1305 | CB | PRO | A | 172 | −13.151 | 9.225 | 11.784 | 1.00 | 32.84 | C |
| ATOM | 1306 | CG | PRO | A | 172 | −12.979 | 9.826 | 13.137 | 1.00 | 36.13 | C |
| ATOM | 1307 | CD | PRO | A | 172 | −12.018 | 10.968 | 12.961 | 1.00 | 33.84 | C |
| ATOM | 1308 | N | ALA | A | 173 | −11.661 | 8.675 | 8.791 | 1.00 | 32.35 | N |
| ATOM | 1309 | CA | ALA | A | 173 | −11.783 | 8.850 | 7.349 | 1.00 | 35.00 | C |
| ATOM | 1310 | C | ALA | A | 173 | −13.237 | 9.021 | 6.930 | 1.00 | 34.52 | C |
| ATOM | 1311 | O | ALA | A | 173 | −14.132 | 8.415 | 7.516 | 1.00 | 37.71 | O |
| ATOM | 1312 | CB | ALA | A | 173 | −11.168 | 7.666 | 6.618 | 1.00 | 34.54 | C |
| ATOM | 1313 | N | VAL | A | 174 | −13.473 | 9.849 | 5.920 | 1.00 | 33.54 | N |
| ATOM | 1314 | CA | VAL | A | 174 | −14.792 | 9.909 | 5.307 | 1.00 | 33.28 | C |
| ATOM | 1315 | C | VAL | A | 174 | −14.737 | 9.250 | 3.939 | 1.00 | 35.09 | C |
| ATOM | 1316 | O | VAL | A | 174 | −13.734 | 9.348 | 3.223 | 1.00 | 34.87 | O |
| ATOM | 1317 | CB | VAL | A | 174 | −15.320 | 11.360 | 5.171 | 1.00 | 32.47 | C |
| ATOM | 1318 | CG1 | VAL | A | 174 | −15.378 | 12.032 | 6.534 | 1.00 | 40.37 | C |
| ATOM | 1319 | CG2 | VAL | A | 174 | −14.469 | 12.168 | 4.196 | 1.00 | 37.12 | C |
| ATOM | 1320 | N | LEU | A | 175 | −15.809 | 8.550 | 3.591 | 1.00 | 40.76 | N |
| ATOM | 1321 | CA | LEU | A | 175 | −15.921 | 7.932 | 2.280 | 1.00 | 38.53 | C |
| ATOM | 1322 | C | LEU | A | 175 | −16.501 | 8.941 | 1.300 | 1.00 | 37.30 | C |
| ATOM | 1323 | O | LEU | A | 175 | −17.605 | 9.447 | 1.494 | 1.00 | 43.25 | O |
| ATOM | 1324 | CB | LEU | A | 175 | −16.788 | 6.669 | 2.344 | 1.00 | 37.54 | C |
| ATOM | 1325 | CG | LEU | A | 175 | −16.905 | 5.864 | 1.047 | 1.00 | 40.58 | C |
| ATOM | 1326 | CD1 | LEU | A | 175 | −15.529 | 5.519 | 0.504 | 1.00 | 37.07 | C |
| ATOM | 1327 | CD2 | LEU | A | 175 | −17.733 | 4.598 | 1.258 | 1.00 | 43.41 | C |
| ATOM | 1328 | N | GLN | A | 176 | −15.744 | 9.239 | 0.252 | 1.00 | 44.15 | N |
| ATOM | 1329 | CA | GLN | A | 176 | −16.163 | 10.211 | −0.746 | 1.00 | 37.45 | C |
| ATOM | 1330 | C | GLN | A | 176 | −17.095 | 9.569 | −1.769 | 1.00 | 44.09 | C |
| ATOM | 1331 | O | GLN | A | 176 | −17.298 | 8.356 | −1.756 | 1.00 | 44.31 | O |
| ATOM | 1332 | CB | GLN | A | 176 | −14.941 | 10.815 | −1.439 | 1.00 | 39.61 | C |
| ATOM | 1333 | CG | GLN | A | 176 | −13.940 | 11.448 | −0.480 | 1.00 | 41.98 | C |

TABLE 10.2-continued

| | | | | | | | | | | |
|---|---|---|---|---|---|---|---|---|---|---|
| ATOM | 1334 | CD | GLN | A | 176 | −12.634 | 11.818 | −1.160 | 1.00 | 45.48 | C |
| ATOM | 1335 | NE2 | GLN | A | 176 | −11.917 | 10.813 | −1.655 | 1.00 | 33.19 | N |
| ATOM | 1336 | OE1 | GLN | A | 176 | −12.270 | 12.993 | −1.231 | 1.00 | 52.08 | O |
| ATOM | 1337 | N | SER | A | 177 | −17.655 | 10.390 | −2.655 | 1.00 | 43.50 | N |
| ATOM | 1338 | CA | SER | A | 177 | −18.571 | 9.913 | −3.690 | 1.00 | 44.39 | C |
| ATOM | 1339 | C | SER | A | 177 | −17.886 | 8.978 | −4.679 | 1.00 | 42.75 | C |
| ATOM | 1340 | O | SER | A | 177 | −18.534 | 8.157 | −5.323 | 1.00 | 48.60 | O |
| ATOM | 1341 | CB | SER | A | 177 | −19.180 | 11.096 | −4.443 | 1.00 | 49.14 | C |
| ATOM | 1342 | OG | SER | A | 177 | −19.961 | 11.895 | −3.575 | 1.00 | 52.77 | O |
| ATOM | 1343 | N | SER | A | 178 | −16.571 | 9.116 | −4.793 | 1.00 | 39.08 | N |
| ATOM | 1344 | CA | SER | A | 178 | −15.780 | 8.312 | −5.714 | 1.00 | 38.13 | C |
| ATOM | 1345 | C | SER | A | 178 | −15.542 | 6.890 | −5.215 | 1.00 | 39.53 | C |
| ATOM | 1346 | O | SER | A | 178 | −14.972 | 6.064 | −5.930 | 1.00 | 46.28 | O |
| ATOM | 1347 | CB | SER | A | 178 | −14.435 | 8.991 | −5.957 | 1.00 | 43.23 | C |
| ATOM | 1348 | OG | SER | A | 178 | −13.792 | 9.255 | −4.720 | 1.00 | 49.71 | O |
| ATOM | 1349 | N | GLY | A | 179 | −15.960 | 6.608 | −3.985 | 1.00 | 41.09 | N |
| ATOM | 1350 | CA | GLY | A | 179 | −15.696 | 5.317 | −3.379 | 1.00 | 35.99 | C |
| ATOM | 1351 | C | GLY | A | 179 | −14.316 | 5.259 | −2.746 | 1.00 | 41.20 | C |
| ATOM | 1352 | O | GLY | A | 179 | −13.882 | 4.210 | −2.266 | 1.00 | 37.34 | O |
| ATOM | 1353 | N | LEU | A | 180 | −13.623 | 6.393 | −2.742 | 1.00 | 37.81 | N |
| ATOM | 1354 | CA | LEU | A | 180 | −12.302 | 6.482 | −2.127 | 1.00 | 39.78 | C |
| ATOM | 1355 | C | LEU | A | 180 | −12.370 | 7.247 | −0.808 | 1.00 | 38.81 | C |
| ATOM | 1356 | O | LEU | A | 180 | −13.165 | 8.179 | −0.659 | 1.00 | 34.97 | O |
| ATOM | 1357 | CB | LEU | A | 180 | −11.310 | 7.152 | −3.082 | 1.00 | 38.31 | C |
| ATOM | 1358 | CG | LEU | A | 180 | −11.181 | 6.507 | −4.470 | 1.00 | 38.11 | C |
| ATOM | 1359 | CD1 | LEU | A | 180 | −10.351 | 7.381 | −5.408 | 1.00 | 33.95 | C |
| ATOM | 1360 | CD2 | LEU | A | 180 | −10.577 | 5.119 | −4.359 | 1.00 | 35.65 | C |
| ATOM | 1361 | N | TYR | A | 181 | −11.534 | 6.849 | 0.147 | 1.00 | 33.32 | N |
| ATOM | 1362 | CA | TYR | A | 181 | −11.492 | 7.494 | 1.457 | 1.00 | 34.27 | C |
| ATOM | 1363 | C | TYR | A | 181 | −10.628 | 8.746 | 1.466 | 1.00 | 36.24 | C |
| ATOM | 1364 | O | TYR | A | 181 | −9.805 | 8.964 | 0.573 | 1.00 | 31.81 | O |
| ATOM | 1365 | CB | TYR | A | 181 | −10.969 | 6.527 | 2.524 | 1.00 | 29.72 | C |
| ATOM | 1366 | CG | TYR | A | 181 | −11.916 | 5.396 | 2.837 | 1.00 | 35.89 | C |
| ATOM | 1367 | CD1 | TYR | A | 181 | −12.985 | 5.582 | 3.707 | 1.00 | 33.01 | C |
| ATOM | 1368 | CD2 | TYR | A | 181 | −11.743 | 4.140 | 2.267 | 1.00 | 31.28 | C |
| ATOM | 1369 | CE1 | TYR | A | 181 | −13.859 | 4.547 | 4.002 | 1.00 | 34.04 | C |
| ATOM | 1370 | CE2 | TYR | A | 181 | −12.614 | 3.095 | 2.560 | 1.00 | 35.99 | C |
| ATOM | 1371 | CZ | TYR | A | 181 | −13.669 | 3.306 | 3.427 | 1.00 | 35.87 | C |
| ATOM | 1372 | OH | TYR | A | 181 | −14.539 | 2.278 | 3.721 | 1.00 | 42.84 | O |
| ATOM | 1373 | N | SER | A | 182 | −10.815 | 9.555 | 2.503 | 1.00 | 33.72 | N |
| ATOM | 1374 | CA | SER | A | 182 | −9.993 | 10.731 | 2.727 | 1.00 | 30.09 | C |
| ATOM | 1375 | C | SER | A | 182 | −9.965 | 11.071 | 4.214 | 1.00 | 35.24 | C |
| ATOM | 1376 | O | SER | A | 182 | −10.975 | 10.941 | 4.907 | 1.00 | 35.29 | O |
| ATOM | 1377 | CB | SER | A | 182 | −10.521 | 11.913 | 1.917 | 1.00 | 35.11 | C |
| ATOM | 1378 | OG | SER | A | 182 | −9.824 | 13.099 | 2.239 | 1.00 | 44.24 | O |
| ATOM | 1379 | N | LEU | A | 183 | −8.809 | 11.488 | 4.713 | 1.00 | 24.60 | N |
| ATOM | 1380 | CA | LEU | A | 183 | −8.745 | 11.992 | 6.077 | 1.00 | 33.42 | C |
| ATOM | 1381 | C | LEU | A | 183 | −7.713 | 13.095 | 6.223 | 1.00 | 28.32 | C |
| ATOM | 1382 | O | LEU | A | 183 | −6.855 | 13.293 | 5.365 | 1.00 | 35.46 | O |
| ATOM | 1383 | CB | LEU | A | 183 | −8.455 | 10.858 | 7.075 | 1.00 | 32.60 | C |
| ATOM | 1384 | CG | LEU | A | 183 | −7.132 | 10.092 | 7.186 | 1.00 | 38.46 | C |
| ATOM | 1385 | CD1 | LEU | A | 183 | −6.003 | 10.910 | 7.815 | 1.00 | 32.89 | C |
| ATOM | 1386 | CD2 | LEU | A | 183 | −7.377 | 8.845 | 8.013 | 1.00 | 35.96 | C |
| ATOM | 1387 | N | SER | A | 184 | −7.801 | 13.812 | 7.329 | 1.00 | 28.07 | N |
| ATOM | 1388 | CA | SER | A | 184 | −6.803 | 14.806 | 7.644 | 1.00 | 30.87 | C |
| ATOM | 1389 | C | SER | A | 184 | −6.202 | 14.512 | 9.009 | 1.00 | 36.19 | C |
| ATOM | 1390 | O | SER | A | 184 | −6.846 | 13.908 | 9.869 | 1.00 | 32.31 | O |
| ATOM | 1391 | CB | SER | A | 184 | −7.411 | 16.198 | 7.619 | 1.00 | 27.57 | C |
| ATOM | 1392 | OG | SER | A | 184 | −8.437 | 16.292 | 8.586 | 1.00 | 37.02 | O |
| ATOM | 1393 | N | SER | A | 185 | −4.958 | 14.930 | 9.190 | 1.00 | 29.68 | N |
| ATOM | 1394 | CA | SER | A | 185 | −4.309 | 14.883 | 10.487 | 1.00 | 27.58 | C |
| ATOM | 1395 | C | SER | A | 185 | −3.733 | 16.254 | 10.747 | 1.00 | 29.16 | C |
| ATOM | 1396 | O | SER | A | 185 | −3.023 | 16.799 | 9.908 | 1.00 | 34.94 | O |
| ATOM | 1397 | CB | SER | A | 185 | −3.211 | 13.822 | 10.533 | 1.00 | 29.89 | C |
| ATOM | 1398 | OG | SER | A | 185 | −2.506 | 13.889 | 11.762 | 1.00 | 33.01 | O |
| ATOM | 1399 | N | VAL | A | 186 | −4.051 | 16.825 | 11.898 | 1.00 | 31.07 | N |
| ATOM | 1400 | CA | VAL | A | 186 | −3.573 | 18.158 | 12.209 | 1.00 | 32.17 | C |
| ATOM | 1401 | C | VAL | A | 186 | −2.863 | 18.166 | 13.545 | 1.00 | 30.53 | C |
| ATOM | 1402 | O | VAL | A | 186 | −3.002 | 17.244 | 14.347 | 1.00 | 29.86 | O |
| ATOM | 1403 | CB | VAL | A | 186 | −4.719 | 19.179 | 12.231 | 1.00 | 30.64 | C |
| ATOM | 1404 | CG1 | VAL | A | 186 | −5.443 | 19.180 | 10.890 | 1.00 | 27.44 | C |
| ATOM | 1405 | CG2 | VAL | A | 186 | −5.684 | 18.868 | 13.369 | 1.00 | 31.93 | C |
| ATOM | 1406 | N | VAL | A | 187 | −2.082 | 19.211 | 13.765 | 1.00 | 28.24 | N |
| ATOM | 1407 | CA | VAL | A | 187 | −1.402 | 19.397 | 15.028 | 1.00 | 29.57 | C |
| ATOM | 1408 | C | VAL | A | 187 | −1.341 | 20.894 | 15.298 | 1.00 | 33.56 | C |
| ATOM | 1409 | O | VAL | A | 187 | −1.156 | 21.689 | 14.377 | 1.00 | 33.65 | O |
| ATOM | 1410 | CB | VAL | A | 187 | 0.013 | 18.764 | 15.013 | 1.00 | 32.42 | C |
| ATOM | 1411 | CG1 | VAL | A | 187 | 0.854 | 19.335 | 13.875 | 1.00 | 35.03 | C |
| ATOM | 1412 | CG2 | VAL | A | 187 | 0.712 | 18.946 | 16.361 | 1.00 | 32.60 | C |
| ATOM | 1413 | N | THR | A | 188 | −1.553 | 21.282 | 16.549 | 1.00 | 31.74 | N |

TABLE 10.2-continued

| | | | | | | | | | | |
|---|---|---|---|---|---|---|---|---|---|---|
| ATOM | 1414 | CA | THR | A | 188 | −1.405 | 22.674 | 16.943 | 1.00 | 36.08 | C |
| ATOM | 1415 | C | THR | A | 188 | −0.048 | 22.862 | 17.608 | 1.00 | 40.20 | C |
| ATOM | 1416 | O | THR | A | 188 | 0.332 | 22.092 | 18.488 | 1.00 | 42.98 | O |
| ATOM | 1417 | CB | THR | A | 188 | −2.526 | 23.122 | 17.898 | 1.00 | 35.80 | C |
| ATOM | 1418 | CG2 | THR | A | 188 | −3.810 | 23.379 | 17.124 | 1.00 | 36.31 | C |
| ATOM | 1419 | OG1 | THR | A | 188 | −2.765 | 22.093 | 18.865 | 1.00 | 43.98 | O |
| ATOM | 1420 | N | VAL | A | 189 | 0.685 | 23.878 | 17.166 | 1.00 | 34.48 | N |
| ATOM | 1421 | CA | VAL | A | 189 | 2.034 | 24.144 | 17.655 | 1.00 | 36.93 | C |
| ATOM | 1422 | C | VAL | A | 189 | 2.205 | 25.642 | 17.918 | 1.00 | 45.71 | C |
| ATOM | 1423 | O | VAL | A | 189 | 1.428 | 26.453 | 17.409 | 1.00 | 48.89 | O |
| ATOM | 1424 | CB | VAL | A | 189 | 3.105 | 23.673 | 16.645 | 1.00 | 39.16 | C |
| ATOM | 1425 | CG1 | VAL | A | 189 | 2.983 | 22.178 | 16.378 | 1.00 | 36.29 | C |
| ATOM | 1426 | CG2 | VAL | A | 189 | 2.999 | 24.470 | 15.354 | 1.00 | 30.72 | C |
| ATOM | 1427 | N | PRO | A | 190 | 3.216 | 26.018 | 18.719 | 1.00 | 45.89 | N |
| ATOM | 1428 | CA | PRO | A | 190 | 3.473 | 27.449 | 18.936 | 1.00 | 50.63 | C |
| ATOM | 1429 | C | PRO | A | 190 | 3.852 | 28.173 | 17.644 | 1.00 | 48.93 | C |
| ATOM | 1430 | O | PRO | A | 190 | 4.637 | 27.643 | 16.858 | 1.00 | 44.98 | O |
| ATOM | 1431 | CB | PRO | A | 190 | 4.645 | 27.450 | 19.924 | 1.00 | 48.82 | C |
| ATOM | 1432 | CG | PRO | A | 190 | 4.553 | 26.131 | 20.620 | 1.00 | 46.27 | C |
| ATOM | 1433 | CD | PRO | A | 190 | 4.067 | 25.170 | 19.574 | 1.00 | 42.43 | C |
| ATOM | 1434 | N | SER | A | 191 | 3.297 | 29.364 | 17.433 | 1.00 | 48.29 | N |
| ATOM | 1435 | CA | SER | A | 191 | 3.581 | 30.147 | 16.231 | 1.00 | 50.08 | C |
| ATOM | 1436 | C | SER | A | 191 | 5.068 | 30.440 | 16.074 | 1.00 | 50.39 | C |
| ATOM | 1437 | O | SER | A | 191 | 5.585 | 30.495 | 14.959 | 1.00 | 44.82 | O |
| ATOM | 1438 | CB | SER | A | 191 | 2.802 | 31.463 | 16.249 | 1.00 | 57.90 | C |
| ATOM | 1439 | OG | SER | A | 191 | 1.415 | 31.239 | 16.078 | 1.00 | 74.28 | O |
| ATOM | 1440 | N | SER | A | 192 | 5.753 | 30.618 | 17.200 | 1.00 | 46.04 | N |
| ATOM | 1441 | CA | SER | A | 192 | 7.169 | 30.965 | 17.193 | 1.00 | 48.53 | C |
| ATOM | 1442 | C | SER | A | 192 | 8.062 | 29.808 | 16.739 | 1.00 | 53.82 | C |
| ATOM | 1443 | O | SER | A | 192 | 9.241 | 30.009 | 16.445 | 1.00 | 58.88 | O |
| ATOM | 1444 | CB | SER | A | 192 | 7.598 | 31.447 | 18.582 | 1.00 | 52.00 | C |
| ATOM | 1445 | OG | SER | A | 192 | 7.184 | 30.541 | 19.592 | 1.00 | 49.57 | O |
| ATOM | 1446 | N | SER | A | 193 | 7.507 | 28.601 | 16.671 | 1.00 | 54.17 | N |
| ATOM | 1447 | CA | SER | A | 193 | 8.299 | 27.443 | 16.260 | 1.00 | 50.73 | C |
| ATOM | 1448 | C | SER | A | 193 | 8.291 | 27.260 | 14.741 | 1.00 | 50.16 | C |
| ATOM | 1449 | O | SER | A | 193 | 9.128 | 26.541 | 14.197 | 1.00 | 53.54 | O |
| ATOM | 1450 | CB | SER | A | 193 | 7.795 | 26.168 | 16.944 | 1.00 | 44.93 | C |
| ATOM | 1451 | OG | SER | A | 193 | 6.626 | 25.670 | 16.317 | 1.00 | 46.77 | O |
| ATOM | 1452 | N | LEU | A | 194 | 7.349 | 27.907 | 14.060 | 1.00 | 45.24 | N |
| ATOM | 1453 | CA | LEU | A | 194 | 7.292 | 27.842 | 12.602 | 1.00 | 46.01 | C |
| ATOM | 1454 | C | LEU | A | 194 | 8.520 | 28.519 | 12.007 | 1.00 | 55.53 | C |
| ATOM | 1455 | O | LEU | A | 194 | 8.857 | 29.643 | 12.376 | 1.00 | 62.86 | O |
| ATOM | 1456 | CB | LEU | A | 194 | 6.021 | 28.502 | 12.073 | 1.00 | 39.49 | C |
| ATOM | 1457 | CG | LEU | A | 194 | 4.678 | 28.001 | 12.599 | 1.00 | 46.53 | C |
| ATOM | 1458 | CD1 | LEU | A | 194 | 3.550 | 28.840 | 12.024 | 1.00 | 43.35 | C |
| ATOM | 1459 | CD2 | LEU | A | 194 | 4.476 | 26.535 | 12.261 | 1.00 | 44.15 | C |
| ATOM | 1460 | N | GLY | A | 195 | 9.195 | 27.832 | 11.091 | 1.00 | 59.38 | N |
| ATOM | 1461 | CA | GLY | A | 195 | 10.422 | 28.355 | 10.519 | 1.00 | 62.95 | C |
| ATOM | 1462 | C | GLY | A | 195 | 11.653 | 27.847 | 11.246 | 1.00 | 59.76 | C |
| ATOM | 1463 | O | GLY | A | 195 | 12.729 | 27.733 | 10.660 | 1.00 | 64.18 | O |
| ATOM | 1464 | N | THR | A | 196 | 11.493 | 27.540 | 12.529 | 1.00 | 59.45 | N |
| ATOM | 1465 | CA | THR | A | 196 | 12.570 | 26.958 | 13.320 | 1.00 | 58.51 | C |
| ATOM | 1466 | C | THR | A | 196 | 12.448 | 25.434 | 13.387 | 1.00 | 60.43 | C |
| ATOM | 1467 | O | THR | A | 196 | 13.414 | 24.713 | 13.138 | 1.00 | 61.86 | O |
| ATOM | 1468 | CB | THR | A | 196 | 12.583 | 27.522 | 14.754 | 1.00 | 61.27 | C |
| ATOM | 1469 | CG2 | THR | A | 196 | 13.706 | 26.891 | 15.568 | 1.00 | 57.43 | C |
| ATOM | 1470 | OG1 | THR | A | 196 | 12.767 | 28.942 | 14.708 | 1.00 | 68.83 | O |
| ATOM | 1471 | N | GLN | A | 197 | 11.254 | 24.954 | 13.725 | 1.00 | 49.07 | N |
| ATOM | 1472 | CA | GLN | A | 197 | 11.009 | 23.525 | 13.894 | 1.00 | 41.26 | C |
| ATOM | 1473 | C | GLN | A | 197 | 10.473 | 22.872 | 12.619 | 1.00 | 42.46 | C |
| ATOM | 1474 | O | GLN | A | 197 | 9.577 | 23.400 | 11.963 | 1.00 | 40.55 | O |
| ATOM | 1475 | CB | GLN | A | 197 | 10.030 | 23.290 | 15.049 | 1.00 | 44.12 | C |
| ATOM | 1476 | CG | GLN | A | 197 | 9.629 | 21.833 | 15.242 | 1.00 | 47.27 | C |
| ATOM | 1477 | CD | GLN | A | 197 | 10.769 | 20.968 | 15.751 | 1.00 | 57.04 | C |
| ATOM | 1478 | NE2 | GLN | A | 197 | 10.939 | 19.790 | 15.150 | 1.00 | 43.31 | N |
| ATOM | 1479 | OE1 | GLN | A | 197 | 11.490 | 21.354 | 16.673 | 1.00 | 51.73 | O |
| ATOM | 1480 | N | THR | A | 198 | 11.034 | 21.719 | 12.273 | 1.00 | 41.32 | N |
| ATOM | 1481 | CA | THR | A | 198 | 10.577 | 20.958 | 11.121 | 1.00 | 35.03 | C |
| ATOM | 1482 | C | THR | A | 198 | 9.365 | 20.113 | 11.502 | 1.00 | 36.05 | C |
| ATOM | 1483 | O | THR | A | 198 | 9.359 | 19.468 | 12.550 | 1.00 | 35.98 | O |
| ATOM | 1484 | CB | THR | A | 198 | 11.705 | 20.058 | 10.565 | 1.00 | 33.49 | C |
| ATOM | 1485 | CG2 | THR | A | 198 | 11.153 | 19.010 | 9.620 | 1.00 | 33.33 | C |
| ATOM | 1486 | OG1 | THR | A | 198 | 12.644 | 20.870 | 9.848 | 1.00 | 47.14 | O |
| ATOM | 1487 | N | TYR | A | 199 | 8.334 | 20.141 | 10.660 | 1.00 | 34.82 | N |
| ATOM | 1488 | CA | TYR | A | 199 | 7.135 | 19.338 | 10.882 | 1.00 | 33.85 | C |
| ATOM | 1489 | C | TYR | A | 199 | 6.877 | 18.409 | 9.704 | 1.00 | 31.69 | C |
| ATOM | 1490 | O | TYR | A | 199 | 6.644 | 18.859 | 8.582 | 1.00 | 34.22 | O |
| ATOM | 1491 | CB | TYR | A | 199 | 5.924 | 20.238 | 11.129 | 1.00 | 28.42 | C |
| ATOM | 1492 | CG | TYR | A | 199 | 6.043 | 21.030 | 12.407 | 1.00 | 33.72 | C |
| ATOM | 1493 | CD1 | TYR | A | 199 | 5.935 | 20.405 | 13.640 | 1.00 | 27.74 | C |

TABLE 10.2-continued

| | | | | | | | | | | |
|---|---|---|---|---|---|---|---|---|---|---|
| ATOM | 1494 | CD2 | TYR | A | 199 | 6.288 | 22.398 | 12.385 | 1.00 | 27.12 | C |
| ATOM | 1495 | CE1 | TYR | A | 199 | 6.058 | 21.120 | 14.822 | 1.00 | 37.15 | C |
| ATOM | 1496 | CE2 | TYR | A | 199 | 6.412 | 23.122 | 13.561 | 1.00 | 35.98 | C |
| ATOM | 1497 | CZ | TYR | A | 199 | 6.294 | 22.477 | 14.776 | 1.00 | 33.49 | C |
| ATOM | 1498 | OH | TYR | A | 199 | 6.414 | 23.184 | 15.948 | 1.00 | 40.19 | O |
| ATOM | 1499 | N | ILE | A | 200 | 6.935 | 17.108 | 9.969 | 1.00 | 30.26 | N |
| ATOM | 1500 | CA | ILE | A | 200 | 6.768 | 16.097 | 8.933 | 1.00 | 31.27 | C |
| ATOM | 1501 | C | ILE | A | 200 | 5.710 | 15.089 | 9.347 | 1.00 | 33.53 | C |
| ATOM | 1502 | O | ILE | A | 200 | 5.768 | 14.546 | 10.452 | 1.00 | 32.98 | O |
| ATOM | 1503 | CB | ILE | A | 200 | 8.093 | 15.352 | 8.644 | 1.00 | 32.27 | C |
| ATOM | 1504 | CG1 | ILE | A | 200 | 9.164 | 16.333 | 8.160 | 1.00 | 37.70 | C |
| ATOM | 1505 | CG2 | ILE | A | 200 | 7.880 | 14.236 | 7.619 | 1.00 | 26.84 | C |
| ATOM | 1506 | CD1 | ILE | A | 200 | 10.495 | 15.689 | 7.860 | 1.00 | 36.87 | C |
| ATOM | 1507 | N | CYS | A | 201 | 4.739 | 14.842 | 8.470 | 1.00 | 28.73 | N |
| ATOM | 1508 | CA | CYS | A | 201 | 3.747 | 13.812 | 8.746 | 1.00 | 31.40 | C |
| ATOM | 1509 | C | CYS | A | 201 | 4.129 | 12.523 | 8.032 | 1.00 | 31.76 | C |
| ATOM | 1510 | O | CYS | A | 201 | 4.442 | 12.518 | 6.837 | 1.00 | 30.36 | O |
| ATOM | 1511 | CB | CYS | A | 201 | 2.338 | 14.264 | 8.341 | 1.00 | 29.40 | C |
| ATOM | 1512 | SG | CYS | A | 201 | 1.974 | 14.198 | 6.581 | 1.00 | 46.24 | S |
| ATOM | 1513 | N | ASN | A | 202 | 4.123 | 11.434 | 8.788 | 1.00 | 32.10 | N |
| ATOM | 1514 | CA | ASN | A | 202 | 4.479 | 10.126 | 8.262 | 1.00 | 32.09 | C |
| ATOM | 1515 | C | ASN | A | 202 | 3.216 | 9.332 | 7.990 | 1.00 | 30.31 | C |
| ATOM | 1516 | O | ASN | A | 202 | 2.476 | 8.990 | 8.908 | 1.00 | 34.67 | O |
| ATOM | 1517 | CB | ASN | A | 202 | 5.384 | 9.380 | 9.243 | 1.00 | 31.62 | C |
| ATOM | 1518 | CG | ASN | A | 202 | 6.445 | 10.276 | 9.849 | 1.00 | 34.57 | C |
| ATOM | 1519 | ND2 | ASN | A | 202 | 7.425 | 10.661 | 9.041 | 1.00 | 31.78 | N |
| ATOM | 1520 | OD1 | ASN | A | 202 | 6.382 | 10.621 | 11.030 | 1.00 | 37.73 | O |
| ATOM | 1521 | N | VAL | A | 203 | 2.958 | 9.057 | 6.722 | 1.00 | 31.29 | N |
| ATOM | 1522 | CA | VAL | A | 203 | 1.730 | 8.384 | 6.341 | 1.00 | 29.99 | C |
| ATOM | 1523 | C | VAL | A | 203 | 2.037 | 6.982 | 5.860 | 1.00 | 29.95 | C |
| ATOM | 1524 | O | VAL | A | 203 | 2.962 | 6.775 | 5.079 | 1.00 | 32.94 | O |
| ATOM | 1525 | CB | VAL | A | 203 | 0.981 | 9.163 | 5.243 | 1.00 | 35.04 | C |
| ATOM | 1526 | CG1 | VAL | A | 203 | −0.314 | 8.459 | 4.876 | 1.00 | 28.65 | C |
| ATOM | 1527 | CG2 | VAL | A | 203 | 0.710 | 10.592 | 5.707 | 1.00 | 26.66 | C |
| ATOM | 1528 | N | ASN | A | 204 | 1.264 | 6.019 | 6.345 | 1.00 | 29.35 | N |
| ATOM | 1529 | CA | ASN | A | 204 | 1.449 | 4.631 | 5.961 | 1.00 | 31.31 | C |
| ATOM | 1530 | C | ASN | A | 204 | 0.127 | 4.003 | 5.525 | 1.00 | 33.24 | C |
| ATOM | 1531 | O | ASN | A | 204 | −0.888 | 4.112 | 6.214 | 1.00 | 34.37 | O |
| ATOM | 1532 | CB | ASN | A | 204 | 2.073 | 3.843 | 7.117 | 1.00 | 37.45 | C |
| ATOM | 1533 | CG | ASN | A | 204 | 2.259 | 2.373 | 6.789 | 1.00 | 54.72 | C |
| ATOM | 1534 | ND2 | ASN | A | 204 | 3.039 | 2.091 | 5.754 | 1.00 | 50.83 | N |
| ATOM | 1535 | OD1 | ASN | A | 204 | 1.698 | 1.501 | 7.455 | 1.00 | 73.44 | O |
| ATOM | 1536 | N | HIS | A | 205 | 0.141 | 3.373 | 4.358 | 1.00 | 31.18 | N |
| ATOM | 1537 | CA | HIS | A | 205 | −1.028 | 2.675 | 3.844 | 1.00 | 37.56 | C |
| ATOM | 1538 | C | HIS | A | 205 | −0.605 | 1.286 | 3.413 | 1.00 | 34.89 | C |
| ATOM | 1539 | O | HIS | A | 205 | −0.256 | 1.068 | 2.253 | 1.00 | 36.52 | O |
| ATOM | 1540 | CB | HIS | A | 205 | −1.658 | 3.433 | 2.675 | 1.00 | 27.77 | C |
| ATOM | 1541 | CG | HIS | A | 205 | −2.917 | 2.803 | 2.155 | 1.00 | 35.56 | C |
| ATOM | 1542 | CD2 | HIS | A | 205 | −4.104 | 2.562 | 2.753 | 1.00 | 33.13 | C |
| ATOM | 1543 | ND1 | HIS | A | 205 | −3.037 | 2.344 | 0.859 | 1.00 | 35.44 | N |
| ATOM | 1544 | CE1 | HIS | A | 205 | −4.248 | 1.846 | 0.686 | 1.00 | 33.94 | C |
| ATOM | 1545 | NE2 | HIS | A | 205 | −4.919 | 1.967 | 1.815 | 1.00 | 29.56 | N |
| ATOM | 1546 | N | LYS | A | 206 | −0.623 | 0.353 | 4.358 | 1.00 | 34.52 | N |
| ATOM | 1547 | CA | LYS | A | 206 | −0.155 | −1.008 | 4.104 | 1.00 | 41.43 | C |
| ATOM | 1548 | C | LYS | A | 206 | −0.833 | −1.754 | 2.942 | 1.00 | 35.74 | C |
| ATOM | 1549 | O | LYS | A | 206 | −0.155 | −2.493 | 2.231 | 1.00 | 39.67 | O |
| ATOM | 1550 | CB | LYS | A | 206 | −0.277 | −1.846 | 5.379 | 1.00 | 47.00 | C |
| ATOM | 1551 | CG | LYS | A | 206 | 0.830 | −1.575 | 6.386 | 1.00 | 57.13 | C |
| ATOM | 1552 | CD | LYS | A | 206 | 0.895 | −2.659 | 7.452 | 1.00 | 81.12 | C |
| ATOM | 1553 | CE | LYS | A | 206 | 2.103 | −2.473 | 8.361 | 1.00 | 81.79 | C |
| ATOM | 1554 | NZ | LYS | A | 206 | 2.106 | −1.138 | 9.024 | 1.00 | 63.36 | N |
| ATOM | 1555 | N | PRO | A | 207 | −2.158 | −1.589 | 2.748 | 1.00 | 37.38 | N |
| ATOM | 1556 | CA | PRO | A | 207 | −2.759 | −2.328 | 1.624 | 1.00 | 32.27 | C |
| ATOM | 1557 | C | PRO | A | 207 | −2.137 | −2.030 | 0.252 | 1.00 | 38.84 | C |
| ATOM | 1558 | O | PRO | A | 207 | −2.064 | −2.930 | −0.578 | 1.00 | 37.23 | O |
| ATOM | 1559 | CB | PRO | A | 207 | −4.218 | −1.876 | 1.655 | 1.00 | 34.91 | C |
| ATOM | 1560 | CG | PRO | A | 207 | −4.471 | −1.559 | 3.085 | 1.00 | 40.39 | C |
| ATOM | 1561 | CD | PRO | A | 207 | −3.192 | −0.955 | 3.590 | 1.00 | 32.89 | C |
| ATOM | 1562 | N | SER | A | 208 | −1.696 | −0.797 | 0.020 | 1.00 | 38.69 | N |
| ATOM | 1563 | CA | SER | A | 208 | −1.064 | −0.446 | −1.250 | 1.00 | 34.52 | C |
| ATOM | 1564 | C | SER | A | 208 | 0.454 | −0.414 | −1.115 | 1.00 | 40.84 | C |
| ATOM | 1565 | O | SER | A | 208 | 1.157 | −0.044 | −2.056 | 1.00 | 41.36 | O |
| ATOM | 1566 | CB | SER | A | 208 | −1.565 | 0.911 | −1.751 | 1.00 | 37.36 | C |
| ATOM | 1567 | OG | SER | A | 208 | −1.111 | 1.961 | −0.912 | 1.00 | 32.83 | O |
| ATOM | 1568 | N | ASN | A | 209 | 0.942 | −0.792 | 0.065 | 1.00 | 38.90 | N |
| ATOM | 1569 | CA | ASN | A | 209 | 2.367 | −0.729 | 0.389 | 1.00 | 42.99 | C |
| ATOM | 1570 | C | ASN | A | 209 | 2.941 | 0.680 | 0.177 | 1.00 | 43.61 | C |
| ATOM | 1571 | O | ASN | A | 209 | 4.051 | 0.841 | −0.327 | 1.00 | 47.92 | O |
| ATOM | 1572 | CB | ASN | A | 209 | 3.147 | −1.756 | −0.441 | 1.00 | 48.09 | C |
| ATOM | 1573 | CG | ASN | A | 209 | 4.502 | −2.086 | 0.159 | 1.00 | 71.77 | C |

TABLE 10.2-continued

| ATOM | 1574 | ND2 | ASN | A | 209 | 5.502 | −2.260 | −0.700 | 1.00 | 76.92 | N |
|---|---|---|---|---|---|---|---|---|---|---|---|
| ATOM | 1575 | OD1 | ASN | A | 209 | 4.649 | −2.177 | 1.379 | 1.00 | 76.40 | O |
| ATOM | 1576 | N | THR | A | 210 | 2.174 | 1.692 | 0.575 | 1.00 | 40.46 | N |
| ATOM | 1577 | CA | THR | A | 210 | 2.546 | 3.090 | 0.371 | 1.00 | 38.21 | C |
| ATOM | 1578 | C | THR | A | 210 | 3.020 | 3.766 | 1.656 | 1.00 | 38.99 | C |
| ATOM | 1579 | O | THR | A | 210 | 2.320 | 3.746 | 2.670 | 1.00 | 38.40 | O |
| ATOM | 1580 | CB | THR | A | 210 | 1.361 | 3.901 | −0.200 | 1.00 | 38.96 | C |
| ATOM | 1581 | CG2 | THR | A | 210 | 1.720 | 5.376 | −0.316 | 1.00 | 37.56 | C |
| ATOM | 1582 | OG1 | THR | A | 210 | 1.006 | 3.395 | −1.494 | 1.00 | 42.32 | O |
| ATOM | 1583 | N | LYS | A | 211 | 4.214 | 4.353 | 1.607 | 1.00 | 32.28 | N |
| ATOM | 1584 | CA | LYS | A | 211 | 4.716 | 5.195 | 2.693 | 1.00 | 35.66 | C |
| ATOM | 1585 | C | LYS | A | 211 | 5.072 | 6.573 | 2.155 | 1.00 | 33.89 | C |
| ATOM | 1586 | O | LYS | A | 211 | 5.786 | 6.698 | 1.158 | 1.00 | 32.27 | O |
| ATOM | 1587 | CB | LYS | A | 211 | 5.940 | 4.569 | 3.370 | 1.00 | 36.77 | C |
| ATOM | 1588 | CG | LYS | A | 211 | 5.624 | 3.421 | 4.316 | 1.00 | 45.64 | C |
| ATOM | 1589 | CD | LYS | A | 211 | 6.864 | 2.974 | 5.086 | 1.00 | 52.89 | C |
| ATOM | 1590 | CE | LYS | A | 211 | 7.970 | 2.513 | 4.143 | 1.00 | 58.66 | C |
| ATOM | 1591 | NZ | LYS | A | 211 | 9.223 | 2.152 | 4.870 | 1.00 | 61.89 | N |
| ATOM | 1592 | N | VAL | A | 212 | 4.564 | 7.608 | 2.811 | 1.00 | 27.70 | N |
| ATOM | 1593 | CA | VAL | A | 212 | 4.861 | 8.978 | 2.416 | 1.00 | 34.14 | C |
| ATOM | 1594 | C | VAL | A | 212 | 5.294 | 9.800 | 3.623 | 1.00 | 33.04 | C |
| ATOM | 1595 | O | VAL | A | 212 | 4.657 | 9.748 | 4.677 | 1.00 | 34.67 | O |
| ATOM | 1596 | CB | VAL | A | 212 | 3.640 | 9.659 | 1.741 | 1.00 | 28.22 | C |
| ATOM | 1597 | CG1 | VAL | A | 212 | 3.944 | 11.111 | 1.424 | 1.00 | 26.60 | C |
| ATOM | 1598 | CG2 | VAL | A | 212 | 3.236 | 8.911 | 0.475 | 1.00 | 33.62 | C |
| ATOM | 1599 | N | ASP | A | 213 | 6.387 | 10.544 | 3.469 | 1.00 | 31.96 | N |
| ATOM | 1600 | CA | ASP | A | 213 | 6.802 | 11.535 | 4.460 | 1.00 | 31.89 | C |
| ATOM | 1601 | C | ASP | A | 213 | 6.622 | 12.935 | 3.886 | 1.00 | 34.24 | C |
| ATOM | 1602 | O | ASP | A | 213 | 7.286 | 13.306 | 2.918 | 1.00 | 32.65 | O |
| ATOM | 1603 | CB | ASP | A | 213 | 8.258 | 11.323 | 4.883 | 1.00 | 35.66 | C |
| ATOM | 1604 | CG | ASP | A | 213 | 8.479 | 9.985 | 5.572 | 1.00 | 47.44 | C |
| ATOM | 1605 | OD1 | ASP | A | 213 | 7.659 | 9.616 | 6.445 | 1.00 | 42.96 | O |
| ATOM | 1606 | OD2 | ASP | A | 213 | 9.475 | 9.302 | 5.238 | 1.00 | 43.88 | O |
| ATOM | 1607 | N | LYS | A | 214 | 5.728 | 13.708 | 4.492 | 1.00 | 33.17 | N |
| ATOM | 1608 | CA | LYS | A | 214 | 5.361 | 15.016 | 3.967 | 1.00 | 30.01 | C |
| ATOM | 1609 | C | LYS | A | 214 | 5.791 | 16.138 | 4.906 | 1.00 | 30.73 | C |
| ATOM | 1610 | O | LYS | A | 214 | 5.254 | 16.286 | 6.004 | 1.00 | 29.64 | O |
| ATOM | 1611 | CB | LYS | A | 214 | 3.849 | 15.082 | 3.727 | 1.00 | 28.75 | C |
| ATOM | 1612 | CG | LYS | A | 214 | 3.356 | 16.407 | 3.174 | 1.00 | 34.59 | C |
| ATOM | 1613 | CD | LYS | A | 214 | 3.879 | 16.624 | 1.767 | 1.00 | 33.64 | C |
| ATOM | 1614 | CE | LYS | A | 214 | 3.468 | 17.978 | 1.222 | 1.00 | 44.70 | C |
| ATOM | 1615 | NZ | LYS | A | 214 | 4.102 | 18.251 | −0.100 | 1.00 | 46.18 | N |
| ATOM | 1616 | N | LYS | A | 215 | 6.760 | 16.932 | 4.469 | 1.00 | 31.30 | N |
| ATOM | 1617 | CA | LYS | A | 215 | 7.181 | 18.086 | 5.247 | 1.00 | 29.47 | C |
| ATOM | 1618 | C | LYS | A | 215 | 6.197 | 19.230 | 5.031 | 1.00 | 34.25 | C |
| ATOM | 1619 | O | LYS | A | 215 | 5.887 | 19.587 | 3.895 | 1.00 | 30.95 | O |
| ATOM | 1620 | CB | LYS | A | 215 | 8.597 | 18.521 | 4.870 | 1.00 | 32.87 | C |
| ATOM | 1621 | CG | LYS | A | 215 | 9.076 | 19.731 | 5.657 | 1.00 | 32.92 | C |
| ATOM | 1622 | CD | LYS | A | 215 | 10.523 | 20.071 | 5.351 | 1.00 | 42.60 | C |
| ATOM | 1623 | CE | LYS | A | 215 | 10.950 | 21.339 | 6.087 | 1.00 | 41.79 | C |
| ATOM | 1624 | NZ | LYS | A | 215 | 12.411 | 21.587 | 5.969 | 1.00 | 52.69 | N |
| ATOM | 1625 | N | VAL | A | 216 | 5.697 | 19.798 | 6.121 | 1.00 | 27.91 | N |
| ATOM | 1626 | CA | VAL | A | 216 | 4.736 | 20.883 | 6.011 | 1.00 | 31.50 | C |
| ATOM | 1627 | C | VAL | A | 216 | 5.346 | 22.189 | 6.512 | 1.00 | 35.76 | C |
| ATOM | 1628 | O | VAL | A | 216 | 5.803 | 22.282 | 7.654 | 1.00 | 31.10 | O |
| ATOM | 1629 | CB | VAL | A | 216 | 3.443 | 20.567 | 6.782 | 1.00 | 32.04 | C |
| ATOM | 1630 | CG1 | VAL | A | 216 | 2.447 | 21.716 | 6.650 | 1.00 | 29.56 | C |
| ATOM | 1631 | CG2 | VAL | A | 216 | 2.833 | 19.265 | 6.271 | 1.00 | 28.39 | C |
| ATOM | 1632 | N | GLU | A | 217 | 5.357 | 23.187 | 5.634 | 1.00 | 39.92 | N |
| ATOM | 1633 | CA | GLU | A | 217 | 5.937 | 24.497 | 5.924 | 1.00 | 46.47 | C |
| ATOM | 1634 | C | GLU | A | 217 | 4.917 | 25.604 | 5.714 | 1.00 | 44.08 | C |
| ATOM | 1635 | O | GLU | A | 217 | 3.980 | 25.443 | 4.933 | 1.00 | 41.16 | O |
| ATOM | 1636 | CB | GLU | A | 217 | 7.149 | 24.764 | 5.026 | 1.00 | 44.32 | C |
| ATOM | 1637 | CG | GLU | A | 217 | 8.396 | 23.976 | 5.365 | 1.00 | 58.93 | C |
| ATOM | 1638 | CD | GLU | A | 217 | 9.501 | 24.188 | 4.344 | 1.00 | 64.35 | C |
| ATOM | 1639 | OE1 | GLU | A | 217 | 10.678 | 24.300 | 4.750 | 1.00 | 75.54 | O |
| ATOM | 1640 | OE2 | GLU | A | 217 | 9.192 | 24.239 | 3.135 | 1.00 | 64.80 | O |
| ATOM | 1641 | N | PRO | A | 218 | 5.099 | 26.740 | 6.406 | 1.00 | 48.25 | N |
| ATOM | 1642 | CA | PRO | A | 218 | 4.315 | 27.925 | 6.039 | 1.00 | 50.69 | C |
| ATOM | 1643 | C | PRO | A | 218 | 4.667 | 28.339 | 4.615 | 1.00 | 57.06 | C |
| ATOM | 1644 | O | PRO | A | 218 | 5.822 | 28.177 | 4.218 | 1.00 | 55.63 | O |
| ATOM | 1645 | CB | PRO | A | 218 | 4.757 | 28.979 | 7.060 | 1.00 | 50.18 | C |
| ATOM | 1646 | CG | PRO | A | 218 | 6.087 | 28.500 | 7.561 | 1.00 | 50.76 | C |
| ATOM | 1647 | CD | PRO | A | 218 | 6.027 | 27.005 | 7.521 | 1.00 | 42.82 | C |
| ATOM | 1648 | N | LYS | A | 219 | 3.703 | 28.834 | 3.846 | 1.00 | 55.24 | N |
| ATOM | 1649 | CA | LYS | A | 219 | 3.998 | 29.214 | 2.468 | 1.00 | 72.58 | C |
| ATOM | 1650 | C | LYS | A | 219 | 4.426 | 30.679 | 2.392 | 1.00 | 77.04 | C |
| ATOM | 1651 | O | LYS | A | 219 | 3.946 | 31.522 | 3.156 | 1.00 | 71.74 | O |
| ATOM | 1652 | CB | LYS | A | 219 | 2.796 | 28.952 | 1.553 | 1.00 | 66.67 | C |
| ATOM | 1653 | CG | LYS | A | 219 | 3.147 | 29.002 | 0.068 | 1.00 | 73.26 | C |

TABLE 10.2-continued

| | | | | | | | | | | |
|---|---|---|---|---|---|---|---|---|---|---|
| ATOM | 1654 | CD | LYS | A | 219 | 2.190 | 28.182 | −0.790 | 1.00 | 78.60 | C |
| ATOM | 1655 | CE | LYS | A | 219 | 0.862 | 28.890 | −1.001 | 1.00 | 76.20 | C |
| ATOM | 1656 | NZ | LYS | A | 219 | 0.010 | 28.168 | −1.992 | 1.00 | 70.66 | N |
| ATOM | 1657 | N | SER | A | 220 | 5.346 | 30.969 | 1.477 | 1.00 | 78.80 | N |
| ATOM | 1658 | CA | SER | A | 220 | 5.870 | 32.319 | 1.306 | 1.00 | 86.14 | C |
| ATOM | 1659 | C | SER | A | 220 | 5.245 | 33.004 | 0.096 | 1.00 | 76.66 | C |
| ATOM | 1660 | O | SER | A | 220 | 4.778 | 32.339 | −0.829 | 1.00 | 76.17 | O |
| ATOM | 1661 | CB | SER | A | 220 | 7.394 | 32.284 | 1.164 | 1.00 | 88.61 | C |
| ATOM | 1662 | OG | SER | A | 220 | 7.787 | 31.375 | 0.150 | 1.00 | 79.58 | O |
| TER | | | | | | | | | | | |
| ATOM | 1663 | N | ASP | B | 1 | −30.071 | −19.770 | 21.044 | 1.00 | 55.86 | N |
| ATOM | 1664 | CA | ASP | B | 1 | −28.959 | −18.907 | 21.429 | 1.00 | 51.10 | C |
| ATOM | 1665 | C | ASP | B | 1 | −29.427 | −17.792 | 22.359 | 1.00 | 49.42 | C |
| ATOM | 1666 | O | ASP | B | 1 | −30.475 | −17.185 | 22.139 | 1.00 | 43.10 | O |
| ATOM | 1667 | CB | ASP | B | 1 | −28.287 | −18.316 | 20.190 | 1.00 | 44.13 | C |
| ATOM | 1668 | CG | ASP | B | 1 | −27.652 | −19.377 | 19.308 | 1.00 | 61.47 | C |
| ATOM | 1669 | OD2 | ASP | B | 1 | −26.859 | −19.009 | 18.415 | 1.00 | 60.15 | O |
| ATOM | 1670 | OD1 | ASP | B | 1 | −27.951 | −20.577 | 19.503 | 1.00 | 63.76 | O |
| ATOM | 1671 | N | ILE | B | 2 | −28.649 | −17.533 | 23.404 | 1.00 | 43.87 | N |
| ATOM | 1672 | CA | ILE | B | 2 | −29.004 | −16.506 | 24.372 | 1.00 | 42.91 | C |
| ATOM | 1673 | C | ILE | B | 2 | −28.769 | −15.115 | 23.794 | 1.00 | 45.05 | C |
| ATOM | 1674 | O | ILE | B | 2 | −27.663 | −14.787 | 23.359 | 1.00 | 46.40 | O |
| ATOM | 1675 | CB | ILE | B | 2 | −28.207 | −16.666 | 25.675 | 1.00 | 39.78 | C |
| ATOM | 1676 | CG1 | ILE | B | 2 | −28.476 | −18.041 | 26.288 | 1.00 | 37.36 | C |
| ATOM | 1677 | CG2 | ILE | B | 2 | −28.563 | −15.558 | 26.659 | 1.00 | 35.94 | C |
| ATOM | 1678 | CD1 | ILE | B | 2 | −27.665 | −18.321 | 27.537 | 1.00 | 32.11 | C |
| ATOM | 1679 | N | VAL | B | 3 | −29.824 | −14.306 | 23.783 | 1.00 | 41.92 | N |
| ATOM | 1680 | CA | VAL | B | 3 | −29.759 | −12.953 | 23.249 | 1.00 | 38.55 | C |
| ATOM | 1681 | C | VAL | B | 3 | −29.539 | −11.943 | 24.372 | 1.00 | 39.90 | C |
| ATOM | 1682 | O | VAL | B | 3 | −30.258 | −11.945 | 25.372 | 1.00 | 40.51 | O |
| ATOM | 1683 | CB | VAL | B | 3 | −31.042 | −12.599 | 22.476 | 1.00 | 39.53 | C |
| ATOM | 1684 | CG1 | VAL | B | 3 | −30.987 | −11.169 | 21.965 | 1.00 | 34.86 | C |
| ATOM | 1685 | CG2 | VAL | B | 3 | −31.241 | −13.570 | 21.324 | 1.00 | 38.27 | C |
| ATOM | 1686 | N | MET | B | 4 | −28.528 | −11.094 | 24.214 | 1.00 | 35.54 | N |
| ATOM | 1687 | CA | MET | B | 4 | −28.248 | −10.063 | 25.208 | 1.00 | 37.31 | C |
| ATOM | 1688 | C | MET | B | 4 | −28.677 | −8.695 | 24.687 | 1.00 | 34.89 | C |
| ATOM | 1689 | O | MET | B | 4 | −28.362 | −8.327 | 23.559 | 1.00 | 35.92 | O |
| ATOM | 1690 | CB | MET | B | 4 | −26.760 | −10.043 | 25.570 | 1.00 | 29.00 | C |
| ATOM | 1691 | CG | MET | B | 4 | −26.173 | −11.410 | 25.886 | 1.00 | 32.64 | C |
| ATOM | 1692 | SD | MET | B | 4 | −26.854 | −12.116 | 27.401 | 1.00 | 36.18 | S |
| ATOM | 1693 | CE | MET | B | 4 | −26.247 | −10.945 | 28.614 | 1.00 | 29.96 | C |
| ATOM | 1694 | N | THR | B | 5 | −29.405 | −7.953 | 25.510 | 1.00 | 36.75 | N |
| ATOM | 1695 | CA | THR | B | 5 | −29.788 | −6.591 | 25.170 | 1.00 | 36.17 | C |
| ATOM | 1696 | C | THR | B | 5 | −29.273 | −5.640 | 26.238 | 1.00 | 38.85 | C |
| ATOM | 1697 | O | THR | B | 5 | −29.080 | −6.029 | 27.392 | 1.00 | 40.10 | O |
| ATOM | 1698 | CB | THR | B | 5 | −31.315 | −6.436 | 25.040 | 1.00 | 33.68 | C |
| ATOM | 1699 | CG2 | THR | B | 5 | −31.853 | −7.309 | 23.910 | 1.00 | 30.80 | C |
| ATOM | 1700 | OG1 | THR | B | 5 | −31.938 | −6.816 | 26.270 | 1.00 | 36.62 | O |
| ATOM | 1701 | N | GLN | B | 6 | −29.038 | −4.394 | 25.848 | 1.00 | 33.36 | N |
| ATOM | 1702 | CA | GLN | B | 6 | −28.602 | −3.376 | 26.788 | 1.00 | 33.06 | C |
| ATOM | 1703 | C | GLN | B | 6 | −29.438 | −2.119 | 26.620 | 1.00 | 31.88 | C |
| ATOM | 1704 | O | GLN | B | 6 | −30.040 | −1.899 | 25.571 | 1.00 | 35.73 | O |
| ATOM | 1705 | CB | GLN | B | 6 | −27.116 | −3.048 | 26.599 | 1.00 | 33.60 | C |
| ATOM | 1706 | CG | GLN | B | 6 | −26.169 | −4.214 | 26.870 | 1.00 | 36.92 | C |
| ATOM | 1707 | CD | GLN | B | 6 | −24.721 | −3.883 | 26.533 | 1.00 | 38.24 | C |
| ATOM | 1708 | NE2 | GLN | B | 6 | −24.272 | −2.702 | 26.941 | 1.00 | 30.52 | N |
| ATOM | 1709 | OE1 | GLN | B | 6 | −24.017 | −4.682 | 25.915 | 1.00 | 36.39 | O |
| ATOM | 1710 | N | SER | B | 7 | −29.470 | −1.302 | 27.665 | 1.00 | 32.38 | N |
| ATOM | 1711 | CA | SER | B | 7 | −30.103 | 0.006 | 27.606 | 1.00 | 37.23 | C |
| ATOM | 1712 | C | SER | B | 7 | −29.416 | 0.933 | 28.601 | 1.00 | 36.04 | C |
| ATOM | 1713 | O | SER | B | 7 | −28.976 | 0.485 | 29.662 | 1.00 | 39.38 | O |
| ATOM | 1714 | CB | SER | B | 7 | −31.602 | −0.096 | 27.901 | 1.00 | 37.67 | C |
| ATOM | 1715 | OG | SER | B | 7 | −31.826 | −0.591 | 29.208 | 1.00 | 50.24 | O |
| ATOM | 1716 | N | PRO | B | 8 | −29.296 | 2.226 | 28.258 | 1.00 | 38.41 | N |
| ATOM | 1717 | CA | PRO | B | 8 | −29.712 | 2.835 | 26.989 | 1.00 | 38.28 | C |
| ATOM | 1718 | C | PRO | B | 8 | −28.708 | 2.568 | 25.872 | 1.00 | 44.42 | C |
| ATOM | 1719 | O | PRO | B | 8 | −27.687 | 1.924 | 26.117 | 1.00 | 41.31 | O |
| ATOM | 1720 | CB | PRO | B | 8 | −29.766 | 4.326 | 27.325 | 1.00 | 41.32 | C |
| ATOM | 1721 | CG | PRO | B | 8 | −28.725 | 4.492 | 28.383 | 1.00 | 37.24 | C |
| ATOM | 1722 | CD | PRO | B | 8 | −28.754 | 3.226 | 29.197 | 1.00 | 31.36 | C |
| ATOM | 1723 | N | ASP | B | 9 | −28.994 | 3.049 | 24.667 | 1.00 | 42.66 | N |
| ATOM | 1724 | CA | ASP | B | 9 | −28.037 | 2.952 | 23.570 | 1.00 | 44.47 | C |
| ATOM | 1725 | C | ASP | B | 9 | −26.850 | 3.863 | 23.842 | 1.00 | 46.92 | C |
| ATOM | 1726 | O | ASP | B | 9 | −25.699 | 3.503 | 23.588 | 1.00 | 38.54 | O |
| ATOM | 1727 | CB | ASP | B | 9 | −28.687 | 3.322 | 22.236 | 1.00 | 44.64 | C |
| ATOM | 1728 | CG | ASP | B | 9 | −29.773 | 2.349 | 21.827 | 1.00 | 70.41 | C |
| ATOM | 1729 | OD1 | ASP | B | 9 | −29.730 | 1.181 | 22.272 | 1.00 | 74.55 | O |
| ATOM | 1730 | OD2 | ASP | B | 9 | −30.671 | 2.753 | 21.057 | 1.00 | 80.56 | O |
| ATOM | 1731 | N | SER | B | 10 | −27.150 | 5.044 | 24.371 | 1.00 | 42.57 | N |
| ATOM | 1732 | CA | SER | B | 10 | −26.146 | 6.061 | 24.628 | 1.00 | 39.96 | C |

TABLE 10.2-continued

| | | | | | | | | | | |
|---|---|---|---|---|---|---|---|---|---|---|
| ATOM | 1733 | C | SER | B | 10 | −26.395 | 6.721 | 25.978 | 1.00 | 42.60 | C |
| ATOM | 1734 | O | SER | B | 10 | −27.522 | 6.742 | 26.475 | 1.00 | 43.39 | O |
| ATOM | 1735 | CB | SER | B | 10 | −26.149 | 7.110 | 23.515 | 1.00 | 29.15 | C |
| ATOM | 1736 | OG | SER | B | 10 | −25.012 | 7.943 | 23.611 | 1.00 | 55.37 | O |
| ATOM | 1737 | N | LEU | B | 11 | −25.342 | 7.286 | 26.553 | 1.00 | 38.86 | N |
| ATOM | 1738 | CA | LEU | B | 11 | −25.384 | 7.756 | 27.927 | 1.00 | 39.26 | C |
| ATOM | 1739 | C | LEU | B | 11 | −24.310 | 8.819 | 28.132 | 1.00 | 33.06 | C |
| ATOM | 1740 | O | LEU | B | 11 | −23.172 | 8.636 | 27.709 | 1.00 | 43.59 | O |
| ATOM | 1741 | CB | LEU | B | 11 | −25.186 | 6.564 | 28.875 | 1.00 | 46.93 | C |
| ATOM | 1742 | CG | LEU | B | 11 | −25.354 | 6.653 | 30.391 | 1.00 | 40.86 | C |
| ATOM | 1743 | CD1 | LEU | B | 11 | −24.122 | 7.245 | 31.054 | 1.00 | 49.46 | C |
| ATOM | 1744 | CD2 | LEU | B | 11 | −26.602 | 7.452 | 30.735 | 1.00 | 58.72 | C |
| ATOM | 1745 | N | ALA | B | 12 | −24.668 | 9.930 | 28.768 | 1.00 | 34.90 | N |
| ATOM | 1746 | CA | ALA | B | 12 | −23.695 | 10.979 | 29.078 | 1.00 | 32.04 | C |
| ATOM | 1747 | C | ALA | B | 12 | −23.942 | 11.565 | 30.460 | 1.00 | 35.38 | C |
| ATOM | 1748 | O | ALA | B | 12 | −25.070 | 11.894 | 30.813 | 1.00 | 40.40 | O |
| ATOM | 1749 | CB | ALA | B | 12 | −23.733 | 12.076 | 28.027 | 1.00 | 39.73 | C |
| ATOM | 1750 | N | VAL | B | 13 | −22.874 | 11.709 | 31.235 | 1.00 | 38.02 | N |
| ATOM | 1751 | CA | VAL | B | 13 | −22.987 | 12.114 | 32.629 | 1.00 | 32.52 | C |
| ATOM | 1752 | C | VAL | B | 13 | −21.794 | 12.994 | 33.009 | 1.00 | 41.29 | C |
| ATOM | 1753 | O | VAL | B | 13 | −20.707 | 12.841 | 32.450 | 1.00 | 40.66 | O |
| ATOM | 1754 | CB | VAL | B | 13 | −23.098 | 10.856 | 33.537 | 1.00 | 47.79 | C |
| ATOM | 1755 | CG1 | VAL | B | 13 | −22.187 | 10.934 | 34.752 | 1.00 | 44.21 | C |
| ATOM | 1756 | CG2 | VAL | B | 13 | −24.548 | 10.619 | 33.939 | 1.00 | 43.75 | C |
| ATOM | 1757 | N | SER | B | 14 | −21.999 | 13.933 | 33.931 | 1.00 | 41.23 | N |
| ATOM | 1758 | CA | SER | B | 14 | −20.938 | 14.857 | 34.333 | 1.00 | 36.91 | C |
| ATOM | 1759 | C | SER | B | 14 | −19.862 | 14.158 | 35.162 | 1.00 | 39.93 | C |
| ATOM | 1760 | O | SER | B | 14 | −20.125 | 13.118 | 35.766 | 1.00 | 42.44 | O |
| ATOM | 1761 | CB | SER | B | 14 | −21.528 | 16.030 | 35.121 | 1.00 | 46.50 | C |
| ATOM | 1762 | OG | SER | B | 14 | −22.570 | 16.660 | 34.393 | 1.00 | 52.97 | O |
| ATOM | 1763 | N | LEU | B | 15 | −18.656 | 14.729 | 35.182 | 1.00 | 35.81 | N |
| ATOM | 1764 | CA | LEU | B | 15 | −17.549 | 14.188 | 35.975 | 1.00 | 41.19 | C |
| ATOM | 1765 | C | LEU | B | 15 | −17.949 | 13.897 | 37.417 | 1.00 | 46.73 | C |
| ATOM | 1766 | O | LEU | B | 15 | −18.711 | 14.651 | 38.022 | 1.00 | 44.31 | O |
| ATOM | 1767 | CB | LEU | B | 15 | −16.356 | 15.148 | 35.990 | 1.00 | 42.78 | C |
| ATOM | 1768 | CG | LEU | B | 15 | −15.368 | 15.192 | 34.825 | 1.00 | 60.55 | C |
| ATOM | 1769 | CD1 | LEU | B | 15 | −15.877 | 16.103 | 33.716 | 1.00 | 58.51 | C |
| ATOM | 1770 | CD2 | LEU | B | 15 | −13.996 | 15.648 | 35.316 | 1.00 | 59.55 | C |
| ATOM | 1771 | N | GLY | B | 16 | −17.431 | 12.800 | 37.960 | 1.00 | 41.51 | N |
| ATOM | 1772 | CA | GLY | B | 16 | −17.639 | 12.466 | 39.355 | 1.00 | 38.32 | C |
| ATOM | 1773 | C | GLY | B | 16 | −19.048 | 12.012 | 39.675 | 1.00 | 37.62 | C |
| ATOM | 1774 | O | GLY | B | 16 | −19.362 | 11.730 | 40.829 | 1.00 | 45.46 | O |
| ATOM | 1775 | N | GLU | B | 17 | −19.902 | 11.938 | 38.661 | 1.00 | 40.92 | N |
| ATOM | 1776 | CA | GLU | B | 17 | −21.273 | 11.496 | 38.876 | 1.00 | 41.65 | C |
| ATOM | 1777 | C | GLU | B | 17 | −21.458 | 10.032 | 38.491 | 1.00 | 45.71 | C |
| ATOM | 1778 | O | GLU | B | 17 | −20.568 | 9.404 | 37.912 | 1.00 | 38.54 | O |
| ATOM | 1779 | CB | GLU | B | 17 | −22.256 | 12.378 | 38.104 | 1.00 | 42.09 | C |
| ATOM | 1780 | CG | GLU | B | 17 | −22.365 | 13.791 | 38.659 | 1.00 | 48.23 | C |
| ATOM | 1781 | CD | GLU | B | 17 | −23.478 | 14.596 | 38.011 | 1.00 | 66.55 | C |
| ATOM | 1782 | OE1 | GLU | B | 17 | −23.909 | 14.234 | 36.894 | 1.00 | 71.11 | O |
| ATOM | 1783 | OE2 | GLU | B | 17 | −23.923 | 15.591 | 38.624 | 1.00 | 74.03 | O |
| ATOM | 1784 | N | ARG | B | 18 | −22.627 | 9.500 | 38.823 | 1.00 | 45.65 | N |
| ATOM | 1785 | CA | ARG | B | 18 | −22.899 | 8.077 | 38.701 | 1.00 | 45.58 | C |
| ATOM | 1786 | C | ARG | B | 18 | −23.508 | 7.729 | 37.346 | 1.00 | 40.92 | C |
| ATOM | 1787 | O | ARG | B | 18 | −24.379 | 8.436 | 36.843 | 1.00 | 38.35 | O |
| ATOM | 1788 | CB | ARG | B | 18 | −23.826 | 7.638 | 39.838 | 1.00 | 43.55 | C |
| ATOM | 1789 | CG | ARG | B | 18 | −24.162 | 6.165 | 39.879 | 1.00 | 54.20 | C |
| ATOM | 1790 | CD | ARG | B | 18 | −24.969 | 5.853 | 41.132 | 1.00 | 66.41 | C |
| ATOM | 1791 | NE | ARG | B | 18 | −25.394 | 4.459 | 41.181 | 1.00 | 84.38 | N |
| ATOM | 1792 | CZ | ARG | B | 18 | −26.076 | 3.921 | 42.186 | 1.00 | 83.62 | C |
| ATOM | 1793 | NH1 | ARG | B | 18 | −26.412 | 4.662 | 43.234 | 1.00 | 81.35 | N |
| ATOM | 1794 | NH2 | ARG | B | 18 | −26.420 | 2.640 | 42.142 | 1.00 | 85.37 | N |
| ATOM | 1795 | N | ALA | B | 19 | −23.030 | 6.643 | 36.751 | 1.00 | 35.20 | N |
| ATOM | 1796 | CA | ALA | B | 19 | −23.584 | 6.161 | 35.491 | 1.00 | 34.46 | C |
| ATOM | 1797 | C | ALA | B | 19 | −23.980 | 4.696 | 35.617 | 1.00 | 39.57 | C |
| ATOM | 1798 | O | ALA | B | 19 | −23.276 | 3.904 | 36.247 | 1.00 | 38.45 | O |
| ATOM | 1799 | CB | ALA | B | 19 | −22.588 | 6.351 | 34.356 | 1.00 | 36.85 | C |
| ATOM | 1800 | N | THR | B | 20 | −25.105 | 4.344 | 35.004 | 1.00 | 33.06 | N |
| ATOM | 1801 | CA | THR | B | 20 | −25.654 | 3.001 | 35.107 | 1.00 | 35.98 | C |
| ATOM | 1802 | C | THR | B | 20 | −26.066 | 2.452 | 33.742 | 1.00 | 38.75 | C |
| ATOM | 1803 | O | THR | B | 20 | −26.762 | 3.118 | 32.979 | 1.00 | 37.55 | O |
| ATOM | 1804 | CB | THR | B | 20 | −26.866 | 2.987 | 36.062 | 1.00 | 38.02 | C |
| ATOM | 1805 | CG2 | THR | B | 20 | −27.718 | 1.757 | 35.842 | 1.00 | 44.22 | C |
| ATOM | 1806 | OG1 | THR | B | 20 | −26.398 | 3.008 | 37.419 | 1.00 | 45.86 | O |
| ATOM | 1807 | N | ILE | B | 21 | −25.622 | 1.235 | 33.441 | 1.00 | 37.58 | N |
| ATOM | 1808 | CA | ILE | B | 21 | −25.973 | 0.559 | 32.196 | 1.00 | 35.14 | C |
| ATOM | 1809 | C | ILE | B | 21 | −26.661 | −0.765 | 32.507 | 1.00 | 37.66 | C |
| ATOM | 1810 | O | ILE | B | 21 | −26.193 | −1.527 | 33.350 | 1.00 | 32.81 | O |
| ATOM | 1811 | CB | ILE | B | 21 | −24.733 | 0.284 | 31.326 | 1.00 | 38.29 | C |
| ATOM | 1812 | CG1 | ILE | B | 21 | −23.964 | 1.573 | 31.057 | 1.00 | 37.46 | C |

TABLE 10.2-continued

| | | | | | | | | | | |
|---|---|---|---|---|---|---|---|---|---|---|
| ATOM | 1813 | CG2 | ILE | B | 21 | −25.127 | −0.395 | 30.018 | 1.00 | 45.60 | C |
| ATOM | 1814 | CD1 | ILE | B | 21 | −22.717 | 1.348 | 30.238 | 1.00 | 41.15 | C |
| ATOM | 1815 | N | ASN | B | 22 | −27.761 | −1.046 | 31.819 | 1.00 | 30.24 | N |
| ATOM | 1816 | CA | ASN | B | 22 | −28.521 | −2.260 | 32.084 | 1.00 | 37.10 | C |
| ATOM | 1817 | C | ASN | B | 22 | −28.270 | −3.358 | 31.050 | 1.00 | 40.28 | C |
| ATOM | 1818 | O | ASN | B | 22 | −28.041 | −3.081 | 29.870 | 1.00 | 35.19 | O |
| ATOM | 1819 | CB | ASN | B | 22 | −30.013 | −1.932 | 32.157 | 1.00 | 36.20 | C |
| ATOM | 1820 | CG | ASN | B | 22 | −30.308 | −0.788 | 33.121 | 1.00 | 60.60 | C |
| ATOM | 1821 | OD1 | ASN | B | 22 | −30.309 | −0.974 | 34.341 | 1.00 | 57.11 | O |
| ATOM | 1822 | ND2 | ASN | B | 22 | −30.547 | 0.407 | 32.576 | 1.00 | 55.17 | N |
| ATOM | 1823 | N | CYS | B | 23 | −28.315 | −4.604 | 31.509 | 1.00 | 36.70 | N |
| ATOM | 1824 | CA | CYS | B | 23 | −28.121 | −5.762 | 30.647 | 1.00 | 34.30 | C |
| ATOM | 1825 | C | CYS | B | 23 | −29.231 | −6.791 | 30.872 | 1.00 | 38.13 | C |
| ATOM | 1826 | O | CYS | B | 23 | −29.570 | −7.107 | 32.012 | 1.00 | 40.38 | O |
| ATOM | 1827 | CB | CYS | B | 23 | −26.748 | −6.391 | 30.913 | 1.00 | 37.80 | C |
| ATOM | 1828 | SG | CYS | B | 23 | −26.222 | −7.657 | 29.735 | 1.00 | 53.67 | S |
| ATOM | 1829 | N | LYS | B | 24 | −29.794 | −7.312 | 29.786 | 1.00 | 33.98 | N |
| ATOM | 1830 | CA | LYS | B | 24 | −30.813 | −8.356 | 29.871 | 1.00 | 36.97 | C |
| ATOM | 1831 | C | LYS | B | 24 | −30.440 | −9.564 | 29.024 | 1.00 | 42.52 | C |
| ATOM | 1832 | O | LYS | B | 24 | −29.979 | −9.419 | 27.890 | 1.00 | 38.82 | O |
| ATOM | 1833 | CB | LYS | B | 24 | −32.181 | −7.831 | 29.425 | 1.00 | 43.72 | C |
| ATOM | 1834 | CG | LYS | B | 24 | −33.084 | −7.356 | 30.550 | 1.00 | 55.35 | C |
| ATOM | 1835 | CD | LYS | B | 24 | −34.508 | −7.143 | 30.045 | 1.00 | 61.25 | C |
| ATOM | 1836 | CE | LYS | B | 24 | −35.433 | −6.673 | 31.155 | 1.00 | 65.56 | C |
| ATOM | 1837 | NZ | LYS | B | 24 | −35.055 | −5.323 | 31.656 | 1.00 | 61.27 | N |
| ATOM | 1838 | N | SER | B | 25 | −30.644 | −10.755 | 29.580 | 1.00 | 37.96 | N |
| ATOM | 1839 | CA | SER | B | 25 | −30.438 | −11.991 | 28.835 | 1.00 | 41.49 | C |
| ATOM | 1840 | C | SER | B | 25 | −31.782 | −12.646 | 28.540 | 1.00 | 40.87 | C |
| ATOM | 1841 | O | SER | B | 25 | −32.677 | −12.640 | 29.379 | 1.00 | 42.24 | O |
| ATOM | 1842 | CB | SER | B | 25 | −29.524 | −12.949 | 29.603 | 1.00 | 33.20 | C |
| ATOM | 1843 | OG | SER | B | 25 | −29.974 | −13.149 | 30.931 | 1.00 | 36.26 | O |
| ATOM | 1844 | N | SER | B | 26 | −31.915 | −13.209 | 27.342 | 1.00 | 38.29 | N |
| ATOM | 1845 | CA | SER | B | 26 | −33.176 | −13.790 | 26.895 | 1.00 | 38.35 | C |
| ATOM | 1846 | C | SER | B | 26 | −33.605 | −14.975 | 27.759 | 1.00 | 43.66 | C |
| ATOM | 1847 | O | SER | B | 26 | −34.760 | −15.394 | 27.720 | 1.00 | 40.54 | O |
| ATOM | 1848 | CB | SER | B | 26 | −33.067 | −14.224 | 25.434 | 1.00 | 35.59 | C |
| ATOM | 1849 | OG | SER | B | 26 | −32.037 | −15.182 | 25.272 | 1.00 | 38.41 | O |
| ATOM | 1850 | N | GLN | B | 27 | −32.666 | −15.519 | 28.527 | 1.00 | 42.85 | N |
| ATOM | 1851 | CA | GLN | B | 27 | −32.979 | −16.560 | 29.498 | 1.00 | 39.30 | C |
| ATOM | 1852 | C | GLN | B | 27 | −32.004 | −16.465 | 30.660 | 1.00 | 43.02 | C |
| ATOM | 1853 | O | GLN | B | 27 | −31.011 | −15.745 | 30.581 | 1.00 | 38.87 | O |
| ATOM | 1854 | CB | GLN | B | 27 | −32.926 | −17.946 | 28.858 | 1.00 | 40.88 | C |
| ATOM | 1855 | CG | GLN | B | 27 | −31.538 | −18.387 | 28.447 | 1.00 | 44.20 | C |
| ATOM | 1856 | CD | GLN | B | 27 | −31.549 | −19.707 | 27.705 | 1.00 | 51.33 | C |
| ATOM | 1857 | NE2 | GLN | B | 27 | −31.158 | −20.776 | 28.393 | 1.00 | 42.28 | N |
| ATOM | 1858 | OE1 | GLN | B | 27 | −31.906 | −19.769 | 26.525 | 1.00 | 47.83 | O |
| ATOM | 1859 | N | SER | B | 28 | −32.291 | −17.187 | 31.738 | 1.00 | 40.20 | N |
| ATOM | 1860 | CA | SER | B | 28 | −31.473 | −17.109 | 32.941 | 1.00 | 36.91 | C |
| ATOM | 1861 | C | SER | B | 28 | −30.065 | −17.631 | 32.699 | 1.00 | 41.10 | C |
| ATOM | 1862 | O | SER | B | 28 | −29.871 | −18.659 | 32.048 | 1.00 | 36.62 | O |
| ATOM | 1863 | CB | SER | B | 28 | −32.120 | −17.889 | 34.087 | 1.00 | 41.70 | C |
| ATOM | 1864 | OG | SER | B | 28 | −31.399 | −17.700 | 35.294 | 1.00 | 42.03 | O |
| ATOM | 1865 | N | ILE | B | 29 | −29.084 | −16.906 | 33.227 | 1.00 | 36.07 | N |
| ATOM | 1866 | CA | ILE | B | 29 | −27.692 | −17.320 | 33.149 | 1.00 | 34.98 | C |
| ATOM | 1867 | C | ILE | B | 29 | −27.143 | −17.474 | 34.564 | 1.00 | 36.30 | C |
| ATOM | 1868 | O | ILE | B | 29 | −25.934 | −17.400 | 34.795 | 1.00 | 34.45 | O |
| ATOM | 1869 | CB | ILE | B | 29 | −26.846 | −16.316 | 32.344 | 1.00 | 31.71 | C |
| ATOM | 1870 | CG1 | ILE | B | 29 | −26.947 | −14.916 | 32.949 | 1.00 | 29.95 | C |
| ATOM | 1871 | CG2 | ILE | B | 29 | −27.310 | −16.276 | 30.898 | 1.00 | 29.61 | C |
| ATOM | 1872 | CD1 | ILE | B | 29 | −26.198 | −13.855 | 32.145 | 1.00 | 31.42 | C |
| ATOM | 1873 | O | LEU | B | 30 | −28.655 | −20.230 | 36.655 | 1.00 | 44.52 | O |
| ATOM | 1874 | N | LEU | B | 30 | −28.058 | −17.672 | 35.508 | 1.00 | 33.91 | N |
| ATOM | 1875 | CA | LEU | B | 30 | −27.709 | −18.044 | 36.873 | 1.00 | 39.31 | C |
| ATOM | 1876 | C | LEU | B | 30 | −27.673 | −19.563 | 36.977 | 1.00 | 38.06 | C |
| ATOM | 1877 | CB | LEU | B | 30 | −28.716 | −17.465 | 37.872 | 1.00 | 37.18 | C |
| ATOM | 1878 | CG | LEU | B | 30 | −28.589 | −17.932 | 39.327 | 1.00 | 39.11 | C |
| ATOM | 1879 | CD2 | LEU | B | 30 | −29.827 | −17.558 | 40.128 | 1.00 | 36.35 | C |
| ATOM | 1880 | CD1 | LEU | B | 30 | −27.331 | −17.378 | 39.987 | 1.00 | 36.12 | C |
| ATOM | 1881 | O | HIS | B | 31 | −26.681 | −21.536 | 39.965 | 1.00 | 38.61 | O |
| ATOM | 1882 | N | HIS | B | 31 | −26.546 | −20.117 | 37.411 | 1.00 | 33.48 | N |
| ATOM | 1883 | CA | HIS | B | 31 | −26.464 | −21.562 | 37.580 | 1.00 | 38.93 | C |
| ATOM | 1884 | C | HIS | B | 31 | −27.113 | −21.968 | 38.897 | 1.00 | 39.33 | C |
| ATOM | 1885 | CB | HIS | B | 31 | −25.018 | −22.046 | 37.533 | 1.00 | 38.09 | C |
| ATOM | 1886 | CG | HIS | B | 31 | −24.889 | −23.538 | 37.446 | 1.00 | 39.11 | C |
| ATOM | 1887 | ND1 | HIS | B | 31 | −24.604 | −24.190 | 36.272 | 1.00 | 42.93 | N |
| ATOM | 1888 | CD2 | HIS | B | 31 | −25.028 | −24.496 | 38.394 | 1.00 | 37.40 | C |
| ATOM | 1889 | CE1 | HIS | B | 31 | −24.560 | −25.497 | 36.497 | 1.00 | 40.76 | C |
| ATOM | 1890 | NE2 | HIS | B | 31 | −24.816 | −25.705 | 37.772 | 1.00 | 41.52 | N |
| ATOM | 1891 | O | SER | B | 32 | −28.568 | −23.745 | 42.260 | 1.00 | 57.25 | O |
| ATOM | 1892 | N | SER | B | 32 | −28.140 | −22.809 | 38.812 | 1.00 | 43.81 | N |

TABLE 10.2-continued

| | | | | | | | | | |
|---|---|---|---|---|---|---|---|---|---|
| ATOM | 1893 | CA | SER | B | 32 | −28.969 | −23.149 | 39.972 | 1.00 | 49.61 | C |
| ATOM | 1894 | C | SER | B | 32 | −28.209 | −23.866 | 41.089 | 1.00 | 43.17 | C |
| ATOM | 1895 | CB | SER | B | 32 | −30.159 | −24.004 | 39.530 | 1.00 | 47.25 | C |
| ATOM | 1896 | OG | SER | B | 32 | −29.731 | −25.115 | 38.758 | 1.00 | 56.93 | O |
| ATOM | 1897 | O | SER | B | 33 | −25.191 | −24.612 | 43.655 | 1.00 | 47.19 | O |
| ATOM | 1898 | N | SER | B | 33 | −27.155 | −24.596 | 40.737 | 1.00 | 40.34 | N |
| ATOM | 1899 | CA | SER | B | 33 | −26.407 | −25.373 | 41.729 | 1.00 | 50.61 | C |
| ATOM | 1900 | C | SER | B | 33 | −25.300 | −24.578 | 42.428 | 1.00 | 46.45 | C |
| ATOM | 1901 | CB | SER | B | 33 | −25.807 | −26.621 | 41.079 | 1.00 | 46.34 | C |
| ATOM | 1902 | OG | SER | B | 33 | −26.825 | −27.469 | 40.581 | 1.00 | 54.71 | O |
| ATOM | 1903 | O | ASN | B | 34 | −22.973 | −20.977 | 43.235 | 1.00 | 37.27 | O |
| ATOM | 1904 | N | ASN | B | 34 | −24.470 | −23.875 | 41.661 | 1.00 | 42.95 | N |
| ATOM | 1905 | CA | ASN | B | 34 | −23.365 | −23.137 | 42.269 | 1.00 | 42.26 | C |
| ATOM | 1906 | C | ASN | B | 34 | −23.735 | −21.686 | 42.578 | 1.00 | 34.30 | C |
| ATOM | 1907 | CB | ASN | B | 34 | −22.112 | −23.195 | 41.378 | 1.00 | 39.81 | C |
| ATOM | 1908 | CG | ASN | B | 34 | −22.306 | −22.519 | 40.027 | 1.00 | 38.01 | C |
| ATOM | 1909 | OD1 | ASN | B | 34 | −22.552 | −21.313 | 39.949 | 1.00 | 35.29 | O |
| ATOM | 1910 | ND2 | ASN | B | 34 | −22.163 | −23.292 | 38.952 | 1.00 | 32.57 | N |
| ATOM | 1911 | O | ASN | B | 35 | −24.573 | −17.694 | 42.495 | 1.00 | 38.12 | O |
| ATOM | 1912 | N | ASN | B | 35 | −24.900 | −21.256 | 42.095 | 1.00 | 36.64 | N |
| ATOM | 1913 | CA | ASN | B | 35 | −25.455 | −19.936 | 42.414 | 1.00 | 41.38 | C |
| ATOM | 1914 | C | ASN | B | 35 | −24.612 | −18.762 | 41.888 | 1.00 | 38.67 | C |
| ATOM | 1915 | CB | ASN | B | 35 | −25.650 | −19.805 | 43.936 | 1.00 | 38.07 | C |
| ATOM | 1916 | CG | ASN | B | 35 | −26.644 | −18.719 | 44.315 | 1.00 | 52.73 | C |
| ATOM | 1917 | OD1 | ASN | B | 35 | −27.611 | −18.462 | 43.594 | 1.00 | 51.71 | O |
| ATOM | 1918 | ND2 | ASN | B | 35 | −26.403 | −18.069 | 45.452 | 1.00 | 46.79 | N |
| ATOM | 1919 | O | ASN | B | 36 | −24.385 | −18.267 | 38.068 | 1.00 | 37.24 | O |
| ATOM | 1920 | N | ASN | B | 36 | −23.947 | −18.955 | 40.752 | 1.00 | 32.67 | N |
| ATOM | 1921 | CA | ASN | B | 36 | −23.207 | −17.863 | 40.120 | 1.00 | 35.30 | C |
| ATOM | 1922 | C | ASN | B | 36 | −23.838 | −17.439 | 38.801 | 1.00 | 30.07 | C |
| ATOM | 1923 | CB | ASN | B | 36 | −21.743 | −18.252 | 39.888 | 1.00 | 30.99 | C |
| ATOM | 1924 | CG | ASN | B | 36 | −20.922 | −18.234 | 41.165 | 1.00 | 39.65 | C |
| ATOM | 1925 | OD1 | ASN | B | 36 | −20.340 | −17.210 | 41.526 | 1.00 | 36.59 | O |
| ATOM | 1926 | ND2 | ASN | B | 36 | −20.870 | −19.369 | 41.854 | 1.00 | 34.78 | N |
| ATOM | 1927 | O | ASN | B | 37 | −22.048 | −14.928 | 36.474 | 1.00 | 26.67 | O |
| ATOM | 1928 | N | ASN | B | 37 | −23.761 | −16.144 | 38.510 | 1.00 | 28.56 | N |
| ATOM | 1929 | CA | ASN | B | 37 | −24.222 | −15.603 | 37.237 | 1.00 | 32.35 | C |
| ATOM | 1930 | C | ASN | B | 37 | −23.090 | −15.540 | 36.217 | 1.00 | 35.69 | C |
| ATOM | 1931 | CB | ASN | B | 37 | −24.817 | −14.214 | 37.437 | 1.00 | 33.21 | C |
| ATOM | 1932 | CG | ASN | B | 37 | −25.996 | −14.219 | 38.386 | 1.00 | 35.83 | C |
| ATOM | 1933 | OD1 | ASN | B | 37 | −25.854 | −13.922 | 39.573 | 1.00 | 39.01 | O |
| ATOM | 1934 | ND2 | ASN | B | 37 | −27.166 | −14.566 | 37.868 | 1.00 | 28.90 | N |
| ATOM | 1935 | N | TYR | B | 38 | −23.306 | −16.156 | 35.059 | 1.00 | 26.80 | N |
| ATOM | 1936 | CA | TYR | B | 38 | −22.251 | −16.313 | 34.063 | 1.00 | 31.80 | C |
| ATOM | 1937 | C | TYR | B | 38 | −22.234 | −15.119 | 33.118 | 1.00 | 29.97 | C |
| ATOM | 1938 | O | TYR | B | 38 | −22.505 | −15.241 | 31.924 | 1.00 | 29.53 | O |
| ATOM | 1939 | CB | TYR | B | 38 | −22.431 | −17.628 | 33.295 | 1.00 | 28.25 | C |
| ATOM | 1940 | CG | TYR | B | 38 | −22.072 | −18.859 | 34.115 | 1.00 | 31.67 | C |
| ATOM | 1941 | CD2 | TYR | B | 38 | −21.149 | −19.792 | 33.649 | 1.00 | 32.47 | C |
| ATOM | 1942 | CD1 | TYR | B | 38 | −22.656 | −19.083 | 35.358 | 1.00 | 26.38 | C |
| ATOM | 1943 | CE2 | TYR | B | 38 | −20.816 | −20.912 | 34.406 | 1.00 | 31.96 | C |
| ATOM | 1944 | CE1 | TYR | B | 38 | −22.327 | −20.190 | 36.118 | 1.00 | 30.74 | C |
| ATOM | 1945 | CZ | TYR | B | 38 | −21.414 | −21.102 | 35.639 | 1.00 | 32.95 | C |
| ATOM | 1946 | OH | TYR | B | 38 | −21.096 | −22.200 | 36.403 | 1.00 | 33.05 | O |
| ATOM | 1947 | N | LEU | B | 39 | −21.905 | −13.963 | 33.680 | 1.00 | 29.02 | N |
| ATOM | 1948 | CA | LEU | B | 39 | −21.932 | −12.703 | 32.957 | 1.00 | 26.70 | C |
| ATOM | 1949 | C | LEU | B | 39 | −20.623 | −11.945 | 33.112 | 1.00 | 25.80 | C |
| ATOM | 1950 | O | LEU | B | 39 | −20.043 | −11.912 | 34.202 | 1.00 | 29.17 | O |
| ATOM | 1951 | CB | LEU | B | 39 | −23.082 | −11.829 | 33.457 | 1.00 | 30.90 | C |
| ATOM | 1952 | CG | LEU | B | 39 | −23.219 | −10.510 | 32.698 | 1.00 | 33.97 | C |
| ATOM | 1953 | CD1 | LEU | B | 39 | −24.064 | −10.714 | 31.458 | 1.00 | 27.79 | C |
| ATOM | 1954 | CD2 | LEU | B | 39 | −23.785 | −9.419 | 33.577 | 1.00 | 33.15 | C |
| ATOM | 1955 | N | ALA | B | 40 | −20.168 | −11.330 | 32.025 | 1.00 | 28.13 | N |
| ATOM | 1956 | CA | ALA | B | 40 | −18.989 | −10.470 | 32.068 | 1.00 | 25.92 | C |
| ATOM | 1957 | C | ALA | B | 40 | −19.287 | −9.078 | 31.501 | 1.00 | 26.60 | C |
| ATOM | 1958 | O | ALA | B | 40 | −20.162 | −8.917 | 30.648 | 1.00 | 25.73 | O |
| ATOM | 1959 | CB | ALA | B | 40 | −17.836 | −11.111 | 31.309 | 1.00 | 26.93 | C |
| ATOM | 1960 | N | TRP | B | 41 | −18.556 | −8.079 | 31.986 | 1.00 | 26.55 | N |
| ATOM | 1961 | CA | TRP | B | 41 | −18.651 | −6.720 | 31.455 | 1.00 | 30.35 | C |
| ATOM | 1962 | C | TRP | B | 41 | −17.325 | −6.293 | 30.832 | 1.00 | 29.83 | C |
| ATOM | 1963 | O | TRP | B | 41 | −16.261 | −6.507 | 31.415 | 1.00 | 26.54 | O |
| ATOM | 1964 | CB | TRP | B | 41 | −19.042 | −5.723 | 32.549 | 1.00 | 25.43 | C |
| ATOM | 1965 | CG | TRP | B | 41 | −20.484 | −5.762 | 32.956 | 1.00 | 30.44 | C |
| ATOM | 1966 | CD1 | TRP | B | 41 | −21.014 | −6.405 | 34.039 | 1.00 | 30.19 | C |
| ATOM | 1967 | CD2 | TRP | B | 41 | −21.581 | −5.116 | 32.297 | 1.00 | 28.45 | C |
| ATOM | 1968 | CE2 | TRP | B | 41 | −22.747 | −5.418 | 33.032 | 1.00 | 31.50 | C |
| ATOM | 1969 | CE3 | TRP | B | 41 | −21.692 | −4.318 | 31.154 | 1.00 | 33.61 | C |
| ATOM | 1970 | NE1 | TRP | B | 41 | −22.372 | −6.204 | 34.090 | 1.00 | 28.08 | N |
| ATOM | 1971 | CZ2 | TRP | B | 41 | −24.008 | −4.946 | 32.664 | 1.00 | 32.35 | C |
| ATOM | 1972 | CZ3 | TRP | B | 41 | −22.947 | −3.846 | 30.787 | 1.00 | 31.41 | C |

TABLE 10.2-continued

| | | | | | | | | | | |
|---|---|---|---|---|---|---|---|---|---|---|
| ATOM | 1973 | CH2 | TRP | B | 41 | −24.087 | −4.163 | 31.541 | 1.00 | 36.76 | C |
| ATOM | 1974 | N | PHE | B | 42 | −17.400 | −5.679 | 29.655 | 1.00 | 25.32 | N |
| ATOM | 1975 | CA | PHE | B | 42 | −16.220 | −5.212 | 28.939 | 1.00 | 27.15 | C |
| ATOM | 1976 | C | PHE | B | 42 | −16.271 | −3.715 | 28.680 | 1.00 | 31.54 | C |
| ATOM | 1977 | O | PHE | B | 42 | −17.338 | −3.154 | 28.431 | 1.00 | 31.28 | O |
| ATOM | 1978 | CB | PHE | B | 42 | −16.073 | −5.944 | 27.601 | 1.00 | 23.42 | C |
| ATOM | 1979 | CG | PHE | B | 42 | −15.772 | −7.405 | 27.739 | 1.00 | 26.14 | C |
| ATOM | 1980 | CD1 | PHE | B | 42 | −14.462 | −7.847 | 27.845 | 1.00 | 24.13 | C |
| ATOM | 1981 | CD2 | PHE | B | 42 | −16.794 | −8.337 | 27.758 | 1.00 | 29.43 | C |
| ATOM | 1982 | CE1 | PHE | B | 42 | −14.181 | −9.195 | 27.976 | 1.00 | 28.57 | C |
| ATOM | 1983 | CE2 | PHE | B | 42 | −16.518 | −9.690 | 27.887 | 1.00 | 26.26 | C |
| ATOM | 1984 | CZ | PHE | B | 42 | −15.212 | −10.116 | 27.997 | 1.00 | 25.92 | C |
| ATOM | 1985 | N | GLN | B | 43 | −15.109 | −3.076 | 28.723 | 1.00 | 27.61 | N |
| ATOM | 1986 | CA | GLN | B | 43 | −14.976 | −1.691 | 28.289 | 1.00 | 26.82 | C |
| ATOM | 1987 | C | GLN | B | 43 | −14.148 | −1.643 | 27.004 | 1.00 | 32.12 | C |
| ATOM | 1988 | O | GLN | B | 43 | −13.062 | −2.221 | 26.945 | 1.00 | 29.12 | O |
| ATOM | 1989 | CB | GLN | B | 43 | −14.317 | −0.842 | 29.375 | 1.00 | 23.34 | C |
| ATOM | 1990 | CG | GLN | B | 43 | −14.190 | 0.629 | 29.022 | 1.00 | 24.31 | C |
| ATOM | 1991 | CD | GLN | B | 43 | −13.172 | 1.345 | 29.891 | 1.00 | 29.32 | C |
| ATOM | 1992 | NE2 | GLN | B | 43 | −13.650 | 2.131 | 30.851 | 1.00 | 31.37 | N |
| ATOM | 1993 | OE1 | GLN | B | 43 | −11.970 | 1.192 | 29.701 | 1.00 | 31.73 | O |
| ATOM | 1994 | N | GLN | B | 44 | −14.656 | −0.977 | 25.972 | 1.00 | 20.12 | N |
| ATOM | 1995 | CA | GLN | B | 44 | −13.869 | −0.810 | 24.754 | 1.00 | 26.13 | C |
| ATOM | 1996 | C | GLN | B | 44 | −13.601 | 0.662 | 24.464 | 1.00 | 26.14 | C |
| ATOM | 1997 | O | GLN | B | 44 | −14.477 | 1.377 | 23.977 | 1.00 | 29.23 | O |
| ATOM | 1998 | CB | GLN | B | 44 | −14.559 | −1.470 | 23.556 | 1.00 | 24.46 | C |
| ATOM | 1999 | CG | GLN | B | 44 | −13.755 | −1.359 | 22.263 | 1.00 | 26.38 | C |
| ATOM | 2000 | CD | GLN | B | 44 | −14.303 | −2.228 | 21.137 | 1.00 | 28.28 | C |
| ATOM | 2001 | NE2 | GLN | B | 44 | −13.407 | −2.827 | 20.355 | 1.00 | 28.01 | N |
| ATOM | 2002 | OE1 | GLN | B | 44 | −15.512 | −2.363 | 20.977 | 1.00 | 28.62 | O |
| ATOM | 2003 | N | LYS | B | 45 | −12.388 | 1.103 | 24.786 | 1.00 | 27.16 | N |
| ATOM | 2004 | CA | LYS | B | 45 | −11.913 | 2.448 | 24.466 | 1.00 | 35.42 | C |
| ATOM | 2005 | C | LYS | B | 45 | −11.696 | 2.581 | 22.963 | 1.00 | 35.66 | C |
| ATOM | 2006 | O | LYS | B | 45 | −11.493 | 1.577 | 22.281 | 1.00 | 35.60 | O |
| ATOM | 2007 | CB | LYS | B | 45 | −10.602 | 2.752 | 25.205 | 1.00 | 33.99 | C |
| ATOM | 2008 | CG | LYS | B | 45 | −10.694 | 2.701 | 26.707 | 1.00 | 42.68 | C |
| ATOM | 2009 | CD | LYS | B | 45 | −9.353 | 3.040 | 27.351 | 1.00 | 41.29 | C |
| ATOM | 2010 | CE | LYS | B | 45 | −8.230 | 2.156 | 26.828 | 1.00 | 41.00 | C |
| ATOM | 2011 | NZ | LYS | B | 45 | −7.078 | 2.115 | 27.785 | 1.00 | 34.96 | N |
| ATOM | 2012 | N | PRO | B | 46 | −11.726 | 3.820 | 22.440 | 1.00 | 38.26 | N |
| ATOM | 2013 | CA | PRO | B | 46 | −11.508 | 4.031 | 21.001 | 1.00 | 37.25 | C |
| ATOM | 2014 | C | PRO | B | 46 | −10.173 | 3.470 | 20.504 | 1.00 | 36.36 | C |
| ATOM | 2015 | O | PRO | B | 46 | −9.125 | 3.762 | 21.087 | 1.00 | 35.60 | O |
| ATOM | 2016 | CB | PRO | B | 46 | −11.537 | 5.559 | 20.865 | 1.00 | 41.28 | C |
| ATOM | 2017 | CG | PRO | B | 46 | −12.362 | 6.021 | 22.009 | 1.00 | 39.45 | C |
| ATOM | 2018 | CD | PRO | B | 46 | −12.046 | 5.080 | 23.138 | 1.00 | 35.28 | C |
| ATOM | 2019 | N | GLY | B | 47 | −10.225 | 2.664 | 19.447 | 1.00 | 34.42 | N |
| ATOM | 2020 | CA | GLY | B | 47 | −9.034 | 2.100 | 18.835 | 1.00 | 31.31 | C |
| ATOM | 2021 | C | GLY | B | 47 | −8.501 | 0.849 | 19.517 | 1.00 | 42.85 | C |
| ATOM | 2022 | O | GLY | B | 47 | −7.507 | 0.270 | 19.074 | 1.00 | 30.21 | O |
| ATOM | 2023 | N | GLN | B | 48 | −9.163 | 0.425 | 20.589 | 1.00 | 29.62 | N |
| ATOM | 2024 | CA | GLN | B | 48 | −8.662 | −0.672 | 21.411 | 1.00 | 33.47 | C |
| ATOM | 2025 | C | GLN | B | 48 | −9.588 | −1.887 | 21.411 | 1.00 | 33.23 | C |
| ATOM | 2026 | O | GLN | B | 48 | −10.787 | −1.757 | 21.171 | 1.00 | 26.94 | O |
| ATOM | 2027 | CB | GLN | B | 48 | −8.451 | −0.187 | 22.850 | 1.00 | 32.23 | C |
| ATOM | 2028 | CG | GLN | B | 48 | −7.391 | 0.893 | 22.990 | 1.00 | 33.96 | C |
| ATOM | 2029 | CD | GLN | B | 48 | −6.011 | 0.404 | 22.590 | 1.00 | 43.63 | C |
| ATOM | 2030 | OE1 | GLN | B | 48 | −5.276 | 1.095 | 21.885 | 1.00 | 42.98 | O |
| ATOM | 2031 | NE2 | GLN | B | 48 | −5.652 | −0.796 | 23.042 | 1.00 | 39.16 | N |
| ATOM | 2032 | N | PRO | B | 49 | −9.032 | −3.077 | 21.691 | 1.00 | 30.89 | N |
| ATOM | 2033 | CA | PRO | B | 49 | −9.885 | −4.246 | 21.918 | 1.00 | 26.27 | C |
| ATOM | 2034 | C | PRO | B | 49 | −10.687 | −4.069 | 23.203 | 1.00 | 27.88 | C |
| ATOM | 2035 | O | PRO | B | 49 | −10.290 | −3.264 | 24.045 | 1.00 | 27.50 | O |
| ATOM | 2036 | CB | PRO | B | 49 | −8.883 | −5.396 | 22.049 | 1.00 | 26.15 | C |
| ATOM | 2037 | CG | PRO | B | 49 | −7.629 | −4.740 | 22.538 | 1.00 | 28.99 | C |
| ATOM | 2038 | CD | PRO | B | 49 | −7.602 | −3.394 | 21.865 | 1.00 | 32.59 | C |
| ATOM | 2039 | N | PRO | B | 50 | −11.803 | −4.799 | 23.351 | 1.00 | 25.78 | N |
| ATOM | 2040 | CA | PRO | B | 50 | −12.539 | −4.746 | 24.621 | 1.00 | 23.59 | C |
| ATOM | 2041 | C | PRO | B | 50 | −11.625 | −5.113 | 25.793 | 1.00 | 30.73 | C |
| ATOM | 2042 | O | PRO | B | 50 | −10.661 | −5.859 | 25.608 | 1.00 | 26.96 | O |
| ATOM | 2043 | CB | PRO | B | 50 | −13.643 | −5.791 | 24.438 | 1.00 | 24.85 | C |
| ATOM | 2044 | CG | PRO | B | 50 | −13.817 | −5.908 | 22.949 | 1.00 | 25.66 | C |
| ATOM | 2045 | CD | PRO | B | 50 | −12.441 | −5.694 | 22.370 | 1.00 | 25.19 | C |
| ATOM | 2046 | N | LYS | B | 51 | −11.909 | −4.574 | 26.972 | 1.00 | 27.75 | N |
| ATOM | 2047 | CA | LYS | B | 51 | −11.131 | −4.899 | 28.158 | 1.00 | 25.94 | C |
| ATOM | 2048 | C | LYS | B | 51 | −12.052 | −5.420 | 29.251 | 1.00 | 30.23 | C |
| ATOM | 2049 | O | LYS | B | 51 | −13.083 | −4.818 | 29.547 | 1.00 | 25.89 | O |
| ATOM | 2050 | CB | LYS | B | 51 | −10.351 | −3.680 | 28.654 | 1.00 | 29.25 | C |
| ATOM | 2051 | CG | LYS | B | 51 | −9.163 | −4.045 | 29.535 | 1.00 | 32.02 | C |
| ATOM | 2052 | CD | LYS | B | 51 | −9.469 | −3.859 | 31.001 | 1.00 | 37.80 | C |

TABLE 10.2-continued

| | | | | | | | | | | |
|---|---|---|---|---|---|---|---|---|---|---|
| ATOM | 2053 | CE | LYS | B | 51 | −8.409 | −4.533 | 31.869 | 1.00 | 37.22 | C |
| ATOM | 2054 | NZ | LYS | B | 51 | −8.655 | −5.999 | 32.014 | 1.00 | 34.08 | N |
| ATOM | 2055 | N | LEU | B | 52 | −11.680 | −6.547 | 29.845 | 1.00 | 24.57 | N |
| ATOM | 2056 | CA | LEU | B | 52 | −12.514 | −7.177 | 30.860 | 1.00 | 28.11 | C |
| ATOM | 2057 | C | LEU | B | 52 | −12.555 | −6.335 | 32.130 | 1.00 | 24.97 | C |
| ATOM | 2058 | O | LEU | B | 52 | −11.514 | −5.962 | 32.663 | 1.00 | 30.29 | O |
| ATOM | 2059 | CB | LEU | B | 52 | −11.998 | −8.583 | 31.172 | 1.00 | 26.30 | C |
| ATOM | 2060 | CG | LEU | B | 52 | −12.775 | −9.420 | 32.190 | 1.00 | 32.39 | C |
| ATOM | 2061 | CD1 | LEU | B | 52 | −14.222 | −9.597 | 31.751 | 1.00 | 25.02 | C |
| ATOM | 2062 | CD2 | LEU | B | 52 | −12.099 | −10.772 | 32.378 | 1.00 | 30.83 | C |
| ATOM | 2063 | N | LEU | B | 53 | −13.760 | −6.030 | 32.600 | 1.00 | 27.61 | N |
| ATOM | 2064 | CA | LEU | B | 53 | −13.938 | −5.297 | 33.854 | 1.00 | 30.52 | C |
| ATOM | 2065 | C | LEU | B | 53 | −14.434 | −6.219 | 34.956 | 1.00 | 31.29 | C |
| ATOM | 2066 | O | LEU | B | 53 | −13.913 | −6.226 | 36.068 | 1.00 | 30.02 | O |
| ATOM | 2067 | CB | LEU | B | 53 | −14.936 | −4.153 | 33.688 | 1.00 | 25.25 | C |
| ATOM | 2068 | CG | LEU | B | 53 | −14.711 | −3.080 | 32.627 | 1.00 | 33.70 | C |
| ATOM | 2069 | CD1 | LEU | B | 53 | −15.917 | −2.149 | 32.611 | 1.00 | 26.80 | C |
| ATOM | 2070 | CD2 | LEU | B | 53 | −13.432 | −2.308 | 32.907 | 1.00 | 32.50 | C |
| ATOM | 2071 | N | LEU | B | 54 | −15.460 | −6.993 | 34.631 | 1.00 | 28.48 | N |
| ATOM | 2072 | CA | LEU | B | 54 | −16.169 | −7.782 | 35.623 | 1.00 | 30.79 | C |
| ATOM | 2073 | C | LEU | B | 54 | −16.516 | −9.152 | 35.071 | 1.00 | 28.54 | C |
| ATOM | 2074 | O | LEU | B | 54 | −16.791 | −9.294 | 33.883 | 1.00 | 26.65 | O |
| ATOM | 2075 | CB | LEU | B | 54 | −17.448 | −7.055 | 36.059 | 1.00 | 31.42 | C |
| ATOM | 2076 | CG | LEU | B | 54 | −17.289 | −5.722 | 36.798 | 1.00 | 33.30 | C |
| ATOM | 2077 | CD1 | LEU | B | 54 | −18.529 | −4.870 | 36.615 | 1.00 | 32.48 | C |
| ATOM | 2078 | CD2 | LEU | B | 54 | −17.052 | −5.971 | 38.268 | 1.00 | 34.07 | C |
| ATOM | 2079 | N | TYR | B | 55 | −16.502 | −10.158 | 35.938 | 1.00 | 29.20 | N |
| ATOM | 2080 | CA | TYR | B | 55 | −17.005 | −11.475 | 35.580 | 1.00 | 29.74 | C |
| ATOM | 2081 | C | TYR | B | 55 | −17.755 | −12.043 | 36.791 | 1.00 | 32.63 | C |
| ATOM | 2082 | O | TYR | B | 55 | −17.726 | −11.449 | 37.872 | 1.00 | 31.32 | O |
| ATOM | 2083 | CB | TYR | B | 55 | −15.869 | −12.393 | 35.101 | 1.00 | 28.86 | C |
| ATOM | 2084 | CG | TYR | B | 55 | −14.714 | −12.558 | 36.065 | 1.00 | 30.07 | C |
| ATOM | 2085 | CD1 | TYR | B | 55 | −13.746 | −11.572 | 36.204 | 1.00 | 31.15 | C |
| ATOM | 2086 | CD2 | TYR | B | 55 | −14.578 | −13.717 | 36.814 | 1.00 | 30.26 | C |
| ATOM | 2087 | CE1 | TYR | B | 55 | −12.686 | −11.728 | 37.088 | 1.00 | 34.78 | C |
| ATOM | 2088 | CE2 | TYR | B | 55 | −13.525 | −13.886 | 37.695 | 1.00 | 33.93 | C |
| ATOM | 2089 | CZ | TYR | B | 55 | −12.582 | −12.889 | 37.828 | 1.00 | 36.44 | C |
| ATOM | 2090 | OH | TYR | B | 55 | −11.534 | −13.059 | 38.705 | 1.00 | 37.42 | O |
| ATOM | 2091 | N | TRP | B | 56 | −18.448 | −13.165 | 36.599 | 1.00 | 28.09 | N |
| ATOM | 2092 | CA | TRP | B | 56 | −19.439 | −13.657 | 37.566 | 1.00 | 26.67 | C |
| ATOM | 2093 | C | TRP | B | 56 | −20.387 | −12.528 | 37.984 | 1.00 | 27.89 | C |
| ATOM | 2094 | O | TRP | B | 56 | −20.767 | −12.420 | 39.151 | 1.00 | 24.63 | O |
| ATOM | 2095 | CB | TRP | B | 56 | −18.769 | −14.276 | 38.799 | 1.00 | 22.01 | C |
| ATOM | 2096 | CG | TRP | B | 56 | −17.799 | −15.367 | 38.462 | 1.00 | 27.09 | C |
| ATOM | 2097 | CD1 | TRP | B | 56 | −16.475 | −15.402 | 38.777 | 1.00 | 26.84 | C |
| ATOM | 2098 | CD2 | TRP | B | 56 | −18.068 | −16.569 | 37.720 | 1.00 | 23.97 | C |
| ATOM | 2099 | NE1 | TRP | B | 56 | −15.901 | −16.551 | 38.286 | 1.00 | 28.86 | N |
| ATOM | 2100 | CE2 | TRP | B | 56 | −16.857 | −17.284 | 37.633 | 1.00 | 25.06 | C |
| ATOM | 2101 | CE3 | TRP | B | 56 | −19.214 | −17.112 | 37.131 | 1.00 | 23.47 | C |
| ATOM | 2102 | CZ2 | TRP | B | 56 | −16.758 | −18.514 | 36.983 | 1.00 | 28.72 | C |
| ATOM | 2103 | CZ3 | TRP | B | 56 | −19.117 | −18.334 | 36.486 | 1.00 | 28.66 | C |
| ATOM | 2104 | CH2 | TRP | B | 56 | −17.896 | −19.021 | 36.414 | 1.00 | 29.03 | C |
| ATOM | 2105 | N | ALA | B | 57 | −20.734 | −11.686 | 37.009 | 1.00 | 26.41 | N |
| ATOM | 2106 | CA | ALA | B | 57 | −21.626 | −10.531 | 37.167 | 1.00 | 29.78 | C |
| ATOM | 2107 | C | ALA | B | 57 | −21.083 | −9.421 | 38.079 | 1.00 | 31.22 | C |
| ATOM | 2108 | O | ALA | B | 57 | −21.331 | −8.242 | 37.817 | 1.00 | 35.13 | O |
| ATOM | 2109 | CB | ALA | B | 57 | −23.008 | −10.985 | 37.667 | 1.00 | 27.19 | C |
| ATOM | 2110 | N | SER | B | 58 | −20.344 | −9.767 | 39.132 | 1.00 | 32.27 | N |
| ATOM | 2111 | CA | SER | B | 58 | −19.992 | −8.748 | 40.125 | 1.00 | 31.56 | C |
| ATOM | 2112 | C | SER | B | 58 | −18.563 | −8.741 | 40.672 | 1.00 | 32.07 | C |
| ATOM | 2113 | O | SER | B | 58 | −18.251 | −7.901 | 41.517 | 1.00 | 37.30 | O |
| ATOM | 2114 | CB | SER | B | 58 | −20.955 | −8.849 | 41.315 | 1.00 | 36.25 | C |
| ATOM | 2115 | OG | SER | B | 58 | −20.817 | −10.091 | 41.985 | 1.00 | 37.37 | O |
| ATOM | 2116 | N | THR | B | 59 | −17.687 | −9.640 | 40.229 | 1.00 | 31.17 | N |
| ATOM | 2117 | CA | THR | B | 59 | −16.319 | −9.596 | 40.759 | 1.00 | 29.77 | C |
| ATOM | 2118 | C | THR | B | 59 | −15.365 | −8.910 | 39.770 | 1.00 | 30.97 | C |
| ATOM | 2119 | O | THR | B | 59 | −15.367 | −9.201 | 38.575 | 1.00 | 31.74 | O |
| ATOM | 2120 | CB | THR | B | 59 | −15.786 | −11.014 | 41.142 | 1.00 | 36.77 | C |
| ATOM | 2121 | OG1 | THR | B | 59 | −14.721 | −11.403 | 40.269 | 1.00 | 41.80 | O |
| ATOM | 2122 | CG2 | THR | B | 59 | −16.890 | −12.053 | 41.102 | 1.00 | 28.98 | C |
| ATOM | 2123 | N | ARG | B | 60 | −14.565 | −7.978 | 40.284 | 1.00 | 32.62 | N |
| ATOM | 2124 | CA | ARG | B | 60 | −13.693 | −7.159 | 39.449 | 1.00 | 36.43 | C |
| ATOM | 2125 | C | ARG | B | 60 | −12.441 | −7.902 | 39.022 | 1.00 | 35.37 | C |
| ATOM | 2126 | O | ARG | B | 60 | −11.819 | −8.588 | 39.825 | 1.00 | 33.08 | O |
| ATOM | 2127 | CB | ARG | B | 60 | −13.278 | −5.877 | 40.182 | 1.00 | 33.09 | C |
| ATOM | 2128 | CG | ARG | B | 60 | −14.342 | −4.796 | 40.212 | 1.00 | 39.07 | C |
| ATOM | 2129 | CD | ARG | B | 60 | −13.752 | −3.436 | 40.558 | 1.00 | 37.50 | C |
| ATOM | 2130 | NE | ARG | B | 60 | −12.854 | −3.495 | 41.707 | 1.00 | 43.68 | N |
| ATOM | 2131 | CZ | ARG | B | 60 | −13.259 | −3.551 | 42.971 | 1.00 | 51.03 | C |
| ATOM | 2132 | NH1 | ARG | B | 60 | −14.555 | −3.560 | 43.254 | 1.00 | 53.34 | N |

TABLE 10.2-continued

| | | | | | | | | | | |
|---|---|---|---|---|---|---|---|---|---|---|
| ATOM | 2133 | NH2 | ARG | B | 60 | −12.368 | −3.603 | 43.952 | 1.00 | 52.19 | N |
| ATOM | 2134 | N | GLU | B | 61 | −12.061 | −7.747 | 37.759 | 1.00 | 30.40 | N |
| ATOM | 2135 | CA | GLU | B | 61 | −10.764 | −8.235 | 37.310 | 1.00 | 35.70 | C |
| ATOM | 2136 | C | GLU | B | 61 | −9.659 | −7.523 | 38.077 | 1.00 | 35.51 | C |
| ATOM | 2137 | O | GLU | B | 61 | −9.863 | −6.424 | 38.598 | 1.00 | 36.52 | O |
| ATOM | 2138 | CB | GLU | B | 61 | −10.582 | −8.023 | 35.805 | 1.00 | 30.95 | C |
| ATOM | 2139 | CG | GLU | B | 61 | −10.406 | −9.307 | 35.015 | 1.00 | 51.01 | C |
| ATOM | 2140 | CD | GLU | B | 61 | −9.084 | −10.015 | 35.278 | 1.00 | 47.16 | C |
| ATOM | 2141 | OE1 | GLU | B | 61 | −8.884 | −10.535 | 36.397 | 1.00 | 57.21 | O |
| ATOM | 2142 | OE2 | GLU | B | 61 | −8.245 | −10.063 | 34.354 | 1.00 | 55.45 | O |
| ATOM | 2143 | N | SER | B | 62 | −8.491 | −8.148 | 38.143 | 1.00 | 36.53 | N |
| ATOM | 2144 | CA | SER | B | 62 | −7.352 | −7.559 | 38.838 | 1.00 | 37.86 | C |
| ATOM | 2145 | C | SER | B | 62 | −6.959 | −6.222 | 38.211 | 1.00 | 35.62 | C |
| ATOM | 2146 | O | SER | B | 62 | −6.919 | −6.086 | 36.992 | 1.00 | 34.27 | O |
| ATOM | 2147 | CB | SER | B | 62 | −6.166 | −8.527 | 38.822 | 1.00 | 40.55 | C |
| ATOM | 2148 | OG | SER | B | 62 | −5.113 | −8.060 | 39.646 | 1.00 | 56.20 | O |
| ATOM | 2149 | N | GLY | B | 63 | −6.690 | −5.228 | 39.049 | 1.00 | 32.40 | N |
| ATOM | 2150 | CA | GLY | B | 63 | −6.280 | −3.924 | 38.561 | 1.00 | 32.97 | C |
| ATOM | 2151 | C | GLY | B | 63 | −7.413 | −2.971 | 38.213 | 1.00 | 38.33 | C |
| ATOM | 2152 | O | GLY | B | 63 | −7.194 | −1.767 | 38.099 | 1.00 | 40.50 | O |
| ATOM | 2153 | N | VAL | B | 64 | −8.624 | −3.498 | 38.045 | 1.00 | 31.70 | N |
| ATOM | 2154 | CA | VAL | B | 64 | −9.780 | −2.664 | 37.711 | 1.00 | 30.42 | C |
| ATOM | 2155 | C | VAL | B | 64 | −10.188 | −1.782 | 38.894 | 1.00 | 34.52 | C |
| ATOM | 2156 | O | VAL | B | 64 | −10.378 | −2.279 | 40.004 | 1.00 | 36.24 | O |
| ATOM | 2157 | CB | VAL | B | 64 | −10.988 | −3.525 | 37.269 | 1.00 | 33.44 | C |
| ATOM | 2158 | CG1 | VAL | B | 64 | −12.241 | −2.668 | 37.101 | 1.00 | 31.47 | C |
| ATOM | 2159 | CG2 | VAL | B | 64 | −10.668 | −4.271 | 35.985 | 1.00 | 30.34 | C |
| ATOM | 2160 | N | PRO | B | 65 | −10.326 | −0.466 | 38.655 | 1.00 | 35.36 | N |
| ATOM | 2161 | CA | PRO | B | 65 | −10.693 | 0.500 | 39.701 | 1.00 | 33.81 | C |
| ATOM | 2162 | C | PRO | B | 65 | −12.039 | 0.170 | 40.344 | 1.00 | 36.63 | C |
| ATOM | 2163 | O | PRO | B | 65 | −12.940 | −0.301 | 39.649 | 1.00 | 30.63 | O |
| ATOM | 2164 | CB | PRO | B | 65 | −10.765 | 1.831 | 38.946 | 1.00 | 31.15 | C |
| ATOM | 2165 | CG | PRO | B | 65 | −9.947 | 1.623 | 37.710 | 1.00 | 35.40 | C |
| ATOM | 2166 | CD | PRO | B | 65 | −10.131 | 0.182 | 37.347 | 1.00 | 33.17 | C |
| ATOM | 2167 | N | ASP | B | 66 | −12.177 | 0.421 | 41.645 | 1.00 | 33.02 | N |
| ATOM | 2168 | CA | ASP | B | 66 | −13.408 | 0.069 | 42.357 | 1.00 | 39.73 | C |
| ATOM | 2169 | C | ASP | B | 66 | −14.599 | 0.965 | 41.998 | 1.00 | 39.77 | C |
| ATOM | 2170 | O | ASP | B | 66 | −15.703 | 0.752 | 42.499 | 1.00 | 35.02 | O |
| ATOM | 2171 | CB | ASP | B | 66 | −13.180 | 0.093 | 43.874 | 1.00 | 38.87 | C |
| ATOM | 2172 | CG | ASP | B | 66 | −12.527 | 1.374 | 44.354 | 1.00 | 46.60 | C |
| ATOM | 2173 | OD1 | ASP | B | 66 | −12.535 | 2.376 | 43.608 | 1.00 | 57.95 | O |
| ATOM | 2174 | OD2 | ASP | B | 66 | −12.004 | 1.377 | 45.489 | 1.00 | 64.41 | O |
| ATOM | 2175 | N | ARG | B | 67 | −14.376 | 1.953 | 41.129 | 1.00 | 35.35 | N |
| ATOM | 2176 | CA | ARG | B | 67 | −15.470 | 2.752 | 40.569 | 1.00 | 31.85 | C |
| ATOM | 2177 | C | ARG | B | 67 | −16.456 | 1.880 | 39.807 | 1.00 | 34.69 | C |
| ATOM | 2178 | O | ARG | B | 67 | −17.638 | 2.209 | 39.698 | 1.00 | 35.56 | O |
| ATOM | 2179 | CB | ARG | B | 67 | −14.947 | 3.828 | 39.614 | 1.00 | 39.18 | C |
| ATOM | 2180 | CG | ARG | B | 67 | −13.752 | 4.611 | 40.095 | 1.00 | 51.83 | C |
| ATOM | 2181 | CD | ARG | B | 67 | −13.589 | 5.861 | 39.242 | 1.00 | 57.84 | C |
| ATOM | 2182 | NE | ARG | B | 67 | −13.490 | 5.570 | 37.810 | 1.00 | 38.84 | N |
| ATOM | 2183 | CZ | ARG | B | 67 | −12.335 | 5.389 | 37.179 | 1.00 | 42.20 | C |
| ATOM | 2184 | NH1 | ARG | B | 67 | −11.197 | 5.458 | 37.859 | 1.00 | 41.09 | N |
| ATOM | 2185 | NH2 | ARG | B | 67 | −12.314 | 5.140 | 35.878 | 1.00 | 37.06 | N |
| ATOM | 2186 | N | PHE | B | 68 | −15.948 | 0.785 | 39.245 | 1.00 | 28.82 | N |
| ATOM | 2187 | CA | PHE | B | 68 | −16.759 | −0.122 | 38.443 | 1.00 | 36.23 | C |
| ATOM | 2188 | C | PHE | B | 68 | −17.314 | −1.232 | 39.308 | 1.00 | 34.50 | C |
| ATOM | 2189 | O | PHE | B | 68 | −16.564 | −1.931 | 39.995 | 1.00 | 31.34 | O |
| ATOM | 2190 | CB | PHE | B | 68 | −15.941 | −0.727 | 37.297 | 1.00 | 30.38 | C |
| ATOM | 2191 | CG | PHE | B | 68 | −15.401 | 0.287 | 36.337 | 1.00 | 34.41 | C |
| ATOM | 2192 | CD1 | PHE | B | 68 | −16.127 | 0.651 | 35.215 | 1.00 | 31.80 | C |
| ATOM | 2193 | CD2 | PHE | B | 68 | −14.163 | 0.874 | 36.551 | 1.00 | 34.95 | C |
| ATOM | 2194 | CE1 | PHE | B | 68 | −15.629 | 1.586 | 34.328 | 1.00 | 29.96 | C |
| ATOM | 2195 | CE2 | PHE | B | 68 | −13.661 | 1.807 | 35.666 | 1.00 | 35.32 | C |
| ATOM | 2196 | CZ | PHE | B | 68 | −14.396 | 2.163 | 34.554 | 1.00 | 31.86 | C |
| ATOM | 2197 | N | SER | B | 69 | −18.627 | −1.408 | 39.275 | 1.00 | 30.82 | N |
| ATOM | 2198 | CA | SER | B | 69 | −19.228 | −2.482 | 40.044 | 1.00 | 30.92 | C |
| ATOM | 2199 | C | SER | B | 69 | −20.364 | −3.114 | 39.268 | 1.00 | 34.45 | C |
| ATOM | 2200 | O | SER | B | 69 | −20.998 | −2.468 | 38.430 | 1.00 | 35.02 | O |
| ATOM | 2201 | CB | SER | B | 69 | −19.724 | −1.970 | 41.397 | 1.00 | 32.49 | C |
| ATOM | 2202 | OG | SER | B | 69 | −20.797 | −1.062 | 41.230 | 1.00 | 37.05 | O |
| ATOM | 2203 | N | GLY | B | 70 | −20.610 | −4.387 | 39.550 | 1.00 | 30.93 | N |
| ATOM | 2204 | CA | GLY | B | 70 | −21.673 | −5.116 | 38.896 | 1.00 | 28.03 | C |
| ATOM | 2205 | C | GLY | B | 70 | −22.689 | −5.620 | 39.898 | 1.00 | 38.68 | C |
| ATOM | 2206 | O | GLY | B | 70 | −22.361 | −5.887 | 41.056 | 1.00 | 36.13 | O |
| ATOM | 2207 | N | SER | B | 71 | −23.932 | −5.737 | 39.449 | 1.00 | 35.97 | N |
| ATOM | 2208 | CA | SER | B | 71 | −24.996 | −6.282 | 40.276 | 1.00 | 32.81 | C |
| ATOM | 2209 | C | SER | B | 71 | −26.038 | −6.927 | 39.380 | 1.00 | 36.09 | C |
| ATOM | 2210 | O | SER | B | 71 | −25.980 | −6.798 | 38.157 | 1.00 | 36.12 | O |
| ATOM | 2211 | CB | SER | B | 71 | −25.632 | −5.193 | 41.136 | 1.00 | 38.54 | C |
| ATOM | 2212 | OG | SER | B | 71 | −26.284 | −4.232 | 40.322 | 1.00 | 42.67 | O |

TABLE 10.2-continued

| | | | | | | | | | | |
|---|---|---|---|---|---|---|---|---|---|---|
| ATOM | 2213 | N   | GLY | B | 72 | −26.996 | −7.612  | 39.992 | 1.00 | 35.53 | N |
| ATOM | 2214 | CA  | GLY | B | 72 | −28.054 | −8.256  | 39.242 | 1.00 | 32.26 | C |
| ATOM | 2215 | C   | GLY | B | 72 | −28.025 | −9.760  | 39.411 | 1.00 | 33.08 | C |
| ATOM | 2216 | O   | GLY | B | 72 | −27.109 | −10.312 | 40.020 | 1.00 | 37.03 | O |
| ATOM | 2217 | N   | SER | B | 73 | −29.038 | −10.420 | 38.869 | 1.00 | 35.95 | N |
| ATOM | 2218 | CA  | SER | B | 73 | −29.166 | −11.861 | 38.993 | 1.00 | 39.04 | C |
| ATOM | 2219 | C   | SER | B | 73 | −30.132 | −12.395 | 37.946 | 1.00 | 40.07 | C |
| ATOM | 2220 | O   | SER | B | 73 | −31.042 | −11.691 | 37.512 | 1.00 | 40.54 | O |
| ATOM | 2221 | CB  | SER | B | 73 | −29.643 | −12.235 | 40.398 | 1.00 | 44.78 | C |
| ATOM | 2222 | OG  | SER | B | 73 | −29.753 | −13.638 | 40.538 | 1.00 | 50.73 | O |
| ATOM | 2223 | N   | GLY | B | 74 | −29.920 | −13.638 | 37.531 | 1.00 | 41.84 | N |
| ATOM | 2224 | CA  | GLY | B | 74 | −30.816 | −14.291 | 36.597 | 1.00 | 37.63 | C |
| ATOM | 2225 | C   | GLY | B | 74 | −30.776 | −13.743 | 35.182 | 1.00 | 41.67 | C |
| ATOM | 2226 | O   | GLY | B | 74 | −29.999 | −14.211 | 34.347 | 1.00 | 37.99 | O |
| ATOM | 2227 | N   | THR | B | 75 | −31.628 | −12.761 | 34.907 | 1.00 | 34.80 | N |
| ATOM | 2228 | CA  | THR | B | 75 | −31.767 | −12.239 | 33.553 | 1.00 | 38.56 | C |
| ATOM | 2229 | C   | THR | B | 75 | −31.515 | −10.733 | 33.475 | 1.00 | 38.78 | C |
| ATOM | 2230 | O   | THR | B | 75 | −31.439 | −10.173 | 32.384 | 1.00 | 44.01 | O |
| ATOM | 2231 | CB  | THR | B | 75 | −33.176 | −12.534 | 32.980 | 1.00 | 38.87 | C |
| ATOM | 2232 | CG2 | THR | B | 75 | −33.477 | −14.025 | 33.021 | 1.00 | 37.18 | C |
| ATOM | 2233 | OG1 | THR | B | 75 | −34.163 | −11.838 | 33.749 | 1.00 | 46.98 | O |
| ATOM | 2234 | N   | ASP | B | 76 | −31.389 | −10.083 | 34.629 | 1.00 | 37.55 | N |
| ATOM | 2235 | CA  | ASP | B | 76 | −31.244 | −8.628  | 34.678 | 1.00 | 38.55 | C |
| ATOM | 2236 | C   | ASP | B | 76 | −29.989 | −8.211  | 35.414 | 1.00 | 30.72 | C |
| ATOM | 2237 | O   | ASP | B | 76 | −29.767 | −8.605  | 36.557 | 1.00 | 39.41 | O |
| ATOM | 2238 | CB  | ASP | B | 76 | −32.463 | −7.978  | 35.340 | 1.00 | 39.46 | C |
| ATOM | 2239 | CG  | ASP | B | 76 | −33.567 | −7.680  | 34.352 | 1.00 | 54.19 | C |
| ATOM | 2240 | OD2 | ASP | B | 76 | −34.444 | −8.548  | 34.149 | 1.00 | 61.43 | O |
| ATOM | 2241 | OD1 | ASP | B | 76 | −33.553 | −6.575  | 33.770 | 1.00 | 68.17 | O |
| ATOM | 2242 | N   | PHE | B | 77 | −29.173 | −7.397  | 34.756 | 1.00 | 32.93 | N |
| ATOM | 2243 | CA  | PHE | B | 77 | −27.890 | −6.999  | 35.314 | 1.00 | 34.16 | C |
| ATOM | 2244 | C   | PHE | B | 77 | −27.608 | −5.540  | 35.021 | 1.00 | 28.32 | C |
| ATOM | 2245 | O   | PHE | B | 77 | −28.054 | −5.005  | 34.010 | 1.00 | 34.43 | O |
| ATOM | 2246 | CB  | PHE | B | 77 | −26.769 | −7.870  | 34.748 | 1.00 | 33.65 | C |
| ATOM | 2247 | CG  | PHE | B | 77 | −27.008 | −9.340  | 34.908 | 1.00 | 31.73 | C |
| ATOM | 2248 | CD1 | PHE | B | 77 | −26.584 | −10.004 | 36.050 | 1.00 | 34.33 | C |
| ATOM | 2249 | CD2 | PHE | B | 77 | −27.663 | −10.061 | 33.924 | 1.00 | 30.60 | C |
| ATOM | 2250 | CE1 | PHE | B | 77 | −26.807 | −11.363 | 36.204 | 1.00 | 28.94 | C |
| ATOM | 2251 | CE2 | PHE | B | 77 | −27.892 | −11.420 | 34.078 | 1.00 | 32.18 | C |
| ATOM | 2252 | CZ  | PHE | B | 77 | −27.463 | −12.067 | 35.215 | 1.00 | 28.31 | C |
| ATOM | 2253 | N   | THR | B | 78 | −26.864 | −4.894  | 35.909 | 1.00 | 33.91 | N |
| ATOM | 2254 | CA  | THR | B | 78 | −26.454 | −3.520  | 35.673 | 1.00 | 36.80 | C |
| ATOM | 2255 | C   | THR | B | 78 | −24.972 | −3.332  | 35.956 | 1.00 | 35.53 | C |
| ATOM | 2256 | O   | THR | B | 78 | −24.429 | −3.893  | 36.909 | 1.00 | 33.42 | O |
| ATOM | 2257 | CB  | THR | B | 78 | −27.250 | −2.514  | 36.536 | 1.00 | 36.13 | C |
| ATOM | 2258 | CG2 | THR | B | 78 | −28.744 | −2.790  | 36.465 | 1.00 | 35.39 | C |
| ATOM | 2259 | OG1 | THR | B | 78 | −26.815 | −2.600  | 37.896 | 1.00 | 52.08 | O |
| ATOM | 2260 | N   | LEU | B | 79 | −24.321 | −2.546  | 35.108 | 1.00 | 33.37 | N |
| ATOM | 2261 | CA  | LEU | B | 79 | −22.978 | −2.072  | 35.382 | 1.00 | 32.04 | C |
| ATOM | 2262 | C   | LEU | B | 79 | −23.082 | −0.689  | 36.000 | 1.00 | 35.99 | C |
| ATOM | 2263 | O   | LEU | B | 79 | −23.805 | 0.166   | 35.494 | 1.00 | 30.23 | O |
| ATOM | 2264 | CB  | LEU | B | 79 | −22.138 | −2.030  | 34.105 | 1.00 | 32.75 | C |
| ATOM | 2265 | CG  | LEU | B | 79 | −20.814 | −1.269  | 34.215 | 1.00 | 31.00 | C |
| ATOM | 2266 | CD1 | LEU | B | 79 | −19.875 | −1.948  | 35.189 | 1.00 | 30.67 | C |
| ATOM | 2267 | CD2 | LEU | B | 79 | −20.151 | −1.129  | 32.853 | 1.00 | 29.83 | C |
| ATOM | 2268 | N   | THR | B | 80 | −22.379 | −0.467  | 37.102 | 1.00 | 37.73 | N |
| ATOM | 2269 | CA  | THR | B | 80 | −22.390 | 0.852   | 37.711 | 1.00 | 37.01 | C |
| ATOM | 2270 | C   | THR | B | 80 | −20.999 | 1.468   | 37.726 | 1.00 | 37.89 | C |
| ATOM | 2271 | O   | THR | B | 80 | −20.044 | 0.876   | 38.229 | 1.00 | 33.52 | O |
| ATOM | 2272 | CB  | THR | B | 80 | −22.938 | 0.816   | 39.152 | 1.00 | 47.22 | C |
| ATOM | 2273 | CG2 | THR | B | 80 | −22.815 | 2.194   | 39.802 | 1.00 | 42.48 | C |
| ATOM | 2274 | OG1 | THR | B | 80 | −24.316 | 0.427   | 39.130 | 1.00 | 44.17 | O |
| ATOM | 2275 | N   | ILE | B | 81 | −20.893 | 2.659   | 37.152 | 1.00 | 36.66 | N |
| ATOM | 2276 | CA  | ILE | B | 81 | −19.699 | 3.464   | 37.321 | 1.00 | 35.94 | C |
| ATOM | 2277 | C   | ILE | B | 81 | −20.013 | 4.576   | 38.308 | 1.00 | 41.22 | C |
| ATOM | 2278 | O   | ILE | B | 81 | −20.729 | 5.527   | 37.984 | 1.00 | 39.45 | O |
| ATOM | 2279 | CB  | ILE | B | 81 | −19.206 | 4.068   | 35.997 | 1.00 | 29.74 | C |
| ATOM | 2280 | CG1 | ILE | B | 81 | −19.077 | 2.986   | 34.927 | 1.00 | 31.37 | C |
| ATOM | 2281 | CG2 | ILE | B | 81 | −17.875 | 4.784   | 36.204 | 1.00 | 37.10 | C |
| ATOM | 2282 | CD1 | ILE | B | 81 | −18.674 | 3.527   | 33.563 | 1.00 | 36.05 | C |
| ATOM | 2283 | N   | SER | B | 82 | −19.506 | 4.442   | 39.525 | 1.00 | 36.61 | N |
| ATOM | 2284 | CA  | SER | B | 82 | −19.621 | 5.521   | 40.489 | 1.00 | 47.92 | C |
| ATOM | 2285 | C   | SER | B | 82 | −18.478 | 6.491   | 40.221 | 1.00 | 54.74 | C |
| ATOM | 2286 | O   | SER | B | 82 | −17.328 | 6.069   | 40.079 | 1.00 | 68.40 | O |
| ATOM | 2287 | CB  | SER | B | 82 | −19.571 | 4.991   | 41.921 | 1.00 | 38.83 | C |
| ATOM | 2288 | OG  | SER | B | 82 | −18.240 | 4.674   | 42.287 | 1.00 | 41.65 | O |
| ATOM | 2289 | N   | SER | B | 83 | −18.803 | 7.776   | 40.124 | 1.00 | 52.26 | N |
| ATOM | 2290 | CA  | SER | B | 83 | −17.818 | 8.825   | 39.853 | 1.00 | 47.12 | C |
| ATOM | 2291 | C   | SER | B | 83 | −17.144 | 8.663   | 38.481 | 1.00 | 47.93 | C |
| ATOM | 2292 | O   | SER | B | 83 | −15.999 | 8.217   | 38.381 | 1.00 | 37.39 | O |

TABLE 10.2-continued

| | | | | | | | | | | |
|---|---|---|---|---|---|---|---|---|---|---|
| ATOM | 2293 | CB | SER | B | 83 | −16.763 | 8.864 | 40.962 | 1.00 | 42.74 | C |
| ATOM | 2294 | OG | SER | B | 83 | −15.929 | 10.003 | 40.831 | 1.00 | 61.34 | O |
| ATOM | 2295 | N | LEU | B | 84 | −17.862 | 9.054 | 37.432 | 1.00 | 39.91 | N |
| ATOM | 2296 | CA | LEU | B | 84 | −17.373 | 8.932 | 36.061 | 1.00 | 40.35 | C |
| ATOM | 2297 | C | LEU | B | 84 | −16.120 | 9.777 | 35.825 | 1.00 | 43.92 | C |
| ATOM | 2298 | O | LEU | B | 84 | −16.079 | 10.954 | 36.188 | 1.00 | 32.91 | O |
| ATOM | 2299 | CB | LEU | B | 84 | −18.470 | 9.334 | 35.072 | 1.00 | 36.00 | C |
| ATOM | 2300 | CG | LEU | B | 84 | −18.281 | 8.902 | 33.616 | 1.00 | 40.11 | C |
| ATOM | 2301 | CD1 | LEU | B | 84 | −18.455 | 7.396 | 33.472 | 1.00 | 34.46 | C |
| ATOM | 2302 | CD2 | LEU | B | 84 | −19.246 | 9.639 | 32.702 | 1.00 | 39.38 | C |
| ATOM | 2303 | N | GLN | B | 85 | −15.103 | 9.166 | 35.221 | 1.00 | 35.37 | N |
| ATOM | 2304 | CA | GLN | B | 85 | −13.839 | 9.844 | 34.940 | 1.00 | 35.03 | C |
| ATOM | 2305 | C | GLN | B | 85 | −13.682 | 10.088 | 33.432 | 1.00 | 35.85 | C |
| ATOM | 2306 | O | GLN | B | 85 | −14.311 | 9.400 | 32.627 | 1.00 | 30.69 | O |
| ATOM | 2307 | CB | GLN | B | 85 | −12.665 | 9.023 | 35.484 | 1.00 | 33.69 | C |
| ATOM | 2308 | CG | GLN | B | 85 | −12.719 | 8.782 | 36.990 | 1.00 | 39.42 | C |
| ATOM | 2309 | CD | GLN | B | 85 | −12.651 | 10.069 | 37.795 | 1.00 | 43.01 | C |
| ATOM | 2310 | NE2 | GLN | B | 85 | −13.732 | 10.386 | 38.500 | 1.00 | 38.02 | N |
| ATOM | 2311 | OE1 | GLN | B | 85 | −11.640 | 10.772 | 37.778 | 1.00 | 40.65 | O |
| ATOM | 2312 | N | PRO | B | 86 | −12.857 | 11.082 | 33.046 | 1.00 | 33.28 | N |
| ATOM | 2313 | CA | PRO | B | 86 | −12.643 | 11.413 | 31.631 | 1.00 | 31.64 | C |
| ATOM | 2314 | C | PRO | B | 86 | −12.220 | 10.209 | 30.792 | 1.00 | 35.32 | C |
| ATOM | 2315 | O | PRO | B | 86 | −12.635 | 10.093 | 29.641 | 1.00 | 30.64 | O |
| ATOM | 2316 | CB | PRO | B | 86 | −11.520 | 12.456 | 31.681 | 1.00 | 34.31 | C |
| ATOM | 2317 | CG | PRO | B | 86 | −11.690 | 13.108 | 33.001 | 1.00 | 42.02 | C |
| ATOM | 2318 | CD | PRO | B | 86 | −12.146 | 12.020 | 33.936 | 1.00 | 35.55 | C |
| ATOM | 2319 | N | GLU | B | 87 | −11.423 | 9.316 | 31.373 | 1.00 | 32.17 | N |
| ATOM | 2320 | CA | GLU | B | 87 | −10.921 | 8.161 | 30.637 | 1.00 | 31.69 | C |
| ATOM | 2321 | C | GLU | B | 87 | −11.975 | 7.063 | 30.470 | 1.00 | 31.13 | C |
| ATOM | 2322 | O | GLU | B | 87 | −11.744 | 6.086 | 29.761 | 1.00 | 31.02 | O |
| ATOM | 2323 | CB | GLU | B | 87 | −9.681 | 7.583 | 31.327 | 1.00 | 32.83 | C |
| ATOM | 2324 | CG | GLU | B | 87 | −9.941 | 6.983 | 32.703 | 1.00 | 34.70 | C |
| ATOM | 2325 | CD | GLU | B | 87 | −9.628 | 7.950 | 33.834 | 1.00 | 47.47 | C |
| ATOM | 2326 | OE1 | GLU | B | 87 | −9.890 | 9.166 | 33.681 | 1.00 | 39.21 | O |
| ATOM | 2327 | OE2 | GLU | B | 87 | −9.111 | 7.486 | 34.876 | 1.00 | 49.29 | O |
| ATOM | 2328 | N | ASP | B | 88 | −13.131 | 7.227 | 31.108 | 1.00 | 28.67 | N |
| ATOM | 2329 | CA | ASP | B | 88 | −14.175 | 6.210 | 31.053 | 1.00 | 29.26 | C |
| ATOM | 2330 | C | ASP | B | 88 | −15.032 | 6.315 | 29.787 | 1.00 | 31.41 | C |
| ATOM | 2331 | O | ASP | B | 88 | −15.961 | 5.532 | 29.602 | 1.00 | 31.09 | O |
| ATOM | 2332 | CB | ASP | B | 88 | −15.070 | 6.293 | 32.295 | 1.00 | 32.59 | C |
| ATOM | 2333 | CG | ASP | B | 88 | −14.287 | 6.153 | 33.595 | 1.00 | 39.45 | C |
| ATOM | 2334 | OD1 | ASP | B | 88 | −13.166 | 5.597 | 33.565 | 1.00 | 34.75 | O |
| ATOM | 2335 | OD2 | ASP | B | 88 | −14.794 | 6.595 | 34.650 | 1.00 | 40.00 | O |
| ATOM | 2336 | N | VAL | B | 89 | −14.725 | 7.276 | 28.920 | 1.00 | 27.74 | N |
| ATOM | 2337 | CA | VAL | B | 89 | −15.437 | 7.395 | 27.648 | 1.00 | 29.97 | C |
| ATOM | 2338 | C | VAL | B | 89 | −15.162 | 6.169 | 26.783 | 1.00 | 26.75 | C |
| ATOM | 2339 | O | VAL | B | 89 | −14.020 | 5.928 | 26.391 | 1.00 | 32.52 | O |
| ATOM | 2340 | CB | VAL | B | 89 | −15.029 | 8.662 | 26.862 | 1.00 | 36.47 | C |
| ATOM | 2341 | CG1 | VAL | B | 89 | −15.785 | 8.732 | 25.538 | 1.00 | 36.88 | C |
| ATOM | 2342 | CG2 | VAL | B | 89 | −15.281 | 9.908 | 27.681 | 1.00 | 41.88 | C |
| ATOM | 2343 | N | ALA | B | 90 | −16.209 | 5.410 | 26.479 | 1.00 | 25.10 | N |
| ATOM | 2344 | CA | ALA | B | 90 | −16.063 | 4.149 | 25.764 | 1.00 | 28.51 | C |
| ATOM | 2345 | C | ALA | B | 90 | −17.410 | 3.508 | 25.491 | 1.00 | 30.70 | C |
| ATOM | 2346 | O | ALA | B | 90 | −18.448 | 3.995 | 25.943 | 1.00 | 27.64 | O |
| ATOM | 2347 | CB | ALA | B | 90 | −15.185 | 3.178 | 26.561 | 1.00 | 30.46 | C |
| ATOM | 2348 | N | VAL | B | 91 | −17.377 | 2.401 | 24.755 | 1.00 | 29.92 | N |
| ATOM | 2349 | CA | VAL | B | 91 | −18.539 | 1.542 | 24.606 | 1.00 | 28.27 | C |
| ATOM | 2350 | C | VAL | B | 91 | −18.425 | 0.364 | 25.573 | 1.00 | 33.48 | C |
| ATOM | 2351 | O | VAL | B | 91 | −17.368 | −0.265 | 25.684 | 1.00 | 25.89 | O |
| ATOM | 2352 | CB | VAL | B | 91 | −18.683 | 1.024 | 23.172 | 1.00 | 28.97 | C |
| ATOM | 2353 | CG1 | VAL | B | 91 | −19.940 | 0.178 | 23.045 | 1.00 | 28.55 | C |
| ATOM | 2354 | CG2 | VAL | B | 91 | −18.723 | 2.194 | 22.196 | 1.00 | 29.32 | C |
| ATOM | 2355 | N | TYR | B | 92 | −19.511 | 0.077 | 26.281 | 1.00 | 29.51 | N |
| ATOM | 2356 | CA | TYR | B | 92 | −19.509 | −0.993 | 27.267 | 1.00 | 29.47 | C |
| ATOM | 2357 | C | TYR | B | 92 | −20.379 | −2.148 | 26.793 | 1.00 | 33.18 | C |
| ATOM | 2358 | O | TYR | B | 92 | −21.477 | −1.945 | 26.267 | 1.00 | 29.29 | O |
| ATOM | 2359 | CB | TYR | B | 92 | −19.978 | −0.472 | 28.630 | 1.00 | 23.56 | C |
| ATOM | 2360 | CG | TYR | B | 92 | −19.010 | 0.510 | 29.254 | 1.00 | 27.95 | C |
| ATOM | 2361 | CD2 | TYR | B | 92 | −18.114 | 0.104 | 30.236 | 1.00 | 31.49 | C |
| ATOM | 2362 | CD1 | TYR | B | 92 | −18.978 | 1.841 | 28.848 | 1.00 | 28.41 | C |
| ATOM | 2363 | CE2 | TYR | B | 92 | −17.222 | 0.995 | 30.808 | 1.00 | 26.89 | C |
| ATOM | 2364 | CE1 | TYR | B | 92 | −18.086 | 2.740 | 29.411 | 1.00 | 25.28 | C |
| ATOM | 2365 | CZ | TYR | B | 92 | −17.213 | 2.309 | 30.387 | 1.00 | 27.09 | C |
| ATOM | 2366 | OH | TYR | B | 92 | −16.325 | 3.190 | 30.940 | 1.00 | 27.92 | O |
| ATOM | 2367 | N | TYR | B | 93 | −19.863 | −3.361 | 26.962 | 1.00 | 27.67 | N |
| ATOM | 2368 | CA | TYR | B | 93 | −20.548 | −4.569 | 26.524 | 1.00 | 26.66 | C |
| ATOM | 2369 | C | TYR | B | 93 | −20.725 | −5.548 | 27.673 | 1.00 | 29.56 | C |
| ATOM | 2370 | O | TYR | B | 93 | −19.802 | −5.759 | 28.458 | 1.00 | 27.75 | O |
| ATOM | 2371 | CB | TYR | B | 93 | −19.765 | −5.270 | 25.412 | 1.00 | 25.28 | C |
| ATOM | 2372 | CG | TYR | B | 93 | −19.615 | −4.503 | 24.125 | 1.00 | 28.54 | C |

TABLE 10.2-continued

| | | | | | | | | | | |
|---|---|---|---|---|---|---|---|---|---|---|
| ATOM | 2373 | CD2 | TYR | B | 93 | −20.529 | −4.662 | 23.090 | 1.00 | 26.88 | C |
| ATOM | 2374 | CD1 | TYR | B | 93 | −18.540 | −3.644 | 23.928 | 1.00 | 27.13 | C |
| ATOM | 2375 | CE2 | TYR | B | 93 | −20.386 | −3.973 | 21.899 | 1.00 | 32.89 | C |
| ATOM | 2376 | CE1 | TYR | B | 93 | −18.385 | −2.955 | 22.743 | 1.00 | 29.51 | C |
| ATOM | 2377 | CZ | TYR | B | 93 | −19.309 | −3.123 | 21.731 | 1.00 | 32.69 | C |
| ATOM | 2378 | OH | TYR | B | 93 | −19.161 | −2.436 | 20.550 | 1.00 | 33.36 | O |
| ATOM | 2379 | N | CYS | B | 94 | −21.901 | −6.157 | 27.762 | 1.00 | 25.68 | N |
| ATOM | 2380 | CA | CYS | B | 94 | −22.079 | −7.300 | 28.644 | 1.00 | 25.53 | C |
| ATOM | 2381 | C | CYS | B | 94 | −21.899 | −8.557 | 27.810 | 1.00 | 28.07 | C |
| ATOM | 2382 | O | CYS | B | 94 | −22.013 | −8.516 | 26.585 | 1.00 | 28.25 | O |
| ATOM | 2383 | CB | CYS | B | 94 | −23.450 | −7.282 | 29.329 | 1.00 | 30.94 | C |
| ATOM | 2384 | SG | CYS | B | 94 | −24.873 | −7.383 | 28.210 | 1.00 | 35.78 | S |
| ATOM | 2385 | N | GLN | B | 95 | −21.606 | −9.671 | 28.468 | 1.00 | 25.81 | N |
| ATOM | 2386 | CA | GLN | B | 95 | −21.373 | −10.920 | 27.758 | 1.00 | 28.41 | C |
| ATOM | 2387 | C | GLN | B | 95 | −21.819 | −12.093 | 28.612 | 1.00 | 24.10 | C |
| ATOM | 2388 | O | GLN | B | 95 | −21.476 | −12.169 | 29.789 | 1.00 | 33.33 | O |
| ATOM | 2389 | CB | GLN | B | 95 | −19.891 | −11.065 | 27.391 | 1.00 | 24.57 | C |
| ATOM | 2390 | CG | GLN | B | 95 | −19.574 | −12.277 | 26.523 | 1.00 | 27.70 | C |
| ATOM | 2391 | CD | GLN | B | 95 | −18.497 | −13.168 | 27.121 | 1.00 | 30.66 | C |
| ATOM | 2392 | NE2 | GLN | B | 95 | −18.756 | −14.468 | 27.147 | 1.00 | 41.67 | N |
| ATOM | 2393 | OE1 | GLN | B | 95 | −17.452 | −12.695 | 27.557 | 1.00 | 36.39 | O |
| ATOM | 2394 | N | GLN | B | 96 | −22.584 | −13.008 | 28.031 | 1.00 | 30.99 | N |
| ATOM | 2395 | CA | GLN | B | 96 | −22.926 | −14.232 | 28.748 | 1.00 | 28.28 | C |
| ATOM | 2396 | C | GLN | B | 96 | −21.986 | −15.347 | 28.313 | 1.00 | 31.50 | C |
| ATOM | 2397 | O | GLN | B | 96 | −21.612 | −15.447 | 27.141 | 1.00 | 27.92 | O |
| ATOM | 2398 | CB | GLN | B | 96 | −24.392 | −14.630 | 28.517 | 1.00 | 24.83 | C |
| ATOM | 2399 | CG | GLN | B | 96 | −24.737 | −15.108 | 27.104 | 1.00 | 28.68 | C |
| ATOM | 2400 | CD | GLN | B | 96 | −24.439 | −16.586 | 26.876 | 1.00 | 32.36 | C |
| ATOM | 2401 | NE2 | GLN | B | 96 | −24.396 | −16.992 | 25.611 | 1.00 | 32.40 | N |
| ATOM | 2402 | OE1 | GLN | B | 96 | −24.241 | −17.348 | 27.826 | 1.00 | 32.56 | O |
| ATOM | 2403 | N | TYR | B | 97 | −21.592 | −16.182 | 29.261 | 1.00 | 26.53 | N |
| ATOM | 2404 | CA | TYR | B | 97 | −20.838 | −17.370 | 28.918 | 1.00 | 30.75 | C |
| ATOM | 2405 | C | TYR | B | 97 | −21.465 | −18.571 | 29.608 | 1.00 | 31.37 | C |
| ATOM | 2406 | O | TYR | B | 97 | −20.778 | −19.519 | 29.989 | 1.00 | 28.22 | O |
| ATOM | 2407 | CB | TYR | B | 97 | −19.367 | −17.209 | 29.294 | 1.00 | 27.16 | C |
| ATOM | 2408 | CG | TYR | B | 97 | −19.121 | −16.745 | 30.714 | 1.00 | 30.11 | C |
| ATOM | 2409 | CD2 | TYR | B | 97 | −18.893 | −17.661 | 31.737 | 1.00 | 25.04 | C |
| ATOM | 2410 | CD1 | TYR | B | 97 | −19.093 | −15.390 | 31.026 | 1.00 | 26.12 | C |
| ATOM | 2411 | CE2 | TYR | B | 97 | −18.650 | −17.239 | 33.033 | 1.00 | 26.05 | C |
| ATOM | 2412 | CE1 | TYR | B | 97 | −18.856 | −14.960 | 32.316 | 1.00 | 30.26 | C |
| ATOM | 2413 | CZ | TYR | B | 97 | −18.634 | −15.887 | 33.314 | 1.00 | 28.89 | C |
| ATOM | 2414 | OH | TYR | B | 97 | −18.396 | −15.458 | 34.597 | 1.00 | 29.84 | O |
| ATOM | 2415 | N | TYR | B | 98 | −22.784 | −18.510 | 29.762 | 1.00 | 37.70 | N |
| ATOM | 2416 | CA | TYR | B | 98 | −23.553 | −19.601 | 30.349 | 1.00 | 32.36 | C |
| ATOM | 2417 | C | TYR | B | 98 | −23.579 | −20.801 | 29.410 | 1.00 | 37.08 | C |
| ATOM | 2418 | O | TYR | B | 98 | −23.446 | −21.942 | 29.849 | 1.00 | 37.43 | O |
| ATOM | 2419 | CB | TYR | B | 98 | −24.981 | −19.153 | 30.672 | 1.00 | 32.63 | C |
| ATOM | 2420 | CG | TYR | B | 98 | −25.769 | −20.191 | 31.440 | 1.00 | 40.80 | C |
| ATOM | 2421 | CD1 | TYR | B | 98 | −25.434 | −20.511 | 32.750 | 1.00 | 39.01 | C |
| ATOM | 2422 | CD2 | TYR | B | 98 | −26.844 | −20.853 | 30.857 | 1.00 | 44.09 | C |
| ATOM | 2423 | CE1 | TYR | B | 98 | −26.146 | −21.462 | 33.461 | 1.00 | 46.24 | C |
| ATOM | 2424 | CE2 | TYR | B | 98 | −27.566 | −21.807 | 31.563 | 1.00 | 46.44 | C |
| ATOM | 2425 | CZ | TYR | B | 98 | −27.209 | −22.107 | 32.864 | 1.00 | 48.82 | C |
| ATOM | 2426 | OH | TYR | B | 98 | −27.913 | −23.052 | 33.574 | 1.00 | 61.88 | O |
| ATOM | 2427 | N | ASN | B | 99 | −23.758 | −20.542 | 28.117 | 1.00 | 36.19 | N |
| ATOM | 2428 | CA | ASN | B | 99 | −23.611 | −21.596 | 27.119 | 1.00 | 44.15 | C |
| ATOM | 2429 | C | ASN | B | 99 | −23.116 | −21.074 | 25.778 | 1.00 | 42.06 | C |
| ATOM | 2430 | O | ASN | B | 99 | −23.118 | −19.868 | 25.521 | 1.00 | 43.16 | O |
| ATOM | 2431 | CB | ASN | B | 99 | −24.927 | −22.361 | 26.924 | 1.00 | 49.30 | C |
| ATOM | 2432 | CG | ASN | B | 99 | −26.102 | −21.455 | 26.600 | 1.00 | 51.38 | C |
| ATOM | 2433 | OD1 | ASN | B | 99 | −27.134 | −21.508 | 27.271 | 1.00 | 68.12 | O |
| ATOM | 2434 | ND2 | ASN | B | 99 | −25.959 | −20.628 | 25.568 | 1.00 | 49.12 | N |
| ATOM | 2435 | N | THR | B | 100 | −22.700 | −22.001 | 24.924 | 1.00 | 38.31 | N |
| ATOM | 2436 | CA | THR | B | 100 | −22.195 | −21.657 | 23.607 | 1.00 | 37.71 | C |
| ATOM | 2437 | C | THR | B | 100 | −23.339 | −21.679 | 22.601 | 1.00 | 36.72 | C |
| ATOM | 2438 | O | THR | B | 100 | −24.243 | −22.506 | 22.713 | 1.00 | 45.21 | O |
| ATOM | 2439 | CB | THR | B | 100 | −21.076 | −22.618 | 23.173 | 1.00 | 40.81 | C |
| ATOM | 2440 | OG1 | THR | B | 100 | −21.540 | −23.966 | 23.286 | 1.00 | 41.71 | O |
| ATOM | 2441 | CG2 | THR | B | 100 | −19.855 | −22.442 | 24.069 | 1.00 | 34.33 | C |
| ATOM | 2442 | N | PRO | B | 101 | −23.313 | −20.765 | 21.617 | 1.00 | 37.91 | N |
| ATOM | 2443 | CA | PRO | B | 101 | −22.253 | −19.773 | 21.404 | 1.00 | 35.04 | C |
| ATOM | 2444 | C | PRO | B | 101 | −22.295 | −18.613 | 22.395 | 1.00 | 38.94 | C |
| ATOM | 2445 | O | PRO | B | 101 | −23.368 | −18.135 | 22.774 | 1.00 | 33.27 | O |
| ATOM | 2446 | CB | PRO | B | 101 | −22.526 | −19.273 | 19.983 | 1.00 | 36.11 | C |
| ATOM | 2447 | CG | PRO | B | 101 | −24.004 | −19.394 | 19.839 | 1.00 | 36.49 | C |
| ATOM | 2448 | CD | PRO | B | 101 | −24.388 | −20.638 | 20.615 | 1.00 | 42.27 | C |
| ATOM | 2449 | N | VAL | B | 102 | −21.111 | −18.192 | 22.823 | 1.00 | 35.40 | N |
| ATOM | 2450 | CA | VAL | B | 102 | −20.943 | −16.980 | 23.610 | 1.00 | 34.45 | C |
| ATOM | 2451 | C | VAL | B | 102 | −21.531 | −15.794 | 22.858 | 1.00 | 35.11 | C |
| ATOM | 2452 | O | VAL | B | 102 | −21.300 | −15.643 | 21.659 | 1.00 | 30.87 | O |

TABLE 10.2-continued

| | | | | | | | | | | |
|---|---|---|---|---|---|---|---|---|---|---|
| ATOM | 2453 | CB | VAL | B | 102 | −19.454 | −16.735 | 23.911 | 1.00 | 38.34 | C |
| ATOM | 2454 | CG1 | VAL | B | 102 | −19.155 | −15.250 | 24.058 | 1.00 | 41.39 | C |
| ATOM | 2455 | CG2 | VAL | B | 102 | −19.046 | −17.509 | 25.142 | 1.00 | 38.42 | C |
| ATOM | 2456 | N | THR | B | 103 | −22.307 | −14.966 | 23.549 | 1.00 | 28.91 | N |
| ATOM | 2457 | CA | THR | B | 103 | −22.929 | −13.817 | 22.901 | 1.00 | 32.04 | C |
| ATOM | 2458 | C | THR | B | 103 | −22.740 | −12.532 | 23.711 | 1.00 | 33.94 | C |
| ATOM | 2459 | O | THR | B | 103 | −22.715 | −12.554 | 24.945 | 1.00 | 30.64 | O |
| ATOM | 2460 | CB | THR | B | 103 | −24.437 | −14.054 | 22.659 | 1.00 | 33.42 | C |
| ATOM | 2461 | CG2 | THR | B | 103 | −24.658 | −15.178 | 21.636 | 1.00 | 30.57 | C |
| ATOM | 2462 | OG1 | THR | B | 103 | −25.068 | −14.415 | 23.890 | 1.00 | 35.52 | O |
| ATOM | 2463 | N | PHE | B | 104 | −22.594 | −11.419 | 22.996 | 1.00 | 27.76 | N |
| ATOM | 2464 | CA | PHE | B | 104 | −22.429 | −10.102 | 23.604 | 1.00 | 32.55 | C |
| ATOM | 2465 | C | PHE | B | 104 | −23.693 | −9.274 | 23.430 | 1.00 | 34.05 | C |
| ATOM | 2466 | O | PHE | B | 104 | −24.481 | −9.520 | 22.519 | 1.00 | 32.37 | O |
| ATOM | 2467 | CB | PHE | B | 104 | −21.257 | −9.342 | 22.971 | 1.00 | 30.42 | C |
| ATOM | 2468 | CG | PHE | B | 104 | −19.915 | −9.986 | 23.175 | 1.00 | 30.59 | C |
| ATOM | 2469 | CD1 | PHE | B | 104 | −19.531 | −11.079 | 22.417 | 1.00 | 27.18 | C |
| ATOM | 2470 | CD2 | PHE | B | 104 | −19.019 | −9.467 | 24.094 | 1.00 | 30.39 | C |
| ATOM | 2471 | CE1 | PHE | B | 104 | −18.289 | −11.660 | 22.590 | 1.00 | 31.59 | C |
| ATOM | 2472 | CE2 | PHE | B | 104 | −17.775 | −10.044 | 24.274 | 1.00 | 31.20 | C |
| ATOM | 2473 | CZ | PHE | B | 104 | −17.411 | −11.144 | 23.519 | 1.00 | 33.50 | C |
| ATOM | 2474 | N | GLY | B | 105 | −23.873 | −8.278 | 24.291 | 1.00 | 34.23 | N |
| ATOM | 2475 | CA | GLY | B | 105 | −24.878 | −7.258 | 24.057 | 1.00 | 26.27 | C |
| ATOM | 2476 | C | GLY | B | 105 | −24.415 | −6.334 | 22.941 | 1.00 | 34.89 | C |
| ATOM | 2477 | O | GLY | B | 105 | −23.264 | −6.413 | 22.509 | 1.00 | 31.29 | O |
| ATOM | 2478 | N | PRO | B | 106 | −25.307 | −5.447 | 22.470 | 1.00 | 35.38 | N |
| ATOM | 2479 | CA | PRO | B | 106 | −25.028 | −4.559 | 21.336 | 1.00 | 33.90 | C |
| ATOM | 2480 | C | PRO | B | 106 | −24.100 | −3.399 | 21.689 | 1.00 | 32.12 | C |
| ATOM | 2481 | O | PRO | B | 106 | −23.610 | −2.715 | 20.794 | 1.00 | 34.27 | O |
| ATOM | 2482 | CB | PRO | B | 106 | −26.417 | −4.037 | 20.956 | 1.00 | 29.01 | C |
| ATOM | 2483 | CG | PRO | B | 106 | −27.173 | −4.053 | 22.248 | 1.00 | 37.44 | C |
| ATOM | 2484 | CD | PRO | B | 106 | −26.676 | −5.267 | 22.989 | 1.00 | 33.03 | C |
| ATOM | 2485 | N | GLY | B | 107 | −23.874 | −3.177 | 22.978 | 1.00 | 34.23 | N |
| ATOM | 2486 | CA | GLY | B | 107 | −22.984 | −2.120 | 23.415 | 1.00 | 34.20 | C |
| ATOM | 2487 | C | GLY | B | 107 | −23.701 | −0.843 | 23.807 | 1.00 | 34.29 | C |
| ATOM | 2488 | O | GLY | B | 107 | −24.725 | −0.489 | 23.230 | 1.00 | 37.38 | O |
| ATOM | 2489 | N | THR | B | 108 | −23.149 | −0.148 | 24.795 | 1.00 | 33.98 | N |
| ATOM | 2490 | CA | THR | B | 108 | −23.695 | 1.121 | 25.256 | 1.00 | 35.86 | C |
| ATOM | 2491 | C | THR | B | 108 | −22.617 | 2.190 | 25.231 | 1.00 | 33.06 | C |
| ATOM | 2492 | O | THR | B | 108 | −21.586 | 2.039 | 25.886 | 1.00 | 33.05 | O |
| ATOM | 2493 | CB | THR | B | 108 | −24.251 | 1.016 | 26.690 | 1.00 | 31.62 | C |
| ATOM | 2494 | CG2 | THR | B | 108 | −24.619 | 2.395 | 27.221 | 1.00 | 36.86 | C |
| ATOM | 2495 | OG1 | THR | B | 108 | −25.406 | 0.174 | 26.702 | 1.00 | 36.12 | O |
| ATOM | 2496 | N | LYS | B | 109 | −22.847 | 3.271 | 24.493 | 1.00 | 28.00 | N |
| ATOM | 2497 | CA | LYS | B | 109 | −21.850 | 4.337 | 24.418 | 1.00 | 33.62 | C |
| ATOM | 2498 | C | LYS | B | 109 | −21.956 | 5.254 | 25.634 | 1.00 | 38.15 | C |
| ATOM | 2499 | O | LYS | B | 109 | −23.026 | 5.786 | 25.931 | 1.00 | 41.81 | O |
| ATOM | 2500 | CB | LYS | B | 109 | −22.008 | 5.142 | 23.124 | 1.00 | 36.39 | C |
| ATOM | 2501 | CG | LYS | B | 109 | −22.625 | 4.343 | 21.980 | 1.00 | 56.96 | C |
| ATOM | 2502 | CD | LYS | B | 109 | −21.807 | 4.421 | 20.696 | 1.00 | 56.11 | C |
| ATOM | 2503 | CE | LYS | B | 109 | −21.884 | 5.792 | 20.054 | 1.00 | 62.08 | C |
| ATOM | 2504 | NZ | LYS | B | 109 | −21.138 | 5.822 | 18.763 | 1.00 | 74.82 | N |
| ATOM | 2505 | N | VAL | B | 110 | −20.848 | 5.420 | 26.348 | 1.00 | 32.23 | N |
| ATOM | 2506 | CA | VAL | B | 110 | −20.804 | 6.345 | 27.474 | 1.00 | 29.73 | C |
| ATOM | 2507 | C | VAL | B | 110 | −19.884 | 7.524 | 27.185 | 1.00 | 32.33 | C |
| ATOM | 2508 | O | VAL | B | 110 | −18.699 | 7.340 | 26.904 | 1.00 | 33.08 | O |
| ATOM | 2509 | CB | VAL | B | 110 | −20.328 | 5.659 | 28.765 | 1.00 | 31.47 | C |
| ATOM | 2510 | CG1 | VAL | B | 110 | −20.223 | 6.678 | 29.886 | 1.00 | 29.96 | C |
| ATOM | 2511 | CG2 | VAL | B | 110 | −21.270 | 4.525 | 29.142 | 1.00 | 34.90 | C |
| ATOM | 2512 | N | GLY | B | 111 | −20.440 | 8.730 | 27.249 | 1.00 | 29.76 | N |
| ATOM | 2513 | CA | GLY | B | 111 | −19.666 | 9.945 | 27.076 | 1.00 | 29.88 | C |
| ATOM | 2514 | C | GLY | B | 111 | −19.749 | 10.757 | 28.351 | 1.00 | 39.68 | C |
| ATOM | 2515 | O | GLY | B | 111 | −20.459 | 10.374 | 29.280 | 1.00 | 39.37 | O |
| ATOM | 2516 | N | ILE | B | 112 | −19.030 | 11.872 | 28.416 | 1.00 | 31.76 | N |
| ATOM | 2517 | CA | ILE | B | 112 | −19.082 | 12.697 | 29.613 | 1.00 | 36.49 | C |
| ATOM | 2518 | C | ILE | B | 112 | −19.508 | 14.132 | 29.295 | 1.00 | 41.86 | C |
| ATOM | 2519 | O | ILE | B | 112 | −19.221 | 14.665 | 28.216 | 1.00 | 33.11 | O |
| ATOM | 2520 | CB | ILE | B | 112 | −17.720 | 12.704 | 30.366 | 1.00 | 36.62 | C |
| ATOM | 2521 | CG1 | ILE | B | 112 | −16.745 | 13.711 | 29.766 | 1.00 | 42.34 | C |
| ATOM | 2522 | CG2 | ILE | B | 112 | −17.105 | 11.311 | 30.403 | 1.00 | 53.62 | C |
| ATOM | 2523 | CD1 | ILE | B | 112 | −16.711 | 15.042 | 30.519 | 1.00 | 54.93 | C |
| ATOM | 2524 | O | LYS | B | 113 | −19.210 | 16.754 | 32.044 | 1.00 | 44.16 | O |
| ATOM | 2525 | N | LYS | B | 113 | −20.201 | 14.744 | 30.251 | 1.00 | 37.92 | N |
| ATOM | 2526 | CA | LYS | B | 113 | −20.582 | 16.147 | 30.170 | 1.00 | 39.34 | C |
| ATOM | 2527 | C | LYS | B | 113 | −19.560 | 17.015 | 30.892 | 1.00 | 43.78 | C |
| ATOM | 2528 | CB | LYS | B | 113 | −21.965 | 16.381 | 30.778 | 1.00 | 41.17 | C |
| ATOM | 2529 | CG | LYS | B | 113 | −23.120 | 15.740 | 30.040 | 1.00 | 40.99 | C |
| ATOM | 2530 | CD | LYS | B | 113 | −24.434 | 16.062 | 30.750 | 1.00 | 46.55 | C |
| ATOM | 2531 | CE | LYS | B | 113 | −25.614 | 15.365 | 30.094 | 1.00 | 50.82 | C |
| ATOM | 2532 | NZ | LYS | B | 113 | −26.868 | 15.545 | 30.882 | 1.00 | 66.34 | N |

TABLE 10.2-continued

| | | | | | | | | | | |
|---|---|---|---|---|---|---|---|---|---|---|
| ATOM | 2533 | O | ARG | B | 114 | −19.706 | 20.614 | 29.907 | 1.00 | 33.63 | O |
| ATOM | 2534 | N | ARG | B | 114 | −19.080 | 18.045 | 30.208 | 1.00 | 37.75 | N |
| ATOM | 2535 | CA | ARG | B | 114 | −18.179 | 19.009 | 30.821 | 1.00 | 32.69 | C |
| ATOM | 2536 | C | ARG | B | 114 | −18.661 | 20.423 | 30.526 | 1.00 | 32.37 | C |
| ATOM | 2537 | CB | ARG | B | 114 | −16.747 | 18.815 | 30.316 | 1.00 | 29.43 | C |
| ATOM | 2538 | CG | ARG | B | 114 | −16.605 | 18.850 | 28.801 | 1.00 | 32.96 | C |
| ATOM | 2539 | CD | ARG | B | 114 | −15.228 | 19.372 | 28.400 | 1.00 | 29.78 | C |
| ATOM | 2540 | NE | ARG | B | 114 | −15.053 | 20.768 | 28.793 | 1.00 | 30.75 | N |
| ATOM | 2541 | CZ | ARG | B | 114 | −13.893 | 21.418 | 28.775 | 1.00 | 35.05 | C |
| ATOM | 2542 | NH1 | ARG | B | 114 | −13.841 | 22.691 | 29.144 | 1.00 | 37.02 | N |
| ATOM | 2543 | NH2 | ARG | B | 114 | −12.784 | 20.801 | 28.392 | 1.00 | 37.36 | N |
| ATOM | 2544 | O | THR | B | 115 | −17.390 | 22.466 | 28.475 | 1.00 | 30.86 | O |
| ATOM | 2545 | N | THR | B | 115 | −17.898 | 21.413 | 30.968 | 1.00 | 34.13 | N |
| ATOM | 2546 | CA | THR | B | 115 | −18.244 | 22.800 | 30.701 | 1.00 | 37.77 | C |
| ATOM | 2547 | C | THR | B | 115 | −18.146 | 23.108 | 29.207 | 1.00 | 38.67 | C |
| ATOM | 2548 | CB | THR | B | 115 | −17.336 | 23.763 | 31.484 | 1.00 | 35.59 | C |
| ATOM | 2549 | OG1 | THR | B | 115 | −15.972 | 23.545 | 31.106 | 1.00 | 34.24 | O |
| ATOM | 2550 | CG2 | THR | B | 115 | −17.485 | 23.531 | 32.986 | 1.00 | 28.14 | C |
| ATOM | 2551 | N | VAL | B | 116 | −18.932 | 24.080 | 28.762 | 1.00 | 39.57 | N |
| ATOM | 2552 | CA | VAL | B | 116 | −18.884 | 24.545 | 27.383 | 1.00 | 35.06 | C |
| ATOM | 2553 | C | VAL | B | 116 | −17.491 | 25.075 | 27.047 | 1.00 | 35.92 | C |
| ATOM | 2554 | O | VAL | B | 116 | −16.872 | 25.772 | 27.855 | 1.00 | 32.43 | O |
| ATOM | 2555 | CB | VAL | B | 116 | −19.938 | 25.649 | 27.133 | 1.00 | 35.82 | C |
| ATOM | 2556 | CG1 | VAL | B | 116 | −19.734 | 26.295 | 25.778 | 1.00 | 33.41 | C |
| ATOM | 2557 | CG2 | VAL | B | 116 | −21.347 | 25.082 | 27.253 | 1.00 | 29.35 | C |
| ATOM | 2558 | N | ALA | B | 117 | −16.991 | 24.725 | 25.865 | 1.00 | 29.09 | N |
| ATOM | 2559 | CA | ALA | B | 117 | −15.719 | 25.259 | 25.387 | 1.00 | 27.87 | C |
| ATOM | 2560 | C | ALA | B | 117 | −15.829 | 25.618 | 23.913 | 1.00 | 34.19 | C |
| ATOM | 2561 | O | ALA | B | 117 | −16.203 | 24.779 | 23.088 | 1.00 | 29.90 | O |
| ATOM | 2562 | CB | ALA | B | 117 | −14.589 | 24.258 | 25.615 | 1.00 | 30.76 | C |
| ATOM | 2563 | N | ALA | B | 118 | −15.522 | 26.870 | 23.588 | 1.00 | 32.82 | N |
| ATOM | 2564 | CA | ALA | B | 118 | −15.615 | 27.347 | 22.212 | 1.00 | 34.29 | C |
| ATOM | 2565 | C | ALA | B | 118 | −14.474 | 26.788 | 21.370 | 1.00 | 29.81 | C |
| ATOM | 2566 | O | ALA | B | 118 | −13.357 | 26.625 | 21.858 | 1.00 | 31.85 | O |
| ATOM | 2567 | CB | ALA | B | 118 | −15.614 | 28.877 | 22.173 | 1.00 | 29.49 | C |
| ATOM | 2568 | N | PRO | B | 119 | −14.753 | 26.481 | 20.097 | 1.00 | 31.49 | N |
| ATOM | 2569 | CA | PRO | B | 119 | −13.680 | 25.979 | 19.237 | 1.00 | 32.80 | C |
| ATOM | 2570 | C | PRO | B | 119 | −12.745 | 27.089 | 18.790 | 1.00 | 34.11 | C |
| ATOM | 2571 | O | PRO | B | 119 | −13.190 | 28.218 | 18.601 | 1.00 | 30.89 | O |
| ATOM | 2572 | CB | PRO | B | 119 | −14.436 | 25.404 | 18.039 | 1.00 | 29.59 | C |
| ATOM | 2573 | CG | PRO | B | 119 | −15.668 | 26.247 | 17.957 | 1.00 | 33.03 | C |
| ATOM | 2574 | CD | PRO | B | 119 | −16.043 | 26.559 | 19.386 | 1.00 | 30.58 | C |
| ATOM | 2575 | N | SER | B | 120 | −11.467 | 26.769 | 18.635 | 1.00 | 29.42 | N |
| ATOM | 2576 | CA | SER | B | 120 | −10.567 | 27.624 | 17.878 | 1.00 | 36.74 | C |
| ATOM | 2577 | C | SER | B | 120 | −10.661 | 27.181 | 16.418 | 1.00 | 34.59 | C |
| ATOM | 2578 | O | SER | B | 120 | −10.687 | 25.983 | 16.131 | 1.00 | 33.48 | O |
| ATOM | 2579 | CB | SER | B | 120 | −9.135 | 27.531 | 18.407 | 1.00 | 31.92 | C |
| ATOM | 2580 | OG | SER | B | 120 | −8.627 | 26.219 | 18.245 | 1.00 | 50.83 | O |
| ATOM | 2581 | N | VAL | B | 121 | −10.734 | 28.139 | 15.499 | 1.00 | 34.03 | N |
| ATOM | 2582 | CA | VAL | B | 121 | −11.015 | 27.831 | 14.096 | 1.00 | 29.08 | C |
| ATOM | 2583 | C | VAL | B | 121 | −9.845 | 28.195 | 13.179 | 1.00 | 31.62 | C |
| ATOM | 2584 | O | VAL | B | 121 | −9.239 | 29.257 | 13.314 | 1.00 | 33.72 | O |
| ATOM | 2585 | CB | VAL | B | 121 | −12.300 | 28.560 | 13.616 | 1.00 | 30.04 | C |
| ATOM | 2586 | CG1 | VAL | B | 121 | −12.663 | 28.158 | 12.193 | 1.00 | 30.45 | C |
| ATOM | 2587 | CG2 | VAL | B | 121 | −13.460 | 28.259 | 14.551 | 1.00 | 31.72 | C |
| ATOM | 2588 | N | PHE | B | 122 | −9.534 | 27.295 | 12.251 | 1.00 | 27.86 | N |
| ATOM | 2589 | CA | PHE | B | 122 | −8.463 | 27.498 | 11.283 | 1.00 | 29.57 | C |
| ATOM | 2590 | C | PHE | B | 122 | −8.935 | 27.084 | 9.890 | 1.00 | 39.92 | C |
| ATOM | 2591 | O | PHE | B | 122 | −9.622 | 26.068 | 9.734 | 1.00 | 34.52 | O |
| ATOM | 2592 | CB | PHE | B | 122 | −7.215 | 26.689 | 11.663 | 1.00 | 36.36 | C |
| ATOM | 2593 | CG | PHE | B | 122 | −6.747 | 26.906 | 13.078 | 1.00 | 32.19 | C |
| ATOM | 2594 | CD1 | PHE | B | 122 | −7.271 | 26.158 | 14.117 | 1.00 | 36.97 | C |
| ATOM | 2595 | CD2 | PHE | B | 122 | −5.770 | 27.847 | 13.362 | 1.00 | 34.40 | C |
| ATOM | 2596 | CE1 | PHE | B | 122 | −6.836 | 26.352 | 15.419 | 1.00 | 41.91 | C |
| ATOM | 2597 | CE2 | PHE | B | 122 | −5.330 | 28.044 | 14.661 | 1.00 | 36.84 | C |
| ATOM | 2598 | CZ | PHE | B | 122 | −5.864 | 27.294 | 15.689 | 1.00 | 37.49 | C |
| ATOM | 2599 | N | ILE | B | 123 | −8.566 | 27.862 | 8.879 | 1.00 | 28.07 | N |
| ATOM | 2600 | CA | ILE | B | 123 | −8.915 | 27.528 | 7.505 | 1.00 | 32.41 | C |
| ATOM | 2601 | C | ILE | B | 123 | −7.636 | 27.277 | 6.701 | 1.00 | 32.00 | C |
| ATOM | 2602 | O | ILE | B | 123 | −6.622 | 27.942 | 6.907 | 1.00 | 31.75 | O |
| ATOM | 2603 | CB | ILE | B | 123 | −9.777 | 28.646 | 6.846 | 1.00 | 28.87 | C |
| ATOM | 2604 | CG1 | ILE | B | 123 | −10.347 | 28.183 | 5.502 | 1.00 | 32.47 | C |
| ATOM | 2605 | CG2 | ILE | B | 123 | −8.985 | 29.938 | 6.700 | 1.00 | 28.48 | C |
| ATOM | 2606 | CD1 | ILE | B | 123 | −11.358 | 29.154 | 4.896 | 1.00 | 31.95 | C |
| ATOM | 2607 | N | PHE | B | 124 | −7.679 | 26.291 | 5.811 | 1.00 | 31.26 | N |
| ATOM | 2608 | CA | PHE | B | 124 | −6.514 | 25.928 | 5.009 | 1.00 | 30.58 | C |
| ATOM | 2609 | C | PHE | B | 124 | −6.854 | 25.944 | 3.523 | 1.00 | 35.12 | C |
| ATOM | 2610 | O | PHE | B | 124 | −7.774 | 25.250 | 3.089 | 1.00 | 33.03 | O |
| ATOM | 2611 | CB | PHE | B | 124 | −5.992 | 24.540 | 5.390 | 1.00 | 32.40 | C |
| ATOM | 2612 | CG | PHE | B | 124 | −5.566 | 24.410 | 6.825 | 1.00 | 32.10 | C |

TABLE 10.2-continued

| | | | | | | | | | | |
|---|---|---|---|---|---|---|---|---|---|---|
| ATOM | 2613 | CD1 | PHE | B | 124 | −4.314 | 24.842 | 7.232 | 1.00 | 31.26 | C |
| ATOM | 2614 | CD2 | PHE | B | 124 | −6.407 | 23.820 | 7.759 | 1.00 | 31.84 | C |
| ATOM | 2615 | CE1 | PHE | B | 124 | −3.913 | 24.711 | 8.549 | 1.00 | 34.33 | C |
| ATOM | 2616 | CE2 | PHE | B | 124 | −6.015 | 23.684 | 9.076 | 1.00 | 34.28 | C |
| ATOM | 2617 | CZ | PHE | B | 124 | −4.765 | 24.133 | 9.474 | 1.00 | 35.30 | C |
| ATOM | 2618 | N | PRO | B | 125 | −6.107 | 26.731 | 2.734 | 1.00 | 37.67 | N |
| ATOM | 2619 | CA | PRO | B | 125 | −6.296 | 26.753 | 1.278 | 1.00 | 33.34 | C |
| ATOM | 2620 | C | PRO | B | 125 | −5.816 | 25.454 | 0.646 | 1.00 | 32.58 | C |
| ATOM | 2621 | O | PRO | B | 125 | −4.996 | 24.766 | 1.247 | 1.00 | 29.20 | O |
| ATOM | 2622 | CB | PRO | B | 125 | −5.422 | 27.930 | 0.816 | 1.00 | 33.45 | C |
| ATOM | 2623 | CG | PRO | B | 125 | −5.036 | 28.671 | 2.074 | 1.00 | 39.04 | C |
| ATOM | 2624 | CD | PRO | B | 125 | −5.049 | 27.658 | 3.171 | 1.00 | 32.49 | C |
| ATOM | 2625 | N | PRO | B | 126 | −6.307 | 25.126 | −0.557 | 1.00 | 31.25 | N |
| ATOM | 2626 | CA | PRO | B | 126 | −5.736 | 23.974 | −1.263 | 1.00 | 36.87 | C |
| ATOM | 2627 | C | PRO | B | 126 | −4.265 | 24.213 | −1.615 | 1.00 | 37.25 | C |
| ATOM | 2628 | O | PRO | B | 126 | −3.844 | 25.360 | −1.778 | 1.00 | 32.38 | O |
| ATOM | 2629 | CB | PRO | B | 126 | −6.599 | 23.868 | −2.527 | 1.00 | 31.74 | C |
| ATOM | 2630 | CG | PRO | B | 126 | −7.137 | 25.243 | −2.728 | 1.00 | 32.69 | C |
| ATOM | 2631 | CD | PRO | B | 126 | −7.351 | 25.800 | −1.348 | 1.00 | 31.78 | C |
| ATOM | 2632 | N | SER | B | 127 | −3.491 | 23.139 | −1.709 | 1.00 | 33.45 | N |
| ATOM | 2633 | CA | SER | B | 127 | −2.082 | 23.251 | −2.055 | 1.00 | 37.63 | C |
| ATOM | 2634 | C | SER | B | 127 | −1.931 | 23.368 | −3.565 | 1.00 | 41.08 | C |
| ATOM | 2635 | O | SER | B | 127 | −2.812 | 22.939 | −4.317 | 1.00 | 38.62 | O |
| ATOM | 2636 | CB | SER | B | 127 | −1.299 | 22.043 | −1.542 | 1.00 | 33.64 | C |
| ATOM | 2637 | OG | SER | B | 127 | −1.647 | 20.874 | −2.267 | 1.00 | 31.28 | O |
| ATOM | 2638 | N | ASP | B | 128 | −0.814 | 23.938 | −4.008 | 1.00 | 40.33 | N |
| ATOM | 2639 | CA | ASP | B | 128 | −0.544 | 24.044 | −5.437 | 1.00 | 42.97 | C |
| ATOM | 2640 | C | ASP | B | 128 | −0.439 | 22.664 | −6.066 | 1.00 | 36.76 | C |
| ATOM | 2641 | O | ASP | B | 128 | −0.783 | 22.481 | −7.232 | 1.00 | 42.27 | O |
| ATOM | 2642 | CB | ASP | B | 128 | 0.737 | 24.841 | −5.695 | 1.00 | 46.63 | C |
| ATOM | 2643 | CG | ASP | B | 128 | 0.570 | 26.322 | −5.406 | 1.00 | 59.28 | C |
| ATOM | 2644 | OD1 | ASP | B | 128 | −0.562 | 26.834 | −5.546 | 1.00 | 59.20 | O |
| ATOM | 2645 | OD2 | ASP | B | 128 | 1.570 | 26.974 | −5.040 | 1.00 | 62.56 | O |
| ATOM | 2646 | N | GLU | B | 129 | 0.022 | 21.690 | −5.286 | 1.00 | 37.90 | N |
| ATOM | 2647 | CA | GLU | B | 129 | 0.240 | 20.347 | −5.809 | 1.00 | 41.75 | C |
| ATOM | 2648 | C | GLU | B | 129 | −1.075 | 19.666 | −6.183 | 1.00 | 42.49 | C |
| ATOM | 2649 | O | GLU | B | 129 | −1.157 | 18.982 | −7.202 | 1.00 | 42.15 | O |
| ATOM | 2650 | CB | GLU | B | 129 | 1.008 | 19.489 | −4.800 | 1.00 | 38.29 | C |
| ATOM | 2651 | CG | GLU | B | 129 | 1.521 | 18.181 | −5.394 | 1.00 | 55.48 | C |
| ATOM | 2652 | CD | GLU | B | 129 | 2.471 | 17.435 | −4.469 | 1.00 | 75.53 | C |
| ATOM | 2653 | OE1 | GLU | B | 129 | 3.644 | 17.234 | −4.857 | 1.00 | 78.69 | O |
| ATOM | 2654 | OE2 | GLU | B | 129 | 2.044 | 17.043 | −3.360 | 1.00 | 72.25 | O |
| ATOM | 2655 | N | GLN | B | 130 | −2.104 | 19.857 | −5.365 | 1.00 | 37.24 | N |
| ATOM | 2656 | CA | GLN | B | 130 | −3.403 | 19.259 | −5.654 | 1.00 | 34.81 | C |
| ATOM | 2657 | C | GLN | B | 130 | −4.093 | 19.947 | −6.829 | 1.00 | 35.05 | C |
| ATOM | 2658 | O | GLN | B | 130 | −4.774 | 19.297 | −7.622 | 1.00 | 36.82 | O |
| ATOM | 2659 | CB | GLN | B | 130 | −4.312 | 19.312 | −4.427 | 1.00 | 32.75 | C |
| ATOM | 2660 | CG | GLN | B | 130 | −5.631 | 18.597 | −4.645 | 1.00 | 30.49 | C |
| ATOM | 2661 | CD | GLN | B | 130 | −6.626 | 18.848 | −3.534 | 1.00 | 38.30 | C |
| ATOM | 2662 | NE2 | GLN | B | 130 | −7.643 | 18.000 | −3.456 | 1.00 | 35.08 | N |
| ATOM | 2663 | OE1 | GLN | B | 130 | −6.485 | 19.793 | −2.754 | 1.00 | 31.99 | O |
| ATOM | 2664 | N | LEU | B | 131 | −3.930 | 21.265 | −6.924 | 1.00 | 34.78 | N |
| ATOM | 2665 | CA | LEU | B | 131 | −4.512 | 22.036 | −8.019 | 1.00 | 46.01 | C |
| ATOM | 2666 | C | LEU | B | 131 | −4.044 | 21.506 | −9.369 | 1.00 | 40.30 | C |
| ATOM | 2667 | O | LEU | B | 131 | −4.800 | 21.497 | −10.337 | 1.00 | 49.24 | O |
| ATOM | 2668 | CB | LEU | B | 131 | −4.160 | 23.521 | −7.884 | 1.00 | 39.51 | C |
| ATOM | 2669 | CG | LEU | B | 131 | −4.884 | 24.279 | −6.773 | 1.00 | 41.36 | C |
| ATOM | 2670 | CD1 | LEU | B | 131 | −4.458 | 25.736 | −6.738 | 1.00 | 42.24 | C |
| ATOM | 2671 | CD2 | LEU | B | 131 | −6.385 | 24.168 | −6.956 | 1.00 | 37.48 | C |
| ATOM | 2672 | N | LYS | B | 132 | −2.798 | 21.048 | −9.414 | 1.00 | 43.36 | N |
| ATOM | 2673 | CA | LYS | B | 132 | −2.214 | 20.462 | −10.616 | 1.00 | 47.83 | C |
| ATOM | 2674 | C | LYS | B | 132 | −2.933 | 19.197 | −11.086 | 1.00 | 46.86 | C |
| ATOM | 2675 | O | LYS | B | 132 | −2.715 | 18.740 | −12.206 | 1.00 | 54.52 | O |
| ATOM | 2676 | CB | LYS | B | 132 | −0.737 | 20.146 | −10.373 | 1.00 | 49.58 | C |
| ATOM | 2677 | CG | LYS | B | 132 | 0.229 | 21.216 | −10.868 | 1.00 | 56.15 | C |
| ATOM | 2678 | CD | LYS | B | 132 | 1.614 | 21.060 | −10.241 | 1.00 | 64.07 | C |
| ATOM | 2679 | CE | LYS | B | 132 | 2.009 | 19.593 | −10.066 | 1.00 | 66.31 | C |
| ATOM | 2680 | NZ | LYS | B | 132 | 2.086 | 18.843 | −11.352 | 1.00 | 66.61 | N |
| ATOM | 2681 | N | SER | B | 133 | −3.776 | 18.626 | −10.232 | 1.00 | 47.49 | N |
| ATOM | 2682 | CA | SER | B | 133 | −4.497 | 17.403 | −10.578 | 1.00 | 38.87 | C |
| ATOM | 2683 | C | SER | B | 133 | −5.963 | 17.680 | −10.922 | 1.00 | 45.85 | C |
| ATOM | 2684 | O | SER | B | 133 | −6.718 | 16.757 | −11.226 | 1.00 | 45.58 | O |
| ATOM | 2685 | CB | SER | B | 133 | −4.415 | 16.389 | −9.433 | 1.00 | 48.92 | C |
| ATOM | 2686 | OG | SER | B | 133 | −5.127 | 16.848 | −8.293 | 1.00 | 52.02 | O |
| ATOM | 2687 | N | GLY | B | 134 | −6.365 | 18.947 | −10.858 | 1.00 | 39.38 | N |
| ATOM | 2688 | CA | GLY | B | 134 | −7.692 | 19.349 | −11.294 | 1.00 | 38.72 | C |
| ATOM | 2689 | C | GLY | B | 134 | −8.737 | 19.497 | −10.202 | 1.00 | 40.64 | C |
| ATOM | 2690 | O | GLY | B | 134 | −9.904 | 19.767 | −10.488 | 1.00 | 47.67 | O |
| ATOM | 2691 | N | THR | B | 135 | −8.320 | 19.335 | −8.951 | 1.00 | 44.09 | N |
| ATOM | 2692 | CA | THR | B | 135 | −9.239 | 19.382 | −7.816 | 1.00 | 41.60 | C |

TABLE 10.2-continued

| | | | | | | | | | | |
|---|---|---|---|---|---|---|---|---|---|---|
| ATOM | 2693 | C | THR | B | 135 | −8.700 | 20.294 | −6.716 | 1.00 | 38.79 | C |
| ATOM | 2694 | O | THR | B | 135 | −7.490 | 20.386 | −6.515 | 1.00 | 39.11 | O |
| ATOM | 2695 | CB | THR | B | 135 | −9.485 | 17.965 | −7.246 | 1.00 | 42.58 | C |
| ATOM | 2696 | CG2 | THR | B | 135 | −10.545 | 17.982 | −6.153 | 1.00 | 36.34 | C |
| ATOM | 2697 | OG1 | THR | B | 135 | −9.910 | 17.092 | −8.300 | 1.00 | 49.29 | O |
| ATOM | 2698 | N | ALA | B | 136 | −9.599 | 20.979 | −6.016 | 1.00 | 39.56 | N |
| ATOM | 2699 | CA | ALA | B | 136 | −9.218 | 21.845 | −4.907 | 1.00 | 31.14 | C |
| ATOM | 2700 | C | ALA | B | 136 | −9.980 | 21.476 | −3.637 | 1.00 | 41.19 | C |
| ATOM | 2701 | O | ALA | B | 136 | −11.211 | 21.514 | −3.609 | 1.00 | 38.90 | O |
| ATOM | 2702 | CB | ALA | B | 136 | −9.465 | 23.300 | −5.257 | 1.00 | 30.89 | C |
| ATOM | 2703 | N | SER | B | 137 | −9.243 | 21.121 | −2.588 | 1.00 | 32.83 | N |
| ATOM | 2704 | CA | SER | B | 137 | −9.844 | 20.823 | −1.295 | 1.00 | 29.16 | C |
| ATOM | 2705 | C | SER | B | 137 | −9.551 | 21.947 | −0.312 | 1.00 | 31.90 | C |
| ATOM | 2706 | O | SER | B | 137 | −8.391 | 22.273 | −0.060 | 1.00 | 32.52 | O |
| ATOM | 2707 | CB | SER | B | 137 | −9.325 | 19.493 | −0.742 | 1.00 | 31.20 | C |
| ATOM | 2708 | OG | SER | B | 137 | −9.665 | 18.411 | −1.588 | 1.00 | 35.83 | O |
| ATOM | 2709 | N | VAL | B | 138 | −10.605 | 22.549 | 0.227 | 1.00 | 29.38 | N |
| ATOM | 2710 | CA | VAL | B | 138 | −10.455 | 23.578 | 1.250 | 1.00 | 28.61 | C |
| ATOM | 2711 | C | VAL | B | 138 | −10.856 | 22.986 | 2.596 | 1.00 | 28.33 | C |
| ATOM | 2712 | O | VAL | B | 138 | −11.896 | 22.332 | 2.708 | 1.00 | 28.89 | O |
| ATOM | 2713 | CB | VAL | B | 138 | −11.304 | 24.821 | 0.943 | 1.00 | 32.25 | C |
| ATOM | 2714 | CG1 | VAL | B | 138 | −10.880 | 25.981 | 1.825 | 1.00 | 32.25 | C |
| ATOM | 2715 | CG2 | VAL | B | 138 | −11.171 | 25.197 | −0.524 | 1.00 | 34.85 | C |
| ATOM | 2716 | N | VAL | B | 139 | −10.031 | 23.208 | 3.615 | 1.00 | 27.05 | N |
| ATOM | 2717 | CA | VAL | B | 139 | −10.241 | 22.558 | 4.906 | 1.00 | 30.66 | C |
| ATOM | 2718 | C | VAL | B | 139 | −10.472 | 23.556 | 6.033 | 1.00 | 28.68 | C |
| ATOM | 2719 | O | VAL | B | 139 | −9.741 | 24.537 | 6.173 | 1.00 | 29.77 | O |
| ATOM | 2720 | CB | VAL | B | 139 | −9.042 | 21.646 | 5.267 | 1.00 | 31.42 | C |
| ATOM | 2721 | CG1 | VAL | B | 139 | −9.199 | 21.067 | 6.665 | 1.00 | 30.03 | C |
| ATOM | 2722 | CG2 | VAL | B | 139 | −8.904 | 20.529 | 4.239 | 1.00 | 29.56 | C |
| ATOM | 2723 | N | CYS | B | 140 | −11.507 | 23.300 | 6.826 | 1.00 | 31.41 | N |
| ATOM | 2724 | CA | CYS | B | 140 | −11.792 | 24.088 | 8.015 | 1.00 | 30.57 | C |
| ATOM | 2725 | C | CYS | B | 140 | −11.634 | 23.207 | 9.245 | 1.00 | 36.50 | C |
| ATOM | 2726 | O | CYS | B | 140 | −12.198 | 22.113 | 9.306 | 1.00 | 29.35 | O |
| ATOM | 2727 | CB | CYS | B | 140 | −13.205 | 24.672 | 7.960 | 1.00 | 32.78 | C |
| ATOM | 2728 | SG | CYS | B | 140 | −13.561 | 25.937 | 9.212 | 1.00 | 47.42 | S |
| ATOM | 2729 | N | LEU | B | 141 | −10.871 | 23.686 | 10.222 | 1.00 | 34.12 | N |
| ATOM | 2730 | CA | LEU | B | 141 | −10.629 | 22.931 | 11.444 | 1.00 | 30.81 | C |
| ATOM | 2731 | C | LEU | B | 141 | −11.230 | 23.619 | 12.672 | 1.00 | 33.78 | C |
| ATOM | 2732 | O | LEU | B | 141 | −11.006 | 24.809 | 12.904 | 1.00 | 32.21 | O |
| ATOM | 2733 | CB | LEU | B | 141 | −9.126 | 22.721 | 11.649 | 1.00 | 30.25 | C |
| ATOM | 2734 | CG | LEU | B | 141 | −8.728 | 22.199 | 13.032 | 1.00 | 33.72 | C |
| ATOM | 2735 | CD1 | LEU | B | 141 | −9.143 | 20.737 | 13.205 | 1.00 | 28.38 | C |
| ATOM | 2736 | CD2 | LEU | B | 141 | −7.234 | 22.383 | 13.280 | 1.00 | 35.34 | C |
| ATOM | 2737 | N | LEU | B | 142 | −12.006 | 22.862 | 13.442 | 1.00 | 25.85 | N |
| ATOM | 2738 | CA | LEU | B | 142 | −12.538 | 23.331 | 14.721 | 1.00 | 29.63 | C |
| ATOM | 2739 | C | LEU | B | 142 | −11.865 | 22.526 | 15.822 | 1.00 | 31.52 | C |
| ATOM | 2740 | O | LEU | B | 142 | −11.966 | 21.300 | 15.848 | 1.00 | 32.17 | O |
| ATOM | 2741 | CB | LEU | B | 142 | −14.062 | 23.177 | 14.796 | 1.00 | 28.07 | C |
| ATOM | 2742 | CG | LEU | B | 142 | −14.992 | 24.140 | 14.044 | 1.00 | 29.90 | C |
| ATOM | 2743 | CD1 | LEU | B | 142 | −14.697 | 24.189 | 12.550 | 1.00 | 36.79 | C |
| ATOM | 2744 | CD2 | LEU | B | 142 | −16.440 | 23.731 | 14.274 | 1.00 | 27.06 | C |
| ATOM | 2745 | N | ASN | B | 143 | −11.174 | 23.209 | 16.723 | 1.00 | 25.29 | N |
| ATOM | 2746 | CA | ASN | B | 143 | −10.291 | 22.521 | 17.648 | 1.00 | 31.88 | C |
| ATOM | 2747 | C | ASN | B | 143 | −10.754 | 22.593 | 19.100 | 1.00 | 34.33 | C |
| ATOM | 2748 | O | ASN | B | 143 | −11.042 | 23.673 | 19.618 | 1.00 | 32.56 | O |
| ATOM | 2749 | CB | ASN | B | 143 | −8.876 | 23.089 | 17.512 | 1.00 | 32.86 | C |
| ATOM | 2750 | CG | ASN | B | 143 | −7.813 | 22.134 | 18.016 | 1.00 | 43.50 | C |
| ATOM | 2751 | ND2 | ASN | B | 143 | −7.037 | 22.574 | 18.997 | 1.00 | 47.72 | N |
| ATOM | 2752 | OD1 | ASN | B | 143 | −7.683 | 21.018 | 17.518 | 1.00 | 44.96 | O |
| ATOM | 2753 | N | ASN | B | 144 | −10.840 | 21.421 | 19.733 | 1.00 | 33.53 | N |
| ATOM | 2754 | CA | ASN | B | 144 | −11.100 | 21.284 | 21.171 | 1.00 | 31.24 | C |
| ATOM | 2755 | C | ASN | B | 144 | −12.330 | 22.023 | 21.688 | 1.00 | 29.06 | C |
| ATOM | 2756 | O | ASN | B | 144 | −12.211 | 22.953 | 22.482 | 1.00 | 33.00 | O |
| ATOM | 2757 | CB | ASN | B | 144 | −9.873 | 21.743 | 21.962 | 1.00 | 30.14 | C |
| ATOM | 2758 | CG | ASN | B | 144 | −8.626 | 20.965 | 21.598 | 1.00 | 37.05 | C |
| ATOM | 2759 | ND2 | ASN | B | 144 | −7.468 | 21.575 | 21.802 | 1.00 | 43.00 | N |
| ATOM | 2760 | OD1 | ASN | B | 144 | −8.704 | 19.827 | 21.134 | 1.00 | 38.36 | O |
| ATOM | 2761 | N | PHE | B | 145 | −13.513 | 21.602 | 21.258 | 1.00 | 31.89 | N |
| ATOM | 2762 | CA | PHE | B | 145 | −14.732 | 22.260 | 21.706 | 1.00 | 29.94 | C |
| ATOM | 2763 | C | PHE | B | 145 | −15.672 | 21.295 | 22.416 | 1.00 | 34.88 | C |
| ATOM | 2764 | O | PHE | B | 145 | −15.533 | 20.074 | 22.317 | 1.00 | 26.87 | O |
| ATOM | 2765 | CB | PHE | B | 145 | −15.455 | 22.936 | 20.529 | 1.00 | 26.54 | C |
| ATOM | 2766 | CG | PHE | B | 145 | −15.846 | 21.994 | 19.418 | 1.00 | 27.20 | C |
| ATOM | 2767 | CD1 | PHE | B | 145 | −14.961 | 21.705 | 18.392 | 1.00 | 25.82 | C |
| ATOM | 2768 | CD2 | PHE | B | 145 | −17.102 | 21.413 | 19.392 | 1.00 | 29.78 | C |
| ATOM | 2769 | CE1 | PHE | B | 145 | −15.316 | 20.839 | 17.368 | 1.00 | 27.58 | C |
| ATOM | 2770 | CE2 | PHE | B | 145 | −17.467 | 20.551 | 18.372 | 1.00 | 29.41 | C |
| ATOM | 2771 | CZ | PHE | B | 145 | −16.569 | 20.263 | 17.356 | 1.00 | 27.09 | C |
| ATOM | 2772 | N | TYR | B | 146 | −16.619 | 21.871 | 23.149 | 1.00 | 28.10 | N |

TABLE 10.2-continued

| | | | | | | | | | | |
|---|---|---|---|---|---|---|---|---|---|---|
| ATOM | 2773 | CA | TYR | B | 146 | −17.698 | 21.125 | 23.778 | 1.00 | 30.54 | C |
| ATOM | 2774 | C | TYR | B | 146 | −18.886 | 22.071 | 23.962 | 1.00 | 29.20 | C |
| ATOM | 2775 | O | TYR | B | 146 | −18.702 | 23.217 | 24.364 | 1.00 | 28.71 | O |
| ATOM | 2776 | CB | TYR | B | 146 | −17.262 | 20.527 | 25.128 | 1.00 | 31.96 | C |
| ATOM | 2777 | CG | TYR | B | 146 | −18.319 | 19.621 | 25.711 | 1.00 | 34.78 | C |
| ATOM | 2778 | CD2 | TYR | B | 146 | −18.334 | 18.262 | 25.418 | 1.00 | 31.97 | C |
| ATOM | 2779 | CD1 | TYR | B | 146 | −19.334 | 20.131 | 26.515 | 1.00 | 31.84 | C |
| ATOM | 2780 | CE2 | TYR | B | 146 | −19.319 | 17.432 | 25.925 | 1.00 | 32.92 | C |
| ATOM | 2781 | CE1 | TYR | B | 146 | −20.324 | 19.311 | 27.022 | 1.00 | 32.17 | C |
| ATOM | 2782 | CZ | TYR | B | 146 | −20.310 | 17.965 | 26.725 | 1.00 | 34.30 | C |
| ATOM | 2783 | OH | TYR | B | 146 | −21.291 | 17.149 | 27.228 | 1.00 | 42.60 | O |
| ATOM | 2784 | N | PRO | B | 147 | −20.112 | 21.593 | 23.695 | 1.00 | 25.21 | N |
| ATOM | 2785 | CA | PRO | B | 147 | −20.474 | 20.225 | 23.311 | 1.00 | 31.43 | C |
| ATOM | 2786 | C | PRO | B | 147 | −20.233 | 19.921 | 21.838 | 1.00 | 34.10 | C |
| ATOM | 2787 | O | PRO | B | 147 | −19.696 | 20.751 | 21.103 | 1.00 | 33.70 | O |
| ATOM | 2788 | CB | PRO | B | 147 | −21.967 | 20.159 | 23.643 | 1.00 | 32.07 | C |
| ATOM | 2789 | CG | PRO | B | 147 | −22.446 | 21.552 | 23.429 | 1.00 | 27.75 | C |
| ATOM | 2790 | CD | PRO | B | 147 | −21.301 | 22.453 | 23.836 | 1.00 | 31.95 | C |
| ATOM | 2791 | N | ARG | B | 148 | −20.646 | 18.725 | 21.434 | 1.00 | 34.40 | N |
| ATOM | 2792 | CA | ARG | B | 148 | −20.383 | 18.168 | 20.110 | 1.00 | 32.34 | C |
| ATOM | 2793 | C | ARG | B | 148 | −21.069 | 18.932 | 18.975 | 1.00 | 32.84 | C |
| ATOM | 2794 | O | ARG | B | 148 | −20.505 | 19.087 | 17.892 | 1.00 | 29.63 | O |
| ATOM | 2795 | CB | ARG | B | 148 | −20.823 | 16.700 | 20.101 | 1.00 | 35.79 | C |
| ATOM | 2796 | CG | ARG | B | 148 | −20.923 | 16.051 | 18.744 | 1.00 | 41.03 | C |
| ATOM | 2797 | CD | ARG | B | 148 | −19.703 | 15.208 | 18.453 | 1.00 | 47.90 | C |
| ATOM | 2798 | NE | ARG | B | 148 | −20.044 | 13.980 | 17.738 | 1.00 | 56.46 | N |
| ATOM | 2799 | CZ | ARG | B | 148 | −20.405 | 13.932 | 16.458 | 1.00 | 56.76 | C |
| ATOM | 2800 | NH1 | ARG | B | 148 | −20.485 | 15.048 | 15.740 | 1.00 | 54.31 | N |
| ATOM | 2801 | NH2 | ARG | B | 148 | −20.688 | 12.767 | 15.893 | 1.00 | 51.59 | N |
| ATOM | 2802 | N | GLU | B | 149 | −22.284 | 19.404 | 19.230 | 1.00 | 36.40 | N |
| ATOM | 2803 | CA | GLU | B | 149 | −23.068 | 20.115 | 18.224 | 1.00 | 39.72 | C |
| ATOM | 2804 | C | GLU | B | 149 | −22.387 | 21.403 | 17.779 | 1.00 | 39.89 | C |
| ATOM | 2805 | O | GLU | B | 149 | −22.182 | 22.319 | 18.577 | 1.00 | 39.53 | O |
| ATOM | 2806 | CB | GLU | B | 149 | −24.473 | 20.431 | 18.755 | 1.00 | 34.93 | C |
| ATOM | 2807 | CG | GLU | B | 149 | −25.369 | 19.209 | 18.956 | 1.00 | 45.72 | C |
| ATOM | 2808 | CD | GLU | B | 149 | −24.967 | 18.363 | 20.158 | 1.00 | 54.80 | C |
| ATOM | 2809 | OE1 | GLU | B | 149 | −24.402 | 18.920 | 21.125 | 1.00 | 48.46 | O |
| ATOM | 2810 | OE2 | GLU | B | 149 | −25.211 | 17.138 | 20.130 | 1.00 | 62.82 | O |
| ATOM | 2811 | N | ALA | B | 150 | −22.042 | 21.462 | 16.498 | 1.00 | 35.98 | N |
| ATOM | 2812 | CA | ALA | B | 150 | −21.432 | 22.649 | 15.914 | 1.00 | 37.14 | C |
| ATOM | 2813 | C | ALA | B | 150 | −21.867 | 22.779 | 14.465 | 1.00 | 43.97 | C |
| ATOM | 2814 | O | ALA | B | 150 | −22.094 | 21.778 | 13.786 | 1.00 | 46.01 | O |
| ATOM | 2815 | CB | ALA | B | 150 | −19.914 | 22.586 | 16.014 | 1.00 | 32.49 | C |
| ATOM | 2816 | N | LYS | B | 151 | −21.987 | 24.012 | 13.992 | 1.00 | 39.41 | N |
| ATOM | 2817 | CA | LYS | B | 151 | −22.417 | 24.246 | 12.624 | 1.00 | 43.48 | C |
| ATOM | 2818 | C | LYS | B | 151 | −21.319 | 24.913 | 11.807 | 1.00 | 39.53 | C |
| ATOM | 2819 | O | LYS | B | 151 | −20.799 | 25.966 | 12.179 | 1.00 | 36.87 | O |
| ATOM | 2820 | CB | LYS | B | 151 | −23.687 | 25.099 | 12.596 | 1.00 | 43.88 | C |
| ATOM | 2821 | CG | LYS | B | 151 | −24.256 | 25.301 | 11.196 | 1.00 | 55.40 | C |
| ATOM | 2822 | CD | LYS | B | 151 | −25.547 | 26.104 | 11.223 | 1.00 | 53.19 | C |
| ATOM | 2823 | CE | LYS | B | 151 | −26.147 | 26.222 | 9.830 | 1.00 | 70.97 | C |
| ATOM | 2824 | NZ | LYS | B | 151 | −27.463 | 26.923 | 9.839 | 1.00 | 84.38 | N |
| ATOM | 2825 | N | VAL | B | 152 | −20.968 | 24.282 | 10.694 | 1.00 | 36.81 | N |
| ATOM | 2826 | CA | VAL | B | 152 | −19.990 | 24.837 | 9.774 | 1.00 | 37.97 | C |
| ATOM | 2827 | C | VAL | B | 152 | −20.652 | 25.168 | 8.446 | 1.00 | 36.38 | C |
| ATOM | 2828 | O | VAL | B | 152 | −21.221 | 24.292 | 7.790 | 1.00 | 36.25 | O |
| ATOM | 2829 | CB | VAL | B | 152 | −18.820 | 23.867 | 9.535 | 1.00 | 39.90 | C |
| ATOM | 2830 | CG1 | VAL | B | 152 | −17.884 | 24.420 | 8.470 | 1.00 | 35.36 | C |
| ATOM | 2831 | CG2 | VAL | B | 152 | −18.078 | 23.614 | 10.834 | 1.00 | 39.55 | C |
| ATOM | 2832 | N | GLN | B | 153 | −20.590 | 26.437 | 8.060 | 1.00 | 32.64 | N |
| ATOM | 2833 | CA | GLN | B | 153 | −21.118 | 26.864 | 6.771 | 1.00 | 34.66 | C |
| ATOM | 2834 | C | GLN | B | 153 | −19.999 | 27.378 | 5.884 | 1.00 | 38.08 | C |
| ATOM | 2835 | O | GLN | B | 153 | −19.290 | 28.319 | 6.244 | 1.00 | 38.02 | O |
| ATOM | 2836 | CB | GLN | B | 153 | −22.187 | 27.946 | 6.946 | 1.00 | 37.83 | C |
| ATOM | 2837 | CG | GLN | B | 153 | −23.590 | 27.404 | 7.164 | 1.00 | 60.26 | C |
| ATOM | 2838 | CD | GLN | B | 153 | −24.596 | 28.498 | 7.470 | 1.00 | 67.71 | C |
| ATOM | 2839 | NE2 | GLN | B | 153 | −25.857 | 28.257 | 7.123 | 1.00 | 56.86 | N |
| ATOM | 2840 | OE1 | GLN | B | 153 | −24.244 | 29.548 | 8.009 | 1.00 | 70.19 | O |
| ATOM | 2841 | N | TRP | B | 154 | −19.840 | 26.747 | 4.727 | 1.00 | 31.58 | N |
| ATOM | 2842 | CA | TRP | B | 154 | −18.864 | 27.189 | 3.747 | 1.00 | 27.44 | C |
| ATOM | 2843 | C | TRP | B | 154 | −19.449 | 28.300 | 2.884 | 1.00 | 33.80 | C |
| ATOM | 2844 | O | TRP | B | 154 | −20.592 | 28.209 | 2.436 | 1.00 | 30.68 | O |
| ATOM | 2845 | CB | TRP | B | 154 | −18.415 | 26.022 | 2.869 | 1.00 | 25.14 | C |
| ATOM | 2846 | CG | TRP | B | 154 | −17.449 | 25.089 | 3.532 | 1.00 | 34.77 | C |
| ATOM | 2847 | CD1 | TRP | B | 154 | −17.729 | 23.870 | 4.080 | 1.00 | 29.48 | C |
| ATOM | 2848 | CD2 | TRP | B | 154 | −16.042 | 25.295 | 3.709 | 1.00 | 33.52 | C |
| ATOM | 2849 | CE2 | TRP | B | 154 | −15.534 | 24.159 | 4.369 | 1.00 | 36.13 | C |
| ATOM | 2850 | CE3 | TRP | B | 154 | −15.163 | 26.328 | 3.370 | 1.00 | 28.50 | C |
| ATOM | 2851 | NE1 | TRP | B | 154 | −16.584 | 23.304 | 4.582 | 1.00 | 32.42 | N |
| ATOM | 2852 | CZ2 | TRP | B | 154 | −14.186 | 24.028 | 4.697 | 1.00 | 35.02 | C |

TABLE 10.2-continued

| | | | | | | | | | | |
|---|---|---|---|---|---|---|---|---|---|---|
| ATOM | 2853 | CZ3 | TRP | B | 154 | −13.827 | 26.199 | 3.699 | 1.00 | 32.42 | C |
| ATOM | 2854 | CH2 | TRP | B | 154 | −13.350 | 25.056 | 4.355 | 1.00 | 33.88 | C |
| ATOM | 2855 | N | LYS | B | 155 | −18.661 | 29.343 | 2.652 | 1.00 | 26.76 | N |
| ATOM | 2856 | CA | LYS | B | 155 | −19.089 | 30.458 | 1.818 | 1.00 | 34.70 | C |
| ATOM | 2857 | C | LYS | B | 155 | −18.018 | 30.803 | 0.795 | 1.00 | 35.14 | C |
| ATOM | 2858 | O | LYS | B | 155 | −16.869 | 31.063 | 1.149 | 1.00 | 34.32 | O |
| ATOM | 2859 | CB | LYS | B | 155 | −19.415 | 31.685 | 2.671 | 1.00 | 31.08 | C |
| ATOM | 2860 | CG | LYS | B | 155 | −20.658 | 31.527 | 3.525 | 1.00 | 39.61 | C |
| ATOM | 2861 | CD | LYS | B | 155 | −20.861 | 32.722 | 4.439 | 1.00 | 45.78 | C |
| ATOM | 2862 | CE | LYS | B | 155 | −22.086 | 32.531 | 5.322 | 1.00 | 52.43 | C |
| ATOM | 2863 | NZ | LYS | B | 155 | −22.240 | 33.644 | 6.300 | 1.00 | 64.93 | N |
| ATOM | 2864 | N | VAL | B | 156 | −18.404 | 30.787 | −0.474 | 1.00 | 33.51 | N |
| ATOM | 2865 | CA | VAL | B | 156 | −17.512 | 31.163 | −1.562 | 1.00 | 34.85 | C |
| ATOM | 2866 | C | VAL | B | 156 | −18.043 | 32.430 | −2.235 | 1.00 | 37.05 | C |
| ATOM | 2867 | O | VAL | B | 156 | −19.085 | 32.398 | −2.889 | 1.00 | 36.43 | O |
| ATOM | 2868 | CB | VAL | B | 156 | −17.378 | 30.035 | −2.590 | 1.00 | 37.60 | C |
| ATOM | 2869 | CG1 | VAL | B | 156 | −16.452 | 30.450 | −3.701 | 1.00 | 36.02 | C |
| ATOM | 2870 | CG2 | VAL | B | 156 | −16.863 | 28.772 | −1.921 | 1.00 | 31.56 | C |
| ATOM | 2871 | N | ASP | B | 157 | −17.321 | 33.536 | −2.060 | 1.00 | 38.87 | N |
| ATOM | 2872 | CA | ASP | B | 157 | −17.785 | 34.866 | −2.468 | 1.00 | 41.38 | C |
| ATOM | 2873 | C | ASP | B | 157 | −19.196 | 35.139 | −1.951 | 1.00 | 44.37 | C |
| ATOM | 2874 | O | ASP | B | 157 | −20.058 | 35.627 | −2.684 | 1.00 | 49.49 | O |
| ATOM | 2875 | CB | ASP | B | 157 | −17.733 | 35.023 | −3.991 | 1.00 | 42.34 | C |
| ATOM | 2876 | CG | ASP | B | 157 | −16.326 | 35.296 | −4.499 | 1.00 | 44.58 | C |
| ATOM | 2877 | OD1 | ASP | B | 157 | −15.517 | 35.866 | −3.734 | 1.00 | 49.40 | O |
| ATOM | 2878 | OD2 | ASP | B | 157 | −16.029 | 34.942 | −5.659 | 1.00 | 49.33 | O |
| ATOM | 2879 | N | ASN | B | 158 | −19.405 | 34.809 | −0.678 | 1.00 | 38.79 | N |
| ATOM | 2880 | CA | ASN | B | 158 | −20.688 | 34.958 | 0.016 | 1.00 | 46.07 | C |
| ATOM | 2881 | C | ASN | B | 158 | −21.827 | 34.101 | −0.535 | 1.00 | 42.73 | C |
| ATOM | 2882 | O | ASN | B | 158 | −22.992 | 34.335 | −0.218 | 1.00 | 49.48 | O |
| ATOM | 2883 | CB | ASN | B | 158 | −21.115 | 36.426 | 0.033 | 1.00 | 47.14 | C |
| ATOM | 2884 | CG | ASN | B | 158 | −20.716 | 37.122 | 1.313 | 1.00 | 64.92 | C |
| ATOM | 2885 | ND2 | ASN | B | 158 | −20.238 | 38.356 | 1.196 | 1.00 | 70.04 | N |
| ATOM | 2886 | OD1 | ASN | B | 158 | −20.825 | 36.549 | 2.400 | 1.00 | 67.22 | O |
| ATOM | 2887 | N | ALA | B | 159 | −21.497 | 33.100 | −1.341 | 1.00 | 37.66 | N |
| ATOM | 2888 | CA | ALA | B | 159 | −22.492 | 32.110 | −1.731 | 1.00 | 37.19 | C |
| ATOM | 2889 | C | ALA | B | 159 | −22.368 | 30.887 | −0.823 | 1.00 | 39.41 | C |
| ATOM | 2890 | O | ALA | B | 159 | −21.298 | 30.285 | −0.720 | 1.00 | 32.50 | O |
| ATOM | 2891 | CB | ALA | B | 159 | −22.330 | 31.717 | −3.191 | 1.00 | 30.09 | C |
| ATOM | 2892 | N | LEU | B | 160 | −23.464 | 30.537 | −0.159 | 1.00 | 34.32 | N |
| ATOM | 2893 | CA | LEU | B | 160 | −23.496 | 29.376 | 0.720 | 1.00 | 29.40 | C |
| ATOM | 2894 | C | LEU | B | 160 | −23.360 | 28.083 | −0.073 | 1.00 | 33.09 | C |
| ATOM | 2895 | O | LEU | B | 160 | −24.083 | 27.858 | −1.044 | 1.00 | 36.96 | O |
| ATOM | 2896 | CB | LEU | B | 160 | −24.790 | 29.348 | 1.540 | 1.00 | 37.86 | C |
| ATOM | 2897 | CG | LEU | B | 160 | −24.960 | 30.336 | 2.701 | 1.00 | 54.68 | C |
| ATOM | 2898 | CD1 | LEU | B | 160 | −25.190 | 31.767 | 2.222 | 1.00 | 48.85 | C |
| ATOM | 2899 | CD2 | LEU | B | 160 | −26.100 | 29.883 | 3.608 | 1.00 | 60.01 | C |
| ATOM | 2900 | N | GLN | B | 161 | −22.427 | 27.238 | 0.347 | 1.00 | 30.58 | N |
| ATOM | 2901 | CA | GLN | B | 161 | −22.206 | 25.943 | −0.284 | 1.00 | 30.22 | C |
| ATOM | 2902 | C | GLN | B | 161 | −22.919 | 24.850 | 0.499 | 1.00 | 35.29 | C |
| ATOM | 2903 | O | GLN | B | 161 | −22.868 | 24.821 | 1.727 | 1.00 | 38.99 | O |
| ATOM | 2904 | CB | GLN | B | 161 | −20.710 | 25.633 | −0.371 | 1.00 | 31.23 | C |
| ATOM | 2905 | CG | GLN | B | 161 | −19.880 | 26.761 | −0.958 | 1.00 | 30.86 | C |
| ATOM | 2906 | CD | GLN | B | 161 | −20.221 | 27.015 | −2.407 | 1.00 | 32.74 | C |
| ATOM | 2907 | NE2 | GLN | B | 161 | −20.715 | 28.210 | −2.698 | 1.00 | 30.42 | N |
| ATOM | 2908 | OE1 | GLN | B | 161 | −20.062 | 26.138 | −3.252 | 1.00 | 34.09 | O |
| ATOM | 2909 | N | SER | B | 162 | −23.588 | 23.955 | −0.215 | 1.00 | 27.98 | N |
| ATOM | 2910 | CA | SER | B | 162 | −24.234 | 22.815 | 0.416 | 1.00 | 38.77 | C |
| ATOM | 2911 | C | SER | B | 162 | −24.111 | 21.602 | −0.496 | 1.00 | 34.56 | C |
| ATOM | 2912 | O | SER | B | 162 | −24.271 | 21.717 | −1.713 | 1.00 | 33.35 | O |
| ATOM | 2913 | CB | SER | B | 162 | −25.703 | 23.126 | 0.723 | 1.00 | 31.67 | C |
| ATOM | 2914 | OG | SER | B | 162 | −26.329 | 22.040 | 1.385 | 1.00 | 49.66 | O |
| ATOM | 2915 | N | GLY | B | 163 | −23.800 | 20.449 | 0.090 | 1.00 | 33.25 | N |
| ATOM | 2916 | CA | GLY | B | 163 | −23.739 | 19.206 | −0.661 | 1.00 | 28.14 | C |
| ATOM | 2917 | C | GLY | B | 163 | −22.356 | 18.880 | −1.192 | 1.00 | 32.51 | C |
| ATOM | 2918 | O | GLY | B | 163 | −22.101 | 17.758 | −1.620 | 1.00 | 33.73 | O |
| ATOM | 2919 | N | ASN | B | 164 | −21.457 | 19.859 | −1.164 | 1.00 | 30.22 | N |
| ATOM | 2920 | CA | ASN | B | 164 | −20.114 | 19.664 | −1.694 | 1.00 | 31.34 | C |
| ATOM | 2921 | C | ASN | B | 164 | −19.043 | 19.693 | −0.605 | 1.00 | 35.48 | C |
| ATOM | 2922 | O | ASN | B | 164 | −17.881 | 19.990 | −0.876 | 1.00 | 31.32 | O |
| ATOM | 2923 | CB | ASN | B | 164 | −19.809 | 20.722 | −2.767 | 1.00 | 30.74 | C |
| ATOM | 2924 | CG | ASN | B | 164 | −19.951 | 22.147 | −2.248 | 1.00 | 33.60 | C |
| ATOM | 2925 | ND2 | ASN | B | 164 | −19.572 | 23.116 | −3.073 | 1.00 | 33.79 | N |
| ATOM | 2926 | OD1 | ASN | B | 164 | −20.405 | 22.374 | −1.127 | 1.00 | 32.68 | O |
| ATOM | 2927 | N | SER | B | 165 | −19.435 | 19.387 | 0.628 | 1.00 | 35.40 | N |
| ATOM | 2928 | CA | SER | B | 165 | −18.470 | 19.275 | 1.714 | 1.00 | 35.79 | C |
| ATOM | 2929 | C | SER | B | 165 | −18.750 | 18.042 | 2.561 | 1.00 | 32.53 | C |
| ATOM | 2930 | O | SER | B | 165 | −19.849 | 17.490 | 2.521 | 1.00 | 29.82 | O |
| ATOM | 2931 | CB | SER | B | 165 | −18.478 | 20.530 | 2.593 | 1.00 | 32.78 | C |
| ATOM | 2932 | OG | SER | B | 165 | −19.639 | 20.592 | 3.401 | 1.00 | 33.05 | O |

TABLE 10.2-continued

| | | | | | | | | | | |
|---|---|---|---|---|---|---|---|---|---|---|
| ATOM | 2933 | N | GLN | B | 166 | −17.742 | 17.606 | 3.311 | 1.00 | 30.86 | N |
| ATOM | 2934 | CA | GLN | B | 166 | −17.896 | 16.486 | 4.236 | 1.00 | 32.40 | C |
| ATOM | 2935 | C | GLN | B | 166 | −17.194 | 16.792 | 5.553 | 1.00 | 32.23 | C |
| ATOM | 2936 | O | GLN | B | 166 | −16.181 | 17.493 | 5.575 | 1.00 | 33.90 | O |
| ATOM | 2937 | CB | GLN | B | 166 | −17.346 | 15.189 | 3.634 | 1.00 | 26.55 | C |
| ATOM | 2938 | CG | GLN | B | 166 | −18.110 | 14.694 | 2.418 | 1.00 | 37.55 | C |
| ATOM | 2939 | CD | GLN | B | 166 | −17.656 | 13.318 | 1.960 | 1.00 | 45.88 | C |
| ATOM | 2940 | NE2 | GLN | B | 166 | −16.458 | 13.247 | 1.393 | 1.00 | 37.75 | N |
| ATOM | 2941 | OE1 | GLN | B | 166 | −18.378 | 12.332 | 2.110 | 1.00 | 44.50 | O |
| ATOM | 2942 | N | GLU | B | 167 | −17.741 | 16.260 | 6.642 | 1.00 | 26.95 | N |
| ATOM | 2943 | CA | GLU | B | 167 | −17.217 | 16.491 | 7.985 | 1.00 | 34.35 | C |
| ATOM | 2944 | C | GLU | B | 167 | −16.789 | 15.199 | 8.666 | 1.00 | 31.65 | C |
| ATOM | 2945 | O | GLU | B | 167 | −17.351 | 14.136 | 8.416 | 1.00 | 31.31 | O |
| ATOM | 2946 | CB | GLU | B | 167 | −18.263 | 17.166 | 8.868 | 1.00 | 33.65 | C |
| ATOM | 2947 | CG | GLU | B | 167 | −18.526 | 18.617 | 8.585 | 1.00 | 50.67 | C |
| ATOM | 2948 | CD | GLU | B | 167 | −19.553 | 19.191 | 9.544 | 1.00 | 59.29 | C |
| ATOM | 2949 | OE1 | GLU | B | 167 | −20.018 | 18.431 | 10.425 | 1.00 | 49.27 | O |
| ATOM | 2950 | OE2 | GLU | B | 167 | −19.895 | 20.388 | 9.418 | 1.00 | 59.18 | O |
| ATOM | 2951 | N | SER | B | 168 | −15.815 | 15.317 | 9.556 | 1.00 | 28.62 | N |
| ATOM | 2952 | CA | SER | B | 168 | −15.393 | 14.216 | 10.407 | 1.00 | 32.03 | C |
| ATOM | 2953 | C | SER | B | 168 | −15.096 | 14.753 | 11.802 | 1.00 | 31.07 | C |
| ATOM | 2954 | O | SER | B | 168 | −14.499 | 15.819 | 11.945 | 1.00 | 28.49 | O |
| ATOM | 2955 | CB | SER | B | 168 | −14.165 | 13.522 | 9.817 | 1.00 | 34.82 | C |
| ATOM | 2956 | OG | SER | B | 168 | −13.566 | 12.666 | 10.762 | 1.00 | 40.29 | O |
| ATOM | 2957 | N | AVAL | B | 169 | −15.514 | 14.013 | 12.828 | 0.89 | 30.56 | N |
| ATOM | 2958 | CA | AVAL | B | 169 | −15.342 | 14.433 | 14.221 | 0.89 | 30.43 | C |
| ATOM | 2959 | C | AVAL | B | 169 | −14.558 | 13.389 | 15.017 | 0.89 | 31.75 | C |
| ATOM | 2960 | O | AVAL | B | 169 | −14.796 | 12.193 | 14.870 | 0.89 | 33.51 | O |
| ATOM | 2961 | CB | AVAL | B | 169 | −16.708 | 14.663 | 14.910 | 0.89 | 32.02 | C |
| ATOM | 2962 | CG1 | AVAL | B | 169 | −16.518 | 15.215 | 16.317 | 0.89 | 33.65 | C |
| ATOM | 2963 | CG2 | AVAL | B | 169 | −17.578 | 15.591 | 14.079 | 0.89 | 31.73 | C |
| ATOM | 2964 | N | BVAL | B | 169 | −15.523 | 14.018 | 12.822 | 0.11 | 30.45 | N |
| ATOM | 2965 | CA | BVAL | B | 169 | −15.292 | 14.424 | 14.200 | 0.11 | 31.12 | C |
| ATOM | 2966 | C | BVAL | B | 169 | −14.467 | 13.380 | 14.937 | 0.11 | 31.77 | C |
| ATOM | 2967 | O | BVAL | B | 169 | −14.578 | 12.184 | 14.669 | 0.11 | 33.10 | O |
| ATOM | 2968 | CB | BVAL | B | 169 | −16.616 | 14.648 | 14.953 | 0.11 | 32.66 | C |
| ATOM | 2969 | CG1 | BVAL | B | 169 | −17.352 | 15.847 | 14.385 | 0.11 | 32.73 | C |
| ATOM | 2970 | CG2 | BVAL | B | 169 | −17.482 | 13.403 | 14.878 | 0.11 | 33.85 | C |
| ATOM | 2971 | N | THR | B | 170 | −13.633 | 13.837 | 15.862 | 1.00 | 29.38 | N |
| ATOM | 2972 | CA | THR | B | 170 | −12.847 | 12.921 | 16.682 | 1.00 | 36.76 | C |
| ATOM | 2973 | C | THR | B | 170 | −13.703 | 12.346 | 17.805 | 1.00 | 33.01 | C |
| ATOM | 2974 | O | THR | B | 170 | −14.762 | 12.885 | 18.133 | 1.00 | 30.78 | O |
| ATOM | 2975 | CB | THR | B | 170 | −11.620 | 13.605 | 17.308 | 1.00 | 30.27 | C |
| ATOM | 2976 | CG2 | THR | B | 170 | −10.719 | 14.211 | 16.235 | 1.00 | 34.58 | C |
| ATOM | 2977 | OG1 | THR | B | 170 | −12.057 | 14.633 | 18.199 | 1.00 | 31.73 | O |
| ATOM | 2978 | N | GLU | B | 171 | −13.243 | 11.248 | 18.390 | 1.00 | 34.68 | N |
| ATOM | 2979 | CA | GLU | B | 171 | −13.843 | 10.746 | 19.618 | 1.00 | 35.38 | C |
| ATOM | 2980 | C | GLU | B | 171 | −13.613 | 11.768 | 20.720 | 1.00 | 37.95 | C |
| ATOM | 2981 | O | GLU | B | 171 | −12.689 | 12.584 | 20.639 | 1.00 | 34.11 | O |
| ATOM | 2982 | CB | GLU | B | 171 | −13.247 | 9.391 | 20.011 | 1.00 | 35.96 | C |
| ATOM | 2983 | CG | GLU | B | 171 | −13.457 | 8.290 | 18.984 | 1.00 | 47.50 | C |
| ATOM | 2984 | CD | GLU | B | 171 | −14.850 | 7.683 | 19.038 | 1.00 | 65.62 | C |
| ATOM | 2985 | OE1 | GLU | B | 171 | −15.595 | 7.969 | 20.002 | 1.00 | 65.84 | O |
| ATOM | 2986 | OE2 | GLU | B | 171 | −15.198 | 6.912 | 18.116 | 1.00 | 70.74 | O |
| ATOM | 2987 | N | GLN | B | 172 | −14.456 | 11.734 | 21.743 | 1.00 | 34.37 | N |
| ATOM | 2988 | CA | GLN | B | 172 | −14.272 | 12.609 | 22.885 | 1.00 | 27.96 | C |
| ATOM | 2989 | C | GLN | B | 172 | −12.897 | 12.347 | 23.509 | 1.00 | 29.48 | C |
| ATOM | 2990 | O | GLN | B | 172 | −12.544 | 11.210 | 23.785 | 1.00 | 33.27 | O |
| ATOM | 2991 | CB | GLN | B | 172 | −15.399 | 12.399 | 23.899 | 1.00 | 31.65 | C |
| ATOM | 2992 | CG | GLN | B | 172 | −15.483 | 13.474 | 24.959 | 1.00 | 34.27 | C |
| ATOM | 2993 | CD | GLN | B | 172 | −16.804 | 13.457 | 25.706 | 1.00 | 37.13 | C |
| ATOM | 2994 | NE2 | GLN | B | 172 | −17.166 | 14.594 | 26.286 | 1.00 | 32.91 | N |
| ATOM | 2995 | OE1 | GLN | B | 172 | −17.496 | 12.437 | 25.755 | 1.00 | 34.99 | O |
| ATOM | 2996 | N | ASP | B | 173 | −12.120 | 13.408 | 23.700 | 1.00 | 30.64 | N |
| ATOM | 2997 | CA | ASP | B | 173 | −10.766 | 13.296 | 24.231 | 1.00 | 32.58 | C |
| ATOM | 2998 | C | ASP | B | 173 | −10.749 | 12.684 | 25.636 | 1.00 | 36.32 | C |
| ATOM | 2999 | O | ASP | B | 173 | −11.537 | 13.069 | 26.502 | 1.00 | 30.09 | O |
| ATOM | 3000 | CB | ASP | B | 173 | −10.097 | 14.671 | 24.246 | 1.00 | 32.10 | C |
| ATOM | 3001 | CG | ASP | B | 173 | −8.613 | 14.593 | 24.538 | 1.00 | 36.21 | C |
| ATOM | 3002 | OD2 | ASP | B | 173 | −8.222 | 14.802 | 25.708 | 1.00 | 36.85 | O |
| ATOM | 3003 | OD1 | ASP | B | 173 | −7.836 | 14.324 | 23.595 | 1.00 | 37.22 | O |
| ATOM | 3004 | N | SER | B | 174 | −9.844 | 11.737 | 25.863 | 1.00 | 32.20 | N |
| ATOM | 3005 | CA | SER | B | 174 | −9.818 | 11.015 | 27.134 | 1.00 | 38.98 | C |
| ATOM | 3006 | C | SER | B | 174 | −9.243 | 11.855 | 28.275 | 1.00 | 32.61 | C |
| ATOM | 3007 | O | SER | B | 174 | −9.301 | 11.447 | 29.432 | 1.00 | 42.30 | O |
| ATOM | 3008 | CB | SER | B | 174 | −9.017 | 9.717 | 26.998 | 1.00 | 36.54 | C |
| ATOM | 3009 | OG | SER | B | 174 | −7.630 | 9.986 | 26.883 | 1.00 | 46.81 | O |
| ATOM | 3010 | N | LYS | B | 175 | −8.691 | 13.020 | 27.954 | 1.00 | 35.47 | N |
| ATOM | 3011 | CA | LYS | B | 175 | −8.142 | 13.907 | 28.981 | 1.00 | 33.77 | C |
| ATOM | 3012 | C | LYS | B | 175 | −9.040 | 15.113 | 29.278 | 1.00 | 36.43 | C |

TABLE 10.2-continued

| | | | | | | | | | | |
|---|---|---|---|---|---|---|---|---|---|---|
| ATOM | 3013 | O | LYS | B | 175 | −9.479 | 15.287 | 30.410 | 1.00 | 30.79 | O |
| ATOM | 3014 | CB | LYS | B | 175 | −6.749 | 14.404 | 28.581 | 1.00 | 36.54 | C |
| ATOM | 3015 | CG | LYS | B | 175 | −5.717 | 13.303 | 28.387 | 1.00 | 47.29 | C |
| ATOM | 3016 | CD | LYS | B | 175 | −4.339 | 13.895 | 28.117 | 1.00 | 54.56 | C |
| ATOM | 3017 | CE | LYS | B | 175 | −3.317 | 12.811 | 27.821 | 1.00 | 53.35 | C |
| ATOM | 3018 | NZ | LYS | B | 175 | −1.931 | 13.358 | 27.809 | 1.00 | 53.83 | N |
| ATOM | 3019 | N | ASP | B | 176 | −9.306 | 15.950 | 28.275 | 1.00 | 35.92 | N |
| ATOM | 3020 | CA | ASP | B | 176 | −10.070 | 17.176 | 28.522 | 1.00 | 33.42 | C |
| ATOM | 3021 | C | ASP | B | 176 | −11.526 | 17.072 | 28.069 | 1.00 | 33.69 | C |
| ATOM | 3022 | O | ASP | B | 176 | −12.293 | 18.025 | 28.205 | 1.00 | 32.10 | O |
| ATOM | 3023 | CB | ASP | B | 176 | −9.391 | 18.387 | 27.857 | 1.00 | 37.93 | C |
| ATOM | 3024 | CG | ASP | B | 176 | −9.374 | 18.315 | 26.326 | 1.00 | 44.81 | C |
| ATOM | 3025 | OD1 | ASP | B | 176 | −10.135 | 17.530 | 25.718 | 1.00 | 39.09 | O |
| ATOM | 3026 | OD2 | ASP | B | 176 | −8.591 | 19.081 | 25.721 | 1.00 | 49.31 | O |
| ATOM | 3027 | N | SER | B | 177 | −11.879 | 15.923 | 27.501 | 1.00 | 31.41 | N |
| ATOM | 3028 | CA | SER | B | 177 | −13.259 | 15.601 | 27.145 | 1.00 | 32.38 | C |
| ATOM | 3029 | C | SER | B | 177 | −13.869 | 16.487 | 26.062 | 1.00 | 31.53 | C |
| ATOM | 3030 | O | SER | B | 177 | −15.087 | 16.651 | 26.017 | 1.00 | 29.23 | O |
| ATOM | 3031 | CB | SER | B | 177 | −14.142 | 15.665 | 28.390 | 1.00 | 29.13 | C |
| ATOM | 3032 | OG | SER | B | 177 | −13.689 | 14.767 | 29.386 | 1.00 | 32.14 | O |
| ATOM | 3033 | N | THR | B | 178 | −13.031 | 17.045 | 25.192 | 1.00 | 32.85 | N |
| ATOM | 3034 | CA | THR | B | 178 | −13.521 | 17.873 | 24.091 | 1.00 | 31.34 | C |
| ATOM | 3035 | C | THR | B | 178 | −13.603 | 17.102 | 22.779 | 1.00 | 29.53 | C |
| ATOM | 3036 | O | THR | B | 178 | −13.145 | 15.960 | 22.680 | 1.00 | 31.68 | O |
| ATOM | 3037 | CB | THR | B | 178 | −12.627 | 19.108 | 23.865 | 1.00 | 30.04 | C |
| ATOM | 3038 | CG2 | THR | B | 178 | −12.576 | 19.979 | 25.117 | 1.00 | 31.87 | C |
| ATOM | 3039 | OG1 | THR | B | 178 | −11.302 | 18.683 | 23.526 | 1.00 | 33.96 | O |
| ATOM | 3040 | N | TYR | B | 179 | −14.199 | 17.738 | 21.776 | 1.00 | 26.97 | N |
| ATOM | 3041 | CA | TYR | B | 179 | −14.198 | 17.225 | 20.411 | 1.00 | 27.62 | C |
| ATOM | 3042 | C | TYR | B | 179 | −13.395 | 18.139 | 19.503 | 1.00 | 28.49 | C |
| ATOM | 3043 | O | TYR | B | 179 | −13.193 | 19.316 | 19.809 | 1.00 | 27.60 | O |
| ATOM | 3044 | CB | TYR | B | 179 | −15.620 | 17.110 | 19.862 | 1.00 | 23.93 | C |
| ATOM | 3045 | CG | TYR | B | 179 | −16.540 | 16.224 | 20.659 | 1.00 | 32.03 | C |
| ATOM | 3046 | CD2 | TYR | B | 179 | −16.701 | 14.884 | 20.326 | 1.00 | 29.16 | C |
| ATOM | 3047 | CD1 | TYR | B | 179 | −17.266 | 16.729 | 21.735 | 1.00 | 27.55 | C |
| ATOM | 3048 | CE2 | TYR | B | 179 | −17.549 | 14.065 | 21.046 | 1.00 | 36.83 | C |
| ATOM | 3049 | CE1 | TYR | B | 179 | −18.118 | 15.915 | 22.467 | 1.00 | 35.32 | C |
| ATOM | 3050 | CZ | TYR | B | 179 | −18.254 | 14.584 | 22.118 | 1.00 | 36.45 | C |
| ATOM | 3051 | OH | TYR | B | 179 | −19.096 | 13.768 | 22.837 | 1.00 | 41.00 | O |
| ATOM | 3052 | N | SER | B | 180 | −12.945 | 17.597 | 18.379 | 1.00 | 27.52 | N |
| ATOM | 3053 | CA | SER | B | 180 | −12.437 | 18.418 | 17.288 | 1.00 | 29.79 | C |
| ATOM | 3054 | C | SER | B | 180 | −13.143 | 18.002 | 16.000 | 1.00 | 28.83 | C |
| ATOM | 3055 | O | SER | B | 180 | −13.591 | 16.862 | 15.875 | 1.00 | 26.78 | O |
| ATOM | 3056 | CB | SER | B | 180 | −10.921 | 18.287 | 17.150 | 1.00 | 34.04 | C |
| ATOM | 3057 | OG | SER | B | 180 | −10.255 | 18.889 | 18.246 | 1.00 | 36.05 | O |
| ATOM | 3058 | N | LEU | B | 181 | −13.252 | 18.928 | 15.053 | 1.00 | 27.50 | N |
| ATOM | 3059 | CA | LEU | B | 181 | −13.984 | 18.670 | 13.819 | 1.00 | 29.24 | C |
| ATOM | 3060 | C | LEU | B | 181 | −13.206 | 19.150 | 12.595 | 1.00 | 34.49 | C |
| ATOM | 3061 | O | LEU | B | 181 | −12.583 | 20.214 | 12.610 | 1.00 | 29.64 | O |
| ATOM | 3062 | CB | LEU | B | 181 | −15.367 | 19.337 | 13.866 | 1.00 | 31.76 | C |
| ATOM | 3063 | CG | LEU | B | 181 | −16.315 | 19.197 | 12.662 | 1.00 | 33.92 | C |
| ATOM | 3064 | CD1 | LEU | B | 181 | −17.770 | 19.237 | 13.115 | 1.00 | 33.67 | C |
| ATOM | 3065 | CD2 | LEU | B | 181 | −16.071 | 20.275 | 11.620 | 1.00 | 27.36 | C |
| ATOM | 3066 | N | SER | B | 182 | −13.266 | 18.355 | 11.534 | 1.00 | 30.45 | N |
| ATOM | 3067 | CA | SER | B | 182 | −12.622 | 18.683 | 10.273 | 1.00 | 32.39 | C |
| ATOM | 3068 | C | SER | B | 182 | −13.653 | 18.706 | 9.157 | 1.00 | 34.50 | C |
| ATOM | 3069 | O | SER | B | 182 | −14.346 | 17.715 | 8.935 | 1.00 | 32.11 | O |
| ATOM | 3070 | CB | SER | B | 182 | −11.521 | 17.671 | 9.953 | 1.00 | 35.13 | C |
| ATOM | 3071 | OG | SER | B | 182 | −10.952 | 17.929 | 8.684 | 1.00 | 35.29 | O |
| ATOM | 3072 | N | SER | B | 183 | −13.769 | 19.841 | 8.473 | 1.00 | 32.48 | N |
| ATOM | 3073 | CA | SER | B | 183 | −14.666 | 19.946 | 7.327 | 1.00 | 31.00 | C |
| ATOM | 3074 | C | SER | B | 183 | −13.877 | 20.240 | 6.058 | 1.00 | 37.54 | C |
| ATOM | 3075 | O | SER | B | 183 | −13.014 | 21.119 | 6.041 | 1.00 | 34.24 | O |
| ATOM | 3076 | CB | SER | B | 183 | −15.720 | 21.028 | 7.548 | 1.00 | 28.88 | C |
| ATOM | 3077 | OG | SER | B | 183 | −16.568 | 21.127 | 6.415 | 1.00 | 34.00 | O |
| ATOM | 3078 | N | THR | B | 184 | −14.185 | 19.495 | 5.002 | 1.00 | 29.33 | N |
| ATOM | 3079 | CA | THR | B | 184 | −13.490 | 19.618 | 3.733 | 1.00 | 32.43 | C |
| ATOM | 3080 | C | THR | B | 184 | −14.449 | 20.002 | 2.609 | 1.00 | 33.53 | C |
| ATOM | 3081 | O | THR | B | 184 | −15.375 | 19.258 | 2.296 | 1.00 | 30.24 | O |
| ATOM | 3082 | CB | THR | B | 184 | −12.778 | 18.303 | 3.347 | 1.00 | 30.27 | C |
| ATOM | 3083 | CG2 | THR | B | 184 | −12.075 | 18.448 | 1.993 | 1.00 | 34.53 | C |
| ATOM | 3084 | OG1 | THR | B | 184 | −11.813 | 17.966 | 4.348 | 1.00 | 43.02 | O |
| ATOM | 3085 | N | LEU | B | 185 | −14.212 | 21.164 | 2.013 | 1.00 | 29.43 | N |
| ATOM | 3086 | CA | LEU | B | 185 | −14.950 | 21.610 | 0.838 | 1.00 | 26.42 | C |
| ATOM | 3087 | C | LEU | B | 185 | −14.195 | 21.216 | −0.428 | 1.00 | 31.67 | C |
| ATOM | 3088 | O | LEU | B | 185 | −13.021 | 21.549 | −0.587 | 1.00 | 32.58 | O |
| ATOM | 3089 | CB | LEU | B | 185 | −15.162 | 23.123 | 0.882 | 1.00 | 26.19 | C |
| ATOM | 3090 | CG | LEU | B | 185 | −15.801 | 23.777 | −0.346 | 1.00 | 33.72 | C |
| ATOM | 3091 | CD1 | LEU | B | 185 | −17.290 | 23.451 | −0.426 | 1.00 | 29.32 | C |
| ATOM | 3092 | CD2 | LEU | B | 185 | −15.570 | 25.285 | −0.336 | 1.00 | 29.64 | C |

TABLE 10.2-continued

| | | | | | | | | | | |
|---|---|---|---|---|---|---|---|---|---|---|
| ATOM | 3093 | N | THR | B | 186 | −14.862 | 20.503 | −1.330 | 1.00 | 27.07 | N |
| ATOM | 3094 | CA | THR | B | 186 | −14.200 | 20.043 | −2.544 | 1.00 | 32.13 | C |
| ATOM | 3095 | C | THR | B | 186 | −14.797 | 20.676 | −3.794 | 1.00 | 34.19 | C |
| ATOM | 3096 | O | THR | B | 186 | −15.999 | 20.569 | −4.046 | 1.00 | 32.51 | O |
| ATOM | 3097 | CB | THR | B | 186 | −14.265 | 18.512 | −2.672 | 1.00 | 35.70 | C |
| ATOM | 3098 | CG2 | THR | B | 186 | −13.532 | 18.054 | −3.919 | 1.00 | 33.31 | C |
| ATOM | 3099 | OG1 | THR | B | 186 | −13.652 | 17.913 | −1.522 | 1.00 | 40.62 | O |
| ATOM | 3100 | N | LEU | B | 187 | −13.941 | 21.346 | −4.562 | 1.00 | 35.11 | N |
| ATOM | 3101 | CA | LEU | B | 187 | −14.315 | 21.945 | −5.843 | 1.00 | 35.77 | C |
| ATOM | 3102 | C | LEU | B | 187 | −13.339 | 21.525 | −6.932 | 1.00 | 37.88 | C |
| ATOM | 3103 | O | LEU | B | 187 | −12.206 | 21.145 | −6.642 | 1.00 | 36.56 | O |
| ATOM | 3104 | CB | LEU | B | 187 | −14.333 | 23.471 | −5.755 | 1.00 | 30.60 | C |
| ATOM | 3105 | CG | LEU | B | 187 | −15.286 | 24.143 | −4.775 | 1.00 | 36.33 | C |
| ATOM | 3106 | CD1 | LEU | B | 187 | −15.031 | 25.641 | −4.767 | 1.00 | 43.76 | C |
| ATOM | 3107 | CD2 | LEU | B | 187 | −16.729 | 23.835 | −5.147 | 1.00 | 50.34 | C |
| ATOM | 3108 | N | SER | B | 188 | −13.767 | 21.609 | −8.187 | 1.00 | 38.12 | N |
| ATOM | 3109 | CA | SER | B | 188 | −12.839 | 21.434 | −9.297 | 1.00 | 37.37 | C |
| ATOM | 3110 | C | SER | B | 188 | −11.888 | 22.627 | −9.343 | 1.00 | 37.79 | C |
| ATOM | 3111 | O | SER | B | 188 | −12.169 | 23.681 | −8.761 | 1.00 | 33.69 | O |
| ATOM | 3112 | CB | SER | B | 188 | −13.584 | 21.297 | −10.625 | 1.00 | 36.22 | C |
| ATOM | 3113 | OG | SER | B | 188 | −14.208 | 22.519 | −10.973 | 1.00 | 39.78 | O |
| ATOM | 3114 | N | LYS | B | 189 | −10.765 | 22.460 | −10.031 | 1.00 | 38.51 | N |
| ATOM | 3115 | CA | LYS | B | 189 | −9.809 | 23.546 | −10.193 | 1.00 | 37.38 | C |
| ATOM | 3116 | C | LYS | B | 189 | −10.460 | 24.721 | −10.915 | 1.00 | 37.61 | C |
| ATOM | 3117 | O | LYS | B | 189 | −10.331 | 25.869 | −10.491 | 1.00 | 42.81 | O |
| ATOM | 3118 | CB | LYS | B | 189 | −8.576 | 23.064 | −10.959 | 1.00 | 43.42 | C |
| ATOM | 3119 | CG | LYS | B | 189 | −7.574 | 24.158 | −11.293 | 1.00 | 46.58 | C |
| ATOM | 3120 | CD | LYS | B | 189 | −6.453 | 23.615 | −12.166 | 1.00 | 47.94 | C |
| ATOM | 3121 | CE | LYS | B | 189 | −5.477 | 24.704 | −12.561 | 1.00 | 50.50 | C |
| ATOM | 3122 | NZ | LYS | B | 189 | −4.369 | 24.160 | −13.395 | 1.00 | 67.88 | N |
| ATOM | 3123 | N | ALA | B | 190 | −11.175 | 24.415 | −11.995 | 1.00 | 37.86 | N |
| ATOM | 3124 | CA | ALA | B | 190 | −11.862 | 25.429 | −12.791 | 1.00 | 38.31 | C |
| ATOM | 3125 | C | ALA | B | 190 | −12.825 | 26.252 | −11.947 | 1.00 | 41.13 | C |
| ATOM | 3126 | O | ALA | B | 190 | −12.859 | 27.477 | −12.057 | 1.00 | 45.90 | O |
| ATOM | 3127 | CB | ALA | B | 190 | −12.602 | 24.777 | −13.953 | 1.00 | 30.47 | C |
| ATOM | 3128 | N | ASP | B | 191 | −13.602 | 25.582 | −11.100 | 1.00 | 38.92 | N |
| ATOM | 3129 | CA | ASP | B | 191 | −14.536 | 26.287 | −10.226 | 1.00 | 37.31 | C |
| ATOM | 3130 | C | ASP | B | 191 | −13.796 | 27.103 | −9.175 | 1.00 | 35.97 | C |
| ATOM | 3131 | O | ASP | B | 191 | −14.211 | 28.214 | −8.831 | 1.00 | 35.16 | O |
| ATOM | 3132 | CB | ASP | B | 191 | −15.497 | 25.308 | −9.542 | 1.00 | 40.65 | C |
| ATOM | 3133 | CG | ASP | B | 191 | −16.675 | 24.932 | −10.425 | 1.00 | 54.48 | C |
| ATOM | 3134 | OD1 | ASP | B | 191 | −16.840 | 25.554 | −11.498 | 1.00 | 48.85 | O |
| ATOM | 3135 | OD2 | ASP | B | 191 | −17.445 | 24.024 | −10.039 | 1.00 | 50.23 | O |
| ATOM | 3136 | N | TYR | B | 192 | −12.700 | 26.549 | −8.667 | 1.00 | 35.50 | N |
| ATOM | 3137 | CA | TYR | B | 192 | −11.948 | 27.193 | −7.595 | 1.00 | 34.33 | C |
| ATOM | 3138 | C | TYR | B | 192 | −11.381 | 28.543 | −8.022 | 1.00 | 37.59 | C |
| ATOM | 3139 | O | TYR | B | 192 | −11.395 | 29.505 | −7.256 | 1.00 | 35.83 | O |
| ATOM | 3140 | CB | TYR | B | 192 | −10.814 | 26.288 | −7.115 | 1.00 | 34.12 | C |
| ATOM | 3141 | CG | TYR | B | 192 | −9.932 | 26.940 | −6.076 | 1.00 | 36.45 | C |
| ATOM | 3142 | CD1 | TYR | B | 192 | −10.429 | 27.251 | −4.815 | 1.00 | 34.80 | C |
| ATOM | 3143 | CD2 | TYR | B | 192 | −8.606 | 27.243 | −6.350 | 1.00 | 32.17 | C |
| ATOM | 3144 | CE1 | TYR | B | 192 | −9.632 | 27.849 | −3.857 | 1.00 | 32.72 | C |
| ATOM | 3145 | CE2 | TYR | B | 192 | −7.797 | 27.838 | −5.394 | 1.00 | 34.13 | C |
| ATOM | 3146 | CZ | TYR | B | 192 | −8.319 | 28.142 | −4.152 | 1.00 | 31.36 | C |
| ATOM | 3147 | OH | TYR | B | 192 | −7.526 | 28.732 | −3.197 | 1.00 | 35.96 | O |
| ATOM | 3148 | N | GLU | B | 193 | −10.895 | 28.609 | −9.255 | 1.00 | 39.80 | N |
| ATOM | 3149 | CA | GLU | B | 193 | −10.237 | 29.811 | −9.763 | 1.00 | 43.18 | C |
| ATOM | 3150 | C | GLU | B | 193 | −11.213 | 30.900 | −10.210 | 1.00 | 39.55 | C |
| ATOM | 3151 | O | GLU | B | 193 | −10.799 | 32.022 | −10.496 | 1.00 | 44.13 | O |
| ATOM | 3152 | CB | GLU | B | 193 | −9.311 | 29.440 | −10.921 | 1.00 | 44.18 | C |
| ATOM | 3153 | CG | GLU | B | 193 | −8.172 | 28.528 | −10.515 | 1.00 | 46.87 | C |
| ATOM | 3154 | CD | GLU | B | 193 | −7.393 | 28.010 | −11.704 | 1.00 | 66.53 | C |
| ATOM | 3155 | OE1 | GLU | B | 193 | −7.965 | 27.968 | −12.815 | 1.00 | 70.34 | O |
| ATOM | 3156 | OE2 | GLU | B | 193 | −6.210 | 27.648 | −11.529 | 1.00 | 73.19 | O |
| ATOM | 3157 | N | LYS | B | 194 | −12.502 | 30.575 | −10.261 | 1.00 | 41.15 | N |
| ATOM | 3158 | CA | LYS | B | 194 | −13.522 | 31.554 | −10.634 | 1.00 | 39.86 | C |
| ATOM | 3159 | C | LYS | B | 194 | −13.955 | 32.429 | −9.461 | 1.00 | 44.25 | C |
| ATOM | 3160 | O | LYS | B | 194 | −14.816 | 33.295 | −9.615 | 1.00 | 42.88 | O |
| ATOM | 3161 | CB | LYS | B | 194 | −14.754 | 30.855 | −11.214 | 1.00 | 43.14 | C |
| ATOM | 3162 | CG | LYS | B | 194 | −14.506 | 30.110 | −12.507 | 1.00 | 50.46 | C |
| ATOM | 3163 | CD | LYS | B | 194 | −15.768 | 29.418 | −12.991 | 1.00 | 54.94 | C |
| ATOM | 3164 | CE | LYS | B | 194 | −15.503 | 28.612 | −14.255 | 1.00 | 65.50 | C |
| ATOM | 3165 | NZ | LYS | B | 194 | −14.922 | 29.454 | −15.339 | 1.00 | 69.52 | N |
| ATOM | 3166 | N | HIS | B | 195 | −13.373 | 32.204 | −8.288 | 1.00 | 42.19 | N |
| ATOM | 3167 | CA | HIS | B | 195 | −13.799 | 32.939 | −7.099 | 1.00 | 42.19 | C |
| ATOM | 3168 | C | HIS | B | 195 | −12.625 | 33.455 | −6.285 | 1.00 | 36.87 | C |
| ATOM | 3169 | O | HIS | B | 195 | −11.498 | 32.976 | −6.423 | 1.00 | 37.36 | O |
| ATOM | 3170 | CB | HIS | B | 195 | −14.687 | 32.061 | −6.214 | 1.00 | 38.63 | C |
| ATOM | 3171 | CG | HIS | B | 195 | −15.894 | 31.518 | −6.914 | 1.00 | 41.06 | C |
| ATOM | 3172 | CD2 | HIS | B | 195 | −16.180 | 30.270 | −7.356 | 1.00 | 44.21 | C |

TABLE 10.2-continued

| | | | | | | | | | | |
|---|---|---|---|---|---|---|---|---|---|---|
| ATOM | 3173 | ND1 | HIS | B | 195 | −16.987 | 32.296 | −7.224 | 1.00 | 43.75 | N |
| ATOM | 3174 | CE1 | HIS | B | 195 | −17.894 | 31.554 | −7.834 | 1.00 | 44.35 | C |
| ATOM | 3175 | NE2 | HIS | B | 195 | −17.430 | 30.321 | −7.926 | 1.00 | 44.01 | N |
| ATOM | 3176 | N | LYS | B | 196 | −12.908 | 34.424 | −5.420 | 1.00 | 38.25 | N |
| ATOM | 3177 | CA | LYS | B | 196 | −11.876 | 35.084 | −4.639 | 1.00 | 35.29 | C |
| ATOM | 3178 | C | LYS | B | 196 | −11.915 | 34.716 | −3.152 | 1.00 | 39.07 | C |
| ATOM | 3179 | O | LYS | B | 196 | −10.942 | 34.190 | −2.615 | 1.00 | 39.45 | O |
| ATOM | 3180 | CB | LYS | B | 196 | −11.998 | 36.602 | −4.793 | 1.00 | 41.25 | C |
| ATOM | 3181 | CG | LYS | B | 196 | −10.931 | 37.391 | −4.047 | 1.00 | 43.11 | C |
| ATOM | 3182 | CD | LYS | B | 196 | −11.215 | 38.884 | −4.099 | 1.00 | 57.11 | C |
| ATOM | 3183 | CE | LYS | B | 196 | −10.103 | 39.686 | −3.447 | 1.00 | 60.58 | C |
| ATOM | 3184 | NZ | LYS | B | 196 | −10.341 | 41.150 | −3.566 | 1.00 | 75.28 | N |
| ATOM | 3185 | N | VAL | B | 197 | −13.032 | 35.002 | −2.488 | 1.00 | 33.64 | N |
| ATOM | 3186 | CA | VAL | B | 197 | −13.108 | 34.851 | −1.037 | 1.00 | 41.13 | C |
| ATOM | 3187 | C | VAL | B | 197 | −13.640 | 33.478 | −0.620 | 1.00 | 39.79 | C |
| ATOM | 3188 | O | VAL | B | 197 | −14.758 | 33.098 | −0.973 | 1.00 | 35.93 | O |
| ATOM | 3189 | CB | VAL | B | 197 | −13.993 | 35.943 | −0.400 | 1.00 | 39.79 | C |
| ATOM | 3190 | CG1 | VAL | B | 197 | −13.964 | 35.829 | 1.117 | 1.00 | 33.80 | C |
| ATOM | 3191 | CG2 | VAL | B | 197 | −13.532 | 37.330 | −0.834 | 1.00 | 36.75 | C |
| ATOM | 3192 | N | TYR | B | 198 | −12.827 | 32.743 | 0.134 | 1.00 | 36.80 | N |
| ATOM | 3193 | CA | TYR | B | 198 | −13.223 | 31.442 | 0.662 | 1.00 | 31.41 | C |
| ATOM | 3194 | C | TYR | B | 198 | −13.289 | 31.518 | 2.173 | 1.00 | 34.47 | C |
| ATOM | 3195 | O | TYR | B | 198 | −12.324 | 31.909 | 2.821 | 1.00 | 35.65 | O |
| ATOM | 3196 | CB | TYR | B | 198 | −12.252 | 30.347 | 0.210 | 1.00 | 29.88 | C |
| ATOM | 3197 | CG | TYR | B | 198 | −12.394 | 30.041 | −1.259 | 1.00 | 32.49 | C |
| ATOM | 3198 | CD1 | TYR | B | 198 | −11.774 | 30.838 | −2.219 | 1.00 | 31.45 | C |
| ATOM | 3199 | CD2 | TYR | B | 198 | −13.179 | 28.978 | −1.694 | 1.00 | 30.07 | C |
| ATOM | 3200 | CE1 | TYR | B | 198 | −11.919 | 30.573 | −3.572 | 1.00 | 35.86 | C |
| ATOM | 3201 | CE2 | TYR | B | 198 | −13.327 | 28.706 | −3.043 | 1.00 | 31.84 | C |
| ATOM | 3202 | CZ | TYR | B | 198 | −12.695 | 29.509 | −3.975 | 1.00 | 31.78 | C |
| ATOM | 3203 | OH | TYR | B | 198 | −12.842 | 29.245 | −5.313 | 1.00 | 37.12 | O |
| ATOM | 3204 | N | ALA | B | 199 | −14.435 | 31.148 | 2.731 | 1.00 | 31.33 | N |
| ATOM | 3205 | CA | ALA | B | 199 | −14.672 | 31.330 | 4.155 | 1.00 | 35.87 | C |
| ATOM | 3206 | C | ALA | B | 199 | −15.414 | 30.150 | 4.755 | 1.00 | 37.75 | C |
| ATOM | 3207 | O | ALA | B | 199 | −16.236 | 29.517 | 4.090 | 1.00 | 29.26 | O |
| ATOM | 3208 | CB | ALA | B | 199 | −15.454 | 32.614 | 4.394 | 1.00 | 28.89 | C |
| ATOM | 3209 | N | CYS | B | 200 | −15.114 | 29.844 | 6.012 | 1.00 | 29.79 | N |
| ATOM | 3210 | CA | CYS | B | 200 | −15.967 | 28.940 | 6.764 | 1.00 | 30.62 | C |
| ATOM | 3211 | C | CYS | B | 200 | −16.481 | 29.695 | 7.980 | 1.00 | 34.82 | C |
| ATOM | 3212 | O | CYS | B | 200 | −15.727 | 30.376 | 8.673 | 1.00 | 35.07 | O |
| ATOM | 3213 | CB | CYS | B | 200 | −15.232 | 27.651 | 7.157 | 1.00 | 39.10 | C |
| ATOM | 3214 | SG | CYS | B | 200 | −13.954 | 27.783 | 8.432 | 1.00 | 54.20 | S |
| ATOM | 3215 | N | GLU | B | 201 | −17.785 | 29.598 | 8.205 | 1.00 | 34.80 | N |
| ATOM | 3216 | CA | GLU | B | 201 | −18.438 | 30.312 | 9.289 | 1.00 | 35.26 | C |
| ATOM | 3217 | C | GLU | B | 201 | −18.905 | 29.313 | 10.338 | 1.00 | 33.11 | C |
| ATOM | 3218 | O | GLU | B | 201 | −19.670 | 28.395 | 10.036 | 1.00 | 30.25 | O |
| ATOM | 3219 | CB | GLU | B | 201 | −19.619 | 31.134 | 8.764 | 1.00 | 31.34 | C |
| ATOM | 3220 | CG | GLU | B | 201 | −20.333 | 31.938 | 9.838 | 1.00 | 46.76 | C |
| ATOM | 3221 | CD | GLU | B | 201 | −21.725 | 32.382 | 9.423 | 1.00 | 57.59 | C |
| ATOM | 3222 | OE1 | GLU | B | 201 | −22.650 | 31.538 | 9.431 | 1.00 | 59.83 | O |
| ATOM | 3223 | OE2 | GLU | B | 201 | −21.893 | 33.575 | 9.093 | 1.00 | 62.46 | O |
| ATOM | 3224 | N | VAL | B | 202 | −18.450 | 29.490 | 11.572 | 1.00 | 33.14 | N |
| ATOM | 3225 | CA | VAL | B | 202 | −18.715 | 28.498 | 12.604 | 1.00 | 34.14 | C |
| ATOM | 3226 | C | VAL | B | 202 | −19.683 | 28.996 | 13.674 | 1.00 | 34.64 | C |
| ATOM | 3227 | O | VAL | B | 202 | −19.512 | 30.079 | 14.236 | 1.00 | 32.69 | O |
| ATOM | 3228 | CB | VAL | B | 202 | −17.408 | 28.046 | 13.276 | 1.00 | 32.83 | C |
| ATOM | 3229 | CG1 | VAL | B | 202 | −17.699 | 27.136 | 14.458 | 1.00 | 27.65 | C |
| ATOM | 3230 | CG2 | VAL | B | 202 | −16.513 | 27.355 | 12.258 | 1.00 | 31.56 | C |
| ATOM | 3231 | N | THR | B | 203 | −20.702 | 28.185 | 13.942 | 1.00 | 30.80 | N |
| ATOM | 3232 | CA | THR | B | 203 | −21.670 | 28.455 | 14.997 | 1.00 | 34.07 | C |
| ATOM | 3233 | C | THR | B | 203 | −21.556 | 27.394 | 16.091 | 1.00 | 36.01 | C |
| ATOM | 3234 | O | THR | B | 203 | −21.518 | 26.196 | 15.802 | 1.00 | 34.64 | O |
| ATOM | 3235 | CB | THR | B | 203 | −23.111 | 28.477 | 14.444 | 1.00 | 36.63 | C |
| ATOM | 3236 | CG2 | THR | B | 203 | −24.102 | 28.883 | 15.526 | 1.00 | 36.15 | C |
| ATOM | 3237 | OG1 | THR | B | 203 | −23.190 | 29.403 | 13.356 | 1.00 | 45.86 | O |
| ATOM | 3238 | N | HIS | B | 204 | −21.499 | 27.841 | 17.343 | 1.00 | 32.76 | N |
| ATOM | 3239 | CA | HIS | B | 204 | −21.356 | 26.946 | 18.487 | 1.00 | 34.42 | C |
| ATOM | 3240 | C | HIS | B | 204 | −21.850 | 27.620 | 19.764 | 1.00 | 33.50 | C |
| ATOM | 3241 | O | HIS | B | 204 | −21.750 | 28.837 | 19.909 | 1.00 | 34.28 | O |
| ATOM | 3242 | CB | HIS | B | 204 | −19.895 | 26.510 | 18.656 | 1.00 | 29.00 | C |
| ATOM | 3243 | CG | HIS | B | 204 | −19.689 | 25.483 | 19.728 | 1.00 | 38.33 | C |
| ATOM | 3244 | CD2 | HIS | B | 204 | −19.847 | 24.138 | 19.717 | 1.00 | 32.84 | C |
| ATOM | 3245 | ND1 | HIS | B | 204 | −19.266 | 25.810 | 20.999 | 1.00 | 29.49 | N |
| ATOM | 3246 | CE1 | HIS | B | 204 | −19.177 | 24.710 | 21.726 | 1.00 | 34.17 | C |
| ATOM | 3247 | NE2 | HIS | B | 204 | −19.522 | 23.681 | 20.973 | 1.00 | 33.34 | N |
| ATOM | 3248 | N | GLN | B | 205 | −22.367 | 26.816 | 20.687 | 1.00 | 33.90 | N |
| ATOM | 3249 | CA | GLN | B | 205 | −22.892 | 27.307 | 21.961 | 1.00 | 33.84 | C |
| ATOM | 3250 | C | GLN | B | 205 | −21.905 | 28.198 | 22.725 | 1.00 | 36.35 | C |
| ATOM | 3251 | O | GLN | B | 205 | −22.313 | 29.126 | 23.425 | 1.00 | 40.21 | O |
| ATOM | 3252 | CB | GLN | B | 205 | −23.309 | 26.121 | 22.835 | 1.00 | 33.40 | C |

TABLE 10.2-continued

| | | | | | | | | | | |
|---|---|---|---|---|---|---|---|---|---|---|
| ATOM | 3253 | CG | GLN | B | 205 | −23.981 | 26.507 | 24.136 | 1.00 | 49.24 | C |
| ATOM | 3254 | CD | GLN | B | 205 | −24.475 | 25.304 | 24.914 | 1.00 | 50.37 | C |
| ATOM | 3255 | NE2 | GLN | B | 205 | −24.852 | 25.527 | 26.168 | 1.00 | 57.58 | N |
| ATOM | 3256 | OE1 | GLN | B | 205 | −24.518 | 24.186 | 24.396 | 1.00 | 53.77 | O |
| ATOM | 3257 | N | GLY | B | 206 | −20.610 | 27.931 | 22.578 | 1.00 | 30.24 | N |
| ATOM | 3258 | CA | GLY | B | 206 | −19.587 | 28.728 | 23.237 | 1.00 | 32.96 | C |
| ATOM | 3259 | C | GLY | B | 206 | −19.239 | 30.036 | 22.542 | 1.00 | 34.80 | C |
| ATOM | 3260 | O | GLY | B | 206 | −18.466 | 30.834 | 23.064 | 1.00 | 30.49 | O |
| ATOM | 3261 | N | LEU | B | 207 | −19.806 | 30.260 | 21.363 | 1.00 | 38.67 | N |
| ATOM | 3262 | CA | LEU | B | 207 | −19.553 | 31.492 | 20.619 | 1.00 | 41.75 | C |
| ATOM | 3263 | C | LEU | B | 207 | −20.765 | 32.412 | 20.674 | 1.00 | 40.10 | C |
| ATOM | 3264 | O | LEU | B | 207 | −21.848 | 32.050 | 20.210 | 1.00 | 42.41 | O |
| ATOM | 3265 | CB | LEU | B | 207 | −19.204 | 31.180 | 19.165 | 1.00 | 34.75 | C |
| ATOM | 3266 | CG | LEU | B | 207 | −17.957 | 30.336 | 18.917 | 1.00 | 35.04 | C |
| ATOM | 3267 | CD1 | LEU | B | 207 | −17.871 | 29.946 | 17.444 | 1.00 | 32.97 | C |
| ATOM | 3268 | CD2 | LEU | B | 207 | −16.709 | 31.087 | 19.362 | 1.00 | 34.44 | C |
| ATOM | 3269 | N | SER | B | 208 | −20.582 | 33.600 | 21.239 | 1.00 | 41.65 | N |
| ATOM | 3270 | CA | SER | B | 208 | −21.685 | 34.551 | 21.366 | 1.00 | 50.19 | C |
| ATOM | 3271 | C | SER | B | 208 | −22.189 | 34.991 | 19.989 | 1.00 | 43.51 | C |
| ATOM | 3272 | O | SER | B | 208 | −23.367 | 35.307 | 19.824 | 1.00 | 51.88 | O |
| ATOM | 3273 | CB | SER | B | 208 | −21.260 | 35.758 | 22.207 | 1.00 | 41.21 | C |
| ATOM | 3274 | OG | SER | B | 208 | −19.985 | 36.239 | 21.815 | 1.00 | 63.38 | O |
| ATOM | 3275 | N | SER | B | 209 | −21.296 | 34.995 | 19.002 | 1.00 | 40.06 | N |
| ATOM | 3276 | CA | SER | B | 209 | −21.682 | 35.228 | 17.613 | 1.00 | 44.47 | C |
| ATOM | 3277 | C | SER | B | 209 | −20.812 | 34.364 | 16.695 | 1.00 | 38.33 | C |
| ATOM | 3278 | O | SER | B | 209 | −19.696 | 34.005 | 17.067 | 1.00 | 43.33 | O |
| ATOM | 3279 | CB | SER | B | 209 | −21.557 | 36.715 | 17.253 | 1.00 | 45.07 | C |
| ATOM | 3280 | OG | SER | B | 209 | −20.203 | 37.102 | 17.120 | 1.00 | 49.50 | O |
| ATOM | 3281 | N | PRO | B | 210 | −21.323 | 34.017 | 15.499 | 1.00 | 44.65 | N |
| ATOM | 3282 | CA | PRO | B | 210 | −20.580 | 33.149 | 14.574 | 1.00 | 38.77 | C |
| ATOM | 3283 | C | PRO | B | 210 | −19.176 | 33.661 | 14.264 | 1.00 | 41.23 | C |
| ATOM | 3284 | O | PRO | B | 210 | −18.966 | 34.867 | 14.141 | 1.00 | 45.61 | O |
| ATOM | 3285 | CB | PRO | B | 210 | −21.450 | 33.156 | 13.315 | 1.00 | 39.30 | C |
| ATOM | 3286 | CG | PRO | B | 210 | −22.826 | 33.399 | 13.826 | 1.00 | 43.89 | C |
| ATOM | 3287 | CD | PRO | B | 210 | −22.658 | 34.357 | 14.974 | 1.00 | 40.75 | C |
| ATOM | 3288 | N | VAL | B | 211 | −18.224 | 32.741 | 14.155 | 1.00 | 39.40 | N |
| ATOM | 3289 | CA | VAL | B | 211 | −16.834 | 33.090 | 13.883 | 1.00 | 39.75 | C |
| ATOM | 3290 | C | VAL | B | 211 | −16.475 | 32.703 | 12.452 | 1.00 | 40.69 | C |
| ATOM | 3291 | O | VAL | B | 211 | −16.747 | 31.582 | 12.020 | 1.00 | 36.87 | O |
| ATOM | 3292 | CB | VAL | B | 211 | −15.877 | 32.398 | 14.880 | 1.00 | 38.99 | C |
| ATOM | 3293 | CG1 | VAL | B | 211 | −14.429 | 32.537 | 14.436 | 1.00 | 34.79 | C |
| ATOM | 3294 | CG2 | VAL | B | 211 | −16.071 | 32.973 | 16.272 | 1.00 | 40.49 | C |
| ATOM | 3295 | N | THR | B | 212 | −15.880 | 33.639 | 11.716 | 1.00 | 35.72 | N |
| ATOM | 3296 | CA | THR | B | 212 | −15.550 | 33.409 | 10.314 | 1.00 | 39.63 | C |
| ATOM | 3297 | C | THR | B | 212 | −14.055 | 33.500 | 10.046 | 1.00 | 35.76 | C |
| ATOM | 3298 | O | THR | B | 212 | −13.424 | 34.518 | 10.323 | 1.00 | 42.94 | O |
| ATOM | 3299 | CB | THR | B | 212 | −16.272 | 34.414 | 9.391 | 1.00 | 38.85 | C |
| ATOM | 3300 | CG2 | THR | B | 212 | −15.814 | 34.238 | 7.953 | 1.00 | 37.83 | C |
| ATOM | 3301 | OG1 | THR | B | 212 | −17.687 | 34.196 | 9.461 | 1.00 | 46.70 | O |
| ATOM | 3302 | N | LYS | B | 213 | −13.491 | 32.424 | 9.513 | 1.00 | 33.60 | N |
| ATOM | 3303 | CA | LYS | B | 213 | −12.120 | 32.451 | 9.029 | 1.00 | 36.19 | C |
| ATOM | 3304 | C | LYS | B | 213 | −12.155 | 32.386 | 7.514 | 1.00 | 38.31 | C |
| ATOM | 3305 | O | LYS | B | 213 | −12.964 | 31.659 | 6.938 | 1.00 | 40.76 | O |
| ATOM | 3306 | CB | LYS | B | 213 | −11.298 | 31.295 | 9.602 | 1.00 | 35.13 | C |
| ATOM | 3307 | CG | LYS | B | 213 | −11.186 | 31.301 | 11.120 | 1.00 | 41.13 | C |
| ATOM | 3308 | CD | LYS | B | 213 | −10.462 | 32.537 | 11.635 | 1.00 | 36.48 | C |
| ATOM | 3309 | CE | LYS | B | 213 | −10.432 | 32.550 | 13.161 | 1.00 | 36.86 | C |
| ATOM | 3310 | NZ | LYS | B | 213 | −9.699 | 33.727 | 13.703 | 1.00 | 51.87 | N |
| ATOM | 3311 | N | SER | B | 214 | −11.283 | 33.149 | 6.869 | 1.00 | 36.97 | N |
| ATOM | 3312 | CA | SER | B | 214 | −11.301 | 33.233 | 5.420 | 1.00 | 35.10 | C |
| ATOM | 3313 | C | SER | B | 214 | −9.934 | 33.547 | 4.827 | 1.00 | 37.64 | C |
| ATOM | 3314 | O | SER | B | 214 | −9.021 | 33.986 | 5.524 | 1.00 | 41.48 | O |
| ATOM | 3315 | CB | SER | B | 214 | −12.307 | 34.291 | 4.971 | 1.00 | 35.76 | C |
| ATOM | 3316 | OG | SER | B | 214 | −11.918 | 35.574 | 5.422 | 1.00 | 40.23 | O |
| ATOM | 3317 | N | PHE | B | 215 | −9.804 | 33.297 | 3.530 | 1.00 | 36.45 | N |
| ATOM | 3318 | CA | PHE | B | 215 | −8.651 | 33.746 | 2.767 | 1.00 | 39.24 | C |
| ATOM | 3319 | C | PHE | B | 215 | −9.114 | 34.202 | 1.388 | 1.00 | 45.83 | C |
| ATOM | 3320 | O | PHE | B | 215 | −10.185 | 33.804 | 0.916 | 1.00 | 37.02 | O |
| ATOM | 3321 | CB | PHE | B | 215 | −7.598 | 32.640 | 2.645 | 1.00 | 32.01 | C |
| ATOM | 3322 | CG | PHE | B | 215 | −8.066 | 31.428 | 1.878 | 1.00 | 38.83 | C |
| ATOM | 3323 | CD1 | PHE | B | 215 | −8.729 | 30.397 | 2.524 | 1.00 | 31.21 | C |
| ATOM | 3324 | CD2 | PHE | B | 215 | −7.830 | 31.315 | 0.516 | 1.00 | 35.76 | C |
| ATOM | 3325 | CE1 | PHE | B | 215 | −9.156 | 29.279 | 1.825 | 1.00 | 33.60 | C |
| ATOM | 3326 | CE2 | PHE | B | 215 | −8.251 | 30.201 | −0.190 | 1.00 | 35.19 | C |
| ATOM | 3327 | CZ | PHE | B | 215 | −8.915 | 29.180 | 0.466 | 1.00 | 34.00 | C |
| ATOM | 3328 | N | ASN | B | 216 | −8.316 | 35.057 | 0.761 | 1.00 | 45.06 | N |
| ATOM | 3329 | CA | ASN | B | 216 | −8.533 | 35.429 | −0.629 | 1.00 | 42.67 | C |
| ATOM | 3330 | C | ASN | B | 216 | −7.591 | 34.626 | −1.499 | 1.00 | 39.47 | C |
| ATOM | 3331 | O | ASN | B | 216 | −6.388 | 34.607 | −1.255 | 1.00 | 45.25 | O |
| ATOM | 3332 | CB | ASN | B | 216 | −8.310 | 36.926 | −0.843 | 1.00 | 45.51 | C |

TABLE 10.2-continued

| | | | | | | | | | | |
|---|---|---|---|---|---|---|---|---|---|---|
| ATOM | 3333 | CG | ASN | B | 216 | −9.256 | 37.778 | −0.024 | 1.00 | 49.43 | C |
| ATOM | 3334 | ND2 | ASN | B | 216 | −8.785 | 38.943 | 0.402 | 1.00 | 55.43 | N |
| ATOM | 3335 | OD1 | ASN | B | 216 | −10.396 | 37.393 | 0.227 | 1.00 | 51.90 | O |
| ATOM | 3336 | N | ARG | B | 217 | −8.138 | 33.946 | −2.499 | 1.00 | 39.98 | N |
| ATOM | 3337 | CA | ARG | B | 217 | −7.327 | 33.135 | −3.396 | 1.00 | 43.37 | C |
| ATOM | 3338 | C | ARG | B | 217 | −6.257 | 33.985 | −4.069 | 1.00 | 49.33 | C |
| ATOM | 3339 | O | ARG | B | 217 | −6.559 | 35.019 | −4.665 | 1.00 | 52.85 | O |
| ATOM | 3340 | CB | ARG | B | 217 | −8.207 | 32.457 | −4.449 | 1.00 | 42.40 | C |
| ATOM | 3341 | CG | ARG | B | 217 | −7.441 | 31.578 | −5.420 | 1.00 | 38.23 | C |
| ATOM | 3342 | CD | ARG | B | 217 | −8.358 | 31.012 | −6.485 | 1.00 | 38.31 | C |
| ATOM | 3343 | NE | ARG | B | 217 | −9.059 | 32.068 | −7.204 | 1.00 | 42.76 | N |
| ATOM | 3344 | CZ | ARG | B | 217 | −8.588 | 32.665 | −8.292 | 1.00 | 51.33 | C |
| ATOM | 3345 | NH1 | ARG | B | 217 | −7.414 | 32.303 | −8.793 | 1.00 | 42.73 | N |
| ATOM | 3346 | NH2 | ARG | B | 217 | −9.294 | 33.622 | −8.883 | 1.00 | 48.38 | N |
| ATOM | 3347 | N | GLY | B | 218 | −5.004 | 33.555 | −3.952 | 1.00 | 53.01 | N |
| ATOM | 3348 | CA | GLY | B | 218 | −3.897 | 34.253 | −4.582 | 1.00 | 57.34 | C |
| ATOM | 3349 | C | GLY | B | 218 | −3.338 | 35.410 | −3.771 | 1.00 | 63.03 | C |
| ATOM | 3350 | O | GLY | B | 218 | −2.818 | 36.373 | −4.334 | 1.00 | 67.80 | O |
| ATOM | 3351 | N | GLU | B | 219 | −3.443 | 35.321 | −2.449 | 1.00 | 60.01 | N |
| ATOM | 3352 | CA | GLU | B | 219 | −2.900 | 36.353 | −1.571 | 1.00 | 61.79 | C |
| ATOM | 3353 | C | GLU | B | 219 | −2.130 | 35.742 | −0.405 | 1.00 | 61.79 | C |
| ATOM | 3354 | O | GLU | B | 219 | −1.976 | 34.525 | −0.321 | 1.00 | 69.81 | O |
| ATOM | 3355 | CB | GLU | B | 219 | −4.015 | 37.259 | −1.042 | 1.00 | 62.53 | C |
| ATOM | 3356 | CG | GLU | B | 219 | −4.663 | 38.151 | −2.096 | 1.00 | 56.22 | C |
| ATOM | 3357 | CD | GLU | B | 219 | −5.625 | 39.161 | −1.489 | 1.00 | 74.19 | C |
| ATOM | 3358 | OE1 | GLU | B | 219 | −5.593 | 39.345 | −0.252 | 1.00 | 78.86 | O |
| ATOM | 3359 | OE2 | GLU | B | 219 | −6.413 | 39.770 | −2.247 | 1.00 | 64.28 | O |
| TER | | | | | | | | | | | |
| ATOM | 3360 | N | THR | C | 152 | −29.241 | −45.858 | 26.627 | 1.00 | 80.47 | D000 N |
| ATOM | 3361 | CA | THR | C | 152 | −29.487 | −45.616 | 28.045 | 1.00 | 91.58 | D000 C |
| ATOM | 3362 | C | THR | C | 152 | −29.269 | −44.146 | 28.405 | 1.00 | 88.87 | D000 C |
| ATOM | 3363 | O | THR | C | 152 | −28.934 | −43.329 | 27.545 | 1.00 | 88.60 | D000 O |
| ATOM | 3364 | CB | THR | C | 152 | −28.582 | −46.499 | 28.936 | 1.00 | 90.05 | D000 C |
| ATOM | 3365 | CG2 | THR | C | 152 | −29.009 | −47.960 | 28.857 | 1.00 | 70.32 | D000 C |
| ATOM | 3366 | OG1 | THR | C | 152 | −27.220 | −46.382 | 28.506 | 1.00 | 79.38 | D000 O |
| ATOM | 3367 | N | CYS | C | 153 | −29.465 | −43.813 | 29.677 | 1.00 | 83.40 | D000 N |
| ATOM | 3368 | CA | CYS | C | 153 | −29.261 | −42.446 | 30.143 | 1.00 | 72.69 | D000 C |
| ATOM | 3369 | C | CYS | C | 153 | −28.836 | −42.415 | 31.611 | 1.00 | 63.73 | D000 C |
| ATOM | 3370 | O | CYS | C | 153 | −28.923 | −43.419 | 32.318 | 1.00 | 52.26 | D000 O |
| ATOM | 3371 | CB | CYS | C | 153 | −30.532 | −41.616 | 29.941 | 1.00 | 73.56 | D000 C |
| ATOM | 3372 | SG | CYS | C | 153 | −30.281 | −39.826 | 30.081 | 1.00 | 98.30 | D000 S |
| ATOM | 3373 | N | CYS | C | 154 | −28.370 | −41.254 | 32.059 | 1.00 | 61.15 | D000 N |
| ATOM | 3374 | CA | CYS | C | 154 | −27.916 | −41.085 | 33.434 | 1.00 | 58.46 | D000 C |
| ATOM | 3375 | C | CYS | C | 154 | −29.071 | −41.141 | 34.432 | 1.00 | 51.28 | D000 C |
| ATOM | 3376 | O | CYS | C | 154 | −30.208 | −40.827 | 34.086 | 1.00 | 47.54 | D000 O |
| ATOM | 3377 | CB | CYS | C | 154 | −27.160 | −39.758 | 33.580 | 1.00 | 53.06 | D000 C |
| ATOM | 3378 | SG | CYS | C | 154 | −25.446 | −39.818 | 33.000 | 1.00 | 71.64 | D000 S |
| ATOM | 3379 | N | PRO | C | 155 | −28.781 | −41.556 | 35.674 | 1.00 | 43.23 | D000 N |
| ATOM | 3380 | CA | PRO | C | 155 | −29.767 | −41.494 | 36.757 | 1.00 | 48.50 | D000 C |
| ATOM | 3381 | C | PRO | C | 155 | −30.193 | −40.062 | 37.062 | 1.00 | 49.23 | D000 C |
| ATOM | 3382 | O | PRO | C | 155 | −29.481 | −39.117 | 36.708 | 1.00 | 42.32 | D000 O |
| ATOM | 3383 | CB | PRO | C | 155 | −29.020 | −42.104 | 37.953 | 1.00 | 42.80 | D000 C |
| ATOM | 3384 | CG | PRO | C | 155 | −27.576 | −41.991 | 37.609 | 1.00 | 50.48 | D000 C |
| ATOM | 3385 | CD | PRO | C | 155 | −27.514 | −42.158 | 36.122 | 1.00 | 50.94 | D000 C |
| ATOM | 3386 | N | VAL | C | 156 | −31.343 | −39.913 | 37.713 | 1.00 | 40.74 | D000 N |
| ATOM | 3387 | CA | VAL | C | 156 | −31.863 | −38.598 | 38.077 | 1.00 | 48.19 | D000 C |
| ATOM | 3388 | C | VAL | C | 156 | −30.837 | −37.822 | 38.897 | 1.00 | 42.17 | D000 C |
| ATOM | 3389 | O | VAL | C | 156 | −30.149 | −38.403 | 39.739 | 1.00 | 40.87 | D000 O |
| ATOM | 3390 | CB | VAL | C | 156 | −33.183 | −38.717 | 38.875 | 1.00 | 54.12 | D000 C |
| ATOM | 3391 | CG1 | VAL | C | 156 | −33.775 | −37.341 | 39.149 | 1.00 | 44.84 | D000 C |
| ATOM | 3392 | CG2 | VAL | C | 156 | −34.181 | −39.590 | 38.122 | 1.00 | 50.34 | D000 C |
| ATOM | 3393 | N | ASN | C | 157 | −30.727 | −36.522 | 38.610 | 1.00 | 41.21 | D000 N |
| ATOM | 3394 | CA | ASN | C | 157 | −29.820 | −35.593 | 39.292 | 1.00 | 41.02 | D000 C |
| ATOM | 3395 | C | ASN | C | 157 | −28.353 | −35.786 | 38.927 | 1.00 | 39.65 | D000 C |
| ATOM | 3396 | O | ASN | C | 157 | −27.481 | −35.121 | 39.485 | 1.00 | 47.91 | D000 O |
| ATOM | 3397 | CB | ASN | C | 157 | −29.979 | −35.689 | 40.812 | 1.00 | 45.93 | D000 C |
| ATOM | 3398 | CG | ASN | C | 157 | −31.360 | −35.289 | 41.276 | 1.00 | 51.89 | D000 C |
| ATOM | 3399 | ND2 | ASN | C | 157 | −31.885 | −36.011 | 42.260 | 1.00 | 51.21 | D000 N |
| ATOM | 3400 | OD1 | ASN | C | 157 | −31.953 | −34.347 | 40.752 | 1.00 | 55.30 | D000 O |
| ATOM | 3401 | N | TRP | C | 158 | −28.081 | −36.696 | 37.997 | 1.00 | 38.04 | D000 N |
| ATOM | 3402 | CA | TRP | C | 158 | −26.737 | −36.841 | 37.449 | 1.00 | 35.52 | D000 C |
| ATOM | 3403 | C | TRP | C | 158 | −26.694 | −36.212 | 36.061 | 1.00 | 41.15 | D000 C |
| ATOM | 3404 | O | TRP | C | 158 | −27.720 | −36.118 | 35.387 | 1.00 | 32.47 | D000 O |
| ATOM | 3405 | CB | TRP | C | 158 | −26.323 | −38.313 | 37.394 | 1.00 | 35.29 | D000 C |
| ATOM | 3406 | CG | TRP | C | 158 | −26.115 | −38.930 | 38.751 | 1.00 | 40.11 | D000 C |
| ATOM | 3407 | CD1 | TRP | C | 158 | −27.045 | −39.064 | 39.741 | 1.00 | 38.54 | D000 C |
| ATOM | 3408 | CD2 | TRP | C | 158 | −24.903 | −39.505 | 39.262 | 1.00 | 36.91 | D000 C |
| ATOM | 3409 | CE2 | TRP | C | 158 | −25.175 | −39.961 | 40.568 | 1.00 | 38.54 | D000 C |
| ATOM | 3410 | CE3 | TRP | C | 158 | −23.615 | −39.676 | 38.743 | 1.00 | 32.86 | D000 C |
| ATOM | 3411 | NE1 | TRP | C | 158 | −26.488 | −39.677 | 40.837 | 1.00 | 42.00 | D000 N |

TABLE 10.2-continued

| | | | | | | | | | | | |
|---|---|---|---|---|---|---|---|---|---|---|---|
| ATOM | 3412 | CZ2 | TRP | C | 158 | −24.209 | −40.576 | 41.362 | 1.00 | 34.01 | D000 C |
| ATOM | 3413 | CZ3 | TRP | C | 158 | −22.657 | −40.286 | 39.533 | 1.00 | 31.10 | D000 C |
| ATOM | 3414 | CH2 | TRP | C | 158 | −22.958 | −40.728 | 40.827 | 1.00 | 31.72 | D000 C |
| ATOM | 3415 | N | VAL | C | 159 | −25.511 | −35.775 | 35.640 | 1.00 | 37.12 | D000 N |
| ATOM | 3416 | CA | VAL | C | 159 | −25.359 | −35.091 | 34.360 | 1.00 | 35.19 | D000 C |
| ATOM | 3417 | C | VAL | C | 159 | −24.434 | −35.876 | 33.422 | 1.00 | 42.52 | D000 C |
| ATOM | 3418 | O | VAL | C | 159 | −23.383 | −36.372 | 33.837 | 1.00 | 37.10 | D000 O |
| ATOM | 3419 | CB | VAL | C | 159 | −24.811 | −33.660 | 34.557 | 1.00 | 36.85 | D000 C |
| ATOM | 3420 | CG1 | VAL | C | 159 | −24.794 | −32.907 | 33.240 | 1.00 | 35.63 | D000 C |
| ATOM | 3421 | CG2 | VAL | C | 159 | −25.650 | −32.909 | 35.583 | 1.00 | 36.56 | D000 C |
| ATOM | 3422 | N | GLU | C | 160 | −24.827 | −35.987 | 32.157 | 1.00 | 36.06 | D000 N |
| ATOM | 3423 | CA | GLU | C | 160 | −24.070 | −36.784 | 31.197 | 1.00 | 43.73 | D000 C |
| ATOM | 3424 | C | GLU | C | 160 | −23.047 | −35.975 | 30.405 | 1.00 | 36.77 | D000 C |
| ATOM | 3425 | O | GLU | C | 160 | −23.328 | −34.874 | 29.939 | 1.00 | 41.07 | D000 O |
| ATOM | 3426 | CB | GLU | C | 160 | −25.018 | −37.481 | 30.221 | 1.00 | 43.94 | D000 C |
| ATOM | 3427 | CG | GLU | C | 160 | −24.301 | −38.291 | 29.158 | 1.00 | 50.04 | D000 C |
| ATOM | 3428 | CD | GLU | C | 160 | −25.222 | −38.743 | 28.045 | 1.00 | 67.78 | D000 C |
| ATOM | 3429 | OE1 | GLU | C | 160 | −26.430 | −38.930 | 28.308 | 1.00 | 69.69 | D000 O |
| ATOM | 3430 | OE2 | GLU | C | 160 | −24.735 | −38.904 | 26.905 | 1.00 | 67.23 | D000 O |
| ATOM | 3431 | N | HIS | C | 161 | −21.856 | −36.541 | 30.261 | 1.00 | 37.45 | D000 N |
| ATOM | 3432 | CA | HIS | C | 161 | −20.829 | −35.993 | 29.388 | 1.00 | 38.41 | D000 C |
| ATOM | 3433 | C | HIS | C | 161 | −19.987 | −37.135 | 28.842 | 1.00 | 40.31 | D000 C |
| ATOM | 3434 | O | HIS | C | 161 | −19.301 | −37.816 | 29.604 | 1.00 | 36.78 | D000 O |
| ATOM | 3435 | CB | HIS | C | 161 | −19.951 | −34.987 | 30.134 | 1.00 | 35.44 | D000 C |
| ATOM | 3436 | CG | HIS | C | 161 | −18.785 | −34.487 | 29.334 | 1.00 | 39.39 | D000 C |
| ATOM | 3437 | CD2 | HIS | C | 161 | −17.492 | −34.888 | 29.300 | 1.00 | 37.49 | D000 C |
| ATOM | 3438 | ND1 | HIS | C | 161 | −18.888 | −33.445 | 28.439 | 1.00 | 37.81 | D000 N |
| ATOM | 3439 | CE1 | HIS | C | 161 | −17.707 | −33.223 | 27.887 | 1.00 | 36.44 | D000 C |
| ATOM | 3440 | NE2 | HIS | C | 161 | −16.844 | −34.085 | 28.390 | 1.00 | 39.12 | D000 N |
| ATOM | 3441 | N | GLU | C | 162 | −20.066 | −37.349 | 27.529 | 1.00 | 45.55 | D000 N |
| ATOM | 3442 | CA | GLU | C | 162 | −19.271 | −38.365 | 26.834 | 1.00 | 40.64 | D000 C |
| ATOM | 3443 | C | GLU | C | 162 | −19.341 | −39.749 | 27.484 | 1.00 | 41.12 | D000 C |
| ATOM | 3444 | O | GLU | C | 162 | −18.318 | −40.305 | 27.887 | 1.00 | 42.56 | D000 O |
| ATOM | 3445 | CB | GLU | C | 162 | −17.806 | −37.919 | 26.744 | 1.00 | 41.10 | D000 C |
| ATOM | 3446 | CG | GLU | C | 162 | −17.596 | −36.576 | 26.052 | 1.00 | 49.56 | D000 C |
| ATOM | 3447 | CD | GLU | C | 162 | −18.120 | −36.554 | 24.622 | 1.00 | 68.97 | D000 C |
| ATOM | 3448 | OE1 | GLU | C | 162 | −18.103 | −37.612 | 23.955 | 1.00 | 61.44 | D000 O |
| ATOM | 3449 | OE2 | GLU | C | 162 | −18.551 | −35.472 | 24.163 | 1.00 | 82.19 | D000 O |
| ATOM | 3450 | N | ARG | C | 163 | −20.550 | −40.289 | 27.586 | 1.00 | 39.55 | D000 N |
| ATOM | 3451 | CA | ARG | C | 163 | −20.790 | −41.614 | 28.175 | 1.00 | 50.72 | D000 C |
| ATOM | 3452 | C | ARG | C | 163 | −20.305 | −41.757 | 29.628 | 1.00 | 46.47 | D000 C |
| ATOM | 3453 | O | ARG | C | 163 | −20.132 | −42.870 | 30.127 | 1.00 | 44.94 | D000 O |
| ATOM | 3454 | CB | ARG | C | 163 | −20.156 | −42.710 | 27.306 | 1.00 | 49.40 | D000 C |
| ATOM | 3455 | CG | ARG | C | 163 | −20.768 | −42.827 | 25.907 | 1.00 | 51.79 | D000 C |
| ATOM | 3456 | CD | ARG | C | 163 | −20.685 | −44.252 | 25.348 | 1.00 | 44.72 | D000 C |
| ATOM | 3457 | NE | ARG | C | 163 | −21.723 | −45.140 | 25.879 | 1.00 | 51.93 | D000 N |
| ATOM | 3458 | CZ | ARG | C | 163 | −21.483 | −46.234 | 26.606 | 1.00 | 59.01 | D000 C |
| ATOM | 3459 | NH1 | ARG | C | 163 | −22.492 | −46.980 | 27.044 | 1.00 | 45.88 | D000 N |
| ATOM | 3460 | NH2 | ARG | C | 163 | −20.236 | −46.586 | 26.897 | 1.00 | 49.85 | D000 N |
| ATOM | 3461 | N | SER | C | 164 | −20.099 | −40.633 | 30.306 | 1.00 | 43.03 | D000 N |
| ATOM | 3462 | CA | SER | C | 164 | −19.865 | −40.646 | 31.746 | 1.00 | 37.64 | D000 C |
| ATOM | 3463 | C | SER | C | 164 | −20.969 | −39.876 | 32.459 | 1.00 | 37.23 | D000 C |
| ATOM | 3464 | O | SER | C | 164 | −21.536 | −38.933 | 31.903 | 1.00 | 37.58 | D000 O |
| ATOM | 3465 | CB | SER | C | 164 | −18.498 | −40.052 | 32.092 | 1.00 | 37.20 | D000 C |
| ATOM | 3466 | OG | SER | C | 164 | −17.509 | −41.061 | 32.172 | 1.00 | 40.60 | D000 O |
| ATOM | 3467 | N | CYS | C | 165 | −21.272 | −40.283 | 33.687 | 1.00 | 36.28 | D000 N |
| ATOM | 3468 | CA | CYS | C | 165 | −22.296 | −39.624 | 34.493 | 1.00 | 35.32 | D000 C |
| ATOM | 3469 | C | CYS | C | 165 | −21.666 | −38.921 | 35.688 | 1.00 | 39.53 | D000 C |
| ATOM | 3470 | O | CYS | C | 165 | −20.843 | −39.504 | 36.398 | 1.00 | 33.29 | D000 O |
| ATOM | 3471 | CB | CYS | C | 165 | −23.344 | −40.632 | 34.974 | 1.00 | 42.45 | D000 C |
| ATOM | 3472 | SG | CYS | C | 165 | −24.315 | −41.382 | 33.657 | 1.00 | 55.85 | D000 S |
| ATOM | 3473 | N | TYR | C | 166 | −22.065 | −37.674 | 35.915 | 1.00 | 29.38 | D000 N |
| ATOM | 3474 | CA | TYR | C | 166 | −21.475 | −36.870 | 36.976 | 1.00 | 33.48 | D000 C |
| ATOM | 3475 | C | TYR | C | 166 | −22.532 | −36.391 | 37.963 | 1.00 | 33.01 | D000 C |
| ATOM | 3476 | O | TYR | C | 166 | −23.665 | −36.110 | 37.589 | 1.00 | 33.24 | D000 O |
| ATOM | 3477 | CB | TYR | C | 166 | −20.730 | −35.667 | 36.388 | 1.00 | 32.05 | D000 C |
| ATOM | 3478 | CG | TYR | C | 166 | −19.658 | −36.030 | 35.383 | 1.00 | 31.06 | D000 C |
| ATOM | 3479 | CD1 | TYR | C | 166 | −19.990 | −36.385 | 34.080 | 1.00 | 30.70 | D000 C |
| ATOM | 3480 | CD2 | TYR | C | 166 | −18.313 | −36.003 | 35.732 | 1.00 | 30.70 | D000 C |
| ATOM | 3481 | CE1 | TYR | C | 166 | −19.017 | −36.713 | 33.153 | 1.00 | 33.69 | D000 C |
| ATOM | 3482 | CE2 | TYR | C | 166 | −17.329 | −36.329 | 34.807 | 1.00 | 32.22 | D000 C |
| ATOM | 3483 | CZ | TYR | C | 166 | −17.690 | −36.682 | 33.519 | 1.00 | 32.45 | D000 C |
| ATOM | 3484 | OH | TYR | C | 166 | −16.723 | −37.007 | 32.593 | 1.00 | 35.47 | D000 O |
| ATOM | 3485 | N | TRP | C | 167 | −22.156 | −36.309 | 39.231 | 1.00 | 33.71 | D000 N |
| ATOM | 3486 | CA | TRP | C | 167 | −23.032 | −35.743 | 40.246 | 1.00 | 35.55 | D000 C |
| ATOM | 3487 | C | TRP | C | 167 | −22.262 | −34.685 | 41.017 | 1.00 | 32.66 | D000 C |
| ATOM | 3488 | O | TRP | C | 167 | −21.140 | −34.931 | 41.470 | 1.00 | 31.46 | D000 O |
| ATOM | 3489 | CB | TRP | C | 167 | −23.559 | −36.827 | 41.186 | 1.00 | 35.80 | D000 C |
| ATOM | 3490 | CG | TRP | C | 167 | −24.458 | −36.290 | 42.265 | 1.00 | 43.58 | D000 C |
| ATOM | 3491 | CD1 | TRP | C | 167 | −25.805 | −36.079 | 42.183 | 1.00 | 38.70 | D000 C |

TABLE 10.2-continued

| ATOM | 3492 | CD2 | TRP | C | 167 | −24.070 | −35.896 | 43.587 | 1.00 | 35.59 | D000 | C |
|------|------|-----|-----|---|-----|---------|---------|--------|------|-------|------|---|
| ATOM | 3493 | CE2 | TRP | C | 167 | −25.235 | −35.456 | 44.251 | 1.00 | 41.09 | D000 | C |
| ATOM | 3494 | CE3 | TRP | C | 167 | −22.852 | −35.869 | 44.271 | 1.00 | 35.37 | D000 | C |
| ATOM | 3495 | NE1 | TRP | C | 167 | −26.280 | −35.577 | 43.373 | 1.00 | 39.42 | D000 | N |
| ATOM | 3496 | CZ2 | TRP | C | 167 | −25.215 | −34.997 | 45.567 | 1.00 | 38.44 | D000 | C |
| ATOM | 3497 | CZ3 | TRP | C | 167 | −22.835 | −35.415 | 45.579 | 1.00 | 37.33 | D000 | C |
| ATOM | 3498 | CH2 | TRP | C | 167 | −24.008 | −34.985 | 46.213 | 1.00 | 36.75 | D000 | C |
| ATOM | 3499 | N   | PHE | C | 168 | −22.858 | −33.505 | 41.155 | 1.00 | 33.58 | D000 | N |
| ATOM | 3500 | CA  | PHE | C | 168 | −22.172 | −32.374 | 41.778 | 1.00 | 33.25 | D000 | C |
| ATOM | 3501 | C   | PHE | C | 168 | −22.773 | −32.041 | 43.134 | 1.00 | 31.97 | D000 | C |
| ATOM | 3502 | O   | PHE | C | 168 | −23.953 | −31.721 | 43.227 | 1.00 | 34.21 | D000 | O |
| ATOM | 3503 | CB  | PHE | C | 168 | −22.229 | −31.148 | 40.861 | 1.00 | 28.44 | D000 | C |
| ATOM | 3504 | CG  | PHE | C | 168 | −21.573 | −31.363 | 39.526 | 1.00 | 30.16 | D000 | C |
| ATOM | 3505 | CD1 | PHE | C | 168 | −22.287 | −31.896 | 38.463 | 1.00 | 31.96 | D000 | C |
| ATOM | 3506 | CD2 | PHE | C | 168 | −20.239 | −31.038 | 39.337 | 1.00 | 29.17 | D000 | C |
| ATOM | 3507 | CE1 | PHE | C | 168 | −21.682 | −32.099 | 37.229 | 1.00 | 29.38 | D000 | C |
| ATOM | 3508 | CE2 | PHE | C | 168 | −19.625 | −31.242 | 38.114 | 1.00 | 28.14 | D000 | C |
| ATOM | 3509 | CZ  | PHE | C | 168 | −20.348 | −31.776 | 37.057 | 1.00 | 28.28 | D000 | C |
| ATOM | 3510 | N   | SER | C | 169 | −21.961 | −32.110 | 44.186 | 1.00 | 30.11 | D000 | N |
| ATOM | 3511 | CA  | SER | C | 169 | −22.462 | −31.851 | 45.528 | 1.00 | 31.18 | D000 | C |
| ATOM | 3512 | C   | SER | C | 169 | −22.693 | −30.360 | 45.740 | 1.00 | 37.87 | D000 | C |
| ATOM | 3513 | O   | SER | C | 169 | −22.121 | −29.522 | 45.038 | 1.00 | 34.20 | D000 | O |
| ATOM | 3514 | CB  | SER | C | 169 | −21.494 | −32.389 | 46.583 | 1.00 | 30.35 | D000 | C |
| ATOM | 3515 | OG  | SER | C | 169 | −20.471 | −31.453 | 46.859 | 1.00 | 30.05 | D000 | O |
| ATOM | 3516 | N   | ARG | C | 170 | −23.536 | −30.027 | 46.708 | 1.00 | 37.76 | D000 | N |
| ATOM | 3517 | CA  | ARG | C | 170 | −23.767 | −28.628 | 47.046 | 1.00 | 42.71 | D000 | C |
| ATOM | 3518 | C   | ARG | C | 170 | −23.330 | −28.383 | 48.488 | 1.00 | 43.83 | D000 | C |
| ATOM | 3519 | O   | ARG | C | 170 | −23.437 | −27.274 | 49.010 | 1.00 | 47.78 | D000 | O |
| ATOM | 3520 | CB  | ARG | C | 170 | −25.237 | −28.254 | 46.829 | 1.00 | 44.70 | D000 | C |
| ATOM | 3521 | CG  | ARG | C | 170 | −25.717 | −28.513 | 45.395 | 1.00 | 57.03 | D000 | C |
| ATOM | 3522 | CD  | ARG | C | 170 | −27.063 | −27.862 | 45.082 | 1.00 | 63.29 | D000 | C |
| ATOM | 3523 | NE  | ARG | C | 170 | −28.144 | −28.365 | 45.925 | 1.00 | 84.25 | D000 | N |
| ATOM | 3524 | CZ  | ARG | C | 170 | −28.822 | −29.485 | 45.688 | 1.00 | 84.39 | D000 | C |
| ATOM | 3525 | NH1 | ARG | C | 170 | −29.792 | −29.862 | 46.511 | 1.00 | 72.14 | D000 | N |
| ATOM | 3526 | NH2 | ARG | C | 170 | −28.528 | −30.230 | 44.631 | 1.00 | 91.59 | D000 | N |
| ATOM | 3527 | N   | SER | C | 171 | −22.817 | −29.439 | 49.112 | 1.00 | 39.23 | D000 | N |
| ATOM | 3528 | CA  | SER | C | 171 | −22.298 | −29.372 | 50.470 | 1.00 | 41.01 | D000 | C |
| ATOM | 3529 | C   | SER | C | 171 | −20.827 | −29.773 | 50.489 | 1.00 | 37.33 | D000 | C |
| ATOM | 3530 | O   | SER | C | 171 | −20.305 | −30.281 | 49.499 | 1.00 | 31.87 | D000 | O |
| ATOM | 3531 | CB  | SER | C | 171 | −23.106 | −30.277 | 51.401 | 1.00 | 36.62 | D000 | C |
| ATOM | 3532 | OG  | SER | C | 171 | −23.000 | −31.633 | 51.004 | 1.00 | 43.48 | D000 | O |
| ATOM | 3533 | N   | GLY | C | 172 | −20.166 | −29.549 | 51.620 | 1.00 | 31.79 | D000 | N |
| ATOM | 3534 | CA  | GLY | C | 172 | −18.749 | −29.840 | 51.743 | 1.00 | 31.58 | D000 | C |
| ATOM | 3535 | C   | GLY | C | 172 | −18.428 | −31.069 | 52.573 | 1.00 | 37.61 | D000 | C |
| ATOM | 3536 | O   | GLY | C | 172 | −19.161 | −31.427 | 53.495 | 1.00 | 34.62 | D000 | O |
| ATOM | 3537 | N   | LYS | C | 173 | −17.317 | −31.714 | 52.231 | 1.00 | 32.21 | D000 | N |
| ATOM | 3538 | CA  | LYS | C | 173 | −16.818 | −32.878 | 52.954 | 1.00 | 30.84 | D000 | C |
| ATOM | 3539 | C   | LYS | C | 173 | −15.300 | −32.903 | 52.885 | 1.00 | 36.15 | D000 | C |
| ATOM | 3540 | O   | LYS | C | 173 | −14.715 | −32.463 | 51.894 | 1.00 | 35.63 | D000 | O |
| ATOM | 3541 | CB  | LYS | C | 173 | −17.365 | −34.184 | 52.367 | 1.00 | 35.20 | D000 | C |
| ATOM | 3542 | CG  | LYS | C | 173 | −18.746 | −34.590 | 52.824 | 1.00 | 33.26 | D000 | C |
| ATOM | 3543 | CD  | LYS | C | 173 | −19.092 | −35.966 | 52.277 | 1.00 | 36.71 | D000 | C |
| ATOM | 3544 | CE  | LYS | C | 173 | −20.518 | −36.364 | 52.617 | 1.00 | 39.30 | D000 | C |
| ATOM | 3545 | NZ  | LYS | C | 173 | −20.706 | −36.532 | 54.082 | 1.00 | 42.46 | D000 | N |
| ATOM | 3546 | N   | ALA | C | 174 | −14.665 | −33.423 | 53.930 | 1.00 | 34.50 | D000 | N |
| ATOM | 3547 | CA  | ALA | C | 174 | −13.244 | −33.733 | 53.871 | 1.00 | 32.78 | D000 | C |
| ATOM | 3548 | C   | ALA | C | 174 | −13.011 | −34.731 | 52.737 | 1.00 | 30.79 | D000 | C |
| ATOM | 3549 | O   | ALA | C | 174 | −13.918 | −35.486 | 52.375 | 1.00 | 27.51 | D000 | O |
| ATOM | 3550 | CB  | ALA | C | 174 | −12.756 | −34.296 | 55.201 | 1.00 | 32.37 | D000 | C |
| ATOM | 3551 | N   | TRP | C | 175 | −11.802 | −34.736 | 52.182 | 1.00 | 28.74 | D000 | N |
| ATOM | 3552 | CA  | TRP | C | 175 | −11.510 | −35.556 | 51.011 | 1.00 | 34.63 | D000 | C |
| ATOM | 3553 | C   | TRP | C | 175 | −11.853 | −37.026 | 51.230 | 1.00 | 31.83 | D000 | C |
| ATOM | 3554 | O   | TRP | C | 175 | −12.520 | −37.640 | 50.398 | 1.00 | 31.59 | D000 | O |
| ATOM | 3555 | CB  | TRP | C | 175 | −10.041 | −35.430 | 50.606 | 1.00 | 31.97 | D000 | C |
| ATOM | 3556 | CG  | TRP | C | 175 | −9.771  | −36.017 | 49.251 | 1.00 | 27.08 | D000 | C |
| ATOM | 3557 | CD1 | TRP | C | 175 | −9.812  | −35.364 | 48.051 | 1.00 | 33.57 | D000 | C |
| ATOM | 3558 | CD2 | TRP | C | 175 | −9.442  | −37.378 | 48.955 | 1.00 | 30.56 | D000 | C |
| ATOM | 3559 | CE2 | TRP | C | 175 | −9.285  | −37.476 | 47.558 | 1.00 | 29.73 | D000 | C |
| ATOM | 3560 | CE3 | TRP | C | 175 | −9.257  | −38.524 | 49.737 | 1.00 | 31.43 | D000 | C |
| ATOM | 3561 | NE1 | TRP | C | 175 | −9.518  | −36.234 | 47.029 | 1.00 | 30.16 | D000 | N |
| ATOM | 3562 | CZ2 | TRP | C | 175 | −8.958  | −38.674 | 46.926 | 1.00 | 31.89 | D000 | C |
| ATOM | 3563 | CZ3 | TRP | C | 175 | −8.934  | −39.711 | 49.107 | 1.00 | 33.11 | D000 | C |
| ATOM | 3564 | CH2 | TRP | C | 175 | −8.787  | −39.777 | 47.715 | 1.00 | 31.57 | D000 | C |
| ATOM | 3565 | N   | ALA | C | 176 | −11.402 | −37.585 | 52.349 | 1.00 | 36.55 | D000 | N |
| ATOM | 3566 | CA  | ALA | C | 176 | −11.654 | −38.992 | 52.642 | 1.00 | 34.85 | D000 | C |
| ATOM | 3567 | C   | ALA | C | 176 | −13.153 | −39.287 | 52.720 | 1.00 | 31.81 | D000 | C |
| ATOM | 3568 | O   | ALA | C | 176 | −13.611 | −40.335 | 52.264 | 1.00 | 32.34 | D000 | O |
| ATOM | 3569 | CB  | ALA | C | 176 | −10.961 | −39.397 | 53.940 | 1.00 | 39.21 | D000 | C |
| ATOM | 3570 | N   | ASP | C | 177 | −13.921 | −38.362 | 53.286 | 1.00 | 29.24 | D000 | N |
| ATOM | 3571 | CA  | ASP | C | 177 | −15.363 | −38.562 | 53.387 | 1.00 | 30.70 | D000 | C |

TABLE 10.2-continued

| | | | | | | | | | | |
|---|---|---|---|---|---|---|---|---|---|---|
| ATOM | 3572 | C | ASP | C | 177 | −16.048 | −38.465 | 52.021 | 1.00 | 34.41 | D000 | C |
| ATOM | 3573 | O | ASP | C | 177 | −17.005 | −39.186 | 51.749 | 1.00 | 30.91 | D000 | O |
| ATOM | 3574 | CB | ASP | C | 177 | −15.976 | −37.560 | 54.363 | 1.00 | 36.68 | D000 | C |
| ATOM | 3575 | CG | ASP | C | 177 | −15.641 | −37.883 | 55.810 | 1.00 | 47.91 | D000 | C |
| ATOM | 3576 | OD1 | ASP | C | 177 | −15.459 | −39.080 | 56.124 | 1.00 | 48.52 | D000 | O |
| ATOM | 3577 | OD2 | ASP | C | 177 | −15.561 | −36.943 | 56.631 | 1.00 | 44.32 | D000 | O |
| ATOM | 3578 | N | ALA | C | 178 | −15.558 | −37.575 | 51.164 | 1.00 | 33.94 | D000 | N |
| ATOM | 3579 | CA | ALA | C | 178 | −16.104 | −37.450 | 49.814 | 1.00 | 37.48 | D000 | C |
| ATOM | 3580 | C | ALA | C | 178 | −15.776 | −38.696 | 48.994 | 1.00 | 30.71 | D000 | C |
| ATOM | 3581 | O | ALA | C | 178 | −16.620 | −39.219 | 48.265 | 1.00 | 33.32 | D000 | O |
| ATOM | 3582 | CB | ALA | C | 178 | −15.568 | −36.197 | 49.130 | 1.00 | 29.20 | D000 | C |
| ATOM | 3583 | N | ASP | C | 179 | −14.540 | −39.161 | 49.134 | 1.00 | 30.70 | D000 | N |
| ATOM | 3584 | CA | ASP | C | 179 | −14.078 | −40.389 | 48.501 | 1.00 | 27.81 | D000 | C |
| ATOM | 3585 | C | ASP | C | 179 | −14.986 | −41.564 | 48.868 | 1.00 | 36.66 | D000 | C |
| ATOM | 3586 | O | ASP | C | 179 | −15.411 | −42.333 | 48.005 | 1.00 | 36.40 | D000 | O |
| ATOM | 3587 | CB | ASP | C | 179 | −12.630 | −40.671 | 48.918 | 1.00 | 31.15 | D000 | C |
| ATOM | 3588 | CG | ASP | C | 179 | −12.068 | −41.935 | 48.289 | 1.00 | 39.74 | D000 | C |
| ATOM | 3589 | OD1 | ASP | C | 179 | −12.435 | −42.255 | 47.139 | 1.00 | 49.64 | D000 | O |
| ATOM | 3590 | OD2 | ASP | C | 179 | −11.247 | −42.607 | 48.947 | 1.00 | 47.11 | D000 | O |
| ATOM | 3591 | N | ASN | C | 180 | −15.299 | −41.680 | 50.153 | 1.00 | 32.38 | D000 | N |
| ATOM | 3592 | CA | ASN | C | 180 | −16.155 | −42.751 | 50.642 | 1.00 | 33.10 | D000 | C |
| ATOM | 3593 | C | ASN | C | 180 | −17.598 | −42.602 | 50.155 | 1.00 | 32.93 | D000 | C |
| ATOM | 3594 | O | ASN | C | 180 | −18.224 | −43.582 | 49.755 | 1.00 | 36.93 | D000 | O |
| ATOM | 3595 | CB | ASN | C | 180 | −16.108 | −42.799 | 52.171 | 1.00 | 39.79 | D000 | C |
| ATOM | 3596 | CG | ASN | C | 180 | −16.936 | −43.931 | 52.745 | 1.00 | 50.05 | D000 | C |
| ATOM | 3597 | ND2 | ASN | C | 180 | −16.557 | −45.165 | 52.427 | 1.00 | 44.28 | D000 | N |
| ATOM | 3598 | OD1 | ASN | C | 180 | −17.911 | −43.699 | 53.461 | 1.00 | 53.44 | D000 | O |
| ATOM | 3599 | N | TYR | C | 181 | −18.120 | −41.378 | 50.182 | 1.00 | 33.15 | D000 | N |
| ATOM | 3600 | CA | TYR | C | 181 | −19.460 | −41.105 | 49.659 | 1.00 | 36.25 | D000 | C |
| ATOM | 3601 | C | TYR | C | 181 | −19.609 | −41.606 | 48.218 | 1.00 | 38.76 | D000 | C |
| ATOM | 3602 | O | TYR | C | 181 | −20.608 | −42.238 | 47.875 | 1.00 | 36.89 | D000 | O |
| ATOM | 3603 | CB | TYR | C | 181 | −19.775 | −39.605 | 49.728 | 1.00 | 29.33 | D000 | C |
| ATOM | 3604 | CG | TYR | C | 181 | −21.139 | −39.226 | 49.184 | 1.00 | 38.78 | D000 | C |
| ATOM | 3605 | CD1 | TYR | C | 181 | −21.333 | −39.016 | 47.820 | 1.00 | 39.24 | D000 | C |
| ATOM | 3606 | CD2 | TYR | C | 181 | −22.232 | −39.065 | 50.032 | 1.00 | 37.86 | D000 | C |
| ATOM | 3607 | CE1 | TYR | C | 181 | −22.574 | −38.670 | 47.316 | 1.00 | 41.79 | D000 | C |
| ATOM | 3608 | CE2 | TYR | C | 181 | −23.484 | −38.716 | 49.534 | 1.00 | 30.18 | D000 | C |
| ATOM | 3609 | CZ | TYR | C | 181 | −23.643 | −38.520 | 48.173 | 1.00 | 43.34 | D000 | C |
| ATOM | 3610 | OH | TYR | C | 181 | −24.868 | −38.175 | 47.654 | 1.00 | 43.72 | D000 | O |
| ATOM | 3611 | N | CYS | C | 182 | −18.617 | −41.321 | 47.379 | 1.00 | 32.27 | D000 | N |
| ATOM | 3612 | CA | CYS | C | 182 | −18.688 | −41.720 | 45.977 | 1.00 | 33.21 | D000 | C |
| ATOM | 3613 | C | CYS | C | 182 | −18.666 | −43.240 | 45.819 | 1.00 | 36.35 | D000 | C |
| ATOM | 3614 | O | CYS | C | 182 | −19.433 | −43.793 | 45.032 | 1.00 | 28.20 | D000 | O |
| ATOM | 3615 | CB | CYS | C | 182 | −17.550 | −41.079 | 45.177 | 1.00 | 33.72 | D000 | C |
| ATOM | 3616 | SG | CYS | C | 182 | −17.775 | −39.294 | 44.910 | 1.00 | 35.82 | D000 | S |
| ATOM | 3617 | N | ARG | C | 183 | −17.798 | −43.911 | 46.573 | 1.00 | 38.71 | D000 | N |
| ATOM | 3618 | CA | ARG | C | 183 | −17.731 | −45.373 | 46.546 | 1.00 | 38.40 | D000 | C |
| ATOM | 3619 | C | ARG | C | 183 | −19.071 | −45.997 | 46.942 | 1.00 | 41.03 | D000 | C |
| ATOM | 3620 | O | ARG | C | 183 | −19.466 | −47.030 | 46.409 | 1.00 | 42.99 | D000 | O |
| ATOM | 3621 | CB | ARG | C | 183 | −16.621 | −45.880 | 47.473 | 1.00 | 39.02 | D000 | C |
| ATOM | 3622 | CG | ARG | C | 183 | −15.217 | −45.538 | 47.002 | 1.00 | 46.96 | D000 | C |
| ATOM | 3623 | CD | ARG | C | 183 | −14.169 | −45.992 | 48.007 | 1.00 | 60.57 | D000 | C |
| ATOM | 3624 | NE | ARG | C | 183 | −12.816 | −45.655 | 47.570 | 1.00 | 80.77 | D000 | N |
| ATOM | 3625 | CZ | ARG | C | 183 | −11.722 | −45.845 | 48.301 | 1.00 | 85.00 | D000 | C |
| ATOM | 3626 | NH1 | ARG | C | 183 | −11.814 | −46.372 | 49.516 | 1.00 | 72.80 | D000 | N |
| ATOM | 3627 | NH2 | ARG | C | 183 | −10.532 | −45.505 | 47.818 | 1.00 | 88.26 | D000 | N |
| ATOM | 3628 | N | LEU | C | 184 | −19.769 | −45.348 | 47.869 | 1.00 | 38.52 | D000 | N |
| ATOM | 3629 | CA | LEU | C | 184 | −21.063 | −45.822 | 48.348 | 1.00 | 45.53 | D000 | C |
| ATOM | 3630 | C | LEU | C | 184 | −22.165 | −45.627 | 47.305 | 1.00 | 44.46 | D000 | C |
| ATOM | 3631 | O | LEU | C | 184 | −23.192 | −46.300 | 47.344 | 1.00 | 49.42 | D000 | O |
| ATOM | 3632 | CB | LEU | C | 184 | −21.436 | −45.110 | 49.656 | 1.00 | 38.94 | D000 | C |
| ATOM | 3633 | CG | LEU | C | 184 | −21.111 | −45.837 | 50.967 | 1.00 | 47.53 | D000 | C |
| ATOM | 3634 | CD1 | LEU | C | 184 | −19.766 | −46.545 | 50.898 | 1.00 | 51.14 | D000 | C |
| ATOM | 3635 | CD2 | LEU | C | 184 | −21.138 | −44.869 | 52.138 | 1.00 | 42.20 | D000 | C |
| ATOM | 3636 | N | GLU | C | 185 | −21.953 | −44.701 | 46.376 | 1.00 | 42.20 | D000 | N |
| ATOM | 3637 | CA | GLU | C | 185 | −22.903 | −44.483 | 45.288 | 1.00 | 39.20 | D000 | C |
| ATOM | 3638 | C | GLU | C | 185 | −22.504 | −45.293 | 44.056 | 1.00 | 40.02 | D000 | C |
| ATOM | 3639 | O | GLU | C | 185 | −22.992 | −45.040 | 42.954 | 1.00 | 41.00 | D000 | O |
| ATOM | 3640 | CB | GLU | C | 185 | −22.991 | −42.997 | 44.936 | 1.00 | 43.28 | D000 | C |
| ATOM | 3641 | CG | GLU | C | 185 | −23.645 | −42.139 | 46.005 | 1.00 | 50.04 | D000 | C |
| ATOM | 3642 | CD | GLU | C | 185 | −25.132 | −42.410 | 46.144 | 1.00 | 63.83 | D000 | C |
| ATOM | 3643 | OE1 | GLU | C | 185 | −25.853 | −42.327 | 45.125 | 1.00 | 64.40 | D000 | O |
| ATOM | 3644 | OE2 | GLU | C | 185 | −25.578 | −42.711 | 47.274 | 1.00 | 66.65 | D000 | O |
| ATOM | 3645 | N | ASP | C | 186 | −21.618 | −46.266 | 44.266 | 1.00 | 39.71 | D000 | N |
| ATOM | 3646 | CA | ASP | C | 186 | −21.073 | −47.104 | 43.197 | 1.00 | 46.14 | D000 | C |
| ATOM | 3647 | C | ASP | C | 186 | −20.374 | −46.235 | 42.149 | 1.00 | 46.36 | D000 | C |
| ATOM | 3648 | O | ASP | C | 186 | −20.472 | −46.469 | 40.940 | 1.00 | 37.33 | D000 | O |
| ATOM | 3649 | CB | ASP | C | 186 | −22.172 | −47.957 | 42.555 | 1.00 | 48.03 | D000 | C |
| ATOM | 3650 | CG | ASP | C | 186 | −21.616 | −49.072 | 41.689 | 1.00 | 57.58 | D000 | C |
| ATOM | 3651 | OD1 | ASP | C | 186 | −20.621 | −49.705 | 42.104 | 1.00 | 69.48 | D000 | O |

TABLE 10.2-continued

| | | | | | | | | | | |
|---|---|---|---|---|---|---|---|---|---|---|
| ATOM | 3652 | OD2 | ASP | C | 186 | −22.167 | −49.306 | 40.592 | 1.00 | 63.55 | D000 O |
| ATOM | 3653 | N | ALA | C | 187 | −19.667 | −45.222 | 42.634 | 1.00 | 37.49 | D000 N |
| ATOM | 3654 | CA | ALA | C | 187 | −18.974 | −44.291 | 41.763 | 1.00 | 36.04 | D000 C |
| ATOM | 3655 | C | ALA | C | 187 | −17.592 | −43.992 | 42.322 | 1.00 | 37.13 | D000 C |
| ATOM | 3656 | O | ALA | C | 187 | −17.086 | −44.715 | 43.183 | 1.00 | 35.71 | D000 O |
| ATOM | 3657 | CB | ALA | C | 187 | −19.784 | −43.005 | 41.603 | 1.00 | 29.96 | D000 C |
| ATOM | 3658 | N | HIS | C | 188 | −16.981 | −42.924 | 41.826 | 1.00 | 31.72 | D000 N |
| ATOM | 3659 | CA | HIS | C | 188 | −15.693 | −42.486 | 42.332 | 1.00 | 29.40 | D000 C |
| ATOM | 3660 | C | HIS | C | 188 | −15.569 | −40.982 | 42.157 | 1.00 | 28.01 | D000 C |
| ATOM | 3661 | O | HIS | C | 188 | −16.263 | −40.391 | 41.329 | 1.00 | 26.39 | D000 O |
| ATOM | 3662 | CB | HIS | C | 188 | −14.556 | −43.211 | 41.618 | 1.00 | 23.87 | D000 C |
| ATOM | 3663 | CG | HIS | C | 188 | −14.541 | −43.002 | 40.137 | 1.00 | 35.80 | D000 C |
| ATOM | 3664 | CD2 | HIS | C | 188 | −14.996 | −43.776 | 39.123 | 1.00 | 32.29 | D000 C |
| ATOM | 3665 | ND1 | HIS | C | 188 | −14.009 | −41.874 | 39.548 | 1.00 | 32.82 | D000 N |
| ATOM | 3666 | CE1 | HIS | C | 188 | −14.134 | −41.964 | 38.236 | 1.00 | 33.00 | D000 C |
| ATOM | 3667 | NE2 | HIS | C | 188 | −14.729 | −43.109 | 37.951 | 1.00 | 33.93 | D000 N |
| ATOM | 3668 | N | LEU | C | 189 | −14.708 | −40.364 | 42.958 | 1.00 | 26.16 | D000 N |
| ATOM | 3669 | CA | LEU | C | 189 | −14.400 | −38.950 | 42.784 | 1.00 | 28.90 | D000 C |
| ATOM | 3670 | C | LEU | C | 189 | −13.909 | −38.716 | 41.362 | 1.00 | 29.00 | D000 C |
| ATOM | 3671 | O | LEU | C | 189 | −13.176 | −39.541 | 40.805 | 1.00 | 27.16 | D000 O |
| ATOM | 3672 | CB | LEU | C | 189 | −13.356 | −38.488 | 43.796 | 1.00 | 26.67 | D000 C |
| ATOM | 3673 | CG | LEU | C | 189 | −13.882 | −38.242 | 45.208 | 1.00 | 33.12 | D000 C |
| ATOM | 3674 | CD1 | LEU | C | 189 | −12.735 | −37.973 | 46.169 | 1.00 | 33.71 | D000 C |
| ATOM | 3675 | CD2 | LEU | C | 189 | −14.857 | −37.076 | 45.186 | 1.00 | 27.90 | D000 C |
| ATOM | 3676 | N | VAL | C | 190 | −14.320 | −37.592 | 40.786 | 1.00 | 27.74 | D000 N |
| ATOM | 3677 | CA | VAL | C | 190 | −14.117 | −37.333 | 39.365 | 1.00 | 27.15 | D000 C |
| ATOM | 3678 | C | VAL | C | 190 | −12.644 | −37.428 | 38.968 | 1.00 | 29.08 | D000 C |
| ATOM | 3679 | O | VAL | C | 190 | −11.743 | −36.982 | 39.690 | 1.00 | 26.29 | D000 O |
| ATOM | 3680 | CB | VAL | C | 190 | −14.699 | −35.946 | 38.957 | 1.00 | 29.42 | D000 C |
| ATOM | 3681 | CG1 | VAL | C | 190 | −13.956 | −34.796 | 39.654 | 1.00 | 25.30 | D000 C |
| ATOM | 3682 | CG2 | VAL | C | 190 | −14.705 | −35.779 | 37.434 | 1.00 | 23.06 | D000 C |
| ATOM | 3683 | N | VAL | C | 191 | −12.420 | −38.079 | 37.834 | 1.00 | 26.83 | D000 N |
| ATOM | 3684 | CA | VAL | C | 191 | −11.106 | −38.192 | 37.221 | 1.00 | 30.57 | D000 C |
| ATOM | 3685 | C | VAL | C | 191 | −11.136 | −37.388 | 35.927 | 1.00 | 28.23 | D000 C |
| ATOM | 3686 | O | VAL | C | 191 | −12.017 | −37.590 | 35.096 | 1.00 | 26.03 | D000 O |
| ATOM | 3687 | CB | VAL | C | 191 | −10.739 | −39.664 | 36.942 | 1.00 | 28.44 | D000 C |
| ATOM | 3688 | CG1 | VAL | C | 191 | −9.433 | −39.763 | 36.170 | 1.00 | 25.60 | D000 C |
| ATOM | 3689 | CG2 | VAL | C | 191 | −10.663 | −40.445 | 38.256 | 1.00 | 26.79 | D000 C |
| ATOM | 3690 | N | VAL | C | 192 | −10.200 | −36.457 | 35.770 | 1.00 | 28.93 | D000 N |
| ATOM | 3691 | CA | VAL | C | 192 | −10.224 | −35.550 | 34.629 | 1.00 | 27.42 | D000 C |
| ATOM | 3692 | C | VAL | C | 192 | −9.181 | −35.963 | 33.602 | 1.00 | 31.88 | D000 C |
| ATOM | 3693 | O | VAL | C | 192 | −7.984 | −35.957 | 33.888 | 1.00 | 27.55 | D000 O |
| ATOM | 3694 | CB | VAL | C | 192 | −9.979 | −34.094 | 35.061 | 1.00 | 23.02 | D000 C |
| ATOM | 3695 | CG1 | VAL | C | 192 | −10.008 | −33.170 | 33.851 | 1.00 | 23.08 | D000 C |
| ATOM | 3696 | CG2 | VAL | C | 192 | −11.017 | −33.670 | 36.085 | 1.00 | 21.27 | D000 C |
| ATOM | 3697 | N | THR | C | 193 | −9.637 | −36.314 | 32.403 | 1.00 | 25.64 | D000 N |
| ATOM | 3698 | CA | THR | C | 193 | −8.751 | −36.918 | 31.415 | 1.00 | 32.64 | D000 C |
| ATOM | 3699 | C | THR | C | 193 | −8.608 | −36.120 | 30.125 | 1.00 | 31.08 | D000 C |
| ATOM | 3700 | O | THR | C | 193 | −7.920 | −36.558 | 29.206 | 1.00 | 30.10 | D000 O |
| ATOM | 3701 | CB | THR | C | 193 | −9.223 | −38.333 | 31.040 | 1.00 | 33.34 | D000 C |
| ATOM | 3702 | CG2 | THR | C | 193 | −9.327 | −39.208 | 32.285 | 1.00 | 32.24 | D000 C |
| ATOM | 3703 | OG1 | THR | C | 193 | −10.501 | −38.252 | 30.398 | 1.00 | 34.27 | D000 O |
| ATOM | 3704 | N | SER | C | 194 | −9.247 | −34.958 | 30.049 | 1.00 | 29.11 | D000 N |
| ATOM | 3705 | CA | SER | C | 194 | −9.115 | −34.111 | 28.866 | 1.00 | 29.77 | D000 C |
| ATOM | 3706 | C | SER | C | 194 | −9.525 | −32.671 | 29.159 | 1.00 | 29.25 | D000 C |
| ATOM | 3707 | O | SER | C | 194 | −10.227 | −32.400 | 30.137 | 1.00 | 23.94 | D000 O |
| ATOM | 3708 | CB | SER | C | 194 | −9.956 | −34.663 | 27.708 | 1.00 | 25.83 | D000 C |
| ATOM | 3709 | OG | SER | C | 194 | −11.335 | −34.423 | 27.935 | 1.00 | 28.83 | D000 O |
| ATOM | 3710 | N | TRP | C | 195 | −9.080 | −31.753 | 28.305 | 1.00 | 28.44 | D000 N |
| ATOM | 3711 | CA | TRP | C | 195 | −9.456 | −30.343 | 28.409 | 1.00 | 29.60 | D000 C |
| ATOM | 3712 | C | TRP | C | 195 | −10.972 | −30.177 | 28.304 | 1.00 | 25.02 | D000 C |
| ATOM | 3713 | O | TRP | C | 195 | −11.553 | −29.331 | 28.974 | 1.00 | 29.97 | D000 O |
| ATOM | 3714 | CB | TRP | C | 195 | −8.737 | −29.531 | 27.323 | 1.00 | 26.47 | D000 C |
| ATOM | 3715 | CG | TRP | C | 195 | −9.010 | −28.039 | 27.283 | 1.00 | 32.42 | D000 C |
| ATOM | 3716 | CD1 | TRP | C | 195 | −9.356 | −27.306 | 26.181 | 1.00 | 34.68 | D000 C |
| ATOM | 3717 | CD2 | TRP | C | 195 | −8.932 | −27.101 | 28.375 | 1.00 | 30.83 | D000 C |
| ATOM | 3718 | CE2 | TRP | C | 195 | −9.245 | −25.827 | 27.853 | 1.00 | 34.03 | D000 C |
| ATOM | 3719 | CE3 | TRP | C | 195 | −8.631 | −27.215 | 29.736 | 1.00 | 30.71 | D000 C |
| ATOM | 3720 | NE1 | TRP | C | 195 | −9.498 | −25.981 | 26.515 | 1.00 | 32.39 | D000 N |
| ATOM | 3721 | CZ2 | TRP | C | 195 | −9.271 | −24.678 | 28.645 | 1.00 | 31.06 | D000 C |
| ATOM | 3722 | CZ3 | TRP | C | 195 | −8.655 | −26.071 | 30.523 | 1.00 | 32.95 | D000 C |
| ATOM | 3723 | CH2 | TRP | C | 195 | −8.969 | −24.820 | 29.974 | 1.00 | 30.07 | D000 C |
| ATOM | 3724 | N | GLU | C | 196 | −11.607 | −30.999 | 27.471 | 1.00 | 26.97 | D000 N |
| ATOM | 3725 | CA | GLU | C | 196 | −13.060 | −30.960 | 27.306 | 1.00 | 30.42 | D000 C |
| ATOM | 3726 | C | GLU | C | 196 | −13.794 | −31.365 | 28.580 | 1.00 | 34.02 | D000 C |
| ATOM | 3727 | O | GLU | C | 196 | −14.802 | −30.757 | 28.943 | 1.00 | 28.31 | D000 O |
| ATOM | 3728 | CB | GLU | C | 196 | −13.505 | −31.871 | 26.158 | 1.00 | 30.46 | D000 C |
| ATOM | 3729 | CG | GLU | C | 196 | −13.221 | −31.329 | 24.769 | 1.00 | 41.10 | D000 C |
| ATOM | 3730 | CD | GLU | C | 196 | −11.772 | −31.498 | 24.353 | 1.00 | 46.52 | D000 C |
| ATOM | 3731 | OE1 | GLU | C | 196 | −11.002 | −32.155 | 25.092 | 1.00 | 42.32 | D000 O |

TABLE 10.2-continued

| | | | | | | | | | | |
|---|---|---|---|---|---|---|---|---|---|---|
| ATOM | 3732 | OE2 | GLU | C | 196 | −11.406 | −30.973 | 23.281 | 1.00 | 46.49 | D000 | O |
| ATOM | 3733 | N | GLU | C | 197 | −13.297 | −32.404 | 29.245 | 1.00 | 29.50 | D000 | N |
| ATOM | 3734 | CA | GLU | C | 197 | −13.899 | −32.854 | 30.489 | 1.00 | 26.78 | D000 | C |
| ATOM | 3735 | C | GLU | C | 197 | −13.708 | −31.790 | 31.574 | 1.00 | 26.09 | D000 | C |
| ATOM | 3736 | O | GLU | C | 197 | −14.631 | −31.493 | 32.329 | 1.00 | 27.28 | D000 | O |
| ATOM | 3737 | CB | GLU | C | 197 | −13.305 | −34.198 | 30.930 | 1.00 | 26.61 | D000 | C |
| ATOM | 3738 | CG | GLU | C | 197 | −14.055 | −34.841 | 32.100 | 1.00 | 27.35 | D000 | C |
| ATOM | 3739 | CD | GLU | C | 197 | −13.518 | −36.215 | 32.488 | 1.00 | 37.87 | D000 | C |
| ATOM | 3740 | OE1 | GLU | C | 197 | −12.434 | −36.602 | 32.003 | 1.00 | 33.97 | D000 | O |
| ATOM | 3741 | OE2 | GLU | C | 197 | −14.187 | −36.910 | 33.285 | 1.00 | 39.22 | D000 | O |
| ATOM | 3742 | N | GLN | C | 198 | −12.514 | −31.205 | 31.629 | 1.00 | 25.72 | D000 | N |
| ATOM | 3743 | CA | GLN | C | 198 | −12.214 | −30.140 | 32.588 | 1.00 | 25.80 | D000 | C |
| ATOM | 3744 | C | GLN | C | 198 | −13.189 | −28.975 | 32.463 | 1.00 | 29.00 | D000 | C |
| ATOM | 3745 | O | GLN | C | 198 | −13.685 | −28.458 | 33.464 | 1.00 | 24.52 | D000 | O |
| ATOM | 3746 | CB | GLN | C | 198 | −10.783 | −29.632 | 32.394 | 1.00 | 23.78 | D000 | C |
| ATOM | 3747 | CG | GLN | C | 198 | −10.506 | −28.288 | 33.045 | 1.00 | 25.75 | D000 | C |
| ATOM | 3748 | CD | GLN | C | 198 | −10.246 | −28.397 | 34.537 | 1.00 | 33.71 | D000 | C |
| ATOM | 3749 | NE2 | GLN | C | 198 | −10.599 | −27.350 | 35.279 | 1.00 | 25.10 | D000 | N |
| ATOM | 3750 | OE1 | GLN | C | 198 | −9.734 | −29.410 | 35.017 | 1.00 | 28.06 | D000 | O |
| ATOM | 3751 | N | LYS | C | 199 | −13.466 | −28.574 | 31.226 | 1.00 | 30.60 | D000 | N |
| ATOM | 3752 | CA | LYS | C | 199 | −14.326 | −27.424 | 30.974 | 1.00 | 34.08 | D000 | C |
| ATOM | 3753 | C | LYS | C | 199 | −15.770 | −27.743 | 31.319 | 1.00 | 28.60 | D000 | C |
| ATOM | 3754 | O | LYS | C | 199 | −16.489 | −26.895 | 31.848 | 1.00 | 25.57 | D000 | O |
| ATOM | 3755 | CB | LYS | C | 199 | −14.212 | −26.978 | 29.517 | 1.00 | 28.25 | D000 | C |
| ATOM | 3756 | CG | LYS | C | 199 | −12.855 | −26.386 | 29.183 | 1.00 | 34.79 | D000 | C |
| ATOM | 3757 | CD | LYS | C | 199 | −12.532 | −26.545 | 27.711 | 1.00 | 43.54 | D000 | C |
| ATOM | 3758 | CE | LYS | C | 199 | −13.150 | −25.447 | 26.892 | 1.00 | 38.89 | D000 | C |
| ATOM | 3759 | NZ | LYS | C | 199 | −12.740 | −25.539 | 25.453 | 1.00 | 35.02 | D000 | N |
| ATOM | 3760 | N | PHE | C | 200 | −16.188 | −28.968 | 31.013 | 1.00 | 29.54 | D000 | N |
| ATOM | 3761 | CA | PHE | C | 200 | −17.515 | −29.436 | 31.393 | 1.00 | 30.79 | D000 | C |
| ATOM | 3762 | C | PHE | C | 200 | −17.682 | −29.381 | 32.909 | 1.00 | 25.62 | D000 | C |
| ATOM | 3763 | O | PHE | C | 200 | −18.651 | −28.807 | 33.414 | 1.00 | 25.66 | D000 | O |
| ATOM | 3764 | CB | PHE | C | 200 | −17.762 | −30.861 | 30.891 | 1.00 | 27.79 | D000 | C |
| ATOM | 3765 | CG | PHE | C | 200 | −18.939 | −31.530 | 31.541 | 1.00 | 33.05 | D000 | C |
| ATOM | 3766 | CD1 | PHE | C | 200 | −20.230 | −31.216 | 31.154 | 1.00 | 29.57 | D000 | C |
| ATOM | 3767 | CD2 | PHE | C | 200 | −18.754 | −32.467 | 32.547 | 1.00 | 33.93 | D000 | C |
| ATOM | 3768 | CE1 | PHE | C | 200 | −21.315 | −31.826 | 31.753 | 1.00 | 31.19 | D000 | C |
| ATOM | 3769 | CE2 | PHE | C | 200 | −19.837 | −33.077 | 33.154 | 1.00 | 30.44 | D000 | C |
| ATOM | 3770 | CZ | PHE | C | 200 | −21.118 | −32.756 | 32.755 | 1.00 | 33.80 | D000 | C |
| ATOM | 3771 | N | VAL | C | 201 | −16.730 | −29.971 | 33.627 | 1.00 | 27.40 | D000 | N |
| ATOM | 3772 | CA | VAL | C | 201 | −16.756 | −29.964 | 35.088 | 1.00 | 26.65 | D000 | C |
| ATOM | 3773 | C | VAL | C | 201 | −16.750 | −28.533 | 35.609 | 1.00 | 33.34 | D000 | C |
| ATOM | 3774 | O | VAL | C | 201 | −17.593 | −28.149 | 36.428 | 1.00 | 25.82 | D000 | O |
| ATOM | 3775 | CB | VAL | C | 201 | −15.557 | −30.727 | 35.679 | 1.00 | 30.52 | D000 | C |
| ATOM | 3776 | CG1 | VAL | C | 201 | −15.448 | −30.466 | 37.173 | 1.00 | 27.81 | D000 | C |
| ATOM | 3777 | CG2 | VAL | C | 201 | −15.677 | −32.219 | 35.392 | 1.00 | 24.80 | D000 | C |
| ATOM | 3778 | N | GLN | C | 202 | −15.804 | −27.748 | 35.098 | 1.00 | 28.75 | D000 | N |
| ATOM | 3779 | CA | GLN | C | 202 | −15.629 | −26.353 | 35.482 | 1.00 | 28.03 | D000 | C |
| ATOM | 3780 | C | GLN | C | 202 | −16.905 | −25.544 | 35.295 | 1.00 | 26.50 | D000 | C |
| ATOM | 3781 | O | GLN | C | 202 | −17.221 | −24.662 | 36.097 | 1.00 | 30.81 | D000 | O |
| ATOM | 3782 | CB | GLN | C | 202 | −14.495 | −25.736 | 34.663 | 1.00 | 28.31 | D000 | C |
| ATOM | 3783 | CG | GLN | C | 202 | −13.779 | −24.603 | 35.333 | 1.00 | 34.63 | D000 | C |
| ATOM | 3784 | CD | GLN | C | 202 | −12.592 | −24.127 | 34.524 | 1.00 | 36.40 | D000 | C |
| ATOM | 3785 | NE2 | GLN | C | 202 | −12.382 | −22.815 | 34.494 | 1.00 | 34.64 | D000 | N |
| ATOM | 3786 | OE1 | GLN | C | 202 | −11.874 | −24.931 | 33.924 | 1.00 | 33.68 | D000 | O |
| ATOM | 3787 | N | HIS | C | 203 | −17.640 | −25.848 | 34.232 | 1.00 | 28.19 | D000 | N |
| ATOM | 3788 | CA | HIS | C | 203 | −18.895 | −25.158 | 33.971 | 1.00 | 28.76 | D000 | C |
| ATOM | 3789 | C | HIS | C | 203 | −19.921 | −25.389 | 35.081 | 1.00 | 37.82 | D000 | C |
| ATOM | 3790 | O | HIS | C | 203 | −20.664 | −24.477 | 35.450 | 1.00 | 30.91 | D000 | O |
| ATOM | 3791 | CB | HIS | C | 203 | −19.490 | −25.597 | 32.633 | 1.00 | 27.45 | D000 | C |
| ATOM | 3792 | CG | HIS | C | 203 | −20.836 | −25.002 | 32.361 | 1.00 | 35.85 | D000 | C |
| ATOM | 3793 | CD2 | HIS | C | 203 | −21.189 | −23.825 | 31.791 | 1.00 | 40.47 | D000 | C |
| ATOM | 3794 | ND1 | HIS | C | 203 | −22.010 | −25.619 | 32.728 | 1.00 | 42.36 | D000 | N |
| ATOM | 3795 | CE1 | HIS | C | 203 | −23.035 | −24.857 | 32.380 | 1.00 | 38.39 | D000 | C |
| ATOM | 3796 | NE2 | HIS | C | 203 | −22.561 | −23.764 | 31.810 | 1.00 | 42.37 | D000 | N |
| ATOM | 3797 | N | HIS | C | 204 | −19.970 | −26.608 | 35.612 | 1.00 | 31.47 | D000 | N |
| ATOM | 3798 | CA | HIS | C | 204 | −20.992 | −26.941 | 36.602 | 1.00 | 30.96 | D000 | C |
| ATOM | 3799 | C | HIS | C | 204 | −20.619 | −26.543 | 38.023 | 1.00 | 29.48 | D000 | C |
| ATOM | 3800 | O | HIS | C | 204 | −21.489 | −26.143 | 38.796 | 1.00 | 28.82 | D000 | O |
| ATOM | 3801 | CB | HIS | C | 204 | −21.317 | −28.434 | 36.545 | 1.00 | 30.72 | D000 | C |
| ATOM | 3802 | CG | HIS | C | 204 | −22.172 | −28.808 | 35.376 | 1.00 | 31.65 | D000 | C |
| ATOM | 3803 | CD2 | HIS | C | 204 | −21.889 | −29.495 | 34.244 | 1.00 | 34.41 | D000 | C |
| ATOM | 3804 | ND1 | HIS | C | 204 | −23.494 | −28.433 | 35.274 | 1.00 | 39.82 | D000 | N |
| ATOM | 3805 | CE1 | HIS | C | 204 | −23.993 | −28.884 | 34.138 | 1.00 | 35.14 | D000 | C |
| ATOM | 3806 | NE2 | HIS | C | 204 | −23.038 | −29.531 | 33.493 | 1.00 | 39.82 | D000 | N |
| ATOM | 3807 | N | ILE | C | 205 | −19.340 | −26.628 | 38.375 | 1.00 | 26.45 | D000 | N |
| ATOM | 3808 | CA | ILE | C | 205 | −18.942 | −26.275 | 39.735 | 1.00 | 32.57 | D000 | C |
| ATOM | 3809 | C | ILE | C | 205 | −18.811 | −24.758 | 39.911 | 1.00 | 29.31 | D000 | C |
| ATOM | 3810 | O | ILE | C | 205 | −18.976 | −24.244 | 41.015 | 1.00 | 30.32 | D000 | O |
| ATOM | 3811 | CB | ILE | C | 205 | −17.613 | −26.955 | 40.152 | 1.00 | 31.86 | D000 | C |

TABLE 10.2-continued

| | | | | | | | | | | | |
|---|---|---|---|---|---|---|---|---|---|---|---|
| ATOM | 3812 | CG1 | ILE | C | 205 | −16.437 | −26.421 | 39.339 | 1.00 | 31.34 | D000 C |
| ATOM | 3813 | CG2 | ILE | C | 205 | −17.710 | −28.477 | 40.014 | 1.00 | 29.23 | D000 C |
| ATOM | 3814 | CD1 | ILE | C | 205 | −15.107 | −26.968 | 39.802 | 1.00 | 32.36 | D000 C |
| ATOM | 3815 | N | GLY | C | 206 | −18.540 | −24.043 | 38.825 | 1.00 | 24.89 | D000 N |
| ATOM | 3816 | CA | GLY | C | 206 | −18.307 | −22.613 | 38.912 | 1.00 | 26.12 | D000 C |
| ATOM | 3817 | C | GLY | C | 206 | −17.033 | −22.318 | 39.688 | 1.00 | 33.16 | D000 C |
| ATOM | 3818 | O | GLY | C | 206 | −16.182 | −23.197 | 39.845 | 1.00 | 27.62 | D000 O |
| ATOM | 3819 | N | PRO | C | 207 | −16.895 | −21.081 | 40.189 | 1.00 | 27.47 | D000 N |
| ATOM | 3820 | CA | PRO | C | 207 | −15.679 | −20.657 | 40.895 | 1.00 | 28.28 | D000 C |
| ATOM | 3821 | C | PRO | C | 207 | −15.651 | −21.107 | 42.360 | 1.00 | 33.47 | D000 C |
| ATOM | 3822 | O | PRO | C | 207 | −15.598 | −20.266 | 43.255 | 1.00 | 30.13 | D000 O |
| ATOM | 3823 | CB | PRO | C | 207 | −15.741 | −19.130 | 40.792 | 1.00 | 27.65 | D000 C |
| ATOM | 3824 | CG | PRO | C | 207 | −17.204 | −18.830 | 40.787 | 1.00 | 30.21 | D000 C |
| ATOM | 3825 | CD | PRO | C | 207 | −17.873 | −19.984 | 40.065 | 1.00 | 29.69 | D000 C |
| ATOM | 3826 | N | VAL | C | 208 | −15.674 | −22.417 | 42.594 | 1.00 | 36.48 | D000 N |
| ATOM | 3827 | CA | VAL | C | 208 | −15.803 | −22.969 | 43.944 | 1.00 | 29.83 | D000 C |
| ATOM | 3828 | C | VAL | C | 208 | −14.809 | −24.105 | 44.182 | 1.00 | 33.04 | D000 C |
| ATOM | 3829 | O | VAL | C | 208 | −14.697 | −25.001 | 43.351 | 1.00 | 26.89 | D000 O |
| ATOM | 3830 | CB | VAL | C | 208 | −17.233 | −23.504 | 44.191 | 1.00 | 35.14 | D000 C |
| ATOM | 3831 | CG1 | VAL | C | 208 | −17.349 | −24.108 | 45.585 | 1.00 | 33.92 | D000 C |
| ATOM | 3832 | CG2 | VAL | C | 208 | −18.271 | −22.402 | 43.981 | 1.00 | 32.86 | D000 C |
| ATOM | 3833 | N | ASN | C | 209 | −14.092 | −24.071 | 45.306 | 1.00 | 30.99 | D000 N |
| ATOM | 3834 | CA | ASN | C | 209 | −13.164 | −25.153 | 45.649 | 1.00 | 31.35 | D000 C |
| ATOM | 3835 | C | ASN | C | 209 | −13.881 | −26.500 | 45.682 | 1.00 | 32.29 | D000 C |
| ATOM | 3836 | O | ASN | C | 209 | −14.881 | −26.666 | 46.379 | 1.00 | 29.08 | D000 O |
| ATOM | 3837 | CB | ASN | C | 209 | −12.486 | −24.895 | 46.994 | 1.00 | 25.98 | D000 C |
| ATOM | 3838 | CG | ASN | C | 209 | −11.461 | −23.781 | 46.931 | 1.00 | 30.97 | D000 C |
| ATOM | 3839 | ND2 | ASN | C | 209 | −11.376 | −22.997 | 48.000 | 1.00 | 35.10 | D000 N |
| ATOM | 3840 | OD1 | ASN | C | 209 | −10.750 | −23.626 | 45.938 | 1.00 | 30.97 | D000 O |
| ATOM | 3841 | N | THR | C | 210 | −13.363 | −27.457 | 44.919 | 1.00 | 30.16 | D000 N |
| ATOM | 3842 | CA | THR | C | 210 | −14.049 | −28.725 | 44.705 | 1.00 | 26.80 | D000 C |
| ATOM | 3843 | C | THR | C | 210 | −13.049 | −29.865 | 44.549 | 1.00 | 26.68 | D000 C |
| ATOM | 3844 | O | THR | C | 210 | −12.182 | −29.822 | 43.673 | 1.00 | 30.56 | D000 O |
| ATOM | 3845 | CB | THR | C | 210 | −14.949 | −28.655 | 43.456 | 1.00 | 29.42 | D000 C |
| ATOM | 3846 | CG2 | THR | C | 210 | −15.785 | −29.916 | 43.312 | 1.00 | 22.22 | D000 C |
| ATOM | 3847 | OG1 | THR | C | 210 | −15.813 | −27.515 | 43.556 | 1.00 | 26.16 | D000 O |
| ATOM | 3848 | N | TRP | C | 211 | −13.165 | −30.872 | 45.410 | 1.00 | 25.09 | D000 N |
| ATOM | 3849 | CA | TRP | C | 211 | −12.294 | −32.041 | 45.357 | 1.00 | 30.07 | D000 C |
| ATOM | 3850 | C | TRP | C | 211 | −12.423 | −32.796 | 44.038 | 1.00 | 36.81 | D000 C |
| ATOM | 3851 | O | TRP | C | 211 | −13.510 | −32.874 | 43.456 | 1.00 | 27.60 | D000 O |
| ATOM | 3852 | CB | TRP | C | 211 | −12.605 | −33.013 | 46.501 | 1.00 | 27.04 | D000 C |
| ATOM | 3853 | CG | TRP | C | 211 | −12.261 | −32.549 | 47.900 | 1.00 | 28.12 | D000 C |
| ATOM | 3854 | CD1 | TRP | C | 211 | −13.097 | −32.529 | 48.983 | 1.00 | 28.01 | D000 C |
| ATOM | 3855 | CD2 | TRP | C | 211 | −10.991 | −32.072 | 48.366 | 1.00 | 26.23 | D000 C |
| ATOM | 3856 | CE2 | TRP | C | 211 | −11.136 | −31.771 | 49.739 | 1.00 | 31.66 | D000 C |
| ATOM | 3857 | CE3 | TRP | C | 211 | −9.751 | −31.857 | 47.756 | 1.00 | 23.53 | D000 C |
| ATOM | 3858 | NE1 | TRP | C | 211 | −12.428 | −32.060 | 50.091 | 1.00 | 29.06 | D000 N |
| ATOM | 3859 | CZ2 | TRP | C | 211 | −10.084 | −31.274 | 50.509 | 1.00 | 31.81 | D000 C |
| ATOM | 3860 | CZ3 | TRP | C | 211 | −8.709 | −31.361 | 48.522 | 1.00 | 26.50 | D000 C |
| ATOM | 3861 | CH2 | TRP | C | 211 | −8.881 | −31.078 | 49.885 | 1.00 | 32.71 | D000 C |
| ATOM | 3862 | N | MET | C | 212 | −11.310 | −33.363 | 43.585 | 1.00 | 29.78 | D000 N |
| ATOM | 3863 | CA | MET | C | 212 | −11.327 | −34.332 | 42.500 | 1.00 | 26.98 | D000 C |
| ATOM | 3864 | C | MET | C | 212 | −10.681 | −35.620 | 43.009 | 1.00 | 30.71 | D000 C |
| ATOM | 3865 | O | MET | C | 212 | −10.179 | −35.655 | 44.134 | 1.00 | 26.90 | D000 O |
| ATOM | 3866 | CB | MET | C | 212 | −10.598 | −33.793 | 41.266 | 1.00 | 28.53 | D000 C |
| ATOM | 3867 | CG | MET | C | 212 | −9.082 | −33.872 | 41.344 | 1.00 | 27.04 | D000 C |
| ATOM | 3868 | SD | MET | C | 212 | −8.287 | −32.882 | 40.061 | 1.00 | 30.51 | D000 S |
| ATOM | 3869 | CE | MET | C | 212 | −8.761 | −31.231 | 40.597 | 1.00 | 22.33 | D000 C |
| ATOM | 3870 | N | GLY | C | 213 | −10.693 | −36.673 | 42.195 | 1.00 | 23.24 | D000 N |
| ATOM | 3871 | CA | GLY | C | 213 | −10.149 | −37.955 | 42.612 | 1.00 | 21.72 | D000 C |
| ATOM | 3872 | C | GLY | C | 213 | −8.655 | −38.108 | 42.405 | 1.00 | 27.75 | D000 C |
| ATOM | 3873 | O | GLY | C | 213 | −8.199 | −39.106 | 41.851 | 1.00 | 28.41 | D000 O |
| ATOM | 3874 | N | LEU | C | 214 | −7.891 | −37.124 | 42.870 | 1.00 | 25.92 | D000 N |
| ATOM | 3875 | CA | LEU | C | 214 | −6.443 | −37.109 | 42.691 | 1.00 | 26.73 | D000 C |
| ATOM | 3876 | C | LEU | C | 214 | −5.755 | −36.799 | 44.018 | 1.00 | 25.75 | D000 C |
| ATOM | 3877 | O | LEU | C | 214 | −6.073 | −35.802 | 44.659 | 1.00 | 25.95 | D000 O |
| ATOM | 3878 | CB | LEU | C | 214 | −6.049 | −36.076 | 41.629 | 1.00 | 24.90 | D000 C |
| ATOM | 3879 | CG | LEU | C | 214 | −4.566 | −35.777 | 41.383 | 1.00 | 25.82 | D000 C |
| ATOM | 3880 | CD1 | LEU | C | 214 | −3.840 | −37.006 | 40.861 | 1.00 | 22.24 | D000 C |
| ATOM | 3881 | CD2 | LEU | C | 214 | −4.428 | −34.615 | 40.402 | 1.00 | 20.00 | D000 C |
| ATOM | 3882 | N | HIS | C | 215 | −4.819 | −37.653 | 44.426 | 1.00 | 28.82 | D000 N |
| ATOM | 3883 | CA | HIS | C | 215 | −4.139 | −37.488 | 45.709 | 1.00 | 25.47 | D000 C |
| ATOM | 3884 | C | HIS | C | 215 | −2.797 | −38.207 | 45.727 | 1.00 | 27.39 | D000 C |
| ATOM | 3885 | O | HIS | C | 215 | −2.570 | −39.123 | 44.938 | 1.00 | 28.76 | D000 O |
| ATOM | 3886 | CB | HIS | C | 215 | −5.011 | −38.011 | 46.850 | 1.00 | 25.17 | D000 C |
| ATOM | 3887 | CG | HIS | C | 215 | −5.082 | −39.505 | 46.915 | 1.00 | 33.85 | D000 C |
| ATOM | 3888 | CD2 | HIS | C | 215 | −5.484 | −40.419 | 45.999 | 1.00 | 36.27 | D000 C |
| ATOM | 3889 | ND1 | HIS | C | 215 | −4.705 | −40.221 | 48.030 | 1.00 | 43.52 | D000 N |
| ATOM | 3890 | CE1 | HIS | C | 215 | −4.874 | −41.511 | 47.800 | 1.00 | 45.66 | D000 C |
| ATOM | 3891 | NE2 | HIS | C | 215 | −5.347 | −41.657 | 46.575 | 1.00 | 38.89 | D000 N |

TABLE 10.2-continued

| | | | | | | | | | | |
|---|---|---|---|---|---|---|---|---|---|---|
| ATOM | 3892 | N | ASP | C | 216 | −1.908 | −37.803 | 46.632 | 1.00 | 31.91 | D000 N |
| ATOM | 3893 | CA | ASP | C | 216 | −0.623 | −38.485 | 46.760 | 1.00 | 28.17 | D000 C |
| ATOM | 3894 | C | ASP | C | 216 | −0.369 | −38.944 | 48.199 | 1.00 | 35.16 | D000 C |
| ATOM | 3895 | O | ASP | C | 216 | 0.764 | −38.955 | 48.668 | 1.00 | 31.36 | D000 O |
| ATOM | 3896 | CB | ASP | C | 216 | 0.518 | −37.585 | 46.258 | 1.00 | 28.42 | D000 C |
| ATOM | 3897 | CG | ASP | C | 216 | 0.795 | −36.394 | 47.171 | 1.00 | 35.01 | D000 C |
| ATOM | 3898 | OD1 | ASP | C | 216 | 0.013 | −36.142 | 48.110 | 1.00 | 28.86 | D000 O |
| ATOM | 3899 | OD2 | ASP | C | 216 | 1.805 | −35.695 | 46.936 | 1.00 | 31.47 | D000 O |
| ATOM | 3900 | N | GLN | C | 217 | −1.432 | −39.332 | 48.894 | 1.00 | 31.06 | D000 N |
| ATOM | 3901 | CA | GLN | C | 217 | −1.305 | −39.781 | 50.278 | 1.00 | 41.47 | D000 C |
| ATOM | 3902 | C | GLN | C | 217 | −0.531 | −41.103 | 50.385 | 1.00 | 38.57 | D000 C |
| ATOM | 3903 | O | GLN | C | 217 | 0.157 | −41.346 | 51.374 | 1.00 | 44.82 | D000 O |
| ATOM | 3904 | CB | GLN | C | 217 | −2.688 | −39.926 | 50.918 | 1.00 | 37.52 | D000 C |
| ATOM | 3905 | CG | GLN | C | 217 | −3.504 | −38.644 | 50.919 | 1.00 | 33.20 | D000 C |
| ATOM | 3906 | CD | GLN | C | 217 | −4.837 | −38.799 | 51.626 | 1.00 | 39.32 | D000 C |
| ATOM | 3907 | NE2 | GLN | C | 217 | −5.810 | −39.389 | 50.941 | 1.00 | 31.27 | D000 N |
| ATOM | 3908 | OE1 | GLN | C | 217 | −4.989 | −38.391 | 52.775 | 1.00 | 48.65 | D000 O |
| ATOM | 3909 | N | ASN | C | 218 | −0.630 | −41.939 | 49.356 | 1.00 | 38.48 | D000 N |
| ATOM | 3910 | CA | ASN | C | 218 | 0.018 | −43.251 | 49.363 | 1.00 | 53.29 | D000 C |
| ATOM | 3911 | C | ASN | C | 218 | 1.205 | −43.357 | 48.405 | 1.00 | 47.43 | D000 C |
| ATOM | 3912 | O | ASN | C | 218 | 1.397 | −44.389 | 47.761 | 1.00 | 58.53 | D000 O |
| ATOM | 3913 | CB | ASN | C | 218 | −1.004 | −44.339 | 49.018 | 1.00 | 57.61 | D000 C |
| ATOM | 3914 | CG | ASN | C | 218 | −2.213 | −44.313 | 49.933 | 1.00 | 65.75 | D000 C |
| ATOM | 3915 | ND2 | ASN | C | 218 | −1.966 | −44.302 | 51.241 | 1.00 | 59.68 | D000 N |
| ATOM | 3916 | OD1 | ASN | C | 218 | −3.356 | −44.293 | 49.471 | 1.00 | 59.70 | D000 O |
| ATOM | 3917 | N | GLY | C | 219 | 2.001 | −42.299 | 48.313 | 1.00 | 35.56 | D000 N |
| ATOM | 3918 | CA | GLY | C | 219 | 3.081 | −42.255 | 47.344 | 1.00 | 36.85 | D000 C |
| ATOM | 3919 | C | GLY | C | 219 | 2.873 | −41.128 | 46.353 | 1.00 | 34.18 | D000 C |
| ATOM | 3920 | O | GLY | C | 219 | 2.347 | −40.080 | 46.716 | 1.00 | 32.25 | D000 O |
| ATOM | 3921 | N | PRO | C | 220 | 3.284 | −41.332 | 45.092 | 1.00 | 35.79 | D000 N |
| ATOM | 3922 | CA | PRO | C | 220 | 3.144 | −40.284 | 44.072 | 1.00 | 33.07 | D000 C |
| ATOM | 3923 | C | PRO | C | 220 | 1.683 | −40.001 | 43.728 | 1.00 | 31.10 | D000 C |
| ATOM | 3924 | O | PRO | C | 220 | 0.801 | −40.767 | 44.117 | 1.00 | 29.49 | D000 O |
| ATOM | 3925 | CB | PRO | C | 220 | 3.897 | −40.859 | 42.867 | 1.00 | 37.25 | D000 C |
| ATOM | 3926 | CG | PRO | C | 220 | 3.868 | −42.336 | 43.073 | 1.00 | 41.99 | D000 C |
| ATOM | 3927 | CD | PRO | C | 220 | 3.925 | −42.547 | 44.558 | 1.00 | 34.70 | D000 C |
| ATOM | 3928 | N | TRP | C | 221 | 1.433 | −38.904 | 43.019 | 1.00 | 28.69 | D000 N |
| ATOM | 3929 | CA | TRP | C | 221 | 0.070 | −38.514 | 42.668 | 1.00 | 29.66 | D000 C |
| ATOM | 3930 | C | TRP | C | 221 | −0.626 | −39.607 | 41.857 | 1.00 | 29.27 | D000 C |
| ATOM | 3931 | O | TRP | C | 221 | −0.081 | −40.110 | 40.879 | 1.00 | 26.36 | D000 O |
| ATOM | 3932 | CB | TRP | C | 221 | 0.075 | −37.185 | 41.900 | 1.00 | 27.58 | D000 C |
| ATOM | 3933 | CG | TRP | C | 221 | 0.406 | −36.020 | 42.782 | 1.00 | 30.86 | D000 C |
| ATOM | 3934 | CD1 | TRP | C | 221 | 1.629 | −35.437 | 42.947 | 1.00 | 32.27 | D000 C |
| ATOM | 3935 | CD2 | TRP | C | 221 | −0.495 | −35.311 | 43.643 | 1.00 | 27.75 | D000 C |
| ATOM | 3936 | CE2 | TRP | C | 221 | 0.253 | −34.309 | 44.298 | 1.00 | 32.54 | D000 C |
| ATOM | 3937 | CE3 | TRP | C | 221 | −1.861 | −35.428 | 43.926 | 1.00 | 25.76 | D000 C |
| ATOM | 3938 | NE1 | TRP | C | 221 | 1.545 | −34.406 | 43.853 | 1.00 | 32.24 | D000 N |
| ATOM | 3939 | CZ2 | TRP | C | 221 | −0.320 | −33.425 | 45.219 | 1.00 | 27.09 | D000 C |
| ATOM | 3940 | CZ3 | TRP | C | 221 | −2.430 | −34.549 | 44.841 | 1.00 | 29.33 | D000 C |
| ATOM | 3941 | CH2 | TRP | C | 221 | −1.658 | −33.560 | 45.474 | 1.00 | 29.04 | D000 C |
| ATOM | 3942 | N | LYS | C | 222 | −1.826 | −39.981 | 42.289 | 1.00 | 30.12 | D000 N |
| ATOM | 3943 | CA | LYS | C | 222 | −2.585 | −41.046 | 41.643 | 1.00 | 30.34 | D000 C |
| ATOM | 3944 | C | LYS | C | 222 | −4.058 | −40.687 | 41.502 | 1.00 | 27.82 | D000 C |
| ATOM | 3945 | O | LYS | C | 222 | −4.627 | −40.026 | 42.370 | 1.00 | 29.51 | D000 O |
| ATOM | 3946 | CB | LYS | C | 222 | −2.453 | −42.351 | 42.436 | 1.00 | 35.42 | D000 C |
| ATOM | 3947 | CG | LYS | C | 222 | −1.072 | −42.983 | 42.388 | 1.00 | 42.04 | D000 C |
| ATOM | 3948 | CD | LYS | C | 222 | −0.966 | −44.138 | 43.373 | 1.00 | 62.76 | D000 C |
| ATOM | 3949 | CE | LYS | C | 222 | 0.452 | −44.687 | 43.443 | 1.00 | 66.16 | D000 C |
| ATOM | 3950 | NZ | LYS | C | 222 | 0.599 | −45.699 | 44.533 | 1.00 | 72.02 | D000 N |
| ATOM | 3951 | N | TRP | C | 223 | −4.670 | −41.121 | 40.406 | 1.00 | 29.14 | D000 N |
| ATOM | 3952 | CA | TRP | C | 223 | −6.119 | −41.022 | 40.249 | 1.00 | 31.28 | D000 C |
| ATOM | 3953 | C | TRP | C | 223 | −6.787 | −42.218 | 40.920 | 1.00 | 29.31 | D000 C |
| ATOM | 3954 | O | TRP | C | 223 | −6.254 | −43.321 | 40.883 | 1.00 | 30.17 | D000 O |
| ATOM | 3955 | CB | TRP | C | 223 | −6.512 | −40.959 | 38.774 | 1.00 | 23.94 | D000 C |
| ATOM | 3956 | CG | TRP | C | 223 | −6.104 | −39.694 | 38.085 | 1.00 | 27.95 | D000 C |
| ATOM | 3957 | CD1 | TRP | C | 223 | −5.059 | −39.530 | 37.226 | 1.00 | 23.23 | D000 C |
| ATOM | 3958 | CD2 | TRP | C | 223 | −6.742 | −38.414 | 38.191 | 1.00 | 24.93 | D000 C |
| ATOM | 3959 | CE2 | TRP | C | 223 | −6.026 | −37.523 | 37.365 | 1.00 | 23.92 | D000 C |
| ATOM | 3960 | CE3 | TRP | C | 223 | −7.851 | −37.938 | 38.901 | 1.00 | 23.92 | D000 C |
| ATOM | 3961 | NE1 | TRP | C | 223 | −5.002 | −38.228 | 36.790 | 1.00 | 25.78 | D000 N |
| ATOM | 3962 | CZ2 | TRP | C | 223 | −6.382 | −36.182 | 37.228 | 1.00 | 28.71 | D000 C |
| ATOM | 3963 | CZ3 | TRP | C | 223 | −8.201 | −36.603 | 38.771 | 1.00 | 28.69 | D000 C |
| ATOM | 3964 | CH2 | TRP | C | 223 | −7.468 | −35.740 | 37.941 | 1.00 | 27.80 | D000 C |
| ATOM | 3965 | N | VAL | C | 224 | −7.958 | −42.001 | 41.514 | 1.00 | 28.47 | D000 N |
| ATOM | 3966 | CA | VAL | C | 224 | −8.620 | −43.038 | 42.302 | 1.00 | 29.16 | D000 C |
| ATOM | 3967 | C | VAL | C | 224 | −9.055 | −44.259 | 41.486 | 1.00 | 31.96 | D000 C |
| ATOM | 3968 | O | VAL | C | 224 | −9.186 | −45.349 | 42.038 | 1.00 | 33.21 | D000 O |
| ATOM | 3969 | CB | VAL | C | 224 | −9.866 | −42.485 | 43.037 | 1.00 | 27.95 | D000 C |
| ATOM | 3970 | CG1 | VAL | C | 224 | −9.463 | −41.450 | 44.071 | 1.00 | 29.62 | D000 C |
| ATOM | 3971 | CG2 | VAL | C | 224 | −10.863 | −41.900 | 42.050 | 1.00 | 31.35 | D000 C |

TABLE 10.2-continued

| | | | | | | | | | | | |
|---|---|---|---|---|---|---|---|---|---|---|---|
| ATOM | 3972 | N | ASP | C | 225 | −9.272 | −44.083 | 40.184 | 1.00 | 30.51 | D000 N |
| ATOM | 3973 | CA | ASP | C | 225 | −9.755 | −45.182 | 39.347 | 1.00 | 33.42 | D000 C |
| ATOM | 3974 | C | ASP | C | 225 | −8.622 | −45.903 | 38.615 | 1.00 | 35.01 | D000 C |
| ATOM | 3975 | O | ASP | C | 225 | −8.866 | −46.705 | 37.717 | 1.00 | 45.07 | D000 O |
| ATOM | 3976 | CB | ASP | C | 225 | −10.798 | −44.673 | 38.337 | 1.00 | 34.24 | D000 C |
| ATOM | 3977 | CG | ASP | C | 225 | −10.187 | −43.849 | 37.205 | 1.00 | 39.60 | D000 C |
| ATOM | 3978 | OD1 | ASP | C | 225 | −9.032 | −43.379 | 37.334 | 1.00 | 35.30 | D000 O |
| ATOM | 3979 | OD2 | ASP | C | 225 | −10.878 | −43.658 | 36.179 | 1.00 | 41.15 | D000 O |
| ATOM | 3980 | N | GLY | C | 226 | −7.383 | −45.605 | 38.989 | 1.00 | 34.08 | D000 N |
| ATOM | 3981 | CA | GLY | C | 226 | −6.241 | −46.272 | 38.389 | 1.00 | 29.68 | D000 C |
| ATOM | 3982 | C | GLY | C | 226 | −5.723 | −45.631 | 37.115 | 1.00 | 34.65 | D000 C |
| ATOM | 3983 | O | GLY | C | 226 | −4.725 | −46.086 | 36.555 | 1.00 | 35.05 | D000 O |
| ATOM | 3984 | N | THR | C | 227 | −6.394 | −44.578 | 36.652 | 1.00 | 34.54 | D000 N |
| ATOM | 3985 | CA | THR | C | 227 | −5.926 | −43.829 | 35.486 | 1.00 | 32.36 | D000 C |
| ATOM | 3986 | C | THR | C | 227 | −4.500 | −43.333 | 35.721 | 1.00 | 35.82 | D000 C |
| ATOM | 3987 | O | THR | C | 227 | −4.196 | −42.779 | 36.779 | 1.00 | 36.25 | D000 O |
| ATOM | 3988 | CB | THR | C | 227 | −6.840 | −42.625 | 35.175 | 1.00 | 36.95 | D000 C |
| ATOM | 3989 | CG2 | THR | C | 227 | −6.315 | −41.834 | 33.980 | 1.00 | 37.07 | D000 C |
| ATOM | 3990 | OG1 | THR | C | 227 | −8.164 | −43.089 | 34.891 | 1.00 | 40.09 | D000 O |
| ATOM | 3991 | N | ASP | C | 228 | −3.625 | −43.540 | 34.743 | 1.00 | 35.21 | D000 N |
| ATOM | 3992 | CA | ASP | C | 228 | −2.227 | −43.165 | 34.900 | 1.00 | 35.66 | D000 C |
| ATOM | 3993 | C | ASP | C | 228 | −2.063 | −41.648 | 34.951 | 1.00 | 40.45 | D000 C |
| ATOM | 3994 | O | ASP | C | 228 | −2.550 | −40.926 | 34.080 | 1.00 | 33.72 | D000 O |
| ATOM | 3995 | CB | ASP | C | 228 | −1.378 | −43.748 | 33.773 | 1.00 | 36.06 | D000 C |
| ATOM | 3996 | CG | ASP | C | 228 | 0.098 | −43.451 | 33.953 | 1.00 | 42.86 | D000 C |
| ATOM | 3997 | OD1 | ASP | C | 228 | 0.720 | −44.052 | 34.855 | 1.00 | 52.83 | D000 O |
| ATOM | 3998 | OD2 | ASP | C | 228 | 0.636 | −42.613 | 33.199 | 1.00 | 43.62 | D000 O |
| ATOM | 3999 | N | TYR | C | 229 | −1.372 | −41.168 | 35.978 | 1.00 | 34.02 | D000 N |
| ATOM | 4000 | CA | TYR | C | 229 | −1.267 | −39.735 | 36.202 | 1.00 | 35.25 | D000 C |
| ATOM | 4001 | C | TYR | C | 229 | −0.210 | −39.078 | 35.320 | 1.00 | 32.64 | D000 C |
| ATOM | 4002 | O | TYR | C | 229 | −0.470 | −38.045 | 34.713 | 1.00 | 32.76 | D000 O |
| ATOM | 4003 | CB | TYR | C | 229 | −0.967 | −39.448 | 37.676 | 1.00 | 34.94 | D000 C |
| ATOM | 4004 | CG | TYR | C | 229 | −0.488 | −38.039 | 37.936 | 1.00 | 31.42 | D000 C |
| ATOM | 4005 | CD1 | TYR | C | 229 | −1.381 | −36.975 | 37.988 | 1.00 | 28.67 | D000 C |
| ATOM | 4006 | CD2 | TYR | C | 229 | 0.860 | −37.773 | 38.129 | 1.00 | 36.14 | D000 C |
| ATOM | 4007 | CE1 | TYR | C | 229 | −0.941 | −35.684 | 38.220 | 1.00 | 24.57 | D000 C |
| ATOM | 4008 | CE2 | TYR | C | 229 | 1.309 | −36.493 | 38.366 | 1.00 | 33.76 | D000 C |
| ATOM | 4009 | CZ | TYR | C | 229 | 0.407 | −35.452 | 38.412 | 1.00 | 34.92 | D000 C |
| ATOM | 4010 | OH | TYR | C | 229 | 0.869 | −34.176 | 38.646 | 1.00 | 35.23 | D000 O |
| ATOM | 4011 | N | GLU | C | 230 | 0.973 | −39.679 | 35.244 | 1.00 | 32.24 | D000 N |
| ATOM | 4012 | CA | GLU | C | 230 | 2.108 | −39.042 | 34.578 | 1.00 | 40.08 | D000 C |
| ATOM | 4013 | C | GLU | C | 230 | 1.866 | −38.810 | 33.086 | 1.00 | 34.17 | D000 C |
| ATOM | 4014 | O | GLU | C | 230 | 2.253 | −37.777 | 32.545 | 1.00 | 32.51 | D000 O |
| ATOM | 4015 | CB | GLU | C | 230 | 3.381 | −39.869 | 34.774 | 1.00 | 40.46 | D000 C |
| ATOM | 4016 | CG | GLU | C | 230 | 4.639 | −39.157 | 34.302 | 1.00 | 62.30 | D000 C |
| ATOM | 4017 | CD | GLU | C | 230 | 5.913 | −39.799 | 34.821 | 1.00 | 100.35 | D000 C |
| ATOM | 4018 | OE1 | GLU | C | 230 | 5.824 | −40.683 | 35.701 | 1.00 | 96.71 | D000 O |
| ATOM | 4019 | OE2 | GLU | C | 230 | 7.006 | −39.416 | 34.349 | 1.00 | 104.16 | D000 O |
| ATOM | 4020 | N | THR | C | 231 | 1.210 | −39.760 | 32.428 | 1.00 | 32.37 | D000 N |
| ATOM | 4021 | CA | THR | C | 231 | 0.942 | −39.638 | 31.001 | 1.00 | 35.98 | D000 C |
| ATOM | 4022 | C | THR | C | 231 | −0.426 | −39.018 | 30.742 | 1.00 | 40.00 | D000 C |
| ATOM | 4023 | O | THR | C | 231 | −0.829 | −38.837 | 29.593 | 1.00 | 34.33 | D000 O |
| ATOM | 4024 | CB | THR | C | 231 | 1.015 | −41.005 | 30.291 | 1.00 | 45.18 | D000 C |
| ATOM | 4025 | CG2 | THR | C | 231 | 2.392 | −41.634 | 30.485 | 1.00 | 36.03 | D000 C |
| ATOM | 4026 | OG1 | THR | C | 231 | 0.004 | −41.878 | 30.813 | 1.00 | 40.41 | D000 O |
| ATOM | 4027 | N | GLY | C | 232 | −1.135 | −38.685 | 31.815 | 1.00 | 31.90 | D000 N |
| ATOM | 4028 | CA | GLY | C | 232 | −2.478 | −38.155 | 31.689 | 1.00 | 35.88 | D000 C |
| ATOM | 4029 | C | GLY | C | 232 | −2.556 | −36.641 | 31.641 | 1.00 | 31.67 | D000 C |
| ATOM | 4030 | O | GLY | C | 232 | −1.569 | −35.940 | 31.855 | 1.00 | 34.20 | D000 O |
| ATOM | 4031 | N | PHE | C | 233 | −3.754 | −36.148 | 31.351 | 1.00 | 34.66 | D000 N |
| ATOM | 4032 | CA | PHE | C | 233 | −4.057 | −34.723 | 31.357 | 1.00 | 30.10 | D000 C |
| ATOM | 4033 | C | PHE | C | 233 | −3.792 | −34.089 | 32.730 | 1.00 | 28.30 | D000 C |
| ATOM | 4034 | O | PHE | C | 233 | −4.053 | −34.702 | 33.766 | 1.00 | 31.59 | D000 O |
| ATOM | 4035 | CB | PHE | C | 233 | −5.520 | −34.520 | 30.932 | 1.00 | 29.82 | D000 C |
| ATOM | 4036 | CG | PHE | C | 233 | −6.022 | −33.115 | 31.094 | 1.00 | 33.74 | D000 C |
| ATOM | 4037 | CD1 | PHE | C | 233 | −5.829 | −32.175 | 30.088 | 1.00 | 27.88 | D000 C |
| ATOM | 4038 | CD2 | PHE | C | 233 | −6.715 | −32.739 | 32.240 | 1.00 | 24.62 | D000 C |
| ATOM | 4039 | CE1 | PHE | C | 233 | −6.298 | −30.878 | 30.231 | 1.00 | 27.56 | D000 C |
| ATOM | 4040 | CE2 | PHE | C | 233 | −7.184 | −31.441 | 32.389 | 1.00 | 32.64 | D000 C |
| ATOM | 4041 | CZ | PHE | C | 233 | −6.975 | −30.510 | 31.381 | 1.00 | 27.36 | D000 C |
| ATOM | 4042 | N | LYS | C | 234 | −3.267 | −32.866 | 32.730 | 1.00 | 29.76 | D000 N |
| ATOM | 4043 | CA | LYS | C | 234 | −3.045 | −32.109 | 33.963 | 1.00 | 29.48 | D000 C |
| ATOM | 4044 | C | LYS | C | 234 | −3.455 | −30.646 | 33.789 | 1.00 | 31.02 | D000 C |
| ATOM | 4045 | O | LYS | C | 234 | −3.316 | −30.077 | 32.704 | 1.00 | 25.86 | D000 O |
| ATOM | 4046 | CB | LYS | C | 234 | −1.579 | −32.189 | 34.397 | 1.00 | 32.09 | D000 C |
| ATOM | 4047 | CG | LYS | C | 234 | −1.056 | −33.603 | 34.611 | 1.00 | 30.92 | D000 C |
| ATOM | 4048 | CD | LYS | C | 234 | 0.422 | −33.598 | 34.955 | 1.00 | 34.48 | D000 C |
| ATOM | 4049 | CE | LYS | C | 234 | 1.026 | −34.993 | 34.843 | 1.00 | 34.77 | D000 C |
| ATOM | 4050 | NZ | LYS | C | 234 | 1.050 | −35.479 | 33.432 | 1.00 | 34.51 | D000 N |
| ATOM | 4051 | N | ASN | C | 235 | −3.957 | −30.040 | 34.861 | 1.00 | 29.35 | D000 N |

TABLE 10.2-continued

| | | | | | | | | | | | |
|---|---|---|---|---|---|---|---|---|---|---|---|
| ATOM | 4052 | CA | ASN | C | 235 | −4.382 | −28.644 | 34.822 | 1.00 | 26.46 | D000 | C |
| ATOM | 4053 | C | ASN | C | 235 | −4.012 | −27.912 | 36.116 | 1.00 | 26.48 | D000 | C |
| ATOM | 4054 | O | ASN | C | 235 | −4.814 | −27.157 | 36.659 | 1.00 | 29.79 | D000 | O |
| ATOM | 4055 | CB | ASN | C | 235 | −5.896 | −28.559 | 34.573 | 1.00 | 25.06 | D000 | C |
| ATOM | 4056 | CG | ASN | C | 235 | −6.345 | −27.173 | 34.127 | 1.00 | 27.67 | D000 | C |
| ATOM | 4057 | ND2 | ASN | C | 235 | −7.464 | −26.705 | 34.673 | 1.00 | 26.28 | D000 | N |
| ATOM | 4058 | OD1 | ASN | C | 235 | −5.692 | −26.533 | 33.308 | 1.00 | 27.02 | D000 | O |
| ATOM | 4059 | N | TRP | C | 236 | −2.795 | −28.145 | 36.607 | 1.00 | 27.50 | D000 | N |
| ATOM | 4060 | CA | TRP | C | 236 | −2.325 | −27.526 | 37.850 | 1.00 | 27.74 | D000 | C |
| ATOM | 4061 | C | TRP | C | 236 | −2.206 | −26.010 | 37.747 | 1.00 | 27.99 | D000 | C |
| ATOM | 4062 | O | TRP | C | 236 | −1.870 | −25.474 | 36.690 | 1.00 | 31.33 | D000 | O |
| ATOM | 4063 | CB | TRP | C | 236 | −0.960 | −28.092 | 38.264 | 1.00 | 23.47 | D000 | C |
| ATOM | 4064 | CG | TRP | C | 236 | −0.967 | −29.533 | 38.710 | 1.00 | 24.40 | D000 | C |
| ATOM | 4065 | CD1 | TRP | C | 236 | −0.544 | −30.616 | 37.990 | 1.00 | 25.63 | D000 | C |
| ATOM | 4066 | CD2 | TRP | C | 236 | −1.407 | −30.040 | 39.979 | 1.00 | 27.52 | D000 | C |
| ATOM | 4067 | CE2 | TRP | C | 236 | −1.224 | −31.442 | 39.955 | 1.00 | 25.85 | D000 | C |
| ATOM | 4068 | CE3 | TRP | C | 236 | −1.940 | −29.450 | 41.132 | 1.00 | 25.98 | D000 | C |
| ATOM | 4069 | NE1 | TRP | C | 236 | −0.696 | −31.766 | 38.732 | 1.00 | 26.26 | D000 | N |
| ATOM | 4070 | CZ2 | TRP | C | 236 | −1.551 | −32.258 | 41.037 | 1.00 | 25.53 | D000 | C |
| ATOM | 4071 | CZ3 | TRP | C | 236 | −2.267 | −30.263 | 42.208 | 1.00 | 25.29 | D000 | C |
| ATOM | 4072 | CH2 | TRP | C | 236 | −2.071 | −31.654 | 42.152 | 1.00 | 26.90 | D000 | C |
| ATOM | 4073 | N | ARG | C | 237 | −2.473 | −25.323 | 38.855 | 1.00 | 29.23 | D000 | N |
| ATOM | 4074 | CA | ARG | C | 237 | −2.100 | −23.918 | 38.983 | 1.00 | 34.44 | D000 | C |
| ATOM | 4075 | C | ARG | C | 237 | −0.586 | −23.790 | 38.820 | 1.00 | 34.81 | D000 | C |
| ATOM | 4076 | O | ARG | C | 237 | 0.147 | −24.755 | 39.052 | 1.00 | 28.62 | D000 | O |
| ATOM | 4077 | CB | ARG | C | 237 | −2.547 | −23.349 | 40.337 | 1.00 | 30.99 | D000 | C |
| ATOM | 4078 | CG | ARG | C | 237 | −4.048 | −23.189 | 40.474 | 1.00 | 37.60 | D000 | C |
| ATOM | 4079 | CD | ARG | C | 237 | −4.455 | −21.737 | 40.591 | 1.00 | 42.14 | D000 | C |
| ATOM | 4080 | NE | ARG | C | 237 | −4.482 | −21.299 | 41.980 | 1.00 | 49.94 | D000 | N |
| ATOM | 4081 | CZ | ARG | C | 237 | −5.493 | −20.641 | 42.538 | 1.00 | 55.18 | D000 | C |
| ATOM | 4082 | NH1 | ARG | C | 237 | −6.568 | −20.334 | 41.822 | 1.00 | 41.85 | D000 | N |
| ATOM | 4083 | NH2 | ARG | C | 237 | −5.428 | −20.287 | 43.814 | 1.00 | 55.93 | D000 | N |
| ATOM | 4084 | N | PRO | C | 238 | −0.113 | −22.606 | 38.401 | 1.00 | 36.47 | D000 | N |
| ATOM | 4085 | CA | PRO | C | 238 | 1.334 | −22.380 | 38.314 | 1.00 | 36.67 | D000 | C |
| ATOM | 4086 | C | PRO | C | 238 | 2.051 | −22.730 | 39.619 | 1.00 | 31.29 | D000 | C |
| ATOM | 4087 | O | PRO | C | 238 | 1.581 | −22.352 | 40.692 | 1.00 | 39.20 | D000 | O |
| ATOM | 4088 | CB | PRO | C | 238 | 1.435 | −20.881 | 38.015 | 1.00 | 41.44 | D000 | C |
| ATOM | 4089 | CG | PRO | C | 238 | 0.172 | −20.566 | 37.297 | 1.00 | 41.47 | D000 | C |
| ATOM | 4090 | CD | PRO | C | 238 | −0.886 | −21.461 | 37.885 | 1.00 | 34.59 | D000 | C |
| ATOM | 4091 | N | GLU | C | 239 | 3.149 | −23.473 | 39.502 | 1.00 | 34.14 | D000 | N |
| ATOM | 4092 | CA | GLU | C | 239 | 4.016 | −23.854 | 40.624 | 1.00 | 40.34 | D000 | C |
| ATOM | 4093 | C | GLU | C | 239 | 3.405 | −24.898 | 41.566 | 1.00 | 40.27 | D000 | C |
| ATOM | 4094 | O | GLU | C | 239 | 3.952 | −25.164 | 42.636 | 1.00 | 43.88 | D000 | O |
| ATOM | 4095 | CB | GLU | C | 239 | 4.428 | −22.615 | 41.426 | 1.00 | 43.42 | D000 | C |
| ATOM | 4096 | CG | GLU | C | 239 | 5.157 | −21.571 | 40.598 | 1.00 | 50.20 | D000 | C |
| ATOM | 4097 | CD | GLU | C | 239 | 5.859 | −20.539 | 41.453 | 1.00 | 75.90 | D000 | C |
| ATOM | 4098 | OE1 | GLU | C | 239 | 5.212 | −19.540 | 41.836 | 1.00 | 82.09 | D000 | O |
| ATOM | 4099 | OE2 | GLU | C | 239 | 7.059 | −20.732 | 41.744 | 1.00 | 84.44 | D000 | O |
| ATOM | 4100 | N | GLN | C | 240 | 2.285 | −25.493 | 41.165 | 1.00 | 33.28 | D000 | N |
| ATOM | 4101 | CA | GLN | C | 240 | 1.703 | −26.611 | 41.904 | 1.00 | 31.36 | D000 | C |
| ATOM | 4102 | C | GLN | C | 240 | 1.873 | −27.891 | 41.082 | 1.00 | 31.46 | D000 | C |
| ATOM | 4103 | O | GLN | C | 240 | 1.926 | −27.827 | 39.856 | 1.00 | 30.03 | D000 | O |
| ATOM | 4104 | CB | GLN | C | 240 | 0.224 | −26.354 | 42.208 | 1.00 | 28.17 | D000 | C |
| ATOM | 4105 | CG | GLN | C | 240 | −0.065 | −25.007 | 42.862 | 1.00 | 36.91 | D000 | C |
| ATOM | 4106 | CD | GLN | C | 240 | 0.799 | −24.737 | 44.083 | 1.00 | 42.84 | D000 | C |
| ATOM | 4107 | NE2 | GLN | C | 240 | 1.452 | −23.580 | 44.095 | 1.00 | 37.20 | D000 | N |
| ATOM | 4108 | OE1 | GLN | C | 240 | 0.885 | −25.559 | 45.001 | 1.00 | 41.85 | D000 | O |
| ATOM | 4109 | N | PRO | C | 241 | 1.968 | −29.060 | 41.746 | 1.00 | 31.89 | D000 | N |
| ATOM | 4110 | CA | PRO | C | 241 | 1.952 | −29.276 | 43.200 | 1.00 | 36.63 | D000 | C |
| ATOM | 4111 | C | PRO | C | 241 | 3.307 | −28.999 | 43.845 | 1.00 | 34.40 | D000 | C |
| ATOM | 4112 | O | PRO | C | 241 | 4.332 | −29.013 | 43.162 | 1.00 | 31.05 | D000 | O |
| ATOM | 4113 | CB | PRO | C | 241 | 1.583 | −30.757 | 43.326 | 1.00 | 30.98 | D000 | C |
| ATOM | 4114 | CG | PRO | C | 241 | 2.166 | −31.380 | 42.097 | 1.00 | 28.05 | D000 | C |
| ATOM | 4115 | CD | PRO | C | 241 | 2.042 | −30.334 | 41.004 | 1.00 | 28.29 | D000 | C |
| ATOM | 4116 | N | ASP | C | 242 | 3.306 | −28.762 | 45.151 | 1.00 | 31.20 | D000 | N |
| ATOM | 4117 | CA | ASP | C | 242 | 4.534 | −28.429 | 45.869 | 1.00 | 33.88 | D000 | C |
| ATOM | 4118 | C | ASP | C | 242 | 5.428 | −29.640 | 46.150 | 1.00 | 36.07 | D000 | C |
| ATOM | 4119 | O | ASP | C | 242 | 6.583 | −29.482 | 46.545 | 1.00 | 35.39 | D000 | O |
| ATOM | 4120 | CB | ASP | C | 242 | 4.189 | −27.712 | 47.176 | 1.00 | 30.91 | D000 | C |
| ATOM | 4121 | CG | ASP | C | 242 | 3.796 | −26.257 | 46.953 | 1.00 | 42.15 | D000 | C |
| ATOM | 4122 | OD2 | ASP | C | 242 | 2.709 | −25.848 | 47.409 | 1.00 | 41.70 | D000 | O |
| ATOM | 4123 | OD1 | ASP | C | 242 | 4.571 | −25.527 | 46.298 | 1.00 | 38.03 | D000 | O |
| ATOM | 4124 | N | ASP | C | 243 | 4.894 | −30.841 | 45.935 | 1.00 | 33.28 | D000 | N |
| ATOM | 4125 | CA | ASP | C | 243 | 5.659 | −32.080 | 46.098 | 1.00 | 33.76 | D000 | C |
| ATOM | 4126 | C | ASP | C | 243 | 5.140 | −33.135 | 45.123 | 1.00 | 36.43 | D000 | C |
| ATOM | 4127 | O | ASP | C | 243 | 4.000 | −33.045 | 44.662 | 1.00 | 31.00 | D000 | O |
| ATOM | 4128 | CB | ASP | C | 243 | 5.562 | −32.592 | 47.539 | 1.00 | 33.56 | D000 | C |
| ATOM | 4129 | CG | ASP | C | 243 | 6.805 | −33.360 | 47.980 | 1.00 | 45.01 | D000 | C |
| ATOM | 4130 | OD1 | ASP | C | 243 | 7.510 | −33.935 | 47.118 | 1.00 | 32.68 | D000 | O |
| ATOM | 4131 | OD2 | ASP | C | 243 | 7.073 | −33.389 | 49.201 | 1.00 | 41.68 | D000 | O |

TABLE 10.2-continued

| | | | | | | | | | | | |
|---|---|---|---|---|---|---|---|---|---|---|---|
| ATOM | 4132 | O | TRP | C | 244 | 4.635 | −37.408 | 43.978 | 1.00 | 29.40 | D000 O |
| ATOM | 4133 | N | TRP | C | 244 | 5.959 | −34.135 | 44.811 | 1.00 | 26.76 | D000 N |
| ATOM | 4134 | CA | TRP | C | 244 | 5.530 | −35.179 | 43.886 | 1.00 | 32.96 | D000 C |
| ATOM | 4135 | C | TRP | C | 244 | 5.096 | −36.460 | 44.610 | 1.00 | 33.98 | D000 C |
| ATOM | 4136 | CB | TRP | C | 244 | 6.635 | −35.486 | 42.872 | 1.00 | 22.49 | D000 C |
| ATOM | 4137 | CG | TRP | C | 244 | 7.926 | −35.939 | 43.487 | 1.00 | 31.66 | D000 C |
| ATOM | 4138 | CD1 | TRP | C | 244 | 8.985 | −35.153 | 43.851 | 1.00 | 35.24 | D000 C |
| ATOM | 4139 | CD2 | TRP | C | 244 | 8.301 | −37.286 | 43.797 | 1.00 | 28.87 | D000 C |
| ATOM | 4140 | NE1 | TRP | C | 244 | 9.992 | −35.930 | 44.374 | 1.00 | 39.02 | D000 N |
| ATOM | 4141 | CE2 | TRP | C | 244 | 9.597 | −37.243 | 44.351 | 1.00 | 34.79 | D000 C |
| ATOM | 4142 | CE3 | TRP | C | 244 | 7.666 | −38.526 | 43.661 | 1.00 | 27.95 | D000 C |
| ATOM | 4143 | CZ2 | TRP | C | 244 | 10.267 | −38.390 | 44.770 | 1.00 | 32.14 | D000 C |
| ATOM | 4144 | CZ3 | TRP | C | 244 | 8.333 | −39.662 | 44.076 | 1.00 | 30.86 | D000 C |
| ATOM | 4145 | CH2 | TRP | C | 244 | 9.621 | −39.586 | 44.624 | 1.00 | 31.78 | D000 C |
| ATOM | 4146 | O | TYR | C | 245 | 4.758 | −35.925 | 48.510 | 1.00 | 29.36 | D000 O |
| ATOM | 4147 | N | TYR | C | 245 | 5.250 | −36.491 | 45.930 | 1.00 | 32.02 | D000 N |
| ATOM | 4148 | CA | TYR | C | 245 | 4.614 | −37.534 | 46.735 | 1.00 | 28.48 | D000 C |
| ATOM | 4149 | C | TYR | C | 245 | 4.247 | −36.969 | 48.099 | 1.00 | 30.14 | D000 C |
| ATOM | 4150 | CB | TYR | C | 245 | 5.502 | −38.778 | 46.871 | 1.00 | 25.38 | D000 C |
| ATOM | 4151 | CG | TYR | C | 245 | 6.734 | −38.633 | 47.739 | 1.00 | 32.91 | D000 C |
| ATOM | 4152 | CD2 | TYR | C | 245 | 6.785 | −39.200 | 49.009 | 1.00 | 31.25 | D000 C |
| ATOM | 4153 | CD1 | TYR | C | 245 | 7.865 | −37.975 | 47.270 | 1.00 | 30.40 | D000 C |
| ATOM | 4154 | CE2 | TYR | C | 245 | 7.920 | −39.093 | 49.795 | 1.00 | 28.79 | D000 C |
| ATOM | 4155 | CE1 | TYR | C | 245 | 8.999 | −37.860 | 48.049 | 1.00 | 32.06 | D000 C |
| ATOM | 4156 | CZ | TYR | C | 245 | 9.025 | −38.420 | 49.307 | 1.00 | 29.81 | D000 C |
| ATOM | 4157 | OH | TYR | C | 245 | 10.159 | −38.300 | 50.077 | 1.00 | 27.57 | D000 O |
| ATOM | 4158 | O | GLY | C | 246 | 4.628 | −37.473 | 51.323 | 1.00 | 34.84 | D000 O |
| ATOM | 4159 | N | GLY | C | 246 | 3.340 | −37.650 | 48.789 | 1.00 | 31.19 | D000 N |
| ATOM | 4160 | CA | GLY | C | 246 | 2.703 | −37.067 | 49.955 | 1.00 | 35.76 | D000 C |
| ATOM | 4161 | C | GLY | C | 246 | 3.427 | −37.207 | 51.272 | 1.00 | 33.62 | D000 C |
| ATOM | 4162 | O | HIS | C | 247 | 2.259 | −37.710 | 55.785 | 1.00 | 43.05 | D000 O |
| ATOM | 4163 | N | HIS | C | 247 | 2.664 | −37.031 | 52.345 | 1.00 | 38.43 | D000 N |
| ATOM | 4164 | CA | HIS | C | 247 | 3.202 | −36.998 | 53.694 | 1.00 | 39.05 | D000 C |
| ATOM | 4165 | C | HIS | C | 247 | 2.411 | −37.945 | 54.588 | 1.00 | 38.77 | D000 C |
| ATOM | 4166 | CB | HIS | C | 247 | 3.164 | −35.565 | 54.234 | 1.00 | 39.25 | D000 C |
| ATOM | 4167 | CG | HIS | C | 247 | 3.692 | −34.553 | 53.266 | 1.00 | 36.64 | D000 C |
| ATOM | 4168 | ND1 | HIS | C | 247 | 4.970 | −34.039 | 53.346 | 1.00 | 46.82 | D000 N |
| ATOM | 4169 | CD2 | HIS | C | 247 | 3.126 | −33.978 | 52.179 | 1.00 | 35.16 | D000 C |
| ATOM | 4170 | CE1 | HIS | C | 247 | 5.163 | −33.185 | 52.358 | 1.00 | 42.11 | D000 C |
| ATOM | 4171 | NE2 | HIS | C | 247 | 4.059 | −33.130 | 51.632 | 1.00 | 47.04 | D000 N |
| ATOM | 4172 | O | GLY | C | 248 | −0.747 | −38.509 | 54.445 | 1.00 | 40.24 | D000 O |
| ATOM | 4173 | N | GLY | C | 248 | 1.903 | −39.018 | 53.991 | 1.00 | 40.96 | D000 N |
| ATOM | 4174 | CA | GLY | C | 248 | 1.118 | −39.995 | 54.720 | 1.00 | 37.66 | D000 C |
| ATOM | 4175 | C | GLY | C | 248 | −0.330 | −39.578 | 54.902 | 1.00 | 47.53 | D000 C |
| ATOM | 4176 | O | LEU | C | 249 | −3.773 | −38.603 | 57.140 | 1.00 | 54.25 | D000 O |
| ATOM | 4177 | N | LEU | C | 249 | −1.097 | −40.433 | 55.574 | 1.00 | 52.35 | D000 N |
| ATOM | 4178 | CA | LEU | C | 249 | −2.508 | −40.173 | 55.842 | 1.00 | 52.11 | D000 C |
| ATOM | 4179 | C | LEU | C | 249 | −2.689 | −39.160 | 56.968 | 1.00 | 52.40 | D000 C |
| ATOM | 4180 | CB | LEU | C | 249 | −3.233 | −41.474 | 56.202 | 1.00 | 42.33 | D000 C |
| ATOM | 4181 | CG | LEU | C | 249 | −3.333 | −42.572 | 55.139 | 1.00 | 60.62 | D000 C |
| ATOM | 4182 | CD2 | LEU | C | 249 | −4.287 | −42.165 | 54.027 | 1.00 | 56.35 | D000 C |
| ATOM | 4183 | CD1 | LEU | C | 249 | −3.789 | −43.874 | 55.773 | 1.00 | 55.71 | D000 C |
| ATOM | 4184 | O | GLY | C | 250 | −1.984 | −35.849 | 59.639 | 1.00 | 57.54 | D000 O |
| ATOM | 4185 | N | GLY | C | 250 | −1.622 | −38.924 | 57.727 | 1.00 | 52.24 | D000 N |
| ATOM | 4186 | CA | GLY | C | 250 | −1.698 | −38.112 | 58.930 | 1.00 | 50.41 | D000 C |
| ATOM | 4187 | C | GLY | C | 250 | −1.663 | −36.608 | 58.725 | 1.00 | 57.93 | D000 C |
| ATOM | 4188 | N | GLY | C | 251 | −1.269 | −36.168 | 57.535 | 1.00 | 52.64 | D000 N |
| ATOM | 4189 | CA | GLY | C | 251 | −1.203 | −34.746 | 57.250 | 1.00 | 44.98 | D000 C |
| ATOM | 4190 | C | GLY | C | 251 | −0.639 | −34.433 | 55.880 | 1.00 | 46.45 | D000 C |
| ATOM | 4191 | O | GLY | C | 251 | −0.459 | −35.329 | 55.051 | 1.00 | 43.28 | D000 O |
| ATOM | 4192 | N | GLY | C | 252 | −0.369 | −33.152 | 55.642 | 1.00 | 37.49 | D000 N |
| ATOM | 4193 | CA | GLY | C | 252 | 0.205 | −32.710 | 54.387 | 1.00 | 32.69 | D000 C |
| ATOM | 4194 | C | GLY | C | 252 | −0.831 | −32.272 | 53.366 | 1.00 | 34.76 | D000 C |
| ATOM | 4195 | O | GLY | C | 252 | −2.005 | −32.646 | 53.445 | 1.00 | 30.54 | D000 O |
| ATOM | 4196 | N | GLU | C | 253 | −0.385 | −31.472 | 52.402 | 1.00 | 33.99 | D000 N |
| ATOM | 4197 | CA | GLU | C | 253 | −1.250 | −30.989 | 51.331 | 1.00 | 40.45 | D000 C |
| ATOM | 4198 | C | GLU | C | 253 | −1.285 | −32.029 | 50.222 | 1.00 | 29.00 | D000 C |
| ATOM | 4199 | O | GLU | C | 253 | −0.676 | −31.860 | 49.168 | 1.00 | 35.30 | D000 O |
| ATOM | 4200 | CB | GLU | C | 253 | −0.757 | −29.632 | 50.821 | 1.00 | 34.32 | D000 C |
| ATOM | 4201 | CG | GLU | C | 253 | −0.717 | −28.572 | 51.926 | 1.00 | 42.40 | D000 C |
| ATOM | 4202 | CD | GLU | C | 253 | −0.225 | −27.217 | 51.444 | 1.00 | 58.00 | D000 C |
| ATOM | 4203 | OE1 | GLU | C | 253 | −0.620 | −26.792 | 50.337 | 1.00 | 59.58 | D000 O |
| ATOM | 4204 | OE2 | GLU | C | 253 | 0.557 | −26.574 | 52.177 | 1.00 | 57.93 | D000 O |
| ATOM | 4205 | N | ASP | C | 254 | −2.015 | −33.109 | 50.484 | 1.00 | 27.38 | D000 N |
| ATOM | 4206 | CA | ASP | C | 254 | −1.921 | −34.327 | 49.693 | 1.00 | 31.18 | D000 C |
| ATOM | 4207 | C | ASP | C | 254 | −3.140 | −34.599 | 48.805 | 1.00 | 33.58 | D000 C |
| ATOM | 4208 | O | ASP | C | 254 | −3.216 | −35.646 | 48.158 | 1.00 | 27.45 | D000 O |
| ATOM | 4209 | CB | ASP | C | 254 | −1.700 | −35.535 | 50.623 | 1.00 | 29.94 | D000 C |
| ATOM | 4210 | CG | ASP | C | 254 | −0.346 | −35.504 | 51.328 | 1.00 | 36.48 | D000 C |
| ATOM | 4211 | OD1 | ASP | C | 254 | 0.494 | −34.630 | 51.013 | 1.00 | 28.05 | D000 O |

TABLE 10.2-continued

| ATOM | 4212 | OD2 | ASP | C | 254 | −0.117 | −36.374 | 52.196 | 1.00 | 35.72 | D000 | O |
|---|---|---|---|---|---|---|---|---|---|---|---|---|
| ATOM | 4213 | N | CYS | C | 255 | −4.090 | −33.670 | 48.768 | 1.00 | 26.75 | D000 | N |
| ATOM | 4214 | CA | CYS | C | 255 | −5.294 | −33.867 | 47.963 | 1.00 | 26.33 | D000 | C |
| ATOM | 4215 | C | CYS | C | 255 | −5.518 | −32.727 | 46.977 | 1.00 | 32.54 | D000 | C |
| ATOM | 4216 | O | CYS | C | 255 | −5.323 | −31.559 | 47.316 | 1.00 | 27.66 | D000 | O |
| ATOM | 4217 | CB | CYS | C | 255 | −6.514 | −34.024 | 48.869 | 1.00 | 27.73 | D000 | C |
| ATOM | 4218 | SG | CYS | C | 255 | −6.407 | −35.447 | 49.969 | 1.00 | 35.91 | D000 | S |
| ATOM | 4219 | N | ALA | C | 256 | −5.930 | −33.072 | 45.758 | 1.00 | 28.09 | D000 | N |
| ATOM | 4220 | CA | ALA | C | 256 | −6.116 | −32.073 | 44.710 | 1.00 | 28.14 | D000 | C |
| ATOM | 4221 | C | ALA | C | 256 | −7.560 | −31.598 | 44.637 | 1.00 | 28.47 | D000 | C |
| ATOM | 4222 | O | ALA | C | 256 | −8.500 | −32.389 | 44.749 | 1.00 | 30.35 | D000 | O |
| ATOM | 4223 | CB | ALA | C | 256 | −5.678 | −32.627 | 43.357 | 1.00 | 25.70 | D000 | C |
| ATOM | 4224 | N | HIS | C | 257 | −7.732 | −30.298 | 44.444 | 1.00 | 28.56 | D000 | N |
| ATOM | 4225 | CA | HIS | C | 257 | −9.054 | −29.742 | 44.223 | 1.00 | 25.18 | D000 | C |
| ATOM | 4226 | C | HIS | C | 257 | −9.020 | −28.689 | 43.127 | 1.00 | 31.48 | D000 | C |
| ATOM | 4227 | O | HIS | C | 257 | −7.990 | −28.054 | 42.895 | 1.00 | 26.66 | D000 | O |
| ATOM | 4228 | CB | HIS | C | 257 | −9.615 | −29.139 | 45.514 | 1.00 | 24.94 | D000 | C |
| ATOM | 4229 | CG | HIS | C | 257 | −8.842 | −27.958 | 46.023 | 1.00 | 29.72 | D000 | C |
| ATOM | 4230 | CD2 | HIS | C | 257 | −7.685 | −27.880 | 46.715 | 1.00 | 26.19 | D000 | C |
| ATOM | 4231 | ND1 | HIS | C | 257 | −9.275 | −26.658 | 45.852 | 1.00 | 31.92 | D000 | N |
| ATOM | 4232 | CE1 | HIS | C | 257 | −8.411 | −25.834 | 46.415 | 1.00 | 33.33 | D000 | C |
| ATOM | 4233 | NE2 | HIS | C | 257 | −7.434 | −26.546 | 46.943 | 1.00 | 31.64 | D000 | N |
| ATOM | 4234 | N | PHE | C | 258 | −10.146 | −28.528 | 42.441 | 1.00 | 25.00 | D000 | N |
| ATOM | 4235 | CA | PHE | C | 258 | −10.340 | −27.385 | 41.567 | 1.00 | 28.97 | D000 | C |
| ATOM | 4236 | C | PHE | C | 258 | −10.347 | −26.129 | 42.421 | 1.00 | 30.92 | D000 | C |
| ATOM | 4237 | O | PHE | C | 258 | −10.917 | −26.128 | 43.511 | 1.00 | 27.46 | D000 | O |
| ATOM | 4238 | CB | PHE | C | 258 | −11.655 | −27.491 | 40.788 | 1.00 | 28.67 | D000 | C |
| ATOM | 4239 | CG | PHE | C | 258 | −11.790 | −28.752 | 39.975 | 1.00 | 28.57 | D000 | C |
| ATOM | 4240 | CD1 | PHE | C | 258 | −11.253 | −28.831 | 38.699 | 1.00 | 24.14 | D000 | C |
| ATOM | 4241 | CD2 | PHE | C | 258 | −12.475 | −29.845 | 40.477 | 1.00 | 26.98 | D000 | C |
| ATOM | 4242 | CE1 | PHE | C | 258 | −11.385 | −29.982 | 37.944 | 1.00 | 27.83 | D000 | C |
| ATOM | 4243 | CE2 | PHE | C | 258 | −12.610 | −31.002 | 39.727 | 1.00 | 29.05 | D000 | C |
| ATOM | 4244 | CZ | PHE | C | 258 | −12.064 | −31.067 | 38.458 | 1.00 | 26.68 | D000 | C |
| ATOM | 4245 | N | THR | C | 259 | −9.709 | −25.068 | 41.935 | 1.00 | 31.52 | D000 | N |
| ATOM | 4246 | CA | THR | C | 259 | −9.778 | −23.766 | 42.596 | 1.00 | 27.35 | D000 | C |
| ATOM | 4247 | C | THR | C | 259 | −10.853 | −22.908 | 41.947 | 1.00 | 32.37 | D000 | C |
| ATOM | 4248 | O | THR | C | 259 | −11.547 | −23.361 | 41.038 | 1.00 | 28.98 | D000 | O |
| ATOM | 4249 | CB | THR | C | 259 | −8.450 | −23.013 | 42.517 | 1.00 | 30.50 | D000 | C |
| ATOM | 4250 | CG2 | THR | C | 259 | −7.336 | −23.832 | 43.146 | 1.00 | 29.47 | D000 | C |
| ATOM | 4251 | OG1 | THR | C | 259 | −8.141 | −22.759 | 41.139 | 1.00 | 26.60 | D000 | O |
| ATOM | 4252 | N | ASP | C | 260 | −10.966 | −21.657 | 42.383 | 1.00 | 33.47 | D000 | N |
| ATOM | 4253 | CA | ASP | C | 260 | −11.989 | −20.772 | 41.841 | 1.00 | 32.04 | D000 | C |
| ATOM | 4254 | C | ASP | C | 260 | −11.660 | −20.274 | 40.432 | 1.00 | 28.10 | D000 | C |
| ATOM | 4255 | O | ASP | C | 260 | −12.469 | −19.571 | 39.833 | 1.00 | 35.94 | D000 | O |
| ATOM | 4256 | CB | ASP | C | 260 | −12.232 | −19.574 | 42.774 | 1.00 | 31.62 | D000 | C |
| ATOM | 4257 | CG | ASP | C | 260 | −10.952 | −18.844 | 43.150 | 1.00 | 39.51 | D000 | C |
| ATOM | 4258 | OD1 | ASP | C | 260 | −9.894 | −19.114 | 42.544 | 1.00 | 46.04 | D000 | O |
| ATOM | 4259 | OD2 | ASP | C | 260 | −11.010 | −17.986 | 44.057 | 1.00 | 48.87 | D000 | O |
| ATOM | 4260 | N | ASP | C | 261 | −10.494 | −20.631 | 39.890 | 1.00 | 32.99 | D000 | N |
| ATOM | 4261 | CA | ASP | C | 261 | −10.219 | −20.308 | 38.483 | 1.00 | 33.63 | D000 | C |
| ATOM | 4262 | C | ASP | C | 261 | −10.169 | −21.568 | 37.618 | 1.00 | 34.02 | D000 | C |
| ATOM | 4263 | O | ASP | C | 261 | −9.808 | −21.517 | 36.440 | 1.00 | 35.61 | D000 | O |
| ATOM | 4264 | CB | ASP | C | 261 | −8.920 | −19.493 | 38.330 | 1.00 | 34.41 | D000 | C |
| ATOM | 4265 | CG | ASP | C | 261 | −7.663 | −20.257 | 38.749 | 1.00 | 41.30 | D000 | C |
| ATOM | 4266 | OD1 | ASP | C | 261 | −7.662 | −21.504 | 38.780 | 1.00 | 38.03 | D000 | O |
| ATOM | 4267 | OD2 | ASP | C | 261 | −6.644 | −19.591 | 39.031 | 1.00 | 47.65 | D000 | O |
| ATOM | 4268 | N | GLY | C | 262 | −10.525 | −22.701 | 38.214 | 1.00 | 34.67 | D000 | N |
| ATOM | 4269 | CA | GLY | C | 262 | −10.608 | −23.949 | 37.477 | 1.00 | 29.76 | D000 | C |
| ATOM | 4270 | C | GLY | C | 262 | −9.366 | −24.810 | 37.571 | 1.00 | 25.05 | D000 | C |
| ATOM | 4271 | O | GLY | C | 262 | −9.449 | −26.038 | 37.513 | 1.00 | 31.23 | D000 | O |
| ATOM | 4272 | N | ARG | C | 263 | −8.207 | −24.177 | 37.710 | 1.00 | 26.83 | D000 | N |
| ATOM | 4273 | CA | ARG | C | 263 | −6.952 | −24.919 | 37.778 | 1.00 | 26.39 | D000 | C |
| ATOM | 4274 | C | ARG | C | 263 | −6.771 | −25.578 | 39.148 | 1.00 | 30.19 | D000 | C |
| ATOM | 4275 | O | ARG | C | 263 | −7.392 | −25.172 | 40.135 | 1.00 | 28.43 | D000 | O |
| ATOM | 4276 | CB | ARG | C | 263 | −5.775 | −24.000 | 37.443 | 1.00 | 27.07 | D000 | C |
| ATOM | 4277 | CG | ARG | C | 263 | −5.652 | −23.711 | 35.943 | 1.00 | 29.33 | D000 | C |
| ATOM | 4278 | CD | ARG | C | 263 | −4.595 | −22.643 | 35.649 | 1.00 | 33.17 | D000 | C |
| ATOM | 4279 | NE | ARG | C | 263 | −5.071 | −21.305 | 35.982 | 1.00 | 44.51 | D000 | N |
| ATOM | 4280 | CZ | ARG | C | 263 | −5.787 | −20.547 | 35.156 | 1.00 | 52.96 | D000 | C |
| ATOM | 4281 | NH1 | ARG | C | 263 | −6.105 | −21.002 | 33.951 | 1.00 | 49.17 | D000 | N |
| ATOM | 4282 | NH2 | ARG | C | 263 | −6.188 | −19.340 | 35.532 | 1.00 | 51.57 | D000 | N |
| ATOM | 4283 | N | TRP | C | 264 | −5.916 | −26.596 | 39.202 | 1.00 | 26.05 | D000 | N |
| ATOM | 4284 | CA | TRP | C | 264 | −5.847 | −27.477 | 40.365 | 1.00 | 28.26 | D000 | C |
| ATOM | 4285 | C | TRP | C | 264 | −4.859 | −27.000 | 41.415 | 1.00 | 27.92 | D000 | C |
| ATOM | 4286 | O | TRP | C | 264 | −3.844 | −26.385 | 41.097 | 1.00 | 28.53 | D000 | O |
| ATOM | 4287 | CB | TRP | C | 264 | −5.460 | −28.897 | 39.938 | 1.00 | 24.67 | D000 | C |
| ATOM | 4288 | CG | TRP | C | 264 | −6.268 | −29.456 | 38.814 | 1.00 | 25.08 | D000 | C |
| ATOM | 4289 | CD1 | TRP | C | 264 | −7.436 | −28.958 | 38.304 | 1.00 | 26.48 | D000 | C |
| ATOM | 4290 | CD2 | TRP | C | 264 | −5.963 | −30.627 | 38.048 | 1.00 | 26.55 | D000 | C |
| ATOM | 4291 | CE2 | TRP | C | 264 | −6.994 | −30.785 | 37.098 | 1.00 | 22.22 | D000 | C |

TABLE 10.2-continued

| | | | | | | | | | | |
|---|---|---|---|---|---|---|---|---|---|---|
| ATOM | 4292 | CE3 | TRP | C | 264 | −4.923 | −31.565 | 38.081 | 1.00 | 25.16 D000 C |
| ATOM | 4293 | NE1 | TRP | C | 264 | −7.879 | −29.752 | 37.276 | 1.00 | 26.28 D000 N |
| ATOM | 4294 | CZ2 | TRP | C | 264 | −7.012 | −31.837 | 36.181 | 1.00 | 27.60 D000 C |
| ATOM | 4295 | CZ3 | TRP | C | 264 | −4.944 | −32.616 | 37.170 | 1.00 | 22.92 D000 C |
| ATOM | 4296 | CH2 | TRP | C | 264 | −5.979 | −32.739 | 36.232 | 1.00 | 24.94 D000 C |
| ATOM | 4297 | N | ASN | C | 265 | −5.155 | −27.313 | 42.670 | 1.00 | 30.65 D000 N |
| ATOM | 4298 | CA | ASN | C | 265 | −4.243 | −27.018 | 43.762 | 1.00 | 29.62 D000 C |
| ATOM | 4299 | C | ASN | C | 265 | −4.178 | −28.182 | 44.735 | 1.00 | 27.94 D000 C |
| ATOM | 4300 | O | ASN | C | 265 | −5.157 | −28.904 | 44.910 | 1.00 | 27.71 D000 O |
| ATOM | 4301 | CB | ASN | C | 265 | −4.668 | −25.746 | 44.490 | 1.00 | 31.63 D000 C |
| ATOM | 4302 | CG | ASN | C | 265 | −3.717 | −25.373 | 45.608 | 1.00 | 37.30 D000 C |
| ATOM | 4303 | ND2 | ASN | C | 265 | −4.220 | −25.357 | 46.839 | 1.00 | 35.10 D000 N |
| ATOM | 4304 | OD1 | ASN | C | 265 | −2.541 | −25.102 | 45.367 | 1.00 | 39.83 D000 O |
| ATOM | 4305 | N | ASP | C | 266 | −3.021 | −28.364 | 45.358 | 1.00 | 24.21 D000 N |
| ATOM | 4306 | CA | ASP | C | 266 | −2.850 | −29.405 | 46.366 | 1.00 | 28.45 D000 C |
| ATOM | 4307 | C | ASP | C | 266 | −3.066 | −28.832 | 47.763 | 1.00 | 36.19 D000 C |
| ATOM | 4308 | O | ASP | C | 266 | −2.397 | −27.880 | 48.157 | 1.00 | 35.56 D000 O |
| ATOM | 4309 | CB | ASP | C | 266 | −1.463 | −30.046 | 46.253 | 1.00 | 25.57 D000 C |
| ATOM | 4310 | CG | ASP | C | 266 | −0.349 | −29.020 | 46.030 | 1.00 | 36.15 D000 C |
| ATOM | 4311 | OD1 | ASP | C | 266 | −0.572 | −28.006 | 45.326 | 1.00 | 34.08 D000 O |
| ATOM | 4312 | OD2 | ASP | C | 266 | 0.762 | −29.236 | 46.554 | 1.00 | 38.58 D000 O |
| ATOM | 4313 | N | ASP | C | 267 | −4.007 | −29.412 | 48.507 | 1.00 | 32.84 D000 N |
| ATOM | 4314 | CA | ASP | C | 267 | −4.386 | −28.883 | 49.817 | 1.00 | 30.12 D000 C |
| ATOM | 4315 | C | ASP | C | 267 | −4.571 | −30.002 | 50.845 | 1.00 | 33.99 D000 C |
| ATOM | 4316 | O | ASP | C | 267 | −4.684 | −31.181 | 50.488 | 1.00 | 23.96 D000 O |
| ATOM | 4317 | CB | ASP | C | 267 | −5.675 | −28.058 | 49.701 | 1.00 | 33.91 D000 C |
| ATOM | 4318 | CG | ASP | C | 267 | −5.729 | −26.898 | 50.691 | 1.00 | 39.18 D000 C |
| ATOM | 4319 | OD1 | ASP | C | 267 | −4.872 | −26.833 | 51.601 | 1.00 | 39.63 D000 O |
| ATOM | 4320 | OD2 | ASP | C | 267 | −6.640 | −26.051 | 50.560 | 1.00 | 41.15 D000 O |
| ATOM | 4321 | N | VAL | C | 268 | −4.610 | −29.625 | 52.121 | 1.00 | 30.38 D000 N |
| ATOM | 4322 | CA | VAL | C | 268 | −4.808 | −30.587 | 53.202 | 1.00 | 34.77 D000 C |
| ATOM | 4323 | C | VAL | C | 268 | −6.169 | −31.260 | 53.054 | 1.00 | 31.59 D000 C |
| ATOM | 4324 | O | VAL | C | 268 | −7.157 | −30.630 | 52.685 | 1.00 | 30.27 D000 O |
| ATOM | 4325 | CB | VAL | C | 268 | −4.683 | −29.923 | 54.596 | 1.00 | 36.31 D000 C |
| ATOM | 4326 | CG1 | VAL | C | 268 | −3.302 | −29.294 | 54.757 | 1.00 | 31.26 D000 C |
| ATOM | 4327 | CG2 | VAL | C | 268 | −5.770 | −28.881 | 54.801 | 1.00 | 33.82 D000 C |
| ATOM | 4328 | N | CYS | C | 269 | −6.209 | −32.555 | 53.334 | 1.00 | 32.86 D000 N |
| ATOM | 4329 | CA | CYS | C | 269 | −7.369 | −33.364 | 52.991 | 1.00 | 31.61 D000 C |
| ATOM | 4330 | C | CYS | C | 269 | −8.559 | −33.098 | 53.917 | 1.00 | 36.95 D000 C |
| ATOM | 4331 | O | CYS | C | 269 | −9.684 | −33.504 | 53.627 | 1.00 | 36.14 D000 O |
| ATOM | 4332 | CB | CYS | C | 269 | −6.984 | −34.839 | 53.009 | 1.00 | 44.62 D000 C |
| ATOM | 4333 | SG | CYS | C | 269 | −5.637 | −35.218 | 51.830 | 1.00 | 60.76 D000 S |
| ATOM | 4334 | N | GLN | C | 270 | −8.305 | −32.384 | 55.009 | 1.00 | 31.38 D000 N |
| ATOM | 4335 | CA | GLN | C | 270 | −9.324 | −32.047 | 55.992 | 1.00 | 34.32 D000 C |
| ATOM | 4336 | C | GLN | C | 270 | −10.328 | −30.995 | 55.495 | 1.00 | 35.28 D000 C |
| ATOM | 4337 | O | GLN | C | 270 | −11.434 | −30.895 | 56.022 | 1.00 | 38.13 D000 O |
| ATOM | 4338 | CB | GLN | C | 270 | −8.640 | −31.552 | 57.265 | 1.00 | 41.74 D000 C |
| ATOM | 4339 | CG | GLN | C | 270 | −9.526 | −31.531 | 58.491 | 1.00 | 57.53 D000 C |
| ATOM | 4340 | CD | GLN | C | 270 | −8.755 | −31.148 | 59.743 | 1.00 | 62.03 D000 C |
| ATOM | 4341 | NE2 | GLN | C | 270 | −9.057 | −29.975 | 60.280 | 1.00 | 54.32 D000 N |
| ATOM | 4342 | OE1 | GLN | C | 270 | −7.898 | −31.898 | 60.222 | 1.00 | 60.58 D000 O |
| ATOM | 4343 | N | ARG | C | 271 | −9.940 | −30.207 | 54.495 | 1.00 | 30.92 D000 N |
| ATOM | 4344 | CA | ARG | C | 271 | −10.790 | −29.124 | 53.996 | 1.00 | 30.72 D000 C |
| ATOM | 4345 | C | ARG | C | 271 | −12.159 | −29.633 | 53.533 | 1.00 | 38.04 D000 C |
| ATOM | 4346 | O | ARG | C | 271 | −12.246 | −30.543 | 52.709 | 1.00 | 31.45 D000 O |
| ATOM | 4347 | CB | ARG | C | 271 | −10.096 | −28.385 | 52.849 | 1.00 | 34.39 D000 C |
| ATOM | 4348 | CG | ARG | C | 271 | −8.799 | −27.676 | 53.234 | 1.00 | 35.61 D000 C |
| ATOM | 4349 | CD | ARG | C | 271 | −9.066 | −26.393 | 53.999 | 1.00 | 43.95 D000 C |
| ATOM | 4350 | NE | ARG | C | 271 | −7.837 | −25.661 | 54.292 | 1.00 | 42.12 D000 N |
| ATOM | 4351 | CZ | ARG | C | 271 | −7.169 | −25.750 | 55.438 | 1.00 | 45.47 D000 C |
| ATOM | 4352 | NH1 | ARG | C | 271 | −7.606 | −26.547 | 56.406 | 1.00 | 42.46 D000 N |
| ATOM | 4353 | NH2 | ARG | C | 271 | −6.059 | −25.048 | 55.614 | 1.00 | 47.94 D000 N |
| ATOM | 4354 | N | PRO | C | 272 | −13.237 | −29.045 | 54.074 | 1.00 | 35.02 D000 N |
| ATOM | 4355 | CA | PRO | C | 272 | −14.604 | −29.446 | 53.724 | 1.00 | 34.48 D000 C |
| ATOM | 4356 | C | PRO | C | 272 | −15.064 | −28.856 | 52.392 | 1.00 | 34.36 D000 C |
| ATOM | 4357 | O | PRO | C | 272 | −16.036 | −28.104 | 52.355 | 1.00 | 37.58 D000 O |
| ATOM | 4358 | CB | PRO | C | 272 | −15.433 | −28.887 | 54.881 | 1.00 | 36.83 D000 C |
| ATOM | 4359 | CG | PRO | C | 272 | −14.678 | −27.668 | 55.306 | 1.00 | 32.07 D000 C |
| ATOM | 4360 | CD | PRO | C | 272 | −13.217 | −28.007 | 55.121 | 1.00 | 35.31 D000 C |
| ATOM | 4361 | N | TYR | C | 273 | −14.370 | −29.197 | 51.312 | 1.00 | 34.00 D000 N |
| ATOM | 4362 | CA | TYR | C | 273 | −14.725 | −28.690 | 49.994 | 1.00 | 34.47 D000 C |
| ATOM | 4363 | C | TYR | C | 273 | −15.886 | −29.467 | 49.399 | 1.00 | 31.88 D000 C |
| ATOM | 4364 | O | TYR | C | 273 | −16.205 | −30.571 | 49.848 | 1.00 | 34.84 D000 O |
| ATOM | 4365 | CB | TYR | C | 273 | −13.523 | −28.760 | 49.048 | 1.00 | 33.39 D000 C |
| ATOM | 4366 | CG | TYR | C | 273 | −12.391 | −27.827 | 49.412 | 1.00 | 29.84 D000 C |
| ATOM | 4367 | CD1 | TYR | C | 273 | −12.634 | −26.642 | 50.096 | 1.00 | 31.84 D000 C |
| ATOM | 4368 | CD2 | TYR | C | 273 | −11.077 | −28.131 | 49.065 | 1.00 | 27.54 D000 C |
| ATOM | 4369 | CE1 | TYR | C | 273 | −11.595 | −25.778 | 50.431 | 1.00 | 30.36 D000 C |
| ATOM | 4370 | CE2 | TYR | C | 273 | −10.036 | −27.280 | 49.391 | 1.00 | 31.31 D000 C |
| ATOM | 4371 | CZ | TYR | C | 273 | −10.303 | −26.104 | 50.075 | 1.00 | 31.94 D000 C |

TABLE 10.2-continued

| | | | | | | | | | | | |
|---|---|---|---|---|---|---|---|---|---|---|---|
| ATOM | 4372 | OH | TYR | C | 273 | −9.273 | −25.261 | 50.404 | 1.00 | 32.60 | D000 O |
| ATOM | 4373 | N | ARG | C | 274 | −16.510 | −28.891 | 48.377 | 1.00 | 29.76 | D000 N |
| ATOM | 4374 | CA | ARG | C | 274 | −17.470 | −29.627 | 47.566 | 1.00 | 28.81 | D000 C |
| ATOM | 4375 | C | ARG | C | 274 | −16.750 | −30.733 | 46.802 | 1.00 | 30.11 | D000 C |
| ATOM | 4376 | O | ARG | C | 274 | −15.520 | −30.772 | 46.766 | 1.00 | 28.45 | D000 O |
| ATOM | 4377 | CB | ARG | C | 274 | −18.191 | −28.689 | 46.601 | 1.00 | 31.26 | D000 C |
| ATOM | 4378 | CG | ARG | C | 274 | −19.110 | −27.703 | 47.298 | 1.00 | 35.55 | D000 C |
| ATOM | 4379 | CD | ARG | C | 274 | −19.871 | −26.844 | 46.309 | 1.00 | 33.61 | D000 C |
| ATOM | 4380 | NE | ARG | C | 274 | −20.885 | −26.046 | 46.984 | 1.00 | 39.40 | D000 N |
| ATOM | 4381 | CZ | ARG | C | 274 | −21.630 | −25.121 | 46.389 | 1.00 | 48.65 | D000 C |
| ATOM | 4382 | NH1 | ARG | C | 274 | −21.474 | −24.867 | 45.097 | 1.00 | 48.98 | D000 N |
| ATOM | 4383 | NH2 | ARG | C | 274 | −22.531 | −24.446 | 47.090 | 1.00 | 55.24 | D000 N |
| ATOM | 4384 | N | TRP | C | 275 | −17.507 | −31.639 | 46.198 | 1.00 | 28.06 | D000 N |
| ATOM | 4385 | CA | TRP | C | 275 | −16.887 | −32.709 | 45.432 | 1.00 | 28.84 | D000 C |
| ATOM | 4386 | C | TRP | C | 275 | −17.754 | −33.114 | 44.252 | 1.00 | 29.72 | D000 C |
| ATOM | 4387 | O | TRP | C | 275 | −18.905 | −32.693 | 44.130 | 1.00 | 26.78 | D000 O |
| ATOM | 4388 | CB | TRP | C | 275 | −16.601 | −33.927 | 46.322 | 1.00 | 29.81 | D000 C |
| ATOM | 4389 | CG | TRP | C | 275 | −17.824 | −34.715 | 46.717 | 1.00 | 31.96 | D000 C |
| ATOM | 4390 | CD1 | TRP | C | 275 | −18.293 | −35.855 | 46.125 | 1.00 | 31.44 | D000 C |
| ATOM | 4391 | CD2 | TRP | C | 275 | −18.726 | −34.423 | 47.795 | 1.00 | 29.40 | D000 C |
| ATOM | 4392 | CE2 | TRP | C | 275 | −19.718 | −35.426 | 47.793 | 1.00 | 31.93 | D000 C |
| ATOM | 4393 | CE3 | TRP | C | 275 | −18.791 | −33.412 | 48.759 | 1.00 | 32.50 | D000 C |
| ATOM | 4394 | NE1 | TRP | C | 275 | −19.430 | −36.288 | 46.767 | 1.00 | 36.68 | D000 N |
| ATOM | 4395 | CZ2 | TRP | C | 275 | −20.761 | −35.447 | 48.718 | 1.00 | 33.08 | D000 C |
| ATOM | 4396 | CZ3 | TRP | C | 275 | −19.829 | −33.433 | 49.676 | 1.00 | 33.96 | D000 C |
| ATOM | 4397 | CH2 | TRP | C | 275 | −20.801 | −34.443 | 49.648 | 1.00 | 35.93 | D000 C |
| ATOM | 4398 | N | VAL | C | 276 | −17.178 | −33.926 | 43.376 | 1.00 | 28.10 | D000 N |
| ATOM | 4399 | CA | VAL | C | 276 | −17.870 | −34.412 | 42.195 | 1.00 | 29.03 | D000 C |
| ATOM | 4400 | C | VAL | C | 276 | −17.737 | −35.924 | 42.114 | 1.00 | 27.19 | D000 C |
| ATOM | 4401 | O | VAL | C | 276 | −16.628 | −36.454 | 42.177 | 1.00 | 28.31 | D000 O |
| ATOM | 4402 | CB | VAL | C | 276 | −17.302 | −33.780 | 40.905 | 1.00 | 28.00 | D000 C |
| ATOM | 4403 | CG1 | VAL | C | 276 | −18.046 | −34.293 | 39.688 | 1.00 | 27.41 | D000 C |
| ATOM | 4404 | CG2 | VAL | C | 276 | −17.364 | −32.259 | 40.982 | 1.00 | 28.48 | D000 C |
| ATOM | 4405 | N | CYS | C | 277 | −18.862 | −36.619 | 41.988 | 1.00 | 26.93 | D000 N |
| ATOM | 4406 | CA | CYS | C | 277 | −18.832 | −38.058 | 41.751 | 1.00 | 33.14 | D000 C |
| ATOM | 4407 | C | CYS | C | 277 | −18.994 | −38.338 | 40.262 | 1.00 | 37.44 | D000 C |
| ATOM | 4408 | O | CYS | C | 277 | −19.699 | −37.612 | 39.564 | 1.00 | 33.29 | D000 O |
| ATOM | 4409 | CB | CYS | C | 277 | −19.922 | −38.770 | 42.562 | 1.00 | 32.89 | D000 C |
| ATOM | 4410 | SG | CYS | C | 277 | −19.660 | −38.700 | 44.364 | 1.00 | 47.93 | D000 S |
| ATOM | 4411 | N | GLU | C | 278 | −18.324 | −39.386 | 39.787 | 1.00 | 30.10 | D000 N |
| ATOM | 4412 | CA | GLU | C | 278 | −18.367 | −39.774 | 38.386 | 1.00 | 28.53 | D000 C |
| ATOM | 4413 | C | GLU | C | 278 | −18.528 | −41.288 | 38.252 | 1.00 | 32.73 | D000 C |
| ATOM | 4414 | O | GLU | C | 278 | −17.931 | −42.050 | 39.008 | 1.00 | 29.46 | D000 O |
| ATOM | 4415 | CB | GLU | C | 278 | −17.095 | −39.315 | 37.655 | 1.00 | 32.72 | D000 C |
| ATOM | 4416 | CG | GLU | C | 278 | −16.913 | −39.932 | 36.260 | 1.00 | 32.26 | D000 C |
| ATOM | 4417 | CD | GLU | C | 278 | −15.636 | −39.483 | 35.555 | 1.00 | 39.23 | D000 C |
| ATOM | 4418 | OE1 | GLU | C | 278 | −14.646 | −39.151 | 36.241 | 1.00 | 36.80 | D000 O |
| ATOM | 4419 | OE2 | GLU | C | 278 | −15.622 | −39.463 | 34.303 | 1.00 | 40.68 | D000 O |
| ATOM | 4420 | N | THR | C | 279 | −19.346 | −41.717 | 37.297 | 1.00 | 27.04 | D000 N |
| ATOM | 4421 | CA | THR | C | 279 | −19.453 | −43.132 | 36.963 | 1.00 | 34.21 | D000 C |
| ATOM | 4422 | C | THR | C | 279 | −19.688 | −43.285 | 35.460 | 1.00 | 36.69 | D000 C |
| ATOM | 4423 | O | THR | C | 279 | −19.848 | −42.296 | 34.746 | 1.00 | 39.25 | D000 O |
| ATOM | 4424 | CB | THR | C | 279 | −20.586 | −43.826 | 37.758 | 1.00 | 39.26 | D000 C |
| ATOM | 4425 | CG2 | THR | C | 279 | −21.950 | −43.311 | 37.326 | 1.00 | 34.73 | D000 C |
| ATOM | 4426 | OG1 | THR | C | 279 | −20.522 | −45.244 | 37.554 | 1.00 | 42.37 | D000 O |
| ATOM | 4427 | N | GLU | C | 280 | −19.704 | −44.522 | 34.980 | 1.00 | 32.85 | D000 N |
| ATOM | 4428 | CA | GLU | C | 280 | −19.835 | −44.782 | 33.548 | 1.00 | 50.68 | D000 C |
| ATOM | 4429 | C | GLU | C | 280 | −21.239 | −45.225 | 33.156 | 1.00 | 52.22 | D000 C |
| ATOM | 4430 | O | GLU | C | 280 | −22.086 | −45.481 | 34.011 | 1.00 | 55.73 | D000 O |
| ATOM | 4431 | CB | GLU | C | 280 | −18.829 | −45.846 | 33.118 | 1.00 | 52.68 | D000 C |
| ATOM | 4432 | CG | GLU | C | 280 | −17.416 | −45.583 | 33.593 | 1.00 | 64.50 | D000 C |
| ATOM | 4433 | CD | GLU | C | 280 | −16.653 | −46.863 | 33.862 | 1.00 | 89.69 | D000 C |
| ATOM | 4434 | OE1 | GLU | C | 280 | −17.283 | −47.943 | 33.861 | 1.00 | 93.00 | D000 O |
| ATOM | 4435 | OE2 | GLU | C | 280 | −15.424 | −46.790 | 34.078 | 1.00 | 104.15 | D000 O |
| ATOM | 4436 | O | LEU | C | 281 | −22.641 | −47.686 | 29.761 | 1.00 | 76.02 | D000 O |
| ATOM | 4437 | N | LEU | C | 281 | −21.477 | −45.319 | 31.852 | 1.00 | 63.81 | D000 N |
| ATOM | 4438 | CA | LEU | C | 281 | −22.728 | −45.870 | 31.340 | 1.00 | 65.22 | D000 C |
| ATOM | 4439 | C | LEU | C | 281 | −22.565 | −47.338 | 30.941 | 1.00 | 72.08 | D000 C |
| ATOM | 4440 | CB | LEU | C | 281 | −23.228 | −45.044 | 30.158 | 1.00 | 59.22 | D000 C |
| ATOM | 4441 | CG | LEU | C | 281 | −23.879 | −43.727 | 30.578 | 1.00 | 63.11 | D000 C |
| ATOM | 4442 | CD1 | LEU | C | 281 | −24.279 | −42.891 | 29.370 | 1.00 | 48.41 | D000 C |
| ATOM | 4443 | CD2 | LEU | C | 281 | −25.083 | −44.021 | 31.458 | 1.00 | 67.92 | D000 C |
| ATOM | 4444 | O | ASP | C | 282 | −20.760 | −51.176 | 30.617 | 1.00 | 50.93 | D000 O |
| ATOM | 4445 | N | ASP | C | 282 | −22.342 | −48.183 | 31.947 | 1.00 | 77.43 | D000 N |
| ATOM | 4446 | CA | ASP | C | 282 | −22.184 | −49.629 | 31.778 | 1.00 | 80.26 | D000 C |
| ATOM | 4447 | C | ASP | C | 282 | −21.144 | −50.009 | 30.726 | 1.00 | 71.14 | D000 C |
| ATOM | 4448 | CB | ASP | C | 282 | −23.529 | −50.272 | 31.433 | 1.00 | 81.46 | D000 C |
| ATOM | 4449 | CG | ASP | C | 282 | −24.448 | −50.366 | 32.632 | 1.00 | 80.75 | D000 C |
| ATOM | 4450 | OD1 | ASP | C | 282 | −24.417 | −49.445 | 33.476 | 1.00 | 77.18 | D000 O |
| ATOM | 4451 | OD2 | ASP | C | 282 | −25.192 | −51.364 | 32.736 | 1.00 | 78.02 | D000 O |

TABLE 10.2-continued

TER

TABLE 10.3

| | | | | | | | | | | | |
|---|---|---|---|---|---|---|---|---|---|---|---|
| ATOM | 1 | N | GLN | C | 1 | 12.778 | 87.875 | 6.343 | 1.00 | 63.46 | N |
| ATOM | 2 | CA | GLN | C | 1 | 12.935 | 86.437 | 6.168 | 1.00 | 57.97 | C |
| ATOM | 3 | C | GLN | C | 1 | 11.798 | 85.716 | 6.845 | 1.00 | 55.78 | C |
| ATOM | 4 | O | GLN | C | 1 | 11.088 | 86.308 | 7.656 | 1.00 | 58.48 | O |
| ATOM | 5 | CB | GLN | C | 1 | 14.271 | 85.946 | 6.714 | 1.00 | 51.88 | C |
| ATOM | 6 | CG | GLN | C | 1 | 14.814 | 84.739 | 5.974 | 1.00 | 59.79 | C |
| ATOM | 7 | CD | GLN | C | 1 | 14.717 | 84.869 | 4.445 | 1.00 | 78.61 | C |
| ATOM | 8 | OE1 | GLN | C | 1 | 14.676 | 85.980 | 3.896 | 1.00 | 61.52 | O |
| ATOM | 9 | NE2 | GLN | C | 1 | 14.669 | 83.721 | 3.753 | 1.00 | 84.10 | N |
| ATOM | 10 | N | VAL | C | 2 | 11.615 | 84.445 | 6.497 | 1.00 | 50.14 | N |
| ATOM | 11 | CA | VAL | C | 2 | 10.404 | 83.710 | 6.828 | 1.00 | 46.16 | C |
| ATOM | 12 | C | VAL | C | 2 | 10.800 | 82.363 | 7.396 | 1.00 | 45.45 | C |
| ATOM | 13 | O | VAL | C | 2 | 11.642 | 81.667 | 6.822 | 1.00 | 49.37 | O |
| ATOM | 14 | CB | VAL | C | 2 | 9.493 | 83.521 | 5.596 | 1.00 | 45.22 | C |
| ATOM | 15 | CG1 | VAL | C | 2 | 8.322 | 82.567 | 5.911 | 1.00 | 45.47 | C |
| ATOM | 16 | CG2 | VAL | C | 2 | 8.965 | 84.848 | 5.109 | 1.00 | 40.64 | C |
| ATOM | 17 | N | GLN | C | 3 | 10.163 | 81.983 | 8.498 | 1.00 | 50.52 | N |
| ATOM | 18 | CA | GLN | C | 3 | 10.262 | 80.648 | 9.066 | 1.00 | 49.86 | C |
| ATOM | 19 | C | GLN | C | 3 | 8.856 | 80.074 | 9.158 | 1.00 | 45.53 | C |
| ATOM | 20 | O | GLN | C | 3 | 7.924 | 80.766 | 9.596 | 1.00 | 40.46 | O |
| ATOM | 21 | CB | GLN | C | 3 | 10.933 | 80.674 | 10.449 | 1.00 | 52.58 | C |
| ATOM | 22 | CG | GLN | C | 3 | 12.476 | 80.689 | 10.448 | 1.00 | 67.48 | C |
| ATOM | 23 | CD | GLN | C | 3 | 13.103 | 82.051 | 10.135 | 1.00 | 74.06 | C |
| ATOM | 24 | OE1 | GLN | C | 3 | 12.444 | 83.102 | 10.186 | 1.00 | 75.22 | O |
| ATOM | 25 | NE2 | GLN | C | 3 | 14.394 | 82.033 | 9.811 | 1.00 | 80.56 | N |
| ATOM | 26 | N | LEU | C | 4 | 8.702 | 78.828 | 8.714 | 1.00 | 36.58 | N |
| ATOM | 27 | CA | LEU | C | 4 | 7.451 | 78.093 | 8.811 | 1.00 | 35.24 | C |
| ATOM | 28 | C | LEU | C | 4 | 7.674 | 76.836 | 9.634 | 1.00 | 35.32 | C |
| ATOM | 29 | O | LEU | C | 4 | 8.563 | 76.043 | 9.319 | 1.00 | 34.10 | O |
| ATOM | 30 | CB | LEU | C | 4 | 6.925 | 77.728 | 7.417 | 1.00 | 35.59 | C |
| ATOM | 31 | CG | LEU | C | 4 | 6.747 | 78.896 | 6.452 | 1.00 | 38.97 | C |
| ATOM | 32 | CD1 | LEU | C | 4 | 6.422 | 78.423 | 5.045 | 1.00 | 39.74 | C |
| ATOM | 33 | CD2 | LEU | C | 4 | 5.653 | 79.806 | 6.970 | 1.00 | 42.54 | C |
| ATOM | 34 | N | VAL | C | 5 | 6.835 | 76.623 | 10.647 | 1.00 | 40.31 | N |
| ATOM | 35 | CA | VAL | C | 5 | 6.970 | 75.492 | 11.568 | 1.00 | 38.30 | C |
| ATOM | 36 | C | VAL | C | 5 | 5.625 | 74.776 | 11.675 | 1.00 | 41.55 | C |
| ATOM | 37 | O | VAL | C | 5 | 4.663 | 75.325 | 12.232 | 1.00 | 47.07 | O |
| ATOM | 38 | CB | VAL | C | 5 | 7.451 | 75.939 | 12.956 | 1.00 | 35.88 | C |
| ATOM | 39 | CG1 | VAL | C | 5 | 7.568 | 74.743 | 13.871 | 1.00 | 36.28 | C |
| ATOM | 40 | CG2 | VAL | C | 5 | 8.763 | 76.660 | 12.847 | 1.00 | 26.29 | C |
| ATOM | 41 | N | GLU | C | 6 | 5.558 | 73.556 | 11.169 | 1.00 | 42.37 | N |
| ATOM | 42 | CA | GLU | C | 6 | 4.354 | 72.741 | 11.241 | 1.00 | 43.70 | C |
| ATOM | 43 | C | GLU | C | 6 | 4.281 | 71.970 | 12.559 | 1.00 | 43.98 | C |
| ATOM | 44 | O | GLU | C | 6 | 5.290 | 71.677 | 13.196 | 1.00 | 49.49 | O |
| ATOM | 45 | CB | GLU | C | 6 | 4.290 | 71.749 | 10.081 | 1.00 | 44.93 | C |
| ATOM | 46 | CG | GLU | C | 6 | 4.481 | 72.363 | 8.699 | 1.00 | 44.29 | C |
| ATOM | 47 | CD | GLU | C | 6 | 5.949 | 72.419 | 8.267 | 1.00 | 44.27 | C |
| ATOM | 48 | OE1 | GLU | C | 6 | 6.215 | 72.317 | 7.041 | 1.00 | 42.60 | O |
| ATOM | 49 | OE2 | GLU | C | 6 | 6.832 | 72.490 | 9.153 | 1.00 | 47.85 | O1− |
| ATOM | 50 | N | SER | C | 7 | 3.061 | 71.619 | 12.950 | 1.00 | 48.19 | N |
| ATOM | 51 | CA | SER | C | 7 | 2.851 | 70.788 | 14.128 | 1.00 | 51.74 | C |
| ATOM | 52 | C | SER | C | 7 | 1.509 | 70.084 | 13.994 | 1.00 | 45.51 | C |
| ATOM | 53 | O | SER | C | 7 | 0.681 | 70.437 | 13.151 | 1.00 | 43.94 | O |
| ATOM | 54 | CB | SER | C | 7 | 2.904 | 71.620 | 15.410 | 1.00 | 38.38 | C |
| ATOM | 55 | OG | SER | C | 7 | 1.907 | 72.623 | 15.354 | 1.00 | 49.56 | O |
| ATOM | 56 | N | GLY | C | 8 | 1.310 | 69.067 | 14.829 | 1.00 | 48.93 | N |
| ATOM | 57 | CA | GLY | C | 8 | 0.030 | 68.405 | 14.930 | 1.00 | 34.09 | C |
| ATOM | 58 | C | GLY | C | 8 | −0.065 | 67.069 | 14.246 | 1.00 | 43.11 | C |
| ATOM | 59 | O | GLY | C | 8 | −1.148 | 66.466 | 14.255 | 1.00 | 46.79 | O |
| ATOM | 60 | N | GLY | C | 9 | 1.015 | 66.567 | 13.666 | 1.00 | 37.58 | N |
| ATOM | 61 | CA | GLY | C | 9 | 0.947 | 65.229 | 13.116 | 1.00 | 47.86 | C |
| ATOM | 62 | C | GLY | C | 9 | 0.747 | 64.199 | 14.226 | 1.00 | 51.47 | C |
| ATOM | 63 | O | GLY | C | 9 | 0.716 | 64.509 | 15.419 | 1.00 | 54.50 | O |
| ATOM | 64 | N | GLY | C | 10 | 0.731 | 62.943 | 13.833 | 1.00 | 46.74 | N |
| ATOM | 65 | CA | GLY | C | 10 | 0.618 | 61.871 | 14.804 | 1.00 | 46.77 | C |
| ATOM | 66 | C | GLY | C | 10 | −0.035 | 60.648 | 14.193 | 1.00 | 52.50 | C |
| ATOM | 67 | O | GLY | C | 10 | −0.310 | 60.586 | 12.994 | 1.00 | 47.51 | O |
| ATOM | 68 | N | VAL | C | 11 | −0.256 | 59.651 | 15.049 | 1.00 | 51.48 | N |
| ATOM | 69 | CA | VAL | C | 11 | −0.832 | 58.380 | 14.625 | 1.00 | 53.97 | C |
| ATOM | 70 | C | VAL | C | 11 | −2.320 | 58.434 | 14.900 | 1.00 | 52.43 | C |
| ATOM | 71 | O | VAL | C | 11 | −2.739 | 58.881 | 15.975 | 1.00 | 50.83 | O |
| ATOM | 72 | CB | VAL | C | 11 | −0.183 | 57.184 | 15.345 | 1.00 | 43.91 | C |
| ATOM | 73 | CG1 | VAL | C | 11 | −0.742 | 55.891 | 14.787 | 1.00 | 43.96 | C |

TABLE 10.3-continued

| | | | | | | | | | | |
|---|---|---|---|---|---|---|---|---|---|---|
| ATOM | 74 | CG2 | VAL | C | 11 | 1.317 | 57.226 | 15.201 | 1.00 | 43.94 | C |
| ATOM | 75 | N | VAL | C | 12 | −3.117 | 58.015 | 13.916 | 1.00 | 45.99 | N |
| ATOM | 76 | CA | VAL | C | 12 | −4.570 | 58.072 | 13.996 | 1.00 | 46.88 | C |
| ATOM | 77 | C | VAL | C | 12 | −5.115 | 56.950 | 13.139 | 1.00 | 46.73 | C |
| ATOM | 78 | O | VAL | C | 12 | −4.469 | 56.494 | 12.191 | 1.00 | 47.91 | O |
| ATOM | 79 | CB | VAL | C | 12 | −5.179 | 59.425 | 13.540 | 1.00 | 47.29 | C |
| ATOM | 80 | CG1 | VAL | C | 12 | −4.763 | 60.547 | 14.468 | 1.00 | 46.14 | C |
| ATOM | 81 | CG2 | VAL | C | 12 | −4.755 | 59.739 | 12.130 | 1.00 | 48.50 | C |
| ATOM | 82 | N | GLN | C | 13 | −6.316 | 56.547 | 13.443 | 1.00 | 51.98 | N |
| ATOM | 83 | CA | GLN | C | 13 | −7.001 | 55.451 | 12.787 | 1.00 | 48.11 | C |
| ATOM | 84 | C | GLN | C | 13 | −7.748 | 55.950 | 11.559 | 1.00 | 42.02 | C |
| ATOM | 85 | O | GLN | C | 13 | −8.237 | 57.082 | 11.548 | 1.00 | 45.22 | O |
| ATOM | 86 | CB | GLN | C | 13 | −8.005 | 54.841 | 13.740 | 1.00 | 57.37 | C |
| ATOM | 87 | CG | GLN | C | 13 | −7.409 | 54.422 | 15.035 | 1.00 | 67.65 | C |
| ATOM | 88 | CD | GLN | C | 13 | −8.286 | 53.439 | 15.730 | 1.00 | 79.97 | C |
| ATOM | 89 | OE1 | GLN | C | 13 | −8.845 | 53.737 | 16.788 | 1.00 | 93.60 | O |
| ATOM | 90 | NE2 | GLN | C | 13 | −8.446 | 52.258 | 15.130 | 1.00 | 91.83 | N |
| ATOM | 91 | N | PRO | C | 14 | −7.878 | 55.101 | 10.541 | 1.00 | 38.64 | N |
| ATOM | 92 | CA | PRO | C | 14 | −8.652 | 55.475 | 9.351 | 1.00 | 37.32 | C |
| ATOM | 93 | C | PRO | C | 14 | −10.050 | 55.954 | 9.725 | 1.00 | 48.06 | C |
| ATOM | 94 | O | PRO | C | 14 | −10.688 | 55.419 | 10.634 | 1.00 | 50.66 | O |
| ATOM | 95 | CB | PRO | C | 14 | −8.711 | 54.174 | 8.539 | 1.00 | 35.18 | C |
| ATOM | 96 | CG | PRO | C | 14 | −7.556 | 53.370 | 9.005 | 1.00 | 40.76 | C |
| ATOM | 97 | CD | PRO | C | 14 | −7.351 | 53.727 | 10.456 | 1.00 | 40.72 | C |
| ATOM | 98 | N | GLY | C | 15 | −10.525 | 56.982 | 9.023 | 1.00 | 45.47 | N |
| ATOM | 99 | CA | GLY | C | 15 | −11.836 | 57.526 | 9.264 | 1.00 | 39.13 | C |
| ATOM | 100 | C | GLY | C | 15 | −11.886 | 58.622 | 10.303 | 1.00 | 40.65 | C |
| ATOM | 101 | O | GLY | C | 15 | −12.887 | 59.331 | 10.374 | 1.00 | 51.10 | O |
| ATOM | 102 | N | ARG | C | 16 | −10.842 | 58.781 | 11.109 | 1.00 | 42.12 | N |
| ATOM | 103 | CA | ARG | C | 16 | −10.775 | 59.854 | 12.087 | 1.00 | 42.11 | C |
| ATOM | 104 | C | ARG | C | 16 | −10.275 | 61.158 | 11.450 | 1.00 | 49.72 | C |
| ATOM | 105 | O | ARG | C | 16 | −10.040 | 61.255 | 10.237 | 1.00 | 41.14 | O |
| ATOM | 106 | CB | ARG | C | 16 | −9.865 | 59.456 | 13.243 | 1.00 | 48.99 | C |
| ATOM | 107 | CG | ARG | C | 16 | −10.287 | 58.203 | 13.961 | 1.00 | 58.16 | C |
| ATOM | 108 | CD | ARG | C | 16 | −11.621 | 58.360 | 14.645 | 1.00 | 60.17 | C |
| ATOM | 109 | NE | ARG | C | 16 | −11.592 | 57.775 | 15.983 | 1.00 | 78.30 | N |
| ATOM | 110 | CZ | ARG | C | 16 | −12.669 | 57.597 | 16.743 | 1.00 | 90.64 | C |
| ATOM | 111 | NH1 | ARG | C | 16 | −13.866 | 57.952 | 16.295 | 1.00 | 92.41 | N1+ |
| ATOM | 112 | NH2 | ARG | C | 16 | −12.552 | 57.058 | 17.950 | 1.00 | 96.43 | N |
| ATOM | 113 | N | SER | C | 17 | −10.093 | 62.174 | 12.299 | 1.00 | 44.14 | N |
| ATOM | 114 | CA | SER | C | 17 | −9.731 | 63.516 | 11.876 | 1.00 | 45.83 | C |
| ATOM | 115 | C | SER | C | 17 | −8.490 | 63.998 | 12.604 | 1.00 | 44.89 | C |
| ATOM | 116 | O | SER | C | 17 | −8.207 | 63.600 | 13.738 | 1.00 | 51.51 | O |
| ATOM | 117 | CB | SER | C | 17 | −10.853 | 64.535 | 12.132 | 1.00 | 45.46 | C |
| ATOM | 118 | OG | SER | C | 17 | −11.938 | 64.263 | 11.274 | 1.00 | 59.74 | O |
| ATOM | 119 | N | LEU | C | 18 | −7.817 | 64.947 | 11.961 | 1.00 | 41.62 | N |
| ATOM | 120 | CA | LEU | C | 18 | −6.610 | 65.573 | 12.473 | 1.00 | 44.03 | C |
| ATOM | 121 | C | LEU | C | 18 | −6.536 | 66.971 | 11.886 | 1.00 | 41.33 | C |
| ATOM | 122 | O | LEU | C | 18 | −6.961 | 67.203 | 10.756 | 1.00 | 44.87 | O |
| ATOM | 123 | CB | LEU | C | 18 | −5.366 | 64.772 | 12.079 | 1.00 | 41.97 | C |
| ATOM | 124 | CG | LEU | C | 18 | −4.114 | 64.794 | 12.940 | 1.00 | 54.29 | C |
| ATOM | 125 | CD1 | LEU | C | 18 | −4.440 | 64.407 | 14.380 | 1.00 | 50.61 | C |
| ATOM | 126 | CD2 | LEU | C | 18 | −3.075 | 63.836 | 12.334 | 1.00 | 49.38 | C |
| ATOM | 127 | N | ARG | C | 19 | −6.000 | 67.902 | 12.654 | 1.00 | 39.81 | N |
| ATOM | 128 | CA | ARG | C | 19 | −5.810 | 69.262 | 12.189 | 1.00 | 40.64 | C |
| ATOM | 129 | C | ARG | C | 19 | −4.334 | 69.605 | 12.283 | 1.00 | 48.86 | C |
| ATOM | 130 | O | ARG | C | 19 | −3.778 | 69.652 | 13.386 | 1.00 | 48.74 | O |
| ATOM | 131 | CB | ARG | C | 19 | −6.650 | 70.222 | 13.021 | 1.00 | 41.19 | C |
| ATOM | 132 | CG | ARG | C | 19 | −6.806 | 71.632 | 12.452 | 1.00 | 46.04 | C |
| ATOM | 133 | CD | ARG | C | 19 | −6.323 | 72.509 | 13.554 | 1.00 | 49.64 | C |
| ATOM | 134 | NE | ARG | C | 19 | −7.182 | 73.633 | 13.872 | 1.00 | 52.33 | N |
| ATOM | 135 | CZ | ARG | C | 19 | −6.947 | 74.447 | 14.900 | 1.00 | 60.69 | C |
| ATOM | 136 | NH1 | ARG | C | 19 | −5.914 | 74.205 | 15.702 | 1.00 | 60.16 | N1+ |
| ATOM | 137 | NH2 | ARG | C | 19 | −7.741 | 75.487 | 15.142 | 1.00 | 61.67 | N |
| ATOM | 138 | N | LEU | C | 20 | −3.716 | 69.890 | 11.137 | 1.00 | 44.47 | N |
| ATOM | 139 | CA | LEU | C | 20 | −2.328 | 70.331 | 11.121 | 1.00 | 42.17 | C |
| ATOM | 140 | C | LEU | C | 20 | −2.270 | 71.840 | 11.202 | 1.00 | 40.77 | C |
| ATOM | 141 | O | LEU | C | 20 | −3.145 | 72.544 | 10.691 | 1.00 | 39.38 | O |
| ATOM | 142 | CB | LEU | C | 20 | −1.591 | 69.860 | 9.864 | 1.00 | 32.38 | C |
| ATOM | 143 | CG | LEU | C | 20 | −1.658 | 68.360 | 9.649 | 1.00 | 39.39 | C |
| ATOM | 144 | CD1 | LEU | C | 20 | −0.808 | 67.907 | 8.483 | 1.00 | 38.47 | C |
| ATOM | 145 | CD2 | LEU | C | 20 | −1.266 | 67.633 | 10.930 | 1.00 | 41.15 | C |
| ATOM | 146 | N | SER | C | 21 | −1.221 | 72.328 | 11.845 | 1.00 | 39.02 | N |
| ATOM | 147 | CA | SER | C | 21 | −0.951 | 73.748 | 11.950 | 1.00 | 40.69 | C |
| ATOM | 148 | C | SER | C | 21 | 0.423 | 74.053 | 11.372 | 1.00 | 47.84 | C |
| ATOM | 149 | O | SER | C | 21 | 1.339 | 73.221 | 11.416 | 1.00 | 45.59 | O |
| ATOM | 150 | CB | SER | C | 21 | −1.011 | 74.211 | 13.397 | 1.00 | 38.57 | C |
| ATOM | 151 | OG | SER | C | 21 | −2.330 | 74.127 | 13.871 | 1.00 | 56.62 | O |
| ATOM | 152 | N | CYS | C | 22 | 0.546 | 75.263 | 10.834 | 1.00 | 38.99 | N |
| ATOM | 153 | CA | CYS | C | 22 | 1.795 | 75.794 | 10.299 | 1.00 | 44.99 | C |

TABLE 10.3-continued

| ATOM | 154 | C | CYS | C | 22 | 1.951 | 77.220 | 10.827 | 1.00 | 46.04 | C |
|---|---|---|---|---|---|---|---|---|---|---|---|
| ATOM | 155 | O | CYS | C | 22 | 1.172 | 78.113 | 10.465 | 1.00 | 41.82 | O |
| ATOM | 156 | CB | CYS | C | 22 | 1.788 | 75.761 | 8.768 | 1.00 | 44.73 | C |
| ATOM | 157 | SG | CYS | C | 22 | 3.139 | 76.705 | 7.941 | 1.00 | 52.54 | S |
| ATOM | 158 | N | ALA | C | 23 | 2.921 | 77.417 | 11.717 | 1.00 | 39.89 | N |
| ATOM | 159 | CA | ALA | C | 23 | 3.158 | 78.694 | 12.375 | 1.00 | 39.98 | C |
| ATOM | 160 | C | ALA | C | 23 | 4.271 | 79.454 | 11.659 | 1.00 | 41.32 | C |
| ATOM | 161 | O | ALA | C | 23 | 5.359 | 78.912 | 11.428 | 1.00 | 44.39 | O |
| ATOM | 162 | CB | ALA | C | 23 | 3.522 | 78.488 | 13.850 | 1.00 | 35.18 | C |
| ATOM | 163 | N | ALA | C | 24 | 3.999 | 80.703 | 11.327 | 1.00 | 39.85 | N |
| ATOM | 164 | CA | ALA | C | 24 | 4.895 | 81.524 | 10.537 | 1.00 | 43.27 | C |
| ATOM | 165 | C | ALA | C | 24 | 5.477 | 82.657 | 11.372 | 1.00 | 46.72 | C |
| ATOM | 166 | O | ALA | C | 24 | 4.801 | 83.237 | 12.220 | 1.00 | 48.85 | O |
| ATOM | 167 | CB | ALA | C | 24 | 4.157 | 82.110 | 9.339 | 1.00 | 38.90 | C |
| ATOM | 168 | N | SER | C | 25 | 6.720 | 83.018 | 11.076 | 1.00 | 44.32 | N |
| ATOM | 169 | CA | SER | C | 25 | 7.328 | 84.177 | 11.710 | 1.00 | 46.12 | C |
| ATOM | 170 | C | SER | C | 25 | 8.226 | 84.874 | 10.695 | 1.00 | 44.36 | C |
| ATOM | 171 | O | SER | C | 25 | 8.623 | 84.304 | 9.673 | 1.00 | 43.53 | O |
| ATOM | 172 | CB | SER | C | 25 | 8.122 | 83.783 | 12.966 | 1.00 | 46.62 | C |
| ATOM | 173 | OG | SER | C | 25 | 9.191 | 82.915 | 12.642 | 1.00 | 42.94 | O |
| ATOM | 174 | N | GLY | C | 26 | 8.563 | 86.112 | 11.001 | 1.00 | 46.40 | N |
| ATOM | 175 | CA | GLY | C | 26 | 9.394 | 86.915 | 10.124 | 1.00 | 42.45 | C |
| ATOM | 176 | C | GLY | C | 26 | 8.527 | 87.884 | 9.326 | 1.00 | 52.00 | C |
| ATOM | 177 | O | GLY | C | 26 | 7.673 | 88.572 | 9.891 | 1.00 | 48.03 | O |
| ATOM | 178 | N | PHE | C | 27 | 8.729 | 87.910 | 8.013 | 1.00 | 49.49 | N |
| ATOM | 179 | CA | PHE | C | 27 | 7.986 | 88.820 | 7.151 | 1.00 | 45.04 | C |
| ATOM | 180 | C | PHE | C | 27 | 6.479 | 88.576 | 7.273 | 1.00 | 44.14 | C |
| ATOM | 181 | O | PHE | C | 27 | 6.025 | 87.430 | 7.293 | 1.00 | 47.90 | O |
| ATOM | 182 | CB | PHE | C | 27 | 8.449 | 88.611 | 5.712 | 1.00 | 45.76 | C |
| ATOM | 183 | CG | PHE | C | 27 | 7.704 | 89.421 | 4.711 | 1.00 | 48.04 | C |
| ATOM | 184 | CD1 | PHE | C | 27 | 7.470 | 90.769 | 4.937 | 1.00 | 50.27 | C |
| ATOM | 185 | CD2 | PHE | C | 27 | 7.236 | 88.838 | 3.539 | 1.00 | 49.31 | C |
| ATOM | 186 | CE1 | PHE | C | 27 | 6.784 | 91.537 | 4.011 | 1.00 | 53.69 | C |
| ATOM | 187 | CE2 | PHE | C | 27 | 6.550 | 89.591 | 2.606 | 1.00 | 47.82 | C |
| ATOM | 188 | CZ | PHE | C | 27 | 6.320 | 90.951 | 2.846 | 1.00 | 49.54 | C |
| ATOM | 189 | N | THR | C | 28 | 5.709 | 89.671 | 7.335 | 1.00 | 44.86 | N |
| ATOM | 190 | CA | THR | C | 28 | 4.261 | 89.693 | 7.577 | 1.00 | 38.38 | C |
| ATOM | 191 | C | THR | C | 28 | 3.475 | 88.544 | 6.941 | 1.00 | 42.91 | C |
| ATOM | 192 | O | THR | C | 28 | 3.343 | 88.483 | 5.711 | 1.00 | 36.78 | O |
| ATOM | 193 | CB | THR | C | 28 | 3.679 | 90.998 | 7.038 | 1.00 | 49.68 | C |
| ATOM | 194 | OG1 | THR | C | 28 | 4.434 | 92.106 | 7.536 | 1.00 | 46.23 | O |
| ATOM | 195 | CG2 | THR | C | 28 | 2.208 | 91.133 | 7.410 | 1.00 | 44.54 | C |
| ATOM | 196 | N | PHE | C | 29 | 2.891 | 87.687 | 7.790 | 1.00 | 38.44 | N |
| ATOM | 197 | CA | PHE | C | 29 | 2.154 | 86.502 | 7.350 | 1.00 | 40.01 | C |
| ATOM | 198 | C | PHE | C | 29 | 1.089 | 86.822 | 6.304 | 1.00 | 36.82 | C |
| ATOM | 199 | O | PHE | C | 29 | 0.942 | 86.092 | 5.316 | 1.00 | 36.46 | O |
| ATOM | 200 | CB | PHE | C | 29 | 1.508 | 85.858 | 8.571 | 1.00 | 39.47 | C |
| ATOM | 201 | CG | PHE | C | 29 | 0.772 | 84.586 | 8.296 | 1.00 | 41.07 | C |
| ATOM | 202 | CD1 | PHE | C | 29 | 1.443 | 83.470 | 7.809 | 1.00 | 39.25 | C |
| ATOM | 203 | CD2 | PHE | C | 29 | −0.586 | 84.484 | 8.581 | 1.00 | 37.61 | C |
| ATOM | 204 | CE1 | PHE | C | 29 | 0.782 | 82.271 | 7.600 | 1.00 | 37.53 | C |
| ATOM | 205 | CE2 | PHE | C | 29 | −1.260 | 83.280 | 8.380 | 1.00 | 42.81 | C |
| ATOM | 206 | CZ | PHE | C | 29 | −0.575 | 82.170 | 7.878 | 1.00 | 41.35 | C |
| ATOM | 207 | N | SER | C | 30 | 0.352 | 87.917 | 6.489 | 1.00 | 34.06 | N |
| ATOM | 208 | CA | SER | C | 30 | −0.719 | 88.270 | 5.564 | 1.00 | 37.45 | C |
| ATOM | 209 | C | SER | C | 30 | −0.200 | 88.707 | 4.203 | 1.00 | 39.61 | C |
| ATOM | 210 | O | SER | C | 30 | −1.018 | 88.991 | 3.319 | 1.00 | 35.46 | O |
| ATOM | 211 | CB | SER | C | 30 | −1.587 | 89.392 | 6.141 | 1.00 | 31.23 | C |
| ATOM | 212 | OG | SER | C | 30 | −0.804 | 90.566 | 6.341 | 1.00 | 38.68 | O |
| ATOM | 213 | N | SER | C | 31 | 1.115 | 88.752 | 3.998 | 1.00 | 31.95 | N |
| ATOM | 214 | CA | SER | C | 31 | 1.653 | 89.144 | 2.705 | 1.00 | 42.10 | C |
| ATOM | 215 | C | SER | C | 31 | 1.858 | 87.979 | 1.743 | 1.00 | 36.93 | C |
| ATOM | 216 | O | SER | C | 31 | 2.347 | 88.199 | 0.629 | 1.00 | 40.45 | O |
| ATOM | 217 | CB | SER | C | 31 | 2.975 | 89.887 | 2.883 | 1.00 | 38.00 | C |
| ATOM | 218 | OG | SER | C | 31 | 2.725 | 91.165 | 3.425 | 1.00 | 50.55 | O |
| ATOM | 219 | N | TYR | C | 32 | 1.476 | 86.759 | 2.103 | 1.00 | 32.77 | N |
| ATOM | 220 | CA | TYR | C | 32 | 1.671 | 85.678 | 1.145 | 1.00 | 37.31 | C |
| ATOM | 221 | C | TYR | C | 32 | 0.613 | 84.597 | 1.312 | 1.00 | 35.54 | C |
| ATOM | 222 | O | TYR | C | 32 | 0.059 | 84.403 | 2.401 | 1.00 | 33.81 | O |
| ATOM | 223 | CB | TYR | C | 32 | 3.083 | 85.087 | 1.282 | 1.00 | 33.59 | C |
| ATOM | 224 | CG | TYR | C | 32 | 3.516 | 84.779 | 2.701 | 1.00 | 29.77 | C |
| ATOM | 225 | CD1 | TYR | C | 32 | 3.130 | 83.599 | 3.315 | 1.00 | 33.82 | C |
| ATOM | 226 | CD2 | TYR | C | 32 | 4.353 | 85.643 | 3.405 | 1.00 | 38.18 | C |
| ATOM | 227 | CE1 | TYR | C | 32 | 3.550 | 83.271 | 4.603 | 1.00 | 38.72 | C |
| ATOM | 228 | CE2 | TYR | C | 32 | 4.781 | 85.340 | 4.703 | 1.00 | 39.15 | C |
| ATOM | 229 | CZ | TYR | C | 32 | 4.365 | 84.145 | 5.296 | 1.00 | 45.73 | C |
| ATOM | 230 | OH | TYR | C | 32 | 4.741 | 83.816 | 6.579 | 1.00 | 41.78 | O |
| ATOM | 231 | N | GLY | C | 33 | 0.344 | 83.893 | 0.209 | 1.00 | 34.05 | N |
| ATOM | 232 | CA | GLY | C | 33 | −0.428 | 82.670 | 0.260 | 1.00 | 32.21 | C |
| ATOM | 233 | C | GLY | C | 33 | 0.446 | 81.497 | 0.679 | 1.00 | 39.56 | C |

TABLE 10.3-continued

| ATOM | 234 | O | GLY | C | 33 | 1.665 | 81.640 | 0.823 | 1.00 | 32.33 | O |
|---|---|---|---|---|---|---|---|---|---|---|---|
| ATOM | 235 | N | LEU | C | 34 | −0.196 | 80.340 | 0.907 | 1.00 | 32.53 | N |
| ATOM | 236 | CA | LEU | C | 34 | 0.521 | 79.169 | 1.401 | 1.00 | 34.46 | C |
| ATOM | 237 | C | LEU | C | 34 | −0.060 | 77.886 | 0.824 | 1.00 | 30.24 | C |
| ATOM | 238 | O | LEU | C | 34 | −1.200 | 77.841 | 0.360 | 1.00 | 33.75 | O |
| ATOM | 239 | CB | LEU | C | 34 | 0.515 | 79.085 | 2.933 | 1.00 | 38.99 | C |
| ATOM | 240 | CG | LEU | C | 34 | 1.236 | 80.236 | 3.655 | 1.00 | 41.08 | C |
| ATOM | 241 | CD1 | LEU | C | 34 | 0.223 | 81.245 | 4.217 | 1.00 | 33.75 | C |
| ATOM | 242 | CD2 | LEU | C | 34 | 2.165 | 79.704 | 4.725 | 1.00 | 35.97 | C |
| ATOM | 243 | N | HIS | C | 35 | 0.768 | 76.846 | 0.863 | 1.00 | 31.72 | N |
| ATOM | 244 | CA | HIS | C | 35 | 0.503 | 75.507 | 0.371 | 1.00 | 29.96 | C |
| ATOM | 245 | C | HIS | C | 35 | 0.618 | 74.498 | 1.498 | 1.00 | 33.37 | C |
| ATOM | 246 | O | HIS | C | 35 | 1.323 | 74.717 | 2.484 | 1.00 | 34.65 | O |
| ATOM | 247 | CB | HIS | C | 35 | 1.534 | 75.064 | −0.671 | 1.00 | 31.82 | C |
| ATOM | 248 | CG | HIS | C | 35 | 1.514 | 75.835 | −1.949 | 1.00 | 38.58 | C |
| ATOM | 249 | ND1 | HIS | C | 35 | 0.781 | 75.435 | −3.047 | 1.00 | 31.99 | N |
| ATOM | 250 | CD2 | HIS | C | 35 | 2.200 | 76.940 | −2.333 | 1.00 | 34.19 | C |
| ATOM | 251 | CE1 | HIS | C | 35 | 1.008 | 76.269 | −4.046 | 1.00 | 28.49 | C |
| ATOM | 252 | NE2 | HIS | C | 35 | 1.855 | 77.197 | −3.635 | 1.00 | 33.84 | N |
| ATOM | 253 | N | TRP | C | 36 | −0.010 | 73.347 | 1.298 | 1.00 | 29.55 | N |
| ATOM | 254 | CA | TRP | C | 36 | 0.381 | 72.110 | 1.957 | 1.00 | 30.04 | C |
| ATOM | 255 | C | TRP | C | 36 | 0.870 | 71.151 | 0.887 | 1.00 | 32.99 | C |
| ATOM | 256 | O | TRP | C | 36 | 0.217 | 70.995 | −0.149 | 1.00 | 33.39 | O |
| ATOM | 257 | CB | TRP | C | 36 | −0.771 | 71.490 | 2.735 | 1.00 | 30.51 | C |
| ATOM | 258 | CG | TRP | C | 36 | −1.084 | 72.233 | 3.977 | 1.00 | 36.65 | C |
| ATOM | 259 | CD1 | TRP | C | 36 | −2.063 | 73.191 | 4.152 | 1.00 | 36.08 | C |
| ATOM | 260 | CD2 | TRP | C | 36 | −0.447 | 72.073 | 5.246 | 1.00 | 33.16 | C |
| ATOM | 261 | NE1 | TRP | C | 36 | −2.055 | 73.637 | 5.456 | 1.00 | 34.80 | N |
| ATOM | 262 | CE2 | TRP | C | 36 | −1.073 | 72.972 | 6.146 | 1.00 | 31.89 | C |
| ATOM | 263 | CE3 | TRP | C | 36 | 0.602 | 71.272 | 5.706 | 1.00 | 33.27 | C |
| ATOM | 264 | CZ2 | TRP | C | 36 | −0.690 | 73.079 | 7.475 | 1.00 | 35.29 | C |
| ATOM | 265 | CZ3 | TRP | C | 36 | 0.976 | 71.373 | 7.022 | 1.00 | 36.31 | C |
| ATOM | 266 | CH2 | TRP | C | 36 | 0.334 | 72.276 | 7.898 | 1.00 | 37.43 | C |
| ATOM | 267 | N | VAL | C | 37 | 2.037 | 70.544 | 1.114 | 1.00 | 31.46 | N |
| ATOM | 268 | CA | VAL | C | 37 | 2.588 | 69.540 | 0.215 | 1.00 | 28.53 | C |
| ATOM | 269 | C | VAL | C | 37 | 2.937 | 68.334 | 1.066 | 1.00 | 37.43 | C |
| ATOM | 270 | O | VAL | C | 37 | 3.354 | 68.473 | 2.221 | 1.00 | 38.22 | O |
| ATOM | 271 | CB | VAL | C | 37 | 3.832 | 70.056 | −0.554 | 1.00 | 32.46 | C |
| ATOM | 272 | CG1 | VAL | C | 37 | 4.424 | 68.959 | −1.463 | 1.00 | 28.26 | C |
| ATOM | 273 | CG2 | VAL | C | 37 | 3.501 | 71.313 | −1.364 | 1.00 | 25.69 | C |
| ATOM | 274 | N | ARG | C | 38 | 2.787 | 67.142 | 0.503 | 1.00 | 30.65 | N |
| ATOM | 275 | CA | ARG | C | 38 | 3.030 | 65.960 | 1.303 | 1.00 | 35.42 | C |
| ATOM | 276 | C | ARG | C | 38 | 3.936 | 64.983 | 0.565 | 1.00 | 33.75 | C |
| ATOM | 277 | O | ARG | C | 38 | 4.133 | 65.061 | −0.657 | 1.00 | 31.48 | O |
| ATOM | 278 | CB | ARG | C | 38 | 1.721 | 65.273 | 1.714 | 1.00 | 31.04 | C |
| ATOM | 279 | CG | ARG | C | 38 | 1.037 | 64.459 | 0.654 | 1.00 | 31.84 | C |
| ATOM | 280 | CD | ARG | C | 38 | −0.318 | 63.986 | 1.190 | 1.00 | 28.76 | C |
| ATOM | 281 | NE | ARG | C | 38 | −1.059 | 63.233 | 0.184 | 1.00 | 33.40 | N |
| ATOM | 282 | CZ | ARG | C | 38 | −2.280 | 62.718 | 0.368 | 1.00 | 33.79 | C |
| ATOM | 283 | NH1 | ARG | C | 38 | −2.940 | 62.867 | 1.523 | 1.00 | 29.44 | N1+ |
| ATOM | 284 | NH2 | ARG | C | 38 | −2.845 | 62.057 | −0.617 | 1.00 | 27.56 | N |
| ATOM | 285 | N | GLN | C | 39 | 4.517 | 64.077 | 1.344 | 1.00 | 31.44 | N |
| ATOM | 286 | CA | GLN | C | 39 | 5.466 | 63.101 | 0.809 | 1.00 | 33.90 | C |
| ATOM | 287 | C | GLN | C | 39 | 5.299 | 61.833 | 1.621 | 1.00 | 30.60 | C |
| ATOM | 288 | O | GLN | C | 39 | 5.589 | 61.823 | 2.816 | 1.00 | 37.53 | O |
| ATOM | 289 | CB | GLN | C | 39 | 6.908 | 63.606 | 0.880 | 1.00 | 29.62 | C |
| ATOM | 290 | CG | GLN | C | 39 | 7.950 | 62.614 | 0.336 | 1.00 | 33.68 | C |
| ATOM | 291 | CD | GLN | C | 39 | 9.317 | 63.272 | 0.142 | 1.00 | 38.26 | C |
| ATOM | 292 | OE1 | GLN | C | 39 | 9.832 | 63.941 | 1.041 | 1.00 | 36.27 | O |
| ATOM | 293 | NE2 | GLN | C | 39 | 9.884 | 63.121 | −1.051 | 1.00 | 31.46 | N |
| ATOM | 294 | N | ALA | C | 40 | 4.806 | 60.795 | 0.980 | 1.00 | 33.74 | N |
| ATOM | 295 | CA | ALA | C | 40 | 4.687 | 59.501 | 1.621 | 1.00 | 42.24 | C |
| ATOM | 296 | C | ALA | C | 40 | 6.082 | 58.868 | 1.723 | 1.00 | 41.93 | C |
| ATOM | 297 | O | ALA | C | 40 | 6.967 | 59.180 | 0.921 | 1.00 | 39.79 | O |
| ATOM | 298 | CB | ALA | C | 40 | 3.726 | 58.625 | 0.811 | 1.00 | 21.89 | C |
| ATOM | 299 | N | PRO | C | 41 | 6.304 | 57.974 | 2.691 | 1.00 | 47.02 | N |
| ATOM | 300 | CA | PRO | C | 41 | 7.671 | 57.444 | 2.920 | 1.00 | 46.31 | C |
| ATOM | 301 | C | PRO | C | 41 | 8.252 | 56.774 | 1.681 | 1.00 | 40.48 | C |
| ATOM | 302 | O | PRO | C | 41 | 7.677 | 55.834 | 1.127 | 1.00 | 49.95 | O |
| ATOM | 303 | CB | PRO | C | 41 | 7.475 | 56.438 | 4.065 | 1.00 | 38.60 | C |
| ATOM | 304 | CG | PRO | C | 41 | 6.179 | 56.872 | 4.754 | 1.00 | 43.78 | C |
| ATOM | 305 | CD | PRO | C | 41 | 5.319 | 57.433 | 3.651 | 1.00 | 44.84 | C |
| ATOM | 306 | N | GLY | C | 42 | 9.416 | 57.254 | 1.256 | 1.00 | 49.67 | N |
| ATOM | 307 | CA | GLY | C | 42 | 10.049 | 56.738 | 0.054 | 1.00 | 47.19 | C |
| ATOM | 308 | C | GLY | C | 42 | 9.476 | 57.189 | −1.279 | 1.00 | 48.22 | C |
| ATOM | 309 | O | GLY | C | 42 | 9.825 | 56.588 | −2.300 | 1.00 | 45.62 | O |
| ATOM | 310 | N | LYS | C | 43 | 8.627 | 58.223 | −1.325 | 1.00 | 42.77 | N |
| ATOM | 311 | CA | LYS | C | 43 | 7.904 | 58.581 | −2.556 | 1.00 | 40.19 | C |
| ATOM | 312 | C | LYS | C | 43 | 8.149 | 60.040 | −2.956 | 1.00 | 36.26 | C |
| ATOM | 313 | O | LYS | C | 43 | 8.895 | 60.789 | −2.310 | 1.00 | 41.39 | O |

TABLE 10.3-continued

| | | | | | | | | | | |
|---|---|---|---|---|---|---|---|---|---|---|
| ATOM | 314 | CB | LYS | C | 43 | 6.402 | 58.338 | −2.390 | 1.00 | 43.74 | C |
| ATOM | 315 | CG | LYS | C | 43 | 6.020 | 56.900 | −2.068 | 1.00 | 44.39 | C |
| ATOM | 316 | CD | LYS | C | 43 | 6.527 | 55.936 | −3.112 | 1.00 | 56.25 | C |
| ATOM | 317 | CE | LYS | C | 43 | 5.920 | 54.540 | −2.918 | 1.00 | 72.49 | C |
| ATOM | 318 | NZ | LYS | C | 43 | 6.709 | 53.467 | −3.617 | 1.00 | 73.82 | N1+ |
| ATOM | 319 | N | GLY | C | 44 | 7.498 | 60.457 | −4.036 | 1.00 | 35.63 | N |
| ATOM | 320 | CA | GLY | C | 44 | 7.709 | 61.788 | −4.551 | 1.00 | 29.55 | C |
| ATOM | 321 | C | GLY | C | 44 | 6.833 | 62.802 | −3.843 | 1.00 | 34.99 | C |
| ATOM | 322 | O | GLY | C | 44 | 6.008 | 62.475 | −2.990 | 1.00 | 36.77 | O |
| ATOM | 323 | N | LEU | C | 45 | 7.026 | 64.067 | −4.205 | 1.00 | 30.55 | N |
| ATOM | 324 | CA | LEU | C | 45 | 6.192 | 65.134 | −3.664 | 1.00 | 32.18 | C |
| ATOM | 325 | C | LEU | C | 45 | 4.783 | 65.057 | −4.257 | 1.00 | 31.76 | C |
| ATOM | 326 | O | LEU | C | 45 | 4.597 | 64.740 | −5.440 | 1.00 | 25.93 | O |
| ATOM | 327 | CB | LEU | C | 45 | 6.820 | 66.508 | −3.939 | 1.00 | 31.66 | C |
| ATOM | 328 | CG | LEU | C | 45 | 8.233 | 66.714 | −3.370 | 1.00 | 32.55 | C |
| ATOM | 329 | CD1 | LEU | C | 45 | 8.776 | 68.091 | −3.682 | 1.00 | 27.48 | C |
| ATOM | 330 | CD2 | LEU | C | 45 | 8.219 | 66.491 | −1.871 | 1.00 | 28.43 | C |
| ATOM | 331 | N | GLU | C | 46 | 3.784 | 65.298 | −3.413 | 1.00 | 27.12 | N |
| ATOM | 332 | CA | GLU | C | 46 | 2.404 | 65.402 | −3.865 | 1.00 | 32.84 | C |
| ATOM | 333 | C | GLU | C | 46 | 1.799 | 66.669 | −3.286 | 1.00 | 32.06 | C |
| ATOM | 334 | O | GLU | C | 46 | 1.754 | 66.837 | −2.062 | 1.00 | 31.76 | O |
| ATOM | 335 | CB | GLU | C | 46 | 1.579 | 64.183 | −3.451 | 1.00 | 36.78 | C |
| ATOM | 336 | CG | GLU | C | 46 | 0.226 | 64.173 | −4.126 | 1.00 | 44.38 | C |
| ATOM | 337 | CD | GLU | C | 46 | −0.758 | 63.166 | −3.539 | 1.00 | 46.89 | C |
| ATOM | 338 | OE1 | GLU | C | 46 | −0.435 | 62.467 | −2.548 | 1.00 | 45.34 | O |
| ATOM | 339 | OE2 | GLU | C | 46 | −1.871 | 63.088 | −4.092 | 1.00 | 50.23 | O1− |
| ATOM | 340 | N | TRP | C | 47 | 1.330 | 67.548 | −4.162 | 1.00 | 27.92 | N |
| ATOM | 341 | CA | TRP | C | 47 | 0.676 | 68.764 | −3.715 | 1.00 | 31.90 | C |
| ATOM | 342 | C | TRP | C | 47 | −0.664 | 68.439 | −3.079 | 1.00 | 31.01 | C |
| ATOM | 343 | O | TRP | C | 47 | −1.386 | 67.555 | −3.546 | 1.00 | 32.31 | O |
| ATOM | 344 | CB | TRP | C | 47 | 0.485 | 69.713 | −4.900 | 1.00 | 35.33 | C |
| ATOM | 345 | CG | TRP | C | 47 | −0.297 | 70.972 | −4.630 | 1.00 | 30.11 | C |
| ATOM | 346 | CD1 | TRP | C | 47 | 0.104 | 72.068 | −3.910 | 1.00 | 29.39 | C |
| ATOM | 347 | CD2 | TRP | C | 47 | −1.616 | 71.270 | −5.118 | 1.00 | 29.40 | C |
| ATOM | 348 | NE1 | TRP | C | 47 | −0.886 | 73.032 | −3.925 | 1.00 | 32.24 | N |
| ATOM | 349 | CE2 | TRP | C | 47 | −1.952 | 72.563 | −4.660 | 1.00 | 34.57 | C |
| ATOM | 350 | CE3 | TRP | C | 47 | −2.534 | 70.575 | −5.913 | 1.00 | 30.62 | C |
| ATOM | 351 | CZ2 | TRP | C | 47 | −3.190 | 73.165 | −4.958 | 1.00 | 29.29 | C |
| ATOM | 352 | CZ3 | TRP | C | 47 | −3.764 | 71.177 | −6.215 | 1.00 | 31.59 | C |
| ATOM | 353 | CH2 | TRP | C | 47 | −4.075 | 72.459 | −5.736 | 1.00 | 32.18 | C |
| ATOM | 354 | N | VAL | C | 48 | −1.010 | 69.189 | −2.031 | 1.00 | 31.17 | N |
| ATOM | 355 | CA | VAL | C | 48 | −2.268 | 69.019 | −1.303 | 1.00 | 28.29 | C |
| ATOM | 356 | C | VAL | C | 48 | −3.239 | 70.192 | −1.553 | 1.00 | 34.03 | C |
| ATOM | 357 | O | VAL | C | 48 | −4.371 | 69.989 | −2.002 | 1.00 | 29.40 | O |
| ATOM | 358 | CB | VAL | C | 48 | −2.007 | 68.824 | 0.206 | 1.00 | 29.92 | C |
| ATOM | 359 | CG1 | VAL | C | 48 | −3.321 | 68.671 | 0.944 | 1.00 | 32.67 | C |
| ATOM | 360 | CG2 | VAL | C | 48 | −1.117 | 67.606 | 0.433 | 1.00 | 28.26 | C |
| ATOM | 361 | N | ALA | C | 49 | −2.825 | 71.421 | −1.237 | 1.00 | 30.79 | N |
| ATOM | 362 | CA | ALA | C | 49 | −3.747 | 72.546 | −1.373 | 1.00 | 31.82 | C |
| ATOM | 363 | C | ALA | C | 49 | −2.974 | 73.854 | −1.325 | 1.00 | 32.29 | C |
| ATOM | 364 | O | ALA | C | 49 | −1.845 | 73.908 | −0.823 | 1.00 | 30.87 | O |
| ATOM | 365 | CB | ALA | C | 49 | −4.821 | 72.517 | −0.277 | 1.00 | 30.36 | C |
| ATOM | 366 | N | AVAL | C | 50 | −3.605 | 74.914 | −1.835 | 0.50 | 31.84 | N |
| ATOM | 367 | CA | AVAL | C | 50 | −3.060 | 76.269 | −1.763 | 0.50 | 30.56 | C |
| ATOM | 368 | C | AVAL | C | 50 | −4.179 | 77.222 | −1.373 | 0.50 | 31.68 | C |
| ATOM | 369 | O | AVAL | C | 50 | −5.333 | 77.047 | −1.784 | 0.50 | 29.47 | O |
| ATOM | 370 | CB | AVAL | C | 50 | −2.408 | 76.711 | −3.093 | 0.50 | 30.12 | C |
| ATOM | 371 | CG1 | AVAL | C | 50 | −3.459 | 76.855 | −4.204 | 0.50 | 28.96 | C |
| ATOM | 372 | CG2 | AVAL | C | 50 | −1.624 | 77.987 | −2.912 | 0.50 | 24.87 | C |
| ATOM | 373 | N | BVAL | C | 50 | −3.584 | 74.900 | −1.900 | 0.50 | 32.14 | N |
| ATOM | 374 | CA | BVAL | C | 50 | −3.117 | 76.279 | −1.776 | 0.50 | 30.77 | C |
| ATOM | 375 | C | BVAL | C | 50 | −4.231 | 77.106 | −1.160 | 0.50 | 31.70 | C |
| ATOM | 376 | O | BVAL | C | 50 | −5.415 | 76.765 | −1.240 | 0.50 | 30.32 | O |
| ATOM | 377 | CB | BVAL | C | 50 | −2.698 | 76.932 | −3.115 | 0.50 | 30.01 | C |
| ATOM | 378 | CG1 | BVAL | C | 50 | −2.103 | 75.960 | −4.000 | 0.50 | 36.11 | C |
| ATOM | 379 | CG2 | BVAL | C | 50 | −3.896 | 77.491 | −3.831 | 0.50 | 31.66 | C |
| ATOM | 380 | N | ILE | C | 51 | −3.834 | 78.232 | −0.574 | 1.00 | 31.49 | N |
| ATOM | 381 | CA | ILE | C | 51 | −4.770 | 79.260 | −0.151 | 1.00 | 28.89 | C |
| ATOM | 382 | C | ILE | C | 51 | −4.143 | 80.593 | −0.519 | 1.00 | 37.27 | C |
| ATOM | 383 | O | ILE | C | 51 | −2.913 | 80.736 | −0.534 | 1.00 | 32.74 | O |
| ATOM | 384 | CB | ILE | C | 51 | −5.085 | 79.203 | 1.356 | 1.00 | 33.18 | C |
| ATOM | 385 | CG1 | ILE | C | 51 | −6.238 | 80.154 | 1.691 | 1.00 | 31.97 | C |
| ATOM | 386 | CG2 | ILE | C | 51 | −3.837 | 79.550 | 2.210 | 1.00 | 26.57 | C |
| ATOM | 387 | CD1 | ILE | C | 51 | −6.766 | 79.971 | 3.093 | 1.00 | 31.63 | C |
| ATOM | 388 | N | TRP | C | 52 | −5.000 | 81.561 | −0.838 | 1.00 | 30.70 | N |
| ATOM | 389 | CA | TRP | C | 52 | −4.563 | 82.882 | −1.241 | 1.00 | 25.99 | C |
| ATOM | 390 | C | TRP | C | 52 | −4.040 | 83.652 | −0.036 | 1.00 | 29.12 | C |
| ATOM | 391 | O | TRP | C | 52 | −4.302 | 83.303 | 1.117 | 1.00 | 36.14 | O |
| ATOM | 392 | CB | TRP | C | 52 | −5.722 | 83.638 | −1.898 | 1.00 | 27.78 | C |
| ATOM | 393 | CG | TRP | C | 52 | −5.405 | 84.135 | −3.270 | 1.00 | 33.59 | C |

TABLE 10.3-continued

| | | | | | | | | | | | |
|---|---|---|---|---|---|---|---|---|---|---|---|
| ATOM | 394 | CD1 | TRP | C | 52 | −5.333 | 85.445 | −3.676 | 1.00 | 32.68 | C |
| ATOM | 395 | CD2 | TRP | C | 52 | −5.102 | 83.340 | −4.426 | 1.00 | 30.76 | C |
| ATOM | 396 | NE1 | TRP | C | 52 | −5.004 | 85.510 | −5.010 | 1.00 | 32.81 | N |
| ATOM | 397 | CE2 | TRP | C | 52 | −4.853 | 84.235 | −5.495 | 1.00 | 33.10 | C |
| ATOM | 398 | CE3 | TRP | C | 52 | −4.989 | 81.962 | −4.657 | 1.00 | 33.14 | C |
| ATOM | 399 | CZ2 | TRP | C | 52 | −4.516 | 83.792 | −6.779 | 1.00 | 32.67 | C |
| ATOM | 400 | CZ3 | TRP | C | 52 | −4.670 | 81.524 | −5.941 | 1.00 | 33.56 | C |
| ATOM | 401 | CH2 | TRP | C | 52 | −4.435 | 82.436 | −6.983 | 1.00 | 32.43 | C |
| ATOM | 402 | N | TYR | C | 53 | −3.304 | 84.726 | −0.315 | 1.00 | 29.93 | N |
| ATOM | 403 | CA | TYR | C | 53 | −2.784 | 85.558 | 0.768 | 1.00 | 38.06 | C |
| ATOM | 404 | C | TYR | C | 53 | −3.898 | 86.148 | 1.630 | 1.00 | 40.02 | C |
| ATOM | 405 | O | TYR | C | 53 | −3.690 | 86.389 | 2.829 | 1.00 | 43.14 | O |
| ATOM | 406 | CB | TYR | C | 53 | −1.915 | 86.685 | 0.203 | 1.00 | 36.99 | C |
| ATOM | 407 | CG | TYR | C | 53 | −2.522 | 87.380 | −0.992 | 1.00 | 42.26 | C |
| ATOM | 408 | CD1 | TYR | C | 53 | −3.449 | 88.409 | −0.831 | 1.00 | 39.71 | C |
| ATOM | 409 | CD2 | TYR | C | 53 | −2.172 | 86.999 | −2.290 | 1.00 | 38.52 | C |
| ATOM | 410 | CE1 | TYR | C | 53 | −4.015 | 89.042 | −1.927 | 1.00 | 38.70 | C |
| ATOM | 411 | CE2 | TYR | C | 53 | −2.720 | 87.631 | −3.397 | 1.00 | 43.88 | C |
| ATOM | 412 | CZ | TYR | C | 53 | −3.647 | 88.654 | −3.211 | 1.00 | 46.93 | C |
| ATOM | 413 | OH | TYR | C | 53 | −4.205 | 89.264 | −4.318 | 1.00 | 49.29 | O |
| ATOM | 414 | N | ASP | C | 54 | −5.082 | 86.385 | 1.058 | 1.00 | 35.51 | N |
| ATOM | 415 | CA | ASP | C | 54 | −6.200 | 86.943 | 1.811 | 1.00 | 38.58 | C |
| ATOM | 416 | C | ASP | C | 54 | −7.258 | 85.899 | 2.166 | 1.00 | 37.13 | C |
| ATOM | 417 | O | ASP | C | 54 | −8.397 | 86.262 | 2.468 | 1.00 | 42.80 | O |
| ATOM | 418 | CB | ASP | C | 54 | −6.839 | 88.093 | 1.036 | 1.00 | 35.61 | C |
| ATOM | 419 | CG | ASP | C | 54 | −7.319 | 87.664 | −0.336 | 1.00 | 39.47 | C |
| ATOM | 420 | OD1 | ASP | C | 54 | −7.355 | 86.435 | −0.617 | 1.00 | 40.37 | O |
| ATOM | 421 | OD2 | ASP | C | 54 | −7.678 | 88.551 | −1.129 | 1.00 | 40.04 | O1− |
| ATOM | 422 | N | GLY | C | 55 | −6.921 | 84.614 | 2.110 | 1.00 | 38.50 | N |
| ATOM | 423 | CA | GLY | C | 55 | −7.878 | 83.579 | 2.451 | 1.00 | 30.61 | C |
| ATOM | 424 | C | GLY | C | 55 | −9.007 | 83.374 | 1.465 | 1.00 | 39.39 | C |
| ATOM | 425 | O | GLY | C | 55 | −9.946 | 82.625 | 1.773 | 1.00 | 37.86 | O |
| ATOM | 426 | N | SER | C | 56 | −8.944 | 83.988 | 0.276 | 1.00 | 37.78 | N |
| ATOM | 427 | CA | SER | C | 56 | −10.036 | 83.866 | −0.689 | 1.00 | 30.88 | C |
| ATOM | 428 | C | SER | C | 56 | −9.948 | 82.566 | −1.485 | 1.00 | 29.51 | C |
| ATOM | 429 | O | SER | C | 56 | −10.561 | 81.560 | −1.107 | 1.00 | 35.66 | O |
| ATOM | 430 | CB | SER | C | 56 | −10.050 | 85.075 | −1.634 | 1.00 | 31.22 | C |
| ATOM | 431 | OG | SER | C | 56 | −8.824 | 85.214 | −2.331 | 1.00 | 32.22 | O |
| ATOM | 432 | N | ASN | C | 57 | −9.192 | 82.555 | −2.578 | 1.00 | 28.37 | N |
| ATOM | 433 | CA | ASN | C | 57 | −9.143 | 81.363 | −3.423 | 1.00 | 35.02 | C |
| ATOM | 434 | C | ASN | C | 57 | −8.480 | 80.196 | −2.691 | 1.00 | 32.70 | C |
| ATOM | 435 | O | ASN | C | 57 | −7.544 | 80.388 | −1.909 | 1.00 | 29.84 | O |
| ATOM | 436 | CB | ASN | C | 57 | −8.407 | 81.655 | −4.733 | 1.00 | 29.59 | C |
| ATOM | 437 | CG | ASN | C | 57 | −9.224 | 82.532 | −5.682 | 1.00 | 35.30 | C |
| ATOM | 438 | OD1 | ASN | C | 57 | −10.082 | 83.295 | −5.248 | 1.00 | 31.05 | O |
| ATOM | 439 | ND2 | ASN | C | 57 | −8.982 | 82.390 | −6.988 | 1.00 | 33.63 | N |
| ATOM | 440 | N | LYS | C | 58 | −9.018 | 78.992 | −2.915 | 1.00 | 28.81 | N |
| ATOM | 441 | CA | LYS | C | 58 | −8.510 | 77.731 | −2.374 | 1.00 | 33.21 | C |
| ATOM | 442 | C | LYS | C | 58 | −8.561 | 76.699 | −3.485 | 1.00 | 31.65 | C |
| ATOM | 443 | O | LYS | C | 58 | −9.609 | 76.539 | −4.111 | 1.00 | 31.96 | O |
| ATOM | 444 | CB | LYS | C | 58 | −9.356 | 77.210 | −1.201 | 1.00 | 29.22 | C |
| ATOM | 445 | CG | LYS | C | 58 | −9.438 | 78.136 | −0.030 | 1.00 | 39.00 | C |
| ATOM | 446 | CD | LYS | C | 58 | −10.443 | 77.655 | 1.024 | 1.00 | 28.02 | C |
| ATOM | 447 | CE | LYS | C | 58 | −10.456 | 78.663 | 2.179 | 1.00 | 29.93 | C |
| ATOM | 448 | NZ | LYS | C | 58 | −11.039 | 78.171 | 3.465 | 1.00 | 34.24 | N1+ |
| ATOM | 449 | N | TYR | C | 59 | −7.465 | 75.969 | −3.693 | 1.00 | 33.17 | N |
| ATOM | 450 | CA | TYR | C | 59 | −7.402 | 74.893 | −4.680 | 1.00 | 31.69 | C |
| ATOM | 451 | C | TYR | C | 59 | −6.931 | 73.623 | −3.988 | 1.00 | 32.39 | C |
| ATOM | 452 | O | TYR | C | 59 | −6.165 | 73.681 | −3.025 | 1.00 | 32.73 | O |
| ATOM | 453 | CB | TYR | C | 59 | −6.450 | 75.203 | −5.856 | 1.00 | 33.11 | C |
| ATOM | 454 | CG | TYR | C | 59 | −6.646 | 76.536 | −6.574 | 1.00 | 41.69 | C |
| ATOM | 455 | CD1 | TYR | C | 59 | −6.539 | 77.741 | −5.914 | 1.00 | 48.94 | C |
| ATOM | 456 | CD2 | TYR | C | 59 | −6.892 | 76.574 | −7.925 | 1.00 | 52.57 | C |
| ATOM | 457 | CE1 | TYR | C | 59 | −6.714 | 78.936 | −6.579 | 1.00 | 54.05 | C |
| ATOM | 458 | CE2 | TYR | C | 59 | −7.055 | 77.762 | −8.590 | 1.00 | 51.75 | C |
| ATOM | 459 | CZ | TYR | C | 59 | −6.973 | 78.936 | −7.916 | 1.00 | 42.38 | C |
| ATOM | 460 | OH | TYR | C | 59 | −7.155 | 80.120 | −8.583 | 1.00 | 40.63 | O |
| ATOM | 461 | N | TYR | C | 60 | −7.401 | 72.470 | −4.475 | 1.00 | 28.26 | N |
| ATOM | 462 | CA | TYR | C | 60 | −7.080 | 71.205 | −3.835 | 1.00 | 26.89 | C |
| ATOM | 463 | C | TYR | C | 60 | −6.720 | 70.156 | −4.864 | 1.00 | 32.21 | C |
| ATOM | 464 | O | TYR | C | 60 | −7.276 | 70.128 | −5.967 | 1.00 | 30.27 | O |
| ATOM | 465 | CB | TYR | C | 60 | −8.232 | 70.657 | −3.004 | 1.00 | 28.01 | C |
| ATOM | 466 | CG | TYR | C | 60 | −8.665 | 71.517 | −1.854 | 1.00 | 34.24 | C |
| ATOM | 467 | CD1 | TYR | C | 60 | −9.607 | 72.540 | −2.036 | 1.00 | 31.75 | C |
| ATOM | 468 | CD2 | TYR | C | 60 | −8.169 | 71.297 | −0.570 | 1.00 | 31.69 | C |
| ATOM | 469 | CE1 | TYR | C | 60 | −10.020 | 73.341 | −0.963 | 1.00 | 28.22 | C |
| ATOM | 470 | CE2 | TYR | C | 60 | −8.595 | 72.093 | 0.512 | 1.00 | 30.87 | C |
| ATOM | 471 | CZ | TYR | C | 60 | −9.516 | 73.111 | 0.301 | 1.00 | 28.55 | C |
| ATOM | 472 | OH | TYR | C | 60 | −9.924 | 73.903 | 1.354 | 1.00 | 30.94 | O |
| ATOM | 473 | N | ALA | C | 61 | −5.807 | 69.267 | −4.468 | 1.00 | 27.28 | N |

TABLE 10.3-continued

| | | | | | | | | | | |
|---|---|---|---|---|---|---|---|---|---|---|
| ATOM | 474 | CA | ALA | C | 61 | −5.533 | 68.075 | −5.252 | 1.00 | 28.59 | C |
| ATOM | 475 | C | ALA | C | 61 | −6.745 | 67.149 | −5.238 | 1.00 | 34.61 | C |
| ATOM | 476 | O | ALA | C | 61 | −7.493 | 67.080 | −4.260 | 1.00 | 31.50 | O |
| ATOM | 477 | CB | ALA | C | 61 | −4.315 | 67.342 | −4.706 | 1.00 | 23.81 | C |
| ATOM | 478 | N | ASP | C | 62 | −6.920 | 66.423 | −6.341 | 1.00 | 38.58 | N |
| ATOM | 479 | CA | ASP | C | 62 | −8.069 | 65.537 | −6.487 | 1.00 | 40.90 | C |
| ATOM | 480 | C | ASP | C | 62 | −8.129 | 64.490 | −5.382 | 1.00 | 41.29 | C |
| ATOM | 481 | O | ASP | C | 62 | −9.210 | 64.175 | −4.884 | 1.00 | 43.64 | O |
| ATOM | 482 | CB | ASP | C | 62 | −8.027 | 64.862 | −7.858 | 1.00 | 41.48 | C |
| ATOM | 483 | CG | ASP | C | 62 | −8.775 | 65.657 | −8.908 | 1.00 | 52.54 | C |
| ATOM | 484 | OD1 | ASP | C | 62 | −9.074 | 66.853 | −8.639 | 1.00 | 50.91 | O |
| ATOM | 485 | OD2 | ASP | C | 62 | −9.074 | 65.083 | −9.984 | 1.00 | 54.03 | O1− |
| ATOM | 486 | N | SER | C | 63 | −6.978 | 63.960 | −4.967 | 1.00 | 38.35 | N |
| ATOM | 487 | CA | SER | C | 63 | −6.931 | 62.918 | −3.948 | 1.00 | 40.77 | C |
| ATOM | 488 | C | SER | C | 63 | −7.429 | 63.398 | −2.589 | 1.00 | 41.73 | C |
| ATOM | 489 | O | SER | C | 63 | −7.557 | 62.586 | −1.666 | 1.00 | 37.97 | O |
| ATOM | 490 | CB | SER | C | 63 | −5.493 | 62.386 | −3.804 | 1.00 | 39.37 | C |
| ATOM | 491 | OG | SER | C | 63 | −4.582 | 63.445 | −3.547 | 1.00 | 39.82 | O |
| ATOM | 492 | N | VAL | C | 64 | −7.730 | 64.681 | −2.445 | 1.00 | 37.08 | N |
| ATOM | 493 | CA | VAL | C | 64 | −7.937 | 65.265 | −1.130 | 1.00 | 34.49 | C |
| ATOM | 494 | C | VAL | C | 64 | −9.234 | 66.090 | −1.105 | 1.00 | 35.91 | C |
| ATOM | 495 | O | VAL | C | 64 | −9.766 | 66.419 | −0.033 | 1.00 | 35.61 | O |
| ATOM | 496 | CB | VAL | C | 64 | −6.652 | 66.052 | −0.800 | 1.00 | 37.75 | C |
| ATOM | 497 | CG1 | VAL | C | 64 | −6.895 | 67.438 | −0.272 | 1.00 | 34.28 | C |
| ATOM | 498 | CG2 | VAL | C | 64 | −5.734 | 65.214 | 0.078 | 1.00 | 37.52 | C |
| ATOM | 499 | N | LYS | C | 65 | −9.774 | 66.389 | −2.294 | 1.00 | 33.05 | N |
| ATOM | 500 | CA | LYS | C | 65 | −11.007 | 67.169 | −2.424 | 1.00 | 35.12 | C |
| ATOM | 501 | C | LYS | C | 65 | −12.143 | 66.581 | −1.599 | 1.00 | 41.45 | C |
| ATOM | 502 | O | LYS | C | 65 | −12.378 | 65.368 | −1.600 | 1.00 | 37.85 | O |
| ATOM | 503 | CB | LYS | C | 65 | −11.463 | 67.244 | −3.888 | 1.00 | 35.87 | C |
| ATOM | 504 | CG | LYS | C | 65 | −10.771 | 68.290 | −4.714 | 1.00 | 35.54 | C |
| ATOM | 505 | CD | LYS | C | 65 | −11.454 | 68.428 | −6.057 | 1.00 | 42.42 | C |
| ATOM | 506 | CE | LYS | C | 65 | −10.975 | 69.680 | −6.795 | 1.00 | 38.45 | C |
| ATOM | 507 | NZ | LYS | C | 65 | −9.588 | 69.479 | −7.281 | 1.00 | 40.01 | N1+ |
| ATOM | 508 | N | GLY | C | 66 | −12.876 | 67.460 | −0.925 | 1.00 | 38.42 | N |
| ATOM | 509 | CA | GLY | C | 66 | −14.008 | 67.048 | −0.131 | 1.00 | 34.79 | C |
| ATOM | 510 | C | GLY | C | 66 | −13.656 | 66.580 | 1.252 | 1.00 | 43.32 | C |
| ATOM | 511 | O | GLY | C | 66 | −14.504 | 66.628 | 2.139 | 1.00 | 44.56 | O |
| ATOM | 512 | N | ARG | C | 67 | −12.416 | 66.177 | 1.488 | 1.00 | 42.85 | N |
| ATOM | 513 | CA | ARG | C | 67 | −12.040 | 65.681 | 2.798 | 1.00 | 33.59 | C |
| ATOM | 514 | C | ARG | C | 67 | −11.185 | 66.653 | 3.587 | 1.00 | 38.28 | C |
| ATOM | 515 | O | ARG | C | 67 | −11.308 | 66.698 | 4.812 | 1.00 | 35.39 | O |
| ATOM | 516 | CB | ARG | C | 67 | −11.317 | 64.333 | 2.663 | 1.00 | 38.43 | C |
| ATOM | 517 | CG | ARG | C | 67 | −12.241 | 63.220 | 2.171 | 1.00 | 33.48 | C |
| ATOM | 518 | CD | ARG | C | 67 | −11.540 | 61.860 | 2.172 | 1.00 | 39.76 | C |
| ATOM | 519 | NE | ARG | C | 67 | −10.284 | 61.891 | 1.423 | 1.00 | 38.65 | N |
| ATOM | 520 | CZ | ARG | C | 67 | −9.081 | 61.717 | 1.967 | 1.00 | 39.28 | C |
| ATOM | 521 | NH1 | ARG | C | 67 | −8.981 | 61.482 | 3.259 | 1.00 | 31.68 | N1+ |
| ATOM | 522 | NH2 | ARG | C | 67 | −7.977 | 61.785 | 1.224 | 1.00 | 36.70 | N |
| ATOM | 523 | N | PHE | C | 68 | −10.304 | 67.413 | 2.922 | 1.00 | 37.96 | N |
| ATOM | 524 | CA | PHE | C | 68 | −9.395 | 68.344 | 3.576 | 1.00 | 30.65 | C |
| ATOM | 525 | C | PHE | C | 68 | −9.874 | 69.766 | 3.351 | 1.00 | 34.00 | C |
| ATOM | 526 | O | PHE | C | 68 | −10.488 | 70.071 | 2.325 | 1.00 | 36.05 | O |
| ATOM | 527 | CB | PHE | C | 68 | −7.959 | 68.224 | 3.047 | 1.00 | 37.02 | C |
| ATOM | 528 | CG | PHE | C | 68 | −7.264 | 66.900 | 3.360 | 1.00 | 38.71 | C |
| ATOM | 529 | CD1 | PHE | C | 68 | −7.954 | 65.814 | 3.888 | 1.00 | 35.33 | C |
| ATOM | 530 | CD2 | PHE | C | 68 | −5.894 | 66.767 | 3.140 | 1.00 | 37.81 | C |
| ATOM | 531 | CE1 | PHE | C | 68 | −7.299 | 64.615 | 4.164 | 1.00 | 36.61 | C |
| ATOM | 532 | CE2 | PHE | C | 68 | −5.218 | 65.569 | 3.425 | 1.00 | 33.40 | C |
| ATOM | 533 | CZ | PHE | C | 68 | −5.919 | 64.498 | 3.934 | 1.00 | 40.51 | C |
| ATOM | 534 | N | THR | C | 69 | −9.582 | 70.646 | 4.307 | 1.00 | 35.34 | N |
| ATOM | 535 | CA | THR | C | 69 | −9.924 | 72.055 | 4.163 | 1.00 | 29.08 | C |
| ATOM | 536 | C | THR | C | 69 | −8.743 | 72.900 | 4.621 | 1.00 | 31.52 | C |
| ATOM | 537 | O | THR | C | 69 | −8.229 | 72.710 | 5.725 | 1.00 | 33.87 | O |
| ATOM | 538 | CB | THR | C | 69 | −11.198 | 72.407 | 4.954 | 1.00 | 32.76 | C |
| ATOM | 539 | OG1 | THR | C | 69 | −12.294 | 71.663 | 4.427 | 1.00 | 36.96 | O |
| ATOM | 540 | CG2 | THR | C | 69 | −11.545 | 73.923 | 4.828 | 1.00 | 25.39 | C |
| ATOM | 541 | N | ILE | C | 70 | −8.309 | 73.827 | 3.778 | 1.00 | 33.09 | N |
| ATOM | 542 | CA | ILE | C | 70 | −7.201 | 74.720 | 4.113 | 1.00 | 29.02 | C |
| ATOM | 543 | C | ILE | C | 70 | −7.786 | 76.038 | 4.602 | 1.00 | 32.22 | C |
| ATOM | 544 | O | ILE | C | 70 | −8.810 | 76.503 | 4.093 | 1.00 | 33.11 | O |
| ATOM | 545 | CB | ILE | C | 70 | −6.265 | 74.911 | 2.899 | 1.00 | 35.27 | C |
| ATOM | 546 | CG1 | ILE | C | 70 | −4.942 | 75.579 | 3.288 | 1.00 | 31.47 | C |
| ATOM | 547 | CG2 | ILE | C | 70 | −6.939 | 75.726 | 1.800 | 1.00 | 23.76 | C |
| ATOM | 548 | CD1 | ILE | C | 70 | −3.965 | 75.590 | 2.138 | 1.00 | 31.12 | C |
| ATOM | 549 | N | SER | C | 71 | −7.174 | 76.618 | 5.627 | 1.00 | 35.69 | N |
| ATOM | 550 | CA | SER | C | 71 | −7.670 | 77.883 | 6.153 | 1.00 | 38.73 | C |
| ATOM | 551 | C | SER | C | 71 | −6.513 | 78.588 | 6.845 | 1.00 | 37.39 | C |
| ATOM | 552 | O | SER | C | 71 | −5.444 | 78.009 | 7.046 | 1.00 | 41.40 | O |
| ATOM | 553 | CB | SER | C | 71 | −8.849 | 77.655 | 7.100 | 1.00 | 37.80 | C |

TABLE 10.3-continued

| | | | | | | | | | | |
|---|---|---|---|---|---|---|---|---|---|---|
| ATOM | 554 | OG | SER | C | 71 | −8.444 | 76.880 | 8.217 | 1.00 | 38.72 | O |
| ATOM | 555 | N | ARG | C | 72 | −6.726 | 79.852 | 7.204 | 1.00 | 35.68 | N |
| ATOM | 556 | CA | ARG | C | 72 | −5.674 | 80.600 | 7.876 | 1.00 | 36.89 | C |
| ATOM | 557 | C | ARG | C | 72 | −6.274 | 81.545 | 8.908 | 1.00 | 40.29 | C |
| ATOM | 558 | O | ARG | C | 72 | −7.421 | 81.973 | 8.791 | 1.00 | 38.24 | O |
| ATOM | 559 | CB | ARG | C | 72 | −4.825 | 81.385 | 6.864 | 1.00 | 35.87 | C |
| ATOM | 560 | CG | ARG | C | 72 | −5.636 | 82.390 | 6.057 | 1.00 | 34.72 | C |
| ATOM | 561 | CD | ARG | C | 72 | −4.828 | 82.983 | 4.903 | 1.00 | 30.54 | C |
| ATOM | 562 | NE | ARG | C | 72 | −3.674 | 83.722 | 5.397 | 1.00 | 39.63 | N |
| ATOM | 563 | CZ | ARG | C | 72 | −2.575 | 83.951 | 4.694 | 1.00 | 41.45 | C |
| ATOM | 564 | NH1 | ARG | C | 72 | −2.475 | 83.499 | 3.449 | 1.00 | 37.50 | N1+ |
| ATOM | 565 | NH2 | ARG | C | 72 | −1.579 | 84.643 | 5.240 | 1.00 | 38.82 | N |
| ATOM | 566 | N | ASP | C | 73 | −5.478 | 81.878 | 9.920 | 1.00 | 38.55 | N |
| ATOM | 567 | CA | ASP | C | 73 | −5.852 | 82.875 | 10.919 | 1.00 | 40.45 | C |
| ATOM | 568 | C | ASP | C | 73 | −4.704 | 83.871 | 11.015 | 1.00 | 44.31 | C |
| ATOM | 569 | O | ASP | C | 73 | −3.699 | 83.601 | 11.676 | 1.00 | 47.19 | O |
| ATOM | 570 | CB | ASP | C | 73 | −6.142 | 82.239 | 12.277 | 1.00 | 45.34 | C |
| ATOM | 571 | CG | ASP | C | 73 | −6.685 | 83.247 | 13.303 | 1.00 | 48.06 | C |
| ATOM | 572 | OD1 | ASP | C | 73 | −6.492 | 84.479 | 13.138 | 1.00 | 54.90 | O |
| ATOM | 573 | OD2 | ASP | C | 73 | −7.277 | 82.797 | 14.305 | 1.00 | 53.87 | O1− |
| ATOM | 574 | N | ASN | C | 74 | −4.865 | 85.028 | 10.374 | 1.00 | 39.84 | N |
| ATOM | 575 | CA | ASN | C | 74 | −3.778 | 85.991 | 10.341 | 1.00 | 43.99 | C |
| ATOM | 576 | C | ASN | C | 74 | −3.450 | 86.497 | 11.739 | 1.00 | 48.38 | C |
| ATOM | 577 | O | ASN | C | 74 | −2.282 | 86.767 | 12.040 | 1.00 | 55.63 | O |
| ATOM | 578 | CB | ASN | C | 74 | −4.126 | 87.136 | 9.385 | 1.00 | 39.05 | C |
| ATOM | 579 | CG | ASN | C | 74 | −3.974 | 86.735 | 7.922 | 1.00 | 46.52 | C |
| ATOM | 580 | OD1 | ASN | C | 74 | −3.620 | 85.591 | 7.606 | 1.00 | 45.49 | O |
| ATOM | 581 | ND2 | ASN | C | 74 | −4.238 | 87.668 | 7.024 | 1.00 | 41.67 | N |
| ATOM | 582 | N | SER | C | 75 | −4.444 | 86.570 | 12.626 | 1.00 | 52.35 | N |
| ATOM | 583 | CA | SER | C | 75 | −4.172 | 87.063 | 13.973 | 1.00 | 49.93 | C |
| ATOM | 584 | C | SER | C | 75 | −3.251 | 86.138 | 14.759 | 1.00 | 51.44 | C |
| ATOM | 585 | O | SER | C | 75 | −2.606 | 86.596 | 15.705 | 1.00 | 53.63 | O |
| ATOM | 586 | CB | SER | C | 75 | −5.480 | 87.277 | 14.735 | 1.00 | 45.73 | C |
| ATOM | 587 | OG | SER | C | 75 | −6.025 | 86.059 | 15.205 | 1.00 | 53.39 | O |
| ATOM | 588 | N | LYS | C | 76 | −3.158 | 84.860 | 14.387 | 1.00 | 49.51 | N |
| ATOM | 589 | CA | LYS | C | 76 | −2.235 | 83.925 | 15.018 | 1.00 | 43.14 | C |
| ATOM | 590 | C | LYS | C | 76 | −1.069 | 83.563 | 14.114 | 1.00 | 50.55 | C |
| ATOM | 591 | O | LYS | C | 76 | −0.325 | 82.632 | 14.440 | 1.00 | 45.43 | O |
| ATOM | 592 | CB | LYS | C | 76 | −2.951 | 82.633 | 15.422 | 1.00 | 45.66 | C |
| ATOM | 593 | CG | LYS | C | 76 | −4.185 | 82.802 | 16.282 | 1.00 | 49.74 | C |
| ATOM | 594 | CD | LYS | C | 76 | −4.789 | 81.447 | 16.612 | 1.00 | 50.31 | C |
| ATOM | 595 | CE | LYS | C | 76 | −6.149 | 81.588 | 17.303 | 1.00 | 56.50 | C |
| ATOM | 596 | NZ | LYS | C | 76 | −6.769 | 80.256 | 17.607 | 1.00 | 68.70 | N1+ |
| ATOM | 597 | N | ASN | C | 77 | −0.896 | 84.275 | 12.992 | 1.00 | 47.54 | N |
| ATOM | 598 | CA | ASN | C | 77 | 0.093 | 83.953 | 11.963 | 1.00 | 44.06 | C |
| ATOM | 599 | C | ASN | C | 77 | 0.174 | 82.458 | 11.667 | 1.00 | 45.22 | C |
| ATOM | 600 | O | ASN | C | 77 | 1.278 | 81.913 | 11.537 | 1.00 | 43.31 | O |
| ATOM | 601 | CB | ASN | C | 77 | 1.470 | 84.476 | 12.358 | 1.00 | 41.59 | C |
| ATOM | 602 | CG | ASN | C | 77 | 1.530 | 85.984 | 12.365 | 1.00 | 44.41 | C |
| ATOM | 603 | OD1 | ASN | C | 77 | 0.827 | 86.646 | 11.609 | 1.00 | 48.47 | O |
| ATOM | 604 | ND2 | ASN | C | 77 | 2.354 | 86.535 | 13.232 | 1.00 | 44.19 | N |
| ATOM | 605 | N | THR | C | 78 | −0.981 | 81.789 | 11.547 | 1.00 | 36.70 | N |
| ATOM | 606 | CA | THR | C | 78 | −1.021 | 80.336 | 11.472 | 1.00 | 40.83 | C |
| ATOM | 607 | C | THR | C | 78 | −1.861 | 79.905 | 10.280 | 1.00 | 44.26 | C |
| ATOM | 608 | O | THR | C | 78 | −2.909 | 80.500 | 10.003 | 1.00 | 37.17 | O |
| ATOM | 609 | CB | THR | C | 78 | −1.599 | 79.724 | 12.774 | 1.00 | 40.36 | C |
| ATOM | 610 | OG1 | THR | C | 78 | −0.819 | 80.156 | 13.888 | 1.00 | 45.18 | O |
| ATOM | 611 | CG2 | THR | C | 78 | −1.572 | 78.205 | 12.739 | 1.00 | 38.53 | C |
| ATOM | 612 | N | LEU | C | 79 | −1.365 | 78.886 | 9.574 | 1.00 | 39.56 | N |
| ATOM | 613 | CA | LEU | C | 79 | −2.067 | 78.174 | 8.513 | 1.00 | 33.74 | C |
| ATOM | 614 | C | LEU | C | 79 | −2.557 | 76.821 | 9.033 | 1.00 | 37.68 | C |
| ATOM | 615 | O | LEU | C | 79 | −1.875 | 76.162 | 9.822 | 1.00 | 39.25 | O |
| ATOM | 616 | CB | LEU | C | 79 | −1.133 | 77.969 | 7.307 | 1.00 | 40.59 | C |
| ATOM | 617 | CG | LEU | C | 79 | −1.615 | 77.032 | 6.178 | 1.00 | 40.09 | C |
| ATOM | 618 | CD1 | LEU | C | 79 | −2.574 | 77.739 | 5.277 | 1.00 | 28.75 | C |
| ATOM | 619 | CD2 | LEU | C | 79 | −0.476 | 76.386 | 5.372 | 1.00 | 31.11 | C |
| ATOM | 620 | N | TYR | C | 80 | −3.738 | 76.399 | 8.599 | 1.00 | 35.37 | N |
| ATOM | 621 | CA | TYR | C | 80 | −4.296 | 75.136 | 9.067 | 1.00 | 38.96 | C |
| ATOM | 622 | C | TYR | C | 80 | −4.592 | 74.197 | 7.909 | 1.00 | 36.52 | C |
| ATOM | 623 | O | TYR | C | 80 | −4.895 | 74.629 | 6.798 | 1.00 | 37.65 | O |
| ATOM | 624 | CB | TYR | C | 80 | −5.592 | 75.328 | 9.872 | 1.00 | 36.20 | C |
| ATOM | 625 | CG | TYR | C | 80 | −5.421 | 76.193 | 11.073 | 1.00 | 41.77 | C |
| ATOM | 626 | CD1 | TYR | C | 80 | −4.830 | 75.697 | 12.234 | 1.00 | 41.02 | C |
| ATOM | 627 | CD2 | TYR | C | 80 | −5.845 | 77.516 | 11.052 | 1.00 | 39.70 | C |
| ATOM | 628 | CE1 | TYR | C | 80 | −4.655 | 76.511 | 13.345 | 1.00 | 44.22 | C |
| ATOM | 629 | CE2 | TYR | C | 80 | −5.685 | 78.340 | 12.152 | 1.00 | 40.29 | C |
| ATOM | 630 | CZ | TYR | C | 80 | −5.089 | 77.837 | 13.297 | 1.00 | 49.44 | C |
| ATOM | 631 | OH | TYR | C | 80 | −4.938 | 78.666 | 14.388 | 1.00 | 54.21 | O |
| ATOM | 632 | N | LEU | C | 81 | −4.520 | 72.901 | 8.194 | 1.00 | 36.72 | N |
| ATOM | 633 | CA | LEU | C | 81 | −5.055 | 71.869 | 7.317 | 1.00 | 41.79 | C |

TABLE 10.3-continued

| | | | | | | | | | | |
|---|---|---|---|---|---|---|---|---|---|---|
| ATOM | 634 | C | LEU | C | 81 | −5.970 | 70.979 | 8.151 | 1.00 | 40.31 | C |
| ATOM | 635 | O | LEU | C | 81 | −5.497 | 70.223 | 9.006 | 1.00 | 40.72 | O |
| ATOM | 636 | CB | LEU | C | 81 | −3.943 | 71.050 | 6.665 | 1.00 | 36.53 | C |
| ATOM | 637 | CG | LEU | C | 81 | −4.473 | 70.006 | 5.677 | 1.00 | 29.95 | C |
| ATOM | 638 | CD1 | LEU | C | 81 | −5.070 | 70.688 | 4.452 | 1.00 | 35.27 | C |
| ATOM | 639 | CD2 | LEU | C | 81 | −3.369 | 69.024 | 5.277 | 1.00 | 31.44 | C |
| ATOM | 640 | N | GLN | C | 82 | −7.274 | 71.101 | 7.926 | 1.00 | 38.93 | N |
| ATOM | 641 | CA | GLN | C | 82 | −8.277 | 70.254 | 8.566 | 1.00 | 35.95 | C |
| ATOM | 642 | C | GLN | C | 82 | −8.454 | 68.996 | 7.728 | 1.00 | 36.48 | C |
| ATOM | 643 | O | GLN | C | 82 | −8.834 | 69.081 | 6.557 | 1.00 | 41.11 | O |
| ATOM | 644 | CB | GLN | C | 82 | −9.606 | 71.009 | 8.718 | 1.00 | 32.87 | C |
| ATOM | 645 | CG | GLN | C | 82 | −10.720 | 70.190 | 9.383 | 1.00 | 27.13 | C |
| ATOM | 646 | CD | GLN | C | 82 | −10.339 | 69.723 | 10.783 | 1.00 | 41.21 | C |
| ATOM | 647 | OE1 | GLN | C | 82 | −9.875 | 70.511 | 11.621 | 1.00 | 41.00 | O |
| ATOM | 648 | NE2 | GLN | C | 82 | −10.466 | 68.418 | 11.018 | 1.00 | 37.49 | N |
| ATOM | 649 | N | MET | C | 83 | −8.136 | 67.839 | 8.304 | 1.00 | 36.04 | N |
| ATOM | 650 | CA | MET | C | 83 | −8.151 | 66.557 | 7.594 | 1.00 | 39.43 | C |
| ATOM | 651 | C | MET | C | 83 | −9.242 | 65.670 | 8.174 | 1.00 | 41.49 | C |
| ATOM | 652 | O | MET | C | 83 | −9.145 | 65.225 | 9.321 | 1.00 | 46.39 | O |
| ATOM | 653 | CB | MET | C | 83 | −6.791 | 65.854 | 7.669 | 1.00 | 42.85 | C |
| ATOM | 654 | CG | MET | C | 83 | −5.616 | 66.618 | 7.030 | 1.00 | 44.37 | C |
| ATOM | 655 | SD | MET | C | 83 | −4.047 | 65.719 | 7.166 | 1.00 | 45.89 | S |
| ATOM | 656 | CE | MET | C | 83 | −3.833 | 65.851 | 8.911 | 1.00 | 41.39 | C |
| ATOM | 657 | N | ASN | C | 84 | −10.284 | 65.432 | 7.400 | 1.00 | 37.96 | N |
| ATOM | 658 | CA | ASN | C | 84 | −11.368 | 64.560 | 7.811 | 1.00 | 38.76 | C |
| ATOM | 659 | C | ASN | C | 84 | −11.332 | 63.268 | 7.002 | 1.00 | 40.86 | C |
| ATOM | 660 | O | ASN | C | 84 | −10.744 | 63.205 | 5.918 | 1.00 | 40.04 | O |
| ATOM | 661 | CB | ASN | C | 84 | −12.715 | 65.273 | 7.649 | 1.00 | 33.01 | C |
| ATOM | 662 | CG | ASN | C | 84 | −12.807 | 66.525 | 8.498 | 1.00 | 37.92 | C |
| ATOM | 663 | OD1 | ASN | C | 84 | −12.179 | 66.617 | 9.548 | 1.00 | 46.79 | O |
| ATOM | 664 | ND2 | ASN | C | 84 | −13.617 | 67.480 | 8.071 | 1.00 | 40.77 | N |
| ATOM | 665 | N | SER | C | 85 | −11.956 | 62.226 | 7.547 | 1.00 | 43.43 | N |
| ATOM | 666 | CA | SER | C | 85 | −12.072 | 60.945 | 6.852 | 1.00 | 40.65 | C |
| ATOM | 667 | C | SER | C | 85 | −10.714 | 60.421 | 6.406 | 1.00 | 39.67 | C |
| ATOM | 668 | O | SER | C | 85 | −10.529 | 60.022 | 5.252 | 1.00 | 36.84 | O |
| ATOM | 669 | CB | SER | C | 85 | −13.010 | 61.055 | 5.654 | 1.00 | 38.73 | C |
| ATOM | 670 | OG | SER | C | 85 | −14.333 | 61.254 | 6.094 | 1.00 | 48.16 | O |
| ATOM | 671 | N | LEU | C | 86 | −9.757 | 60.421 | 7.331 | 1.00 | 38.73 | N |
| ATOM | 672 | CA | LEU | C | 86 | −8.390 | 60.056 | 6.977 | 1.00 | 37.86 | C |
| ATOM | 673 | C | LEU | C | 86 | −8.328 | 58.625 | 6.457 | 1.00 | 38.76 | C |
| ATOM | 674 | O | LEU | C | 86 | −9.063 | 57.749 | 6.909 | 1.00 | 43.94 | O |
| ATOM | 675 | CB | LEU | C | 86 | −7.471 | 60.241 | 8.184 | 1.00 | 39.02 | C |
| ATOM | 676 | CG | LEU | C | 86 | −7.098 | 61.711 | 8.395 | 1.00 | 38.85 | C |
| ATOM | 677 | CD1 | LEU | C | 86 | −6.467 | 61.983 | 9.765 | 1.00 | 37.48 | C |
| ATOM | 678 | CD2 | LEU | C | 86 | −6.157 | 62.137 | 7.290 | 1.00 | 41.68 | C |
| ATOM | 679 | N | ARG | C | 87 | −7.468 | 58.400 | 5.470 | 1.00 | 41.40 | N |
| ATOM | 680 | CA | ARG | C | 87 | −7.251 | 57.088 | 4.882 | 1.00 | 37.22 | C |
| ATOM | 681 | C | ARG | C | 87 | −5.782 | 56.695 | 5.005 | 1.00 | 43.89 | C |
| ATOM | 682 | O | ARG | C | 87 | −4.900 | 57.546 | 5.190 | 1.00 | 37.28 | O |
| ATOM | 683 | CB | ARG | C | 87 | −7.661 | 57.052 | 3.409 | 1.00 | 41.43 | C |
| ATOM | 684 | CG | ARG | C | 87 | −8.995 | 57.661 | 3.103 | 1.00 | 47.94 | C |
| ATOM | 685 | CD | ARG | C | 87 | −9.556 | 57.025 | 1.858 | 1.00 | 52.28 | C |
| ATOM | 686 | NE | ARG | C | 87 | −9.802 | 57.968 | 0.770 | 1.00 | 59.65 | N |
| ATOM | 687 | CZ | ARG | C | 87 | −10.945 | 58.629 | 0.592 | 1.00 | 56.84 | C |
| ATOM | 688 | NH1 | ARG | C | 87 | −11.947 | 58.483 | 1.459 | 1.00 | 62.30 | N1+ |
| ATOM | 689 | NH2 | ARG | C | 87 | −11.079 | 59.444 | −0.449 | 1.00 | 58.47 | N |
| ATOM | 690 | N | VAL | C | 88 | −5.536 | 55.384 | 4.900 | 1.00 | 37.13 | N |
| ATOM | 691 | CA | VAL | C | 88 | −4.184 | 54.851 | 5.067 | 1.00 | 40.40 | C |
| ATOM | 692 | C | VAL | C | 88 | −3.218 | 55.550 | 4.113 | 1.00 | 41.32 | C |
| ATOM | 693 | O | VAL | C | 88 | −2.142 | 56.021 | 4.510 | 1.00 | 39.20 | O |
| ATOM | 694 | CB | VAL | C | 88 | −4.191 | 53.320 | 4.863 | 1.00 | 38.65 | C |
| ATOM | 695 | CG1 | VAL | C | 88 | −2.774 | 52.764 | 4.702 | 1.00 | 37.78 | C |
| ATOM | 696 | CG2 | VAL | C | 88 | −4.883 | 52.634 | 6.045 | 1.00 | 35.60 | C |
| ATOM | 697 | N | GLU | C | 89 | −3.621 | 55.684 | 2.856 | 1.00 | 36.74 | N |
| ATOM | 698 | CA | GLU | C | 89 | −2.794 | 56.334 | 1.849 | 1.00 | 37.93 | C |
| ATOM | 699 | C | GLU | C | 89 | −2.629 | 57.845 | 2.082 | 1.00 | 39.72 | C |
| ATOM | 700 | O | GLU | C | 89 | −1.953 | 58.480 | 1.274 | 1.00 | 41.02 | O |
| ATOM | 701 | CB | GLU | C | 89 | −3.324 | 56.041 | 0.434 | 1.00 | 30.08 | C |
| ATOM | 702 | CG | GLU | C | 89 | −4.747 | 56.489 | 0.150 | 1.00 | 44.00 | C |
| ATOM | 703 | CD | GLU | C | 89 | −5.802 | 55.528 | 0.720 | 1.00 | 65.19 | C |
| ATOM | 704 | OE1 | GLU | C | 89 | −7.001 | 55.726 | 0.398 | 1.00 | 72.89 | O |
| ATOM | 705 | OE2 | GLU | C | 89 | −5.434 | 54.580 | 1.479 | 1.00 | 57.08 | O1− |
| ATOM | 706 | N | ASP | C | 90 | −3.261 | 58.456 | 3.092 | 1.00 | 34.66 | N |
| ATOM | 707 | CA | ASP | C | 90 | −2.892 | 59.824 | 3.461 | 1.00 | 35.63 | C |
| ATOM | 708 | C | ASP | C | 90 | −1.648 | 59.885 | 4.344 | 1.00 | 36.64 | C |
| ATOM | 709 | O | ASP | C | 90 | −1.213 | 60.994 | 4.704 | 1.00 | 34.03 | O |
| ATOM | 710 | CB | ASP | C | 90 | −4.032 | 60.545 | 4.200 | 1.00 | 37.08 | C |
| ATOM | 711 | CG | ASP | C | 90 | −5.265 | 60.761 | 3.338 | 1.00 | 41.53 | C |
| ATOM | 712 | OD1 | ASP | C | 90 | −5.126 | 61.135 | 2.135 | 1.00 | 39.64 | O |
| ATOM | 713 | OD2 | ASP | C | 90 | −6.380 | 60.541 | 3.882 | 1.00 | 36.67 | O1− |

TABLE 10.3-continued

| ATOM | 714 | N | THR | C | 91 | −1.085 | 58.733 | 4.713 | 1.00 | 35.16 | N |
|---|---|---|---|---|---|---|---|---|---|---|---|
| ATOM | 715 | CA | THR | C | 91 | 0.114 | 58.684 | 5.552 | 1.00 | 38.29 | C |
| ATOM | 716 | C | THR | C | 91 | 1.260 | 59.354 | 4.826 | 1.00 | 31.75 | C |
| ATOM | 717 | O | THR | C | 91 | 1.572 | 58.989 | 3.690 | 1.00 | 36.79 | O |
| ATOM | 718 | CB | THR | C | 91 | 0.484 | 57.225 | 5.857 | 1.00 | 49.62 | C |
| ATOM | 719 | OG1 | THR | C | 91 | −0.561 | 56.594 | 6.611 | 1.00 | 40.91 | O |
| ATOM | 720 | CG2 | THR | C | 91 | 1.824 | 57.138 | 6.602 | 1.00 | 35.10 | C |
| ATOM | 721 | N | ALA | C | 92 | 1.876 | 60.340 | 5.462 | 1.00 | 34.05 | N |
| ATOM | 722 | CA | ALA | C | 92 | 2.886 | 61.136 | 4.778 | 1.00 | 32.82 | C |
| ATOM | 723 | C | ALA | C | 92 | 3.495 | 62.111 | 5.760 | 1.00 | 30.84 | C |
| ATOM | 724 | O | ALA | C | 92 | 2.938 | 62.368 | 6.827 | 1.00 | 30.26 | O |
| ATOM | 725 | CB | ALA | C | 92 | 2.304 | 61.923 | 3.596 | 1.00 | 36.15 | C |
| ATOM | 726 | N | VAL | C | 93 | 4.648 | 62.657 | 5.382 | 1.00 | 35.57 | N |
| ATOM | 727 | CA | VAL | C | 93 | 5.111 | 63.910 | 5.967 | 1.00 | 35.12 | C |
| ATOM | 728 | C | VAL | C | 93 | 4.408 | 65.064 | 5.265 | 1.00 | 34.14 | C |
| ATOM | 729 | O | VAL | C | 93 | 4.322 | 65.099 | 4.032 | 1.00 | 35.63 | O |
| ATOM | 730 | CB | VAL | C | 93 | 6.633 | 64.038 | 5.857 | 1.00 | 34.90 | C |
| ATOM | 731 | CG1 | VAL | C | 93 | 7.077 | 65.442 | 6.323 | 1.00 | 28.59 | C |
| ATOM | 732 | CG2 | VAL | C | 93 | 7.297 | 62.925 | 6.680 | 1.00 | 31.28 | C |
| ATOM | 733 | N | TYR | C | 94 | 3.897 | 66.006 | 6.045 | 1.00 | 33.45 | N |
| ATOM | 734 | CA | TYR | C | 94 | 3.184 | 67.159 | 5.518 | 1.00 | 37.19 | C |
| ATOM | 735 | C | TYR | C | 94 | 4.043 | 68.395 | 5.707 | 1.00 | 36.22 | C |
| ATOM | 736 | O | TYR | C | 94 | 4.511 | 68.654 | 6.820 | 1.00 | 37.12 | O |
| ATOM | 737 | CB | TYR | C | 94 | 1.826 | 67.335 | 6.216 | 1.00 | 29.33 | C |
| ATOM | 738 | CG | TYR | C | 94 | 0.818 | 66.349 | 5.708 | 1.00 | 38.48 | C |
| ATOM | 739 | CD1 | TYR | C | 94 | 0.931 | 64.986 | 6.003 | 1.00 | 33.38 | C |
| ATOM | 740 | CD2 | TYR | C | 94 | −0.223 | 66.760 | 4.887 | 1.00 | 34.11 | C |
| ATOM | 741 | CE1 | TYR | C | 94 | 0.012 | 64.069 | 5.508 | 1.00 | 35.06 | C |
| ATOM | 742 | CE2 | TYR | C | 94 | −1.143 | 65.848 | 4.386 | 1.00 | 32.26 | C |
| ATOM | 743 | CZ | TYR | C | 94 | −1.033 | 64.510 | 4.706 | 1.00 | 31.31 | C |
| ATOM | 744 | OH | TYR | C | 94 | −1.955 | 63.614 | 4.184 | 1.00 | 29.76 | O |
| ATOM | 745 | N | TYR | C | 95 | 4.240 | 69.154 | 4.625 | 1.00 | 33.06 | N |
| ATOM | 746 | CA | TYR | C | 95 | 4.988 | 70.408 | 4.660 | 1.00 | 37.25 | C |
| ATOM | 747 | C | TYR | C | 95 | 4.091 | 71.583 | 4.292 | 1.00 | 38.95 | C |
| ATOM | 748 | O | TYR | C | 95 | 3.283 | 71.491 | 3.356 | 1.00 | 34.73 | O |
| ATOM | 749 | CB | TYR | C | 95 | 6.160 | 70.409 | 3.680 | 1.00 | 33.44 | C |
| ATOM | 750 | CG | TYR | C | 95 | 7.187 | 69.311 | 3.833 | 1.00 | 36.03 | C |
| ATOM | 751 | CD1 | TYR | C | 95 | 8.260 | 69.444 | 4.718 | 1.00 | 30.51 | C |
| ATOM | 752 | CD2 | TYR | C | 95 | 7.124 | 68.165 | 3.036 | 1.00 | 34.65 | C |
| ATOM | 753 | CE1 | TYR | C | 95 | 9.231 | 68.431 | 4.825 | 1.00 | 35.04 | C |
| ATOM | 754 | CE2 | TYR | C | 95 | 8.078 | 67.163 | 3.132 | 1.00 | 35.40 | C |
| ATOM | 755 | CZ | TYR | C | 95 | 9.124 | 67.295 | 4.023 | 1.00 | 36.07 | C |
| ATOM | 756 | OH | TYR | C | 95 | 10.054 | 66.281 | 4.097 | 1.00 | 43.55 | O |
| ATOM | 757 | N | CYS | C | 96 | 4.277 | 72.713 | 4.969 | 1.00 | 32.29 | N |
| ATOM | 758 | CA | CYS | C | 96 | 3.722 | 73.935 | 4.419 | 1.00 | 35.55 | C |
| ATOM | 759 | C | CYS | C | 96 | 4.819 | 74.668 | 3.674 | 1.00 | 34.71 | C |
| ATOM | 760 | O | CYS | C | 96 | 6.007 | 74.463 | 3.919 | 1.00 | 37.92 | O |
| ATOM | 761 | CB | CYS | C | 96 | 3.090 | 74.846 | 5.484 | 1.00 | 37.18 | C |
| ATOM | 762 | SG | CYS | C | 96 | 4.149 | 75.311 | 6.821 | 1.00 | 55.09 | S |
| ATOM | 763 | N | ALA | C | 97 | 4.391 | 75.493 | 2.720 | 1.00 | 37.06 | N |
| ATOM | 764 | CA | ALA | C | 97 | 5.252 | 76.388 | 1.965 | 1.00 | 33.86 | C |
| ATOM | 765 | C | ALA | C | 97 | 4.453 | 77.646 | 1.659 | 1.00 | 36.16 | C |
| ATOM | 766 | O | ALA | C | 97 | 3.224 | 77.620 | 1.638 | 1.00 | 37.96 | O |
| ATOM | 767 | CB | ALA | C | 97 | 5.744 | 75.736 | 0.667 | 1.00 | 31.03 | C |
| ATOM | 768 | N | ASN | C | 98 | 5.141 | 78.756 | 1.411 | 1.00 | 36.24 | N |
| ATOM | 769 | CA | ASN | C | 98 | 4.402 | 79.933 | 0.984 | 1.00 | 36.16 | C |
| ATOM | 770 | C | ASN | C | 98 | 4.643 | 80.154 | −0.505 | 1.00 | 33.85 | C |
| ATOM | 771 | O | ASN | C | 98 | 5.379 | 79.405 | −1.150 | 1.00 | 34.25 | O |
| ATOM | 772 | CB | ASN | C | 98 | 4.750 | 81.159 | 1.836 | 1.00 | 33.87 | C |
| ATOM | 773 | CG | ASN | C | 98 | 6.152 | 81.689 | 1.602 | 1.00 | 36.19 | C |
| ATOM | 774 | OD1 | ASN | C | 98 | 6.912 | 81.172 | 0.781 | 1.00 | 35.81 | O |
| ATOM | 775 | ND2 | ASN | C | 98 | 6.490 | 82.759 | 2.312 | 1.00 | 32.46 | N |
| ATOM | 776 | N | TRP | C | 99 | 4.001 | 81.179 | −1.060 | 1.00 | 29.34 | N |
| ATOM | 777 | CA | TRP | C | 99 | 4.253 | 81.534 | −2.451 | 1.00 | 32.42 | C |
| ATOM | 778 | C | TRP | C | 99 | 4.141 | 83.043 | −2.609 | 1.00 | 34.35 | C |
| ATOM | 779 | O | TRP | C | 99 | 3.294 | 83.677 | −1.978 | 1.00 | 36.87 | O |
| ATOM | 780 | CB | TRP | C | 99 | 3.301 | 80.808 | −3.409 | 1.00 | 31.13 | C |
| ATOM | 781 | CG | TRP | C | 99 | 1.832 | 81.172 | −3.311 | 1.00 | 38.60 | C |
| ATOM | 782 | CD1 | TRP | C | 99 | 0.869 | 80.545 | −2.558 | 1.00 | 36.35 | C |
| ATOM | 783 | CD2 | TRP | C | 99 | 1.160 | 82.217 | −4.028 | 1.00 | 33.13 | C |
| ATOM | 784 | NE1 | TRP | C | 99 | −0.359 | 81.151 | −2.754 | 1.00 | 32.28 | N |
| ATOM | 785 | CE2 | TRP | C | 99 | −0.207 | 82.175 | −3.653 | 1.00 | 36.97 | C |
| ATOM | 786 | CE3 | TRP | C | 99 | 1.580 | 83.187 | −4.949 | 1.00 | 33.81 | C |
| ATOM | 787 | CZ2 | TRP | C | 99 | −1.155 | 83.078 | −4.160 | 1.00 | 35.91 | C |
| ATOM | 788 | CZ3 | TRP | C | 99 | 0.639 | 84.078 | −5.459 | 1.00 | 33.25 | C |
| ATOM | 789 | CH2 | TRP | C | 99 | −0.712 | 84.016 | −5.059 | 1.00 | 34.18 | C |
| ATOM | 790 | N | TYR | C | 100 | 5.011 | 83.606 | −3.443 | 1.00 | 35.97 | N |
| ATOM | 791 | CA | TYR | C | 100 | 5.148 | 85.048 | −3.651 | 1.00 | 34.82 | C |
| ATOM | 792 | C | TYR | C | 100 | 4.693 | 85.512 | −5.022 | 1.00 | 35.71 | C |
| ATOM | 793 | O | TYR | C | 100 | 4.101 | 86.591 | −5.143 | 1.00 | 33.01 | O |

TABLE 10.3-continued

| | | | | | | | | | | |
|---|---|---|---|---|---|---|---|---|---|---|
| ATOM | 794 | CB | TYR | C | 100 | 6.615 | 85.472 | −3.493 | 1.00 | 28.22 | C |
| ATOM | 795 | CG | TYR | C | 100 | 7.184 | 85.286 | −2.114 | 1.00 | 36.73 | C |
| ATOM | 796 | CD1 | TYR | C | 100 | 6.415 | 85.536 | −0.971 | 1.00 | 34.55 | C |
| ATOM | 797 | CD2 | TYR | C | 100 | 8.496 | 84.852 | −1.946 | 1.00 | 35.48 | C |
| ATOM | 798 | CE1 | TYR | C | 100 | 6.951 | 85.365 | 0.299 | 1.00 | 36.55 | C |
| ATOM | 799 | CE2 | TYR | C | 100 | 9.032 | 84.666 | −0.684 | 1.00 | 33.46 | C |
| ATOM | 800 | CZ | TYR | C | 100 | 8.263 | 84.929 | 0.430 | 1.00 | 36.36 | C |
| ATOM | 801 | OH | TYR | C | 100 | 8.813 | 84.749 | 1.674 | 1.00 | 36.68 | O |
| ATOM | 802 | N | TYR | C | 101 | 4.990 | 84.731 | −6.059 | 1.00 | 32.01 | N |
| ATOM | 803 | CA | TYR | C | 101 | 4.927 | 85.197 | −7.439 | 1.00 | 35.14 | C |
| ATOM | 804 | C | TYR | C | 101 | 3.758 | 84.539 | −8.159 | 1.00 | 31.46 | C |
| ATOM | 805 | O | TYR | C | 101 | 2.795 | 85.215 | −8.492 | 1.00 | 32.52 | O |
| ATOM | 806 | CB | TYR | C | 101 | 6.249 | 84.921 | −8.157 | 1.00 | 25.12 | C |
| ATOM | 807 | CG | TYR | C | 101 | 7.430 | 85.482 | −7.409 | 1.00 | 31.29 | C |
| ATOM | 808 | CD1 | TYR | C | 101 | 7.594 | 86.850 | −7.307 | 1.00 | 30.52 | C |
| ATOM | 809 | CD2 | TYR | C | 101 | 8.385 | 84.653 | −6.796 | 1.00 | 34.01 | C |
| ATOM | 810 | CE1 | TYR | C | 101 | 8.646 | 87.393 | −6.644 | 1.00 | 31.83 | C |
| ATOM | 811 | CE2 | TYR | C | 101 | 9.470 | 85.205 | −6.099 | 1.00 | 29.33 | C |
| ATOM | 812 | CZ | TYR | C | 101 | 9.586 | 86.589 | −6.042 | 1.00 | 34.04 | C |
| ATOM | 813 | OH | TYR | C | 101 | 10.613 | 87.238 | −5.396 | 1.00 | 38.85 | O |
| ATOM | 814 | N | TYR | C | 102 | 3.818 | 83.241 | −8.407 | 1.00 | 32.18 | N |
| ATOM | 815 | CA | TYR | C | 102 | 2.692 | 82.528 | −8.984 | 1.00 | 26.83 | C |
| ATOM | 816 | C | TYR | C | 102 | 2.185 | 81.474 | −8.000 | 1.00 | 34.57 | C |
| ATOM | 817 | O | TYR | C | 102 | 2.959 | 80.888 | −7.237 | 1.00 | 30.16 | O |
| ATOM | 818 | CB | TYR | C | 102 | 3.069 | 81.916 | −10.328 | 1.00 | 26.41 | C |
| ATOM | 819 | CG | TYR | C | 102 | 4.422 | 81.207 | −10.424 | 1.00 | 31.59 | C |
| ATOM | 820 | CD1 | TYR | C | 102 | 5.586 | 81.894 | −10.776 | 1.00 | 25.87 | C |
| ATOM | 821 | CD2 | TYR | C | 102 | 4.510 | 79.827 | −10.218 | 1.00 | 34.03 | C |
| ATOM | 822 | CE1 | TYR | C | 102 | 6.807 | 81.225 | −10.900 | 1.00 | 28.32 | C |
| ATOM | 823 | CE2 | TYR | C | 102 | 5.708 | 79.150 | −10.339 | 1.00 | 29.44 | C |
| ATOM | 824 | CZ | TYR | C | 102 | 6.856 | 79.842 | −10.677 | 1.00 | 37.60 | C |
| ATOM | 825 | OH | TYR | C | 102 | 8.030 | 79.125 | −10.804 | 1.00 | 31.27 | O |
| ATOM | 826 | N | TYR | C | 103 | 0.861 | 81.255 | −8.005 | 1.00 | 34.62 | N |
| ATOM | 827 | CA | TYR | C | 103 | 0.206 | 80.545 | −6.908 | 1.00 | 30.24 | C |
| ATOM | 828 | C | TYR | C | 103 | 0.561 | 79.069 | −6.860 | 1.00 | 33.90 | C |
| ATOM | 829 | O | TYR | C | 103 | 0.334 | 78.431 | −5.826 | 1.00 | 33.35 | O |
| ATOM | 830 | CB | TYR | C | 103 | −1.330 | 80.708 | −6.981 | 1.00 | 32.59 | C |
| ATOM | 831 | CG | TYR | C | 103 | −1.968 | 80.050 | −8.196 | 1.00 | 30.66 | C |
| ATOM | 832 | CD1 | TYR | C | 103 | −2.097 | 80.744 | −9.398 | 1.00 | 32.62 | C |
| ATOM | 833 | CD2 | TYR | C | 103 | −2.439 | 78.739 | −8.145 | 1.00 | 31.75 | C |
| ATOM | 834 | CE1 | TYR | C | 103 | −2.677 | 80.151 | −10.526 | 1.00 | 34.17 | C |
| ATOM | 835 | CE2 | TYR | C | 103 | −3.030 | 78.132 | −9.277 | 1.00 | 35.45 | C |
| ATOM | 836 | CZ | TYR | C | 103 | −3.140 | 78.851 | −10.460 | 1.00 | 38.01 | C |
| ATOM | 837 | OH | TYR | C | 103 | −3.707 | 78.286 | −11.585 | 1.00 | 43.93 | O |
| ATOM | 838 | N | TYR | C | 104 | 1.090 | 78.503 | −7.941 | 1.00 | 33.41 | N |
| ATOM | 839 | CA | TYR | C | 104 | 1.431 | 77.088 | −7.959 | 1.00 | 31.54 | C |
| ATOM | 840 | C | TYR | C | 104 | 2.921 | 76.846 | −7.775 | 1.00 | 35.80 | C |
| ATOM | 841 | O | TYR | C | 104 | 3.383 | 75.706 | −7.933 | 1.00 | 34.83 | O |
| ATOM | 842 | CB | TYR | C | 104 | 0.942 | 76.437 | −9.254 | 1.00 | 31.39 | C |
| ATOM | 843 | CG | TYR | C | 104 | 1.310 | 77.192 | −10.505 | 1.00 | 35.92 | C |
| ATOM | 844 | CD1 | TYR | C | 104 | 2.537 | 76.979 | −11.134 | 1.00 | 29.90 | C |
| ATOM | 845 | CD2 | TYR | C | 104 | 0.431 | 78.136 | −11.058 | 1.00 | 37.72 | C |
| ATOM | 846 | CE1 | TYR | C | 104 | 2.887 | 77.682 | −12.297 | 1.00 | 31.96 | C |
| ATOM | 847 | CE2 | TYR | C | 104 | 0.773 | 78.853 | −12.216 | 1.00 | 33.33 | C |
| ATOM | 848 | CZ | TYR | C | 104 | 1.997 | 78.611 | −12.832 | 1.00 | 37.08 | C |
| ATOM | 849 | OH | TYR | C | 104 | 2.322 | 79.290 | −13.988 | 1.00 | 38.85 | O |
| ATOM | 850 | N | GLY | C | 105 | 3.677 | 77.881 | −7.424 | 1.00 | 30.57 | N |
| ATOM | 851 | CA | GLY | C | 105 | 5.069 | 77.729 | −7.046 | 1.00 | 31.29 | C |
| ATOM | 852 | C | GLY | C | 105 | 5.189 | 77.804 | −5.536 | 1.00 | 35.97 | C |
| ATOM | 853 | O | GLY | C | 105 | 4.381 | 78.439 | −4.880 | 1.00 | 39.78 | O |
| ATOM | 854 | N | MET | C | 106 | 6.174 | 77.104 | −4.983 | 1.00 | 35.79 | N |
| ATOM | 855 | CA | MET | C | 106 | 6.477 | 77.149 | −3.560 | 1.00 | 29.65 | C |
| ATOM | 856 | C | MET | C | 106 | 7.811 | 77.844 | −3.359 | 1.00 | 34.76 | C |
| ATOM | 857 | O | MET | C | 106 | 8.814 | 77.447 | −3.964 | 1.00 | 40.34 | O |
| ATOM | 858 | CB | MET | C | 106 | 6.531 | 75.749 | −2.967 | 1.00 | 33.58 | C |
| ATOM | 859 | CG | MET | C | 106 | 5.200 | 75.079 | −2.997 | 1.00 | 40.63 | C |
| ATOM | 860 | SD | MET | C | 106 | 5.175 | 73.827 | −4.259 | 1.00 | 38.99 | S |
| ATOM | 861 | CE | MET | C | 106 | 3.449 | 73.894 | −4.753 | 1.00 | 39.97 | C |
| ATOM | 862 | N | ASP | C | 107 | 7.833 | 78.872 | −2.510 | 1.00 | 32.14 | N |
| ATOM | 863 | CA | ASP | C | 107 | 9.038 | 79.679 | −2.359 | 1.00 | 36.28 | C |
| ATOM | 864 | C | ASP | C | 107 | 9.814 | 79.363 | −1.087 | 1.00 | 36.05 | C |
| ATOM | 865 | O | ASP | C | 107 | 10.987 | 79.000 | −1.168 | 1.00 | 43.22 | O |
| ATOM | 866 | CB | ASP | C | 107 | 8.684 | 81.166 | −2.419 | 1.00 | 35.85 | C |
| ATOM | 867 | CG | ASP | C | 107 | 8.243 | 81.582 | −3.791 | 1.00 | 36.58 | C |
| ATOM | 868 | OD1 | ASP | C | 107 | 9.126 | 81.733 | −4.663 | 1.00 | 39.74 | O1− |
| ATOM | 869 | OD2 | ASP | C | 107 | 7.024 | 81.741 | −4.005 | 1.00 | 38.36 | O |
| ATOM | 870 | N | VAL | C | 108 | 9.185 | 79.486 | 0.079 | 1.00 | 34.27 | N |
| ATOM | 871 | CA | VAL | C | 108 | 9.795 | 79.131 | 1.354 | 1.00 | 37.63 | C |
| ATOM | 872 | C | VAL | C | 108 | 9.081 | 77.906 | 1.893 | 1.00 | 35.71 | C |
| ATOM | 873 | O | VAL | C | 108 | 7.853 | 77.818 | 1.820 | 1.00 | 36.94 | O |

TABLE 10.3-continued

| | | | | | | | | | | |
|---|---|---|---|---|---|---|---|---|---|---|
| ATOM | 874 | CB | VAL | C | 108 | 9.716 | 80.275 | 2.375 | 1.00 | 39.13 | C |
| ATOM | 875 | CG1 | VAL | C | 108 | 10.395 | 79.854 | 3.662 | 1.00 | 34.94 | C |
| ATOM | 876 | CG2 | VAL | C | 108 | 10.334 | 81.534 | 1.809 | 1.00 | 37.63 | C |
| ATOM | 877 | N | TRP | C | 109 | 9.845 | 76.969 | 2.442 | 1.00 | 35.86 | N |
| ATOM | 878 | CA | TRP | C | 109 | 9.305 | 75.713 | 2.950 | 1.00 | 38.43 | C |
| ATOM | 879 | C | TRP | C | 109 | 9.523 | 75.578 | 4.452 | 1.00 | 36.07 | C |
| ATOM | 880 | O | TRP | C | 109 | 10.470 | 76.127 | 5.011 | 1.00 | 34.83 | O |
| ATOM | 881 | CB | TRP | C | 109 | 9.935 | 74.510 | 2.270 | 1.00 | 28.64 | C |
| ATOM | 882 | CG | TRP | C | 109 | 9.627 | 74.379 | 0.834 | 1.00 | 32.20 | C |
| ATOM | 883 | CD1 | TRP | C | 109 | 10.053 | 75.196 | −0.178 | 1.00 | 33.19 | C |
| ATOM | 884 | CD2 | TRP | C | 109 | 8.857 | 73.338 | 0.215 | 1.00 | 30.88 | C |
| ATOM | 885 | NE1 | TRP | C | 109 | 9.589 | 74.729 | −1.385 | 1.00 | 32.70 | N |
| ATOM | 886 | CE2 | TRP | C | 109 | 8.853 | 73.589 | −1.171 | 1.00 | 32.73 | C |
| ATOM | 887 | CE3 | TRP | C | 109 | 8.175 | 72.219 | 0.696 | 1.00 | 31.39 | C |
| ATOM | 888 | CZ2 | TRP | C | 109 | 8.183 | 72.759 | −2.079 | 1.00 | 27.14 | C |
| ATOM | 889 | CZ3 | TRP | C | 109 | 7.510 | 71.395 | −0.205 | 1.00 | 25.68 | C |
| ATOM | 890 | CH2 | TRP | C | 109 | 7.532 | 71.661 | −1.575 | 1.00 | 25.11 | C |
| ATOM | 891 | N | GLY | C | 110 | 8.611 | 74.852 | 5.095 | 1.00 | 38.56 | N |
| ATOM | 892 | CA | GLY | C | 110 | 8.732 | 74.483 | 6.489 | 1.00 | 37.65 | C |
| ATOM | 893 | C | GLY | C | 110 | 9.578 | 73.243 | 6.689 | 1.00 | 38.90 | C |
| ATOM | 894 | O | GLY | C | 110 | 10.348 | 72.825 | 5.821 | 1.00 | 44.35 | O |
| ATOM | 895 | N | GLN | C | 111 | 9.417 | 72.638 | 7.864 | 1.00 | 37.08 | N |
| ATOM | 896 | CA | GLN | C | 111 | 10.257 | 71.526 | 8.265 | 1.00 | 37.72 | C |
| ATOM | 897 | C | GLN | C | 111 | 9.554 | 70.171 | 8.274 | 1.00 | 39.10 | C |
| ATOM | 898 | O | GLN | C | 111 | 10.241 | 69.143 | 8.268 | 1.00 | 46.62 | O |
| ATOM | 899 | CB | GLN | C | 111 | 10.854 | 71.823 | 9.646 | 1.00 | 41.49 | C |
| ATOM | 900 | CG | GLN | C | 111 | 9.971 | 71.407 | 10.795 | 1.00 | 57.57 | C |
| ATOM | 901 | CD | GLN | C | 111 | 10.317 | 72.142 | 12.083 | 1.00 | 71.42 | C |
| ATOM | 902 | OE1 | GLN | C | 111 | 11.162 | 73.046 | 12.079 | 1.00 | 67.32 | O |
| ATOM | 903 | NE2 | GLN | C | 111 | 9.662 | 71.761 | 13.194 | 1.00 | 62.29 | N |
| ATOM | 904 | N | GLY | C | 112 | 8.229 | 70.137 | 8.247 | 1.00 | 38.85 | N |
| ATOM | 905 | CA | GLY | C | 112 | 7.483 | 68.892 | 8.185 | 1.00 | 37.13 | C |
| ATOM | 906 | C | GLY | C | 112 | 6.892 | 68.477 | 9.528 | 1.00 | 40.61 | C |
| ATOM | 907 | O | GLY | C | 112 | 7.389 | 68.837 | 10.601 | 1.00 | 43.71 | O |
| ATOM | 908 | N | THR | C | 113 | 5.771 | 67.754 | 9.462 | 1.00 | 38.16 | N |
| ATOM | 909 | CA | THR | C | 113 | 5.125 | 67.066 | 10.574 | 1.00 | 37.93 | C |
| ATOM | 910 | C | THR | C | 113 | 4.592 | 65.777 | 9.967 | 1.00 | 40.18 | C |
| ATOM | 911 | O | THR | C | 113 | 4.106 | 65.791 | 8.834 | 1.00 | 43.97 | O |
| ATOM | 912 | CB | THR | C | 113 | 4.008 | 67.924 | 11.231 | 1.00 | 40.04 | C |
| ATOM | 913 | OG1 | THR | C | 113 | 3.470 | 67.248 | 12.370 | 1.00 | 48.01 | O |
| ATOM | 914 | CG2 | THR | C | 113 | 2.863 | 68.248 | 10.265 | 1.00 | 39.86 | C |
| ATOM | 915 | N | ATHR | C | 114 | 4.716 | 64.665 | 10.689 | 0.50 | 39.81 | N |
| ATOM | 916 | CA | ATHR | C | 114 | 4.418 | 63.359 | 10.110 | 0.50 | 39.05 | C |
| ATOM | 917 | C | ATHR | C | 114 | 3.038 | 62.873 | 10.545 | 0.50 | 39.83 | C |
| ATOM | 918 | O | ATHR | C | 114 | 2.650 | 63.015 | 11.709 | 0.50 | 39.84 | O |
| ATOM | 919 | CB | ATHR | C | 114 | 5.484 | 62.320 | 10.487 | 0.50 | 39.38 | C |
| ATOM | 920 | OG1 | ATHR | C | 114 | 5.310 | 61.937 | 11.853 | 0.50 | 49.44 | O |
| ATOM | 921 | CG2 | ATHR | C | 114 | 6.901 | 62.878 | 10.295 | 0.50 | 34.14 | C |
| ATOM | 922 | N | BTHR | C | 114 | 4.722 | 64.656 | 10.669 | 0.50 | 39.81 | N |
| ATOM | 923 | CA | BTHR | C | 114 | 4.413 | 63.376 | 10.040 | 0.50 | 39.04 | C |
| ATOM | 924 | C | BTHR | C | 114 | 3.083 | 62.819 | 10.539 | 0.50 | 39.82 | C |
| ATOM | 925 | O | BTHR | C | 114 | 2.766 | 62.880 | 11.731 | 0.50 | 39.90 | O |
| ATOM | 926 | CB | BTHR | C | 114 | 5.554 | 62.360 | 10.232 | 0.50 | 39.16 | C |
| ATOM | 927 | OG1 | BTHR | C | 114 | 5.037 | 61.021 | 10.248 | 0.50 | 33.47 | O |
| ATOM | 928 | CG2 | BTHR | C | 114 | 6.343 | 62.647 | 11.490 | 0.50 | 42.84 | C |
| ATOM | 929 | N | VAL | C | 115 | 2.298 | 62.308 | 9.592 | 1.00 | 38.42 | N |
| ATOM | 930 | CA | VAL | C | 115 | 0.962 | 61.778 | 9.817 | 1.00 | 36.25 | C |
| ATOM | 931 | C | VAL | C | 115 | 0.968 | 60.298 | 9.446 | 1.00 | 37.55 | C |
| ATOM | 932 | O | VAL | C | 115 | 1.310 | 59.940 | 8.313 | 1.00 | 39.55 | O |
| ATOM | 933 | CB | VAL | C | 115 | −0.092 | 62.536 | 8.991 | 1.00 | 37.32 | C |
| ATOM | 934 | CG1 | VAL | C | 115 | −1.443 | 61.798 | 9.049 | 1.00 | 33.92 | C |
| ATOM | 935 | CG2 | VAL | C | 115 | −0.223 | 63.961 | 9.492 | 1.00 | 31.70 | C |
| ATOM | 936 | N | THR | C | 116 | 0.580 | 59.443 | 10.388 | 1.00 | 35.49 | N |
| ATOM | 937 | CA | THR | C | 116 | 0.471 | 58.014 | 10.145 | 1.00 | 38.36 | C |
| ATOM | 938 | C | THR | C | 116 | −0.987 | 57.603 | 10.309 | 1.00 | 43.76 | C |
| ATOM | 939 | O | THR | C | 116 | −1.596 | 57.873 | 11.350 | 1.00 | 43.30 | O |
| ATOM | 940 | CB | THR | C | 116 | 1.379 | 57.223 | 11.096 | 1.00 | 45.91 | C |
| ATOM | 941 | OG1 | THR | C | 116 | 2.734 | 57.660 | 10.937 | 1.00 | 47.40 | O |
| ATOM | 942 | CG2 | THR | C | 116 | 1.342 | 55.751 | 10.742 | 1.00 | 42.59 | C |
| ATOM | 943 | N | VAL | C | 117 | −1.553 | 56.977 | 9.283 | 1.00 | 36.12 | N |
| ATOM | 944 | CA | VAL | C | 117 | −2.926 | 56.501 | 9.346 | 1.00 | 41.60 | C |
| ATOM | 945 | C | VAL | C | 117 | −2.891 | 54.978 | 9.276 | 1.00 | 45.74 | C |
| ATOM | 946 | O | VAL | C | 117 | −2.634 | 54.394 | 8.211 | 1.00 | 44.01 | O |
| ATOM | 947 | CB | VAL | C | 117 | −3.813 | 57.107 | 8.244 | 1.00 | 42.69 | C |
| ATOM | 948 | CG1 | VAL | C | 117 | −5.257 | 56.664 | 8.437 | 1.00 | 34.13 | C |
| ATOM | 949 | CG2 | VAL | C | 117 | −3.720 | 58.666 | 8.235 | 1.00 | 38.65 | C |
| ATOM | 950 | N | SER | C | 118 | −3.181 | 54.330 | 10.407 | 1.00 | 42.18 | N |
| ATOM | 951 | CA | SER | C | 118 | −3.101 | 52.882 | 10.500 | 1.00 | 45.65 | C |
| ATOM | 952 | C | SER | C | 118 | −4.244 | 52.329 | 11.345 | 1.00 | 46.76 | C |
| ATOM | 953 | O | SER | C | 118 | −4.596 | 52.891 | 12.389 | 1.00 | 43.45 | O |

TABLE 10.3-continued

| ATOM | 954 | CB | SER | C | 118 | −1.764 | 52.442 | 11.101 | 1.00 | 45.42 | | C |
|------|-----|-----|-----|---|-----|--------|--------|--------|------|-------|------|-----|
| ATOM | 955 | OG | SER | C | 118 | −1.694 | 51.028 | 11.142 | 1.00 | 53.46 | | O |
| ATOM | 956 | N | SER | C | 119 | −4.800 | 51.204 | 10.901 | 1.00 | 39.96 | | N |
| ATOM | 957 | CA | SER | C | 119 | −5.765 | 50.456 | 11.697 | 1.00 | 55.76 | | C |
| ATOM | 958 | C | SER | C | 119 | −5.145 | 49.241 | 12.384 | 1.00 | 58.97 | | C |
| ATOM | 959 | O | SER | C | 119 | −5.879 | 48.417 | 12.940 | 1.00 | 56.42 | | O |
| ATOM | 960 | CB | SER | C | 119 | −6.956 | 50.024 | 10.833 | 1.00 | 47.59 | | C |
| ATOM | 961 | OG | SER | C | 119 | −6.537 | 49.473 | 9.592 | 1.00 | 60.90 | | O |
| ATOM | 962 | N | ALA | C | 120 | −3.821 | 49.092 | 12.325 | 1.00 | 53.37 | | N |
| ATOM | 963 | CA | ALA | C | 120 | −3.157 | 47.942 | 12.923 | 1.00 | 49.27 | | C |
| ATOM | 964 | C | ALA | C | 120 | −3.115 | 48.063 | 14.439 | 1.00 | 53.61 | | C |
| ATOM | 965 | O | ALA | C | 120 | −3.088 | 49.160 | 15.007 | 1.00 | 51.80 | | O |
| ATOM | 966 | CB | ALA | C | 120 | −1.736 | 47.799 | 12.376 | 1.00 | 54.97 | | C |
| ATOM | 967 | N | SER | C | 121 | −3.101 | 46.918 | 15.104 | 1.00 | 50.81 | GZ00 | N |
| ATOM | 968 | CA | SER | C | 121 | −2.922 | 46.921 | 16.546 | 1.00 | 62.62 | GZ00 | C |
| ATOM | 969 | C | SER | C | 121 | −1.817 | 45.945 | 16.925 | 1.00 | 55.18 | GZ00 | C |
| ATOM | 970 | O | SER | C | 121 | −1.492 | 45.015 | 16.175 | 1.00 | 50.22 | GZ00 | O |
| ATOM | 971 | CB | SER | C | 121 | −4.226 | 46.571 | 17.271 | 1.00 | 60.87 | GZ00 | C |
| ATOM | 972 | OG | SER | C | 121 | −4.902 | 45.539 | 16.576 | 1.00 | 67.02 | GZ00 | O |
| ATOM | 973 | N | THR | C | 122 | −1.276 | 46.170 | 18.123 | 1.00 | 43.63 | GZ00 | N |
| ATOM | 974 | CA | THR | C | 122 | −0.125 | 45.444 | 18.640 | 1.00 | 49.19 | GZ00 | C |
| ATOM | 975 | C | THR | C | 122 | −0.197 | 43.955 | 18.342 | 1.00 | 48.67 | GZ00 | C |
| ATOM | 976 | O | THR | C | 122 | −1.207 | 43.300 | 18.591 | 1.00 | 54.63 | GZ00 | O |
| ATOM | 977 | CB | THR | C | 122 | −0.014 | 45.661 | 20.147 | 1.00 | 51.65 | GZ00 | C |
| ATOM | 978 | OG1 | THR | C | 122 | 0.017 | 47.074 | 20.426 | 1.00 | 49.30 | GZ00 | O |
| ATOM | 979 | CG2 | THR | C | 122 | 1.260 | 44.988 | 20.690 | 1.00 | 49.88 | GZ00 | C |
| ATOM | 980 | N | LYS | C | 123 | 0.890 | 43.430 | 17.795 | 1.00 | 50.80 | GZ00 | N |
| ATOM | 981 | CA | LYS | C | 123 | 0.976 | 42.015 | 17.485 | 1.00 | 49.10 | GZ00 | C |
| ATOM | 982 | C | LYS | C | 123 | 2.446 | 41.622 | 17.506 | 1.00 | 56.41 | GZ00 | C |
| ATOM | 983 | O | LYS | C | 123 | 3.290 | 42.358 | 16.985 | 1.00 | 49.74 | GZ00 | O |
| ATOM | 984 | CB | LYS | C | 123 | 0.338 | 41.693 | 16.133 | 1.00 | 44.99 | GZ00 | C |
| ATOM | 985 | CG | LYS | C | 123 | 0.499 | 40.238 | 15.807 | 1.00 | 44.28 | GZ00 | C |
| ATOM | 986 | CD | LYS | C | 123 | −0.078 | 39.820 | 14.484 | 1.00 | 49.15 | GZ00 | C |
| ATOM | 987 | CE | LYS | C | 123 | 0.361 | 38.368 | 14.217 | 1.00 | 62.00 | GZ00 | C |
| ATOM | 988 | NZ | LYS | C | 123 | −0.182 | 37.795 | 12.951 | 1.00 | 72.41 | GZ00 | N1+ |
| ATOM | 989 | N | GLY | C | 124 | 2.752 | 40.507 | 18.178 | 1.00 | 53.97 | GZ00 | N |
| ATOM | 990 | CA | GLY | C | 124 | 4.094 | 39.983 | 18.217 | 1.00 | 39.15 | GZ00 | C |
| ATOM | 991 | C | GLY | C | 124 | 4.382 | 39.194 | 16.962 | 1.00 | 43.80 | GZ00 | C |
| ATOM | 992 | O | GLY | C | 124 | 3.474 | 38.686 | 16.297 | 1.00 | 46.60 | GZ00 | O |
| ATOM | 993 | N | PRO | C | 125 | 5.658 | 39.060 | 16.625 | 1.00 | 47.07 | GZ00 | N |
| ATOM | 994 | CA | PRO | C | 125 | 6.043 | 38.419 | 15.362 | 1.00 | 48.03 | GZ00 | C |
| ATOM | 995 | C | PRO | C | 125 | 6.129 | 36.902 | 15.443 | 1.00 | 43.83 | GZ00 | C |
| ATOM | 996 | O | PRO | C | 125 | 6.341 | 36.326 | 16.503 | 1.00 | 45.86 | GZ00 | O |
| ATOM | 997 | CB | PRO | C | 125 | 7.440 | 38.999 | 15.095 | 1.00 | 45.07 | GZ00 | C |
| ATOM | 998 | CG | PRO | C | 125 | 7.989 | 39.254 | 16.464 | 1.00 | 48.96 | GZ00 | C |
| ATOM | 999 | CD | PRO | C | 125 | 6.800 | 39.689 | 17.314 | 1.00 | 46.04 | GZ00 | C |
| ATOM | 1000 | N | SER | C | 126 | 5.963 | 36.270 | 14.280 | 1.00 | 42.83 | GZ00 | N |
| ATOM | 1001 | CA | SER | C | 126 | 6.393 | 34.900 | 14.053 | 1.00 | 46.91 | GZ00 | C |
| ATOM | 1002 | C | SER | C | 126 | 7.817 | 34.900 | 13.498 | 1.00 | 49.79 | GZ00 | C |
| ATOM | 1003 | O | SER | C | 126 | 8.157 | 35.713 | 12.635 | 1.00 | 45.82 | GZ00 | O |
| ATOM | 1004 | CB | SER | C | 126 | 5.461 | 34.192 | 13.071 | 1.00 | 50.64 | GZ00 | C |
| ATOM | 1005 | OG | SER | C | 126 | 4.145 | 34.158 | 13.572 | 1.00 | 58.04 | GZ00 | O |
| ATOM | 1006 | N | VAL | C | 127 | 8.645 | 33.980 | 13.986 | 1.00 | 49.68 | GZ00 | N |
| ATOM | 1007 | CA | VAL | C | 127 | 10.059 | 33.915 | 13.624 | 1.00 | 45.00 | GZ00 | C |
| ATOM | 1008 | C | VAL | C | 127 | 10.335 | 32.584 | 12.950 | 1.00 | 42.10 | GZ00 | C |
| ATOM | 1009 | O | VAL | C | 127 | 10.021 | 31.528 | 13.504 | 1.00 | 57.42 | GZ00 | O |
| ATOM | 1010 | CB | VAL | C | 127 | 10.958 | 34.110 | 14.855 | 1.00 | 44.31 | GZ00 | C |
| ATOM | 1011 | CG1 | VAL | C | 127 | 12.431 | 34.119 | 14.456 | 1.00 | 47.62 | GZ00 | C |
| ATOM | 1012 | CG2 | VAL | C | 127 | 10.577 | 35.406 | 15.554 | 1.00 | 41.45 | GZ00 | C |
| ATOM | 1013 | N | PHE | C | 128 | 10.912 | 32.635 | 11.758 | 1.00 | 43.32 | GZ00 | N |
| ATOM | 1014 | CA | PHE | C | 128 | 11.244 | 31.451 | 10.983 | 1.00 | 44.87 | GZ00 | C |
| ATOM | 1015 | C | PHE | C | 128 | 12.729 | 31.447 | 10.629 | 1.00 | 50.79 | GZ00 | C |
| ATOM | 1016 | O | PHE | C | 128 | 13.327 | 32.511 | 10.435 | 1.00 | 47.46 | GZ00 | O |
| ATOM | 1017 | CB | PHE | C | 128 | 10.425 | 31.399 | 9.694 | 1.00 | 48.10 | GZ00 | C |
| ATOM | 1018 | CG | PHE | C | 128 | 8.942 | 31.384 | 9.922 | 1.00 | 58.19 | GZ00 | C |
| ATOM | 1019 | CD1 | PHE | C | 128 | 8.272 | 30.200 | 10.176 | 1.00 | 58.46 | GZ00 | C |
| ATOM | 1020 | CD2 | PHE | C | 128 | 8.220 | 32.566 | 9.912 | 1.00 | 56.25 | GZ00 | C |
| ATOM | 1021 | CE1 | PHE | C | 128 | 6.912 | 30.198 | 10.387 | 1.00 | 58.84 | GZ00 | C |
| ATOM | 1022 | CE2 | PHE | C | 128 | 6.855 | 32.568 | 10.128 | 1.00 | 55.91 | GZ00 | C |
| ATOM | 1023 | CZ | PHE | C | 128 | 6.205 | 31.387 | 10.358 | 1.00 | 55.09 | GZ00 | C |
| ATOM | 1024 | N | PRO | C | 129 | 13.360 | 30.275 | 10.560 | 1.00 | 52.29 | GZ00 | N |
| ATOM | 1025 | CA | PRO | C | 129 | 14.779 | 30.230 | 10.200 | 1.00 | 40.71 | GZ00 | C |
| ATOM | 1026 | C | PRO | C | 129 | 14.975 | 30.363 | 8.705 | 1.00 | 44.60 | GZ00 | C |
| ATOM | 1027 | O | PRO | C | 129 | 14.205 | 29.819 | 7.907 | 1.00 | 48.43 | GZ00 | O |
| ATOM | 1028 | CB | PRO | C | 129 | 15.218 | 28.840 | 10.681 | 1.00 | 53.19 | GZ00 | C |
| ATOM | 1029 | CG | PRO | C | 129 | 13.998 | 28.000 | 10.486 | 1.00 | 46.32 | GZ00 | C |
| ATOM | 1030 | CD | PRO | C | 129 | 12.829 | 28.925 | 10.840 | 1.00 | 50.96 | GZ00 | C |
| ATOM | 1031 | N | LEU | C | 130 | 16.017 | 31.101 | 8.330 | 1.00 | 39.68 | GZ00 | N |
| ATOM | 1032 | CA | LEU | C | 130 | 16.463 | 31.190 | 6.947 | 1.00 | 38.79 | GZ00 | C |
| ATOM | 1033 | C | LEU | C | 130 | 17.725 | 30.330 | 6.838 | 1.00 | 45.86 | GZ00 | C |

TABLE 10.3-continued

| | | | | | | | | | | | |
|---|---|---|---|---|---|---|---|---|---|---|---|
| ATOM | 1034 | O | LEU | C | 130 | 18.834 | 30.778 | 7.150 | 1.00 | 44.51 | GZ00 O |
| ATOM | 1035 | CB | LEU | C | 130 | 16.699 | 32.647 | 6.568 | 1.00 | 41.81 | GZ00 C |
| ATOM | 1036 | CG | LEU | C | 130 | 15.436 | 33.491 | 6.795 | 1.00 | 45.70 | GZ00 C |
| ATOM | 1037 | CD1 | LEU | C | 130 | 15.639 | 34.968 | 6.444 | 1.00 | 40.24 | GZ00 C |
| ATOM | 1038 | CD2 | LEU | C | 130 | 14.275 | 32.910 | 6.003 | 1.00 | 44.72 | GZ00 C |
| ATOM | 1039 | N | ALA | C | 131 | 17.552 | 29.096 | 6.402 | 1.00 | 46.13 | GZ00 N |
| ATOM | 1040 | CA | ALA | C | 131 | 18.618 | 28.113 | 6.528 | 1.00 | 43.66 | GZ00 C |
| ATOM | 1041 | C | ALA | C | 131 | 19.672 | 28.301 | 5.441 | 1.00 | 44.63 | GZ00 C |
| ATOM | 1042 | O | ALA | C | 131 | 19.339 | 28.524 | 4.278 | 1.00 | 46.42 | GZ00 O |
| ATOM | 1043 | CB | ALA | C | 131 | 18.060 | 26.703 | 6.457 | 1.00 | 36.60 | GZ00 C |
| ATOM | 1044 | N | PRO | C | 132 | 20.943 | 28.159 | 5.792 | 1.00 | 50.91 | GZ00 N |
| ATOM | 1045 | CA | PRO | C | 132 | 22.009 | 28.205 | 4.784 | 1.00 | 52.92 | GZ00 C |
| ATOM | 1046 | C | PRO | C | 132 | 22.027 | 26.951 | 3.921 | 1.00 | 63.10 | GZ00 C |
| ATOM | 1047 | O | PRO | C | 132 | 21.557 | 25.876 | 4.315 | 1.00 | 65.83 | GZ00 O |
| ATOM | 1048 | CB | PRO | C | 132 | 23.279 | 28.301 | 5.631 | 1.00 | 51.34 | GZ00 C |
| ATOM | 1049 | CG | PRO | C | 132 | 22.910 | 27.548 | 6.901 | 1.00 | 47.48 | GZ00 C |
| ATOM | 1050 | CD | PRO | C | 132 | 21.454 | 27.876 | 7.145 | 1.00 | 49.36 | GZ00 C |
| ATOM | 1051 | N | SER | C | 133 | 22.606 | 27.103 | 2.724 | 1.00 | 65.77 | GZ00 N |
| ATOM | 1052 | CA | SER | C | 133 | 22.642 | 26.041 | 1.718 | 1.00 | 75.34 | GZ00 C |
| ATOM | 1053 | C | SER | C | 133 | 23.713 | 26.317 | 0.668 | 1.00 | 79.20 | GZ00 C |
| ATOM | 1054 | O | SER | C | 133 | 24.893 | 26.462 | 0.990 | 1.00 | 81.66 | GZ00 O |
| ATOM | 1055 | CB | SER | C | 133 | 21.272 | 25.900 | 1.043 | 1.00 | 74.63 | GZ00 C |
| ATOM | 1056 | OG | SER | C | 133 | 20.727 | 27.170 | 0.711 | 1.00 | 72.62 | GZ00 O |
| ATOM | 1057 | N | SER | C | 134 | 23.317 | 26.372 | −0.599 | 1.00 | 91.08 | GZ00 N |
| ATOM | 1058 | CA | SER | C | 134 | 24.136 | 27.032 | −1.612 | 1.00 | 84.25 | GZ00 C |
| ATOM | 1059 | C | SER | C | 134 | 23.720 | 28.503 | −1.692 | 1.00 | 85.59 | GZ00 C |
| ATOM | 1060 | O | SER | C | 134 | 23.292 | 29.031 | −2.718 | 1.00 | 89.34 | GZ00 O |
| ATOM | 1061 | CB | SER | C | 134 | 24.022 | 26.312 | −2.950 | 1.00 | 90.76 | GZ00 C |
| ATOM | 1062 | OG | SER | C | 134 | 24.604 | 25.016 | −2.867 | 1.00 | 71.01 | GZ00 O |
| ATOM | 1063 | N | SER | C | 136 | 23.766 | 29.125 | −0.514 | 1.00 | 87.58 | GZ00 N |
| ATOM | 1064 | CA | SER | C | 136 | 23.877 | 30.568 | −0.336 | 1.00 | 76.32 | GZ00 C |
| ATOM | 1065 | C | SER | C | 136 | 25.274 | 30.904 | 0.199 | 1.00 | 70.77 | GZ00 C |
| ATOM | 1066 | O | SER | C | 136 | 25.441 | 31.713 | 1.121 | 1.00 | 56.45 | GZ00 O |
| ATOM | 1067 | CB | SER | C | 136 | 22.777 | 31.098 | 0.588 | 1.00 | 64.27 | GZ00 C |
| ATOM | 1068 | OG | SER | C | 136 | 22.863 | 30.567 | 1.905 | 1.00 | 55.15 | GZ00 O |
| ATOM | 1069 | N | THR | C | 137 | 26.294 | 30.248 | −0.363 | 1.00 | 68.34 | GZ00 N |
| ATOM | 1070 | CA | THR | C | 137 | 27.686 | 30.490 | −0.008 | 1.00 | 69.91 | GZ00 C |
| ATOM | 1071 | C | THR | C | 137 | 28.416 | 31.190 | −1.157 | 1.00 | 67.19 | GZ00 C |
| ATOM | 1072 | O | THR | C | 137 | 28.180 | 30.891 | −2.332 | 1.00 | 69.81 | GZ00 O |
| ATOM | 1073 | CB | THR | C | 137 | 28.407 | 29.183 | 0.387 | 1.00 | 64.52 | GZ00 C |
| ATOM | 1074 | OG1 | THR | C | 137 | 29.096 | 28.626 | −0.739 | 1.00 | 77.04 | GZ00 O |
| ATOM | 1075 | CG2 | THR | C | 137 | 27.427 | 28.167 | 0.946 | 1.00 | 58.14 | GZ00 C |
| ATOM | 1076 | N | SER | C | 138 | 29.289 | 32.144 | −0.810 | 1.00 | 68.23 | GZ00 N |
| ATOM | 1077 | CA | SER | C | 138 | 30.030 | 32.950 | −1.784 | 1.00 | 66.23 | GZ00 C |
| ATOM | 1078 | C | SER | C | 138 | 31.526 | 32.891 | −1.454 | 1.00 | 65.41 | GZ00 C |
| ATOM | 1079 | O | SER | C | 138 | 32.054 | 33.661 | −0.629 | 1.00 | 62.93 | GZ00 O |
| ATOM | 1080 | CB | SER | C | 138 | 29.508 | 34.383 | −1.828 | 1.00 | 70.26 | GZ00 C |
| ATOM | 1081 | OG | SER | C | 138 | 29.183 | 34.732 | −3.162 | 1.00 | 77.29 | GZ00 O |
| ATOM | 1082 | N | GLY | C | 139 | 32.210 | 31.988 | −2.153 | 1.00 | 65.74 | GZ00 N |
| ATOM | 1083 | CA | GLY | C | 139 | 33.577 | 31.673 | −1.822 | 1.00 | 55.52 | GZ00 C |
| ATOM | 1084 | C | GLY | C | 139 | 33.581 | 30.952 | −0.495 | 1.00 | 52.92 | GZ00 C |
| ATOM | 1085 | O | GLY | C | 139 | 32.963 | 29.889 | −0.339 | 1.00 | 56.98 | GZ00 O |
| ATOM | 1086 | N | GLY | C | 140 | 34.241 | 31.550 | 0.483 | 1.00 | 39.11 | GZ00 N |
| ATOM | 1087 | CA | GLY | C | 140 | 34.394 | 30.917 | 1.767 | 1.00 | 37.84 | GZ00 C |
| ATOM | 1088 | C | GLY | C | 140 | 33.435 | 31.476 | 2.782 | 1.00 | 35.31 | GZ00 C |
| ATOM | 1089 | O | GLY | C | 140 | 33.686 | 31.410 | 3.987 | 1.00 | 35.90 | GZ00 O |
| ATOM | 1090 | N | THR | C | 141 | 32.312 | 31.990 | 2.314 | 1.00 | 30.60 | GZ00 N |
| ATOM | 1091 | CA | THR | C | 141 | 31.371 | 32.678 | 3.180 | 1.00 | 35.07 | GZ00 C |
| ATOM | 1092 | C | THR | C | 141 | 29.975 | 32.121 | 2.959 | 1.00 | 45.03 | GZ00 C |
| ATOM | 1093 | O | THR | C | 141 | 29.638 | 31.698 | 1.858 | 1.00 | 45.95 | GZ00 O |
| ATOM | 1094 | CB | THR | C | 141 | 31.469 | 34.196 | 2.898 | 1.00 | 34.50 | GZ00 C |
| ATOM | 1095 | OG1 | THR | C | 141 | 31.995 | 34.851 | 4.055 | 1.00 | 45.09 | GZ00 O |
| ATOM | 1096 | CG2 | THR | C | 141 | 30.182 | 34.807 | 2.446 | 1.00 | 40.84 | GZ00 C |
| ATOM | 1097 | N | ALA | C | 142 | 29.186 | 32.058 | 4.026 | 1.00 | 40.91 | GZ00 N |
| ATOM | 1098 | CA | ALA | C | 142 | 27.833 | 31.528 | 3.943 | 1.00 | 37.80 | GZ00 C |
| ATOM | 1099 | C | ALA | C | 142 | 26.893 | 32.457 | 4.683 | 1.00 | 34.33 | GZ00 C |
| ATOM | 1100 | O | ALA | C | 142 | 27.251 | 33.006 | 5.730 | 1.00 | 37.65 | GZ00 O |
| ATOM | 1101 | CB | ALA | C | 142 | 27.729 | 30.125 | 4.539 | 1.00 | 37.82 | GZ00 C |
| ATOM | 1102 | N | ALA | C | 143 | 25.685 | 32.608 | 4.148 | 1.00 | 31.94 | GZ00 N |
| ATOM | 1103 | CA | ALA | C | 143 | 24.649 | 33.451 | 4.731 | 1.00 | 31.30 | GZ00 C |
| ATOM | 1104 | C | ALA | C | 143 | 23.527 | 32.602 | 5.324 | 1.00 | 38.60 | GZ00 C |
| ATOM | 1105 | O | ALA | C | 143 | 23.079 | 31.624 | 4.715 | 1.00 | 36.49 | GZ00 O |
| ATOM | 1106 | CB | ALA | C | 143 | 24.062 | 34.401 | 3.689 | 1.00 | 33.71 | GZ00 C |
| ATOM | 1107 | N | LEU | C | 144 | 23.099 | 32.976 | 6.529 | 1.00 | 37.05 | GZ00 N |
| ATOM | 1108 | CA | LEU | C | 144 | 21.975 | 32.361 | 7.208 | 1.00 | 40.29 | GZ00 C |
| ATOM | 1109 | C | LEU | C | 144 | 21.227 | 33.458 | 7.957 | 1.00 | 40.87 | GZ00 C |
| ATOM | 1110 | O | LEU | C | 144 | 21.800 | 34.504 | 8.281 | 1.00 | 41.49 | GZ00 O |
| ATOM | 1111 | CB | LEU | C | 144 | 22.463 | 31.247 | 8.144 | 1.00 | 42.35 | GZ00 C |
| ATOM | 1112 | CG | LEU | C | 144 | 23.403 | 31.747 | 9.239 | 1.00 | 47.05 | GZ00 C |
| ATOM | 1113 | CD1 | LEU | C | 144 | 22.647 | 31.926 | 10.545 | 1.00 | 49.65 | GZ00 C |

TABLE 10.3-continued

| | | | | | | | | | | | |
|---|---|---|---|---|---|---|---|---|---|---|---|
| ATOM | 1114 | CD2 | LEU | C | 144 | 24.583 | 30.834 | 9.410 | 1.00 | 40.72 | GZ00 C |
| ATOM | 1115 | N | GLY | C | 145 | 19.949 | 33.219 | 8.252 | 1.00 | 37.19 | GZ00 N |
| ATOM | 1116 | CA | GLY | C | 145 | 19.181 | 34.289 | 8.851 | 1.00 | 39.70 | GZ00 C |
| ATOM | 1117 | C | GLY | C | 145 | 17.884 | 33.886 | 9.522 | 1.00 | 40.16 | GZ00 C |
| ATOM | 1118 | O | GLY | C | 145 | 17.574 | 32.702 | 9.685 | 1.00 | 44.79 | GZ00 O |
| ATOM | 1119 | N | CYS | C | 146 | 17.133 | 34.916 | 9.910 | 1.00 | 38.48 | GZ00 N |
| ATOM | 1120 | CA | CYS | C | 146 | 15.879 | 34.810 | 10.641 | 1.00 | 40.61 | GZ00 C |
| ATOM | 1121 | C | CYS | C | 146 | 14.846 | 35.719 | 9.998 | 1.00 | 48.21 | GZ00 C |
| ATOM | 1122 | O | CYS | C | 146 | 15.099 | 36.916 | 9.820 | 1.00 | 41.15 | GZ00 O |
| ATOM | 1123 | CB | CYS | C | 146 | 16.058 | 35.212 | 12.114 | 1.00 | 36.30 | GZ00 C |
| ATOM | 1124 | SG | CYS | C | 146 | 16.447 | 33.783 | 13.156 | 1.00 | 70.07 | GZ00 S |
| ATOM | 1125 | N | LEU | C | 147 | 13.679 | 35.163 | 9.688 | 1.00 | 47.77 | GZ00 N |
| ATOM | 1126 | CA | LEU | C | 147 | 12.549 | 35.928 | 9.168 | 1.00 | 37.79 | GZ00 C |
| ATOM | 1127 | C | LEU | C | 147 | 11.641 | 36.320 | 10.333 | 1.00 | 45.95 | GZ00 C |
| ATOM | 1128 | O | LEU | C | 147 | 11.217 | 35.458 | 11.112 | 1.00 | 45.78 | GZ00 O |
| ATOM | 1129 | CB | LEU | C | 147 | 11.786 | 35.101 | 8.140 | 1.00 | 39.44 | GZ00 C |
| ATOM | 1130 | CG | LEU | C | 147 | 10.457 | 35.637 | 7.600 | 1.00 | 42.29 | GZ00 C |
| ATOM | 1131 | CD1 | LEU | C | 147 | 10.605 | 37.010 | 6.924 | 1.00 | 35.22 | GZ00 C |
| ATOM | 1132 | CD2 | LEU | C | 147 | 9.902 | 34.623 | 6.626 | 1.00 | 41.37 | GZ00 C |
| ATOM | 1133 | N | VAL | C | 148 | 11.392 | 37.614 | 10.493 | 1.00 | 36.60 | GZ00 N |
| ATOM | 1134 | CA | VAL | C | 148 | 10.604 | 38.136 | 11.607 | 1.00 | 39.69 | GZ00 C |
| ATOM | 1135 | C | VAL | C | 148 | 9.309 | 38.707 | 11.027 | 1.00 | 47.33 | GZ00 C |
| ATOM | 1136 | O | VAL | C | 148 | 9.266 | 39.872 | 10.617 | 1.00 | 45.03 | GZ00 O |
| ATOM | 1137 | CB | VAL | C | 148 | 11.375 | 39.192 | 12.409 | 1.00 | 42.14 | GZ00 C |
| ATOM | 1138 | CG1 | VAL | C | 148 | 10.549 | 39.661 | 13.557 | 1.00 | 34.51 | GZ00 C |
| ATOM | 1139 | CG2 | VAL | C | 148 | 12.701 | 38.631 | 12.933 | 1.00 | 38.14 | GZ00 C |
| ATOM | 1140 | N | LYS | C | 149 | 8.226 | 37.923 | 11.045 | 1.00 | 47.26 | GZ00 N |
| ATOM | 1141 | CA | LYS | C | 149 | 7.039 | 38.205 | 10.244 | 1.00 | 49.61 | GZ00 C |
| ATOM | 1142 | C | LYS | C | 149 | 5.887 | 38.797 | 11.059 | 1.00 | 48.25 | GZ00 C |
| ATOM | 1143 | O | LYS | C | 149 | 5.698 | 38.455 | 12.228 | 1.00 | 50.60 | GZ00 O |
| ATOM | 1144 | CB | LYS | C | 149 | 6.563 | 36.933 | 9.547 | 1.00 | 49.65 | GZ00 C |
| ATOM | 1145 | CG | LYS | C | 149 | 6.317 | 37.131 | 8.074 | 1.00 | 60.63 | GZ00 C |
| ATOM | 1146 | CD | LYS | C | 149 | 5.120 | 36.330 | 7.579 | 1.00 | 59.80 | GZ00 C |
| ATOM | 1147 | CE | LYS | C | 149 | 5.405 | 34.849 | 7.597 | 1.00 | 63.78 | GZ00 C |
| ATOM | 1148 | NZ | LYS | C | 149 | 4.321 | 34.077 | 6.887 | 1.00 | 62.06 | GZ00 N1+ |
| ATOM | 1149 | N | ASP | C | 150 | 5.154 | 39.729 | 10.430 | 1.00 | 52.54 | GZ00 N |
| ATOM | 1150 | CA | ASP | C | 150 | 3.795 | 40.160 | 10.809 | 1.00 | 43.96 | GZ00 C |
| ATOM | 1151 | C | ASP | C | 150 | 3.707 | 40.710 | 12.236 | 1.00 | 45.35 | GZ00 C |
| ATOM | 1152 | O | ASP | C | 150 | 2.955 | 40.200 | 13.068 | 1.00 | 47.95 | GZ00 O |
| ATOM | 1153 | CB | ASP | C | 150 | 2.782 | 39.021 | 10.633 | 1.00 | 43.67 | GZ00 C |
| ATOM | 1154 | CG | ASP | C | 150 | 2.587 | 38.624 | 9.190 | 1.00 | 49.50 | GZ00 C |
| ATOM | 1155 | OD1 | ASP | C | 150 | 2.874 | 39.436 | 8.284 | 1.00 | 47.60 | GZ00 O |
| ATOM | 1156 | OD2 | ASP | C | 150 | 2.133 | 37.486 | 8.957 | 1.00 | 63.54 | GZ00 O1- |
| ATOM | 1157 | N | TYR | C | 151 | 4.437 | 41.792 | 12.498 | 1.00 | 38.78 | GZ00 N |
| ATOM | 1158 | CA | TYR | C | 151 | 4.395 | 42.435 | 13.802 | 1.00 | 42.10 | GZ00 C |
| ATOM | 1159 | C | TYR | C | 151 | 4.012 | 43.911 | 13.689 | 1.00 | 41.99 | GZ00 C |
| ATOM | 1160 | O | TYR | C | 151 | 4.115 | 44.534 | 12.628 | 1.00 | 46.82 | GZ00 O |
| ATOM | 1161 | CB | TYR | C | 151 | 5.751 | 42.308 | 14.529 | 1.00 | 46.66 | GZ00 C |
| ATOM | 1162 | CG | TYR | C | 151 | 6.892 | 43.080 | 13.890 | 1.00 | 45.23 | GZ00 C |
| ATOM | 1163 | CD1 | TYR | C | 151 | 7.665 | 42.517 | 12.871 | 1.00 | 43.89 | GZ00 C |
| ATOM | 1164 | CD2 | TYR | C | 151 | 7.206 | 44.366 | 14.317 | 1.00 | 45.36 | GZ00 C |
| ATOM | 1165 | CE1 | TYR | C | 151 | 8.726 | 43.223 | 12.280 | 1.00 | 43.44 | GZ00 C |
| ATOM | 1166 | CE2 | TYR | C | 151 | 8.259 | 45.082 | 13.739 | 1.00 | 52.49 | GZ00 C |
| ATOM | 1167 | CZ | TYR | C | 151 | 9.018 | 44.504 | 12.721 | 1.00 | 50.42 | GZ00 C |
| ATOM | 1168 | OH | TYR | C | 151 | 10.045 | 45.224 | 12.149 | 1.00 | 41.96 | GZ00 O |
| ATOM | 1169 | N | PHE | C | 152 | 3.617 | 44.474 | 14.824 | 1.00 | 40.95 | GZ00 N |
| ATOM | 1170 | CA | PHE | C | 152 | 3.224 | 45.868 | 14.926 | 1.00 | 45.04 | GZ00 C |
| ATOM | 1171 | C | PHE | C | 152 | 3.209 | 46.273 | 16.388 | 1.00 | 42.56 | GZ00 C |
| ATOM | 1172 | O | PHE | C | 152 | 2.802 | 45.496 | 17.235 | 1.00 | 45.01 | GZ00 O |
| ATOM | 1173 | CB | PHE | C | 152 | 1.847 | 46.113 | 14.294 | 1.00 | 47.75 | GZ00 C |
| ATOM | 1174 | CG | PHE | C | 152 | 1.465 | 47.558 | 14.260 | 1.00 | 48.38 | GZ00 C |
| ATOM | 1175 | CD1 | PHE | C | 152 | 0.824 | 48.148 | 15.339 | 1.00 | 48.32 | GZ00 C |
| ATOM | 1176 | CD2 | PHE | C | 152 | 1.783 | 48.342 | 13.167 | 1.00 | 51.92 | GZ00 C |
| ATOM | 1177 | CE1 | PHE | C | 152 | 0.510 | 49.493 | 15.322 | 1.00 | 46.78 | GZ00 C |
| ATOM | 1178 | CE2 | PHE | C | 152 | 1.451 | 49.693 | 13.144 | 1.00 | 49.11 | GZ00 C |
| ATOM | 1179 | CZ | PHE | C | 152 | 0.824 | 50.262 | 14.228 | 1.00 | 41.05 | GZ00 C |
| ATOM | 1180 | N | PRO | C | 153 | 3.698 | 47.479 | 16.702 | 1.00 | 42.68 | GZ00 N |
| ATOM | 1181 | CA | PRO | C | 153 | 4.419 | 48.428 | 15.848 | 1.00 | 52.96 | GZ00 C |
| ATOM | 1182 | C | PRO | C | 153 | 5.930 | 48.163 | 15.829 | 1.00 | 52.60 | GZ00 C |
| ATOM | 1183 | O | PRO | C | 153 | 6.398 | 47.155 | 16.353 | 1.00 | 54.71 | GZ00 O |
| ATOM | 1184 | CB | PRO | C | 153 | 4.152 | 49.766 | 16.532 | 1.00 | 43.17 | GZ00 C |
| ATOM | 1185 | CG | PRO | C | 153 | 4.224 | 49.393 | 17.978 | 1.00 | 39.59 | GZ00 C |
| ATOM | 1186 | CD | PRO | C | 153 | 3.545 | 48.016 | 18.065 | 1.00 | 40.76 | GZ00 C |
| ATOM | 1187 | N | GLU | C | 154 | 6.682 | 49.068 | 15.220 | 1.00 | 50.80 | GZ00 N |
| ATOM | 1188 | CA | GLU | C | 154 | 8.130 | 49.012 | 15.287 | 1.00 | 47.84 | GZ00 C |
| ATOM | 1189 | C | GLU | C | 154 | 8.530 | 49.382 | 16.706 | 1.00 | 45.65 | GZ00 C |
| ATOM | 1190 | O | GLU | C | 154 | 7.755 | 49.990 | 17.417 | 1.00 | 48.79 | GZ00 O |
| ATOM | 1191 | CB | GLU | C | 154 | 8.749 | 49.958 | 14.264 | 1.00 | 45.04 | GZ00 C |
| ATOM | 1192 | CG | GLU | C | 154 | 8.425 | 49.586 | 12.831 | 1.00 | 49.34 | GZ00 C |
| ATOM | 1193 | CD | GLU | C | 154 | 9.635 | 49.012 | 12.119 | 1.00 | 59.99 | GZ00 C |

TABLE 10.3-continued

| ATOM | 1194 | OE1 | GLU | C | 154 | 10.114 | 49.663 | 11.168 | 1.00 | 58.68 | GZ00 | O |
|------|------|-----|-----|---|-----|--------|--------|--------|------|-------|------|---|
| ATOM | 1195 | OE2 | GLU | C | 154 | 10.120 | 47.929 | 12.535 | 1.00 | 57.95 | GZ00 | O1− |
| ATOM | 1196 | N | PRO | C | 155 | 9.737 | 49.006 | 17.137 | 1.00 | 50.54 | GZ00 | N |
| ATOM | 1197 | CA | PRO | C | 155 | 10.755 | 48.195 | 16.472 | 1.00 | 44.50 | GZ00 | C |
| ATOM | 1198 | C | PRO | C | 155 | 10.803 | 46.753 | 16.983 | 1.00 | 53.89 | GZ00 | C |
| ATOM | 1199 | O | PRO | C | 155 | 10.174 | 46.436 | 17.999 | 1.00 | 55.35 | GZ00 | O |
| ATOM | 1200 | CB | PRO | C | 155 | 12.031 | 48.921 | 16.845 | 1.00 | 44.74 | GZ00 | C |
| ATOM | 1201 | CG | PRO | C | 155 | 11.773 | 49.333 | 18.257 | 1.00 | 44.99 | GZ00 | C |
| ATOM | 1202 | CD | PRO | C | 155 | 10.279 | 49.641 | 18.350 | 1.00 | 39.64 | GZ00 | C |
| ATOM | 1203 | N | VAL | C | 156 | 11.530 | 45.887 | 16.278 | 1.00 | 45.82 | GZ00 | N |
| ATOM | 1204 | CA | VAL | C | 156 | 12.054 | 44.666 | 16.870 | 1.00 | 55.31 | GZ00 | C |
| ATOM | 1205 | C | VAL | C | 156 | 13.562 | 44.814 | 16.945 | 1.00 | 52.03 | GZ00 | C |
| ATOM | 1206 | O | VAL | C | 156 | 14.183 | 45.530 | 16.153 | 1.00 | 55.45 | GZ00 | O |
| ATOM | 1207 | CB | VAL | C | 156 | 11.698 | 43.375 | 16.105 | 1.00 | 52.00 | GZ00 | C |
| ATOM | 1208 | CG1 | VAL | C | 156 | 10.204 | 43.139 | 16.092 | 1.00 | 51.44 | GZ00 | C |
| ATOM | 1209 | CG2 | VAL | C | 156 | 12.231 | 43.446 | 14.719 | 1.00 | 48.82 | GZ00 | C |
| ATOM | 1210 | N | THR | C | 157 | 14.153 | 44.146 | 17.919 | 1.00 | 53.96 | GZ00 | N |
| ATOM | 1211 | CA | THR | C | 157 | 15.596 | 44.007 | 17.989 | 1.00 | 54.98 | GZ00 | C |
| ATOM | 1212 | C | THR | C | 157 | 15.949 | 42.554 | 17.732 | 1.00 | 54.62 | GZ00 | C |
| ATOM | 1213 | O | THR | C | 157 | 15.221 | 41.644 | 18.142 | 1.00 | 54.87 | GZ00 | O |
| ATOM | 1214 | CB | THR | C | 157 | 16.140 | 44.458 | 19.341 | 1.00 | 45.77 | GZ00 | C |
| ATOM | 1215 | OG1 | THR | C | 157 | 15.663 | 43.570 | 20.361 | 1.00 | 57.07 | GZ00 | O |
| ATOM | 1216 | CG2 | THR | C | 157 | 15.691 | 45.877 | 19.627 | 1.00 | 51.52 | GZ00 | C |
| ATOM | 1217 | N | VAL | C | 158 | 17.042 | 42.345 | 17.015 | 1.00 | 51.30 | GZ00 | N |
| ATOM | 1218 | CA | VAL | C | 158 | 17.521 | 41.010 | 16.706 | 1.00 | 47.26 | GZ00 | C |
| ATOM | 1219 | C | VAL | C | 158 | 18.988 | 40.957 | 17.085 | 1.00 | 50.93 | GZ00 | C |
| ATOM | 1220 | O | VAL | C | 158 | 19.767 | 41.833 | 16.692 | 1.00 | 49.49 | GZ00 | O |
| ATOM | 1221 | CB | VAL | C | 158 | 17.343 | 40.660 | 15.219 | 1.00 | 46.28 | GZ00 | C |
| ATOM | 1222 | CG1 | VAL | C | 158 | 17.733 | 39.213 | 14.986 | 1.00 | 46.68 | GZ00 | C |
| ATOM | 1223 | CG2 | VAL | C | 158 | 15.911 | 40.951 | 14.752 | 1.00 | 43.16 | GZ00 | C |
| ATOM | 1224 | N | SER | C | 159 | 19.361 | 39.943 | 17.850 | 1.00 | 51.31 | GZ00 | N |
| ATOM | 1225 | CA | SER | C | 159 | 20.756 | 39.667 | 18.134 | 1.00 | 44.21 | GZ00 | C |
| ATOM | 1226 | C | SER | C | 159 | 21.001 | 38.215 | 17.769 | 1.00 | 45.69 | GZ00 | C |
| ATOM | 1227 | O | SER | C | 159 | 20.063 | 37.437 | 17.578 | 1.00 | 44.40 | GZ00 | O |
| ATOM | 1228 | CB | SER | C | 159 | 21.126 | 39.946 | 19.605 | 1.00 | 39.33 | GZ00 | C |
| ATOM | 1229 | OG | SER | C | 159 | 20.384 | 39.132 | 20.511 | 1.00 | 48.22 | GZ00 | O |
| ATOM | 1230 | N | TRP | C | 160 | 22.270 | 37.863 | 17.648 | 1.00 | 44.65 | GZ00 | N |
| ATOM | 1231 | CA | TRP | C | 160 | 22.671 | 36.505 | 17.332 | 1.00 | 38.87 | GZ00 | C |
| ATOM | 1232 | C | TRP | C | 160 | 23.533 | 35.984 | 18.468 | 1.00 | 43.64 | GZ00 | C |
| ATOM | 1233 | O | TRP | C | 160 | 24.351 | 36.729 | 19.025 | 1.00 | 42.33 | GZ00 | O |
| ATOM | 1234 | CB | TRP | C | 160 | 23.420 | 36.436 | 15.998 | 1.00 | 36.78 | GZ00 | C |
| ATOM | 1235 | CG | TRP | C | 160 | 22.520 | 36.662 | 14.845 | 1.00 | 41.44 | GZ00 | C |
| ATOM | 1236 | CD1 | TRP | C | 160 | 22.178 | 37.861 | 14.294 | 1.00 | 39.79 | GZ00 | C |
| ATOM | 1237 | CD2 | TRP | C | 160 | 21.786 | 35.664 | 14.123 | 1.00 | 40.51 | GZ00 | C |
| ATOM | 1238 | NE1 | TRP | C | 160 | 21.304 | 37.671 | 13.245 | 1.00 | 37.10 | GZ00 | N |
| ATOM | 1239 | CE2 | TRP | C | 160 | 21.038 | 36.335 | 13.125 | 1.00 | 36.83 | GZ00 | C |
| ATOM | 1240 | CE3 | TRP | C | 160 | 21.695 | 34.270 | 14.216 | 1.00 | 38.13 | GZ00 | C |
| ATOM | 1241 | CZ2 | TRP | C | 160 | 20.209 | 35.662 | 12.228 | 1.00 | 37.10 | GZ00 | C |
| ATOM | 1242 | CZ3 | TRP | C | 160 | 20.878 | 33.596 | 13.314 | 1.00 | 42.58 | GZ00 | C |
| ATOM | 1243 | CH2 | TRP | C | 160 | 20.142 | 34.294 | 12.336 | 1.00 | 43.28 | GZ00 | C |
| ATOM | 1244 | N | ASN | C | 161 | 23.291 | 34.718 | 18.825 | 1.00 | 41.18 | GZ00 | N |
| ATOM | 1245 | CA | ASN | C | 161 | 23.956 | 34.018 | 19.929 | 1.00 | 45.75 | GZ00 | C |
| ATOM | 1246 | C | ASN | C | 161 | 24.057 | 34.898 | 21.169 | 1.00 | 45.89 | GZ00 | C |
| ATOM | 1247 | O | ASN | C | 161 | 25.123 | 35.079 | 21.763 | 1.00 | 49.59 | GZ00 | O |
| ATOM | 1248 | CB | ASN | C | 161 | 25.315 | 33.479 | 19.496 | 1.00 | 36.85 | GZ00 | C |
| ATOM | 1249 | CG | ASN | C | 161 | 25.181 | 32.440 | 18.399 | 1.00 | 44.50 | GZ00 | C |
| ATOM | 1250 | OD1 | ASN | C | 161 | 24.067 | 32.010 | 18.062 | 1.00 | 46.14 | GZ00 | O |
| ATOM | 1251 | ND2 | ASN | C | 161 | 26.306 | 31.997 | 17.865 | 1.00 | 43.54 | GZ00 | N |
| ATOM | 1252 | N | SER | C | 162 | 22.918 | 35.503 | 21.508 | 1.00 | 46.88 | GZ00 | N |
| ATOM | 1253 | CA | SER | C | 162 | 22.740 | 36.290 | 22.727 | 1.00 | 43.45 | GZ00 | C |
| ATOM | 1254 | C | SER | C | 162 | 23.687 | 37.476 | 22.784 | 1.00 | 47.59 | GZ00 | C |
| ATOM | 1255 | O | SER | C | 162 | 24.110 | 37.883 | 23.866 | 1.00 | 49.00 | GZ00 | O |
| ATOM | 1256 | CB | SER | C | 162 | 22.879 | 35.412 | 23.972 | 1.00 | 38.83 | GZ00 | C |
| ATOM | 1257 | OG | SER | C | 162 | 22.029 | 34.280 | 23.821 | 1.00 | 48.75 | GZ00 | O |
| ATOM | 1258 | N | GLY | C | 163 | 24.028 | 38.040 | 21.622 | 1.00 | 48.38 | GZ00 | N |
| ATOM | 1259 | CA | GLY | C | 163 | 24.887 | 39.205 | 21.551 | 1.00 | 40.94 | GZ00 | C |
| ATOM | 1260 | C | GLY | C | 163 | 26.359 | 38.927 | 21.292 | 1.00 | 53.03 | GZ00 | C |
| ATOM | 1261 | O | GLY | C | 163 | 27.105 | 39.878 | 20.999 | 1.00 | 49.49 | GZ00 | O |
| ATOM | 1262 | N | ALA | C | 164 | 26.804 | 37.665 | 21.374 | 1.00 | 39.35 | GZ00 | N |
| ATOM | 1263 | CA | ALA | C | 164 | 28.227 | 37.381 | 21.179 | 1.00 | 50.46 | GZ00 | C |
| ATOM | 1264 | C | ALA | C | 164 | 28.658 | 37.609 | 19.732 | 1.00 | 52.21 | GZ00 | C |
| ATOM | 1265 | O | ALA | C | 164 | 29.776 | 38.077 | 19.475 | 1.00 | 52.82 | GZ00 | O |
| ATOM | 1266 | CB | ALA | C | 164 | 28.544 | 35.947 | 21.599 | 1.00 | 41.14 | GZ00 | C |
| ATOM | 1267 | N | LEU | C | 165 | 27.793 | 37.267 | 18.780 | 1.00 | 42.69 | GZ00 | N |
| ATOM | 1268 | CA | LEU | C | 165 | 28.085 | 37.349 | 17.355 | 1.00 | 43.42 | GZ00 | C |
| ATOM | 1269 | C | LEU | C | 165 | 27.513 | 38.653 | 16.821 | 1.00 | 44.45 | GZ00 | C |
| ATOM | 1270 | O | LEU | C | 165 | 26.292 | 38.824 | 16.778 | 1.00 | 55.89 | GZ00 | O |
| ATOM | 1271 | CB | LEU | C | 165 | 27.476 | 36.152 | 16.631 | 1.00 | 43.81 | GZ00 | C |
| ATOM | 1272 | CG | LEU | C | 165 | 27.622 | 36.030 | 15.125 | 1.00 | 44.99 | GZ00 | C |
| ATOM | 1273 | CD1 | LEU | C | 165 | 29.090 | 36.095 | 14.649 | 1.00 | 39.41 | GZ00 | C |

TABLE 10.3-continued

| ATOM | 1274 | CD2 | LEU | C | 165 | 26.958 | 34.734 | 14.708 | 1.00 | 42.07 | GZ00 | C |
|---|---|---|---|---|---|---|---|---|---|---|---|---|
| ATOM | 1275 | N | THR | C | 166 | 28.389 | 39.563 | 16.411 | 1.00 | 43.67 | GZ00 | N |
| ATOM | 1276 | CA | THR | C | 166 | 28.013 | 40.872 | 15.890 | 1.00 | 50.96 | GZ00 | C |
| ATOM | 1277 | C | THR | C | 166 | 28.621 | 41.169 | 14.521 | 1.00 | 48.02 | GZ00 | C |
| ATOM | 1278 | O | THR | C | 166 | 27.950 | 41.770 | 13.676 | 1.00 | 46.23 | GZ00 | O |
| ATOM | 1279 | CB | THR | C | 166 | 28.415 | 41.954 | 16.912 | 1.00 | 52.37 | GZ00 | C |
| ATOM | 1280 | OG1 | THR | C | 166 | 29.835 | 41.950 | 17.073 | 1.00 | 48.81 | GZ00 | O |
| ATOM | 1281 | CG2 | THR | C | 166 | 27.770 | 41.663 | 18.271 | 1.00 | 45.85 | GZ00 | C |
| ATOM | 1282 | N | SER | C | 167 | 29.856 | 40.736 | 14.268 | 1.00 | 44.72 | GZ00 | N |
| ATOM | 1283 | CA | SER | C | 167 | 30.445 | 40.880 | 12.941 | 1.00 | 46.25 | GZ00 | C |
| ATOM | 1284 | C | SER | C | 167 | 29.673 | 40.045 | 11.937 | 1.00 | 42.05 | GZ00 | C |
| ATOM | 1285 | O | SER | C | 167 | 29.319 | 38.894 | 12.201 | 1.00 | 43.05 | GZ00 | O |
| ATOM | 1286 | CB | SER | C | 167 | 31.909 | 40.437 | 12.933 | 1.00 | 39.29 | GZ00 | C |
| ATOM | 1287 | OG | SER | C | 167 | 32.675 | 41.320 | 13.706 | 1.00 | 49.43 | GZ00 | O |
| ATOM | 1288 | N | GLY | C | 168 | 29.424 | 40.629 | 10.779 | 1.00 | 39.63 | GZ00 | N |
| ATOM | 1289 | CA | GLY | C | 168 | 28.689 | 39.955 | 9.740 | 1.00 | 37.44 | GZ00 | C |
| ATOM | 1290 | C | GLY | C | 168 | 27.189 | 39.958 | 9.919 | 1.00 | 39.53 | GZ00 | C |
| ATOM | 1291 | O | GLY | C | 168 | 26.500 | 39.304 | 9.131 | 1.00 | 41.74 | GZ00 | O |
| ATOM | 1292 | N | VAL | C | 169 | 26.653 | 40.702 | 10.893 | 1.00 | 37.21 | GZ00 | N |
| ATOM | 1293 | CA | VAL | C | 169 | 25.219 | 40.711 | 11.158 | 1.00 | 39.62 | GZ00 | C |
| ATOM | 1294 | C | VAL | C | 169 | 24.583 | 41.858 | 10.391 | 1.00 | 34.91 | GZ00 | C |
| ATOM | 1295 | O | VAL | C | 169 | 24.991 | 43.010 | 10.529 | 1.00 | 35.65 | GZ00 | O |
| ATOM | 1296 | CB | VAL | C | 169 | 24.921 | 40.858 | 12.660 | 1.00 | 42.01 | GZ00 | C |
| ATOM | 1297 | CG1 | VAL | C | 169 | 23.404 | 41.063 | 12.867 | 1.00 | 36.86 | GZ00 | C |
| ATOM | 1298 | CG2 | VAL | C | 169 | 25.410 | 39.673 | 13.434 | 1.00 | 42.36 | GZ00 | C |
| ATOM | 1299 | N | HIS | C | 170 | 23.545 | 41.564 | 9.630 | 1.00 | 37.60 | GZ00 | N |
| ATOM | 1300 | CA | HIS | C | 170 | 22.842 | 42.603 | 8.889 | 1.00 | 37.31 | GZ00 | C |
| ATOM | 1301 | C | HIS | C | 170 | 21.345 | 42.438 | 9.134 | 1.00 | 37.74 | GZ00 | C |
| ATOM | 1302 | O | HIS | C | 170 | 20.704 | 41.559 | 8.554 | 1.00 | 38.41 | GZ00 | O |
| ATOM | 1303 | CB | HIS | C | 170 | 23.180 | 42.538 | 7.406 | 1.00 | 34.76 | GZ00 | C |
| ATOM | 1304 | CG | HIS | C | 170 | 22.719 | 43.735 | 6.634 | 1.00 | 43.07 | GZ00 | C |
| ATOM | 1305 | ND1 | HIS | C | 170 | 22.966 | 43.897 | 5.287 | 1.00 | 43.71 | GZ00 | N |
| ATOM | 1306 | CD2 | HIS | C | 170 | 22.022 | 44.830 | 7.023 | 1.00 | 40.56 | GZ00 | C |
| ATOM | 1307 | CE1 | HIS | C | 170 | 22.453 | 45.045 | 4.883 | 1.00 | 45.93 | GZ00 | C |
| ATOM | 1308 | NE2 | HIS | C | 170 | 21.866 | 45.626 | 5.915 | 1.00 | 45.52 | GZ00 | N |
| ATOM | 1309 | N | THR | C | 171 | 20.787 | 43.270 | 10.006 | 1.00 | 40.13 | GZ00 | N |
| ATOM | 1310 | CA | THR | C | 171 | 19.342 | 43.337 | 10.182 | 1.00 | 39.22 | GZ00 | C |
| ATOM | 1311 | C | THR | C | 171 | 18.800 | 44.400 | 9.230 | 1.00 | 39.29 | GZ00 | C |
| ATOM | 1312 | O | THR | C | 171 | 19.079 | 45.581 | 9.404 | 1.00 | 36.69 | GZ00 | O |
| ATOM | 1313 | CB | THR | C | 171 | 18.984 | 43.680 | 11.629 | 1.00 | 39.31 | GZ00 | C |
| ATOM | 1314 | OG1 | THR | C | 171 | 19.473 | 42.647 | 12.494 | 1.00 | 41.01 | GZ00 | O |
| ATOM | 1315 | CG2 | THR | C | 171 | 17.445 | 43.812 | 11.801 | 1.00 | 33.43 | GZ00 | C |
| ATOM | 1316 | N | PHE | C | 172 | 17.989 | 43.982 | 8.262 | 1.00 | 38.72 | GZ00 | N |
| ATOM | 1317 | CA | PHE | C | 172 | 17.457 | 44.839 | 7.215 | 1.00 | 38.37 | GZ00 | C |
| ATOM | 1318 | C | PHE | C | 172 | 16.263 | 45.638 | 7.728 | 1.00 | 39.77 | GZ00 | C |
| ATOM | 1319 | O | PHE | C | 172 | 15.478 | 45.140 | 8.537 | 1.00 | 41.83 | GZ00 | O |
| ATOM | 1320 | CB | PHE | C | 172 | 16.990 | 44.017 | 6.013 | 1.00 | 35.77 | GZ00 | C |
| ATOM | 1321 | CG | PHE | C | 172 | 18.092 | 43.449 | 5.195 | 1.00 | 34.43 | GZ00 | C |
| ATOM | 1322 | CD1 | PHE | C | 172 | 18.884 | 42.416 | 5.679 | 1.00 | 40.25 | GZ00 | C |
| ATOM | 1323 | CD2 | PHE | C | 172 | 18.354 | 43.957 | 3.936 | 1.00 | 40.94 | GZ00 | C |
| ATOM | 1324 | CE1 | PHE | C | 172 | 19.914 | 41.886 | 4.906 | 1.00 | 37.45 | GZ00 | C |
| ATOM | 1325 | CE2 | PHE | C | 172 | 19.389 | 43.434 | 3.162 | 1.00 | 43.89 | GZ00 | C |
| ATOM | 1326 | CZ | PHE | C | 172 | 20.164 | 42.395 | 3.650 | 1.00 | 36.64 | GZ00 | C |
| ATOM | 1327 | N | PRO | C | 173 | 16.092 | 46.871 | 7.252 | 1.00 | 37.95 | GZ00 | N |
| ATOM | 1328 | CA | PRO | C | 173 | 14.883 | 47.639 | 7.596 | 1.00 | 33.97 | GZ00 | C |
| ATOM | 1329 | C | PRO | C | 173 | 13.616 | 46.905 | 7.173 | 1.00 | 35.10 | GZ00 | C |
| ATOM | 1330 | O | PRO | C | 173 | 13.585 | 46.195 | 6.163 | 1.00 | 33.25 | GZ00 | O |
| ATOM | 1331 | CB | PRO | C | 173 | 15.064 | 48.945 | 6.817 | 1.00 | 35.19 | GZ00 | C |
| ATOM | 1332 | CG | PRO | C | 173 | 16.573 | 49.046 | 6.616 | 1.00 | 34.04 | GZ00 | C |
| ATOM | 1333 | CD | PRO | C | 173 | 17.049 | 47.638 | 6.441 | 1.00 | 32.78 | GZ00 | C |
| ATOM | 1334 | N | ALA | C | 174 | 12.550 | 47.109 | 7.945 | 1.00 | 39.15 | GZ00 | N |
| ATOM | 1335 | CA | ALA | C | 174 | 11.316 | 46.339 | 7.783 | 1.00 | 39.81 | GZ00 | C |
| ATOM | 1336 | C | ALA | C | 174 | 10.533 | 46.750 | 6.532 | 1.00 | 35.98 | GZ00 | C |
| ATOM | 1337 | O | ALA | C | 174 | 10.677 | 47.856 | 6.028 | 1.00 | 39.58 | GZ00 | O |
| ATOM | 1338 | CB | ALA | C | 174 | 10.432 | 46.527 | 9.013 | 1.00 | 43.39 | GZ00 | C |
| ATOM | 1339 | N | VAL | C | 175 | 9.686 | 45.824 | 6.013 | 1.00 | 38.79 | GZ00 | N |
| ATOM | 1340 | CA | VAL | C | 175 | 8.639 | 46.209 | 5.066 | 1.00 | 39.33 | GZ00 | C |
| ATOM | 1341 | C | VAL | C | 175 | 7.400 | 46.592 | 5.844 | 1.00 | 44.21 | GZ00 | C |
| ATOM | 1342 | O | VAL | C | 175 | 7.056 | 45.957 | 6.847 | 1.00 | 43.28 | GZ00 | O |
| ATOM | 1343 | CB | VAL | C | 175 | 8.256 | 45.087 | 4.084 | 1.00 | 50.56 | GZ00 | C |
| ATOM | 1344 | CG1 | VAL | C | 175 | 8.851 | 45.303 | 2.713 | 1.00 | 51.62 | GZ00 | C |
| ATOM | 1345 | CG2 | VAL | C | 175 | 8.510 | 43.718 | 4.667 | 1.00 | 44.82 | GZ00 | C |
| ATOM | 1346 | N | LEU | C | 176 | 6.686 | 47.587 | 5.342 | 1.00 | 46.20 | GZ00 | N |
| ATOM | 1347 | CA | LEU | C | 176 | 5.329 | 47.863 | 5.785 | 1.00 | 41.81 | GZ00 | C |
| ATOM | 1348 | C | LEU | C | 176 | 4.400 | 47.199 | 4.775 | 1.00 | 42.53 | GZ00 | C |
| ATOM | 1349 | O | LEU | C | 176 | 4.405 | 47.554 | 3.595 | 1.00 | 55.35 | GZ00 | O |
| ATOM | 1350 | CB | LEU | C | 176 | 5.082 | 49.361 | 5.889 | 1.00 | 43.16 | GZ00 | C |
| ATOM | 1351 | CG | LEU | C | 176 | 3.653 | 49.738 | 6.270 | 1.00 | 46.81 | GZ00 | C |
| ATOM | 1352 | CD1 | LEU | C | 176 | 3.258 | 48.982 | 7.523 | 1.00 | 39.25 | GZ00 | C |
| ATOM | 1353 | CD2 | LEU | C | 176 | 3.565 | 51.241 | 6.509 | 1.00 | 41.80 | GZ00 | C |

TABLE 10.3-continued

| | | | | | | | | | | | |
|---|---|---|---|---|---|---|---|---|---|---|---|
| ATOM | 1354 | N | GLN | C | 177 | 3.666 | 46.189 | 5.219 | 1.00 | 44.53 | GZ00 N |
| ATOM | 1355 | CA | GLN | C | 177 | 2.809 | 45.403 | 4.345 | 1.00 | 50.59 | GZ00 C |
| ATOM | 1356 | C | GLN | C | 177 | 1.442 | 46.069 | 4.173 | 1.00 | 49.14 | GZ00 C |
| ATOM | 1357 | O | GLN | C | 177 | 0.999 | 46.856 | 5.018 | 1.00 | 43.05 | GZ00 O |
| ATOM | 1358 | CB | GLN | C | 177 | 2.634 | 43.990 | 4.909 | 1.00 | 46.96 | GZ00 C |
| ATOM | 1359 | CG | GLN | C | 177 | 3.923 | 43.188 | 5.105 | 1.00 | 49.24 | GZ00 C |
| ATOM | 1360 | CD | GLN | C | 177 | 3.666 | 41.894 | 5.863 | 1.00 | 56.86 | GZ00 C |
| ATOM | 1361 | OE1 | GLN | C | 177 | 3.214 | 40.898 | 5.285 | 1.00 | 62.22 | GZ00 O |
| ATOM | 1362 | NE2 | GLN | C | 177 | 3.939 | 41.905 | 7.170 | 1.00 | 48.26 | GZ00 N |
| ATOM | 1363 | N | SER | C | 178 | 0.751 | 45.698 | 3.084 | 1.00 | 45.38 | GZ00 N |
| ATOM | 1364 | CA | SER | C | 178 | −0.624 | 46.166 | 2.867 | 1.00 | 48.86 | GZ00 C |
| ATOM | 1365 | C | SER | C | 178 | −1.544 | 45.854 | 4.039 | 1.00 | 46.49 | GZ00 C |
| ATOM | 1366 | O | SER | C | 178 | −2.528 | 46.562 | 4.260 | 1.00 | 57.16 | GZ00 O |
| ATOM | 1367 | CB | SER | C | 178 | −1.216 | 45.531 | 1.617 | 1.00 | 50.40 | GZ00 C |
| ATOM | 1368 | OG | SER | C | 178 | −0.204 | 45.003 | 0.795 | 1.00 | 71.70 | GZ00 O |
| ATOM | 1369 | N | SER | C | 179 | −1.258 | 44.793 | 4.786 | 1.00 | 50.74 | GZ00 N |
| ATOM | 1370 | CA | SER | C | 179 | −1.988 | 44.477 | 6.007 | 1.00 | 43.18 | GZ00 C |
| ATOM | 1371 | C | SER | C | 179 | −1.776 | 45.503 | 7.110 | 1.00 | 49.34 | GZ00 C |
| ATOM | 1372 | O | SER | C | 179 | −2.482 | 45.454 | 8.121 | 1.00 | 48.58 | GZ00 O |
| ATOM | 1373 | CB | SER | C | 179 | −1.546 | 43.111 | 6.513 | 1.00 | 44.27 | GZ00 C |
| ATOM | 1374 | OG | SER | C | 179 | −0.258 | 43.204 | 7.095 | 1.00 | 48.97 | GZ00 O |
| ATOM | 1375 | N | GLY | C | 180 | −0.798 | 46.398 | 6.970 | 1.00 | 46.74 | GZ00 N |
| ATOM | 1376 | CA | GLY | C | 180 | −0.440 | 47.281 | 8.059 | 1.00 | 45.92 | GZ00 C |
| ATOM | 1377 | C | GLY | C | 180 | 0.566 | 46.707 | 9.037 | 1.00 | 50.25 | GZ00 C |
| ATOM | 1378 | O | GLY | C | 180 | 0.916 | 47.389 | 10.012 | 1.00 | 43.25 | GZ00 O |
| ATOM | 1379 | N | LEU | C | 181 | 1.039 | 45.481 | 8.813 | 1.00 | 44.89 | GZ00 N |
| ATOM | 1380 | CA | LEU | C | 181 | 2.003 | 44.836 | 9.695 | 1.00 | 49.99 | GZ00 C |
| ATOM | 1381 | C | LEU | C | 181 | 3.408 | 44.908 | 9.101 | 1.00 | 47.59 | GZ00 C |
| ATOM | 1382 | O | LEU | C | 181 | 3.594 | 45.023 | 7.887 | 1.00 | 47.03 | GZ00 O |
| ATOM | 1383 | CB | LEU | C | 181 | 1.621 | 43.373 | 9.938 | 1.00 | 43.97 | GZ00 C |
| ATOM | 1384 | CG | LEU | C | 181 | 0.269 | 43.159 | 10.616 | 1.00 | 50.80 | GZ00 C |
| ATOM | 1385 | CD1 | LEU | C | 181 | −0.047 | 41.676 | 10.719 | 1.00 | 43.98 | GZ00 C |
| ATOM | 1386 | CD2 | LEU | C | 181 | 0.246 | 43.830 | 11.981 | 1.00 | 46.56 | GZ00 C |
| ATOM | 1387 | N | TYR | C | 182 | 4.404 | 44.833 | 9.973 | 1.00 | 45.32 | GZ00 N |
| ATOM | 1388 | CA | TYR | C | 182 | 5.793 | 44.866 | 9.536 | 1.00 | 45.62 | GZ00 C |
| ATOM | 1389 | C | TYR | C | 182 | 6.381 | 43.465 | 9.437 | 1.00 | 44.85 | GZ00 C |
| ATOM | 1390 | O | TYR | C | 182 | 5.955 | 42.536 | 10.124 | 1.00 | 51.18 | GZ00 O |
| ATOM | 1391 | CB | TYR | C | 182 | 6.645 | 45.701 | 10.484 | 1.00 | 44.25 | GZ00 C |
| ATOM | 1392 | CG | TYR | C | 182 | 6.265 | 47.162 | 10.529 | 1.00 | 49.19 | GZ00 C |
| ATOM | 1393 | CD1 | TYR | C | 182 | 6.805 | 48.072 | 9.628 | 1.00 | 49.61 | GZ00 C |
| ATOM | 1394 | CD2 | TYR | C | 182 | 5.368 | 47.633 | 11.474 | 1.00 | 51.64 | GZ00 C |
| ATOM | 1395 | CE1 | TYR | C | 182 | 6.474 | 49.408 | 9.678 | 1.00 | 43.85 | GZ00 C |
| ATOM | 1396 | CE2 | TYR | C | 182 | 5.029 | 48.974 | 11.530 | 1.00 | 55.94 | GZ00 C |
| ATOM | 1397 | CZ | TYR | C | 182 | 5.587 | 49.853 | 10.626 | 1.00 | 50.36 | GZ00 C |
| ATOM | 1398 | OH | TYR | C | 182 | 5.243 | 51.177 | 10.679 | 1.00 | 43.75 | GZ00 O |
| ATOM | 1399 | N | SER | C | 183 | 7.374 | 43.326 | 8.569 | 1.00 | 46.44 | GZ00 N |
| ATOM | 1400 | CA | SER | C | 183 | 8.231 | 42.152 | 8.534 | 1.00 | 42.34 | GZ00 C |
| ATOM | 1401 | C | SER | C | 183 | 9.673 | 42.600 | 8.304 | 1.00 | 42.61 | GZ00 C |
| ATOM | 1402 | O | SER | C | 183 | 9.927 | 43.635 | 7.681 | 1.00 | 42.07 | GZ00 O |
| ATOM | 1403 | CB | SER | C | 183 | 7.799 | 41.173 | 7.452 | 1.00 | 40.89 | GZ00 C |
| ATOM | 1404 | OG | SER | C | 183 | 6.531 | 40.617 | 7.751 | 1.00 | 50.66 | GZ00 O |
| ATOM | 1405 | N | LEU | C | 184 | 10.622 | 41.838 | 8.842 | 1.00 | 42.23 | GZ00 N |
| ATOM | 1406 | CA | LEU | C | 184 | 12.018 | 42.081 | 8.515 | 1.00 | 39.25 | GZ00 C |
| ATOM | 1407 | C | LEU | C | 184 | 12.794 | 40.772 | 8.518 | 1.00 | 43.48 | GZ00 C |
| ATOM | 1408 | O | LEU | C | 184 | 12.337 | 39.746 | 9.029 | 1.00 | 40.77 | GZ00 O |
| ATOM | 1409 | CB | LEU | C | 184 | 12.650 | 43.095 | 9.473 | 1.00 | 35.18 | GZ00 C |
| ATOM | 1410 | CG | LEU | C | 184 | 12.809 | 42.808 | 10.965 | 1.00 | 45.00 | GZ00 C |
| ATOM | 1411 | CD1 | LEU | C | 184 | 13.869 | 41.700 | 11.303 | 1.00 | 40.29 | GZ00 C |
| ATOM | 1412 | CD2 | LEU | C | 184 | 13.218 | 44.117 | 11.588 | 1.00 | 33.99 | GZ00 C |
| ATOM | 1413 | N | SER | C | 185 | 14.012 | 40.842 | 7.986 | 1.00 | 44.24 | GZ00 N |
| ATOM | 1414 | CA | SER | C | 185 | 14.963 | 39.747 | 8.041 | 1.00 | 35.64 | GZ00 C |
| ATOM | 1415 | C | SER | C | 185 | 16.258 | 40.228 | 8.669 | 1.00 | 41.38 | GZ00 C |
| ATOM | 1416 | O | SER | C | 185 | 16.650 | 41.392 | 8.526 | 1.00 | 39.54 | GZ00 O |
| ATOM | 1417 | CB | SER | C | 185 | 15.260 | 39.197 | 6.661 | 1.00 | 36.15 | GZ00 C |
| ATOM | 1418 | OG | SER | C | 185 | 14.075 | 38.752 | 6.055 | 1.00 | 40.64 | GZ00 O |
| ATOM | 1419 | N | SER | C | 186 | 16.927 | 39.308 | 9.349 | 1.00 | 38.32 | GZ00 N |
| ATOM | 1420 | CA | SER | C | 186 | 18.265 | 39.524 | 9.871 | 1.00 | 36.92 | GZ00 C |
| ATOM | 1421 | C | SER | C | 186 | 19.108 | 38.382 | 9.349 | 1.00 | 40.04 | GZ00 C |
| ATOM | 1422 | O | SER | C | 186 | 18.687 | 37.226 | 9.434 | 1.00 | 43.87 | GZ00 O |
| ATOM | 1423 | CB | SER | C | 186 | 18.273 | 39.558 | 11.396 | 1.00 | 38.94 | GZ00 C |
| ATOM | 1424 | OG | SER | C | 186 | 19.589 | 39.675 | 11.902 | 1.00 | 39.68 | GZ00 O |
| ATOM | 1425 | N | VAL | C | 187 | 20.267 | 38.698 | 8.773 | 1.00 | 38.05 | GZ00 N |
| ATOM | 1426 | CA | VAL | C | 187 | 21.164 | 37.675 | 8.245 | 1.00 | 39.23 | GZ00 C |
| ATOM | 1427 | C | VAL | C | 187 | 22.543 | 37.869 | 8.849 | 1.00 | 38.02 | GZ00 C |
| ATOM | 1428 | O | VAL | C | 187 | 22.977 | 38.990 | 9.130 | 1.00 | 40.44 | GZ00 O |
| ATOM | 1429 | CB | VAL | C | 187 | 21.291 | 37.714 | 6.708 | 1.00 | 42.17 | GZ00 C |
| ATOM | 1430 | CG1 | VAL | C | 187 | 19.984 | 37.334 | 6.048 | 1.00 | 51.50 | GZ00 C |
| ATOM | 1431 | CG2 | VAL | C | 187 | 21.733 | 39.100 | 6.265 | 1.00 | 42.55 | GZ00 C |
| ATOM | 1432 | N | VAL | C | 188 | 23.252 | 36.770 | 9.018 | 1.00 | 36.36 | GZ00 N |
| ATOM | 1433 | CA | VAL | C | 188 | 24.640 | 36.836 | 9.426 | 1.00 | 36.04 | GZ00 C |

TABLE 10.3-continued

| | | | | | | | | | | | |
|---|---|---|---|---|---|---|---|---|---|---|---|
| ATOM | 1434 | C | VAL | C | 188 | 25.458 | 36.076 | 8.397 | 1.00 | 29.41 | GZ00 C |
| ATOM | 1435 | O | VAL | C | 188 | 25.037 | 35.025 | 7.901 | 1.00 | 36.76 | GZ00 O |
| ATOM | 1436 | CB | VAL | C | 188 | 24.848 | 36.314 | 10.861 | 1.00 | 42.84 | GZ00 C |
| ATOM | 1437 | CG1 | VAL | C | 188 | 24.200 | 34.977 | 11.043 | 1.00 | 38.37 | GZ00 C |
| ATOM | 1438 | CG2 | VAL | C | 188 | 26.343 | 36.272 | 11.210 | 1.00 | 41.22 | GZ00 C |
| ATOM | 1439 | N | THR | C | 189 | 26.558 | 36.673 | 8.000 | 1.00 | 28.33 | GZ00 N |
| ATOM | 1440 | CA | THR | C | 189 | 27.541 | 36.056 | 7.132 | 1.00 | 32.84 | GZ00 C |
| ATOM | 1441 | C | THR | C | 189 | 28.628 | 35.434 | 8.001 | 1.00 | 34.03 | GZ00 C |
| ATOM | 1442 | O | THR | C | 189 | 29.180 | 36.100 | 8.883 | 1.00 | 35.30 | GZ00 O |
| ATOM | 1443 | CB | THR | C | 189 | 28.159 | 37.112 | 6.215 | 1.00 | 32.93 | GZ00 C |
| ATOM | 1444 | OG1 | THR | C | 189 | 27.144 | 37.724 | 5.438 | 1.00 | 45.99 | GZ00 O |
| ATOM | 1445 | CG2 | THR | C | 189 | 29.182 | 36.491 | 5.293 | 1.00 | 42.71 | GZ00 C |
| ATOM | 1446 | N | VAL | C | 190 | 28.939 | 34.171 | 7.745 | 1.00 | 34.62 | GZ00 N |
| ATOM | 1447 | CA | VAL | C | 190 | 29.911 | 33.429 | 8.544 | 1.00 | 31.43 | GZ00 C |
| ATOM | 1448 | C | VAL | C | 190 | 30.828 | 32.676 | 7.590 | 1.00 | 33.62 | GZ00 C |
| ATOM | 1449 | O | VAL | C | 190 | 30.489 | 32.452 | 6.412 | 1.00 | 32.38 | GZ00 O |
| ATOM | 1450 | CB | VAL | C | 190 | 29.217 | 32.438 | 9.514 | 1.00 | 32.44 | GZ00 C |
| ATOM | 1451 | CG1 | VAL | C | 190 | 28.249 | 33.160 | 10.466 | 1.00 | 30.52 | GZ00 C |
| ATOM | 1452 | CG2 | VAL | C | 190 | 28.516 | 31.364 | 8.716 | 1.00 | 32.19 | GZ00 C |
| ATOM | 1453 | N | PRO | C | 191 | 31.989 | 32.240 | 8.078 | 1.00 | 30.12 | GZ00 N |
| ATOM | 1454 | CA | PRO | C | 191 | 32.826 | 31.359 | 7.271 | 1.00 | 32.76 | GZ00 C |
| ATOM | 1455 | C | PRO | C | 191 | 32.058 | 30.080 | 6.963 | 1.00 | 30.65 | GZ00 C |
| ATOM | 1456 | O | PRO | C | 191 | 31.363 | 29.531 | 7.820 | 1.00 | 33.10 | GZ00 O |
| ATOM | 1457 | CB | PRO | C | 191 | 34.045 | 31.120 | 8.172 | 1.00 | 32.26 | GZ00 C |
| ATOM | 1458 | CG | PRO | C | 191 | 34.060 | 32.297 | 9.081 | 1.00 | 34.77 | GZ00 C |
| ATOM | 1459 | CD | PRO | C | 191 | 32.645 | 32.579 | 9.350 | 1.00 | 27.68 | GZ00 C |
| ATOM | 1460 | N | SER | C | 192 | 32.149 | 29.634 | 5.711 | 1.00 | 29.53 | GZ00 N |
| ATOM | 1461 | CA | SER | C | 192 | 31.350 | 28.487 | 5.287 | 1.00 | 39.33 | GZ00 C |
| ATOM | 1462 | C | SER | C | 192 | 31.675 | 27.230 | 6.099 | 1.00 | 36.23 | GZ00 C |
| ATOM | 1463 | O | SER | C | 192 | 30.769 | 26.485 | 6.472 | 1.00 | 42.93 | GZ00 O |
| ATOM | 1464 | CB | SER | C | 192 | 31.541 | 28.240 | 3.789 | 1.00 | 38.81 | GZ00 C |
| ATOM | 1465 | OG | SER | C | 192 | 32.874 | 27.909 | 3.459 | 1.00 | 43.23 | GZ00 O |
| ATOM | 1466 | N | SER | C | 193 | 32.938 | 27.035 | 6.471 | 1.00 | 34.82 | GZ00 N |
| ATOM | 1467 | CA | SER | C | 193 | 33.323 | 25.884 | 7.287 | 1.00 | 34.53 | GZ00 C |
| ATOM | 1468 | C | SER | C | 193 | 32.696 | 25.922 | 8.671 | 1.00 | 34.09 | GZ00 C |
| ATOM | 1469 | O | SER | C | 193 | 32.757 | 24.928 | 9.386 | 1.00 | 39.08 | GZ00 O |
| ATOM | 1470 | CB | SER | C | 193 | 34.853 | 25.776 | 7.406 | 1.00 | 30.12 | GZ00 C |
| ATOM | 1471 | OG | SER | C | 193 | 35.392 | 26.892 | 8.093 | 1.00 | 36.36 | GZ00 O |
| ATOM | 1472 | N | SER | C | 194 | 32.163 | 27.056 | 9.102 | 1.00 | 38.37 | GZ00 N |
| ATOM | 1473 | CA | SER | C | 194 | 31.530 | 27.087 | 10.411 | 1.00 | 33.39 | GZ00 C |
| ATOM | 1474 | C | SER | C | 194 | 30.113 | 26.516 | 10.401 | 1.00 | 42.74 | GZ00 C |
| ATOM | 1475 | O | SER | C | 194 | 29.523 | 26.338 | 11.474 | 1.00 | 39.11 | GZ00 O |
| ATOM | 1476 | CB | SER | C | 194 | 31.499 | 28.525 | 10.943 | 1.00 | 36.98 | GZ00 C |
| ATOM | 1477 | OG | SER | C | 194 | 32.808 | 29.033 | 11.127 | 1.00 | 48.78 | GZ00 O |
| ATOM | 1478 | N | LEU | C | 195 | 29.544 | 26.221 | 9.235 | 1.00 | 39.64 | GZ00 N |
| ATOM | 1479 | CA | LEU | C | 195 | 28.171 | 25.716 | 9.219 | 1.00 | 49.46 | GZ00 C |
| ATOM | 1480 | C | LEU | C | 195 | 28.073 | 24.358 | 9.912 | 1.00 | 44.13 | GZ00 C |
| ATOM | 1481 | O | LEU | C | 195 | 27.079 | 24.064 | 10.584 | 1.00 | 58.41 | GZ00 O |
| ATOM | 1482 | CB | LEU | C | 195 | 27.658 | 25.619 | 7.783 | 1.00 | 39.54 | GZ00 C |
| ATOM | 1483 | CG | LEU | C | 195 | 27.446 | 26.952 | 7.097 | 1.00 | 40.14 | GZ00 C |
| ATOM | 1484 | CD1 | LEU | C | 195 | 26.943 | 26.739 | 5.696 | 1.00 | 44.58 | GZ00 C |
| ATOM | 1485 | CD2 | LEU | C | 195 | 26.470 | 27.772 | 7.904 | 1.00 | 40.80 | GZ00 C |
| ATOM | 1486 | N | GLY | C | 196 | 29.081 | 23.506 | 9.744 | 1.00 | 51.36 | GZ00 N |
| ATOM | 1487 | CA | GLY | C | 196 | 29.046 | 22.221 | 10.420 | 1.00 | 65.18 | GZ00 C |
| ATOM | 1488 | C | GLY | C | 196 | 29.407 | 22.268 | 11.889 | 1.00 | 66.41 | GZ00 C |
| ATOM | 1489 | O | GLY | C | 196 | 29.013 | 21.375 | 12.644 | 1.00 | 61.49 | GZ00 O |
| ATOM | 1490 | N | THR | C | 197 | 30.128 | 23.300 | 12.314 | 1.00 | 62.25 | GZ00 N |
| ATOM | 1491 | CA | THR | C | 197 | 30.755 | 23.340 | 13.626 | 1.00 | 58.93 | GZ00 C |
| ATOM | 1492 | C | THR | C | 197 | 29.995 | 24.161 | 14.655 | 1.00 | 58.26 | GZ00 C |
| ATOM | 1493 | O | THR | C | 197 | 30.047 | 23.842 | 15.845 | 1.00 | 62.50 | GZ00 O |
| ATOM | 1494 | CB | THR | C | 197 | 32.165 | 23.899 | 13.486 | 1.00 | 60.74 | GZ00 C |
| ATOM | 1495 | OG1 | THR | C | 197 | 32.802 | 23.224 | 12.405 | 1.00 | 62.30 | GZ00 O |
| ATOM | 1496 | CG2 | THR | C | 197 | 32.961 | 23.642 | 14.759 | 1.00 | 74.83 | GZ00 C |
| ATOM | 1497 | N | GLN | C | 198 | 29.373 | 25.261 | 14.243 | 1.00 | 52.75 | GZ00 N |
| ATOM | 1498 | CA | GLN | C | 198 | 28.836 | 26.250 | 15.166 | 1.00 | 50.37 | GZ00 C |
| ATOM | 1499 | C | GLN | C | 198 | 27.314 | 26.260 | 15.176 | 1.00 | 47.44 | GZ00 C |
| ATOM | 1500 | O | GLN | C | 198 | 26.650 | 25.910 | 14.197 | 1.00 | 47.96 | GZ00 O |
| ATOM | 1501 | CB | GLN | C | 198 | 29.345 | 27.650 | 14.839 | 1.00 | 49.33 | GZ00 C |
| ATOM | 1502 | CG | GLN | C | 198 | 30.852 | 27.725 | 14.782 | 1.00 | 55.27 | GZ00 C |
| ATOM | 1503 | CD | GLN | C | 198 | 31.515 | 27.225 | 16.062 | 1.00 | 61.24 | GZ00 C |
| ATOM | 1504 | OE1 | GLN | C | 198 | 32.566 | 26.585 | 16.007 | 1.00 | 51.30 | GZ00 O |
| ATOM | 1505 | NE2 | GLN | C | 198 | 30.903 | 27.517 | 17.218 | 1.00 | 56.92 | GZ00 N |
| ATOM | 1506 | N | THR | C | 199 | 26.773 | 26.623 | 16.322 | 1.00 | 52.47 | GZ00 N |
| ATOM | 1507 | CA | THR | C | 199 | 25.343 | 26.782 | 16.481 | 1.00 | 55.26 | GZ00 C |
| ATOM | 1508 | C | THR | C | 199 | 25.008 | 28.268 | 16.402 | 1.00 | 49.37 | GZ00 C |
| ATOM | 1509 | O | THR | C | 199 | 25.618 | 29.094 | 17.092 | 1.00 | 42.11 | GZ00 O |
| ATOM | 1510 | CB | THR | C | 199 | 24.875 | 26.156 | 17.795 | 1.00 | 51.51 | GZ00 C |
| ATOM | 1511 | OG1 | THR | C | 199 | 24.993 | 24.734 | 17.686 | 1.00 | 63.19 | GZ00 O |
| ATOM | 1512 | CG2 | THR | C | 199 | 23.428 | 26.505 | 18.070 | 1.00 | 53.59 | GZ00 C |
| ATOM | 1513 | N | TYR | C | 200 | 24.078 | 28.610 | 15.518 | 1.00 | 48.90 | GZ00 N |

TABLE 10.3-continued

| ATOM | 1514 | CA  | TYR | C | 200 | 23.662 | 29.990 | 15.315 | 1.00 | 48.61 | GZ00 | C   |
|------|------|-----|-----|---|-----|--------|--------|--------|------|-------|------|-----|
| ATOM | 1515 | C   | TYR | C | 200 | 22.209 | 30.127 | 15.721 | 1.00 | 46.13 | GZ00 | C   |
| ATOM | 1516 | O   | TYR | C | 200 | 21.332 | 29.443 | 15.173 | 1.00 | 44.41 | GZ00 | O   |
| ATOM | 1517 | CB  | TYR | C | 200 | 23.885 | 30.425 | 13.871 | 1.00 | 40.49 | GZ00 | C   |
| ATOM | 1518 | CG  | TYR | C | 200 | 25.348 | 30.403 | 13.527 | 1.00 | 43.98 | GZ00 | C   |
| ATOM | 1519 | CD1 | TYR | C | 200 | 26.196 | 31.359 | 14.053 | 1.00 | 42.42 | GZ00 | C   |
| ATOM | 1520 | CD2 | TYR | C | 200 | 25.891 | 29.415 | 12.718 | 1.00 | 41.47 | GZ00 | C   |
| ATOM | 1521 | CE1 | TYR | C | 200 | 27.536 | 31.356 | 13.770 | 1.00 | 39.19 | GZ00 | C   |
| ATOM | 1522 | CE2 | TYR | C | 200 | 27.254 | 29.408 | 12.425 | 1.00 | 45.38 | GZ00 | C   |
| ATOM | 1523 | CZ  | TYR | C | 200 | 28.062 | 30.394 | 12.954 | 1.00 | 39.23 | GZ00 | C   |
| ATOM | 1524 | OH  | TYR | C | 200 | 29.417 | 30.433 | 12.699 | 1.00 | 45.19 | GZ00 | O   |
| ATOM | 1525 | N   | ILE | C | 201 | 21.975 | 30.996 | 16.697 | 1.00 | 42.87 | GZ00 | N   |
| ATOM | 1526 | CA  | ILE | C | 201 | 20.663 | 31.253 | 17.264 | 1.00 | 42.84 | GZ00 | C   |
| ATOM | 1527 | C   | ILE | C | 201 | 20.414 | 32.743 | 17.188 | 1.00 | 44.10 | GZ00 | C   |
| ATOM | 1528 | O   | ILE | C | 201 | 21.240 | 33.530 | 17.663 | 1.00 | 46.46 | GZ00 | O   |
| ATOM | 1529 | CB  | ILE | C | 201 | 20.581 | 30.788 | 18.727 | 1.00 | 50.09 | GZ00 | C   |
| ATOM | 1530 | CG1 | ILE | C | 201 | 20.743 | 29.262 | 18.814 | 1.00 | 45.99 | GZ00 | C   |
| ATOM | 1531 | CG2 | ILE | C | 201 | 19.298 | 31.312 | 19.375 | 1.00 | 42.60 | GZ00 | C   |
| ATOM | 1532 | CD1 | ILE | C | 201 | 20.953 | 28.790 | 20.208 | 1.00 | 32.65 | GZ00 | C   |
| ATOM | 1533 | N   | CYS | C | 202 | 19.279 | 33.131 | 16.604 | 1.00 | 42.47 | GZ00 | N   |
| ATOM | 1534 | CA  | CYS | C | 202 | 18.862 | 34.523 | 16.601 | 1.00 | 43.27 | GZ00 | C   |
| ATOM | 1535 | C   | CYS | C | 202 | 17.860 | 34.776 | 17.723 | 1.00 | 49.37 | GZ00 | C   |
| ATOM | 1536 | O   | CYS | C | 202 | 17.021 | 33.922 | 18.040 | 1.00 | 48.50 | GZ00 | O   |
| ATOM | 1537 | CB  | CYS | C | 202 | 18.262 | 34.923 | 15.250 | 1.00 | 47.82 | GZ00 | C   |
| ATOM | 1538 | SG  | CYS | C | 202 | 16.539 | 34.525 | 15.045 | 1.00 | 59.08 | GZ00 | S   |
| ATOM | 1539 | N   | ASN | C | 203 | 17.976 | 35.945 | 18.341 | 1.00 | 44.56 | GZ00 | N   |
| ATOM | 1540 | CA  | ASN | C | 203 | 17.167 | 36.321 | 19.492 | 1.00 | 39.69 | GZ00 | C   |
| ATOM | 1541 | C   | ASN | C | 203 | 16.329 | 37.519 | 19.079 | 1.00 | 46.86 | GZ00 | C   |
| ATOM | 1542 | O   | ASN | C | 203 | 16.862 | 38.616 | 18.876 | 1.00 | 43.01 | GZ00 | O   |
| ATOM | 1543 | CB  | ASN | C | 203 | 18.043 | 36.660 | 20.698 | 1.00 | 40.17 | GZ00 | C   |
| ATOM | 1544 | CG  | ASN | C | 203 | 19.277 | 35.769 | 20.785 | 1.00 | 50.91 | GZ00 | C   |
| ATOM | 1545 | OD1 | ASN | C | 203 | 20.407 | 36.239 | 20.626 | 1.00 | 44.43 | GZ00 | O   |
| ATOM | 1546 | ND2 | ASN | C | 203 | 19.057 | 34.467 | 20.968 | 1.00 | 40.98 | GZ00 | N   |
| ATOM | 1547 | N   | VAL | C | 204 | 15.027 | 37.320 | 18.972 | 1.00 | 44.56 | GZ00 | N   |
| ATOM | 1548 | CA  | VAL | C | 204 | 14.126 | 38.360 | 18.515 | 1.00 | 46.34 | GZ00 | C   |
| ATOM | 1549 | C   | VAL | C | 204 | 13.377 | 38.894 | 19.715 | 1.00 | 43.52 | GZ00 | C   |
| ATOM | 1550 | O   | VAL | C | 204 | 12.839 | 38.122 | 20.516 | 1.00 | 51.43 | GZ00 | O   |
| ATOM | 1551 | CB  | VAL | C | 204 | 13.166 | 37.826 | 17.447 | 1.00 | 50.83 | GZ00 | C   |
| ATOM | 1552 | CG1 | VAL | C | 204 | 12.204 | 38.932 | 17.006 | 1.00 | 40.92 | GZ00 | C   |
| ATOM | 1553 | CG2 | VAL | C | 204 | 13.984 | 37.271 | 16.291 | 1.00 | 38.78 | GZ00 | C   |
| ATOM | 1554 | N   | ASN | C | 205 | 13.361 | 40.208 | 19.858 | 1.00 | 40.86 | GZ00 | N   |
| ATOM | 1555 | CA  | ASN | C | 205 | 12.687 | 40.856 | 20.970 | 1.00 | 54.57 | GZ00 | C   |
| ATOM | 1556 | C   | ASN | C | 205 | 11.772 | 41.947 | 20.431 | 1.00 | 58.30 | GZ00 | C   |
| ATOM | 1557 | O   | ASN | C | 205 | 12.237 | 42.886 | 19.776 | 1.00 | 55.70 | GZ00 | O   |
| ATOM | 1558 | CB  | ASN | C | 205 | 13.691 | 41.445 | 21.965 | 1.00 | 49.16 | GZ00 | C   |
| ATOM | 1559 | CG  | ASN | C | 205 | 13.009 | 42.013 | 23.204 | 1.00 | 69.12 | GZ00 | C   |
| ATOM | 1560 | OD1 | ASN | C | 205 | 11.837 | 41.702 | 23.489 | 1.00 | 63.20 | GZ00 | O   |
| ATOM | 1561 | ND2 | ASN | C | 205 | 13.716 | 42.884 | 23.921 | 1.00 | 72.08 | GZ00 | N   |
| ATOM | 1562 | N   | HIS | C | 206 | 10.482 | 41.839 | 20.732 | 1.00 | 55.60 | GZ00 | N   |
| ATOM | 1563 | CA  | HIS | C | 206 | 9.489  | 42.834 | 20.326 | 1.00 | 56.54 | GZ00 | C   |
| ATOM | 1564 | C   | HIS | C | 206 | 8.843  | 43.347 | 21.611 | 1.00 | 58.64 | GZ00 | C   |
| ATOM | 1565 | O   | HIS | C | 206 | 7.857  | 42.788 | 22.098 | 1.00 | 54.70 | GZ00 | O   |
| ATOM | 1566 | CB  | HIS | C | 206 | 8.472  | 42.249 | 19.356 | 1.00 | 51.09 | GZ00 | C   |
| ATOM | 1567 | CG  | HIS | C | 206 | 7.482  | 43.251 | 18.851 | 1.00 | 60.00 | GZ00 | C   |
| ATOM | 1568 | ND1 | HIS | C | 206 | 6.150  | 42.954 | 18.660 | 1.00 | 56.09 | GZ00 | N   |
| ATOM | 1569 | CD2 | HIS | C | 206 | 7.633  | 44.548 | 18.494 | 1.00 | 60.16 | GZ00 | C   |
| ATOM | 1570 | CE1 | HIS | C | 206 | 5.525  | 44.026 | 18.209 | 1.00 | 55.91 | GZ00 | C   |
| ATOM | 1571 | NE2 | HIS | C | 206 | 6.402  | 45.007 | 18.100 | 1.00 | 50.50 | GZ00 | N   |
| ATOM | 1572 | N   | LYS | C | 207 | 9.435  | 44.398 | 22.179 | 1.00 | 59.62 | GZ00 | N   |
| ATOM | 1573 | CA  | LYS | C | 207 | 8.977  | 44.892 | 23.475 | 1.00 | 60.73 | GZ00 | C   |
| ATOM | 1574 | C   | LYS | C | 207 | 7.519  | 45.338 | 23.493 | 1.00 | 69.23 | GZ00 | C   |
| ATOM | 1575 | O   | LYS | C | 207 | 6.848  | 45.083 | 24.509 | 1.00 | 66.50 | GZ00 | O   |
| ATOM | 1576 | CB  | LYS | C | 207 | 9.906  | 46.014 | 23.956 | 1.00 | 58.40 | GZ00 | C   |
| ATOM | 1577 | CG  | LYS | C | 207 | 11.292 | 45.481 | 24.321 | 1.00 | 69.34 | GZ00 | C   |
| ATOM | 1578 | CD  | LYS | C | 207 | 12.257 | 46.543 | 24.809 | 1.00 | 77.26 | GZ00 | C   |
| ATOM | 1579 | CE  | LYS | C | 207 | 13.596 | 45.890 | 25.148 | 1.00 | 81.04 | GZ00 | C   |
| ATOM | 1580 | NZ  | LYS | C | 207 | 14.641 | 46.873 | 25.530 | 1.00 | 87.24 | GZ00 | N1+ |
| ATOM | 1581 | N   | PRO | C | 208 | 6.956  | 45.959 | 22.441 | 1.00 | 69.40 | GZ00 | N   |
| ATOM | 1582 | CA  | PRO | C | 208 | 5.540  | 46.372 | 22.538 | 1.00 | 59.57 | GZ00 | C   |
| ATOM | 1583 | C   | PRO | C | 208 | 4.585  | 45.244 | 22.898 | 1.00 | 64.04 | GZ00 | C   |
| ATOM | 1584 | O   | PRO | C | 208 | 3.640  | 45.466 | 23.666 | 1.00 | 69.66 | GZ00 | O   |
| ATOM | 1585 | CB  | PRO | C | 208 | 5.257  | 46.942 | 21.145 | 1.00 | 53.38 | GZ00 | C   |
| ATOM | 1586 | CG  | PRO | C | 208 | 6.582  | 47.479 | 20.704 | 1.00 | 65.93 | GZ00 | C   |
| ATOM | 1587 | CD  | PRO | C | 208 | 7.608  | 46.524 | 21.241 | 1.00 | 55.91 | GZ00 | C   |
| ATOM | 1588 | N   | SER | C | 209 | 4.814  | 44.034 | 22.401 | 1.00 | 60.28 | GZ00 | N   |
| ATOM | 1589 | CA  | SER | C | 209 | 4.019  | 42.880 | 22.786 | 1.00 | 57.00 | GZ00 | C   |
| ATOM | 1590 | C   | SER | C | 209 | 4.762  | 41.960 | 23.758 | 1.00 | 67.68 | GZ00 | C   |
| ATOM | 1591 | O   | SER | C | 209 | 4.284  | 40.848 | 24.024 | 1.00 | 64.38 | GZ00 | O   |
| ATOM | 1592 | CB  | SER | C | 209 | 3.586  | 42.091 | 21.546 | 1.00 | 56.00 | GZ00 | C   |
| ATOM | 1593 | OG  | SER | C | 209 | 4.691  | 41.469 | 20.915 | 1.00 | 63.30 | GZ00 | O   |

TABLE 10.3-continued

| ATOM | 1594 | N | ASN | C | 210 | 5.918 | 42.392 | 24.271 | 1.00 | 68.38 | GZ00 | N |
|---|---|---|---|---|---|---|---|---|---|---|---|---|
| ATOM | 1595 | CA | ASN | C | 210 | 6.846 | 41.563 | 25.049 | 1.00 | 66.63 | GZ00 | C |
| ATOM | 1596 | C | ASN | C | 210 | 6.898 | 40.139 | 24.505 | 1.00 | 64.18 | GZ00 | C |
| ATOM | 1597 | O | ASN | C | 210 | 6.538 | 39.164 | 25.164 | 1.00 | 67.42 | GZ00 | O |
| ATOM | 1598 | CB | ASN | C | 210 | 6.528 | 41.574 | 26.543 | 1.00 | 74.01 | GZ00 | C |
| ATOM | 1599 | CG | ASN | C | 210 | 5.055 | 41.657 | 26.828 | 1.00 | 83.26 | GZ00 | C |
| ATOM | 1600 | OD1 | ASN | C | 210 | 4.483 | 42.750 | 26.885 | 1.00 | 89.02 | GZ00 | O |
| ATOM | 1601 | ND2 | ASN | C | 210 | 4.420 | 40.502 | 26.997 | 1.00 | 83.49 | GZ00 | N |
| ATOM | 1602 | N | THR | C | 211 | 7.358 | 40.045 | 23.268 | 1.00 | 61.55 | GZ00 | N |
| ATOM | 1603 | CA | THR | C | 211 | 7.633 | 38.772 | 22.633 | 1.00 | 57.57 | GZ00 | C |
| ATOM | 1604 | C | THR | C | 211 | 9.143 | 38.608 | 22.609 | 1.00 | 60.01 | GZ00 | C |
| ATOM | 1605 | O | THR | C | 211 | 9.862 | 39.532 | 22.214 | 1.00 | 65.19 | GZ00 | O |
| ATOM | 1606 | CB | THR | C | 211 | 7.089 | 38.734 | 21.209 | 1.00 | 54.23 | GZ00 | C |
| ATOM | 1607 | OG1 | THR | C | 211 | 5.691 | 39.013 | 21.227 | 1.00 | 60.96 | GZ00 | O |
| ATOM | 1608 | CG2 | THR | C | 211 | 7.316 | 37.377 | 20.586 | 1.00 | 57.50 | GZ00 | C |
| ATOM | 1609 | N | LYS | C | 212 | 9.620 | 37.460 | 23.084 | 1.00 | 60.21 | GZ00 | N |
| ATOM | 1610 | CA | LYS | C | 212 | 11.018 | 37.076 | 22.951 | 1.00 | 52.01 | GZ00 | C |
| ATOM | 1611 | C | LYS | C | 212 | 11.042 | 35.689 | 22.350 | 1.00 | 52.91 | GZ00 | C |
| ATOM | 1612 | O | LYS | C | 212 | 10.456 | 34.760 | 22.906 | 1.00 | 57.94 | GZ00 | O |
| ATOM | 1613 | CB | LYS | C | 212 | 11.753 | 37.110 | 24.290 | 1.00 | 47.41 | GZ00 | C |
| ATOM | 1614 | CG | LYS | C | 212 | 11.691 | 38.475 | 24.978 | 1.00 | 57.15 | GZ00 | C |
| ATOM | 1615 | CD | LYS | C | 212 | 12.644 | 38.565 | 26.174 | 1.00 | 66.23 | GZ00 | C |
| ATOM | 1616 | CE | LYS | C | 212 | 12.433 | 39.861 | 26.969 | 1.00 | 79.81 | GZ00 | C |
| ATOM | 1617 | NZ | LYS | C | 212 | 13.705 | 40.467 | 27.503 | 1.00 | 78.51 | GZ00 | N1+ |
| ATOM | 1618 | N | VAL | C | 213 | 11.710 | 35.555 | 21.215 | 1.00 | 55.55 | GZ00 | N |
| ATOM | 1619 | CA | VAL | C | 213 | 11.839 | 34.287 | 20.520 | 1.00 | 49.66 | GZ00 | C |
| ATOM | 1620 | C | VAL | C | 213 | 13.319 | 34.021 | 20.272 | 1.00 | 50.74 | GZ00 | C |
| ATOM | 1621 | O | VAL | C | 213 | 14.050 | 34.906 | 19.810 | 1.00 | 48.29 | GZ00 | O |
| ATOM | 1622 | CB | VAL | C | 213 | 11.051 | 34.291 | 19.199 | 1.00 | 51.80 | GZ00 | C |
| ATOM | 1623 | CG1 | VAL | C | 213 | 11.260 | 32.982 | 18.441 | 1.00 | 52.63 | GZ00 | C |
| ATOM | 1624 | CG2 | VAL | C | 213 | 9.583 | 34.508 | 19.477 | 1.00 | 52.72 | GZ00 | C |
| ATOM | 1625 | N | ASP | C | 214 | 13.757 | 32.813 | 20.598 | 1.00 | 51.96 | GZ00 | N |
| ATOM | 1626 | CA | ASP | C | 214 | 15.054 | 32.301 | 20.199 | 1.00 | 43.41 | GZ00 | C |
| ATOM | 1627 | C | ASP | C | 214 | 14.791 | 31.231 | 19.160 | 1.00 | 52.09 | GZ00 | C |
| ATOM | 1628 | O | ASP | C | 214 | 13.923 | 30.374 | 19.356 | 1.00 | 60.39 | GZ00 | O |
| ATOM | 1629 | CB | ASP | C | 214 | 15.820 | 31.717 | 21.384 | 1.00 | 47.17 | GZ00 | C |
| ATOM | 1630 | CG | ASP | C | 214 | 16.093 | 32.742 | 22.473 | 1.00 | 53.34 | GZ00 | C |
| ATOM | 1631 | OD1 | ASP | C | 214 | 16.343 | 33.921 | 22.145 | 1.00 | 53.82 | GZ00 | O |
| ATOM | 1632 | OD2 | ASP | C | 214 | 16.071 | 32.367 | 23.665 | 1.00 | 64.40 | GZ00 | O1- |
| ATOM | 1633 | N | LYS | C | 215 | 15.527 | 31.282 | 18.060 | 1.00 | 49.22 | GZ00 | N |
| ATOM | 1634 | CA | LYS | C | 215 | 15.322 | 30.324 | 16.993 | 1.00 | 46.64 | GZ00 | C |
| ATOM | 1635 | C | LYS | C | 215 | 16.691 | 29.904 | 16.489 | 1.00 | 51.67 | GZ00 | C |
| ATOM | 1636 | O | LYS | C | 215 | 17.531 | 30.748 | 16.165 | 1.00 | 50.73 | GZ00 | O |
| ATOM | 1637 | CB | LYS | C | 215 | 14.459 | 30.916 | 15.877 | 1.00 | 41.93 | GZ00 | C |
| ATOM | 1638 | CG | LYS | C | 215 | 14.213 | 29.983 | 14.699 | 1.00 | 58.37 | GZ00 | C |
| ATOM | 1639 | CD | LYS | C | 215 | 13.161 | 28.894 | 14.993 | 1.00 | 57.43 | GZ00 | C |
| ATOM | 1640 | CE | LYS | C | 215 | 11.848 | 29.473 | 15.498 | 1.00 | 54.91 | GZ00 | C |
| ATOM | 1641 | NZ | LYS | C | 215 | 10.704 | 28.533 | 15.296 | 1.00 | 59.67 | GZ00 | N1+ |
| ATOM | 1642 | N | LYS | C | 216 | 16.916 | 28.597 | 16.475 | 1.00 | 48.55 | GZ00 | N |
| ATOM | 1643 | CA | LYS | C | 216 | 18.160 | 28.025 | 16.004 | 1.00 | 44.55 | GZ00 | C |
| ATOM | 1644 | C | LYS | C | 216 | 18.075 | 27.873 | 14.498 | 1.00 | 51.23 | GZ00 | C |
| ATOM | 1645 | O | LYS | C | 216 | 17.073 | 27.377 | 13.973 | 1.00 | 48.07 | GZ00 | O |
| ATOM | 1646 | CB | LYS | C | 216 | 18.384 | 26.667 | 16.671 | 1.00 | 53.16 | GZ00 | C |
| ATOM | 1647 | CG | LYS | C | 216 | 19.666 | 25.939 | 16.297 | 1.00 | 58.06 | GZ00 | C |
| ATOM | 1648 | CD | LYS | C | 216 | 19.698 | 24.568 | 16.972 | 1.00 | 68.72 | GZ00 | C |
| ATOM | 1649 | CE | LYS | C | 216 | 21.064 | 23.901 | 16.884 | 1.00 | 76.90 | GZ00 | C |
| ATOM | 1650 | NZ | LYS | C | 216 | 21.133 | 22.703 | 17.775 | 1.00 | 81.06 | GZ00 | N1+ |
| ATOM | 1651 | N | VAL | C | 217 | 19.122 | 28.296 | 13.802 | 1.00 | 42.74 | GZ00 | N |
| ATOM | 1652 | CA | VAL | C | 217 | 19.158 | 28.228 | 12.355 | 1.00 | 45.91 | GZ00 | C |
| ATOM | 1653 | C | VAL | C | 217 | 20.199 | 27.179 | 12.003 | 1.00 | 52.09 | GZ00 | C |
| ATOM | 1654 | O | VAL | C | 217 | 21.399 | 27.371 | 12.243 | 1.00 | 50.43 | GZ00 | O |
| ATOM | 1655 | CB | VAL | C | 217 | 19.472 | 29.594 | 11.727 | 1.00 | 47.85 | GZ00 | C |
| ATOM | 1656 | CG1 | VAL | C | 217 | 19.352 | 29.534 | 10.217 | 1.00 | 36.68 | GZ00 | C |
| ATOM | 1657 | CG2 | VAL | C | 217 | 18.552 | 30.667 | 12.314 | 1.00 | 38.98 | GZ00 | C |
| ATOM | 1658 | N | GLU | C | 218 | 19.742 | 26.069 | 11.431 | 1.00 | 54.61 | GZ00 | N |
| ATOM | 1659 | CA | GLU | C | 218 | 20.591 | 24.937 | 11.107 | 1.00 | 54.05 | GZ00 | C |
| ATOM | 1660 | C | GLU | C | 218 | 20.622 | 24.755 | 9.603 | 1.00 | 49.13 | GZ00 | C |
| ATOM | 1661 | O | GLU | C | 218 | 19.647 | 25.082 | 8.922 | 1.00 | 58.50 | GZ00 | O |
| ATOM | 1662 | CB | GLU | C | 218 | 20.080 | 23.637 | 11.742 | 1.00 | 65.26 | GZ00 | C |
| ATOM | 1663 | CG | GLU | C | 218 | 19.944 | 23.671 | 13.253 | 1.00 | 70.38 | GZ00 | C |
| ATOM | 1664 | CD | GLU | C | 218 | 19.413 | 22.365 | 13.822 | 1.00 | 84.00 | GZ00 | C |
| ATOM | 1665 | OE1 | GLU | C | 218 | 18.889 | 21.534 | 13.040 | 1.00 | 82.26 | GZ00 | O |
| ATOM | 1666 | OE2 | GLU | C | 218 | 19.515 | 22.180 | 15.056 | 1.00 | 91.02 | GZ00 | O1- |
| ATOM | 1667 | N | PRO | C | 219 | 21.716 | 24.232 | 9.056 | 1.00 | 57.01 | GZ00 | N |
| ATOM | 1668 | CA | PRO | C | 219 | 21.755 | 23.952 | 7.612 | 1.00 | 53.03 | GZ00 | C |
| ATOM | 1669 | C | PRO | C | 219 | 20.705 | 22.941 | 7.170 | 1.00 | 58.97 | GZ00 | C |
| ATOM | 1670 | O | PRO | C | 219 | 19.991 | 22.384 | 8.008 | 1.00 | 62.86 | GZ00 | O |
| ATOM | 1671 | CB | PRO | C | 219 | 23.185 | 23.443 | 7.393 | 1.00 | 49.20 | GZ00 | C |
| ATOM | 1672 | CG | PRO | C | 219 | 23.796 | 23.307 | 8.761 | 1.00 | 47.12 | GZ00 | C |
| ATOM | 1673 | CD | PRO | C | 219 | 23.051 | 24.186 | 9.671 | 1.00 | 55.30 | GZ00 | C |

TABLE 10.3-continued

| | | | | | | | | | | | |
|---|---|---|---|---|---|---|---|---|---|---|---|
| ATOM | 1674 | N | LYS | C | 220 | 20.623 | 22.700 | 5.857 | 1.00 | 71.75 | GZ00 N |
| ATOM | 1675 | CA | LYS | C | 220 | 19.610 | 21.841 | 5.209 | 1.00 | 68.27 | GZ00 C |
| ATOM | 1676 | C | LYS | C | 220 | 18.226 | 22.491 | 5.306 | 1.00 | 73.79 | GZ00 C |
| ATOM | 1677 | O | LYS | C | 220 | 17.355 | 22.046 | 6.058 | 1.00 | 80.81 | GZ00 O |
| ATOM | 1678 | CB | LYS | C | 220 | 19.570 | 20.424 | 5.812 | 1.00 | 60.33 | GZ00 C |
| ATOM | 1679 | CG | LYS | C | 220 | 18.562 | 19.498 | 5.140 | 1.00 | 75.19 | GZ00 C |
| ATOM | 1680 | CD | LYS | C | 220 | 18.194 | 18.314 | 6.009 | 1.00 | 81.62 | GZ00 C |
| ATOM | 1681 | CE | LYS | C | 220 | 17.204 | 17.408 | 5.284 | 1.00 | 83.68 | GZ00 C |
| ATOM | 1682 | NZ | LYS | C | 220 | 15.922 | 18.107 | 4.974 | 1.00 | 81.30 | GZ00 N1+ |
| TER | | | | | | | | | | | |
| ATOM | 1683 | N | GLN | D | 1 | 3.622 | 57.068 | −14.037 | 1.00 | 73.81 | N |
| ATOM | 1684 | CA | GLN | D | 1 | 2.256 | 57.519 | −13.830 | 1.00 | 77.03 | C |
| ATOM | 1685 | C | GLN | D | 1 | 2.220 | 58.975 | −13.340 | 1.00 | 71.19 | C |
| ATOM | 1686 | O | GLN | D | 1 | 1.170 | 59.618 | −13.403 | 1.00 | 70.55 | O |
| ATOM | 1687 | CB | GLN | D | 1 | 1.535 | 56.594 | −12.844 | 1.00 | 76.72 | C |
| ATOM | 1688 | CG | GLN | D | 1 | 0.016 | 56.704 | −12.856 | 1.00 | 83.42 | C |
| ATOM | 1689 | CD | GLN | D | 1 | −0.568 | 56.892 | −11.458 | 1.00 | 94.69 | C |
| ATOM | 1690 | OE1 | GLN | D | 1 | 0.127 | 56.720 | −10.448 | 1.00 | 86.56 | O |
| ATOM | 1691 | NE2 | GLN | D | 1 | −1.851 | 57.255 | −11.395 | 1.00 | 91.59 | N |
| ATOM | 1692 | N | SER | D | 2 | 3.352 | 59.504 | −12.865 | 1.00 | 62.32 | N |
| ATOM | 1693 | CA | SER | D | 2 | 3.404 | 60.928 | −12.539 | 1.00 | 62.06 | C |
| ATOM | 1694 | C | SER | D | 2 | 3.359 | 61.752 | −13.826 | 1.00 | 54.47 | C |
| ATOM | 1695 | O | SER | D | 2 | 3.840 | 61.331 | −14.885 | 1.00 | 54.37 | O |
| ATOM | 1696 | CB | SER | D | 2 | 4.637 | 61.269 | −11.685 | 1.00 | 55.55 | C |
| ATOM | 1697 | OG | SER | D | 2 | 5.815 | 61.429 | −12.445 | 1.00 | 44.68 | O |
| ATOM | 1698 | N | VAL | D | 3 | 2.765 | 62.942 | −13.725 | 1.00 | 51.09 | N |
| ATOM | 1699 | CA | VAL | D | 3 | 2.399 | 63.693 | −14.926 | 1.00 | 44.98 | C |
| ATOM | 1700 | C | VAL | D | 3 | 3.625 | 64.277 | −15.623 | 1.00 | 44.14 | C |
| ATOM | 1701 | O | VAL | D | 3 | 3.682 | 64.317 | −16.858 | 1.00 | 42.24 | O |
| ATOM | 1702 | CB | VAL | D | 3 | 1.355 | 64.762 | −14.561 | 1.00 | 48.49 | C |
| ATOM | 1703 | CG1 | VAL | D | 3 | 1.035 | 65.656 | −15.762 | 1.00 | 33.38 | C |
| ATOM | 1704 | CG2 | VAL | D | 3 | 0.095 | 64.072 | −13.994 | 1.00 | 36.61 | C |
| ATOM | 1705 | N | LEU | D | 4 | 4.610 | 64.757 | −14.867 | 1.00 | 40.88 | N |
| ATOM | 1706 | CA | LEU | D | 4 | 5.895 | 65.115 | −15.451 | 1.00 | 38.31 | C |
| ATOM | 1707 | C | LEU | D | 4 | 6.842 | 63.946 | −15.255 | 1.00 | 42.46 | C |
| ATOM | 1708 | O | LEU | D | 4 | 6.841 | 63.318 | −14.195 | 1.00 | 41.68 | O |
| ATOM | 1709 | CB | LEU | D | 4 | 6.484 | 66.365 | −14.808 | 1.00 | 36.49 | C |
| ATOM | 1710 | CG | LEU | D | 4 | 5.476 | 67.494 | −14.624 | 1.00 | 34.13 | C |
| ATOM | 1711 | CD1 | LEU | D | 4 | 6.074 | 68.656 | −13.825 | 1.00 | 34.44 | C |
| ATOM | 1712 | CD2 | LEU | D | 4 | 4.978 | 67.953 | −15.972 | 1.00 | 29.23 | C |
| ATOM | 1713 | N | THR | D | 5 | 7.637 | 63.640 | −16.273 | 1.00 | 39.33 | N |
| ATOM | 1714 | CA | THR | D | 5 | 8.541 | 62.503 | −16.203 | 1.00 | 34.69 | C |
| ATOM | 1715 | C | THR | D | 5 | 9.987 | 62.990 | −16.144 | 1.00 | 41.85 | C |
| ATOM | 1716 | O | THR | D | 5 | 10.420 | 63.814 | −16.959 | 1.00 | 32.54 | O |
| ATOM | 1717 | CB | THR | D | 5 | 8.307 | 61.529 | −17.363 | 1.00 | 40.41 | C |
| ATOM | 1718 | OG1 | THR | D | 5 | 8.542 | 62.190 | −18.596 | 1.00 | 58.56 | O |
| ATOM | 1719 | CG2 | THR | D | 5 | 6.858 | 61.060 | −17.366 | 1.00 | 35.80 | C |
| ATOM | 1720 | N | GLN | D | 6 | 10.703 | 62.522 | −15.132 | 1.00 | 33.22 | N |
| ATOM | 1721 | CA | GLN | D | 6 | 12.100 | 62.739 | −14.872 | 1.00 | 31.46 | C |
| ATOM | 1722 | C | GLN | D | 6 | 12.802 | 61.390 | −14.902 | 1.00 | 35.85 | C |
| ATOM | 1723 | O | GLN | D | 6 | 12.187 | 60.381 | −14.554 | 1.00 | 35.36 | O |
| ATOM | 1724 | CB | GLN | D | 6 | 12.302 | 63.370 | −13.490 | 1.00 | 31.54 | C |
| ATOM | 1725 | CG | GLN | D | 6 | 11.670 | 64.731 | −13.302 | 1.00 | 32.96 | C |
| ATOM | 1726 | CD | GLN | D | 6 | 11.827 | 65.238 | −11.884 | 1.00 | 38.63 | C |
| ATOM | 1727 | OE1 | GLN | D | 6 | 10.841 | 65.645 | −11.248 | 1.00 | 36.32 | O |
| ATOM | 1728 | NE2 | GLN | D | 6 | 13.073 | 65.220 | −11.367 | 1.00 | 31.40 | N |
| ATOM | 1729 | N | PRO | D | 7 | 14.069 | 61.323 | −15.306 | 1.00 | 39.24 | N |
| ATOM | 1730 | CA | PRO | D | 7 | 14.832 | 60.087 | −15.078 | 1.00 | 33.07 | C |
| ATOM | 1731 | C | PRO | D | 7 | 14.881 | 59.791 | −13.588 | 1.00 | 34.60 | C |
| ATOM | 1732 | O | PRO | D | 7 | 15.015 | 60.714 | −12.764 | 1.00 | 32.93 | O |
| ATOM | 1733 | CB | PRO | D | 7 | 16.235 | 60.402 | −15.652 | 1.00 | 31.22 | C |
| ATOM | 1734 | CG | PRO | D | 7 | 16.356 | 61.910 | −15.589 | 1.00 | 34.93 | C |
| ATOM | 1735 | CD | PRO | D | 7 | 14.921 | 62.430 | −15.806 | 1.00 | 35.72 | C |
| ATOM | 1736 | N | PRO | D | 8 | 14.755 | 58.518 | −13.197 | 1.00 | 33.41 | N |
| ATOM | 1737 | CA | PRO | D | 8 | 14.682 | 58.200 | −11.756 | 1.00 | 33.71 | C |
| ATOM | 1738 | C | PRO | D | 8 | 15.987 | 58.443 | −11.027 | 1.00 | 36.29 | C |
| ATOM | 1739 | O | PRO | D | 8 | 15.966 | 58.847 | −9.855 | 1.00 | 35.95 | O |
| ATOM | 1740 | CB | PRO | D | 8 | 14.299 | 56.705 | −11.730 | 1.00 | 31.63 | C |
| ATOM | 1741 | CG | PRO | D | 8 | 14.777 | 56.181 | −13.032 | 1.00 | 33.24 | C |
| ATOM | 1742 | CD | PRO | D | 8 | 14.568 | 57.333 | −14.040 | 1.00 | 28.70 | C |
| ATOM | 1743 | N | SER | D | 9 | 17.128 | 58.252 | −11.679 | 1.00 | 31.20 | N |
| ATOM | 1744 | CA | SER | D | 9 | 18.367 | 58.463 | −10.945 | 1.00 | 41.37 | C |
| ATOM | 1745 | C | SER | D | 9 | 19.485 | 58.910 | −11.869 | 1.00 | 41.68 | C |
| ATOM | 1746 | O | SER | D | 9 | 19.492 | 58.642 | −13.075 | 1.00 | 39.62 | O |
| ATOM | 1747 | CB | SER | D | 9 | 18.788 | 57.197 | −10.195 | 1.00 | 32.55 | C |
| ATOM | 1748 | OG | SER | D | 9 | 18.984 | 56.168 | −11.129 | 1.00 | 46.27 | O |
| ATOM | 1749 | N | VAL | D | 10 | 20.465 | 59.553 | −11.259 | 1.00 | 35.48 | N |
| ATOM | 1750 | CA | VAL | D | 10 | 21.529 | 60.199 | −12.000 | 1.00 | 37.87 | C |
| ATOM | 1751 | C | VAL | D | 10 | 22.736 | 60.253 | −11.082 | 1.00 | 34.78 | C |
| ATOM | 1752 | O | VAL | D | 10 | 22.605 | 60.523 | −9.880 | 1.00 | 36.71 | O |

TABLE 10.3-continued

| | | | | | | | | | | |
|---|---|---|---|---|---|---|---|---|---|---|
| ATOM | 1753 | CB | VAL | D | 10 | 21.041 | 61.588 | −12.472 | 1.00 | 40.73 | C |
| ATOM | 1754 | CG1 | VAL | D | 10 | 21.926 | 62.691 | −11.971 | 1.00 | 40.07 | C |
| ATOM | 1755 | CG2 | VAL | D | 10 | 20.845 | 61.613 | −13.973 | 1.00 | 38.95 | C |
| ATOM | 1756 | N | SER | D | 11 | 23.915 | 59.963 | −11.625 | 1.00 | 37.46 | N |
| ATOM | 1757 | CA | SER | D | 11 | 25.092 | 59.962 | −10.762 | 1.00 | 35.14 | C |
| ATOM | 1758 | C | SER | D | 11 | 26.324 | 60.390 | −11.542 | 1.00 | 31.82 | C |
| ATOM | 1759 | O | SER | D | 11 | 26.474 | 60.057 | −12.715 | 1.00 | 37.48 | O |
| ATOM | 1760 | CB | SER | D | 11 | 25.311 | 58.580 | −10.130 | 1.00 | 33.24 | C |
| ATOM | 1761 | OG | SER | D | 11 | 25.640 | 57.636 | −11.125 | 1.00 | 37.23 | O |
| ATOM | 1762 | N | ALA | D | 12 | 27.196 | 61.139 | −10.877 | 1.00 | 35.26 | N |
| ATOM | 1763 | CA | ALA | D | 12 | 28.433 | 61.620 | −11.469 | 1.00 | 34.57 | C |
| ATOM | 1764 | C | ALA | D | 12 | 29.379 | 61.996 | −10.338 | 1.00 | 39.68 | C |
| ATOM | 1765 | O | ALA | D | 12 | 28.955 | 62.218 | −9.199 | 1.00 | 31.45 | O |
| ATOM | 1766 | CB | ALA | D | 12 | 28.200 | 62.814 | −12.409 | 1.00 | 31.29 | C |
| ATOM | 1767 | N | ALA | D | 13 | 30.673 | 62.071 | −10.679 | 1.00 | 36.93 | N |
| ATOM | 1768 | CA | ALA | D | 13 | 31.748 | 62.366 | −9.733 | 1.00 | 40.49 | C |
| ATOM | 1769 | C | ALA | D | 13 | 31.847 | 63.860 | −9.433 | 1.00 | 40.25 | C |
| ATOM | 1770 | O | ALA | D | 13 | 31.411 | 64.695 | −10.236 | 1.00 | 39.24 | O |
| ATOM | 1771 | CB | ALA | D | 13 | 33.081 | 61.875 | −10.291 | 1.00 | 30.80 | C |
| ATOM | 1772 | N | PRO | D | 14 | 32.434 | 64.225 | −8.288 | 1.00 | 33.52 | N |
| ATOM | 1773 | CA | PRO | D | 14 | 32.647 | 65.646 | −7.994 | 1.00 | 38.76 | C |
| ATOM | 1774 | C | PRO | D | 14 | 33.382 | 66.324 | −9.141 | 1.00 | 44.78 | C |
| ATOM | 1775 | O | PRO | D | 14 | 34.233 | 65.718 | −9.798 | 1.00 | 36.43 | O |
| ATOM | 1776 | CB | PRO | D | 14 | 33.485 | 65.629 | −6.711 | 1.00 | 35.31 | C |
| ATOM | 1777 | CG | PRO | D | 14 | 33.152 | 64.283 | −6.060 | 1.00 | 30.30 | C |
| ATOM | 1778 | CD | PRO | D | 14 | 32.928 | 63.345 | −7.208 | 1.00 | 32.96 | C |
| ATOM | 1779 | N | GLY | D | 15 | 33.008 | 67.579 | −9.410 | 1.00 | 45.92 | N |
| ATOM | 1780 | CA | GLY | D | 15 | 33.585 | 68.342 | −10.484 | 1.00 | 34.84 | C |
| ATOM | 1781 | C | GLY | D | 15 | 32.932 | 68.138 | −11.829 | 1.00 | 41.92 | C |
| ATOM | 1782 | O | GLY | D | 15 | 33.143 | 68.956 | −12.728 | 1.00 | 49.13 | O |
| ATOM | 1783 | N | GLN | D | 16 | 32.143 | 67.083 | −12.001 | 1.00 | 37.37 | N |
| ATOM | 1784 | CA | GLN | D | 16 | 31.533 | 66.844 | −13.302 | 1.00 | 48.89 | C |
| ATOM | 1785 | C | GLN | D | 16 | 30.220 | 67.627 | −13.500 | 1.00 | 47.03 | C |
| ATOM | 1786 | O | GLN | D | 16 | 29.744 | 68.367 | −12.628 | 1.00 | 39.51 | O |
| ATOM | 1787 | CB | GLN | D | 16 | 31.306 | 65.355 | −13.502 | 1.00 | 50.09 | C |
| ATOM | 1788 | CG | GLN | D | 16 | 32.570 | 64.589 | −13.809 | 1.00 | 57.03 | C |
| ATOM | 1789 | CD | GLN | D | 16 | 32.260 | 63.311 | −14.566 | 1.00 | 75.65 | C |
| ATOM | 1790 | OE1 | GLN | D | 16 | 31.830 | 62.302 | −13.979 | 1.00 | 62.08 | O |
| ATOM | 1791 | NE2 | GLN | D | 16 | 32.445 | 63.353 | −15.886 | 1.00 | 86.71 | N |
| ATOM | 1792 | N | LYS | D | 17 | 29.674 | 67.481 | −14.711 | 1.00 | 50.37 | N |
| ATOM | 1793 | CA | LYS | D | 17 | 28.424 | 68.054 | −15.189 | 1.00 | 47.34 | C |
| ATOM | 1794 | C | LYS | D | 17 | 27.325 | 67.004 | −15.183 | 1.00 | 51.01 | C |
| ATOM | 1795 | O | LYS | D | 17 | 27.566 | 65.822 | −15.440 | 1.00 | 57.21 | O |
| ATOM | 1796 | CB | LYS | D | 17 | 28.537 | 68.558 | −16.635 | 1.00 | 48.76 | C |
| ATOM | 1797 | CG | LYS | D | 17 | 29.325 | 69.812 | −16.889 | 1.00 | 66.24 | C |
| ATOM | 1798 | CD | LYS | D | 17 | 29.537 | 69.967 | −18.408 | 1.00 | 76.78 | C |
| ATOM | 1799 | CE | LYS | D | 17 | 30.502 | 71.109 | −18.742 | 1.00 | 85.45 | C |
| ATOM | 1800 | NZ | LYS | D | 17 | 30.739 | 71.204 | −20.209 | 1.00 | 85.79 | N |
| ATOM | 1801 | N | AVAL | D | 18 | 26.098 | 67.456 | −14.947 | 0.60 | 46.54 | N |
| ATOM | 1802 | CA | AVAL | D | 18 | 24.936 | 66.572 | −14.935 | 0.60 | 45.04 | C |
| ATOM | 1803 | C | AVAL | D | 18 | 23.728 | 67.369 | −15.412 | 0.60 | 42.17 | C |
| ATOM | 1804 | O | AVAL | D | 18 | 23.622 | 68.572 | −15.150 | 0.60 | 42.21 | O |
| ATOM | 1805 | CB | AVAL | D | 18 | 24.745 | 65.964 | −13.527 | 0.60 | 43.33 | C |
| ATOM | 1806 | CG1 | AVAL | D | 18 | 23.328 | 66.101 | −13.049 | 0.60 | 41.29 | C |
| ATOM | 1807 | CG2 | AVAL | D | 18 | 25.187 | 64.524 | −13.516 | 0.60 | 41.57 | C |
| ATOM | 1808 | N | BVAL | D | 18 | 26.101 | 67.445 | −14.920 | 0.40 | 46.52 | N |
| ATOM | 1809 | CA | BVAL | D | 18 | 24.961 | 66.551 | −15.030 | 0.40 | 45.04 | C |
| ATOM | 1810 | C | BVAL | D | 18 | 23.744 | 67.363 | −15.441 | 0.40 | 42.19 | C |
| ATOM | 1811 | O | BVAL | D | 18 | 23.643 | 68.561 | −15.158 | 0.40 | 42.16 | O |
| ATOM | 1812 | CB | BVAL | D | 18 | 24.729 | 65.769 | −13.718 | 0.40 | 43.17 | C |
| ATOM | 1813 | CG1 | BVAL | D | 18 | 24.057 | 66.644 | −12.663 | 0.40 | 39.96 | C |
| ATOM | 1814 | CG2 | BVAL | D | 18 | 23.942 | 64.530 | −14.005 | 0.40 | 42.54 | C |
| ATOM | 1815 | N | THR | D | 19 | 22.831 | 66.698 | −16.143 | 1.00 | 46.67 | N |
| ATOM | 1816 | CA | THR | D | 19 | 21.594 | 67.285 | −16.650 | 1.00 | 42.21 | C |
| ATOM | 1817 | C | THR | D | 19 | 20.412 | 66.449 | −16.178 | 1.00 | 42.60 | C |
| ATOM | 1818 | O | THR | D | 19 | 20.469 | 65.212 | −16.217 | 1.00 | 40.66 | O |
| ATOM | 1819 | CB | THR | D | 19 | 21.646 | 67.356 | −18.189 | 1.00 | 36.82 | C |
| ATOM | 1820 | OG1 | THR | D | 19 | 21.854 | 68.714 | −18.572 | 1.00 | 49.09 | O |
| ATOM | 1821 | CG2 | THR | D | 19 | 20.396 | 66.796 | −18.859 | 1.00 | 40.02 | C |
| ATOM | 1822 | N | ILE | D | 20 | 19.343 | 67.117 | −15.733 | 1.00 | 35.88 | N |
| ATOM | 1823 | CA | ILE | D | 20 | 18.132 | 66.439 | −15.267 | 1.00 | 33.46 | C |
| ATOM | 1824 | C | ILE | D | 20 | 16.954 | 66.997 | −16.042 | 1.00 | 38.36 | C |
| ATOM | 1825 | O | ILE | D | 20 | 16.680 | 68.200 | −15.976 | 1.00 | 36.03 | O |
| ATOM | 1826 | CB | ILE | D | 20 | 17.907 | 66.602 | −13.753 | 1.00 | 38.27 | C |
| ATOM | 1827 | CG1 | ILE | D | 20 | 19.043 | 65.927 | −12.976 | 1.00 | 32.31 | C |
| ATOM | 1828 | CG2 | ILE | D | 20 | 16.555 | 65.993 | −13.341 | 1.00 | 34.30 | C |
| ATOM | 1829 | CD1 | ILE | D | 20 | 19.010 | 66.199 | −11.490 | 1.00 | 28.88 | C |
| ATOM | 1830 | N | SER | D | 21 | 16.253 | 66.127 | −16.764 | 1.00 | 31.98 | N |
| ATOM | 1831 | CA | SER | D | 21 | 15.188 | 66.575 | −17.643 | 1.00 | 36.18 | C |
| ATOM | 1832 | C | SER | D | 21 | 13.814 | 66.346 | −17.011 | 1.00 | 40.44 | C |

TABLE 10.3-continued

| | | | | | | | | | | |
|---|---|---|---|---|---|---|---|---|---|---|
| ATOM | 1833 | O | SER | D | 21 | 13.639 | 65.541 | −16.094 | 1.00 | 35.10 | O |
| ATOM | 1834 | CB | SER | D | 21 | 15.267 | 65.862 | −18.988 | 1.00 | 35.20 | C |
| ATOM | 1835 | OG | SER | D | 21 | 15.097 | 64.461 | −18.840 | 1.00 | 43.09 | O |
| ATOM | 1836 | N | CYS | D | 22 | 12.829 | 67.052 | −17.552 | 1.00 | 32.32 | N |
| ATOM | 1837 | CA | CYS | D | 22 | 11.476 | 67.044 | −17.012 | 1.00 | 36.57 | C |
| ATOM | 1838 | C | CYS | D | 22 | 10.549 | 67.317 | −18.192 | 1.00 | 36.72 | C |
| ATOM | 1839 | O | CYS | D | 22 | 10.444 | 68.454 | −18.656 | 1.00 | 33.99 | O |
| ATOM | 1840 | CB | CYS | D | 22 | 11.339 | 68.103 | −15.933 | 1.00 | 34.58 | C |
| ATOM | 1841 | SG | CYS | D | 22 | 9.650 | 68.451 | −15.371 | 1.00 | 54.36 | S |
| ATOM | 1842 | N | SER | D | 23 | 9.915 | 66.282 | −18.703 | 1.00 | 34.27 | N |
| ATOM | 1843 | CA | SER | D | 23 | 9.059 | 66.460 | −19.859 | 1.00 | 42.72 | C |
| ATOM | 1844 | C | SER | D | 23 | 7.582 | 66.345 | −19.454 | 1.00 | 41.50 | C |
| ATOM | 1845 | O | SER | D | 23 | 7.209 | 65.545 | −18.582 | 1.00 | 29.92 | O |
| ATOM | 1846 | CB | SER | D | 23 | 9.450 | 65.476 | −20.954 | 1.00 | 34.92 | C |
| ATOM | 1847 | OG | SER | D | 23 | 8.893 | 64.230 | −20.677 | 1.00 | 50.39 | O |
| ATOM | 1848 | N | GLY | D | 24 | 6.765 | 67.218 | −20.037 | 1.00 | 36.33 | N |
| ATOM | 1849 | CA | GLY | D | 24 | 5.336 | 67.237 | −19.809 | 1.00 | 38.73 | C |
| ATOM | 1850 | C | GLY | D | 24 | 4.600 | 67.510 | −21.103 | 1.00 | 39.14 | C |
| ATOM | 1851 | O | GLY | D | 24 | 4.942 | 66.945 | −22.139 | 1.00 | 42.42 | O |
| ATOM | 1852 | N | SER | D | 25 | 3.620 | 68.406 | −21.078 | 1.00 | 36.67 | N |
| ATOM | 1853 | CA | SER | D | 25 | 2.743 | 68.598 | −22.221 | 1.00 | 39.25 | C |
| ATOM | 1854 | C | SER | D | 25 | 2.382 | 70.072 | −22.346 | 1.00 | 38.01 | C |
| ATOM | 1855 | O | SER | D | 25 | 2.754 | 70.902 | −21.506 | 1.00 | 33.82 | O |
| ATOM | 1856 | CB | SER | D | 25 | 1.496 | 67.732 | −22.067 | 1.00 | 41.16 | C |
| ATOM | 1857 | OG | SER | D | 25 | 0.709 | 68.227 | −20.994 | 1.00 | 50.29 | O |
| ATOM | 1858 | N | SER | D | 26 | 1.657 | 70.404 | −23.420 | 1.00 | 31.89 | N |
| ATOM | 1859 | CA | SER | D | 26 | 1.329 | 71.809 | −23.656 | 1.00 | 36.67 | C |
| ATOM | 1860 | C | SER | D | 26 | 0.486 | 72.395 | −22.527 | 1.00 | 38.14 | C |
| ATOM | 1861 | O | SER | D | 26 | 0.548 | 73.600 | −22.271 | 1.00 | 38.11 | O |
| ATOM | 1862 | CB | SER | D | 26 | 0.624 | 71.976 | −25.002 | 1.00 | 31.63 | C |
| ATOM | 1863 | OG | SER | D | 26 | −0.356 | 70.980 | −25.146 | 1.00 | 53.99 | O |
| ATOM | 1864 | N | SER | D | 27 | −0.279 | 71.575 | −21.818 | 1.00 | 33.81 | N |
| ATOM | 1865 | CA | SER | D | 27 | −1.109 | 72.150 | −20.773 | 1.00 | 37.80 | C |
| ATOM | 1866 | C | SER | D | 27 | −0.387 | 72.281 | −19.431 | 1.00 | 40.08 | C |
| ATOM | 1867 | O | SER | D | 27 | −0.954 | 72.862 | −18.498 | 1.00 | 36.37 | O |
| ATOM | 1868 | CB | SER | D | 27 | −2.393 | 71.336 | −20.608 | 1.00 | 31.40 | C |
| ATOM | 1869 | OG | SER | D | 27 | −2.088 | 70.014 | −20.236 | 1.00 | 50.96 | O |
| ATOM | 1870 | N | ASN | D | 28 | 0.839 | 71.765 | −19.295 | 1.00 | 34.89 | N |
| ATOM | 1871 | CA | ASN | D | 28 | 1.555 | 72.073 | −18.068 | 1.00 | 33.57 | C |
| ATOM | 1872 | C | ASN | D | 28 | 2.831 | 72.854 | −18.389 | 1.00 | 34.78 | C |
| ATOM | 1873 | O | ASN | D | 28 | 2.800 | 74.091 | −18.405 | 1.00 | 36.75 | O |
| ATOM | 1874 | CB | ASN | D | 28 | 1.817 | 70.808 | −17.214 | 1.00 | 34.30 | C |
| ATOM | 1875 | CG | ASN | D | 28 | 2.277 | 69.580 | −18.027 | 1.00 | 34.72 | C |
| ATOM | 1876 | OD1 | ASN | D | 28 | 3.345 | 69.568 | −18.641 | 1.00 | 33.73 | O |
| ATOM | 1877 | ND2 | ASN | D | 28 | 1.500 | 68.515 | −17.949 | 1.00 | 35.11 | N |
| ATOM | 1878 | N | ILE | D | 29 | 3.952 | 72.171 | −18.633 | 1.00 | 33.54 | N |
| ATOM | 1879 | CA | ILE | D | 29 | 5.218 | 72.866 | −18.877 | 1.00 | 34.11 | C |
| ATOM | 1880 | C | ILE | D | 29 | 5.107 | 73.810 | −20.072 | 1.00 | 36.11 | C |
| ATOM | 1881 | O | ILE | D | 29 | 5.691 | 74.897 | −20.082 | 1.00 | 33.26 | O |
| ATOM | 1882 | CB | ILE | D | 29 | 6.350 | 71.840 | −19.063 | 1.00 | 33.30 | C |
| ATOM | 1883 | CG1 | ILE | D | 29 | 6.604 | 71.107 | −17.741 | 1.00 | 32.39 | C |
| ATOM | 1884 | CG2 | ILE | D | 29 | 7.621 | 72.520 | −19.555 | 1.00 | 25.88 | C |
| ATOM | 1885 | CD1 | ILE | D | 29 | 7.724 | 70.138 | −17.806 | 1.00 | 36.95 | C |
| ATOM | 1886 | N | GLY | D | 30 | 4.368 | 73.412 | −21.103 | 1.00 | 38.51 | N |
| ATOM | 1887 | CA | GLY | D | 30 | 4.274 | 74.237 | −22.289 | 1.00 | 30.45 | C |
| ATOM | 1888 | C | GLY | D | 30 | 3.608 | 75.580 | −22.062 | 1.00 | 38.50 | C |
| ATOM | 1889 | O | GLY | D | 30 | 3.763 | 76.475 | −22.889 | 1.00 | 40.64 | O |
| ATOM | 1890 | N | ASN | D | 31 | 2.836 | 75.744 | −20.987 | 1.00 | 37.18 | N |
| ATOM | 1891 | CA | ASN | D | 31 | 2.178 | 77.031 | −20.815 | 1.00 | 37.16 | C |
| ATOM | 1892 | C | ASN | D | 31 | 2.192 | 77.595 | −19.395 | 1.00 | 36.18 | C |
| ATOM | 1893 | O | ASN | D | 31 | 1.488 | 78.576 | −19.137 | 1.00 | 42.11 | O |
| ATOM | 1894 | CB | ASN | D | 31 | 0.731 | 76.942 | −21.340 | 1.00 | 41.60 | C |
| ATOM | 1895 | CG | ASN | D | 31 | 0.681 | 77.025 | −22.867 | 1.00 | 53.09 | C |
| ATOM | 1896 | OD1 | ASN | D | 31 | 0.759 | 78.110 | −23.442 | 1.00 | 63.01 | O |
| ATOM | 1897 | ND2 | ASN | D | 31 | 0.591 | 75.877 | −23.525 | 1.00 | 45.20 | N |
| ATOM | 1898 | N | ASN | D | 32 | 2.985 | 77.059 | −18.471 | 1.00 | 38.29 | N |
| ATOM | 1899 | CA | ASN | D | 32 | 3.026 | 77.622 | −17.128 | 1.00 | 35.50 | C |
| ATOM | 1900 | C | ASN | D | 32 | 4.467 | 77.757 | −16.662 | 1.00 | 33.99 | C |
| ATOM | 1901 | O | ASN | D | 32 | 5.394 | 77.247 | −17.291 | 1.00 | 37.19 | O |
| ATOM | 1902 | CB | ASN | D | 32 | 2.192 | 76.787 | −16.158 | 1.00 | 29.83 | C |
| ATOM | 1903 | CG | ASN | D | 32 | 0.731 | 76.754 | −16.548 | 1.00 | 35.04 | C |
| ATOM | 1904 | OD1 | ASN | D | 32 | 0.003 | 77.720 | −16.321 | 1.00 | 41.43 | O |
| ATOM | 1905 | ND2 | ASN | D | 32 | 0.299 | 75.657 | −17.166 | 1.00 | 38.66 | N |
| ATOM | 1906 | N | TYR | D | 33 | 4.647 | 78.497 | −15.572 | 1.00 | 30.88 | N |
| ATOM | 1907 | CA | TYR | D | 33 | 5.973 | 78.725 | −15.020 | 1.00 | 31.61 | C |
| ATOM | 1908 | C | TYR | D | 33 | 6.529 | 77.443 | −14.422 | 1.00 | 39.01 | C |
| ATOM | 1909 | O | TYR | D | 33 | 5.815 | 76.704 | −13.751 | 1.00 | 35.01 | O |
| ATOM | 1910 | CB | TYR | D | 33 | 5.925 | 79.804 | −13.951 | 1.00 | 27.05 | C |
| ATOM | 1911 | CG | TYR | D | 33 | 5.492 | 81.136 | −14.476 | 1.00 | 32.55 | C |
| ATOM | 1912 | CD1 | TYR | D | 33 | 6.214 | 81.780 | −15.478 | 1.00 | 29.14 | C |

TABLE 10.3-continued

| | | | | | | | | | | |
|---|---|---|---|---|---|---|---|---|---|---|
| ATOM | 1913 | CD2 | TYR | D | 33 | 4.358 | 81.770 | −13.965 | 1.00 | 38.90 | C |
| ATOM | 1914 | CE1 | TYR | D | 33 | 5.805 | 83.036 | −15.967 | 1.00 | 36.47 | C |
| ATOM | 1915 | CE2 | TYR | D | 33 | 3.948 | 83.013 | −14.438 | 1.00 | 33.42 | C |
| ATOM | 1916 | CZ | TYR | D | 33 | 4.671 | 83.642 | −15.438 | 1.00 | 37.47 | C |
| ATOM | 1917 | OH | TYR | D | 33 | 4.246 | 84.866 | −15.903 | 1.00 | 36.22 | O |
| ATOM | 1918 | N | VAL | D | 34 | 7.821 | 77.195 | −14.623 | 1.00 | 33.97 | N |
| ATOM | 1919 | CA | VAL | D | 34 | 8.440 | 75.966 | −14.138 | 1.00 | 32.04 | C |
| ATOM | 1920 | C | VAL | D | 34 | 9.272 | 76.250 | −12.896 | 1.00 | 31.06 | C |
| ATOM | 1921 | O | VAL | D | 34 | 9.986 | 77.254 | −12.832 | 1.00 | 32.29 | O |
| ATOM | 1922 | CB | VAL | D | 34 | 9.292 | 75.308 | −15.236 | 1.00 | 33.98 | C |
| ATOM | 1923 | CG1 | VAL | D | 34 | 10.002 | 74.100 | −14.684 | 1.00 | 30.92 | C |
| ATOM | 1924 | CG2 | VAL | D | 34 | 8.407 | 74.884 | −16.397 | 1.00 | 34.56 | C |
| ATOM | 1925 | N | SER | D | 35 | 9.166 | 75.373 | −11.896 | 1.00 | 31.29 | N |
| ATOM | 1926 | CA | SER | D | 35 | 9.991 | 75.425 | −10.697 | 1.00 | 30.60 | C |
| ATOM | 1927 | C | SER | D | 35 | 10.791 | 74.134 | −10.560 | 1.00 | 35.34 | C |
| ATOM | 1928 | O | SER | D | 35 | 10.367 | 73.068 | −11.017 | 1.00 | 31.50 | O |
| ATOM | 1929 | CB | SER | D | 35 | 9.166 | 75.614 | −9.423 | 1.00 | 26.83 | C |
| ATOM | 1930 | OG | SER | D | 35 | 8.548 | 76.889 | −9.407 | 1.00 | 31.37 | O |
| ATOM | 1931 | N | TRP | D | 36 | 11.967 | 74.248 | −9.938 | 1.00 | 31.19 | N |
| ATOM | 1932 | CA | TRP | D | 36 | 12.774 | 73.104 | −9.559 | 1.00 | 30.26 | C |
| ATOM | 1933 | C | TRP | D | 36 | 12.996 | 73.142 | −8.060 | 1.00 | 29.04 | C |
| ATOM | 1934 | O | TRP | D | 36 | 13.286 | 74.196 | −7.491 | 1.00 | 29.53 | O |
| ATOM | 1935 | CB | TRP | D | 36 | 14.112 | 73.084 | −10.274 | 1.00 | 25.90 | C |
| ATOM | 1936 | CG | TRP | D | 36 | 14.009 | 72.705 | −11.713 | 1.00 | 32.87 | C |
| ATOM | 1937 | CD1 | TRP | D | 36 | 13.867 | 73.552 | −12.773 | 1.00 | 33.05 | C |
| ATOM | 1938 | CD2 | TRP | D | 36 | 14.049 | 71.383 | −12.259 | 1.00 | 32.92 | C |
| ATOM | 1939 | NE1 | TRP | D | 36 | 13.812 | 72.835 | −13.947 | 1.00 | 33.23 | N |
| ATOM | 1940 | CE2 | TRP | D | 36 | 13.941 | 71.505 | −13.660 | 1.00 | 29.67 | C |
| ATOM | 1941 | CE3 | TRP | D | 36 | 14.187 | 70.108 | −11.701 | 1.00 | 32.52 | C |
| ATOM | 1942 | CZ2 | TRP | D | 36 | 13.946 | 70.401 | −14.512 | 1.00 | 32.64 | C |
| ATOM | 1943 | CZ3 | TRP | D | 36 | 14.185 | 69.012 | −12.546 | 1.00 | 30.06 | C |
| ATOM | 1944 | CH2 | TRP | D | 36 | 14.058 | 69.166 | −13.936 | 1.00 | 35.04 | C |
| ATOM | 1945 | N | TYR | D | 37 | 12.874 | 71.982 | −7.429 | 1.00 | 31.89 | N |
| ATOM | 1946 | CA | TYR | D | 37 | 13.051 | 71.848 | −5.995 | 1.00 | 29.68 | C |
| ATOM | 1947 | C | TYR | D | 37 | 14.168 | 70.859 | −5.693 | 1.00 | 36.72 | C |
| ATOM | 1948 | O | TYR | D | 37 | 14.324 | 69.839 | −6.383 | 1.00 | 33.31 | O |
| ATOM | 1949 | CB | TYR | D | 37 | 11.735 | 71.417 | −5.343 | 1.00 | 28.40 | C |
| ATOM | 1950 | CG | TYR | D | 37 | 10.598 | 72.378 | −5.659 | 1.00 | 30.46 | C |
| ATOM | 1951 | CD1 | TYR | D | 37 | 10.417 | 73.540 | −4.921 | 1.00 | 27.52 | C |
| ATOM | 1952 | CD2 | TYR | D | 37 | 9.723 | 72.130 | −6.719 | 1.00 | 29.85 | C |
| ATOM | 1953 | CE1 | TYR | D | 37 | 9.368 | 74.423 | −5.219 | 1.00 | 32.37 | C |
| ATOM | 1954 | CE2 | TYR | D | 37 | 8.691 | 72.993 | −7.019 | 1.00 | 27.34 | C |
| ATOM | 1955 | CZ | TYR | D | 37 | 8.517 | 74.137 | −6.271 | 1.00 | 30.55 | C |
| ATOM | 1956 | OH | TYR | D | 37 | 7.495 | 74.995 | −6.595 | 1.00 | 35.11 | O |
| ATOM | 1957 | N | GLN | D | 38 | 14.938 | 71.174 | −4.653 | 1.00 | 32.56 | N |
| ATOM | 1958 | CA | GLN | D | 38 | 16.019 | 70.332 | −4.174 | 1.00 | 30.13 | C |
| ATOM | 1959 | C | GLN | D | 38 | 15.690 | 69.837 | −2.770 | 1.00 | 33.68 | C |
| ATOM | 1960 | O | GLN | D | 38 | 15.362 | 70.635 | −1.880 | 1.00 | 31.93 | O |
| ATOM | 1961 | CB | GLN | D | 38 | 17.349 | 71.102 | −4.170 | 1.00 | 30.01 | C |
| ATOM | 1962 | CG | GLN | D | 38 | 18.527 | 70.323 | −3.564 | 1.00 | 28.04 | C |
| ATOM | 1963 | CD | GLN | D | 38 | 19.729 | 71.214 | −3.280 | 1.00 | 34.96 | C |
| ATOM | 1964 | OE1 | GLN | D | 38 | 19.664 | 72.147 | −2.473 | 1.00 | 32.51 | O |
| ATOM | 1965 | NE2 | GLN | D | 38 | 20.828 | 70.944 | −3.971 | 1.00 | 33.81 | N |
| ATOM | 1966 | N | GLN | D | 39 | 15.790 | 68.528 | −2.572 | 1.00 | 32.31 | N |
| ATOM | 1967 | CA | GLN | D | 39 | 15.552 | 67.918 | −1.266 | 1.00 | 38.47 | C |
| ATOM | 1968 | C | GLN | D | 39 | 16.805 | 67.162 | −0.843 | 1.00 | 33.22 | C |
| ATOM | 1969 | O | GLN | D | 39 | 17.057 | 66.051 | −1.324 | 1.00 | 33.95 | O |
| ATOM | 1970 | CB | GLN | D | 39 | 14.336 | 67.001 | −1.294 | 1.00 | 32.82 | C |
| ATOM | 1971 | CG | GLN | D | 39 | 13.941 | 66.543 | 0.090 | 1.00 | 38.29 | C |
| ATOM | 1972 | CD | GLN | D | 39 | 12.621 | 65.809 | 0.118 | 1.00 | 34.34 | C |
| ATOM | 1973 | OE1 | GLN | D | 39 | 12.221 | 65.165 | −0.862 | 1.00 | 38.36 | O |
| ATOM | 1974 | NE2 | GLN | D | 39 | 11.909 | 65.942 | 1.236 | 1.00 | 30.94 | N |
| ATOM | 1975 | N | LEU | D | 40 | 17.612 | 67.779 | 0.023 | 1.00 | 37.41 | N |
| ATOM | 1976 | CA | LEU | D | 40 | 18.766 | 67.069 | 0.571 | 1.00 | 41.50 | C |
| ATOM | 1977 | C | LEU | D | 40 | 18.281 | 65.913 | 1.450 | 1.00 | 44.75 | C |
| ATOM | 1978 | O | LEU | D | 40 | 17.202 | 65.988 | 2.051 | 1.00 | 39.49 | O |
| ATOM | 1979 | CB | LEU | D | 40 | 19.659 | 68.020 | 1.368 | 1.00 | 41.85 | C |
| ATOM | 1980 | CG | LEU | D | 40 | 20.144 | 69.262 | 0.592 | 1.00 | 42.10 | C |
| ATOM | 1981 | CD1 | LEU | D | 40 | 20.614 | 70.363 | 1.515 | 1.00 | 38.12 | C |
| ATOM | 1982 | CD2 | LEU | D | 40 | 21.236 | 68.903 | −0.380 | 1.00 | 31.04 | C |
| ATOM | 1983 | N | PRO | D | 41 | 19.045 | 64.827 | 1.520 | 1.00 | 47.88 | N |
| ATOM | 1984 | CA | PRO | D | 41 | 18.568 | 63.625 | 2.225 | 1.00 | 42.38 | C |
| ATOM | 1985 | C | PRO | D | 41 | 18.152 | 63.935 | 3.656 | 1.00 | 45.34 | C |
| ATOM | 1986 | O | PRO | D | 41 | 18.876 | 64.603 | 4.404 | 1.00 | 46.53 | O |
| ATOM | 1987 | CB | PRO | D | 41 | 19.780 | 62.691 | 2.182 | 1.00 | 43.44 | C |
| ATOM | 1988 | CG | PRO | D | 41 | 20.639 | 63.217 | 1.062 | 1.00 | 46.87 | C |
| ATOM | 1989 | CD | PRO | D | 41 | 20.427 | 64.690 | 1.030 | 1.00 | 42.00 | C |
| ATOM | 1990 | N | GLY | D | 42 | 16.963 | 63.459 | 4.029 | 1.00 | 38.47 | N |
| ATOM | 1991 | CA | GLY | D | 42 | 16.400 | 63.729 | 5.346 | 1.00 | 39.47 | C |
| ATOM | 1992 | C | GLY | D | 42 | 15.980 | 65.164 | 5.648 | 1.00 | 51.21 | C |

TABLE 10.3-continued

| | | | | | | | | | | |
|---|---|---|---|---|---|---|---|---|---|---|
| ATOM | 1993 | O | GLY | D | 42 | 15.801 | 65.501 | 6.822 | 1.00 | 48.36 | O |
| ATOM | 1994 | N | THR | D | 43 | 15.793 | 66.022 | 4.642 | 1.00 | 44.85 | N |
| ATOM | 1995 | CA | THR | D | 43 | 15.393 | 67.415 | 4.867 | 1.00 | 47.53 | C |
| ATOM | 1996 | C | THR | D | 43 | 14.123 | 67.747 | 4.090 | 1.00 | 39.84 | C |
| ATOM | 1997 | O | THR | D | 43 | 13.599 | 66.944 | 3.315 | 1.00 | 42.92 | O |
| ATOM | 1998 | CB | THR | D | 43 | 16.503 | 68.414 | 4.475 | 1.00 | 45.75 | C |
| ATOM | 1999 | OG1 | THR | D | 43 | 16.602 | 68.488 | 3.045 | 1.00 | 36.10 | O |
| ATOM | 2000 | CG2 | THR | D | 43 | 17.857 | 67.992 | 5.056 | 1.00 | 41.52 | C |
| ATOM | 2001 | N | ALA | D | 44 | 13.619 | 68.952 | 4.318 | 1.00 | 38.36 | N |
| ATOM | 2002 | CA | ALA | D | 44 | 12.484 | 69.426 | 3.553 | 1.00 | 38.31 | C |
| ATOM | 2003 | C | ALA | D | 44 | 12.916 | 69.799 | 2.137 | 1.00 | 39.83 | C |
| ATOM | 2004 | O | ALA | D | 44 | 14.100 | 70.032 | 1.878 | 1.00 | 37.35 | O |
| ATOM | 2005 | CB | ALA | D | 44 | 11.849 | 70.632 | 4.238 | 1.00 | 38.73 | C |
| ATOM | 2006 | N | PRO | D | 45 | 11.977 | 69.838 | 1.194 | 1.00 | 36.33 | N |
| ATOM | 2007 | CA | PRO | D | 45 | 12.277 | 70.462 | −0.097 | 1.00 | 35.97 | C |
| ATOM | 2008 | C | PRO | D | 45 | 12.678 | 71.911 | 0.121 | 1.00 | 33.44 | C |
| ATOM | 2009 | O | PRO | D | 45 | 12.384 | 72.519 | 1.155 | 1.00 | 33.83 | O |
| ATOM | 2010 | CB | PRO | D | 45 | 10.948 | 70.365 | −0.872 | 1.00 | 28.82 | C |
| ATOM | 2011 | CG | PRO | D | 45 | 10.265 | 69.198 | −0.245 | 1.00 | 36.55 | C |
| ATOM | 2012 | CD | PRO | D | 45 | 10.615 | 69.281 | 1.225 | 1.00 | 34.97 | C |
| ATOM | 2013 | N | LYS | D | 46 | 13.362 | 72.460 | −0.880 | 1.00 | 39.06 | N |
| ATOM | 2014 | CA | LYS | D | 46 | 13.782 | 73.855 | −0.903 | 1.00 | 35.89 | C |
| ATOM | 2015 | C | LYS | D | 46 | 13.682 | 74.312 | −2.350 | 1.00 | 36.30 | C |
| ATOM | 2016 | O | LYS | D | 46 | 13.953 | 73.521 | −3.262 | 1.00 | 37.16 | O |
| ATOM | 2017 | CB | LYS | D | 46 | 15.212 | 73.986 | −0.348 | 1.00 | 36.94 | C |
| ATOM | 2018 | CG | LYS | D | 46 | 15.919 | 75.292 | −0.569 | 1.00 | 43.26 | C |
| ATOM | 2019 | CD | LYS | D | 46 | 17.430 | 75.058 | −0.548 | 1.00 | 46.21 | C |
| ATOM | 2020 | CE | LYS | D | 46 | 18.178 | 76.121 | 0.262 | 1.00 | 53.10 | C |
| ATOM | 2021 | NZ | LYS | D | 46 | 19.663 | 75.960 | 0.110 | 1.00 | 59.22 | N1+ |
| ATOM | 2022 | N | LEU | D | 47 | 13.270 | 75.565 | −2.569 | 1.00 | 31.33 | N |
| ATOM | 2023 | CA | LEU | D | 47 | 13.200 | 76.086 | −3.931 | 1.00 | 31.83 | C |
| ATOM | 2024 | C | LEU | D | 47 | 14.601 | 76.299 | −4.513 | 1.00 | 35.29 | C |
| ATOM | 2025 | O | LEU | D | 47 | 15.454 | 76.963 | −3.911 | 1.00 | 33.02 | O |
| ATOM | 2026 | CB | LEU | D | 47 | 12.417 | 77.388 | −3.962 | 1.00 | 26.35 | C |
| ATOM | 2027 | CG | LEU | D | 47 | 12.230 | 78.066 | −5.326 | 1.00 | 35.90 | C |
| ATOM | 2028 | CD1 | LEU | D | 47 | 11.484 | 77.183 | −6.337 | 1.00 | 30.55 | C |
| ATOM | 2029 | CD2 | LEU | D | 47 | 11.508 | 79.411 | −5.153 | 1.00 | 30.96 | C |
| ATOM | 2030 | N | LEU | D | 48 | 14.837 | 75.725 | −5.687 | 1.00 | 34.87 | N |
| ATOM | 2031 | CA | LEU | D | 48 | 16.123 | 75.799 | −6.374 | 1.00 | 37.46 | C |
| ATOM | 2032 | C | LEU | D | 48 | 16.107 | 76.811 | −7.513 | 1.00 | 33.53 | C |
| ATOM | 2033 | O | LEU | D | 48 | 17.043 | 77.600 | −7.660 | 1.00 | 38.96 | O |
| ATOM | 2034 | CB | LEU | D | 48 | 16.516 | 74.416 | −6.926 | 1.00 | 27.18 | C |
| ATOM | 2035 | CG | LEU | D | 48 | 17.944 | 74.289 | −7.452 | 1.00 | 28.56 | C |
| ATOM | 2036 | CD1 | LEU | D | 48 | 18.892 | 74.353 | −6.289 | 1.00 | 32.28 | C |
| ATOM | 2037 | CD2 | LEU | D | 48 | 18.153 | 72.987 | −8.196 | 1.00 | 32.35 | C |
| ATOM | 2038 | N | LEU | D | 49 | 15.063 | 76.766 | −8.334 | 1.00 | 29.89 | N |
| ATOM | 2039 | CA | LEU | D | 49 | 14.871 | 77.609 | −9.500 | 1.00 | 31.38 | C |
| ATOM | 2040 | C | LEU | D | 49 | 13.383 | 77.885 | −9.629 | 1.00 | 35.27 | C |
| ATOM | 2041 | O | LEU | D | 49 | 12.563 | 76.964 | −9.504 | 1.00 | 32.72 | O |
| ATOM | 2042 | CB | LEU | D | 49 | 15.360 | 76.932 | −10.789 | 1.00 | 28.28 | C |
| ATOM | 2043 | CG | LEU | D | 49 | 16.848 | 76.621 | −10.937 | 1.00 | 40.25 | C |
| ATOM | 2044 | CD1 | LEU | D | 49 | 17.100 | 75.739 | −12.173 | 1.00 | 34.47 | C |
| ATOM | 2045 | CD2 | LEU | D | 49 | 17.642 | 77.943 | −10.996 | 1.00 | 32.52 | C |
| ATOM | 2046 | N | TYR | D | 50 | 13.031 | 79.136 | −9.909 | 1.00 | 28.76 | N |
| ATOM | 2047 | CA | TYR | D | 50 | 11.656 | 79.423 | −10.287 | 1.00 | 31.24 | C |
| ATOM | 2048 | C | TYR | D | 50 | 11.659 | 80.149 | −11.622 | 1.00 | 31.13 | C |
| ATOM | 2049 | O | TYR | D | 50 | 12.697 | 80.634 | −12.077 | 1.00 | 32.85 | O |
| ATOM | 2050 | CB | TYR | D | 50 | 10.923 | 80.211 | −9.196 | 1.00 | 30.09 | C |
| ATOM | 2051 | CG | TYR | D | 50 | 11.519 | 81.554 | −8.869 | 1.00 | 27.45 | C |
| ATOM | 2052 | CD1 | TYR | D | 50 | 12.726 | 81.672 | −8.163 | 1.00 | 31.73 | C |
| ATOM | 2053 | CD2 | TYR | D | 50 | 10.859 | 82.708 | −9.238 | 1.00 | 29.79 | C |
| ATOM | 2054 | CE1 | TYR | D | 50 | 13.253 | 82.920 | −7.843 | 1.00 | 34.25 | C |
| ATOM | 2055 | CE2 | TYR | D | 50 | 11.366 | 83.964 | −8.921 | 1.00 | 36.09 | C |
| ATOM | 2056 | CZ | TYR | D | 50 | 12.546 | 84.072 | −8.229 | 1.00 | 36.80 | C |
| ATOM | 2057 | OH | TYR | D | 50 | 12.995 | 85.340 | −7.954 | 1.00 | 34.65 | O |
| ATOM | 2058 | N | ASP | D | 51 | 10.487 | 80.198 | −12.260 | 1.00 | 33.46 | N |
| ATOM | 2059 | CA | ASP | D | 51 | 10.371 | 80.678 | −13.638 | 1.00 | 34.13 | C |
| ATOM | 2060 | C | ASP | D | 51 | 11.474 | 80.078 | −14.517 | 1.00 | 35.70 | C |
| ATOM | 2061 | O | ASP | D | 51 | 12.269 | 80.788 | −15.139 | 1.00 | 32.50 | O |
| ATOM | 2062 | CB | ASP | D | 51 | 10.410 | 82.199 | −13.683 | 1.00 | 33.19 | C |
| ATOM | 2063 | CG | ASP | D | 51 | 10.091 | 82.738 | −15.053 | 1.00 | 36.53 | C |
| ATOM | 2064 | OD1 | ASP | D | 51 | 9.413 | 82.007 | −15.813 | 1.00 | 37.05 | O |
| ATOM | 2065 | OD2 | ASP | D | 51 | 10.507 | 83.882 | −15.361 | 1.00 | 36.34 | O1− |
| ATOM | 2066 | N | SER | D | 52 | 11.565 | 78.745 | −14.494 | 1.00 | 35.41 | N |
| ATOM | 2067 | CA | SER | D | 52 | 12.525 | 77.980 | −15.295 | 1.00 | 35.10 | C |
| ATOM | 2068 | C | SER | D | 52 | 13.986 | 78.153 | −14.884 | 1.00 | 34.26 | C |
| ATOM | 2069 | O | SER | D | 52 | 14.730 | 77.167 | −14.836 | 1.00 | 34.09 | O |
| ATOM | 2070 | CB | SER | D | 52 | 12.393 | 78.333 | −16.779 | 1.00 | 29.40 | C |
| ATOM | 2071 | OG | SER | D | 52 | 11.152 | 77.892 | −17.275 | 1.00 | 42.15 | O |
| ATOM | 2072 | N | ASN | D | 53 | 14.437 | 79.386 | −14.628 | 1.00 | 32.85 | N |

TABLE 10.3-continued

| | | | | | | | | | | |
|---|---|---|---|---|---|---|---|---|---|---|
| ATOM | 2073 | CA | ASN | D | 53 | 15.878 | 79.558 | −14.463 | 1.00 | 32.56 | C |
| ATOM | 2074 | C | ASN | D | 53 | 16.290 | 80.660 | −13.495 | 1.00 | 34.70 | C |
| ATOM | 2075 | O | ASN | D | 53 | 17.467 | 81.027 | −13.485 | 1.00 | 34.38 | O |
| ATOM | 2076 | CB | ASN | D | 53 | 16.536 | 79.814 | −15.804 | 1.00 | 29.46 | C |
| ATOM | 2077 | CG | ASN | D | 53 | 16.066 | 81.113 | −16.443 | 1.00 | 40.20 | C |
| ATOM | 2078 | OD1 | ASN | D | 53 | 15.192 | 81.817 | −15.918 | 1.00 | 32.59 | O |
| ATOM | 2079 | ND2 | ASN | D | 53 | 16.652 | 81.440 | −17.583 | 1.00 | 37.64 | N |
| ATOM | 2080 | N | LYS | D | 54 | 15.391 | 81.191 | −12.677 | 1.00 | 36.81 | N |
| ATOM | 2081 | CA | LYS | D | 54 | 15.761 | 82.209 | −11.713 | 1.00 | 29.79 | C |
| ATOM | 2082 | C | LYS | D | 54 | 16.163 | 81.540 | −10.408 | 1.00 | 35.07 | C |
| ATOM | 2083 | O | LYS | D | 54 | 15.433 | 80.686 | −9.887 | 1.00 | 34.40 | O |
| ATOM | 2084 | CB | LYS | D | 54 | 14.601 | 83.166 | −11.469 | 1.00 | 34.19 | C |
| ATOM | 2085 | CG | LYS | D | 54 | 14.979 | 84.334 | −10.607 | 1.00 | 39.09 | C |
| ATOM | 2086 | CD | LYS | D | 54 | 15.984 | 85.215 | −11.319 | 1.00 | 36.81 | C |
| ATOM | 2087 | CE | LYS | D | 54 | 16.480 | 86.282 | −10.370 | 1.00 | 39.74 | C |
| ATOM | 2088 | NZ | LYS | D | 54 | 17.279 | 87.308 | −11.098 | 1.00 | 49.26 | N1+ |
| ATOM | 2089 | N | ARG | D | 55 | 17.318 | 81.924 | −9.890 | 1.00 | 38.57 | N |
| ATOM | 2090 | C | ARG | D | 55 | 17.333 | 82.285 | −7.476 | 1.00 | 39.73 | C |
| ATOM | 2091 | O | ARG | D | 55 | 17.511 | 83.503 | −7.533 | 1.00 | 41.35 | O |
| ATOM | 2092 | CA | AARG | D | 55 | 17.814 | 81.402 | −8.621 | 0.50 | 38.68 | C |
| ATOM | 2093 | CB | AARG | D | 55 | 19.341 | 81.344 | −8.605 | 0.50 | 37.77 | C |
| ATOM | 2094 | CG | AARG | D | 55 | 19.958 | 80.202 | −9.404 | 0.50 | 40.11 | C |
| ATOM | 2095 | CD | AARG | D | 55 | 21.494 | 80.251 | −9.387 | 0.50 | 40.35 | C |
| ATOM | 2096 | NE | AARG | D | 55 | 22.017 | 81.378 | −10.159 | 0.50 | 39.90 | N |
| ATOM | 2097 | CZ | AARG | D | 55 | 22.738 | 82.377 | −9.659 | 0.50 | 39.21 | C |
| ATOM | 2098 | NH1 | AARG | D | 55 | 23.141 | 83.349 | −10.459 | 0.50 | 39.24 | N1+ |
| ATOM | 2099 | NH2 | AARG | D | 55 | 23.060 | 82.406 | −8.369 | 0.50 | 34.82 | N |
| ATOM | 2100 | CA | BARG | D | 55 | 17.803 | 81.399 | −8.621 | 0.50 | 38.68 | C |
| ATOM | 2101 | CB | BARG | D | 55 | 19.324 | 81.321 | −8.607 | 0.50 | 37.74 | C |
| ATOM | 2102 | CG | BARG | D | 55 | 19.902 | 80.435 | −9.684 | 0.50 | 40.11 | C |
| ATOM | 2103 | CD | BARG | D | 55 | 21.390 | 80.690 | −9.875 | 0.50 | 41.27 | C |
| ATOM | 2104 | NE | BARG | D | 55 | 21.881 | 80.029 | −11.080 | 0.50 | 44.29 | N |
| ATOM | 2105 | CZ | BARG | D | 55 | 21.979 | 80.606 | −12.275 | 0.50 | 41.10 | C |
| ATOM | 2106 | NH1 | BARG | D | 55 | 21.632 | 81.878 | −12.448 | 0.50 | 43.98 | N1+ |
| ATOM | 2107 | NH2 | BARG | D | 55 | 22.436 | 79.903 | −13.299 | 0.50 | 37.99 | N |
| ATOM | 2108 | N | PRO | D | 56 | 16.709 | 81.722 | −6.444 | 1.00 | 42.43 | N |
| ATOM | 2109 | CA | PRO | D | 56 | 16.550 | 82.476 | −5.202 | 1.00 | 39.14 | C |
| ATOM | 2110 | C | PRO | D | 56 | 17.937 | 82.781 | −4.673 | 1.00 | 39.14 | C |
| ATOM | 2111 | O | PRO | D | 56 | 18.921 | 82.132 | −5.037 | 1.00 | 39.24 | O |
| ATOM | 2112 | CB | PRO | D | 56 | 15.800 | 81.513 | −4.264 | 1.00 | 40.40 | C |
| ATOM | 2113 | CG | PRO | D | 56 | 15.350 | 80.384 | −5.079 | 1.00 | 36.67 | C |
| ATOM | 2114 | CD | PRO | D | 56 | 16.195 | 80.347 | −6.344 | 1.00 | 38.20 | C |
| ATOM | 2115 | N | SER | D | 57 | 18.025 | 83.787 | −3.819 | 1.00 | 38.52 | N |
| ATOM | 2116 | CA | SER | D | 57 | 19.326 | 84.087 | −3.245 | 1.00 | 45.88 | C |
| ATOM | 2117 | C | SER | D | 57 | 19.760 | 82.911 | −2.381 | 1.00 | 44.76 | C |
| ATOM | 2118 | O | SER | D | 57 | 18.928 | 82.206 | −1.807 | 1.00 | 46.46 | O |
| ATOM | 2119 | CB | SER | D | 57 | 19.282 | 85.384 | −2.441 | 1.00 | 45.60 | C |
| ATOM | 2120 | OG | SER | D | 57 | 18.126 | 85.430 | −1.652 | 1.00 | 61.35 | O |
| ATOM | 2121 | N | GLY | D | 58 | 21.056 | 82.630 | −2.375 | 1.00 | 45.80 | N |
| ATOM | 2122 | CA | GLY | D | 58 | 21.558 | 81.468 | −1.677 | 1.00 | 38.95 | C |
| ATOM | 2123 | C | GLY | D | 58 | 21.780 | 80.253 | −2.549 | 1.00 | 45.79 | C |
| ATOM | 2124 | O | GLY | D | 58 | 22.406 | 79.290 | −2.093 | 1.00 | 50.05 | O |
| ATOM | 2125 | N | ILE | D | 59 | 21.280 | 80.246 | −3.777 | 1.00 | 44.59 | N |
| ATOM | 2126 | CA | ILE | D | 59 | 21.479 | 79.123 | −4.684 | 1.00 | 37.66 | C |
| ATOM | 2127 | C | ILE | D | 59 | 22.682 | 79.446 | −5.571 | 1.00 | 42.15 | C |
| ATOM | 2128 | O | ILE | D | 59 | 22.645 | 80.454 | −6.294 | 1.00 | 41.34 | O |
| ATOM | 2129 | CB | ILE | D | 59 | 20.232 | 78.831 | −5.528 | 1.00 | 40.49 | C |
| ATOM | 2130 | CG1 | ILE | D | 59 | 19.045 | 78.500 | −4.616 | 1.00 | 37.44 | C |
| ATOM | 2131 | CG2 | ILE | D | 59 | 20.527 | 77.690 | −6.542 | 1.00 | 36.08 | C |
| ATOM | 2132 | CD1 | ILE | D | 59 | 19.273 | 77.277 | −3.723 | 1.00 | 34.90 | C |
| ATOM | 2133 | N | PRO | D | 60 | 23.724 | 78.612 | −5.571 | 1.00 | 38.05 | N |
| ATOM | 2134 | CA | PRO | D | 60 | 24.938 | 78.914 | −6.342 | 1.00 | 42.90 | C |
| ATOM | 2135 | C | PRO | D | 60 | 24.666 | 78.936 | −7.835 | 1.00 | 40.36 | C |
| ATOM | 2136 | O | PRO | D | 60 | 23.778 | 78.245 | −8.333 | 1.00 | 40.44 | O |
| ATOM | 2137 | CB | PRO | D | 60 | 25.888 | 77.754 | −5.990 | 1.00 | 43.52 | C |
| ATOM | 2138 | CG | PRO | D | 60 | 25.222 | 76.963 | −4.934 | 1.00 | 44.09 | C |
| ATOM | 2139 | CD | PRO | D | 60 | 23.756 | 77.268 | −4.984 | 1.00 | 41.65 | C |
| ATOM | 2140 | N | ALA | D | 61 | 25.495 | 79.695 | −8.557 | 1.00 | 38.15 | N |
| ATOM | 2141 | CA | ALA | D | 61 | 25.351 | 79.835 | −10.003 | 1.00 | 46.92 | C |
| ATOM | 2142 | C | ALA | D | 61 | 25.639 | 78.546 | −10.780 | 1.00 | 41.95 | C |
| ATOM | 2143 | O | ALA | D | 61 | 25.376 | 78.501 | −11.990 | 1.00 | 41.08 | O |
| ATOM | 2144 | CB | ALA | D | 61 | 26.268 | 80.955 | −10.507 | 1.00 | 37.90 | C |
| ATOM | 2145 | N | ARG | D | 62 | 26.167 | 77.501 | −10.144 | 1.00 | 40.02 | N |
| ATOM | 2146 | CA | ARG | D | 62 | 26.364 | 76.277 | −10.909 | 1.00 | 39.12 | C |
| ATOM | 2147 | C | ARG | D | 62 | 25.061 | 75.511 | −11.136 | 1.00 | 41.84 | C |
| ATOM | 2148 | O | ARG | D | 62 | 25.060 | 74.529 | −11.894 | 1.00 | 38.44 | O |
| ATOM | 2149 | CB | ARG | D | 62 | 27.411 | 75.384 | −10.240 | 1.00 | 40.13 | C |
| ATOM | 2150 | CG | ARG | D | 62 | 27.061 | 74.940 | −8.830 | 1.00 | 51.16 | C |
| ATOM | 2151 | CD | ARG | D | 62 | 28.110 | 73.962 | −8.276 | 1.00 | 54.07 | C |
| ATOM | 2152 | NE | ARG | D | 62 | 27.617 | 73.327 | −7.065 | 1.00 | 42.44 | N |

TABLE 10.3-continued

| | | | | | | | | | | |
|---|---|---|---|---|---|---|---|---|---|---|
| ATOM | 2153 | CZ | ARG | D | 62 | 27.632 | 73.937 | −5.888 | 1.00 | 48.82 | C |
| ATOM | 2154 | NH1 | ARG | D | 62 | 28.139 | 75.165 | −5.790 | 1.00 | 55.75 | N1+ |
| ATOM | 2155 | NH2 | ARG | D | 62 | 27.145 | 73.336 | −4.819 | 1.00 | 44.87 | N |
| ATOM | 2156 | N | PHE | D | 63 | 23.959 | 75.946 | −10.518 | 1.00 | 35.81 | N |
| ATOM | 2157 | CA | PHE | D | 63 | 22.630 | 75.461 | −10.857 | 1.00 | 36.89 | C |
| ATOM | 2158 | C | PHE | D | 63 | 22.032 | 76.381 | −11.914 | 1.00 | 41.20 | C |
| ATOM | 2159 | O | PHE | D | 63 | 22.021 | 77.610 | −11.749 | 1.00 | 39.30 | O |
| ATOM | 2160 | CB | PHE | D | 63 | 21.724 | 75.420 | −9.622 | 1.00 | 36.15 | C |
| ATOM | 2161 | CG | PHE | D | 63 | 22.177 | 74.455 | −8.550 | 1.00 | 35.88 | C |
| ATOM | 2162 | CD1 | PHE | D | 63 | 23.020 | 74.870 | −7.539 | 1.00 | 36.00 | C |
| ATOM | 2163 | CD2 | PHE | D | 63 | 21.747 | 73.132 | −8.556 | 1.00 | 38.64 | C |
| ATOM | 2164 | CE1 | PHE | D | 63 | 23.443 | 73.983 | −6.550 | 1.00 | 43.00 | C |
| ATOM | 2165 | CE2 | PHE | D | 63 | 22.165 | 72.239 | −7.572 | 1.00 | 37.52 | C |
| ATOM | 2166 | CZ | PHE | D | 63 | 23.013 | 72.664 | −6.565 | 1.00 | 36.44 | C |
| ATOM | 2167 | N | SER | D | 64 | 21.548 | 75.795 | −13.005 | 1.00 | 35.81 | N |
| ATOM | 2168 | CA | SER | D | 64 | 20.854 | 76.595 | −14.008 | 1.00 | 37.12 | C |
| ATOM | 2169 | C | SER | D | 64 | 19.753 | 75.760 | −14.648 | 1.00 | 38.07 | C |
| ATOM | 2170 | O | SER | D | 64 | 19.691 | 74.529 | −14.505 | 1.00 | 38.30 | O |
| ATOM | 2171 | CB | SER | D | 64 | 21.812 | 77.151 | −15.076 | 1.00 | 31.57 | C |
| ATOM | 2172 | OG | SER | D | 64 | 22.505 | 76.104 | −15.730 | 1.00 | 44.67 | O |
| ATOM | 2173 | N | GLY | D | 65 | 18.868 | 76.454 | −15.349 | 1.00 | 34.85 | N |
| ATOM | 2174 | CA | GLY | D | 65 | 17.712 | 75.817 | −15.927 | 1.00 | 38.26 | C |
| ATOM | 2175 | C | GLY | D | 65 | 17.422 | 76.371 | −17.302 | 1.00 | 40.50 | C |
| ATOM | 2176 | O | GLY | D | 65 | 17.829 | 77.479 | −17.661 | 1.00 | 39.25 | O |
| ATOM | 2177 | N | SER | D | 66 | 16.706 | 75.570 | −18.071 | 1.00 | 33.85 | N |
| ATOM | 2178 | CA | SER | D | 66 | 16.204 | 76.050 | −19.344 | 1.00 | 35.96 | C |
| ATOM | 2179 | C | SER | D | 66 | 14.865 | 75.386 | −19.584 | 1.00 | 39.56 | C |
| ATOM | 2180 | O | SER | D | 66 | 14.493 | 74.412 | −18.914 | 1.00 | 36.55 | O |
| ATOM | 2181 | CB | SER | D | 66 | 17.164 | 75.765 | −20.490 | 1.00 | 36.16 | C |
| ATOM | 2182 | OG | SER | D | 66 | 17.463 | 74.379 | −20.517 | 1.00 | 43.70 | O |
| ATOM | 2183 | N | LYS | D | 67 | 14.132 | 75.959 | −20.522 | 1.00 | 31.53 | N |
| ATOM | 2184 | CA | LYS | D | 67 | 12.820 | 75.482 | −20.896 | 1.00 | 33.07 | C |
| ATOM | 2185 | C | LYS | D | 67 | 12.746 | 75.549 | −22.407 | 1.00 | 38.33 | C |
| ATOM | 2186 | O | LYS | D | 67 | 13.238 | 76.494 | −23.014 | 1.00 | 43.23 | O |
| ATOM | 2187 | CB | LYS | D | 67 | 11.690 | 76.313 | −20.249 | 1.00 | 32.47 | C |
| ATOM | 2188 | CG | LYS | D | 67 | 10.269 | 75.914 | −20.705 | 1.00 | 28.80 | C |
| ATOM | 2189 | CD | LYS | D | 67 | 9.194 | 76.736 | −20.001 | 1.00 | 35.59 | C |
| ATOM | 2190 | CE | LYS | D | 67 | 7.890 | 76.733 | −20.788 | 1.00 | 45.34 | C |
| ATOM | 2191 | NZ | LYS | D | 67 | 6.693 | 77.312 | −20.018 | 1.00 | 45.74 | N1+ |
| ATOM | 2192 | N | SER | D | 68 | 12.175 | 74.523 | −23.008 | 1.00 | 40.72 | N |
| ATOM | 2193 | CA | SER | D | 68 | 11.983 | 74.502 | −24.446 | 1.00 | 40.77 | C |
| ATOM | 2194 | C | SER | D | 68 | 10.705 | 73.722 | −24.702 | 1.00 | 40.33 | C |
| ATOM | 2195 | O | SER | D | 68 | 10.665 | 72.518 | −24.439 | 1.00 | 41.36 | O |
| ATOM | 2196 | CB | SER | D | 68 | 13.179 | 73.866 | −25.139 | 1.00 | 44.26 | C |
| ATOM | 2197 | OG | SER | D | 68 | 12.935 | 73.761 | −26.526 | 1.00 | 55.67 | O |
| ATOM | 2198 | N | GLY | D | 69 | 9.655 | 74.408 | −25.145 | 1.00 | 37.35 | N |
| ATOM | 2199 | CA | GLY | D | 69 | 8.413 | 73.715 | −25.466 | 1.00 | 34.14 | C |
| ATOM | 2200 | C | GLY | D | 69 | 7.800 | 73.055 | −24.242 | 1.00 | 37.93 | C |
| ATOM | 2201 | O | GLY | D | 69 | 7.543 | 73.700 | −23.220 | 1.00 | 34.02 | O |
| ATOM | 2202 | N | THR | D | 70 | 7.592 | 71.738 | −24.310 | 1.00 | 38.48 | N |
| ATOM | 2203 | CA | THR | D | 70 | 6.956 | 71.011 | −23.219 | 1.00 | 38.13 | C |
| ATOM | 2204 | C | THR | D | 70 | 7.967 | 70.318 | −22.304 | 1.00 | 39.79 | C |
| ATOM | 2205 | O | THR | D | 70 | 7.590 | 69.416 | −21.549 | 1.00 | 40.93 | O |
| ATOM | 2206 | CB | THR | D | 70 | 5.968 | 69.982 | −23.771 | 1.00 | 37.94 | C |
| ATOM | 2207 | OG1 | THR | D | 70 | 6.672 | 69.053 | −24.608 | 1.00 | 38.51 | O |
| ATOM | 2208 | CG2 | THR | D | 70 | 4.899 | 70.665 | −24.571 | 1.00 | 27.17 | C |
| ATOM | 2209 | N | SER | D | 71 | 9.240 | 70.702 | −22.357 | 1.00 | 32.96 | N |
| ATOM | 2210 | CA | SER | D | 71 | 10.202 | 70.129 | −21.431 | 1.00 | 40.52 | C |
| ATOM | 2211 | C | SER | D | 71 | 11.091 | 71.219 | −20.853 | 1.00 | 36.32 | C |
| ATOM | 2212 | O | SER | D | 71 | 11.231 | 72.312 | −21.411 | 1.00 | 44.52 | O |
| ATOM | 2213 | CB | SER | D | 71 | 11.049 | 69.031 | −22.089 | 1.00 | 48.49 | C |
| ATOM | 2214 | OG | SER | D | 71 | 11.991 | 69.599 | −22.976 | 1.00 | 58.32 | O |
| ATOM | 2215 | N | ALA | D | 72 | 11.645 | 70.915 | −19.686 | 1.00 | 31.74 | N |
| ATOM | 2216 | CA | ALA | D | 72 | 12.519 | 71.800 | −18.942 | 1.00 | 32.67 | C |
| ATOM | 2217 | C | ALA | D | 72 | 13.688 | 70.976 | −18.443 | 1.00 | 37.05 | C |
| ATOM | 2218 | O | ALA | D | 72 | 13.541 | 69.784 | −18.161 | 1.00 | 35.94 | O |
| ATOM | 2219 | CB | ALA | D | 72 | 11.796 | 72.461 | −17.758 | 1.00 | 29.67 | C |
| ATOM | 2220 | N | THR | D | 73 | 14.861 | 71.594 | −18.349 | 1.00 | 33.25 | N |
| ATOM | 2221 | CA | THR | D | 73 | 15.969 | 70.834 | −17.809 | 1.00 | 33.69 | C |
| ATOM | 2222 | C | THR | D | 73 | 16.765 | 71.667 | −16.813 | 1.00 | 36.67 | C |
| ATOM | 2223 | O | THR | D | 73 | 16.912 | 72.886 | −16.951 | 1.00 | 37.39 | O |
| ATOM | 2224 | CB | THR | D | 73 | 16.875 | 70.239 | −18.916 | 1.00 | 40.87 | C |
| ATOM | 2225 | OG1 | THR | D | 73 | 18.214 | 70.724 | −18.799 | 1.00 | 48.32 | O |
| ATOM | 2226 | CG2 | THR | D | 73 | 16.335 | 70.483 | −20.289 | 1.00 | 31.17 | C |
| ATOM | 2227 | N | LEU | D | 74 | 17.224 | 70.979 | −15.775 | 1.00 | 36.18 | N |
| ATOM | 2228 | CA | LEU | D | 74 | 18.084 | 71.536 | −14.749 | 1.00 | 40.71 | C |
| ATOM | 2229 | C | LEU | D | 74 | 19.514 | 71.068 | −15.005 | 1.00 | 39.16 | C |
| ATOM | 2230 | O | LEU | D | 74 | 19.747 | 69.887 | −15.269 | 1.00 | 36.86 | O |
| ATOM | 2231 | CB | LEU | D | 74 | 17.597 | 71.088 | −13.375 | 1.00 | 32.52 | C |
| ATOM | 2232 | CG | LEU | D | 74 | 18.632 | 71.088 | −12.262 | 1.00 | 33.76 | C |

TABLE 10.3-continued

| ATOM | 2233 | CD1 | LEU | D | 74 | 18.979 | 72.495 | −11.837 | 1.00 | 34.80 | C |
|------|------|-----|-----|---|----|--------|--------|---------|------|-------|---|
| ATOM | 2234 | CD2 | LEU | D | 74 | 18.078 | 70.285 | −11.105 | 1.00 | 28.46 | C |
| ATOM | 2235 | N | GLY | D | 75 | 20.456 | 71.992 | −14.964 | 1.00 | 39.23 | N |
| ATOM | 2236 | CA | GLY | D | 75 | 21.861 | 71.676 | −15.155 | 1.00 | 34.28 | C |
| ATOM | 2237 | C | GLY | D | 75 | 22.643 | 71.975 | −13.891 | 1.00 | 35.73 | C |
| ATOM | 2238 | O | GLY | D | 75 | 22.380 | 72.971 | −13.212 | 1.00 | 31.27 | O |
| ATOM | 2239 | N | ILE | D | 76 | 23.572 | 71.083 | −13.555 | 1.00 | 37.91 | N |
| ATOM | 2240 | CA | ILE | D | 76 | 24.460 | 71.270 | −12.416 | 1.00 | 37.96 | C |
| ATOM | 2241 | C | ILE | D | 76 | 25.880 | 71.043 | −12.900 | 1.00 | 44.61 | C |
| ATOM | 2242 | O | ILE | D | 76 | 26.245 | 69.912 | −13.243 | 1.00 | 45.05 | O |
| ATOM | 2243 | CB | ILE | D | 76 | 24.132 | 70.324 | −11.259 | 1.00 | 37.47 | C |
| ATOM | 2244 | CG1 | ILE | D | 76 | 22.612 | 70.258 | −11.056 | 1.00 | 38.58 | C |
| ATOM | 2245 | CG2 | ILE | D | 76 | 24.842 | 70.801 | −10.019 | 1.00 | 34.75 | C |
| ATOM | 2246 | CD1 | ILE | D | 76 | 22.182 | 69.396 | −9.926 | 1.00 | 35.25 | C |
| ATOM | 2247 | N | THR | D | 77 | 26.684 | 72.103 | −12.916 | 1.00 | 41.92 | N |
| ATOM | 2248 | CA | THR | D | 77 | 28.105 | 72.001 | −13.217 | 1.00 | 45.22 | C |
| ATOM | 2249 | C | THR | D | 77 | 28.911 | 71.995 | −11.922 | 1.00 | 49.05 | C |
| ATOM | 2250 | O | THR | D | 77 | 28.433 | 72.413 | −10.863 | 1.00 | 46.09 | O |
| ATOM | 2251 | CB | THR | D | 77 | 28.570 | 73.156 | −14.111 | 1.00 | 45.74 | C |
| ATOM | 2252 | OG1 | THR | D | 77 | 28.494 | 74.389 | −13.383 | 1.00 | 45.10 | O |
| ATOM | 2253 | CG2 | THR | D | 77 | 27.707 | 73.246 | −15.356 | 1.00 | 41.50 | C |
| ATOM | 2254 | N | GLY | D | 78 | 30.136 | 71.474 | −12.015 | 1.00 | 50.10 | N |
| ATOM | 2255 | CA | GLY | D | 78 | 31.054 | 71.450 | −10.893 | 1.00 | 40.32 | C |
| ATOM | 2256 | C | GLY | D | 78 | 30.509 | 70.763 | −9.660 | 1.00 | 47.60 | C |
| ATOM | 2257 | O | GLY | D | 78 | 30.599 | 71.321 | −8.562 | 1.00 | 46.13 | O |
| ATOM | 2258 | N | LEU | D | 79 | 29.977 | 69.545 | −9.822 | 1.00 | 44.28 | N |
| ATOM | 2259 | CA | LEU | D | 79 | 29.291 | 68.851 | −8.735 | 1.00 | 41.62 | C |
| ATOM | 2260 | C | LEU | D | 79 | 30.097 | 68.875 | −7.445 | 1.00 | 41.28 | C |
| ATOM | 2261 | O | LEU | D | 79 | 31.306 | 68.625 | −7.445 | 1.00 | 43.99 | O |
| ATOM | 2262 | CB | LEU | D | 79 | 29.044 | 67.391 | −9.108 | 1.00 | 44.54 | C |
| ATOM | 2263 | CG | LEU | D | 79 | 27.718 | 66.829 | −9.591 | 1.00 | 41.80 | C |
| ATOM | 2264 | CD1 | LEU | D | 79 | 26.548 | 67.743 | −9.317 | 1.00 | 41.01 | C |
| ATOM | 2265 | CD2 | LEU | D | 79 | 27.807 | 66.456 | −11.048 | 1.00 | 48.29 | C |
| ATOM | 2266 | N | GLN | D | 80 | 29.407 | 69.147 | −6.341 | 1.00 | 38.12 | N |
| ATOM | 2267 | CA | GLN | D | 80 | 29.955 | 69.025 | −5.000 | 1.00 | 37.63 | C |
| ATOM | 2268 | C | GLN | D | 80 | 29.166 | 67.992 | −4.207 | 1.00 | 39.83 | C |
| ATOM | 2269 | O | GLN | D | 80 | 27.975 | 67.771 | −4.461 | 1.00 | 44.36 | O |
| ATOM | 2270 | CB | GLN | D | 80 | 29.925 | 70.349 | −4.277 | 1.00 | 35.93 | C |
| ATOM | 2271 | CG | GLN | D | 80 | 30.598 | 71.424 | −5.072 | 1.00 | 44.41 | C |
| ATOM | 2272 | CD | GLN | D | 80 | 30.602 | 72.746 | −4.351 | 1.00 | 48.07 | C |
| ATOM | 2273 | OE1 | GLN | D | 80 | 30.141 | 72.848 | −3.211 | 1.00 | 51.38 | O |
| ATOM | 2274 | NE2 | GLN | D | 80 | 31.108 | 73.778 | −5.018 | 1.00 | 49.68 | N |
| ATOM | 2275 | N | THR | D | 81 | 29.838 | 67.362 | −3.236 | 1.00 | 39.23 | N |
| ATOM | 2276 | CA | THR | D | 81 | 29.185 | 66.313 | −2.459 | 1.00 | 43.43 | C |
| ATOM | 2277 | C | THR | D | 81 | 27.905 | 66.827 | −1.825 | 1.00 | 38.49 | C |
| ATOM | 2278 | O | THR | D | 81 | 26.949 | 66.066 | −1.660 | 1.00 | 43.22 | O |
| ATOM | 2279 | CB | THR | D | 81 | 30.122 | 65.740 | −1.386 | 1.00 | 33.08 | C |
| ATOM | 2280 | OG1 | THR | D | 81 | 30.589 | 66.796 | −0.558 | 1.00 | 47.69 | O |
| ATOM | 2281 | CG2 | THR | D | 81 | 31.307 | 65.035 | −2.020 | 1.00 | 35.64 | C |
| ATOM | 2282 | N | GLY | D | 82 | 27.859 | 68.112 | −1.498 | 1.00 | 35.25 | N |
| ATOM | 2283 | CA | GLY | D | 82 | 26.664 | 68.722 | −0.952 | 1.00 | 40.04 | C |
| ATOM | 2284 | C | GLY | D | 82 | 25.510 | 68.895 | −1.929 | 1.00 | 38.60 | C |
| ATOM | 2285 | O | GLY | D | 82 | 24.437 | 69.339 | −1.510 | 1.00 | 35.12 | O |
| ATOM | 2286 | N | ASP | D | 83 | 25.694 | 68.543 | −3.200 | 1.00 | 33.43 | N |
| ATOM | 2287 | CA | ASP | D | 83 | 24.619 | 68.564 | −4.179 | 1.00 | 37.84 | C |
| ATOM | 2288 | C | ASP | D | 83 | 23.834 | 67.251 | −4.245 | 1.00 | 43.45 | C |
| ATOM | 2289 | O | ASP | D | 83 | 22.814 | 67.191 | −4.957 | 1.00 | 40.21 | O |
| ATOM | 2290 | CB | ASP | D | 83 | 25.181 | 68.882 | −5.566 | 1.00 | 33.25 | C |
| ATOM | 2291 | CG | ASP | D | 83 | 25.971 | 70.173 | −5.593 | 1.00 | 42.35 | C |
| ATOM | 2292 | OD1 | ASP | D | 83 | 25.680 | 71.085 | −4.788 | 1.00 | 36.88 | O |
| ATOM | 2293 | OD2 | ASP | D | 83 | 26.882 | 70.284 | −6.440 | 1.00 | 44.43 | O1− |
| ATOM | 2294 | N | GLU | D | 84 | 24.310 | 66.192 | −3.577 | 1.00 | 37.08 | N |
| ATOM | 2295 | CA | GLU | D | 84 | 23.578 | 64.931 | −3.529 | 1.00 | 38.14 | C |
| ATOM | 2296 | C | GLU | D | 84 | 22.192 | 65.159 | −2.929 | 1.00 | 37.73 | C |
| ATOM | 2297 | O | GLU | D | 84 | 22.075 | 65.642 | −1.800 | 1.00 | 36.95 | O |
| ATOM | 2298 | CB | GLU | D | 84 | 24.359 | 63.904 | −2.708 | 1.00 | 33.68 | C |
| ATOM | 2299 | CG | GLU | D | 84 | 23.683 | 62.544 | −2.653 | 1.00 | 41.33 | C |
| ATOM | 2300 | CD | GLU | D | 84 | 24.682 | 61.389 | −2.458 | 1.00 | 46.09 | C |
| ATOM | 2301 | OE1 | GLU | D | 84 | 24.374 | 60.429 | −1.716 | 1.00 | 49.48 | O |
| ATOM | 2302 | OE2 | GLU | D | 84 | 25.766 | 61.427 | −3.078 | 1.00 | 45.22 | O1− |
| ATOM | 2303 | N | ALA | D | 85 | 21.146 | 64.836 | −3.688 | 1.00 | 31.07 | N |
| ATOM | 2304 | CA | ALA | D | 85 | 19.786 | 65.206 | −3.298 | 1.00 | 29.56 | C |
| ATOM | 2305 | C | ALA | D | 85 | 18.818 | 64.596 | −4.293 | 1.00 | 32.77 | C |
| ATOM | 2306 | O | ALA | D | 85 | 19.218 | 64.022 | −5.314 | 1.00 | 32.03 | O |
| ATOM | 2307 | CB | ALA | D | 85 | 19.590 | 66.729 | −3.227 | 1.00 | 30.06 | C |
| ATOM | 2308 | N | ASP | D | 86 | 17.531 | 64.697 | −3.959 | 1.00 | 30.95 | N |
| ATOM | 2309 | CA | ASP | D | 86 | 16.457 | 64.474 | −4.921 | 1.00 | 30.44 | C |
| ATOM | 2310 | C | ASP | D | 86 | 16.015 | 65.817 | −5.481 | 1.00 | 33.26 | C |
| ATOM | 2311 | O | ASP | D | 86 | 15.958 | 66.816 | −4.752 | 1.00 | 29.91 | O |
| ATOM | 2312 | CB | ASP | D | 86 | 15.261 | 63.780 | −4.283 | 1.00 | 36.23 | C |

TABLE 10.3-continued

| | | | | | | | | | | |
|---|---|---|---|---|---|---|---|---|---|---|
| ATOM | 2313 | CG | ASP | D | 86 | 15.600 | 62.414 | −3.757 | 1.00 | 39.79 | C |
| ATOM | 2314 | OD1 | ASP | D | 86 | 16.287 | 61.640 | −4.460 | 1.00 | 49.35 | O |
| ATOM | 2315 | OD2 | ASP | D | 86 | 15.202 | 62.134 | −2.620 | 1.00 | 52.11 | O1− |
| ATOM | 2316 | N | TYR | D | 87 | 15.723 | 65.834 | −6.775 | 1.00 | 28.24 | N |
| ATOM | 2317 | CA | TYR | D | 87 | 15.349 | 67.045 | −7.481 | 1.00 | 30.37 | C |
| ATOM | 2318 | C | TYR | D | 87 | 13.993 | 66.832 | −8.116 | 1.00 | 30.53 | C |
| ATOM | 2319 | O | TYR | D | 87 | 13.736 | 65.781 | −8.716 | 1.00 | 31.12 | O |
| ATOM | 2320 | CB | TYR | D | 87 | 16.407 | 67.425 | −8.550 | 1.00 | 31.35 | C |
| ATOM | 2321 | CG | TYR | D | 87 | 17.707 | 67.860 | −7.930 | 1.00 | 28.53 | C |
| ATOM | 2322 | CD2 | TYR | D | 87 | 18.711 | 66.933 | −7.628 | 1.00 | 29.65 | C |
| ATOM | 2323 | CD1 | TYR | D | 87 | 17.919 | 69.192 | −7.596 | 1.00 | 30.97 | C |
| ATOM | 2324 | CE2 | TYR | D | 87 | 19.913 | 67.350 | −7.040 | 1.00 | 36.12 | C |
| ATOM | 2325 | CE1 | TYR | D | 87 | 19.110 | 69.620 | −6.999 | 1.00 | 32.34 | C |
| ATOM | 2326 | CZ | TYR | D | 87 | 20.101 | 68.700 | −6.728 | 1.00 | 36.00 | C |
| ATOM | 2327 | OH | TYR | D | 87 | 21.261 | 69.124 | −6.123 | 1.00 | 36.35 | O |
| ATOM | 2328 | N | TYR | D | 88 | 13.130 | 67.833 | −7.986 | 1.00 | 31.77 | N |
| ATOM | 2329 | CA | TYR | D | 88 | 11.763 | 67.756 | −8.495 | 1.00 | 30.69 | C |
| ATOM | 2330 | C | TYR | D | 88 | 11.442 | 68.977 | −9.350 | 1.00 | 33.16 | C |
| ATOM | 2331 | O | TYR | D | 88 | 11.697 | 70.123 | −8.943 | 1.00 | 27.49 | O |
| ATOM | 2332 | CB | TYR | D | 88 | 10.755 | 67.662 | −7.330 | 1.00 | 28.47 | C |
| ATOM | 2333 | CG | TYR | D | 88 | 10.863 | 66.418 | −6.469 | 1.00 | 32.12 | C |
| ATOM | 2334 | CD1 | TYR | D | 88 | 10.157 | 65.254 | −6.797 | 1.00 | 33.44 | C |
| ATOM | 2335 | CD2 | TYR | D | 88 | 11.639 | 66.407 | −5.312 | 1.00 | 35.30 | C |
| ATOM | 2336 | CE1 | TYR | D | 88 | 10.246 | 64.107 | −6.011 | 1.00 | 33.26 | C |
| ATOM | 2337 | CE2 | TYR | D | 88 | 11.735 | 65.256 | −4.505 | 1.00 | 28.88 | C |
| ATOM | 2338 | CZ | TYR | D | 88 | 11.038 | 64.121 | −4.860 | 1.00 | 35.12 | C |
| ATOM | 2339 | OH | TYR | D | 88 | 11.138 | 63.001 | −4.067 | 1.00 | 41.20 | O |
| ATOM | 2340 | N | CYS | D | 89 | 10.860 | 68.743 | −10.520 | 1.00 | 29.10 | N |
| ATOM | 2341 | CA | CYS | D | 89 | 10.217 | 69.855 | −11.206 | 1.00 | 33.19 | C |
| ATOM | 2342 | C | CYS | D | 89 | 8.723 | 69.907 | −10.850 | 1.00 | 37.48 | C |
| ATOM | 2343 | O | CYS | D | 89 | 8.110 | 68.906 | −10.450 | 1.00 | 33.89 | O |
| ATOM | 2344 | CB | CYS | D | 89 | 10.397 | 69.751 | −12.722 | 1.00 | 35.57 | C |
| ATOM | 2345 | SG | CYS | D | 89 | 9.788 | 68.160 | −13.353 | 1.00 | 50.43 | S |
| ATOM | 2346 | N | GLY | D | 90 | 8.153 | 71.103 | −10.985 | 1.00 | 35.51 | N |
| ATOM | 2347 | CA | GLY | D | 90 | 6.747 | 71.329 | −10.696 | 1.00 | 31.51 | C |
| ATOM | 2348 | C | GLY | D | 90 | 6.184 | 72.474 | −11.510 | 1.00 | 32.91 | C |
| ATOM | 2349 | O | GLY | D | 90 | 6.886 | 73.440 | −11.821 | 1.00 | 37.81 | O |
| ATOM | 2350 | N | THR | D | 91 | 4.905 | 72.347 | −11.876 | 1.00 | 29.44 | N |
| ATOM | 2351 | CA | THR | D | 91 | 4.112 | 73.391 | −12.523 | 1.00 | 35.31 | C |
| ATOM | 2352 | C | THR | D | 91 | 2.648 | 73.192 | −12.187 | 1.00 | 34.83 | C |
| ATOM | 2353 | O | THR | D | 91 | 2.252 | 72.229 | −11.533 | 1.00 | 31.62 | O |
| ATOM | 2354 | CB | THR | D | 91 | 4.039 | 73.364 | −14.063 | 1.00 | 36.67 | C |
| ATOM | 2355 | OG1 | THR | D | 91 | 4.722 | 72.256 | −14.635 | 1.00 | 42.40 | O |
| ATOM | 2356 | CG2 | THR | D | 91 | 4.377 | 74.637 | −14.683 | 1.00 | 25.98 | C |
| ATOM | 2357 | N | TRP | D | 92 | 1.845 | 74.047 | −12.800 | 1.00 | 33.75 | N |
| ATOM | 2358 | CA | TRP | D | 92 | 0.422 | 73.882 | −12.929 | 1.00 | 32.47 | C |
| ATOM | 2359 | C | TRP | D | 92 | 0.088 | 73.103 | −14.202 | 1.00 | 34.81 | C |
| ATOM | 2360 | O | TRP | D | 92 | 0.757 | 73.209 | −15.235 | 1.00 | 30.64 | O |
| ATOM | 2361 | CB | TRP | D | 92 | −0.234 | 75.251 | −12.956 | 1.00 | 33.91 | C |
| ATOM | 2362 | CG | TRP | D | 92 | −1.719 | 75.251 | −12.940 | 1.00 | 35.91 | C |
| ATOM | 2363 | CD1 | TRP | D | 92 | −2.553 | 75.591 | −13.969 | 1.00 | 31.74 | C |
| ATOM | 2364 | CD2 | TRP | D | 92 | −2.557 | 74.949 | −11.818 | 1.00 | 34.97 | C |
| ATOM | 2365 | NE1 | TRP | D | 92 | −3.860 | 75.519 | −13.554 | 1.00 | 37.78 | N |
| ATOM | 2366 | CE2 | TRP | D | 92 | −3.893 | 75.127 | −12.238 | 1.00 | 39.89 | C |
| ATOM | 2367 | CE3 | TRP | D | 92 | −2.308 | 74.567 | −10.494 | 1.00 | 27.09 | C |
| ATOM | 2368 | CZ2 | TRP | D | 92 | −4.979 | 74.921 | −11.380 | 1.00 | 36.03 | C |
| ATOM | 2369 | CZ3 | TRP | D | 92 | −3.384 | 74.357 | −9.643 | 1.00 | 35.46 | C |
| ATOM | 2370 | CH2 | TRP | D | 92 | −4.706 | 74.542 | −10.087 | 1.00 | 35.32 | C |
| ATOM | 2371 | N | ASP | D | 93 | −0.943 | 72.296 | −14.109 | 1.00 | 32.62 | N |
| ATOM | 2372 | CA | ASP | D | 93 | −1.540 | 71.671 | −15.277 | 1.00 | 38.27 | C |
| ATOM | 2373 | C | ASP | D | 93 | −2.925 | 72.275 | −15.476 | 1.00 | 37.51 | C |
| ATOM | 2374 | O | ASP | D | 93 | −3.809 | 72.089 | −14.634 | 1.00 | 39.63 | O |
| ATOM | 2375 | CB | ASP | D | 93 | −1.609 | 70.162 | −15.121 | 1.00 | 37.98 | C |
| ATOM | 2376 | CG | ASP | D | 93 | −2.016 | 69.490 | −16.396 | 1.00 | 37.56 | C |
| ATOM | 2377 | OD1 | ASP | D | 93 | −3.109 | 69.827 | −16.919 | 1.00 | 38.96 | O1− |
| ATOM | 2378 | OD2 | ASP | D | 93 | −1.226 | 68.659 | −16.884 | 1.00 | 37.13 | O |
| ATOM | 2379 | N | SER | D | 94 | −3.094 | 73.010 | −16.583 | 1.00 | 40.55 | N |
| ATOM | 2380 | CA | SER | D | 94 | −4.324 | 73.756 | −16.838 | 1.00 | 43.35 | C |
| ATOM | 2381 | C | SER | D | 94 | −5.502 | 72.843 | −17.132 | 1.00 | 41.15 | C |
| ATOM | 2382 | O | SER | D | 94 | −6.643 | 73.204 | −16.848 | 1.00 | 47.84 | O |
| ATOM | 2383 | CB | SER | D | 94 | −4.124 | 74.716 | −18.009 | 1.00 | 37.93 | C |
| ATOM | 2384 | OG | SER | D | 94 | −3.093 | 75.653 | −17.720 | 1.00 | 50.29 | O |
| ATOM | 2385 | N | SER | D | 95 | −5.261 | 71.659 | −17.656 | 1.00 | 39.23 | N |
| ATOM | 2386 | CA | SER | D | 95 | −6.392 | 70.814 | −17.991 | 1.00 | 45.37 | C |
| ATOM | 2387 | C | SER | D | 95 | −6.795 | 69.916 | −16.843 | 1.00 | 44.47 | C |
| ATOM | 2388 | O | SER | D | 95 | −7.981 | 69.617 | −16.704 | 1.00 | 52.00 | O |
| ATOM | 2389 | CB | SER | D | 95 | −6.084 | 69.960 | −19.223 | 1.00 | 44.25 | C |
| ATOM | 2390 | OG | SER | D | 95 | −5.390 | 68.785 | −18.856 | 1.00 | 58.75 | O |
| ATOM | 2391 | N | LEU | D | 96 | −5.845 | 69.487 | −16.012 | 1.00 | 43.88 | N |
| ATOM | 2392 | CA | LEU | D | 96 | −6.173 | 68.775 | −14.780 | 1.00 | 37.73 | C |

TABLE 10.3-continued

| | | | | | | | | | | |
|---|---|---|---|---|---|---|---|---|---|---|
| ATOM | 2393 | C | LEU | D | 96 | −6.491 | 69.723 | −13.621 | 1.00 | 36.61 | C |
| ATOM | 2394 | O | LEU | D | 96 | −6.885 | 69.255 | −12.550 | 1.00 | 38.29 | O |
| ATOM | 2395 | CB | LEU | D | 96 | −5.019 | 67.839 | −14.391 | 1.00 | 41.42 | C |
| ATOM | 2396 | CG | LEU | D | 96 | −4.577 | 66.750 | −15.380 | 1.00 | 39.10 | C |
| ATOM | 2397 | CD1 | LEU | D | 96 | −3.261 | 66.160 | −14.963 | 1.00 | 34.94 | C |
| ATOM | 2398 | CD2 | LEU | D | 96 | −5.612 | 65.640 | −15.506 | 1.00 | 35.48 | C |
| ATOM | 2399 | N | ASN | D | 97 | −6.353 | 71.034 | −13.811 | 1.00 | 37.50 | N |
| ATOM | 2400 | CA | ASN | D | 97 | −6.524 | 72.032 | −12.750 | 1.00 | 39.48 | C |
| ATOM | 2401 | C | ASN | D | 97 | −5.885 | 71.606 | −11.418 | 1.00 | 35.80 | C |
| ATOM | 2402 | O | ASN | D | 97 | −6.519 | 71.581 | −10.367 | 1.00 | 35.42 | O |
| ATOM | 2403 | CB | ASN | D | 97 | −8.002 | 72.403 | −12.591 | 1.00 | 33.46 | C |
| ATOM | 2404 | CG | ASN | D | 97 | −8.304 | 73.766 | −13.211 | 1.00 | 59.81 | C |
| ATOM | 2405 | OD1 | ASN | D | 97 | −8.600 | 74.731 | −12.490 | 1.00 | 63.64 | O |
| ATOM | 2406 | ND2 | ASN | D | 97 | −8.104 | 73.888 | −14.535 | 1.00 | 48.78 | N |
| ATOM | 2407 | N | THR | D | 98 | −4.584 | 71.319 | −11.468 | 1.00 | 34.96 | N |
| ATOM | 2408 | CA | THR | D | 98 | −3.880 | 70.883 | −10.267 | 1.00 | 40.51 | C |
| ATOM | 2409 | C | THR | D | 98 | −2.389 | 71.197 | −10.382 | 1.00 | 33.13 | C |
| ATOM | 2410 | O | THR | D | 98 | −1.843 | 71.349 | −11.482 | 1.00 | 33.25 | O |
| ATOM | 2411 | CB | THR | D | 98 | −4.095 | 69.378 | −10.000 | 1.00 | 31.21 | C |
| ATOM | 2412 | OG1 | THR | D | 98 | −3.498 | 69.048 | −8.749 | 1.00 | 36.06 | O |
| ATOM | 2413 | CG2 | THR | D | 98 | −3.428 | 68.531 | −11.061 | 1.00 | 31.76 | C |
| ATOM | 2414 | N | VAL | D | 99 | −1.730 | 71.290 | −9.222 | 1.00 | 29.98 | N |
| ATOM | 2415 | CA | VAL | D | 99 | −0.267 | 71.342 | −9.211 | 1.00 | 34.24 | C |
| ATOM | 2416 | C | VAL | D | 99 | 0.296 | 69.972 | −9.558 | 1.00 | 34.16 | C |
| ATOM | 2417 | O | VAL | D | 99 | −0.215 | 68.936 | −9.120 | 1.00 | 34.33 | O |
| ATOM | 2418 | CB | VAL | D | 99 | 0.278 | 71.796 | −7.849 | 1.00 | 33.92 | C |
| ATOM | 2419 | CG1 | VAL | D | 99 | 1.787 | 71.619 | −7.819 | 1.00 | 30.13 | C |
| ATOM | 2420 | CG2 | VAL | D | 99 | −0.114 | 73.241 | −7.535 | 1.00 | 28.38 | C |
| ATOM | 2421 | N | VAL | D | 100 | 1.375 | 69.952 | −10.321 | 1.00 | 29.37 | N |
| ATOM | 2422 | CA | VAL | D | 100 | 1.871 | 68.706 | −10.875 | 1.00 | 30.81 | C |
| ATOM | 2423 | C | VAL | D | 100 | 3.380 | 68.659 | −10.653 | 1.00 | 33.23 | C |
| ATOM | 2424 | O | VAL | D | 100 | 4.072 | 69.662 | −10.890 | 1.00 | 32.58 | O |
| ATOM | 2425 | CB | VAL | D | 100 | 1.442 | 68.618 | −12.352 | 1.00 | 32.14 | C |
| ATOM | 2426 | CG1 | VAL | D | 100 | 2.538 | 68.362 | −13.255 | 1.00 | 38.21 | C |
| ATOM | 2427 | CG2 | VAL | D | 100 | 0.327 | 67.591 | −12.507 | 1.00 | 35.01 | C |
| ATOM | 2428 | N | PHE | D | 101 | 3.869 | 67.537 | −10.090 | 1.00 | 32.44 | N |
| ATOM | 2429 | CA | PHE | D | 101 | 5.292 | 67.296 | −9.826 | 1.00 | 28.74 | C |
| ATOM | 2430 | C | PHE | D | 101 | 5.824 | 66.191 | −10.728 | 1.00 | 30.41 | C |
| ATOM | 2431 | O | PHE | D | 101 | 5.091 | 65.280 | −11.116 | 1.00 | 36.07 | O |
| ATOM | 2432 | CB | PHE | D | 101 | 5.571 | 66.879 | −8.367 | 1.00 | 29.14 | C |
| ATOM | 2433 | CG | PHE | D | 101 | 5.505 | 68.006 | −7.372 | 1.00 | 29.14 | C |
| ATOM | 2434 | CD1 | PHE | D | 101 | 6.472 | 68.991 | −7.355 | 1.00 | 29.41 | C |
| ATOM | 2435 | CD2 | PHE | D | 101 | 4.483 | 68.067 | −6.438 | 1.00 | 29.40 | C |
| ATOM | 2436 | CE1 | PHE | D | 101 | 6.421 | 70.041 | −6.430 | 1.00 | 30.71 | C |
| ATOM | 2437 | CE2 | PHE | D | 101 | 4.412 | 69.107 | −5.519 | 1.00 | 31.48 | C |
| ATOM | 2438 | CZ | PHE | D | 101 | 5.388 | 70.100 | −5.509 | 1.00 | 28.28 | C |
| ATOM | 2439 | N | GLY | D | 102 | 7.112 | 66.269 | −11.069 | 1.00 | 35.21 | N |
| ATOM | 2440 | CA | GLY | D | 102 | 7.774 | 65.104 | −11.621 | 1.00 | 30.07 | C |
| ATOM | 2441 | C | GLY | D | 102 | 7.949 | 64.054 | −10.539 | 1.00 | 34.24 | C |
| ATOM | 2442 | O | GLY | D | 102 | 7.809 | 64.324 | −9.342 | 1.00 | 32.05 | O |
| ATOM | 2443 | N | GLY | D | 103 | 8.282 | 62.833 | −10.962 | 1.00 | 33.87 | N |
| ATOM | 2444 | CA | GLY | D | 103 | 8.500 | 61.756 | −9.998 | 1.00 | 30.14 | C |
| ATOM | 2445 | C | GLY | D | 103 | 9.767 | 61.896 | −9.164 | 1.00 | 33.06 | C |
| ATOM | 2446 | O | GLY | D | 103 | 9.929 | 61.153 | −8.195 | 1.00 | 33.57 | O |
| ATOM | 2447 | N | GLY | D | 104 | 10.649 | 62.840 | −9.500 | 1.00 | 34.22 | N |
| ATOM | 2448 | CA | GLY | D | 104 | 11.866 | 63.034 | −8.746 | 1.00 | 30.60 | C |
| ATOM | 2449 | C | GLY | D | 104 | 13.056 | 62.330 | −9.363 | 1.00 | 32.84 | C |
| ATOM | 2450 | O | GLY | D | 104 | 12.939 | 61.230 | −9.914 | 1.00 | 37.98 | O |
| ATOM | 2451 | N | THR | D | 105 | 14.219 | 62.953 | −9.267 | 1.00 | 33.92 | N |
| ATOM | 2452 | CA | THR | D | 105 | 15.460 | 62.372 | −9.749 | 1.00 | 32.14 | C |
| ATOM | 2453 | C | THR | D | 105 | 16.422 | 62.308 | −8.581 | 1.00 | 35.31 | C |
| ATOM | 2454 | O | THR | D | 105 | 16.683 | 63.335 | −7.945 | 1.00 | 33.86 | O |
| ATOM | 2455 | CB | THR | D | 105 | 16.052 | 63.202 | −10.878 | 1.00 | 35.69 | C |
| ATOM | 2456 | OG1 | THR | D | 105 | 15.118 | 63.236 | −11.966 | 1.00 | 33.00 | O |
| ATOM | 2457 | CG2 | THR | D | 105 | 17.374 | 62.575 | −11.328 | 1.00 | 32.50 | C |
| ATOM | 2458 | N | LYS | D | 106 | 16.895 | 61.095 | −8.260 | 1.00 | 35.10 | N |
| ATOM | 2459 | CA | LYS | D | 106 | 17.920 | 60.928 | −7.232 | 1.00 | 39.20 | C |
| ATOM | 2460 | C | LYS | D | 106 | 19.287 | 61.212 | −7.857 | 1.00 | 35.77 | C |
| ATOM | 2461 | O | LYS | D | 106 | 19.709 | 60.517 | −8.796 | 1.00 | 33.65 | O |
| ATOM | 2462 | CB | LYS | D | 106 | 17.875 | 59.523 | −6.612 | 1.00 | 37.13 | C |
| ATOM | 2463 | CG | LYS | D | 106 | 18.991 | 59.257 | −5.575 | 1.00 | 41.72 | C |
| ATOM | 2464 | CD | LYS | D | 106 | 18.843 | 57.864 | −4.893 | 1.00 | 66.03 | C |
| ATOM | 2465 | CE | LYS | D | 106 | 20.060 | 57.472 | −4.002 | 1.00 | 43.48 | C |
| ATOM | 2466 | NZ | LYS | D | 106 | 20.399 | 58.527 | −2.969 | 1.00 | 59.67 | N1+ |
| ATOM | 2467 | N | LEU | D | 107 | 19.955 | 62.253 | −7.355 | 1.00 | 37.32 | N |
| ATOM | 2468 | CA | LEU | D | 107 | 21.313 | 62.606 | −7.757 | 1.00 | 39.36 | C |
| ATOM | 2469 | C | LEU | D | 107 | 22.264 | 62.033 | −6.720 | 1.00 | 37.65 | C |
| ATOM | 2470 | O | LEU | D | 107 | 22.211 | 62.419 | −5.542 | 1.00 | 38.47 | O |
| ATOM | 2471 | CB | LEU | D | 107 | 21.518 | 64.129 | −7.855 | 1.00 | 26.67 | C |
| ATOM | 2472 | CG | LEU | D | 107 | 22.784 | 64.731 | −8.570 | 1.00 | 37.81 | C |

TABLE 10.3-continued

| | | | | | | | | | | | |
|---|---|---|---|---|---|---|---|---|---|---|---|
| ATOM | 2473 | CD1 | LEU | D | 107 | 23.134 | 66.182 | −8.167 | 1.00 | 38.40 | C |
| ATOM | 2474 | CD2 | LEU | D | 107 | 24.043 | 63.923 | −8.466 | 1.00 | 34.25 | C |
| ATOM | 2475 | N | THR | D | 108 | 23.176 | 61.171 | −7.148 | 1.00 | 30.15 | N |
| ATOM | 2476 | CA | THR | D | 108 | 24.270 | 60.823 | −6.255 | 1.00 | 39.12 | C |
| ATOM | 2477 | C | THR | D | 108 | 25.591 | 61.351 | −6.810 | 1.00 | 33.08 | C |
| ATOM | 2478 | O | THR | D | 108 | 25.888 | 61.234 | −8.004 | 1.00 | 36.87 | O |
| ATOM | 2479 | CB | THR | D | 108 | 24.311 | 59.316 | −5.951 | 1.00 | 42.14 | C |
| ATOM | 2480 | OG1 | THR | D | 108 | 25.514 | 58.733 | −6.459 | 1.00 | 51.43 | O |
| ATOM | 2481 | CG2 | THR | D | 108 | 23.075 | 58.603 | −6.471 | 1.00 | 39.89 | C |
| ATOM | 2482 | N | VAL | D | 109 | 26.338 | 62.011 | −5.950 | 1.00 | 28.89 | N |
| ATOM | 2483 | CA | VAL | D | 109 | 27.679 | 62.461 | −6.272 | 1.00 | 36.64 | C |
| ATOM | 2484 | C | VAL | D | 109 | 28.632 | 61.337 | −5.873 | 1.00 | 36.03 | C |
| ATOM | 2485 | O | VAL | D | 109 | 28.838 | 61.088 | −4.686 | 1.00 | 34.38 | O |
| ATOM | 2486 | CB | VAL | D | 109 | 27.999 | 63.769 | −5.547 | 1.00 | 39.07 | C |
| ATOM | 2487 | CG1 | VAL | D | 109 | 29.402 | 64.264 | −5.930 | 1.00 | 39.69 | C |
| ATOM | 2488 | CG2 | VAL | D | 109 | 26.914 | 64.807 | −5.871 | 1.00 | 39.03 | C |
| ATOM | 2489 | N | LEU | D | 110 | 29.179 | 60.637 | −6.868 | 1.00 | 36.80 | N |
| ATOM | 2490 | CA | LEU | D | 110 | 29.935 | 59.407 | −6.646 | 1.00 | 35.35 | C |
| ATOM | 2491 | C | LEU | D | 110 | 31.166 | 59.653 | −5.794 | 1.00 | 38.39 | C |
| ATOM | 2492 | O | LEU | D | 110 | 32.109 | 60.294 | −6.255 | 1.00 | 39.60 | O |
| ATOM | 2493 | CB | LEU | D | 110 | 30.358 | 58.813 | −7.978 | 1.00 | 31.68 | C |
| ATOM | 2494 | CG | LEU | D | 110 | 29.190 | 58.470 | −8.886 | 1.00 | 42.08 | C |
| ATOM | 2495 | CD1 | LEU | D | 110 | 29.720 | 58.230 | −10.264 | 1.00 | 33.32 | C |
| ATOM | 2496 | CD2 | LEU | D | 110 | 28.489 | 57.239 | −8.343 | 1.00 | 40.75 | C |
| ATOM | 2497 | N | SER | D | 111 | 31.182 | 59.144 | −4.564 | 1.00 | 38.34 | N |
| ATOM | 2498 | CA | SER | D | 111 | 32.330 | 59.296 | −3.680 | 1.00 | 44.10 | C |
| ATOM | 2499 | C | SER | D | 111 | 32.991 | 57.956 | −3.361 | 1.00 | 43.27 | C |
| ATOM | 2500 | O | SER | D | 111 | 33.843 | 57.885 | −2.476 | 1.00 | 38.62 | O |
| ATOM | 2501 | CB | SER | D | 111 | 31.917 | 60.001 | −2.396 | 1.00 | 39.42 | C |
| ATOM | 2502 | OG | SER | D | 111 | 30.920 | 59.235 | −1.763 | 1.00 | 48.72 | O |
| ATOM | 2503 | N | GLN | D | 112 | 32.606 | 56.901 | −4.058 | 1.00 | 36.34 | N |
| ATOM | 2504 | CA | GLN | D | 112 | 33.300 | 55.623 | −4.010 | 1.00 | 36.47 | C |
| ATOM | 2505 | C | GLN | D | 112 | 32.964 | 54.900 | −5.300 | 1.00 | 39.73 | C |
| ATOM | 2506 | O | GLN | D | 112 | 32.074 | 55.336 | −6.045 | 1.00 | 41.47 | O |
| ATOM | 2507 | CB | GLN | D | 112 | 32.884 | 54.798 | −2.774 | 1.00 | 34.11 | C |
| ATOM | 2508 | CG | GLN | D | 112 | 31.427 | 54.370 | −2.745 | 1.00 | 40.26 | C |
| ATOM | 2509 | CD | GLN | D | 112 | 31.098 | 53.480 | −1.545 | 1.00 | 44.54 | C |
| ATOM | 2510 | OE1 | GLN | D | 112 | 31.422 | 52.289 | −1.542 | 1.00 | 49.63 | O |
| ATOM | 2511 | NE2 | GLN | D | 112 | 30.446 | 54.054 | −0.523 | 1.00 | 32.71 | N |
| ATOM | 2512 | N | PRO | D | 113 | 33.662 | 53.816 | −5.614 | 1.00 | 35.83 | GZ00 N |
| ATOM | 2513 | CA | PRO | D | 113 | 33.350 | 53.105 | −6.859 | 1.00 | 29.36 | GZ00 C |
| ATOM | 2514 | C | PRO | D | 113 | 31.937 | 52.559 | −6.824 | 1.00 | 41.40 | GZ00 C |
| ATOM | 2515 | O | PRO | D | 113 | 31.391 | 52.249 | −5.763 | 1.00 | 33.72 | GZ00 O |
| ATOM | 2516 | CB | PRO | D | 113 | 34.371 | 51.969 | −6.897 | 1.00 | 29.06 | GZ00 C |
| ATOM | 2517 | CG | PRO | D | 113 | 35.545 | 52.491 | −6.029 | 1.00 | 36.02 | GZ00 C |
| ATOM | 2518 | CD | PRO | D | 113 | 34.878 | 53.300 | −4.948 | 1.00 | 37.13 | GZ00 C |
| ATOM | 2519 | N | LYS | D | 114 | 31.346 | 52.445 | −8.007 | 1.00 | 41.30 | GZ00 N |
| ATOM | 2520 | CA | LYS | D | 114 | 30.050 | 51.806 | −8.112 | 1.00 | 39.99 | GZ00 C |
| ATOM | 2521 | C | LYS | D | 114 | 30.168 | 50.332 | −7.726 | 1.00 | 42.17 | GZ00 C |
| ATOM | 2522 | O | LYS | D | 114 | 31.189 | 49.691 | −7.965 | 1.00 | 37.31 | GZ00 O |
| ATOM | 2523 | CB | LYS | D | 114 | 29.510 | 51.967 | −9.527 | 1.00 | 38.27 | GZ00 C |
| ATOM | 2524 | CG | LYS | D | 114 | 29.198 | 53.426 | −9.890 | 1.00 | 48.75 | GZ00 C |
| ATOM | 2525 | CD | LYS | D | 114 | 28.597 | 53.502 | −11.284 | 1.00 | 54.69 | GZ00 C |
| ATOM | 2526 | CE | LYS | D | 114 | 27.812 | 54.779 | −11.536 | 1.00 | 43.93 | GZ00 C |
| ATOM | 2527 | NZ | LYS | D | 114 | 26.918 | 54.529 | −12.718 | 1.00 | 45.98 | GZ00 N1+ |
| ATOM | 2528 | N | ALA | D | 115 | 29.108 | 49.806 | −7.107 | 1.00 | 37.03 | GZ00 N |
| ATOM | 2529 | CA | ALA | D | 115 | 29.084 | 48.455 | −6.562 | 1.00 | 31.87 | GZ00 C |
| ATOM | 2530 | C | ALA | D | 115 | 27.754 | 47.802 | −6.906 | 1.00 | 41.28 | GZ00 C |
| ATOM | 2531 | O | ALA | D | 115 | 26.691 | 48.304 | −6.514 | 1.00 | 37.09 | GZ00 O |
| ATOM | 2532 | CB | ALA | D | 115 | 29.280 | 48.470 | −5.040 | 1.00 | 29.90 | GZ00 C |
| ATOM | 2533 | N | ALA | D | 116 | 27.816 | 46.676 | −7.610 | 1.00 | 34.16 | GZ00 N |
| ATOM | 2534 | CA | ALA | D | 116 | 26.622 | 45.929 | −7.933 | 1.00 | 37.15 | GZ00 C |
| ATOM | 2535 | C | ALA | D | 116 | 26.071 | 45.289 | −6.658 | 1.00 | 37.53 | GZ00 C |
| ATOM | 2536 | O | ALA | D | 116 | 26.816 | 45.037 | −5.715 | 1.00 | 41.85 | GZ00 O |
| ATOM | 2537 | CB | ALA | D | 116 | 26.937 | 44.870 | −8.989 | 1.00 | 28.78 | GZ00 C |
| ATOM | 2538 | N | PRO | D | 117 | 24.772 | 45.028 | −6.594 | 1.00 | 40.96 | GZ00 N |
| ATOM | 2539 | CA | PRO | D | 117 | 24.207 | 44.481 | −5.355 | 1.00 | 39.65 | GZ00 C |
| ATOM | 2540 | C | PRO | D | 117 | 24.590 | 43.022 | −5.180 | 1.00 | 40.39 | GZ00 C |
| ATOM | 2541 | O | PRO | D | 117 | 24.686 | 42.263 | −6.149 | 1.00 | 43.42 | GZ00 O |
| ATOM | 2542 | CB | PRO | D | 117 | 22.699 | 44.620 | −5.568 | 1.00 | 37.24 | GZ00 C |
| ATOM | 2543 | CG | PRO | D | 117 | 22.553 | 44.435 | −7.049 | 1.00 | 32.78 | GZ00 C |
| ATOM | 2544 | CD | PRO | D | 117 | 23.761 | 45.109 | −7.664 | 1.00 | 38.78 | GZ00 C |
| ATOM | 2545 | N | SER | D | 118 | 24.817 | 42.626 | −3.934 | 1.00 | 40.21 | GZ00 N |
| ATOM | 2546 | CA | SER | D | 118 | 24.859 | 41.203 | −3.626 | 1.00 | 43.65 | GZ00 C |
| ATOM | 2547 | C | SER | D | 118 | 23.460 | 40.793 | −3.190 | 1.00 | 44.22 | GZ00 C |
| ATOM | 2548 | O | SER | D | 118 | 22.822 | 41.475 | −2.371 | 1.00 | 39.75 | GZ00 O |
| ATOM | 2549 | CB | SER | D | 118 | 25.901 | 40.867 | −2.559 | 1.00 | 37.70 | GZ00 C |
| ATOM | 2550 | OG | SER | D | 118 | 25.559 | 41.468 | −1.335 | 1.00 | 51.03 | GZ00 O |
| ATOM | 2551 | N | VAL | D | 119 | 22.982 | 39.701 | −3.774 | 1.00 | 39.65 | GZ00 N |
| ATOM | 2552 | CA | VAL | D | 119 | 21.609 | 39.244 | −3.641 | 1.00 | 39.06 | GZ00 C |

TABLE 10.3-continued

| ATOM | 2553 | C | VAL | D | 119 | 21.647 | 37.843 | −3.065 | 1.00 | 44.09 | GZ00 | C |
|---|---|---|---|---|---|---|---|---|---|---|---|---|
| ATOM | 2554 | O | VAL | D | 119 | 22.315 | 36.966 | −3.626 | 1.00 | 39.00 | GZ00 | O |
| ATOM | 2555 | CB | VAL | D | 119 | 20.894 | 39.235 | −5.007 | 1.00 | 40.58 | GZ00 | C |
| ATOM | 2556 | CG1 | VAL | D | 119 | 19.469 | 38.765 | −4.865 | 1.00 | 33.51 | GZ00 | C |
| ATOM | 2557 | CG2 | VAL | D | 119 | 20.964 | 40.602 | −5.658 | 1.00 | 38.29 | GZ00 | C |
| ATOM | 2558 | N | THR | D | 120 | 20.928 | 37.620 | −1.963 | 1.00 | 38.97 | GZ00 | N |
| ATOM | 2559 | CA | THR | D | 120 | 20.719 | 36.256 | −1.507 | 1.00 | 40.40 | GZ00 | C |
| ATOM | 2560 | C | THR | D | 120 | 19.218 | 36.005 | −1.360 | 1.00 | 41.57 | GZ00 | C |
| ATOM | 2561 | O | THR | D | 120 | 18.487 | 36.826 | −0.798 | 1.00 | 39.96 | GZ00 | O |
| ATOM | 2562 | CB | THR | D | 120 | 21.524 | 35.939 | −0.211 | 1.00 | 48.39 | GZ00 | C |
| ATOM | 2563 | OG1 | THR | D | 120 | 20.649 | 35.655 | 0.882 | 1.00 | 55.57 | GZ00 | O |
| ATOM | 2564 | CG2 | THR | D | 120 | 22.506 | 37.053 | 0.178 | 1.00 | 42.25 | GZ00 | C |
| ATOM | 2565 | N | LEU | D | 121 | 18.761 | 34.879 | −1.903 | 1.00 | 42.65 | GZ00 | N |
| ATOM | 2566 | CA | LEU | D | 121 | 17.343 | 34.562 | −2.031 | 1.00 | 44.51 | GZ00 | C |
| ATOM | 2567 | C | LEU | D | 121 | 17.063 | 33.332 | −1.184 | 1.00 | 42.61 | GZ00 | C |
| ATOM | 2568 | O | LEU | D | 121 | 17.626 | 32.269 | −1.444 | 1.00 | 39.39 | GZ00 | O |
| ATOM | 2569 | CB | LEU | D | 121 | 16.993 | 34.281 | −3.495 | 1.00 | 42.30 | GZ00 | C |
| ATOM | 2570 | CG | LEU | D | 121 | 15.574 | 34.358 | −4.059 | 1.00 | 45.15 | GZ00 | C |
| ATOM | 2571 | CD1 | LEU | D | 121 | 15.333 | 33.234 | −5.034 | 1.00 | 45.85 | GZ00 | C |
| ATOM | 2572 | CD2 | LEU | D | 121 | 14.485 | 34.413 | −2.986 | 1.00 | 44.86 | GZ00 | C |
| ATOM | 2573 | N | PHE | D | 122 | 16.200 | 33.467 | −0.209 | 1.00 | 37.70 | GZ00 | N |
| ATOM | 2574 | CA | PHE | D | 122 | 15.865 | 32.293 | 0.587 | 1.00 | 43.33 | GZ00 | C |
| ATOM | 2575 | C | PHE | D | 122 | 14.487 | 31.766 | 0.221 | 1.00 | 49.36 | GZ00 | C |
| ATOM | 2576 | O | PHE | D | 122 | 13.539 | 32.551 | 0.069 | 1.00 | 41.30 | GZ00 | O |
| ATOM | 2577 | CB | PHE | D | 122 | 15.850 | 32.606 | 2.079 | 1.00 | 39.48 | GZ00 | C |
| ATOM | 2578 | CG | PHE | D | 122 | 17.181 | 32.910 | 2.660 | 1.00 | 38.94 | GZ00 | C |
| ATOM | 2579 | CD1 | PHE | D | 122 | 18.057 | 31.887 | 2.982 | 1.00 | 38.46 | GZ00 | C |
| ATOM | 2580 | CD2 | PHE | D | 122 | 17.533 | 34.229 | 2.949 | 1.00 | 36.53 | GZ00 | C |
| ATOM | 2581 | CE1 | PHE | D | 122 | 19.288 | 32.169 | 3.550 | 1.00 | 45.61 | GZ00 | C |
| ATOM | 2582 | CE2 | PHE | D | 122 | 18.740 | 34.526 | 3.528 | 1.00 | 38.72 | GZ00 | C |
| ATOM | 2583 | CZ | PHE | D | 122 | 19.636 | 33.494 | 3.830 | 1.00 | 40.64 | GZ00 | C |
| ATOM | 2584 | N | PRO | D | 123 | 14.347 | 30.448 | 0.130 | 1.00 | 50.41 | GZ00 | N |
| ATOM | 2585 | CA | PRO | D | 123 | 13.024 | 29.850 | −0.048 | 1.00 | 46.66 | GZ00 | C |
| ATOM | 2586 | C | PRO | D | 123 | 12.262 | 29.853 | 1.266 | 1.00 | 47.32 | GZ00 | C |
| ATOM | 2587 | O | PRO | D | 123 | 12.829 | 30.182 | 2.317 | 1.00 | 41.78 | GZ00 | O |
| ATOM | 2588 | CB | PRO | D | 123 | 13.356 | 28.423 | −0.505 | 1.00 | 53.34 | GZ00 | C |
| ATOM | 2589 | CG | PRO | D | 123 | 14.625 | 28.122 | 0.208 | 1.00 | 54.44 | GZ00 | C |
| ATOM | 2590 | CD | PRO | D | 123 | 15.402 | 29.428 | 0.251 | 1.00 | 49.34 | GZ00 | C |
| ATOM | 2591 | N | PRO | D | 124 | 10.968 | 29.530 | 1.259 | 1.00 | 54.23 | GZ00 | N |
| ATOM | 2592 | CA | PRO | D | 124 | 10.243 | 29.456 | 2.533 | 1.00 | 49.80 | GZ00 | C |
| ATOM | 2593 | C | PRO | D | 124 | 10.766 | 28.290 | 3.353 | 1.00 | 47.27 | GZ00 | C |
| ATOM | 2594 | O | PRO | D | 124 | 11.127 | 27.246 | 2.809 | 1.00 | 40.84 | GZ00 | O |
| ATOM | 2595 | CB | PRO | D | 124 | 8.786 | 29.239 | 2.109 | 1.00 | 52.85 | GZ00 | C |
| ATOM | 2596 | CG | PRO | D | 124 | 8.882 | 28.604 | 0.771 | 1.00 | 58.62 | GZ00 | C |
| ATOM | 2597 | CD | PRO | D | 124 | 10.120 | 29.144 | 0.117 | 1.00 | 50.64 | GZ00 | C |
| ATOM | 2598 | N | SER | D | 125 | 10.848 | 28.487 | 4.665 | 1.00 | 47.15 | GZ00 | N |
| ATOM | 2599 | CA | SER | D | 125 | 11.315 | 27.415 | 5.533 | 1.00 | 46.19 | GZ00 | C |
| ATOM | 2600 | C | SER | D | 125 | 10.226 | 26.360 | 5.725 | 1.00 | 55.91 | GZ00 | C |
| ATOM | 2601 | O | SER | D | 125 | 9.024 | 26.627 | 5.602 | 1.00 | 48.89 | GZ00 | O |
| ATOM | 2602 | CB | SER | D | 125 | 11.725 | 27.963 | 6.895 | 1.00 | 46.67 | GZ00 | C |
| ATOM | 2603 | OG | SER | D | 125 | 10.587 | 28.428 | 7.610 | 1.00 | 43.78 | GZ00 | O |
| ATOM | 2604 | N | SER | D | 126 | 10.661 | 25.150 | 6.076 | 1.00 | 53.45 | GZ00 | N |
| ATOM | 2605 | CA | SER | D | 126 | 9.697 | 24.081 | 6.294 | 1.00 | 49.33 | GZ00 | C |
| ATOM | 2606 | C | SER | D | 126 | 8.769 | 24.420 | 7.455 | 1.00 | 51.40 | GZ00 | C |
| ATOM | 2607 | O | SER | D | 126 | 7.564 | 24.166 | 7.392 | 1.00 | 57.31 | GZ00 | O |
| ATOM | 2608 | CB | SER | D | 126 | 10.432 | 22.769 | 6.528 | 1.00 | 46.88 | GZ00 | C |
| ATOM | 2609 | OG | SER | D | 126 | 11.378 | 22.938 | 7.552 | 1.00 | 58.67 | GZ00 | O |
| ATOM | 2610 | N | GLU | D | 127 | 9.303 | 25.045 | 8.500 | 1.00 | 46.78 | GZ00 | N |
| ATOM | 2611 | CA | GLU | D | 127 | 8.464 | 25.457 | 9.621 | 1.00 | 50.81 | GZ00 | C |
| ATOM | 2612 | C | GLU | D | 127 | 7.347 | 26.393 | 9.173 | 1.00 | 60.09 | GZ00 | C |
| ATOM | 2613 | O | GLU | D | 127 | 6.256 | 26.382 | 9.759 | 1.00 | 61.69 | GZ00 | O |
| ATOM | 2614 | CB | GLU | D | 127 | 9.329 | 26.118 | 10.686 | 1.00 | 53.57 | GZ00 | C |
| ATOM | 2615 | CG | GLU | D | 127 | 10.626 | 25.340 | 10.894 | 1.00 | 62.62 | GZ00 | C |
| ATOM | 2616 | CD | GLU | D | 127 | 11.443 | 25.816 | 12.072 | 1.00 | 72.05 | GZ00 | C |
| ATOM | 2617 | OE1 | GLU | D | 127 | 10.899 | 26.562 | 12.933 | 1.00 | 69.83 | GZ00 | O |
| ATOM | 2618 | OE2 | GLU | D | 127 | 12.635 | 25.426 | 12.129 | 1.00 | 72.47 | GZ00 | O1− |
| ATOM | 2619 | N | GLU | D | 128 | 7.608 | 27.240 | 8.170 | 1.00 | 56.85 | GZ00 | N |
| ATOM | 2620 | CA | GLU | D | 128 | 6.568 | 28.148 | 7.700 | 1.00 | 54.23 | GZ00 | C |
| ATOM | 2621 | C | GLU | D | 128 | 5.590 | 27.441 | 6.774 | 1.00 | 52.82 | GZ00 | C |
| ATOM | 2622 | O | GLU | D | 128 | 4.390 | 27.728 | 6.804 | 1.00 | 53.66 | GZ00 | O |
| ATOM | 2623 | CB | GLU | D | 128 | 7.174 | 29.364 | 6.983 | 1.00 | 52.45 | GZ00 | C |
| ATOM | 2624 | CG | GLU | D | 128 | 6.132 | 30.482 | 6.745 | 1.00 | 57.44 | GZ00 | C |
| ATOM | 2625 | CD | GLU | D | 128 | 6.545 | 31.555 | 5.722 | 1.00 | 58.50 | GZ00 | C |
| ATOM | 2626 | OE1 | GLU | D | 128 | 5.856 | 32.590 | 5.684 | 1.00 | 54.07 | GZ00 | O |
| ATOM | 2627 | OE2 | GLU | D | 128 | 7.518 | 31.373 | 4.950 | 1.00 | 49.75 | GZ00 | O1− |
| ATOM | 2628 | N | LEU | D | 129 | 6.095 | 26.539 | 5.927 | 1.00 | 52.50 | GZ00 | N |
| ATOM | 2629 | CA | LEU | D | 129 | 5.226 | 25.707 | 5.104 | 1.00 | 51.40 | GZ00 | C |
| ATOM | 2630 | C | LEU | D | 129 | 4.279 | 24.879 | 5.969 | 1.00 | 59.74 | GZ00 | C |
| ATOM | 2631 | O | LEU | D | 129 | 3.106 | 24.702 | 5.623 | 1.00 | 63.72 | GZ00 | O |
| ATOM | 2632 | CB | LEU | D | 129 | 6.078 | 24.807 | 4.214 | 1.00 | 51.65 | GZ00 | C |

TABLE 10.3-continued

| | | | | | | | | | | | |
|---|---|---|---|---|---|---|---|---|---|---|---|
| ATOM | 2633 | CG | LEU | D | 129 | 6.868 | 25.538 | 3.131 | 1.00 | 52.87 | GZ00 | C |
| ATOM | 2634 | CD1 | LEU | D | 129 | 7.857 | 24.604 | 2.459 | 1.00 | 44.54 | GZ00 | C |
| ATOM | 2635 | CD2 | LEU | D | 129 | 5.917 | 26.140 | 2.101 | 1.00 | 49.64 | GZ00 | C |
| ATOM | 2636 | N | GLN | D | 130 | 4.767 | 24.388 | 7.115 | 1.00 | 54.99 | GZ00 | N |
| ATOM | 2637 | CA | GLN | D | 130 | 3.913 | 23.640 | 8.032 | 1.00 | 66.06 | GZ00 | C |
| ATOM | 2638 | C | GLN | D | 130 | 2.760 | 24.489 | 8.552 | 1.00 | 64.20 | GZ00 | C |
| ATOM | 2639 | O | GLN | D | 130 | 1.673 | 23.958 | 8.810 | 1.00 | 68.64 | GZ00 | O |
| ATOM | 2640 | CB | GLN | D | 130 | 4.729 | 23.097 | 9.210 | 1.00 | 64.34 | GZ00 | C |
| ATOM | 2641 | CG | GLN | D | 130 | 5.729 | 22.005 | 8.863 | 1.00 | 65.01 | GZ00 | C |
| ATOM | 2642 | CD | GLN | D | 130 | 6.363 | 21.409 | 10.113 | 1.00 | 78.91 | GZ00 | C |
| ATOM | 2643 | OE1 | GLN | D | 130 | 5.663 | 21.103 | 11.083 | 1.00 | 88.40 | GZ00 | O |
| ATOM | 2644 | NE2 | GLN | D | 130 | 7.691 | 21.262 | 10.108 | 1.00 | 62.99 | GZ00 | N |
| ATOM | 2645 | N | ALA | D | 131 | 2.972 | 25.794 | 8.729 | 1.00 | 53.92 | GZ00 | N |
| ATOM | 2646 | CA | ALA | D | 131 | 1.903 | 26.700 | 9.129 | 1.00 | 51.41 | GZ00 | C |
| ATOM | 2647 | C | ALA | D | 131 | 1.100 | 27.196 | 7.943 | 1.00 | 56.66 | GZ00 | C |
| ATOM | 2648 | O | ALA | D | 131 | 0.366 | 28.184 | 8.075 | 1.00 | 63.18 | GZ00 | O |
| ATOM | 2649 | CB | ALA | D | 131 | 2.459 | 27.889 | 9.915 | 1.00 | 45.31 | GZ00 | C |
| ATOM | 2650 | N | ASN | D | 132 | 1.246 | 26.543 | 6.784 | 1.00 | 55.73 | GZ00 | N |
| ATOM | 2651 | CA | ASN | D | 132 | 0.472 | 26.840 | 5.573 | 1.00 | 65.28 | GZ00 | C |
| ATOM | 2652 | C | ASN | D | 132 | 0.645 | 28.283 | 5.100 | 1.00 | 66.61 | GZ00 | C |
| ATOM | 2653 | O | ASN | D | 132 | −0.264 | 28.869 | 4.507 | 1.00 | 68.44 | GZ00 | O |
| ATOM | 2654 | CB | ASN | D | 132 | −1.018 | 26.502 | 5.762 | 1.00 | 67.97 | GZ00 | C |
| ATOM | 2655 | CG | ASN | D | 132 | −1.347 | 25.065 | 5.335 | 1.00 | 88.31 | GZ00 | C |
| ATOM | 2656 | OD1 | ASN | D | 132 | −1.487 | 24.776 | 4.134 | 1.00 | 78.43 | GZ00 | O |
| ATOM | 2657 | ND2 | ASN | D | 132 | −1.448 | 24.155 | 6.318 | 1.00 | 80.50 | GZ00 | N |
| ATOM | 2658 | N | LYS | D | 133 | 1.812 | 28.866 | 5.352 | 1.00 | 68.70 | GZ00 | N |
| ATOM | 2659 | CA | LYS | D | 133 | 2.244 | 30.090 | 4.696 | 1.00 | 59.67 | GZ00 | C |
| ATOM | 2660 | C | LYS | D | 133 | 3.522 | 29.799 | 3.923 | 1.00 | 57.71 | GZ00 | C |
| ATOM | 2661 | O | LYS | D | 133 | 4.135 | 28.737 | 4.069 | 1.00 | 58.17 | GZ00 | O |
| ATOM | 2662 | CB | LYS | D | 133 | 2.468 | 31.225 | 5.701 | 1.00 | 52.27 | GZ00 | C |
| ATOM | 2663 | CG | LYS | D | 133 | 1.236 | 31.650 | 6.454 | 1.00 | 58.15 | GZ00 | C |
| ATOM | 2664 | CD | LYS | D | 133 | 1.590 | 32.644 | 7.547 | 1.00 | 82.46 | GZ00 | C |
| ATOM | 2665 | CE | LYS | D | 133 | 0.389 | 32.977 | 8.428 | 1.00 | 90.01 | GZ00 | C |
| ATOM | 2666 | NZ | LYS | D | 133 | −0.049 | 31.789 | 9.221 | 1.00 | 85.20 | GZ00 | N1+ |
| ATOM | 2667 | N | ALA | D | 134 | 3.923 | 30.754 | 3.087 | 1.00 | 59.30 | GZ00 | N |
| ATOM | 2668 | CA | ALA | D | 134 | 5.167 | 30.615 | 2.328 | 1.00 | 57.19 | GZ00 | C |
| ATOM | 2669 | C | ALA | D | 134 | 5.607 | 31.994 | 1.872 | 1.00 | 56.76 | GZ00 | C |
| ATOM | 2670 | O | ALA | D | 134 | 4.842 | 32.692 | 1.196 | 1.00 | 55.80 | GZ00 | O |
| ATOM | 2671 | CB | ALA | D | 134 | 4.985 | 29.678 | 1.129 | 1.00 | 53.33 | GZ00 | C |
| ATOM | 2672 | N | THR | D | 135 | 6.826 | 32.399 | 2.238 | 1.00 | 51.12 | GZ00 | N |
| ATOM | 2673 | CA | THR | D | 135 | 7.368 | 33.652 | 1.730 | 1.00 | 46.27 | GZ00 | C |
| ATOM | 2674 | C | THR | D | 135 | 8.764 | 33.429 | 1.168 | 1.00 | 50.06 | GZ00 | C |
| ATOM | 2675 | O | THR | D | 135 | 9.604 | 32.783 | 1.803 | 1.00 | 41.99 | GZ00 | O |
| ATOM | 2676 | CB | THR | D | 135 | 7.422 | 34.735 | 2.803 | 1.00 | 43.17 | GZ00 | C |
| ATOM | 2677 | OG1 | THR | D | 135 | 8.619 | 34.572 | 3.555 | 1.00 | 70.40 | GZ00 | O |
| ATOM | 2678 | CG2 | THR | D | 135 | 6.270 | 34.632 | 3.735 | 1.00 | 40.85 | GZ00 | C |
| ATOM | 2679 | N | LEU | D | 136 | 9.002 | 33.964 | −0.025 | 1.00 | 49.86 | GZ00 | N |
| ATOM | 2680 | CA | LEU | D | 136 | 10.344 | 34.047 | −0.574 | 1.00 | 43.03 | GZ00 | C |
| ATOM | 2681 | C | LEU | D | 136 | 10.956 | 35.371 | −0.127 | 1.00 | 44.71 | GZ00 | C |
| ATOM | 2682 | O | LEU | D | 136 | 10.274 | 36.400 | −0.088 | 1.00 | 45.54 | GZ00 | O |
| ATOM | 2683 | CB | LEU | D | 136 | 10.328 | 33.951 | −2.101 | 1.00 | 48.82 | GZ00 | C |
| ATOM | 2684 | CG | LEU | D | 136 | 9.744 | 32.685 | −2.734 | 1.00 | 50.57 | GZ00 | C |
| ATOM | 2685 | CD1 | LEU | D | 136 | 9.722 | 32.777 | −4.241 | 1.00 | 43.90 | GZ00 | C |
| ATOM | 2686 | CD2 | LEU | D | 136 | 10.592 | 31.534 | −2.313 | 1.00 | 54.51 | GZ00 | C |
| ATOM | 2687 | N | VAL | D | 137 | 12.231 | 35.329 | 0.251 | 1.00 | 38.61 | GZ00 | N |
| ATOM | 2688 | CA | VAL | D | 137 | 12.914 | 36.459 | 0.867 | 1.00 | 39.76 | GZ00 | C |
| ATOM | 2689 | C | VAL | D | 137 | 14.144 | 36.781 | 0.037 | 1.00 | 43.30 | GZ00 | C |
| ATOM | 2690 | O | VAL | D | 137 | 15.046 | 35.946 | −0.086 | 1.00 | 43.19 | GZ00 | O |
| ATOM | 2691 | CB | VAL | D | 137 | 13.286 | 36.167 | 2.326 | 1.00 | 40.83 | GZ00 | C |
| ATOM | 2692 | CG1 | VAL | D | 137 | 13.930 | 37.386 | 2.954 | 1.00 | 40.34 | GZ00 | C |
| ATOM | 2693 | CG2 | VAL | D | 137 | 12.032 | 35.756 | 3.116 | 1.00 | 39.27 | GZ00 | C |
| ATOM | 2694 | N | CYS | D | 138 | 14.161 | 37.969 | −0.563 | 1.00 | 39.42 | GZ00 | N |
| ATOM | 2695 | CA | CYS | D | 138 | 15.270 | 38.436 | −1.392 | 1.00 | 38.06 | GZ00 | C |
| ATOM | 2696 | C | CYS | D | 138 | 15.958 | 39.590 | −0.669 | 1.00 | 42.98 | GZ00 | C |
| ATOM | 2697 | O | CYS | D | 138 | 15.379 | 40.679 | −0.549 | 1.00 | 42.34 | GZ00 | O |
| ATOM | 2698 | CB | CYS | D | 138 | 14.764 | 38.869 | −2.767 | 1.00 | 46.28 | GZ00 | C |
| ATOM | 2699 | SG | CYS | D | 138 | 16.005 | 39.055 | −4.058 | 1.00 | 46.59 | GZ00 | S |
| ATOM | 2700 | N | LEU | D | 139 | 17.165 | 39.345 | −0.149 | 1.00 | 35.86 | GZ00 | N |
| ATOM | 2701 | CA | LEU | D | 139 | 17.953 | 40.386 | 0.503 | 1.00 | 34.94 | GZ00 | C |
| ATOM | 2702 | C | LEU | D | 139 | 18.994 | 40.946 | −0.456 | 1.00 | 40.09 | GZ00 | C |
| ATOM | 2703 | O | LEU | D | 139 | 19.692 | 40.198 | −1.153 | 1.00 | 38.00 | GZ00 | O |
| ATOM | 2704 | CB | LEU | D | 139 | 18.641 | 39.914 | 1.784 | 1.00 | 38.60 | GZ00 | C |
| ATOM | 2705 | CG | LEU | D | 139 | 17.851 | 39.429 | 2.994 | 1.00 | 42.05 | GZ00 | C |
| ATOM | 2706 | CD1 | LEU | D | 139 | 16.412 | 39.996 | 2.992 | 1.00 | 34.31 | GZ00 | C |
| ATOM | 2707 | CD2 | LEU | D | 139 | 17.888 | 37.954 | 3.110 | 1.00 | 41.56 | GZ00 | C |
| ATOM | 2708 | N | ILE | D | 140 | 19.072 | 42.271 | −0.498 | 1.00 | 36.85 | GZ00 | N |
| ATOM | 2709 | CA | ILE | D | 140 | 19.852 | 42.991 | −1.490 | 1.00 | 40.84 | GZ00 | C |
| ATOM | 2710 | C | ILE | D | 140 | 20.717 | 43.982 | −0.735 | 1.00 | 39.30 | GZ00 | C |
| ATOM | 2711 | O | ILE | D | 140 | 20.196 | 44.821 | 0.012 | 1.00 | 36.82 | GZ00 | O |
| ATOM | 2712 | CB | ILE | D | 140 | 18.946 | 43.703 | −2.510 | 1.00 | 36.07 | GZ00 | C |

TABLE 10.3-continued

| | | | | | | | | | | | |
|---|---|---|---|---|---|---|---|---|---|---|---|
| ATOM | 2713 | CG1 | ILE | D | 140 | 17.852 | 42.738 | −2.998 | 1.00 | 41.84 | GZ00 C |
| ATOM | 2714 | CG2 | ILE | D | 140 | 19.749 | 44.191 | −3.673 | 1.00 | 33.32 | GZ00 C |
| ATOM | 2715 | CD1 | ILE | D | 140 | 16.606 | 43.414 | −3.540 | 1.00 | 40.09 | GZ00 C |
| ATOM | 2716 | N | SER | D | 141 | 22.028 | 43.899 | −0.928 | 1.00 | 33.24 | GZ00 N |
| ATOM | 2717 | CA | SER | D | 141 | 22.918 | 44.678 | −0.083 | 1.00 | 40.45 | GZ00 C |
| ATOM | 2718 | C | SER | D | 141 | 24.146 | 45.120 | −0.865 | 1.00 | 40.51 | GZ00 C |
| ATOM | 2719 | O | SER | D | 141 | 24.453 | 44.592 | −1.948 | 1.00 | 33.29 | GZ00 O |
| ATOM | 2720 | CB | SER | D | 141 | 23.348 | 43.878 | 1.155 | 1.00 | 39.86 | GZ00 C |
| ATOM | 2721 | OG | SER | D | 141 | 23.964 | 42.664 | 0.748 | 1.00 | 40.92 | GZ00 O |
| ATOM | 2722 | N | ASP | D | 142 | 24.835 | 46.117 | −0.288 | 1.00 | 34.55 | GZ00 N |
| ATOM | 2723 | CA | ASP | D | 142 | 26.137 | 46.573 | −0.776 | 1.00 | 45.39 | GZ00 C |
| ATOM | 2724 | C | ASP | D | 142 | 26.059 | 47.148 | −2.192 | 1.00 | 42.72 | GZ00 C |
| ATOM | 2725 | O | ASP | D | 142 | 26.985 | 46.983 | −2.988 | 1.00 | 37.05 | GZ00 O |
| ATOM | 2726 | CB | ASP | D | 142 | 27.165 | 45.436 | −0.742 | 1.00 | 42.27 | GZ00 C |
| ATOM | 2727 | CG | ASP | D | 142 | 27.636 | 45.114 | 0.650 | 1.00 | 45.03 | GZ00 C |
| ATOM | 2728 | OD1 | ASP | D | 142 | 27.734 | 46.043 | 1.489 | 1.00 | 49.79 | GZ00 O |
| ATOM | 2729 | OD2 | ASP | D | 142 | 27.890 | 43.921 | 0.902 | 1.00 | 52.25 | GZ00 O1− |
| ATOM | 2730 | N | PHE | D | 143 | 24.967 | 47.826 | −2.529 | 1.00 | 33.33 | GZ00 N |
| ATOM | 2731 | CA | PHE | D | 143 | 24.908 | 48.407 | −3.858 | 1.00 | 35.29 | GZ00 C |
| ATOM | 2732 | C | PHE | D | 143 | 25.067 | 49.921 | −3.775 | 1.00 | 33.78 | GZ00 C |
| ATOM | 2733 | O | PHE | D | 143 | 24.717 | 50.556 | −2.773 | 1.00 | 36.42 | GZ00 O |
| ATOM | 2734 | CB | PHE | D | 143 | 23.637 | 48.009 | −4.617 | 1.00 | 34.97 | GZ00 C |
| ATOM | 2735 | CG | PHE | D | 143 | 22.340 | 48.333 | −3.911 | 1.00 | 35.61 | GZ00 C |
| ATOM | 2736 | CD1 | PHE | D | 143 | 21.712 | 49.549 | −4.113 | 1.00 | 32.64 | GZ00 C |
| ATOM | 2737 | CD2 | PHE | D | 143 | 21.709 | 47.379 | −3.112 | 1.00 | 38.53 | GZ00 C |
| ATOM | 2738 | CE1 | PHE | D | 143 | 20.485 | 49.834 | −3.493 | 1.00 | 41.16 | GZ00 C |
| ATOM | 2739 | CE2 | PHE | D | 143 | 20.494 | 47.658 | −2.486 | 1.00 | 40.15 | GZ00 C |
| ATOM | 2740 | CZ | PHE | D | 143 | 19.880 | 48.890 | −2.672 | 1.00 | 32.95 | GZ00 C |
| ATOM | 2741 | N | TYR | D | 144 | 25.665 | 50.471 | −4.824 | 1.00 | 35.76 | GZ00 N |
| ATOM | 2742 | CA | TYR | D | 144 | 26.002 | 51.882 | −4.906 | 1.00 | 37.17 | GZ00 C |
| ATOM | 2743 | C | TYR | D | 144 | 26.142 | 52.286 | −6.363 | 1.00 | 41.07 | GZ00 C |
| ATOM | 2744 | O | TYR | D | 144 | 26.899 | 51.649 | −7.096 | 1.00 | 40.05 | GZ00 O |
| ATOM | 2745 | CB | TYR | D | 144 | 27.305 | 52.176 | −4.182 | 1.00 | 31.07 | GZ00 C |
| ATOM | 2746 | CG | TYR | D | 144 | 27.652 | 53.644 | −4.148 | 1.00 | 33.84 | GZ00 C |
| ATOM | 2747 | CD1 | TYR | D | 144 | 27.125 | 54.478 | −3.168 | 1.00 | 34.22 | GZ00 C |
| ATOM | 2748 | CD2 | TYR | D | 144 | 28.485 | 54.207 | −5.107 | 1.00 | 34.49 | GZ00 C |
| ATOM | 2749 | CE1 | TYR | D | 144 | 27.433 | 55.822 | −3.129 | 1.00 | 36.40 | GZ00 C |
| ATOM | 2750 | CE2 | TYR | D | 144 | 28.800 | 55.559 | −5.076 | 1.00 | 35.36 | GZ00 C |
| ATOM | 2751 | CZ | TYR | D | 144 | 28.271 | 56.358 | −4.082 | 1.00 | 35.95 | GZ00 C |
| ATOM | 2752 | OH | TYR | D | 144 | 28.578 | 57.699 | −4.037 | 1.00 | 40.59 | GZ00 O |
| ATOM | 2753 | N | PRO | D | 145 | 25.442 | 53.357 | −6.782 | 1.00 | 35.13 | GZ00 N |
| ATOM | 2754 | CA | PRO | D | 145 | 24.556 | 54.168 | −5.930 | 1.00 | 41.08 | GZ00 C |
| ATOM | 2755 | C | PRO | D | 145 | 23.258 | 53.476 | −5.465 | 1.00 | 39.60 | GZ00 C |
| ATOM | 2756 | O | PRO | D | 145 | 22.944 | 52.359 | −5.874 | 1.00 | 35.16 | GZ00 O |
| ATOM | 2757 | CB | PRO | D | 145 | 24.231 | 55.395 | −6.811 | 1.00 | 40.78 | GZ00 C |
| ATOM | 2758 | CG | PRO | D | 145 | 24.659 | 55.048 | −8.190 | 1.00 | 39.08 | GZ00 C |
| ATOM | 2759 | CD | PRO | D | 145 | 25.708 | 53.989 | −8.088 | 1.00 | 36.76 | GZ00 C |
| ATOM | 2760 | N | GLY | D | 146 | 22.514 | 54.161 | −4.600 | 1.00 | 34.87 | GZ00 N |
| ATOM | 2761 | CA | GLY | D | 146 | 21.429 | 53.525 | −3.892 | 1.00 | 34.83 | GZ00 C |
| ATOM | 2762 | C | GLY | D | 146 | 20.087 | 53.444 | −4.593 | 1.00 | 36.93 | GZ00 C |
| ATOM | 2763 | O | GLY | D | 146 | 19.088 | 53.931 | −4.062 | 1.00 | 34.26 | GZ00 O |
| ATOM | 2764 | N | ALA | D | 147 | 20.037 | 52.844 | −5.777 | 1.00 | 32.90 | GZ00 N |
| ATOM | 2765 | CA | ALA | D | 147 | 18.750 | 52.609 | −6.410 | 1.00 | 32.84 | GZ00 C |
| ATOM | 2766 | C | ALA | D | 147 | 18.802 | 51.314 | −7.178 | 1.00 | 32.60 | GZ00 C |
| ATOM | 2767 | O | ALA | D | 147 | 19.792 | 51.008 | −7.841 | 1.00 | 39.02 | GZ00 O |
| ATOM | 2768 | CB | ALA | D | 147 | 18.326 | 53.719 | −7.365 | 1.00 | 29.65 | GZ00 C |
| ATOM | 2769 | N | VAL | D | 148 | 17.684 | 50.603 | −7.141 | 1.00 | 33.58 | GZ00 N |
| ATOM | 2770 | CA | VAL | D | 148 | 17.588 | 49.253 | −7.651 | 1.00 | 34.66 | GZ00 C |
| ATOM | 2771 | C | VAL | D | 148 | 16.121 | 49.045 | −7.985 | 1.00 | 41.83 | GZ00 C |
| ATOM | 2772 | O | VAL | D | 148 | 15.247 | 49.684 | −7.396 | 1.00 | 32.66 | GZ00 O |
| ATOM | 2773 | CB | VAL | D | 148 | 18.126 | 48.264 | −6.582 | 1.00 | 38.73 | GZ00 C |
| ATOM | 2774 | CG1 | VAL | D | 148 | 17.030 | 47.484 | −5.915 | 1.00 | 37.24 | GZ00 C |
| ATOM | 2775 | CG2 | VAL | D | 148 | 19.218 | 47.381 | −7.146 | 1.00 | 41.31 | GZ00 C |
| ATOM | 2776 | N | THR | D | 149 | 15.845 | 48.198 | −8.967 | 1.00 | 38.40 | GZ00 N |
| ATOM | 2777 | CA | THR | D | 149 | 14.472 | 47.753 | −9.182 | 1.00 | 44.38 | GZ00 C |
| ATOM | 2778 | C | THR | D | 149 | 14.427 | 46.229 | −9.138 | 1.00 | 46.22 | GZ00 C |
| ATOM | 2779 | O | THR | D | 149 | 15.385 | 45.556 | −9.546 | 1.00 | 43.23 | GZ00 O |
| ATOM | 2780 | CB | THR | D | 149 | 13.899 | 48.266 | −10.513 | 1.00 | 46.92 | GZ00 C |
| ATOM | 2781 | OG1 | THR | D | 149 | 14.727 | 47.815 | −11.599 | 1.00 | 50.51 | GZ00 O |
| ATOM | 2782 | CG2 | THR | D | 149 | 13.810 | 49.796 | −10.512 | 1.00 | 38.30 | GZ00 C |
| ATOM | 2783 | N | VAL | D | 150 | 13.311 | 45.686 | −8.642 | 1.00 | 36.64 | GZ00 N |
| ATOM | 2784 | CA | VAL | D | 150 | 13.203 | 44.262 | −8.355 | 1.00 | 39.12 | GZ00 C |
| ATOM | 2785 | C | VAL | D | 150 | 12.046 | 43.662 | −9.128 | 1.00 | 38.75 | GZ00 C |
| ATOM | 2786 | O | VAL | D | 150 | 10.920 | 44.160 | −9.054 | 1.00 | 46.61 | GZ00 O |
| ATOM | 2787 | CB | VAL | D | 150 | 13.032 | 43.987 | −6.853 | 1.00 | 39.37 | GZ00 C |
| ATOM | 2788 | CG1 | VAL | D | 150 | 12.929 | 42.488 | −6.631 | 1.00 | 41.26 | GZ00 C |
| ATOM | 2789 | CG2 | VAL | D | 150 | 14.213 | 44.522 | −6.121 | 1.00 | 34.76 | GZ00 C |
| ATOM | 2790 | N | ALA | D | 151 | 12.333 | 42.596 | −9.865 | 1.00 | 39.71 | GZ00 N |
| ATOM | 2791 | CA | ALA | D | 151 | 11.333 | 41.805 | −10.560 | 1.00 | 44.18 | GZ00 C |
| ATOM | 2792 | C | ALA | D | 151 | 11.434 | 40.350 | −10.127 | 1.00 | 50.02 | GZ00 C |

TABLE 10.3-continued

| ATOM | 2793 | O | ALA | D | 151 | 12.534 | 39.784 | −10.032 | 1.00 | 47.26 | GZ00 | O |
|---|---|---|---|---|---|---|---|---|---|---|---|---|
| ATOM | 2794 | CB | ALA | D | 151 | 11.494 | 41.895 | −12.081 | 1.00 | 37.34 | GZ00 | C |
| ATOM | 2795 | N | TRP | D | 152 | 10.276 | 39.748 | −9.889 | 1.00 | 47.18 | GZ00 | N |
| ATOM | 2796 | CA | TRP | D | 152 | 10.164 | 38.343 | −9.544 | 1.00 | 47.04 | GZ00 | C |
| ATOM | 2797 | C | TRP | D | 152 | 9.629 | 37.556 | −10.731 | 1.00 | 49.55 | GZ00 | C |
| ATOM | 2798 | O | TRP | D | 152 | 8.800 | 38.055 | −11.498 | 1.00 | 59.75 | GZ00 | O |
| ATOM | 2799 | CB | TRP | D | 152 | 9.248 | 38.155 | −8.345 | 1.00 | 41.47 | GZ00 | C |
| ATOM | 2800 | CG | TRP | D | 152 | 9.799 | 38.641 | −7.051 | 1.00 | 45.78 | GZ00 | C |
| ATOM | 2801 | CD1 | TRP | D | 152 | 9.786 | 39.918 | −6.579 | 1.00 | 49.07 | GZ00 | C |
| ATOM | 2802 | CD2 | TRP | D | 152 | 10.400 | 37.837 | −6.026 | 1.00 | 43.34 | GZ00 | C |
| ATOM | 2803 | NE1 | TRP | D | 152 | 10.361 | 39.967 | −5.325 | 1.00 | 46.95 | GZ00 | N |
| ATOM | 2804 | CE2 | TRP | D | 152 | 10.736 | 38.700 | −4.961 | 1.00 | 46.03 | GZ00 | C |
| ATOM | 2805 | CE3 | TRP | D | 152 | 10.699 | 36.468 | −5.914 | 1.00 | 44.86 | GZ00 | C |
| ATOM | 2806 | CZ2 | TRP | D | 152 | 11.364 | 38.245 | −3.792 | 1.00 | 48.01 | GZ00 | C |
| ATOM | 2807 | CZ3 | TRP | D | 152 | 11.318 | 36.008 | −4.748 | 1.00 | 46.08 | GZ00 | C |
| ATOM | 2808 | CH2 | TRP | D | 152 | 11.649 | 36.905 | −3.702 | 1.00 | 46.48 | GZ00 | C |
| ATOM | 2809 | N | LYS | D | 153 | 10.109 | 36.330 | −10.882 | 1.00 | 54.87 | GZ00 | N |
| ATOM | 2810 | CA | LYS | D | 153 | 9.649 | 35.434 | −11.929 | 1.00 | 57.27 | GZ00 | C |
| ATOM | 2811 | C | LYS | D | 153 | 9.247 | 34.090 | −11.331 | 1.00 | 66.16 | GZ00 | C |
| ATOM | 2812 | O | LYS | D | 153 | 9.884 | 33.591 | −10.396 | 1.00 | 64.92 | GZ00 | O |
| ATOM | 2813 | CB | LYS | D | 153 | 10.728 | 35.247 | −12.999 | 1.00 | 61.27 | GZ00 | C |
| ATOM | 2814 | CG | LYS | D | 153 | 10.832 | 36.442 | −13.910 | 1.00 | 66.71 | GZ00 | C |
| ATOM | 2815 | CD | LYS | D | 153 | 11.805 | 36.232 | −15.044 | 1.00 | 71.68 | GZ00 | C |
| ATOM | 2816 | CE | LYS | D | 153 | 11.839 | 37.483 | −15.930 | 1.00 | 79.74 | GZ00 | C |
| ATOM | 2817 | NZ | LYS | D | 153 | 12.960 | 37.469 | −16.930 | 1.00 | 89.60 | GZ00 | N1+ |
| ATOM | 2818 | N | ALA | D | 154 | 8.145 | 33.543 | −11.836 | 1.00 | 68.05 | GZ00 | N |
| ATOM | 2819 | CA | ALA | D | 154 | 7.729 | 32.169 | −11.568 | 1.00 | 66.27 | GZ00 | C |
| ATOM | 2820 | C | ALA | D | 154 | 7.933 | 31.392 | −12.864 | 1.00 | 70.66 | GZ00 | C |
| ATOM | 2821 | O | ALA | D | 154 | 7.229 | 31.641 | −13.848 | 1.00 | 74.13 | GZ00 | O |
| ATOM | 2822 | CB | ALA | D | 154 | 6.280 | 32.108 | −11.092 | 1.00 | 57.49 | GZ00 | C |
| ATOM | 2823 | N | ASP | D | 155 | 8.892 | 30.464 | −12.866 | 1.00 | 69.01 | GZ00 | N |
| ATOM | 2824 | CA | ASP | D | 155 | 9.320 | 29.751 | −14.079 | 1.00 | 76.96 | GZ00 | C |
| ATOM | 2825 | C | ASP | D | 155 | 9.440 | 30.697 | −15.267 | 1.00 | 78.16 | GZ00 | C |
| ATOM | 2826 | O | ASP | D | 155 | 8.849 | 30.482 | −16.327 | 1.00 | 86.27 | GZ00 | O |
| ATOM | 2827 | CB | ASP | D | 155 | 8.342 | 28.625 | −14.445 | 1.00 | 79.86 | GZ00 | C |
| ATOM | 2828 | CG | ASP | D | 155 | 8.311 | 27.503 | −13.442 | 1.00 | 77.78 | GZ00 | C |
| ATOM | 2829 | OD1 | ASP | D | 155 | 9.379 | 27.134 | −12.919 | 1.00 | 80.60 | GZ00 | O1− |
| ATOM | 2830 | OD2 | ASP | D | 155 | 7.205 | 26.974 | −13.197 | 1.00 | 86.69 | GZ00 | O |
| ATOM | 2831 | N | SER | D | 156 | 10.188 | 31.777 | −15.083 | 1.00 | 72.25 | GZ00 | N |
| ATOM | 2832 | CA | SER | D | 156 | 10.451 | 32.741 | −16.147 | 1.00 | 79.24 | GZ00 | C |
| ATOM | 2833 | C | SER | D | 156 | 9.207 | 33.506 | −16.599 | 1.00 | 70.74 | GZ00 | C |
| ATOM | 2834 | O | SER | D | 156 | 9.242 | 34.141 | −17.656 | 1.00 | 70.59 | GZ00 | O |
| ATOM | 2835 | CB | SER | D | 156 | 11.103 | 32.085 | −17.366 | 1.00 | 79.59 | GZ00 | C |
| ATOM | 2836 | OG | SER | D | 156 | 10.117 | 31.458 | −18.157 | 1.00 | 81.93 | GZ00 | O |
| ATOM | 2837 | N | SER | D | 157 | 8.086 | 33.449 | −15.840 | 1.00 | 66.95 | GZ00 | N |
| ATOM | 2838 | CA | SER | D | 157 | 6.934 | 34.326 | −16.090 | 1.00 | 65.14 | GZ00 | C |
| ATOM | 2839 | C | SER | D | 157 | 6.878 | 35.425 | −15.047 | 1.00 | 67.53 | GZ00 | C |
| ATOM | 2840 | O | SER | D | 157 | 7.031 | 35.145 | −13.848 | 1.00 | 64.92 | GZ00 | O |
| ATOM | 2841 | CB | SER | D | 157 | 5.624 | 33.544 | −16.060 | 1.00 | 63.23 | GZ00 | C |
| ATOM | 2842 | OG | SER | D | 157 | 5.562 | 32.633 | −17.136 | 1.00 | 75.81 | GZ00 | O |
| ATOM | 2843 | N | PRO | D | 158 | 6.652 | 36.670 | −15.446 | 1.00 | 66.82 | GZ00 | N |
| ATOM | 2844 | CA | PRO | D | 158 | 6.585 | 37.756 | −14.462 | 1.00 | 56.39 | GZ00 | C |
| ATOM | 2845 | C | PRO | D | 158 | 5.538 | 37.504 | −13.392 | 1.00 | 59.58 | GZ00 | C |
| ATOM | 2846 | O | PRO | D | 158 | 4.450 | 36.989 | −13.660 | 1.00 | 66.88 | GZ00 | O |
| ATOM | 2847 | CB | PRO | D | 158 | 6.236 | 38.986 | −15.308 | 1.00 | 52.59 | GZ00 | C |
| ATOM | 2848 | CG | PRO | D | 158 | 5.845 | 38.451 | −16.652 | 1.00 | 66.17 | GZ00 | C |
| ATOM | 2849 | CD | PRO | D | 158 | 6.585 | 37.169 | −16.824 | 1.00 | 63.85 | GZ00 | C |
| ATOM | 2850 | N | VAL | D | 159 | 5.900 | 37.834 | −12.160 | 1.00 | 59.53 | GZ00 | N |
| ATOM | 2851 | CA | VAL | D | 159 | 5.012 | 37.741 | −11.012 | 1.00 | 57.33 | GZ00 | C |
| ATOM | 2852 | C | VAL | D | 159 | 4.480 | 39.133 | −10.721 | 1.00 | 64.87 | GZ00 | C |
| ATOM | 2853 | O | VAL | D | 159 | 5.261 | 40.073 | −10.535 | 1.00 | 75.66 | GZ00 | O |
| ATOM | 2854 | CB | VAL | D | 159 | 5.735 | 37.169 | −9.785 | 1.00 | 58.46 | GZ00 | C |
| ATOM | 2855 | CG1 | VAL | D | 159 | 4.831 | 37.239 | −8.567 | 1.00 | 61.48 | GZ00 | C |
| ATOM | 2856 | CG2 | VAL | D | 159 | 6.174 | 35.737 | −10.050 | 1.00 | 55.69 | GZ00 | C |
| ATOM | 2857 | N | LYS | D | 160 | 3.157 | 39.269 | −10.654 | 1.00 | 74.88 | GZ00 | N |
| ATOM | 2858 | CA | LYS | D | 160 | 2.552 | 40.558 | −10.329 | 1.00 | 76.06 | GZ00 | C |
| ATOM | 2859 | C | LYS | D | 160 | 2.274 | 40.696 | −8.831 | 1.00 | 82.77 | GZ00 | C |
| ATOM | 2860 | O | LYS | D | 160 | 2.850 | 41.565 | −8.160 | 1.00 | 78.66 | GZ00 | O |
| ATOM | 2861 | CB | LYS | D | 160 | 1.265 | 40.755 | −11.142 | 1.00 | 83.14 | GZ00 | C |
| ATOM | 2862 | CG | LYS | D | 160 | 1.460 | 41.529 | −12.445 | 1.00 | 91.80 | GZ00 | C |
| ATOM | 2863 | CD | LYS | D | 160 | 2.006 | 42.934 | −12.175 | 1.00 | 100.07 | GZ00 | C |
| ATOM | 2864 | CE | LYS | D | 160 | 1.058 | 43.758 | −11.302 | 1.00 | 96.51 | GZ00 | C |
| ATOM | 2865 | NZ | LYS | D | 160 | 1.729 | 44.973 | −10.750 | 1.00 | 94.46 | GZ00 | N1+ |
| ATOM | 2866 | N | ALA | D | 161 | 1.410 | 39.836 | −8.293 | 1.00 | 72.49 | GZ00 | N |
| ATOM | 2867 | CA | ALA | D | 161 | 0.885 | 40.022 | −6.947 | 1.00 | 69.27 | GZ00 | C |
| ATOM | 2868 | C | ALA | D | 161 | 1.739 | 39.312 | −5.903 | 1.00 | 63.52 | GZ00 | C |
| ATOM | 2869 | O | ALA | D | 161 | 2.490 | 38.379 | −6.201 | 1.00 | 56.61 | GZ00 | O |
| ATOM | 2870 | CB | ALA | D | 161 | −0.551 | 39.514 | −6.859 | 1.00 | 71.61 | GZ00 | C |
| ATOM | 2871 | N | GLY | D | 162 | 1.608 | 39.774 | −4.659 | 1.00 | 50.21 | GZ00 | N |
| ATOM | 2872 | CA | GLY | D | 162 | 2.313 | 39.191 | −3.536 | 1.00 | 58.65 | GZ00 | C |

TABLE 10.3-continued

| | | | | | | | | | | | |
|---|---|---|---|---|---|---|---|---|---|---|---|
| ATOM | 2873 | C | GLY | D | 162 | 3.711 | 39.714 | -3.291 | 1.00 | 57.47 | GZ00 C |
| ATOM | 2874 | O | GLY | D | 162 | 4.417 | 39.167 | -2.426 | 1.00 | 54.30 | GZ00 O |
| ATOM | 2875 | N | VAL | D | 163 | 4.135 | 40.745 | -4.023 | 1.00 | 51.81 | GZ00 N |
| ATOM | 2876 | CA | VAL | D | 163 | 5.480 | 41.291 | -3.929 | 1.00 | 45.48 | GZ00 C |
| ATOM | 2877 | C | VAL | D | 163 | 5.431 | 42.543 | -3.074 | 1.00 | 47.42 | GZ00 C |
| ATOM | 2878 | O | VAL | D | 163 | 4.618 | 43.442 | -3.316 | 1.00 | 44.17 | GZ00 O |
| ATOM | 2879 | CB | VAL | D | 163 | 6.060 | 41.604 | -5.319 | 1.00 | 46.37 | GZ00 C |
| ATOM | 2880 | CG1 | VAL | D | 163 | 7.423 | 42.278 | -5.184 | 1.00 | 50.48 | GZ00 C |
| ATOM | 2881 | CG2 | VAL | D | 163 | 6.183 | 40.338 | -6.140 | 1.00 | 47.00 | GZ00 C |
| ATOM | 2882 | N | GLU | D | 164 | 6.301 | 42.609 | -2.076 | 1.00 | 45.49 | GZ00 N |
| ATOM | 2883 | CA | GLU | D | 164 | 6.498 | 43.832 | -1.326 | 1.00 | 39.71 | GZ00 C |
| ATOM | 2884 | C | GLU | D | 164 | 7.990 | 44.067 | -1.169 | 1.00 | 48.75 | GZ00 C |
| ATOM | 2885 | O | GLU | D | 164 | 8.749 | 43.133 | -0.864 | 1.00 | 44.83 | GZ00 O |
| ATOM | 2886 | CB | GLU | D | 164 | 5.764 | 43.793 | 0.009 | 1.00 | 46.37 | GZ00 C |
| ATOM | 2887 | CG | GLU | D | 164 | 4.308 | 44.218 | -0.195 | 1.00 | 59.54 | GZ00 C |
| ATOM | 2888 | CD | GLU | D | 164 | 3.415 | 43.931 | 0.978 | 1.00 | 60.43 | GZ00 C |
| ATOM | 2889 | OE1 | GLU | D | 164 | 3.928 | 43.465 | 2.015 | 1.00 | 70.95 | GZ00 O |
| ATOM | 2890 | OE2 | GLU | D | 164 | 2.197 | 44.189 | 0.869 | 1.00 | 56.32 | GZ00 O1- |
| ATOM | 2891 | N | THR | D | 165 | 8.400 | 45.308 | -1.434 | 1.00 | 43.26 | GZ00 N |
| ATOM | 2892 | CA | THR | D | 165 | 9.794 | 45.691 | -1.572 | 1.00 | 34.34 | GZ00 C |
| ATOM | 2893 | C | THR | D | 165 | 10.043 | 46.955 | -0.778 | 1.00 | 37.84 | GZ00 C |
| ATOM | 2894 | O | THR | D | 165 | 9.267 | 47.903 | -0.883 | 1.00 | 43.88 | GZ00 O |
| ATOM | 2895 | CB | THR | D | 165 | 10.122 | 45.903 | -3.040 | 1.00 | 37.47 | GZ00 C |
| ATOM | 2896 | OG1 | THR | D | 165 | 9.909 | 44.671 | -3.730 | 1.00 | 39.61 | GZ00 O |
| ATOM | 2897 | CG2 | THR | D | 165 | 11.578 | 46.354 | -3.240 | 1.00 | 38.05 | GZ00 C |
| ATOM | 2898 | N | THR | D | 166 | 11.131 | 46.982 | -0.011 | 1.00 | 37.74 | GZ00 N |
| ATOM | 2899 | CA | THR | D | 166 | 11.464 | 48.177 | 0.757 | 1.00 | 47.21 | GZ00 C |
| ATOM | 2900 | C | THR | D | 166 | 12.099 | 49.231 | -0.141 | 1.00 | 40.41 | GZ00 C |
| ATOM | 2901 | O | THR | D | 166 | 12.548 | 48.951 | -1.256 | 1.00 | 41.42 | GZ00 O |
| ATOM | 2902 | CB | THR | D | 166 | 12.470 | 47.888 | 1.882 | 1.00 | 40.73 | GZ00 C |
| ATOM | 2903 | OG1 | THR | D | 166 | 13.677 | 47.375 | 1.311 | 1.00 | 36.35 | GZ00 O |
| ATOM | 2904 | CG2 | THR | D | 166 | 11.922 | 46.878 | 2.882 | 1.00 | 40.85 | GZ00 C |
| ATOM | 2905 | N | THR | D | 167 | 12.135 | 50.451 | 0.365 | 1.00 | 42.55 | GZ00 N |
| ATOM | 2906 | CA | THR | D | 167 | 12.976 | 51.467 | -0.237 | 1.00 | 49.39 | GZ00 C |
| ATOM | 2907 | C | THR | D | 167 | 14.429 | 51.231 | 0.164 | 1.00 | 47.70 | GZ00 C |
| ATOM | 2908 | O | THR | D | 167 | 14.702 | 50.656 | 1.218 | 1.00 | 50.42 | GZ00 O |
| ATOM | 2909 | CB | THR | D | 167 | 12.564 | 52.846 | 0.231 | 1.00 | 42.03 | GZ00 C |
| ATOM | 2910 | OG1 | THR | D | 167 | 12.784 | 52.916 | 1.640 | 1.00 | 55.83 | GZ00 O |
| ATOM | 2911 | CG2 | THR | D | 167 | 11.133 | 53.079 | -0.052 | 1.00 | 40.08 | GZ00 C |
| ATOM | 2912 | N | PRO | D | 168 | 15.383 | 51.666 | -0.647 | 1.00 | 50.17 | GZ00 N |
| ATOM | 2913 | CA | PRO | D | 168 | 16.789 | 51.463 | -0.271 | 1.00 | 46.73 | GZ00 C |
| ATOM | 2914 | C | PRO | D | 168 | 17.132 | 52.312 | 0.943 | 1.00 | 48.10 | GZ00 C |
| ATOM | 2915 | O | PRO | D | 168 | 16.592 | 53.405 | 1.140 | 1.00 | 47.07 | GZ00 O |
| ATOM | 2916 | CB | PRO | D | 168 | 17.572 | 51.906 | -1.515 | 1.00 | 44.24 | GZ00 C |
| ATOM | 2917 | CG | PRO | D | 168 | 16.579 | 52.648 | -2.378 | 1.00 | 51.68 | GZ00 C |
| ATOM | 2918 | CD | PRO | D | 168 | 15.216 | 52.134 | -2.030 | 1.00 | 42.84 | GZ00 C |
| ATOM | 2919 | N | SER | D | 169 | 18.006 | 51.773 | 1.789 | 1.00 | 38.56 | GZ00 N |
| ATOM | 2920 | CA | SER | D | 169 | 18.460 | 52.490 | 2.976 | 1.00 | 44.06 | GZ00 C |
| ATOM | 2921 | C | SER | D | 169 | 19.974 | 52.364 | 3.091 | 1.00 | 40.12 | GZ00 C |
| ATOM | 2922 | O | SER | D | 169 | 20.562 | 51.347 | 2.703 | 1.00 | 42.12 | GZ00 O |
| ATOM | 2923 | CB | SER | D | 169 | 17.776 | 51.973 | 4.261 | 1.00 | 37.35 | GZ00 C |
| ATOM | 2924 | OG | SER | D | 169 | 18.098 | 50.608 | 4.455 | 1.00 | 51.17 | GZ00 O |
| ATOM | 2925 | N | LYS | D | 170 | 20.601 | 53.409 | 3.614 | 1.00 | 38.28 | GZ00 N |
| ATOM | 2926 | CA | LYS | D | 170 | 22.053 | 53.472 | 3.624 | 1.00 | 42.03 | GZ00 C |
| ATOM | 2927 | C | LYS | D | 170 | 22.610 | 52.541 | 4.691 | 1.00 | 41.78 | GZ00 C |
| ATOM | 2928 | O | LYS | D | 170 | 22.160 | 52.564 | 5.839 | 1.00 | 44.51 | GZ00 O |
| ATOM | 2929 | CB | LYS | D | 170 | 22.542 | 54.897 | 3.877 | 1.00 | 38.33 | GZ00 C |
| ATOM | 2930 | CG | LYS | D | 170 | 24.014 | 55.068 | 3.482 | 1.00 | 45.43 | GZ00 C |
| ATOM | 2931 | CD | LYS | D | 170 | 24.575 | 56.405 | 3.934 | 1.00 | 48.05 | GZ00 C |
| ATOM | 2932 | CE | LYS | D | 170 | 23.962 | 57.548 | 3.176 | 1.00 | 54.50 | GZ00 C |
| ATOM | 2933 | NZ | LYS | D | 170 | 24.635 | 58.806 | 3.569 | 1.00 | 69.11 | GZ00 N1+ |
| ATOM | 2934 | N | GLN | D | 171 | 23.589 | 51.723 | 4.305 | 1.00 | 41.93 | GZ00 N |
| ATOM | 2935 | CA | GLN | D | 171 | 24.346 | 50.889 | 5.228 | 1.00 | 47.20 | GZ00 C |
| ATOM | 2936 | C | GLN | D | 171 | 25.483 | 51.692 | 5.858 | 1.00 | 45.26 | GZ00 C |
| ATOM | 2937 | O | GLN | D | 171 | 25.816 | 52.797 | 5.422 | 1.00 | 47.74 | GZ00 O |
| ATOM | 2938 | CB | GLN | D | 171 | 24.933 | 49.672 | 4.508 | 1.00 | 38.79 | GZ00 C |
| ATOM | 2939 | CG | GLN | D | 171 | 23.914 | 48.809 | 3.823 | 1.00 | 38.60 | GZ00 C |
| ATOM | 2940 | CD | GLN | D | 171 | 24.560 | 47.787 | 2.932 | 1.00 | 45.79 | GZ00 C |
| ATOM | 2941 | OE1 | GLN | D | 171 | 23.900 | 46.859 | 2.433 | 1.00 | 43.80 | GZ00 O |
| ATOM | 2942 | NE2 | GLN | D | 171 | 25.868 | 47.942 | 2.715 | 1.00 | 45.31 | GZ00 N |
| ATOM | 2943 | N | SER | D | 172 | 26.118 | 51.089 | 6.865 | 1.00 | 49.48 | GZ00 N |
| ATOM | 2944 | CA | SER | D | 172 | 27.258 | 51.724 | 7.529 | 1.00 | 45.76 | GZ00 C |
| ATOM | 2945 | C | SER | D | 172 | 28.391 | 52.012 | 6.557 | 1.00 | 43.14 | GZ00 C |
| ATOM | 2946 | O | SER | D | 172 | 29.073 | 53.033 | 6.675 | 1.00 | 51.69 | GZ00 O |
| ATOM | 2947 | CB | SER | D | 172 | 27.769 | 50.826 | 8.658 | 1.00 | 55.56 | GZ00 C |
| ATOM | 2948 | OG | SER | D | 172 | 26.906 | 50.898 | 9.777 | 1.00 | 71.74 | GZ00 O |
| ATOM | 2949 | N | ASN | D | 173 | 28.628 | 51.122 | 5.601 | 1.00 | 40.90 | GZ00 N |
| ATOM | 2950 | CA | ASN | D | 173 | 29.697 | 51.363 | 4.646 | 1.00 | 37.43 | GZ00 C |
| ATOM | 2951 | C | ASN | D | 173 | 29.304 | 52.349 | 3.542 | 1.00 | 44.12 | GZ00 C |
| ATOM | 2952 | O | ASN | D | 173 | 30.080 | 52.526 | 2.588 | 1.00 | 41.37 | GZ00 O |

TABLE 10.3-continued

| | | | | | | | | | | | |
|---|---|---|---|---|---|---|---|---|---|---|---|
| ATOM | 2953 | CB | ASN | D | 173 | 30.171 | 50.030 | 4.038 | 1.00 | 41.28 | GZ00 C |
| ATOM | 2954 | CG | ASN | D | 173 | 29.139 | 49.370 | 3.147 | 1.00 | 44.26 | GZ00 C |
| ATOM | 2955 | OD1 | ASN | D | 173 | 28.038 | 49.887 | 2.944 | 1.00 | 43.64 | GZ00 O |
| ATOM | 2956 | ND2 | ASN | D | 173 | 29.500 | 48.208 | 2.597 | 1.00 | 50.50 | GZ00 N |
| ATOM | 2957 | N | ASN | D | 174 | 28.142 | 52.999 | 3.669 | 1.00 | 41.55 | GZ00 N |
| ATOM | 2958 | CA | ASN | D | 174 | 27.608 | 54.005 | 2.759 | 1.00 | 44.88 | GZ00 C |
| ATOM | 2959 | C | ASN | D | 174 | 27.151 | 53.429 | 1.426 | 1.00 | 44.23 | GZ00 C |
| ATOM | 2960 | O | ASN | D | 174 | 26.811 | 54.200 | 0.525 | 1.00 | 39.27 | GZ00 O |
| ATOM | 2961 | CB | ASN | D | 174 | 28.610 | 55.139 | 2.484 | 1.00 | 42.38 | GZ00 C |
| ATOM | 2962 | CG | ASN | D | 174 | 28.741 | 56.082 | 3.653 | 1.00 | 45.60 | GZ00 C |
| ATOM | 2963 | OD1 | ASN | D | 174 | 27.827 | 56.220 | 4.457 | 1.00 | 52.29 | GZ00 O |
| ATOM | 2964 | ND2 | ASN | D | 174 | 29.895 | 56.706 | 3.775 | 1.00 | 48.22 | GZ00 N |
| ATOM | 2965 | N | LYS | D | 175 | 27.187 | 52.114 | 1.242 | 1.00 | 43.55 | GZ00 N |
| ATOM | 2966 | CA | LYS | D | 175 | 26.380 | 51.487 | 0.204 | 1.00 | 46.60 | GZ00 C |
| ATOM | 2967 | C | LYS | D | 175 | 24.958 | 51.250 | 0.748 | 1.00 | 40.26 | GZ00 C |
| ATOM | 2968 | O | LYS | D | 175 | 24.628 | 51.624 | 1.877 | 1.00 | 36.35 | GZ00 O |
| ATOM | 2969 | CB | LYS | D | 175 | 27.054 | 50.204 | −0.272 | 1.00 | 43.68 | GZ00 C |
| ATOM | 2970 | CG | LYS | D | 175 | 28.501 | 50.379 | −0.772 | 1.00 | 42.53 | GZ00 C |
| ATOM | 2971 | CD | LYS | D | 175 | 29.043 | 48.983 | −1.135 | 1.00 | 47.00 | GZ00 C |
| ATOM | 2972 | CE | LYS | D | 175 | 30.522 | 48.940 | −1.403 | 1.00 | 54.60 | GZ00 C |
| ATOM | 2973 | NZ | LYS | D | 175 | 30.884 | 47.568 | −1.857 | 1.00 | 65.92 | GZ00 N |
| ATOM | 2974 | N | TYR | D | 176 | 24.091 | 50.623 | −0.042 | 1.00 | 37.23 | GZ00 N |
| ATOM | 2975 | CA | TYR | D | 176 | 22.676 | 50.583 | 0.302 | 1.00 | 36.34 | GZ00 C |
| ATOM | 2976 | C | TYR | D | 176 | 22.145 | 49.158 | 0.349 | 1.00 | 42.73 | GZ00 C |
| ATOM | 2977 | O | TYR | D | 176 | 22.657 | 48.244 | −0.314 | 1.00 | 36.34 | GZ00 O |
| ATOM | 2978 | CB | TYR | D | 176 | 21.844 | 51.409 | −0.693 | 1.00 | 36.80 | GZ00 C |
| ATOM | 2979 | CG | TYR | D | 176 | 22.044 | 52.899 | −0.563 | 1.00 | 36.36 | GZ00 C |
| ATOM | 2980 | CD2 | TYR | D | 176 | 21.057 | 53.710 | −0.021 | 1.00 | 37.31 | GZ00 C |
| ATOM | 2981 | CD1 | TYR | D | 176 | 23.222 | 53.497 | −0.996 | 1.00 | 41.41 | GZ00 C |
| ATOM | 2982 | CE2 | TYR | D | 176 | 21.252 | 55.072 | 0.098 | 1.00 | 40.59 | GZ00 C |
| ATOM | 2983 | CE1 | TYR | D | 176 | 23.423 | 54.857 | −0.883 | 1.00 | 39.52 | GZ00 C |
| ATOM | 2984 | CZ | TYR | D | 176 | 22.440 | 55.639 | −0.347 | 1.00 | 39.72 | GZ00 C |
| ATOM | 2985 | OH | TYR | D | 176 | 22.662 | 56.981 | −0.238 | 1.00 | 49.13 | GZ00 O |
| ATOM | 2986 | N | ALA | D | 177 | 21.056 | 49.003 | 1.103 | 1.00 | 41.16 | GZ00 N |
| ATOM | 2987 | CA | ALA | D | 177 | 20.371 | 47.728 | 1.246 | 1.00 | 39.60 | GZ00 C |
| ATOM | 2988 | C | ALA | D | 177 | 18.886 | 47.901 | 0.957 | 1.00 | 37.33 | GZ00 C |
| ATOM | 2989 | O | ALA | D | 177 | 18.321 | 48.987 | 1.140 | 1.00 | 41.92 | GZ00 O |
| ATOM | 2990 | CB | ALA | D | 177 | 20.552 | 47.133 | 2.665 | 1.00 | 35.41 | GZ00 C |
| ATOM | 2991 | N | ALA | D | 178 | 18.271 | 46.809 | 0.488 | 1.00 | 36.97 | GZ00 N |
| ATOM | 2992 | CA | ALA | D | 178 | 16.829 | 46.711 | 0.308 | 1.00 | 39.14 | GZ00 C |
| ATOM | 2993 | C | ALA | D | 178 | 16.415 | 45.246 | 0.381 | 1.00 | 41.15 | GZ00 C |
| ATOM | 2994 | O | ALA | D | 178 | 17.230 | 44.339 | 0.192 | 1.00 | 38.19 | GZ00 O |
| ATOM | 2995 | CB | ALA | D | 178 | 16.380 | 47.324 | −1.023 | 1.00 | 31.46 | GZ00 C |
| ATOM | 2996 | N | SER | D | 179 | 15.125 | 45.012 | 0.628 | 1.00 | 39.23 | GZ00 N |
| ATOM | 2997 | CA | SER | D | 179 | 14.626 | 43.644 | 0.607 | 1.00 | 42.89 | GZ00 C |
| ATOM | 2998 | C | SER | D | 179 | 13.279 | 43.569 | −0.100 | 1.00 | 42.30 | GZ00 C |
| ATOM | 2999 | O | SER | D | 179 | 12.526 | 44.543 | −0.157 | 1.00 | 39.32 | GZ00 O |
| ATOM | 3000 | CB | SER | D | 179 | 14.561 | 43.043 | 2.026 | 1.00 | 37.57 | GZ00 C |
| ATOM | 3001 | OG | SER | D | 179 | 14.059 | 43.953 | 2.960 | 1.00 | 39.68 | GZ00 O |
| ATOM | 3002 | N | SER | D | 180 | 13.012 | 42.399 | −0.673 | 1.00 | 39.99 | GZ00 N |
| ATOM | 3003 | CA | SER | D | 180 | 11.786 | 42.133 | −1.407 | 1.00 | 45.51 | GZ00 C |
| ATOM | 3004 | C | SER | D | 180 | 11.212 | 40.781 | −0.972 | 1.00 | 51.71 | GZ00 C |
| ATOM | 3005 | O | SER | D | 180 | 11.932 | 39.774 | −0.921 | 1.00 | 43.37 | GZ00 O |
| ATOM | 3006 | CB | SER | D | 180 | 12.062 | 42.153 | −2.911 | 1.00 | 42.12 | GZ00 C |
| ATOM | 3007 | OG | SER | D | 180 | 10.869 | 42.076 | −3.655 | 1.00 | 40.91 | GZ00 O |
| ATOM | 3008 | N | TYR | D | 181 | 9.914 | 40.756 | −0.686 | 1.00 | 44.23 | GZ00 N |
| ATOM | 3009 | CA | TYR | D | 181 | 9.237 | 39.561 | −0.206 | 1.00 | 45.60 | GZ00 C |
| ATOM | 3010 | C | TYR | D | 181 | 8.159 | 39.158 | −1.203 | 1.00 | 48.02 | GZ00 C |
| ATOM | 3011 | O | TYR | D | 181 | 7.369 | 40.001 | −1.637 | 1.00 | 44.19 | GZ00 O |
| ATOM | 3012 | CB | TYR | D | 181 | 8.612 | 39.804 | 1.164 | 1.00 | 39.73 | GZ00 C |
| ATOM | 3013 | CG | TYR | D | 181 | 9.601 | 40.149 | 2.246 | 1.00 | 42.39 | GZ00 C |
| ATOM | 3014 | CD2 | TYR | D | 181 | 10.094 | 39.167 | 3.100 | 1.00 | 35.39 | GZ00 C |
| ATOM | 3015 | CD1 | TYR | D | 181 | 10.050 | 41.464 | 2.416 | 1.00 | 38.95 | GZ00 C |
| ATOM | 3016 | CE2 | TYR | D | 181 | 11.005 | 39.477 | 4.098 | 1.00 | 38.77 | GZ00 C |
| ATOM | 3017 | CE1 | TYR | D | 181 | 10.958 | 41.786 | 3.414 | 1.00 | 42.49 | GZ00 C |
| ATOM | 3018 | CZ | TYR | D | 181 | 11.437 | 40.785 | 4.254 | 1.00 | 40.93 | GZ00 C |
| ATOM | 3019 | OH | TYR | D | 181 | 12.335 | 41.092 | 5.250 | 1.00 | 36.93 | GZ00 O |
| ATOM | 3020 | N | LEU | D | 182 | 8.137 | 37.878 | −1.576 | 1.00 | 39.63 | GZ00 N |
| ATOM | 3021 | CA | LEU | D | 182 | 7.075 | 37.312 | −2.399 | 1.00 | 48.32 | GZ00 C |
| ATOM | 3022 | C | LEU | D | 182 | 6.258 | 36.347 | −1.533 | 1.00 | 49.68 | GZ00 C |
| ATOM | 3023 | O | LEU | D | 182 | 6.774 | 35.321 | −1.072 | 1.00 | 44.59 | GZ00 O |
| ATOM | 3024 | CB | LEU | D | 182 | 7.672 | 36.616 | −3.621 | 1.00 | 45.93 | GZ00 C |
| ATOM | 3025 | CG | LEU | D | 182 | 6.711 | 35.859 | −4.540 | 1.00 | 54.86 | GZ00 C |
| ATOM | 3026 | CD1 | LEU | D | 182 | 5.643 | 36.822 | −5.050 | 1.00 | 49.90 | GZ00 C |
| ATOM | 3027 | CD2 | LEU | D | 182 | 7.467 | 35.191 | −5.703 | 1.00 | 43.02 | GZ00 C |
| ATOM | 3028 | N | SER | D | 183 | 4.992 | 36.680 | −1.295 | 1.00 | 52.23 | GZ00 N |
| ATOM | 3029 | CA | SER | D | 183 | 4.099 | 35.806 | −0.538 | 1.00 | 47.98 | GZ00 C |
| ATOM | 3030 | C | SER | D | 183 | 3.397 | 34.840 | −1.481 | 1.00 | 47.04 | GZ00 C |
| ATOM | 3031 | O | SER | D | 183 | 2.956 | 35.225 | −2.564 | 1.00 | 52.72 | GZ00 O |
| ATOM | 3032 | CB | SER | D | 183 | 3.072 | 36.608 | 0.251 | 1.00 | 45.88 | GZ00 C |

TABLE 10.3-continued

| | | | | | | | | | | | |
|---|---|---|---|---|---|---|---|---|---|---|---|
| ATOM | 3033 | OG | SER | D | 183 | 3.720 | 37.533 | 1.102 | 1.00 | 53.76 | GZ00 | O |
| ATOM | 3034 | N | LEU | D | 184 | 3.356 | 33.574 | −1.088 | 1.00 | 51.61 | GZ00 | N |
| ATOM | 3035 | CA | LEU | D | 184 | 2.741 | 32.523 | −1.874 | 1.00 | 51.65 | GZ00 | C |
| ATOM | 3036 | C | LEU | D | 184 | 1.951 | 31.621 | −0.944 | 1.00 | 60.30 | GZ00 | C |
| ATOM | 3037 | O | LEU | D | 184 | 2.089 | 31.679 | 0.284 | 1.00 | 57.40 | GZ00 | O |
| ATOM | 3038 | CB | LEU | D | 184 | 3.777 | 31.687 | −2.623 | 1.00 | 53.86 | GZ00 | C |
| ATOM | 3039 | CG | LEU | D | 184 | 4.672 | 32.341 | −3.654 | 1.00 | 51.77 | GZ00 | C |
| ATOM | 3040 | CD1 | LEU | D | 184 | 5.638 | 31.317 | −4.213 | 1.00 | 50.48 | GZ00 | C |
| ATOM | 3041 | CD2 | LEU | D | 184 | 3.803 | 32.927 | −4.738 | 1.00 | 58.87 | GZ00 | C |
| ATOM | 3042 | N | THR | D | 185 | 1.097 | 30.745 | −1.569 | 1.00 | 63.83 | GZ00 | N |
| ATOM | 3043 | CA | THR | D | 185 | 0.577 | 29.598 | −0.843 | 1.00 | 63.50 | GZ00 | C |
| ATOM | 3044 | C | THR | D | 185 | 1.550 | 28.438 | −0.977 | 1.00 | 60.27 | GZ00 | C |
| ATOM | 3045 | O | THR | D | 185 | 2.270 | 28.332 | −1.982 | 1.00 | 54.12 | GZ00 | O |
| ATOM | 3046 | CB | THR | D | 185 | −0.782 | 29.160 | −1.397 | 1.00 | 58.04 | GZ00 | C |
| ATOM | 3047 | OG1 | THR | D | 185 | −0.611 | 28.645 | −2.727 | 1.00 | 62.01 | GZ00 | O |
| ATOM | 3048 | CG2 | THR | D | 185 | −1.765 | 30.324 | −1.417 | 1.00 | 49.17 | GZ00 | C |
| ATOM | 3049 | N | PRO | D | 186 | 1.567 | 27.545 | 0.008 | 1.00 | 56.65 | GZ00 | N |
| ATOM | 3050 | CA | PRO | D | 186 | 2.337 | 26.307 | −0.160 | 1.00 | 61.35 | GZ00 | C |
| ATOM | 3051 | C | PRO | D | 186 | 2.054 | 25.617 | −1.484 | 1.00 | 70.92 | GZ00 | C |
| ATOM | 3052 | O | PRO | D | 186 | 2.972 | 25.043 | −2.089 | 1.00 | 71.62 | GZ00 | O |
| ATOM | 3053 | CB | PRO | D | 186 | 1.893 | 25.474 | 1.047 | 1.00 | 64.94 | GZ00 | C |
| ATOM | 3054 | CG | PRO | D | 186 | 1.565 | 26.502 | 2.095 | 1.00 | 56.23 | GZ00 | C |
| ATOM | 3055 | CD | PRO | D | 186 | 0.970 | 27.657 | 1.353 | 1.00 | 57.72 | GZ00 | C |
| ATOM | 3056 | N | GLU | D | 187 | 0.815 | 25.725 | −1.981 | 1.00 | 72.13 | GZ00 | N |
| ATOM | 3057 | CA | GLU | D | 187 | 0.440 | 25.117 | −3.255 | 1.00 | 73.38 | GZ00 | C |
| ATOM | 3058 | C | GLU | D | 187 | 1.182 | 25.782 | −4.408 | 1.00 | 71.22 | GZ00 | C |
| ATOM | 3059 | O | GLU | D | 187 | 1.817 | 25.105 | −5.229 | 1.00 | 67.47 | GZ00 | O |
| ATOM | 3060 | CB | GLU | D | 187 | −1.074 | 25.235 | −3.473 | 1.00 | 72.72 | GZ00 | C |
| ATOM | 3061 | CG | GLU | D | 187 | −1.909 | 25.465 | −2.206 | 1.00 | 73.60 | GZ00 | C |
| ATOM | 3062 | CD | GLU | D | 187 | −1.655 | 24.438 | −1.114 | 1.00 | 91.17 | GZ00 | C |
| ATOM | 3063 | OE1 | GLU | D | 187 | −1.492 | 23.239 | −1.442 | 1.00 | 95.11 | GZ00 | O |
| ATOM | 3064 | OE2 | GLU | D | 187 | −1.608 | 24.842 | 0.072 | 1.00 | 86.41 | GZ00 | O1− |
| ATOM | 3065 | N | GLN | D | 188 | 1.080 | 27.116 | −4.499 | 1.00 | 63.92 | GZ00 | N |
| ATOM | 3066 | CA | GLN | D | 188 | 1.803 | 27.852 | −5.532 | 1.00 | 67.27 | GZ00 | C |
| ATOM | 3067 | C | GLN | D | 188 | 3.302 | 27.589 | −5.466 | 1.00 | 68.44 | GZ00 | C |
| ATOM | 3068 | O | GLN | D | 188 | 3.959 | 27.448 | −6.507 | 1.00 | 68.93 | GZ00 | O |
| ATOM | 3069 | CB | GLN | D | 188 | 1.524 | 29.347 | −5.411 | 1.00 | 69.32 | GZ00 | C |
| ATOM | 3070 | CG | GLN | D | 188 | 0.092 | 29.737 | −5.677 | 1.00 | 64.52 | GZ00 | C |
| ATOM | 3071 | CD | GLN | D | 188 | −0.225 | 31.124 | −5.174 | 1.00 | 74.32 | GZ00 | C |
| ATOM | 3072 | OE1 | GLN | D | 188 | 0.362 | 31.585 | −4.199 | 1.00 | 75.61 | GZ00 | O |
| ATOM | 3073 | NE2 | GLN | D | 188 | −1.147 | 31.808 | −5.847 | 1.00 | 79.67 | GZ00 | N |
| ATOM | 3074 | N | TRP | D | 189 | 3.865 | 27.522 | −4.255 | 1.00 | 65.05 | GZ00 | N |
| ATOM | 3075 | CA | TRP | D | 189 | 5.304 | 27.301 | −4.130 | 1.00 | 65.52 | GZ00 | C |
| ATOM | 3076 | C | TRP | D | 189 | 5.697 | 25.960 | −4.734 | 1.00 | 70.69 | GZ00 | C |
| ATOM | 3077 | O | TRP | D | 189 | 6.669 | 25.871 | −5.497 | 1.00 | 69.56 | GZ00 | O |
| ATOM | 3078 | CB | TRP | D | 189 | 5.730 | 27.397 | −2.659 | 1.00 | 64.52 | GZ00 | C |
| ATOM | 3079 | CG | TRP | D | 189 | 7.127 | 26.879 | −2.336 | 1.00 | 69.67 | GZ00 | C |
| ATOM | 3080 | CD1 | TRP | D | 189 | 7.448 | 25.892 | −1.442 | 1.00 | 67.82 | GZ00 | C |
| ATOM | 3081 | CD2 | TRP | D | 189 | 8.372 | 27.335 | −2.885 | 1.00 | 66.64 | GZ00 | C |
| ATOM | 3082 | NE1 | TRP | D | 189 | 8.806 | 25.699 | −1.414 | 1.00 | 62.01 | GZ00 | N |
| ATOM | 3083 | CE2 | TRP | D | 189 | 9.399 | 26.569 | −2.287 | 1.00 | 64.99 | GZ00 | C |
| ATOM | 3084 | CE3 | TRP | D | 189 | 8.720 | 28.305 | −3.833 | 1.00 | 68.36 | GZ00 | C |
| ATOM | 3085 | CZ2 | TRP | D | 189 | 10.750 | 26.753 | −2.592 | 1.00 | 66.69 | GZ00 | C |
| ATOM | 3086 | CZ3 | TRP | D | 189 | 10.067 | 28.481 | −4.146 | 1.00 | 68.79 | GZ00 | C |
| ATOM | 3087 | CH2 | TRP | D | 189 | 11.064 | 27.704 | −3.527 | 1.00 | 63.38 | GZ00 | C |
| ATOM | 3088 | N | LYS | D | 190 | 4.925 | 24.909 | −4.437 | 1.00 | 74.93 | GZ00 | N |
| ATOM | 3089 | CA | LYS | D | 190 | 5.269 | 23.562 | −4.875 | 1.00 | 74.61 | GZ00 | C |
| ATOM | 3090 | C | LYS | D | 190 | 4.919 | 23.317 | −6.334 | 1.00 | 72.06 | GZ00 | C |
| ATOM | 3091 | O | LYS | D | 190 | 5.471 | 22.395 | −6.946 | 1.00 | 76.50 | GZ00 | O |
| ATOM | 3092 | CB | LYS | D | 190 | 4.556 | 22.538 | −3.988 | 1.00 | 72.08 | GZ00 | C |
| ATOM | 3093 | CG | LYS | D | 190 | 5.012 | 22.585 | −2.539 | 1.00 | 73.58 | GZ00 | C |
| ATOM | 3094 | CD | LYS | D | 190 | 4.154 | 21.723 | −1.635 | 1.00 | 86.29 | GZ00 | C |
| ATOM | 3095 | CE | LYS | D | 190 | 4.625 | 21.833 | −0.191 | 1.00 | 92.57 | GZ00 | C |
| ATOM | 3096 | NZ | LYS | D | 190 | 3.732 | 21.118 | 0.762 | 1.00 | 99.72 | GZ00 | N1+ |
| ATOM | 3097 | N | SER | D | 191 | 4.050 | 24.142 | −6.915 | 1.00 | 68.71 | GZ00 | N |
| ATOM | 3098 | CA | SER | D | 191 | 3.582 | 23.882 | −8.272 | 1.00 | 73.46 | GZ00 | C |
| ATOM | 3099 | C | SER | D | 191 | 4.650 | 24.213 | −9.315 | 1.00 | 72.57 | GZ00 | C |
| ATOM | 3100 | O | SER | D | 191 | 4.878 | 23.431 | −10.244 | 1.00 | 79.90 | GZ00 | O |
| ATOM | 3101 | CB | SER | D | 191 | 2.289 | 24.655 | −8.529 | 1.00 | 70.09 | GZ00 | C |
| ATOM | 3102 | OG | SER | D | 191 | 2.531 | 26.044 | −8.539 | 1.00 | 81.55 | GZ00 | O |
| ATOM | 3103 | N | HIS | D | 192 | 5.313 | 25.363 | −9.190 | 1.00 | 72.67 | GZ00 | N |
| ATOM | 3104 | CA | HIS | D | 192 | 6.267 | 25.792 | −10.210 | 1.00 | 69.13 | GZ00 | C |
| ATOM | 3105 | C | HIS | D | 192 | 7.641 | 25.135 | −10.038 | 1.00 | 66.99 | GZ00 | C |
| ATOM | 3106 | O | HIS | D | 192 | 8.020 | 24.695 | −8.951 | 1.00 | 72.31 | GZ00 | O |
| ATOM | 3107 | CB | HIS | D | 192 | 6.420 | 27.313 | −10.199 | 1.00 | 72.85 | GZ00 | C |
| ATOM | 3108 | CG | HIS | D | 192 | 5.178 | 28.049 | −10.597 | 1.00 | 71.64 | GZ00 | C |
| ATOM | 3109 | ND1 | HIS | D | 192 | 4.172 | 28.355 | −9.704 | 1.00 | 70.93 | GZ00 | N |
| ATOM | 3110 | CD2 | HIS | D | 192 | 4.763 | 28.504 | −11.803 | 1.00 | 68.93 | GZ00 | C |
| ATOM | 3111 | CE1 | HIS | D | 192 | 3.202 | 28.990 | −10.338 | 1.00 | 65.00 | GZ00 | C |
| ATOM | 3112 | NE2 | HIS | D | 192 | 3.534 | 29.089 | −11.614 | 1.00 | 73.86 | GZ00 | N |

TABLE 10.3-continued

| ATOM | 3113 | N | ARG | D | 193 | 8.390 | 25.070 | −11.148 | 1.00 | 64.89 | GZ00 | N |
|---|---|---|---|---|---|---|---|---|---|---|---|---|
| ATOM | 3114 | CA | ARG | D | 193 | 9.731 | 24.476 | −11.135 | 1.00 | 69.27 | GZ00 | C |
| ATOM | 3115 | C | ARG | D | 193 | 10.705 | 25.313 | −10.313 | 1.00 | 67.85 | GZ00 | C |
| ATOM | 3116 | O | ARG | D | 193 | 11.542 | 24.769 | −9.586 | 1.00 | 68.86 | GZ00 | O |
| ATOM | 3117 | CB | ARG | D | 193 | 10.269 | 24.354 | −12.565 | 1.00 | 71.73 | GZ00 | C |
| ATOM | 3118 | CG | ARG | D | 193 | 9.414 | 23.557 | −13.540 | 1.00 | 81.33 | GZ00 | C |
| ATOM | 3119 | CD | ARG | D | 193 | 9.846 | 23.822 | −14.993 | 1.00 | 88.10 | GZ00 | C |
| ATOM | 3120 | NE | ARG | D | 193 | 8.722 | 24.419 | −15.728 | 1.00 | 99.94 | GZ00 | N |
| ATOM | 3121 | CZ | ARG | D | 193 | 8.814 | 25.092 | −16.875 | 1.00 | 101.58 | GZ00 | C |
| ATOM | 3122 | NH1 | ARG | D | 193 | 7.716 | 25.589 | −17.441 | 1.00 | 88.37 | GZ00 | N1+ |
| ATOM | 3123 | NH2 | ARG | D | 193 | 9.997 | 25.305 | −17.440 | 1.00 | 99.51 | GZ00 | N |
| ATOM | 3124 | N | SER | D | 194 | 10.619 | 26.637 | −10.428 | 1.00 | 68.05 | GZ00 | N |
| ATOM | 3125 | CA | SER | D | 194 | 11.553 | 27.534 | −9.768 | 1.00 | 62.46 | GZ00 | C |
| ATOM | 3126 | C | SER | D | 194 | 10.936 | 28.917 | −9.658 | 1.00 | 66.77 | GZ00 | C |
| ATOM | 3127 | O | SER | D | 194 | 9.957 | 29.242 | −10.334 | 1.00 | 71.03 | GZ00 | O |
| ATOM | 3128 | CB | SER | D | 194 | 12.876 | 27.622 | −10.529 | 1.00 | 66.04 | GZ00 | C |
| ATOM | 3129 | OG | SER | D | 194 | 12.739 | 28.441 | −11.681 | 1.00 | 66.32 | GZ00 | O |
| ATOM | 3130 | N | TYR | D | 195 | 11.520 | 29.722 | −8.782 | 1.00 | 64.92 | GZ00 | N |
| ATOM | 3131 | CA | TYR | D | 195 | 11.219 | 31.142 | −8.688 | 1.00 | 63.56 | GZ00 | C |
| ATOM | 3132 | C | TYR | D | 195 | 12.522 | 31.927 | −8.748 | 1.00 | 61.50 | GZ00 | C |
| ATOM | 3133 | O | TYR | D | 195 | 13.580 | 31.431 | −8.351 | 1.00 | 54.93 | GZ00 | O |
| ATOM | 3134 | CB | TYR | D | 195 | 10.481 | 31.482 | −7.408 | 1.00 | 57.26 | GZ00 | C |
| ATOM | 3135 | CG | TYR | D | 195 | 9.037 | 31.058 | −7.392 | 1.00 | 64.67 | GZ00 | C |
| ATOM | 3136 | CD1 | TYR | D | 195 | 8.679 | 29.742 | −7.126 | 1.00 | 69.64 | GZ00 | C |
| ATOM | 3137 | CD2 | TYR | D | 195 | 8.025 | 31.986 | −7.618 | 1.00 | 66.11 | GZ00 | C |
| ATOM | 3138 | CE1 | TYR | D | 195 | 7.350 | 29.362 | −7.094 | 1.00 | 72.89 | GZ00 | C |
| ATOM | 3139 | CE2 | TYR | D | 195 | 6.704 | 31.621 | −7.592 | 1.00 | 63.75 | GZ00 | C |
| ATOM | 3140 | CZ | TYR | D | 195 | 6.369 | 30.311 | −7.336 | 1.00 | 69.62 | GZ00 | C |
| ATOM | 3141 | OH | TYR | D | 195 | 5.043 | 29.958 | −7.309 | 1.00 | 71.41 | GZ00 | O |
| ATOM | 3142 | N | SER | D | 196 | 12.441 | 33.161 | −9.235 | 1.00 | 58.30 | GZ00 | N |
| ATOM | 3143 | CA | SER | D | 196 | 13.627 | 33.990 | −9.396 | 1.00 | 54.75 | GZ00 | C |
| ATOM | 3144 | C | SER | D | 196 | 13.387 | 35.383 | −8.852 | 1.00 | 52.46 | GZ00 | C |
| ATOM | 3145 | O | SER | D | 196 | 12.282 | 35.924 | −8.944 | 1.00 | 50.50 | GZ00 | O |
| ATOM | 3146 | CB | SER | D | 196 | 14.068 | 34.102 | −10.856 | 1.00 | 55.06 | GZ00 | C |
| ATOM | 3147 | OG | SER | D | 196 | 14.543 | 32.862 | −11.337 | 1.00 | 59.56 | GZ00 | O |
| ATOM | 3148 | N | CYS | D | 197 | 14.434 | 35.941 | −8.263 | 1.00 | 51.88 | GZ00 | N |
| ATOM | 3149 | CA | CYS | D | 197 | 14.485 | 37.334 | −7.862 | 1.00 | 48.95 | GZ00 | C |
| ATOM | 3150 | C | CYS | D | 197 | 15.499 | 38.031 | −8.771 | 1.00 | 49.99 | GZ00 | C |
| ATOM | 3151 | O | CYS | D | 197 | 16.667 | 37.641 | −8.809 | 1.00 | 46.06 | GZ00 | O |
| ATOM | 3152 | CB | CYS | D | 197 | 14.868 | 37.443 | −6.389 | 1.00 | 50.65 | GZ00 | C |
| ATOM | 3153 | SG | CYS | D | 197 | 14.970 | 39.121 | −5.807 | 1.00 | 59.52 | GZ00 | S |
| ATOM | 3154 | N | GLN | D | 198 | 15.048 | 39.021 | −9.538 | 1.00 | 50.95 | GZ00 | N |
| ATOM | 3155 | CA | GLN | D | 198 | 15.912 | 39.731 | −10.476 | 1.00 | 45.62 | GZ00 | C |
| ATOM | 3156 | C | GLN | D | 198 | 16.058 | 41.165 | −10.006 | 1.00 | 45.99 | GZ00 | C |
| ATOM | 3157 | O | GLN | D | 198 | 15.064 | 41.888 | −9.860 | 1.00 | 43.74 | GZ00 | O |
| ATOM | 3158 | CB | GLN | D | 198 | 15.372 | 39.667 | −11.901 | 1.00 | 43.17 | GZ00 | C |
| ATOM | 3159 | CG | GLN | D | 198 | 15.534 | 38.283 | −12.527 | 1.00 | 59.20 | GZ00 | C |
| ATOM | 3160 | CD | GLN | D | 198 | 14.770 | 38.107 | −13.837 | 1.00 | 67.77 | GZ00 | C |
| ATOM | 3161 | OE1 | GLN | D | 198 | 14.034 | 38.996 | −14.273 | 1.00 | 68.74 | GZ00 | O |
| ATOM | 3162 | NE2 | GLN | D | 198 | 14.933 | 36.945 | −14.460 | 1.00 | 69.92 | GZ00 | N |
| ATOM | 3163 | N | VAL | D | 199 | 17.291 | 41.556 | −9.722 | 1.00 | 43.86 | GZ00 | N |
| ATOM | 3164 | CA | VAL | D | 199 | 17.600 | 42.869 | −9.177 | 1.00 | 43.86 | GZ00 | C |
| ATOM | 3165 | C | VAL | D | 199 | 18.389 | 43.626 | −10.233 | 1.00 | 44.40 | GZ00 | C |
| ATOM | 3166 | O | VAL | D | 199 | 19.480 | 43.197 | −10.619 | 1.00 | 41.88 | GZ00 | O |
| ATOM | 3167 | CB | VAL | D | 199 | 18.389 | 42.750 | −7.865 | 1.00 | 40.13 | GZ00 | C |
| ATOM | 3168 | CG1 | VAL | D | 199 | 18.560 | 44.088 | −7.241 | 1.00 | 33.53 | GZ00 | C |
| ATOM | 3169 | CG2 | VAL | D | 199 | 17.679 | 41.778 | −6.906 | 1.00 | 37.93 | GZ00 | C |
| ATOM | 3170 | N | THR | D | 200 | 17.838 | 44.732 | −10.719 | 1.00 | 43.84 | GZ00 | N |
| ATOM | 3171 | CA | THR | D | 200 | 18.513 | 45.558 | −11.712 | 1.00 | 42.52 | GZ00 | C |
| ATOM | 3172 | C | THR | D | 200 | 19.125 | 46.783 | −11.044 | 1.00 | 39.89 | GZ00 | C |
| ATOM | 3173 | O | THR | D | 200 | 18.442 | 47.506 | −10.310 | 1.00 | 39.87 | GZ00 | O |
| ATOM | 3174 | CB | THR | D | 200 | 17.542 | 45.987 | −12.813 | 1.00 | 48.84 | GZ00 | C |
| ATOM | 3175 | OG1 | THR | D | 200 | 16.958 | 44.805 | −13.380 | 1.00 | 46.64 | GZ00 | O |
| ATOM | 3176 | CG2 | THR | D | 200 | 18.290 | 46.806 | −13.918 | 1.00 | 33.12 | GZ00 | C |
| ATOM | 3177 | N | HIS | D | 201 | 20.406 | 47.016 | −11.313 | 1.00 | 40.27 | GZ00 | N |
| ATOM | 3178 | CA | HIS | D | 201 | 21.145 | 48.125 | −10.723 | 1.00 | 39.47 | GZ00 | C |
| ATOM | 3179 | C | HIS | D | 201 | 22.047 | 48.723 | −11.790 | 1.00 | 44.85 | GZ00 | C |
| ATOM | 3180 | O | HIS | D | 201 | 22.892 | 48.013 | −12.345 | 1.00 | 39.41 | GZ00 | O |
| ATOM | 3181 | CB | HIS | D | 201 | 21.973 | 47.660 | −9.532 | 1.00 | 37.22 | GZ00 | C |
| ATOM | 3182 | CG | HIS | D | 201 | 22.797 | 48.738 | −8.905 | 1.00 | 34.72 | GZ00 | C |
| ATOM | 3183 | ND1 | HIS | D | 201 | 24.134 | 48.915 | −9.190 | 1.00 | 33.61 | GZ00 | N |
| ATOM | 3184 | CD2 | HIS | D | 201 | 22.486 | 49.658 | −7.960 | 1.00 | 33.33 | GZ00 | C |
| ATOM | 3185 | CE1 | HIS | D | 201 | 24.608 | 49.907 | −8.455 | 1.00 | 40.99 | GZ00 | C |
| ATOM | 3186 | NE2 | HIS | D | 201 | 23.628 | 50.377 | −7.699 | 1.00 | 33.68 | GZ00 | N |
| ATOM | 3187 | N | GLU | D | 202 | 21.840 | 50.010 | −12.100 | 1.00 | 47.82 | GZ00 | N |
| ATOM | 3188 | CA | GLU | D | 202 | 22.672 | 50.726 | −13.064 | 1.00 | 45.90 | GZ00 | C |
| ATOM | 3189 | C | GLU | D | 202 | 22.753 | 49.963 | −14.385 | 1.00 | 44.77 | GZ00 | C |
| ATOM | 3190 | O | GLU | D | 202 | 23.828 | 49.757 | −14.947 | 1.00 | 45.87 | GZ00 | O |
| ATOM | 3191 | CB | GLU | D | 202 | 24.068 | 50.973 | −12.485 | 1.00 | 40.73 | GZ00 | C |
| ATOM | 3192 | CG | GLU | D | 202 | 24.078 | 51.833 | −11.241 | 1.00 | 37.51 | GZ00 | C |

TABLE 10.3-continued

| | | | | | | | | | | | |
|---|---|---|---|---|---|---|---|---|---|---|---|
| ATOM | 3193 | CD | GLU | D | 202 | 23.780 | 53.301 | −11.543 | 1.00 | 53.62 | GZ00 C |
| ATOM | 3194 | OE1 | GLU | D | 202 | 24.472 | 53.880 | −12.414 | 1.00 | 54.80 | GZ00 O |
| ATOM | 3195 | OE2 | GLU | D | 202 | 22.853 | 53.878 | −10.924 | 1.00 | 56.28 | GZ00 O1− |
| ATOM | 3196 | N | GLY | D | 203 | 21.600 | 49.498 | −14.862 | 1.00 | 40.18 | GZ00 N |
| ATOM | 3197 | CA | GLY | D | 203 | 21.584 | 48.775 | −16.117 | 1.00 | 41.95 | GZ00 C |
| ATOM | 3198 | C | GLY | D | 203 | 22.137 | 47.357 | −16.110 | 1.00 | 51.05 | GZ00 C |
| ATOM | 3199 | O | GLY | D | 203 | 22.259 | 46.760 | −17.186 | 1.00 | 50.18 | GZ00 O |
| ATOM | 3200 | N | SER | D | 206 | 22.505 | 46.793 | −14.958 | 1.00 | 47.41 | GZ00 N |
| ATOM | 3201 | CA | SER | D | 206 | 22.921 | 45.390 | −14.906 | 1.00 | 50.13 | GZ00 C |
| ATOM | 3202 | C | SER | D | 206 | 22.101 | 44.640 | −13.874 | 1.00 | 46.73 | GZ00 C |
| ATOM | 3203 | O | SER | D | 206 | 21.921 | 45.117 | −12.747 | 1.00 | 45.75 | GZ00 O |
| ATOM | 3204 | CB | SER | D | 206 | 24.404 | 45.243 | −14.607 | 1.00 | 46.12 | GZ00 C |
| ATOM | 3205 | OG | SER | D | 206 | 25.155 | 45.750 | −15.688 | 1.00 | 57.53 | GZ00 O |
| ATOM | 3206 | N | THR | D | 207 | 21.592 | 43.477 | −14.262 | 1.00 | 41.69 | GZ00 N |
| ATOM | 3207 | CA | THR | D | 207 | 20.697 | 42.720 | −13.400 | 1.00 | 50.12 | GZ00 C |
| ATOM | 3208 | C | THR | D | 207 | 21.425 | 41.525 | −12.797 | 1.00 | 47.45 | GZ00 C |
| ATOM | 3209 | O | THR | D | 207 | 22.129 | 40.793 | −13.501 | 1.00 | 43.02 | GZ00 O |
| ATOM | 3210 | CB | THR | D | 207 | 19.449 | 42.249 | −14.155 | 1.00 | 49.49 | GZ00 C |
| ATOM | 3211 | OG1 | THR | D | 207 | 19.797 | 41.130 | −14.968 | 1.00 | 59.30 | GZ00 O |
| ATOM | 3212 | CG2 | THR | D | 207 | 18.885 | 43.358 | −15.031 | 1.00 | 37.86 | GZ00 C |
| ATOM | 3213 | N | VAL | D | 208 | 21.234 | 41.328 | −11.495 | 1.00 | 45.06 | GZ00 N |
| ATOM | 3214 | CA | VAL | D | 208 | 21.724 | 40.163 | −10.767 | 1.00 | 49.03 | GZ00 C |
| ATOM | 3215 | C | VAL | D | 208 | 20.514 | 39.301 | −10.447 | 1.00 | 44.06 | GZ00 C |
| ATOM | 3216 | O | VAL | D | 208 | 19.493 | 39.815 | −9.974 | 1.00 | 50.95 | GZ00 O |
| ATOM | 3217 | CB | VAL | D | 208 | 22.467 | 40.579 | −9.484 | 1.00 | 48.97 | GZ00 C |
| ATOM | 3218 | CG1 | VAL | D | 208 | 22.858 | 39.372 | −8.668 | 1.00 | 41.12 | GZ00 C |
| ATOM | 3219 | CG2 | VAL | D | 208 | 23.700 | 41.376 | −9.829 | 1.00 | 39.61 | GZ00 C |
| ATOM | 3220 | N | GLU | D | 209 | 20.614 | 38.005 | −10.709 | 1.00 | 41.82 | GZ00 N |
| ATOM | 3221 | CA | GLU | D | 209 | 19.483 | 37.103 | −10.538 | 1.00 | 43.40 | GZ00 C |
| ATOM | 3222 | C | GLU | D | 209 | 19.835 | 35.970 | −9.586 | 1.00 | 50.61 | GZ00 C |
| ATOM | 3223 | O | GLU | D | 209 | 20.917 | 35.383 | −9.674 | 1.00 | 57.28 | GZ00 O |
| ATOM | 3224 | CB | GLU | D | 209 | 19.042 | 36.508 | −11.873 | 1.00 | 49.58 | GZ00 C |
| ATOM | 3225 | CG | GLU | D | 209 | 17.851 | 35.561 | −11.761 | 1.00 | 62.21 | GZ00 C |
| ATOM | 3226 | CD | GLU | D | 209 | 17.419 | 34.999 | −13.108 | 1.00 | 75.52 | GZ00 C |
| ATOM | 3227 | OE1 | GLU | D | 209 | 17.297 | 33.759 | −13.240 | 1.00 | 85.24 | GZ00 O |
| ATOM | 3228 | OE2 | GLU | D | 209 | 17.155 | 35.806 | −14.026 | 1.00 | 77.80 | GZ00 O1− |
| ATOM | 3229 | N | LYS | D | 210 | 18.902 | 35.636 | −8.705 | 1.00 | 48.46 | GZ00 N |
| ATOM | 3230 | CA | LYS | D | 210 | 19.006 | 34.443 | −7.885 | 1.00 | 52.58 | GZ00 C |
| ATOM | 3231 | C | LYS | D | 210 | 17.741 | 33.630 | −8.066 | 1.00 | 49.39 | GZ00 C |
| ATOM | 3232 | O | LYS | D | 210 | 16.639 | 34.182 | −8.150 | 1.00 | 51.83 | GZ00 O |
| ATOM | 3233 | CB | LYS | D | 210 | 19.228 | 34.785 | −6.401 | 1.00 | 50.40 | GZ00 C |
| ATOM | 3234 | CG | LYS | D | 210 | 20.608 | 35.341 | −6.116 | 1.00 | 46.93 | GZ00 C |
| ATOM | 3235 | CD | LYS | D | 210 | 21.675 | 34.454 | −6.726 | 1.00 | 45.41 | GZ00 C |
| ATOM | 3236 | CE | LYS | D | 210 | 23.095 | 35.008 | −6.476 | 1.00 | 52.18 | GZ00 C |
| ATOM | 3237 | NZ | LYS | D | 210 | 23.541 | 34.804 | −5.069 | 1.00 | 57.98 | GZ00 N1+ |
| ATOM | 3238 | N | THR | D | 211 | 17.900 | 32.324 | −8.168 | 1.00 | 47.49 | GZ00 N |
| ATOM | 3239 | CA | THR | D | 211 | 16.750 | 31.460 | −8.337 | 1.00 | 56.28 | GZ00 C |
| ATOM | 3240 | C | THR | D | 211 | 16.772 | 30.374 | −7.276 | 1.00 | 53.77 | GZ00 C |
| ATOM | 3241 | O | THR | D | 211 | 17.832 | 29.917 | −6.845 | 1.00 | 60.67 | GZ00 O |
| ATOM | 3242 | CB | THR | D | 211 | 16.708 | 30.815 | −9.722 | 1.00 | 53.88 | GZ00 C |
| ATOM | 3243 | OG1 | THR | D | 211 | 17.474 | 29.617 | −9.690 | 1.00 | 68.57 | GZ00 O |
| ATOM | 3244 | CG2 | THR | D | 211 | 17.315 | 31.729 | −10.774 | 1.00 | 54.97 | GZ00 C |
| ATOM | 3245 | N | VAL | D | 212 | 15.583 | 29.943 | −6.893 | 1.00 | 54.81 | GZ00 N |
| ATOM | 3246 | CA | VAL | D | 212 | 15.393 | 28.942 | −5.858 | 1.00 | 54.01 | GZ00 C |
| ATOM | 3247 | C | VAL | D | 212 | 14.264 | 28.011 | −6.313 | 1.00 | 62.68 | GZ00 C |
| ATOM | 3248 | O | VAL | D | 212 | 13.334 | 28.429 | −7.016 | 1.00 | 62.49 | GZ00 O |
| ATOM | 3249 | CB | VAL | D | 212 | 15.121 | 29.656 | −4.510 | 1.00 | 51.80 | GZ00 C |
| ATOM | 3250 | CG1 | VAL | D | 212 | 13.642 | 30.033 | −4.363 | 1.00 | 48.35 | GZ00 C |
| ATOM | 3251 | CG2 | VAL | D | 212 | 15.626 | 28.849 | −3.351 | 1.00 | 63.22 | GZ00 C |
| ATOM | 3252 | N | ALA | D | 213 | 14.367 | 26.729 | −5.951 | 1.00 | 62.74 | GZ00 N |
| ATOM | 3253 | CA | ALA | D | 213 | 13.422 | 25.713 | −6.406 | 1.00 | 61.72 | GZ00 C |
| ATOM | 3254 | C | ALA | D | 213 | 12.828 | 24.959 | −5.225 | 1.00 | 66.88 | GZ00 C |
| ATOM | 3255 | O | ALA | D | 213 | 13.502 | 24.746 | −4.213 | 1.00 | 69.81 | GZ00 O |
| ATOM | 3256 | CB | ALA | D | 213 | 14.074 | 24.712 | −7.370 | 1.00 | 52.61 | GZ00 C |
| ATOM | 3257 | N | PRO | D | 214 | 11.554 | 24.566 | −5.318 | 1.00 | 71.94 | GZ00 N |
| ATOM | 3258 | CA | PRO | D | 214 | 10.911 | 23.880 | −4.181 | 1.00 | 73.82 | GZ00 C |
| ATOM | 3259 | C | PRO | D | 214 | 11.485 | 22.508 | −3.872 | 1.00 | 83.15 | GZ00 C |
| ATOM | 3260 | O | PRO | D | 214 | 11.296 | 22.024 | −2.748 | 1.00 | 87.02 | GZ00 O |
| ATOM | 3261 | CB | PRO | D | 214 | 9.437 | 23.798 | −4.599 | 1.00 | 71.13 | GZ00 C |
| ATOM | 3262 | CG | PRO | D | 214 | 9.430 | 24.016 | −6.077 | 1.00 | 76.39 | GZ00 C |
| ATOM | 3263 | CD | PRO | D | 214 | 10.598 | 24.897 | −6.388 | 1.00 | 73.27 | GZ00 C |
| ATOM | 3264 | N | THR | D | 215 | 12.167 | 21.863 | −4.815 | 1.00 | 81.47 | GZ00 N |
| ATOM | 3265 | CA | THR | D | 215 | 12.918 | 20.647 | −4.512 | 1.00 | 88.36 | GZ00 C |
| ATOM | 3266 | C | THR | D | 215 | 14.100 | 21.003 | −3.608 | 1.00 | 95.90 | GZ00 C |
| ATOM | 3267 | O | THR | D | 215 | 15.126 | 21.513 | −4.071 | 1.00 | 92.30 | GZ00 O |
| ATOM | 3268 | CB | THR | D | 215 | 13.383 | 19.978 | −5.802 | 1.00 | 93.99 | GZ00 C |
| ATOM | 3269 | OG1 | THR | D | 215 | 14.373 | 20.797 | −6.434 | 1.00 | 97.00 | GZ00 O |
| ATOM | 3270 | CG2 | THR | D | 215 | 12.210 | 19.791 | −6.759 | 1.00 | 92.11 | GZ00 C |
| ATOM | 3271 | N | GLU | D | 216 | 13.956 | 20.757 | −2.306 | 1.00 | 96.37 | GZ00 N |
| ATOM | 3272 | CA | GLU | D | 216 | 14.997 | 21.115 | −1.340 | 1.00 | 94.49 | GZ00 C |

TABLE 10.3-continued

| | | | | | | | | | | |
|---|---|---|---|---|---|---|---|---|---|---|
| ATOM | 3273 | C | GLU | D | 216 | 15.586 | 19.863 | −0.689 | 1.00 | 103.70 GZ00 C |
| ATOM | 3274 | O | GLU | D | 216 | 16.586 | 19.934 | 0.031 | 1.00 | 103.19 GZ00 O |
| ATOM | 3275 | CB | GLU | D | 216 | 14.453 | 22.060 | −0.258 | 1.00 | 98.63 GZ00 C |
| ATOM | 3276 | CG | GLU | D | 216 | 14.051 | 23.474 | −0.741 | 1.00 | 99.48 GZ00 C |
| ATOM | 3277 | CD | GLU | D | 216 | 13.551 | 24.375 | 0.397 | 1.00 | 94.82 GZ00 C |
| ATOM | 3278 | OE1 | GLU | D | 216 | 14.356 | 24.704 | 1.304 | 1.00 | 90.53 GZ00 O |
| ATOM | 3279 | OE2 | GLU | D | 216 | 12.349 | 24.740 | 0.394 | 1.00 | 84.44 GZ00 O1− |
| TER | | | | | | | | | | |
| ATOM | 3280 | N | GLN | A | 1 | −34.534 | 69.246 | −14.750 | 1.00 | 68.93 N |
| ATOM | 3281 | CA | GLN | A | 1 | −35.181 | 70.408 | −14.148 | 1.00 | 63.15 C |
| ATOM | 3282 | C | GLN | A | 1 | −34.574 | 70.759 | −12.783 | 1.00 | 64.87 C |
| ATOM | 3283 | O | GLN | A | 1 | −34.907 | 70.176 | −11.757 | 1.00 | 73.80 O |
| ATOM | 3284 | CB | GLN | A | 1 | −36.678 | 70.168 | −14.001 | 1.00 | 72.61 C |
| ATOM | 3285 | CG | GLN | A | 1 | −37.438 | 71.350 | −13.425 | 1.00 | 79.05 C |
| ATOM | 3286 | CD | GLN | A | 1 | −38.607 | 70.901 | −12.574 | 1.00 | 82.55 C |
| ATOM | 3287 | OE1 | GLN | A | 1 | −38.585 | 69.803 | −12.013 | 1.00 | 76.25 O |
| ATOM | 3288 | NE2 | GLN | A | 1 | −39.638 | 71.743 | −12.478 | 1.00 | 75.07 N |
| ATOM | 3289 | N | VAL | A | 2 | −33.670 | 71.708 | −12.792 | 1.00 | 52.55 N |
| ATOM | 3290 | CA | VAL | A | 2 | −33.090 | 72.273 | −11.587 | 1.00 | 39.46 C |
| ATOM | 3291 | C | VAL | A | 2 | −33.760 | 73.615 | −11.340 | 1.00 | 37.36 C |
| ATOM | 3292 | O | VAL | A | 2 | −34.051 | 74.357 | −12.286 | 1.00 | 42.98 O |
| ATOM | 3293 | CB | VAL | A | 2 | −31.561 | 72.402 | −11.744 | 1.00 | 37.95 C |
| ATOM | 3294 | CG1 | VAL | A | 2 | −30.942 | 73.173 | −10.605 | 1.00 | 32.40 C |
| ATOM | 3295 | CG2 | VAL | A | 2 | −30.938 | 71.007 | −11.812 | 1.00 | 38.29 C |
| ATOM | 3296 | N | GLN | A | 3 | −34.074 | 73.905 | −10.086 | 1.00 | 28.57 N |
| ATOM | 3297 | CA | GLN | A | 3 | −34.530 | 75.234 | −9.705 | 1.00 | 36.17 C |
| ATOM | 3298 | C | GLN | A | 3 | −33.616 | 75.802 | −8.623 | 1.00 | 32.07 C |
| ATOM | 3299 | O | GLN | A | 3 | −33.291 | 75.112 | −7.650 | 1.00 | 33.31 O |
| ATOM | 3300 | CB | GLN | A | 3 | −35.981 | 75.198 | −9.230 | 1.00 | 33.26 C |
| ATOM | 3301 | CG | GLN | A | 3 | −36.980 | 75.166 | −10.396 | 1.00 | 48.28 C |
| ATOM | 3302 | CD | GLN | A | 3 | −38.422 | 75.482 | −9.975 | 1.00 | 66.43 C |
| ATOM | 3303 | OE1 | GLN | A | 3 | −38.748 | 75.535 | −8.779 | 1.00 | 59.16 O |
| ATOM | 3304 | NE2 | GLN | A | 3 | −39.284 | 75.714 | −10.964 | 1.00 | 65.91 N |
| ATOM | 3305 | N | LEU | A | 4 | −33.202 | 77.051 | −8.798 | 1.00 | 28.83 N |
| ATOM | 3306 | CA | LEU | A | 4 | −32.404 | 77.779 | −7.823 | 1.00 | 34.07 C |
| ATOM | 3307 | C | LEU | A | 4 | −33.199 | 79.004 | −7.385 | 1.00 | 31.68 C |
| ATOM | 3308 | O | LEU | A | 4 | −33.759 | 79.699 | −8.231 | 1.00 | 35.93 O |
| ATOM | 3309 | CB | LEU | A | 4 | −31.054 | 78.181 | −8.431 | 1.00 | 31.35 C |
| ATOM | 3310 | CG | LEU | A | 4 | −30.271 | 77.022 | −9.054 | 1.00 | 35.66 C |
| ATOM | 3311 | CD1 | LEU | A | 4 | −29.061 | 77.538 | −9.848 | 1.00 | 33.22 C |
| ATOM | 3312 | CD2 | LEU | A | 4 | −29.820 | 76.024 | −7.986 | 1.00 | 28.58 C |
| ATOM | 3313 | N | VAL | A | 5 | −33.296 | 79.236 | −6.074 | 1.00 | 31.24 N |
| ATOM | 3314 | CA | VAL | A | 5 | −34.075 | 80.340 | −5.501 | 1.00 | 29.71 C |
| ATOM | 3315 | C | VAL | A | 5 | −33.192 | 81.106 | −4.521 | 1.00 | 30.40 C |
| ATOM | 3316 | O | VAL | A | 5 | −32.883 | 80.594 | −3.439 | 1.00 | 34.07 O |
| ATOM | 3317 | CB | VAL | A | 5 | −35.352 | 79.849 | −4.790 | 1.00 | 33.16 C |
| ATOM | 3318 | CG1 | VAL | A | 5 | −36.116 | 81.023 | −4.194 | 1.00 | 22.32 C |
| ATOM | 3319 | CG2 | VAL | A | 5 | −36.244 | 79.088 | −5.746 | 1.00 | 27.68 C |
| ATOM | 3320 | N | GLU | A | 6 | −32.830 | 82.344 | −4.866 | 1.00 | 27.45 N |
| ATOM | 3321 | CA | GLU | A | 6 | −32.039 | 83.183 | −3.970 | 1.00 | 34.31 C |
| ATOM | 3322 | C | GLU | A | 6 | −32.938 | 83.895 | −2.964 | 1.00 | 35.66 C |
| ATOM | 3323 | O | GLU | A | 6 | −34.094 | 84.211 | −3.250 | 1.00 | 35.15 O |
| ATOM | 3324 | CB | GLU | A | 6 | −31.242 | 84.251 | −4.738 | 1.00 | 35.33 C |
| ATOM | 3325 | CG | GLU | A | 6 | −30.370 | 83.745 | −5.877 | 1.00 | 36.08 C |
| ATOM | 3326 | CD | GLU | A | 6 | −31.115 | 83.636 | −7.209 | 1.00 | 39.10 C |
| ATOM | 3327 | OE1 | GLU | A | 6 | −32.369 | 83.508 | −7.199 | 1.00 | 35.08 O |
| ATOM | 3328 | OE2 | GLU | A | 6 | −30.432 | 83.628 | −8.263 | 1.00 | 35.04 O1− |
| ATOM | 3329 | N | SER | A | 7 | −32.368 | 84.204 | −1.800 | 1.00 | 36.13 N |
| ATOM | 3330 | CA | SER | A | 7 | −33.075 | 84.945 | −0.763 | 1.00 | 34.15 C |
| ATOM | 3331 | C | SER | A | 7 | −32.033 | 85.588 | 0.132 | 1.00 | 31.67 C |
| ATOM | 3332 | O | SER | A | 7 | −30.848 | 85.263 | 0.062 | 1.00 | 34.14 O |
| ATOM | 3333 | CB | SER | A | 7 | −34.004 | 84.045 | 0.060 | 1.00 | 29.39 C |
| ATOM | 3334 | OG | SER | A | 7 | −33.246 | 83.029 | 0.704 | 1.00 | 39.57 O |
| ATOM | 3335 | N | GLY | A | 8 | −32.484 | 86.520 | 0.962 | 1.00 | 33.72 N |
| ATOM | 3336 | CA | GLY | A | 8 | −31.621 | 87.148 | 1.934 | 1.00 | 31.16 C |
| ATOM | 3337 | C | GLY | A | 8 | −31.165 | 88.543 | 1.590 | 1.00 | 40.14 C |
| ATOM | 3338 | O | GLY | A | 8 | −30.323 | 89.095 | 2.311 | 1.00 | 41.88 O |
| ATOM | 3339 | N | GLY | A | 9 | −31.679 | 89.131 | 0.518 | 1.00 | 30.46 N |
| ATOM | 3340 | CA | GLY | A | 9 | −31.281 | 90.478 | 0.150 | 1.00 | 42.56 C |
| ATOM | 3341 | C | GLY | A | 9 | −31.699 | 91.554 | 1.150 | 1.00 | 45.12 C |
| ATOM | 3342 | O | GLY | A | 9 | −31.989 | 91.303 | 2.319 | 1.00 | 45.51 O |
| ATOM | 3343 | N | GLY | A | 10 | −31.614 | 92.794 | 0.695 | 1.00 | 40.16 N |
| ATOM | 3344 | CA | GLY | A | 10 | −32.173 | 93.880 | 1.461 | 1.00 | 36.55 C |
| ATOM | 3345 | C | GLY | A | 10 | −31.303 | 95.118 | 1.379 | 1.00 | 41.88 C |
| ATOM | 3346 | O | GLY | A | 10 | −30.334 | 95.184 | 0.617 | 1.00 | 34.74 O |
| ATOM | 3347 | N | VAL | A | 11 | −31.676 | 96.112 | 2.184 | 1.00 | 37.50 N |
| ATOM | 3348 | CA | VAL | A | 11 | −30.953 | 97.369 | 2.303 | 1.00 | 38.58 C |
| ATOM | 3349 | C | VAL | A | 11 | −30.020 | 97.243 | 3.493 | 1.00 | 43.54 C |
| ATOM | 3350 | O | VAL | A | 11 | −30.423 | 96.759 | 4.555 | 1.00 | 47.55 O |
| ATOM | 3351 | CB | VAL | A | 11 | −31.911 | 98.559 | 2.483 | 1.00 | 48.63 C |

TABLE 10.3-continued

| | | | | | | | | | | |
|---|---|---|---|---|---|---|---|---|---|---|
| ATOM | 3352 | CG1 | VAL | A | 11 | −31.118 | 99.850 | 2.585 | 1.00 | 43.07 | C |
| ATOM | 3353 | CG2 | VAL | A | 11 | −32.901 | 98.626 | 1.323 | 1.00 | 45.11 | C |
| ATOM | 3354 | N | VAL | A | 12 | −28.773 | 97.676 | 3.324 | 1.00 | 36.28 | N |
| ATOM | 3355 | CA | VAL | A | 12 | −27.767 | 97.511 | 4.364 | 1.00 | 44.38 | C |
| ATOM | 3356 | C | VAL | A | 12 | −26.802 | 98.696 | 4.298 | 1.00 | 42.35 | C |
| ATOM | 3357 | O | VAL | A | 12 | −26.638 | 99.336 | 3.253 | 1.00 | 42.56 | O |
| ATOM | 3358 | CB | VAL | A | 12 | −27.051 | 96.138 | 4.207 | 1.00 | 47.04 | C |
| ATOM | 3359 | CG1 | VAL | A | 12 | −26.272 | 96.069 | 2.897 | 1.00 | 44.35 | C |
| ATOM | 3360 | CG2 | VAL | A | 12 | −26.125 | 95.864 | 5.359 | 1.00 | 49.20 | C |
| ATOM | 3361 | N | GLN | A | 13 | −26.197 | 99.009 | 5.427 | 1.00 | 43.55 | N |
| ATOM | 3362 | CA | GLN | A | 13 | −25.312 | 100.156 | 5.405 | 1.00 | 44.17 | C |
| ATOM | 3363 | C | GLN | A | 13 | −23.884 | 99.743 | 5.086 | 1.00 | 47.16 | C |
| ATOM | 3364 | O | GLN | A | 13 | −23.471 | 98.619 | 5.399 | 1.00 | 45.14 | O |
| ATOM | 3365 | CB | GLN | A | 13 | −25.334 | 100.881 | 6.734 | 1.00 | 45.16 | C |
| ATOM | 3366 | CG | GLN | A | 13 | −26.698 | 101.357 | 7.135 | 1.00 | 59.94 | C |
| ATOM | 3367 | CD | GLN | A | 13 | −26.607 | 102.516 | 8.099 | 1.00 | 69.00 | C |
| ATOM | 3368 | OE1 | GLN | A | 13 | −26.037 | 103.566 | 7.771 | 1.00 | 69.47 | O |
| ATOM | 3369 | NE2 | GLN | A | 13 | −27.151 | 102.335 | 9.297 | 1.00 | 70.89 | N |
| ATOM | 3370 | N | PRO | A | 14 | −23.132 | 100.657 | 4.472 | 1.00 | 41.71 | N |
| ATOM | 3371 | CA | PRO | A | 14 | −21.726 | 100.372 | 4.167 | 1.00 | 38.64 | C |
| ATOM | 3372 | C | PRO | A | 14 | −21.001 | 99.888 | 5.411 | 1.00 | 41.46 | C |
| ATOM | 3373 | O | PRO | A | 14 | −21.225 | 100.390 | 6.512 | 1.00 | 43.96 | O |
| ATOM | 3374 | CB | PRO | A | 14 | −21.191 | 101.725 | 3.683 | 1.00 | 36.30 | C |
| ATOM | 3375 | CG | PRO | A | 14 | −22.417 | 102.449 | 3.166 | 1.00 | 37.34 | C |
| ATOM | 3376 | CD | PRO | A | 14 | −23.553 | 101.995 | 4.015 | 1.00 | 42.17 | C |
| ATOM | 3377 | N | GLY | A | 15 | −20.150 | 98.877 | 5.237 | 1.00 | 39.52 | N |
| ATOM | 3378 | CA | GLY | A | 15 | −19.389 | 98.318 | 6.335 | 1.00 | 35.94 | C |
| ATOM | 3379 | C | GLY | A | 15 | −20.077 | 97.199 | 7.088 | 1.00 | 40.72 | C |
| ATOM | 3380 | O | GLY | A | 15 | −19.407 | 96.463 | 7.826 | 1.00 | 44.51 | O |
| ATOM | 3381 | N | ARG | A | 16 | −21.388 | 97.045 | 6.924 | 1.00 | 39.84 | N |
| ATOM | 3382 | CA | ARG | A | 16 | −22.114 | 95.953 | 7.556 | 1.00 | 53.52 | C |
| ATOM | 3383 | C | ARG | A | 16 | −21.962 | 94.660 | 6.746 | 1.00 | 46.84 | C |
| ATOM | 3384 | O | ARG | A | 16 | −21.259 | 94.600 | 5.727 | 1.00 | 39.84 | O |
| ATOM | 3385 | CB | ARG | A | 16 | −23.592 | 96.303 | 7.706 | 1.00 | 54.09 | C |
| ATOM | 3386 | CG | ARG | A | 16 | −23.880 | 97.531 | 8.533 | 1.00 | 61.92 | C |
| ATOM | 3387 | CD | ARG | A | 16 | −23.430 | 97.323 | 9.960 | 1.00 | 69.75 | C |
| ATOM | 3388 | NE | ARG | A | 16 | −24.436 | 97.796 | 10.906 | 1.00 | 97.69 | N |
| ATOM | 3389 | CZ | ARG | A | 16 | −24.245 | 97.901 | 12.218 | 1.00 | 105.26 | C |
| ATOM | 3390 | NH1 | ARG | A | 16 | −23.075 | 97.566 | 12.754 | 1.00 | 97.15 | N1+ |
| ATOM | 3391 | NH2 | ARG | A | 16 | −25.226 | 98.346 | 12.995 | 1.00 | 108.93 | N |
| ATOM | 3392 | N | SER | A | 17 | −22.664 | 93.625 | 7.206 | 1.00 | 37.36 | N |
| ATOM | 3393 | CA | SER | A | 17 | −22.586 | 92.271 | 6.692 | 1.00 | 37.19 | C |
| ATOM | 3394 | C | SER | A | 17 | −23.962 | 91.796 | 6.274 | 1.00 | 41.75 | C |
| ATOM | 3395 | O | SER | A | 17 | −24.980 | 92.251 | 6.795 | 1.00 | 39.73 | O |
| ATOM | 3396 | CB | SER | A | 17 | −22.044 | 91.275 | 7.738 | 1.00 | 42.19 | C |
| ATOM | 3397 | OG | SER | A | 17 | −20.664 | 91.495 | 7.994 | 1.00 | 55.67 | O |
| ATOM | 3398 | N | LEU | A | 18 | −23.976 | 90.833 | 5.361 | 1.00 | 40.66 | N |
| ATOM | 3399 | CA | LEU | A | 18 | −25.220 | 90.256 | 4.877 | 1.00 | 42.98 | C |
| ATOM | 3400 | C | LEU | A | 18 | −24.901 | 88.861 | 4.361 | 1.00 | 40.59 | C |
| ATOM | 3401 | O | LEU | A | 18 | −23.804 | 88.623 | 3.850 | 1.00 | 41.78 | O |
| ATOM | 3402 | CB | LEU | A | 18 | −25.806 | 91.135 | 3.773 | 1.00 | 44.15 | C |
| ATOM | 3403 | CG | LEU | A | 18 | −27.278 | 91.269 | 3.460 | 1.00 | 54.36 | C |
| ATOM | 3404 | CD1 | LEU | A | 18 | −28.038 | 91.644 | 4.712 | 1.00 | 49.30 | C |
| ATOM | 3405 | CD2 | LEU | A | 18 | −27.392 | 92.395 | 2.454 | 1.00 | 49.78 | C |
| ATOM | 3406 | N | ARG | A | 19 | −25.848 | 87.940 | 4.497 | 1.00 | 30.82 | N |
| ATOM | 3407 | CA | ARG | A | 19 | −25.670 | 86.595 | 3.965 | 1.00 | 34.82 | C |
| ATOM | 3408 | C | ARG | A | 19 | −26.783 | 86.270 | 2.981 | 1.00 | 34.54 | C |
| ATOM | 3409 | O | ARG | A | 19 | −27.959 | 86.364 | 3.329 | 1.00 | 38.10 | O |
| ATOM | 3410 | CB | ARG | A | 19 | −25.635 | 85.549 | 5.073 | 1.00 | 35.74 | C |
| ATOM | 3411 | CG | ARG | A | 19 | −25.012 | 84.268 | 4.606 | 1.00 | 37.23 | C |
| ATOM | 3412 | CD | ARG | A | 19 | −25.223 | 83.128 | 5.579 | 1.00 | 38.05 | C |
| ATOM | 3413 | NE | ARG | A | 19 | −26.633 | 82.826 | 5.730 | 1.00 | 39.69 | N |
| ATOM | 3414 | CZ | ARG | A | 19 | −27.107 | 81.838 | 6.477 | 1.00 | 47.15 | C |
| ATOM | 3415 | NH1 | ARG | A | 19 | −28.419 | 81.642 | 6.559 | 1.00 | 43.39 | N1+ |
| ATOM | 3416 | NH2 | ARG | A | 19 | −26.271 | 81.043 | 7.130 | 1.00 | 46.94 | N |
| ATOM | 3417 | N | LEU | A | 20 | −26.416 | 85.921 | 1.750 | 1.00 | 33.95 | N |
| ATOM | 3418 | CA | LEU | A | 20 | −27.386 | 85.431 | 0.783 | 1.00 | 32.04 | C |
| ATOM | 3419 | C | LEU | A | 20 | −27.486 | 83.908 | 0.841 | 1.00 | 35.48 | C |
| ATOM | 3420 | O | LEU | A | 20 | −26.522 | 83.206 | 1.174 | 1.00 | 34.13 | O |
| ATOM | 3421 | CB | LEU | A | 20 | −27.019 | 85.873 | −0.631 | 1.00 | 26.84 | C |
| ATOM | 3422 | CG | LEU | A | 20 | −26.829 | 87.380 | −0.792 | 1.00 | 31.60 | C |
| ATOM | 3423 | CD1 | LEU | A | 20 | −26.621 | 87.704 | −2.261 | 1.00 | 25.55 | C |
| ATOM | 3424 | CD2 | LEU | A | 20 | −28.028 | 88.140 | −0.220 | 1.00 | 24.15 | C |
| ATOM | 3425 | N | SER | A | 21 | −28.675 | 83.403 | 0.528 | 1.00 | 33.17 | N |
| ATOM | 3426 | CA | SER | A | 21 | −28.924 | 81.976 | 0.391 | 1.00 | 32.39 | C |
| ATOM | 3427 | C | SER | A | 21 | −29.441 | 81.658 | −1.002 | 1.00 | 34.28 | C |
| ATOM | 3428 | O | SER | A | 21 | −30.123 | 82.470 | −1.633 | 1.00 | 35.15 | O |
| ATOM | 3429 | CB | SER | A | 21 | −29.944 | 81.457 | 1.411 | 1.00 | 29.91 | C |
| ATOM | 3430 | OG | SER | A | 21 | −29.401 | 81.456 | 2.706 | 1.00 | 32.59 | O |
| ATOM | 3431 | N | CYS | A | 22 | −29.122 | 80.452 | −1.463 | 1.00 | 29.55 | N |

TABLE 10.3-continued

| | | | | | | | | | | |
|---|---|---|---|---|---|---|---|---|---|---|
| ATOM | 3432 | CA | CYS | A | 22 | −29.608 | 79.954 | −2.740 | 1.00 | 29.82 | C |
| ATOM | 3433 | C | CYS | A | 22 | −30.059 | 78.520 | −2.506 | 1.00 | 34.08 | C |
| ATOM | 3434 | O | CYS | A | 22 | −29.225 | 77.635 | −2.286 | 1.00 | 33.80 | O |
| ATOM | 3435 | CB | CYS | A | 22 | −28.515 | 80.040 | −3.803 | 1.00 | 37.60 | C |
| ATOM | 3436 | SG | CYS | A | 22 | −28.846 | 79.175 | −5.362 | 1.00 | 44.81 | S |
| ATOM | 3437 | N | ALA | A | 23 | −31.366 | 78.297 | −2.544 | 1.00 | 27.47 | N |
| ATOM | 3438 | CA | ALA | A | 23 | −31.956 | 77.006 | −2.235 | 1.00 | 31.62 | C |
| ATOM | 3439 | C | ALA | A | 23 | −32.152 | 76.263 | −3.540 | 1.00 | 32.14 | C |
| ATOM | 3440 | O | ALA | A | 23 | −32.753 | 76.799 | −4.480 | 1.00 | 32.98 | O |
| ATOM | 3441 | CB | ALA | A | 23 | −33.296 | 77.155 | −1.500 | 1.00 | 23.36 | C |
| ATOM | 3442 | N | ALA | A | 24 | −31.646 | 75.037 | −3.593 | 1.00 | 31.79 | N |
| ATOM | 3443 | CA | ALA | A | 24 | −31.642 | 74.239 | −4.809 | 1.00 | 29.92 | C |
| ATOM | 3444 | C | ALA | A | 24 | −32.595 | 73.062 | −4.685 | 1.00 | 29.71 | C |
| ATOM | 3445 | O | ALA | A | 24 | −32.735 | 72.476 | −3.612 | 1.00 | 39.67 | O |
| ATOM | 3446 | CB | ALA | A | 24 | −30.238 | 73.724 | −5.104 | 1.00 | 27.23 | C |
| ATOM | 3447 | N | SER | A | 25 | −33.239 | 72.708 | −5.790 | 1.00 | 32.42 | N |
| ATOM | 3448 | CA | SER | A | 25 | −34.067 | 71.515 | −5.851 | 1.00 | 28.53 | C |
| ATOM | 3449 | C | SER | A | 25 | −34.108 | 70.982 | −7.273 | 1.00 | 34.80 | C |
| ATOM | 3450 | O | SER | A | 25 | −33.754 | 71.688 | −8.228 | 1.00 | 28.65 | O |
| ATOM | 3451 | CB | SER | A | 25 | −35.484 | 71.822 | −5.400 | 1.00 | 36.68 | C |
| ATOM | 3452 | OG | SER | A | 25 | −36.046 | 72.798 | −6.269 | 1.00 | 34.63 | O |
| ATOM | 3453 | N | GLY | A | 26 | −34.558 | 69.720 | −7.410 | 1.00 | 31.26 | N |
| ATOM | 3454 | CA | GLY | A | 26 | −34.824 | 69.150 | −8.718 | 1.00 | 31.69 | C |
| ATOM | 3455 | C | GLY | A | 26 | −33.759 | 68.254 | −9.323 | 1.00 | 50.48 | C |
| ATOM | 3456 | O | GLY | A | 26 | −33.944 | 67.786 | −10.460 | 1.00 | 59.29 | O |
| ATOM | 3457 | N | PHE | A | 27 | −32.666 | 68.001 | −8.613 | 1.00 | 34.76 | N |
| ATOM | 3458 | CA | PHE | A | 27 | −31.536 | 67.198 | −9.082 | 1.00 | 36.25 | C |
| ATOM | 3459 | C | PHE | A | 27 | −30.495 | 67.347 | −8.004 | 1.00 | 35.91 | C |
| ATOM | 3460 | O | PHE | A | 27 | −30.163 | 68.473 | −7.622 | 1.00 | 41.91 | O |
| ATOM | 3461 | CB | PHE | A | 27 | −30.986 | 67.647 | −10.455 | 1.00 | 34.34 | C |
| ATOM | 3462 | CG | PHE | A | 27 | −29.671 | 66.974 | −10.868 | 1.00 | 35.77 | C |
| ATOM | 3463 | CD1 | PHE | A | 27 | −29.467 | 65.601 | −10.706 | 1.00 | 38.27 | C |
| ATOM | 3464 | CD2 | PHE | A | 27 | −28.645 | 67.728 | −11.455 | 1.00 | 39.96 | C |
| ATOM | 3465 | CE1 | PHE | A | 27 | −28.246 | 64.992 | −11.075 | 1.00 | 42.34 | C |
| ATOM | 3466 | CE2 | PHE | A | 27 | −27.422 | 67.132 | −11.848 | 1.00 | 39.02 | C |
| ATOM | 3467 | CZ | PHE | A | 27 | −27.221 | 65.758 | −11.651 | 1.00 | 37.64 | C |
| ATOM | 3468 | N | THR | A | 28 | −29.960 | 66.224 | −7.555 | 1.00 | 34.00 | N |
| ATOM | 3469 | CA | THR | A | 28 | −29.086 | 66.145 | −6.398 | 1.00 | 32.16 | C |
| ATOM | 3470 | C | THR | A | 28 | −28.160 | 67.347 | −6.297 | 1.00 | 32.73 | C |
| ATOM | 3471 | O | THR | A | 28 | −27.324 | 67.570 | −7.174 | 1.00 | 34.74 | O |
| ATOM | 3472 | CB | THR | A | 28 | −28.286 | 64.858 | −6.521 | 1.00 | 39.57 | C |
| ATOM | 3473 | OG1 | THR | A | 28 | −29.211 | 63.801 | −6.780 | 1.00 | 48.76 | O |
| ATOM | 3474 | CG2 | THR | A | 28 | −27.527 | 64.570 | −5.250 | 1.00 | 39.97 | C |
| ATOM | 3475 | N | PHE | A | 29 | −28.340 | 68.137 | −5.232 | 1.00 | 37.84 | N |
| ATOM | 3476 | CA | PHE | A | 29 | −27.545 | 69.348 | −5.012 | 1.00 | 34.13 | C |
| ATOM | 3477 | C | PHE | A | 29 | −26.050 | 69.063 | −5.057 | 1.00 | 35.71 | C |
| ATOM | 3478 | O | PHE | A | 29 | −25.277 | 69.821 | −5.666 | 1.00 | 31.39 | O |
| ATOM | 3479 | CB | PHE | A | 29 | −27.924 | 69.954 | −3.661 | 1.00 | 33.04 | C |
| ATOM | 3480 | CG | PHE | A | 29 | −27.217 | 71.251 | −3.309 | 1.00 | 29.10 | C |
| ATOM | 3481 | CD1 | PHE | A | 29 | −27.347 | 72.386 | −4.112 | 1.00 | 28.49 | C |
| ATOM | 3482 | CD2 | PHE | A | 29 | −26.505 | 71.364 | −2.117 | 1.00 | 30.52 | C |
| ATOM | 3483 | CE1 | PHE | A | 29 | −26.748 | 73.607 | −3.754 | 1.00 | 29.07 | C |
| ATOM | 3484 | CE2 | PHE | A | 29 | −25.893 | 72.592 | −1.755 | 1.00 | 33.69 | C |
| ATOM | 3485 | CZ | PHE | A | 29 | −26.023 | 73.707 | −2.578 | 1.00 | 27.96 | C |
| ATOM | 3486 | N | SER | A | 30 | −25.628 | 67.963 | −4.434 | 1.00 | 33.43 | N |
| ATOM | 3487 | CA | SER | A | 30 | −24.208 | 67.634 | −4.348 | 1.00 | 38.52 | C |
| ATOM | 3488 | C | SER | A | 30 | −23.621 | 67.208 | −5.682 | 1.00 | 33.12 | C |
| ATOM | 3489 | O | SER | A | 30 | −22.422 | 66.936 | −5.741 | 1.00 | 35.08 | O |
| ATOM | 3490 | CB | SER | A | 30 | −23.988 | 66.534 | −3.303 | 1.00 | 28.69 | C |
| ATOM | 3491 | OG | SER | A | 30 | −24.728 | 65.385 | −3.669 | 1.00 | 38.89 | O |
| ATOM | 3492 | N | SER | A | 31 | −24.419 | 67.147 | −6.740 | 1.00 | 27.16 | N |
| ATOM | 3493 | CA | SER | A | 31 | −23.905 | 66.778 | −8.045 | 1.00 | 38.98 | C |
| ATOM | 3494 | C | SER | A | 31 | −23.443 | 67.962 | −8.896 | 1.00 | 39.11 | C |
| ATOM | 3495 | O | SER | A | 31 | −23.036 | 67.740 | −10.050 | 1.00 | 33.54 | O |
| ATOM | 3496 | CB | SER | A | 31 | −24.944 | 65.966 | −8.806 | 1.00 | 31.50 | C |
| ATOM | 3497 | OG | SER | A | 31 | −25.034 | 64.689 | −8.205 | 1.00 | 43.55 | O |
| ATOM | 3498 | N | TYR | A | 32 | −23.469 | 69.194 | −8.377 | 1.00 | 30.49 | N |
| ATOM | 3499 | CA | TYR | A | 32 | −22.942 | 70.307 | −9.164 | 1.00 | 28.71 | C |
| ATOM | 3500 | C | TYR | A | 32 | −22.356 | 71.382 | −8.268 | 1.00 | 29.76 | C |
| ATOM | 3501 | O | TYR | A | 32 | −22.712 | 71.503 | −7.092 | 1.00 | 29.23 | O |
| ATOM | 3502 | CB | TYR | A | 32 | −24.002 | 70.910 | −10.078 | 1.00 | 34.80 | C |
| ATOM | 3503 | CG | TYR | A | 32 | −25.331 | 71.155 | −9.416 | 1.00 | 32.18 | C |
| ATOM | 3504 | CD1 | TYR | A | 32 | −25.549 | 72.299 | −8.660 | 1.00 | 33.21 | C |
| ATOM | 3505 | CD2 | TYR | A | 32 | −26.364 | 70.259 | −9.562 | 1.00 | 32.73 | C |
| ATOM | 3506 | CE1 | TYR | A | 32 | −26.770 | 72.536 | −8.050 | 1.00 | 37.14 | C |
| ATOM | 3507 | CE2 | TYR | A | 32 | −27.589 | 70.484 | −8.953 | 1.00 | 36.08 | C |
| ATOM | 3508 | CZ | TYR | A | 32 | −27.783 | 71.621 | −8.202 | 1.00 | 34.54 | C |
| ATOM | 3509 | OH | TYR | A | 32 | −28.995 | 71.854 | −7.605 | 1.00 | 42.41 | O |
| ATOM | 3510 | N | GLY | A | 33 | −21.391 | 72.118 | −8.828 | 1.00 | 29.06 | N |
| ATOM | 3511 | CA | GLY | A | 33 | −20.917 | 73.336 | −8.213 | 1.00 | 26.22 | C |

TABLE 10.3-continued

| | | | | | | | | | | |
|---|---|---|---|---|---|---|---|---|---|---|
| ATOM | 3512 | C | GLY | A | 33 | −21.823 | 74.508 | −8.562 | 1.00 | 32.33 | C |
| ATOM | 3513 | O | GLY | A | 33 | −22.749 | 74.389 | −9.373 | 1.00 | 32.28 | O |
| ATOM | 3514 | N | LEU | A | 34 | −21.549 | 75.660 | −7.944 | 1.00 | 28.11 | N |
| ATOM | 3515 | CA | LEU | A | 34 | −22.397 | 76.825 | −8.149 | 1.00 | 28.06 | C |
| ATOM | 3516 | C | LEU | A | 34 | −21.579 | 78.107 | −8.137 | 1.00 | 32.81 | C |
| ATOM | 3517 | O | LEU | A | 34 | −20.482 | 78.185 | −7.562 | 1.00 | 30.26 | O |
| ATOM | 3518 | CB | LEU | A | 34 | −23.503 | 76.934 | −7.083 | 1.00 | 25.69 | C |
| ATOM | 3519 | CG | LEU | A | 34 | −24.496 | 75.772 | −7.075 | 1.00 | 29.24 | C |
| ATOM | 3520 | CD1 | LEU | A | 34 | −24.122 | 74.810 | −5.948 | 1.00 | 25.51 | C |
| ATOM | 3521 | CD2 | LEU | A | 34 | −25.937 | 76.248 | −6.951 | 1.00 | 28.69 | C |
| ATOM | 3522 | N | HIS | A | 35 | −22.174 | 79.124 | −8.757 | 1.00 | 25.76 | N |
| ATOM | 3523 | CA | HIS | A | 35 | −21.645 | 80.469 | −8.877 | 1.00 | 28.30 | C |
| ATOM | 3524 | C | HIS | A | 35 | −22.559 | 81.459 | −8.167 | 1.00 | 28.45 | C |
| ATOM | 3525 | O | HIS | A | 35 | −23.771 | 81.255 | −8.047 | 1.00 | 26.56 | O |
| ATOM | 3526 | CB | HIS | A | 35 | −21.583 | 80.946 | −10.334 | 1.00 | 27.75 | C |
| ATOM | 3527 | CG | HIS | A | 35 | −20.599 | 80.236 | −11.204 | 1.00 | 34.48 | C |
| ATOM | 3528 | ND1 | HIS | A | 35 | −19.305 | 80.689 | −11.377 | 1.00 | 31.96 | N |
| ATOM | 3529 | CD2 | HIS | A | 35 | −20.742 | 79.174 | −12.034 | 1.00 | 27.73 | C |
| ATOM | 3530 | CE1 | HIS | A | 35 | −18.693 | 79.927 | −12.263 | 1.00 | 30.71 | C |
| ATOM | 3531 | NE2 | HIS | A | 35 | −19.537 | 78.989 | −12.664 | 1.00 | 32.82 | N |
| ATOM | 3532 | N | TRP | A | 36 | −21.971 | 82.583 | −7.793 | 1.00 | 24.52 | N |
| ATOM | 3533 | CA | TRP | A | 36 | −22.702 | 83.815 | −7.578 | 1.00 | 24.53 | C |
| ATOM | 3534 | C | TRP | A | 36 | −22.276 | 84.804 | −8.656 | 1.00 | 30.64 | C |
| ATOM | 3535 | O | TRP | A | 36 | −21.078 | 84.979 | −8.895 | 1.00 | 31.45 | O |
| ATOM | 3536 | CB | TRP | A | 36 | −22.431 | 84.389 | −6.184 | 1.00 | 25.38 | C |
| ATOM | 3537 | CG | TRP | A | 36 | −23.102 | 83.636 | −5.061 | 1.00 | 34.21 | C |
| ATOM | 3538 | CD1 | TRP | A | 36 | −22.528 | 82.700 | −4.225 | 1.00 | 27.01 | C |
| ATOM | 3539 | CD2 | TRP | A | 36 | −24.483 | 83.734 | −4.662 | 1.00 | 29.26 | C |
| ATOM | 3540 | NE1 | TRP | A | 36 | −23.464 | 82.236 | −3.328 | 1.00 | 29.61 | N |
| ATOM | 3541 | CE2 | TRP | A | 36 | −24.669 | 82.850 | −3.574 | 1.00 | 29.15 | C |
| ATOM | 3542 | CE3 | TRP | A | 36 | −25.569 | 84.500 | −5.104 | 1.00 | 31.70 | C |
| ATOM | 3543 | CZ2 | TRP | A | 36 | −25.902 | 82.707 | −2.925 | 1.00 | 29.62 | C |
| ATOM | 3544 | CZ3 | TRP | A | 36 | −26.795 | 84.353 | −4.464 | 1.00 | 31.58 | C |
| ATOM | 3545 | CH2 | TRP | A | 36 | −26.950 | 83.447 | −3.390 | 1.00 | 32.02 | C |
| ATOM | 3546 | N | VAL | A | 37 | −23.255 | 85.430 | −9.315 | 1.00 | 26.17 | N |
| ATOM | 3547 | CA | VAL | A | 37 | −23.052 | 86.487 | −10.305 | 1.00 | 26.93 | C |
| ATOM | 3548 | C | VAL | A | 37 | −23.911 | 87.683 | −9.909 | 1.00 | 31.18 | C |
| ATOM | 3549 | O | VAL | A | 37 | −24.979 | 87.514 | −9.311 | 1.00 | 32.57 | O |
| ATOM | 3550 | CB | VAL | A | 37 | −23.436 | 86.003 | −11.725 | 1.00 | 30.07 | C |
| ATOM | 3551 | CG1 | VAL | A | 37 | −23.336 | 87.141 | −12.741 | 1.00 | 25.17 | C |
| ATOM | 3552 | CG2 | VAL | A | 37 | −22.577 | 84.797 | −12.141 | 1.00 | 27.92 | C |
| ATOM | 3553 | N | ARG | A | 38 | −23.451 | 88.900 | −10.217 | 1.00 | 26.83 | N |
| ATOM | 3554 | CA | ARG | A | 38 | −24.222 | 90.086 | −9.838 | 1.00 | 28.59 | C |
| ATOM | 3555 | C | ARG | A | 38 | −24.327 | 91.074 | −10.987 | 1.00 | 32.00 | C |
| ATOM | 3556 | O | ARG | A | 38 | −23.546 | 91.042 | −11.942 | 1.00 | 34.12 | O |
| ATOM | 3557 | CB | ARG | A | 38 | −23.649 | 90.790 | −8.616 | 1.00 | 24.52 | C |
| ATOM | 3558 | CG | ARG | A | 38 | −22.405 | 91.581 | −8.863 | 1.00 | 27.87 | C |
| ATOM | 3559 | CD | ARG | A | 38 | −21.832 | 92.016 | −7.532 | 1.00 | 25.42 | C |
| ATOM | 3560 | NE | ARG | A | 38 | −20.569 | 92.691 | −7.719 | 1.00 | 26.21 | N |
| ATOM | 3561 | CZ | ARG | A | 38 | −19.825 | 93.186 | −6.735 | 1.00 | 33.88 | C |
| ATOM | 3562 | NH1 | ARG | A | 38 | −20.207 | 93.058 | −5.470 | 1.00 | 31.46 | N1+ |
| ATOM | 3563 | NH2 | ARG | A | 38 | −18.700 | 93.822 | −7.026 | 1.00 | 27.28 | N |
| ATOM | 3564 | N | GLN | A | 39 | −25.317 | 91.961 | −10.874 | 1.00 | 31.14 | N |
| ATOM | 3565 | CA | GLN | A | 39 | −25.594 | 92.942 | −11.923 | 1.00 | 26.67 | C |
| ATOM | 3566 | C | GLN | A | 39 | −26.067 | 94.237 | −11.278 | 1.00 | 33.37 | C |
| ATOM | 3567 | O | GLN | A | 39 | −27.144 | 94.282 | −10.657 | 1.00 | 30.44 | O |
| ATOM | 3568 | CB | GLN | A | 39 | −26.635 | 92.419 | −12.901 | 1.00 | 29.71 | C |
| ATOM | 3569 | CG | GLN | A | 39 | −26.977 | 93.391 | −14.031 | 1.00 | 30.87 | C |
| ATOM | 3570 | CD | GLN | A | 39 | −27.797 | 92.710 | −15.108 | 1.00 | 35.35 | C |
| ATOM | 3571 | OE1 | GLN | A | 39 | −28.796 | 92.048 | −14.812 | 1.00 | 37.94 | O |
| ATOM | 3572 | NE2 | GLN | A | 39 | −27.370 | 92.841 | −16.358 | 1.00 | 26.92 | N |
| ATOM | 3573 | N | ALA | A | 40 | −25.269 | 95.279 | −11.425 | 1.00 | 28.05 | N |
| ATOM | 3574 | CA | ALA | A | 40 | −25.664 | 96.588 | −10.926 | 1.00 | 34.65 | C |
| ATOM | 3575 | C | ALA | A | 40 | −26.709 | 97.199 | −11.859 | 1.00 | 34.83 | C |
| ATOM | 3576 | O | ALA | A | 40 | −26.757 | 96.861 | −13.039 | 1.00 | 32.60 | O |
| ATOM | 3577 | CB | ALA | A | 40 | −24.443 | 97.499 | −10.812 | 1.00 | 29.23 | C |
| ATOM | 3578 | N | PRO | A | 41 | −27.556 | 98.095 | −11.352 | 1.00 | 41.70 | N |
| ATOM | 3579 | CA | PRO | A | 41 | −28.654 | 98.645 | −12.175 | 1.00 | 37.62 | C |
| ATOM | 3580 | C | PRO | A | 41 | −28.143 | 99.327 | −13.440 | 1.00 | 38.87 | C |
| ATOM | 3581 | O | PRO | A | 41 | −27.259 | 100.188 | −13.392 | 1.00 | 37.58 | O |
| ATOM | 3582 | CB | PRO | A | 41 | −29.330 | 99.656 | −11.236 | 1.00 | 34.86 | C |
| ATOM | 3583 | CG | PRO | A | 41 | −28.936 | 99.229 | −9.859 | 1.00 | 40.20 | C |
| ATOM | 3584 | CD | PRO | A | 41 | −27.557 | 98.641 | −9.983 | 1.00 | 35.94 | C |
| ATOM | 3585 | N | GLY | A | 42 | −28.698 | 98.918 | −14.578 | 1.00 | 36.04 | N |
| ATOM | 3586 | CA | GLY | A | 42 | −28.295 | 99.408 | −15.887 | 1.00 | 32.92 | C |
| ATOM | 3587 | C | GLY | A | 42 | −26.969 | 98.887 | −16.429 | 1.00 | 42.89 | C |
| ATOM | 3588 | O | GLY | A | 42 | −26.492 | 99.395 | −17.446 | 1.00 | 48.01 | O |
| ATOM | 3589 | N | LYS | A | 43 | −26.358 | 97.882 | −15.817 | 1.00 | 37.13 | N |
| ATOM | 3590 | CA | LYS | A | 43 | −25.003 | 97.473 | −16.196 | 1.00 | 39.84 | C |
| ATOM | 3591 | C | LYS | A | 43 | −24.961 | 95.989 | −16.548 | 1.00 | 36.76 | C |

TABLE 10.3-continued

| | | | | | | | | | | |
|---|---|---|---|---|---|---|---|---|---|---|
| ATOM | 3592 | O | LYS | A | 43 | −25.989 | 95.301 | −16.591 | 1.00 | 33.65 | O |
| ATOM | 3593 | CB | LYS | A | 43 | −24.004 | 97.816 | −15.094 | 1.00 | 35.22 | C |
| ATOM | 3594 | CG | LYS | A | 43 | −23.960 | 99.326 | −14.833 | 1.00 | 42.47 | C |
| ATOM | 3595 | CD | LYS | A | 43 | −22.804 | 99.688 | −13.941 | 1.00 | 57.71 | C |
| ATOM | 3596 | CE | LYS | A | 43 | −22.589 | 101.201 | −13.864 | 1.00 | 72.06 | C |
| ATOM | 3597 | NZ | LYS | A | 43 | −21.339 | 101.531 | −13.103 | 1.00 | 70.64 | N1+ |
| ATOM | 3598 | N | GLY | A | 44 | −23.743 | 95.520 | −16.834 | 1.00 | 31.12 | N |
| ATOM | 3599 | CA | GLY | A | 44 | −23.510 | 94.165 | −17.290 | 1.00 | 28.92 | C |
| ATOM | 3600 | C | GLY | A | 44 | −23.333 | 93.158 | −16.166 | 1.00 | 33.92 | C |
| ATOM | 3601 | O | GLY | A | 44 | −23.295 | 93.484 | −14.979 | 1.00 | 35.65 | O |
| ATOM | 3602 | N | LEU | A | 45 | −23.202 | 91.898 | −16.569 | 1.00 | 31.47 | N |
| ATOM | 3603 | CA | LEU | A | 45 | −22.959 | 90.839 | −15.606 | 1.00 | 26.60 | C |
| ATOM | 3604 | C | LEU | A | 45 | −21.542 | 90.959 | −15.072 | 1.00 | 31.15 | C |
| ATOM | 3605 | O | LEU | A | 45 | −20.601 | 91.246 | −15.820 | 1.00 | 31.96 | O |
| ATOM | 3606 | CB | LEU | A | 45 | −23.173 | 89.462 | −16.256 | 1.00 | 28.04 | C |
| ATOM | 3607 | CG | LEU | A | 45 | −24.575 | 89.294 | −16.881 | 1.00 | 33.18 | C |
| ATOM | 3608 | CD1 | LEU | A | 45 | −24.804 | 87.921 | −17.544 | 1.00 | 29.82 | C |
| ATOM | 3609 | CD2 | LEU | A | 45 | −25.639 | 89.585 | −15.859 | 1.00 | 27.89 | C |
| ATOM | 3610 | N | GLU | A | 46 | −21.397 | 90.735 | −13.767 | 1.00 | 30.38 | N |
| ATOM | 3611 | CA | GLU | A | 46 | −20.101 | 90.660 | −13.112 | 1.00 | 31.96 | C |
| ATOM | 3612 | C | GLU | A | 46 | −20.049 | 89.376 | −12.306 | 1.00 | 28.71 | C |
| ATOM | 3613 | O | GLU | A | 46 | −20.899 | 89.156 | −11.440 | 1.00 | 28.54 | O |
| ATOM | 3614 | CB | GLU | A | 46 | −19.854 | 91.859 | −12.196 | 1.00 | 30.82 | C |
| ATOM | 3615 | CG | GLU | A | 46 | −18.411 | 91.886 | −11.708 | 1.00 | 35.43 | C |
| ATOM | 3616 | CD | GLU | A | 46 | −18.145 | 92.863 | −10.551 | 1.00 | 42.19 | C |
| ATOM | 3617 | OE1 | GLU | A | 46 | −19.076 | 93.544 | −10.038 | 1.00 | 34.18 | O |
| ATOM | 3618 | OE2 | GLU | A | 46 | −16.968 | 92.932 | −10.154 | 1.00 | 46.04 | O1− |
| ATOM | 3619 | N | TRP | A | 47 | −19.052 | 88.537 | −12.584 | 1.00 | 28.91 | N |
| ATOM | 3620 | CA | TRP | A | 47 | −18.888 | 87.300 | −11.834 | 1.00 | 28.05 | C |
| ATOM | 3621 | C | TRP | A | 47 | −18.433 | 87.610 | −10.414 | 1.00 | 28.38 | C |
| ATOM | 3622 | O | TRP | A | 47 | −17.652 | 88.534 | −10.199 | 1.00 | 29.03 | O |
| ATOM | 3623 | CB | TRP | A | 47 | −17.882 | 86.396 | −12.547 | 1.00 | 28.79 | C |
| ATOM | 3624 | CG | TRP | A | 47 | −17.570 | 85.150 | −11.808 | 1.00 | 27.80 | C |
| ATOM | 3625 | CD1 | TRP | A | 47 | −18.396 | 84.090 | −11.618 | 1.00 | 26.75 | C |
| ATOM | 3626 | CD2 | TRP | A | 47 | −16.330 | 84.810 | −11.186 | 1.00 | 29.28 | C |
| ATOM | 3627 | NE1 | TRP | A | 47 | −17.759 | 83.119 | −10.900 | 1.00 | 30.04 | N |
| ATOM | 3628 | CE2 | TRP | A | 47 | −16.487 | 83.529 | −10.623 | 1.00 | 26.53 | C |
| ATOM | 3629 | CE3 | TRP | A | 47 | −15.093 | 85.455 | −11.067 | 1.00 | 30.37 | C |
| ATOM | 3630 | CZ2 | TRP | A | 47 | −15.454 | 82.870 | −9.945 | 1.00 | 30.41 | C |
| ATOM | 3631 | CZ3 | TRP | A | 47 | −14.058 | 84.797 | −10.376 | 1.00 | 27.15 | C |
| ATOM | 3632 | CH2 | TRP | A | 47 | −14.251 | 83.527 | −9.832 | 1.00 | 30.81 | C |
| ATOM | 3633 | N | VAL | A | 48 | −18.923 | 86.836 | −9.441 | 1.00 | 26.85 | N |
| ATOM | 3634 | CA | VAL | A | 48 | −18.590 | 87.031 | −8.026 | 1.00 | 26.22 | C |
| ATOM | 3635 | C | VAL | A | 48 | −17.740 | 85.890 | −7.475 | 1.00 | 27.91 | C |
| ATOM | 3636 | O | VAL | A | 48 | −16.641 | 86.118 | −6.962 | 1.00 | 31.20 | O |
| ATOM | 3637 | CB | VAL | A | 48 | −19.858 | 87.245 | −7.171 | 1.00 | 29.89 | C |
| ATOM | 3638 | CG1 | VAL | A | 48 | −19.465 | 87.415 | −5.709 | 1.00 | 27.30 | C |
| ATOM | 3639 | CG2 | VAL | A | 48 | −20.640 | 88.465 | −7.680 | 1.00 | 27.25 | C |
| ATOM | 3640 | N | ALA | A | 49 | −18.234 | 84.656 | −7.552 | 1.00 | 27.92 | N |
| ATOM | 3641 | CA | ALA | A | 49 | −17.498 | 83.540 | −6.964 | 1.00 | 27.21 | C |
| ATOM | 3642 | C | ALA | A | 49 | −18.028 | 82.240 | −7.528 | 1.00 | 29.25 | C |
| ATOM | 3643 | O | ALA | A | 49 | −19.155 | 82.178 | −8.025 | 1.00 | 29.04 | O |
| ATOM | 3644 | CB | ALA | A | 49 | −17.590 | 83.500 | −5.429 | 1.00 | 22.18 | C |
| ATOM | 3645 | N | VAL | A | 50 | −17.187 | 81.190 | −7.435 | 1.00 | 25.65 | N |
| ATOM | 3646 | CA | VAL | A | 50 | −17.592 | 79.835 | −7.777 | 1.00 | 25.46 | C |
| ATOM | 3647 | C | VAL | A | 50 | −17.129 | 78.894 | −6.678 | 1.00 | 28.11 | C |
| ATOM | 3648 | O | VAL | A | 50 | −16.137 | 79.144 | −5.988 | 1.00 | 30.11 | O |
| ATOM | 3649 | CB | VAL | A | 50 | −17.068 | 79.380 | −9.162 | 1.00 | 31.87 | C |
| ATOM | 3650 | CG1 | VAL | A | 50 | −15.561 | 79.238 | −9.175 | 1.00 | 28.23 | C |
| ATOM | 3651 | CG2 | VAL | A | 50 | −17.767 | 78.084 | −9.606 | 1.00 | 28.82 | C |
| ATOM | 3652 | N | ILE | A | 51 | −17.884 | 77.821 | −6.484 | 1.00 | 29.93 | N |
| ATOM | 3653 | CA | ILE | A | 51 | −17.514 | 76.799 | −5.522 | 1.00 | 25.88 | C |
| ATOM | 3654 | C | ILE | A | 51 | −17.657 | 75.447 | −6.203 | 1.00 | 26.86 | C |
| ATOM | 3655 | O | ILE | A | 51 | −18.486 | 75.262 | −7.100 | 1.00 | 26.48 | O |
| ATOM | 3656 | CB | ILE | A | 51 | −18.354 | 76.879 | −4.227 | 1.00 | 28.38 | C |
| ATOM | 3657 | CG1 | ILE | A | 51 | −17.776 | 75.932 | −3.163 | 1.00 | 29.68 | C |
| ATOM | 3658 | CG2 | ILE | A | 51 | −19.831 | 76.565 | −4.498 | 1.00 | 23.38 | C |
| ATOM | 3659 | CD1 | ILE | A | 51 | −18.344 | 76.180 | −1.775 | 1.00 | 28.59 | C |
| ATOM | 3660 | N | TRP | A | 52 | −16.821 | 74.510 | −5.793 | 1.00 | 24.08 | N |
| ATOM | 3661 | CA | TRP | A | 52 | −16.856 | 73.188 | −6.392 | 1.00 | 28.60 | C |
| ATOM | 3662 | C | TRP | A | 52 | −18.074 | 72.397 | −5.899 | 1.00 | 30.88 | C |
| ATOM | 3663 | O | TRP | A | 52 | −18.688 | 72.722 | −4.879 | 1.00 | 26.43 | O |
| ATOM | 3664 | CB | TRP | A | 52 | −15.559 | 72.452 | −6.066 | 1.00 | 30.05 | C |
| ATOM | 3665 | CG | TRP | A | 52 | −14.821 | 71.992 | −7.256 | 1.00 | 31.59 | C |
| ATOM | 3666 | CD1 | TRP | A | 52 | −14.551 | 70.701 | −7.601 | 1.00 | 34.80 | C |
| ATOM | 3667 | CD2 | TRP | A | 52 | −14.265 | 72.811 | −8.293 | 1.00 | 30.63 | C |
| ATOM | 3668 | NE1 | TRP | A | 52 | −13.842 | 70.664 | −8.781 | 1.00 | 33.66 | N |
| ATOM | 3669 | CE2 | TRP | A | 52 | −13.652 | 71.942 | −9.228 | 1.00 | 31.14 | C |
| ATOM | 3670 | CE3 | TRP | A | 52 | −14.220 | 74.183 | −8.522 | 1.00 | 28.98 | C |
| ATOM | 3671 | CZ2 | TRP | A | 52 | −12.999 | 72.404 | −10.368 | 1.00 | 30.12 | C |

TABLE 10.3-continued

| ATOM | 3672 | CZ3 | TRP | A | 52 | −13.564 | 74.646 | −9.663 | 1.00 | 37.05 | C |
|---|---|---|---|---|---|---|---|---|---|---|---|
| ATOM | 3673 | CH2 | TRP | A | 52 | −12.953 | 73.756 | −10.562 | 1.00 | 36.23 | C |
| ATOM | 3674 | N | TYR | A | 53 | −18.401 | 71.330 | −6.635 | 1.00 | 28.62 | N |
| ATOM | 3675 | CA | TYR | A | 53 | −19.539 | 70.484 | −6.281 | 1.00 | 31.01 | C |
| ATOM | 3676 | C | TYR | A | 53 | −19.373 | 69.846 | −4.909 | 1.00 | 36.12 | C |
| ATOM | 3677 | O | TYR | A | 53 | −20.370 | 69.557 | −4.240 | 1.00 | 36.43 | O |
| ATOM | 3678 | CB | TYR | A | 53 | −19.743 | 69.393 | −7.329 | 1.00 | 31.97 | C |
| ATOM | 3679 | CG | TYR | A | 53 | −18.458 | 68.713 | −7.742 | 1.00 | 35.13 | C |
| ATOM | 3680 | CD1 | TYR | A | 53 | −17.918 | 67.672 | −6.989 | 1.00 | 37.05 | C |
| ATOM | 3681 | CD2 | TYR | A | 53 | −17.791 | 69.104 | −8.896 | 1.00 | 37.33 | C |
| ATOM | 3682 | CE1 | TYR | A | 53 | −16.755 | 67.058 | −7.366 | 1.00 | 36.11 | C |
| ATOM | 3683 | CE2 | TYR | A | 53 | −16.614 | 68.492 | −9.286 | 1.00 | 40.57 | C |
| ATOM | 3684 | CZ | TYR | A | 53 | −16.095 | 67.479 | −8.521 | 1.00 | 40.64 | C |
| ATOM | 3685 | OH | TYR | A | 53 | −14.916 | 66.886 | −8.923 | 1.00 | 51.83 | O |
| ATOM | 3686 | N | ASP | A | 54 | −18.136 | 69.613 | −4.468 | 1.00 | 31.86 | N |
| ATOM | 3687 | CA | ASP | A | 54 | −17.896 | 69.044 | −3.150 | 1.00 | 32.47 | C |
| ATOM | 3688 | C | ASP | A | 54 | −17.433 | 70.090 | −2.141 | 1.00 | 32.55 | C |
| ATOM | 3689 | O | ASP | A | 54 | −16.894 | 69.732 | −1.097 | 1.00 | 34.26 | O |
| ATOM | 3690 | CB | ASP | A | 54 | −16.882 | 67.901 | −3.245 | 1.00 | 33.69 | C |
| ATOM | 3691 | CG | ASP | A | 54 | −15.550 | 68.344 | −3.878 | 1.00 | 41.63 | C |
| ATOM | 3692 | OD1 | ASP | A | 54 | −15.332 | 69.574 | −4.029 | 1.00 | 35.39 | O |
| ATOM | 3693 | OD2 | ASP | A | 54 | −14.721 | 67.462 | −4.224 | 1.00 | 41.66 | O1− |
| ATOM | 3694 | N | GLY | A | 55 | −17.633 | 71.376 | −2.428 | 1.00 | 35.34 | N |
| ATOM | 3695 | CA | GLY | A | 55 | −17.197 | 72.416 | −1.516 | 1.00 | 28.60 | C |
| ATOM | 3696 | C | GLY | A | 55 | −15.696 | 72.626 | −1.397 | 1.00 | 30.85 | C |
| ATOM | 3697 | O | GLY | A | 55 | −15.261 | 73.340 | −0.483 | 1.00 | 31.85 | O |
| ATOM | 3698 | N | SER | A | 56 | −14.880 | 72.030 | −2.271 | 1.00 | 31.41 | N |
| ATOM | 3699 | CA | SER | A | 56 | −13.427 | 72.159 | −2.138 | 1.00 | 28.55 | C |
| ATOM | 3700 | C | SER | A | 56 | −12.921 | 73.456 | −2.773 | 1.00 | 29.96 | C |
| ATOM | 3701 | O | SER | A | 56 | −12.790 | 74.463 | −2.071 | 1.00 | 35.87 | O |
| ATOM | 3702 | CB | SER | A | 56 | −12.716 | 70.922 | −2.715 | 1.00 | 29.73 | C |
| ATOM | 3703 | OG | SER | A | 56 | −13.055 | 70.688 | −4.069 | 1.00 | 33.14 | O |
| ATOM | 3704 | N | ASN | A | 57 | −12.648 | 73.468 | −4.080 | 1.00 | 27.89 | N |
| ATOM | 3705 | CA | ASN | A | 57 | −12.094 | 74.669 | −4.708 | 1.00 | 30.78 | C |
| ATOM | 3706 | C | ASN | A | 57 | −13.090 | 75.836 | −4.663 | 1.00 | 34.96 | C |
| ATOM | 3707 | O | ASN | A | 57 | −14.296 | 75.655 | −4.883 | 1.00 | 29.93 | O |
| ATOM | 3708 | CB | ASN | A | 57 | −11.712 | 74.392 | −6.167 | 1.00 | 28.41 | C |
| ATOM | 3709 | CG | ASN | A | 57 | −10.430 | 73.551 | −6.316 | 1.00 | 36.02 | C |
| ATOM | 3710 | OD1 | ASN | A | 57 | −10.034 | 72.789 | −5.427 | 1.00 | 31.33 | O |
| ATOM | 3711 | ND2 | ASN | A | 57 | −9.779 | 73.703 | −7.462 | 1.00 | 33.91 | N |
| ATOM | 3712 | N | LYS | A | 58 | −12.562 | 77.042 | −4.418 | 1.00 | 30.71 | N |
| ATOM | 3713 | CA | LYS | A | 58 | −13.307 | 78.299 | −4.384 | 1.00 | 31.44 | C |
| ATOM | 3714 | C | LYS | A | 58 | −12.504 | 79.356 | −5.117 | 1.00 | 31.50 | C |
| ATOM | 3715 | O | LYS | A | 58 | −11.306 | 79.491 | −4.858 | 1.00 | 35.00 | O |
| ATOM | 3716 | CB | LYS | A | 58 | −13.541 | 78.796 | −2.953 | 1.00 | 28.26 | C |
| ATOM | 3717 | CG | LYS | A | 58 | −14.308 | 77.853 | −2.071 | 1.00 | 32.31 | C |
| ATOM | 3718 | CD | LYS | A | 58 | −14.359 | 78.350 | −0.623 | 1.00 | 29.79 | C |
| ATOM | 3719 | CE | LYS | A | 58 | −15.146 | 77.337 | 0.247 | 1.00 | 31.84 | C |
| ATOM | 3720 | NZ | LYS | A | 58 | −15.624 | 77.954 | 1.523 | 1.00 | 28.78 | N1+ |
| ATOM | 3721 | N | TYR | A | 59 | −13.143 | 80.105 | −6.025 | 1.00 | 31.81 | N |
| ATOM | 3722 | CA | TYR | A | 59 | −12.489 | 81.224 | −6.704 | 1.00 | 29.74 | C |
| ATOM | 3723 | C | TYR | A | 59 | −13.349 | 82.463 | −6.543 | 1.00 | 31.86 | C |
| ATOM | 3724 | O | TYR | A | 59 | −14.581 | 82.379 | −6.491 | 1.00 | 36.21 | O |
| ATOM | 3725 | CB | TYR | A | 59 | −12.258 | 80.990 | −8.212 | 1.00 | 35.36 | C |
| ATOM | 3726 | CG | TYR | A | 59 | −11.620 | 79.662 | −8.593 | 1.00 | 35.36 | C |
| ATOM | 3727 | CD1 | TYR | A | 59 | −10.873 | 78.936 | −7.693 | 1.00 | 49.05 | C |
| ATOM | 3728 | CD2 | TYR | A | 59 | −11.776 | 79.141 | −9.849 | 1.00 | 46.01 | C |
| ATOM | 3729 | CE1 | TYR | A | 59 | −10.317 | 77.708 | −8.033 | 1.00 | 56.82 | C |
| ATOM | 3730 | CE2 | TYR | A | 59 | −11.212 | 77.925 | −10.198 | 1.00 | 50.42 | C |
| ATOM | 3731 | CZ | TYR | A | 59 | −10.494 | 77.215 | −9.292 | 1.00 | 45.11 | C |
| ATOM | 3732 | OH | TYR | A | 59 | −9.945 | 76.014 | −9.656 | 1.00 | 44.41 | O |
| ATOM | 3733 | N | TYR | A | 60 | −12.706 | 83.617 | −6.491 | 1.00 | 28.31 | N |
| ATOM | 3734 | CA | TYR | A | 60 | −13.418 | 84.868 | −6.277 | 1.00 | 31.56 | C |
| ATOM | 3735 | C | TYR | A | 60 | −12.950 | 85.928 | −7.263 | 1.00 | 33.13 | C |
| ATOM | 3736 | O | TYR | A | 60 | −11.782 | 85.963 | −7.657 | 1.00 | 36.90 | O |
| ATOM | 3737 | CB | TYR | A | 60 | −13.221 | 85.407 | −4.884 | 1.00 | 26.95 | C |
| ATOM | 3738 | CG | TYR | A | 60 | −13.706 | 84.522 | −3.780 | 1.00 | 31.53 | C |
| ATOM | 3739 | CD1 | TYR | A | 60 | −12.877 | 83.520 | −3.249 | 1.00 | 34.43 | C |
| ATOM | 3740 | CD2 | TYR | A | 60 | −14.958 | 84.703 | −3.225 | 1.00 | 29.79 | C |
| ATOM | 3741 | CE1 | TYR | A | 60 | −13.308 | 82.707 | −2.215 | 1.00 | 28.05 | C |
| ATOM | 3742 | CE2 | TYR | A | 60 | −15.400 | 83.896 | −2.183 | 1.00 | 32.79 | C |
| ATOM | 3743 | CZ | TYR | A | 60 | −14.567 | 82.900 | −1.679 | 1.00 | 33.02 | C |
| ATOM | 3744 | OH | TYR | A | 60 | −14.995 | 82.098 | −0.641 | 1.00 | 31.57 | O |
| ATOM | 3745 | N | ALA | A | 61 | −13.872 | 86.804 | −7.650 | 1.00 | 23.00 | N |
| ATOM | 3746 | CA | ALA | A | 61 | −13.464 | 87.976 | −8.406 | 1.00 | 28.65 | C |
| ATOM | 3747 | C | ALA | A | 61 | −12.612 | 88.888 | −7.526 | 1.00 | 32.06 | C |
| ATOM | 3748 | O | ALA | A | 61 | −12.759 | 88.923 | −6.301 | 1.00 | 30.34 | O |
| ATOM | 3749 | CB | ALA | A | 61 | −14.679 | 88.736 | −8.937 | 1.00 | 25.89 | C |
| ATOM | 3750 | N | ASP | A | 62 | −11.713 | 89.633 | −8.171 | 1.00 | 32.65 | N |
| ATOM | 3751 | CA | ASP | A | 62 | −10.805 | 90.522 | −7.445 | 1.00 | 32.02 | C |

TABLE 10.3-continued

| ATOM | 3752 | C | ASP | A | 62 | −11.551 | 91.559 | −6.605 | 1.00 | 31.30 | C |
|---|---|---|---|---|---|---|---|---|---|---|---|
| ATOM | 3753 | O | ASP | A | 62 | −11.125 | 91.882 | −5.492 | 1.00 | 33.95 | O |
| ATOM | 3754 | CB | ASP | A | 62 | −9.856 | 91.208 | −8.428 | 1.00 | 30.42 | C |
| ATOM | 3755 | CG | ASP | A | 62 | −8.574 | 90.404 | −8.671 | 1.00 | 42.21 | C |
| ATOM | 3756 | OD1 | ASP | A | 62 | −8.521 | 89.196 | −8.308 | 1.00 | 50.07 | O |
| ATOM | 3757 | OD2 | ASP | A | 62 | −7.625 | 90.972 | −9.257 | 1.00 | 56.07 | O1− |
| ATOM | 3758 | N | SER | A | 63 | −12.672 | 92.082 | −7.106 | 1.00 | 28.74 | N |
| ATOM | 3759 | CA | SER | A | 63 | −13.409 | 93.118 | −6.383 | 1.00 | 32.42 | C |
| ATOM | 3760 | C | SER | A | 63 | −13.980 | 92.646 | −5.048 | 1.00 | 39.97 | C |
| ATOM | 3761 | O | SER | A | 63 | −14.490 | 93.477 | −4.280 | 1.00 | 38.00 | O |
| ATOM | 3762 | CB | SER | A | 63 | −14.542 | 93.641 | −7.263 | 1.00 | 35.16 | C |
| ATOM | 3763 | OG | SER | A | 63 | −15.314 | 92.561 | −7.747 | 1.00 | 42.20 | O |
| ATOM | 3764 | N | VAL | A | 64 | −13.865 | 91.356 | −4.740 | 1.00 | 33.69 | N |
| ATOM | 3765 | CA | VAL | A | 64 | −14.600 | 90.717 | −3.663 | 1.00 | 31.03 | C |
| ATOM | 3766 | C | VAL | A | 64 | −13.681 | 89.860 | −2.780 | 1.00 | 35.18 | C |
| ATOM | 3767 | O | VAL | A | 64 | −14.040 | 89.490 | −1.651 | 1.00 | 33.73 | O |
| ATOM | 3768 | CB | VAL | A | 64 | −15.740 | 89.918 | −4.330 | 1.00 | 34.61 | C |
| ATOM | 3769 | CG1 | VAL | A | 64 | −15.732 | 88.417 | −4.001 | 1.00 | 22.27 | C |
| ATOM | 3770 | CG2 | VAL | A | 64 | −17.031 | 90.609 | −4.115 | 1.00 | 28.14 | C |
| ATOM | 3771 | N | LYS | A | 65 | −12.476 | 89.566 | −3.273 | 1.00 | 30.69 | N |
| ATOM | 3772 | CA | LYS | A | 65 | −11.498 | 88.785 | −2.511 | 1.00 | 32.30 | C |
| ATOM | 3773 | C | LYS | A | 65 | −11.300 | 89.377 | −1.126 | 1.00 | 35.92 | C |
| ATOM | 3774 | O | LYS | A | 65 | −11.119 | 90.590 | −0.975 | 1.00 | 37.34 | O |
| ATOM | 3775 | CB | LYS | A | 65 | −10.155 | 88.769 | −3.242 | 1.00 | 31.37 | C |
| ATOM | 3776 | CG | LYS | A | 65 | −10.056 | 87.772 | −4.365 | 1.00 | 35.93 | C |
| ATOM | 3777 | CD | LYS | A | 65 | −8.637 | 87.667 | −4.881 | 1.00 | 39.14 | C |
| ATOM | 3778 | CE | LYS | A | 65 | −8.443 | 86.411 | −5.742 | 1.00 | 40.69 | C |
| ATOM | 3779 | NZ | LYS | A | 65 | −9.097 | 86.500 | −7.077 | 1.00 | 44.27 | N1+ |
| ATOM | 3780 | N | GLY | A | 66 | −11.300 | 88.509 | −0.118 | 1.00 | 36.76 | N |
| ATOM | 3781 | CA | GLY | A | 66 | −11.109 | 88.926 | 1.249 | 1.00 | 34.77 | C |
| ATOM | 3782 | C | GLY | A | 66 | −12.355 | 89.409 | 1.957 | 1.00 | 37.43 | C |
| ATOM | 3783 | O | GLY | A | 66 | −12.361 | 89.462 | 3.185 | 1.00 | 43.41 | O |
| ATOM | 3784 | N | ARG | A | 67 | −13.407 | 89.779 | 1.231 | 1.00 | 37.34 | N |
| ATOM | 3785 | CA | ARG | A | 67 | −14.630 | 90.281 | 1.849 | 1.00 | 34.16 | C |
| ATOM | 3786 | C | ARG | A | 67 | −15.789 | 89.302 | 1.783 | 1.00 | 32.20 | C |
| ATOM | 3787 | O | ARG | A | 67 | −16.554 | 89.208 | 2.745 | 1.00 | 35.10 | O |
| ATOM | 3788 | CB | ARG | A | 67 | −15.047 | 91.609 | 1.199 | 1.00 | 28.81 | C |
| ATOM | 3789 | CG | ARG | A | 67 | −14.047 | 92.745 | 1.481 | 1.00 | 38.29 | C |
| ATOM | 3790 | CD | ARG | A | 67 | −14.504 | 94.103 | 0.942 | 1.00 | 39.40 | C |
| ATOM | 3791 | NE | ARG | A | 67 | −14.857 | 94.018 | −0.470 | 1.00 | 34.94 | N |
| ATOM | 3792 | CZ | ARG | A | 67 | −16.086 | 94.209 | −0.939 | 1.00 | 36.27 | C |
| ATOM | 3793 | NH1 | ARG | A | 67 | −17.074 | 94.532 | −0.113 | 1.00 | 29.46 | N1+ |
| ATOM | 3794 | NH2 | ARG | A | 67 | −16.325 | 94.083 | −2.236 | 1.00 | 33.40 | N |
| ATOM | 3795 | N | PHE | A | 68 | −15.936 | 88.558 | 0.688 | 1.00 | 31.92 | N |
| ATOM | 3796 | CA | PHE | A | 68 | −17.046 | 87.626 | 0.523 | 1.00 | 33.41 | C |
| ATOM | 3797 | C | PHE | A | 68 | −16.540 | 86.204 | 0.697 | 1.00 | 34.08 | C |
| ATOM | 3798 | O | PHE | A | 68 | −15.382 | 85.903 | 0.405 | 1.00 | 35.01 | O |
| ATOM | 3799 | CB | PHE | A | 68 | −17.727 | 87.743 | −0.850 | 1.00 | 29.41 | C |
| ATOM | 3800 | CG | PHE | A | 68 | −18.410 | 89.076 | −1.108 | 1.00 | 31.18 | C |
| ATOM | 3801 | CD1 | PHE | A | 68 | −18.242 | 90.156 | −0.256 | 1.00 | 28.93 | C |
| ATOM | 3802 | CD2 | PHE | A | 68 | −19.236 | 89.231 | −2.206 | 1.00 | 29.68 | C |
| ATOM | 3803 | CE1 | PHE | A | 68 | −18.851 | 91.388 | −0.518 | 1.00 | 33.26 | C |
| ATOM | 3804 | CE2 | PHE | A | 68 | −19.865 | 90.444 | −2.462 | 1.00 | 36.39 | C |
| ATOM | 3805 | CZ | PHE | A | 68 | −19.660 | 91.532 | −1.618 | 1.00 | 35.74 | C |
| ATOM | 3806 | N | THR | A | 69 | −17.413 | 85.325 | 1.177 | 1.00 | 33.37 | N |
| ATOM | 3807 | CA | THR | A | 69 | −17.054 | 83.917 | 1.293 | 1.00 | 32.05 | C |
| ATOM | 3808 | C | THR | A | 69 | −18.206 | 83.085 | 0.775 | 1.00 | 30.76 | C |
| ATOM | 3809 | O | THR | A | 69 | −19.354 | 83.292 | 1.177 | 1.00 | 28.56 | O |
| ATOM | 3810 | CB | THR | A | 69 | −16.720 | 83.513 | 2.739 | 1.00 | 38.78 | C |
| ATOM | 3811 | OG1 | THR | A | 69 | −15.552 | 84.216 | 3.173 | 1.00 | 33.71 | O |
| ATOM | 3812 | CG2 | THR | A | 69 | −16.475 | 81.992 | 2.856 | 1.00 | 30.01 | C |
| ATOM | 3813 | N | ILE | A | 70 | −17.892 | 82.169 | −0.143 | 1.00 | 28.12 | N |
| ATOM | 3814 | CA | ILE | A | 70 | −18.862 | 81.246 | −0.708 | 1.00 | 31.36 | C |
| ATOM | 3815 | C | ILE | A | 70 | −18.754 | 79.918 | 0.040 | 1.00 | 32.93 | C |
| ATOM | 3816 | O | ILE | A | 70 | −17.655 | 79.472 | 0.402 | 1.00 | 33.29 | O |
| ATOM | 3817 | CB | ILE | A | 70 | −18.656 | 81.079 | −2.230 | 1.00 | 31.45 | C |
| ATOM | 3818 | CG1 | ILE | A | 70 | −19.832 | 80.302 | −2.852 | 1.00 | 29.85 | C |
| ATOM | 3819 | CG2 | ILE | A | 70 | −17.257 | 80.401 | −2.554 | 1.00 | 29.79 | C |
| ATOM | 3820 | CD1 | ILE | A | 70 | −19.805 | 80.244 | −4.411 | 1.00 | 27.30 | C |
| ATOM | 3821 | N | SER | A | 71 | −19.899 | 79.300 | 0.307 | 1.00 | 30.39 | N |
| ATOM | 3822 | CA | SER | A | 71 | −19.935 | 78.023 | 1.017 | 1.00 | 34.30 | C |
| ATOM | 3823 | C | SER | A | 71 | −21.233 | 77.320 | 0.648 | 1.00 | 30.83 | C |
| ATOM | 3824 | O | SER | A | 71 | −22.137 | 77.905 | 0.046 | 1.00 | 34.13 | O |
| ATOM | 3825 | CB | SER | A | 71 | −19.827 | 78.201 | 2.544 | 1.00 | 28.89 | C |
| ATOM | 3826 | OG | SER | A | 71 | −20.944 | 78.930 | 3.075 | 1.00 | 31.85 | O |
| ATOM | 3827 | N | ARG | A | 72 | −21.333 | 76.064 | 1.046 | 1.00 | 33.01 | N |
| ATOM | 3828 | CA | ARG | A | 72 | −22.531 | 75.307 | 0.753 | 1.00 | 33.51 | C |
| ATOM | 3829 | C | ARG | A | 72 | −22.820 | 74.404 | 1.941 | 1.00 | 36.68 | C |
| ATOM | 3830 | O | ARG | A | 72 | −21.918 | 74.070 | 2.713 | 1.00 | 32.75 | O |
| ATOM | 3831 | CB | ARG | A | 72 | −22.364 | 74.492 | −0.545 | 1.00 | 29.96 | C |

TABLE 10.3-continued

| ATOM | 3832 | CG | ARG | A | 72 | −21.230 | 73.458 | −0.489 | 1.00 | 29.86 | C |
|---|---|---|---|---|---|---|---|---|---|---|---|
| ATOM | 3833 | CD | ARG | A | 72 | −20.985 | 72.827 | −1.859 | 1.00 | 31.26 | C |
| ATOM | 3834 | NE | ARG | A | 72 | −22.179 | 72.130 | −2.344 | 1.00 | 36.14 | N |
| ATOM | 3835 | CZ | ARG | A | 72 | −22.480 | 71.942 | −3.627 | 1.00 | 33.42 | C |
| ATOM | 3836 | NH1 | ARG | A | 72 | −21.683 | 72.400 | −4.575 | 1.00 | 31.33 | N1+ |
| ATOM | 3837 | NH2 | ARG | A | 72 | −23.599 | 71.322 | −3.972 | 1.00 | 33.70 | N |
| ATOM | 3838 | N | ASP | A | 73 | −24.094 | 74.046 | 2.108 | 1.00 | 35.23 | N |
| ATOM | 3839 | CA | ASP | A | 73 | −24.523 | 73.070 | 3.119 | 1.00 | 36.76 | C |
| ATOM | 3840 | C | ASP | A | 73 | −25.407 | 72.032 | 2.428 | 1.00 | 39.51 | C |
| ATOM | 3841 | O | ASP | A | 73 | −26.597 | 72.270 | 2.181 | 1.00 | 34.82 | O |
| ATOM | 3842 | CB | ASP | A | 73 | −25.251 | 73.761 | 4.266 | 1.00 | 34.22 | C |
| ATOM | 3843 | CG | ASP | A | 73 | −25.616 | 72.808 | 5.397 | 1.00 | 42.95 | C |
| ATOM | 3844 | OD1 | ASP | A | 73 | −25.733 | 71.576 | 5.175 | 1.00 | 42.54 | O |
| ATOM | 3845 | OD2 | ASP | A | 73 | −25.774 | 73.306 | 6.532 | 1.00 | 48.48 | O1− |
| ATOM | 3846 | N | ASN | A | 74 | −24.825 | 70.874 | 2.117 | 1.00 | 37.32 | N |
| ATOM | 3847 | CA | ASN | A | 74 | −25.569 | 69.888 | 1.350 | 1.00 | 37.99 | C |
| ATOM | 3848 | C | ASN | A | 74 | −26.773 | 69.366 | 2.126 | 1.00 | 38.75 | C |
| ATOM | 3849 | O | ASN | A | 74 | −27.823 | 69.104 | 1.530 | 1.00 | 38.15 | O |
| ATOM | 3850 | CB | ASN | A | 74 | −24.634 | 68.757 | 0.923 | 1.00 | 38.26 | C |
| ATOM | 3851 | CG | ASN | A | 74 | −23.691 | 69.174 | −0.228 | 1.00 | 43.82 | C |
| ATOM | 3852 | OD1 | ASN | A | 74 | −23.726 | 70.314 | −0.699 | 1.00 | 41.08 | O |
| ATOM | 3853 | ND2 | ASN | A | 74 | −22.837 | 68.252 | −0.664 | 1.00 | 42.34 | N |
| ATOM | 3854 | N | SER | A | 75 | −26.678 | 69.273 | 3.454 | 1.00 | 37.68 | N |
| ATOM | 3855 | CA | SER | A | 75 | −27.820 | 68.764 | 4.205 | 1.00 | 40.41 | C |
| ATOM | 3856 | C | SER | A | 75 | −29.031 | 69.694 | 4.108 | 1.00 | 39.19 | C |
| ATOM | 3857 | O | SER | A | 75 | −30.152 | 69.250 | 4.331 | 1.00 | 38.81 | O |
| ATOM | 3858 | CB | SER | A | 75 | −27.433 | 68.533 | 5.666 | 1.00 | 34.54 | C |
| ATOM | 3859 | OG | SER | A | 75 | −27.418 | 69.751 | 6.380 | 1.00 | 41.65 | O |
| ATOM | 3860 | N | LYS | A | 76 | −28.840 | 70.966 | 3.765 | 1.00 | 39.96 | N |
| ATOM | 3861 | CA | LYS | A | 76 | −29.947 | 71.888 | 3.540 | 1.00 | 32.91 | C |
| ATOM | 3862 | C | LYS | A | 76 | −30.127 | 72.270 | 2.076 | 1.00 | 33.45 | C |
| ATOM | 3863 | O | LYS | A | 76 | −30.819 | 73.255 | 1.793 | 1.00 | 32.73 | O |
| ATOM | 3864 | CB | LYS | A | 76 | −29.760 | 73.156 | 4.371 | 1.00 | 34.21 | C |
| ATOM | 3865 | CG | LYS | A | 76 | −29.536 | 72.893 | 5.843 | 1.00 | 39.47 | C |
| ATOM | 3866 | CD | LYS | A | 76 | −29.433 | 74.203 | 6.610 | 1.00 | 37.51 | C |
| ATOM | 3867 | CE | LYS | A | 76 | −29.059 | 73.960 | 8.060 | 1.00 | 36.30 | C |
| ATOM | 3868 | NZ | LYS | A | 76 | −28.974 | 75.226 | 8.812 | 1.00 | 53.39 | N1+ |
| ATOM | 3869 | N | ASN | A | 77 | −29.486 | 71.560 | 1.142 | 1.00 | 34.23 | N |
| ATOM | 3870 | CA | ASN | A | 77 | −29.510 | 71.936 | −0.275 | 1.00 | 34.08 | C |
| ATOM | 3871 | C | ASN | A | 77 | −29.340 | 73.439 | −0.531 | 1.00 | 33.69 | C |
| ATOM | 3872 | O | ASN | A | 77 | −30.019 | 73.994 | −1.395 | 1.00 | 31.88 | O |
| ATOM | 3873 | CB | ASN | A | 77 | −30.814 | 71.468 | −0.910 | 1.00 | 35.11 | C |
| ATOM | 3874 | CG | ASN | A | 77 | −30.897 | 69.952 | −1.020 | 1.00 | 45.26 | C |
| ATOM | 3875 | OD1 | ASN | A | 77 | −29.889 | 69.267 | −1.184 | 1.00 | 51.24 | O |
| ATOM | 3876 | ND2 | ASN | A | 77 | −32.095 | 69.426 | −0.909 | 1.00 | 53.41 | N |
| ATOM | 3877 | N | THR | A | 78 | −28.427 | 74.101 | 0.184 | 1.00 | 28.09 | N |
| ATOM | 3878 | CA | THR | A | 78 | −28.320 | 75.550 | 0.139 | 1.00 | 34.16 | C |
| ATOM | 3879 | C | THR | A | 78 | −26.883 | 75.999 | −0.101 | 1.00 | 31.55 | C |
| ATOM | 3880 | O | THR | A | 78 | −25.941 | 75.476 | 0.499 | 1.00 | 29.95 | O |
| ATOM | 3881 | CB | THR | A | 78 | −28.867 | 76.150 | 1.432 | 1.00 | 32.28 | C |
| ATOM | 3882 | OG1 | THR | A | 78 | −30.230 | 75.746 | 1.559 | 1.00 | 36.31 | O |
| ATOM | 3883 | CG2 | THR | A | 78 | −28.789 | 77.662 | 1.405 | 1.00 | 32.86 | C |
| ATOM | 3884 | N | LEU | A | 79 | −26.747 | 76.977 | −0.989 | 1.00 | 33.81 | N |
| ATOM | 3885 | CA | LEU | A | 79 | −25.515 | 77.701 | −1.273 | 1.00 | 30.18 | C |
| ATOM | 3886 | C | LEU | A | 79 | −25.571 | 79.060 | −0.585 | 1.00 | 32.22 | C |
| ATOM | 3887 | O | LEU | A | 79 | −26.606 | 79.724 | −0.617 | 1.00 | 34.07 | O |
| ATOM | 3888 | CB | LEU | A | 79 | −25.381 | 77.913 | −2.782 | 1.00 | 31.42 | C |
| ATOM | 3889 | CG | LEU | A | 79 | −24.281 | 78.860 | −3.263 | 1.00 | 32.10 | C |
| ATOM | 3890 | CD1 | LEU | A | 79 | −22.973 | 78.101 | −3.223 | 1.00 | 23.19 | C |
| ATOM | 3891 | CD2 | LEU | A | 79 | −24.601 | 79.393 | −4.668 | 1.00 | 27.71 | C |
| ATOM | 3892 | N | TYR | A | 80 | −24.450 | 79.498 | −0.015 | 1.00 | 30.45 | N |
| ATOM | 3893 | CA | TYR | A | 80 | −24.385 | 80.758 | 0.715 | 1.00 | 29.65 | C |
| ATOM | 3894 | C | TYR | A | 80 | −23.352 | 81.714 | 0.114 | 1.00 | 36.35 | C |
| ATOM | 3895 | O | TYR | A | 80 | −22.353 | 81.294 | −0.486 | 1.00 | 29.45 | O |
| ATOM | 3896 | CB | TYR | A | 80 | −24.022 | 80.536 | 2.194 | 1.00 | 29.90 | C |
| ATOM | 3897 | CG | TYR | A | 80 | −24.972 | 79.655 | 2.914 | 1.00 | 35.65 | C |
| ATOM | 3898 | CD1 | TYR | A | 80 | −26.209 | 80.148 | 3.347 | 1.00 | 31.27 | C |
| ATOM | 3899 | CD2 | TYR | A | 80 | −24.656 | 78.311 | 3.162 | 1.00 | 32.71 | C |
| ATOM | 3900 | CE1 | TYR | A | 80 | −27.109 | 79.334 | 4.006 | 1.00 | 30.61 | C |
| ATOM | 3901 | CE2 | TYR | A | 80 | −25.548 | 77.480 | 3.834 | 1.00 | 34.98 | C |
| ATOM | 3902 | CZ | TYR | A | 80 | −26.780 | 77.999 | 4.253 | 1.00 | 43.60 | C |
| ATOM | 3903 | OH | TYR | A | 80 | −27.691 | 77.183 | 4.903 | 1.00 | 43.60 | O |
| ATOM | 3904 | N | LEU | A | 81 | −23.608 | 83.016 | 0.286 | 1.00 | 33.92 | N |
| ATOM | 3905 | CA | LEU | A | 81 | −22.616 | 84.067 | 0.062 | 1.00 | 32.11 | C |
| ATOM | 3906 | C | LEU | A | 81 | −22.609 | 84.955 | 1.294 | 1.00 | 35.72 | C |
| ATOM | 3907 | O | LEU | A | 81 | −23.559 | 85.712 | 1.534 | 1.00 | 31.37 | O |
| ATOM | 3908 | CB | LEU | A | 81 | −22.899 | 84.890 | −1.193 | 1.00 | 29.72 | C |
| ATOM | 3909 | CG | LEU | A | 81 | −21.820 | 85.907 | −1.554 | 1.00 | 30.90 | C |
| ATOM | 3910 | CD1 | LEU | A | 81 | −20.535 | 85.193 | −2.008 | 1.00 | 31.13 | C |
| ATOM | 3911 | CD2 | LEU | A | 81 | −22.311 | 86.863 | −2.620 | 1.00 | 29.96 | C |

TABLE 10.3-continued

| | | | | | | | | | | |
|---|---|---|---|---|---|---|---|---|---|---|
| ATOM | 3912 | N | GLN | A | 82 | −21.546 | 84.836 | 2.077 | 1.00 | 35.14 | N |
| ATOM | 3913 | CA | GLN | A | 82 | −21.322 | 85.681 | 3.236 | 1.00 | 35.67 | C |
| ATOM | 3914 | C | GLN | A | 82 | −20.628 | 86.948 | 2.753 | 1.00 | 33.89 | C |
| ATOM | 3915 | O | GLN | A | 82 | −19.504 | 86.883 | 2.239 | 1.00 | 36.17 | O |
| ATOM | 3916 | CB | GLN | A | 82 | −20.463 | 84.940 | 4.264 | 1.00 | 33.97 | C |
| ATOM | 3917 | CG | GLN | A | 82 | −20.206 | 85.726 | 5.526 | 1.00 | 35.10 | C |
| ATOM | 3918 | CD | GLN | A | 82 | −21.509 | 86.106 | 6.226 | 1.00 | 41.65 | C |
| ATOM | 3919 | OE1 | GLN | A | 82 | −22.419 | 85.279 | 6.375 | 1.00 | 41.07 | O |
| ATOM | 3920 | NE2 | GLN | A | 82 | −21.598 | 87.354 | 6.669 | 1.00 | 39.37 | N |
| ATOM | 3921 | N | MET | A | 83 | −21.290 | 88.089 | 2.892 | 1.00 | 34.01 | N |
| ATOM | 3922 | CA | MET | A | 83 | −20.762 | 89.349 | 2.360 | 1.00 | 40.25 | C |
| ATOM | 3923 | C | MET | A | 83 | −20.390 | 90.231 | 3.540 | 1.00 | 34.20 | C |
| ATOM | 3924 | O | MET | A | 83 | −21.271 | 90.753 | 4.231 | 1.00 | 43.36 | O |
| ATOM | 3925 | CB | MET | A | 83 | −21.782 | 90.054 | 1.460 | 1.00 | 35.88 | C |
| ATOM | 3926 | CG | MET | A | 83 | −22.247 | 89.246 | 0.242 | 1.00 | 40.32 | C |
| ATOM | 3927 | SD | MET | A | 83 | −23.444 | 90.120 | −0.837 | 1.00 | 45.75 | S |
| ATOM | 3928 | CE | MET | A | 83 | −24.869 | 90.178 | 0.214 | 1.00 | 39.89 | C |
| ATOM | 3929 | N | ASN | A | 84 | −19.098 | 90.416 | 3.767 | 1.00 | 34.41 | N |
| ATOM | 3930 | CA | ASN | A | 84 | −18.649 | 91.282 | 4.849 | 1.00 | 35.66 | C |
| ATOM | 3931 | C | ASN | A | 84 | −18.114 | 92.576 | 4.266 | 1.00 | 35.32 | C |
| ATOM | 3932 | O | ASN | A | 84 | −17.798 | 92.660 | 3.078 | 1.00 | 37.11 | O |
| ATOM | 3933 | CB | ASN | A | 84 | −17.563 | 90.616 | 5.694 | 1.00 | 33.02 | C |
| ATOM | 3934 | CG | ASN | A | 84 | −18.033 | 89.347 | 6.358 | 1.00 | 38.60 | C |
| ATOM | 3935 | OD1 | ASN | A | 84 | −19.196 | 89.206 | 6.717 | 1.00 | 38.86 | O |
| ATOM | 3936 | ND2 | ASN | A | 84 | −17.127 | 88.398 | 6.499 | 1.00 | 43.30 | N |
| ATOM | 3937 | N | SER | A | 85 | −18.051 | 93.598 | 5.113 | 1.00 | 37.32 | N |
| ATOM | 3938 | CA | SER | A | 85 | −17.446 | 94.870 | 4.742 | 1.00 | 40.34 | C |
| ATOM | 3939 | C | SER | A | 85 | −18.091 | 95.435 | 3.483 | 1.00 | 36.53 | C |
| ATOM | 3940 | O | SER | A | 85 | −17.417 | 95.833 | 2.536 | 1.00 | 42.50 | O |
| ATOM | 3941 | CB | SER | A | 85 | −15.936 | 94.707 | 4.545 | 1.00 | 41.25 | C |
| ATOM | 3942 | OG | SER | A | 85 | −15.303 | 94.426 | 5.777 | 1.00 | 48.30 | O |
| ATOM | 3943 | N | LEU | A | 86 | −19.419 | 95.440 | 3.469 | 1.00 | 36.42 | N |
| ATOM | 3944 | CA | LEU | A | 86 | −20.121 | 95.839 | 2.269 | 1.00 | 30.29 | C |
| ATOM | 3945 | C | LEU | A | 86 | −19.768 | 97.269 | 1.898 | 1.00 | 37.87 | C |
| ATOM | 3946 | O | LEU | A | 86 | −19.530 | 98.126 | 2.759 | 1.00 | 39.88 | O |
| ATOM | 3947 | CB | LEU | A | 86 | −21.620 | 95.670 | 2.458 | 1.00 | 37.21 | C |
| ATOM | 3948 | CG | LEU | A | 86 | −22.026 | 94.199 | 2.267 | 1.00 | 41.48 | C |
| ATOM | 3949 | CD1 | LEU | A | 86 | −23.420 | 93.965 | 2.745 | 1.00 | 31.33 | C |
| ATOM | 3950 | CD2 | LEU | A | 86 | −21.912 | 93.809 | 0.788 | 1.00 | 34.28 | C |
| ATOM | 3951 | N | ARG | A | 87 | −19.673 | 97.500 | 0.601 | 1.00 | 31.11 | N |
| ATOM | 3952 | CA | ARG | A | 87 | −19.397 | 98.809 | 0.054 | 1.00 | 36.58 | C |
| ATOM | 3953 | C | ARG | A | 87 | −20.539 | 99.186 | −0.890 | 1.00 | 37.14 | C |
| ATOM | 3954 | O | ARG | A | 87 | −21.233 | 98.322 | −1.439 | 1.00 | 30.93 | O |
| ATOM | 3955 | CB | ARG | A | 87 | −18.047 | 98.816 | −0.688 | 1.00 | 36.84 | C |
| ATOM | 3956 | CG | ARG | A | 87 | −16.843 | 98.100 | −0.017 | 1.00 | 39.75 | C |
| ATOM | 3957 | CD | ARG | A | 87 | −15.620 | 98.762 | −0.560 | 1.00 | 50.01 | C |
| ATOM | 3958 | NE | ARG | A | 87 | −14.715 | 97.898 | −1.313 | 1.00 | 57.70 | N |
| ATOM | 3959 | CZ | ARG | A | 87 | −13.636 | 97.274 | −0.840 | 1.00 | 54.84 | C |
| ATOM | 3960 | NH1 | ARG | A | 87 | −13.275 | 97.378 | 0.442 | 1.00 | 55.39 | N1+ |
| ATOM | 3961 | NH2 | ARG | A | 87 | −12.907 | 96.541 | −1.682 | 1.00 | 46.24 | N |
| ATOM | 3962 | N | VAL | A | 88 | −20.706 | 100.495 | −1.088 | 1.00 | 33.94 | N |
| ATOM | 3963 | CA | VAL | A | 88 | −21.786 | 101.015 | −1.927 | 1.00 | 35.85 | C |
| ATOM | 3964 | C | VAL | A | 88 | −21.768 | 100.348 | −3.297 | 1.00 | 33.17 | C |
| ATOM | 3965 | O | VAL | A | 88 | −22.812 | 99.996 | −3.856 | 1.00 | 34.21 | O |
| ATOM | 3966 | CB | VAL | A | 88 | −21.681 | 102.557 | −2.018 | 1.00 | 41.36 | C |
| ATOM | 3967 | CG1 | VAL | A | 88 | −22.508 | 103.125 | −3.182 | 1.00 | 34.83 | C |
| ATOM | 3968 | CG2 | VAL | A | 88 | −22.191 | 103.172 | −0.697 | 1.00 | 32.83 | C |
| ATOM | 3969 | N | GLU | A | 89 | −20.577 | 100.142 | −3.842 | 1.00 | 32.51 | N |
| ATOM | 3970 | CA | GLU | A | 89 | −20.416 | 99.535 | −5.149 | 1.00 | 32.60 | C |
| ATOM | 3971 | C | GLU | A | 89 | −20.831 | 98.070 | −5.195 | 1.00 | 35.92 | C |
| ATOM | 3972 | O | GLU | A | 89 | −20.914 | 97.531 | −6.303 | 1.00 | 32.77 | O |
| ATOM | 3973 | CB | GLU | A | 89 | −18.947 | 99.625 | −5.598 | 1.00 | 33.36 | C |
| ATOM | 3974 | CG | GLU | A | 89 | −18.249 | 100.917 | −5.267 | 1.00 | 52.01 | C |
| ATOM | 3975 | CD | GLU | A | 89 | −17.581 | 100.894 | −3.898 | 1.00 | 57.81 | C |
| ATOM | 3976 | OE1 | GLU | A | 89 | −18.121 | 101.544 | −2.969 | 1.00 | 46.95 | O |
| ATOM | 3977 | OE2 | GLU | A | 89 | −16.513 | 100.230 | −3.762 | 1.00 | 68.05 | O1− |
| ATOM | 3978 | N | ASP | A | 90 | −21.123 | 97.427 | −4.048 | 1.00 | 30.72 | N |
| ATOM | 3979 | CA | ASP | A | 90 | −21.653 | 96.063 | −4.058 | 1.00 | 34.90 | C |
| ATOM | 3980 | C | ASP | A | 90 | −23.142 | 96.017 | −4.360 | 1.00 | 35.83 | C |
| ATOM | 3981 | O | ASP | A | 90 | −23.710 | 94.912 | −4.422 | 1.00 | 33.53 | O |
| ATOM | 3982 | CB | ASP | A | 90 | −21.377 | 95.351 | −2.721 | 1.00 | 28.51 | C |
| ATOM | 3983 | CG | ASP | A | 90 | −19.884 | 95.173 | −2.453 | 1.00 | 37.19 | C |
| ATOM | 3984 | OD1 | ASP | A | 90 | −19.142 | 94.821 | −3.411 | 1.00 | 36.43 | O |
| ATOM | 3985 | OD2 | ASP | A | 90 | −19.439 | 95.412 | −1.300 | 1.00 | 36.43 | O1− |
| ATOM | 3986 | N | THR | A | 91 | −23.778 | 97.180 | −4.534 | 1.00 | 30.48 | N |
| ATOM | 3987 | CA | THR | A | 91 | −25.207 | 97.244 | −4.843 | 1.00 | 34.41 | C |
| ATOM | 3988 | C | THR | A | 91 | −25.488 | 96.586 | −6.183 | 1.00 | 29.60 | C |
| ATOM | 3989 | O | THR | A | 91 | −24.889 | 96.958 | −7.192 | 1.00 | 33.51 | O |
| ATOM | 3990 | CB | THR | A | 91 | −25.655 | 98.705 | −4.865 | 1.00 | 34.98 | C |
| ATOM | 3991 | OG1 | THR | A | 91 | −25.482 | 99.260 | −3.556 | 1.00 | 33.04 | O |

TABLE 10.3-continued

| | | | | | | | | | | |
|---|---|---|---|---|---|---|---|---|---|---|
| ATOM | 3992 | CG2 | THR | A | 91 | −27.119 | 98.836 | −5.317 | 1.00 | 22.08 | C |
| ATOM | 3993 | N | ALA | A | 92 | −26.384 | 95.601 | −6.196 | 1.00 | 26.49 | N |
| ATOM | 3994 | CA | ALA | A | 92 | −26.628 | 94.831 | −7.418 | 1.00 | 33.82 | C |
| ATOM | 3995 | C | ALA | A | 92 | −27.764 | 93.858 | −7.167 | 1.00 | 31.11 | C |
| ATOM | 3996 | O | ALA | A | 92 | −28.109 | 93.559 | −6.019 | 1.00 | 33.45 | O |
| ATOM | 3997 | CB | ALA | A | 92 | −25.374 | 94.036 | −7.893 | 1.00 | 29.95 | C |
| ATOM | 3998 | N | VAL | A | 93 | −28.318 | 93.336 | −8.255 | 1.00 | 27.74 | N |
| ATOM | 3999 | CA | VAL | A | 93 | −29.052 | 92.083 | −8.161 | 1.00 | 27.69 | C |
| ATOM | 4000 | C | VAL | A | 93 | −28.035 | 90.949 | −8.156 | 1.00 | 32.05 | C |
| ATOM | 4001 | O | VAL | A | 93 | −27.098 | 90.935 | −8.970 | 1.00 | 32.98 | O |
| ATOM | 4002 | CB | VAL | A | 93 | −30.043 | 91.925 | −9.321 | 1.00 | 30.90 | C |
| ATOM | 4003 | CG1 | VAL | A | 93 | −30.675 | 90.530 | −9.260 | 1.00 | 27.42 | C |
| ATOM | 4004 | CG2 | VAL | A | 93 | −31.106 | 93.006 | −9.272 | 1.00 | 22.48 | C |
| ATOM | 4005 | N | TYR | A | 94 | −28.210 | 90.005 | −7.236 | 1.00 | 28.80 | N |
| ATOM | 4006 | CA | TYR | A | 94 | −27.333 | 88.851 | −7.090 | 1.00 | 27.10 | C |
| ATOM | 4007 | C | TYR | A | 94 | −28.052 | 87.579 | −7.535 | 1.00 | 30.77 | C |
| ATOM | 4008 | O | TYR | A | 94 | −29.164 | 87.290 | −7.070 | 1.00 | 32.21 | O |
| ATOM | 4009 | CB | TYR | A | 94 | −26.849 | 88.711 | −5.643 | 1.00 | 25.98 | C |
| ATOM | 4010 | CG | TYR | A | 94 | −25.744 | 89.678 | −5.299 | 1.00 | 35.21 | C |
| ATOM | 4011 | CD1 | TYR | A | 94 | −26.003 | 91.042 | −5.195 | 1.00 | 33.48 | C |
| ATOM | 4012 | CD2 | TYR | A | 94 | −24.448 | 89.235 | −5.071 | 1.00 | 28.53 | C |
| ATOM | 4013 | CE1 | TYR | A | 94 | −25.011 | 91.927 | −4.887 | 1.00 | 31.11 | C |
| ATOM | 4014 | CE2 | TYR | A | 94 | −23.439 | 90.127 | −4.754 | 1.00 | 34.57 | C |
| ATOM | 4015 | CZ | TYR | A | 94 | −23.734 | 91.482 | −4.674 | 1.00 | 34.25 | C |
| ATOM | 4016 | OH | TYR | A | 94 | −22.756 | 92.410 | −4.395 | 1.00 | 31.02 | O |
| ATOM | 4017 | N | TYR | A | 95 | −27.399 | 86.815 | −8.412 | 1.00 | 27.50 | N |
| ATOM | 4018 | CA | TYR | A | 95 | −27.904 | 85.566 | −8.958 | 1.00 | 28.28 | C |
| ATOM | 4019 | C | TYR | A | 95 | −26.990 | 84.436 | −8.531 | 1.00 | 30.88 | C |
| ATOM | 4020 | O | TYR | A | 95 | −25.769 | 84.610 | −8.464 | 1.00 | 30.35 | O |
| ATOM | 4021 | CB | TYR | A | 95 | −27.948 | 85.576 | −10.497 | 1.00 | 23.11 | C |
| ATOM | 4022 | CG | TYR | A | 95 | −28.742 | 86.673 | −11.106 | 1.00 | 28.17 | C |
| ATOM | 4023 | CD1 | TYR | A | 95 | −30.120 | 86.537 | −11.313 | 1.00 | 35.38 | C |
| ATOM | 4024 | CD2 | TYR | A | 95 | −28.128 | 87.864 | −11.486 | 1.00 | 31.26 | C |
| ATOM | 4025 | CE1 | TYR | A | 95 | −30.863 | 87.559 | −11.882 | 1.00 | 29.38 | C |
| ATOM | 4026 | CE2 | TYR | A | 95 | −28.854 | 88.887 | −12.059 | 1.00 | 27.86 | C |
| ATOM | 4027 | CZ | TYR | A | 95 | −30.210 | 88.733 | −12.251 | 1.00 | 32.29 | C |
| ATOM | 4028 | OH | TYR | A | 95 | −30.913 | 89.752 | −12.812 | 1.00 | 36.01 | O |
| ATOM | 4029 | N | CYS | A | 96 | −27.576 | 83.288 | −8.237 | 1.00 | 28.07 | N |
| ATOM | 4030 | CA | CYS | A | 96 | −26.795 | 82.069 | −8.201 | 1.00 | 31.83 | C |
| ATOM | 4031 | C | CYS | A | 96 | −27.035 | 81.314 | −9.498 | 1.00 | 30.66 | C |
| ATOM | 4032 | O | CYS | A | 96 | −28.063 | 81.482 | −10.165 | 1.00 | 27.69 | O |
| ATOM | 4033 | CB | CYS | A | 96 | −27.113 | 81.176 | −6.989 | 1.00 | 35.63 | C |
| ATOM | 4034 | SG | CYS | A | 96 | −28.807 | 80.660 | −6.800 | 1.00 | 52.39 | S |
| ATOM | 4035 | N | ALA | A | 97 | −26.055 | 80.500 | −9.860 | 1.00 | 25.32 | N |
| ATOM | 4036 | CA | ALA | A | 97 | −26.171 | 79.615 | −11.005 | 1.00 | 29.44 | C |
| ATOM | 4037 | C | ALA | A | 97 | −25.383 | 78.346 | −10.695 | 1.00 | 29.42 | C |
| ATOM | 4038 | O | ALA | A | 97 | −24.512 | 78.346 | −9.823 | 1.00 | 32.47 | O |
| ATOM | 4039 | CB | ALA | A | 97 | −25.671 | 80.294 | −12.287 | 1.00 | 26.70 | C |
| ATOM | 4040 | N | ASN | A | 98 | −25.693 | 77.251 | −11.396 | 1.00 | 25.38 | N |
| ATOM | 4041 | CA | ASN | A | 98 | −24.856 | 76.072 | −11.236 | 1.00 | 31.07 | C |
| ATOM | 4042 | C | ASN | A | 98 | −23.922 | 75.893 | −12.441 | 1.00 | 25.38 | C |
| ATOM | 4043 | O | ASN | A | 98 | −23.936 | 76.655 | −13.416 | 1.00 | 26.89 | O |
| ATOM | 4044 | CB | ASN | A | 98 | −25.714 | 74.832 | −10.962 | 1.00 | 26.42 | C |
| ATOM | 4045 | CG | ASN | A | 98 | −26.528 | 74.385 | −12.153 | 1.00 | 31.33 | C |
| ATOM | 4046 | OD1 | ASN | A | 98 | −26.444 | 74.948 | −13.257 | 1.00 | 31.54 | O |
| ATOM | 4047 | ND2 | ASN | A | 98 | −27.362 | 73.366 | −11.925 | 1.00 | 34.14 | N |
| ATOM | 4048 | N | TRP | A | 99 | −23.088 | 74.869 | −12.372 | 1.00 | 27.06 | N |
| ATOM | 4049 | CA | TRP | A | 99 | −22.251 | 74.549 | −13.521 | 1.00 | 30.36 | C |
| ATOM | 4050 | C | TRP | A | 99 | −22.064 | 73.046 | −13.590 | 1.00 | 30.04 | C |
| ATOM | 4051 | O | TRP | A | 99 | −21.903 | 72.391 | −12.555 | 1.00 | 29.39 | O |
| ATOM | 4052 | CB | TRP | A | 99 | −20.897 | 75.266 | −13.450 | 1.00 | 25.45 | C |
| ATOM | 4053 | CG | TRP | A | 99 | −19.972 | 74.863 | −12.353 | 1.00 | 29.81 | C |
| ATOM | 4054 | CD1 | TRP | A | 99 | −19.834 | 75.449 | −11.122 | 1.00 | 28.02 | C |
| ATOM | 4055 | CD2 | TRP | A | 99 | −18.997 | 73.810 | −12.408 | 1.00 | 26.75 | C |
| ATOM | 4056 | NE1 | TRP | A | 99 | −18.818 | 74.830 | −10.414 | 1.00 | 23.44 | N |
| ATOM | 4057 | CE2 | TRP | A | 99 | −18.300 | 73.816 | −11.178 | 1.00 | 25.89 | C |
| ATOM | 4058 | CE3 | TRP | A | 99 | −18.634 | 72.880 | −13.385 | 1.00 | 28.32 | C |
| ATOM | 4059 | CZ2 | TRP | A | 99 | −17.278 | 72.904 | −10.891 | 1.00 | 30.78 | C |
| ATOM | 4060 | CZ3 | TRP | A | 99 | −17.613 | 71.972 | −13.101 | 1.00 | 30.19 | C |
| ATOM | 4061 | CH2 | TRP | A | 99 | −16.951 | 71.992 | −11.859 | 1.00 | 28.00 | C |
| ATOM | 4062 | N | TYR | A | 100 | −22.084 | 72.513 | −14.814 | 1.00 | 30.79 | N |
| ATOM | 4063 | CA | TYR | A | 100 | −22.044 | 71.070 | −15.081 | 1.00 | 34.23 | C |
| ATOM | 4064 | C | TYR | A | 100 | −20.741 | 70.594 | −15.703 | 1.00 | 36.36 | C |
| ATOM | 4065 | O | TYR | A | 100 | −20.246 | 69.521 | −15.339 | 1.00 | 31.49 | O |
| ATOM | 4066 | CB | TYR | A | 100 | −23.188 | 70.657 | −16.023 | 1.00 | 29.48 | C |
| ATOM | 4067 | CG | TYR | A | 100 | −24.563 | 70.844 | −15.457 | 1.00 | 29.45 | C |
| ATOM | 4068 | CD1 | TYR | A | 100 | −24.812 | 70.621 | −14.106 | 1.00 | 32.61 | C |
| ATOM | 4069 | CD2 | TYR | A | 100 | −25.623 | 71.233 | −16.273 | 1.00 | 31.46 | C |
| ATOM | 4070 | CE1 | TYR | A | 100 | −26.081 | 70.796 | −13.576 | 1.00 | 32.67 | C |
| ATOM | 4071 | CE2 | TYR | A | 100 | −26.904 | 71.403 | −15.756 | 1.00 | 30.44 | C |

TABLE 10.3-continued

| | | | | | | | | | | |
|---|---|---|---|---|---|---|---|---|---|---|
| ATOM | 4072 | CZ | TYR | A | 100 | −27.124 | 71.173 | −14.404 | 1.00 | 31.95 | C |
| ATOM | 4073 | OH | TYR | A | 100 | −28.372 | 71.337 | −13.866 | 1.00 | 30.17 | O |
| ATOM | 4074 | N | TYR | A | 101 | −20.183 | 71.382 | −16.626 | 1.00 | 29.07 | N |
| ATOM | 4075 | CA | TYR | A | 101 | −19.125 | 70.940 | −17.527 | 1.00 | 29.25 | C |
| ATOM | 4076 | C | TYR | A | 101 | −17.797 | 71.608 | −17.189 | 1.00 | 34.28 | C |
| ATOM | 4077 | O | TYR | A | 101 | −16.868 | 70.944 | −16.723 | 1.00 | 35.11 | O |
| ATOM | 4078 | CB | TYR | A | 101 | −19.548 | 71.243 | −18.955 | 1.00 | 24.67 | C |
| ATOM | 4079 | CG | TYR | A | 101 | −20.914 | 70.690 | −19.282 | 1.00 | 32.07 | C |
| ATOM | 4080 | CD1 | TYR | A | 101 | −21.119 | 69.317 | −19.342 | 1.00 | 32.40 | C |
| ATOM | 4081 | CD2 | TYR | A | 101 | −21.996 | 71.534 | −19.549 | 1.00 | 27.53 | C |
| ATOM | 4082 | CE1 | TYR | A | 101 | −22.357 | 68.791 | −19.657 | 1.00 | 33.92 | C |
| ATOM | 4083 | CE2 | TYR | A | 101 | −23.255 | 71.019 | −19.850 | 1.00 | 27.34 | C |
| ATOM | 4084 | CZ | TYR | A | 101 | −23.419 | 69.641 | −19.902 | 1.00 | 34.29 | C |
| ATOM | 4085 | OH | TYR | A | 101 | −24.622 | 69.081 | −20.215 | 1.00 | 35.46 | O |
| ATOM | 4086 | N | TYR | A | 102 | −17.670 | 72.911 | −17.415 | 1.00 | 28.83 | N |
| ATOM | 4087 | CA | TYR | A | 102 | −16.483 | 73.631 | −16.998 | 1.00 | 29.54 | C |
| ATOM | 4088 | C | TYR | A | 102 | −16.872 | 74.660 | −15.951 | 1.00 | 31.00 | C |
| ATOM | 4089 | O | TYR | A | 102 | −17.957 | 75.244 | −16.004 | 1.00 | 33.23 | O |
| ATOM | 4090 | CB | TYR | A | 102 | −15.761 | 74.287 | −18.187 | 1.00 | 27.78 | C |
| ATOM | 4091 | CG | TYR | A | 102 | −16.664 | 74.965 | −19.187 | 1.00 | 30.93 | C |
| ATOM | 4092 | CD1 | TYR | A | 102 | −17.186 | 74.251 | −20.261 | 1.00 | 31.23 | C |
| ATOM | 4093 | CD2 | TYR | A | 102 | −16.985 | 76.326 | −19.074 | 1.00 | 27.14 | C |
| ATOM | 4094 | CE1 | TYR | A | 102 | −18.004 | 74.864 | −21.204 | 1.00 | 29.52 | C |
| ATOM | 4095 | CE2 | TYR | A | 102 | −17.801 | 76.957 | −20.027 | 1.00 | 26.32 | C |
| ATOM | 4096 | CZ | TYR | A | 102 | −18.311 | 76.217 | −21.086 | 1.00 | 29.71 | C |
| ATOM | 4097 | OH | TYR | A | 102 | −19.120 | 76.803 | −22.045 | 1.00 | 27.38 | O |
| ATOM | 4098 | N | TYR | A | 103 | −15.960 | 74.870 | −15.000 | 1.00 | 33.17 | N |
| ATOM | 4099 | CA | TYR | A | 103 | −16.282 | 75.569 | −13.768 | 1.00 | 30.18 | C |
| ATOM | 4100 | C | TYR | A | 103 | −16.585 | 77.043 | −13.983 | 1.00 | 30.85 | C |
| ATOM | 4101 | O | TYR | A | 103 | −17.198 | 77.659 | −13.111 | 1.00 | 31.82 | O |
| ATOM | 4102 | CB | TYR | A | 103 | −15.133 | 75.420 | −12.772 | 1.00 | 30.32 | C |
| ATOM | 4103 | CG | TYR | A | 103 | −13.820 | 76.094 | −13.175 | 1.00 | 36.74 | C |
| ATOM | 4104 | CD1 | TYR | A | 103 | −12.864 | 75.419 | −13.922 | 1.00 | 34.48 | C |
| ATOM | 4105 | CD2 | TYR | A | 103 | −13.527 | 77.399 | −12.776 | 1.00 | 36.39 | C |
| ATOM | 4106 | CE1 | TYR | A | 103 | −11.652 | 76.031 | −14.266 | 1.00 | 37.99 | C |
| ATOM | 4107 | CE2 | TYR | A | 103 | −12.332 | 78.012 | −13.120 | 1.00 | 34.39 | C |
| ATOM | 4108 | CZ | TYR | A | 103 | −11.394 | 77.329 | −13.860 | 1.00 | 40.90 | C |
| ATOM | 4109 | OH | TYR | A | 103 | −10.196 | 77.947 | −14.206 | 1.00 | 43.10 | O |
| ATOM | 4110 | N | TYR | A | 104 | −16.189 | 77.616 | −15.112 | 1.00 | 27.43 | N |
| ATOM | 4111 | CA | TYR | A | 104 | −16.416 | 79.027 | −15.373 | 1.00 | 29.07 | C |
| ATOM | 4112 | C | TYR | A | 104 | −17.599 | 79.242 | −16.291 | 1.00 | 28.87 | C |
| ATOM | 4113 | O | TYR | A | 104 | −17.791 | 80.354 | −16.780 | 1.00 | 35.12 | O |
| ATOM | 4114 | CB | TYR | A | 104 | −15.149 | 79.690 | −15.953 | 1.00 | 25.68 | C |
| ATOM | 4115 | CG | TYR | A | 104 | −14.499 | 78.931 | −17.095 | 1.00 | 30.36 | C |
| ATOM | 4116 | CD1 | TYR | A | 104 | −13.573 | 77.894 | −16.846 | 1.00 | 29.10 | C |
| ATOM | 4117 | CD2 | TYR | A | 104 | −14.813 | 79.233 | −18.429 | 1.00 | 27.13 | C |
| ATOM | 4118 | CE1 | TYR | A | 104 | −12.964 | 77.181 | −17.913 | 1.00 | 27.53 | C |
| ATOM | 4119 | CE2 | TYR | A | 104 | −14.225 | 78.528 | −19.494 | 1.00 | 27.81 | C |
| ATOM | 4120 | CZ | TYR | A | 104 | −13.296 | 77.508 | −19.232 | 1.00 | 31.37 | C |
| ATOM | 4121 | OH | TYR | A | 104 | −12.708 | 76.829 | −20.282 | 1.00 | 33.25 | O |
| ATOM | 4122 | N | GLY | A | 105 | −18.385 | 78.199 | −16.546 | 1.00 | 33.05 | N |
| ATOM | 4123 | CA | GLY | A | 105 | −19.642 | 78.324 | −17.262 | 1.00 | 28.37 | C |
| ATOM | 4124 | C | GLY | A | 105 | −20.806 | 78.259 | −16.290 | 1.00 | 33.54 | C |
| ATOM | 4125 | O | GLY | A | 105 | −20.731 | 77.601 | −15.262 | 1.00 | 36.54 | O |
| ATOM | 4126 | N | MET | A | 106 | −21.885 | 78.955 | −16.614 | 1.00 | 33.38 | N |
| ATOM | 4127 | CA | MET | A | 106 | −23.107 | 78.909 | −15.818 | 1.00 | 33.92 | C |
| ATOM | 4128 | C | MET | A | 106 | −24.192 | 78.210 | −16.619 | 1.00 | 33.40 | C |
| ATOM | 4129 | O | MET | A | 106 | −24.516 | 78.645 | −17.727 | 1.00 | 41.54 | O |
| ATOM | 4130 | CB | MET | A | 106 | −23.575 | 80.314 | −15.438 | 1.00 | 31.98 | C |
| ATOM | 4131 | CG | MET | A | 106 | −22.640 | 81.023 | −14.492 | 1.00 | 38.84 | C |
| ATOM | 4132 | SD | MET | A | 106 | −21.690 | 82.292 | −15.342 | 1.00 | 39.21 | S |
| ATOM | 4133 | CE | MET | A | 106 | −20.191 | 82.280 | −14.355 | 1.00 | 44.14 | C |
| ATOM | 4134 | N | ASP | A | 107 | −24.786 | 77.161 | −16.049 | 1.00 | 30.51 | N |
| ATOM | 4135 | CA | ASP | A | 107 | −25.760 | 76.380 | −16.809 | 1.00 | 30.12 | C |
| ATOM | 4136 | C | ASP | A | 107 | −27.213 | 76.688 | −16.421 | 1.00 | 31.04 | C |
| ATOM | 4137 | O | ASP | A | 107 | −28.019 | 76.977 | −17.300 | 1.00 | 30.61 | O |
| ATOM | 4138 | CB | ASP | A | 107 | −25.432 | 74.882 | −16.678 | 1.00 | 32.36 | C |
| ATOM | 4139 | CG | ASP | A | 107 | −24.108 | 74.509 | −17.383 | 1.00 | 34.37 | C |
| ATOM | 4140 | OD1 | ASP | A | 107 | −24.105 | 74.413 | −18.627 | 1.00 | 32.86 | O1− |
| ATOM | 4141 | OD2 | ASP | A | 107 | −23.060 | 74.339 | −16.705 | 1.00 | 36.09 | O |
| ATOM | 4142 | N | VAL | A | 108 | −27.581 | 76.603 | −15.138 | 1.00 | 32.41 | N |
| ATOM | 4143 | CA | VAL | A | 108 | −28.922 | 76.954 | −14.662 | 1.00 | 26.51 | C |
| ATOM | 4144 | C | VAL | A | 108 | −28.818 | 78.175 | −13.754 | 1.00 | 32.76 | C |
| ATOM | 4145 | O | VAL | A | 108 | −27.911 | 78.254 | −12.920 | 1.00 | 31.62 | O |
| ATOM | 4146 | CB | VAL | A | 108 | −29.590 | 75.776 | −13.915 | 1.00 | 28.43 | C |
| ATOM | 4147 | CG1 | VAL | A | 108 | −31.028 | 76.146 | −13.506 | 1.00 | 27.65 | C |
| ATOM | 4148 | CG2 | VAL | A | 108 | −29.617 | 74.516 | −14.803 | 1.00 | 30.87 | C |
| ATOM | 4149 | N | TRP | A | 109 | −29.752 | 79.117 | −13.893 | 1.00 | 33.08 | N |
| ATOM | 4150 | CA | TRP | A | 109 | −29.744 | 80.348 | −13.102 | 1.00 | 34.02 | C |
| ATOM | 4151 | C | TRP | A | 109 | −30.981 | 80.440 | −12.208 | 1.00 | 33.68 | C |

TABLE 10.3-continued

| | | | | | | | | | | |
|---|---|---|---|---|---|---|---|---|---|---|
| ATOM | 4152 | O | TRP | A | 109 | −32.064 | 79.966 | −12.563 | 1.00 | 33.19 | O |
| ATOM | 4153 | CB | TRP | A | 109 | −29.716 | 81.605 | −13.997 | 1.00 | 30.84 | C |
| ATOM | 4154 | CG | TRP | A | 109 | −28.485 | 81.762 | −14.834 | 1.00 | 36.98 | C |
| ATOM | 4155 | CD1 | TRP | A | 109 | −28.097 | 80.972 | −15.893 | 1.00 | 30.27 | C |
| ATOM | 4156 | CD2 | TRP | A | 109 | −27.503 | 82.805 | −14.730 | 1.00 | 31.30 | C |
| ATOM | 4157 | NE1 | TRP | A | 109 | −26.927 | 81.459 | −16.432 | 1.00 | 31.83 | N |
| ATOM | 4158 | CE2 | TRP | A | 109 | −26.534 | 82.571 | −15.731 | 1.00 | 29.54 | C |
| ATOM | 4159 | CE3 | TRP | A | 109 | −27.339 | 83.902 | −13.875 | 1.00 | 30.44 | C |
| ATOM | 4160 | CZ2 | TRP | A | 109 | −25.409 | 83.392 | −15.896 | 1.00 | 31.19 | C |
| ATOM | 4161 | CZ3 | TRP | A | 109 | −26.223 | 84.723 | −14.042 | 1.00 | 30.38 | C |
| ATOM | 4162 | CH2 | TRP | A | 109 | −25.271 | 84.460 | −15.043 | 1.00 | 29.90 | C |
| ATOM | 4163 | N | GLY | A | 110 | −30.820 | 81.113 | −11.066 | 1.00 | 29.11 | N |
| ATOM | 4164 | CA | GLY | A | 110 | −31.931 | 81.457 | −10.200 | 1.00 | 35.80 | C |
| ATOM | 4165 | C | GLY | A | 110 | −32.644 | 82.701 | −10.704 | 1.00 | 37.01 | C |
| ATOM | 4166 | O | GLY | A | 110 | −32.532 | 83.075 | −11.871 | 1.00 | 37.79 | O |
| ATOM | 4167 | N | GLN | A | 111 | −33.399 | 83.358 | −9.817 | 1.00 | 35.07 | N |
| ATOM | 4168 | CA | GLN | A | 111 | −34.189 | 84.495 | −10.276 | 1.00 | 30.15 | C |
| ATOM | 4169 | C | GLN | A | 111 | −33.645 | 85.841 | −9.831 | 1.00 | 32.38 | C |
| ATOM | 4170 | O | GLN | A | 111 | −34.080 | 86.862 | −10.372 | 1.00 | 33.82 | O |
| ATOM | 4171 | CB | GLN | A | 111 | −35.644 | 84.410 | −9.787 | 1.00 | 37.66 | C |
| ATOM | 4172 | CG | GLN | A | 111 | −35.874 | 85.115 | −8.454 | 1.00 | 36.90 | C |
| ATOM | 4173 | CD | GLN | A | 111 | −35.642 | 84.208 | −7.281 | 1.00 | 42.01 | C |
| ATOM | 4174 | OE1 | GLN | A | 111 | −35.896 | 82.996 | −7.380 | 1.00 | 52.02 | O |
| ATOM | 4175 | NE2 | GLN | A | 111 | −35.176 | 84.777 | −6.142 | 1.00 | 30.60 | N |
| ATOM | 4176 | N | GLY | A | 112 | −32.755 | 85.872 | −8.846 | 1.00 | 31.52 | N |
| ATOM | 4177 | CA | GLY | A | 112 | −32.098 | 87.079 | −8.391 | 1.00 | 29.27 | C |
| ATOM | 4178 | C | GLY | A | 112 | −32.707 | 87.635 | −7.114 | 1.00 | 30.54 | C |
| ATOM | 4179 | O | GLY | A | 112 | −33.900 | 87.487 | −6.840 | 1.00 | 36.59 | O |
| ATOM | 4180 | N | THR | A | 113 | −31.873 | 88.297 | −6.326 | 1.00 | 32.24 | N |
| ATOM | 4181 | CA | THR | A | 113 | −32.301 | 89.057 | −5.166 | 1.00 | 33.85 | C |
| ATOM | 4182 | C | THR | A | 113 | −31.459 | 90.323 | −5.122 | 1.00 | 32.53 | C |
| ATOM | 4183 | O | THR | A | 113 | −30.284 | 90.295 | −5.496 | 1.00 | 30.25 | O |
| ATOM | 4184 | CB | THR | A | 113 | −32.150 | 88.240 | −3.878 | 1.00 | 31.09 | C |
| ATOM | 4185 | OG1 | THR | A | 113 | −32.645 | 89.016 | −2.780 | 1.00 | 36.12 | O |
| ATOM | 4186 | CG2 | THR | A | 113 | −30.672 | 87.868 | −3.623 | 1.00 | 30.38 | C |
| ATOM | 4187 | N | ATHR | A | 114 | −32.052 | 91.460 | −4.734 | 0.50 | 32.93 | N |
| ATOM | 4188 | CA | ATHR | A | 114 | −31.300 | 92.714 | −4.776 | 0.50 | 30.39 | C |
| ATOM | 4189 | C | ATHR | A | 114 | −30.691 | 93.019 | −3.419 | 0.50 | 31.37 | C |
| ATOM | 4190 | O | ATHR | A | 114 | −31.310 | 92.805 | −2.374 | 0.50 | 33.91 | O |
| ATOM | 4191 | CB | ATHR | A | 114 | −32.120 | 93.928 | −5.266 | 0.50 | 31.38 | C |
| ATOM | 4192 | OG1 | ATHR | A | 114 | −31.978 | 95.061 | −4.375 | 0.50 | 27.49 | O |
| ATOM | 4193 | CG2 | ATHR | A | 114 | −33.533 | 93.593 | −5.476 | 0.50 | 26.66 | C |
| ATOM | 4194 | N | BTHR | A | 114 | −32.061 | 91.410 | −4.642 | 0.50 | 32.98 | N |
| ATOM | 4195 | CA | BTHR | A | 114 | −31.413 | 92.712 | −4.641 | 0.50 | 30.32 | C |
| ATOM | 4196 | C | BTHR | A | 114 | −30.650 | 92.930 | −3.345 | 0.50 | 31.38 | C |
| ATOM | 4197 | O | BTHR | A | 114 | −31.141 | 92.610 | −2.260 | 0.50 | 34.03 | O |
| ATOM | 4198 | CB | BTHR | A | 114 | −32.434 | 93.834 | −4.810 | 0.50 | 30.28 | C |
| ATOM | 4199 | OG1 | BTHR | A | 114 | −33.299 | 93.846 | −3.681 | 0.50 | 37.62 | O |
| ATOM | 4200 | CG2 | BTHR | A | 114 | −33.258 | 93.627 | −6.018 | 0.50 | 25.95 | C |
| ATOM | 4201 | N | VAL | A | 115 | −29.451 | 93.489 | −3.463 | 1.00 | 29.38 | N |
| ATOM | 4202 | CA | VAL | A | 115 | −28.711 | 93.973 | −2.317 | 1.00 | 31.80 | C |
| ATOM | 4203 | C | VAL | A | 115 | −28.460 | 95.452 | −2.583 | 1.00 | 32.96 | C |
| ATOM | 4204 | O | VAL | A | 115 | −27.891 | 95.811 | −3.622 | 1.00 | 32.78 | O |
| ATOM | 4205 | CB | VAL | A | 115 | −27.392 | 93.209 | −2.130 | 1.00 | 36.32 | C |
| ATOM | 4206 | CG1 | VAL | A | 115 | −26.569 | 93.856 | −1.020 | 1.00 | 35.15 | C |
| ATOM | 4207 | CG2 | VAL | A | 115 | −27.651 | 91.686 | −1.886 | 1.00 | 32.11 | C |
| ATOM | 4208 | N | THR | A | 116 | −28.917 | 96.307 | −1.676 | 1.00 | 32.75 | N |
| ATOM | 4209 | CA | THR | A | 116 | −28.678 | 97.741 | −1.754 | 1.00 | 34.57 | C |
| ATOM | 4210 | C | THR | A | 116 | −27.787 | 98.139 | −0.584 | 1.00 | 34.59 | C |
| ATOM | 4211 | O | THR | A | 116 | −28.121 | 97.881 | 0.580 | 1.00 | 36.50 | O |
| ATOM | 4212 | CB | THR | A | 116 | −29.995 | 98.522 | −1.736 | 1.00 | 43.36 | C |
| ATOM | 4213 | OG1 | THR | A | 116 | −30.802 | 98.125 | −2.856 | 1.00 | 40.71 | O |
| ATOM | 4214 | CG2 | THR | A | 116 | −29.731 | 100.021 | −1.809 | 1.00 | 29.94 | C |
| ATOM | 4215 | N | VAL | A | 117 | −26.649 | 98.738 | −0.890 | 1.00 | 34.23 | N |
| ATOM | 4216 | CA | VAL | A | 117 | −25.719 | 99.181 | 0.134 | 1.00 | 34.01 | C |
| ATOM | 4217 | C | VAL | A | 117 | −25.756 | 100.691 | 0.076 | 1.00 | 33.64 | C |
| ATOM | 4218 | O | VAL | A | 117 | −25.318 | 101.293 | −0.906 | 1.00 | 37.46 | O |
| ATOM | 4219 | CB | VAL | A | 117 | −24.301 | 98.631 | −0.073 | 1.00 | 36.31 | C |
| ATOM | 4220 | CG1 | VAL | A | 117 | −23.392 | 99.053 | 1.093 | 1.00 | 33.46 | C |
| ATOM | 4221 | CG2 | VAL | A | 117 | −24.317 | 97.090 | −0.232 | 1.00 | 29.32 | C |
| ATOM | 4222 | N | SER | A | 118 | −26.359 | 101.302 | 1.081 | 1.00 | 39.03 | N |
| ATOM | 4223 | CA | SER | A | 118 | −26.566 | 102.738 | 1.077 | 1.00 | 39.96 | C |
| ATOM | 4224 | C | SER | A | 118 | −26.419 | 103.243 | 2.497 | 1.00 | 45.19 | C |
| ATOM | 4225 | O | SER | A | 118 | −26.858 | 102.579 | 3.439 | 1.00 | 47.46 | O |
| ATOM | 4226 | CB | SER | A | 118 | −27.961 | 103.097 | 0.529 | 1.00 | 38.81 | C |
| ATOM | 4227 | OG | SER | A | 118 | −28.165 | 104.501 | 0.460 | 1.00 | 48.85 | O |
| ATOM | 4228 | N | SER | A | 119 | −25.802 | 104.406 | 2.653 | 1.00 | 46.28 | N |
| ATOM | 4229 | CA | SER | A | 119 | −25.847 | 105.090 | 3.935 | 1.00 | 53.97 | C |
| ATOM | 4230 | C | SER | A | 119 | −26.871 | 106.217 | 3.954 | 1.00 | 56.65 | C |
| ATOM | 4231 | O | SER | A | 119 | −26.985 | 106.913 | 4.961 | 1.00 | 67.20 | O |

TABLE 10.3-continued

| ATOM | 4232 | CB | SER | A | 119 | −24.468 | 105.628 | 4.292 | 1.00 | 47.03 | | C |
|------|------|------|-----|---|-----|---------|---------|-------|------|-------|------|----|
| ATOM | 4233 | OG | SER | A | 119 | −23.903 | 106.260 | 3.168 | 1.00 | 54.58 | | O |
| ATOM | 4234 | N | ALA | A | 120 | −27.649 | 106.385 | 2.890 | 1.00 | 48.46 | | N |
| ATOM | 4235 | CA | ALA | A | 120 | −28.631 | 107.451 | 2.863 | 1.00 | 46.93 | | C |
| ATOM | 4236 | C | ALA | A | 120 | −29.791 | 107.119 | 3.793 | 1.00 | 50.99 | | C |
| ATOM | 4237 | O | ALA | A | 120 | −30.104 | 105.957 | 4.047 | 1.00 | 62.07 | | O |
| ATOM | 4238 | CB | ALA | A | 120 | −29.138 | 107.672 | 1.439 | 1.00 | 43.79 | | C |
| ATOM | 4239 | N | SER | A | 121 | −30.399 | 108.159 | 4.341 | 1.00 | 61.71 | GZ00 | N |
| ATOM | 4240 | CA | SER | A | 121 | −31.605 | 108.063 | 5.149 | 1.00 | 54.23 | GZ00 | C |
| ATOM | 4241 | C | SER | A | 121 | −32.579 | 109.105 | 4.648 | 1.00 | 47.84 | GZ00 | C |
| ATOM | 4242 | O | SER | A | 121 | −32.202 | 110.015 | 3.907 | 1.00 | 55.11 | GZ00 | O |
| ATOM | 4243 | CB | SER | A | 121 | −31.338 | 108.273 | 6.640 | 1.00 | 50.17 | GZ00 | C |
| ATOM | 4244 | OG | SER | A | 121 | −30.386 | 109.312 | 6.829 | 1.00 | 66.59 | GZ00 | O |
| ATOM | 4245 | N | THR | A | 122 | −33.838 | 108.938 | 5.041 | 1.00 | 46.14 | GZ00 | N |
| ATOM | 4246 | CA | THR | A | 122 | −34.934 | 109.776 | 4.572 | 1.00 | 52.42 | GZ00 | C |
| ATOM | 4247 | C | THR | A | 122 | −34.557 | 111.248 | 4.510 | 1.00 | 56.26 | GZ00 | C |
| ATOM | 4248 | O | THR | A | 122 | −33.924 | 111.783 | 5.426 | 1.00 | 48.53 | GZ00 | O |
| ATOM | 4249 | CB | THR | A | 122 | −36.129 | 109.606 | 5.486 | 1.00 | 52.24 | GZ00 | C |
| ATOM | 4250 | OG1 | THR | A | 122 | −36.428 | 108.215 | 5.593 | 1.00 | 57.02 | GZ00 | O |
| ATOM | 4251 | CG2 | THR | A | 122 | −37.310 | 110.342 | 4.912 | 1.00 | 53.18 | GZ00 | C |
| ATOM | 4252 | N | LYS | A | 123 | −34.894 | 111.876 | 3.385 | 1.00 | 54.75 | GZ00 | N |
| ATOM | 4253 | CA | LYS | A | 123 | −34.659 | 113.296 | 3.176 | 1.00 | 45.96 | GZ00 | C |
| ATOM | 4254 | C | LYS | A | 123 | −35.645 | 113.763 | 2.125 | 1.00 | 53.79 | GZ00 | C |
| ATOM | 4255 | O | LYS | A | 123 | −35.799 | 113.095 | 1.099 | 1.00 | 47.21 | GZ00 | O |
| ATOM | 4256 | CB | LYS | A | 123 | −33.228 | 113.577 | 2.727 | 1.00 | 48.41 | GZ00 | C |
| ATOM | 4257 | CG | LYS | A | 123 | −32.969 | 115.041 | 2.451 | 1.00 | 46.73 | GZ00 | C |
| ATOM | 4258 | CD | LYS | A | 123 | −31.559 | 115.291 | 1.972 | 1.00 | 52.19 | GZ00 | C |
| ATOM | 4259 | CE | LYS | A | 123 | −31.365 | 116.750 | 1.520 | 1.00 | 54.71 | GZ00 | C |
| ATOM | 4260 | NZ | LYS | A | 123 | −32.367 | 117.163 | 0.481 | 1.00 | 49.08 | GZ00 | N1+ |
| ATOM | 4261 | N | GLY | A | 124 | −36.311 | 114.898 | 2.382 | 1.00 | 53.18 | GZ00 | N |
| ATOM | 4262 | CA | GLY | A | 124 | −37.243 | 115.482 | 1.440 | 1.00 | 35.65 | GZ00 | C |
| ATOM | 4263 | C | GLY | A | 124 | −36.503 | 116.234 | 0.347 | 1.00 | 38.66 | GZ00 | C |
| ATOM | 4264 | O | GLY | A | 124 | −35.330 | 116.589 | 0.499 | 1.00 | 39.24 | GZ00 | O |
| ATOM | 4265 | N | PRO | A | 125 | −37.165 | 116.475 | −0.782 | 1.00 | 39.30 | GZ00 | N |
| ATOM | 4266 | CA | PRO | A | 125 | −36.474 | 117.071 | −1.933 | 1.00 | 45.65 | GZ00 | C |
| ATOM | 4267 | C | PRO | A | 125 | −36.378 | 118.586 | −1.844 | 1.00 | 46.64 | GZ00 | C |
| ATOM | 4268 | O | PRO | A | 125 | −37.212 | 119.253 | −1.230 | 1.00 | 46.44 | GZ00 | O |
| ATOM | 4269 | CB | PRO | A | 125 | −37.378 | 116.684 | −3.110 | 1.00 | 44.97 | GZ00 | C |
| ATOM | 4270 | CG | PRO | A | 125 | −38.764 | 116.674 | −2.504 | 1.00 | 34.50 | GZ00 | C |
| ATOM | 4271 | CD | PRO | A | 125 | −38.573 | 116.145 | −1.088 | 1.00 | 36.15 | GZ00 | C |
| ATOM | 4272 | N | SER | A | 126 | −35.358 | 119.126 | −2.502 | 1.00 | 46.29 | GZ00 | N |
| ATOM | 4273 | CA | SER | A | 126 | −35.329 | 120.540 | −2.858 | 1.00 | 46.55 | GZ00 | C |
| ATOM | 4274 | C | SER | A | 126 | −35.926 | 120.698 | −4.247 | 1.00 | 51.08 | GZ00 | C |
| ATOM | 4275 | O | SER | A | 126 | −35.646 | 119.893 | −5.139 | 1.00 | 52.88 | GZ00 | O |
| ATOM | 4276 | CB | SER | A | 126 | −33.903 | 121.093 | −2.860 | 1.00 | 40.26 | GZ00 | C |
| ATOM | 4277 | OG | SER | A | 126 | −33.293 | 120.973 | −1.591 | 1.00 | 55.79 | GZ00 | O |
| ATOM | 4278 | N | VAL | A | 127 | −36.744 | 121.735 | −4.438 | 1.00 | 47.44 | GZ00 | N |
| ATOM | 4279 | CA | VAL | A | 127 | −37.420 | 121.956 | −5.713 | 1.00 | 40.11 | GZ00 | C |
| ATOM | 4280 | C | VAL | A | 127 | −36.980 | 123.290 | −6.314 | 1.00 | 43.78 | GZ00 | C |
| ATOM | 4281 | O | VAL | A | 127 | −37.076 | 124.339 | −5.665 | 1.00 | 52.62 | GZ00 | O |
| ATOM | 4282 | CB | VAL | A | 127 | −38.948 | 121.898 | −5.553 | 1.00 | 45.33 | GZ00 | C |
| ATOM | 4283 | CG1 | VAL | A | 127 | −39.618 | 122.036 | −6.908 | 1.00 | 44.26 | GZ00 | C |
| ATOM | 4284 | CG2 | VAL | A | 127 | −39.359 | 120.584 | −4.873 | 1.00 | 41.94 | GZ00 | C |
| ATOM | 4285 | N | PHE | A | 128 | −36.517 | 123.250 | −7.564 | 1.00 | 40.88 | GZ00 | N |
| ATOM | 4286 | CA | PHE | A | 128 | −36.074 | 124.425 | −8.285 | 1.00 | 43.70 | GZ00 | C |
| ATOM | 4287 | C | PHE | A | 128 | −36.857 | 124.590 | −9.578 | 1.00 | 46.15 | GZ00 | C |
| ATOM | 4288 | O | PHE | A | 128 | −37.192 | 123.598 | −10.227 | 1.00 | 47.49 | GZ00 | O |
| ATOM | 4289 | CB | PHE | A | 128 | −34.582 | 124.356 | −8.615 | 1.00 | 42.40 | GZ00 | C |
| ATOM | 4290 | CG | PHE | A | 128 | −33.714 | 124.253 | −7.406 | 1.00 | 49.59 | GZ00 | C |
| ATOM | 4291 | CD1 | PHE | A | 128 | −33.404 | 125.389 | −6.666 | 1.00 | 47.01 | GZ00 | C |
| ATOM | 4292 | CD2 | PHE | A | 128 | −33.188 | 123.033 | −7.012 | 1.00 | 45.42 | GZ00 | C |
| ATOM | 4293 | CE1 | PHE | A | 128 | −32.604 | 125.308 | −5.538 | 1.00 | 45.05 | GZ00 | C |
| ATOM | 4294 | CE2 | PHE | A | 128 | −32.379 | 122.946 | −5.890 | 1.00 | 55.33 | GZ00 | C |
| ATOM | 4295 | CZ | PHE | A | 128 | −32.084 | 124.085 | −5.152 | 1.00 | 51.39 | GZ00 | C |
| ATOM | 4296 | N | PRO | A | 129 | −37.153 | 125.823 | −9.985 | 1.00 | 44.34 | GZ00 | N |
| ATOM | 4297 | CA | PRO | A | 129 | −37.894 | 126.021 | −11.233 | 1.00 | 46.78 | GZ00 | C |
| ATOM | 4298 | C | PRO | A | 129 | −36.975 | 125.867 | −12.426 | 1.00 | 45.16 | GZ00 | C |
| ATOM | 4299 | O | PRO | A | 129 | −35.815 | 126.280 | −12.397 | 1.00 | 53.62 | GZ00 | O |
| ATOM | 4300 | CB | PRO | A | 129 | −38.404 | 127.460 | −11.109 | 1.00 | 47.94 | GZ00 | C |
| ATOM | 4301 | CG | PRO | A | 129 | −37.334 | 128.141 | −10.336 | 1.00 | 40.44 | GZ00 | C |
| ATOM | 4302 | CD | PRO | A | 129 | −36.844 | 127.103 | −9.323 | 1.00 | 47.69 | GZ00 | C |
| ATOM | 4303 | N | LEU | A | 130 | −37.486 | 125.227 | −13.465 | 1.00 | 44.60 | GZ00 | N |
| ATOM | 4304 | CA | LEU | A | 130 | −36.794 | 125.147 | −14.749 | 1.00 | 49.12 | GZ00 | C |
| ATOM | 4305 | C | LEU | A | 130 | −37.528 | 126.108 | −15.677 | 1.00 | 54.30 | GZ00 | C |
| ATOM | 4306 | O | LEU | A | 130 | −38.580 | 125.769 | −16.225 | 1.00 | 53.88 | GZ00 | O |
| ATOM | 4307 | CB | LEU | A | 130 | −36.764 | 123.714 | −15.283 | 1.00 | 52.10 | GZ00 | C |
| ATOM | 4308 | CG | LEU | A | 130 | −36.085 | 122.707 | −14.338 | 1.00 | 49.99 | GZ00 | C |
| ATOM | 4309 | CD1 | LEU | A | 130 | −36.064 | 121.284 | −14.876 | 1.00 | 44.72 | GZ00 | C |
| ATOM | 4310 | CD2 | LEU | A | 130 | −34.670 | 123.167 | −14.003 | 1.00 | 49.22 | GZ00 | C |
| ATOM | 4311 | N | ALA | A | 131 | −36.979 | 127.339 | −15.828 | 1.00 | 51.83 | GZ00 | N |

TABLE 10.3-continued

| | | | | | | | | | | | |
|---|---|---|---|---|---|---|---|---|---|---|---|
| ATOM | 4312 | CA | ALA | A | 131 | −37.752 | 128.405 | −16.461 | 1.00 | 60.57 | GZ00 | C |
| ATOM | 4313 | C | ALA | A | 131 | −37.777 | 128.241 | −17.979 | 1.00 | 58.44 | GZ00 | C |
| ATOM | 4314 | O | ALA | A | 131 | −36.767 | 127.860 | −18.578 | 1.00 | 62.01 | GZ00 | O |
| ATOM | 4315 | CB | ALA | A | 131 | −37.182 | 129.780 | −16.118 | 1.00 | 52.12 | GZ00 | C |
| ATOM | 4316 | N | PRO | A | 132 | −38.922 | 128.508 | −18.610 | 1.00 | 63.89 | GZ00 | N |
| ATOM | 4317 | CA | PRO | A | 132 | −38.974 | 128.551 | −20.076 | 1.00 | 60.84 | GZ00 | C |
| ATOM | 4318 | C | PRO | A | 132 | −38.312 | 129.818 | −20.583 | 1.00 | 68.50 | GZ00 | C |
| ATOM | 4319 | O | PRO | A | 132 | −38.605 | 130.917 | −20.107 | 1.00 | 78.71 | GZ00 | O |
| ATOM | 4320 | CB | PRO | A | 132 | −40.477 | 128.546 | −20.374 | 1.00 | 61.98 | GZ00 | C |
| ATOM | 4321 | CG | PRO | A | 132 | −41.076 | 129.218 | −19.186 | 1.00 | 59.91 | GZ00 | C |
| ATOM | 4322 | CD | PRO | A | 132 | −40.239 | 128.787 | −18.005 | 1.00 | 64.04 | GZ00 | C |
| ATOM | 4323 | N | SER | A | 133 | −37.403 | 129.660 | −21.536 | 1.00 | 78.25 | GZ00 | N |
| ATOM | 4324 | CA | SER | A | 133 | −36.712 | 130.783 | −22.151 | 1.00 | 90.93 | GZ00 | C |
| ATOM | 4325 | C | SER | A | 133 | −36.986 | 130.784 | −23.647 | 1.00 | 95.12 | GZ00 | C |
| ATOM | 4326 | O | SER | A | 133 | −37.432 | 129.785 | −24.219 | 1.00 | 92.73 | GZ00 | O |
| ATOM | 4327 | CB | SER | A | 133 | −35.195 | 130.741 | −21.878 | 1.00 | 93.56 | GZ00 | C |
| ATOM | 4328 | OG | SER | A | 133 | −34.721 | 129.411 | −21.727 | 1.00 | 92.59 | GZ00 | O |
| ATOM | 4329 | N | SER | A | 134 | −36.724 | 131.923 | −24.279 | 1.00 | 101.62 | GZ00 | N |
| ATOM | 4330 | CA | SER | A | 134 | −37.027 | 132.073 | −25.696 | 1.00 | 101.63 | GZ00 | C |
| ATOM | 4331 | C | SER | A | 134 | −35.957 | 131.408 | −26.549 | 1.00 | 98.00 | GZ00 | C |
| ATOM | 4332 | O | SER | A | 134 | −36.000 | 130.197 | −26.770 | 1.00 | 105.90 | GZ00 | O |
| ATOM | 4333 | CB | SER | A | 134 | −37.165 | 133.548 | −26.069 | 1.00 | 96.91 | GZ00 | C |
| ATOM | 4334 | OG | SER | A | 134 | −37.994 | 133.692 | −27.209 | 1.00 | 104.41 | GZ00 | O |
| ATOM | 4335 | N | GLY | A | 139 | −42.971 | 131.608 | −30.259 | 1.00 | 100.95 | GZ00 | N |
| ATOM | 4336 | CA | GLY | A | 139 | −44.001 | 130.908 | −31.008 | 1.00 | 110.26 | GZ00 | C |
| ATOM | 4337 | C | GLY | A | 139 | −43.531 | 129.600 | −31.626 | 1.00 | 116.15 | GZ00 | C |
| ATOM | 4338 | O | GLY | A | 139 | −42.529 | 129.576 | −32.345 | 1.00 | 129.42 | GZ00 | O |
| ATOM | 4339 | N | GLY | A | 140 | −44.252 | 128.512 | −31.352 | 1.00 | 102.94 | GZ00 | N |
| ATOM | 4340 | CA | GLY | A | 140 | −45.429 | 128.577 | −30.509 | 1.00 | 98.08 | GZ00 | C |
| ATOM | 4341 | C | GLY | A | 140 | −45.549 | 127.510 | −29.435 | 1.00 | 93.20 | GZ00 | C |
| ATOM | 4342 | O | GLY | A | 140 | −46.648 | 127.229 | −28.960 | 1.00 | 88.91 | GZ00 | O |
| ATOM | 4343 | N | THR | A | 141 | −44.427 | 126.906 | −29.049 | 1.00 | 94.52 | GZ00 | N |
| ATOM | 4344 | CA | THR | A | 141 | −44.434 | 125.891 | −28.005 | 1.00 | 84.86 | GZ00 | C |
| ATOM | 4345 | C | THR | A | 141 | −43.275 | 126.163 | −27.053 | 1.00 | 82.99 | GZ00 | C |
| ATOM | 4346 | O | THR | A | 141 | −42.191 | 126.566 | −27.485 | 1.00 | 81.83 | GZ00 | O |
| ATOM | 4347 | CB | THR | A | 141 | −44.353 | 124.474 | −28.595 | 1.00 | 90.26 | GZ00 | C |
| ATOM | 4348 | OG1 | THR | A | 141 | −44.628 | 123.513 | −27.566 | 1.00 | 85.35 | GZ00 | O |
| ATOM | 4349 | CG2 | THR | A | 141 | −42.971 | 124.203 | −29.232 | 1.00 | 79.54 | GZ00 | C |
| ATOM | 4350 | N | ALA | A | 142 | −43.506 | 125.953 | −25.756 | 1.00 | 80.86 | GZ00 | N |
| ATOM | 4351 | CA | ALA | A | 142 | −42.487 | 126.212 | −24.745 | 1.00 | 77.11 | GZ00 | C |
| ATOM | 4352 | C | ALA | A | 142 | −42.460 | 125.082 | −23.731 | 1.00 | 70.08 | GZ00 | C |
| ATOM | 4353 | O | ALA | A | 142 | −43.508 | 124.527 | −23.382 | 1.00 | 69.86 | GZ00 | O |
| ATOM | 4354 | CB | ALA | A | 142 | −42.731 | 127.539 | −24.014 | 1.00 | 76.03 | GZ00 | C |
| ATOM | 4355 | N | ALA | A | 143 | −41.262 | 124.748 | −23.262 | 1.00 | 59.75 | GZ00 | N |
| ATOM | 4356 | CA | ALA | A | 143 | −41.079 | 123.717 | −22.248 | 1.00 | 63.56 | GZ00 | C |
| ATOM | 4357 | C | ALA | A | 143 | −40.608 | 124.351 | −20.947 | 1.00 | 58.18 | GZ00 | C |
| ATOM | 4358 | O | ALA | A | 143 | −39.664 | 125.152 | −20.948 | 1.00 | 54.35 | GZ00 | O |
| ATOM | 4359 | CB | ALA | A | 143 | −40.072 | 122.666 | −22.710 | 1.00 | 62.26 | GZ00 | C |
| ATOM | 4360 | N | LEU | A | 144 | −41.241 | 123.961 | −19.840 | 1.00 | 51.02 | GZ00 | N |
| ATOM | 4361 | CA | LEU | A | 144 | −40.864 | 124.417 | −18.507 | 1.00 | 54.72 | GZ00 | C |
| ATOM | 4362 | C | LEU | A | 144 | −41.027 | 123.254 | −17.537 | 1.00 | 53.32 | GZ00 | C |
| ATOM | 4363 | O | LEU | A | 144 | −41.753 | 122.293 | −17.812 | 1.00 | 53.18 | GZ00 | O |
| ATOM | 4364 | CB | LEU | A | 144 | −41.709 | 125.621 | −18.047 | 1.00 | 46.73 | GZ00 | C |
| ATOM | 4365 | CG | LEU | A | 144 | −43.215 | 125.351 | −17.951 | 1.00 | 56.02 | GZ00 | C |
| ATOM | 4366 | CD1 | LEU | A | 144 | −43.665 | 125.025 | −16.521 | 1.00 | 52.68 | GZ00 | C |
| ATOM | 4367 | CD2 | LEU | A | 144 | −44.014 | 126.520 | −18.513 | 1.00 | 58.59 | GZ00 | C |
| ATOM | 4368 | N | GLY | A | 145 | −40.359 | 123.341 | −16.391 | 1.00 | 51.88 | GZ00 | N |
| ATOM | 4369 | CA | GLY | A | 145 | −40.399 | 122.209 | −15.497 | 1.00 | 48.27 | GZ00 | C |
| ATOM | 4370 | C | GLY | A | 145 | −39.960 | 122.514 | −14.085 | 1.00 | 51.16 | GZ00 | C |
| ATOM | 4371 | O | GLY | A | 145 | −39.791 | 123.673 | −13.698 | 1.00 | 53.82 | GZ00 | O |
| ATOM | 4372 | N | CYS | A | 146 | −39.798 | 121.434 | −13.315 | 1.00 | 44.69 | GZ00 | N |
| ATOM | 4373 | CA | CYS | A | 146 | −39.413 | 121.470 | −11.910 | 1.00 | 47.10 | GZ00 | C |
| ATOM | 4374 | C | CYS | A | 146 | −38.297 | 120.462 | −11.680 | 1.00 | 45.37 | GZ00 | C |
| ATOM | 4375 | O | CYS | A | 146 | −38.433 | 119.290 | −12.038 | 1.00 | 42.62 | GZ00 | O |
| ATOM | 4376 | CB | CYS | A | 146 | −40.597 | 121.139 | −10.990 | 1.00 | 47.73 | GZ00 | C |
| ATOM | 4377 | SG | CYS | A | 146 | −41.531 | 122.590 | −10.443 | 1.00 | 76.23 | GZ00 | S |
| ATOM | 4378 | N | LEU | A | 147 | −37.207 | 120.910 | −11.080 | 1.00 | 47.76 | GZ00 | N |
| ATOM | 4379 | CA | LEU | A | 147 | −36.102 | 120.037 | −10.725 | 1.00 | 40.76 | GZ00 | C |
| ATOM | 4380 | C | LEU | A | 147 | −36.281 | 119.619 | −9.279 | 1.00 | 43.78 | GZ00 | C |
| ATOM | 4381 | O | LEU | A | 147 | −36.273 | 120.470 | −8.388 | 1.00 | 44.48 | GZ00 | O |
| ATOM | 4382 | CB | LEU | A | 147 | −34.767 | 120.742 | −10.938 | 1.00 | 37.72 | GZ00 | C |
| ATOM | 4383 | CG | LEU | A | 147 | −33.513 | 120.047 | −10.400 | 1.00 | 47.51 | GZ00 | C |
| ATOM | 4384 | CD1 | LEU | A | 147 | −33.360 | 118.653 | −10.996 | 1.00 | 40.15 | GZ00 | C |
| ATOM | 4385 | CD2 | LEU | A | 147 | −32.260 | 120.918 | −10.669 | 1.00 | 37.25 | GZ00 | C |
| ATOM | 4386 | N | VAL | A | 148 | −36.396 | 118.311 | −9.046 | 1.00 | 48.64 | GZ00 | N |
| ATOM | 4387 | CA | VAL | A | 148 | −36.699 | 117.743 | −7.733 | 1.00 | 46.35 | GZ00 | C |
| ATOM | 4388 | C | VAL | A | 148 | −35.441 | 117.031 | −7.252 | 1.00 | 49.34 | GZ00 | C |
| ATOM | 4389 | O | VAL | A | 148 | −35.200 | 115.861 | −7.576 | 1.00 | 50.72 | GZ00 | O |
| ATOM | 4390 | CB | VAL | A | 148 | −37.896 | 116.788 | −7.790 | 1.00 | 38.94 | GZ00 | C |
| ATOM | 4391 | CG1 | VAL | A | 148 | −38.234 | 116.266 | −6.410 | 1.00 | 40.39 | GZ00 | C |

TABLE 10.3-continued

| | | | | | | | | | | | | |
|---|---|---|---|---|---|---|---|---|---|---|---|---|
| ATOM | 4392 | CG2 | VAL | A | 148 | −39.087 | 117.487 | −8.380 | 1.00 | 40.04 | GZ00 | C |
| ATOM | 4393 | N | LYS | A | 149 | −34.660 | 117.721 | −6.440 | 1.00 | 45.78 | GZ00 | N |
| ATOM | 4394 | CA | LYS | A | 149 | −33.291 | 117.334 | −6.155 | 1.00 | 45.80 | GZ00 | C |
| ATOM | 4395 | C | LYS | A | 149 | −33.137 | 116.710 | −4.774 | 1.00 | 47.10 | GZ00 | C |
| ATOM | 4396 | O | LYS | A | 149 | −33.791 | 117.126 | −3.815 | 1.00 | 47.43 | GZ00 | O |
| ATOM | 4397 | CB | LYS | A | 149 | −32.379 | 118.554 | −6.266 | 1.00 | 47.24 | GZ00 | C |
| ATOM | 4398 | CG | LYS | A | 149 | −31.174 | 118.293 | −7.097 | 1.00 | 56.69 | GZ00 | C |
| ATOM | 4399 | CD | LYS | A | 149 | −29.975 | 119.004 | −6.564 | 1.00 | 59.82 | GZ00 | C |
| ATOM | 4400 | CE | LYS | A | 149 | −30.099 | 120.481 | −6.760 | 1.00 | 57.45 | GZ00 | C |
| ATOM | 4401 | NZ | LYS | A | 149 | −28.781 | 121.117 | −6.434 | 1.00 | 60.94 | GZ00 | N1+ |
| ATOM | 4402 | N | ASP | A | 150 | −32.254 | 115.710 | −4.694 | 1.00 | 49.92 | GZ00 | N |
| ATOM | 4403 | CA | ASP | A | 150 | −31.630 | 115.231 | −3.456 | 1.00 | 45.59 | GZ00 | C |
| ATOM | 4404 | C | ASP | A | 150 | −32.643 | 114.736 | −2.423 | 1.00 | 44.92 | GZ00 | C |
| ATOM | 4405 | O | ASP | A | 150 | −32.679 | 115.208 | −1.289 | 1.00 | 51.88 | GZ00 | O |
| ATOM | 4406 | CB | ASP | A | 150 | −30.741 | 116.314 | −2.838 | 1.00 | 42.77 | GZ00 | C |
| ATOM | 4407 | CG | ASP | A | 150 | −29.533 | 116.637 | −3.689 | 1.00 | 56.92 | GZ00 | C |
| ATOM | 4408 | OD1 | ASP | A | 150 | −29.136 | 115.782 | −4.512 | 1.00 | 57.01 | GZ00 | O |
| ATOM | 4409 | OD2 | ASP | A | 150 | −28.970 | 117.747 | −3.525 | 1.00 | 62.51 | GZ00 | O1− |
| ATOM | 4410 | N | TYR | A | 151 | −33.415 | 113.725 | −2.802 | 1.00 | 45.00 | GZ00 | N |
| ATOM | 4411 | CA | TYR | A | 151 | −34.367 | 113.102 | −1.894 | 1.00 | 49.20 | GZ00 | C |
| ATOM | 4412 | C | TYR | A | 151 | −34.088 | 111.606 | −1.765 | 1.00 | 57.02 | GZ00 | C |
| ATOM | 4413 | O | TYR | A | 151 | −33.356 | 111.009 | −2.563 | 1.00 | 54.16 | GZ00 | O |
| ATOM | 4414 | CB | TYR | A | 151 | −35.807 | 113.316 | −2.346 | 1.00 | 41.84 | GZ00 | C |
| ATOM | 4415 | CG | TYR | A | 151 | −36.146 | 112.630 | −3.642 | 1.00 | 53.39 | GZ00 | C |
| ATOM | 4416 | CD1 | TYR | A | 151 | −36.579 | 111.294 | −3.672 | 1.00 | 58.67 | GZ00 | C |
| ATOM | 4417 | CD2 | TYR | A | 151 | −36.045 | 113.316 | −4.845 | 1.00 | 47.72 | GZ00 | C |
| ATOM | 4418 | CE1 | TYR | A | 151 | −36.898 | 110.679 | −4.879 | 1.00 | 55.52 | GZ00 | C |
| ATOM | 4419 | CE2 | TYR | A | 151 | −36.365 | 112.718 | −6.041 | 1.00 | 47.90 | GZ00 | C |
| ATOM | 4420 | CZ | TYR | A | 151 | −36.782 | 111.403 | −6.063 | 1.00 | 54.44 | GZ00 | C |
| ATOM | 4421 | OH | TYR | A | 151 | −37.077 | 110.834 | −7.286 | 1.00 | 56.96 | GZ00 | O |
| ATOM | 4422 | N | PHE | A | 152 | −34.688 | 111.011 | −0.737 | 1.00 | 52.17 | GZ00 | N |
| ATOM | 4423 | CA | PHE | A | 152 | −34.494 | 109.613 | −0.424 | 1.00 | 56.95 | GZ00 | C |
| ATOM | 4424 | C | PHE | A | 152 | −35.543 | 109.170 | 0.575 | 1.00 | 59.21 | GZ00 | C |
| ATOM | 4425 | O | PHE | A | 152 | −35.877 | 109.929 | 1.472 | 1.00 | 56.82 | GZ00 | O |
| ATOM | 4426 | CB | PHE | A | 152 | −33.097 | 109.382 | 0.144 | 1.00 | 56.68 | GZ00 | C |
| ATOM | 4427 | CG | PHE | A | 152 | −32.764 | 107.946 | 0.349 | 1.00 | 56.75 | GZ00 | C |
| ATOM | 4428 | CD1 | PHE | A | 152 | −33.106 | 107.301 | 1.528 | 1.00 | 57.37 | GZ00 | C |
| ATOM | 4429 | CD2 | PHE | A | 152 | −32.097 | 107.233 | −0.640 | 1.00 | 61.45 | GZ00 | C |
| ATOM | 4430 | CE1 | PHE | A | 152 | −32.796 | 105.963 | 1.718 | 1.00 | 62.30 | GZ00 | C |
| ATOM | 4431 | CE2 | PHE | A | 152 | −31.784 | 105.899 | −0.457 | 1.00 | 54.88 | GZ00 | C |
| ATOM | 4432 | CZ | PHE | A | 152 | −32.136 | 105.258 | 0.722 | 1.00 | 52.68 | GZ00 | C |
| ATOM | 4433 | N | PRO | A | 153 | −36.081 | 107.947 | 0.414 | 1.00 | 64.15 | GZ00 | N |
| ATOM | 4434 | CA | PRO | A | 153 | −35.890 | 107.052 | −0.728 | 1.00 | 60.57 | GZ00 | C |
| ATOM | 4435 | C | PRO | A | 153 | −36.949 | 107.343 | −1.784 | 1.00 | 57.01 | GZ00 | C |
| ATOM | 4436 | O | PRO | A | 153 | −37.736 | 108.261 | −1.579 | 1.00 | 57.18 | GZ00 | O |
| ATOM | 4437 | CB | PRO | A | 153 | −36.104 | 105.684 | −0.109 | 1.00 | 56.69 | GZ00 | C |
| ATOM | 4438 | CG | PRO | A | 153 | −37.250 | 105.962 | 0.843 | 1.00 | 50.72 | GZ00 | C |
| ATOM | 4439 | CD | PRO | A | 153 | −36.942 | 107.317 | 1.434 | 1.00 | 59.37 | GZ00 | C |
| ATOM | 4440 | N | GLU | A | 154 | −37.022 | 106.550 | −2.848 | 1.00 | 55.69 | GZ00 | N |
| ATOM | 4441 | CA | GLU | A | 154 | −38.086 | 106.727 | −3.833 | 1.00 | 52.35 | GZ00 | C |
| ATOM | 4442 | C | GLU | A | 154 | −39.389 | 106.318 | −3.182 | 1.00 | 47.39 | GZ00 | C |
| ATOM | 4443 | O | GLU | A | 154 | −39.364 | 105.619 | −2.171 | 1.00 | 52.96 | GZ00 | O |
| ATOM | 4444 | CB | GLU | A | 154 | −37.805 | 105.905 | −5.093 | 1.00 | 53.56 | GZ00 | C |
| ATOM | 4445 | CG | GLU | A | 154 | −36.530 | 106.322 | −5.818 | 1.00 | 58.65 | GZ00 | C |
| ATOM | 4446 | CD | GLU | A | 154 | −36.727 | 106.415 | −7.315 | 1.00 | 67.26 | GZ00 | C |
| ATOM | 4447 | OE1 | GLU | A | 154 | −36.043 | 105.662 | −8.041 | 1.00 | 74.85 | GZ00 | O |
| ATOM | 4448 | OE2 | GLU | A | 154 | −37.572 | 107.227 | −7.765 | 1.00 | 66.72 | GZ00 | O1− |
| ATOM | 4449 | N | PRO | A | 155 | −40.533 | 106.779 | −3.713 | 1.00 | 45.32 | GZ00 | N |
| ATOM | 4450 | CA | PRO | A | 155 | −40.792 | 107.703 | −4.827 | 1.00 | 55.68 | GZ00 | C |
| ATOM | 4451 | C | PRO | A | 155 | −41.144 | 109.144 | −4.437 | 1.00 | 57.15 | GZ00 | C |
| ATOM | 4452 | O | PRO | A | 155 | −41.413 | 109.427 | −3.272 | 1.00 | 61.59 | GZ00 | O |
| ATOM | 4453 | CB | PRO | A | 155 | −42.020 | 107.086 | −5.474 | 1.00 | 54.31 | GZ00 | C |
| ATOM | 4454 | CG | PRO | A | 155 | −42.813 | 106.627 | −4.281 | 1.00 | 36.78 | GZ00 | C |
| ATOM | 4455 | CD | PRO | A | 155 | −41.792 | 106.177 | −3.235 | 1.00 | 36.78 | GZ00 | C |
| ATOM | 4456 | N | VAL | A | 156 | −41.135 | 110.047 | −5.417 | 1.00 | 56.20 | GZ00 | N |
| ATOM | 4457 | CA | VAL | A | 156 | −41.884 | 111.294 | −5.339 | 1.00 | 56.13 | GZ00 | C |
| ATOM | 4458 | C | VAL | A | 156 | −42.962 | 111.242 | −6.407 | 1.00 | 55.59 | GZ00 | C |
| ATOM | 4459 | O | VAL | A | 156 | −42.818 | 110.570 | −7.432 | 1.00 | 66.78 | GZ00 | O |
| ATOM | 4460 | CB | VAL | A | 156 | −41.023 | 112.567 | −5.514 | 1.00 | 57.46 | GZ00 | C |
| ATOM | 4461 | CG1 | VAL | A | 156 | −40.008 | 112.698 | −4.399 | 1.00 | 56.24 | GZ00 | C |
| ATOM | 4462 | CG2 | VAL | A | 156 | −40.327 | 112.555 | −6.838 | 1.00 | 58.46 | GZ00 | C |
| ATOM | 4463 | N | THR | A | 157 | −44.052 | 111.949 | −6.156 | 1.00 | 55.63 | GZ00 | N |
| ATOM | 4464 | CA | THR | A | 157 | −45.091 | 112.189 | −7.145 | 1.00 | 48.48 | GZ00 | C |
| ATOM | 4465 | C | THR | A | 157 | −45.079 | 113.673 | −7.480 | 1.00 | 56.97 | GZ00 | C |
| ATOM | 4466 | O | THR | A | 157 | −44.819 | 114.506 | −6.606 | 1.00 | 54.54 | GZ00 | O |
| ATOM | 4467 | CB | THR | A | 157 | −46.464 | 111.777 | −6.608 | 1.00 | 58.63 | GZ00 | C |
| ATOM | 4468 | OG1 | THR | A | 157 | −46.837 | 112.659 | −5.542 | 1.00 | 69.16 | GZ00 | O |
| ATOM | 4469 | CG2 | THR | A | 157 | −46.413 | 110.369 | −6.046 | 1.00 | 52.02 | GZ00 | C |
| ATOM | 4470 | N | VAL | A | 158 | −45.317 | 114.003 | −8.747 | 1.00 | 52.48 | GZ00 | N |
| ATOM | 4471 | CA | VAL | A | 158 | −45.344 | 115.385 | −9.209 | 1.00 | 49.55 | GZ00 | C |

TABLE 10.3-continued

| ATOM | 4472 | C   | VAL | A | 158 | −46.619 | 115.606 | −10.001 | 1.00 | 53.68 | GZ00 | C |
| ATOM | 4473 | O   | VAL | A | 158 | −46.942 | 114.809 | −10.885 | 1.00 | 58.24 | GZ00 | O |
| ATOM | 4474 | CB  | VAL | A | 158 | −44.131 | 115.743 | −10.087 | 1.00 | 53.34 | GZ00 | C |
| ATOM | 4475 | CG1 | VAL | A | 158 | −44.181 | 117.245 | −10.447 | 1.00 | 47.23 | GZ00 | C |
| ATOM | 4476 | CG2 | VAL | A | 158 | −42.819 | 115.357 | −9.407  | 1.00 | 50.02 | GZ00 | C |
| ATOM | 4477 | N   | SER | A | 159 | −47.337 | 116.684 | −9.693  | 1.00 | 53.96 | GZ00 | N |
| ATOM | 4478 | CA  | SER | A | 159 | −48.485 | 117.098 | −10.485 | 1.00 | 54.02 | GZ00 | C |
| ATOM | 4479 | C   | SER | A | 159 | −48.334 | 118.563 | −10.856 | 1.00 | 57.99 | GZ00 | C |
| ATOM | 4480 | O   | SER | A | 159 | −47.487 | 119.282 | −10.319 | 1.00 | 58.35 | GZ00 | O |
| ATOM | 4481 | CB  | SER | A | 159 | −49.802 | 116.870 | −9.741  | 1.00 | 57.03 | GZ00 | C |
| ATOM | 4482 | OG  | SER | A | 159 | −49.841 | 117.623 | −8.548  | 1.00 | 64.29 | GZ00 | O |
| ATOM | 4483 | N   | TRP | A | 160 | −49.143 | 119.008 | −11.804 | 1.00 | 52.93 | GZ00 | N |
| ATOM | 4484 | CA  | TRP | A | 160 | −49.127 | 120.403 | −12.198 | 1.00 | 53.69 | GZ00 | C |
| ATOM | 4485 | C   | TRP | A | 160 | −50.507 | 120.996 | −11.965 | 1.00 | 60.22 | GZ00 | C |
| ATOM | 4486 | O   | TRP | A | 160 | −51.524 | 120.353 | −12.254 | 1.00 | 56.05 | GZ00 | O |
| ATOM | 4487 | CB  | TRP | A | 160 | −48.667 | 120.551 | −13.654 | 1.00 | 52.01 | GZ00 | C |
| ATOM | 4488 | CG  | TRP | A | 160 | −47.199 | 120.239 | −13.791 | 1.00 | 61.18 | GZ00 | C |
| ATOM | 4489 | CD1 | TRP | A | 160 | −46.630 | 119.002 | −13.982 | 1.00 | 51.63 | GZ00 | C |
| ATOM | 4490 | CD2 | TRP | A | 160 | −46.108 | 121.169 | −13.703 | 1.00 | 51.85 | GZ00 | C |
| ATOM | 4491 | NE1 | TRP | A | 160 | −45.260 | 119.116 | −14.035 | 1.00 | 51.65 | GZ00 | N |
| ATOM | 4492 | CE2 | TRP | A | 160 | −44.914 | 120.433 | −13.871 | 1.00 | 55.17 | GZ00 | C |
| ATOM | 4493 | CE3 | TRP | A | 160 | −46.025 | 122.550 | −13.513 | 1.00 | 49.96 | GZ00 | C |
| ATOM | 4494 | CZ2 | TRP | A | 160 | −43.654 | 121.035 | −13.847 | 1.00 | 52.75 | GZ00 | C |
| ATOM | 4495 | CZ3 | TRP | A | 160 | −44.772 | 123.148 | −13.502 | 1.00 | 55.98 | GZ00 | C |
| ATOM | 4496 | CH2 | TRP | A | 160 | −43.604 | 122.389 | −13.663 | 1.00 | 51.25 | GZ00 | C |
| ATOM | 4497 | N   | ASN | A | 161 | −50.521 | 122.215 | −11.417 | 1.00 | 59.30 | GZ00 | N |
| ATOM | 4498 | CA  | ASN | A | 161 | −51.738 | 122.946 | −11.048 | 1.00 | 53.77 | GZ00 | C |
| ATOM | 4499 | C   | ASN | A | 161 | −52.737 | 122.039 | −10.336 | 1.00 | 58.01 | GZ00 | C |
| ATOM | 4500 | O   | ASN | A | 161 | −53.929 | 122.014 | −10.642 | 1.00 | 64.68 | GZ00 | O |
| ATOM | 4501 | CB  | ASN | A | 161 | −52.353 | 123.615 | −12.267 | 1.00 | 42.97 | GZ00 | C |
| ATOM | 4502 | CG  | ASN | A | 161 | −51.430 | 124.645 | −12.851 | 1.00 | 59.88 | GZ00 | C |
| ATOM | 4503 | OD1 | ASN | A | 161 | −50.421 | 124.988 | −12.231 | 1.00 | 57.52 | GZ00 | O |
| ATOM | 4504 | ND2 | ASN | A | 161 | −51.743 | 125.141 | −14.043 | 1.00 | 62.17 | GZ00 | N |
| ATOM | 4505 | N   | SER | A | 162 | −52.218 | 121.280 | −9.367  | 1.00 | 60.34 | GZ00 | N |
| ATOM | 4506 | CA  | SER | A | 162 | −53.022 | 120.430 | −8.483  | 1.00 | 66.27 | GZ00 | C |
| ATOM | 4507 | C   | SER | A | 162 | −53.790 | 119.353 | −9.244  | 1.00 | 71.65 | GZ00 | C |
| ATOM | 4508 | O   | SER | A | 162 | −54.873 | 118.941 | −8.821  | 1.00 | 79.00 | GZ00 | O |
| ATOM | 4509 | CB  | SER | A | 162 | −53.984 | 121.273 | −7.641  | 1.00 | 67.29 | GZ00 | C |
| ATOM | 4510 | OG  | SER | A | 162 | −53.287 | 122.322 | −6.987  | 1.00 | 70.91 | GZ00 | O |
| ATOM | 4511 | N   | GLY | A | 163 | −53.224 | 118.858 | −10.349 | 1.00 | 70.85 | GZ00 | N |
| ATOM | 4512 | CA  | GLY | A | 163 | −53.876 | 117.868 | −11.181 | 1.00 | 59.17 | GZ00 | C |
| ATOM | 4513 | C   | GLY | A | 163 | −54.598 | 118.443 | −12.385 | 1.00 | 68.56 | GZ00 | C |
| ATOM | 4514 | O   | GLY | A | 163 | −55.017 | 117.675 | −13.255 | 1.00 | 76.49 | GZ00 | O |
| ATOM | 4515 | N   | ALA | A | 164 | −54.744 | 119.772 | −12.463 | 1.00 | 67.36 | GZ00 | N |
| ATOM | 4516 | CA  | ALA | A | 164 | −55.483 | 120.392 | −13.561 | 1.00 | 63.96 | GZ00 | C |
| ATOM | 4517 | C   | ALA | A | 164 | −54.755 | 120.239 | −14.885 | 1.00 | 68.34 | GZ00 | C |
| ATOM | 4518 | O   | ALA | A | 164 | −55.391 | 120.060 | −15.927 | 1.00 | 75.07 | GZ00 | O |
| ATOM | 4519 | CB  | ALA | A | 164 | −55.712 | 121.879 | −13.280 | 1.00 | 57.29 | GZ00 | C |
| ATOM | 4520 | N   | LEU | A | 165 | −53.431 | 120.361 | −14.874 | 1.00 | 70.33 | GZ00 | N |
| ATOM | 4521 | CA  | LEU | A | 165 | −52.620 | 120.265 | −16.082 | 1.00 | 64.91 | GZ00 | C |
| ATOM | 4522 | C   | LEU | A | 165 | −52.055 | 118.846 | −16.163 | 1.00 | 69.76 | GZ00 | C |
| ATOM | 4523 | O   | LEU | A | 165 | −51.263 | 118.438 | −15.303 | 1.00 | 66.93 | GZ00 | O |
| ATOM | 4524 | CB  | LEU | A | 165 | −51.521 | 121.324 | −16.062 | 1.00 | 64.77 | GZ00 | C |
| ATOM | 4525 | CG  | LEU | A | 165 | −50.556 | 121.397 | −17.245 | 1.00 | 68.60 | GZ00 | C |
| ATOM | 4526 | CD1 | LEU | A | 165 | −51.313 | 121.483 | −18.560 | 1.00 | 68.89 | GZ00 | C |
| ATOM | 4527 | CD2 | LEU | A | 165 | −49.654 | 122.612 | −17.083 | 1.00 | 68.22 | GZ00 | C |
| ATOM | 4528 | N   | THR | A | 166 | −52.506 | 118.076 | −17.164 | 1.00 | 75.54 | GZ00 | N |
| ATOM | 4529 | CA  | THR | A | 166 | −52.042 | 116.700 | −17.363 | 1.00 | 72.10 | GZ00 | C |
| ATOM | 4530 | C   | THR | A | 166 | −51.554 | 116.504 | −18.792 | 1.00 | 68.22 | GZ00 | C |
| ATOM | 4531 | O   | THR | A | 166 | −50.624 | 115.732 | −19.042 | 1.00 | 71.78 | GZ00 | O |
| ATOM | 4532 | CB  | THR | A | 166 | −53.133 | 115.662 | −17.055 | 1.00 | 67.33 | GZ00 | C |
| ATOM | 4533 | OG1 | THR | A | 166 | −54.242 | 115.850 | −17.938 | 1.00 | 72.47 | GZ00 | O |
| ATOM | 4534 | CG2 | THR | A | 166 | −53.609 | 115.751 | −15.608 | 1.00 | 70.69 | GZ00 | C |
| ATOM | 4535 | N   | SER | A | 167 | −52.193 | 117.175 | −19.742 | 1.00 | 70.73 | GZ00 | N |
| ATOM | 4536 | CA  | SER | A | 167 | −51.742 | 117.096 | −21.121 | 1.00 | 77.77 | GZ00 | C |
| ATOM | 4537 | C   | SER | A | 167 | −50.357 | 117.710 | −21.242 | 1.00 | 66.92 | GZ00 | C |
| ATOM | 4538 | O   | SER | A | 167 | −50.104 | 118.796 | −20.717 | 1.00 | 69.96 | GZ00 | O |
| ATOM | 4539 | CB  | SER | A | 167 | −52.734 | 117.819 | −22.039 | 1.00 | 74.39 | GZ00 | C |
| ATOM | 4540 | OG  | SER | A | 167 | −52.114 | 118.270 | −23.233 | 1.00 | 68.17 | GZ00 | O |
| ATOM | 4541 | N   | GLY | A | 168 | −49.455 | 117.012 | −21.932 | 1.00 | 64.19 | GZ00 | N |
| ATOM | 4542 | CA  | GLY | A | 168 | −48.125 | 117.554 | −22.141 | 1.00 | 62.50 | GZ00 | C |
| ATOM | 4543 | C   | GLY | A | 168 | −47.169 | 117.414 | −20.977 | 1.00 | 58.51 | GZ00 | C |
| ATOM | 4544 | O   | GLY | A | 168 | −46.115 | 118.053 | −20.994 | 1.00 | 54.75 | GZ00 | O |
| ATOM | 4545 | N   | VAL | A | 169 | −47.512 | 116.619 | −19.963 | 1.00 | 59.87 | GZ00 | N |
| ATOM | 4546 | CA  | VAL | A | 169 | −46.709 | 116.442 | −18.757 | 1.00 | 53.22 | GZ00 | C |
| ATOM | 4547 | C   | VAL | A | 169 | −45.837 | 115.206 | −18.906 | 1.00 | 57.24 | GZ00 | C |
| ATOM | 4548 | O   | VAL | A | 169 | −46.341 | 114.121 | −19.219 | 1.00 | 54.95 | GZ00 | O |
| ATOM | 4549 | CB  | VAL | A | 169 | −47.605 | 116.322 | −17.514 | 1.00 | 52.90 | GZ00 | C |
| ATOM | 4550 | CG1 | VAL | A | 169 | −46.789 | 115.872 | −16.311 | 1.00 | 50.21 | GZ00 | C |
| ATOM | 4551 | CG2 | VAL | A | 169 | −48.279 | 117.657 | −17.237 | 1.00 | 56.97 | GZ00 | C |

TABLE 10.3-continued

| | | | | | | | | | | | |
|---|---|---|---|---|---|---|---|---|---|---|---|
| ATOM | 4552 | N | HIS | A | 170 | −44.533 | 115.362 | −18.656 | 1.00 | 49.30 | GZ00 N |
| ATOM | 4553 | CA | HIS | A | 170 | −43.571 | 114.263 | −18.742 | 1.00 | 46.23 | GZ00 C |
| ATOM | 4554 | C | HIS | A | 170 | −42.653 | 114.312 | −17.519 | 1.00 | 45.18 | GZ00 C |
| ATOM | 4555 | O | HIS | A | 170 | −41.702 | 115.095 | −17.482 | 1.00 | 48.42 | GZ00 O |
| ATOM | 4556 | CB | HIS | A | 170 | −42.786 | 114.360 | −20.050 | 1.00 | 46.88 | GZ00 C |
| ATOM | 4557 | CG | HIS | A | 170 | −41.995 | 113.136 | −20.400 | 1.00 | 50.83 | GZ00 C |
| ATOM | 4558 | ND1 | HIS | A | 170 | −41.756 | 112.109 | −19.507 | 1.00 | 51.60 | GZ00 N |
| ATOM | 4559 | CD2 | HIS | A | 170 | −41.374 | 112.784 | −21.551 | 1.00 | 45.43 | GZ00 C |
| ATOM | 4560 | CE1 | HIS | A | 170 | −41.020 | 111.180 | −20.092 | 1.00 | 44.58 | GZ00 C |
| ATOM | 4561 | NE2 | HIS | A | 170 | −40.776 | 111.565 | −21.332 | 1.00 | 49.60 | GZ00 N |
| ATOM | 4562 | N | THR | A | 171 | −42.927 | 113.466 | −16.529 | 1.00 | 43.26 | GZ00 N |
| ATOM | 4563 | CA | THR | A | 171 | −42.052 | 113.277 | −15.380 | 1.00 | 42.92 | GZ00 C |
| ATOM | 4564 | C | THR | A | 171 | −41.082 | 112.128 | −15.662 | 1.00 | 43.51 | GZ00 C |
| ATOM | 4565 | O | THR | A | 171 | −41.505 | 111.018 | −15.974 | 1.00 | 42.46 | GZ00 O |
| ATOM | 4566 | CB | THR | A | 171 | −42.883 | 113.022 | −14.124 | 1.00 | 37.89 | GZ00 C |
| ATOM | 4567 | OG1 | THR | A | 171 | −43.681 | 114.176 | −13.878 | 1.00 | 47.19 | GZ00 O |
| ATOM | 4568 | CG2 | THR | A | 171 | −42.006 | 112.776 | −12.906 | 1.00 | 32.66 | GZ00 C |
| ATOM | 4569 | N | PHE | A | 172 | −39.793 | 112.421 | −15.634 | 1.00 | 46.02 | GZ00 N |
| ATOM | 4570 | CA | PHE | A | 172 | −38.722 | 111.494 | −15.965 | 1.00 | 45.07 | GZ00 C |
| ATOM | 4571 | C | PHE | A | 172 | −38.336 | 110.651 | −14.754 | 1.00 | 49.93 | GZ00 C |
| ATOM | 4572 | O | PHE | A | 172 | −38.364 | 111.141 | −13.628 | 1.00 | 51.84 | GZ00 O |
| ATOM | 4573 | CB | PHE | A | 172 | −37.501 | 112.256 | −16.475 | 1.00 | 38.72 | GZ00 C |
| ATOM | 4574 | CG | PHE | A | 172 | −37.680 | 112.793 | −17.855 | 1.00 | 43.18 | GZ00 C |
| ATOM | 4575 | CD1 | PHE | A | 172 | −38.599 | 113.810 | −18.104 | 1.00 | 42.98 | GZ00 C |
| ATOM | 4576 | CD2 | PHE | A | 172 | −36.942 | 112.277 | −18.917 | 1.00 | 40.18 | GZ00 C |
| ATOM | 4577 | CE1 | PHE | A | 172 | −38.782 | 114.304 | −19.389 | 1.00 | 43.59 | GZ00 C |
| ATOM | 4578 | CE2 | PHE | A | 172 | −37.108 | 112.779 | −20.216 | 1.00 | 44.39 | GZ00 C |
| ATOM | 4579 | CZ | PHE | A | 172 | −38.030 | 113.797 | −20.449 | 1.00 | 45.10 | GZ00 C |
| ATOM | 4580 | N | PRO | A | 173 | −37.971 | 109.388 | −14.970 | 1.00 | 45.23 | GZ00 N |
| ATOM | 4581 | CA | PRO | A | 173 | −37.427 | 108.573 | −13.877 | 1.00 | 46.41 | GZ00 C |
| ATOM | 4582 | C | PRO | A | 173 | −36.181 | 109.215 | −13.275 | 1.00 | 46.24 | GZ00 C |
| ATOM | 4583 | O | PRO | A | 173 | −35.412 | 109.890 | −13.963 | 1.00 | 49.60 | GZ00 O |
| ATOM | 4584 | CB | PRO | A | 173 | −37.083 | 107.243 | −14.568 | 1.00 | 43.84 | GZ00 C |
| ATOM | 4585 | CG | PRO | A | 173 | −37.966 | 107.212 | −15.777 | 1.00 | 42.54 | GZ00 C |
| ATOM | 4586 | CD | PRO | A | 173 | −38.103 | 108.633 | −16.230 | 1.00 | 42.67 | GZ00 C |
| ATOM | 4587 | N | ALA | A | 174 | −35.971 | 108.971 | −11.983 | 1.00 | 43.82 | GZ00 N |
| ATOM | 4588 | CA | ALA | A | 174 | −34.906 | 109.615 | −11.225 | 1.00 | 43.70 | GZ00 C |
| ATOM | 4589 | C | ALA | A | 174 | −33.520 | 109.033 | −11.547 | 1.00 | 43.64 | GZ00 C |
| ATOM | 4590 | O | ALA | A | 174 | −33.392 | 107.905 | −12.020 | 1.00 | 48.77 | GZ00 O |
| ATOM | 4591 | CB | ALA | A | 174 | −35.195 | 109.486 | −9.733 | 1.00 | 46.19 | GZ00 C |
| ATOM | 4592 | N | VAL | A | 175 | −32.460 | 109.857 | −11.304 | 1.00 | 40.72 | GZ00 N |
| ATOM | 4593 | CA | VAL | A | 175 | −31.066 | 109.414 | −11.216 | 1.00 | 40.07 | GZ00 C |
| ATOM | 4594 | C | VAL | A | 175 | −30.766 | 109.037 | −9.779 | 1.00 | 49.10 | GZ00 C |
| ATOM | 4595 | O | VAL | A | 175 | −31.260 | 109.680 | −8.847 | 1.00 | 49.26 | GZ00 O |
| ATOM | 4596 | CB | VAL | A | 175 | −30.053 | 110.495 | −11.665 | 1.00 | 47.05 | GZ00 C |
| ATOM | 4597 | CG1 | VAL | A | 175 | −29.752 | 110.424 | −13.122 | 1.00 | 49.41 | GZ00 C |
| ATOM | 4598 | CG2 | VAL | A | 175 | −30.479 | 111.906 | −11.241 | 1.00 | 43.16 | GZ00 C |
| ATOM | 4599 | N | LEU | A | 176 | −29.930 | 108.011 | −9.593 | 1.00 | 45.95 | GZ00 N |
| ATOM | 4600 | CA | LEU | A | 176 | −29.317 | 107.724 | −8.305 | 1.00 | 45.89 | GZ00 C |
| ATOM | 4601 | C | LEU | A | 176 | −27.916 | 108.315 | −8.322 | 1.00 | 50.82 | GZ00 C |
| ATOM | 4602 | O | LEU | A | 176 | −27.048 | 107.853 | −9.066 | 1.00 | 64.34 | GZ00 O |
| ATOM | 4603 | CB | LEU | A | 176 | −29.278 | 106.231 | −8.012 | 1.00 | 50.15 | GZ00 C |
| ATOM | 4604 | CG | LEU | A | 176 | −28.524 | 105.913 | −6.714 | 1.00 | 55.35 | GZ00 C |
| ATOM | 4605 | CD1 | LEU | A | 176 | −29.054 | 106.726 | −5.525 | 1.00 | 46.25 | GZ00 C |
| ATOM | 4606 | CD2 | LEU | A | 176 | −28.546 | 104.409 | −6.408 | 1.00 | 46.32 | GZ00 C |
| ATOM | 4607 | N | GLN | A | 177 | −27.691 | 109.322 | −7.492 | 1.00 | 52.50 | GZ00 N |
| ATOM | 4608 | CA | GLN | A | 177 | −26.422 | 110.026 | −7.518 | 1.00 | 63.27 | GZ00 C |
| ATOM | 4609 | C | GLN | A | 177 | −25.368 | 109.285 | −6.697 | 1.00 | 56.88 | GZ00 C |
| ATOM | 4610 | O | GLN | A | 177 | −25.678 | 108.456 | −5.831 | 1.00 | 51.21 | GZ00 O |
| ATOM | 4611 | CB | GLN | A | 177 | −26.600 | 111.448 | −6.985 | 1.00 | 64.89 | GZ00 C |
| ATOM | 4612 | CG | GLN | A | 177 | −27.646 | 112.247 | −7.732 | 1.00 | 67.73 | GZ00 C |
| ATOM | 4613 | CD | GLN | A | 177 | −27.955 | 113.563 | −7.061 | 1.00 | 68.75 | GZ00 C |
| ATOM | 4614 | OE1 | GLN | A | 177 | −27.236 | 114.552 | −7.240 | 1.00 | 87.07 | GZ00 O |
| ATOM | 4615 | NE2 | GLN | A | 177 | −29.018 | 113.581 | −6.259 | 1.00 | 58.03 | GZ00 N |
| ATOM | 4616 | N | SER | A | 178 | −24.100 | 109.596 | −6.997 | 1.00 | 53.78 | GZ00 N |
| ATOM | 4617 | CA | SER | A | 178 | −22.982 | 109.070 | −6.216 | 1.00 | 54.16 | GZ00 C |
| ATOM | 4618 | C | SER | A | 178 | −23.113 | 109.421 | −4.744 | 1.00 | 58.69 | GZ00 C |
| ATOM | 4619 | O | SER | A | 178 | −22.550 | 108.730 | −3.889 | 1.00 | 66.24 | GZ00 O |
| ATOM | 4620 | CB | SER | A | 178 | −21.648 | 109.588 | −6.769 | 1.00 | 54.96 | GZ00 C |
| ATOM | 4621 | OG | SER | A | 178 | −21.589 | 111.004 | −6.780 | 1.00 | 68.48 | GZ00 O |
| ATOM | 4622 | N | SER | A | 179 | −23.821 | 110.508 | −4.432 | 1.00 | 59.99 | GZ00 N |
| ATOM | 4623 | CA | SER | A | 179 | −24.134 | 110.871 | −3.058 | 1.00 | 57.94 | GZ00 C |
| ATOM | 4624 | C | SER | A | 179 | −25.059 | 109.870 | −2.372 | 1.00 | 50.10 | GZ00 C |
| ATOM | 4625 | O | SER | A | 179 | −25.232 | 109.952 | −1.154 | 1.00 | 50.29 | GZ00 O |
| ATOM | 4626 | CB | SER | A | 179 | −24.787 | 112.254 | −3.030 | 1.00 | 52.99 | GZ00 C |
| ATOM | 4627 | OG | SER | A | 179 | −26.135 | 112.159 | −3.478 | 1.00 | 61.58 | GZ00 O |
| ATOM | 4628 | N | GLY | A | 180 | −25.671 | 108.949 | −3.113 | 1.00 | 43.93 | GZ00 N |
| ATOM | 4629 | CA | GLY | A | 180 | −26.698 | 108.079 | −2.571 | 1.00 | 44.88 | GZ00 C |
| ATOM | 4630 | C | GLY | A | 180 | −28.110 | 108.631 | −2.606 | 1.00 | 52.65 | GZ00 C |
| ATOM | 4631 | O | GLY | A | 180 | −29.037 | 107.923 | −2.196 | 1.00 | 57.69 | GZ00 O |

TABLE 10.3-continued

| | | | | | | | | | | | |
|---|---|---|---|---|---|---|---|---|---|---|---|
| ATOM | 4632 | N | LEU | A | 181 | −28.306 | 109.863 | −3.094 | 1.00 | 54.40 | GZ00 N |
| ATOM | 4633 | CA | LEU | A | 181 | −29.609 | 110.513 | −3.171 | 1.00 | 55.39 | GZ00 C |
| ATOM | 4634 | C | LEU | A | 181 | −30.141 | 110.518 | −4.600 | 1.00 | 52.55 | GZ00 C |
| ATOM | 4635 | O | LEU | A | 181 | −29.377 | 110.492 | −5.571 | 1.00 | 47.86 | GZ00 O |
| ATOM | 4636 | CB | LEU | A | 181 | −29.523 | 111.954 | −2.660 | 1.00 | 50.22 | GZ00 C |
| ATOM | 4637 | CG | LEU | A | 181 | −29.108 | 112.109 | −1.207 | 1.00 | 54.13 | GZ00 C |
| ATOM | 4638 | CD1 | LEU | A | 181 | −28.919 | 113.590 | −0.837 | 1.00 | 45.91 | GZ00 C |
| ATOM | 4639 | CD2 | LEU | A | 181 | −30.175 | 111.435 | −0.357 | 1.00 | 50.94 | GZ00 C |
| ATOM | 4640 | N | TYR | A | 182 | −31.469 | 110.607 | −4.712 | 1.00 | 45.18 | GZ00 N |
| ATOM | 4641 | CA | TYR | A | 182 | −32.159 | 110.643 | −5.991 | 1.00 | 44.17 | GZ00 C |
| ATOM | 4642 | C | TYR | A | 182 | −32.489 | 112.069 | −6.403 | 1.00 | 48.41 | GZ00 C |
| ATOM | 4643 | O | TYR | A | 182 | −32.683 | 112.946 | −5.562 | 1.00 | 50.13 | GZ00 O |
| ATOM | 4644 | CB | TYR | A | 182 | −33.454 | 109.832 | −5.939 | 1.00 | 51.31 | GZ00 C |
| ATOM | 4645 | CG | TYR | A | 182 | −33.222 | 108.357 | −5.719 | 1.00 | 51.52 | GZ00 C |
| ATOM | 4646 | CD1 | TYR | A | 182 | −32.971 | 107.499 | −6.796 | 1.00 | 53.09 | GZ00 C |
| ATOM | 4647 | CD2 | TYR | A | 182 | −33.255 | 107.817 | −4.441 | 1.00 | 49.04 | GZ00 C |
| ATOM | 4648 | CE1 | TYR | A | 182 | −32.746 | 106.144 | −6.595 | 1.00 | 57.42 | GZ00 C |
| ATOM | 4649 | CE2 | TYR | A | 182 | −33.037 | 106.464 | −4.231 | 1.00 | 58.73 | GZ00 C |
| ATOM | 4650 | CZ | TYR | A | 182 | −32.784 | 105.634 | −5.305 | 1.00 | 56.88 | GZ00 C |
| ATOM | 4651 | OH | TYR | A | 182 | −32.567 | 104.299 | −5.082 | 1.00 | 64.47 | GZ00 O |
| ATOM | 4652 | N | SER | A | 183 | −32.565 | 112.285 | −7.718 | 1.00 | 46.87 | GZ00 N |
| ATOM | 4653 | CA | SER | A | 183 | −33.102 | 113.509 | −8.298 | 1.00 | 44.44 | GZ00 C |
| ATOM | 4654 | C | SER | A | 183 | −33.911 | 113.162 | −9.541 | 1.00 | 46.59 | GZ00 C |
| ATOM | 4655 | O | SER | A | 183 | −33.582 | 112.222 | −10.262 | 1.00 | 44.22 | GZ00 O |
| ATOM | 4656 | CB | SER | A | 183 | −31.992 | 114.502 | −8.679 | 1.00 | 39.93 | GZ00 C |
| ATOM | 4657 | OG | SER | A | 183 | −31.284 | 114.978 | −7.545 | 1.00 | 50.25 | GZ00 O |
| ATOM | 4658 | N | LEU | A | 184 | −34.945 | 113.951 | −9.821 | 1.00 | 43.36 | GZ00 N |
| ATOM | 4659 | CA | LEU | A | 184 | −35.653 | 113.810 | −11.084 | 1.00 | 43.02 | GZ00 C |
| ATOM | 4660 | C | LEU | A | 184 | −36.113 | 115.182 | −11.552 | 1.00 | 47.62 | GZ00 C |
| ATOM | 4661 | O | LEU | A | 184 | −36.058 | 116.171 | −10.815 | 1.00 | 47.17 | GZ00 O |
| ATOM | 4662 | CB | LEU | A | 184 | −36.840 | 112.839 | −10.975 | 1.00 | 38.26 | GZ00 C |
| ATOM | 4663 | CG | LEU | A | 184 | −38.061 | 113.103 | −10.085 | 1.00 | 43.98 | GZ00 C |
| ATOM | 4664 | CD1 | LEU | A | 184 | −38.998 | 114.216 | −10.603 | 1.00 | 40.01 | GZ00 C |
| ATOM | 4665 | CD2 | LEU | A | 184 | −38.840 | 111.795 | −9.902 | 1.00 | 43.99 | GZ00 C |
| ATOM | 4666 | N | SER | A | 185 | −36.568 | 115.229 | −12.801 | 1.00 | 43.75 | GZ00 N |
| ATOM | 4667 | CA | SER | A | 185 | −37.198 | 116.411 | −13.358 | 1.00 | 38.83 | GZ00 C |
| ATOM | 4668 | C | SER | A | 185 | −38.565 | 116.044 | −13.909 | 1.00 | 43.09 | GZ00 C |
| ATOM | 4669 | O | SER | A | 185 | −38.803 | 114.901 | −14.312 | 1.00 | 45.04 | GZ00 O |
| ATOM | 4670 | CB | SER | A | 185 | −36.346 | 117.037 | −14.462 | 1.00 | 38.03 | GZ00 C |
| ATOM | 4671 | OG | SER | A | 185 | −35.075 | 117.365 | −13.952 | 1.00 | 38.25 | GZ00 O |
| ATOM | 4672 | N | SER | A | 186 | −39.468 | 117.023 | −13.889 | 1.00 | 39.49 | GZ00 N |
| ATOM | 4673 | CA | SER | A | 186 | −40.767 | 116.950 | −14.544 | 1.00 | 41.04 | GZ00 C |
| ATOM | 4674 | C | SER | A | 186 | −40.899 | 118.159 | −15.449 | 1.00 | 42.89 | GZ00 C |
| ATOM | 4675 | O | SER | A | 186 | −40.584 | 119.272 | −15.032 | 1.00 | 44.02 | GZ00 O |
| ATOM | 4676 | CB | SER | A | 186 | −41.917 | 116.931 | −13.536 | 1.00 | 44.24 | GZ00 C |
| ATOM | 4677 | OG | SER | A | 186 | −43.174 | 117.016 | −14.199 | 1.00 | 48.30 | GZ00 O |
| ATOM | 4678 | N | VAL | A | 187 | −41.298 | 117.945 | −16.698 | 1.00 | 47.04 | GZ00 N |
| ATOM | 4679 | CA | VAL | A | 187 | −41.489 | 119.062 | −17.613 | 1.00 | 45.11 | GZ00 C |
| ATOM | 4680 | C | VAL | A | 187 | −42.849 | 118.971 | −18.275 | 1.00 | 51.54 | GZ00 C |
| ATOM | 4681 | O | VAL | A | 187 | −43.401 | 117.887 | −18.494 | 1.00 | 53.22 | GZ00 O |
| ATOM | 4682 | CB | VAL | A | 187 | −40.385 | 119.152 | −18.666 | 1.00 | 43.95 | GZ00 C |
| ATOM | 4683 | CG1 | VAL | A | 187 | −39.102 | 119.540 | −17.976 | 1.00 | 54.28 | GZ00 C |
| ATOM | 4684 | CG2 | VAL | A | 187 | −40.236 | 117.828 | −19.352 | 1.00 | 52.33 | GZ00 C |
| ATOM | 4685 | N | VAL | A | 188 | −43.405 | 120.132 | −18.564 | 1.00 | 54.43 | GZ00 N |
| ATOM | 4686 | CA | VAL | A | 188 | −44.641 | 120.228 | −19.315 | 1.00 | 58.17 | GZ00 C |
| ATOM | 4687 | C | VAL | A | 188 | −44.385 | 121.161 | −20.480 | 1.00 | 59.55 | GZ00 C |
| ATOM | 4688 | O | VAL | A | 188 | −43.710 | 122.188 | −20.330 | 1.00 | 58.11 | GZ00 O |
| ATOM | 4689 | CB | VAL | A | 188 | −45.821 | 120.710 | −18.443 | 1.00 | 59.93 | GZ00 C |
| ATOM | 4690 | CG1 | VAL | A | 188 | −45.449 | 121.979 | −17.680 | 1.00 | 60.26 | GZ00 C |
| ATOM | 4691 | CG2 | VAL | A | 188 | −47.062 | 120.912 | −19.297 | 1.00 | 61.12 | GZ00 C |
| ATOM | 4692 | N | THR | A | 189 | −44.859 | 120.768 | −21.655 | 1.00 | 62.33 | GZ00 N |
| ATOM | 4693 | CA | THR | A | 189 | −44.814 | 121.638 | −22.815 | 1.00 | 66.67 | GZ00 C |
| ATOM | 4694 | C | THR | A | 189 | −46.153 | 122.362 | −22.930 | 1.00 | 69.89 | GZ00 C |
| ATOM | 4695 | O | THR | A | 189 | −47.220 | 121.739 | −22.815 | 1.00 | 62.33 | GZ00 O |
| ATOM | 4696 | CB | THR | A | 189 | −44.477 | 120.837 | −24.072 | 1.00 | 67.75 | GZ00 C |
| ATOM | 4697 | OG1 | THR | A | 189 | −44.384 | 119.450 | −23.731 | 1.00 | 69.60 | GZ00 O |
| ATOM | 4698 | CG2 | THR | A | 189 | −43.130 | 121.278 | −24.620 | 1.00 | 74.71 | GZ00 C |
| ATOM | 4699 | N | VAL | A | 190 | −46.084 | 123.681 | −23.102 | 1.00 | 66.60 | GZ00 N |
| ATOM | 4700 | CA | VAL | A | 190 | −47.263 | 124.547 | −23.133 | 1.00 | 66.10 | GZ00 C |
| ATOM | 4701 | C | VAL | A | 190 | −47.136 | 125.490 | −24.322 | 1.00 | 73.09 | GZ00 C |
| ATOM | 4702 | O | VAL | A | 190 | −46.045 | 125.641 | −24.901 | 1.00 | 71.87 | GZ00 O |
| ATOM | 4703 | CB | VAL | A | 190 | −47.425 | 125.349 | −21.818 | 1.00 | 64.66 | GZ00 C |
| ATOM | 4704 | CG1 | VAL | A | 190 | −47.569 | 124.428 | −20.610 | 1.00 | 58.32 | GZ00 C |
| ATOM | 4705 | CG2 | VAL | A | 190 | −46.261 | 126.316 | −21.640 | 1.00 | 59.75 | GZ00 C |
| ATOM | 4706 | N | PRO | A | 191 | −48.245 | 126.108 | −24.739 | 1.00 | 74.14 | GZ00 N |
| ATOM | 4707 | CA | PRO | A | 191 | −48.160 | 127.158 | −25.763 | 1.00 | 74.58 | GZ00 C |
| ATOM | 4708 | C | PRO | A | 191 | −47.354 | 128.344 | −25.261 | 1.00 | 76.75 | GZ00 C |
| ATOM | 4709 | O | PRO | A | 191 | −47.577 | 128.839 | −24.154 | 1.00 | 81.03 | GZ00 O |
| ATOM | 4710 | CB | PRO | A | 191 | −49.625 | 127.539 | −26.000 | 1.00 | 69.86 | GZ00 C |
| ATOM | 4711 | CG | PRO | A | 191 | −50.402 | 126.339 | −25.563 | 1.00 | 73.10 | GZ00 C |

TABLE 10.3-continued

| | | | | | | | | | | | |
|---|---|---|---|---|---|---|---|---|---|---|---|
| ATOM | 4712 | CD | PRO | A | 191 | −49.645 | 125.802 | −24.391 | 1.00 | 71.77 | GZ00 | C |
| ATOM | 4713 | N | SER | A | 192 | −46.422 | 128.813 | −26.093 | 1.00 | 74.74 | GZ00 | N |
| ATOM | 4714 | CA | SER | A | 192 | −45.569 | 129.925 | −25.684 | 1.00 | 84.32 | GZ00 | C |
| ATOM | 4715 | C | SER | A | 192 | −46.375 | 131.203 | −25.449 | 1.00 | 87.52 | GZ00 | C |
| ATOM | 4716 | O | SER | A | 192 | −46.000 | 132.033 | −24.611 | 1.00 | 90.45 | GZ00 | O |
| ATOM | 4717 | CB | SER | A | 192 | −44.469 | 130.145 | −26.720 | 1.00 | 82.62 | GZ00 | C |
| ATOM | 4718 | OG | SER | A | 192 | −45.022 | 130.471 | −27.977 | 1.00 | 97.04 | GZ00 | O |
| ATOM | 4719 | N | SER | A | 193 | −47.472 | 131.392 | −26.187 | 1.00 | 89.79 | GZ00 | N |
| ATOM | 4720 | CA | SER | A | 193 | −48.307 | 132.573 | −25.998 | 1.00 | 89.74 | GZ00 | C |
| ATOM | 4721 | C | SER | A | 193 | −48.972 | 132.612 | −24.626 | 1.00 | 93.59 | GZ00 | C |
| ATOM | 4722 | O | SER | A | 193 | −49.320 | 133.699 | −24.148 | 1.00 | 95.20 | GZ00 | O |
| ATOM | 4723 | CB | SER | A | 193 | −49.389 | 132.613 | −27.076 | 1.00 | 81.94 | GZ00 | C |
| ATOM | 4724 | OG | SER | A | 193 | −50.265 | 131.503 | −26.929 | 1.00 | 74.81 | GZ00 | O |
| ATOM | 4725 | N | SER | A | 194 | −49.138 | 131.462 | −23.975 | 1.00 | 87.57 | GZ00 | N |
| ATOM | 4726 | CA | SER | A | 194 | −49.771 | 131.416 | −22.662 | 1.00 | 89.09 | GZ00 | C |
| ATOM | 4727 | C | SER | A | 194 | −48.823 | 131.758 | −21.516 | 1.00 | 91.10 | GZ00 | C |
| ATOM | 4728 | O | SER | A | 194 | −49.278 | 131.840 | −20.368 | 1.00 | 89.32 | GZ00 | O |
| ATOM | 4729 | CB | SER | A | 194 | −50.372 | 130.030 | −22.418 | 1.00 | 81.55 | GZ00 | C |
| ATOM | 4730 | OG | SER | A | 194 | −49.347 | 129.061 | −22.241 | 1.00 | 88.02 | GZ00 | O |
| ATOM | 4731 | N | LEU | A | 195 | −47.528 | 131.951 | −21.791 | 1.00 | 87.53 | GZ00 | N |
| ATOM | 4732 | CA | LEU | A | 195 | −46.560 | 132.107 | −20.708 | 1.00 | 88.74 | GZ00 | C |
| ATOM | 4733 | C | LEU | A | 195 | −46.827 | 133.359 | −19.882 | 1.00 | 89.05 | GZ00 | C |
| ATOM | 4734 | O | LEU | A | 195 | −46.677 | 133.340 | −18.654 | 1.00 | 89.42 | GZ00 | O |
| ATOM | 4735 | CB | LEU | A | 195 | −45.137 | 132.120 | −21.267 | 1.00 | 85.76 | GZ00 | C |
| ATOM | 4736 | CG | LEU | A | 195 | −44.685 | 130.772 | −21.838 | 1.00 | 84.17 | GZ00 | C |
| ATOM | 4737 | CD1 | LEU | A | 195 | −43.245 | 130.846 | −22.337 | 1.00 | 78.51 | GZ00 | C |
| ATOM | 4738 | CD2 | LEU | A | 195 | −44.872 | 129.643 | −20.827 | 1.00 | 71.43 | GZ00 | C |
| ATOM | 4739 | N | GLY | A | 196 | −47.240 | 134.451 | −20.529 | 1.00 | 92.67 | GZ00 | N |
| ATOM | 4740 | CA | GLY | A | 196 | −47.552 | 135.661 | −19.789 | 1.00 | 83.87 | GZ00 | C |
| ATOM | 4741 | C | GLY | A | 196 | −48.867 | 135.611 | −19.045 | 1.00 | 82.81 | GZ00 | C |
| ATOM | 4742 | O | GLY | A | 196 | −49.054 | 136.368 | −18.090 | 1.00 | 84.91 | GZ00 | O |
| ATOM | 4743 | N | THR | A | 197 | −49.775 | 134.728 | −19.455 | 1.00 | 85.57 | GZ00 | N |
| ATOM | 4744 | CA | THR | A | 197 | −51.143 | 134.692 | −18.952 | 1.00 | 86.43 | GZ00 | C |
| ATOM | 4745 | C | THR | A | 197 | −51.368 | 133.631 | −17.888 | 1.00 | 86.30 | GZ00 | C |
| ATOM | 4746 | O | THR | A | 197 | −52.058 | 133.892 | −16.898 | 1.00 | 86.17 | GZ00 | O |
| ATOM | 4747 | CB | THR | A | 197 | −52.121 | 134.417 | −20.097 | 1.00 | 86.40 | GZ00 | C |
| ATOM | 4748 | OG1 | THR | A | 197 | −51.849 | 135.303 | −21.187 | 1.00 | 91.08 | GZ00 | O |
| ATOM | 4749 | CG2 | THR | A | 197 | −53.569 | 134.569 | −19.626 | 1.00 | 80.19 | GZ00 | C |
| ATOM | 4750 | N | GLN | A | 198 | −50.770 | 132.454 | −18.048 | 1.00 | 84.30 | GZ00 | N |
| ATOM | 4751 | CA | GLN | A | 198 | −51.154 | 131.288 | −17.272 | 1.00 | 78.44 | GZ00 | C |
| ATOM | 4752 | C | GLN | A | 198 | −50.118 | 131.004 | −16.194 | 1.00 | 79.40 | GZ00 | C |
| ATOM | 4753 | O | GLN | A | 198 | −48.910 | 131.155 | −16.412 | 1.00 | 78.37 | GZ00 | O |
| ATOM | 4754 | CB | GLN | A | 198 | −51.315 | 130.071 | −18.184 | 1.00 | 76.20 | GZ00 | C |
| ATOM | 4755 | CG | GLN | A | 198 | −51.543 | 128.762 | −17.443 | 1.00 | 79.56 | GZ00 | C |
| ATOM | 4756 | CD | GLN | A | 198 | −52.867 | 128.724 | −16.710 | 1.00 | 81.18 | GZ00 | C |
| ATOM | 4757 | OE1 | GLN | A | 198 | −53.881 | 129.172 | −17.236 | 1.00 | 93.21 | GZ00 | O |
| ATOM | 4758 | NE2 | GLN | A | 198 | −52.867 | 128.185 | −15.493 | 1.00 | 73.89 | GZ00 | N |
| ATOM | 4759 | N | THR | A | 199 | −50.606 | 130.551 | −15.043 | 1.00 | 73.01 | GZ00 | N |
| ATOM | 4760 | CA | THR | A | 199 | −49.774 | 130.248 | −13.891 | 1.00 | 76.95 | GZ00 | C |
| ATOM | 4761 | C | THR | A | 199 | −49.518 | 128.747 | −13.834 | 1.00 | 74.20 | GZ00 | C |
| ATOM | 4762 | O | THR | A | 199 | −50.462 | 127.944 | −13.805 | 1.00 | 70.39 | GZ00 | O |
| ATOM | 4763 | CB | THR | A | 199 | −50.445 | 130.746 | −12.610 | 1.00 | 71.33 | GZ00 | C |
| ATOM | 4764 | OG1 | THR | A | 199 | −50.421 | 132.179 | −12.601 | 1.00 | 73.00 | GZ00 | O |
| ATOM | 4765 | CG2 | THR | A | 199 | −49.728 | 130.224 | −11.382 | 1.00 | 65.14 | GZ00 | C |
| ATOM | 4766 | N | TYR | A | 200 | −48.242 | 128.376 | −13.805 | 1.00 | 68.08 | GZ00 | N |
| ATOM | 4767 | CA | TYR | A | 200 | −47.829 | 126.982 | −13.781 | 1.00 | 61.58 | GZ00 | C |
| ATOM | 4768 | C | TYR | A | 200 | −47.135 | 126.697 | −12.461 | 1.00 | 60.20 | GZ00 | C |
| ATOM | 4769 | O | TYR | A | 200 | −46.093 | 127.293 | −12.153 | 1.00 | 57.85 | GZ00 | O |
| ATOM | 4770 | CB | TYR | A | 200 | −46.911 | 126.674 | −14.955 | 1.00 | 57.54 | GZ00 | C |
| ATOM | 4771 | CG | TYR | A | 200 | −47.580 | 126.881 | −16.287 | 1.00 | 62.50 | GZ00 | C |
| ATOM | 4772 | CD1 | TYR | A | 200 | −48.564 | 126.013 | −16.731 | 1.00 | 61.12 | GZ00 | C |
| ATOM | 4773 | CD2 | TYR | A | 200 | −47.218 | 127.943 | −17.106 | 1.00 | 67.26 | GZ00 | C |
| ATOM | 4774 | CE1 | TYR | A | 200 | −49.178 | 126.194 | −17.951 | 1.00 | 65.39 | GZ00 | C |
| ATOM | 4775 | CE2 | TYR | A | 200 | −47.820 | 128.135 | −18.333 | 1.00 | 69.26 | GZ00 | C |
| ATOM | 4776 | CZ | TYR | A | 200 | −48.802 | 127.257 | −18.753 | 1.00 | 70.05 | GZ00 | C |
| ATOM | 4777 | OH | TYR | A | 200 | −49.409 | 127.447 | −19.979 | 1.00 | 69.68 | GZ00 | O |
| ATOM | 4778 | N | ILE | A | 201 | −47.710 | 125.775 | −11.699 | 1.00 | 54.42 | GZ00 | N |
| ATOM | 4779 | CA | ILE | A | 201 | −47.224 | 125.396 | −10.384 | 1.00 | 55.01 | GZ00 | C |
| ATOM | 4780 | C | ILE | A | 201 | −47.026 | 123.891 | −10.383 | 1.00 | 53.67 | GZ00 | C |
| ATOM | 4781 | O | ILE | A | 201 | −47.944 | 123.147 | −10.738 | 1.00 | 51.99 | GZ00 | O |
| ATOM | 4782 | CB | ILE | A | 201 | −48.220 | 125.791 | −9.275 | 1.00 | 53.52 | GZ00 | C |
| ATOM | 4783 | CG1 | ILE | A | 201 | −48.406 | 127.304 | −9.225 | 1.00 | 59.92 | GZ00 | C |
| ATOM | 4784 | CG2 | ILE | A | 201 | −47.757 | 125.257 | −7.920 | 1.00 | 51.50 | GZ00 | C |
| ATOM | 4785 | CD1 | ILE | A | 201 | −49.568 | 127.719 | −8.359 | 1.00 | 59.25 | GZ00 | C |
| ATOM | 4786 | N | CYS | A | 202 | −45.846 | 123.434 | −9.979 | 1.00 | 49.43 | GZ00 | N |
| ATOM | 4787 | CA | CYS | A | 202 | −45.655 | 122.005 | −9.794 | 1.00 | 52.57 | GZ00 | C |
| ATOM | 4788 | C | CYS | A | 202 | −45.814 | 121.642 | −8.324 | 1.00 | 50.37 | GZ00 | C |
| ATOM | 4789 | O | CYS | A | 202 | −45.364 | 122.364 | −7.433 | 1.00 | 52.12 | GZ00 | O |
| ATOM | 4790 | CB | CYS | A | 202 | −44.301 | 121.549 | −10.331 | 1.00 | 62.40 | GZ00 | C |
| ATOM | 4791 | SG | CYS | A | 202 | −42.952 | 121.799 | −9.238 | 1.00 | 64.20 | GZ00 | S |

TABLE 10.3-continued

| ATOM | 4792 | N | ASN | A | 203 | −46.465 | 120.516 | −8.082 | 1.00 | 47.36 | GZ00 | N |
|---|---|---|---|---|---|---|---|---|---|---|---|---|
| ATOM | 4793 | CA | ASN | A | 203 | −46.831 | 120.068 | −6.747 | 1.00 | 46.99 | GZ00 | C |
| ATOM | 4794 | C | ASN | A | 203 | −46.058 | 118.791 | −6.497 | 1.00 | 48.88 | GZ00 | C |
| ATOM | 4795 | O | ASN | A | 203 | −46.287 | 117.778 | −7.163 | 1.00 | 57.36 | GZ00 | O |
| ATOM | 4796 | CB | ASN | A | 203 | −48.342 | 119.850 | −6.635 | 1.00 | 48.02 | GZ00 | C |
| ATOM | 4797 | CG | ASN | A | 203 | −49.137 | 120.936 | −7.344 | 1.00 | 55.33 | GZ00 | C |
| ATOM | 4798 | OD1 | ASN | A | 203 | −49.750 | 120.696 | −8.385 | 1.00 | 60.59 | GZ00 | O |
| ATOM | 4799 | ND2 | ASN | A | 203 | −49.148 | 122.139 | −6.765 | 1.00 | 49.46 | GZ00 | N |
| ATOM | 4800 | N | VAL | A | 204 | −45.120 | 118.858 | −5.568 | 1.00 | 44.47 | GZ00 | N |
| ATOM | 4801 | CA | VAL | A | 204 | −44.215 | 117.764 | −5.274 | 1.00 | 47.87 | GZ00 | C |
| ATOM | 4802 | C | VAL | A | 204 | −44.619 | 117.151 | −3.949 | 1.00 | 46.74 | GZ00 | C |
| ATOM | 4803 | O | VAL | A | 204 | −44.770 | 117.864 | −2.952 | 1.00 | 50.77 | GZ00 | O |
| ATOM | 4804 | CB | VAL | A | 204 | −42.755 | 118.248 | −5.231 | 1.00 | 44.63 | GZ00 | C |
| ATOM | 4805 | CG1 | VAL | A | 204 | −41.843 | 117.090 | −4.887 | 1.00 | 38.03 | GZ00 | C |
| ATOM | 4806 | CG2 | VAL | A | 204 | −42.380 | 118.903 | −6.567 | 1.00 | 40.53 | GZ00 | C |
| ATOM | 4807 | N | ASN | A | 205 | −44.767 | 115.832 | −3.928 | 1.00 | 48.79 | GZ00 | N |
| ATOM | 4808 | CA | ASN | A | 205 | −45.133 | 115.123 | −2.714 | 1.00 | 47.93 | GZ00 | C |
| ATOM | 4809 | C | ASN | A | 205 | −44.153 | 113.974 | −2.534 | 1.00 | 49.20 | GZ00 | C |
| ATOM | 4810 | O | ASN | A | 205 | −43.964 | 113.166 | −3.445 | 1.00 | 60.40 | GZ00 | O |
| ATOM | 4811 | CB | ASN | A | 205 | −46.588 | 114.648 | −2.781 | 1.00 | 53.37 | GZ00 | C |
| ATOM | 4812 | CG | ASN | A | 205 | −47.095 | 114.117 | −1.449 | 1.00 | 66.37 | GZ00 | C |
| ATOM | 4813 | OD1 | ASN | A | 205 | −46.479 | 114.336 | −0.404 | 1.00 | 69.20 | GZ00 | O |
| ATOM | 4814 | ND2 | ASN | A | 205 | −48.254 | 113.468 | −1.473 | 1.00 | 77.20 | GZ00 | N |
| ATOM | 4815 | N | HIS | A | 206 | −43.476 | 113.954 | −1.396 | 1.00 | 45.52 | GZ00 | N |
| ATOM | 4816 | CA | HIS | A | 206 | −42.524 | 112.919 | −1.028 | 1.00 | 43.97 | GZ00 | C |
| ATOM | 4817 | C | HIS | A | 206 | −42.971 | 112.323 | 0.309 | 1.00 | 53.01 | GZ00 | C |
| ATOM | 4818 | O | HIS | A | 206 | −42.520 | 112.750 | 1.378 | 1.00 | 53.77 | GZ00 | O |
| ATOM | 4819 | CB | HIS | A | 206 | −41.137 | 113.478 | −0.951 | 1.00 | 40.28 | GZ00 | C |
| ATOM | 4820 | CG | HIS | A | 206 | −40.104 | 112.463 | −0.585 | 1.00 | 48.58 | GZ00 | C |
| ATOM | 4821 | ND1 | HIS | A | 206 | −39.422 | 112.498 | 0.611 | 1.00 | 53.96 | GZ00 | N |
| ATOM | 4822 | CD2 | HIS | A | 206 | −39.646 | 111.374 | −1.247 | 1.00 | 48.75 | GZ00 | C |
| ATOM | 4823 | CE1 | HIS | A | 206 | −38.579 | 111.482 | 0.667 | 1.00 | 51.43 | GZ00 | C |
| ATOM | 4824 | NE2 | HIS | A | 206 | −38.689 | 110.790 | −0.453 | 1.00 | 52.90 | GZ00 | N |
| ATOM | 4825 | N | LYS | A | 207 | −43.829 | 111.306 | 0.233 | 1.00 | 54.92 | GZ00 | N |
| ATOM | 4826 | CA | LYS | A | 207 | −44.424 | 110.729 | 1.434 | 1.00 | 48.15 | GZ00 | C |
| ATOM | 4827 | C | LYS | A | 207 | −43.418 | 110.140 | 2.423 | 1.00 | 52.26 | GZ00 | C |
| ATOM | 4828 | O | LYS | A | 207 | −43.648 | 110.282 | 3.635 | 1.00 | 59.42 | GZ00 | O |
| ATOM | 4829 | CB | LYS | A | 207 | −45.481 | 109.710 | 1.007 | 1.00 | 49.63 | GZ00 | C |
| ATOM | 4830 | CG | LYS | A | 207 | −46.665 | 110.413 | 0.313 | 1.00 | 60.89 | GZ00 | C |
| ATOM | 4831 | CD | LYS | A | 207 | −47.752 | 109.458 | −0.167 | 1.00 | 75.35 | GZ00 | C |
| ATOM | 4832 | CE | LYS | A | 207 | −48.892 | 110.226 | −0.848 | 1.00 | 81.98 | GZ00 | C |
| ATOM | 4833 | NZ | LYS | A | 207 | −49.961 | 109.352 | −1.445 | 1.00 | 90.80 | GZ00 | N1+ |
| ATOM | 4834 | N | PRO | A | 208 | −42.313 | 109.506 | 2.016 | 1.00 | 53.20 | GZ00 | N |
| ATOM | 4835 | CA | PRO | A | 208 | −41.376 | 108.969 | 3.026 | 1.00 | 54.32 | GZ00 | C |
| ATOM | 4836 | C | PRO | A | 208 | −40.864 | 109.993 | 4.034 | 1.00 | 57.05 | GZ00 | C |
| ATOM | 4837 | O | PRO | A | 208 | −40.579 | 109.623 | 5.178 | 1.00 | 57.60 | GZ00 | O |
| ATOM | 4838 | CB | PRO | A | 208 | −40.231 | 108.409 | 2.174 | 1.00 | 48.60 | GZ00 | C |
| ATOM | 4839 | CG | PRO | A | 208 | −40.871 | 108.022 | 0.913 | 1.00 | 50.40 | GZ00 | C |
| ATOM | 4840 | CD | PRO | A | 208 | −41.948 | 109.055 | 0.660 | 1.00 | 50.23 | GZ00 | C |
| ATOM | 4841 | N | SER | A | 209 | −40.691 | 111.254 | 3.636 | 1.00 | 61.65 | GZ00 | N |
| ATOM | 4842 | CA | SER | A | 209 | −40.273 | 112.325 | 4.535 | 1.00 | 62.97 | GZ00 | C |
| ATOM | 4843 | C | SER | A | 209 | −41.416 | 113.260 | 4.930 | 1.00 | 61.87 | GZ00 | C |
| ATOM | 4844 | O | SER | A | 209 | −41.174 | 114.251 | 5.630 | 1.00 | 60.78 | GZ00 | O |
| ATOM | 4845 | CB | SER | A | 209 | −39.165 | 113.147 | 3.879 | 1.00 | 59.23 | GZ00 | C |
| ATOM | 4846 | OG | SER | A | 209 | −39.685 | 113.856 | 2.755 | 1.00 | 55.04 | GZ00 | O |
| ATOM | 4847 | N | ASN | A | 210 | −42.646 | 112.940 | 4.539 | 1.00 | 55.47 | GZ00 | N |
| ATOM | 4848 | CA | ASN | A | 210 | −43.808 | 113.822 | 4.651 | 1.00 | 56.64 | GZ00 | C |
| ATOM | 4849 | C | ASN | A | 210 | −43.460 | 115.261 | 4.290 | 1.00 | 56.98 | GZ00 | C |
| ATOM | 4850 | O | ASN | A | 210 | −43.558 | 116.181 | 5.100 | 1.00 | 62.92 | GZ00 | O |
| ATOM | 4851 | CB | ASN | A | 210 | −44.398 | 113.761 | 6.053 | 1.00 | 60.66 | GZ00 | C |
| ATOM | 4852 | CG | ASN | A | 210 | −44.555 | 112.358 | 6.550 | 1.00 | 60.50 | GZ00 | C |
| ATOM | 4853 | OD1 | ASN | A | 210 | −45.556 | 111.702 | 6.273 | 1.00 | 64.24 | GZ00 | O |
| ATOM | 4854 | ND2 | ASN | A | 210 | −43.562 | 111.880 | 7.288 | 1.00 | 60.19 | GZ00 | N |
| ATOM | 4855 | N | THR | A | 211 | −43.011 | 115.442 | 3.057 | 1.00 | 54.32 | GZ00 | N |
| ATOM | 4856 | CA | THR | A | 211 | −42.767 | 116.765 | 2.504 | 1.00 | 47.32 | GZ00 | C |
| ATOM | 4857 | C | THR | A | 211 | −43.723 | 117.022 | 1.349 | 1.00 | 47.89 | GZ00 | C |
| ATOM | 4858 | O | THR | A | 211 | −43.910 | 116.159 | 0.489 | 1.00 | 54.45 | GZ00 | O |
| ATOM | 4859 | CB | THR | A | 211 | −41.317 | 116.913 | 2.046 | 1.00 | 49.88 | GZ00 | C |
| ATOM | 4860 | OG1 | THR | A | 211 | −40.444 | 116.645 | 3.148 | 1.00 | 51.07 | GZ00 | O |
| ATOM | 4861 | CG2 | THR | A | 211 | −41.061 | 118.318 | 1.560 | 1.00 | 42.66 | GZ00 | C |
| ATOM | 4862 | N | LYS | A | 212 | −44.338 | 118.194 | 1.339 | 1.00 | 50.89 | GZ00 | N |
| ATOM | 4863 | CA | LYS | A | 212 | −45.112 | 118.659 | 0.198 | 1.00 | 47.65 | GZ00 | C |
| ATOM | 4864 | C | LYS | A | 212 | −44.570 | 120.029 | −0.168 | 1.00 | 47.72 | GZ00 | C |
| ATOM | 4865 | O | LYS | A | 212 | −44.386 | 120.878 | 0.712 | 1.00 | 52.21 | GZ00 | O |
| ATOM | 4866 | CB | LYS | A | 212 | −46.611 | 118.715 | 0.514 | 1.00 | 52.77 | GZ00 | C |
| ATOM | 4867 | CG | LYS | A | 212 | −47.140 | 117.383 | 1.052 | 1.00 | 63.53 | GZ00 | C |
| ATOM | 4868 | CD | LYS | A | 212 | −48.662 | 117.295 | 1.167 | 1.00 | 63.25 | GZ00 | C |
| ATOM | 4869 | CE | LYS | A | 212 | −49.049 | 116.010 | 1.920 | 1.00 | 71.43 | GZ00 | C |
| ATOM | 4870 | NZ | LYS | A | 212 | −50.290 | 115.345 | 1.415 | 1.00 | 66.03 | GZ00 | N1+ |
| ATOM | 4871 | N | VAL | A | 213 | −44.223 | 120.212 | −1.437 | 1.00 | 41.63 | GZ00 | N |

TABLE 10.3-continued

| | | | | | | | | | | | |
|---|---|---|---|---|---|---|---|---|---|---|---|
| ATOM | 4872 | CA | VAL | A | 213 | −43.729 | 121.485 | −1.935 | 1.00 | 44.71 | GZ00 C |
| ATOM | 4873 | C | VAL | A | 213 | −44.585 | 121.894 | −3.121 | 1.00 | 48.49 | GZ00 C |
| ATOM | 4874 | O | VAL | A | 213 | −44.882 | 121.063 | −3.983 | 1.00 | 53.14 | GZ00 O |
| ATOM | 4875 | CB | VAL | A | 213 | −42.246 | 121.419 | −2.347 | 1.00 | 43.73 | GZ00 C |
| ATOM | 4876 | CG1 | VAL | A | 213 | −41.816 | 122.764 | −2.924 | 1.00 | 39.48 | GZ00 C |
| ATOM | 4877 | CG2 | VAL | A | 213 | −41.362 | 121.029 | −1.165 | 1.00 | 37.84 | GZ00 C |
| ATOM | 4878 | N | ASP | A | 214 | −45.015 | 123.156 | −3.139 | 1.00 | 47.97 | GZ00 N |
| ATOM | 4879 | CA | ASP | A | 214 | −45.585 | 123.795 | −4.317 | 1.00 | 44.59 | GZ00 C |
| ATOM | 4880 | C | ASP | A | 214 | −44.598 | 124.838 | −4.810 | 1.00 | 46.54 | GZ00 C |
| ATOM | 4881 | O | ASP | A | 214 | −44.025 | 125.579 | −4.009 | 1.00 | 54.01 | GZ00 O |
| ATOM | 4882 | CB | ASP | A | 214 | −46.929 | 124.477 | −4.017 | 1.00 | 51.53 | GZ00 C |
| ATOM | 4883 | CG | ASP | A | 214 | −47.982 | 123.512 | −3.513 | 1.00 | 63.26 | GZ00 C |
| ATOM | 4884 | OD2 | ASP | A | 214 | −48.796 | 123.914 | −2.654 | 1.00 | 87.44 | GZ00 O1− |
| ATOM | 4885 | OD1 | ASP | A | 214 | −48.012 | 122.352 | −3.969 | 1.00 | 69.85 | GZ00 O |
| ATOM | 4886 | N | LYS | A | 215 | −44.377 | 124.888 | −6.119 | 1.00 | 44.93 | GZ00 N |
| ATOM | 4887 | CA | LYS | A | 215 | −43.442 | 125.855 | −6.679 | 1.00 | 46.63 | GZ00 C |
| ATOM | 4888 | C | LYS | A | 215 | −43.978 | 126.399 | −7.988 | 1.00 | 52.58 | GZ00 C |
| ATOM | 4889 | O | LYS | A | 215 | −44.348 | 125.626 | −8.878 | 1.00 | 52.15 | GZ00 O |
| ATOM | 4890 | CB | LYS | A | 215 | −42.051 | 125.248 | −6.899 | 1.00 | 47.58 | GZ00 C |
| ATOM | 4891 | CG | LYS | A | 215 | −40.969 | 125.964 | −6.129 | 1.00 | 50.19 | GZ00 C |
| ATOM | 4892 | CD | LYS | A | 215 | −40.152 | 126.858 | −7.027 | 1.00 | 48.08 | GZ00 C |
| ATOM | 4893 | CE | LYS | A | 215 | −39.413 | 127.923 | −6.211 | 1.00 | 55.88 | GZ00 C |
| ATOM | 4894 | NZ | LYS | A | 215 | −38.638 | 127.415 | −5.023 | 1.00 | 63.59 | GZ00 N1+ |
| ATOM | 4895 | N | LYS | A | 216 | −44.024 | 127.727 | −8.093 | 1.00 | 50.59 | GZ00 N |
| ATOM | 4896 | CA | LYS | A | 216 | −44.437 | 128.396 | −9.312 | 1.00 | 51.04 | GZ00 C |
| ATOM | 4897 | C | LYS | A | 216 | −43.241 | 128.550 | −10.244 | 1.00 | 53.52 | GZ00 C |
| ATOM | 4898 | O | LYS | A | 216 | −42.135 | 128.880 | −9.807 | 1.00 | 49.36 | GZ00 O |
| ATOM | 4899 | CB | LYS | A | 216 | −45.052 | 129.760 | −8.996 | 1.00 | 56.62 | GZ00 C |
| ATOM | 4900 | CG | LYS | A | 216 | −45.566 | 130.514 | −10.215 | 1.00 | 61.12 | GZ00 C |
| ATOM | 4901 | CD | LYS | A | 216 | −46.136 | 131.864 | −9.823 | 1.00 | 67.36 | GZ00 C |
| ATOM | 4902 | CE | LYS | A | 216 | −46.919 | 132.483 | −10.962 | 1.00 | 66.87 | GZ00 C |
| ATOM | 4903 | NZ | LYS | A | 216 | −47.732 | 133.632 | −10.483 | 1.00 | 75.15 | GZ00 N1+ |
| ATOM | 4904 | N | VAL | A | 217 | −43.462 | 128.277 | −11.526 | 1.00 | 51.79 | GZ00 N |
| ATOM | 4905 | CA | VAL | A | 217 | −42.414 | 128.342 | −12.536 | 1.00 | 53.46 | GZ00 C |
| ATOM | 4906 | C | VAL | A | 217 | −42.741 | 129.494 | −13.465 | 1.00 | 54.54 | GZ00 C |
| ATOM | 4907 | O | VAL | A | 217 | −43.747 | 129.455 | −14.179 | 1.00 | 59.89 | GZ00 O |
| ATOM | 4908 | CB | VAL | A | 217 | −42.292 | 127.021 | −13.308 | 1.00 | 55.15 | GZ00 C |
| ATOM | 4909 | CG1 | VAL | A | 217 | −41.110 | 127.076 | −14.255 | 1.00 | 49.43 | GZ00 C |
| ATOM | 4910 | CG2 | VAL | A | 217 | −42.184 | 125.845 | −12.330 | 1.00 | 40.65 | GZ00 C |
| ATOM | 4911 | N | GLU | A | 218 | −41.905 | 130.525 | −13.455 | 1.00 | 58.16 | GZ00 N |
| ATOM | 4912 | CA | GLU | A | 218 | −42.169 | 131.714 | −14.244 | 1.00 | 61.44 | GZ00 C |
| ATOM | 4913 | C | GLU | A | 218 | −41.064 | 131.965 | −15.263 | 1.00 | 73.28 | GZ00 C |
| ATOM | 4914 | O | GLU | A | 218 | −39.904 | 131.589 | −15.043 | 1.00 | 69.38 | GZ00 O |
| ATOM | 4915 | CB | GLU | A | 218 | −42.312 | 132.955 | −13.350 | 1.00 | 65.18 | GZ00 C |
| ATOM | 4916 | CG | GLU | A | 218 | −43.436 | 132.867 | −12.323 | 1.00 | 71.84 | GZ00 C |
| ATOM | 4917 | CD | GLU | A | 218 | −43.518 | 134.104 | −11.427 | 1.00 | 80.98 | GZ00 C |
| ATOM | 4918 | OE1 | GLU | A | 218 | −42.537 | 134.884 | −11.391 | 1.00 | 69.24 | GZ00 O |
| ATOM | 4919 | OE2 | GLU | A | 218 | −44.568 | 134.295 | −10.769 | 1.00 | 78.83 | GZ00 O1− |
| ATOM | 4920 | N | PRO | A | 219 | −41.401 | 132.592 | −16.400 | 1.00 | 72.81 | GZ00 N |
| ATOM | 4921 | CA | PRO | A | 219 | −40.374 | 133.004 | −17.371 | 1.00 | 73.28 | GZ00 C |
| ATOM | 4922 | C | PRO | A | 219 | −39.387 | 134.017 | −16.815 | 1.00 | 77.52 | GZ00 C |
| ATOM | 4923 | O | PRO | A | 219 | −39.500 | 134.420 | −15.653 | 1.00 | 81.78 | GZ00 O |
| ATOM | 4924 | CB | PRO | A | 219 | −41.194 | 133.614 | −18.517 | 1.00 | 73.25 | GZ00 C |
| ATOM | 4925 | CG | PRO | A | 219 | −42.619 | 133.679 | −18.024 | 1.00 | 67.58 | GZ00 C |
| ATOM | 4926 | CD | PRO | A | 219 | −42.759 | 132.663 | −16.958 | 1.00 | 67.19 | GZ00 C |
| ATOM | 4927 | N | LYS | A | 220 | −38.405 | 134.405 | −17.627 | 1.00 | 81.29 | GZ00 N |
| ATOM | 4928 | CA | LYS | A | 220 | −37.376 | 135.375 | −17.234 | 1.00 | 82.90 | GZ00 C |
| ATOM | 4929 | C | LYS | A | 220 | −36.507 | 134.815 | −16.117 | 1.00 | 88.96 | GZ00 C |
| ATOM | 4930 | O | LYS | A | 220 | −36.186 | 133.626 | −16.112 | 1.00 | 89.60 | GZ00 O |
| ATOM | 4931 | CB | LYS | A | 220 | −38.003 | 136.710 | −16.809 | 1.00 | 83.44 | GZ00 C |
| ATOM | 4932 | CG | LYS | A | 220 | −37.004 | 137.772 | −16.372 | 1.00 | 79.50 | GZ00 C |
| ATOM | 4933 | CD | LYS | A | 220 | −36.117 | 138.217 | −17.516 | 1.00 | 78.87 | GZ00 C |
| ATOM | 4934 | CE | LYS | A | 220 | −35.095 | 139.231 | −17.031 | 1.00 | 76.44 | GZ00 C |
| ATOM | 4935 | NZ | LYS | A | 220 | −34.316 | 139.811 | −18.154 | 1.00 | 72.11 | GZ00 N1+ |
| TER | | | | | | | | | | | |
| ATOM | 4936 | N | GLN | X | 1 | −13.182 | 99.213 | −18.301 | 1.00 | 76.62 | N |
| ATOM | 4937 | CA | GLN | X | 1 | −13.330 | 98.583 | −19.611 | 1.00 | 76.63 | C |
| ATOM | 4938 | C | GLN | X | 1 | −13.561 | 97.073 | −19.505 | 1.00 | 74.72 | C |
| ATOM | 4939 | O | GLN | X | 1 | −12.891 | 96.390 | −18.727 | 1.00 | 80.15 | O |
| ATOM | 4940 | CB | GLN | X | 1 | −12.095 | 98.863 | −20.464 | 1.00 | 81.35 | C |
| ATOM | 4941 | CG | GLN | X | 1 | −11.908 | 100.324 | −20.759 | 1.00 | 87.31 | C |
| ATOM | 4942 | CD | GLN | X | 1 | −13.144 | 100.930 | −21.400 | 1.00 | 101.98 | C |
| ATOM | 4943 | OE1 | GLN | X | 1 | −13.815 | 101.779 | −20.806 | 1.00 | 102.82 | O |
| ATOM | 4944 | NE2 | GLN | X | 1 | −13.454 | 100.491 | −22.619 | 1.00 | 97.35 | N |
| ATOM | 4945 | N | SER | X | 2 | −14.506 | 96.551 | −20.287 | 1.00 | 67.44 | N |
| ATOM | 4946 | CA | SER | X | 2 | −14.749 | 95.113 | −20.298 | 1.00 | 60.09 | C |
| ATOM | 4947 | C | SER | X | 2 | −13.572 | 94.377 | −20.927 | 1.00 | 57.36 | C |
| ATOM | 4948 | O | SER | X | 2 | −12.944 | 94.860 | −21.875 | 1.00 | 53.67 | O |
| ATOM | 4949 | CB | SER | X | 2 | −16.026 | 94.785 | −21.086 | 1.00 | 46.51 | C |
| ATOM | 4950 | OG | SER | X | 2 | −17.130 | 94.586 | −20.224 | 1.00 | 58.04 | O |

TABLE 10.3-continued

| | | | | | | | | | | |
|---|---|---|---|---|---|---|---|---|---|---|
| ATOM | 4951 | N | VAL | X | 3 | −13.284 | 93.183 | −20.403 | 1.00 | 47.89 | N |
| ATOM | 4952 | CA | VAL | X | 3 | −12.146 | 92.428 | −20.923 | 1.00 | 46.54 | C |
| ATOM | 4953 | C | VAL | X | 3 | −12.475 | 91.869 | −22.301 | 1.00 | 47.23 | C |
| ATOM | 4954 | O | VAL | X | 3 | −11.622 | 91.855 | −23.201 | 1.00 | 45.87 | O |
| ATOM | 4955 | CB | VAL | X | 3 | −11.731 | 91.309 | −19.951 | 1.00 | 44.31 | C |
| ATOM | 4956 | CG1 | VAL | X | 3 | −10.685 | 90.401 | −20.593 | 1.00 | 34.16 | C |
| ATOM | 4957 | CG2 | VAL | X | 3 | −11.202 | 91.895 | −18.640 | 1.00 | 39.33 | C |
| ATOM | 4958 | N | LEU | X | 4 | −13.716 | 91.408 | −22.490 | 1.00 | 42.72 | N |
| ATOM | 4959 | CA | LEU | X | 4 | −14.234 | 91.004 | −23.790 | 1.00 | 40.50 | C |
| ATOM | 4960 | C | LEU | X | 4 | −15.023 | 92.164 | −24.377 | 1.00 | 38.73 | C |
| ATOM | 4961 | O | LEU | X | 4 | −15.756 | 92.844 | −23.656 | 1.00 | 38.68 | O |
| ATOM | 4962 | CB | LEU | X | 4 | −15.120 | 89.761 | −23.666 | 1.00 | 32.58 | C |
| ATOM | 4963 | CG | LEU | X | 4 | −14.559 | 88.652 | −22.763 | 1.00 | 35.07 | C |
| ATOM | 4964 | CD1 | LEU | X | 4 | −15.572 | 87.502 | −22.591 | 1.00 | 33.11 | C |
| ATOM | 4965 | CD2 | LEU | X | 4 | −13.193 | 88.130 | −23.260 | 1.00 | 26.20 | C |
| ATOM | 4966 | N | THR | X | 5 | −14.874 | 92.394 | −25.683 | 1.00 | 30.86 | N |
| ATOM | 4967 | CA | THR | X | 5 | −15.506 | 93.541 | −26.318 | 1.00 | 31.01 | C |
| ATOM | 4968 | C | THR | X | 5 | −16.635 | 93.087 | −27.228 | 1.00 | 32.92 | C |
| ATOM | 4969 | O | THR | X | 5 | −16.412 | 92.301 | −28.156 | 1.00 | 34.89 | O |
| ATOM | 4970 | CB | THR | X | 5 | −14.488 | 94.361 | −27.114 | 1.00 | 35.46 | C |
| ATOM | 4971 | OG1 | THR | X | 5 | −13.373 | 94.678 | −26.280 | 1.00 | 37.79 | O |
| ATOM | 4972 | CG2 | THR | X | 5 | −15.130 | 95.668 | −27.583 | 1.00 | 23.38 | C |
| ATOM | 4973 | N | GLN | X | 6 | −17.836 | 93.608 | −26.972 | 1.00 | 31.00 | N |
| ATOM | 4974 | CA | GLN | X | 6 | −19.060 | 93.406 | −27.730 | 1.00 | 33.70 | C |
| ATOM | 4975 | C | GLN | X | 6 | −19.549 | 94.756 | −28.224 | 1.00 | 33.00 | C |
| ATOM | 4976 | O | GLN | X | 6 | −19.399 | 95.759 | −27.519 | 1.00 | 30.42 | O |
| ATOM | 4977 | CB | GLN | X | 6 | −20.188 | 92.765 | −26.892 | 1.00 | 30.43 | C |
| ATOM | 4978 | CG | GLN | X | 6 | −19.910 | 91.392 | −26.335 | 1.00 | 28.80 | C |
| ATOM | 4979 | CD | GLN | X | 6 | −21.049 | 90.852 | −25.456 | 1.00 | 32.96 | C |
| ATOM | 4980 | OE1 | GLN | X | 6 | −20.823 | 90.407 | −24.329 | 1.00 | 32.89 | O |
| ATOM | 4981 | NE2 | GLN | X | 6 | −22.266 | 90.879 | −25.978 | 1.00 | 26.46 | N |
| ATOM | 4982 | N | PRO | X | 7 | −20.179 | 94.813 | −29.392 | 1.00 | 28.38 | N |
| ATOM | 4983 | CA | PRO | X | 7 | −20.880 | 96.043 | −29.796 | 1.00 | 33.26 | C |
| ATOM | 4984 | C | PRO | X | 7 | −21.977 | 96.356 | −28.791 | 1.00 | 38.21 | C |
| ATOM | 4985 | O | PRO | X | 7 | −22.613 | 95.435 | −28.252 | 1.00 | 35.17 | O |
| ATOM | 4986 | CB | PRO | X | 7 | −21.461 | 95.693 | −31.181 | 1.00 | 33.21 | C |
| ATOM | 4987 | CG | PRO | X | 7 | −21.607 | 94.178 | −31.146 | 1.00 | 34.98 | C |
| ATOM | 4988 | CD | PRO | X | 7 | −20.480 | 93.673 | −30.276 | 1.00 | 33.91 | C |
| ATOM | 4989 | N | PRO | X | 8 | −22.189 | 97.632 | −28.468 | 1.00 | 34.91 | N |
| ATOM | 4990 | CA | PRO | X | 8 | −23.156 | 97.962 | −27.407 | 1.00 | 29.83 | C |
| ATOM | 4991 | C | PRO | X | 8 | −24.604 | 97.731 | −27.792 | 1.00 | 37.56 | C |
| ATOM | 4992 | O | PRO | X | 8 | −25.412 | 97.420 | −26.908 | 1.00 | 36.02 | O |
| ATOM | 4993 | CB | PRO | X | 8 | −22.879 | 99.443 | −27.119 | 1.00 | 28.75 | C |
| ATOM | 4994 | CG | PRO | X | 8 | −22.237 | 99.952 | −28.379 | 1.00 | 41.44 | C |
| ATOM | 4995 | CD | PRO | X | 8 | −21.416 | 98.803 | −28.911 | 1.00 | 31.17 | C |
| ATOM | 4996 | N | SER | X | 9 | −24.980 | 97.891 | −29.057 | 1.00 | 30.64 | N |
| ATOM | 4997 | CA | SER | X | 9 | −26.373 | 97.657 | −29.406 | 1.00 | 33.12 | C |
| ATOM | 4998 | C | SER | X | 9 | −26.487 | 97.243 | −30.864 | 1.00 | 36.96 | C |
| ATOM | 4999 | O | SER | X | 9 | −25.582 | 97.451 | −31.685 | 1.00 | 34.35 | O |
| ATOM | 5000 | CB | SER | X | 9 | −27.257 | 98.873 | −29.146 | 1.00 | 35.68 | C |
| ATOM | 5001 | OG | SER | X | 9 | −26.883 | 99.958 | −29.965 | 1.00 | 42.47 | O |
| ATOM | 5002 | N | VAL | X | 10 | −27.628 | 96.644 | −31.164 | 1.00 | 33.72 | N |
| ATOM | 5003 | CA | VAL | X | 10 | −27.851 | 95.977 | −32.431 | 1.00 | 34.33 | C |
| ATOM | 5004 | C | VAL | X | 10 | −29.358 | 95.932 | −32.642 | 1.00 | 34.97 | C |
| ATOM | 5005 | O | VAL | X | 10 | −30.118 | 95.725 | −31.688 | 1.00 | 36.04 | O |
| ATOM | 5006 | CB | VAL | X | 10 | −27.170 | 94.585 | −32.397 | 1.00 | 36.02 | C |
| ATOM | 5007 | CG1 | VAL | X | 10 | −28.071 | 93.486 | −32.875 | 1.00 | 38.30 | C |
| ATOM | 5008 | CG2 | VAL | X | 10 | −25.823 | 94.625 | −33.148 | 1.00 | 34.46 | C |
| ATOM | 5009 | N | SER | X | 11 | −29.801 | 96.196 | −33.872 | 1.00 | 35.57 | N |
| ATOM | 5010 | CA | SER | X | 11 | −31.238 | 96.220 | −34.114 | 1.00 | 38.43 | C |
| ATOM | 5011 | C | SER | X | 11 | −31.565 | 95.782 | −35.531 | 1.00 | 38.48 | C |
| ATOM | 5012 | O | SER | X | 11 | −30.839 | 96.101 | −36.473 | 1.00 | 39.31 | O |
| ATOM | 5013 | CB | SER | X | 11 | −31.841 | 97.609 | −33.833 | 1.00 | 38.56 | C |
| ATOM | 5014 | OG | SER | X | 11 | −31.368 | 98.589 | −34.727 | 1.00 | 43.26 | O |
| ATOM | 5015 | N | ALA | X | 12 | −32.670 | 95.054 | −35.669 | 1.00 | 37.39 | N |
| ATOM | 5016 | CA | ALA | X | 12 | −33.132 | 94.581 | −36.965 | 1.00 | 35.97 | C |
| ATOM | 5017 | C | ALA | X | 12 | −34.610 | 94.221 | −36.869 | 1.00 | 39.63 | C |
| ATOM | 5018 | O | ALA | X | 12 | −35.144 | 93.969 | −35.782 | 1.00 | 37.40 | O |
| ATOM | 5019 | CB | ALA | X | 12 | −32.317 | 93.374 | −37.454 | 1.00 | 32.40 | C |
| ATOM | 5020 | N | ALA | X | 13 | −35.245 | 94.137 | −38.035 | 1.00 | 39.79 | N |
| ATOM | 5021 | CA | ALA | X | 13 | −36.664 | 93.835 | −38.153 | 1.00 | 40.54 | C |
| ATOM | 5022 | C | ALA | X | 13 | −36.949 | 92.341 | −37.964 | 1.00 | 39.36 | C |
| ATOM | 5023 | O | ALA | X | 13 | −36.060 | 91.493 | −38.120 | 1.00 | 38.64 | O |
| ATOM | 5024 | CB | ALA | X | 13 | −37.170 | 94.286 | −39.518 | 1.00 | 26.30 | C |
| ATOM | 5025 | N | PRO | X | 14 | −38.182 | 91.992 | −37.606 | 1.00 | 39.35 | N |
| ATOM | 5026 | CA | PRO | X | 14 | −38.543 | 90.572 | −37.547 | 1.00 | 40.01 | C |
| ATOM | 5027 | C | PRO | X | 14 | −38.206 | 89.887 | −38.865 | 1.00 | 43.81 | C |
| ATOM | 5028 | O | PRO | X | 14 | −38.330 | 90.469 | −39.949 | 1.00 | 40.74 | O |
| ATOM | 5029 | CB | PRO | X | 14 | −40.050 | 90.596 | −37.287 | 1.00 | 28.16 | C |
| ATOM | 5030 | CG | PRO | X | 14 | −40.292 | 91.919 | −36.614 | 1.00 | 38.63 | C |

TABLE 10.3-continued

| ATOM | 5031 | CD  | PRO | X | 14 | −39.300 | 92.873 | −37.204 | 1.00 | 38.01 | C |
| ATOM | 5032 | N   | GLY | X | 15 | −37.742 | 88.649 | −38.754 | 1.00 | 42.53 | N |
| ATOM | 5033 | CA  | GLY | X | 15 | −37.352 | 87.856 | −39.886 | 1.00 | 39.20 | C |
| ATOM | 5034 | C   | GLY | X | 15 | −35.927 | 88.040 | −40.349 | 1.00 | 44.97 | C |
| ATOM | 5035 | O   | GLY | X | 15 | −35.426 | 87.186 | −41.077 | 1.00 | 48.28 | O |
| ATOM | 5036 | N   | GLN | X | 16 | −35.257 | 89.115 | −39.944 | 1.00 | 41.58 | N |
| ATOM | 5037 | CA  | GLN | X | 16 | −33.915 | 89.385 | −40.433 | 1.00 | 43.47 | C |
| ATOM | 5038 | C   | GLN | X | 16 | −32.862 | 88.623 | −39.621 | 1.00 | 47.57 | C |
| ATOM | 5039 | O   | GLN | X | 16 | −33.167 | 87.903 | −38.664 | 1.00 | 46.60 | O |
| ATOM | 5040 | CB  | GLN | X | 16 | −33.635 | 90.888 | −40.417 | 1.00 | 52.99 | C |
| ATOM | 5041 | CG  | GLN | X | 16 | −34.303 | 91.702 | −41.539 | 1.00 | 46.17 | C |
| ATOM | 5042 | CD  | GLN | X | 16 | −33.566 | 93.024 | −41.807 | 1.00 | 74.76 | C |
| ATOM | 5043 | OE1 | GLN | X | 16 | −33.715 | 94.021 | −41.064 | 1.00 | 62.51 | O |
| ATOM | 5044 | NE2 | GLN | X | 16 | −32.758 | 93.034 | −42.866 | 1.00 | 79.00 | N |
| ATOM | 5045 | N   | LYS | X | 17 | −31.607 | 88.762 | −40.053 | 1.00 | 53.20 | N |
| ATOM | 5046 | CA  | LYS | X | 17 | −30.415 | 88.195 | −39.436 | 1.00 | 49.52 | C |
| ATOM | 5047 | C   | LYS | X | 17 | −29.695 | 89.254 | −38.627 | 1.00 | 51.74 | C |
| ATOM | 5048 | O   | LYS | X | 17 | −29.796 | 90.454 | −38.883 | 1.00 | 62.58 | O |
| ATOM | 5049 | CB  | LYS | X | 17 | −29.417 | 87.662 | −40.469 | 1.00 | 49.86 | C |
| ATOM | 5050 | CG  | LYS | X | 17 | −29.783 | 86.391 | −41.150 | 1.00 | 61.26 | C |
| ATOM | 5051 | CD  | LYS | X | 17 | −28.839 | 86.137 | −42.317 | 1.00 | 75.06 | C |
| ATOM | 5052 | CE  | LYS | X | 17 | −29.295 | 84.939 | −43.148 | 1.00 | 82.27 | C |
| ATOM | 5053 | NZ  | LYS | X | 17 | −28.391 | 84.723 | −44.304 | 1.00 | 82.49 | N |
| ATOM | 5054 | N   | VAL | X | 18 | −28.913 | 88.785 | −37.670 | 1.00 | 51.92 | N |
| ATOM | 5055 | CA  | VAL | X | 18 | −28.083 | 89.670 | −36.876 | 1.00 | 47.06 | C |
| ATOM | 5056 | C   | VAL | X | 18 | −26.882 | 88.857 | −36.416 | 1.00 | 42.24 | C |
| ATOM | 5057 | O   | VAL | X | 18 | −26.969 | 87.645 | −36.210 | 1.00 | 39.00 | O |
| ATOM | 5058 | CB  | VAL | X | 18 | −28.932 | 90.288 | −35.735 | 1.00 | 50.43 | C |
| ATOM | 5059 | CG1 | VAL | X | 18 | −28.437 | 89.925 | −34.363 | 1.00 | 44.21 | C |
| ATOM | 5060 | CG2 | VAL | X | 18 | −29.054 | 91.783 | −35.919 | 1.00 | 48.19 | C |
| ATOM | 5061 | N   | THR | X | 19 | −25.745 | 89.520 | −36.323 | 1.00 | 40.09 | N |
| ATOM | 5062 | CA  | THR | X | 19 | −24.519 | 88.924 | −35.825 | 1.00 | 43.49 | C |
| ATOM | 5063 | C   | THR | X | 19 | −24.005 | 89.770 | −34.672 | 1.00 | 39.57 | C |
| ATOM | 5064 | O   | THR | X | 19 | −24.036 | 91.000 | −34.737 | 1.00 | 39.43 | O |
| ATOM | 5065 | CB  | THR | X | 19 | −23.484 | 88.816 | −36.961 | 1.00 | 40.40 | C |
| ATOM | 5066 | OG1 | THR | X | 19 | −23.352 | 87.443 | −37.322 | 1.00 | 51.45 | O |
| ATOM | 5067 | CG2 | THR | X | 19 | −22.132 | 89.395 | −36.582 | 1.00 | 45.74 | C |
| ATOM | 5068 | N   | ILE | X | 20 | −23.557 | 89.116 | −33.607 | 1.00 | 36.67 | N |
| ATOM | 5069 | CA  | ILE | X | 20 | −23.009 | 89.805 | −32.449 | 1.00 | 34.08 | C |
| ATOM | 5070 | C   | ILE | X | 20 | −21.638 | 89.219 | −32.166 | 1.00 | 35.80 | C |
| ATOM | 5071 | O   | ILE | X | 20 | −21.517 | 88.008 | −31.946 | 1.00 | 34.42 | O |
| ATOM | 5072 | CB  | ILE | X | 20 | −23.917 | 89.679 | −31.210 | 1.00 | 36.76 | C |
| ATOM | 5073 | CG1 | ILE | X | 20 | −25.269 | 90.345 | −31.467 | 1.00 | 35.10 | C |
| ATOM | 5074 | CG2 | ILE | X | 20 | −23.257 | 90.324 | −29.996 | 1.00 | 27.82 | C |
| ATOM | 5075 | CD1 | ILE | X | 20 | −26.276 | 90.127 | −30.364 | 1.00 | 28.66 | C |
| ATOM | 5076 | N   | SER | X | 21 | −20.614 | 90.068 | −32.153 | 1.00 | 38.15 | N |
| ATOM | 5077 | CA  | SER | X | 21 | −19.237 | 89.614 | −31.980 | 1.00 | 37.42 | C |
| ATOM | 5078 | C   | SER | X | 21 | −18.762 | 89.818 | −30.547 | 1.00 | 38.58 | C |
| ATOM | 5079 | O   | SER | X | 21 | −19.344 | 90.570 | −29.762 | 1.00 | 39.24 | O |
| ATOM | 5080 | CB  | SER | X | 21 | −18.290 | 90.351 | −32.932 | 1.00 | 30.39 | C |
| ATOM | 5081 | OG  | SER | X | 21 | −18.312 | 91.741 | −32.656 | 1.00 | 45.43 | O |
| ATOM | 5082 | N   | CYS | X | 22 | −17.662 | 89.152 | −30.226 | 1.00 | 31.32 | N |
| ATOM | 5083 | CA  | CYS | X | 22 | −17.099 | 89.156 | −28.883 | 1.00 | 33.00 | C |
| ATOM | 5084 | C   | CYS | X | 22 | −15.601 | 88.936 | −29.035 | 1.00 | 36.67 | C |
| ATOM | 5085 | O   | CYS | X | 22 | −15.179 | 87.824 | −29.367 | 1.00 | 33.05 | O |
| ATOM | 5086 | CB  | CYS | X | 22 | −17.737 | 88.067 | −28.029 | 1.00 | 33.80 | C |
| ATOM | 5087 | SG  | CYS | X | 22 | −16.950 | 87.740 | −26.422 | 1.00 | 49.12 | S |
| ATOM | 5088 | N   | SER | X | 23 | −14.806 | 89.986 | −28.830 | 1.00 | 35.27 | N |
| ATOM | 5089 | CA  | SER | X | 23 | −13.362 | 89.917 | −29.015 | 1.00 | 36.02 | C |
| ATOM | 5090 | C   | SER | X | 23 | −12.635 | 89.893 | −27.682 | 1.00 | 35.20 | C |
| ATOM | 5091 | O   | SER | X | 23 | −12.961 | 90.659 | −26.765 | 1.00 | 32.83 | O |
| ATOM | 5092 | CB  | SER | X | 23 | −12.847 | 91.105 | −29.824 | 1.00 | 34.28 | C |
| ATOM | 5093 | OG  | SER | X | 23 | −13.487 | 91.109 | −31.082 | 1.00 | 60.42 | O |
| ATOM | 5094 | N   | GLY | X | 24 | −11.631 | 89.027 | −27.600 | 1.00 | 29.76 | N |
| ATOM | 5095 | CA  | GLY | X | 24 | −10.801 | 88.942 | −26.426 | 1.00 | 32.74 | C |
| ATOM | 5096 | C   | GLY | X | 24 | −9.364  | 88.732 | −26.822 | 1.00 | 36.96 | C |
| ATOM | 5097 | O   | GLY | X | 24 | −8.898  | 89.366 | −27.766 | 1.00 | 35.74 | O |
| ATOM | 5098 | N   | SER | X | 25 | −8.666  | 87.829 | −26.132 | 1.00 | 34.51 | N |
| ATOM | 5099 | CA  | SER | X | 25 | −7.238  | 87.632 | −26.326 | 1.00 | 35.15 | C |
| ATOM | 5100 | C   | SER | X | 25 | −6.925  | 86.161 | −26.114 | 1.00 | 38.46 | C |
| ATOM | 5101 | O   | SER | X | 25 | −7.793  | 85.366 | −25.733 | 1.00 | 35.89 | O |
| ATOM | 5102 | CB  | SER | X | 25 | −6.411  | 88.485 | −25.366 | 1.00 | 31.48 | C |
| ATOM | 5103 | OG  | SER | X | 25 | −6.531  | 87.980 | −24.047 | 1.00 | 41.73 | O |
| ATOM | 5104 | N   | SER | X | 26 | −5.656  | 85.811 | −26.338 | 1.00 | 32.62 | N |
| ATOM | 5105 | CA  | SER | X | 26 | −5.255  | 84.410 | −26.269 | 1.00 | 40.22 | C |
| ATOM | 5106 | C   | SER | X | 26 | −5.478  | 83.825 | −24.886 | 1.00 | 39.50 | C |
| ATOM | 5107 | O   | SER | X | 26 | −5.701  | 82.616 | −24.755 | 1.00 | 43.16 | O |
| ATOM | 5108 | CB  | SER | X | 26 | −3.779  | 84.236 | −26.645 | 1.00 | 33.65 | C |
| ATOM | 5109 | OG  | SER | X | 26 | −2.978  | 85.154 | −25.933 | 1.00 | 50.17 | O |
| ATOM | 5110 | N   | SER | X | 27 | −5.442  | 84.650 | −23.847 | 1.00 | 37.12 | N |

TABLE 10.3-continued

| | | | | | | | | | | |
|---|---|---|---|---|---|---|---|---|---|---|
| ATOM | 5111 | CA | SER | X | 27 | −5.564 | 84.097 | −22.504 | 1.00 | 35.96 | C |
| ATOM | 5112 | C | SER | X | 27 | −7.010 | 83.927 | −22.062 | 1.00 | 36.99 | C |
| ATOM | 5113 | O | SER | X | 27 | −7.236 | 83.380 | −20.976 | 1.00 | 37.69 | O |
| ATOM | 5114 | CB | SER | X | 27 | −4.848 | 84.982 | −21.480 | 1.00 | 32.77 | C |
| ATOM | 5115 | OG | SER | X | 27 | −5.484 | 86.238 | −21.459 | 1.00 | 46.10 | O |
| ATOM | 5116 | N | ASN | X | 28 | −7.992 | 84.407 | −22.840 | 1.00 | 35.46 | N |
| ATOM | 5117 | CA | ASN | X | 28 | −9.372 | 84.080 | −22.495 | 1.00 | 33.17 | C |
| ATOM | 5118 | C | ASN | X | 28 | −10.056 | 83.327 | −23.636 | 1.00 | 34.99 | C |
| ATOM | 5119 | O | ASN | X | 28 | −10.028 | 82.089 | −23.659 | 1.00 | 30.44 | O |
| ATOM | 5120 | CB | ASN | X | 28 | −10.161 | 85.324 | −22.072 | 1.00 | 29.46 | C |
| ATOM | 5121 | CG | ASN | X | 28 | −9.945 | 86.529 | −22.981 | 1.00 | 33.39 | C |
| ATOM | 5122 | OD1 | ASN | X | 28 | −10.325 | 86.527 | −24.163 | 1.00 | 33.37 | O |
| ATOM | 5123 | ND2 | ASN | X | 28 | −9.394 | 87.594 | −22.408 | 1.00 | 28.13 | N |
| ATOM | 5124 | N | ILE | X | 29 | −10.677 | 84.041 | −24.577 | 1.00 | 26.63 | N |
| ATOM | 5125 | CA | ILE | X | 29 | −11.370 | 83.349 | −25.660 | 1.00 | 33.95 | C |
| ATOM | 5126 | C | ILE | X | 29 | −10.423 | 82.422 | −26.417 | 1.00 | 37.55 | C |
| ATOM | 5127 | O | ILE | X | 29 | −10.814 | 81.335 | −26.857 | 1.00 | 33.77 | O |
| ATOM | 5128 | CB | ILE | X | 29 | −12.029 | 84.355 | −26.611 | 1.00 | 31.78 | C |
| ATOM | 5129 | CG1 | ILE | X | 29 | −13.165 | 85.074 | −25.894 | 1.00 | 37.08 | C |
| ATOM | 5130 | CG2 | ILE | X | 29 | −12.570 | 83.634 | −27.846 | 1.00 | 27.80 | C |
| ATOM | 5131 | CD1 | ILE | X | 29 | −13.921 | 85.975 | −26.801 | 1.00 | 36.60 | C |
| ATOM | 5132 | N | GLY | X | 30 | −9.171 | 82.838 | −26.596 | 1.00 | 38.13 | N |
| ATOM | 5133 | CA | GLY | X | 30 | −8.264 | 82.044 | −27.399 | 1.00 | 32.55 | C |
| ATOM | 5134 | C | GLY | X | 30 | −7.961 | 80.683 | −26.819 | 1.00 | 33.31 | C |
| ATOM | 5135 | O | GLY | X | 30 | −7.589 | 79.781 | −27.559 | 1.00 | 43.57 | O |
| ATOM | 5136 | N | ASN | X | 31 | −8.136 | 80.495 | −25.521 | 1.00 | 40.07 | N |
| ATOM | 5137 | CA | ASN | X | 31 | −7.797 | 79.191 | −24.968 | 1.00 | 37.30 | C |
| ATOM | 5138 | C | ASN | X | 31 | −8.808 | 78.618 | −23.980 | 1.00 | 36.23 | C |
| ATOM | 5139 | O | ASN | X | 31 | −8.500 | 77.622 | −23.324 | 1.00 | 37.83 | O |
| ATOM | 5140 | CB | ASN | X | 31 | −6.405 | 79.245 | −24.343 | 1.00 | 43.50 | C |
| ATOM | 5141 | CG | ASN | X | 31 | −5.314 | 79.117 | −25.408 | 1.00 | 56.73 | C |
| ATOM | 5142 | OD1 | ASN | X | 31 | −5.006 | 78.007 | −25.858 | 1.00 | 58.50 | O |
| ATOM | 5143 | ND2 | ASN | X | 31 | −4.764 | 80.253 | −25.851 | 1.00 | 48.77 | N |
| ATOM | 5144 | N | ASN | X | 32 | −10.015 | 79.157 | −23.886 | 1.00 | 33.81 | N |
| ATOM | 5145 | CA | ASN | X | 32 | −10.979 | 78.603 | −22.954 | 1.00 | 35.74 | C |
| ATOM | 5146 | C | ASN | X | 32 | −12.338 | 78.460 | −23.628 | 1.00 | 33.34 | C |
| ATOM | 5147 | O | ASN | X | 32 | −12.583 | 79.011 | −24.700 | 1.00 | 34.66 | O |
| ATOM | 5148 | CB | ASN | X | 32 | −11.035 | 79.466 | −21.699 | 1.00 | 32.31 | C |
| ATOM | 5149 | CG | ASN | X | 32 | −9.711 | 79.508 | −20.983 | 1.00 | 33.00 | C |
| ATOM | 5150 | OD1 | ASN | X | 32 | −9.339 | 78.559 | −20.300 | 1.00 | 35.81 | O |
| ATOM | 5151 | ND2 | ASN | X | 32 | −8.979 | 80.606 | −21.141 | 1.00 | 40.72 | N |
| ATOM | 5152 | N | TYR | X | 33 | −13.220 | 77.691 | −22.998 | 1.00 | 33.41 | N |
| ATOM | 5153 | CA | TYR | X | 33 | −14.543 | 77.451 | −23.572 | 1.00 | 35.49 | C |
| ATOM | 5154 | C | TYR | X | 33 | −15.355 | 78.735 | −23.542 | 1.00 | 30.39 | C |
| ATOM | 5155 | O | TYR | X | 33 | −15.333 | 79.455 | −22.555 | 1.00 | 29.67 | O |
| ATOM | 5156 | CB | TYR | X | 33 | −15.281 | 76.348 | −22.793 | 1.00 | 28.71 | C |
| ATOM | 5157 | CG | TYR | X | 33 | −14.627 | 74.978 | −22.878 | 1.00 | 33.53 | C |
| ATOM | 5158 | CD1 | TYR | X | 33 | −14.513 | 74.311 | −24.098 | 1.00 | 27.38 | C |
| ATOM | 5159 | CD2 | TYR | X | 33 | −14.115 | 74.356 | −21.740 | 1.00 | 32.47 | C |
| ATOM | 5160 | CE1 | TYR | X | 33 | −13.915 | 73.063 | −24.178 | 1.00 | 30.49 | C |
| ATOM | 5161 | CE2 | TYR | X | 33 | −13.514 | 73.101 | −21.813 | 1.00 | 31.14 | C |
| ATOM | 5162 | CZ | TYR | X | 33 | −13.409 | 72.468 | −23.043 | 1.00 | 31.76 | C |
| ATOM | 5163 | OH | TYR | X | 33 | −12.815 | 71.235 | −23.121 | 1.00 | 31.17 | O |
| ATOM | 5164 | N | VAL | X | 34 | −16.106 | 79.006 | −24.602 | 1.00 | 29.15 | N |
| ATOM | 5165 | CA | VAL | X | 34 | −16.887 | 80.240 | −24.708 | 1.00 | 36.08 | C |
| ATOM | 5166 | C | VAL | X | 34 | −18.366 | 79.954 | −24.434 | 1.00 | 32.87 | C |
| ATOM | 5167 | O | VAL | X | 34 | −18.934 | 79.011 | −24.996 | 1.00 | 30.79 | O |
| ATOM | 5168 | CB | VAL | X | 34 | −16.704 | 80.865 | −26.098 | 1.00 | 33.81 | C |
| ATOM | 5169 | CG1 | VAL | X | 34 | −17.582 | 82.090 | −26.255 | 1.00 | 27.19 | C |
| ATOM | 5170 | CG2 | VAL | X | 34 | −15.243 | 81.172 | −26.332 | 1.00 | 32.31 | C |
| ATOM | 5171 | N | SER | X | 35 | −19.008 | 80.798 | −23.617 | 1.00 | 32.88 | N |
| ATOM | 5172 | CA | SER | X | 35 | −20.444 | 80.696 | −23.349 | 1.00 | 30.32 | C |
| ATOM | 5173 | C | SER | X | 35 | −21.176 | 81.975 | −23.759 | 1.00 | 32.72 | C |
| ATOM | 5174 | O | SER | X | 35 | −20.616 | 83.075 | −23.709 | 1.00 | 28.89 | O |
| ATOM | 5175 | CB | SER | X | 35 | −20.725 | 80.419 | −21.869 | 1.00 | 28.37 | C |
| ATOM | 5176 | OG | SER | X | 35 | −20.265 | 79.144 | −21.480 | 1.00 | 28.41 | O |
| ATOM | 5177 | N | TRP | X | 36 | −22.446 | 81.832 | −24.154 | 1.00 | 28.96 | N |
| ATOM | 5178 | CA | TRP | X | 36 | −23.308 | 82.972 | −24.451 | 1.00 | 27.19 | C |
| ATOM | 5179 | C | TRP | X | 36 | −24.541 | 82.934 | −23.566 | 1.00 | 32.55 | C |
| ATOM | 5180 | O | TRP | X | 36 | −25.151 | 81.873 | −23.374 | 1.00 | 33.96 | O |
| ATOM | 5181 | CB | TRP | X | 36 | −23.738 | 83.010 | −25.915 | 1.00 | 28.66 | C |
| ATOM | 5182 | CG | TRP | X | 36 | −22.661 | 83.470 | −26.893 | 1.00 | 32.03 | C |
| ATOM | 5183 | CD1 | TRP | X | 36 | −21.775 | 82.676 | −27.576 | 1.00 | 30.86 | C |
| ATOM | 5184 | CD2 | TRP | X | 36 | −22.382 | 84.821 | −27.305 | 1.00 | 29.58 | C |
| ATOM | 5185 | NE1 | TRP | X | 36 | −20.965 | 83.451 | −28.377 | 1.00 | 29.86 | N |
| ATOM | 5186 | CE2 | TRP | X | 36 | −21.320 | 84.767 | −28.231 | 1.00 | 32.46 | C |
| ATOM | 5187 | CE3 | TRP | X | 36 | −22.926 | 86.067 | −26.979 | 1.00 | 30.71 | C |
| ATOM | 5188 | CZ2 | TRP | X | 36 | −20.784 | 85.917 | −28.827 | 1.00 | 34.25 | C |
| ATOM | 5189 | CZ3 | TRP | X | 36 | −22.391 | 87.204 | −27.571 | 1.00 | 32.12 | C |
| ATOM | 5190 | CH2 | TRP | X | 36 | −21.329 | 87.120 | −28.480 | 1.00 | 31.97 | C |

TABLE 10.3-continued

| | | | | | | | | | | |
|---|---|---|---|---|---|---|---|---|---|---|
| ATOM | 5191 | N | TYR | X | 37 | −24.909 | 84.105 | −23.040 | 1.00 | 34.18 | N |
| ATOM | 5192 | CA | TYR | X | 37 | −26.054 | 84.256 | −22.152 | 1.00 | 28.55 | C |
| ATOM | 5193 | C | TYR | X | 37 | −27.044 | 85.232 | −22.763 | 1.00 | 30.63 | C |
| ATOM | 5194 | O | TYR | X | 37 | −26.646 | 86.220 | −23.399 | 1.00 | 30.08 | O |
| ATOM | 5195 | CB | TYR | X | 37 | −25.607 | 84.731 | −20.760 | 1.00 | 24.98 | C |
| ATOM | 5196 | CG | TYR | X | 37 | −24.567 | 83.797 | −20.195 | 1.00 | 29.34 | C |
| ATOM | 5197 | CD1 | TYR | X | 37 | −24.941 | 82.601 | −19.573 | 1.00 | 27.60 | C |
| ATOM | 5198 | CD2 | TYR | X | 37 | −23.210 | 84.059 | −20.346 | 1.00 | 27.93 | C |
| ATOM | 5199 | CE1 | TYR | X | 37 | −23.978 | 81.699 | −19.056 | 1.00 | 30.73 | C |
| ATOM | 5200 | CE2 | TYR | X | 37 | −22.234 | 83.172 | −19.828 | 1.00 | 31.38 | C |
| ATOM | 5201 | CZ | TYR | X | 37 | −22.629 | 81.990 | −19.195 | 1.00 | 32.90 | C |
| ATOM | 5202 | OH | TYR | X | 37 | −21.685 | 81.119 | −18.701 | 1.00 | 30.71 | O |
| ATOM | 5203 | N | GLN | X | 38 | −28.331 | 84.926 | −22.592 | 1.00 | 29.50 | N |
| ATOM | 5204 | CA | GLN | X | 38 | −29.430 | 85.780 | −23.026 | 1.00 | 30.90 | C |
| ATOM | 5205 | C | GLN | X | 38 | −30.211 | 86.252 | −21.807 | 1.00 | 31.01 | C |
| ATOM | 5206 | O | GLN | X | 38 | −30.612 | 85.436 | −20.970 | 1.00 | 29.04 | O |
| ATOM | 5207 | CB | GLN | X | 38 | −30.365 | 85.044 | −23.979 | 1.00 | 27.81 | C |
| ATOM | 5208 | CG | GLN | X | 38 | −31.587 | 85.851 | −24.407 | 1.00 | 27.64 | C |
| ATOM | 5209 | CD | GLN | X | 38 | −32.640 | 84.958 | −25.007 | 1.00 | 34.54 | C |
| ATOM | 5210 | OE1 | GLN | X | 38 | −33.141 | 84.043 | −24.329 | 1.00 | 34.50 | O |
| ATOM | 5211 | NE2 | GLN | X | 38 | −32.985 | 85.195 | −26.279 | 1.00 | 26.87 | N |
| ATOM | 5212 | N | GLN | X | 39 | −30.416 | 87.566 | −21.705 | 1.00 | 29.58 | N |
| ATOM | 5213 | CA | GLN | X | 39 | −31.199 | 88.157 | −20.623 | 1.00 | 29.79 | C |
| ATOM | 5214 | C | GLN | X | 39 | −32.378 | 88.907 | −21.252 | 1.00 | 36.36 | C |
| ATOM | 5215 | O | GLN | X | 39 | −32.234 | 90.040 | −21.731 | 1.00 | 37.54 | O |
| ATOM | 5216 | CB | GLN | X | 39 | −30.341 | 89.067 | −19.749 | 1.00 | 26.28 | C |
| ATOM | 5217 | CG | GLN | X | 39 | −31.077 | 89.513 | −18.479 | 1.00 | 31.07 | C |
| ATOM | 5218 | CD | GLN | X | 39 | −30.207 | 90.302 | −17.520 | 1.00 | 33.21 | C |
| ATOM | 5219 | OE1 | GLN | X | 39 | −29.255 | 90.951 | −17.926 | 1.00 | 33.77 | O |
| ATOM | 5220 | NE2 | GLN | X | 39 | −30.542 | 90.260 | −16.241 | 1.00 | 34.37 | N |
| ATOM | 5221 | N | LEU | X | 40 | −33.539 | 88.255 | −21.271 | 1.00 | 32.04 | N |
| ATOM | 5222 | CA | LEU | X | 40 | −34.756 | 88.889 | −21.729 | 1.00 | 34.90 | C |
| ATOM | 5223 | C | LEU | X | 40 | −35.132 | 90.007 | −20.753 | 1.00 | 38.54 | C |
| ATOM | 5224 | O | LEU | X | 40 | −34.759 | 89.948 | −19.575 | 1.00 | 31.68 | O |
| ATOM | 5225 | CB | LEU | X | 40 | −35.872 | 87.851 | −21.832 | 1.00 | 33.07 | C |
| ATOM | 5226 | CG | LEU | X | 40 | −35.490 | 86.643 | −22.697 | 1.00 | 39.00 | C |
| ATOM | 5227 | CD1 | LEU | X | 40 | −36.411 | 85.450 | −22.373 | 1.00 | 38.05 | C |
| ATOM | 5228 | CD2 | LEU | X | 40 | −35.493 | 86.947 | −24.228 | 1.00 | 26.12 | C |
| ATOM | 5229 | N | PRO | X | 41 | −35.826 | 91.047 | −21.227 | 1.00 | 36.64 | N |
| ATOM | 5230 | CA | PRO | X | 41 | −36.146 | 92.208 | −20.371 | 1.00 | 41.13 | C |
| ATOM | 5231 | C | PRO | X | 41 | −36.855 | 91.770 | −19.096 | 1.00 | 38.67 | C |
| ATOM | 5232 | O | PRO | X | 41 | −37.737 | 90.913 | −19.128 | 1.00 | 32.82 | O |
| ATOM | 5233 | CB | PRO | X | 41 | −37.079 | 93.058 | −21.246 | 1.00 | 36.21 | C |
| ATOM | 5234 | CG | PRO | X | 41 | −36.885 | 92.555 | −22.651 | 1.00 | 38.84 | C |
| ATOM | 5235 | CD | PRO | X | 41 | −36.528 | 91.097 | −22.519 | 1.00 | 39.30 | C |
| ATOM | 5236 | N | GLY | X | 42 | −36.410 | 92.308 | −17.961 | 1.00 | 37.25 | N |
| ATOM | 5237 | CA | GLY | X | 42 | −36.981 | 91.946 | −16.678 | 1.00 | 39.06 | C |
| ATOM | 5238 | C | GLY | X | 42 | −36.772 | 90.514 | −16.194 | 1.00 | 47.15 | C |
| ATOM | 5239 | O | GLY | X | 42 | −37.474 | 90.080 | −15.269 | 1.00 | 47.29 | O |
| ATOM | 5240 | N | THR | X | 43 | −35.830 | 89.759 | −16.760 | 1.00 | 42.87 | N |
| ATOM | 5241 | CA | THR | X | 43 | −35.594 | 88.390 | −16.295 | 1.00 | 41.60 | C |
| ATOM | 5242 | C | THR | X | 43 | −34.125 | 88.218 | −15.937 | 1.00 | 34.86 | C |
| ATOM | 5243 | O | THR | X | 43 | −33.283 | 89.070 | −16.225 | 1.00 | 35.66 | O |
| ATOM | 5244 | CB | THR | X | 43 | −35.966 | 87.300 | −17.340 | 1.00 | 38.72 | C |
| ATOM | 5245 | OG1 | THR | X | 43 | −34.965 | 87.232 | −18.372 | 1.00 | 37.04 | O |
| ATOM | 5246 | CG2 | THR | X | 43 | −37.299 | 87.578 | −18.007 | 1.00 | 39.86 | C |
| ATOM | 5247 | N | ALA | X | 44 | −33.838 | 87.056 | −15.351 | 1.00 | 36.79 | N |
| ATOM | 5248 | CA | ALA | X | 44 | −32.495 | 86.614 | −15.069 | 1.00 | 33.26 | C |
| ATOM | 5249 | C | ALA | X | 44 | −31.804 | 86.190 | −16.368 | 1.00 | 34.93 | C |
| ATOM | 5250 | O | ALA | X | 44 | −32.466 | 85.879 | −17.358 | 1.00 | 32.13 | O |
| ATOM | 5251 | CB | ALA | X | 44 | −32.537 | 85.449 | −14.085 | 1.00 | 29.97 | C |
| ATOM | 5252 | N | PRO | X | 45 | −30.470 | 86.187 | −16.399 | 1.00 | 31.73 | N |
| ATOM | 5253 | CA | PRO | X | 45 | −29.779 | 85.591 | −17.540 | 1.00 | 29.03 | C |
| ATOM | 5254 | C | PRO | X | 45 | −30.152 | 84.124 | −17.700 | 1.00 | 32.97 | C |
| ATOM | 5255 | O | PRO | X | 45 | −30.631 | 83.455 | −16.779 | 1.00 | 27.00 | O |
| ATOM | 5256 | CB | PRO | X | 45 | −28.294 | 85.750 | −17.187 | 1.00 | 29.30 | C |
| ATOM | 5257 | CG | PRO | X | 45 | −28.267 | 86.928 | −16.262 | 1.00 | 32.14 | C |
| ATOM | 5258 | CD | PRO | X | 45 | −29.524 | 86.784 | −15.442 | 1.00 | 28.71 | C |
| ATOM | 5259 | N | LYS | X | 46 | −29.905 | 83.624 | −18.898 | 1.00 | 28.36 | N |
| ATOM | 5260 | CA | LYS | X | 46 | −30.155 | 82.237 | −19.238 | 1.00 | 34.68 | C |
| ATOM | 5261 | C | LYS | X | 46 | −29.009 | 81.792 | −20.131 | 1.00 | 35.47 | C |
| ATOM | 5262 | O | LYS | X | 46 | −28.503 | 82.593 | −20.930 | 1.00 | 27.61 | O |
| ATOM | 5263 | CB | LYS | X | 46 | −31.500 | 82.135 | −19.949 | 1.00 | 31.10 | C |
| ATOM | 5264 | CG | LYS | X | 46 | −31.750 | 80.915 | −20.700 | 1.00 | 41.49 | C |
| ATOM | 5265 | CD | LYS | X | 46 | −32.725 | 81.196 | −21.858 | 1.00 | 47.60 | C |
| ATOM | 5266 | CE | LYS | X | 46 | −33.943 | 81.979 | −21.420 | 1.00 | 48.37 | C |
| ATOM | 5267 | NZ | LYS | X | 46 | −35.081 | 81.729 | −22.345 | 1.00 | 49.13 | N1+ |
| ATOM | 5268 | N | LEU | X | 47 | −28.574 | 80.539 | −19.977 | 1.00 | 28.77 | N |
| ATOM | 5269 | CA | LEU | X | 47 | −27.546 | 80.027 | −20.872 | 1.00 | 24.97 | C |
| ATOM | 5270 | C | LEU | X | 47 | −28.138 | 79.828 | −22.264 | 1.00 | 32.77 | C |

TABLE 10.3-continued

| | | | | | | | | | | |
|---|---|---|---|---|---|---|---|---|---|---|
| ATOM | 5271 | O | LEU | X | 47 | −29.190 | 79.200 | −22.426 | 1.00 | 29.18 | O |
| ATOM | 5272 | CB | LEU | X | 47 | −26.955 | 78.730 | −20.347 | 1.00 | 26.07 | C |
| ATOM | 5273 | CG | LEU | X | 47 | −25.872 | 78.105 | −21.231 | 1.00 | 29.09 | C |
| ATOM | 5274 | CD1 | LEU | X | 47 | −24.689 | 79.042 | −21.402 | 1.00 | 29.03 | C |
| ATOM | 5275 | CD2 | LEU | X | 47 | −25.420 | 76.789 | −20.647 | 1.00 | 27.90 | C |
| ATOM | 5276 | N | LEU | X | 48 | −27.482 | 80.418 | −23.260 | 1.00 | 30.28 | N |
| ATOM | 5277 | CA | LEU | X | 48 | −27.901 | 80.361 | −24.651 | 1.00 | 33.70 | C |
| ATOM | 5278 | C | LEU | X | 48 | −27.075 | 79.352 | −25.441 | 1.00 | 38.84 | C |
| ATOM | 5279 | O | LEU | X | 48 | −27.633 | 78.536 | −26.179 | 1.00 | 35.80 | O |
| ATOM | 5280 | CB | LEU | X | 48 | −27.787 | 81.757 | −25.286 | 1.00 | 30.10 | C |
| ATOM | 5281 | CG | LEU | X | 48 | −28.388 | 81.949 | −26.684 | 1.00 | 36.25 | C |
| ATOM | 5282 | CD1 | LEU | X | 48 | −29.916 | 81.905 | −26.686 | 1.00 | 29.13 | C |
| ATOM | 5283 | CD2 | LEU | X | 48 | −27.887 | 83.232 | −27.342 | 1.00 | 32.77 | C |
| ATOM | 5284 | N | LEU | X | 49 | −25.749 | 79.397 | −25.279 | 1.00 | 38.10 | N |
| ATOM | 5285 | CA | LEU | X | 49 | −24.799 | 78.535 | −25.968 | 1.00 | 29.61 | C |
| ATOM | 5286 | C | LEU | X | 49 | −23.642 | 78.253 | −25.028 | 1.00 | 31.16 | C |
| ATOM | 5287 | O | LEU | X | 49 | −23.153 | 79.160 | −24.352 | 1.00 | 32.51 | O |
| ATOM | 5288 | CB | LEU | X | 49 | −24.241 | 79.177 | −27.235 | 1.00 | 29.50 | C |
| ATOM | 5289 | CG | LEU | X | 49 | −25.158 | 79.484 | −28.410 | 1.00 | 35.20 | C |
| ATOM | 5290 | CD1 | LEU | X | 49 | −24.385 | 80.328 | −29.434 | 1.00 | 32.31 | C |
| ATOM | 5291 | CD2 | LEU | X | 49 | −25.624 | 78.172 | −29.024 | 1.00 | 29.29 | C |
| ATOM | 5292 | N | TYR | X | 50 | −23.204 | 77.003 | −24.983 | 1.00 | 27.72 | N |
| ATOM | 5293 | CA | TYR | X | 50 | −21.976 | 76.679 | −24.285 | 1.00 | 28.60 | C |
| ATOM | 5294 | C | TYR | X | 50 | −21.037 | 75.963 | −25.242 | 1.00 | 30.23 | C |
| ATOM | 5295 | O | TYR | X | 50 | −21.429 | 75.569 | −26.346 | 1.00 | 31.08 | O |
| ATOM | 5296 | CB | TYR | X | 50 | −22.250 | 75.864 | −23.018 | 1.00 | 28.65 | C |
| ATOM | 5297 | CG | TYR | X | 50 | −22.900 | 74.531 | −23.227 | 1.00 | 33.55 | C |
| ATOM | 5298 | CD1 | TYR | X | 50 | −24.246 | 74.422 | −23.613 | 1.00 | 37.48 | C |
| ATOM | 5299 | CD2 | TYR | X | 50 | −22.196 | 73.384 | −22.985 | 1.00 | 29.14 | C |
| ATOM | 5300 | CE1 | TYR | X | 50 | −24.833 | 73.183 | −23.799 | 1.00 | 34.48 | C |
| ATOM | 5301 | CE2 | TYR | X | 50 | −22.768 | 72.149 | −23.152 | 1.00 | 39.17 | C |
| ATOM | 5302 | CZ | TYR | X | 50 | −24.076 | 72.041 | −23.550 | 1.00 | 38.17 | C |
| ATOM | 5303 | OH | TYR | X | 50 | −24.590 | 70.771 | −23.700 | 1.00 | 35.08 | O |
| ATOM | 5304 | N | ASP | X | 51 | −19.768 | 75.877 | −24.840 | 1.00 | 31.56 | N |
| ATOM | 5305 | CA | ASP | X | 51 | −18.698 | 75.390 | −25.713 | 1.00 | 29.21 | C |
| ATOM | 5306 | C | ASP | X | 51 | −18.816 | 76.000 | −27.122 | 1.00 | 34.44 | C |
| ATOM | 5307 | O | ASP | X | 51 | −18.908 | 75.308 | −28.144 | 1.00 | 31.23 | O |
| ATOM | 5308 | CB | ASP | X | 51 | −18.699 | 73.865 | −25.753 | 1.00 | 30.93 | C |
| ATOM | 5309 | CG | ASP | X | 51 | −17.509 | 73.308 | −26.507 | 1.00 | 34.52 | C |
| ATOM | 5310 | OD1 | ASP | X | 51 | −16.467 | 74.009 | −26.589 | 1.00 | 38.97 | O |
| ATOM | 5311 | OD2 | ASP | X | 51 | −17.633 | 72.187 | −27.047 | 1.00 | 37.63 | O1− |
| ATOM | 5312 | N | SER | X | 52 | −18.882 | 77.333 | −27.151 | 1.00 | 29.36 | N |
| ATOM | 5313 | CA | SER | X | 52 | −18.957 | 78.121 | −28.379 | 1.00 | 32.69 | C |
| ATOM | 5314 | C | SER | X | 52 | −20.258 | 77.970 | −29.163 | 1.00 | 32.50 | C |
| ATOM | 5315 | O | SER | X | 52 | −20.805 | 78.977 | −29.637 | 1.00 | 32.67 | O |
| ATOM | 5316 | CB | SER | X | 52 | −17.781 | 77.808 | −29.305 | 1.00 | 32.99 | C |
| ATOM | 5317 | OG | SER | X | 52 | −16.569 | 78.277 | −28.744 | 1.00 | 42.26 | O |
| ATOM | 5318 | N | ASN | X | 53 | −20.772 | 76.746 | −29.333 | 1.00 | 31.33 | N |
| ATOM | 5319 | CA | ASN | X | 53 | −21.880 | 76.604 | −30.271 | 1.00 | 33.53 | C |
| ATOM | 5320 | C | ASN | X | 53 | −22.896 | 75.532 | −29.886 | 1.00 | 36.41 | C |
| ATOM | 5321 | O | ASN | X | 53 | −23.725 | 75.172 | −30.735 | 1.00 | 34.64 | O |
| ATOM | 5322 | CB | ASN | X | 53 | −21.326 | 76.305 | −31.671 | 1.00 | 29.24 | C |
| ATOM | 5323 | CG | ASN | X | 53 | −20.625 | 74.953 | −31.730 | 1.00 | 38.39 | C |
| ATOM | 5324 | OD1 | ASN | X | 53 | −20.519 | 74.254 | −30.721 | 1.00 | 35.56 | O |
| ATOM | 5325 | ND2 | ASN | X | 53 | −20.163 | 74.573 | −32.906 | 1.00 | 35.38 | N |
| ATOM | 5326 | N | LYS | X | 54 | −22.879 | 75.013 | −28.657 | 1.00 | 37.93 | N |
| ATOM | 5327 | CA | LYS | X | 54 | −23.821 | 73.978 | −28.239 | 1.00 | 37.84 | C |
| ATOM | 5328 | C | LYS | X | 54 | −25.063 | 74.592 | −27.605 | 1.00 | 33.93 | C |
| ATOM | 5329 | O | LYS | X | 54 | −24.957 | 75.380 | −26.656 | 1.00 | 33.00 | O |
| ATOM | 5330 | CB | LYS | X | 54 | −23.165 | 73.014 | −27.250 | 1.00 | 34.82 | C |
| ATOM | 5331 | CG | LYS | X | 54 | −24.025 | 71.814 | −26.907 | 1.00 | 36.40 | C |
| ATOM | 5332 | CD | LYS | X | 54 | −24.191 | 70.937 | −28.131 | 1.00 | 37.62 | C |
| ATOM | 5333 | CE | LYS | X | 54 | −25.209 | 69.832 | −27.894 | 1.00 | 33.30 | C |
| ATOM | 5334 | NZ | LYS | X | 54 | −25.145 | 68.918 | −29.053 | 1.00 | 47.57 | N1+ |
| ATOM | 5335 | N | AARG | X | 55 | −26.235 | 74.212 | −28.121 | 0.50 | 35.72 | N |
| ATOM | 5336 | CA | AARG | X | 55 | −27.511 | 74.703 | −27.600 | 0.50 | 37.84 | C |
| ATOM | 5337 | C | AARG | X | 55 | −27.955 | 73.849 | −26.418 | 0.50 | 37.19 | C |
| ATOM | 5338 | O | AARG | X | 55 | −28.052 | 72.622 | −26.555 | 0.50 | 39.62 | O |
| ATOM | 5339 | CB | AARG | X | 55 | −28.585 | 74.683 | −28.683 | 0.50 | 35.53 | C |
| ATOM | 5340 | CG | AARG | X | 55 | −28.487 | 75.808 | −29.722 | 0.50 | 38.76 | C |
| ATOM | 5341 | CD | AARG | X | 55 | −29.610 | 75.753 | −30.781 | 0.50 | 37.60 | C |
| ATOM | 5342 | NE | AARG | X | 55 | −29.427 | 74.636 | −31.705 | 0.50 | 42.24 | N |
| ATOM | 5343 | CZ | AARG | X | 55 | −30.198 | 73.555 | −31.759 | 0.50 | 40.39 | C |
| ATOM | 5344 | NH1 | AARG | X | 55 | −29.919 | 72.598 | −32.628 | 0.50 | 43.66 | N1+ |
| ATOM | 5345 | NH2 | AARG | X | 55 | −31.248 | 73.434 | −30.961 | 0.50 | 39.76 | N |
| ATOM | 5346 | N | BARG | X | 55 | −26.235 | 74.213 | −28.110 | 0.50 | 35.73 | N |
| ATOM | 5347 | CA | BARG | X | 55 | −27.499 | 74.742 | −27.594 | 0.50 | 37.86 | C |
| ATOM | 5348 | C | BARG | X | 55 | −27.999 | 73.875 | −26.441 | 0.50 | 37.17 | C |
| ATOM | 5349 | O | BARG | X | 55 | −28.165 | 72.661 | −26.619 | 0.50 | 39.65 | O |
| ATOM | 5350 | CB | BARG | X | 55 | −28.548 | 74.810 | −28.701 | 0.50 | 35.58 | C |

TABLE 10.3-continued

| | | | | | | | | | | |
|---|---|---|---|---|---|---|---|---|---|---|
| ATOM | 5351 | CG | BARG | X | 55 | −28.335 | 75.971 | −29.695 | 0.50 | 38.67 | C |
| ATOM | 5352 | CD | BARG | X | 55 | −29.274 | 75.940 | −30.919 | 0.50 | 37.26 | C |
| ATOM | 5353 | NE | BARG | X | 55 | −28.921 | 74.866 | −31.845 | 0.50 | 42.86 | N |
| ATOM | 5354 | CZ | BARG | X | 55 | −28.062 | 74.983 | −32.859 | 0.50 | 43.30 | C |
| ATOM | 5355 | NH1 | BARG | X | 55 | −27.465 | 76.140 | −33.108 | 0.50 | 28.23 | N1+ |
| ATOM | 5356 | NH2 | BARG | X | 55 | −27.803 | 73.928 | −33.632 | 0.50 | 47.26 | N |
| ATOM | 5357 | N | PRO | X | 56 | −28.209 | 74.432 | −25.251 | 1.00 | 39.61 | N |
| ATOM | 5358 | CA | PRO | X | 56 | −28.924 | 73.683 | −24.208 | 1.00 | 37.27 | C |
| ATOM | 5359 | C | PRO | X | 56 | −30.328 | 73.384 | −24.708 | 1.00 | 37.17 | C |
| ATOM | 5360 | O | PRO | X | 56 | −30.836 | 74.048 | −25.614 | 1.00 | 35.06 | O |
| ATOM | 5361 | CB | PRO | X | 56 | −28.960 | 74.643 | −23.020 | 1.00 | 32.87 | C |
| ATOM | 5362 | CG | PRO | X | 56 | −28.041 | 75.768 | −23.374 | 1.00 | 39.79 | C |
| ATOM | 5363 | CD | PRO | X | 56 | −27.841 | 75.794 | −24.846 | 1.00 | 34.03 | C |
| ATOM | 5364 | N | SER | X | 57 | −30.973 | 72.378 | −24.127 | 1.00 | 35.37 | N |
| ATOM | 5365 | CA | SER | X | 57 | −32.324 | 72.095 | −24.603 | 1.00 | 45.77 | C |
| ATOM | 5366 | C | SER | X | 57 | −33.240 | 73.271 | −24.286 | 1.00 | 39.53 | C |
| ATOM | 5367 | O | SER | X | 57 | −33.082 | 73.960 | −23.274 | 1.00 | 42.51 | O |
| ATOM | 5368 | CB | SER | X | 57 | −32.860 | 70.777 | −24.033 | 1.00 | 44.76 | C |
| ATOM | 5369 | OG | SER | X | 57 | −32.486 | 70.611 | −22.686 | 1.00 | 57.37 | O |
| ATOM | 5370 | N | GLY | X | 58 | −34.149 | 73.551 | −25.208 | 1.00 | 46.11 | N |
| ATOM | 5371 | CA | GLY | X | 58 | −35.017 | 74.704 | −25.108 | 1.00 | 38.41 | C |
| ATOM | 5372 | C | GLY | X | 58 | −34.575 | 75.906 | −25.915 | 1.00 | 46.36 | C |
| ATOM | 5373 | O | GLY | X | 58 | −35.360 | 76.846 | −26.056 | 1.00 | 47.75 | O |
| ATOM | 5374 | N | ILE | X | 59 | −33.356 | 75.916 | −26.442 | 1.00 | 38.47 | N |
| ATOM | 5375 | CA | ILE | X | 59 | −32.858 | 77.042 | −27.231 | 1.00 | 39.45 | C |
| ATOM | 5376 | C | ILE | X | 59 | −33.096 | 76.740 | −28.706 | 1.00 | 38.36 | C |
| ATOM | 5377 | O | ILE | X | 59 | −32.567 | 75.743 | −29.218 | 1.00 | 41.39 | O |
| ATOM | 5378 | CB | ILE | X | 59 | −31.372 | 77.301 | −26.950 | 1.00 | 41.60 | C |
| ATOM | 5379 | CG1 | ILE | X | 59 | −31.165 | 77.604 | −25.460 | 1.00 | 39.46 | C |
| ATOM | 5380 | CG2 | ILE | X | 59 | −30.858 | 78.449 | −27.839 | 1.00 | 36.16 | C |
| ATOM | 5381 | CD1 | ILE | X | 59 | −31.957 | 78.855 | −24.970 | 1.00 | 33.58 | C |
| ATOM | 5382 | N | PRO | X | 60 | −33.829 | 77.583 | −29.429 | 1.00 | 38.04 | N |
| ATOM | 5383 | CA | PRO | X | 60 | −34.124 | 77.311 | −30.841 | 1.00 | 40.67 | C |
| ATOM | 5384 | C | PRO | X | 60 | −32.877 | 77.315 | −31.712 | 1.00 | 41.79 | C |
| ATOM | 5385 | O | PRO | X | 60 | −31.899 | 78.020 | −31.439 | 1.00 | 39.12 | O |
| ATOM | 5386 | CB | PRO | X | 60 | −35.047 | 78.468 | −31.240 | 1.00 | 37.50 | C |
| ATOM | 5387 | CG | PRO | X | 60 | −35.340 | 79.184 | −30.024 | 1.00 | 40.79 | C |
| ATOM | 5388 | CD | PRO | X | 60 | −34.325 | 78.891 | −29.004 | 1.00 | 41.33 | C |
| ATOM | 5389 | N | ALA | X | 61 | −32.956 | 76.574 | −32.821 | 1.00 | 41.88 | N |
| ATOM | 5390 | CA | ALA | X | 61 | −31.816 | 76.464 | −33.727 | 1.00 | 41.28 | C |
| ATOM | 5391 | C | ALA | X | 61 | −31.500 | 77.762 | −34.449 | 1.00 | 37.80 | C |
| ATOM | 5392 | O | ALA | X | 61 | −30.440 | 77.855 | −35.066 | 1.00 | 37.27 | O |
| ATOM | 5393 | CB | ALA | X | 61 | −32.043 | 75.362 | −34.759 | 1.00 | 34.30 | C |
| ATOM | 5394 | N | ARG | X | 62 | −32.356 | 78.779 | −34.366 | 1.00 | 38.43 | N |
| ATOM | 5395 | CA | ARG | X | 62 | −31.978 | 80.019 | −35.031 | 1.00 | 42.28 | C |
| ATOM | 5396 | C | ARG | X | 62 | −30.888 | 80.776 | −34.273 | 1.00 | 39.16 | C |
| ATOM | 5397 | O | ARG | X | 62 | −30.360 | 81.763 | −34.795 | 1.00 | 42.60 | O |
| ATOM | 5398 | CB | ARG | X | 62 | −33.215 | 80.894 | −35.260 | 1.00 | 40.18 | C |
| ATOM | 5399 | CG | ARG | X | 62 | −33.956 | 81.319 | −34.029 | 1.00 | 45.22 | C |
| ATOM | 5400 | CD | ARG | X | 62 | −35.169 | 82.228 | −34.403 | 1.00 | 57.00 | C |
| ATOM | 5401 | NE | ARG | X | 62 | −35.710 | 82.874 | −33.214 | 1.00 | 45.98 | N |
| ATOM | 5402 | CZ | ARG | X | 62 | −36.485 | 82.241 | −32.345 | 1.00 | 47.84 | C |
| ATOM | 5403 | NH1 | ARG | X | 62 | −36.807 | 80.976 | −32.560 | 1.00 | 50.34 | N1+ |
| ATOM | 5404 | NH2 | ARG | X | 62 | −36.923 | 82.855 | −31.261 | 1.00 | 51.21 | N |
| ATOM | 5405 | N | PHE | X | 63 | −30.522 | 80.330 | −33.074 | 1.00 | 40.25 | N |
| ATOM | 5406 | CA | PHE | X | 63 | −29.323 | 80.816 | −32.410 | 1.00 | 41.09 | C |
| ATOM | 5407 | C | PHE | X | 63 | −28.171 | 79.886 | −32.756 | 1.00 | 41.66 | C |
| ATOM | 5408 | O | PHE | X | 63 | −28.299 | 78.666 | −32.622 | 1.00 | 35.82 | O |
| ATOM | 5409 | CB | PHE | X | 63 | −29.510 | 80.887 | −30.891 | 1.00 | 33.46 | C |
| ATOM | 5410 | CG | PHE | X | 63 | −30.586 | 81.832 | −30.473 | 1.00 | 36.45 | C |
| ATOM | 5411 | CD1 | PHE | X | 63 | −30.310 | 83.184 | −30.280 | 1.00 | 39.83 | C |
| ATOM | 5412 | CD2 | PHE | X | 63 | −31.884 | 81.377 | −30.287 | 1.00 | 34.93 | C |
| ATOM | 5413 | CE1 | PHE | X | 63 | −31.325 | 84.085 | −29.906 | 1.00 | 36.05 | C |
| ATOM | 5414 | CE2 | PHE | X | 63 | −32.889 | 82.251 | −29.923 | 1.00 | 38.93 | C |
| ATOM | 5415 | CZ | PHE | X | 63 | −32.614 | 83.614 | −29.734 | 1.00 | 35.26 | C |
| ATOM | 5416 | N | SER | X | 64 | −27.053 | 80.455 | −33.207 | 1.00 | 33.96 | N |
| ATOM | 5417 | CA | SER | X | 64 | −25.866 | 79.646 | −33.436 | 1.00 | 36.60 | C |
| ATOM | 5418 | C | SER | X | 64 | −24.626 | 80.455 | −33.101 | 1.00 | 33.97 | C |
| ATOM | 5419 | O | SER | X | 64 | −24.663 | 81.684 | −32.984 | 1.00 | 37.04 | O |
| ATOM | 5420 | CB | SER | X | 64 | −25.792 | 79.134 | −34.878 | 1.00 | 33.50 | C |
| ATOM | 5421 | OG | SER | X | 64 | −25.828 | 80.219 | −35.797 | 1.00 | 41.55 | O |
| ATOM | 5422 | N | GLY | X | 65 | −23.514 | 79.743 | −32.965 | 1.00 | 33.67 | N |
| ATOM | 5423 | CA | GLY | X | 65 | −22.271 | 80.366 | −32.569 | 1.00 | 32.37 | C |
| ATOM | 5424 | C | GLY | X | 65 | −21.099 | 79.800 | −33.342 | 1.00 | 37.26 | C |
| ATOM | 5425 | O | GLY | X | 65 | −21.144 | 78.694 | −33.885 | 1.00 | 37.56 | O |
| ATOM | 5426 | N | SER | X | 66 | −20.044 | 80.596 | −33.386 | 1.00 | 36.95 | N |
| ATOM | 5427 | CA | SER | X | 66 | −18.782 | 80.154 | −33.937 | 1.00 | 39.89 | C |
| ATOM | 5428 | C | SER | X | 66 | −17.675 | 80.805 | −33.137 | 1.00 | 38.97 | C |
| ATOM | 5429 | O | SER | X | 66 | −17.884 | 81.794 | −32.427 | 1.00 | 42.94 | O |
| ATOM | 5430 | CB | SER | X | 66 | −18.645 | 80.521 | −35.416 | 1.00 | 43.54 | C |

TABLE 10.3-continued

| | | | | | | | | | | |
|---|---|---|---|---|---|---|---|---|---|---|
| ATOM | 5431 | OG | SER | X | 66 | −18.842 | 81.914 | −35.579 | 1.00 | 44.16 | O |
| ATOM | 5432 | N | LYS | X | 67 | −16.493 | 80.236 | −33.268 | 1.00 | 37.88 | N |
| ATOM | 5433 | CA | LYS | X | 67 | −15.318 | 80.724 | −32.578 | 1.00 | 38.71 | C |
| ATOM | 5434 | C | LYS | X | 67 | −14.182 | 80.683 | −33.584 | 1.00 | 41.62 | C |
| ATOM | 5435 | O | LYS | X | 67 | −14.049 | 79.712 | −34.332 | 1.00 | 36.78 | O |
| ATOM | 5436 | CB | LYS | X | 67 | −14.996 | 79.866 | −31.337 | 1.00 | 34.63 | C |
| ATOM | 5437 | CG | LYS | X | 67 | −13.718 | 80.278 | −30.577 | 1.00 | 39.36 | C |
| ATOM | 5438 | CD | LYS | X | 67 | −13.483 | 79.408 | −29.335 | 1.00 | 43.58 | C |
| ATOM | 5439 | CE | LYS | X | 67 | −12.029 | 79.470 | −28.865 | 1.00 | 49.06 | C |
| ATOM | 5440 | NZ | LYS | X | 67 | −11.798 | 78.829 | −27.509 | 1.00 | 45.19 | N1+ |
| ATOM | 5441 | N | SER | X | 68 | −13.372 | 81.733 | −33.603 | 1.00 | 32.64 | N |
| ATOM | 5442 | CA | SER | X | 68 | −12.213 | 81.766 | −34.484 | 1.00 | 39.05 | C |
| ATOM | 5443 | C | SER | X | 68 | −11.107 | 82.533 | −33.774 | 1.00 | 44.53 | C |
| ATOM | 5444 | O | SER | X | 68 | −11.196 | 83.760 | −33.617 | 1.00 | 37.82 | O |
| ATOM | 5445 | CB | SER | X | 68 | −12.578 | 82.412 | −35.816 | 1.00 | 40.60 | C |
| ATOM | 5446 | OG | SER | X | 68 | −11.432 | 82.493 | −36.637 | 1.00 | 69.58 | O |
| ATOM | 5447 | N | GLY | X | 69 | −10.073 | 81.825 | −33.344 | 1.00 | 41.45 | N |
| ATOM | 5448 | CA | GLY | X | 69 | −8.973 | 82.520 | −32.683 | 1.00 | 38.45 | C |
| ATOM | 5449 | C | GLY | X | 69 | −9.424 | 83.162 | −31.382 | 1.00 | 38.09 | C |
| ATOM | 5450 | O | GLY | X | 69 | −9.944 | 82.493 | −30.485 | 1.00 | 40.05 | O |
| ATOM | 5451 | N | THR | X | 70 | −9.248 | 84.479 | −31.260 | 1.00 | 38.95 | N |
| ATOM | 5452 | CA | THR | X | 70 | −9.575 | 85.191 | −30.033 | 1.00 | 31.37 | C |
| ATOM | 5453 | C | THR | X | 70 | −10.914 | 85.919 | −30.101 | 1.00 | 36.24 | C |
| ATOM | 5454 | O | THR | X | 70 | −11.192 | 86.796 | −29.271 | 1.00 | 37.77 | O |
| ATOM | 5455 | CB | THR | X | 70 | −8.458 | 86.171 | −29.692 | 1.00 | 36.81 | C |
| ATOM | 5456 | OG1 | THR | X | 70 | −8.349 | 87.134 | −30.744 | 1.00 | 30.74 | O |
| ATOM | 5457 | CG2 | THR | X | 70 | −7.134 | 85.414 | −29.544 | 1.00 | 25.19 | C |
| ATOM | 5458 | N | SER | X | 71 | −11.765 | 85.574 | −31.048 | 1.00 | 37.57 | N |
| ATOM | 5459 | CA | SER | X | 71 | −13.081 | 86.175 | −31.072 | 1.00 | 38.07 | C |
| ATOM | 5460 | C | SER | X | 71 | −14.125 | 85.082 | −31.262 | 1.00 | 38.54 | C |
| ATOM | 5461 | O | SER | X | 71 | −13.834 | 83.992 | −31.759 | 1.00 | 37.91 | O |
| ATOM | 5462 | CB | SER | X | 71 | −13.185 | 87.249 | −32.162 | 1.00 | 40.23 | C |
| ATOM | 5463 | OG | SER | X | 71 | −13.241 | 86.662 | −33.448 | 1.00 | 48.33 | O |
| ATOM | 5464 | N | ALA | X | 72 | −15.344 | 85.387 | −30.821 | 1.00 | 30.70 | N |
| ATOM | 5465 | CA | ALA | X | 72 | −16.491 | 84.505 | −30.944 | 1.00 | 32.65 | C |
| ATOM | 5466 | C | ALA | X | 72 | −17.649 | 85.344 | −31.464 | 1.00 | 33.91 | C |
| ATOM | 5467 | O | ALA | X | 72 | −17.724 | 86.538 | −31.199 | 1.00 | 35.37 | O |
| ATOM | 5468 | CB | ALA | X | 72 | −16.847 | 83.861 | −29.596 | 1.00 | 28.85 | C |
| ATOM | 5469 | N | ATHR | X | 73 | −18.543 | 84.722 | −32.219 | 0.60 | 34.81 | N |
| ATOM | 5470 | CA | ATHR | X | 73 | −19.686 | 85.428 | −32.781 | 0.60 | 36.26 | C |
| ATOM | 5471 | C | ATHR | X | 73 | −20.968 | 84.644 | −32.530 | 0.60 | 38.23 | C |
| ATOM | 5472 | O | ATHR | X | 73 | −21.021 | 83.423 | −32.730 | 0.60 | 36.94 | O |
| ATOM | 5473 | CB | ATHR | X | 73 | −19.528 | 85.662 | −34.285 | 0.60 | 37.26 | C |
| ATOM | 5474 | OG1 | ATHR | X | 73 | −19.317 | 84.403 | −34.929 | 0.60 | 39.56 | O |
| ATOM | 5475 | CG2 | ATHR | X | 73 | −18.350 | 86.575 | −34.575 | 0.60 | 38.40 | C |
| ATOM | 5476 | N | BTHR | X | 73 | −18.549 | 84.710 | −32.211 | 0.40 | 34.91 | N |
| ATOM | 5477 | CA | BTHR | X | 73 | −19.684 | 85.400 | −32.812 | 0.40 | 36.39 | C |
| ATOM | 5478 | C | BTHR | X | 73 | −20.970 | 84.636 | −32.529 | 0.40 | 38.11 | C |
| ATOM | 5479 | O | BTHR | X | 73 | −21.026 | 83.413 | −32.708 | 0.40 | 36.77 | O |
| ATOM | 5480 | CB | BTHR | X | 73 | −19.509 | 85.557 | −34.327 | 0.40 | 37.24 | C |
| ATOM | 5481 | OG1 | BTHR | X | 73 | −18.230 | 86.138 | −34.608 | 0.40 | 37.63 | O |
| ATOM | 5482 | CG2 | BTHR | X | 73 | −20.620 | 86.434 | −34.910 | 0.40 | 32.90 | C |
| ATOM | 5483 | N | LEU | X | 74 | −21.997 | 85.359 | −32.097 | 1.00 | 35.38 | N |
| ATOM | 5484 | CA | LEU | X | 74 | −23.326 | 84.804 | −31.943 | 1.00 | 34.79 | C |
| ATOM | 5485 | C | LEU | X | 74 | −24.147 | 85.205 | −33.156 | 1.00 | 36.97 | C |
| ATOM | 5486 | O | LEU | X | 74 | −24.156 | 86.379 | −33.545 | 1.00 | 33.92 | O |
| ATOM | 5487 | CB | LEU | X | 74 | −23.986 | 85.314 | −30.665 | 1.00 | 32.61 | C |
| ATOM | 5488 | CG | LEU | X | 74 | −25.507 | 85.206 | −30.626 | 1.00 | 31.72 | C |
| ATOM | 5489 | CD1 | LEU | X | 74 | −25.882 | 83.725 | −30.473 | 1.00 | 30.32 | C |
| ATOM | 5490 | CD2 | LEU | X | 74 | −26.036 | 86.026 | −29.454 | 1.00 | 27.99 | C |
| ATOM | 5491 | N | GLY | X | 75 | −24.840 | 84.247 | −33.745 | 1.00 | 36.52 | N |
| ATOM | 5492 | CA | GLY | X | 75 | −25.703 | 84.512 | −34.884 | 1.00 | 34.24 | C |
| ATOM | 5493 | C | GLY | X | 75 | −27.148 | 84.242 | −34.527 | 1.00 | 37.87 | C |
| ATOM | 5494 | O | GLY | X | 75 | −27.451 | 83.245 | −33.871 | 1.00 | 37.63 | O |
| ATOM | 5495 | N | ILE | X | 76 | −28.035 | 85.141 | −34.957 | 1.00 | 39.75 | N |
| ATOM | 5496 | CA | ILE | X | 76 | −29.479 | 84.985 | −34.802 | 1.00 | 41.67 | C |
| ATOM | 5497 | C | ILE | X | 76 | −30.121 | 85.182 | −36.168 | 1.00 | 42.37 | C |
| ATOM | 5498 | O | ILE | X | 76 | −30.094 | 86.290 | −36.715 | 1.00 | 44.35 | O |
| ATOM | 5499 | CB | ILE | X | 76 | −30.078 | 85.974 | −33.790 | 1.00 | 40.33 | C |
| ATOM | 5500 | CG1 | ILE | X | 76 | −29.186 | 86.075 | −32.552 | 1.00 | 41.66 | C |
| ATOM | 5501 | CG2 | ILE | X | 76 | −31.481 | 85.526 | −33.397 | 1.00 | 35.42 | C |
| ATOM | 5502 | CD1 | ILE | X | 76 | −29.726 | 86.959 | −31.465 | 1.00 | 37.72 | C |
| ATOM | 5503 | N | THR | X | 77 | −30.686 | 84.119 | −36.725 | 1.00 | 43.91 | N |
| ATOM | 5504 | CA | THR | X | 77 | −31.472 | 84.236 | −37.948 | 1.00 | 48.21 | C |
| ATOM | 5505 | C | THR | X | 77 | −32.958 | 84.232 | −37.615 | 1.00 | 43.41 | C |
| ATOM | 5506 | O | THR | X | 77 | −33.376 | 83.754 | −36.561 | 1.00 | 53.87 | O |
| ATOM | 5507 | CB | THR | X | 77 | −31.176 | 83.090 | −38.915 | 1.00 | 48.60 | C |
| ATOM | 5508 | OG1 | THR | X | 77 | −31.675 | 81.879 | −38.346 | 1.00 | 50.81 | O |
| ATOM | 5509 | CG2 | THR | X | 77 | −29.695 | 82.947 | −39.136 | 1.00 | 39.95 | C |
| ATOM | 5510 | N | GLY | X | 78 | −33.757 | 84.758 | −38.536 | 1.00 | 46.47 | N |

TABLE 10.3-continued

| | | | | | | | | | | |
|---|---|---|---|---|---|---|---|---|---|---|
| ATOM | 5511 | CA | GLY | X | 78 | −35.202 | 84.734 | −38.389 | 1.00 | 39.22 | C |
| ATOM | 5512 | C | GLY | X | 78 | −35.720 | 85.391 | −37.128 | 1.00 | 45.27 | C |
| ATOM | 5513 | O | GLY | X | 78 | −36.522 | 84.791 | −36.407 | 1.00 | 43.17 | O |
| ATOM | 5514 | N | LEU | X | 79 | −35.270 | 86.624 | −36.870 | 1.00 | 46.54 | N |
| ATOM | 5515 | CA | LEU | X | 79 | −35.555 | 87.331 | −35.624 | 1.00 | 38.18 | C |
| ATOM | 5516 | C | LEU | X | 79 | −37.039 | 87.325 | −35.285 | 1.00 | 35.99 | C |
| ATOM | 5517 | O | LEU | X | 79 | −37.888 | 87.609 | −36.131 | 1.00 | 36.59 | O |
| ATOM | 5518 | CB | LEU | X | 79 | −35.059 | 88.776 | −35.730 | 1.00 | 39.04 | C |
| ATOM | 5519 | CG | LEU | X | 79 | −33.807 | 89.295 | −34.996 | 1.00 | 40.52 | C |
| ATOM | 5520 | CD1 | LEU | X | 79 | −33.440 | 88.520 | −33.740 | 1.00 | 39.26 | C |
| ATOM | 5521 | CD2 | LEU | X | 79 | −32.618 | 89.397 | −35.910 | 1.00 | 54.14 | C |
| ATOM | 5522 | N | GLN | X | 80 | −37.345 | 87.044 | −34.026 | 1.00 | 38.14 | N |
| ATOM | 5523 | CA | GLN | X | 80 | −38.697 | 87.144 | −33.497 | 1.00 | 39.98 | C |
| ATOM | 5524 | C | GLN | X | 80 | −38.700 | 88.184 | −32.389 | 1.00 | 41.62 | C |
| ATOM | 5525 | O | GLN | X | 80 | −37.668 | 88.422 | −31.753 | 1.00 | 36.20 | O |
| ATOM | 5526 | CB | GLN | X | 80 | −39.186 | 85.813 | −32.942 | 1.00 | 33.25 | C |
| ATOM | 5527 | CG | GLN | X | 80 | −39.044 | 84.680 | −33.904 | 1.00 | 43.46 | C |
| ATOM | 5528 | CD | GLN | X | 80 | −39.580 | 83.358 | −33.355 | 1.00 | 50.00 | C |
| ATOM | 5529 | OE1 | GLN | X | 80 | −39.521 | 82.335 | −34.031 | 1.00 | 49.67 | O |
| ATOM | 5530 | NE2 | GLN | X | 80 | −40.101 | 83.378 | −32.131 | 1.00 | 47.24 | N |
| ATOM | 5531 | N | THR | X | 81 | −39.865 | 88.806 | −32.161 | 1.00 | 42.32 | N |
| ATOM | 5532 | CA | THR | X | 81 | −39.935 | 89.865 | −31.159 | 1.00 | 40.35 | C |
| ATOM | 5533 | C | THR | X | 81 | −39.450 | 89.373 | −29.794 | 1.00 | 36.41 | C |
| ATOM | 5534 | O | THR | X | 81 | −38.817 | 90.132 | −29.050 | 1.00 | 35.09 | O |
| ATOM | 5535 | CB | THR | X | 81 | −41.369 | 90.415 | −31.067 | 1.00 | 40.85 | C |
| ATOM | 5536 | OG1 | THR | X | 81 | −42.261 | 89.347 | −30.772 | 1.00 | 57.82 | O |
| ATOM | 5537 | CG2 | THR | X | 81 | −41.798 | 90.998 | −32.377 | 1.00 | 43.15 | C |
| ATOM | 5538 | N | GLY | X | 82 | −39.684 | 88.094 | −29.474 | 1.00 | 36.68 | N |
| ATOM | 5539 | CA | GLY | X | 82 | −39.232 | 87.486 | −28.236 | 1.00 | 28.64 | C |
| ATOM | 5540 | C | GLY | X | 82 | −37.724 | 87.287 | −28.129 | 1.00 | 37.77 | C |
| ATOM | 5541 | O | GLY | X | 82 | −37.248 | 86.752 | −27.124 | 1.00 | 34.17 | O |
| ATOM | 5542 | N | ASP | X | 83 | −36.959 | 87.652 | −29.150 | 1.00 | 30.06 | N |
| ATOM | 5543 | CA | ASP | X | 83 | −35.509 | 87.630 | −29.043 | 1.00 | 32.84 | C |
| ATOM | 5544 | C | ASP | X | 83 | −34.923 | 88.941 | −28.517 | 1.00 | 34.01 | C |
| ATOM | 5545 | O | ASP | X | 83 | −33.729 | 88.984 | −28.208 | 1.00 | 31.84 | O |
| ATOM | 5546 | CB | ASP | X | 83 | −34.907 | 87.303 | −30.404 | 1.00 | 31.73 | C |
| ATOM | 5547 | CG | ASP | X | 83 | −35.427 | 85.990 | −30.952 | 1.00 | 41.54 | C |
| ATOM | 5548 | OD1 | ASP | X | 83 | −35.746 | 85.088 | −30.133 | 1.00 | 36.80 | O |
| ATOM | 5549 | OD2 | ASP | X | 83 | −35.522 | 85.868 | −32.194 | 1.00 | 42.52 | O1− |
| ATOM | 5550 | N | GLU | X | 84 | −35.724 | 90.002 | −28.424 | 1.00 | 31.24 | N |
| ATOM | 5551 | CA | GLU | X | 84 | −35.262 | 91.272 | −27.871 | 1.00 | 37.59 | C |
| ATOM | 5552 | C | GLU | X | 84 | −34.719 | 91.031 | −26.459 | 1.00 | 32.26 | C |
| ATOM | 5553 | O | GLU | X | 84 | −35.402 | 90.452 | −25.609 | 1.00 | 35.56 | O |
| ATOM | 5554 | CB | GLU | X | 84 | −36.416 | 92.283 | −27.890 | 1.00 | 30.20 | C |
| ATOM | 5555 | CG | GLU | X | 84 | −36.070 | 93.629 | −27.345 | 1.00 | 45.30 | C |
| ATOM | 5556 | CD | GLU | X | 84 | −36.947 | 94.775 | −27.890 | 1.00 | 45.92 | C |
| ATOM | 5557 | OE1 | GLU | X | 84 | −37.343 | 95.625 | −27.064 | 1.00 | 55.26 | O |
| ATOM | 5558 | OE2 | GLU | X | 84 | −37.238 | 94.832 | −29.112 | 1.00 | 39.84 | O1− |
| ATOM | 5559 | N | ALA | X | 85 | −33.455 | 91.385 | −26.241 | 1.00 | 33.55 | N |
| ATOM | 5560 | CA | ALA | X | 85 | −32.741 | 90.944 | −25.047 | 1.00 | 30.96 | C |
| ATOM | 5561 | C | ALA | X | 85 | −31.361 | 91.575 | −25.034 | 1.00 | 28.54 | C |
| ATOM | 5562 | O | ALA | X | 85 | −30.916 | 92.168 | −26.021 | 1.00 | 32.81 | O |
| ATOM | 5563 | CB | ALA | X | 85 | −32.594 | 89.409 | −24.997 | 1.00 | 30.64 | C |
| ATOM | 5564 | N | ASP | X | 86 | −30.680 | 91.413 | −23.903 | 1.00 | 29.41 | N |
| ATOM | 5565 | CA | ASP | X | 86 | −29.249 | 91.647 | −23.793 | 1.00 | 31.96 | C |
| ATOM | 5566 | C | ASP | X | 86 | −28.504 | 90.322 | −23.884 | 1.00 | 32.23 | C |
| ATOM | 5567 | O | ASP | X | 86 | −28.925 | 89.318 | −23.303 | 1.00 | 33.09 | O |
| ATOM | 5568 | CB | ASP | X | 86 | −28.907 | 92.357 | −22.482 | 1.00 | 33.01 | C |
| ATOM | 5569 | CG | ASP | X | 86 | −29.599 | 93.708 | −22.367 | 1.00 | 39.16 | C |
| ATOM | 5570 | OD1 | ASP | X | 86 | −29.651 | 94.437 | −23.368 | 1.00 | 40.13 | O |
| ATOM | 5571 | OD2 | ASP | X | 86 | −30.101 | 94.037 | −21.280 | 1.00 | 48.35 | O1− |
| ATOM | 5572 | N | TYR | X | 87 | −27.386 | 90.329 | −24.599 | 1.00 | 31.45 | N |
| ATOM | 5573 | CA | TYR | X | 87 | −26.601 | 89.129 | −24.842 | 1.00 | 28.71 | C |
| ATOM | 5574 | C | TYR | X | 87 | −25.182 | 89.374 | −24.358 | 1.00 | 32.26 | C |
| ATOM | 5575 | O | TYR | X | 87 | −24.609 | 90.435 | −24.628 | 1.00 | 31.02 | O |
| ATOM | 5576 | CB | TYR | X | 87 | −26.621 | 88.762 | −26.326 | 1.00 | 26.11 | C |
| ATOM | 5577 | CG | TYR | X | 87 | −28.002 | 88.352 | −26.816 | 1.00 | 30.12 | C |
| ATOM | 5578 | CD1 | TYR | X | 87 | −28.925 | 89.305 | −27.224 | 1.00 | 29.60 | C |
| ATOM | 5579 | CD2 | TYR | X | 87 | −28.378 | 87.014 | −26.863 | 1.00 | 28.20 | C |
| ATOM | 5580 | CE1 | TYR | X | 87 | −30.188 | 88.932 | −27.678 | 1.00 | 34.26 | C |
| ATOM | 5581 | CE2 | TYR | X | 87 | −29.626 | 86.630 | −27.320 | 1.00 | 32.08 | C |
| ATOM | 5582 | CZ | TYR | X | 87 | −30.527 | 87.596 | −27.726 | 1.00 | 34.03 | C |
| ATOM | 5583 | OH | TYR | X | 87 | −31.777 | 87.223 | −28.150 | 1.00 | 31.35 | O |
| ATOM | 5584 | N | TYR | X | 88 | −24.632 | 88.394 | −23.642 | 1.00 | 29.11 | N |
| ATOM | 5585 | CA | TYR | X | 88 | −23.311 | 88.458 | −23.036 | 1.00 | 28.65 | C |
| ATOM | 5586 | C | TYR | X | 88 | −22.534 | 87.201 | −23.398 | 1.00 | 32.64 | C |
| ATOM | 5587 | O | TYR | X | 88 | −23.054 | 86.084 | −23.241 | 1.00 | 32.58 | O |
| ATOM | 5588 | CB | TYR | X | 88 | −23.408 | 88.547 | −21.508 | 1.00 | 27.95 | C |
| ATOM | 5589 | CG | TYR | X | 88 | −24.118 | 89.757 | −20.959 | 1.00 | 30.42 | C |
| ATOM | 5590 | CD1 | TYR | X | 88 | −25.501 | 89.759 | −20.792 | 1.00 | 28.19 | C |

TABLE 10.3-continued

| | | | | | | | | | | |
|---|---|---|---|---|---|---|---|---|---|---|
| ATOM | 5591 | CD2 | TYR | X | 88 | −23.401 | 90.890 | −20.574 | 1.00 | 31.06 | C |
| ATOM | 5592 | CE1 | TYR | X | 88 | −26.162 | 90.867 | −20.275 | 1.00 | 27.13 | C |
| ATOM | 5593 | CE2 | TYR | X | 88 | −24.041 | 92.005 | −20.067 | 1.00 | 32.77 | C |
| ATOM | 5594 | CZ | TYR | X | 88 | −25.424 | 91.989 | −19.920 | 1.00 | 36.54 | C |
| ATOM | 5595 | OH | TYR | X | 88 | −26.055 | 93.090 | −19.405 | 1.00 | 30.95 | O |
| ATOM | 5596 | N | CYS | X | 89 | −21.287 | 87.372 | −23.833 | 1.00 | 28.04 | N |
| ATOM | 5597 | CA | CYS | X | 89 | −20.334 | 86.269 | −23.902 | 1.00 | 28.74 | C |
| ATOM | 5598 | C | CYS | X | 89 | −19.528 | 86.212 | −22.607 | 1.00 | 32.37 | C |
| ATOM | 5599 | O | CYS | X | 89 | −19.378 | 87.212 | −21.902 | 1.00 | 35.41 | O |
| ATOM | 5600 | CB | CYS | X | 89 | −19.378 | 86.436 | −25.082 | 1.00 | 33.37 | C |
| ATOM | 5601 | SG | CYS | X | 89 | −18.463 | 88.060 | −25.073 | 1.00 | 43.75 | S |
| ATOM | 5602 | N | GLY | X | 90 | −19.005 | 85.032 | −22.303 | 1.00 | 32.61 | N |
| ATOM | 5603 | CA | GLY | X | 90 | −18.237 | 84.821 | −21.083 | 1.00 | 31.53 | C |
| ATOM | 5604 | C | GLY | X | 90 | −17.235 | 83.695 | −21.244 | 1.00 | 33.08 | C |
| ATOM | 5605 | O | GLY | X | 90 | −17.445 | 82.767 | −22.030 | 1.00 | 35.81 | O |
| ATOM | 5606 | N | THR | X | 91 | −16.107 | 83.816 | −20.531 | 1.00 | 25.99 | N |
| ATOM | 5607 | CA | THR | X | 91 | −15.089 | 82.778 | −20.428 | 1.00 | 29.82 | C |
| ATOM | 5608 | C | THR | X | 91 | −14.309 | 82.951 | −19.143 | 1.00 | 31.29 | C |
| ATOM | 5609 | O | THR | X | 91 | −14.533 | 83.878 | −18.365 | 1.00 | 34.63 | O |
| ATOM | 5610 | CB | THR | X | 91 | −13.968 | 82.816 | −21.479 | 1.00 | 38.46 | C |
| ATOM | 5611 | OG1 | THR | X | 91 | −14.245 | 83.717 | −22.547 | 1.00 | 45.88 | O |
| ATOM | 5612 | CG2 | THR | X | 91 | −13.680 | 81.476 | −21.973 | 1.00 | 27.98 | C |
| ATOM | 5613 | N | TRP | X | 92 | −13.306 | 82.097 | −19.016 | 1.00 | 27.25 | N |
| ATOM | 5614 | CA | TRP | X | 92 | −12.219 | 82.230 | −18.077 | 1.00 | 29.16 | C |
| ATOM | 5615 | C | TRP | X | 92 | −11.070 | 83.003 | −18.714 | 1.00 | 32.78 | C |
| ATOM | 5616 | O | TRP | X | 92 | −10.800 | 82.873 | −19.912 | 1.00 | 30.90 | O |
| ATOM | 5617 | CB | TRP | X | 92 | −11.757 | 80.836 | −17.670 | 1.00 | 27.36 | C |
| ATOM | 5618 | CG | TRP | X | 92 | −10.715 | 80.810 | −16.612 | 1.00 | 35.33 | C |
| ATOM | 5619 | CD1 | TRP | X | 92 | −9.392 | 80.455 | −16.757 | 1.00 | 34.95 | C |
| ATOM | 5620 | CD2 | TRP | X | 92 | −10.900 | 81.116 | −15.227 | 1.00 | 34.91 | C |
| ATOM | 5621 | NE1 | TRP | X | 92 | −8.751 | 80.510 | −15.535 | 1.00 | 33.88 | N |
| ATOM | 5622 | CE2 | TRP | X | 92 | −9.647 | 80.927 | −14.584 | 1.00 | 35.68 | C |
| ATOM | 5623 | CE3 | TRP | X | 92 | −11.998 | 81.527 | −14.465 | 1.00 | 29.27 | C |
| ATOM | 5624 | CZ2 | TRP | X | 92 | −9.471 | 81.141 | −13.221 | 1.00 | 32.90 | C |
| ATOM | 5625 | CZ3 | TRP | X | 92 | −11.821 | 81.740 | −13.107 | 1.00 | 30.95 | C |
| ATOM | 5626 | CH2 | TRP | X | 92 | −10.571 | 81.542 | −12.498 | 1.00 | 36.18 | C |
| ATOM | 5627 | N | ASP | X | 93 | −10.389 | 83.802 | −17.915 | 1.00 | 34.71 | N |
| ATOM | 5628 | CA | ASP | X | 93 | −9.143 | 84.431 | −18.340 | 1.00 | 35.49 | C |
| ATOM | 5629 | C | ASP | X | 93 | −8.004 | 83.809 | −17.537 | 1.00 | 35.61 | C |
| ATOM | 5630 | O | ASP | X | 93 | −7.912 | 84.013 | −16.322 | 1.00 | 38.60 | O |
| ATOM | 5631 | CB | ASP | X | 93 | −9.192 | 85.940 | −18.151 | 1.00 | 30.03 | C |
| ATOM | 5632 | CG | ASP | X | 93 | −8.045 | 86.639 | −18.857 | 1.00 | 39.44 | C |
| ATOM | 5633 | OD1 | ASP | X | 93 | −6.878 | 86.282 | −18.573 | 1.00 | 37.16 | O1− |
| ATOM | 5634 | OD2 | ASP | X | 93 | −8.317 | 87.531 | −19.701 | 1.00 | 32.36 | O |
| ATOM | 5635 | N | SER | X | 94 | −7.137 | 83.061 | −18.223 | 1.00 | 33.93 | N |
| ATOM | 5636 | CA | SER | X | 94 | −6.072 | 82.302 | −17.571 | 1.00 | 37.23 | C |
| ATOM | 5637 | C | SER | X | 94 | −5.010 | 83.199 | −16.958 | 1.00 | 43.27 | C |
| ATOM | 5638 | O | SER | X | 94 | −4.321 | 82.779 | −16.024 | 1.00 | 47.17 | O |
| ATOM | 5639 | CB | SER | X | 94 | −5.415 | 81.337 | −18.557 | 1.00 | 35.59 | C |
| ATOM | 5640 | OG | SER | X | 94 | −6.349 | 80.369 | −19.056 | 1.00 | 47.61 | O |
| ATOM | 5641 | N | SER | X | 95 | −4.851 | 84.415 | −17.456 | 1.00 | 36.82 | N |
| ATOM | 5642 | CA | SER | X | 95 | −3.842 | 85.284 | −16.877 | 1.00 | 40.13 | C |
| ATOM | 5643 | C | SER | X | 95 | −4.390 | 86.199 | −15.784 | 1.00 | 43.12 | C |
| ATOM | 5644 | O | SER | X | 95 | −3.652 | 86.546 | −14.858 | 1.00 | 44.13 | O |
| ATOM | 5645 | CB | SER | X | 95 | −3.177 | 86.104 | −17.979 | 1.00 | 38.64 | C |
| ATOM | 5646 | OG | SER | X | 95 | −3.953 | 87.241 | −18.283 | 1.00 | 52.16 | O |
| ATOM | 5647 | N | LEU | X | 96 | −5.653 | 86.623 | −15.858 | 1.00 | 49.30 | N |
| ATOM | 5648 | CA | LEU | X | 96 | −6.260 | 87.359 | −14.750 | 1.00 | 41.53 | C |
| ATOM | 5649 | C | LEU | X | 96 | −6.849 | 86.436 | −13.685 | 1.00 | 36.33 | C |
| ATOM | 5650 | O | LEU | X | 96 | −7.332 | 86.925 | −12.663 | 1.00 | 40.59 | O |
| ATOM | 5651 | CB | LEU | X | 96 | −7.345 | 88.299 | −15.263 | 1.00 | 31.21 | C |
| ATOM | 5652 | CG | LEU | X | 96 | −6.975 | 89.345 | −16.315 | 1.00 | 35.69 | C |
| ATOM | 5653 | CD1 | LEU | X | 96 | −8.257 | 89.972 | −16.878 | 1.00 | 32.73 | C |
| ATOM | 5654 | CD2 | LEU | X | 96 | −6.072 | 90.443 | −15.740 | 1.00 | 33.32 | C |
| ATOM | 5655 | N | ASN | X | 97 | −6.819 | 85.128 | −13.908 | 1.00 | 33.69 | N |
| ATOM | 5656 | CA | ASN | X | 97 | −7.457 | 84.113 | −13.054 | 1.00 | 40.52 | C |
| ATOM | 5657 | C | ASN | X | 97 | −8.862 | 84.515 | −12.585 | 1.00 | 37.02 | C |
| ATOM | 5658 | O | ASN | X | 97 | −9.170 | 84.528 | −11.394 | 1.00 | 38.37 | O |
| ATOM | 5659 | CB | ASN | X | 97 | −6.566 | 83.762 | −11.863 | 1.00 | 40.15 | C |
| ATOM | 5660 | CG | ASN | X | 97 | −5.793 | 82.485 | −12.103 | 1.00 | 56.68 | C |
| ATOM | 5661 | OD1 | ASN | X | 97 | −6.057 | 81.431 | −11.474 | 1.00 | 58.82 | O |
| ATOM | 5662 | ND2 | ASN | X | 97 | −4.866 | 82.541 | −13.069 | 1.00 | 45.20 | N |
| ATOM | 5663 | N | THR | X | 98 | −9.736 | 84.807 | −13.551 | 1.00 | 33.40 | N |
| ATOM | 5664 | CA | THR | X | 98 | −11.086 | 85.225 | −13.198 | 1.00 | 36.45 | C |
| ATOM | 5665 | C | THR | X | 98 | −12.042 | 84.934 | −14.345 | 1.00 | 31.02 | C |
| ATOM | 5666 | O | THR | X | 98 | −11.637 | 84.809 | −15.497 | 1.00 | 29.12 | O |
| ATOM | 5667 | CB | THR | X | 98 | −11.138 | 86.713 | −12.830 | 1.00 | 32.72 | C |
| ATOM | 5668 | OG1 | THR | X | 98 | −12.455 | 87.038 | −12.382 | 1.00 | 37.61 | O |
| ATOM | 5669 | CG2 | THR | X | 98 | −10.840 | 87.569 | −14.031 | 1.00 | 32.00 | C |
| ATOM | 5670 | N | VAL | X | 99 | −13.326 | 84.815 | −14.005 | 1.00 | 30.06 | N |

TABLE 10.3-continued

| | | | | | | | | | | |
|---|---|---|---|---|---|---|---|---|---|---|
| ATOM | 5671 | CA | VAL | X | 99 | −14.358 | 84.769 | −15.027 | 1.00 | 24.45 | C |
| ATOM | 5672 | C | VAL | X | 99 | −14.563 | 86.160 | −15.611 | 1.00 | 29.75 | C |
| ATOM | 5673 | O | VAL | X | 99 | −14.620 | 87.174 | −14.897 | 1.00 | 26.93 | O |
| ATOM | 5674 | CB | VAL | X | 99 | −15.680 | 84.233 | −14.460 | 1.00 | 28.00 | C |
| ATOM | 5675 | CG1 | VAL | X | 99 | −16.739 | 84.291 | −15.532 | 1.00 | 26.99 | C |
| ATOM | 5676 | CG2 | VAL | X | 99 | −15.525 | 82.801 | −13.869 | 1.00 | 29.57 | C |
| ATOM | 5677 | N | VAL | X | 100 | −14.775 | 86.208 | −16.906 | 1.00 | 29.21 | N |
| ATOM | 5678 | CA | VAL | X | 100 | −14.748 | 87.464 | −17.623 | 1.00 | 28.67 | C |
| ATOM | 5679 | C | VAL | X | 100 | −15.948 | 87.512 | −18.574 | 1.00 | 32.26 | C |
| ATOM | 5680 | O | VAL | X | 100 | −16.225 | 86.546 | −19.296 | 1.00 | 33.30 | O |
| ATOM | 5681 | CB | VAL | X | 100 | −13.355 | 87.559 | −18.285 | 1.00 | 34.89 | C |
| ATOM | 5682 | CG1 | VAL | X | 100 | −13.294 | 87.188 | −19.773 | 1.00 | 28.07 | C |
| ATOM | 5683 | CG2 | VAL | X | 100 | −12.657 | 88.799 | −17.889 | 1.00 | 30.67 | C |
| ATOM | 5684 | N | PHE | X | 101 | −16.709 | 88.599 | −18.512 | 1.00 | 29.76 | N |
| ATOM | 5685 | CA | PHE | X | 101 | −17.876 | 88.803 | −19.365 | 1.00 | 37.29 | C |
| ATOM | 5686 | C | PHE | X | 101 | −17.634 | 89.939 | −20.348 | 1.00 | 33.64 | C |
| ATOM | 5687 | O | PHE | X | 101 | −16.940 | 90.913 | −20.039 | 1.00 | 36.04 | O |
| ATOM | 5688 | CB | PHE | X | 101 | −19.138 | 89.186 | −18.567 | 1.00 | 33.79 | C |
| ATOM | 5689 | CG | PHE | X | 101 | −19.780 | 88.069 | −17.808 | 1.00 | 32.73 | C |
| ATOM | 5690 | CD1 | PHE | X | 101 | −20.482 | 87.064 | −18.464 | 1.00 | 38.68 | C |
| ATOM | 5691 | CD2 | PHE | X | 101 | −19.729 | 88.057 | −16.407 | 1.00 | 31.51 | C |
| ATOM | 5692 | CE1 | PHE | X | 101 | −21.114 | 86.044 | −17.743 | 1.00 | 34.99 | C |
| ATOM | 5693 | CE2 | PHE | X | 101 | −20.345 | 87.044 | −15.674 | 1.00 | 28.97 | C |
| ATOM | 5694 | CZ | PHE | X | 101 | −21.040 | 86.028 | −16.349 | 1.00 | 30.18 | C |
| ATOM | 5695 | N | GLY | X | 102 | −18.283 | 89.846 | −21.507 | 1.00 | 31.53 | N |
| ATOM | 5696 | CA | GLY | X | 102 | −18.420 | 91.004 | −22.354 | 1.00 | 30.93 | C |
| ATOM | 5697 | C | GLY | X | 102 | −19.343 | 92.039 | −21.708 | 1.00 | 38.01 | C |
| ATOM | 5698 | O | GLY | X | 102 | −20.047 | 91.780 | −20.724 | 1.00 | 32.78 | O |
| ATOM | 5699 | N | GLY | X | 103 | −19.311 | 93.246 | −22.272 | 1.00 | 29.12 | N |
| ATOM | 5700 | CA | GLY | X | 103 | −20.117 | 94.353 | −21.794 | 1.00 | 29.37 | C |
| ATOM | 5701 | C | GLY | X | 103 | −21.583 | 94.244 | −22.120 | 1.00 | 33.08 | C |
| ATOM | 5702 | O | GLY | X | 103 | −22.376 | 95.015 | −21.576 | 1.00 | 35.44 | O |
| ATOM | 5703 | N | GLY | X | 104 | −21.964 | 93.300 | −22.974 | 1.00 | 34.27 | N |
| ATOM | 5704 | CA | GLY | X | 104 | −23.358 | 93.149 | −23.326 | 1.00 | 29.50 | C |
| ATOM | 5705 | C | GLY | X | 104 | −23.731 | 93.836 | −24.619 | 1.00 | 29.53 | C |
| ATOM | 5706 | O | GLY | X | 104 | −23.197 | 94.891 | −24.951 | 1.00 | 32.35 | O |
| ATOM | 5707 | N | THR | X | 105 | −24.636 | 93.220 | −25.369 | 1.00 | 34.88 | N |
| ATOM | 5708 | CA | THR | X | 105 | −25.182 | 93.780 | −26.591 | 1.00 | 32.20 | C |
| ATOM | 5709 | C | THR | X | 105 | −26.689 | 93.826 | −26.424 | 1.00 | 34.52 | C |
| ATOM | 5710 | O | THR | X | 105 | −27.326 | 92.787 | −26.221 | 1.00 | 32.97 | O |
| ATOM | 5711 | CB | THR | X | 105 | −24.791 | 92.943 | −27.812 | 1.00 | 30.26 | C |
| ATOM | 5712 | OG1 | THR | X | 105 | −23.367 | 92.949 | −27.935 | 1.00 | 36.62 | O |
| ATOM | 5713 | CG2 | THR | X | 105 | −25.397 | 93.520 | −29.084 | 1.00 | 27.38 | C |
| ATOM | 5714 | N | LYS | X | 106 | −27.246 | 95.027 | −26.490 | 1.00 | 33.22 | N |
| ATOM | 5715 | CA | LYS | X | 106 | −28.686 | 95.209 | −26.472 | 1.00 | 35.13 | C |
| ATOM | 5716 | C | LYS | X | 106 | −29.210 | 94.955 | −27.877 | 1.00 | 32.47 | C |
| ATOM | 5717 | O | LYS | X | 106 | −28.824 | 95.647 | −28.822 | 1.00 | 37.14 | O |
| ATOM | 5718 | CB | LYS | X | 106 | −29.035 | 96.619 | −26.001 | 1.00 | 33.00 | C |
| ATOM | 5719 | CG | LYS | X | 106 | −30.515 | 96.974 | −26.093 | 1.00 | 40.50 | C |
| ATOM | 5720 | CD | LYS | X | 106 | −30.760 | 98.406 | −25.536 | 1.00 | 50.00 | C |
| ATOM | 5721 | CE | LYS | X | 106 | −32.202 | 98.919 | −25.776 | 1.00 | 54.95 | C |
| ATOM | 5722 | NZ | LYS | X | 106 | −33.307 | 98.040 | −25.259 | 1.00 | 53.87 | N1+ |
| ATOM | 5723 | N | LEU | X | 107 | −30.039 | 93.941 | −28.022 | 1.00 | 31.69 | N |
| ATOM | 5724 | CA | LEU | X | 107 | −30.702 | 93.641 | −29.282 | 1.00 | 35.95 | C |
| ATOM | 5725 | C | LEU | X | 107 | −32.109 | 94.195 | −29.217 | 1.00 | 34.06 | C |
| ATOM | 5726 | O | LEU | X | 107 | −32.890 | 93.810 | −28.335 | 1.00 | 36.06 | O |
| ATOM | 5727 | CB | LEU | X | 107 | −30.764 | 92.135 | −29.542 | 1.00 | 29.30 | C |
| ATOM | 5728 | CG | LEU | X | 107 | −31.101 | 91.566 | −30.925 | 1.00 | 36.45 | C |
| ATOM | 5729 | CD1 | LEU | X | 107 | −31.582 | 90.117 | −30.792 | 1.00 | 47.08 | C |
| ATOM | 5730 | CD2 | LEU | X | 107 | −32.108 | 92.310 | −31.732 | 1.00 | 35.75 | C |
| ATOM | 5731 | N | ATHR | X | 108 | −32.447 | 95.068 | −30.150 | 0.50 | 29.34 | N |
| ATOM | 5732 | CA | ATHR | X | 108 | −33.819 | 95.519 | −30.281 | 0.50 | 34.47 | C |
| ATOM | 5733 | C | ATHR | X | 108 | −34.372 | 94.993 | −31.598 | 0.50 | 34.43 | C |
| ATOM | 5734 | O | ATHR | X | 108 | −33.730 | 95.114 | −32.645 | 0.50 | 33.84 | O |
| ATOM | 5735 | CB | ATHR | X | 108 | −33.929 | 97.050 | −30.167 | 0.50 | 35.43 | C |
| ATOM | 5736 | OG1 | ATHR | X | 108 | −34.721 | 97.575 | −31.244 | 0.50 | 39.77 | O |
| ATOM | 5737 | CG2 | ATHR | X | 108 | −32.553 | 97.713 | −30.114 | 0.50 | 36.64 | C |
| ATOM | 5738 | N | BTHR | X | 108 | −32.435 | 95.083 | −30.149 | 0.50 | 28.73 | N |
| ATOM | 5739 | CA | BTHR | X | 108 | −33.795 | 95.559 | −30.334 | 0.50 | 34.59 | C |
| ATOM | 5740 | C | BTHR | X | 108 | −34.344 | 94.934 | −31.610 | 0.50 | 34.22 | C |
| ATOM | 5741 | O | BTHR | X | 108 | −33.682 | 94.959 | −32.651 | 0.50 | 33.77 | O |
| ATOM | 5742 | CB | BTHR | X | 108 | −33.864 | 97.095 | −30.407 | 0.50 | 35.40 | C |
| ATOM | 5743 | OG1 | BTHR | X | 108 | −33.311 | 97.671 | −29.217 | 0.50 | 29.14 | O |
| ATOM | 5744 | CG2 | BTHR | X | 108 | −35.332 | 97.571 | −30.561 | 0.50 | 36.81 | C |
| ATOM | 5745 | N | VAL | X | 109 | −35.533 | 94.354 | −31.521 | 1.00 | 34.56 | N |
| ATOM | 5746 | CA | VAL | X | 109 | −36.242 | 93.847 | −32.687 | 1.00 | 37.76 | C |
| ATOM | 5747 | C | VAL | X | 109 | −37.211 | 94.947 | −33.124 | 1.00 | 37.56 | C |
| ATOM | 5748 | O | VAL | X | 109 | −38.195 | 95.233 | −32.435 | 1.00 | 39.51 | O |
| ATOM | 5749 | CB | VAL | X | 109 | −36.957 | 92.526 | −32.370 | 1.00 | 36.89 | C |
| ATOM | 5750 | CG1 | VAL | X | 109 | −37.657 | 91.986 | −33.592 | 1.00 | 37.00 | C |

TABLE 10.3-continued

| | | | | | | | | | | | |
|---|---|---|---|---|---|---|---|---|---|---|---|
| ATOM | 5751 | CG2 | VAL | X | 109 | −35.944 | 91.498 | −31.854 | 1.00 | 35.12 | C |
| ATOM | 5752 | N | LEU | X | 110 | −36.903 | 95.596 | −34.249 | 1.00 | 40.19 | N |
| ATOM | 5753 | CA | LEU | X | 110 | −37.598 | 96.804 | −34.693 | 1.00 | 37.97 | C |
| ATOM | 5754 | C | LEU | X | 110 | −39.089 | 96.596 | −34.915 | 1.00 | 42.37 | C |
| ATOM | 5755 | O | LEU | X | 110 | −39.492 | 95.862 | −35.816 | 1.00 | 42.06 | O |
| ATOM | 5756 | CB | LEU | X | 110 | −36.952 | 97.330 | −35.974 | 1.00 | 32.89 | C |
| ATOM | 5757 | CG | LEU | X | 110 | −35.483 | 97.738 | −35.777 | 1.00 | 44.78 | C |
| ATOM | 5758 | CD1 | LEU | X | 110 | −34.740 | 97.954 | −37.095 | 1.00 | 36.15 | C |
| ATOM | 5759 | CD2 | LEU | X | 110 | −35.451 | 98.999 | −34.936 | 1.00 | 37.61 | C |
| ATOM | 5760 | N | SER | X | 111 | −39.923 | 97.222 | −34.090 | 1.00 | 44.41 | N |
| ATOM | 5761 | CA | SER | X | 111 | −41.366 | 97.119 | −34.268 | 1.00 | 50.21 | C |
| ATOM | 5762 | C | SER | X | 111 | −42.007 | 98.460 | −34.601 | 1.00 | 49.69 | C |
| ATOM | 5763 | O | SER | X | 111 | −43.235 | 98.560 | −34.605 | 1.00 | 52.76 | O |
| ATOM | 5764 | CB | SER | X | 111 | −42.017 | 96.500 | −33.028 | 1.00 | 44.40 | C |
| ATOM | 5765 | OG | SER | X | 111 | −41.726 | 97.270 | −31.878 | 1.00 | 60.88 | O |
| ATOM | 5766 | N | GLN | X | 112 | −41.211 | 99.487 | −34.878 | 1.00 | 47.15 | N |
| ATOM | 5767 | CA | GLN | X | 112 | −41.707 | 100.757 | −35.390 | 1.00 | 48.33 | C |
| ATOM | 5768 | C | GLN | X | 112 | −40.538 | 101.473 | −36.048 | 1.00 | 46.20 | C |
| ATOM | 5769 | O | GLN | X | 112 | −39.389 | 101.022 | −35.937 | 1.00 | 50.86 | O |
| ATOM | 5770 | CB | GLN | X | 112 | −42.328 | 101.613 | −34.268 | 1.00 | 45.44 | C |
| ATOM | 5771 | CG | GLN | X | 112 | −41.332 | 102.017 | −33.210 | 1.00 | 54.29 | C |
| ATOM | 5772 | CD | GLN | X | 112 | −41.921 | 102.957 | −32.174 | 1.00 | 55.17 | C |
| ATOM | 5773 | OE1 | GLN | X | 112 | −42.268 | 102.535 | −31.064 | 1.00 | 50.12 | O |
| ATOM | 5774 | NE2 | GLN | X | 112 | −42.016 | 104.247 | −32.523 | 1.00 | 51.29 | N |
| ATOM | 5775 | N | PRO | X | 113 | −40.791 | 102.573 | −36.760 | 1.00 | 47.86 | GZ00 N |
| ATOM | 5776 | CA | PRO | X | 113 | −39.684 | 103.305 | −37.392 | 1.00 | 44.33 | GZ00 C |
| ATOM | 5777 | C | PRO | X | 113 | −38.722 | 103.861 | −36.360 | 1.00 | 47.98 | GZ00 C |
| ATOM | 5778 | O | PRO | X | 113 | −39.099 | 104.165 | −35.229 | 1.00 | 51.31 | GZ00 O |
| ATOM | 5779 | CB | PRO | X | 113 | −40.386 | 104.439 | −38.148 | 1.00 | 44.96 | GZ00 C |
| ATOM | 5780 | CG | PRO | X | 113 | −41.754 | 103.943 | −38.377 | 1.00 | 46.92 | GZ00 C |
| ATOM | 5781 | CD | PRO | X | 113 | −42.098 | 103.123 | −37.162 | 1.00 | 47.64 | GZ00 C |
| ATOM | 5782 | N | LYS | X | 114 | −37.464 | 104.002 | −36.764 | 1.00 | 48.55 | GZ00 N |
| ATOM | 5783 | CA | LYS | X | 114 | −36.492 | 104.609 | −35.876 | 1.00 | 42.68 | GZ00 C |
| ATOM | 5784 | C | LYS | X | 114 | −36.864 | 106.065 | −35.628 | 1.00 | 49.83 | GZ00 C |
| ATOM | 5785 | O | LYS | X | 114 | −37.429 | 106.739 | −36.491 | 1.00 | 52.51 | GZ00 O |
| ATOM | 5786 | CB | LYS | X | 114 | −35.082 | 104.485 | −36.457 | 1.00 | 45.63 | GZ00 C |
| ATOM | 5787 | CG | LYS | X | 114 | −34.596 | 103.034 | −36.553 | 1.00 | 50.09 | GZ00 C |
| ATOM | 5788 | CD | LYS | X | 114 | −33.151 | 102.950 | −37.039 | 1.00 | 58.16 | GZ00 C |
| ATOM | 5789 | CE | LYS | X | 114 | −32.468 | 101.608 | −36.704 | 1.00 | 40.47 | GZ00 C |
| ATOM | 5790 | NZ | LYS | X | 114 | −30.975 | 101.802 | −36.780 | 1.00 | 37.72 | GZ00 N1+ |
| ATOM | 5791 | N | ALA | X | 115 | −36.559 | 106.540 | −34.424 | 1.00 | 48.82 | GZ00 N |
| ATOM | 5792 | CA | ALA | X | 115 | −36.951 | 107.875 | −33.987 | 1.00 | 42.61 | GZ00 C |
| ATOM | 5793 | C | ALA | X | 115 | −35.771 | 108.535 | −33.298 | 1.00 | 43.87 | GZ00 C |
| ATOM | 5794 | O | ALA | X | 115 | −35.255 | 108.014 | −32.302 | 1.00 | 42.55 | GZ00 O |
| ATOM | 5795 | CB | ALA | X | 115 | −38.151 | 107.809 | −33.040 | 1.00 | 37.00 | GZ00 C |
| ATOM | 5796 | N | ALA | X | 116 | −35.349 | 109.676 | −33.825 | 1.00 | 42.05 | GZ00 N |
| ATOM | 5797 | CA | ALA | X | 116 | −34.281 | 110.428 | −33.189 | 1.00 | 51.37 | GZ00 C |
| ATOM | 5798 | C | ALA | X | 116 | −34.776 | 111.034 | −31.871 | 1.00 | 46.85 | GZ00 C |
| ATOM | 5799 | O | ALA | X | 116 | −35.976 | 111.217 | −31.674 | 1.00 | 42.99 | GZ00 O |
| ATOM | 5800 | CB | ALA | X | 116 | −33.779 | 111.525 | −34.121 | 1.00 | 48.36 | GZ00 C |
| ATOM | 5801 | N | PRO | X | 117 | −33.881 | 111.279 | −30.922 | 1.00 | 47.49 | GZ00 N |
| ATOM | 5802 | CA | PRO | X | 117 | −34.320 | 111.846 | −29.642 | 1.00 | 49.41 | GZ00 C |
| ATOM | 5803 | C | PRO | X | 117 | −34.616 | 113.337 | −29.751 | 1.00 | 53.03 | GZ00 C |
| ATOM | 5804 | O | PRO | X | 117 | −33.903 | 114.088 | −30.426 | 1.00 | 49.88 | GZ00 O |
| ATOM | 5805 | CB | PRO | X | 117 | −33.120 | 111.582 | −28.721 | 1.00 | 48.21 | GZ00 C |
| ATOM | 5806 | CG | PRO | X | 117 | −31.929 | 111.617 | −29.651 | 1.00 | 40.15 | GZ00 C |
| ATOM | 5807 | CD | PRO | X | 117 | −32.431 | 110.999 | −30.939 | 1.00 | 47.80 | GZ00 C |
| ATOM | 5808 | N | SER | X | 118 | −35.660 | 113.776 | −29.048 | 1.00 | 43.61 | GZ00 N |
| ATOM | 5809 | CA | SER | X | 118 | −35.846 | 115.206 | −28.812 | 1.00 | 49.92 | GZ00 C |
| ATOM | 5810 | C | SER | X | 118 | −35.152 | 115.555 | −27.504 | 1.00 | 43.16 | GZ00 C |
| ATOM | 5811 | O | SER | X | 118 | −35.266 | 114.824 | −26.515 | 1.00 | 50.92 | GZ00 O |
| ATOM | 5812 | CB | SER | X | 118 | −37.325 | 115.608 | −28.770 | 1.00 | 47.75 | GZ00 C |
| ATOM | 5813 | OG | SER | X | 118 | −37.961 | 115.002 | −27.671 | 1.00 | 58.79 | GZ00 O |
| ATOM | 5814 | N | VAL | X | 119 | −34.377 | 116.627 | −27.528 | 1.00 | 41.52 | GZ00 N |
| ATOM | 5815 | CA | VAL | X | 119 | −33.512 | 117.022 | −26.426 | 1.00 | 44.89 | GZ00 C |
| ATOM | 5816 | C | VAL | X | 119 | −33.886 | 118.439 | −26.021 | 1.00 | 52.97 | GZ00 C |
| ATOM | 5817 | O | VAL | X | 119 | −33.914 | 119.338 | −26.869 | 1.00 | 55.14 | GZ00 O |
| ATOM | 5818 | CB | VAL | X | 119 | −32.030 | 116.957 | −26.837 | 1.00 | 42.97 | GZ00 C |
| ATOM | 5819 | CG1 | VAL | X | 119 | −31.122 | 117.319 | −25.668 | 1.00 | 42.13 | GZ00 C |
| ATOM | 5820 | CG2 | VAL | X | 119 | −31.694 | 115.590 | −27.416 | 1.00 | 46.14 | GZ00 C |
| ATOM | 5821 | N | THR | X | 120 | −34.183 | 118.644 | −24.741 | 1.00 | 53.84 | GZ00 N |
| ATOM | 5822 | CA | THR | X | 120 | −34.297 | 119.997 | −24.223 | 1.00 | 52.90 | GZ00 C |
| ATOM | 5823 | C | THR | X | 120 | −33.396 | 120.136 | −23.000 | 1.00 | 49.02 | GZ00 C |
| ATOM | 5824 | O | THR | X | 120 | −33.365 | 119.257 | −22.135 | 1.00 | 44.38 | GZ00 O |
| ATOM | 5825 | CB | THR | X | 120 | −35.779 | 120.402 | −23.935 | 1.00 | 46.21 | GZ00 C |
| ATOM | 5826 | OG1 | THR | X | 120 | −35.982 | 120.611 | −22.536 | 1.00 | 53.27 | GZ00 O |
| ATOM | 5827 | CG2 | THR | X | 120 | −36.767 | 119.365 | −24.468 | 1.00 | 51.58 | GZ00 C |
| ATOM | 5828 | N | LEU | X | 121 | −32.652 | 121.246 | −22.960 | 1.00 | 49.59 | GZ00 N |
| ATOM | 5829 | CA | LEU | X | 121 | −31.580 | 121.506 | −22.006 | 1.00 | 46.69 | GZ00 C |
| ATOM | 5830 | C | LEU | X | 121 | −31.926 | 122.718 | −21.147 | 1.00 | 49.22 | GZ00 C |

TABLE 10.3-continued

| ATOM | 5831 | O | LEU | X | 121 | −32.183 | 123.802 | −21.676 | 1.00 | 57.48 | GZ00 | O |
|---|---|---|---|---|---|---|---|---|---|---|---|---|
| ATOM | 5832 | CB | LEU | X | 121 | −30.282 | 121.762 | −22.756 | 1.00 | 42.85 | GZ00 | C |
| ATOM | 5833 | CG | LEU | X | 121 | −28.925 | 121.456 | −22.159 | 1.00 | 49.09 | GZ00 | C |
| ATOM | 5834 | CD1 | LEU | X | 121 | −27.908 | 122.373 | −22.827 | 1.00 | 42.63 | GZ00 | C |
| ATOM | 5835 | CD2 | LEU | X | 121 | −28.888 | 121.557 | −20.653 | 1.00 | 50.57 | GZ00 | C |
| ATOM | 5836 | N | PHE | X | 122 | −31.952 | 122.534 | −19.834 | 1.00 | 51.49 | GZ00 | N |
| ATOM | 5837 | CA | PHE | X | 122 | −32.197 | 123.630 | −18.917 | 1.00 | 48.21 | GZ00 | C |
| ATOM | 5838 | C | PHE | X | 122 | −30.914 | 124.009 | −18.215 | 1.00 | 52.42 | GZ00 | C |
| ATOM | 5839 | O | PHE | X | 122 | −30.201 | 123.122 | −17.727 | 1.00 | 47.78 | GZ00 | O |
| ATOM | 5840 | CB | PHE | X | 122 | −33.245 | 123.263 | −17.872 | 1.00 | 44.54 | GZ00 | C |
| ATOM | 5841 | CG | PHE | X | 122 | −34.637 | 123.136 | −18.419 | 1.00 | 55.06 | GZ00 | C |
| ATOM | 5842 | CD1 | PHE | X | 122 | −35.407 | 124.269 | −18.664 | 1.00 | 49.10 | GZ00 | C |
| ATOM | 5843 | CD2 | PHE | X | 122 | −35.197 | 121.885 | −18.648 | 1.00 | 51.91 | GZ00 | C |
| ATOM | 5844 | CE1 | PHE | X | 122 | −36.697 | 124.155 | −19.151 | 1.00 | 52.05 | GZ00 | C |
| ATOM | 5845 | CE2 | PHE | X | 122 | −36.487 | 121.766 | −19.133 | 1.00 | 44.48 | GZ00 | C |
| ATOM | 5846 | CZ | PHE | X | 122 | −37.238 | 122.899 | −19.385 | 1.00 | 49.83 | GZ00 | C |
| ATOM | 5847 | N | PRO | X | 123 | −30.613 | 125.302 | −18.116 | 1.00 | 55.21 | GZ00 | N |
| ATOM | 5848 | CA | PRO | X | 123 | −29.470 | 125.760 | −17.316 | 1.00 | 49.75 | GZ00 | C |
| ATOM | 5849 | C | PRO | X | 123 | −29.834 | 125.768 | −15.844 | 1.00 | 49.06 | GZ00 | C |
| ATOM | 5850 | O | PRO | X | 123 | −31.016 | 125.607 | −15.493 | 1.00 | 43.82 | GZ00 | O |
| ATOM | 5851 | CB | PRO | X | 123 | −29.233 | 127.183 | −17.842 | 1.00 | 55.50 | GZ00 | C |
| ATOM | 5852 | CG | PRO | X | 123 | −30.612 | 127.648 | −18.178 | 1.00 | 51.07 | GZ00 | C |
| ATOM | 5853 | CD | PRO | X | 123 | −31.353 | 126.426 | −18.710 | 1.00 | 47.80 | GZ00 | C |
| ATOM | 5854 | N | PRO | X | 124 | −28.866 | 125.964 | −14.950 | 1.00 | 48.22 | GZ00 | N |
| ATOM | 5855 | CA | PRO | X | 124 | −29.212 | 126.031 | −13.526 | 1.00 | 50.20 | GZ00 | C |
| ATOM | 5856 | C | PRO | X | 124 | −30.040 | 127.272 | −13.245 | 1.00 | 49.48 | GZ00 | C |
| ATOM | 5857 | O | PRO | X | 124 | −29.819 | 128.331 | −13.832 | 1.00 | 60.15 | GZ00 | O |
| ATOM | 5858 | CB | PRO | X | 124 | −27.850 | 126.075 | −12.822 | 1.00 | 45.39 | GZ00 | C |
| ATOM | 5859 | CG | PRO | X | 124 | −26.917 | 126.606 | −13.838 | 1.00 | 51.55 | GZ00 | C |
| ATOM | 5860 | CD | PRO | X | 124 | −27.423 | 126.159 | −15.178 | 1.00 | 47.41 | GZ00 | C |
| ATOM | 5861 | N | SER | X | 125 | −31.021 | 127.122 | −12.367 | 1.00 | 47.01 | GZ00 | N |
| ATOM | 5862 | CA | SER | X | 125 | −31.863 | 128.243 | −11.982 | 1.00 | 52.47 | GZ00 | C |
| ATOM | 5863 | C | SER | X | 125 | −31.107 | 129.183 | −11.033 | 1.00 | 58.92 | GZ00 | C |
| ATOM | 5864 | O | SER | X | 125 | −30.113 | 128.806 | −10.387 | 1.00 | 46.42 | GZ00 | O |
| ATOM | 5865 | CB | SER | X | 125 | −33.156 | 127.749 | −11.322 | 1.00 | 46.03 | GZ00 | C |
| ATOM | 5866 | OG | SER | X | 125 | −32.890 | 127.191 | −10.049 | 1.00 | 47.81 | GZ00 | O |
| ATOM | 5867 | N | SER | X | 126 | −31.591 | 130.436 | −10.966 | 1.00 | 57.48 | GZ00 | N |
| ATOM | 5868 | CA | SER | X | 126 | −30.955 | 131.426 | −10.096 | 1.00 | 51.60 | GZ00 | C |
| ATOM | 5869 | C | SER | X | 126 | −31.069 | 131.029 | −8.631 | 1.00 | 45.30 | GZ00 | C |
| ATOM | 5870 | O | SER | X | 126 | −30.103 | 131.177 | −7.870 | 1.00 | 56.73 | GZ00 | O |
| ATOM | 5871 | CB | SER | X | 126 | −31.552 | 132.818 | −10.327 | 1.00 | 46.73 | GZ00 | C |
| ATOM | 5872 | OG | SER | X | 126 | −32.956 | 132.793 | −10.192 | 1.00 | 64.48 | GZ00 | O |
| ATOM | 5873 | N | GLU | X | 127 | −32.222 | 130.484 | −8.219 | 1.00 | 49.07 | GZ00 | N |
| ATOM | 5874 | CA | GLU | X | 127 | −32.347 | 130.017 | −6.839 | 1.00 | 53.87 | GZ00 | C |
| ATOM | 5875 | C | GLU | X | 127 | −31.302 | 128.962 | −6.507 | 1.00 | 55.39 | GZ00 | C |
| ATOM | 5876 | O | GLU | X | 127 | −30.761 | 128.948 | −5.394 | 1.00 | 53.30 | GZ00 | O |
| ATOM | 5877 | CB | GLU | X | 127 | −33.733 | 129.444 | −6.558 | 1.00 | 46.74 | GZ00 | C |
| ATOM | 5878 | CG | GLU | X | 127 | −34.909 | 130.267 | −7.005 | 1.00 | 50.20 | GZ00 | C |
| ATOM | 5879 | CD | GLU | X | 127 | −36.221 | 129.697 | −6.458 | 1.00 | 67.37 | GZ00 | C |
| ATOM | 5880 | OE1 | GLU | X | 127 | −36.163 | 128.878 | −5.501 | 1.00 | 58.54 | GZ00 | O |
| ATOM | 5881 | OE2 | GLU | X | 127 | −37.303 | 130.059 | −6.988 | 1.00 | 72.90 | GZ00 | O1− |
| ATOM | 5882 | N | GLU | X | 128 | −30.978 | 128.088 | −7.466 | 1.00 | 52.88 | GZ00 | N |
| ATOM | 5883 | CA | GLU | X | 128 | −30.012 | 127.035 | −7.162 | 1.00 | 58.48 | GZ00 | C |
| ATOM | 5884 | C | GLU | X | 128 | −28.600 | 127.593 | −7.114 | 1.00 | 54.84 | GZ00 | C |
| ATOM | 5885 | O | GLU | X | 128 | −27.778 | 127.141 | −6.305 | 1.00 | 50.17 | GZ00 | O |
| ATOM | 5886 | CB | GLU | X | 128 | −30.100 | 125.882 | −8.171 | 1.00 | 51.98 | GZ00 | C |
| ATOM | 5887 | CG | GLU | X | 128 | −29.266 | 124.683 | −7.739 | 1.00 | 50.39 | GZ00 | C |
| ATOM | 5888 | CD | GLU | X | 128 | −29.022 | 123.641 | −8.841 | 1.00 | 56.66 | GZ00 | C |
| ATOM | 5889 | OE1 | GLU | X | 128 | −28.576 | 122.533 | −8.481 | 1.00 | 51.79 | GZ00 | O |
| ATOM | 5890 | OE2 | GLU | X | 128 | −29.257 | 123.912 | −10.044 | 1.00 | 50.04 | GZ00 | O1− |
| ATOM | 5891 | N | LEU | X | 129 | −28.300 | 128.569 | −7.971 | 1.00 | 51.67 | GZ00 | N |
| ATOM | 5892 | CA | LEU | X | 129 | −27.020 | 129.247 | −7.835 | 1.00 | 57.61 | GZ00 | C |
| ATOM | 5893 | C | LEU | X | 129 | −26.899 | 129.856 | −6.440 | 1.00 | 54.69 | GZ00 | C |
| ATOM | 5894 | O | LEU | X | 129 | −25.876 | 129.685 | −5.768 | 1.00 | 56.10 | GZ00 | O |
| ATOM | 5895 | CB | LEU | X | 129 | −26.861 | 130.296 | −8.938 | 1.00 | 51.14 | GZ00 | C |
| ATOM | 5896 | CG | LEU | X | 129 | −26.749 | 129.691 | −10.350 | 1.00 | 59.65 | GZ00 | C |
| ATOM | 5897 | CD1 | LEU | X | 129 | −26.772 | 130.745 | −11.454 | 1.00 | 51.42 | GZ00 | C |
| ATOM | 5898 | CD2 | LEU | X | 129 | −25.537 | 128.778 | −10.502 | 1.00 | 48.62 | GZ00 | C |
| ATOM | 5899 | N | GLN | X | 130 | −27.979 | 130.476 | −5.947 | 1.00 | 51.64 | GZ00 | N |
| ATOM | 5900 | CA | GLN | X | 130 | −27.987 | 131.040 | −4.600 | 1.00 | 54.55 | GZ00 | C |
| ATOM | 5901 | C | GLN | X | 130 | −27.717 | 130.007 | −3.525 | 1.00 | 57.65 | GZ00 | C |
| ATOM | 5902 | O | GLN | X | 130 | −27.308 | 130.384 | −2.425 | 1.00 | 62.14 | GZ00 | O |
| ATOM | 5903 | CB | GLN | X | 130 | −29.325 | 131.707 | −4.308 | 1.00 | 49.30 | GZ00 | C |
| ATOM | 5904 | CG | GLN | X | 130 | −29.494 | 133.013 | −5.001 | 1.00 | 55.98 | GZ00 | C |
| ATOM | 5905 | CD | GLN | X | 130 | −29.020 | 134.140 | −4.135 | 1.00 | 68.65 | GZ00 | C |
| ATOM | 5906 | OE1 | GLN | X | 130 | −27.848 | 134.527 | −4.169 | 1.00 | 64.86 | GZ00 | O |
| ATOM | 5907 | NE2 | GLN | X | 130 | −29.925 | 134.657 | −3.313 | 1.00 | 63.69 | GZ00 | N |
| ATOM | 5908 | N | ALA | X | 131 | −27.980 | 128.727 | −3.788 | 1.00 | 58.30 | GZ00 | N |
| ATOM | 5909 | CA | ALA | X | 131 | −27.635 | 127.669 | −2.849 | 1.00 | 53.42 | GZ00 | C |
| ATOM | 5910 | C | ALA | X | 131 | −26.223 | 127.155 | −3.057 | 1.00 | 55.16 | GZ00 | C |

TABLE 10.3-continued

| ATOM | 5911 | O | ALA | X | 131 | −25.840 | 126.154 | −2.444 | 1.00 | 55.67 | GZ00 | O |
|---|---|---|---|---|---|---|---|---|---|---|---|---|
| ATOM | 5912 | CB | ALA | X | 131 | −28.629 | 126.517 | −2.951 | 1.00 | 53.39 | GZ00 | C |
| ATOM | 5913 | N | ASN | X | 132 | −25.445 | 127.820 | −3.909 | 1.00 | 57.80 | GZ00 | N |
| ATOM | 5914 | CA | ASN | X | 132 | −24.062 | 127.430 | −4.188 | 1.00 | 65.38 | GZ00 | C |
| ATOM | 5915 | C | ASN | X | 132 | −23.983 | 126.038 | −4.819 | 1.00 | 64.86 | GZ00 | C |
| ATOM | 5916 | O | ASN | X | 132 | −23.125 | 125.221 | −4.474 | 1.00 | 58.78 | GZ00 | O |
| ATOM | 5917 | CB | ASN | X | 132 | −23.198 | 127.502 | −2.930 | 1.00 | 57.21 | GZ00 | C |
| ATOM | 5918 | CG | ASN | X | 132 | −21.742 | 127.673 | −3.259 | 1.00 | 66.70 | GZ00 | C |
| ATOM | 5919 | OD1 | ASN | X | 132 | −21.389 | 128.368 | −4.221 | 1.00 | 68.31 | GZ00 | O |
| ATOM | 5920 | ND2 | ASN | X | 132 | −20.880 | 127.021 | −2.485 | 1.00 | 71.71 | GZ00 | N |
| ATOM | 5921 | N | LYS | X | 133 | −24.891 | 125.766 | −5.750 | 1.00 | 63.21 | GZ00 | N |
| ATOM | 5922 | CA | LYS | X | 133 | −24.866 | 124.558 | −6.558 | 1.00 | 55.69 | GZ00 | C |
| ATOM | 5923 | C | LYS | X | 133 | −25.304 | 124.950 | −7.959 | 1.00 | 58.70 | GZ00 | C |
| ATOM | 5924 | O | LYS | X | 133 | −25.800 | 126.057 | −8.195 | 1.00 | 60.57 | GZ00 | O |
| ATOM | 5925 | CB | LYS | X | 133 | −25.778 | 123.468 | −5.978 | 1.00 | 57.74 | GZ00 | C |
| ATOM | 5926 | CG | LYS | X | 133 | −25.404 | 122.972 | −4.574 | 1.00 | 60.29 | GZ00 | C |
| ATOM | 5927 | CD | LYS | X | 133 | −26.528 | 122.090 | −3.989 | 1.00 | 77.16 | GZ00 | C |
| ATOM | 5928 | CE | LYS | X | 133 | −26.295 | 121.712 | −2.516 | 1.00 | 67.68 | GZ00 | C |
| ATOM | 5929 | NZ | LYS | X | 133 | −27.578 | 121.494 | −1.757 | 1.00 | 61.53 | GZ00 | N1+ |
| ATOM | 5930 | N | ALA | X | 134 | −25.128 | 124.033 | −8.899 | 1.00 | 57.91 | GZ00 | N |
| ATOM | 5931 | CA | ALA | X | 134 | −25.550 | 124.292 | −10.273 | 1.00 | 57.46 | GZ00 | C |
| ATOM | 5932 | C | ALA | X | 134 | −25.676 | 122.951 | −10.970 | 1.00 | 58.56 | GZ00 | C |
| ATOM | 5933 | O | ALA | X | 134 | −24.715 | 122.173 | −10.980 | 1.00 | 56.94 | GZ00 | O |
| ATOM | 5934 | CB | ALA | X | 134 | −24.546 | 125.194 | −10.994 | 1.00 | 46.64 | GZ00 | C |
| ATOM | 5935 | N | THR | X | 135 | −26.850 | 122.650 | −11.519 | 1.00 | 55.26 | GZ00 | N |
| ATOM | 5936 | CA | THR | X | 135 | −26.986 | 121.434 | −12.308 | 1.00 | 47.36 | GZ00 | C |
| ATOM | 5937 | C | THR | X | 135 | −27.631 | 121.778 | −13.640 | 1.00 | 45.07 | GZ00 | C |
| ATOM | 5938 | O | THR | X | 135 | −28.602 | 122.540 | −13.693 | 1.00 | 43.66 | GZ00 | O |
| ATOM | 5939 | CB | THR | X | 135 | −27.779 | 120.335 | −11.579 | 1.00 | 46.59 | GZ00 | C |
| ATOM | 5940 | OG1 | THR | X | 135 | −29.174 | 120.523 | −11.787 | 1.00 | 60.99 | GZ00 | O |
| ATOM | 5941 | CG2 | THR | X | 135 | −27.487 | 120.331 | −10.088 | 1.00 | 40.51 | GZ00 | C |
| ATOM | 5942 | N | LEU | X | 136 | −27.050 | 121.251 | −14.711 | 1.00 | 43.91 | GZ00 | N |
| ATOM | 5943 | CA | LEU | X | 136 | −27.635 | 121.315 | −16.036 | 1.00 | 42.15 | GZ00 | C |
| ATOM | 5944 | C | LEU | X | 136 | −28.501 | 120.080 | −16.231 | 1.00 | 50.30 | GZ00 | C |
| ATOM | 5945 | O | LEU | X | 136 | −28.140 | 118.976 | −15.812 | 1.00 | 46.46 | GZ00 | O |
| ATOM | 5946 | CB | LEU | X | 136 | −26.544 | 121.383 | −17.101 | 1.00 | 46.62 | GZ00 | C |
| ATOM | 5947 | CG | LEU | X | 136 | −25.574 | 122.574 | −17.036 | 1.00 | 48.02 | GZ00 | C |
| ATOM | 5948 | CD1 | LEU | X | 136 | −24.445 | 122.431 | −18.044 | 1.00 | 53.43 | GZ00 | C |
| ATOM | 5949 | CD2 | LEU | X | 136 | −26.330 | 123.797 | −17.372 | 1.00 | 47.48 | GZ00 | C |
| ATOM | 5950 | N | VAL | X | 137 | −29.654 | 120.270 | −16.849 | 1.00 | 48.09 | GZ00 | N |
| ATOM | 5951 | CA | VAL | X | 137 | −30.643 | 119.214 | −16.962 | 1.00 | 49.70 | GZ00 | C |
| ATOM | 5952 | C | VAL | X | 137 | −30.865 | 118.972 | −18.443 | 1.00 | 47.78 | GZ00 | C |
| ATOM | 5953 | O | VAL | X | 137 | −31.364 | 119.852 | −19.156 | 1.00 | 46.56 | GZ00 | O |
| ATOM | 5954 | CB | VAL | X | 137 | −31.951 | 119.574 | −16.249 | 1.00 | 41.53 | GZ00 | C |
| ATOM | 5955 | CG1 | VAL | X | 137 | −32.927 | 118.433 | −16.354 | 1.00 | 38.78 | GZ00 | C |
| ATOM | 5956 | CG2 | VAL | X | 137 | −31.677 | 119.926 | −14.782 | 1.00 | 37.08 | GZ00 | C |
| ATOM | 5957 | N | CYS | X | 138 | −30.480 | 117.787 | −18.905 | 1.00 | 41.44 | GZ00 | N |
| ATOM | 5958 | CA | CYS | X | 138 | −30.653 | 117.371 | −20.292 | 1.00 | 44.75 | GZ00 | C |
| ATOM | 5959 | C | CYS | X | 138 | −31.717 | 116.286 | −20.316 | 1.00 | 42.51 | GZ00 | C |
| ATOM | 5960 | O | CYS | X | 138 | −31.459 | 115.150 | −19.904 | 1.00 | 45.75 | GZ00 | O |
| ATOM | 5961 | CB | CYS | X | 138 | −29.341 | 116.850 | −20.872 | 1.00 | 41.85 | GZ00 | C |
| ATOM | 5962 | SG | CYS | X | 138 | −29.335 | 116.711 | −22.686 | 1.00 | 48.77 | GZ00 | S |
| ATOM | 5963 | N | LEU | X | 139 | −32.904 | 116.627 | −20.803 | 1.00 | 40.25 | GZ00 | N |
| ATOM | 5964 | CA | LEU | X | 139 | −33.998 | 115.670 | −20.918 | 1.00 | 44.13 | GZ00 | C |
| ATOM | 5965 | C | LEU | X | 139 | −34.091 | 115.164 | −22.348 | 1.00 | 48.33 | GZ00 | C |
| ATOM | 5966 | O | LEU | X | 139 | −34.096 | 115.956 | −23.296 | 1.00 | 49.49 | GZ00 | O |
| ATOM | 5967 | CB | LEU | X | 139 | −35.323 | 116.286 | −20.469 | 1.00 | 40.97 | GZ00 | C |
| ATOM | 5968 | CG | LEU | X | 139 | −35.163 | 116.830 | −19.046 | 1.00 | 45.88 | GZ00 | C |
| ATOM | 5969 | CD1 | LEU | X | 139 | −34.991 | 118.304 | −19.121 | 1.00 | 55.62 | GZ00 | C |
| ATOM | 5970 | CD2 | LEU | X | 139 | −36.336 | 116.513 | −18.183 | 1.00 | 56.00 | GZ00 | C |
| ATOM | 5971 | N | ILE | X | 140 | −34.185 | 113.843 | −22.489 | 1.00 | 43.98 | GZ00 | N |
| ATOM | 5972 | CA | ILE | X | 140 | −34.065 | 113.151 | −23.763 | 1.00 | 39.00 | GZ00 | C |
| ATOM | 5973 | C | ILE | X | 140 | −35.287 | 112.261 | −23.897 | 1.00 | 41.08 | GZ00 | C |
| ATOM | 5974 | O | ILE | X | 140 | −35.562 | 111.453 | −23.003 | 1.00 | 45.21 | GZ00 | O |
| ATOM | 5975 | CB | ILE | X | 140 | −32.776 | 112.314 | −23.820 | 1.00 | 38.23 | GZ00 | C |
| ATOM | 5976 | CG1 | ILE | X | 140 | −31.593 | 113.141 | −23.326 | 1.00 | 38.68 | GZ00 | C |
| ATOM | 5977 | CG2 | ILE | X | 140 | −32.517 | 111.813 | −25.212 | 1.00 | 37.81 | GZ00 | C |
| ATOM | 5978 | CD1 | ILE | X | 140 | −30.465 | 112.309 | −22.831 | 1.00 | 36.60 | GZ00 | C |
| ATOM | 5979 | N | SER | X | 141 | −36.037 | 112.410 | −24.986 | 1.00 | 38.32 | GZ00 | N |
| ATOM | 5980 | CA | SER | X | 141 | −37.296 | 111.688 | −25.062 | 1.00 | 41.71 | GZ00 | C |
| ATOM | 5981 | C | SER | X | 141 | −37.616 | 111.305 | −26.496 | 1.00 | 42.47 | GZ00 | C |
| ATOM | 5982 | O | SER | X | 141 | −37.050 | 111.841 | −27.451 | 1.00 | 41.57 | GZ00 | O |
| ATOM | 5983 | CB | SER | X | 141 | −38.442 | 112.523 | −24.495 | 1.00 | 41.65 | GZ00 | C |
| ATOM | 5984 | OG | SER | X | 141 | −38.508 | 113.735 | −25.214 | 1.00 | 44.00 | GZ00 | O |
| ATOM | 5985 | N | ASP | X | 142 | −38.557 | 110.367 | −26.620 | 1.00 | 46.32 | GZ00 | N |
| ATOM | 5986 | CA | ASP | X | 142 | −39.150 | 109.987 | −27.901 | 1.00 | 48.85 | GZ00 | C |
| ATOM | 5987 | C | ASP | X | 142 | −38.129 | 109.382 | −28.860 | 1.00 | 51.47 | GZ00 | C |
| ATOM | 5988 | O | ASP | X | 142 | −38.175 | 109.623 | −30.072 | 1.00 | 44.48 | GZ00 | O |
| ATOM | 5989 | CB | ASP | X | 142 | −39.846 | 111.179 | −28.546 | 1.00 | 47.17 | GZ00 | C |
| ATOM | 5990 | CG | ASP | X | 142 | −41.165 | 111.502 | −27.888 | 1.00 | 60.06 | GZ00 | C |

TABLE 10.3-continued

| ATOM | 5991 | OD1 | ASP | X | 142 | −41.856 | 110.559 | −27.429 | 1.00 | 53.08 | GZ00 | O |
| ATOM | 5992 | OD2 | ASP | X | 142 | −41.509 | 112.706 | −27.833 | 1.00 | 72.08 | GZ00 | O1− |
| ATOM | 5993 | N | PHE | X | 143 | −37.183 | 108.607 | −28.329 | 1.00 | 42.34 | GZ00 | N |
| ATOM | 5994 | CA | PHE | X | 143 | −36.209 | 107.975 | −29.202 | 1.00 | 50.27 | GZ00 | C |
| ATOM | 5995 | C | PHE | X | 143 | −36.431 | 106.471 | −29.275 | 1.00 | 46.86 | GZ00 | C |
| ATOM | 5996 | O | PHE | X | 143 | −36.969 | 105.852 | −28.352 | 1.00 | 43.04 | GZ00 | O |
| ATOM | 5997 | CB | PHE | X | 143 | −34.773 | 108.296 | −28.793 | 1.00 | 38.71 | GZ00 | C |
| ATOM | 5998 | CG | PHE | X | 143 | −34.426 | 107.944 | −27.388 | 1.00 | 40.75 | GZ00 | C |
| ATOM | 5999 | CD1 | PHE | X | 143 | −33.898 | 106.698 | −27.084 | 1.00 | 36.49 | GZ00 | C |
| ATOM | 6000 | CD2 | PHE | X | 143 | −34.537 | 108.889 | −26.377 | 1.00 | 38.84 | GZ00 | C |
| ATOM | 6001 | CE1 | PHE | X | 143 | −33.510 | 106.389 | −25.788 | 1.00 | 41.99 | GZ00 | C |
| ATOM | 6002 | CE2 | PHE | X | 143 | −34.161 | 108.588 | −25.078 | 1.00 | 39.59 | GZ00 | C |
| ATOM | 6003 | CZ | PHE | X | 143 | −33.645 | 107.330 | −24.777 | 1.00 | 38.14 | GZ00 | C |
| ATOM | 6004 | N | TYR | X | 144 | −36.071 | 105.909 | −30.422 | 1.00 | 41.60 | GZ00 | N |
| ATOM | 6005 | CA | TYR | X | 144 | −36.247 | 104.485 | −30.675 | 1.00 | 40.98 | GZ00 | C |
| ATOM | 6006 | C | TYR | X | 144 | −35.290 | 104.053 | −31.769 | 1.00 | 46.46 | GZ00 | C |
| ATOM | 6007 | O | TYR | X | 144 | −35.237 | 104.680 | −32.843 | 1.00 | 42.13 | GZ00 | O |
| ATOM | 6008 | CB | TYR | X | 144 | −37.685 | 104.146 | −31.067 | 1.00 | 43.87 | GZ00 | C |
| ATOM | 6009 | CG | TYR | X | 144 | −37.912 | 102.658 | −31.265 | 1.00 | 41.93 | GZ00 | C |
| ATOM | 6010 | CD1 | TYR | X | 144 | −38.183 | 101.821 | −30.184 | 1.00 | 44.51 | GZ00 | C |
| ATOM | 6011 | CD2 | TYR | X | 144 | −37.838 | 102.090 | −32.527 | 1.00 | 35.71 | GZ00 | C |
| ATOM | 6012 | CE1 | TYR | X | 144 | −38.379 | 100.445 | −30.358 | 1.00 | 40.63 | GZ00 | C |
| ATOM | 6013 | CE2 | TYR | X | 144 | −38.050 | 100.733 | −32.717 | 1.00 | 40.34 | GZ00 | C |
| ATOM | 6014 | CZ | TYR | X | 144 | −38.309 | 99.912 | −31.631 | 1.00 | 41.12 | GZ00 | C |
| ATOM | 6015 | OH | TYR | X | 144 | −38.511 | 98.567 | −31.831 | 1.00 | 40.40 | GZ00 | O |
| ATOM | 6016 | N | PRO | X | 145 | −34.530 | 102.974 | −31.511 | 1.00 | 40.55 | GZ00 | N |
| ATOM | 6017 | CA | PRO | X | 145 | −34.563 | 102.164 | −30.284 | 1.00 | 43.72 | GZ00 | C |
| ATOM | 6018 | C | PRO | X | 145 | −33.998 | 102.849 | −29.028 | 1.00 | 43.96 | GZ00 | C |
| ATOM | 6019 | O | PRO | X | 145 | −33.489 | 103.965 | −29.115 | 1.00 | 40.33 | GZ00 | O |
| ATOM | 6020 | CB | PRO | X | 145 | −33.699 | 100.937 | −30.644 | 1.00 | 43.12 | GZ00 | C |
| ATOM | 6021 | CG | PRO | X | 145 | −32.956 | 101.292 | −31.849 | 1.00 | 42.92 | GZ00 | C |
| ATOM | 6022 | CD | PRO | X | 145 | −33.714 | 102.356 | −32.570 | 1.00 | 40.02 | GZ00 | C |
| ATOM | 6023 | N | GLY | X | 146 | −34.102 | 102.165 | −27.884 | 1.00 | 38.67 | GZ00 | N |
| ATOM | 6024 | CA | GLY | X | 146 | −33.811 | 102.737 | −26.584 | 1.00 | 36.90 | GZ00 | C |
| ATOM | 6025 | C | GLY | X | 146 | −32.366 | 102.660 | −26.134 | 1.00 | 38.27 | GZ00 | C |
| ATOM | 6026 | O | GLY | X | 146 | −32.068 | 102.118 | −25.070 | 1.00 | 42.45 | GZ00 | O |
| ATOM | 6027 | N | ALA | X | 147 | −31.462 | 103.201 | −26.930 | 1.00 | 33.88 | GZ00 | N |
| ATOM | 6028 | CA | ALA | X | 147 | −30.063 | 103.278 | −26.560 | 1.00 | 36.10 | GZ00 | C |
| ATOM | 6029 | C | ALA | X | 147 | −29.541 | 104.597 | −27.083 | 1.00 | 33.68 | GZ00 | C |
| ATOM | 6030 | O | ALA | X | 147 | −29.858 | 105.007 | −28.203 | 1.00 | 39.90 | GZ00 | O |
| ATOM | 6031 | CB | ALA | X | 147 | −29.225 | 102.121 | −27.118 | 1.00 | 29.64 | GZ00 | C |
| ATOM | 6032 | N | VAL | X | 148 | −28.712 | 105.231 | −26.263 | 1.00 | 33.29 | GZ00 | N |
| ATOM | 6033 | CA | VAL | X | 148 | −28.309 | 106.608 | −26.467 | 1.00 | 34.38 | GZ00 | C |
| ATOM | 6034 | C | VAL | X | 148 | −27.005 | 106.806 | −25.702 | 1.00 | 44.52 | GZ00 | C |
| ATOM | 6035 | O | VAL | X | 148 | −26.787 | 106.191 | −24.652 | 1.00 | 39.89 | GZ00 | O |
| ATOM | 6036 | CB | VAL | X | 148 | −29.464 | 107.518 | −25.970 | 1.00 | 40.00 | GZ00 | C |
| ATOM | 6037 | CG1 | VAL | X | 148 | −28.993 | 108.560 | −25.020 | 1.00 | 41.53 | GZ00 | C |
| ATOM | 6038 | CG2 | VAL | X | 148 | −30.271 | 108.073 | −27.138 | 1.00 | 35.87 | GZ00 | C |
| ATOM | 6039 | N | THR | X | 149 | −26.133 | 107.663 | −26.213 | 1.00 | 36.77 | GZ00 | N |
| ATOM | 6040 | CA | THR | X | 149 | −24.987 | 108.051 | −25.409 | 1.00 | 38.57 | GZ00 | C |
| ATOM | 6041 | C | THR | X | 149 | −24.960 | 109.563 | −25.294 | 1.00 | 44.30 | GZ00 | C |
| ATOM | 6042 | O | THR | X | 149 | −25.353 | 110.287 | −26.217 | 1.00 | 42.08 | GZ00 | O |
| ATOM | 6043 | CB | THR | X | 149 | −23.650 | 107.565 | −25.975 | 1.00 | 48.56 | GZ00 | C |
| ATOM | 6044 | OG1 | THR | X | 149 | −23.455 | 108.130 | −27.276 | 1.00 | 56.60 | GZ00 | O |
| ATOM | 6045 | CG2 | THR | X | 149 | −23.624 | 106.035 | −26.054 | 1.00 | 37.17 | GZ00 | C |
| ATOM | 6046 | N | VAL | X | 150 | −24.503 | 110.036 | −24.146 | 1.00 | 43.54 | GZ00 | N |
| ATOM | 6047 | CA | VAL | X | 150 | −24.564 | 111.452 | −23.836 | 1.00 | 47.15 | GZ00 | C |
| ATOM | 6048 | C | VAL | X | 150 | −23.160 | 111.946 | −23.536 | 1.00 | 46.29 | GZ00 | C |
| ATOM | 6049 | O | VAL | X | 150 | −22.484 | 111.422 | −22.642 | 1.00 | 44.10 | GZ00 | O |
| ATOM | 6050 | CB | VAL | X | 150 | −25.519 | 111.726 | −22.663 | 1.00 | 42.61 | GZ00 | C |
| ATOM | 6051 | CG1 | VAL | X | 150 | −25.584 | 113.212 | −22.388 | 1.00 | 45.14 | GZ00 | C |
| ATOM | 6052 | CG2 | VAL | X | 150 | −26.919 | 111.152 | −22.975 | 1.00 | 37.35 | GZ00 | C |
| ATOM | 6053 | N | ALA | X | 151 | −22.741 | 112.977 | −24.260 | 1.00 | 43.99 | GZ00 | N |
| ATOM | 6054 | CA | ALA | X | 151 | −21.484 | 113.665 | −24.002 | 1.00 | 55.42 | GZ00 | C |
| ATOM | 6055 | C | ALA | X | 151 | −21.769 | 115.133 | −23.706 | 1.00 | 56.11 | GZ00 | C |
| ATOM | 6056 | O | ALA | X | 151 | −22.614 | 115.758 | −24.361 | 1.00 | 51.73 | GZ00 | O |
| ATOM | 6057 | CB | ALA | X | 151 | −20.528 | 113.545 | −25.190 | 1.00 | 47.91 | GZ00 | C |
| ATOM | 6058 | N | TRP | X | 152 | −21.091 | 115.665 | −22.693 | 1.00 | 48.76 | GZ00 | N |
| ATOM | 6059 | CA | TRP | X | 152 | −21.207 | 117.064 | −22.312 | 1.00 | 52.98 | GZ00 | C |
| ATOM | 6060 | C | TRP | X | 152 | −19.957 | 117.821 | −22.742 | 1.00 | 62.60 | GZ00 | C |
| ATOM | 6061 | O | TRP | X | 152 | −18.840 | 117.307 | −22.638 | 1.00 | 63.13 | GZ00 | O |
| ATOM | 6062 | CB | TRP | X | 152 | −21.402 | 117.202 | −20.798 | 1.00 | 54.47 | GZ00 | C |
| ATOM | 6063 | CG | TRP | X | 152 | −22.732 | 116.706 | −20.310 | 1.00 | 55.93 | GZ00 | C |
| ATOM | 6064 | CD1 | TRP | X | 152 | −23.070 | 115.415 | −20.021 | 1.00 | 50.45 | GZ00 | C |
| ATOM | 6065 | CD2 | TRP | X | 152 | −23.908 | 117.493 | −20.059 | 1.00 | 54.33 | GZ00 | C |
| ATOM | 6066 | NE1 | TRP | X | 152 | −24.380 | 115.350 | −19.603 | 1.00 | 45.37 | GZ00 | N |
| ATOM | 6067 | CE2 | TRP | X | 152 | −24.919 | 116.608 | −19.624 | 1.00 | 49.73 | GZ00 | C |
| ATOM | 6068 | CE3 | TRP | X | 152 | −24.205 | 118.856 | −20.162 | 1.00 | 49.64 | GZ00 | C |
| ATOM | 6069 | CZ2 | TRP | X | 152 | −26.201 | 117.046 | −19.286 | 1.00 | 49.17 | GZ00 | C |
| ATOM | 6070 | CZ3 | TRP | X | 152 | −25.488 | 119.290 | −19.834 | 1.00 | 47.92 | GZ00 | C |

TABLE 10.3-continued

| | | | | | | | | | | | |
|---|---|---|---|---|---|---|---|---|---|---|---|
| ATOM | 6071 | CH2 | TRP | X | 152 | −26.464 | 118.390 | −19.400 | 1.00 | 49.61 | GZ00 C |
| ATOM | 6072 | N | LYS | X | 153 | −20.141 | 119.053 | −23.204 | 1.00 | 65.10 | GZ00 N |
| ATOM | 6073 | CA | LYS | X | 153 | −19.019 | 119.883 | −23.602 | 1.00 | 62.17 | GZ00 C |
| ATOM | 6074 | C | LYS | X | 153 | −19.122 | 121.266 | −22.971 | 1.00 | 70.98 | GZ00 C |
| ATOM | 6075 | O | LYS | X | 153 | −20.213 | 121.849 | −22.883 | 1.00 | 60.73 | GZ00 O |
| ATOM | 6076 | CB | LYS | X | 153 | −18.918 | 119.968 | −25.133 | 1.00 | 62.97 | GZ00 C |
| ATOM | 6077 | CG | LYS | X | 153 | −18.343 | 118.679 | −25.728 | 1.00 | 71.97 | GZ00 C |
| ATOM | 6078 | CD | LYS | X | 153 | −18.093 | 118.773 | −27.212 | 1.00 | 76.62 | GZ00 C |
| ATOM | 6079 | CE | LYS | X | 153 | −17.488 | 117.483 | −27.757 | 1.00 | 78.74 | GZ00 C |
| ATOM | 6080 | NZ | LYS | X | 153 | −17.470 | 117.510 | −29.257 | 1.00 | 82.65 | GZ00 N1+ |
| ATOM | 6081 | N | ALA | X | 154 | −17.966 | 121.767 | −22.517 | 1.00 | 68.61 | GZ00 N |
| ATOM | 6082 | CA | ALA | X | 154 | −17.783 | 123.138 | −22.053 | 1.00 | 70.61 | GZ00 C |
| ATOM | 6083 | C | ALA | X | 154 | −16.988 | 123.883 | −23.122 | 1.00 | 76.84 | GZ00 C |
| ATOM | 6084 | O | ALA | X | 154 | −15.785 | 123.645 | −23.282 | 1.00 | 70.93 | GZ00 O |
| ATOM | 6085 | CB | ALA | X | 154 | −17.057 | 123.158 | −20.709 | 1.00 | 58.77 | GZ00 C |
| ATOM | 6086 | N | ASP | X | 155 | −17.672 | 124.765 | −23.853 | 1.00 | 75.44 | GZ00 N |
| ATOM | 6087 | CA | ASP | X | 155 | −17.137 | 125.491 | −25.013 | 1.00 | 86.60 | GZ00 C |
| ATOM | 6088 | C | ASP | X | 155 | −16.167 | 124.618 | −25.821 | 1.00 | 88.28 | GZ00 C |
| ATOM | 6089 | O | ASP | X | 155 | −14.980 | 124.919 | −25.980 | 1.00 | 92.56 | GZ00 O |
| ATOM | 6090 | CB | ASP | X | 155 | −16.529 | 126.864 | −24.643 | 1.00 | 93.75 | GZ00 C |
| ATOM | 6091 | CG | ASP | X | 155 | −15.592 | 126.838 | −23.429 | 1.00 | 92.88 | GZ00 C |
| ATOM | 6092 | OD2 | ASP | X | 155 | −15.842 | 127.652 | −22.504 | 1.00 | 84.61 | GZ00 O1− |
| ATOM | 6093 | OD1 | ASP | X | 155 | −14.599 | 126.064 | −23.414 | 1.00 | 88.83 | GZ00 O |
| ATOM | 6094 | N | SER | X | 156 | −16.707 | 123.493 | −26.297 | 1.00 | 79.32 | GZ00 N |
| ATOM | 6095 | CA | SER | X | 156 | −16.051 | 122.520 | −27.174 | 1.00 | 78.60 | GZ00 C |
| ATOM | 6096 | C | SER | X | 156 | −14.971 | 121.688 | −26.498 | 1.00 | 74.64 | GZ00 C |
| ATOM | 6097 | O | SER | X | 156 | −14.249 | 120.963 | −27.189 | 1.00 | 84.36 | GZ00 O |
| ATOM | 6098 | CB | SER | X | 156 | −15.436 | 123.186 | −28.416 | 1.00 | 73.87 | GZ00 C |
| ATOM | 6099 | OG | SER | X | 156 | −16.405 | 123.895 | −29.165 | 1.00 | 81.66 | GZ00 O |
| ATOM | 6100 | N | SER | X | 157 | −14.854 | 121.728 | −25.183 | 1.00 | 69.01 | GZ00 N |
| ATOM | 6101 | CA | SER | X | 157 | −13.979 | 120.769 | −24.541 | 1.00 | 69.77 | GZ00 C |
| ATOM | 6102 | C | SER | X | 157 | −14.813 | 119.693 | −23.873 | 1.00 | 80.18 | GZ00 C |
| ATOM | 6103 | O | SER | X | 157 | −15.795 | 120.013 | −23.189 | 1.00 | 78.55 | GZ00 O |
| ATOM | 6104 | CB | SER | X | 157 | −13.084 | 121.447 | −23.505 | 1.00 | 71.70 | GZ00 C |
| ATOM | 6105 | OG | SER | X | 157 | −12.182 | 122.329 | −24.136 | 1.00 | 83.37 | GZ00 O |
| ATOM | 6106 | N | PRO | X | 158 | −14.476 | 118.419 | −24.062 | 1.00 | 82.78 | GZ00 N |
| ATOM | 6107 | CA | PRO | X | 158 | −15.228 | 117.349 | −23.395 | 1.00 | 76.46 | GZ00 C |
| ATOM | 6108 | C | PRO | X | 158 | −15.217 | 117.510 | −21.881 | 1.00 | 71.70 | GZ00 C |
| ATOM | 6109 | O | PRO | X | 158 | −14.185 | 117.812 | −21.277 | 1.00 | 72.61 | GZ00 O |
| ATOM | 6110 | CB | PRO | X | 158 | −14.501 | 116.072 | −23.839 | 1.00 | 73.01 | GZ00 C |
| ATOM | 6111 | CG | PRO | X | 158 | −13.220 | 116.534 | −24.487 | 1.00 | 79.70 | GZ00 C |
| ATOM | 6112 | CD | PRO | X | 158 | −13.513 | 117.891 | −25.037 | 1.00 | 80.30 | GZ00 C |
| ATOM | 6113 | N | VAL | X | 159 | −16.375 | 117.266 | −21.266 | 1.00 | 66.35 | GZ00 N |
| ATOM | 6114 | CA | VAL | X | 159 | −16.548 | 117.386 | −19.823 | 1.00 | 62.00 | GZ00 C |
| ATOM | 6115 | C | VAL | X | 159 | −16.401 | 116.006 | −19.204 | 1.00 | 69.04 | GZ00 C |
| ATOM | 6116 | O | VAL | X | 159 | −17.189 | 115.099 | −19.491 | 1.00 | 77.71 | GZ00 O |
| ATOM | 6117 | CB | VAL | X | 159 | −17.910 | 117.997 | −19.467 | 1.00 | 64.97 | GZ00 C |
| ATOM | 6118 | CG1 | VAL | X | 159 | −18.084 | 118.013 | −17.959 | 1.00 | 62.71 | GZ00 C |
| ATOM | 6119 | CG2 | VAL | X | 159 | −18.059 | 119.400 | −20.075 | 1.00 | 59.52 | GZ00 C |
| ATOM | 6120 | N | LYS | X | 160 | −15.413 | 115.857 | −18.328 | 1.00 | 74.85 | GZ00 N |
| ATOM | 6121 | CA | LYS | X | 160 | −14.967 | 114.550 | −17.867 | 1.00 | 79.58 | GZ00 C |
| ATOM | 6122 | C | LYS | X | 160 | −15.580 | 114.124 | −16.535 | 1.00 | 75.16 | GZ00 C |
| ATOM | 6123 | O | LYS | X | 160 | −15.412 | 112.964 | −16.143 | 1.00 | 82.11 | GZ00 O |
| ATOM | 6124 | CB | LYS | X | 160 | −13.429 | 114.543 | −17.758 | 1.00 | 85.50 | GZ00 C |
| ATOM | 6125 | CG | LYS | X | 160 | −12.723 | 113.330 | −18.377 | 1.00 | 89.99 | GZ00 C |
| ATOM | 6126 | CD | LYS | X | 160 | −12.558 | 113.438 | −19.900 | 1.00 | 91.72 | GZ00 C |
| ATOM | 6127 | CE | LYS | X | 160 | −11.807 | 112.217 | −20.463 | 1.00 | 101.89 | GZ00 C |
| ATOM | 6128 | NZ | LYS | X | 160 | −11.786 | 112.147 | −21.960 | 1.00 | 92.33 | GZ00 N1+ |
| ATOM | 6129 | N | ALA | X | 161 | −16.284 | 115.011 | −15.833 | 1.00 | 64.13 | GZ00 N |
| ATOM | 6130 | CA | ALA | X | 161 | −16.778 | 114.677 | −14.503 | 1.00 | 64.11 | GZ00 C |
| ATOM | 6131 | C | ALA | X | 161 | −18.053 | 115.454 | −14.206 | 1.00 | 60.81 | GZ00 C |
| ATOM | 6132 | O | ALA | X | 161 | −18.346 | 116.472 | −14.836 | 1.00 | 59.19 | GZ00 O |
| ATOM | 6133 | CB | ALA | X | 161 | −15.728 | 114.953 | −13.424 | 1.00 | 61.76 | GZ00 C |
| ATOM | 6134 | N | GLY | X | 162 | −18.809 | 114.954 | −13.231 | 1.00 | 53.42 | GZ00 N |
| ATOM | 6135 | CA | GLY | X | 162 | −20.048 | 115.575 | −12.823 | 1.00 | 55.17 | GZ00 C |
| ATOM | 6136 | C | GLY | X | 162 | −21.273 | 115.133 | −13.595 | 1.00 | 59.06 | GZ00 C |
| ATOM | 6137 | O | GLY | X | 162 | −22.353 | 115.706 | −13.396 | 1.00 | 55.42 | GZ00 O |
| ATOM | 6138 | N | VAL | X | 163 | −21.147 | 114.128 | −14.458 | 1.00 | 52.82 | GZ00 N |
| ATOM | 6139 | CA | VAL | X | 163 | −22.234 | 113.680 | −15.316 | 1.00 | 48.37 | GZ00 C |
| ATOM | 6140 | C | VAL | X | 163 | −22.874 | 112.455 | −14.689 | 1.00 | 49.71 | GZ00 C |
| ATOM | 6141 | O | VAL | X | 163 | −22.179 | 111.511 | −14.296 | 1.00 | 50.43 | GZ00 O |
| ATOM | 6142 | CB | VAL | X | 163 | −21.738 | 113.364 | −16.737 | 1.00 | 45.16 | GZ00 C |
| ATOM | 6143 | CG1 | VAL | X | 163 | −22.863 | 112.761 | −17.564 | 1.00 | 41.69 | GZ00 C |
| ATOM | 6144 | CG2 | VAL | X | 163 | −21.220 | 114.622 | −17.401 | 1.00 | 46.72 | GZ00 C |
| ATOM | 6145 | N | GLU | X | 164 | −24.197 | 112.468 | −14.599 | 1.00 | 47.13 | GZ00 N |
| ATOM | 6146 | CA | GLU | X | 164 | −24.964 | 111.300 | −14.201 | 1.00 | 53.09 | GZ00 C |
| ATOM | 6147 | C | GLU | X | 164 | −26.115 | 111.140 | −15.178 | 1.00 | 46.61 | GZ00 C |
| ATOM | 6148 | O | GLU | X | 164 | −26.815 | 112.113 | −15.471 | 1.00 | 51.75 | GZ00 O |
| ATOM | 6149 | CB | GLU | X | 164 | −25.447 | 111.448 | −12.757 | 1.00 | 51.29 | GZ00 C |
| ATOM | 6150 | CG | GLU | X | 164 | −24.369 | 110.989 | −11.771 | 1.00 | 66.35 | GZ00 C |

TABLE 10.3-continued

| ATOM | 6151 | CD | GLU | X | 164 | −24.588 | 111.481 | −10.349 | 1.00 | 80.34 | GZ00 | C |
|---|---|---|---|---|---|---|---|---|---|---|---|---|
| ATOM | 6152 | OE1 | GLU | X | 164 | −25.618 | 112.153 | −10.090 | 1.00 | 84.11 | GZ00 | O |
| ATOM | 6153 | OE2 | GLU | X | 164 | −23.723 | 111.189 | −9.486 | 1.00 | 74.82 | GZ00 | O1− |
| ATOM | 6154 | N | THR | X | 165 | −26.291 | 109.923 | −15.699 | 1.00 | 44.17 | GZ00 | N |
| ATOM | 6155 | CA | THR | X | 165 | −27.216 | 109.646 | −16.791 | 1.00 | 41.22 | GZ00 | C |
| ATOM | 6156 | C | THR | X | 165 | −28.051 | 108.419 | −16.450 | 1.00 | 43.11 | GZ00 | C |
| ATOM | 6157 | O | THR | X | 165 | −27.536 | 107.449 | −15.891 | 1.00 | 46.87 | GZ00 | O |
| ATOM | 6158 | CB | THR | X | 165 | −26.455 | 109.433 | −18.098 | 1.00 | 41.49 | GZ00 | C |
| ATOM | 6159 | OG1 | THR | X | 165 | −25.742 | 110.625 | −18.421 | 1.00 | 41.60 | GZ00 | O |
| ATOM | 6160 | CG2 | THR | X | 165 | −27.397 | 109.091 | −19.242 | 1.00 | 40.37 | GZ00 | C |
| ATOM | 6161 | N | THR | X | 166 | −29.352 | 108.492 | −16.715 | 1.00 | 45.39 | GZ00 | N |
| ATOM | 6162 | CA | THR | X | 166 | −30.228 | 107.356 | −16.466 | 1.00 | 48.92 | GZ00 | C |
| ATOM | 6163 | C | THR | X | 166 | −30.165 | 106.353 | −17.611 | 1.00 | 43.82 | GZ00 | C |
| ATOM | 6164 | O | THR | X | 166 | −29.861 | 106.689 | −18.756 | 1.00 | 48.48 | GZ00 | O |
| ATOM | 6165 | CB | THR | X | 166 | −31.684 | 107.786 | −16.285 | 1.00 | 42.46 | GZ00 | C |
| ATOM | 6166 | OG1 | THR | X | 166 | −32.133 | 108.501 | −17.446 | 1.00 | 42.85 | GZ00 | O |
| ATOM | 6167 | CG2 | THR | X | 166 | −31.833 | 108.639 | −15.075 | 1.00 | 49.93 | GZ00 | C |
| ATOM | 6168 | N | VAL | X | 167 | −30.481 | 105.109 | −17.287 | 1.00 | 43.83 | GZ00 | N |
| ATOM | 6169 | CA | VAL | X | 167 | −30.761 | 104.109 | −18.306 | 1.00 | 47.99 | GZ00 | C |
| ATOM | 6170 | C | VAL | X | 167 | −32.044 | 104.535 | −19.004 | 1.00 | 43.14 | GZ00 | C |
| ATOM | 6171 | O | VAL | X | 167 | −32.921 | 105.146 | −18.381 | 1.00 | 51.16 | GZ00 | O |
| ATOM | 6172 | CB | VAL | X | 167 | −30.905 | 102.716 | −17.689 | 1.00 | 47.80 | GZ00 | C |
| ATOM | 6173 | CG1 | VAL | X | 167 | −29.736 | 102.444 | −16.786 | 1.00 | 37.96 | GZ00 | C |
| ATOM | 6174 | CG2 | VAL | X | 167 | −32.215 | 102.646 | −16.913 | 1.00 | 51.34 | GZ00 | C |
| ATOM | 6175 | N | PRO | X | 168 | −32.201 | 104.266 | −20.280 | 1.00 | 44.56 | GZ00 | N |
| ATOM | 6176 | CA | PRO | X | 168 | −33.464 | 104.616 | −20.934 | 1.00 | 41.00 | GZ00 | C |
| ATOM | 6177 | C | PRO | X | 168 | −34.607 | 103.782 | −20.385 | 1.00 | 47.02 | GZ00 | C |
| ATOM | 6178 | O | PRO | X | 168 | −34.429 | 102.648 | −19.941 | 1.00 | 49.69 | GZ00 | O |
| ATOM | 6179 | CB | PRO | X | 168 | −33.202 | 104.334 | −22.419 | 1.00 | 43.99 | GZ00 | C |
| ATOM | 6180 | CG | PRO | X | 168 | −31.908 | 103.574 | −22.452 | 1.00 | 46.78 | GZ00 | C |
| ATOM | 6181 | CD | PRO | X | 168 | −31.141 | 103.904 | −21.227 | 1.00 | 39.42 | GZ00 | C |
| ATOM | 6182 | N | SER | X | 169 | −35.784 | 104.384 | −20.368 | 1.00 | 47.67 | GZ00 | N |
| ATOM | 6183 | CA | SER | X | 169 | −36.987 | 103.723 | −19.907 | 1.00 | 50.31 | GZ00 | C |
| ATOM | 6184 | C | SER | X | 169 | −38.095 | 103.966 | −20.920 | 1.00 | 49.36 | GZ00 | C |
| ATOM | 6185 | O | SER | X | 169 | −38.168 | 105.022 | −21.563 | 1.00 | 43.92 | GZ00 | O |
| ATOM | 6186 | CB | SER | X | 169 | −37.417 | 104.225 | −18.517 | 1.00 | 43.96 | GZ00 | C |
| ATOM | 6187 | OG | SER | X | 169 | −37.708 | 105.604 | −18.594 | 1.00 | 55.02 | GZ00 | O |
| ATOM | 6188 | N | LYS | X | 170 | −38.955 | 102.967 | −21.057 | 1.00 | 52.10 | GZ00 | N |
| ATOM | 6189 | CA | LYS | X | 170 | −39.974 | 102.986 | −22.090 | 1.00 | 53.24 | GZ00 | C |
| ATOM | 6190 | C | LYS | X | 170 | −41.088 | 103.939 | −21.683 | 1.00 | 52.61 | GZ00 | C |
| ATOM | 6191 | O | LYS | X | 170 | −41.529 | 103.938 | −20.531 | 1.00 | 55.96 | GZ00 | O |
| ATOM | 6192 | CB | LYS | X | 170 | −40.491 | 101.563 | −22.339 | 1.00 | 57.92 | GZ00 | C |
| ATOM | 6193 | CG | LYS | X | 170 | −41.220 | 101.352 | −23.678 | 1.00 | 61.39 | GZ00 | C |
| ATOM | 6194 | CD | LYS | X | 170 | −41.730 | 99.902 | −23.841 | 1.00 | 60.71 | GZ00 | C |
| ATOM | 6195 | CE | LYS | X | 170 | −40.545 | 98.928 | −24.020 | 1.00 | 68.36 | GZ00 | C |
| ATOM | 6196 | NZ | LYS | X | 170 | −40.911 | 97.510 | −24.330 | 1.00 | 76.29 | GZ00 | N1+ |
| ATOM | 6197 | N | GLN | X | 171 | −41.485 | 104.794 | −22.619 | 1.00 | 49.96 | GZ00 | N |
| ATOM | 6198 | CA | GLN | X | 171 | −42.633 | 105.668 | −22.499 | 1.00 | 48.46 | GZ00 | C |
| ATOM | 6199 | C | GLN | X | 171 | −43.897 | 104.888 | −22.851 | 1.00 | 55.64 | GZ00 | C |
| ATOM | 6200 | O | GLN | X | 171 | −43.843 | 103.749 | −23.324 | 1.00 | 58.51 | GZ00 | O |
| ATOM | 6201 | CB | GLN | X | 171 | −42.474 | 106.880 | −23.422 | 1.00 | 47.95 | GZ00 | C |
| ATOM | 6202 | CG | GLN | X | 171 | −41.214 | 107.699 | −23.166 | 1.00 | 44.29 | GZ00 | C |
| ATOM | 6203 | CD | GLN | X | 171 | −40.919 | 108.737 | −24.253 | 1.00 | 49.84 | GZ00 | C |
| ATOM | 6204 | OE1 | GLN | X | 171 | −40.035 | 109.590 | −24.090 | 1.00 | 47.77 | GZ00 | O |
| ATOM | 6205 | NE2 | GLN | X | 171 | −41.651 | 108.667 | −25.365 | 1.00 | 49.40 | GZ00 | N |
| ATOM | 6206 | N | SER | X | 172 | −45.052 | 105.506 | −22.605 | 1.00 | 61.57 | GZ00 | N |
| ATOM | 6207 | CA | SER | X | 172 | −46.313 | 104.841 | −22.927 | 1.00 | 67.22 | GZ00 | C |
| ATOM | 6208 | C | SER | X | 172 | −46.410 | 104.535 | −24.419 | 1.00 | 65.89 | GZ00 | C |
| ATOM | 6209 | O | SER | X | 172 | −46.922 | 103.477 | −24.808 | 1.00 | 65.81 | GZ00 | O |
| ATOM | 6210 | CB | SER | X | 172 | −47.491 | 105.696 | −22.460 | 1.00 | 55.65 | GZ00 | C |
| ATOM | 6211 | OG | SER | X | 172 | −47.391 | 106.989 | −23.016 | 1.00 | 65.82 | GZ00 | O |
| ATOM | 6212 | N | ASN | X | 173 | −45.891 | 105.434 | −25.268 | 1.00 | 64.43 | GZ00 | N |
| ATOM | 6213 | CA | ASN | X | 173 | −45.898 | 105.274 | −26.722 | 1.00 | 55.79 | GZ00 | C |
| ATOM | 6214 | C | ASN | X | 173 | −44.815 | 104.319 | −27.236 | 1.00 | 60.52 | GZ00 | C |
| ATOM | 6215 | O | ASN | X | 173 | −44.548 | 104.300 | −28.446 | 1.00 | 58.94 | GZ00 | O |
| ATOM | 6216 | CB | ASN | X | 173 | −45.762 | 106.634 | −27.419 | 1.00 | 56.26 | GZ00 | C |
| ATOM | 6217 | CG | ASN | X | 173 | −44.404 | 107.291 | −27.198 | 1.00 | 62.34 | GZ00 | C |
| ATOM | 6218 | OD1 | ASN | X | 173 | −43.536 | 106.762 | −26.496 | 1.00 | 55.11 | GZ00 | O |
| ATOM | 6219 | ND2 | ASN | X | 173 | −44.207 | 108.450 | −27.834 | 1.00 | 61.15 | GZ00 | N |
| ATOM | 6220 | N | ASN | X | 174 | −44.162 | 103.573 | −26.348 | 1.00 | 57.78 | GZ00 | N |
| ATOM | 6221 | CA | ASN | X | 174 | −43.139 | 102.573 | −26.649 | 1.00 | 62.92 | GZ00 | C |
| ATOM | 6222 | C | ASN | X | 174 | −41.849 | 103.159 | −27.207 | 1.00 | 62.49 | GZ00 | C |
| ATOM | 6223 | O | ASN | X | 174 | −40.923 | 102.390 | −27.512 | 1.00 | 56.92 | GZ00 | O |
| ATOM | 6224 | CB | ASN | X | 174 | −43.647 | 101.485 | −27.598 | 1.00 | 64.96 | GZ00 | C |
| ATOM | 6225 | CG | ASN | X | 174 | −44.491 | 100.463 | −26.877 | 1.00 | 72.73 | GZ00 | C |
| ATOM | 6226 | OD1 | ASN | X | 174 | −44.329 | 100.265 | −25.673 | 1.00 | 66.54 | GZ00 | O |
| ATOM | 6227 | ND2 | ASN | X | 174 | −45.394 | 99.809 | −27.599 | 1.00 | 78.95 | GZ00 | N |
| ATOM | 6228 | N | LYS | X | 175 | −41.738 | 104.481 | −27.328 | 1.00 | 58.39 | GZ00 | N |
| ATOM | 6229 | CA | LYS | X | 175 | −40.429 | 105.092 | −27.468 | 1.00 | 52.42 | GZ00 | C |
| ATOM | 6230 | C | LYS | X | 175 | −39.796 | 105.219 | −26.086 | 1.00 | 49.60 | GZ00 | C |

TABLE 10.3-continued

| | | | | | | | | | | | |
|---|---|---|---|---|---|---|---|---|---|---|---|
| ATOM | 6231 | O | LYS | X | 175 | −40.366 | 104.789 | −25.077 | 1.00 | 48.97 | GZ00 O |
| ATOM | 6232 | CB | LYS | X | 175 | −40.537 | 106.429 | −28.183 | 1.00 | 49.13 | GZ00 C |
| ATOM | 6233 | CG | LYS | X | 175 | −41.199 | 106.317 | −29.545 | 1.00 | 48.64 | GZ00 C |
| ATOM | 6234 | CD | LYS | X | 175 | −41.226 | 107.678 | −30.217 | 1.00 | 55.03 | GZ00 C |
| ATOM | 6235 | CE | LYS | X | 175 | −42.052 | 107.683 | −31.482 | 1.00 | 50.14 | GZ00 C |
| ATOM | 6236 | NZ | LYS | X | 175 | −41.863 | 108.996 | −32.147 | 1.00 | 65.58 | GZ00 N |
| ATOM | 6237 | N | TYR | X | 176 | −38.595 | 105.789 | −26.028 | 1.00 | 45.23 | GZ00 N |
| ATOM | 6238 | CA | TYR | X | 176 | −37.810 | 105.757 | −24.803 | 1.00 | 46.64 | GZ00 C |
| ATOM | 6239 | C | TYR | X | 176 | −37.405 | 107.159 | −24.375 | 1.00 | 46.24 | GZ00 C |
| ATOM | 6240 | O | TYR | X | 176 | −37.332 | 108.091 | −25.185 | 1.00 | 42.79 | GZ00 O |
| ATOM | 6241 | CB | TYR | X | 176 | −36.559 | 104.893 | −24.956 | 1.00 | 40.24 | GZ00 C |
| ATOM | 6242 | CG | TYR | X | 176 | −36.865 | 103.419 | −25.082 | 1.00 | 46.22 | GZ00 C |
| ATOM | 6243 | CD1 | TYR | X | 176 | −37.356 | 102.882 | −26.276 | 1.00 | 40.78 | GZ00 C |
| ATOM | 6244 | CD2 | TYR | X | 176 | −36.683 | 102.567 | −24.006 | 1.00 | 47.03 | GZ00 C |
| ATOM | 6245 | CE1 | TYR | X | 176 | −37.628 | 101.537 | −26.389 | 1.00 | 43.89 | GZ00 C |
| ATOM | 6246 | CE2 | TYR | X | 176 | −36.965 | 101.215 | −24.107 | 1.00 | 51.38 | GZ00 C |
| ATOM | 6247 | CZ | TYR | X | 176 | −37.439 | 100.706 | −25.294 | 1.00 | 52.19 | GZ00 C |
| ATOM | 6248 | OH | TYR | X | 176 | −37.713 | 99.359 | −25.380 | 1.00 | 57.66 | GZ00 O |
| ATOM | 6249 | N | ALA | X | 177 | −37.152 | 107.290 | −23.072 | 1.00 | 42.19 | GZ00 N |
| ATOM | 6250 | CA | ALA | X | 177 | −36.737 | 108.543 | −22.464 | 1.00 | 42.58 | GZ00 C |
| ATOM | 6251 | C | ALA | X | 177 | −35.553 | 108.309 | −21.543 | 1.00 | 39.64 | GZ00 C |
| ATOM | 6252 | O | ALA | X | 177 | −35.393 | 107.231 | −20.966 | 1.00 | 43.45 | GZ00 O |
| ATOM | 6253 | CB | ALA | X | 177 | −37.873 | 109.197 | −21.673 | 1.00 | 36.73 | GZ00 C |
| ATOM | 6254 | N | ALA | X | 178 | −34.735 | 109.339 | −21.397 | 1.00 | 35.05 | GZ00 N |
| ATOM | 6255 | CA | ALA | X | 178 | −33.635 | 109.306 | −20.451 | 1.00 | 41.99 | GZ00 C |
| ATOM | 6256 | C | ALA | X | 178 | −33.310 | 110.743 | −20.087 | 1.00 | 37.98 | GZ00 C |
| ATOM | 6257 | O | ALA | X | 178 | −33.750 | 111.681 | −20.751 | 1.00 | 42.02 | GZ00 O |
| ATOM | 6258 | CB | ALA | X | 178 | −32.406 | 108.580 | −21.021 | 1.00 | 32.61 | GZ00 C |
| ATOM | 6259 | N | SER | X | 179 | −32.574 | 110.910 | −18.999 | 1.00 | 43.75 | GZ00 N |
| ATOM | 6260 | CA | SER | X | 179 | −32.093 | 112.230 | −18.639 | 1.00 | 42.28 | GZ00 C |
| ATOM | 6261 | C | SER | X | 179 | −30.654 | 112.109 | −18.170 | 1.00 | 40.65 | GZ00 C |
| ATOM | 6262 | O | SER | X | 179 | −30.220 | 111.051 | −17.713 | 1.00 | 48.12 | GZ00 O |
| ATOM | 6263 | CB | SER | X | 179 | −32.956 | 112.897 | −17.572 | 1.00 | 35.06 | GZ00 C |
| ATOM | 6264 | OG | SER | X | 179 | −33.250 | 112.013 | −16.525 | 1.00 | 37.63 | GZ00 O |
| ATOM | 6265 | N | SER | X | 180 | −29.921 | 113.202 | −18.326 | 1.00 | 41.05 | GZ00 N |
| ATOM | 6266 | CA | SER | X | 180 | −28.523 | 113.321 | −17.950 | 1.00 | 41.22 | GZ00 C |
| ATOM | 6267 | C | SER | X | 180 | −28.336 | 114.625 | −17.185 | 1.00 | 47.40 | GZ00 C |
| ATOM | 6268 | O | SER | X | 180 | −28.846 | 115.667 | −17.606 | 1.00 | 38.98 | GZ00 O |
| ATOM | 6269 | CB | SER | X | 180 | −27.628 | 113.305 | −19.187 | 1.00 | 42.77 | GZ00 C |
| ATOM | 6270 | OG | SER | X | 180 | −26.270 | 113.291 | −18.824 | 1.00 | 40.90 | GZ00 O |
| ATOM | 6271 | N | TYR | X | 181 | −27.616 | 114.556 | −16.062 | 1.00 | 49.96 | GZ00 N |
| ATOM | 6272 | CA | TYR | X | 181 | −27.366 | 115.685 | −15.179 | 1.00 | 43.04 | GZ00 C |
| ATOM | 6273 | C | TYR | X | 181 | −25.872 | 115.961 | −15.084 | 1.00 | 48.60 | GZ00 C |
| ATOM | 6274 | O | TYR | X | 181 | −25.089 | 115.054 | −14.778 | 1.00 | 50.29 | GZ00 O |
| ATOM | 6275 | CB | TYR | X | 181 | −27.922 | 115.419 | −13.778 | 1.00 | 32.89 | GZ00 C |
| ATOM | 6276 | CG | TYR | X | 181 | −29.417 | 115.274 | −13.722 | 1.00 | 40.29 | GZ00 C |
| ATOM | 6277 | CD2 | TYR | X | 181 | −30.224 | 116.358 | −13.413 | 1.00 | 36.67 | GZ00 C |
| ATOM | 6278 | CD1 | TYR | X | 181 | −30.030 | 114.053 | −13.999 | 1.00 | 41.31 | GZ00 C |
| ATOM | 6279 | CE2 | TYR | X | 181 | −31.614 | 116.238 | −13.366 | 1.00 | 40.95 | GZ00 C |
| ATOM | 6280 | CE1 | TYR | X | 181 | −31.402 | 113.909 | −13.951 | 1.00 | 38.36 | GZ00 C |
| ATOM | 6281 | CZ | TYR | X | 181 | −32.195 | 115.000 | −13.636 | 1.00 | 46.60 | GZ00 C |
| ATOM | 6282 | OH | TYR | X | 181 | −33.561 | 114.845 | −13.591 | 1.00 | 40.50 | GZ00 O |
| ATOM | 6283 | N | LEU | X | 182 | −25.488 | 117.220 | −15.298 | 1.00 | 46.12 | GZ00 N |
| ATOM | 6284 | CA | LEU | X | 182 | −24.119 | 117.692 | −15.092 | 1.00 | 47.69 | GZ00 C |
| ATOM | 6285 | C | LEU | X | 182 | −24.094 | 118.629 | −13.889 | 1.00 | 50.67 | GZ00 C |
| ATOM | 6286 | O | LEU | X | 182 | −24.748 | 119.679 | −13.906 | 1.00 | 45.67 | GZ00 O |
| ATOM | 6287 | CB | LEU | X | 182 | −23.582 | 118.410 | −16.332 | 1.00 | 50.05 | GZ00 C |
| ATOM | 6288 | CG | LEU | X | 182 | −22.207 | 119.070 | −16.145 | 1.00 | 51.24 | GZ00 C |
| ATOM | 6289 | CD1 | LEU | X | 182 | −21.143 | 118.063 | −15.726 | 1.00 | 46.82 | GZ00 C |
| ATOM | 6290 | CD2 | LEU | X | 182 | −21.779 | 119.815 | −17.399 | 1.00 | 48.62 | GZ00 C |
| ATOM | 6291 | N | SER | X | 183 | −23.382 | 118.231 | −12.839 | 1.00 | 44.73 | GZ00 N |
| ATOM | 6292 | CA | SER | X | 183 | −23.218 | 119.066 | −11.658 | 1.00 | 53.81 | GZ00 C |
| ATOM | 6293 | C | SER | X | 183 | −21.967 | 119.928 | −11.797 | 1.00 | 58.46 | GZ00 C |
| ATOM | 6294 | O | SER | X | 183 | −20.896 | 119.430 | −12.152 | 1.00 | 65.34 | GZ00 O |
| ATOM | 6295 | CB | SER | X | 183 | −23.124 | 118.218 | −10.393 | 1.00 | 46.16 | GZ00 C |
| ATOM | 6296 | OG | SER | X | 183 | −24.237 | 117.370 | −10.277 | 1.00 | 53.51 | GZ00 O |
| ATOM | 6297 | N | LEU | X | 184 | −22.104 | 121.208 | −11.480 | 1.00 | 52.70 | GZ00 N |
| ATOM | 6298 | CA | LEU | X | 184 | −21.025 | 122.174 | −11.566 | 1.00 | 59.11 | GZ00 C |
| ATOM | 6299 | C | LEU | X | 184 | −21.049 | 123.030 | −10.308 | 1.00 | 62.24 | GZ00 C |
| ATOM | 6300 | O | LEU | X | 184 | −22.011 | 123.007 | −9.537 | 1.00 | 61.48 | GZ00 O |
| ATOM | 6301 | CB | LEU | X | 184 | −21.178 | 123.079 | −12.796 | 1.00 | 57.83 | GZ00 C |
| ATOM | 6302 | CG | LEU | X | 184 | −21.196 | 122.468 | −14.189 | 1.00 | 57.44 | GZ00 C |
| ATOM | 6303 | CD1 | LEU | X | 184 | −21.426 | 123.563 | −15.208 | 1.00 | 52.24 | GZ00 C |
| ATOM | 6304 | CD2 | LEU | X | 184 | −19.901 | 121.740 | −14.475 | 1.00 | 62.82 | GZ00 C |
| ATOM | 6305 | N | THR | X | 185 | −19.978 | 123.805 | −10.106 | 1.00 | 64.47 | GZ00 N |
| ATOM | 6306 | CA | THR | X | 185 | −20.070 | 124.923 | −9.176 | 1.00 | 60.49 | GZ00 C |
| ATOM | 6307 | C | THR | X | 185 | −20.580 | 126.161 | −9.899 | 1.00 | 61.60 | GZ00 C |
| ATOM | 6308 | O | THR | X | 185 | −20.455 | 126.279 | −11.129 | 1.00 | 56.95 | GZ00 O |
| ATOM | 6309 | CB | THR | X | 185 | −18.710 | 125.225 | −8.555 | 1.00 | 61.74 | GZ00 C |
| ATOM | 6310 | OG1 | THR | X | 185 | −17.813 | 125.690 | −9.577 | 1.00 | 64.33 | GZ00 O |

TABLE 10.3-continued

| | | | | | | | | | | | |
|---|---|---|---|---|---|---|---|---|---|---|---|
| ATOM | 6311 | CG2 | THR | X | 185 | −18.149 | 124.005 | −7.840 | 1.00 | 49.10 | GZ00 | C |
| ATOM | 6312 | N | PRO | X | 186 | −21.194 | 127.094 | −9.165 | 1.00 | 63.67 | GZ00 | N |
| ATOM | 6313 | CA | PRO | X | 186 | −21.536 | 128.392 | −9.774 | 1.00 | 66.91 | GZ00 | C |
| ATOM | 6314 | C | PRO | X | 186 | −20.364 | 129.034 | −10.512 | 1.00 | 66.84 | GZ00 | C |
| ATOM | 6315 | O | PRO | X | 186 | −20.570 | 129.710 | −11.529 | 1.00 | 66.08 | GZ00 | O |
| ATOM | 6316 | CB | PRO | X | 186 | −21.974 | 129.227 | −8.564 | 1.00 | 55.91 | GZ00 | C |
| ATOM | 6317 | CG | PRO | X | 186 | −22.496 | 128.215 | −7.584 | 1.00 | 54.51 | GZ00 | C |
| ATOM | 6318 | CD | PRO | X | 186 | −21.625 | 127.004 | −7.757 | 1.00 | 56.56 | GZ00 | C |
| ATOM | 6319 | N | GLU | X | 187 | −19.133 | 128.818 | −10.030 | 1.00 | 69.10 | GZ00 | N |
| ATOM | 6320 | CA | GLU | X | 187 | −17.938 | 129.365 | −10.676 | 1.00 | 76.90 | GZ00 | C |
| ATOM | 6321 | C | GLU | X | 187 | −17.718 | 128.740 | −12.049 | 1.00 | 75.85 | GZ00 | C |
| ATOM | 6322 | O | GLU | X | 187 | −17.599 | 129.450 | −13.059 | 1.00 | 69.16 | GZ00 | O |
| ATOM | 6323 | CB | GLU | X | 187 | −16.708 | 129.124 | −9.791 | 1.00 | 78.07 | GZ00 | C |
| ATOM | 6324 | CG | GLU | X | 187 | −17.004 | 128.966 | −8.297 | 1.00 | 81.84 | GZ00 | C |
| ATOM | 6325 | CD | GLU | X | 187 | −17.761 | 130.158 | −7.714 | 1.00 | 100.11 | GZ00 | C |
| ATOM | 6326 | OE1 | GLU | X | 187 | −17.435 | 131.317 | −8.086 | 1.00 | 95.34 | GZ00 | O |
| ATOM | 6327 | OE2 | GLU | X | 187 | −18.692 | 129.930 | −6.901 | 1.00 | 102.20 | GZ00 | O1− |
| ATOM | 6328 | N | GLN | X | 188 | −17.652 | 127.402 | −12.095 | 1.00 | 68.87 | GZ00 | N |
| ATOM | 6329 | CA | GLN | X | 188 | −17.499 | 126.699 | −13.361 | 1.00 | 62.65 | GZ00 | C |
| ATOM | 6330 | C | GLN | X | 188 | −18.597 | 127.093 | −14.333 | 1.00 | 65.88 | GZ00 | C |
| ATOM | 6331 | O | GLN | X | 188 | −18.350 | 127.252 | −15.533 | 1.00 | 66.09 | GZ00 | O |
| ATOM | 6332 | CB | GLN | X | 188 | −17.540 | 125.195 | −13.127 | 1.00 | 65.71 | GZ00 | C |
| ATOM | 6333 | CG | GLN | X | 188 | −16.451 | 124.635 | −12.256 | 1.00 | 60.72 | GZ00 | C |
| ATOM | 6334 | CD | GLN | X | 188 | −16.821 | 123.252 | −11.764 | 1.00 | 66.14 | GZ00 | C |
| ATOM | 6335 | OE1 | GLN | X | 188 | −17.996 | 122.941 | −11.617 | 1.00 | 70.69 | GZ00 | O |
| ATOM | 6336 | NE2 | GLN | X | 188 | −15.827 | 122.419 | −11.504 | 1.00 | 73.28 | GZ00 | N |
| ATOM | 6337 | N | TRP | X | 189 | −19.821 | 127.251 | −13.828 | 1.00 | 60.70 | GZ00 | N |
| ATOM | 6338 | CA | TRP | X | 189 | −20.941 | 127.588 | −14.695 | 1.00 | 61.89 | GZ00 | C |
| ATOM | 6339 | C | TRP | X | 189 | −20.728 | 128.932 | −15.381 | 1.00 | 66.39 | GZ00 | C |
| ATOM | 6340 | O | TRP | X | 189 | −20.889 | 129.048 | −16.601 | 1.00 | 69.50 | GZ00 | O |
| ATOM | 6341 | CB | TRP | X | 189 | −22.233 | 127.581 | −13.880 | 1.00 | 53.09 | GZ00 | C |
| ATOM | 6342 | CG | TRP | X | 189 | −23.388 | 128.262 | −14.520 | 1.00 | 48.26 | GZ00 | C |
| ATOM | 6343 | CD1 | TRP | X | 189 | −24.099 | 129.288 | −13.998 | 1.00 | 54.93 | GZ00 | C |
| ATOM | 6344 | CD2 | TRP | X | 189 | −23.972 | 127.976 | −15.799 | 1.00 | 53.12 | GZ00 | C |
| ATOM | 6345 | NE1 | TRP | X | 189 | −25.102 | 129.665 | −14.859 | 1.00 | 60.99 | GZ00 | N |
| ATOM | 6346 | CE2 | TRP | X | 189 | −25.047 | 128.878 | −15.976 | 1.00 | 52.94 | GZ00 | C |
| ATOM | 6347 | CE3 | TRP | X | 189 | −23.704 | 127.040 | −16.803 | 1.00 | 54.03 | GZ00 | C |
| ATOM | 6348 | CZ2 | TRP | X | 189 | −25.861 | 128.873 | −17.116 | 1.00 | 55.81 | GZ00 | C |
| ATOM | 6349 | CZ3 | TRP | X | 189 | −24.512 | 127.036 | −17.944 | 1.00 | 57.95 | GZ00 | C |
| ATOM | 6350 | CH2 | TRP | X | 189 | −25.577 | 127.953 | −18.090 | 1.00 | 55.87 | GZ00 | C |
| ATOM | 6351 | N | LYS | X | 190 | −20.337 | 129.957 | −14.619 | 1.00 | 75.20 | GZ00 | N |
| ATOM | 6352 | CA | LYS | X | 190 | −20.232 | 131.302 | −15.184 | 1.00 | 80.83 | GZ00 | C |
| ATOM | 6353 | C | LYS | X | 190 | −18.940 | 131.535 | −15.962 | 1.00 | 78.13 | GZ00 | C |
| ATOM | 6354 | O | LYS | X | 190 | −18.891 | 132.458 | −16.786 | 1.00 | 75.06 | GZ00 | O |
| ATOM | 6355 | CB | LYS | X | 190 | −20.398 | 132.357 | −14.081 | 1.00 | 73.65 | GZ00 | C |
| ATOM | 6356 | CG | LYS | X | 190 | −21.825 | 132.394 | −13.491 | 1.00 | 81.54 | GZ00 | C |
| ATOM | 6357 | CD | LYS | X | 190 | −21.973 | 133.326 | −12.286 | 1.00 | 80.94 | GZ00 | C |
| ATOM | 6358 | CE | LYS | X | 190 | −23.413 | 133.330 | −11.769 | 1.00 | 79.11 | GZ00 | C |
| ATOM | 6359 | NZ | LYS | X | 190 | −23.602 | 134.127 | −10.516 | 1.00 | 82.23 | GZ00 | N1+ |
| ATOM | 6360 | N | SER | X | 191 | −17.917 | 130.698 | −15.765 | 1.00 | 70.70 | GZ00 | N |
| ATOM | 6361 | CA | SER | X | 191 | −16.625 | 130.963 | −16.388 | 1.00 | 77.12 | GZ00 | C |
| ATOM | 6362 | C | SER | X | 191 | −16.645 | 130.672 | −17.891 | 1.00 | 80.54 | GZ00 | C |
| ATOM | 6363 | O | SER | X | 191 | −16.183 | 131.494 | −18.691 | 1.00 | 90.60 | GZ00 | O |
| ATOM | 6364 | CB | SER | X | 191 | −15.528 | 130.163 | −15.676 | 1.00 | 70.51 | GZ00 | C |
| ATOM | 6365 | OG | SER | X | 191 | −15.673 | 128.776 | −15.878 | 1.00 | 73.70 | GZ00 | O |
| ATOM | 6366 | N | HIS | X | 192 | −17.193 | 129.529 | −18.303 | 1.00 | 79.21 | GZ00 | N |
| ATOM | 6367 | CA | HIS | X | 192 | −17.144 | 129.148 | −19.709 | 1.00 | 68.99 | GZ00 | C |
| ATOM | 6368 | C | HIS | X | 192 | −18.216 | 129.880 | −20.503 | 1.00 | 68.52 | GZ00 | C |
| ATOM | 6369 | O | HIS | X | 192 | −19.228 | 130.326 | −19.959 | 1.00 | 75.08 | GZ00 | O |
| ATOM | 6370 | CB | HIS | X | 192 | −17.328 | 127.646 | −19.858 | 1.00 | 67.33 | GZ00 | C |
| ATOM | 6371 | CG | HIS | X | 192 | −16.211 | 126.849 | −19.270 | 1.00 | 72.96 | GZ00 | C |
| ATOM | 6372 | ND1 | HIS | X | 192 | −16.133 | 126.565 | −17.924 | 1.00 | 69.38 | GZ00 | N |
| ATOM | 6373 | CD2 | HIS | X | 192 | −15.134 | 126.260 | −19.844 | 1.00 | 69.24 | GZ00 | C |
| ATOM | 6374 | CE1 | HIS | X | 192 | −15.051 | 125.843 | −17.690 | 1.00 | 77.85 | GZ00 | C |
| ATOM | 6375 | NE2 | HIS | X | 192 | −14.427 | 125.644 | −18.839 | 1.00 | 78.93 | GZ00 | N |
| ATOM | 6376 | N | ARG | X | 193 | −17.980 | 130.015 | −21.811 | 1.00 | 67.36 | GZ00 | N |
| ATOM | 6377 | CA | ARG | X | 193 | −18.945 | 130.743 | −22.627 | 1.00 | 70.06 | GZ00 | C |
| ATOM | 6378 | C | ARG | X | 193 | −20.261 | 129.998 | −22.711 | 1.00 | 73.81 | GZ00 | C |
| ATOM | 6379 | O | ARG | X | 193 | −21.329 | 130.620 | −22.671 | 1.00 | 71.37 | GZ00 | O |
| ATOM | 6380 | CB | ARG | X | 193 | −18.411 | 131.013 | −24.033 | 1.00 | 83.17 | GZ00 | C |
| ATOM | 6381 | CG | ARG | X | 193 | −17.125 | 131.815 | −24.098 | 1.00 | 91.89 | GZ00 | C |
| ATOM | 6382 | CD | ARG | X | 193 | −16.644 | 131.932 | −25.540 | 1.00 | 98.59 | GZ00 | C |
| ATOM | 6383 | NE | ARG | X | 193 | −15.566 | 132.909 | −25.682 | 1.00 | 110.88 | GZ00 | N |
| ATOM | 6384 | CZ | ARG | X | 193 | −14.801 | 133.031 | −26.763 | 1.00 | 111.56 | GZ00 | C |
| ATOM | 6385 | NH1 | ARG | X | 193 | −13.838 | 133.947 | −26.798 | 1.00 | 100.02 | GZ00 | N1+ |
| ATOM | 6386 | NH2 | ARG | X | 193 | −15.019 | 132.260 | −27.824 | 1.00 | 112.85 | GZ00 | N |
| ATOM | 6387 | N | SER | X | 194 | −20.207 | 128.670 | −22.831 | 1.00 | 80.31 | GZ00 | N |
| ATOM | 6388 | CA | SER | X | 194 | −21.414 | 127.865 | −22.991 | 1.00 | 74.11 | GZ00 | C |
| ATOM | 6389 | C | SER | X | 194 | −21.137 | 126.416 | −22.618 | 1.00 | 71.90 | GZ00 | C |
| ATOM | 6390 | O | SER | X | 194 | −19.991 | 125.955 | −22.604 | 1.00 | 68.02 | GZ00 | O |

TABLE 10.3-continued

| ATOM | 6391 | CB | SER | X | 194 | −21.945 | 127.911 | −24.425 | 1.00 | 69.53 | GZ00 | C |
| ATOM | 6392 | OG | SER | X | 194 | −21.159 | 127.065 | −25.246 | 1.00 | 67.74 | GZ00 | O |
| ATOM | 6393 | N | TYR | X | 195 | −22.224 | 125.690 | −22.382 | 1.00 | 67.26 | GZ00 | N |
| ATOM | 6394 | CA | TYR | X | 195 | −22.180 | 124.258 | −22.168 | 1.00 | 63.57 | GZ00 | C |
| ATOM | 6395 | C | TYR | X | 195 | −23.120 | 123.573 | −23.142 | 1.00 | 64.49 | GZ00 | C |
| ATOM | 6396 | O | TYR | X | 195 | −24.117 | 124.154 | −23.584 | 1.00 | 56.47 | GZ00 | O |
| ATOM | 6397 | CB | TYR | X | 195 | −22.572 | 123.889 | −20.766 | 1.00 | 57.00 | GZ00 | C |
| ATOM | 6398 | CG | TYR | X | 195 | −21.519 | 124.195 | −19.752 | 1.00 | 60.50 | GZ00 | C |
| ATOM | 6399 | CD1 | TYR | X | 195 | −21.344 | 125.486 | −19.268 | 1.00 | 63.71 | GZ00 | C |
| ATOM | 6400 | CD2 | TYR | X | 195 | −20.712 | 123.184 | −19.254 | 1.00 | 60.86 | GZ00 | C |
| ATOM | 6401 | CE1 | TYR | X | 195 | −20.383 | 125.757 | −18.319 | 1.00 | 66.00 | GZ00 | C |
| ATOM | 6402 | CE2 | TYR | X | 195 | −19.756 | 123.440 | −18.310 | 1.00 | 67.49 | GZ00 | C |
| ATOM | 6403 | CZ | TYR | X | 195 | −19.588 | 124.727 | −17.850 | 1.00 | 65.78 | GZ00 | C |
| ATOM | 6404 | OH | TYR | X | 195 | −18.626 | 124.963 | −16.906 | 1.00 | 71.05 | GZ00 | O |
| ATOM | 6405 | N | SER | X | 196 | −22.786 | 122.326 | −23.470 | 1.00 | 62.79 | GZ00 | N |
| ATOM | 6406 | CA | SER | X | 196 | −23.538 | 121.568 | −24.453 | 1.00 | 61.48 | GZ00 | C |
| ATOM | 6407 | C | SER | X | 196 | −23.826 | 120.160 | −23.952 | 1.00 | 61.15 | GZ00 | C |
| ATOM | 6408 | O | SER | X | 196 | −23.001 | 119.525 | −23.279 | 1.00 | 54.07 | GZ00 | O |
| ATOM | 6409 | CB | SER | X | 196 | −22.791 | 121.504 | −25.783 | 1.00 | 63.75 | GZ00 | C |
| ATOM | 6410 | OG | SER | X | 196 | −22.721 | 122.789 | −26.372 | 1.00 | 69.20 | GZ00 | O |
| ATOM | 6411 | N | CYS | X | 197 | −25.014 | 119.690 | −24.294 | 1.00 | 52.83 | GZ00 | N |
| ATOM | 6412 | CA | CYS | X | 197 | −25.428 | 118.315 | −24.085 | 1.00 | 51.91 | GZ00 | C |
| ATOM | 6413 | C | CYS | X | 197 | −25.524 | 117.683 | −25.463 | 1.00 | 55.35 | GZ00 | C |
| ATOM | 6414 | O | CYS | X | 197 | −26.303 | 118.149 | −26.305 | 1.00 | 55.75 | GZ00 | O |
| ATOM | 6415 | CB | CYS | X | 197 | −26.772 | 118.256 | −23.354 | 1.00 | 51.31 | GZ00 | C |
| ATOM | 6416 | SG | CYS | X | 197 | −27.349 | 116.579 | −23.083 | 1.00 | 51.29 | GZ00 | S |
| ATOM | 6417 | N | GLN | X | 198 | −24.716 | 116.655 | −25.704 | 1.00 | 49.43 | GZ00 | N |
| ATOM | 6418 | CA | GLN | X | 198 | −24.668 | 115.979 | −26.996 | 1.00 | 53.99 | GZ00 | C |
| ATOM | 6419 | C | GLN | X | 198 | −25.193 | 114.555 | −26.839 | 1.00 | 53.90 | GZ00 | C |
| ATOM | 6420 | O | GLN | X | 198 | −24.579 | 113.736 | −26.139 | 1.00 | 49.13 | GZ00 | O |
| ATOM | 6421 | CB | GLN | X | 198 | −23.245 | 115.967 | −27.554 | 1.00 | 51.29 | GZ00 | C |
| ATOM | 6422 | CG | GLN | X | 198 | −22.782 | 117.315 | −28.078 | 1.00 | 67.46 | GZ00 | C |
| ATOM | 6423 | CD | GLN | X | 198 | −21.293 | 117.357 | −28.388 | 1.00 | 69.14 | GZ00 | C |
| ATOM | 6424 | OE1 | GLN | X | 198 | −20.565 | 116.404 | −28.128 | 1.00 | 72.78 | GZ00 | O |
| ATOM | 6425 | NE2 | GLN | X | 198 | −20.838 | 118.470 | −28.943 | 1.00 | 73.70 | GZ00 | N |
| ATOM | 6426 | N | VAL | X | 199 | −26.299 | 114.256 | −27.519 | 1.00 | 45.97 | GZ00 | N |
| ATOM | 6427 | CA | VAL | X | 199 | −26.970 | 112.961 | −27.422 | 1.00 | 47.62 | GZ00 | C |
| ATOM | 6428 | C | VAL | X | 199 | −26.780 | 112.222 | −28.743 | 1.00 | 49.39 | GZ00 | C |
| ATOM | 6429 | O | VAL | X | 199 | −27.294 | 112.648 | −29.786 | 1.00 | 43.67 | GZ00 | O |
| ATOM | 6430 | CB | VAL | X | 199 | −28.465 | 113.117 | −27.091 | 1.00 | 38.03 | GZ00 | C |
| ATOM | 6431 | CG1 | VAL | X | 199 | −29.116 | 111.753 | −26.854 | 1.00 | 36.64 | GZ00 | C |
| ATOM | 6432 | CG2 | VAL | X | 199 | −28.642 | 114.009 | −25.881 | 1.00 | 43.16 | GZ00 | C |
| ATOM | 6433 | N | THR | X | 200 | −26.069 | 111.100 | −28.699 | 1.00 | 44.37 | GZ00 | N |
| ATOM | 6434 | CA | THR | X | 200 | −25.870 | 110.288 | −29.888 | 1.00 | 47.13 | GZ00 | C |
| ATOM | 6435 | C | THR | X | 200 | −26.837 | 109.107 | −29.884 | 1.00 | 46.93 | GZ00 | C |
| ATOM | 6436 | O | THR | X | 200 | −26.959 | 108.389 | −28.886 | 1.00 | 37.31 | GZ00 | O |
| ATOM | 6437 | CB | THR | X | 200 | −24.426 | 109.819 | −29.990 | 1.00 | 47.07 | GZ00 | C |
| ATOM | 6438 | OG1 | THR | X | 200 | −23.583 | 110.975 | −30.046 | 1.00 | 49.61 | GZ00 | O |
| ATOM | 6439 | CG2 | THR | X | 200 | −24.222 | 108.955 | −31.246 | 1.00 | 48.16 | GZ00 | C |
| ATOM | 6440 | N | HIS | X | 201 | −27.533 | 108.936 | −31.002 | 1.00 | 40.95 | GZ00 | N |
| ATOM | 6441 | CA | HIS | X | 201 | −28.533 | 107.899 | −31.163 | 1.00 | 45.21 | GZ00 | C |
| ATOM | 6442 | C | HIS | X | 201 | −28.414 | 107.309 | −32.559 | 1.00 | 45.62 | GZ00 | C |
| ATOM | 6443 | O | HIS | X | 201 | −28.609 | 108.023 | −33.549 | 1.00 | 41.52 | GZ00 | O |
| ATOM | 6444 | CB | HIS | X | 201 | −29.928 | 108.468 | −30.953 | 1.00 | 37.81 | GZ00 | C |
| ATOM | 6445 | CG | HIS | X | 201 | −31.009 | 107.472 | −31.174 | 1.00 | 40.25 | GZ00 | C |
| ATOM | 6446 | ND1 | HIS | X | 201 | −31.717 | 107.395 | −32.354 | 1.00 | 39.48 | GZ00 | N |
| ATOM | 6447 | CD2 | HIS | X | 201 | −31.492 | 106.492 | −30.372 | 1.00 | 32.60 | GZ00 | C |
| ATOM | 6448 | CE1 | HIS | X | 201 | −32.614 | 106.425 | −32.257 | 1.00 | 41.48 | GZ00 | C |
| ATOM | 6449 | NE2 | HIS | X | 201 | −32.500 | 105.865 | −31.063 | 1.00 | 36.04 | GZ00 | N |
| ATOM | 6450 | N | GLU | X | 202 | −28.100 | 106.014 | −32.636 | 1.00 | 40.07 | GZ00 | N |
| ATOM | 6451 | CA | GLU | X | 202 | −27.996 | 105.307 | −33.916 | 1.00 | 39.77 | GZ00 | C |
| ATOM | 6452 | C | GLU | X | 202 | −27.068 | 106.042 | −34.889 | 1.00 | 44.82 | GZ00 | C |
| ATOM | 6453 | O | GLU | X | 202 | −27.387 | 106.247 | −36.062 | 1.00 | 40.88 | GZ00 | O |
| ATOM | 6454 | CB | GLU | X | 202 | −29.376 | 105.095 | −34.535 | 1.00 | 36.52 | GZ00 | C |
| ATOM | 6455 | CG | GLU | X | 202 | −30.307 | 104.272 | −33.669 | 1.00 | 41.95 | GZ00 | C |
| ATOM | 6456 | CD | GLU | X | 202 | −29.852 | 102.821 | −33.573 | 1.00 | 51.67 | GZ00 | C |
| ATOM | 6457 | OE1 | GLU | X | 202 | −29.603 | 102.188 | −34.631 | 1.00 | 51.18 | GZ00 | O |
| ATOM | 6458 | OE2 | GLU | X | 202 | −29.735 | 102.316 | −32.433 | 1.00 | 49.62 | GZ00 | O1− |
| ATOM | 6459 | N | GLY | X | 203 | −25.911 | 106.464 | −34.381 | 1.00 | 41.22 | GZ00 | N |
| ATOM | 6460 | CA | GLY | X | 203 | −24.926 | 107.146 | −35.193 | 1.00 | 42.73 | GZ00 | C |
| ATOM | 6461 | C | GLY | X | 203 | −25.235 | 108.578 | −35.586 | 1.00 | 47.72 | GZ00 | C |
| ATOM | 6462 | O | GLY | X | 203 | −24.445 | 109.169 | −36.321 | 1.00 | 53.27 | GZ00 | O |
| ATOM | 6463 | N | SER | X | 206 | −26.322 | 109.176 | −35.101 | 1.00 | 52.11 | GZ00 | N |
| ATOM | 6464 | CA | SER | X | 206 | −26.642 | 110.577 | −35.375 | 1.00 | 50.86 | GZ00 | C |
| ATOM | 6465 | C | SER | X | 206 | −26.773 | 111.328 | −34.056 | 1.00 | 52.21 | GZ00 | C |
| ATOM | 6466 | O | SER | X | 206 | −27.448 | 110.853 | −33.136 | 1.00 | 52.48 | GZ00 | O |
| ATOM | 6467 | CB | SER | X | 206 | −27.944 | 110.707 | −36.167 | 1.00 | 47.57 | GZ00 | C |
| ATOM | 6468 | OG | SER | X | 206 | −27.838 | 110.125 | −37.454 | 1.00 | 59.00 | GZ00 | O |
| ATOM | 6469 | N | THR | X | 207 | −26.128 | 112.488 | −33.953 | 1.00 | 50.76 | GZ00 | N |
| ATOM | 6470 | CA | THR | X | 207 | −26.108 | 113.241 | −32.704 | 1.00 | 55.87 | GZ00 | C |

TABLE 10.3-continued

| | | | | | | | | | | | |
|---|---|---|---|---|---|---|---|---|---|---|---|
| ATOM | 6471 | C | THR | X | 207 | −27.025 | 114.462 | −32.764 | 1.00 | 57.12 | GZ00 C |
| ATOM | 6472 | O | THR | X | 207 | −27.074 | 115.180 | −33.767 | 1.00 | 57.64 | GZ00 O |
| ATOM | 6473 | CB | THR | X | 207 | −24.696 | 113.690 | −32.344 | 1.00 | 48.26 | GZ00 C |
| ATOM | 6474 | OG1 | THR | X | 207 | −24.359 | 114.813 | −33.157 | 1.00 | 73.99 | GZ00 O |
| ATOM | 6475 | CG2 | THR | X | 207 | −23.702 | 112.580 | −32.600 | 1.00 | 47.46 | GZ00 C |
| ATOM | 6476 | N | VAL | X | 208 | −27.777 | 114.659 | −31.690 | 1.00 | 49.79 | GZ00 N |
| ATOM | 6477 | CA | VAL | X | 208 | −28.598 | 115.842 | −31.472 | 1.00 | 52.71 | GZ00 C |
| ATOM | 6478 | C | VAL | X | 208 | −27.951 | 116.636 | −30.343 | 1.00 | 55.59 | GZ00 C |
| ATOM | 6479 | O | VAL | X | 208 | −27.557 | 116.063 | −29.317 | 1.00 | 52.08 | GZ00 O |
| ATOM | 6480 | CB | VAL | X | 208 | −30.047 | 115.452 | −31.131 | 1.00 | 51.79 | GZ00 C |
| ATOM | 6481 | CG1 | VAL | X | 208 | −30.880 | 116.672 | −30.802 | 1.00 | 49.77 | GZ00 C |
| ATOM | 6482 | CG2 | VAL | X | 208 | −30.666 | 114.651 | −32.276 | 1.00 | 48.08 | GZ00 C |
| ATOM | 6483 | N | GLU | X | 209 | −27.787 | 117.939 | −30.547 | 1.00 | 56.25 | GZ00 N |
| ATOM | 6484 | CA | GLU | X | 209 | −27.107 | 118.778 | −29.571 | 1.00 | 56.90 | GZ00 C |
| ATOM | 6485 | C | GLU | X | 209 | −27.976 | 119.957 | −29.174 | 1.00 | 58.39 | GZ00 C |
| ATOM | 6486 | O | GLU | X | 209 | −28.692 | 120.525 | −30.005 | 1.00 | 55.14 | GZ00 O |
| ATOM | 6487 | CB | GLU | X | 209 | −25.772 | 119.293 | −30.087 | 1.00 | 57.63 | GZ00 C |
| ATOM | 6488 | CG | GLU | X | 209 | −25.088 | 120.229 | −29.113 | 1.00 | 64.92 | GZ00 C |
| ATOM | 6489 | CD | GLU | X | 209 | −23.766 | 120.754 | −29.630 | 1.00 | 76.32 | GZ00 C |
| ATOM | 6490 | OE1 | GLU | X | 209 | −22.869 | 119.942 | −29.932 | 1.00 | 78.95 | GZ00 O |
| ATOM | 6491 | OE2 | GLU | X | 209 | −23.636 | 121.986 | −29.766 | 1.00 | 85.57 | GZ00 O1− |
| ATOM | 6492 | N | LYS | X | 210 | −27.935 | 120.282 | −27.886 | 1.00 | 62.74 | GZ00 N |
| ATOM | 6493 | CA | LYS | X | 210 | −28.467 | 121.522 | −27.345 | 1.00 | 53.79 | GZ00 C |
| ATOM | 6494 | C | LYS | X | 210 | −27.379 | 122.171 | −26.505 | 1.00 | 56.56 | GZ00 C |
| ATOM | 6495 | O | LYS | X | 210 | −26.616 | 121.476 | −25.823 | 1.00 | 56.28 | GZ00 O |
| ATOM | 6496 | CB | LYS | X | 210 | −29.711 | 121.279 | −26.513 | 1.00 | 53.44 | GZ00 C |
| ATOM | 6497 | CG | LYS | X | 210 | −30.907 | 120.841 | −27.324 | 1.00 | 54.02 | GZ00 C |
| ATOM | 6498 | CD | LYS | X | 210 | −31.098 | 121.748 | −28.509 | 1.00 | 54.29 | GZ00 C |
| ATOM | 6499 | CE | LYS | X | 210 | −32.343 | 121.367 | −29.282 | 1.00 | 55.10 | GZ00 C |
| ATOM | 6500 | NZ | LYS | X | 210 | −33.545 | 121.832 | −28.528 | 1.00 | 61.72 | GZ00 N1+ |
| ATOM | 6501 | N | THR | X | 211 | −27.270 | 123.498 | −26.592 | 1.00 | 59.32 | GZ00 N |
| ATOM | 6502 | CA | THR | X | 211 | −26.267 | 124.229 | −25.828 | 1.00 | 59.32 | GZ00 C |
| ATOM | 6503 | C | THR | X | 211 | −26.946 | 125.341 | −25.039 | 1.00 | 55.85 | GZ00 C |
| ATOM | 6504 | O | THR | X | 211 | −27.984 | 125.869 | −25.443 | 1.00 | 52.37 | GZ00 O |
| ATOM | 6505 | CB | THR | X | 211 | −25.177 | 124.830 | −26.725 | 1.00 | 59.58 | GZ00 C |
| ATOM | 6506 | OG1 | THR | X | 211 | −25.586 | 126.134 | −27.141 | 1.00 | 68.27 | GZ00 O |
| ATOM | 6507 | CG2 | THR | X | 211 | −24.975 | 123.970 | −27.975 | 1.00 | 57.88 | GZ00 C |
| ATOM | 6508 | N | VAL | X | 212 | −26.348 | 125.706 | −23.911 | 1.00 | 52.69 | GZ00 N |
| ATOM | 6509 | CA | VAL | X | 212 | −26.936 | 126.709 | −23.035 | 1.00 | 63.41 | GZ00 C |
| ATOM | 6510 | C | VAL | X | 212 | −25.825 | 127.640 | −22.548 | 1.00 | 67.46 | GZ00 C |
| ATOM | 6511 | O | VAL | X | 212 | −24.665 | 127.233 | −22.408 | 1.00 | 65.23 | GZ00 O |
| ATOM | 6512 | CB | VAL | X | 212 | −27.702 | 126.029 | −21.866 | 1.00 | 57.88 | GZ00 C |
| ATOM | 6513 | CG1 | VAL | X | 212 | −26.783 | 125.712 | −20.700 | 1.00 | 44.64 | GZ00 C |
| ATOM | 6514 | CG2 | VAL | X | 212 | −28.897 | 126.846 | −21.442 | 1.00 | 65.99 | GZ00 C |
| ATOM | 6515 | N | ALA | X | 213 | −26.174 | 128.916 | −22.332 | 1.00 | 65.82 | GZ00 N |
| ATOM | 6516 | CA | ALA | X | 213 | −25.166 | 129.919 | −21.988 | 1.00 | 71.28 | GZ00 C |
| ATOM | 6517 | C | ALA | X | 213 | −25.503 | 130.667 | −20.702 | 1.00 | 73.86 | GZ00 C |
| ATOM | 6518 | O | ALA | X | 213 | −26.677 | 130.982 | −20.445 | 1.00 | 75.77 | GZ00 O |
| ATOM | 6519 | CB | ALA | X | 213 | −25.003 | 130.928 | −23.133 | 1.00 | 69.34 | GZ00 C |
| ATOM | 6520 | N | PRO | X | 214 | −24.486 | 130.994 | −19.889 | 1.00 | 70.92 | GZ00 N |
| ATOM | 6521 | CA | PRO | X | 214 | −24.746 | 131.692 | −18.614 | 1.00 | 72.76 | GZ00 C |
| ATOM | 6522 | C | PRO | X | 214 | −25.314 | 133.090 | −18.773 | 1.00 | 82.62 | GZ00 C |
| ATOM | 6523 | O | PRO | X | 214 | −25.933 | 133.596 | −17.827 | 1.00 | 89.01 | GZ00 O |
| ATOM | 6524 | CB | PRO | X | 214 | −23.366 | 131.732 | −17.943 | 1.00 | 66.71 | GZ00 C |
| ATOM | 6525 | CG | PRO | X | 214 | −22.637 | 130.585 | −18.525 | 1.00 | 65.72 | GZ00 C |
| ATOM | 6526 | CD | PRO | X | 214 | −23.119 | 130.445 | −19.944 | 1.00 | 70.60 | GZ00 C |
| ATOM | 6527 | N | THR | X | 215 | −25.149 | 133.725 | −19.928 | 1.00 | 84.77 | GZ00 N |
| ATOM | 6528 | CA | THR | X | 215 | −25.832 | 134.986 | −20.202 | 1.00 | 96.30 | GZ00 C |
| ATOM | 6529 | C | THR | X | 215 | −27.332 | 134.702 | −20.252 | 1.00 | 95.28 | GZ00 C |
| ATOM | 6530 | O | THR | X | 215 | −27.859 | 134.231 | −21.265 | 1.00 | 91.48 | GZ00 O |
| ATOM | 6531 | CB | THR | X | 215 | −25.328 | 135.593 | −21.510 | 1.00 | 97.14 | GZ00 C |
| ATOM | 6532 | OG1 | THR | X | 215 | −25.743 | 134.773 | −22.612 | 1.00 | 87.67 | GZ00 O |
| ATOM | 6533 | CG2 | THR | X | 215 | −23.793 | 135.691 | −21.507 | 1.00 | 90.01 | GZ00 C |
| ATOM | 6534 | N | GLU | X | 216 | −28.027 | 134.994 | −19.152 | 1.00 | 96.06 | GZ00 N |
| ATOM | 6535 | CA | GLU | X | 216 | −29.446 | 134.662 | −19.010 | 1.00 | 98.88 | GZ00 C |
| ATOM | 6536 | C | GLU | X | 216 | −30.325 | 135.917 | −18.923 | 1.00 | 99.86 | GZ00 C |
| ATOM | 6537 | O | GLU | X | 216 | −31.553 | 135.830 | −18.821 | 1.00 | 94.58 | GZ00 O |
| ATOM | 6538 | CB | GLU | X | 216 | −29.662 | 133.791 | −17.762 | 1.00 | 104.37 | GZ00 C |
| ATOM | 6539 | CG | GLU | X | 216 | −29.007 | 132.394 | −17.811 | 1.00 | 103.51 | GZ00 C |
| ATOM | 6540 | CD | GLU | X | 216 | −29.281 | 131.561 | −16.556 | 1.00 | 100.31 | GZ00 C |
| ATOM | 6541 | OE1 | GLU | X | 216 | −30.463 | 131.201 | −16.329 | 1.00 | 98.05 | GZ00 O |
| ATOM | 6542 | OE2 | GLU | X | 216 | −28.323 | 131.288 | −15.788 | 1.00 | 94.94 | GZ00 O1− |
| TER | | | | | | | | | | | |
| ATOM | 6543 | N | THR | E | 152 | −7.503 | 113.907 | 0.585 | 1.00 | 78.03 | B000 N |
| ATOM | 6544 | CA | THR | E | 152 | −7.804 | 113.632 | 1.990 | 1.00 | 91.98 | B000 C |
| ATOM | 6545 | C | THR | E | 152 | −6.989 | 112.446 | 2.537 | 1.00 | 87.18 | B000 C |
| ATOM | 6546 | O | THR | E | 152 | −5.914 | 112.642 | 3.113 | 1.00 | 87.17 | B000 O |
| ATOM | 6547 | CB | THR | E | 152 | −9.331 | 113.377 | 2.199 | 1.00 | 99.46 | B000 C |
| ATOM | 6548 | OG1 | THR | E | 152 | −9.547 | 112.614 | 3.396 | 1.00 | 103.56 | B000 O |
| ATOM | 6549 | CG2 | THR | E | 152 | −9.959 | 112.661 | 0.997 | 1.00 | 88.04 | B000 C |

TABLE 10.3-continued

| | | | | | | | | | | | |
|---|---|---|---|---|---|---|---|---|---|---|---|
| ATOM | 6550 | N | CYS | E | 153 | −7.511 | 111.230 | 2.378 | 1.00 | 83.15 | B000 N |
| ATOM | 6551 | CA | CYS | E | 153 | −6.804 | 109.997 | 2.699 | 1.00 | 86.88 | B000 C |
| ATOM | 6552 | C | CYS | E | 153 | −6.722 | 109.106 | 1.463 | 1.00 | 80.76 | B000 C |
| ATOM | 6553 | O | CYS | E | 153 | −7.463 | 109.278 | 0.486 | 1.00 | 71.27 | B000 O |
| ATOM | 6554 | CB | CYS | E | 153 | −7.471 | 109.227 | 3.860 | 1.00 | 86.61 | B000 C |
| ATOM | 6555 | SG | CYS | E | 153 | −6.738 | 109.471 | 5.513 | 1.00 | 90.81 | B000 S |
| ATOM | 6556 | N | CYS | E | 154 | −5.817 | 108.133 | 1.525 | 1.00 | 72.71 | B000 N |
| ATOM | 6557 | CA | CYS | E | 154 | −5.632 | 107.218 | 0.411 | 1.00 | 64.86 | B000 C |
| ATOM | 6558 | C | CYS | E | 154 | −6.850 | 106.311 | 0.243 | 1.00 | 66.48 | B000 C |
| ATOM | 6559 | O | CYS | E | 154 | −7.564 | 106.023 | 1.210 | 1.00 | 66.73 | B000 O |
| ATOM | 6560 | CB | CYS | E | 154 | −4.385 | 106.373 | 0.626 | 1.00 | 57.69 | B000 C |
| ATOM | 6561 | SG | CYS | E | 154 | −2.833 | 107.296 | 0.371 | 1.00 | 72.69 | B000 S |
| ATOM | 6562 | N | PRO | E | 155 | −7.115 | 105.854 | −0.978 | 1.00 | 56.60 | B000 N |
| ATOM | 6563 | CA | PRO | E | 155 | −8.220 | 104.914 | −1.192 | 1.00 | 57.19 | B000 C |
| ATOM | 6564 | C | PRO | E | 155 | −8.052 | 103.661 | −0.345 | 1.00 | 62.02 | B000 C |
| ATOM | 6565 | O | PRO | E | 155 | −7.012 | 103.404 | 0.267 | 1.00 | 60.28 | B000 O |
| ATOM | 6566 | CB | PRO | E | 155 | −8.143 | 104.589 | −2.687 | 1.00 | 52.85 | B000 C |
| ATOM | 6567 | CG | PRO | E | 155 | −7.332 | 105.677 | −3.277 | 1.00 | 56.95 | B000 C |
| ATOM | 6568 | CD | PRO | E | 155 | −6.392 | 106.158 | −2.220 | 1.00 | 54.57 | B000 C |
| ATOM | 6569 | N | VAL | E | 156 | −9.123 | 102.871 | −0.306 | 1.00 | 64.34 | B000 N |
| ATOM | 6570 | CA | VAL | E | 156 | −9.121 | 101.644 | 0.477 | 1.00 | 62.48 | B000 C |
| ATOM | 6571 | C | VAL | E | 156 | −8.013 | 100.726 | −0.021 | 1.00 | 57.31 | B000 C |
| ATOM | 6572 | O | VAL | E | 156 | −7.843 | 100.536 | −1.235 | 1.00 | 55.79 | B000 O |
| ATOM | 6573 | CB | VAL | E | 156 | −10.498 | 100.968 | 0.373 | 1.00 | 58.69 | B000 C |
| ATOM | 6574 | CG1 | VAL | E | 156 | −10.628 | 99.853 | 1.400 | 1.00 | 62.99 | B000 C |
| ATOM | 6575 | CG2 | VAL | E | 156 | −11.612 | 102.013 | 0.508 | 1.00 | 72.16 | B000 C |
| ATOM | 6576 | N | ASN | E | 157 | −7.244 | 100.163 | 0.915 | 1.00 | 49.37 | B000 N |
| ATOM | 6577 | CA | ASN | E | 157 | −6.142 | 99.218 | 0.687 | 1.00 | 55.22 | B000 C |
| ATOM | 6578 | C | ASN | E | 157 | −4.871 | 99.882 | 0.162 | 1.00 | 52.64 | B000 C |
| ATOM | 6579 | O | ASN | E | 157 | −3.871 | 99.180 | −0.036 | 1.00 | 49.46 | B000 O |
| ATOM | 6580 | CB | ASN | E | 157 | −6.513 | 98.075 | −0.276 | 1.00 | 51.75 | B000 C |
| ATOM | 6581 | CG | ASN | E | 157 | −7.713 | 97.282 | 0.202 | 1.00 | 58.73 | B000 C |
| ATOM | 6582 | OD1 | ASN | E | 157 | −7.839 | 97.001 | 1.392 | 1.00 | 60.67 | B000 O |
| ATOM | 6583 | ND2 | ASN | E | 157 | −8.609 | 96.935 | −0.720 | 1.00 | 58.30 | B000 N |
| ATOM | 6584 | N | TRP | E | 158 | −4.868 | 101.187 | −0.082 | 1.00 | 49.22 | B000 N |
| ATOM | 6585 | CA | TRP | E | 158 | −3.644 | 101.885 | −0.433 | 1.00 | 45.78 | B000 C |
| ATOM | 6586 | C | TRP | E | 158 | −2.983 | 102.464 | 0.818 | 1.00 | 47.63 | B000 C |
| ATOM | 6587 | O | TRP | E | 158 | −3.618 | 102.655 | 1.855 | 1.00 | 53.96 | B000 O |
| ATOM | 6588 | CB | TRP | E | 158 | −3.933 | 102.979 | −1.453 | 1.00 | 48.76 | B000 C |
| ATOM | 6589 | CG | TRP | E | 158 | −4.381 | 102.473 | −2.793 | 1.00 | 40.31 | B000 C |
| ATOM | 6590 | CD1 | TRP | E | 158 | −5.498 | 101.731 | −3.072 | 1.00 | 46.46 | B000 C |
| ATOM | 6591 | CD2 | TRP | E | 158 | −3.718 | 102.683 | −4.043 | 1.00 | 35.79 | B000 C |
| ATOM | 6592 | NE1 | TRP | E | 158 | −5.573 | 101.465 | −4.432 | 1.00 | 39.86 | B000 N |
| ATOM | 6593 | CE2 | TRP | E | 158 | −4.495 | 102.050 | −5.047 | 1.00 | 45.74 | B000 C |
| ATOM | 6594 | CE3 | TRP | E | 158 | −2.548 | 103.355 | −4.417 | 1.00 | 40.22 | B000 C |
| ATOM | 6595 | CZ2 | TRP | E | 158 | −4.132 | 102.067 | −6.395 | 1.00 | 41.97 | B000 C |
| ATOM | 6596 | CZ3 | TRP | E | 158 | −2.193 | 103.378 | −5.764 | 1.00 | 41.46 | B000 C |
| ATOM | 6597 | CH2 | TRP | E | 158 | −2.980 | 102.727 | −6.732 | 1.00 | 40.39 | B000 C |
| ATOM | 6598 | N | VAL | E | 159 | −1.689 | 102.734 | 0.702 | 1.00 | 44.22 | B000 N |
| ATOM | 6599 | CA | VAL | E | 159 | −0.837 | 103.172 | 1.800 | 1.00 | 48.43 | B000 C |
| ATOM | 6600 | C | VAL | E | 159 | −0.297 | 104.558 | 1.461 | 1.00 | 58.07 | B000 C |
| ATOM | 6601 | O | VAL | E | 159 | 0.103 | 104.818 | 0.318 | 1.00 | 55.09 | B000 O |
| ATOM | 6602 | CB | VAL | E | 159 | 0.330 | 102.189 | 2.039 | 1.00 | 52.63 | B000 C |
| ATOM | 6603 | CG1 | VAL | E | 159 | 1.251 | 102.704 | 3.126 | 1.00 | 54.92 | B000 C |
| ATOM | 6604 | CG2 | VAL | E | 159 | −0.184 | 100.818 | 2.407 | 1.00 | 53.05 | B000 C |
| ATOM | 6605 | N | GLU | E | 160 | −0.275 | 105.443 | 2.456 | 1.00 | 57.15 | B000 N |
| ATOM | 6606 | CA | GLU | E | 160 | 0.120 | 106.833 | 2.256 | 1.00 | 59.51 | B000 C |
| ATOM | 6607 | C | GLU | E | 160 | 1.577 | 107.054 | 2.654 | 1.00 | 55.30 | B000 C |
| ATOM | 6608 | O | GLU | E | 160 | 2.043 | 106.531 | 3.673 | 1.00 | 50.50 | B000 O |
| ATOM | 6609 | CB | GLU | E | 160 | −0.809 | 107.756 | 3.046 | 1.00 | 51.43 | B000 C |
| ATOM | 6610 | CG | GLU | E | 160 | −0.440 | 109.219 | 3.035 | 1.00 | 65.54 | B000 C |
| ATOM | 6611 | CD | GLU | E | 160 | −1.336 | 110.058 | 3.952 | 1.00 | 77.96 | B000 C |
| ATOM | 6612 | OE1 | GLU | E | 160 | −2.418 | 109.568 | 4.357 | 1.00 | 79.30 | B000 O |
| ATOM | 6613 | OE2 | GLU | E | 160 | −0.951 | 111.203 | 4.281 | 1.00 | 75.66 | B000 O1− |
| ATOM | 6614 | N | HIS | E | 161 | 2.304 | 107.801 | 1.822 | 1.00 | 53.62 | B000 N |
| ATOM | 6615 | CA | HIS | E | 161 | 3.658 | 108.222 | 2.177 | 1.00 | 53.50 | B000 C |
| ATOM | 6616 | C | HIS | E | 161 | 4.013 | 109.474 | 1.393 | 1.00 | 61.66 | B000 C |
| ATOM | 6617 | O | HIS | E | 161 | 3.896 | 109.472 | 0.159 | 1.00 | 55.60 | B000 O |
| ATOM | 6618 | CB | HIS | E | 161 | 4.656 | 107.120 | 1.884 | 1.00 | 50.97 | B000 C |
| ATOM | 6619 | CG | HIS | E | 161 | 6.076 | 107.514 | 2.135 | 1.00 | 58.56 | B000 C |
| ATOM | 6620 | ND1 | HIS | E | 161 | 6.845 | 108.173 | 1.196 | 1.00 | 62.19 | B000 N |
| ATOM | 6621 | CD2 | HIS | E | 161 | 6.877 | 107.322 | 3.213 | 1.00 | 53.33 | B000 C |
| ATOM | 6622 | CE1 | HIS | E | 161 | 8.056 | 108.376 | 1.687 | 1.00 | 63.04 | B000 C |
| ATOM | 6623 | NE2 | HIS | E | 161 | 8.102 | 107.869 | 2.909 | 1.00 | 61.41 | B000 N |
| ATOM | 6624 | N | GLU | E | 162 | 4.410 | 110.541 | 2.112 | 1.00 | 61.25 | B000 N |
| ATOM | 6625 | CA | GLU | E | 162 | 4.767 | 111.850 | 1.561 | 1.00 | 55.02 | B000 C |
| ATOM | 6626 | C | GLU | E | 162 | 3.975 | 112.247 | 0.322 | 1.00 | 62.64 | B000 C |
| ATOM | 6627 | O | GLU | E | 162 | 4.537 | 112.301 | −0.778 | 1.00 | 75.86 | B000 O |
| ATOM | 6628 | CB | GLU | E | 162 | 6.267 | 111.936 | 1.225 | 1.00 | 60.44 | B000 C |
| ATOM | 6629 | CG | GLU | E | 162 | 7.223 | 111.633 | 2.366 | 1.00 | 61.24 | B000 C |

TABLE 10.3-continued

| | | | | | | | | | | | |
|---|---|---|---|---|---|---|---|---|---|---|---|
| ATOM | 6630 | CD | GLU | E | 162 | 8.697 | 111.610 | 1.933 | 1.00 | 86.98 | B000 | C |
| ATOM | 6631 | OE1 | GLU | E | 162 | 9.025 | 111.099 | 0.822 | 1.00 | 83.67 | B000 | O |
| ATOM | 6632 | OE2 | GLU | E | 162 | 9.538 | 112.097 | 2.725 | 1.00 | 95.90 | B000 | O1− |
| ATOM | 6633 | N | ARG | E | 163 | 2.679 | 112.496 | 0.469 | 1.00 | 55.87 | B000 | N |
| ATOM | 6634 | CA | ARG | E | 163 | 1.819 | 113.000 | −0.602 | 1.00 | 76.66 | B000 | C |
| ATOM | 6635 | C | ARG | E | 163 | 1.554 | 112.012 | −1.738 | 1.00 | 68.88 | B000 | C |
| ATOM | 6636 | O | ARG | E | 163 | 0.922 | 112.388 | −2.739 | 1.00 | 65.44 | B000 | O |
| ATOM | 6637 | CB | ARG | E | 163 | 2.398 | 114.288 | −1.215 | 1.00 | 89.70 | B000 | C |
| ATOM | 6638 | CG | ARG | E | 163 | 2.928 | 115.328 | −0.208 | 1.00 | 98.04 | B000 | C |
| ATOM | 6639 | CD | ARG | E | 163 | 3.983 | 116.257 | −0.835 | 1.00 | 106.40 | B000 | C |
| ATOM | 6640 | NE | ARG | E | 163 | 3.452 | 117.044 | −1.950 | 1.00 | 124.58 | B000 | N |
| ATOM | 6641 | CZ | ARG | E | 163 | 3.588 | 116.723 | −3.236 | 1.00 | 120.88 | B000 | C |
| ATOM | 6642 | NH1 | ARG | E | 163 | 4.245 | 115.622 | −3.585 | 1.00 | 111.66 | B000 | N1+ |
| ATOM | 6643 | NH2 | ARG | E | 163 | 3.063 | 117.503 | −4.176 | 1.00 | 118.93 | B000 | N |
| ATOM | 6644 | N | SER | E | 164 | 1.973 | 110.758 | −1.622 | 1.00 | 63.49 | B000 | N |
| ATOM | 6645 | CA | SER | E | 164 | 1.606 | 109.768 | −2.620 | 1.00 | 57.22 | B000 | C |
| ATOM | 6646 | C | SER | E | 164 | 0.888 | 108.601 | −1.952 | 1.00 | 52.22 | B000 | C |
| ATOM | 6647 | O | SER | E | 164 | 1.071 | 108.329 | −0.761 | 1.00 | 49.98 | B000 | O |
| ATOM | 6648 | CB | SER | E | 164 | 2.823 | 109.290 | −3.411 | 1.00 | 56.71 | B000 | C |
| ATOM | 6649 | OG | SER | E | 164 | 3.161 | 110.233 | −4.411 | 1.00 | 65.04 | B000 | O |
| ATOM | 6650 | N | CYS | E | 165 | 0.066 | 107.913 | −2.740 | 1.00 | 50.88 | B000 | N |
| ATOM | 6651 | CA | CYS | E | 165 | −0.614 | 106.691 | −2.322 | 1.00 | 53.42 | B000 | C |
| ATOM | 6652 | C | CYS | E | 165 | −0.042 | 105.497 | −3.076 | 1.00 | 50.12 | B000 | C |
| ATOM | 6653 | O | CYS | E | 165 | 0.124 | 105.555 | −4.300 | 1.00 | 46.54 | B000 | O |
| ATOM | 6654 | CB | CYS | E | 165 | −2.118 | 106.793 | −2.576 | 1.00 | 56.64 | B000 | C |
| ATOM | 6655 | SG | CYS | E | 165 | −2.945 | 108.028 | −1.541 | 1.00 | 67.86 | B000 | S |
| ATOM | 6656 | N | TYR | E | 166 | 0.226 | 104.410 | −2.350 | 1.00 | 52.80 | B000 | N |
| ATOM | 6657 | CA | TYR | E | 166 | 0.904 | 103.231 | −2.882 | 1.00 | 48.23 | B000 | C |
| ATOM | 6658 | C | TYR | E | 166 | 0.064 | 101.984 | −2.650 | 1.00 | 48.96 | B000 | C |
| ATOM | 6659 | O | TYR | E | 166 | −0.538 | 101.821 | −1.584 | 1.00 | 46.07 | B000 | O |
| ATOM | 6660 | CB | TYR | E | 166 | 2.265 | 103.033 | −2.222 | 1.00 | 45.49 | B000 | C |
| ATOM | 6661 | CG | TYR | E | 166 | 3.196 | 104.186 | −2.406 | 1.00 | 51.14 | B000 | C |
| ATOM | 6662 | CD1 | TYR | E | 166 | 3.000 | 105.382 | −1.709 | 1.00 | 50.78 | B000 | C |
| ATOM | 6663 | CD2 | TYR | E | 166 | 4.296 | 104.081 | −3.249 | 1.00 | 49.21 | B000 | C |
| ATOM | 6664 | CE1 | TYR | E | 166 | 3.859 | 106.442 | −1.867 | 1.00 | 52.01 | B000 | C |
| ATOM | 6665 | CE2 | TYR | E | 166 | 5.175 | 105.138 | −3.408 | 1.00 | 52.82 | B000 | C |
| ATOM | 6666 | CZ | TYR | E | 166 | 4.954 | 106.317 | −2.714 | 1.00 | 56.72 | B000 | C |
| ATOM | 6667 | OH | TYR | E | 166 | 5.829 | 107.368 | −2.874 | 1.00 | 55.75 | B000 | O |
| ATOM | 6668 | N | TRP | E | 167 | 0.064 | 101.085 | −3.634 | 1.00 | 43.75 | B000 | N |
| ATOM | 6669 | CA | TRP | E | 167 | −0.639 | 99.813 | −3.539 | 1.00 | 41.16 | B000 | C |
| ATOM | 6670 | C | TRP | E | 167 | 0.346 | 98.684 | −3.794 | 1.00 | 42.24 | B000 | C |
| ATOM | 6671 | O | TRP | E | 167 | 1.054 | 98.693 | −4.804 | 1.00 | 37.42 | B000 | O |
| ATOM | 6672 | CB | TRP | E | 167 | −1.804 | 99.743 | −4.530 | 1.00 | 42.53 | B000 | C |
| ATOM | 6673 | CG | TRP | E | 167 | −2.599 | 98.467 | −4.395 | 1.00 | 46.44 | B000 | C |
| ATOM | 6674 | CD1 | TRP | E | 167 | −3.662 | 98.242 | −3.560 | 1.00 | 49.81 | B000 | C |
| ATOM | 6675 | CD2 | TRP | E | 167 | −2.395 | 97.251 | −5.116 | 1.00 | 43.13 | B000 | C |
| ATOM | 6676 | NE1 | TRP | E | 167 | −4.114 | 96.955 | −3.706 | 1.00 | 51.07 | B000 | N |
| ATOM | 6677 | CE2 | TRP | E | 167 | −3.366 | 96.330 | −4.665 | 1.00 | 46.50 | B000 | C |
| ATOM | 6678 | CE3 | TRP | E | 167 | −1.491 | 96.852 | −6.103 | 1.00 | 40.37 | B000 | C |
| ATOM | 6679 | CZ2 | TRP | E | 167 | −3.455 | 95.041 | −5.165 | 1.00 | 36.86 | B000 | C |
| ATOM | 6680 | CZ3 | TRP | E | 167 | −1.587 | 95.579 | −6.604 | 1.00 | 39.69 | B000 | C |
| ATOM | 6681 | CH2 | TRP | E | 167 | −2.554 | 94.682 | −6.133 | 1.00 | 42.15 | B000 | C |
| ATOM | 6682 | N | PHE | E | 168 | 0.377 | 97.709 | −2.891 | 1.00 | 42.39 | B000 | N |
| ATOM | 6683 | CA | PHE | E | 168 | 1.369 | 96.645 | −2.921 | 1.00 | 39.44 | B000 | C |
| ATOM | 6684 | C | PHE | E | 168 | 0.718 | 95.320 | −3.300 | 1.00 | 41.71 | B000 | C |
| ATOM | 6685 | O | PHE | E | 168 | −0.056 | 94.762 | −2.515 | 1.00 | 39.56 | B000 | O |
| ATOM | 6686 | CB | PHE | E | 168 | 2.054 | 96.539 | −1.567 | 1.00 | 33.24 | B000 | C |
| ATOM | 6687 | CG | PHE | E | 168 | 2.834 | 97.745 | −1.209 | 1.00 | 45.15 | B000 | C |
| ATOM | 6688 | CD1 | PHE | E | 168 | 4.165 | 97.858 | −1.603 | 1.00 | 43.49 | B000 | C |
| ATOM | 6689 | CD2 | PHE | E | 168 | 2.251 | 98.776 | −0.472 | 1.00 | 43.18 | B000 | C |
| ATOM | 6690 | CE1 | PHE | E | 168 | 4.917 | 98.991 | −1.279 | 1.00 | 48.63 | B000 | C |
| ATOM | 6691 | CE2 | PHE | E | 168 | 2.986 | 99.913 | −0.135 | 1.00 | 49.01 | B000 | C |
| ATOM | 6692 | CZ | PHE | E | 168 | 4.326 | 100.026 | −0.541 | 1.00 | 48.19 | B000 | C |
| ATOM | 6693 | N | SER | E | 169 | 1.081 | 94.788 | −4.469 | 1.00 | 34.62 | B000 | N |
| ATOM | 6694 | CA | SER | E | 169 | 0.586 | 93.478 | −4.863 | 1.00 | 37.57 | B000 | C |
| ATOM | 6695 | C | SER | E | 169 | 1.143 | 92.402 | −3.936 | 1.00 | 34.54 | B000 | C |
| ATOM | 6696 | O | SER | E | 169 | 2.169 | 92.574 | −3.280 | 1.00 | 36.05 | B000 | O |
| ATOM | 6697 | CB | SER | E | 169 | 0.978 | 93.141 | −6.308 | 1.00 | 33.43 | B000 | C |
| ATOM | 6698 | OG | SER | E | 169 | 2.306 | 92.629 | −6.362 | 1.00 | 34.63 | B000 | O |
| ATOM | 6699 | N | ARG | E | 170 | 0.449 | 91.272 | −3.899 | 1.00 | 35.37 | B000 | N |
| ATOM | 6700 | CA | ARG | E | 170 | 0.918 | 90.093 | −3.184 | 1.00 | 37.90 | B000 | C |
| ATOM | 6701 | C | ARG | E | 170 | 0.997 | 88.896 | −4.131 | 1.00 | 35.62 | B000 | C |
| ATOM | 6702 | O | ARG | E | 170 | 0.924 | 87.742 | −3.715 | 1.00 | 37.12 | B000 | O |
| ATOM | 6703 | CB | ARG | E | 170 | 0.028 | 89.827 | −1.967 | 1.00 | 36.19 | B000 | C |
| ATOM | 6704 | CG | ARG | E | 170 | 0.216 | 90.900 | −0.870 | 1.00 | 40.70 | B000 | C |
| ATOM | 6705 | CD | ARG | E | 170 | −0.749 | 90.780 | 0.304 | 1.00 | 45.71 | B000 | C |
| ATOM | 6706 | NE | ARG | E | 170 | −2.082 | 91.308 | −0.011 | 1.00 | 51.47 | B000 | N |
| ATOM | 6707 | CZ | ARG | E | 170 | −3.156 | 91.221 | 0.782 | 1.00 | 53.18 | B000 | C |
| ATOM | 6708 | NH1 | ARG | E | 170 | −3.089 | 90.606 | 1.963 | 1.00 | 52.87 | B000 | N1+ |
| ATOM | 6709 | NH2 | ARG | E | 170 | −4.315 | 91.737 | 0.384 | 1.00 | 52.00 | B000 | N |

TABLE 10.3-continued

| | | | | | | | | | | | |
|---|---|---|---|---|---|---|---|---|---|---|---|
| ATOM | 6710 | N | SER | E | 171 | 1.194 | 89.177 | −5.414 | 1.00 | 34.01 | B000 | N |
| ATOM | 6711 | CA | SER | E | 171 | 1.334 | 88.153 | −6.435 | 1.00 | 37.47 | B000 | C |
| ATOM | 6712 | C | SER | E | 171 | 2.092 | 88.761 | −7.607 | 1.00 | 36.87 | B000 | C |
| ATOM | 6713 | O | SER | E | 171 | 2.269 | 89.978 | −7.692 | 1.00 | 35.85 | B000 | O |
| ATOM | 6714 | CB | SER | E | 171 | −0.030 | 87.625 | −6.873 | 1.00 | 33.20 | B000 | C |
| ATOM | 6715 | OG | SER | E | 171 | −0.796 | 88.688 | −7.418 | 1.00 | 38.78 | B000 | O |
| ATOM | 6716 | N | GLY | E | 172 | 2.519 | 87.895 | −8.521 | 1.00 | 30.60 | B000 | N |
| ATOM | 6717 | CA | GLY | E | 172 | 3.411 | 88.281 | −9.590 | 1.00 | 32.88 | B000 | C |
| ATOM | 6718 | C | GLY | E | 172 | 2.710 | 88.558 | −10.905 | 1.00 | 33.42 | B000 | C |
| ATOM | 6719 | O | GLY | E | 172 | 1.628 | 88.050 | −11.168 | 1.00 | 38.97 | B000 | O |
| ATOM | 6720 | N | LYS | E | 173 | 3.360 | 89.389 | −11.723 | 1.00 | 34.61 | B000 | N |
| ATOM | 6721 | CA | LYS | E | 173 | 2.968 | 89.700 | −13.090 | 1.00 | 31.95 | B000 | C |
| ATOM | 6722 | C | LYS | E | 173 | 4.217 | 90.055 | −13.875 | 1.00 | 32.50 | B000 | C |
| ATOM | 6723 | O | LYS | E | 173 | 5.168 | 90.618 | −13.327 | 1.00 | 29.30 | B000 | O |
| ATOM | 6724 | CB | LYS | E | 173 | 1.999 | 90.887 | −13.185 | 1.00 | 35.19 | B000 | C |
| ATOM | 6725 | CG | LYS | E | 173 | 0.540 | 90.586 | −12.876 | 1.00 | 36.71 | B000 | C |
| ATOM | 6726 | CD | LYS | E | 173 | −0.272 | 91.847 | −13.150 | 1.00 | 36.28 | B000 | C |
| ATOM | 6727 | CE | LYS | E | 173 | −1.752 | 91.726 | −12.775 | 1.00 | 37.38 | B000 | C |
| ATOM | 6728 | NZ | LYS | E | 173 | −2.515 | 90.874 | −13.720 | 1.00 | 40.13 | B000 | N1+ |
| ATOM | 6729 | N | ALA | E | 174 | 4.199 | 89.739 | −15.165 | 1.00 | 34.25 | B000 | N |
| ATOM | 6730 | CA | ALA | E | 174 | 5.174 | 90.319 | −16.074 | 1.00 | 31.99 | B000 | C |
| ATOM | 6731 | C | ALA | E | 174 | 5.058 | 91.834 | −16.026 | 1.00 | 33.17 | B000 | C |
| ATOM | 6732 | O | ALA | E | 174 | 3.962 | 92.387 | −15.834 | 1.00 | 28.18 | B000 | O |
| ATOM | 6733 | CB | ALA | E | 174 | 4.938 | 89.837 | −17.503 | 1.00 | 26.95 | B000 | C |
| ATOM | 6734 | N | TRP | E | 175 | 6.199 | 92.506 | −16.231 | 1.00 | 27.62 | B000 | N |
| ATOM | 6735 | CA | TRP | E | 175 | 6.257 | 93.962 | −16.080 | 1.00 | 28.95 | B000 | C |
| ATOM | 6736 | C | TRP | E | 175 | 5.178 | 94.667 | −16.903 | 1.00 | 31.61 | B000 | C |
| ATOM | 6737 | O | TRP | E | 175 | 4.487 | 95.560 | −16.403 | 1.00 | 35.29 | B000 | O |
| ATOM | 6738 | CB | TRP | E | 175 | 7.641 | 94.464 | −16.472 | 1.00 | 34.77 | B000 | C |
| ATOM | 6739 | CG | TRP | E | 175 | 7.893 | 95.874 | −16.085 | 1.00 | 35.77 | B000 | C |
| ATOM | 6740 | CD1 | TRP | E | 175 | 8.505 | 96.308 | −14.950 | 1.00 | 35.08 | B000 | C |
| ATOM | 6741 | CD2 | TRP | E | 175 | 7.574 | 97.046 | −16.846 | 1.00 | 33.62 | B000 | C |
| ATOM | 6742 | NE1 | TRP | E | 175 | 8.582 | 97.688 | −14.946 | 1.00 | 39.22 | B000 | N |
| ATOM | 6743 | CE2 | TRP | E | 175 | 8.021 | 98.164 | −16.099 | 1.00 | 37.24 | B000 | C |
| ATOM | 6744 | CE3 | TRP | E | 175 | 6.965 | 97.259 | −18.086 | 1.00 | 30.92 | B000 | C |
| ATOM | 6745 | CZ2 | TRP | E | 175 | 7.878 | 99.471 | −16.550 | 1.00 | 34.67 | B000 | C |
| ATOM | 6746 | CZ3 | TRP | E | 175 | 6.812 | 98.559 | −18.531 | 1.00 | 41.35 | B000 | C |
| ATOM | 6747 | CH2 | TRP | E | 175 | 7.273 | 99.651 | −17.769 | 1.00 | 41.09 | B000 | C |
| ATOM | 6748 | N | ALA | E | 176 | 5.003 | 94.268 | −18.164 | 1.00 | 31.68 | B000 | N |
| ATOM | 6749 | CA | ALA | E | 176 | 4.017 | 94.938 | −19.011 | 1.00 | 34.92 | B000 | C |
| ATOM | 6750 | C | ALA | E | 176 | 2.598 | 94.731 | −18.504 | 1.00 | 42.84 | B000 | C |
| ATOM | 6751 | O | ALA | E | 176 | 1.760 | 95.625 | −18.637 | 1.00 | 44.50 | B000 | O |
| ATOM | 6752 | CB | ALA | E | 176 | 4.121 | 94.464 | −20.459 | 1.00 | 27.15 | B000 | C |
| ATOM | 6753 | N | ASP | E | 177 | 2.296 | 93.569 | −17.928 | 1.00 | 38.72 | B000 | N |
| ATOM | 6754 | CA | ASP | E | 177 | 0.959 | 93.397 | −17.376 | 1.00 | 38.20 | B000 | C |
| ATOM | 6755 | C | ASP | E | 177 | 0.800 | 94.189 | −16.085 | 1.00 | 37.56 | B000 | C |
| ATOM | 6756 | O | ASP | E | 177 | −0.277 | 94.742 | −15.824 | 1.00 | 35.06 | B000 | O |
| ATOM | 6757 | CB | ASP | E | 177 | 0.658 | 91.915 | −17.144 | 1.00 | 38.76 | B000 | C |
| ATOM | 6758 | CG | ASP | E | 177 | 0.524 | 91.144 | −18.441 | 1.00 | 44.40 | B000 | C |
| ATOM | 6759 | OD1 | ASP | E | 177 | −0.060 | 91.696 | −19.397 | 1.00 | 46.46 | B000 | O |
| ATOM | 6760 | OD2 | ASP | E | 177 | 1.027 | 90.000 | −18.513 | 1.00 | 46.19 | B000 | O1− |
| ATOM | 6761 | N | ALA | E | 178 | 1.851 | 94.231 | −15.255 | 1.00 | 34.06 | B000 | N |
| ATOM | 6762 | CA | ALA | E | 178 | 1.810 | 95.046 | −14.045 | 1.00 | 37.97 | B000 | C |
| ATOM | 6763 | C | ALA | E | 178 | 1.710 | 96.521 | −14.403 | 1.00 | 38.84 | B000 | C |
| ATOM | 6764 | O | ALA | E | 178 | 1.028 | 97.294 | −13.722 | 1.00 | 36.52 | B000 | O |
| ATOM | 6765 | CB | ALA | E | 178 | 3.040 | 94.776 | −13.174 | 1.00 | 36.54 | B000 | C |
| ATOM | 6766 | N | ASP | E | 179 | 2.391 | 96.921 | −15.471 | 1.00 | 38.85 | B000 | N |
| ATOM | 6767 | CA | ASP | E | 179 | 2.284 | 98.283 | −15.969 | 1.00 | 39.27 | B000 | C |
| ATOM | 6768 | C | ASP | E | 179 | 0.840 | 98.610 | −16.344 | 1.00 | 44.49 | B000 | C |
| ATOM | 6769 | O | ASP | E | 179 | 0.287 | 99.630 | −15.911 | 1.00 | 43.34 | B000 | O |
| ATOM | 6770 | CB | ASP | E | 179 | 3.233 | 98.437 | −17.155 | 1.00 | 41.76 | B000 | C |
| ATOM | 6771 | CG | ASP | E | 179 | 3.180 | 99.817 | −17.795 | 1.00 | 53.27 | B000 | C |
| ATOM | 6772 | OD1 | ASP | E | 179 | 3.353 | 100.836 | −17.081 | 1.00 | 46.80 | B000 | O |
| ATOM | 6773 | OD2 | ASP | E | 179 | 2.980 | 99.863 | −19.031 | 1.00 | 46.92 | B000 | O1− |
| ATOM | 6774 | N | ASN | E | 180 | 0.193 | 97.723 | −17.106 | 1.00 | 42.03 | B000 | N |
| ATOM | 6775 | CA | ASN | E | 180 | −1.199 | 97.957 | −17.482 | 1.00 | 44.06 | B000 | C |
| ATOM | 6776 | C | ASN | E | 180 | −2.105 | 97.976 | −16.261 | 1.00 | 47.76 | B000 | C |
| ATOM | 6777 | O | ASN | E | 180 | −3.071 | 98.746 | −16.212 | 1.00 | 47.34 | B000 | O |
| ATOM | 6778 | CB | ASN | E | 180 | −1.687 | 96.905 | −18.488 | 1.00 | 43.06 | B000 | C |
| ATOM | 6779 | CG | ASN | E | 180 | −1.015 | 97.046 | −19.870 | 1.00 | 67.38 | B000 | C |
| ATOM | 6780 | OD1 | ASN | E | 180 | −0.489 | 98.113 | −20.216 | 1.00 | 70.80 | B000 | O |
| ATOM | 6781 | ND2 | ASN | E | 180 | −1.053 | 95.971 | −20.670 | 1.00 | 65.59 | B000 | N |
| ATOM | 6782 | N | TYR | E | 181 | −1.826 | 97.126 | −15.271 | 1.00 | 39.12 | B000 | N |
| ATOM | 6783 | CA | TYR | E | 181 | −2.653 | 97.125 | −14.068 | 1.00 | 43.01 | B000 | C |
| ATOM | 6784 | C | TYR | E | 181 | −2.651 | 98.498 | −13.388 | 1.00 | 42.74 | B000 | C |
| ATOM | 6785 | O | TYR | E | 181 | −3.710 | 99.015 | −13.016 | 1.00 | 42.29 | B000 | O |
| ATOM | 6786 | CB | TYR | E | 181 | −2.191 | 96.021 | −13.109 | 1.00 | 37.06 | B000 | C |
| ATOM | 6787 | CG | TYR | E | 181 | −2.917 | 96.012 | −11.794 | 1.00 | 38.21 | B000 | C |
| ATOM | 6788 | CD1 | TYR | E | 181 | −2.558 | 96.897 | −10.772 | 1.00 | 34.22 | B000 | C |
| ATOM | 6789 | CD2 | TYR | E | 181 | −3.956 | 95.118 | −11.558 | 1.00 | 37.19 | B000 | C |

TABLE 10.3-continued

| | | | | | | | | | | | |
|---|---|---|---|---|---|---|---|---|---|---|---|
| ATOM | 6790 | CE1 | TYR | E | 181 | −3.234 | 96.912 | −9.562 | 1.00 | 38.89 | B000 C |
| ATOM | 6791 | CE2 | TYR | E | 181 | −4.640 | 95.112 | −10.337 | 1.00 | 36.01 | B000 C |
| ATOM | 6792 | CZ | TYR | E | 181 | −4.276 | 96.010 | −9.345 | 1.00 | 44.74 | B000 C |
| ATOM | 6793 | OH | TYR | E | 181 | −4.927 | 95.998 | −8.128 | 1.00 | 40.18 | B000 O |
| ATOM | 6794 | N | CYS | E | 182 | −1.472 | 99.100 | −13.203 | 1.00 | 38.84 | B000 N |
| ATOM | 6795 | CA | CYS | E | 182 | −1.422 | 100.388 | −12.511 | 1.00 | 45.63 | B000 C |
| ATOM | 6796 | C | CYS | E | 182 | −2.149 | 101.467 | −13.312 | 1.00 | 47.11 | B000 C |
| ATOM | 6797 | O | CYS | E | 182 | −2.911 | 102.262 | −12.747 | 1.00 | 44.58 | B000 O |
| ATOM | 6798 | CB | CYS | E | 182 | 0.031 | 100.804 | −12.239 | 1.00 | 42.50 | B000 C |
| ATOM | 6799 | SG | CYS | E | 182 | 0.953 | 99.774 | −11.010 | 1.00 | 49.37 | B000 S |
| ATOM | 6800 | N | ARG | E | 183 | −1.957 | 101.483 | −14.636 | 1.00 | 46.95 | B000 N |
| ATOM | 6801 | CA | ARG | E | 183 | −2.612 | 102.478 | −15.481 | 1.00 | 44.11 | B000 C |
| ATOM | 6802 | C | ARG | E | 183 | −4.130 | 102.366 | −15.394 | 1.00 | 50.00 | B000 C |
| ATOM | 6803 | O | ARG | E | 183 | −4.833 | 103.386 | −15.359 | 1.00 | 44.76 | B000 O |
| ATOM | 6804 | CB | ARG | E | 183 | −2.113 | 102.348 | −16.926 | 1.00 | 40.71 | B000 C |
| ATOM | 6805 | CG | ARG | E | 183 | −0.821 | 103.153 | −17.173 | 1.00 | 63.11 | B000 C |
| ATOM | 6806 | CD | ARG | E | 183 | 0.070 | 102.668 | −18.340 | 1.00 | 66.43 | B000 C |
| ATOM | 6807 | NE | ARG | E | 183 | 1.428 | 103.228 | −18.202 | 1.00 | 85.06 | B000 N |
| ATOM | 6808 | CZ | ARG | E | 183 | 2.473 | 102.943 | −18.989 | 1.00 | 82.14 | B000 C |
| ATOM | 6809 | NH1 | ARG | E | 183 | 2.333 | 102.088 | −19.998 | 1.00 | 86.34 | B000 N1+ |
| ATOM | 6810 | NH2 | ARG | E | 183 | 3.667 | 103.501 | −18.759 | 1.00 | 56.98 | B000 N |
| ATOM | 6811 | N | LEU | E | 184 | −4.656 | 101.136 | −15.327 | 1.00 | 45.91 | B000 N |
| ATOM | 6812 | CA | LEU | E | 184 | −6.094 | 100.958 | −15.156 | 1.00 | 43.34 | B000 C |
| ATOM | 6813 | C | LEU | E | 184 | −6.575 | 101.442 | −13.804 | 1.00 | 44.25 | B000 C |
| ATOM | 6814 | O | LEU | E | 184 | −7.769 | 101.694 | −13.646 | 1.00 | 51.06 | B000 O |
| ATOM | 6815 | CB | LEU | E | 184 | −6.497 | 99.490 | −15.302 | 1.00 | 47.73 | B000 C |
| ATOM | 6816 | CG | LEU | E | 184 | −6.471 | 98.840 | −16.680 | 1.00 | 54.62 | B000 C |
| ATOM | 6817 | CD1 | LEU | E | 184 | −6.890 | 97.380 | −16.546 | 1.00 | 41.74 | B000 C |
| ATOM | 6818 | CD2 | LEU | E | 184 | −7.353 | 99.606 | −17.678 | 1.00 | 43.16 | B000 C |
| ATOM | 6819 | N | GLU | E | 185 | −5.685 | 101.579 | −12.827 | 1.00 | 49.85 | B000 N |
| ATOM | 6820 | CA | GLU | E | 185 | −6.032 | 102.169 | −11.541 | 1.00 | 49.61 | B000 C |
| ATOM | 6821 | C | GLU | E | 185 | −5.766 | 103.658 | −11.502 | 1.00 | 48.64 | B000 C |
| ATOM | 6822 | O | GLU | E | 185 | −5.704 | 104.233 | −10.412 | 1.00 | 53.97 | B000 O |
| ATOM | 6823 | CB | GLU | E | 185 | −5.258 | 101.484 | −10.416 | 1.00 | 52.10 | B000 C |
| ATOM | 6824 | CG | GLU | E | 185 | −5.516 | 100.002 | −10.355 | 1.00 | 58.31 | B000 C |
| ATOM | 6825 | CD | GLU | E | 185 | −6.899 | 99.698 | −9.827 | 1.00 | 64.50 | B000 C |
| ATOM | 6826 | OE1 | GLU | E | 185 | −7.284 | 100.277 | −8.780 | 1.00 | 62.30 | B000 O |
| ATOM | 6827 | OE2 | GLU | E | 185 | −7.614 | 98.911 | −10.485 | 1.00 | 74.36 | B000 O1− |
| ATOM | 6828 | N | ASP | E | 186 | −5.571 | 104.286 | −12.662 | 1.00 | 44.48 | B000 N |
| ATOM | 6829 | CA | ASP | E | 186 | −5.173 | 105.692 | −12.731 | 1.00 | 54.36 | B000 C |
| ATOM | 6830 | C | ASP | E | 186 | −3.929 | 105.951 | −11.874 | 1.00 | 51.31 | B000 C |
| ATOM | 6831 | O | ASP | E | 186 | −3.859 | 106.883 | −11.069 | 1.00 | 57.99 | B000 O |
| ATOM | 6832 | CB | ASP | E | 186 | −6.337 | 106.604 | −12.332 | 1.00 | 56.91 | B000 C |
| ATOM | 6833 | CG | ASP | E | 186 | −6.105 | 108.048 | −12.733 | 1.00 | 74.54 | B000 C |
| ATOM | 6834 | OD1 | ASP | E | 186 | −5.482 | 108.279 | −13.798 | 1.00 | 78.01 | B000 O |
| ATOM | 6835 | OD2 | ASP | E | 186 | −6.541 | 108.948 | −11.982 | 1.00 | 75.17 | B000 O1− |
| ATOM | 6836 | N | ALA | E | 187 | −2.940 | 105.083 | −12.033 | 1.00 | 50.91 | B000 N |
| ATOM | 6837 | CA | ALA | E | 187 | −1.713 | 105.165 | −11.265 | 1.00 | 42.37 | B000 C |
| ATOM | 6838 | C | ALA | E | 187 | −0.593 | 104.718 | −12.183 | 1.00 | 37.72 | B000 C |
| ATOM | 6839 | O | ALA | E | 187 | −0.810 | 104.469 | −13.372 | 1.00 | 44.89 | B000 O |
| ATOM | 6840 | CB | ALA | E | 187 | −1.820 | 104.332 | −9.980 | 1.00 | 41.53 | B000 C |
| ATOM | 6841 | N | HIS | E | 188 | 0.612 | 104.603 | −11.641 | 1.00 | 40.45 | B000 N |
| ATOM | 6842 | CA | HIS | E | 188 | 1.724 | 104.095 | −12.422 | 1.00 | 40.26 | B000 C |
| ATOM | 6843 | C | HIS | E | 188 | 2.622 | 103.249 | −11.526 | 1.00 | 42.46 | B000 C |
| ATOM | 6844 | O | HIS | E | 188 | 2.526 | 103.288 | −10.296 | 1.00 | 40.81 | B000 O |
| ATOM | 6845 | CB | HIS | E | 188 | 2.499 | 105.237 | −13.079 | 1.00 | 40.08 | B000 C |
| ATOM | 6846 | CG | HIS | E | 188 | 2.996 | 106.266 | −12.107 | 1.00 | 47.93 | B000 C |
| ATOM | 6847 | ND1 | HIS | E | 188 | 4.133 | 106.085 | −11.346 | 1.00 | 46.18 | B000 N |
| ATOM | 6848 | CD2 | HIS | E | 188 | 2.508 | 107.486 | −11.772 | 1.00 | 40.80 | B000 C |
| ATOM | 6849 | CE1 | HIS | E | 188 | 4.327 | 107.151 | −10.587 | 1.00 | 51.18 | B000 C |
| ATOM | 6850 | NE2 | HIS | E | 188 | 3.358 | 108.017 | −10.829 | 1.00 | 50.42 | B000 N |
| ATOM | 6851 | N | LEU | E | 189 | 3.518 | 102.490 | −12.157 | 1.00 | 37.36 | B000 N |
| ATOM | 6852 | CA | LEU | E | 189 | 4.459 | 101.686 | −11.393 | 1.00 | 38.98 | B000 C |
| ATOM | 6853 | C | LEU | E | 189 | 5.384 | 102.583 | −10.588 | 1.00 | 38.79 | B000 C |
| ATOM | 6854 | O | LEU | E | 189 | 5.766 | 103.663 | −11.040 | 1.00 | 44.62 | B000 O |
| ATOM | 6855 | CB | LEU | E | 189 | 5.264 | 100.782 | −12.324 | 1.00 | 42.15 | B000 C |
| ATOM | 6856 | CG | LEU | E | 189 | 4.561 | 99.535 | −12.851 | 1.00 | 38.45 | B000 C |
| ATOM | 6857 | CD1 | LEU | E | 189 | 5.376 | 98.948 | −13.979 | 1.00 | 31.59 | B000 C |
| ATOM | 6858 | CD2 | LEU | E | 189 | 4.384 | 98.533 | −11.707 | 1.00 | 36.53 | B000 C |
| ATOM | 6859 | N | VAL | E | 190 | 5.742 | 102.130 | −9.386 | 1.00 | 33.02 | B000 N |
| ATOM | 6860 | CA | VAL | E | 190 | 6.360 | 103.022 | −8.410 | 1.00 | 37.67 | B000 C |
| ATOM | 6861 | C | VAL | E | 190 | 7.627 | 103.653 | −8.977 | 1.00 | 41.59 | B000 C |
| ATOM | 6862 | O | VAL | E | 190 | 8.477 | 102.978 | −9.571 | 1.00 | 39.37 | B000 O |
| ATOM | 6863 | CB | VAL | E | 190 | 6.626 | 102.274 | −7.093 | 1.00 | 40.50 | B000 C |
| ATOM | 6864 | CG1 | VAL | E | 190 | 7.570 | 101.068 | −7.292 | 1.00 | 36.01 | B000 C |
| ATOM | 6865 | CG2 | VAL | E | 190 | 7.216 | 103.229 | −6.056 | 1.00 | 39.66 | B000 C |
| ATOM | 6866 | N | VAL | E | 191 | 7.751 | 104.967 | −8.792 | 1.00 | 42.38 | B000 N |
| ATOM | 6867 | CA | VAL | E | 191 | 8.934 | 105.734 | −9.169 | 1.00 | 38.93 | B000 C |
| ATOM | 6868 | C | VAL | E | 191 | 9.618 | 106.183 | −7.886 | 1.00 | 41.89 | B000 C |
| ATOM | 6869 | O | VAL | E | 191 | 8.994 | 106.850 | −7.054 | 1.00 | 49.00 | B000 O |

TABLE 10.3-continued

| ATOM | 6870 | CB  | VAL | E | 191 | 8.569  | 106.923 | -10.062 | 1.00 | 39.27 | B000 | C   |
|------|------|-----|-----|---|-----|--------|---------|---------|------|-------|------|-----|
| ATOM | 6871 | CG1 | VAL | E | 191 | 9.802  | 107.734 | -10.381 | 1.00 | 41.98 | B000 | C   |
| ATOM | 6872 | CG2 | VAL | E | 191 | 7.920  | 106.410 | -11.351 | 1.00 | 37.38 | B000 | C   |
| ATOM | 6873 | N   | VAL | E | 192 | 10.885 | 105.796 | -7.712  | 1.00 | 36.78 | B000 | N   |
| ATOM | 6874 | CA  | VAL | E | 192 | 11.606 | 106.006 | -6.456  | 1.00 | 43.13 | B000 | C   |
| ATOM | 6875 | C   | VAL | E | 192 | 12.466 | 107.255 | -6.601  | 1.00 | 46.90 | B000 | C   |
| ATOM | 6876 | O   | VAL | E | 192 | 13.429 | 107.274 | -7.375  | 1.00 | 45.02 | B000 | O   |
| ATOM | 6877 | CB  | VAL | E | 192 | 12.459 | 104.793 | -6.065  | 1.00 | 41.45 | B000 | C   |
| ATOM | 6878 | CG1 | VAL | E | 192 | 13.073 | 105.013 | -4.679  | 1.00 | 35.87 | B000 | C   |
| ATOM | 6879 | CG2 | VAL | E | 192 | 11.618 | 103.512 | -6.094  | 1.00 | 37.77 | B000 | C   |
| ATOM | 6880 | N   | THR | E | 193 | 12.117 | 108.311 | -5.870  | 1.00 | 47.21 | B000 | N   |
| ATOM | 6881 | CA  | THR | E | 193 | 12.800 | 109.589 | -6.012  | 1.00 | 54.54 | B000 | C   |
| ATOM | 6882 | C   | THR | E | 193 | 13.689 | 109.963 | -4.828  | 1.00 | 53.96 | B000 | C   |
| ATOM | 6883 | O   | THR | E | 193 | 14.342 | 111.005 | -4.886  | 1.00 | 57.35 | B000 | O   |
| ATOM | 6884 | CB  | THR | E | 193 | 11.775 | 110.701 | -6.279  | 1.00 | 47.81 | B000 | C   |
| ATOM | 6885 | OG1 | THR | E | 193 | 10.889 | 110.829 | -5.158  | 1.00 | 54.26 | B000 | O   |
| ATOM | 6886 | CG2 | THR | E | 193 | 10.954 | 110.359 | -7.522  | 1.00 | 49.33 | B000 | C   |
| ATOM | 6887 | N   | SER | E | 194 | 13.765 | 109.142 | -3.779  | 1.00 | 50.25 | B000 | N   |
| ATOM | 6888 | CA  | SER | E | 194 | 14.493 | 109.535 | -2.577  | 1.00 | 47.10 | B000 | C   |
| ATOM | 6889 | C   | SER | E | 194 | 14.737 | 108.321 | -1.701  | 1.00 | 54.45 | B000 | C   |
| ATOM | 6890 | O   | SER | E | 194 | 14.097 | 107.277 | -1.857  | 1.00 | 55.35 | B000 | O   |
| ATOM | 6891 | CB  | SER | E | 194 | 13.727 | 110.596 | -1.779  | 1.00 | 50.58 | B000 | C   |
| ATOM | 6892 | OG  | SER | E | 194 | 12.588 | 110.027 | -1.152  | 1.00 | 52.89 | B000 | O   |
| ATOM | 6893 | N   | TRP | E | 195 | 15.656 | 108.488 | -0.749  | 1.00 | 54.05 | B000 | N   |
| ATOM | 6894 | CA  | TRP | E | 195 | 15.954 | 107.418 | 0.196   | 1.00 | 53.90 | B000 | C   |
| ATOM | 6895 | C   | TRP | E | 195 | 14.742 | 107.048 | 1.047   | 1.00 | 56.80 | B000 | C   |
| ATOM | 6896 | O   | TRP | E | 195 | 14.512 | 105.862 | 1.323   | 1.00 | 53.39 | B000 | O   |
| ATOM | 6897 | CB  | TRP | E | 195 | 17.124 | 107.822 | 1.086   | 1.00 | 52.43 | B000 | C   |
| ATOM | 6898 | CG  | TRP | E | 195 | 18.407 | 107.331 | 0.552   | 1.00 | 62.39 | B000 | C   |
| ATOM | 6899 | CD1 | TRP | E | 195 | 19.444 | 108.092 | 0.068   | 1.00 | 63.42 | B000 | C   |
| ATOM | 6900 | CD2 | TRP | E | 195 | 18.804 | 105.965 | 0.402   | 1.00 | 65.61 | B000 | C   |
| ATOM | 6901 | NE1 | TRP | E | 195 | 20.464 | 107.278 | -0.362  | 1.00 | 65.18 | B000 | N   |
| ATOM | 6902 | CE2 | TRP | E | 195 | 20.100 | 105.969 | -0.170  | 1.00 | 69.72 | B000 | C   |
| ATOM | 6903 | CE3 | TRP | E | 195 | 18.199 | 104.739 | 0.703   | 1.00 | 59.71 | B000 | C   |
| ATOM | 6904 | CZ2 | TRP | E | 195 | 20.797 | 104.792 | -0.447  | 1.00 | 59.79 | B000 | C   |
| ATOM | 6905 | CZ3 | TRP | E | 195 | 18.890 | 103.571 | 0.425   | 1.00 | 54.31 | B000 | C   |
| ATOM | 6906 | CH2 | TRP | E | 195 | 20.174 | 103.605 | -0.142  | 1.00 | 59.74 | B000 | C   |
| ATOM | 6907 | N   | GLU | E | 196 | 13.961 | 108.038 | 1.487   | 1.00 | 55.10 | B000 | N   |
| ATOM | 6908 | CA  | GLU | E | 196 | 12.781 | 107.723 | 2.292   | 1.00 | 58.29 | B000 | C   |
| ATOM | 6909 | C   | GLU | E | 196 | 11.786 | 106.895 | 1.505   | 1.00 | 53.21 | B000 | C   |
| ATOM | 6910 | O   | GLU | E | 196 | 11.299 | 105.874 | 1.999   | 1.00 | 56.81 | B000 | O   |
| ATOM | 6911 | CB  | GLU | E | 196 | 12.127 | 108.987 | 2.849   | 1.00 | 67.43 | B000 | C   |
| ATOM | 6912 | CG  | GLU | E | 196 | 12.825 | 109.494 | 4.092   | 1.00 | 75.36 | B000 | C   |
| ATOM | 6913 | CD  | GLU | E | 196 | 14.139 | 110.132 | 3.758   | 1.00 | 90.49 | B000 | C   |
| ATOM | 6914 | OE1 | GLU | E | 196 | 14.259 | 110.606 | 2.610   | 1.00 | 89.70 | B000 | O   |
| ATOM | 6915 | OE2 | GLU | E | 196 | 15.055 | 110.128 | 4.613   | 1.00 | 94.74 | B000 | O1- |
| ATOM | 6916 | N   | GLU | E | 197 | 11.460 | 107.326 | 0.281   | 1.00 | 51.77 | B000 | N   |
| ATOM | 6917 | CA  | GLU | E | 197 | 10.589 | 106.525 | -0.570  | 1.00 | 52.50 | B000 | C   |
| ATOM | 6918 | C   | GLU | E | 197 | 11.155 | 105.116 | -0.740  | 1.00 | 51.92 | B000 | C   |
| ATOM | 6919 | O   | GLU | E | 197 | 10.436 | 104.125 | -0.567  | 1.00 | 48.95 | B000 | O   |
| ATOM | 6920 | CB  | GLU | E | 197 | 10.376 | 107.217 | -1.920  | 1.00 | 44.93 | B000 | C   |
| ATOM | 6921 | CG  | GLU | E | 197 | 9.163  | 106.692 | -2.685  | 1.00 | 46.53 | B000 | C   |
| ATOM | 6922 | CD  | GLU | E | 197 | 8.827  | 107.482 | -3.949  | 1.00 | 48.66 | B000 | C   |
| ATOM | 6923 | OE1 | GLU | E | 197 | 9.651  | 108.313 | -4.402  | 1.00 | 48.86 | B000 | O   |
| ATOM | 6924 | OE2 | GLU | E | 197 | 7.727  | 107.257 | -4.507  | 1.00 | 50.40 | B000 | O1- |
| ATOM | 6925 | N   | GLN | E | 198 | 12.462 | 105.006 | -1.006  | 1.00 | 45.93 | B000 | N   |
| ATOM | 6926 | CA  | GLN | E | 198 | 13.088 | 103.692 | -1.102  | 1.00 | 44.41 | B000 | C   |
| ATOM | 6927 | C   | GLN | E | 198 | 12.894 | 102.888 | 0.183   | 1.00 | 52.88 | B000 | C   |
| ATOM | 6928 | O   | GLN | E | 198 | 12.542 | 101.701 | 0.145   | 1.00 | 50.74 | B000 | O   |
| ATOM | 6929 | CB  | GLN | E | 198 | 14.572 | 103.831 | -1.416  | 1.00 | 39.60 | B000 | C   |
| ATOM | 6930 | CG  | GLN | E | 198 | 15.367 | 102.576 | -1.148  | 1.00 | 36.79 | B000 | C   |
| ATOM | 6931 | CD  | GLN | E | 198 | 15.210 | 101.541 | -2.254  | 1.00 | 42.68 | B000 | C   |
| ATOM | 6932 | OE1 | GLN | E | 198 | 14.942 | 101.881 | -3.399  | 1.00 | 38.01 | B000 | O   |
| ATOM | 6933 | NE2 | GLN | E | 198 | 15.359 | 100.273 | -1.906  | 1.00 | 40.53 | B000 | N   |
| ATOM | 6934 | N   | LYS | E | 199 | 13.135 | 103.512 | 1.337   | 1.00 | 51.74 | B000 | N   |
| ATOM | 6935 | CA  | LYS | E | 199 | 13.004 | 102.770 | 2.587   | 1.00 | 50.49 | B000 | C   |
| ATOM | 6936 | C   | LYS | E | 199 | 11.544 | 102.452 | 2.890   | 1.00 | 51.58 | B000 | C   |
| ATOM | 6937 | O   | LYS | E | 199 | 11.242 | 101.379 | 3.427   | 1.00 | 48.97 | B000 | O   |
| ATOM | 6938 | CB  | LYS | E | 199 | 13.670 | 103.539 | 3.731   | 1.00 | 53.77 | B000 | C   |
| ATOM | 6939 | CG  | LYS | E | 199 | 15.157 | 103.755 | 3.500   | 1.00 | 55.44 | B000 | C   |
| ATOM | 6940 | CD  | LYS | E | 199 | 15.992 | 103.547 | 4.755   | 1.00 | 75.31 | B000 | C   |
| ATOM | 6941 | CE  | LYS | E | 199 | 17.390 | 104.165 | 4.583   | 1.00 | 85.03 | B000 | C   |
| ATOM | 6942 | NZ  | LYS | E | 199 | 18.151 | 104.301 | 5.862   | 1.00 | 83.45 | B000 | N1+ |
| ATOM | 6943 | N   | PHE | E | 200 | 10.631 | 103.358 | 2.531   | 1.00 | 48.81 | B000 | N   |
| ATOM | 6944 | CA  | PHE | E | 200 | 9.204  | 103.098 | 2.691   | 1.00 | 48.98 | B000 | C   |
| ATOM | 6945 | C   | PHE | E | 200 | 8.773  | 101.845 | 1.931   | 1.00 | 55.28 | B000 | C   |
| ATOM | 6946 | O   | PHE | E | 200 | 8.032  | 101.010 | 2.465   | 1.00 | 54.84 | B000 | O   |
| ATOM | 6947 | CB  | PHE | E | 200 | 8.406  | 104.312 | 2.224   | 1.00 | 46.91 | B000 | C   |
| ATOM | 6948 | CG  | PHE | E | 200 | 6.965  | 104.034 | 2.006   | 1.00 | 50.71 | B000 | C   |
| ATOM | 6949 | CD1 | PHE | E | 200 | 6.112  | 103.847 | 3.085   | 1.00 | 53.71 | B000 | C   |

TABLE 10.3-continued

| | | | | | | | | | | |
|---|---|---|---|---|---|---|---|---|---|---|
| ATOM | 6950 | CD2 | PHE | E | 200 | 6.449 | 103.965 | 0.722 | 1.00 | 51.62 | B000 | C |
| ATOM | 6951 | CE1 | PHE | E | 200 | 4.756 | 103.588 | 2.891 | 1.00 | 52.00 | B000 | C |
| ATOM | 6952 | CE2 | PHE | E | 200 | 5.097 | 103.710 | 0.512 | 1.00 | 50.54 | B000 | C |
| ATOM | 6953 | CZ | PHE | E | 200 | 4.248 | 103.518 | 1.605 | 1.00 | 54.40 | B000 | C |
| ATOM | 6954 | N | VAL | E | 201 | 9.229 | 101.697 | 0.680 | 1.00 | 51.49 | B000 | N |
| ATOM | 6955 | CA | VAL | E | 201 | 8.826 | 100.553 | −0.137 | 1.00 | 48.07 | B000 | C |
| ATOM | 6956 | C | VAL | E | 201 | 9.420 | 99.254 | 0.413 | 1.00 | 49.06 | B000 | C |
| ATOM | 6957 | O | VAL | E | 201 | 8.706 | 98.253 | 0.569 | 1.00 | 46.98 | B000 | O |
| ATOM | 6958 | CB | VAL | E | 201 | 9.208 | 100.788 | −1.611 | 1.00 | 46.66 | B000 | C |
| ATOM | 6959 | CG1 | VAL | E | 201 | 9.067 | 99.495 | −2.434 | 1.00 | 41.41 | B000 | C |
| ATOM | 6960 | CG2 | VAL | E | 201 | 8.349 | 101.902 | −2.212 | 1.00 | 37.70 | B000 | C |
| ATOM | 6961 | N | GLN | E | 202 | 10.728 | 99.252 | 0.723 | 1.00 | 49.32 | B000 | N |
| ATOM | 6962 | CA | GLN | E | 202 | 11.380 | 98.063 | 1.284 | 1.00 | 50.74 | B000 | C |
| ATOM | 6963 | C | GLN | E | 202 | 10.622 | 97.528 | 2.481 | 1.00 | 51.55 | B000 | C |
| ATOM | 6964 | O | GLN | E | 202 | 10.464 | 96.310 | 2.640 | 1.00 | 56.45 | B000 | O |
| ATOM | 6965 | CB | GLN | E | 202 | 12.803 | 98.371 | 1.749 | 1.00 | 47.47 | B000 | C |
| ATOM | 6966 | CG | GLN | E | 202 | 13.739 | 98.831 | 0.710 | 1.00 | 55.69 | B000 | C |
| ATOM | 6967 | CD | GLN | E | 202 | 15.139 | 98.987 | 1.254 | 1.00 | 56.47 | B000 | C |
| ATOM | 6968 | OE1 | GLN | E | 202 | 15.907 | 99.831 | 0.790 | 1.00 | 57.62 | B000 | O |
| ATOM | 6969 | NE2 | GLN | E | 202 | 15.490 | 98.154 | 2.219 | 1.00 | 53.11 | B000 | N |
| ATOM | 6970 | N | HIS | E | 203 | 10.189 | 98.433 | 3.360 | 1.00 | 51.67 | B000 | N |
| ATOM | 6971 | CA | HIS | E | 203 | 9.452 | 98.030 | 4.546 | 1.00 | 53.23 | B000 | C |
| ATOM | 6972 | C | HIS | E | 203 | 8.230 | 97.215 | 4.173 | 1.00 | 58.75 | B000 | C |
| ATOM | 6973 | O | HIS | E | 203 | 7.901 | 96.227 | 4.840 | 1.00 | 59.40 | B000 | O |
| ATOM | 6974 | CB | HIS | E | 203 | 9.043 | 99.256 | 5.346 | 1.00 | 52.17 | B000 | C |
| ATOM | 6975 | CG | HIS | E | 203 | 8.280 | 98.924 | 6.587 | 1.00 | 63.88 | B000 | C |
| ATOM | 6976 | ND1 | HIS | E | 203 | 6.924 | 99.142 | 6.710 | 1.00 | 66.92 | B000 | N |
| ATOM | 6977 | CD2 | HIS | E | 203 | 8.681 | 98.359 | 7.750 | 1.00 | 59.72 | B000 | C |
| ATOM | 6978 | CE1 | HIS | E | 203 | 6.525 | 98.741 | 7.904 | 1.00 | 64.58 | B000 | C |
| ATOM | 6979 | NE2 | HIS | E | 203 | 7.572 | 98.265 | 8.555 | 1.00 | 67.38 | B000 | N |
| ATOM | 6980 | N | HIS | E | 204 | 7.548 | 97.609 | 3.105 | 1.00 | 51.87 | B000 | N |
| ATOM | 6981 | CA | HIS | E | 204 | 6.320 | 96.930 | 2.742 | 1.00 | 47.42 | B000 | C |
| ATOM | 6982 | C | HIS | E | 204 | 6.528 | 95.712 | 1.851 | 1.00 | 45.87 | B000 | C |
| ATOM | 6983 | O | HIS | E | 204 | 5.734 | 94.781 | 1.934 | 1.00 | 46.13 | B000 | O |
| ATOM | 6984 | CB | HIS | E | 204 | 5.375 | 97.925 | 2.086 | 1.00 | 43.64 | B000 | C |
| ATOM | 6985 | CG | HIS | E | 204 | 4.761 | 98.864 | 3.071 | 1.00 | 55.52 | B000 | C |
| ATOM | 6986 | ND1 | HIS | E | 204 | 5.277 | 100.116 | 3.331 | 1.00 | 62.43 | B000 | N |
| ATOM | 6987 | CD2 | HIS | E | 204 | 3.719 | 98.703 | 3.917 | 1.00 | 51.63 | B000 | C |
| ATOM | 6988 | CE1 | HIS | E | 204 | 4.551 | 100.702 | 4.265 | 1.00 | 56.76 | B000 | C |
| ATOM | 6989 | NE2 | HIS | E | 204 | 3.598 | 99.867 | 4.634 | 1.00 | 58.19 | B000 | N |
| ATOM | 6990 | N | ILE | E | 205 | 7.554 | 95.673 | 0.998 | 1.00 | 45.67 | B000 | N |
| ATOM | 6991 | CA | ILE | E | 205 | 7.676 | 94.532 | 0.097 | 1.00 | 43.17 | B000 | C |
| ATOM | 6992 | C | ILE | E | 205 | 8.408 | 93.363 | 0.749 | 1.00 | 43.69 | B000 | C |
| ATOM | 6993 | O | ILE | E | 205 | 8.193 | 92.215 | 0.356 | 1.00 | 42.25 | B000 | O |
| ATOM | 6994 | CB | ILE | E | 205 | 8.346 | 94.913 | −1.235 | 1.00 | 39.71 | B000 | C |
| ATOM | 6995 | CG1 | ILE | E | 205 | 9.791 | 95.341 | −1.023 | 1.00 | 34.62 | B000 | C |
| ATOM | 6996 | CG2 | ILE | E | 205 | 7.572 | 96.011 | −1.954 | 1.00 | 32.37 | B000 | C |
| ATOM | 6997 | CD1 | ILE | E | 205 | 10.470 | 95.665 | −2.317 | 1.00 | 33.57 | B000 | C |
| ATOM | 6998 | N | GLY | E | 206 | 9.273 | 93.616 | 1.728 | 1.00 | 45.56 | B000 | N |
| ATOM | 6999 | CA | GLY | E | 206 | 10.038 | 92.555 | 2.352 | 1.00 | 38.77 | B000 | C |
| ATOM | 7000 | C | GLY | E | 206 | 11.058 | 91.943 | 1.409 | 1.00 | 45.53 | B000 | C |
| ATOM | 7001 | O | GLY | E | 206 | 11.640 | 92.616 | 0.551 | 1.00 | 53.68 | B000 | O |
| ATOM | 7002 | N | PRO | E | 207 | 11.268 | 90.646 | 1.525 | 1.00 | 41.49 | B000 | N |
| ATOM | 7003 | CA | PRO | E | 207 | 12.312 | 89.995 | 0.720 | 1.00 | 48.79 | B000 | C |
| ATOM | 7004 | C | PRO | E | 207 | 11.816 | 89.452 | −0.616 | 1.00 | 39.32 | B000 | C |
| ATOM | 7005 | O | PRO | E | 207 | 12.233 | 88.359 | −0.999 | 1.00 | 49.37 | B000 | O |
| ATOM | 7006 | CB | PRO | E | 207 | 12.736 | 88.837 | 1.624 | 1.00 | 42.37 | B000 | C |
| ATOM | 7007 | CG | PRO | E | 207 | 11.386 | 88.411 | 2.205 | 1.00 | 39.72 | B000 | C |
| ATOM | 7008 | CD | PRO | E | 207 | 10.597 | 89.687 | 2.422 | 1.00 | 38.72 | B000 | C |
| ATOM | 7009 | N | VAL | E | 208 | 10.949 | 90.169 | −1.333 | 1.00 | 40.46 | B000 | N |
| ATOM | 7010 | CA | VAL | E | 208 | 10.315 | 89.659 | −2.546 | 1.00 | 37.68 | B000 | C |
| ATOM | 7011 | C | VAL | E | 208 | 10.706 | 90.542 | −3.729 | 1.00 | 38.16 | B000 | C |
| ATOM | 7012 | O | VAL | E | 208 | 10.561 | 91.767 | −3.665 | 1.00 | 39.77 | B000 | O |
| ATOM | 7013 | CB | VAL | E | 208 | 8.785 | 89.601 | −2.383 | 1.00 | 40.03 | B000 | C |
| ATOM | 7014 | CG1 | VAL | E | 208 | 8.133 | 88.976 | −3.608 | 1.00 | 32.03 | B000 | C |
| ATOM | 7015 | CG2 | VAL | E | 208 | 8.427 | 88.819 | −1.106 | 1.00 | 41.62 | B000 | C |
| ATOM | 7016 | N | ASN | E | 209 | 11.186 | 89.917 | −4.812 | 1.00 | 35.17 | B000 | N |
| ATOM | 7017 | CA | ASN | E | 209 | 11.506 | 90.657 | −6.028 | 1.00 | 30.25 | B000 | C |
| ATOM | 7018 | C | ASN | E | 209 | 10.268 | 91.389 | −6.522 | 1.00 | 39.60 | B000 | C |
| ATOM | 7019 | O | ASN | E | 209 | 9.189 | 90.792 | −6.646 | 1.00 | 35.43 | B000 | O |
| ATOM | 7020 | CB | ASN | E | 209 | 12.020 | 89.710 | −7.105 | 1.00 | 33.04 | B000 | C |
| ATOM | 7021 | CG | ASN | E | 209 | 13.430 | 89.196 | −6.817 | 1.00 | 37.45 | B000 | C |
| ATOM | 7022 | OD1 | ASN | E | 209 | 14.282 | 89.914 | −6.286 | 1.00 | 39.88 | B000 | O |
| ATOM | 7023 | ND2 | ASN | E | 209 | 13.676 | 87.948 | −7.166 | 1.00 | 34.14 | B000 | N |
| ATOM | 7024 | N | THR | E | 210 | 10.417 | 92.686 | −6.801 | 1.00 | 32.18 | B000 | N |
| ATOM | 7025 | CA | THR | E | 210 | 9.258 | 93.553 | −6.998 | 1.00 | 34.27 | B000 | C |
| ATOM | 7026 | C | THR | E | 210 | 9.571 | 94.589 | −8.068 | 1.00 | 34.48 | B000 | C |
| ATOM | 7027 | O | THR | E | 210 | 10.533 | 95.349 | −7.932 | 1.00 | 31.68 | B000 | O |
| ATOM | 7028 | CB | THR | E | 210 | 8.864 | 94.225 | −5.667 | 1.00 | 33.37 | B000 | C |
| ATOM | 7029 | OG1 | THR | E | 210 | 8.661 | 93.210 | −4.675 | 1.00 | 35.38 | B000 | O |

TABLE 10.3-continued

| | | | | | | | | | | | |
|---|---|---|---|---|---|---|---|---|---|---|---|
| ATOM | 7030 | CG2 | THR | E | 210 | 7.604 | 95.081 | −5.789 | 1.00 | 26.61 | B000 | C |
| ATOM | 7031 | N | TRP | E | 211 | 8.743 | 94.626 | −9.112 | 1.00 | 29.97 | B000 | N |
| ATOM | 7032 | CA | TRP | E | 211 | 8.933 | 95.562 | −10.208 | 1.00 | 27.14 | B000 | C |
| ATOM | 7033 | C | TRP | E | 211 | 8.801 | 97.006 | −9.731 | 1.00 | 35.31 | B000 | C |
| ATOM | 7034 | O | TRP | E | 211 | 7.981 | 97.316 | −8.863 | 1.00 | 35.67 | B000 | O |
| ATOM | 7035 | CB | TRP | E | 211 | 7.887 | 95.312 | −11.297 | 1.00 | 30.90 | B000 | C |
| ATOM | 7036 | CG | TRP | E | 211 | 8.066 | 94.071 | −12.124 | 1.00 | 34.50 | B000 | C |
| ATOM | 7037 | CD1 | TRP | E | 211 | 7.104 | 93.138 | −12.433 | 1.00 | 29.56 | B000 | C |
| ATOM | 7038 | CD2 | TRP | E | 211 | 9.267 | 93.640 | −12.788 | 1.00 | 34.63 | B000 | C |
| ATOM | 7039 | NE1 | TRP | E | 211 | 7.630 | 92.160 | −13.254 | 1.00 | 28.60 | B000 | N |
| ATOM | 7040 | CE2 | TRP | E | 211 | 8.955 | 92.439 | −13.482 | 1.00 | 35.28 | B000 | C |
| ATOM | 7041 | CE3 | TRP | E | 211 | 10.575 | 94.146 | −12.860 | 1.00 | 35.02 | B000 | C |
| ATOM | 7042 | CZ2 | TRP | E | 211 | 9.904 | 91.741 | −14.231 | 1.00 | 29.26 | B000 | C |
| ATOM | 7043 | CZ3 | TRP | E | 211 | 11.518 | 93.452 | −13.602 | 1.00 | 36.35 | B000 | C |
| ATOM | 7044 | CH2 | TRP | E | 211 | 11.177 | 92.251 | −14.275 | 1.00 | 30.95 | B000 | C |
| ATOM | 7045 | N | MET | E | 212 | 9.605 | 97.895 | −10.316 | 1.00 | 32.55 | B000 | N |
| ATOM | 7046 | CA | MET | E | 212 | 9.380 | 99.331 | −10.239 | 1.00 | 29.40 | B000 | C |
| ATOM | 7047 | C | MET | E | 212 | 9.191 | 99.869 | −11.652 | 1.00 | 37.49 | B000 | C |
| ATOM | 7048 | O | MET | E | 212 | 9.421 | 99.163 | −12.641 | 1.00 | 33.69 | B000 | O |
| ATOM | 7049 | CB | MET | E | 212 | 10.532 | 100.045 | −9.538 | 1.00 | 32.77 | B000 | C |
| ATOM | 7050 | CG | MET | E | 212 | 11.802 | 100.197 | −10.374 | 1.00 | 37.02 | B000 | C |
| ATOM | 7051 | SD | MET | E | 212 | 13.201 | 100.683 | −9.319 | 1.00 | 36.83 | B000 | S |
| ATOM | 7052 | CE | MET | E | 212 | 13.620 | 99.156 | −8.467 | 1.00 | 32.94 | B000 | C |
| ATOM | 7053 | N | GLY | E | 213 | 8.730 | 101.124 | −11.741 | 1.00 | 37.19 | B000 | N |
| ATOM | 7054 | CA | GLY | E | 213 | 8.440 | 101.761 | −13.019 | 1.00 | 32.81 | B000 | C |
| ATOM | 7055 | C | GLY | E | 213 | 9.662 | 102.269 | −13.761 | 1.00 | 40.32 | B000 | C |
| ATOM | 7056 | O | GLY | E | 213 | 9.719 | 103.432 | −14.187 | 1.00 | 38.40 | B000 | O |
| ATOM | 7057 | N | LEU | E | 214 | 10.634 | 101.380 | −13.941 | 1.00 | 34.17 | B000 | N |
| ATOM | 7058 | CA | LEU | E | 214 | 11.934 | 101.714 | −14.503 | 1.00 | 39.27 | B000 | C |
| ATOM | 7059 | C | LEU | E | 214 | 12.321 | 100.610 | −15.473 | 1.00 | 39.76 | B000 | C |
| ATOM | 7060 | O | LEU | E | 214 | 12.335 | 99.431 | −15.100 | 1.00 | 41.29 | B000 | O |
| ATOM | 7061 | CB | LEU | E | 214 | 12.988 | 101.877 | −13.395 | 1.00 | 36.55 | B000 | C |
| ATOM | 7062 | CG | LEU | E | 214 | 14.450 | 102.064 | −13.797 | 1.00 | 42.98 | B000 | C |
| ATOM | 7063 | CD1 | LEU | E | 214 | 14.624 | 103.269 | −14.744 | 1.00 | 38.04 | B000 | C |
| ATOM | 7064 | CD2 | LEU | E | 214 | 15.305 | 102.224 | −12.529 | 1.00 | 37.75 | B000 | C |
| ATOM | 7065 | N | HIS | E | 215 | 12.601 | 100.987 | −16.718 | 1.00 | 36.19 | B000 | N |
| ATOM | 7066 | CA | HIS | E | 215 | 12.875 | 100.024 | −17.774 | 1.00 | 39.33 | B000 | C |
| ATOM | 7067 | C | HIS | E | 215 | 13.746 | 100.691 | −18.829 | 1.00 | 41.39 | B000 | C |
| ATOM | 7068 | O | HIS | E | 215 | 13.843 | 101.921 | −18.899 | 1.00 | 36.50 | B000 | O |
| ATOM | 7069 | CB | HIS | E | 215 | 11.588 | 99.528 | −18.420 | 1.00 | 37.31 | B000 | C |
| ATOM | 7070 | CG | HIS | E | 215 | 10.877 | 100.605 | −19.156 | 1.00 | 43.54 | B000 | C |
| ATOM | 7071 | ND1 | HIS | E | 215 | 10.975 | 100.759 | −20.521 | 1.00 | 59.96 | B000 | N |
| ATOM | 7072 | CD2 | HIS | E | 215 | 10.149 | 101.654 | −18.708 | 1.00 | 43.07 | B000 | C |
| ATOM | 7073 | CE1 | HIS | E | 215 | 10.292 | 101.830 | −20.888 | 1.00 | 55.73 | B000 | C |
| ATOM | 7074 | NE2 | HIS | E | 215 | 9.780 | 102.387 | −19.807 | 1.00 | 46.66 | B000 | N |
| ATOM | 7075 | N | ASP | E | 216 | 14.341 | 99.858 | −19.680 | 1.00 | 35.15 | B000 | N |
| ATOM | 7076 | CA | ASP | E | 216 | 15.301 | 100.290 | −20.686 | 1.00 | 39.15 | B000 | C |
| ATOM | 7077 | C | ASP | E | 216 | 14.788 | 99.998 | −22.085 | 1.00 | 42.63 | B000 | C |
| ATOM | 7078 | O | ASP | E | 216 | 15.571 | 99.773 | −23.004 | 1.00 | 42.03 | B000 | O |
| ATOM | 7079 | CB | ASP | E | 216 | 16.648 | 99.600 | −20.467 | 1.00 | 41.75 | B000 | C |
| ATOM | 7080 | CG | ASP | E | 216 | 16.632 | 98.097 | −20.849 | 1.00 | 44.42 | B000 | C |
| ATOM | 7081 | OD1 | ASP | E | 216 | 15.551 | 97.505 | −21.130 | 1.00 | 37.16 | B000 | O |
| ATOM | 7082 | OD2 | ASP | E | 216 | 17.732 | 97.502 | −20.848 | 1.00 | 43.61 | B000 | O1− |
| ATOM | 7083 | N | GLN | E | 217 | 13.476 | 99.947 | −22.253 | 1.00 | 46.29 | B000 | N |
| ATOM | 7084 | CA | GLN | E | 217 | 12.991 | 99.214 | −23.411 | 1.00 | 59.57 | B000 | C |
| ATOM | 7085 | C | GLN | E | 217 | 13.208 | 99.957 | −24.721 | 1.00 | 65.22 | B000 | C |
| ATOM | 7086 | O | GLN | E | 217 | 13.083 | 99.331 | −25.778 | 1.00 | 73.01 | B000 | O |
| ATOM | 7087 | CB | GLN | E | 217 | 11.516 | 98.820 | −23.200 | 1.00 | 62.75 | B000 | C |
| ATOM | 7088 | CG | GLN | E | 217 | 11.375 | 97.683 | −22.125 | 1.00 | 61.06 | B000 | C |
| ATOM | 7089 | CD | GLN | E | 217 | 9.984 | 97.034 | −22.070 | 1.00 | 67.45 | B000 | C |
| ATOM | 7090 | OE1 | GLN | E | 217 | 9.134 | 97.409 | −21.253 | 1.00 | 58.29 | B000 | O |
| ATOM | 7091 | NE2 | GLN | E | 217 | 9.759 | 96.044 | −22.936 | 1.00 | 73.72 | B000 | N |
| ATOM | 7092 | N | ASN | E | 218 | 13.622 | 101.226 | −24.688 | 1.00 | 54.85 | B000 | N |
| ATOM | 7093 | CA | ASN | E | 218 | 14.065 | 101.896 | −25.900 | 1.00 | 56.88 | B000 | C |
| ATOM | 7094 | C | ASN | E | 218 | 15.579 | 101.999 | −25.997 | 1.00 | 63.85 | B000 | C |
| ATOM | 7095 | O | ASN | E | 218 | 16.099 | 102.476 | −27.010 | 1.00 | 65.96 | B000 | O |
| ATOM | 7096 | CB | ASN | E | 218 | 13.440 | 103.283 | −25.982 | 1.00 | 68.65 | B000 | C |
| ATOM | 7097 | CG | ASN | E | 218 | 11.988 | 103.230 | −26.379 | 1.00 | 76.18 | B000 | C |
| ATOM | 7098 | OD1 | ASN | E | 218 | 11.117 | 103.732 | −25.663 | 1.00 | 80.28 | B000 | O |
| ATOM | 7099 | ND2 | ASN | E | 218 | 11.710 | 102.603 | −27.524 | 1.00 | 70.77 | B000 | N |
| ATOM | 7100 | N | GLY | E | 219 | 16.294 | 101.546 | −24.980 | 1.00 | 55.99 | B000 | N |
| ATOM | 7101 | CA | GLY | E | 219 | 17.721 | 101.702 | −24.908 | 1.00 | 47.24 | B000 | C |
| ATOM | 7102 | C | GLY | E | 219 | 18.086 | 102.395 | −23.615 | 1.00 | 46.37 | B000 | C |
| ATOM | 7103 | O | GLY | E | 219 | 18.657 | 101.797 | −22.697 | 1.00 | 45.37 | B000 | O |
| ATOM | 7104 | N | PRO | E | 220 | 17.760 | 103.679 | −23.515 | 1.00 | 47.23 | B000 | N |
| ATOM | 7105 | CA | PRO | E | 220 | 18.027 | 104.396 | −22.266 | 1.00 | 48.53 | B000 | C |
| ATOM | 7106 | C | PRO | E | 220 | 17.055 | 103.993 | −21.169 | 1.00 | 44.15 | B000 | C |
| ATOM | 7107 | O | PRO | E | 220 | 15.875 | 103.736 | −21.413 | 1.00 | 47.26 | B000 | O |
| ATOM | 7108 | CB | PRO | E | 220 | 17.875 | 105.872 | −22.658 | 1.00 | 43.34 | B000 | C |
| ATOM | 7109 | CG | PRO | E | 220 | 17.055 | 105.868 | −23.864 | 1.00 | 50.66 | B000 | C |

TABLE 10.3-continued

| | | | | | | | | | | | |
|---|---|---|---|---|---|---|---|---|---|---|---|
| ATOM | 7110 | CD | PRO | E | 220 | 17.359 | 104.593 | −24.598 | 1.00 | 46.49 | B000 | C |
| ATOM | 7111 | N | TRP | E | 221 | 17.592 | 103.878 | −19.961 | 1.00 | 41.42 | B000 | N |
| ATOM | 7112 | CA | TRP | E | 221 | 16.767 | 103.695 | −18.783 | 1.00 | 38.08 | B000 | C |
| ATOM | 7113 | C | TRP | E | 221 | 15.871 | 104.916 | −18.561 | 1.00 | 43.21 | B000 | C |
| ATOM | 7114 | O | TRP | E | 221 | 16.325 | 106.062 | −18.630 | 1.00 | 45.08 | B000 | O |
| ATOM | 7115 | CB | TRP | E | 221 | 17.672 | 103.446 | −17.577 | 1.00 | 37.90 | B000 | C |
| ATOM | 7116 | CG | TRP | E | 221 | 18.256 | 102.057 | −17.559 | 1.00 | 35.77 | B000 | C |
| ATOM | 7117 | CD1 | TRP | E | 221 | 19.520 | 101.683 | −17.939 | 1.00 | 39.29 | B000 | C |
| ATOM | 7118 | CD2 | TRP | E | 221 | 17.586 | 100.853 | −17.157 | 1.00 | 36.68 | B000 | C |
| ATOM | 7119 | NE1 | TRP | E | 221 | 19.676 | 100.323 | −17.789 | 1.00 | 39.97 | B000 | N |
| ATOM | 7120 | CE2 | TRP | E | 221 | 18.501 | 99.790 | −17.318 | 1.00 | 39.47 | B000 | C |
| ATOM | 7121 | CE3 | TRP | E | 221 | 16.296 | 100.571 | −16.676 | 1.00 | 37.85 | B000 | C |
| ATOM | 7122 | CZ2 | TRP | E | 221 | 18.176 | 98.469 | −16.997 | 1.00 | 34.61 | B000 | C |
| ATOM | 7123 | CZ3 | TRP | E | 221 | 15.970 | 99.246 | −16.364 | 1.00 | 38.91 | B000 | C |
| ATOM | 7124 | CH2 | TRP | E | 221 | 16.909 | 98.220 | −16.523 | 1.00 | 36.77 | B000 | C |
| ATOM | 7125 | N | LYS | E | 222 | 14.591 | 104.666 | −18.298 | 1.00 | 42.42 | B000 | N |
| ATOM | 7126 | CA | LYS | E | 222 | 13.600 | 105.715 | −18.110 | 1.00 | 45.91 | B000 | C |
| ATOM | 7127 | C | LYS | E | 222 | 12.648 | 105.317 | −16.994 | 1.00 | 49.90 | B000 | C |
| ATOM | 7128 | O | LYS | E | 222 | 12.383 | 104.131 | −16.772 | 1.00 | 45.80 | B000 | O |
| ATOM | 7129 | CB | LYS | E | 222 | 12.766 | 105.968 | −19.368 | 1.00 | 48.31 | B000 | C |
| ATOM | 7130 | CG | LYS | E | 222 | 13.519 | 106.492 | −20.561 | 1.00 | 57.72 | B000 | C |
| ATOM | 7131 | CD | LYS | E | 222 | 12.640 | 106.357 | −21.800 | 1.00 | 65.32 | B000 | C |
| ATOM | 7132 | CE | LYS | E | 222 | 12.661 | 104.903 | −22.305 | 1.00 | 75.88 | B000 | C |
| ATOM | 7133 | NZ | LYS | E | 222 | 12.007 | 104.696 | −23.635 | 1.00 | 76.97 | B000 | N1+ |
| ATOM | 7134 | N | TRP | E | 223 | 12.133 | 106.321 | −16.298 | 1.00 | 47.14 | B000 | N |
| ATOM | 7135 | CA | TRP | E | 223 | 11.031 | 106.134 | −15.372 | 1.00 | 41.03 | B000 | C |
| ATOM | 7136 | C | TRP | E | 223 | 9.714 | 106.314 | −16.124 | 1.00 | 47.51 | B000 | C |
| ATOM | 7137 | O | TRP | E | 223 | 9.617 | 107.117 | −17.056 | 1.00 | 50.81 | B000 | O |
| ATOM | 7138 | CB | TRP | E | 223 | 11.115 | 107.123 | −14.218 | 1.00 | 39.77 | B000 | C |
| ATOM | 7139 | CG | TRP | E | 223 | 12.293 | 106.912 | −13.328 | 1.00 | 40.93 | B000 | C |
| ATOM | 7140 | CD1 | TRP | E | 223 | 13.467 | 107.621 | −13.338 | 1.00 | 41.70 | B000 | C |
| ATOM | 7141 | CD2 | TRP | E | 223 | 12.410 | 105.957 | −12.270 | 1.00 | 41.60 | B000 | C |
| ATOM | 7142 | NE1 | TRP | E | 223 | 14.311 | 107.148 | −12.366 | 1.00 | 40.09 | B000 | N |
| ATOM | 7143 | CE2 | TRP | E | 223 | 13.688 | 106.129 | −11.692 | 1.00 | 39.35 | B000 | C |
| ATOM | 7144 | CE3 | TRP | E | 223 | 11.561 | 104.962 | −11.758 | 1.00 | 42.49 | B000 | C |
| ATOM | 7145 | CZ2 | TRP | E | 223 | 14.141 | 105.342 | −10.627 | 1.00 | 38.41 | B000 | C |
| ATOM | 7146 | CZ3 | TRP | E | 223 | 12.010 | 104.183 | −10.698 | 1.00 | 39.66 | B000 | C |
| ATOM | 7147 | CH2 | TRP | E | 223 | 13.291 | 104.374 | −10.147 | 1.00 | 37.68 | B000 | C |
| ATOM | 7148 | N | VAL | E | 224 | 8.693 | 105.555 | −15.715 | 1.00 | 38.47 | B000 | N |
| ATOM | 7149 | CA | VAL | E | 224 | 7.441 | 105.568 | −16.467 | 1.00 | 44.59 | B000 | C |
| ATOM | 7150 | C | VAL | E | 224 | 6.732 | 106.924 | −16.423 | 1.00 | 46.85 | B000 | C |
| ATOM | 7151 | O | VAL | E | 224 | 5.908 | 107.197 | −17.298 | 1.00 | 50.06 | B000 | O |
| ATOM | 7152 | CB | VAL | E | 224 | 6.487 | 104.458 | −15.967 | 1.00 | 42.40 | B000 | C |
| ATOM | 7153 | CG1 | VAL | E | 224 | 7.059 | 103.070 | −16.288 | 1.00 | 42.00 | B000 | C |
| ATOM | 7154 | CG2 | VAL | E | 224 | 6.227 | 104.600 | −14.475 | 1.00 | 34.29 | B000 | C |
| ATOM | 7155 | N | ASP | E | 225 | 7.017 | 107.790 | −15.444 | 1.00 | 48.54 | B000 | N |
| ATOM | 7156 | CA | ASP | E | 225 | 6.329 | 109.079 | −15.338 | 1.00 | 53.13 | B000 | C |
| ATOM | 7157 | C | ASP | E | 225 | 7.149 | 110.250 | −15.865 | 1.00 | 51.10 | B000 | C |
| ATOM | 7158 | O | ASP | E | 225 | 6.709 | 111.394 | −15.749 | 1.00 | 47.62 | B000 | O |
| ATOM | 7159 | CB | ASP | E | 225 | 5.898 | 109.358 | −13.886 | 1.00 | 39.25 | B000 | C |
| ATOM | 7160 | CG | ASP | E | 225 | 7.078 | 109.617 | −12.948 | 1.00 | 49.56 | B000 | C |
| ATOM | 7161 | OD1 | ASP | E | 225 | 8.244 | 109.417 | −13.352 | 1.00 | 47.55 | B000 | O |
| ATOM | 7162 | OD2 | ASP | E | 225 | 6.834 | 109.961 | −11.767 | 1.00 | 55.28 | B000 | O1− |
| ATOM | 7163 | N | GLY | E | 226 | 8.319 | 110.001 | −16.449 | 1.00 | 50.70 | B000 | N |
| ATOM | 7164 | CA | GLY | E | 226 | 9.118 | 111.058 | −17.029 | 1.00 | 50.75 | B000 | C |
| ATOM | 7165 | C | GLY | E | 226 | 10.206 | 111.608 | −16.128 | 1.00 | 49.85 | B000 | C |
| ATOM | 7166 | O | GLY | E | 226 | 11.083 | 112.321 | −16.614 | 1.00 | 55.13 | B000 | O |
| ATOM | 7167 | N | THR | E | 227 | 10.149 | 111.328 | −14.832 | 1.00 | 46.51 | B000 | N |
| ATOM | 7168 | CA | THR | E | 227 | 11.258 | 111.622 | −13.942 | 1.00 | 42.53 | B000 | C |
| ATOM | 7169 | C | THR | E | 227 | 12.579 | 111.301 | −14.624 | 1.00 | 50.97 | B000 | C |
| ATOM | 7170 | O | THR | E | 227 | 12.760 | 110.213 | −15.178 | 1.00 | 57.64 | B000 | O |
| ATOM | 7171 | CB | THR | E | 227 | 11.117 | 110.795 | −12.667 | 1.00 | 48.55 | B000 | C |
| ATOM | 7172 | OG1 | THR | E | 227 | 9.834 | 111.037 | −12.070 | 1.00 | 46.24 | B000 | O |
| ATOM | 7173 | CG2 | THR | E | 227 | 12.226 | 111.120 | −11.690 | 1.00 | 41.66 | B000 | C |
| ATOM | 7174 | N | ASP | E | 228 | 13.490 | 112.268 | −14.601 | 1.00 | 59.03 | B000 | N |
| ATOM | 7175 | CA | ASP | E | 228 | 14.770 | 112.131 | −15.280 | 1.00 | 45.94 | B000 | C |
| ATOM | 7176 | C | ASP | E | 228 | 15.624 | 111.088 | −14.580 | 1.00 | 51.75 | B000 | C |
| ATOM | 7177 | O | ASP | E | 228 | 15.872 | 111.182 | −13.374 | 1.00 | 56.28 | B000 | O |
| ATOM | 7178 | CB | ASP | E | 228 | 15.501 | 113.474 | −15.311 | 1.00 | 47.30 | B000 | C |
| ATOM | 7179 | CG | ASP | E | 228 | 16.845 | 113.379 | −15.998 | 1.00 | 56.00 | B000 | C |
| ATOM | 7180 | OD1 | ASP | E | 228 | 16.859 | 113.296 | −17.250 | 1.00 | 54.17 | B000 | O |
| ATOM | 7181 | OD2 | ASP | E | 228 | 17.881 | 113.348 | −15.290 | 1.00 | 56.42 | B000 | O1− |
| ATOM | 7182 | N | TYR | E | 229 | 16.112 | 110.114 | −15.350 | 1.00 | 52.14 | B000 | N |
| ATOM | 7183 | CA | TYR | E | 229 | 16.829 | 109.000 | −14.743 | 1.00 | 46.06 | B000 | C |
| ATOM | 7184 | C | TYR | E | 229 | 18.227 | 109.400 | −14.287 | 1.00 | 47.79 | B000 | C |
| ATOM | 7185 | O | TYR | E | 229 | 18.667 | 108.998 | −13.201 | 1.00 | 47.55 | B000 | O |
| ATOM | 7186 | CB | TYR | E | 229 | 16.901 | 107.830 | −15.729 | 1.00 | 43.66 | B000 | C |
| ATOM | 7187 | CG | TYR | E | 229 | 17.852 | 106.745 | −15.304 | 1.00 | 42.09 | B000 | C |
| ATOM | 7188 | CD1 | TYR | E | 229 | 17.523 | 105.882 | −14.269 | 1.00 | 38.14 | B000 | C |
| ATOM | 7189 | CD2 | TYR | E | 229 | 19.090 | 106.594 | −15.917 | 1.00 | 42.41 | B000 | C |

TABLE 10.3-continued

| | | | | | | | | | | | |
|---|---|---|---|---|---|---|---|---|---|---|---|
| ATOM | 7190 | CE1 | TYR | E | 229 | 18.387 | 104.882 | −13.864 | 1.00 | 40.35 | B000 C |
| ATOM | 7191 | CE2 | TYR | E | 229 | 19.968 | 105.589 | −15.517 | 1.00 | 46.35 | B000 C |
| ATOM | 7192 | CZ | TYR | E | 229 | 19.599 | 104.734 | −14.486 | 1.00 | 46.45 | B000 C |
| ATOM | 7193 | OH | TYR | E | 229 | 20.450 | 103.738 | −14.064 | 1.00 | 40.57 | B000 O |
| ATOM | 7194 | N | GLU | E | 230 | 18.954 | 110.170 | −15.103 | 1.00 | 49.15 | B000 N |
| ATOM | 7195 | CA | GLU | E | 230 | 20.375 | 110.365 | −14.821 | 1.00 | 46.97 | B000 C |
| ATOM | 7196 | C | GLU | E | 230 | 20.591 | 111.198 | −13.556 | 1.00 | 51.12 | B000 C |
| ATOM | 7197 | O | GLU | E | 230 | 21.457 | 110.879 | −12.738 | 1.00 | 53.36 | B000 O |
| ATOM | 7198 | CB | GLU | E | 230 | 21.082 | 110.992 | −16.017 | 1.00 | 50.20 | B000 C |
| ATOM | 7199 | CG | GLU | E | 230 | 22.607 | 110.803 | −15.963 | 1.00 | 63.82 | B000 C |
| ATOM | 7200 | CD | GLU | E | 230 | 23.021 | 109.363 | −15.585 | 1.00 | 76.02 | B000 C |
| ATOM | 7201 | OE1 | GLU | E | 230 | 22.553 | 108.396 | −16.253 | 1.00 | 66.88 | B000 O |
| ATOM | 7202 | OE2 | GLU | E | 230 | 23.821 | 109.201 | −14.625 | 1.00 | 79.76 | B000 O1− |
| ATOM | 7203 | N | THR | E | 231 | 19.809 | 112.248 | −13.359 | 1.00 | 48.10 | B000 N |
| ATOM | 7204 | CA | THR | E | 231 | 19.981 | 113.081 | −12.176 | 1.00 | 56.05 | B000 C |
| ATOM | 7205 | C | THR | E | 231 | 19.161 | 112.602 | −10.988 | 1.00 | 60.28 | B000 C |
| ATOM | 7206 | O | THR | E | 231 | 19.280 | 113.183 | −9.900 | 1.00 | 51.86 | B000 O |
| ATOM | 7207 | CB | THR | E | 231 | 19.606 | 114.531 | −12.495 | 1.00 | 52.22 | B000 C |
| ATOM | 7208 | OG1 | THR | E | 231 | 18.217 | 114.591 | −12.844 | 1.00 | 53.83 | B000 O |
| ATOM | 7209 | CG2 | THR | E | 231 | 20.445 | 115.043 | −13.668 | 1.00 | 46.56 | B000 C |
| ATOM | 7210 | N | GLY | E | 232 | 18.363 | 111.540 | −11.160 | 1.00 | 55.84 | B000 N |
| ATOM | 7211 | CA | GLY | E | 232 | 17.470 | 111.077 | −10.123 | 1.00 | 48.35 | B000 C |
| ATOM | 7212 | C | GLY | E | 232 | 18.105 | 110.067 | −9.184 | 1.00 | 48.84 | B000 C |
| ATOM | 7213 | O | GLY | E | 232 | 19.249 | 109.642 | −9.345 | 1.00 | 44.82 | B000 O |
| ATOM | 7214 | N | PHE | E | 233 | 17.313 | 109.679 | −8.185 | 1.00 | 47.45 | B000 N |
| ATOM | 7215 | CA | PHE | E | 233 | 17.724 | 108.672 | −7.218 | 1.00 | 45.48 | B000 C |
| ATOM | 7216 | C | PHE | E | 233 | 17.998 | 107.339 | −7.920 | 1.00 | 45.39 | B000 C |
| ATOM | 7217 | O | PHE | E | 233 | 17.309 | 106.963 | −8.870 | 1.00 | 43.33 | B000 O |
| ATOM | 7218 | CB | PHE | E | 233 | 16.627 | 108.531 | −6.141 | 1.00 | 43.07 | B000 C |
| ATOM | 7219 | CG | PHE | E | 233 | 16.952 | 107.537 | −5.062 | 1.00 | 49.50 | B000 C |
| ATOM | 7220 | CD1 | PHE | E | 233 | 17.819 | 107.865 | −4.031 | 1.00 | 49.13 | B000 C |
| ATOM | 7221 | CD2 | PHE | E | 233 | 16.393 | 106.267 | −5.077 | 1.00 | 46.36 | B000 C |
| ATOM | 7222 | CE1 | PHE | E | 233 | 18.130 | 106.941 | −3.043 | 1.00 | 56.48 | B000 C |
| ATOM | 7223 | CE2 | PHE | E | 233 | 16.703 | 105.332 | −4.089 | 1.00 | 43.16 | B000 C |
| ATOM | 7224 | CZ | PHE | E | 233 | 17.570 | 105.668 | −3.073 | 1.00 | 50.08 | B000 C |
| ATOM | 7225 | N | LYS | E | 234 | 19.027 | 106.631 | −7.461 | 1.00 | 43.29 | B000 N |
| ATOM | 7226 | CA | LYS | E | 234 | 19.350 | 105.304 | −7.964 | 1.00 | 42.55 | B000 C |
| ATOM | 7227 | C | LYS | E | 234 | 19.835 | 104.464 | −6.800 | 1.00 | 48.47 | B000 C |
| ATOM | 7228 | O | LYS | E | 234 | 20.501 | 104.989 | −5.904 | 1.00 | 44.87 | B000 O |
| ATOM | 7229 | CB | LYS | E | 234 | 20.433 | 105.329 | −9.047 | 1.00 | 43.84 | B000 C |
| ATOM | 7230 | CG | LYS | E | 234 | 20.093 | 106.096 | −10.319 | 1.00 | 43.53 | B000 C |
| ATOM | 7231 | CD | LYS | E | 234 | 21.305 | 106.028 | −11.250 | 1.00 | 42.53 | B000 C |
| ATOM | 7232 | CE | LYS | E | 234 | 21.235 | 107.016 | −12.398 | 1.00 | 46.96 | B000 C |
| ATOM | 7233 | NZ | LYS | E | 234 | 21.273 | 108.424 | −11.907 | 1.00 | 55.21 | B000 N1+ |
| ATOM | 7234 | N | ASN | E | 235 | 19.486 | 103.171 | −6.793 | 1.00 | 46.39 | B000 N |
| ATOM | 7235 | CA | ASN | E | 235 | 19.925 | 102.276 | −5.717 | 1.00 | 42.44 | B000 C |
| ATOM | 7236 | C | ASN | E | 235 | 20.263 | 100.885 | −6.277 | 1.00 | 41.99 | B000 C |
| ATOM | 7237 | O | ASN | E | 235 | 19.881 | 99.849 | −5.728 | 1.00 | 41.55 | B000 O |
| ATOM | 7238 | CB | ASN | E | 235 | 18.867 | 102.211 | −4.605 | 1.00 | 37.90 | B000 C |
| ATOM | 7239 | CG | ASN | E | 235 | 19.353 | 101.448 | −3.380 | 1.00 | 40.64 | B000 C |
| ATOM | 7240 | OD1 | ASN | E | 235 | 20.538 | 101.458 | −3.079 | 1.00 | 45.11 | B000 O |
| ATOM | 7241 | ND2 | ASN | E | 235 | 18.449 | 100.769 | −2.685 | 1.00 | 41.74 | B000 N |
| ATOM | 7242 | N | TRP | E | 236 | 21.051 | 100.853 | −7.346 | 1.00 | 39.52 | B000 N |
| ATOM | 7243 | CA | TRP | E | 236 | 21.407 | 99.599 | −7.994 | 1.00 | 37.91 | B000 C |
| ATOM | 7244 | C | TRP | E | 236 | 22.266 | 98.720 | −7.099 | 1.00 | 42.70 | B000 C |
| ATOM | 7245 | O | TRP | E | 236 | 23.054 | 99.199 | −6.281 | 1.00 | 46.72 | B000 O |
| ATOM | 7246 | CB | TRP | E | 236 | 22.178 | 99.848 | −9.299 | 1.00 | 34.60 | B000 C |
| ATOM | 7247 | CG | TRP | E | 236 | 21.377 | 100.494 | −10.396 | 1.00 | 43.16 | B000 C |
| ATOM | 7248 | CD1 | TRP | E | 236 | 21.452 | 101.794 | −10.810 | 1.00 | 36.82 | B000 C |
| ATOM | 7249 | CD2 | TRP | E | 236 | 20.363 | 99.873 | −11.207 | 1.00 | 38.15 | B000 C |
| ATOM | 7250 | NE1 | TRP | E | 236 | 20.565 | 102.017 | −11.839 | 1.00 | 41.26 | B000 N |
| ATOM | 7251 | CE2 | TRP | E | 236 | 19.884 | 100.857 | −12.103 | 1.00 | 39.75 | B000 C |
| ATOM | 7252 | CE3 | TRP | E | 236 | 19.831 | 98.581 | −11.273 | 1.00 | 36.10 | B000 C |
| ATOM | 7253 | CZ2 | TRP | E | 236 | 18.894 | 100.591 | −13.054 | 1.00 | 35.54 | B000 C |
| ATOM | 7254 | CZ3 | TRP | E | 236 | 18.850 | 98.311 | −12.219 | 1.00 | 35.95 | B000 C |
| ATOM | 7255 | CH2 | TRP | E | 236 | 18.389 | 99.317 | −13.096 | 1.00 | 41.76 | B000 C |
| ATOM | 7256 | N | ARG | E | 237 | 22.102 | 97.410 | −7.274 | 1.00 | 45.40 | B000 N |
| ATOM | 7257 | CA | ARG | E | 237 | 23.050 | 96.440 | −6.763 | 1.00 | 47.18 | B000 C |
| ATOM | 7258 | C | ARG | E | 237 | 24.449 | 96.720 | −7.314 | 1.00 | 51.81 | B000 C |
| ATOM | 7259 | O | ARG | E | 237 | 24.595 | 97.350 | −8.368 | 1.00 | 43.69 | B000 O |
| ATOM | 7260 | CB | ARG | E | 237 | 22.634 | 95.041 | −7.185 | 1.00 | 46.24 | B000 C |
| ATOM | 7261 | CG | ARG | E | 237 | 21.530 | 94.422 | −6.393 | 1.00 | 51.40 | B000 C |
| ATOM | 7262 | CD | ARG | E | 237 | 22.096 | 93.585 | −5.285 | 1.00 | 58.45 | B000 C |
| ATOM | 7263 | NE | ARG | E | 237 | 21.038 | 92.772 | −4.710 | 1.00 | 70.66 | B000 N |
| ATOM | 7264 | CZ | ARG | E | 237 | 21.262 | 91.703 | −3.961 | 1.00 | 72.34 | B000 C |
| ATOM | 7265 | NH1 | ARG | E | 237 | 20.232 | 90.990 | −3.494 | 1.00 | 63.81 | B000 N1+ |
| ATOM | 7266 | NH2 | ARG | E | 237 | 22.525 | 91.368 | −3.681 | 1.00 | 60.30 | B000 N |
| ATOM | 7267 | N | PRO | E | 238 | 25.489 | 96.240 | −6.628 | 1.00 | 52.18 | B000 N |
| ATOM | 7268 | CA | PRO | E | 238 | 26.853 | 96.359 | −7.163 | 1.00 | 56.03 | B000 C |
| ATOM | 7269 | C | PRO | E | 238 | 26.950 | 95.788 | −8.569 | 1.00 | 52.87 | B000 C |

TABLE 10.3-continued

| ATOM | 7270 | O | PRO | E | 238 | 26.528 | 94.660 | −8.830 | 1.00 | 56.32 | B000 | O |
|---|---|---|---|---|---|---|---|---|---|---|---|---|
| ATOM | 7271 | CB | PRO | E | 238 | 27.694 | 95.545 | −6.171 | 1.00 | 52.68 | B000 | C |
| ATOM | 7272 | CG | PRO | E | 238 | 26.934 | 95.614 | −4.891 | 1.00 | 56.74 | B000 | C |
| ATOM | 7273 | CD | PRO | E | 238 | 25.473 | 95.617 | −5.291 | 1.00 | 58.40 | B000 | C |
| ATOM | 7274 | N | GLU | E | 239 | 27.508 | 96.588 | −9.477 | 1.00 | 54.34 | B000 | N |
| ATOM | 7275 | CA | GLU | E | 239 | 27.753 | 96.254 | −10.877 | 1.00 | 53.49 | B000 | C |
| ATOM | 7276 | C | GLU | E | 239 | 26.481 | 96.144 | −11.711 | 1.00 | 55.15 | B000 | C |
| ATOM | 7277 | O | GLU | E | 239 | 26.545 | 95.684 | −12.862 | 1.00 | 57.25 | B000 | O |
| ATOM | 7278 | CB | GLU | E | 239 | 28.578 | 94.974 | −11.029 | 1.00 | 50.60 | B000 | C |
| ATOM | 7279 | CG | GLU | E | 239 | 30.001 | 95.104 | −10.514 | 1.00 | 66.65 | B000 | C |
| ATOM | 7280 | CD | GLU | E | 239 | 30.663 | 93.760 | −10.297 | 1.00 | 83.88 | B000 | C |
| ATOM | 7281 | OE1 | GLU | E | 239 | 30.038 | 92.728 | −10.639 | 1.00 | 75.71 | B000 | O |
| ATOM | 7282 | OE2 | GLU | E | 239 | 31.816 | 93.739 | −9.808 | 1.00 | 96.45 | B000 | O1− |
| ATOM | 7283 | N | GLN | E | 240 | 25.336 | 96.571 | −11.187 | 1.00 | 42.77 | B000 | N |
| ATOM | 7284 | CA | GLN | E | 240 | 24.126 | 96.666 | −11.990 | 1.00 | 44.13 | B000 | C |
| ATOM | 7285 | C | GLN | E | 240 | 23.886 | 98.142 | −12.320 | 1.00 | 39.19 | B000 | C |
| ATOM | 7286 | O | GLN | E | 240 | 24.353 | 99.013 | −11.600 | 1.00 | 37.74 | B000 | O |
| ATOM | 7287 | CB | GLN | E | 240 | 22.931 | 96.054 | −11.253 | 1.00 | 41.92 | B000 | C |
| ATOM | 7288 | CG | GLN | E | 240 | 23.174 | 94.638 | −10.737 | 1.00 | 41.56 | B000 | C |
| ATOM | 7289 | CD | GLN | E | 240 | 23.857 | 93.758 | −11.761 | 1.00 | 47.34 | B000 | C |
| ATOM | 7290 | OE1 | GLN | E | 240 | 23.461 | 93.713 | −12.927 | 1.00 | 45.90 | B000 | O |
| ATOM | 7291 | NE2 | GLN | E | 240 | 24.908 | 93.071 | −11.336 | 1.00 | 53.15 | B000 | N |
| ATOM | 7292 | N | PRO | E | 241 | 23.176 | 98.433 | −13.423 | 1.00 | 39.17 | B000 | N |
| ATOM | 7293 | CA | PRO | E | 241 | 22.582 | 97.492 | −14.382 | 1.00 | 41.50 | B000 | C |
| ATOM | 7294 | C | PRO | E | 241 | 23.654 | 96.945 | −15.327 | 1.00 | 39.88 | B000 | C |
| ATOM | 7295 | O | PRO | E | 241 | 24.800 | 97.332 | −15.130 | 1.00 | 47.11 | B000 | O |
| ATOM | 7296 | CB | PRO | E | 241 | 21.539 | 98.350 | −15.114 | 1.00 | 41.31 | B000 | C |
| ATOM | 7297 | CG | PRO | E | 241 | 22.116 | 99.770 | −15.042 | 1.00 | 40.16 | B000 | C |
| ATOM | 7298 | CD | PRO | E | 241 | 22.851 | 99.844 | −13.732 | 1.00 | 35.10 | B000 | C |
| ATOM | 7299 | N | ASP | E | 242 | 23.325 | 96.074 | −16.287 | 1.00 | 39.07 | B000 | N |
| ATOM | 7300 | CA | ASP | E | 242 | 24.337 | 95.571 | −17.221 | 1.00 | 42.10 | B000 | C |
| ATOM | 7301 | C | ASP | E | 242 | 25.112 | 96.732 | −17.827 | 1.00 | 45.64 | B000 | C |
| ATOM | 7302 | O | ASP | E | 242 | 24.512 | 97.697 | −18.317 | 1.00 | 42.87 | B000 | O |
| ATOM | 7303 | CB | ASP | E | 242 | 23.691 | 94.761 | −18.348 | 1.00 | 42.84 | B000 | C |
| ATOM | 7304 | CG | ASP | E | 242 | 22.886 | 93.568 | −17.852 | 1.00 | 43.37 | B000 | C |
| ATOM | 7305 | OD1 | ASP | E | 242 | 23.330 | 92.905 | −16.895 | 1.00 | 46.50 | B000 | O |
| ATOM | 7306 | OD2 | ASP | E | 242 | 21.800 | 93.308 | −18.430 | 1.00 | 43.11 | B000 | O1− |
| ATOM | 7307 | N | ASP | E | 243 | 26.448 | 96.634 | −17.808 | 1.00 | 39.31 | B000 | N |
| ATOM | 7308 | CA | ASP | E | 243 | 27.300 | 97.761 | −18.190 | 1.00 | 47.79 | B000 | C |
| ATOM | 7309 | C | ASP | E | 243 | 27.812 | 97.693 | −19.621 | 1.00 | 43.78 | B000 | C |
| ATOM | 7310 | O | ASP | E | 243 | 28.698 | 98.475 | −19.976 | 1.00 | 46.39 | B000 | O |
| ATOM | 7311 | CB | ASP | E | 243 | 28.506 | 97.880 | −17.250 | 1.00 | 43.08 | B000 | C |
| ATOM | 7312 | CG | ASP | E | 243 | 29.395 | 96.633 | −17.252 | 1.00 | 54.01 | B000 | C |
| ATOM | 7313 | OD1 | ASP | E | 243 | 29.151 | 95.676 | −18.025 | 1.00 | 56.31 | B000 | O |
| ATOM | 7314 | OD2 | ASP | E | 243 | 30.350 | 96.604 | −16.453 | 1.00 | 60.30 | B000 | O1− |
| ATOM | 7315 | N | TRP | E | 244 | 27.332 | 96.754 | −20.435 | 1.00 | 42.79 | B000 | N |
| ATOM | 7316 | CA | TRP | E | 244 | 27.941 | 96.563 | −21.742 | 1.00 | 44.21 | B000 | C |
| ATOM | 7317 | C | TRP | E | 244 | 27.283 | 97.361 | −22.860 | 1.00 | 43.63 | B000 | C |
| ATOM | 7318 | O | TRP | E | 244 | 27.674 | 97.194 | −24.018 | 1.00 | 43.92 | B000 | O |
| ATOM | 7319 | CB | TRP | E | 244 | 28.043 | 95.072 | −22.108 | 1.00 | 43.09 | B000 | C |
| ATOM | 7320 | CG | TRP | E | 244 | 26.891 | 94.182 | −21.886 | 1.00 | 44.80 | B000 | C |
| ATOM | 7321 | CD1 | TRP | E | 244 | 25.879 | 93.900 | −22.770 | 1.00 | 47.43 | B000 | C |
| ATOM | 7322 | CD2 | TRP | E | 244 | 26.668 | 93.355 | −20.746 | 1.00 | 43.82 | B000 | C |
| ATOM | 7323 | NE1 | TRP | E | 244 | 25.016 | 92.980 | −22.226 | 1.00 | 44.04 | B000 | N |
| ATOM | 7324 | CE2 | TRP | E | 244 | 25.482 | 92.621 | −20.987 | 1.00 | 46.21 | B000 | C |
| ATOM | 7325 | CE3 | TRP | E | 244 | 27.346 | 93.171 | −19.540 | 1.00 | 42.76 | B000 | C |
| ATOM | 7326 | CZ2 | TRP | E | 244 | 24.957 | 91.729 | −20.060 | 1.00 | 44.01 | B000 | C |
| ATOM | 7327 | CZ3 | TRP | E | 244 | 26.827 | 92.292 | −18.622 | 1.00 | 42.24 | B000 | C |
| ATOM | 7328 | CH2 | TRP | E | 244 | 25.641 | 91.579 | −18.883 | 1.00 | 49.08 | B000 | C |
| ATOM | 7329 | N | TYR | E | 245 | 26.330 | 98.242 | −22.550 | 1.00 | 43.45 | B000 | N |
| ATOM | 7330 | CA | TYR | E | 245 | 25.626 | 99.013 | −23.574 | 1.00 | 45.01 | B000 | C |
| ATOM | 7331 | C | TYR | E | 245 | 26.012 | 100.481 | −23.628 | 1.00 | 42.12 | B000 | C |
| ATOM | 7332 | O | TYR | E | 245 | 25.598 | 101.169 | −24.560 | 1.00 | 45.10 | B000 | O |
| ATOM | 7333 | CB | TYR | E | 245 | 24.099 | 98.947 | −23.366 | 1.00 | 42.26 | B000 | C |
| ATOM | 7334 | CG | TYR | E | 245 | 23.544 | 97.553 | −23.256 | 1.00 | 43.72 | B000 | C |
| ATOM | 7335 | CD1 | TYR | E | 245 | 23.355 | 96.770 | −24.391 | 1.00 | 40.29 | B000 | C |
| ATOM | 7336 | CD2 | TYR | E | 245 | 23.224 | 97.006 | −22.016 | 1.00 | 39.35 | B000 | C |
| ATOM | 7337 | CE1 | TYR | E | 245 | 22.841 | 95.500 | −24.301 | 1.00 | 39.08 | B000 | C |
| ATOM | 7338 | CE2 | TYR | E | 245 | 22.717 | 95.722 | −21.918 | 1.00 | 43.84 | B000 | C |
| ATOM | 7339 | CZ | TYR | E | 245 | 22.533 | 94.976 | −23.064 | 1.00 | 41.96 | B000 | C |
| ATOM | 7340 | OH | TYR | E | 245 | 22.036 | 93.706 | −22.975 | 1.00 | 45.97 | B000 | O |
| ATOM | 7341 | N | GLY | E | 246 | 26.710 | 101.001 | −22.638 | 1.00 | 41.64 | B000 | N |
| ATOM | 7342 | CA | GLY | E | 246 | 26.989 | 102.420 | −22.592 | 1.00 | 43.53 | B000 | C |
| ATOM | 7343 | C | GLY | E | 246 | 26.255 | 103.119 | −21.455 | 1.00 | 47.49 | B000 | C |
| ATOM | 7344 | O | GLY | E | 246 | 25.273 | 102.626 | −20.898 | 1.00 | 44.82 | B000 | O |
| ATOM | 7345 | N | HIS | E | 247 | 26.714 | 104.343 | −21.189 | 1.00 | 50.58 | B000 | N |
| ATOM | 7346 | CA | HIS | E | 247 | 26.284 | 105.118 | −20.030 | 1.00 | 42.87 | B000 | C |
| ATOM | 7347 | C | HIS | E | 247 | 24.783 | 105.367 | −20.033 | 1.00 | 44.35 | B000 | C |
| ATOM | 7348 | O | HIS | E | 247 | 24.236 | 105.933 | −20.985 | 1.00 | 45.35 | B000 | O |
| ATOM | 7349 | CB | HIS | E | 247 | 27.044 | 106.440 | −20.003 | 1.00 | 53.73 | B000 | C |

TABLE 10.3-continued

| | | | | | | | | | | |
|---|---|---|---|---|---|---|---|---|---|---|
| ATOM | 7350 | CG | HIS | E | 247 | 26.584 | 107.373 | −18.933 | 1.00 | 56.75 | B000 C |
| ATOM | 7351 | ND1 | HIS | E | 247 | 26.920 | 107.206 | −17.607 | 1.00 | 59.80 | B000 N |
| ATOM | 7352 | CD2 | HIS | E | 247 | 25.799 | 108.476 | −18.991 | 1.00 | 55.82 | B000 C |
| ATOM | 7353 | CE1 | HIS | E | 247 | 26.367 | 108.172 | −16.894 | 1.00 | 66.18 | B000 C |
| ATOM | 7354 | NE2 | HIS | E | 247 | 25.682 | 108.956 | −17.710 | 1.00 | 63.47 | B000 N |
| ATOM | 7355 | N | GLY | E | 248 | 24.117 | 104.949 | −18.954 | 1.00 | 45.02 | B000 N |
| ATOM | 7356 | CA | GLY | E | 248 | 22.680 | 105.131 | −18.847 | 1.00 | 45.46 | B000 C |
| ATOM | 7357 | C | GLY | E | 248 | 21.849 | 104.287 | −19.791 | 1.00 | 46.59 | B000 C |
| ATOM | 7358 | O | GLY | E | 248 | 20.659 | 104.568 | −19.979 | 1.00 | 40.42 | B000 O |
| ATOM | 7359 | N | LEU | E | 249 | 22.431 | 103.242 | −20.380 | 1.00 | 42.75 | B000 N |
| ATOM | 7360 | CA | LEU | E | 249 | 21.760 | 102.493 | −21.430 | 1.00 | 42.93 | B000 C |
| ATOM | 7361 | C | LEU | E | 249 | 21.579 | 101.026 | −21.050 | 1.00 | 42.71 | B000 C |
| ATOM | 7362 | O | LEU | E | 249 | 22.327 | 100.466 | −20.239 | 1.00 | 35.38 | B000 O |
| ATOM | 7363 | CB | LEU | E | 249 | 22.536 | 102.595 | −22.750 | 1.00 | 39.36 | B000 C |
| ATOM | 7364 | CG | LEU | E | 249 | 22.689 | 104.006 | −23.343 | 1.00 | 42.86 | B000 C |
| ATOM | 7365 | CD1 | LEU | E | 249 | 23.340 | 103.916 | −24.714 | 1.00 | 39.37 | B000 C |
| ATOM | 7366 | CD2 | LEU | E | 249 | 21.350 | 104.700 | −23.442 | 1.00 | 40.64 | B000 C |
| ATOM | 7367 | N | GLY | E | 250 | 20.569 | 100.410 | −21.653 | 1.00 | 40.13 | B000 N |
| ATOM | 7368 | CA | GLY | E | 250 | 20.394 | 98.976 | −21.584 | 1.00 | 34.39 | B000 C |
| ATOM | 7369 | C | GLY | E | 250 | 20.162 | 98.460 | −22.986 | 1.00 | 42.96 | B000 C |
| ATOM | 7370 | O | GLY | E | 250 | 20.251 | 99.242 | −23.936 | 1.00 | 39.19 | B000 O |
| ATOM | 7371 | N | GLY | E | 251 | 19.857 | 97.167 | −23.135 | 1.00 | 42.21 | B000 N |
| ATOM | 7372 | CA | GLY | E | 251 | 19.622 | 96.533 | −24.418 | 1.00 | 38.08 | B000 C |
| ATOM | 7373 | C | GLY | E | 251 | 18.179 | 96.437 | −24.892 | 1.00 | 41.51 | B000 C |
| ATOM | 7374 | O | GLY | E | 251 | 17.932 | 95.813 | −25.932 | 1.00 | 47.66 | B000 O |
| ATOM | 7375 | N | GLY | E | 252 | 17.209 | 97.010 | −24.169 | 1.00 | 45.08 | B000 N |
| ATOM | 7376 | CA | GLY | E | 252 | 15.832 | 97.049 | −24.628 | 1.00 | 44.10 | B000 C |
| ATOM | 7377 | C | GLY | E | 252 | 14.893 | 95.971 | −24.115 | 1.00 | 40.91 | B000 C |
| ATOM | 7378 | O | GLY | E | 252 | 13.707 | 96.009 | −24.452 | 1.00 | 51.54 | B000 O |
| ATOM | 7379 | N | GLU | E | 253 | 15.380 | 94.997 | −23.351 | 1.00 | 49.13 | B000 N |
| ATOM | 7380 | CA | GLU | E | 253 | 14.569 | 93.886 | −22.849 | 1.00 | 44.54 | B000 C |
| ATOM | 7381 | C | GLU | E | 253 | 14.410 | 93.867 | −21.335 | 1.00 | 40.80 | B000 C |
| ATOM | 7382 | O | GLU | E | 253 | 13.844 | 92.902 | −20.810 | 1.00 | 43.41 | B000 O |
| ATOM | 7383 | CB | GLU | E | 253 | 15.180 | 92.537 | −23.273 | 1.00 | 49.30 | B000 C |
| ATOM | 7384 | CG | GLU | E | 253 | 15.553 | 92.443 | −24.748 | 1.00 | 58.40 | B000 C |
| ATOM | 7385 | CD | GLU | E | 253 | 14.373 | 92.111 | −25.651 | 1.00 | 68.11 | B000 C |
| ATOM | 7386 | OE1 | GLU | E | 253 | 13.919 | 90.934 | −25.628 | 1.00 | 71.69 | B000 O |
| ATOM | 7387 | OE2 | GLU | E | 253 | 13.900 | 93.027 | −26.378 | 1.00 | 62.49 | B000 O1− |
| ATOM | 7388 | N | ASP | E | 254 | 14.951 | 94.848 | −20.611 | 1.00 | 41.14 | B000 N |
| ATOM | 7389 | CA | ASP | E | 254 | 15.056 | 94.754 | −19.159 | 1.00 | 36.67 | B000 C |
| ATOM | 7390 | C | ASP | E | 254 | 14.148 | 95.742 | −18.448 | 1.00 | 37.02 | B000 C |
| ATOM | 7391 | O | ASP | E | 254 | 13.733 | 96.776 | −18.990 | 1.00 | 37.00 | B000 O |
| ATOM | 7392 | CB | ASP | E | 254 | 16.497 | 94.967 | −18.685 | 1.00 | 34.36 | B000 C |
| ATOM | 7393 | CG | ASP | E | 254 | 17.333 | 93.693 | −18.779 | 1.00 | 37.96 | B000 C |
| ATOM | 7394 | OD1 | ASP | E | 254 | 16.776 | 92.662 | −19.226 | 1.00 | 36.64 | B000 O |
| ATOM | 7395 | OD2 | ASP | E | 254 | 18.547 | 93.740 | −18.453 | 1.00 | 41.46 | B000 O1− |
| ATOM | 7396 | N | CYS | E | 255 | 13.822 | 95.368 | −17.219 | 1.00 | 35.51 | B000 N |
| ATOM | 7397 | CA | CYS | E | 255 | 13.086 | 96.210 | −16.300 | 1.00 | 32.38 | B000 C |
| ATOM | 7398 | C | CYS | E | 255 | 13.781 | 96.107 | −14.955 | 1.00 | 37.45 | B000 C |
| ATOM | 7399 | O | CYS | E | 255 | 14.493 | 95.137 | −14.689 | 1.00 | 34.78 | B000 O |
| ATOM | 7400 | CB | CYS | E | 255 | 11.612 | 95.789 | −16.219 | 1.00 | 34.76 | B000 C |
| ATOM | 7401 | SG | CYS | E | 255 | 10.671 | 96.035 | −17.761 | 1.00 | 37.35 | B000 S |
| ATOM | 7402 | N | ALA | E | 256 | 13.609 | 97.138 | −14.123 | 1.00 | 31.93 | B000 N |
| ATOM | 7403 | CA | ALA | E | 256 | 14.263 | 97.192 | −12.823 | 1.00 | 34.86 | B000 C |
| ATOM | 7404 | C | ALA | E | 256 | 13.329 | 96.663 | −11.744 | 1.00 | 35.59 | B000 C |
| ATOM | 7405 | O | ALA | E | 256 | 12.138 | 96.994 | −11.720 | 1.00 | 30.92 | B000 O |
| ATOM | 7406 | CB | ALA | E | 256 | 14.688 | 98.621 | −12.480 | 1.00 | 33.92 | B000 C |
| ATOM | 7407 | N | HIS | E | 257 | 13.870 | 95.833 | −10.854 | 1.00 | 28.95 | B000 N |
| ATOM | 7408 | CA | HIS | E | 257 | 13.097 | 95.348 | −9.721 | 1.00 | 35.16 | B000 C |
| ATOM | 7409 | C | HIS | E | 257 | 13.897 | 95.485 | −8.434 | 1.00 | 35.13 | B000 C |
| ATOM | 7410 | O | HIS | E | 257 | 15.130 | 95.402 | −8.425 | 1.00 | 34.18 | B000 O |
| ATOM | 7411 | CB | HIS | E | 257 | 12.655 | 93.884 | −9.909 | 1.00 | 30.40 | B000 C |
| ATOM | 7412 | CG | HIS | E | 257 | 13.789 | 92.909 | −10.005 | 1.00 | 36.00 | B000 C |
| ATOM | 7413 | ND1 | HIS | E | 257 | 14.213 | 92.160 | −8.930 | 1.00 | 36.61 | B000 N |
| ATOM | 7414 | CD2 | HIS | E | 257 | 14.576 | 92.547 | −11.050 | 1.00 | 29.26 | B000 C |
| ATOM | 7415 | CE1 | HIS | E | 257 | 15.205 | 91.373 | −9.306 | 1.00 | 36.08 | B000 C |
| ATOM | 7416 | NE2 | HIS | E | 257 | 15.444 | 91.589 | −10.588 | 1.00 | 41.23 | B000 N |
| ATOM | 7417 | N | PHE | E | 258 | 13.178 | 95.722 | −7.344 | 1.00 | 32.98 | B000 N |
| ATOM | 7418 | CA | PHE | E | 258 | 13.783 | 95.567 | −6.036 | 1.00 | 35.47 | B000 C |
| ATOM | 7419 | C | PHE | E | 258 | 14.126 | 94.102 | −5.825 | 1.00 | 36.56 | B000 C |
| ATOM | 7420 | O | PHE | E | 258 | 13.342 | 93.217 | −6.182 | 1.00 | 37.64 | B000 O |
| ATOM | 7421 | CB | PHE | E | 258 | 12.828 | 96.024 | −4.943 | 1.00 | 34.07 | B000 C |
| ATOM | 7422 | CG | PHE | E | 258 | 12.279 | 97.408 | −5.140 | 1.00 | 36.26 | B000 C |
| ATOM | 7423 | CD1 | PHE | E | 258 | 12.991 | 98.528 | −4.707 | 1.00 | 31.80 | B000 C |
| ATOM | 7424 | CD2 | PHE | E | 258 | 11.025 | 97.588 | −5.714 | 1.00 | 31.31 | B000 C |
| ATOM | 7425 | CE1 | PHE | E | 258 | 12.469 | 99.798 | −4.865 | 1.00 | 33.16 | B000 C |
| ATOM | 7426 | CE2 | PHE | E | 258 | 10.492 | 98.861 | −5.882 | 1.00 | 39.41 | B000 C |
| ATOM | 7427 | CZ | PHE | E | 258 | 11.208 | 99.972 | −5.462 | 1.00 | 34.38 | B000 C |
| ATOM | 7428 | N | THR | E | 259 | 15.302 | 93.853 | −5.249 | 1.00 | 37.86 | B000 N |
| ATOM | 7429 | CA | THR | E | 259 | 15.716 | 92.540 | −4.772 | 1.00 | 42.13 | B000 C |

TABLE 10.3-continued

| | | | | | | | | | | | |
|---|---|---|---|---|---|---|---|---|---|---|---|
| ATOM | 7430 | C | THR | E | 259 | 15.405 | 92.419 | −3.289 | 1.00 | 44.25 | B000 C |
| ATOM | 7431 | O | THR | E | 259 | 14.879 | 93.339 | −2.660 | 1.00 | 47.92 | B000 O |
| ATOM | 7432 | CB | THR | E | 259 | 17.209 | 92.303 | −4.996 | 1.00 | 42.54 | B000 C |
| ATOM | 7433 | OG1 | THR | E | 259 | 17.953 | 93.161 | −4.117 | 1.00 | 44.35 | B000 O |
| ATOM | 7434 | CG2 | THR | E | 259 | 17.579 | 92.593 | −6.433 | 1.00 | 39.50 | B000 C |
| ATOM | 7435 | N | ASP | E | 260 | 15.785 | 91.280 | −2.712 | 1.00 | 46.15 | B000 N |
| ATOM | 7436 | CA | ASP | E | 260 | 15.408 | 91.003 | −1.334 | 1.00 | 48.77 | B000 C |
| ATOM | 7437 | C | ASP | E | 260 | 16.141 | 91.866 | −0.318 | 1.00 | 51.79 | B000 C |
| ATOM | 7438 | O | ASP | E | 260 | 15.772 | 91.841 | 0.862 | 1.00 | 57.39 | B000 O |
| ATOM | 7439 | CB | ASP | E | 260 | 15.627 | 89.530 | −1.002 | 1.00 | 48.59 | B000 C |
| ATOM | 7440 | CG | ASP | E | 260 | 17.039 | 89.064 | −1.282 | 1.00 | 52.19 | B000 C |
| ATOM | 7441 | OD1 | ASP | E | 260 | 17.934 | 89.890 | −1.563 | 1.00 | 54.71 | B000 O |
| ATOM | 7442 | OD2 | ASP | E | 260 | 17.255 | 87.847 | −1.199 | 1.00 | 57.65 | B000 O1− |
| ATOM | 7443 | N | ASP | E | 261 | 17.175 | 92.602 | −0.719 | 1.00 | 46.10 | B000 N |
| ATOM | 7444 | CA | ASP | E | 261 | 17.795 | 93.567 | 0.177 | 1.00 | 47.68 | B000 C |
| ATOM | 7445 | C | ASP | E | 261 | 17.411 | 95.007 | −0.158 | 1.00 | 43.64 | B000 C |
| ATOM | 7446 | O | ASP | E | 261 | 17.959 | 95.938 | 0.434 | 1.00 | 50.15 | B000 O |
| ATOM | 7447 | CB | ASP | E | 261 | 19.322 | 93.386 | 0.195 | 1.00 | 43.46 | B000 C |
| ATOM | 7448 | CG | ASP | E | 261 | 20.013 | 93.851 | −1.092 | 1.00 | 51.38 | B000 C |
| ATOM | 7449 | OD1 | ASP | E | 261 | 19.414 | 94.549 | −1.938 | 1.00 | 53.10 | B000 O |
| ATOM | 7450 | OD2 | ASP | E | 261 | 21.201 | 93.523 | −1.249 | 1.00 | 61.28 | B000 O1− |
| ATOM | 7451 | N | GLY | E | 262 | 16.490 | 95.208 | −1.098 | 1.00 | 41.82 | B000 N |
| ATOM | 7452 | CA | GLY | E | 262 | 16.009 | 96.524 | −1.460 | 1.00 | 37.30 | B000 C |
| ATOM | 7453 | C | GLY | E | 262 | 16.761 | 97.180 | −2.597 | 1.00 | 36.57 | B000 C |
| ATOM | 7454 | O | GLY | E | 262 | 16.212 | 98.052 | −3.272 | 1.00 | 41.75 | B000 O |
| ATOM | 7455 | N | ARG | E | 263 | 18.012 | 96.804 | −2.802 | 1.00 | 38.36 | B000 N |
| ATOM | 7456 | CA | ARG | E | 263 | 18.764 | 97.311 | −3.928 | 1.00 | 41.20 | B000 C |
| ATOM | 7457 | C | ARG | E | 263 | 18.224 | 96.727 | −5.227 | 1.00 | 45.69 | B000 C |
| ATOM | 7458 | O | ARG | E | 263 | 17.553 | 95.687 | −5.250 | 1.00 | 42.28 | B000 O |
| ATOM | 7459 | CB | ARG | E | 263 | 20.242 | 96.991 | −3.749 | 1.00 | 41.55 | B000 C |
| ATOM | 7460 | CG | ARG | E | 263 | 20.841 | 97.820 | −2.615 | 1.00 | 42.80 | B000 C |
| ATOM | 7461 | CD | ARG | E | 263 | 22.274 | 97.464 | −2.375 | 1.00 | 42.94 | B000 C |
| ATOM | 7462 | NE | ARG | E | 263 | 22.431 | 96.060 | −2.029 | 1.00 | 50.20 | B000 N |
| ATOM | 7463 | CZ | ARG | E | 263 | 23.609 | 95.464 | −1.881 | 1.00 | 58.64 | B000 C |
| ATOM | 7464 | NH1 | ARG | E | 263 | 24.728 | 96.164 | −2.057 | 1.00 | 53.73 | B000 N1+ |
| ATOM | 7465 | NH2 | ARG | E | 263 | 23.670 | 94.172 | −1.573 | 1.00 | 56.41 | B000 N |
| ATOM | 7466 | N | TRP | E | 264 | 18.506 | 97.428 | −6.314 | 1.00 | 43.23 | B000 N |
| ATOM | 7467 | CA | TRP | E | 264 | 17.854 | 97.186 | −7.588 | 1.00 | 42.16 | B000 C |
| ATOM | 7468 | C | TRP | E | 264 | 18.687 | 96.288 | −8.491 | 1.00 | 43.43 | B000 C |
| ATOM | 7469 | O | TRP | E | 264 | 19.921 | 96.322 | −8.465 | 1.00 | 41.15 | B000 O |
| ATOM | 7470 | CB | TRP | E | 264 | 17.595 | 98.493 | −8.322 | 1.00 | 37.69 | B000 C |
| ATOM | 7471 | CG | TRP | E | 264 | 16.910 | 99.526 | −7.547 | 1.00 | 42.39 | B000 C |
| ATOM | 7472 | CD1 | TRP | E | 264 | 16.342 | 99.410 | −6.306 | 1.00 | 42.33 | B000 C |
| ATOM | 7473 | CD2 | TRP | E | 264 | 16.714 | 100.874 | −7.958 | 1.00 | 41.30 | B000 C |
| ATOM | 7474 | NE1 | TRP | E | 264 | 15.797 | 100.613 | −5.924 | 1.00 | 37.50 | B000 N |
| ATOM | 7475 | CE2 | TRP | E | 264 | 16.011 | 101.530 | −6.921 | 1.00 | 43.31 | B000 C |
| ATOM | 7476 | CE3 | TRP | E | 264 | 17.068 | 101.595 | −9.104 | 1.00 | 38.49 | B000 C |
| ATOM | 7477 | CZ2 | TRP | E | 264 | 15.649 | 102.882 | −6.999 | 1.00 | 46.31 | B000 C |
| ATOM | 7478 | CZ3 | TRP | E | 264 | 16.716 | 102.938 | −9.179 | 1.00 | 44.68 | B000 C |
| ATOM | 7479 | CH2 | TRP | E | 264 | 16.005 | 103.564 | −8.135 | 1.00 | 47.08 | B000 C |
| ATOM | 7480 | N | ASN | E | 265 | 17.986 | 95.533 | −9.339 | 1.00 | 40.37 | B000 N |
| ATOM | 7481 | CA | ASN | E | 265 | 18.601 | 94.718 | −10.374 | 1.00 | 38.67 | B000 C |
| ATOM | 7482 | C | ASN | E | 265 | 17.770 | 94.816 | −11.652 | 1.00 | 35.88 | B000 C |
| ATOM | 7483 | O | ASN | E | 265 | 16.561 | 95.055 | −11.608 | 1.00 | 33.72 | B000 O |
| ATOM | 7484 | CB | ASN | E | 265 | 18.731 | 93.267 | −9.899 | 1.00 | 40.88 | B000 C |
| ATOM | 7485 | CG | ASN | E | 265 | 19.363 | 92.369 | −10.940 | 1.00 | 49.30 | B000 C |
| ATOM | 7486 | OD1 | ASN | E | 265 | 20.484 | 92.622 | −11.373 | 1.00 | 46.08 | B000 O |
| ATOM | 7487 | ND2 | ASN | E | 265 | 18.667 | 91.288 | −11.315 | 1.00 | 49.35 | B000 N |
| ATOM | 7488 | N | ASP | E | 266 | 18.431 | 94.646 | −12.795 | 1.00 | 37.44 | B000 N |
| ATOM | 7489 | CA | ASP | E | 266 | 17.769 | 94.648 | −14.092 | 1.00 | 34.38 | B000 C |
| ATOM | 7490 | C | ASP | E | 266 | 17.585 | 93.211 | −14.559 | 1.00 | 35.40 | B000 C |
| ATOM | 7491 | O | ASP | E | 266 | 18.516 | 92.408 | −14.481 | 1.00 | 38.07 | B000 O |
| ATOM | 7492 | CB | ASP | E | 266 | 18.549 | 95.463 | −15.137 | 1.00 | 34.61 | B000 C |
| ATOM | 7493 | CG | ASP | E | 266 | 20.046 | 95.092 | −15.230 | 1.00 | 42.09 | B000 C |
| ATOM | 7494 | OD1 | ASP | E | 266 | 20.690 | 94.762 | −14.202 | 1.00 | 40.07 | B000 O |
| ATOM | 7495 | OD2 | ASP | E | 266 | 20.593 | 95.167 | −16.358 | 1.00 | 40.68 | B000 O1− |
| ATOM | 7496 | N | ASP | E | 267 | 16.372 | 92.880 | −15.001 | 1.00 | 37.34 | B000 N |
| ATOM | 7497 | CA | ASP | E | 267 | 16.034 | 91.524 | −15.412 | 1.00 | 36.69 | B000 C |
| ATOM | 7498 | C | ASP | E | 267 | 15.052 | 91.576 | −16.581 | 1.00 | 35.84 | B000 C |
| ATOM | 7499 | O | ASP | E | 267 | 14.431 | 92.609 | −16.843 | 1.00 | 37.16 | B000 O |
| ATOM | 7500 | CB | ASP | E | 267 | 15.448 | 90.748 | −14.230 | 1.00 | 33.55 | B000 C |
| ATOM | 7501 | CG | ASP | E | 267 | 15.724 | 89.244 | −14.319 | 1.00 | 44.66 | B000 C |
| ATOM | 7502 | OD1 | ASP | E | 267 | 16.128 | 88.792 | −15.410 | 1.00 | 43.90 | B000 O |
| ATOM | 7503 | OD2 | ASP | E | 267 | 15.535 | 88.518 | −13.301 | 1.00 | 45.36 | B000 O1− |
| ATOM | 7504 | N | VAL | E | 268 | 14.901 | 90.455 | −17.294 | 1.00 | 32.21 | B000 N |
| ATOM | 7505 | CA | VAL | E | 268 | 13.973 | 90.457 | −18.423 | 1.00 | 34.18 | B000 C |
| ATOM | 7506 | C | VAL | E | 268 | 12.553 | 90.719 | −17.928 | 1.00 | 37.30 | B000 C |
| ATOM | 7507 | O | VAL | E | 268 | 12.123 | 90.211 | −16.883 | 1.00 | 38.04 | B000 O |
| ATOM | 7508 | CB | VAL | E | 268 | 14.050 | 89.154 | −19.239 | 1.00 | 37.36 | B000 C |
| ATOM | 7509 | CG1 | VAL | E | 268 | 15.409 | 89.057 | −19.938 | 1.00 | 36.15 | B000 C |

TABLE 10.3-continued

| | | | | | | | | | | |
|---|---|---|---|---|---|---|---|---|---|---|
| ATOM | 7510 | CG2 | VAL | E | 268 | 13.806 | 87.936 | −18.370 | 1.00 | 35.18 | B000 | C |
| ATOM | 7511 | N | CYS | E | 269 | 11.809 | 91.513 | −18.697 | 1.00 | 36.57 | B000 | N |
| ATOM | 7512 | CA | CYS | E | 269 | 10.538 | 92.045 | −18.240 | 1.00 | 36.70 | B000 | C |
| ATOM | 7513 | C | CYS | E | 269 | 9.449 | 90.995 | −18.103 | 1.00 | 34.59 | B000 | C |
| ATOM | 7514 | O | CYS | E | 269 | 8.418 | 91.294 | −17.500 | 1.00 | 35.91 | B000 | O |
| ATOM | 7515 | CB | CYS | E | 269 | 10.088 | 93.163 | −19.185 | 1.00 | 42.38 | B000 | C |
| ATOM | 7516 | SG | CYS | E | 269 | 11.267 | 94.591 | −19.164 | 1.00 | 53.92 | B000 | S |
| ATOM | 7517 | N | GLN | E | 270 | 9.643 | 89.777 | −18.595 | 1.00 | 33.91 | B000 | N |
| ATOM | 7518 | CA | GLN | E | 270 | 8.591 | 88.778 | −18.422 | 1.00 | 38.11 | B000 | C |
| ATOM | 7519 | C | GLN | E | 270 | 8.652 | 88.057 | −17.086 | 1.00 | 33.78 | B000 | C |
| ATOM | 7520 | O | GLN | E | 270 | 7.760 | 87.247 | −16.828 | 1.00 | 33.42 | B000 | O |
| ATOM | 7521 | CB | GLN | E | 270 | 8.578 | 87.723 | −19.549 | 1.00 | 38.43 | B000 | C |
| ATOM | 7522 | CG | GLN | E | 270 | 9.815 | 87.602 | −20.390 | 1.00 | 44.86 | B000 | C |
| ATOM | 7523 | CD | GLN | E | 270 | 10.038 | 88.821 | −21.260 | 1.00 | 52.91 | B000 | C |
| ATOM | 7524 | OE1 | GLN | E | 270 | 11.140 | 89.358 | −21.293 | 1.00 | 55.48 | B000 | O |
| ATOM | 7525 | NE2 | GLN | E | 270 | 8.986 | 89.280 | −21.949 | 1.00 | 51.33 | B000 | N |
| ATOM | 7526 | N | ARG | E | 271 | 9.649 | 88.338 | −16.229 | 1.00 | 31.87 | B000 | N |
| ATOM | 7527 | CA | ARG | E | 271 | 9.677 | 87.758 | −14.889 | 1.00 | 29.54 | B000 | C |
| ATOM | 7528 | C | ARG | E | 271 | 8.356 | 88.049 | −14.171 | 1.00 | 36.60 | B000 | C |
| ATOM | 7529 | O | ARG | E | 271 | 7.873 | 89.192 | −14.210 | 1.00 | 35.38 | B000 | O |
| ATOM | 7530 | CB | ARG | E | 271 | 10.829 | 88.325 | −14.050 | 1.00 | 28.67 | B000 | C |
| ATOM | 7531 | CG | ARG | E | 271 | 12.220 | 87.973 | −14.479 | 1.00 | 27.89 | B000 | C |
| ATOM | 7532 | CD | ARG | E | 271 | 12.418 | 86.476 | −14.518 | 1.00 | 31.48 | B000 | C |
| ATOM | 7533 | NE | ARG | E | 271 | 13.822 | 86.098 | −14.676 | 1.00 | 33.37 | B000 | N |
| ATOM | 7534 | CZ | ARG | E | 271 | 14.203 | 84.864 | −14.987 | 1.00 | 37.02 | B000 | C |
| ATOM | 7535 | NH1 | ARG | E | 271 | 13.268 | 83.937 | −15.180 | 1.00 | 30.74 | B000 | N1+ |
| ATOM | 7536 | NH2 | ARG | E | 271 | 15.492 | 84.540 | −15.076 | 1.00 | 29.23 | B000 | N |
| ATOM | 7537 | N | PRO | E | 272 | 7.778 | 87.122 | −13.565 | 1.00 | 34.45 | B000 | N |
| ATOM | 7538 | CA | PRO | E | 272 | 6.493 | 87.373 | −12.870 | 1.00 | 35.22 | B000 | C |
| ATOM | 7539 | C | PRO | E | 272 | 6.670 | 87.925 | −11.455 | 1.00 | 35.16 | B000 | C |
| ATOM | 7540 | O | PRO | E | 272 | 6.234 | 87.321 | −10.470 | 1.00 | 31.89 | B000 | O |
| ATOM | 7541 | CB | PRO | E | 272 | 5.847 | 85.979 | −12.867 | 1.00 | 31.77 | B000 | C |
| ATOM | 7542 | CG | PRO | E | 272 | 7.003 | 85.036 | −12.787 | 1.00 | 32.91 | B000 | C |
| ATOM | 7543 | CD | PRO | E | 272 | 8.114 | 85.689 | −13.621 | 1.00 | 30.82 | B000 | C |
| ATOM | 7544 | N | TYR | E | 273 | 7.295 | 89.101 | −11.344 | 1.00 | 31.62 | B000 | N |
| ATOM | 7545 | CA | TYR | E | 273 | 7.555 | 89.672 | −10.028 | 1.00 | 32.44 | B000 | C |
| ATOM | 7546 | C | TYR | E | 273 | 6.327 | 90.398 | −9.474 | 1.00 | 33.52 | B000 | C |
| ATOM | 7547 | O | TYR | E | 273 | 5.355 | 90.667 | −10.183 | 1.00 | 33.94 | B000 | O |
| ATOM | 7548 | CB | TYR | E | 273 | 8.752 | 90.615 | −10.089 | 1.00 | 32.72 | B000 | C |
| ATOM | 7549 | CG | TYR | E | 273 | 10.050 | 89.893 | −10.371 | 1.00 | 34.81 | B000 | C |
| ATOM | 7550 | CD1 | TYR | E | 273 | 10.215 | 88.558 | −10.004 | 1.00 | 30.34 | B000 | C |
| ATOM | 7551 | CD2 | TYR | E | 273 | 11.125 | 90.546 | −10.996 | 1.00 | 34.47 | B000 | C |
| ATOM | 7552 | CE1 | TYR | E | 273 | 11.428 | 87.883 | −10.249 | 1.00 | 31.47 | B000 | C |
| ATOM | 7553 | CE2 | TYR | E | 273 | 12.329 | 89.879 | −11.245 | 1.00 | 31.66 | B000 | C |
| ATOM | 7554 | CZ | TYR | E | 273 | 12.468 | 88.549 | −10.867 | 1.00 | 32.58 | B000 | C |
| ATOM | 7555 | OH | TYR | E | 273 | 13.639 | 87.883 | −11.117 | 1.00 | 37.35 | B000 | O |
| ATOM | 7556 | N | ARG | E | 274 | 6.356 | 90.671 | −8.170 | 1.00 | 34.37 | B000 | N |
| ATOM | 7557 | CA | ARG | E | 274 | 5.350 | 91.549 | −7.579 | 1.00 | 32.60 | B000 | C |
| ATOM | 7558 | C | ARG | E | 274 | 5.542 | 92.978 | −8.089 | 1.00 | 35.51 | B000 | C |
| ATOM | 7559 | O | ARG | E | 274 | 6.533 | 93.300 | −8.757 | 1.00 | 31.65 | B000 | O |
| ATOM | 7560 | CB | ARG | E | 274 | 5.426 | 91.519 | −6.048 | 1.00 | 31.74 | B000 | C |
| ATOM | 7561 | CG | ARG | E | 274 | 5.044 | 90.177 | −5.455 | 1.00 | 35.22 | B000 | C |
| ATOM | 7562 | CD | ARG | E | 274 | 4.922 | 90.200 | −3.952 | 1.00 | 36.81 | B000 | C |
| ATOM | 7563 | NE | ARG | E | 274 | 4.320 | 88.966 | −3.474 | 1.00 | 36.66 | B000 | N |
| ATOM | 7564 | CZ | ARG | E | 274 | 4.010 | 88.714 | −2.206 | 1.00 | 38.82 | B000 | C |
| ATOM | 7565 | NH1 | ARG | E | 274 | 4.266 | 89.605 | −1.260 | 1.00 | 40.20 | B000 | N1+ |
| ATOM | 7566 | NH2 | ARG | E | 274 | 3.432 | 87.563 | −1.886 | 1.00 | 37.93 | B000 | N |
| ATOM | 7567 | N | TRP | E | 275 | 4.591 | 93.857 | −7.757 | 1.00 | 34.71 | B000 | N |
| ATOM | 7568 | CA | TRP | E | 275 | 4.709 | 95.242 | −8.207 | 1.00 | 35.25 | B000 | C |
| ATOM | 7569 | C | TRP | E | 275 | 4.038 | 96.177 | −7.209 | 1.00 | 33.77 | B000 | C |
| ATOM | 7570 | O | TRP | E | 275 | 3.288 | 95.762 | −6.316 | 1.00 | 34.64 | B000 | O |
| ATOM | 7571 | CB | TRP | E | 275 | 4.133 | 95.429 | −9.622 | 1.00 | 29.33 | B000 | C |
| ATOM | 7572 | CG | TRP | E | 275 | 2.633 | 95.433 | −9.666 | 1.00 | 41.26 | B000 | C |
| ATOM | 7573 | CD1 | TRP | E | 275 | 1.824 | 96.531 | −9.687 | 1.00 | 32.79 | B000 | C |
| ATOM | 7574 | CD2 | TRP | E | 275 | 1.762 | 94.290 | −9.659 | 1.00 | 35.30 | B000 | C |
| ATOM | 7575 | NE1 | TRP | E | 275 | 0.516 | 96.147 | −9.707 | 1.00 | 34.43 | B000 | N |
| ATOM | 7576 | CE2 | TRP | E | 275 | 0.441 | 94.779 | −9.687 | 1.00 | 41.97 | B000 | C |
| ATOM | 7577 | CE3 | TRP | E | 275 | 1.971 | 92.908 | −9.650 | 1.00 | 34.18 | B000 | C |
| ATOM | 7578 | CZ2 | TRP | E | 275 | −0.681 | 93.928 | −9.698 | 1.00 | 39.53 | B000 | C |
| ATOM | 7579 | CZ3 | TRP | E | 275 | 0.861 | 92.059 | −9.654 | 1.00 | 40.96 | B000 | C |
| ATOM | 7580 | CH2 | TRP | E | 275 | −0.445 | 92.574 | −9.680 | 1.00 | 40.67 | B000 | C |
| ATOM | 7581 | N | VAL | E | 276 | 4.345 | 97.453 | −7.367 | 1.00 | 32.75 | B000 | N |
| ATOM | 7582 | CA | VAL | E | 276 | 3.827 | 98.520 | −6.528 | 1.00 | 36.54 | B000 | C |
| ATOM | 7583 | C | VAL | E | 276 | 3.248 | 99.578 | −7.451 | 1.00 | 43.35 | B000 | C |
| ATOM | 7584 | O | VAL | E | 276 | 3.916 | 99.998 | −8.404 | 1.00 | 39.24 | B000 | O |
| ATOM | 7585 | CB | VAL | E | 276 | 4.932 | 99.125 | −5.636 | 1.00 | 39.71 | B000 | C |
| ATOM | 7586 | CG1 | VAL | E | 276 | 4.364 | 100.226 | −4.708 | 1.00 | 36.15 | B000 | C |
| ATOM | 7587 | CG2 | VAL | E | 276 | 5.626 | 98.033 | −4.830 | 1.00 | 33.07 | B000 | C |
| ATOM | 7588 | N | CYS | E | 277 | 2.015 | 100.004 | −7.176 | 1.00 | 41.27 | B000 | N |
| ATOM | 7589 | CA | CYS | E | 277 | 1.403 | 101.127 | −7.878 | 1.00 | 39.77 | B000 | C |

TABLE 10.3-continued

| | | | | | | | | | | |
|---|---|---|---|---|---|---|---|---|---|---|
| ATOM | 7590 | C | CYS | E | 277 | 1.513 | 102.387 | −7.022 | 1.00 | 46.66 B000 C |
| ATOM | 7591 | O | CYS | E | 277 | 1.519 | 102.321 | −5.786 | 1.00 | 41.72 B000 O |
| ATOM | 7592 | CB | CYS | E | 277 | −0.063 | 100.847 | −8.209 | 1.00 | 41.42 B000 C |
| ATOM | 7593 | SG | CYS | E | 277 | −0.364 | 99.509 | −9.393 | 1.00 | 51.15 B000 S |
| ATOM | 7594 | N | GLU | E | 278 | 1.622 | 103.536 | −7.698 | 1.00 | 43.54 B000 N |
| ATOM | 7595 | CA | GLU | E | 278 | 1.776 | 104.841 | −7.069 | 1.00 | 38.79 B000 C |
| ATOM | 7596 | C | GLU | E | 278 | 0.862 | 105.858 | −7.751 | 1.00 | 45.95 B000 C |
| ATOM | 7597 | O | GLU | E | 278 | 0.782 | 105.914 | −8.988 | 1.00 | 39.44 B000 O |
| ATOM | 7598 | CB | GLU | E | 278 | 3.243 | 105.302 | −7.137 | 1.00 | 47.37 B000 C |
| ATOM | 7599 | CG | GLU | E | 278 | 3.523 | 106.665 | −6.506 | 1.00 | 54.07 B000 C |
| ATOM | 7600 | CD | GLU | E | 278 | 4.983 | 107.122 | −6.640 | 1.00 | 55.74 B000 C |
| ATOM | 7601 | OE1 | GLU | E | 278 | 5.813 | 106.384 | −7.214 | 1.00 | 49.09 B000 O |
| ATOM | 7602 | OE2 | GLU | E | 278 | 5.299 | 108.234 | −6.158 | 1.00 | 63.05 B000 O1− |
| ATOM | 7603 | N | THR | E | 279 | 0.194 | 106.677 | −6.933 | 1.00 | 44.07 B000 N |
| ATOM | 7604 | CA | THR | E | 279 | −0.653 | 107.764 | −7.416 | 1.00 | 49.75 B000 C |
| ATOM | 7605 | C | THR | E | 279 | −0.567 | 108.944 | −6.440 | 1.00 | 52.93 B000 C |
| ATOM | 7606 | O | THR | E | 279 | 0.043 | 108.854 | −5.367 | 1.00 | 51.44 B000 O |
| ATOM | 7607 | CB | THR | E | 279 | −2.103 | 107.288 | −7.604 | 1.00 | 51.62 B000 C |
| ATOM | 7608 | OG1 | THR | E | 279 | −2.814 | 108.206 | −8.438 | 1.00 | 58.36 B000 O |
| ATOM | 7609 | CG2 | THR | E | 279 | −2.815 | 107.204 | −6.271 | 1.00 | 48.77 B000 C |
| ATOM | 7610 | N | GLU | E | 280 | −1.195 | 110.058 | −6.818 | 1.00 | 57.24 B000 N |
| ATOM | 7611 | CA | GLU | E | 280 | −1.083 | 111.317 | −6.090 | 1.00 | 59.43 B000 C |
| ATOM | 7612 | C | GLU | E | 280 | −2.071 | 111.410 | −4.922 | 1.00 | 60.25 B000 C |
| ATOM | 7613 | O | GLU | E | 280 | −2.950 | 110.567 | −4.738 | 1.00 | 57.16 B000 O |
| ATOM | 7614 | CB | GLU | E | 280 | −1.329 | 112.479 | −7.040 | 1.00 | 72.93 B000 C |
| ATOM | 7615 | CG | GLU | E | 280 | −1.062 | 112.139 | −8.487 | 1.00 | 81.08 B000 C |
| ATOM | 7616 | CD | GLU | E | 280 | −0.073 | 113.097 | −9.119 | 1.00 | 105.55 B000 C |
| ATOM | 7617 | OE1 | GLU | E | 280 | −0.010 | 114.263 | −8.665 | 1.00 | 104.59 B000 O |
| ATOM | 7618 | OE2 | GLU | E | 280 | 0.648 | 112.680 | −10.055 | 1.00 | 113.25 B000 O1− |
| ATOM | 7619 | N | LEU | E | 281 | −1.917 | 112.479 | −4.135 | 1.00 | 77.88 B000 N |
| ATOM | 7620 | CA | LEU | E | 281 | −2.807 | 112.826 | −3.011 | 1.00 | 70.25 B000 C |
| ATOM | 7621 | C | LEU | E | 281 | −2.681 | 111.825 | −1.876 | 1.00 | 67.47 B000 C |
| ATOM | 7622 | O | LEU | E | 281 | −2.139 | 112.153 | −0.819 | 1.00 | 68.88 B000 O |
| ATOM | 7623 | CB | LEU | E | 281 | −4.279 | 112.937 | −3.459 | 1.00 | 61.71 B000 C |
| ATOM | 7624 | CG | LEU | E | 281 | −4.707 | 114.296 | −4.035 | 1.00 | 80.45 B000 C |
| ATOM | 7625 | CD1 | LEU | E | 281 | −5.181 | 114.179 | −5.490 | 1.00 | 71.81 B000 C |
| ATOM | 7626 | CD2 | LEU | E | 281 | −5.774 | 114.969 | −3.143 | 1.00 | 70.21 B000 C |
| TER | | | | | | | | | | |
| ATOM | 7627 | O | THR | F | 152 | −18.909 | 43.540 | −2.518 | 1.00 | 85.67 B000 O |
| ATOM | 7628 | N | THR | F | 152 | −17.763 | 41.399 | −0.880 | 1.00 | 85.67 B000 N |
| ATOM | 7629 | CA | THR | F | 152 | −16.968 | 42.333 | −1.678 | 1.00 | 88.53 B000 C |
| ATOM | 7630 | C | THR | F | 152 | −17.777 | 43.608 | −2.017 | 1.00 | 91.37 B000 C |
| ATOM | 7631 | CB | THR | F | 152 | −16.431 | 41.637 | −2.979 | 1.00 | 92.20 B000 C |
| ATOM | 7632 | OG1 | THR | F | 152 | −15.806 | 42.597 | −3.844 | 1.00 | 90.90 B000 O |
| ATOM | 7633 | CG2 | THR | F | 152 | −17.541 | 40.894 | −3.731 | 1.00 | 84.33 B000 C |
| ATOM | 7634 | N | CYS | F | 153 | −17.202 | 44.774 | −1.715 | 1.00 | 87.63 B000 N |
| ATOM | 7635 | CA | CYS | F | 153 | −17.870 | 46.050 | −1.926 | 1.00 | 82.80 B000 C |
| ATOM | 7636 | C | CYS | F | 153 | −17.103 | 46.899 | −2.940 | 1.00 | 77.69 B000 C |
| ATOM | 7637 | O | CYS | F | 153 | −15.918 | 46.673 | −3.212 | 1.00 | 67.09 B000 O |
| ATOM | 7638 | CB | CYS | F | 153 | −18.029 | 46.817 | −0.596 | 1.00 | 79.27 B000 C |
| ATOM | 7639 | SG | CYS | F | 153 | −19.643 | 46.575 | 0.239 | 1.00 | 104.11 B000 S |
| ATOM | 7640 | N | CYS | F | 154 | −17.803 | 47.886 | −3.508 | 1.00 | 76.91 B000 N |
| ATOM | 7641 | CA | CYS | F | 154 | −17.185 | 48.793 | −4.462 | 1.00 | 59.34 B000 C |
| ATOM | 7642 | C | CYS | F | 154 | −16.202 | 49.711 | −3.745 | 1.00 | 54.16 B000 C |
| ATOM | 7643 | O | CYS | F | 154 | −16.398 | 50.041 | −2.575 | 1.00 | 63.36 B000 O |
| ATOM | 7644 | CB | CYS | F | 154 | −18.244 | 49.634 | −5.172 | 1.00 | 55.19 B000 C |
| ATOM | 7645 | SG | CYS | F | 154 | −19.186 | 48.756 | −6.443 | 1.00 | 69.85 B000 S |
| ATOM | 7646 | N | PRO | F | 155 | −15.156 | 50.163 | −4.429 | 1.00 | 53.28 B000 N |
| ATOM | 7647 | CA | PRO | F | 155 | −14.236 | 51.130 | −3.812 | 1.00 | 56.60 B000 C |
| ATOM | 7648 | C | PRO | F | 155 | −14.973 | 52.379 | −3.346 | 1.00 | 57.95 B000 C |
| ATOM | 7649 | O | PRO | F | 155 | −16.130 | 52.640 | −3.696 | 1.00 | 55.60 B000 O |
| ATOM | 7650 | CB | PRO | F | 155 | −13.243 | 51.459 | −4.932 | 1.00 | 48.00 B000 C |
| ATOM | 7651 | CG | PRO | F | 155 | −13.374 | 50.336 | −5.913 | 1.00 | 55.49 B000 C |
| ATOM | 7652 | CD | PRO | F | 155 | −14.777 | 49.826 | −5.811 | 1.00 | 51.46 B000 C |
| ATOM | 7653 | N | VAL | F | 156 | −14.268 | 53.174 | −2.539 | 1.00 | 56.46 B000 N |
| ATOM | 7654 | CA | VAL | F | 156 | −14.855 | 54.394 | −1.991 | 1.00 | 63.80 B000 C |
| ATOM | 7655 | C | VAL | F | 156 | −15.250 | 55.333 | −3.126 | 1.00 | 59.48 B000 C |
| ATOM | 7656 | O | VAL | F | 156 | −14.488 | 55.538 | −4.081 | 1.00 | 58.09 B000 O |
| ATOM | 7657 | CB | VAL | F | 156 | −13.873 | 55.058 | −1.014 | 1.00 | 62.21 B000 C |
| ATOM | 7658 | CG1 | VAL | F | 156 | −14.577 | 56.145 | −0.211 | 1.00 | 55.24 B000 C |
| ATOM | 7659 | CG2 | VAL | F | 156 | −13.256 | 54.002 | −0.096 | 1.00 | 73.19 B000 C |
| ATOM | 7660 | N | ASN | F | 157 | −16.460 | 55.891 | −3.031 | 1.00 | 53.19 B000 N |
| ATOM | 7661 | CA | ASN | F | 157 | −17.093 | 56.831 | −3.964 | 1.00 | 54.02 B000 C |
| ATOM | 7662 | C | ASN | F | 157 | −17.605 | 56.142 | −5.227 | 1.00 | 54.32 B000 C |
| ATOM | 7663 | O | ASN | F | 157 | −18.209 | 56.814 | −6.072 | 1.00 | 53.93 B000 O |
| ATOM | 7664 | CB | ASN | F | 157 | −16.170 | 57.985 | −4.387 | 1.00 | 49.92 B000 C |
| ATOM | 7665 | CG | ASN | F | 157 | −15.632 | 58.759 | −3.202 | 1.00 | 59.88 B000 C |
| ATOM | 7666 | OD1 | ASN | F | 157 | −16.357 | 59.008 | −2.236 | 1.00 | 56.12 B000 O |
| ATOM | 7667 | ND2 | ASN | F | 157 | −14.346 | 59.136 | −3.262 | 1.00 | 53.76 B000 N |
| ATOM | 7668 | N | TRP | F | 158 | −17.394 | 54.844 | −5.396 | 1.00 | 49.14 B000 N |

TABLE 10.3-continued

| | | | | | | | | | | | |
|---|---|---|---|---|---|---|---|---|---|---|---|
| ATOM | 7669 | CA | TRP | F | 158 | −18.015 | 54.160 | −6.516 | 1.00 | 47.06 | B000 | C |
| ATOM | 7670 | C | TRP | F | 158 | −19.353 | 53.577 | −6.080 | 1.00 | 46.07 | B000 | C |
| ATOM | 7671 | O | TRP | F | 158 | −19.629 | 53.429 | −4.891 | 1.00 | 48.01 | B000 | O |
| ATOM | 7672 | CB | TRP | F | 158 | −17.109 | 53.069 | −7.059 | 1.00 | 48.92 | B000 | C |
| ATOM | 7673 | CG | TRP | F | 158 | −15.830 | 53.586 | −7.632 | 1.00 | 42.48 | B000 | C |
| ATOM | 7674 | CD1 | TRP | F | 158 | −14.854 | 54.269 | −6.967 | 1.00 | 46.04 | B000 | C |
| ATOM | 7675 | CD2 | TRP | F | 158 | −15.364 | 53.425 | −8.975 | 1.00 | 40.30 | B000 | C |
| ATOM | 7676 | NE1 | TRP | F | 158 | −13.811 | 54.549 | −7.812 | 1.00 | 40.04 | B000 | N |
| ATOM | 7677 | CE2 | TRP | F | 158 | −14.098 | 54.047 | −9.053 | 1.00 | 40.63 | B000 | C |
| ATOM | 7678 | CE3 | TRP | F | 158 | −15.900 | 52.830 | −10.124 | 1.00 | 38.93 | B000 | C |
| ATOM | 7679 | CZ2 | TRP | F | 158 | −13.358 | 54.092 | −10.234 | 1.00 | 36.03 | B000 | C |
| ATOM | 7680 | CZ3 | TRP | F | 158 | −15.164 | 52.864 | −11.283 | 1.00 | 40.94 | B000 | C |
| ATOM | 7681 | CH2 | TRP | F | 158 | −13.908 | 53.499 | −11.336 | 1.00 | 38.94 | B000 | C |
| ATOM | 7682 | N | VAL | F | 159 | −20.207 | 53.303 | −7.065 | 1.00 | 48.15 | B000 | N |
| ATOM | 7683 | CA | VAL | F | 159 | −21.584 | 52.872 | −6.854 | 1.00 | 43.77 | B000 | C |
| ATOM | 7684 | C | VAL | F | 159 | −21.777 | 51.526 | −7.536 | 1.00 | 53.64 | B000 | C |
| ATOM | 7685 | O | VAL | F | 159 | −21.317 | 51.328 | −8.666 | 1.00 | 50.16 | B000 | O |
| ATOM | 7686 | CB | VAL | F | 159 | −22.571 | 53.918 | −7.409 | 1.00 | 47.04 | B000 | C |
| ATOM | 7687 | CG1 | VAL | F | 159 | −24.008 | 53.459 | −7.275 | 1.00 | 49.61 | B000 | C |
| ATOM | 7688 | CG2 | VAL | F | 159 | −22.361 | 55.239 | −6.711 | 1.00 | 48.78 | B000 | C |
| ATOM | 7689 | N | GLU | F | 160 | −22.478 | 50.611 | −6.864 | 1.00 | 57.06 | B000 | N |
| ATOM | 7690 | CA | GLU | F | 160 | −22.632 | 49.242 | −7.343 | 1.00 | 56.04 | B000 | C |
| ATOM | 7691 | C | GLU | F | 160 | −23.958 | 49.061 | −8.070 | 1.00 | 50.46 | B000 | C |
| ATOM | 7692 | O | GLU | F | 160 | −25.000 | 49.538 | −7.619 | 1.00 | 54.39 | B000 | O |
| ATOM | 7693 | CB | GLU | F | 160 | −22.568 | 48.223 | −6.201 | 1.00 | 59.56 | B000 | C |
| ATOM | 7694 | CG | GLU | F | 160 | −22.813 | 46.795 | −6.710 | 1.00 | 68.99 | B000 | C |
| ATOM | 7695 | CD | GLU | F | 160 | −23.041 | 45.748 | −5.621 | 1.00 | 80.25 | B000 | C |
| ATOM | 7696 | OE1 | GLU | F | 160 | −22.777 | 46.016 | −4.427 | 1.00 | 79.75 | B000 | O |
| ATOM | 7697 | OE2 | GLU | F | 160 | −23.491 | 44.637 | −5.985 | 1.00 | 78.26 | B000 | O1− |
| ATOM | 7698 | N | HIS | F | 161 | −23.912 | 48.328 | −9.175 | 1.00 | 51.49 | B000 | N |
| ATOM | 7699 | CA | HIS | F | 161 | −25.104 | 47.913 | −9.892 | 1.00 | 49.49 | B000 | C |
| ATOM | 7700 | C | HIS | F | 161 | −24.786 | 46.601 | −10.587 | 1.00 | 53.28 | B000 | C |
| ATOM | 7701 | O | HIS | F | 161 | −23.801 | 46.508 | −11.332 | 1.00 | 47.92 | B000 | O |
| ATOM | 7702 | CB | HIS | F | 161 | −25.561 | 48.959 | −10.901 | 1.00 | 47.30 | B000 | C |
| ATOM | 7703 | CG | HIS | F | 161 | −26.699 | 48.503 | −11.759 | 1.00 | 52.32 | B000 | C |
| ATOM | 7704 | ND1 | HIS | F | 161 | −26.511 | 47.794 | −12.930 | 1.00 | 49.15 | B000 | N |
| ATOM | 7705 | CD2 | HIS | F | 161 | −28.039 | 48.641 | −11.611 | 1.00 | 49.74 | B000 | C |
| ATOM | 7706 | CE1 | HIS | F | 161 | −27.687 | 47.540 | −13.478 | 1.00 | 52.61 | B000 | C |
| ATOM | 7707 | NE2 | HIS | F | 161 | −28.630 | 48.037 | −12.696 | 1.00 | 54.26 | B000 | N |
| ATOM | 7708 | N | GLU | F | 162 | −25.666 | 45.618 | −10.386 | 1.00 | 61.24 | B000 | N |
| ATOM | 7709 | CA | GLU | F | 162 | −25.426 | 44.226 | −10.751 | 1.00 | 57.31 | B000 | C |
| ATOM | 7710 | C | GLU | F | 162 | −24.028 | 43.809 | −10.315 | 1.00 | 59.22 | B000 | C |
| ATOM | 7711 | O | GLU | F | 162 | −23.715 | 43.833 | −9.118 | 1.00 | 59.32 | B000 | O |
| ATOM | 7712 | CB | GLU | F | 162 | −25.596 | 44.005 | −12.253 | 1.00 | 54.87 | B000 | C |
| ATOM | 7713 | CG | GLU | F | 162 | −26.901 | 44.546 | −12.835 | 1.00 | 59.80 | B000 | C |
| ATOM | 7714 | CD | GLU | F | 162 | −28.197 | 43.921 | −12.303 | 1.00 | 84.54 | B000 | C |
| ATOM | 7715 | OE1 | GLU | F | 162 | −28.210 | 43.290 | −11.211 | 1.00 | 82.94 | B000 | O |
| ATOM | 7716 | OE2 | GLU | F | 162 | −29.231 | 44.078 | −13.007 | 1.00 | 83.83 | B000 | O1− |
| ATOM | 7717 | N | ARG | F | 163 | −23.163 | 43.459 | −11.263 | 1.00 | 55.56 | B000 | N |
| ATOM | 7718 | CA | ARG | F | 163 | −21.811 | 43.028 | −10.919 | 1.00 | 70.50 | B000 | C |
| ATOM | 7719 | C | ARG | F | 163 | −20.730 | 44.041 | −11.292 | 1.00 | 65.87 | B000 | C |
| ATOM | 7720 | O | ARG | F | 163 | −19.541 | 43.699 | −11.301 | 1.00 | 61.99 | B000 | O |
| ATOM | 7721 | CB | ARG | F | 163 | −21.533 | 41.645 | −11.517 | 1.00 | 71.43 | B000 | C |
| ATOM | 7722 | CG | ARG | F | 163 | −22.636 | 40.621 | −11.170 | 1.00 | 84.91 | B000 | C |
| ATOM | 7723 | CD | ARG | F | 163 | −23.371 | 40.027 | −12.366 | 1.00 | 94.82 | B000 | C |
| ATOM | 7724 | NE | ARG | F | 163 | −23.213 | 38.571 | −12.447 | 1.00 | 110.28 | B000 | N |
| ATOM | 7725 | CZ | ARG | F | 163 | −22.337 | 37.951 | −13.238 | 1.00 | 109.36 | B000 | C |
| ATOM | 7726 | NH1 | ARG | F | 163 | −21.538 | 38.656 | −14.031 | 1.00 | 107.55 | B000 | N1+ |
| ATOM | 7727 | NH2 | ARG | F | 163 | −22.266 | 36.625 | −13.245 | 1.00 | 108.51 | B000 | N |
| ATOM | 7728 | N | SER | F | 164 | −21.104 | 45.289 | −11.551 | 1.00 | 62.99 | B000 | N |
| ATOM | 7729 | CA | SER | F | 164 | −20.137 | 46.326 | −11.872 | 1.00 | 54.70 | B000 | C |
| ATOM | 7730 | C | SER | F | 164 | −20.163 | 47.454 | −10.845 | 1.00 | 52.59 | B000 | C |
| ATOM | 7731 | O | SER | F | 164 | −21.153 | 47.666 | −10.136 | 1.00 | 53.73 | B000 | O |
| ATOM | 7732 | CB | SER | F | 164 | −20.405 | 46.896 | −13.272 | 1.00 | 56.24 | B000 | C |
| ATOM | 7733 | OG | SER | F | 164 | −19.909 | 46.041 | −14.287 | 1.00 | 65.36 | B000 | O |
| ATOM | 7734 | N | CYS | F | 165 | −19.036 | 48.161 | −10.771 | 1.00 | 51.69 | B000 | N |
| ATOM | 7735 | CA | CYS | F | 165 | −18.866 | 49.373 | −9.981 | 1.00 | 51.61 | B000 | C |
| ATOM | 7736 | C | CYS | F | 165 | −18.723 | 50.574 | −10.909 | 1.00 | 50.55 | B000 | C |
| ATOM | 7737 | O | CYS | F | 165 | −18.004 | 50.511 | −11.912 | 1.00 | 48.71 | B000 | O |
| ATOM | 7738 | CB | CYS | F | 165 | −17.633 | 49.280 | −9.076 | 1.00 | 55.01 | B000 | C |
| ATOM | 7739 | SG | CYS | F | 165 | −17.771 | 48.053 | −7.751 | 1.00 | 71.45 | B000 | S |
| ATOM | 7740 | N | TYR | F | 166 | −19.410 | 51.670 | −10.577 | 1.00 | 48.64 | B000 | N |
| ATOM | 7741 | CA | TYR | F | 166 | −19.481 | 52.838 | −11.449 | 1.00 | 45.58 | B000 | C |
| ATOM | 7742 | C | TYR | F | 166 | −19.040 | 54.104 | −10.722 | 1.00 | 51.09 | B000 | C |
| ATOM | 7743 | O | TYR | F | 166 | −19.325 | 54.283 | −9.533 | 1.00 | 49.78 | B000 | O |
| ATOM | 7744 | CB | TYR | F | 166 | −20.886 | 53.045 | −11.982 | 1.00 | 39.51 | B000 | C |
| ATOM | 7745 | CG | TYR | F | 166 | −21.427 | 51.889 | −12.777 | 1.00 | 45.13 | B000 | C |
| ATOM | 7746 | CD1 | TYR | F | 166 | −21.884 | 50.732 | −12.151 | 1.00 | 50.08 | B000 | C |
| ATOM | 7747 | CD2 | TYR | F | 166 | −21.471 | 51.945 | −14.159 | 1.00 | 46.42 | B000 | C |
| ATOM | 7748 | CE1 | TYR | F | 166 | −22.393 | 49.667 | −12.887 | 1.00 | 48.67 | B000 | C |

TABLE 10.3-continued

| | | | | | | | | | | | |
|---|---|---|---|---|---|---|---|---|---|---|---|
| ATOM | 7749 | CE2 | TYR | F | 166 | −21.968 | 50.892 | −14.902 | 1.00 | 52.75 | B000 C |
| ATOM | 7750 | CZ | TYR | F | 166 | −22.429 | 49.752 | −14.264 | 1.00 | 51.87 | B000 C |
| ATOM | 7751 | OH | TYR | F | 166 | −22.922 | 48.712 | −15.024 | 1.00 | 47.43 | B000 O |
| ATOM | 7752 | N | TRP | F | 167 | −18.358 | 54.989 | −11.446 | 1.00 | 41.54 | B000 N |
| ATOM | 7753 | CA | TRP | F | 167 | −17.941 | 56.279 | −10.914 | 1.00 | 39.17 | B000 C |
| ATOM | 7754 | C | TRP | F | 167 | −18.472 | 57.396 | −11.821 | 1.00 | 40.61 | B000 C |
| ATOM | 7755 | O | TRP | F | 167 | −18.300 | 57.352 | −13.048 | 1.00 | 39.85 | B000 O |
| ATOM | 7756 | CB | TRP | F | 167 | −16.408 | 56.328 | −10.776 | 1.00 | 39.26 | B000 C |
| ATOM | 7757 | CG | TRP | F | 167 | −15.921 | 57.583 | −10.131 | 1.00 | 47.81 | B000 C |
| ATOM | 7758 | CD1 | TRP | F | 167 | −15.728 | 57.812 | −8.787 | 1.00 | 43.33 | B000 C |
| ATOM | 7759 | CD2 | TRP | F | 167 | −15.599 | 58.806 | −10.799 | 1.00 | 36.88 | B000 C |
| ATOM | 7760 | NE1 | TRP | F | 167 | −15.292 | 59.110 | −8.588 | 1.00 | 37.39 | B000 N |
| ATOM | 7761 | CE2 | TRP | F | 167 | −15.191 | 59.735 | −9.807 | 1.00 | 42.60 | B000 C |
| ATOM | 7762 | CE3 | TRP | F | 167 | −15.593 | 59.202 | −12.140 | 1.00 | 35.30 | B000 C |
| ATOM | 7763 | CZ2 | TRP | F | 167 | −14.796 | 61.049 | −10.122 | 1.00 | 32.52 | B000 C |
| ATOM | 7764 | CZ3 | TRP | F | 167 | −15.177 | 60.506 | −12.455 | 1.00 | 41.65 | B000 C |
| ATOM | 7765 | CH2 | TRP | F | 167 | −14.805 | 61.415 | −11.442 | 1.00 | 34.25 | B000 C |
| ATOM | 7766 | N | PHE | F | 168 | −19.128 | 58.386 | −11.215 | 1.00 | 32.85 | B000 N |
| ATOM | 7767 | CA | PHE | F | 168 | −19.816 | 59.459 | −11.933 | 1.00 | 36.14 | B000 C |
| ATOM | 7768 | C | PHE | F | 168 | −19.062 | 60.768 | −11.757 | 1.00 | 33.17 | B000 C |
| ATOM | 7769 | O | PHE | F | 168 | −18.933 | 61.266 | −10.640 | 1.00 | 32.62 | B000 O |
| ATOM | 7770 | CB | PHE | F | 168 | −21.257 | 59.611 | −11.439 | 1.00 | 31.85 | B000 C |
| ATOM | 7771 | CG | PHE | F | 168 | −22.092 | 58.410 | −11.718 | 1.00 | 43.90 | B000 C |
| ATOM | 7772 | CD1 | PHE | F | 168 | −22.788 | 58.303 | −12.918 | 1.00 | 37.94 | B000 C |
| ATOM | 7773 | CD2 | PHE | F | 168 | −22.121 | 57.349 | −10.824 | 1.00 | 37.92 | B000 C |
| ATOM | 7774 | CE1 | PHE | F | 168 | −23.534 | 57.188 | −13.204 | 1.00 | 33.97 | B000 C |
| ATOM | 7775 | CE2 | PHE | F | 168 | −22.863 | 56.231 | −11.102 | 1.00 | 43.27 | B000 C |
| ATOM | 7776 | CZ | PHE | F | 168 | −23.576 | 56.147 | −12.299 | 1.00 | 39.89 | B000 C |
| ATOM | 7777 | N | SER | F | 169 | −18.544 | 61.311 | −12.851 | 1.00 | 34.64 | B000 N |
| ATOM | 7778 | CA | SER | F | 169 | −17.896 | 62.613 | −12.753 | 1.00 | 37.47 | B000 C |
| ATOM | 7779 | C | SER | F | 169 | −18.933 | 63.691 | −12.453 | 1.00 | 35.48 | B000 C |
| ATOM | 7780 | O | SER | F | 169 | −20.132 | 63.531 | −12.708 | 1.00 | 35.12 | B000 O |
| ATOM | 7781 | CB | SER | F | 169 | −17.154 | 62.974 | −14.046 | 1.00 | 31.74 | B000 C |
| ATOM | 7782 | OG | SER | F | 169 | −18.061 | 63.533 | −14.999 | 1.00 | 33.74 | B000 O |
| ATOM | 7783 | N | ARG | F | 170 | −18.454 | 64.810 | −11.921 | 1.00 | 32.66 | B000 N |
| ATOM | 7784 | CA | ARG | F | 170 | −19.292 | 65.983 | −11.718 | 1.00 | 35.64 | B000 C |
| ATOM | 7785 | C | ARG | F | 170 | −18.692 | 67.198 | −12.423 | 1.00 | 37.46 | B000 C |
| ATOM | 7786 | O | ARG | F | 170 | −18.918 | 68.347 | −12.037 | 1.00 | 32.51 | B000 O |
| ATOM | 7787 | CB | ARG | F | 170 | −19.527 | 66.211 | −10.228 | 1.00 | 30.96 | B000 C |
| ATOM | 7788 | CG | ARG | F | 170 | −20.457 | 65.128 | −9.645 | 1.00 | 33.93 | B000 C |
| ATOM | 7789 | CD | ARG | F | 170 | −20.628 | 65.237 | −8.142 | 1.00 | 36.53 | B000 C |
| ATOM | 7790 | NE | ARG | F | 170 | −19.466 | 64.712 | −7.440 | 1.00 | 46.87 | B000 N |
| ATOM | 7791 | CZ | ARG | F | 170 | −19.272 | 64.766 | −6.121 | 1.00 | 50.98 | B000 C |
| ATOM | 7792 | NH1 | ARG | F | 170 | −18.153 | 64.253 | −5.600 | 1.00 | 44.20 | B000 N1+ |
| ATOM | 7793 | NH2 | ARG | F | 170 | −20.184 | 65.325 | −5.321 | 1.00 | 43.86 | B000 N |
| ATOM | 7794 | N | SER | F | 171 | −17.935 | 66.933 | −13.484 | 1.00 | 32.24 | B000 N |
| ATOM | 7795 | CA | SER | F | 171 | −17.355 | 67.964 | −14.328 | 1.00 | 32.82 | B000 C |
| ATOM | 7796 | C | SER | F | 171 | −17.068 | 67.317 | −15.673 | 1.00 | 33.70 | B000 C |
| ATOM | 7797 | O | SER | F | 171 | −17.093 | 66.090 | −15.807 | 1.00 | 32.42 | B000 O |
| ATOM | 7798 | CB | SER | F | 171 | −16.078 | 68.565 | −13.724 | 1.00 | 32.95 | B000 C |
| ATOM | 7799 | OG | SER | F | 171 | −15.041 | 67.584 | −13.595 | 1.00 | 37.93 | B000 O |
| ATOM | 7800 | N | GLY | F | 172 | −16.766 | 68.160 | −16.662 | 1.00 | 27.87 | B000 N |
| ATOM | 7801 | CA | GLY | F | 172 | −16.607 | 67.725 | −18.032 | 1.00 | 30.72 | B000 C |
| ATOM | 7802 | C | GLY | F | 172 | −15.165 | 67.477 | −18.471 | 1.00 | 37.04 | B000 C |
| ATOM | 7803 | O | GLY | F | 172 | −14.203 | 68.006 | −17.891 | 1.00 | 31.19 | B000 O |
| ATOM | 7804 | N | LYS | F | 173 | −15.039 | 66.642 | −19.510 | 1.00 | 31.65 | B000 N |
| ATOM | 7805 | CA | LYS | F | 173 | −13.782 | 66.382 | −20.205 | 1.00 | 34.23 | B000 C |
| ATOM | 7806 | C | LYS | F | 173 | −14.091 | 66.048 | −21.659 | 1.00 | 34.10 | B000 C |
| ATOM | 7807 | O | LYS | F | 173 | −15.137 | 65.468 | −21.967 | 1.00 | 27.67 | B000 O |
| ATOM | 7808 | CB | LYS | F | 173 | −12.986 | 65.212 | −19.599 | 1.00 | 36.67 | B000 C |
| ATOM | 7809 | CG | LYS | F | 173 | −12.212 | 65.491 | −18.319 | 1.00 | 36.30 | B000 C |
| ATOM | 7810 | CD | LYS | F | 173 | −11.406 | 64.251 | −17.943 | 1.00 | 31.78 | B000 C |
| ATOM | 7811 | CE | LYS | F | 173 | −10.707 | 64.369 | −16.569 | 1.00 | 33.56 | B000 C |
| ATOM | 7812 | NZ | LYS | F | 173 | −9.556 | 65.313 | −16.523 | 1.00 | 45.73 | B000 N1+ |
| ATOM | 7813 | N | ALA | F | 174 | −13.167 | 66.400 | −22.557 | 1.00 | 31.22 | B000 N |
| ATOM | 7814 | CA | ALA | F | 174 | −13.226 | 65.821 | −23.890 | 1.00 | 31.29 | B000 C |
| ATOM | 7815 | C | ALA | F | 174 | −13.149 | 64.297 | −23.774 | 1.00 | 30.96 | B000 C |
| ATOM | 7816 | O | ALA | F | 174 | −12.525 | 63.758 | −22.851 | 1.00 | 33.23 | B000 O |
| ATOM | 7817 | CB | ALA | F | 174 | −12.099 | 66.364 | −24.763 | 1.00 | 29.41 | B000 C |
| ATOM | 7818 | N | TRP | F | 175 | −13.823 | 63.602 | −24.698 | 1.00 | 28.04 | B000 N |
| ATOM | 7819 | CA | TRP | F | 175 | −13.972 | 62.145 | −24.586 | 1.00 | 34.38 | B000 C |
| ATOM | 7820 | C | TRP | F | 175 | −12.623 | 61.449 | −24.421 | 1.00 | 37.26 | B000 C |
| ATOM | 7821 | O | TRP | F | 175 | −12.450 | 60.587 | −23.549 | 1.00 | 35.08 | B000 O |
| ATOM | 7822 | CB | TRP | F | 175 | −14.700 | 61.599 | −25.815 | 1.00 | 28.70 | B000 C |
| ATOM | 7823 | CG | TRP | F | 175 | −15.152 | 60.160 | −25.730 | 1.00 | 37.75 | B000 C |
| ATOM | 7824 | CD1 | TRP | F | 175 | −16.401 | 59.702 | −25.374 | 1.00 | 32.61 | B000 C |
| ATOM | 7825 | CD2 | TRP | F | 175 | −14.381 | 58.992 | −26.056 | 1.00 | 35.80 | B000 C |
| ATOM | 7826 | NE1 | TRP | F | 175 | −16.440 | 58.337 | −25.446 | 1.00 | 36.32 | B000 N |
| ATOM | 7827 | CE2 | TRP | F | 175 | −15.219 | 57.874 | −25.866 | 1.00 | 39.10 | B000 C |
| ATOM | 7828 | CE3 | TRP | F | 175 | −13.067 | 58.786 | −26.488 | 1.00 | 34.63 | B000 C |

TABLE 10.3-continued

| ATOM | 7829 | CZ2 | TRP | F | 175 | −14.788 | 56.573 | −26.097 | 1.00 | 34.59 | B000 | C |
| ATOM | 7830 | CZ3 | TRP | F | 175 | −12.637 | 57.494 | −26.720 | 1.00 | 37.06 | B000 | C |
| ATOM | 7831 | CH2 | TRP | F | 175 | −13.493 | 56.402 | −26.517 | 1.00 | 41.92 | B000 | C |
| ATOM | 7832 | N | ALA | F | 176 | −11.637 | 61.842 | −25.230 | 1.00 | 31.21 | B000 | N |
| ATOM | 7833 | CA | ALA | F | 176 | −10.356 | 61.158 | −25.149 | 1.00 | 35.56 | B000 | C |
| ATOM | 7834 | C | ALA | F | 176 | −9.749 | 61.306 | −23.765 | 1.00 | 38.45 | B000 | C |
| ATOM | 7835 | O | ALA | F | 176 | −9.108 | 60.373 | −23.270 | 1.00 | 39.51 | B000 | O |
| ATOM | 7836 | CB | ALA | F | 176 | −9.403 | 61.684 | −26.229 | 1.00 | 24.62 | B000 | C |
| ATOM | 7837 | N | ASP | F | 177 | −9.964 | 62.449 | −23.107 | 1.00 | 34.61 | B000 | N |
| ATOM | 7838 | CA | ASP | F | 177 | −9.426 | 62.601 | −21.759 | 1.00 | 35.23 | B000 | C |
| ATOM | 7839 | C | ASP | F | 177 | −10.233 | 61.808 | −20.751 | 1.00 | 37.46 | B000 | C |
| ATOM | 7840 | O | ASP | F | 177 | −9.663 | 61.241 | −19.812 | 1.00 | 34.54 | B000 | O |
| ATOM | 7841 | CB | ASP | F | 177 | −9.379 | 64.072 | −21.351 | 1.00 | 34.09 | B000 | C |
| ATOM | 7842 | CG | ASP | F | 177 | −8.386 | 64.859 | −22.167 | 1.00 | 41.05 | B000 | C |
| ATOM | 7843 | OD1 | ASP | F | 177 | −7.313 | 64.292 | −22.458 | 1.00 | 42.78 | B000 | O |
| ATOM | 7844 | OD2 | ASP | F | 177 | −8.681 | 66.028 | −22.531 | 1.00 | 43.34 | B000 | O1− |
| ATOM | 7845 | N | ALA | F | 178 | −11.561 | 61.775 | −20.907 | 1.00 | 34.72 | B000 | N |
| ATOM | 7846 | CA | ALA | F | 178 | −12.357 | 60.941 | −20.010 | 1.00 | 40.52 | B000 | C |
| ATOM | 7847 | C | ALA | F | 178 | −11.978 | 59.471 | −20.186 | 1.00 | 36.67 | B000 | C |
| ATOM | 7848 | O | ALA | F | 178 | −11.853 | 58.724 | −19.208 | 1.00 | 36.37 | B000 | O |
| ATOM | 7849 | CB | ALA | F | 178 | −13.850 | 61.165 | −20.268 | 1.00 | 32.74 | B000 | C |
| ATOM | 7850 | N | ASP | F | 179 | −11.714 | 59.070 | −21.424 | 1.00 | 34.82 | B000 | N |
| ATOM | 7851 | CA | ASP | F | 179 | −11.257 | 57.715 | −21.706 | 1.00 | 36.26 | B000 | C |
| ATOM | 7852 | C | ASP | F | 179 | −9.957 | 57.397 | −20.955 | 1.00 | 42.39 | B000 | C |
| ATOM | 7853 | O | ASP | F | 179 | −9.861 | 56.368 | −20.275 | 1.00 | 44.65 | B000 | O |
| ATOM | 7854 | CB | ASP | F | 179 | −11.107 | 57.584 | −23.221 | 1.00 | 41.84 | B000 | C |
| ATOM | 7855 | CG | ASP | F | 179 | −10.618 | 56.220 | −23.670 | 1.00 | 52.24 | B000 | C |
| ATOM | 7856 | OD1 | ASP | F | 179 | −11.237 | 55.192 | −23.304 | 1.00 | 48.91 | B000 | O |
| ATOM | 7857 | OD2 | ASP | F | 179 | −9.620 | 56.195 | −24.430 | 1.00 | 51.25 | B000 | O1− |
| ATOM | 7858 | N | ASN | F | 180 | −8.959 | 58.292 | −21.019 | 1.00 | 36.75 | B000 | N |
| ATOM | 7859 | CA | ASN | F | 180 | −7.704 | 58.044 | −20.302 | 1.00 | 37.14 | B000 | C |
| ATOM | 7860 | C | ASN | F | 180 | −7.923 | 58.008 | −18.796 | 1.00 | 39.01 | B000 | C |
| ATOM | 7861 | O | ASN | F | 180 | −7.306 | 57.205 | −18.089 | 1.00 | 45.89 | B000 | O |
| ATOM | 7862 | CB | ASN | F | 180 | −6.654 | 59.118 | −20.615 | 1.00 | 46.92 | B000 | C |
| ATOM | 7863 | CG | ASN | F | 180 | −6.153 | 59.087 | −22.053 | 1.00 | 58.49 | B000 | C |
| ATOM | 7864 | OD1 | ASN | F | 180 | −6.232 | 58.070 | −22.751 | 1.00 | 61.49 | B000 | O |
| ATOM | 7865 | ND2 | ASN | F | 180 | −5.630 | 60.232 | −22.507 | 1.00 | 67.59 | B000 | N |
| ATOM | 7866 | N | TYR | F | 181 | −8.782 | 58.887 | −18.283 | 1.00 | 43.70 | B000 | N |
| ATOM | 7867 | CA | TYR | F | 181 | −9.073 | 58.899 | −16.852 | 1.00 | 39.91 | B000 | C |
| ATOM | 7868 | C | TYR | F | 181 | −9.597 | 57.540 | −16.394 | 1.00 | 37.95 | B000 | C |
| ATOM | 7869 | O | TYR | F | 181 | −9.186 | 57.026 | −15.351 | 1.00 | 39.77 | B000 | O |
| ATOM | 7870 | CB | TYR | F | 181 | −10.089 | 60.009 | −16.524 | 1.00 | 38.63 | B000 | C |
| ATOM | 7871 | CG | TYR | F | 181 | −10.493 | 60.066 | −15.056 | 1.00 | 41.58 | B000 | C |
| ATOM | 7872 | CD1 | TYR | F | 181 | −11.438 | 59.167 | −14.527 | 1.00 | 31.11 | B000 | C |
| ATOM | 7873 | CD2 | TYR | F | 181 | −9.928 | 61.018 | −14.193 | 1.00 | 31.82 | B000 | C |
| ATOM | 7874 | CE1 | TYR | F | 181 | −11.782 | 59.205 | −13.193 | 1.00 | 31.20 | B000 | C |
| ATOM | 7875 | CE2 | TYR | F | 181 | −10.285 | 61.067 | −12.856 | 1.00 | 32.07 | B000 | C |
| ATOM | 7876 | CZ | TYR | F | 181 | −11.206 | 60.153 | −12.364 | 1.00 | 37.73 | B000 | C |
| ATOM | 7877 | OH | TYR | F | 181 | −11.565 | 60.192 | −11.049 | 1.00 | 44.00 | B000 | O |
| ATOM | 7878 | N | CYS | F | 182 | −10.545 | 56.962 | −17.133 | 1.00 | 38.33 | B000 | N |
| ATOM | 7879 | CA | CYS | F | 182 | −11.080 | 55.671 | −16.702 | 1.00 | 46.48 | B000 | C |
| ATOM | 7880 | C | CYS | F | 182 | −10.008 | 54.591 | −16.772 | 1.00 | 43.13 | B000 | C |
| ATOM | 7881 | O | CYS | F | 182 | −9.877 | 53.782 | −15.848 | 1.00 | 43.36 | B000 | O |
| ATOM | 7882 | CB | CYS | F | 182 | −12.309 | 55.282 | −17.529 | 1.00 | 39.09 | B000 | C |
| ATOM | 7883 | SG | CYS | F | 182 | −13.808 | 56.319 | −17.269 | 1.00 | 47.89 | B000 | S |
| ATOM | 7884 | N | ARG | F | 183 | −9.196 | 54.599 | −17.834 | 1.00 | 45.20 | B000 | N |
| ATOM | 7885 | CA | ARG | F | 183 | −8.147 | 53.596 | −17.968 | 1.00 | 43.53 | B000 | C |
| ATOM | 7886 | C | ARG | F | 183 | −7.166 | 53.667 | −16.806 | 1.00 | 46.41 | B000 | C |
| ATOM | 7887 | O | ARG | F | 183 | −6.782 | 52.629 | −16.254 | 1.00 | 47.85 | B000 | O |
| ATOM | 7888 | CB | ARG | F | 183 | −7.439 | 53.764 | −19.316 | 1.00 | 41.85 | B000 | C |
| ATOM | 7889 | CG | ARG | F | 183 | −8.193 | 53.051 | −20.444 | 1.00 | 61.73 | B000 | C |
| ATOM | 7890 | CD | ARG | F | 183 | −7.918 | 53.573 | −21.866 | 1.00 | 68.72 | B000 | C |
| ATOM | 7891 | NE | ARG | F | 183 | −8.968 | 53.099 | −22.784 | 1.00 | 81.47 | B000 | N |
| ATOM | 7892 | CZ | ARG | F | 183 | −9.062 | 53.405 | −24.082 | 1.00 | 84.12 | B000 | C |
| ATOM | 7893 | NH1 | ARG | F | 183 | −8.149 | 54.199 | −24.652 | 1.00 | 78.81 | B000 | N1+ |
| ATOM | 7894 | NH2 | ARG | F | 183 | −10.082 | 52.925 | −24.811 | 1.00 | 60.08 | B000 | N |
| ATOM | 7895 | N | LEU | F | 184 | −6.805 | 54.884 | −16.367 | 1.00 | 42.66 | B000 | N |
| ATOM | 7896 | CA | LEU | F | 184 | −5.910 | 55.030 | −15.220 | 1.00 | 41.52 | B000 | C |
| ATOM | 7897 | C | LEU | F | 184 | −6.542 | 54.558 | −13.921 | 1.00 | 45.58 | B000 | C |
| ATOM | 7898 | O | LEU | F | 184 | −5.822 | 54.349 | −12.944 | 1.00 | 51.35 | B000 | O |
| ATOM | 7899 | CB | LEU | F | 184 | −5.441 | 56.481 | −15.057 | 1.00 | 36.16 | B000 | C |
| ATOM | 7900 | CG | LEU | F | 184 | −4.410 | 57.032 | −16.056 | 1.00 | 52.39 | B000 | C |
| ATOM | 7901 | CD1 | LEU | F | 184 | −4.128 | 58.507 | −15.803 | 1.00 | 41.04 | B000 | C |
| ATOM | 7902 | CD2 | LEU | F | 184 | −3.105 | 56.258 | −15.999 | 1.00 | 43.74 | B000 | C |
| ATOM | 7903 | N | GLU | F | 185 | −7.862 | 54.403 | −13.875 | 1.00 | 49.78 | B000 | N |
| ATOM | 7904 | CA | GLU | F | 185 | −8.548 | 53.829 | −12.724 | 1.00 | 54.22 | B000 | C |
| ATOM | 7905 | C | GLU | F | 185 | −8.765 | 52.324 | −12.849 | 1.00 | 48.30 | B000 | C |
| ATOM | 7906 | O | GLU | F | 185 | −9.579 | 51.769 | −12.104 | 1.00 | 50.24 | B000 | O |
| ATOM | 7907 | CB | GLU | F | 185 | −9.905 | 54.506 | −12.523 | 1.00 | 53.96 | B000 | C |
| ATOM | 7908 | CG | GLU | F | 185 | −9.835 | 55.994 | −12.368 | 1.00 | 48.05 | B000 | C |

TABLE 10.3-continued

| | | | | | | | | | | | |
|---|---|---|---|---|---|---|---|---|---|---|---|
| ATOM | 7909 | CD | GLU | F | 185 | −9.246 | 56.395 | −11.042 | 1.00 | 60.24 | B000 | C |
| ATOM | 7910 | OE1 | GLU | F | 185 | −9.666 | 55.804 | −10.016 | 1.00 | 64.06 | B000 | O |
| ATOM | 7911 | OE2 | GLU | F | 185 | −8.376 | 57.300 | −11.033 | 1.00 | 63.60 | B000 | O1− |
| ATOM | 7912 | N | ASP | F | 186 | −8.062 | 51.659 | −13.765 | 1.00 | 48.69 | B000 | N |
| ATOM | 7913 | CA | ASP | F | 186 | −8.311 | 50.254 | −14.090 | 1.00 | 49.60 | B000 | C |
| ATOM | 7914 | C | ASP | F | 186 | −9.782 | 50.054 | −14.431 | 1.00 | 52.34 | B000 | C |
| ATOM | 7915 | O | ASP | F | 186 | −10.445 | 49.131 | −13.950 | 1.00 | 49.55 | B000 | O |
| ATOM | 7916 | CB | ASP | F | 186 | −7.889 | 49.319 | −12.951 | 1.00 | 53.42 | B000 | C |
| ATOM | 7917 | CG | ASP | F | 186 | −6.443 | 49.508 | −12.545 | 1.00 | 79.16 | B000 | C |
| ATOM | 7918 | OD1 | ASP | F | 186 | −5.652 | 50.034 | −13.366 | 1.00 | 85.17 | B000 | O |
| ATOM | 7919 | OD2 | ASP | F | 186 | −6.093 | 49.125 | −11.403 | 1.00 | 86.75 | B000 | O1− |
| ATOM | 7920 | N | ALA | F | 187 | −10.303 | 50.958 | −15.252 | 1.00 | 50.66 | B000 | N |
| ATOM | 7921 | CA | ALA | F | 187 | −11.705 | 50.915 | −15.627 | 1.00 | 43.40 | B000 | C |
| ATOM | 7922 | C | ALA | F | 187 | −11.822 | 51.404 | −17.061 | 1.00 | 39.32 | B000 | C |
| ATOM | 7923 | O | ALA | F | 187 | −10.822 | 51.623 | −17.752 | 1.00 | 42.43 | B000 | O |
| ATOM | 7924 | CB | ALA | F | 187 | −12.559 | 51.716 | −14.636 | 1.00 | 37.47 | B000 | C |
| ATOM | 7925 | N | HIS | F | 188 | −13.048 | 51.547 | −17.523 | 1.00 | 38.43 | B000 | N |
| ATOM | 7926 | CA | HIS | F | 188 | −13.273 | 52.036 | −18.864 | 1.00 | 42.96 | B000 | C |
| ATOM | 7927 | C | HIS | F | 188 | −14.539 | 52.878 | −18.839 | 1.00 | 39.88 | B000 | C |
| ATOM | 7928 | O | HIS | F | 188 | −15.291 | 52.871 | −17.865 | 1.00 | 47.38 | B000 | O |
| ATOM | 7929 | CB | HIS | F | 188 | −13.377 | 50.872 | −19.852 | 1.00 | 40.78 | B000 | C |
| ATOM | 7930 | CG | HIS | F | 188 | −14.461 | 49.901 | −19.512 | 1.00 | 40.48 | B000 | C |
| ATOM | 7931 | ND1 | HIS | F | 188 | −15.783 | 50.124 | −19.830 | 1.00 | 46.61 | B000 | N |
| ATOM | 7932 | CD2 | HIS | F | 188 | −14.427 | 48.716 | −18.858 | 1.00 | 45.33 | B000 | C |
| ATOM | 7933 | CE1 | HIS | F | 188 | −16.515 | 49.109 | −19.403 | 1.00 | 45.57 | B000 | C |
| ATOM | 7934 | NE2 | HIS | F | 188 | −15.716 | 48.241 | −18.811 | 1.00 | 46.51 | B000 | N |
| ATOM | 7935 | N | LEU | F | 189 | −14.764 | 53.613 | −19.918 | 1.00 | 37.01 | B000 | N |
| ATOM | 7936 | CA | LEU | F | 189 | −15.978 | 54.400 | −20.036 | 1.00 | 37.46 | B000 | C |
| ATOM | 7937 | C | LEU | F | 189 | −17.191 | 53.475 | −20.121 | 1.00 | 43.07 | B000 | C |
| ATOM | 7938 | O | LEU | F | 189 | −17.135 | 52.415 | −20.754 | 1.00 | 37.38 | B000 | O |
| ATOM | 7939 | CB | LEU | F | 189 | −15.891 | 55.299 | −21.263 | 1.00 | 31.01 | B000 | C |
| ATOM | 7940 | CG | LEU | F | 189 | −14.995 | 56.532 | −21.160 | 1.00 | 35.76 | B000 | C |
| ATOM | 7941 | CD1 | LEU | F | 189 | −14.766 | 57.097 | −22.537 | 1.00 | 33.40 | B000 | C |
| ATOM | 7942 | CD2 | LEU | F | 189 | −15.624 | 57.607 | −20.257 | 1.00 | 34.63 | B000 | C |
| ATOM | 7943 | N | VAL | F | 190 | −18.301 | 53.904 | −19.502 | 1.00 | 37.96 | B000 | N |
| ATOM | 7944 | CA | VAL | F | 190 | −19.417 | 53.006 | −19.237 | 1.00 | 34.67 | B000 | C |
| ATOM | 7945 | C | VAL | F | 190 | −19.928 | 52.393 | −20.536 | 1.00 | 42.14 | B000 | C |
| ATOM | 7946 | O | VAL | F | 190 | −20.044 | 53.064 | −21.573 | 1.00 | 40.38 | B000 | O |
| ATOM | 7947 | CB | VAL | F | 190 | −20.551 | 53.722 | −18.477 | 1.00 | 36.38 | B000 | C |
| ATOM | 7948 | CG1 | VAL | F | 190 | −21.205 | 54.857 | −19.319 | 1.00 | 31.50 | B000 | C |
| ATOM | 7949 | CG2 | VAL | F | 190 | −21.573 | 52.718 | −18.006 | 1.00 | 38.12 | B000 | C |
| ATOM | 7950 | N | VAL | F | 191 | −20.178 | 51.085 | −20.485 | 1.00 | 40.92 | B000 | N |
| ATOM | 7951 | CA | VAL | F | 191 | −20.787 | 50.325 | −21.567 | 1.00 | 40.00 | B000 | C |
| ATOM | 7952 | C | VAL | F | 191 | −22.162 | 49.884 | −21.082 | 1.00 | 41.46 | B000 | C |
| ATOM | 7953 | O | VAL | F | 191 | −22.265 | 49.187 | −20.063 | 1.00 | 51.69 | B000 | O |
| ATOM | 7954 | CB | VAL | F | 191 | −19.928 | 49.113 | −21.966 | 1.00 | 43.90 | B000 | C |
| ATOM | 7955 | CG1 | VAL | F | 191 | −20.596 | 48.350 | −23.106 | 1.00 | 38.60 | B000 | C |
| ATOM | 7956 | CG2 | VAL | F | 191 | −18.503 | 49.546 | −22.338 | 1.00 | 38.08 | B000 | C |
| ATOM | 7957 | N | VAL | F | 192 | −23.209 | 50.284 | −21.805 | 1.00 | 39.60 | B000 | N |
| ATOM | 7958 | CA | VAL | F | 192 | −24.603 | 50.091 | −21.402 | 1.00 | 40.55 | B000 | C |
| ATOM | 7959 | C | VAL | F | 192 | −25.139 | 48.872 | −22.134 | 1.00 | 42.33 | B000 | C |
| ATOM | 7960 | O | VAL | F | 192 | −25.454 | 48.955 | −23.326 | 1.00 | 43.63 | B000 | O |
| ATOM | 7961 | CB | VAL | F | 192 | −25.464 | 51.319 | −21.747 | 1.00 | 43.28 | B000 | C |
| ATOM | 7962 | CG1 | VAL | F | 192 | −26.869 | 51.182 | −21.155 | 1.00 | 32.94 | B000 | C |
| ATOM | 7963 | CG2 | VAL | F | 192 | −24.772 | 52.629 | −21.333 | 1.00 | 35.84 | B000 | C |
| ATOM | 7964 | N | THR | F | 193 | −25.341 | 47.762 | −21.429 | 1.00 | 48.94 | B000 | N |
| ATOM | 7965 | CA | THR | F | 193 | −25.745 | 46.531 | −22.105 | 1.00 | 47.71 | B000 | C |
| ATOM | 7966 | C | THR | F | 193 | −27.211 | 46.169 | −21.896 | 1.00 | 49.57 | B000 | C |
| ATOM | 7967 | O | THR | F | 193 | −27.654 | 45.172 | −22.465 | 1.00 | 51.89 | B000 | O |
| ATOM | 7968 | CB | THR | F | 193 | −24.866 | 45.344 | −21.673 | 1.00 | 37.74 | B000 | C |
| ATOM | 7969 | OG1 | THR | F | 193 | −25.053 | 45.097 | −20.280 | 1.00 | 43.14 | B000 | O |
| ATOM | 7970 | CG2 | THR | F | 193 | −23.361 | 45.624 | −21.935 | 1.00 | 34.77 | B000 | C |
| ATOM | 7971 | N | SER | F | 194 | −27.986 | 46.957 | −21.143 | 1.00 | 45.16 | B000 | N |
| ATOM | 7972 | CA | SER | F | 194 | −29.364 | 46.570 | −20.845 | 1.00 | 43.88 | B000 | C |
| ATOM | 7973 | C | SER | F | 194 | −30.163 | 47.775 | −20.395 | 1.00 | 47.69 | B000 | C |
| ATOM | 7974 | O | SER | F | 194 | −29.609 | 48.782 | −19.938 | 1.00 | 48.48 | B000 | O |
| ATOM | 7975 | CB | SER | F | 194 | −29.443 | 45.506 | −19.738 | 1.00 | 52.95 | B000 | C |
| ATOM | 7976 | OG | SER | F | 194 | −29.162 | 46.065 | −18.455 | 1.00 | 47.85 | B000 | O |
| ATOM | 7977 | N | TRP | F | 195 | −31.488 | 47.622 | −20.464 | 1.00 | 48.46 | B000 | N |
| ATOM | 7978 | CA | TRP | F | 195 | −32.386 | 48.680 | −20.012 | 1.00 | 44.88 | B000 | C |
| ATOM | 7979 | C | TRP | F | 195 | −32.160 | 49.001 | −18.546 | 1.00 | 47.13 | B000 | C |
| ATOM | 7980 | O | TRP | F | 195 | −32.238 | 50.165 | −18.133 | 1.00 | 45.99 | B000 | O |
| ATOM | 7981 | CB | TRP | F | 195 | −33.843 | 48.288 | −20.250 | 1.00 | 41.25 | B000 | C |
| ATOM | 7982 | CG | TRP | F | 195 | −34.410 | 48.910 | −21.469 | 1.00 | 54.27 | B000 | C |
| ATOM | 7983 | CD1 | TRP | F | 195 | −34.863 | 48.275 | −22.601 | 1.00 | 50.60 | B000 | C |
| ATOM | 7984 | CD2 | TRP | F | 195 | −34.541 | 50.319 | −21.716 | 1.00 | 55.13 | B000 | C |
| ATOM | 7985 | NE1 | TRP | F | 195 | −35.307 | 49.212 | −23.521 | 1.00 | 52.12 | B000 | N |
| ATOM | 7986 | CE2 | TRP | F | 195 | −35.114 | 50.470 | −23.005 | 1.00 | 54.46 | B000 | C |
| ATOM | 7987 | CE3 | TRP | F | 195 | −34.246 | 51.467 | −20.964 | 1.00 | 50.27 | B000 | C |
| ATOM | 7988 | CZ2 | TRP | F | 195 | −35.391 | 51.727 | −23.561 | 1.00 | 62.09 | B000 | C |

TABLE 10.3-continued

| | | | | | | | | | | | |
|---|---|---|---|---|---|---|---|---|---|---|---|
| ATOM | 7989 | CZ3 | TRP | F | 195 | −34.530 | 52.721 | −21.513 | 1.00 | 54.11 | B000 C |
| ATOM | 7990 | CH2 | TRP | F | 195 | −35.091 | 52.837 | −22.804 | 1.00 | 59.63 | B000 C |
| ATOM | 7991 | N | GLU | F | 196 | −31.875 | 47.980 | −17.747 | 1.00 | 43.73 | B000 N |
| ATOM | 7992 | CA | GLU | F | 196 | −31.638 | 48.202 | −16.330 | 1.00 | 46.25 | B000 C |
| ATOM | 7993 | C | GLU | F | 196 | −30.421 | 49.094 | −16.133 | 1.00 | 48.83 | B000 C |
| ATOM | 7994 | O | GLU | F | 196 | −30.505 | 50.141 | −15.480 | 1.00 | 50.61 | B000 O |
| ATOM | 7995 | CB | GLU | F | 196 | −31.445 | 46.853 | −15.623 | 1.00 | 52.52 | B000 C |
| ATOM | 7996 | CG | GLU | F | 196 | −32.744 | 46.023 | −15.500 | 1.00 | 56.68 | B000 C |
| ATOM | 7997 | CD | GLU | F | 196 | −33.141 | 45.323 | −16.823 | 1.00 | 67.73 | B000 C |
| ATOM | 7998 | OE1 | GLU | F | 196 | −32.250 | 45.039 | −17.660 | 1.00 | 66.56 | B000 O |
| ATOM | 7999 | OE2 | GLU | F | 196 | −34.348 | 45.063 | −17.030 | 1.00 | 76.24 | B000 O1− |
| ATOM | 8000 | N | GLU | F | 197 | −29.293 | 48.717 | −16.744 | 1.00 | 40.21 | B000 N |
| ATOM | 8001 | CA | GLU | F | 197 | −28.089 | 49.533 | −16.666 | 1.00 | 46.56 | B000 C |
| ATOM | 8002 | C | GLU | F | 197 | −28.364 | 50.956 | −17.149 | 1.00 | 46.02 | B000 C |
| ATOM | 8003 | O | GLU | F | 197 | −27.964 | 51.927 | −16.494 | 1.00 | 39.09 | B000 O |
| ATOM | 8004 | CB | GLU | F | 197 | −26.965 | 48.881 | −17.475 | 1.00 | 41.68 | B000 C |
| ATOM | 8005 | CG | GLU | F | 197 | −25.566 | 49.351 | −17.097 | 1.00 | 46.61 | B000 C |
| ATOM | 8006 | CD | GLU | F | 197 | −24.465 | 48.581 | −17.830 | 1.00 | 49.56 | B000 C |
| ATOM | 8007 | OE1 | GLU | F | 197 | −24.781 | 47.861 | −18.816 | 1.00 | 45.94 | B000 O |
| ATOM | 8008 | OE2 | GLU | F | 197 | −23.283 | 48.692 | −17.413 | 1.00 | 45.17 | B000 O1− |
| ATOM | 8009 | N | GLN | F | 198 | −29.087 | 51.091 | −18.271 | 1.00 | 37.03 | B000 N |
| ATOM | 8010 | CA | GLN | F | 198 | −29.451 | 52.403 | −18.794 | 1.00 | 36.33 | B000 C |
| ATOM | 8011 | C | GLN | F | 198 | −30.217 | 53.231 | −17.769 | 1.00 | 44.55 | B000 C |
| ATOM | 8012 | O | GLN | F | 198 | −29.896 | 54.400 | −17.546 | 1.00 | 40.80 | B000 O |
| ATOM | 8013 | CB | GLN | F | 198 | −30.275 | 52.248 | −20.065 | 1.00 | 35.40 | B000 C |
| ATOM | 8014 | CG | GLN | F | 198 | −31.035 | 53.513 | −20.445 | 1.00 | 35.73 | B000 C |
| ATOM | 8015 | CD | GLN | F | 198 | −30.137 | 54.563 | −21.106 | 1.00 | 43.38 | B000 C |
| ATOM | 8016 | OE1 | GLN | F | 198 | −29.107 | 54.240 | −21.704 | 1.00 | 38.10 | B000 O |
| ATOM | 8017 | NE2 | GLN | F | 198 | −30.535 | 55.821 | −21.007 | 1.00 | 38.22 | B000 N |
| ATOM | 8018 | N | LYS | F | 199 | −31.229 | 52.641 | −17.123 | 1.00 | 47.51 | B000 N |
| ATOM | 8019 | CA | LYS | F | 199 | −32.018 | 53.399 | −16.154 | 1.00 | 44.51 | B000 C |
| ATOM | 8020 | C | LYS | F | 199 | −31.196 | 53.714 | −14.918 | 1.00 | 39.60 | B000 C |
| ATOM | 8021 | O | LYS | F | 199 | −31.308 | 54.805 | −14.351 | 1.00 | 43.02 | B000 O |
| ATOM | 8022 | CB | LYS | F | 199 | −33.276 | 52.619 | −15.760 | 1.00 | 48.82 | B000 C |
| ATOM | 8023 | CG | LYS | F | 199 | −34.257 | 52.311 | −16.891 | 1.00 | 50.78 | B000 C |
| ATOM | 8024 | CD | LYS | F | 199 | −35.683 | 52.463 | −16.392 | 1.00 | 65.99 | B000 C |
| ATOM | 8025 | CE | LYS | F | 199 | −36.698 | 51.763 | −17.281 | 1.00 | 72.04 | B000 C |
| ATOM | 8026 | NZ | LYS | F | 199 | −38.023 | 51.636 | −16.575 | 1.00 | 76.98 | B000 N1+ |
| ATOM | 8027 | N | PHE | F | 200 | −30.351 | 52.773 | −14.502 | 1.00 | 38.71 | B000 N |
| ATOM | 8028 | CA | PHE | F | 200 | −29.447 | 53.007 | −13.388 | 1.00 | 38.04 | B000 C |
| ATOM | 8029 | C | PHE | F | 200 | −28.557 | 54.224 | −13.641 | 1.00 | 47.55 | B000 C |
| ATOM | 8030 | O | PHE | F | 200 | −28.381 | 55.073 | −12.761 | 1.00 | 42.70 | B000 O |
| ATOM | 8031 | CB | PHE | F | 200 | −28.604 | 51.759 | −13.163 | 1.00 | 40.51 | B000 C |
| ATOM | 8032 | CG | PHE | F | 200 | −27.381 | 51.999 | −12.347 | 1.00 | 41.69 | B000 C |
| ATOM | 8033 | CD1 | PHE | F | 200 | −27.473 | 52.215 | −10.980 | 1.00 | 38.29 | B000 C |
| ATOM | 8034 | CD2 | PHE | F | 200 | −26.130 | 52.027 | −12.953 | 1.00 | 37.96 | B000 C |
| ATOM | 8035 | CE1 | PHE | F | 200 | −26.330 | 52.448 | −10.216 | 1.00 | 42.63 | B000 C |
| ATOM | 8036 | CE2 | PHE | F | 200 | −24.978 | 52.252 | −12.205 | 1.00 | 39.67 | B000 C |
| ATOM | 8037 | CZ | PHE | F | 200 | −25.076 | 52.466 | −10.830 | 1.00 | 44.08 | B000 C |
| ATOM | 8038 | N | VAL | F | 201 | −27.984 | 54.328 | −14.842 | 1.00 | 43.83 | B000 N |
| ATOM | 8039 | CA | VAL | F | 201 | −27.087 | 55.445 | −15.131 | 1.00 | 40.81 | B000 C |
| ATOM | 8040 | C | VAL | F | 201 | −27.865 | 56.756 | −15.182 | 1.00 | 44.68 | B000 C |
| ATOM | 8041 | O | VAL | F | 201 | −27.442 | 57.758 | −14.596 | 1.00 | 42.14 | B000 O |
| ATOM | 8042 | CB | VAL | F | 201 | −26.313 | 55.196 | −16.438 | 1.00 | 40.73 | B000 C |
| ATOM | 8043 | CG1 | VAL | F | 201 | −25.631 | 56.475 | −16.900 | 1.00 | 38.56 | B000 C |
| ATOM | 8044 | CG2 | VAL | F | 201 | −25.297 | 54.053 | −16.260 | 1.00 | 34.68 | B000 C |
| ATOM | 8045 | N | GLN | F | 202 | −29.005 | 56.768 | −15.894 | 1.00 | 37.85 | B000 N |
| ATOM | 8046 | CA | GLN | F | 202 | −29.859 | 57.956 | −15.959 | 1.00 | 43.72 | B000 C |
| ATOM | 8047 | C | GLN | F | 202 | −30.185 | 58.499 | −14.582 | 1.00 | 46.87 | B000 C |
| ATOM | 8048 | O | GLN | F | 202 | −30.211 | 59.720 | −14.367 | 1.00 | 46.96 | B000 O |
| ATOM | 8049 | CB | GLN | F | 202 | −31.184 | 57.645 | −16.634 | 1.00 | 43.62 | B000 C |
| ATOM | 8050 | CG | GLN | F | 202 | −31.156 | 57.250 | −18.044 | 1.00 | 46.33 | B000 C |
| ATOM | 8051 | CD | GLN | F | 202 | −32.572 | 57.120 | −18.537 | 1.00 | 50.37 | B000 C |
| ATOM | 8052 | OE1 | GLN | F | 202 | −32.871 | 56.353 | −19.451 | 1.00 | 47.40 | B000 O |
| ATOM | 8053 | NE2 | GLN | F | 202 | −33.469 | 57.864 | −17.901 | 1.00 | 48.25 | B000 N |
| ATOM | 8054 | N | HIS | F | 203 | −30.503 | 57.603 | −13.654 | 1.00 | 41.20 | B000 N |
| ATOM | 8055 | CA | HIS | F | 203 | −30.825 | 58.034 | −12.307 | 1.00 | 44.02 | B000 C |
| ATOM | 8056 | C | HIS | F | 203 | −29.701 | 58.866 | −11.707 | 1.00 | 47.89 | B000 C |
| ATOM | 8057 | O | HIS | F | 203 | −29.958 | 59.896 | −11.078 | 1.00 | 47.99 | B000 O |
| ATOM | 8058 | CB | HIS | F | 203 | −31.106 | 56.827 | −11.421 | 1.00 | 40.71 | B000 C |
| ATOM | 8059 | CG | HIS | F | 203 | −31.413 | 57.206 | −10.013 | 1.00 | 53.47 | B000 C |
| ATOM | 8060 | ND1 | HIS | F | 203 | −30.514 | 57.028 | −8.982 | 1.00 | 56.30 | B000 N |
| ATOM | 8061 | CD2 | HIS | F | 203 | −32.499 | 57.805 | −9.470 | 1.00 | 46.30 | B000 C |
| ATOM | 8062 | CE1 | HIS | F | 203 | −31.044 | 57.478 | −7.858 | 1.00 | 55.89 | B000 C |
| ATOM | 8063 | NE2 | HIS | F | 203 | −32.248 | 57.953 | −8.127 | 1.00 | 56.08 | B000 N |
| ATOM | 8064 | N | HIS | F | 204 | −28.444 | 58.458 | −11.918 | 1.00 | 41.43 | B000 N |
| ATOM | 8065 | CA | HIS | F | 204 | −27.328 | 59.148 | −11.283 | 1.00 | 39.37 | B000 C |
| ATOM | 8066 | C | HIS | F | 204 | −26.814 | 60.355 | −12.055 | 1.00 | 40.69 | B000 C |
| ATOM | 8067 | O | HIS | F | 204 | −26.317 | 61.291 | −11.426 | 1.00 | 42.64 | B000 O |
| ATOM | 8068 | CB | HIS | F | 204 | −26.174 | 58.188 | −11.035 | 1.00 | 43.78 | B000 C |

TABLE 10.3-continued

| | | | | | | | | | | | |
|---|---|---|---|---|---|---|---|---|---|---|---|
| ATOM | 8069 | CG | HIS | F | 204 | −26.401 | 57.295 | −9.864 | 1.00 | 48.22 | B000 | C |
| ATOM | 8070 | ND1 | HIS | F | 204 | −26.903 | 56.017 | −9.983 | 1.00 | 46.54 | B000 | N |
| ATOM | 8071 | CD2 | HIS | F | 204 | −26.255 | 57.524 | −8.538 | 1.00 | 40.29 | B000 | C |
| ATOM | 8072 | CE1 | HIS | F | 204 | −27.021 | 55.484 | −8.781 | 1.00 | 48.73 | B000 | C |
| ATOM | 8073 | NE2 | HIS | F | 204 | −26.638 | 56.378 | −7.887 | 1.00 | 42.03 | B000 | N |
| ATOM | 8074 | N | ILE | F | 205 | −26.916 | 60.374 | −13.387 | 1.00 | 37.14 | B000 | N |
| ATOM | 8075 | CA | ILE | F | 205 | −26.350 | 61.499 | −14.131 | 1.00 | 36.61 | B000 | C |
| ATOM | 8076 | C | ILE | F | 205 | −27.319 | 62.674 | −14.148 | 1.00 | 42.45 | B000 | C |
| ATOM | 8077 | O | ILE | F | 205 | −26.895 | 63.820 | −14.292 | 1.00 | 40.59 | B000 | O |
| ATOM | 8078 | CB | ILE | F | 205 | −25.950 | 61.116 | −15.576 | 1.00 | 34.16 | B000 | C |
| ATOM | 8079 | CG1 | ILE | F | 205 | −27.167 | 60.709 | −16.402 | 1.00 | 34.84 | B000 | C |
| ATOM | 8080 | CG2 | ILE | F | 205 | −24.871 | 60.040 | −15.609 | 1.00 | 29.47 | B000 | C |
| ATOM | 8081 | CD1 | ILE | F | 205 | −26.829 | 60.403 | −17.814 | 1.00 | 37.88 | B000 | C |
| ATOM | 8082 | N | GLY | F | 206 | −28.620 | 62.416 | −14.017 | 1.00 | 43.01 | B000 | N |
| ATOM | 8083 | CA | GLY | F | 206 | −29.611 | 63.456 | −14.094 | 1.00 | 36.11 | B000 | C |
| ATOM | 8084 | C | GLY | F | 206 | −29.691 | 64.031 | −15.491 | 1.00 | 41.59 | B000 | C |
| ATOM | 8085 | O | GLY | F | 206 | −29.511 | 63.335 | −16.493 | 1.00 | 41.37 | B000 | O |
| ATOM | 8086 | N | PRO | F | 207 | −29.950 | 65.320 | −15.574 | 1.00 | 36.32 | B000 | N |
| ATOM | 8087 | CA | PRO | F | 207 | −30.143 | 65.969 | −16.875 | 1.00 | 39.41 | B000 | C |
| ATOM | 8088 | C | PRO | F | 207 | −28.881 | 66.583 | −17.484 | 1.00 | 35.53 | B000 | C |
| ATOM | 8089 | O | PRO | F | 207 | −28.943 | 67.699 | −18.000 | 1.00 | 50.85 | B000 | O |
| ATOM | 8090 | CB | PRO | F | 207 | −31.148 | 67.068 | −16.531 | 1.00 | 38.74 | B000 | C |
| ATOM | 8091 | CG | PRO | F | 207 | −30.663 | 67.508 | −15.160 | 1.00 | 35.34 | B000 | C |
| ATOM | 8092 | CD | PRO | F | 207 | −30.199 | 66.246 | −14.457 | 1.00 | 39.53 | B000 | C |
| ATOM | 8093 | N | VAL | F | 208 | −27.741 | 65.910 | −17.422 | 1.00 | 33.23 | B000 | N |
| ATOM | 8094 | CA | VAL | F | 208 | −26.468 | 66.469 | −17.858 | 1.00 | 39.13 | B000 | C |
| ATOM | 8095 | C | VAL | F | 208 | −25.919 | 65.604 | −18.985 | 1.00 | 35.96 | B000 | C |
| ATOM | 8096 | O | VAL | F | 208 | −25.881 | 64.378 | −18.856 | 1.00 | 36.23 | B000 | O |
| ATOM | 8097 | CB | VAL | F | 208 | −25.470 | 66.542 | −16.690 | 1.00 | 35.73 | B000 | C |
| ATOM | 8098 | CG1 | VAL | F | 208 | −24.205 | 67.239 | −17.130 | 1.00 | 31.91 | B000 | C |
| ATOM | 8099 | CG2 | VAL | F | 208 | −26.108 | 67.258 | −15.495 | 1.00 | 37.34 | B000 | C |
| ATOM | 8100 | N | ASN | F | 209 | −25.509 | 66.232 | −20.088 | 1.00 | 32.26 | B000 | N |
| ATOM | 8101 | CA | ASN | F | 209 | −24.855 | 65.476 | −21.157 | 1.00 | 32.97 | B000 | C |
| ATOM | 8102 | C | ASN | F | 209 | −23.617 | 64.755 | −20.626 | 1.00 | 34.25 | B000 | C |
| ATOM | 8103 | O | ASN | F | 209 | −22.796 | 65.346 | −19.917 | 1.00 | 33.13 | B000 | O |
| ATOM | 8104 | CB | ASN | F | 209 | −24.481 | 66.389 | −22.315 | 1.00 | 30.89 | B000 | C |
| ATOM | 8105 | CG | ASN | F | 209 | −25.679 | 66.764 | −23.167 | 1.00 | 37.35 | B000 | C |
| ATOM | 8106 | OD1 | ASN | F | 209 | −26.585 | 65.948 | −23.377 | 1.00 | 36.11 | B000 | O |
| ATOM | 8107 | ND2 | ASN | F | 209 | −25.682 | 67.989 | −23.685 | 1.00 | 31.49 | B000 | N |
| ATOM | 8108 | N | THR | F | 210 | −23.508 | 63.458 | −20.934 | 1.00 | 30.22 | B000 | N |
| ATOM | 8109 | CA | THR | F | 210 | −22.544 | 62.592 | −20.266 | 1.00 | 31.09 | B000 | C |
| ATOM | 8110 | C | THR | F | 210 | −21.985 | 61.559 | −21.244 | 1.00 | 34.46 | B000 | C |
| ATOM | 8111 | O | THR | F | 210 | −22.756 | 60.821 | −21.873 | 1.00 | 32.16 | B000 | O |
| ATOM | 8112 | CB | THR | F | 210 | −23.210 | 61.900 | −19.071 | 1.00 | 32.23 | B000 | C |
| ATOM | 8113 | OG1 | THR | F | 210 | −23.838 | 62.882 | −18.229 | 1.00 | 31.01 | B000 | O |
| ATOM | 8114 | CG2 | THR | F | 210 | −22.187 | 61.116 | −18.256 | 1.00 | 27.20 | B000 | C |
| ATOM | 8115 | N | TRP | F | 211 | −20.650 | 61.510 | −21.371 | 1.00 | 29.01 | B000 | N |
| ATOM | 8116 | CA | TRP | F | 211 | −19.987 | 60.567 | −22.278 | 1.00 | 30.78 | B000 | C |
| ATOM | 8117 | C | TRP | F | 211 | −20.208 | 59.116 | −21.857 | 1.00 | 33.57 | B000 | C |
| ATOM | 8118 | O | TRP | F | 211 | −20.215 | 58.792 | −20.667 | 1.00 | 33.68 | B000 | O |
| ATOM | 8119 | CB | TRP | F | 211 | −18.473 | 60.834 | −22.329 | 1.00 | 28.32 | B000 | C |
| ATOM | 8120 | CG | TRP | F | 211 | −18.041 | 62.091 | −23.074 | 1.00 | 29.99 | B000 | C |
| ATOM | 8121 | CD1 | TRP | F | 211 | −17.177 | 63.044 | −22.623 | 1.00 | 28.61 | B000 | C |
| ATOM | 8122 | CD2 | TRP | F | 211 | −18.423 | 62.498 | −24.404 | 1.00 | 30.26 | B000 | C |
| ATOM | 8123 | NE1 | TRP | F | 211 | −16.989 | 64.012 | −23.580 | 1.00 | 32.26 | B000 | N |
| ATOM | 8124 | CE2 | TRP | F | 211 | −17.742 | 63.709 | −24.681 | 1.00 | 29.27 | B000 | C |
| ATOM | 8125 | CE3 | TRP | F | 211 | −19.273 | 61.958 | −25.381 | 1.00 | 26.34 | B000 | C |
| ATOM | 8126 | CZ2 | TRP | F | 211 | −17.891 | 64.402 | −25.888 | 1.00 | 28.81 | B000 | C |
| ATOM | 8127 | CZ3 | TRP | F | 211 | −19.431 | 62.640 | −26.575 | 1.00 | 28.36 | B000 | C |
| ATOM | 8128 | CH2 | TRP | F | 211 | −18.739 | 63.866 | −26.818 | 1.00 | 34.89 | B000 | C |
| ATOM | 8129 | N | MET | F | 212 | −20.359 | 58.232 | −22.845 | 1.00 | 36.13 | B000 | N |
| ATOM | 8130 | CA | MET | F | 212 | −20.261 | 56.789 | −22.634 | 1.00 | 36.28 | B000 | C |
| ATOM | 8131 | C | MET | F | 212 | −19.149 | 56.198 | −23.506 | 1.00 | 41.20 | B000 | C |
| ATOM | 8132 | O | MET | F | 212 | −18.610 | 56.848 | −24.412 | 1.00 | 38.23 | B000 | O |
| ATOM | 8133 | CB | MET | F | 212 | −21.598 | 56.096 | −22.919 | 1.00 | 36.01 | B000 | C |
| ATOM | 8134 | CG | MET | F | 212 | −21.950 | 55.930 | −24.386 | 1.00 | 32.65 | B000 | C |
| ATOM | 8135 | SD | MET | F | 212 | −23.698 | 55.486 | −24.615 | 1.00 | 40.40 | B000 | S |
| ATOM | 8136 | CE | MET | F | 212 | −24.541 | 57.090 | −24.376 | 1.00 | 32.88 | B000 | C |
| ATOM | 8137 | N | GLY | F | 213 | −18.810 | 54.942 | −23.233 | 1.00 | 41.45 | B000 | N |
| ATOM | 8138 | CA | GLY | F | 213 | −17.729 | 54.287 | −23.952 | 1.00 | 36.96 | B000 | C |
| ATOM | 8139 | C | GLY | F | 213 | −18.090 | 53.824 | −25.345 | 1.00 | 39.99 | B000 | C |
| ATOM | 8140 | O | GLY | F | 213 | −17.905 | 52.645 | −25.677 | 1.00 | 38.24 | B000 | O |
| ATOM | 8141 | N | LEU | F | 214 | −18.614 | 54.732 | −26.173 | 1.00 | 34.09 | B000 | N |
| ATOM | 8142 | CA | LEU | F | 214 | −19.135 | 54.371 | −27.489 | 1.00 | 37.28 | B000 | C |
| ATOM | 8143 | C | LEU | F | 214 | −18.700 | 55.449 | −28.470 | 1.00 | 36.04 | B000 | C |
| ATOM | 8144 | O | LEU | F | 214 | −18.965 | 56.632 | −28.244 | 1.00 | 38.95 | B000 | O |
| ATOM | 8145 | CB | LEU | F | 214 | −20.673 | 54.216 | −27.453 | 1.00 | 36.90 | B000 | C |
| ATOM | 8146 | CG | LEU | F | 214 | −21.474 | 53.990 | −28.753 | 1.00 | 39.75 | B000 | C |
| ATOM | 8147 | CD1 | LEU | F | 214 | −20.997 | 52.758 | −29.501 | 1.00 | 40.07 | B000 | C |
| ATOM | 8148 | CD2 | LEU | F | 214 | −22.967 | 53.871 | −28.493 | 1.00 | 34.46 | B000 | C |

TABLE 10.3-continued

| | | | | | | | | | | | |
|---|---|---|---|---|---|---|---|---|---|---|---|
| ATOM | 8149 | N | HIS | F | 215 | −18.023 | 55.054 | −29.545 | 1.00 | 41.21 | B000 | N |
| ATOM | 8150 | CA | HIS | F | 215 | −17.454 | 56.028 | −30.471 | 1.00 | 43.32 | B000 | C |
| ATOM | 8151 | C | HIS | F | 215 | −17.360 | 55.421 | −31.860 | 1.00 | 44.63 | B000 | C |
| ATOM | 8152 | O | HIS | F | 215 | −17.496 | 54.209 | −32.041 | 1.00 | 41.89 | B000 | O |
| ATOM | 8153 | CB | HIS | F | 215 | −16.081 | 56.493 | −30.014 | 1.00 | 37.84 | B000 | C |
| ATOM | 8154 | CG | HIS | F | 215 | −15.059 | 55.406 | −30.023 | 1.00 | 48.13 | B000 | C |
| ATOM | 8155 | ND1 | HIS | F | 215 | −14.161 | 55.238 | −31.054 | 1.00 | 51.31 | B000 | N |
| ATOM | 8156 | CD2 | HIS | F | 215 | −14.806 | 54.416 | −29.137 | 1.00 | 50.71 | B000 | C |
| ATOM | 8157 | CE1 | HIS | F | 215 | −13.391 | 54.198 | −30.797 | 1.00 | 52.71 | B000 | C |
| ATOM | 8158 | NE2 | HIS | F | 215 | −13.760 | 53.683 | −29.639 | 1.00 | 46.57 | B000 | N |
| ATOM | 8159 | N | ASP | F | 216 | −17.144 | 56.288 | −32.853 | 1.00 | 40.97 | B000 | N |
| ATOM | 8160 | CA | ASP | F | 216 | −17.135 | 55.874 | −34.252 | 1.00 | 42.50 | B000 | C |
| ATOM | 8161 | C | ASP | F | 216 | −15.783 | 56.113 | −34.912 | 1.00 | 43.44 | B000 | C |
| ATOM | 8162 | O | ASP | F | 216 | −15.701 | 56.251 | −36.131 | 1.00 | 42.45 | B000 | O |
| ATOM | 8163 | CB | ASP | F | 216 | −18.241 | 56.589 | −35.029 | 1.00 | 40.42 | B000 | C |
| ATOM | 8164 | CG | ASP | F | 216 | −17.950 | 58.067 | −35.268 | 1.00 | 43.85 | B000 | C |
| ATOM | 8165 | OD1 | ASP | F | 216 | −16.970 | 58.617 | −34.703 | 1.00 | 43.41 | B000 | O |
| ATOM | 8166 | OD2 | ASP | F | 216 | −18.733 | 58.690 | −36.024 | 1.00 | 45.80 | B000 | O1− |
| ATOM | 8167 | N | GLN | F | 217 | −14.710 | 56.137 | −34.128 | 1.00 | 51.10 | B000 | N |
| ATOM | 8168 | CA | GLN | F | 217 | −13.512 | 56.817 | −34.600 | 1.00 | 58.50 | B000 | C |
| ATOM | 8169 | C | GLN | F | 217 | −12.746 | 56.030 | −35.663 | 1.00 | 59.01 | B000 | C |
| ATOM | 8170 | O | GLN | F | 217 | −11.858 | 56.600 | −36.302 | 1.00 | 64.06 | B000 | O |
| ATOM | 8171 | CB | GLN | F | 217 | −12.653 | 57.214 | −33.385 | 1.00 | 60.37 | B000 | C |
| ATOM | 8172 | CG | GLN | F | 217 | −13.415 | 58.358 | −32.581 | 1.00 | 65.68 | B000 | C |
| ATOM | 8173 | CD | GLN | F | 217 | −12.601 | 59.087 | −31.493 | 1.00 | 70.67 | B000 | C |
| ATOM | 8174 | OE1 | GLN | F | 217 | −12.640 | 58.714 | −30.307 | 1.00 | 52.11 | B000 | O |
| ATOM | 8175 | NE2 | GLN | F | 217 | −11.925 | 60.175 | −31.884 | 1.00 | 67.51 | B000 | N |
| ATOM | 8176 | N | ASN | F | 218 | −13.108 | 54.777 | −35.930 | 1.00 | 52.55 | B000 | N |
| ATOM | 8177 | CA | ASN | F | 218 | −12.597 | 54.084 | −37.103 | 1.00 | 58.15 | B000 | C |
| ATOM | 8178 | C | ASN | F | 218 | −13.615 | 53.968 | −38.223 | 1.00 | 65.45 | B000 | C |
| ATOM | 8179 | O | ASN | F | 218 | −13.292 | 53.430 | −39.289 | 1.00 | 62.69 | B000 | O |
| ATOM | 8180 | CB | ASN | F | 218 | −12.114 | 52.698 | −36.724 | 1.00 | 71.05 | B000 | C |
| ATOM | 8181 | CG | ASN | F | 218 | −10.817 | 52.743 | −35.976 | 1.00 | 81.96 | B000 | C |
| ATOM | 8182 | OD1 | ASN | F | 218 | −10.715 | 52.221 | −34.854 | 1.00 | 76.60 | B000 | O |
| ATOM | 8183 | ND2 | ASN | F | 218 | −9.816 | 53.410 | −36.568 | 1.00 | 58.18 | B000 | N |
| ATOM | 8184 | N | GLY | F | 219 | −14.834 | 54.440 | −38.007 | 1.00 | 51.95 | B000 | N |
| ATOM | 8185 | CA | GLY | F | 219 | −15.897 | 54.245 | −38.957 | 1.00 | 50.90 | B000 | C |
| ATOM | 8186 | C | GLY | F | 219 | −17.074 | 53.561 | −38.292 | 1.00 | 41.92 | B000 | C |
| ATOM | 8187 | O | GLY | F | 219 | −18.131 | 54.156 | −38.073 | 1.00 | 49.46 | B000 | O |
| ATOM | 8188 | N | PRO | F | 220 | −16.902 | 52.297 | −37.938 | 1.00 | 48.10 | B000 | N |
| ATOM | 8189 | CA | PRO | F | 220 | −17.984 | 51.582 | −37.251 | 1.00 | 50.76 | B000 | C |
| ATOM | 8190 | C | PRO | F | 220 | −18.125 | 52.032 | −35.803 | 1.00 | 45.49 | B000 | C |
| ATOM | 8191 | O | PRO | F | 220 | −17.137 | 52.233 | −35.095 | 1.00 | 50.03 | B000 | O |
| ATOM | 8192 | CB | PRO | F | 220 | −17.550 | 50.113 | −37.340 | 1.00 | 44.33 | B000 | C |
| ATOM | 8193 | CG | PRO | F | 220 | −16.058 | 50.172 | −37.501 | 1.00 | 53.78 | B000 | C |
| ATOM | 8194 | CD | PRO | F | 220 | −15.762 | 51.421 | −38.268 | 1.00 | 48.76 | B000 | C |
| ATOM | 8195 | N | TRP | F | 221 | −19.371 | 52.181 | −35.365 | 1.00 | 42.06 | B000 | N |
| ATOM | 8196 | CA | TRP | F | 221 | −19.631 | 52.403 | −33.953 | 1.00 | 44.69 | B000 | C |
| ATOM | 8197 | C | TRP | F | 221 | −19.168 | 51.194 | −33.147 | 1.00 | 38.24 | B000 | C |
| ATOM | 8198 | O | TRP | F | 221 | −19.473 | 50.053 | −33.498 | 1.00 | 49.53 | B000 | O |
| ATOM | 8199 | CB | TRP | F | 221 | −21.123 | 52.668 | −33.733 | 1.00 | 41.17 | B000 | C |
| ATOM | 8200 | CG | TRP | F | 221 | −21.529 | 54.055 | −34.121 | 1.00 | 43.26 | B000 | C |
| ATOM | 8201 | CD1 | TRP | F | 221 | −22.156 | 54.450 | −35.268 | 1.00 | 36.74 | B000 | C |
| ATOM | 8202 | CD2 | TRP | F | 221 | −21.300 | 55.244 | −33.355 | 1.00 | 34.96 | B000 | C |
| ATOM | 8203 | NE1 | TRP | F | 221 | −22.336 | 55.817 | −35.259 | 1.00 | 35.73 | B000 | N |
| ATOM | 8204 | CE2 | TRP | F | 221 | −21.824 | 56.322 | −34.089 | 1.00 | 37.88 | B000 | C |
| ATOM | 8205 | CE3 | TRP | F | 221 | −20.709 | 55.492 | −32.116 | 1.00 | 35.21 | B000 | C |
| ATOM | 8206 | CZ2 | TRP | F | 221 | −21.781 | 57.639 | −33.617 | 1.00 | 42.62 | B000 | C |
| ATOM | 8207 | CZ3 | TRP | F | 221 | −20.663 | 56.791 | −31.648 | 1.00 | 39.03 | B000 | C |
| ATOM | 8208 | CH2 | TRP | F | 221 | −21.194 | 57.848 | −32.395 | 1.00 | 38.23 | B000 | C |
| ATOM | 8209 | N | LYS | F | 222 | −18.432 | 51.450 | −32.065 | 1.00 | 41.84 | B000 | N |
| ATOM | 8210 | CA | LYS | F | 222 | −17.829 | 50.409 | −31.245 | 1.00 | 41.88 | B000 | C |
| ATOM | 8211 | C | LYS | F | 222 | −17.885 | 50.777 | −29.770 | 1.00 | 45.01 | B000 | C |
| ATOM | 8212 | O | LYS | F | 222 | −17.788 | 51.953 | −29.409 | 1.00 | 38.97 | B000 | O |
| ATOM | 8213 | CB | LYS | F | 222 | −16.367 | 50.176 | −31.639 | 1.00 | 47.29 | B000 | C |
| ATOM | 8214 | CG | LYS | F | 222 | −16.184 | 49.600 | −33.033 | 1.00 | 60.26 | B000 | C |
| ATOM | 8215 | CD | LYS | F | 222 | −14.729 | 49.672 | −33.464 | 1.00 | 61.80 | B000 | C |
| ATOM | 8216 | CE | LYS | F | 222 | −14.371 | 51.081 | −33.924 | 1.00 | 69.59 | B000 | C |
| ATOM | 8217 | NZ | LYS | F | 222 | −13.030 | 51.109 | −34.562 | 1.00 | 80.69 | B000 | N1+ |
| ATOM | 8218 | N | TRP | F | 223 | −18.007 | 49.751 | −28.918 | 1.00 | 43.07 | B000 | N |
| ATOM | 8219 | CA | TRP | F | 223 | −17.864 | 49.911 | −27.476 | 1.00 | 42.29 | B000 | C |
| ATOM | 8220 | C | TRP | F | 223 | −16.411 | 49.702 | −27.074 | 1.00 | 45.99 | B000 | C |
| ATOM | 8221 | O | TRP | F | 223 | −15.708 | 48.879 | −27.661 | 1.00 | 52.22 | B000 | O |
| ATOM | 8222 | CB | TRP | F | 223 | −18.762 | 48.940 | −26.696 | 1.00 | 41.28 | B000 | C |
| ATOM | 8223 | CG | TRP | F | 223 | −20.258 | 49.200 | −26.825 | 1.00 | 43.60 | B000 | C |
| ATOM | 8224 | CD1 | TRP | F | 223 | −21.155 | 48.512 | −27.605 | 1.00 | 41.95 | B000 | C |
| ATOM | 8225 | CD2 | TRP | F | 223 | −21.014 | 50.224 | −26.158 | 1.00 | 45.65 | B000 | C |
| ATOM | 8226 | NE1 | TRP | F | 223 | −22.422 | 49.047 | −27.462 | 1.00 | 42.77 | B000 | N |
| ATOM | 8227 | CE2 | TRP | F | 223 | −22.366 | 50.089 | −26.575 | 1.00 | 41.46 | B000 | C |
| ATOM | 8228 | CE3 | TRP | F | 223 | −20.684 | 51.237 | −25.249 | 1.00 | 40.03 | B000 | C |

TABLE 10.3-continued

| | | | | | | | | | | | |
|---|---|---|---|---|---|---|---|---|---|---|---|
| ATOM | 8229 | CZ2 | TRP | F | 223 | −23.376 | 50.933 | −26.118 | 1.00 | 42.16 | B000 C |
| ATOM | 8230 | CZ3 | TRP | F | 223 | −21.695 | 52.075 | −24.792 | 1.00 | 38.55 | B000 C |
| ATOM | 8231 | CH2 | TRP | F | 223 | −23.023 | 51.918 | −25.225 | 1.00 | 39.46 | B000 C |
| ATOM | 8232 | N | VAL | F | 224 | −15.966 | 50.458 | −26.065 | 1.00 | 39.89 | B000 N |
| ATOM | 8233 | CA | VAL | F | 224 | −14.557 | 50.478 | −25.696 | 1.00 | 41.43 | B000 C |
| ATOM | 8234 | C | VAL | F | 224 | −14.084 | 49.166 | −25.090 | 1.00 | 43.72 | B000 C |
| ATOM | 8235 | O | VAL | F | 224 | −12.878 | 48.924 | −25.048 | 1.00 | 41.80 | B000 O |
| ATOM | 8236 | CB | VAL | F | 224 | −14.257 | 51.635 | −24.718 | 1.00 | 38.57 | B000 C |
| ATOM | 8237 | CG1 | VAL | F | 224 | −14.434 | 52.978 | −25.419 | 1.00 | 35.91 | B000 C |
| ATOM | 8238 | CG2 | VAL | F | 224 | −15.154 | 51.522 | −23.509 | 1.00 | 37.24 | B000 C |
| ATOM | 8239 | N | ASP | F | 225 | −14.978 | 48.330 | −24.572 | 1.00 | 44.78 | B000 N |
| ATOM | 8240 | CA | ASP | F | 225 | −14.559 | 47.074 | −23.971 | 1.00 | 40.21 | B000 C |
| ATOM | 8241 | C | ASP | F | 225 | −14.719 | 45.908 | −24.924 | 1.00 | 47.22 | B000 C |
| ATOM | 8242 | O | ASP | F | 225 | −14.534 | 44.763 | −24.513 | 1.00 | 49.29 | B000 O |
| ATOM | 8243 | CB | ASP | F | 225 | −15.321 | 46.788 | −22.679 | 1.00 | 41.32 | B000 C |
| ATOM | 8244 | CG | ASP | F | 225 | −16.790 | 46.487 | −22.914 | 1.00 | 46.80 | B000 C |
| ATOM | 8245 | OD1 | ASP | F | 225 | −17.305 | 46.755 | −24.021 | 1.00 | 40.18 | B000 O |
| ATOM | 8246 | OD2 | ASP | F | 225 | −17.426 | 45.946 | −21.982 | 1.00 | 55.82 | B000 O1− |
| ATOM | 8247 | N | GLY | F | 226 | −15.078 | 46.173 | −26.181 | 1.00 | 46.15 | B000 N |
| ATOM | 8248 | CA | GLY | F | 226 | −15.202 | 45.151 | −27.189 | 1.00 | 44.93 | B000 C |
| ATOM | 8249 | C | GLY | F | 226 | −16.606 | 44.610 | −27.394 | 1.00 | 49.56 | B000 C |
| ATOM | 8250 | O | GLY | F | 226 | −16.858 | 43.993 | −28.440 | 1.00 | 52.14 | B000 O |
| ATOM | 8251 | N | THR | F | 227 | −17.522 | 44.843 | −26.443 | 1.00 | 45.78 | B000 N |
| ATOM | 8252 | CA | THR | F | 227 | −18.938 | 44.496 | −26.585 | 1.00 | 38.28 | B000 C |
| ATOM | 8253 | C | THR | F | 227 | −19.437 | 44.781 | −27.996 | 1.00 | 49.56 | B000 C |
| ATOM | 8254 | O | THR | F | 227 | −19.216 | 45.868 | −28.544 | 1.00 | 51.44 | B000 O |
| ATOM | 8255 | CB | THR | F | 227 | −19.779 | 45.282 | −25.571 | 1.00 | 46.77 | B000 C |
| ATOM | 8256 | OG1 | THR | F | 227 | −19.284 | 45.062 | −24.244 | 1.00 | 49.45 | B000 O |
| ATOM | 8257 | CG2 | THR | F | 227 | −21.244 | 44.872 | −25.628 | 1.00 | 32.96 | B000 C |
| ATOM | 8258 | N | ASP | F | 228 | −20.089 | 43.791 | −28.594 | 1.00 | 48.42 | B000 N |
| ATOM | 8259 | CA | ASP | F | 228 | −20.557 | 43.942 | −29.964 | 1.00 | 52.56 | B000 C |
| ATOM | 8260 | C | ASP | F | 228 | −21.653 | 44.996 | −30.034 | 1.00 | 47.16 | B000 C |
| ATOM | 8261 | O | ASP | F | 228 | −22.638 | 44.926 | −29.297 | 1.00 | 54.76 | B000 O |
| ATOM | 8262 | CB | ASP | F | 228 | −21.080 | 42.609 | −30.513 | 1.00 | 52.04 | B000 C |
| ATOM | 8263 | CG | ASP | F | 228 | −21.620 | 42.741 | −31.938 | 1.00 | 51.96 | B000 C |
| ATOM | 8264 | OD1 | ASP | F | 228 | −20.800 | 42.871 | −32.867 | 1.00 | 55.04 | B000 O |
| ATOM | 8265 | OD2 | ASP | F | 228 | −22.857 | 42.731 | −32.133 | 1.00 | 53.62 | B000 O1− |
| ATOM | 8266 | N | TYR | F | 229 | −21.480 | 45.975 | −30.926 | 1.00 | 49.63 | B000 N |
| ATOM | 8267 | CA | TYR | F | 229 | −22.438 | 47.072 | −31.032 | 1.00 | 51.91 | B000 C |
| ATOM | 8268 | C | TYR | F | 229 | −23.725 | 46.641 | −31.741 | 1.00 | 51.02 | B000 C |
| ATOM | 8269 | O | TYR | F | 229 | −24.823 | 47.054 | −31.343 | 1.00 | 48.95 | B000 O |
| ATOM | 8270 | CB | TYR | F | 229 | −21.800 | 48.280 | −31.749 | 1.00 | 41.08 | B000 C |
| ATOM | 8271 | CG | TYR | F | 229 | −22.801 | 49.368 | −32.155 | 1.00 | 42.20 | B000 C |
| ATOM | 8272 | CD1 | TYR | F | 229 | −23.377 | 50.216 | −31.208 | 1.00 | 40.58 | B000 C |
| ATOM | 8273 | CD2 | TYR | F | 229 | −23.178 | 49.530 | −33.482 | 1.00 | 40.58 | B000 C |
| ATOM | 8274 | CE1 | TYR | F | 229 | −24.293 | 51.223 | −31.586 | 1.00 | 37.62 | B000 C |
| ATOM | 8275 | CE2 | TYR | F | 229 | −24.088 | 50.511 | −33.864 | 1.00 | 42.49 | B000 C |
| ATOM | 8276 | CZ | TYR | F | 229 | −24.634 | 51.359 | −32.910 | 1.00 | 40.45 | B000 C |
| ATOM | 8277 | OH | TYR | F | 229 | −25.527 | 52.323 | −33.311 | 1.00 | 45.55 | B000 O |
| ATOM | 8278 | N | GLU | F | 230 | −23.605 | 45.833 | −32.800 | 1.00 | 57.91 | B000 N |
| ATOM | 8279 | CA | GLU | F | 230 | −24.743 | 45.560 | −33.679 | 1.00 | 55.10 | B000 C |
| ATOM | 8280 | C | GLU | F | 230 | −25.831 | 44.782 | −32.956 | 1.00 | 53.04 | B000 C |
| ATOM | 8281 | O | GLU | F | 230 | −27.014 | 45.118 | −33.055 | 1.00 | 52.09 | B000 O |
| ATOM | 8282 | CB | GLU | F | 230 | −24.273 | 44.782 | −34.909 | 1.00 | 58.23 | B000 C |
| ATOM | 8283 | CG | GLU | F | 230 | −25.270 | 44.727 | −36.048 | 1.00 | 61.69 | B000 C |
| ATOM | 8284 | CD | GLU | F | 230 | −25.912 | 46.067 | −36.325 | 1.00 | 76.73 | B000 C |
| ATOM | 8285 | OE1 | GLU | F | 230 | −27.160 | 46.119 | −36.285 | 1.00 | 75.40 | B000 O |
| ATOM | 8286 | OE2 | GLU | F | 230 | −25.178 | 47.067 | −36.556 | 1.00 | 78.82 | B000 O1− |
| ATOM | 8287 | N | THR | F | 231 | −25.449 | 43.767 | −32.201 | 1.00 | 51.54 | B000 N |
| ATOM | 8288 | CA | THR | F | 231 | −26.410 | 42.954 | −31.478 | 1.00 | 55.16 | B000 C |
| ATOM | 8289 | C | THR | F | 231 | −26.687 | 43.461 | −30.072 | 1.00 | 58.68 | B000 C |
| ATOM | 8290 | O | THR | F | 231 | −27.516 | 42.866 | −29.371 | 1.00 | 54.74 | B000 O |
| ATOM | 8291 | CB | THR | F | 231 | −25.922 | 41.510 | −31.415 | 1.00 | 49.05 | B000 C |
| ATOM | 8292 | OG1 | THR | F | 231 | −24.684 | 41.463 | −30.698 | 1.00 | 52.11 | B000 O |
| ATOM | 8293 | CG2 | THR | F | 231 | −25.715 | 40.964 | −32.820 | 1.00 | 45.52 | B000 C |
| ATOM | 8294 | N | GLY | F | 232 | −26.030 | 44.546 | −29.646 | 1.00 | 55.48 | B000 N |
| ATOM | 8295 | CA | GLY | F | 232 | −26.155 | 45.022 | −28.285 | 1.00 | 46.35 | B000 C |
| ATOM | 8296 | C | GLY | F | 232 | −27.303 | 46.007 | −28.088 | 1.00 | 42.93 | B000 C |
| ATOM | 8297 | O | GLY | F | 232 | −27.997 | 46.417 | −29.016 | 1.00 | 45.48 | B000 O |
| ATOM | 8298 | N | PHE | F | 233 | −27.484 | 46.390 | −26.830 | 1.00 | 40.91 | B000 N |
| ATOM | 8299 | CA | PHE | F | 233 | −28.463 | 47.401 | −26.462 | 1.00 | 38.08 | B000 C |
| ATOM | 8300 | C | PHE | F | 233 | −28.162 | 48.738 | −27.146 | 1.00 | 45.77 | B000 C |
| ATOM | 8301 | O | PHE | F | 233 | −26.997 | 49.125 | −27.305 | 1.00 | 39.98 | B000 O |
| ATOM | 8302 | CB | PHE | F | 233 | −28.440 | 47.548 | −24.939 | 1.00 | 42.77 | B000 C |
| ATOM | 8303 | CG | PHE | F | 233 | −29.411 | 48.544 | −24.406 | 1.00 | 46.27 | B000 C |
| ATOM | 8304 | CD1 | PHE | F | 233 | −30.749 | 48.224 | −24.274 | 1.00 | 47.88 | B000 C |
| ATOM | 8305 | CD2 | PHE | F | 233 | −28.981 | 49.804 | −24.013 | 1.00 | 42.70 | B000 C |
| ATOM | 8306 | CE1 | PHE | F | 233 | −31.650 | 49.153 | −23.777 | 1.00 | 51.88 | B000 C |
| ATOM | 8307 | CE2 | PHE | F | 233 | −29.871 | 50.726 | −23.515 | 1.00 | 41.09 | B000 C |
| ATOM | 8308 | CZ | PHE | F | 233 | −31.206 | 50.404 | −23.391 | 1.00 | 45.56 | B000 C |

TABLE 10.3-continued

| ATOM | 8309 | N   | LYS | F | 234 | −29.225 | 49.439 | −27.562 | 1.00 | 40.43 | B000 | N   |
|------|------|-----|-----|---|-----|---------|--------|---------|------|-------|------|-----|
| ATOM | 8310 | CA  | LYS | F | 234 | −29.131 | 50.788 | −28.118 | 1.00 | 41.63 | B000 | C   |
| ATOM | 8311 | C   | LYS | F | 234 | −30.309 | 51.634 | −27.654 | 1.00 | 46.34 | B000 | C   |
| ATOM | 8312 | O   | LYS | F | 234 | −31.441 | 51.156 | −27.610 | 1.00 | 48.63 | B000 | O   |
| ATOM | 8313 | CB  | LYS | F | 234 | −29.123 | 50.778 | −29.649 | 1.00 | 44.55 | B000 | C   |
| ATOM | 8314 | CG  | LYS | F | 234 | −27.951 | 50.067 | −30.289 | 1.00 | 40.30 | B000 | C   |
| ATOM | 8315 | CD  | LYS | F | 234 | −28.092 | 50.103 | −31.807 | 1.00 | 43.14 | B000 | C   |
| ATOM | 8316 | CE  | LYS | F | 234 | −27.123 | 49.127 | −32.446 | 1.00 | 48.35 | B000 | C   |
| ATOM | 8317 | NZ  | LYS | F | 234 | −27.471 | 47.729 | −32.045 | 1.00 | 53.70 | B000 | N1+ |
| ATOM | 8318 | N   | ASN | F | 235 | −30.060 | 52.909 | −27.362 | 1.00 | 47.83 | B000 | N   |
| ATOM | 8319 | CA  | ASN | F | 235 | −31.120 | 53.815 | −26.906 | 1.00 | 38.15 | B000 | C   |
| ATOM | 8320 | C   | ASN | F | 235 | −30.936 | 55.217 | −27.509 | 1.00 | 39.90 | B000 | C   |
| ATOM | 8321 | O   | ASN | F | 235 | −30.978 | 56.235 | −26.819 | 1.00 | 38.13 | B000 | O   |
| ATOM | 8322 | CB  | ASN | F | 235 | −31.154 | 53.827 | −25.376 | 1.00 | 37.57 | B000 | C   |
| ATOM | 8323 | CG  | ASN | F | 235 | −32.291 | 54.652 | −24.816 | 1.00 | 44.55 | B000 | C   |
| ATOM | 8324 | OD1 | ASN | F | 235 | −33.337 | 54.797 | −25.445 | 1.00 | 47.07 | B000 | O   |
| ATOM | 8325 | ND2 | ASN | F | 235 | −32.088 | 55.204 | −23.620 | 1.00 | 46.24 | B000 | N   |
| ATOM | 8326 | N   | TRP | F | 236 | −30.749 | 55.278 | −28.826 | 1.00 | 36.87 | B000 | N   |
| ATOM | 8327 | CA  | TRP | F | 236 | −30.517 | 56.540 | −29.518 | 1.00 | 38.92 | B000 | C   |
| ATOM | 8328 | C   | TRP | F | 236 | −31.753 | 57.439 | −29.510 | 1.00 | 41.60 | B000 | C   |
| ATOM | 8329 | O   | TRP | F | 236 | −32.890 | 56.967 | −29.580 | 1.00 | 44.93 | B000 | O   |
| ATOM | 8330 | CB  | TRP | F | 236 | −30.123 | 56.288 | −30.973 | 1.00 | 32.28 | B000 | C   |
| ATOM | 8331 | CG  | TRP | F | 236 | −28.813 | 55.606 | −31.170 | 1.00 | 44.09 | B000 | C   |
| ATOM | 8332 | CD1 | TRP | F | 236 | −28.612 | 54.296 | −31.518 | 1.00 | 40.32 | B000 | C   |
| ATOM | 8333 | CD2 | TRP | F | 236 | −27.511 | 56.192 | −31.037 | 1.00 | 41.90 | B000 | C   |
| ATOM | 8334 | NE1 | TRP | F | 236 | −27.266 | 54.034 | −31.608 | 1.00 | 35.68 | B000 | N   |
| ATOM | 8335 | CE2 | TRP | F | 236 | −26.568 | 55.182 | −31.327 | 1.00 | 41.49 | B000 | C   |
| ATOM | 8336 | CE3 | TRP | F | 236 | −27.051 | 57.474 | −30.700 | 1.00 | 37.67 | B000 | C   |
| ATOM | 8337 | CZ2 | TRP | F | 236 | −25.183 | 55.420 | −31.300 | 1.00 | 41.56 | B000 | C   |
| ATOM | 8338 | CZ3 | TRP | F | 236 | −25.686 | 57.715 | −30.683 | 1.00 | 37.32 | B000 | C   |
| ATOM | 8339 | CH2 | TRP | F | 236 | −24.762 | 56.689 | −30.982 | 1.00 | 41.77 | B000 | C   |
| ATOM | 8340 | N   | ARG | F | 237 | −31.508 | 58.757 | −29.481 | 1.00 | 35.83 | B000 | N   |
| ATOM | 8341 | CA  | ARG | F | 237 | −32.537 | 59.734 | −29.801 | 1.00 | 44.59 | B000 | C   |
| ATOM | 8342 | C   | ARG | F | 237 | −33.103 | 59.444 | −31.181 | 1.00 | 48.74 | B000 | C   |
| ATOM | 8343 | O   | ARG | F | 237 | −32.434 | 58.828 | −32.017 | 1.00 | 49.21 | B000 | O   |
| ATOM | 8344 | CB  | ARG | F | 237 | −31.976 | 61.164 | −29.788 | 1.00 | 36.97 | B000 | C   |
| ATOM | 8345 | CG  | ARG | F | 237 | −31.858 | 61.766 | −28.411 | 1.00 | 45.68 | B000 | C   |
| ATOM | 8346 | CD  | ARG | F | 237 | −33.080 | 62.584 | −28.086 | 1.00 | 53.50 | B000 | C   |
| ATOM | 8347 | NE  | ARG | F | 237 | −32.997 | 63.225 | −26.778 | 1.00 | 54.24 | B000 | N   |
| ATOM | 8348 | CZ  | ARG | F | 237 | −32.798 | 64.523 | −26.580 | 1.00 | 66.27 | B000 | C   |
| ATOM | 8349 | NH1 | ARG | F | 237 | −32.738 | 65.003 | −25.335 | 1.00 | 53.38 | B000 | N1+ |
| ATOM | 8350 | NH2 | ARG | F | 237 | −32.650 | 65.337 | −27.621 | 1.00 | 69.85 | B000 | N   |
| ATOM | 8351 | N   | PRO | F | 238 | −34.326 | 59.897 | −31.447 | 1.00 | 53.51 | B000 | N   |
| ATOM | 8352 | CA  | PRO | F | 238 | −34.896 | 59.751 | −32.790 | 1.00 | 53.89 | B000 | C   |
| ATOM | 8353 | C   | PRO | F | 238 | −33.963 | 60.284 | −33.869 | 1.00 | 55.90 | B000 | C   |
| ATOM | 8354 | O   | PRO | F | 238 | −33.458 | 61.409 | −33.783 | 1.00 | 47.93 | B000 | O   |
| ATOM | 8355 | CB  | PRO | F | 238 | −36.184 | 60.577 | −32.707 | 1.00 | 53.03 | B000 | C   |
| ATOM | 8356 | CG  | PRO | F | 238 | −36.568 | 60.511 | −31.263 | 1.00 | 50.27 | B000 | C   |
| ATOM | 8357 | CD  | PRO | F | 238 | −35.285 | 60.495 | −30.496 | 1.00 | 54.51 | B000 | C   |
| ATOM | 8358 | N   | GLU | F | 239 | −33.727 | 59.454 | −34.887 | 1.00 | 48.36 | B000 | N   |
| ATOM | 8359 | CA  | GLU | F | 239 | −32.951 | 59.792 | −36.076 | 1.00 | 55.08 | B000 | C   |
| ATOM | 8360 | C   | GLU | F | 239 | −31.463 | 59.925 | −35.799 | 1.00 | 51.71 | B000 | C   |
| ATOM | 8361 | O   | GLU | F | 239 | −30.717 | 60.378 | −36.673 | 1.00 | 53.39 | B000 | O   |
| ATOM | 8362 | CB  | GLU | F | 239 | −33.471 | 61.081 | −36.715 | 1.00 | 54.02 | B000 | C   |
| ATOM | 8363 | CG  | GLU | F | 239 | −34.894 | 60.933 | −37.217 | 1.00 | 64.17 | B000 | C   |
| ATOM | 8364 | CD  | GLU | F | 239 | −35.603 | 62.267 | −37.357 | 1.00 | 82.12 | B000 | C   |
| ATOM | 8365 | OE1 | GLU | F | 239 | −34.947 | 63.318 | −37.174 | 1.00 | 79.31 | B000 | O   |
| ATOM | 8366 | OE2 | GLU | F | 239 | −36.828 | 62.260 | −37.609 | 1.00 | 90.31 | B000 | O1− |
| ATOM | 8367 | N   | GLN | F | 240 | −31.010 | 59.539 | −34.613 | 1.00 | 45.35 | B000 | N   |
| ATOM | 8368 | CA  | GLN | F | 240 | −29.594 | 59.480 | −34.313 | 1.00 | 45.02 | B000 | C   |
| ATOM | 8369 | C   | GLN | F | 240 | −29.207 | 58.001 | −34.305 | 1.00 | 40.34 | B000 | C   |
| ATOM | 8370 | O   | GLN | F | 240 | −30.041 | 57.164 | −33.989 | 1.00 | 38.58 | B000 | O   |
| ATOM | 8371 | CB  | GLN | F | 240 | −29.274 | 60.163 | −32.964 | 1.00 | 40.27 | B000 | C   |
| ATOM | 8372 | CG  | GLN | F | 240 | −29.798 | 61.588 | −32.801 | 1.00 | 35.48 | B000 | C   |
| ATOM | 8373 | CD  | GLN | F | 240 | −29.552 | 62.460 | −34.038 | 1.00 | 52.50 | B000 | C   |
| ATOM | 8374 | OE1 | GLN | F | 240 | −28.448 | 62.496 | −34.599 | 1.00 | 44.08 | B000 | O   |
| ATOM | 8375 | NE2 | GLN | F | 240 | −30.594 | 63.166 | −34.470 | 1.00 | 52.73 | B000 | N   |
| ATOM | 8376 | N   | PRO | F | 241 | −27.933 | 57.680 | −34.609 | 1.00 | 41.65 | B000 | N   |
| ATOM | 8377 | CA  | PRO | F | 241 | −26.875 | 58.646 | −34.945 | 1.00 | 36.96 | B000 | C   |
| ATOM | 8378 | C   | PRO | F | 241 | −27.011 | 59.145 | −36.366 | 1.00 | 42.81 | B000 | C   |
| ATOM | 8379 | O   | PRO | F | 241 | −27.998 | 58.769 | −37.004 | 1.00 | 45.53 | B000 | O   |
| ATOM | 8380 | CB  | PRO | F | 241 | −25.586 | 57.853 | −34.749 | 1.00 | 38.94 | B000 | C   |
| ATOM | 8381 | CG  | PRO | F | 241 | −25.986 | 56.428 | −34.992 | 1.00 | 43.27 | B000 | C   |
| ATOM | 8382 | CD  | PRO | F | 241 | −27.423 | 56.298 | −34.511 | 1.00 | 38.99 | B000 | C   |
| ATOM | 8383 | N   | ASP | F | 242 | −26.097 | 60.013 | −36.818 | 1.00 | 39.75 | B000 | N   |
| ATOM | 8384 | CA  | ASP | F | 242 | −26.139 | 60.504 | −38.190 | 1.00 | 36.75 | B000 | C   |
| ATOM | 8385 | C   | ASP | F | 242 | −26.229 | 59.323 | −39.143 | 1.00 | 43.99 | B000 | C   |
| ATOM | 8386 | O   | ASP | F | 242 | −25.504 | 58.332 | −38.991 | 1.00 | 46.47 | B000 | O   |
| ATOM | 8387 | CB  | ASP | F | 242 | −24.894 | 61.335 | −38.515 | 1.00 | 49.95 | B000 | C   |
| ATOM | 8388 | CG  | ASP | F | 242 | −24.677 | 62.473 | −37.551 | 1.00 | 48.49 | B000 | C   |

TABLE 10.3-continued

| ATOM | 8389 | OD1 | ASP | F | 242 | −25.683 | 63.064 | −37.104 | 1.00 | 52.88 | B000 | O |
|------|------|-----|-----|---|-----|---------|--------|---------|------|-------|------|---|
| ATOM | 8390 | OD2 | ASP | F | 242 | −23.497 | 62.767 | −37.248 | 1.00 | 50.34 | B000 | O |
| ATOM | 8391 | N | ASP | F | 243 | −27.147 | 59.405 | −40.097 | 1.00 | 38.82 | B000 | N |
| ATOM | 8392 | CA | ASP | F | 243 | −27.412 | 58.269 | −40.967 | 1.00 | 51.83 | B000 | C |
| ATOM | 8393 | C | ASP | F | 243 | −26.703 | 58.364 | −42.308 | 1.00 | 46.33 | B000 | C |
| ATOM | 8394 | O | ASP | F | 243 | −26.951 | 57.526 | −43.172 | 1.00 | 49.46 | B000 | O |
| ATOM | 8395 | CB | ASP | F | 243 | −28.919 | 58.079 | −41.193 | 1.00 | 42.32 | B000 | C |
| ATOM | 8396 | CG | ASP | F | 243 | −29.605 | 59.327 | −41.786 | 1.00 | 64.08 | B000 | C |
| ATOM | 8397 | OD1 | ASP | F | 243 | −28.935 | 60.346 | −42.070 | 1.00 | 56.96 | B000 | O |
| ATOM | 8398 | OD2 | ASP | F | 243 | −30.842 | 59.286 | −41.971 | 1.00 | 77.59 | B000 | O |
| ATOM | 8399 | N | TRP | F | 244 | −25.799 | 59.322 | −42.495 | 1.00 | 46.94 | B000 | N |
| ATOM | 8400 | CA | TRP | F | 244 | −25.235 | 59.541 | −43.822 | 1.00 | 43.08 | B000 | C |
| ATOM | 8401 | C | TRP | F | 244 | −24.046 | 58.643 | −44.134 | 1.00 | 41.86 | B000 | C |
| ATOM | 8402 | O | TRP | F | 244 | −23.528 | 58.721 | −45.250 | 1.00 | 43.66 | B000 | O |
| ATOM | 8403 | CB | TRP | F | 244 | −24.765 | 60.989 | −43.994 | 1.00 | 49.74 | B000 | C |
| ATOM | 8404 | CG | TRP | F | 244 | −25.371 | 61.991 | −43.064 | 1.00 | 50.88 | B000 | C |
| ATOM | 8405 | CD1 | TRP | F | 244 | −26.695 | 62.261 | −42.902 | 1.00 | 52.58 | B000 | C |
| ATOM | 8406 | CD2 | TRP | F | 244 | −24.674 | 62.891 | −42.206 | 1.00 | 42.95 | B000 | C |
| ATOM | 8407 | NE1 | TRP | F | 244 | −26.876 | 63.254 | −41.976 | 1.00 | 50.24 | B000 | N |
| ATOM | 8408 | CE2 | TRP | F | 244 | −25.650 | 63.672 | −41.536 | 1.00 | 51.72 | B000 | C |
| ATOM | 8409 | CE3 | TRP | F | 244 | −23.333 | 63.117 | −41.940 | 1.00 | 40.66 | B000 | C |
| ATOM | 8410 | CZ2 | TRP | F | 244 | −25.322 | 64.660 | −40.608 | 1.00 | 34.70 | B000 | C |
| ATOM | 8411 | CZ3 | TRP | F | 244 | −23.008 | 64.096 | −41.014 | 1.00 | 51.45 | B000 | C |
| ATOM | 8412 | CH2 | TRP | F | 244 | −24.002 | 64.849 | −40.357 | 1.00 | 45.14 | B000 | C |
| ATOM | 8413 | N | TYR | F | 245 | −23.649 | 57.749 | −43.225 | 1.00 | 38.07 | B000 | N |
| ATOM | 8414 | CA | TYR | F | 245 | −22.447 | 56.950 | −43.423 | 1.00 | 34.89 | B000 | C |
| ATOM | 8415 | C | TYR | F | 245 | −22.709 | 55.483 | −43.712 | 1.00 | 44.67 | B000 | C |
| ATOM | 8416 | O | TYR | F | 245 | −21.778 | 54.779 | −44.103 | 1.00 | 52.17 | B000 | O |
| ATOM | 8417 | CB | TYR | F | 245 | −21.529 | 57.030 | −42.191 | 1.00 | 38.23 | B000 | C |
| ATOM | 8418 | CG | TYR | F | 245 | −21.240 | 58.429 | −41.761 | 1.00 | 43.82 | B000 | C |
| ATOM | 8419 | CD1 | TYR | F | 245 | −20.344 | 59.219 | −42.479 | 1.00 | 42.91 | B000 | C |
| ATOM | 8420 | CD2 | TYR | F | 245 | −21.868 | 58.976 | −40.638 | 1.00 | 38.95 | B000 | C |
| ATOM | 8421 | CE1 | TYR | F | 245 | −20.090 | 60.513 | −42.101 | 1.00 | 39.31 | B000 | C |
| ATOM | 8422 | CE2 | TYR | F | 245 | −21.616 | 60.266 | −40.249 | 1.00 | 40.49 | B000 | C |
| ATOM | 8423 | CZ | TYR | F | 245 | −20.719 | 61.032 | −40.978 | 1.00 | 43.99 | B000 | C |
| ATOM | 8424 | OH | TYR | F | 245 | −20.449 | 62.323 | −40.589 | 1.00 | 46.79 | B000 | O |
| ATOM | 8425 | N | GLY | F | 246 | −23.918 | 54.993 | −43.508 | 1.00 | 42.86 | B000 | N |
| ATOM | 8426 | CA | GLY | F | 246 | −24.172 | 53.575 | −43.641 | 1.00 | 47.08 | B000 | C |
| ATOM | 8427 | C | GLY | F | 246 | −24.546 | 52.918 | −42.321 | 1.00 | 48.63 | B000 | C |
| ATOM | 8428 | O | GLY | F | 246 | −24.464 | 53.502 | −41.238 | 1.00 | 46.31 | B000 | O |
| ATOM | 8429 | N | HIS | F | 247 | −25.011 | 51.682 | −42.461 | 1.00 | 45.64 | B000 | N |
| ATOM | 8430 | CA | HIS | F | 247 | −25.504 | 50.908 | −41.338 | 1.00 | 45.98 | B000 | C |
| ATOM | 8431 | C | HIS | F | 247 | −24.400 | 50.682 | −40.309 | 1.00 | 49.00 | B000 | C |
| ATOM | 8432 | O | HIS | F | 247 | −23.329 | 50.161 | −40.640 | 1.00 | 47.43 | B000 | O |
| ATOM | 8433 | CB | HIS | F | 247 | −26.052 | 49.570 | −41.836 | 1.00 | 48.96 | B000 | C |
| ATOM | 8434 | CG | HIS | F | 247 | −26.470 | 48.656 | −40.731 | 1.00 | 52.43 | B000 | C |
| ATOM | 8435 | ND1 | HIS | F | 247 | −27.650 | 48.819 | −40.037 | 1.00 | 52.47 | B000 | N |
| ATOM | 8436 | CD2 | HIS | F | 247 | −25.835 | 47.606 | −40.157 | 1.00 | 55.93 | B000 | C |
| ATOM | 8437 | CE1 | HIS | F | 247 | −27.737 | 47.891 | −39.102 | 1.00 | 55.95 | B000 | C |
| ATOM | 8438 | NE2 | HIS | F | 247 | −26.649 | 47.142 | −39.154 | 1.00 | 65.30 | B000 | N |
| ATOM | 8439 | N | GLY | F | 248 | −24.656 | 51.080 | −39.063 | 1.00 | 45.09 | B000 | N |
| ATOM | 8440 | CA | GLY | F | 248 | −23.694 | 50.884 | −37.992 | 1.00 | 43.43 | B000 | C |
| ATOM | 8441 | C | GLY | F | 248 | −22.442 | 51.723 | −38.086 | 1.00 | 44.64 | B000 | C |
| ATOM | 8442 | O | GLY | F | 248 | −21.463 | 51.431 | −37.391 | 1.00 | 45.17 | B000 | O |
| ATOM | 8443 | N | LEU | F | 249 | −22.449 | 52.777 | −38.907 | 1.00 | 44.92 | B000 | N |
| ATOM | 8444 | CA | LEU | F | 249 | −21.244 | 53.532 | −39.232 | 1.00 | 47.53 | B000 | C |
| ATOM | 8445 | C | LEU | F | 249 | −21.355 | 55.001 | −38.833 | 1.00 | 45.44 | B000 | C |
| ATOM | 8446 | O | LEU | F | 249 | −22.456 | 55.561 | −38.758 | 1.00 | 38.63 | B000 | O |
| ATOM | 8447 | CB | LEU | F | 249 | −20.942 | 53.464 | −40.737 | 1.00 | 45.64 | B000 | C |
| ATOM | 8448 | CG | LEU | F | 249 | −20.640 | 52.090 | −41.349 | 1.00 | 49.29 | B000 | C |
| ATOM | 8449 | CD1 | LEU | F | 249 | −20.212 | 52.237 | −42.809 | 1.00 | 41.47 | B000 | C |
| ATOM | 8450 | CD2 | LEU | F | 249 | −19.590 | 51.359 | −40.538 | 1.00 | 35.93 | B000 | C |
| ATOM | 8451 | N | GLY | F | 250 | −20.186 | 55.619 | −38.598 | 1.00 | 43.79 | B000 | N |
| ATOM | 8452 | CA | GLY | F | 250 | −20.033 | 57.062 | −38.423 | 1.00 | 40.09 | B000 | C |
| ATOM | 8453 | C | GLY | F | 250 | −18.890 | 57.625 | −39.262 | 1.00 | 46.39 | B000 | C |
| ATOM | 8454 | O | GLY | F | 250 | −18.312 | 56.892 | −40.068 | 1.00 | 46.10 | B000 | O |
| ATOM | 8455 | N | ALA | F | 251 | −18.553 | 58.910 | −39.081 | 1.00 | 38.76 | B000 | N |
| ATOM | 8456 | CA | ALA | F | 251 | −17.474 | 59.596 | −39.795 | 1.00 | 44.18 | B000 | C |
| ATOM | 8457 | C | ALA | F | 251 | −16.114 | 59.542 | −39.122 | 1.00 | 41.29 | B000 | C |
| ATOM | 8458 | O | ALA | F | 251 | −15.172 | 60.113 | −39.673 | 1.00 | 48.88 | B000 | O |
| ATOM | 8459 | CB | ALA | F | 251 | −17.762 | 61.085 | −39.974 | 1.00 | 67.76 | B000 | C |
| ATOM | 8460 | N | GLY | F | 252 | −15.989 | 58.946 | −37.942 | 1.00 | 43.97 | B000 | N |
| ATOM | 8461 | CA | GLY | F | 252 | −14.714 | 58.903 | −37.255 | 1.00 | 44.53 | B000 | C |
| ATOM | 8462 | C | GLY | F | 252 | −14.440 | 60.030 | −36.276 | 1.00 | 47.60 | B000 | C |
| ATOM | 8463 | O | GLY | F | 252 | −13.427 | 59.971 | −35.575 | 1.00 | 55.35 | B000 | O |
| ATOM | 8464 | N | GLU | F | 253 | −15.306 | 61.045 | −36.183 | 1.00 | 45.85 | B000 | N |
| ATOM | 8465 | CA | GLU | F | 253 | −15.090 | 62.165 | −35.268 | 1.00 | 42.89 | B000 | C |
| ATOM | 8466 | C | GLU | F | 253 | −16.069 | 62.200 | −34.096 | 1.00 | 42.96 | B000 | C |
| ATOM | 8467 | O | GLU | F | 253 | −15.975 | 63.117 | −33.272 | 1.00 | 41.71 | B000 | O |
| ATOM | 8468 | CB | GLU | F | 253 | −15.188 | 63.512 | −36.017 | 1.00 | 43.68 | B000 | C |

TABLE 10.3-continued

| | | | | | | | | | | |
|---|---|---|---|---|---|---|---|---|---|---|
| ATOM | 8469 | CG | GLU | F | 253 | −14.363 | 63.614 | −37.321 | 1.00 | 57.15 | B000 | C |
| ATOM | 8470 | CD | GLU | F | 253 | −12.875 | 63.967 | −37.117 | 1.00 | 70.88 | B000 | C |
| ATOM | 8471 | OE1 | GLU | F | 253 | −12.568 | 65.139 | −36.771 | 1.00 | 71.64 | B000 | O |
| ATOM | 8472 | OE2 | GLU | F | 253 | −12.008 | 63.079 | −37.331 | 1.00 | 63.29 | B000 | O |
| ATOM | 8473 | N | ASP | F | 254 | −17.000 | 61.242 | −33.982 | 1.00 | 36.37 | B000 | N |
| ATOM | 8474 | CA | ASP | F | 254 | −18.107 | 61.378 | −33.045 | 1.00 | 37.71 | B000 | C |
| ATOM | 8475 | C | ASP | F | 254 | −17.988 | 60.412 | −31.877 | 1.00 | 36.53 | B000 | C |
| ATOM | 8476 | O | ASP | F | 254 | −17.374 | 59.349 | −31.973 | 1.00 | 36.91 | B000 | O |
| ATOM | 8477 | CB | ASP | F | 254 | −19.473 | 61.157 | −33.717 | 1.00 | 35.74 | B000 | C |
| ATOM | 8478 | CG | ASP | F | 254 | −20.006 | 62.400 | −34.396 | 1.00 | 38.14 | B000 | C |
| ATOM | 8479 | OD2 | ASP | F | 254 | −21.148 | 62.350 | −34.936 | 1.00 | 36.55 | B000 | O |
| ATOM | 8480 | OD1 | ASP | F | 254 | −19.280 | 63.427 | −34.386 | 1.00 | 41.05 | B000 | O1− |
| ATOM | 8481 | N | CYS | F | 255 | −18.603 | 60.799 | −30.769 | 1.00 | 38.85 | B000 | N |
| ATOM | 8482 | CA | CYS | F | 255 | −18.733 | 59.942 | −29.606 | 1.00 | 28.30 | B000 | C |
| ATOM | 8483 | C | CYS | F | 255 | −20.176 | 60.039 | −29.135 | 1.00 | 32.80 | B000 | C |
| ATOM | 8484 | O | CYS | F | 255 | −20.878 | 61.013 | −29.418 | 1.00 | 34.41 | B000 | O |
| ATOM | 8485 | CB | CYS | F | 255 | −17.749 | 60.342 | −28.515 | 1.00 | 32.19 | B000 | C |
| ATOM | 8486 | SG | CYS | F | 255 | −15.954 | 60.090 | −28.944 | 1.00 | 42.14 | B000 | S |
| ATOM | 8487 | N | ALA | F | 256 | −20.630 | 59.006 | −28.447 | 1.00 | 31.53 | B000 | N |
| ATOM | 8488 | CA | ALA | F | 256 | −22.004 | 58.933 | −27.991 | 1.00 | 30.16 | B000 | C |
| ATOM | 8489 | C | ALA | F | 256 | −22.096 | 59.438 | −26.562 | 1.00 | 34.02 | B000 | C |
| ATOM | 8490 | O | ALA | F | 256 | −21.281 | 59.074 | −25.706 | 1.00 | 31.73 | B000 | O |
| ATOM | 8491 | CB | ALA | F | 256 | −22.530 | 57.498 | −28.071 | 1.00 | 28.94 | B000 | C |
| ATOM | 8492 | N | HIS | F | 257 | −23.103 | 60.261 | −26.301 | 1.00 | 28.80 | B000 | N |
| ATOM | 8493 | CA | HIS | F | 257 | −23.347 | 60.726 | −24.947 | 1.00 | 33.62 | B000 | C |
| ATOM | 8494 | C | HIS | F | 257 | −24.822 | 60.589 | −24.608 | 1.00 | 29.12 | B000 | C |
| ATOM | 8495 | O | HIS | F | 257 | −25.696 | 60.659 | −25.483 | 1.00 | 29.71 | B000 | O |
| ATOM | 8496 | CB | HIS | F | 257 | −22.895 | 62.209 | −24.730 | 1.00 | 31.05 | B000 | C |
| ATOM | 8497 | CG | HIS | F | 257 | −23.622 | 63.196 | −25.584 | 1.00 | 27.54 | B000 | C |
| ATOM | 8498 | ND1 | HIS | F | 257 | −24.699 | 63.926 | −25.124 | 1.00 | 35.11 | B000 | N |
| ATOM | 8499 | CD2 | HIS | F | 257 | −23.433 | 63.578 | −26.873 | 1.00 | 31.63 | B000 | C |
| ATOM | 8500 | CE1 | HIS | F | 257 | −25.140 | 64.719 | −26.088 | 1.00 | 30.09 | B000 | C |
| ATOM | 8501 | NE2 | HIS | F | 257 | −24.389 | 64.529 | −27.160 | 1.00 | 34.93 | B000 | N |
| ATOM | 8502 | N | PHE | F | 258 | −25.083 | 60.369 | −23.324 | 1.00 | 31.39 | B000 | N |
| ATOM | 8503 | CA | PHE | F | 258 | −26.433 | 60.529 | −22.810 | 1.00 | 37.72 | B000 | C |
| ATOM | 8504 | C | PHE | F | 258 | −26.830 | 61.993 | −22.915 | 1.00 | 35.33 | B000 | C |
| ATOM | 8505 | O | PHE | F | 258 | −26.020 | 62.879 | −22.636 | 1.00 | 37.08 | B000 | O |
| ATOM | 8506 | CB | PHE | F | 258 | −26.519 | 60.088 | −21.354 | 1.00 | 31.41 | B000 | C |
| ATOM | 8507 | CG | PHE | F | 258 | −26.032 | 58.691 | −21.094 | 1.00 | 30.94 | B000 | C |
| ATOM | 8508 | CD1 | PHE | F | 258 | −26.884 | 57.598 | −21.263 | 1.00 | 34.60 | B000 | C |
| ATOM | 8509 | CD2 | PHE | F | 258 | −24.750 | 58.465 | −20.612 | 1.00 | 31.04 | B000 | C |
| ATOM | 8510 | CE1 | PHE | F | 258 | −26.449 | 56.297 | −20.988 | 1.00 | 35.62 | B000 | C |
| ATOM | 8511 | CE2 | PHE | F | 258 | −24.295 | 57.160 | −20.350 | 1.00 | 37.38 | B000 | C |
| ATOM | 8512 | CZ | PHE | F | 258 | −25.156 | 56.076 | −20.534 | 1.00 | 34.44 | B000 | C |
| ATOM | 8513 | N | THR | F | 259 | −28.072 | 62.242 | −23.340 | 1.00 | 39.97 | B000 | N |
| ATOM | 8514 | CA | THR | F | 259 | −28.683 | 63.565 | −23.297 | 1.00 | 37.91 | B000 | C |
| ATOM | 8515 | C | THR | F | 259 | −29.508 | 63.699 | −22.023 | 1.00 | 38.85 | B000 | C |
| ATOM | 8516 | O | THR | F | 259 | −29.572 | 62.785 | −21.197 | 1.00 | 42.20 | B000 | O |
| ATOM | 8517 | CB | THR | F | 259 | −29.566 | 63.817 | −24.514 | 1.00 | 38.22 | B000 | C |
| ATOM | 8518 | OG1 | THR | F | 259 | −30.726 | 62.979 | −24.427 | 1.00 | 40.99 | B000 | O |
| ATOM | 8519 | CG2 | THR | F | 259 | −28.812 | 63.526 | −25.789 | 1.00 | 35.73 | B000 | C |
| ATOM | 8520 | N | ASP | F | 260 | −30.176 | 64.845 | −21.874 | 1.00 | 41.22 | B000 | N |
| ATOM | 8521 | CA | ASP | F | 260 | −30.859 | 65.107 | −20.611 | 1.00 | 45.54 | B000 | C |
| ATOM | 8522 | C | ASP | F | 260 | −32.098 | 64.241 | −20.394 | 1.00 | 44.40 | B000 | C |
| ATOM | 8523 | O | ASP | F | 260 | −32.576 | 64.175 | −19.260 | 1.00 | 47.44 | B000 | O |
| ATOM | 8524 | CB | ASP | F | 260 | −31.211 | 66.595 | −20.486 | 1.00 | 42.85 | B000 | C |
| ATOM | 8525 | CG | ASP | F | 260 | −32.026 | 67.112 | −21.654 | 1.00 | 50.76 | B000 | C |
| ATOM | 8526 | OD1 | ASP | F | 260 | −32.520 | 66.298 | −22.465 | 1.00 | 48.72 | B000 | O |
| ATOM | 8527 | OD2 | ASP | F | 260 | −32.156 | 68.351 | −21.769 | 1.00 | 54.59 | B000 | O1− |
| ATOM | 8528 | N | ASP | F | 261 | −32.598 | 63.531 | −21.406 | 1.00 | 42.99 | B000 | N |
| ATOM | 8529 | CA | ASP | F | 261 | −33.649 | 62.544 | −21.167 | 1.00 | 41.51 | B000 | C |
| ATOM | 8530 | C | ASP | F | 261 | −33.118 | 61.115 | −21.152 | 1.00 | 43.32 | B000 | C |
| ATOM | 8531 | O | ASP | F | 261 | −33.911 | 60.169 | −21.146 | 1.00 | 48.34 | B000 | O |
| ATOM | 8532 | CB | ASP | F | 261 | −34.795 | 62.676 | −22.192 | 1.00 | 37.72 | B000 | C |
| ATOM | 8533 | CG | ASP | F | 261 | −34.432 | 62.185 | −23.606 | 1.00 | 50.07 | B000 | C |
| ATOM | 8534 | OD1 | ASP | F | 261 | −33.408 | 61.504 | −23.808 | 1.00 | 49.28 | B000 | O |
| ATOM | 8535 | OD2 | ASP | F | 261 | −35.212 | 62.470 | −24.543 | 1.00 | 57.06 | B000 | O1− |
| ATOM | 8536 | N | GLY | F | 262 | −31.801 | 60.929 | −21.192 | 1.00 | 37.84 | B000 | N |
| ATOM | 8537 | CA | GLY | F | 262 | −31.223 | 59.600 | −21.120 | 1.00 | 39.30 | B000 | C |
| ATOM | 8538 | C | GLY | F | 262 | −30.982 | 58.938 | −22.466 | 1.00 | 41.80 | B000 | C |
| ATOM | 8539 | O | GLY | F | 262 | −30.102 | 58.076 | −22.575 | 1.00 | 39.59 | B000 | O |
| ATOM | 8540 | N | ARG | F | 263 | −31.736 | 59.319 | −23.494 | 1.00 | 35.33 | B000 | N |
| ATOM | 8541 | CA | ARG | F | 263 | −31.468 | 58.795 | −24.822 | 1.00 | 38.94 | B000 | C |
| ATOM | 8542 | C | ARG | F | 263 | −30.159 | 59.370 | −25.357 | 1.00 | 41.24 | B000 | C |
| ATOM | 8543 | O | ARG | F | 263 | −29.688 | 60.429 | −24.926 | 1.00 | 40.40 | B000 | O |
| ATOM | 8544 | CB | ARG | F | 263 | −32.646 | 59.085 | −25.760 | 1.00 | 39.18 | B000 | C |
| ATOM | 8545 | CG | ARG | F | 263 | −33.888 | 58.222 | −25.393 | 1.00 | 46.56 | B000 | C |
| ATOM | 8546 | CD | ARG | F | 263 | −35.120 | 58.506 | −26.239 | 1.00 | 38.08 | B000 | C |
| ATOM | 8547 | NE | ARG | F | 263 | −35.507 | 59.908 | −26.134 | 1.00 | 51.22 | B000 | N |
| ATOM | 8548 | CZ | ARG | F | 263 | −36.495 | 60.464 | −26.827 | 1.00 | 58.02 | B000 | C |

TABLE 10.3-continued

| | | | | | | | | | | | |
|---|---|---|---|---|---|---|---|---|---|---|---|
| ATOM | 8549 | NH1 | ARG | F | 263 | −37.218 | 59.731 | −27.673 | 1.00 | 52.64 | B000 | N1+ |
| ATOM | 8550 | NH2 | ARG | F | 263 | −36.754 | 61.756 | −26.676 | 1.00 | 51.34 | B000 | N |
| ATOM | 8551 | N | TRP | F | 264 | −29.579 | 58.655 | −26.311 | 1.00 | 35.20 | B000 | N |
| ATOM | 8552 | CA | TRP | F | 264 | −28.211 | 58.875 | −26.746 | 1.00 | 33.30 | B000 | C |
| ATOM | 8553 | C | TRP | F | 264 | −28.146 | 59.805 | −27.951 | 1.00 | 36.94 | B000 | C |
| ATOM | 8554 | O | TRP | F | 264 | −29.059 | 59.860 | −28.785 | 1.00 | 39.27 | B000 | O |
| ATOM | 8555 | CB | TRP | F | 264 | −27.546 | 57.555 | −27.110 | 1.00 | 32.18 | B000 | C |
| ATOM | 8556 | CG | TRP | F | 264 | −27.593 | 56.508 | −26.057 | 1.00 | 35.42 | B000 | C |
| ATOM | 8557 | CD1 | TRP | F | 264 | −28.003 | 56.652 | −24.766 | 1.00 | 40.13 | B000 | C |
| ATOM | 8558 | CD2 | TRP | F | 264 | −27.196 | 55.143 | −26.203 | 1.00 | 36.70 | B000 | C |
| ATOM | 8559 | NE1 | TRP | F | 264 | −27.880 | 55.459 | −24.095 | 1.00 | 37.06 | B000 | N |
| ATOM | 8560 | CE2 | TRP | F | 264 | −27.388 | 54.516 | −24.960 | 1.00 | 38.24 | B000 | C |
| ATOM | 8561 | CE3 | TRP | F | 264 | −26.688 | 54.387 | −27.270 | 1.00 | 40.49 | B000 | C |
| ATOM | 8562 | CZ2 | TRP | F | 264 | −27.101 | 53.169 | −24.756 | 1.00 | 35.99 | B000 | C |
| ATOM | 8563 | CZ3 | TRP | F | 264 | −26.407 | 53.045 | −27.061 | 1.00 | 32.82 | B000 | C |
| ATOM | 8564 | CH2 | TRP | F | 264 | −26.613 | 52.457 | −25.819 | 1.00 | 37.82 | B000 | C |
| ATOM | 8565 | N | ASN | F | 265 | −27.044 | 60.540 | −28.034 | 1.00 | 31.28 | B000 | N |
| ATOM | 8566 | CA | ASN | F | 265 | −26.763 | 61.379 | −29.187 | 1.00 | 33.60 | B000 | C |
| ATOM | 8567 | C | ASN | F | 265 | −25.275 | 61.280 | −29.513 | 1.00 | 33.44 | B000 | C |
| ATOM | 8568 | O | ASN | F | 265 | −24.446 | 60.973 | −28.645 | 1.00 | 29.37 | B000 | O |
| ATOM | 8569 | CB | ASN | F | 265 | −27.200 | 62.832 | −28.912 | 1.00 | 31.57 | B000 | C |
| ATOM | 8570 | CG | ASN | F | 265 | −26.915 | 63.768 | −30.076 | 1.00 | 39.82 | B000 | C |
| ATOM | 8571 | OD1 | ASN | F | 265 | −27.466 | 63.615 | −31.166 | 1.00 | 41.22 | B000 | O |
| ATOM | 8572 | ND2 | ASN | F | 265 | −26.003 | 64.724 | −29.856 | 1.00 | 36.27 | B000 | N |
| ATOM | 8573 | N | ASP | F | 266 | −24.950 | 61.494 | −30.786 | 1.00 | 31.29 | B000 | N |
| ATOM | 8574 | CA | ASP | F | 266 | −23.572 | 61.488 | −31.255 | 1.00 | 31.23 | B000 | C |
| ATOM | 8575 | C | ASP | F | 266 | −23.107 | 62.919 | −31.488 | 1.00 | 32.82 | B000 | C |
| ATOM | 8576 | O | ASP | F | 266 | −23.788 | 63.693 | −32.166 | 1.00 | 30.42 | B000 | O |
| ATOM | 8577 | CB | ASP | F | 266 | −23.408 | 60.650 | −32.536 | 1.00 | 36.08 | B000 | C |
| ATOM | 8578 | CG | ASP | F | 266 | −24.411 | 61.018 | −33.661 | 1.00 | 40.88 | B000 | C |
| ATOM | 8579 | OD1 | ASP | F | 266 | −25.586 | 61.367 | −33.390 | 1.00 | 36.41 | B000 | O |
| ATOM | 8580 | OD2 | ASP | F | 266 | −24.013 | 60.933 | −34.844 | 1.00 | 40.99 | B000 | O1− |
| ATOM | 8581 | N | ASP | F | 267 | −21.943 | 63.261 | −30.935 | 1.00 | 35.94 | B000 | N |
| ATOM | 8582 | CA | ASP | F | 267 | −21.403 | 64.616 | −31.027 | 1.00 | 36.54 | B000 | C |
| ATOM | 8583 | C | ASP | F | 267 | −19.880 | 64.547 | −31.126 | 1.00 | 34.86 | B000 | C |
| ATOM | 8584 | O | ASP | F | 267 | −19.271 | 63.507 | −30.850 | 1.00 | 34.33 | B000 | O |
| ATOM | 8585 | CB | ASP | F | 267 | −21.835 | 65.470 | −29.834 | 1.00 | 30.38 | B000 | C |
| ATOM | 8586 | CG | ASP | F | 267 | −21.905 | 66.947 | −30.180 | 1.00 | 43.85 | B000 | C |
| ATOM | 8587 | OD1 | ASP | F | 267 | −21.377 | 67.294 | −31.265 | 1.00 | 39.52 | B000 | O |
| ATOM | 8588 | OD2 | ASP | F | 267 | −22.463 | 67.744 | −29.369 | 1.00 | 37.84 | B000 | O1− |
| ATOM | 8589 | N | VAL | F | 268 | −19.263 | 65.675 | −31.519 | 1.00 | 30.07 | B000 | N |
| ATOM | 8590 | CA | VAL | F | 268 | −17.811 | 65.692 | −31.674 | 1.00 | 34.19 | B000 | C |
| ATOM | 8591 | C | VAL | F | 268 | −17.155 | 65.408 | −30.331 | 1.00 | 32.91 | B000 | C |
| ATOM | 8592 | O | VAL | F | 268 | −17.605 | 65.876 | −29.277 | 1.00 | 34.33 | B000 | O |
| ATOM | 8593 | CB | VAL | F | 268 | −17.313 | 67.013 | −32.292 | 1.00 | 36.17 | B000 | C |
| ATOM | 8594 | CG1 | VAL | F | 268 | −17.784 | 67.114 | −33.734 | 1.00 | 30.93 | B000 | C |
| ATOM | 8595 | CG2 | VAL | F | 268 | −17.786 | 68.204 | −31.515 | 1.00 | 29.63 | B000 | C |
| ATOM | 8596 | N | CYS | F | 269 | −16.096 | 64.605 | −30.366 | 1.00 | 30.58 | B000 | N |
| ATOM | 8597 | CA | CYS | F | 269 | −15.512 | 64.059 | −29.147 | 1.00 | 32.39 | B000 | C |
| ATOM | 8598 | C | CYS | F | 269 | −14.819 | 65.101 | −28.276 | 1.00 | 35.95 | B000 | C |
| ATOM | 8599 | O | CYS | F | 269 | −14.508 | 64.795 | −27.110 | 1.00 | 34.91 | B000 | O |
| ATOM | 8600 | CB | CYS | F | 269 | −14.527 | 62.940 | −29.502 | 1.00 | 40.17 | B000 | C |
| ATOM | 8601 | SG | CYS | F | 269 | −15.360 | 61.521 | −30.340 | 1.00 | 50.58 | B000 | S |
| ATOM | 8602 | N | GLN | F | 270 | −14.605 | 66.326 | −28.768 | 1.00 | 30.41 | B000 | N |
| ATOM | 8603 | CA | GLN | F | 270 | −13.991 | 67.316 | −27.886 | 1.00 | 37.36 | B000 | C |
| ATOM | 8604 | C | GLN | F | 270 | −14.990 | 68.026 | −26.982 | 1.00 | 33.95 | B000 | C |
| ATOM | 8605 | O | GLN | F | 270 | −14.541 | 68.820 | −26.158 | 1.00 | 37.08 | B000 | O |
| ATOM | 8606 | CB | GLN | F | 270 | −13.179 | 68.371 | −28.659 | 1.00 | 34.85 | B000 | C |
| ATOM | 8607 | CG | GLN | F | 270 | −13.560 | 68.598 | −30.097 | 1.00 | 52.16 | B000 | C |
| ATOM | 8608 | CD | GLN | F | 270 | −13.134 | 67.433 | −30.977 | 1.00 | 59.41 | B000 | C |
| ATOM | 8609 | OE1 | GLN | F | 270 | −13.911 | 66.970 | −31.818 | 1.00 | 54.59 | B000 | O |
| ATOM | 8610 | NE2 | GLN | F | 270 | −11.912 | 66.916 | −30.748 | 1.00 | 48.02 | B000 | N |
| ATOM | 8611 | N | ARG | F | 271 | −16.302 | 67.744 | −27.083 | 1.00 | 27.57 | B000 | N |
| ATOM | 8612 | CA | ARG | F | 271 | −17.274 | 68.311 | −26.158 | 1.00 | 29.87 | B000 | C |
| ATOM | 8613 | C | ARG | F | 271 | −16.853 | 68.013 | −24.720 | 1.00 | 34.79 | B000 | C |
| ATOM | 8614 | O | ARG | F | 271 | −16.512 | 66.861 | −24.400 | 1.00 | 30.23 | B000 | O |
| ATOM | 8615 | CB | ARG | F | 271 | −18.688 | 67.750 | −26.374 | 1.00 | 30.54 | B000 | C |
| ATOM | 8616 | CG | ARG | F | 271 | −19.384 | 68.131 | −27.667 | 1.00 | 31.79 | B000 | C |
| ATOM | 8617 | CD | ARG | F | 271 | −19.505 | 69.613 | −27.794 | 1.00 | 33.75 | B000 | C |
| ATOM | 8618 | NE | ARG | F | 271 | −20.347 | 70.002 | −28.916 | 1.00 | 33.09 | B000 | N |
| ATOM | 8619 | CZ | ARG | F | 271 | −20.385 | 71.243 | −29.388 | 1.00 | 38.41 | B000 | C |
| ATOM | 8620 | NH1 | ARG | F | 271 | −19.614 | 72.177 | −28.817 | 1.00 | 34.05 | B000 | N1+ |
| ATOM | 8621 | NH2 | ARG | F | 271 | −21.173 | 71.556 | −30.417 | 1.00 | 29.00 | B000 | N |
| ATOM | 8622 | N | PRO | F | 272 | −16.862 | 68.955 | −23.879 | 1.00 | 32.65 | B000 | N |
| ATOM | 8623 | CA | PRO | F | 272 | −16.460 | 68.718 | −22.481 | 1.00 | 27.76 | B000 | C |
| ATOM | 8624 | C | PRO | F | 272 | −17.615 | 68.190 | −21.630 | 1.00 | 31.78 | B000 | C |
| ATOM | 8625 | O | PRO | F | 272 | −18.061 | 68.832 | −20.676 | 1.00 | 29.70 | B000 | O |
| ATOM | 8626 | CB | PRO | F | 272 | −15.983 | 70.111 | −22.042 | 1.00 | 28.08 | B000 | C |
| ATOM | 8627 | CG | PRO | F | 272 | −16.860 | 71.083 | −22.841 | 1.00 | 28.41 | B000 | C |
| ATOM | 8628 | CD | PRO | F | 272 | −17.059 | 70.391 | −24.190 | 1.00 | 31.14 | B000 | C |

TABLE 10.3-continued

| | | | | | | | | | | | |
|---|---|---|---|---|---|---|---|---|---|---|---|
| ATOM | 8629 | N | TYR | F | 273 | −18.129 | 67.005 | −21.987 | 1.00 | 32.02 | B000 | N |
| ATOM | 8630 | CA | TYR | F | 273 | −19.251 | 66.438 | −21.248 | 1.00 | 31.15 | B000 | C |
| ATOM | 8631 | C | TYR | F | 273 | −18.759 | 65.726 | −19.999 | 1.00 | 28.60 | B000 | C |
| ATOM | 8632 | O | TYR | F | 273 | −17.577 | 65.427 | −19.850 | 1.00 | 27.10 | B000 | O |
| ATOM | 8633 | CB | TYR | F | 273 | −20.061 | 65.473 | −22.113 | 1.00 | 28.19 | B000 | C |
| ATOM | 8634 | CG | TYR | F | 273 | −20.762 | 66.174 | −23.244 | 1.00 | 30.22 | B000 | C |
| ATOM | 8635 | CD1 | TYR | F | 273 | −21.111 | 67.519 | −23.133 | 1.00 | 29.80 | B000 | C |
| ATOM | 8636 | CD2 | TYR | F | 273 | −21.057 | 65.512 | −24.440 | 1.00 | 28.43 | B000 | C |
| ATOM | 8637 | CE1 | TYR | F | 273 | −21.765 | 68.193 | −24.178 | 1.00 | 29.36 | B000 | C |
| ATOM | 8638 | CE2 | TYR | F | 273 | −21.695 | 66.178 | −25.493 | 1.00 | 26.89 | B000 | C |
| ATOM | 8639 | CZ | TYR | F | 273 | −22.039 | 67.519 | −25.355 | 1.00 | 30.78 | B000 | C |
| ATOM | 8640 | OH | TYR | F | 273 | −22.668 | 68.191 | −26.375 | 1.00 | 33.01 | B000 | O |
| ATOM | 8641 | N | ARG | F | 274 | −19.688 | 65.469 | −19.083 | 1.00 | 31.67 | B000 | N |
| ATOM | 8642 | CA | ARG | F | 274 | −19.383 | 64.573 | −17.977 | 1.00 | 32.33 | B000 | C |
| ATOM | 8643 | C | ARG | F | 274 | −19.177 | 63.156 | −18.523 | 1.00 | 29.48 | B000 | C |
| ATOM | 8644 | O | ARG | F | 274 | −19.403 | 62.875 | −19.703 | 1.00 | 29.20 | B000 | O |
| ATOM | 8645 | CB | ARG | F | 274 | −20.501 | 64.618 | −16.931 | 1.00 | 33.56 | B000 | C |
| ATOM | 8646 | CG | ARG | F | 274 | −20.639 | 65.990 | −16.246 | 1.00 | 34.67 | B000 | C |
| ATOM | 8647 | CD | ARG | F | 274 | −21.615 | 65.998 | −15.050 | 1.00 | 38.53 | B000 | C |
| ATOM | 8648 | NE | ARG | F | 274 | −21.480 | 67.235 | −14.265 | 1.00 | 37.38 | B000 | N |
| ATOM | 8649 | CZ | ARG | F | 274 | −22.106 | 67.482 | −13.117 | 1.00 | 34.94 | B000 | C |
| ATOM | 8650 | NH1 | ARG | F | 274 | −22.944 | 66.591 | −12.600 | 1.00 | 33.17 | B000 | N1+ |
| ATOM | 8651 | NH2 | ARG | F | 274 | −21.886 | 68.623 | −12.476 | 1.00 | 31.06 | B000 | N |
| ATOM | 8652 | N | TRP | F | 275 | −18.741 | 62.250 | −17.662 | 1.00 | 29.84 | B000 | N |
| ATOM | 8653 | CA | TRP | F | 275 | −18.518 | 60.878 | −18.100 | 1.00 | 34.86 | B000 | C |
| ATOM | 8654 | C | TRP | F | 275 | −18.726 | 59.935 | −16.926 | 1.00 | 36.82 | B000 | C |
| ATOM | 8655 | O | TRP | F | 275 | −18.766 | 60.351 | −15.763 | 1.00 | 32.31 | B000 | O |
| ATOM | 8656 | CB | TRP | F | 275 | −17.112 | 60.684 | −18.679 | 1.00 | 28.66 | B000 | C |
| ATOM | 8657 | CG | TRP | F | 275 | −16.078 | 60.676 | −17.628 | 1.00 | 32.25 | B000 | C |
| ATOM | 8658 | CD1 | TRP | F | 275 | −15.531 | 59.586 | −17.019 | 1.00 | 34.72 | B000 | C |
| ATOM | 8659 | CD2 | TRP | F | 275 | −15.448 | 61.826 | −17.041 | 1.00 | 33.73 | B000 | C |
| ATOM | 8660 | NE1 | TRP | F | 275 | −14.587 | 59.989 | −16.085 | 1.00 | 33.65 | B000 | N |
| ATOM | 8661 | CE2 | TRP | F | 275 | −14.521 | 61.358 | −16.087 | 1.00 | 32.03 | B000 | C |
| ATOM | 8662 | CE3 | TRP | F | 275 | −15.575 | 63.203 | −17.238 | 1.00 | 32.63 | B000 | C |
| ATOM | 8663 | CZ2 | TRP | F | 275 | −13.732 | 62.217 | −15.334 | 1.00 | 34.54 | B000 | C |
| ATOM | 8664 | CZ3 | TRP | F | 275 | −14.798 | 64.057 | −16.476 | 1.00 | 32.70 | B000 | C |
| ATOM | 8665 | CH2 | TRP | F | 275 | −13.890 | 63.563 | −15.542 | 1.00 | 33.77 | B000 | C |
| ATOM | 8666 | N | VAL | F | 276 | −18.840 | 58.646 | −17.247 | 1.00 | 33.42 | B000 | N |
| ATOM | 8667 | CA | VAL | F | 276 | −19.034 | 57.591 | −16.256 | 1.00 | 37.19 | B000 | C |
| ATOM | 8668 | C | VAL | F | 276 | −17.985 | 56.504 | −16.480 | 1.00 | 41.17 | B000 | C |
| ATOM | 8669 | O | VAL | F | 276 | −17.762 | 56.073 | −17.620 | 1.00 | 38.26 | B000 | O |
| ATOM | 8670 | CB | VAL | F | 276 | −20.454 | 56.999 | −16.338 | 1.00 | 37.30 | B000 | C |
| ATOM | 8671 | CG1 | VAL | F | 276 | −20.677 | 55.983 | −15.212 | 1.00 | 34.94 | B000 | C |
| ATOM | 8672 | CG2 | VAL | F | 276 | −21.488 | 58.117 | −16.312 | 1.00 | 29.37 | B000 | C |
| ATOM | 8673 | N | CYS | F | 277 | −17.328 | 56.085 | −15.402 | 1.00 | 36.51 | B000 | N |
| ATOM | 8674 | CA | CYS | F | 277 | −16.406 | 54.958 | −15.437 | 1.00 | 39.62 | B000 | C |
| ATOM | 8675 | C | CYS | F | 277 | −17.094 | 53.700 | −14.909 | 1.00 | 45.76 | B000 | C |
| ATOM | 8676 | O | CYS | F | 277 | −17.945 | 53.759 | −14.015 | 1.00 | 44.66 | B000 | O |
| ATOM | 8677 | CB | CYS | F | 277 | −15.146 | 55.230 | −14.605 | 1.00 | 40.57 | B000 | C |
| ATOM | 8678 | SG | CYS | F | 277 | −14.058 | 56.553 | −15.196 | 1.00 | 50.52 | B000 | S |
| ATOM | 8679 | N | GLU | F | 278 | −16.695 | 52.557 | −15.462 | 1.00 | 39.15 | B000 | N |
| ATOM | 8680 | CA | GLU | F | 278 | −17.250 | 51.260 | −15.112 | 1.00 | 44.84 | B000 | C |
| ATOM | 8681 | C | GLU | F | 278 | −16.120 | 50.256 | −14.936 | 1.00 | 47.20 | B000 | C |
| ATOM | 8682 | O | GLU | F | 278 | −15.173 | 50.230 | −15.729 | 1.00 | 47.48 | B000 | O |
| ATOM | 8683 | CB | GLU | F | 278 | −18.203 | 50.751 | −16.194 | 1.00 | 38.93 | B000 | C |
| ATOM | 8684 | CG | GLU | F | 278 | −18.836 | 49.416 | −15.857 | 1.00 | 46.64 | B000 | C |
| ATOM | 8685 | CD | GLU | F | 278 | −19.732 | 48.897 | −16.963 | 1.00 | 49.83 | B000 | C |
| ATOM | 8686 | OE1 | GLU | F | 278 | −19.861 | 49.572 | −18.007 | 1.00 | 51.92 | B000 | O |
| ATOM | 8687 | OE2 | GLU | F | 278 | −20.316 | 47.813 | −16.790 | 1.00 | 61.81 | B000 | O1− |
| ATOM | 8688 | N | THR | F | 279 | −16.212 | 49.447 | −13.886 | 1.00 | 44.44 | B000 | N |
| ATOM | 8689 | CA | THR | F | 279 | −15.287 | 48.339 | −13.689 | 1.00 | 49.01 | B000 | C |
| ATOM | 8690 | C | THR | F | 279 | −16.035 | 47.205 | −13.000 | 1.00 | 55.21 | B000 | C |
| ATOM | 8691 | O | THR | F | 279 | −17.179 | 47.359 | −12.564 | 1.00 | 50.33 | B000 | O |
| ATOM | 8692 | CB | THR | F | 279 | −14.035 | 48.775 | −12.899 | 1.00 | 50.55 | B000 | C |
| ATOM | 8693 | OG1 | THR | F | 279 | −13.019 | 47.768 | −13.000 | 1.00 | 60.70 | B000 | O |
| ATOM | 8694 | CG2 | THR | F | 279 | −14.349 | 49.063 | −11.433 | 1.00 | 40.44 | B000 | C |
| ATOM | 8695 | N | GLU | F | 280 | −15.392 | 46.046 | −12.929 | 1.00 | 62.33 | B000 | N |
| ATOM | 8696 | CA | GLU | F | 280 | −16.042 | 44.856 | −12.389 | 1.00 | 60.95 | B000 | C |
| ATOM | 8697 | C | GLU | F | 280 | −15.846 | 44.774 | −10.881 | 1.00 | 59.82 | B000 | C |
| ATOM | 8698 | O | GLU | F | 280 | −14.755 | 45.070 | −10.384 | 1.00 | 61.25 | B000 | O |
| ATOM | 8699 | CB | GLU | F | 280 | −15.489 | 43.597 | −13.056 | 1.00 | 64.94 | B000 | C |
| ATOM | 8700 | CG | GLU | F | 280 | −13.982 | 43.637 | −13.300 | 1.00 | 75.16 | B000 | C |
| ATOM | 8701 | CD | GLU | F | 280 | −13.631 | 44.136 | −14.695 | 1.00 | 87.07 | B000 | C |
| ATOM | 8702 | OE1 | GLU | F | 280 | −14.294 | 43.684 | −15.660 | 1.00 | 92.63 | B000 | O |
| ATOM | 8703 | OE2 | GLU | F | 280 | −12.707 | 44.977 | −14.825 | 1.00 | 87.02 | B000 | O1− |
| ATOM | 8704 | N | GLU | F | 281 | −16.934 | 44.447 | −10.167 | 1.00 | 59.93 | B000 | N |
| ATOM | 8705 | CA | GLU | F | 281 | −16.960 | 43.756 | −8.848 | 1.00 | 67.16 | B000 | C |
| ATOM | 8706 | C | GLU | F | 281 | −18.241 | 44.090 | −8.095 | 1.00 | 67.27 | B000 | C |
| ATOM | 8707 | O | GLU | F | 281 | −18.257 | 44.100 | −6.862 | 1.00 | 68.70 | B000 | O |
| ATOM | 8708 | CB | GLU | F | 281 | −15.757 | 44.085 | −7.951 | 1.00 | 63.68 | B000 | C |

TABLE 10.3-continued

| | | | | | | | | | | | |
|---|---|---|---|---|---|---|---|---|---|---|---|
| ATOM | 8709 | CG | GLU | F | 281 | −15.131 | 42.885 | −7.230 | 1.00 | 68.36 | B000 | C |
| ATOM | 8710 | CD | GLU | F | 281 | −14.442 | 41.881 | −8.172 | 1.00 | 83.09 | B000 | C |
| ATOM | 8711 | OE1 | GLU | F | 281 | −15.127 | 41.287 | −9.037 | 1.00 | 77.83 | B000 | O |
| ATOM | 8712 | OE2 | GLU | F | 281 | −13.210 | 41.679 | −8.043 | 1.00 | 76.05 | B000 | O |
| TER | | | | | | | | | | | | |
| HETATM | 9170 | C1 | GAL | G | 401 | 19.131 | 84.986 | −13.073 | 1.00 | 67.87 | | C |
| HETATM | 9171 | O1 | GAL | G | 401 | 19.230 | 83.939 | −14.075 | 1.00 | 65.01 | | O |
| HETATM | 9172 | C2 | GAL | G | 401 | 19.826 | 84.527 | −11.743 | 1.00 | 63.05 | | C |
| HETATM | 9173 | O2 | GAL | G | 401 | 19.202 | 83.373 | −11.240 | 1.00 | 42.62 | | O |
| HETATM | 9174 | C3 | GAL | G | 401 | 19.822 | 85.673 | −10.639 | 1.00 | 71.79 | | C |
| HETATM | 9175 | O3 | GAL | G | 401 | 20.324 | 85.299 | −9.317 | 1.00 | 63.98 | | O |
| HETATM | 9176 | C4 | GAL | G | 401 | 20.547 | 86.954 | −11.192 | 1.00 | 74.66 | | C |
| HETATM | 9177 | O4 | GAL | G | 401 | 21.936 | 86.736 | −11.495 | 1.00 | 79.63 | | O |
| HETATM | 9178 | C5 | GAL | G | 401 | 19.774 | 87.370 | −12.469 | 1.00 | 75.84 | | C |
| HETATM | 9179 | O5 | GAL | G | 401 | 19.667 | 86.275 | −13.538 | 1.00 | 68.13 | | O |
| HETATM | 9180 | C6 | GAL | G | 401 | 20.270 | 88.659 | −13.125 | 1.00 | 68.64 | | C |
| HETATM | 9181 | O6 | GAL | G | 401 | 19.157 | 89.413 | −13.631 | 1.00 | 52.02 | | O |
| TER | | | | | | | | | | | | |
| HETATM | 9182 | C1 | GAL | G | 402 | −25.502 | 71.256 | −32.056 | 1.00 | 74.77 | | C |
| HETATM | 9183 | O1 | GAL | G | 402 | −24.812 | 72.366 | −32.713 | 1.00 | 60.32 | | O |
| HETATM | 9184 | C2 | GAL | G | 402 | −26.779 | 71.727 | −31.263 | 1.00 | 62.62 | | C |
| HETATM | 9185 | O2 | GAL | G | 402 | −26.494 | 72.728 | −30.323 | 1.00 | 41.25 | | O |
| HETATM | 9186 | C3 | GAL | G | 402 | −27.470 | 70.522 | −30.515 | 1.00 | 66.23 | | C |
| HETATM | 9187 | O3 | GAL | G | 402 | −28.624 | 70.910 | −29.737 | 1.00 | 63.41 | | O |
| HETATM | 9188 | C4 | GAL | G | 402 | −27.905 | 69.432 | −31.526 | 1.00 | 75.11 | | C |
| HETATM | 9189 | O4 | GAL | G | 402 | −29.064 | 69.854 | −32.279 | 1.00 | 80.69 | | O |
| HETATM | 9190 | C5 | GAL | G | 402 | −26.702 | 69.051 | −32.464 | 1.00 | 82.81 | | C |
| HETATM | 9191 | O5 | GAL | G | 402 | −25.897 | 70.216 | −33.013 | 1.00 | 81.70 | | O |
| HETATM | 9192 | C6 | GAL | G | 402 | −27.102 | 68.166 | −33.664 | 1.00 | 85.18 | | C |
| HETATM | 9193 | O6 | GAL | G | 402 | −26.406 | 68.545 | −34.844 | 1.00 | 94.12 | | O |
| TER | | | | | | | | | | | | |
| HETATM | 9194 | CA | CA | H | 1 | 21.469 | 91.701 | −14.212 | 1.00 | 79.84 | | Ca |
| TER | | | | | | | | | | | | |
| HETATM | 9195 | CA | CA | H | 2 | −26.073 | 64.419 | −34.040 | 1.00 | 79.26 | | Ca |
| TER | | | | | | | | | | | | |
| HETATM | 9196 | CA | CA | H | 3 | −18.333 | 61.223 | −36.994 | 1.00 | 75.64 | | Ca |
| HETATM | 9197 | CA | CA | H | 4 | 18.240 | 94.784 | −21.928 | 1.00 | 73.55 | | Ca |
| TER | | | | | | | | | | | | |

TABLE 10.4

| | | | | | | | | | | |
|---|---|---|---|---|---|---|---|---|---|---|
| ATOM | 1 | O | GLN | A | 1 | −24.853 | −26.439 | 84.334 | 1.00 | 39.67 | O |
| ATOM | 2 | N | GLN | A | 1 | −23.947 | −29.300 | 85.222 | 1.00 | 49.60 | N |
| ATOM | 3 | CA | GLN | A | 1 | −24.872 | −28.345 | 85.852 | 1.00 | 56.88 | C |
| ATOM | 4 | C | GLN | A | 1 | −25.501 | −27.209 | 85.050 | 1.00 | 51.47 | C |
| ATOM | 5 | CB | GLN | A | 1 | −24.208 | −27.745 | 87.074 | 1.00 | 45.63 | C |
| ATOM | 6 | CG | GLN | A | 1 | −23.967 | −28.823 | 88.054 | 1.00 | 44.21 | C |
| ATOM | 7 | CD | GLN | A | 1 | −25.274 | −29.457 | 88.407 | 1.00 | 54.28 | C |
| ATOM | 8 | OE1 | GLN | A | 1 | −26.030 | −28.899 | 89.200 | 1.00 | 62.35 | O |
| ATOM | 9 | NE2 | GLN | A | 1 | −25.592 | −30.592 | 87.778 | 1.00 | 57.03 | N |
| ATOM | 10 | N | VAL | A | 2 | −26.812 | −27.135 | 85.264 | 1.00 | 51.10 | N |
| ATOM | 11 | CA | VAL | A | 2 | −27.671 | −26.124 | 84.683 | 1.00 | 42.93 | C |
| ATOM | 12 | C | VAL | A | 2 | −27.754 | −24.968 | 85.669 | 1.00 | 44.75 | C |
| ATOM | 13 | O | VAL | A | 2 | −28.236 | −25.134 | 86.793 | 1.00 | 42.04 | O |
| ATOM | 14 | CB | VAL | A | 2 | −29.061 | −26.696 | 84.378 | 1.00 | 39.51 | C |
| ATOM | 15 | CG1 | VAL | A | 2 | −29.809 | −25.773 | 83.468 | 1.00 | 44.64 | C |
| ATOM | 16 | CG2 | VAL | A | 2 | −28.948 | −28.065 | 83.754 | 1.00 | 39.26 | C |
| ATOM | 17 | N | GLN | A | 3 | −27.240 | −23.812 | 85.269 | 1.00 | 45.15 | N |
| ATOM | 18 | CA | GLN | A | 3 | −27.403 | −22.586 | 86.031 | 1.00 | 44.60 | C |
| ATOM | 19 | C | GLN | A | 3 | −28.455 | −21.725 | 85.355 | 1.00 | 34.85 | C |
| ATOM | 20 | O | GLN | A | 3 | −28.496 | −21.629 | 84.128 | 1.00 | 39.72 | O |
| ATOM | 21 | CB | GLN | A | 3 | −26.091 | −21.792 | 86.128 | 1.00 | 50.01 | C |
| ATOM | 22 | CG | GLN | A | 3 | −24.978 | −22.456 | 86.931 | 1.00 | 56.60 | C |
| ATOM | 23 | CD | GLN | A | 3 | −23.919 | −23.128 | 86.052 | 1.00 | 59.49 | C |
| ATOM | 24 | OE1 | GLN | A | 3 | −24.036 | −23.141 | 84.811 | 1.00 | 56.42 | O |
| ATOM | 25 | NE2 | GLN | A | 3 | −22.874 | −23.691 | 86.692 | 1.00 | 48.31 | N |
| ATOM | 26 | N | LEU | A | 4 | −29.296 | −21.109 | 86.161 | 1.00 | 34.42 | N |
| ATOM | 27 | CA | LEU | A | 4 | −30.179 | −20.024 | 85.752 | 1.00 | 31.59 | C |
| ATOM | 28 | C | LEU | A | 4 | −29.640 | −18.812 | 86.491 | 1.00 | 37.33 | C |
| ATOM | 29 | O | LEU | A | 4 | −29.854 | −18.673 | 87.696 | 1.00 | 44.24 | O |
| ATOM | 30 | CB | LEU | A | 4 | −31.634 | −20.283 | 86.124 | 1.00 | 31.99 | C |
| ATOM | 31 | CG | LEU | A | 4 | −32.309 | −21.572 | 85.670 | 1.00 | 34.73 | C |
| ATOM | 32 | CD1 | LEU | A | 4 | −33.852 | −21.433 | 85.729 | 1.00 | 32.19 | C |
| ATOM | 33 | CD2 | LEU | A | 4 | −31.838 | −21.916 | 84.287 | 1.00 | 30.49 | C |
| ATOM | 34 | N | GLN | A | 5 | −28.883 | −17.976 | 85.797 | 1.00 | 40.51 | N |
| ATOM | 35 | CA | GLN | A | 5 | −28.269 | −16.810 | 86.412 | 1.00 | 38.81 | C |
| ATOM | 36 | C | GLN | A | 5 | −29.203 | −15.614 | 86.259 | 1.00 | 37.64 | C |

TABLE 10.4-continued

| ATOM | 37 | O | GLN | A | 5 | −29.714 | −15.358 | 85.170 | 1.00 | 41.01 | O |
| ATOM | 38 | CB | GLN | A | 5 | −26.911 | −16.544 | 85.768 | 1.00 | 38.94 | C |
| ATOM | 39 | CG | GLN | A | 5 | −26.103 | −17.812 | 85.595 | 1.00 | 46.98 | C |
| ATOM | 40 | CD | GLN | A | 5 | −24.690 | −17.565 | 85.045 | 1.00 | 61.68 | C |
| ATOM | 41 | OE1 | GLN | A | 5 | −24.523 | −17.011 | 83.956 | 1.00 | 63.24 | O |
| ATOM | 42 | NE2 | GLN | A | 5 | −23.671 | −17.982 | 85.800 | 1.00 | 53.29 | N |
| ATOM | 43 | N | GLN | A | 6 | −29.465 | −14.912 | 87.348 | 1.00 | 37.71 | N |
| ATOM | 44 | CA | GLN | A | 6 | −30.413 | −13.810 | 87.326 | 1.00 | 37.43 | C |
| ATOM | 45 | C | GLN | A | 6 | −29.670 | −12.491 | 87.484 | 1.00 | 41.79 | C |
| ATOM | 46 | O | GLN | A | 6 | −28.694 | −12.405 | 88.237 | 1.00 | 42.07 | O |
| ATOM | 47 | CB | GLN | A | 6 | −31.445 | −13.932 | 88.448 | 1.00 | 34.57 | C |
| ATOM | 48 | CG | GLN | A | 6 | −32.083 | −15.276 | 88.561 | 1.00 | 37.33 | C |
| ATOM | 49 | CD | GLN | A | 6 | −33.308 | −15.279 | 89.458 | 1.00 | 36.27 | C |
| ATOM | 50 | OE1 | GLN | A | 6 | −33.695 | −16.319 | 89.966 | 1.00 | 30.06 | O |
| ATOM | 51 | NE2 | GLN | A | 6 | −33.920 | −14.117 | 89.653 | 1.00 | 32.89 | N |
| ATOM | 52 | N | TRP | A | 7 | −30.144 | −11.463 | 86.785 | 1.00 | 36.25 | N |
| ATOM | 53 | CA | TRP | A | 7 | −29.729 | −10.098 | 87.059 | 1.00 | 33.75 | C |
| ATOM | 54 | C | TRP | A | 7 | −30.876 | −9.160 | 86.714 | 1.00 | 37.39 | C |
| ATOM | 55 | O | TRP | A | 7 | −31.883 | −9.557 | 86.120 | 1.00 | 39.47 | O |
| ATOM | 56 | CB | TRP | A | 7 | −28.452 | −9.723 | 86.303 | 1.00 | 33.51 | C |
| ATOM | 57 | CG | TRP | A | 7 | −28.542 | −9.763 | 84.822 | 1.00 | 34.91 | C |
| ATOM | 58 | CD1 | TRP | A | 7 | −28.929 | −8.739 | 83.990 | 1.00 | 37.52 | C |
| ATOM | 59 | CD2 | TRP | A | 7 | −28.206 | −10.865 | 83.970 | 1.00 | 37.56 | C |
| ATOM | 60 | NE1 | TRP | A | 7 | −28.872 | −9.149 | 82.675 | 1.00 | 37.51 | N |
| ATOM | 61 | CE2 | TRP | A | 7 | −28.425 | −10.446 | 82.635 | 1.00 | 36.81 | C |
| ATOM | 62 | CE3 | TRP | A | 7 | −27.737 | −12.160 | 84.204 | 1.00 | 43.59 | C |
| ATOM | 63 | CZ2 | TRP | A | 7 | −28.199 | −11.280 | 81.542 | 1.00 | 35.12 | C |
| ATOM | 64 | CZ3 | TRP | A | 7 | −27.517 | −12.993 | 83.112 | 1.00 | 48.14 | C |
| ATOM | 65 | CH2 | TRP | A | 7 | −27.754 | −12.547 | 81.797 | 1.00 | 43.93 | C |
| ATOM | 66 | N | GLY | A | 8 | −30.711 | −7.909 | 87.092 | 1.00 | 31.94 | N |
| ATOM | 67 | CA | GLY | A | 8 | −31.730 | −6.894 | 86.915 | 1.00 | 32.15 | C |
| ATOM | 68 | C | GLY | A | 8 | −31.597 | −6.027 | 88.146 | 1.00 | 36.03 | C |
| ATOM | 69 | O | GLY | A | 8 | −31.196 | −6.479 | 89.217 | 1.00 | 34.32 | O |
| ATOM | 70 | N | ALA | A | 9 | −31.911 | −4.745 | 87.991 | 1.00 | 39.30 | N |
| ATOM | 71 | CA | ALA | A | 9 | −31.830 | −3.844 | 89.129 | 1.00 | 40.16 | C |
| ATOM | 72 | C | ALA | A | 9 | −32.853 | −4.275 | 90.168 | 1.00 | 41.09 | C |
| ATOM | 73 | O | ALA | A | 9 | −34.026 | −4.460 | 89.845 | 1.00 | 43.60 | O |
| ATOM | 74 | CB | ALA | A | 9 | −32.073 | −2.399 | 88.690 | 1.00 | 33.25 | C |
| ATOM | 75 | N | GLY | A | 10 | −32.405 | −4.458 | 91.411 | 1.00 | 37.64 | N |
| ATOM | 76 | CA | GLY | A | 10 | −33.275 | −4.938 | 92.461 | 1.00 | 28.47 | C |
| ATOM | 77 | C | GLY | A | 10 | −33.861 | −3.889 | 93.382 | 1.00 | 36.57 | C |
| ATOM | 78 | O | GLY | A | 10 | −34.710 | −4.214 | 94.213 | 1.00 | 43.35 | O |
| ATOM | 79 | N | LEU | A | 11 | −33.418 | −2.638 | 93.273 | 1.00 | 36.99 | N |
| ATOM | 80 | CA | LEU | A | 11 | −33.946 | −1.533 | 94.067 | 1.00 | 34.54 | C |
| ATOM | 81 | C | LEU | A | 11 | −34.748 | −0.595 | 93.168 | 1.00 | 35.85 | C |
| ATOM | 82 | O | LEU | A | 11 | −34.244 | −0.129 | 92.144 | 1.00 | 38.05 | O |
| ATOM | 83 | CB | LEU | A | 11 | −32.818 | −0.764 | 94.760 | 1.00 | 36.89 | C |
| ATOM | 84 | CG | LEU | A | 11 | −33.040 | −0.447 | 96.238 | 1.00 | 40.06 | C |
| ATOM | 85 | CD1 | LEU | A | 11 | −31.989 | 0.520 | 96.748 | 1.00 | 38.21 | C |
| ATOM | 86 | CD2 | LEU | A | 11 | −34.443 | 0.097 | 96.487 | 1.00 | 39.59 | C |
| ATOM | 87 | N | LEU | A | 12 | −35.997 | −0.333 | 93.537 | 1.00 | 36.22 | N |
| ATOM | 88 | CA | LEU | A | 12 | −36.874 | 0.495 | 92.724 | 1.00 | 38.68 | C |
| ATOM | 89 | C | LEU | A | 12 | −37.710 | 1.388 | 93.624 | 1.00 | 37.27 | C |
| ATOM | 90 | O | LEU | A | 12 | −37.955 | 1.071 | 94.791 | 1.00 | 40.06 | O |
| ATOM | 91 | CB | LEU | A | 12 | −37.815 | −0.342 | 91.843 | 1.00 | 36.78 | C |
| ATOM | 92 | CG | LEU | A | 12 | −37.179 | −1.328 | 90.872 | 1.00 | 36.77 | C |
| ATOM | 93 | CD1 | LEU | A | 12 | −38.285 | −2.117 | 90.244 | 1.00 | 42.02 | C |
| ATOM | 94 | CD2 | LEU | A | 12 | −36.382 | −0.610 | 89.812 | 1.00 | 40.37 | C |
| ATOM | 95 | N | LYS | A | 13 | −38.164 | 2.508 | 93.053 | 1.00 | 36.92 | N |
| ATOM | 96 | CA | LYS | A | 13 | −39.141 | 3.391 | 93.665 | 1.00 | 36.42 | C |
| ATOM | 97 | C | LYS | A | 13 | −40.505 | 3.163 | 93.036 | 1.00 | 35.60 | C |
| ATOM | 98 | O | LYS | A | 13 | −40.605 | 2.637 | 91.921 | 1.00 | 39.97 | O |
| ATOM | 99 | CB | LYS | A | 13 | −38.711 | 4.848 | 93.499 | 1.00 | 41.56 | C |
| ATOM | 100 | CG | LYS | A | 13 | −37.227 | 5.088 | 93.781 | 1.00 | 52.81 | C |
| ATOM | 101 | CD | LYS | A | 13 | −36.541 | 5.678 | 92.538 | 1.00 | 68.42 | C |
| ATOM | 102 | CE | LYS | A | 13 | −35.056 | 5.297 | 92.399 | 1.00 | 70.40 | C |
| ATOM | 103 | NZ | LYS | A | 13 | −34.516 | 5.679 | 91.038 | 1.00 | 67.86 | N1+ |
| ATOM | 104 | N | PRO | A | 14 | −41.587 | 3.512 | 93.736 | 1.00 | 32.85 | N |
| ATOM | 105 | CA | PRO | A | 14 | −42.932 | 3.257 | 93.200 | 1.00 | 31.49 | C |
| ATOM | 106 | C | PRO | A | 14 | −43.114 | 3.852 | 91.806 | 1.00 | 38.32 | C |
| ATOM | 107 | O | PRO | A | 14 | −42.521 | 4.880 | 91.465 | 1.00 | 35.32 | O |
| ATOM | 108 | CB | PRO | A | 14 | −43.852 | 3.929 | 94.218 | 1.00 | 25.23 | C |
| ATOM | 109 | CG | PRO | A | 14 | −43.104 | 3.927 | 95.441 | 1.00 | 29.72 | C |
| ATOM | 110 | CD | PRO | A | 14 | −41.646 | 4.040 | 95.105 | 1.00 | 33.69 | C |
| ATOM | 111 | N | SER | A | 15 | −43.920 | 3.155 | 90.996 | 1.00 | 36.29 | N |
| ATOM | 112 | CA | SER | A | 15 | −44.274 | 3.500 | 89.622 | 1.00 | 33.19 | C |
| ATOM | 113 | C | SER | A | 15 | −43.184 | 3.147 | 88.614 | 1.00 | 34.56 | C |
| ATOM | 114 | O | SER | A | 15 | −43.472 | 3.106 | 87.414 | 1.00 | 34.31 | O |
| ATOM | 115 | CB | SER | A | 15 | −44.597 | 4.994 | 89.468 | 1.00 | 38.65 | C |
| ATOM | 116 | OG | SER | A | 15 | −43.421 | 5.751 | 89.168 | 1.00 | 34.68 | O |

TABLE 10.4-continued

| ATOM | 117 | N | GLU | A | 16 | −41.943 | 2.899 | 89.051 | 1.00 | 30.66 | N |
|---|---|---|---|---|---|---|---|---|---|---|---|
| ATOM | 118 | CA | GLU | A | 16 | −40.952 | 2.443 | 88.083 | 1.00 | 28.63 | C |
| ATOM | 119 | C | GLU | A | 16 | −41.330 | 1.055 | 87.551 | 1.00 | 33.32 | C |
| ATOM | 120 | O | GLU | A | 16 | −42.281 | 0.410 | 88.010 | 1.00 | 35.10 | O |
| ATOM | 121 | CB | GLU | A | 16 | −39.539 | 2.437 | 88.684 | 1.00 | 30.89 | C |
| ATOM | 122 | CG | GLU | A | 16 | −39.075 | 3.729 | 89.360 | 1.00 | 31.88 | C |
| ATOM | 123 | CD | GLU | A | 16 | −37.549 | 3.780 | 89.616 | 1.00 | 49.97 | C |
| ATOM | 124 | OE1 | GLU | A | 16 | −36.907 | 2.727 | 89.843 | 1.00 | 54.84 | O |
| ATOM | 125 | OE2 | GLU | A | 16 | −36.967 | 4.885 | 89.556 | 1.00 | 57.53 | O |
| ATOM | 126 | N | THR | A | 17 | −40.583 | 0.583 | 86.565 | 1.00 | 32.70 | N |
| ATOM | 127 | CA | THR | A | 17 | −40.829 | −0.744 | 86.034 | 1.00 | 35.01 | C |
| ATOM | 128 | C | THR | A | 17 | −39.637 | −1.655 | 86.318 | 1.00 | 38.16 | C |
| ATOM | 129 | O | THR | A | 17 | −38.473 | −1.238 | 86.259 | 1.00 | 36.52 | O |
| ATOM | 130 | CB | THR | A | 17 | −41.198 | −0.690 | 84.543 | 1.00 | 36.57 | C |
| ATOM | 131 | OG1 | THR | A | 17 | −40.325 | −1.515 | 83.766 | 1.00 | 34.00 | O |
| ATOM | 132 | CG2 | THR | A | 17 | −41.198 | 0.711 | 84.055 | 1.00 | 37.19 | C |
| ATOM | 133 | N | LEU | A | 18 | −39.955 | −2.874 | 86.733 | 1.00 | 35.90 | N |
| ATOM | 134 | CA | LEU | A | 18 | −38.969 | −3.873 | 87.100 | 1.00 | 33.49 | C |
| ATOM | 135 | C | LEU | A | 18 | −38.603 | −4.669 | 85.861 | 1.00 | 32.72 | C |
| ATOM | 136 | O | LEU | A | 18 | −39.482 | −5.056 | 85.082 | 1.00 | 30.94 | O |
| ATOM | 137 | CB | LEU | A | 18 | −39.537 | −4.770 | 88.209 | 1.00 | 34.34 | C |
| ATOM | 138 | CG | LEU | A | 18 | −38.899 | −6.037 | 88.790 | 1.00 | 34.31 | C |
| ATOM | 139 | C1 | LEU | A | 18 | −39.067 | −7.231 | 87.855 | 1.00 | 31.61 | C |
| ATOM | 140 | CD2 | LEU | A | 18 | −37.433 | −5.823 | 89.128 | 1.00 | 34.33 | C |
| ATOM | 141 | N | SER | A | 19 | −37.309 | −4.888 | 85.660 | 1.00 | 31.86 | N |
| ATOM | 142 | CA | SER | A | 19 | −36.877 | −5.700 | 84.536 | 1.00 | 35.19 | C |
| ATOM | 143 | C | SER | A | 19 | −35.754 | −6.613 | 85.001 | 1.00 | 31.16 | C |
| ATOM | 144 | O | SER | A | 19 | −34.777 | −6.145 | 85.596 | 1.00 | 30.06 | O |
| ATOM | 145 | CB | SER | A | 19 | −36.449 | −4.841 | 83.346 | 1.00 | 33.07 | C |
| ATOM | 146 | OG | SER | A | 19 | −35.218 | −4.239 | 83.612 | 1.00 | 47.41 | O |
| ATOM | 147 | N | LEU | A | 20 | −35.934 | −7.916 | 84.768 | 1.00 | 25.55 | N |
| ATOM | 148 | CA | LEU | A | 20 | −35.022 | −8.962 | 85.214 | 1.00 | 28.53 | C |
| ATOM | 149 | C | LEU | A | 20 | −34.777 | −9.941 | 84.074 | 1.00 | 27.96 | C |
| ATOM | 150 | O | LEU | A | 20 | −35.643 | −10.142 | 83.220 | 1.00 | 27.00 | O |
| ATOM | 151 | CB | LEU | A | 20 | −35.596 | −9.712 | 86.425 | 1.00 | 26.52 | C |
| ATOM | 152 | CG | LEU | A | 20 | −35.939 | −8.899 | 87.678 | 1.00 | 29.44 | C |
| ATOM | 153 | CD1 | LEU | A | 20 | −36.684 | −9.780 | 88.650 | 1.00 | 34.23 | C |
| ATOM | 154 | CD2 | LEU | A | 20 | −34.683 | −8.369 | 88.365 | 1.00 | 31.36 | C |
| ATOM | 155 | N | THR | A | 21 | −33.589 | −10.552 | 84.061 | 1.00 | 28.15 | N |
| ATOM | 156 | CA | THR | A | 21 | −33.237 | −11.526 | 83.034 | 1.00 | 30.18 | C |
| ATOM | 157 | C | THR | A | 21 | −32.621 | −12.772 | 83.663 | 1.00 | 33.03 | C |
| ATOM | 158 | O | THR | A | 21 | −31.918 | −12.678 | 84.673 | 1.00 | 38.27 | O |
| ATOM | 159 | CB | THR | A | 21 | −32.240 | −10.913 | 82.023 | 1.00 | 32.85 | C |
| ATOM | 160 | OG1 | THR | A | 21 | −32.757 | −9.670 | 81.536 | 1.00 | 32.16 | O |
| ATOM | 161 | CG2 | THR | A | 21 | −31.977 | −11.866 | 80.841 | 1.00 | 28.45 | C |
| ATOM | 162 | N | CYS | A | 22 | −32.883 | −13.939 | 83.053 | 1.00 | 27.52 | N |
| ATOM | 163 | CA | CYS | A | 22 | −32.197 | −15.190 | 83.374 | 1.00 | 32.00 | C |
| ATOM | 164 | C | CYS | A | 22 | −31.452 | −15.675 | 82.149 | 1.00 | 29.74 | C |
| ATOM | 165 | O | CYS | A | 22 | −31.974 | −15.629 | 81.036 | 1.00 | 26.79 | O |
| ATOM | 166 | CB | CYS | A | 22 | −33.116 | −16.343 | 83.872 | 1.00 | 27.00 | C |
| ATOM | 167 | SG | CYS | A | 22 | −33.354 | −16.118 | 85.624 | 1.00 | 68.31 | S |
| ATOM | 168 | N | ALA | A | 23 | −30.228 | −16.135 | 82.379 | 1.00 | 32.24 | N |
| ATOM | 169 | CA | ALA | A | 23 | −29.397 | −16.762 | 81.370 | 1.00 | 32.34 | C |
| ATOM | 170 | C | ALA | A | 23 | −29.311 | −18.234 | 81.721 | 1.00 | 30.10 | C |
| ATOM | 171 | O | ALA | A | 23 | −29.020 | −18.577 | 82.867 | 1.00 | 34.73 | O |
| ATOM | 172 | CB | ALA | A | 23 | −28.004 | −16.125 | 81.339 | 1.00 | 32.68 | C |
| ATOM | 173 | N | VAL | A | 24 | −29.614 | −19.093 | 80.763 | 1.00 | 27.15 | N |
| ATOM | 174 | CA | VAL | A | 24 | −29.616 | −20.533 | 80.977 | 1.00 | 32.40 | C |
| ATOM | 175 | C | VAL | A | 24 | −28.371 | −21.124 | 80.342 | 1.00 | 32.49 | C |
| ATOM | 176 | O | VAL | A | 24 | −28.115 | −20.916 | 79.155 | 1.00 | 31.92 | O |
| ATOM | 177 | CB | VAL | A | 24 | −30.872 | −21.204 | 80.377 | 1.00 | 31.63 | C |
| ATOM | 178 | CG1 | VAL | A | 24 | −30.833 | −22.694 | 80.642 | 1.00 | 23.27 | C |
| ATOM | 179 | CG2 | VAL | A | 24 | −32.187 | −20.590 | 80.898 | 1.00 | 27.72 | C |
| ATOM | 180 | N | SER | A | 25 | −27.609 | −21.875 | 81.117 | 1.00 | 37.38 | N |
| ATOM | 181 | CA | SER | A | 25 | −26.471 | −22.620 | 80.602 | 1.00 | 34.69 | C |
| ATOM | 182 | C | SER | A | 25 | −26.544 | −24.037 | 81.136 | 1.00 | 37.68 | C |
| ATOM | 183 | O | SER | A | 25 | −27.107 | −24.279 | 82.206 | 1.00 | 45.11 | O |
| ATOM | 184 | CB | SER | A | 25 | −25.146 | −21.979 | 81.013 | 1.00 | 35.05 | C |
| ATOM | 185 | OG | SER | A | 25 | −25.168 | −21.665 | 82.396 | 1.00 | 40.52 | O |
| ATOM | 186 | N | GLY | A | 26 | −25.978 | −24.977 | 80.405 | 1.00 | 31.17 | N |
| ATOM | 187 | CA | GLY | A | 26 | −25.970 | −26.319 | 80.939 | 1.00 | 34.95 | C |
| ATOM | 188 | C | GLY | A | 26 | −26.773 | −27.339 | 80.181 | 1.00 | 44.75 | C |
| ATOM | 189 | O | GLY | A | 26 | −26.261 | −28.422 | 79.895 | 1.00 | 53.93 | O |
| ATOM | 190 | N | GLY | A | 27 | −28.035 | −27.049 | 79.897 | 1.00 | 43.99 | N |
| ATOM | 191 | CA | GLY | A | 27 | −28.827 | −28.022 | 79.179 | 1.00 | 39.13 | C |
| ATOM | 192 | C | GLY | A | 27 | −29.426 | −27.412 | 77.935 | 1.00 | 44.00 | C |
| ATOM | 193 | O | GLY | A | 27 | −28.940 | −26.394 | 77.426 | 1.00 | 44.61 | O |
| ATOM | 194 | N | SER | A | 28 | −30.525 | −27.991 | 77.475 | 1.00 | 48.00 | N |
| ATOM | 195 | CA | SER | A | 28 | −31.204 | −27.507 | 76.286 | 1.00 | 42.16 | C |
| ATOM | 196 | C | SER | A | 28 | −32.051 | −26.285 | 76.611 | 1.00 | 41.49 | C |

TABLE 10.4-continued

| | | | | | | | | | | | |
|---|---|---|---|---|---|---|---|---|---|---|---|
| ATOM | 197 | O | SER | A | 28 | −32.302 | −25.961 | 77.778 | 1.00 | 37.48 | O |
| ATOM | 198 | CB | SER | A | 28 | −32.071 | −28.605 | 75.684 | 1.00 | 39.00 | C |
| ATOM | 199 | OG | SER | A | 28 | −31.253 | −29.679 | 75.263 | 1.00 | 45.34 | O |
| ATOM | 200 | N | PHE | A | 29 | −32.448 | −25.569 | 75.552 | 1.00 | 39.22 | N |
| ATOM | 201 | CA | PHE | A | 29 | −33.327 | −24.425 | 75.695 | 1.00 | 34.42 | C |
| ATOM | 202 | C | PHE | A | 29 | −34.696 | −24.653 | 75.097 | 1.00 | 38.24 | C |
| ATOM | 203 | O | PHE | A | 29 | −35.628 | −23.923 | 75.439 | 1.00 | 40.29 | O |
| ATOM | 204 | CB | PHE | A | 29 | −32.710 | −23.181 | 75.041 | 1.00 | 30.96 | C |
| ATOM | 205 | CG | PHE | A | 29 | −33.191 | −21.874 | 75.633 | 1.00 | 31.50 | C |
| ATOM | 206 | CD1 | PHE | A | 29 | −33.148 | −21.663 | 77.004 | 1.00 | 33.59 | C |
| ATOM | 207 | CD2 | PHE | A | 29 | −33.660 | −20.850 | 74.823 | 1.00 | 28.85 | C |
| ATOM | 208 | CE1 | PHE | A | 29 | −33.578 | −20.450 | 77.564 | 1.00 | 31.05 | C |
| ATOM | 209 | CE2 | PHE | A | 29 | −34.073 | −19.653 | 75.359 | 1.00 | 29.76 | C |
| ATOM | 210 | CZ | PHE | A | 29 | −34.042 | −19.449 | 76.740 | 1.00 | 30.19 | C |
| ATOM | 211 | N | ARG | A | 30 | −34.855 | −25.653 | 74.242 | 1.00 | 41.39 | N |
| ATOM | 212 | CA | ARG | A | 30 | −36.009 | −25.653 | 73.362 | 1.00 | 44.20 | C |
| ATOM | 213 | C | ARG | A | 30 | −37.145 | −26.551 | 73.833 | 1.00 | 39.55 | C |
| ATOM | 214 | O | ARG | A | 30 | −38.265 | −26.412 | 73.331 | 1.00 | 42.77 | O |
| ATOM | 215 | CB | ARG | A | 30 | −35.568 | −26.002 | 71.939 | 1.00 | 31.85 | C |
| ATOM | 216 | CG | ARG | A | 30 | −35.075 | −27.382 | 71.728 | 1.00 | 39.91 | C |
| ATOM | 217 | CD | ARG | A | 30 | −34.814 | −27.548 | 70.245 | 1.00 | 43.27 | C |
| ATOM | 218 | NE | ARG | A | 30 | −33.604 | −28.305 | 69.892 | 1.00 | 49.24 | N |
| ATOM | 219 | CZ | ARG | A | 30 | −32.393 | −28.213 | 70.464 | 1.00 | 57.67 | C |
| ATOM | 220 | NH1 | ARG | A | 30 | −31.409 | −28.969 | 69.985 | 1.00 | 63.98 | N |
| ATOM | 221 | NH2 | ARG | A | 30 | −32.135 | −27.413 | 71.512 | 1.00 | 54.11 | N |
| ATOM | 222 | N | TYR | A | 31 | −36.902 | −27.434 | 74.789 | 1.00 | 36.60 | N |
| ATOM | 223 | CA | TYR | A | 31 | −37.940 | −28.340 | 75.264 | 1.00 | 40.80 | C |
| ATOM | 224 | C | TYR | A | 31 | −38.685 | −27.821 | 76.489 | 1.00 | 37.66 | C |
| ATOM | 225 | O | TYR | A | 31 | −39.628 | −28.470 | 76.946 | 1.00 | 36.93 | O |
| ATOM | 226 | CB | TYR | A | 31 | −37.334 | −29.699 | 75.619 | 1.00 | 37.87 | C |
| ATOM | 227 | CG | TYR | A | 31 | −36.422 | −30.240 | 74.573 | 1.00 | 39.45 | C |
| ATOM | 228 | CD1 | TYR | A | 31 | −36.888 | −30.500 | 73.300 | 1.00 | 42.59 | C |
| ATOM | 229 | CD2 | TYR | A | 31 | −35.088 | −30.528 | 74.861 | 1.00 | 44.81 | C |
| ATOM | 230 | CE1 | TYR | A | 31 | −36.047 | −31.005 | 72.325 | 1.00 | 45.84 | C |
| ATOM | 231 | CE2 | TYR | A | 31 | −34.240 | −31.049 | 73.890 | 1.00 | 43.49 | C |
| ATOM | 232 | CZ | TYR | A | 31 | −34.729 | −31.281 | 72.625 | 1.00 | 43.29 | C |
| ATOM | 233 | OH | TYR | A | 31 | −33.922 | −31.803 | 71.648 | 1.00 | 43.72 | O |
| ATOM | 234 | N | TYR | A | 32 | −38.302 | −26.677 | 77.027 | 1.00 | 39.36 | N |
| ATOM | 235 | CA | TYR | A | 32 | −38.735 | −26.280 | 78.350 | 1.00 | 34.43 | C |
| ATOM | 236 | C | TYR | A | 32 | −39.587 | −25.028 | 78.263 | 1.00 | 38.74 | C |
| ATOM | 237 | O | TYR | A | 32 | −39.501 | −24.256 | 77.305 | 1.00 | 39.83 | O |
| ATOM | 238 | CB | TYR | A | 32 | −37.533 | −26.028 | 79.265 | 1.00 | 33.39 | C |
| ATOM | 239 | CG | TYR | A | 32 | −36.634 | −27.226 | 79.343 | 1.00 | 38.75 | C |
| ATOM | 240 | CD2 | TYR | A | 32 | −35.377 | −27.236 | 78.750 | 1.00 | 32.24 | C |
| ATOM | 241 | CD1 | TYR | A | 32 | −37.061 | −28.368 | 80.004 | 1.00 | 38.64 | C |
| ATOM | 242 | CE2 | TYR | A | 32 | −34.570 | −28.364 | 78.823 | 1.00 | 39.82 | C |
| ATOM | 243 | CE1 | TYR | A | 32 | −36.270 | −29.495 | 80.088 | 1.00 | 40.18 | C |
| ATOM | 244 | CZ | TYR | A | 32 | −35.029 | −29.505 | 79.499 | 1.00 | 46.72 | C |
| ATOM | 245 | OH | TYR | A | 32 | −34.278 | −30.668 | 79.604 | 1.00 | 41.88 | O |
| ATOM | 246 | N | TYR | A | 33 | −40.420 | −24.842 | 79.282 | 1.00 | 31.10 | N |
| ATOM | 247 | CA | TYR | A | 33 | −41.042 | −23.558 | 79.529 | 1.00 | 30.58 | C |
| ATOM | 248 | C | TYR | A | 33 | −40.221 | −22.800 | 80.563 | 1.00 | 30.77 | C |
| ATOM | 249 | O | TYR | A | 33 | −39.686 | −23.392 | 81.507 | 1.00 | 29.88 | O |
| ATOM | 250 | CB | TYR | A | 33 | −42.491 | −23.726 | 79.987 | 1.00 | 30.38 | C |
| ATOM | 251 | CG | TYR | A | 33 | −43.440 | −23.801 | 78.834 | 1.00 | 33.35 | C |
| ATOM | 252 | CD2 | TYR | A | 33 | −44.211 | −22.698 | 78.485 | 1.00 | 33.18 | C |
| ATOM | 253 | CD1 | TYR | A | 33 | −43.550 | −24.966 | 78.059 | 1.00 | 33.82 | C |
| ATOM | 254 | CE2 | TYR | A | 33 | −45.080 | −22.746 | 77.407 | 1.00 | 36.40 | C |
| ATOM | 255 | CE1 | TYR | A | 33 | −44.430 | −25.030 | 76.976 | 1.00 | 33.85 | C |
| ATOM | 256 | CZ | TYR | A | 33 | −45.186 | −23.909 | 76.655 | 1.00 | 39.33 | C |
| ATOM | 257 | OH | TYR | A | 33 | −46.051 | −23.924 | 75.590 | 1.00 | 39.05 | O |
| ATOM | 258 | N | TRP | A | 34 | −40.133 | −21.490 | 80.381 | 1.00 | 25.37 | N |
| ATOM | 259 | CA | TRP | A | 34 | −39.285 | −20.639 | 81.189 | 1.00 | 25.30 | C |
| ATOM | 260 | C | TRP | A | 34 | −40.172 | −19.666 | 81.940 | 1.00 | 30.32 | C |
| ATOM | 261 | O | TRP | A | 34 | −41.013 | −18.993 | 81.328 | 1.00 | 28.04 | O |
| ATOM | 262 | CB | TRP | A | 34 | −38.242 | −19.932 | 80.310 | 1.00 | 27.04 | C |
| ATOM | 263 | CG | TRP | A | 34 | −37.375 | −20.952 | 79.641 | 1.00 | 28.16 | C |
| ATOM | 264 | CD1 | TRP | A | 34 | −37.436 | −21.371 | 78.333 | 1.00 | 31.12 | C |
| ATOM | 265 | CD2 | TRP | A | 34 | −36.410 | −21.787 | 80.279 | 1.00 | 28.13 | C |
| ATOM | 266 | NE1 | TRP | A | 34 | −36.525 | −22.375 | 78.110 | 1.00 | 27.45 | N |
| ATOM | 267 | CE2 | TRP | A | 34 | −35.881 | −22.653 | 79.287 | 1.00 | 31.81 | C |
| ATOM | 268 | CE3 | TRP | A | 34 | −35.920 | −21.875 | 81.587 | 1.00 | 28.15 | C |
| ATOM | 269 | CZ2 | TRP | A | 34 | −34.880 | −23.591 | 79.567 | 1.00 | 31.29 | C |
| ATOM | 270 | CZ3 | TRP | A | 34 | −34.911 | −22.807 | 81.864 | 1.00 | 29.29 | C |
| ATOM | 271 | CH2 | TRP | A | 34 | −34.411 | −23.654 | 80.858 | 1.00 | 25.81 | C |
| ATOM | 272 | N | SER | A | 35 | −39.993 | −19.608 | 83.268 | 1.00 | 28.16 | N |
| ATOM | 273 | CA | SER | A | 35 | −41.009 | −19.048 | 84.150 | 1.00 | 29.83 | C |
| ATOM | 274 | C | SER | A | 35 | −40.463 | −17.999 | 85.106 | 1.00 | 27.98 | C |
| ATOM | 275 | O | SER | A | 35 | −39.266 | −17.907 | 85.361 | 1.00 | 25.65 | O |
| ATOM | 276 | CB | SER | A | 35 | −41.677 | −20.145 | 84.957 | 1.00 | 25.41 | C |

TABLE 10.4-continued

| | | | | | | | | | | |
|---|---|---|---|---|---|---|---|---|---|---|
| ATOM | 277 | OG | SER | A | 35 | −42.298 | −21.049 | 84.068 | 1.00 | 33.06 | O |
| ATOM | 278 | N | TRP | A | 36 | −41.388 | −17.224 | 85.655 | 1.00 | 26.15 | N |
| ATOM | 279 | CA | TRP | A | 36 | −41.091 | −16.278 | 86.712 | 1.00 | 23.95 | C |
| ATOM | 280 | C | TRP | A | 36 | −42.037 | −16.535 | 87.877 | 1.00 | 26.92 | C |
| ATOM | 281 | O | TRP | A | 36 | −43.249 | −16.680 | 87.693 | 1.00 | 24.36 | O |
| ATOM | 282 | CB | TRP | A | 36 | −41.200 | −14.847 | 86.204 | 1.00 | 21.96 | C |
| ATOM | 283 | CG | TRP | A | 36 | −40.123 | −14.545 | 85.243 | 1.00 | 27.15 | C |
| ATOM | 284 | CD1 | TRP | A | 36 | −40.208 | −14.586 | 83.880 | 1.00 | 28.66 | C |
| ATOM | 285 | CD2 | TRP | A | 36 | −38.764 | −14.186 | 85.550 | 1.00 | 30.43 | C |
| ATOM | 286 | NE1 | TRP | A | 36 | −38.998 | −14.263 | 83.319 | 1.00 | 28.45 | N |
| ATOM | 287 | CE2 | TRP | A | 36 | −38.092 | −14.011 | 84.318 | 1.00 | 31.09 | C |
| ATOM | 288 | CE3 | TRP | A | 36 | −38.051 | −13.988 | 86.744 | 1.00 | 26.18 | C |
| ATOM | 289 | CZ2 | TRP | A | 36 | −36.736 | −13.635 | 84.245 | 1.00 | 30.83 | C |
| ATOM | 290 | CZ3 | TRP | A | 36 | −36.710 | −13.624 | 86.669 | 1.00 | 31.94 | C |
| ATOM | 291 | CH2 | TRP | A | 36 | −36.065 | −13.444 | 85.426 | 1.00 | 27.34 | C |
| ATOM | 292 | N | ILE | A | 37 | −41.470 | −16.623 | 89.072 | 1.00 | 28.61 | N |
| ATOM | 293 | CA | ILE | A | 37 | −42.220 | −16.887 | 90.289 | 1.00 | 25.71 | C |
| ATOM | 294 | C | ILE | A | 37 | −41.703 | −15.924 | 91.344 | 1.00 | 26.51 | C |
| ATOM | 295 | O | ILE | A | 37 | −40.485 | −15.758 | 91.473 | 1.00 | 28.46 | O |
| ATOM | 296 | CB | ILE | A | 37 | −42.043 | −18.359 | 90.726 | 1.00 | 28.49 | C |
| ATOM | 297 | CG1 | ILE | A | 37 | −42.496 | −19.298 | 89.602 | 1.00 | 20.22 | C |
| ATOM | 298 | CG2 | ILE | A | 37 | −42.842 | −18.657 | 91.998 | 1.00 | 30.40 | C |
| ATOM | 299 | CD1 | ILE | A | 37 | −41.935 | −20.641 | 89.672 | 1.00 | 19.85 | C |
| ATOM | 300 | N | ARG | A | 38 | −42.608 | −15.271 | 92.089 | 1.00 | 27.82 | N |
| ATOM | 301 | CA | ARG | A | 38 | −42.178 | −14.383 | 93.172 | 1.00 | 31.79 | C |
| ATOM | 302 | C | ARG | A | 38 | −42.654 | −14.877 | 94.535 | 1.00 | 29.28 | C |
| ATOM | 303 | O | ARG | A | 38 | −43.711 | −15.493 | 94.666 | 1.00 | 30.31 | O |
| ATOM | 304 | CB | ARG | A | 38 | −42.642 | −12.902 | 92.983 | 1.00 | 25.98 | C |
| ATOM | 305 | CG | ARG | A | 38 | −44.132 | −12.704 | 92.827 | 1.00 | 30.50 | C |
| ATOM | 306 | CD | ARG | A | 38 | −44.718 | −11.710 | 93.796 | 1.00 | 31.27 | C |
| ATOM | 307 | NE | ARG | A | 38 | −44.660 | −10.332 | 93.330 | 1.00 | 38.33 | N |
| ATOM | 308 | CZ | ARG | A | 38 | −45.723 | −9.550 | 93.118 | 1.00 | 40.05 | C |
| ATOM | 309 | NH1 | ARG | A | 38 | −46.967 | −9.987 | 93.311 | 1.00 | 29.85 | N1+ |
| ATOM | 310 | NH2 | ARG | A | 38 | −45.529 | −8.307 | 92.711 | 1.00 | 35.67 | N |
| ATOM | 311 | N | GLN | A | 39 | −41.874 | −14.544 | 95.561 | 1.00 | 29.83 | N |
| ATOM | 312 | CA | GLN | A | 39 | −42.189 | −14.894 | 96.940 | 1.00 | 29.44 | C |
| ATOM | 313 | C | GLN | A | 39 | −42.070 | −13.629 | 97.776 | 1.00 | 30.99 | C |
| ATOM | 314 | O | GLN | A | 39 | −40.945 | −13.189 | 98.072 | 1.00 | 30.65 | O |
| ATOM | 315 | CB | GLN | A | 39 | −41.278 | −15.997 | 97.467 | 1.00 | 26.80 | C |
| ATOM | 316 | CG | GLN | A | 39 | −41.737 | −16.561 | 98.799 | 1.00 | 29.10 | C |
| ATOM | 317 | CD | GLN | A | 39 | −41.020 | −17.825 | 99.195 | 1.00 | 32.69 | C |
| ATOM | 318 | OE1 | GLN | A | 39 | −39.808 | −17.945 | 99.051 | 1.00 | 34.15 | O |
| ATOM | 319 | NE2 | GLN | A | 39 | −41.773 | −18.787 | 99.702 | 1.00 | 36.84 | N |
| ATOM | 320 | N | PRO | A | 40 | −43.199 | −13.006 | 98.142 | 1.00 | 32.88 | N |
| ATOM | 321 | CA | PRO | A | 40 | −43.142 | −11.823 | 99.012 | 1.00 | 32.74 | C |
| ATOM | 322 | C | PRO | A | 40 | −42.699 | −12.202 | 100.414 | 1.00 | 37.01 | C |
| ATOM | 323 | O | PRO | A | 40 | −42.970 | −13.320 | 100.883 | 1.00 | 37.15 | O |
| ATOM | 324 | CB | PRO | A | 40 | −44.590 | −11.305 | 99.005 | 1.00 | 28.52 | C |
| ATOM | 325 | CG | PRO | A | 40 | −45.230 | −11.963 | 97.786 | 1.00 | 33.90 | C |
| ATOM | 326 | CD | PRO | A | 40 | −44.566 | −13.290 | 97.668 | 1.00 | 32.61 | C |
| ATOM | 327 | N | PRO | A | 41 | −42.011 | −11.304 | 101.120 | 1.00 | 41.34 | N |
| ATOM | 328 | CA | PRO | A | 41 | −41.405 | −11.689 | 102.405 | 1.00 | 35.97 | C |
| ATOM | 329 | C | PRO | A | 41 | −42.486 | −12.089 | 103.398 | 1.00 | 39.15 | C |
| ATOM | 330 | O | PRO | A | 41 | −43.499 | −11.400 | 103.564 | 1.00 | 39.19 | O |
| ATOM | 331 | CB | PRO | A | 41 | −40.643 | −10.430 | 102.834 | 1.00 | 35.82 | C |
| ATOM | 332 | CG | PRO | A | 41 | −41.378 | −9.304 | 102.151 | 1.00 | 36.54 | C |
| ATOM | 333 | CD | PRO | A | 41 | −41.862 | −9.861 | 100.839 | 1.00 | 32.74 | C |
| ATOM | 334 | N | GLY | A | 42 | −42.264 | −13.220 | 104.057 | 1.00 | 39.49 | N |
| ATOM | 335 | CA | GLY | A | 42 | −43.319 | −13.884 | 104.786 | 1.00 | 43.62 | C |
| ATOM | 336 | C | GLY | A | 42 | −44.017 | −14.964 | 103.996 | 1.00 | 43.06 | C |
| ATOM | 337 | O | GLY | A | 42 | −45.137 | −15.343 | 104.347 | 1.00 | 44.55 | O |
| ATOM | 338 | N | LYS | A | 43 | −43.392 | −15.449 | 102.924 | 1.00 | 49.76 | N |
| ATOM | 339 | CA | LYS | A | 43 | −43.711 | −16.719 | 102.276 | 1.00 | 46.50 | C |
| ATOM | 340 | C | LYS | A | 43 | −44.975 | −16.606 | 101.432 | 1.00 | 41.59 | C |
| ATOM | 341 | O | LYS | A | 43 | −45.732 | −15.629 | 101.536 | 1.00 | 39.86 | O |
| ATOM | 342 | CB | LYS | A | 43 | −43.844 | −17.858 | 103.320 | 1.00 | 55.91 | C |
| ATOM | 343 | CG | LYS | A | 43 | −42.513 | −18.447 | 103.914 | 1.00 | 45.31 | C |
| ATOM | 344 | CD | LYS | A | 43 | −41.860 | −19.485 | 102.968 | 1.00 | 46.63 | C |
| ATOM | 345 | CE | LYS | A | 43 | −41.212 | −20.692 | 103.684 | 1.00 | 40.96 | C |
| ATOM | 346 | NZ | LYS | A | 43 | −39.846 | −20.507 | 104.327 | 1.00 | 38.05 | N |
| ATOM | 347 | N | GLY | A | 44 | −45.192 | −17.625 | 100.601 | 1.00 | 39.58 | N |
| ATOM | 348 | CA | GLY | A | 44 | −46.241 | −17.682 | 99.609 | 1.00 | 36.71 | C |
| ATOM | 349 | C | GLY | A | 44 | −45.620 | −17.601 | 98.231 | 1.00 | 37.64 | C |
| ATOM | 350 | O | GLY | A | 44 | −44.862 | −16.666 | 97.961 | 1.00 | 40.33 | O |
| ATOM | 351 | N | LEU | A | 45 | −45.870 | −18.568 | 97.359 | 1.00 | 32.84 | N |
| ATOM | 352 | CA | LEU | A | 45 | −45.302 | −18.533 | 96.019 | 1.00 | 31.46 | C |
| ATOM | 353 | C | LEU | A | 45 | −46.409 | −18.152 | 95.047 | 1.00 | 32.57 | C |
| ATOM | 354 | O | LEU | A | 45 | −47.476 | −18.773 | 95.054 | 1.00 | 37.03 | O |
| ATOM | 355 | CB | LEU | A | 45 | −44.665 | −19.877 | 95.649 | 1.00 | 29.61 | C |
| ATOM | 356 | CG | LEU | A | 45 | −43.412 | −20.297 | 96.434 | 1.00 | 28.20 | C |

TABLE 10.4-continued

| | | | | | | | | | | |
|---|---|---|---|---|---|---|---|---|---|---|
| ATOM | 357 | CD1 | LEU | A | 45 | −43.088 | −21.788 | 96.284 | 1.00 | 22.57 | C |
| ATOM | 358 | CD2 | LEU | A | 45 | −42.235 | −19.474 | 95.976 | 1.00 | 25.94 | C |
| ATOM | 359 | N | GLU | A | 46 | −46.150 | −17.152 | 94.201 | 1.00 | 27.39 | N |
| ATOM | 360 | CA | GLU | A | 46 | −47.092 | −16.747 | 93.168 | 1.00 | 31.51 | C |
| ATOM | 361 | C | GLU | A | 46 | −46.444 | −16.851 | 91.798 | 1.00 | 35.34 | C |
| ATOM | 362 | O | GLU | A | 46 | −45.360 | −16.303 | 91.565 | 1.00 | 32.92 | O |
| ATOM | 363 | CB | GLU | A | 46 | −47.602 | −15.323 | 93.347 | 1.00 | 29.82 | C |
| ATOM | 364 | CG | GLU | A | 46 | −47.130 | −14.572 | 94.552 | 1.00 | 39.23 | C |
| ATOM | 365 | CD | GLU | A | 46 | −47.805 | −13.180 | 94.638 | 1.00 | 55.69 | C |
| ATOM | 366 | OE1 | GLU | A | 46 | −48.162 | −12.613 | 93.554 | 1.00 | 51.35 | O |
| ATOM | 367 | OE2 | GLU | A | 46 | −48.001 | −12.680 | 95.784 | 1.00 | 52.13 | O1− |
| ATOM | 368 | N | TRP | A | 47 | −47.137 | −17.524 | 90.893 | 1.00 | 29.44 | N |
| ATOM | 369 | CA | TRP | A | 47 | −46.647 | −17.778 | 89.551 | 1.00 | 30.35 | C |
| ATOM | 370 | C | TRP | A | 47 | −46.982 | −16.605 | 88.644 | 1.00 | 32.75 | C |
| ATOM | 371 | O | TRP | A | 47 | −48.143 | −16.202 | 88.550 | 1.00 | 36.68 | O |
| ATOM | 372 | CB | TRP | A | 47 | −47.265 | −19.068 | 89.037 | 1.00 | 24.36 | C |
| ATOM | 373 | CG | TRP | A | 47 | −46.961 | −19.432 | 87.637 | 1.00 | 29.61 | C |
| ATOM | 374 | CD1 | TRP | A | 47 | −45.883 | −20.133 | 87.188 | 1.00 | 25.71 | C |
| ATOM | 375 | CD2 | TRP | A | 47 | −47.784 | −19.186 | 86.495 | 1.00 | 28.45 | C |
| ATOM | 376 | NE1 | TRP | A | 47 | −45.979 | −20.319 | 85.840 | 1.00 | 26.95 | N |
| ATOM | 377 | CE2 | TRP | A | 47 | −47.136 | −19.748 | 85.388 | 1.00 | 25.32 | C |
| ATOM | 378 | CE3 | TRP | A | 47 | −49.001 | −18.540 | 86.303 | 1.00 | 25.64 | C |
| ATOM | 379 | CZ2 | TRP | A | 47 | −47.662 | −19.687 | 84.112 | 1.00 | 26.63 | C |
| ATOM | 380 | CZ3 | TRP | A | 47 | −49.517 | −18.479 | 85.032 | 1.00 | 29.15 | C |
| ATOM | 381 | CH2 | TRP | A | 47 | −48.853 | −19.054 | 83.953 | 1.00 | 27.51 | C |
| ATOM | 382 | N | PHE | A | 48 | −45.966 | −16.059 | 87.975 | 1.00 | 33.76 | N |
| ATOM | 383 | CA | PHE | A | 48 | −46.182 | −14.896 | 87.119 | 1.00 | 32.37 | C |
| ATOM | 384 | C | PHE | A | 48 | −46.601 | −15.253 | 85.708 | 1.00 | 32.57 | C |
| ATOM | 385 | O | PHE | A | 48 | −47.502 | −14.615 | 85.160 | 1.00 | 39.41 | O |
| ATOM | 386 | CB | PHE | A | 48 | −44.925 | −14.027 | 87.073 | 1.00 | 31.35 | C |
| ATOM | 387 | CG | PHE | A | 48 | −44.998 | −12.843 | 87.979 | 1.00 | 30.88 | C |
| ATOM | 388 | CD2 | PHE | A | 48 | −44.484 | −11.622 | 87.593 | 1.00 | 32.09 | C |
| ATOM | 389 | CD1 | PHE | A | 48 | −45.606 | −12.952 | 89.221 | 1.00 | 31.12 | C |
| ATOM | 390 | CE2 | PHE | A | 48 | −44.562 | −10.519 | 88.440 | 1.00 | 34.85 | C |
| ATOM | 391 | CE1 | PHE | A | 48 | −45.695 | −11.855 | 90.073 | 1.00 | 34.60 | C |
| ATOM | 392 | CZ | PHE | A | 48 | −45.165 | −10.639 | 89.683 | 1.00 | 36.89 | C |
| ATOM | 393 | N | GLY | A | 49 | −45.982 | −16.255 | 85.111 | 1.00 | 31.20 | N |
| ATOM | 394 | CA | GLY | A | 49 | −46.195 | −16.531 | 83.707 | 1.00 | 30.09 | C |
| ATOM | 395 | C | GLY | A | 49 | −45.089 | −17.418 | 83.178 | 1.00 | 31.55 | C |
| ATOM | 396 | O | GLY | A | 49 | −44.201 | −17.849 | 83.913 | 1.00 | 31.30 | O |
| ATOM | 397 | N | GLU | A | 50 | −45.176 | −17.704 | 81.881 | 1.00 | 28.58 | N |
| ATOM | 398 | CA | GLU | A | 50 | −44.233 | −18.608 | 81.247 | 1.00 | 27.28 | C |
| ATOM | 399 | C | GLU | A | 50 | −44.118 | −18.247 | 79.773 | 1.00 | 31.68 | C |
| ATOM | 400 | O | GLU | A | 50 | −45.015 | −17.630 | 79.199 | 1.00 | 32.98 | O |
| ATOM | 401 | CB | GLU | A | 50 | −44.669 | −20.060 | 81.434 | 1.00 | 26.85 | C |
| ATOM | 402 | CG | GLU | A | 50 | −46.040 | −20.348 | 80.874 | 1.00 | 29.78 | C |
| ATOM | 403 | CD | GLU | A | 50 | −46.438 | −21.812 | 81.020 | 1.00 | 35.37 | C |
| ATOM | 404 | OE1 | GLU | A | 50 | −47.350 | −22.259 | 80.271 | 1.00 | 37.88 | O |
| ATOM | 405 | OE2 | GLU | A | 50 | −45.834 | −22.514 | 81.875 | 1.00 | 28.88 | O |
| ATOM | 406 | N | ILE | A | 51 | −42.989 | −18.610 | 79.165 | 1.00 | 32.55 | N |
| ATOM | 407 | CA | ILE | A | 51 | −42.790 | −18.425 | 77.735 | 1.00 | 28.12 | C |
| ATOM | 408 | C | ILE | A | 51 | −42.187 | −19.702 | 77.167 | 1.00 | 34.07 | C |
| ATOM | 409 | O | ILE | A | 51 | −41.470 | −20.426 | 77.867 | 1.00 | 29.86 | O |
| ATOM | 410 | CB | ILE | A | 51 | −41.917 | −17.191 | 77.464 | 1.00 | 29.20 | C |
| ATOM | 411 | CG1 | ILE | A | 51 | −41.860 | −16.866 | 75.954 | 1.00 | 32.21 | C |
| ATOM | 412 | CG2 | ILE | A | 51 | −40.574 | −17.350 | 78.147 | 1.00 | 26.55 | C |
| ATOM | 413 | CD1 | ILE | A | 51 | −41.585 | −15.399 | 75.639 | 1.00 | 26.20 | C |
| ATOM | 414 | N | SER | A | 52 | −42.453 | −19.969 | 75.876 | 1.00 | 37.40 | N |
| ATOM | 415 | CA | SER | A | 52 | −42.398 | −21.343 | 75.378 | 1.00 | 41.14 | C |
| ATOM | 416 | C | SER | A | 52 | −41.162 | −21.701 | 74.563 | 1.00 | 43.60 | C |
| ATOM | 417 | O | SER | A | 52 | −40.851 | −22.904 | 74.473 | 1.00 | 56.16 | O |
| ATOM | 418 | CB | SER | A | 52 | −43.624 | −21.655 | 74.508 | 1.00 | 44.90 | C |
| ATOM | 419 | OG | SER | A | 52 | −43.499 | −21.091 | 73.211 | 1.00 | 42.47 | O |
| ATOM | 420 | N | HIS | A | 53 | −40.465 | −20.709 | 73.992 | 1.00 | 38.93 | N |
| ATOM | 421 | CA | HIS | A | 53 | −39.361 | −20.843 | 73.025 | 1.00 | 46.69 | C |
| ATOM | 422 | C | HIS | A | 53 | −39.838 | −20.322 | 71.682 | 1.00 | 40.68 | C |
| ATOM | 423 | O | HIS | A | 53 | −39.045 | −19.789 | 70.908 | 1.00 | 48.98 | O |
| ATOM | 424 | CB | HIS | A | 53 | −38.827 | −22.278 | 72.833 | 1.00 | 47.29 | C |
| ATOM | 425 | CG | HIS | A | 53 | −37.623 | −22.370 | 71.938 | 1.00 | 50.45 | C |
| ATOM | 426 | ND1 | HIS | A | 53 | −36.332 | −22.400 | 72.429 | 1.00 | 48.68 | N |
| ATOM | 427 | CD2 | HIS | A | 53 | −37.510 | −22.432 | 70.589 | 1.00 | 50.73 | C |
| ATOM | 428 | CE1 | HIS | A | 53 | −35.477 | −22.464 | 71.421 | 1.00 | 44.63 | C |
| ATOM | 429 | NE2 | HIS | A | 53 | −36.166 | −22.483 | 70.294 | 1.00 | 45.11 | N |
| ATOM | 430 | N | SER | A | 54 | −41.136 | −20.418 | 71.427 | 1.00 | 43.19 | N |
| ATOM | 431 | CA | SER | A | 54 | −41.723 | −19.986 | 70.163 | 1.00 | 37.71 | C |
| ATOM | 432 | C | SER | A | 54 | −41.978 | −18.486 | 69.934 | 1.00 | 41.91 | C |
| ATOM | 433 | O | SER | A | 54 | −42.167 | −18.132 | 68.783 | 1.00 | 58.83 | O |
| ATOM | 434 | CB | SER | A | 54 | −43.072 | −20.685 | 69.930 | 1.00 | 41.65 | C |
| ATOM | 435 | OG | SER | A | 54 | −43.284 | −21.786 | 70.799 | 1.00 | 58.13 | O |
| ATOM | 436 | N | GLY | A | 55 | −42.077 | −17.595 | 70.928 | 1.00 | 41.19 | N |

TABLE 10.4-continued

| | | | | | | | | | | |
|---|---|---|---|---|---|---|---|---|---|---|
| ATOM | 437 | CA | GLY | A | 55 | −42.199 | −17.864 | 72.342 | 1.00 | 37.12 | C |
| ATOM | 438 | C | GLY | A | 55 | −43.565 | −17.363 | 72.782 | 1.00 | 38.09 | C |
| ATOM | 439 | O | GLY | A | 55 | −43.782 | −16.170 | 73.025 | 1.00 | 35.63 | O |
| ATOM | 440 | N | SER | A | 56 | −44.514 | −18.290 | 72.843 | 1.00 | 35.38 | N |
| ATOM | 441 | CA | SER | A | 56 | −45.839 | −17.960 | 73.328 | 1.00 | 36.92 | C |
| ATOM | 442 | C | SER | A | 56 | −45.838 | −17.864 | 74.851 | 1.00 | 39.87 | C |
| ATOM | 443 | O | SER | A | 56 | −45.057 | −18.536 | 75.536 | 1.00 | 38.19 | O |
| ATOM | 444 | CB | SER | A | 56 | −46.855 | −19.002 | 72.851 | 1.00 | 43.51 | C |
| ATOM | 445 | OG | SER | A | 56 | −46.477 | −20.320 | 73.214 | 1.00 | 52.12 | O |
| ATOM | 446 | N | THR | A | 57 | −46.745 | −17.035 | 75.381 | 1.00 | 36.78 | N |
| ATOM | 447 | CA | THR | A | 57 | −46.758 | −16.688 | 76.792 | 1.00 | 35.49 | C |
| ATOM | 448 | C | THR | A | 57 | −48.106 | −17.037 | 77.412 | 1.00 | 36.54 | C |
| ATOM | 449 | O | THR | A | 57 | −49.129 | −17.068 | 76.738 | 1.00 | 36.43 | O |
| ATOM | 450 | CB | THR | A | 57 | −46.464 | −15.195 | 77.048 | 1.00 | 34.28 | C |
| ATOM | 451 | OG1 | THR | A | 57 | −47.488 | −14.390 | 76.463 | 1.00 | 34.38 | O |
| ATOM | 452 | CG2 | THR | A | 57 | −45.110 | −14.791 | 76.511 | 1.00 | 32.77 | C |
| ATOM | 453 | N | ASN | A | 58 | −48.081 | −17.324 | 78.707 | 1.00 | 34.99 | N |
| ATOM | 454 | CA | ASN | A | 58 | −49.282 | −17.540 | 79.497 | 1.00 | 35.60 | C |
| ATOM | 455 | C | ASN | A | 58 | −49.013 | −16.847 | 80.812 | 1.00 | 38.61 | C |
| ATOM | 456 | O | ASN | A | 58 | −48.117 | −17.271 | 81.548 | 1.00 | 38.39 | O |
| ATOM | 457 | CB | ASN | A | 58 | −49.562 | −19.013 | 79.731 | 1.00 | 33.14 | C |
| ATOM | 458 | CG | ASN | A | 58 | −49.588 | −19.785 | 78.459 | 1.00 | 38.06 | C |
| ATOM | 459 | OD1 | ASN | A | 58 | −50.518 | −19.669 | 77.673 | 1.00 | 42.44 | O |
| ATOM | 460 | ND2 | ASN | A | 58 | −48.555 | −20.583 | 78.234 | 1.00 | 37.72 | N |
| ATOM | 461 | N | TYR | A | 59 | −49.778 | −15.800 | 81.101 | 1.00 | 35.54 | N |
| ATOM | 462 | CA | TYR | A | 59 | −49.557 | −14.988 | 82.281 | 1.00 | 36.21 | C |
| ATOM | 463 | C | TYR | A | 59 | −50.617 | −15.291 | 83.325 | 1.00 | 34.45 | C |
| ATOM | 464 | O | TYR | A | 59 | −51.674 | −15.857 | 83.041 | 1.00 | 36.30 | O |
| ATOM | 465 | CB | TYR | A | 59 | −49.603 | −13.498 | 81.943 | 1.00 | 35.28 | C |
| ATOM | 466 | CG | TYR | A | 59 | −48.633 | −13.043 | 80.880 | 1.00 | 35.74 | C |
| ATOM | 467 | CD1 | TYR | A | 59 | −47.259 | −13.085 | 81.082 | 1.00 | 34.19 | C |
| ATOM | 468 | CD2 | TYR | A | 59 | −49.101 | −12.544 | 79.678 | 1.00 | 35.17 | C |
| ATOM | 469 | CE1 | TYR | A | 59 | −46.383 | −12.644 | 80.107 | 1.00 | 33.92 | C |
| ATOM | 470 | CE2 | TYR | A | 59 | −48.241 | −12.098 | 78.700 | 1.00 | 31.35 | C |
| ATOM | 471 | CZ | TYR | A | 59 | −46.888 | −12.143 | 78.912 | 1.00 | 37.17 | C |
| ATOM | 472 | OH | TYR | A | 59 | −46.055 | −11.690 | 77.915 | 1.00 | 33.15 | O |
| ATOM | 473 | N | ASN | A | 60 | −50.335 | −14.882 | 84.531 | 1.00 | 37.70 | N |
| ATOM | 474 | CA | ASN | A | 60 | −51.356 | −14.909 | 85.549 | 1.00 | 38.74 | C |
| ATOM | 475 | C | ASN | A | 60 | −52.356 | −13.791 | 85.274 | 1.00 | 42.68 | C |
| ATOM | 476 | O | ASN | A | 60 | −51.962 | −12.615 | 85.220 | 1.00 | 41.91 | O |
| ATOM | 477 | CB | ASN | A | 60 | −50.706 | −14.771 | 86.911 | 1.00 | 35.36 | C |
| ATOM | 478 | CG | ASN | A | 60 | −51.663 | −15.019 | 88.031 | 1.00 | 37.89 | C |
| ATOM | 479 | OD1 | ASN | A | 60 | −52.874 | −14.862 | 87.873 | 1.00 | 38.66 | O |
| ATOM | 480 | ND2 | ASN | A | 60 | −51.142 | −15.541 | 89.137 | 1.00 | 36.71 | N |
| ATOM | 481 | N | PRO | A | 61 | −53.642 | −14.102 | 85.084 | 1.00 | 43.65 | N |
| ATOM | 482 | CA | PRO | A | 61 | −54.609 | −13.045 | 84.741 | 1.00 | 37.57 | C |
| ATOM | 483 | C | PRO | A | 61 | −54.670 | −11.924 | 85.762 | 1.00 | 40.30 | C |
| ATOM | 484 | O | PRO | A | 61 | −54.997 | −10.786 | 85.405 | 1.00 | 42.33 | O |
| ATOM | 485 | CB | PRO | A | 61 | −55.931 | −13.820 | 84.677 | 1.00 | 32.38 | C |
| ATOM | 486 | CG | PRO | A | 61 | −55.502 | −15.207 | 84.249 | 1.00 | 39.32 | C |
| ATOM | 487 | CD | PRO | A | 61 | −54.273 | −15.439 | 85.092 | 1.00 | 39.25 | C |
| ATOM | 488 | N | SER | A | 62 | −54.321 | −12.218 | 87.016 | 1.00 | 40.22 | N |
| ATOM | 489 | CA | SER | A | 62 | −54.367 | −11.233 | 88.092 | 1.00 | 39.59 | C |
| ATOM | 490 | C | SER | A | 62 | −53.386 | −10.087 | 87.868 | 1.00 | 45.31 | C |
| ATOM | 491 | O | SER | A | 62 | −53.617 | −8.957 | 88.319 | 1.00 | 43.39 | O |
| ATOM | 492 | CB | SER | A | 62 | −54.058 | −11.920 | 89.419 | 1.00 | 40.43 | C |
| ATOM | 493 | OG | SER | A | 62 | −53.155 | −11.129 | 90.177 | 1.00 | 48.57 | O |
| ATOM | 494 | N | LEU | A | 63 | −52.237 | −10.383 | 87.272 | 1.00 | 45.35 | N |
| ATOM | 495 | CA | LEU | A | 63 | −51.297 | −9.329 | 86.930 | 1.00 | 44.69 | C |
| ATOM | 496 | C | LEU | A | 63 | −51.894 | −8.416 | 85.869 | 1.00 | 53.96 | C |
| ATOM | 497 | O | LEU | A | 63 | −51.658 | −7.201 | 85.861 | 1.00 | 54.71 | O |
| ATOM | 498 | CB | LEU | A | 63 | −50.001 | −9.971 | 86.440 | 1.00 | 43.57 | C |
| ATOM | 499 | CG | LEU | A | 63 | −49.158 | −10.633 | 87.535 | 1.00 | 43.51 | C |
| ATOM | 500 | CD1 | LEU | A | 63 | −47.844 | −11.134 | 86.978 | 1.00 | 40.31 | C |
| ATOM | 501 | CD2 | LEU | A | 63 | −48.888 | −9.663 | 88.691 | 1.00 | 43.97 | C |
| ATOM | 502 | N | LYS | A | 64 | −52.663 | −9.003 | 84.955 | 1.00 | 58.46 | N |
| ATOM | 503 | CA | LYS | A | 64 | −53.324 | −8.320 | 83.854 | 1.00 | 58.94 | C |
| ATOM | 504 | C | LYS | A | 64 | −52.277 | −7.745 | 82.912 | 1.00 | 51.96 | C |
| ATOM | 505 | O | LYS | A | 64 | −51.377 | −8.460 | 82.452 | 1.00 | 48.34 | O |
| ATOM | 506 | CB | LYS | A | 64 | −54.274 | −7.204 | 84.304 | 1.00 | 52.16 | C |
| ATOM | 507 | CG | LYS | A | 64 | −55.571 | −7.258 | 83.486 | 1.00 | 62.77 | C |
| ATOM | 508 | CD | LYS | A | 64 | −56.400 | −5.965 | 83.488 | 1.00 | 81.85 | C |
| ATOM | 509 | CE | LYS | A | 64 | −57.048 | −5.593 | 84.810 | 1.00 | 81.71 | C |
| ATOM | 510 | NZ | LYS | A | 64 | −57.659 | −4.226 | 84.694 | 1.00 | 73.63 | N |
| ATOM | 511 | N | ALA | A | 65 | −52.386 | −6.444 | 82.659 | 1.00 | 41.71 | N |
| ATOM | 512 | CA | ALA | A | 65 | −51.539 | −5.768 | 81.693 | 1.00 | 43.20 | C |
| ATOM | 513 | C | ALA | A | 65 | −50.168 | −5.367 | 82.231 | 1.00 | 38.62 | C |
| ATOM | 514 | O | ALA | A | 65 | −49.389 | −4.808 | 81.463 | 1.00 | 42.39 | O |
| ATOM | 515 | CB | ALA | A | 65 | −52.249 | −4.540 | 81.128 | 1.00 | 46.41 | C |
| ATOM | 516 | N | ARG | A | 66 | −49.867 | −5.542 | 83.523 | 1.00 | 38.64 | N |

TABLE 10.4-continued

| | | | | | | | | | | |
|---|---|---|---|---|---|---|---|---|---|---|
| ATOM | 517 | CA | ARG | A | 66 | −48.595 | −5.016 | 84.025 | 1.00 | 34.40 | C |
| ATOM | 518 | C | ARG | A | 66 | −47.377 | −5.847 | 83.627 | 1.00 | 36.18 | C |
| ATOM | 519 | O | ARG | A | 66 | −46.249 | −5.349 | 83.752 | 1.00 | 31.12 | O |
| ATOM | 520 | CB | ARG | A | 66 | −48.586 | −4.863 | 85.546 | 1.00 | 33.68 | C |
| ATOM | 521 | CG | ARG | A | 66 | −49.764 | −4.132 | 86.091 | 1.00 | 40.09 | C |
| ATOM | 522 | CD | ARG | A | 66 | −49.537 | −3.649 | 87.519 | 1.00 | 40.22 | C |
| ATOM | 523 | NE | ARG | A | 66 | −49.265 | −4.663 | 88.539 | 1.00 | 35.47 | N |
| ATOM | 524 | CZ | ARG | A | 66 | −48.148 | −4.713 | 89.268 | 1.00 | 34.74 | C |
| ATOM | 525 | NH1 | ARG | A | 66 | −47.168 | −3.842 | 89.065 | 1.00 | 33.41 | N1+ |
| ATOM | 526 | NH2 | ARG | A | 66 | −48.004 | −5.640 | 90.205 | 1.00 | 40.56 | N |
| ATOM | 527 | N | VAL | A | 67 | −47.559 | −7.095 | 83.188 | 1.00 | 34.62 | N |
| ATOM | 528 | CA | VAL | A | 67 | −46.463 | −8.049 | 83.084 | 1.00 | 36.24 | C |
| ATOM | 529 | C | VAL | A | 67 | −46.186 | −8.411 | 81.626 | 1.00 | 36.09 | C |
| ATOM | 530 | O | VAL | A | 67 | −47.113 | −8.575 | 80.828 | 1.00 | 36.24 | O |
| ATOM | 531 | CB | VAL | A | 67 | −46.782 | −9.292 | 83.935 | 1.00 | 34.93 | C |
| ATOM | 532 | CG1 | VAL | A | 67 | −47.992 | −9.994 | 83.388 | 1.00 | 41.56 | C |
| ATOM | 533 | CG2 | VAL | A | 67 | −45.596 | −10.222 | 83.981 | 1.00 | 36.82 | C |
| ATOM | 534 | N | THR | A | 68 | −44.894 | −8.531 | 81.289 | 1.00 | 35.40 | N |
| ATOM | 535 | CA | THR | A | 68 | −44.405 | −8.998 | 79.998 | 1.00 | 33.94 | C |
| ATOM | 536 | C | THR | A | 68 | −43.267 | −9.973 | 80.231 | 1.00 | 33.46 | C |
| ATOM | 537 | O | THR | A | 68 | −42.412 | −9.739 | 81.087 | 1.00 | 34.05 | O |
| ATOM | 538 | CB | THR | A | 68 | −43.854 | −7.882 | 79.090 | 1.00 | 37.93 | C |
| ATOM | 539 | OG1 | THR | A | 68 | −44.745 | −6.763 | 79.052 | 1.00 | 38.69 | O |
| ATOM | 540 | CG2 | THR | A | 68 | −43.621 | −8.423 | 77.672 | 1.00 | 27.13 | C |
| ATOM | 541 | N | ILE | A | 69 | −43.262 | −11.064 | 79.471 | 1.00 | 35.17 | N |
| ATOM | 542 | CA | ILE | A | 69 | −42.163 | −12.021 | 79.455 | 1.00 | 31.25 | C |
| ATOM | 543 | C | ILE | A | 69 | −41.710 | −12.169 | 78.008 | 1.00 | 37.24 | C |
| ATOM | 544 | O | ILE | A | 69 | −42.541 | −12.313 | 77.103 | 1.00 | 33.89 | O |
| ATOM | 545 | CB | ILE | A | 69 | −42.574 | −13.382 | 80.051 | 1.00 | 27.84 | C |
| ATOM | 546 | CG1 | ILE | A | 69 | −42.912 | −13.212 | 81.523 | 1.00 | 31.71 | C |
| ATOM | 547 | CG2 | ILE | A | 69 | −41.468 | −14.407 | 79.896 | 1.00 | 25.74 | C |
| ATOM | 548 | CD1 | ILE | A | 69 | −43.605 | −14.385 | 82.110 | 1.00 | 30.41 | C |
| ATOM | 549 | N | SER | A | 70 | −40.401 | −12.101 | 77.789 | 1.00 | 32.26 | N |
| ATOM | 550 | CA | SER | A | 70 | −39.826 | −12.197 | 76.460 | 1.00 | 29.37 | C |
| ATOM | 551 | C | SER | A | 70 | −38.678 | −13.195 | 76.500 | 1.00 | 33.52 | C |
| ATOM | 552 | O | SER | A | 70 | −38.103 | −13.470 | 77.557 | 1.00 | 32.58 | O |
| ATOM | 553 | CB | SER | A | 70 | −39.322 | −10.841 | 75.963 | 1.00 | 30.41 | C |
| ATOM | 554 | OG | SER | A | 70 | −38.395 | −10.282 | 76.888 | 1.00 | 41.93 | O |
| ATOM | 555 | N | ILE | A | 71 | −38.333 | −13.724 | 75.331 | 1.00 | 30.14 | N |
| ATOM | 556 | CA | ILE | A | 71 | −37.327 | −14.761 | 75.222 | 1.00 | 29.53 | C |
| ATOM | 557 | C | ILE | A | 71 | −36.358 | −14.414 | 74.097 | 1.00 | 34.98 | C |
| ATOM | 558 | O | ILE | A | 71 | −36.762 | −13.926 | 73.035 | 1.00 | 33.60 | O |
| ATOM | 559 | CB | ILE | A | 71 | −37.992 | −16.132 | 75.000 | 1.00 | 29.32 | C |
| ATOM | 560 | CG1 | ILE | A | 71 | −37.001 | −17.267 | 75.279 | 1.00 | 29.60 | C |
| ATOM | 561 | CG2 | ILE | A | 71 | −38.575 | −16.224 | 73.606 | 1.00 | 30.62 | C |
| ATOM | 562 | CD1 | ILE | A | 71 | −37.644 | −18.637 | 75.331 | 1.00 | 29.78 | C |
| ATOM | 563 | N | ASP | A | 72 | −35.076 | −14.658 | 74.339 | 1.00 | 33.23 | N |
| ATOM | 564 | CA | ASP | A | 72 | −34.016 | −14.453 | 73.355 | 1.00 | 32.69 | C |
| ATOM | 565 | C | ASP | A | 72 | −33.394 | −15.828 | 73.138 | 1.00 | 36.12 | C |
| ATOM | 566 | O | ASP | A | 72 | −32.525 | −16.242 | 73.910 | 1.00 | 37.95 | O |
| ATOM | 567 | CB | ASP | A | 72 | −33.008 | −13.415 | 73.862 | 1.00 | 31.36 | C |
| ATOM | 568 | CG | ASP | A | 72 | −31.876 | −13.113 | 72.861 | 1.00 | 47.78 | C |
| ATOM | 569 | OD2 | ASP | A | 72 | −31.214 | −12.051 | 73.040 | 1.00 | 43.89 | O |
| ATOM | 570 | OD1 | ASP | A | 72 | −31.629 | −13.924 | 71.921 | 1.00 | 48.56 | O |
| ATOM | 571 | N | THR | A | 73 | −33.847 | −16.547 | 72.100 | 1.00 | 39.39 | N |
| ATOM | 572 | CA | THR | A | 73 | −33.375 | −17.916 | 71.888 | 1.00 | 36.77 | C |
| ATOM | 573 | C | THR | A | 73 | −31.919 | −17.989 | 71.429 | 1.00 | 43.07 | C |
| ATOM | 574 | O | THR | A | 73 | −31.301 | −19.055 | 71.535 | 1.00 | 46.66 | O |
| ATOM | 575 | CB | THR | A | 73 | −34.251 | −18.621 | 70.868 | 1.00 | 36.60 | C |
| ATOM | 576 | OG1 | THR | A | 73 | −34.346 | −17.803 | 69.699 | 1.00 | 47.78 | O |
| ATOM | 577 | CG2 | THR | A | 73 | −35.625 | −18.860 | 71.428 | 1.00 | 33.19 | C |
| ATOM | 578 | N | SER | A | 74 | −31.349 | −16.886 | 70.949 | 1.00 | 40.76 | N |
| ATOM | 579 | CA | SER | A | 74 | −29.949 | −16.891 | 70.549 | 1.00 | 43.57 | C |
| ATOM | 580 | C | SER | A | 74 | −29.032 | −16.974 | 71.758 | 1.00 | 50.46 | C |
| ATOM | 581 | O | SER | A | 74 | −28.083 | −17.779 | 71.784 | 1.00 | 52.51 | O |
| ATOM | 582 | CB | SER | A | 74 | −29.654 | −15.639 | 69.744 | 1.00 | 48.36 | C |
| ATOM | 583 | OG | SER | A | 74 | −30.524 | −15.613 | 68.635 | 1.00 | 60.90 | O |
| ATOM | 584 | O | LYS | A | 75 | −28.334 | −16.929 | 76.160 | 1.00 | 39.85 | O |
| ATOM | 585 | N | LYS | A | 75 | −29.291 | −16.123 | 72.754 | 1.00 | 40.62 | N |
| ATOM | 586 | CA | LYS | A | 75 | −28.494 | −15.995 | 73.967 | 1.00 | 44.56 | C |
| ATOM | 587 | C | LYS | A | 75 | −28.929 | −16.951 | 75.076 | 1.00 | 39.19 | C |
| ATOM | 588 | CB | LYS | A | 75 | −28.574 | −14.552 | 74.490 | 1.00 | 42.65 | C |
| ATOM | 589 | CG | LYS | A | 75 | −28.087 | −13.508 | 73.502 | 1.00 | 48.05 | C |
| ATOM | 590 | CD | LYS | A | 75 | −28.250 | −12.099 | 74.045 | 1.00 | 49.13 | C |
| ATOM | 591 | CE | LYS | A | 75 | −28.043 | −11.079 | 72.924 | 1.00 | 55.25 | C |
| ATOM | 592 | NZ | LYS | A | 75 | −27.500 | −9.765 | 73.364 | 1.00 | 55.09 | N |
| ATOM | 593 | N | ASN | A | 76 | −29.936 | −17.793 | 74.823 | 1.00 | 43.17 | N |
| ATOM | 594 | CA | ASN | A | 76 | −30.578 | −18.625 | 75.845 | 1.00 | 36.87 | C |
| ATOM | 595 | C | ASN | A | 76 | −30.949 | −17.780 | 77.073 | 1.00 | 35.94 | C |
| ATOM | 596 | O | ASN | A | 76 | −30.668 | −18.130 | 78.221 | 1.00 | 33.33 | O |

TABLE 10.4-continued

| | | | | | | | | | | |
|---|---|---|---|---|---|---|---|---|---|---|
| ATOM | 597 | CB | ASN | A | 76 | −29.696 | −19.823 | 76.213 | 1.00 | 32.65 | C |
| ATOM | 598 | CG | ASN | A | 76 | −29.729 | −20.940 | 75.144 | 1.00 | 41.58 | C |
| ATOM | 599 | OD1 | ASN | A | 76 | −30.207 | −20.738 | 74.016 | 1.00 | 42.66 | O |
| ATOM | 600 | ND2 | ASN | A | 76 | −29.215 | −22.117 | 75.500 | 1.00 | 36.55 | N |
| ATOM | 601 | N | GLN | A | 77 | −31.635 | −16.668 | 76.813 | 1.00 | 29.24 | N |
| ATOM | 602 | CA | GLN | A | 77 | −32.064 | −15.729 | 77.828 | 1.00 | 28.20 | C |
| ATOM | 603 | C | GLN | A | 77 | −33.578 | −15.515 | 77.767 | 1.00 | 32.38 | C |
| ATOM | 604 | O | GLN | A | 77 | −34.233 | −15.760 | 76.747 | 1.00 | 32.97 | O |
| ATOM | 605 | CB | GLN | A | 77 | −31.365 | −14.391 | 77.668 | 1.00 | 31.15 | C |
| ATOM | 606 | CG | GLN | A | 77 | −29.894 | −14.376 | 78.032 | 1.00 | 35.97 | C |
| ATOM | 607 | CD | GLN | A | 77 | −29.313 | −12.956 | 77.951 | 1.00 | 39.65 | C |
| ATOM | 608 | OE1 | GLN | A | 77 | −29.979 | −12.017 | 77.502 | 1.00 | 40.22 | O |
| ATOM | 609 | NE2 | GLN | A | 77 | −28.096 | −12.792 | 78.433 | 1.00 | 41.23 | N |
| ATOM | 610 | N | PHE | A | 78 | −34.148 | −15.096 | 78.891 | 1.00 | 24.83 | N |
| ATOM | 611 | CA | PHE | A | 78 | −35.544 | −14.682 | 78.904 | 1.00 | 30.44 | C |
| ATOM | 612 | C | PHE | A | 78 | −35.711 | −13.657 | 80.014 | 1.00 | 28.14 | C |
| ATOM | 613 | O | PHE | A | 78 | −34.863 | −13.544 | 80.899 | 1.00 | 29.63 | O |
| ATOM | 614 | CB | PHE | A | 78 | −36.519 | −15.877 | 79.038 | 1.00 | 27.85 | C |
| ATOM | 615 | CG | PHE | A | 78 | −36.399 | −16.648 | 80.334 | 1.00 | 29.82 | C |
| ATOM | 616 | CD1 | PHE | A | 78 | −35.434 | −17.641 | 80.482 | 1.00 | 28.03 | C |
| ATOM | 617 | CD2 | PHE | A | 78 | −37.290 | −16.414 | 81.385 | 1.00 | 27.75 | C |
| ATOM | 618 | CE1 | PHE | A | 78 | −35.334 | −18.366 | 81.658 | 1.00 | 28.84 | C |
| ATOM | 619 | CE2 | PHE | A | 78 | −37.201 | −17.127 | 82.571 | 1.00 | 29.25 | C |
| ATOM | 620 | CZ | PHE | A | 78 | −36.224 | −18.108 | 82.713 | 1.00 | 31.58 | C |
| ATOM | 621 | N | SER | A | 79 | −36.779 | −12.866 | 79.933 | 1.00 | 27.98 | N |
| ATOM | 622 | CA | SER | A | 79 | −36.845 | −11.640 | 80.717 | 1.00 | 29.89 | C |
| ATOM | 623 | C | SER | A | 79 | −38.230 | −11.432 | 81.299 | 1.00 | 27.88 | C |
| ATOM | 624 | O | SER | A | 79 | −39.225 | −11.992 | 80.827 | 1.00 | 27.43 | O |
| ATOM | 625 | CB | SER | A | 79 | −36.437 | −10.410 | 79.881 | 1.00 | 27.31 | C |
| ATOM | 626 | OG | SER | A | 79 | −35.076 | −10.523 | 79.495 | 1.00 | 33.81 | O |
| ATOM | 627 | N | LEU | A | 80 | −38.270 | −10.585 | 82.327 | 1.00 | 24.79 | N |
| ATOM | 628 | CA | LEU | A | 80 | −39.503 | −10.224 | 82.998 | 1.00 | 25.66 | C |
| ATOM | 629 | C | LEU | A | 80 | −39.605 | −8.711 | 83.069 | 1.00 | 30.62 | C |
| ATOM | 630 | O | LEU | A | 80 | −38.669 | −8.045 | 83.525 | 1.00 | 32.93 | O |
| ATOM | 631 | CB | LEU | A | 80 | −39.563 | −10.806 | 84.409 | 1.00 | 30.64 | C |
| ATOM | 632 | CG | LEU | A | 80 | −40.803 | −10.348 | 85.179 | 1.00 | 29.58 | C |
| ATOM | 633 | CD2 | LEU | A | 80 | −40.702 | −10.668 | 86.648 | 1.00 | 29.00 | C |
| ATOM | 634 | CD1 | LEU | A | 80 | −42.002 | −11.007 | 84.558 | 1.00 | 27.41 | C |
| ATOM | 635 | N | LYS | A | 81 | −40.750 | −8.174 | 82.655 | 1.00 | 30.10 | N |
| ATOM | 636 | CA | LYS | A | 81 | −41.086 | −6.769 | 82.845 | 1.00 | 30.96 | C |
| ATOM | 637 | C | LYS | A | 81 | −42.340 | −6.677 | 83.705 | 1.00 | 30.22 | C |
| ATOM | 638 | O | LYS | A | 81 | −43.320 | −7.382 | 83.453 | 1.00 | 32.80 | O |
| ATOM | 639 | CB | LYS | A | 81 | −41.299 | −6.065 | 81.499 | 1.00 | 30.39 | C |
| ATOM | 640 | CG | LYS | A | 81 | −40.033 | −5.832 | 80.708 | 1.00 | 30.35 | C |
| ATOM | 641 | CD | LYS | A | 81 | −39.381 | −4.518 | 81.077 | 1.00 | 41.11 | C |
| ATOM | 642 | CE | LYS | A | 81 | −38.053 | −4.352 | 80.368 | 1.00 | 43.35 | C |
| ATOM | 643 | NZ | LYS | A | 81 | −38.187 | −4.617 | 78.920 | 1.00 | 51.59 | N |
| ATOM | 644 | N | LEU | A | 82 | −42.298 | −5.837 | 84.739 | 1.00 | 30.39 | N |
| ATOM | 645 | CA | LEU | A | 82 | −43.450 | −5.573 | 85.601 | 1.00 | 29.80 | C |
| ATOM | 646 | C | LEU | A | 82 | −43.573 | −4.071 | 85.755 | 1.00 | 32.85 | C |
| ATOM | 647 | O | LEU | A | 82 | −42.697 | −3.440 | 86.352 | 1.00 | 31.95 | O |
| ATOM | 648 | CB | LEU | A | 82 | −43.304 | −6.239 | 86.968 | 1.00 | 32.00 | C |
| ATOM | 649 | CG | LEU | A | 82 | −44.442 | −6.002 | 87.959 | 1.00 | 32.12 | C |
| ATOM | 650 | CD1 | LEU | A | 82 | −45.711 | −6.714 | 87.526 | 1.00 | 26.83 | C |
| ATOM | 651 | CD2 | LEU | A | 82 | −44.016 | −6.435 | 89.349 | 1.00 | 28.77 | C |
| ATOM | 652 | N | ARG | A | 83 | −44.645 | −3.505 | 85.209 | 1.00 | 35.72 | N |
| ATOM | 653 | CA | ARG | A | 83 | −44.790 | −2.062 | 85.113 | 1.00 | 33.38 | C |
| ATOM | 654 | C | ARG | A | 83 | −45.506 | −1.514 | 86.344 | 1.00 | 34.77 | C |
| ATOM | 655 | O | ARG | A | 83 | −46.221 | −2.234 | 87.051 | 1.00 | 37.08 | O |
| ATOM | 656 | CB | ARG | A | 83 | −45.556 | −1.686 | 83.838 | 1.00 | 30.94 | C |
| ATOM | 657 | CG | ARG | A | 83 | −44.709 | −1.827 | 82.572 | 1.00 | 31.53 | C |
| ATOM | 658 | CD | ARG | A | 83 | −45.526 | −1.799 | 81.301 | 1.00 | 34.78 | C |
| ATOM | 659 | NE | ARG | A | 83 | −46.273 | −3.036 | 81.049 | 1.00 | 36.35 | N |
| ATOM | 660 | CZ | ARG | A | 83 | −45.806 | −4.149 | 80.484 | 1.00 | 32.43 | C |
| ATOM | 661 | NH1 | ARG | A | 83 | −46.625 | −5.178 | 80.327 | 1.00 | 35.09 | N |
| ATOM | 662 | NH2 | ARG | A | 83 | −44.550 | −4.257 | 80.084 | 1.00 | 29.31 | N |
| ATOM | 663 | N | SER | A | 84 | −45.335 | −0.214 | 86.571 | 1.00 | 37.19 | N |
| ATOM | 664 | CA | SER | A | 84 | −46.105 | 0.534 | 87.573 | 1.00 | 35.36 | C |
| ATOM | 665 | C | SER | A | 84 | −46.068 | −0.152 | 88.936 | 1.00 | 39.37 | C |
| ATOM | 666 | O | SER | A | 84 | −47.092 | −0.470 | 89.546 | 1.00 | 39.10 | O |
| ATOM | 667 | CB | SER | A | 84 | −47.548 | 0.713 | 87.111 | 1.00 | 33.54 | C |
| ATOM | 668 | OG | SER | A | 84 | −47.598 | 1.374 | 85.864 | 1.00 | 48.40 | O |
| ATOM | 669 | N | VAL | A | 85 | −44.868 | −0.296 | 89.432 | 1.00 | 35.87 | N |
| ATOM | 670 | CA | VAL | A | 85 | −44.588 | −1.159 | 90.568 | 1.00 | 36.45 | C |
| ATOM | 671 | C | VAL | A | 85 | −44.889 | −0.417 | 91.872 | 1.00 | 34.18 | C |
| ATOM | 672 | O | VAL | A | 85 | −44.767 | 0.807 | 91.943 | 1.00 | 36.97 | O |
| ATOM | 673 | CB | VAL | A | 85 | −43.117 | −1.606 | 90.424 | 1.00 | 35.38 | C |
| ATOM | 674 | CG1 | VAL | A | 85 | −42.214 | −0.855 | 91.349 | 1.00 | 36.25 | C |
| ATOM | 675 | CG2 | VAL | A | 85 | −42.981 | −3.082 | 90.543 | 1.00 | 34.41 | C |
| ATOM | 676 | N | THR | A | 86 | −45.346 | −1.130 | 92.907 | 1.00 | 36.49 | N |

TABLE 10.4-continued

| | | | | | | | | | | |
|---|---|---|---|---|---|---|---|---|---|---|
| ATOM | 677 | CA | THR | A | 86 | −45.612 | −0.502 | 94.212 | 1.00 | 32.44 | C |
| ATOM | 678 | C | THR | A | 86 | −44.908 | −1.279 | 95.326 | 1.00 | 33.48 | C |
| ATOM | 679 | O | THR | A | 86 | −44.209 | −2.271 | 95.087 | 1.00 | 34.30 | O |
| ATOM | 680 | CB | THR | A | 86 | −47.107 | −0.413 | 94.556 | 1.00 | 32.14 | C |
| ATOM | 681 | OG1 | THR | A | 86 | −47.526 | −1.616 | 95.204 | 1.00 | 36.59 | O |
| ATOM | 682 | CG2 | THR | A | 86 | −47.956 | −0.200 | 93.321 | 1.00 | 27.41 | C |
| ATOM | 683 | N | ALA | A | 87 | −45.082 | −0.810 | 96.565 | 1.00 | 35.31 | N |
| ATOM | 684 | CA | ALA | A | 87 | −44.442 | −1.484 | 97.698 | 1.00 | 33.73 | C |
| ATOM | 685 | C | ALA | A | 87 | −44.927 | −2.921 | 97.822 | 1.00 | 31.88 | C |
| ATOM | 686 | O | ALA | A | 87 | −44.184 | −3.798 | 98.273 | 1.00 | 31.04 | O |
| ATOM | 687 | CB | ALA | A | 87 | −44.701 | −0.719 | 98.996 | 1.00 | 25.59 | C |
| ATOM | 688 | N | ALA | A | 88 | −46.161 | −3.186 | 97.408 | 1.00 | 30.13 | N |
| ATOM | 689 | CA | ALA | A | 88 | −46.689 | −4.537 | 97.438 | 1.00 | 27.33 | C |
| ATOM | 690 | C | ALA | A | 88 | −45.962 | −5.482 | 96.487 | 1.00 | 29.67 | C |
| ATOM | 691 | O | ALA | A | 88 | −46.226 | −6.681 | 96.532 | 1.00 | 32.42 | O |
| ATOM | 692 | CB | ALA | A | 88 | −48.185 | −4.510 | 97.113 | 1.00 | 20.61 | C |
| ATOM | 693 | N | ASP | A | 89 | −45.073 | −4.987 | 95.628 | 1.00 | 29.86 | N |
| ATOM | 694 | CA | ASP | A | 89 | −44.275 | −5.840 | 94.756 | 1.00 | 27.31 | C |
| ATOM | 695 | C | ASP | A | 89 | −42.892 | −6.166 | 95.332 | 1.00 | 29.16 | C |
| ATOM | 696 | O | ASP | A | 89 | −42.057 | −6.737 | 94.618 | 1.00 | 28.53 | O |
| ATOM | 697 | CB | ASP | A | 89 | −44.141 | −5.200 | 93.359 | 1.00 | 31.57 | C |
| ATOM | 698 | CG | ASP | A | 89 | −45.504 | −4.988 | 92.660 | 1.00 | 35.37 | C |
| ATOM | 699 | OD1 | ASP | A | 89 | −46.204 | −5.990 | 92.421 | 1.00 | 36.17 | O |
| ATOM | 700 | OD2 | ASP | A | 89 | −45.880 | −3.830 | 92.332 | 1.00 | 34.69 | O1− |
| ATOM | 701 | N | THR | A | 90 | −42.616 | −5.798 | 96.590 | 1.00 | 31.96 | N |
| ATOM | 702 | CA | THR | A | 90 | −41.400 | −6.246 | 97.270 | 1.00 | 27.24 | C |
| ATOM | 703 | C | THR | A | 90 | −41.440 | −7.754 | 97.476 | 1.00 | 25.30 | C |
| ATOM | 704 | O | THR | A | 90 | −42.379 | −8.277 | 98.074 | 1.00 | 30.54 | O |
| ATOM | 705 | CB | THR | A | 90 | −41.237 | −5.541 | 98.604 | 1.00 | 25.80 | C |
| ATOM | 706 | OG1 | THR | A | 90 | −40.966 | −4.159 | 98.369 | 1.00 | 34.42 | O |
| ATOM | 707 | CG2 | THR | A | 90 | −40.111 | −6.162 | 99.391 | 1.00 | 23.83 | C |
| ATOM | 708 | N | ALA | A | 91 | −40.460 | −8.455 | 96.928 | 1.00 | 26.62 | N |
| ATOM | 709 | CA | ALA | A | 91 | −40.455 | −9.906 | 96.947 | 1.00 | 26.31 | C |
| ATOM | 710 | C | ALA | A | 91 | −39.136 | −10.402 | 96.385 | 1.00 | 31.03 | C |
| ATOM | 711 | O | ALA | A | 91 | −38.386 | −9.658 | 95.738 | 1.00 | 27.14 | O |
| ATOM | 712 | CB | ALA | A | 91 | −41.605 | −10.497 | 96.134 | 1.00 | 25.43 | C |
| ATOM | 713 | N | VAL | A | 92 | −38.876 | −11.680 | 96.632 | 1.00 | 31.34 | N |
| ATOM | 714 | CA | VAL | A | 92 | −37.860 | −12.385 | 95.875 | 1.00 | 31.22 | C |
| ATOM | 715 | C | VAL | A | 92 | −38.510 | −12.880 | 94.591 | 1.00 | 32.03 | C |
| ATOM | 716 | O | VAL | A | 92 | −39.615 | −13.429 | 94.616 | 1.00 | 32.99 | O |
| ATOM | 717 | CB | VAL | A | 92 | −37.243 | −13.525 | 96.695 | 1.00 | 25.83 | C |
| ATOM | 718 | CG1 | VAL | A | 92 | −36.306 | −14.333 | 95.817 | 1.00 | 27.86 | C |
| ATOM | 719 | CG2 | VAL | A | 92 | −36.479 | −12.962 | 97.892 | 1.00 | 20.30 | C |
| ATOM | 720 | N | TYR | A | 93 | −37.871 | −12.596 | 93.460 | 1.00 | 31.17 | N |
| ATOM | 721 | CA | TYR | A | 93 | −38.321 | −13.013 | 92.141 | 1.00 | 25.61 | C |
| ATOM | 722 | C | TYR | A | 93 | −37.385 | −14.112 | 91.680 | 1.00 | 27.44 | C |
| ATOM | 723 | O | TYR | A | 93 | −36.167 | −13.932 | 91.702 | 1.00 | 29.84 | O |
| ATOM | 724 | CB | TYR | A | 93 | −38.327 | −11.832 | 91.166 | 1.00 | 24.64 | C |
| ATOM | 725 | CG | TYR | A | 93 | −39.424 | −10.852 | 91.484 | 1.00 | 26.39 | C |
| ATOM | 726 | CD1 | TYR | A | 93 | −39.346 | −10.047 | 92.606 | 1.00 | 24.17 | C |
| ATOM | 727 | CD2 | TYR | A | 93 | −40.556 | −10.756 | 90.675 | 1.00 | 29.39 | C |
| ATOM | 728 | CE1 | TYR | A | 93 | −40.360 | −9.180 | 92.927 | 1.00 | 30.45 | C |
| ATOM | 729 | CE2 | TYR | A | 93 | −41.573 | −9.886 | 90.974 | 1.00 | 28.95 | C |
| ATOM | 730 | CZ | TYR | A | 93 | −41.470 | −9.096 | 92.108 | 1.00 | 30.87 | C |
| ATOM | 731 | OH | TYR | A | 93 | −42.478 | −8.228 | 92.442 | 1.00 | 29.44 | O |
| ATOM | 732 | N | TYR | A | 94 | −37.946 | −15.271 | 91.356 | 1.00 | 27.38 | N |
| ATOM | 733 | CA | TYR | A | 94 | −37.195 | −16.387 | 90.803 | 1.00 | 27.27 | C |
| ATOM | 734 | C | TYR | A | 94 | −37.582 | −16.602 | 89.347 | 1.00 | 27.79 | C |
| ATOM | 735 | O | TYR | A | 94 | −38.728 | −16.360 | 88.943 | 1.00 | 25.82 | O |
| ATOM | 736 | CB | TYR | A | 94 | −37.453 | −17.695 | 91.544 | 1.00 | 24.75 | C |
| ATOM | 737 | CG | TYR | A | 94 | −37.170 | −17.737 | 92.995 | 1.00 | 23.43 | C |
| ATOM | 738 | CD1 | TYR | A | 94 | −35.885 | −17.935 | 93.462 | 1.00 | 28.16 | C |
| ATOM | 739 | CD2 | TYR | A | 94 | −38.199 | −17.643 | 93.910 | 1.00 | 25.00 | C |
| ATOM | 740 | CE1 | TYR | A | 94 | −35.621 | −18.000 | 94.820 | 1.00 | 32.06 | C |
| ATOM | 741 | CE2 | TYR | A | 94 | −37.955 | −17.702 | 95.271 | 1.00 | 29.99 | C |
| ATOM | 742 | CZ | TYR | A | 94 | −36.666 | −17.881 | 95.720 | 1.00 | 33.84 | C |
| ATOM | 743 | OH | TYR | A | 94 | −36.428 | −17.954 | 97.069 | 1.00 | 39.80 | O |
| ATOM | 744 | N | CYS | A | 95 | −36.618 | −17.046 | 88.560 | 1.00 | 23.05 | N |
| ATOM | 745 | CA | CYS | A | 95 | −36.940 | −17.717 | 87.319 | 1.00 | 26.62 | C |
| ATOM | 746 | C | CYS | A | 95 | −36.809 | −19.212 | 87.547 | 1.00 | 27.72 | C |
| ATOM | 747 | O | CYS | A | 95 | −36.050 | −19.661 | 88.416 | 1.00 | 27.65 | O |
| ATOM | 748 | CB | CYS | A | 95 | −36.029 | −17.289 | 86.177 | 1.00 | 33.36 | C |
| ATOM | 749 | SG | CYS | A | 95 | −34.315 | −17.693 | 86.436 | 1.00 | 42.59 | S |
| ATOM | 750 | N | ALA | A | 96 | −37.549 | −19.988 | 86.766 | 1.00 | 25.63 | N |
| ATOM | 751 | CA | ALA | A | 96 | −37.488 | −21.432 | 86.941 | 1.00 | 24.92 | C |
| ATOM | 752 | C | ALA | A | 96 | −37.693 | −22.118 | 85.603 | 1.00 | 23.67 | C |
| ATOM | 753 | O | ALA | A | 96 | −38.234 | −21.545 | 84.650 | 1.00 | 22.72 | O |
| ATOM | 754 | CB | ALA | A | 96 | −38.514 | −21.933 | 87.971 | 1.00 | 20.77 | C |
| ATOM | 755 | N | ARG | A | 97 | −37.232 | −23.359 | 85.549 | 1.00 | 29.65 | N |
| ATOM | 756 | CA | ARG | A | 97 | −37.442 | −24.222 | 84.397 | 1.00 | 27.16 | C |

TABLE 10.4-continued

| | | | | | | | | | | |
|---|---|---|---|---|---|---|---|---|---|---|
| ATOM | 757 | C | ARG | A | 97 | −38.707 | −25.049 | 84.601 | 1.00 | 25.26 | C |
| ATOM | 758 | O | ARG | A | 97 | −38.796 | −25.837 | 85.543 | 1.00 | 26.21 | O |
| ATOM | 759 | CB | ARG | A | 97 | −36.241 | −25.141 | 84.199 | 1.00 | 28.02 | C |
| ATOM | 760 | CG | ARG | A | 97 | −36.333 | −25.943 | 82.927 | 1.00 | 30.37 | C |
| ATOM | 761 | CD | ARG | A | 97 | −35.057 | −26.647 | 82.678 | 1.00 | 30.79 | C |
| ATOM | 762 | NE | ARG | A | 97 | −35.199 | −28.067 | 82.916 | 1.00 | 37.06 | N |
| ATOM | 763 | CZ | ARG | A | 97 | −34.181 | −28.869 | 83.182 | 1.00 | 41.04 | C |
| ATOM | 764 | NH1 | ARG | A | 97 | −32.962 | −28.358 | 83.257 | 1.00 | 44.36 | N |
| ATOM | 765 | NH2 | ARG | A | 97 | −34.378 | −30.172 | 83.387 | 1.00 | 43.81 | N |
| ATOM | 766 | N | ASP | A | 98 | −39.663 | −24.894 | 83.701 | 1.00 | 28.03 | N |
| ATOM | 767 | CA | ASP | A | 98 | −40.928 | −25.608 | 83.765 | 1.00 | 28.42 | C |
| ATOM | 768 | C | ASP | A | 98 | −40.781 | −26.830 | 82.871 | 1.00 | 29.02 | C |
| ATOM | 769 | O | ASP | A | 98 | −40.568 | −26.690 | 81.661 | 1.00 | 30.24 | O |
| ATOM | 770 | CB | ASP | A | 98 | −42.074 | −24.693 | 83.315 | 1.00 | 28.02 | C |
| ATOM | 771 | CG | ASP | A | 98 | −43.460 | −25.253 | 83.615 | 1.00 | 32.08 | C |
| ATOM | 772 | OD2 | ASP | A | 98 | −44.210 | −24.615 | 84.387 | 1.00 | 34.95 | O |
| ATOM | 773 | OD1 | ASP | A | 98 | −43.837 | −26.292 | 83.050 | 1.00 | 33.28 | O |
| ATOM | 774 | N | TYR | A | 99 | −40.940 | −28.023 | 83.458 | 1.00 | 30.78 | N |
| ATOM | 775 | CA | TYR | A | 99 | −40.738 | −29.329 | 82.815 | 1.00 | 30.04 | C |
| ATOM | 776 | C | TYR | A | 99 | −41.625 | −30.324 | 83.561 | 1.00 | 33.93 | C |
| ATOM | 777 | O | TYR | A | 99 | −41.159 | −31.204 | 84.293 | 1.00 | 38.31 | O |
| ATOM | 778 | CB | TYR | A | 99 | −39.272 | −29.767 | 82.827 | 1.00 | 29.21 | C |
| ATOM | 779 | CG | TYR | A | 99 | −38.929 | −30.840 | 81.794 | 1.00 | 34.85 | C |
| ATOM | 780 | CD1 | TYR | A | 99 | −39.322 | −30.698 | 80.458 | 1.00 | 35.04 | C |
| ATOM | 781 | CD2 | TYR | A | 99 | −38.133 | −31.940 | 82.127 | 1.00 | 32.30 | C |
| ATOM | 782 | CE1 | TYR | A | 99 | −38.982 | −31.651 | 79.496 | 1.00 | 36.24 | C |
| ATOM | 783 | CE2 | TYR | A | 99 | −37.783 | −32.896 | 81.172 | 1.00 | 28.54 | C |
| ATOM | 784 | CZ | TYR | A | 99 | −38.209 | −32.749 | 79.865 | 1.00 | 35.98 | C |
| ATOM | 785 | OH | TYR | A | 99 | −37.874 | −33.692 | 78.917 | 1.00 | 34.12 | O |
| ATOM | 786 | N | GLY | A | 100 | −42.933 | −30.172 | 83.358 | 1.00 | 28.51 | N |
| ATOM | 787 | CA | GLY | A | 100 | −43.910 | −30.735 | 84.262 | 1.00 | 24.10 | C |
| ATOM | 788 | C | GLY | A | 100 | −44.030 | −29.821 | 85.465 | 1.00 | 27.81 | C |
| ATOM | 789 | O | GLY | A | 100 | −44.871 | −28.922 | 85.491 | 1.00 | 27.49 | O |
| ATOM | 790 | N | ALA | A | 101 | −43.179 | −30.038 | 86.462 | 1.00 | 27.49 | N |
| ATOM | 791 | CA | ALA | A | 101 | −43.007 | −29.155 | 87.602 | 1.00 | 27.47 | C |
| ATOM | 792 | C | ALA | A | 101 | −41.783 | −28.256 | 87.421 | 1.00 | 30.09 | C |
| ATOM | 793 | O | ALA | A | 101 | −41.094 | −28.287 | 86.395 | 1.00 | 27.64 | O |
| ATOM | 794 | CB | ALA | A | 101 | −42.895 | −29.967 | 88.884 | 1.00 | 25.99 | C |
| ATOM | 795 | N | PHE | A | 102 | −41.526 | −27.427 | 88.434 | 1.00 | 23.58 | N |
| ATOM | 796 | CA | PHE | A | 102 | −40.378 | −26.521 | 88.429 | 1.00 | 29.82 | C |
| ATOM | 797 | C | PHE | A | 102 | −39.181 | −27.242 | 89.042 | 1.00 | 28.21 | C |
| ATOM | 798 | O | PHE | A | 102 | −39.007 | −27.255 | 90.268 | 1.00 | 26.65 | O |
| ATOM | 799 | CB | PHE | A | 102 | −40.704 | −25.241 | 89.185 | 1.00 | 24.30 | C |
| ATOM | 800 | CG | PHE | A | 102 | −41.831 | −24.469 | 88.585 | 1.00 | 29.71 | C |
| ATOM | 801 | CD1 | PHE | A | 102 | −41.705 | −23.921 | 87.306 | 1.00 | 27.01 | C |
| ATOM | 802 | CD2 | PHE | A | 102 | −43.012 | −24.265 | 89.297 | 1.00 | 28.29 | C |
| ATOM | 803 | CE1 | PHE | A | 102 | −42.719 | −23.201 | 86.752 | 1.00 | 23.76 | C |
| ATOM | 804 | CE2 | PHE | A | 102 | −44.047 | −23.538 | 88.738 | 1.00 | 27.29 | C |
| ATOM | 805 | CZ | PHE | A | 102 | −43.897 | −23.010 | 87.461 | 1.00 | 27.69 | C |
| ATOM | 806 | N | ASP | A | 103 | −38.333 | −27.818 | 88.179 | 1.00 | 24.44 | N |
| ATOM | 807 | CA | ASP | A | 103 | −37.235 | −28.648 | 88.657 | 1.00 | 28.27 | C |
| ATOM | 808 | C | ASP | A | 103 | −35.943 | −27.887 | 88.873 | 1.00 | 27.03 | C |
| ATOM | 809 | O | ASP | A | 103 | −35.131 | −28.306 | 89.693 | 1.00 | 37.49 | O |
| ATOM | 810 | CB | ASP | A | 103 | −36.989 | −29.838 | 87.721 | 1.00 | 31.73 | C |
| ATOM | 811 | CG | ASP | A | 103 | −36.673 | −29.436 | 86.302 | 1.00 | 39.51 | C |
| ATOM | 812 | OD1 | ASP | A | 103 | −36.346 | −28.251 | 86.038 | 1.00 | 36.08 | O |
| ATOM | 813 | OD2 | ASP | A | 103 | −36.735 | −30.340 | 85.438 | 1.00 | 44.53 | O1− |
| ATOM | 814 | N | ILE | A | 104 | −35.734 | −26.768 | 88.205 | 1.00 | 32.07 | N |
| ATOM | 815 | CA | ILE | A | 104 | −34.562 | −25.951 | 88.461 | 1.00 | 32.48 | C |
| ATOM | 816 | C | ILE | A | 104 | −35.014 | −24.530 | 88.674 | 1.00 | 30.55 | C |
| ATOM | 817 | O | ILE | A | 104 | −35.832 | −24.011 | 87.910 | 1.00 | 32.04 | O |
| ATOM | 818 | CB | ILE | A | 104 | −33.537 | −25.999 | 87.318 | 1.00 | 33.95 | C |
| ATOM | 819 | CG1 | ILE | A | 104 | −33.052 | −27.421 | 87.124 | 1.00 | 31.05 | C |
| ATOM | 820 | CG2 | ILE | A | 104 | −32.357 | −25.103 | 87.642 | 1.00 | 29.90 | C |
| ATOM | 821 | CD1 | ILE | A | 104 | −32.035 | −27.491 | 86.097 | 1.00 | 37.82 | C |
| ATOM | 822 | N | TRP | A | 105 | −34.437 | −23.891 | 89.678 | 1.00 | 30.90 | N |
| ATOM | 823 | CA | TRP | A | 105 | −34.761 | −22.534 | 90.062 | 1.00 | 29.84 | C |
| ATOM | 824 | C | TRP | A | 105 | −33.493 | −21.703 | 90.002 | 1.00 | 35.42 | C |
| ATOM | 825 | O | TRP | A | 105 | −32.384 | −22.226 | 90.145 | 1.00 | 32.10 | O |
| ATOM | 826 | CB | TRP | A | 105 | −35.340 | −22.469 | 91.479 | 1.00 | 30.72 | C |
| ATOM | 827 | CG | TRP | A | 105 | −36.660 | −23.174 | 91.650 | 1.00 | 28.36 | C |
| ATOM | 828 | CD1 | TRP | A | 105 | −36.900 | −24.508 | 91.535 | 1.00 | 26.86 | C |
| ATOM | 829 | CD2 | TRP | A | 105 | −37.906 | −22.570 | 92.029 | 1.00 | 27.83 | C |
| ATOM | 830 | NE1 | TRP | A | 105 | −38.221 | −24.775 | 91.787 | 1.00 | 26.76 | N |
| ATOM | 831 | CE2 | TRP | A | 105 | −38.862 | −23.601 | 92.093 | 1.00 | 27.46 | C |
| ATOM | 832 | CE3 | TRP | A | 105 | −38.306 | −21.246 | 92.305 | 1.00 | 24.64 | C |
| ATOM | 833 | CZ2 | TRP | A | 105 | −40.203 | −23.359 | 92.425 | 1.00 | 26.14 | C |
| ATOM | 834 | CZ3 | TRP | A | 105 | −39.632 | −21.002 | 92.628 | 1.00 | 26.09 | C |
| ATOM | 835 | CH2 | TRP | A | 105 | −40.569 | −22.052 | 92.682 | 1.00 | 27.22 | C |
| ATOM | 836 | N | GLY | A | 106 | −33.675 | −20.409 | 89.739 | 1.00 | 36.95 | N |

TABLE 10.4-continued

| | | | | | | | | | | |
|---|---|---|---|---|---|---|---|---|---|---|
| ATOM | 837 | CA | GLY | A | 106 | −32.621 | −19.444 | 89.932 | 1.00 | 30.80 | C |
| ATOM | 838 | C | GLY | A | 106 | −32.355 | −19.129 | 91.400 | 1.00 | 35.16 | C |
| ATOM | 839 | O | GLY | A | 106 | −33.108 | −19.455 | 92.312 | 1.00 | 36.82 | O |
| ATOM | 840 | N | GLN | A | 107 | −31.218 | −18.464 | 91.603 | 1.00 | 47.39 | N |
| ATOM | 841 | CA | GLN | A | 107 | −30.810 | −17.934 | 92.899 | 1.00 | 36.74 | C |
| ATOM | 842 | C | GLN | A | 107 | −31.901 | −17.089 | 93.533 | 1.00 | 39.96 | C |
| ATOM | 843 | O | GLN | A | 107 | −32.042 | −17.063 | 94.766 | 1.00 | 42.16 | O |
| ATOM | 844 | CB | GLN | A | 107 | −29.557 | −17.093 | 92.676 | 1.00 | 42.92 | C |
| ATOM | 845 | CG | GLN | A | 107 | −29.167 | −17.061 | 91.154 | 1.00 | 49.03 | C |
| ATOM | 846 | CD | GLN | A | 107 | −28.508 | −15.762 | 90.696 | 1.00 | 54.29 | C |
| ATOM | 847 | OE1 | GLN | A | 107 | −28.954 | −14.661 | 91.047 | 1.00 | 58.14 | O |
| ATOM | 848 | NE2 | GLN | A | 107 | −27.442 | −15.886 | 89.898 | 1.00 | 50.79 | N |
| ATOM | 849 | N | GLY | A | 108 | −32.681 | −16.410 | 92.707 | 1.00 | 31.86 | N |
| ATOM | 850 | CA | GLY | A | 108 | −33.598 | −15.378 | 93.128 | 1.00 | 27.03 | C |
| ATOM | 851 | C | GLY | A | 108 | −32.949 | −14.010 | 93.074 | 1.00 | 30.24 | C |
| ATOM | 852 | O | GLY | A | 108 | −31.729 | −13.864 | 93.142 | 1.00 | 37.43 | O |
| ATOM | 853 | N | THR | A | 109 | −33.797 | −12.994 | 92.950 | 1.00 | 25.96 | N |
| ATOM | 854 | CA | THR | A | 109 | −33.387 | −11.598 | 92.963 | 1.00 | 27.32 | C |
| ATOM | 855 | C | THR | A | 109 | −34.249 | −10.910 | 94.000 | 1.00 | 31.41 | C |
| ATOM | 856 | O | THR | A | 109 | −35.475 | −10.935 | 93.890 | 1.00 | 32.07 | O |
| ATOM | 857 | CB | THR | A | 109 | −33.582 | −10.910 | 91.604 | 1.00 | 34.49 | C |
| ATOM | 858 | OG1 | THR | A | 109 | −32.815 | −11.575 | 90.587 | 1.00 | 40.25 | O |
| ATOM | 859 | CG2 | THR | A | 109 | −33.151 | −9.449 | 91.696 | 1.00 | 26.29 | C |
| ATOM | 860 | N | MET | A | 110 | −33.618 | −10.317 | 95.010 | 1.00 | 34.98 | N |
| ATOM | 861 | CA | MET | A | 110 | −34.341 | −9.610 | 96.058 | 1.00 | 32.57 | C |
| ATOM | 862 | C | MET | A | 110 | −34.744 | −8.234 | 95.546 | 1.00 | 36.42 | C |
| ATOM | 863 | O | MET | A | 110 | −33.881 | −7.407 | 95.236 | 1.00 | 38.21 | O |
| ATOM | 864 | CB | MET | A | 110 | −33.471 | −9.495 | 97.301 | 1.00 | 32.17 | C |
| ATOM | 865 | CG | MET | A | 110 | −34.222 | −9.231 | 98.593 | 1.00 | 40.32 | C |
| ATOM | 866 | SD | MET | A | 110 | −33.067 | −9.017 | 99.988 | 1.00 | 67.95 | S |
| ATOM | 867 | CE | MET | A | 110 | −31.758 | −10.224 | 99.627 | 1.00 | 33.01 | C |
| ATOM | 868 | N | VAL | A | 111 | −36.046 | −7.977 | 95.455 | 1.00 | 33.03 | N |
| ATOM | 869 | CA | VAL | A | 111 | −36.549 | −6.745 | 94.860 | 1.00 | 33.46 | C |
| ATOM | 870 | C | VAL | A | 111 | −37.261 | −5.962 | 95.940 | 1.00 | 32.80 | C |
| ATOM | 871 | O | VAL | A | 111 | −38.250 | −6.441 | 96.502 | 1.00 | 34.50 | O |
| ATOM | 872 | CB | VAL | A | 111 | −37.500 | −7.004 | 93.679 | 1.00 | 34.14 | C |
| ATOM | 873 | CG1 | VAL | A | 111 | −38.216 | −5.736 | 93.323 | 1.00 | 25.66 | C |
| ATOM | 874 | CG2 | VAL | A | 111 | −36.748 | −7.559 | 92.470 | 1.00 | 30.59 | C |
| ATOM | 875 | N | THR | A | 112 | −36.777 | −4.756 | 96.211 | 1.00 | 33.30 | N |
| ATOM | 876 | CA | THR | A | 112 | −37.383 | −3.856 | 97.176 | 1.00 | 31.95 | C |
| ATOM | 877 | C | THR | A | 112 | −37.950 | −2.664 | 96.425 | 1.00 | 36.12 | C |
| ATOM | 878 | O | THR | A | 112 | −37.249 | −2.038 | 95.621 | 1.00 | 37.45 | O |
| ATOM | 879 | CB | THR | A | 112 | −36.362 | −3.387 | 98.207 | 1.00 | 31.08 | C |
| ATOM | 880 | OG1 | THR | A | 112 | −35.660 | −4.523 | 98.708 | 1.00 | 33.39 | O |
| ATOM | 881 | CG2 | THR | A | 112 | −37.042 | −2.661 | 99.366 | 1.00 | 29.77 | C |
| ATOM | 882 | N | VAL | A | 113 | −39.210 | −2.344 | 96.684 | 1.00 | 31.43 | N |
| ATOM | 883 | CA | VAL | A | 113 | −39.827 | −1.173 | 96.089 | 1.00 | 36.35 | C |
| ATOM | 884 | C | VAL | A | 113 | −40.215 | −0.226 | 97.216 | 1.00 | 36.75 | C |
| ATOM | 885 | O | VAL | A | 113 | −41.039 | −0.569 | 98.072 | 1.00 | 39.18 | O |
| ATOM | 886 | CB | VAL | A | 113 | −41.043 | −1.550 | 95.234 | 1.00 | 34.86 | C |
| ATOM | 887 | CG1 | VAL | A | 113 | −41.651 | −0.305 | 94.602 | 1.00 | 34.99 | C |
| ATOM | 888 | CG2 | VAL | A | 113 | −40.631 | −2.533 | 94.188 | 1.00 | 34.01 | C |
| ATOM | 889 | N | SER | A | 114 | −39.653 | 0.974 | 97.192 | 1.00 | 36.38 | N |
| ATOM | 890 | CA | SER | A | 114 | −39.797 | 1.848 | 98.340 | 1.00 | 36.28 | C |
| ATOM | 891 | C | SER | A | 114 | −39.395 | 3.273 | 97.977 | 1.00 | 40.12 | C |
| ATOM | 892 | O | SER | A | 114 | −38.525 | 3.507 | 97.123 | 1.00 | 40.70 | O |
| ATOM | 893 | CB | SER | A | 114 | −38.954 | 1.341 | 99.507 | 1.00 | 31.28 | C |
| ATOM | 894 | OG | SER | A | 114 | −38.863 | 2.336 | 100.505 | 1.00 | 39.00 | O |
| ATOM | 895 | N | SER | A | 115 | −40.017 | 4.217 | 98.672 | 1.00 | 38.69 | N |
| ATOM | 896 | CA | SER | A | 115 | −39.621 | 5.613 | 98.576 | 1.00 | 42.10 | C |
| ATOM | 897 | C | SER | A | 115 | −38.296 | 5.892 | 99.267 | 1.00 | 46.74 | C |
| ATOM | 898 | O | SER | A | 115 | −37.675 | 6.920 | 98.973 | 1.00 | 42.92 | O |
| ATOM | 899 | CB | SER | A | 115 | −40.717 | 6.490 | 99.162 | 1.00 | 39.28 | C |
| ATOM | 900 | OG | SER | A | 115 | −41.885 | 6.392 | 98.349 | 1.00 | 47.59 | O |
| ATOM | 901 | N | ALA | A | 116 | −37.853 | 5.008 | 100.168 | 1.00 | 39.54 | N |
| ATOM | 902 | CA | ALA | A | 116 | −36.656 | 5.257 | 100.954 | 1.00 | 35.81 | C |
| ATOM | 903 | C | ALA | A | 116 | −35.417 | 5.270 | 100.067 | 1.00 | 37.57 | C |
| ATOM | 904 | O | ALA | A | 116 | −35.411 | 4.730 | 98.963 | 1.00 | 38.65 | O |
| ATOM | 905 | CB | ALA | A | 116 | −36.507 | 4.199 | 102.035 | 1.00 | 35.27 | C |
| ATOM | 906 | N | SER | A | 117 | −34.347 | 5.880 | 100.571 | 1.00 | 38.00 | N |
| ATOM | 907 | CA | SER | A | 117 | −33.079 | 5.924 | 99.855 | 1.00 | 40.96 | C |
| ATOM | 908 | C | SER | A | 117 | −32.040 | 5.082 | 100.572 | 1.00 | 39.82 | C |
| ATOM | 909 | O | SER | A | 117 | −32.108 | 4.893 | 101.790 | 1.00 | 40.84 | O |
| ATOM | 910 | CB | SER | A | 117 | −32.561 | 7.352 | 99.715 | 1.00 | 38.33 | C |
| ATOM | 911 | OG | SER | A | 117 | −33.448 | 8.084 | 98.896 | 1.00 | 52.15 | O |
| ATOM | 912 | N | THR | A | 118 | −31.078 | 4.576 | 99.803 | 1.00 | 34.77 | N |
| ATOM | 913 | CA | THR | A | 118 | −30.059 | 3.709 | 100.378 | 1.00 | 35.77 | C |
| ATOM | 914 | C | THR | A | 118 | −29.387 | 4.392 | 101.560 | 1.00 | 40.75 | C |
| ATOM | 915 | O | THR | A | 118 | −29.127 | 5.595 | 101.535 | 1.00 | 45.66 | O |
| ATOM | 916 | CB | THR | A | 118 | −29.030 | 3.346 | 99.320 | 1.00 | 33.58 | C |

TABLE 10.4-continued

| | | | | | | | | | | |
|---|---|---|---|---|---|---|---|---|---|---|
| ATOM | 917 | OG1 | THR | A | 118 | −29.662 | 2.534 | 98.320 | 1.00 | 42.35 | O |
| ATOM | 918 | CG2 | THR | A | 118 | −27.854 | 2.607 | 99.941 | 1.00 | 35.40 | C |
| ATOM | 919 | N | LYS | A | 119 | −29.152 | 3.629 | 102.621 | 1.00 | 37.56 | N |
| ATOM | 920 | CA | LYS | A | 119 | −28.635 | 4.215 | 103.848 | 1.00 | 36.23 | C |
| ATOM | 921 | C | LYS | A | 119 | −28.000 | 3.126 | 104.697 | 1.00 | 36.78 | C |
| ATOM | 922 | O | LYS | A | 119 | −28.629 | 2.100 | 104.959 | 1.00 | 31.04 | O |
| ATOM | 923 | CB | LYS | A | 119 | −29.742 | 4.904 | 104.631 | 1.00 | 36.08 | C |
| ATOM | 924 | CG | LYS | A | 119 | −29.224 | 5.571 | 105.867 | 1.00 | 32.45 | C |
| ATOM | 925 | CD | LYS | A | 119 | −30.331 | 6.005 | 106.761 | 1.00 | 36.11 | C |
| ATOM | 926 | CE | LYS | A | 119 | −29.719 | 6.656 | 107.950 | 1.00 | 41.55 | C |
| ATOM | 927 | NZ | LYS | A | 119 | −28.719 | 5.693 | 108.485 | 1.00 | 40.27 | N1+ |
| ATOM | 928 | N | GLY | A | 120 | −26.761 | 3.351 | 105.115 | 1.00 | 32.34 | N |
| ATOM | 929 | CA | GLY | A | 120 | −26.058 | 2.407 | 105.937 | 1.00 | 32.74 | C |
| ATOM | 930 | C | GLY | A | 120 | −26.563 | 2.417 | 107.364 | 1.00 | 33.41 | C |
| ATOM | 931 | O | GLY | A | 120 | −27.264 | 3.331 | 107.801 | 1.00 | 34.70 | O |
| ATOM | 932 | N | PRO | A | 121 | −26.210 | 1.393 | 108.120 | 1.00 | 31.38 | N |
| ATOM | 933 | CA | PRO | A | 121 | −26.705 | 1.283 | 109.493 | 1.00 | 36.27 | C |
| ATOM | 934 | C | PRO | A | 121 | −25.863 | 2.075 | 110.478 | 1.00 | 29.36 | C |
| ATOM | 935 | O | PRO | A | 121 | −24.723 | 2.442 | 110.213 | 1.00 | 28.70 | O |
| ATOM | 936 | CB | PRO | A | 121 | −26.592 | −0.217 | 109.784 | 1.00 | 32.75 | C |
| ATOM | 937 | CG | PRO | A | 121 | −25.450 | −0.653 | 108.950 | 1.00 | 31.60 | C |
| ATOM | 938 | CD | PRO | A | 121 | −25.485 | 0.190 | 107.692 | 1.00 | 31.22 | C |
| ATOM | 939 | N | SER | A | 122 | −26.481 | 2.365 | 111.614 | 1.00 | 28.35 | N |
| ATOM | 940 | CA | SER | A | 122 | −25.790 | 2.748 | 112.834 | 1.00 | 27.65 | C |
| ATOM | 941 | C | SER | A | 122 | −25.766 | 1.529 | 113.743 | 1.00 | 28.89 | C |
| ATOM | 942 | O | SER | A | 122 | −26.780 | 0.843 | 113.874 | 1.00 | 33.72 | O |
| ATOM | 943 | CB | SER | A | 122 | −26.490 | 3.915 | 113.528 | 1.00 | 27.60 | C |
| ATOM | 944 | OG | SER | A | 122 | −26.537 | 5.035 | 112.665 | 1.00 | 32.84 | O |
| ATOM | 945 | N | VAL | A | 123 | −24.615 | 1.239 | 114.341 | 1.00 | 30.13 | N |
| ATOM | 946 | CA | VAL | A | 123 | −24.439 | 0.062 | 115.188 | 1.00 | 29.26 | C |
| ATOM | 947 | C | VAL | A | 123 | −24.266 | 0.513 | 116.638 | 1.00 | 28.50 | C |
| ATOM | 948 | O | VAL | A | 123 | −23.290 | 1.188 | 116.982 | 1.00 | 36.71 | O |
| ATOM | 949 | CB | VAL | A | 123 | −23.257 | −0.800 | 114.713 | 1.00 | 29.30 | C |
| ATOM | 950 | CG1 | VAL | A | 123 | −23.161 | −2.079 | 115.535 | 1.00 | 32.16 | C |
| ATOM | 951 | CG2 | VAL | A | 123 | −23.421 | −1.143 | 113.243 | 1.00 | 29.73 | C |
| ATOM | 952 | N | PHE | A | 124 | −25.204 | 0.154 | 117.477 | 1.00 | 29.11 | N |
| ATOM | 953 | CA | PHE | A | 124 | −25.117 | 0.453 | 118.892 | 1.00 | 30.43 | C |
| ATOM | 954 | C | PHE | A | 124 | −24.914 | −0.818 | 119.710 | 1.00 | 30.05 | C |
| ATOM | 955 | O | PHE | A | 124 | −25.432 | −1.871 | 119.341 | 1.00 | 28.55 | O |
| ATOM | 956 | CB | PHE | A | 124 | −26.387 | 1.149 | 119.375 | 1.00 | 29.02 | C |
| ATOM | 957 | CG | PHE | A | 124 | −26.765 | 2.328 | 118.559 | 1.00 | 31.89 | C |
| ATOM | 958 | CD1 | PHE | A | 124 | −25.952 | 3.448 | 118.525 | 1.00 | 37.36 | C |
| ATOM | 959 | CD2 | PHE | A | 124 | −27.948 | 2.345 | 117.848 | 1.00 | 33.36 | C |
| ATOM | 960 | CE1 | PHE | A | 124 | −26.309 | 4.550 | 117.784 | 1.00 | 33.03 | C |
| ATOM | 961 | CE2 | PHE | A | 124 | −28.307 | 3.451 | 117.112 | 1.00 | 32.67 | C |
| ATOM | 962 | CZ | PHE | A | 124 | −27.486 | 4.548 | 117.085 | 1.00 | 31.27 | C |
| ATOM | 963 | N | PRO | A | 125 | −24.212 | −0.744 | 120.845 | 1.00 | 34.75 | N |
| ATOM | 964 | CA | PRO | A | 125 | −23.997 | −1.942 | 121.663 | 1.00 | 33.50 | C |
| ATOM | 965 | C | PRO | A | 125 | −25.209 | −2.306 | 122.514 | 1.00 | 33.10 | C |
| ATOM | 966 | O | PRO | A | 125 | −25.956 | −1.452 | 122.991 | 1.00 | 31.28 | O |
| ATOM | 967 | CB | PRO | A | 125 | −22.808 | −1.549 | 122.546 | 1.00 | 27.55 | C |
| ATOM | 968 | CG | PRO | A | 125 | −22.913 | −0.105 | 122.656 | 1.00 | 24.38 | C |
| ATOM | 969 | CD | PRO | A | 125 | −23.459 | 0.407 | 121.378 | 1.00 | 30.67 | C |
| ATOM | 970 | N | LEU | A | 126 | −25.395 | −3.609 | 122.688 | 1.00 | 29.05 | N |
| ATOM | 971 | CA | LEU | A | 126 | −26.264 | −4.145 | 123.724 | 1.00 | 31.66 | C |
| ATOM | 972 | C | LEU | A | 126 | −25.315 | −4.627 | 124.801 | 1.00 | 33.65 | C |
| ATOM | 973 | O | LEU | A | 126 | −24.728 | −5.701 | 124.688 | 1.00 | 37.65 | O |
| ATOM | 974 | CB | LEU | A | 126 | −27.167 | −5.249 | 123.195 | 1.00 | 30.81 | C |
| ATOM | 975 | CG | LEU | A | 126 | −27.997 | −4.672 | 122.052 | 1.00 | 29.82 | C |
| ATOM | 976 | CD1 | LEU | A | 126 | −28.827 | −5.730 | 121.357 | 1.00 | 26.48 | C |
| ATOM | 977 | CD2 | LEU | A | 126 | −28.860 | −3.574 | 122.603 | 1.00 | 30.33 | C |
| ATOM | 978 | N | ALA | A | 127 | −25.143 | −3.805 | 125.835 | 1.00 | 38.61 | N |
| ATOM | 979 | CA | ALA | A | 127 | −24.053 | −4.011 | 126.768 | 1.00 | 36.09 | C |
| ATOM | 980 | C | ALA | A | 127 | −24.399 | −5.128 | 127.738 | 1.00 | 40.57 | C |
| ATOM | 981 | O | ALA | A | 127 | −25.510 | −5.137 | 128.289 | 1.00 | 36.21 | O |
| ATOM | 982 | CB | ALA | A | 127 | −23.763 | −2.733 | 127.529 | 1.00 | 35.02 | C |
| ATOM | 983 | N | PRO | A | 128 | −23.478 | −6.062 | 127.986 | 1.00 | 38.34 | N |
| ATOM | 984 | CA | PRO | A | 128 | −23.759 | −7.137 | 128.941 | 1.00 | 45.51 | C |
| ATOM | 985 | C | PRO | A | 128 | −24.091 | −6.569 | 130.309 | 1.00 | 56.56 | C |
| ATOM | 986 | O | PRO | A | 128 | −23.360 | −5.736 | 130.865 | 1.00 | 52.82 | O |
| ATOM | 987 | CB | PRO | A | 128 | −22.463 | −7.953 | 128.968 | 1.00 | 43.58 | C |
| ATOM | 988 | CG | PRO | A | 128 | −21.433 | −7.043 | 128.440 | 1.00 | 45.25 | C |
| ATOM | 989 | CD | PRO | A | 128 | −22.124 | −6.162 | 127.441 | 1.00 | 39.79 | C |
| ATOM | 990 | N | SER | A | 129 | −25.212 | −7.049 | 130.837 | 1.00 | 66.36 | N |
| ATOM | 991 | CA | SER | A | 129 | −25.759 | −6.677 | 132.128 | 1.00 | 72.65 | C |
| ATOM | 992 | C | SER | A | 129 | −24.673 | −6.810 | 133.195 | 1.00 | 76.84 | C |
| ATOM | 993 | O | SER | A | 129 | −24.175 | −7.914 | 133.453 | 1.00 | 78.41 | O |
| ATOM | 994 | CB | SER | A | 129 | −26.983 | −7.568 | 132.406 | 1.00 | 69.58 | C |
| ATOM | 995 | OG | SER | A | 129 | −27.910 | −7.001 | 133.309 | 1.00 | 70.69 | O |
| ATOM | 996 | N | SER | A | 130 | −24.252 | −5.681 | 133.776 | 1.00 | 77.98 | N |

TABLE 10.4-continued

| ATOM | 997 | CA | SER | A | 130 | −23.377 | −5.731 | 134.943 | 1.00 | 85.61 | C |
| ATOM | 998 | C | SER | A | 130 | −23.994 | −6.604 | 136.037 | 1.00 | 90.91 | C |
| ATOM | 999 | O | SER | A | 130 | −23.273 | −7.223 | 136.835 | 1.00 | 87.54 | O |
| ATOM | 1000 | CB | SER | A | 130 | −23.089 | −4.307 | 135.444 | 1.00 | 90.00 | C |
| ATOM | 1001 | OG | SER | A | 130 | −24.274 | −3.529 | 135.594 | 1.00 | 85.47 | O |
| ATOM | 1002 | N | LYS | A | 131 | −25.331 | −6.708 | 136.043 | 1.00 | 95.09 | N |
| ATOM | 1003 | CA | LYS | A | 131 | −26.101 | −7.524 | 136.974 | 1.00 | 92.61 | C |
| ATOM | 1004 | C | LYS | A | 131 | −26.337 | −8.936 | 136.436 | 1.00 | 92.99 | C |
| ATOM | 1005 | O | LYS | A | 131 | −27.391 | −9.540 | 136.695 | 1.00 | 88.38 | O |
| ATOM | 1006 | CB | LYS | A | 131 | −27.436 | −6.839 | 137.284 | 1.00 | 84.94 | C |
| ATOM | 1007 | CG | LYS | A | 131 | −27.308 | −5.523 | 138.053 | 1.00 | 86.39 | C |
| ATOM | 1008 | CD | LYS | A | 131 | −28.673 | −4.977 | 138.437 | 1.00 | 85.07 | C |
| ATOM | 1009 | CE | LYS | A | 131 | −28.583 | −4.070 | 139.646 | 1.00 | 74.74 | C |
| ATOM | 1010 | NZ | LYS | A | 131 | −29.939 | −3.594 | 140.022 | 1.00 | 70.33 | N1+ |
| ATOM | 1011 | N | SER | A | 132 | −25.386 | −9.453 | 135.655 | 1.00 | 91.67 | N |
| ATOM | 1012 | CA | SER | A | 132 | −25.423 | −10.837 | 135.210 | 1.00 | 89.98 | C |
| ATOM | 1013 | C | SER | A | 132 | −25.152 | −11.744 | 136.398 | 1.00 | 95.97 | C |
| ATOM | 1014 | O | SER | A | 132 | −24.296 | −11.439 | 137.237 | 1.00 | 97.89 | O |
| ATOM | 1015 | CB | SER | A | 132 | −24.366 | −11.076 | 134.130 | 1.00 | 80.08 | C |
| ATOM | 1016 | OG | SER | A | 132 | −24.779 | −10.567 | 132.876 | 1.00 | 75.09 | O |
| ATOM | 1017 | N | THR | A | 133 | −25.903 | −12.846 | 136.495 | 1.00 | 96.88 | N |
| ATOM | 1018 | CA | THR | A | 133 | −25.589 | −13.828 | 137.529 | 1.00 | 94.98 | C |
| ATOM | 1019 | C | THR | A | 133 | −24.133 | −14.276 | 137.346 | 1.00 | 90.31 | C |
| ATOM | 1020 | O | THR | A | 133 | −23.836 | −15.107 | 136.480 | 1.00 | 81.64 | O |
| ATOM | 1021 | CB | THR | A | 133 | −26.595 | −15.001 | 137.481 | 1.00 | 90.13 | C |
| ATOM | 1022 | OG1 | THR | A | 133 | −26.943 | −15.313 | 136.117 | 1.00 | 86.99 | O |
| ATOM | 1023 | CG2 | THR | A | 133 | −27.872 | −14.664 | 138.271 | 1.00 | 77.20 | C |
| ATOM | 1024 | N | SER | A | 134 | −23.219 | −13.722 | 138.160 | 1.00 | 93.80 | N |
| ATOM | 1025 | CA | SER | A | 134 | −21.784 | −13.900 | 137.935 | 1.00 | 90.34 | C |
| ATOM | 1026 | C | SER | A | 134 | −21.364 | −15.323 | 138.275 | 1.00 | 87.03 | C |
| ATOM | 1027 | O | SER | A | 134 | −21.597 | −15.802 | 139.389 | 1.00 | 88.65 | O |
| ATOM | 1028 | CB | SER | A | 134 | −20.971 | −12.892 | 138.748 | 1.00 | 81.79 | C |
| ATOM | 1029 | OG | SER | A | 134 | −19.872 | −12.426 | 137.986 | 1.00 | 69.79 | O |
| ATOM | 1030 | N | GLY | A | 135 | −20.701 | −15.981 | 137.329 | 1.00 | 83.14 | N |
| ATOM | 1031 | CA | GLY | A | 135 | −20.552 | −17.418 | 137.366 | 1.00 | 79.97 | C |
| ATOM | 1032 | C | GLY | A | 135 | −21.634 | −18.150 | 136.607 | 1.00 | 75.17 | C |
| ATOM | 1033 | O | GLY | A | 135 | −21.672 | −19.387 | 136.643 | 1.00 | 70.13 | O |
| ATOM | 1034 | N | GLY | A | 136 | −22.531 | −17.411 | 135.954 | 1.00 | 73.84 | N |
| ATOM | 1035 | CA | GLY | A | 136 | −23.577 | −17.924 | 135.095 | 1.00 | 61.25 | C |
| ATOM | 1036 | C | GLY | A | 136 | −23.388 | −17.420 | 133.676 | 1.00 | 63.22 | C |
| ATOM | 1037 | O | GLY | A | 136 | −22.265 | −17.397 | 133.152 | 1.00 | 56.06 | O |
| ATOM | 1038 | N | THR | A | 137 | −24.476 | −16.996 | 133.040 | 1.00 | 59.59 | N |
| ATOM | 1039 | CA | THR | A | 137 | −24.446 | −16.674 | 131.626 | 1.00 | 48.48 | C |
| ATOM | 1040 | C | THR | A | 137 | −24.845 | −15.227 | 131.387 | 1.00 | 51.06 | C |
| ATOM | 1041 | O | THR | A | 137 | −25.789 | −14.712 | 132.002 | 1.00 | 56.26 | O |
| ATOM | 1042 | CB | THR | A | 137 | −25.342 | −17.624 | 130.849 | 1.00 | 47.89 | C |
| ATOM | 1043 | OG1 | THR | A | 137 | −24.756 | −18.935 | 130.893 | 1.00 | 52.57 | O |
| ATOM | 1044 | CG2 | THR | A | 137 | −25.461 | −17.182 | 129.398 | 1.00 | 39.41 | C |
| ATOM | 1045 | N | ALA | A | 138 | −24.088 | −14.574 | 130.510 | 1.00 | 44.74 | N |
| ATOM | 1046 | CA | ALA | A | 138 | −24.313 | −13.195 | 130.117 | 1.00 | 41.78 | C |
| ATOM | 1047 | C | ALA | A | 138 | −24.782 | −13.142 | 128.670 | 1.00 | 43.49 | C |
| ATOM | 1048 | O | ALA | A | 138 | −24.337 | −13.933 | 127.833 | 1.00 | 41.75 | O |
| ATOM | 1049 | CB | ALA | A | 138 | −23.036 | −12.369 | 130.273 | 1.00 | 44.03 | C |
| ATOM | 1050 | N | ALA | A | 139 | −25.689 | −12.215 | 128.384 | 1.00 | 43.46 | N |
| ATOM | 1051 | CA | ALA | A | 139 | −26.067 | −11.872 | 127.022 | 1.00 | 39.95 | C |
| ATOM | 1052 | C | ALA | A | 139 | −25.455 | −10.522 | 126.665 | 1.00 | 35.35 | C |
| ATOM | 1053 | O | ALA | A | 139 | −25.393 | −9.618 | 127.504 | 1.00 | 31.47 | O |
| ATOM | 1054 | CB | ALA | A | 139 | −27.593 | −11.827 | 126.865 | 1.00 | 27.83 | C |
| ATOM | 1055 | N | LEU | A | 140 | −25.005 | −10.399 | 125.419 | 1.00 | 30.62 | N |
| ATOM | 1056 | CA | LEU | A | 140 | −24.563 | −9.129 | 124.863 | 1.00 | 32.63 | C |
| ATOM | 1057 | C | LEU | A | 140 | −24.915 | −9.129 | 123.382 | 1.00 | 32.74 | C |
| ATOM | 1058 | O | LEU | A | 140 | −25.288 | −10.161 | 122.824 | 1.00 | 33.31 | O |
| ATOM | 1059 | CB | LEU | A | 140 | −23.067 | −8.925 | 125.098 | 1.00 | 36.31 | C |
| ATOM | 1060 | CG | LEU | A | 140 | −22.182 | −10.012 | 124.493 | 1.00 | 33.45 | C |
| ATOM | 1061 | CD1 | LEU | A | 140 | −21.538 | −9.500 | 123.223 | 1.00 | 31.90 | C |
| ATOM | 1062 | CD2 | LEU | A | 140 | −21.146 | −10.511 | 125.497 | 1.00 | 33.92 | C |
| ATOM | 1063 | N | GLY | A | 141 | −24.839 | −7.966 | 122.745 | 1.00 | 31.54 | N |
| ATOM | 1064 | CA | GLY | A | 141 | −25.151 | −7.940 | 121.332 | 1.00 | 28.33 | C |
| ATOM | 1065 | C | GLY | A | 141 | −24.948 | −6.589 | 120.690 | 1.00 | 27.25 | C |
| ATOM | 1066 | O | GLY | A | 141 | −24.461 | −5.640 | 121.304 | 1.00 | 31.88 | O |
| ATOM | 1067 | N | CYS | A | 142 | −25.353 | −6.529 | 119.428 | 1.00 | 25.30 | N |
| ATOM | 1068 | CA | CYS | A | 142 | −25.336 | −5.319 | 118.623 | 1.00 | 28.40 | C |
| ATOM | 1069 | C | CYS | A | 142 | −26.729 | −5.018 | 118.105 | 1.00 | 27.36 | C |
| ATOM | 1070 | O | CYS | A | 142 | −27.484 | −5.930 | 117.757 | 1.00 | 27.52 | O |
| ATOM | 1071 | CB | CYS | A | 142 | −24.402 | −5.447 | 117.435 | 1.00 | 30.69 | C |
| ATOM | 1072 | SG | CYS | A | 142 | −22.691 | −5.228 | 117.879 | 1.00 | 51.18 | S |
| ATOM | 1073 | N | LEU | A | 143 | −27.056 | −3.735 | 118.049 | 1.00 | 27.56 | N |
| ATOM | 1074 | CA | LEU | A | 143 | −28.293 | −3.248 | 117.460 | 1.00 | 27.81 | C |
| ATOM | 1075 | C | LEU | A | 143 | −27.931 | −2.565 | 116.145 | 1.00 | 27.63 | C |
| ATOM | 1076 | O | LEU | A | 143 | −27.155 | −1.613 | 116.136 | 1.00 | 31.79 | O |

TABLE 10.4-continued

| | | | | | | | | | | |
|---|---|---|---|---|---|---|---|---|---|---|
| ATOM | 1077 | CB  | LEU | A | 143 | −28.985 | −2.274 | 118.406 | 1.00 | 31.36 | C |
| ATOM | 1078 | CG  | LEU | A | 143 | −30.346 | −1.766 | 117.963 | 1.00 | 31.23 | C |
| ATOM | 1079 | CD1 | LEU | A | 143 | −31.250 | −2.954 | 117.862 | 1.00 | 28.10 | C |
| ATOM | 1080 | CD2 | LEU | A | 143 | −30.899 | −0.706 | 118.886 | 1.00 | 32.28 | C |
| ATOM | 1081 | N   | VAL | A | 144 | −28.436 | −3.083 | 115.036 | 1.00 | 30.74 | N |
| ATOM | 1082 | CA  | VAL | A | 144 | −28.101 | −2.590 | 113.702 | 1.00 | 27.82 | C |
| ATOM | 1083 | C   | VAL | A | 144 | −29.311 | −1.800 | 113.216 | 1.00 | 30.66 | C |
| ATOM | 1084 | O   | VAL | A | 144 | −30.289 | −2.381 | 112.744 | 1.00 | 30.67 | O |
| ATOM | 1085 | CB  | VAL | A | 144 | −27.732 | −3.744 | 112.769 | 1.00 | 28.14 | C |
| ATOM | 1086 | CG1 | VAL | A | 144 | −27.347 | −3.252 | 111.375 | 1.00 | 23.30 | C |
| ATOM | 1087 | CG2 | VAL | A | 144 | −26.591 | −4.541 | 113.411 | 1.00 | 25.34 | C |
| ATOM | 1088 | N   | LYS | A | 145 | −29.269 | −0.470 | 113.374 | 1.00 | 33.19 | N |
| ATOM | 1089 | CA  | LYS | A | 145 | −30.446 | 0.383  | 113.245 | 1.00 | 31.94 | C |
| ATOM | 1090 | C   | LYS | A | 145 | −30.392 | 1.292  | 112.020 | 1.00 | 34.55 | C |
| ATOM | 1091 | O   | LYS | A | 145 | −29.322 | 1.758  | 111.612 | 1.00 | 32.70 | O |
| ATOM | 1092 | CB  | LYS | A | 145 | −30.637 | 1.229  | 114.504 | 1.00 | 34.83 | C |
| ATOM | 1093 | CG  | LYS | A | 145 | −32.055 | 1.752  | 114.654 | 1.00 | 39.24 | C |
| ATOM | 1094 | CD  | LYS | A | 145 | −32.309 | 2.302  | 116.035 | 1.00 | 37.76 | C |
| ATOM | 1095 | CE  | LYS | A | 145 | −33.802 | 2.550  | 116.282 | 1.00 | 47.55 | C |
| ATOM | 1096 | NZ  | LYS | A | 145 | −34.483 | 3.453  | 115.296 | 1.00 | 48.57 | N1+ |
| ATOM | 1097 | N   | ASP | A | 146 | −31.564 | 1.494  | 111.414 | 1.00 | 35.65 | N |
| ATOM | 1098 | CA  | ASP | A | 146 | −31.815 | 2.517  | 110.399 | 1.00 | 31.21 | C |
| ATOM | 1099 | C   | ASP | A | 146 | −30.985 | 2.308  | 109.134 | 1.00 | 34.08 | C |
| ATOM | 1100 | O   | ASP | A | 146 | −30.204 | 3.170  | 108.721 | 1.00 | 35.04 | O |
| ATOM | 1101 | CB  | ASP | A | 146 | −31.568 | 3.919  | 110.960 | 1.00 | 31.93 | C |
| ATOM | 1102 | CG  | ASP | A | 146 | −32.501 | 4.276  | 112.097 | 1.00 | 39.35 | C |
| ATOM | 1103 | OD1 | ASP | A | 146 | −33.621 | 3.731  | 112.154 | 1.00 | 37.78 | O |
| ATOM | 1104 | OD2 | ASP | A | 146 | −32.150 | 5.184  | 112.878 | 1.00 | 48.93 | O1− |
| ATOM | 1105 | N   | TYR | A | 147 | −31.184 | 1.169  | 108.490 | 1.00 | 35.70 | N |
| ATOM | 1106 | CA  | TYR | A | 147 | −30.527 | 0.965  | 107.205 | 1.00 | 32.13 | C |
| ATOM | 1107 | C   | TYR | A | 147 | −31.548 | 0.662  | 106.127 | 1.00 | 30.25 | C |
| ATOM | 1108 | O   | TYR | A | 147 | −32.711 | 0.385  | 106.401 | 1.00 | 34.62 | O |
| ATOM | 1109 | CB  | TYR | A | 147 | −29.480 | −0.146 | 107.270 | 1.00 | 29.22 | C |
| ATOM | 1110 | CG  | TYR | A | 147 | −30.026 | −1.497 | 107.584 | 1.00 | 31.09 | C |
| ATOM | 1111 | CD1 | TYR | A | 147 | −30.476 | −2.344 | 106.572 | 1.00 | 34.27 | C |
| ATOM | 1112 | CD2 | TYR | A | 147 | −30.068 | −1.953 | 108.896 | 1.00 | 31.93 | C |
| ATOM | 1113 | CE1 | TYR | A | 147 | −30.965 | −3.615 | 106.863 | 1.00 | 33.60 | C |
| ATOM | 1114 | CE2 | TYR | A | 147 | −30.547 | −3.216 | 109.201 | 1.00 | 34.30 | C |
| ATOM | 1115 | CZ  | TYR | A | 147 | −30.998 | −4.039 | 108.186 | 1.00 | 35.75 | C |
| ATOM | 1116 | OH  | TYR | A | 147 | −31.474 | −5.283 | 108.511 | 1.00 | 33.90 | O |
| ATOM | 1117 | N   | PHE | A | 148 | −31.087 | 0.720  | 104.889 | 1.00 | 36.14 | N |
| ATOM | 1118 | CA  | PHE | A | 148 | −31.931 | 0.444  | 103.740 | 1.00 | 36.37 | C |
| ATOM | 1119 | C   | PHE | A | 148 | −31.063 | 0.353  | 102.506 | 1.00 | 35.17 | C |
| ATOM | 1120 | O   | PHE | A | 148 | −30.171 | 1.168  | 102.324 | 1.00 | 40.37 | O |
| ATOM | 1121 | CB  | PHE | A | 148 | −32.994 | 1.533  | 103.573 | 1.00 | 35.29 | C |
| ATOM | 1122 | CG  | PHE | A | 148 | −33.914 | 1.300  | 102.429 | 1.00 | 38.94 | C |
| ATOM | 1123 | CD2 | PHE | A | 148 | −33.582 | 1.733  | 101.154 | 1.00 | 37.28 | C |
| ATOM | 1124 | CD1 | PHE | A | 148 | −35.116 | 0.633  | 102.619 | 1.00 | 43.66 | C |
| ATOM | 1125 | CE2 | PHE | A | 148 | −34.431 | 1.509  | 100.090 | 1.00 | 40.33 | C |
| ATOM | 1126 | CE1 | PHE | A | 148 | −35.980 | 0.405  | 101.558 | 1.00 | 40.99 | C |
| ATOM | 1127 | CZ  | PHE | A | 148 | −35.632 | 0.843  | 100.288 | 1.00 | 41.29 | C |
| ATOM | 1128 | N   | PRO | A | 149 | −31.317 | −0.641 | 101.646 | 1.00 | 38.61 | N |
| ATOM | 1129 | CA  | PRO | A | 149 | −32.320 | −1.693 | 101.818 | 1.00 | 36.40 | C |
| ATOM | 1130 | C   | PRO | A | 149 | −31.736 | −2.913 | 102.534 | 1.00 | 32.84 | C |
| ATOM | 1131 | O   | PRO | A | 149 | −30.607 | −2.867 | 103.010 | 1.00 | 32.70 | O |
| ATOM | 1132 | CB  | PRO | A | 149 | −32.679 | −2.036 | 100.378 | 1.00 | 36.43 | C |
| ATOM | 1133 | CG  | PRO | A | 149 | −31.331 | −1.921 | 99.683  | 1.00 | 33.06 | C |
| ATOM | 1134 | CD  | PRO | A | 149 | −30.649 | −0.743 | 100.332 | 1.00 | 34.54 | C |
| ATOM | 1135 | N   | GLU | A | 150 | −32.499 | −3.995 | 102.601 | 1.00 | 33.19 | N |
| ATOM | 1136 | CA  | GLU | A | 150 | −31.952 | −5.302 | 102.970 | 1.00 | 32.31 | C |
| ATOM | 1137 | C   | GLU | A | 150 | −30.980 | −5.788 | 101.891 | 1.00 | 29.80 | C |
| ATOM | 1138 | O   | GLU | A | 150 | −31.160 | −5.456 | 100.713 | 1.00 | 29.74 | O |
| ATOM | 1139 | CB  | GLU | A | 150 | −33.087 | −6.301 | 103.166 | 1.00 | 28.58 | C |
| ATOM | 1140 | CG  | GLU | A | 150 | −33.977 | −6.000 | 104.360 | 1.00 | 29.38 | C |
| ATOM | 1141 | CD  | GLU | A | 150 | −33.563 | −6.767 | 105.602 | 1.00 | 39.48 | C |
| ATOM | 1142 | OE1 | GLU | A | 150 | −34.378 | −7.590 | 106.099 | 1.00 | 41.15 | O |
| ATOM | 1143 | OE2 | GLU | A | 150 | −32.413 | −6.566 | 106.065 | 1.00 | 41.49 | O1− |
| ATOM | 1144 | N   | PRO | A | 151 | −29.992 | −6.630 | 102.263 | 1.00 | 31.91 | N |
| ATOM | 1145 | CA  | PRO | A | 151 | −29.735 | −7.230 | 103.581 | 1.00 | 31.76 | C |
| ATOM | 1146 | C   | PRO | A | 151 | −28.502 | −6.701 | 104.317 | 1.00 | 35.19 | C |
| ATOM | 1147 | O   | PRO | A | 151 | −27.684 | −5.998 | 103.713 | 1.00 | 34.57 | O |
| ATOM | 1148 | CB  | PRO | A | 151 | −29.510 | −8.690 | 103.223 | 1.00 | 23.34 | C |
| ATOM | 1149 | CG  | PRO | A | 151 | −28.788 | −8.605 | 101.939 | 1.00 | 20.46 | C |
| ATOM | 1150 | CD  | PRO | A | 151 | −29.218 | −7.334 | 101.225 | 1.00 | 25.12 | C |
| ATOM | 1151 | N   | VAL | A | 152 | −28.379 | −7.046 | 105.602 | 1.00 | 30.30 | N |
| ATOM | 1152 | CA  | VAL | A | 152 | −27.128 | −6.911 | 106.335 | 1.00 | 29.66 | C |
| ATOM | 1153 | C   | VAL | A | 152 | −26.726 | −8.297 | 106.815 | 1.00 | 33.28 | C |
| ATOM | 1154 | O   | VAL | A | 152 | −27.580 | −9.147 | 107.078 | 1.00 | 31.82 | O |
| ATOM | 1155 | CB  | VAL | A | 152 | −27.221 | −5.959 | 107.550 | 1.00 | 31.08 | C |
| ATOM | 1156 | CG1 | VAL | A | 152 | −27.344 | −4.523 | 107.116 | 1.00 | 36.88 | C |

TABLE 10.4-continued

| ATOM | 1157 | CG2 | VAL | A | 152 | −28.382 | −6.349 | 108.403 | 1.00 | 32.42 | C |
|------|------|-----|-----|---|-----|---------|--------|---------|------|-------|---|
| ATOM | 1158 | N | THR | A | 153 | −25.419 | −8.509 | 106.967 | 1.00 | 32.49 | N |
| ATOM | 1159 | CA | THR | A | 153 | −24.873 | −9.711 | 107.585 | 1.00 | 31.87 | C |
| ATOM | 1160 | C | THR | A | 153 | −24.123 | −9.336 | 108.858 | 1.00 | 33.40 | C |
| ATOM | 1161 | O | THR | A | 153 | −23.517 | −8.264 | 108.952 | 1.00 | 35.81 | O |
| ATOM | 1162 | CB | THR | A | 153 | −23.924 | −10.442 | 106.644 | 1.00 | 27.89 | C |
| ATOM | 1163 | OG1 | THR | A | 153 | −22.904 | −9.528 | 106.239 | 1.00 | 36.53 | O |
| ATOM | 1164 | CG2 | THR | A | 153 | −24.676 | −10.910 | 105.408 | 1.00 | 29.45 | C |
| ATOM | 1165 | N | VAL | A | 154 | −24.189 | −10.213 | 109.852 | 1.00 | 24.86 | N |
| ATOM | 1166 | CA | VAL | A | 154 | −23.508 | −10.013 | 111.116 | 1.00 | 27.57 | C |
| ATOM | 1167 | C | VAL | A | 154 | −22.745 | −11.281 | 111.472 | 1.00 | 29.28 | C |
| ATOM | 1168 | O | VAL | A | 154 | −23.316 | −12.374 | 111.480 | 1.00 | 35.29 | O |
| ATOM | 1169 | CB | VAL | A | 154 | −24.499 | −9.646 | 112.240 | 1.00 | 30.65 | C |
| ATOM | 1170 | CG1 | VAL | A | 154 | −23.770 | −9.393 | 113.542 | 1.00 | 30.74 | C |
| ATOM | 1171 | CG2 | VAL | A | 154 | −25.312 | −8.454 | 111.849 | 1.00 | 29.70 | C |
| ATOM | 1172 | N | SER | A | 155 | −21.463 | −11.137 | 111.766 | 1.00 | 29.75 | N |
| ATOM | 1173 | CA | SER | A | 155 | −20.720 | −12.183 | 112.446 | 1.00 | 32.79 | C |
| ATOM | 1174 | C | SER | A | 155 | −20.100 | −11.604 | 113.711 | 1.00 | 36.14 | C |
| ATOM | 1175 | O | SER | A | 155 | −20.134 | −10.393 | 113.961 | 1.00 | 34.64 | O |
| ATOM | 1176 | CB | SER | A | 155 | −19.648 | −12.800 | 111.550 | 1.00 | 28.09 | C |
| ATOM | 1177 | OG | SER | A | 155 | −18.682 | −11.839 | 111.164 | 1.00 | 32.25 | O |
| ATOM | 1178 | N | TRP | A | 156 | −19.522 | −12.495 | 114.504 | 1.00 | 28.20 | N |
| ATOM | 1179 | CA | TRP | A | 156 | −18.940 | −12.149 | 115.781 | 1.00 | 30.93 | C |
| ATOM | 1180 | C | TRP | A | 156 | −17.495 | −12.610 | 115.807 | 1.00 | 35.40 | C |
| ATOM | 1181 | O | TRP | A | 156 | −17.202 | −13.750 | 115.427 | 1.00 | 34.28 | O |
| ATOM | 1182 | CB | TRP | A | 156 | −19.731 | −12.786 | 116.913 | 1.00 | 30.86 | C |
| ATOM | 1183 | CG | TRP | A | 156 | −20.988 | −12.046 | 117.160 | 1.00 | 32.29 | C |
| ATOM | 1184 | CD1 | TRP | A | 156 | −22.184 | −12.252 | 116.553 | 1.00 | 32.31 | C |
| ATOM | 1185 | CD2 | TRP | A | 156 | −21.168 | −10.939 | 118.048 | 1.00 | 31.77 | C |
| ATOM | 1186 | NE1 | TRP | A | 156 | −23.106 | −11.348 | 117.012 | 1.00 | 33.15 | N |
| ATOM | 1187 | CE2 | TRP | A | 156 | −22.508 | −10.529 | 117.933 | 1.00 | 31.90 | C |
| ATOM | 1188 | CE3 | TRP | A | 156 | −20.325 | −10.253 | 118.929 | 1.00 | 33.09 | C |
| ATOM | 1189 | CZ2 | TRP | A | 156 | −23.037 | −9.477 | 118.679 | 1.00 | 29.54 | C |
| ATOM | 1190 | CZ3 | TRP | A | 156 | −20.852 | −9.197 | 119.665 | 1.00 | 34.64 | C |
| ATOM | 1191 | CH2 | TRP | A | 156 | −22.199 | −8.828 | 119.539 | 1.00 | 31.80 | C |
| ATOM | 1192 | N | ASN | A | 157 | −16.603 | −11.723 | 116.262 | 1.00 | 28.12 | N |
| ATOM | 1193 | CA | ASN | A | 157 | −15.185 | −12.020 | 116.346 | 1.00 | 27.84 | C |
| ATOM | 1194 | C | ASN | A | 157 | −14.675 | −12.543 | 115.010 | 1.00 | 31.80 | C |
| ATOM | 1195 | O | ASN | A | 157 | −13.925 | −13.515 | 114.956 | 1.00 | 33.84 | O |
| ATOM | 1196 | CB | ASN | A | 157 | −14.888 | −13.031 | 117.461 | 1.00 | 29.77 | C |
| ATOM | 1197 | CG | ASN | A | 157 | −15.039 | −12.460 | 118.845 | 1.00 | 26.46 | C |
| ATOM | 1198 | OD1 | ASN | A | 157 | −15.346 | −11.294 | 119.024 | 1.00 | 30.29 | O |
| ATOM | 1199 | ND2 | ASN | A | 157 | −14.823 | −13.294 | 119.842 | 1.00 | 33.06 | N |
| ATOM | 1200 | N | SER | A | 158 | −15.102 | −11.898 | 113.922 | 1.00 | 31.97 | N |
| ATOM | 1201 | CA | SER | A | 158 | −14.661 | −12.248 | 112.570 | 1.00 | 33.51 | C |
| ATOM | 1202 | C | SER | A | 158 | −14.956 | −13.699 | 112.215 | 1.00 | 36.31 | C |
| ATOM | 1203 | O | SER | A | 158 | −14.224 | −14.307 | 111.438 | 1.00 | 42.62 | O |
| ATOM | 1204 | CB | SER | A | 158 | −13.170 | −11.972 | 112.375 | 1.00 | 28.57 | C |
| ATOM | 1205 | OG | SER | A | 158 | −12.839 | −10.678 | 112.818 | 1.00 | 41.72 | O |
| ATOM | 1206 | N | GLY | A | 159 | −16.007 | −14.278 | 112.791 | 1.00 | 36.17 | N |
| ATOM | 1207 | CA | GLY | A | 159 | −16.371 | −15.654 | 112.532 | 1.00 | 30.18 | C |
| ATOM | 1208 | C | GLY | A | 159 | −15.840 | −16.648 | 113.540 | 1.00 | 32.92 | C |
| ATOM | 1209 | O | GLY | A | 159 | −16.226 | −17.823 | 113.497 | 1.00 | 29.97 | O |
| ATOM | 1210 | N | ALA | A | 160 | −14.960 | −16.217 | 114.437 | 1.00 | 37.02 | N |
| ATOM | 1211 | CA | ALA | A | 160 | −14.420 | −17.132 | 115.431 | 1.00 | 32.79 | C |
| ATOM | 1212 | C | ALA | A | 160 | −15.442 | −17.476 | 116.505 | 1.00 | 34.92 | C |
| ATOM | 1213 | O | ALA | A | 160 | −15.345 | −18.540 | 117.121 | 1.00 | 48.32 | O |
| ATOM | 1214 | CB | ALA | A | 160 | −13.164 | −16.532 | 116.061 | 1.00 | 28.82 | C |
| ATOM | 1215 | N | LEU | A | 161 | −16.416 | −16.617 | 116.751 | 1.00 | 35.16 | N |
| ATOM | 1216 | CA | LEU | A | 161 | −17.432 | −16.878 | 117.759 | 1.00 | 33.95 | C |
| ATOM | 1217 | C | LEU | A | 161 | −18.713 | −17.278 | 117.047 | 1.00 | 32.88 | C |
| ATOM | 1218 | O | LEU | A | 161 | −19.239 | −16.519 | 116.234 | 1.00 | 35.85 | O |
| ATOM | 1219 | CB | LEU | A | 161 | −17.653 | −15.658 | 118.648 | 1.00 | 30.18 | C |
| ATOM | 1220 | CG | LEU | A | 161 | −18.778 | −15.719 | 119.683 | 1.00 | 35.02 | C |
| ATOM | 1221 | CD1 | LEU | A | 161 | −18.826 | −17.042 | 120.432 | 1.00 | 28.23 | C |
| ATOM | 1222 | CD2 | LEU | A | 161 | −18.673 | −14.517 | 120.661 | 1.00 | 33.30 | C |
| ATOM | 1223 | N | THR | A | 162 | −19.233 | −18.450 | 117.394 | 1.00 | 39.79 | N |
| ATOM | 1224 | CA | THR | A | 162 | −20.298 | −19.078 | 116.630 | 1.00 | 33.54 | C |
| ATOM | 1225 | C | THR | A | 162 | −21.336 | −19.691 | 117.569 | 1.00 | 32.35 | C |
| ATOM | 1226 | O | THR | A | 162 | −22.541 | −19.506 | 117.391 | 1.00 | 30.46 | O |
| ATOM | 1227 | CB | THR | A | 162 | −19.662 | −20.099 | 115.669 | 1.00 | 33.49 | C |
| ATOM | 1228 | OG1 | THR | A | 162 | −19.956 | −19.724 | 114.318 | 1.00 | 27.42 | O |
| ATOM | 1229 | CG2 | THR | A | 162 | −20.098 | −21.543 | 115.959 | 1.00 | 34.98 | C |
| ATOM | 1230 | N | SER | A | 163 | −20.885 | −20.391 | 118.598 | 1.00 | 34.58 | N |
| ATOM | 1231 | CA | SER | A | 163 | −21.813 | −20.925 | 119.583 | 1.00 | 35.61 | C |
| ATOM | 1232 | C | SER | A | 163 | −22.538 | −19.785 | 120.301 | 1.00 | 35.40 | C |
| ATOM | 1233 | O | SER | A | 163 | −21.925 | −18.781 | 120.681 | 1.00 | 37.87 | O |
| ATOM | 1234 | CB | SER | A | 163 | −21.044 | −21.799 | 120.578 | 1.00 | 35.71 | C |
| ATOM | 1235 | OG | SER | A | 163 | −21.864 | −22.247 | 121.633 | 1.00 | 43.49 | O |
| ATOM | 1236 | N | GLY | A | 164 | −23.856 | −19.911 | 120.442 | 1.00 | 28.98 | N |

TABLE 10.4-continued

| | | | | | | | | | | |
|---|---|---|---|---|---|---|---|---|---|---|
| ATOM | 1237 | CA | GLY | A | 164 | −24.625 | −18.958 | 121.206 | 1.00 | 25.01 | C |
| ATOM | 1238 | C | GLY | A | 164 | −25.128 | −17.744 | 120.446 | 1.00 | 33.29 | C |
| ATOM | 1239 | O | GLY | A | 164 | −25.869 | −16.946 | 121.031 | 1.00 | 33.20 | O |
| ATOM | 1240 | N | VAL | A | 165 | −24.754 | −17.576 | 119.160 | 1.00 | 30.78 | N |
| ATOM | 1241 | CA | VAL | A | 165 | −25.156 | −16.414 | 118.374 | 1.00 | 25.26 | C |
| ATOM | 1242 | C | VAL | A | 165 | −26.588 | −16.586 | 117.885 | 1.00 | 31.13 | C |
| ATOM | 1243 | O | VAL | A | 165 | −26.998 | −17.679 | 117.480 | 1.00 | 36.05 | O |
| ATOM | 1244 | CB | VAL | A | 165 | −24.189 | −16.187 | 117.195 | 1.00 | 24.24 | C |
| ATOM | 1245 | CG1 | VAL | A | 165 | −24.660 | −15.030 | 116.320 | 1.00 | 26.94 | C |
| ATOM | 1246 | CG2 | VAL | A | 165 | −22.806 | −15.872 | 117.701 | 1.00 | 26.51 | C |
| ATOM | 1247 | N | HIS | A | 166 | −27.368 | −15.507 | 117.975 | 1.00 | 30.95 | N |
| ATOM | 1248 | CA | HIS | A | 166 | −28.639 | −15.358 | 117.275 | 1.00 | 27.16 | C |
| ATOM | 1249 | C | HIS | A | 166 | −28.634 | −14.011 | 116.567 | 1.00 | 29.61 | C |
| ATOM | 1250 | O | HIS | A | 166 | −28.486 | −12.968 | 117.218 | 1.00 | 28.82 | O |
| ATOM | 1251 | CB | HIS | A | 166 | −29.841 | −15.434 | 118.225 | 1.00 | 26.50 | C |
| ATOM | 1252 | CG | HIS | A | 166 | −29.913 | −16.697 | 119.017 | 1.00 | 29.14 | C |
| ATOM | 1253 | ND1 | HIS | A | 166 | −30.069 | −17.932 | 118.430 | 1.00 | 31.57 | N |
| ATOM | 1254 | CD2 | HIS | A | 166 | −29.894 | −16.914 | 120.349 | 1.00 | 29.50 | C |
| ATOM | 1255 | CE1 | HIS | A | 166 | −30.123 | −18.859 | 119.368 | 1.00 | 30.30 | C |
| ATOM | 1256 | NE2 | HIS | A | 166 | −30.025 | −18.267 | 120.541 | 1.00 | 29.10 | N |
| ATOM | 1257 | N | THR | A | 167 | −28.765 | −14.030 | 115.242 | 1.00 | 32.27 | N |
| ATOM | 1258 | CA | THR | A | 167 | −29.023 | −12.828 | 114.457 | 1.00 | 30.55 | C |
| ATOM | 1259 | C | THR | A | 167 | −30.473 | −12.820 | 113.997 | 1.00 | 29.36 | C |
| ATOM | 1260 | O | THR | A | 167 | −30.914 | −13.738 | 113.306 | 1.00 | 34.07 | O |
| ATOM | 1261 | CB | THR | A | 167 | −28.089 | −12.737 | 113.264 | 1.00 | 24.74 | C |
| ATOM | 1262 | OG1 | THR | A | 167 | −26.740 | −12.697 | 113.745 | 1.00 | 35.43 | O |
| ATOM | 1263 | CG2 | THR | A | 167 | −28.377 | −11.481 | 112.509 | 1.00 | 23.22 | C |
| ATOM | 1264 | N | PHE | A | 168 | −31.182 | −11.797 | 114.351 | 1.00 | 28.41 | N |
| ATOM | 1265 | CA | PHE | A | 168 | −32.626 | −11.776 | 114.226 | 1.00 | 28.58 | C |
| ATOM | 1266 | C | PHE | A | 168 | −33.064 | −11.245 | 112.869 | 1.00 | 30.77 | C |
| ATOM | 1267 | O | PHE | A | 168 | −32.304 | −10.564 | 112.176 | 1.00 | 31.27 | O |
| ATOM | 1268 | CB | PHE | A | 168 | −33.222 | −10.953 | 115.358 | 1.00 | 22.95 | C |
| ATOM | 1269 | CG | PHE | A | 168 | −33.164 | −11.654 | 116.672 | 1.00 | 28.82 | C |
| ATOM | 1270 | CD1 | PHE | A | 168 | −34.177 | −12.526 | 117.052 | 1.00 | 30.01 | C |
| ATOM | 1271 | CD2 | PHE | A | 168 | −32.089 | −11.484 | 117.521 | 1.00 | 26.59 | C |
| ATOM | 1272 | CE1 | PHE | A | 168 | −34.120 | −13.192 | 118.269 | 1.00 | 26.13 | C |
| ATOM | 1273 | CE2 | PHE | A | 168 | −32.034 | −12.153 | 118.738 | 1.00 | 24.89 | C |
| ATOM | 1274 | CZ | PHE | A | 168 | −33.047 | −12.999 | 119.109 | 1.00 | 25.58 | C |
| ATOM | 1275 | N | PRO | A | 169 | −34.268 | −11.613 | 112.428 | 1.00 | 30.91 | N |
| ATOM | 1276 | CA | PRO | A | 169 | −34.825 | −10.991 | 111.221 | 1.00 | 28.45 | C |
| ATOM | 1277 | C | PRO | A | 169 | −35.017 | −9.500 | 111.445 | 1.00 | 30.28 | C |
| ATOM | 1278 | O | PRO | A | 169 | −35.392 | −9.063 | 112.534 | 1.00 | 26.91 | O |
| ATOM | 1279 | CB | PRO | A | 169 | −36.166 | −11.705 | 111.036 | 1.00 | 21.98 | C |
| ATOM | 1280 | CG | PRO | A | 169 | −36.064 | −12.951 | 111.870 | 1.00 | 25.73 | C |
| ATOM | 1281 | CD | PRO | A | 169 | −35.157 | −12.642 | 112.999 | 1.00 | 24.24 | C |
| ATOM | 1282 | N | ALA | A | 170 | −34.718 | −8.713 | 110.419 | 1.00 | 29.94 | N |
| ATOM | 1283 | CA | ALA | A | 170 | −34.909 | −7.277 | 110.530 | 1.00 | 28.66 | C |
| ATOM | 1284 | C | ALA | A | 170 | −36.397 | −6.962 | 110.631 | 1.00 | 24.51 | C |
| ATOM | 1285 | O | ALA | A | 170 | −37.231 | −7.715 | 110.147 | 1.00 | 20.86 | O |
| ATOM | 1286 | CB | ALA | A | 170 | −34.289 | −6.564 | 109.326 | 1.00 | 28.82 | C |
| ATOM | 1287 | N | VAL | A | 171 | −36.725 | −5.833 | 111.264 | 1.00 | 25.89 | N |
| ATOM | 1288 | CA | VAL | A | 171 | −38.070 | −5.279 | 111.200 | 1.00 | 24.76 | C |
| ATOM | 1289 | C | VAL | A | 171 | −38.012 | −4.012 | 110.358 | 1.00 | 28.48 | C |
| ATOM | 1290 | O | VAL | A | 171 | −36.997 | −3.307 | 110.326 | 1.00 | 27.98 | O |
| ATOM | 1291 | CB | VAL | A | 171 | −38.700 | −4.967 | 112.577 | 1.00 | 27.45 | C |
| ATOM | 1292 | CG1 | VAL | A | 171 | −38.882 | −6.245 | 113.387 | 1.00 | 27.65 | C |
| ATOM | 1293 | CG2 | VAL | A | 171 | −37.913 | −3.890 | 113.334 | 1.00 | 27.22 | C |
| ATOM | 1294 | N | LEU | A | 172 | −39.111 | −3.745 | 109.653 | 1.00 | 25.17 | N |
| ATOM | 1295 | CA | LEU | A | 172 | −39.301 | −2.534 | 108.867 | 1.00 | 27.51 | C |
| ATOM | 1296 | C | LEU | A | 172 | −40.092 | −1.517 | 109.692 | 1.00 | 31.05 | C |
| ATOM | 1297 | O | LEU | A | 172 | −41.270 | −1.730 | 109.995 | 1.00 | 33.68 | O |
| ATOM | 1298 | CB | LEU | A | 172 | −40.015 | −2.862 | 107.565 | 1.00 | 27.53 | C |
| ATOM | 1299 | CG | LEU | A | 172 | −40.360 | −1.652 | 106.713 | 1.00 | 31.73 | C |
| ATOM | 1300 | CD1 | LEU | A | 172 | −39.092 | −0.851 | 106.423 | 1.00 | 31.62 | C |
| ATOM | 1301 | CD2 | LEU | A | 172 | −41.011 | −2.118 | 105.405 | 1.00 | 28.68 | C |
| ATOM | 1302 | N | GLN | A | 173 | −39.439 | −0.422 | 110.052 | 1.00 | 25.80 | N |
| ATOM | 1303 | CA | GLN | A | 173 | −40.029 | 0.612 | 110.877 | 1.00 | 31.71 | C |
| ATOM | 1304 | C | GLN | A | 173 | −40.841 | 1.595 | 110.033 | 1.00 | 34.79 | C |
| ATOM | 1305 | O | GLN | A | 173 | −40.706 | 1.669 | 108.805 | 1.00 | 31.87 | O |
| ATOM | 1306 | CB | GLN | A | 173 | −38.945 | 1.372 | 111.634 | 1.00 | 33.05 | C |
| ATOM | 1307 | CG | GLN | A | 173 | −37.969 | 0.495 | 112.392 | 1.00 | 33.17 | C |
| ATOM | 1308 | CD | GLN | A | 173 | −36.669 | 1.222 | 112.686 | 1.00 | 35.50 | C |
| ATOM | 1309 | OE1 | GLN | A | 173 | −36.309 | 1.424 | 113.850 | 1.00 | 39.44 | O |
| ATOM | 1310 | NE2 | GLN | A | 173 | −35.960 | 1.626 | 111.629 | 1.00 | 33.32 | N |
| ATOM | 1311 | N | SER | A | 174 | −41.681 | 2.378 | 110.726 | 1.00 | 34.71 | N |
| ATOM | 1312 | CA | SER | A | 174 | −42.563 | 3.323 | 110.049 | 1.00 | 30.21 | C |
| ATOM | 1313 | C | SER | A | 174 | −41.773 | 4.343 | 109.245 | 1.00 | 31.66 | C |
| ATOM | 1314 | O | SER | A | 174 | −42.322 | 4.937 | 108.314 | 1.00 | 34.94 | O |
| ATOM | 1315 | CB | SER | A | 174 | −43.461 | 4.017 | 111.063 | 1.00 | 31.49 | C |
| ATOM | 1316 | OG | SER | A | 174 | −42.708 | 4.905 | 111.882 | 1.00 | 40.96 | O |

TABLE 10.4-continued

| | | | | | | | | | | |
|---|---|---|---|---|---|---|---|---|---|---|
| ATOM | 1317 | N | SER | A | 175 | −40.480 | 4.495 | 109.533 | 1.00 | 29.45 | N |
| ATOM | 1318 | CA | SER | A | 175 | −39.594 | 5.363 | 108.769 | 1.00 | 29.62 | C |
| ATOM | 1319 | C | SER | A | 175 | −39.270 | 4.831 | 107.374 | 1.00 | 37.39 | C |
| ATOM | 1320 | O | SER | A | 175 | −38.665 | 5.564 | 106.581 | 1.00 | 35.03 | O |
| ATOM | 1321 | CB | SER | A | 175 | −38.288 | 5.558 | 109.531 | 1.00 | 26.45 | C |
| ATOM | 1322 | OG | SER | A | 175 | −37.522 | 4.366 | 109.537 | 1.00 | 33.35 | O |
| ATOM | 1323 | N | GLY | A | 176 | −39.610 | 3.574 | 107.068 | 1.00 | 33.52 | N |
| ATOM | 1324 | CA | GLY | A | 176 | −39.139 | 2.922 | 105.865 | 1.00 | 26.71 | C |
| ATOM | 1325 | C | GLY | A | 176 | −37.767 | 2.308 | 105.988 | 1.00 | 28.94 | C |
| ATOM | 1326 | O | GLY | A | 176 | −37.323 | 1.632 | 105.061 | 1.00 | 33.48 | O |
| ATOM | 1327 | N | LEU | A | 177 | −37.105 | 2.482 | 107.118 | 1.00 | 31.53 | N |
| ATOM | 1328 | CA | LEU | A | 177 | −35.796 | 1.912 | 107.374 | 1.00 | 32.69 | C |
| ATOM | 1329 | C | LEU | A | 177 | −35.924 | 0.601 | 108.155 | 1.00 | 33.78 | C |
| ATOM | 1330 | O | LEU | A | 177 | −36.839 | 0.412 | 108.965 | 1.00 | 27.20 | O |
| ATOM | 1331 | CB | LEU | A | 177 | −34.937 | 2.932 | 108.138 | 1.00 | 30.37 | C |
| ATOM | 1332 | CG | LEU | A | 177 | −34.691 | 4.252 | 107.381 | 1.00 | 31.43 | C |
| ATOM | 1333 | CD1 | LEU | A | 177 | −33.897 | 5.220 | 108.180 | 1.00 | 29.09 | C |
| ATOM | 1334 | CD2 | LEU | A | 177 | −33.948 | 4.024 | 106.072 | 1.00 | 32.81 | C |
| ATOM | 1335 | N | TYR | A | 178 | −34.979 | −0.299 | 107.915 | 1.00 | 32.33 | N |
| ATOM | 1336 | CA | TYR | A | 178 | −34.938 | −1.580 | 108.601 | 1.00 | 31.28 | C |
| ATOM | 1337 | C | TYR | A | 178 | −34.061 | −1.480 | 109.848 | 1.00 | 31.26 | C |
| ATOM | 1338 | O | TYR | A | 178 | −33.221 | −0.589 | 109.975 | 1.00 | 30.90 | O |
| ATOM | 1339 | CB | TYR | A | 178 | −34.399 | −2.679 | 107.681 | 1.00 | 30.14 | C |
| ATOM | 1340 | CG | TYR | A | 178 | −35.311 | −3.040 | 106.535 | 1.00 | 29.91 | C |
| ATOM | 1341 | CD2 | TYR | A | 178 | −35.140 | −2.470 | 105.275 | 1.00 | 30.71 | C |
| ATOM | 1342 | CD1 | TYR | A | 178 | −36.324 | −3.960 | 106.703 | 1.00 | 28.37 | C |
| ATOM | 1343 | CE2 | TYR | A | 178 | −35.966 | −2.793 | 104.226 | 1.00 | 32.21 | C |
| ATOM | 1344 | CE1 | TYR | A | 178 | −37.160 | −4.287 | 105.667 | 1.00 | 29.97 | C |
| ATOM | 1345 | CZ | TYR | A | 178 | −36.984 | −3.704 | 104.426 | 1.00 | 34.62 | C |
| ATOM | 1346 | OH | TYR | A | 178 | −37.822 | −4.043 | 103.385 | 1.00 | 35.36 | O |
| ATOM | 1347 | N | SER | A | 179 | −34.265 | −2.425 | 110.764 | 1.00 | 31.86 | N |
| ATOM | 1348 | CA | SER | A | 179 | −33.513 | −2.503 | 112.007 | 1.00 | 29.05 | C |
| ATOM | 1349 | C | SER | A | 179 | −33.405 | −3.960 | 112.453 | 1.00 | 30.76 | C |
| ATOM | 1350 | O | SER | A | 179 | −34.418 | −4.660 | 112.534 | 1.00 | 31.95 | O |
| ATOM | 1351 | CB | SER | A | 179 | −34.185 | −1.669 | 113.086 | 1.00 | 29.95 | C |
| ATOM | 1352 | OG | SER | A | 179 | −33.208 | −1.108 | 113.936 | 1.00 | 40.38 | O |
| ATOM | 1353 | N | LEU | A | 180 | −32.192 | −4.427 | 112.737 | 1.00 | 28.38 | N |
| ATOM | 1354 | CA | LEU | A | 180 | −32.044 | −5.768 | 113.282 | 1.00 | 31.63 | C |
| ATOM | 1355 | C | LEU | A | 180 | −31.118 | −5.768 | 114.492 | 1.00 | 29.92 | C |
| ATOM | 1356 | O | LEU | A | 180 | −30.388 | −4.810 | 114.763 | 1.00 | 25.79 | O |
| ATOM | 1357 | CB | LEU | A | 180 | −31.555 | −6.783 | 112.224 | 1.00 | 30.26 | C |
| ATOM | 1358 | CG | LEU | A | 180 | −30.143 | −7.049 | 111.701 | 1.00 | 31.57 | C |
| ATOM | 1359 | CD1 | LEU | A | 180 | −29.103 | −7.464 | 112.770 | 1.00 | 28.74 | C |
| ATOM | 1360 | CD2 | LEU | A | 180 | −30.291 | −8.158 | 110.658 | 1.00 | 28.38 | C |
| ATOM | 1361 | N | SER | A | 181 | −31.159 | −6.872 | 115.228 | 1.00 | 25.89 | N |
| ATOM | 1362 | CA | SER | A | 181 | −30.261 | −7.060 | 116.348 | 1.00 | 29.69 | C |
| ATOM | 1363 | C | SER | A | 181 | −29.651 | −8.454 | 116.283 | 1.00 | 34.25 | C |
| ATOM | 1364 | O | SER | A | 181 | −30.228 | −9.383 | 115.710 | 1.00 | 28.49 | O |
| ATOM | 1365 | CB | SER | A | 181 | −30.972 | −6.840 | 117.680 | 1.00 | 32.18 | C |
| ATOM | 1366 | OG | SER | A | 181 | −31.900 | −7.868 | 117.927 | 1.00 | 34.51 | O |
| ATOM | 1367 | N | SER | A | 182 | −28.451 | −8.572 | 116.852 | 1.00 | 34.33 | N |
| ATOM | 1368 | CA | SER | A | 182 | −27.720 | −9.826 | 116.939 | 1.00 | 31.79 | C |
| ATOM | 1369 | C | SER | A | 182 | −27.166 | −9.956 | 118.351 | 1.00 | 29.53 | C |
| ATOM | 1370 | O | SER | A | 182 | −26.634 | −8.992 | 118.899 | 1.00 | 29.22 | O |
| ATOM | 1371 | CB | SER | A | 182 | −26.589 | −9.875 | 115.889 | 1.00 | 28.22 | C |
| ATOM | 1372 | OG | SER | A | 182 | −25.793 | −11.040 | 116.033 | 1.00 | 32.19 | O |
| ATOM | 1373 | N | VAL | A | 183 | −27.302 | −11.140 | 118.946 | 1.00 | 31.33 | N |
| ATOM | 1374 | CA | VAL | A | 183 | −26.891 | −11.353 | 120.329 | 1.00 | 32.43 | C |
| ATOM | 1375 | C | VAL | A | 183 | −26.090 | −12.648 | 120.461 | 1.00 | 34.27 | C |
| ATOM | 1376 | O | VAL | A | 183 | −26.118 | −13.530 | 119.599 | 1.00 | 34.59 | O |
| ATOM | 1377 | CB | VAL | A | 183 | −28.100 | −11.386 | 121.290 | 1.00 | 34.07 | C |
| ATOM | 1378 | CG1 | VAL | A | 183 | −28.915 | −10.138 | 121.139 | 1.00 | 30.31 | C |
| ATOM | 1379 | CG2 | VAL | A | 183 | −28.962 | −12.619 | 121.027 | 1.00 | 34.20 | C |
| ATOM | 1380 | N | VAL | A | 184 | −25.370 | −12.750 | 121.567 | 1.00 | 30.31 | N |
| ATOM | 1381 | CA | VAL | A | 184 | −24.615 | −13.950 | 121.895 | 1.00 | 34.88 | C |
| ATOM | 1382 | C | VAL | A | 184 | −24.629 | −14.101 | 123.409 | 1.00 | 36.21 | C |
| ATOM | 1383 | O | VAL | A | 184 | −24.549 | −13.112 | 124.145 | 1.00 | 36.42 | O |
| ATOM | 1384 | CB | VAL | A | 184 | −23.172 | −13.893 | 121.322 | 1.00 | 36.52 | C |
| ATOM | 1385 | CG1 | VAL | A | 184 | −22.405 | −12.622 | 121.770 | 1.00 | 28.53 | C |
| ATOM | 1386 | CG2 | VAL | A | 184 | −22.413 | −15.146 | 121.668 | 1.00 | 28.44 | C |
| ATOM | 1387 | N | THR | A | 185 | −24.800 | −15.335 | 123.876 | 1.00 | 37.42 | N |
| ATOM | 1388 | CA | THR | A | 185 | −24.681 | −15.649 | 125.290 | 1.00 | 33.86 | C |
| ATOM | 1389 | C | THR | A | 185 | −23.296 | −16.235 | 125.522 | 1.00 | 36.91 | C |
| ATOM | 1390 | O | THR | A | 185 | −22.829 | −17.074 | 124.744 | 1.00 | 36.01 | O |
| ATOM | 1391 | CB | THR | A | 185 | −25.772 | −16.614 | 125.758 | 1.00 | 36.45 | C |
| ATOM | 1392 | OG1 | THR | A | 185 | −25.864 | −17.719 | 124.850 | 1.00 | 42.60 | O |
| ATOM | 1393 | CG2 | THR | A | 185 | −27.110 | −15.912 | 125.804 | 1.00 | 34.96 | C |
| ATOM | 1394 | N | VAL | A | 186 | −22.632 | −15.755 | 126.567 | 1.00 | 40.17 | N |
| ATOM | 1395 | CA | VAL | A | 186 | −21.268 | −16.144 | 126.917 | 1.00 | 38.85 | C |
| ATOM | 1396 | C | VAL | A | 186 | −21.196 | −16.288 | 128.432 | 1.00 | 47.21 | C |

TABLE 10.4-continued

| ATOM | 1397 | O | VAL | A | 186 | −22.080 | −15.806 | 129.155 | 1.00 | 45.09 | O |
|---|---|---|---|---|---|---|---|---|---|---|---|
| ATOM | 1398 | CB | VAL | A | 186 | −20.244 | −15.102 | 126.425 | 1.00 | 36.70 | C |
| ATOM | 1399 | CG1 | VAL | A | 186 | −20.351 | −14.919 | 124.902 | 1.00 | 33.73 | C |
| ATOM | 1400 | CG2 | VAL | A | 186 | −20.485 | −13.768 | 127.107 | 1.00 | 35.85 | C |
| ATOM | 1401 | N | PRO | A | 187 | −20.161 | −16.964 | 128.944 | 1.00 | 47.74 | N |
| ATOM | 1402 | CA | PRO | A | 187 | −20.031 | −17.090 | 130.404 | 1.00 | 46.98 | C |
| ATOM | 1403 | C | PRO | A | 187 | −19.776 | −15.738 | 131.058 | 1.00 | 48.85 | C |
| ATOM | 1404 | O | PRO | A | 187 | −19.016 | −14.922 | 130.538 | 1.00 | 46.36 | O |
| ATOM | 1405 | CB | PRO | A | 187 | −18.830 | −18.026 | 130.571 | 1.00 | 43.33 | C |
| ATOM | 1406 | CG | PRO | A | 187 | −18.751 | −18.759 | 129.303 | 1.00 | 39.13 | C |
| ATOM | 1407 | CD | PRO | A | 187 | −19.170 | −17.794 | 128.244 | 1.00 | 43.58 | C |
| ATOM | 1408 | N | SER | A | 188 | −20.423 | −15.509 | 132.208 | 1.00 | 50.33 | N |
| ATOM | 1409 | CA | SER | A | 188 | −20.194 | −14.283 | 132.972 | 1.00 | 47.34 | C |
| ATOM | 1410 | C | SER | A | 188 | −18.715 | −14.066 | 133.275 | 1.00 | 55.46 | C |
| ATOM | 1411 | O | SER | A | 188 | −18.208 | −12.942 | 133.158 | 1.00 | 49.43 | O |
| ATOM | 1412 | CB | SER | A | 188 | −21.001 | −14.310 | 134.262 | 1.00 | 52.91 | C |
| ATOM | 1413 | OG | SER | A | 188 | −22.363 | −14.112 | 133.973 | 1.00 | 59.47 | O |
| ATOM | 1414 | N | SER | A | 189 | −18.010 | −15.127 | 133.685 | 1.00 | 55.39 | N |
| ATOM | 1415 | CA | SER | A | 189 | −16.590 | −15.005 | 134.003 | 1.00 | 55.76 | C |
| ATOM | 1416 | C | SER | A | 189 | −15.769 | −14.513 | 132.811 | 1.00 | 58.34 | C |
| ATOM | 1417 | O | SER | A | 189 | −14.681 | −13.951 | 133.002 | 1.00 | 59.39 | O |
| ATOM | 1418 | CB | SER | A | 189 | −16.042 | −16.351 | 134.478 | 1.00 | 56.17 | C |
| ATOM | 1419 | OG | SER | A | 189 | −16.101 | −17.316 | 133.435 | 1.00 | 52.74 | O |
| ATOM | 1420 | N | SER | A | 190 | −16.276 | −14.687 | 131.590 | 1.00 | 53.51 | N |
| ATOM | 1421 | CA | SER | A | 190 | −15.528 | −14.312 | 130.396 | 1.00 | 56.22 | C |
| ATOM | 1422 | C | SER | A | 190 | −15.594 | −12.816 | 130.086 | 1.00 | 54.08 | C |
| ATOM | 1423 | O | SER | A | 190 | −14.802 | −12.330 | 129.265 | 1.00 | 51.28 | O |
| ATOM | 1424 | CB | SER | A | 190 | −16.020 | −15.138 | 129.197 | 1.00 | 51.36 | C |
| ATOM | 1425 | OG | SER | A | 190 | −17.368 | −14.852 | 128.863 | 1.00 | 46.74 | O |
| ATOM | 1426 | N | LEU | A | 191 | −16.523 | −12.081 | 130.693 | 1.00 | 53.01 | N |
| ATOM | 1427 | CA | LEU | A | 191 | −16.577 | −10.644 | 130.464 | 1.00 | 53.09 | C |
| ATOM | 1428 | C | LEU | A | 191 | −15.339 | −9.981 | 131.058 | 1.00 | 54.27 | C |
| ATOM | 1429 | O | LEU | A | 191 | −14.790 | −10.428 | 132.071 | 1.00 | 58.30 | O |
| ATOM | 1430 | CB | LEU | A | 191 | −17.839 | −10.054 | 131.081 | 1.00 | 38.62 | C |
| ATOM | 1431 | CG | LEU | A | 191 | −19.093 | −10.795 | 130.646 | 1.00 | 45.96 | C |
| ATOM | 1432 | CD1 | LEU | A | 191 | −20.297 | −10.313 | 131.431 | 1.00 | 42.60 | C |
| ATOM | 1433 | CD2 | LEU | A | 191 | −19.308 | −10.675 | 129.131 | 1.00 | 40.49 | C |
| ATOM | 1434 | N | GLY | A | 192 | −14.896 | −8.905 | 130.421 | 1.00 | 50.04 | N |
| ATOM | 1435 | CA | GLY | A | 192 | −13.722 | −8.196 | 130.886 | 1.00 | 59.39 | C |
| ATOM | 1436 | C | GLY | A | 192 | −12.384 | −8.841 | 130.570 | 1.00 | 59.35 | C |
| ATOM | 1437 | O | GLY | A | 192 | −11.382 | −8.120 | 130.468 | 1.00 | 65.09 | O |
| ATOM | 1438 | N | THR | A | 193 | −12.332 | −10.163 | 130.376 | 1.00 | 50.42 | N |
| ATOM | 1439 | CA | THR | A | 193 | −11.152 | −10.830 | 129.835 | 1.00 | 51.34 | C |
| ATOM | 1440 | C | THR | A | 193 | −11.269 | −11.178 | 128.350 | 1.00 | 53.60 | C |
| ATOM | 1441 | O | THR | A | 193 | −10.257 | −11.147 | 127.651 | 1.00 | 57.09 | O |
| ATOM | 1442 | CB | THR | A | 193 | −10.822 | −12.109 | 130.622 | 1.00 | 56.32 | C |
| ATOM | 1443 | OG1 | THR | A | 193 | −11.943 | −12.512 | 131.418 | 1.00 | 57.77 | O |
| ATOM | 1444 | CG2 | THR | A | 193 | −9.595 | −11.892 | 131.523 | 1.00 | 48.53 | C |
| ATOM | 1445 | N | GLN | A | 194 | −12.451 | −11.519 | 127.838 | 1.00 | 53.81 | N |
| ATOM | 1446 | CA | GLN | A | 194 | −12.619 | −11.879 | 126.431 | 1.00 | 47.52 | C |
| ATOM | 1447 | C | GLN | A | 194 | −13.238 | −10.716 | 125.660 | 1.00 | 45.35 | C |
| ATOM | 1448 | O | GLN | A | 194 | −14.169 | −10.066 | 126.142 | 1.00 | 47.02 | O |
| ATOM | 1449 | CB | GLN | A | 194 | −13.512 | −13.111 | 126.292 | 1.00 | 46.52 | C |
| ATOM | 1450 | CG | GLN | A | 194 | −13.761 | −13.550 | 124.857 | 1.00 | 46.74 | C |
| ATOM | 1451 | CD | GLN | A | 194 | −12.496 | −13.985 | 124.141 | 1.00 | 53.73 | C |
| ATOM | 1452 | OE1 | GLN | A | 194 | −12.011 | −13.301 | 123.239 | 1.00 | 52.18 | O |
| ATOM | 1453 | NE2 | GLN | A | 194 | −11.967 | −15.148 | 124.528 | 1.00 | 50.74 | N |
| ATOM | 1454 | N | THR | A | 195 | −12.745 | −10.462 | 124.453 | 1.00 | 44.88 | N |
| ATOM | 1455 | CA | THR | A | 195 | −13.244 | −9.345 | 123.657 | 1.00 | 46.31 | C |
| ATOM | 1456 | C | THR | A | 195 | −14.325 | −9.802 | 122.680 | 1.00 | 43.67 | C |
| ATOM | 1457 | O | THR | A | 195 | −14.211 | −10.862 | 122.057 | 1.00 | 41.58 | O |
| ATOM | 1458 | CB | THR | A | 195 | −12.104 | −8.651 | 122.909 | 1.00 | 53.06 | C |
| ATOM | 1459 | OG1 | THR | A | 195 | −11.441 | −7.742 | 123.803 | 1.00 | 57.28 | O |
| ATOM | 1460 | CG2 | THR | A | 195 | −12.631 | −7.884 | 121.694 | 1.00 | 42.53 | C |
| ATOM | 1461 | N | TYR | A | 196 | −15.393 | −9.007 | 122.579 | 1.00 | 43.78 | N |
| ATOM | 1462 | CA | TYR | A | 196 | −16.551 | −9.321 | 121.750 | 1.00 | 36.48 | C |
| ATOM | 1463 | C | TYR | A | 196 | −16.798 | −8.201 | 120.755 | 1.00 | 34.63 | C |
| ATOM | 1464 | O | TYR | A | 196 | −17.090 | −7.066 | 121.139 | 1.00 | 34.38 | O |
| ATOM | 1465 | CB | TYR | A | 196 | −17.769 | −9.564 | 122.621 | 1.00 | 32.34 | C |
| ATOM | 1466 | CG | TYR | A | 196 | −17.567 | −10.773 | 123.470 | 1.00 | 38.36 | C |
| ATOM | 1467 | CD1 | TYR | A | 196 | −17.517 | −12.036 | 122.900 | 1.00 | 36.90 | C |
| ATOM | 1468 | CD2 | TYR | A | 196 | −17.359 | −10.655 | 124.830 | 1.00 | 39.09 | C |
| ATOM | 1469 | CE1 | TYR | A | 196 | −17.316 | −13.151 | 123.676 | 1.00 | 37.95 | C |
| ATOM | 1470 | CE2 | TYR | A | 196 | −17.147 | −11.755 | 125.605 | 1.00 | 39.61 | C |
| ATOM | 1471 | CZ | TYR | A | 196 | −17.129 | −13.001 | 125.028 | 1.00 | 39.92 | C |
| ATOM | 1472 | OH | TYR | A | 196 | −16.921 | −14.098 | 125.825 | 1.00 | 47.25 | O |
| ATOM | 1473 | N | ILE | A | 197 | −16.653 | −8.516 | 119.478 | 1.00 | 35.82 | N |
| ATOM | 1474 | CA | ILE | A | 197 | −16.831 | −7.548 | 118.405 | 1.00 | 36.37 | C |
| ATOM | 1475 | C | ILE | A | 197 | −17.841 | −8.108 | 117.422 | 1.00 | 30.22 | C |
| ATOM | 1476 | O | ILE | A | 197 | −17.783 | −9.287 | 117.065 | 1.00 | 32.67 | O |

TABLE 10.4-continued

| ATOM | 1477 | CB | ILE | A | 197 | −15.496 | −7.222 | 117.702 | 1.00 | 32.39 | C |
|---|---|---|---|---|---|---|---|---|---|---|---|
| ATOM | 1478 | CG1 | ILE | A | 197 | −14.528 | −6.609 | 118.709 | 1.00 | 32.03 | C |
| ATOM | 1479 | CG2 | ILE | A | 197 | −15.722 | −6.302 | 116.521 | 1.00 | 28.21 | C |
| ATOM | 1480 | CD1 | ILE | A | 197 | −13.138 | −6.617 | 118.246 | 1.00 | 30.83 | C |
| ATOM | 1481 | N | CYS | A | 198 | −18.784 | −7.287 | 117.016 | 1.00 | 34.51 | N |
| ATOM | 1482 | CA | CYS | A | 198 | −19.717 | −7.687 | 115.984 | 1.00 | 35.67 | C |
| ATOM | 1483 | C | CYS | A | 198 | −19.346 | −7.002 | 114.676 | 1.00 | 33.53 | C |
| ATOM | 1484 | O | CYS | A | 198 | −19.039 | −5.805 | 114.645 | 1.00 | 32.08 | O |
| ATOM | 1485 | CB | CYS | A | 198 | −21.157 | −7.379 | 116.404 | 1.00 | 36.62 | C |
| ATOM | 1486 | SG | CYS | A | 198 | −21.662 | −5.699 | 116.191 | 1.00 | 46.42 | S |
| ATOM | 1487 | N | ASN | A | 199 | −19.373 | −7.777 | 113.598 | 1.00 | 31.00 | N |
| ATOM | 1488 | CA | ASN | A | 199 | −18.952 | −7.325 | 112.279 | 1.00 | 34.62 | C |
| ATOM | 1489 | C | ASN | A | 199 | −20.212 | −7.179 | 111.438 | 1.00 | 30.03 | C |
| ATOM | 1490 | O | ASN | A | 199 | −20.926 | −8.157 | 111.205 | 1.00 | 33.61 | O |
| ATOM | 1491 | CB | ASN | A | 199 | −17.969 | −8.322 | 111.669 | 1.00 | 30.80 | C |
| ATOM | 1492 | CG | ASN | A | 199 | −16.998 | −8.861 | 112.691 | 1.00 | 33.45 | C |
| ATOM | 1493 | OD1 | ASN | A | 199 | −17.071 | −10.028 | 113.087 | 1.00 | 30.25 | O |
| ATOM | 1494 | ND2 | ASN | A | 199 | −16.090 | −8.004 | 113.146 | 1.00 | 31.39 | N |
| ATOM | 1495 | N | VAL | A | 200 | −20.530 | −5.961 | 111.036 | 1.00 | 25.18 | N |
| ATOM | 1496 | CA | VAL | A | 200 | −21.753 | −5.699 | 110.295 | 1.00 | 31.02 | C |
| ATOM | 1497 | C | VAL | A | 200 | −21.346 | −5.394 | 108.868 | 1.00 | 31.80 | C |
| ATOM | 1498 | O | VAL | A | 200 | −20.402 | −4.632 | 108.642 | 1.00 | 32.16 | O |
| ATOM | 1499 | CB | VAL | A | 200 | −22.581 | −4.546 | 110.896 | 1.00 | 26.09 | C |
| ATOM | 1500 | CG1 | VAL | A | 200 | −23.862 | −4.409 | 110.130 | 1.00 | 31.91 | C |
| ATOM | 1501 | CG2 | VAL | A | 200 | −22.900 | −4.792 | 112.348 | 1.00 | 27.12 | C |
| ATOM | 1502 | N | ASN | A | 201 | −22.022 | −6.016 | 107.910 | 1.00 | 31.12 | N |
| ATOM | 1503 | CA | ASN | A | 201 | −21.800 | −5.693 | 106.511 | 1.00 | 34.13 | C |
| ATOM | 1504 | C | ASN | A | 201 | −23.127 | −5.341 | 105.866 | 1.00 | 32.42 | C |
| ATOM | 1505 | O | ASN | A | 201 | −24.065 | −6.141 | 105.883 | 1.00 | 35.02 | O |
| ATOM | 1506 | CB | ASN | A | 201 | −21.122 | −6.839 | 105.767 | 1.00 | 36.09 | C |
| ATOM | 1507 | CG | ASN | A | 201 | −20.557 | −6.390 | 104.457 | 1.00 | 39.19 | C |
| ATOM | 1508 | OD1 | ASN | A | 201 | −20.860 | −5.296 | 104.000 | 1.00 | 43.01 | O |
| ATOM | 1509 | ND2 | ASN | A | 201 | −19.730 | −7.218 | 103.844 | 1.00 | 44.41 | N |
| ATOM | 1510 | N | HIS | A | 202 | −23.222 | −4.123 | 105.361 | 1.00 | 34.15 | N |
| ATOM | 1511 | CA | HIS | A | 202 | −24.349 | −3.682 | 104.561 | 1.00 | 33.64 | C |
| ATOM | 1512 | C | HIS | A | 202 | −23.801 | −3.403 | 103.168 | 1.00 | 39.81 | C |
| ATOM | 1513 | O | HIS | A | 202 | −23.463 | −2.264 | 102.836 | 1.00 | 37.99 | O |
| ATOM | 1514 | CB | HIS | A | 202 | −25.001 | −2.473 | 105.147 | 1.00 | 31.71 | C |
| ATOM | 1515 | CG | HIS | A | 202 | −26.244 | −2.052 | 104.425 | 1.00 | 37.75 | C |
| ATOM | 1516 | ND1 | HIS | A | 202 | −26.419 | −0.780 | 103.917 | 1.00 | 38.12 | N |
| ATOM | 1517 | CD2 | HIS | A | 202 | −27.377 | −2.735 | 104.129 | 1.00 | 32.94 | C |
| ATOM | 1518 | CE1 | HIS | A | 202 | −27.607 | −0.699 | 103.344 | 1.00 | 37.74 | C |
| ATOM | 1519 | NE2 | HIS | A | 202 | −28.210 | −1.871 | 103.463 | 1.00 | 34.91 | N |
| ATOM | 1520 | N | LYS | A | 203 | −23.690 | −4.461 | 102.359 | 1.00 | 34.79 | N |
| ATOM | 1521 | CA | LYS | A | 203 | −23.249 | −4.285 | 100.978 | 1.00 | 35.75 | C |
| ATOM | 1522 | C | LYS | A | 203 | −24.071 | −3.261 | 100.195 | 1.00 | 39.45 | C |
| ATOM | 1523 | O | LYS | A | 203 | −23.482 | −2.573 | 99.346 | 1.00 | 38.28 | O |
| ATOM | 1524 | CB | LYS | A | 203 | −23.166 | −5.647 | 100.266 | 1.00 | 29.77 | C |
| ATOM | 1525 | CG | LYS | A | 203 | −21.879 | −6.425 | 100.649 | 1.00 | 40.20 | C |
| ATOM | 1526 | CD | LYS | A | 203 | −20.652 | −5.726 | 99.988 | 1.00 | 63.25 | C |
| ATOM | 1527 | CE | LYS | A | 203 | −19.279 | −6.000 | 100.660 | 1.00 | 68.58 | C |
| ATOM | 1528 | NZ | LYS | A | 203 | −18.938 | −7.439 | 100.898 | 1.00 | 69.85 | N1+ |
| ATOM | 1529 | N | PRO | A | 204 | −25.392 | −3.108 | 100.390 | 1.00 | 41.00 | N |
| ATOM | 1530 | CA | PRO | A | 204 | −26.120 | −2.121 | 99.566 | 1.00 | 38.96 | C |
| ATOM | 1531 | C | PRO | A | 204 | −25.629 | −0.681 | 99.705 | 1.00 | 40.45 | C |
| ATOM | 1532 | O | PRO | A | 204 | −25.839 | 0.114 | 98.782 | 1.00 | 44.07 | O |
| ATOM | 1533 | CB | PRO | A | 204 | −27.568 | −2.272 | 100.043 | 1.00 | 36.97 | C |
| ATOM | 1534 | CG | PRO | A | 204 | −27.647 | −3.652 | 100.563 | 1.00 | 35.26 | C |
| ATOM | 1535 | CD | PRO | A | 204 | −26.327 | −3.952 | 101.168 | 1.00 | 33.30 | C |
| ATOM | 1536 | N | SER | A | 205 | −25.061 | −0.287 | 100.845 | 1.00 | 42.01 | N |
| ATOM | 1537 | CA | SER | A | 205 | −24.455 | 1.034 | 100.993 | 1.00 | 40.43 | C |
| ATOM | 1538 | C | SER | A | 205 | −22.931 | 0.956 | 101.094 | 1.00 | 39.05 | C |
| ATOM | 1539 | O | SER | A | 205 | −22.279 | 1.963 | 101.369 | 1.00 | 37.64 | O |
| ATOM | 1540 | CB | SER | A | 205 | −25.052 | 1.778 | 102.195 | 1.00 | 35.25 | C |
| ATOM | 1541 | OG | SER | A | 205 | −24.659 | 1.213 | 103.424 | 1.00 | 36.65 | O |
| ATOM | 1542 | N | ASN | A | 206 | −22.354 | −0.219 | 100.868 | 1.00 | 42.36 | N |
| ATOM | 1543 | CA | ASN | A | 206 | −20.919 | −0.449 | 101.017 | 1.00 | 44.31 | C |
| ATOM | 1544 | C | ASN | A | 206 | −20.414 | 0.021 | 102.382 | 1.00 | 46.67 | C |
| ATOM | 1545 | O | ASN | A | 206 | −19.385 | 0.680 | 102.506 | 1.00 | 50.37 | O |
| ATOM | 1546 | CB | ASN | A | 206 | −20.146 | 0.208 | 99.880 | 1.00 | 49.52 | C |
| ATOM | 1547 | CG | ASN | A | 206 | −19.229 | −0.766 | 99.187 | 1.00 | 61.70 | C |
| ATOM | 1548 | OD1 | ASN | A | 206 | −19.323 | −1.979 | 99.401 | 1.00 | 67.47 | O |
| ATOM | 1549 | ND2 | ASN | A | 206 | −18.336 | −0.253 | 98.352 | 1.00 | 70.26 | N |
| ATOM | 1550 | N | THR | A | 207 | −21.150 | −0.352 | 103.423 | 1.00 | 45.98 | N |
| ATOM | 1551 | CA | THR | A | 207 | −20.861 | 0.041 | 104.792 | 1.00 | 36.87 | C |
| ATOM | 1552 | C | THR | A | 207 | −20.417 | −1.180 | 105.574 | 1.00 | 37.03 | C |
| ATOM | 1553 | O | THR | A | 207 | −21.118 | −2.192 | 105.590 | 1.00 | 41.13 | O |
| ATOM | 1554 | CB | THR | A | 207 | −22.100 | 0.626 | 105.457 | 1.00 | 42.00 | C |
| ATOM | 1555 | OG1 | THR | A | 207 | −22.616 | 1.689 | 104.649 | 1.00 | 45.30 | O |
| ATOM | 1556 | CG2 | THR | A | 207 | −21.767 | 1.132 | 106.876 | 1.00 | 42.01 | C |

TABLE 10.4-continued

| | | | | | | | | | | |
|---|---|---|---|---|---|---|---|---|---|---|
| ATOM | 1557 | N | LYS | A | 208 | −19.263 | −1.088 | 106.210 | 1.00 | 36.32 | N |
| ATOM | 1558 | CA | LYS | A | 208 | −18.793 | −2.110 | 107.127 | 1.00 | 32.74 | C |
| ATOM | 1559 | C | LYS | A | 208 | −18.511 | −1.465 | 108.478 | 1.00 | 34.61 | C |
| ATOM | 1560 | O | LYS | A | 208 | −18.088 | −0.307 | 108.545 | 1.00 | 39.61 | O |
| ATOM | 1561 | CB | LYS | A | 208 | −17.552 | −2.827 | 106.585 | 1.00 | 40.21 | C |
| ATOM | 1562 | CG | LYS | A | 208 | −17.865 | −3.863 | 105.502 | 1.00 | 39.11 | C |
| ATOM | 1563 | CD | LYS | A | 208 | −16.707 | −4.821 | 105.239 | 1.00 | 34.67 | C |
| ATOM | 1564 | CE | LYS | A | 208 | −15.518 | −4.128 | 104.606 | 1.00 | 49.09 | C |
| ATOM | 1565 | NZ | LYS | A | 208 | −14.349 | −5.076 | 104.456 | 1.00 | 57.65 | N1+ |
| ATOM | 1566 | N | VAL | A | 209 | −18.846 | −2.174 | 109.552 | 1.00 | 32.84 | N |
| ATOM | 1567 | CA | VAL | A | 209 | −18.671 | −1.684 | 110.917 | 1.00 | 32.20 | C |
| ATOM | 1568 | C | VAL | A | 209 | −18.247 | −2.844 | 111.797 | 1.00 | 34.40 | C |
| ATOM | 1569 | O | VAL | A | 209 | −18.906 | −3.889 | 111.817 | 1.00 | 38.11 | O |
| ATOM | 1570 | CB | VAL | A | 209 | −19.960 | −1.054 | 111.491 | 1.00 | 31.14 | C |
| ATOM | 1571 | CG1 | VAL | A | 209 | −19.816 | −0.826 | 112.974 | 1.00 | 27.96 | C |
| ATOM | 1572 | CG2 | VAL | A | 209 | −20.276 | 0.252 | 110.810 | 1.00 | 26.07 | C |
| ATOM | 1573 | N | ASP | A | 210 | −17.195 | −2.642 | 112.574 | 1.00 | 36.64 | N |
| ATOM | 1574 | CA | ASP | A | 210 | −16.821 | −3.545 | 113.659 | 1.00 | 33.62 | C |
| ATOM | 1575 | C | ASP | A | 210 | −17.053 | −2.791 | 114.962 | 1.00 | 30.39 | C |
| ATOM | 1576 | O | ASP | A | 210 | −16.490 | −1.718 | 115.159 | 1.00 | 32.48 | O |
| ATOM | 1577 | CB | ASP | A | 210 | −15.360 | −3.980 | 113.548 | 1.00 | 32.01 | C |
| ATOM | 1578 | CG | ASP | A | 210 | −15.084 | −4.843 | 112.325 | 1.00 | 42.55 | C |
| ATOM | 1579 | OD1 | ASP | A | 210 | −15.829 | −5.839 | 112.124 | 1.00 | 46.60 | O |
| ATOM | 1580 | OD2 | ASP | A | 210 | −14.119 | −4.527 | 111.570 | 1.00 | 34.51 | O1− |
| ATOM | 1581 | N | LYS | A | 211 | −17.904 | −3.319 | 115.827 | 1.00 | 34.41 | N |
| ATOM | 1582 | CA | LYS | A | 211 | −18.270 | −2.654 | 117.073 | 1.00 | 28.87 | C |
| ATOM | 1583 | C | LYS | A | 211 | −17.832 | −3.519 | 118.243 | 1.00 | 33.13 | C |
| ATOM | 1584 | O | LYS | A | 211 | −18.283 | −4.661 | 118.374 | 1.00 | 31.45 | O |
| ATOM | 1585 | CB | LYS | A | 211 | −19.775 | −2.409 | 117.155 | 1.00 | 30.56 | C |
| ATOM | 1586 | CG | LYS | A | 211 | −20.246 | −1.799 | 118.460 | 1.00 | 33.07 | C |
| ATOM | 1587 | CD | LYS | A | 211 | −19.646 | −0.430 | 118.618 | 1.00 | 36.20 | C |
| ATOM | 1588 | CE | LYS | A | 211 | −20.539 | 0.467 | 119.407 | 1.00 | 33.18 | C |
| ATOM | 1589 | NZ | LYS | A | 211 | −20.169 | 1.877 | 119.156 | 1.00 | 35.41 | N1+ |
| ATOM | 1590 | N | LYS | A | 212 | −16.962 | −2.972 | 119.094 | 1.00 | 35.68 | N |
| ATOM | 1591 | CA | LYS | A | 212 | −16.654 | −3.617 | 120.354 | 1.00 | 28.26 | C |
| ATOM | 1592 | C | LYS | A | 212 | −17.806 | −3.349 | 121.296 | 1.00 | 30.86 | C |
| ATOM | 1593 | O | LYS | A | 212 | −18.409 | −2.271 | 121.278 | 1.00 | 33.51 | O |
| ATOM | 1594 | CB | LYS | A | 212 | −15.341 | −3.112 | 120.955 | 1.00 | 31.23 | C |
| ATOM | 1595 | CG | LYS | A | 212 | −14.740 | −4.080 | 121.984 | 1.00 | 38.53 | C |
| ATOM | 1596 | CD | LYS | A | 212 | −13.567 | −3.503 | 122.778 | 1.00 | 42.63 | C |
| ATOM | 1597 | CE | LYS | A | 212 | −13.088 | −4.492 | 123.847 | 1.00 | 44.88 | C |
| ATOM | 1598 | NZ | LYS | A | 212 | −12.001 | −3.960 | 124.723 | 1.00 | 52.61 | N1+ |
| ATOM | 1599 | N | VAL | A | 213 | −18.175 | −4.376 | 122.039 | 1.00 | 30.30 | N |
| ATOM | 1600 | CA | VAL | A | 213 | −19.246 | −4.322 | 123.012 | 1.00 | 34.60 | C |
| ATOM | 1601 | C | VAL | A | 213 | −18.589 | −4.663 | 124.336 | 1.00 | 35.78 | C |
| ATOM | 1602 | O | VAL | A | 213 | −18.141 | −5.795 | 124.530 | 1.00 | 39.34 | O |
| ATOM | 1603 | CB | VAL | A | 213 | −20.380 | −5.300 | 122.667 | 1.00 | 36.86 | C |
| ATOM | 1604 | CG1 | VAL | A | 213 | −21.521 | −5.226 | 123.700 | 1.00 | 37.67 | C |
| ATOM | 1605 | CG2 | VAL | A | 213 | −20.903 | −5.028 | 121.278 | 1.00 | 27.28 | C |
| ATOM | 1606 | N | GLU | A | 214 | −18.489 | −3.687 | 125.228 | 1.00 | 43.48 | N |
| ATOM | 1607 | CA | GLU | A | 214 | −17.839 | −3.878 | 126.521 | 1.00 | 42.79 | C |
| ATOM | 1608 | C | GLU | A | 214 | −18.866 | −3.868 | 127.636 | 1.00 | 39.79 | C |
| ATOM | 1609 | O | GLU | A | 214 | −19.925 | −3.250 | 127.508 | 1.00 | 39.59 | O |
| ATOM | 1610 | CB | GLU | A | 214 | −16.795 | −2.787 | 126.788 | 1.00 | 42.03 | C |
| ATOM | 1611 | CG | GLU | A | 214 | −15.715 | −2.770 | 125.730 | 1.00 | 53.61 | C |
| ATOM | 1612 | CD | GLU | A | 214 | −14.732 | −1.636 | 125.888 | 1.00 | 60.49 | C |
| ATOM | 1613 | OE1 | GLU | A | 214 | −13.614 | −1.878 | 126.391 | 1.00 | 64.12 | O |
| ATOM | 1614 | OE2 | GLU | A | 214 | −15.085 | −0.500 | 125.505 | 1.00 | 65.45 | O1− |
| ATOM | 1615 | N | PRO | A | 215 | −18.599 | −4.573 | 128.724 | 1.00 | 42.19 | N |
| ATOM | 1616 | CA | PRO | A | 215 | −19.495 | −4.496 | 129.882 | 1.00 | 47.10 | C |
| ATOM | 1617 | C | PRO | A | 215 | −19.546 | −3.089 | 130.452 | 1.00 | 54.06 | C |
| ATOM | 1618 | O | PRO | A | 215 | −18.521 | −2.414 | 130.566 | 1.00 | 56.58 | O |
| ATOM | 1619 | CB | PRO | A | 215 | −18.885 | −5.492 | 130.874 | 1.00 | 49.68 | C |
| ATOM | 1620 | CG | PRO | A | 215 | −17.567 | −5.950 | 130.264 | 1.00 | 48.26 | C |
| ATOM | 1621 | CD | PRO | A | 215 | −17.651 | −5.695 | 128.809 | 1.00 | 45.54 | C |
| ATOM | 1622 | N | LYS | A | 216 | −20.760 | −2.636 | 130.768 | 1.00 | 59.07 | N |
| ATOM | 1623 | CA | LYS | A | 216 | −21.008 | −1.289 | 131.272 | 1.00 | 66.58 | C |
| ATOM | 1624 | C | LYS | A | 216 | −21.516 | −1.355 | 132.710 | 1.00 | 80.80 | C |
| ATOM | 1625 | O | LYS | A | 216 | −22.468 | −2.092 | 133.005 | 1.00 | 75.99 | O |
| ATOM | 1626 | CB | LYS | A | 216 | −22.036 | −0.555 | 130.408 | 1.00 | 66.80 | C |
| ATOM | 1627 | CG | LYS | A | 216 | −22.360 | 0.859 | 130.899 | 1.00 | 73.54 | C |
| ATOM | 1628 | CD | LYS | A | 216 | −23.096 | 1.653 | 129.834 | 1.00 | 77.62 | C |
| ATOM | 1629 | CE | LYS | A | 216 | −23.325 | 3.092 | 130.255 | 1.00 | 75.50 | C |
| ATOM | 1630 | NZ | LYS | A | 216 | −23.769 | 3.921 | 129.103 | 1.00 | 65.88 | N1+ |
| ATOM | 1631 | N | SER | A | 217 | −20.927 | −0.528 | 133.580 | 1.00 | 90.64 | N |
| ATOM | 1632 | CA | SER | A | 217 | −21.323 | −0.451 | 134.994 | 1.00 | 92.77 | C |
| ATOM | 1633 | C | SER | A | 217 | −22.109 | 0.829 | 135.282 | 1.00 | 85.80 | C |
| ATOM | 1634 | O | SER | A | 217 | −23.332 | 0.797 | 135.455 | 1.00 | 82.11 | O |
| ATOM | 1635 | CB | SER | A | 217 | −20.096 | −0.528 | 135.915 | 1.00 | 84.71 | C |
| ATOM | 1636 | OG | SER | A | 217 | −19.239 | 0.585 | 135.722 | 1.00 | 86.75 | O |

TABLE 10.4-continued

| | | | | | | | | | | |
|---|---|---|---|---|---|---|---|---|---|---|
| TER | | | | | | | | | | |
| ATOM | 1637 | N | GLU | B | 1 | −59.401 | −19.548 | 88.941 | 1.00 | 32.61 | N |
| ATOM | 1638 | CA | GLU | B | 1 | −58.164 | −20.286 | 89.135 | 1.00 | 32.73 | C |
| ATOM | 1639 | C | GLU | B | 1 | −58.344 | −21.415 | 90.159 | 1.00 | 39.88 | C |
| ATOM | 1640 | O | GLU | B | 1 | −59.196 | −21.331 | 91.040 | 1.00 | 39.29 | O |
| ATOM | 1641 | CB | GLU | B | 1 | −57.054 | −19.366 | 89.613 | 1.00 | 32.87 | C |
| ATOM | 1642 | CG | GLU | B | 1 | −57.037 | −19.224 | 91.116 | 1.00 | 33.91 | C |
| ATOM | 1643 | CD | GLU | B | 1 | −56.083 | −18.160 | 91.599 | 1.00 | 44.88 | C |
| ATOM | 1644 | OE1 | GLU | B | 1 | −56.022 | −17.970 | 92.832 | 1.00 | 55.17 | O |
| ATOM | 1645 | OE2 | GLU | B | 1 | −55.378 | −17.536 | 90.763 | 1.00 | 44.77 | O1− |
| ATOM | 1646 | N | ILE | B | 2 | −57.536 | −22.470 | 90.052 | 1.00 | 36.20 | N |
| ATOM | 1647 | CA | ILE | B | 2 | −57.589 | −23.542 | 91.037 | 1.00 | 31.00 | C |
| ATOM | 1648 | C | ILE | B | 2 | −56.950 | −23.074 | 92.339 | 1.00 | 27.84 | C |
| ATOM | 1649 | O | ILE | B | 2 | −55.774 | −22.694 | 92.370 | 1.00 | 27.28 | O |
| ATOM | 1650 | CB | ILE | B | 2 | −56.893 | −24.797 | 90.521 | 1.00 | 30.83 | C |
| ATOM | 1651 | CG1 | ILE | B | 2 | −57.571 | −25.303 | 89.259 | 1.00 | 24.03 | C |
| ATOM | 1652 | CG2 | ILE | B | 2 | −56.832 | −25.856 | 91.649 | 1.00 | 24.77 | C |
| ATOM | 1653 | CD1 | ILE | B | 2 | −56.866 | −26.508 | 88.716 | 1.00 | 24.00 | C |
| ATOM | 1654 | N | VAL | B | 3 | −57.718 | −23.116 | 93.424 | 1.00 | 28.01 | N |
| ATOM | 1655 | CA | VAL | B | 3 | −57.227 | −22.750 | 94.748 | 1.00 | 31.60 | C |
| ATOM | 1656 | C | VAL | B | 3 | −56.810 | −24.011 | 95.498 | 1.00 | 30.30 | C |
| ATOM | 1657 | O | VAL | B | 3 | −57.580 | −24.976 | 95.602 | 1.00 | 30.30 | O |
| ATOM | 1658 | CB | VAL | B | 3 | −58.287 | −21.965 | 95.535 | 1.00 | 30.01 | C |
| ATOM | 1659 | CG1 | VAL | B | 3 | −57.782 | −21.724 | 96.916 | 1.00 | 23.45 | C |
| ATOM | 1660 | CG2 | VAL | B | 3 | −58.637 | −20.645 | 94.815 | 1.00 | 24.87 | C |
| ATOM | 1661 | N | LEU | B | 4 | −55.591 | −24.017 | 96.006 | 1.00 | 27.66 | N |
| ATOM | 1662 | CA | LEU | B | 4 | −55.047 | −25.168 | 96.709 | 1.00 | 27.72 | C |
| ATOM | 1663 | C | LEU | B | 4 | −54.941 | −24.793 | 98.170 | 1.00 | 30.07 | C |
| ATOM | 1664 | O | LEU | B | 4 | −54.281 | −23.805 | 98.509 | 1.00 | 34.25 | O |
| ATOM | 1665 | CB | LEU | B | 4 | −53.677 | −25.570 | 96.165 | 1.00 | 31.34 | C |
| ATOM | 1666 | CG | LEU | B | 4 | −53.596 | −26.025 | 94.711 | 1.00 | 30.78 | C |
| ATOM | 1667 | CD1 | LEU | B | 4 | −52.155 | −26.475 | 94.361 | 1.00 | 29.60 | C |
| ATOM | 1668 | CD2 | LEU | B | 4 | −54.571 | −27.161 | 94.511 | 1.00 | 23.79 | C |
| ATOM | 1669 | N | THR | B | 5 | −55.591 | −25.568 | 99.026 | 1.00 | 26.39 | N |
| ATOM | 1670 | CA | THR | B | 5 | −55.586 | −25.330 | 100.458 | 1.00 | 23.07 | C |
| ATOM | 1671 | C | THR | B | 5 | −54.765 | −26.407 | 101.130 | 1.00 | 26.07 | C |
| ATOM | 1672 | O | THR | B | 5 | −55.089 | −27.591 | 101.034 | 1.00 | 29.54 | O |
| ATOM | 1673 | CB | THR | B | 5 | −57.007 | −25.330 | 101.019 | 1.00 | 23.58 | C |
| ATOM | 1674 | OG1 | THR | B | 5 | −57.813 | −24.424 | 100.256 | 1.00 | 25.83 | O |
| ATOM | 1675 | CG2 | THR | B | 5 | −56.992 | −24.892 | 102.458 | 1.00 | 18.31 | C |
| ATOM | 1676 | N | GLN | B | 6 | −53.731 | −26.003 | 101.830 | 1.00 | 23.61 | N |
| ATOM | 1677 | CA | GLN | B | 6 | −52.920 | −26.943 | 102.569 | 1.00 | 25.57 | C |
| ATOM | 1678 | C | GLN | B | 6 | −53.328 | −26.929 | 104.024 | 1.00 | 24.28 | C |
| ATOM | 1679 | O | GLN | B | 6 | −53.585 | −25.871 | 104.592 | 1.00 | 28.38 | O |
| ATOM | 1680 | CB | GLN | B | 6 | −51.432 | −26.623 | 102.442 | 1.00 | 21.43 | C |
| ATOM | 1681 | CG | GLN | B | 6 | −50.866 | −27.125 | 101.172 | 1.00 | 25.09 | C |
| ATOM | 1682 | CD | GLN | B | 6 | −49.406 | −26.785 | 101.003 | 1.00 | 29.92 | C |
| ATOM | 1683 | OE1 | GLN | B | 6 | −49.065 | −25.856 | 100.258 | 1.00 | 30.10 | O |
| ATOM | 1684 | NE2 | GLN | B | 6 | −48.529 | −27.542 | 101.671 | 1.00 | 23.00 | N |
| ATOM | 1685 | N | SER | B | 7 | −53.388 | −28.113 | 104.609 | 1.00 | 28.46 | N |
| ATOM | 1686 | CA | SER | B | 7 | −53.526 | −28.273 | 106.046 | 1.00 | 32.14 | C |
| ATOM | 1687 | C | SER | B | 7 | −52.626 | −29.410 | 106.541 | 1.00 | 32.52 | C |
| ATOM | 1688 | O | SER | B | 7 | −52.238 | −30.294 | 105.774 | 1.00 | 31.45 | O |
| ATOM | 1689 | CB | SER | B | 7 | −54.960 | −28.558 | 106.404 | 1.00 | 26.70 | C |
| ATOM | 1690 | OG | SER | B | 7 | −55.208 | −29.883 | 106.045 | 1.00 | 39.01 | O |
| ATOM | 1691 | N | PRO | B | 8 | −52.242 | −29.367 | 107.816 | 1.00 | 35.79 | N |
| ATOM | 1692 | CA | PRO | B | 8 | −52.444 | −28.237 | 108.728 | 1.00 | 32.17 | C |
| ATOM | 1693 | C | PRO | B | 8 | −51.456 | −27.142 | 108.349 | 1.00 | 33.18 | C |
| ATOM | 1694 | O | PRO | B | 8 | −50.550 | −27.465 | 107.590 | 1.00 | 35.18 | O |
| ATOM | 1695 | CB | PRO | B | 8 | −52.119 | −28.837 | 110.103 | 1.00 | 26.39 | C |
| ATOM | 1696 | CG | PRO | B | 8 | −51.061 | −29.854 | 109.786 | 1.00 | 33.66 | C |
| ATOM | 1697 | CD | PRO | B | 8 | −51.426 | −30.438 | 108.422 | 1.00 | 30.11 | C |
| ATOM | 1698 | N | GLY | B | 9 | −51.584 | −25.920 | 108.877 | 1.00 | 35.12 | N |
| ATOM | 1699 | CA | GLY | B | 9 | −50.583 | −24.899 | 108.603 | 1.00 | 25.91 | C |
| ATOM | 1700 | C | GLY | B | 9 | −49.249 | −25.202 | 109.264 | 1.00 | 27.68 | C |
| ATOM | 1701 | O | GLY | B | 9 | −48.196 | −25.015 | 108.661 | 1.00 | 27.97 | O |
| ATOM | 1702 | N | THR | B | 10 | −49.274 | −25.726 | 110.487 | 1.00 | 26.27 | N |
| ATOM | 1703 | CA | THR | B | 10 | −48.056 | −26.118 | 111.179 | 1.00 | 27.02 | C |
| ATOM | 1704 | C | THR | B | 10 | −48.197 | −27.524 | 111.746 | 1.00 | 26.07 | C |
| ATOM | 1705 | O | THR | B | 10 | −49.251 | −27.890 | 112.264 | 1.00 | 30.58 | O |
| ATOM | 1706 | CB | THR | B | 10 | −47.725 | −25.143 | 112.310 | 1.00 | 26.29 | C |
| ATOM | 1707 | OG1 | THR | B | 10 | −47.699 | −23.812 | 111.789 | 1.00 | 30.87 | O |
| ATOM | 1708 | CG2 | THR | B | 10 | −46.368 | −25.480 | 112.929 | 1.00 | 18.58 | C |
| ATOM | 1709 | N | LEU | B | 11 | −47.117 | −28.296 | 111.669 | 1.00 | 28.05 | N |
| ATOM | 1710 | CA | LEU | B | 11 | −47.057 | −29.670 | 112.156 | 1.00 | 27.74 | C |
| ATOM | 1711 | C | LEU | B | 11 | −45.839 | −29.819 | 113.059 | 1.00 | 29.19 | C |
| ATOM | 1712 | O | LEU | B | 11 | −44.706 | −29.647 | 112.600 | 1.00 | 31.16 | O |
| ATOM | 1713 | CB | LEU | B | 11 | −46.954 | −30.632 | 110.978 | 1.00 | 33.49 | C |
| ATOM | 1714 | CG | LEU | B | 11 | −47.842 | −31.847 | 110.756 | 1.00 | 40.86 | C |
| ATOM | 1715 | CD1 | LEU | B | 11 | −47.188 | −32.642 | 109.625 | 1.00 | 33.69 | C |

TABLE 10.4-continued

| | | | | | | | | | | |
|---|---|---|---|---|---|---|---|---|---|---|
| ATOM | 1716 | CD2 | LEU | B | 11 | −47.976 | −32.687 | 112.003 | 1.00 | 34.11 | C |
| ATOM | 1717 | N | SER | B | 12 | −46.055 | −30.135 | 114.336 | 1.00 | 32.77 | N |
| ATOM | 1718 | CA | SER | B | 12 | −44.956 | −30.381 | 115.271 | 1.00 | 30.27 | C |
| ATOM | 1719 | C | SER | B | 12 | −44.851 | −31.873 | 115.562 | 1.00 | 30.86 | C |
| ATOM | 1720 | O | SER | B | 12 | −45.793 | −32.475 | 116.083 | 1.00 | 35.59 | O |
| ATOM | 1721 | CB | SER | B | 12 | −45.145 | −29.592 | 116.560 | 1.00 | 27.94 | C |
| ATOM | 1722 | OG | SER | B | 12 | −45.372 | −28.227 | 116.236 | 1.00 | 38.87 | O |
| ATOM | 1723 | N | LEU | B | 13 | −43.694 | −32.453 | 115.245 | 1.00 | 31.96 | N |
| ATOM | 1724 | CA | LEU | B | 13 | −43.453 | −33.887 | 115.299 | 1.00 | 32.10 | C |
| ATOM | 1725 | C | LEU | B | 13 | −42.010 | −34.098 | 115.707 | 1.00 | 30.66 | C |
| ATOM | 1726 | O | LEU | B | 13 | −41.159 | −33.231 | 115.489 | 1.00 | 31.40 | O |
| ATOM | 1727 | CB | LEU | B | 13 | −43.690 | −34.572 | 113.949 | 1.00 | 32.81 | C |
| ATOM | 1728 | CG | LEU | B | 13 | −45.087 | −34.460 | 113.332 | 1.00 | 34.52 | C |
| ATOM | 1729 | CD1 | LEU | B | 13 | −45.085 | −35.018 | 111.924 | 1.00 | 32.83 | C |
| ATOM | 1730 | CD2 | LEU | B | 13 | −46.110 | −35.164 | 114.189 | 1.00 | 26.42 | C |
| ATOM | 1731 | N | SER | B | 14 | −41.745 | −35.232 | 116.316 | 1.00 | 28.88 | N |
| ATOM | 1732 | CA | SER | B | 14 | −40.359 | −35.534 | 116.639 | 1.00 | 32.75 | C |
| ATOM | 1733 | C | SER | B | 14 | −39.649 | −36.161 | 115.442 | 1.00 | 28.56 | C |
| ATOM | 1734 | O | SER | B | 14 | −40.281 | −36.766 | 114.580 | 1.00 | 31.22 | O |
| ATOM | 1735 | CB | SER | B | 14 | −40.292 | −36.469 | 117.838 | 1.00 | 36.49 | C |
| ATOM | 1736 | OG | SER | B | 14 | −40.626 | −35.749 | 119.019 | 1.00 | 44.98 | O |
| ATOM | 1737 | N | PRO | B | 15 | −38.341 | −36.015 | 115.345 | 1.00 | 29.37 | N |
| ATOM | 1738 | CA | PRO | B | 15 | −37.609 | −36.799 | 114.341 | 1.00 | 28.36 | C |
| ATOM | 1739 | C | PRO | B | 15 | −37.846 | −38.290 | 114.566 | 1.00 | 33.54 | C |
| ATOM | 1740 | O | PRO | B | 15 | −37.877 | −38.770 | 115.702 | 1.00 | 39.74 | O |
| ATOM | 1741 | CB | PRO | B | 15 | −36.149 | −36.404 | 114.575 | 1.00 | 31.85 | C |
| ATOM | 1742 | CG | PRO | B | 15 | −36.230 | −35.042 | 115.265 | 1.00 | 27.05 | C |
| ATOM | 1743 | CD | PRO | B | 15 | −37.481 | −35.086 | 116.097 | 1.00 | 29.92 | C |
| ATOM | 1744 | N | GLY | B | 16 | −37.994 | −39.032 | 113.467 | 1.00 | 34.12 | N |
| ATOM | 1745 | CA | GLY | B | 16 | −38.362 | −40.428 | 113.500 | 1.00 | 30.27 | C |
| ATOM | 1746 | C | GLY | B | 16 | −39.837 | −40.693 | 113.284 | 1.00 | 32.66 | C |
| ATOM | 1747 | O | GLY | B | 16 | −40.204 | −41.796 | 112.862 | 1.00 | 38.35 | O |
| ATOM | 1748 | N | GLU | B | 17 | −40.690 | −39.722 | 113.549 | 1.00 | 28.58 | N |
| ATOM | 1749 | CA | GLU | B | 17 | −42.105 | −39.947 | 113.346 | 1.00 | 27.09 | C |
| ATOM | 1750 | C | GLU | B | 17 | −42.502 | −39.762 | 111.878 | 1.00 | 32.66 | C |
| ATOM | 1751 | O | GLU | B | 17 | −41.728 | −39.318 | 111.016 | 1.00 | 27.01 | O |
| ATOM | 1752 | CB | GLU | B | 17 | −42.923 | −39.013 | 114.220 | 1.00 | 26.44 | C |
| ATOM | 1753 | CG | GLU | B | 17 | −42.896 | −39.366 | 115.689 | 1.00 | 35.87 | C |
| ATOM | 1754 | CD | GLU | B | 17 | −43.872 | −38.506 | 116.494 | 1.00 | 50.33 | C |
| ATOM | 1755 | OE1 | GLU | B | 17 | −43.659 | −37.269 | 116.602 | 1.00 | 47.95 | O |
| ATOM | 1756 | OE2 | GLU | B | 17 | −44.862 | −39.066 | 117.011 | 1.00 | 67.19 | O1− |
| ATOM | 1757 | N | ARG | B | 18 | −43.757 | −40.098 | 111.626 | 1.00 | 28.24 | N |
| ATOM | 1758 | CA | ARG | B | 18 | −44.377 | −40.060 | 110.321 | 1.00 | 29.25 | C |
| ATOM | 1759 | C | ARG | B | 18 | −45.174 | −38.768 | 110.187 | 1.00 | 31.06 | C |
| ATOM | 1760 | O | ARG | B | 18 | −45.801 | −38.322 | 111.151 | 1.00 | 28.90 | O |
| ATOM | 1761 | CB | ARG | B | 18 | −45.273 | −41.278 | 110.169 | 1.00 | 28.93 | C |
| ATOM | 1762 | CG | ARG | B | 18 | −46.000 | −41.420 | 108.875 | 1.00 | 35.84 | C |
| ATOM | 1763 | CD | ARG | B | 18 | −46.955 | −42.591 | 109.004 | 1.00 | 33.74 | C |
| ATOM | 1764 | NE | ARG | B | 18 | −47.724 | −42.806 | 107.792 | 1.00 | 42.81 | N |
| ATOM | 1765 | CZ | ARG | B | 18 | −47.249 | −43.450 | 106.731 | 1.00 | 49.16 | C |
| ATOM | 1766 | NH1 | ARG | B | 18 | −45.993 | −43.927 | 106.747 | 1.00 | 44.51 | N1+ |
| ATOM | 1767 | NH2 | ARG | B | 18 | −48.021 | −43.606 | 105.656 | 1.00 | 37.48 | N |
| ATOM | 1768 | N | ALA | B | 19 | −45.104 | −38.148 | 109.001 | 1.00 | 30.81 | N |
| ATOM | 1769 | CA | ALA | B | 19 | −45.764 | −36.880 | 108.699 | 1.00 | 27.46 | C |
| ATOM | 1770 | C | ALA | B | 19 | −46.674 | −37.020 | 107.488 | 1.00 | 27.67 | C |
| ATOM | 1771 | O | ALA | B | 19 | −46.284 | −37.594 | 106.466 | 1.00 | 29.51 | O |
| ATOM | 1772 | CB | ALA | B | 19 | −44.745 | −35.775 | 108.431 | 1.00 | 26.69 | C |
| ATOM | 1773 | N | THR | B | 20 | −47.863 | −36.437 | 107.576 | 1.00 | 23.65 | N |
| ATOM | 1774 | CA | THR | B | 20 | −48.833 | −36.478 | 106.489 | 1.00 | 28.01 | C |
| ATOM | 1775 | C | THR | B | 20 | −49.374 | −35.076 | 106.258 | 1.00 | 29.74 | C |
| ATOM | 1776 | O | THR | B | 20 | −49.974 | −34.477 | 107.155 | 1.00 | 31.62 | O |
| ATOM | 1777 | CB | THR | B | 20 | −49.966 | −37.477 | 106.791 | 1.00 | 31.91 | C |
| ATOM | 1778 | OG1 | THR | B | 20 | −49.516 | −38.802 | 106.486 | 1.00 | 38.10 | O |
| ATOM | 1779 | CG2 | THR | B | 20 | −51.212 | −37.192 | 105.973 | 1.00 | 31.11 | C |
| ATOM | 1780 | N | LEU | B | 21 | −49.163 | −34.561 | 105.054 | 1.00 | 28.91 | N |
| ATOM | 1781 | CA | LEU | B | 21 | −49.541 | −33.209 | 104.693 | 1.00 | 27.86 | C |
| ATOM | 1782 | C | LEU | B | 21 | −50.689 | −33.322 | 103.711 | 1.00 | 27.21 | C |
| ATOM | 1783 | O | LEU | B | 21 | −50.742 | −34.261 | 102.921 | 1.00 | 27.15 | O |
| ATOM | 1784 | CB | LEU | B | 21 | −48.377 | −32.459 | 104.031 | 1.00 | 24.41 | C |
| ATOM | 1785 | CG | LEU | B | 21 | −46.975 | −32.345 | 104.643 | 1.00 | 26.45 | C |
| ATOM | 1786 | CD1 | LEU | B | 21 | −46.405 | −30.957 | 104.460 | 1.00 | 27.98 | C |
| ATOM | 1787 | CD2 | LEU | B | 21 | −46.871 | −32.762 | 106.081 | 1.00 | 28.98 | C |
| ATOM | 1788 | N | SER | B | 22 | −51.620 | −32.390 | 103.764 | 1.00 | 27.44 | N |
| ATOM | 1789 | CA | SER | B | 22 | −52.739 | −32.439 | 102.843 | 1.00 | 27.56 | C |
| ATOM | 1790 | C | SER | B | 22 | −52.718 | −31.231 | 101.926 | 1.00 | 29.41 | C |
| ATOM | 1791 | O | SER | B | 22 | −52.281 | −30.148 | 102.321 | 1.00 | 23.55 | O |
| ATOM | 1792 | CB | SER | B | 22 | −54.067 | −32.506 | 103.571 | 1.00 | 22.71 | C |
| ATOM | 1793 | OG | SER | B | 22 | −54.374 | −33.869 | 103.733 | 1.00 | 40.86 | O |
| ATOM | 1794 | N | CYS | B | 23 | −53.188 | −31.445 | 100.693 | 1.00 | 24.46 | N |
| ATOM | 1795 | CA | CYS | B | 23 | −53.456 | −30.379 | 99.735 | 1.00 | 26.64 | C |

TABLE 10.4-continued

| | | | | | | | | | | |
|---|---|---|---|---|---|---|---|---|---|---|
| ATOM | 1796 | C | CYS | B | 23 | −54.824 | −30.660 | 99.146 | 1.00 | 26.09 | C |
| ATOM | 1797 | O | CYS | B | 23 | −55.034 | −31.718 | 98.547 | 1.00 | 30.05 | O |
| ATOM | 1798 | CB | CYS | B | 23 | −52.392 | −30.330 | 98.623 | 1.00 | 29.42 | C |
| ATOM | 1799 | SG | CYS | B | 23 | −52.509 | −28.931 | 97.438 | 1.00 | 45.36 | S |
| ATOM | 1800 | N | ARG | B | 24 | −55.756 | −29.740 | 99.326 | 1.00 | 26.38 | N |
| ATOM | 1801 | CA | ARG | B | 24 | −57.084 | −29.874 | 98.762 | 1.00 | 25.14 | C |
| ATOM | 1802 | C | ARG | B | 24 | −57.249 | −28.870 | 97.633 | 1.00 | 27.66 | C |
| ATOM | 1803 | O | ARG | B | 24 | −56.984 | −27.677 | 97.815 | 1.00 | 27.74 | O |
| ATOM | 1804 | CB | ARG | B | 24 | −58.151 | −29.702 | 99.834 | 1.00 | 25.05 | C |
| ATOM | 1805 | CG | ARG | B | 24 | −58.148 | −30.888 | 100.781 | 1.00 | 39.63 | C |
| ATOM | 1806 | CD | ARG | B | 24 | −58.919 | −30.636 | 102.071 | 1.00 | 56.87 | C |
| ATOM | 1807 | NE | ARG | B | 24 | −60.337 | −30.971 | 101.921 | 1.00 | 70.81 | N |
| ATOM | 1808 | CZ | ARG | B | 24 | −60.899 | −32.091 | 102.373 | 1.00 | 75.66 | C |
| ATOM | 1809 | NH1 | ARG | B | 24 | −60.156 | −32.994 | 103.017 | 1.00 | 74.34 | N1+ |
| ATOM | 1810 | NH2 | ARG | B | 24 | −62.204 | −32.303 | 102.187 | 1.00 | 69.31 | N |
| ATOM | 1811 | N | ALA | B | 25 | −57.657 | −29.371 | 96.465 | 1.00 | 25.97 | N |
| ATOM | 1812 | CA | ALA | B | 25 | −57.809 | −28.586 | 95.252 | 1.00 | 24.73 | C |
| ATOM | 1813 | C | ALA | B | 25 | −59.271 | −28.236 | 95.024 | 1.00 | 25.92 | C |
| ATOM | 1814 | O | ALA | B | 25 | −60.147 | −29.102 | 95.093 | 1.00 | 27.92 | O |
| ATOM | 1815 | CB | ALA | B | 25 | −57.263 | −29.344 | 94.042 | 1.00 | 25.78 | C |
| ATOM | 1816 | N | SER | B | 26 | −59.524 | −26.969 | 94.744 | 1.00 | 28.48 | N |
| ATOM | 1817 | CA | SER | B | 26 | −60.840 | −26.517 | 94.342 | 1.00 | 26.13 | C |
| ATOM | 1818 | C | SER | B | 26 | −60.758 | −25.481 | 93.190 | 1.00 | 29.42 | C |
| ATOM | 1819 | O | SER | B | 26 | −60.242 | −24.370 | 93.373 | 1.00 | 30.69 | O |
| ATOM | 1820 | CB | SER | B | 26 | −61.562 | −25.932 | 95.549 | 1.00 | 24.33 | C |
| ATOM | 1821 | OG | SER | B | 26 | −62.823 | −25.420 | 95.178 | 1.00 | 39.40 | O |
| ATOM | 1822 | N | PRO | B | 27 | −61.248 | −25.837 | 91.994 | 1.00 | 27.29 | N |
| ATOM | 1823 | CA | PRO | B | 27 | −61.824 | −27.118 | 91.541 | 1.00 | 25.37 | C |
| ATOM | 1824 | C | PRO | B | 27 | −60.819 | −28.258 | 91.496 | 1.00 | 27.72 | C |
| ATOM | 1825 | O | PRO | B | 27 | −59.639 | −28.025 | 91.702 | 1.00 | 28.26 | O |
| ATOM | 1826 | CB | PRO | B | 27 | −62.331 | −26.806 | 90.123 | 1.00 | 22.36 | C |
| ATOM | 1827 | CG | PRO | B | 27 | −61.831 | −25.420 | 89.788 | 1.00 | 21.74 | C |
| ATOM | 1828 | CD | PRO | B | 27 | −61.584 | −24.724 | 91.085 | 1.00 | 22.47 | C |
| ATOM | 1829 | N | SER | B | 28 | −61.284 | −29.468 | 91.201 | 1.00 | 29.06 | N |
| ATOM | 1830 | CA | SER | B | 28 | −60.424 | −30.643 | 91.235 | 1.00 | 29.98 | C |
| ATOM | 1831 | C | SER | B | 28 | −59.291 | −30.567 | 90.206 | 1.00 | 31.92 | C |
| ATOM | 1832 | O | SER | B | 28 | −59.390 | −29.898 | 89.174 | 1.00 | 33.40 | O |
| ATOM | 1833 | CB | SER | B | 28 | −61.256 | −31.892 | 90.993 | 1.00 | 30.66 | C |
| ATOM | 1834 | OG | SER | B | 28 | −62.051 | −32.132 | 92.124 | 1.00 | 36.68 | O |
| ATOM | 1835 | N | VAL | B | 29 | −58.219 | −31.314 | 90.488 | 1.00 | 29.10 | N |
| ATOM | 1836 | CA | VAL | B | 29 | −57.081 | −31.501 | 89.588 | 1.00 | 27.86 | C |
| ATOM | 1837 | C | VAL | B | 29 | −57.110 | −32.960 | 89.140 | 1.00 | 34.14 | C |
| ATOM | 1838 | O | VAL | B | 29 | −56.339 | −33.796 | 89.630 | 1.00 | 31.49 | O |
| ATOM | 1839 | CB | VAL | B | 29 | −55.739 | −31.126 | 90.270 | 1.00 | 26.93 | C |
| ATOM | 1840 | CG1 | VAL | B | 29 | −54.536 | −31.343 | 89.352 | 1.00 | 31.84 | C |
| ATOM | 1841 | CG2 | VAL | B | 29 | −55.741 | −29.679 | 90.699 | 1.00 | 27.83 | C |
| ATOM | 1842 | N | ASN | B | 30 | −58.040 | −33.287 | 88.234 | 1.00 | 37.48 | N |
| ATOM | 1843 | CA | ASN | B | 30 | −58.225 | −34.670 | 87.784 | 1.00 | 33.93 | C |
| ATOM | 1844 | C | ASN | B | 30 | −57.128 | −35.163 | 86.860 | 1.00 | 28.81 | C |
| ATOM | 1845 | O | ASN | B | 30 | −57.130 | −36.351 | 86.526 | 1.00 | 35.16 | O |
| ATOM | 1846 | CB | ASN | B | 30 | −59.573 | −34.847 | 87.088 | 1.00 | 30.66 | C |
| ATOM | 1847 | CG | ASN | B | 30 | −60.750 | −34.648 | 88.034 | 1.00 | 32.10 | C |
| ATOM | 1848 | OD1 | ASN | B | 30 | −60.735 | −35.110 | 89.179 | 1.00 | 36.69 | O |
| ATOM | 1849 | ND2 | ASN | B | 30 | −61.763 | −33.952 | 87.564 | 1.00 | 29.33 | N |
| ATOM | 1850 | N | SER | B | 31 | −56.223 | −34.293 | 86.406 | 1.00 | 30.18 | N |
| ATOM | 1851 | CA | SER | B | 31 | −55.082 | −34.759 | 85.625 | 1.00 | 28.46 | C |
| ATOM | 1852 | C | SER | B | 31 | −54.004 | −35.394 | 86.484 | 1.00 | 30.09 | C |
| ATOM | 1853 | O | SER | B | 31 | −53.192 | −36.163 | 85.956 | 1.00 | 25.87 | O |
| ATOM | 1854 | CB | SER | B | 31 | −54.464 | −33.608 | 84.839 | 1.00 | 28.04 | C |
| ATOM | 1855 | OG | SER | B | 31 | −54.110 | −32.544 | 85.699 | 1.00 | 28.97 | O |
| ATOM | 1856 | N | GLY | B | 32 | −54.026 | −35.129 | 87.797 | 1.00 | 30.79 | N |
| ATOM | 1857 | CA | GLY | B | 32 | −52.930 | −35.453 | 88.685 | 1.00 | 23.28 | C |
| ATOM | 1858 | C | GLY | B | 32 | −51.708 | −34.581 | 88.501 | 1.00 | 25.51 | C |
| ATOM | 1859 | O | GLY | B | 32 | −50.636 | −34.931 | 88.982 | 1.00 | 24.92 | O |
| ATOM | 1860 | N | TYR | B | 33 | −51.838 | −33.436 | 87.830 | 1.00 | 25.51 | N |
| ATOM | 1861 | CA | TYR | B | 33 | −50.697 | −32.549 | 87.607 | 1.00 | 22.85 | C |
| ATOM | 1862 | C | TYR | B | 33 | −50.468 | −31.718 | 88.875 | 1.00 | 28.41 | C |
| ATOM | 1863 | O | TYR | B | 33 | −50.739 | −30.514 | 88.938 | 1.00 | 24.46 | O |
| ATOM | 1864 | CB | TYR | B | 33 | −50.934 | −31.657 | 86.394 | 1.00 | 25.72 | C |
| ATOM | 1865 | CG | TYR | B | 33 | −50.986 | −32.351 | 85.031 | 1.00 | 27.40 | C |
| ATOM | 1866 | CD1 | TYR | B | 33 | −50.607 | −33.684 | 84.869 | 1.00 | 25.12 | C |
| ATOM | 1867 | CD2 | TYR | B | 33 | −51.398 | −31.651 | 83.901 | 1.00 | 25.37 | C |
| ATOM | 1868 | CE1 | TYR | B | 33 | −50.659 | −34.306 | 83.618 | 1.00 | 27.61 | C |
| ATOM | 1869 | CE2 | TYR | B | 33 | −51.443 | −32.256 | 82.647 | 1.00 | 28.75 | C |
| ATOM | 1870 | CZ | TYR | B | 33 | −51.073 | −33.582 | 82.505 | 1.00 | 31.43 | C |
| ATOM | 1871 | OH | TYR | B | 33 | −51.108 | −34.164 | 81.251 | 1.00 | 25.68 | O |
| ATOM | 1872 | N | LEU | B | 34 | −49.964 | −32.400 | 89.908 | 1.00 | 26.49 | N |
| ATOM | 1873 | CA | LEU | B | 34 | −49.740 | −31.801 | 91.217 | 1.00 | 25.62 | C |
| ATOM | 1874 | C | LEU | B | 34 | −48.316 | −32.075 | 91.697 | 1.00 | 25.75 | C |
| ATOM | 1875 | O | LEU | B | 34 | −47.893 | −33.228 | 91.789 | 1.00 | 27.99 | O |

TABLE 10.4-continued

| | | | | | | | | | | |
|---|---|---|---|---|---|---|---|---|---|---|
| ATOM | 1876 | CB | LEU | B | 34 | −50.742 | −32.328 | 92.239 | 1.00 | 25.15 | C |
| ATOM | 1877 | CG | LEU | B | 34 | −50.732 | −31.388 | 93.436 | 1.00 | 22.33 | C |
| ATOM | 1878 | CD1 | LEU | B | 34 | −52.055 | −30.748 | 93.532 | 1.00 | 24.71 | C |
| ATOM | 1879 | CD2 | LEU | B | 34 | −50.401 | −32.127 | 94.682 | 1.00 | 22.19 | C |
| ATOM | 1880 | N | ALA | B | 35 | −47.595 | −31.021 | 92.035 | 1.00 | 26.54 | N |
| ATOM | 1881 | CA | ALA | B | 35 | −46.221 | −31.114 | 92.497 | 1.00 | 27.18 | C |
| ATOM | 1882 | C | ALA | B | 35 | −46.154 | −30.759 | 93.973 | 1.00 | 25.51 | C |
| ATOM | 1883 | O | ALA | B | 35 | −47.050 | −30.117 | 94.516 | 1.00 | 24.44 | O |
| ATOM | 1884 | CB | ALA | B | 35 | −45.293 | −30.186 | 91.706 | 1.00 | 20.44 | C |
| ATOM | 1885 | N | TRP | B | 36 | −45.088 | −31.214 | 94.621 | 1.00 | 23.22 | N |
| ATOM | 1886 | CA | TRP | B | 36 | −44.790 | −30.852 | 95.995 | 1.00 | 26.05 | C |
| ATOM | 1887 | C | TRP | B | 36 | −43.368 | −30.316 | 96.037 | 1.00 | 25.42 | C |
| ATOM | 1888 | O | TRP | B | 36 | −42.462 | −30.896 | 95.429 | 1.00 | 26.45 | O |
| ATOM | 1889 | CB | TRP | B | 36 | −44.935 | −32.050 | 96.966 | 1.00 | 23.50 | C |
| ATOM | 1890 | CG | TRP | B | 36 | −46.328 | −32.470 | 97.286 | 1.00 | 23.73 | C |
| ATOM | 1891 | CD1 | TRP | B | 36 | −47.071 | −33.413 | 96.633 | 1.00 | 26.66 | C |
| ATOM | 1892 | CD2 | TRP | B | 36 | −47.144 | −32.006 | 98.375 | 1.00 | 28.12 | C |
| ATOM | 1893 | NE1 | TRP | B | 36 | −48.304 | −33.549 | 97.229 | 1.00 | 24.58 | N |
| ATOM | 1894 | CE2 | TRP | B | 36 | −48.374 | −32.709 | 98.306 | 1.00 | 26.57 | C |
| ATOM | 1895 | CE3 | TRP | B | 36 | −46.951 | −31.079 | 99.407 | 1.00 | 20.21 | C |
| ATOM | 1896 | CZ2 | TRP | B | 36 | −49.407 | −32.506 | 99.222 | 1.00 | 22.88 | C |
| ATOM | 1897 | CZ3 | TRP | B | 36 | −47.970 | −30.872 | 100.294 | 1.00 | 23.52 | C |
| ATOM | 1898 | CH2 | TRP | B | 36 | −49.190 | −31.584 | 100.203 | 1.00 | 24.77 | C |
| ATOM | 1899 | N | TYR | B | 37 | −43.173 | −29.219 | 96.764 | 1.00 | 25.12 | N |
| ATOM | 1900 | CA | TYR | B | 37 | −41.858 | −28.628 | 96.947 | 1.00 | 23.85 | C |
| ATOM | 1901 | C | TYR | B | 37 | −41.551 | −28.525 | 98.427 | 1.00 | 27.32 | C |
| ATOM | 1902 | O | TYR | B | 37 | −42.446 | −28.279 | 99.247 | 1.00 | 28.76 | O |
| ATOM | 1903 | CB | TYR | B | 37 | −41.764 | −27.229 | 96.341 | 1.00 | 25.99 | C |
| ATOM | 1904 | CG | TYR | B | 37 | −42.052 | −27.217 | 94.879 | 1.00 | 25.68 | C |
| ATOM | 1905 | CD2 | TYR | B | 37 | −41.025 | −27.346 | 93.944 | 1.00 | 27.12 | C |
| ATOM | 1906 | CD1 | TYR | B | 37 | −43.346 | −27.106 | 94.426 | 1.00 | 20.71 | C |
| ATOM | 1907 | CE2 | TYR | B | 37 | −41.296 | −27.349 | 92.584 | 1.00 | 23.06 | C |
| ATOM | 1908 | CE1 | TYR | B | 37 | −43.622 | −27.112 | 93.088 | 1.00 | 25.67 | C |
| ATOM | 1909 | CZ | TYR | B | 37 | −42.598 | −27.241 | 92.170 | 1.00 | 22.19 | C |
| ATOM | 1910 | OH | TYR | B | 37 | −42.911 | −27.244 | 90.831 | 1.00 | 28.45 | O |
| ATOM | 1911 | N | GLN | B | 38 | −40.267 | −28.679 | 98.742 | 1.00 | 24.78 | N |
| ATOM | 1912 | CA | GLN | B | 38 | −39.708 | −28.428 | 100.061 | 1.00 | 26.12 | C |
| ATOM | 1913 | C | GLN | B | 38 | −38.871 | −27.147 | 100.017 | 1.00 | 23.99 | C |
| ATOM | 1914 | O | GLN | B | 38 | −38.168 | −26.890 | 99.034 | 1.00 | 22.68 | O |
| ATOM | 1915 | CB | GLN | B | 38 | −38.852 | −29.619 | 100.509 | 1.00 | 24.24 | C |
| ATOM | 1916 | CG | GLN | B | 38 | −38.144 | −29.399 | 101.826 | 1.00 | 22.10 | C |
| ATOM | 1917 | CD | GLN | B | 38 | −37.108 | −30.460 | 102.113 | 1.00 | 26.91 | C |
| ATOM | 1918 | OE1 | GLN | B | 38 | −36.023 | −30.439 | 101.532 | 1.00 | 33.75 | O |
| ATOM | 1919 | NE2 | GLN | B | 38 | −37.418 | −31.376 | 103.032 | 1.00 | 24.91 | N |
| ATOM | 1920 | N | GLN | B | 39 | −38.944 | −26.339 | 101.072 | 1.00 | 19.06 | N |
| ATOM | 1921 | CA | GLN | B | 39 | −38.193 | −25.085 | 101.113 | 1.00 | 24.00 | C |
| ATOM | 1922 | C | GLN | B | 39 | −37.632 | −24.846 | 102.498 | 1.00 | 23.43 | C |
| ATOM | 1923 | O | GLN | B | 39 | −38.389 | −24.722 | 103.462 | 1.00 | 21.25 | O |
| ATOM | 1924 | CB | GLN | B | 39 | −39.043 | −23.881 | 100.719 | 1.00 | 25.47 | C |
| ATOM | 1925 | CG | GLN | B | 39 | −38.226 | −22.610 | 100.620 | 1.00 | 25.34 | C |
| ATOM | 1926 | CD | GLN | B | 39 | −39.027 | −21.423 | 100.161 | 1.00 | 31.02 | C |
| ATOM | 1927 | OE1 | GLN | B | 39 | −40.183 | −21.244 | 100.538 | 1.00 | 34.04 | O |
| ATOM | 1928 | NE2 | GLN | B | 39 | −38.418 | −20.601 | 99.334 | 1.00 | 33.16 | N |
| ATOM | 1929 | N | LYS | B | 40 | −36.319 | −24.712 | 102.575 | 1.00 | 25.20 | N |
| ATOM | 1930 | CA | LYS | B | 40 | −35.694 | −24.322 | 103.822 | 1.00 | 25.84 | C |
| ATOM | 1931 | C | LYS | B | 40 | −35.497 | −22.813 | 103.870 | 1.00 | 27.20 | C |
| ATOM | 1932 | O | LYS | B | 40 | −35.478 | −22.145 | 102.827 | 1.00 | 26.37 | O |
| ATOM | 1933 | CB | LYS | B | 40 | −34.382 | −25.077 | 103.991 | 1.00 | 27.92 | C |
| ATOM | 1934 | CG | LYS | B | 40 | −34.624 | −26.487 | 104.544 | 1.00 | 30.32 | C |
| ATOM | 1935 | CD | LYS | B | 40 | −33.459 | −27.416 | 104.259 | 1.00 | 42.40 | C |
| ATOM | 1936 | CE | LYS | B | 40 | −33.761 | −28.834 | 104.704 | 1.00 | 39.36 | C |
| ATOM | 1937 | NZ | LYS | B | 40 | −33.984 | −28.911 | 106.185 | 1.00 | 42.39 | N1+ |
| ATOM | 1938 | N | PRO | B | 41 | −35.419 | −22.231 | 105.072 | 1.00 | 28.86 | N |
| ATOM | 1939 | CA | PRO | B | 41 | −35.467 | −20.757 | 105.192 | 1.00 | 27.65 | C |
| ATOM | 1940 | C | PRO | B | 41 | −34.345 | −20.077 | 104.416 | 1.00 | 27.79 | C |
| ATOM | 1941 | O | PRO | B | 41 | −33.168 | −20.420 | 104.558 | 1.00 | 30.55 | O |
| ATOM | 1942 | CB | PRO | B | 41 | −35.331 | −20.523 | 106.701 | 1.00 | 25.62 | C |
| ATOM | 1943 | CG | PRO | B | 41 | −35.861 | −21.785 | 107.321 | 1.00 | 23.53 | C |
| ATOM | 1944 | CD | PRO | B | 41 | −35.415 | −22.885 | 106.393 | 1.00 | 22.03 | C |
| ATOM | 1945 | N | GLY | B | 42 | −34.724 | −19.113 | 103.577 | 1.00 | 30.24 | N |
| ATOM | 1946 | CA | GLY | B | 42 | −33.743 | −18.444 | 102.750 | 1.00 | 26.94 | C |
| ATOM | 1947 | C | GLY | B | 42 | −33.131 | −19.294 | 101.657 | 1.00 | 34.34 | C |
| ATOM | 1948 | O | GLY | B | 42 | −32.033 | −18.976 | 101.191 | 1.00 | 29.82 | O |
| ATOM | 1949 | N | GLN | B | 43 | −33.790 | −20.388 | 101.254 | 1.00 | 29.49 | N |
| ATOM | 1950 | CA | GLN | B | 43 | −33.330 | −21.236 | 100.164 | 1.00 | 29.08 | C |
| ATOM | 1951 | C | GLN | B | 43 | −34.400 | −21.299 | 99.086 | 1.00 | 26.57 | C |
| ATOM | 1952 | O | GLN | B | 43 | −35.578 | −21.019 | 99.329 | 1.00 | 28.43 | O |
| ATOM | 1953 | CB | GLN | B | 43 | −32.994 | −22.665 | 100.622 | 1.00 | 33.38 | C |
| ATOM | 1954 | CG | GLN | B | 43 | −32.182 | −22.796 | 101.894 | 1.00 | 31.30 | C |
| ATOM | 1955 | CD | GLN | B | 43 | −30.769 | −22.262 | 101.737 | 1.00 | 45.21 | C |

TABLE 10.4-continued

| | | | | | | | | | | | |
|---|---|---|---|---|---|---|---|---|---|---|---|
| ATOM | 1956 | OE1 | GLN | B | 43 | −30.173 | −22.361 | 100.665 | 1.00 | 48.17 | O |
| ATOM | 1957 | NE2 | GLN | B | 43 | −30.215 | −21.713 | 102.818 | 1.00 | 50.07 | N |
| ATOM | 1958 | N | THR | B | 44 | −33.988 | −21.698 | 97.895 | 1.00 | 28.06 | N |
| ATOM | 1959 | CA | THR | B | 44 | −34.976 | −21.828 | 96.832 | 1.00 | 32.50 | C |
| ATOM | 1960 | C | THR | B | 44 | −35.755 | −23.142 | 97.000 | 1.00 | 29.43 | C |
| ATOM | 1961 | O | THR | B | 44 | −35.282 | −24.077 | 97.652 | 1.00 | 28.21 | O |
| ATOM | 1962 | CB | THR | B | 44 | −34.303 | −21.769 | 95.453 | 1.00 | 28.68 | C |
| ATOM | 1963 | OG1 | THR | B | 44 | −33.844 | −23.064 | 95.087 | 1.00 | 33.54 | O |
| ATOM | 1964 | CG2 | THR | B | 44 | −33.095 | −20.847 | 95.473 | 1.00 | 35.23 | C |
| ATOM | 1965 | N | PRO | B | 45 | −36.982 | −23.217 | 96.495 | 1.00 | 29.94 | N |
| ATOM | 1966 | CA | PRO | B | 45 | −37.745 | −24.456 | 96.658 | 1.00 | 27.80 | C |
| ATOM | 1967 | C | PRO | B | 45 | −37.021 | −25.614 | 95.982 | 1.00 | 24.29 | C |
| ATOM | 1968 | O | PRO | B | 45 | −36.256 | −25.428 | 95.042 | 1.00 | 28.45 | O |
| ATOM | 1969 | CB | PRO | B | 45 | −39.079 | −24.140 | 95.967 | 1.00 | 26.59 | C |
| ATOM | 1970 | CG | PRO | B | 45 | −39.175 | −22.670 | 95.983 | 1.00 | 23.14 | C |
| ATOM | 1971 | CD | PRO | B | 45 | −37.774 | −22.177 | 95.813 | 1.00 | 27.43 | C |
| ATOM | 1972 | N | ARG | B | 46 | −37.249 | −26.817 | 96.485 | 1.00 | 24.84 | N |
| ATOM | 1973 | CA | ARG | B | 46 | −36.741 | −28.036 | 95.863 | 1.00 | 27.05 | C |
| ATOM | 1974 | C | ARG | B | 46 | −37.920 | −28.935 | 95.516 | 1.00 | 28.13 | C |
| ATOM | 1975 | O | ARG | B | 46 | −38.743 | −29.258 | 96.385 | 1.00 | 27.30 | O |
| ATOM | 1976 | CB | ARG | B | 46 | −35.754 | −28.763 | 96.782 | 1.00 | 27.57 | C |
| ATOM | 1977 | CG | ARG | B | 46 | −35.323 | −30.144 | 96.305 | 1.00 | 35.27 | C |
| ATOM | 1978 | CD | ARG | B | 46 | −34.354 | −30.799 | 97.302 | 1.00 | 42.68 | C |
| ATOM | 1979 | NE | ARG | B | 46 | −33.035 | −30.146 | 97.316 | 1.00 | 59.78 | N |
| ATOM | 1980 | CZ | ARG | B | 46 | −32.623 | −29.218 | 98.197 | 1.00 | 64.38 | C |
| ATOM | 1981 | NH1 | ARG | B | 46 | −33.408 | −28.780 | 99.199 | 1.00 | 56.48 | N1+ |
| ATOM | 1982 | NH2 | ARG | B | 46 | −31.399 | −28.715 | 98.076 | 1.00 | 61.89 | N |
| ATOM | 1983 | N | LEU | B | 47 | −38.007 | −29.318 | 94.244 | 1.00 | 28.50 | N |
| ATOM | 1984 | CA | LEU | B | 47 | −39.058 | −30.216 | 93.781 | 1.00 | 25.28 | C |
| ATOM | 1985 | C | LEU | B | 47 | −38.930 | −31.576 | 94.455 | 1.00 | 25.95 | C |
| ATOM | 1986 | O | LEU | B | 47 | −37.851 | −32.175 | 94.457 | 1.00 | 30.65 | O |
| ATOM | 1987 | CB | LEU | B | 47 | −38.970 | −30.365 | 92.262 | 1.00 | 27.11 | C |
| ATOM | 1988 | CG | LEU | B | 47 | −39.935 | −31.368 | 91.643 | 1.00 | 27.81 | C |
| ATOM | 1989 | CD1 | LEU | B | 47 | −41.357 | −30.870 | 91.856 | 1.00 | 21.28 | C |
| ATOM | 1990 | CD2 | LEU | B | 47 | −39.622 | −31.533 | 90.175 | 1.00 | 24.15 | C |
| ATOM | 1991 | N | LEU | B | 48 | −40.027 | −32.055 | 95.040 | 1.00 | 22.73 | N |
| ATOM | 1992 | CA | LEU | B | 48 | −40.056 | −33.353 | 95.715 | 1.00 | 28.05 | C |
| ATOM | 1993 | C | LEU | B | 48 | −40.844 | −34.397 | 94.953 | 1.00 | 30.46 | C |
| ATOM | 1994 | O | LEU | B | 48 | −40.406 | −35.548 | 94.862 | 1.00 | 28.89 | O |
| ATOM | 1995 | CB | LEU | B | 48 | −40.685 | −33.237 | 97.112 | 1.00 | 29.74 | C |
| ATOM | 1996 | CG | LEU | B | 48 | −40.032 | −32.529 | 98.287 | 1.00 | 28.54 | C |
| ATOM | 1997 | CD1 | LEU | B | 48 | −40.954 | −32.632 | 99.462 | 1.00 | 25.93 | C |
| ATOM | 1998 | CD2 | LEU | B | 48 | −38.712 | −33.198 | 98.616 | 1.00 | 30.43 | C |
| ATOM | 1999 | N | ILE | B | 49 | −42.012 | −33.999 | 94.435 | 1.00 | 26.40 | N |
| ATOM | 2000 | CA | ILE | B | 49 | −42.988 | −34.879 | 93.804 | 1.00 | 26.75 | C |
| ATOM | 2001 | C | ILE | B | 49 | −43.560 | −34.161 | 92.594 | 1.00 | 24.70 | C |
| ATOM | 2002 | O | ILE | B | 49 | −43.809 | −32.958 | 92.648 | 1.00 | 22.99 | O |
| ATOM | 2003 | CB | ILE | B | 49 | −44.129 | −35.264 | 94.780 | 1.00 | 26.52 | C |
| ATOM | 2004 | CG1 | ILE | B | 49 | −43.583 | −35.980 | 96.018 | 1.00 | 21.26 | C |
| ATOM | 2005 | CG2 | ILE | B | 49 | −45.215 | −36.049 | 94.058 | 1.00 | 20.52 | C |
| ATOM | 2006 | CD1 | ILE | B | 49 | −43.212 | −37.429 | 95.770 | 1.00 | 22.03 | C |
| ATOM | 2007 | N | PHE | B | 50 | −43.749 | −34.888 | 91.491 | 1.00 | 26.33 | N |
| ATOM | 2008 | CA | PHE | B | 50 | −44.548 | −34.395 | 90.375 | 1.00 | 26.42 | C |
| ATOM | 2009 | C | PHE | B | 50 | −45.564 | −35.460 | 89.959 | 1.00 | 30.44 | C |
| ATOM | 2010 | O | PHE | B | 50 | −45.467 | −36.634 | 90.342 | 1.00 | 27.91 | O |
| ATOM | 2011 | CB | PHE | B | 50 | −43.678 | −33.982 | 89.184 | 1.00 | 21.93 | C |
| ATOM | 2012 | CG | PHE | B | 50 | −42.877 | −35.114 | 88.610 | 1.00 | 30.11 | C |
| ATOM | 2013 | CD1 | PHE | B | 50 | −43.407 | −35.919 | 87.609 | 1.00 | 27.24 | C |
| ATOM | 2014 | CD2 | PHE | B | 50 | −41.599 | −35.383 | 89.079 | 1.00 | 28.83 | C |
| ATOM | 2015 | CE1 | PHE | B | 50 | −42.682 | −36.965 | 87.085 | 1.00 | 34.14 | C |
| ATOM | 2016 | CE2 | PHE | B | 50 | −40.865 | −36.430 | 88.547 | 1.00 | 34.66 | C |
| ATOM | 2017 | CZ | PHE | B | 50 | −41.409 | −37.230 | 87.553 | 1.00 | 31.45 | C |
| ATOM | 2018 | N | GLY | B | 51 | −46.579 | −35.022 | 89.216 | 1.00 | 29.06 | N |
| ATOM | 2019 | CA | GLY | B | 51 | −47.640 | −35.920 | 88.790 | 1.00 | 23.55 | C |
| ATOM | 2020 | C | GLY | B | 51 | −48.357 | −36.601 | 89.926 | 1.00 | 28.78 | C |
| ATOM | 2021 | O | GLY | B | 51 | −48.771 | −37.758 | 89.789 | 1.00 | 31.77 | O |
| ATOM | 2022 | N | ALA | B | 52 | −48.497 | −35.913 | 91.057 | 1.00 | 27.54 | N |
| ATOM | 2023 | CA | ALA | B | 52 | −49.180 | −36.389 | 92.253 | 1.00 | 27.65 | C |
| ATOM | 2024 | C | ALA | B | 52 | −48.403 | −37.468 | 92.995 | 1.00 | 27.89 | C |
| ATOM | 2025 | O | ALA | B | 52 | −48.422 | −37.465 | 94.231 | 1.00 | 25.68 | O |
| ATOM | 2026 | CB | ALA | B | 52 | −50.589 | −36.907 | 91.927 | 1.00 | 24.96 | C |
| ATOM | 2027 | N | SER | B | 53 | −47.679 | −38.358 | 92.289 | 1.00 | 24.53 | N |
| ATOM | 2028 | CA | SER | B | 53 | −47.036 | −39.468 | 93.002 | 1.00 | 27.35 | C |
| ATOM | 2029 | C | SER | B | 53 | −45.606 | −39.792 | 92.588 | 1.00 | 30.40 | C |
| ATOM | 2030 | O | SER | B | 53 | −44.970 | −40.616 | 93.257 | 1.00 | 31.18 | O |
| ATOM | 2031 | CB | SER | B | 53 | −47.855 | −40.745 | 92.844 | 1.00 | 27.15 | C |
| ATOM | 2032 | OG | SER | B | 53 | −48.178 | −40.933 | 91.485 | 1.00 | 33.66 | O |
| ATOM | 2033 | N | SER | B | 54 | −45.082 | −39.207 | 91.526 | 1.00 | 27.47 | N |
| ATOM | 2034 | CA | SER | B | 54 | −43.758 | −39.568 | 91.050 | 1.00 | 28.53 | C |
| ATOM | 2035 | C | SER | B | 54 | −42.717 | −38.787 | 91.833 | 1.00 | 28.97 | C |

TABLE 10.4-continued

| | | | | | | | | | | |
|---|---|---|---|---|---|---|---|---|---|---|
| ATOM | 2036 | O | SER | B | 54 | −42.754 | −37.552 | 91.877 | 1.00 | 29.74 | O |
| ATOM | 2037 | CB | SER | B | 54 | −43.621 | −39.289 | 89.556 | 1.00 | 27.68 | C |
| ATOM | 2038 | OG | SER | B | 54 | −44.449 | −40.156 | 88.815 | 1.00 | 33.67 | O |
| ATOM | 2039 | N | ARG | B | 55 | −41.795 | −39.519 | 92.432 | 1.00 | 27.26 | N |
| ATOM | 2040 | CA | ARG | B | 55 | −40.657 | −38.955 | 93.138 | 1.00 | 32.14 | C |
| ATOM | 2041 | C | ARG | B | 55 | −39.710 | −38.275 | 92.152 | 1.00 | 30.42 | C |
| ATOM | 2042 | O | ARG | B | 55 | −39.438 | −38.817 | 91.084 | 1.00 | 34.35 | O |
| ATOM | 2043 | CB | ARG | B | 55 | −39.955 | −40.099 | 93.864 | 1.00 | 28.20 | C |
| ATOM | 2044 | CG | ARG | B | 55 | −39.168 | −39.786 | 95.061 | 1.00 | 33.52 | C |
| ATOM | 2045 | CD | ARG | B | 55 | −38.583 | −41.090 | 95.651 | 1.00 | 37.14 | C |
| ATOM | 2046 | NE | ARG | B | 55 | −39.581 | −41.791 | 96.442 | 1.00 | 41.03 | N |
| ATOM | 2047 | CZ | ARG | B | 55 | −40.134 | −42.948 | 96.118 | 1.00 | 41.47 | C |
| ATOM | 2048 | NH1 | ARG | B | 55 | −41.056 | −43.474 | 96.923 | 1.00 | 39.94 | N1+ |
| ATOM | 2049 | NH2 | ARG | B | 55 | −39.756 | −43.579 | 95.009 | 1.00 | 39.66 | N |
| ATOM | 2050 | N | ALA | B | 56 | −39.246 | −37.068 | 92.483 | 1.00 | 32.10 | N |
| ATOM | 2051 | CA | ALA | B | 56 | −38.216 | −36.416 | 91.686 | 1.00 | 34.96 | C |
| ATOM | 2052 | C | ALA | B | 56 | −36.843 | −37.013 | 91.987 | 1.00 | 37.35 | C |
| ATOM | 2053 | O | ALA | B | 56 | −36.647 | −37.718 | 92.975 | 1.00 | 43.05 | O |
| ATOM | 2054 | CB | ALA | B | 56 | −38.183 | −34.911 | 91.952 | 1.00 | 30.18 | C |
| ATOM | 2055 | N | THR | B | 57 | −35.892 | −36.740 | 91.111 | 1.00 | 37.37 | N |
| ATOM | 2056 | CA | THR | B | 57 | −34.521 | −37.183 | 91.324 | 1.00 | 38.34 | C |
| ATOM | 2057 | C | THR | B | 57 | −33.836 | −36.270 | 92.313 | 1.00 | 39.91 | C |
| ATOM | 2058 | O | THR | B | 57 | −34.179 | −35.087 | 92.386 | 1.00 | 46.64 | O |
| ATOM | 2059 | CB | THR | B | 57 | −33.716 | −37.185 | 90.020 | 1.00 | 45.59 | C |
| ATOM | 2060 | OG1 | THR | B | 57 | −34.516 | −36.612 | 88.969 | 1.00 | 40.75 | O |
| ATOM | 2061 | CG2 | THR | B | 57 | −33.271 | −38.620 | 89.674 | 1.00 | 44.70 | C |
| ATOM | 2062 | N | GLY | B | 58 | −32.937 | −36.780 | 93.143 | 1.00 | 39.76 | N |
| ATOM | 2063 | CA | GLY | B | 58 | −32.957 | −38.118 | 93.653 | 1.00 | 35.82 | C |
| ATOM | 2064 | C | GLY | B | 58 | −33.485 | −37.854 | 95.061 | 1.00 | 40.59 | C |
| ATOM | 2065 | O | GLY | B | 58 | −32.728 | −37.724 | 96.021 | 1.00 | 37.19 | O |
| ATOM | 2066 | N | ILE | B | 59 | −34.798 | −37.704 | 95.160 | 1.00 | 33.85 | N |
| ATOM | 2067 | CA | ILE | B | 59 | −35.455 | −37.513 | 96.450 | 1.00 | 31.14 | C |
| ATOM | 2068 | C | ILE | B | 59 | −35.518 | −38.865 | 97.158 | 1.00 | 38.31 | C |
| ATOM | 2069 | O | ILE | B | 59 | −35.890 | −39.859 | 96.524 | 1.00 | 35.35 | O |
| ATOM | 2070 | CB | ILE | B | 59 | −36.855 | −36.904 | 96.264 | 1.00 | 29.49 | C |
| ATOM | 2071 | CG1 | ILE | B | 59 | −36.817 | −35.375 | 96.109 | 1.00 | 29.46 | C |
| ATOM | 2072 | CG2 | ILE | B | 59 | −37.756 | −37.240 | 97.420 | 1.00 | 30.78 | C |
| ATOM | 2073 | CD1 | ILE | B | 59 | −35.937 | −34.826 | 95.062 | 1.00 | 37.31 | C |
| ATOM | 2074 | N | PRO | B | 60 | −35.097 | −38.960 | 98.459 | 1.00 | 38.88 | N |
| ATOM | 2075 | CA | PRO | B | 60 | −35.157 | −40.238 | 99.191 | 1.00 | 33.20 | C |
| ATOM | 2076 | C | PRO | B | 60 | −36.530 | −40.890 | 99.128 | 1.00 | 36.41 | C |
| ATOM | 2077 | O | PRO | B | 60 | −37.527 | −40.200 | 98.889 | 1.00 | 37.79 | O |
| ATOM | 2078 | CB | PRO | B | 60 | −34.831 | −39.817 | 100.629 | 1.00 | 34.92 | C |
| ATOM | 2079 | CG | PRO | B | 60 | −34.076 | −38.600 | 100.501 | 1.00 | 30.53 | C |
| ATOM | 2080 | CD | PRO | B | 60 | −34.609 | −37.876 | 99.320 | 1.00 | 31.01 | C |
| ATOM | 2081 | N | ASP | B | 61 | −36.626 | −42.202 | 99.320 | 1.00 | 33.86 | N |
| ATOM | 2082 | CA | ASP | B | 61 | −37.968 | −42.778 | 99.248 | 1.00 | 38.89 | C |
| ATOM | 2083 | C | ASP | B | 61 | −38.762 | −42.694 | 100.558 | 1.00 | 33.94 | C |
| ATOM | 2084 | O | ASP | B | 61 | −39.868 | −43.244 | 100.610 | 1.00 | 36.31 | O |
| ATOM | 2085 | CB | ASP | B | 61 | −37.897 | −44.220 | 98.751 | 1.00 | 43.25 | C |
| ATOM | 2086 | CG | ASP | B | 61 | −36.955 | −45.052 | 99.542 | 1.00 | 47.58 | C |
| ATOM | 2087 | OD1 | ASP | B | 61 | −36.741 | −44.735 | 100.731 | 1.00 | 49.56 | O |
| ATOM | 2088 | OD2 | ASP | B | 61 | −36.427 | −46.029 | 98.972 | 1.00 | 65.96 | O1− |
| ATOM | 2089 | N | ARG | B | 62 | −38.222 | −42.061 | 101.609 | 1.00 | 32.55 | N |
| ATOM | 2090 | CA | ARG | B | 62 | −39.015 | −41.532 | 102.717 | 1.00 | 32.36 | C |
| ATOM | 2091 | C | ARG | B | 62 | −40.241 | −40.805 | 102.198 | 1.00 | 29.63 | C |
| ATOM | 2092 | O | ARG | B | 62 | −41.318 | −40.850 | 102.794 | 1.00 | 30.70 | O |
| ATOM | 2093 | CB | ARG | B | 62 | −38.243 | −40.501 | 103.536 | 1.00 | 35.05 | C |
| ATOM | 2094 | CG | ARG | B | 62 | −37.041 | −40.958 | 104.180 | 1.00 | 36.82 | C |
| ATOM | 2095 | CD | ARG | B | 62 | −36.754 | −40.043 | 105.334 | 1.00 | 38.78 | C |
| ATOM | 2096 | NE | ARG | B | 62 | −36.191 | −38.739 | 105.001 | 1.00 | 39.12 | N |
| ATOM | 2097 | CZ | ARG | B | 62 | −35.001 | −38.571 | 104.422 | 1.00 | 39.01 | C |
| ATOM | 2098 | NH1 | ARG | B | 62 | −34.289 | −39.630 | 104.056 | 1.00 | 36.63 | N1+ |
| ATOM | 2099 | NH2 | ARG | B | 62 | −34.530 | −37.352 | 104.195 | 1.00 | 33.11 | N |
| ATOM | 2100 | N | PHE | B | 63 | −40.042 | −40.074 | 101.115 | 1.00 | 31.12 | N |
| ATOM | 2101 | CA | PHE | B | 63 | −41.075 | −39.242 | 100.534 | 1.00 | 35.11 | C |
| ATOM | 2102 | C | PHE | B | 63 | −41.916 | −40.080 | 99.586 | 1.00 | 34.68 | C |
| ATOM | 2103 | O | PHE | B | 63 | −41.373 | −40.790 | 98.729 | 1.00 | 30.34 | O |
| ATOM | 2104 | CB | PHE | B | 63 | −40.444 | −38.054 | 99.803 | 1.00 | 27.94 | C |
| ATOM | 2105 | CG | PHE | B | 63 | −39.701 | −37.135 | 100.713 | 1.00 | 28.72 | C |
| ATOM | 2106 | CD1 | PHE | B | 63 | −38.408 | −37.425 | 101.099 | 1.00 | 31.44 | C |
| ATOM | 2107 | CD2 | PHE | B | 63 | −40.308 | −36.008 | 101.227 | 1.00 | 30.94 | C |
| ATOM | 2108 | CE1 | PHE | B | 63 | −37.731 | −36.592 | 101.968 | 1.00 | 33.00 | C |
| ATOM | 2109 | CE2 | PHE | B | 63 | −39.630 | −35.178 | 102.097 | 1.00 | 29.25 | C |
| ATOM | 2110 | CZ | PHE | B | 63 | −38.344 | −35.471 | 102.464 | 1.00 | 27.63 | C |
| ATOM | 2111 | N | SER | B | 64 | −43.235 | −40.023 | 99.775 | 1.00 | 30.03 | N |
| ATOM | 2112 | CA | SER | B | 64 | −44.181 | −40.581 | 98.819 | 1.00 | 30.73 | C |
| ATOM | 2113 | C | SER | B | 64 | −45.432 | −39.715 | 98.844 | 1.00 | 27.36 | C |
| ATOM | 2114 | O | SER | B | 64 | −45.684 | −38.974 | 99.796 | 1.00 | 25.57 | O |
| ATOM | 2115 | CB | SER | B | 64 | −44.501 | −42.064 | 99.109 | 1.00 | 28.95 | C |

TABLE 10.4-continued

| ATOM | 2116 | OG | SER | B | 64 | −45.445 | −42.217 | 100.156 | 1.00 | 29.24 | O |
|---|---|---|---|---|---|---|---|---|---|---|---|
| ATOM | 2117 | N | ALA | B | 65 | −46.221 | −39.806 | 97.784 | 1.00 | 26.92 | N |
| ATOM | 2118 | CA | ALA | B | 65 | −47.407 | −38.974 | 97.723 | 1.00 | 30.37 | C |
| ATOM | 2119 | C | ALA | B | 65 | −48.448 | −39.670 | 96.870 | 1.00 | 30.47 | C |
| ATOM | 2120 | O | ALA | B | 65 | −48.134 | −40.578 | 96.096 | 1.00 | 31.92 | O |
| ATOM | 2121 | CB | ALA | B | 65 | −47.087 | −37.583 | 97.157 | 1.00 | 26.67 | C |
| ATOM | 2122 | N | SER | B | 66 | −49.692 | −39.216 | 97.007 | 1.00 | 27.32 | N |
| ATOM | 2123 | CA | SER | B | 66 | −50.792 | −39.781 | 96.242 | 1.00 | 30.42 | C |
| ATOM | 2124 | C | SER | B | 66 | −51.978 | −38.825 | 96.278 | 1.00 | 27.86 | C |
| ATOM | 2125 | O | SER | B | 66 | −51.955 | −37.788 | 96.938 | 1.00 | 30.99 | O |
| ATOM | 2126 | CB | SER | B | 66 | −51.165 | −41.164 | 96.778 | 1.00 | 32.05 | C |
| ATOM | 2127 | OG | SER | B | 66 | −51.732 | −41.026 | 98.065 | 1.00 | 42.20 | O |
| ATOM | 2128 | N | GLY | B | 67 | −53.025 | −39.190 | 95.559 | 1.00 | 32.79 | N |
| ATOM | 2129 | CA | GLY | B | 67 | −54.256 | −38.435 | 95.552 | 1.00 | 28.74 | C |
| ATOM | 2130 | C | GLY | B | 67 | −54.669 | −38.125 | 94.138 | 1.00 | 34.13 | C |
| ATOM | 2131 | O | GLY | B | 67 | −53.835 | −38.175 | 93.223 | 1.00 | 38.32 | O |
| ATOM | 2132 | N | SER | B | 68 | −55.943 | −37.795 | 93.936 | 1.00 | 35.14 | N |
| ATOM | 2133 | CA | SER | B | 68 | −56.352 | −37.221 | 92.663 | 1.00 | 35.12 | C |
| ATOM | 2134 | C | SER | B | 68 | −57.678 | −36.522 | 92.863 | 1.00 | 35.78 | C |
| ATOM | 2135 | O | SER | B | 68 | −58.409 | −36.804 | 93.810 | 1.00 | 40.40 | O |
| ATOM | 2136 | CB | SER | B | 68 | −56.473 | −38.268 | 91.551 | 1.00 | 42.92 | C |
| ATOM | 2137 | OG | SER | B | 68 | −56.634 | −37.637 | 90.276 | 1.00 | 47.38 | O |
| ATOM | 2138 | N | GLY | B | 69 | −57.990 | −35.635 | 91.924 | 1.00 | 38.09 | N |
| ATOM | 2139 | CA | GLY | B | 69 | −59.167 | −34.812 | 91.999 | 1.00 | 27.17 | C |
| ATOM | 2140 | C | GLY | B | 69 | −59.015 | −33.747 | 93.048 | 1.00 | 30.94 | C |
| ATOM | 2141 | O | GLY | B | 69 | −58.281 | −32.775 | 92.867 | 1.00 | 32.99 | O |
| ATOM | 2142 | N | ALA | B | 70 | −59.712 | −33.901 | 94.161 | 1.00 | 36.50 | N |
| ATOM | 2143 | CA | ALA | B | 70 | −59.738 | −32.812 | 95.113 | 1.00 | 33.81 | C |
| ATOM | 2144 | C | ALA | B | 70 | −58.726 | −32.974 | 96.231 | 1.00 | 32.23 | C |
| ATOM | 2145 | O | ALA | B | 70 | −58.401 | −31.980 | 96.877 | 1.00 | 32.47 | O |
| ATOM | 2146 | CB | ALA | B | 70 | −61.137 | −32.661 | 95.704 | 1.00 | 27.91 | C |
| ATOM | 2147 | N | ASP | B | 71 | −58.216 | −34.184 | 96.471 | 1.00 | 28.53 | N |
| ATOM | 2148 | CA | ASP | B | 71 | −57.431 | −34.467 | 97.669 | 1.00 | 32.89 | C |
| ATOM | 2149 | C | ASP | B | 71 | −56.068 | −35.055 | 97.343 | 1.00 | 29.82 | C |
| ATOM | 2150 | O | ASP | B | 71 | −55.966 | −36.028 | 96.596 | 1.00 | 32.00 | O |
| ATOM | 2151 | CB | ASP | B | 71 | −58.176 | −35.394 | 98.631 | 1.00 | 29.01 | C |
| ATOM | 2152 | CG | ASP | B | 71 | −59.067 | −34.621 | 99.579 | 1.00 | 49.76 | C |
| ATOM | 2153 | OD1 | ASP | B | 71 | −58.492 | −34.037 | 100.529 | 1.00 | 51.82 | O |
| ATOM | 2154 | OD2 | ASP | B | 71 | −60.313 | −34.586 | 99.395 | 1.00 | 55.52 | O1− |
| ATOM | 2155 | N | PHE | B | 72 | −55.023 | −34.452 | 97.915 | 1.00 | 28.01 | N |
| ATOM | 2156 | CA | PHE | B | 72 | −53.651 | −34.911 | 97.756 | 1.00 | 26.76 | C |
| ATOM | 2157 | C | PHE | B | 72 | −52.964 | −34.963 | 99.110 | 1.00 | 24.59 | C |
| ATOM | 2158 | O | PHE | B | 72 | −53.217 | −34.129 | 99.987 | 1.00 | 27.45 | O |
| ATOM | 2159 | CB | PHE | B | 72 | −52.889 | −34.002 | 96.778 | 1.00 | 29.56 | C |
| ATOM | 2160 | CG | PHE | B | 72 | −53.477 | −34.000 | 95.391 | 1.00 | 29.36 | C |
| ATOM | 2161 | CD1 | PHE | B | 72 | −54.491 | −33.128 | 95.058 | 1.00 | 29.76 | C |
| ATOM | 2162 | CD2 | PHE | B | 72 | −53.050 | −34.917 | 94.441 | 1.00 | 28.24 | C |
| ATOM | 2163 | CE1 | PHE | B | 72 | −55.056 | −33.152 | 93.790 | 1.00 | 33.06 | C |
| ATOM | 2164 | CE2 | PHE | B | 72 | −53.606 | −34.935 | 93.163 | 1.00 | 29.21 | C |
| ATOM | 2165 | CZ | PHE | B | 72 | −54.619 | −34.058 | 92.846 | 1.00 | 27.62 | C |
| ATOM | 2166 | N | THR | B | 73 | −52.117 | −35.955 | 99.300 | 1.00 | 20.91 | N |
| ATOM | 2167 | CA | THR | B | 73 | −51.335 | −36.002 | 100.516 | 1.00 | 24.42 | C |
| ATOM | 2168 | C | THR | B | 73 | −49.884 | −36.323 | 100.180 | 1.00 | 25.69 | C |
| ATOM | 2169 | O | THR | B | 73 | −49.583 | −37.044 | 99.216 | 1.00 | 24.83 | O |
| ATOM | 2170 | CB | THR | B | 73 | −51.917 | −37.002 | 101.553 | 1.00 | 23.96 | C |
| ATOM | 2171 | OG1 | THR | B | 73 | −51.922 | −38.307 | 101.005 | 1.00 | 31.75 | O |
| ATOM | 2172 | CG2 | THR | B | 73 | −53.357 | −36.634 | 101.919 | 1.00 | 29.11 | C |
| ATOM | 2173 | N | LEU | B | 74 | −48.989 | −35.720 | 100.963 | 1.00 | 25.80 | N |
| ATOM | 2174 | CA | LEU | B | 74 | −47.565 | −36.023 | 100.955 | 1.00 | 26.02 | C |
| ATOM | 2175 | C | LEU | B | 74 | −47.252 | −36.738 | 102.262 | 1.00 | 25.39 | C |
| ATOM | 2176 | O | LEU | B | 74 | −47.701 | −36.303 | 103.322 | 1.00 | 25.96 | O |
| ATOM | 2177 | CB | LEU | B | 74 | −46.730 | −34.747 | 100.811 | 1.00 | 22.71 | C |
| ATOM | 2178 | CG | LEU | B | 74 | −45.217 | −34.943 | 100.997 | 1.00 | 27.97 | C |
| ATOM | 2179 | CD1 | LEU | B | 74 | −44.602 | −35.660 | 99.806 | 1.00 | 23.58 | C |
| ATOM | 2180 | CD2 | LEU | B | 74 | −44.486 | −33.635 | 101.264 | 1.00 | 25.42 | C |
| ATOM | 2181 | N | THR | B | 75 | −46.551 | −37.866 | 102.182 | 1.00 | 25.21 | N |
| ATOM | 2182 | CA | THR | B | 75 | −46.187 | −38.649 | 103.358 | 1.00 | 24.77 | C |
| ATOM | 2183 | C | THR | B | 75 | −44.676 | −38.773 | 103.458 | 1.00 | 29.94 | C |
| ATOM | 2184 | O | THR | B | 75 | −44.012 | −39.180 | 102.496 | 1.00 | 30.23 | O |
| ATOM | 2185 | CB | THR | B | 75 | −46.830 | −40.040 | 103.345 | 1.00 | 27.93 | C |
| ATOM | 2186 | OG1 | THR | B | 75 | −48.185 | −39.936 | 103.785 | 1.00 | 33.93 | O |
| ATOM | 2187 | CG2 | THR | B | 75 | −46.105 | −40.998 | 104.261 | 1.00 | 32.07 | C |
| ATOM | 2188 | N | ILE | B | 76 | −44.145 | −38.402 | 104.621 | 1.00 | 29.36 | N |
| ATOM | 2189 | CA | ILE | B | 76 | −42.760 | −38.649 | 105.003 | 1.00 | 29.13 | C |
| ATOM | 2190 | C | ILE | B | 76 | −42.807 | −39.727 | 106.074 | 1.00 | 29.72 | C |
| ATOM | 2191 | O | ILE | B | 76 | −43.436 | −39.537 | 107.122 | 1.00 | 30.62 | O |
| ATOM | 2192 | CB | ILE | B | 76 | −42.070 | −37.369 | 105.508 | 1.00 | 26.60 | C |
| ATOM | 2193 | CG1 | ILE | B | 76 | −42.336 | −36.210 | 104.551 | 1.00 | 32.41 | C |
| ATOM | 2194 | CG2 | ILE | B | 76 | −40.581 | −37.563 | 105.617 | 1.00 | 24.68 | C |
| ATOM | 2195 | CD1 | ILE | B | 76 | −41.949 | −34.861 | 105.118 | 1.00 | 27.44 | C |

TABLE 10.4-continued

| | | | | | | | | | | |
|---|---|---|---|---|---|---|---|---|---|---|
| ATOM | 2196 | N | SER | B | 77 | −42.195 | −40.878 | 105.798 | 1.00 | 31.29 | N |
| ATOM | 2197 | CA | SER | B | 77 | −42.453 | −42.041 | 106.645 | 1.00 | 34.52 | C |
| ATOM | 2198 | C | SER | B | 77 | −41.647 | −42.001 | 107.937 | 1.00 | 36.39 | C |
| ATOM | 2199 | O | SER | B | 77 | −42.148 | −42.404 | 108.994 | 1.00 | 42.84 | O |
| ATOM | 2200 | CB | SER | B | 77 | −42.183 | −43.327 | 105.871 | 1.00 | 28.00 | C |
| ATOM | 2201 | OG | SER | B | 77 | −40.838 | −43.394 | 105.441 | 1.00 | 30.78 | O |
| ATOM | 2202 | N | ARG | B | 78 | −40.419 | −41.502 | 107.873 | 1.00 | 29.86 | N |
| ATOM | 2203 | CA | ARG | B | 78 | −39.567 | −41.274 | 109.032 | 1.00 | 29.69 | C |
| ATOM | 2204 | C | ARG | B | 78 | −38.973 | −39.882 | 108.882 | 1.00 | 32.92 | C |
| ATOM | 2205 | O | ARG | B | 78 | −38.317 | −39.601 | 107.879 | 1.00 | 33.41 | O |
| ATOM | 2206 | CB | ARG | B | 78 | −38.467 | −42.342 | 109.133 | 1.00 | 39.68 | C |
| ATOM | 2207 | CG | ARG | B | 78 | −37.255 | −41.895 | 109.982 | 1.00 | 45.90 | C |
| ATOM | 2208 | CD | ARG | B | 78 | −36.191 | −42.997 | 110.245 | 1.00 | 50.49 | C |
| ATOM | 2209 | NE | ARG | B | 78 | −35.401 | −42.741 | 111.473 | 1.00 | 56.24 | N |
| ATOM | 2210 | CZ | ARG | B | 78 | −35.796 | −43.031 | 112.717 | 1.00 | 51.76 | C |
| ATOM | 2211 | NH1 | ARG | B | 78 | −35.013 | −42.754 | 113.768 | 1.00 | 42.94 | N1+ |
| ATOM | 2212 | NH2 | ARG | B | 78 | −36.989 | −43.591 | 112.915 | 1.00 | 53.21 | N |
| ATOM | 2213 | N | LEU | B | 79 | −39.284 | −38.987 | 109.813 | 1.00 | 33.51 | N |
| ATOM | 2214 | CA | LEU | B | 79 | −38.785 | −37.612 | 109.757 | 1.00 | 30.48 | C |
| ATOM | 2215 | C | LEU | B | 79 | −37.289 | −37.545 | 110.092 | 1.00 | 31.79 | C |
| ATOM | 2216 | O | LEU | B | 79 | −36.893 | −37.791 | 111.233 | 1.00 | 34.10 | O |
| ATOM | 2217 | CB | LEU | B | 79 | −39.590 | −36.756 | 110.722 | 1.00 | 29.33 | C |
| ATOM | 2218 | CG | LEU | B | 79 | −40.492 | −35.683 | 110.136 | 1.00 | 29.23 | C |
| ATOM | 2219 | CD1 | LEU | B | 79 | −40.779 | −35.916 | 108.706 | 1.00 | 23.33 | C |
| ATOM | 2220 | CD2 | LEU | B | 79 | −41.769 | −35.681 | 110.920 | 1.00 | 27.74 | C |
| ATOM | 2221 | N | GLU | B | 80 | −36.439 | −37.169 | 109.109 | 1.00 | 32.68 | N |
| ATOM | 2222 | CA | GLU | B | 80 | −35.028 | −36.892 | 109.360 | 1.00 | 33.86 | C |
| ATOM | 2223 | C | GLU | B | 80 | −34.836 | −35.408 | 109.665 | 1.00 | 35.88 | C |
| ATOM | 2224 | O | GLU | B | 80 | −35.701 | −34.593 | 109.339 | 1.00 | 34.51 | O |
| ATOM | 2225 | CB | GLU | B | 80 | −34.186 | −37.294 | 108.144 | 1.00 | 36.87 | C |
| ATOM | 2226 | CG | GLU | B | 80 | −34.116 | −38.792 | 107.876 | 1.00 | 36.11 | C |
| ATOM | 2227 | CD | GLU | B | 80 | −33.480 | −39.579 | 109.018 | 1.00 | 45.93 | C |
| ATOM | 2228 | OE1 | GLU | B | 80 | −33.946 | −40.719 | 109.264 | 1.00 | 47.66 | O |
| ATOM | 2229 | OE2 | GLU | B | 80 | −32.553 | −39.050 | 109.696 | 1.00 | 47.84 | O1− |
| ATOM | 2230 | N | PRO | B | 81 | −33.719 | −35.014 | 110.302 | 1.00 | 38.88 | N |
| ATOM | 2231 | CA | PRO | B | 81 | −33.544 | −33.588 | 110.659 | 1.00 | 34.21 | C |
| ATOM | 2232 | C | PRO | B | 81 | −33.719 | −32.635 | 109.488 | 1.00 | 36.66 | C |
| ATOM | 2233 | O | PRO | B | 81 | −34.340 | −31.574 | 109.634 | 1.00 | 35.85 | O |
| ATOM | 2234 | CB | PRO | B | 81 | −32.112 | −33.540 | 111.209 | 1.00 | 41.16 | C |
| ATOM | 2235 | CG | PRO | B | 81 | −31.881 | −34.922 | 111.747 | 1.00 | 43.24 | C |
| ATOM | 2236 | CD | PRO | B | 81 | −32.600 | −35.843 | 110.790 | 1.00 | 43.50 | C |
| ATOM | 2237 | N | GLU | B | 82 | −33.190 | −32.994 | 108.325 | 1.00 | 33.34 | N |
| ATOM | 2238 | CA | GLU | B | 82 | −33.310 | −32.225 | 107.093 | 1.00 | 34.68 | C |
| ATOM | 2239 | C | GLU | B | 82 | −34.704 | −32.235 | 106.492 | 1.00 | 36.53 | C |
| ATOM | 2240 | O | GLU | B | 82 | −34.861 | −31.767 | 105.360 | 1.00 | 32.72 | O |
| ATOM | 2241 | CB | GLU | B | 82 | −32.363 | −32.799 | 106.059 | 1.00 | 37.11 | C |
| ATOM | 2242 | CG | GLU | B | 82 | −32.783 | −34.160 | 105.573 | 1.00 | 41.97 | C |
| ATOM | 2243 | CD | GLU | B | 82 | −31.777 | −35.240 | 105.930 | 1.00 | 51.14 | C |
| ATOM | 2244 | OE1 | GLU | B | 82 | −31.259 | −35.252 | 107.093 | 1.00 | 45.81 | O |
| ATOM | 2245 | OE2 | GLU | B | 82 | −31.522 | −36.080 | 105.032 | 1.00 | 60.52 | O1− |
| ATOM | 2246 | N | ASP | B | 83 | −35.691 | −32.835 | 107.151 | 1.00 | 36.25 | N |
| ATOM | 2247 | CA | ASP | B | 83 | −37.045 | −32.856 | 106.622 | 1.00 | 30.47 | C |
| ATOM | 2248 | C | ASP | B | 83 | −37.924 | −31.782 | 107.227 | 1.00 | 26.07 | C |
| ATOM | 2249 | O | ASP | B | 83 | −39.029 | −31.554 | 106.726 | 1.00 | 22.59 | O |
| ATOM | 2250 | CB | ASP | B | 83 | −37.673 | −34.235 | 106.815 | 1.00 | 28.20 | C |
| ATOM | 2251 | CG | ASP | B | 83 | −36.966 | −35.300 | 105.987 | 1.00 | 37.30 | C |
| ATOM | 2252 | OD1 | ASP | B | 83 | −36.200 | −34.897 | 105.068 | 1.00 | 38.14 | O |
| ATOM | 2253 | OD2 | ASP | B | 83 | −37.177 | −36.519 | 106.234 | 1.00 | 37.91 | O1− |
| ATOM | 2254 | N | PHE | B | 84 | −37.420 | −31.069 | 108.221 | 1.00 | 22.98 | N |
| ATOM | 2255 | CA | PHE | B | 84 | −38.174 | −30.025 | 108.897 | 1.00 | 27.33 | C |
| ATOM | 2256 | C | PHE | B | 84 | −37.971 | −28.727 | 108.122 | 1.00 | 28.99 | C |
| ATOM | 2257 | O | PHE | B | 84 | −36.861 | −28.182 | 108.083 | 1.00 | 25.03 | O |
| ATOM | 2258 | CB | PHE | B | 84 | −37.721 | −29.926 | 110.346 | 1.00 | 27.37 | C |
| ATOM | 2259 | CG | PHE | B | 84 | −37.992 | −31.172 | 111.114 | 1.00 | 29.16 | C |
| ATOM | 2260 | CD2 | PHE | B | 84 | −39.193 | −31.337 | 111.794 | 1.00 | 27.59 | C |
| ATOM | 2261 | CD1 | PHE | B | 84 | −37.076 | −32.213 | 111.100 | 1.00 | 25.70 | C |
| ATOM | 2262 | CE2 | PHE | B | 84 | −39.456 | −32.507 | 112.497 | 1.00 | 31.00 | C |
| ATOM | 2263 | CE1 | PHE | B | 84 | −37.334 | −33.386 | 111.793 | 1.00 | 31.57 | C |
| ATOM | 2264 | CZ | PHE | B | 84 | −38.527 | −33.529 | 112.505 | 1.00 | 32.40 | C |
| ATOM | 2265 | N | ALA | B | 85 | −39.048 | −28.257 | 107.494 | 1.00 | 26.46 | N |
| ATOM | 2266 | CA | ALA | B | 85 | −39.022 | −27.288 | 106.408 | 1.00 | 23.46 | C |
| ATOM | 2267 | C | ALA | B | 85 | −40.457 | −26.866 | 106.126 | 1.00 | 23.53 | C |
| ATOM | 2268 | O | ALA | B | 85 | −41.404 | −27.329 | 106.771 | 1.00 | 22.25 | O |
| ATOM | 2269 | CB | ALA | B | 85 | −38.376 | −27.893 | 105.154 | 1.00 | 21.86 | C |
| ATOM | 2270 | N | VAL | B | 86 | −40.617 | −26.039 | 105.105 | 1.00 | 23.47 | N |
| ATOM | 2271 | CA | VAL | B | 86 | −41.936 | −25.680 | 104.600 | 1.00 | 23.19 | C |
| ATOM | 2272 | C | VAL | B | 86 | −42.201 | −26.477 | 103.330 | 1.00 | 22.81 | C |
| ATOM | 2273 | O | VAL | B | 86 | −41.314 | −26.672 | 102.500 | 1.00 | 22.61 | O |
| ATOM | 2274 | CB | VAL | B | 86 | −42.053 | −24.162 | 104.366 | 1.00 | 25.35 | C |
| ATOM | 2275 | CG1 | VAL | B | 86 | −43.330 | −23.837 | 103.664 | 1.00 | 26.56 | C |

TABLE 10.4-continued

| | | | | | | | | | | |
|---|---|---|---|---|---|---|---|---|---|---|
| ATOM | 2276 | CG2 | VAL | B | 86 | −42.014 | −23.424 | 105.700 | 1.00 | 19.36 | C |
| ATOM | 2277 | N | TYR | B | 87 | −43.417 | −26.967 | 103.188 | 1.00 | 23.96 | N |
| ATOM | 2278 | CA | TYR | B | 87 | −43.798 | −27.738 | 102.021 | 1.00 | 25.43 | C |
| ATOM | 2279 | C | TYR | B | 87 | −44.915 | −27.002 | 101.304 | 1.00 | 27.51 | C |
| ATOM | 2280 | O | TYR | B | 87 | −45.806 | −26.452 | 101.949 | 1.00 | 24.76 | O |
| ATOM | 2281 | CB | TYR | B | 87 | −44.216 | −29.157 | 102.418 | 1.00 | 22.13 | C |
| ATOM | 2282 | CG | TYR | B | 87 | −43.036 | −29.940 | 102.943 | 1.00 | 26.73 | C |
| ATOM | 2283 | CD1 | TYR | B | 87 | −42.575 | −29.754 | 104.253 | 1.00 | 22.18 | C |
| ATOM | 2284 | CD2 | TYR | B | 87 | −42.355 | −30.833 | 102.129 | 1.00 | 22.28 | C |
| ATOM | 2285 | CE1 | TYR | B | 87 | −41.484 | −30.435 | 104.729 | 1.00 | 21.84 | C |
| ATOM | 2286 | CE2 | TYR | B | 87 | −41.256 | −31.533 | 102.612 | 1.00 | 25.81 | C |
| ATOM | 2287 | CZ | TYR | B | 87 | −40.816 | −31.334 | 103.906 | 1.00 | 22.45 | C |
| ATOM | 2288 | OH | TYR | B | 87 | −39.716 | −32.037 | 104.374 | 1.00 | 18.88 | O |
| ATOM | 2289 | N | PHE | B | 88 | −44.823 | −26.949 | 99.973 | 1.00 | 25.00 | N |
| ATOM | 2290 | CA | PHE | B | 88 | −45.780 | −26.258 | 99.124 | 1.00 | 26.03 | C |
| ATOM | 2291 | C | PHE | B | 88 | −46.299 | −27.240 | 98.077 | 1.00 | 30.78 | C |
| ATOM | 2292 | O | PHE | B | 88 | −45.519 | −28.026 | 97.519 | 1.00 | 30.24 | O |
| ATOM | 2293 | CB | PHE | B | 88 | −45.131 | −25.063 | 98.406 | 1.00 | 27.78 | C |
| ATOM | 2294 | CG | PHE | B | 88 | −44.809 | −23.887 | 99.307 | 1.00 | 31.23 | C |
| ATOM | 2295 | CD1 | PHE | B | 88 | −45.802 | −23.008 | 99.730 | 1.00 | 30.25 | C |
| ATOM | 2296 | CD2 | PHE | B | 88 | −43.494 | −23.634 | 99.690 | 1.00 | 30.31 | C |
| ATOM | 2297 | CE1 | PHE | B | 88 | −45.493 | −21.904 | 100.539 | 1.00 | 30.57 | C |
| ATOM | 2298 | CE2 | PHE | B | 88 | −43.185 | −22.549 | 100.489 | 1.00 | 34.11 | C |
| ATOM | 2299 | CZ | PHE | B | 88 | −44.197 | −21.678 | 100.917 | 1.00 | 34.33 | C |
| ATOM | 2300 | N | CYS | B | 89 | −47.603 | −27.210 | 97.808 | 1.00 | 25.66 | N |
| ATOM | 2301 | CA | CYS | B | 89 | −48.130 | −27.930 | 96.660 | 1.00 | 24.07 | C |
| ATOM | 2302 | C | CYS | B | 89 | −48.355 | −26.953 | 95.513 | 1.00 | 23.52 | C |
| ATOM | 2303 | O | CYS | B | 89 | −48.402 | −25.739 | 95.708 | 1.00 | 21.13 | O |
| ATOM | 2304 | CB | CYS | B | 89 | −49.416 | −28.709 | 96.998 | 1.00 | 21.36 | C |
| ATOM | 2305 | SG | CYS | B | 89 | −50.748 | −27.800 | 97.719 | 1.00 | 30.20 | S |
| ATOM | 2306 | N | GLN | B | 90 | −48.451 | −27.502 | 94.302 | 1.00 | 22.98 | N |
| ATOM | 2307 | CA | GLN | B | 90 | −48.547 | −26.702 | 93.085 | 1.00 | 23.61 | C |
| ATOM | 2308 | C | GLN | B | 90 | −49.265 | −27.514 | 92.017 | 1.00 | 24.59 | C |
| ATOM | 2309 | O | GLN | B | 90 | −48.979 | −28.703 | 91.859 | 1.00 | 24.95 | O |
| ATOM | 2310 | CB | GLN | B | 90 | −47.153 | −26.272 | 92.588 | 1.00 | 23.03 | C |
| ATOM | 2311 | CG | GLN | B | 90 | −47.199 | −25.382 | 91.346 | 1.00 | 24.92 | C |
| ATOM | 2312 | CD | GLN | B | 90 | −46.481 | −25.971 | 90.137 | 1.00 | 26.13 | C |
| ATOM | 2313 | OE1 | GLN | B | 90 | −45.402 | −26.556 | 90.261 | 1.00 | 32.43 | O |
| ATOM | 2314 | NE2 | GLN | B | 90 | −47.093 | −25.847 | 88.969 | 1.00 | 23.23 | N |
| ATOM | 2315 | N | GLN | B | 91 | −50.221 | −26.897 | 91.319 | 1.00 | 22.59 | N |
| ATOM | 2316 | CA | GLN | B | 91 | −50.911 | −27.567 | 90.224 | 1.00 | 24.25 | C |
| ATOM | 2317 | C | GLN | B | 91 | −50.510 | −26.926 | 88.899 | 1.00 | 25.92 | C |
| ATOM | 2318 | O | GLN | B | 91 | −50.206 | −25.731 | 88.830 | 1.00 | 24.83 | O |
| ATOM | 2319 | CB | GLN | B | 91 | −52.449 | −27.564 | 90.405 | 1.00 | 19.74 | C |
| ATOM | 2320 | CG | GLN | B | 91 | −53.125 | −26.219 | 90.299 | 1.00 | 21.60 | C |
| ATOM | 2321 | CD | GLN | B | 91 | −53.417 | −25.811 | 88.871 | 1.00 | 24.32 | C |
| ATOM | 2322 | OE1 | GLN | B | 91 | −53.515 | −26.657 | 87.975 | 1.00 | 23.50 | O |
| ATOM | 2323 | NE2 | GLN | B | 91 | −53.561 | −24.499 | 88.648 | 1.00 | 23.44 | N |
| ATOM | 2324 | N | TYR | B | 92 | −50.462 | −27.737 | 87.850 | 1.00 | 24.33 | N |
| ATOM | 2325 | CA | TYR | B | 92 | −50.099 | −27.241 | 86.524 | 1.00 | 26.73 | C |
| ATOM | 2326 | C | TYR | B | 92 | −51.027 | −27.842 | 85.493 | 1.00 | 27.55 | C |
| ATOM | 2327 | O | TYR | B | 92 | −50.626 | −28.137 | 84.362 | 1.00 | 29.60 | O |
| ATOM | 2328 | CB | TYR | B | 92 | −48.610 | −27.501 | 86.194 | 1.00 | 23.03 | C |
| ATOM | 2329 | CG | TYR | B | 92 | −48.133 | −28.903 | 86.494 | 1.00 | 22.43 | C |
| ATOM | 2330 | CD1 | TYR | B | 92 | −47.776 | −29.257 | 87.789 | 1.00 | 22.77 | C |
| ATOM | 2331 | CD2 | TYR | B | 92 | −48.036 | −29.874 | 85.496 | 1.00 | 22.32 | C |
| ATOM | 2332 | CE1 | TYR | B | 92 | −47.349 | −30.533 | 88.095 | 1.00 | 22.69 | C |
| ATOM | 2333 | CE2 | TYR | B | 92 | −47.589 | −31.154 | 85.788 | 1.00 | 21.88 | C |
| ATOM | 2334 | CZ | TYR | B | 92 | −47.254 | −31.478 | 87.096 | 1.00 | 23.71 | C |
| ATOM | 2335 | OH | TYR | B | 92 | −46.820 | −32.729 | 87.444 | 1.00 | 20.44 | O |
| ATOM | 2336 | N | GLU | B | 93 | −52.289 | −28.031 | 85.880 | 1.00 | 27.99 | N |
| ATOM | 2337 | CA | GLU | B | 93 | −53.312 | −28.512 | 84.958 | 1.00 | 30.82 | C |
| ATOM | 2338 | C | GLU | B | 93 | −53.999 | −27.364 | 84.244 | 1.00 | 31.11 | C |
| ATOM | 2339 | O | GLU | B | 93 | −54.182 | −27.424 | 83.026 | 1.00 | 30.30 | O |
| ATOM | 2340 | CB | GLU | B | 93 | −54.360 | −29.364 | 85.691 | 1.00 | 30.98 | C |
| ATOM | 2341 | CG | GLU | B | 93 | −55.690 | −29.496 | 84.939 | 1.00 | 25.68 | C |
| ATOM | 2342 | CD | GLU | B | 93 | −56.678 | −30.425 | 85.629 | 1.00 | 33.12 | C |
| ATOM | 2343 | OE1 | GLU | B | 93 | −56.247 | −31.498 | 86.123 | 1.00 | 31.54 | O |
| ATOM | 2344 | OE2 | GLU | B | 93 | −57.889 | −30.090 | 85.680 | 1.00 | 32.74 | O1− |
| ATOM | 2345 | N | SER | B | 94 | −54.366 | −26.310 | 84.970 | 1.00 | 30.35 | N |
| ATOM | 2346 | CA | SER | B | 94 | −55.097 | −25.199 | 84.378 | 1.00 | 32.23 | C |
| ATOM | 2347 | C | SER | B | 94 | −54.388 | −23.888 | 84.703 | 1.00 | 28.38 | C |
| ATOM | 2348 | O | SER | B | 94 | −54.044 | −23.617 | 85.861 | 1.00 | 23.42 | O |
| ATOM | 2349 | CB | SER | B | 94 | −56.556 | −25.171 | 84.862 | 1.00 | 32.62 | C |
| ATOM | 2350 | OG | SER | B | 94 | −57.144 | −23.891 | 84.656 | 1.00 | 44.26 | O |
| ATOM | 2351 | N | SER | B | 95 | −54.180 | −23.077 | 83.678 | 1.00 | 29.26 | N |
| ATOM | 2352 | CA | SER | B | 95 | −53.498 | −21.814 | 83.854 | 1.00 | 28.94 | C |
| ATOM | 2353 | C | SER | B | 95 | −54.464 | −20.862 | 84.524 | 1.00 | 28.67 | C |
| ATOM | 2354 | O | SER | B | 95 | −55.645 | −20.897 | 84.219 | 1.00 | 29.79 | O |
| ATOM | 2355 | CB | SER | B | 95 | −53.015 | −21.271 | 82.514 | 1.00 | 23.10 | C |

TABLE 10.4-continued

| | | | | | | | | | | |
|---|---|---|---|---|---|---|---|---|---|---|
| ATOM | 2356 | OG | SER | B | 95 | −52.370 | −20.022 | 82.690 | 1.00 | 38.38 | O |
| ATOM | 2357 | N | PRO | B | 96 | −53.976 | −20.029 | 85.458 | 1.00 | 27.09 | N |
| ATOM | 2358 | CA | PRO | B | 96 | −52.599 | −19.892 | 85.956 | 1.00 | 26.26 | C |
| ATOM | 2359 | C | PRO | B | 96 | −52.131 | −21.034 | 86.857 | 1.00 | 27.92 | C |
| ATOM | 2360 | O | PRO | B | 96 | −52.933 | −21.550 | 87.627 | 1.00 | 31.29 | O |
| ATOM | 2361 | CB | PRO | B | 96 | −52.658 | −18.601 | 86.768 | 1.00 | 25.28 | C |
| ATOM | 2362 | CG | PRO | B | 96 | −54.047 | −18.557 | 87.258 | 1.00 | 27.55 | C |
| ATOM | 2363 | CD | PRO | B | 96 | −54.892 | −19.111 | 86.148 | 1.00 | 23.84 | C |
| ATOM | 2364 | N | TRP | B | 97 | −50.858 | −21.419 | 86.786 | 1.00 | 26.30 | N |
| ATOM | 2365 | CA | TRP | B | 97 | −50.330 | −22.305 | 87.811 | 1.00 | 26.57 | C |
| ATOM | 2366 | C | TRP | B | 97 | −50.524 | −21.661 | 89.178 | 1.00 | 25.80 | C |
| ATOM | 2367 | O | TRP | B | 97 | −50.307 | −20.460 | 89.358 | 1.00 | 25.76 | O |
| ATOM | 2368 | CB | TRP | B | 97 | −48.847 | −22.617 | 87.594 | 1.00 | 25.63 | C |
| ATOM | 2369 | CG | TRP | B | 97 | −48.411 | −23.337 | 86.309 | 1.00 | 28.94 | C |
| ATOM | 2370 | CD1 | TRP | B | 97 | −47.124 | −23.541 | 85.926 | 1.00 | 29.48 | C |
| ATOM | 2371 | CD2 | TRP | B | 97 | −49.229 | −23.928 | 85.264 | 1.00 | 29.78 | C |
| ATOM | 2372 | NE1 | TRP | B | 97 | −47.073 | −24.216 | 84.733 | 1.00 | 32.61 | N |
| ATOM | 2373 | CE2 | TRP | B | 97 | −48.344 | −24.459 | 84.296 | 1.00 | 28.86 | C |
| ATOM | 2374 | CE3 | TRP | B | 97 | −50.608 | −24.072 | 85.061 | 1.00 | 29.91 | C |
| ATOM | 2375 | CZ2 | TRP | B | 97 | −48.789 | −25.116 | 83.134 | 1.00 | 31.43 | C |
| ATOM | 2376 | CZ3 | TRP | B | 97 | −51.054 | −24.724 | 83.902 | 1.00 | 28.75 | C |
| ATOM | 2377 | CH2 | TRP | B | 97 | −50.140 | −25.232 | 82.951 | 1.00 | 31.01 | C |
| ATOM | 2378 | N | THR | B | 98 | −50.931 | −22.460 | 90.148 | 1.00 | 21.99 | N |
| ATOM | 2379 | CA | THR | B | 98 | −51.167 | −21.932 | 91.472 | 1.00 | 23.81 | C |
| ATOM | 2380 | C | THR | B | 98 | −50.474 | −22.819 | 92.488 | 1.00 | 23.94 | C |
| ATOM | 2381 | O | THR | B | 98 | −50.148 | −23.973 | 92.215 | 1.00 | 25.95 | O |
| ATOM | 2382 | CB | THR | B | 98 | −52.674 | −21.787 | 91.782 | 1.00 | 26.18 | C |
| ATOM | 2383 | OG1 | THR | B | 98 | −53.374 | −23.006 | 91.498 | 1.00 | 23.15 | O |
| ATOM | 2384 | CG2 | THR | B | 98 | −53.270 | −20.618 | 90.969 | 1.00 | 24.44 | C |
| ATOM | 2385 | N | PHE | B | 99 | −50.184 | −22.209 | 93.633 | 1.00 | 28.63 | N |
| ATOM | 2386 | CA | PHE | B | 99 | −49.511 | −22.803 | 94.776 | 1.00 | 26.82 | C |
| ATOM | 2387 | C | PHE | B | 99 | −50.436 | −22.773 | 95.988 | 1.00 | 29.46 | C |
| ATOM | 2388 | O | PHE | B | 99 | −51.311 | −21.912 | 96.089 | 1.00 | 31.15 | O |
| ATOM | 2389 | CB | PHE | B | 99 | −48.236 | −22.020 | 95.121 | 1.00 | 27.58 | C |
| ATOM | 2390 | CG | PHE | B | 99 | −47.123 | −22.166 | 94.115 | 1.00 | 26.17 | C |
| ATOM | 2391 | CD1 | PHE | B | 99 | −46.212 | −23.210 | 94.213 | 1.00 | 21.23 | C |
| ATOM | 2392 | CD2 | PHE | B | 99 | −46.970 | −21.236 | 93.096 | 1.00 | 26.56 | C |
| ATOM | 2393 | CE1 | PHE | B | 99 | −45.179 | −23.346 | 93.313 | 1.00 | 23.45 | C |
| ATOM | 2394 | CE2 | PHE | B | 99 | −45.935 | −21.362 | 92.177 | 1.00 | 28.21 | C |
| ATOM | 2395 | CZ | PHE | B | 99 | −45.028 | −22.420 | 92.291 | 1.00 | 25.30 | C |
| ATOM | 2396 | N | GLY | B | 100 | −50.252 | −23.722 | 96.909 | 1.00 | 29.01 | N |
| ATOM | 2397 | CA | GLY | B | 100 | −50.849 | −23.604 | 98.224 | 1.00 | 26.65 | C |
| ATOM | 2398 | C | GLY | B | 100 | −50.062 | −22.660 | 99.136 | 1.00 | 32.15 | C |
| ATOM | 2399 | O | GLY | B | 100 | −48.953 | −22.224 | 98.831 | 1.00 | 30.70 | O |
| ATOM | 2400 | N | GLN | B | 101 | −50.651 | −22.339 | 100.291 | 1.00 | 32.09 | N |
| ATOM | 2401 | CA | GLN | B | 101 | −49.953 | −21.455 | 101.219 | 1.00 | 27.63 | C |
| ATOM | 2402 | C | GLN | B | 101 | −48.788 | −22.134 | 101.926 | 1.00 | 31.28 | C |
| ATOM | 2403 | O | GLN | B | 101 | −47.993 | −21.430 | 102.555 | 1.00 | 31.67 | O |
| ATOM | 2404 | CB | GLN | B | 101 | −50.888 | −20.871 | 102.296 | 1.00 | 31.00 | C |
| ATOM | 2405 | CG | GLN | B | 101 | −52.371 | −21.297 | 102.285 | 1.00 | 41.04 | C |
| ATOM | 2406 | CD | GLN | B | 101 | −52.581 | −22.771 | 102.623 | 1.00 | 41.89 | C |
| ATOM | 2407 | OE1 | GLN | B | 101 | −52.927 | −23.567 | 101.736 | 1.00 | 36.09 | O |
| ATOM | 2408 | NE2 | GLN | B | 101 | −52.365 | −23.147 | 103.900 | 1.00 | 37.62 | N |
| ATOM | 2409 | N | GLY | B | 102 | −48.665 | −23.453 | 101.858 | 1.00 | 26.43 | N |
| ATOM | 2410 | CA | GLY | B | 102 | −47.548 | −24.085 | 102.535 | 1.00 | 24.50 | C |
| ATOM | 2411 | C | GLY | B | 102 | −47.895 | −24.678 | 103.898 | 1.00 | 27.19 | C |
| ATOM | 2412 | O | GLY | B | 102 | −48.800 | −24.215 | 104.600 | 1.00 | 27.42 | O |
| ATOM | 2413 | N | THR | B | 103 | −47.158 | −25.724 | 104.283 | 1.00 | 24.40 | N |
| ATOM | 2414 | CA | THR | B | 103 | −47.207 | −26.276 | 105.634 | 1.00 | 27.22 | C |
| ATOM | 2415 | C | THR | B | 103 | −45.806 | −26.259 | 106.239 | 1.00 | 25.76 | C |
| ATOM | 2416 | O | THR | B | 103 | −44.857 | −26.746 | 105.621 | 1.00 | 27.96 | O |
| ATOM | 2417 | CB | THR | B | 103 | −47.752 | −27.718 | 105.647 | 1.00 | 28.05 | C |
| ATOM | 2418 | OG1 | THR | B | 103 | −49.120 | −27.729 | 105.232 | 1.00 | 31.71 | O |
| ATOM | 2419 | CG2 | THR | B | 103 | −47.654 | −28.348 | 107.061 | 1.00 | 25.08 | C |
| ATOM | 2420 | N | LYS | B | 104 | −45.673 | −25.709 | 107.442 | 1.00 | 22.08 | N |
| ATOM | 2421 | CA | LYS | B | 104 | −44.409 | −25.758 | 108.159 | 1.00 | 26.19 | C |
| ATOM | 2422 | C | LYS | B | 104 | −44.360 | −27.021 | 109.014 | 1.00 | 27.07 | C |
| ATOM | 2423 | O | LYS | B | 104 | −45.205 | −27.212 | 109.889 | 1.00 | 28.44 | O |
| ATOM | 2424 | CB | LYS | B | 104 | −44.212 | −24.523 | 109.032 | 1.00 | 25.21 | C |
| ATOM | 2425 | CG | LYS | B | 104 | −42.846 | −24.510 | 109.709 | 1.00 | 26.78 | C |
| ATOM | 2426 | CD | LYS | B | 104 | −42.677 | −23.365 | 110.699 | 1.00 | 30.43 | C |
| ATOM | 2427 | CE | LYS | B | 104 | −41.301 | −23.463 | 111.391 | 1.00 | 45.22 | C |
| ATOM | 2428 | NZ | LYS | B | 104 | −40.967 | −22.316 | 112.301 | 1.00 | 44.27 | N1+ |
| ATOM | 2429 | N | VAL | B | 105 | −43.366 | −27.869 | 108.779 | 1.00 | 25.76 | N |
| ATOM | 2430 | CA | VAL | B | 105 | −43.119 | −29.033 | 109.624 | 1.00 | 29.32 | C |
| ATOM | 2431 | C | VAL | B | 105 | −42.005 | −28.664 | 110.597 | 1.00 | 27.51 | C |
| ATOM | 2432 | O | VAL | B | 105 | −40.841 | −28.516 | 110.211 | 1.00 | 25.98 | O |
| ATOM | 2433 | CB | VAL | B | 105 | −42.757 | −30.283 | 108.813 | 1.00 | 24.39 | C |
| ATOM | 2434 | CG1 | VAL | B | 105 | −42.488 | −31.445 | 109.776 | 1.00 | 26.12 | C |
| ATOM | 2435 | CG2 | VAL | B | 105 | −43.868 | −30.636 | 107.890 | 1.00 | 21.86 | C |

TABLE 10.4-continued

| ATOM | 2436 | N | GLU | B | 106 | −42.367 | −28.533 | 111.863 | 1.00 | 31.16 | N |
| ATOM | 2437 | CA | GLU | B | 106 | −41.473 | −28.092 | 112.919 | 1.00 | 28.93 | C |
| ATOM | 2438 | C | GLU | B | 106 | −41.144 | −29.242 | 113.875 | 1.00 | 33.11 | C |
| ATOM | 2439 | O | GLU | B | 106 | −41.922 | −30.197 | 114.030 | 1.00 | 30.26 | O |
| ATOM | 2440 | CB | GLU | B | 106 | −42.130 | −26.943 | 113.669 | 1.00 | 31.52 | C |
| ATOM | 2441 | CG | GLU | B | 106 | −41.324 | −26.435 | 114.830 | 1.00 | 41.69 | C |
| ATOM | 2442 | CD | GLU | B | 106 | −42.170 | −26.121 | 116.028 | 1.00 | 37.31 | C |
| ATOM | 2443 | OE1 | GLU | B | 106 | −42.903 | −27.027 | 116.485 | 1.00 | 37.32 | O |
| ATOM | 2444 | OE2 | GLU | B | 106 | −42.102 | −24.963 | 116.492 | 1.00 | 39.39 | O1− |
| ATOM | 2445 | N | ILE | B | 107 | −39.971 | −29.149 | 114.495 | 1.00 | 26.80 | N |
| ATOM | 2446 | CA | ILE | B | 107 | −39.486 | −30.168 | 115.421 | 1.00 | 28.39 | C |
| ATOM | 2447 | C | ILE | B | 107 | −40.205 | −30.038 | 116.755 | 1.00 | 32.03 | C |
| ATOM | 2448 | O | ILE | B | 107 | −40.118 | −29.003 | 117.420 | 1.00 | 27.69 | O |
| ATOM | 2449 | CB | ILE | B | 107 | −37.974 | −30.050 | 115.622 | 1.00 | 26.88 | C |
| ATOM | 2450 | CG1 | ILE | B | 107 | −37.240 | −30.423 | 114.344 | 1.00 | 27.26 | C |
| ATOM | 2451 | CG2 | ILE | B | 107 | −37.552 | −30.898 | 116.793 | 1.00 | 26.83 | C |
| ATOM | 2452 | CD1 | ILE | B | 107 | −35.799 | −30.043 | 114.347 | 1.00 | 30.15 | C |
| ATOM | 2453 | N | LYS | B | 108 | −40.866 | −31.106 | 117.182 | 1.00 | 31.78 | N |
| ATOM | 2454 | CA | LYS | B | 108 | −41.455 | −31.110 | 118.512 | 1.00 | 32.40 | C |
| ATOM | 2455 | C | LYS | B | 108 | −40.382 | −31.497 | 119.529 | 1.00 | 32.97 | C |
| ATOM | 2456 | O | LYS | B | 108 | −39.654 | −32.475 | 119.336 | 1.00 | 33.78 | O |
| ATOM | 2457 | CB | LYS | B | 108 | −42.649 | −32.069 | 118.567 | 1.00 | 34.38 | C |
| ATOM | 2458 | CG | LYS | B | 108 | −43.460 | −32.006 | 119.864 | 1.00 | 35.60 | C |
| ATOM | 2459 | CD | LYS | B | 108 | −44.379 | −33.223 | 120.000 | 1.00 | 34.87 | C |
| ATOM | 2460 | CE | LYS | B | 108 | −45.671 | −32.857 | 120.690 | 1.00 | 39.16 | C |
| ATOM | 2461 | NZ | LYS | B | 108 | −45.560 | −31.457 | 121.228 | 1.00 | 41.36 | N1+ |
| ATOM | 2462 | N | ARG | B | 109 | −40.270 | −30.720 | 120.604 | 1.00 | 30.43 | N |
| ATOM | 2463 | CA | ARG | B | 109 | −39.298 | −30.996 | 121.651 | 1.00 | 27.95 | C |
| ATOM | 2464 | C | ARG | B | 109 | −39.942 | −30.659 | 122.985 | 1.00 | 29.25 | C |
| ATOM | 2465 | O | ARG | B | 109 | −41.117 | −30.284 | 123.040 | 1.00 | 33.46 | O |
| ATOM | 2466 | CB | ARG | B | 109 | −37.993 | −30.224 | 121.445 | 1.00 | 27.54 | C |
| ATOM | 2467 | CG | ARG | B | 109 | −38.128 | −28.705 | 121.378 | 1.00 | 29.91 | C |
| ATOM | 2468 | CD | ARG | B | 109 | −36.873 | −28.023 | 121.928 | 1.00 | 26.11 | C |
| ATOM | 2469 | NE | ARG | B | 109 | −36.853 | −28.173 | 123.386 | 1.00 | 32.71 | N |
| ATOM | 2470 | CZ | ARG | B | 109 | −35.751 | −28.189 | 124.126 | 1.00 | 27.84 | C |
| ATOM | 2471 | NH1 | ARG | B | 109 | −35.827 | −28.351 | 125.449 | 1.00 | 24.67 | N1+ |
| ATOM | 2472 | NH2 | ARG | B | 109 | −34.577 | −28.039 | 123.536 | 1.00 | 23.42 | N |
| ATOM | 2473 | N | THR | B | 110 | −39.191 | −30.838 | 124.073 | 1.00 | 27.37 | N |
| ATOM | 2474 | CA | THR | B | 110 | −39.762 | −30.554 | 125.385 | 1.00 | 28.62 | C |
| ATOM | 2475 | C | THR | B | 110 | −39.775 | −29.056 | 125.631 | 1.00 | 29.53 | C |
| ATOM | 2476 | O | THR | B | 110 | −38.878 | −28.311 | 125.203 | 1.00 | 26.75 | O |
| ATOM | 2477 | CB | THR | B | 110 | −39.006 | −31.227 | 126.546 | 1.00 | 27.19 | C |
| ATOM | 2478 | OG1 | THR | B | 110 | −37.641 | −30.803 | 126.570 | 1.00 | 31.87 | O |
| ATOM | 2479 | CG2 | THR | B | 110 | −39.052 | −32.727 | 126.445 | 1.00 | 25.84 | C |
| ATOM | 2480 | N | VAL | B | 111 | −40.796 | −28.630 | 126.367 | 1.00 | 31.89 | N |
| ATOM | 2481 | CA | VAL | B | 111 | −40.905 | −27.236 | 126.752 | 1.00 | 33.07 | C |
| ATOM | 2482 | C | VAL | B | 111 | −39.618 | −26.751 | 127.407 | 1.00 | 31.48 | C |
| ATOM | 2483 | O | VAL | B | 111 | −38.982 | −27.463 | 128.195 | 1.00 | 31.62 | O |
| ATOM | 2484 | CB | VAL | B | 111 | −42.112 | −27.056 | 127.683 | 1.00 | 30.76 | C |
| ATOM | 2485 | CG1 | VAL | B | 111 | −42.176 | −25.612 | 128.149 | 1.00 | 27.34 | C |
| ATOM | 2486 | CG2 | VAL | B | 111 | −43.381 | −27.478 | 126.949 | 1.00 | 24.38 | C |
| ATOM | 2487 | N | ALA | B | 112 | −39.223 | −25.532 | 127.044 | 1.00 | 29.57 | N |
| ATOM | 2488 | CA | ALA | B | 112 | −38.047 | −24.863 | 127.582 | 1.00 | 25.09 | C |
| ATOM | 2489 | C | ALA | B | 112 | −38.425 | −23.405 | 127.788 | 1.00 | 30.16 | C |
| ATOM | 2490 | O | ALA | B | 112 | −38.831 | −22.734 | 126.835 | 1.00 | 27.80 | O |
| ATOM | 2491 | CB | ALA | B | 112 | −36.844 | −24.984 | 126.639 | 1.00 | 23.34 | C |
| ATOM | 2492 | N | ALA | B | 113 | −38.318 | −22.928 | 129.029 | 1.00 | 32.01 | N |
| ATOM | 2493 | CA | ALA | B | 113 | −38.663 | −21.549 | 129.326 | 1.00 | 28.03 | C |
| ATOM | 2494 | C | ALA | B | 113 | −37.579 | −20.640 | 128.768 | 1.00 | 29.40 | C |
| ATOM | 2495 | O | ALA | B | 113 | −36.412 | −21.035 | 128.710 | 1.00 | 31.93 | O |
| ATOM | 2496 | CB | ALA | B | 113 | −38.799 | −21.325 | 130.830 | 1.00 | 23.97 | C |
| ATOM | 2497 | N | PRO | B | 114 | −37.934 | −19.422 | 128.353 | 1.00 | 27.52 | N |
| ATOM | 2498 | CA | PRO | B | 114 | −36.911 | −18.489 | 127.860 | 1.00 | 27.42 | C |
| ATOM | 2499 | C | PRO | B | 114 | −36.095 | −17.920 | 129.004 | 1.00 | 27.03 | C |
| ATOM | 2500 | O | PRO | B | 114 | −36.590 | −17.719 | 130.108 | 1.00 | 29.23 | O |
| ATOM | 2501 | CB | PRO | B | 114 | −37.731 | −17.386 | 127.186 | 1.00 | 27.64 | C |
| ATOM | 2502 | CG | PRO | B | 114 | −39.012 | −17.376 | 127.998 | 1.00 | 27.54 | C |
| ATOM | 2503 | CD | PRO | B | 114 | −39.274 | −18.806 | 128.403 | 1.00 | 24.48 | C |
| ATOM | 2504 | N | SER | B | 115 | −34.835 | −17.635 | 128.730 | 1.00 | 27.91 | N |
| ATOM | 2505 | CA | SER | B | 115 | −34.092 | −16.739 | 129.592 | 1.00 | 25.63 | C |
| ATOM | 2506 | C | SER | B | 115 | −34.236 | −15.331 | 129.028 | 1.00 | 25.72 | C |
| ATOM | 2507 | O | SER | B | 115 | −34.238 | −15.130 | 127.814 | 1.00 | 27.20 | O |
| ATOM | 2508 | CB | SER | B | 115 | −32.628 | −17.157 | 129.726 | 1.00 | 24.15 | C |
| ATOM | 2509 | OG | SER | B | 115 | −32.139 | −17.720 | 128.535 | 1.00 | 40.34 | O |
| ATOM | 2510 | N | VAL | B | 116 | −34.430 | −14.371 | 129.922 | 1.00 | 26.54 | N |
| ATOM | 2511 | CA | VAL | B | 116 | −34.857 | −13.023 | 129.579 | 1.00 | 28.89 | C |
| ATOM | 2512 | C | VAL | B | 116 | −33.762 | −12.037 | 129.979 | 1.00 | 26.93 | C |
| ATOM | 2513 | O | VAL | B | 116 | −33.243 | −12.093 | 131.094 | 1.00 | 31.62 | O |
| ATOM | 2514 | CB | VAL | B | 116 | −36.203 | −12.695 | 130.259 | 1.00 | 28.35 | C |
| ATOM | 2515 | CG1 | VAL | B | 116 | −36.709 | −11.313 | 129.860 | 1.00 | 28.35 | C |

TABLE 10.4-continued

| | | | | | | | | | | |
|---|---|---|---|---|---|---|---|---|---|---|
| ATOM | 2516 | CG2 | VAL | B | 116 | −37.212 | −13.740 | 129.882 | 1.00 | 18.89 | C |
| ATOM | 2517 | N | PHE | B | 117 | −33.406 | −11.151 | 129.063 | 1.00 | 25.01 | N |
| ATOM | 2518 | CA | PHE | B | 117 | −32.424 | −10.118 | 129.311 | 1.00 | 25.46 | C |
| ATOM | 2519 | C | PHE | B | 117 | −32.963 | −8.826 | 128.726 | 1.00 | 28.62 | C |
| ATOM | 2520 | O | PHE | B | 117 | −33.533 | −8.832 | 127.632 | 1.00 | 31.30 | O |
| ATOM | 2521 | CB | PHE | B | 117 | −31.081 | −10.413 | 128.650 | 1.00 | 25.62 | C |
| ATOM | 2522 | CG | PHE | B | 117 | −30.536 | −11.799 | 128.892 | 1.00 | 29.84 | C |
| ATOM | 2523 | CD1 | PHE | B | 117 | −30.935 | −12.876 | 128.093 | 1.00 | 24.22 | C |
| ATOM | 2524 | CD2 | PHE | B | 117 | −29.542 | −12.015 | 129.835 | 1.00 | 31.65 | C |
| ATOM | 2525 | CE1 | PHE | B | 117 | −30.405 | −14.136 | 128.283 | 1.00 | 22.90 | C |
| ATOM | 2526 | CE2 | PHE | B | 117 | −28.998 | −13.290 | 130.013 | 1.00 | 29.63 | C |
| ATOM | 2527 | CZ | PHE | B | 117 | −29.430 | −14.339 | 129.234 | 1.00 | 24.06 | C |
| ATOM | 2528 | N | ILE | B | 118 | −32.755 | −7.717 | 129.428 | 1.00 | 28.33 | N |
| ATOM | 2529 | CA | ILE | B | 118 | −33.211 | −6.409 | 128.973 | 1.00 | 27.52 | C |
| ATOM | 2530 | C | ILE | B | 118 | −31.997 | −5.501 | 128.878 | 1.00 | 27.02 | C |
| ATOM | 2531 | O | ILE | B | 118 | −31.130 | −5.541 | 129.750 | 1.00 | 28.87 | O |
| ATOM | 2532 | CB | ILE | B | 118 | −34.280 | −5.811 | 129.911 | 1.00 | 29.46 | C |
| ATOM | 2533 | CG1 | ILE | B | 118 | −34.774 | −4.480 | 129.347 | 1.00 | 30.76 | C |
| ATOM | 2534 | CG2 | ILE | B | 118 | −33.752 | −5.639 | 131.343 | 1.00 | 25.68 | C |
| ATOM | 2535 | CD1 | ILE | B | 118 | −35.736 | −3.775 | 130.229 | 1.00 | 29.17 | C |
| ATOM | 2536 | N | PHE | B | 119 | −31.925 | −4.700 | 127.811 | 1.00 | 28.09 | N |
| ATOM | 2537 | CA | PHE | B | 119 | −30.765 | −3.875 | 127.503 | 1.00 | 24.90 | C |
| ATOM | 2538 | C | PHE | B | 119 | −31.149 | −2.406 | 127.478 | 1.00 | 29.17 | C |
| ATOM | 2539 | O | PHE | B | 119 | −32.037 | −2.018 | 126.706 | 1.00 | 31.62 | O |
| ATOM | 2540 | CB | PHE | B | 119 | −30.163 | −4.224 | 126.148 | 1.00 | 26.03 | C |
| ATOM | 2541 | CG | PHE | B | 119 | −29.643 | −5.603 | 126.045 | 1.00 | 29.01 | C |
| ATOM | 2542 | CD1 | PHE | B | 119 | −28.383 | −5.913 | 126.505 | 1.00 | 26.67 | C |
| ATOM | 2543 | CD2 | PHE | B | 119 | −30.400 | −6.594 | 125.430 | 1.00 | 30.15 | C |
| ATOM | 2544 | CE1 | PHE | B | 119 | −27.897 | −7.200 | 126.403 | 1.00 | 29.34 | C |
| ATOM | 2545 | CE2 | PHE | B | 119 | −29.927 | −7.882 | 125.314 | 1.00 | 25.71 | C |
| ATOM | 2546 | CZ | PHE | B | 119 | −28.670 | −8.191 | 125.806 | 1.00 | 29.15 | C |
| ATOM | 2547 | N | PRO | B | 120 | −30.468 | −1.550 | 128.231 | 1.00 | 34.18 | N |
| ATOM | 2548 | CA | PRO | B | 120 | −30.747 | −0.106 | 128.152 | 1.00 | 34.68 | C |
| ATOM | 2549 | C | PRO | B | 120 | −30.251 | 0.460 | 126.834 | 1.00 | 34.50 | C |
| ATOM | 2550 | O | PRO | B | 120 | −29.378 | −0.140 | 126.188 | 1.00 | 36.34 | O |
| ATOM | 2551 | CB | PRO | B | 120 | −29.963 | 0.474 | 129.339 | 1.00 | 33.20 | C |
| ATOM | 2552 | CG | PRO | B | 120 | −29.568 | −0.746 | 130.190 | 1.00 | 37.48 | C |
| ATOM | 2553 | CD | PRO | B | 120 | −29.417 | −1.862 | 129.212 | 1.00 | 32.46 | C |
| ATOM | 2554 | N | PRO | B | 121 | −30.761 | 1.616 | 126.402 | 1.00 | 35.15 | N |
| ATOM | 2555 | CA | PRO | B | 121 | −30.200 | 2.248 | 125.203 | 1.00 | 34.06 | C |
| ATOM | 2556 | C | PRO | B | 121 | −28.766 | 2.697 | 125.452 | 1.00 | 32.75 | C |
| ATOM | 2557 | O | PRO | B | 121 | −28.410 | 3.117 | 126.551 | 1.00 | 34.53 | O |
| ATOM | 2558 | CB | PRO | B | 121 | −31.138 | 3.436 | 124.958 | 1.00 | 30.93 | C |
| ATOM | 2559 | CG | PRO | B | 121 | −31.733 | 3.718 | 126.279 | 1.00 | 29.12 | C |
| ATOM | 2560 | CD | PRO | B | 121 | −31.870 | 2.404 | 126.965 | 1.00 | 30.02 | C |
| ATOM | 2561 | N | SER | B | 122 | −27.930 | 2.583 | 124.431 | 1.00 | 35.60 | N |
| ATOM | 2562 | CA | SER | B | 122 | −26.558 | 3.043 | 124.576 | 1.00 | 40.70 | C |
| ATOM | 2563 | C | SER | B | 122 | −26.517 | 4.570 | 124.585 | 1.00 | 42.19 | C |
| ATOM | 2564 | O | SER | B | 122 | −27.311 | 5.239 | 123.913 | 1.00 | 40.94 | O |
| ATOM | 2565 | CB | SER | B | 122 | −25.677 | 2.503 | 123.437 | 1.00 | 38.69 | C |
| ATOM | 2566 | OG | SER | B | 122 | −25.921 | 3.200 | 122.223 | 1.00 | 33.97 | O |
| ATOM | 2567 | N | ASP | B | 123 | −25.550 | 5.120 | 125.328 | 1.00 | 41.84 | N |
| ATOM | 2568 | CA | ASP | B | 123 | −25.391 | 6.569 | 125.357 | 1.00 | 44.12 | C |
| ATOM | 2569 | C | ASP | B | 123 | −25.119 | 7.126 | 123.965 | 1.00 | 48.91 | C |
| ATOM | 2570 | O | ASP | B | 123 | −25.453 | 8.285 | 123.682 | 1.00 | 47.81 | O |
| ATOM | 2571 | CB | ASP | B | 123 | −24.267 | 6.968 | 126.311 | 1.00 | 47.34 | C |
| ATOM | 2572 | CG | ASP | B | 123 | −24.693 | 6.950 | 127.779 | 1.00 | 59.18 | C |
| ATOM | 2573 | OD1 | ASP | B | 123 | −25.864 | 7.272 | 128.086 | 1.00 | 59.74 | O |
| ATOM | 2574 | OD2 | ASP | B | 123 | −23.839 | 6.640 | 128.638 | 1.00 | 65.74 | O1− |
| ATOM | 2575 | N | GLU | B | 124 | −24.542 | 6.312 | 123.079 | 1.00 | 44.91 | N |
| ATOM | 2576 | CA | GLU | B | 124 | −24.273 | 6.776 | 121.722 | 1.00 | 48.45 | C |
| ATOM | 2577 | C | GLU | B | 124 | −25.559 | 7.001 | 120.919 | 1.00 | 48.55 | C |
| ATOM | 2578 | O | GLU | B | 124 | −25.649 | 7.962 | 120.145 | 1.00 | 48.61 | O |
| ATOM | 2579 | CB | GLU | B | 124 | −23.360 | 5.788 | 121.014 | 1.00 | 46.13 | C |
| ATOM | 2580 | CG | GLU | B | 124 | −22.949 | 6.279 | 119.661 | 1.00 | 52.72 | C |
| ATOM | 2581 | CD | GLU | B | 124 | −22.264 | 5.209 | 118.846 | 1.00 | 59.55 | C |
| ATOM | 2582 | OE1 | GLU | B | 124 | −22.167 | 5.408 | 117.608 | 1.00 | 50.04 | O |
| ATOM | 2583 | OE2 | GLU | B | 124 | −21.850 | 4.175 | 119.443 | 1.00 | 55.47 | O1− |
| ATOM | 2584 | N | GLN | B | 125 | −26.574 | 6.143 | 121.093 | 1.00 | 46.17 | N |
| ATOM | 2585 | CA | GLN | B | 125 | −27.839 | 6.369 | 120.391 | 1.00 | 41.17 | C |
| ATOM | 2586 | C | GLN | B | 125 | −28.632 | 7.506 | 121.018 | 1.00 | 44.73 | C |
| ATOM | 2587 | O | GLN | B | 125 | −29.391 | 8.187 | 120.315 | 1.00 | 41.05 | O |
| ATOM | 2588 | CB | GLN | B | 125 | −28.687 | 5.095 | 120.366 | 1.00 | 36.73 | C |
| ATOM | 2589 | CG | GLN | B | 125 | −30.012 | 5.222 | 119.593 | 1.00 | 33.48 | C |
| ATOM | 2590 | CD | GLN | B | 125 | −31.023 | 4.118 | 119.918 | 1.00 | 37.11 | C |
| ATOM | 2591 | OE1 | GLN | B | 125 | −30.936 | 3.430 | 120.947 | 1.00 | 35.61 | O |
| ATOM | 2592 | NE2 | GLN | B | 125 | −31.976 | 3.925 | 119.016 | 1.00 | 41.82 | N |
| ATOM | 2593 | N | LEU | B | 126 | −28.493 | 7.704 | 122.337 | 1.00 | 43.68 | N |
| ATOM | 2594 | CA | LEU | B | 126 | −29.168 | 8.813 | 123.006 | 1.00 | 45.10 | C |
| ATOM | 2595 | C | LEU | B | 126 | −28.719 | 10.152 | 122.434 | 1.00 | 49.62 | C |

TABLE 10.4-continued

| | | | | | | | | | | |
|---|---|---|---|---|---|---|---|---|---|---|
| ATOM | 2596 | O | LEU | B | 126 | −29.526 | 11.085 | 122.313 | 1.00 | 49.20 | O |
| ATOM | 2597 | CB | LEU | B | 126 | −28.906 | 8.751 | 124.510 | 1.00 | 46.51 | C |
| ATOM | 2598 | CG | LEU | B | 126 | −29.691 | 7.699 | 125.300 | 1.00 | 44.00 | C |
| ATOM | 2599 | CD1 | LEU | B | 126 | −29.263 | 7.692 | 126.754 | 1.00 | 37.07 | C |
| ATOM | 2600 | CD2 | LEU | B | 126 | −31.208 | 7.898 | 125.167 | 1.00 | 36.79 | C |
| ATOM | 2601 | N | LYS | B | 127 | −27.428 | 10.263 | 122.083 | 1.00 | 47.40 | N |
| ATOM | 2602 | CA | LYS | B | 127 | −26.902 | 11.463 | 121.438 | 1.00 | 44.91 | C |
| ATOM | 2603 | C | LYS | B | 127 | −27.707 | 11.875 | 120.208 | 1.00 | 50.97 | C |
| ATOM | 2604 | O | LYS | B | 127 | −27.782 | 13.065 | 119.883 | 1.00 | 56.06 | O |
| ATOM | 2605 | CB | LYS | B | 127 | −25.441 | 11.244 | 121.060 | 1.00 | 53.95 | C |
| ATOM | 2606 | CG | LYS | B | 127 | −24.474 | 11.931 | 122.009 | 1.00 | 65.16 | C |
| ATOM | 2607 | CD | LYS | B | 127 | −24.039 | 11.038 | 123.160 | 1.00 | 60.17 | C |
| ATOM | 2608 | CE | LYS | B | 127 | −22.846 | 10.198 | 122.738 | 1.00 | 65.63 | C |
| ATOM | 2609 | NZ | LYS | B | 127 | −21.833 | 11.021 | 122.005 | 1.00 | 65.70 | N1+ |
| ATOM | 2610 | N | SER | B | 128 | −28.302 | 10.918 | 119.506 | 1.00 | 48.42 | N |
| ATOM | 2611 | CA | SER | B | 128 | −29.026 | 11.194 | 118.274 | 1.00 | 44.86 | C |
| ATOM | 2612 | C | SER | B | 128 | −30.527 | 11.393 | 118.485 | 1.00 | 48.97 | C |
| ATOM | 2613 | O | SER | B | 128 | −31.271 | 11.432 | 117.498 | 1.00 | 56.04 | O |
| ATOM | 2614 | CB | SER | B | 128 | −28.814 | 10.057 | 117.266 | 1.00 | 51.64 | C |
| ATOM | 2615 | OG | SER | B | 128 | −29.460 | 8.856 | 117.686 | 1.00 | 48.78 | O |
| ATOM | 2616 | N | GLY | B | 129 | −30.999 | 11.500 | 119.728 | 1.00 | 42.11 | N |
| ATOM | 2617 | CA | GLY | B | 129 | −32.383 | 11.859 | 119.953 | 1.00 | 39.56 | C |
| ATOM | 2618 | C | GLY | B | 129 | −33.356 | 10.703 | 120.071 | 1.00 | 47.15 | C |
| ATOM | 2619 | O | GLY | B | 129 | −34.553 | 10.945 | 120.312 | 1.00 | 45.83 | O |
| ATOM | 2620 | N | THR | B | 130 | −32.894 | 9.459 | 119.903 | 1.00 | 44.00 | N |
| ATOM | 2621 | CA | THR | B | 130 | −33.745 | 8.278 | 119.983 | 1.00 | 37.83 | C |
| ATOM | 2622 | C | THR | B | 130 | −33.231 | 7.272 | 121.008 | 1.00 | 36.90 | C |
| ATOM | 2623 | O | THR | B | 130 | −32.023 | 7.117 | 121.190 | 1.00 | 41.23 | O |
| ATOM | 2624 | CB | THR | B | 130 | −33.871 | 7.637 | 118.606 | 1.00 | 40.93 | C |
| ATOM | 2625 | OG1 | THR | B | 130 | −34.572 | 8.543 | 117.740 | 1.00 | 34.84 | O |
| ATOM | 2626 | CG2 | THR | B | 130 | −34.617 | 6.297 | 118.679 | 1.00 | 44.09 | C |
| ATOM | 2627 | N | ALA | B | 131 | −34.155 | 6.598 | 121.686 | 1.00 | 35.77 | N |
| ATOM | 2628 | CA | ALA | B | 131 | −33.841 | 5.535 | 122.636 | 1.00 | 35.93 | C |
| ATOM | 2629 | C | ALA | B | 131 | −34.469 | 4.216 | 122.186 | 1.00 | 35.42 | C |
| ATOM | 2630 | O | ALA | B | 131 | −35.693 | 4.128 | 121.999 | 1.00 | 37.68 | O |
| ATOM | 2631 | CB | ALA | B | 131 | −34.346 | 5.896 | 124.039 | 1.00 | 33.77 | C |
| ATOM | 2632 | N | SER | B | 132 | −33.645 | 3.183 | 122.055 | 1.00 | 29.61 | N |
| ATOM | 2633 | CA | SER | B | 132 | −34.127 | 1.837 | 121.791 | 1.00 | 29.37 | C |
| ATOM | 2634 | C | SER | B | 132 | −33.845 | 0.960 | 122.999 | 1.00 | 24.73 | C |
| ATOM | 2635 | O | SER | B | 132 | −32.689 | 0.774 | 123.367 | 1.00 | 30.61 | O |
| ATOM | 2636 | CB | SER | B | 132 | −33.466 | 1.265 | 120.545 | 1.00 | 28.99 | C |
| ATOM | 2637 | OG | SER | B | 132 | −33.838 | 2.013 | 119.420 | 1.00 | 32.09 | O |
| ATOM | 2638 | N | VAL | B | 133 | −34.890 | 0.411 | 123.599 | 1.00 | 29.26 | N |
| ATOM | 2639 | CA | VAL | B | 133 | −34.753 | −0.593 | 124.654 | 1.00 | 30.39 | C |
| ATOM | 2640 | C | VAL | B | 133 | −35.021 | −1.960 | 124.044 | 1.00 | 28.40 | C |
| ATOM | 2641 | O | VAL | B | 133 | −35.963 | −2.123 | 123.264 | 1.00 | 30.58 | O |
| ATOM | 2642 | CB | VAL | B | 133 | −35.717 | −0.303 | 125.816 | 1.00 | 29.07 | C |
| ATOM | 2643 | CG1 | VAL | B | 133 | −35.309 | −1.095 | 127.049 | 1.00 | 27.89 | C |
| ATOM | 2644 | CG2 | VAL | B | 133 | −35.751 | 1.186 | 126.090 | 1.00 | 26.20 | C |
| ATOM | 2645 | N | VAL | B | 134 | −34.203 | −2.948 | 124.392 | 1.00 | 26.36 | N |
| ATOM | 2646 | CA | VAL | B | 134 | −34.262 | −4.261 | 123.762 | 1.00 | 28.94 | C |
| ATOM | 2647 | C | VAL | B | 134 | −34.505 | −5.315 | 124.830 | 1.00 | 29.71 | C |
| ATOM | 2648 | O | VAL | B | 134 | −33.851 | −5.305 | 125.880 | 1.00 | 30.17 | O |
| ATOM | 2649 | CB | VAL | B | 134 | −32.973 | −4.576 | 122.980 | 1.00 | 30.23 | C |
| ATOM | 2650 | CG1 | VAL | B | 134 | −33.115 | −5.912 | 122.281 | 1.00 | 22.43 | C |
| ATOM | 2651 | CG2 | VAL | B | 134 | −32.648 | −3.460 | 121.991 | 1.00 | 24.76 | C |
| ATOM | 2652 | N | CYS | B | 135 | −35.438 | −6.226 | 124.560 | 1.00 | 27.09 | N |
| ATOM | 2653 | CA | CYS | B | 135 | −35.688 | −7.373 | 125.423 | 1.00 | 30.29 | C |
| ATOM | 2654 | C | CYS | B | 135 | −35.351 | −8.641 | 124.645 | 1.00 | 30.83 | C |
| ATOM | 2655 | O | CYS | B | 135 | −35.841 | −8.828 | 123.528 | 1.00 | 31.86 | O |
| ATOM | 2656 | CB | CYS | B | 135 | −37.149 | −7.402 | 125.895 | 1.00 | 28.77 | C |
| ATOM | 2657 | SG | CYS | B | 135 | −37.549 | −8.569 | 127.279 | 1.00 | 36.90 | S |
| ATOM | 2658 | N | LEU | B | 136 | −34.537 | −9.514 | 125.236 | 1.00 | 28.65 | N |
| ATOM | 2659 | CA | LEU | B | 136 | −34.113 | −10.767 | 124.610 | 1.00 | 26.89 | C |
| ATOM | 2660 | C | LEU | B | 136 | −34.712 | −11.963 | 125.340 | 1.00 | 27.49 | C |
| ATOM | 2661 | O | LEU | B | 136 | −34.462 | −12.158 | 126.536 | 1.00 | 26.81 | O |
| ATOM | 2662 | CB | LEU | B | 136 | −32.587 | −10.874 | 124.591 | 1.00 | 23.26 | C |
| ATOM | 2663 | CG | LEU | B | 136 | −32.021 | −12.242 | 124.215 | 1.00 | 26.55 | C |
| ATOM | 2664 | CD1 | LEU | B | 136 | −32.394 | −12.677 | 122.784 | 1.00 | 29.37 | C |
| ATOM | 2665 | CD2 | LEU | B | 136 | −30.539 | −12.206 | 124.383 | 1.00 | 26.86 | C |
| ATOM | 2666 | N | LEU | B | 137 | −35.471 | −12.776 | 124.612 | 1.00 | 27.17 | N |
| ATOM | 2667 | CA | LEU | B | 137 | −36.003 | −14.046 | 125.109 | 1.00 | 24.46 | C |
| ATOM | 2668 | C | LEU | B | 137 | −35.244 | −15.151 | 124.412 | 1.00 | 25.24 | C |
| ATOM | 2669 | O | LEU | B | 137 | −35.476 | −15.416 | 123.232 | 1.00 | 27.19 | O |
| ATOM | 2670 | CB | LEU | B | 137 | −37.498 | −14.197 | 124.847 | 1.00 | 24.41 | C |
| ATOM | 2671 | CG | LEU | B | 137 | −38.513 | −13.411 | 125.671 | 1.00 | 26.56 | C |
| ATOM | 2672 | CD1 | LEU | B | 137 | −38.301 | −11.899 | 125.512 | 1.00 | 22.36 | C |
| ATOM | 2673 | CD2 | LEU | B | 137 | −39.922 | −13.845 | 125.275 | 1.00 | 24.34 | C |
| ATOM | 2674 | N | ASN | B | 138 | −34.374 | −15.820 | 125.147 | 1.00 | 27.07 | N |
| ATOM | 2675 | CA | ASN | B | 138 | −33.403 | −16.731 | 124.575 | 1.00 | 27.89 | C |

TABLE 10.4-continued

| ATOM | 2676 | C | ASN | B | 138 | −33.800 | −18.186 | 124.822 | 1.00 | 28.77 | C |
|---|---|---|---|---|---|---|---|---|---|---|---|
| ATOM | 2677 | O | ASN | B | 138 | −34.161 | −18.546 | 125.945 | 1.00 | 33.61 | O |
| ATOM | 2678 | CB | ASN | B | 138 | −32.033 | −16.411 | 125.163 | 1.00 | 31.08 | C |
| ATOM | 2679 | CG | ASN | B | 138 | −30.904 | −16.806 | 124.256 | 1.00 | 37.01 | C |
| ATOM | 2680 | OD1 | ASN | B | 138 | −30.870 | −16.438 | 123.076 | 1.00 | 34.03 | O |
| ATOM | 2681 | ND2 | ASN | B | 138 | −29.933 | −17.509 | 124.815 | 1.00 | 40.66 | N |
| ATOM | 2682 | N | ASN | B | 139 | −33.800 | −18.987 | 123.747 | 1.00 | 26.63 | N |
| ATOM | 2683 | CA | ASN | B | 139 | −33.861 | −20.463 | 123.722 | 1.00 | 26.50 | C |
| ATOM | 2684 | C | ASN | B | 139 | −35.075 | −21.037 | 124.462 | 1.00 | 25.84 | C |
| ATOM | 2685 | O | ASN | B | 139 | −34.958 | −21.778 | 125.436 | 1.00 | 30.08 | O |
| ATOM | 2686 | CB | ASN | B | 139 | −32.559 | −21.104 | 124.220 | 1.00 | 27.61 | C |
| ATOM | 2687 | CG | ASN | B | 139 | −31.415 | −20.897 | 123.232 | 1.00 | 35.63 | C |
| ATOM | 2688 | OD1 | ASN | B | 139 | −31.150 | −19.770 | 122.822 | 1.00 | 31.84 | O |
| ATOM | 2689 | ND2 | ASN | B | 139 | −30.785 | −21.990 | 122.787 | 1.00 | 33.37 | N |
| ATOM | 2690 | N | PHE | B | 140 | −36.249 | −20.756 | 123.903 | 1.00 | 27.05 | N |
| ATOM | 2691 | CA | PHE | B | 140 | −37.494 | −21.275 | 124.449 | 1.00 | 28.39 | C |
| ATOM | 2692 | C | PHE | B | 140 | −38.206 | −22.147 | 123.413 | 1.00 | 30.25 | C |
| ATOM | 2693 | O | PHE | B | 140 | −37.990 | −22.032 | 122.203 | 1.00 | 30.54 | O |
| ATOM | 2694 | CB | PHE | B | 140 | −38.430 | −20.144 | 124.905 | 1.00 | 25.56 | C |
| ATOM | 2695 | CG | PHE | B | 140 | −38.791 | −19.192 | 123.813 | 1.00 | 27.91 | C |
| ATOM | 2696 | CD1 | PHE | B | 140 | −37.989 | −18.086 | 123.541 | 1.00 | 25.72 | C |
| ATOM | 2697 | CD2 | PHE | B | 140 | −39.922 | −19.410 | 123.030 | 1.00 | 27.50 | C |
| ATOM | 2698 | CE1 | PHE | B | 140 | −38.309 | −17.202 | 122.515 | 1.00 | 24.13 | C |
| ATOM | 2699 | CE2 | PHE | B | 140 | −40.257 | −18.524 | 122.002 | 1.00 | 29.76 | C |
| ATOM | 2700 | CZ | PHE | B | 140 | −39.438 | −17.415 | 121.744 | 1.00 | 27.82 | C |
| ATOM | 2701 | N | TYR | B | 141 | −39.054 | −23.030 | 123.914 | 1.00 | 27.15 | N |
| ATOM | 2702 | CA | TYR | B | 141 | −39.947 | −23.833 | 123.101 | 1.00 | 27.13 | C |
| ATOM | 2703 | C | TYR | B | 141 | −41.183 | −24.086 | 123.982 | 1.00 | 29.40 | C |
| ATOM | 2704 | O | TYR | B | 141 | −41.048 | −24.404 | 125.162 | 1.00 | 28.49 | O |
| ATOM | 2705 | CB | TYR | B | 141 | −39.278 | −25.150 | 122.634 | 1.00 | 27.47 | C |
| ATOM | 2706 | CG | TYR | B | 141 | −40.171 | −25.919 | 121.693 | 1.00 | 28.08 | C |
| ATOM | 2707 | CD1 | TYR | B | 141 | −41.133 | −26.780 | 122.196 | 1.00 | 30.33 | C |
| ATOM | 2708 | CD2 | TYR | B | 141 | −40.098 | −25.746 | 120.308 | 1.00 | 24.75 | C |
| ATOM | 2709 | CE1 | TYR | B | 141 | −42.002 | −27.456 | 121.359 | 1.00 | 30.51 | C |
| ATOM | 2710 | CE2 | TYR | B | 141 | −40.969 | −26.402 | 119.464 | 1.00 | 25.25 | C |
| ATOM | 2711 | CZ | TYR | B | 141 | −41.930 | −27.270 | 120.002 | 1.00 | 30.79 | C |
| ATOM | 2712 | OH | TYR | B | 141 | −42.841 | −27.974 | 119.229 | 1.00 | 28.57 | O |
| ATOM | 2713 | N | PRO | B | 142 | −42.394 | −23.975 | 123.414 | 1.00 | 29.92 | N |
| ATOM | 2714 | CA | PRO | B | 142 | −42.663 | −23.735 | 121.996 | 1.00 | 28.29 | C |
| ATOM | 2715 | C | PRO | B | 142 | −42.638 | −22.263 | 121.586 | 1.00 | 29.24 | C |
| ATOM | 2716 | O | PRO | B | 142 | −42.345 | −21.399 | 122.404 | 1.00 | 30.25 | O |
| ATOM | 2717 | CB | PRO | B | 142 | −44.067 | −24.327 | 121.825 | 1.00 | 28.67 | C |
| ATOM | 2718 | CG | PRO | B | 142 | −44.726 | −24.029 | 123.121 | 1.00 | 25.40 | C |
| ATOM | 2719 | CD | PRO | B | 142 | −43.635 | −24.261 | 124.160 | 1.00 | 27.51 | C |
| ATOM | 2720 | N | ARG | B | 143 | −43.042 | −22.022 | 120.332 | 1.00 | 33.09 | N |
| ATOM | 2721 | CA | ARG | B | 143 | −42.828 | −20.754 | 119.634 | 1.00 | 32.76 | C |
| ATOM | 2722 | C | ARG | B | 143 | −43.567 | −19.587 | 120.289 | 1.00 | 33.19 | C |
| ATOM | 2723 | O | ARG | B | 143 | −43.061 | −18.461 | 120.295 | 1.00 | 34.09 | O |
| ATOM | 2724 | CB | ARG | B | 143 | −43.256 | −20.953 | 118.174 | 1.00 | 30.54 | C |
| ATOM | 2725 | CG | ARG | B | 143 | −43.343 | −19.750 | 117.269 | 1.00 | 30.54 | C |
| ATOM | 2726 | CD | ARG | B | 143 | −42.071 | −19.508 | 116.495 | 1.00 | 35.91 | C |
| ATOM | 2727 | NE | ARG | B | 143 | −42.253 | −18.751 | 115.239 | 1.00 | 36.61 | N |
| ATOM | 2728 | CZ | ARG | B | 143 | −42.878 | −17.569 | 115.145 | 1.00 | 37.84 | C |
| ATOM | 2729 | NH1 | ARG | B | 143 | −43.464 | −17.009 | 116.203 | 1.00 | 40.08 | N1+ |
| ATOM | 2730 | NH2 | ARG | B | 143 | −42.943 | −16.947 | 113.987 | 1.00 | 35.58 | N |
| ATOM | 2731 | N | GLU | B | 144 | −44.743 | −19.837 | 120.856 | 1.00 | 31.25 | N |
| ATOM | 2732 | CA | GLU | B | 144 | −45.607 | −18.768 | 121.346 | 1.00 | 35.56 | C |
| ATOM | 2733 | C | GLU | B | 144 | −45.024 | −18.121 | 122.602 | 1.00 | 34.95 | C |
| ATOM | 2734 | O | GLU | B | 144 | −44.602 | −18.808 | 123.537 | 1.00 | 34.88 | O |
| ATOM | 2735 | CB | GLU | B | 144 | −47.021 | −19.299 | 121.646 | 1.00 | 30.65 | C |
| ATOM | 2736 | CG | GLU | B | 144 | −47.821 | −19.817 | 120.448 | 1.00 | 34.84 | C |
| ATOM | 2737 | CD | GLU | B | 144 | −47.385 | −21.206 | 119.951 | 1.00 | 44.49 | C |
| ATOM | 2738 | OE1 | GLU | B | 144 | −47.117 | −22.107 | 120.783 | 1.00 | 41.20 | O |
| ATOM | 2739 | OE2 | GLU | B | 144 | −47.333 | −21.404 | 118.716 | 1.00 | 47.18 | O1− |
| ATOM | 2740 | N | ALA | B | 145 | −45.002 | −16.795 | 122.623 | 1.00 | 29.26 | N |
| ATOM | 2741 | CA | ALA | B | 145 | −44.486 | −16.077 | 123.774 | 1.00 | 34.47 | C |
| ATOM | 2742 | C | ALA | B | 145 | −45.102 | −14.691 | 123.756 | 1.00 | 33.83 | C |
| ATOM | 2743 | O | ALA | B | 145 | −45.457 | −14.194 | 122.684 | 1.00 | 35.59 | O |
| ATOM | 2744 | CB | ALA | B | 145 | −42.952 | −16.007 | 123.737 | 1.00 | 31.26 | C |
| ATOM | 2745 | N | LYS | B | 146 | −45.250 | −14.077 | 124.937 | 1.00 | 26.49 | N |
| ATOM | 2746 | CA | LYS | B | 146 | −45.754 | −12.707 | 125.026 | 1.00 | 28.76 | C |
| ATOM | 2747 | C | LYS | B | 146 | −44.766 | −11.790 | 125.756 | 1.00 | 32.11 | C |
| ATOM | 2748 | O | LYS | B | 146 | −44.336 | −12.085 | 126.880 | 1.00 | 25.51 | O |
| ATOM | 2749 | CB | LYS | B | 146 | −47.130 | −12.683 | 125.687 | 1.00 | 34.49 | C |
| ATOM | 2750 | CG | LYS | B | 146 | −47.879 | −11.354 | 125.547 | 1.00 | 44.62 | C |
| ATOM | 2751 | CD | LYS | B | 146 | −49.339 | −11.502 | 126.002 | 1.00 | 51.17 | C |
| ATOM | 2752 | CE | LYS | B | 146 | −50.157 | −10.231 | 125.771 | 1.00 | 55.61 | C |
| ATOM | 2753 | NZ | LYS | B | 146 | −51.627 | −10.552 | 125.678 | 1.00 | 51.90 | N1+ |
| ATOM | 2754 | N | VAL | B | 147 | −44.417 | −10.672 | 125.113 | 1.00 | 32.22 | N |
| ATOM | 2755 | CA | VAL | B | 147 | −43.616 | −9.609 | 125.712 | 1.00 | 28.21 | C |

TABLE 10.4-continued

| | | | | | | | | | | |
|---|---|---|---|---|---|---|---|---|---|---|
| ATOM | 2756 | C | VAL | B | 147 | −44.534 | −8.434 | 126.015 | 1.00 | 34.36 | C |
| ATOM | 2757 | O | VAL | B | 147 | −45.332 | −8.029 | 125.165 | 1.00 | 33.36 | O |
| ATOM | 2758 | CB | VAL | B | 147 | −42.464 | −9.160 | 124.794 | 1.00 | 27.98 | C |
| ATOM | 2759 | CG1 | VAL | B | 147 | −41.768 | −7.931 | 125.372 | 1.00 | 29.12 | C |
| ATOM | 2760 | CG2 | VAL | B | 147 | −41.472 | −10.275 | 124.560 | 1.00 | 32.19 | C |
| ATOM | 2761 | N | GLN | B | 148 | −44.444 | −7.904 | 127.230 | 1.00 | 35.67 | N |
| ATOM | 2762 | CA | GLN | B | 148 | −45.128 | −6.673 | 127.593 | 1.00 | 36.29 | C |
| ATOM | 2763 | C | GLN | B | 148 | −44.100 | −5.665 | 128.073 | 1.00 | 33.05 | C |
| ATOM | 2764 | O | GLN | B | 148 | −43.303 | −5.968 | 128.966 | 1.00 | 29.76 | O |
| ATOM | 2765 | CB | GLN | B | 148 | −46.192 | −6.913 | 128.676 | 1.00 | 36.98 | C |
| ATOM | 2766 | CG | GLN | B | 148 | −47.614 | −6.800 | 128.154 | 1.00 | 47.87 | C |
| ATOM | 2767 | CD | GLN | B | 148 | −48.651 | −7.188 | 129.192 | 1.00 | 64.59 | C |
| ATOM | 2768 | OE1 | GLN | B | 148 | −48.420 | −7.050 | 130.398 | 1.00 | 64.90 | O |
| ATOM | 2769 | NE2 | GLN | B | 148 | −49.806 | −7.674 | 128.728 | 1.00 | 58.09 | N |
| ATOM | 2770 | N | TRP | B | 149 | −44.099 | −4.485 | 127.465 | 1.00 | 34.92 | N |
| ATOM | 2771 | CA | TRP | B | 149 | −43.234 | −3.400 | 127.918 | 1.00 | 35.07 | C |
| ATOM | 2772 | C | TRP | B | 149 | −43.941 | −2.522 | 128.952 | 1.00 | 31.98 | C |
| ATOM | 2773 | O | TRP | B | 149 | −45.105 | −2.154 | 128.778 | 1.00 | 33.16 | O |
| ATOM | 2774 | CB | TRP | B | 149 | −42.797 | −2.549 | 126.730 | 1.00 | 28.25 | C |
| ATOM | 2775 | CG | TRP | B | 149 | −41.704 | −3.158 | 125.876 | 1.00 | 31.59 | C |
| ATOM | 2776 | CD1 | TRP | B | 149 | −41.851 | −3.717 | 124.640 | 1.00 | 28.61 | C |
| ATOM | 2777 | CD2 | TRP | B | 149 | −40.305 | −3.236 | 126.186 | 1.00 | 28.06 | C |
| ATOM | 2778 | NE1 | TRP | B | 149 | −40.640 | −4.134 | 124.164 | 1.00 | 31.98 | N |
| ATOM | 2779 | CE2 | TRP | B | 149 | −39.671 | −3.852 | 125.091 | 1.00 | 31.31 | C |
| ATOM | 2780 | CE3 | TRP | B | 149 | −39.529 | −2.842 | 127.280 | 1.00 | 32.39 | C |
| ATOM | 2781 | CZ2 | TRP | B | 149 | −38.289 | −4.080 | 125.048 | 1.00 | 29.16 | C |
| ATOM | 2782 | CZ3 | TRP | B | 149 | −38.159 | −3.066 | 127.242 | 1.00 | 36.30 | C |
| ATOM | 2783 | CH2 | TRP | B | 149 | −37.550 | −3.676 | 126.125 | 1.00 | 32.50 | C |
| ATOM | 2784 | N | LYS | B | 150 | −43.228 | −2.174 | 130.023 | 1.00 | 34.33 | N |
| ATOM | 2785 | CA | LYS | B | 150 | −43.736 | −1.240 | 131.030 | 1.00 | 35.21 | C |
| ATOM | 2786 | C | LYS | B | 150 | −42.711 | −0.143 | 131.257 | 1.00 | 36.04 | C |
| ATOM | 2787 | O | LYS | B | 150 | −41.534 | −0.433 | 131.489 | 1.00 | 40.23 | O |
| ATOM | 2788 | CB | LYS | B | 150 | −44.050 | −1.918 | 132.374 | 1.00 | 29.19 | C |
| ATOM | 2789 | CG | LYS | B | 150 | −45.326 | −2.755 | 132.421 | 1.00 | 32.86 | C |
| ATOM | 2790 | CD | LYS | B | 150 | −45.296 | −3.677 | 133.643 | 1.00 | 42.43 | C |
| ATOM | 2791 | CE | LYS | B | 150 | −46.327 | −4.800 | 133.536 | 1.00 | 54.13 | C |
| ATOM | 2792 | NZ | LYS | B | 150 | −46.598 | −5.502 | 134.839 | 1.00 | 48.84 | N1+ |
| ATOM | 2793 | N | VAL | B | 151 | −43.158 | 1.107 | 131.189 | 1.00 | 34.12 | N |
| ATOM | 2794 | CA | VAL | B | 151 | −42.355 | 2.270 | 131.559 | 1.00 | 34.61 | C |
| ATOM | 2795 | C | VAL | B | 151 | −43.003 | 2.921 | 132.784 | 1.00 | 36.08 | C |
| ATOM | 2796 | O | VAL | B | 151 | −44.118 | 3.448 | 132.699 | 1.00 | 35.70 | O |
| ATOM | 2797 | CB | VAL | B | 151 | −42.241 | 3.255 | 130.392 | 1.00 | 31.07 | C |
| ATOM | 2798 | CG1 | VAL | B | 151 | −41.307 | 4.377 | 130.732 | 1.00 | 31.60 | C |
| ATOM | 2799 | CG2 | VAL | B | 151 | −41.752 | 2.528 | 129.173 | 1.00 | 37.80 | C |
| ATOM | 2800 | N | ASP | B | 152 | −42.299 | 2.902 | 133.921 | 1.00 | 39.23 | N |
| ATOM | 2801 | CA | ASP | B | 152 | −42.854 | 3.340 | 135.217 | 1.00 | 38.88 | C |
| ATOM | 2802 | C | ASP | B | 152 | −44.243 | 2.743 | 135.428 | 1.00 | 37.74 | C |
| ATOM | 2803 | O | ASP | B | 152 | −45.194 | 3.412 | 135.836 | 1.00 | 35.76 | O |
| ATOM | 2804 | CB | ASP | B | 152 | −42.848 | 4.863 | 135.343 | 1.00 | 36.31 | C |
| ATOM | 2805 | CG | ASP | B | 152 | −41.451 | 5.404 | 135.628 | 1.00 | 44.31 | C |
| ATOM | 2806 | OD1 | ASP | B | 152 | −40.688 | 4.719 | 136.357 | 1.00 | 39.45 | O |
| ATOM | 2807 | OD2 | ASP | B | 152 | −41.093 | 6.479 | 135.094 | 1.00 | 46.68 | O1− |
| ATOM | 2808 | N | ASN | B | 153 | −44.333 | 1.457 | 135.097 | 1.00 | 38.94 | N |
| ATOM | 2809 | CA | ASN | B | 153 | −45.491 | 0.579 | 135.212 | 1.00 | 39.28 | C |
| ATOM | 2810 | C | ASN | B | 153 | −46.660 | 0.990 | 134.321 | 1.00 | 37.08 | C |
| ATOM | 2811 | O | ASN | B | 153 | −47.783 | 0.508 | 134.502 | 1.00 | 39.74 | O |
| ATOM | 2812 | CB | ASN | B | 153 | −45.933 | 0.433 | 136.666 | 1.00 | 37.94 | C |
| ATOM | 2813 | CG | ASN | B | 153 | −46.502 | −0.927 | 136.937 | 1.00 | 41.53 | C |
| ATOM | 2814 | OD1 | ASN | B | 153 | −47.693 | −1.071 | 137.197 | 1.00 | 48.49 | O |
| ATOM | 2815 | ND2 | ASN | B | 153 | −45.658 | −1.953 | 136.827 | 1.00 | 47.40 | N |
| ATOM | 2816 | N | ALA | B | 154 | −46.418 | 1.824 | 133.322 | 1.00 | 27.73 | N |
| ATOM | 2817 | CA | ALA | B | 154 | −47.403 | 2.060 | 132.281 | 1.00 | 31.59 | C |
| ATOM | 2818 | C | ALA | B | 154 | −47.152 | 1.064 | 131.145 | 1.00 | 35.73 | C |
| ATOM | 2819 | O | ALA | B | 154 | −46.034 | 1.006 | 130.611 | 1.00 | 34.76 | O |
| ATOM | 2820 | CB | ALA | B | 154 | −47.314 | 3.503 | 131.785 | 1.00 | 30.19 | C |
| ATOM | 2821 | N | LEU | B | 155 | −48.168 | 0.246 | 130.817 | 1.00 | 31.02 | N |
| ATOM | 2822 | CA | LEU | B | 155 | −48.092 | −0.680 | 129.680 | 1.00 | 29.47 | C |
| ATOM | 2823 | C | LEU | B | 155 | −47.940 | 0.045 | 128.364 | 1.00 | 29.26 | C |
| ATOM | 2824 | O | LEU | B | 155 | −48.816 | 0.809 | 127.967 | 1.00 | 32.19 | O |
| ATOM | 2825 | CB | LEU | B | 155 | −49.321 | −1.578 | 129.581 | 1.00 | 26.14 | C |
| ATOM | 2826 | CG | LEU | B | 155 | −49.137 | −2.963 | 130.188 | 1.00 | 41.59 | C |
| ATOM | 2827 | CD1 | LEU | B | 155 | −49.358 | −2.997 | 131.716 | 1.00 | 37.40 | C |
| ATOM | 2828 | CD2 | LEU | B | 155 | −49.966 | −3.985 | 129.430 | 1.00 | 49.03 | C |
| ATOM | 2829 | N | GLN | B | 156 | −46.891 | −0.293 | 127.632 | 1.00 | 32.37 | N |
| ATOM | 2830 | CA | GLN | B | 156 | −46.687 | 0.225 | 126.289 | 1.00 | 31.54 | C |
| ATOM | 2831 | C | GLN | B | 156 | −47.433 | −0.647 | 125.293 | 1.00 | 27.02 | C |
| ATOM | 2832 | O | GLN | B | 156 | −47.493 | −1.864 | 125.444 | 1.00 | 36.94 | O |
| ATOM | 2833 | CB | GLN | B | 156 | −45.193 | 0.270 | 125.966 | 1.00 | 31.74 | C |
| ATOM | 2834 | CG | GLN | B | 156 | −44.395 | 0.948 | 127.069 | 1.00 | 31.12 | C |
| ATOM | 2835 | CD | GLN | B | 156 | −44.877 | 2.358 | 127.299 | 1.00 | 33.29 | C |

TABLE 10.4-continued

| | | | | | | | | | | |
|---|---|---|---|---|---|---|---|---|---|---|
| ATOM | 2836 | OE1 | GLN | B | 156 | −44.789 | 3.213 | 126.412 | 1.00 | 33.92 | O |
| ATOM | 2837 | NE2 | GLN | B | 156 | −45.445 | 2.599 | 128.470 | 1.00 | 34.06 | N |
| ATOM | 2838 | N | SER | B | 157 | −48.069 | −0.017 | 124.322 | 1.00 | 25.15 | N |
| ATOM | 2839 | CA | SER | B | 157 | −48.818 | −0.745 | 123.309 | 1.00 | 24.13 | C |
| ATOM | 2840 | C | SER | B | 157 | −48.684 | 0.008 | 121.998 | 1.00 | 28.91 | C |
| ATOM | 2841 | O | SER | B | 157 | −49.132 | 1.153 | 121.903 | 1.00 | 33.39 | O |
| ATOM | 2842 | CB | SER | B | 157 | −50.284 | −0.869 | 123.724 | 1.00 | 27.59 | C |
| ATOM | 2843 | OG | SER | B | 157 | −51.056 | −1.511 | 122.738 | 1.00 | 34.07 | O |
| ATOM | 2844 | N | GLY | B | 158 | −48.052 | −0.597 | 121.005 | 1.00 | 23.39 | N |
| ATOM | 2845 | CA | GLY | B | 158 | −47.959 | 0.017 | 119.698 | 1.00 | 22.69 | C |
| ATOM | 2846 | C | GLY | B | 158 | −46.630 | 0.665 | 119.370 | 1.00 | 26.97 | C |
| ATOM | 2847 | O | GLY | B | 158 | −46.467 | 1.166 | 118.256 | 1.00 | 30.74 | O |
| ATOM | 2848 | N | ASN | B | 159 | −45.695 | 0.721 | 120.312 | 1.00 | 26.14 | N |
| ATOM | 2849 | CA | ASN | B | 159 | −44.412 | 1.373 | 120.086 | 1.00 | 25.51 | C |
| ATOM | 2850 | C | ASN | B | 159 | −43.236 | 0.401 | 120.206 | 1.00 | 30.63 | C |
| ATOM | 2851 | O | ASN | B | 159 | −42.149 | 0.779 | 120.660 | 1.00 | 25.81 | O |
| ATOM | 2852 | CB | ASN | B | 159 | −44.236 | 2.542 | 121.043 | 1.00 | 22.42 | C |
| ATOM | 2853 | CG | ASN | B | 159 | −44.537 | 2.165 | 122.463 | 1.00 | 29.01 | C |
| ATOM | 2854 | OD1 | ASN | B | 159 | −44.940 | 1.021 | 122.757 | 1.00 | 30.10 | O |
| ATOM | 2855 | ND2 | ASN | B | 159 | −44.335 | 3.114 | 123.370 | 1.00 | 32.61 | N |
| ATOM | 2856 | N | SER | B | 160 | −43.439 | −0.859 | 119.819 | 1.00 | 27.65 | N |
| ATOM | 2857 | CA | SER | B | 160 | −42.360 | −1.827 | 119.814 | 1.00 | 29.05 | C |
| ATOM | 2858 | C | SER | B | 160 | −42.510 | −2.753 | 118.615 | 1.00 | 28.89 | C |
| ATOM | 2859 | O | SER | B | 160 | −43.602 | −2.939 | 118.089 | 1.00 | 29.48 | O |
| ATOM | 2860 | CB | SER | B | 160 | −42.328 | −2.626 | 121.112 | 1.00 | 26.29 | C |
| ATOM | 2861 | OG | SER | B | 160 | −43.447 | −3.475 | 121.181 | 1.00 | 31.67 | O |
| ATOM | 2862 | N | GLN | B | 161 | −41.400 | −3.357 | 118.197 | 1.00 | 28.03 | N |
| ATOM | 2863 | CA | GLN | B | 161 | −41.425 | −4.362 | 117.147 | 1.00 | 26.96 | C |
| ATOM | 2864 | C | GLN | B | 161 | −40.634 | −5.596 | 117.581 | 1.00 | 31.51 | C |
| ATOM | 2865 | O | GLN | B | 161 | −39.759 | −5.537 | 118.451 | 1.00 | 30.01 | O |
| ATOM | 2866 | CB | GLN | B | 161 | −40.871 | −3.794 | 115.850 | 1.00 | 27.24 | C |
| ATOM | 2867 | CG | GLN | B | 161 | −41.747 | −2.764 | 115.183 | 1.00 | 27.43 | C |
| ATOM | 2868 | CD | GLN | B | 161 | −41.064 | −2.142 | 113.976 | 1.00 | 35.97 | C |
| ATOM | 2869 | OE1 | GLN | B | 161 | −40.203 | −1.267 | 114.121 | 1.00 | 35.92 | O |
| ATOM | 2870 | NE2 | GLN | B | 161 | −41.418 | −2.607 | 112.782 | 1.00 | 30.28 | N |
| ATOM | 2871 | N | GLU | B | 162 | −40.938 | −6.720 | 116.938 | 1.00 | 31.79 | N |
| ATOM | 2872 | CA | GLU | B | 162 | −40.438 | −8.034 | 117.331 | 1.00 | 29.63 | C |
| ATOM | 2873 | C | GLU | B | 162 | −40.040 | −8.837 | 116.104 | 1.00 | 30.95 | C |
| ATOM | 2874 | O | GLU | B | 162 | −40.654 | −8.718 | 115.042 | 1.00 | 26.14 | O |
| ATOM | 2875 | CB | GLU | B | 162 | −41.503 | −8.877 | 117.989 | 1.00 | 23.86 | C |
| ATOM | 2876 | CG | GLU | B | 162 | −41.567 | −8.969 | 119.420 | 1.00 | 34.85 | C |
| ATOM | 2877 | CD | GLU | B | 162 | −42.807 | −9.765 | 119.781 | 1.00 | 41.65 | C |
| ATOM | 2878 | OE1 | GLU | B | 162 | −43.430 | −10.284 | 118.835 | 1.00 | 38.04 | O |
| ATOM | 2879 | OE2 | GLU | B | 162 | −43.177 | −9.858 | 120.973 | 1.00 | 45.93 | O1− |
| ATOM | 2880 | N | SER | B | 163 | −39.057 | −9.712 | 116.280 | 1.00 | 31.61 | N |
| ATOM | 2881 | CA | SER | B | 163 | −38.794 | −10.763 | 115.312 | 1.00 | 25.04 | C |
| ATOM | 2882 | C | SER | B | 163 | −38.348 | −11.995 | 116.088 | 1.00 | 28.10 | C |
| ATOM | 2883 | O | SER | B | 163 | −37.857 | −11.890 | 117.218 | 1.00 | 25.85 | O |
| ATOM | 2884 | CB | SER | B | 163 | −37.781 | −10.326 | 114.254 | 1.00 | 26.93 | C |
| ATOM | 2885 | OG | SER | B | 163 | −36.461 | −10.447 | 114.714 | 1.00 | 29.93 | O |
| ATOM | 2886 | N | VAL | B | 164 | −38.587 | −13.169 | 115.504 | 1.00 | 29.93 | N |
| ATOM | 2887 | CA | VAL | B | 164 | −38.200 | −14.441 | 116.104 | 1.00 | 26.45 | C |
| ATOM | 2888 | C | VAL | B | 164 | −37.323 | −15.214 | 115.130 | 1.00 | 23.48 | C |
| ATOM | 2889 | O | VAL | B | 164 | −37.520 | −15.156 | 113.918 | 1.00 | 28.17 | O |
| ATOM | 2890 | CB | VAL | B | 164 | −39.430 | −15.281 | 116.521 | 1.00 | 30.77 | C |
| ATOM | 2891 | CG1 | VAL | B | 164 | −40.375 | −14.468 | 117.392 | 1.00 | 26.66 | C |
| ATOM | 2892 | CG2 | VAL | B | 164 | −40.156 | −15.786 | 115.308 | 1.00 | 40.64 | C |
| ATOM | 2893 | N | THR | B | 165 | −36.328 | −15.908 | 115.663 | 1.00 | 28.51 | N |
| ATOM | 2894 | CA | THR | B | 165 | −35.442 | −16.716 | 114.848 | 1.00 | 27.61 | C |
| ATOM | 2895 | C | THR | B | 165 | −36.154 | −17.967 | 114.344 | 1.00 | 29.58 | C |
| ATOM | 2896 | O | THR | B | 165 | −37.279 | −18.300 | 114.751 | 1.00 | 28.80 | O |
| ATOM | 2897 | CB | THR | B | 165 | −34.195 | −17.113 | 115.641 | 1.00 | 28.32 | C |
| ATOM | 2898 | OG1 | THR | B | 165 | −34.575 | −17.596 | 116.939 | 1.00 | 33.79 | O |
| ATOM | 2899 | CG2 | THR | B | 165 | −33.275 | −15.942 | 115.795 | 1.00 | 25.22 | C |
| ATOM | 2900 | N | GLU | B | 166 | −35.489 | −18.634 | 113.402 | 1.00 | 28.57 | N |
| ATOM | 2901 | CA | GLU | B | 166 | −35.851 | −19.992 | 113.026 | 1.00 | 29.18 | C |
| ATOM | 2902 | C | GLU | B | 166 | −35.474 | −20.953 | 114.149 | 1.00 | 25.81 | C |
| ATOM | 2903 | O | GLU | B | 166 | −34.705 | −20.622 | 115.046 | 1.00 | 28.21 | O |
| ATOM | 2904 | CB | GLU | B | 166 | −35.158 | −20.398 | 111.722 | 1.00 | 25.69 | C |
| ATOM | 2905 | CG | GLU | B | 166 | −35.615 | −19.673 | 110.472 | 1.00 | 23.14 | C |
| ATOM | 2906 | CD | GLU | B | 166 | −37.112 | −19.776 | 110.263 | 1.00 | 35.69 | C |
| ATOM | 2907 | OE1 | GLU | B | 166 | −37.691 | −20.801 | 110.689 | 1.00 | 45.01 | O |
| ATOM | 2908 | OE2 | GLU | B | 166 | −37.715 | −18.853 | 109.661 | 1.00 | 37.00 | O1− |
| ATOM | 2909 | N | GLN | B | 167 | −36.061 | −22.138 | 114.120 | 1.00 | 29.35 | N |
| ATOM | 2910 | CA | GLN | B | 167 | −35.749 | −23.146 | 115.126 | 1.00 | 27.70 | C |
| ATOM | 2911 | C | GLN | B | 167 | −34.250 | −23.426 | 115.143 | 1.00 | 26.23 | C |
| ATOM | 2912 | O | GLN | B | 167 | −33.622 | −23.530 | 114.093 | 1.00 | 25.94 | O |
| ATOM | 2913 | CB | GLN | B | 167 | −36.538 | −24.406 | 114.823 | 1.00 | 25.14 | C |
| ATOM | 2914 | CG | GLN | B | 167 | −36.995 | −25.171 | 116.012 | 1.00 | 27.67 | C |
| ATOM | 2915 | CD | GLN | B | 167 | −38.037 | −26.211 | 115.661 | 1.00 | 25.13 | C |

TABLE 10.4-continued

| | | | | | | | | | | |
|---|---|---|---|---|---|---|---|---|---|---|
| ATOM | 2916 | OE1 | GLN | B | 167 | −38.324 | −26.473 | 114.489 | 1.00 | 27.17 | O |
| ATOM | 2917 | NE2 | GLN | B | 167 | −38.591 | −26.819 | 116.672 | 1.00 | 23.92 | N |
| ATOM | 2918 | N | ASP | B | 168 | −33.660 | −23.496 | 116.338 | 1.00 | 30.80 | N |
| ATOM | 2919 | CA | ASP | B | 168 | −32.202 | −23.493 | 116.448 | 1.00 | 28.93 | C |
| ATOM | 2920 | C | ASP | B | 168 | −31.602 | −24.806 | 115.962 | 1.00 | 31.78 | C |
| ATOM | 2921 | O | ASP | B | 168 | −31.981 | −25.882 | 116.433 | 1.00 | 30.59 | O |
| ATOM | 2922 | CB | ASP | B | 168 | −31.771 | −23.268 | 117.895 | 1.00 | 31.58 | C |
| ATOM | 2923 | CG | ASP | B | 168 | −30.269 | −23.104 | 118.028 | 1.00 | 34.74 | C |
| ATOM | 2924 | OD1 | ASP | B | 168 | −29.610 | −24.086 | 118.410 | 1.00 | 36.21 | O1− |
| ATOM | 2925 | OD2 | ASP | B | 168 | −29.737 | −22.026 | 117.677 | 1.00 | 38.15 | O |
| ATOM | 2926 | N | SER | B | 169 | −30.583 | −24.714 | 115.101 | 1.00 | 37.85 | N |
| ATOM | 2927 | CA | SER | B | 169 | −30.001 | −25.906 | 114.488 | 1.00 | 32.86 | C |
| ATOM | 2928 | C | SER | B | 169 | −29.342 | −26.845 | 115.487 | 1.00 | 33.78 | C |
| ATOM | 2929 | O | SER | B | 169 | −29.068 | −27.992 | 115.126 | 1.00 | 37.40 | O |
| ATOM | 2930 | CB | SER | B | 169 | −28.999 | −25.515 | 113.412 | 1.00 | 35.71 | C |
| ATOM | 2931 | OG | SER | B | 169 | −27.919 | −24.817 | 113.973 | 1.00 | 45.05 | O |
| ATOM | 2932 | N | LYS | B | 170 | −29.105 | −26.415 | 116.725 | 1.00 | 35.30 | N |
| ATOM | 2933 | CA | LYS | B | 170 | −28.484 | −27.260 | 117.742 | 1.00 | 32.69 | C |
| ATOM | 2934 | C | LYS | B | 170 | −29.445 | −27.779 | 118.816 | 1.00 | 33.51 | C |
| ATOM | 2935 | O | LYS | B | 170 | −29.365 | −28.957 | 119.161 | 1.00 | 33.92 | O |
| ATOM | 2936 | CB | LYS | B | 170 | −27.311 | −26.510 | 118.389 | 1.00 | 32.22 | C |
| ATOM | 2937 | CG | LYS | B | 170 | −26.523 | −27.313 | 119.398 | 1.00 | 35.45 | C |
| ATOM | 2938 | CD | LYS | B | 170 | −25.696 | −26.399 | 120.284 | 1.00 | 39.33 | C |
| ATOM | 2939 | CE | LYS | B | 170 | −24.687 | −27.150 | 121.125 | 1.00 | 41.85 | C |
| ATOM | 2940 | NZ | LYS | B | 170 | −23.466 | −26.291 | 121.260 | 1.00 | 49.14 | N1+ |
| ATOM | 2941 | N | ASP | B | 171 | −30.386 | −26.985 | 119.360 | 1.00 | 29.53 | N |
| ATOM | 2942 | CA | ASP | B | 171 | −31.298 | −27.535 | 120.366 | 1.00 | 24.54 | C |
| ATOM | 2943 | C | ASP | B | 171 | −32.772 | −27.335 | 120.036 | 1.00 | 25.46 | C |
| ATOM | 2944 | O | ASP | B | 171 | −33.615 | −27.519 | 120.926 | 1.00 | 22.30 | O |
| ATOM | 2945 | CB | ASP | B | 171 | −31.001 | −27.011 | 121.795 | 1.00 | 25.26 | C |
| ATOM | 2946 | CG | ASP | B | 171 | −31.151 | −25.471 | 121.965 | 1.00 | 35.81 | C |
| ATOM | 2947 | OD1 | ASP | B | 171 | −31.871 | −24.789 | 121.205 | 1.00 | 38.80 | O |
| ATOM | 2948 | OD2 | ASP | B | 171 | −30.555 | −24.925 | 122.927 | 1.00 | 42.26 | O1− |
| ATOM | 2949 | N | SER | B | 172 | −33.096 | −26.958 | 118.791 | 1.00 | 24.40 | N |
| ATOM | 2950 | CA | SER | B | 172 | −34.458 | −26.783 | 118.271 | 1.00 | 22.81 | C |
| ATOM | 2951 | C | SER | B | 172 | −35.296 | −25.735 | 119.023 | 1.00 | 29.46 | C |
| ATOM | 2952 | O | SER | B | 172 | −36.540 | −25.777 | 118.980 | 1.00 | 30.46 | O |
| ATOM | 2953 | CB | SER | B | 172 | −35.204 | −28.122 | 118.240 | 1.00 | 27.26 | C |
| ATOM | 2954 | OG | SER | B | 172 | −34.476 | −29.076 | 117.480 | 1.00 | 29.50 | O |
| ATOM | 2955 | N | THR | B | 173 | −34.685 | −24.758 | 119.688 | 1.00 | 26.53 | N |
| ATOM | 2956 | CA | THR | B | 173 | −35.479 | −23.750 | 120.371 | 1.00 | 30.13 | C |
| ATOM | 2957 | C | THR | B | 173 | −35.667 | −22.512 | 119.487 | 1.00 | 28.94 | C |
| ATOM | 2958 | O | THR | B | 173 | −35.137 | −22.397 | 118.377 | 1.00 | 28.80 | O |
| ATOM | 2959 | CB | THR | B | 173 | −34.869 | −23.380 | 121.742 | 1.00 | 29.06 | C |
| ATOM | 2960 | OG1 | THR | B | 173 | −33.536 | −22.886 | 121.592 | 1.00 | 27.56 | O |
| ATOM | 2961 | CG2 | THR | B | 173 | −34.849 | −24.577 | 122.671 | 1.00 | 23.15 | C |
| ATOM | 2962 | N | TYR | B | 174 | −36.479 | −21.598 | 119.989 | 1.00 | 27.86 | N |
| ATOM | 2963 | CA | TYR | B | 174 | −36.710 | −20.306 | 119.375 | 1.00 | 27.59 | C |
| ATOM | 2964 | C | TYR | B | 174 | −36.103 | −19.210 | 120.245 | 1.00 | 28.01 | C |
| ATOM | 2965 | O | TYR | B | 174 | −35.906 | −19.388 | 121.452 | 1.00 | 28.60 | O |
| ATOM | 2966 | CB | TYR | B | 174 | −38.210 | −20.069 | 119.181 | 1.00 | 27.30 | C |
| ATOM | 2967 | CG | TYR | B | 174 | −38.818 | −20.983 | 118.147 | 1.00 | 30.86 | C |
| ATOM | 2968 | CD1 | TYR | B | 174 | −38.743 | −20.672 | 116.791 | 1.00 | 26.78 | C |
| ATOM | 2969 | CD2 | TYR | B | 174 | −39.452 | −22.171 | 118.521 | 1.00 | 31.18 | C |
| ATOM | 2970 | CE1 | TYR | B | 174 | −39.283 | −21.496 | 115.842 | 1.00 | 27.76 | C |
| ATOM | 2971 | CE2 | TYR | B | 174 | −39.994 | −23.016 | 117.567 | 1.00 | 30.49 | C |
| ATOM | 2972 | CZ | TYR | B | 174 | −39.906 | −22.666 | 116.224 | 1.00 | 31.46 | C |
| ATOM | 2973 | OH | TYR | B | 174 | −40.448 | −23.480 | 115.262 | 1.00 | 32.46 | O |
| ATOM | 2974 | N | SER | B | 175 | −35.773 | −18.087 | 119.621 | 1.00 | 26.84 | N |
| ATOM | 2975 | CA | SER | B | 175 | −35.396 | −16.886 | 120.355 | 1.00 | 28.52 | C |
| ATOM | 2976 | C | SER | B | 175 | −36.172 | −15.696 | 119.814 | 1.00 | 28.84 | C |
| ATOM | 2977 | O | SER | B | 175 | −36.595 | −15.687 | 118.656 | 1.00 | 24.93 | O |
| ATOM | 2978 | CB | SER | B | 175 | −33.904 | −16.608 | 120.274 | 1.00 | 31.06 | C |
| ATOM | 2979 | OG | SER | B | 175 | −33.199 | −17.479 | 121.133 | 1.00 | 35.19 | O |
| ATOM | 2980 | N | LEU | B | 176 | −36.367 | −14.694 | 120.671 | 1.00 | 29.11 | N |
| ATOM | 2981 | CA | LEU | B | 176 | −37.165 | −13.529 | 120.323 | 1.00 | 27.58 | C |
| ATOM | 2982 | C | LEU | B | 176 | −36.445 | −12.262 | 120.739 | 1.00 | 24.37 | C |
| ATOM | 2983 | O | LEU | B | 176 | −35.796 | −12.218 | 121.779 | 1.00 | 27.04 | O |
| ATOM | 2984 | CB | LEU | B | 176 | −38.553 | −13.589 | 120.973 | 1.00 | 29.13 | C |
| ATOM | 2985 | CG | LEU | B | 176 | −39.558 | −12.517 | 120.560 | 1.00 | 30.07 | C |
| ATOM | 2986 | CD1 | LEU | B | 176 | −40.920 | −13.129 | 120.631 | 1.00 | 30.39 | C |
| ATOM | 2987 | CD2 | LEU | B | 176 | −39.485 | −11.303 | 121.483 | 1.00 | 24.93 | C |
| ATOM | 2988 | N | SER | B | 177 | −36.556 | −11.235 | 119.905 | 1.00 | 29.33 | N |
| ATOM | 2989 | CA | SER | B | 177 | −35.972 | −9.932 | 120.178 | 1.00 | 26.82 | C |
| ATOM | 2990 | C | SER | B | 177 | −37.041 | −8.863 | 119.992 | 1.00 | 27.17 | C |
| ATOM | 2991 | O | SER | B | 177 | −37.669 | −8.809 | 118.934 | 1.00 | 25.25 | O |
| ATOM | 2992 | CB | SER | B | 177 | −34.782 | −9.694 | 119.255 | 1.00 | 26.28 | C |
| ATOM | 2993 | OG | SER | B | 177 | −34.307 | −8.377 | 119.379 | 1.00 | 27.89 | O |
| ATOM | 2994 | N | SER | B | 178 | −37.232 | −8.006 | 121.013 | 1.00 | 25.92 | N |
| ATOM | 2995 | CA | SER | B | 178 | −38.255 | −6.966 | 121.020 | 1.00 | 23.84 | C |

TABLE 10.4-continued

| | | | | | | | | | | |
|---|---|---|---|---|---|---|---|---|---|---|
| ATOM | 2996 | C | SER | B | 178 | −37.624 | −5.603 | 121.261 | 1.00 | 27.80 | C |
| ATOM | 2997 | O | SER | B | 178 | −36.822 | −5.443 | 122.189 | 1.00 | 29.43 | O |
| ATOM | 2998 | CB | SER | B | 178 | −39.308 | −7.226 | 122.096 | 1.00 | 28.27 | C |
| ATOM | 2999 | OG | SER | B | 178 | −40.307 | −6.215 | 122.090 | 1.00 | 26.54 | O |
| ATOM | 3000 | N | THR | B | 179 | −38.007 | −4.617 | 120.444 | 1.00 | 26.02 | N |
| ATOM | 3001 | CA | THR | B | 179 | −37.450 | −3.266 | 120.535 | 1.00 | 30.99 | C |
| ATOM | 3002 | C | THR | B | 179 | −38.536 | −2.247 | 120.809 | 1.00 | 25.23 | C |
| ATOM | 3003 | O | THR | B | 179 | −39.357 | −1.967 | 119.938 | 1.00 | 24.43 | O |
| ATOM | 3004 | CB | THR | B | 179 | −36.714 | −2.839 | 119.274 | 1.00 | 31.29 | C |
| ATOM | 3005 | OG1 | THR | B | 179 | −35.681 | −3.781 | 118.962 | 1.00 | 35.76 | O |
| ATOM | 3006 | CG2 | THR | B | 179 | −36.121 | −1.472 | 119.512 | 1.00 | 23.65 | C |
| ATOM | 3007 | N | LEU | B | 180 | −38.489 | −1.662 | 121.997 | 1.00 | 26.49 | N |
| ATOM | 3008 | CA | LEU | B | 180 | −39.263 | −0.482 | 122.349 | 1.00 | 28.48 | C |
| ATOM | 3009 | C | LEU | B | 180 | −38.502 | 0.769 | 121.939 | 1.00 | 24.67 | C |
| ATOM | 3010 | O | LEU | B | 180 | −37.356 | 0.949 | 122.350 | 1.00 | 26.90 | O |
| ATOM | 3011 | CB | LEU | B | 180 | −39.510 | −0.482 | 123.855 | 1.00 | 30.84 | C |
| ATOM | 3012 | CG | LEU | B | 180 | −40.291 | 0.643 | 124.498 | 1.00 | 34.83 | C |
| ATOM | 3013 | CD1 | LEU | B | 180 | −41.724 | 0.580 | 123.976 | 1.00 | 34.95 | C |
| ATOM | 3014 | CD2 | LEU | B | 180 | −40.215 | 0.471 | 126.015 | 1.00 | 31.30 | C |
| ATOM | 3015 | N | THR | B | 181 | −39.142 | 1.642 | 121.161 | 1.00 | 25.09 | N |
| ATOM | 3016 | CA | THR | B | 181 | −38.529 | 2.892 | 120.712 | 1.00 | 34.09 | C |
| ATOM | 3017 | C | THR | B | 181 | −39.245 | 4.090 | 121.341 | 1.00 | 40.80 | C |
| ATOM | 3018 | O | THR | B | 181 | −40.484 | 4.142 | 121.354 | 1.00 | 36.26 | O |
| ATOM | 3019 | CB | THR | B | 181 | −38.548 | 3.005 | 119.181 | 1.00 | 33.92 | C |
| ATOM | 3020 | OG1 | THR | B | 181 | −37.870 | 1.881 | 118.610 | 1.00 | 36.57 | O |
| ATOM | 3021 | CG2 | THR | B | 181 | −37.793 | 4.230 | 118.744 | 1.00 | 36.41 | C |
| ATOM | 3022 | N | LEU | B | 182 | −38.452 | 5.031 | 121.882 | 1.00 | 36.61 | N |
| ATOM | 3023 | CA | LEU | B | 182 | −38.910 | 6.286 | 122.483 | 1.00 | 33.83 | C |
| ATOM | 3024 | C | LEU | B | 182 | −38.034 | 7.434 | 121.997 | 1.00 | 37.62 | C |
| ATOM | 3025 | O | LEU | B | 182 | −36.923 | 7.235 | 121.506 | 1.00 | 36.88 | O |
| ATOM | 3026 | CB | LEU | B | 182 | −38.837 | 6.287 | 124.017 | 1.00 | 39.93 | C |
| ATOM | 3027 | CG | LEU | B | 182 | −39.550 | 5.271 | 124.901 | 1.00 | 43.75 | C |
| ATOM | 3028 | CD1 | LEU | B | 182 | −39.188 | 5.503 | 126.364 | 1.00 | 42.80 | C |
| ATOM | 3029 | CD2 | LEU | B | 182 | −41.051 | 5.401 | 124.698 | 1.00 | 48.91 | C |
| ATOM | 3030 | N | SER | B | 183 | −38.515 | 8.653 | 122.183 | 1.00 | 40.17 | N |
| ATOM | 3031 | CA | SER | B | 183 | −37.616 | 9.784 | 122.023 | 1.00 | 39.39 | C |
| ATOM | 3032 | C | SER | B | 183 | −36.639 | 9.844 | 123.195 | 1.00 | 39.08 | C |
| ATOM | 3033 | O | SER | B | 183 | −36.882 | 9.278 | 124.259 | 1.00 | 39.26 | O |
| ATOM | 3034 | CB | SER | B | 183 | −38.401 | 11.088 | 121.963 | 1.00 | 38.95 | C |
| ATOM | 3035 | OG | SER | B | 183 | −39.031 | 11.322 | 123.210 | 1.00 | 35.92 | O |
| ATOM | 3036 | N | LYS | B | 184 | −35.510 | 10.530 | 122.986 | 1.00 | 42.26 | N |
| ATOM | 3037 | CA | LYS | B | 184 | −34.617 | 10.803 | 124.109 | 1.00 | 40.17 | C |
| ATOM | 3038 | C | LYS | B | 184 | −35.348 | 11.566 | 125.208 | 1.00 | 41.28 | C |
| ATOM | 3039 | O | LYS | B | 184 | −35.138 | 11.310 | 126.401 | 1.00 | 38.53 | O |
| ATOM | 3040 | CB | LYS | B | 184 | −33.405 | 11.605 | 123.646 | 1.00 | 42.87 | C |
| ATOM | 3041 | CG | LYS | B | 184 | −32.462 | 11.986 | 124.806 | 1.00 | 52.77 | C |
| ATOM | 3042 | CD | LYS | B | 184 | −31.228 | 12.771 | 124.339 | 1.00 | 51.17 | C |
| ATOM | 3043 | CE | LYS | B | 184 | −30.325 | 13.153 | 125.500 | 1.00 | 56.17 | C |
| ATOM | 3044 | NZ | LYS | B | 184 | −30.191 | 14.632 | 125.670 | 1.00 | 63.96 | N1+ |
| ATOM | 3045 | N | ALA | B | 185 | −36.219 | 12.500 | 124.816 | 1.00 | 39.51 | N |
| ATOM | 3046 | CA | ALA | B | 185 | −36.995 | 13.275 | 125.780 | 1.00 | 38.41 | C |
| ATOM | 3047 | C | ALA | B | 185 | −37.914 | 12.389 | 126.613 | 1.00 | 39.82 | C |
| ATOM | 3048 | O | ALA | B | 185 | −37.897 | 12.456 | 127.844 | 1.00 | 44.20 | O |
| ATOM | 3049 | CB | ALA | B | 185 | −37.806 | 14.346 | 125.057 | 1.00 | 33.82 | C |
| ATOM | 3050 | N | ASP | B | 186 | −38.764 | 11.591 | 125.959 | 1.00 | 42.91 | N |
| ATOM | 3051 | CA | ASP | B | 186 | −39.646 | 10.690 | 126.697 | 1.00 | 37.37 | C |
| ATOM | 3052 | C | ASP | B | 186 | −38.844 | 9.750 | 127.573 | 1.00 | 37.99 | C |
| ATOM | 3053 | O | ASP | B | 186 | −39.192 | 9.506 | 128.736 | 1.00 | 37.79 | O |
| ATOM | 3054 | CB | ASP | B | 186 | −40.512 | 9.876 | 125.739 | 1.00 | 42.26 | C |
| ATOM | 3055 | CG | ASP | B | 186 | −41.589 | 10.703 | 125.065 | 1.00 | 48.82 | C |
| ATOM | 3056 | OD1 | ASP | B | 186 | −42.264 | 11.496 | 125.752 | 1.00 | 49.68 | O |
| ATOM | 3057 | OD2 | ASP | B | 186 | −41.778 | 10.531 | 123.839 | 1.00 | 61.13 | O1− |
| ATOM | 3058 | N | TYR | B | 187 | −37.781 | 9.181 | 127.006 | 1.00 | 41.31 | N |
| ATOM | 3059 | CA | TYR | B | 187 | −36.932 | 8.262 | 127.745 | 1.00 | 37.24 | C |
| ATOM | 3060 | C | TYR | B | 187 | −36.398 | 8.907 | 129.016 | 1.00 | 35.05 | C |
| ATOM | 3061 | O | TYR | B | 187 | −36.349 | 8.272 | 130.075 | 1.00 | 36.76 | O |
| ATOM | 3062 | CB | TYR | B | 187 | −35.786 | 7.785 | 126.852 | 1.00 | 37.33 | C |
| ATOM | 3063 | CG | TYR | B | 187 | −34.823 | 6.915 | 127.604 | 1.00 | 37.18 | C |
| ATOM | 3064 | CD1 | TYR | B | 187 | −35.223 | 5.663 | 128.068 | 1.00 | 34.09 | C |
| ATOM | 3065 | CD2 | TYR | B | 187 | −33.539 | 7.359 | 127.900 | 1.00 | 27.91 | C |
| ATOM | 3066 | CE1 | TYR | B | 187 | −34.363 | 4.870 | 128.780 | 1.00 | 33.76 | C |
| ATOM | 3067 | CE2 | TYR | B | 187 | −32.678 | 6.577 | 128.618 | 1.00 | 30.33 | C |
| ATOM | 3068 | CZ | TYR | B | 187 | −33.090 | 5.328 | 129.058 | 1.00 | 31.48 | C |
| ATOM | 3069 | OH | TYR | B | 187 | −32.233 | 4.528 | 129.785 | 1.00 | 31.99 | O |
| ATOM | 3070 | N | GLU | B | 188 | −35.991 | 10.166 | 128.935 | 1.00 | 39.77 | N |
| ATOM | 3071 | CA | GLU | B | 188 | −35.344 | 10.782 | 130.083 | 1.00 | 44.77 | C |
| ATOM | 3072 | C | GLU | B | 188 | −36.325 | 11.334 | 131.097 | 1.00 | 40.36 | C |
| ATOM | 3073 | O | GLU | B | 188 | −35.879 | 11.832 | 132.131 | 1.00 | 41.81 | O |
| ATOM | 3074 | CB | GLU | B | 188 | −34.358 | 11.849 | 129.625 | 1.00 | 39.20 | C |
| ATOM | 3075 | CG | GLU | B | 188 | −32.978 | 11.224 | 129.620 | 1.00 | 45.15 | C |

TABLE 10.4-continued

| | | | | | | | | | | |
|---|---|---|---|---|---|---|---|---|---|---|
| ATOM | 3076 | CD | GLU | B | 188 | −31.974 | 11.914 | 128.723 | 1.00 | 56.05 | C |
| ATOM | 3077 | OE1 | GLU | B | 188 | −32.317 | 12.924 | 128.049 | 1.00 | 48.75 | O |
| ATOM | 3078 | OE2 | GLU | B | 188 | −30.831 | 11.394 | 128.688 | 1.00 | 59.27 | O1− |
| ATOM | 3079 | N | LYS | B | 189 | −37.630 | 11.197 | 130.852 | 1.00 | 37.43 | N |
| ATOM | 3080 | CA | LYS | B | 189 | −38.687 | 11.560 | 131.788 | 1.00 | 38.07 | C |
| ATOM | 3081 | C | LYS | B | 189 | −39.236 | 10.363 | 132.579 | 1.00 | 40.62 | C |
| ATOM | 3082 | O | LYS | B | 189 | −40.315 | 10.465 | 133.167 | 1.00 | 46.60 | O |
| ATOM | 3083 | CB | LYS | B | 189 | −39.813 | 12.270 | 131.030 | 1.00 | 37.89 | C |
| ATOM | 3084 | CG | LYS | B | 189 | −39.327 | 13.568 | 130.380 | 1.00 | 51.23 | C |
| ATOM | 3085 | CD | LYS | B | 189 | −40.333 | 14.215 | 129.404 | 1.00 | 62.14 | C |
| ATOM | 3086 | CE | LYS | B | 189 | −39.717 | 15.470 | 128.720 | 1.00 | 60.71 | C |
| ATOM | 3087 | NZ | LYS | B | 189 | −40.587 | 16.123 | 127.684 | 1.00 | 51.31 | N1+ |
| ATOM | 3088 | N | HIS | B | 190 | −38.541 | 9.223 | 132.588 | 1.00 | 41.83 | N |
| ATOM | 3089 | CA | HIS | B | 190 | −39.025 | 8.026 | 133.271 | 1.00 | 35.94 | C |
| ATOM | 3090 | C | HIS | B | 190 | −37.865 | 7.259 | 133.879 | 1.00 | 35.72 | C |
| ATOM | 3091 | O | HIS | B | 190 | −36.701 | 7.484 | 133.543 | 1.00 | 36.41 | O |
| ATOM | 3092 | CB | HIS | B | 190 | −39.810 | 7.120 | 132.337 | 1.00 | 37.87 | C |
| ATOM | 3093 | CG | HIS | B | 190 | −41.069 | 7.745 | 131.840 | 1.00 | 37.33 | C |
| ATOM | 3094 | ND1 | HIS | B | 190 | −41.173 | 8.323 | 130.596 | 1.00 | 40.44 | N |
| ATOM | 3095 | CD2 | HIS | B | 190 | −42.264 | 7.926 | 132.442 | 1.00 | 37.28 | C |
| ATOM | 3096 | CE1 | HIS | B | 190 | −42.386 | 8.813 | 130.442 | 1.00 | 36.52 | C |
| ATOM | 3097 | NE2 | HIS | B | 190 | −43.068 | 8.583 | 131.548 | 1.00 | 42.61 | N |
| ATOM | 3098 | N | LYS | B | 191 | −38.188 | 6.365 | 134.806 | 1.00 | 32.95 | N |
| ATOM | 3099 | CA | LYS | B | 191 | −37.139 | 5.707 | 135.580 | 1.00 | 44.01 | C |
| ATOM | 3100 | C | LYS | B | 191 | −37.065 | 4.204 | 135.352 | 1.00 | 37.37 | C |
| ATOM | 3101 | O | LYS | B | 191 | −35.988 | 3.687 | 135.032 | 1.00 | 37.81 | O |
| ATOM | 3102 | CB | LYS | B | 191 | −37.316 | 6.017 | 137.084 | 1.00 | 41.79 | C |
| ATOM | 3103 | CG | LYS | B | 191 | −36.346 | 5.312 | 138.042 | 1.00 | 43.26 | C |
| ATOM | 3104 | CD | LYS | B | 191 | −36.731 | 5.623 | 139.511 | 1.00 | 54.07 | C |
| ATOM | 3105 | CE | LYS | B | 191 | −35.668 | 5.177 | 140.515 | 1.00 | 56.60 | C |
| ATOM | 3106 | NZ | LYS | B | 191 | −36.031 | 5.546 | 141.905 | 1.00 | 51.73 | N1+ |
| ATOM | 3107 | N | VAL | B | 192 | −38.164 | 3.482 | 135.530 | 1.00 | 31.57 | N |
| ATOM | 3108 | CA | VAL | B | 192 | −38.156 | 2.027 | 135.503 | 1.00 | 34.89 | C |
| ATOM | 3109 | C | VAL | B | 192 | −38.596 | 1.564 | 134.126 | 1.00 | 35.04 | C |
| ATOM | 3110 | O | VAL | B | 192 | −39.687 | 1.918 | 133.661 | 1.00 | 35.31 | O |
| ATOM | 3111 | CB | VAL | B | 192 | −39.054 | 1.439 | 136.599 | 1.00 | 34.98 | C |
| ATOM | 3112 | CG1 | VAL | B | 192 | −39.122 | −0.073 | 136.464 | 1.00 | 30.15 | C |
| ATOM | 3113 | CG2 | VAL | B | 192 | −38.522 | 1.842 | 137.965 | 1.00 | 36.73 | C |
| ATOM | 3114 | N | TYR | B | 193 | −37.737 | 0.785 | 133.473 | 1.00 | 36.15 | N |
| ATOM | 3115 | CA | TYR | B | 193 | −38.019 | 0.172 | 132.181 | 1.00 | 35.85 | C |
| ATOM | 3116 | C | TYR | B | 193 | −38.078 | −1.327 | 132.381 | 1.00 | 29.50 | C |
| ATOM | 3117 | O | TYR | B | 193 | −37.178 | −1.898 | 132.995 | 1.00 | 31.86 | O |
| ATOM | 3118 | CB | TYR | B | 193 | −36.958 | 0.576 | 131.150 | 1.00 | 28.31 | C |
| ATOM | 3119 | CG | TYR | B | 193 | −37.137 | 2.020 | 130.781 | 1.00 | 32.21 | C |
| ATOM | 3120 | CD1 | TYR | B | 193 | −36.656 | 3.034 | 131.613 | 1.00 | 34.12 | C |
| ATOM | 3121 | CD2 | TYR | B | 193 | −37.831 | 2.384 | 129.628 | 1.00 | 32.20 | C |
| ATOM | 3122 | CE1 | TYR | B | 193 | −36.859 | 4.366 | 131.313 | 1.00 | 31.90 | C |
| ATOM | 3123 | CE2 | TYR | B | 193 | −38.023 | 3.724 | 129.299 | 1.00 | 38.14 | C |
| ATOM | 3124 | CZ | TYR | B | 193 | −37.536 | 4.707 | 130.163 | 1.00 | 37.14 | C |
| ATOM | 3125 | OH | TYR | B | 193 | −37.717 | 6.025 | 129.872 | 1.00 | 39.52 | O |
| ATOM | 3126 | N | ALA | B | 194 | −39.149 | −1.954 | 131.908 | 1.00 | 28.74 | N |
| ATOM | 3127 | CA | ALA | B | 194 | −39.300 | −3.384 | 132.148 | 1.00 | 34.71 | C |
| ATOM | 3128 | C | ALA | B | 194 | −39.970 | −4.081 | 130.963 | 1.00 | 33.72 | C |
| ATOM | 3129 | O | ALA | B | 194 | −40.748 | −3.479 | 130.211 | 1.00 | 34.66 | O |
| ATOM | 3130 | CB | ALA | B | 194 | −40.083 | −3.634 | 133.442 | 1.00 | 29.91 | C |
| ATOM | 3131 | N | CYS | B | 195 | −39.623 | −5.349 | 130.776 | 1.00 | 32.36 | N |
| ATOM | 3132 | CA | CYS | B | 195 | −40.382 | −6.251 | 129.919 | 1.00 | 37.46 | C |
| ATOM | 3133 | C | CYS | B | 195 | −40.814 | −7.461 | 130.732 | 1.00 | 40.08 | C |
| ATOM | 3134 | O | CYS | B | 195 | −40.045 | −8.000 | 131.544 | 1.00 | 39.11 | O |
| ATOM | 3135 | CB | CYS | B | 195 | −39.615 | −6.703 | 128.639 | 1.00 | 33.36 | C |
| ATOM | 3136 | SG | CYS | B | 195 | −37.984 | −7.394 | 128.903 | 1.00 | 49.70 | S |
| ATOM | 3137 | N | GLU | B | 196 | −42.077 | −7.822 | 130.550 | 1.00 | 36.65 | N |
| ATOM | 3138 | CA | GLU | B | 196 | −42.702 | −8.939 | 131.228 | 1.00 | 37.99 | C |
| ATOM | 3139 | C | GLU | B | 196 | −42.961 | −10.009 | 130.181 | 1.00 | 33.89 | C |
| ATOM | 3140 | O | GLU | B | 196 | −43.502 | −9.711 | 129.111 | 1.00 | 30.27 | O |
| ATOM | 3141 | CB | GLU | B | 196 | −43.986 | −8.481 | 131.926 | 1.00 | 37.34 | C |
| ATOM | 3142 | CG | GLU | B | 196 | −44.748 | −9.548 | 132.707 | 1.00 | 42.18 | C |
| ATOM | 3143 | CD | GLU | B | 196 | −46.068 | −9.008 | 133.278 | 1.00 | 51.19 | C |
| ATOM | 3144 | OE1 | GLU | B | 196 | −46.538 | −7.957 | 132.796 | 1.00 | 55.09 | O |
| ATOM | 3145 | OE2 | GLU | B | 196 | −46.618 | −9.605 | 134.234 | 1.00 | 54.09 | O1− |
| ATOM | 3146 | N | VAL | B | 197 | −42.549 | −11.236 | 130.491 | 1.00 | 33.59 | N |
| ATOM | 3147 | CA | VAL | B | 197 | −42.499 | −12.350 | 129.550 | 1.00 | 28.73 | C |
| ATOM | 3148 | C | VAL | B | 197 | −43.396 | −13.467 | 130.057 | 1.00 | 31.19 | C |
| ATOM | 3149 | O | VAL | B | 197 | −43.137 | −14.053 | 131.117 | 1.00 | 32.63 | O |
| ATOM | 3150 | CB | VAL | B | 197 | −41.057 | −12.851 | 129.355 | 1.00 | 29.79 | C |
| ATOM | 3151 | CG1 | VAL | B | 197 | −41.040 | −14.182 | 128.614 | 1.00 | 27.12 | C |
| ATOM | 3152 | CG2 | VAL | B | 197 | −40.238 | −11.808 | 128.589 | 1.00 | 28.85 | C |
| ATOM | 3153 | N | THR | B | 198 | −44.436 | −13.778 | 129.293 | 1.00 | 32.91 | N |
| ATOM | 3154 | CA | THR | B | 198 | −45.297 | −14.926 | 129.549 | 1.00 | 29.91 | C |
| ATOM | 3155 | C | THR | B | 198 | −45.009 | −16.037 | 128.547 | 1.00 | 32.14 | C |

TABLE 10.4-continued

| ATOM | 3156 | O | THR | B | 198 | −45.017 | −15.808 | 127.328 | 1.00 | 29.74 | O |
|---|---|---|---|---|---|---|---|---|---|---|---|
| ATOM | 3157 | CB | THR | B | 198 | −46.763 | −14.516 | 129.502 | 1.00 | 29.14 | C |
| ATOM | 3158 | OG1 | THR | B | 198 | −46.977 | −13.539 | 130.518 | 1.00 | 36.91 | O |
| ATOM | 3159 | CG2 | THR | B | 198 | −47.664 | −15.701 | 129.771 | 1.00 | 31.29 | C |
| ATOM | 3160 | N | HIS | B | 199 | −44.758 | −17.237 | 129.066 | 1.00 | 29.27 | N |
| ATOM | 3161 | CA | HIS | B | 199 | −44.464 | −18.393 | 128.233 | 1.00 | 32.48 | C |
| ATOM | 3162 | C | HIS | B | 199 | −44.929 | −19.638 | 128.964 | 1.00 | 34.28 | C |
| ATOM | 3163 | O | HIS | B | 199 | −44.998 | −19.645 | 130.194 | 1.00 | 35.68 | O |
| ATOM | 3164 | CB | HIS | B | 199 | −42.975 | −18.520 | 127.932 | 1.00 | 28.76 | C |
| ATOM | 3165 | CG | HIS | B | 199 | −42.659 | −19.599 | 126.950 | 1.00 | 31.19 | C |
| ATOM | 3166 | ND1 | HIS | B | 199 | −42.284 | −20.867 | 127.331 | 1.00 | 29.79 | N |
| ATOM | 3167 | CD2 | HIS | B | 199 | −42.657 | −19.594 | 125.595 | 1.00 | 31.07 | C |
| ATOM | 3168 | CE1 | HIS | B | 199 | −42.066 | −21.596 | 126.252 | 1.00 | 29.75 | C |
| ATOM | 3169 | NE2 | HIS | B | 199 | −42.280 | −20.845 | 125.185 | 1.00 | 26.47 | N |
| ATOM | 3170 | N | GLN | B | 200 | −45.239 | −20.693 | 128.204 | 1.00 | 28.40 | N |
| ATOM | 3171 | CA | GLN | B | 200 | −45.833 | −21.862 | 128.839 | 1.00 | 28.53 | C |
| ATOM | 3172 | C | GLN | B | 200 | −44.841 | −22.620 | 129.706 | 1.00 | 34.07 | C |
| ATOM | 3173 | O | GLN | B | 200 | −45.270 | −23.425 | 130.535 | 1.00 | 36.20 | O |
| ATOM | 3174 | CB | GLN | B | 200 | −46.471 | −22.791 | 127.805 | 1.00 | 34.90 | C |
| ATOM | 3175 | CG | GLN | B | 200 | −45.638 | −23.987 | 127.362 | 1.00 | 36.70 | C |
| ATOM | 3176 | CD | GLN | B | 200 | −46.492 | −25.092 | 126.712 | 1.00 | 43.78 | C |
| ATOM | 3177 | OE1 | GLN | B | 200 | −46.443 | −26.257 | 127.124 | 1.00 | 43.09 | O |
| ATOM | 3178 | NE2 | GLN | B | 200 | −47.268 | −24.723 | 125.692 | 1.00 | 41.04 | N |
| ATOM | 3179 | N | GLY | B | 201 | −43.538 | −22.378 | 129.558 | 1.00 | 35.51 | N |
| ATOM | 3180 | CA | GLY | B | 201 | −42.576 | −22.968 | 130.464 | 1.00 | 29.44 | C |
| ATOM | 3181 | C | GLY | B | 201 | −42.338 | −22.163 | 131.720 | 1.00 | 33.22 | C |
| ATOM | 3182 | O | GLY | B | 201 | −41.524 | −22.553 | 132.563 | 1.00 | 33.63 | O |
| ATOM | 3183 | N | LEU | B | 202 | −43.062 | −21.058 | 131.884 | 1.00 | 32.15 | N |
| ATOM | 3184 | CA | LEU | B | 202 | −42.986 | −20.209 | 133.061 | 1.00 | 36.14 | C |
| ATOM | 3185 | C | LEU | B | 202 | −44.298 | −20.336 | 133.808 | 1.00 | 37.68 | C |
| ATOM | 3186 | O | LEU | B | 202 | −45.352 | −20.003 | 133.256 | 1.00 | 37.45 | O |
| ATOM | 3187 | CB | LEU | B | 202 | −42.765 | −18.743 | 132.669 | 1.00 | 36.59 | C |
| ATOM | 3188 | CG | LEU | B | 202 | −41.529 | −18.334 | 131.867 | 1.00 | 27.10 | C |
| ATOM | 3189 | CD1 | LEU | B | 202 | −41.560 | −16.866 | 131.516 | 1.00 | 29.06 | C |
| ATOM | 3190 | CD2 | LEU | B | 202 | −40.313 | −18.626 | 132.669 | 1.00 | 31.65 | C |
| ATOM | 3191 | N | SER | B | 203 | −44.227 | −20.741 | 135.082 | 1.00 | 42.21 | N |
| ATOM | 3192 | CA | SER | B | 203 | −45.444 | −20.866 | 135.880 | 1.00 | 41.93 | C |
| ATOM | 3193 | C | SER | B | 203 | −46.098 | −19.513 | 136.127 | 1.00 | 42.43 | C |
| ATOM | 3194 | O | SER | B | 203 | −47.312 | −19.458 | 136.334 | 1.00 | 41.82 | O |
| ATOM | 3195 | CB | SER | B | 203 | −45.145 | −21.561 | 137.214 | 1.00 | 44.30 | C |
| ATOM | 3196 | OG | SER | B | 203 | −44.114 | −20.886 | 137.919 | 1.00 | 57.08 | O |
| ATOM | 3197 | N | SER | B | 204 | −45.333 | −18.425 | 136.065 | 1.00 | 41.83 | N |
| ATOM | 3198 | CA | SER | B | 204 | −45.886 | −17.077 | 136.094 | 1.00 | 43.80 | C |
| ATOM | 3199 | C | SER | B | 204 | −44.928 | −16.136 | 135.369 | 1.00 | 41.32 | C |
| ATOM | 3200 | O | SER | B | 204 | −43.777 | −16.501 | 135.094 | 1.00 | 39.18 | O |
| ATOM | 3201 | CB | SER | B | 204 | −46.175 | −16.616 | 137.537 | 1.00 | 37.72 | C |
| ATOM | 3202 | OG | SER | B | 204 | −45.011 | −16.540 | 138.333 | 1.00 | 37.17 | O |
| ATOM | 3203 | N | PRO | B | 205 | −45.400 | −14.953 | 134.971 | 1.00 | 34.11 | N |
| ATOM | 3204 | CA | PRO | B | 205 | −44.574 | −14.046 | 134.171 | 1.00 | 33.10 | C |
| ATOM | 3205 | C | PRO | B | 205 | −43.256 | −13.665 | 134.836 | 1.00 | 39.09 | C |
| ATOM | 3206 | O | PRO | B | 205 | −43.148 | −13.550 | 136.053 | 1.00 | 45.40 | O |
| ATOM | 3207 | CB | PRO | B | 205 | −45.475 | −12.821 | 133.999 | 1.00 | 37.31 | C |
| ATOM | 3208 | CG | PRO | B | 205 | −46.835 | −13.372 | 134.001 | 1.00 | 39.03 | C |
| ATOM | 3209 | CD | PRO | B | 205 | −46.817 | −14.553 | 134.944 | 1.00 | 38.32 | C |
| ATOM | 3210 | N | VAL | B | 206 | −42.232 | −13.502 | 134.016 | 1.00 | 34.71 | N |
| ATOM | 3211 | CA | VAL | B | 206 | −40.922 | −13.075 | 134.467 | 1.00 | 35.91 | C |
| ATOM | 3212 | C | VAL | B | 206 | −40.692 | −11.645 | 133.984 | 1.00 | 38.85 | C |
| ATOM | 3213 | O | VAL | B | 206 | −40.938 | −11.328 | 132.811 | 1.00 | 36.12 | O |
| ATOM | 3214 | CB | VAL | B | 206 | −39.836 | −14.036 | 133.951 | 1.00 | 34.83 | C |
| ATOM | 3215 | CG1 | VAL | B | 206 | −38.475 | −13.474 | 134.183 | 1.00 | 32.65 | C |
| ATOM | 3216 | CG2 | VAL | B | 206 | −39.970 | −15.355 | 134.650 | 1.00 | 35.57 | C |
| ATOM | 3217 | N | THR | B | 207 | −40.236 | −10.774 | 134.883 | 1.00 | 38.08 | N |
| ATOM | 3218 | CA | THR | B | 207 | −39.870 | −9.416 | 134.504 | 1.00 | 40.84 | C |
| ATOM | 3219 | C | THR | B | 207 | −38.378 | −9.204 | 134.736 | 1.00 | 39.54 | C |
| ATOM | 3220 | O | THR | B | 207 | −37.836 | −9.618 | 135.761 | 1.00 | 42.64 | O |
| ATOM | 3221 | CB | THR | B | 207 | −40.678 | −8.361 | 135.276 | 1.00 | 37.84 | C |
| ATOM | 3222 | OG1 | THR | B | 207 | −42.077 | −8.538 | 135.017 | 1.00 | 43.59 | O |
| ATOM | 3223 | CG2 | THR | B | 207 | −40.291 | −6.972 | 134.837 | 1.00 | 32.49 | C |
| ATOM | 3224 | N | LYS | B | 208 | −37.715 | −8.590 | 133.762 | 1.00 | 38.06 | N |
| ATOM | 3225 | CA | LYS | B | 208 | −36.376 | −8.048 | 133.928 | 1.00 | 36.13 | C |
| ATOM | 3226 | C | LYS | B | 208 | −36.503 | −6.553 | 133.717 | 1.00 | 30.77 | C |
| ATOM | 3227 | O | LYS | B | 208 | −37.237 | −6.108 | 132.840 | 1.00 | 34.40 | O |
| ATOM | 3228 | CB | LYS | B | 208 | −35.349 | −8.617 | 132.922 | 1.00 | 32.55 | C |
| ATOM | 3229 | CG | LYS | B | 208 | −35.155 | −10.137 | 132.891 | 1.00 | 33.52 | C |
| ATOM | 3230 | CD | LYS | B | 208 | −34.907 | −10.808 | 134.236 | 1.00 | 35.71 | C |
| ATOM | 3231 | CE | LYS | B | 208 | −34.562 | −12.283 | 133.994 | 1.00 | 39.12 | C |
| ATOM | 3232 | NZ | LYS | B | 208 | −34.393 | −13.134 | 135.206 | 1.00 | 41.39 | N1+ |
| ATOM | 3233 | N | SER | B | 209 | −35.841 | −5.768 | 134.543 | 1.00 | 37.37 | N |
| ATOM | 3234 | CA | SER | B | 209 | −36.013 | −4.330 | 134.455 | 1.00 | 33.94 | C |
| ATOM | 3235 | C | SER | B | 209 | −34.700 | −3.653 | 134.776 | 1.00 | 29.43 | C |

TABLE 10.4-continued

| | | | | | | | | | | |
|---|---|---|---|---|---|---|---|---|---|---|
| ATOM | 3236 | O | SER | B | 209 | −33.780 | −4.271 | 135.305 | 1.00 | 31.80 | O |
| ATOM | 3237 | CB | SER | B | 209 | −37.096 | −3.848 | 135.420 | 1.00 | 33.21 | C |
| ATOM | 3238 | OG | SER | B | 209 | −36.754 | −4.262 | 136.724 | 1.00 | 35.51 | O |
| ATOM | 3239 | N | PHE | B | 210 | −34.653 | −2.351 | 134.517 | 1.00 | 34.31 | N |
| ATOM | 3240 | CA | PHE | B | 210 | −33.559 | −1.507 | 134.978 | 1.00 | 37.85 | C |
| ATOM | 3241 | C | PHE | B | 210 | −34.108 | −0.121 | 135.302 | 1.00 | 39.37 | C |
| ATOM | 3242 | O | PHE | B | 210 | −35.098 | 0.319 | 134.705 | 1.00 | 33.58 | O |
| ATOM | 3243 | CB | PHE | B | 210 | −32.434 | −1.395 | 133.935 | 1.00 | 26.33 | C |
| ATOM | 3244 | CG | PHE | B | 210 | −32.827 | −0.647 | 132.698 | 1.00 | 33.39 | C |
| ATOM | 3245 | CD1 | PHE | B | 210 | −32.688 | 0.736 | 132.632 | 1.00 | 31.43 | C |
| ATOM | 3246 | CD2 | PHE | B | 210 | −33.342 | −1.321 | 131.597 | 1.00 | 32.75 | C |
| ATOM | 3247 | CE1 | PHE | B | 210 | −33.052 | 1.438 | 131.490 | 1.00 | 35.66 | C |
| ATOM | 3248 | CE2 | PHE | B | 210 | −33.702 | −0.630 | 130.436 | 1.00 | 33.47 | C |
| ATOM | 3249 | CZ | PHE | B | 210 | −33.559 | 0.752 | 130.380 | 1.00 | 34.55 | C |
| ATOM | 3250 | N | ASN | B | 211 | −33.475 | 0.547 | 136.284 | 1.00 | 42.75 | N |
| ATOM | 3251 | CA | ASN | B | 211 | −33.738 | 1.955 | 136.583 | 1.00 | 38.70 | C |
| ATOM | 3252 | C | ASN | B | 211 | −32.818 | 2.832 | 135.752 | 1.00 | 43.04 | C |
| ATOM | 3253 | O | ASN | B | 211 | −31.602 | 2.610 | 135.717 | 1.00 | 39.58 | O |
| ATOM | 3254 | CB | ASN | B | 211 | −33.515 | 2.295 | 138.054 | 1.00 | 48.54 | C |
| ATOM | 3255 | CG | ASN | B | 211 | −34.216 | 1.354 | 138.988 | 1.00 | 51.99 | C |
| ATOM | 3256 | OD1 | ASN | B | 211 | −35.237 | 0.765 | 138.642 | 1.00 | 48.81 | O |
| ATOM | 3257 | ND2 | ASN | B | 211 | −33.672 | 1.208 | 140.193 | 1.00 | 53.46 | N |
| ATOM | 3258 | N | ARG | B | 212 | −33.396 | 3.826 | 135.088 | 1.00 | 42.30 | N |
| ATOM | 3259 | CA | ARG | B | 212 | −32.585 | 4.725 | 134.279 | 1.00 | 44.00 | C |
| ATOM | 3260 | C | ARG | B | 212 | −31.547 | 5.416 | 135.166 | 1.00 | 53.42 | C |
| ATOM | 3261 | O | ARG | B | 212 | −31.838 | 5.807 | 136.304 | 1.00 | 49.38 | O |
| ATOM | 3262 | CB | ARG | B | 212 | −33.478 | 5.748 | 133.579 | 1.00 | 35.08 | C |
| ATOM | 3263 | CG | ARG | B | 212 | −32.768 | 6.567 | 132.543 | 1.00 | 35.57 | C |
| ATOM | 3264 | CD | ARG | B | 212 | −33.745 | 7.458 | 131.855 | 1.00 | 39.63 | C |
| ATOM | 3265 | NE | ARG | B | 212 | −34.383 | 8.298 | 132.850 | 1.00 | 48.56 | N |
| ATOM | 3266 | CZ | ARG | B | 212 | −33.927 | 9.489 | 133.210 | 1.00 | 47.89 | C |
| ATOM | 3267 | NH1 | ARG | B | 212 | −32.853 | 9.988 | 132.617 | 1.00 | 49.63 | N1+ |
| ATOM | 3268 | NH2 | ARG | B | 212 | −34.554 | 10.182 | 134.150 | 1.00 | 49.80 | N |
| ATOM | 3269 | N | GLY | B | 213 | −30.313 | 5.513 | 134.660 | 1.00 | 57.27 | N |
| ATOM | 3270 | CA | GLY | B | 213 | −29.233 | 6.174 | 135.372 | 1.00 | 56.62 | C |
| ATOM | 3271 | C | GLY | B | 213 | −28.594 | 5.389 | 136.502 | 1.00 | 64.15 | C |
| ATOM | 3272 | O | GLY | B | 213 | −27.852 | 5.979 | 137.297 | 1.00 | 72.50 | O |
| ATOM | 3273 | N | GLU | B | 214 | −28.872 | 4.093 | 136.624 | 1.00 | 62.54 | N |
| ATOM | 3274 | CA | GLU | B | 214 | −28.300 | 3.285 | 137.703 | 1.00 | 62.11 | C |
| ATOM | 3275 | C | GLU | B | 214 | −27.713 | 1.996 | 137.157 | 1.00 | 59.03 | C |
| ATOM | 3276 | O | GLU | B | 214 | −26.518 | 1.940 | 136.863 | 1.00 | 63.86 | O |
| ATOM | 3277 | CB | GLU | B | 214 | −29.353 | 3.001 | 138.781 | 1.00 | 51.33 | C |
| ATOM | 3278 | CG | GLU | B | 214 | −29.912 | 4.302 | 139.342 | 1.00 | 61.22 | C |
| ATOM | 3279 | CD | GLU | B | 214 | −31.228 | 4.170 | 140.105 | 1.00 | 66.11 | C |
| ATOM | 3280 | OE1 | GLU | B | 214 | −31.496 | 3.123 | 140.751 | 1.00 | 61.27 | O |
| ATOM | 3281 | OE2 | GLU | B | 214 | −32.004 | 5.152 | 140.044 | 1.00 | 64.67 | O1− |
| TER | | | | | | | | | | | |
| ATOM | 3282 | N | GLN | C | 1 | −37.672 | −36.358 | 87.095 | 1.00 | 48.43 | N |
| ATOM | 3283 | CA | GLN | C | 1 | −37.796 | −35.842 | 85.733 | 1.00 | 53.92 | C |
| ATOM | 3284 | C | GLN | C | 1 | −36.907 | −36.762 | 84.921 | 1.00 | 48.53 | C |
| ATOM | 3285 | O | GLN | C | 1 | −37.375 | −37.531 | 84.085 | 1.00 | 49.71 | O |
| ATOM | 3286 | CB | GLN | C | 1 | −37.335 | −34.383 | 85.628 | 1.00 | 47.24 | C |
| ATOM | 3287 | CG | GLN | C | 1 | −37.925 | −33.494 | 86.693 | 1.00 | 41.90 | C |
| ATOM | 3288 | CD | GLN | C | 1 | −37.270 | −33.771 | 88.072 | 1.00 | 54.37 | C |
| ATOM | 3289 | OE1 | GLN | C | 1 | −37.245 | −34.914 | 88.549 | 1.00 | 44.69 | O |
| ATOM | 3290 | NE2 | GLN | C | 1 | −36.710 | −32.731 | 88.690 | 1.00 | 59.79 | N |
| ATOM | 3291 | N | VAL | C | 2 | −35.614 | −36.686 | 85.222 | 1.00 | 51.69 | N |
| ATOM | 3292 | CA | VAL | C | 2 | −34.607 | −37.545 | 84.617 | 1.00 | 47.55 | C |
| ATOM | 3293 | C | VAL | C | 2 | −34.423 | −38.731 | 85.545 | 1.00 | 47.63 | C |
| ATOM | 3294 | O | VAL | C | 2 | −33.898 | −38.581 | 86.647 | 1.00 | 46.25 | O |
| ATOM | 3295 | CB | VAL | C | 2 | −33.299 | −36.782 | 84.412 | 1.00 | 42.21 | C |
| ATOM | 3296 | CG1 | VAL | C | 2 | −32.374 | −37.549 | 83.497 | 1.00 | 38.77 | C |
| ATOM | 3297 | CG2 | VAL | C | 2 | −33.625 | −35.409 | 83.861 | 1.00 | 38.63 | C |
| ATOM | 3298 | N | GLN | C | 3 | −34.870 | −39.908 | 85.122 | 1.00 | 44.76 | N |
| ATOM | 3299 | CA | GLN | C | 3 | −34.623 | −41.114 | 85.894 | 1.00 | 46.20 | C |
| ATOM | 3300 | C | GLN | C | 3 | −33.571 | −41.955 | 85.194 | 1.00 | 38.10 | C |
| ATOM | 3301 | O | GLN | C | 3 | −33.475 | −41.955 | 83.965 | 1.00 | 39.47 | O |
| ATOM | 3302 | CB | GLN | C | 3 | −35.902 | −41.931 | 86.152 | 1.00 | 46.17 | C |
| ATOM | 3303 | CG | GLN | C | 3 | −36.857 | −42.057 | 84.981 | 1.00 | 54.72 | C |
| ATOM | 3304 | CD | GLN | C | 3 | −37.939 | −40.974 | 84.954 | 1.00 | 59.64 | C |
| ATOM | 3305 | OE1 | GLN | C | 3 | −38.022 | −40.180 | 83.996 | 1.00 | 55.09 | O |
| ATOM | 3306 | NE2 | GLN | C | 3 | −38.794 | −40.952 | 85.996 | 1.00 | 49.26 | N |
| ATOM | 3307 | N | LEU | C | 4 | −32.728 | −42.584 | 85.993 | 1.00 | 36.10 | N |
| ATOM | 3308 | CA | LEU | C | 4 | −31.834 | −43.639 | 85.548 | 1.00 | 36.24 | C |
| ATOM | 3309 | C | LEU | C | 4 | −32.349 | −44.892 | 86.234 | 1.00 | 38.70 | C |
| ATOM | 3310 | O | LEU | C | 4 | −32.006 | −45.155 | 87.383 | 1.00 | 41.03 | O |
| ATOM | 3311 | CB | LEU | C | 4 | −30.377 | −43.351 | 85.916 | 1.00 | 31.18 | C |
| ATOM | 3312 | CG | LEU | C | 4 | −29.695 | −42.051 | 85.479 | 1.00 | 32.11 | C |
| ATOM | 3313 | CD1 | LEU | C | 4 | −28.199 | −42.201 | 85.552 | 1.00 | 34.48 | C |
| ATOM | 3314 | CD2 | LEU | C | 4 | −30.085 | −41.672 | 84.084 | 1.00 | 36.90 | C |

TABLE 10.4-continued

| | | | | | | | | | | |
|---|---|---|---|---|---|---|---|---|---|---|
| ATOM | 3315 | N | GLN | C | 5 | −33.149 | −45.677 | 85.525 | 1.00 | 44.15 | N |
| ATOM | 3316 | CA | GLN | C | 5 | −33.773 | −46.856 | 86.108 | 1.00 | 45.12 | C |
| ATOM | 3317 | C | GLN | C | 5 | −32.880 | −48.063 | 85.887 | 1.00 | 41.78 | C |
| ATOM | 3318 | O | GLN | C | 5 | −32.475 | −48.340 | 84.755 | 1.00 | 41.54 | O |
| ATOM | 3319 | CB | GLN | C | 5 | −35.152 | −47.084 | 85.489 | 1.00 | 49.54 | C |
| ATOM | 3320 | CG | GLN | C | 5 | −35.943 | −48.256 | 86.071 | 1.00 | 56.47 | C |
| ATOM | 3321 | CD | GLN | C | 5 | −37.440 | −48.116 | 85.797 | 1.00 | 74.65 | C |
| ATOM | 3322 | OE1 | GLN | C | 5 | −37.935 | −47.009 | 85.533 | 1.00 | 74.08 | O |
| ATOM | 3323 | NE2 | GLN | C | 5 | −38.166 | −49.236 | 85.850 | 1.00 | 70.76 | N |
| ATOM | 3324 | N | GLN | C | 6 | −32.592 | −48.786 | 86.963 | 1.00 | 36.00 | N |
| ATOM | 3325 | CA | GLN | C | 6 | −31.668 | −49.905 | 86.917 | 1.00 | 37.25 | C |
| ATOM | 3326 | C | GLN | C | 6 | −32.432 | −51.207 | 87.049 | 1.00 | 40.30 | C |
| ATOM | 3327 | O | GLN | C | 6 | −33.416 | −51.281 | 87.787 | 1.00 | 48.42 | O |
| ATOM | 3328 | CB | GLN | C | 6 | −30.617 | −49.841 | 88.032 | 1.00 | 37.59 | C |
| ATOM | 3329 | CG | GLN | C | 6 | −29.875 | −48.541 | 88.142 | 1.00 | 40.04 | C |
| ATOM | 3330 | CD | GLN | C | 6 | −28.646 | −48.621 | 89.041 | 1.00 | 38.65 | C |
| ATOM | 3331 | OE1 | GLN | C | 6 | −28.173 | −47.599 | 89.535 | 1.00 | 36.68 | O |
| ATOM | 3332 | NE2 | GLN | C | 6 | −28.111 | −49.834 | 89.239 | 1.00 | 31.43 | N |
| ATOM | 3333 | N | TRP | C | 7 | −31.969 | −52.228 | 86.334 | 1.00 | 36.46 | N |
| ATOM | 3334 | CA | TRP | C | 7 | −32.424 | −53.585 | 86.573 | 1.00 | 39.72 | C |
| ATOM | 3335 | C | TRP | C | 7 | −31.284 | −54.527 | 86.258 | 1.00 | 37.13 | C |
| ATOM | 3336 | O | TRP | C | 7 | −30.252 | −54.125 | 85.709 | 1.00 | 36.52 | O |
| ATOM | 3337 | CB | TRP | C | 7 | −33.669 | −53.937 | 85.756 | 1.00 | 36.24 | C |
| ATOM | 3338 | CG | TRP | C | 7 | −33.515 | −53.880 | 84.294 | 1.00 | 38.80 | C |
| ATOM | 3339 | CD1 | TRP | C | 7 | −33.103 | −54.893 | 83.464 | 1.00 | 37.72 | C |
| ATOM | 3340 | CD2 | TRP | C | 7 | −33.812 | −52.760 | 83.446 | 1.00 | 41.40 | C |
| ATOM | 3341 | NE1 | TRP | C | 7 | −33.111 | −54.462 | 82.153 | 1.00 | 39.38 | N |
| ATOM | 3342 | CE2 | TRP | C | 7 | −33.544 | −53.159 | 82.113 | 1.00 | 39.28 | C |
| ATOM | 3343 | CE3 | TRP | C | 7 | −34.270 | −51.460 | 83.683 | 1.00 | 41.24 | C |
| ATOM | 3344 | CZ2 | TRP | C | 7 | −33.713 | −52.298 | 81.022 | 1.00 | 37.17 | C |
| ATOM | 3345 | CZ3 | TRP | C | 7 | −34.443 | −50.603 | 82.589 | 1.00 | 42.48 | C |
| ATOM | 3346 | CH2 | TRP | C | 7 | −34.164 | −51.032 | 81.278 | 1.00 | 38.07 | C |
| ATOM | 3347 | N | GLY | C | 8 | −31.479 | −55.779 | 86.640 | 1.00 | 30.53 | N |
| ATOM | 3348 | CA | GLY | C | 8 | −30.480 | −56.819 | 86.491 | 1.00 | 29.00 | C |
| ATOM | 3349 | C | GLY | C | 8 | −30.542 | −57.704 | 87.715 | 1.00 | 28.80 | C |
| ATOM | 3350 | O | GLY | C | 8 | −30.936 | −57.284 | 88.802 | 1.00 | 35.52 | O |
| ATOM | 3351 | N | ALA | C | 9 | −30.175 | −58.964 | 87.536 | 1.00 | 31.95 | N |
| ATOM | 3352 | CA | ALA | C | 9 | −30.163 | −59.902 | 88.650 | 1.00 | 36.64 | C |
| ATOM | 3353 | C | ALA | C | 9 | −29.108 | −59.490 | 89.672 | 1.00 | 40.72 | C |
| ATOM | 3354 | O | ALA | C | 9 | −27.936 | −59.312 | 89.329 | 1.00 | 44.07 | O |
| ATOM | 3355 | CB | ALA | C | 9 | −29.893 | −61.324 | 88.152 | 1.00 | 32.88 | C |
| ATOM | 3356 | N | GLY | C | 10 | −29.528 | −59.350 | 90.927 | 1.00 | 40.53 | N |
| ATOM | 3357 | CA | GLY | C | 10 | −28.651 | −58.938 | 92.001 | 1.00 | 34.92 | C |
| ATOM | 3358 | C | GLY | C | 10 | −28.135 | −60.045 | 92.894 | 1.00 | 32.59 | C |
| ATOM | 3359 | O | GLY | C | 10 | −27.259 | −59.787 | 93.722 | 1.00 | 37.26 | O |
| ATOM | 3360 | N | LEU | C | 11 | −28.643 | −61.269 | 92.760 | 1.00 | 33.32 | N |
| ATOM | 3361 | CA | LEU | C | 11 | −28.155 | −62.401 | 93.550 | 1.00 | 35.63 | C |
| ATOM | 3362 | C | LEU | C | 11 | −27.388 | −63.330 | 92.625 | 1.00 | 37.18 | C |
| ATOM | 3363 | O | LEU | C | 11 | −27.945 | −63.832 | 91.641 | 1.00 | 40.37 | O |
| ATOM | 3364 | CB | LEU | C | 11 | −29.292 | −63.162 | 94.238 | 1.00 | 33.21 | C |
| ATOM | 3365 | CG | LEU | C | 11 | −29.045 | −63.745 | 95.639 | 1.00 | 35.68 | C |
| ATOM | 3366 | CD1 | LEU | C | 11 | −29.828 | −65.026 | 95.836 | 1.00 | 37.14 | C |
| ATOM | 3367 | CD2 | LEU | C | 11 | −27.589 | −63.991 | 95.974 | 1.00 | 34.37 | C |
| ATOM | 3368 | N | LEU | C | 12 | −26.125 | −63.573 | 92.957 | 1.00 | 33.96 | N |
| ATOM | 3369 | CA | LEU | C | 12 | −25.238 | −64.365 | 92.126 | 1.00 | 37.97 | C |
| ATOM | 3370 | C | LEU | C | 12 | −24.363 | −65.240 | 93.002 | 1.00 | 35.65 | C |
| ATOM | 3371 | O | LEU | C | 12 | −24.068 | −64.894 | 94.147 | 1.00 | 36.30 | O |
| ATOM | 3372 | CB | LEU | C | 12 | −24.331 | −63.494 | 91.246 | 1.00 | 34.37 | C |
| ATOM | 3373 | CG | LEU | C | 12 | −24.960 | −62.530 | 90.262 | 1.00 | 37.66 | C |
| ATOM | 3374 | CD1 | LEU | C | 12 | −23.856 | −61.733 | 89.638 | 1.00 | 43.23 | C |
| ATOM | 3375 | CD2 | LEU | C | 12 | −25.713 | −63.294 | 89.190 | 1.00 | 44.30 | C |
| ATOM | 3376 | N | LYS | C | 13 | −23.932 | −66.390 | 92.428 | 1.00 | 36.66 | N |
| ATOM | 3377 | CA | LYS | C | 13 | −22.957 | −67.321 | 92.963 | 1.00 | 38.43 | C |
| ATOM | 3378 | C | LYS | C | 13 | −21.606 | −67.082 | 92.306 | 1.00 | 39.27 | C |
| ATOM | 3379 | O | LYS | C | 13 | −21.543 | −66.620 | 91.160 | 1.00 | 39.31 | O |
| ATOM | 3380 | CB | LYS | C | 13 | −23.391 | −68.766 | 92.715 | 1.00 | 36.21 | C |
| ATOM | 3381 | CG | LYS | C | 13 | −24.872 | −68.896 | 92.517 | 1.00 | 42.22 | C |
| ATOM | 3382 | CD | LYS | C | 13 | −25.398 | −70.074 | 93.270 | 1.00 | 45.83 | C |
| ATOM | 3383 | CE | LYS | C | 13 | −25.107 | −69.921 | 94.743 | 1.00 | 45.08 | C |
| ATOM | 3384 | NZ | LYS | C | 13 | −25.676 | −71.073 | 95.499 | 1.00 | 49.42 | N1+ |
| ATOM | 3385 | N | PRO | C | 14 | −20.517 | −67.383 | 93.016 | 1.00 | 33.06 | N |
| ATOM | 3386 | CA | PRO | C | 14 | −19.180 | −67.135 | 92.464 | 1.00 | 31.17 | C |
| ATOM | 3387 | C | PRO | C | 14 | −19.019 | −67.705 | 91.063 | 1.00 | 35.18 | C |
| ATOM | 3388 | O | PRO | C | 14 | −19.621 | −68.717 | 90.712 | 1.00 | 37.79 | O |
| ATOM | 3389 | CB | PRO | C | 14 | −18.258 | −67.830 | 93.463 | 1.00 | 24.90 | C |
| ATOM | 3390 | CG | PRO | C | 14 | −19.016 | −67.795 | 94.737 | 1.00 | 29.59 | C |
| ATOM | 3391 | CD | PRO | C | 14 | −20.461 | −67.876 | 94.405 | 1.00 | 27.79 | C |
| ATOM | 3392 | N | SER | C | 15 | −18.235 | −66.995 | 90.251 | 1.00 | 38.99 | N |
| ATOM | 3393 | CA | SER | C | 15 | −17.811 | −67.278 | 88.882 | 1.00 | 33.18 | C |
| ATOM | 3394 | C | SER | C | 15 | −18.911 | −66.976 | 87.855 | 1.00 | 35.06 | C |

TABLE 10.4-continued

| ATOM | 3395 | O | SER | C | 15 | −18.601 | −66.892 | 86.661 | 1.00 | 34.68 | O |
| --- | --- | --- | --- | --- | --- | --- | --- | --- | --- | --- | --- |
| ATOM | 3396 | CB | SER | C | 15 | −17.276 | −68.717 | 88.689 | 1.00 | 35.00 | C |
| ATOM | 3397 | OG | SER | C | 15 | −18.279 | −69.665 | 88.363 | 1.00 | 36.60 | O |
| ATOM | 3398 | N | GLU | C | 16 | −20.172 | −66.781 | 88.266 | 1.00 | 33.98 | N |
| ATOM | 3399 | CA | GLU | C | 16 | −21.187 | −66.305 | 87.322 | 1.00 | 35.39 | C |
| ATOM | 3400 | C | GLU | C | 16 | −20.811 | −64.890 | 86.852 | 1.00 | 35.84 | C |
| ATOM | 3401 | O | GLU | C | 16 | −19.841 | −64.279 | 87.324 | 1.00 | 35.76 | O |
| ATOM | 3402 | CB | GLU | C | 16 | −22.590 | −66.308 | 87.953 | 1.00 | 33.60 | C |
| ATOM | 3403 | CG | GLU | C | 16 | −22.982 | −67.595 | 88.701 | 1.00 | 38.40 | C |
| ATOM | 3404 | CD | GLU | C | 16 | −24.487 | −67.720 | 89.061 | 1.00 | 49.48 | C |
| ATOM | 3405 | OE1 | GLU | C | 16 | −25.199 | −66.698 | 89.225 | 1.00 | 50.75 | O |
| ATOM | 3406 | OE2 | GLU | C | 16 | −24.950 | −68.866 | 89.261 | 1.00 | 51.03 | O1− |
| ATOM | 3407 | N | THR | C | 17 | −21.570 | −64.359 | 85.905 | 1.00 | 32.01 | N |
| ATOM | 3408 | CA | THR | C | 17 | −21.301 | −63.010 | 85.451 | 1.00 | 32.01 | C |
| ATOM | 3409 | C | THR | C | 17 | −22.463 | −62.094 | 85.818 | 1.00 | 39.55 | C |
| ATOM | 3410 | O | THR | C | 17 | −23.637 | −62.460 | 85.685 | 1.00 | 36.43 | O |
| ATOM | 3411 | CB | THR | C | 17 | −20.978 | −62.950 | 83.939 | 1.00 | 34.07 | C |
| ATOM | 3412 | OG1 | THR | C | 17 | −21.956 | −62.180 | 83.230 | 1.00 | 39.64 | O |
| ATOM | 3413 | CG2 | THR | C | 17 | −20.841 | −64.327 | 83.325 | 1.00 | 35.94 | C |
| ATOM | 3414 | N | LEU | C | 18 | −22.109 | −60.901 | 86.295 | 1.00 | 37.34 | N |
| ATOM | 3415 | CA | LEU | C | 18 | −23.065 | −59.889 | 86.703 | 1.00 | 30.52 | C |
| ATOM | 3416 | C | LEU | C | 18 | −23.481 | −59.095 | 85.476 | 1.00 | 34.01 | C |
| ATOM | 3417 | O | LEU | C | 18 | −22.639 | −58.717 | 84.651 | 1.00 | 35.55 | O |
| ATOM | 3418 | CB | LEU | C | 18 | −22.437 | −59.006 | 87.782 | 1.00 | 29.47 | C |
| ATOM | 3419 | CG | LEU | C | 18 | −22.993 | −57.708 | 88.384 | 1.00 | 35.82 | C |
| ATOM | 3420 | CD1 | LEU | C | 18 | −22.732 | −56.524 | 87.491 | 1.00 | 32.88 | C |
| ATOM | 3421 | CD2 | LEU | C | 18 | −24.488 | −57.846 | 88.679 | 1.00 | 31.62 | C |
| ATOM | 3422 | N | SER | C | 19 | −24.783 | −58.870 | 85.340 | 1.00 | 31.00 | N |
| ATOM | 3423 | CA | SER | C | 19 | −25.301 | −58.146 | 84.187 | 1.00 | 36.91 | C |
| ATOM | 3424 | C | SER | C | 19 | −26.378 | −57.173 | 84.657 | 1.00 | 32.12 | C |
| ATOM | 3425 | O | SER | C | 19 | −27.371 | −57.593 | 85.262 | 1.00 | 30.22 | O |
| ATOM | 3426 | CB | SER | C | 19 | −25.835 | −59.143 | 83.141 | 1.00 | 33.82 | C |
| ATOM | 3427 | OG | SER | C | 19 | −26.265 | −58.506 | 81.963 | 1.00 | 42.48 | O |
| ATOM | 3428 | N | LEU | C | 20 | −26.175 | −55.877 | 84.364 | 1.00 | 30.42 | N |
| ATOM | 3429 | CA | LEU | C | 20 | −27.041 | −54.785 | 84.804 | 1.00 | 30.56 | C |
| ATOM | 3430 | C | LEU | C | 20 | −27.300 | −53.840 | 83.643 | 1.00 | 29.54 | C |
| ATOM | 3431 | O | LEU | C | 20 | −26.430 | −53.618 | 82.801 | 1.00 | 31.80 | O |
| ATOM | 3432 | CB | LEU | C | 20 | −26.416 | −53.973 | 85.970 | 1.00 | 25.88 | C |
| ATOM | 3433 | CG | LEU | C | 20 | −26.042 | −54.745 | 87.243 | 1.00 | 27.95 | C |
| ATOM | 3434 | CD1 | LEU | C | 20 | −25.312 | −53.866 | 88.232 | 1.00 | 25.17 | C |
| ATOM | 3435 | CD2 | LEU | C | 20 | −27.288 | −55.391 | 87.897 | 1.00 | 28.86 | C |
| ATOM | 3436 | N | THR | C | 21 | −28.479 | −53.236 | 83.636 | 1.00 | 29.19 | N |
| ATOM | 3437 | CA | THR | C | 21 | −28.844 | −52.262 | 82.616 | 1.00 | 32.34 | C |
| ATOM | 3438 | C | THR | C | 21 | −29.444 | −51.043 | 83.297 | 1.00 | 33.93 | C |
| ATOM | 3439 | O | THR | C | 21 | −30.059 | −51.155 | 84.360 | 1.00 | 41.09 | O |
| ATOM | 3440 | CB | THR | C | 21 | −29.833 | −52.839 | 81.576 | 1.00 | 32.67 | C |
| ATOM | 3441 | OG1 | THR | C | 21 | −29.282 | −54.034 | 81.016 | 1.00 | 29.98 | O |
| ATOM | 3442 | CG2 | THR | C | 21 | −30.116 | −51.832 | 80.457 | 1.00 | 28.76 | C |
| ATOM | 3443 | N | CYS | C | 22 | −29.221 | −49.880 | 82.686 | 1.00 | 28.26 | N |
| ATOM | 3444 | CA | CYS | C | 22 | −29.766 | −48.596 | 83.090 | 1.00 | 26.22 | C |
| ATOM | 3445 | C | CYS | C | 22 | −30.582 | −48.024 | 81.939 | 1.00 | 35.11 | C |
| ATOM | 3446 | O | CYS | C | 22 | −30.119 | −48.022 | 80.794 | 1.00 | 35.88 | O |
| ATOM | 3447 | CB | CYS | C | 22 | −28.601 | −47.671 | 83.441 | 1.00 | 34.45 | C |
| ATOM | 3448 | SG | CYS | C | 22 | −28.863 | −46.199 | 84.443 | 1.00 | 35.91 | S |
| ATOM | 3449 | N | ALA | C | 23 | −31.786 | −47.526 | 82.223 | 1.00 | 41.07 | N |
| ATOM | 3450 | CA | ALA | C | 23 | −32.593 | −46.849 | 81.211 | 1.00 | 32.31 | C |
| ATOM | 3451 | C | ALA | C | 23 | −32.715 | −45.377 | 81.565 | 1.00 | 38.18 | C |
| ATOM | 3452 | O | ALA | C | 23 | −33.077 | −45.034 | 82.693 | 1.00 | 40.40 | O |
| ATOM | 3453 | CB | ALA | C | 23 | −33.971 | −47.489 | 81.072 | 1.00 | 31.29 | C |
| ATOM | 3454 | N | VAL | C | 24 | −32.419 | −44.515 | 80.601 | 1.00 | 37.14 | N |
| ATOM | 3455 | CA | VAL | C | 24 | −32.433 | −43.067 | 80.777 | 1.00 | 34.17 | C |
| ATOM | 3456 | C | VAL | C | 24 | −33.726 | −42.531 | 80.183 | 1.00 | 39.79 | C |
| ATOM | 3457 | O | VAL | C | 24 | −34.063 | −42.841 | 79.033 | 1.00 | 44.85 | O |
| ATOM | 3458 | CB | VAL | C | 24 | −31.202 | −42.429 | 80.111 | 1.00 | 35.68 | C |
| ATOM | 3459 | CG1 | VAL | C | 24 | −31.194 | −40.927 | 80.274 | 1.00 | 33.16 | C |
| ATOM | 3460 | CG2 | VAL | C | 24 | −29.937 | −43.034 | 80.689 | 1.00 | 35.47 | C |
| ATOM | 3461 | N | SER | C | 25 | −34.433 | −41.694 | 80.936 | 1.00 | 40.19 | N |
| ATOM | 3462 | CA | SER | C | 25 | −35.722 | −41.217 | 80.453 | 1.00 | 37.50 | C |
| ATOM | 3463 | C | SER | C | 25 | −35.843 | −39.707 | 80.355 | 1.00 | 46.83 | C |
| ATOM | 3464 | O | SER | C | 25 | −36.323 | −39.206 | 79.339 | 1.00 | 56.63 | O |
| ATOM | 3465 | CB | SER | C | 25 | −36.842 | −41.735 | 81.372 | 1.00 | 39.57 | C |
| ATOM | 3466 | OG | SER | C | 25 | −36.448 | −42.914 | 82.077 | 1.00 | 44.46 | O |
| ATOM | 3467 | N | GLY | C | 26 | −35.362 | −38.958 | 81.342 | 1.00 | 46.38 | N |
| ATOM | 3468 | CA | GLY | C | 26 | −35.703 | −37.542 | 81.413 | 1.00 | 45.90 | C |
| ATOM | 3469 | C | GLY | C | 26 | −35.175 | −36.666 | 80.290 | 1.00 | 45.91 | C |
| ATOM | 3470 | O | GLY | C | 26 | −35.926 | −35.873 | 79.720 | 1.00 | 50.30 | O |
| ATOM | 3471 | N | GLY | C | 27 | −33.881 | −36.752 | 79.983 | 1.00 | 41.90 | N |
| ATOM | 3472 | CA | GLY | C | 27 | −33.299 | −35.764 | 79.082 | 1.00 | 33.59 | C |
| ATOM | 3473 | C | GLY | C | 27 | −32.626 | −36.313 | 77.847 | 1.00 | 35.39 | C |
| ATOM | 3474 | O | GLY | C | 27 | −33.065 | −37.324 | 77.298 | 1.00 | 41.91 | O |

TABLE 10.4-continued

| | | | | | | | | | | |
|---|---|---|---|---|---|---|---|---|---|---|
| ATOM | 3475 | N | SER | C | 28 | −31.574 | −35.646 | 77.382 | 1.00 | 41.18 | N |
| ATOM | 3476 | CA | SER | C | 28 | −30.856 | −36.113 | 76.204 | 1.00 | 38.29 | C |
| ATOM | 3477 | C | SER | C | 28 | −29.975 | −37.312 | 76.538 | 1.00 | 36.07 | C |
| ATOM | 3478 | O | SER | C | 28 | −29.631 | −37.575 | 77.693 | 1.00 | 37.41 | O |
| ATOM | 3479 | CB | SER | C | 28 | −29.983 | −35.007 | 75.609 | 1.00 | 38.36 | C |
| ATOM | 3480 | OG | SER | C | 28 | −30.761 | −33.920 | 75.126 | 1.00 | 40.67 | O |
| ATOM | 3481 | N | PHE | C | 29 | −29.605 | −38.042 | 75.494 | 1.00 | 36.30 | N |
| ATOM | 3482 | CA | PHE | C | 29 | −28.717 | −39.178 | 75.630 | 1.00 | 36.41 | C |
| ATOM | 3483 | C | PHE | C | 29 | −27.350 | −38.932 | 75.015 | 1.00 | 41.79 | C |
| ATOM | 3484 | O | PHE | C | 29 | −26.408 | −39.669 | 75.329 | 1.00 | 42.57 | O |
| ATOM | 3485 | CB | PHE | C | 29 | −29.357 | −40.414 | 74.999 | 1.00 | 29.89 | C |
| ATOM | 3486 | CG | PHE | C | 29 | −28.843 | −41.712 | 75.541 | 1.00 | 31.96 | C |
| ATOM | 3487 | CD1 | PHE | C | 29 | −28.786 | −41.939 | 76.912 | 1.00 | 37.24 | C |
| ATOM | 3488 | CD2 | PHE | C | 29 | −28.466 | −42.735 | 74.682 | 1.00 | 32.71 | C |
| ATOM | 3489 | CE1 | PHE | C | 29 | −28.325 | −43.161 | 77.428 | 1.00 | 31.78 | C |
| ATOM | 3490 | CE2 | PHE | C | 29 | −28.010 | −43.953 | 75.182 | 1.00 | 32.65 | C |
| ATOM | 3491 | CZ | PHE | C | 29 | −27.946 | −44.167 | 76.558 | 1.00 | 31.78 | C |
| ATOM | 3492 | N | ARG | C | 30 | −27.207 | −37.893 | 74.190 | 1.00 | 36.62 | N |
| ATOM | 3493 | CA | ARG | C | 30 | −26.097 | −37.790 | 73.261 | 1.00 | 40.24 | C |
| ATOM | 3494 | C | ARG | C | 30 | −24.969 | −36.896 | 73.757 | 1.00 | 41.65 | C |
| ATOM | 3495 | O | ARG | C | 30 | −23.861 | −36.972 | 73.223 | 1.00 | 37.36 | O |
| ATOM | 3496 | CB | ARG | C | 30 | −26.601 | −37.249 | 71.922 | 1.00 | 37.58 | C |
| ATOM | 3497 | CG | ARG | C | 30 | −27.046 | −35.805 | 72.068 | 1.00 | 51.10 | C |
| ATOM | 3498 | CD | ARG | C | 30 | −27.335 | −35.130 | 70.748 | 1.00 | 52.17 | C |
| ATOM | 3499 | NE | ARG | C | 30 | −28.733 | −35.284 | 70.381 | 1.00 | 58.44 | N |
| ATOM | 3500 | CZ | ARG | C | 30 | −29.297 | −34.695 | 69.334 | 1.00 | 65.83 | C |
| ATOM | 3501 | NH1 | ARG | C | 30 | −30.583 | −34.897 | 69.073 | 1.00 | 66.12 | N1+ |
| ATOM | 3502 | NH2 | ARG | C | 30 | −28.575 | −33.907 | 68.548 | 1.00 | 74.46 | N |
| ATOM | 3503 | N | TYR | C | 31 | −25.210 | −36.062 | 74.758 | 1.00 | 44.38 | N |
| ATOM | 3504 | CA | TYR | C | 31 | −24.179 | −35.148 | 75.227 | 1.00 | 38.68 | C |
| ATOM | 3505 | C | TYR | C | 31 | −23.376 | −35.702 | 76.382 | 1.00 | 38.31 | C |
| ATOM | 3506 | O | TYR | C | 31 | −22.476 | −35.022 | 76.876 | 1.00 | 37.88 | O |
| ATOM | 3507 | CB | TYR | C | 31 | −24.791 | −33.816 | 75.660 | 1.00 | 39.97 | C |
| ATOM | 3508 | CG | TYR | C | 31 | −25.693 | −33.157 | 74.646 | 1.00 | 38.66 | C |
| ATOM | 3509 | CD1 | TYR | C | 31 | −25.199 | −32.718 | 73.428 | 1.00 | 39.15 | C |
| ATOM | 3510 | CD2 | TYR | C | 31 | −27.032 | −32.967 | 74.913 | 1.00 | 40.52 | C |
| ATOM | 3511 | CE1 | TYR | C | 31 | −26.008 | −32.113 | 72.518 | 1.00 | 41.25 | C |
| ATOM | 3512 | CE2 | TYR | C | 31 | −27.852 | −32.352 | 74.011 | 1.00 | 45.11 | C |
| ATOM | 3513 | CZ | TYR | C | 31 | −27.342 | −31.928 | 72.814 | 1.00 | 48.11 | C |
| ATOM | 3514 | OH | TYR | C | 31 | −28.178 | −31.317 | 71.914 | 1.00 | 50.76 | O |
| ATOM | 3515 | N | TYR | C | 32 | −23.699 | −36.894 | 76.851 | 1.00 | 41.37 | N |
| ATOM | 3516 | CA | TYR | C | 32 | −23.187 | −37.357 | 78.121 | 1.00 | 33.57 | C |
| ATOM | 3517 | C | TYR | C | 32 | −22.357 | −38.615 | 77.953 | 1.00 | 35.33 | C |
| ATOM | 3518 | O | TYR | C | 32 | −22.466 | −39.346 | 76.967 | 1.00 | 39.05 | O |
| ATOM | 3519 | CB | TYR | C | 32 | −24.325 | −37.630 | 79.090 | 1.00 | 34.60 | C |
| ATOM | 3520 | CG | TYR | C | 32 | −25.238 | −36.454 | 79.258 | 1.00 | 38.37 | C |
| ATOM | 3521 | CD1 | TYR | C | 32 | −24.873 | −35.386 | 80.057 | 1.00 | 38.78 | C |
| ATOM | 3522 | CD2 | TYR | C | 32 | −26.472 | −36.408 | 78.610 | 1.00 | 37.80 | C |
| ATOM | 3523 | CE1 | TYR | C | 32 | −25.711 | −34.288 | 80.207 | 1.00 | 42.05 | C |
| ATOM | 3524 | CE2 | TYR | C | 32 | −27.310 | −35.329 | 78.749 | 1.00 | 41.43 | C |
| ATOM | 3525 | CZ | TYR | C | 32 | −26.927 | −34.266 | 79.551 | 1.00 | 45.45 | C |
| ATOM | 3526 | OH | TYR | C | 32 | −27.758 | −33.180 | 79.704 | 1.00 | 53.26 | O |
| ATOM | 3527 | N | TYR | C | 33 | −21.511 | −38.840 | 78.942 | 1.00 | 36.12 | N |
| ATOM | 3528 | CA | TYR | C | 33 | −20.902 | −40.133 | 79.185 | 1.00 | 33.30 | C |
| ATOM | 3529 | C | TYR | C | 33 | −21.731 | −40.841 | 80.236 | 1.00 | 29.90 | C |
| ATOM | 3530 | O | TYR | C | 33 | −22.282 | −40.201 | 81.135 | 1.00 | 34.09 | O |
| ATOM | 3531 | CB | TYR | C | 33 | −19.453 | −39.988 | 79.655 | 1.00 | 32.91 | C |
| ATOM | 3532 | CG | TYR | C | 33 | −18.490 | −39.876 | 78.500 | 1.00 | 32.64 | C |
| ATOM | 3533 | CD1 | TYR | C | 33 | −18.235 | −38.637 | 77.891 | 1.00 | 29.43 | C |
| ATOM | 3534 | CD2 | TYR | C | 33 | −17.843 | −41.004 | 78.005 | 1.00 | 32.78 | C |
| ATOM | 3535 | CE1 | TYR | C | 33 | −17.352 | −38.526 | 76.834 | 1.00 | 31.81 | C |
| ATOM | 3536 | CE2 | TYR | C | 33 | −16.947 | −40.905 | 76.954 | 1.00 | 37.66 | C |
| ATOM | 3537 | CZ | TYR | C | 33 | −16.714 | −39.671 | 76.363 | 1.00 | 36.45 | C |
| ATOM | 3538 | OH | TYR | C | 33 | −15.840 | −39.599 | 75.307 | 1.00 | 33.16 | O |
| ATOM | 3539 | N | TRP | C | 34 | −21.845 | −42.154 | 80.099 | 1.00 | 31.46 | N |
| ATOM | 3540 | CA | TRP | C | 34 | −22.687 | −42.974 | 80.957 | 1.00 | 28.61 | C |
| ATOM | 3541 | C | TRP | C | 34 | −21.790 | −43.981 | 81.658 | 1.00 | 31.34 | C |
| ATOM | 3542 | O | TRP | C | 34 | −20.997 | −44.666 | 80.994 | 1.00 | 26.44 | O |
| ATOM | 3543 | CB | TRP | C | 34 | −23.790 | −43.628 | 80.118 | 1.00 | 25.06 | C |
| ATOM | 3544 | CG | TRP | C | 34 | −24.610 | −42.557 | 79.485 | 1.00 | 31.01 | C |
| ATOM | 3545 | CD1 | TRP | C | 34 | −24.506 | −42.091 | 78.205 | 1.00 | 32.39 | C |
| ATOM | 3546 | CD2 | TRP | C | 34 | −25.632 | −41.770 | 80.113 | 1.00 | 33.17 | C |
| ATOM | 3547 | NE1 | TRP | C | 34 | −25.403 | −41.072 | 77.993 | 1.00 | 33.65 | N |
| ATOM | 3548 | CE2 | TRP | C | 34 | −26.108 | −40.853 | 79.145 | 1.00 | 34.22 | C |
| ATOM | 3549 | CE3 | TRP | C | 34 | −26.205 | −41.761 | 81.389 | 1.00 | 28.29 | C |
| ATOM | 3550 | CZ2 | TRP | C | 34 | −27.131 | −39.940 | 79.416 | 1.00 | 33.64 | C |
| ATOM | 3551 | CZ3 | TRP | C | 34 | −27.211 | −40.834 | 81.659 | 1.00 | 30.29 | C |
| ATOM | 3552 | CH2 | TRP | C | 34 | −27.660 | −39.944 | 80.682 | 1.00 | 29.13 | C |
| ATOM | 3553 | N | SER | C | 35 | −21.903 | −44.049 | 82.998 | 1.00 | 28.84 | N |
| ATOM | 3554 | CA | SER | C | 35 | −20.898 | −44.663 | 83.856 | 1.00 | 26.34 | C |

TABLE 10.4-continued

| | | | | | | | | | | |
|---|---|---|---|---|---|---|---|---|---|---|
| ATOM | 3555 | C | SER | C | 35 | −21.495 | −45.683 | 84.815 | 1.00 | 25.62 | C |
| ATOM | 3556 | O | SER | C | 35 | −22.691 | −45.688 | 85.096 | 1.00 | 28.59 | O |
| ATOM | 3557 | CB | SER | C | 35 | −20.153 | −43.603 | 84.674 | 1.00 | 25.36 | C |
| ATOM | 3558 | OG | SER | C | 35 | −19.476 | −42.699 | 83.828 | 1.00 | 36.45 | O |
| ATOM | 3559 | N | TRP | C | 36 | −20.611 | −46.515 | 85.359 | 1.00 | 24.98 | N |
| ATOM | 3560 | CA | TRP | C | 36 | −20.914 | −47.468 | 86.419 | 1.00 | 22.69 | C |
| ATOM | 3561 | C | TRP | C | 36 | −19.937 | −47.262 | 87.567 | 1.00 | 26.01 | C |
| ATOM | 3562 | O | TRP | C | 36 | −18.723 | −47.189 | 87.354 | 1.00 | 30.88 | O |
| ATOM | 3563 | CB | TRP | C | 36 | −20.829 | −48.911 | 85.911 | 1.00 | 27.21 | C |
| ATOM | 3564 | CG | TRP | C | 36 | −21.922 | −49.263 | 84.951 | 1.00 | 31.29 | C |
| ATOM | 3565 | CD1 | TRP | C | 36 | −21.856 | −49.288 | 83.581 | 1.00 | 27.11 | C |
| ATOM | 3566 | CD2 | TRP | C | 36 | −23.263 | −49.599 | 85.293 | 1.00 | 28.25 | C |
| ATOM | 3567 | NE1 | TRP | C | 36 | −23.082 | −49.636 | 83.050 | 1.00 | 25.91 | N |
| ATOM | 3568 | CE2 | TRP | C | 36 | −23.959 | −49.843 | 84.083 | 1.00 | 31.98 | C |
| ATOM | 3569 | CE3 | TRP | C | 36 | −23.942 | −49.732 | 86.504 | 1.00 | 23.12 | C |
| ATOM | 3570 | CZ2 | TRP | C | 36 | −25.310 | −50.203 | 84.059 | 1.00 | 30.86 | C |
| ATOM | 3571 | CZ3 | TRP | C | 36 | −25.280 | −50.087 | 86.479 | 1.00 | 26.83 | C |
| ATOM | 3572 | CH2 | TRP | C | 36 | −25.954 | −50.315 | 85.266 | 1.00 | 26.13 | C |
| ATOM | 3573 | N | ILE | C | 37 | −20.469 | −47.181 | 88.779 | 1.00 | 27.24 | N |
| ATOM | 3574 | CA | ILE | C | 37 | −19.713 | −46.954 | 90.007 | 1.00 | 25.13 | C |
| ATOM | 3575 | C | ILE | C | 37 | −20.228 | −47.955 | 91.036 | 1.00 | 26.55 | C |
| ATOM | 3576 | O | ILE | C | 37 | −21.442 | −48.138 | 91.155 | 1.00 | 29.45 | O |
| ATOM | 3577 | CB | ILE | C | 37 | −19.904 | −45.502 | 90.503 | 1.00 | 24.76 | C |
| ATOM | 3578 | CG1 | ILE | C | 37 | −19.417 | −44.509 | 89.444 | 1.00 | 26.03 | C |
| ATOM | 3579 | CG2 | ILE | C | 37 | −19.245 | −45.259 | 91.853 | 1.00 | 28.36 | C |
| ATOM | 3580 | CD1 | ILE | C | 37 | −20.031 | −43.142 | 89.552 | 1.00 | 27.83 | C |
| ATOM | 3581 | N | ARG | C | 38 | −19.328 | −48.630 | 91.755 | 1.00 | 21.22 | N |
| ATOM | 3582 | CA | ARG | C | 38 | −19.764 | −49.538 | 92.810 | 1.00 | 25.95 | C |
| ATOM | 3583 | C | ARG | C | 38 | −19.274 | −49.069 | 94.183 | 1.00 | 31.35 | C |
| ATOM | 3584 | O | ARG | C | 38 | −18.283 | −48.340 | 94.308 | 1.00 | 26.88 | O |
| ATOM | 3585 | CB | ARG | C | 38 | −19.314 | −50.993 | 92.559 | 1.00 | 23.96 | C |
| ATOM | 3586 | CG | ARG | C | 38 | −17.834 | −51.151 | 92.450 | 1.00 | 33.62 | C |
| ATOM | 3587 | CD | ARG | C | 38 | −17.312 | −52.176 | 93.382 | 1.00 | 31.96 | C |
| ATOM | 3588 | NE | ARG | C | 38 | −17.339 | −53.503 | 92.796 | 1.00 | 36.58 | N |
| ATOM | 3589 | CZ | ARG | C | 38 | −16.278 | −54.294 | 92.657 | 1.00 | 33.65 | C |
| ATOM | 3590 | NH1 | ARG | C | 38 | −15.072 | −53.910 | 93.057 | 1.00 | 31.68 | N1+ |
| ATOM | 3591 | NH2 | ARG | C | 38 | −16.436 | −55.483 | 92.123 | 1.00 | 28.23 | N |
| ATOM | 3592 | N | GLN | C | 39 | −20.015 | −49.467 | 95.215 | 1.00 | 27.22 | N |
| ATOM | 3593 | CA | GLN | C | 39 | −19.688 | −49.135 | 96.599 | 1.00 | 29.87 | C |
| ATOM | 3594 | C | GLN | C | 39 | −19.795 | −50.406 | 97.437 | 1.00 | 28.44 | C |
| ATOM | 3595 | O | GLN | C | 39 | −20.911 | −50.833 | 97.779 | 1.00 | 29.08 | O |
| ATOM | 3596 | CB | GLN | C | 39 | −20.621 | −48.042 | 97.105 | 1.00 | 24.56 | C |
| ATOM | 3597 | CG | GLN | C | 39 | −20.252 | −47.429 | 98.435 | 1.00 | 28.85 | C |
| ATOM | 3598 | CD | GLN | C | 39 | −21.101 | −46.198 | 98.718 | 1.00 | 36.48 | C |
| ATOM | 3599 | OE1 | GLN | C | 39 | −22.318 | −46.187 | 98.497 | 1.00 | 42.72 | O |
| ATOM | 3600 | NE2 | GLN | C | 39 | −20.459 | −45.144 | 99.169 | 1.00 | 38.36 | N |
| ATOM | 3601 | N | PRO | C | 40 | −18.674 | −51.040 | 97.791 | 1.00 | 30.67 | N |
| ATOM | 3602 | CA | PRO | C | 40 | −18.757 | −52.243 | 98.625 | 1.00 | 27.55 | C |
| ATOM | 3603 | C | PRO | C | 40 | −19.218 | −51.877 | 100.021 | 1.00 | 33.77 | C |
| ATOM | 3604 | O | PRO | C | 40 | −18.964 | −50.757 | 100.496 | 1.00 | 34.43 | O |
| ATOM | 3605 | CB | PRO | C | 40 | −17.315 | −52.776 | 98.621 | 1.00 | 27.60 | C |
| ATOM | 3606 | CG | PRO | C | 40 | −16.645 | −52.058 | 97.420 | 1.00 | 26.34 | C |
| ATOM | 3607 | CD | PRO | C | 40 | −17.294 | −50.736 | 97.371 | 1.00 | 28.79 | C |
| ATOM | 3608 | N | PRO | C | 41 | −19.933 | −52.772 | 100.711 | 1.00 | 38.11 | N |
| ATOM | 3609 | CA | PRO | C | 41 | −20.568 | −52.374 | 101.976 | 1.00 | 33.02 | C |
| ATOM | 3610 | C | PRO | C | 41 | −19.528 | −51.959 | 103.001 | 1.00 | 40.48 | C |
| ATOM | 3611 | O | PRO | C | 41 | −18.509 | −52.636 | 103.187 | 1.00 | 40.42 | O |
| ATOM | 3612 | CB | PRO | C | 41 | −21.327 | −53.631 | 102.408 | 1.00 | 37.98 | C |
| ATOM | 3613 | CG | PRO | C | 41 | −20.611 | −54.752 | 101.751 | 1.00 | 37.85 | C |
| ATOM | 3614 | CD | PRO | C | 41 | −20.123 | −54.207 | 100.431 | 1.00 | 37.87 | C |
| ATOM | 3615 | N | GLY | C | 42 | −19.761 | −50.786 | 103.604 | 1.00 | 40.56 | N |
| ATOM | 3616 | CA | GLY | C | 42 | −18.805 | −50.159 | 104.482 | 1.00 | 38.30 | C |
| ATOM | 3617 | C | GLY | C | 42 | −17.794 | −49.262 | 103.801 | 1.00 | 45.76 | C |
| ATOM | 3618 | O | GLY | C | 42 | −17.212 | −48.400 | 104.462 | 1.00 | 47.20 | O |
| ATOM | 3619 | N | LYS | C | 43 | −17.557 | −49.445 | 102.505 | 1.00 | 44.96 | N |
| ATOM | 3620 | CA | LYS | C | 43 | −16.391 | −48.889 | 101.836 | 1.00 | 42.23 | C |
| ATOM | 3621 | C | LYS | C | 43 | −16.754 | −47.617 | 101.060 | 1.00 | 40.08 | C |
| ATOM | 3622 | O | LYS | C | 43 | −17.835 | −47.040 | 101.222 | 1.00 | 39.81 | O |
| ATOM | 3623 | CB | LYS | C | 43 | −15.764 | −49.967 | 100.939 | 1.00 | 39.38 | C |
| ATOM | 3624 | CG | LYS | C | 43 | −15.348 | −51.222 | 101.710 | 1.00 | 43.20 | C |
| ATOM | 3625 | CD | LYS | C | 43 | −14.763 | −50.832 | 103.075 | 1.00 | 44.43 | C |
| ATOM | 3626 | CE | LYS | C | 43 | −14.563 | −52.031 | 103.993 | 1.00 | 51.32 | C |
| ATOM | 3627 | NZ | LYS | C | 43 | −13.263 | −52.735 | 103.784 | 1.00 | 55.64 | N1+ |
| ATOM | 3628 | N | GLY | C | 44 | −15.827 | −47.168 | 100.217 | 1.00 | 38.92 | N |
| ATOM | 3629 | CA | GLY | C | 44 | −16.003 | −45.991 | 99.404 | 1.00 | 38.32 | C |
| ATOM | 3630 | C | GLY | C | 44 | −16.454 | −46.330 | 98.000 | 1.00 | 39.62 | C |
| ATOM | 3631 | O | GLY | C | 44 | −17.012 | −47.402 | 97.737 | 1.00 | 42.04 | O |
| ATOM | 3632 | N | LEU | C | 45 | −16.159 | −45.425 | 97.075 | 1.00 | 32.83 | N |
| ATOM | 3633 | CA | LEU | C | 45 | −16.642 | −45.491 | 95.709 | 1.00 | 27.76 | C |
| ATOM | 3634 | C | LEU | C | 45 | −15.528 | −45.909 | 94.759 | 1.00 | 30.80 | C |

TABLE 10.4-continued

| ATOM | 3635 | O | LEU | C | 45 | −14.385 | −45.473 | 94.905 | 1.00 | 37.23 | O |
|---|---|---|---|---|---|---|---|---|---|---|---|
| ATOM | 3636 | CB | LEU | C | 45 | −17.213 | −44.134 | 95.309 | 1.00 | 28.31 | C |
| ATOM | 3637 | CG | LEU | C | 45 | −18.413 | −43.760 | 96.186 | 1.00 | 29.60 | C |
| ATOM | 3638 | CD1 | LEU | C | 45 | −18.761 | −42.284 | 96.033 | 1.00 | 25.47 | C |
| ATOM | 3639 | CD2 | LEU | C | 45 | −19.619 | −44.621 | 95.903 | 1.00 | 26.22 | C |
| ATOM | 3640 | N | GLU | C | 46 | −15.834 | −46.819 | 93.839 | 1.00 | 25.91 | N |
| ATOM | 3641 | CA | GLU | C | 46 | −14.895 | −47.185 | 92.791 | 1.00 | 30.55 | C |
| ATOM | 3642 | C | GLU | C | 46 | −15.566 | −47.029 | 91.433 | 1.00 | 35.38 | C |
| ATOM | 3643 | O | GLU | C | 46 | −16.677 | −47.523 | 91.215 | 1.00 | 35.98 | O |
| ATOM | 3644 | CB | GLU | C | 46 | −14.340 | −48.609 | 92.936 | 1.00 | 34.86 | C |
| ATOM | 3645 | CG | GLU | C | 46 | −14.868 | −49.426 | 94.118 | 1.00 | 42.88 | C |
| ATOM | 3646 | CD | GLU | C | 46 | −14.142 | −50.792 | 94.274 | 1.00 | 55.29 | C |
| ATOM | 3647 | OE1 | GLU | C | 46 | −13.692 | −51.365 | 93.231 | 1.00 | 52.24 | O |
| ATOM | 3648 | OE2 | GLU | C | 46 | −14.010 | −51.261 | 95.444 | 1.00 | 42.79 | O1− |
| ATOM | 3649 | N | TRP | C | 47 | −14.880 | −46.345 | 90.524 | 1.00 | 35.22 | N |
| ATOM | 3650 | CA | TRP | C | 47 | −15.389 | −46.093 | 89.189 | 1.00 | 31.80 | C |
| ATOM | 3651 | C | TRP | C | 47 | −15.070 | −47.293 | 88.313 | 1.00 | 32.40 | C |
| ATOM | 3652 | O | TRP | C | 47 | −13.919 | −47.720 | 88.238 | 1.00 | 34.10 | O |
| ATOM | 3653 | CB | TRP | C | 47 | −14.750 | −44.817 | 88.647 | 1.00 | 27.85 | C |
| ATOM | 3654 | CG | TRP | C | 47 | −15.028 | −44.369 | 87.213 | 1.00 | 29.38 | C |
| ATOM | 3655 | CD1 | TRP | C | 47 | −16.066 | −43.591 | 86.769 | 1.00 | 28.35 | C |
| ATOM | 3656 | CD2 | TRP | C | 47 | −14.194 | −44.605 | 86.072 | 1.00 | 31.89 | C |
| ATOM | 3657 | NE1 | TRP | C | 47 | −15.932 | −43.340 | 85.418 | 1.00 | 29.56 | N |
| ATOM | 3658 | CE2 | TRP | C | 47 | −14.792 | −43.954 | 84.970 | 1.00 | 29.80 | C |
| ATOM | 3659 | CE3 | TRP | C | 47 | −12.996 | −45.312 | 85.873 | 1.00 | 29.70 | C |
| ATOM | 3660 | CZ2 | TRP | C | 47 | −14.234 | −43.990 | 83.699 | 1.00 | 30.22 | C |
| ATOM | 3661 | CZ3 | TRP | C | 47 | −12.455 | −45.356 | 84.615 | 1.00 | 26.84 | C |
| ATOM | 3662 | CH2 | TRP | C | 47 | −13.068 | −44.696 | 83.541 | 1.00 | 31.06 | C |
| ATOM | 3663 | N | PHE | C | 48 | −16.096 | −47.849 | 87.666 | 1.00 | 29.92 | N |
| ATOM | 3664 | CA | PHE | C | 48 | −15.868 | −48.990 | 86.792 | 1.00 | 29.20 | C |
| ATOM | 3665 | C | PHE | C | 48 | −15.444 | −48.547 | 85.397 | 1.00 | 29.36 | C |
| ATOM | 3666 | O | PHE | C | 48 | −14.536 | −49.142 | 84.808 | 1.00 | 30.45 | O |
| ATOM | 3667 | CB | PHE | C | 48 | −17.123 | −49.875 | 86.744 | 1.00 | 27.65 | C |
| ATOM | 3668 | CG | PHE | C | 48 | −17.029 | −51.079 | 87.638 | 1.00 | 30.68 | C |
| ATOM | 3669 | CD1 | PHE | C | 48 | −16.381 | −50.992 | 88.876 | 1.00 | 34.82 | C |
| ATOM | 3670 | CD2 | PHE | C | 48 | −17.539 | −52.300 | 87.246 | 1.00 | 31.72 | C |
| ATOM | 3671 | CE1 | PHE | C | 48 | −16.247 | −52.101 | 89.705 | 1.00 | 32.25 | C |
| ATOM | 3672 | CE2 | PHE | C | 48 | −17.423 | −53.420 | 88.075 | 1.00 | 30.94 | C |
| ATOM | 3673 | CZ | PHE | C | 48 | −16.775 | −53.319 | 89.298 | 1.00 | 33.98 | C |
| ATOM | 3674 | N | GLY | C | 49 | −16.078 | −47.519 | 84.858 | 1.00 | 28.11 | N |
| ATOM | 3675 | CA | GLY | C | 49 | −15.826 | −47.128 | 83.488 | 1.00 | 29.63 | C |
| ATOM | 3676 | C | GLY | C | 49 | −16.967 | −46.291 | 82.950 | 1.00 | 32.96 | C |
| ATOM | 3677 | O | GLY | C | 49 | −17.956 | −46.032 | 83.640 | 1.00 | 32.51 | O |
| ATOM | 3678 | N | GLU | C | 50 | −16.831 | −45.916 | 81.674 | 1.00 | 31.40 | N |
| ATOM | 3679 | CA | GLU | C | 50 | −17.768 | −45.012 | 81.011 | 1.00 | 31.61 | C |
| ATOM | 3680 | C | GLU | C | 50 | −17.854 | −45.334 | 79.519 | 1.00 | 30.45 | C |
| ATOM | 3681 | O | GLU | C | 50 | −16.891 | −45.819 | 78.920 | 1.00 | 31.68 | O |
| ATOM | 3682 | CB | GLU | C | 50 | −17.341 | −43.542 | 81.204 | 1.00 | 28.42 | C |
| ATOM | 3683 | CG | GLU | C | 50 | −15.895 | −43.237 | 80.715 | 1.00 | 27.97 | C |
| ATOM | 3684 | CD | GLU | C | 50 | −15.501 | −41.745 | 80.792 | 1.00 | 33.91 | C |
| ATOM | 3685 | OE1 | GLU | C | 50 | −14.488 | −41.342 | 80.144 | 1.00 | 32.01 | O |
| ATOM | 3686 | OE2 | GLU | C | 50 | −16.189 | −40.969 | 81.511 | 1.00 | 33.87 | O1− |
| ATOM | 3687 | N | ILE | C | 51 | −19.006 | −45.009 | 78.914 | 1.00 | 31.49 | N |
| ATOM | 3688 | CA | ILE | C | 51 | −19.254 | −45.162 | 77.481 | 1.00 | 29.58 | C |
| ATOM | 3689 | C | ILE | C | 51 | −19.904 | −43.883 | 76.949 | 1.00 | 36.19 | C |
| ATOM | 3690 | O | ILE | C | 51 | −20.636 | −43.193 | 77.666 | 1.00 | 32.17 | O |
| ATOM | 3691 | CB | ILE | C | 51 | −20.128 | −46.407 | 77.173 | 1.00 | 30.54 | C |
| ATOM | 3692 | CG1 | ILE | C | 51 | −20.175 | −46.709 | 75.657 | 1.00 | 30.91 | C |
| ATOM | 3693 | CG2 | ILE | C | 51 | −21.541 | −46.263 | 77.756 | 1.00 | 22.08 | C |
| ATOM | 3694 | CD1 | ILE | C | 51 | −20.472 | −48.177 | 75.340 | 1.00 | 21.13 | C |
| ATOM | 3695 | N | SER | C | 52 | −19.687 | −43.604 | 75.652 | 1.00 | 44.18 | N |
| ATOM | 3696 | CA | SER | C | 52 | −19.747 | −42.237 | 75.128 | 1.00 | 42.64 | C |
| ATOM | 3697 | C | SER | C | 52 | −21.001 | −41.880 | 74.342 | 1.00 | 41.94 | C |
| ATOM | 3698 | O | SER | C | 52 | −21.272 | −40.681 | 74.190 | 1.00 | 50.21 | O |
| ATOM | 3699 | CB | SER | C | 52 | −18.545 | −41.962 | 74.210 | 1.00 | 46.91 | C |
| ATOM | 3700 | OG | SER | C | 52 | −18.720 | −42.561 | 72.930 | 1.00 | 51.82 | O |
| ATOM | 3701 | N | HIS | C | 53 | −21.739 | −42.865 | 73.831 | 1.00 | 36.80 | N |
| ATOM | 3702 | CA | HIS | C | 53 | −22.860 | −42.688 | 72.900 | 1.00 | 46.33 | C |
| ATOM | 3703 | C | HIS | C | 53 | −22.439 | −43.129 | 71.515 | 1.00 | 45.86 | C |
| ATOM | 3704 | O | HIS | C | 53 | −23.241 | −43.704 | 70.781 | 1.00 | 49.43 | O |
| ATOM | 3705 | CB | HIS | C | 53 | −23.410 | −41.251 | 72.789 | 1.00 | 46.91 | C |
| ATOM | 3706 | CG | HIS | C | 53 | −24.569 | −41.127 | 71.846 | 1.00 | 52.45 | C |
| ATOM | 3707 | ND1 | HIS | C | 53 | −24.405 | −40.953 | 70.488 | 1.00 | 47.45 | N |
| ATOM | 3708 | CD2 | HIS | C | 53 | −25.907 | −41.185 | 72.059 | 1.00 | 50.31 | C |
| ATOM | 3709 | CE1 | HIS | C | 53 | −25.590 | −40.915 | 69.905 | 1.00 | 43.08 | C |
| ATOM | 3710 | NE2 | HIS | C | 53 | −26.519 | −41.054 | 70.835 | 1.00 | 45.78 | N |
| ATOM | 3711 | N | SER | C | 54 | −21.183 | −42.881 | 71.170 | 1.00 | 47.96 | N |
| ATOM | 3712 | CA | SER | C | 54 | −20.637 | −43.213 | 69.863 | 1.00 | 43.93 | C |
| ATOM | 3713 | C | SER | C | 54 | −20.189 | −44.668 | 69.568 | 1.00 | 48.52 | C |
| ATOM | 3714 | O | SER | C | 54 | −19.920 | −44.942 | 68.399 | 1.00 | 63.14 | O |

TABLE 10.4-continued

| ATOM | 3715 | CB | SER | C | 54 | −19.464 | −42.299 | 69.569 | 1.00 | 40.27 | C |
|---|---|---|---|---|---|---|---|---|---|---|---|
| ATOM | 3716 | OG | SER | C | 54 | −18.399 | −42.599 | 70.436 | 1.00 | 55.03 | O |
| ATOM | 3717 | N | GLY | C | 55 | −19.968 | −45.572 | 70.529 | 1.00 | 41.03 | N |
| ATOM | 3718 | CA | GLY | C | 55 | −19.813 | −45.352 | 71.953 | 1.00 | 41.92 | C |
| ATOM | 3719 | C | GLY | C | 55 | −18.437 | −45.851 | 72.360 | 1.00 | 42.37 | C |
| ATOM | 3720 | O | GLY | C | 55 | −18.224 | −47.051 | 72.578 | 1.00 | 27.61 | O |
| ATOM | 3721 | N | SER | C | 56 | −17.483 | −44.927 | 72.441 | 1.00 | 44.03 | N |
| ATOM | 3722 | CA | SER | C | 56 | −16.156 | −45.301 | 72.891 | 1.00 | 40.77 | C |
| ATOM | 3723 | C | SER | C | 56 | −16.173 | −45.524 | 74.394 | 1.00 | 39.74 | C |
| ATOM | 3724 | O | SER | C | 56 | −17.034 | −45.019 | 75.114 | 1.00 | 41.06 | O |
| ATOM | 3725 | CB | SER | C | 56 | −15.122 | −44.243 | 72.520 | 1.00 | 39.37 | C |
| ATOM | 3726 | OG | SER | C | 56 | −15.509 | −42.986 | 73.018 | 1.00 | 48.88 | O |
| ATOM | 3727 | N | THR | C | 57 | −15.206 | −46.299 | 74.857 | 1.00 | 38.23 | N |
| ATOM | 3728 | CA | THR | C | 57 | −15.193 | −46.845 | 76.196 | 1.00 | 29.07 | C |
| ATOM | 3729 | C | THR | C | 57 | −13.912 | −46.459 | 76.932 | 1.00 | 32.82 | C |
| ATOM | 3730 | O | THR | C | 57 | −12.865 | −46.266 | 76.312 | 1.00 | 34.18 | O |
| ATOM | 3731 | CB | THR | C | 57 | −15.325 | −48.352 | 76.054 | 1.00 | 31.23 | C |
| ATOM | 3732 | OG1 | THR | C | 57 | −16.527 | −48.801 | 76.681 | 1.00 | 34.61 | O |
| ATOM | 3733 | CG2 | THR | C | 57 | −14.109 | −49.052 | 76.571 | 1.00 | 31.55 | C |
| ATOM | 3734 | N | ASN | C | 58 | −14.002 | −46.318 | 78.257 | 1.00 | 31.01 | N |
| ATOM | 3735 | CA | ASN | C | 58 | −12.838 | −46.118 | 79.121 | 1.00 | 27.41 | C |
| ATOM | 3736 | C | ASN | C | 58 | −13.078 | −46.909 | 80.389 | 1.00 | 30.68 | C |
| ATOM | 3737 | O | ASN | C | 58 | −14.007 | −46.592 | 81.136 | 1.00 | 31.50 | O |
| ATOM | 3738 | CB | ASN | C | 58 | −12.590 | −44.649 | 79.491 | 1.00 | 24.84 | C |
| ATOM | 3739 | CG | ASN | C | 58 | −12.449 | −43.760 | 78.297 | 1.00 | 28.91 | C |
| ATOM | 3740 | OD1 | ASN | C | 58 | −11.439 | −43.792 | 77.598 | 1.00 | 34.90 | O |
| ATOM | 3741 | ND2 | ASN | C | 58 | −13.458 | −42.937 | 78.055 | 1.00 | 33.30 | N |
| ATOM | 3742 | N | TYR | C | 59 | −12.249 | −47.915 | 80.640 | 1.00 | 29.82 | N |
| ATOM | 3743 | CA | TYR | C | 59 | −12.450 | −48.796 | 81.775 | 1.00 | 33.27 | C |
| ATOM | 3744 | C | TYR | C | 59 | −11.447 | −48.512 | 82.871 | 1.00 | 30.48 | C |
| ATOM | 3745 | O | TYR | C | 59 | −10.402 | −47.903 | 82.644 | 1.00 | 32.69 | O |
| ATOM | 3746 | CB | TYR | C | 59 | −12.326 | −50.263 | 81.379 | 1.00 | 31.17 | C |
| ATOM | 3747 | CG | TYR | C | 59 | −13.321 | −50.726 | 80.367 | 1.00 | 34.24 | C |
| ATOM | 3748 | CD1 | TYR | C | 59 | −14.679 | −50.757 | 80.670 | 1.00 | 35.71 | C |
| ATOM | 3749 | CD2 | TYR | C | 59 | −12.913 | −51.192 | 79.125 | 1.00 | 34.28 | C |
| ATOM | 3750 | CE1 | TYR | C | 59 | −15.611 | −51.214 | 79.741 | 1.00 | 37.87 | C |
| ATOM | 3751 | CE2 | TYR | C | 59 | −13.837 | −51.665 | 78.194 | 1.00 | 33.51 | C |
| ATOM | 3752 | CZ | TYR | C | 59 | −15.183 | −51.659 | 78.498 | 1.00 | 33.62 | C |
| ATOM | 3753 | OH | TYR | C | 59 | −16.095 | −52.115 | 77.572 | 1.00 | 34.03 | O |
| ATOM | 3754 | N | ASN | C | 60 | −11.765 | −48.993 | 84.060 | 1.00 | 29.37 | N |
| ATOM | 3755 | CA | ASN | C | 60 | −10.778 | −48.990 | 85.128 | 1.00 | 38.84 | C |
| ATOM | 3756 | C | ASN | C | 60 | −9.747 | −50.095 | 84.877 | 1.00 | 40.23 | C |
| ATOM | 3757 | O | ASN | C | 60 | −10.119 | −51.280 | 84.829 | 1.00 | 38.66 | O |
| ATOM | 3758 | CB | ASN | C | 60 | −11.437 | −49.191 | 86.480 | 1.00 | 32.03 | C |
| ATOM | 3759 | CG | ASN | C | 60 | −10.484 | −48.942 | 87.617 | 1.00 | 34.48 | C |
| ATOM | 3760 | OD1 | ASN | C | 60 | −9.270 | −48.906 | 87.422 | 1.00 | 34.69 | O |
| ATOM | 3761 | ND2 | ASN | C | 60 | −11.018 | −48.808 | 88.819 | 1.00 | 30.93 | N |
| ATOM | 3762 | N | PRO | C | 61 | −8.458 | −49.763 | 84.741 | 1.00 | 38.19 | N |
| ATOM | 3763 | CA | PRO | C | 61 | −7.459 | −50.799 | 84.419 | 1.00 | 38.23 | C |
| ATOM | 3764 | C | PRO | C | 61 | −7.385 | −51.943 | 85.412 | 1.00 | 36.76 | C |
| ATOM | 3765 | O | PRO | C | 61 | −6.981 | −53.047 | 85.035 | 1.00 | 42.26 | O |
| ATOM | 3766 | CB | PRO | C | 61 | −6.156 | −49.991 | 84.368 | 1.00 | 37.21 | C |
| ATOM | 3767 | CG | PRO | C | 61 | −6.609 | −48.658 | 83.864 | 1.00 | 35.33 | C |
| ATOM | 3768 | CD | PRO | C | 61 | −7.870 | −48.412 | 84.660 | 1.00 | 38.00 | C |
| ATOM | 3769 | N | SER | C | 62 | −7.766 | −51.718 | 86.663 | 1.00 | 37.94 | N |
| ATOM | 3770 | CA | SER | C | 62 | −7.755 | −52.781 | 87.665 | 1.00 | 41.69 | C |
| ATOM | 3771 | C | SER | C | 62 | −8.781 | −53.878 | 87.376 | 1.00 | 45.04 | C |
| ATOM | 3772 | O | SER | C | 62 | −8.587 | −55.025 | 87.790 | 1.00 | 52.57 | O |
| ATOM | 3773 | CB | SER | C | 62 | −8.016 | −52.197 | 89.039 | 1.00 | 36.72 | C |
| ATOM | 3774 | OG | SER | C | 62 | −9.370 | −51.807 | 89.106 | 1.00 | 43.47 | O |
| ATOM | 3775 | N | LEU | C | 63 | −9.927 | −53.530 | 86.792 | 1.00 | 39.84 | N |
| ATOM | 3776 | CA | LEU | C | 63 | −10.881 | −54.557 | 86.394 | 1.00 | 42.71 | C |
| ATOM | 3777 | C | LEU | C | 63 | −10.311 | −55.431 | 85.298 | 1.00 | 47.05 | C |
| ATOM | 3778 | O | LEU | C | 63 | −10.608 | −56.635 | 85.235 | 1.00 | 44.87 | O |
| ATOM | 3779 | CB | LEU | C | 63 | −12.177 | −53.929 | 85.914 | 1.00 | 39.14 | C |
| ATOM | 3780 | CG | LEU | C | 63 | −12.942 | −53.409 | 87.106 | 1.00 | 41.14 | C |
| ATOM | 3781 | CD1 | LEU | C | 63 | −14.324 | −52.965 | 86.651 | 1.00 | 39.64 | C |
| ATOM | 3782 | CD2 | LEU | C | 63 | −13.003 | −54.481 | 88.194 | 1.00 | 37.86 | C |
| ATOM | 3783 | N | LYS | C | 64 | −9.555 | −54.816 | 84.389 | 1.00 | 50.10 | N |
| ATOM | 3784 | CA | LYS | C | 64 | −8.831 | −55.520 | 83.346 | 1.00 | 45.99 | C |
| ATOM | 3785 | C | LYS | C | 64 | −9.797 | −56.175 | 82.376 | 1.00 | 46.14 | C |
| ATOM | 3786 | O | LYS | C | 64 | −10.663 | −55.500 | 81.805 | 1.00 | 47.95 | O |
| ATOM | 3787 | CB | LYS | C | 64 | −7.875 | −56.515 | 84.000 | 1.00 | 45.38 | C |
| ATOM | 3788 | CG | LYS | C | 64 | −6.494 | −56.522 | 83.397 | 1.00 | 56.60 | C |
| ATOM | 3789 | CD | LYS | C | 64 | −5.651 | −57.503 | 84.141 | 1.00 | 57.39 | C |
| ATOM | 3790 | CE | LYS | C | 64 | −5.450 | −56.943 | 85.551 | 1.00 | 64.49 | C |
| ATOM | 3791 | NZ | LYS | C | 64 | −4.775 | −57.891 | 86.483 | 1.00 | 75.39 | N1+ |
| ATOM | 3792 | N | ALA | C | 65 | −9.676 | −57.484 | 82.203 | 1.00 | 43.80 | N |
| ATOM | 3793 | CA | ALA | C | 65 | −10.484 | −58.168 | 81.210 | 1.00 | 43.71 | C |
| ATOM | 3794 | C | ALA | C | 65 | −11.908 | −58.474 | 81.670 | 1.00 | 40.71 | C |

TABLE 10.4-continued

| | | | | | | | | | | |
|---|---|---|---|---|---|---|---|---|---|---|
| ATOM | 3795 | O | ALA | C | 65 | −12.730 | −58.856 | 80.830 | 1.00 | 46.79 | O |
| ATOM | 3796 | CB | ALA | C | 65 | −9.789 | −59.462 | 80.808 | 1.00 | 46.98 | C |
| ATOM | 3797 | N | ARG | C | 66 | −12.232 | −58.303 | 82.958 | 1.00 | 34.69 | N |
| ATOM | 3798 | CA | ARG | C | 66 | −13.508 | −58.800 | 83.490 | 1.00 | 35.91 | C |
| ATOM | 3799 | C | ARG | C | 66 | −14.721 | −57.969 | 83.088 | 1.00 | 34.48 | C |
| ATOM | 3800 | O | ARG | C | 66 | −15.841 | −58.467 | 83.207 | 1.00 | 34.86 | O |
| ATOM | 3801 | CB | ARG | C | 66 | −13.467 | −58.840 | 85.013 | 1.00 | 37.25 | C |
| ATOM | 3802 | CG | ARG | C | 66 | −12.241 | −59.497 | 85.584 | 1.00 | 41.56 | C |
| ATOM | 3803 | CD | ARG | C | 66 | −12.258 | −59.442 | 87.090 | 1.00 | 33.48 | C |
| ATOM | 3804 | NE | ARG | C | 66 | −13.537 | −59.870 | 87.586 | 1.00 | 36.42 | N |
| ATOM | 3805 | CZ | ARG | C | 66 | −14.096 | −59.444 | 88.710 | 1.00 | 31.00 | C |
| ATOM | 3806 | NH1 | ARG | C | 66 | −15.275 | −59.921 | 89.045 | 1.00 | 32.67 | N |
| ATOM | 3807 | NH2 | ARG | C | 66 | −13.499 | −58.556 | 89.483 | 1.00 | 29.13 | N |
| ATOM | 3808 | N | VAL | C | 67 | −14.545 | −56.720 | 82.650 | 1.00 | 36.81 | N |
| ATOM | 3809 | CA | VAL | C | 67 | −15.642 | −55.760 | 82.552 | 1.00 | 33.37 | C |
| ATOM | 3810 | C | VAL | C | 67 | −15.923 | −55.381 | 81.104 | 1.00 | 38.37 | C |
| ATOM | 3811 | O | VAL | C | 67 | −15.005 | −55.251 | 80.288 | 1.00 | 41.21 | O |
| ATOM | 3812 | CB | VAL | C | 67 | −15.353 | −54.501 | 83.391 | 1.00 | 36.36 | C |
| ATOM | 3813 | CG1 | VAL | C | 67 | −14.134 | −53.780 | 82.865 | 1.00 | 34.65 | C |
| ATOM | 3814 | CG2 | VAL | C | 67 | −16.552 | −53.582 | 83.346 | 1.00 | 36.14 | C |
| ATOM | 3815 | N | THR | C | 68 | −17.203 | −55.212 | 80.792 | 1.00 | 35.08 | N |
| ATOM | 3816 | CA | THR | C | 68 | −17.654 | −54.712 | 79.510 | 1.00 | 32.85 | C |
| ATOM | 3817 | C | THR | C | 68 | −18.769 | −53.715 | 79.758 | 1.00 | 29.58 | C |
| ATOM | 3818 | O | THR | C | 68 | −19.686 | −53.981 | 80.536 | 1.00 | 30.01 | O |
| ATOM | 3819 | CB | THR | C | 68 | −18.196 | −55.829 | 78.605 | 1.00 | 36.95 | C |
| ATOM | 3820 | OG1 | THR | C | 68 | −17.324 | −56.957 | 78.657 | 1.00 | 39.01 | O |
| ATOM | 3821 | CG2 | THR | C | 68 | −18.339 | −55.320 | 77.154 | 1.00 | 28.49 | C |
| ATOM | 3822 | N | ILE | C | 69 | −18.719 | −52.595 | 79.060 | 1.00 | 33.88 | N |
| ATOM | 3823 | CA | ILE | C | 69 | −19.792 | −51.617 | 79.088 | 1.00 | 33.76 | C |
| ATOM | 3824 | C | ILE | C | 69 | −20.257 | −51.398 | 77.658 | 1.00 | 34.31 | C |
| ATOM | 3825 | O | ILE | C | 69 | −19.439 | −51.192 | 76.757 | 1.00 | 34.33 | O |
| ATOM | 3826 | CB | ILE | C | 69 | −19.349 | −50.307 | 79.752 | 1.00 | 25.14 | C |
| ATOM | 3827 | CG1 | ILE | C | 69 | −19.047 | −50.590 | 81.218 | 1.00 | 24.64 | C |
| ATOM | 3828 | CG2 | ILE | C | 69 | −20.418 | −49.246 | 79.567 | 1.00 | 21.90 | C |
| ATOM | 3829 | CD1 | ILE | C | 69 | −18.299 | −49.486 | 81.965 | 1.00 | 29.90 | C |
| ATOM | 3830 | N | SER | C | 70 | −21.567 | −51.459 | 77.455 | 1.00 | 35.47 | N |
| ATOM | 3831 | CA | SER | C | 70 | −22.170 | −51.319 | 76.141 | 1.00 | 33.35 | C |
| ATOM | 3832 | C | SER | C | 70 | −23.321 | −50.323 | 76.226 | 1.00 | 31.43 | C |
| ATOM | 3833 | O | SER | C | 70 | −23.862 | −50.073 | 77.305 | 1.00 | 30.39 | O |
| ATOM | 3834 | CB | SER | C | 70 | −22.654 | −52.668 | 75.638 | 1.00 | 23.50 | C |
| ATOM | 3835 | OG | SER | C | 70 | −23.508 | −53.222 | 76.609 | 1.00 | 35.38 | O |
| ATOM | 3836 | N | ILE | C | 71 | −23.683 | −49.755 | 75.074 | 1.00 | 30.99 | N |
| ATOM | 3837 | CA | ILE | C | 71 | −24.705 | −48.722 | 74.981 | 1.00 | 30.48 | C |
| ATOM | 3838 | C | ILE | C | 71 | −25.660 | −49.058 | 73.838 | 1.00 | 34.95 | C |
| ATOM | 3839 | O | ILE | C | 71 | −25.246 | −49.587 | 72.806 | 1.00 | 34.86 | O |
| ATOM | 3840 | CB | ILE | C | 71 | −24.064 | −47.335 | 74.790 | 1.00 | 32.81 | C |
| ATOM | 3841 | CG1 | ILE | C | 71 | −25.061 | −46.237 | 75.120 | 1.00 | 29.16 | C |
| ATOM | 3842 | CG2 | ILE | C | 71 | −23.480 | −47.167 | 73.376 | 1.00 | 30.88 | C |
| ATOM | 3843 | CD1 | ILE | C | 71 | −24.442 | −44.876 | 75.149 | 1.00 | 30.80 | C |
| ATOM | 3844 | N | ASP | C | 72 | −26.949 | −48.798 | 74.042 | 1.00 | 39.76 | N |
| ATOM | 3845 | CA | ASP | C | 72 | −27.988 | −48.981 | 73.025 | 1.00 | 35.04 | C |
| ATOM | 3846 | C | ASP | C | 72 | −28.651 | −47.630 | 72.771 | 1.00 | 39.02 | C |
| ATOM | 3847 | O | ASP | C | 72 | −29.552 | −47.241 | 73.518 | 1.00 | 43.96 | O |
| ATOM | 3848 | CB | ASP | C | 72 | −29.012 | −50.011 | 73.491 | 1.00 | 37.61 | C |
| ATOM | 3849 | CG | ASP | C | 72 | −30.119 | −50.283 | 72.465 | 1.00 | 45.97 | C |
| ATOM | 3850 | OD1 | ASP | C | 72 | −30.612 | −49.345 | 71.798 | 1.00 | 48.11 | O |
| ATOM | 3851 | OD2 | ASP | C | 72 | −30.518 | −51.461 | 72.346 | 1.00 | 49.16 | O1− |
| ATOM | 3852 | N | THR | C | 73 | −28.231 | −46.910 | 71.726 | 1.00 | 38.09 | N |
| ATOM | 3853 | CA | THR | C | 73 | −28.807 | −45.586 | 71.501 | 1.00 | 40.83 | C |
| ATOM | 3854 | C | THR | C | 73 | −30.255 | −45.626 | 71.029 | 1.00 | 44.67 | C |
| ATOM | 3855 | O | THR | C | 73 | −30.892 | −44.568 | 70.997 | 1.00 | 48.41 | O |
| ATOM | 3856 | CB | THR | C | 73 | −27.996 | −44.759 | 70.502 | 1.00 | 39.06 | C |
| ATOM | 3857 | OG1 | THR | C | 73 | −27.774 | −45.521 | 69.308 | 1.00 | 46.00 | O |
| ATOM | 3858 | CG2 | THR | C | 73 | −26.679 | −44.327 | 71.114 | 1.00 | 40.64 | C |
| ATOM | 3859 | O | SER | C | 74 | −33.984 | −45.804 | 71.487 | 1.00 | 55.05 | O |
| ATOM | 3860 | N | SER | C | 74 | −30.781 | −46.782 | 70.622 | 1.00 | 41.41 | N |
| ATOM | 3861 | CA | SER | C | 74 | −32.194 | −46.829 | 70.244 | 1.00 | 49.65 | C |
| ATOM | 3862 | C | SER | C | 74 | −33.087 | −46.665 | 71.466 | 1.00 | 55.28 | C |
| ATOM | 3863 | CB | SER | C | 74 | −32.524 | −48.149 | 69.539 | 1.00 | 50.83 | C |
| ATOM | 3864 | OG | SER | C | 74 | −31.745 | −48.338 | 68.375 | 1.00 | 60.96 | O |
| ATOM | 3865 | O | LYS | C | 75 | −33.672 | −46.626 | 75.929 | 1.00 | 49.05 | O |
| ATOM | 3866 | N | LYS | C | 75 | −32.833 | −47.481 | 72.498 | 1.00 | 48.96 | N |
| ATOM | 3867 | CA | LYS | C | 75 | −33.603 | −47.551 | 73.730 | 1.00 | 48.48 | C |
| ATOM | 3868 | C | LYS | C | 75 | −33.120 | −46.598 | 74.819 | 1.00 | 45.98 | C |
| ATOM | 3869 | CB | LYS | C | 75 | −33.594 | −48.986 | 74.274 | 1.00 | 47.37 | C |
| ATOM | 3870 | CG | LYS | C | 75 | −34.202 | −49.988 | 73.320 | 1.00 | 54.32 | C |
| ATOM | 3871 | CD | LYS | C | 75 | −34.219 | −51.397 | 73.886 | 1.00 | 53.30 | C |
| ATOM | 3872 | CE | LYS | C | 75 | −34.656 | −52.383 | 72.819 | 1.00 | 62.19 | C |
| ATOM | 3873 | NZ | LYS | C | 75 | −35.421 | −53.518 | 73.409 | 1.00 | 63.45 | N |
| ATOM | 3874 | O | ASN | C | 76 | −31.622 | −45.589 | 77.918 | 1.00 | 39.83 | O |

TABLE 10.4-continued

| | | | | | | | | | | |
|---|---|---|---|---|---|---|---|---|---|---|
| ATOM | 3875 | N | ASN | C | 76 | −32.109 | −45.772 | 74.550 | 1.00 | 41.83 | N |
| ATOM | 3876 | CA | ASN | C | 76 | −31.496 | −44.951 | 75.593 | 1.00 | 43.47 | C |
| ATOM | 3877 | C | ASN | C | 76 | −31.146 | −45.811 | 76.807 | 1.00 | 36.05 | C |
| ATOM | 3878 | CB | ASN | C | 76 | −32.402 | −43.771 | 75.976 | 1.00 | 36.10 | C |
| ATOM | 3879 | CG | ASN | C | 76 | −32.342 | −42.656 | 74.963 | 1.00 | 38.85 | C |
| ATOM | 3880 | OD1 | ASN | C | 76 | −31.821 | −42.833 | 73.857 | 1.00 | 46.14 | O |
| ATOM | 3881 | ND2 | ASN | C | 76 | −32.863 | −41.498 | 75.326 | 1.00 | 45.02 | N |
| ATOM | 3882 | N | GLN | C | 77 | −30.384 | −46.868 | 76.554 | 1.00 | 35.70 | N |
| ATOM | 3883 | CA | GLN | C | 77 | −29.976 | −47.812 | 77.580 | 1.00 | 35.90 | C |
| ATOM | 3884 | C | GLN | C | 77 | −28.472 | −48.013 | 77.506 | 1.00 | 36.92 | C |
| ATOM | 3885 | O | GLN | C | 77 | −27.858 | −47.827 | 76.452 | 1.00 | 34.91 | O |
| ATOM | 3886 | CB | GLN | C | 77 | −30.697 | −49.147 | 77.409 | 1.00 | 33.22 | C |
| ATOM | 3887 | CG | GLN | C | 77 | −32.184 | −49.061 | 77.707 | 1.00 | 37.44 | C |
| ATOM | 3888 | CD | GLN | C | 77 | −32.889 | −50.386 | 77.542 | 1.00 | 35.36 | C |
| ATOM | 3889 | OE1 | GLN | C | 77 | −32.301 | −51.358 | 77.088 | 1.00 | 30.09 | O |
| ATOM | 3890 | NE2 | GLN | C | 77 | −34.154 | −50.431 | 77.919 | 1.00 | 37.97 | N |
| ATOM | 3891 | N | PHE | C | 78 | −27.882 | −48.404 | 78.638 | 1.00 | 30.45 | N |
| ATOM | 3892 | CA | PHE | C | 78 | −26.495 | −48.839 | 78.650 | 1.00 | 28.00 | C |
| ATOM | 3893 | C | PHE | C | 78 | −26.342 | −49.884 | 79.739 | 1.00 | 32.46 | C |
| ATOM | 3894 | O | PHE | C | 78 | −27.128 | −49.933 | 80.686 | 1.00 | 33.14 | O |
| ATOM | 3895 | CB | PHE | C | 78 | −25.501 | −47.668 | 78.812 | 1.00 | 29.59 | C |
| ATOM | 3896 | CG | PHE | C | 78 | −25.617 | −46.911 | 80.109 | 1.00 | 29.92 | C |
| ATOM | 3897 | CD1 | PHE | C | 78 | −26.541 | −45.898 | 80.252 | 1.00 | 28.69 | C |
| ATOM | 3898 | CD2 | PHE | C | 78 | −24.767 | −47.182 | 81.160 | 1.00 | 29.77 | C |
| ATOM | 3899 | CE1 | PHE | C | 78 | −26.635 | −45.191 | 81.422 | 1.00 | 31.87 | C |
| ATOM | 3900 | CE2 | PHE | C | 78 | −24.865 | −46.484 | 82.343 | 1.00 | 32.84 | C |
| ATOM | 3901 | CZ | PHE | C | 78 | −25.800 | −45.481 | 82.475 | 1.00 | 32.57 | C |
| ATOM | 3902 | N | SER | C | 79 | −25.321 | −50.732 | 79.595 | 1.00 | 30.53 | N |
| ATOM | 3903 | CA | SER | C | 79 | −25.288 | −51.973 | 80.344 | 1.00 | 27.00 | C |
| ATOM | 3904 | C | SER | C | 79 | −23.887 | −52.250 | 80.869 | 1.00 | 29.56 | C |
| ATOM | 3905 | O | SER | C | 79 | −22.890 | −51.729 | 80.365 | 1.00 | 29.66 | O |
| ATOM | 3906 | CB | SER | C | 79 | −25.778 | −53.134 | 79.474 | 1.00 | 30.28 | C |
| ATOM | 3907 | OG | SER | C | 79 | −27.128 | −52.938 | 79.104 | 1.00 | 31.71 | O |
| ATOM | 3908 | N | LEU | C | 80 | −23.833 | −53.114 | 81.879 | 1.00 | 24.67 | N |
| ATOM | 3909 | CA | LEU | C | 80 | −22.595 | −53.502 | 82.522 | 1.00 | 26.25 | C |
| ATOM | 3910 | C | LEU | C | 80 | −22.509 | −55.012 | 82.551 | 1.00 | 31.30 | C |
| ATOM | 3911 | O | LEU | C | 80 | −23.454 | −55.677 | 82.982 | 1.00 | 32.63 | O |
| ATOM | 3912 | CB | LEU | C | 80 | −22.519 | −52.968 | 83.957 | 1.00 | 30.49 | C |
| ATOM | 3913 | CG | LEU | C | 80 | −21.310 | −53.471 | 84.764 | 1.00 | 31.84 | C |
| ATOM | 3914 | CD1 | LEU | C | 80 | −19.986 | −52.935 | 84.206 | 1.00 | 24.42 | C |
| ATOM | 3915 | CD2 | LEU | C | 80 | −21.459 | −53.149 | 86.240 | 1.00 | 29.26 | C |
| ATOM | 3916 | N | LYS | C | 81 | −21.377 | −55.549 | 82.111 | 1.00 | 29.00 | N |
| ATOM | 3917 | CA | LYS | C | 81 | −21.065 | −56.958 | 82.299 | 1.00 | 31.81 | C |
| ATOM | 3918 | C | LYS | C | 81 | −19.803 | −57.045 | 83.139 | 1.00 | 31.17 | C |
| ATOM | 3919 | O | LYS | C | 81 | −18.822 | −56.361 | 82.845 | 1.00 | 34.99 | O |
| ATOM | 3920 | CB | LYS | C | 81 | −20.864 | −57.684 | 80.964 | 1.00 | 28.39 | C |
| ATOM | 3921 | CG | LYS | C | 81 | −22.140 | −57.880 | 80.163 | 1.00 | 33.95 | C |
| ATOM | 3922 | CD | LYS | C | 81 | −22.873 | −59.151 | 80.545 | 1.00 | 40.33 | C |
| ATOM | 3923 | CE | LYS | C | 81 | −24.202 | −59.282 | 79.817 | 1.00 | 42.26 | C |
| ATOM | 3924 | NZ | LYS | C | 81 | −24.025 | −59.096 | 78.349 | 1.00 | 53.78 | N1+ |
| ATOM | 3925 | N | LEU | C | 82 | −19.835 | −57.857 | 84.193 | 1.00 | 30.70 | N |
| ATOM | 3926 | CA | LEU | C | 82 | −18.652 | −58.141 | 85.004 | 1.00 | 28.52 | C |
| ATOM | 3927 | C | LEU | C | 82 | −18.571 | −59.645 | 85.180 | 1.00 | 31.87 | C |
| ATOM | 3928 | O | LEU | C | 82 | −19.434 | −60.247 | 85.824 | 1.00 | 37.82 | O |
| ATOM | 3929 | CB | LEU | C | 82 | −18.701 | −57.439 | 86.356 | 1.00 | 33.35 | C |
| ATOM | 3930 | CG | LEU | C | 82 | −17.543 | −57.699 | 87.330 | 1.00 | 35.28 | C |
| ATOM | 3931 | CD1 | LEU | C | 82 | −16.244 | −57.034 | 86.881 | 1.00 | 26.92 | C |
| ATOM | 3932 | CD2 | LEU | C | 82 | −17.950 | −57.297 | 88.741 | 1.00 | 25.50 | C |
| ATOM | 3933 | N | ARG | C | 83 | −17.554 | −60.251 | 84.600 | 1.00 | 36.83 | N |
| ATOM | 3934 | CA | ARG | C | 83 | −17.451 | −61.703 | 84.527 | 1.00 | 39.83 | C |
| ATOM | 3935 | C | ARG | C | 83 | −16.737 | −62.289 | 85.745 | 1.00 | 38.25 | C |
| ATOM | 3936 | O | ARG | C | 83 | −16.042 | −61.586 | 86.490 | 1.00 | 34.22 | O |
| ATOM | 3937 | CB | ARG | C | 83 | −16.745 | −62.101 | 83.221 | 1.00 | 31.30 | C |
| ATOM | 3938 | CG | ARG | C | 83 | −17.726 | −62.259 | 82.070 | 1.00 | 37.56 | C |
| ATOM | 3939 | CD | ARG | C | 83 | −17.165 | −62.116 | 80.661 | 1.00 | 34.40 | C |
| ATOM | 3940 | NE | ARG | C | 83 | −17.224 | −60.730 | 80.213 | 1.00 | 37.07 | N |
| ATOM | 3941 | CZ | ARG | C | 83 | −16.174 | −59.946 | 80.029 | 1.00 | 39.95 | C |
| ATOM | 3942 | NH1 | ARG | C | 83 | −16.359 | −58.701 | 79.618 | 1.00 | 31.66 | N1+ |
| ATOM | 3943 | NH2 | ARG | C | 83 | −14.947 | −60.412 | 80.249 | 1.00 | 46.34 | N |
| ATOM | 3944 | N | SER | C | 84 | −16.975 | −63.586 | 85.964 | 1.00 | 35.95 | N |
| ATOM | 3945 | CA | SER | C | 84 | −16.215 | −64.416 | 86.908 | 1.00 | 36.75 | C |
| ATOM | 3946 | C | SER | C | 84 | −16.089 | −63.725 | 88.271 | 1.00 | 37.32 | C |
| ATOM | 3947 | O | SER | C | 84 | −15.020 | −63.344 | 88.754 | 1.00 | 41.30 | O |
| ATOM | 3948 | CB | SER | C | 84 | −14.857 | −64.809 | 86.316 | 1.00 | 31.04 | C |
| ATOM | 3949 | OG | SER | C | 84 | −14.036 | −63.687 | 86.179 | 1.00 | 38.56 | O |
| ATOM | 3950 | N | VAL | C | 85 | −17.235 | −63.589 | 88.856 | 1.00 | 33.08 | N |
| ATOM | 3951 | CA | VAL | C | 85 | −17.473 | −62.751 | 90.014 | 1.00 | 32.08 | C |
| ATOM | 3952 | C | VAL | C | 85 | −17.088 | −63.499 | 91.292 | 1.00 | 32.80 | C |
| ATOM | 3953 | O | VAL | C | 85 | −17.190 | −64.723 | 91.359 | 1.00 | 32.85 | O |
| ATOM | 3954 | CB | VAL | C | 85 | −18.965 | −62.372 | 89.921 | 1.00 | 32.31 | C |

TABLE 10.4-continued

| ATOM | 3955 | CG1 | VAL | C | 85 | −19.791 | −63.006 | 90.981 | 1.00 | 35.43 | C |
|------|------|-----|-----|---|----|---------|---------|--------|------|-------|---|
| ATOM | 3956 | CG2 | VAL | C | 85 | −19.159 | −60.893 | 89.771 | 1.00 | 33.02 | C |
| ATOM | 3957 | N | THR | C | 86 | −16.596 | −62.785 | 92.310 | 1.00 | 36.06 | N |
| ATOM | 3958 | CA | THR | C | 86 | −16.263 | −63.389 | 93.614 | 1.00 | 32.42 | C |
| ATOM | 3959 | C | THR | C | 86 | −16.976 | −62.624 | 94.727 | 1.00 | 32.82 | C |
| ATOM | 3960 | O | THR | C | 86 | −17.644 | −61.619 | 94.485 | 1.00 | 32.02 | O |
| ATOM | 3961 | CB | THR | C | 86 | −14.760 | −63.395 | 93.919 | 1.00 | 32.77 | C |
| ATOM | 3962 | OG1 | THR | C | 86 | −14.390 | −62.115 | 94.438 | 1.00 | 35.84 | O |
| ATOM | 3963 | CG2 | THR | C | 86 | −13.914 | −63.727 | 92.683 | 1.00 | 31.07 | C |
| ATOM | 3964 | N | ALA | C | 87 | −16.813 | −63.084 | 95.972 | 1.00 | 34.97 | N |
| ATOM | 3965 | CA | ALA | C | 87 | −17.533 | −62.446 | 97.079 | 1.00 | 35.92 | C |
| ATOM | 3966 | C | ALA | C | 87 | −17.170 | −60.978 | 97.205 | 1.00 | 36.06 | C |
| ATOM | 3967 | O | ALA | C | 87 | −18.015 | −60.163 | 97.593 | 1.00 | 34.31 | O |
| ATOM | 3968 | CB | ALA | C | 87 | −17.241 | −63.146 | 98.407 | 1.00 | 24.03 | C |
| ATOM | 3969 | N | ALA | C | 88 | −15.927 | −60.626 | 96.853 | 1.00 | 32.27 | N |
| ATOM | 3970 | CA | ALA | C | 88 | −15.448 | −59.255 | 96.922 | 1.00 | 32.44 | C |
| ATOM | 3971 | C | ALA | C | 88 | −16.179 | −58.331 | 95.964 | 1.00 | 35.33 | C |
| ATOM | 3972 | O | ALA | C | 88 | −15.973 | −57.119 | 96.027 | 1.00 | 41.10 | O |
| ATOM | 3973 | CB | ALA | C | 88 | −13.953 | −59.211 | 96.632 | 1.00 | 26.07 | C |
| ATOM | 3974 | N | ASP | C | 89 | −17.024 | −58.861 | 95.090 | 1.00 | 31.77 | N |
| ATOM | 3975 | CA | ASP | C | 89 | −17.818 | −58.037 | 94.203 | 1.00 | 29.68 | C |
| ATOM | 3976 | C | ASP | C | 89 | −19.198 | −57.735 | 94.785 | 1.00 | 28.71 | C |
| ATOM | 3977 | O | ASP | C | 89 | −20.017 | −57.099 | 94.115 | 1.00 | 29.06 | O |
| ATOM | 3978 | CB | ASP | C | 89 | −17.943 | −58.712 | 92.825 | 1.00 | 36.29 | C |
| ATOM | 3979 | CG | ASP | C | 89 | −16.584 | −58.922 | 92.122 | 1.00 | 33.46 | C |
| ATOM | 3980 | OD1 | ASP | C | 89 | −15.893 | −57.927 | 91.817 | 1.00 | 37.02 | O |
| ATOM | 3981 | OD2 | ASP | C | 89 | −16.209 | −60.092 | 91.867 | 1.00 | 34.16 | O1− |
| ATOM | 3982 | N | THR | C | 90 | −19.454 | −58.137 | 96.028 | 1.00 | 27.76 | N |
| ATOM | 3983 | CA | THR | C | 90 | −20.653 | −57.712 | 96.747 | 1.00 | 34.87 | C |
| ATOM | 3984 | C | THR | C | 90 | −20.606 | −56.194 | 96.997 | 1.00 | 27.98 | C |
| ATOM | 3985 | O | THR | C | 90 | −19.694 | −55.699 | 97.659 | 1.00 | 27.17 | O |
| ATOM | 3986 | CB | THR | C | 90 | −20.747 | −58.492 | 98.058 | 1.00 | 32.97 | C |
| ATOM | 3987 | OG1 | THR | C | 90 | −20.912 | −59.884 | 97.753 | 1.00 | 34.09 | O |
| ATOM | 3988 | CG2 | THR | C | 90 | −21.914 | −58.010 | 98.923 | 1.00 | 24.31 | C |
| ATOM | 3989 | N | ALA | C | 91 | −21.575 | −55.456 | 96.461 | 1.00 | 24.84 | N |
| ATOM | 3990 | CA | ALA | C | 91 | −21.553 | −53.998 | 96.516 | 1.00 | 25.95 | C |
| ATOM | 3991 | C | ALA | C | 91 | −22.876 | −53.467 | 95.992 | 1.00 | 29.10 | C |
| ATOM | 3992 | O | ALA | C | 91 | −23.667 | −54.198 | 95.393 | 1.00 | 30.38 | O |
| ATOM | 3993 | CB | ALA | C | 91 | −20.408 | −53.408 | 95.698 | 1.00 | 27.41 | C |
| ATOM | 3994 | N | VAL | C | 92 | −23.121 | −52.183 | 96.249 | 1.00 | 28.41 | N |
| ATOM | 3995 | CA | VAL | C | 92 | −24.154 | −51.471 | 95.517 | 1.00 | 25.07 | C |
| ATOM | 3996 | C | VAL | C | 92 | −23.533 | −50.973 | 94.227 | 1.00 | 26.45 | C |
| ATOM | 3997 | O | VAL | C | 92 | −22.473 | −50.348 | 94.242 | 1.00 | 29.34 | O |
| ATOM | 3998 | CB | VAL | C | 92 | −24.746 | −50.313 | 96.338 | 1.00 | 25.04 | C |
| ATOM | 3999 | CG1 | VAL | C | 92 | −25.682 | −49.486 | 95.466 | 1.00 | 22.80 | C |
| ATOM | 4000 | CG2 | VAL | C | 92 | −25.542 | −50.843 | 97.503 | 1.00 | 26.44 | C |
| ATOM | 4001 | N | TYR | C | 93 | −24.177 | −51.270 | 93.107 | 1.00 | 29.41 | N |
| ATOM | 4002 | CA | TYR | C | 93 | −23.720 | −50.835 | 91.800 | 1.00 | 25.88 | C |
| ATOM | 4003 | C | TYR | C | 93 | −24.646 | −49.722 | 91.336 | 1.00 | 24.87 | C |
| ATOM | 4004 | O | TYR | C | 93 | −25.854 | −49.927 | 91.241 | 1.00 | 28.12 | O |
| ATOM | 4005 | CB | TYR | C | 93 | −23.703 | −52.015 | 90.826 | 1.00 | 23.05 | C |
| ATOM | 4006 | CG | TYR | C | 93 | −22.607 | −53.020 | 91.156 | 1.00 | 28.89 | C |
| ATOM | 4007 | CD1 | TYR | C | 93 | −22.704 | −53.859 | 92.280 | 1.00 | 24.24 | C |
| ATOM | 4008 | CD2 | TYR | C | 93 | −21.462 | −53.115 | 90.359 | 1.00 | 26.34 | C |
| ATOM | 4009 | CE1 | TYR | C | 93 | −21.702 | −54.752 | 92.593 | 1.00 | 23.55 | C |
| ATOM | 4010 | CE2 | TYR | C | 93 | −20.449 | −53.996 | 90.670 | 1.00 | 26.02 | C |
| ATOM | 4011 | CZ | TYR | C | 93 | −20.566 | −54.818 | 91.783 | 1.00 | 26.56 | C |
| ATOM | 4012 | OH | TYR | C | 93 | −19.535 | −55.695 | 92.078 | 1.00 | 23.40 | O |
| ATOM | 4013 | N | TYR | C | 94 | −24.085 | −48.550 | 91.070 | 1.00 | 23.22 | N |
| ATOM | 4014 | CA | TYR | C | 94 | −24.829 | −47.415 | 90.541 | 1.00 | 28.65 | C |
| ATOM | 4015 | C | TYR | C | 94 | −24.425 | −47.179 | 89.097 | 1.00 | 25.80 | C |
| ATOM | 4016 | O | TYR | C | 94 | −23.241 | −47.248 | 88.766 | 1.00 | 24.60 | O |
| ATOM | 4017 | CB | TYR | C | 94 | −24.547 | −46.097 | 91.309 | 1.00 | 25.22 | C |
| ATOM | 4018 | CG | TYR | C | 94 | −24.796 | −46.109 | 92.775 | 1.00 | 22.71 | C |
| ATOM | 4019 | CD1 | TYR | C | 94 | −26.082 | −45.978 | 93.280 | 1.00 | 24.72 | C |
| ATOM | 4020 | CD2 | TYR | C | 94 | −23.738 | −46.219 | 93.672 | 1.00 | 20.09 | C |
| ATOM | 4021 | CE1 | TYR | C | 94 | −26.311 | −45.997 | 94.640 | 1.00 | 22.52 | C |
| ATOM | 4022 | CE2 | TYR | C | 94 | −23.950 | −46.237 | 95.020 | 1.00 | 17.42 | C |
| ATOM | 4023 | CZ | TYR | C | 94 | −25.240 | −46.119 | 95.508 | 1.00 | 27.12 | C |
| ATOM | 4024 | OH | TYR | C | 94 | −25.463 | −46.130 | 96.877 | 1.00 | 35.58 | O |
| ATOM | 4025 | N | CYS | C | 95 | −25.391 | −46.795 | 88.272 | 1.00 | 25.05 | N |
| ATOM | 4026 | CA | CYS | C | 95 | −25.096 | −46.099 | 87.030 | 1.00 | 26.50 | C |
| ATOM | 4027 | C | CYS | C | 95 | −25.220 | −44.602 | 87.287 | 1.00 | 28.56 | C |
| ATOM | 4028 | O | CYS | C | 95 | −25.943 | −44.161 | 88.192 | 1.00 | 25.46 | O |
| ATOM | 4029 | CB | CYS | C | 95 | −26.022 | −46.563 | 85.883 | 1.00 | 27.62 | C |
| ATOM | 4030 | SG | CYS | C | 95 | −27.838 | −46.477 | 86.215 | 1.00 | 41.12 | S |
| ATOM | 4031 | N | ALA | C | 96 | −24.469 | −43.816 | 86.520 | 1.00 | 26.44 | N |
| ATOM | 4032 | CA | ALA | C | 96 | −24.522 | −42.377 | 86.723 | 1.00 | 27.54 | C |
| ATOM | 4033 | C | ALA | C | 96 | −24.302 | −41.656 | 85.408 | 1.00 | 32.97 | C |
| ATOM | 4034 | O | ALA | C | 96 | −23.727 | −42.202 | 84.464 | 1.00 | 34.61 | O |

TABLE 10.4-continued

| | | | | | | | | | | |
|---|---|---|---|---|---|---|---|---|---|---|
| ATOM | 4035 | CB | ALA | C | 96 | −23.493 | −41.909 | 87.746 | 1.00 | 24.37 | C |
| ATOM | 4036 | N | ARG | C | 97 | −24.772 | −40.412 | 85.364 | 1.00 | 35.37 | N |
| ATOM | 4037 | CA | ARG | C | 97 | −24.529 | −39.520 | 84.244 | 1.00 | 26.30 | C |
| ATOM | 4038 | C | ARG | C | 97 | −23.290 | −38.679 | 84.524 | 1.00 | 28.79 | C |
| ATOM | 4039 | O | ARG | C | 97 | −23.208 | −38.000 | 85.551 | 1.00 | 27.36 | O |
| ATOM | 4040 | CB | ARG | C | 97 | −25.732 | −38.630 | 83.997 | 1.00 | 29.64 | C |
| ATOM | 4041 | CG | ARG | C | 97 | −25.581 | −37.755 | 82.773 | 1.00 | 32.76 | C |
| ATOM | 4042 | CD | ARG | C | 97 | −26.887 | −37.112 | 82.453 | 1.00 | 32.80 | C |
| ATOM | 4043 | NE | ARG | C | 97 | −26.856 | −35.720 | 82.854 | 1.00 | 39.43 | N |
| ATOM | 4044 | CZ | ARG | C | 97 | −27.927 | −34.974 | 83.090 | 1.00 | 37.66 | C |
| ATOM | 4045 | NH1 | ARG | C | 97 | −27.763 | −33.707 | 83.447 | 1.00 | 44.97 | N1+ |
| ATOM | 4046 | NH2 | ARG | C | 97 | −29.146 | −35.483 | 82.978 | 1.00 | 39.25 | N |
| ATOM | 4047 | N | ASP | C | 98 | −22.322 | −38.755 | 83.621 | 1.00 | 30.15 | N |
| ATOM | 4048 | CA | ASP | C | 98 | −21.054 | −38.053 | 83.724 | 1.00 | 29.73 | C |
| ATOM | 4049 | C | ASP | C | 98 | −21.145 | −36.751 | 82.929 | 1.00 | 33.62 | C |
| ATOM | 4050 | O | ASP | C | 98 | −21.487 | −36.781 | 81.742 | 1.00 | 31.03 | O |
| ATOM | 4051 | CB | ASP | C | 98 | −19.936 | −38.949 | 83.190 | 1.00 | 30.30 | C |
| ATOM | 4052 | CG | ASP | C | 98 | −18.555 | −38.414 | 83.490 | 1.00 | 31.40 | C |
| ATOM | 4053 | OD1 | ASP | C | 98 | −18.240 | −37.292 | 83.033 | 1.00 | 31.40 | O1− |
| ATOM | 4054 | OD2 | ASP | C | 98 | −17.779 | −39.139 | 84.160 | 1.00 | 32.47 | O |
| ATOM | 4055 | N | TYR | C | 99 | −20.901 | −35.610 | 83.601 | 1.00 | 32.07 | N |
| ATOM | 4056 | CA | TYR | C | 99 | −20.981 | −34.283 | 82.971 | 1.00 | 29.21 | C |
| ATOM | 4057 | C | TYR | C | 99 | −20.323 | −33.081 | 83.723 | 1.00 | 28.12 | C |
| ATOM | 4058 | O | TYR | C | 99 | −21.081 | −32.255 | 84.196 | 1.00 | 36.95 | O |
| ATOM | 4059 | CB | TYR | C | 99 | −22.484 | −33.958 | 82.761 | 1.00 | 35.21 | C |
| ATOM | 4060 | CG | TYR | C | 99 | −22.884 | −32.899 | 81.729 | 1.00 | 37.19 | C |
| ATOM | 4061 | CD1 | TYR | C | 99 | −22.518 | −33.004 | 80.378 | 1.00 | 37.05 | C |
| ATOM | 4062 | CD2 | TYR | C | 99 | −23.629 | −31.784 | 82.114 | 1.00 | 38.73 | C |
| ATOM | 4063 | CE1 | TYR | C | 99 | −22.905 | −32.034 | 79.447 | 1.00 | 36.99 | C |
| ATOM | 4064 | CE2 | TYR | C | 99 | −24.008 | −30.801 | 81.195 | 1.00 | 32.76 | C |
| ATOM | 4065 | CZ | TYR | C | 99 | −23.652 | −30.924 | 79.871 | 1.00 | 40.53 | C |
| ATOM | 4066 | OH | TYR | C | 99 | −24.045 | −29.934 | 78.971 | 1.00 | 41.60 | O |
| ATOM | 4067 | N | GLY | C | 100 | −19.003 | −32.924 | 83.921 | 1.00 | 28.67 | N |
| ATOM | 4068 | CA | GLY | C | 100 | −17.960 | −33.926 | 83.970 | 1.00 | 29.97 | C |
| ATOM | 4069 | C | GLY | C | 100 | −17.825 | −34.458 | 85.387 | 1.00 | 28.43 | C |
| ATOM | 4070 | O | GLY | C | 100 | −17.023 | −35.343 | 85.668 | 1.00 | 35.72 | O |
| ATOM | 4071 | N | ALA | C | 101 | −18.638 | −33.941 | 86.294 | 1.00 | 28.13 | N |
| ATOM | 4072 | CA | ALA | C | 101 | −18.846 | −34.644 | 87.546 | 1.00 | 23.31 | C |
| ATOM | 4073 | C | ALA | C | 101 | −20.080 | −35.531 | 87.385 | 1.00 | 29.38 | C |
| ATOM | 4074 | O | ALA | C | 101 | −20.763 | −35.484 | 86.363 | 1.00 | 31.34 | O |
| ATOM | 4075 | CB | ALA | C | 101 | −19.026 | −33.659 | 88.689 | 1.00 | 26.55 | C |
| ATOM | 4076 | N | PHE | C | 102 | −20.379 | −36.347 | 88.395 | 1.00 | 25.69 | N |
| ATOM | 4077 | CA | PHE | C | 102 | −21.562 | −37.213 | 88.337 | 1.00 | 30.27 | C |
| ATOM | 4078 | C | PHE | C | 102 | −22.754 | −36.480 | 88.948 | 1.00 | 27.72 | C |
| ATOM | 4079 | O | PHE | C | 102 | −22.912 | −36.444 | 90.170 | 1.00 | 25.66 | O |
| ATOM | 4080 | CB | PHE | C | 102 | −21.314 | −38.547 | 89.035 | 1.00 | 28.00 | C |
| ATOM | 4081 | CG | PHE | C | 102 | −20.216 | −39.368 | 88.406 | 1.00 | 28.82 | C |
| ATOM | 4082 | CD1 | PHE | C | 102 | −20.377 | −39.915 | 87.135 | 1.00 | 26.74 | C |
| ATOM | 4083 | CD2 | PHE | C | 102 | −19.002 | −39.556 | 89.069 | 1.00 | 25.45 | C |
| ATOM | 4084 | CE1 | PHE | C | 102 | −19.376 | −40.658 | 86.548 | 1.00 | 23.07 | C |
| ATOM | 4085 | CE2 | PHE | C | 102 | −17.987 | −40.307 | 88.488 | 1.00 | 27.62 | C |
| ATOM | 4086 | CZ | PHE | C | 102 | −18.173 | −40.859 | 87.220 | 1.00 | 24.95 | C |
| ATOM | 4087 | N | ASP | C | 103 | −23.611 | −35.906 | 88.097 | 1.00 | 25.30 | N |
| ATOM | 4088 | CA | ASP | C | 103 | −24.746 | −35.131 | 88.591 | 1.00 | 29.00 | C |
| ATOM | 4089 | C | ASP | C | 103 | −26.021 | −35.943 | 88.801 | 1.00 | 32.32 | C |
| ATOM | 4090 | O | ASP | C | 103 | −26.862 | −35.523 | 89.596 | 1.00 | 36.85 | O |
| ATOM | 4091 | CB | ASP | C | 103 | −25.067 | −33.937 | 87.671 | 1.00 | 26.81 | C |
| ATOM | 4092 | CG | ASP | C | 103 | −25.328 | −34.341 | 86.198 | 1.00 | 41.22 | C |
| ATOM | 4093 | OD1 | ASP | C | 103 | −25.539 | −35.538 | 85.880 | 1.00 | 33.40 | O1− |
| ATOM | 4094 | OD2 | ASP | C | 103 | −25.333 | −33.419 | 85.338 | 1.00 | 51.21 | O |
| ATOM | 4095 | N | ILE | C | 104 | −26.213 | −37.077 | 88.127 | 1.00 | 29.34 | N |
| ATOM | 4096 | CA | ILE | C | 104 | −27.410 | −37.884 | 88.337 | 1.00 | 28.45 | C |
| ATOM | 4097 | C | ILE | C | 104 | −27.007 | −39.332 | 88.536 | 1.00 | 30.33 | C |
| ATOM | 4098 | O | ILE | C | 104 | −26.120 | −39.840 | 87.842 | 1.00 | 31.30 | O |
| ATOM | 4099 | CB | ILE | C | 104 | −28.406 | −37.758 | 87.170 | 1.00 | 31.09 | C |
| ATOM | 4100 | CG1 | ILE | C | 104 | −28.861 | −36.309 | 87.017 | 1.00 | 29.48 | C |
| ATOM | 4101 | CG2 | ILE | C | 104 | −29.583 | −38.689 | 87.387 | 1.00 | 25.98 | C |
| ATOM | 4102 | CD1 | ILE | C | 104 | −29.838 | −36.138 | 85.943 | 1.00 | 31.56 | C |
| ATOM | 4103 | N | TRP | C | 105 | −27.666 | −39.992 | 89.480 | 1.00 | 27.28 | N |
| ATOM | 4104 | CA | TRP | C | 105 | −27.361 | −41.357 | 89.855 | 1.00 | 27.66 | C |
| ATOM | 4105 | C | TRP | C | 105 | −28.599 | −42.236 | 89.754 | 1.00 | 29.36 | C |
| ATOM | 4106 | O | TRP | C | 105 | −29.720 | −41.789 | 90.005 | 1.00 | 31.41 | O |
| ATOM | 4107 | CB | TRP | C | 105 | −26.830 | −41.398 | 91.288 | 1.00 | 28.75 | C |
| ATOM | 4108 | CG | TRP | C | 105 | −25.559 | −40.624 | 91.483 | 1.00 | 27.49 | C |
| ATOM | 4109 | CD1 | TRP | C | 105 | −25.394 | −39.267 | 91.400 | 1.00 | 27.23 | C |
| ATOM | 4110 | CD2 | TRP | C | 105 | −24.276 | −41.167 | 91.802 | 1.00 | 25.31 | C |
| ATOM | 4111 | NE1 | TRP | C | 105 | −24.078 | −38.935 | 91.650 | 1.00 | 25.97 | N |
| ATOM | 4112 | CE2 | TRP | C | 105 | −23.373 | −40.083 | 91.900 | 1.00 | 25.23 | C |
| ATOM | 4113 | CE3 | TRP | C | 105 | −23.801 | −42.466 | 92.016 | 1.00 | 25.04 | C |
| ATOM | 4114 | CZ2 | TRP | C | 105 | −22.026 | −40.259 | 92.188 | 1.00 | 22.01 | C |

TABLE 10.4-continued

| | | | | | | | | | | |
|---|---|---|---|---|---|---|---|---|---|---|
| ATOM | 4115 | CZ3 | TRP | C | 105 | −22.461 | −42.639 | 92.307 | 1.00 | 27.62 | C |
| ATOM | 4116 | CH2 | TRP | C | 105 | −21.586 | −41.532 | 92.389 | 1.00 | 24.95 | C |
| ATOM | 4117 | N | GLY | C | 106 | −28.381 | −43.504 | 89.436 | 1.00 | 29.88 | N |
| ATOM | 4118 | CA | GLY | C | 106 | −29.424 | −44.496 | 89.587 | 1.00 | 34.79 | C |
| ATOM | 4119 | C | GLY | C | 106 | −29.697 | −44.833 | 91.048 | 1.00 | 34.11 | C |
| ATOM | 4120 | O | GLY | C | 106 | −28.952 | −44.456 | 91.951 | 1.00 | 31.75 | O |
| ATOM | 4121 | N | GLN | C | 107 | −30.828 | −45.525 | 91.277 | 1.00 | 37.10 | N |
| ATOM | 4122 | CA | GLN | C | 107 | −31.137 | −46.052 | 92.607 | 1.00 | 33.95 | C |
| ATOM | 4123 | C | GLN | C | 107 | −30.005 | −46.904 | 93.124 | 1.00 | 30.12 | C |
| ATOM | 4124 | O | GLN | C | 107 | −29.773 | −46.956 | 94.331 | 1.00 | 31.44 | O |
| ATOM | 4125 | CB | GLN | C | 107 | −32.411 | −46.921 | 92.621 | 1.00 | 38.95 | C |
| ATOM | 4126 | CG | GLN | C | 107 | −33.442 | −46.732 | 91.485 | 1.00 | 53.38 | C |
| ATOM | 4127 | CD | GLN | C | 107 | −33.137 | −47.557 | 90.207 | 1.00 | 55.26 | C |
| ATOM | 4128 | OE1 | GLN | C | 107 | −33.665 | −48.666 | 89.992 | 1.00 | 51.28 | O |
| ATOM | 4129 | NE2 | GLN | C | 107 | −32.299 | −46.993 | 89.348 | 1.00 | 50.94 | N |
| ATOM | 4130 | N | GLY | C | 108 | −29.311 | −47.597 | 92.233 | 1.00 | 30.68 | N |
| ATOM | 4131 | CA | GLY | C | 108 | −28.376 | −48.619 | 92.628 | 1.00 | 25.20 | C |
| ATOM | 4132 | C | GLY | C | 108 | −29.039 | −49.981 | 92.689 | 1.00 | 28.53 | C |
| ATOM | 4133 | O | GLY | C | 108 | −30.254 | −50.110 | 92.792 | 1.00 | 32.61 | O |
| ATOM | 4134 | N | THR | C | 109 | −28.203 | −51.008 | 92.614 | 1.00 | 26.94 | N |
| ATOM | 4135 | CA | THR | C | 109 | −28.607 | −52.403 | 92.680 | 1.00 | 22.92 | C |
| ATOM | 4136 | C | THR | C | 109 | −27.757 | −53.086 | 93.740 | 1.00 | 30.47 | C |
| ATOM | 4137 | O | THR | C | 109 | −26.523 | −53.049 | 93.674 | 1.00 | 32.40 | O |
| ATOM | 4138 | CB | THR | C | 109 | −28.418 | −53.094 | 91.321 | 1.00 | 29.24 | C |
| ATOM | 4139 | OG1 | THR | C | 109 | −29.226 | −52.453 | 90.327 | 1.00 | 29.50 | O |
| ATOM | 4140 | CG2 | THR | C | 109 | −28.754 | −54.591 | 91.395 | 1.00 | 25.49 | C |
| ATOM | 4141 | N | MET | C | 110 | −28.402 | −53.685 | 94.726 | 1.00 | 30.19 | N |
| ATOM | 4142 | CA | MET | C | 110 | −27.674 | −54.400 | 95.765 | 1.00 | 31.87 | C |
| ATOM | 4143 | C | MET | C | 110 | −27.271 | −55.749 | 95.187 | 1.00 | 30.25 | C |
| ATOM | 4144 | O | MET | C | 110 | −28.133 | −56.548 | 94.818 | 1.00 | 31.68 | O |
| ATOM | 4145 | CB | MET | C | 110 | −28.571 | −54.546 | 96.991 | 1.00 | 38.09 | C |
| ATOM | 4146 | CG | MET | C | 110 | −27.925 | −54.739 | 98.362 | 1.00 | 38.26 | C |
| ATOM | 4147 | SD | MET | C | 110 | −29.296 | −54.935 | 99.598 | 1.00 | 60.00 | S |
| ATOM | 4148 | CE | MET | C | 110 | −30.587 | −53.829 | 98.963 | 1.00 | 28.36 | C |
| ATOM | 4149 | N | VAL | C | 111 | −25.971 | −55.986 | 95.049 | 1.00 | 30.68 | N |
| ATOM | 4150 | CA | VAL | C | 111 | −25.467 | −57.191 | 94.399 | 1.00 | 30.46 | C |
| ATOM | 4151 | C | VAL | C | 111 | −24.685 | −57.989 | 95.422 | 1.00 | 30.94 | C |
| ATOM | 4152 | O | VAL | C | 111 | −23.698 | −57.495 | 95.978 | 1.00 | 34.81 | O |
| ATOM | 4153 | CB | VAL | C | 111 | −24.601 | −56.875 | 93.164 | 1.00 | 34.32 | C |
| ATOM | 4154 | CG1 | VAL | C | 111 | −23.821 | −58.100 | 92.745 | 1.00 | 28.86 | C |
| ATOM | 4155 | CG2 | VAL | C | 111 | −25.462 | −56.397 | 91.995 | 1.00 | 24.78 | C |
| ATOM | 4156 | N | THR | C | 112 | −25.136 | −59.214 | 95.676 | 1.00 | 33.49 | N |
| ATOM | 4157 | CA | THR | C | 112 | −24.495 | −60.147 | 96.593 | 1.00 | 29.04 | C |
| ATOM | 4158 | C | THR | C | 112 | −23.993 | −61.341 | 95.798 | 1.00 | 31.99 | C |
| ATOM | 4159 | O | THR | C | 112 | −24.749 | −61.926 | 95.013 | 1.00 | 28.19 | O |
| ATOM | 4160 | CB | THR | C | 112 | −25.483 | −60.629 | 97.670 | 1.00 | 27.70 | C |
| ATOM | 4161 | OG1 | THR | C | 112 | −26.126 | −59.513 | 98.275 | 1.00 | 27.51 | O |
| ATOM | 4162 | CG2 | THR | C | 112 | −24.800 | −61.447 | 98.736 | 1.00 | 30.55 | C |
| ATOM | 4163 | N | VAL | C | 113 | −22.726 | −61.696 | 95.985 | 1.00 | 29.97 | N |
| ATOM | 4164 | CA | VAL | C | 113 | −22.185 | −62.918 | 95.405 | 1.00 | 36.12 | C |
| ATOM | 4165 | C | VAL | C | 113 | −21.678 | −63.780 | 96.550 | 1.00 | 33.41 | C |
| ATOM | 4166 | O | VAL | C | 113 | −20.902 | −63.312 | 97.392 | 1.00 | 31.40 | O |
| ATOM | 4167 | CB | VAL | C | 113 | −21.119 | −62.648 | 94.319 | 1.00 | 37.87 | C |
| ATOM | 4168 | CG1 | VAL | C | 113 | −20.582 | −61.246 | 94.423 | 1.00 | 37.11 | C |
| ATOM | 4169 | CG2 | VAL | C | 113 | −20.016 | −63.719 | 94.288 | 1.00 | 28.90 | C |
| ATOM | 4170 | N | SER | C | 114 | −22.171 | −65.019 | 96.610 | 1.00 | 33.34 | N |
| ATOM | 4171 | CA | SER | C | 114 | −21.991 | −65.863 | 97.781 | 1.00 | 37.36 | C |
| ATOM | 4172 | C | SER | C | 114 | −22.309 | −67.316 | 97.449 | 1.00 | 34.25 | C |
| ATOM | 4173 | O | SER | C | 114 | −23.113 | −67.606 | 96.563 | 1.00 | 32.33 | O |
| ATOM | 4174 | CB | SER | C | 114 | −22.886 | −65.382 | 98.932 | 1.00 | 34.37 | C |
| ATOM | 4175 | OG | SER | C | 114 | −22.928 | −66.326 | 99.983 | 1.00 | 36.36 | O |
| ATOM | 4176 | N | SER | C | 115 | −21.682 | −68.224 | 98.195 | 1.00 | 38.98 | N |
| ATOM | 4177 | CA | SER | C | 115 | −22.065 | −69.629 | 98.129 | 1.00 | 38.55 | C |
| ATOM | 4178 | C | SER | C | 115 | −23.430 | −69.890 | 98.753 | 1.00 | 44.22 | C |
| ATOM | 4179 | O | SER | C | 115 | −24.069 | −70.889 | 98.410 | 1.00 | 48.62 | O |
| ATOM | 4180 | CB | SER | C | 115 | −21.032 | −70.491 | 98.847 | 1.00 | 40.98 | C |
| ATOM | 4181 | OG | SER | C | 115 | −19.794 | −70.465 | 98.158 | 1.00 | 57.58 | O |
| ATOM | 4182 | N | ALA | C | 116 | −23.912 | −69.003 | 99.620 | 1.00 | 34.12 | N |
| ATOM | 4183 | CA | ALA | C | 116 | −25.140 | −69.269 | 100.348 | 1.00 | 37.60 | C |
| ATOM | 4184 | C | ALA | C | 116 | −26.347 | −69.330 | 99.415 | 1.00 | 39.26 | C |
| ATOM | 4185 | O | ALA | C | 116 | −26.329 | −68.827 | 98.282 | 1.00 | 36.17 | O |
| ATOM | 4186 | CB | ALA | C | 116 | −25.366 | −68.194 | 101.413 | 1.00 | 33.12 | C |
| ATOM | 4187 | N | SER | C | 117 | −27.414 | −69.957 | 99.915 | 1.00 | 36.37 | N |
| ATOM | 4188 | CA | SER | C | 117 | −28.684 | −70.042 | 99.206 | 1.00 | 39.66 | C |
| ATOM | 4189 | C | SER | C | 117 | −29.745 | −69.252 | 99.960 | 1.00 | 36.99 | C |
| ATOM | 4190 | O | SER | C | 117 | −29.660 | −69.069 | 101.179 | 1.00 | 40.67 | O |
| ATOM | 4191 | CB | SER | C | 117 | −29.137 | −71.504 | 99.021 | 1.00 | 40.84 | C |
| ATOM | 4192 | OG | SER | C | 117 | −28.239 | −72.218 | 98.172 | 1.00 | 42.49 | O |
| ATOM | 4193 | N | THR | C | 118 | −30.735 | −68.770 | 99.215 | 1.00 | 35.22 | N |
| ATOM | 4194 | CA | THR | C | 118 | −31.796 | −67.963 | 99.796 | 1.00 | 34.00 | C |

TABLE 10.4-continued

| | | | | | | | | | | |
|---|---|---|---|---|---|---|---|---|---|---|
| ATOM | 4195 | C | THR | C | 118 | −32.453 | −68.705 | 100.953 | 1.00 | 37.86 | C |
| ATOM | 4196 | O | THR | C | 118 | −32.680 | −69.912 | 100.889 | 1.00 | 37.72 | O |
| ATOM | 4197 | CB | THR | C | 118 | −32.829 | −67.600 | 98.724 | 1.00 | 27.84 | C |
| ATOM | 4198 | OG1 | THR | C | 118 | −32.225 | −66.729 | 97.771 | 1.00 | 31.08 | O |
| ATOM | 4199 | CG2 | THR | C | 118 | −34.051 | −66.887 | 99.332 | 1.00 | 36.20 | C |
| ATOM | 4200 | N | LYS | C | 119 | −32.740 | −67.973 | 102.024 | 1.00 | 38.37 | N |
| ATOM | 4201 | CA | LYS | C | 119 | −33.239 | −68.569 | 103.256 | 1.00 | 37.26 | C |
| ATOM | 4202 | C | LYS | C | 119 | −33.922 | −67.486 | 104.079 | 1.00 | 34.75 | C |
| ATOM | 4203 | O | LYS | C | 119 | −33.332 | −66.432 | 104.331 | 1.00 | 32.89 | O |
| ATOM | 4204 | CB | LYS | C | 119 | −32.093 | −69.201 | 104.040 | 1.00 | 32.21 | C |
| ATOM | 4205 | CG | LYS | C | 119 | −32.520 | −69.868 | 105.295 | 1.00 | 32.82 | C |
| ATOM | 4206 | CD | LYS | C | 119 | −31.299 | −70.193 | 106.108 | 1.00 | 34.06 | C |
| ATOM | 4207 | CE | LYS | C | 119 | −31.675 | −70.872 | 107.411 | 1.00 | 37.24 | C |
| ATOM | 4208 | NZ | LYS | C | 119 | −32.670 | −70.086 | 108.181 | 1.00 | 41.53 | N1+ |
| ATOM | 4209 | N | GLY | C | 120 | −35.166 | −67.738 | 104.474 | 1.00 | 34.46 | N |
| ATOM | 4210 | CA | GLY | C | 120 | −35.906 | −66.796 | 105.275 | 1.00 | 30.62 | C |
| ATOM | 4211 | C | GLY | C | 120 | −35.395 | −66.829 | 106.696 | 1.00 | 30.67 | C |
| ATOM | 4212 | O | GLY | C | 120 | −34.703 | −67.767 | 107.102 | 1.00 | 29.23 | O |
| ATOM | 4213 | N | PRO | C | 121 | −35.705 | −65.792 | 107.467 | 1.00 | 28.30 | N |
| ATOM | 4214 | CA | PRO | C | 121 | −35.198 | −65.683 | 108.838 | 1.00 | 30.58 | C |
| ATOM | 4215 | C | PRO | C | 121 | −36.084 | −66.380 | 109.863 | 1.00 | 30.35 | C |
| ATOM | 4216 | O | PRO | C | 121 | −37.286 | −66.554 | 109.668 | 1.00 | 31.40 | O |
| ATOM | 4217 | CB | PRO | C | 121 | −35.223 | −64.172 | 109.082 | 1.00 | 29.17 | C |
| ATOM | 4218 | CG | PRO | C | 121 | −36.377 | −63.701 | 108.245 | 1.00 | 27.47 | C |
| ATOM | 4219 | CD | PRO | C | 121 | −36.411 | −64.578 | 107.029 | 1.00 | 27.41 | C |
| ATOM | 4220 | N | SER | C | 122 | −35.465 | −66.726 | 110.991 | 1.00 | 27.52 | N |
| ATOM | 4221 | CA | SER | C | 122 | −36.176 | −67.066 | 112.219 | 1.00 | 26.31 | C |
| ATOM | 4222 | C | SER | C | 122 | −36.157 | −65.874 | 113.165 | 1.00 | 30.19 | C |
| ATOM | 4223 | O | SER | C | 122 | −35.108 | −65.263 | 113.389 | 1.00 | 33.03 | O |
| ATOM | 4224 | CB | SER | C | 122 | −35.553 | −68.272 | 112.920 | 1.00 | 33.10 | C |
| ATOM | 4225 | OG | SER | C | 122 | −35.607 | −69.425 | 112.115 | 1.00 | 42.58 | O |
| ATOM | 4226 | N | VAL | C | 123 | −37.305 | −65.555 | 113.736 | 1.00 | 30.40 | N |
| ATOM | 4227 | CA | VAL | C | 123 | −37.439 | −64.392 | 114.599 | 1.00 | 29.30 | C |
| ATOM | 4228 | C | VAL | C | 123 | −37.651 | −64.870 | 116.038 | 1.00 | 28.97 | C |
| ATOM | 4229 | O | VAL | C | 123 | −38.681 | −65.469 | 116.368 | 1.00 | 37.16 | O |
| ATOM | 4230 | CB | VAL | C | 123 | −38.576 | −63.481 | 114.123 | 1.00 | 27.97 | C |
| ATOM | 4231 | CG1 | VAL | C | 123 | −38.600 | −62.206 | 114.971 | 1.00 | 29.32 | C |
| ATOM | 4232 | CG2 | VAL | C | 123 | −38.448 | −63.196 | 112.593 | 1.00 | 23.94 | C |
| ATOM | 4233 | N | PHE | C | 124 | −36.703 | −64.598 | 116.890 | 1.00 | 27.59 | N |
| ATOM | 4234 | CA | PHE | C | 124 | −36.791 | −64.961 | 118.289 | 1.00 | 30.52 | C |
| ATOM | 4235 | C | PHE | C | 124 | −36.968 | −63.708 | 119.143 | 1.00 | 32.03 | C |
| ATOM | 4236 | O | PHE | C | 124 | −36.508 | −62.623 | 118.771 | 1.00 | 29.31 | O |
| ATOM | 4237 | CB | PHE | C | 124 | −35.539 | −65.723 | 118.760 | 1.00 | 34.19 | C |
| ATOM | 4238 | CG | PHE | C | 124 | −35.145 | −66.879 | 117.868 | 1.00 | 33.33 | C |
| ATOM | 4239 | CD1 | PHE | C | 124 | −35.968 | −67.985 | 117.730 | 1.00 | 37.57 | C |
| ATOM | 4240 | CD2 | PHE | C | 124 | −33.956 | −66.851 | 117.163 | 1.00 | 31.04 | C |
| ATOM | 4241 | CE1 | PHE | C | 124 | −35.618 | −69.033 | 116.892 | 1.00 | 34.49 | C |
| ATOM | 4242 | CE2 | PHE | C | 124 | −33.596 | −67.901 | 116.333 | 1.00 | 34.61 | C |
| ATOM | 4243 | CZ | PHE | C | 124 | −34.430 | −68.991 | 116.196 | 1.00 | 33.73 | C |
| ATOM | 4244 | N | PRO | C | 125 | −37.636 | −63.815 | 120.285 | 1.00 | 34.51 | N |
| ATOM | 4245 | CA | PRO | C | 125 | −37.839 | −62.633 | 121.124 | 1.00 | 30.32 | C |
| ATOM | 4246 | C | PRO | C | 125 | −36.613 | −62.280 | 121.951 | 1.00 | 32.51 | C |
| ATOM | 4247 | O | PRO | C | 125 | −35.832 | −63.136 | 122.369 | 1.00 | 36.65 | O |
| ATOM | 4248 | CB | PRO | C | 125 | −39.010 | −63.039 | 122.025 | 1.00 | 29.69 | C |
| ATOM | 4249 | CG | PRO | C | 125 | −38.894 | −64.526 | 122.107 | 1.00 | 32.87 | C |
| ATOM | 4250 | CD | PRO | C | 125 | −38.363 | −64.991 | 120.794 | 1.00 | 34.01 | C |
| ATOM | 4251 | N | LEU | C | 126 | −36.434 | −60.985 | 122.134 | 1.00 | 26.85 | N |
| ATOM | 4252 | CA | LEU | C | 126 | −35.595 | −60.422 | 123.175 | 1.00 | 26.86 | C |
| ATOM | 4253 | C | LEU | C | 126 | −36.568 | −59.902 | 124.234 | 1.00 | 31.33 | C |
| ATOM | 4254 | O | LEU | C | 126 | −37.153 | −58.825 | 124.081 | 1.00 | 27.81 | O |
| ATOM | 4255 | CB | LEU | C | 126 | −34.714 | −59.324 | 122.596 | 1.00 | 31.15 | C |
| ATOM | 4256 | CG | LEU | C | 126 | −33.839 | −59.786 | 121.435 | 1.00 | 29.11 | C |
| ATOM | 4257 | CD1 | LEU | C | 126 | −33.179 | −58.601 | 120.808 | 1.00 | 26.98 | C |
| ATOM | 4258 | CD2 | LEU | C | 126 | −32.786 | −60.749 | 121.950 | 1.00 | 28.83 | C |
| ATOM | 4259 | N | ALA | C | 127 | −36.784 | −60.706 | 125.302 | 1.00 | 34.13 | N |
| ATOM | 4260 | CA | ALA | C | 127 | −37.874 | −60.477 | 126.253 | 1.00 | 34.68 | C |
| ATOM | 4261 | C | ALA | C | 127 | −37.515 | −59.383 | 127.258 | 1.00 | 38.36 | C |
| ATOM | 4262 | O | ALA | C | 127 | −36.400 | −59.366 | 127.792 | 1.00 | 34.45 | O |
| ATOM | 4263 | CB | ALA | C | 127 | −38.229 | −61.756 | 126.999 | 1.00 | 34.71 | C |
| ATOM | 4264 | N | PRO | C | 128 | −38.453 | −58.480 | 127.552 | 1.00 | 43.79 | N |
| ATOM | 4265 | CA | PRO | C | 128 | −38.163 | −57.410 | 128.513 | 1.00 | 43.68 | C |
| ATOM | 4266 | C | PRO | C | 128 | −37.732 | −57.972 | 129.856 | 1.00 | 54.93 | C |
| ATOM | 4267 | O | PRO | C | 128 | −38.285 | −58.961 | 130.350 | 1.00 | 50.70 | O |
| ATOM | 4268 | CB | PRO | C | 128 | −39.481 | −56.625 | 128.600 | 1.00 | 40.46 | C |
| ATOM | 4269 | CG | PRO | C | 128 | −40.513 | −57.526 | 128.054 | 1.00 | 44.62 | C |
| ATOM | 4270 | CD | PRO | C | 128 | −39.823 | −58.379 | 127.020 | 1.00 | 37.96 | C |
| ATOM | 4271 | N | SER | C | 129 | −36.668 | −57.356 | 130.389 | 1.00 | 69.23 | N |
| ATOM | 4272 | CA | SER | C | 129 | −36.026 | −57.680 | 131.657 | 1.00 | 73.37 | C |
| ATOM | 4273 | C | SER | C | 129 | −37.065 | −57.798 | 132.767 | 1.00 | 80.23 | C |
| ATOM | 4274 | O | SER | C | 129 | −37.700 | −56.804 | 133.139 | 1.00 | 81.02 | O |

TABLE 10.4-continued

| | | | | | | | | | | |
|---|---|---|---|---|---|---|---|---|---|---|
| ATOM | 4275 | CB | SER | C | 129 | −34.983 | −56.595 | 131.987 | 1.00 | 71.73 | C |
| ATOM | 4276 | OG | SER | C | 129 | −34.000 | −57.018 | 132.909 | 1.00 | 63.19 | O |
| ATOM | 4277 | N | SER | C | 130 | −37.246 | −59.018 | 133.289 | 1.00 | 83.03 | N |
| ATOM | 4278 | CA | SER | C | 130 | −38.109 | −59.226 | 134.446 | 1.00 | 85.79 | C |
| ATOM | 4279 | C | SER | C | 130 | −37.714 | −58.318 | 135.603 | 1.00 | 95.78 | C |
| ATOM | 4280 | O | SER | C | 130 | −38.566 | −57.941 | 136.424 | 1.00 | 93.56 | O |
| ATOM | 4281 | CB | SER | C | 130 | −38.040 | −60.696 | 134.882 | 1.00 | 88.42 | C |
| ATOM | 4282 | OG | SER | C | 130 | −36.688 | −61.134 | 135.021 | 1.00 | 84.37 | O |
| ATOM | 4283 | N | LYS | C | 131 | −36.428 | −57.953 | 135.673 | 1.00 | 96.01 | N |
| ATOM | 4284 | CA | LYS | C | 131 | −35.860 | −57.111 | 136.721 | 1.00 | 92.69 | C |
| ATOM | 4285 | C | LYS | C | 131 | −35.737 | −55.631 | 136.334 | 1.00 | 88.64 | C |
| ATOM | 4286 | O | LYS | C | 131 | −34.824 | −54.957 | 136.820 | 1.00 | 93.47 | O |
| ATOM | 4287 | CB | LYS | C | 131 | −34.490 | −57.660 | 137.135 | 1.00 | 85.98 | C |
| ATOM | 4288 | CG | LYS | C | 131 | −34.512 | −59.018 | 137.841 | 1.00 | 83.85 | C |
| ATOM | 4289 | CD | LYS | C | 131 | −33.113 | −59.398 | 138.328 | 1.00 | 86.44 | C |
| ATOM | 4290 | CE | LYS | C | 131 | −33.162 | −60.359 | 139.509 | 1.00 | 81.44 | C |
| ATOM | 4291 | NZ | LYS | C | 131 | −31.802 | −60.691 | 140.021 | 1.00 | 67.72 | N1+ |
| ATOM | 4292 | N | SER | C | 132 | −36.625 | −55.088 | 135.498 | 1.00 | 91.44 | N |
| ATOM | 4293 | CA | SER | C | 132 | −36.567 | −53.651 | 135.224 | 1.00 | 88.79 | C |
| ATOM | 4294 | C | SER | C | 132 | −36.967 | −52.857 | 136.461 | 1.00 | 93.64 | C |
| ATOM | 4295 | O | SER | C | 132 | −37.915 | −53.218 | 137.168 | 1.00 | 97.31 | O |
| ATOM | 4296 | CB | SER | C | 132 | −37.472 | −53.256 | 134.048 | 1.00 | 75.72 | C |
| ATOM | 4297 | OG | SER | C | 132 | −36.862 | −53.513 | 132.797 | 1.00 | 71.83 | O |
| ATOM | 4298 | N | THR | C | 133 | −36.229 | −51.769 | 136.723 | 1.00 | 99.77 | N |
| ATOM | 4299 | CA | THR | C | 133 | −36.569 | −50.845 | 137.806 | 1.00 | 97.90 | C |
| ATOM | 4300 | C | THR | C | 133 | −38.009 | −50.364 | 137.611 | 1.00 | 93.15 | C |
| ATOM | 4301 | O | THR | C | 133 | −38.291 | −49.593 | 136.684 | 1.00 | 89.44 | O |
| ATOM | 4302 | CB | THR | C | 133 | −35.563 | −49.669 | 137.882 | 1.00 | 87.55 | C |
| ATOM | 4303 | OG1 | THR | C | 133 | −35.179 | −49.234 | 136.565 | 1.00 | 83.45 | O |
| ATOM | 4304 | CG2 | THR | C | 133 | −34.303 | −50.077 | 138.653 | 1.00 | 84.85 | C |
| ATOM | 4305 | N | SER | C | 134 | −38.929 | −50.829 | 138.466 | 1.00 | 93.26 | N |
| ATOM | 4306 | CA | SER | C | 134 | −40.352 | −50.635 | 138.210 | 1.00 | 87.74 | C |
| ATOM | 4307 | C | SER | C | 134 | −40.679 | −49.153 | 138.274 | 1.00 | 85.43 | C |
| ATOM | 4308 | O | SER | C | 134 | −40.329 | −48.472 | 139.242 | 1.00 | 87.73 | O |
| ATOM | 4309 | CB | SER | C | 134 | −41.195 | −51.410 | 139.224 | 1.00 | 74.42 | C |
| ATOM | 4310 | OG | SER | C | 134 | −42.211 | −52.150 | 138.567 | 1.00 | 81.41 | O |
| ATOM | 4311 | N | GLY | C | 135 | −41.314 | −48.643 | 137.223 | 1.00 | 80.04 | N |
| ATOM | 4312 | CA | GLY | C | 135 | −41.395 | −47.211 | 137.051 | 1.00 | 78.15 | C |
| ATOM | 4313 | C | GLY | C | 135 | −40.279 | −46.614 | 136.227 | 1.00 | 80.05 | C |
| ATOM | 4314 | O | GLY | C | 135 | −40.186 | −45.381 | 136.144 | 1.00 | 77.05 | O |
| ATOM | 4315 | N | GLY | C | 136 | −39.414 | −47.444 | 135.639 | 1.00 | 72.87 | N |
| ATOM | 4316 | CA | GLY | C | 136 | −38.350 | −46.962 | 134.783 | 1.00 | 61.44 | C |
| ATOM | 4317 | C | GLY | C | 136 | −38.489 | −47.391 | 133.333 | 1.00 | 56.58 | C |
| ATOM | 4318 | O | GLY | C | 136 | −39.592 | −47.407 | 132.771 | 1.00 | 51.45 | O |
| ATOM | 4319 | N | THR | C | 137 | −37.382 | −47.773 | 132.713 | 1.00 | 53.14 | N |
| ATOM | 4320 | CA | THR | C | 137 | −37.361 | −48.017 | 131.279 | 1.00 | 47.91 | C |
| ATOM | 4321 | C | THR | C | 137 | −37.015 | −49.473 | 131.008 | 1.00 | 48.48 | C |
| ATOM | 4322 | O | THR | C | 137 | −36.090 | −50.028 | 131.617 | 1.00 | 47.97 | O |
| ATOM | 4323 | CB | THR | C | 137 | −36.370 | −47.081 | 130.592 | 1.00 | 48.09 | C |
| ATOM | 4324 | OG1 | THR | C | 137 | −36.886 | −45.745 | 130.650 | 1.00 | 54.06 | O |
| ATOM | 4325 | CG2 | THR | C | 137 | −36.140 | −47.485 | 129.123 | 1.00 | 43.01 | C |
| ATOM | 4326 | N | ALA | C | 138 | −37.781 | −50.087 | 130.110 | 1.00 | 38.89 | N |
| ATOM | 4327 | CA | ALA | C | 138 | −37.598 | −51.469 | 129.714 | 1.00 | 38.16 | C |
| ATOM | 4328 | C | ALA | C | 138 | −37.117 | −51.516 | 128.268 | 1.00 | 36.59 | C |
| ATOM | 4329 | O | ALA | C | 138 | −37.541 | −50.708 | 127.437 | 1.00 | 36.87 | O |
| ATOM | 4330 | CB | ALA | C | 138 | −38.908 | −52.249 | 129.871 | 1.00 | 31.25 | C |
| ATOM | 4331 | N | ALA | C | 139 | −36.232 | −52.454 | 127.964 | 1.00 | 33.10 | N |
| ATOM | 4332 | CA | ALA | C | 139 | −35.886 | −52.755 | 126.582 | 1.00 | 30.90 | C |
| ATOM | 4333 | C | ALA | C | 139 | −36.522 | −54.080 | 126.199 | 1.00 | 30.77 | C |
| ATOM | 4334 | O | ALA | C | 139 | −36.619 | −54.986 | 127.028 | 1.00 | 31.77 | O |
| ATOM | 4335 | CB | ALA | C | 139 | −34.371 | −52.823 | 126.376 | 1.00 | 25.95 | C |
| ATOM | 4336 | N | LEU | C | 140 | −36.978 | −54.176 | 124.952 | 1.00 | 29.69 | N |
| ATOM | 4337 | CA | LEU | C | 140 | −37.426 | −55.439 | 124.376 | 1.00 | 30.12 | C |
| ATOM | 4338 | C | LEU | C | 140 | −37.081 | −55.420 | 122.891 | 1.00 | 30.17 | C |
| ATOM | 4339 | O | LEU | C | 140 | −36.795 | −54.369 | 122.319 | 1.00 | 29.86 | O |
| ATOM | 4340 | CB | LEU | C | 140 | −38.930 | −55.666 | 124.605 | 1.00 | 29.80 | C |
| ATOM | 4341 | CG | LEU | C | 140 | −39.844 | −54.591 | 124.028 | 1.00 | 30.15 | C |
| ATOM | 4342 | CD1 | LEU | C | 140 | −40.427 | −55.049 | 122.720 | 1.00 | 29.13 | C |
| ATOM | 4343 | CD2 | LEU | C | 140 | −40.945 | −54.256 | 125.007 | 1.00 | 30.43 | C |
| ATOM | 4344 | N | GLY | C | 141 | −37.135 | −56.581 | 122.250 | 1.00 | 27.97 | N |
| ATOM | 4345 | CA | GLY | C | 141 | −36.809 | −56.584 | 120.844 | 1.00 | 27.01 | C |
| ATOM | 4346 | C | GLY | C | 141 | −37.043 | −57.919 | 120.174 | 1.00 | 30.67 | C |
| ATOM | 4347 | O | GLY | C | 141 | −37.628 | −58.835 | 120.754 | 1.00 | 31.90 | O |
| ATOM | 4348 | N | CYS | C | 142 | −36.604 | −57.978 | 118.908 | 1.00 | 28.16 | N |
| ATOM | 4349 | CA | CYS | C | 142 | −36.633 | −59.156 | 118.051 | 1.00 | 31.74 | C |
| ATOM | 4350 | C | CYS | C | 142 | −35.238 | −59.467 | 117.527 | 1.00 | 28.43 | C |
| ATOM | 4351 | O | CYS | C | 142 | −34.478 | −58.563 | 117.193 | 1.00 | 24.09 | O |
| ATOM | 4352 | CB | CYS | C | 142 | −37.563 | −58.947 | 116.858 | 1.00 | 32.06 | C |
| ATOM | 4353 | SG | CYS | C | 142 | −39.293 | −59.136 | 117.287 | 1.00 | 49.90 | S |
| ATOM | 4354 | N | LEU | C | 143 | −34.903 | −60.747 | 117.447 | 1.00 | 28.84 | N |

TABLE 10.4-continued

| ATOM | 4355 | CA | LEU | C | 143 | −33.651 | −61.187 | 116.845 | 1.00 | 26.55 | C |
|---|---|---|---|---|---|---|---|---|---|---|---|
| ATOM | 4356 | C | LEU | C | 143 | −33.989 | −61.904 | 115.550 | 1.00 | 27.72 | C |
| ATOM | 4357 | O | LEU | C | 143 | −34.719 | −62.892 | 115.562 | 1.00 | 29.16 | O |
| ATOM | 4358 | CB | LEU | C | 143 | −32.849 | −62.069 | 117.805 | 1.00 | 29.85 | C |
| ATOM | 4359 | CG | LEU | C | 143 | −31.504 | −62.623 | 117.312 | 1.00 | 31.81 | C |
| ATOM | 4360 | CD1 | LEU | C | 143 | −30.634 | −61.539 | 116.821 | 1.00 | 29.50 | C |
| ATOM | 4361 | CD2 | LEU | C | 143 | −30.809 | −63.273 | 118.476 | 1.00 | 34.71 | C |
| ATOM | 4362 | N | VAL | C | 144 | −33.506 | −61.374 | 114.434 | 1.00 | 24.21 | N |
| ATOM | 4363 | CA | VAL | C | 144 | −33.850 | −61.888 | 113.121 | 1.00 | 25.88 | C |
| ATOM | 4364 | C | VAL | C | 144 | −32.632 | −62.683 | 112.650 | 1.00 | 31.73 | C |
| ATOM | 4365 | O | VAL | C | 144 | −31.676 | −62.122 | 112.104 | 1.00 | 27.35 | O |
| ATOM | 4366 | CB | VAL | C | 144 | −34.237 | −60.756 | 112.162 | 1.00 | 29.39 | C |
| ATOM | 4367 | CG1 | VAL | C | 144 | −34.620 | −61.297 | 110.801 | 1.00 | 29.56 | C |
| ATOM | 4368 | CG2 | VAL | C | 144 | −35.395 | −59.939 | 112.721 | 1.00 | 21.42 | C |
| ATOM | 4369 | N | LYS | C | 145 | −32.658 | −64.003 | 112.849 | 1.00 | 26.44 | N |
| ATOM | 4370 | CA | LYS | C | 145 | −31.455 | −64.811 | 112.726 | 1.00 | 29.06 | C |
| ATOM | 4371 | C | LYS | C | 145 | −31.472 | −65.687 | 111.476 | 1.00 | 30.53 | C |
| ATOM | 4372 | O | LYS | C | 145 | −32.513 | −66.244 | 111.098 | 1.00 | 29.40 | O |
| ATOM | 4373 | CB | LYS | C | 145 | −31.253 | −65.686 | 113.974 | 1.00 | 29.44 | C |
| ATOM | 4374 | CG | LYS | C | 145 | −29.832 | −66.217 | 114.070 | 1.00 | 30.84 | C |
| ATOM | 4375 | CD | LYS | C | 145 | −29.511 | −66.818 | 115.405 | 1.00 | 37.83 | C |
| ATOM | 4376 | CE | LYS | C | 145 | −28.009 | −67.086 | 115.543 | 1.00 | 43.25 | C |
| ATOM | 4377 | NZ | LYS | C | 145 | −27.433 | −67.955 | 114.471 | 1.00 | 39.52 | N1+ |
| ATOM | 4378 | N | ASP | C | 146 | −30.298 | −65.782 | 110.837 | 1.00 | 28.14 | N |
| ATOM | 4379 | CA | ASP | C | 146 | −30.003 | −66.758 | 109.784 | 1.00 | 33.06 | C |
| ATOM | 4380 | C | ASP | C | 146 | −30.862 | −66.564 | 108.531 | 1.00 | 33.58 | C |
| ATOM | 4381 | O | ASP | C | 146 | −31.584 | −67.465 | 108.102 | 1.00 | 36.23 | O |
| ATOM | 4382 | CB | ASP | C | 146 | −30.185 | −68.177 | 110.330 | 1.00 | 36.19 | C |
| ATOM | 4383 | CG | ASP | C | 146 | −29.226 | −68.502 | 111.441 | 1.00 | 38.83 | C |
| ATOM | 4384 | OD1 | ASP | C | 146 | −28.041 | −68.058 | 111.404 | 1.00 | 37.01 | O |
| ATOM | 4385 | OD2 | ASP | C | 146 | −29.716 | −69.135 | 112.405 | 1.00 | 41.05 | O1− |
| ATOM | 4386 | N | TYR | C | 147 | −30.735 | −65.405 | 107.905 | 1.00 | 29.04 | N |
| ATOM | 4387 | CA | TYR | C | 147 | −31.400 | −65.202 | 106.626 | 1.00 | 29.40 | C |
| ATOM | 4388 | C | TYR | C | 147 | −30.361 | −64.899 | 105.547 | 1.00 | 29.62 | C |
| ATOM | 4389 | O | TYR | C | 147 | −29.186 | −64.645 | 105.826 | 1.00 | 30.41 | O |
| ATOM | 4390 | CB | TYR | C | 147 | −32.443 | −64.080 | 106.711 | 1.00 | 26.97 | C |
| ATOM | 4391 | CG | TYR | C | 147 | −31.863 | −62.715 | 106.999 | 1.00 | 28.14 | C |
| ATOM | 4392 | CD1 | TYR | C | 147 | −31.628 | −62.304 | 108.303 | 1.00 | 28.44 | C |
| ATOM | 4393 | CD2 | TYR | C | 147 | −31.529 | −61.840 | 105.963 | 1.00 | 29.70 | C |
| ATOM | 4394 | CE1 | TYR | C | 147 | −31.098 | −61.071 | 108.575 | 1.00 | 30.16 | C |
| ATOM | 4395 | CE2 | TYR | C | 147 | −30.994 | −60.586 | 106.226 | 1.00 | 29.35 | C |
| ATOM | 4396 | CZ | TYR | C | 147 | −30.788 | −60.204 | 107.538 | 1.00 | 32.07 | C |
| ATOM | 4397 | OH | TYR | C | 147 | −30.269 | −58.954 | 107.832 | 1.00 | 32.73 | O |
| ATOM | 4398 | N | PHE | C | 148 | −30.808 | −64.941 | 104.298 | 1.00 | 31.56 | N |
| ATOM | 4399 | CA | PHE | C | 148 | −29.950 | −64.658 | 103.161 | 1.00 | 31.89 | C |
| ATOM | 4400 | C | PHE | C | 148 | −30.781 | −64.535 | 101.900 | 1.00 | 31.76 | C |
| ATOM | 4401 | O | PHE | C | 148 | −31.634 | −65.367 | 101.661 | 1.00 | 30.72 | O |
| ATOM | 4402 | CB | PHE | C | 148 | −28.910 | −65.765 | 102.977 | 1.00 | 30.49 | C |
| ATOM | 4403 | CG | PHE | C | 148 | −27.980 | −65.524 | 101.839 | 1.00 | 32.65 | C |
| ATOM | 4404 | CD1 | PHE | C | 148 | −28.316 | −65.923 | 100.550 | 1.00 | 30.37 | C |
| ATOM | 4405 | CD2 | PHE | C | 148 | −26.766 | −64.876 | 102.053 | 1.00 | 31.85 | C |
| ATOM | 4406 | CE1 | PHE | C | 148 | −27.460 | −65.681 | 99.502 | 1.00 | 33.92 | C |
| ATOM | 4407 | CE2 | PHE | C | 148 | −25.903 | −64.629 | 101.010 | 1.00 | 31.05 | C |
| ATOM | 4408 | CZ | PHE | C | 148 | −26.244 | −65.032 | 99.734 | 1.00 | 36.04 | C |
| ATOM | 4409 | N | PRO | C | 149 | −30.503 | −63.514 | 101.066 | 1.00 | 37.13 | N |
| ATOM | 4410 | CA | PRO | C | 149 | −29.514 | −62.453 | 101.301 | 1.00 | 34.36 | C |
| ATOM | 4411 | C | PRO | C | 149 | −30.136 | −61.270 | 102.025 | 1.00 | 31.13 | C |
| ATOM | 4412 | O | PRO | C | 149 | −31.294 | −61.362 | 102.414 | 1.00 | 33.18 | O |
| ATOM | 4413 | CB | PRO | C | 149 | −29.116 | −62.050 | 99.885 | 1.00 | 28.91 | C |
| ATOM | 4414 | CG | PRO | C | 149 | −30.384 | −62.167 | 99.146 | 1.00 | 26.99 | C |
| ATOM | 4415 | CD | PRO | C | 149 | −31.093 | −63.390 | 99.717 | 1.00 | 27.60 | C |
| ATOM | 4416 | N | GLU | C | 150 | −29.394 | −60.176 | 102.157 | 1.00 | 27.31 | N |
| ATOM | 4417 | CA | GLU | C | 150 | −29.961 | −58.888 | 102.552 | 1.00 | 30.44 | C |
| ATOM | 4418 | C | GLU | C | 150 | −30.938 | −58.398 | 101.479 | 1.00 | 29.76 | C |
| ATOM | 4419 | O | GLU | C | 150 | −30.806 | −58.770 | 100.312 | 1.00 | 30.40 | O |
| ATOM | 4420 | CB | GLU | C | 150 | −28.839 | −57.872 | 102.761 | 1.00 | 29.87 | C |
| ATOM | 4421 | CG | GLU | C | 150 | −27.928 | −58.160 | 103.958 | 1.00 | 29.34 | C |
| ATOM | 4422 | CD | GLU | C | 150 | −28.365 | −57.400 | 105.210 | 1.00 | 38.78 | C |
| ATOM | 4423 | OE1 | GLU | C | 150 | −27.573 | −56.543 | 105.699 | 1.00 | 37.11 | O |
| ATOM | 4424 | OE2 | GLU | C | 150 | −29.512 | −57.629 | 105.680 | 1.00 | 39.42 | O1− |
| ATOM | 4425 | N | PRO | C | 151 | −31.930 | −57.571 | 101.855 | 1.00 | 28.20 | N |
| ATOM | 4426 | CA | PRO | C | 151 | −32.224 | −57.019 | 103.180 | 1.00 | 28.76 | C |
| ATOM | 4427 | C | PRO | C | 151 | −33.460 | −57.594 | 103.883 | 1.00 | 32.34 | C |
| ATOM | 4428 | O | PRO | C | 151 | −34.284 | −58.288 | 103.291 | 1.00 | 27.74 | O |
| ATOM | 4429 | CB | PRO | C | 151 | −32.488 | −55.554 | 102.867 | 1.00 | 21.65 | C |
| ATOM | 4430 | CG | PRO | C | 151 | −33.145 | −55.605 | 101.554 | 1.00 | 15.86 | C |
| ATOM | 4431 | CD | PRO | C | 151 | −32.640 | −56.807 | 100.810 | 1.00 | 20.18 | C |
| ATOM | 4432 | N | VAL | C | 152 | −33.572 | −57.269 | 105.165 | 1.00 | 31.09 | N |
| ATOM | 4433 | CA | VAL | C | 152 | −34.798 | −57.431 | 105.925 | 1.00 | 31.79 | C |
| ATOM | 4434 | C | VAL | C | 152 | −35.215 | −56.053 | 106.399 | 1.00 | 32.70 | C |

TABLE 10.4-continued

| | | | | | | | | | | |
|---|---|---|---|---|---|---|---|---|---|---|
| ATOM | 4435 | O | VAL | C | 152 | −34.378 | −55.174 | 106.625 | 1.00 | 38.99 | O |
| ATOM | 4436 | CB | VAL | C | 152 | −34.616 | −58.366 | 107.130 | 1.00 | 32.39 | C |
| ATOM | 4437 | CG1 | VAL | C | 152 | −34.480 | −59.798 | 106.688 | 1.00 | 34.75 | C |
| ATOM | 4438 | CG2 | VAL | C | 152 | −33.386 | −57.962 | 107.854 | 1.00 | 32.91 | C |
| ATOM | 4439 | N | THR | C | 153 | −36.513 | −55.863 | 106.552 | 1.00 | 30.59 | N |
| ATOM | 4440 | CA | THR | C | 153 | −37.032 | −54.660 | 107.178 | 1.00 | 33.61 | C |
| ATOM | 4441 | C | THR | C | 153 | −37.799 | −55.060 | 108.426 | 1.00 | 32.20 | C |
| ATOM | 4442 | O | THR | C | 153 | −38.455 | −56.108 | 108.450 | 1.00 | 30.80 | O |
| ATOM | 4443 | CB | THR | C | 153 | −37.918 | −53.848 | 106.212 | 1.00 | 32.33 | C |
| ATOM | 4444 | OG1 | THR | C | 153 | −38.950 | −54.679 | 105.683 | 1.00 | 37.08 | O |
| ATOM | 4445 | CG2 | THR | C | 153 | −37.089 | −53.315 | 105.061 | 1.00 | 33.42 | C |
| ATOM | 4446 | N | VAL | C | 154 | −37.709 | −54.221 | 109.459 | 1.00 | 27.86 | N |
| ATOM | 4447 | CA | VAL | C | 154 | −38.401 | −54.438 | 110.727 | 1.00 | 29.82 | C |
| ATOM | 4448 | C | VAL | C | 154 | −39.162 | −53.168 | 111.090 | 1.00 | 26.12 | C |
| ATOM | 4449 | O | VAL | C | 154 | −38.574 | −52.085 | 111.121 | 1.00 | 30.95 | O |
| ATOM | 4450 | CB | VAL | C | 154 | −37.414 | −54.808 | 111.861 | 1.00 | 29.46 | C |
| ATOM | 4451 | CG1 | VAL | C | 154 | −38.155 | −55.064 | 113.142 | 1.00 | 29.26 | C |
| ATOM | 4452 | CG2 | VAL | C | 154 | −36.547 | −56.023 | 111.485 | 1.00 | 24.20 | C |
| ATOM | 4453 | N | SER | C | 155 | −40.459 | −53.293 | 111.373 | 1.00 | 28.07 | N |
| ATOM | 4454 | CA | SER | C | 155 | −41.207 | −52.221 | 112.033 | 1.00 | 29.61 | C |
| ATOM | 4455 | C | SER | C | 155 | −41.832 | −52.750 | 113.315 | 1.00 | 35.01 | C |
| ATOM | 4456 | O | SER | C | 155 | −41.790 | −53.949 | 113.616 | 1.00 | 36.17 | O |
| ATOM | 4457 | CB | SER | C | 155 | −42.310 | −51.632 | 111.151 | 1.00 | 25.87 | C |
| ATOM | 4458 | OG | SER | C | 155 | −43.302 | −52.591 | 110.859 | 1.00 | 28.75 | O |
| ATOM | 4459 | N | TRP | C | 156 | −42.424 | −51.846 | 114.080 | 1.00 | 29.64 | N |
| ATOM | 4460 | CA | TRP | C | 156 | −43.029 | −52.229 | 115.344 | 1.00 | 33.60 | C |
| ATOM | 4461 | C | TRP | C | 156 | −44.490 | −51.793 | 115.369 | 1.00 | 34.15 | C |
| ATOM | 4462 | O | TRP | C | 156 | −44.813 | −50.652 | 115.017 | 1.00 | 33.36 | O |
| ATOM | 4463 | CB | TRP | C | 156 | −42.226 | −51.655 | 116.514 | 1.00 | 31.35 | C |
| ATOM | 4464 | CG | TRP | C | 156 | −40.969 | −52.463 | 116.781 | 1.00 | 31.98 | C |
| ATOM | 4465 | CD1 | TRP | C | 156 | −39.734 | −52.302 | 116.196 | 1.00 | 33.14 | C |
| ATOM | 4466 | CD2 | TRP | C | 156 | −40.836 | −53.564 | 117.686 | 1.00 | 30.45 | C |
| ATOM | 4467 | NE1 | TRP | C | 156 | −38.849 | −53.230 | 116.690 | 1.00 | 25.96 | N |
| ATOM | 4468 | CE2 | TRP | C | 156 | −39.498 | −54.008 | 117.616 | 1.00 | 30.62 | C |
| ATOM | 4469 | CE3 | TRP | C | 156 | −41.717 | −54.213 | 118.566 | 1.00 | 32.88 | C |
| ATOM | 4470 | CZ2 | TRP | C | 156 | −39.025 | −55.076 | 118.391 | 1.00 | 31.18 | C |
| ATOM | 4471 | CZ3 | TRP | C | 156 | −41.243 | −55.274 | 119.341 | 1.00 | 27.61 | C |
| ATOM | 4472 | CH2 | TRP | C | 156 | −39.914 | −55.694 | 119.242 | 1.00 | 30.88 | C |
| ATOM | 4473 | N | ASN | C | 157 | −45.370 | −52.719 | 115.757 | 1.00 | 34.57 | N |
| ATOM | 4474 | CA | ASN | C | 157 | −46.805 | −52.459 | 115.826 | 1.00 | 28.72 | C |
| ATOM | 4475 | C | ASN | C | 157 | −47.299 | −51.895 | 114.495 | 1.00 | 36.26 | C |
| ATOM | 4476 | O | ASN | C | 157 | −47.997 | −50.880 | 114.432 | 1.00 | 35.07 | O |
| ATOM | 4477 | CB | ASN | C | 157 | −47.133 | −51.515 | 116.989 | 1.00 | 31.99 | C |
| ATOM | 4478 | CG | ASN | C | 157 | −46.897 | −52.156 | 118.368 | 1.00 | 33.31 | C |
| ATOM | 4479 | OD1 | ASN | C | 157 | −46.496 | −53.318 | 118.479 | 1.00 | 34.80 | O |
| ATOM | 4480 | ND2 | ASN | C | 157 | −47.136 | −51.387 | 119.418 | 1.00 | 32.04 | N |
| ATOM | 4481 | N | SER | C | 158 | −46.870 | −52.540 | 113.410 | 1.00 | 39.26 | N |
| ATOM | 4482 | CA | SER | C | 158 | −47.310 | −52.190 | 112.062 | 1.00 | 36.22 | C |
| ATOM | 4483 | C | SER | C | 158 | −46.991 | −50.739 | 111.719 | 1.00 | 35.47 | C |
| ATOM | 4484 | O | SER | C | 158 | −47.673 | −50.119 | 110.908 | 1.00 | 39.31 | O |
| ATOM | 4485 | CB | SER | C | 158 | −48.807 | −52.459 | 111.895 | 1.00 | 33.86 | C |
| ATOM | 4486 | OG | SER | C | 158 | −49.145 | −53.743 | 112.399 | 1.00 | 43.34 | O |
| ATOM | 4487 | N | GLY | C | 159 | −45.938 | −50.192 | 112.306 | 1.00 | 35.45 | N |
| ATOM | 4488 | CA | GLY | C | 159 | −45.566 | −48.813 | 112.078 | 1.00 | 33.17 | C |
| ATOM | 4489 | C | GLY | C | 159 | −46.053 | −47.833 | 113.124 | 1.00 | 36.82 | C |
| ATOM | 4490 | O | GLY | C | 159 | −45.608 | −46.684 | 113.114 | 1.00 | 41.61 | O |
| ATOM | 4491 | N | ALA | C | 160 | −46.919 | −48.260 | 114.048 | 1.00 | 38.45 | N |
| ATOM | 4492 | CA | ALA | C | 160 | −47.469 | −47.347 | 115.047 | 1.00 | 32.99 | C |
| ATOM | 4493 | C | ALA | C | 160 | −46.449 | −46.967 | 116.108 | 1.00 | 41.51 | C |
| ATOM | 4494 | O | ALA | C | 160 | −46.566 | −45.903 | 116.718 | 1.00 | 49.03 | O |
| ATOM | 4495 | CB | ALA | C | 160 | −48.695 | −47.977 | 115.719 | 1.00 | 29.64 | C |
| ATOM | 4496 | N | LEU | C | 161 | −45.463 | −47.818 | 116.362 | 1.00 | 40.25 | N |
| ATOM | 4497 | CA | LEU | C | 161 | −44.450 | −47.562 | 117.372 | 1.00 | 30.64 | C |
| ATOM | 4498 | C | LEU | C | 161 | −43.161 | −47.174 | 116.659 | 1.00 | 33.32 | C |
| ATOM | 4499 | O | LEU | C | 161 | −42.702 | −47.877 | 115.757 | 1.00 | 31.89 | O |
| ATOM | 4500 | CB | LEU | C | 161 | −44.269 | −48.786 | 118.270 | 1.00 | 31.29 | C |
| ATOM | 4501 | CG | LEU | C | 161 | −43.229 | −48.759 | 119.395 | 1.00 | 38.45 | C |
| ATOM | 4502 | CD1 | LEU | C | 161 | −43.249 | −47.451 | 120.164 | 1.00 | 23.88 | C |
| ATOM | 4503 | CD2 | LEU | C | 161 | −43.494 | −49.922 | 120.328 | 1.00 | 32.82 | C |
| ATOM | 4504 | N | THR | C | 162 | −42.606 | −46.032 | 117.032 | 1.00 | 37.42 | N |
| ATOM | 4505 | CA | THR | C | 162 | −41.535 | −45.418 | 116.262 | 1.00 | 33.06 | C |
| ATOM | 4506 | C | THR | C | 162 | −40.497 | −44.859 | 117.219 | 1.00 | 29.92 | C |
| ATOM | 4507 | O | THR | C | 162 | −39.296 | −45.096 | 117.071 | 1.00 | 28.52 | O |
| ATOM | 4508 | CB | THR | C | 162 | −42.139 | −44.328 | 115.362 | 1.00 | 36.32 | C |
| ATOM | 4509 | OG1 | THR | C | 162 | −42.104 | −44.761 | 113.998 | 1.00 | 34.07 | O |
| ATOM | 4510 | CG2 | THR | C | 162 | −41.443 | −42.968 | 115.527 | 1.00 | 36.07 | C |
| ATOM | 4511 | N | SER | C | 163 | −40.981 | −44.153 | 118.234 | 1.00 | 30.45 | N |
| ATOM | 4512 | CA | SER | C | 163 | −40.121 | −43.634 | 119.272 | 1.00 | 26.52 | C |
| ATOM | 4513 | C | SER | C | 163 | −39.452 | −44.780 | 120.014 | 1.00 | 30.83 | C |
| ATOM | 4514 | O | SER | C | 163 | −40.117 | −45.724 | 120.461 | 1.00 | 32.58 | O |

TABLE 10.4-continued

| | | | | | | | | | | |
|---|---|---|---|---|---|---|---|---|---|---|
| ATOM | 4515 | CB | SER | C | 163 | −40.954 | −42.786 | 120.226 | 1.00 | 28.23 | C |
| ATOM | 4516 | OG | SER | C | 163 | −40.230 | −42.404 | 121.384 | 1.00 | 40.32 | O |
| ATOM | 4517 | N | GLY | C | 164 | −38.137 | −44.673 | 120.178 | 1.00 | 30.58 | N |
| ATOM | 4518 | CA | GLY | C | 164 | −37.364 | −45.625 | 120.941 | 1.00 | 29.23 | C |
| ATOM | 4519 | C | GLY | C | 164 | −36.839 | −46.804 | 120.153 | 1.00 | 31.45 | C |
| ATOM | 4520 | O | GLY | C | 164 | −36.059 | −47.589 | 120.704 | 1.00 | 33.69 | O |
| ATOM | 4521 | N | VAL | C | 165 | −37.207 | −46.930 | 118.878 | 1.00 | 27.51 | N |
| ATOM | 4522 | CA | VAL | C | 165 | −36.793 | −48.069 | 118.070 | 1.00 | 28.93 | C |
| ATOM | 4523 | C | VAL | C | 165 | −35.357 | −47.887 | 117.587 | 1.00 | 28.12 | C |
| ATOM | 4524 | O | VAL | C | 165 | −34.979 | −46.831 | 117.081 | 1.00 | 37.17 | O |
| ATOM | 4525 | CB | VAL | C | 165 | −37.748 | −48.269 | 116.884 | 1.00 | 26.69 | C |
| ATOM | 4526 | CG1 | VAL | C | 165 | −37.278 | −49.432 | 116.023 | 1.00 | 24.04 | C |
| ATOM | 4527 | CG2 | VAL | C | 165 | −39.163 | −48.502 | 117.367 | 1.00 | 24.09 | C |
| ATOM | 4528 | N | HIS | C | 166 | −34.566 | −48.942 | 117.693 | 1.00 | 30.28 | N |
| ATOM | 4529 | CA | HIS | C | 166 | −33.290 | −49.052 | 116.999 | 1.00 | 27.00 | C |
| ATOM | 4530 | C | HIS | C | 166 | −33.270 | −50.379 | 116.259 | 1.00 | 23.79 | C |
| ATOM | 4531 | O | HIS | C | 166 | −33.286 | −51.436 | 116.895 | 1.00 | 25.39 | O |
| ATOM | 4532 | CB | HIS | C | 166 | −32.105 | −49.007 | 117.975 | 1.00 | 27.83 | C |
| ATOM | 4533 | CG | HIS | C | 166 | −32.009 | −47.759 | 118.809 | 1.00 | 31.08 | C |
| ATOM | 4534 | ND1 | HIS | C | 166 | −31.757 | −46.516 | 118.271 | 1.00 | 32.94 | N |
| ATOM | 4535 | CD2 | HIS | C | 166 | −32.070 | −47.578 | 120.153 | 1.00 | 30.56 | C |
| ATOM | 4536 | CE1 | HIS | C | 166 | −31.681 | −45.622 | 119.242 | 1.00 | 30.93 | C |
| ATOM | 4537 | NE2 | HIS | C | 166 | −31.861 | −46.242 | 120.395 | 1.00 | 27.04 | N |
| ATOM | 4538 | N | THR | C | 167 | −33.209 | −50.338 | 114.928 | 1.00 | 24.71 | N |
| ATOM | 4539 | CA | THR | C | 167 | −32.896 | −51.526 | 114.139 | 1.00 | 22.25 | C |
| ATOM | 4540 | C | THR | C | 167 | −31.455 | −51.439 | 113.637 | 1.00 | 24.53 | C |
| ATOM | 4541 | O | THR | C | 167 | −31.093 | −50.498 | 112.927 | 1.00 | 26.79 | O |
| ATOM | 4542 | CB | THR | C | 167 | −33.857 | −51.694 | 112.980 | 1.00 | 20.41 | C |
| ATOM | 4543 | OG1 | THR | C | 167 | −35.176 | −51.829 | 113.501 | 1.00 | 28.97 | O |
| ATOM | 4544 | CG2 | THR | C | 167 | −33.529 | −52.967 | 112.219 | 1.00 | 21.90 | C |
| ATOM | 4545 | N | PHE | C | 168 | −30.658 | −52.417 | 113.986 | 1.00 | 25.58 | N |
| ATOM | 4546 | CA | PHE | C | 168 | −29.210 | −52.471 | 113.865 | 1.00 | 26.05 | C |
| ATOM | 4547 | C | PHE | C | 168 | −28.807 | −53.018 | 112.505 | 1.00 | 21.09 | C |
| ATOM | 4548 | O | PHE | C | 168 | −29.560 | −53.760 | 111.890 | 1.00 | 25.00 | O |
| ATOM | 4549 | CB | PHE | C | 168 | −28.623 | −53.352 | 114.969 | 1.00 | 23.55 | C |
| ATOM | 4550 | CG | PHE | C | 168 | −28.681 | −52.722 | 116.316 | 1.00 | 22.06 | C |
| ATOM | 4551 | CD1 | PHE | C | 168 | −29.812 | −52.855 | 117.113 | 1.00 | 23.76 | C |
| ATOM | 4552 | CD2 | PHE | C | 168 | −27.617 | −51.958 | 116.788 | 1.00 | 24.14 | C |
| ATOM | 4553 | CE1 | PHE | C | 168 | −29.892 | −52.232 | 118.390 | 1.00 | 24.66 | C |
| ATOM | 4554 | CE2 | PHE | C | 168 | −27.683 | −51.341 | 118.064 | 1.00 | 28.11 | C |
| ATOM | 4555 | CZ | PHE | C | 168 | −28.828 | −51.482 | 118.866 | 1.00 | 22.06 | C |
| ATOM | 4556 | N | PRO | C | 169 | −27.626 | −52.662 | 112.009 | 1.00 | 26.60 | N |
| ATOM | 4557 | CA | PRO | C | 169 | −27.121 | −53.295 | 110.778 | 1.00 | 25.79 | C |
| ATOM | 4558 | C | PRO | C | 169 | −26.907 | −54.793 | 110.988 | 1.00 | 26.33 | C |
| ATOM | 4559 | O | PRO | C | 169 | −26.457 | −55.228 | 112.050 | 1.00 | 23.48 | O |
| ATOM | 4560 | CB | PRO | C | 169 | −25.790 | −52.569 | 110.525 | 1.00 | 17.06 | C |
| ATOM | 4561 | CG | PRO | C | 169 | −25.829 | −51.348 | 111.350 | 1.00 | 17.09 | C |
| ATOM | 4562 | CD | PRO | C | 169 | −26.686 | −51.660 | 112.546 | 1.00 | 22.12 | C |
| ATOM | 4563 | N | ALA | C | 170 | −27.222 | −55.586 | 109.966 | 1.00 | 23.48 | N |
| ATOM | 4564 | CA | ALA | C | 170 | −27.009 | −57.027 | 110.064 | 1.00 | 26.56 | C |
| ATOM | 4565 | C | ALA | C | 170 | −25.523 | −57.369 | 110.178 | 1.00 | 25.54 | C |
| ATOM | 4566 | O | ALA | C | 170 | −24.650 | −56.604 | 109.782 | 1.00 | 26.69 | O |
| ATOM | 4567 | CB | ALA | C | 170 | −27.591 | −57.744 | 108.847 | 1.00 | 29.48 | C |
| ATOM | 4568 | N | VAL | C | 171 | −25.237 | −58.531 | 110.747 | 1.00 | 26.07 | N |
| ATOM | 4569 | CA | VAL | C | 171 | −23.899 | −59.104 | 110.683 | 1.00 | 24.19 | C |
| ATOM | 4570 | C | VAL | C | 171 | −23.934 | −60.333 | 109.789 | 1.00 | 26.45 | C |
| ATOM | 4571 | O | VAL | C | 171 | −24.935 | −61.047 | 109.711 | 1.00 | 31.14 | O |
| ATOM | 4572 | CB | VAL | C | 171 | −23.315 | −59.455 | 112.072 | 1.00 | 29.65 | C |
| ATOM | 4573 | CG1 | VAL | C | 171 | −23.042 | −58.193 | 112.858 | 1.00 | 27.11 | C |
| ATOM | 4574 | CG2 | VAL | C | 171 | −24.254 | −60.404 | 112.853 | 1.00 | 25.85 | C |
| ATOM | 4575 | N | LEU | C | 172 | −22.832 | −60.571 | 109.101 | 1.00 | 31.64 | N |
| ATOM | 4576 | CA | LEU | C | 172 | −22.658 | −61.767 | 108.288 | 1.00 | 28.57 | C |
| ATOM | 4577 | C | LEU | C | 172 | −21.868 | −62.750 | 109.143 | 1.00 | 26.67 | C |
| ATOM | 4578 | O | LEU | C | 172 | −20.718 | −62.492 | 109.489 | 1.00 | 30.87 | O |
| ATOM | 4579 | CB | LEU | C | 172 | −21.937 | −61.442 | 106.982 | 1.00 | 27.30 | C |
| ATOM | 4580 | CG | LEU | C | 172 | −21.662 | −62.583 | 105.992 | 1.00 | 32.63 | C |
| ATOM | 4581 | CD1 | LEU | C | 172 | −22.971 | −63.245 | 105.549 | 1.00 | 26.83 | C |
| ATOM | 4582 | CD2 | LEU | C | 172 | −20.839 | −62.101 | 104.772 | 1.00 | 28.21 | C |
| ATOM | 4583 | N | GLN | C | 173 | −22.503 | −63.845 | 109.522 | 1.00 | 27.90 | N |
| ATOM | 4584 | CA | GLN | C | 173 | −21.916 | −64.862 | 110.372 | 1.00 | 32.35 | C |
| ATOM | 4585 | C | GLN | C | 173 | −21.087 | −65.824 | 109.528 | 1.00 | 36.44 | C |
| ATOM | 4586 | O | GLN | C | 173 | −21.204 | −65.870 | 108.294 | 1.00 | 34.30 | O |
| ATOM | 4587 | CB | GLN | C | 173 | −23.010 | −65.632 | 111.111 | 1.00 | 33.56 | C |
| ATOM | 4588 | CG | GLN | C | 173 | −23.996 | −64.769 | 111.851 | 1.00 | 29.57 | C |
| ATOM | 4589 | CD | GLN | C | 173 | −25.319 | −65.478 | 112.079 | 1.00 | 34.07 | C |
| ATOM | 4590 | OE1 | GLN | C | 173 | −25.724 | −65.696 | 113.215 | 1.00 | 34.19 | O |
| ATOM | 4591 | NE2 | GLN | C | 173 | −26.002 | −65.836 | 110.991 | 1.00 | 32.53 | N |
| ATOM | 4592 | N | SER | C | 174 | −20.254 | −66.622 | 110.208 | 1.00 | 36.04 | N |
| ATOM | 4593 | CA | SER | C | 174 | −19.363 | −67.525 | 109.481 | 1.00 | 33.82 | C |
| ATOM | 4594 | C | SER | C | 174 | −20.138 | −68.509 | 108.622 | 1.00 | 32.65 | C |

TABLE 10.4-continued

| ATOM | 4595 | O | SER | C | 174 | −19.561 | −69.087 | 107.697 | 1.00 | 35.26 | O |
|---|---|---|---|---|---|---|---|---|---|---|---|
| ATOM | 4596 | CB | SER | C | 174 | −18.437 | −68.272 | 110.441 | 1.00 | 31.17 | C |
| ATOM | 4597 | OG | SER | C | 174 | −18.868 | −68.133 | 111.788 | 1.00 | 51.22 | O |
| ATOM | 4598 | N | SER | C | 175 | −21.438 | −68.678 | 108.879 | 1.00 | 30.00 | N |
| ATOM | 4599 | CA | SER | C | 175 | −22.267 | −69.541 | 108.055 | 1.00 | 23.99 | C |
| ATOM | 4600 | C | SER | C | 175 | −22.566 | −68.950 | 106.691 | 1.00 | 33.95 | C |
| ATOM | 4601 | O | SER | C | 175 | −23.018 | −69.689 | 105.810 | 1.00 | 36.33 | O |
| ATOM | 4602 | CB | SER | C | 175 | −23.588 | −69.851 | 108.767 | 1.00 | 31.25 | C |
| ATOM | 4603 | OG | SER | C | 175 | −24.482 | −68.743 | 108.809 | 1.00 | 33.60 | O |
| ATOM | 4604 | N | GLY | C | 176 | −22.299 | −67.659 | 106.473 | 1.00 | 34.11 | N |
| ATOM | 4605 | CA | GLY | C | 176 | −22.780 | −67.006 | 105.275 | 1.00 | 26.57 | C |
| ATOM | 4606 | C | GLY | C | 176 | −24.191 | −66.479 | 105.380 | 1.00 | 33.77 | C |
| ATOM | 4607 | O | GLY | C | 176 | −24.690 | −65.897 | 104.409 | 1.00 | 34.08 | O |
| ATOM | 4608 | N | LEU | C | 177 | −24.857 | −66.682 | 106.515 | 1.00 | 32.19 | N |
| ATOM | 4609 | CA | LEU | C | 177 | −26.185 | −66.145 | 106.765 | 1.00 | 30.75 | C |
| ATOM | 4610 | C | LEU | C | 177 | −26.072 | −64.870 | 107.584 | 1.00 | 33.31 | C |
| ATOM | 4611 | O | LEU | C | 177 | −25.122 | −64.683 | 108.347 | 1.00 | 33.18 | O |
| ATOM | 4612 | CB | LEU | C | 177 | −27.062 | −67.141 | 107.512 | 1.00 | 35.99 | C |
| ATOM | 4613 | CG | LEU | C | 177 | −27.316 | −68.487 | 106.843 | 1.00 | 34.64 | C |
| ATOM | 4614 | CD1 | LEU | C | 177 | −28.208 | −69.291 | 107.732 | 1.00 | 30.71 | C |
| ATOM | 4615 | CD2 | LEU | C | 177 | −27.932 | −68.291 | 105.469 | 1.00 | 29.23 | C |
| ATOM | 4616 | N | TYR | C | 178 | −27.048 | −63.992 | 107.413 | 1.00 | 32.29 | N |
| ATOM | 4617 | CA | TYR | C | 178 | −27.076 | −62.736 | 108.138 | 1.00 | 29.56 | C |
| ATOM | 4618 | C | TYR | C | 178 | −27.923 | −62.834 | 109.408 | 1.00 | 32.53 | C |
| ATOM | 4619 | O | TYR | C | 178 | −28.819 | −63.665 | 109.535 | 1.00 | 33.61 | O |
| ATOM | 4620 | CB | TYR | C | 178 | −27.616 | −61.627 | 107.249 | 1.00 | 26.03 | C |
| ATOM | 4621 | CG | TYR | C | 178 | −26.708 | −61.260 | 106.096 | 1.00 | 32.82 | C |
| ATOM | 4622 | CD1 | TYR | C | 178 | −25.696 | −60.309 | 106.248 | 1.00 | 25.25 | C |
| ATOM | 4623 | CD2 | TYR | C | 178 | −26.874 | −61.855 | 104.843 | 1.00 | 28.59 | C |
| ATOM | 4624 | CE1 | TYR | C | 178 | −24.890 | −59.978 | 105.188 | 1.00 | 27.51 | C |
| ATOM | 4625 | CE2 | TYR | C | 178 | −26.075 | −61.526 | 103.785 | 1.00 | 25.14 | C |
| ATOM | 4626 | CZ | TYR | C | 178 | −25.085 | −60.589 | 103.952 | 1.00 | 33.10 | C |
| ATOM | 4627 | OH | TYR | C | 178 | −24.299 | −60.260 | 102.873 | 1.00 | 31.54 | O |
| ATOM | 4628 | N | SER | C | 179 | −27.674 | −61.906 | 110.316 | 1.00 | 30.12 | N |
| ATOM | 4629 | CA | SER | C | 179 | −28.377 | −61.836 | 111.580 | 1.00 | 26.37 | C |
| ATOM | 4630 | C | SER | C | 179 | −28.484 | −60.373 | 111.974 | 1.00 | 28.91 | C |
| ATOM | 4631 | O | SER | C | 179 | −27.473 | −59.669 | 112.014 | 1.00 | 33.49 | O |
| ATOM | 4632 | CB | SER | C | 179 | −27.616 | −62.615 | 112.653 | 1.00 | 31.79 | C |
| ATOM | 4633 | OG | SER | C | 179 | −28.434 | −63.550 | 113.310 | 1.00 | 36.87 | O |
| ATOM | 4634 | N | LEU | C | 180 | −29.693 | −59.908 | 112.244 | 1.00 | 24.41 | N |
| ATOM | 4635 | CA | LEU | C | 180 | −29.847 | −58.581 | 112.796 | 1.00 | 26.13 | C |
| ATOM | 4636 | C | LEU | C | 180 | −30.787 | −58.623 | 113.991 | 1.00 | 33.77 | C |
| ATOM | 4637 | O | LEU | C | 180 | −31.507 | −59.597 | 114.238 | 1.00 | 33.18 | O |
| ATOM | 4638 | CB | LEU | C | 180 | −30.340 | −57.570 | 111.757 | 1.00 | 32.63 | C |
| ATOM | 4639 | CG | LEU | C | 180 | −31.742 | −57.362 | 111.177 | 1.00 | 31.41 | C |
| ATOM | 4640 | CD1 | LEU | C | 180 | −32.886 | −57.085 | 112.196 | 1.00 | 23.59 | C |
| ATOM | 4641 | CD2 | LEU | C | 180 | −31.574 | −56.181 | 110.212 | 1.00 | 23.09 | C |
| ATOM | 4642 | N | SER | C | 181 | −30.773 | −57.531 | 114.735 | 1.00 | 33.23 | N |
| ATOM | 4643 | CA | SER | C | 181 | −31.662 | −57.356 | 115.859 | 1.00 | 28.03 | C |
| ATOM | 4644 | C | SER | C | 181 | −32.311 | −55.982 | 115.766 | 1.00 | 26.07 | C |
| ATOM | 4645 | O | SER | C | 181 | −31.777 | −55.063 | 115.154 | 1.00 | 28.63 | O |
| ATOM | 4646 | CB | SER | C | 181 | −30.906 | −57.540 | 117.184 | 1.00 | 30.44 | C |
| ATOM | 4647 | OG | SER | C | 181 | −29.984 | −56.493 | 117.391 | 1.00 | 31.22 | O |
| ATOM | 4648 | N | SER | C | 182 | −33.506 | −55.881 | 116.326 | 1.00 | 27.13 | N |
| ATOM | 4649 | CA | SER | C | 182 | −34.271 | −54.649 | 116.409 | 1.00 | 27.94 | C |
| ATOM | 4650 | C | SER | C | 182 | −34.805 | −54.551 | 117.827 | 1.00 | 28.64 | C |
| ATOM | 4651 | O | SER | C | 182 | −35.302 | −55.543 | 118.363 | 1.00 | 26.17 | O |
| ATOM | 4652 | CB | SER | C | 182 | −35.424 | −54.637 | 115.408 | 1.00 | 25.46 | C |
| ATOM | 4653 | OG | SER | C | 182 | −36.221 | −53.487 | 115.599 | 1.00 | 27.32 | O |
| ATOM | 4654 | N | VAL | C | 183 | −34.683 | −53.373 | 118.446 | 1.00 | 27.27 | N |
| ATOM | 4655 | CA | VAL | C | 183 | −35.089 | −53.201 | 119.837 | 1.00 | 30.94 | C |
| ATOM | 4656 | C | VAL | C | 183 | −35.878 | −51.909 | 120.005 | 1.00 | 30.82 | C |
| ATOM | 4657 | O | VAL | C | 183 | −35.875 | −51.032 | 119.142 | 1.00 | 33.72 | O |
| ATOM | 4658 | CB | VAL | C | 183 | −33.886 | −53.209 | 120.800 | 1.00 | 27.96 | C |
| ATOM | 4659 | CG1 | VAL | C | 183 | −33.091 | −54.486 | 120.621 | 1.00 | 17.87 | C |
| ATOM | 4660 | CG2 | VAL | C | 183 | −33.031 | −51.953 | 120.585 | 1.00 | 29.36 | C |
| ATOM | 4661 | N | VAL | C | 184 | −36.585 | −51.813 | 121.122 | 1.00 | 25.36 | N |
| ATOM | 4662 | CA | VAL | C | 184 | −37.315 | −50.601 | 121.452 | 1.00 | 29.08 | C |
| ATOM | 4663 | C | VAL | C | 184 | −37.320 | −50.459 | 122.968 | 1.00 | 33.22 | C |
| ATOM | 4664 | O | VAL | C | 184 | −37.476 | −51.444 | 123.700 | 1.00 | 34.38 | O |
| ATOM | 4665 | CB | VAL | C | 184 | −38.734 | −50.602 | 120.812 | 1.00 | 30.67 | C |
| ATOM | 4666 | CG1 | VAL | C | 184 | −39.523 | −51.866 | 121.135 | 1.00 | 28.94 | C |
| ATOM | 4667 | CG2 | VAL | C | 184 | −39.531 | −49.352 | 121.221 | 1.00 | 30.72 | C |
| ATOM | 4668 | N | THR | C | 185 | −37.102 | −49.234 | 123.440 | 1.00 | 31.38 | N |
| ATOM | 4669 | CA | THR | C | 185 | −37.213 | −48.922 | 124.854 | 1.00 | 29.00 | C |
| ATOM | 4670 | C | THR | C | 185 | −38.591 | −48.319 | 125.074 | 1.00 | 30.90 | C |
| ATOM | 4671 | O | THR | C | 185 | −39.048 | −47.490 | 124.284 | 1.00 | 37.29 | O |
| ATOM | 4672 | CB | THR | C | 185 | −36.102 | −47.977 | 125.330 | 1.00 | 24.92 | C |
| ATOM | 4673 | OG1 | THR | C | 185 | −35.966 | −46.874 | 124.424 | 1.00 | 32.54 | O |
| ATOM | 4674 | CG2 | THR | C | 185 | −34.779 | −48.706 | 125.402 | 1.00 | 26.78 | C |

TABLE 10.4-continued

| ATOM | 4675 | N | VAL | C | 186 | −39.273 | −48.800 | 126.103 | 1.00 | 29.32 | N |
|---|---|---|---|---|---|---|---|---|---|---|---|
| ATOM | 4676 | CA | VAL | C | 186 | −40.625 | −48.377 | 126.458 | 1.00 | 34.69 | C |
| ATOM | 4677 | C | VAL | C | 186 | −40.698 | −48.292 | 127.970 | 1.00 | 36.57 | C |
| ATOM | 4678 | O | VAL | C | 186 | −39.835 | −48.836 | 128.675 | 1.00 | 34.20 | O |
| ATOM | 4679 | CB | VAL | C | 186 | −41.699 | −49.358 | 125.944 | 1.00 | 36.77 | C |
| ATOM | 4680 | CG1 | VAL | C | 186 | −41.645 | −49.516 | 124.421 | 1.00 | 27.93 | C |
| ATOM | 4681 | CG2 | VAL | C | 186 | −41.571 | −50.715 | 126.679 | 1.00 | 32.35 | C |
| ATOM | 4682 | N | PRO | C | 187 | −41.717 | −47.608 | 128.499 | 1.00 | 38.80 | N |
| ATOM | 4683 | CA | PRO | C | 187 | −41.851 | −47.521 | 129.958 | 1.00 | 40.40 | C |
| ATOM | 4684 | C | PRO | C | 187 | −42.128 | −48.886 | 130.574 | 1.00 | 43.67 | C |
| ATOM | 4685 | O | PRO | C | 187 | −42.872 | −49.703 | 130.024 | 1.00 | 42.12 | O |
| ATOM | 4686 | CB | PRO | C | 187 | −43.033 | −46.566 | 130.145 | 1.00 | 36.03 | C |
| ATOM | 4687 | CG | PRO | C | 187 | −43.095 | −45.798 | 128.889 | 1.00 | 29.12 | C |
| ATOM | 4688 | CD | PRO | C | 187 | −42.697 | −46.739 | 127.820 | 1.00 | 34.04 | C |
| ATOM | 4689 | N | SER | C | 188 | −41.501 | −49.128 | 131.728 | 1.00 | 47.08 | N |
| ATOM | 4690 | CA | SER | C | 188 | −41.753 | −50.348 | 132.489 | 1.00 | 48.24 | C |
| ATOM | 4691 | C | SER | C | 188 | −43.244 | −50.561 | 132.733 | 1.00 | 47.93 | C |
| ATOM | 4692 | O | SER | C | 188 | −43.776 | −51.660 | 132.523 | 1.00 | 45.02 | O |
| ATOM | 4693 | CB | SER | C | 188 | −41.011 | −50.260 | 133.813 | 1.00 | 50.96 | C |
| ATOM | 4694 | OG | SER | C | 188 | −39.631 | −50.377 | 133.576 | 1.00 | 59.84 | O |
| ATOM | 4695 | N | SER | C | 189 | −43.941 | −49.495 | 133.134 | 1.00 | 46.10 | N |
| ATOM | 4696 | CA | SER | C | 189 | −45.363 | −49.574 | 133.444 | 1.00 | 51.64 | C |
| ATOM | 4697 | C | SER | C | 189 | −46.222 | −50.037 | 132.263 | 1.00 | 51.86 | C |
| ATOM | 4698 | O | SER | C | 189 | −47.344 | −50.512 | 132.481 | 1.00 | 58.15 | O |
| ATOM | 4699 | CB | SER | C | 189 | −45.834 | −48.218 | 133.976 | 1.00 | 51.35 | C |
| ATOM | 4700 | OG | SER | C | 189 | −45.680 | −47.208 | 133.001 | 1.00 | 55.98 | O |
| ATOM | 4701 | N | SER | C | 190 | −45.740 | −49.918 | 131.022 | 1.00 | 51.05 | N |
| ATOM | 4702 | CA | SER | C | 190 | −46.558 | −50.310 | 129.870 | 1.00 | 50.46 | C |
| ATOM | 4703 | C | SER | C | 190 | −46.527 | −51.807 | 129.570 | 1.00 | 49.06 | C |
| ATOM | 4704 | O | SER | C | 190 | −47.396 | −52.279 | 128.830 | 1.00 | 45.72 | O |
| ATOM | 4705 | CB | SER | C | 190 | −46.113 | −49.566 | 128.610 | 1.00 | 40.88 | C |
| ATOM | 4706 | OG | SER | C | 190 | −44.817 | −49.995 | 128.218 | 1.00 | 41.80 | O |
| ATOM | 4707 | N | LEU | C | 191 | −45.553 | −52.559 | 130.096 | 1.00 | 47.92 | N |
| ATOM | 4708 | CA | LEU | C | 191 | −45.508 | −53.993 | 129.838 | 1.00 | 42.80 | C |
| ATOM | 4709 | C | LEU | C | 191 | −46.706 | −54.670 | 130.475 | 1.00 | 48.54 | C |
| ATOM | 4710 | O | LEU | C | 191 | −47.206 | −54.244 | 131.517 | 1.00 | 56.38 | O |
| ATOM | 4711 | CB | LEU | C | 191 | −44.230 | −54.612 | 130.387 | 1.00 | 39.21 | C |
| ATOM | 4712 | CG | LEU | C | 191 | −42.884 | −54.023 | 129.982 | 1.00 | 44.80 | C |
| ATOM | 4713 | CD1 | LEU | C | 191 | −41.792 | −54.654 | 130.804 | 1.00 | 34.81 | C |
| ATOM | 4714 | CD2 | LEU | C | 191 | −42.634 | −54.240 | 128.501 | 1.00 | 37.00 | C |
| ATOM | 4715 | N | GLY | C | 192 | −47.170 | −55.743 | 129.856 | 1.00 | 48.62 | N |
| ATOM | 4716 | CA | GLY | C | 192 | −48.335 | −56.412 | 130.386 | 1.00 | 56.13 | C |
| ATOM | 4717 | C | GLY | C | 192 | −49.643 | −55.692 | 130.132 | 1.00 | 55.78 | C |
| ATOM | 4718 | O | GLY | C | 192 | −50.704 | −56.327 | 130.177 | 1.00 | 56.01 | O |
| ATOM | 4719 | N | THR | C | 193 | −49.601 | −54.388 | 129.869 | 1.00 | 48.97 | N |
| ATOM | 4720 | CA | THR | C | 193 | −50.727 | −53.607 | 129.378 | 1.00 | 49.79 | C |
| ATOM | 4721 | C | THR | C | 193 | −50.644 | −53.332 | 127.883 | 1.00 | 49.11 | C |
| ATOM | 4722 | O | THR | C | 193 | −51.669 | −53.324 | 127.197 | 1.00 | 53.12 | O |
| ATOM | 4723 | CB | THR | C | 193 | −50.780 | −52.266 | 130.114 | 1.00 | 58.23 | C |
| ATOM | 4724 | OG1 | THR | C | 193 | −50.126 | −52.405 | 131.385 | 1.00 | 58.05 | O |
| ATOM | 4725 | CG2 | THR | C | 193 | −52.227 | −51.790 | 130.293 | 1.00 | 53.04 | C |
| ATOM | 4726 | N | GLN | C | 194 | −49.443 | −53.103 | 127.361 | 1.00 | 48.44 | N |
| ATOM | 4727 | CA | GLN | C | 194 | −49.241 | −52.741 | 125.967 | 1.00 | 42.09 | C |
| ATOM | 4728 | C | GLN | C | 194 | −48.676 | −53.911 | 125.177 | 1.00 | 37.51 | C |
| ATOM | 4729 | O | GLN | C | 194 | −47.808 | −54.636 | 125.660 | 1.00 | 40.92 | O |
| ATOM | 4730 | CB | GLN | C | 194 | −48.324 | −51.517 | 125.873 | 1.00 | 43.18 | C |
| ATOM | 4731 | CG | GLN | C | 194 | −48.013 | −51.097 | 124.469 | 1.00 | 46.41 | C |
| ATOM | 4732 | CD | GLN | C | 194 | −49.252 | −50.772 | 123.679 | 1.00 | 49.54 | C |
| ATOM | 4733 | OE1 | GLN | C | 194 | −49.610 | −51.489 | 122.735 | 1.00 | 42.75 | O |
| ATOM | 4734 | NE2 | GLN | C | 194 | −49.939 | −49.707 | 124.080 | 1.00 | 49.73 | N |
| ATOM | 4735 | N | THR | C | 195 | −49.176 | −54.093 | 123.963 | 1.00 | 36.34 | N |
| ATOM | 4736 | CA | THR | C | 195 | −48.744 | −55.181 | 123.101 | 1.00 | 39.27 | C |
| ATOM | 4737 | C | THR | C | 195 | −47.657 | −54.704 | 122.151 | 1.00 | 39.62 | C |
| ATOM | 4738 | O | THR | C | 195 | −47.782 | −53.650 | 121.523 | 1.00 | 38.44 | O |
| ATOM | 4739 | CB | THR | C | 195 | −49.921 | −55.761 | 122.312 | 1.00 | 43.59 | C |
| ATOM | 4740 | OG1 | THR | C | 195 | −50.568 | −56.759 | 123.110 | 1.00 | 45.10 | O |
| ATOM | 4741 | CG2 | THR | C | 195 | −49.470 | −56.364 | 120.984 | 1.00 | 36.94 | C |
| ATOM | 4742 | N | TYR | C | 196 | −46.604 | −55.500 | 122.044 | 1.00 | 39.64 | N |
| ATOM | 4743 | CA | TYR | C | 196 | −45.452 | −55.182 | 121.224 | 1.00 | 31.97 | C |
| ATOM | 4744 | C | TYR | C | 196 | −45.224 | −56.327 | 120.252 | 1.00 | 32.44 | C |
| ATOM | 4745 | O | TYR | C | 196 | −44.912 | −57.445 | 120.668 | 1.00 | 28.81 | O |
| ATOM | 4746 | CB | TYR | C | 196 | −44.231 | −54.930 | 122.098 | 1.00 | 33.73 | C |
| ATOM | 4747 | CG | TYR | C | 196 | −44.426 | −53.737 | 123.002 | 1.00 | 38.32 | C |
| ATOM | 4748 | CD1 | TYR | C | 196 | −44.552 | −52.458 | 122.474 | 1.00 | 33.41 | C |
| ATOM | 4749 | CD2 | TYR | C | 196 | −44.483 | −53.884 | 124.380 | 1.00 | 37.95 | C |
| ATOM | 4750 | CE1 | TYR | C | 196 | −44.728 | −51.370 | 123.289 | 1.00 | 33.25 | C |
| ATOM | 4751 | CE2 | TYR | C | 196 | −44.660 | −52.788 | 125.201 | 1.00 | 36.63 | C |
| ATOM | 4752 | CZ | TYR | C | 196 | −44.781 | −51.541 | 124.647 | 1.00 | 33.58 | C |
| ATOM | 4753 | OH | TYR | C | 196 | −44.966 | −50.453 | 125.459 | 1.00 | 38.73 | O |
| ATOM | 4754 | N | ILE | C | 197 | −45.395 | −56.038 | 118.964 | 1.00 | 31.69 | N |

TABLE 10.4-continued

| | | | | | | | | | | |
|---|---|---|---|---|---|---|---|---|---|---|
| ATOM | 4755 | CA | ILE | C | 197 | −45.176 | −56.988 | 117.885 | 1.00 | 31.54 | C |
| ATOM | 4756 | C | ILE | C | 197 | −44.163 | −56.386 | 116.919 | 1.00 | 33.20 | C |
| ATOM | 4757 | O | ILE | C | 197 | −44.321 | −55.239 | 116.484 | 1.00 | 33.69 | O |
| ATOM | 4758 | CB | ILE | C | 197 | −46.476 | −57.288 | 117.131 | 1.00 | 31.06 | C |
| ATOM | 4759 | CG1 | ILE | C | 197 | −47.516 | −57.886 | 118.042 | 1.00 | 33.48 | C |
| ATOM | 4760 | CG2 | ILE | C | 197 | −46.201 | −58.193 | 115.952 | 1.00 | 33.02 | C |
| ATOM | 4761 | CD1 | ILE | C | 197 | −48.862 | −57.783 | 117.425 | 1.00 | 24.92 | C |
| ATOM | 4762 | N | CYS | C | 198 | −43.163 | −57.165 | 116.533 | 1.00 | 28.72 | N |
| ATOM | 4763 | CA | CYS | C | 198 | −42.254 | −56.721 | 115.489 | 1.00 | 35.10 | C |
| ATOM | 4764 | C | CYS | C | 198 | −42.613 | −57.390 | 114.159 | 1.00 | 33.06 | C |
| ATOM | 4765 | O | CYS | C | 198 | −42.986 | −58.566 | 114.107 | 1.00 | 34.76 | O |
| ATOM | 4766 | CB | CYS | C | 198 | −40.798 | −56.986 | 115.869 | 1.00 | 35.03 | C |
| ATOM | 4767 | SG | CYS | C | 198 | −40.302 | −58.637 | 115.586 | 1.00 | 44.99 | S |
| ATOM | 4768 | N | ASN | C | 199 | −42.585 | −56.609 | 113.098 | 1.00 | 28.45 | N |
| ATOM | 4769 | CA | ASN | C | 199 | −43.018 | −57.057 | 111.786 | 1.00 | 29.27 | C |
| ATOM | 4770 | C | ASN | C | 199 | −41.775 | −57.159 | 110.921 | 1.00 | 28.88 | C |
| ATOM | 4771 | O | ASN | C | 199 | −41.126 | −56.148 | 110.645 | 1.00 | 34.72 | O |
| ATOM | 4772 | CB | ASN | C | 199 | −44.058 | −56.094 | 111.214 | 1.00 | 29.40 | C |
| ATOM | 4773 | CG | ASN | C | 199 | −45.068 | −55.631 | 112.274 | 1.00 | 35.22 | C |
| ATOM | 4774 | OD1 | ASN | C | 199 | −45.044 | −54.468 | 112.719 | 1.00 | 33.27 | O |
| ATOM | 4775 | ND2 | ASN | C | 199 | −45.951 | −56.546 | 112.693 | 1.00 | 28.65 | N |
| ATOM | 4776 | N | VAL | C | 200 | −41.435 | −58.381 | 110.521 | 1.00 | 26.15 | N |
| ATOM | 4777 | CA | VAL | C | 200 | −40.230 | −58.679 | 109.758 | 1.00 | 28.67 | C |
| ATOM | 4778 | C | VAL | C | 200 | −40.617 | −59.030 | 108.329 | 1.00 | 30.60 | C |
| ATOM | 4779 | O | VAL | C | 200 | −41.478 | −59.890 | 108.106 | 1.00 | 28.53 | O |
| ATOM | 4780 | CB | VAL | C | 200 | −39.450 | −59.841 | 110.388 | 1.00 | 21.99 | C |
| ATOM | 4781 | CG1 | VAL | C | 200 | −38.183 | −60.065 | 109.624 | 1.00 | 27.77 | C |
| ATOM | 4782 | CG2 | VAL | C | 200 | −39.182 | −59.577 | 111.849 | 1.00 | 26.33 | C |
| ATOM | 4783 | N | ASN | C | 201 | −39.960 | −58.406 | 107.359 | 1.00 | 31.19 | N |
| ATOM | 4784 | CA | ASN | C | 201 | −40.153 | −58.800 | 105.970 | 1.00 | 33.45 | C |
| ATOM | 4785 | C | ASN | C | 201 | −38.805 | −59.085 | 105.341 | 1.00 | 35.94 | C |
| ATOM | 4786 | O | ASN | C | 201 | −37.952 | −58.195 | 105.238 | 1.00 | 38.25 | O |
| ATOM | 4787 | CB | ASN | C | 201 | −40.899 | −57.739 | 105.160 | 1.00 | 34.65 | C |
| ATOM | 4788 | CG | ASN | C | 201 | −41.430 | −58.284 | 103.832 | 1.00 | 38.40 | C |
| ATOM | 4789 | OD1 | ASN | C | 201 | −42.045 | −57.555 | 103.074 | 1.00 | 47.99 | O |
| ATOM | 4790 | ND2 | ASN | C | 201 | −41.203 | −59.568 | 103.557 | 1.00 | 39.32 | N |
| ATOM | 4791 | N | HIS | C | 202 | −38.630 | −60.310 | 104.893 | 1.00 | 35.27 | N |
| ATOM | 4792 | CA | HIS | C | 202 | −37.474 | −60.692 | 104.107 | 1.00 | 32.39 | C |
| ATOM | 4793 | C | HIS | C | 202 | −38.047 | −60.925 | 102.719 | 1.00 | 34.80 | C |
| ATOM | 4794 | O | HIS | C | 202 | −38.424 | −62.043 | 102.375 | 1.00 | 35.23 | O |
| ATOM | 4795 | CB | HIS | C | 202 | −36.777 | −61.922 | 104.669 | 1.00 | 29.35 | C |
| ATOM | 4796 | CG | HIS | C | 202 | −35.529 | −62.276 | 103.935 | 1.00 | 32.95 | C |
| ATOM | 4797 | ND1 | HIS | C | 202 | −35.318 | −63.520 | 103.385 | 1.00 | 37.12 | N |
| ATOM | 4798 | CD2 | HIS | C | 202 | −34.440 | −61.537 | 103.623 | 1.00 | 31.23 | C |
| ATOM | 4799 | CE1 | HIS | C | 202 | −34.145 | −63.538 | 102.778 | 1.00 | 33.20 | C |
| ATOM | 4800 | NE2 | HIS | C | 202 | −33.593 | −62.346 | 102.905 | 1.00 | 32.51 | N |
| ATOM | 4801 | N | LYS | C | 203 | −38.159 | −59.837 | 101.948 | 1.00 | 37.66 | N |
| ATOM | 4802 | CA | LYS | C | 203 | −38.635 | −59.928 | 100.569 | 1.00 | 34.00 | C |
| ATOM | 4803 | C | LYS | C | 203 | −37.907 | −60.983 | 99.750 | 1.00 | 36.61 | C |
| ATOM | 4804 | O | LYS | C | 203 | −38.585 | −61.707 | 99.002 | 1.00 | 36.77 | O |
| ATOM | 4805 | CB | LYS | C | 203 | −38.464 | −58.583 | 99.854 | 1.00 | 31.21 | C |
| ATOM | 4806 | CG | LYS | C | 203 | −39.438 | −57.458 | 100.162 | 1.00 | 39.44 | C |
| ATOM | 4807 | CD | LYS | C | 203 | −40.808 | −57.621 | 99.534 | 1.00 | 41.59 | C |
| ATOM | 4808 | CE | LYS | C | 203 | −41.815 | −56.681 | 100.199 | 1.00 | 47.06 | C |
| ATOM | 4809 | NZ | LYS | C | 203 | −41.248 | −55.297 | 100.259 | 1.00 | 45.84 | N1+ |
| ATOM | 4810 | N | PRO | C | 204 | −36.574 | −61.155 | 99.854 | 1.00 | 38.41 | N |
| ATOM | 4811 | CA | PRO | C | 204 | −35.907 | −62.124 | 98.962 | 1.00 | 33.23 | C |
| ATOM | 4812 | C | PRO | C | 204 | −36.392 | −63.552 | 99.111 | 1.00 | 37.59 | C |
| ATOM | 4813 | O | PRO | C | 204 | −36.358 | −64.297 | 98.129 | 1.00 | 44.57 | O |
| ATOM | 4814 | CB | PRO | C | 204 | −34.425 | −61.994 | 99.342 | 1.00 | 28.63 | C |
| ATOM | 4815 | CG | PRO | C | 204 | −34.306 | −60.634 | 99.898 | 1.00 | 32.37 | C |
| ATOM | 4816 | CD | PRO | C | 204 | −35.587 | −60.346 | 100.603 | 1.00 | 28.15 | C |
| ATOM | 4817 | N | SER | C | 205 | −36.857 | −63.964 | 100.287 | 1.00 | 37.25 | N |
| ATOM | 4818 | CA | SER | C | 205 | −37.381 | −65.312 | 100.469 | 1.00 | 37.14 | C |
| ATOM | 4819 | C | SER | C | 205 | −38.895 | −65.320 | 100.574 | 1.00 | 38.83 | C |
| ATOM | 4820 | O | SER | C | 205 | −39.480 | −66.367 | 100.869 | 1.00 | 37.58 | O |
| ATOM | 4821 | CB | SER | C | 205 | −36.771 | −65.963 | 101.709 | 1.00 | 34.91 | C |
| ATOM | 4822 | OG | SER | C | 205 | −37.253 | −65.348 | 102.893 | 1.00 | 33.36 | O |
| ATOM | 4823 | N | ASN | C | 206 | −39.532 | −64.173 | 100.334 | 1.00 | 40.37 | N |
| ATOM | 4824 | CA | ASN | C | 206 | −40.974 | −63.989 | 100.466 | 1.00 | 40.89 | C |
| ATOM | 4825 | C | ASN | C | 206 | −41.484 | −64.469 | 101.827 | 1.00 | 44.23 | C |
| ATOM | 4826 | O | ASN | C | 206 | −42.478 | −65.192 | 101.926 | 1.00 | 46.80 | O |
| ATOM | 4827 | CB | ASN | C | 206 | −41.703 | −64.684 | 99.332 | 1.00 | 49.25 | C |
| ATOM | 4828 | CG | ASN | C | 206 | −42.643 | −63.766 | 98.626 | 1.00 | 60.95 | C |
| ATOM | 4829 | OD1 | ASN | C | 206 | −42.272 | −63.130 | 97.632 | 1.00 | 64.04 | O |
| ATOM | 4830 | ND2 | ASN | C | 206 | −43.871 | −63.660 | 99.141 | 1.00 | 62.21 | N |
| ATOM | 4831 | N | THR | C | 207 | −40.773 | −64.069 | 102.880 | 1.00 | 37.63 | N |
| ATOM | 4832 | CA | THR | C | 207 | −41.070 | −64.446 | 104.256 | 1.00 | 33.70 | C |
| ATOM | 4833 | C | THR | C | 207 | −41.518 | −63.223 | 105.044 | 1.00 | 35.76 | C |
| ATOM | 4834 | O | THR | C | 207 | −40.806 | −62.218 | 105.096 | 1.00 | 34.16 | O |

TABLE 10.4-continued

| | | | | | | | | | | |
|---|---|---|---|---|---|---|---|---|---|---|
| ATOM | 4835 | CB | THR | C | 207 | −39.844 | −65.055 | 104.920 | 1.00 | 30.61 | C |
| ATOM | 4836 | OG1 | THR | C | 207 | −39.390 | −66.163 | 104.140 | 1.00 | 32.93 | O |
| ATOM | 4837 | CG2 | THR | C | 207 | −40.164 | −65.490 | 106.323 | 1.00 | 30.98 | C |
| ATOM | 4838 | N | LYS | C | 208 | −42.686 | −63.311 | 105.663 | 1.00 | 35.22 | N |
| ATOM | 4839 | CA | LYS | C | 208 | −43.154 | −62.277 | 106.565 | 1.00 | 31.98 | C |
| ATOM | 4840 | C | LYS | C | 208 | −43.461 | −62.906 | 107.915 | 1.00 | 33.42 | C |
| ATOM | 4841 | O | LYS | C | 208 | −44.079 | −63.966 | 107.977 | 1.00 | 34.80 | O |
| ATOM | 4842 | CB | LYS | C | 208 | −44.375 | −61.587 | 105.990 | 1.00 | 29.96 | C |
| ATOM | 4843 | CG | LYS | C | 208 | −44.038 | −60.590 | 104.902 | 1.00 | 34.70 | C |
| ATOM | 4844 | CD | LYS | C | 208 | −45.215 | −59.721 | 104.524 | 1.00 | 37.48 | C |
| ATOM | 4845 | CE | LYS | C | 208 | −46.304 | −60.544 | 103.838 | 1.00 | 44.32 | C |
| ATOM | 4846 | NZ | LYS | C | 208 | −47.529 | −59.739 | 103.513 | 1.00 | 56.22 | N1+ |
| ATOM | 4847 | N | VAL | C | 209 | −43.064 | −62.232 | 108.994 | 1.00 | 29.95 | N |
| ATOM | 4848 | CA | VAL | C | 209 | −43.234 | −62.745 | 110.348 | 1.00 | 29.28 | C |
| ATOM | 4849 | C | VAL | C | 209 | −43.711 | −61.614 | 111.255 | 1.00 | 31.89 | C |
| ATOM | 4850 | O | VAL | C | 209 | −43.177 | −60.501 | 111.209 | 1.00 | 33.86 | O |
| ATOM | 4851 | CB | VAL | C | 209 | −41.930 | −63.382 | 110.883 | 1.00 | 29.99 | C |
| ATOM | 4852 | CG1 | VAL | C | 209 | −42.024 | −63.631 | 112.364 | 1.00 | 29.51 | C |
| ATOM | 4853 | CG2 | VAL | C | 209 | −41.659 | −64.720 | 110.193 | 1.00 | 28.13 | C |
| ATOM | 4854 | N | ASP | C | 210 | −44.744 | −61.888 | 112.051 | 1.00 | 32.06 | N |
| ATOM | 4855 | CA | ASP | C | 210 | −45.187 | −61.015 | 113.137 | 1.00 | 31.18 | C |
| ATOM | 4856 | C | ASP | C | 210 | −44.963 | −61.720 | 114.466 | 1.00 | 32.54 | C |
| ATOM | 4857 | O | ASP | C | 210 | −45.627 | −62.717 | 114.749 | 1.00 | 37.02 | O |
| ATOM | 4858 | CB | ASP | C | 210 | −46.667 | −60.664 | 112.988 | 1.00 | 32.07 | C |
| ATOM | 4859 | CG | ASP | C | 210 | −46.950 | −59.774 | 111.779 | 1.00 | 38.99 | C |
| ATOM | 4860 | OD1 | ASP | C | 210 | −46.283 | −58.727 | 111.607 | 1.00 | 38.00 | O |
| ATOM | 4861 | OD2 | ASP | C | 210 | −47.851 | −60.125 | 110.993 | 1.00 | 43.24 | O1− |
| ATOM | 4862 | N | LYS | C | 211 | −44.090 | −61.171 | 115.307 | 1.00 | 28.18 | N |
| ATOM | 4863 | CA | LYS | C | 211 | −43.714 | −61.808 | 116.561 | 1.00 | 27.79 | C |
| ATOM | 4864 | C | LYS | C | 211 | −44.107 | −60.919 | 117.735 | 1.00 | 35.35 | C |
| ATOM | 4865 | O | LYS | C | 211 | −43.646 | −59.778 | 117.840 | 1.00 | 31.15 | O |
| ATOM | 4866 | CB | LYS | C | 211 | −42.214 | −62.112 | 116.591 | 1.00 | 30.51 | C |
| ATOM | 4867 | CG | LYS | C | 211 | −41.695 | −62.682 | 117.906 | 1.00 | 29.62 | C |
| ATOM | 4868 | CD | LYS | C | 211 | −42.354 | −64.008 | 118.183 | 1.00 | 35.84 | C |
| ATOM | 4869 | CE | LYS | C | 211 | −41.473 | −64.913 | 119.014 | 1.00 | 40.39 | C |
| ATOM | 4870 | NZ | LYS | C | 211 | −41.983 | −66.295 | 118.890 | 1.00 | 39.30 | N1+ |
| ATOM | 4871 | N | LYS | C | 212 | −44.971 | −61.439 | 118.608 | 1.00 | 33.29 | N |
| ATOM | 4872 | CA | LYS | C | 212 | −45.256 | −60.779 | 119.867 | 1.00 | 29.95 | C |
| ATOM | 4873 | C | LYS | C | 212 | −44.162 | −61.099 | 120.869 | 1.00 | 33.39 | C |
| ATOM | 4874 | O | LYS | C | 212 | −43.713 | −62.248 | 120.985 | 1.00 | 41.06 | O |
| ATOM | 4875 | CB | LYS | C | 212 | −46.621 | −61.213 | 120.394 | 1.00 | 33.65 | C |
| ATOM | 4876 | CG | LYS | C | 212 | −47.235 | −60.285 | 121.413 | 1.00 | 32.68 | C |
| ATOM | 4877 | CD | LYS | C | 212 | −48.491 | −60.893 | 122.040 | 1.00 | 34.32 | C |
| ATOM | 4878 | CE | LYS | C | 212 | −49.020 | −59.999 | 123.150 | 1.00 | 34.90 | C |
| ATOM | 4879 | NZ | LYS | C | 212 | −50.184 | −60.548 | 123.882 | 1.00 | 52.78 | N1+ |
| ATOM | 4880 | N | VAL | C | 213 | −43.742 | −60.078 | 121.602 | 1.00 | 29.81 | N |
| ATOM | 4881 | CA | VAL | C | 213 | −42.705 | −60.195 | 122.612 | 1.00 | 28.67 | C |
| ATOM | 4882 | C | VAL | C | 213 | −43.332 | −59.803 | 123.948 | 1.00 | 35.48 | C |
| ATOM | 4883 | O | VAL | C | 213 | −43.668 | −58.634 | 124.170 | 1.00 | 34.53 | O |
| ATOM | 4884 | CB | VAL | C | 213 | −41.493 | −59.313 | 122.281 | 1.00 | 34.29 | C |
| ATOM | 4885 | CG1 | VAL | C | 213 | −40.355 | −59.481 | 123.311 | 1.00 | 29.32 | C |
| ATOM | 4886 | CG2 | VAL | C | 213 | −41.022 | −59.563 | 120.861 | 1.00 | 28.07 | C |
| ATOM | 4887 | N | GLU | C | 214 | −43.503 | −60.781 | 124.833 | 1.00 | 43.40 | N |
| ATOM | 4888 | CA | GLU | C | 214 | −44.067 | −60.573 | 126.149 | 1.00 | 43.27 | C |
| ATOM | 4889 | C | GLU | C | 214 | −42.990 | −60.735 | 127.209 | 1.00 | 49.50 | C |
| ATOM | 4890 | O | GLU | C | 214 | −42.011 | −61.461 | 126.997 | 1.00 | 50.46 | O |
| ATOM | 4891 | CB | GLU | C | 214 | −45.206 | −61.558 | 126.434 | 1.00 | 48.02 | C |
| ATOM | 4892 | CG | GLU | C | 214 | −46.365 | −61.449 | 125.439 | 1.00 | 53.85 | C |
| ATOM | 4893 | CD | GLU | C | 214 | −47.489 | −62.450 | 125.686 | 1.00 | 57.28 | C |
| ATOM | 4894 | OE1 | GLU | C | 214 | −48.525 | −62.026 | 126.249 | 1.00 | 58.32 | O |
| ATOM | 4895 | OE2 | GLU | C | 214 | −47.343 | −63.644 | 125.318 | 1.00 | 60.40 | O1− |
| ATOM | 4896 | N | PRO | C | 215 | −43.109 | −60.039 | 128.338 | 1.00 | 50.15 | N |
| ATOM | 4897 | CA | PRO | C | 215 | −42.182 | −60.293 | 129.452 | 1.00 | 50.10 | C |
| ATOM | 4898 | C | PRO | C | 215 | −42.336 | −61.727 | 129.928 | 1.00 | 54.89 | C |
| ATOM | 4899 | O | PRO | C | 215 | −43.450 | −62.225 | 130.077 | 1.00 | 62.80 | O |
| ATOM | 4900 | CB | PRO | C | 215 | −42.606 | −59.277 | 130.515 | 1.00 | 49.74 | C |
| ATOM | 4901 | CG | PRO | C | 215 | −43.879 | −58.612 | 129.977 | 1.00 | 51.15 | C |
| ATOM | 4902 | CD | PRO | C | 215 | −43.892 | −58.805 | 128.515 | 1.00 | 47.22 | C |
| ATOM | 4903 | N | LYS | C | 216 | −41.208 | −62.402 | 130.137 | 1.00 | 59.54 | N |
| ATOM | 4904 | CA | LYS | C | 216 | −41.205 | −63.833 | 130.410 | 1.00 | 68.05 | C |
| ATOM | 4905 | C | LYS | C | 216 | −40.699 | −64.127 | 131.820 | 1.00 | 79.82 | C |
| ATOM | 4906 | O | LYS | C | 216 | −39.755 | −63.482 | 132.304 | 1.00 | 68.19 | O |
| ATOM | 4907 | CB | LYS | C | 216 | −40.371 | −64.581 | 129.359 | 1.00 | 67.81 | C |
| ATOM | 4908 | CG | LYS | C | 216 | −40.384 | −66.093 | 129.519 | 1.00 | 71.95 | C |
| ATOM | 4909 | CD | LYS | C | 216 | −39.957 | −66.793 | 128.233 | 1.00 | 73.44 | C |
| ATOM | 4910 | CE | LYS | C | 216 | −40.151 | −68.301 | 128.345 | 1.00 | 66.41 | C |
| ATOM | 4911 | NZ | LYS | C | 216 | −40.055 | −68.966 | 127.016 | 1.00 | 77.32 | N1+ |
| ATOM | 4912 | N | SER | C | 217 | −41.360 | −65.090 | 132.479 | 1.00 | 86.12 | N |
| ATOM | 4913 | CA | SER | C | 217 | −41.015 | −65.548 | 133.838 | 1.00 | 92.36 | C |
| ATOM | 4914 | C | SER | C | 217 | −40.297 | −66.901 | 133.836 | 1.00 | 83.50 | C |

TABLE 10.4-continued

| | | | | | | | | | |
|---|---|---|---|---|---|---|---|---|---|
| ATOM | 4915 | O | SER | C | 217 | −40.341 | −67.644 | 132.851 | 1.00 | 85.79 | O |
| ATOM | 4916 | CB | SER | C | 217 | −42.273 | −65.660 | 134.707 | 1.00 | 84.83 | C |
| ATOM | 4917 | OG | SER | C | 217 | −43.144 | −66.656 | 134.191 | 1.00 | 75.85 | O |
| TER | | | | | | | | | | |
| ATOM | 4918 | N | GLU | D | 1 | −2.709 | −44.362 | 88.539 | 1.00 | 46.38 | N |
| ATOM | 4919 | CA | GLU | D | 1 | −3.927 | −43.604 | 88.796 | 1.00 | 40.18 | C |
| ATOM | 4920 | C | GLU | D | 1 | −3.692 | −42.543 | 89.882 | 1.00 | 40.43 | C |
| ATOM | 4921 | O | GLU | D | 1 | −2.818 | −42.704 | 90.730 | 1.00 | 41.89 | O |
| ATOM | 4922 | CB | GLU | D | 1 | −5.056 | −44.548 | 89.205 | 1.00 | 33.14 | C |
| ATOM | 4923 | CG | GLU | D | 1 | −5.071 | −44.860 | 90.693 | 1.00 | 34.96 | C |
| ATOM | 4924 | CD | GLU | D | 1 | −6.026 | −45.981 | 91.081 | 1.00 | 47.71 | C |
| ATOM | 4925 | OE1 | GLU | D | 1 | −6.745 | −46.523 | 90.207 | 1.00 | 56.37 | O |
| ATOM | 4926 | OE2 | GLU | D | 1 | −6.060 | −46.324 | 92.281 | 1.00 | 57.65 | O1− |
| ATOM | 4927 | N | ILE | D | 2 | −4.482 | −41.470 | 89.840 | 1.00 | 35.77 | N |
| ATOM | 4928 | CA | ILE | D | 2 | −4.431 | −40.417 | 90.844 | 1.00 | 30.01 | C |
| ATOM | 4929 | C | ILE | D | 2 | −5.055 | −40.916 | 92.141 | 1.00 | 34.99 | C |
| ATOM | 4930 | O | ILE | D | 2 | −6.246 | −41.247 | 92.184 | 1.00 | 35.20 | O |
| ATOM | 4931 | CB | ILE | D | 2 | −5.147 | −39.166 | 90.336 | 1.00 | 32.58 | C |
| ATOM | 4932 | CG1 | ILE | D | 2 | −4.425 | −38.645 | 89.088 | 1.00 | 29.66 | C |
| ATOM | 4933 | CG2 | ILE | D | 2 | −5.297 | −38.133 | 91.458 | 1.00 | 29.46 | C |
| ATOM | 4934 | CD1 | ILE | D | 2 | −5.026 | −37.400 | 88.488 | 1.00 | 28.66 | C |
| ATOM | 4935 | N | VAL | D | 3 | −4.263 | −40.933 | 93.219 | 1.00 | 34.76 | N |
| ATOM | 4936 | CA | VAL | D | 3 | −4.726 | −41.369 | 94.533 | 1.00 | 30.38 | C |
| ATOM | 4937 | C | VAL | D | 3 | −5.153 | −40.143 | 95.325 | 1.00 | 31.44 | C |
| ATOM | 4938 | O | VAL | D | 3 | −4.409 | −39.155 | 95.403 | 1.00 | 31.03 | O |
| ATOM | 4939 | CB | VAL | D | 3 | −3.641 | −42.166 | 95.278 | 1.00 | 29.88 | C |
| ATOM | 4940 | CG1 | VAL | D | 3 | −4.089 | −42.450 | 96.695 | 1.00 | 25.14 | C |
| ATOM | 4941 | CG2 | VAL | D | 3 | −3.355 | −43.479 | 94.565 | 1.00 | 22.24 | C |
| ATOM | 4942 | N | LEU | D | 4 | −6.379 | −40.174 | 95.851 | 1.00 | 30.04 | N |
| ATOM | 4943 | CA | LEU | D | 4 | −6.942 | −39.055 | 96.604 | 1.00 | 28.75 | C |
| ATOM | 4944 | C | LEU | D | 4 | −7.087 | −39.490 | 98.050 | 1.00 | 29.11 | C |
| ATOM | 4945 | O | LEU | D | 4 | −7.809 | −40.450 | 98.337 | 1.00 | 37.17 | O |
| ATOM | 4946 | CB | LEU | D | 4 | −8.303 | −38.607 | 96.057 | 1.00 | 27.56 | C |
| ATOM | 4947 | CG | LEU | D | 4 | −8.478 | −38.095 | 94.619 | 1.00 | 27.56 | C |
| ATOM | 4948 | CD1 | LEU | D | 4 | −9.887 | −37.577 | 94.388 | 1.00 | 23.55 | C |
| ATOM | 4949 | CD2 | LEU | D | 4 | −7.477 | −37.038 | 94.270 | 1.00 | 27.03 | C |
| ATOM | 4950 | N | THR | D | 5 | −6.414 | −38.795 | 98.956 | 1.00 | 27.89 | N |
| ATOM | 4951 | CA | THR | D | 5 | −6.535 | −39.071 | 100.382 | 1.00 | 27.95 | C |
| ATOM | 4952 | C | THR | D | 5 | −7.291 | −37.915 | 101.020 | 1.00 | 27.80 | C |
| ATOM | 4953 | O | THR | D | 5 | −6.899 | −36.752 | 100.880 | 1.00 | 29.84 | O |
| ATOM | 4954 | CB | THR | D | 5 | −5.180 | −39.257 | 101.067 | 1.00 | 25.13 | C |
| ATOM | 4955 | OG1 | THR | D | 5 | −4.610 | −37.975 | 101.281 | 1.00 | 44.55 | O |
| ATOM | 4956 | CG2 | THR | D | 5 | −4.229 | −40.091 | 100.229 | 1.00 | 22.72 | C |
| ATOM | 4957 | N | GLN | D | 6 | −8.379 | −38.229 | 101.693 | 1.00 | 26.25 | N |
| ATOM | 4958 | CA | GLN | D | 6 | −9.154 | −37.231 | 102.401 | 1.00 | 29.68 | C |
| ATOM | 4959 | C | GLN | D | 6 | −8.770 | −37.227 | 103.870 | 1.00 | 29.42 | C |
| ATOM | 4960 | O | GLN | D | 6 | −8.596 | −38.287 | 104.475 | 1.00 | 30.59 | O |
| ATOM | 4961 | CB | GLN | D | 6 | −10.645 | −37.515 | 102.260 | 1.00 | 28.59 | C |
| ATOM | 4962 | CG | GLN | D | 6 | −11.199 | −37.068 | 100.946 | 1.00 | 26.38 | C |
| ATOM | 4963 | CD | GLN | D | 6 | −12.674 | −37.347 | 100.825 | 1.00 | 28.44 | C |
| ATOM | 4964 | OE1 | GLN | D | 6 | −13.063 | −38.310 | 100.182 | 1.00 | 30.52 | O |
| ATOM | 4965 | NE2 | GLN | D | 6 | −13.507 | −36.497 | 101.430 | 1.00 | 23.50 | N |
| ATOM | 4966 | N | SER | D | 7 | −8.646 | −36.032 | 104.442 | 1.00 | 32.95 | N |
| ATOM | 4967 | CA | SER | D | 7 | −8.474 | −35.923 | 105.893 | 1.00 | 34.15 | C |
| ATOM | 4968 | C | SER | D | 7 | −9.305 | −34.779 | 106.507 | 1.00 | 36.23 | C |
| ATOM | 4969 | O | SER | D | 7 | −9.692 | −33.818 | 105.822 | 1.00 | 34.31 | O |
| ATOM | 4970 | CB | SER | D | 7 | −7.007 | −35.732 | 106.234 | 1.00 | 32.05 | C |
| ATOM | 4971 | OG | SER | D | 7 | −6.622 | −34.406 | 105.965 | 1.00 | 36.70 | O |
| ATOM | 4972 | N | PRO | D | 8 | −9.657 | −34.917 | 107.791 | 1.00 | 35.26 | N |
| ATOM | 4973 | CA | PRO | D | 8 | −9.493 | −36.114 | 108.627 | 1.00 | 31.68 | C |
| ATOM | 4974 | C | PRO | D | 8 | −10.479 | −37.209 | 108.218 | 1.00 | 35.24 | C |
| ATOM | 4975 | O | PRO | D | 8 | −11.338 | −36.963 | 107.380 | 1.00 | 34.44 | O |
| ATOM | 4976 | CB | PRO | D | 8 | −9.812 | −35.599 | 110.022 | 1.00 | 31.95 | C |
| ATOM | 4977 | CG | PRO | D | 8 | −10.849 | −34.538 | 109.772 | 1.00 | 33.10 | C |
| ATOM | 4978 | CD | PRO | D | 8 | −10.446 | −33.874 | 108.471 | 1.00 | 32.84 | C |
| ATOM | 4979 | N | GLY | D | 9 | −10.345 | −38.409 | 108.776 | 1.00 | 36.77 | N |
| ATOM | 4980 | CA | GLY | D | 9 | −11.322 | −39.448 | 108.496 | 1.00 | 26.26 | C |
| ATOM | 4981 | C | GLY | D | 9 | −12.671 | −39.170 | 109.129 | 1.00 | 26.81 | C |
| ATOM | 4982 | O | GLY | D | 9 | −13.706 | −39.472 | 108.541 | 1.00 | 29.93 | O |
| ATOM | 4983 | N | THR | D | 10 | −12.681 | −38.619 | 110.349 | 1.00 | 29.94 | N |
| ATOM | 4984 | CA | THR | D | 10 | −13.909 | −38.207 | 111.025 | 1.00 | 29.91 | C |
| ATOM | 4985 | C | THR | D | 10 | −13.748 | −36.800 | 111.602 | 1.00 | 35.08 | C |
| ATOM | 4986 | O | THR | D | 10 | −12.672 | −36.421 | 112.072 | 1.00 | 37.12 | O |
| ATOM | 4987 | CB | THR | D | 10 | −14.324 | −39.175 | 112.138 | 1.00 | 28.55 | C |
| ATOM | 4988 | OG1 | THR | D | 10 | −14.423 | −40.503 | 111.612 | 1.00 | 29.83 | O |
| ATOM | 4989 | CG2 | THR | D | 10 | −15.682 | −38.775 | 112.712 | 1.00 | 26.70 | C |
| ATOM | 4990 | N | LEU | D | 11 | −14.823 | −36.022 | 111.527 | 1.00 | 33.72 | N |
| ATOM | 4991 | CA | LEU | D | 11 | −14.874 | −34.646 | 111.997 | 1.00 | 30.12 | C |
| ATOM | 4992 | C | LEU | D | 11 | −16.092 | −34.516 | 112.895 | 1.00 | 32.24 | C |
| ATOM | 4993 | O | LEU | D | 11 | −17.220 | −34.659 | 112.407 | 1.00 | 35.42 | O |

TABLE 10.4-continued

| | | | | | | | | | | |
|---|---|---|---|---|---|---|---|---|---|---|
| ATOM | 4994 | CB | LEU | D | 11 | −15.010 | −33.702 | 110.811 | 1.00 | 31.05 | C |
| ATOM | 4995 | CG | LEU | D | 11 | −14.043 | −32.578 | 110.566 | 1.00 | 35.03 | C |
| ATOM | 4996 | CD1 | LEU | D | 11 | −14.736 | −31.626 | 109.611 | 1.00 | 32.51 | C |
| ATOM | 4997 | CD2 | LEU | D | 11 | −13.741 | −31.926 | 111.890 | 1.00 | 32.63 | C |
| ATOM | 4998 | N | SER | D | 12 | −15.880 | −34.220 | 114.183 | 1.00 | 27.22 | N |
| ATOM | 4999 | CA | SER | D | 12 | −16.969 | −34.041 | 115.149 | 1.00 | 31.54 | C |
| ATOM | 5000 | C | SER | D | 12 | −17.136 | −32.563 | 115.466 | 1.00 | 26.28 | C |
| ATOM | 5001 | O | SER | D | 12 | −16.200 | −31.925 | 115.940 | 1.00 | 31.22 | O |
| ATOM | 5002 | CB | SER | D | 12 | −16.711 | −34.815 | 116.443 | 1.00 | 30.19 | C |
| ATOM | 5003 | OG | SER | D | 12 | −16.413 | −36.172 | 116.169 | 1.00 | 30.39 | O |
| ATOM | 5004 | N | LEU | D | 13 | −18.320 | −32.023 | 115.209 | 1.00 | 28.43 | N |
| ATOM | 5005 | CA | LEU | D | 13 | −18.535 | −30.588 | 115.335 | 1.00 | 32.40 | C |
| ATOM | 5006 | C | LEU | D | 13 | −19.965 | −30.311 | 115.779 | 1.00 | 32.08 | C |
| ATOM | 5007 | O | LEU | D | 13 | −20.889 | −31.062 | 115.463 | 1.00 | 33.15 | O |
| ATOM | 5008 | CB | LEU | D | 13 | −18.229 | −29.860 | 114.013 | 1.00 | 29.60 | C |
| ATOM | 5009 | CG | LEU | D | 13 | −16.792 | −29.909 | 113.449 | 1.00 | 31.08 | C |
| ATOM | 5010 | CD1 | LEU | D | 13 | −16.740 | −29.357 | 112.045 | 1.00 | 34.57 | C |
| ATOM | 5011 | CD2 | LEU | D | 13 | −15.818 | −29.128 | 114.313 | 1.00 | 19.13 | C |
| ATOM | 5012 | N | SER | D | 14 | −20.148 | −29.201 | 116.468 | 1.00 | 33.43 | N |
| ATOM | 5013 | CA | SER | D | 14 | −21.515 | −28.841 | 116.784 | 1.00 | 34.69 | C |
| ATOM | 5014 | C | SER | D | 14 | −22.184 | −28.181 | 115.589 | 1.00 | 30.63 | C |
| ATOM | 5015 | O | SER | D | 14 | −21.528 | −27.507 | 114.789 | 1.00 | 26.53 | O |
| ATOM | 5016 | CB | SER | D | 14 | −21.563 | −27.869 | 117.963 | 1.00 | 40.13 | C |
| ATOM | 5017 | OG | SER | D | 14 | −21.315 | −28.526 | 119.189 | 1.00 | 49.17 | O |
| ATOM | 5018 | N | PRO | D | 15 | −23.496 | −28.324 | 115.471 | 1.00 | 30.71 | N |
| ATOM | 5019 | CA | PRO | D | 15 | −24.231 | −27.513 | 114.495 | 1.00 | 30.71 | C |
| ATOM | 5020 | C | PRO | D | 15 | −23.981 | −26.030 | 114.753 | 1.00 | 33.52 | C |
| ATOM | 5021 | O | PRO | D | 15 | −23.778 | −25.598 | 115.892 | 1.00 | 30.44 | O |
| ATOM | 5022 | CB | PRO | D | 15 | −25.694 | −27.907 | 114.732 | 1.00 | 29.82 | C |
| ATOM | 5023 | CG | PRO | D | 15 | −25.633 | −29.250 | 115.357 | 1.00 | 27.19 | C |
| ATOM | 5024 | CD | PRO | D | 15 | −24.368 | −29.263 | 116.188 | 1.00 | 28.99 | C |
| ATOM | 5025 | N | GLY | D | 16 | −23.917 | −25.264 | 113.673 | 1.00 | 34.76 | N |
| ATOM | 5026 | CA | GLY | D | 16 | −23.561 | −23.872 | 113.725 | 1.00 | 30.06 | C |
| ATOM | 5027 | C | GLY | D | 16 | −22.093 | −23.615 | 113.489 | 1.00 | 32.57 | C |
| ATOM | 5028 | O | GLY | D | 16 | −21.728 | −22.532 | 113.024 | 1.00 | 34.09 | O |
| ATOM | 5029 | N | GLU | D | 17 | −21.243 | −24.599 | 113.748 | 1.00 | 30.04 | N |
| ATOM | 5030 | CA | GLU | D | 17 | −19.828 | −24.365 | 113.578 | 1.00 | 29.50 | C |
| ATOM | 5031 | C | GLU | D | 17 | −19.442 | −24.466 | 112.111 | 1.00 | 33.26 | C |
| ATOM | 5032 | O | GLU | D | 17 | −20.236 | −24.848 | 111.242 | 1.00 | 28.54 | O |
| ATOM | 5033 | CB | GLU | D | 17 | −18.997 | −25.365 | 114.370 | 1.00 | 30.61 | C |
| ATOM | 5034 | CG | GLU | D | 17 | −18.967 | −25.187 | 115.863 | 1.00 | 38.28 | C |
| ATOM | 5035 | CD | GLU | D | 17 | −17.955 | −26.152 | 116.491 | 1.00 | 47.48 | C |
| ATOM | 5036 | OE1 | GLU | D | 17 | −16.740 | −25.933 | 116.281 | 1.00 | 51.97 | O |
| ATOM | 5037 | OE2 | GLU | D | 17 | −18.365 | −27.154 | 117.143 | 1.00 | 47.45 | O1− |
| ATOM | 5038 | N | ARG | D | 18 | −18.183 | −24.132 | 111.861 | 1.00 | 33.39 | N |
| ATOM | 5039 | CA | ARG | D | 18 | −17.585 | −24.128 | 110.544 | 1.00 | 30.46 | C |
| ATOM | 5040 | C | ARG | D | 18 | −16.823 | −25.439 | 110.354 | 1.00 | 35.01 | C |
| ATOM | 5041 | O | ARG | D | 18 | −16.148 | −25.911 | 111.273 | 1.00 | 36.75 | O |
| ATOM | 5042 | CB | ARG | D | 18 | −16.673 | −22.903 | 110.427 | 1.00 | 30.90 | C |
| ATOM | 5043 | CG | ARG | D | 18 | −15.935 | −22.722 | 109.136 | 1.00 | 33.87 | C |
| ATOM | 5044 | CD | ARG | D | 18 | −14.967 | −21.575 | 109.278 | 1.00 | 28.90 | C |
| ATOM | 5045 | NE | ARG | D | 18 | −14.168 | −21.350 | 108.073 | 1.00 | 42.50 | N |
| ATOM | 5046 | CZ | ARG | D | 18 | −14.603 | −20.689 | 106.995 | 1.00 | 46.47 | C |
| ATOM | 5047 | NH1 | ARG | D | 18 | −15.851 | −20.199 | 106.968 | 1.00 | 39.59 | N1+ |
| ATOM | 5048 | NH2 | ARG | D | 18 | −13.799 | −20.529 | 105.939 | 1.00 | 36.96 | N |
| ATOM | 5049 | N | ALA | D | 19 | −16.955 | −26.046 | 109.172 | 1.00 | 33.54 | N |
| ATOM | 5050 | CA | ALA | D | 19 | −16.302 | −27.317 | 108.864 | 1.00 | 31.96 | C |
| ATOM | 5051 | C | ALA | D | 19 | −15.394 | −27.131 | 107.661 | 1.00 | 27.02 | C |
| ATOM | 5052 | O | ALA | D | 19 | −15.760 | −26.443 | 106.707 | 1.00 | 28.38 | O |
| ATOM | 5053 | CB | ALA | D | 19 | −17.319 | −28.428 | 108.564 | 1.00 | 30.29 | C |
| ATOM | 5054 | N | THR | D | 20 | −14.203 | −27.715 | 107.720 | 1.00 | 24.79 | N |
| ATOM | 5055 | CA | THR | D | 20 | −13.250 | −27.647 | 106.619 | 1.00 | 25.95 | C |
| ATOM | 5056 | C | THR | D | 20 | −12.657 | −29.031 | 106.370 | 1.00 | 28.87 | C |
| ATOM | 5057 | O | THR | D | 20 | −12.056 | −29.619 | 107.272 | 1.00 | 27.37 | O |
| ATOM | 5058 | CB | THR | D | 20 | −12.160 | −26.618 | 106.920 | 1.00 | 33.57 | C |
| ATOM | 5059 | OG1 | THR | D | 20 | −12.678 | −25.302 | 106.669 | 1.00 | 35.59 | O |
| ATOM | 5060 | CG2 | THR | D | 20 | −10.942 | −26.842 | 106.026 | 1.00 | 35.30 | C |
| ATOM | 5061 | N | LEU | D | 21 | −12.845 | −29.553 | 105.153 | 1.00 | 27.92 | N |
| ATOM | 5062 | CA | LEU | D | 21 | −12.408 | −30.885 | 104.753 | 1.00 | 21.26 | C |
| ATOM | 5063 | C | LEU | D | 21 | −11.291 | −30.788 | 103.721 | 1.00 | 27.12 | C |
| ATOM | 5064 | O | LEU | D | 21 | −11.276 | −29.891 | 102.879 | 1.00 | 25.65 | O |
| ATOM | 5065 | CB | LEU | D | 21 | −13.567 | −31.688 | 104.171 | 1.00 | 24.71 | C |
| ATOM | 5066 | CG | LEU | D | 21 | −14.800 | −31.873 | 105.044 | 1.00 | 24.88 | C |
| ATOM | 5067 | CD1 | LEU | D | 21 | −15.745 | −32.804 | 104.393 | 1.00 | 25.75 | C |
| ATOM | 5068 | CD2 | LEU | D | 21 | −14.358 | −32.453 | 106.324 | 1.00 | 26.95 | C |
| ATOM | 5069 | N | SER | D | 22 | −10.364 | −31.732 | 103.777 | 1.00 | 25.30 | N |
| ATOM | 5070 | CA | SER | D | 22 | −9.207 | −31.718 | 102.906 | 1.00 | 29.86 | C |
| ATOM | 5071 | C | SER | D | 22 | −9.228 | −32.907 | 101.960 | 1.00 | 31.55 | C |
| ATOM | 5072 | O | SER | D | 22 | −9.637 | −34.010 | 102.338 | 1.00 | 32.22 | O |
| ATOM | 5073 | CB | SER | D | 22 | −7.908 | −31.743 | 103.711 | 1.00 | 29.48 | C |

TABLE 10.4-continued

| | | | | | | | | | | |
|---|---|---|---|---|---|---|---|---|---|---|
| ATOM | 5074 | OG | SER | D | 22 | −7.484 | −30.430 | 103.983 | 1.00 | 48.01 | O |
| ATOM | 5075 | N | CYS | D | 23 | −8.748 | −32.668 | 100.743 | 1.00 | 23.08 | N |
| ATOM | 5076 | CA | CYS | D | 23 | −8.493 | −33.696 | 99.746 | 1.00 | 29.55 | C |
| ATOM | 5077 | C | CYS | D | 23 | −7.132 | −33.425 | 99.133 | 1.00 | 28.60 | C |
| ATOM | 5078 | O | CYS | D | 23 | −6.927 | −32.375 | 98.510 | 1.00 | 28.22 | O |
| ATOM | 5079 | CB | CYS | D | 23 | −9.577 | −33.692 | 98.661 | 1.00 | 32.45 | C |
| ATOM | 5080 | SG | CYS | D | 23 | −9.448 | −34.937 | 97.349 | 1.00 | 34.53 | S |
| ATOM | 5081 | N | ARG | D | 24 | −6.215 | −34.370 | 99.282 | 1.00 | 27.16 | N |
| ATOM | 5082 | CA | ARG | D | 24 | −4.896 | −34.261 | 98.682 | 1.00 | 30.26 | C |
| ATOM | 5083 | C | ARG | D | 24 | −4.755 | −35.243 | 97.517 | 1.00 | 29.93 | C |
| ATOM | 5084 | O | ARG | D | 24 | −5.021 | −36.442 | 97.663 | 1.00 | 32.04 | O |
| ATOM | 5085 | CB | ARG | D | 24 | −3.830 | −34.452 | 99.759 | 1.00 | 30.70 | C |
| ATOM | 5086 | CG | ARG | D | 24 | −3.797 | −33.212 | 100.656 | 1.00 | 40.46 | C |
| ATOM | 5087 | CD | ARG | D | 24 | −3.107 | −33.392 | 101.998 | 1.00 | 47.57 | C |
| ATOM | 5088 | NE | ARG | D | 24 | −2.760 | −32.094 | 102.596 | 1.00 | 64.41 | N |
| ATOM | 5089 | CZ | ARG | D | 24 | −3.482 | −31.436 | 103.512 | 1.00 | 65.33 | C |
| ATOM | 5090 | NH1 | ARG | D | 24 | −4.626 | −31.944 | 103.967 | 1.00 | 59.49 | N1+ |
| ATOM | 5091 | NH2 | ARG | D | 24 | −3.054 | −30.259 | 103.979 | 1.00 | 59.83 | N |
| ATOM | 5092 | N | ALA | D | 25 | −4.379 | −34.715 | 96.351 | 1.00 | 25.59 | N |
| ATOM | 5093 | CA | ALA | D | 25 | −4.224 | −35.487 | 95.126 | 1.00 | 27.28 | C |
| ATOM | 5094 | C | ALA | D | 25 | −2.745 | −35.776 | 94.882 | 1.00 | 29.22 | C |
| ATOM | 5095 | O | ALA | D | 25 | −1.914 | −34.868 | 94.943 | 1.00 | 32.95 | O |
| ATOM | 5096 | CB | ALA | D | 25 | −4.810 | −34.736 | 93.927 | 1.00 | 21.36 | C |
| ATOM | 5097 | N | SER | D | 26 | −2.428 | −37.029 | 94.593 | 1.00 | 26.23 | N |
| ATOM | 5098 | CA | SER | D | 26 | −1.100 | −37.425 | 94.171 | 1.00 | 26.45 | C |
| ATOM | 5099 | C | SER | D | 26 | −1.179 | −38.425 | 93.014 | 1.00 | 36.59 | C |
| ATOM | 5100 | O | SER | D | 26 | −1.636 | −39.568 | 93.195 | 1.00 | 38.09 | O |
| ATOM | 5101 | CB | SER | D | 26 | −0.330 | −38.048 | 95.323 | 1.00 | 31.96 | C |
| ATOM | 5102 | OG | SER | D | 26 | 0.947 | −38.468 | 94.888 | 1.00 | 40.33 | O |
| ATOM | 5103 | N | PRO | D | 27 | −0.729 | −38.019 | 91.817 | 1.00 | 33.93 | N |
| ATOM | 5104 | CA | PRO | D | 27 | −0.176 | −36.725 | 91.413 | 1.00 | 32.59 | C |
| ATOM | 5105 | C | PRO | D | 27 | −1.180 | −35.587 | 91.464 | 1.00 | 31.97 | C |
| ATOM | 5106 | O | PRO | D | 27 | −2.361 | −35.800 | 91.744 | 1.00 | 29.04 | O |
| ATOM | 5107 | CB | PRO | D | 27 | 0.255 | −36.957 | 89.967 | 1.00 | 25.77 | C |
| ATOM | 5108 | CG | PRO | D | 27 | 0.295 | −38.395 | 89.799 | 1.00 | 30.50 | C |
| ATOM | 5109 | CD | PRO | D | 27 | −0.695 | −38.986 | 90.712 | 1.00 | 33.60 | C |
| ATOM | 5110 | N | SER | D | 28 | −0.691 | −34.384 | 91.176 | 1.00 | 29.51 | N |
| ATOM | 5111 | CA | SER | D | 28 | −1.531 | −33.204 | 91.247 | 1.00 | 33.06 | C |
| ATOM | 5112 | C | SER | D | 28 | −2.689 | −33.306 | 90.258 | 1.00 | 31.21 | C |
| ATOM | 5113 | O | SER | D | 28 | −2.658 | −34.064 | 89.292 | 1.00 | 32.08 | O |
| ATOM | 5114 | CB | SER | D | 28 | −0.708 | −31.948 | 90.968 | 1.00 | 30.39 | C |
| ATOM | 5115 | OG | SER | D | 28 | 0.122 | −31.650 | 92.075 | 1.00 | 39.06 | O |
| ATOM | 5116 | N | VAL | D | 29 | −3.741 | −32.552 | 90.537 | 1.00 | 31.26 | N |
| ATOM | 5117 | CA | VAL | D | 29 | −4.834 | −32.398 | 89.589 | 1.00 | 31.02 | C |
| ATOM | 5118 | C | VAL | D | 29 | −4.828 | −30.937 | 89.154 | 1.00 | 30.74 | C |
| ATOM | 5119 | O | VAL | D | 29 | −5.671 | −30.137 | 89.581 | 1.00 | 32.15 | O |
| ATOM | 5120 | CB | VAL | D | 29 | −6.180 | −32.849 | 90.199 | 1.00 | 28.79 | C |
| ATOM | 5121 | CG1 | VAL | D | 29 | −7.331 | −32.660 | 89.220 | 1.00 | 29.57 | C |
| ATOM | 5122 | CG2 | VAL | D | 29 | −6.092 | −34.296 | 90.584 | 1.00 | 28.20 | C |
| ATOM | 5123 | N | ASN | D | 30 | −3.867 | −30.579 | 88.300 | 1.00 | 29.06 | N |
| ATOM | 5124 | CA | ASN | D | 30 | −3.706 | −29.191 | 87.881 | 1.00 | 27.78 | C |
| ATOM | 5125 | C | ASN | D | 30 | −4.829 | −28.695 | 86.974 | 1.00 | 28.98 | C |
| ATOM | 5126 | O | ASN | D | 30 | −4.903 | −27.494 | 86.715 | 1.00 | 34.22 | O |
| ATOM | 5127 | CB | ASN | D | 30 | −2.371 | −29.012 | 87.165 | 1.00 | 25.95 | C |
| ATOM | 5128 | CG | ASN | D | 30 | −1.177 | −29.247 | 88.072 | 1.00 | 29.67 | C |
| ATOM | 5129 | OD1 | ASN | D | 30 | −1.142 | −28.823 | 89.232 | 1.00 | 38.01 | O |
| ATOM | 5130 | ND2 | ASN | D | 30 | −0.188 | −29.923 | 87.546 | 1.00 | 31.76 | N |
| ATOM | 5131 | N | SER | D | 31 | −5.715 | −29.565 | 86.496 | 1.00 | 32.77 | N |
| ATOM | 5132 | CA | SER | D | 31 | −6.854 | −29.076 | 85.733 | 1.00 | 29.44 | C |
| ATOM | 5133 | C | SER | D | 31 | −7.919 | −28.456 | 86.623 | 1.00 | 29.07 | C |
| ATOM | 5134 | O | SER | D | 31 | −8.807 | −27.763 | 86.115 | 1.00 | 30.00 | O |
| ATOM | 5135 | CB | SER | D | 31 | −7.480 | −30.207 | 84.911 | 1.00 | 30.70 | C |
| ATOM | 5136 | OG | SER | D | 31 | −7.863 | −31.300 | 85.728 | 1.00 | 28.68 | O |
| ATOM | 5137 | N | GLY | D | 32 | −7.865 | −28.708 | 87.928 | 1.00 | 26.73 | N |
| ATOM | 5138 | CA | GLY | D | 32 | −8.956 | −28.326 | 88.788 | 1.00 | 24.35 | C |
| ATOM | 5139 | C | GLY | D | 32 | −10.205 | −29.141 | 88.582 | 1.00 | 28.63 | C |
| ATOM | 5140 | O | GLY | D | 32 | −11.275 | −28.720 | 89.003 | 1.00 | 23.12 | O |
| ATOM | 5141 | N | TYR | D | 33 | −10.109 | −30.294 | 87.917 | 1.00 | 28.39 | N |
| ATOM | 5142 | CA | TYR | D | 33 | −11.280 | −31.144 | 87.695 | 1.00 | 27.10 | C |
| ATOM | 5143 | C | TYR | D | 33 | −11.513 | −31.989 | 88.947 | 1.00 | 25.88 | C |
| ATOM | 5144 | O | TYR | D | 33 | −11.254 | −33.194 | 88.991 | 1.00 | 26.06 | O |
| ATOM | 5145 | CB | TYR | D | 33 | −11.095 | −32.028 | 86.468 | 1.00 | 27.24 | C |
| ATOM | 5146 | CG | TYR | D | 33 | −11.026 | −31.318 | 85.121 | 1.00 | 30.30 | C |
| ATOM | 5147 | CD1 | TYR | D | 33 | −11.355 | −29.972 | 84.977 | 1.00 | 24.29 | C |
| ATOM | 5148 | CD2 | TYR | D | 33 | −10.625 | −32.014 | 83.988 | 1.00 | 29.73 | C |
| ATOM | 5149 | CE1 | TYR | D | 33 | −11.272 | −29.351 | 83.739 | 1.00 | 29.00 | C |
| ATOM | 5150 | CE2 | TYR | D | 33 | −10.535 | −31.403 | 82.757 | 1.00 | 27.95 | C |
| ATOM | 5151 | CZ | TYR | D | 33 | −10.851 | −30.083 | 82.626 | 1.00 | 29.77 | C |
| ATOM | 5152 | OH | TYR | D | 33 | −10.753 | −29.528 | 81.366 | 1.00 | 27.33 | O |
| ATOM | 5153 | N | LEU | D | 34 | −11.990 | −31.331 | 89.993 | 1.00 | 24.59 | N |

TABLE 10.4-continued

| ATOM | 5154 | CA | LEU | D | 34 | −12.197 | −32.008 | 91.264 | 1.00 | 22.23 | C |
|------|------|-----|-----|---|----|---------|---------|--------|------|-------|---|
| ATOM | 5155 | C | LEU | D | 34 | −13.626 | −31.783 | 91.730 | 1.00 | 22.58 | C |
| ATOM | 5156 | O | LEU | D | 34 | −14.082 | −30.644 | 91.811 | 1.00 | 30.13 | O |
| ATOM | 5157 | CB | LEU | D | 34 | −11.211 | −31.517 | 92.326 | 1.00 | 22.34 | C |
| ATOM | 5158 | CG | LEU | D | 34 | −11.174 | −32.540 | 93.472 | 1.00 | 25.73 | C |
| ATOM | 5159 | CD1 | LEU | D | 34 | −9.862 | −33.273 | 93.510 | 1.00 | 24.20 | C |
| ATOM | 5160 | CD2 | LEU | D | 34 | −11.517 | −31.936 | 94.803 | 1.00 | 22.15 | C |
| ATOM | 5161 | N | ALA | D | 35 | −14.331 | −32.856 | 92.019 | 1.00 | 19.87 | N |
| ATOM | 5162 | CA | ALA | D | 35 | −15.711 | −32.778 | 92.454 | 1.00 | 21.92 | C |
| ATOM | 5163 | C | ALA | D | 35 | −15.824 | −33.191 | 93.917 | 1.00 | 23.07 | C |
| ATOM | 5164 | O | ALA | D | 35 | −14.962 | −33.884 | 94.461 | 1.00 | 19.99 | O |
| ATOM | 5165 | CB | ALA | D | 35 | −16.614 | −33.657 | 91.593 | 1.00 | 18.13 | C |
| ATOM | 5166 | N | TRP | D | 36 | −16.908 | −32.743 | 94.544 | 1.00 | 22.34 | N |
| ATOM | 5167 | CA | TRP | D | 36 | −17.251 | −33.112 | 95.911 | 1.00 | 25.99 | C |
| ATOM | 5168 | C | TRP | D | 36 | −18.673 | −33.656 | 95.941 | 1.00 | 24.08 | C |
| ATOM | 5169 | O | TRP | D | 36 | −19.573 | −33.115 | 95.291 | 1.00 | 23.80 | O |
| ATOM | 5170 | CB | TRP | D | 36 | −17.138 | −31.920 | 96.890 | 1.00 | 24.75 | C |
| ATOM | 5171 | CG | TRP | D | 36 | −15.751 | −31.504 | 97.216 | 1.00 | 23.08 | C |
| ATOM | 5172 | CD1 | TRP | D | 36 | −15.013 | −30.555 | 96.564 | 1.00 | 27.42 | C |
| ATOM | 5173 | CD2 | TRP | D | 36 | −14.917 | −32.009 | 98.268 | 1.00 | 23.07 | C |
| ATOM | 5174 | NE1 | TRP | D | 36 | −13.774 | −30.439 | 97.142 | 1.00 | 26.35 | N |
| ATOM | 5175 | CE2 | TRP | D | 36 | −13.685 | −31.316 | 98.193 | 1.00 | 26.49 | C |
| ATOM | 5176 | CE3 | TRP | D | 36 | −15.096 | −32.959 | 99.275 | 1.00 | 23.59 | C |
| ATOM | 5177 | CZ2 | TRP | D | 36 | −12.630 | −31.546 | 99.092 | 1.00 | 24.68 | C |
| ATOM | 5178 | CZ3 | TRP | D | 36 | −14.049 | −33.189 | 100.167 | 1.00 | 27.30 | C |
| ATOM | 5179 | CH2 | TRP | D | 36 | −12.829 | −32.484 | 100.064 | 1.00 | 27.81 | C |
| ATOM | 5180 | N | TYR | D | 37 | −18.861 | −34.737 | 96.689 | 1.00 | 22.56 | N |
| ATOM | 5181 | CA | TYR | D | 37 | −20.166 | −35.347 | 96.873 | 1.00 | 23.04 | C |
| ATOM | 5182 | C | TYR | D | 37 | −20.507 | −35.457 | 98.354 | 1.00 | 24.32 | C |
| ATOM | 5183 | O | TYR | D | 37 | −19.638 | −35.621 | 99.213 | 1.00 | 21.76 | O |
| ATOM | 5184 | CB | TYR | D | 37 | −20.222 | −36.732 | 96.232 | 1.00 | 22.03 | C |
| ATOM | 5185 | CG | TYR | D | 37 | −19.937 | −36.707 | 94.768 | 1.00 | 22.72 | C |
| ATOM | 5186 | CD1 | TYR | D | 37 | −18.634 | −36.802 | 94.302 | 1.00 | 19.01 | C |
| ATOM | 5187 | CD2 | TYR | D | 37 | −20.965 | −36.569 | 93.840 | 1.00 | 22.13 | C |
| ATOM | 5188 | CE1 | TYR | D | 37 | −18.355 | −36.772 | 92.962 | 1.00 | 20.66 | C |
| ATOM | 5189 | CE2 | TYR | D | 37 | −20.690 | −36.541 | 92.487 | 1.00 | 21.78 | C |
| ATOM | 5190 | CZ | TYR | D | 37 | −19.378 | −36.642 | 92.056 | 1.00 | 23.03 | C |
| ATOM | 5191 | OH | TYR | D | 37 | −19.071 | −36.606 | 90.716 | 1.00 | 26.68 | O |
| ATOM | 5192 | N | GLN | D | 38 | −21.790 | −35.368 | 98.640 | 1.00 | 24.80 | N |
| ATOM | 5193 | CA | GLN | D | 38 | −22.316 | −35.653 | 99.956 | 1.00 | 24.70 | C |
| ATOM | 5194 | C | GLN | D | 38 | −23.084 | −36.960 | 99.888 | 1.00 | 25.31 | C |
| ATOM | 5195 | O | GLN | D | 38 | −23.766 | −37.233 | 98.901 | 1.00 | 29.60 | O |
| ATOM | 5196 | CB | GLN | D | 38 | −23.231 | −34.524 | 100.429 | 1.00 | 26.48 | C |
| ATOM | 5197 | CG | GLN | D | 38 | −23.861 | −34.780 | 101.757 | 1.00 | 29.22 | C |
| ATOM | 5198 | CD | GLN | D | 38 | −24.925 | −33.785 | 102.068 | 1.00 | 32.98 | C |
| ATOM | 5199 | OE1 | GLN | D | 38 | −26.040 | −33.894 | 101.560 | 1.00 | 39.02 | O |
| ATOM | 5200 | NE2 | GLN | D | 38 | −24.591 | −32.780 | 102.888 | 1.00 | 28.25 | N |
| ATOM | 5201 | N | GLN | D | 39 | −22.956 | −37.781 | 100.916 | 1.00 | 22.53 | N |
| ATOM | 5202 | CA | GLN | D | 39 | −23.703 | −39.024 | 100.962 | 1.00 | 27.58 | C |
| ATOM | 5203 | C | GLN | D | 39 | −24.189 | −39.277 | 102.379 | 1.00 | 28.58 | C |
| ATOM | 5204 | O | GLN | D | 39 | −23.379 | −39.372 | 103.304 | 1.00 | 23.07 | O |
| ATOM | 5205 | CB | GLN | D | 39 | −22.875 | −40.207 | 100.468 | 1.00 | 26.29 | C |
| ATOM | 5206 | CG | GLN | D | 39 | −23.719 | −41.455 | 100.412 | 1.00 | 24.76 | C |
| ATOM | 5207 | CD | GLN | D | 39 | −23.000 | −42.610 | 99.847 | 1.00 | 27.83 | C |
| ATOM | 5208 | OE1 | GLN | D | 39 | −21.818 | −42.804 | 100.103 | 1.00 | 28.43 | O |
| ATOM | 5209 | NE2 | GLN | D | 39 | −23.697 | −43.390 | 99.042 | 1.00 | 31.88 | N |
| ATOM | 5210 | N | LYS | D | 40 | −25.520 | −39.390 | 102.538 | 1.00 | 28.80 | N |
| ATOM | 5211 | CA | LYS | D | 40 | −26.175 | −39.790 | 103.771 | 1.00 | 29.70 | C |
| ATOM | 5212 | C | LYS | D | 40 | −26.436 | −41.289 | 103.763 | 1.00 | 34.10 | C |
| ATOM | 5213 | O | LYS | D | 40 | −26.510 | −41.910 | 102.691 | 1.00 | 30.33 | O |
| ATOM | 5214 | CB | LYS | D | 40 | −27.478 | −39.021 | 103.946 | 1.00 | 31.38 | C |
| ATOM | 5215 | CG | LYS | D | 40 | −27.272 | −37.656 | 104.529 | 1.00 | 32.07 | C |
| ATOM | 5216 | CD | LYS | D | 40 | −28.432 | −36.768 | 104.221 | 1.00 | 42.17 | C |
| ATOM | 5217 | CE | LYS | D | 40 | −28.195 | −35.363 | 104.744 | 1.00 | 44.38 | C |
| ATOM | 5218 | NZ | LYS | D | 40 | −28.086 | −35.382 | 106.237 | 1.00 | 45.69 | N1+ |
| ATOM | 5219 | N | PRO | D | 41 | −26.551 | −41.899 | 104.951 | 1.00 | 33.47 | N |
| ATOM | 5220 | CA | PRO | D | 41 | −26.573 | −43.373 | 105.051 | 1.00 | 33.11 | C |
| ATOM | 5221 | C | PRO | D | 41 | −27.702 | −44.029 | 104.267 | 1.00 | 30.28 | C |
| ATOM | 5222 | O | PRO | D | 41 | −28.872 | −43.660 | 104.394 | 1.00 | 32.79 | O |
| ATOM | 5223 | CB | PRO | D | 41 | −26.726 | −43.612 | 106.558 | 1.00 | 34.12 | C |
| ATOM | 5224 | CG | PRO | D | 41 | −26.096 | −42.407 | 107.186 | 1.00 | 25.92 | C |
| ATOM | 5225 | CD | PRO | D | 41 | −26.471 | −41.265 | 106.280 | 1.00 | 26.33 | C |
| ATOM | 5226 | N | GLY | D | 42 | −27.342 | −45.026 | 103.460 | 1.00 | 29.14 | N |
| ATOM | 5227 | CA | GLY | D | 42 | −28.337 | −45.688 | 102.630 | 1.00 | 29.58 | C |
| ATOM | 5228 | C | GLY | D | 42 | −28.914 | −44.852 | 101.497 | 1.00 | 36.52 | C |
| ATOM | 5229 | O | GLY | D | 42 | −29.956 | −45.213 | 100.952 | 1.00 | 36.30 | O |
| ATOM | 5230 | N | GLN | D | 43 | −28.242 | −43.771 | 101.092 | 1.00 | 32.91 | N |
| ATOM | 5231 | CA | GLN | D | 43 | −28.685 | −42.898 | 100.016 | 1.00 | 27.04 | C |
| ATOM | 5232 | C | GLN | D | 43 | −27.619 | −42.825 | 98.930 | 1.00 | 27.93 | C |
| ATOM | 5233 | O | GLN | D | 43 | −26.452 | −43.162 | 99.153 | 1.00 | 27.99 | O |

TABLE 10.4-continued

| | | | | | | | | | | |
|---|---|---|---|---|---|---|---|---|---|---|
| ATOM | 5234 | CB | GLN | D | 43 | −28.952 | −41.481 | 100.523 | 1.00 | 30.13 | C |
| ATOM | 5235 | CG | GLN | D | 43 | −29.659 | −41.422 | 101.838 | 1.00 | 33.40 | C |
| ATOM | 5236 | CD | GLN | D | 43 | −31.073 | −41.941 | 101.754 | 1.00 | 45.27 | C |
| ATOM | 5237 | OE1 | GLN | D | 43 | −31.760 | −41.731 | 100.750 | 1.00 | 42.82 | O |
| ATOM | 5238 | NE2 | GLN | D | 43 | −31.511 | −42.665 | 102.800 | 1.00 | 44.71 | N |
| ATOM | 5239 | N | THR | D | 44 | −28.032 | −42.367 | 97.742 | 1.00 | 25.68 | N |
| ATOM | 5240 | CA | THR | D | 44 | −27.045 | −42.187 | 96.692 | 1.00 | 30.33 | C |
| ATOM | 5241 | C | THR | D | 44 | −26.306 | −40.848 | 96.866 | 1.00 | 30.71 | C |
| ATOM | 5242 | O | THR | D | 44 | −26.834 | −39.904 | 97.464 | 1.00 | 26.05 | O |
| ATOM | 5243 | CB | THR | D | 44 | −27.702 | −42.278 | 95.303 | 1.00 | 28.63 | C |
| ATOM | 5244 | OG1 | THR | D | 44 | −28.240 | −41.013 | 94.924 | 1.00 | 32.11 | O |
| ATOM | 5245 | CG2 | THR | D | 44 | −28.834 | −43.319 | 95.292 | 1.00 | 29.12 | C |
| ATOM | 5246 | N | PRO | D | 45 | −25.070 | −40.756 | 96.375 | 1.00 | 25.93 | N |
| ATOM | 5247 | CA | PRO | D | 45 | −24.312 | −39.512 | 96.515 | 1.00 | 25.74 | C |
| ATOM | 5248 | C | PRO | D | 45 | −24.977 | −38.343 | 95.801 | 1.00 | 24.98 | C |
| ATOM | 5249 | O | PRO | D | 45 | −25.616 | −38.493 | 94.761 | 1.00 | 23.19 | O |
| ATOM | 5250 | CB | PRO | D | 45 | −22.962 | −39.857 | 95.878 | 1.00 | 28.44 | C |
| ATOM | 5251 | CG | PRO | D | 45 | −22.886 | −41.342 | 95.963 | 1.00 | 23.47 | C |
| ATOM | 5252 | CD | PRO | D | 45 | −24.265 | −41.820 | 95.764 | 1.00 | 23.77 | C |
| ATOM | 5253 | N | ARG | D | 46 | −24.812 | −37.163 | 96.382 | 1.00 | 28.06 | N |
| ATOM | 5254 | CA | ARG | D | 46 | −25.306 | −35.910 | 95.824 | 1.00 | 26.21 | C |
| ATOM | 5255 | C | ARG | D | 46 | −24.120 | −35.028 | 95.449 | 1.00 | 27.60 | C |
| ATOM | 5256 | O | ARG | D | 46 | −23.212 | −34.814 | 96.265 | 1.00 | 24.95 | O |
| ATOM | 5257 | CB | ARG | D | 46 | −26.203 | −35.199 | 96.836 | 1.00 | 28.93 | C |
| ATOM | 5258 | CG | ARG | D | 46 | −26.747 | −33.885 | 96.372 | 1.00 | 35.19 | C |
| ATOM | 5259 | CD | ARG | D | 46 | −28.129 | −33.660 | 96.926 | 1.00 | 42.94 | C |
| ATOM | 5260 | NE | ARG | D | 46 | −28.813 | −32.616 | 96.172 | 1.00 | 54.78 | N |
| ATOM | 5261 | CZ | ARG | D | 46 | −28.994 | −31.379 | 96.619 | 1.00 | 62.11 | C |
| ATOM | 5262 | NH1 | ARG | D | 46 | −29.621 | −30.481 | 95.858 | 1.00 | 53.78 | N1+ |
| ATOM | 5263 | NH2 | ARG | D | 46 | −28.553 | −31.045 | 97.837 | 1.00 | 63.79 | N |
| ATOM | 5264 | N | LEU | D | 47 | −24.116 | −34.535 | 94.216 | 1.00 | 26.63 | N |
| ATOM | 5265 | CA | LEU | D | 47 | −23.029 | −33.680 | 93.772 | 1.00 | 24.56 | C |
| ATOM | 5266 | C | LEU | D | 47 | −23.125 | −32.333 | 94.474 | 1.00 | 23.50 | C |
| ATOM | 5267 | O | LEU | D | 47 | −24.201 | −31.746 | 94.529 | 1.00 | 28.69 | O |
| ATOM | 5268 | CB | LEU | D | 47 | −23.083 | −33.508 | 92.264 | 1.00 | 21.59 | C |
| ATOM | 5269 | CG | LEU | D | 47 | −22.042 | −32.542 | 91.689 | 1.00 | 28.11 | C |
| ATOM | 5270 | CD1 | LEU | D | 47 | −20.587 | −33.047 | 91.831 | 1.00 | 23.37 | C |
| ATOM | 5271 | CD2 | LEU | D | 47 | −22.396 | −32.293 | 90.251 | 1.00 | 26.58 | C |
| ATOM | 5272 | N | LEU | D | 48 | −22.020 | −31.872 | 95.064 | 1.00 | 25.20 | N |
| ATOM | 5273 | CA | LEU | D | 48 | −21.967 | −30.576 | 95.756 | 1.00 | 29.85 | C |
| ATOM | 5274 | C | LEU | D | 48 | −21.153 | −29.530 | 95.021 | 1.00 | 28.28 | C |
| ATOM | 5275 | O | LEU | D | 48 | −21.553 | −28.371 | 94.962 | 1.00 | 26.16 | O |
| ATOM | 5276 | CB | LEU | D | 48 | −21.354 | −30.705 | 97.156 | 1.00 | 24.38 | C |
| ATOM | 5277 | CG | LEU | D | 48 | −22.032 | −31.429 | 98.300 | 1.00 | 29.64 | C |
| ATOM | 5278 | CD1 | LEU | D | 48 | −21.124 | −31.235 | 99.476 | 1.00 | 28.92 | C |
| ATOM | 5279 | CD2 | LEU | D | 48 | −23.421 | −30.868 | 98.604 | 1.00 | 30.54 | C |
| ATOM | 5280 | N | ILE | D | 49 | −19.998 | −29.933 | 94.505 | 1.00 | 24.89 | N |
| ATOM | 5281 | CA | ILE | D | 49 | −19.008 | −29.059 | 93.903 | 1.00 | 25.06 | C |
| ATOM | 5282 | C | ILE | D | 49 | −18.484 | −29.781 | 92.672 | 1.00 | 28.83 | C |
| ATOM | 5283 | O | ILE | D | 49 | −18.212 | −30.986 | 92.726 | 1.00 | 25.60 | O |
| ATOM | 5284 | CB | ILE | D | 49 | −17.833 | −28.787 | 94.879 | 1.00 | 27.73 | C |
| ATOM | 5285 | CG1 | ILE | D | 49 | −18.307 | −28.181 | 96.214 | 1.00 | 22.96 | C |
| ATOM | 5286 | CG2 | ILE | D | 49 | −16.678 | −28.055 | 94.176 | 1.00 | 21.77 | C |
| ATOM | 5287 | CD1 | ILE | D | 49 | −18.656 | −26.704 | 96.180 | 1.00 | 28.66 | C |
| ATOM | 5288 | N | PHE | D | 50 | −18.308 | −29.049 | 91.573 | 1.00 | 25.66 | N |
| ATOM | 5289 | CA | PHE | D | 50 | −17.533 | −29.563 | 90.460 | 1.00 | 23.52 | C |
| ATOM | 5290 | C | PHE | D | 50 | −16.420 | −28.576 | 90.149 | 1.00 | 30.77 | C |
| ATOM | 5291 | O | PHE | D | 50 | −16.505 | −27.377 | 90.451 | 1.00 | 26.94 | O |
| ATOM | 5292 | CB | PHE | D | 50 | −18.381 | −29.861 | 89.202 | 1.00 | 25.10 | C |
| ATOM | 5293 | CG | PHE | D | 50 | −19.084 | −28.669 | 88.645 | 1.00 | 29.89 | C |
| ATOM | 5294 | CD2 | PHE | D | 50 | −20.394 | −28.380 | 89.034 | 1.00 | 28.85 | C |
| ATOM | 5295 | CD1 | PHE | D | 50 | −18.460 | −27.848 | 87.720 | 1.00 | 26.32 | C |
| ATOM | 5296 | CE2 | PHE | D | 50 | −21.038 | −27.263 | 88.538 | 1.00 | 33.45 | C |
| ATOM | 5297 | CE1 | PHE | D | 50 | −19.111 | −26.747 | 87.212 | 1.00 | 31.34 | C |
| ATOM | 5298 | CZ | PHE | D | 50 | −20.412 | −26.457 | 87.616 | 1.00 | 33.07 | C |
| ATOM | 5299 | N | GLY | D | 51 | −15.381 | −29.125 | 89.536 | 1.00 | 29.64 | N |
| ATOM | 5300 | CA | GLY | D | 51 | −14.110 | −28.473 | 89.344 | 1.00 | 31.07 | C |
| ATOM | 5301 | C | GLY | D | 51 | −13.912 | −27.013 | 89.635 | 1.00 | 29.90 | C |
| ATOM | 5302 | O | GLY | D | 51 | −14.299 | −26.190 | 88.823 | 1.00 | 41.98 | O |
| ATOM | 5303 | N | ALA | D | 52 | −13.331 | −26.633 | 90.761 | 1.00 | 29.04 | N |
| ATOM | 5304 | CA | ALA | D | 52 | −13.045 | −27.404 | 91.963 | 1.00 | 27.42 | C |
| ATOM | 5305 | C | ALA | D | 52 | −13.634 | −26.483 | 93.033 | 1.00 | 31.29 | C |
| ATOM | 5306 | O | ALA | D | 52 | −13.389 | −26.630 | 94.242 | 1.00 | 26.21 | O |
| ATOM | 5307 | CB | ALA | D | 52 | −11.545 | −27.613 | 92.180 | 1.00 | 24.46 | C |
| ATOM | 5308 | N | SER | D | 53 | −14.356 | −25.473 | 92.528 | 1.00 | 25.45 | N |
| ATOM | 5309 | CA | SER | D | 53 | −14.951 | −24.408 | 93.321 | 1.00 | 29.64 | C |
| ATOM | 5310 | C | SER | D | 53 | −16.366 | −24.061 | 92.909 | 1.00 | 29.31 | C |
| ATOM | 5311 | O | SER | D | 53 | −17.001 | −23.251 | 93.595 | 1.00 | 29.52 | O |
| ATOM | 5312 | CB | SER | D | 53 | −14.102 | −23.144 | 93.229 | 1.00 | 24.22 | C |
| ATOM | 5313 | OG | SER | D | 53 | −13.751 | −22.931 | 91.878 | 1.00 | 30.08 | O |

TABLE 10.4-continued

| | | | | | | | | | | |
|---|---|---|---|---|---|---|---|---|---|---|
| ATOM | 5314 | N | SER | D | 54 | −16.872 | −24.618 | 91.819 | 1.00 | 24.59 | N |
| ATOM | 5315 | CA | SER | D | 54 | −18.183 | −24.249 | 91.320 | 1.00 | 28.33 | C |
| ATOM | 5316 | C | SER | D | 54 | −19.261 | −25.017 | 92.073 | 1.00 | 29.42 | C |
| ATOM | 5317 | O | SER | D | 54 | −19.261 | −26.252 | 92.107 | 1.00 | 28.83 | O |
| ATOM | 5318 | CB | SER | D | 54 | −18.294 | −24.510 | 89.818 | 1.00 | 30.14 | C |
| ATOM | 5319 | OG | SER | D | 54 | −17.503 | −23.611 | 89.086 | 1.00 | 31.63 | O |
| ATOM | 5320 | N | ARG | D | 55 | −20.185 | −24.274 | 92.653 | 1.00 | 26.56 | N |
| ATOM | 5321 | CA | ARG | D | 55 | −21.342 | −24.858 | 93.293 | 1.00 | 26.99 | C |
| ATOM | 5322 | C | ARG | D | 55 | −22.293 | −25.465 | 92.261 | 1.00 | 31.42 | C |
| ATOM | 5323 | O | ARG | D | 55 | −22.594 | −24.854 | 91.230 | 1.00 | 34.25 | O |
| ATOM | 5324 | CB | ARG | D | 55 | −22.033 | −23.773 | 94.100 | 1.00 | 31.93 | C |
| ATOM | 5325 | CG | ARG | D | 55 | −22.782 | −24.249 | 95.296 | 1.00 | 39.96 | C |
| ATOM | 5326 | CD | ARG | D | 55 | −23.378 | −23.054 | 96.043 | 1.00 | 42.71 | C |
| ATOM | 5327 | NE | ARG | D | 55 | −22.393 | −22.357 | 96.853 | 1.00 | 39.62 | N |
| ATOM | 5328 | CZ | ARG | D | 55 | −21.943 | −21.142 | 96.574 | 1.00 | 42.81 | C |
| ATOM | 5329 | NH1 | ARG | D | 55 | −21.042 | −20.564 | 97.367 | 1.00 | 46.41 | N1+ |
| ATOM | 5330 | NH2 | ARG | D | 55 | −22.396 | −20.516 | 95.497 | 1.00 | 41.95 | N |
| ATOM | 5331 | N | ALA | D | 56 | −22.783 | −26.668 | 92.562 | 1.00 | 29.25 | N |
| ATOM | 5332 | CA | ALA | D | 56 | −23.814 | −27.344 | 91.783 | 1.00 | 34.27 | C |
| ATOM | 5333 | C | ALA | D | 56 | −25.176 | −26.678 | 91.997 | 1.00 | 36.12 | C |
| ATOM | 5334 | O | ALA | D | 56 | −25.355 | −25.830 | 92.877 | 1.00 | 36.11 | O |
| ATOM | 5335 | CB | ALA | D | 56 | −23.891 | −28.823 | 92.166 | 1.00 | 31.23 | C |
| ATOM | 5336 | N | THR | D | 57 | −26.154 | −27.081 | 91.184 | 1.00 | 36.05 | N |
| ATOM | 5337 | CA | THR | D | 57 | −27.475 | −26.471 | 91.274 | 1.00 | 46.10 | C |
| ATOM | 5338 | C | THR | D | 57 | −28.178 | −26.905 | 92.546 | 1.00 | 41.98 | C |
| ATOM | 5339 | O | THR | D | 57 | −28.091 | −28.063 | 92.960 | 1.00 | 44.69 | O |
| ATOM | 5340 | CB | THR | D | 57 | −28.345 | −26.861 | 90.081 | 1.00 | 48.23 | C |
| ATOM | 5341 | OG1 | THR | D | 57 | −27.504 | −27.188 | 88.968 | 1.00 | 51.51 | O |
| ATOM | 5342 | CG2 | THR | D | 57 | −29.281 | −25.707 | 89.713 | 1.00 | 39.36 | C |
| ATOM | 5343 | N | GLY | D | 58 | −28.898 | −25.966 | 93.148 | 1.00 | 36.11 | N |
| ATOM | 5344 | CA | GLY | D | 58 | −29.589 | −26.198 | 94.396 | 1.00 | 36.25 | C |
| ATOM | 5345 | C | GLY | D | 58 | −28.722 | −26.367 | 95.629 | 1.00 | 35.95 | C |
| ATOM | 5346 | O | GLY | D | 58 | −29.266 | −26.615 | 96.706 | 1.00 | 46.21 | O |
| ATOM | 5347 | N | ILE | D | 59 | −27.406 | −26.270 | 95.526 | 1.00 | 35.23 | N |
| ATOM | 5348 | CA | ILE | D | 59 | −26.552 | −26.443 | 96.707 | 1.00 | 37.35 | C |
| ATOM | 5349 | C | ILE | D | 59 | −26.499 | −25.124 | 97.480 | 1.00 | 32.79 | C |
| ATOM | 5350 | O | ILE | D | 59 | −26.110 | −24.102 | 96.902 | 1.00 | 34.26 | O |
| ATOM | 5351 | CB | ILE | D | 59 | −25.147 | −26.884 | 96.291 | 1.00 | 34.60 | C |
| ATOM | 5352 | CG1 | ILE | D | 59 | −25.150 | −28.289 | 95.658 | 1.00 | 33.46 | C |
| ATOM | 5353 | CG2 | ILE | D | 59 | −24.257 | −26.892 | 97.511 | 1.00 | 28.92 | C |
| ATOM | 5354 | CD1 | ILE | D | 59 | −25.990 | −29.321 | 96.371 | 1.00 | 33.20 | C |
| ATOM | 5355 | N | PRO | D | 60 | −26.822 | −25.098 | 98.776 | 1.00 | 35.94 | N |
| ATOM | 5356 | CA | PRO | D | 60 | −26.753 | −23.831 | 99.528 | 1.00 | 36.87 | C |
| ATOM | 5357 | C | PRO | D | 60 | −25.384 | −23.165 | 99.443 | 1.00 | 39.65 | C |
| ATOM | 5358 | O | PRO | D | 60 | −24.357 | −23.825 | 99.258 | 1.00 | 40.06 | O |
| ATOM | 5359 | CB | PRO | D | 60 | −27.068 | −24.261 | 100.967 | 1.00 | 39.32 | C |
| ATOM | 5360 | CG | PRO | D | 60 | −27.875 | −25.486 | 100.816 | 1.00 | 40.27 | C |
| ATOM | 5361 | CD | PRO | D | 60 | −27.346 | −26.199 | 99.601 | 1.00 | 37.18 | C |
| ATOM | 5362 | N | ASP | D | 61 | −25.355 | −21.841 | 99.615 | 1.00 | 37.82 | N |
| ATOM | 5363 | CA | ASP | D | 61 | −24.047 | −21.197 | 99.529 | 1.00 | 38.85 | C |
| ATOM | 5364 | C | ASP | D | 61 | −23.271 | −21.286 | 100.830 | 1.00 | 38.37 | C |
| ATOM | 5365 | O | ASP | D | 61 | −22.161 | −20.757 | 100.895 | 1.00 | 43.54 | O |
| ATOM | 5366 | CB | ASP | D | 61 | −24.153 | −19.736 | 99.070 | 1.00 | 39.37 | C |
| ATOM | 5367 | CG | ASP | D | 61 | −25.124 | −18.914 | 99.898 | 1.00 | 54.57 | C |
| ATOM | 5368 | OD1 | ASP | D | 61 | −25.360 | −19.253 | 101.082 | 1.00 | 61.72 | O |
| ATOM | 5369 | OD2 | ASP | D | 61 | −25.635 | −17.901 | 99.363 | 1.00 | 51.55 | O1− |
| ATOM | 5370 | N | ARG | D | 62 | −23.833 | −21.947 | 101.850 | 1.00 | 39.40 | N |
| ATOM | 5371 | CA | ARG | D | 62 | −23.032 | −22.496 | 102.939 | 1.00 | 36.54 | C |
| ATOM | 5372 | C | ARG | D | 62 | −21.805 | −23.229 | 102.414 | 1.00 | 34.81 | C |
| ATOM | 5373 | O | ARG | D | 62 | −20.738 | −23.199 | 103.037 | 1.00 | 31.24 | O |
| ATOM | 5374 | CB | ARG | D | 62 | −23.837 | −23.511 | 103.745 | 1.00 | 37.64 | C |
| ATOM | 5375 | CG | ARG | D | 62 | −25.054 | −23.076 | 104.366 | 1.00 | 36.64 | C |
| ATOM | 5376 | CD | ARG | D | 62 | −25.298 | −24.006 | 105.536 | 1.00 | 40.91 | C |
| ATOM | 5377 | NE | ARG | D | 62 | −25.716 | −25.370 | 105.214 | 1.00 | 38.63 | N |
| ATOM | 5378 | CZ | ARG | D | 62 | −26.848 | −25.692 | 104.593 | 1.00 | 43.76 | C |
| ATOM | 5379 | NH1 | ARG | D | 62 | −27.662 | −24.743 | 104.160 | 1.00 | 45.94 | N1+ |
| ATOM | 5380 | NH2 | ARG | D | 62 | −27.159 | −26.964 | 104.383 | 1.00 | 41.39 | N |
| ATOM | 5381 | N | PHE | D | 63 | −21.980 | −23.979 | 101.323 | 1.00 | 34.78 | N |
| ATOM | 5382 | CA | PHE | D | 63 | −20.936 | −24.809 | 100.738 | 1.00 | 34.76 | C |
| ATOM | 5383 | C | PHE | D | 63 | −20.101 | −23.966 | 99.797 | 1.00 | 32.41 | C |
| ATOM | 5384 | O | PHE | D | 63 | −20.646 | −23.271 | 98.933 | 1.00 | 35.79 | O |
| ATOM | 5385 | CB | PHE | D | 63 | −21.536 | −26.013 | 99.992 | 1.00 | 29.42 | C |
| ATOM | 5386 | CG | PHE | D | 63 | −22.210 | −27.001 | 100.898 | 1.00 | 28.36 | C |
| ATOM | 5387 | CD1 | PHE | D | 63 | −23.504 | −26.790 | 101.344 | 1.00 | 31.54 | C |
| ATOM | 5388 | CD2 | PHE | D | 63 | −21.537 | −28.120 | 101.336 | 1.00 | 28.75 | C |
| ATOM | 5389 | CE1 | PHE | D | 63 | −24.117 | −27.686 | 102.190 | 1.00 | 29.90 | C |
| ATOM | 5390 | CE2 | PHE | D | 63 | −22.149 | −29.017 | 102.180 | 1.00 | 31.42 | C |
| ATOM | 5391 | CZ | PHE | D | 63 | −23.441 | −28.796 | 102.611 | 1.00 | 27.00 | C |
| ATOM | 5392 | N | SER | D | 64 | −18.783 | −24.021 | 99.986 | 1.00 | 32.03 | N |
| ATOM | 5393 | CA | SER | D | 64 | −17.815 | −23.408 | 99.081 | 1.00 | 33.91 | C |

TABLE 10.4-continued

| ATOM | 5394 | C | SER | D | 64 | −16.566 | −24.279 | 99.051 | 1.00 | 26.96 | C |
|---|---|---|---|---|---|---|---|---|---|---|---|
| ATOM | 5395 | O | SER | D | 64 | −16.345 | −25.111 | 99.934 | 1.00 | 29.99 | O |
| ATOM | 5396 | CB | SER | D | 64 | −17.482 | −21.975 | 99.511 | 1.00 | 31.16 | C |
| ATOM | 5397 | OG | SER | D | 64 | −16.576 | −21.995 | 100.592 | 1.00 | 35.76 | O |
| ATOM | 5398 | N | ALA | D | 65 | −15.766 | −24.128 | 98.007 | 1.00 | 21.94 | N |
| ATOM | 5399 | CA | ALA | D | 65 | −14.588 | −24.982 | 97.928 | 1.00 | 27.79 | C |
| ATOM | 5400 | C | ALA | D | 65 | −13.547 | −24.302 | 97.063 | 1.00 | 28.20 | C |
| ATOM | 5401 | O | ALA | D | 65 | −13.859 | −23.392 | 96.297 | 1.00 | 28.35 | O |
| ATOM | 5402 | CB | ALA | D | 65 | −14.930 | −26.370 | 97.382 | 1.00 | 26.70 | C |
| ATOM | 5403 | N | SER | D | 66 | −12.305 | −24.767 | 97.185 | 1.00 | 31.90 | N |
| ATOM | 5404 | CA | SER | D | 66 | −11.196 | −24.189 | 96.432 | 1.00 | 32.71 | C |
| ATOM | 5405 | C | SER | D | 66 | −10.001 | −25.141 | 96.468 | 1.00 | 32.60 | C |
| ATOM | 5406 | O | SER | D | 66 | −10.005 | −26.170 | 97.149 | 1.00 | 34.80 | O |
| ATOM | 5407 | CB | SER | D | 66 | −10.787 | −22.831 | 97.003 | 1.00 | 27.36 | C |
| ATOM | 5408 | OG | SER | D | 66 | −10.156 | −23.031 | 98.253 | 1.00 | 32.54 | O |
| ATOM | 5409 | N | GLY | D | 67 | −8.948 | −24.745 | 95.780 | 1.00 | 31.68 | N |
| ATOM | 5410 | CA | GLY | D | 67 | −7.719 | −25.498 | 95.795 | 1.00 | 28.89 | C |
| ATOM | 5411 | C | GLY | D | 67 | −7.316 | −25.711 | 94.364 | 1.00 | 38.37 | C |
| ATOM | 5412 | O | GLY | D | 67 | −8.135 | −25.485 | 93.466 | 1.00 | 39.57 | O |
| ATOM | 5413 | N | SER | D | 68 | −6.057 | −26.066 | 94.125 | 1.00 | 36.68 | N |
| ATOM | 5414 | CA | SER | D | 68 | −5.677 | −26.559 | 92.813 | 1.00 | 36.53 | C |
| ATOM | 5415 | C | SER | D | 68 | −4.366 | −27.296 | 92.959 | 1.00 | 30.07 | C |
| ATOM | 5416 | O | SER | D | 68 | −3.660 | −27.148 | 93.952 | 1.00 | 38.18 | O |
| ATOM | 5417 | CB | SER | D | 68 | −5.559 | −25.449 | 91.757 | 1.00 | 44.96 | C |
| ATOM | 5418 | OG | SER | D | 68 | −5.439 | −26.014 | 90.444 | 1.00 | 48.06 | O |
| ATOM | 5419 | N | GLY | D | 69 | −4.062 | −28.097 | 91.954 | 1.00 | 29.21 | N |
| ATOM | 5420 | CA | GLY | D | 69 | −2.896 | −28.929 | 91.987 | 1.00 | 29.40 | C |
| ATOM | 5421 | C | GLY | D | 69 | −3.069 | −30.067 | 92.949 | 1.00 | 31.99 | C |
| ATOM | 5422 | O | GLY | D | 69 | −3.815 | −31.018 | 92.687 | 1.00 | 33.63 | O |
| ATOM | 5423 | N | ALA | D | 70 | −2.379 | −29.966 | 94.080 | 1.00 | 31.64 | N |
| ATOM | 5424 | CA | ALA | D | 70 | −2.287 | −31.065 | 95.022 | 1.00 | 31.80 | C |
| ATOM | 5425 | C | ALA | D | 70 | −3.275 | −30.980 | 96.171 | 1.00 | 31.37 | C |
| ATOM | 5426 | O | ALA | D | 70 | −3.550 | −32.008 | 96.792 | 1.00 | 36.24 | O |
| ATOM | 5427 | CB | ALA | D | 70 | −0.868 | −31.140 | 95.594 | 1.00 | 28.13 | C |
| ATOM | 5428 | N | ASP | D | 71 | −3.817 | −29.803 | 96.471 | 1.00 | 30.57 | N |
| ATOM | 5429 | CA | ASP | D | 71 | −4.565 | −29.587 | 97.706 | 1.00 | 33.18 | C |
| ATOM | 5430 | C | ASP | D | 71 | −5.945 | −29.009 | 97.415 | 1.00 | 32.16 | C |
| ATOM | 5431 | O | ASP | D | 71 | −6.063 | −27.965 | 96.768 | 1.00 | 31.72 | O |
| ATOM | 5432 | CB | ASP | D | 71 | −3.800 | −28.638 | 98.622 | 1.00 | 31.72 | C |
| ATOM | 5433 | CG | ASP | D | 71 | −2.722 | −29.331 | 99.396 | 1.00 | 47.35 | C |
| ATOM | 5434 | OD1 | ASP | D | 71 | −3.025 | −30.000 | 100.408 | 1.00 | 54.93 | O |
| ATOM | 5435 | OD2 | ASP | D | 71 | −1.553 | −29.211 | 98.980 | 1.00 | 57.78 | O1− |
| ATOM | 5436 | N | PHE | D | 72 | −6.981 | −29.643 | 97.939 | 1.00 | 28.95 | N |
| ATOM | 5437 | CA | PHE | D | 72 | −8.335 | −29.145 | 97.771 | 1.00 | 25.33 | C |
| ATOM | 5438 | C | PHE | D | 72 | −8.994 | −29.122 | 99.135 | 1.00 | 24.96 | C |
| ATOM | 5439 | O | PHE | D | 72 | −8.687 | −29.939 | 100.005 | 1.00 | 21.64 | O |
| ATOM | 5440 | CB | PHE | D | 72 | −9.121 | −30.008 | 96.781 | 1.00 | 26.11 | C |
| ATOM | 5441 | CG | PHE | D | 72 | −8.492 | −30.051 | 95.425 | 1.00 | 30.35 | C |
| ATOM | 5442 | CD1 | PHE | D | 72 | −7.479 | −30.982 | 95.144 | 1.00 | 29.20 | C |
| ATOM | 5443 | CD2 | PHE | D | 72 | −8.862 | −29.139 | 94.444 | 1.00 | 27.20 | C |
| ATOM | 5444 | CE1 | PHE | D | 72 | −6.862 | −31.014 | 93.898 | 1.00 | 31.22 | C |
| ATOM | 5445 | CE2 | PHE | D | 72 | −8.250 | −29.161 | 93.189 | 1.00 | 30.03 | C |
| ATOM | 5446 | CZ | PHE | D | 72 | −7.251 | −30.105 | 92.913 | 1.00 | 29.83 | C |
| ATOM | 5447 | N | THR | D | 73 | −9.842 | −28.133 | 99.354 | 1.00 | 23.98 | N |
| ATOM | 5448 | CA | THR | D | 73 | −10.593 | −28.118 | 100.589 | 1.00 | 27.63 | C |
| ATOM | 5449 | C | THR | D | 73 | −12.045 | −27.791 | 100.275 | 1.00 | 28.02 | C |
| ATOM | 5450 | O | THR | D | 73 | −12.363 | −27.129 | 99.275 | 1.00 | 25.48 | O |
| ATOM | 5451 | CB | THR | D | 73 | −9.993 | −27.156 | 101.661 | 1.00 | 32.96 | C |
| ATOM | 5452 | OG1 | THR | D | 73 | −10.611 | −25.872 | 101.585 | 1.00 | 38.47 | O |
| ATOM | 5453 | CG2 | THR | D | 73 | −8.473 | −26.987 | 101.511 | 1.00 | 24.84 | C |
| ATOM | 5454 | N | LEU | D | 74 | −12.926 | −28.368 | 101.090 | 1.00 | 30.82 | N |
| ATOM | 5455 | CA | LEU | D | 74 | −14.351 | −28.062 | 101.114 | 1.00 | 26.16 | C |
| ATOM | 5456 | C | LEU | D | 74 | −14.662 | −27.367 | 102.433 | 1.00 | 27.40 | C |
| ATOM | 5457 | O | LEU | D | 74 | −14.247 | −27.843 | 103.499 | 1.00 | 27.12 | O |
| ATOM | 5458 | CB | LEU | D | 74 | −15.184 | −29.336 | 100.953 | 1.00 | 21.42 | C |
| ATOM | 5459 | CG | LEU | D | 74 | −16.696 | −29.239 | 101.152 | 1.00 | 21.05 | C |
| ATOM | 5460 | CD1 | LEU | D | 74 | −17.360 | −28.535 | 100.013 | 1.00 | 24.58 | C |
| ATOM | 5461 | CD2 | LEU | D | 74 | −17.329 | −30.584 | 101.345 | 1.00 | 20.48 | C |
| ATOM | 5462 | N | THR | D | 75 | −15.378 | −26.243 | 102.365 | 1.00 | 24.12 | N |
| ATOM | 5463 | CA | THR | D | 75 | −15.762 | −25.486 | 103.548 | 1.00 | 24.98 | C |
| ATOM | 5464 | C | THR | D | 75 | −17.286 | −25.435 | 103.651 | 1.00 | 28.91 | C |
| ATOM | 5465 | O | THR | D | 75 | −17.971 | −25.077 | 102.687 | 1.00 | 33.13 | O |
| ATOM | 5466 | CB | THR | D | 75 | −15.167 | −24.066 | 103.513 | 1.00 | 29.48 | C |
| ATOM | 5467 | OG1 | THR | D | 75 | −13.776 | −24.123 | 103.842 | 1.00 | 31.85 | O |
| ATOM | 5468 | CG2 | THR | D | 75 | −15.840 | −23.161 | 104.544 | 1.00 | 30.01 | C |
| ATOM | 5469 | N | ILE | D | 76 | −17.820 | −25.840 | 104.799 | 1.00 | 25.85 | N |
| ATOM | 5470 | CA | ILE | D | 76 | −19.217 | −25.616 | 105.141 | 1.00 | 25.76 | C |
| ATOM | 5471 | C | ILE | D | 76 | −19.211 | −24.568 | 106.232 | 1.00 | 30.23 | C |
| ATOM | 5472 | O | ILE | D | 76 | −18.718 | −24.829 | 107.337 | 1.00 | 34.43 | O |
| ATOM | 5473 | CB | ILE | D | 76 | −19.922 | −26.893 | 105.619 | 1.00 | 28.28 | C |

TABLE 10.4-continued

| | | | | | | | | | | |
|---|---|---|---|---|---|---|---|---|---|---|
| ATOM | 5474 | CG1 | ILE | D | 76 | −19.619 | −28.063 | 104.696 | 1.00 | 28.54 | C |
| ATOM | 5475 | CG2 | ILE | D | 76 | −21.443 | −26.672 | 105.686 | 1.00 | 28.62 | C |
| ATOM | 5476 | CD1 | ILE | D | 76 | −20.092 | −29.368 | 105.257 | 1.00 | 27.59 | C |
| ATOM | 5477 | N | SER | D | 77 | −19.775 | −23.395 | 105.945 | 1.00 | 30.77 | N |
| ATOM | 5478 | CA | SER | D | 77 | −19.475 | −22.251 | 106.803 | 1.00 | 33.53 | C |
| ATOM | 5479 | C | SER | D | 77 | −20.286 | −22.267 | 108.097 | 1.00 | 32.03 | C |
| ATOM | 5480 | O | SER | D | 77 | −19.781 | −21.840 | 109.141 | 1.00 | 35.78 | O |
| ATOM | 5481 | CB | SER | D | 77 | −19.681 | −20.943 | 106.038 | 1.00 | 25.30 | C |
| ATOM | 5482 | OG | SER | D | 77 | −21.029 | −20.795 | 105.672 | 1.00 | 30.61 | O |
| ATOM | 5483 | N | ARG | D | 78 | −21.539 | −22.727 | 108.051 | 1.00 | 34.30 | N |
| ATOM | 5484 | CA | ARG | D | 78 | −22.346 | −22.937 | 109.254 | 1.00 | 33.67 | C |
| ATOM | 5485 | C | ARG | D | 78 | −23.026 | −24.294 | 109.107 | 1.00 | 33.98 | C |
| ATOM | 5486 | O | ARG | D | 78 | −23.982 | −24.422 | 108.341 | 1.00 | 30.96 | O |
| ATOM | 5487 | CB | ARG | D | 78 | −23.387 | −21.830 | 109.423 | 1.00 | 34.14 | C |
| ATOM | 5488 | CG | ARG | D | 78 | −24.425 | −22.137 | 110.499 | 1.00 | 46.20 | C |
| ATOM | 5489 | CD | ARG | D | 78 | −25.375 | −20.962 | 110.761 | 1.00 | 46.68 | C |
| ATOM | 5490 | NE | ARG | D | 78 | −25.737 | −20.874 | 112.185 | 1.00 | 49.36 | N |
| ATOM | 5491 | CZ | ARG | D | 78 | −26.801 | −21.439 | 112.763 | 1.00 | 57.02 | C |
| ATOM | 5492 | NH1 | ARG | D | 78 | −27.008 | −21.283 | 114.074 | 1.00 | 54.06 | N1+ |
| ATOM | 5493 | NH2 | ARG | D | 78 | −27.666 | −22.153 | 112.047 | 1.00 | 59.27 | N |
| ATOM | 5494 | N | LEU | D | 79 | −22.616 | −25.273 | 109.904 | 1.00 | 31.63 | N |
| ATOM | 5495 | CA | LEU | D | 79 | −23.146 | −26.627 | 109.772 | 1.00 | 29.40 | C |
| ATOM | 5496 | C | LEU | D | 79 | −24.623 | −26.674 | 110.172 | 1.00 | 34.83 | C |
| ATOM | 5497 | O | LEU | D | 79 | −24.969 | −26.417 | 111.328 | 1.00 | 36.97 | O |
| ATOM | 5498 | CB | LEU | D | 79 | −22.333 | −27.580 | 110.640 | 1.00 | 26.40 | C |
| ATOM | 5499 | CG | LEU | D | 79 | −21.373 | −28.630 | 110.107 | 1.00 | 26.42 | C |
| ATOM | 5500 | CD1 | LEU | D | 79 | −21.113 | −28.496 | 108.643 | 1.00 | 29.85 | C |
| ATOM | 5501 | CD2 | LEU | D | 79 | −20.083 | −28.535 | 110.868 | 1.00 | 29.71 | C |
| ATOM | 5502 | N | GLU | D | 80 | −25.507 | −26.990 | 109.211 | 1.00 | 35.29 | N |
| ATOM | 5503 | CA | GLU | D | 80 | −26.911 | −27.234 | 109.503 | 1.00 | 33.25 | C |
| ATOM | 5504 | C | GLU | D | 80 | −27.130 | −28.711 | 109.784 | 1.00 | 37.31 | C |
| ATOM | 5505 | O | GLU | D | 80 | −26.269 | −29.536 | 109.472 | 1.00 | 34.23 | O |
| ATOM | 5506 | CB | GLU | D | 80 | −27.771 | −26.790 | 108.334 | 1.00 | 37.10 | C |
| ATOM | 5507 | CG | GLU | D | 80 | −27.822 | −25.300 | 108.123 | 1.00 | 37.33 | C |
| ATOM | 5508 | CD | GLU | D | 80 | −28.430 | −24.559 | 109.292 | 1.00 | 45.25 | C |
| ATOM | 5509 | OE1 | GLU | D | 80 | −29.311 | −25.110 | 109.996 | 1.00 | 48.39 | O |
| ATOM | 5510 | OE2 | GLU | D | 80 | −28.039 | −23.395 | 109.496 | 1.00 | 54.67 | O1− |
| ATOM | 5511 | N | PRO | D | 81 | −28.261 | −29.088 | 110.403 | 1.00 | 43.56 | N |
| ATOM | 5512 | CA | PRO | D | 81 | −28.458 | −30.514 | 110.743 | 1.00 | 45.48 | C |
| ATOM | 5513 | C | PRO | D | 81 | −28.252 | −31.464 | 109.571 | 1.00 | 42.65 | C |
| ATOM | 5514 | O | PRO | D | 81 | −27.600 | −32.508 | 109.728 | 1.00 | 39.13 | O |
| ATOM | 5515 | CB | PRO | D | 81 | −29.909 | −30.547 | 111.254 | 1.00 | 44.07 | C |
| ATOM | 5516 | CG | PRO | D | 81 | −30.130 | −29.185 | 111.794 | 1.00 | 40.26 | C |
| ATOM | 5517 | CD | PRO | D | 81 | −29.382 | −28.259 | 110.884 | 1.00 | 41.88 | C |
| ATOM | 5518 | N | GLU | D | 82 | −28.761 | −31.107 | 108.389 | 1.00 | 40.42 | N |
| ATOM | 5519 | CA | GLU | D | 82 | −28.620 | −31.911 | 107.178 | 1.00 | 37.02 | C |
| ATOM | 5520 | C | GLU | D | 82 | −27.222 | −31.924 | 106.602 | 1.00 | 38.11 | C |
| ATOM | 5521 | O | GLU | D | 82 | −27.053 | −32.461 | 105.498 | 1.00 | 37.79 | O |
| ATOM | 5522 | CB | GLU | D | 82 | −29.528 | −31.396 | 106.079 | 1.00 | 34.91 | C |
| ATOM | 5523 | CG | GLU | D | 82 | −29.092 | −30.088 | 105.479 | 1.00 | 42.26 | C |
| ATOM | 5524 | CD | GLU | D | 82 | −30.094 | −28.977 | 105.612 | 1.00 | 49.69 | C |
| ATOM | 5525 | OE1 | GLU | D | 82 | −30.683 | −28.801 | 106.716 | 1.00 | 59.37 | O |
| ATOM | 5526 | OE2 | GLU | D | 82 | −30.297 | −28.286 | 104.582 | 1.00 | 55.07 | O1− |
| ATOM | 5527 | N | ASP | D | 83 | −26.234 | −31.314 | 107.246 | 1.00 | 31.73 | N |
| ATOM | 5528 | CA | ASP | D | 83 | −24.893 | −31.308 | 106.690 | 1.00 | 31.81 | C |
| ATOM | 5529 | C | ASP | D | 83 | −24.033 | −32.399 | 107.278 | 1.00 | 27.67 | C |
| ATOM | 5530 | O | ASP | D | 83 | −22.905 | −32.577 | 106.833 | 1.00 | 28.90 | O |
| ATOM | 5531 | CB | ASP | D | 83 | −24.205 | −29.949 | 106.911 | 1.00 | 35.00 | C |
| ATOM | 5532 | CG | ASP | D | 83 | −24.923 | −28.802 | 106.203 | 1.00 | 36.30 | C |
| ATOM | 5533 | OD1 | ASP | D | 83 | −25.767 | −29.091 | 105.334 | 1.00 | 39.93 | O |
| ATOM | 5534 | OD2 | ASP | D | 83 | −24.663 | −27.615 | 106.524 | 1.00 | 33.84 | O1− |
| ATOM | 5535 | N | PHE | D | 84 | −24.531 | −33.133 | 108.262 | 1.00 | 28.52 | N |
| ATOM | 5536 | CA | PHE | D | 84 | −23.736 | −34.160 | 108.921 | 1.00 | 27.69 | C |
| ATOM | 5537 | C | PHE | D | 84 | −23.892 | −35.469 | 108.164 | 1.00 | 27.68 | C |
| ATOM | 5538 | O | PHE | D | 84 | −24.963 | −36.083 | 108.176 | 1.00 | 27.12 | O |
| ATOM | 5539 | CB | PHE | D | 84 | −24.127 | −34.276 | 110.391 | 1.00 | 26.49 | C |
| ATOM | 5540 | CG | PHE | D | 84 | −23.758 | −33.065 | 111.194 | 1.00 | 27.03 | C |
| ATOM | 5541 | CD1 | PHE | D | 84 | −22.520 | −32.992 | 111.822 | 1.00 | 27.26 | C |
| ATOM | 5542 | CD2 | PHE | D | 84 | −24.628 | −31.981 | 111.289 | 1.00 | 30.67 | C |
| ATOM | 5543 | CE1 | PHE | D | 84 | −22.156 | −31.865 | 112.562 | 1.00 | 31.27 | C |
| ATOM | 5544 | CE2 | PHE | D | 84 | −24.281 | −30.849 | 112.016 | 1.00 | 29.02 | C |
| ATOM | 5545 | CZ | PHE | D | 84 | −23.039 | −30.794 | 112.667 | 1.00 | 32.36 | C |
| ATOM | 5546 | N | ALA | D | 85 | −22.815 | −35.890 | 107.516 | 1.00 | 25.77 | N |
| ATOM | 5547 | CA | ALA | D | 85 | −22.859 | −36.899 | 106.469 | 1.00 | 21.15 | C |
| ATOM | 5548 | C | ALA | D | 85 | −21.420 | −37.274 | 106.118 | 1.00 | 22.96 | C |
| ATOM | 5549 | O | ALA | D | 85 | −20.472 | −36.875 | 106.800 | 1.00 | 22.25 | O |
| ATOM | 5550 | CB | ALA | D | 85 | −23.660 | −36.381 | 105.275 | 1.00 | 25.38 | C |
| ATOM | 5551 | N | VAL | D | 86 | −21.251 | −38.069 | 105.059 | 1.00 | 25.06 | N |
| ATOM | 5552 | CA | VAL | D | 86 | −19.939 | −38.399 | 104.521 | 1.00 | 20.70 | C |
| ATOM | 5553 | C | VAL | D | 86 | −19.708 | −37.553 | 103.278 | 1.00 | 22.14 | C |

TABLE 10.4-continued

| ATOM | 5554 | O | VAL | D | 86 | −20.628 | −37.341 | 102.488 | 1.00 | 27.68 | O |
|---|---|---|---|---|---|---|---|---|---|---|---|
| ATOM | 5555 | CB | VAL | D | 86 | −19.841 | −39.901 | 104.217 | 1.00 | 19.64 | C |
| ATOM | 5556 | CG1 | VAL | D | 86 | −18.533 | −40.230 | 103.523 | 1.00 | 22.34 | C |
| ATOM | 5557 | CG2 | VAL | D | 86 | −19.953 | −40.660 | 105.485 | 1.00 | 16.64 | C |
| ATOM | 5558 | N | TYR | D | 87 | −18.497 | −37.033 | 103.120 | 1.00 | 21.19 | N |
| ATOM | 5559 | CA | TYR | D | 87 | −18.151 | −36.206 | 101.975 | 1.00 | 24.17 | C |
| ATOM | 5560 | C | TYR | D | 87 | −17.024 | −36.879 | 101.219 | 1.00 | 25.06 | C |
| ATOM | 5561 | O | TYR | D | 87 | −16.084 | −37.381 | 101.837 | 1.00 | 25.52 | O |
| ATOM | 5562 | CB | TYR | D | 87 | −17.765 | −34.766 | 102.410 | 1.00 | 25.82 | C |
| ATOM | 5563 | CG | TYR | D | 87 | −18.963 | −34.036 | 102.978 | 1.00 | 24.53 | C |
| ATOM | 5564 | CD1 | TYR | D | 87 | −19.368 | −34.249 | 104.286 | 1.00 | 22.98 | C |
| ATOM | 5565 | CD2 | TYR | D | 87 | −19.735 | −33.198 | 102.178 | 1.00 | 22.74 | C |
| ATOM | 5566 | CE1 | TYR | D | 87 | −20.502 | −33.616 | 104.791 | 1.00 | 27.82 | C |
| ATOM | 5567 | CE2 | TYR | D | 87 | −20.857 | −32.573 | 102.662 | 1.00 | 22.11 | C |
| ATOM | 5568 | CZ | TYR | D | 87 | −21.244 | −32.777 | 103.966 | 1.00 | 28.03 | C |
| ATOM | 5569 | OH | TYR | D | 87 | −22.379 | −32.154 | 104.449 | 1.00 | 29.25 | O |
| ATOM | 5570 | N | PHE | D | 88 | −17.140 | −36.897 | 99.885 | 1.00 | 22.99 | N |
| ATOM | 5571 | CA | PHE | D | 88 | −16.222 | −37.590 | 98.990 | 1.00 | 25.06 | C |
| ATOM | 5572 | C | PHE | D | 88 | −15.653 | −36.649 | 97.952 | 1.00 | 27.58 | C |
| ATOM | 5573 | O | PHE | D | 88 | −16.403 | −35.890 | 97.327 | 1.00 | 28.74 | O |
| ATOM | 5574 | CB | PHE | D | 88 | −16.920 | −38.715 | 98.216 | 1.00 | 29.50 | C |
| ATOM | 5575 | CG | PHE | D | 88 | −17.173 | −39.937 | 99.013 | 1.00 | 30.12 | C |
| ATOM | 5576 | CD1 | PHE | D | 88 | −16.133 | −40.820 | 99.283 | 1.00 | 27.68 | C |
| ATOM | 5577 | CD2 | PHE | D | 88 | −18.442 | −40.231 | 99.470 | 1.00 | 26.34 | C |
| ATOM | 5578 | CE1 | PHE | D | 88 | −16.354 | −41.984 | 100.003 | 1.00 | 31.19 | C |
| ATOM | 5579 | CE2 | PHE | D | 88 | −18.664 | −41.389 | 100.198 | 1.00 | 31.81 | C |
| ATOM | 5580 | CZ | PHE | D | 88 | −17.614 | −42.268 | 100.470 | 1.00 | 27.93 | C |
| ATOM | 5581 | N | CYS | D | 89 | −14.350 | −36.745 | 97.704 | 1.00 | 26.11 | N |
| ATOM | 5582 | CA | CYS | D | 89 | −13.809 | −36.023 | 96.567 | 1.00 | 24.60 | C |
| ATOM | 5583 | C | CYS | D | 89 | −13.561 | −36.988 | 95.406 | 1.00 | 25.26 | C |
| ATOM | 5584 | O | CYS | D | 89 | −13.464 | −38.206 | 95.575 | 1.00 | 23.50 | O |
| ATOM | 5585 | CB | CYS | D | 89 | −12.537 | −35.249 | 96.941 | 1.00 | 23.65 | C |
| ATOM | 5586 | SG | CYS | D | 89 | −11.143 | −36.170 | 97.584 | 1.00 | 38.72 | S |
| ATOM | 5587 | N | GLN | D | 90 | −13.489 | −36.424 | 94.208 | 1.00 | 21.35 | N |
| ATOM | 5588 | CA | GLN | D | 90 | −13.364 | −37.237 | 93.006 | 1.00 | 24.00 | C |
| ATOM | 5589 | C | GLN | D | 90 | −12.697 | −36.404 | 91.921 | 1.00 | 24.00 | C |
| ATOM | 5590 | O | GLN | D | 90 | −13.073 | −35.249 | 91.715 | 1.00 | 23.20 | O |
| ATOM | 5591 | CB | GLN | D | 90 | −14.732 | −37.733 | 92.536 | 1.00 | 21.84 | C |
| ATOM | 5592 | CG | GLN | D | 90 | −14.703 | −38.606 | 91.307 | 1.00 | 21.39 | C |
| ATOM | 5593 | CD | GLN | D | 90 | −15.439 | −37.976 | 90.144 | 1.00 | 26.00 | C |
| ATOM | 5594 | OE1 | GLN | D | 90 | −16.481 | −37.331 | 90.333 | 1.00 | 29.02 | O |
| ATOM | 5595 | NE2 | GLN | D | 90 | −14.915 | −38.158 | 88.933 | 1.00 | 21.45 | N |
| ATOM | 5596 | N | GLN | D | 91 | −11.714 | −36.984 | 91.236 | 1.00 | 22.32 | N |
| ATOM | 5597 | CA | GLN | D | 91 | −11.051 | −36.316 | 90.130 | 1.00 | 24.41 | C |
| ATOM | 5598 | C | GLN | D | 91 | −11.459 | −36.980 | 88.818 | 1.00 | 26.03 | C |
| ATOM | 5599 | O | GLN | D | 91 | −11.628 | −38.205 | 88.750 | 1.00 | 23.79 | O |
| ATOM | 5600 | CB | GLN | D | 91 | −9.520 | −36.329 | 90.308 | 1.00 | 21.11 | C |
| ATOM | 5601 | CG | GLN | D | 91 | −8.866 | −37.697 | 90.214 | 1.00 | 21.28 | C |
| ATOM | 5602 | CD | GLN | D | 91 | −8.585 | −38.091 | 88.785 | 1.00 | 26.27 | C |
| ATOM | 5603 | OE1 | GLN | D | 91 | −8.432 | −37.231 | 87.917 | 1.00 | 28.92 | O |
| ATOM | 5604 | NE2 | GLN | D | 91 | −8.567 | −39.384 | 88.514 | 1.00 | 26.42 | N |
| ATOM | 5605 | N | TYR | D | 92 | −11.588 | −36.162 | 87.776 | 1.00 | 22.58 | N |
| ATOM | 5606 | CA | TYR | D | 92 | −11.946 | −36.594 | 86.432 | 1.00 | 26.01 | C |
| ATOM | 5607 | C | TYR | D | 92 | −11.013 | −35.927 | 85.432 | 1.00 | 27.20 | C |
| ATOM | 5608 | O | TYR | D | 92 | −11.409 | −35.517 | 84.334 | 1.00 | 25.89 | O |
| ATOM | 5609 | CB | TYR | D | 92 | −13.413 | −36.300 | 86.093 | 1.00 | 22.29 | C |
| ATOM | 5610 | CG | TYR | D | 92 | −13.889 | −34.864 | 86.367 | 1.00 | 26.32 | C |
| ATOM | 5611 | CD1 | TYR | D | 92 | −14.320 | −34.475 | 87.646 | 1.00 | 21.74 | C |
| ATOM | 5612 | CD2 | TYR | D | 92 | −13.903 | −33.893 | 85.344 | 1.00 | 26.96 | C |
| ATOM | 5613 | CE1 | TYR | D | 92 | −14.755 | −33.186 | 87.894 | 1.00 | 22.81 | C |
| ATOM | 5614 | CE2 | TYR | D | 92 | −14.347 | −32.585 | 85.587 | 1.00 | 24.44 | C |
| ATOM | 5615 | CZ | TYR | D | 92 | −14.764 | −32.247 | 86.867 | 1.00 | 27.75 | C |
| ATOM | 5616 | OH | TYR | D | 92 | −15.189 | −30.972 | 87.141 | 1.00 | 29.35 | O |
| ATOM | 5617 | N | GLU | D | 93 | −9.755 | −35.782 | 85.826 | 1.00 | 27.70 | N |
| ATOM | 5618 | CA | GLU | D | 93 | −8.729 | −35.263 | 84.936 | 1.00 | 29.92 | C |
| ATOM | 5619 | C | GLU | D | 93 | −8.055 | −36.384 | 84.141 | 1.00 | 31.61 | C |
| ATOM | 5620 | O | GLU | D | 93 | −7.883 | −36.278 | 82.926 | 1.00 | 33.23 | O |
| ATOM | 5621 | CB | GLU | D | 93 | −7.687 | −34.482 | 85.744 | 1.00 | 25.29 | C |
| ATOM | 5622 | CG | GLU | D | 93 | −6.386 | −34.312 | 84.993 | 1.00 | 28.20 | C |
| ATOM | 5623 | CD | GLU | D | 93 | −5.369 | −33.447 | 85.700 | 1.00 | 32.11 | C |
| ATOM | 5624 | OE1 | GLU | D | 93 | −5.735 | −32.389 | 86.285 | 1.00 | 26.85 | O |
| ATOM | 5625 | OE2 | GLU | D | 93 | −4.183 | −33.828 | 85.637 | 1.00 | 36.40 | O1− |
| ATOM | 5626 | N | SER | D | 94 | −7.694 | −37.471 | 84.810 | 1.00 | 28.99 | N |
| ATOM | 5627 | CA | SER | D | 94 | −6.939 | −38.555 | 84.213 | 1.00 | 28.53 | C |
| ATOM | 5628 | C | SER | D | 94 | −7.651 | −39.859 | 84.514 | 1.00 | 28.50 | C |
| ATOM | 5629 | O | SER | D | 94 | −8.040 | −40.110 | 85.661 | 1.00 | 26.38 | O |
| ATOM | 5630 | CB | SER | D | 94 | −5.499 | −38.586 | 84.754 | 1.00 | 27.94 | C |
| ATOM | 5631 | OG | SER | D | 94 | −4.912 | −39.865 | 84.570 | 1.00 | 33.48 | O |
| ATOM | 5632 | N | SER | D | 95 | −7.844 | −40.669 | 83.487 | 1.00 | 25.22 | N |
| ATOM | 5633 | CA | SER | D | 95 | −8.488 | −41.943 | 83.683 | 1.00 | 29.13 | C |

TABLE 10.4-continued

| | | | | | | | | | | |
|---|---|---|---|---|---|---|---|---|---|---|
| ATOM | 5634 | C | SER | D | 95 | −7.512 | −42.941 | 84.345 | 1.00 | 28.02 | C |
| ATOM | 5635 | O | SER | D | 95 | −6.324 | −42.923 | 84.083 | 1.00 | 28.38 | O |
| ATOM | 5636 | CB | SER | D | 95 | −9.012 | −42.479 | 82.363 | 1.00 | 30.42 | C |
| ATOM | 5637 | OG | SER | D | 95 | −9.598 | −43.754 | 82.570 | 1.00 | 42.60 | O |
| ATOM | 5638 | N | PRO | D | 96 | −8.018 | −43.796 | 85.228 | 1.00 | 25.83 | N |
| ATOM | 5639 | CA | PRO | D | 96 | −9.421 | −43.894 | 85.652 | 1.00 | 27.86 | C |
| ATOM | 5640 | C | PRO | D | 96 | −9.883 | −42.764 | 86.572 | 1.00 | 29.69 | C |
| ATOM | 5641 | O | PRO | D | 96 | −9.078 | −42.248 | 87.363 | 1.00 | 29.09 | O |
| ATOM | 5642 | CB | PRO | D | 96 | −9.454 | −45.229 | 86.397 | 1.00 | 32.44 | C |
| ATOM | 5643 | CG | PRO | D | 96 | −8.081 | −45.372 | 86.953 | 1.00 | 29.69 | C |
| ATOM | 5644 | CD | PRO | D | 96 | −7.169 | −44.788 | 85.901 | 1.00 | 25.85 | C |
| ATOM | 5645 | N | TRP | D | 97 | −11.153 | −42.369 | 86.470 | 1.00 | 27.79 | N |
| ATOM | 5646 | CA | TRP | D | 97 | −11.727 | −41.539 | 87.513 | 1.00 | 23.51 | C |
| ATOM | 5647 | C | TRP | D | 97 | −11.541 | −42.239 | 88.855 | 1.00 | 27.99 | C |
| ATOM | 5648 | O | TRP | D | 97 | −11.697 | −43.459 | 88.964 | 1.00 | 26.14 | O |
| ATOM | 5649 | CB | TRP | D | 97 | −13.205 | −41.292 | 87.265 | 1.00 | 26.18 | C |
| ATOM | 5650 | CG | TRP | D | 97 | −13.628 | −40.489 | 86.072 | 1.00 | 26.55 | C |
| ATOM | 5651 | CD1 | TRP | D | 97 | −14.907 | −40.229 | 85.726 | 1.00 | 23.15 | C |
| ATOM | 5652 | CD2 | TRP | D | 97 | −12.804 | −39.864 | 85.056 | 1.00 | 32.73 | C |
| ATOM | 5653 | NE1 | TRP | D | 97 | −14.953 | −39.474 | 84.583 | 1.00 | 28.40 | N |
| ATOM | 5654 | CE2 | TRP | D | 97 | −13.683 | −39.228 | 84.151 | 1.00 | 27.44 | C |
| ATOM | 5655 | CE3 | TRP | D | 97 | −11.419 | −39.760 | 84.835 | 1.00 | 25.48 | C |
| ATOM | 5656 | CZ2 | TRP | D | 97 | −13.232 | −38.510 | 83.046 | 1.00 | 28.49 | C |
| ATOM | 5657 | CZ3 | TRP | D | 97 | −10.975 | −39.045 | 83.734 | 1.00 | 23.95 | C |
| ATOM | 5658 | CH2 | TRP | D | 97 | −11.876 | −38.438 | 82.849 | 1.00 | 28.01 | C |
| ATOM | 5659 | N | THR | D | 98 | −11.174 | −41.469 | 89.877 | 1.00 | 28.12 | N |
| ATOM | 5660 | CA | THR | D | 98 | −10.911 | −42.018 | 91.196 | 1.00 | 28.04 | C |
| ATOM | 5661 | C | THR | D | 98 | −11.606 | −41.178 | 92.255 | 1.00 | 27.40 | C |
| ATOM | 5662 | O | THR | D | 98 | −11.797 | −39.972 | 92.089 | 1.00 | 24.69 | O |
| ATOM | 5663 | CB | THR | D | 98 | −9.390 | −42.067 | 91.493 | 1.00 | 30.50 | C |
| ATOM | 5664 | OG1 | THR | D | 98 | −8.813 | −40.781 | 91.230 | 1.00 | 29.88 | O |
| ATOM | 5665 | CG2 | THR | D | 98 | −8.687 | −43.122 | 90.648 | 1.00 | 24.32 | C |
| ATOM | 5666 | N | PHE | D | 99 | −11.928 | −41.821 | 93.372 | 1.00 | 28.87 | N |
| ATOM | 5667 | CA | PHE | D | 99 | −12.603 | −41.187 | 94.492 | 1.00 | 28.08 | C |
| ATOM | 5668 | C | PHE | D | 99 | −11.686 | −41.223 | 95.704 | 1.00 | 31.16 | C |
| ATOM | 5669 | O | PHE | D | 99 | −10.854 | −42.128 | 95.835 | 1.00 | 28.56 | O |
| ATOM | 5670 | CB | PHE | D | 99 | −13.931 | −41.891 | 94.859 | 1.00 | 22.78 | C |
| ATOM | 5671 | CG | PHE | D | 99 | −15.028 | −41.690 | 93.863 | 1.00 | 25.65 | C |
| ATOM | 5672 | CD1 | PHE | D | 99 | −15.156 | −42.534 | 92.778 | 1.00 | 25.60 | C |
| ATOM | 5673 | CD2 | PHE | D | 99 | −15.945 | −40.658 | 94.015 | 1.00 | 25.03 | C |
| ATOM | 5674 | CE1 | PHE | D | 99 | −16.171 | −42.362 | 91.864 | 1.00 | 23.95 | C |
| ATOM | 5675 | CE2 | PHE | D | 99 | −16.957 | −40.474 | 93.100 | 1.00 | 25.16 | C |
| ATOM | 5676 | CZ | PHE | D | 99 | −17.066 | −41.336 | 92.011 | 1.00 | 23.49 | C |
| ATOM | 5677 | N | GLY | D | 100 | −11.852 | −40.218 | 96.597 | 1.00 | 26.03 | N |
| ATOM | 5678 | CA | GLY | D | 100 | −11.280 | −40.302 | 97.918 | 1.00 | 25.35 | C |
| ATOM | 5679 | C | GLY | D | 100 | −12.110 | −41.227 | 98.769 | 1.00 | 29.26 | C |
| ATOM | 5680 | O | GLY | D | 100 | −13.227 | −41.602 | 98.411 | 1.00 | 31.89 | O |
| ATOM | 5681 | N | GLN | D | 101 | −11.553 | −41.623 | 99.901 | 1.00 | 26.91 | N |
| ATOM | 5682 | CA | GLN | D | 101 | −12.213 | −42.607 | 100.740 | 1.00 | 29.14 | C |
| ATOM | 5683 | C | GLN | D | 101 | −13.218 | −42.004 | 101.718 | 1.00 | 33.18 | C |
| ATOM | 5684 | O | GLN | D | 101 | −13.871 | −42.757 | 102.446 | 1.00 | 31.79 | O |
| ATOM | 5685 | CB | GLN | D | 101 | −11.163 | −43.426 | 101.480 | 1.00 | 37.07 | C |
| ATOM | 5686 | CG | GLN | D | 101 | −10.254 | −44.203 | 100.497 | 1.00 | 50.48 | C |
| ATOM | 5687 | CD | GLN | D | 101 | −10.653 | −45.667 | 100.316 | 1.00 | 57.12 | C |
| ATOM | 5688 | OE1 | GLN | D | 101 | −10.139 | −46.549 | 101.022 | 1.00 | 66.11 | O |
| ATOM | 5689 | NE2 | GLN | D | 101 | −11.564 | −45.935 | 99.371 | 1.00 | 48.92 | N |
| ATOM | 5690 | N | GLY | D | 102 | −13.381 | −40.691 | 101.740 | 1.00 | 27.41 | N |
| ATOM | 5691 | CA | GLY | D | 102 | −14.489 | −40.090 | 102.452 | 1.00 | 24.59 | C |
| ATOM | 5692 | C | GLY | D | 102 | −14.084 | −39.542 | 103.806 | 1.00 | 24.13 | C |
| ATOM | 5693 | O | GLY | D | 102 | −13.158 | −40.032 | 104.454 | 1.00 | 30.96 | O |
| ATOM | 5694 | N | THR | D | 103 | −14.767 | −38.478 | 104.226 | 1.00 | 26.72 | N |
| ATOM | 5695 | CA | THR | D | 103 | −14.681 | −37.929 | 105.577 | 1.00 | 25.89 | C |
| ATOM | 5696 | C | THR | D | 103 | −16.080 | −37.902 | 106.164 | 1.00 | 25.39 | C |
| ATOM | 5697 | O | THR | D | 103 | −16.997 | −37.334 | 105.560 | 1.00 | 19.85 | O |
| ATOM | 5698 | CB | THR | D | 103 | −14.116 | −36.500 | 105.626 | 1.00 | 28.14 | C |
| ATOM | 5699 | OG1 | THR | D | 103 | −12.740 | −36.480 | 105.221 | 1.00 | 28.24 | O |
| ATOM | 5700 | CG2 | THR | D | 103 | −14.269 | −35.913 | 107.044 | 1.00 | 26.41 | C |
| ATOM | 5701 | N | LYS | D | 104 | −16.230 | −38.501 | 107.344 | 1.00 | 27.38 | N |
| ATOM | 5702 | CA | LYS | D | 104 | −17.489 | −38.491 | 108.073 | 1.00 | 27.31 | C |
| ATOM | 5703 | C | LYS | D | 104 | −17.515 | −37.253 | 108.966 | 1.00 | 28.48 | C |
| ATOM | 5704 | O | LYS | D | 104 | −16.604 | −37.032 | 109.773 | 1.00 | 28.70 | O |
| ATOM | 5705 | CB | LYS | D | 104 | −17.661 | −39.787 | 108.875 | 1.00 | 25.02 | C |
| ATOM | 5706 | CG | LYS | D | 104 | −19.009 | −39.923 | 109.600 | 1.00 | 29.05 | C |
| ATOM | 5707 | CD | LYS | D | 104 | −19.050 | −41.169 | 110.488 | 1.00 | 32.39 | C |
| ATOM | 5708 | CE | LYS | D | 104 | −20.386 | −41.319 | 111.265 | 1.00 | 49.50 | C |
| ATOM | 5709 | NZ | LYS | D | 104 | −20.557 | −42.613 | 112.082 | 1.00 | 40.68 | N1+ |
| ATOM | 5710 | N | VAL | D | 105 | −18.520 | −36.416 | 108.767 | 1.00 | 26.83 | N |
| ATOM | 5711 | CA | VAL | D | 105 | −18.791 | −35.267 | 109.621 | 1.00 | 27.60 | C |
| ATOM | 5712 | C | VAL | D | 105 | −19.905 | −35.666 | 110.574 | 1.00 | 25.51 | C |
| ATOM | 5713 | O | VAL | D | 105 | −21.054 | −35.808 | 110.157 | 1.00 | 24.45 | O |

TABLE 10.4-continued

| ATOM | 5714 | CB | VAL | D | 105 | −19.176 | −34.041 | 108.785 | 1.00 | 27.65 | C |
|---|---|---|---|---|---|---|---|---|---|---|---|
| ATOM | 5715 | CG1 | VAL | D | 105 | −19.528 | −32.864 | 109.682 | 1.00 | 29.48 | C |
| ATOM | 5716 | CG2 | VAL | D | 105 | −18.026 | −33.694 | 107.825 | 1.00 | 22.38 | C |
| ATOM | 5717 | N | GLU | D | 106 | −19.579 | −35.866 | 111.851 | 1.00 | 31.50 | N |
| ATOM | 5718 | CA | GLU | D | 106 | −20.568 | −36.309 | 112.826 | 1.00 | 28.01 | C |
| ATOM | 5719 | C | GLU | D | 106 | −20.867 | −35.198 | 113.826 | 1.00 | 31.26 | C |
| ATOM | 5720 | O | GLU | D | 106 | −20.043 | −34.311 | 114.068 | 1.00 | 29.59 | O |
| ATOM | 5721 | CB | GLU | D | 106 | −20.137 | −37.601 | 113.551 | 1.00 | 29.60 | C |
| ATOM | 5722 | CG | GLU | D | 106 | −18.949 | −37.531 | 114.521 | 1.00 | 33.75 | C |
| ATOM | 5723 | CD | GLU | D | 106 | −19.264 | −38.095 | 115.928 | 1.00 | 34.42 | C |
| ATOM | 5724 | OE1 | GLU | D | 106 | −19.053 | −37.378 | 116.921 | 1.00 | 40.25 | O |
| ATOM | 5725 | OE2 | GLU | D | 106 | −19.688 | −39.257 | 116.061 | 1.00 | 33.48 | O1− |
| ATOM | 5726 | N | ILE | D | 107 | −22.075 | −35.258 | 114.387 | 1.00 | 29.99 | N |
| ATOM | 5727 | CA | ILE | D | 107 | −22.541 | −34.269 | 115.347 | 1.00 | 27.29 | C |
| ATOM | 5728 | C | ILE | D | 107 | −21.815 | −34.467 | 116.668 | 1.00 | 32.55 | C |
| ATOM | 5729 | O | ILE | D | 107 | −21.916 | −35.529 | 117.291 | 1.00 | 29.14 | O |
| ATOM | 5730 | CB | ILE | D | 107 | −24.048 | −34.396 | 115.581 | 1.00 | 29.36 | C |
| ATOM | 5731 | CG1 | ILE | D | 107 | −24.859 | −33.985 | 114.363 | 1.00 | 29.05 | C |
| ATOM | 5732 | CG2 | ILE | D | 107 | −24.428 | −33.602 | 116.816 | 1.00 | 30.42 | C |
| ATOM | 5733 | CD1 | ILE | D | 107 | −26.308 | −34.346 | 114.489 | 1.00 | 29.83 | C |
| ATOM | 5734 | N | LYS | D | 108 | −21.120 | −33.428 | 117.121 | 1.00 | 35.45 | N |
| ATOM | 5735 | CA | LYS | D | 108 | −20.531 | −33.410 | 118.452 | 1.00 | 32.78 | C |
| ATOM | 5736 | C | LYS | D | 108 | −21.581 | −32.996 | 119.483 | 1.00 | 36.07 | C |
| ATOM | 5737 | O | LYS | D | 108 | −22.303 | −32.011 | 119.282 | 1.00 | 36.02 | O |
| ATOM | 5738 | CB | LYS | D | 108 | −19.355 | −32.445 | 118.484 | 1.00 | 34.28 | C |
| ATOM | 5739 | CG | LYS | D | 108 | −18.623 | −32.454 | 119.791 | 1.00 | 36.31 | C |
| ATOM | 5740 | CD | LYS | D | 108 | −17.705 | −31.273 | 119.907 | 1.00 | 36.98 | C |
| ATOM | 5741 | CE | LYS | D | 108 | −16.504 | −31.728 | 120.659 | 1.00 | 44.81 | C |
| ATOM | 5742 | NZ | LYS | D | 108 | −16.855 | −33.094 | 121.165 | 1.00 | 40.45 | N1+ |
| ATOM | 5743 | N | ARG | D | 109 | −21.682 | −33.760 | 120.572 | 1.00 | 31.47 | N |
| ATOM | 5744 | CA | ARG | D | 109 | −22.636 | −33.469 | 121.642 | 1.00 | 32.33 | C |
| ATOM | 5745 | C | ARG | D | 109 | −22.004 | −33.853 | 122.962 | 1.00 | 30.94 | C |
| ATOM | 5746 | O | ARG | D | 109 | −20.848 | −34.273 | 123.008 | 1.00 | 35.21 | O |
| ATOM | 5747 | CB | ARG | D | 109 | −23.957 | −34.203 | 121.464 | 1.00 | 26.67 | C |
| ATOM | 5748 | CG | ARG | D | 109 | −23.826 | −35.711 | 121.380 | 1.00 | 32.22 | C |
| ATOM | 5749 | CD | ARG | D | 109 | −25.081 | −36.397 | 121.890 | 1.00 | 28.47 | C |
| ATOM | 5750 | NE | ARG | D | 109 | −25.123 | −36.331 | 123.335 | 1.00 | 32.52 | N |
| ATOM | 5751 | CZ | ARG | D | 109 | −26.235 | −36.307 | 124.056 | 1.00 | 28.79 | C |
| ATOM | 5752 | NH1 | ARG | D | 109 | −26.159 | −36.242 | 125.377 | 1.00 | 28.77 | N1+ |
| ATOM | 5753 | NH2 | ARG | D | 109 | −27.406 | −36.312 | 123.460 | 1.00 | 25.19 | N |
| ATOM | 5754 | N | THR | D | 110 | −22.765 | −33.713 | 124.040 | 1.00 | 27.95 | N |
| ATOM | 5755 | CA | THR | D | 110 | −22.224 | −34.032 | 125.356 | 1.00 | 33.38 | C |
| ATOM | 5756 | C | THR | D | 110 | −22.147 | −35.538 | 125.572 | 1.00 | 32.27 | C |
| ATOM | 5757 | O | THR | D | 110 | −22.956 | −36.306 | 125.044 | 1.00 | 32.94 | O |
| ATOM | 5758 | CB | THR | D | 110 | −23.068 | −33.429 | 126.468 | 1.00 | 32.63 | C |
| ATOM | 5759 | OG1 | THR | D | 110 | −24.415 | −33.917 | 126.356 | 1.00 | 28.33 | O |
| ATOM | 5760 | CG2 | THR | D | 110 | −23.037 | −31.936 | 126.370 | 1.00 | 31.15 | C |
| ATOM | 5761 | N | VAL | D | 111 | −21.145 | −35.946 | 126.354 | 1.00 | 29.24 | N |
| ATOM | 5762 | CA | VAL | D | 111 | −20.999 | −37.339 | 126.750 | 1.00 | 29.80 | C |
| ATOM | 5763 | C | VAL | D | 111 | −22.298 | −37.861 | 127.374 | 1.00 | 31.10 | C |
| ATOM | 5764 | O | VAL | D | 111 | −22.978 | −37.165 | 128.137 | 1.00 | 36.10 | O |
| ATOM | 5765 | CB | VAL | D | 111 | −19.794 | −37.464 | 127.699 | 1.00 | 29.10 | C |
| ATOM | 5766 | CG1 | VAL | D | 111 | −19.627 | −38.899 | 128.181 | 1.00 | 32.56 | C |
| ATOM | 5767 | CG2 | VAL | D | 111 | −18.522 | −36.988 | 126.978 | 1.00 | 24.86 | C |
| ATOM | 5768 | N | ALA | D | 112 | −22.665 | −39.086 | 127.004 | 1.00 | 30.83 | N |
| ATOM | 5769 | CA | ALA | D | 112 | −23.886 | −39.735 | 127.460 | 1.00 | 27.58 | C |
| ATOM | 5770 | C | ALA | D | 112 | −23.597 | −41.211 | 127.684 | 1.00 | 30.58 | C |
| ATOM | 5771 | O | ALA | D | 112 | −23.169 | −41.899 | 126.759 | 1.00 | 35.39 | O |
| ATOM | 5772 | CB | ALA | D | 112 | −25.003 | −39.561 | 126.435 | 1.00 | 26.61 | C |
| ATOM | 5773 | N | ALA | D | 113 | −23.828 | −41.703 | 128.896 | 1.00 | 32.52 | N |
| ATOM | 5774 | CA | ALA | D | 113 | −23.548 | −43.102 | 129.185 | 1.00 | 31.32 | C |
| ATOM | 5775 | C | ALA | D | 113 | −24.588 | −44.017 | 128.544 | 1.00 | 31.91 | C |
| ATOM | 5776 | O | ALA | D | 113 | −25.757 | −43.648 | 128.414 | 1.00 | 30.66 | O |
| ATOM | 5777 | CB | ALA | D | 113 | −23.530 | −43.351 | 130.685 | 1.00 | 26.64 | C |
| ATOM | 5778 | N | PRO | D | 114 | −24.193 | −45.222 | 128.150 | 1.00 | 29.42 | N |
| ATOM | 5779 | CA | PRO | D | 114 | −25.182 | −46.176 | 127.649 | 1.00 | 29.26 | C |
| ATOM | 5780 | C | PRO | D | 114 | −26.021 | −46.730 | 128.781 | 1.00 | 29.73 | C |
| ATOM | 5781 | O | PRO | D | 114 | −25.589 | −46.804 | 129.925 | 1.00 | 28.84 | O |
| ATOM | 5782 | CB | PRO | D | 114 | −24.334 | −47.277 | 127.005 | 1.00 | 27.37 | C |
| ATOM | 5783 | CG | PRO | D | 114 | −23.042 | −47.236 | 127.766 | 1.00 | 30.02 | C |
| ATOM | 5784 | CD | PRO | D | 114 | −22.823 | −45.773 | 128.131 | 1.00 | 29.01 | C |
| ATOM | 5785 | N | SER | D | 115 | −27.255 | −47.068 | 128.454 | 1.00 | 28.42 | N |
| ATOM | 5786 | CA | SER | D | 115 | −28.020 | −47.994 | 129.254 | 1.00 | 24.77 | C |
| ATOM | 5787 | C | SER | D | 115 | −27.788 | −49.394 | 128.706 | 1.00 | 27.46 | C |
| ATOM | 5788 | O | SER | D | 115 | −27.741 | −49.606 | 127.489 | 1.00 | 25.81 | O |
| ATOM | 5789 | CB | SER | D | 115 | −29.502 | −47.638 | 129.221 | 1.00 | 27.83 | C |
| ATOM | 5790 | OG | SER | D | 115 | −29.644 | −46.253 | 129.452 | 1.00 | 30.47 | O |
| ATOM | 5791 | N | VAL | D | 116 | −27.612 | −50.342 | 129.612 | 1.00 | 26.91 | N |
| ATOM | 5792 | CA | VAL | D | 116 | −27.156 | −51.679 | 129.275 | 1.00 | 27.26 | C |
| ATOM | 5793 | C | VAL | D | 116 | −28.258 | −52.657 | 129.636 | 1.00 | 26.73 | C |

TABLE 10.4-continued

| ATOM | 5794 | O   | VAL | D | 116 | −28.800 | −52.605 | 130.742 | 1.00 | 33.45 | O   |
|------|------|-----|-----|---|-----|---------|---------|---------|------|-------|-----|
| ATOM | 5795 | CB  | VAL | D | 116 | −25.850 | −52.032 | 130.010 | 1.00 | 29.29 | C   |
| ATOM | 5796 | CG1 | VAL | D | 116 | −25.339 | −53.387 | 129.535 | 1.00 | 30.85 | C   |
| ATOM | 5797 | CG2 | VAL | D | 116 | −24.814 | −50.930 | 129.803 | 1.00 | 24.64 | C   |
| ATOM | 5798 | N   | PHE | D | 117 | −28.591 | −53.535 | 128.703 | 1.00 | 25.90 | N   |
| ATOM | 5799 | CA  | PHE | D | 117 | −29.585 | −54.573 | 128.907 | 1.00 | 25.96 | C   |
| ATOM | 5800 | C   | PHE | D | 117 | −29.037 | −55.838 | 128.293 | 1.00 | 27.24 | C   |
| ATOM | 5801 | O   | PHE | D | 117 | −28.399 | −55.788 | 127.240 | 1.00 | 29.01 | O   |
| ATOM | 5802 | CB  | PHE | D | 117 | −30.930 | −54.282 | 128.244 | 1.00 | 26.04 | C   |
| ATOM | 5803 | CG  | PHE | D | 117 | −31.510 | −52.943 | 128.560 | 1.00 | 29.45 | C   |
| ATOM | 5804 | CD1 | PHE | D | 117 | −31.119 | −51.810 | 127.851 | 1.00 | 28.96 | C   |
| ATOM | 5805 | CD2 | PHE | D | 117 | −32.523 | −52.826 | 129.497 | 1.00 | 27.92 | C   |
| ATOM | 5806 | CE1 | PHE | D | 117 | −31.698 | −50.590 | 128.119 | 1.00 | 31.67 | C   |
| ATOM | 5807 | CE2 | PHE | D | 117 | −33.108 | −51.607 | 129.767 | 1.00 | 28.75 | C   |
| ATOM | 5808 | CZ  | PHE | D | 117 | −32.705 | −50.490 | 129.086 | 1.00 | 31.59 | C   |
| ATOM | 5809 | N   | ILE | D | 118 | −29.288 | −56.966 | 128.938 | 1.00 | 28.76 | N   |
| ATOM | 5810 | CA  | ILE | D | 118 | −28.835 | −58.252 | 128.429 | 1.00 | 30.93 | C   |
| ATOM | 5811 | C   | ILE | D | 118 | −30.053 | −59.149 | 128.291 | 1.00 | 27.51 | C   |
| ATOM | 5812 | O   | ILE | D | 118 | −30.949 | −59.115 | 129.134 | 1.00 | 28.60 | O   |
| ATOM | 5813 | CB  | ILE | D | 118 | −27.764 | −58.872 | 129.348 | 1.00 | 29.79 | C   |
| ATOM | 5814 | CG1 | ILE | D | 118 | −27.230 | −60.167 | 128.757 | 1.00 | 33.20 | C   |
| ATOM | 5815 | CG2 | ILE | D | 118 | −28.321 | −59.122 | 130.738 | 1.00 | 28.76 | C   |
| ATOM | 5816 | CD1 | ILE | D | 118 | −26.243 | −60.873 | 129.679 | 1.00 | 35.26 | C   |
| ATOM | 5817 | N   | PHE | D | 119 | −30.108 | −59.909 | 127.204 | 1.00 | 28.10 | N   |
| ATOM | 5818 | CA  | PHE | D | 119 | −31.241 | −60.753 | 126.853 | 1.00 | 27.79 | C   |
| ATOM | 5819 | C   | PHE | D | 119 | −30.812 | −62.209 | 126.778 | 1.00 | 32.91 | C   |
| ATOM | 5820 | O   | PHE | D | 119 | −29.869 | −62.544 | 126.044 | 1.00 | 31.43 | O   |
| ATOM | 5821 | CB  | PHE | D | 119 | −31.858 | −60.343 | 125.507 | 1.00 | 29.66 | C   |
| ATOM | 5822 | CG  | PHE | D | 119 | −32.413 | −58.970 | 125.513 | 1.00 | 31.25 | C   |
| ATOM | 5823 | CD1 | PHE | D | 119 | −33.683 | −58.729 | 126.018 | 1.00 | 26.70 | C   |
| ATOM | 5824 | CD2 | PHE | D | 119 | −31.659 | −57.909 | 125.051 | 1.00 | 27.96 | C   |
| ATOM | 5825 | CE1 | PHE | D | 119 | −34.198 | −57.450 | 126.055 | 1.00 | 28.84 | C   |
| ATOM | 5826 | CE2 | PHE | D | 119 | −32.165 | −56.635 | 125.086 | 1.00 | 30.39 | C   |
| ATOM | 5827 | CZ  | PHE | D | 119 | −33.445 | −56.399 | 125.584 | 1.00 | 27.28 | C   |
| ATOM | 5828 | N   | PRO | D | 120 | −31.482 | −63.097 | 127.497 | 1.00 | 35.56 | N   |
| ATOM | 5829 | CA  | PRO | D | 120 | −31.187 | −64.530 | 127.394 | 1.00 | 36.54 | C   |
| ATOM | 5830 | C   | PRO | D | 120 | −31.661 | −65.088 | 126.065 | 1.00 | 34.90 | C   |
| ATOM | 5831 | O   | PRO | D | 120 | −32.495 | −64.470 | 125.387 | 1.00 | 33.38 | O   |
| ATOM | 5832 | CB  | PRO | D | 120 | −31.987 | −65.138 | 128.557 | 1.00 | 36.73 | C   |
| ATOM | 5833 | CG  | PRO | D | 120 | −32.403 | −63.956 | 129.408 | 1.00 | 42.07 | C   |
| ATOM | 5834 | CD  | PRO | D | 120 | −32.546 | −62.814 | 128.466 | 1.00 | 32.56 | C   |
| ATOM | 5835 | N   | PRO | D | 121 | −31.155 | −66.248 | 125.655 | 1.00 | 33.49 | N   |
| ATOM | 5836 | CA  | PRO | D | 121 | −31.711 | −66.900 | 124.463 | 1.00 | 35.36 | C   |
| ATOM | 5837 | C   | PRO | D | 121 | −33.137 | −67.359 | 124.718 | 1.00 | 32.32 | C   |
| ATOM | 5838 | O   | PRO | D | 121 | −33.510 | −67.738 | 125.829 | 1.00 | 33.72 | O   |
| ATOM | 5839 | CB  | PRO | D | 121 | −30.772 | −68.091 | 124.225 | 1.00 | 34.18 | C   |
| ATOM | 5840 | CG  | PRO | D | 121 | −30.187 | −68.357 | 125.588 | 1.00 | 34.16 | C   |
| ATOM | 5841 | CD  | PRO | D | 121 | −30.062 | −67.026 | 126.262 | 1.00 | 28.95 | C   |
| ATOM | 5842 | N   | SER | D | 122 | −33.949 | −67.282 | 123.672 | 1.00 | 37.30 | N   |
| ATOM | 5843 | CA  | SER | D | 122 | −35.326 | −67.733 | 123.761 | 1.00 | 35.72 | C   |
| ATOM | 5844 | C   | SER | D | 122 | −35.386 | −69.261 | 123.796 | 1.00 | 40.60 | C   |
| ATOM | 5845 | O   | SER | D | 122 | −34.510 | −69.961 | 123.264 | 1.00 | 37.13 | O   |
| ATOM | 5846 | CB  | SER | D | 122 | −36.141 | −67.176 | 122.589 | 1.00 | 30.63 | C   |
| ATOM | 5847 | OG  | SER | D | 122 | −35.821 | −67.837 | 121.384 | 1.00 | 34.59 | O   |
| ATOM | 5848 | N   | ASP | D | 123 | −36.413 | −69.776 | 124.481 | 1.00 | 44.14 | N   |
| ATOM | 5849 | CA  | ASP | D | 123 | −36.631 | −71.221 | 124.525 | 1.00 | 47.46 | C   |
| ATOM | 5850 | C   | ASP | D | 123 | −36.913 | −71.793 | 123.142 | 1.00 | 46.92 | C   |
| ATOM | 5851 | O   | ASP | D | 123 | −36.606 | −72.964 | 122.884 | 1.00 | 49.21 | O   |
| ATOM | 5852 | CB  | ASP | D | 123 | −37.776 | −71.541 | 125.478 | 1.00 | 54.79 | C   |
| ATOM | 5853 | CG  | ASP | D | 123 | −37.352 | −71.471 | 126.921 | 1.00 | 61.77 | C   |
| ATOM | 5854 | OD1 | ASP | D | 123 | −36.195 | −71.849 | 127.207 | 1.00 | 56.99 | O   |
| ATOM | 5855 | OD2 | ASP | D | 123 | −38.161 | −71.015 | 127.763 | 1.00 | 71.23 | O1− |
| ATOM | 5856 | N   | GLU | D | 124 | −37.480 | −70.978 | 122.241 | 1.00 | 45.60 | N   |
| ATOM | 5857 | CA  | GLU | D | 124 | −37.753 | −71.411 | 120.869 | 1.00 | 49.64 | C   |
| ATOM | 5858 | C   | GLU | D | 124 | −36.463 | −71.644 | 120.084 | 1.00 | 50.62 | C   |
| ATOM | 5859 | O   | GLU | D | 124 | −36.383 | −72.565 | 119.259 | 1.00 | 49.45 | O   |
| ATOM | 5860 | CB  | GLU | D | 124 | −38.613 | −70.365 | 120.168 | 1.00 | 45.37 | C   |
| ATOM | 5861 | CG  | GLU | D | 124 | −39.053 | −70.740 | 118.759 | 1.00 | 60.55 | C   |
| ATOM | 5862 | CD  | GLU | D | 124 | −39.635 | −69.542 | 117.988 | 1.00 | 74.03 | C   |
| ATOM | 5863 | OE1 | GLU | D | 124 | −39.948 | −68.502 | 118.626 | 1.00 | 67.91 | O   |
| ATOM | 5864 | OE2 | GLU | D | 124 | −39.760 | −69.633 | 116.740 | 1.00 | 80.45 | O1− |
| ATOM | 5865 | N   | GLN | D | 125 | −35.452 | −70.799 | 120.309 | 1.00 | 44.68 | N   |
| ATOM | 5866 | CA  | GLN | D | 125 | −34.161 | −70.979 | 119.660 | 1.00 | 44.38 | C   |
| ATOM | 5867 | C   | GLN | D | 125 | −33.365 | −72.110 | 120.296 | 1.00 | 44.17 | C   |
| ATOM | 5868 | O   | GLN | D | 125 | −32.617 | −72.803 | 119.596 | 1.00 | 44.30 | O   |
| ATOM | 5869 | CB  | GLN | D | 125 | −33.353 | −69.677 | 119.726 | 1.00 | 38.62 | C   |
| ATOM | 5870 | CG  | GLN | D | 125 | −32.017 | −69.721 | 118.987 | 1.00 | 34.83 | C   |
| ATOM | 5871 | CD  | GLN | D | 125 | −31.067 | −68.656 | 119.471 | 1.00 | 36.06 | C   |
| ATOM | 5872 | OE1 | GLN | D | 125 | −31.232 | −68.116 | 120.570 | 1.00 | 37.90 | O   |
| ATOM | 5873 | NE2 | GLN | D | 125 | −30.080 | −68.328 | 118.652 | 1.00 | 40.51 | N   |

TABLE 10.4-continued

| | | | | | | | | | | |
|---|---|---|---|---|---|---|---|---|---|---|
| ATOM | 5874 | N | LEU | D | 126 | −33.515 | −72.316 | 121.606 | 1.00 | 39.87 | N |
| ATOM | 5875 | CA | LEU | D | 126 | −32.798 | −73.405 | 122.254 | 1.00 | 43.24 | C |
| ATOM | 5876 | C | LEU | D | 126 | −33.200 | −74.756 | 121.683 | 1.00 | 49.92 | C |
| ATOM | 5877 | O | LEU | D | 126 | −32.343 | −75.623 | 121.467 | 1.00 | 50.55 | O |
| ATOM | 5878 | CB | LEU | D | 126 | −33.035 | −73.372 | 123.755 | 1.00 | 37.51 | C |
| ATOM | 5879 | CG | LEU | D | 126 | −32.229 | −72.275 | 124.411 | 1.00 | 38.73 | C |
| ATOM | 5880 | CD1 | LEU | D | 126 | −32.542 | −72.240 | 125.881 | 1.00 | 34.97 | C |
| ATOM | 5881 | CD2 | LEU | D | 126 | −30.723 | −72.461 | 124.145 | 1.00 | 38.73 | C |
| ATOM | 5882 | N | LYS | D | 127 | −34.486 | −74.933 | 121.365 | 1.00 | 50.02 | N |
| ATOM | 5883 | CA | LYS | D | 127 | −34.931 | −76.193 | 120.777 | 1.00 | 50.42 | C |
| ATOM | 5884 | C | LYS | D | 127 | −34.041 | −76.636 | 119.621 | 1.00 | 50.52 | C |
| ATOM | 5885 | O | LYS | D | 127 | −33.827 | −77.838 | 119.434 | 1.00 | 61.34 | O |
| ATOM | 5886 | CB | LYS | D | 127 | −36.378 | −76.066 | 120.287 | 1.00 | 54.82 | C |
| ATOM | 5887 | CG | LYS | D | 127 | −37.364 | −75.491 | 121.309 | 1.00 | 56.44 | C |
| ATOM | 5888 | CD | LYS | D | 127 | −38.834 | −75.811 | 120.959 | 1.00 | 64.32 | C |
| ATOM | 5889 | CE | LYS | D | 127 | −39.297 | −75.170 | 119.628 | 1.00 | 72.71 | C |
| ATOM | 5890 | NZ | LYS | D | 127 | −39.699 | −76.161 | 118.571 | 1.00 | 64.97 | N1+ |
| ATOM | 5891 | N | SER | D | 128 | −33.470 | −75.687 | 118.880 | 1.00 | 50.62 | N |
| ATOM | 5892 | CA | SER | D | 128 | −32.691 | −75.949 | 117.674 | 1.00 | 48.62 | C |
| ATOM | 5893 | C | SER | D | 128 | −31.181 | −76.031 | 117.919 | 1.00 | 52.68 | C |
| ATOM | 5894 | O | SER | D | 128 | −30.403 | −76.019 | 116.957 | 1.00 | 53.36 | O |
| ATOM | 5895 | CB | SER | D | 128 | −32.998 | −74.877 | 116.626 | 1.00 | 51.45 | C |
| ATOM | 5896 | OG | SER | D | 128 | −32.539 | −73.605 | 117.065 | 1.00 | 54.76 | O |
| ATOM | 5897 | N | GLY | D | 129 | −30.742 | −76.074 | 119.169 | 1.00 | 49.90 | N |
| ATOM | 5898 | CA | GLY | D | 129 | −29.355 | −76.368 | 119.452 | 1.00 | 48.29 | C |
| ATOM | 5899 | C | GLY | D | 129 | −28.416 | −75.187 | 119.533 | 1.00 | 52.26 | C |
| ATOM | 5900 | O | GLY | D | 129 | −27.243 | −75.382 | 119.882 | 1.00 | 50.58 | O |
| ATOM | 5901 | N | THR | D | 130 | −28.886 | −73.969 | 119.259 | 1.00 | 49.43 | N |
| ATOM | 5902 | CA | THR | D | 130 | −28.043 | −72.784 | 119.302 | 1.00 | 44.36 | C |
| ATOM | 5903 | C | THR | D | 130 | −28.614 | −71.774 | 120.285 | 1.00 | 44.57 | C |
| ATOM | 5904 | O | THR | D | 130 | −29.830 | −71.596 | 120.369 | 1.00 | 45.91 | O |
| ATOM | 5905 | CB | THR | D | 130 | −27.942 | −72.142 | 117.926 | 1.00 | 49.85 | C |
| ATOM | 5906 | OG1 | THR | D | 130 | −27.337 | −73.073 | 117.030 | 1.00 | 49.94 | O |
| ATOM | 5907 | CG2 | THR | D | 130 | −27.087 | −70.871 | 117.975 | 1.00 | 47.05 | C |
| ATOM | 5908 | N | ALA | D | 131 | −27.729 | −71.098 | 121.008 | 1.00 | 40.05 | N |
| ATOM | 5909 | CA | ALA | D | 131 | −28.104 | −70.036 | 121.924 | 1.00 | 38.97 | C |
| ATOM | 5910 | C | ALA | D | 131 | −27.432 | −68.727 | 121.512 | 1.00 | 37.81 | C |
| ATOM | 5911 | O | ALA | D | 131 | −26.209 | −68.683 | 121.329 | 1.00 | 38.34 | O |
| ATOM | 5912 | CB | ALA | D | 131 | −27.721 | −70.421 | 123.347 | 1.00 | 38.52 | C |
| ATOM | 5913 | N | SER | D | 132 | −28.224 | −67.667 | 121.359 | 1.00 | 33.37 | N |
| ATOM | 5914 | CA | SER | D | 132 | −27.707 | −66.314 | 121.152 | 1.00 | 30.63 | C |
| ATOM | 5915 | C | SER | D | 132 | −28.011 | −65.482 | 122.392 | 1.00 | 31.31 | C |
| ATOM | 5916 | O | SER | D | 132 | −29.166 | −65.369 | 122.800 | 1.00 | 39.28 | O |
| ATOM | 5917 | CB | SER | D | 132 | −28.321 | −65.659 | 119.913 | 1.00 | 31.88 | C |
| ATOM | 5918 | OG | SER | D | 132 | −27.968 | −66.338 | 118.727 | 1.00 | 32.64 | O |
| ATOM | 5919 | N | VAL | D | 133 | −26.999 | −64.942 | 123.008 | 1.00 | 32.01 | N |
| ATOM | 5920 | CA | VAL | D | 133 | −27.179 | −63.987 | 124.097 | 1.00 | 34.18 | C |
| ATOM | 5921 | C | VAL | D | 133 | −26.944 | −62.601 | 123.519 | 1.00 | 32.77 | C |
| ATOM | 5922 | O | VAL | D | 133 | −26.025 | −62.421 | 122.706 | 1.00 | 31.33 | O |
| ATOM | 5923 | CB | VAL | D | 133 | −26.213 | −64.294 | 125.261 | 1.00 | 34.59 | C |
| ATOM | 5924 | CG1 | VAL | D | 133 | −26.610 | −63.544 | 126.532 | 1.00 | 32.22 | C |
| ATOM | 5925 | CG2 | VAL | D | 133 | −26.180 | −65.792 | 125.517 | 1.00 | 30.53 | C |
| ATOM | 5926 | N | VAL | D | 134 | −27.781 | −61.625 | 123.893 | 1.00 | 27.21 | N |
| ATOM | 5927 | CA | VAL | D | 134 | −27.711 | −60.290 | 123.295 | 1.00 | 28.33 | C |
| ATOM | 5928 | C | VAL | D | 134 | −27.496 | −59.226 | 124.365 | 1.00 | 28.83 | C |
| ATOM | 5929 | O | VAL | D | 134 | −28.174 | −59.214 | 125.397 | 1.00 | 27.78 | O |
| ATOM | 5930 | CB | VAL | D | 134 | −28.950 | −59.955 | 122.450 | 1.00 | 27.75 | C |
| ATOM | 5931 | CG1 | VAL | D | 134 | −28.794 | −58.585 | 121.858 | 1.00 | 26.08 | C |
| ATOM | 5932 | CG2 | VAL | D | 134 | −29.096 | −60.957 | 121.319 | 1.00 | 30.78 | C |
| ATOM | 5933 | N | CYS | D | 135 | −26.565 | −58.313 | 124.092 | 1.00 | 27.54 | N |
| ATOM | 5934 | CA | CYS | D | 135 | −26.299 | −57.155 | 124.928 | 1.00 | 31.96 | C |
| ATOM | 5935 | C | CYS | D | 135 | −26.651 | −55.895 | 124.141 | 1.00 | 32.81 | C |
| ATOM | 5936 | O | CYS | D | 135 | −26.250 | −55.760 | 122.979 | 1.00 | 27.82 | O |
| ATOM | 5937 | CB | CYS | D | 135 | −24.827 | −57.154 | 125.365 | 1.00 | 32.75 | C |
| ATOM | 5938 | SG | CYS | D | 135 | −24.350 | −56.013 | 126.697 | 1.00 | 40.27 | S |
| ATOM | 5939 | N | LEU | D | 136 | −27.422 | −54.996 | 124.762 | 1.00 | 26.44 | N |
| ATOM | 5940 | CA | LEU | D | 136 | −27.826 | −53.726 | 124.161 | 1.00 | 24.84 | C |
| ATOM | 5941 | C | LEU | D | 136 | −27.168 | −52.559 | 124.898 | 1.00 | 28.43 | C |
| ATOM | 5942 | O | LEU | D | 136 | −27.375 | −52.380 | 126.107 | 1.00 | 27.53 | O |
| ATOM | 5943 | CB | LEU | D | 136 | −29.345 | −53.566 | 124.191 | 1.00 | 26.69 | C |
| ATOM | 5944 | CG | LEU | D | 136 | −29.908 | −52.191 | 123.787 | 1.00 | 30.11 | C |
| ATOM | 5945 | CD1 | LEU | D | 136 | −29.570 | −51.875 | 122.330 | 1.00 | 22.63 | C |
| ATOM | 5946 | CD2 | LEU | D | 136 | −31.439 | −52.087 | 124.042 | 1.00 | 23.90 | C |
| ATOM | 5947 | N | LEU | D | 137 | −26.403 | −51.746 | 124.169 | 1.00 | 27.96 | N |
| ATOM | 5948 | CA | LEU | D | 137 | −25.860 | −50.492 | 124.687 | 1.00 | 24.59 | C |
| ATOM | 5949 | C | LEU | D | 137 | −26.657 | −49.367 | 124.027 | 1.00 | 28.90 | C |
| ATOM | 5950 | O | LEU | D | 137 | −26.501 | −49.096 | 122.830 | 1.00 | 28.52 | O |
| ATOM | 5951 | CB | LEU | D | 137 | −24.364 | −50.380 | 124.419 | 1.00 | 20.03 | C |
| ATOM | 5952 | CG | LEU | D | 137 | −23.377 | −51.186 | 125.271 | 1.00 | 24.15 | C |
| ATOM | 5953 | CD1 | LEU | D | 137 | −23.602 | −52.697 | 125.252 | 1.00 | 20.47 | C |

TABLE 10.4-continued

| | | | | | | | | | |
|---|---|---|---|---|---|---|---|---|---|
| ATOM | 5954 | CD2 | LEU | D | 137 | −21.943 | −50.875 | 124.827 | 1.00 | 21.46 | C |
| ATOM | 5955 | N | ASN | D | 138 | −27.531 | −48.732 | 124.806 | 1.00 | 30.48 | N |
| ATOM | 5956 | CA | ASN | D | 138 | −28.551 | −47.836 | 124.285 | 1.00 | 28.96 | C |
| ATOM | 5957 | C | ASN | D | 138 | −28.215 | −46.368 | 124.560 | 1.00 | 31.63 | C |
| ATOM | 5958 | O | ASN | D | 138 | −27.933 | −45.994 | 125.705 | 1.00 | 33.79 | O |
| ATOM | 5959 | CB | ASN | D | 138 | −29.904 | −48.179 | 124.900 | 1.00 | 27.28 | C |
| ATOM | 5960 | CG | ASN | D | 138 | −31.052 | −47.802 | 124.004 | 1.00 | 31.25 | C |
| ATOM | 5961 | OD1 | ASN | D | 138 | −31.153 | −48.280 | 122.875 | 1.00 | 36.62 | O |
| ATOM | 5962 | ND2 | ASN | D | 138 | −31.880 | −46.874 | 124.463 | 1.00 | 36.73 | N |
| ATOM | 5963 | N | ASN | D | 139 | −28.258 | −45.549 | 123.495 | 1.00 | 33.24 | N |
| ATOM | 5964 | CA | ASN | D | 139 | −28.250 | −44.074 | 123.524 | 1.00 | 28.78 | C |
| ATOM | 5965 | C | ASN | D | 139 | −27.036 | −43.490 | 124.238 | 1.00 | 27.30 | C |
| ATOM | 5966 | O | ASN | D | 139 | −27.168 | −42.799 | 125.238 | 1.00 | 35.75 | O |
| ATOM | 5967 | CB | ASN | D | 139 | −29.520 | −43.529 | 124.171 | 1.00 | 27.41 | C |
| ATOM | 5968 | CG | ASN | D | 139 | −30.755 | −43.820 | 123.364 | 1.00 | 34.79 | C |
| ATOM | 5969 | OD1 | ASN | D | 139 | −30.693 | −44.255 | 122.215 | 1.00 | 31.67 | O |
| ATOM | 5970 | ND2 | ASN | D | 139 | −31.903 | −43.606 | 123.985 | 1.00 | 49.31 | N |
| ATOM | 5971 | N | PHE | D | 140 | −25.853 | −43.720 | 123.683 | 1.00 | 28.66 | N |
| ATOM | 5972 | CA | PHE | D | 140 | −24.631 | −43.200 | 124.279 | 1.00 | 30.52 | C |
| ATOM | 5973 | C | PHE | D | 140 | −23.895 | −42.295 | 123.301 | 1.00 | 30.45 | C |
| ATOM | 5974 | O | PHE | D | 140 | −24.127 | −42.323 | 122.089 | 1.00 | 31.04 | O |
| ATOM | 5975 | CB | PHE | D | 140 | −23.703 | −44.333 | 124.760 | 1.00 | 27.13 | C |
| ATOM | 5976 | CG | PHE | D | 140 | −23.324 | −45.299 | 123.685 | 1.00 | 30.02 | C |
| ATOM | 5977 | CD1 | PHE | D | 140 | −24.068 | −46.450 | 123.482 | 1.00 | 29.03 | C |
| ATOM | 5978 | CD2 | PHE | D | 140 | −22.224 | −45.059 | 122.868 | 1.00 | 27.79 | C |
| ATOM | 5979 | CE1 | PHE | D | 140 | −23.724 | −47.344 | 122.477 | 1.00 | 28.63 | C |
| ATOM | 5980 | CE2 | PHE | D | 140 | −21.869 | −45.950 | 121.866 | 1.00 | 25.04 | C |
| ATOM | 5981 | CZ | PHE | D | 140 | −22.619 | −47.090 | 121.666 | 1.00 | 25.93 | C |
| ATOM | 5982 | N | TYR | D | 141 | −23.033 | −41.452 | 123.855 | 1.00 | 27.31 | N |
| ATOM | 5983 | CA | TYR | D | 141 | −22.138 | −40.640 | 123.059 | 1.00 | 29.62 | C |
| ATOM | 5984 | C | TYR | D | 141 | −20.895 | −40.416 | 123.882 | 1.00 | 30.14 | C |
| ATOM | 5985 | O | TYR | D | 141 | −21.002 | −40.131 | 125.060 | 1.00 | 31.98 | O |
| ATOM | 5986 | CB | TYR | D | 141 | −22.777 | −39.292 | 122.657 | 1.00 | 30.01 | C |
| ATOM | 5987 | CG | TYR | D | 141 | −21.868 | −38.536 | 121.719 | 1.00 | 28.91 | C |
| ATOM | 5988 | CD1 | TYR | D | 141 | −21.906 | −38.764 | 120.356 | 1.00 | 24.75 | C |
| ATOM | 5989 | CD2 | TYR | D | 141 | −20.915 | −37.652 | 122.207 | 1.00 | 33.08 | C |
| ATOM | 5990 | CE1 | TYR | D | 141 | −21.055 | −38.124 | 119.505 | 1.00 | 27.43 | C |
| ATOM | 5991 | CE2 | TYR | D | 141 | −20.049 | −36.991 | 121.353 | 1.00 | 32.86 | C |
| ATOM | 5992 | CZ | TYR | D | 141 | −20.123 | −37.233 | 119.999 | 1.00 | 31.49 | C |
| ATOM | 5993 | OH | TYR | D | 141 | −19.254 | −36.584 | 119.149 | 1.00 | 29.36 | O |
| ATOM | 5994 | N | PRO | D | 142 | −19.704 | −40.530 | 123.272 | 1.00 | 33.14 | N |
| ATOM | 5995 | CA | PRO | D | 142 | −19.424 | −40.777 | 121.853 | 1.00 | 31.33 | C |
| ATOM | 5996 | C | PRO | D | 142 | −19.435 | −42.241 | 121.404 | 1.00 | 31.01 | C |
| ATOM | 5997 | O | PRO | D | 142 | −19.806 | −43.143 | 122.140 | 1.00 | 30.96 | O |
| ATOM | 5998 | CB | PRO | D | 142 | −18.028 | −40.201 | 121.691 | 1.00 | 27.46 | C |
| ATOM | 5999 | CG | PRO | D | 142 | −17.393 | −40.495 | 123.007 | 1.00 | 28.61 | C |
| ATOM | 6000 | CD | PRO | D | 142 | −18.464 | −40.243 | 124.019 | 1.00 | 27.72 | C |
| ATOM | 6001 | N | ARG | D | 143 | −18.974 | −42.430 | 120.167 | 1.00 | 35.41 | N |
| ATOM | 6002 | CA | ARG | D | 143 | −19.142 | −43.686 | 119.441 | 1.00 | 32.43 | C |
| ATOM | 6003 | C | ARG | D | 143 | −18.410 | −44.842 | 120.111 | 1.00 | 35.51 | C |
| ATOM | 6004 | O | ARG | D | 143 | −18.897 | −45.974 | 120.120 | 1.00 | 39.91 | O |
| ATOM | 6005 | CB | ARG | D | 143 | −18.633 | −43.477 | 118.018 | 1.00 | 36.16 | C |
| ATOM | 6006 | CG | ARG | D | 143 | −18.522 | −44.686 | 117.126 | 1.00 | 44.24 | C |
| ATOM | 6007 | CD | ARG | D | 143 | −19.818 | −44.835 | 116.397 | 1.00 | 40.17 | C |
| ATOM | 6008 | NE | ARG | D | 143 | −19.792 | −45.523 | 115.101 | 1.00 | 38.57 | N |
| ATOM | 6009 | CZ | ARG | D | 143 | −19.299 | −46.736 | 114.883 | 1.00 | 38.79 | C |
| ATOM | 6010 | NH1 | ARG | D | 143 | −18.689 | −47.407 | 115.852 | 1.00 | 42.03 | N1+ |
| ATOM | 6011 | NH2 | ARG | D | 143 | −19.395 | −47.265 | 113.675 | 1.00 | 43.44 | N |
| ATOM | 6012 | N | GLU | D | 144 | −17.256 | −44.580 | 120.697 | 1.00 | 31.31 | N |
| ATOM | 6013 | CA | GLU | D | 144 | −16.406 | −45.662 | 121.160 | 1.00 | 30.73 | C |
| ATOM | 6014 | C | GLU | D | 144 | −16.975 | −46.318 | 122.418 | 1.00 | 29.58 | C |
| ATOM | 6015 | O | GLU | D | 144 | −17.308 | −45.649 | 123.397 | 1.00 | 32.43 | O |
| ATOM | 6016 | CB | GLU | D | 144 | −14.994 | −45.126 | 121.391 | 1.00 | 28.89 | C |
| ATOM | 6017 | CG | GLU | D | 144 | −14.361 | −44.583 | 120.090 | 1.00 | 45.09 | C |
| ATOM | 6018 | CD | GLU | D | 144 | −14.920 | −43.198 | 119.638 | 1.00 | 55.20 | C |
| ATOM | 6019 | OE1 | GLU | D | 144 | −15.083 | −42.301 | 120.513 | 1.00 | 49.33 | O |
| ATOM | 6020 | OE2 | GLU | D | 144 | −15.215 | −43.020 | 118.417 | 1.00 | 49.10 | O1− |
| ATOM | 6021 | N | ALA | D | 145 | −17.065 | −47.640 | 122.396 | 1.00 | 25.69 | N |
| ATOM | 6022 | CA | ALA | D | 145 | −17.552 | −48.390 | 123.535 | 1.00 | 29.57 | C |
| ATOM | 6023 | C | ALA | D | 145 | −16.972 | −49.792 | 123.452 | 1.00 | 31.44 | C |
| ATOM | 6024 | O | ALA | D | 145 | −16.702 | −50.304 | 122.364 | 1.00 | 37.00 | O |
| ATOM | 6025 | CB | ALA | D | 145 | −19.095 | −48.415 | 123.584 | 1.00 | 25.18 | C |
| ATOM | 6026 | N | LYS | D | 146 | −16.792 | −50.416 | 124.607 | 1.00 | 31.28 | N |
| ATOM | 6027 | CA | LYS | D | 146 | −16.278 | −51.775 | 124.678 | 1.00 | 35.67 | C |
| ATOM | 6028 | C | LYS | D | 146 | −17.308 | −52.687 | 125.339 | 1.00 | 38.62 | C |
| ATOM | 6029 | O | LYS | D | 146 | −17.790 | −52.390 | 126.436 | 1.00 | 36.49 | O |
| ATOM | 6030 | CB | LYS | D | 146 | −14.972 | −51.810 | 125.466 | 1.00 | 33.50 | C |
| ATOM | 6031 | CG | LYS | D | 146 | −14.242 | −53.136 | 125.440 | 1.00 | 40.82 | C |
| ATOM | 6032 | CD | LYS | D | 146 | −12.883 | −53.049 | 126.167 | 1.00 | 52.07 | C |
| ATOM | 6033 | CE | LYS | D | 146 | −12.130 | −54.385 | 126.127 | 1.00 | 60.61 | C |

TABLE 10.4-continued

| | | | | | | | | | | |
|---|---|---|---|---|---|---|---|---|---|---|
| ATOM | 6034 | NZ | LYS | D | 146 | −10.663 | −54.265 | 126.375 | 1.00 | 71.34 | N1+ |
| ATOM | 6035 | N | VAL | D | 147 | −17.649 | −53.786 | 124.663 | 1.00 | 35.29 | N |
| ATOM | 6036 | CA | VAL | D | 147 | −18.415 | −54.883 | 125.242 | 1.00 | 37.00 | C |
| ATOM | 6037 | C | VAL | D | 147 | −17.443 | −56.024 | 125.497 | 1.00 | 36.93 | C |
| ATOM | 6038 | O | VAL | D | 147 | −16.711 | −56.436 | 124.593 | 1.00 | 43.76 | O |
| ATOM | 6039 | CB | VAL | D | 147 | −19.568 | −55.348 | 124.331 | 1.00 | 32.86 | C |
| ATOM | 6040 | CG1 | VAL | D | 147 | −20.166 | −56.646 | 124.849 | 1.00 | 30.69 | C |
| ATOM | 6041 | CG2 | VAL | D | 147 | −20.638 | −54.322 | 124.288 | 1.00 | 31.55 | C |
| ATOM | 6042 | N | GLN | D | 148 | −17.443 | −56.529 | 126.720 | 1.00 | 35.29 | N |
| ATOM | 6043 | CA | GLN | D | 148 | −16.699 | −57.714 | 127.106 | 1.00 | 36.02 | C |
| ATOM | 6044 | C | GLN | D | 148 | −17.719 | −58.707 | 127.647 | 1.00 | 37.18 | C |
| ATOM | 6045 | O | GLN | D | 148 | −18.459 | −58.386 | 128.579 | 1.00 | 35.76 | O |
| ATOM | 6046 | CB | GLN | D | 148 | −15.637 | −57.350 | 128.153 | 1.00 | 38.02 | C |
| ATOM | 6047 | CG | GLN | D | 148 | −14.870 | −58.512 | 128.744 | 1.00 | 45.95 | C |
| ATOM | 6048 | CD | GLN | D | 148 | −13.798 | −59.062 | 127.806 | 1.00 | 52.43 | C |
| ATOM | 6049 | OE1 | GLN | D | 148 | −13.806 | −60.255 | 127.467 | 1.00 | 49.60 | O |
| ATOM | 6050 | NE2 | GLN | D | 148 | −12.857 | −58.196 | 127.398 | 1.00 | 47.07 | N |
| ATOM | 6051 | N | TRP | D | 149 | −17.787 | −59.886 | 127.037 | 1.00 | 36.10 | N |
| ATOM | 6052 | CA | TRP | D | 149 | −18.680 | −60.955 | 127.473 | 1.00 | 37.96 | C |
| ATOM | 6053 | C | TRP | D | 149 | −17.977 | −61.861 | 128.481 | 1.00 | 35.95 | C |
| ATOM | 6054 | O | TRP | D | 149 | −16.799 | −62.191 | 128.318 | 1.00 | 37.64 | O |
| ATOM | 6055 | CB | TRP | D | 149 | −19.142 | −61.800 | 126.281 | 1.00 | 33.14 | C |
| ATOM | 6056 | CG | TRP | D | 149 | −20.226 | −61.240 | 125.409 | 1.00 | 34.49 | C |
| ATOM | 6057 | CD1 | TRP | D | 149 | −20.083 | −60.721 | 124.147 | 1.00 | 33.46 | C |
| ATOM | 6058 | CD2 | TRP | D | 149 | −21.630 | −61.200 | 125.697 | 1.00 | 36.39 | C |
| ATOM | 6059 | NE1 | TRP | D | 149 | −21.301 | −60.343 | 123.643 | 1.00 | 29.56 | N |
| ATOM | 6060 | CE2 | TRP | D | 149 | −22.272 | −60.620 | 124.571 | 1.00 | 33.79 | C |
| ATOM | 6061 | CE3 | TRP | D | 149 | −22.406 | −61.584 | 126.795 | 1.00 | 31.81 | C |
| ATOM | 6062 | CZ2 | TRP | D | 149 | −23.653 | −60.408 | 124.518 | 1.00 | 28.35 | C |
| ATOM | 6063 | CZ3 | TRP | D | 149 | −23.777 | −61.367 | 126.741 | 1.00 | 37.34 | C |
| ATOM | 6064 | CH2 | TRP | D | 149 | −24.385 | −60.787 | 125.607 | 1.00 | 31.64 | C |
| ATOM | 6065 | N | LYS | D | 150 | −18.700 | −62.265 | 129.526 | 1.00 | 35.84 | N |
| ATOM | 6066 | CA | LYS | D | 150 | −18.195 | −63.242 | 130.494 | 1.00 | 39.20 | C |
| ATOM | 6067 | C | LYS | D | 150 | −19.214 | −64.355 | 130.710 | 1.00 | 34.68 | C |
| ATOM | 6068 | O | LYS | D | 150 | −20.391 | −64.086 | 130.979 | 1.00 | 33.70 | O |
| ATOM | 6069 | CB | LYS | D | 150 | −17.856 | −62.579 | 131.831 | 1.00 | 29.07 | C |
| ATOM | 6070 | CG | LYS | D | 150 | −16.601 | −61.761 | 131.779 | 1.00 | 33.89 | C |
| ATOM | 6071 | CD | LYS | D | 150 | −16.602 | −60.781 | 132.911 | 1.00 | 41.07 | C |
| ATOM | 6072 | CE | LYS | D | 150 | −15.607 | −59.667 | 132.710 | 1.00 | 43.52 | C |
| ATOM | 6073 | NZ | LYS | D | 150 | −15.402 | −58.953 | 134.001 | 1.00 | 45.35 | N1+ |
| ATOM | 6074 | N | VAL | D | 151 | −18.756 | −65.597 | 130.594 | 1.00 | 30.40 | N |
| ATOM | 6075 | CA | VAL | D | 151 | −19.524 | −66.777 | 130.977 | 1.00 | 36.11 | C |
| ATOM | 6076 | C | VAL | D | 151 | −18.820 | −67.400 | 132.176 | 1.00 | 36.89 | C |
| ATOM | 6077 | O | VAL | D | 151 | −17.662 | −67.816 | 132.061 | 1.00 | 34.20 | O |
| ATOM | 6078 | CB | VAL | D | 151 | −19.637 | −67.786 | 129.825 | 1.00 | 37.15 | C |
| ATOM | 6079 | CG1 | VAL | D | 151 | −20.568 | −68.901 | 130.211 | 1.00 | 34.22 | C |
| ATOM | 6080 | CG2 | VAL | D | 151 | −20.111 | −67.106 | 128.549 | 1.00 | 38.38 | C |
| ATOM | 6081 | N | ASP | D | 152 | −19.508 | −67.435 | 133.333 | 1.00 | 40.45 | N |
| ATOM | 6082 | CA | ASP | D | 152 | −18.928 | −67.863 | 134.626 | 1.00 | 35.46 | C |
| ATOM | 6083 | C | ASP | D | 152 | −17.564 | −67.218 | 134.854 | 1.00 | 37.61 | C |
| ATOM | 6084 | O | ASP | D | 152 | −16.602 | −67.868 | 135.265 | 1.00 | 40.92 | O |
| ATOM | 6085 | CB | ASP | D | 152 | −18.833 | −69.391 | 134.739 | 1.00 | 34.39 | C |
| ATOM | 6086 | CG | ASP | D | 152 | −20.200 | −70.051 | 134.992 | 1.00 | 43.58 | C |
| ATOM | 6087 | OD1 | ASP | D | 152 | −21.057 | −69.424 | 135.659 | 1.00 | 44.13 | O |
| ATOM | 6088 | OD2 | ASP | D | 152 | −20.411 | −71.206 | 134.549 | 1.00 | 44.21 | O1− |
| ATOM | 6089 | N | ASN | D | 153 | −17.493 | −65.920 | 134.560 | 1.00 | 36.04 | N |
| ATOM | 6090 | CA | ASN | D | 153 | −16.305 | −65.088 | 134.682 | 1.00 | 34.97 | C |
| ATOM | 6091 | C | ASN | D | 153 | −15.188 | −65.521 | 133.737 | 1.00 | 37.78 | C |
| ATOM | 6092 | O | ASN | D | 153 | −14.015 | −65.140 | 133.922 | 1.00 | 36.32 | O |
| ATOM | 6093 | CB | ASN | D | 153 | −15.802 | −65.009 | 136.126 | 1.00 | 33.76 | C |
| ATOM | 6094 | CG | ASN | D | 153 | −15.114 | −63.678 | 136.417 | 1.00 | 42.55 | C |
| ATOM | 6095 | OD1 | ASN | D | 153 | −15.704 | −62.598 | 136.248 | 1.00 | 42.84 | O |
| ATOM | 6096 | ND2 | ASN | D | 153 | −13.853 | −63.747 | 136.831 | 1.00 | 46.83 | N |
| ATOM | 6097 | N | ALA | D | 154 | −15.521 | −66.293 | 132.706 | 1.00 | 34.52 | N |
| ATOM | 6098 | CA | ALA | D | 154 | −14.577 | −66.555 | 131.629 | 1.00 | 35.50 | C |
| ATOM | 6099 | C | ALA | D | 154 | −14.784 | −65.526 | 130.521 | 1.00 | 38.64 | C |
| ATOM | 6100 | O | ALA | D | 154 | −15.880 | −65.417 | 129.954 | 1.00 | 35.76 | O |
| ATOM | 6101 | CB | ALA | D | 154 | −14.727 | −67.973 | 131.090 | 1.00 | 31.21 | C |
| ATOM | 6102 | N | LEU | D | 155 | −13.725 | −64.775 | 130.223 | 1.00 | 39.22 | N |
| ATOM | 6103 | CA | LEU | D | 155 | −13.728 | −63.839 | 129.108 | 1.00 | 34.49 | C |
| ATOM | 6104 | C | LEU | D | 155 | −13.970 | −64.578 | 127.815 | 1.00 | 31.95 | C |
| ATOM | 6105 | O | LEU | D | 155 | −13.276 | −65.550 | 127.518 | 1.00 | 33.49 | O |
| ATOM | 6106 | CB | LEU | D | 155 | −12.391 | −63.125 | 129.038 | 1.00 | 36.99 | C |
| ATOM | 6107 | CG | LEU | D | 155 | −12.350 | −61.800 | 129.779 | 1.00 | 48.06 | C |
| ATOM | 6108 | CD1 | LEU | D | 155 | −12.181 | −62.015 | 131.301 | 1.00 | 43.48 | C |
| ATOM | 6109 | CD2 | LEU | D | 155 | −11.219 | −60.978 | 129.190 | 1.00 | 51.82 | C |
| ATOM | 6110 | N | GLN | D | 156 | −14.996 | −64.166 | 127.080 | 1.00 | 36.40 | N |
| ATOM | 6111 | CA | GLN | D | 156 | −15.212 | −64.660 | 125.725 | 1.00 | 35.33 | C |
| ATOM | 6112 | C | GLN | D | 156 | −14.505 | −63.750 | 124.725 | 1.00 | 31.08 | C |
| ATOM | 6113 | O | GLN | D | 156 | −14.665 | −62.526 | 124.763 | 1.00 | 36.72 | O |

TABLE 10.4-continued

| | | | | | | | | | | |
|---|---|---|---|---|---|---|---|---|---|---|
| ATOM | 6114 | CB | GLN | D | 156 | −16.703 | −64.738 | 125.398 | 1.00 | 32.10 | C |
| ATOM | 6115 | CG | GLN | D | 156 | −17.523 | −65.447 | 126.450 | 1.00 | 35.66 | C |
| ATOM | 6116 | CD | GLN | D | 156 | −17.059 | −66.878 | 126.701 | 1.00 | 36.63 | C |
| ATOM | 6117 | OE1 | GLN | D | 156 | −17.090 | −67.722 | 125.804 | 1.00 | 31.49 | O |
| ATOM | 6118 | NE2 | GLN | D | 156 | −16.638 | −67.153 | 127.929 | 1.00 | 35.80 | N |
| ATOM | 6119 | N | SER | D | 157 | −13.790 | −64.354 | 123.795 | 1.00 | 24.35 | N |
| ATOM | 6120 | CA | SER | D | 157 | −13.068 | −63.629 | 122.758 | 1.00 | 27.71 | C |
| ATOM | 6121 | C | SER | D | 157 | −13.201 | −64.434 | 121.474 | 1.00 | 29.57 | C |
| ATOM | 6122 | O | SER | D | 157 | −12.715 | −65.562 | 121.405 | 1.00 | 31.81 | O |
| ATOM | 6123 | CB | SER | D | 157 | −11.607 | −63.449 | 123.142 | 1.00 | 27.38 | C |
| ATOM | 6124 | OG | SER | D | 157 | −10.897 | −62.800 | 122.115 | 1.00 | 32.95 | O |
| ATOM | 6125 | N | GLY | D | 158 | −13.880 | −63.886 | 120.474 | 1.00 | 25.60 | N |
| ATOM | 6126 | CA | GLY | D | 158 | −13.995 | −64.518 | 119.171 | 1.00 | 23.02 | C |
| ATOM | 6127 | C | GLY | D | 158 | −15.329 | −65.156 | 118.862 | 1.00 | 31.71 | C |
| ATOM | 6128 | O | GLY | D | 158 | −15.544 | −65.567 | 117.710 | 1.00 | 30.83 | O |
| ATOM | 6129 | N | ASN | D | 159 | −16.253 | −65.223 | 119.824 | 1.00 | 28.19 | N |
| ATOM | 6130 | CA | ASN | D | 159 | −17.529 | −65.872 | 119.572 | 1.00 | 22.12 | C |
| ATOM | 6131 | C | ASN | D | 159 | −18.686 | −64.886 | 119.660 | 1.00 | 25.52 | C |
| ATOM | 6132 | O | ASN | D | 159 | −19.803 | −65.268 | 120.002 | 1.00 | 26.86 | O |
| ATOM | 6133 | CB | ASN | D | 159 | −17.749 | −67.054 | 120.516 | 1.00 | 25.99 | C |
| ATOM | 6134 | CG | ASN | D | 159 | −17.495 | −66.712 | 121.997 | 1.00 | 31.94 | C |
| ATOM | 6135 | OD1 | ASN | D | 159 | −17.103 | −65.589 | 122.345 | 1.00 | 28.21 | O |
| ATOM | 6136 | ND2 | ASN | D | 159 | −17.712 | −67.706 | 122.875 | 1.00 | 27.51 | N |
| ATOM | 6137 | N | SER | D | 160 | −18.445 | −63.625 | 119.295 | 1.00 | 27.33 | N |
| ATOM | 6138 | CA | SER | D | 160 | −19.484 | −62.606 | 119.297 | 1.00 | 26.68 | C |
| ATOM | 6139 | C | SER | D | 160 | −19.310 | −61.677 | 118.099 | 1.00 | 24.99 | C |
| ATOM | 6140 | O | SER | D | 160 | −18.224 | −61.571 | 117.525 | 1.00 | 29.23 | O |
| ATOM | 6141 | CB | SER | D | 160 | −19.475 | −61.812 | 120.614 | 1.00 | 27.08 | C |
| ATOM | 6142 | OG | SER | D | 160 | −18.327 | −61.009 | 120.707 | 1.00 | 26.36 | O |
| ATOM | 6143 | N | GLN | D | 161 | −20.407 | −61.024 | 117.708 | 1.00 | 24.70 | N |
| ATOM | 6144 | CA | GLN | D | 161 | −20.404 | −59.998 | 116.667 | 1.00 | 24.60 | C |
| ATOM | 6145 | C | GLN | D | 161 | −21.192 | −58.766 | 117.128 | 1.00 | 29.81 | C |
| ATOM | 6146 | O | GLN | D | 161 | −21.972 | −58.818 | 118.082 | 1.00 | 31.67 | O |
| ATOM | 6147 | CB | GLN | D | 161 | −20.954 | −60.560 | 115.380 | 1.00 | 22.23 | C |
| ATOM | 6148 | CG | GLN | D | 161 | −20.025 | −61.563 | 114.752 | 1.00 | 24.29 | C |
| ATOM | 6149 | CD | GLN | D | 161 | −20.631 | −62.200 | 113.532 | 1.00 | 27.64 | C |
| ATOM | 6150 | OE1 | GLN | D | 161 | −21.466 | −63.098 | 113.629 | 1.00 | 32.76 | O |
| ATOM | 6151 | NE2 | GLN | D | 161 | −20.246 | −61.717 | 112.372 | 1.00 | 23.06 | N |
| ATOM | 6152 | N | GLU | D | 162 | −20.965 | −57.641 | 116.458 | 1.00 | 30.47 | N |
| ATOM | 6153 | CA | GLU | D | 162 | −21.462 | −56.341 | 116.919 | 1.00 | 34.77 | C |
| ATOM | 6154 | C | GLU | D | 162 | −21.983 | −55.478 | 115.772 | 1.00 | 30.23 | C |
| ATOM | 6155 | O | GLU | D | 162 | −21.425 | −55.485 | 114.678 | 1.00 | 26.52 | O |
| ATOM | 6156 | CB | GLU | D | 162 | −20.360 | −55.528 | 117.568 | 1.00 | 32.41 | C |
| ATOM | 6157 | CG | GLU | D | 162 | −20.266 | −55.519 | 119.031 | 1.00 | 32.77 | C |
| ATOM | 6158 | CD | GLU | D | 162 | −19.053 | −54.695 | 119.437 | 1.00 | 41.06 | C |
| ATOM | 6159 | OE1 | GLU | D | 162 | −18.443 | −54.075 | 118.530 | 1.00 | 38.20 | O |
| ATOM | 6160 | OE2 | GLU | D | 162 | −18.704 | −54.667 | 120.637 | 1.00 | 50.77 | O1− |
| ATOM | 6161 | N | SER | D | 163 | −22.953 | −54.617 | 116.084 | 1.00 | 27.60 | N |
| ATOM | 6162 | CA | SER | D | 163 | −23.426 | −53.583 | 115.170 | 1.00 | 27.13 | C |
| ATOM | 6163 | C | SER | D | 163 | −23.656 | −52.284 | 115.923 | 1.00 | 25.97 | C |
| ATOM | 6164 | O | SER | D | 163 | −24.105 | −52.299 | 117.068 | 1.00 | 26.91 | O |
| ATOM | 6165 | CB | SER | D | 163 | −24.781 | −53.931 | 114.531 | 1.00 | 29.47 | C |
| ATOM | 6166 | OG | SER | D | 163 | −24.662 | −54.692 | 113.366 | 1.00 | 32.02 | O |
| ATOM | 6167 | N | VAL | D | 164 | −23.422 | −51.161 | 115.243 | 1.00 | 20.54 | N |
| ATOM | 6168 | CA | VAL | D | 164 | −23.727 | −49.843 | 115.781 | 1.00 | 23.87 | C |
| ATOM | 6169 | C | VAL | D | 164 | −24.632 | −49.109 | 114.794 | 1.00 | 25.79 | C |
| ATOM | 6170 | O | VAL | D | 164 | −24.411 | −49.146 | 113.580 | 1.00 | 28.96 | O |
| ATOM | 6171 | CB | VAL | D | 164 | −22.451 | −49.022 | 116.079 | 1.00 | 27.40 | C |
| ATOM | 6172 | CG1 | VAL | D | 164 | −22.804 | −47.685 | 116.731 | 1.00 | 26.22 | C |
| ATOM | 6173 | CG2 | VAL | D | 164 | −21.543 | −49.782 | 116.997 | 1.00 | 25.86 | C |
| ATOM | 6174 | N | THR | D | 165 | −25.645 | −48.432 | 115.318 | 1.00 | 22.06 | N |
| ATOM | 6175 | CA | THR | D | 165 | −26.530 | −47.661 | 114.471 | 1.00 | 26.12 | C |
| ATOM | 6176 | C | THR | D | 165 | −25.845 | −46.376 | 113.991 | 1.00 | 27.66 | C |
| ATOM | 6177 | O | THR | D | 165 | −24.781 | −45.984 | 114.468 | 1.00 | 24.77 | O |
| ATOM | 6178 | CB | THR | D | 165 | −27.813 | −47.311 | 115.216 | 1.00 | 27.08 | C |
| ATOM | 6179 | OG1 | THR | D | 165 | −27.482 | −46.765 | 116.504 | 1.00 | 27.47 | O |
| ATOM | 6180 | CG2 | THR | D | 165 | −28.688 | −48.544 | 115.355 | 1.00 | 26.44 | C |
| ATOM | 6181 | N | GLU | D | 166 | −26.479 | −45.719 | 113.023 | 1.00 | 27.00 | N |
| ATOM | 6182 | CA | GLU | D | 166 | −26.079 | −44.370 | 112.686 | 1.00 | 27.71 | C |
| ATOM | 6183 | C | GLU | D | 166 | −26.495 | −43.432 | 113.817 | 1.00 | 33.03 | C |
| ATOM | 6184 | O | GLU | D | 166 | −27.359 | −43.761 | 114.640 | 1.00 | 33.28 | O |
| ATOM | 6185 | CB | GLU | D | 166 | −26.689 | −43.951 | 111.339 | 1.00 | 30.38 | C |
| ATOM | 6186 | CG | GLU | D | 166 | −26.119 | −44.711 | 110.120 | 1.00 | 25.40 | C |
| ATOM | 6187 | CD | GLU | D | 166 | −24.599 | −44.606 | 110.040 | 1.00 | 38.65 | C |
| ATOM | 6188 | OE1 | GLU | D | 166 | −24.038 | −43.552 | 110.423 | 1.00 | 46.73 | O |
| ATOM | 6189 | OE2 | GLU | D | 166 | −23.946 | −45.597 | 109.652 | 1.00 | 40.23 | O1− |
| ATOM | 6190 | N | GLN | D | 167 | −25.866 | −42.254 | 113.856 | 1.00 | 29.35 | N |
| ATOM | 6191 | CA | GLN | D | 167 | −26.181 | −41.280 | 114.885 | 1.00 | 27.68 | C |
| ATOM | 6192 | C | GLN | D | 167 | −27.675 | −40.977 | 114.888 | 1.00 | 30.18 | C |
| ATOM | 6193 | O | GLN | D | 167 | −28.273 | −40.743 | 113.841 | 1.00 | 28.88 | O |

TABLE 10.4-continued

| | | | | | | | | | | |
|---|---|---|---|---|---|---|---|---|---|---|
| ATOM | 6194 | CB | GLN | D | 167 | −25.371 | −40.014 | 114.663 | 1.00 | 26.86 | C |
| ATOM | 6195 | CG | GLN | D | 167 | −25.050 | −39.318 | 115.952 | 1.00 | 30.75 | C |
| ATOM | 6196 | CD | GLN | D | 167 | −24.012 | −38.230 | 115.810 | 1.00 | 30.88 | C |
| ATOM | 6197 | OE1 | GLN | D | 167 | −23.630 | −37.851 | 114.707 | 1.00 | 26.28 | O |
| ATOM | 6198 | NE2 | GLN | D | 167 | −23.526 | −37.741 | 116.942 | 1.00 | 31.17 | N |
| ATOM | 6199 | N | ASP | D | 168 | −28.284 | −40.993 | 116.073 | 1.00 | 32.93 | N |
| ATOM | 6200 | CA | ASP | D | 168 | −29.740 | −40.995 | 116.145 | 1.00 | 30.89 | C |
| ATOM | 6201 | C | ASP | D | 168 | −30.322 | −39.647 | 115.730 | 1.00 | 32.78 | C |
| ATOM | 6202 | O | ASP | D | 168 | −29.864 | −38.588 | 116.175 | 1.00 | 32.90 | O |
| ATOM | 6203 | CB | ASP | D | 168 | −30.198 | −41.372 | 117.553 | 1.00 | 31.28 | C |
| ATOM | 6204 | CG | ASP | D | 168 | −31.716 | −41.521 | 117.659 | 1.00 | 38.67 | C |
| ATOM | 6205 | OD2 | ASP | D | 168 | −32.352 | −40.708 | 118.357 | 1.00 | 38.36 | O |
| ATOM | 6206 | OD1 | ASP | D | 168 | −32.272 | −42.488 | 117.088 | 1.00 | 46.18 | O1− |
| ATOM | 6207 | N | SER | D | 169 | −31.354 | −39.697 | 114.883 | 1.00 | 39.01 | N |
| ATOM | 6208 | CA | SER | D | 169 | −31.955 | −38.482 | 114.346 | 1.00 | 32.75 | C |
| ATOM | 6209 | C | SER | D | 169 | −32.582 | −37.588 | 115.413 | 1.00 | 37.05 | C |
| ATOM | 6210 | O | SER | D | 169 | −32.812 | −36.404 | 115.145 | 1.00 | 38.37 | O |
| ATOM | 6211 | CB | SER | D | 169 | −33.001 | −38.845 | 113.284 | 1.00 | 39.20 | C |
| ATOM | 6212 | OG | SER | D | 169 | −34.079 | −39.588 | 113.824 | 1.00 | 50.23 | O |
| ATOM | 6213 | N | LYS | D | 170 | −32.814 | −38.077 | 116.629 | 1.00 | 34.51 | N |
| ATOM | 6214 | CA | LYS | D | 170 | −33.421 | −37.203 | 117.625 | 1.00 | 34.07 | C |
| ATOM | 6215 | C | LYS | D | 170 | −32.468 | −36.701 | 118.701 | 1.00 | 33.50 | C |
| ATOM | 6216 | O | LYS | D | 170 | −32.589 | −35.552 | 119.108 | 1.00 | 37.46 | O |
| ATOM | 6217 | CB | LYS | D | 170 | −34.629 | −37.888 | 118.275 | 1.00 | 37.63 | C |
| ATOM | 6218 | CG | LYS | D | 170 | −35.389 | −37.006 | 119.243 | 1.00 | 37.03 | C |
| ATOM | 6219 | CD | LYS | D | 170 | −36.331 | −37.786 | 120.178 | 1.00 | 38.46 | C |
| ATOM | 6220 | CE | LYS | D | 170 | −37.575 | −38.283 | 119.424 | 1.00 | 45.87 | C |
| ATOM | 6221 | NZ | LYS | D | 170 | −38.639 | −38.916 | 120.302 | 1.00 | 39.82 | N1+ |
| ATOM | 6222 | N | ASP | D | 171 | −31.531 | −37.506 | 119.210 | 1.00 | 36.72 | N |
| ATOM | 6223 | CA | ASP | D | 171 | −30.652 | −37.034 | 120.285 | 1.00 | 30.44 | C |
| ATOM | 6224 | C | ASP | D | 171 | −29.163 | −37.175 | 119.956 | 1.00 | 31.83 | C |
| ATOM | 6225 | O | ASP | D | 171 | −28.327 | −37.027 | 120.864 | 1.00 | 24.40 | O |
| ATOM | 6226 | CB | ASP | D | 171 | −30.977 | −37.745 | 121.621 | 1.00 | 24.58 | C |
| ATOM | 6227 | CG | ASP | D | 171 | −30.724 | −39.290 | 121.598 | 1.00 | 37.38 | C |
| ATOM | 6228 | OD1 | ASP | D | 171 | −29.900 | −39.800 | 120.803 | 1.00 | 38.28 | O |
| ATOM | 6229 | OD2 | ASP | D | 171 | −31.345 | −40.026 | 122.402 | 1.00 | 44.17 | O1− |
| ATOM | 6230 | N | SER | D | 172 | −28.814 | −37.467 | 118.691 | 1.00 | 27.49 | N |
| ATOM | 6231 | CA | SER | D | 172 | −27.433 | −37.542 | 118.210 | 1.00 | 29.50 | C |
| ATOM | 6232 | C | SER | D | 172 | −26.575 | −38.575 | 118.954 | 1.00 | 33.88 | C |
| ATOM | 6233 | O | SER | D | 172 | −25.339 | −38.428 | 119.009 | 1.00 | 32.88 | O |
| ATOM | 6234 | CB | SER | D | 172 | −26.756 | −36.167 | 118.283 | 1.00 | 28.79 | C |
| ATOM | 6235 | OG | SER | D | 172 | −27.503 | −35.209 | 117.557 | 1.00 | 32.16 | O |
| ATOM | 6236 | N | THR | D | 173 | −27.185 | −39.602 | 119.550 | 1.00 | 25.27 | N |
| ATOM | 6237 | CA | THR | D | 173 | −26.443 | −40.663 | 120.214 | 1.00 | 26.81 | C |
| ATOM | 6238 | C | THR | D | 173 | −26.265 | −41.868 | 119.287 | 1.00 | 28.18 | C |
| ATOM | 6239 | O | THR | D | 173 | −26.791 | −41.932 | 118.163 | 1.00 | 26.72 | O |
| ATOM | 6240 | CB | THR | D | 173 | −27.127 | −41.101 | 121.529 | 1.00 | 29.20 | C |
| ATOM | 6241 | OG1 | THR | D | 173 | −28.454 | −41.578 | 121.279 | 1.00 | 26.42 | O |
| ATOM | 6242 | CG2 | THR | D | 173 | −27.181 | −39.948 | 122.547 | 1.00 | 27.06 | C |
| ATOM | 6243 | N | TYR | D | 174 | −25.492 | −42.824 | 119.787 | 1.00 | 24.11 | N |
| ATOM | 6244 | CA | TYR | D | 174 | −25.252 | −44.113 | 119.162 | 1.00 | 25.18 | C |
| ATOM | 6245 | C | TYR | D | 174 | −25.858 | −45.225 | 120.001 | 1.00 | 27.09 | C |
| ATOM | 6246 | O | TYR | D | 174 | −25.925 | −45.130 | 121.232 | 1.00 | 26.92 | O |
| ATOM | 6247 | CB | TYR | D | 174 | −23.740 | −44.371 | 118.993 | 1.00 | 24.71 | C |
| ATOM | 6248 | CG | TYR | D | 174 | −23.145 | −43.461 | 117.980 | 1.00 | 27.06 | C |
| ATOM | 6249 | CD1 | TYR | D | 174 | −23.212 | −43.778 | 116.625 | 1.00 | 23.86 | C |
| ATOM | 6250 | CD2 | TYR | D | 174 | −22.587 | −42.234 | 118.355 | 1.00 | 29.38 | C |
| ATOM | 6251 | CE1 | TYR | D | 174 | −22.697 | −42.931 | 115.671 | 1.00 | 28.55 | C |
| ATOM | 6252 | CE2 | TYR | D | 174 | −22.060 | −41.366 | 117.397 | 1.00 | 28.07 | C |
| ATOM | 6253 | CZ | TYR | D | 174 | −22.125 | −41.719 | 116.053 | 1.00 | 30.70 | C |
| ATOM | 6254 | OH | TYR | D | 174 | −21.626 | −40.882 | 115.081 | 1.00 | 29.66 | O |
| ATOM | 6255 | N | SER | D | 175 | −26.220 | −46.318 | 119.329 | 1.00 | 29.12 | N |
| ATOM | 6256 | CA | SER | D | 175 | −26.623 | −47.546 | 120.005 | 1.00 | 29.70 | C |
| ATOM | 6257 | C | SER | D | 175 | −25.851 | −48.723 | 119.437 | 1.00 | 27.77 | C |
| ATOM | 6258 | O | SER | D | 175 | −25.515 | −48.748 | 118.252 | 1.00 | 26.37 | O |
| ATOM | 6259 | CB | SER | D | 175 | −28.127 | −47.796 | 119.868 | 1.00 | 28.32 | C |
| ATOM | 6260 | OG | SER | D | 175 | −28.822 | −46.950 | 120.755 | 1.00 | 29.89 | O |
| ATOM | 6261 | N | LEU | D | 176 | −25.615 | −49.725 | 120.284 | 1.00 | 29.44 | N |
| ATOM | 6262 | CA | LEU | D | 176 | −24.808 | −50.884 | 119.918 | 1.00 | 26.61 | C |
| ATOM | 6263 | C | LEU | D | 176 | −25.499 | −52.174 | 120.346 | 1.00 | 25.01 | C |
| ATOM | 6264 | O | LEU | D | 176 | −26.055 | −52.255 | 121.444 | 1.00 | 25.06 | O |
| ATOM | 6265 | CB | LEU | D | 176 | −23.412 | −50.791 | 120.557 | 1.00 | 23.61 | C |
| ATOM | 6266 | CG | LEU | D | 176 | −22.361 | −51.831 | 120.176 | 1.00 | 26.86 | C |
| ATOM | 6267 | CD1 | LEU | D | 176 | −20.995 | −51.225 | 120.278 | 1.00 | 28.36 | C |
| ATOM | 6268 | CD2 | LEU | D | 176 | −22.428 | −53.052 | 121.099 | 1.00 | 25.35 | C |
| ATOM | 6269 | N | SER | D | 177 | −25.405 | −53.202 | 119.500 | 1.00 | 26.18 | N |
| ATOM | 6270 | CA | SER | D | 177 | −25.932 | −54.536 | 119.789 | 1.00 | 25.92 | C |
| ATOM | 6271 | C | SER | D | 177 | −24.840 | −55.587 | 119.589 | 1.00 | 25.55 | C |
| ATOM | 6272 | O | SER | D | 177 | −24.136 | −55.566 | 118.577 | 1.00 | 30.42 | O |
| ATOM | 6273 | CB | SER | D | 177 | −27.142 | −54.840 | 118.895 | 1.00 | 30.52 | C |

TABLE 10.4-continued

| ATOM | 6274 | OG | SER | D | 177 | −27.570 | −56.176 | 119.035 | 1.00 | 31.20 | O |
|---|---|---|---|---|---|---|---|---|---|---|---|
| ATOM | 6275 | N | SER | D | 178 | −24.668 | −56.474 | 120.574 | 1.00 | 28.18 | N |
| ATOM | 6276 | CA | SER | D | 178 | −23.659 | −57.527 | 120.542 | 1.00 | 25.27 | C |
| ATOM | 6277 | C | SER | D | 178 | −24.288 | −58.885 | 120.794 | 1.00 | 26.75 | C |
| ATOM | 6278 | O | SER | D | 178 | −25.102 | −59.040 | 121.705 | 1.00 | 31.18 | O |
| ATOM | 6279 | CB | SER | D | 178 | −22.560 | −57.312 | 121.568 | 1.00 | 30.71 | C |
| ATOM | 6280 | OG | SER | D | 178 | −21.592 | −58.348 | 121.447 | 1.00 | 32.24 | O |
| ATOM | 6281 | N | THR | D | 179 | −23.888 | −59.880 | 120.010 | 1.00 | 27.93 | N |
| ATOM | 6282 | CA | THR | D | 179 | −24.458 | −61.220 | 120.122 | 1.00 | 29.75 | C |
| ATOM | 6283 | C | THR | D | 179 | −23.379 | −62.248 | 120.444 | 1.00 | 31.38 | C |
| ATOM | 6284 | O | THR | D | 179 | −22.529 | −62.546 | 119.604 | 1.00 | 25.41 | O |
| ATOM | 6285 | CB | THR | D | 179 | −25.160 | −61.608 | 118.837 | 1.00 | 32.19 | C |
| ATOM | 6286 | OG1 | THR | D | 179 | −26.110 | −60.586 | 118.488 | 1.00 | 42.39 | O |
| ATOM | 6287 | CG2 | THR | D | 179 | −25.841 | −62.933 | 119.026 | 1.00 | 33.94 | C |
| ATOM | 6288 | N | LEU | D | 180 | −23.448 | −62.822 | 121.641 | 1.00 | 33.64 | N |
| ATOM | 6289 | CA | LEU | D | 180 | −22.651 | −63.988 | 121.989 | 1.00 | 26.84 | C |
| ATOM | 6290 | C | LEU | D | 180 | −23.377 | −65.233 | 121.509 | 1.00 | 28.96 | C |
| ATOM | 6291 | O | LEU | D | 180 | −24.576 | −65.383 | 121.759 | 1.00 | 33.24 | O |
| ATOM | 6292 | CB | LEU | D | 180 | −22.446 | −64.042 | 123.496 | 1.00 | 26.91 | C |
| ATOM | 6293 | CG | LEU | D | 180 | −21.584 | −65.169 | 124.035 | 1.00 | 32.83 | C |
| ATOM | 6294 | CD1 | LEU | D | 180 | −20.179 | −64.954 | 123.541 | 1.00 | 32.39 | C |
| ATOM | 6295 | CD2 | LEU | D | 180 | −21.624 | −65.196 | 125.566 | 1.00 | 35.83 | C |
| ATOM | 6296 | N | THR | D | 181 | −22.683 | −66.101 | 120.784 | 1.00 | 24.60 | N |
| ATOM | 6297 | CA | THR | D | 181 | −23.289 | −67.321 | 120.267 | 1.00 | 29.40 | C |
| ATOM | 6298 | C | THR | D | 181 | −22.656 | −68.546 | 120.928 | 1.00 | 35.38 | C |
| ATOM | 6299 | O | THR | D | 181 | −21.430 | −68.622 | 121.063 | 1.00 | 32.82 | O |
| ATOM | 6300 | CB | THR | D | 181 | −23.162 | −67.393 | 118.744 | 1.00 | 29.01 | C |
| ATOM | 6301 | OG1 | THR | D | 181 | −23.762 | −66.235 | 118.169 | 1.00 | 36.58 | O |
| ATOM | 6302 | CG2 | THR | D | 181 | −23.943 | −68.571 | 118.214 | 1.00 | 35.08 | C |
| ATOM | 6303 | N | LEU | D | 182 | −23.499 | −69.481 | 121.375 | 1.00 | 33.54 | N |
| ATOM | 6304 | CA | LEU | D | 182 | −23.061 | −70.743 | 121.957 | 1.00 | 31.73 | C |
| ATOM | 6305 | C | LEU | D | 182 | −23.908 | −71.860 | 121.379 | 1.00 | 38.06 | C |
| ATOM | 6306 | O | LEU | D | 182 | −25.010 | −71.638 | 120.866 | 1.00 | 39.76 | O |
| ATOM | 6307 | CB | LEU | D | 182 | −23.242 | −70.791 | 123.473 | 1.00 | 34.20 | C |
| ATOM | 6308 | CG | LEU | D | 182 | −22.667 | −69.731 | 124.395 | 1.00 | 37.93 | C |
| ATOM | 6309 | CD1 | LEU | D | 182 | −23.089 | −70.021 | 125.827 | 1.00 | 39.29 | C |
| ATOM | 6310 | CD2 | LEU | D | 182 | −21.154 | −69.692 | 124.276 | 1.00 | 41.23 | C |
| ATOM | 6311 | N | SER | D | 183 | −23.401 | −73.075 | 121.491 | 1.00 | 41.78 | N |
| ATOM | 6312 | CA | SER | D | 183 | −24.276 | −74.218 | 121.302 | 1.00 | 41.97 | C |
| ATOM | 6313 | C | SER | D | 183 | −25.171 | −74.354 | 122.533 | 1.00 | 40.93 | C |
| ATOM | 6314 | O | SER | D | 183 | −24.832 | −73.874 | 123.619 | 1.00 | 39.70 | O |
| ATOM | 6315 | CB | SER | D | 183 | −23.449 | −75.481 | 121.071 | 1.00 | 42.62 | C |
| ATOM | 6316 | OG | SER | D | 183 | −22.677 | −75.783 | 122.224 | 1.00 | 45.39 | O |
| ATOM | 6317 | N | LYS | D | 184 | −26.323 | −75.017 | 122.368 | 1.00 | 38.98 | N |
| ATOM | 6318 | CA | LYS | D | 184 | −27.172 | −75.267 | 123.536 | 1.00 | 46.77 | C |
| ATOM | 6319 | C | LYS | D | 184 | −26.428 | −76.067 | 124.602 | 1.00 | 45.69 | C |
| ATOM | 6320 | O | LYS | D | 184 | −26.586 | −75.820 | 125.806 | 1.00 | 44.13 | O |
| ATOM | 6321 | CB | LYS | D | 184 | −28.465 | −75.982 | 123.135 | 1.00 | 52.78 | C |
| ATOM | 6322 | CG | LYS | D | 184 | −29.383 | −76.279 | 124.334 | 1.00 | 45.82 | C |
| ATOM | 6323 | CD | LYS | D | 184 | −30.721 | −76.916 | 123.925 | 1.00 | 49.11 | C |
| ATOM | 6324 | CE | LYS | D | 184 | −30.567 | −78.342 | 123.414 | 1.00 | 56.53 | C |
| ATOM | 6325 | NZ | LYS | D | 184 | −31.811 | −78.834 | 122.761 | 1.00 | 58.33 | N1+ |
| ATOM | 6326 | N | ALA | D | 185 | −25.599 | −77.019 | 124.172 | 1.00 | 44.49 | N |
| ATOM | 6327 | CA | ALA | D | 185 | −24.835 | −77.822 | 125.116 | 1.00 | 44.16 | C |
| ATOM | 6328 | C | ALA | D | 185 | −23.903 | −76.953 | 125.958 | 1.00 | 46.66 | C |
| ATOM | 6329 | O | ALA | D | 185 | −23.932 | −77.018 | 127.193 | 1.00 | 48.01 | O |
| ATOM | 6330 | CB | ALA | D | 185 | −24.067 | −78.902 | 124.363 | 1.00 | 43.48 | C |
| ATOM | 6331 | N | ASP | D | 186 | −23.057 | −76.142 | 125.307 | 1.00 | 47.56 | N |
| ATOM | 6332 | CA | ASP | D | 186 | −22.203 | −75.208 | 126.042 | 1.00 | 43.67 | C |
| ATOM | 6333 | C | ASP | D | 186 | −23.040 | −74.263 | 126.887 | 1.00 | 41.82 | C |
| ATOM | 6334 | O | ASP | D | 186 | −22.744 | −74.029 | 128.065 | 1.00 | 43.44 | O |
| ATOM | 6335 | CB | ASP | D | 186 | −21.334 | −74.400 | 125.079 | 1.00 | 47.25 | C |
| ATOM | 6336 | CG | ASP | D | 186 | −20.218 | −75.210 | 124.472 | 1.00 | 49.80 | C |
| ATOM | 6337 | OD1 | ASP | D | 186 | −19.524 | −75.925 | 125.218 | 1.00 | 51.32 | O |
| ATOM | 6338 | OD2 | ASP | D | 186 | −20.038 | −75.131 | 123.241 | 1.00 | 59.81 | O1− |
| ATOM | 6339 | N | TYR | D | 187 | −24.100 | −73.713 | 126.296 | 1.00 | 42.10 | N |
| ATOM | 6340 | CA | TYR | D | 187 | −24.958 | −72.799 | 127.030 | 1.00 | 42.00 | C |
| ATOM | 6341 | C | TYR | D | 187 | −25.446 | −73.439 | 128.322 | 1.00 | 40.74 | C |
| ATOM | 6342 | O | TYR | D | 187 | −25.462 | −72.797 | 129.381 | 1.00 | 36.12 | O |
| ATOM | 6343 | CB | TYR | D | 187 | −26.148 | −72.356 | 126.154 | 1.00 | 35.24 | C |
| ATOM | 6344 | CG | TYR | D | 187 | −27.113 | −71.482 | 126.924 | 1.00 | 36.73 | C |
| ATOM | 6345 | CD1 | TYR | D | 187 | −26.712 | −70.236 | 127.403 | 1.00 | 33.83 | C |
| ATOM | 6346 | CD2 | TYR | D | 187 | −28.407 | −71.905 | 127.202 | 1.00 | 37.83 | C |
| ATOM | 6347 | CE1 | TYR | D | 187 | −27.570 | −69.443 | 128.137 | 1.00 | 35.37 | C |
| ATOM | 6348 | CE2 | TYR | D | 187 | −29.278 | −71.112 | 127.932 | 1.00 | 36.87 | C |
| ATOM | 6349 | CZ | TYR | D | 187 | −28.848 | −69.883 | 128.404 | 1.00 | 34.37 | C |
| ATOM | 6350 | OH | TYR | D | 187 | −29.704 | −69.082 | 129.125 | 1.00 | 33.53 | O |
| ATOM | 6351 | N | GLU | D | 188 | −25.818 | −74.715 | 128.266 | 1.00 | 44.28 | N |
| ATOM | 6352 | CA | GLU | D | 188 | −26.463 | −75.311 | 129.426 | 1.00 | 48.57 | C |
| ATOM | 6353 | C | GLU | D | 188 | −25.494 | −75.827 | 130.473 | 1.00 | 44.50 | C |

TABLE 10.4-continued

| ATOM | 6354 | O | GLU | D | 188 | −25.954 | −76.294 | 131.513 | 1.00 | 43.86 | O |
| --- | --- | --- | --- | --- | --- | --- | --- | --- | --- | --- | --- |
| ATOM | 6355 | CB | GLU | D | 188 | −27.384 | −76.431 | 128.984 | 1.00 | 46.87 | C |
| ATOM | 6356 | CG | GLU | D | 188 | −28.803 | −75.966 | 128.881 | 1.00 | 52.89 | C |
| ATOM | 6357 | CD | GLU | D | 188 | −29.586 | −76.862 | 127.993 | 1.00 | 60.48 | C |
| ATOM | 6358 | OE1 | GLU | D | 188 | −28.963 | −77.811 | 127.472 | 1.00 | 63.90 | O |
| ATOM | 6359 | OE2 | GLU | D | 188 | −30.800 | −76.623 | 127.817 | 1.00 | 70.92 | O1− |
| ATOM | 6360 | N | LYS | D | 189 | −24.184 | −75.709 | 130.249 | 1.00 | 42.21 | N |
| ATOM | 6361 | CA | LYS | D | 189 | −23.166 | −76.082 | 131.214 | 1.00 | 34.10 | C |
| ATOM | 6362 | C | LYS | D | 189 | −22.659 | −74.905 | 132.027 | 1.00 | 41.19 | C |
| ATOM | 6363 | O | LYS | D | 189 | −21.617 | −75.025 | 132.675 | 1.00 | 43.76 | O |
| ATOM | 6364 | CB | LYS | D | 189 | −21.981 | −76.727 | 130.501 | 1.00 | 42.21 | C |
| ATOM | 6365 | CG | LYS | D | 189 | −22.277 | −78.025 | 129.749 | 1.00 | 49.04 | C |
| ATOM | 6366 | CD | LYS | D | 189 | −21.065 | −78.418 | 128.889 | 1.00 | 50.62 | C |
| ATOM | 6367 | CE | LYS | D | 189 | −21.332 | −79.669 | 128.071 | 1.00 | 61.29 | C |
| ATOM | 6368 | NZ | LYS | D | 189 | −20.165 | −79.960 | 127.197 | 1.00 | 67.56 | N1+ |
| ATOM | 6369 | N | HIS | D | 190 | −23.349 | −73.768 | 132.011 | 1.00 | 40.38 | N |
| ATOM | 6370 | CA | HIS | D | 190 | −22.850 | −72.595 | 132.712 | 1.00 | 37.11 | C |
| ATOM | 6371 | C | HIS | D | 190 | −24.018 | −71.833 | 133.309 | 1.00 | 37.04 | C |
| ATOM | 6372 | O | HIS | D | 190 | −25.167 | −72.014 | 132.913 | 1.00 | 39.95 | O |
| ATOM | 6373 | CB | HIS | D | 190 | −22.044 | −71.702 | 131.782 | 1.00 | 41.03 | C |
| ATOM | 6374 | CG | HIS | D | 190 | −20.840 | −72.376 | 131.212 | 1.00 | 41.24 | C |
| ATOM | 6375 | ND1 | HIS | D | 190 | −19.759 | −72.747 | 131.983 | 1.00 | 41.48 | N |
| ATOM | 6376 | CD2 | HIS | D | 190 | −20.560 | −72.778 | 129.951 | 1.00 | 39.46 | C |
| ATOM | 6377 | CE1 | HIS | D | 190 | −18.856 | −73.333 | 131.218 | 1.00 | 36.30 | C |
| ATOM | 6378 | NE2 | HIS | D | 190 | −19.320 | −73.368 | 129.981 | 1.00 | 39.82 | N |
| ATOM | 6379 | N | LYS | D | 191 | −23.719 | −70.969 | 134.270 | 1.00 | 34.63 | N |
| ATOM | 6380 | CA | LYS | D | 191 | −24.775 | −70.340 | 135.046 | 1.00 | 45.76 | C |
| ATOM | 6381 | C | LYS | D | 191 | −24.874 | −68.842 | 134.790 | 1.00 | 46.36 | C |
| ATOM | 6382 | O | LYS | D | 191 | −25.944 | −68.357 | 134.407 | 1.00 | 46.07 | O |
| ATOM | 6383 | CB | LYS | D | 191 | −24.566 | −70.607 | 136.548 | 1.00 | 42.22 | C |
| ATOM | 6384 | CG | LYS | D | 191 | −25.568 | −69.875 | 137.451 | 1.00 | 49.74 | C |
| ATOM | 6385 | CD | LYS | D | 191 | −25.227 | −70.029 | 138.954 | 1.00 | 59.90 | C |
| ATOM | 6386 | CE | LYS | D | 191 | −26.350 | −69.510 | 139.853 | 1.00 | 60.67 | C |
| ATOM | 6387 | NZ | LYS | D | 191 | −26.031 | −69.671 | 141.293 | 1.00 | 66.07 | N1+ |
| ATOM | 6388 | N | VAL | D | 192 | −23.782 | −68.100 | 134.968 | 1.00 | 39.06 | N |
| ATOM | 6389 | CA | VAL | D | 192 | −23.809 | −66.644 | 134.941 | 1.00 | 38.75 | C |
| ATOM | 6390 | C | VAL | D | 192 | −23.378 | −66.173 | 133.553 | 1.00 | 39.96 | C |
| ATOM | 6391 | O | VAL | D | 192 | −22.277 | −66.490 | 133.091 | 1.00 | 41.97 | O |
| ATOM | 6392 | CB | VAL | D | 192 | −22.906 | −66.063 | 136.039 | 1.00 | 36.31 | C |
| ATOM | 6393 | CG1 | VAL | D | 192 | −22.876 | −64.544 | 135.989 | 1.00 | 34.38 | C |
| ATOM | 6394 | CG2 | VAL | D | 192 | −23.360 | −66.548 | 137.380 | 1.00 | 41.02 | C |
| ATOM | 6395 | N | TYR | D | 193 | −24.241 | −65.414 | 132.886 | 1.00 | 38.30 | N |
| ATOM | 6396 | CA | TYR | D | 193 | −23.924 | −64.789 | 131.608 | 1.00 | 35.90 | C |
| ATOM | 6397 | C | TYR | D | 193 | −23.862 | −63.290 | 131.845 | 1.00 | 33.90 | C |
| ATOM | 6398 | O | TYR | D | 193 | −24.747 | −62.734 | 132.487 | 1.00 | 36.52 | O |
| ATOM | 6399 | CB | TYR | D | 193 | −24.957 | −65.165 | 130.534 | 1.00 | 31.33 | C |
| ATOM | 6400 | CG | TYR | D | 193 | −24.828 | −66.629 | 130.183 | 1.00 | 35.91 | C |
| ATOM | 6401 | CD1 | TYR | D | 193 | −25.458 | −67.608 | 130.950 | 1.00 | 38.83 | C |
| ATOM | 6402 | CD2 | TYR | D | 193 | −23.971 | −67.049 | 129.171 | 1.00 | 38.88 | C |
| ATOM | 6403 | CE1 | TYR | D | 193 | −25.297 | −68.968 | 130.671 | 1.00 | 36.63 | C |
| ATOM | 6404 | CE2 | TYR | D | 193 | −23.799 | −68.410 | 128.885 | 1.00 | 39.70 | C |
| ATOM | 6405 | CZ | TYR | D | 193 | −24.461 | −69.359 | 129.646 | 1.00 | 36.21 | C |
| ATOM | 6406 | OH | TYR | D | 193 | −24.302 | −70.691 | 129.360 | 1.00 | 37.29 | O |
| ATOM | 6407 | N | ALA | D | 194 | −22.791 | −62.646 | 131.400 | 1.00 | 33.30 | N |
| ATOM | 6408 | CA | ALA | D | 194 | −22.654 | −61.226 | 131.670 | 1.00 | 34.22 | C |
| ATOM | 6409 | C | ALA | D | 194 | −22.000 | −60.510 | 130.488 | 1.00 | 36.04 | C |
| ATOM | 6410 | O | ALA | D | 194 | −21.164 | −61.083 | 129.782 | 1.00 | 35.02 | O |
| ATOM | 6411 | CB | ALA | D | 194 | −21.857 | −61.026 | 132.952 | 1.00 | 29.25 | C |
| ATOM | 6412 | N | CYS | D | 195 | −22.396 | −59.254 | 130.263 | 1.00 | 32.88 | N |
| ATOM | 6413 | CA | CYS | D | 195 | −21.638 | −58.361 | 129.389 | 1.00 | 39.71 | C |
| ATOM | 6414 | C | CYS | D | 195 | −21.246 | −57.121 | 130.170 | 1.00 | 37.39 | C |
| ATOM | 6415 | O | CYS | D | 195 | −22.084 | −56.498 | 130.839 | 1.00 | 33.62 | O |
| ATOM | 6416 | CB | CYS | D | 195 | −22.382 | −57.939 | 128.108 | 1.00 | 39.73 | C |
| ATOM | 6417 | SG | CYS | D | 195 | −23.983 | −57.183 | 128.349 | 1.00 | 55.69 | S |
| ATOM | 6418 | N | GLU | D | 196 | −19.981 | −56.753 | 130.035 | 1.00 | 33.07 | N |
| ATOM | 6419 | CA | GLU | D | 196 | −19.377 | −55.641 | 130.742 | 1.00 | 38.70 | C |
| ATOM | 6420 | C | GLU | D | 196 | −19.127 | −54.523 | 129.734 | 1.00 | 35.02 | C |
| ATOM | 6421 | O | GLU | D | 196 | −18.610 | −54.777 | 128.639 | 1.00 | 28.28 | O |
| ATOM | 6422 | CB | GLU | D | 196 | −18.078 | −56.104 | 131.410 | 1.00 | 35.85 | C |
| ATOM | 6423 | CG | GLU | D | 196 | −17.366 | −55.070 | 132.220 | 1.00 | 39.77 | C |
| ATOM | 6424 | CD | GLU | D | 196 | −15.962 | −55.516 | 132.610 | 1.00 | 46.03 | C |
| ATOM | 6425 | OE1 | GLU | D | 196 | −15.435 | −56.465 | 131.988 | 1.00 | 40.61 | O |
| ATOM | 6426 | OE2 | GLU | D | 196 | −15.373 | −54.880 | 133.511 | 1.00 | 57.77 | O1− |
| ATOM | 6427 | N | VAL | D | 197 | −19.512 | −53.297 | 130.097 | 1.00 | 34.66 | N |
| ATOM | 6428 | CA | VAL | D | 197 | −19.563 | −52.169 | 129.169 | 1.00 | 35.82 | C |
| ATOM | 6429 | C | VAL | D | 197 | −18.595 | −51.112 | 129.680 | 1.00 | 34.18 | C |
| ATOM | 6430 | O | VAL | D | 197 | −18.751 | −50.610 | 130.797 | 1.00 | 35.27 | O |
| ATOM | 6431 | CB | VAL | D | 197 | −20.993 | −51.601 | 129.024 | 1.00 | 31.64 | C |
| ATOM | 6432 | CG1 | VAL | D | 197 | −21.014 | −50.336 | 128.159 | 1.00 | 28.99 | C |
| ATOM | 6433 | CG2 | VAL | D | 197 | −21.944 | −52.640 | 128.462 | 1.00 | 28.78 | C |

TABLE 10.4-continued

| | | | | | | | | | | |
|---|---|---|---|---|---|---|---|---|---|---|
| ATOM | 6434 | N | THR | D | 198 | −17.577 | −50.805 | 128.883 | 1.00 | 33.99 | N |
| ATOM | 6435 | CA | THR | D | 198 | −16.654 | −49.718 | 129.164 | 1.00 | 32.70 | C |
| ATOM | 6436 | C | THR | D | 198 | −16.983 | −48.563 | 128.229 | 1.00 | 40.52 | C |
| ATOM | 6437 | O | THR | D | 198 | −17.023 | −48.743 | 127.005 | 1.00 | 37.25 | O |
| ATOM | 6438 | CB | THR | D | 198 | −15.203 | −50.146 | 128.950 | 1.00 | 33.81 | C |
| ATOM | 6439 | OG1 | THR | D | 198 | −14.907 | −51.282 | 129.766 | 1.00 | 43.84 | O |
| ATOM | 6440 | CG2 | THR | D | 198 | −14.282 | −49.029 | 129.347 | 1.00 | 29.60 | C |
| ATOM | 6441 | N | HIS | D | 199 | −17.211 | −47.384 | 128.805 | 1.00 | 37.58 | N |
| ATOM | 6442 | CA | HIS | D | 199 | −17.528 | −46.198 | 128.030 | 1.00 | 31.22 | C |
| ATOM | 6443 | C | HIS | D | 199 | −17.075 | −44.973 | 128.805 | 1.00 | 34.53 | C |
| ATOM | 6444 | O | HIS | D | 199 | −17.002 | −44.999 | 130.033 | 1.00 | 35.60 | O |
| ATOM | 6445 | CB | HIS | D | 199 | −19.020 | −46.115 | 127.723 | 1.00 | 33.40 | C |
| ATOM | 6446 | CG | HIS | D | 199 | −19.383 | −44.969 | 126.828 | 1.00 | 34.76 | C |
| ATOM | 6447 | ND1 | HIS | D | 199 | −19.824 | −43.756 | 127.313 | 1.00 | 30.33 | N |
| ATOM | 6448 | CD2 | HIS | D | 199 | −19.360 | −44.849 | 125.479 | 1.00 | 32.19 | C |
| ATOM | 6449 | CE1 | HIS | D | 199 | −20.061 | −42.940 | 126.301 | 1.00 | 31.06 | C |
| ATOM | 6450 | NE2 | HIS | D | 199 | −19.778 | −43.575 | 125.178 | 1.00 | 31.67 | N |
| ATOM | 6451 | N | GLN | D | 200 | −16.786 | −43.888 | 128.085 | 1.00 | 29.72 | N |
| ATOM | 6452 | CA | GLN | D | 200 | −16.199 | −42.738 | 128.754 | 1.00 | 31.37 | C |
| ATOM | 6453 | C | GLU | D | 200 | −17.177 | −42.022 | 129.684 | 1.00 | 35.36 | C |
| ATOM | 6454 | O | GLN | D | 200 | −16.735 | −41.248 | 130.541 | 1.00 | 42.18 | O |
| ATOM | 6455 | CB | GLN | D | 200 | −15.629 | −41.779 | 127.723 | 1.00 | 33.74 | C |
| ATOM | 6456 | CG | GLN | D | 200 | −16.370 | −40.476 | 127.548 | 1.00 | 35.08 | C |
| ATOM | 6457 | CD | GLN | D | 200 | −15.538 | −39.467 | 126.778 | 1.00 | 39.26 | C |
| ATOM | 6458 | OE1 | GLN | D | 200 | −15.357 | −38.324 | 127.205 | 1.00 | 44.14 | O |
| ATOM | 6459 | NE2 | GLN | D | 200 | −15.015 | −39.893 | 125.639 | 1.00 | 40.13 | N |
| ATOM | 6460 | N | GLY | D | 201 | −18.482 | −42.261 | 129.550 | 1.00 | 34.51 | N |
| ATOM | 6461 | CA | GLY | D | 201 | −19.496 | −41.749 | 130.451 | 1.00 | 32.88 | C |
| ATOM | 6462 | C | GLY | D | 201 | −19.793 | −42.624 | 131.658 | 1.00 | 34.93 | C |
| ATOM | 6463 | O | GLY | D | 201 | −20.740 | −42.333 | 132.397 | 1.00 | 30.85 | O |
| ATOM | 6464 | N | LEU | D | 202 | −19.050 | −43.719 | 131.838 | 1.00 | 30.30 | N |
| ATOM | 6465 | CA | LEU | D | 202 | −19.137 | −44.588 | 133.007 | 1.00 | 35.37 | C |
| ATOM | 6466 | C | LEU | D | 202 | −17.845 | −44.491 | 133.805 | 1.00 | 41.52 | C |
| ATOM | 6467 | O | LEU | D | 202 | −16.751 | −44.633 | 133.240 | 1.00 | 41.27 | O |
| ATOM | 6468 | CB | LEU | D | 202 | −19.405 | −46.046 | 132.624 | 1.00 | 36.42 | C |
| ATOM | 6469 | CG | LEU | D | 202 | −20.723 | −46.250 | 131.880 | 1.00 | 35.17 | C |
| ATOM | 6470 | CD1 | LEU | D | 202 | −20.916 | −47.704 | 131.503 | 1.00 | 29.43 | C |
| ATOM | 6471 | CD2 | LEU | D | 202 | −21.865 | −45.735 | 132.713 | 1.00 | 29.90 | C |
| ATOM | 6472 | N | SER | D | 203 | −17.973 | −44.219 | 135.113 | 1.00 | 44.01 | N |
| ATOM | 6473 | CA | SER | D | 203 | −16.802 | −44.095 | 135.978 | 1.00 | 39.30 | C |
| ATOM | 6474 | C | SER | D | 203 | −16.068 | −45.416 | 136.165 | 1.00 | 41.65 | C |
| ATOM | 6475 | O | SER | D | 203 | −14.867 | −45.408 | 136.460 | 1.00 | 49.60 | O |
| ATOM | 6476 | CB | SER | D | 203 | −17.213 | −43.537 | 137.323 | 1.00 | 34.65 | C |
| ATOM | 6477 | OG | SER | D | 203 | −18.227 | −44.369 | 137.839 | 1.00 | 55.55 | O |
| ATOM | 6478 | N | SER | D | 204 | −16.749 | −46.545 | 136.003 | 1.00 | 42.27 | N |
| ATOM | 6479 | CA | SER | D | 204 | −16.084 | −47.841 | 135.927 | 1.00 | 45.69 | C |
| ATOM | 6480 | C | SER | D | 204 | −16.989 | −48.788 | 135.149 | 1.00 | 36.06 | C |
| ATOM | 6481 | O | SER | D | 204 | −18.181 | −48.508 | 134.979 | 1.00 | 38.46 | O |
| ATOM | 6482 | CB | SER | D | 204 | −15.755 | −48.401 | 137.332 | 1.00 | 48.88 | C |
| ATOM | 6483 | OG | SER | D | 204 | −16.914 | −48.719 | 138.093 | 1.00 | 47.01 | O |
| ATOM | 6484 | N | PRO | D | 205 | −16.453 | −49.888 | 134.637 | 1.00 | 32.30 | N |
| ATOM | 6485 | CA | PRO | D | 205 | −17.271 | −50.768 | 133.791 | 1.00 | 36.16 | C |
| ATOM | 6486 | C | PRO | D | 205 | −18.534 | −51.253 | 134.498 | 1.00 | 37.49 | C |
| ATOM | 6487 | O | PRO | D | 205 | −18.503 | −51.695 | 135.642 | 1.00 | 46.01 | O |
| ATOM | 6488 | CB | PRO | D | 205 | −16.313 | −51.925 | 133.468 | 1.00 | 34.46 | C |
| ATOM | 6489 | CG | PRO | D | 205 | −14.973 | −51.268 | 133.442 | 1.00 | 33.52 | C |
| ATOM | 6490 | CD | PRO | D | 205 | −15.013 | −50.158 | 134.481 | 1.00 | 32.12 | C |
| ATOM | 6491 | N | VAL | D | 206 | −19.629 | −51.261 | 133.750 | 1.00 | 37.13 | N |
| ATOM | 6492 | CA | VAL | D | 206 | −20.952 | −51.648 | 134.217 | 1.00 | 32.96 | C |
| ATOM | 6493 | C | VAL | D | 206 | −21.270 | −53.027 | 133.650 | 1.00 | 35.67 | C |
| ATOM | 6494 | O | VAL | D | 206 | −21.071 | −53.272 | 132.456 | 1.00 | 33.93 | O |
| ATOM | 6495 | CB | VAL | D | 206 | −21.984 | −50.601 | 133.769 | 1.00 | 30.63 | C |
| ATOM | 6496 | CG1 | VAL | D | 206 | −23.390 | −51.059 | 134.005 | 1.00 | 30.69 | C |
| ATOM | 6497 | CG2 | VAL | D | 206 | −21.703 | −49.316 | 134.479 | 1.00 | 38.52 | C |
| ATOM | 6498 | N | THR | D | 207 | −21.748 | −53.932 | 134.503 | 1.00 | 40.16 | N |
| ATOM | 6499 | CA | THR | D | 207 | −22.093 | −55.285 | 134.087 | 1.00 | 33.00 | C |
| ATOM | 6500 | C | THR | D | 207 | −23.587 | −55.538 | 134.269 | 1.00 | 33.37 | C |
| ATOM | 6501 | O | THR | D | 207 | −24.188 | −55.112 | 135.255 | 1.00 | 34.36 | O |
| ATOM | 6502 | CB | THR | D | 207 | −21.271 | −56.317 | 134.871 | 1.00 | 32.59 | C |
| ATOM | 6503 | OG1 | THR | D | 207 | −19.872 | −56.064 | 134.677 | 1.00 | 35.95 | O |
| ATOM | 6504 | CG2 | THR | D | 207 | −21.585 | −57.744 | 134.412 | 1.00 | 31.54 | C |
| ATOM | 6505 | N | LYS | D | 208 | −24.194 | −56.172 | 133.277 | 1.00 | 38.08 | N |
| ATOM | 6506 | CA | LYS | D | 208 | −25.529 | −56.734 | 133.393 | 1.00 | 33.58 | C |
| ATOM | 6507 | C | LYS | D | 208 | −25.435 | −58.233 | 133.155 | 1.00 | 31.51 | C |
| ATOM | 6508 | O | LYS | D | 208 | −24.797 | −58.679 | 132.202 | 1.00 | 36.26 | O |
| ATOM | 6509 | CB | LYS | D | 208 | −26.510 | −56.072 | 132.395 | 1.00 | 32.49 | C |
| ATOM | 6510 | CG | LYS | D | 208 | −26.633 | −54.559 | 132.573 | 1.00 | 34.11 | C |
| ATOM | 6511 | CD | LYS | D | 208 | −26.879 | −54.180 | 134.030 | 1.00 | 32.10 | C |
| ATOM | 6512 | CE | LYS | D | 208 | −27.135 | −52.694 | 134.212 | 1.00 | 31.43 | C |
| ATOM | 6513 | HZ | LYS | D | 208 | −28.595 | −52.396 | 134.289 | 1.00 | 30.11 | N1+ |

TABLE 10.4-continued

| ATOM | 6514 | N | SER | D | 209 | −26.099 | −59.013 | 133.995 | 1.00 | 40.89 | | N |
|---|---|---|---|---|---|---|---|---|---|---|---|---|
| ATOM | 6515 | CA | SER | D | 209 | −25.955 | −60.457 | 133.950 | 1.00 | 34.12 | | C |
| ATOM | 6516 | C | SER | D | 209 | −27.289 | −61.121 | 134.250 | 1.00 | 35.96 | | C |
| ATOM | 6517 | O | SER | D | 209 | −28.265 | −60.469 | 134.620 | 1.00 | 35.44 | | O |
| ATOM | 6518 | CB | SER | D | 209 | −24.856 | −60.923 | 134.926 | 1.00 | 34.50 | | C |
| ATOM | 6519 | OG | SER | D | 209 | −25.082 | −60.438 | 136.238 | 1.00 | 29.12 | | O |
| ATOM | 6520 | N | PHE | D | 210 | −27.333 | −62.431 | 134.025 | 1.00 | 39.78 | | N |
| ATOM | 6521 | CA | PHE | D | 210 | −28.424 | −63.272 | 134.488 | 1.00 | 37.92 | | C |
| ATOM | 6522 | C | PHE | D | 210 | −27.883 | −64.670 | 134.767 | 1.00 | 42.87 | | C |
| ATOM | 6523 | O | PHE | D | 210 | −26.994 | −65.149 | 134.055 | 1.00 | 42.97 | | O |
| ATOM | 6524 | CB | PHE | D | 210 | −29.555 | −63.296 | 133.464 | 1.00 | 34.40 | | C |
| ATOM | 6525 | CG | PHE | D | 210 | −29.193 | −63.943 | 132.160 | 1.00 | 40.31 | | C |
| ATOM | 6526 | CD1 | PHE | D | 210 | −29.365 | −65.304 | 131.973 | 1.00 | 38.92 | | C |
| ATOM | 6527 | CD2 | PHE | D | 210 | −28.702 | −63.182 | 131.109 | 1.00 | 37.04 | | C |
| ATOM | 6528 | CE1 | PHE | D | 210 | −29.055 | −65.893 | 130.777 | 1.00 | 36.51 | | C |
| ATOM | 6529 | CE2 | PHE | D | 210 | −28.393 | −63.765 | 129.913 | 1.00 | 35.57 | | C |
| ATOM | 6530 | CZ | PHE | D | 210 | −28.568 | −65.125 | 129.745 | 1.00 | 36.28 | | C |
| ATOM | 6531 | N | ASN | D | 211 | −28.433 | −65.331 | 135.796 | 1.00 | 41.98 | | N |
| ATOM | 6532 | CA | ASN | D | 211 | −28.093 | −66.720 | 136.076 | 1.00 | 44.07 | | C |
| ATOM | 6533 | C | ASN | D | 211 | −29.047 | −67.583 | 135.273 | 1.00 | 45.82 | | C |
| ATOM | 6534 | O | ASN | D | 211 | −30.260 | −67.386 | 135.349 | 1.00 | 49.01 | | O |
| ATOM | 6535 | CB | ASN | D | 211 | −28.194 | −67.060 | 137.568 | 1.00 | 42.88 | | C |
| ATOM | 6536 | CG | ASN | D | 211 | −27.474 | −66.058 | 138.456 | 1.00 | 48.18 | | C |
| ATOM | 6537 | OD1 | ASN | D | 211 | −26.529 | −65.407 | 138.034 | 1.00 | 55.66 | | O |
| ATOM | 6538 | ND2 | ASN | D | 211 | −27.920 | −65.934 | 139.701 | 1.00 | 53.20 | | N |
| ATOM | 6539 | N | ARG | D | 212 | −28.501 | −68.538 | 134.512 | 1.00 | 42.56 | | N |
| ATOM | 6540 | CA | ARG | D | 212 | −29.339 | −69.369 | 133.655 | 1.00 | 44.17 | | C |
| ATOM | 6541 | C | ARG | D | 212 | −30.389 | −70.120 | 134.460 | 1.00 | 52.65 | | C |
| ATOM | 6542 | O | ARG | D | 212 | −30.117 | −70.632 | 135.550 | 1.00 | 57.95 | | O |
| ATOM | 6543 | CB | ARG | D | 212 | −28.497 | −70.365 | 132.870 | 1.00 | 44.08 | | C |
| ATOM | 6544 | CG | ARG | D | 212 | −29.313 | −71.160 | 131.848 | 1.00 | 39.96 | | C |
| ATOM | 6545 | CD | ARG | D | 212 | −28.430 | −72.092 | 131.021 | 1.00 | 41.55 | | C |
| ATOM | 6546 | NE | ARG | D | 212 | −27.681 | −72.968 | 131.906 | 1.00 | 52.14 | | N |
| ATOM | 6547 | CZ | ARG | D | 212 | −28.121 | −74.138 | 132.360 | 1.00 | 52.75 | | C |
| ATOM | 6548 | NH1 | ARG | D | 212 | −29.310 | −74.604 | 131.997 | 1.00 | 55.42 | | N1+ |
| ATOM | 6549 | NH2 | ARG | D | 212 | −27.365 | −74.845 | 133.177 | 1.00 | 50.00 | | N |
| ATOM | 6550 | N | GLY | D | 213 | −31.606 | −70.150 | 133.923 | 1.00 | 55.21 | | N |
| ATOM | 6551 | CA | GLY | D | 213 | −32.710 | −70.874 | 134.521 | 1.00 | 61.80 | | C |
| ATOM | 6552 | C | GLY | D | 213 | −33.365 | −70.219 | 135.716 | 1.00 | 69.36 | | C |
| ATOM | 6553 | O | GLY | D | 213 | −34.221 | −70.844 | 136.350 | 1.00 | 78.60 | | O |
| ATOM | 6554 | N | GLU | D | 214 | −33.041 | −68.971 | 136.017 | 1.00 | 64.22 | | N |
| ATOM | 6555 | CA | GLU | D | 214 | −33.596 | −68.288 | 137.169 | 1.00 | 66.25 | | C |
| ATOM | 6556 | C | GLU | D | 214 | −34.131 | −66.936 | 136.710 | 1.00 | 74.30 | | C |
| ATOM | 6557 | O | GLU | D | 214 | −34.125 | −66.617 | 135.517 | 1.00 | 72.76 | | O |
| ATOM | 6558 | CB | GLU | D | 214 | −32.534 | −68.153 | 138.268 | 1.00 | 68.20 | | C |
| ATOM | 6559 | CG | GLU | D | 214 | −31.925 | −69.500 | 138.684 | 1.00 | 65.40 | | C |
| ATOM | 6560 | CD | GLU | D | 214 | −30.610 | −69.356 | 139.461 | 1.00 | 70.80 | | C |
| ATOM | 6561 | OE1 | GLU | D | 214 | −30.431 | −68.335 | 140.180 | 1.00 | 56.20 | | O |
| ATOM | 6562 | OE2 | GLU | D | 214 | −29.760 | −70.276 | 139.354 | 1.00 | 68.01 | | O1− |
| ATOM | 6563 | N | CYS | D | 215 | −34.599 | −66.138 | 137.668 | 1.00 | 83.83 | | N |
| ATOM | 6564 | CA | CYS | D | 215 | −35.238 | −64.844 | 137.389 | 1.00 | 81.44 | | C |
| ATOM | 6565 | C | CYS | D | 215 | −34.229 | −63.723 | 137.129 | 1.00 | 91.66 | | C |
| ATOM | 6566 | O | CYS | D | 215 | −33.764 | −63.051 | 138.055 | 1.00 | 89.67 | | O |
| ATOM | 6567 | CB | CYS | D | 215 | −36.153 | −64.449 | 138.554 | 1.00 | 87.78 | | C |
| ATOM | 6568 | SG | CYS | D | 215 | −35.402 | −64.679 | 140.202 | 1.00 | 106.03 | | S |
| TER | | | | | | | | | | | | |
| ATOM | 6569 | N | THR | I | 152 | −42.630 | −26.640 | 53.407 | 1.00 | 78.60 | D000 | N |
| ATOM | 6570 | CA | THR | I | 152 | −41.299 | −26.066 | 53.631 | 1.00 | 90.61 | D000 | C |
| ATOM | 6571 | C | THR | I | 152 | −41.155 | −25.639 | 55.096 | 1.00 | 90.48 | D000 | C |
| ATOM | 6572 | O | THR | I | 152 | −40.054 | −25.653 | 55.660 | 1.00 | 85.79 | D000 | O |
| ATOM | 6573 | CB | THR | I | 152 | −41.001 | −24.845 | 52.694 | 1.00 | 84.39 | D000 | C |
| ATOM | 6574 | OG1 | THR | I | 152 | −42.169 | −24.027 | 52.567 | 1.00 | 87.95 | D000 | O |
| ATOM | 6575 | CG2 | THR | I | 152 | −40.569 | −25.297 | 51.311 | 1.00 | 74.94 | D000 | C |
| ATOM | 6576 | N | CYS | I | 153 | −42.275 | −25.254 | 55.707 | 1.00 | 89.21 | D000 | N |
| ATOM | 6577 | CA | CYS | I | 153 | −42.264 | −24.807 | 57.092 | 1.00 | 81.53 | D000 | C |
| ATOM | 6578 | C | CYS | I | 153 | −43.556 | −25.234 | 57.776 | 1.00 | 76.72 | D000 | C |
| ATOM | 6579 | O | CYS | I | 153 | −44.575 | −25.496 | 57.128 | 1.00 | 77.13 | D000 | O |
| ATOM | 6580 | CB | CYS | I | 153 | −42.087 | −23.284 | 57.178 | 1.00 | 79.48 | D000 | C |
| ATOM | 6581 | SG | CYS | I | 153 | −40.357 | −22.736 | 57.167 | 1.00 | 91.46 | D000 | S |
| ATOM | 6582 | N | CYS | I | 154 | −43.494 | −25.316 | 59.112 | 1.00 | 68.58 | D000 | N |
| ATOM | 6583 | CA | CYS | I | 154 | −44.632 | −25.662 | 59.947 | 1.00 | 56.00 | D000 | C |
| ATOM | 6584 | C | CYS | I | 154 | −45.352 | −24.407 | 60.411 | 1.00 | 54.60 | D000 | C |
| ATOM | 6585 | O | CYS | I | 154 | −44.726 | −23.355 | 60.580 | 1.00 | 53.80 | D000 | O |
| ATOM | 6586 | CB | CYS | I | 154 | −44.181 | −26.474 | 61.153 | 1.00 | 48.63 | D000 | C |
| ATOM | 6587 | SG | CYS | I | 154 | −43.645 | −28.112 | 60.680 | 1.00 | 63.81 | D000 | S |
| ATOM | 6588 | N | PRO | I | 155 | −46.667 | −24.480 | 60.621 | 1.00 | 47.88 | D000 | N |
| ATOM | 6589 | CA | PRO | I | 155 | −47.397 | −23.284 | 61.039 | 1.00 | 41.43 | D000 | C |
| ATOM | 6590 | C | PRO | I | 155 | −46.878 | −22.765 | 62.371 | 1.00 | 47.89 | D000 | C |
| ATOM | 6591 | O | PRO | I | 155 | −46.206 | −23.471 | 63.130 | 1.00 | 43.34 | D000 | O |
| ATOM | 6592 | CB | PRO | I | 155 | −48.855 | −23.757 | 61.137 | 1.00 | 38.59 | D000 | C |

TABLE 10.4-continued

| ATOM | 6593 | CG | PRO | I | 155 | −48.818 | −25.245 | 61.066 | 1.00 | 40.42 | D000 | C |
|---|---|---|---|---|---|---|---|---|---|---|---|---|
| ATOM | 6594 | CD | PRO | I | 155 | −47.558 | −25.631 | 60.385 | 1.00 | 47.80 | D000 | C |
| ATOM | 6595 | N | VAL | I | 156 | −47.223 | −21.503 | 62.648 | 1.00 | 50.69 | D000 | N |
| ATOM | 6596 | CA | VAL | I | 156 | −46.805 | −20.823 | 63.868 | 1.00 | 49.74 | D000 | C |
| ATOM | 6597 | C | VAL | I | 156 | −47.161 | −21.667 | 65.084 | 1.00 | 50.63 | D000 | C |
| ATOM | 6598 | O | VAL | I | 156 | −48.294 | −22.142 | 65.215 | 1.00 | 49.76 | D000 | O |
| ATOM | 6599 | CB | VAL | I | 156 | −47.471 | −19.435 | 63.931 | 1.00 | 56.06 | D000 | C |
| ATOM | 6600 | CG1 | VAL | I | 156 | −46.956 | −18.628 | 65.112 | 1.00 | 48.56 | D000 | C |
| ATOM | 6601 | CG2 | VAL | I | 156 | −47.275 | −18.685 | 62.605 | 1.00 | 59.05 | D000 | C |
| ATOM | 6602 | N | ASN | I | 157 | −46.178 | −21.872 | 65.968 | 1.00 | 51.11 | D000 | N |
| ATOM | 6603 | CA | ASN | I | 157 | −46.292 | −22.645 | 67.205 | 1.00 | 44.19 | D000 | C |
| ATOM | 6604 | C | ASN | I | 157 | −46.372 | −24.144 | 66.981 | 1.00 | 40.81 | D000 | C |
| ATOM | 6605 | O | ASN | I | 157 | −46.737 | −24.864 | 67.902 | 1.00 | 42.83 | D000 | O |
| ATOM | 6606 | CB | ASN | I | 157 | −47.464 | −22.193 | 68.081 | 1.00 | 45.04 | D000 | C |
| ATOM | 6607 | CG | ASN | I | 157 | −47.278 | −20.791 | 68.601 | 1.00 | 50.02 | D000 | C |
| ATOM | 6608 | OD1 | ASN | I | 157 | −46.197 | −20.437 | 69.063 | 1.00 | 54.69 | D000 | O |
| ATOM | 6609 | ND2 | ASN | I | 157 | −48.315 | −19.979 | 68.513 | 1.00 | 59.66 | D000 | N |
| ATOM | 6610 | N | TRP | I | 158 | −46.085 | −24.633 | 65.778 | 1.00 | 40.56 | D000 | N |
| ATOM | 6611 | CA | TRP | I | 158 | −45.839 | −26.051 | 65.566 | 1.00 | 38.45 | D000 | C |
| ATOM | 6612 | C | TRP | I | 158 | −44.345 | −26.293 | 65.371 | 1.00 | 40.31 | D000 | C |
| ATOM | 6613 | O | TRP | I | 158 | −43.584 | −25.397 | 65.007 | 1.00 | 39.61 | D000 | O |
| ATOM | 6614 | CB | TRP | I | 158 | −46.629 | −26.590 | 64.371 | 1.00 | 40.79 | D000 | C |
| ATOM | 6615 | CG | TRP | I | 158 | −48.118 | −26.566 | 64.574 | 1.00 | 40.96 | D000 | C |
| ATOM | 6616 | CD1 | TRP | I | 158 | −48.892 | −25.473 | 64.883 | 1.00 | 39.11 | D000 | C |
| ATOM | 6617 | CD2 | TRP | I | 158 | −49.025 | −27.667 | 64.427 | 1.00 | 36.12 | D000 | C |
| ATOM | 6618 | NE1 | TRP | I | 158 | −50.213 | −25.840 | 64.971 | 1.00 | 35.50 | D000 | N |
| ATOM | 6619 | CE2 | TRP | I | 158 | −50.325 | −27.175 | 64.688 | 1.00 | 32.39 | D000 | C |
| ATOM | 6620 | CE3 | TRP | I | 158 | −48.867 | −29.017 | 64.101 | 1.00 | 36.76 | D000 | C |
| ATOM | 6621 | CZ2 | TRP | I | 158 | −51.453 | −27.985 | 64.636 | 1.00 | 33.44 | D000 | C |
| ATOM | 6622 | CZ3 | TRP | I | 158 | −49.993 | −29.826 | 64.048 | 1.00 | 36.91 | D000 | C |
| ATOM | 6623 | CH2 | TRP | I | 158 | −51.271 | −29.308 | 64.321 | 1.00 | 34.08 | D000 | C |
| ATOM | 6624 | N | VAL | I | 159 | −43.939 | −27.531 | 65.615 | 1.00 | 42.08 | D000 | N |
| ATOM | 6625 | CA | VAL | I | 159 | −42.544 | −27.931 | 65.687 | 1.00 | 36.72 | D000 | C |
| ATOM | 6626 | C | VAL | I | 159 | −42.284 | −28.942 | 64.582 | 1.00 | 40.42 | D000 | C |
| ATOM | 6627 | O | VAL | I | 159 | −42.934 | −29.992 | 64.529 | 1.00 | 34.21 | D000 | O |
| ATOM | 6628 | CB | VAL | I | 159 | −42.222 | −28.551 | 67.060 | 1.00 | 40.12 | D000 | C |
| ATOM | 6629 | CG1 | VAL | I | 159 | −40.793 | −29.037 | 67.110 | 1.00 | 39.21 | D000 | C |
| ATOM | 6630 | CG2 | VAL | I | 159 | −42.486 | −27.563 | 68.171 | 1.00 | 43.22 | D000 | C |
| ATOM | 6631 | N | GLU | I | 160 | −41.300 | −28.660 | 63.739 | 1.00 | 45.25 | D000 | N |
| ATOM | 6632 | CA | GLU | I | 160 | −40.975 | −29.588 | 62.671 | 1.00 | 43.30 | D000 | C |
| ATOM | 6633 | C | GLU | I | 160 | −40.058 | −30.686 | 63.184 | 1.00 | 41.09 | D000 | C |
| ATOM | 6634 | O | GLU | I | 160 | −39.201 | −30.447 | 64.036 | 1.00 | 44.54 | D000 | O |
| ATOM | 6635 | CB | GLU | I | 160 | −40.309 | −28.861 | 61.510 | 1.00 | 49.23 | D000 | C |
| ATOM | 6636 | CG | GLU | I | 160 | −40.396 | −29.626 | 60.191 | 1.00 | 61.45 | D000 | C |
| ATOM | 6637 | CD | GLU | I | 160 | −39.556 | −28.996 | 59.095 | 1.00 | 74.24 | D000 | C |
| ATOM | 6638 | OE1 | GLU | I | 160 | −40.073 | −28.128 | 58.350 | 1.00 | 75.44 | D000 | O |
| ATOM | 6639 | OE2 | GLU | I | 160 | −38.365 | −29.367 | 58.996 | 1.00 | 82.31 | D000 | O1− |
| ATOM | 6640 | N | HIS | I | 161 | −40.262 | −31.899 | 62.675 | 1.00 | 34.25 | D000 | N |
| ATOM | 6641 | CA | HIS | I | 161 | −39.358 | −33.005 | 62.927 | 1.00 | 35.38 | D000 | C |
| ATOM | 6642 | C | HIS | I | 161 | −39.634 | −34.146 | 61.950 | 1.00 | 44.04 | D000 | C |
| ATOM | 6643 | O | HIS | I | 161 | −40.655 | −34.832 | 62.063 | 1.00 | 44.75 | D000 | O |
| ATOM | 6644 | CB | HIS | I | 161 | −39.491 | −33.493 | 64.372 | 1.00 | 34.41 | D000 | C |
| ATOM | 6645 | CG | HIS | I | 161 | −38.662 | −34.709 | 64.679 | 1.00 | 42.31 | D000 | C |
| ATOM | 6646 | ND1 | HIS | I | 161 | −37.356 | −34.632 | 65.127 | 1.00 | 39.49 | D000 | N |
| ATOM | 6647 | CD2 | HIS | I | 161 | −38.947 | −36.031 | 64.578 | 1.00 | 37.68 | D000 | C |
| ATOM | 6648 | CE1 | HIS | I | 161 | −36.884 | −35.854 | 65.308 | 1.00 | 36.84 | D000 | C |
| ATOM | 6649 | NE2 | HIS | I | 161 | −37.823 | −36.720 | 64.970 | 1.00 | 37.93 | D000 | N |
| ATOM | 6650 | N | GLU | I | 162 | −38.726 | −34.358 | 60.992 | 1.00 | 48.09 | D000 | N |
| ATOM | 6651 | CA | GLU | I | 162 | −38.750 | −35.513 | 60.090 | 1.00 | 42.19 | D000 | C |
| ATOM | 6652 | C | GLU | I | 162 | −39.999 | −35.567 | 59.225 | 1.00 | 46.13 | D000 | C |
| ATOM | 6653 | O | GLU | I | 162 | −40.676 | −36.597 | 59.149 | 1.00 | 46.71 | D000 | O |
| ATOM | 6654 | CB | GLU | I | 162 | −38.576 | −36.822 | 60.852 | 1.00 | 38.57 | D000 | C |
| ATOM | 6655 | CG | GLU | I | 162 | −37.232 | −36.891 | 61.474 | 1.00 | 49.45 | D000 | C |
| ATOM | 6656 | CD | GLU | I | 162 | −36.178 | −37.369 | 60.479 | 1.00 | 67.10 | D000 | C |
| ATOM | 6657 | OE1 | GLU | I | 162 | −36.210 | −38.565 | 60.098 | 1.00 | 74.81 | D000 | O |
| ATOM | 6658 | OE2 | GLU | I | 162 | −35.341 | −36.533 | 60.050 | 1.00 | 59.37 | D000 | O1− |
| ATOM | 6659 | N | ARG | I | 163 | −40.289 | −34.453 | 58.547 | 1.00 | 48.14 | D000 | N |
| ATOM | 6660 | CA | ARG | I | 163 | −41.446 | −34.362 | 57.648 | 1.00 | 57.33 | D000 | C |
| ATOM | 6661 | C | ARG | I | 163 | −42.768 | −34.545 | 58.387 | 1.00 | 53.34 | D000 | C |
| ATOM | 6662 | O | ARG | I | 163 | −43.712 | −35.129 | 57.854 | 1.00 | 56.97 | D000 | O |
| ATOM | 6663 | CB | ARG | I | 163 | −41.335 | −35.388 | 56.509 | 1.00 | 65.00 | D000 | C |
| ATOM | 6664 | CG | ARG | I | 163 | −40.188 | −35.176 | 55.528 | 1.00 | 68.66 | D000 | C |
| ATOM | 6665 | CD | ARG | I | 163 | −40.271 | −36.202 | 54.398 | 1.00 | 80.19 | D000 | C |
| ATOM | 6666 | NE | ARG | I | 163 | −41.472 | −36.074 | 53.577 | 1.00 | 89.56 | D000 | N |
| ATOM | 6667 | CZ | ARG | I | 163 | −41.971 | −37.066 | 52.841 | 1.00 | 92.42 | D000 | C |
| ATOM | 6668 | NH1 | ARG | I | 163 | −43.077 | −36.881 | 52.123 | 1.00 | 78.10 | D000 | N1+ |
| ATOM | 6669 | NH2 | ARG | I | 163 | −41.362 | −38.249 | 52.832 | 1.00 | 94.56 | D000 | N |
| ATOM | 6670 | N | SER | I | 164 | −42.822 | −34.104 | 59.641 | 1.00 | 53.57 | D000 | N |
| ATOM | 6671 | CA | SER | I | 164 | −44.059 | −33.988 | 60.400 | 1.00 | 46.49 | D000 | C |
| ATOM | 6672 | C | SER | I | 164 | −44.026 | −32.697 | 61.203 | 1.00 | 51.04 | D000 | C |

TABLE 10.4-continued

| | | | | | | | | | | |
|---|---|---|---|---|---|---|---|---|---|---|
| ATOM | 6673 | O | SER | I | 164 | −42.965 | −32.279 | 61.679 | 1.00 | 50.06 | D000 O |
| ATOM | 6674 | CB | SER | I | 164 | −44.270 | −35.170 | 61.343 | 1.00 | 43.89 | D000 C |
| ATOM | 6675 | OG | SER | I | 164 | −44.907 | −36.249 | 60.692 | 1.00 | 50.01 | D000 O |
| ATOM | 6676 | N | CYS | I | 165 | −45.194 | −32.075 | 61.357 | 1.00 | 50.05 | D000 N |
| ATOM | 6677 | CA | CYS | I | 165 | −45.370 | −30.919 | 62.233 | 1.00 | 47.87 | D000 C |
| ATOM | 6678 | C | CYS | I | 165 | −46.135 | −31.340 | 63.489 | 1.00 | 43.11 | 0000 C |
| ATOM | 6679 | O | CYS | I | 165 | −47.190 | −31.975 | 63.399 | 1.00 | 42.93 | D000 O |
| ATOM | 6680 | CB | CYS | I | 165 | −46.116 | −29.778 | 61.524 | 1.00 | 50.43 | D000 C |
| ATOM | 6681 | SG | CYS | I | 165 | −45.326 | −29.058 | 60.031 | 1.00 | 58.62 | D000 S |
| ATOM | 6682 | N | TYR | I | 166 | −45.622 | −30.957 | 64.656 | 1.00 | 43.41 | D000 N |
| ATOM | 6683 | CA | TYR | I | 166 | −46.198 | −31.350 | 65.934 | 1.00 | 35.17 | D000 C |
| ATOM | 6684 | C | TYR | I | 166 | −46.617 | −30.116 | 66.719 | 1.00 | 36.72 | D000 C |
| ATOM | 6685 | O | TYR | I | 166 | −45.937 | −29.084 | 66.683 | 1.00 | 35.81 | D000 O |
| ATOM | 6686 | CB | TYR | I | 166 | −45.214 | −32.158 | 66.761 | 1.00 | 28.42 | D000 C |
| ATOM | 6687 | CG | TYR | I | 166 | −44.766 | −33.439 | 66.120 | 1.00 | 35.36 | D000 C |
| ATOM | 6688 | CD1 | TYR | I | 166 | −43.703 | −33.461 | 65.194 | 1.00 | 40.74 | D000 C |
| ATOM | 6689 | CD2 | TYR | I | 166 | −45.379 | −34.629 | 66.435 | 1.00 | 28.15 | D000 C |
| ATOM | 6690 | CE1 | TYR | I | 166 | −43.280 | −34.646 | 64.614 | 1.00 | 31.55 | D000 C |
| ATOM | 6691 | CE2 | TYR | I | 166 | −44.966 | −35.813 | 65.864 | 1.00 | 35.33 | D000 C |
| ATOM | 6692 | CZ | TYR | I | 166 | −43.926 | −35.818 | 64.952 | 1.00 | 36.07 | D000 C |
| ATOM | 6693 | OH | TYR | I | 166 | −43.557 | −37.022 | 64.406 | 1.00 | 37.06 | D000 O |
| ATOM | 6694 | N | TRP | I | 167 | −47.735 | −30.235 | 67.438 | 1.00 | 33.78 | D000 N |
| ATOM | 6695 | CA | TRP | I | 167 | −48.213 | −29.191 | 68.335 | 1.00 | 33.91 | D000 C |
| ATOM | 6696 | C | TRP | I | 167 | −48.485 | −29.823 | 69.692 | 1.00 | 33.58 | D000 C |
| ATOM | 6697 | O | TRP | I | 167 | −49.169 | −30.848 | 69.776 | 1.00 | 37.11 | D000 O |
| ATOM | 6698 | CB | TRP | I | 167 | −49.478 | −28.509 | 67.776 | 1.00 | 37.58 | D000 C |
| ATOM | 6699 | CG | TRP | I | 167 | −50.029 | −27.432 | 68.678 | 1.00 | 36.19 | D000 C |
| ATOM | 6700 | CD1 | TRP | I | 167 | −49.648 | −26.122 | 68.725 | 1.00 | 37.64 | D000 C |
| ATOM | 6701 | CD2 | TRP | I | 167 | −51.064 | −27.580 | 69.657 | 1.00 | 33.12 | D000 C |
| ATOM | 6702 | NE1 | TRP | I | 167 | −50.365 | −25.452 | 69.692 | 1.00 | 32.45 | D000 N |
| ATOM | 6703 | CE2 | TRP | I | 167 | −51.246 | −26.325 | 70.269 | 1.00 | 31.52 | D000 C |
| ATOM | 6704 | CE3 | TRP | I | 167 | −51.846 | −28.659 | 70.083 | 1.00 | 35.72 | D000 C |
| ATOM | 6705 | CZ2 | TRP | I | 167 | −52.183 | −26.116 | 71.277 | 1.00 | 34.14 | D000 C |
| ATOM | 6706 | CZ3 | TRP | I | 167 | −52.782 | −28.447 | 71.087 | 1.00 | 32.27 | D000 C |
| ATOM | 6707 | CH2 | TRP | I | 167 | −52.941 | −27.185 | 71.669 | 1.00 | 31.51 | D000 C |
| ATOM | 6708 | N | PHE | I | 168 | −47.934 | −29.223 | 70.748 | 1.00 | 35.27 | D000 N |
| ATOM | 6709 | CA | PHE | I | 168 | −47.963 | −29.784 | 72.101 | 1.00 | 31.67 | D000 C |
| ATOM | 6710 | C | PHE | I | 168 | −48.837 | −28.898 | 72.975 | 1.00 | 31.00 | D000 C |
| ATOM | 6711 | O | PHE | I | 168 | −48.468 | −27.757 | 73.263 | 1.00 | 28.23 | D000 O |
| ATOM | 6712 | CB | PHE | I | 168 | −46.555 | −29.881 | 72.685 | 1.00 | 28.79 | D000 C |
| ATOM | 6713 | CG | PHE | I | 168 | −45.609 | −30.707 | 71.860 | 1.00 | 29.81 | D000 C |
| ATOM | 6714 | CD1 | PHE | I | 168 | −45.461 | −32.067 | 72.099 | 1.00 | 30.76 | D000 C |
| ATOM | 6715 | CD2 | PHE | I | 168 | −44.881 | −30.129 | 70.836 | 1.00 | 27.05 | D000 C |
| ATOM | 6716 | CE1 | PHE | I | 168 | −44.587 | −32.824 | 71.329 | 1.00 | 29.28 | D000 C |
| ATOM | 6717 | CE2 | PHE | I | 168 | −44.009 | −30.878 | 70.073 | 1.00 | 27.44 | D000 C |
| ATOM | 6718 | CZ | PHE | I | 168 | −43.869 | −32.224 | 70.310 | 1.00 | 26.73 | D000 C |
| ATOM | 6719 | N | SER | I | 169 | −49.963 | −29.437 | 73.440 | 1.00 | 31.45 | D000 N |
| ATOM | 6720 | CA | SER | I | 169 | −50.883 | −28.643 | 74.245 | 1.00 | 31.26 | D000 C |
| ATOM | 6721 | C | SER | I | 169 | −50.266 | −28.259 | 75.591 | 1.00 | 25.88 | D000 C |
| ATOM | 6722 | O | SER | I | 169 | −49.376 | −28.932 | 76.115 | 1.00 | 23.51 | D000 O |
| ATOM | 6723 | CB | SER | I | 169 | −52.201 | −29.404 | 74.471 | 1.00 | 30.30 | D000 C |
| ATOM | 6724 | OG | SER | I | 169 | −52.074 | −30.442 | 75.438 | 1.00 | 28.82 | D000 O |
| ATOM | 6725 | N | ARG | I | 170 | −50.734 | −27.135 | 76.129 | 1.00 | 27.95 | D000 N |
| ATOM | 6726 | CA | ARG | I | 170 | −50.447 | −26.722 | 77.495 | 1.00 | 34.22 | D000 C |
| ATOM | 6727 | C | ARG | I | 170 | −51.671 | −26.846 | 78.392 | 1.00 | 33.58 | D000 C |
| ATOM | 6728 | O | ARG | I | 170 | −51.627 | −26.414 | 79.546 | 1.00 | 31.86 | D000 O |
| ATOM | 6729 | CB | ARG | I | 170 | −49.944 | −25.282 | 77.529 | 1.00 | 25.51 | D000 C |
| ATOM | 6730 | CG | ARG | I | 170 | −48.455 | −25.122 | 77.693 | 1.00 | 33.77 | D000 C |
| ATOM | 6731 | CD | ARG | I | 170 | −48.071 | −25.130 | 79.130 | 1.00 | 32.63 | D000 C |
| ATOM | 6732 | NE | ARG | I | 170 | −47.020 | −26.113 | 79.328 | 1.00 | 38.28 | D000 N |
| ATOM | 6733 | CZ | ARG | I | 170 | −46.005 | −25.992 | 80.166 | 1.00 | 33.99 | D000 C |
| ATOM | 6734 | NH1 | ARG | I | 170 | −45.904 | −24.932 | 80.960 | 1.00 | 29.65 | D000 N1+ |
| ATOM | 6735 | NH2 | ARG | I | 170 | −45.123 | −26.986 | 80.241 | 1.00 | 33.21 | D000 N |
| ATOM | 6736 | N | SER | I | 171 | −52.760 | −27.420 | 77.888 | 1.00 | 27.31 | D000 N |
| ATOM | 6737 | CA | SER | I | 171 | −53.943 | −27.684 | 78.682 | 1.00 | 24.95 | D000 C |
| ATOM | 6738 | C | SER | I | 171 | −54.303 | −29.138 | 78.489 | 1.00 | 29.34 | D000 C |
| ATOM | 6739 | O | SER | I | 171 | −53.693 | −29.847 | 77.682 | 1.00 | 31.49 | D000 O |
| ATOM | 6740 | CB | SER | I | 171 | −55.119 | −26.815 | 78.277 | 1.00 | 21.97 | D000 C |
| ATOM | 6741 | OG | SER | I | 171 | −55.427 | −27.085 | 76.932 | 1.00 | 35.69 | D000 O |
| ATOM | 6742 | N | GLY | I | 172 | −55.301 | −29.577 | 79.252 | 1.00 | 29.63 | D000 N |
| ATOM | 6743 | CA | GLY | I | 172 | −55.700 | −30.970 | 79.280 | 1.00 | 24.44 | D000 C |
| ATOM | 6744 | C | GLY | I | 172 | −57.075 | −31.181 | 78.703 | 1.00 | 25.61 | D000 C |
| ATOM | 6745 | O | GLY | I | 172 | −57.864 | −30.245 | 78.637 | 1.00 | 27.53 | D000 O |
| ATOM | 6746 | N | LYS | I | 173 | −57.363 | −32.400 | 78.273 | 1.00 | 25.19 | D000 N |
| ATOM | 6747 | CA | LYS | I | 173 | −58.629 | −32.726 | 77.650 | 1.00 | 27.09 | D000 C |
| ATOM | 6748 | C | LYS | I | 173 | −58.823 | −34.231 | 77.752 | 1.00 | 33.35 | D000 C |
| ATOM | 6749 | O | LYS | I | 173 | −57.854 | −34.995 | 77.672 | 1.00 | 29.52 | D000 O |
| ATOM | 6750 | CB | LYS | I | 173 | −58.693 | −32.295 | 76.172 | 1.00 | 27.91 | D000 C |
| ATOM | 6751 | CG | LYS | I | 173 | −58.975 | −30.805 | 75.865 | 1.00 | 25.52 | D000 C |
| ATOM | 6752 | CD | LYS | I | 173 | −59.510 | −30.671 | 74.410 | 1.00 | 26.32 | D000 C |

TABLE 10.4-continued

| | | | | | | | | | | |
|---|---|---|---|---|---|---|---|---|---|---|
| ATOM | 6753 | CE | LYS | I | 173 | −59.494 | −29.257 | 73.861 | 1.00 | 19.84 | D000 C |
| ATOM | 6754 | NZ | LYS | I | 173 | −60.449 | −28.327 | 74.536 | 1.00 | 27.70 | D000 N1+ |
| ATOM | 6755 | N | ALA | I | 174 | −60.076 | −34.643 | 77.956 | 1.00 | 29.60 | D000 N |
| ATOM | 6756 | CA | ALA | I | 174 | −60.433 | −36.038 | 77.791 | 1.00 | 32.67 | D000 C |
| ATOM | 6757 | C | ALA | I | 174 | −60.003 | −36.509 | 76.401 | 1.00 | 33.60 | D000 C |
| ATOM | 6758 | O | ALA | I | 174 | −59.996 | −35.730 | 75.441 | 1.00 | 31.75 | D000 O |
| ATOM | 6759 | CB | ALA | I | 174 | −61.943 | −36.202 | 77.997 | 1.00 | 28.75 | D000 C |
| ATOM | 6760 | N | TRP | I | 175 | −59.641 | −37.796 | 76.289 | 1.00 | 30.30 | D000 N |
| ATOM | 6761 | CA | TRP | I | 175 | −59.069 | −38.288 | 75.033 | 1.00 | 32.92 | D000 C |
| ATOM | 6762 | C | TRP | I | 175 | −59.946 | −37.956 | 73.824 | 1.00 | 35.10 | D000 C |
| ATOM | 6763 | O | TRP | I | 175 | −59.441 | −37.507 | 72.790 | 1.00 | 38.08 | D000 O |
| ATOM | 6764 | CB | TRP | I | 175 | −58.822 | −39.795 | 75.102 | 1.00 | 33.10 | D000 C |
| ATOM | 6765 | CG | TRP | I | 175 | −58.056 | −40.337 | 73.893 | 1.00 | 38.61 | D000 C |
| ATOM | 6766 | CD1 | TRP | I | 175 | −56.729 | −40.615 | 73.835 | 1.00 | 38.20 | D000 C |
| ATOM | 6767 | CD2 | TRP | I | 175 | −58.584 | −40.653 | 72.579 | 1.00 | 43.49 | D000 C |
| ATOM | 6768 | NE1 | TRP | I | 175 | −56.388 | −41.079 | 72.580 | 1.00 | 35.04 | D000 N |
| ATOM | 6769 | CE2 | TRP | I | 175 | −57.505 | −41.113 | 71.793 | 1.00 | 38.92 | D000 C |
| ATOM | 6770 | CE3 | TRP | I | 175 | −59.863 | −40.593 | 71.996 | 1.00 | 43.77 | D000 C |
| ATOM | 6771 | CZ2 | TRP | I | 175 | −57.662 | −41.517 | 70.456 | 1.00 | 44.27 | D000 C |
| ATOM | 6772 | CZ3 | TRP | I | 175 | −60.016 | −40.989 | 70.650 | 1.00 | 43.79 | D000 C |
| ATOM | 6773 | CH2 | TRP | I | 175 | −58.925 | −41.448 | 69.906 | 1.00 | 44.29 | D000 C |
| ATOM | 6774 | N | ALA | I | 176 | −61.260 | −38.156 | 73.936 | 1.00 | 33.82 | D000 N |
| ATOM | 6775 | CA | ALA | I | 176 | −62.154 | −37.894 | 72.815 | 1.00 | 28.11 | D000 C |
| ATOM | 6776 | C | ALA | I | 176 | −62.108 | −36.432 | 72.394 | 1.00 | 37.58 | D000 C |
| ATOM | 6777 | O | ALA | I | 176 | −62.150 | −36.111 | 71.196 | 1.00 | 36.74 | D000 O |
| ATOM | 6778 | CB | ALA | I | 176 | −63.578 | −38.275 | 73.199 | 1.00 | 27.93 | D000 C |
| ATOM | 6779 | N | ASP | I | 177 | −62.043 | −35.528 | 73.370 | 1.00 | 35.00 | D000 N |
| ATOM | 6780 | CA | ASP | I | 177 | −62.036 | −34.117 | 73.044 | 1.00 | 32.37 | D000 C |
| ATOM | 6781 | C | ASP | I | 177 | −60.712 | −33.703 | 72.435 | 1.00 | 34.46 | D000 C |
| ATOM | 6782 | O | ASP | I | 177 | −60.672 | −32.790 | 71.591 | 1.00 | 33.36 | D000 O |
| ATOM | 6783 | CB | ASP | I | 177 | −62.355 | −33.298 | 74.290 | 1.00 | 36.16 | D000 C |
| ATOM | 6784 | CG | ASP | I | 177 | −63.729 | −33.623 | 74.876 | 1.00 | 40.76 | D000 C |
| ATOM | 6785 | OD1 | ASP | I | 177 | −64.648 | −33.982 | 74.097 | 1.00 | 35.33 | D000 O |
| ATOM | 6786 | OD2 | ASP | I | 177 | −63.888 | −33.508 | 76.122 | 1.00 | 45.92 | D000 O1− |
| ATOM | 6787 | N | ALA | I | 178 | −59.622 | −34.340 | 72.869 | 1.00 | 33.13 | D000 N |
| ATOM | 6788 | CA | ALA | I | 178 | −58.325 | −34.082 | 72.255 | 1.00 | 34.80 | D000 C |
| ATOM | 6789 | C | ALA | I | 178 | −58.313 | −34.585 | 70.812 | 1.00 | 35.86 | D000 C |
| ATOM | 6790 | O | ALA | I | 178 | −57.887 | −33.873 | 69.898 | 1.00 | 30.16 | D000 O |
| ATOM | 6791 | CB | ALA | I | 178 | −57.224 | −34.734 | 73.085 | 1.00 | 29.11 | D000 C |
| ATOM | 6792 | N | ASP | I | 179 | −58.825 | −35.803 | 70.601 | 1.00 | 38.39 | D000 N |
| ATOM | 6793 | CA | ASP | I | 179 | −59.085 | −36.343 | 69.268 | 1.00 | 35.65 | D000 C |
| ATOM | 6794 | C | ASP | I | 179 | −59.826 | −35.347 | 68.401 | 1.00 | 37.02 | D000 C |
| ATOM | 6795 | O | ASP | I | 179 | −59.397 | −35.030 | 67.286 | 1.00 | 39.99 | D000 O |
| ATOM | 6796 | CB | ASP | I | 179 | −59.886 | −37.642 | 69.413 | 1.00 | 41.79 | D000 C |
| ATOM | 6797 | CG | ASP | I | 179 | −60.149 | −38.338 | 68.094 | 1.00 | 42.90 | D000 C |
| ATOM | 6798 | OD1 | ASP | I | 179 | −59.371 | −38.120 | 67.149 | 1.00 | 43.83 | D000 O |
| ATOM | 6799 | OD2 | ASP | I | 179 | −61.096 | −39.163 | 68.035 | 1.00 | 43.02 | D000 O1− |
| ATOM | 6800 | N | ASN | I | 180 | −60.934 | −34.820 | 68.911 | 1.00 | 39.12 | D000 N |
| ATOM | 6801 | CA | ASN | I | 180 | −61.715 | −33.882 | 68.117 | 1.00 | 39.76 | D000 C |
| ATOM | 6802 | C | ASN | I | 180 | −60.945 | −32.601 | 67.851 | 1.00 | 32.43 | D000 C |
| ATOM | 6803 | O | ASN | I | 180 | −61.062 | −32.026 | 66.768 | 1.00 | 38.63 | D000 O |
| ATOM | 6804 | CB | ASN | I | 180 | −63.053 | −33.580 | 68.801 | 1.00 | 34.44 | D000 C |
| ATOM | 6805 | CG | ASN | I | 180 | −63.983 | −34.773 | 68.793 | 1.00 | 38.43 | D000 C |
| ATOM | 6806 | OD1 | ASN | I | 180 | −63.692 | −35.795 | 68.162 | 1.00 | 43.96 | D000 O |
| ATOM | 6807 | ND2 | ASN | I | 180 | −65.126 | −34.642 | 69.458 | 1.00 | 38.70 | D000 N |
| ATOM | 6808 | N | TYR | I | 181 | −60.142 | −32.144 | 68.814 | 1.00 | 37.95 | D000 N |
| ATOM | 6809 | CA | TYR | I | 181 | −59.388 | −30.900 | 68.623 | 1.00 | 36.10 | D000 C |
| ATOM | 6810 | C | TYR | I | 181 | −58.390 | −31.012 | 67.470 | 1.00 | 36.90 | D000 C |
| ATOM | 6811 | O | TYR | I | 181 | −58.240 | −30.077 | 66.667 | 1.00 | 35.28 | D000 O |
| ATOM | 6812 | CB | TYR | I | 181 | −58.660 | −30.519 | 69.908 | 1.00 | 25.56 | D000 C |
| ATOM | 6813 | CG | TYR | I | 181 | −57.826 | −29.264 | 69.780 | 1.00 | 28.66 | D000 C |
| ATOM | 6814 | CD1 | TYR | I | 181 | −56.520 | −29.301 | 69.277 | 1.00 | 31.67 | D000 C |
| ATOM | 6815 | CD2 | TYR | I | 181 | −58.336 | −28.043 | 70.162 | 1.00 | 25.48 | D000 C |
| ATOM | 6816 | CE1 | TYR | I | 181 | −55.768 | −28.154 | 69.148 | 1.00 | 29.47 | D000 C |
| ATOM | 6817 | CE2 | TYR | I | 181 | −57.579 | −26.897 | 70.054 | 1.00 | 29.61 | D000 C |
| ATOM | 6818 | CZ | TYR | I | 181 | −56.299 | −26.952 | 69.546 | 1.00 | 33.58 | D000 C |
| ATOM | 6819 | OH | TYR | I | 181 | −55.570 | −25.786 | 69.431 | 1.00 | 36.52 | D000 O |
| ATOM | 6820 | N | CYS | I | 182 | −57.668 | −32.125 | 67.395 | 1.00 | 30.45 | D000 N |
| ATOM | 6821 | CA | CYS | I | 182 | −56.669 | −32.250 | 66.346 | 1.00 | 39.92 | D000 C |
| ATOM | 6822 | C | CYS | I | 182 | −57.323 | −32.304 | 64.964 | 1.00 | 42.48 | D000 C |
| ATOM | 6823 | O | CYS | I | 182 | −56.879 | −31.607 | 64.034 | 1.00 | 37.23 | D000 O |
| ATOM | 6824 | CB | CYS | I | 182 | −55.793 | −33.477 | 66.614 | 1.00 | 37.71 | D000 C |
| ATOM | 6825 | SG | CYS | I | 182 | −54.685 | −33.283 | 68.064 | 1.00 | 42.44 | D000 S |
| ATOM | 6826 | N | ARG | I | 183 | −58.413 | −33.073 | 64.832 | 1.00 | 33.83 | D000 N |
| ATOM | 6827 | CA | ARG | I | 183 | −59.071 | −33.213 | 63.538 | 1.00 | 34.20 | D000 C |
| ATOM | 6828 | C | ARG | I | 183 | −59.478 | −31.860 | 62.965 | 1.00 | 40.37 | D000 C |
| ATOM | 6829 | O | ARG | I | 183 | −59.310 | −31.617 | 61.764 | 1.00 | 43.30 | D000 O |
| ATOM | 6830 | CB | ARG | I | 183 | −60.275 | −34.128 | 63.670 | 1.00 | 36.10 | D000 C |
| ATOM | 6831 | CG | ARG | I | 183 | −59.902 | −35.562 | 63.991 | 1.00 | 34.06 | D000 C |
| ATOM | 6832 | CD | ARG | I | 183 | −61.081 | −36.236 | 64.587 | 1.00 | 39.52 | D000 C |

TABLE 10.4-continued

| ATOM | 6833 | NE  | ARG | I | 183 | −61.350 | −37.531 | 63.997 | 1.00 | 57.45 | D000 | N   |
|------|------|-----|-----|---|-----|---------|---------|--------|------|-------|------|-----|
| ATOM | 6834 | CZ  | ARG | I | 183 | −62.574 | −37.960 | 63.698 | 1.00 | 68.60 | D000 | C   |
| ATOM | 6835 | NH1 | ARG | I | 183 | −63.619 | −37.172 | 63.920 | 1.00 | 55.03 | D000 | N1+ |
| ATOM | 6836 | NH2 | ARG | I | 183 | −62.754 | −39.165 | 63.159 | 1.00 | 76.79 | D000 | N   |
| ATOM | 6837 | N   | LEU | I | 184 | −59.980 | −30.952 | 63.805 | 1.00 | 34.08 | D000 | N   |
| ATOM | 6838 | CA  | LEU | I | 184 | −60.347 | −29.625 | 63.319 | 1.00 | 36.10 | D000 | C   |
| ATOM | 6839 | C   | LEU | I | 184 | −59.159 | −28.729 | 62.998 | 1.00 | 40.84 | D000 | C   |
| ATOM | 6840 | O   | LEU | I | 184 | −59.369 | −27.647 | 62.436 | 1.00 | 43.24 | D000 | O   |
| ATOM | 6841 | CB  | LEU | I | 184 | −61.207 | −28.901 | 64.344 | 1.00 | 42.44 | D000 | C   |
| ATOM | 6842 | CG  | LEU | I | 184 | −62.705 | −29.142 | 64.369 | 1.00 | 44.30 | D000 | C   |
| ATOM | 6843 | CD1 | LEU | I | 184 | −62.982 | −30.550 | 64.684 | 1.00 | 40.27 | D000 | C   |
| ATOM | 6844 | CD2 | LEU | I | 184 | −63.246 | −28.314 | 65.458 | 1.00 | 44.72 | D000 | C   |
| ATOM | 6845 | N   | GLU | I | 185 | −57.938 | −29.126 | 63.359 | 1.00 | 44.61 | D000 | N   |
| ATOM | 6846 | CA  | GLU | I | 185 | −56.714 | −28.453 | 62.938 | 1.00 | 42.87 | D000 | C   |
| ATOM | 6847 | C   | GLU | I | 185 | −56.132 | −29.068 | 61.664 | 1.00 | 45.96 | D000 | C   |
| ATOM | 6848 | O   | GLU | I | 185 | −55.000 | −28.744 | 61.284 | 1.00 | 41.44 | D000 | O   |
| ATOM | 6849 | CB  | GLU | I | 185 | −55.678 | −28.517 | 64.061 | 1.00 | 38.65 | D000 | C   |
| ATOM | 6850 | CG  | GLU | I | 185 | −56.035 | −27.729 | 65.294 | 1.00 | 42.71 | D000 | C   |
| ATOM | 6851 | CD  | GLU | I | 185 | −55.905 | −26.233 | 65.117 | 1.00 | 46.41 | D000 | C   |
| ATOM | 6852 | OE1 | GLU | I | 185 | −54.995 | −25.799 | 64.379 | 1.00 | 49.20 | D000 | O   |
| ATOM | 6853 | OE2 | GLU | I | 185 | −56.701 | −25.489 | 65.737 | 1.00 | 47.94 | D000 | O1− |
| ATOM | 6854 | N   | ASP | I | 186 | −56.902 | −29.923 | 60.992 | 1.00 | 46.15 | D000 | N   |
| ATOM | 6855 | CA  | ASP | I | 186 | −56.421 | −30.765 | 59.904 | 1.00 | 46.32 | D000 | C   |
| ATOM | 6856 | C   | ASP | I | 186 | −55.202 | −31.570 | 60.344 | 1.00 | 45.43 | D000 | C   |
| ATOM | 6857 | O   | ASP | I | 186 | −54.175 | −31.625 | 59.670 | 1.00 | 47.14 | D000 | O   |
| ATOM | 6858 | CB  | ASP | I | 186 | −56.136 | −29.951 | 58.642 | 1.00 | 54.37 | D000 | C   |
| ATOM | 6859 | CG  | ASP | I | 186 | −56.259 | −30.795 | 57.356 | 1.00 | 66.46 | D000 | C   |
| ATOM | 6860 | OD1 | ASP | I | 186 | −56.408 | −32.045 | 57.464 | 1.00 | 61.88 | D000 | O   |
| ATOM | 6861 | OD2 | ASP | I | 186 | −56.193 | −30.206 | 56.242 | 1.00 | 69.65 | D000 | O1− |
| ATOM | 6862 | N   | ALA | I | 187 | −55.318 | −32.197 | 61.505 | 1.00 | 42.36 | D000 | N   |
| ATOM | 6863 | CA  | ALA | I | 187 | −54.205 | −32.950 | 62.052 | 1.00 | 35.32 | D000 | C   |
| ATOM | 6864 | C   | ALA | I | 187 | −54.783 | −34.150 | 62.787 | 1.00 | 33.26 | D000 | C   |
| ATOM | 6865 | O   | ALA | I | 187 | −55.966 | −34.465 | 62.668 | 1.00 | 37.96 | D000 | O   |
| ATOM | 6866 | CB  | ALA | I | 187 | −53.337 | −32.044 | 62.933 | 1.00 | 32.84 | D000 | C   |
| ATOM | 6867 | N   | HIS | I | 188 | −53.962 | −34.816 | 63.567 | 1.00 | 30.88 | D000 | N   |
| ATOM | 6868 | CA  | HIS | I | 188 | −54.456 | −35.987 | 64.253 | 1.00 | 32.32 | D000 | C   |
| ATOM | 6869 | C   | HIS | I | 188 | −53.593 | −36.192 | 65.488 | 1.00 | 38.94 | D000 | C   |
| ATOM | 6870 | O   | HIS | I | 188 | −52.452 | −35.723 | 65.547 | 1.00 | 41.15 | D000 | O   |
| ATOM | 6871 | CB  | HIS | I | 188 | −54.419 | −37.199 | 63.331 | 1.00 | 28.57 | D000 | C   |
| ATOM | 6872 | CG  | HIS | I | 188 | −53.039 | −37.551 | 62.871 | 1.00 | 39.86 | D000 | C   |
| ATOM | 6873 | ND1 | HIS | I | 188 | −52.317 | −38.593 | 63.414 | 1.00 | 43.77 | D000 | N   |
| ATOM | 6874 | CD2 | HIS | I | 188 | −52.238 | −36.986 | 61.935 | 1.00 | 40.63 | D000 | C   |
| ATOM | 6875 | CE1 | HIS | I | 188 | −51.136 | −38.662 | 62.824 | 1.00 | 43.40 | D000 | C   |
| ATOM | 6876 | NE2 | HIS | I | 188 | −51.063 | −37.697 | 61.925 | 1.00 | 44.73 | D000 | N   |
| ATOM | 6877 | N   | LEU | I | 189 | −54.155 | −36.887 | 66.480 | 1.00 | 34.91 | D000 | N   |
| ATOM | 6878 | CA  | LEU | I | 189 | −53.389 | −37.240 | 67.667 | 1.00 | 36.57 | D000 | C   |
| ATOM | 6879 | C   | LEU | I | 189 | −52.134 | −38.003 | 67.269 | 1.00 | 36.22 | D000 | C   |
| ATOM | 6880 | O   | LEU | I | 189 | −52.181 | −38.892 | 66.414 | 1.00 | 36.87 | D000 | O   |
| ATOM | 6881 | CB  | LEU | I | 189 | −54.227 | −38.079 | 68.626 | 1.00 | 33.58 | D000 | C   |
| ATOM | 6882 | CG  | LEU | I | 189 | −55.332 | −37.326 | 69.361 | 1.00 | 32.53 | D000 | C   |
| ATOM | 6883 | CD1 | LEU | I | 189 | −56.060 | −38.310 | 70.251 | 1.00 | 31.98 | D000 | C   |
| ATOM | 6884 | CD2 | LEU | I | 189 | −54.785 | −36.156 | 70.127 | 1.00 | 32.11 | D000 | C   |
| ATOM | 6885 | N   | VAL | I | 190 | −51.006 | −37.639 | 67.889 | 1.00 | 34.36 | D000 | N   |
| ATOM | 6886 | CA  | VAL | I | 190 | −49.706 | −38.113 | 67.426 | 1.00 | 36.90 | D000 | C   |
| ATOM | 6887 | C   | VAL | I | 190 | −49.705 | −39.621 | 67.302 | 1.00 | 34.99 | D000 | C   |
| ATOM | 6888 | O   | VAL | I | 190 | −50.277 | −40.340 | 68.126 | 1.00 | 38.49 | D000 | O   |
| ATOM | 6889 | CB  | VAL | I | 190 | −48.565 | −37.658 | 68.355 | 1.00 | 40.36 | D000 | C   |
| ATOM | 6890 | CG1 | VAL | I | 190 | −48.720 | −38.264 | 69.755 | 1.00 | 36.50 | D000 | C   |
| ATOM | 6891 | CG2 | VAL | I | 190 | −47.214 | −38.026 | 67.743 | 1.00 | 36.89 | D000 | C   |
| ATOM | 6892 | N   | VAL | I | 191 | −49.097 | −40.091 | 66.224 | 1.00 | 38.67 | D000 | N   |
| ATOM | 6893 | CA  | VAL | I | 191 | −48.933 | −41.503 | 65.926 | 1.00 | 40.35 | D000 | C   |
| ATOM | 6894 | C   | VAL | I | 191 | −47.436 | −41.758 | 65.901 | 1.00 | 37.87 | D000 | C   |
| ATOM | 6895 | O   | VAL | I | 191 | −46.719 | −41.196 | 65.064 | 1.00 | 39.61 | D000 | O   |
| ATOM | 6896 | CB  | VAL | I | 191 | −49.589 | −41.882 | 64.586 | 1.00 | 42.11 | D000 | C   |
| ATOM | 6897 | CG1 | VAL | I | 191 | −49.208 | −43.319 | 64.164 | 1.00 | 36.05 | D000 | C   |
| ATOM | 6898 | CG2 | VAL | I | 191 | −51.109 | −41.663 | 64.648 | 1.00 | 38.64 | D000 | C   |
| ATOM | 6899 | N   | VAL | I | 192 | −46.969 | −42.599 | 66.805 | 1.00 | 36.01 | D000 | N   |
| ATOM | 6900 | CA  | VAL | I | 192 | −45.545 | −42.767 | 67.055 | 1.00 | 41.63 | D000 | C   |
| ATOM | 6901 | C   | VAL | I | 192 | −45.088 | −44.039 | 66.361 | 1.00 | 37.03 | D000 | C   |
| ATOM | 6902 | O   | VAL | I | 192 | −45.528 | −45.138 | 66.718 | 1.00 | 40.05 | D000 | O   |
| ATOM | 6903 | CB  | VAL | I | 192 | −45.264 | −42.808 | 68.565 | 1.00 | 40.06 | D000 | C   |
| ATOM | 6904 | CG1 | VAL | I | 192 | −43.805 | −43.021 | 68.828 | 1.00 | 43.89 | D000 | C   |
| ATOM | 6905 | CG2 | VAL | I | 192 | −45.723 | −41.516 | 69.199 | 1.00 | 30.23 | D000 | C   |
| ATOM | 6906 | N   | THR | I | 193 | −44.188 | −43.897 | 65.377 | 1.00 | 40.22 | D000 | N   |
| ATOM | 6907 | CA  | THR | I | 193 | −43.828 | −45.009 | 64.496 | 1.00 | 46.20 | D000 | C   |
| ATOM | 6908 | C   | THR | I | 193 | −42.371 | −45.451 | 64.595 | 1.00 | 48.77 | D000 | C   |
| ATOM | 6909 | O   | THR | I | 193 | −42.009 | −46.439 | 63.948 | 1.00 | 50.27 | D000 | O   |
| ATOM | 6910 | CB  | THR | I | 193 | −44.081 | −44.649 | 63.021 | 1.00 | 37.88 | D000 | C   |
| ATOM | 6911 | OG1 | THR | I | 193 | −43.196 | −43.588 | 62.655 | 1.00 | 46.69 | D000 | O   |
| ATOM | 6912 | CG2 | THR | I | 193 | −45.516 | −44.167 | 62.808 | 1.00 | 35.86 | D000 | C   |

TABLE 10.4-continued

| | | | | | | | | | | |
|---|---|---|---|---|---|---|---|---|---|---|
| ATOM | 6913 | N | SER | I | 194 | −41.529 | −44.758 | 65.364 | 1.00 | 47.04 | D000 N |
| ATOM | 6914 | CA | SER | I | 194 | −40.107 | −45.072 | 65.443 | 1.00 | 47.61 | D000 C |
| ATOM | 6915 | C | SER | I | 194 | −39.578 | −44.648 | 66.802 | 1.00 | 47.34 | D000 C |
| ATOM | 6916 | O | SER | I | 194 | −40.228 | −43.898 | 67.531 | 1.00 | 48.44 | D000 O |
| ATOM | 6917 | CB | SER | I | 194 | −39.292 | −44.369 | 64.357 | 1.00 | 44.10 | D000 C |
| ATOM | 6918 | OG | SER | I | 194 | −39.457 | −42.964 | 64.442 | 1.00 | 48.66 | D000 O |
| ATOM | 6919 | N | TRP | I | 195 | −38.388 | −45.147 | 67.143 | 1.00 | 44.89 | D000 N |
| ATOM | 6920 | CA | TRP | I | 195 | −37.764 | −44.738 | 68.392 | 1.00 | 43.95 | D000 C |
| ATOM | 6921 | C | TRP | I | 195 | −37.376 | −43.274 | 68.361 | 1.00 | 46.62 | D000 C |
| ATOM | 6922 | O | TRP | I | 195 | −37.488 | −42.577 | 69.379 | 1.00 | 43.24 | D000 O |
| ATOM | 6923 | CB | TRP | I | 195 | −36.552 | −45.605 | 68.717 | 1.00 | 48.92 | D000 C |
| ATOM | 6924 | CG | TRP | I | 195 | −36.802 | −46.281 | 70.004 | 1.00 | 55.85 | D000 C |
| ATOM | 6925 | CD1 | TRP | I | 195 | −37.056 | −45.676 | 71.212 | 1.00 | 56.28 | D000 C |
| ATOM | 6926 | CD2 | TRP | I | 195 | −36.901 | −47.690 | 70.230 | 1.00 | 56.55 | D000 C |
| ATOM | 6927 | NE1 | TRP | I | 195 | −37.292 | −46.630 | 72.179 | 1.00 | 58.55 | D000 N |
| ATOM | 6928 | CE2 | TRP | I | 195 | −37.199 | −47.874 | 71.605 | 1.00 | 65.39 | D000 C |
| ATOM | 6929 | CE3 | TRP | I | 195 | −36.755 | −48.815 | 69.413 | 1.00 | 48.79 | D000 C |
| ATOM | 6930 | CZ2 | TRP | I | 195 | −37.353 | −49.140 | 72.174 | 1.00 | 63.33 | D000 C |
| ATOM | 6931 | CZ3 | TRP | I | 195 | −36.904 | −50.070 | 69.980 | 1.00 | 61.76 | D000 C |
| ATOM | 6932 | CH2 | TRP | I | 195 | −37.198 | −50.223 | 71.349 | 1.00 | 69.03 | D000 C |
| ATOM | 6933 | N | GLU | I | 196 | −36.914 | −42.786 | 67.210 | 1.00 | 43.07 | D000 N |
| ATOM | 6934 | CA | GLU | I | 196 | −36.579 | −41.374 | 67.119 | 1.00 | 38.64 | D000 C |
| ATOM | 6935 | C | GLU | I | 196 | −37.818 | −40.526 | 67.331 | 1.00 | 38.66 | D000 C |
| ATOM | 6936 | O | GLU | I | 196 | −37.782 | −39.540 | 68.074 | 1.00 | 41.67 | D000 O |
| ATOM | 6937 | CB | GLU | I | 196 | −35.919 | −41.061 | 65.783 | 1.00 | 37.74 | D000 C |
| ATOM | 6938 | CG | GLU | I | 196 | −36.000 | −42.187 | 64.776 | 1.00 | 52.87 | D000 C |
| ATOM | 6939 | CD | GLU | I | 196 | −35.141 | −43.397 | 65.156 | 1.00 | 66.98 | D000 C |
| ATOM | 6940 | OE1 | GLU | I | 196 | −35.717 | −44.504 | 65.378 | 1.00 | 59.55 | D000 O |
| ATOM | 6941 | OE2 | GLU | I | 196 | −33.899 | −43.224 | 65.260 | 1.00 | 74.05 | D000 O1− |
| ATOM | 6942 | N | GLU | I | 197 | −38.945 | −40.923 | 66.737 | 1.00 | 39.39 | D000 N |
| ATOM | 6943 | CA | GLU | I | 197 | −40.168 | −40.155 | 66.948 | 1.00 | 42.64 | D000 C |
| ATOM | 6944 | C | GLU | I | 197 | −40.599 | −40.215 | 68.410 | 1.00 | 37.64 | D000 C |
| ATOM | 6945 | O | GLU | I | 197 | −41.014 | −39.205 | 68.981 | 1.00 | 32.92 | D000 O |
| ATOM | 6946 | CB | GLU | I | 197 | −41.283 | −40.664 | 66.038 | 1.00 | 40.56 | D000 C |
| ATOM | 6947 | CG | GLU | I | 197 | −42.482 | −39.748 | 66.042 | 1.00 | 37.27 | D000 C |
| ATOM | 6948 | CD | GLU | I | 197 | −43.515 | −40.096 | 64.990 | 1.00 | 42.36 | D000 C |
| ATOM | 6949 | OE1 | GLU | I | 197 | −43.544 | −41.263 | 64.528 | 1.00 | 39.06 | D000 O |
| ATOM | 6950 | OE2 | GLU | I | 197 | −44.277 | −39.173 | 64.601 | 1.00 | 44.17 | D000 O1− |
| ATOM | 6951 | N | GLN | I | 198 | −40.485 | −41.396 | 69.026 | 1.00 | 37.19 | D000 N |
| ATOM | 6952 | CA | GLN | I | 198 | −40.810 | −41.562 | 70.435 | 1.00 | 33.73 | D000 C |
| ATOM | 6953 | C | GLN | I | 198 | −39.920 | −40.689 | 71.301 | 1.00 | 39.61 | D000 C |
| ATOM | 6954 | O | GLN | I | 198 | −40.401 | −39.995 | 72.206 | 1.00 | 35.04 | D000 O |
| ATOM | 6955 | CB | GLN | I | 198 | −40.659 | −43.026 | 70.832 | 1.00 | 32.87 | D000 C |
| ATOM | 6956 | CG | GLN | I | 198 | −40.502 | −43.235 | 72.323 | 1.00 | 37.28 | D000 C |
| ATOM | 6957 | CD | GLN | I | 198 | −41.830 | −43.123 | 73.085 | 1.00 | 35.70 | D000 C |
| ATOM | 6958 | OE1 | GLN | I | 198 | −42.902 | −43.371 | 72.539 | 1.00 | 30.32 | D000 O |
| ATOM | 6959 | NE2 | GLN | I | 198 | −41.749 | −42.729 | 74.345 | 1.00 | 35.65 | D000 N |
| ATOM | 6960 | N | LYS | I | 199 | −38.610 | −40.700 | 71.014 | 1.00 | 44.77 | D000 N |
| ATOM | 6961 | CA | LYS | I | 199 | −37.666 | −39.882 | 71.765 | 1.00 | 39.06 | D000 C |
| ATOM | 6962 | C | LYS | I | 199 | −37.934 | −38.405 | 71.551 | 1.00 | 32.39 | D000 C |
| ATOM | 6963 | O | LYS | I | 199 | −37.949 | −37.629 | 72.509 | 1.00 | 31.60 | D000 O |
| ATOM | 6964 | CB | LYS | I | 199 | −36.232 | −40.241 | 71.380 | 1.00 | 36.82 | D000 C |
| ATOM | 6965 | CG | LYS | I | 199 | −35.661 | −41.318 | 72.265 | 1.00 | 38.84 | D000 C |
| ATOM | 6966 | CD | LYS | I | 199 | −34.660 | −42.196 | 71.578 | 1.00 | 46.27 | D000 C |
| ATOM | 6967 | CE | LYS | I | 199 | −33.601 | −41.398 | 70.901 | 1.00 | 41.73 | D000 C |
| ATOM | 6968 | NZ | LYS | I | 199 | −32.530 | −42.355 | 70.568 | 1.00 | 49.72 | D000 N1+ |
| ATOM | 6969 | N | PHE | I | 200 | −38.200 | −38.011 | 70.309 | 1.00 | 34.30 | D000 N |
| ATOM | 6970 | CA | PHE | I | 200 | −38.496 | −36.613 | 70.030 | 1.00 | 32.36 | D000 C |
| ATOM | 6971 | C | PHE | I | 200 | −39.712 | −36.127 | 70.813 | 1.00 | 34.19 | D000 C |
| ATOM | 6972 | O | PHE | I | 200 | −39.724 | −34.995 | 71.313 | 1.00 | 32.22 | D000 O |
| ATOM | 6973 | CB | PHE | I | 200 | −38.719 | −36.408 | 68.539 | 1.00 | 28.30 | D000 C |
| ATOM | 6974 | CG | PHE | I | 200 | −39.389 | −35.123 | 68.221 | 1.00 | 29.58 | D000 C |
| ATOM | 6975 | CD1 | PHE | I | 200 | −38.661 | −33.950 | 68.167 | 1.00 | 34.42 | D000 C |
| ATOM | 6976 | CD2 | PHE | I | 200 | −40.750 | −35.070 | 67.988 | 1.00 | 32.89 | D000 C |
| ATOM | 6977 | CE1 | PHE | I | 200 | −39.278 | −32.727 | 67.878 | 1.00 | 36.14 | D000 C |
| ATOM | 6978 | CE2 | PHE | I | 200 | −41.373 | −33.852 | 67.708 | 1.00 | 32.23 | D000 C |
| ATOM | 6979 | CZ | PHE | I | 200 | −40.628 | −32.679 | 67.656 | 1.00 | 32.52 | D000 C |
| ATOM | 6980 | N | VAL | I | 201 | −40.766 | −36.949 | 70.896 | 1.00 | 34.21 | D000 N |
| ATOM | 6981 | CA | VAL | I | 201 | −41.963 | −36.512 | 71.604 | 1.00 | 32.09 | D000 C |
| ATOM | 6982 | C | VAL | I | 201 | −41.691 | −36.409 | 73.104 | 1.00 | 28.47 | D000 C |
| ATOM | 6983 | O | VAL | I | 201 | −42.112 | −35.445 | 73.745 | 1.00 | 29.67 | D000 O |
| ATOM | 6984 | CB | VAL | I | 201 | −43.166 | −37.423 | 71.280 | 1.00 | 33.84 | D000 C |
| ATOM | 6985 | CG1 | VAL | I | 201 | −44.371 | −37.069 | 72.171 | 1.00 | 26.65 | D000 C |
| ATOM | 6986 | CG2 | VAL | I | 201 | −43.564 | −37.259 | 69.826 | 1.00 | 29.93 | D000 C |
| ATOM | 6987 | N | GLN | I | 202 | −40.948 | −37.368 | 73.675 | 1.00 | 29.76 | D000 N |
| ATOM | 6988 | CA | GLN | I | 202 | −40.625 | −37.333 | 75.103 | 1.00 | 27.89 | D000 C |
| ATOM | 6989 | C | GLN | I | 202 | −39.957 | −36.027 | 75.500 | 1.00 | 30.88 | D000 C |
| ATOM | 6990 | O | GLN | I | 202 | −40.371 | −35.375 | 76.462 | 1.00 | 33.51 | D000 O |
| ATOM | 6991 | CB | GLN | I | 202 | −39.692 | −38.471 | 75.456 | 1.00 | 36.89 | D000 C |
| ATOM | 6992 | CG | GLN | I | 202 | −40.291 | −39.826 | 75.569 | 1.00 | 42.55 | D000 C |

TABLE 10.4-continued

| | | | | | | | | | | | |
|---|---|---|---|---|---|---|---|---|---|---|---|
| ATOM | 6993 | CD | GLN | I | 202 | −39.269 | −40.793 | 76.129 | 1.00 | 48.57 | D000 C |
| ATOM | 6994 | OE1 | GLN | I | 202 | −39.196 | −41.954 | 75.707 | 1.00 | 49.10 | D000 O |
| ATOM | 6995 | NE2 | GLN | I | 202 | −38.440 | −40.305 | 77.064 | 1.00 | 45.91 | D000 N |
| ATOM | 6996 | N | HIS | I | 203 | −38.934 | −35.620 | 74.748 | 1.00 | 28.33 | D000 N |
| ATOM | 6997 | CA | HIS | I | 203 | −38.244 | −34.367 | 74.998 | 1.00 | 28.20 | D000 C |
| ATOM | 6998 | C | HIS | I | 203 | −39.221 | −33.223 | 75.160 | 1.00 | 32.96 | D000 C |
| ATOM | 6999 | O | HIS | I | 203 | −39.085 | −32.395 | 76.066 | 1.00 | 38.66 | D000 O |
| ATOM | 7000 | CB | HIS | I | 203 | −37.308 | −34.053 | 73.837 | 1.00 | 38.51 | D000 C |
| ATOM | 7001 | CG | HIS | I | 203 | −35.942 | −34.622 | 73.991 | 1.00 | 45.00 | D000 C |
| ATOM | 7002 | ND1 | HIS | I | 203 | −35.086 | −34.222 | 74.994 | 1.00 | 43.86 | D000 N |
| ATOM | 7003 | CD2 | HIS | I | 203 | −35.274 | −35.544 | 73.260 | 1.00 | 44.53 | D000 C |
| ATOM | 7004 | CE1 | HIS | I | 203 | −33.951 | −34.887 | 74.882 | 1.00 | 48.63 | D000 C |
| ATOM | 7005 | NE2 | HIS | I | 203 | −34.043 | −35.701 | 73.843 | 1.00 | 52.83 | D000 N |
| ATOM | 7006 | N | HIS | I | 204 | −40.192 | −33.140 | 74.253 | 1.00 | 33.22 | D000 N |
| ATOM | 7007 | CA | HIS | I | 204 | −41.092 | −32.000 | 74.229 | 1.00 | 33.76 | D000 C |
| ATOM | 7008 | C | HIS | I | 204 | −42.207 | −32.107 | 75.257 | 1.00 | 30.31 | D000 C |
| ATOM | 7009 | O | HIS | I | 204 | −42.651 | −31.076 | 75.766 | 1.00 | 32.42 | D000 O |
| ATOM | 7010 | CB | HIS | I | 204 | −41.680 | −31.825 | 72.836 | 1.00 | 34.09 | D000 C |
| ATOM | 7011 | CG | HIS | I | 204 | −40.730 | −31.209 | 71.872 | 1.00 | 33.98 | D000 C |
| ATOM | 7012 | ND1 | HIS | I | 204 | −40.541 | −29.847 | 71.793 | 1.00 | 36.56 | D000 N |
| ATOM | 7013 | CD2 | HIS | I | 204 | −39.894 | −31.764 | 70.964 | 1.00 | 37.43 | D000 C |
| ATOM | 7014 | CE1 | HIS | I | 204 | −39.636 | −29.587 | 70.865 | 1.00 | 42.50 | D000 C |
| ATOM | 7015 | NE2 | HIS | I | 204 | −39.224 | −30.732 | 70.349 | 1.00 | 42.23 | D000 N |
| ATOM | 7016 | N | ILE | I | 205 | −42.658 | −33.313 | 75.609 | 1.00 | 27.51 | D000 N |
| ATOM | 7017 | CA | ILE | I | 205 | −43.735 | −33.386 | 76.587 | 1.00 | 30.86 | D000 C |
| ATOM | 7018 | C | ILE | I | 205 | −43.220 | −33.433 | 78.017 | 1.00 | 29.89 | D000 C |
| ATOM | 7019 | O | ILE | I | 205 | −43.958 | −33.056 | 78.934 | 1.00 | 35.65 | D000 O |
| ATOM | 7020 | CB | ILE | I | 205 | −44.686 | −34.591 | 76.395 | 1.00 | 31.24 | D000 C |
| ATOM | 7021 | CG1 | ILE | I | 205 | −43.981 | −35.940 | 76.592 | 1.00 | 26.46 | D000 C |
| ATOM | 7022 | CG2 | ILE | I | 205 | −45.357 | −34.529 | 75.064 | 1.00 | 28.37 | D000 C |
| ATOM | 7023 | CD1 | ILE | I | 205 | −44.943 | −37.086 | 76.633 | 1.00 | 25.80 | D000 C |
| ATOM | 7024 | N | GLY | I | 206 | −41.978 | −33.852 | 78.238 | 1.00 | 28.95 | D000 N |
| ATOM | 7025 | CA | GLY | I | 206 | −41.465 | −33.985 | 79.584 | 1.00 | 29.61 | D000 C |
| ATOM | 7026 | C | GLY | I | 206 | −42.122 | −35.118 | 80.345 | 1.00 | 27.57 | D000 C |
| ATOM | 7027 | O | GLY | I | 206 | −42.811 | −35.956 | 79.766 | 1.00 | 29.14 | D000 O |
| ATOM | 7028 | N | PRO | I | 207 | −41.941 | −35.153 | 81.711 | 1.00 | 29.38 | D000 N |
| ATOM | 7029 | CA | PRO | I | 207 | −42.433 | −36.295 | 82.509 | 1.00 | 32.33 | D000 C |
| ATOM | 7030 | C | PRO | I | 207 | −43.904 | −36.143 | 82.896 | 1.00 | 35.00 | D000 C |
| ATOM | 7031 | O | PRO | I | 207 | −44.262 | −36.029 | 84.077 | 1.00 | 27.86 | D000 O |
| ATOM | 7032 | CB | PRO | I | 207 | −41.492 | −36.271 | 83.719 | 1.00 | 29.81 | D000 C |
| ATOM | 7033 | CG | PRO | I | 207 | −41.194 | −34.812 | 83.899 | 1.00 | 30.51 | D000 C |
| ATOM | 7034 | CD | PRO | I | 207 | −41.260 | −34.150 | 82.549 | 1.00 | 24.29 | D000 C |
| ATOM | 7035 | N | VAL | I | 208 | −44.771 | −36.126 | 81.879 | 1.00 | 31.78 | D000 N |
| ATOM | 7036 | CA | VAL | I | 208 | −46.167 | −35.726 | 81.999 | 1.00 | 26.40 | D000 C |
| ATOM | 7037 | C | VAL | I | 208 | −47.040 | −36.722 | 81.258 | 1.00 | 27.82 | D000 C |
| ATOM | 7038 | O | VAL | I | 208 | −46.764 | −37.034 | 80.098 | 1.00 | 30.68 | D000 O |
| ATOM | 7039 | CB | VAL | I | 208 | −46.388 | −34.323 | 81.425 | 1.00 | 25.92 | D000 C |
| ATOM | 7040 | CG1 | VAL | I | 208 | −47.832 | −33.981 | 81.495 | 1.00 | 28.17 | D000 C |
| ATOM | 7041 | CG2 | VAL | I | 208 | −45.544 | −33.320 | 82.172 | 1.00 | 26.96 | D000 C |
| ATOM | 7042 | N | ASN | I | 209 | −48.080 | −37.232 | 81.927 | 1.00 | 27.70 | D000 N |
| ATOM | 7043 | CA | ASN | I | 209 | −49.054 | −38.093 | 81.264 | 1.00 | 25.54 | D000 C |
| ATOM | 7044 | C | ASN | I | 209 | −49.688 | −37.350 | 80.096 | 1.00 | 29.53 | D000 C |
| ATOM | 7045 | O | ASN | I | 209 | −50.263 | −36.271 | 80.277 | 1.00 | 30.75 | D000 O |
| ATOM | 7046 | CB | ASN | I | 209 | −50.119 | −38.560 | 82.251 | 1.00 | 24.84 | D000 C |
| ATOM | 7047 | CG | ASN | I | 209 | −49.588 | −39.606 | 83.223 | 1.00 | 31.55 | D000 C |
| ATOM | 7048 | OD1 | ASN | I | 209 | −48.636 | −40.343 | 82.922 | 1.00 | 29.18 | D000 O |
| ATOM | 7049 | ND2 | ASN | I | 209 | −50.193 | −39.667 | 84.407 | 1.00 | 32.11 | D000 N |
| ATOM | 7050 | N | THR | I | 210 | −49.543 | −37.905 | 78.889 | 1.00 | 28.06 | D000 N |
| ATOM | 7051 | CA | THR | I | 210 | −49.900 | −37.194 | 77.666 | 1.00 | 29.54 | D000 C |
| ATOM | 7052 | C | THR | I | 210 | −50.593 | −38.164 | 76.716 | 1.00 | 30.18 | D000 C |
| ATOM | 7053 | O | THR | I | 210 | −50.080 | −39.257 | 76.474 | 1.00 | 31.78 | D000 O |
| ATOM | 7054 | CB | THR | I | 210 | −48.635 | −36.568 | 77.017 | 1.00 | 32.46 | D000 C |
| ATOM | 7055 | OG1 | THR | I | 210 | −48.068 | −35.576 | 77.891 | 1.00 | 28.52 | D000 O |
| ATOM | 7056 | CG2 | THR | I | 210 | −48.955 | −35.895 | 75.680 | 1.00 | 32.03 | D000 C |
| ATOM | 7057 | N | TRP | I | 211 | −51.748 | −37.771 | 76.178 | 1.00 | 28.21 | D000 N |
| ATOM | 7058 | CA | TRP | I | 211 | −52.484 | −38.637 | 75.257 | 1.00 | 30.26 | D000 C |
| ATOM | 7059 | C | TRP | I | 211 | −51.777 | −38.768 | 73.915 | 1.00 | 34.53 | D000 C |
| ATOM | 7060 | O | TRP | I | 211 | −51.243 | −37.784 | 73.388 | 1.00 | 36.53 | D000 O |
| ATOM | 7061 | CB | TRP | I | 211 | −53.870 | −38.078 | 74.986 | 1.00 | 27.00 | D000 C |
| ATOM | 7062 | CG | TRP | I | 211 | −54.837 | −38.105 | 76.098 | 1.00 | 29.16 | D000 C |
| ATOM | 7063 | CD1 | TRP | I | 211 | −55.575 | −37.051 | 76.552 | 1.00 | 29.17 | D000 C |
| ATOM | 7064 | CD2 | TRP | I | 211 | −55.232 | −39.235 | 76.871 | 1.00 | 27.40 | D000 C |
| ATOM | 7065 | NE1 | TRP | I | 211 | −56.401 | −37.453 | 77.547 | 1.00 | 29.33 | D000 N |
| ATOM | 7066 | CE2 | TRP | I | 211 | −56.208 | −38.791 | 77.777 | 1.00 | 31.18 | D000 C |
| ATOM | 7067 | CE3 | TRP | I | 211 | −54.849 | −40.575 | 76.896 | 1.00 | 30.57 | D000 C |
| ATOM | 7068 | CZ2 | TRP | I | 211 | −56.804 | −39.643 | 78.721 | 1.00 | 33.48 | D000 C |
| ATOM | 7069 | CZ3 | TRP | I | 211 | −55.442 | −41.420 | 77.828 | 1.00 | 32.75 | D000 C |
| ATOM | 7070 | CH2 | TRP | I | 211 | −56.414 | −40.952 | 78.721 | 1.00 | 31.65 | D000 C |
| ATOM | 7071 | N | MET | I | 212 | −51.828 | −39.969 | 73.332 | 1.00 | 30.71 | D000 N |
| ATOM | 7072 | CA | MET | I | 212 | −51.425 | −40.202 | 71.945 | 1.00 | 35.06 | D000 C |

TABLE 10.4-continued

| ATOM | 7073 | C | MET | I | 212 | −52.588 | −40.816 | 71.166 | 1.00 | 34.50 | D000 | C |
|---|---|---|---|---|---|---|---|---|---|---|---|---|
| ATOM | 7074 | O | MET | I | 212 | −53.536 | −41.339 | 71.746 | 1.00 | 29.90 | D000 | O |
| ATOM | 7075 | CB | MET | I | 212 | −50.197 | −41.126 | 71.870 | 1.00 | 33.98 | D000 | C |
| ATOM | 7076 | CG | MET | I | 212 | −50.532 | −42.612 | 72.009 | 1.00 | 34.65 | D000 | C |
| ATOM | 7077 | SD | MET | I | 212 | −49.112 | −43.701 | 72.320 | 1.00 | 36.95 | D000 | S |
| ATOM | 7078 | CE | MET | I | 212 | −48.665 | −43.185 | 73.977 | 1.00 | 32.76 | D000 | C |
| ATOM | 7079 | N | GLY | I | 213 | −52.482 | −40.824 | 69.836 | 1.00 | 31.69 | D000 | N |
| ATOM | 7080 | CA | GLY | I | 213 | −53.575 | −41.340 | 69.027 | 1.00 | 34.66 | D000 | C |
| ATOM | 7081 | C | GLY | I | 213 | −53.764 | −42.849 | 68.974 | 1.00 | 32.70 | D000 | C |
| ATOM | 7082 | O | GLY | I | 213 | −53.862 | −43.424 | 67.900 | 1.00 | 36.23 | D000 | O |
| ATOM | 7083 | N | LEU | I | 214 | −53.871 | −43.509 | 70.116 | 1.00 | 34.81 | D000 | N |
| ATOM | 7084 | CA | LEU | I | 214 | −53.951 | −44.961 | 70.150 | 1.00 | 39.32 | D000 | C |
| ATOM | 7085 | C | LEU | I | 214 | −55.046 | −45.365 | 71.132 | 1.00 | 45.03 | D000 | C |
| ATOM | 7086 | O | LEU | I | 214 | −54.950 | −45.073 | 72.327 | 1.00 | 45.18 | D000 | O |
| ATOM | 7087 | CB | LEU | I | 214 | −52.589 | −45.544 | 70.557 | 1.00 | 39.33 | D000 | C |
| ATOM | 7088 | CG | LEU | I | 214 | −52.388 | −47.049 | 70.722 | 1.00 | 44.57 | D000 | C |
| ATOM | 7089 | CD1 | LEU | I | 214 | −52.448 | −47.717 | 69.369 | 1.00 | 42.58 | D000 | C |
| ATOM | 7090 | CD2 | LEU | I | 214 | −51.059 | −47.335 | 71.406 | 1.00 | 38.76 | D000 | C |
| ATOM | 7091 | N | HIS | I | 215 | −56.076 | −46.053 | 70.639 | 1.00 | 50.99 | D000 | N |
| ATOM | 7092 | CA | HIS | I | 215 | −57.202 | −46.449 | 71.479 | 1.00 | 54.24 | D000 | C |
| ATOM | 7093 | C | HIS | I | 215 | −57.809 | −47.741 | 70.957 | 1.00 | 53.49 | D000 | C |
| ATOM | 7094 | O | HIS | I | 215 | −57.726 | −48.039 | 69.766 | 1.00 | 59.77 | D000 | O |
| ATOM | 7095 | CB | HIS | I | 215 | −58.297 | −45.381 | 71.525 | 1.00 | 51.69 | D000 | C |
| ATOM | 7096 | CG | HIS | I | 215 | −58.991 | −45.169 | 70.220 | 1.00 | 53.16 | D000 | C |
| ATOM | 7097 | ND1 | HIS | I | 215 | −60.319 | −44.814 | 70.139 | 1.00 | 61.14 | D000 | N |
| ATOM | 7098 | CD2 | HIS | I | 215 | −58.542 | −45.241 | 68.946 | 1.00 | 52.42 | D000 | C |
| ATOM | 7099 | CE1 | HIS | I | 215 | −60.664 | −44.692 | 68.868 | 1.00 | 60.68 | D000 | C |
| ATOM | 7100 | NE2 | HIS | I | 215 | −59.602 | −44.938 | 68.124 | 1.00 | 56.57 | D000 | N |
| ATOM | 7101 | N | ASP | I | 216 | −58.446 | −48.489 | 71.850 | 1.00 | 51.53 | D000 | N |
| ATOM | 7102 | CA | ASP | I | 216 | −59.163 | −49.708 | 71.488 | 1.00 | 63.11 | D000 | C |
| ATOM | 7103 | C | ASP | I | 216 | −60.629 | −49.629 | 71.897 | 1.00 | 70.32 | D000 | C |
| ATOM | 7104 | O | ASP | I | 216 | −61.218 | −50.615 | 72.345 | 1.00 | 73.44 | D000 | O |
| ATOM | 7105 | CB | ASP | I | 216 | −58.504 | −50.956 | 72.083 | 1.00 | 62.05 | D000 | C |
| ATOM | 7106 | CG | ASP | I | 216 | −58.816 | −51.157 | 73.565 | 1.00 | 63.11 | D000 | C |
| ATOM | 7107 | OD1 | ASP | I | 216 | −59.134 | −50.177 | 74.265 | 1.00 | 66.02 | D000 | O |
| ATOM | 7108 | OD2 | ASP | I | 216 | −58.783 | −52.313 | 74.025 | 1.00 | 71.37 | D000 | O1− |
| ATOM | 7109 | N | GLN | I | 217 | −61.243 | −48.448 | 71.761 | 1.00 | 68.81 | D000 | N |
| ATOM | 7110 | CA | GLN | I | 217 | −62.674 | −48.330 | 72.036 | 1.00 | 79.13 | D000 | C |
| ATOM | 7111 | C | GLN | I | 217 | −63.497 | −49.323 | 71.214 | 1.00 | 82.76 | D000 | C |
| ATOM | 7112 | O | GLN | I | 217 | −64.637 | −49.629 | 71.584 | 1.00 | 81.10 | D000 | O |
| ATOM | 7113 | CB | GLN | I | 217 | −63.136 | −46.885 | 71.804 | 1.00 | 78.37 | D000 | C |
| ATOM | 7114 | CG | GLN | I | 217 | −63.047 | −46.020 | 73.089 | 1.00 | 75.77 | D000 | C |
| ATOM | 7115 | CD | GLN | I | 217 | −62.642 | −44.570 | 72.825 | 1.00 | 67.80 | D000 | C |
| ATOM | 7116 | OE1 | GLN | I | 217 | −61.796 | −44.296 | 71.969 | 1.00 | 62.96 | D000 | O |
| ATOM | 7117 | NE2 | GLN | I | 217 | −63.220 | −43.637 | 73.591 | 1.00 | 56.15 | D000 | N |
| ATOM | 7118 | N | ASN | I | 218 | −62.934 | −49.838 | 70.118 | 1.00 | 81.51 | D000 | N |
| ATOM | 7119 | CA | ASN | I | 218 | −63.546 | −50.918 | 69.346 | 1.00 | 86.93 | D000 | C |
| ATOM | 7120 | C | ASN | I | 218 | −63.369 | −52.279 | 70.037 | 1.00 | 84.87 | D000 | C |
| ATOM | 7121 | O | ASN | I | 218 | −64.349 | −52.951 | 70.386 | 1.00 | 79.46 | D000 | O |
| ATOM | 7122 | CB | ASN | I | 218 | −62.928 | −50.932 | 67.942 | 1.00 | 92.18 | D000 | C |
| ATOM | 7123 | CG | ASN | I | 218 | −63.905 | −51.382 | 66.867 | 1.00 | 99.76 | D000 | C |
| ATOM | 7124 | OD1 | ASN | I | 218 | −63.626 | −51.249 | 65.669 | 1.00 | 98.33 | D000 | O |
| ATOM | 7125 | ND2 | ASN | I | 218 | −65.059 | −51.902 | 67.285 | 1.00 | 97.53 | D000 | N |
| ATOM | 7126 | N | GLY | I | 219 | −62.117 | −52.679 | 70.279 | 1.00 | 81.16 | D000 | N |
| ATOM | 7127 | CA | GLY | I | 219 | −61.786 | −54.004 | 70.763 | 1.00 | 72.74 | D000 | C |
| ATOM | 7128 | C | GLY | I | 219 | −60.286 | −54.248 | 70.697 | 1.00 | 71.27 | D000 | C |
| ATOM | 7129 | O | GLY | I | 219 | −59.631 | −54.504 | 71.715 | 1.00 | 64.68 | D000 | O |
| ATOM | 7130 | N | PRO | I | 220 | −59.712 | −54.165 | 69.493 | 1.00 | 71.97 | D000 | N |
| ATOM | 7131 | CA | PRO | I | 220 | −58.254 | −54.149 | 69.354 | 1.00 | 66.99 | D000 | C |
| ATOM | 7132 | C | PRO | I | 220 | −57.718 | −52.723 | 69.288 | 1.00 | 65.66 | D000 | C |
| ATOM | 7133 | O | PRO | I | 220 | −58.435 | −51.765 | 68.980 | 1.00 | 63.20 | D000 | O |
| ATOM | 7134 | CB | PRO | I | 220 | −58.025 | −54.861 | 68.014 | 1.00 | 60.23 | D000 | C |
| ATOM | 7135 | CG | PRO | I | 220 | −59.311 | −54.670 | 67.242 | 1.00 | 61.26 | D000 | C |
| ATOM | 7136 | CD | PRO | I | 220 | −60.369 | −54.114 | 68.172 | 1.00 | 66.08 | D000 | C |
| ATOM | 7137 | N | TRP | I | 221 | −56.429 | −52.596 | 69.586 | 1.00 | 55.14 | D000 | N |
| ATOM | 7138 | CA | TRP | I | 221 | −55.793 | −51.292 | 69.545 | 1.00 | 47.35 | D000 | C |
| ATOM | 7139 | C | TRP | I | 221 | −55.622 | −50.832 | 68.103 | 1.00 | 49.66 | D000 | C |
| ATOM | 7140 | O | TRP | I | 221 | −55.267 | −51.614 | 67.218 | 1.00 | 47.87 | D000 | O |
| ATOM | 7141 | CB | TRP | I | 221 | −54.450 | −51.345 | 70.262 | 1.00 | 52.11 | D000 | C |
| ATOM | 7142 | CG | TRP | I | 221 | −54.577 | −51.541 | 71.768 | 1.00 | 58.06 | D000 | C |
| ATOM | 7143 | CD1 | TRP | I | 221 | −54.489 | −52.721 | 72.456 | 1.00 | 56.76 | D000 | C |
| ATOM | 7144 | CD2 | TRP | I | 221 | −54.817 | −50.524 | 72.754 | 1.00 | 56.97 | D000 | C |
| ATOM | 7145 | NE1 | TRP | I | 221 | −54.650 | −52.500 | 73.800 | 1.00 | 58.53 | D000 | N |
| ATOM | 7146 | CE2 | TRP | I | 221 | −54.860 | −51.163 | 74.012 | 1.00 | 57.57 | D000 | C |
| ATOM | 7147 | CE3 | TRP | I | 221 | −54.999 | −49.136 | 72.695 | 1.00 | 53.29 | D000 | C |
| ATOM | 7148 | CZ2 | TRP | I | 221 | −55.078 | −50.464 | 75.201 | 1.00 | 53.89 | D000 | C |
| ATOM | 7149 | CZ3 | TRP | I | 221 | −55.211 | −48.447 | 73.874 | 1.00 | 50.92 | D000 | C |
| ATOM | 7150 | CH2 | TRP | I | 221 | −55.251 | −49.113 | 75.110 | 1.00 | 52.06 | D000 | C |
| ATOM | 7151 | N | LYS | I | 222 | −55.888 | −49.550 | 67.870 | 1.00 | 47.59 | D000 | N |
| ATOM | 7152 | CA | LYS | I | 222 | −55.833 | −48.951 | 66.546 | 1.00 | 47.00 | D000 | C |

TABLE 10.4-continued

| | | | | | | | | | | | |
|---|---|---|---|---|---|---|---|---|---|---|---|
| ATOM | 7153 | C | LYS | I | 222 | −55.218 | −47.565 | 66.654 | 1.00 | 47.01 | D000 C |
| ATOM | 7154 | O | LYS | I | 222 | −55.421 | −46.869 | 67.650 | 1.00 | 48.52 | D000 O |
| ATOM | 7155 | CB | LYS | I | 222 | −57.240 | −48.830 | 65.933 | 1.00 | 47.34 | D000 C |
| ATOM | 7156 | CG | LYS | I | 222 | −58.076 | −50.090 | 66.018 | 1.00 | 46.82 | D000 C |
| ATOM | 7157 | CD | LYS | I | 222 | −59.483 | −49.822 | 65.523 | 1.00 | 66.09 | D000 C |
| ATOM | 7158 | CE | LYS | I | 222 | −60.297 | −51.108 | 65.437 | 1.00 | 78.89 | D000 C |
| ATOM | 7159 | NZ | LYS | I | 222 | −61.575 | −50.950 | 64.682 | 1.00 | 75.65 | D000 N1+ |
| ATOM | 7160 | N | TRP | I | 223 | −54.475 | −47.155 | 65.630 | 1.00 | 40.12 | D000 N |
| ATOM | 7161 | CA | TRP | I | 223 | −54.033 | −45.768 | 65.562 | 1.00 | 42.18 | D000 C |
| ATOM | 7162 | C | TRP | I | 223 | −55.057 | −44.910 | 64.815 | 1.00 | 40.82 | D000 C |
| ATOM | 7163 | O | TRP | I | 223 | −55.674 | −45.348 | 63.843 | 1.00 | 42.00 | D000 O |
| ATOM | 7164 | CB | TRP | I | 223 | −52.654 | −45.651 | 64.892 | 1.00 | 40.05 | D000 C |
| ATOM | 7165 | CG | TRP | I | 223 | −51.497 | −46.261 | 65.689 | 1.00 | 43.88 | D000 C |
| ATOM | 7166 | CD1 | TRP | I | 223 | −50.994 | −47.529 | 65.568 | 1.00 | 43.26 | D000 C |
| ATOM | 7167 | CD2 | TRP | I | 223 | −50.711 | −45.620 | 66.718 | 1.00 | 45.79 | D000 C |
| ATOM | 7168 | NE1 | TRP | I | 223 | −49.959 | −47.722 | 66.455 | 1.00 | 40.92 | D000 N |
| ATOM | 7169 | CE2 | TRP | I | 223 | −49.761 | −46.570 | 67.171 | 1.00 | 42.07 | D000 C |
| ATOM | 7170 | CE3 | TRP | I | 223 | −50.730 | −44.341 | 67.310 | 1.00 | 40.91 | D000 C |
| ATOM | 7171 | CZ2 | TRP | I | 223 | −48.837 | −46.284 | 68.182 | 1.00 | 38.74 | D000 C |
| ATOM | 7172 | CZ3 | TRP | I | 223 | −49.809 | −44.054 | 68.305 | 1.00 | 37.29 | D000 C |
| ATOM | 7173 | CH2 | TRP | I | 223 | −48.872 | −45.027 | 68.730 | 1.00 | 42.40 | D000 C |
| ATOM | 7174 | N | VAL | I | 224 | −55.158 | −43.642 | 65.220 | 1.00 | 35.57 | D000 N |
| ATOM | 7175 | CA | VAL | I | 224 | −56.214 | −42.782 | 64.710 | 1.00 | 38.56 | D000 C |
| ATOM | 7176 | C | VAL | I | 224 | −56.046 | −42.420 | 63.229 | 1.00 | 44.84 | D000 C |
| ATOM | 7177 | O | VAL | I | 224 | −57.010 | −41.965 | 62.593 | 1.00 | 41.50 | D000 O |
| ATOM | 7178 | CB | VAL | I | 224 | −56.317 | −41.511 | 65.574 | 1.00 | 38.88 | D000 C |
| ATOM | 7179 | CG1 | VAL | I | 224 | −56.643 | −41.880 | 66.984 | 1.00 | 34.96 | D000 C |
| ATOM | 7180 | CG2 | VAL | I | 224 | −55.044 | −40.664 | 65.498 | 1.00 | 36.68 | D000 C |
| ATOM | 7181 | N | ASP | I | 225 | −54.854 | −42.575 | 62.657 | 1.00 | 47.42 | D000 N |
| ATOM | 7182 | CA | ASP | I | 225 | −54.634 | −42.202 | 61.264 | 1.00 | 45.07 | D000 C |
| ATOM | 7183 | C | ASP | I | 225 | −54.667 | −43.405 | 60.323 | 1.00 | 47.81 | D000 C |
| ATOM | 7184 | O | ASP | I | 225 | −54.433 | −43.248 | 59.117 | 1.00 | 47.18 | D000 O |
| ATOM | 7185 | CB | ASP | I | 225 | −53.316 | −41.416 | 61.120 | 1.00 | 43.11 | D000 C |
| ATOM | 7186 | CG | ASP | I | 225 | −52.062 | −42.297 | 61.130 | 1.00 | 45.43 | D000 C |
| ATOM | 7187 | OD1 | ASP | I | 225 | −52.115 | −43.489 | 61.519 | 1.00 | 41.39 | D000 O |
| ATOM | 7188 | OD2 | ASP | I | 225 | −50.996 | −41.765 | 60.728 | 1.00 | 46.94 | D000 O1− |
| ATOM | 7189 | N | GLY | I | 226 | −54.980 | −44.593 | 60.847 | 1.00 | 47.45 | D000 N |
| ATOM | 7190 | CA | GLY | I | 226 | −55.065 | −45.811 | 60.081 | 1.00 | 41.79 | D000 C |
| ATOM | 7191 | C | GLY | I | 226 | −53.833 | −46.683 | 60.170 | 1.00 | 52.00 | D000 C |
| ATOM | 7192 | O | GLY | I | 226 | −53.912 | −47.876 | 59.850 | 1.00 | 56.10 | D000 O |
| ATOM | 7193 | N | THR | I | 227 | −52.713 | −46.128 | 60.647 | 1.00 | 51.85 | D000 N |
| ATOM | 7194 | CA | THR | I | 227 | −51.473 | −46.886 | 60.769 | 1.00 | 46.63 | D000 C |
| ATOM | 7195 | C | THR | I | 227 | −51.717 | −48.209 | 61.476 | 1.00 | 39.30 | D000 C |
| ATOM | 7196 | O | THR | I | 227 | −52.498 | −48.293 | 62.422 | 1.00 | 45.35 | D000 O |
| ATOM | 7197 | CB | THR | I | 227 | −50.425 | −46.078 | 61.535 | 1.00 | 41.84 | D000 C |
| ATOM | 7198 | OG1 | THR | I | 227 | −50.287 | −44.782 | 60.931 | 1.00 | 39.58 | D000 O |
| ATOM | 7199 | CG2 | THR | I | 227 | −49.093 | −46.792 | 61.502 | 1.00 | 32.58 | D000 C |
| ATOM | 7200 | N | ASP | I | 228 | −51.097 | −49.259 | 60.965 | 1.00 | 42.37 | D000 N |
| ATOM | 7201 | CA | ASP | I | 228 | −51.312 | −50.564 | 61.553 | 1.00 | 43.67 | D000 C |
| ATOM | 7202 | C | ASP | I | 228 | −50.643 | −50.637 | 62.911 | 1.00 | 47.41 | D000 C |
| ATOM | 7203 | O | ASP | I | 228 | −49.510 | −50.182 | 63.090 | 1.00 | 48.24 | D000 O |
| ATOM | 7204 | CB | ASP | I | 228 | −50.780 | −51.670 | 60.657 | 1.00 | 44.10 | D000 C |
| ATOM | 7205 | CG | ASP | I | 228 | −50.886 | −53.024 | 61.317 | 1.00 | 47.63 | D000 C |
| ATOM | 7206 | OD1 | ASP | I | 228 | −52.011 | −53.436 | 61.652 | 1.00 | 48.15 | D000 O |
| ATOM | 7207 | OD2 | ASP | I | 228 | −49.842 | −53.674 | 61.519 | 1.00 | 56.59 | D000 O1− |
| ATOM | 7208 | N | TYR | I | 229 | −51.362 | −51.196 | 63.878 | 1.00 | 48.84 | D000 N |
| ATOM | 7209 | CA | TYR | I | 229 | −50.808 | −51.333 | 65.220 | 1.00 | 52.99 | D000 C |
| ATOM | 7210 | C | TYR | I | 229 | −49.895 | −52.557 | 65.345 | 1.00 | 52.23 | D000 C |
| ATOM | 7211 | O | TYR | I | 229 | −48.800 | −52.471 | 65.919 | 1.00 | 51.49 | D000 O |
| ATOM | 7212 | CB | TYR | I | 229 | −51.949 | −51.395 | 66.243 | 1.00 | 46.59 | D000 C |
| ATOM | 7213 | CG | TYR | I | 229 | −51.529 | −51.806 | 67.625 | 1.00 | 44.81 | D000 C |
| ATOM | 7214 | CD2 | TYR | I | 229 | −51.533 | −53.141 | 67.992 | 1.00 | 47.32 | D000 C |
| ATOM | 7215 | CD1 | TYR | I | 229 | −51.096 | −50.875 | 68.549 | 1.00 | 47.52 | D000 C |
| ATOM | 7216 | CE2 | TYR | I | 229 | −51.138 | −53.545 | 69.242 | 1.00 | 50.06 | D000 C |
| ATOM | 7217 | CE1 | TYR | I | 229 | −50.700 | −51.268 | 69.830 | 1.00 | 49.62 | D000 C |
| ATOM | 7218 | CZ | TYR | I | 229 | −50.723 | −52.613 | 70.161 | 1.00 | 51.78 | D000 C |
| ATOM | 7219 | OH | TYR | I | 229 | −50.341 | −53.044 | 71.407 | 1.00 | 41.13 | D000 O |
| ATOM | 7220 | N | GLU | I | 230 | −50.333 | −53.705 | 64.828 | 1.00 | 53.05 | D000 N |
| ATOM | 7221 | CA | GLU | I | 230 | −49.710 | −54.967 | 65.221 | 1.00 | 54.20 | D000 C |
| ATOM | 7222 | C | GLU | I | 230 | −48.276 | −55.102 | 64.708 | 1.00 | 52.15 | D000 C |
| ATOM | 7223 | O | GLU | I | 230 | −47.392 | −55.578 | 65.430 | 1.00 | 54.02 | D000 O |
| ATOM | 7224 | CB | GLU | I | 230 | −50.577 | −56.134 | 64.766 | 1.00 | 60.03 | D000 C |
| ATOM | 7225 | CG | GLU | I | 230 | −50.249 | −57.386 | 65.539 | 1.00 | 67.01 | D000 C |
| ATOM | 7226 | CD | GLU | I | 230 | −50.036 | −57.099 | 67.016 | 1.00 | 66.61 | D000 C |
| ATOM | 7227 | OE1 | GLU | I | 230 | −51.027 | −56.765 | 67.706 | 1.00 | 68.50 | D000 O |
| ATOM | 7228 | OE2 | GLU | I | 230 | −48.871 | −57.189 | 67.479 | 1.00 | 67.23 | D000 O1− |
| ATOM | 7229 | N | THR | I | 231 | −48.019 | −54.721 | 63.470 | 1.00 | 52.10 | D000 N |
| ATOM | 7230 | CA | THR | I | 231 | −46.651 | −54.762 | 62.968 | 1.00 | 54.05 | D000 C |
| ATOM | 7231 | C | THR | I | 231 | −45.864 | −53.483 | 63.276 | 1.00 | 50.36 | D000 C |
| ATOM | 7232 | O | THR | I | 231 | −44.664 | −53.426 | 62.977 | 1.00 | 52.95 | D000 O |

TABLE 10.4-continued

| ATOM | 7233 | CB | THR | I | 231 | −46.649 | −55.055 | 61.450 | 1.00 | 52.18 | D000 | C |
|---|---|---|---|---|---|---|---|---|---|---|---|---|
| ATOM | 7234 | OG1 | THR | I | 231 | −47.303 | −53.996 | 60.732 | 1.00 | 44.52 | D000 | O |
| ATOM | 7235 | CG2 | THR | I | 231 | −47.325 | −56.388 | 61.140 | 1.00 | 44.56 | D000 | C |
| ATOM | 7236 | N | GLY | I | 232 | −46.494 | −52.478 | 63.907 | 1.00 | 46.91 | D000 | N |
| ATOM | 7237 | CA | GLY | I | 232 | −45.878 | −51.180 | 64.126 | 1.00 | 47.37 | D000 | C |
| ATOM | 7238 | C | GLY | I | 232 | −45.126 | −51.024 | 65.460 | 1.00 | 47.60 | D000 | C |
| ATOM | 7239 | O | GLY | I | 232 | −45.082 | −51.911 | 66.317 | 1.00 | 49.36 | D000 | O |
| ATOM | 7240 | N | PHE | I | 233 | −44.496 | −49.860 | 65.599 | 1.00 | 41.36 | D000 | N |
| ATOM | 7241 | CA | PHE | I | 233 | −43.718 | −49.535 | 66.789 | 1.00 | 43.90 | D000 | C |
| ATOM | 7242 | C | PHE | I | 233 | −44.583 | −49.581 | 68.043 | 1.00 | 44.53 | D000 | C |
| ATOM | 7243 | O | PHE | I | 233 | −45.750 | −49.180 | 68.019 | 1.00 | 48.88 | D000 | O |
| ATOM | 7244 | CB | PHE | I | 233 | −43.083 | −48.144 | 66.644 | 1.00 | 46.48 | D000 | C |
| ATOM | 7245 | CG | PHE | I | 233 | −42.286 | −47.729 | 67.846 | 1.00 | 53.61 | D000 | C |
| ATOM | 7246 | CD1 | PHE | I | 233 | −40.995 | −48.197 | 68.026 | 1.00 | 46.82 | D000 | C |
| ATOM | 7247 | CD2 | PHE | I | 233 | −42.838 | −46.911 | 68.820 | 1.00 | 52.29 | D000 | C |
| ATOM | 7248 | CE1 | PHE | I | 233 | −40.276 | −47.855 | 69.139 | 1.00 | 48.20 | D000 | C |
| ATOM | 7249 | CE2 | PHE | I | 233 | −42.114 | −46.558 | 69.940 | 1.00 | 45.86 | D000 | C |
| ATOM | 7250 | CZ | PHE | I | 233 | −40.831 | −47.029 | 70.096 | 1.00 | 50.22 | D000 | C |
| ATOM | 7251 | N | LYS | I | 234 | −44.011 | −50.083 | 69.143 | 1.00 | 41.34 | D000 | N |
| ATOM | 7252 | CA | LYS | I | 234 | −44.704 | −50.159 | 70.428 | 1.00 | 44.31 | D000 | C |
| ATOM | 7253 | C | LYS | I | 234 | −43.739 | −49.876 | 71.575 | 1.00 | 45.74 | D000 | C |
| ATOM | 7254 | O | LYS | I | 234 | −42.561 | −50.223 | 71.499 | 1.00 | 52.26 | D000 | O |
| ATOM | 7255 | CB | LYS | I | 234 | −45.349 | −51.532 | 70.647 | 1.00 | 50.12 | D000 | C |
| ATOM | 7256 | CG | LYS | I | 234 | −46.423 | −51.935 | 69.649 | 1.00 | 46.91 | D000 | C |
| ATOM | 7257 | CD | LYS | I | 234 | −46.920 | −53.333 | 69.980 | 1.00 | 41.34 | D000 | C |
| ATOM | 7258 | CE | LYS | I | 234 | −47.495 | −53.986 | 68.756 | 1.00 | 52.95 | D000 | C |
| ATOM | 7259 | NZ | LYS | I | 234 | −46.449 | −54.101 | 67.706 | 1.00 | 54.61 | D000 | N1+ |
| ATOM | 7260 | N | ASN | I | 235 | −44.239 | −49.255 | 72.646 | 1.00 | 46.61 | D000 | N |
| ATOM | 7261 | CA | ASN | I | 235 | −43.386 | −48.905 | 73.785 | 1.00 | 40.27 | D000 | C |
| ATOM | 7262 | C | ASN | I | 235 | −44.180 | −48.890 | 75.098 | 1.00 | 44.39 | D000 | C |
| ATOM | 7263 | O | ASN | I | 235 | −44.138 | −47.925 | 75.865 | 1.00 | 45.23 | D000 | O |
| ATOM | 7264 | CB | ASN | I | 235 | −42.691 | −47.564 | 73.545 | 1.00 | 38.53 | D000 | C |
| ATOM | 7265 | CG | ASN | I | 235 | −41.620 | −47.270 | 74.577 | 1.00 | 40.11 | D000 | C |
| ATOM | 7266 | OD1 | ASN | I | 235 | −40.990 | −48.178 | 75.105 | 1.00 | 44.27 | D000 | O |
| ATOM | 7267 | ND2 | ASN | I | 235 | −41.420 | −46.000 | 74.879 | 1.00 | 41.29 | D000 | N |
| ATOM | 7268 | N | TRP | I | 236 | −44.905 | −49.971 | 75.387 | 1.00 | 43.99 | D000 | N |
| ATOM | 7269 | CA | TRP | I | 236 | −45.720 | −50.052 | 76.600 | 1.00 | 45.07 | D000 | C |
| ATOM | 7270 | C | TRP | I | 236 | −44.866 | −50.125 | 77.866 | 1.00 | 46.24 | D000 | C |
| ATOM | 7271 | O | TRP | I | 236 | −43.739 | −50.626 | 77.846 | 1.00 | 47.40 | D000 | O |
| ATOM | 7272 | CB | TRP | I | 236 | −46.614 | −51.289 | 76.550 | 1.00 | 44.75 | D000 | C |
| ATOM | 7273 | CG | TRP | I | 236 | −47.647 | −51.240 | 75.491 | 1.00 | 48.81 | D000 | C |
| ATOM | 7274 | CD1 | TRP | I | 236 | −47.616 | −51.876 | 74.288 | 1.00 | 46.27 | D000 | C |
| ATOM | 7275 | CD2 | TRP | I | 236 | −48.878 | −50.513 | 75.531 | 1.00 | 50.08 | D000 | C |
| ATOM | 7276 | NE1 | TRP | I | 236 | −48.749 | −51.591 | 73.573 | 1.00 | 46.50 | D000 | N |
| ATOM | 7277 | CE2 | TRP | I | 236 | −49.543 | −50.756 | 74.314 | 1.00 | 52.31 | D000 | C |
| ATOM | 7278 | CE3 | TRP | I | 236 | −49.482 | −49.680 | 76.480 | 1.00 | 48.48 | D000 | C |
| ATOM | 7279 | CZ2 | TRP | I | 236 | −50.787 | −50.195 | 74.018 | 1.00 | 53.44 | D000 | C |
| ATOM | 7280 | CZ3 | TRP | I | 236 | −50.708 | −49.126 | 76.192 | 1.00 | 49.54 | D000 | C |
| ATOM | 7281 | CH2 | TRP | I | 236 | −51.354 | −49.388 | 74.969 | 1.00 | 55.96 | D000 | C |
| ATOM | 7282 | N | ARG | I | 237 | −45.410 | −49.600 | 78.981 | 1.00 | 46.86 | D000 | N |
| ATOM | 7283 | CA | ARG | I | 237 | −44.869 | −49.924 | 80.304 | 1.00 | 52.81 | D000 | C |
| ATOM | 7284 | C | ARG | I | 237 | −45.128 | −51.400 | 80.593 | 1.00 | 57.44 | D000 | C |
| ATOM | 7285 | O | ARG | I | 237 | −46.167 | −51.926 | 80.193 | 1.00 | 65.84 | D000 | O |
| ATOM | 7286 | CB | ARG | I | 237 | −45.507 | −49.082 | 81.421 | 1.00 | 48.92 | D000 | C |
| ATOM | 7287 | CG | ARG | I | 237 | −45.148 | −47.579 | 81.479 | 1.00 | 52.62 | D000 | C |
| ATOM | 7288 | CD | ARG | I | 237 | −43.916 | −47.207 | 82.346 | 1.00 | 51.01 | D000 | C |
| ATOM | 7289 | NE | ARG | I | 237 | −44.221 | −47.118 | 83.786 | 1.00 | 55.72 | D000 | N |
| ATOM | 7290 | CZ | ARG | I | 237 | −44.309 | −45.995 | 84.513 | 1.00 | 52.55 | D000 | C |
| ATOM | 7291 | NH1 | ARG | I | 237 | −44.119 | −44.796 | 83.979 | 1.00 | 44.43 | D000 | N1+ |
| ATOM | 7292 | NH2 | ARG | I | 237 | −44.588 | −46.073 | 85.808 | 1.00 | 64.23 | D000 | N |
| ATOM | 7293 | N | PRO | I | 238 | −44.206 | −52.094 | 81.259 | 1.00 | 64.01 | D000 | N |
| ATOM | 7294 | CA | PRO | I | 238 | −44.450 | −53.500 | 81.615 | 1.00 | 65.03 | D000 | C |
| ATOM | 7295 | C | PRO | I | 238 | −45.771 | −53.685 | 82.356 | 1.00 | 74.35 | D000 | C |
| ATOM | 7296 | O | PRO | I | 238 | −46.138 | −52.874 | 83.210 | 1.00 | 79.19 | D000 | O |
| ATOM | 7297 | CB | PRO | I | 238 | −43.244 | −53.846 | 82.493 | 1.00 | 66.34 | D000 | C |
| ATOM | 7298 | CG | PRO | I | 238 | −42.143 | −53.019 | 81.911 | 1.00 | 66.55 | D000 | C |
| ATOM | 7299 | CD | PRO | I | 238 | −42.800 | −51.710 | 81.488 | 1.00 | 66.32 | D000 | C |
| ATOM | 7300 | N | GLU | I | 239 | −46.483 | −54.772 | 82.011 | 1.00 | 76.56 | D000 | N |
| ATOM | 7301 | CA | GLU | I | 239 | −47.850 | −55.186 | 82.415 | 1.00 | 81.96 | D000 | C |
| ATOM | 7302 | C | GLU | I | 239 | −48.960 | −54.622 | 81.521 | 1.00 | 85.73 | D000 | C |
| ATOM | 7303 | O | GLU | I | 239 | −50.134 | −54.970 | 81.747 | 1.00 | 90.20 | D000 | O |
| ATOM | 7304 | CB | GLU | I | 239 | −48.223 | −54.802 | 83.865 | 1.00 | 84.76 | D000 | C |
| ATOM | 7305 | CG | GLU | I | 239 | −48.026 | −55.831 | 84.975 | 1.00 | 89.72 | D000 | C |
| ATOM | 7306 | CD | GLU | I | 239 | −49.063 | −55.648 | 86.104 | 1.00 | 97.46 | D000 | C |
| ATOM | 7307 | OE1 | GLU | I | 239 | −50.264 | −55.495 | 85.787 | 1.00 | 95.00 | D000 | O |
| ATOM | 7308 | OE2 | GLU | I | 239 | −48.689 | −55.645 | 87.301 | 1.00 | 99.60 | D000 | O1− |
| ATOM | 7309 | N | GLN | I | 240 | −48.655 | −53.809 | 80.513 | 1.00 | 78.77 | D000 | N |
| ATOM | 7310 | CA | GLN | I | 240 | −49.716 | −53.126 | 79.762 | 1.00 | 74.65 | D000 | C |
| ATOM | 7311 | C | GLN | I | 240 | −49.744 | −53.472 | 78.266 | 1.00 | 75.43 | D000 | C |
| ATOM | 7312 | O | GLN | I | 240 | −48.690 | −53.736 | 77.678 | 1.00 | 70.27 | D000 | O |

TABLE 10.4-continued

| ATOM | 7313 | CB | GLN | I | 240 | −49.570 | −51.610 | 79.956 | 1.00 | 69.99 | D000 | C |
|---|---|---|---|---|---|---|---|---|---|---|---|---|
| ATOM | 7314 | CG | GLN | I | 240 | −49.627 | −51.179 | 81.421 | 1.00 | 73.64 | D000 | C |
| ATOM | 7315 | CD | GLN | I | 240 | −51.003 | −51.423 | 82.047 | 1.00 | 79.48 | D000 | C |
| ATOM | 7316 | OE1 | GLN | I | 240 | −51.278 | −52.503 | 82.587 | 1.00 | 78.83 | D000 | O |
| ATOM | 7317 | NE2 | GLN | I | 240 | −51.877 | −50.413 | 81.968 | 1.00 | 68.96 | D000 | N |
| ATOM | 7318 | N | PRO | I | 241 | −50.945 | −53.443 | 77.634 | 1.00 | 74.07 | D000 | N |
| ATOM | 7319 | CA | PRO | I | 241 | −52.250 | −53.045 | 78.188 | 1.00 | 70.37 | D000 | C |
| ATOM | 7320 | C | PRO | I | 241 | −52.840 | −54.061 | 79.178 | 1.00 | 75.66 | D000 | C |
| ATOM | 7321 | O | PRO | I | 241 | −53.904 | −54.638 | 78.940 | 1.00 | 82.05 | D000 | O |
| ATOM | 7322 | CB | PRO | I | 241 | −53.129 | −52.936 | 76.941 | 1.00 | 70.97 | D000 | C |
| ATOM | 7323 | CG | PRO | I | 241 | −52.543 | −53.932 | 75.998 | 1.00 | 67.57 | D000 | C |
| ATOM | 7324 | CD | PRO | I | 241 | −51.061 | −53.841 | 76.215 | 1.00 | 64.21 | D000 | C |
| ATOM | 7325 | N | GLY | I | 252 | −62.815 | −49.790 | 79.716 | 1.00 | 70.62 | D000 | N |
| ATOM | 7326 | CA | GLY | I | 252 | −62.424 | −49.267 | 81.017 | 1.00 | 74.95 | D000 | C |
| ATOM | 7327 | C | GLY | I | 252 | −61.035 | −48.648 | 81.048 | 1.00 | 70.30 | D000 | C |
| ATOM | 7328 | O | GLY | I | 252 | −60.698 | −47.871 | 81.940 | 1.00 | 66.65 | D000 | O |
| ATOM | 7329 | N | GLU | I | 253 | −60.214 | −49.020 | 80.065 | 1.00 | 73.32 | D000 | N |
| ATOM | 7330 | CA | GLU | I | 253 | −58.880 | −48.472 | 79.814 | 1.00 | 64.01 | D000 | C |
| ATOM | 7331 | C | GLU | I | 253 | −58.695 | −48.525 | 78.298 | 1.00 | 60.63 | D000 | C |
| ATOM | 7332 | O | GLU | I | 253 | −57.927 | −49.303 | 77.737 | 1.00 | 61.66 | D000 | O |
| ATOM | 7333 | CB | GLU | I | 253 | −57.775 | −49.234 | 80.548 | 1.00 | 65.40 | D000 | C |
| ATOM | 7334 | CG | GLU | I | 253 | −57.837 | −49.139 | 82.057 | 1.00 | 69.16 | D000 | C |
| ATOM | 7335 | CD | GLU | I | 253 | −57.007 | −50.206 | 82.724 | 1.00 | 72.49 | D000 | C |
| ATOM | 7336 | OE1 | GLU | I | 253 | −55.760 | −50.161 | 82.597 | 1.00 | 66.87 | D000 | O |
| ATOM | 7337 | OE2 | GLU | I | 253 | −57.610 | −51.095 | 83.367 | 1.00 | 87.80 | D000 | O1− |
| ATOM | 7338 | N | ASP | I | 254 | −59.422 | −47.662 | 77.607 | 1.00 | 59.36 | D000 | N |
| ATOM | 7339 | CA | ASP | I | 254 | −59.495 | −47.720 | 76.163 | 1.00 | 59.89 | D000 | C |
| ATOM | 7340 | C | ASP | I | 254 | −58.603 | −46.688 | 75.471 | 1.00 | 54.78 | D000 | C |
| ATOM | 7341 | O | ASP | I | 254 | −58.661 | −46.575 | 74.247 | 1.00 | 56.31 | D000 | O |
| ATOM | 7342 | CB | ASP | I | 254 | −60.957 | −47.546 | 75.721 | 1.00 | 67.74 | D000 | C |
| ATOM | 7343 | CG | ASP | I | 254 | −61.915 | −48.563 | 76.378 | 1.00 | 69.29 | D000 | C |
| ATOM | 7344 | OD1 | ASP | I | 254 | −61.449 | −49.599 | 76.909 | 1.00 | 61.14 | D000 | O |
| ATOM | 7345 | OD2 | ASP | I | 254 | −63.146 | −48.308 | 76.361 | 1.00 | 69.38 | D000 | O1− |
| ATOM | 7346 | N | CYS | I | 255 | −57.789 | −45.925 | 76.210 | 1.00 | 47.78 | D000 | N |
| ATOM | 7347 | CA | CYS | I | 255 | −56.967 | −44.877 | 75.608 | 1.00 | 41.04 | D000 | C |
| ATOM | 7348 | C | CYS | I | 255 | −55.530 | −44.924 | 76.117 | 1.00 | 39.20 | D000 | C |
| ATOM | 7349 | O | CYS | I | 255 | −55.295 | −45.211 | 77.290 | 1.00 | 41.84 | D000 | O |
| ATOM | 7350 | CB | CYS | I | 255 | −57.559 | −43.510 | 75.866 | 1.00 | 41.88 | D000 | C |
| ATOM | 7351 | SG | CYS | I | 255 | −59.123 | −43.260 | 75.028 | 1.00 | 54.50 | D000 | S |
| ATOM | 7352 | N | ALA | I | 256 | −54.577 | −44.614 | 75.230 | 1.00 | 35.83 | D000 | N |
| ATOM | 7353 | CA | ALA | I | 256 | −53.144 | −44.757 | 75.487 | 1.00 | 36.99 | D000 | C |
| ATOM | 7354 | C | ALA | I | 256 | −52.466 | −43.414 | 75.756 | 1.00 | 31.83 | D000 | C |
| ATOM | 7355 | O | ALA | I | 256 | −52.700 | −42.427 | 75.047 | 1.00 | 30.75 | D000 | O |
| ATOM | 7356 | CB | ALA | I | 256 | −52.445 | −45.428 | 74.300 | 1.00 | 37.73 | D000 | C |
| ATOM | 7357 | N | HIS | I | 257 | −51.584 | −43.386 | 76.754 | 1.00 | 31.20 | D000 | N |
| ATOM | 7358 | CA | HIS | I | 257 | −50.871 | −42.153 | 77.060 | 1.00 | 31.95 | D000 | C |
| ATOM | 7359 | C | HIS | I | 257 | −49.411 | −42.453 | 77.347 | 1.00 | 31.16 | D000 | C |
| ATOM | 7360 | O | HIS | I | 257 | −49.056 | −43.554 | 77.782 | 1.00 | 30.03 | D000 | O |
| ATOM | 7361 | CB | HIS | I | 257 | −51.523 | −41.373 | 78.240 | 1.00 | 28.18 | D000 | C |
| ATOM | 7362 | CG | HIS | I | 257 | −51.545 | −42.119 | 79.546 | 1.00 | 35.85 | D000 | C |
| ATOM | 7363 | ND1 | HIS | I | 257 | −50.561 | −41.985 | 80.501 | 1.00 | 32.60 | D000 | N |
| ATOM | 7364 | CD2 | HIS | I | 257 | −52.433 | −43.010 | 80.051 | 1.00 | 37.79 | D000 | C |
| ATOM | 7365 | CE1 | HIS | I | 257 | −50.842 | −42.756 | 81.535 | 1.00 | 33.70 | D000 | C |
| ATOM | 7366 | NE2 | HIS | I | 257 | −51.975 | −43.385 | 81.290 | 1.00 | 38.87 | D000 | N |
| ATOM | 7367 | N | PHE | I | 258 | −48.566 | −41.458 | 77.069 | 1.00 | 32.31 | D000 | N |
| ATOM | 7368 | CA | PHE | I | 258 | −47.195 | −41.470 | 77.550 | 1.00 | 29.99 | D000 | C |
| ATOM | 7369 | C | PHE | I | 258 | −47.186 | −41.294 | 79.066 | 1.00 | 32.50 | D000 | C |
| ATOM | 7370 | O | PHE | I | 258 | −48.064 | −40.659 | 79.648 | 1.00 | 28.89 | D000 | O |
| ATOM | 7371 | CB | PHE | I | 258 | −46.375 | −40.346 | 76.926 | 1.00 | 31.38 | D000 | C |
| ATOM | 7372 | CG | PHE | I | 258 | −46.400 | −40.303 | 75.434 | 1.00 | 30.17 | D000 | C |
| ATOM | 7373 | CD1 | PHE | I | 258 | −45.501 | −41.033 | 74.692 | 1.00 | 31.17 | D000 | C |
| ATOM | 7374 | CD2 | PHE | I | 258 | −47.305 | −39.487 | 74.769 | 1.00 | 35.10 | D000 | C |
| ATOM | 7375 | CE1 | PHE | I | 258 | −45.522 | −40.966 | 73.303 | 1.00 | 36.51 | D000 | C |
| ATOM | 7376 | CE2 | PHE | I | 258 | −47.330 | −39.415 | 73.380 | 1.00 | 33.32 | D000 | C |
| ATOM | 7377 | CZ | PHE | I | 258 | −46.440 | −40.152 | 72.648 | 1.00 | 29.52 | D000 | C |
| ATOM | 7378 | N | THR | I | 259 | −46.212 | −41.900 | 79.709 | 1.00 | 33.00 | D000 | N |
| ATOM | 7379 | CA | THR | I | 259 | −46.015 | −41.713 | 81.132 | 1.00 | 34.18 | D000 | C |
| ATOM | 7380 | C | THR | I | 259 | −44.809 | −40.809 | 81.341 | 1.00 | 36.61 | D000 | C |
| ATOM | 7381 | O | THR | I | 259 | −44.172 | −40.339 | 80.389 | 1.00 | 38.23 | D000 | O |
| ATOM | 7382 | CB | THR | I | 259 | −45.834 | −43.049 | 81.856 | 1.00 | 36.60 | D000 | C |
| ATOM | 7383 | OG1 | THR | I | 259 | −44.598 | −43.658 | 81.448 | 1.00 | 38.29 | D000 | O |
| ATOM | 7384 | CG2 | THR | I | 259 | −47.006 | −43.966 | 81.583 | 1.00 | 32.69 | D000 | C |
| ATOM | 7385 | N | ASP | I | 260 | −44.535 | −40.524 | 82.610 | 1.00 | 36.88 | D000 | N |
| ATOM | 7386 | CA | ASP | I | 260 | −43.424 | −39.664 | 82.983 | 1.00 | 36.02 | D000 | C |
| ATOM | 7387 | C | ASP | I | 260 | −42.065 | −40.201 | 82.520 | 1.00 | 37.71 | D000 | C |
| ATOM | 7388 | O | ASP | I | 260 | −41.091 | −39.443 | 82.545 | 1.00 | 42.78 | D000 | O |
| ATOM | 7389 | CB | ASP | I | 260 | −43.475 | −39.440 | 84.501 | 1.00 | 38.98 | D000 | C |
| ATOM | 7390 | CG | ASP | I | 260 | −43.369 | −40.730 | 85.292 | 1.00 | 40.08 | D000 | C |
| ATOM | 7391 | OD1 | ASP | I | 260 | −43.567 | −41.816 | 84.709 | 1.00 | 45.52 | D000 | O |
| ATOM | 7392 | OD2 | ASP | I | 260 | −43.171 | −40.658 | 86.518 | 1.00 | 38.74 | D000 | O1− |

TABLE 10.4-continued

| ATOM | 7393 | N | ASP | I | 261 | −41.964 | −41.467 | 82.099 | 1.00 | 33.98 | D000 | N |
|---|---|---|---|---|---|---|---|---|---|---|---|---|
| ATOM | 7394 | CA | ASP | I | 261 | −40.713 | −42.008 | 81.579 | 1.00 | 35.49 | D000 | C |
| ATOM | 7395 | C | ASP | I | 261 | −40.771 | −42.320 | 80.090 | 1.00 | 41.58 | D000 | C |
| ATOM | 7396 | O | ASP | I | 261 | −39.833 | −42.910 | 79.550 | 1.00 | 41.61 | D000 | O |
| ATOM | 7397 | CB | ASP | I | 261 | −40.289 | −43.240 | 82.374 | 1.00 | 31.38 | D000 | C |
| ATOM | 7398 | CG | ASP | I | 261 | −41.194 | −44.433 | 82.150 | 1.00 | 44.50 | D000 | C |
| ATOM | 7399 | OD1 | ASP | I | 261 | −42.145 | −44.348 | 81.338 | 1.00 | 49.19 | D000 | O |
| ATOM | 7400 | OD2 | ASP | I | 261 | −40.992 | −45.454 | 82.843 | 1.00 | 43.56 | D000 | O1− |
| ATOM | 7401 | N | GLY | I | 262 | −41.853 | −41.954 | 79.414 | 1.00 | 43.44 | D000 | N |
| ATOM | 7402 | CA | GLY | I | 262 | −41.983 | −42.127 | 77.991 | 1.00 | 39.17 | D000 | C |
| ATOM | 7403 | C | GLY | I | 262 | −42.711 | −43.389 | 77.570 | 1.00 | 36.69 | D000 | C |
| ATOM | 7404 | O | GLY | I | 262 | −43.387 | −43.377 | 76.537 | 1.00 | 31.77 | D000 | O |
| ATOM | 7405 | N | ARG | I | 263 | −42.625 | −44.459 | 78.358 | 1.00 | 32.80 | D000 | N |
| ATOM | 7406 | CA | ARG | I | 263 | −43.300 | −45.692 | 77.987 | 1.00 | 40.54 | D000 | C |
| ATOM | 7407 | C | ARG | I | 263 | −44.820 | −45.549 | 78.138 | 1.00 | 42.34 | D000 | C |
| ATOM | 7408 | O | ARG | I | 263 | −45.332 | −44.731 | 78.905 | 1.00 | 38.87 | D000 | O |
| ATOM | 7409 | CB | ARG | I | 263 | −42.773 | −46.854 | 78.822 | 1.00 | 43.57 | D000 | C |
| ATOM | 7410 | CG | ARG | I | 263 | −41.309 | −47.117 | 78.559 | 1.00 | 42.00 | D000 | C |
| ATOM | 7411 | CD | ARG | I | 263 | −40.789 | −48.259 | 79.373 | 1.00 | 43.37 | D000 | C |
| ATOM | 7412 | NE | ARG | I | 263 | −41.000 | −48.089 | 80.802 | 1.00 | 47.00 | D000 | N |
| ATOM | 7413 | CZ | ARG | I | 263 | −40.718 | −49.024 | 81.706 | 1.00 | 54.61 | D000 | C |
| ATOM | 7414 | NH1 | ARG | I | 263 | −40.206 | −50.187 | 81.325 | 1.00 | 56.14 | D000 | N1+ |
| ATOM | 7415 | NH2 | ARG | I | 263 | −40.954 | −48.806 | 82.995 | 1.00 | 57.34 | D000 | N |
| ATOM | 7416 | N | TRP | I | 264 | −45.545 | −46.362 | 77.390 | 1.00 | 41.85 | D000 | N |
| ATOM | 7417 | CA | TRP | I | 264 | −46.964 | −46.115 | 77.212 | 1.00 | 40.32 | D000 | C |
| ATOM | 7418 | C | TRP | I | 264 | −47.801 | −46.797 | 78.282 | 1.00 | 39.94 | D000 | C |
| ATOM | 7419 | O | TRP | I | 264 | −47.377 | −47.759 | 78.922 | 1.00 | 45.09 | D000 | O |
| ATOM | 7420 | CB | TRP | I | 264 | −47.427 | −46.610 | 75.851 | 1.00 | 41.81 | D000 | C |
| ATOM | 7421 | CG | TRP | I | 264 | −46.709 | −46.051 | 74.695 | 1.00 | 36.80 | D000 | C |
| ATOM | 7422 | CD1 | TRP | I | 264 | −45.834 | −45.016 | 74.688 | 1.00 | 37.17 | D000 | C |
| ATOM | 7423 | CD2 | TRP | I | 264 | −46.807 | −46.512 | 73.349 | 1.00 | 41.41 | D000 | C |
| ATOM | 7424 | NE1 | TRP | I | 264 | −45.377 | −44.795 | 73.417 | 1.00 | 37.55 | D000 | N |
| ATOM | 7425 | CE2 | TRP | I | 264 | −45.957 | −45.707 | 72.574 | 1.00 | 42.77 | D000 | C |
| ATOM | 7426 | CE3 | TRP | I | 264 | −47.530 | −47.534 | 72.724 | 1.00 | 37.74 | D000 | C |
| ATOM | 7427 | CZ2 | TRP | I | 264 | −45.810 | −45.888 | 71.205 | 1.00 | 40.50 | D000 | C |
| ATOM | 7428 | CZ3 | TRP | I | 264 | −47.378 | −47.716 | 71.383 | 1.00 | 38.97 | D000 | C |
| ATOM | 7429 | CH2 | TRP | I | 264 | −46.536 | −46.894 | 70.631 | 1.00 | 44.66 | D000 | C |
| ATOM | 7430 | N | ASN | I | 265 | −49.029 | −46.309 | 78.432 | 1.00 | 37.04 | D000 | N |
| ATOM | 7431 | CA | ASN | I | 265 | −49.963 | −46.923 | 79.356 | 1.00 | 37.46 | D000 | C |
| ATOM | 7432 | C | ASN | I | 265 | −51.387 | −46.554 | 78.963 | 1.00 | 37.95 | D000 | C |
| ATOM | 7433 | O | ASN | I | 265 | −51.631 | −45.512 | 78.353 | 1.00 | 36.28 | D000 | O |
| ATOM | 7434 | CB | ASN | I | 265 | −49.655 | −46.518 | 80.791 | 1.00 | 40.53 | D000 | C |
| ATOM | 7435 | CG | ASN | I | 265 | −50.611 | −47.123 | 81.765 | 1.00 | 49.10 | D000 | C |
| ATOM | 7436 | OD1 | ASN | I | 265 | −50.635 | −48.337 | 81.939 | 1.00 | 51.66 | D000 | O |
| ATOM | 7437 | ND2 | ASN | I | 265 | −51.389 | −46.281 | 82.440 | 1.00 | 49.67 | D000 | N |
| ATOM | 7438 | N | ASP | I | 266 | −52.314 | −47.446 | 79.291 | 1.00 | 45.60 | D000 | N |
| ATOM | 7439 | CA | ASP | I | 266 | −53.738 | −47.257 | 79.058 | 1.00 | 45.74 | D000 | C |
| ATOM | 7440 | C | ASP | I | 266 | −54.403 | −46.761 | 80.331 | 1.00 | 47.12 | D000 | C |
| ATOM | 7441 | O | ASP | I | 266 | −54.070 | −47.212 | 81.429 | 1.00 | 52.08 | D000 | O |
| ATOM | 7442 | CB | ASP | I | 266 | −54.413 | −48.561 | 78.615 | 1.00 | 52.43 | D000 | C |
| ATOM | 7443 | CG | ASP | I | 266 | −54.095 | −49.732 | 79.538 | 1.00 | 60.22 | D000 | C |
| ATOM | 7444 | OD1 | ASP | I | 266 | −52.905 | −49.973 | 79.827 | 1.00 | 64.14 | D000 | O |
| ATOM | 7445 | OD2 | ASP | I | 266 | −55.035 | −50.421 | 79.977 | 1.00 | 67.69 | D000 | O1− |
| ATOM | 7446 | N | ASP | I | 267 | −55.347 | −45.838 | 80.176 | 1.00 | 44.83 | D000 | N |
| ATOM | 7447 | CA | ASP | I | 267 | −56.072 | −45.253 | 81.295 | 1.00 | 49.89 | D000 | C |
| ATOM | 7448 | C | ASP | I | 267 | −57.475 | −44.917 | 80.805 | 1.00 | 46.26 | D000 | C |
| ATOM | 7449 | O | ASP | I | 267 | −57.782 | −45.069 | 79.623 | 1.00 | 47.12 | D000 | O |
| ATOM | 7450 | CB | ASP | I | 267 | −55.339 | −44.020 | 81.860 | 1.00 | 46.24 | D000 | C |
| ATOM | 7451 | CG | ASP | I | 267 | −55.846 | −43.631 | 83.228 | 1.00 | 48.24 | D000 | C |
| ATOM | 7452 | OD1 | ASP | I | 267 | −56.671 | −44.391 | 83.773 | 1.00 | 56.95 | D000 | O |
| ATOM | 7453 | OD2 | ASP | I | 267 | −55.448 | −42.573 | 83.754 | 1.00 | 49.05 | D000 | O1− |
| ATOM | 7454 | N | VAL | I | 268 | −58.347 | −44.502 | 81.727 | 1.00 | 41.94 | D000 | N |
| ATOM | 7455 | CA | VAL | I | 268 | −59.707 | −44.168 | 81.328 | 1.00 | 44.09 | D000 | C |
| ATOM | 7456 | C | VAL | I | 268 | −59.676 | −42.946 | 80.419 | 1.00 | 44.94 | D000 | C |
| ATOM | 7457 | O | VAL | I | 268 | −58.896 | −42.007 | 80.629 | 1.00 | 44.57 | D000 | O |
| ATOM | 7458 | CB | VAL | I | 268 | −60.606 | −43.939 | 82.554 | 1.00 | 40.01 | D000 | C |
| ATOM | 7459 | CG1 | VAL | I | 268 | −60.463 | −45.079 | 83.506 | 1.00 | 42.61 | D000 | C |
| ATOM | 7460 | CG2 | VAL | I | 268 | −60.274 | −42.634 | 83.242 | 1.00 | 40.82 | D000 | C |
| ATOM | 7461 | N | CYS | I | 269 | −60.506 | −42.962 | 79.379 | 1.00 | 38.74 | D000 | N |
| ATOM | 7462 | CA | CYS | I | 269 | −60.422 | −41.901 | 78.385 | 1.00 | 41.24 | D000 | C |
| ATOM | 7463 | C | CYS | I | 269 | −60.908 | −40.569 | 78.913 | 1.00 | 35.89 | D000 | C |
| ATOM | 7464 | O | CYS | I | 269 | −60.800 | −39.554 | 78.219 | 1.00 | 40.53 | D000 | O |
| ATOM | 7465 | CB | CYS | I | 269 | −61.204 | −42.298 | 77.127 | 1.00 | 43.34 | D000 | C |
| ATOM | 7466 | SG | CYS | I | 269 | −60.582 | −43.835 | 76.370 | 1.00 | 57.52 | D000 | S |
| ATOM | 7467 | N | GLN | I | 270 | −61.422 | −40.534 | 80.127 | 1.00 | 37.09 | D000 | N |
| ATOM | 7468 | CA | GLN | I | 270 | −61.959 | −39.299 | 80.666 | 1.00 | 35.74 | D000 | C |
| ATOM | 7469 | C | GLN | I | 270 | −60.892 | −38.406 | 81.284 | 1.00 | 33.91 | D000 | C |
| ATOM | 7470 | O | GLN | I | 270 | −61.156 | −37.213 | 81.465 | 1.00 | 36.79 | D000 | O |
| ATOM | 7471 | CB | GLN | I | 270 | −63.029 | −39.618 | 81.709 | 1.00 | 43.76 | D000 | C |
| ATOM | 7472 | CG | GLN | I | 270 | −64.394 | −39.929 | 81.095 | 1.00 | 52.98 | D000 | C |

TABLE 10.4-continued

| | | | | | | | | | | |
|---|---|---|---|---|---|---|---|---|---|---|
| ATOM | 7473 | CD | GLN | I | 270 | −64.451 | −41.352 | 80.534 | 1.00 | 53.45 | D000 | C |
| ATOM | 7474 | OE1 | GLN | I | 270 | −63.849 | −42.272 | 81.106 | 1.00 | 52.07 | D000 | O |
| ATOM | 7475 | NE2 | GLN | I | 270 | −65.156 | −41.535 | 79.407 | 1.00 | 46.18 | D000 | N |
| ATOM | 7476 | N | ARG | I | 271 | −59.698 | −38.940 | 81.589 | 1.00 | 33.55 | D000 | N |
| ATOM | 7477 | CA | ARG | I | 271 | −58.656 | −38.139 | 82.228 | 1.00 | 34.17 | D000 | C |
| ATOM | 7478 | C | ARG | I | 271 | −58.333 | −36.927 | 81.364 | 1.00 | 35.86 | D000 | C |
| ATOM | 7479 | O | ARG | I | 271 | −58.224 | −37.058 | 80.136 | 1.00 | 34.42 | D000 | O |
| ATOM | 7480 | CB | ARG | I | 271 | −57.380 | −38.947 | 82.464 | 1.00 | 36.48 | D000 | C |
| ATOM | 7481 | CG | ARG | I | 271 | −57.518 | −40.084 | 83.447 | 1.00 | 39.60 | D000 | C |
| ATOM | 7482 | CD | ARG | I | 271 | −57.065 | −39.699 | 84.838 | 1.00 | 45.14 | D000 | C |
| ATOM | 7483 | NE | ARG | I | 271 | −57.534 | −40.662 | 85.844 | 1.00 | 59.73 | D000 | N |
| ATOM | 7484 | CZ | ARG | I | 271 | −58.422 | −40.401 | 86.810 | 1.00 | 58.63 | D000 | C |
| ATOM | 7485 | NH1 | ARG | I | 271 | −58.962 | −39.185 | 86.947 | 1.00 | 54.22 | D000 | N1+ |
| ATOM | 7486 | NH2 | ARG | I | 271 | −58.758 | −41.360 | 87.660 | 1.00 | 55.45 | D000 | N |
| ATOM | 7487 | N | PRO | I | 272 | −58.230 | −35.749 | 81.936 | 1.00 | 32.00 | D000 | N |
| ATOM | 7488 | CA | PRO | I | 272 | −57.855 | −34.553 | 81.148 | 1.00 | 29.00 | D000 | C |
| ATOM | 7489 | C | PRO | I | 272 | −56.342 | −34.344 | 81.068 | 1.00 | 32.23 | D000 | C |
| ATOM | 7490 | O | PRO | I | 272 | −55.758 | −33.416 | 81.633 | 1.00 | 31.22 | D000 | O |
| ATOM | 7491 | CB | PRO | I | 272 | −58.583 | −33.433 | 81.892 | 1.00 | 26.05 | D000 | C |
| ATOM | 7492 | CG | PRO | I | 272 | −58.775 | −33.959 | 83.324 | 1.00 | 28.86 | D000 | C |
| ATOM | 7493 | CD | PRO | I | 272 | −58.499 | −35.435 | 83.347 | 1.00 | 27.78 | D000 | C |
| ATOM | 7494 | N | TYR | I | 273 | −55.680 | −35.225 | 80.325 | 1.00 | 32.52 | D000 | N |
| ATOM | 7495 | CA | TYR | I | 273 | −54.251 | −35.145 | 80.086 | 1.00 | 29.17 | D000 | C |
| ATOM | 7496 | C | TYR | I | 273 | −53.931 | −34.170 | 78.946 | 1.00 | 28.33 | D000 | C |
| ATOM | 7497 | O | TYR | I | 273 | −54.790 | −33.766 | 78.166 | 1.00 | 26.77 | D000 | O |
| ATOM | 7498 | CB | TYR | I | 273 | −53.689 | −36.524 | 79.748 | 1.00 | 26.56 | D000 | C |
| ATOM | 7499 | CG | TYR | I | 273 | −53.687 | −37.527 | 80.867 | 1.00 | 26.99 | D000 | C |
| ATOM | 7500 | CD1 | TYR | I | 273 | −53.588 | −37.129 | 82.194 | 1.00 | 29.63 | D000 | C |
| ATOM | 7501 | CD2 | TYR | I | 273 | −53.757 | −38.883 | 80.594 | 1.00 | 28.80 | D000 | C |
| ATOM | 7502 | CE1 | TYR | I | 273 | −53.582 | −38.057 | 83.212 | 1.00 | 28.90 | D000 | C |
| ATOM | 7503 | CE2 | TYR | I | 273 | −53.737 | −39.825 | 81.609 | 1.00 | 32.53 | D000 | C |
| ATOM | 7504 | CZ | TYR | I | 273 | −53.656 | −39.404 | 82.911 | 1.00 | 29.59 | D000 | C |
| ATOM | 7505 | OH | TYR | I | 273 | −53.634 | −40.338 | 83.910 | 1.00 | 29.82 | D000 | O |
| ATOM | 7506 | N | ARG | I | 274 | −52.672 | −33.768 | 78.882 | 1.00 | 28.32 | D000 | N |
| ATOM | 7507 | CA | ARG | I | 274 | −52.212 | −33.033 | 77.729 | 1.00 | 27.19 | D000 | C |
| ATOM | 7508 | C | ARG | I | 274 | −52.169 | −33.971 | 76.536 | 1.00 | 26.48 | D000 | C |
| ATOM | 7509 | O | ARG | I | 274 | −52.280 | −35.187 | 76.673 | 1.00 | 28.05 | D000 | O |
| ATOM | 7510 | CB | ARG | I | 274 | −50.857 | −32.403 | 78.011 | 1.00 | 24.95 | D000 | C |
| ATOM | 7511 | CG | ARG | I | 274 | −50.926 | −31.334 | 79.066 | 1.00 | 25.95 | D000 | C |
| ATOM | 7512 | CD | ARG | I | 274 | −49.541 | −30.802 | 79.382 | 1.00 | 28.18 | D000 | C |
| ATOM | 7513 | NE | ARG | I | 274 | −49.548 | −29.767 | 80.411 | 1.00 | 27.97 | D000 | N |
| ATOM | 7514 | CZ | ARG | I | 274 | −48.464 | −29.347 | 81.063 | 1.00 | 29.49 | D000 | C |
| ATOM | 7515 | NH1 | ARG | I | 274 | −47.274 | −29.877 | 80.802 | 1.00 | 24.44 | D000 | N1+ |
| ATOM | 7516 | NH2 | ARG | I | 274 | −48.567 | −28.400 | 81.992 | 1.00 | 28.37 | D000 | N |
| ATOM | 7517 | N | TRP | I | 275 | −52.038 | −33.395 | 75.344 | 1.00 | 27.91 | D000 | N |
| ATOM | 7518 | CA | TRP | I | 275 | −52.039 | −34.203 | 74.138 | 1.00 | 28.85 | D000 | C |
| ATOM | 7519 | C | TRP | I | 275 | −51.106 | −33.568 | 73.105 | 1.00 | 30.78 | D000 | C |
| ATOM | 7520 | O | TRP | I | 275 | −50.671 | −32.410 | 73.241 | 1.00 | 27.47 | D000 | O |
| ATOM | 7521 | CB | TRP | I | 275 | −53.473 | −34.368 | 73.600 | 1.00 | 23.59 | D000 | C |
| ATOM | 7522 | CG | TRP | I | 275 | −54.009 | −33.123 | 72.979 | 1.00 | 26.26 | D000 | C |
| ATOM | 7523 | CD1 | TRP | I | 275 | −53.991 | −32.808 | 71.648 | 1.00 | 26.24 | D000 | C |
| ATOM | 7524 | CD2 | TRP | I | 275 | −54.629 | −32.005 | 73.643 | 1.00 | 27.84 | D000 | C |
| ATOM | 7525 | NE1 | TRP | I | 275 | −54.549 | −31.571 | 71.442 | 1.00 | 27.63 | D000 | N |
| ATOM | 7526 | CE2 | TRP | I | 275 | −54.959 | −31.059 | 72.646 | 1.00 | 29.00 | D000 | C |
| ATOM | 7527 | CE3 | TRP | I | 275 | −54.949 | −31.718 | 74.971 | 1.00 | 27.22 | D000 | C |
| ATOM | 7528 | CZ2 | TRP | I | 275 | −55.589 | −29.850 | 72.941 | 1.00 | 23.11 | D000 | C |
| ATOM | 7529 | CZ3 | TRP | I | 275 | −55.572 | −30.511 | 75.258 | 1.00 | 26.94 | D000 | C |
| ATOM | 7530 | CH2 | TRP | I | 275 | −55.876 | −29.595 | 74.248 | 1.00 | 27.13 | D000 | C |
| ATOM | 7531 | N | VAL | I | 276 | −50.827 | −34.338 | 72.051 | 1.00 | 26.77 | D000 | N |
| ATOM | 7532 | CA | VAL | I | 276 | −49.950 | −33.930 | 70.959 | 1.00 | 29.58 | D000 | C |
| ATOM | 7533 | C | VAL | I | 276 | −50.723 | −34.063 | 69.650 | 1.00 | 29.99 | D000 | C |
| ATOM | 7534 | O | VAL | I | 276 | −51.233 | −35.146 | 69.335 | 1.00 | 32.34 | D000 | O |
| ATOM | 7535 | CB | VAL | I | 276 | −48.666 | −34.790 | 70.916 | 1.00 | 34.01 | D000 | C |
| ATOM | 7536 | CG1 | VAL | I | 276 | −47.726 | −34.358 | 69.768 | 1.00 | 25.34 | D000 | C |
| ATOM | 7537 | CG2 | VAL | I | 276 | −47.957 | −34.821 | 72.259 | 1.00 | 22.27 | D000 | C |
| ATOM | 7538 | N | CYS | I | 277 | −50.815 | −32.973 | 68.892 | 1.00 | 30.05 | D000 | N |
| ATOM | 7539 | CA | CYS | I | 277 | −51.289 | −33.032 | 67.507 | 1.00 | 36.56 | D000 | C |
| ATOM | 7540 | C | CYS | I | 277 | −50.113 | −33.216 | 66.544 | 1.00 | 39.90 | D000 | C |
| ATOM | 7541 | O | CYS | I | 277 | −49.037 | −32.638 | 66.739 | 1.00 | 34.93 | D000 | O |
| ATOM | 7542 | CB | CYS | I | 277 | −52.054 | −31.764 | 67.111 | 1.00 | 33.98 | D000 | C |
| ATOM | 7543 | SG | CYS | I | 277 | −53.711 | −31.466 | 67.812 | 1.00 | 42.15 | D000 | S |
| ATOM | 7544 | N | GLU | I | 278 | −50.336 | −34.004 | 65.486 | 1.00 | 37.84 | D000 | N |
| ATOM | 7545 | CA | GLU | I | 278 | −49.361 | −34.207 | 64.419 | 1.00 | 38.01 | D000 | C |
| ATOM | 7546 | C | GLU | I | 278 | −49.980 | −33.930 | 63.054 | 1.00 | 40.54 | D000 | C |
| ATOM | 7547 | O | GLU | I | 278 | −51.105 | −34.354 | 62.766 | 1.00 | 41.44 | D000 | O |
| ATOM | 7548 | CB | GLU | I | 278 | −48.801 | −35.646 | 64.430 | 1.00 | 36.62 | D000 | C |
| ATOM | 7549 | CG | GLU | I | 278 | −47.685 | −35.926 | 63.414 | 1.00 | 36.43 | D000 | C |
| ATOM | 7550 | CD | GLU | I | 278 | −47.249 | −37.379 | 63.472 | 1.00 | 44.33 | D000 | C |
| ATOM | 7551 | OE1 | GLU | I | 278 | −47.852 | −38.105 | 64.290 | 1.00 | 43.28 | D000 | O |
| ATOM | 7552 | OE2 | GLU | I | 278 | −46.341 | −37.806 | 62.708 | 1.00 | 44.12 | D000 | O1− |

TABLE 10.4-continued

| | | | | | | | | | | | |
|---|---|---|---|---|---|---|---|---|---|---|---|
| ATOM | 7553 | N | THR | I | 279 | −49.215 | −33.280 | 62.187 | 1.00 | 40.86 | D000 N |
| ATOM | 7554 | CA | THR | I | 279 | −49.596 | −33.153 | 60.789 | 1.00 | 45.51 | D000 C |
| ATOM | 7555 | C | THR | I | 279 | −48.349 | −33.290 | 59.921 | 1.00 | 50.70 | D000 C |
| ATOM | 7556 | O | THR | I | 279 | −47.274 | −32.791 | 60.269 | 1.00 | 52.15 | D000 O |
| ATOM | 7557 | CB | THR | I | 279 | −50.344 | −31.830 | 60.515 | 1.00 | 40.68 | D000 C |
| ATOM | 7558 | OG1 | THR | I | 279 | −50.995 | −31.916 | 59.247 | 1.00 | 46.37 | D000 O |
| ATOM | 7559 | CG2 | THR | I | 279 | −49.413 | −30.622 | 60.530 | 1.00 | 40.76 | D000 C |
| ATOM | 7560 | N | GLU | I | 280 | −48.502 | −33.993 | 58.801 | 1.00 | 51.69 | D000 N |
| ATOM | 7561 | CA | GLU | I | 280 | −47.419 | −34.287 | 57.872 | 1.00 | 49.36 | D000 C |
| ATOM | 7562 | C | GLU | I | 280 | −47.271 | −33.158 | 56.860 | 1.00 | 56.06 | D000 C |
| ATOM | 7563 | O | GLU | I | 280 | −48.253 | −32.530 | 56.466 | 1.00 | 60.37 | D000 O |
| ATOM | 7564 | CB | GLU | I | 280 | −47.687 | −35.615 | 57.154 | 1.00 | 46.67 | D000 C |
| ATOM | 7565 | CG | GLU | I | 280 | −47.603 | −36.893 | 58.036 | 1.00 | 52.72 | D000 C |
| ATOM | 7566 | CD | GLU | I | 280 | −48.756 | −37.083 | 59.067 | 1.00 | 61.50 | D000 C |
| ATOM | 7567 | OE1 | GLU | I | 280 | −49.701 | −36.259 | 59.124 | 1.00 | 55.57 | D000 O |
| ATOM | 7568 | OE2 | GLU | I | 280 | −48.724 | −38.095 | 59.816 | 1.00 | 65.48 | D000 O1− |
| ATOM | 7569 | N | LEU | I | 281 | −46.024 | −32.894 | 56.450 | 1.00 | 68.28 | D000 N |
| ATOM | 7570 | CA | LEU | I | 281 | −45.668 | −31.688 | 55.705 | 1.00 | 66.92 | D000 C |
| ATOM | 7571 | C | LEU | I | 281 | −45.742 | −31.880 | 54.192 | 1.00 | 77.57 | D000 C |
| ATOM | 7572 | O | LEU | I | 281 | −45.234 | −31.029 | 53.454 | 1.00 | 82.51 | D000 O |
| ATOM | 7573 | CB | LEU | I | 281 | −44.264 | −31.217 | 56.095 | 1.00 | 62.30 | D000 C |
| ATOM | 7574 | CG | LEU | I | 281 | −44.155 | −29.845 | 56.772 | 1.00 | 72.01 | D000 C |
| ATOM | 7575 | CD1 | LEU | I | 281 | −42.720 | −29.512 | 57.120 | 1.00 | 70.45 | D000 C |
| ATOM | 7576 | CD2 | LEU | I | 281 | −44.746 | −28.748 | 55.893 | 1.00 | 76.75 | D000 C |
| ATOM | 7577 | N | ASP | I | 282 | −46.399 | −32.958 | 53.737 | 1.00 | 85.50 | D000 N |
| ATOM | 7578 | CA | ASP | I | 282 | −46.623 | −33.356 | 52.326 | 1.00 | 86.01 | D000 C |
| ATOM | 7579 | C | ASP | I | 282 | −45.384 | −34.002 | 51.715 | 1.00 | 79.75 | D000 C |
| ATOM | 7580 | O | ASP | I | 282 | −45.258 | −35.228 | 51.711 | 1.00 | 78.04 | D000 O |
| ATOM | 7581 | CB | ASP | I | 282 | −47.092 | −32.180 | 51.440 | 1.00 | 96.47 | D000 C |
| ATOM | 7582 | CG | ASP | I | 282 | −48.461 | −31.617 | 51.857 | 1.00 | 96.65 | D000 C |
| ATOM | 7583 | OD1 | ASP | I | 282 | −48.811 | −31.701 | 53.055 | 1.00 | 90.88 | D000 O |
| ATOM | 7584 | OD2 | ASP | I | 282 | −49.190 | −31.087 | 50.977 | 1.00 | 93.64 | D000 O1− |
| TER | | | | | | | | | | | |
| ATOM | 7585 | N | THR | P | 152 | −18.008 | −35.866 | 53.223 | 1.00 | 83.74 | D000 N |
| ATOM | 7586 | CA | THR | P | 152 | −19.403 | −36.301 | 53.203 | 1.00 | 93.67 | D000 C |
| ATOM | 7587 | C | THR | P | 152 | −19.882 | −36.656 | 54.610 | 1.00 | 97.43 | D000 C |
| ATOM | 7588 | O | THR | P | 152 | −21.055 | −36.465 | 54.949 | 1.00 | 99.74 | D000 O |
| ATOM | 7589 | CB | THR | P | 152 | −19.616 | −37.526 | 52.274 | 1.00 | 95.00 | D000 C |
| ATOM | 7590 | OG1 | THR | P | 152 | −18.515 | −38.434 | 52.412 | 1.00 | 96.24 | D000 O |
| ATOM | 7591 | CG2 | THR | P | 152 | −19.745 | −37.100 | 50.820 | 1.00 | 89.07 | D000 C |
| ATOM | 7592 | N | CYS | P | 153 | −18.962 | −37.176 | 55.422 | 1.00 | 93.53 | D000 N |
| ATOM | 7593 | CA | CYS | P | 153 | −19.248 | −37.564 | 56.798 | 1.00 | 86.06 | D000 C |
| ATOM | 7594 | C | CYS | P | 153 | −18.009 | −37.320 | 57.642 | 1.00 | 73.09 | D000 C |
| ATOM | 7595 | O | CYS | P | 153 | −16.902 | −37.129 | 57.131 | 1.00 | 68.83 | D000 O |
| ATOM | 7596 | CB | CYS | P | 153 | −19.718 | −39.025 | 56.941 | 1.00 | 85.43 | D000 C |
| ATOM | 7597 | SG | CYS | P | 153 | −21.535 | −39.281 | 56.843 | 1.00 | 98.27 | D000 S |
| ATOM | 7598 | N | CYS | P | 154 | −18.209 | −37.292 | 58.847 | 1.00 | 71.85 | D000 N |
| ATOM | 7599 | CA | CYS | P | 154 | −17.147 | −37.059 | 59.803 | 1.00 | 58.19 | D000 C |
| ATOM | 7600 | C | CYS | P | 154 | −16.521 | −38.377 | 60.251 | 1.00 | 53.75 | D000 C |
| ATOM | 7601 | O | CYS | P | 154 | −17.198 | −39.409 | 60.291 | 1.00 | 57.74 | D000 O |
| ATOM | 7602 | CB | CYS | P | 154 | −17.697 | −36.308 | 61.010 | 1.00 | 51.76 | D000 C |
| ATOM | 7603 | SG | CYS | P | 154 | −18.273 | −34.615 | 60.600 | 1.00 | 60.05 | D000 S |
| ATOM | 7604 | N | PRO | P | 155 | −15.231 | −38.360 | 60.584 | 1.00 | 46.56 | D000 N |
| ATOM | 7605 | CA | PRO | P | 155 | −14.547 | −39.591 | 61.004 | 1.00 | 44.27 | D000 C |
| ATOM | 7606 | C | PRO | P | 155 | −15.153 | −40.210 | 62.258 | 1.00 | 48.95 | D000 C |
| ATOM | 7607 | O | PRO | P | 155 | −15.934 | −39.588 | 62.987 | 1.00 | 49.26 | D000 O |
| ATOM | 7608 | CB | PRO | P | 155 | −13.109 | −39.126 | 61.268 | 1.00 | 42.58 | D000 C |
| ATOM | 7609 | CG | PRO | P | 155 | −12.971 | −37.842 | 60.535 | 1.00 | 40.45 | D000 C |
| ATOM | 7610 | CD | PRO | P | 155 | −14.317 | −37.209 | 60.522 | 1.00 | 44.50 | D000 C |
| ATOM | 7611 | N | VAL | P | 156 | −14.786 | −41.475 | 62.492 | 1.00 | 50.73 | D000 N |
| ATOM | 7612 | CA | VAL | P | 156 | −15.268 | −42.191 | 63.670 | 1.00 | 48.55 | D000 C |
| ATOM | 7613 | C | VAL | P | 156 | −14.926 | −41.390 | 64.914 | 1.00 | 49.57 | D000 C |
| ATOM | 7614 | O | VAL | P | 156 | −13.791 | −40.923 | 65.071 | 1.00 | 49.11 | D000 O |
| ATOM | 7615 | CB | VAL | P | 156 | −14.658 | −43.599 | 63.733 | 1.00 | 49.04 | D000 C |
| ATOM | 7616 | CG1 | VAL | P | 156 | −15.733 | −44.639 | 63.993 | 1.00 | 37.71 | D000 C |
| ATOM | 7617 | CG2 | VAL | P | 156 | −13.879 | −43.914 | 62.449 | 1.00 | 56.31 | D000 C |
| ATOM | 7618 | N | ASN | P | 157 | −15.919 | −41.205 | 65.791 | 1.00 | 49.29 | D000 N |
| ATOM | 7619 | CA | ASN | P | 157 | −15.831 | −40.490 | 67.074 | 1.00 | 45.69 | D000 C |
| ATOM | 7620 | C | ASN | P | 157 | −15.791 | −38.976 | 66.917 | 1.00 | 42.84 | D000 C |
| ATOM | 7621 | O | ASN | P | 157 | −15.571 | −38.265 | 67.913 | 1.00 | 42.59 | D000 O |
| ATOM | 7622 | CB | ASN | P | 157 | −14.592 | −40.896 | 67.878 | 1.00 | 46.95 | D000 C |
| ATOM | 7623 | CG | ASN | P | 157 | −14.548 | −42.372 | 68.177 | 1.00 | 48.62 | D000 C |
| ATOM | 7624 | OD1 | ASN | P | 157 | −15.544 | −42.976 | 68.582 | 1.00 | 51.67 | D000 O |
| ATOM | 7625 | ND2 | ASN | P | 157 | −13.396 | −42.973 | 67.937 | 1.00 | 38.36 | D000 N |
| ATOM | 7626 | N | TRP | P | 158 | −16.009 | −38.453 | 65.719 | 1.00 | 42.42 | D000 N |
| ATOM | 7627 | CA | TRP | P | 158 | −16.226 | −37.030 | 65.523 | 1.00 | 41.39 | D000 C |
| ATOM | 7628 | C | TRP | P | 158 | −17.714 | −36.789 | 65.274 | 1.00 | 42.54 | D000 C |
| ATOM | 7629 | O | TRP | P | 158 | −18.454 | −37.697 | 64.895 | 1.00 | 47.35 | D000 O |
| ATOM | 7630 | CB | TRP | P | 158 | −15.395 | −36.490 | 64.348 | 1.00 | 38.79 | D000 C |
| ATOM | 7631 | CG | TRP | P | 158 | −13.877 | −36.545 | 64.488 | 1.00 | 37.39 | D000 C |

TABLE 10.4-continued

| | | | | | | | | | | | |
|---|---|---|---|---|---|---|---|---|---|---|---|
| ATOM | 7632 | CD1 | TRP | P | 158 | −13.107 | −37.655 | 64.704 | 1.00 | 39.44 | D000 C |
| ATOM | 7633 | CD2 | TRP | P | 158 | −12.955 | −35.444 | 64.366 | 1.00 | 35.99 | D000 C |
| ATOM | 7634 | NE1 | TRP | P | 158 | −11.763 | −37.316 | 64.728 | 1.00 | 31.69 | D000 N |
| ATOM | 7635 | CE2 | TRP | P | 158 | −11.644 | −35.969 | 64.524 | 1.00 | 34.45 | D000 C |
| ATOM | 7636 | CE3 | TRP | P | 158 | −13.107 | −34.070 | 64.140 | 1.00 | 35.66 | D000 C |
| ATOM | 7637 | CZ2 | TRP | P | 158 | −10.501 | −35.165 | 64.471 | 1.00 | 30.75 | D000 C |
| ATOM | 7638 | CZ3 | TRP | P | 158 | −11.970 | −33.273 | 64.083 | 1.00 | 35.96 | D000 C |
| ATOM | 7639 | CH2 | TRP | P | 158 | −10.681 | −33.827 | 64.247 | 1.00 | 31.46 | D000 C |
| ATOM | 7640 | N | VAL | P | 159 | −18.149 | −35.554 | 65.509 | 1.00 | 37.16 | D000 N |
| ATOM | 7641 | CA | VAL | P | 159 | −19.556 | −35.188 | 65.499 | 1.00 | 34.88 | D000 C |
| ATOM | 7642 | C | VAL | P | 159 | −19.788 | −34.115 | 64.443 | 1.00 | 38.07 | D000 C |
| ATOM | 7643 | O | VAL | P | 159 | −19.116 | −33.083 | 64.447 | 1.00 | 39.78 | D000 O |
| ATOM | 7644 | CB | VAL | P | 159 | −19.996 | −34.693 | 66.885 | 1.00 | 37.29 | D000 C |
| ATOM | 7645 | CG1 | VAL | P | 159 | −21.462 | −34.286 | 66.872 | 1.00 | 33.76 | D000 C |
| ATOM | 7646 | CG2 | VAL | P | 159 | −19.717 | −35.762 | 67.920 | 1.00 | 35.15 | D000 C |
| ATOM | 7647 | N | GLU | P | 160 | −20.747 | −34.346 | 63.548 | 1.00 | 44.59 | D000 N |
| ATOM | 7648 | CA | GLU | P | 160 | −21.060 | −33.351 | 62.529 | 1.00 | 41.41 | D000 C |
| ATOM | 7649 | C | GLU | P | 160 | −22.016 | −32.294 | 63.071 | 1.00 | 42.80 | D000 C |
| ATOM | 7650 | O | GLU | P | 160 | −22.890 | −32.577 | 63.894 | 1.00 | 40.17 | D000 O |
| ATOM | 7651 | CB | GLU | P | 160 | −21.661 | −34.005 | 61.284 | 1.00 | 46.52 | D000 C |
| ATOM | 7652 | CG | GLU | P | 160 | −21.512 | −33.122 | 60.047 | 1.00 | 56.68 | D000 C |
| ATOM | 7653 | CD | GLU | P | 160 | −22.207 | −33.644 | 58.800 | 1.00 | 66.43 | D000 C |
| ATOM | 7654 | OE1 | GLU | P | 160 | −22.148 | −34.876 | 58.533 | 1.00 | 67.75 | D000 O |
| ATOM | 7655 | OE2 | GLU | P | 160 | −22.785 | −32.796 | 58.074 | 1.00 | 67.82 | D000 O1− |
| ATOM | 7656 | N | HIS | P | 161 | −21.824 | −31.060 | 62.622 | 1.00 | 42.59 | D000 N |
| ATOM | 7657 | CA | HIS | P | 161 | −22.738 | −29.980 | 62.952 | 1.00 | 40.24 | D000 C |
| ATOM | 7658 | C | HIS | P | 161 | −22.456 | −28.824 | 62.011 | 1.00 | 43.60 | D000 C |
| ATOM | 7659 | O | HIS | P | 161 | −21.382 | −28.220 | 62.096 | 1.00 | 45.56 | D000 O |
| ATOM | 7660 | CB | HIS | P | 161 | −22.588 | −29.557 | 64.413 | 1.00 | 35.89 | D000 C |
| ATOM | 7661 | CG | HIS | P | 161 | −23.438 | −28.383 | 64.790 | 1.00 | 44.75 | D000 C |
| ATOM | 7662 | ND1 | HIS | P | 161 | −24.736 | −28.521 | 65.238 | 1.00 | 41.80 | D000 N |
| ATOM | 7663 | CD2 | HIS | P | 161 | −23.178 | −27.050 | 64.788 | 1.00 | 44.31 | D000 C |
| ATOM | 7664 | CE1 | HIS | P | 161 | −25.239 | −27.324 | 65.496 | 1.00 | 44.21 | D000 C |
| ATOM | 7665 | NE2 | HIS | P | 161 | −24.315 | −26.415 | 65.231 | 1.00 | 47.45 | D000 N |
| ATOM | 7666 | N | GLU | P | 162 | −23.391 | −28.535 | 61.098 | 1.00 | 46.24 | D000 N |
| ATOM | 7667 | CA | GLU | P | 162 | −23.294 | −27.382 | 60.201 | 1.00 | 47.89 | D000 C |
| ATOM | 7668 | C | GLU | P | 162 | −22.059 | −27.512 | 59.301 | 1.00 | 50.82 | D000 C |
| ATOM | 7669 | O | GLU | P | 162 | −21.272 | −26.573 | 59.127 | 1.00 | 44.74 | D000 O |
| ATOM | 7670 | CB | GLU | P | 162 | −23.249 | −26.082 | 61.009 | 1.00 | 53.01 | D000 C |
| ATOM | 7671 | CG | GLU | P | 162 | −24.485 | −25.787 | 61.849 | 1.00 | 58.08 | D000 C |
| ATOM | 7672 | CD | GLU | P | 162 | −25.529 | −24.958 | 61.127 | 1.00 | 70.25 | D000 C |
| ATOM | 7673 | OE1 | GLU | P | 162 | −25.288 | −23.740 | 60.921 | 1.00 | 71.49 | D000 O |
| ATOM | 7674 | OE2 | GLU | P | 162 | −26.575 | −25.529 | 60.746 | 1.00 | 76.35 | D000 O1− |
| ATOM | 7675 | N | ARG | P | 163 | −21.884 | −28.714 | 58.744 | 1.00 | 48.09 | D000 N |
| ATOM | 7676 | CA | ARG | P | 163 | −20.780 | −29.023 | 57.836 | 1.00 | 57.37 | D000 C |
| ATOM | 7677 | C | ARG | P | 163 | −19.428 | −28.733 | 58.490 | 1.00 | 57.98 | D000 C |
| ATOM | 7678 | O | ARG | P | 163 | −18.464 | −28.324 | 57.834 | 1.00 | 57.75 | D000 O |
| ATOM | 7679 | CB | ARG | P | 163 | −20.918 | −28.307 | 56.486 | 1.00 | 60.45 | D000 C |
| ATOM | 7680 | CG | ARG | P | 163 | −22.191 | −28.694 | 55.747 | 1.00 | 58.49 | D000 C |
| ATOM | 7681 | CD | ARG | P | 163 | −22.201 | −28.270 | 54.296 | 1.00 | 71.93 | D000 C |
| ATOM | 7682 | NE | ARG | P | 163 | −21.240 | −29.050 | 53.518 | 1.00 | 71.00 | D000 N |
| ATOM | 7683 | CZ | ARG | P | 163 | −20.116 | −28.576 | 52.983 | 1.00 | 75.19 | D000 C |
| ATOM | 7684 | NH1 | ARG | P | 163 | −19.331 | −29.398 | 52.298 | 1.00 | 77.55 | D000 N1+ |
| ATOM | 7685 | NH2 | ARG | P | 163 | −19.773 | −27.296 | 53.117 | 1.00 | 67.90 | D000 N |
| ATOM | 7686 | N | SER | P | 164 | −19.350 | −28.961 | 59.794 | 1.00 | 55.73 | D000 N |
| ATOM | 7687 | CA | SER | P | 164 | −18.096 | −28.955 | 60.520 | 1.00 | 45.84 | D000 C |
| ATOM | 7688 | C | SER | P | 164 | −18.058 | −30.235 | 61.329 | 1.00 | 47.92 | D000 C |
| ATOM | 7689 | O | SER | P | 164 | −19.103 | −30.761 | 61.727 | 1.00 | 45.64 | D000 O |
| ATOM | 7690 | CB | SER | P | 164 | −17.950 | −27.732 | 61.415 | 1.00 | 45.00 | D000 C |
| ATOM | 7691 | OG | SER | P | 164 | −17.414 | −26.645 | 60.673 | 1.00 | 53.08 | D000 O |
| ATOM | 7692 | N | CYS | P | 165 | −16.854 | −30.786 | 61.464 | 1.00 | 44.78 | D000 N |
| ATOM | 7693 | CA | CYS | P | 165 | −16.607 | −31.976 | 62.262 | 1.00 | 41.69 | D000 C |
| ATOM | 7694 | C | CYS | P | 165 | −15.855 | −31.593 | 63.523 | 1.00 | 41.12 | D000 C |
| ATOM | 7695 | O | CYS | P | 165 | −14.843 | −30.886 | 63.464 | 1.00 | 42.93 | D000 O |
| ATOM | 7696 | CB | CYS | P | 165 | −15.813 | −33.009 | 61.472 | 1.00 | 49.43 | D000 C |
| ATOM | 7697 | SG | CYS | P | 165 | −16.607 | −33.584 | 59.964 | 1.00 | 54.63 | D000 S |
| ATOM | 7698 | N | TYR | P | 166 | −16.342 | −32.073 | 64.651 | 1.00 | 38.95 | D000 N |
| ATOM | 7699 | CA | TYR | P | 166 | −15.815 | −31.709 | 65.949 | 1.00 | 35.52 | D000 C |
| ATOM | 7700 | C | TYR | P | 166 | −15.385 | −32.965 | 66.674 | 1.00 | 36.03 | D000 C |
| ATOM | 7701 | O | TYR | P | 166 | −16.004 | −34.021 | 66.524 | 1.00 | 35.78 | D000 O |
| ATOM | 7702 | CB | TYR | P | 166 | −16.857 | −30.955 | 66.776 | 1.00 | 34.96 | D000 C |
| ATOM | 7703 | CG | TYR | P | 166 | −17.320 | −29.668 | 66.153 | 1.00 | 36.68 | D000 C |
| ATOM | 7704 | CD1 | TYR | P | 166 | −18.334 | −29.650 | 65.195 | 1.00 | 32.91 | D000 C |
| ATOM | 7705 | CD2 | TYR | P | 166 | −16.732 | −28.461 | 66.513 | 1.00 | 33.68 | D000 C |
| ATOM | 7706 | CE1 | TYR | P | 166 | −18.753 | −28.447 | 64.630 | 1.00 | 36.09 | D000 C |
| ATOM | 7707 | CE2 | TYR | P | 166 | −17.141 | −27.259 | 65.953 | 1.00 | 30.23 | D000 C |
| ATOM | 7708 | CZ | TYR | P | 166 | −18.149 | −27.251 | 65.019 | 1.00 | 35.59 | D000 C |
| ATOM | 7709 | OH | TYR | P | 166 | −18.541 | −26.044 | 64.482 | 1.00 | 35.19 | D000 O |
| ATOM | 7710 | N | TRP | P | 167 | −14.307 | −32.851 | 67.435 | 1.00 | 34.48 | D000 N |
| ATOM | 7711 | CA | TRP | P | 167 | −13.853 | −33.934 | 68.284 | 1.00 | 32.86 | D000 C |

TABLE 10.4-continued

| | | | | | | | | | | | |
|---|---|---|---|---|---|---|---|---|---|---|---|
| ATOM | 7712 | C | TRP | P | 167 | −13.586 | −33.377 | 69.678 | 1.00 | 34.10 | D000 C |
| ATOM | 7713 | O | TRP | P | 167 | −12.924 | −32.339 | 69.820 | 1.00 | 34.23 | D000 O |
| ATOM | 7714 | CB | TRP | P | 167 | −12.613 | −34.593 | 67.695 | 1.00 | 31.80 | D000 C |
| ATOM | 7715 | CG | TRP | P | 167 | −12.104 | −35.731 | 68.511 | 1.00 | 33.09 | D000 C |
| ATOM | 7716 | CD1 | TRP | P | 167 | −12.489 | −37.025 | 68.430 | 1.00 | 33.37 | D000 C |
| ATOM | 7717 | CD2 | TRP | P | 167 | −11.128 | −35.664 | 69.554 | 1.00 | 28.44 | D000 C |
| ATOM | 7718 | NE1 | TRP | P | 167 | −11.793 | −37.780 | 69.336 | 1.00 | 29.92 | D000 N |
| ATOM | 7719 | CE2 | TRP | P | 167 | −10.948 | −36.966 | 70.036 | 1.00 | 29.30 | D000 C |
| ATOM | 7720 | CE3 | TRP | P | 167 | −10.351 | −34.629 | 70.091 | 1.00 | 31.68 | D000 C |
| ATOM | 7721 | CZ2 | TRP | P | 167 | −10.034 | −37.270 | 71.048 | 1.00 | 34.20 | D000 C |
| ATOM | 7722 | CZ3 | TRP | P | 167 | −9.442 | −34.929 | 71.100 | 1.00 | 32.44 | D000 C |
| ATOM | 7723 | CH2 | TRP | P | 167 | −9.294 | −36.236 | 71.570 | 1.00 | 30.38 | D000 C |
| ATOM | 7724 | N | PHE | P | 168 | −14.102 | −34.066 | 70.699 | 1.00 | 30.71 | D000 N |
| ATOM | 7725 | CA | PHE | P | 168 | −14.055 | −33.612 | 72.088 | 1.00 | 32.96 | D000 C |
| ATOM | 7726 | C | PHE | P | 168 | −13.115 | −34.503 | 72.884 | 1.00 | 29.97 | D000 C |
| ATOM | 7727 | O | PHE | P | 168 | −13.354 | −35.706 | 73.001 | 1.00 | 33.55 | D000 O |
| ATOM | 7728 | CB | PHE | P | 168 | −15.460 | −33.603 | 72.691 | 1.00 | 26.93 | D000 C |
| ATOM | 7729 | CG | PHE | P | 168 | −16.381 | −32.711 | 71.950 | 1.00 | 26.93 | D000 C |
| ATOM | 7730 | CD1 | PHE | P | 168 | −16.509 | −31.381 | 72.314 | 1.00 | 25.66 | D000 C |
| ATOM | 7731 | CD2 | PHE | P | 168 | −17.057 | −33.170 | 70.831 | 1.00 | 28.28 | D000 C |
| ATOM | 7732 | CE1 | PHE | P | 168 | −17.335 | −30.515 | 71.594 | 1.00 | 29.79 | D000 C |
| ATOM | 7733 | CE2 | PHE | P | 168 | −17.877 | −32.328 | 70.108 | 1.00 | 30.00 | D000 C |
| ATOM | 7734 | CZ | PHE | P | 168 | −18.025 | −30.988 | 70.490 | 1.00 | 26.93 | D000 C |
| ATOM | 7735 | N | SER | P | 169 | −12.026 | −33.922 | 73.385 | 1.00 | 30.64 | D000 N |
| ATOM | 7736 | CA | SER | P | 169 | −11.061 | −34.707 | 74.145 | 1.00 | 34.97 | D000 C |
| ATOM | 7737 | C | SER | P | 169 | −11.675 | −35.155 | 75.471 | 1.00 | 27.83 | D000 C |
| ATOM | 7738 | O | SER | P | 169 | −12.547 | −34.495 | 76.036 | 1.00 | 28.09 | D000 O |
| ATOM | 7739 | CB | SER | P | 169 | −9.761 | −33.908 | 74.389 | 1.00 | 29.33 | D000 C |
| ATOM | 7740 | OG | SER | P | 169 | −9.906 | −32.926 | 75.407 | 1.00 | 28.03 | D000 O |
| ATOM | 7741 | N | ARG | P | 170 | −11.219 | −36.298 | 75.960 | 1.00 | 26.00 | D000 N |
| ATOM | 7742 | CA | ARG | P | 170 | −11.564 | −36.758 | 77.295 | 1.00 | 31.89 | D000 C |
| ATOM | 7743 | C | ARG | P | 170 | −10.359 | −36.735 | 78.233 | 1.00 | 33.73 | D000 C |
| ATOM | 7744 | O | ARG | P | 170 | −10.416 | −37.279 | 79.337 | 1.00 | 35.93 | D000 O |
| ATOM | 7745 | CB | ARG | P | 170 | −12.183 | −38.148 | 77.207 | 1.00 | 26.68 | D000 C |
| ATOM | 7746 | CG | ARG | P | 170 | −12.874 | −38.607 | 78.430 | 1.00 | 33.68 | D000 C |
| ATOM | 7747 | CD | ARG | P | 170 | −14.298 | −38.263 | 78.356 | 1.00 | 32.40 | D000 C |
| ATOM | 7748 | NE | ARG | P | 170 | −15.029 | −38.782 | 79.492 | 1.00 | 28.94 | D000 N |
| ATOM | 7749 | CZ | ARG | P | 170 | −15.923 | −38.060 | 80.155 | 1.00 | 29.78 | D000 C |
| ATOM | 7750 | NH1 | ARG | P | 170 | −16.586 | −38.582 | 81.182 | 1.00 | 24.35 | D000 N1+ |
| ATOM | 7751 | NH2 | ARG | P | 170 | −16.137 | −36.805 | 79.779 | 1.00 | 23.51 | D000 N |
| ATOM | 7752 | N | SER | P | 171 | −9.256 | −36.149 | 77.801 | 1.00 | 29.68 | D000 N |
| ATOM | 7753 | CA | SER | P | 171 | −8.088 | −35.943 | 78.633 | 1.00 | 26.30 | D000 C |
| ATOM | 7754 | C | SER | P | 171 | −7.684 | −34.481 | 78.520 | 1.00 | 31.62 | D000 C |
| ATOM | 7755 | O | SER | P | 171 | −8.299 | −33.707 | 77.774 | 1.00 | 33.43 | D000 O |
| ATOM | 7756 | CB | SER | P | 171 | −6.959 | −36.886 | 78.220 | 1.00 | 26.16 | D000 C |
| ATOM | 7757 | OG | SER | P | 171 | −6.679 | −36.700 | 76.857 | 1.00 | 32.31 | D000 O |
| ATOM | 7758 | N | GLY | P | 172 | −6.662 | −34.095 | 79.290 | 1.00 | 28.87 | D000 N |
| ATOM | 7759 | CA | GLY | P | 172 | −6.215 | −32.713 | 79.329 | 1.00 | 27.34 | D000 C |
| ATOM | 7760 | C | GLY | P | 172 | −4.841 | −32.482 | 78.725 | 1.00 | 28.11 | D000 C |
| ATOM | 7761 | O | GLY | P | 172 | −4.034 | −33.407 | 78.627 | 1.00 | 29.36 | D000 O |
| ATOM | 7762 | N | LYS | P | 173 | −4.567 | −31.249 | 78.312 | 1.00 | 26.28 | D000 N |
| ATOM | 7763 | CA | LYS | P | 173 | −3.311 | −30.891 | 77.669 | 1.00 | 28.99 | D000 C |
| ATOM | 7764 | C | LYS | P | 173 | −3.133 | −29.390 | 77.801 | 1.00 | 31.16 | D000 C |
| ATOM | 7765 | O | LYS | P | 173 | −4.101 | −28.640 | 77.686 | 1.00 | 26.89 | D000 O |
| ATOM | 7766 | CB | LYS | P | 173 | −3.274 | −31.249 | 76.168 | 1.00 | 29.64 | D000 C |
| ATOM | 7767 | CG | LYS | P | 173 | −3.023 | −32.712 | 75.792 | 1.00 | 25.52 | D000 C |
| ATOM | 7768 | CD | LYS | P | 173 | −2.577 | −32.794 | 74.349 | 1.00 | 26.55 | D000 C |
| ATOM | 7769 | CE | LYS | P | 173 | −2.684 | −34.206 | 73.811 | 1.00 | 33.01 | D000 C |
| ATOM | 7770 | NZ | LYS | P | 173 | −1.755 | −35.154 | 74.459 | 1.00 | 35.05 | D000 N1+ |
| ATOM | 7771 | N | ALA | P | 174 | −1.890 | −28.962 | 78.015 | 1.00 | 32.75 | D000 N |
| ATOM | 7772 | CA | ALA | P | 174 | −1.556 | −27.556 | 77.874 | 1.00 | 30.91 | D000 C |
| ATOM | 7773 | C | ALA | P | 174 | −1.960 | −27.069 | 76.483 | 1.00 | 32.66 | D000 C |
| ATOM | 7774 | O | ALA | P | 174 | −1.967 | −27.838 | 75.511 | 1.00 | 28.87 | D000 O |
| ATOM | 7775 | CB | ALA | P | 174 | −0.062 | −27.349 | 78.113 | 1.00 | 32.92 | D000 C |
| ATOM | 7776 | N | TRP | P | 175 | −2.308 | −25.777 | 76.396 | 1.00 | 31.13 | D000 N |
| ATOM | 7777 | CA | TRP | P | 175 | −2.873 | −25.232 | 75.157 | 1.00 | 35.20 | D000 C |
| ATOM | 7778 | C | TRP | P | 175 | −1.991 | −25.526 | 73.942 | 1.00 | 35.94 | D000 C |
| ATOM | 7779 | O | TRP | P | 175 | −2.491 | −25.919 | 72.884 | 1.00 | 31.80 | D000 O |
| ATOM | 7780 | CB | TRP | P | 175 | −3.105 | −23.719 | 75.294 | 1.00 | 35.59 | D000 C |
| ATOM | 7781 | CG | TRP | P | 175 | −3.896 | −23.089 | 74.131 | 1.00 | 42.77 | D000 C |
| ATOM | 7782 | CD1 | TRP | P | 175 | −5.235 | −22.812 | 74.113 | 1.00 | 41.04 | D000 C |
| ATOM | 7783 | CD2 | TRP | P | 175 | −3.387 | −22.650 | 72.846 | 1.00 | 48.23 | D000 C |
| ATOM | 7784 | NE1 | TRP | P | 175 | −5.594 | −22.244 | 72.908 | 1.00 | 42.82 | D000 N |
| ATOM | 7785 | CE2 | TRP | P | 175 | −4.483 | −22.130 | 72.115 | 1.00 | 46.08 | D000 C |
| ATOM | 7786 | CE3 | TRP | P | 175 | −2.117 | −22.651 | 72.244 | 1.00 | 45.34 | D000 C |
| ATOM | 7787 | CZ2 | TRP | P | 175 | −4.348 | −21.616 | 70.816 | 1.00 | 42.61 | D000 C |
| ATOM | 7788 | CZ3 | TRP | P | 175 | −1.988 | −22.133 | 70.948 | 1.00 | 42.70 | D000 C |
| ATOM | 7789 | CH2 | TRP | P | 175 | −3.095 | −21.626 | 70.256 | 1.00 | 41.85 | D000 C |
| ATOM | 7790 | N | ALA | P | 176 | −0.677 | −25.331 | 74.076 | 1.00 | 34.88 | D000 N |
| ATOM | 7791 | CA | ALA | P | 176 | 0.226 | −25.561 | 72.957 | 1.00 | 30.60 | D000 C |

TABLE 10.4-continued

| ATOM | 7792 | C | ALA | P | 176 | 0.226 | −27.022 | 72.528 | 1.00 | 36.67 | D000 | C |
|---|---|---|---|---|---|---|---|---|---|---|---|---|
| ATOM | 7793 | O | ALA | P | 176 | 0.291 | −27.325 | 71.328 | 1.00 | 33.09 | D000 | O |
| ATOM | 7794 | CB | ALA | P | 176 | 1.632 | −25.111 | 73.326 | 1.00 | 30.07 | D000 | C |
| ATOM | 7795 | N | ASP | P | 177 | 0.176 | −27.949 | 73.490 | 1.00 | 34.27 | D000 | N |
| ATOM | 7796 | CA | ASP | P | 177 | 0.168 | −29.353 | 73.103 | 1.00 | 30.80 | D000 | C |
| ATOM | 7797 | C | ASP | P | 177 | −1.161 | −29.738 | 72.466 | 1.00 | 29.53 | D000 | C |
| ATOM | 7798 | O | ASP | P | 177 | −1.190 | −30.546 | 71.540 | 1.00 | 28.69 | D000 | O |
| ATOM | 7799 | CB | ASP | P | 177 | 0.466 | −30.238 | 74.315 | 1.00 | 33.82 | D000 | C |
| ATOM | 7800 | CG | ASP | P | 177 | 1.804 | −29.908 | 74.967 | 1.00 | 40.40 | D000 | C |
| ATOM | 7801 | OD1 | ASP | P | 177 | 2.724 | −29.448 | 74.243 | 1.00 | 40.31 | D000 | O |
| ATOM | 7802 | OD2 | ASP | P | 177 | 1.934 | −30.111 | 76.206 | 1.00 | 43.49 | D000 | O1− |
| ATOM | 7803 | N | ALA | P | 178 | −2.267 | −29.156 | 72.931 | 1.00 | 33.12 | D000 | N |
| ATOM | 7804 | CA | ALA | P | 178 | −3.558 | −29.421 | 72.307 | 1.00 | 31.89 | D000 | C |
| ATOM | 7805 | C | ALA | P | 178 | −3.617 | −28.832 | 70.899 | 1.00 | 35.82 | D000 | C |
| ATOM | 7806 | O | ALA | P | 178 | −4.104 | −29.487 | 69.969 | 1.00 | 35.46 | D000 | O |
| ATOM | 7807 | CB | ALA | P | 178 | −4.690 | −28.874 | 73.178 | 1.00 | 25.57 | D000 | C |
| ATOM | 7808 | N | ASP | P | 179 | −3.149 | −27.588 | 70.741 | 1.00 | 33.89 | D000 | N |
| ATOM | 7809 | CA | ASP | P | 179 | −2.957 | −26.971 | 69.429 | 1.00 | 35.32 | D000 | C |
| ATOM | 7810 | C | ASP | P | 179 | −2.204 | −27.905 | 68.481 | 1.00 | 38.70 | D000 | C |
| ATOM | 7811 | O | ASP | P | 179 | −2.660 | −28.182 | 67.365 | 1.00 | 37.15 | D000 | O |
| ATOM | 7812 | CB | ASP | P | 179 | −2.188 | −25.656 | 69.607 | 1.00 | 36.39 | D000 | C |
| ATOM | 7813 | CG | ASP | P | 179 | −2.089 | −24.840 | 68.331 | 1.00 | 45.78 | D000 | C |
| ATOM | 7814 | OD1 | ASP | P | 179 | −2.995 | −24.936 | 67.468 | 1.00 | 47.95 | D000 | O |
| ATOM | 7815 | OD2 | ASP | P | 179 | −1.093 | −24.096 | 68.191 | 1.00 | 50.66 | D000 | O1− |
| ATOM | 7816 | N | ASN | P | 180 | −1.049 | −28.410 | 68.918 | 1.00 | 32.54 | D000 | N |
| ATOM | 7817 | CA | ASN | P | 180 | −0.271 | −29.285 | 68.052 | 1.00 | 37.32 | D000 | C |
| ATOM | 7818 | C | ASN | P | 180 | −1.019 | −30.582 | 67.794 | 1.00 | 38.98 | D000 | C |
| ATOM | 7819 | O | ASN | P | 180 | −0.911 | −31.163 | 66.707 | 1.00 | 43.91 | D000 | O |
| ATOM | 7820 | CB | ASN | P | 180 | 1.118 | −29.563 | 68.660 | 1.00 | 33.88 | D000 | C |
| ATOM | 7821 | CG | ASN | P | 180 | 2.023 | −28.309 | 68.713 | 1.00 | 36.32 | D000 | C |
| ATOM | 7822 | OD1 | ASN | P | 180 | 1.696 | −27.243 | 68.174 | 1.00 | 45.19 | D000 | O |
| ATOM | 7823 | ND2 | ASN | P | 180 | 3.160 | −28.445 | 69.372 | 1.00 | 35.02 | D000 | N |
| ATOM | 7824 | N | TYR | P | 181 | −1.771 | −31.060 | 68.782 | 1.00 | 39.97 | D000 | N |
| ATOM | 7825 | CA | TYR | P | 181 | −2.544 | −32.280 | 68.589 | 1.00 | 39.12 | D000 | C |
| ATOM | 7826 | C | TYR | P | 181 | −3.578 | −32.097 | 67.471 | 1.00 | 38.18 | D000 | C |
| ATOM | 7827 | O | TYR | P | 181 | −3.740 | −32.963 | 66.601 | 1.00 | 35.54 | D000 | O |
| ATOM | 7828 | CB | TYR | P | 181 | −3.216 | −32.680 | 69.908 | 1.00 | 26.15 | D000 | C |
| ATOM | 7829 | CG | TYR | P | 181 | −4.103 | −33.884 | 69.760 | 1.00 | 30.23 | D000 | C |
| ATOM | 7830 | CD1 | TYR | P | 181 | −5.415 | −33.752 | 69.303 | 1.00 | 32.63 | D000 | C |
| ATOM | 7831 | CD2 | TYR | P | 181 | −3.642 | −35.158 | 70.052 | 1.00 | 31.11 | D000 | C |
| ATOM | 7832 | CE1 | TYR | P | 181 | −6.223 | −34.846 | 69.131 | 1.00 | 29.23 | D000 | C |
| ATOM | 7833 | CE2 | TYR | P | 181 | −4.463 | −36.267 | 69.898 | 1.00 | 26.83 | D000 | C |
| ATOM | 7834 | CZ | TYR | P | 181 | −5.750 | −36.093 | 69.433 | 1.00 | 27.61 | D000 | C |
| ATOM | 7835 | OH | TYR | P | 181 | −6.587 | −37.157 | 69.283 | 1.00 | 34.40 | D000 | O |
| ATOM | 7836 | N | CYS | P | 182 | −4.291 | −30.973 | 67.476 | 1.00 | 34.18 | D000 | N |
| ATOM | 7837 | CA | CYS | P | 182 | −5.297 | −30.784 | 66.443 | 1.00 | 40.39 | D000 | C |
| ATOM | 7838 | C | CYS | P | 182 | −4.643 | −30.653 | 65.076 | 1.00 | 39.40 | D000 | C |
| ATOM | 7839 | O | CYS | P | 182 | −5.119 | −31.245 | 64.098 | 1.00 | 36.09 | D000 | O |
| ATOM | 7840 | CB | CYS | P | 182 | −6.178 | −29.570 | 66.756 | 1.00 | 38.38 | D000 | C |
| ATOM | 7841 | SG | CYS | P | 182 | −7.302 | −29.774 | 68.185 | 1.00 | 41.03 | D000 | S |
| ATOM | 7842 | N | ARG | P | 183 | −3.541 | −29.899 | 64.997 | 1.00 | 38.60 | D000 | N |
| ATOM | 7843 | CA | ARG | P | 183 | −2.855 | −29.714 | 63.724 | 1.00 | 36.47 | D000 | C |
| ATOM | 7844 | C | ARG | P | 183 | −2.442 | −31.048 | 63.106 | 1.00 | 35.85 | D000 | C |
| ATOM | 7845 | O | ARG | P | 183 | −2.647 | −31.265 | 61.908 | 1.00 | 36.71 | D000 | O |
| ATOM | 7846 | CB | ARG | P | 183 | −1.648 | −28.802 | 63.900 | 1.00 | 36.20 | D000 | C |
| ATOM | 7847 | CG | ARG | P | 183 | −1.953 | −27.334 | 64.191 | 1.00 | 35.03 | D000 | C |
| ATOM | 7848 | CD | ARG | P | 183 | −0.707 | −26.729 | 64.791 | 1.00 | 45.48 | D000 | C |
| ATOM | 7849 | NE | ARG | P | 183 | −0.297 | −25.461 | 64.189 | 1.00 | 63.54 | D000 | N |
| ATOM | 7850 | CZ | ARG | P | 183 | 0.971 | −25.139 | 63.900 | 1.00 | 64.81 | D000 | C |
| ATOM | 7851 | NH1 | ARG | P | 183 | 1.957 | −25.996 | 64.123 | 1.00 | 42.00 | D000 | N1+ |
| ATOM | 7852 | NH2 | ARG | P | 183 | 1.259 | −23.956 | 63.368 | 1.00 | 73.94 | D000 | N |
| ATOM | 7853 | N | LEU | P | 184 | −1.906 | −31.972 | 63.906 | 1.00 | 34.56 | D000 | N |
| ATOM | 7854 | CA | LEU | P | 184 | −1.585 | −33.295 | 63.377 | 1.00 | 34.47 | D000 | C |
| ATOM | 7855 | C | LEU | P | 184 | −2.812 | −34.158 | 63.104 | 1.00 | 43.39 | D000 | C |
| ATOM | 7856 | O | LEU | P | 184 | −2.648 | −35.287 | 62.629 | 1.00 | 48.31 | D000 | O |
| ATOM | 7857 | CB | LEU | P | 184 | −0.669 | −34.073 | 64.311 | 1.00 | 40.32 | D000 | C |
| ATOM | 7858 | CG | LEU | P | 184 | 0.849 | −33.962 | 64.235 | 1.00 | 47.86 | D000 | C |
| ATOM | 7859 | CD1 | LEU | P | 184 | 1.306 | −33.127 | 63.057 | 1.00 | 34.57 | D000 | C |
| ATOM | 7860 | CD2 | LEU | P | 184 | 1.398 | −33.477 | 65.565 | 1.00 | 40.91 | D000 | C |
| ATOM | 7861 | N | GLU | P | 185 | −4.016 | −33.714 | 63.463 | 1.00 | 43.99 | D000 | N |
| ATOM | 7862 | CA | GLU | P | 185 | −5.220 | −34.401 | 63.011 | 1.00 | 42.68 | D000 | C |
| ATOM | 7863 | C | GLU | P | 185 | −5.746 | −33.822 | 61.714 | 1.00 | 42.10 | D000 | C |
| ATOM | 7864 | O | GLU | P | 185 | −6.877 | −34.117 | 61.325 | 1.00 | 41.36 | D000 | O |
| ATOM | 7865 | CB | GLU | P | 185 | −6.314 | −34.365 | 64.076 | 1.00 | 40.55 | D000 | C |
| ATOM | 7866 | CG | GLU | P | 185 | −5.941 | −35.182 | 65.257 | 1.00 | 41.11 | D000 | C |
| ATOM | 7867 | CD | GLU | P | 185 | −5.903 | −36.635 | 64.898 | 1.00 | 46.25 | D000 | C |
| ATOM | 7868 | OE1 | GLU | P | 185 | −6.722 | −37.051 | 64.048 | 1.00 | 49.14 | D000 | O |
| ATOM | 7869 | OE2 | GLU | P | 185 | −5.032 | −37.350 | 65.434 | 1.00 | 47.23 | D000 | O1− |
| ATOM | 7870 | N | ASP | P | 186 | −4.940 | −33.010 | 61.039 | 1.00 | 47.67 | D000 | N |
| ATOM | 7871 | CA | ASP | P | 186 | −5.390 | −32.232 | 59.896 | 1.00 | 45.07 | D000 | C |

TABLE 10.4-continued

| | | | | | | | | | | | |
|---|---|---|---|---|---|---|---|---|---|---|---|
| ATOM | 7872 | C | ASP | P | 186 | −6.621 | −31.416 | 60.279 | 1.00 | 43.94 | D000 C |
| ATOM | 7873 | O | ASP | P | 186 | −7.601 | −31.332 | 59.539 | 1.00 | 49.84 | D000 O |
| ATOM | 7874 | CB | ASP | P | 186 | −5.656 | −33.149 | 58.700 | 1.00 | 47.50 | D000 C |
| ATOM | 7875 | CG | ASP | P | 186 | −5.429 | −32.459 | 57.365 | 1.00 | 55.72 | D000 C |
| ATOM | 7876 | OD1 | ASP | P | 186 | −5.209 | −31.227 | 57.346 | 1.00 | 54.34 | D000 O |
| ATOM | 7877 | OD2 | ASP | P | 186 | −5.476 | −33.160 | 56.329 | 1.00 | 65.88 | D000 O1− |
| ATOM | 7878 | N | ALA | P | 187 | −6.558 | −30.797 | 61.453 | 1.00 | 43.57 | D000 N |
| ATOM | 7879 | CA | ALA | P | 187 | −7.683 | −30.054 | 62.009 | 1.00 | 40.06 | D000 C |
| ATOM | 7880 | C | ALA | P | 187 | −7.136 | −28.872 | 62.799 | 1.00 | 39.06 | D000 C |
| ATOM | 7881 | O | ALA | P | 187 | −5.965 | −28.502 | 62.673 | 1.00 | 41.54 | D000 O |
| ATOM | 7882 | CB | ALA | P | 187 | −8.559 | −30.971 | 62.871 | 1.00 | 37.26 | D000 C |
| ATOM | 7883 | N | HIS | P | 188 | −7.984 | −28.270 | 63.620 | 1.00 | 38.84 | D000 N |
| ATOM | 7884 | CA | HIS | P | 188 | −7.523 | −27.141 | 64.411 | 1.00 | 42.15 | D000 C |
| ATOM | 7885 | C | HIS | P | 188 | −8.399 | −26.992 | 65.655 | 1.00 | 44.84 | D000 C |
| ATOM | 7886 | O | HIS | P | 188 | −9.536 | −27.477 | 65.704 | 1.00 | 37.93 | D000 O |
| ATOM | 7887 | CB | HIS | P | 188 | −7.528 | −25.863 | 63.577 | 1.00 | 38.38 | D000 C |
| ATOM | 7888 | CG | HIS | P | 188 | −8.885 | −25.488 | 63.084 | 1.00 | 39.56 | D000 C |
| ATOM | 7889 | ND1 | HIS | P | 188 | −9.637 | −24.489 | 63.663 | 1.00 | 42.56 | D000 N |
| ATOM | 7890 | CD2 | HIS | P | 188 | −9.644 | −26.008 | 62.092 | 1.00 | 38.88 | D000 C |
| ATOM | 7891 | CE1 | HIS | P | 188 | −10.793 | −24.394 | 63.034 | 1.00 | 45.45 | D000 C |
| ATOM | 7892 | NE2 | HIS | P | 188 | −10.822 | −25.305 | 62.075 | 1.00 | 47.23 | D000 N |
| ATOM | 7893 | N | LEU | P | 189 | −7.834 | −26.338 | 66.673 | 1.00 | 39.67 | D000 N |
| ATOM | 7894 | CA | LEU | P | 189 | −8.599 | −26.011 | 67.860 | 1.00 | 36.17 | D000 C |
| ATOM | 7895 | C | LEU | P | 189 | −9.829 | −25.215 | 67.464 | 1.00 | 35.83 | D000 C |
| ATOM | 7896 | O | LEU | P | 189 | −9.731 | −24.279 | 66.669 | 1.00 | 34.94 | D000 O |
| ATOM | 7897 | CB | LEU | P | 189 | −7.733 | −25.219 | 68.832 | 1.00 | 37.51 | D000 C |
| ATOM | 7898 | CG | LEU | P | 189 | −6.682 | −25.973 | 69.637 | 1.00 | 36.68 | D000 C |
| ATOM | 7899 | CD1 | LEU | P | 189 | −5.830 | −25.001 | 70.439 | 1.00 | 36.06 | D000 C |
| ATOM | 7900 | CD2 | LEU | P | 189 | −7.377 | −26.952 | 70.569 | 1.00 | 34.22 | D000 C |
| ATOM | 7901 | N | VAL | P | 190 | −10.979 | −25.590 | 68.040 | 1.00 | 34.05 | D000 N |
| ATOM | 7902 | CA | VAL | P | 190 | −12.274 | −25.094 | 67.585 | 1.00 | 34.93 | D000 C |
| ATOM | 7903 | C | VAL | P | 190 | −12.304 | −23.565 | 67.518 | 1.00 | 35.33 | D000 C |
| ATOM | 7904 | O | VAL | P | 190 | −11.823 | −22.852 | 68.410 | 1.00 | 34.50 | D000 O |
| ATOM | 7905 | CB | VAL | P | 190 | −13.400 | −25.641 | 68.486 | 1.00 | 34.45 | D000 C |
| ATOM | 7906 | CG1 | VAL | P | 190 | −13.221 | −25.185 | 69.924 | 1.00 | 32.88 | D000 C |
| ATOM | 7907 | CG2 | VAL | P | 190 | −14.740 | −25.157 | 67.990 | 1.00 | 33.98 | D000 C |
| ATOM | 7908 | N | VAL | P | 191 | −12.889 | −23.066 | 66.438 | 1.00 | 34.01 | D000 N |
| ATOM | 7909 | CA | VAL | P | 191 | −13.051 | −21.643 | 66.182 | 1.00 | 35.07 | D000 C |
| ATOM | 7910 | C | VAL | P | 191 | −14.544 | −21.382 | 66.161 | 1.00 | 36.61 | D000 C |
| ATOM | 7911 | O | VAL | P | 191 | −15.256 | −21.923 | 65.306 | 1.00 | 41.56 | D000 O |
| ATOM | 7912 | CB | VAL | P | 191 | −12.385 | −21.225 | 64.856 | 1.00 | 35.46 | D000 C |
| ATOM | 7913 | CG1 | VAL | P | 191 | −12.817 | −19.830 | 64.431 | 1.00 | 35.96 | D000 C |
| ATOM | 7914 | CG2 | VAL | P | 191 | −10.875 | −21.295 | 64.981 | 1.00 | 36.37 | D000 C |
| ATOM | 7915 | N | VAL | P | 192 | −15.021 | −20.581 | 67.111 | 1.00 | 35.79 | D000 N |
| ATOM | 7916 | CA | VAL | P | 192 | −16.450 | −20.417 | 67.355 | 1.00 | 37.67 | D000 C |
| ATOM | 7917 | C | VAL | P | 192 | −16.893 | −19.094 | 66.754 | 1.00 | 37.75 | D000 C |
| ATOM | 7918 | O | VAL | P | 192 | −16.442 | −18.024 | 67.186 | 1.00 | 38.75 | D000 O |
| ATOM | 7919 | CB | VAL | P | 192 | −16.776 | −20.473 | 68.854 | 1.00 | 38.25 | D000 C |
| ATOM | 7920 | CG1 | VAL | P | 192 | −18.267 | −20.314 | 69.053 | 1.00 | 35.90 | D000 C |
| ATOM | 7921 | CG2 | VAL | P | 192 | −16.282 | −21.774 | 69.455 | 1.00 | 37.22 | D000 C |
| ATOM | 7922 | N | THR | P | 193 | −17.795 | −19.159 | 65.778 | 1.00 | 36.90 | D000 N |
| ATOM | 7923 | CA | THR | P | 193 | −18.151 | −17.982 | 64.995 | 1.00 | 42.26 | D000 C |
| ATOM | 7924 | C | THR | P | 193 | −19.600 | −17.530 | 65.148 | 1.00 | 41.06 | D000 C |
| ATOM | 7925 | O | THR | P | 193 | −19.950 | −16.480 | 64.605 | 1.00 | 46.91 | D000 O |
| ATOM | 7926 | CB | THR | P | 193 | −17.813 | −18.204 | 63.503 | 1.00 | 40.10 | D000 C |
| ATOM | 7927 | OG1 | THR | P | 193 | −18.471 | −19.382 | 63.012 | 1.00 | 45.59 | D000 O |
| ATOM | 7928 | CG2 | THR | P | 193 | −16.302 | −18.323 | 63.286 | 1.00 | 36.33 | D000 C |
| ATOM | 7929 | N | SER | P | 194 | −20.440 | −18.252 | 65.892 | 1.00 | 39.77 | D000 N |
| ATOM | 7930 | CA | SER | P | 194 | −21.849 | −17.898 | 66.016 | 1.00 | 36.24 | D000 C |
| ATOM | 7931 | C | SER | P | 194 | −22.416 | −18.395 | 67.342 | 1.00 | 40.36 | D000 C |
| ATOM | 7932 | O | SER | P | 194 | −21.829 | −19.244 | 68.013 | 1.00 | 39.43 | D000 O |
| ATOM | 7933 | CB | SER | P | 194 | −22.666 | −18.470 | 64.855 | 1.00 | 32.78 | D000 C |
| ATOM | 7934 | OG | SER | P | 194 | −22.508 | −19.875 | 64.777 | 1.00 | 40.86 | D000 O |
| ATOM | 7935 | N | TRP | P | 195 | −23.589 | −17.862 | 67.714 | 1.00 | 44.41 | D000 N |
| ATOM | 7936 | CA | TRP | P | 195 | −24.275 | −18.381 | 68.894 | 1.00 | 41.04 | D000 C |
| ATOM | 7937 | C | TRP | P | 195 | −24.665 | −19.830 | 68.684 | 1.00 | 37.41 | D000 C |
| ATOM | 7938 | O | TRP | P | 195 | −24.633 | −20.639 | 69.618 | 1.00 | 38.72 | D000 O |
| ATOM | 7939 | CB | TRP | P | 195 | −25.519 | −17.557 | 69.216 | 1.00 | 44.82 | D000 C |
| ATOM | 7940 | CG | TRP | P | 195 | −25.243 | −16.309 | 70.020 | 1.00 | 51.32 | D000 C |
| ATOM | 7941 | CD1 | TRP | P | 195 | −25.307 | −15.008 | 69.586 | 1.00 | 46.03 | D000 C |
| ATOM | 7942 | CD2 | TRP | P | 195 | −24.854 | −16.251 | 71.395 | 1.00 | 47.53 | D000 C |
| ATOM | 7943 | NE1 | TRP | P | 195 | −24.987 | −14.148 | 70.610 | 1.00 | 47.20 | D000 N |
| ATOM | 7944 | CE2 | TRP | P | 195 | −24.706 | −14.885 | 71.733 | 1.00 | 51.18 | D000 C |
| ATOM | 7945 | CE3 | TRP | P | 195 | −24.614 | −17.221 | 72.375 | 1.00 | 46.44 | D000 C |
| ATOM | 7946 | CZ2 | TRP | P | 195 | −24.331 | −14.464 | 73.016 | 1.00 | 55.85 | D000 C |
| ATOM | 7947 | CZ3 | TRP | P | 195 | −24.241 | −16.801 | 73.654 | 1.00 | 53.40 | D000 C |
| ATOM | 7948 | CH2 | TRP | P | 195 | −24.105 | −15.435 | 73.961 | 1.00 | 52.97 | D000 C |
| ATOM | 7949 | N | GLU | P | 196 | −25.024 | −20.181 | 67.458 | 1.00 | 34.05 | D000 N |
| ATOM | 7950 | CA | GLU | P | 196 | −25.384 | −21.557 | 67.174 | 1.00 | 36.55 | D000 C |
| ATOM | 7951 | C | GLU | P | 196 | −24.200 | −22.484 | 67.430 | 1.00 | 37.31 | D000 C |

TABLE 10.4-continued

| | | | | | | | | | | | |
|---|---|---|---|---|---|---|---|---|---|---|---|
| ATOM | 7952 | O | GLU | P | 196 | −24.343 | −23.528 | 68.078 | 1.00 | 36.90 | D000 O |
| ATOM | 7953 | CB | GLU | P | 196 | −25.899 | −21.650 | 65.740 | 1.00 | 37.33 | D000 C |
| ATOM | 7954 | CG | GLU | P | 196 | −25.908 | −23.036 | 65.156 | 1.00 | 54.30 | D000 C |
| ATOM | 7955 | CD | GLU | P | 196 | −27.254 | −23.709 | 65.306 | 1.00 | 67.53 | D000 C |
| ATOM | 7956 | OE1 | GLU | P | 196 | −28.111 | −23.139 | 66.025 | 1.00 | 74.43 | D000 O |
| ATOM | 7957 | OE2 | GLU | P | 196 | −27.453 | −24.799 | 64.704 | 1.00 | 66.20 | D000 O1− |
| ATOM | 7958 | N | GLU | P | 197 | −23.008 | −22.101 | 66.961 | 1.00 | 37.44 | D000 N |
| ATOM | 7959 | CA | GLU | P | 197 | −21.837 | −22.949 | 67.173 | 1.00 | 37.15 | D000 C |
| ATOM | 7960 | C | GLU | P | 197 | −21.448 | −23.002 | 68.652 | 1.00 | 36.59 | D000 C |
| ATOM | 7961 | O | GLU | P | 197 | −21.077 | −24.064 | 69.166 | 1.00 | 34.20 | D000 O |
| ATOM | 7962 | CB | GLU | P | 197 | −20.674 | −22.458 | 66.315 | 1.00 | 32.94 | D000 C |
| ATOM | 7963 | CG | GLU | P | 197 | −19.417 | −23.347 | 66.343 | 1.00 | 35.50 | D000 C |
| ATOM | 7964 | CD | GLU | P | 197 | −18.383 | −22.948 | 65.292 | 1.00 | 41.89 | D000 C |
| ATOM | 7965 | OE1 | GLU | P | 197 | −18.466 | −21.807 | 64.772 | 1.00 | 45.12 | D000 O |
| ATOM | 7966 | OE2 | GLU | P | 197 | −17.486 | −23.771 | 64.985 | 1.00 | 41.03 | D000 O1− |
| ATOM | 7967 | N | GLN | P | 198 | −21.538 | −21.865 | 69.345 | 1.00 | 32.12 | D000 N |
| ATOM | 7968 | CA | GLN | P | 198 | −21.193 | −21.792 | 70.759 | 1.00 | 31.52 | D000 C |
| ATOM | 7969 | C | GLN | P | 198 | −22.083 | −22.703 | 71.598 | 1.00 | 35.74 | D000 C |
| ATOM | 7970 | O | GLN | P | 198 | −21.600 | −23.403 | 72.501 | 1.00 | 30.28 | D000 O |
| ATOM | 7971 | CB | GLN | P | 198 | −21.298 | −20.334 | 71.226 | 1.00 | 33.50 | D000 C |
| ATOM | 7972 | CG | GLN | P | 198 | −21.391 | −20.126 | 72.734 | 1.00 | 33.84 | D000 C |
| ATOM | 7973 | CD | GLN | P | 198 | −20.055 | −20.173 | 73.450 | 1.00 | 33.31 | D000 C |
| ATOM | 7974 | OE1 | GLN | P | 198 | −19.009 | −19.859 | 72.878 | 1.00 | 30.27 | D000 O |
| ATOM | 7975 | NE2 | GLN | P | 198 | −20.085 | −20.563 | 74.713 | 1.00 | 33.30 | D000 N |
| ATOM | 7976 | N | LYS | P | 199 | −23.393 | −22.694 | 71.320 | 1.00 | 35.11 | D000 N |
| ATOM | 7977 | CA | LYS | P | 199 | −24.328 | −23.523 | 72.070 | 1.00 | 32.09 | D000 C |
| ATOM | 7978 | C | LYS | P | 199 | −24.070 | −25.009 | 71.828 | 1.00 | 32.10 | D000 C |
| ATOM | 7979 | O | LYS | P | 199 | −24.103 | −25.811 | 72.767 | 1.00 | 31.39 | D000 O |
| ATOM | 7980 | CB | LYS | P | 199 | −25.753 | −23.142 | 71.692 | 1.00 | 31.90 | D000 C |
| ATOM | 7981 | CG | LYS | P | 199 | −26.283 | −21.993 | 72.497 | 1.00 | 34.02 | D000 C |
| ATOM | 7982 | CD | LYS | P | 199 | −27.260 | −21.182 | 71.709 | 1.00 | 36.65 | D000 C |
| ATOM | 7983 | CE | LYS | P | 199 | −28.314 | −22.071 | 71.096 | 1.00 | 40.59 | D000 C |
| ATOM | 7984 | NZ | LYS | P | 199 | −29.444 | −21.249 | 70.594 | 1.00 | 48.36 | D000 N1+ |
| ATOM | 7985 | N | PHE | P | 200 | −23.806 | −25.392 | 70.581 | 1.00 | 28.05 | D000 N |
| ATOM | 7986 | CA | PHE | P | 200 | −23.515 | −26.788 | 70.283 | 1.00 | 28.75 | D000 C |
| ATOM | 7987 | C | PHE | P | 200 | −22.286 | −27.284 | 71.036 | 1.00 | 32.43 | D000 C |
| ATOM | 7988 | O | PHE | P | 200 | −22.287 | −28.399 | 71.568 | 1.00 | 30.79 | D000 O |
| ATOM | 7989 | CB | PHE | P | 200 | −23.318 | −26.956 | 68.787 | 1.00 | 27.58 | D000 C |
| ATOM | 7990 | CG | PHE | P | 200 | −22.644 | −28.222 | 68.417 | 1.00 | 29.26 | D000 C |
| ATOM | 7991 | CD1 | PHE | P | 200 | −23.363 | −29.387 | 68.303 | 1.00 | 28.09 | D000 C |
| ATOM | 7992 | CD2 | PHE | P | 200 | −21.279 | −28.247 | 68.172 | 1.00 | 31.84 | D000 C |
| ATOM | 7993 | CE1 | PHE | P | 200 | −22.747 | −30.561 | 67.943 | 1.00 | 30.20 | D000 C |
| ATOM | 7994 | CE2 | PHE | P | 200 | −20.647 | −29.415 | 67.799 | 1.00 | 31.13 | D000 C |
| ATOM | 7995 | CZ | PHE | P | 200 | −21.385 | −30.577 | 67.682 | 1.00 | 33.34 | D000 C |
| ATOM | 7996 | N | VAL | P | 201 | −21.220 | −26.478 | 71.083 | 1.00 | 30.80 | D000 N |
| ATOM | 7997 | CA | VAL | P | 201 | −20.015 | −26.900 | 71.787 | 1.00 | 31.26 | D000 C |
| ATOM | 7998 | C | VAL | P | 201 | −20.277 | −26.989 | 73.295 | 1.00 | 31.79 | D000 C |
| ATOM | 7999 | O | VAL | P | 201 | −19.849 | −27.947 | 73.948 | 1.00 | 29.59 | D000 O |
| ATOM | 8000 | CB | VAL | P | 201 | −18.836 | −25.959 | 71.458 | 1.00 | 30.91 | D000 C |
| ATOM | 8001 | CG1 | VAL | P | 201 | −17.611 | −26.260 | 72.345 | 1.00 | 32.04 | D000 C |
| ATOM | 8002 | CG2 | VAL | P | 201 | −18.433 | −26.104 | 70.020 | 1.00 | 33.28 | D000 C |
| ATOM | 8003 | N | GLN | P | 202 | −21.001 | −26.012 | 73.862 | 1.00 | 30.50 | D000 N |
| ATOM | 8004 | CA | GLN | P | 202 | −21.323 | −26.044 | 75.290 | 1.00 | 30.37 | D000 C |
| ATOM | 8005 | C | GLN | P | 202 | −22.040 | −27.327 | 75.670 | 1.00 | 25.89 | D000 C |
| ATOM | 8006 | O | GLN | P | 202 | −21.755 | −27.903 | 76.719 | 1.00 | 33.97 | D000 O |
| ATOM | 8007 | CB | GLN | P | 202 | −22.203 | −24.865 | 75.701 | 1.00 | 35.09 | D000 C |
| ATOM | 8008 | CG | GLN | P | 202 | −21.566 | −23.520 | 75.783 | 1.00 | 35.69 | D000 C |
| ATOM | 8009 | CD | GLN | P | 202 | −22.490 | −22.528 | 76.480 | 1.00 | 47.70 | D000 C |
| ATOM | 8010 | OE1 | GLN | P | 202 | −22.615 | −21.351 | 76.078 | 1.00 | 41.49 | D000 O |
| ATOM | 8011 | NE2 | GLN | P | 202 | −23.110 | −22.990 | 77.575 | 1.00 | 49.12 | D000 N |
| ATOM | 8012 | N | HIS | P | 203 | −23.025 | −27.742 | 74.871 | 1.00 | 25.10 | D000 N |
| ATOM | 8013 | CA | HIS | P | 203 | −23.731 | −29.000 | 75.117 | 1.00 | 27.41 | D000 C |
| ATOM | 8014 | C | HIS | P | 203 | −22.780 | −30.154 | 75.316 | 1.00 | 32.74 | D000 C |
| ATOM | 8015 | O | HIS | P | 203 | −22.919 | −30.940 | 76.262 | 1.00 | 37.16 | D000 O |
| ATOM | 8016 | CB | HIS | P | 203 | −24.638 | −29.354 | 73.947 | 1.00 | 31.40 | D000 C |
| ATOM | 8017 | CG | HIS | P | 203 | −26.051 | −28.936 | 74.117 | 1.00 | 37.58 | D000 C |
| ATOM | 8018 | ND1 | HIS | P | 203 | −26.725 | −28.198 | 73.167 | 1.00 | 46.93 | D000 N |
| ATOM | 8019 | CD2 | HIS | P | 203 | −26.942 | −29.204 | 75.098 | 1.00 | 43.64 | D000 C |
| ATOM | 8020 | CE1 | HIS | P | 203 | −27.963 | −27.992 | 73.576 | 1.00 | 52.72 | D000 C |
| ATOM | 8021 | NE2 | HIS | P | 203 | −28.122 | −28.598 | 74.742 | 1.00 | 57.54 | D000 N |
| ATOM | 8022 | N | HIS | P | 204 | −21.809 | −30.280 | 74.406 | 1.00 | 33.87 | D000 N |
| ATOM | 8023 | CA | HIS | P | 204 | −20.952 | −31.453 | 74.375 | 1.00 | 32.62 | D000 C |
| ATOM | 8024 | C | HIS | P | 204 | −19.857 | −31.394 | 75.428 | 1.00 | 30.65 | D000 C |
| ATOM | 8025 | O | HIS | P | 204 | −19.399 | −32.445 | 75.880 | 1.00 | 27.67 | D000 O |
| ATOM | 8026 | CB | HIS | P | 204 | −20.373 | −31.635 | 72.969 | 1.00 | 25.37 | D000 C |
| ATOM | 8027 | CG | HIS | P | 204 | −21.341 | −32.234 | 71.995 | 1.00 | 29.38 | D000 C |
| ATOM | 8028 | ND1 | HIS | P | 204 | −21.525 | −33.593 | 71.869 | 1.00 | 30.92 | D000 N |
| ATOM | 8029 | CD2 | HIS | P | 204 | −22.217 | −31.661 | 71.137 | 1.00 | 32.57 | D000 C |
| ATOM | 8030 | CE1 | HIS | P | 204 | −22.445 | −33.835 | 70.953 | 1.00 | 28.23 | D000 C |
| ATOM | 8031 | NE2 | HIS | P | 204 | −22.883 | −32.678 | 70.494 | 1.00 | 34.46 | D000 N |

TABLE 10.4-continued

| | | | | | | | | | | | |
|---|---|---|---|---|---|---|---|---|---|---|---|
| ATOM | 8032 | N | ILE | P | 205 | −19.424 | −30.197 | 75.830 | 1.00 | 28.24 | D000 N |
| ATOM | 8033 | CA | ILE | P | 205 | −18.324 | −30.104 | 76.778 | 1.00 | 27.46 | D000 C |
| ATOM | 8034 | C | ILE | P | 205 | −18.778 | −30.056 | 78.220 | 1.00 | 33.06 | D000 C |
| ATOM | 8035 | O | ILE | P | 205 | −17.952 | −30.295 | 79.111 | 1.00 | 35.59 | D000 O |
| ATOM | 8036 | CB | ILE | P | 205 | −17.392 | −28.907 | 76.513 | 1.00 | 33.12 | D000 C |
| ATOM | 8037 | CG1 | ILE | P | 205 | −18.123 | −27.564 | 76.648 | 1.00 | 26.96 | D000 C |
| ATOM | 8038 | CG2 | ILE | P | 205 | −16.702 | −29.080 | 75.173 | 1.00 | 25.98 | D000 C |
| ATOM | 8039 | CD1 | ILE | P | 205 | −17.174 | −26.412 | 76.624 | 1.00 | 23.08 | D000 C |
| ATOM | 8040 | N | GLY | P | 206 | −20.043 | −29.713 | 78.482 | 1.00 | 35.40 | D000 N |
| ATOM | 8041 | CA | GLY | P | 206 | −20.536 | −29.649 | 79.837 | 1.00 | 29.75 | D000 C |
| ATOM | 8042 | C | GLY | P | 206 | −19.906 | −28.523 | 80.620 | 1.00 | 32.65 | D000 C |
| ATOM | 8043 | O | GLY | P | 206 | −19.313 | −27.601 | 80.053 | 1.00 | 35.11 | D000 O |
| ATOM | 8044 | N | PRO | P | 207 | −20.032 | −28.568 | 81.948 | 1.00 | 33.48 | D000 N |
| ATOM | 8045 | CA | PRO | P | 207 | −19.544 | −27.464 | 82.797 | 1.00 | 31.43 | D000 C |
| ATOM | 8046 | C | PRO | P | 207 | −18.059 | −27.610 | 83.123 | 1.00 | 36.17 | D000 C |
| ATOM | 8047 | O | PRO | P | 207 | −17.637 | −27.650 | 84.288 | 1.00 | 38.20 | D000 O |
| ATOM | 8048 | CB | PRO | P | 207 | −20.443 | −27.590 | 84.032 | 1.00 | 35.30 | D000 C |
| ATOM | 8049 | CG | PRO | P | 207 | −20.723 | −29.073 | 84.132 | 1.00 | 31.37 | D000 C |
| ATOM | 8050 | CD | PRO | P | 207 | −20.694 | −29.628 | 82.727 | 1.00 | 30.51 | D000 C |
| ATOM | 8051 | N | VAL | P | 208 | −17.242 | −27.622 | 82.071 | 1.00 | 35.28 | D000 N |
| ATOM | 8052 | CA | VAL | P | 208 | −15.854 | −28.057 | 82.127 | 1.00 | 31.19 | D000 C |
| ATOM | 8053 | C | VAL | P | 208 | −14.990 | −27.043 | 81.389 | 1.00 | 32.34 | D000 C |
| ATOM | 8054 | O | VAL | P | 208 | −15.252 | −26.754 | 80.217 | 1.00 | 30.13 | D000 O |
| ATOM | 8055 | CB | VAL | P | 208 | −15.733 | −29.454 | 81.493 | 1.00 | 24.39 | D000 C |
| ATOM | 8056 | CG1 | VAL | P | 208 | −14.304 | −29.927 | 81.433 | 1.00 | 19.72 | D000 C |
| ATOM | 8057 | CG2 | VAL | P | 208 | −16.623 | −30.417 | 82.259 | 1.00 | 26.85 | D000 C |
| ATOM | 8058 | N | ASN | P | 209 | −13.955 | −26.514 | 82.065 | 1.00 | 33.01 | D000 N |
| ATOM | 8059 | CA | ASN | P | 209 | −12.987 | −25.628 | 81.404 | 1.00 | 28.33 | D000 C |
| ATOM | 8060 | C | ASN | P | 209 | −12.325 | −26.339 | 80.224 | 1.00 | 28.70 | D000 C |
| ATOM | 8061 | O | ASN | P | 209 | −11.666 | −27.369 | 80.409 | 1.00 | 26.30 | D000 O |
| ATOM | 8062 | CB | ASN | P | 209 | −11.911 | −25.165 | 82.388 | 1.00 | 26.60 | D000 C |
| ATOM | 8063 | CG | ASN | P | 209 | −12.401 | −24.116 | 83.370 | 1.00 | 27.81 | D000 C |
| ATOM | 8064 | OD1 | ASN | P | 209 | −13.324 | −23.343 | 83.094 | 1.00 | 31.03 | D000 O |
| ATOM | 8065 | ND2 | ASN | P | 209 | −11.774 | −24.083 | 84.528 | 1.00 | 22.70 | D000 N |
| ATOM | 8066 | N | THR | P | 210 | −12.487 | −25.786 | 79.017 | 1.00 | 27.48 | D000 N |
| ATOM | 8067 | CA | THR | P | 210 | −12.049 | −26.451 | 77.790 | 1.00 | 27.53 | D000 C |
| ATOM | 8068 | C | THR | P | 210 | −11.385 | −25.441 | 76.860 | 1.00 | 29.97 | D000 C |
| ATOM | 8069 | O | THR | P | 210 | −11.918 | −24.350 | 76.656 | 1.00 | 28.86 | D000 O |
| ATOM | 8070 | CB | THR | P | 210 | −13.223 | −27.156 | 77.082 | 1.00 | 28.24 | D000 C |
| ATOM | 8071 | OG1 | THR | P | 210 | −13.710 | −28.226 | 77.908 | 1.00 | 30.12 | D000 O |
| ATOM | 8072 | CG2 | THR | P | 210 | −12.801 | −27.746 | 75.755 | 1.00 | 23.19 | D000 C |
| ATOM | 8073 | N | TRP | P | 211 | −10.219 | −25.797 | 76.313 | 1.00 | 29.85 | D000 N |
| ATOM | 8074 | CA | TRP | P | 211 | −9.514 | −24.902 | 75.399 | 1.00 | 31.37 | D000 C |
| ATOM | 8075 | C | TRP | P | 211 | −10.280 | −24.746 | 74.099 | 1.00 | 34.18 | D000 C |
| ATOM | 8076 | O | TRP | P | 211 | −10.884 | −25.707 | 73.604 | 1.00 | 32.26 | D000 O |
| ATOM | 8077 | CB | TRP | P | 211 | −8.122 | −25.430 | 75.046 | 1.00 | 26.53 | D000 C |
| ATOM | 8078 | CG | TRP | P | 211 | −7.115 | −25.421 | 76.131 | 1.00 | 30.84 | D000 C |
| ATOM | 8079 | CD1 | TRP | P | 211 | −6.341 | −26.470 | 76.523 | 1.00 | 29.48 | D000 C |
| ATOM | 8080 | CD2 | TRP | P | 211 | −6.740 | −24.312 | 76.959 | 1.00 | 29.42 | D000 C |
| ATOM | 8081 | NE1 | TRP | P | 211 | −5.507 | −26.084 | 77.538 | 1.00 | 29.42 | D000 N |
| ATOM | 8082 | CE2 | TRP | P | 211 | −5.740 | −24.768 | 77.832 | 1.00 | 29.17 | D000 C |
| ATOM | 8083 | CE3 | TRP | P | 211 | −7.150 | −22.979 | 77.041 | 1.00 | 31.34 | D000 C |
| ATOM | 8084 | CZ2 | TRP | P | 211 | −5.145 | −23.942 | 78.778 | 1.00 | 31.63 | D000 C |
| ATOM | 8085 | CZ3 | TRP | P | 211 | −6.563 | −22.163 | 77.977 | 1.00 | 28.33 | D000 C |
| ATOM | 8086 | CH2 | TRP | P | 211 | −5.568 | −22.642 | 78.830 | 1.00 | 30.22 | D000 C |
| ATOM | 8087 | N | MET | P | 212 | −10.227 | −23.530 | 73.540 | 1.00 | 33.06 | D000 N |
| ATOM | 8088 | CA | MET | P | 212 | −10.647 | −23.222 | 72.175 | 1.00 | 33.50 | D000 C |
| ATOM | 8089 | C | MET | P | 212 | −9.461 | −22.623 | 71.415 | 1.00 | 35.69 | D000 C |
| ATOM | 8090 | O | MET | P | 212 | −8.401 | −22.362 | 71.985 | 1.00 | 33.28 | D000 O |
| ATOM | 8091 | CB | MET | P | 212 | −11.841 | −22.265 | 72.153 | 1.00 | 27.35 | D000 C |
| ATOM | 8092 | CG | MET | P | 212 | −11.442 | −20.835 | 72.335 | 1.00 | 34.07 | D000 C |
| ATOM | 8093 | SD | MET | P | 212 | −12.807 | −19.717 | 72.680 | 1.00 | 33.50 | D000 S |
| ATOM | 8094 | CE | MET | P | 212 | −13.264 | −20.227 | 74.323 | 1.00 | 34.96 | D000 C |
| ATOM | 8095 | N | GLY | P | 213 | −9.615 | −22.465 | 70.099 | 1.00 | 38.96 | D000 N |
| ATOM | 8096 | CA | GLY | P | 213 | −8.538 | −21.941 | 69.266 | 1.00 | 36.71 | D000 C |
| ATOM | 8097 | C | GLY | P | 213 | −8.297 | −20.437 | 69.293 | 1.00 | 36.61 | D000 C |
| ATOM | 8098 | O | GLY | P | 213 | −8.265 | −19.807 | 68.237 | 1.00 | 34.15 | D000 O |
| ATOM | 8099 | N | LEU | P | 214 | −8.113 | −19.847 | 70.472 | 1.00 | 37.22 | D000 N |
| ATOM | 8100 | CA | LEU | P | 214 | −7.994 | −18.399 | 70.609 | 1.00 | 40.19 | D000 C |
| ATOM | 8101 | C | LEU | P | 214 | −6.897 | −18.065 | 71.618 | 1.00 | 44.61 | D000 C |
| ATOM | 8102 | O | LEU | P | 214 | −6.928 | −18.534 | 72.761 | 1.00 | 42.53 | D000 O |
| ATOM | 8103 | CB | LEU | P | 214 | −9.340 | −17.783 | 71.019 | 1.00 | 36.46 | D000 C |
| ATOM | 8104 | CG | LEU | P | 214 | −9.420 | −16.273 | 71.253 | 1.00 | 39.49 | D000 C |
| ATOM | 8105 | CD1 | LEU | P | 214 | −9.308 | −15.528 | 69.943 | 1.00 | 39.79 | D000 C |
| ATOM | 8106 | CD2 | LEU | P | 214 | −10.692 | −15.890 | 71.983 | 1.00 | 37.37 | D000 C |
| ATOM | 8107 | N | HIS | P | 215 | −5.914 | −17.274 | 71.191 | 1.00 | 47.99 | D000 N |
| ATOM | 8108 | CA | HIS | P | 215 | −4.787 | −16.902 | 72.042 | 1.00 | 53.52 | D000 C |
| ATOM | 8109 | C | HIS | P | 215 | −4.270 | −15.525 | 71.632 | 1.00 | 50.41 | D000 C |
| ATOM | 8110 | O | HIS | P | 215 | −4.496 | −15.076 | 70.506 | 1.00 | 50.05 | D000 O |
| ATOM | 8111 | CB | HIS | P | 215 | −3.668 | −17.963 | 71.988 | 1.00 | 48.40 | D000 C |

TABLE 10.4-continued

| | | | | | | | | | | | |
|---|---|---|---|---|---|---|---|---|---|---|---|
| ATOM | 8112 | CG | HIS | P | 215 | −3.026 | −18.112 | 70.645 | 1.00 | 51.27 | D000 | C |
| ATOM | 8113 | ND1 | HIS | P | 215 | −1.709 | −18.488 | 70.490 | 1.00 | 52.99 | D000 | N |
| ATOM | 8114 | CD2 | HIS | P | 215 | −3.517 | −17.937 | 69.394 | 1.00 | 48.48 | D000 | C |
| ATOM | 8115 | CE1 | HIS | P | 215 | −1.417 | −18.539 | 69.203 | 1.00 | 55.12 | D000 | C |
| ATOM | 8116 | NE2 | HIS | P | 215 | −2.496 | −18.205 | 68.517 | 1.00 | 52.31 | D000 | N |
| ATOM | 8117 | N | ASP | P | 216 | −3.639 | −14.826 | 72.579 | 1.00 | 50.32 | D000 | N |
| ATOM | 8118 | CA | ASP | P | 216 | −2.999 | −13.547 | 72.283 | 1.00 | 62.90 | D000 | C |
| ATOM | 8119 | C | ASP | P | 216 | −1.529 | −13.584 | 72.680 | 1.00 | 66.62 | D000 | C |
| ATOM | 8120 | O | ASP | P | 216 | −0.957 | −12.579 | 73.111 | 1.00 | 70.47 | D000 | O |
| ATOM | 8121 | CB | ASP | P | 216 | −3.730 | −12.376 | 72.949 | 1.00 | 58.20 | D000 | C |
| ATOM | 8122 | CG | ASP | P | 216 | −3.387 | −12.201 | 74.428 | 1.00 | 62.56 | D000 | C |
| ATOM | 8123 | OD1 | ASP | P | 216 | −2.915 | −13.156 | 75.088 | 1.00 | 67.95 | D000 | O |
| ATOM | 8124 | OD2 | ASP | P | 216 | −3.613 | −11.088 | 74.942 | 1.00 | 66.89 | D000 | O1− |
| ATOM | 8125 | N | GLN | P | 217 | −0.907 | −14.751 | 72.520 | 1.00 | 64.97 | D000 | N |
| ATOM | 8126 | CA | GLN | P | 217 | 0.521 | −14.866 | 72.771 | 1.00 | 76.33 | D000 | C |
| ATOM | 8127 | C | GLN | P | 217 | 1.312 | −13.867 | 71.944 | 1.00 | 79.09 | D000 | C |
| ATOM | 8128 | O | GLN | P | 217 | 2.439 | −13.521 | 72.314 | 1.00 | 84.36 | D000 | O |
| ATOM | 8129 | CB | GLN | P | 217 | 0.981 | −16.309 | 72.509 | 1.00 | 76.19 | D000 | C |
| ATOM | 8130 | CG | GLN | P | 217 | 0.950 | −17.206 | 73.776 | 1.00 | 69.70 | D000 | C |
| ATOM | 8131 | CD | GLN | P | 217 | 0.539 | −18.645 | 73.498 | 1.00 | 61.34 | D000 | C |
| ATOM | 8132 | OE1 | GLN | P | 217 | −0.353 | −18.897 | 72.690 | 1.00 | 62.21 | D000 | O |
| ATOM | 8133 | NE2 | GLN | P | 217 | 1.177 | −19.597 | 74.185 | 1.00 | 61.50 | D000 | N |
| ATOM | 8134 | N | ASN | P | 218 | 0.722 | −13.361 | 70.863 | 1.00 | 80.19 | D000 | N |
| ATOM | 8135 | CA | ASN | P | 218 | 1.363 | −12.319 | 70.073 | 1.00 | 87.85 | D000 | C |
| ATOM | 8136 | C | ASN | P | 218 | 1.275 | −10.964 | 70.775 | 1.00 | 79.48 | D000 | C |
| ATOM | 8137 | O | ASN | P | 218 | 2.294 | −10.367 | 71.140 | 1.00 | 80.45 | D000 | O |
| ATOM | 8138 | CB | ASN | P | 218 | 0.705 | −12.268 | 68.689 | 1.00 | 84.56 | D000 | C |
| ATOM | 8139 | CG | ASN | P | 218 | 1.684 | −11.916 | 67.594 | 1.00 | 89.88 | D000 | C |
| ATOM | 8140 | OD1 | ASN | P | 218 | 1.373 | −12.042 | 66.404 | 1.00 | 90.71 | D000 | O |
| ATOM | 8141 | ND2 | ASN | P | 218 | 2.891 | −11.507 | 67.986 | 1.00 | 84.53 | D000 | N |
| ATOM | 8142 | N | GLY | P | 219 | 0.059 | −10.514 | 71.040 | 1.00 | 74.18 | D000 | N |
| ATOM | 8143 | CA | GLY | P | 219 | −0.212 | −9.187 | 71.530 | 1.00 | 68.61 | D000 | C |
| ATOM | 8144 | C | GLY | P | 219 | −1.710 | −8.949 | 71.462 | 1.00 | 73.97 | D000 | C |
| ATOM | 8145 | O | GLY | P | 219 | −2.366 | −8.740 | 72.489 | 1.00 | 71.33 | D000 | O |
| ATOM | 8146 | N | PRO | P | 220 | −2.285 | −9.017 | 70.255 | 1.00 | 69.70 | D000 | N |
| ATOM | 8147 | CA | PRO | P | 220 | −3.745 | −9.029 | 70.112 | 1.00 | 69.83 | D000 | C |
| ATOM | 8148 | C | PRO | P | 220 | −4.304 | −10.446 | 70.009 | 1.00 | 67.70 | D000 | C |
| ATOM | 8149 | O | PRO | P | 220 | −3.608 | −11.402 | 69.652 | 1.00 | 66.31 | D000 | O |
| ATOM | 8150 | CB | PRO | P | 220 | −3.967 | −8.274 | 68.792 | 1.00 | 64.94 | D000 | C |
| ATOM | 8151 | CG | PRO | P | 220 | −2.674 | −8.444 | 68.009 | 1.00 | 60.23 | D000 | C |
| ATOM | 8152 | CD | PRO | P | 220 | −1.625 | −9.035 | 68.933 | 1.00 | 70.78 | D000 | C |
| ATOM | 8153 | N | TRP | P | 221 | −5.595 | −10.568 | 70.309 | 1.00 | 58.78 | D000 | N |
| ATOM | 8154 | CA | TRP | P | 221 | −6.244 | −11.868 | 70.228 | 1.00 | 52.55 | D000 | C |
| ATOM | 8155 | C | TRP | P | 221 | −6.415 | −12.290 | 68.778 | 1.00 | 51.19 | D000 | C |
| ATOM | 8156 | O | TRP | P | 221 | −6.795 | −11.486 | 67.920 | 1.00 | 53.28 | D000 | O |
| ATOM | 8157 | CB | TRP | P | 221 | −7.601 | −11.831 | 70.940 | 1.00 | 52.62 | D000 | C |
| ATOM | 8158 | CG | TRP | P | 221 | −7.438 | −11.729 | 72.425 | 1.00 | 50.70 | D000 | C |
| ATOM | 8159 | CD1 | TRP | P | 221 | −7.477 | −10.597 | 73.179 | 1.00 | 52.92 | D000 | C |
| ATOM | 8160 | CD2 | TRP | P | 221 | −7.164 | −12.807 | 73.332 | 1.00 | 48.63 | D000 | C |
| ATOM | 8161 | NE1 | TRP | P | 221 | −7.256 | −10.901 | 74.505 | 1.00 | 54.57 | D000 | N |
| ATOM | 8162 | CE2 | TRP | P | 221 | −7.058 | −12.251 | 74.624 | 1.00 | 49.93 | D000 | C |
| ATOM | 8163 | CE3 | TRP | P | 221 | −7.001 | −14.189 | 73.177 | 1.00 | 46.93 | D000 | C |
| ATOM | 8164 | CZ2 | TRP | P | 221 | −6.796 | −13.029 | 75.757 | 1.00 | 50.65 | D000 | C |
| ATOM | 8165 | CZ3 | TRP | P | 221 | −6.739 | −14.960 | 74.303 | 1.00 | 46.92 | D000 | C |
| ATOM | 8166 | CH2 | TRP | P | 221 | −6.643 | −14.377 | 75.575 | 1.00 | 48.14 | D000 | C |
| ATOM | 8167 | N | LYS | P | 222 | −6.132 | −13.568 | 68.513 | 1.00 | 50.38 | D000 | N |
| ATOM | 8168 | CA | LYS | P | 222 | −6.213 | −14.155 | 67.178 | 1.00 | 52.36 | D000 | C |
| ATOM | 8169 | C | LYS | P | 222 | −6.785 | −15.564 | 67.274 | 1.00 | 48.11 | D000 | C |
| ATOM | 8170 | O | LYS | P | 222 | −6.551 | −16.277 | 68.253 | 1.00 | 43.41 | D000 | O |
| ATOM | 8171 | CB | LYS | P | 222 | −4.842 | −14.247 | 66.473 | 1.00 | 48.15 | D000 | C |
| ATOM | 8172 | CG | LYS | P | 222 | −3.989 | −13.006 | 66.480 | 1.00 | 49.51 | D000 | C |
| ATOM | 8173 | CD | LYS | P | 222 | −2.623 | −13.343 | 65.879 | 1.00 | 63.49 | D000 | C |
| ATOM | 8174 | CE | LYS | P | 222 | −1.744 | −12.107 | 65.682 | 1.00 | 74.29 | D000 | C |
| ATOM | 8175 | NZ | LYS | P | 222 | −0.559 | −12.385 | 64.812 | 1.00 | 71.05 | D000 | N1+ |
| ATOM | 8176 | N | TRP | P | 223 | −7.518 | −15.967 | 66.239 | 1.00 | 46.69 | D000 | N |
| ATOM | 8177 | CA | TRP | P | 223 | −7.966 | −17.345 | 66.081 | 1.00 | 40.92 | D000 | C |
| ATOM | 8178 | C | TRP | P | 223 | −6.901 | −18.155 | 65.334 | 1.00 | 42.46 | D000 | C |
| ATOM | 8179 | O | TRP | P | 223 | −6.100 | −17.605 | 64.578 | 1.00 | 42.65 | D000 | O |
| ATOM | 8180 | CB | TRP | P | 223 | −9.314 | −17.398 | 65.346 | 1.00 | 38.25 | D000 | C |
| ATOM | 8181 | CG | TRP | P | 223 | −10.464 | −16.803 | 66.160 | 1.00 | 46.60 | D000 | C |
| ATOM | 8182 | CD1 | TRP | P | 223 | −10.918 | −15.508 | 66.115 | 1.00 | 44.78 | D000 | C |
| ATOM | 8183 | CD2 | TRP | P | 223 | −11.284 | −17.476 | 67.141 | 1.00 | 41.63 | D000 | C |
| ATOM | 8184 | NE1 | TRP | P | 223 | −11.954 | −15.337 | 67.003 | 1.00 | 45.05 | D000 | N |
| ATOM | 8185 | CE2 | TRP | P | 223 | −12.203 | −16.526 | 67.641 | 1.00 | 43.02 | D000 | C |
| ATOM | 8186 | CE3 | TRP | P | 223 | −11.328 | −18.786 | 67.644 | 1.00 | 40.53 | D000 | C |
| ATOM | 8187 | CZ2 | TRP | P | 223 | −13.152 | −16.843 | 68.628 | 1.00 | 38.24 | D000 | C |
| ATOM | 8188 | CZ3 | TRP | P | 223 | −12.271 | −19.097 | 68.619 | 1.00 | 38.15 | D000 | C |
| ATOM | 8189 | CH2 | TRP | P | 223 | −13.165 | −18.125 | 69.103 | 1.00 | 37.47 | D000 | C |
| ATOM | 8190 | N | VAL | P | 224 | −6.863 | −19.466 | 65.601 | 1.00 | 41.18 | D000 | N |
| ATOM | 8191 | CA | VAL | P | 224 | −5.813 | −20.316 | 65.049 | 1.00 | 40.27 | D000 | C |

TABLE 10.4-continued

| | | | | | | | | | | | |
|---|---|---|---|---|---|---|---|---|---|---|---|
| ATOM | 8192 | C | VAL | P | 224 | −5.952 | −20.568 | 63.553 | 1.00 | 43.70 | D000 C |
| ATOM | 8193 | O | VAL | P | 224 | −4.977 | −20.993 | 62.918 | 1.00 | 45.37 | D000 O |
| ATOM | 8194 | CB | VAL | P | 224 | −5.738 | −21.679 | 65.760 | 1.00 | 35.45 | D000 C |
| ATOM | 8195 | CG1 | VAL | P | 224 | −5.402 | −21.490 | 67.200 | 1.00 | 39.13 | D000 C |
| ATOM | 8196 | CG2 | VAL | P | 224 | −7.025 | −22.441 | 65.581 | 1.00 | 35.78 | D000 C |
| ATOM | 8197 | N | ASP | P | 225 | −7.132 | −20.379 | 62.966 | 1.00 | 45.80 | D000 N |
| ATOM | 8198 | CA | ASP | P | 225 | −7.297 | −20.628 | 61.535 | 1.00 | 47.35 | D000 C |
| ATOM | 8199 | C | ASP | P | 225 | −7.260 | −19.343 | 60.721 | 1.00 | 44.18 | D000 C |
| ATOM | 8200 | O | ASP | P | 225 | −7.418 | −19.380 | 59.496 | 1.00 | 41.75 | D000 O |
| ATOM | 8201 | CB | ASP | P | 225 | −8.590 | −21.431 | 61.261 | 1.00 | 42.90 | D000 C |
| ATOM | 8202 | CG | ASP | P | 225 | −9.864 | −20.593 | 61.367 | 1.00 | 45.62 | D000 C |
| ATOM | 8203 | OD1 | ASP | P | 225 | −9.832 | −19.473 | 61.933 | 1.00 | 42.32 | D000 O |
| ATOM | 8204 | OD2 | ASP | P | 225 | −10.912 | −21.079 | 60.878 | 1.00 | 49.08 | D000 O1− |
| ATOM | 8205 | N | GLY | P | 226 | −7.023 | −18.215 | 61.373 | 1.00 | 42.84 | D000 N |
| ATOM | 8206 | CA | GLY | P | 226 | −6.919 | −16.957 | 60.693 | 1.00 | 37.63 | D000 C |
| ATOM | 8207 | C | GLY | P | 226 | −8.168 | −16.131 | 60.725 | 1.00 | 40.53 | D000 C |
| ATOM | 8208 | O | GLY | P | 226 | −8.089 | −14.938 | 60.408 | 1.00 | 43.36 | D000 O |
| ATOM | 8209 | N | THR | P | 227 | −9.315 | −16.725 | 61.089 | 1.00 | 42.48 | D000 N |
| ATOM | 8210 | CA | THR | P | 227 | −10.562 | −15.973 | 61.156 | 1.00 | 39.26 | D000 C |
| ATOM | 8211 | C | THR | P | 227 | −10.348 | −14.706 | 61.974 | 1.00 | 43.02 | D000 C |
| ATOM | 8212 | O | THR | P | 227 | −9.666 | −14.722 | 63.005 | 1.00 | 41.15 | D000 O |
| ATOM | 8213 | CB | THR | P | 227 | −11.684 | −16.819 | 61.760 | 1.00 | 38.82 | D000 C |
| ATOM | 8214 | OG1 | THR | P | 227 | −11.803 | −18.060 | 61.044 | 1.00 | 45.33 | D000 O |
| ATOM | 8215 | CG2 | THR | P | 227 | −13.015 | −16.065 | 61.694 | 1.00 | 30.94 | D000 C |
| ATOM | 8216 | N | ASP | P | 228 | −10.899 | −13.600 | 61.485 | 1.00 | 35.97 | D000 N |
| ATOM | 8217 | CA | ASP | P | 228 | −10.647 | −12.323 | 62.128 | 1.00 | 43.82 | D000 C |
| ATOM | 8218 | C | ASP | P | 228 | −11.342 | −12.271 | 63.487 | 1.00 | 45.21 | D000 C |
| ATOM | 8219 | O | ASP | P | 228 | −12.534 | −12.577 | 63.606 | 1.00 | 44.16 | D000 O |
| ATOM | 8220 | CB | ASP | P | 228 | −11.127 | −11.167 | 61.243 | 1.00 | 38.78 | D000 C |
| ATOM | 8221 | CG | ASP | P | 228 | −10.940 | −9.817 | 61.909 | 1.00 | 49.28 | D000 C |
| ATOM | 8222 | OD1 | ASP | P | 228 | −9.775 | −9.419 | 62.162 | 1.00 | 54.97 | D000 O |
| ATOM | 8223 | OD2 | ASP | P | 228 | −11.958 | −9.175 | 62.242 | 1.00 | 50.80 | D000 O1− |
| ATOM | 8224 | N | TYR | P | 229 | −10.601 | −11.828 | 64.501 | 1.00 | 48.02 | D000 N |
| ATOM | 8225 | CA | TYR | P | 229 | −11.132 | −11.730 | 65.857 | 1.00 | 49.96 | D000 C |
| ATOM | 8226 | C | TYR | P | 229 | −11.979 | −10.481 | 66.041 | 1.00 | 49.04 | D000 C |
| ATOM | 8227 | O | TYR | P | 229 | −13.064 | −10.540 | 66.628 | 1.00 | 53.87 | D000 O |
| ATOM | 8228 | CB | TYR | P | 229 | −9.995 | −11.743 | 66.883 | 1.00 | 44.05 | D000 C |
| ATOM | 8229 | CG | TYR | P | 229 | −10.439 | −11.358 | 68.269 | 1.00 | 45.49 | D000 C |
| ATOM | 8230 | CD2 | TYR | P | 229 | −10.286 | −10.061 | 68.725 | 1.00 | 53.43 | D000 C |
| ATOM | 8231 | CD1 | TYR | P | 229 | −10.994 | −12.296 | 69.132 | 1.00 | 44.65 | D000 C |
| ATOM | 8232 | CE2 | TYR | P | 229 | −10.684 | −9.695 | 69.997 | 1.00 | 56.58 | D000 C |
| ATOM | 8233 | CE1 | TYR | P | 229 | −11.403 | −11.944 | 70.406 | 1.00 | 46.74 | D000 C |
| ATOM | 8234 | CZ | TYR | P | 229 | −11.243 | −10.638 | 70.838 | 1.00 | 52.93 | D000 C |
| ATOM | 8235 | OH | TYR | P | 229 | −11.634 | −10.250 | 72.104 | 1.00 | 43.44 | D000 O |
| ATOM | 8236 | N | GLU | P | 230 | −11.503 | −9.341 | 65.555 | 1.00 | 51.91 | D000 N |
| ATOM | 8237 | CA | GLU | P | 230 | −12.119 | −8.087 | 65.968 | 1.00 | 56.16 | D000 C |
| ATOM | 8238 | C | GLU | P | 230 | −13.560 | −7.995 | 65.476 | 1.00 | 54.64 | D000 C |
| ATOM | 8239 | O | GLU | P | 230 | −14.468 | −7.629 | 66.236 | 1.00 | 52.29 | D000 O |
| ATOM | 8240 | CB | GLU | P | 230 | −11.292 | −6.908 | 65.456 | 1.00 | 50.78 | D000 C |
| ATOM | 8241 | CG | GLU | P | 230 | −11.547 | −5.640 | 66.240 | 1.00 | 59.32 | D000 C |
| ATOM | 8242 | CD | GLU | P | 230 | −11.610 | −5.897 | 67.751 | 1.00 | 65.21 | D000 C |
| ATOM | 8243 | OE1 | GLU | P | 230 | −10.556 | −6.220 | 68.353 | 1.00 | 63.19 | D000 O |
| ATOM | 8244 | OE2 | GLU | P | 230 | −12.718 | −5.790 | 68.330 | 1.00 | 66.54 | D000 O1− |
| ATOM | 8245 | N | THR | P | 231 | −13.797 | −8.382 | 64.231 | 1.00 | 49.30 | D000 N |
| ATOM | 8246 | CA | THR | P | 231 | −15.125 | −8.335 | 63.651 | 1.00 | 49.06 | D000 C |
| ATOM | 8247 | C | THR | P | 231 | −15.943 | −9.595 | 63.913 | 1.00 | 48.66 | D000 C |
| ATOM | 8248 | O | THR | P | 231 | −17.084 | −9.685 | 63.450 | 1.00 | 46.72 | D000 O |
| ATOM | 8249 | CB | THR | P | 231 | −14.999 | −8.096 | 62.145 | 1.00 | 51.91 | D000 C |
| ATOM | 8250 | OG1 | THR | P | 231 | −14.418 | −9.247 | 61.519 | 1.00 | 49.55 | D000 O |
| ATOM | 8251 | CG2 | THR | P | 231 | −14.092 | −6.893 | 61.895 | 1.00 | 44.25 | D000 C |
| ATOM | 8252 | N | GLY | P | 232 | −15.374 | −10.596 | 64.593 | 1.00 | 53.28 | D000 N |
| ATOM | 8253 | CA | GLY | P | 232 | −16.057 | −11.861 | 64.770 | 1.00 | 51.71 | D000 C |
| ATOM | 8254 | C | GLY | P | 232 | −16.832 | −11.982 | 66.082 | 1.00 | 49.39 | D000 C |
| ATOM | 8255 | O | GLY | P | 232 | −16.750 | −11.136 | 66.974 | 1.00 | 45.77 | D000 O |
| ATOM | 8256 | N | PHE | P | 233 | −17.569 | −13.087 | 66.178 | 1.00 | 46.98 | D000 N |
| ATOM | 8257 | CA | PHE | P | 233 | −18.353 | −13.412 | 67.362 | 1.00 | 45.41 | D000 C |
| ATOM | 8258 | C | PHE | P | 233 | −17.477 | −13.478 | 68.610 | 1.00 | 43.09 | D000 C |
| ATOM | 8259 | O | PHE | P | 233 | −16.350 | −13.978 | 68.572 | 1.00 | 40.14 | D000 O |
| ATOM | 8260 | CB | PHE | P | 233 | −19.050 | −14.755 | 67.133 | 1.00 | 43.80 | D000 C |
| ATOM | 8261 | CG | PHE | P | 233 | −19.795 | −15.261 | 68.318 | 1.00 | 41.20 | D000 C |
| ATOM | 8262 | CD1 | PHE | P | 233 | −21.056 | −14.778 | 68.620 | 1.00 | 42.87 | D000 C |
| ATOM | 8263 | CD2 | PHE | P | 233 | −19.235 | −16.234 | 69.130 | 1.00 | 41.22 | D000 C |
| ATOM | 8264 | CE1 | PHE | P | 233 | −21.746 | −15.250 | 69.718 | 1.00 | 43.07 | D000 C |
| ATOM | 8265 | CE2 | PHE | P | 233 | −19.917 | −16.712 | 70.232 | 1.00 | 42.28 | D000 C |
| ATOM | 8266 | CZ | PHE | P | 233 | −21.179 | −16.221 | 70.526 | 1.00 | 42.72 | D000 C |
| ATOM | 8267 | N | LYS | P | 234 | −18.005 | −12.976 | 69.728 | 1.00 | 42.82 | D000 N |
| ATOM | 8268 | CA | LYS | P | 234 | −17.292 | −12.988 | 71.000 | 1.00 | 37.90 | D000 C |
| ATOM | 8269 | C | LYS | P | 234 | −18.268 | −13.294 | 72.133 | 1.00 | 41.60 | D000 C |
| ATOM | 8270 | O | LYS | P | 234 | −19.440 | −12.901 | 72.093 | 1.00 | 44.48 | D000 O |
| ATOM | 8271 | CB | LYS | P | 234 | −16.596 | −11.656 | 71.279 | 1.00 | 35.56 | D000 C |

TABLE 10.4-continued

| | | | | | | | | | | | |
|---|---|---|---|---|---|---|---|---|---|---|---|
| ATOM | 8272 | CG | LYS | P | 234 | −15.570 | −11.240 | 70.265 | 1.00 | 40.67 | D000 | C |
| ATOM | 8273 | CD | LYS | P | 234 | −14.974 | −9.900 | 70.655 | 1.00 | 45.48 | D000 | C |
| ATOM | 8274 | CE | LYS | P | 234 | −14.396 | −9.152 | 69.453 | 1.00 | 51.18 | D000 | C |
| ATOM | 8275 | NZ | LYS | P | 234 | −15.432 | −8.815 | 68.436 | 1.00 | 50.83 | D000 | N1+ |
| ATOM | 8276 | N | ASN | P | 235 | −17.770 | −13.978 | 73.161 | 1.00 | 41.60 | D000 | N |
| ATOM | 8277 | CA | ASN | P | 235 | −18.619 | −14.402 | 74.273 | 1.00 | 37.71 | D000 | C |
| ATOM | 8278 | C | ASN | P | 235 | −17.822 | −14.433 | 75.583 | 1.00 | 37.90 | D000 | C |
| ATOM | 8279 | O | ASN | P | 235 | −17.903 | −15.379 | 76.370 | 1.00 | 37.72 | D000 | O |
| ATOM | 8280 | CB | ASN | P | 235 | −19.249 | −15.757 | 73.947 | 1.00 | 35.17 | D000 | C |
| ATOM | 8281 | CG | ASN | P | 235 | −20.286 | −16.187 | 74.963 | 1.00 | 40.71 | D000 | C |
| ATOM | 8282 | OD1 | ASN | P | 235 | −20.393 | −17.373 | 75.280 | 1.00 | 40.09 | D000 | O |
| ATOM | 8283 | ND2 | ASN | P | 235 | −21.034 | −15.228 | 75.504 | 1.00 | 41.85 | D000 | N |
| ATOM | 8284 | N | TRP | P | 236 | −17.096 | −13.353 | 75.867 | 1.00 | 39.79 | D000 | N |
| ATOM | 8285 | CA | TRP | P | 236 | −16.261 | −13.296 | 77.062 | 1.00 | 46.37 | D000 | C |
| ATOM | 8286 | C | TRP | P | 236 | −17.096 | −13.235 | 78.337 | 1.00 | 41.70 | D000 | C |
| ATOM | 8287 | O | TRP | P | 236 | −18.198 | −12.687 | 78.359 | 1.00 | 49.28 | D000 | O |
| ATOM | 8288 | CB | TRP | P | 236 | −15.335 | −12.082 | 77.009 | 1.00 | 45.14 | D000 | C |
| ATOM | 8289 | CG | TRP | P | 236 | −14.278 | −12.168 | 75.954 | 1.00 | 47.98 | D000 | C |
| ATOM | 8290 | CD1 | TRP | P | 236 | −14.263 | −11.524 | 74.742 | 1.00 | 45.52 | D000 | C |
| ATOM | 8291 | CD2 | TRP | P | 236 | −13.076 | −12.948 | 76.010 | 1.00 | 46.16 | D000 | C |
| ATOM | 8292 | NE1 | TRP | P | 236 | −13.122 | −11.854 | 74.047 | 1.00 | 47.86 | D000 | N |
| ATOM | 8293 | CE2 | TRP | P | 236 | −12.377 | −12.728 | 74.800 | 1.00 | 48.95 | D000 | C |
| ATOM | 8294 | CE3 | TRP | P | 236 | −12.524 | −13.813 | 76.961 | 1.00 | 44.69 | D000 | C |
| ATOM | 8295 | CZ2 | TRP | P | 236 | −11.155 | −13.347 | 74.517 | 1.00 | 41.16 | D000 | C |
| ATOM | 8296 | CZ3 | TRP | P | 236 | −11.303 | −14.427 | 76.679 | 1.00 | 46.91 | D000 | C |
| ATOM | 8297 | CH2 | TRP | P | 236 | −10.630 | −14.180 | 75.469 | 1.00 | 44.61 | D000 | C |
| ATOM | 8298 | N | ARG | P | 237 | −16.554 | −13.787 | 79.415 | 1.00 | 41.38 | D000 | N |
| ATOM | 8299 | CA | ARG | P | 237 | −17.130 | −13.493 | 80.718 | 1.00 | 53.87 | D000 | C |
| ATOM | 8300 | C | ARG | P | 237 | −16.928 | −12.007 | 80.992 | 1.00 | 61.28 | D000 | C |
| ATOM | 8301 | O | ARG | P | 237 | −15.886 | −11.452 | 80.630 | 1.00 | 66.27 | D000 | O |
| ATOM | 8302 | CB | ARG | P | 237 | −16.478 | −14.322 | 81.833 | 1.00 | 53.42 | D000 | C |
| ATOM | 8303 | CG | ARG | P | 237 | −16.800 | −15.823 | 81.816 | 1.00 | 47.57 | D000 | C |
| ATOM | 8304 | CD | ARG | P | 237 | −18.062 | −16.175 | 82.614 | 1.00 | 51.09 | D000 | C |
| ATOM | 8305 | NE | ARG | P | 237 | −17.828 | −16.314 | 84.057 | 1.00 | 58.37 | D000 | N |
| ATOM | 8306 | CZ | ARG | P | 237 | −17.838 | −17.466 | 84.735 | 1.00 | 56.45 | D000 | C |
| ATOM | 8307 | NH1 | ARG | P | 237 | −18.083 | −18.621 | 84.123 | 1.00 | 48.82 | D000 | N1+ |
| ATOM | 8308 | NH2 | ARG | P | 237 | −17.612 | −17.462 | 86.046 | 1.00 | 63.83 | D000 | N |
| ATOM | 8309 | N | PRO | P | 238 | −17.893 | −11.331 | 81.605 | 1.00 | 62.76 | D000 | N |
| ATOM | 8310 | CA | PRO | P | 238 | −17.707 | −9.908 | 81.907 | 1.00 | 69.38 | D000 | C |
| ATOM | 8311 | C | PRO | P | 238 | −16.409 | −9.654 | 82.665 | 1.00 | 74.57 | D000 | C |
| ATOM | 8312 | O | PRO | P | 238 | −16.040 | −10.408 | 83.571 | 1.00 | 71.66 | D000 | O |
| ATOM | 8313 | CB | PRO | P | 238 | −18.942 | −9.573 | 82.746 | 1.00 | 64.98 | D000 | C |
| ATOM | 8314 | CG | PRO | P | 238 | −19.987 | −10.474 | 82.171 | 1.00 | 64.63 | D000 | C |
| ATOM | 8315 | CD | PRO | P | 238 | −19.285 | −11.760 | 81.814 | 1.00 | 57.83 | D000 | C |
| ATOM | 8316 | N | GLU | P | 239 | −15.705 | −8.593 | 82.248 | 1.00 | 76.88 | D000 | N |
| ATOM | 8317 | CA | GLU | P | 239 | −14.381 | −8.126 | 82.688 | 1.00 | 83.12 | D000 | C |
| ATOM | 8318 | C | GLU | P | 239 | −13.208 | −8.804 | 81.960 | 1.00 | 80.80 | D000 | C |
| ATOM | 8319 | O | GLU | P | 239 | −12.049 | −8.510 | 82.297 | 1.00 | 84.63 | D000 | O |
| ATOM | 8320 | CB | GLU | P | 239 | −14.170 | −8.253 | 84.207 | 1.00 | 83.81 | D000 | C |
| ATOM | 8321 | CG | GLU | P | 239 | −14.580 | −6.991 | 84.959 | 1.00 | 91.55 | D000 | C |
| ATOM | 8322 | CD | GLU | P | 239 | −13.794 | −6.763 | 86.239 | 1.00 | 97.32 | D000 | C |
| ATOM | 8323 | OE1 | GLU | P | 239 | −14.226 | −7.250 | 87.308 | 1.00 | 93.15 | D000 | O |
| ATOM | 8324 | OE2 | GLU | P | 239 | −12.745 | −6.086 | 86.172 | 1.00 | 96.55 | D000 | O1− |
| ATOM | 8325 | N | GLN | P | 240 | −13.452 | −9.674 | 80.980 | 1.00 | 74.55 | D000 | N |
| ATOM | 8326 | CA | GLN | P | 240 | −12.388 | −10.436 | 80.304 | 1.00 | 70.87 | D000 | C |
| ATOM | 8327 | C | GLN | P | 240 | −12.327 | −10.058 | 78.811 | 1.00 | 70.85 | D000 | C |
| ATOM | 8328 | O | GLN | P | 240 | −13.346 | −9.637 | 78.253 | 1.00 | 75.89 | D000 | O |
| ATOM | 8329 | CB | GLN | P | 240 | −12.619 | −11.949 | 80.462 | 1.00 | 68.58 | D000 | C |
| ATOM | 8330 | CG | GLN | P | 240 | −12.717 | −12.433 | 81.899 | 1.00 | 68.41 | D000 | C |
| ATOM | 8331 | CD | GLN | P | 240 | −11.414 | −12.251 | 82.660 | 1.00 | 75.96 | D000 | C |
| ATOM | 8332 | OE1 | GLN | P | 240 | −10.466 | −13.018 | 82.480 | 1.00 | 70.60 | D000 | O |
| ATOM | 8333 | NE2 | GLN | P | 240 | −11.359 | −11.226 | 83.518 | 1.00 | 77.27 | D000 | N |
| ATOM | 8334 | N | PRO | P | 241 | −11.147 | −10.193 | 78.150 | 1.00 | 69.18 | D000 | N |
| ATOM | 8335 | CA | PRO | P | 241 | −9.849 | −10.736 | 78.592 | 1.00 | 66.74 | D000 | C |
| ATOM | 8336 | C | PRO | P | 241 | −9.056 | −9.841 | 79.559 | 1.00 | 73.69 | D000 | C |
| ATOM | 8337 | O | PRO | P | 241 | −9.074 | −8.611 | 79.454 | 1.00 | 81.53 | D000 | O |
| ATOM | 8338 | CB | PRO | P | 241 | −9.088 | −10.907 | 77.273 | 1.00 | 58.34 | D000 | C |
| ATOM | 8339 | CG | PRO | P | 241 | −9.646 | −9.842 | 76.388 | 1.00 | 54.80 | D000 | C |
| ATOM | 8340 | CD | PRO | P | 241 | −11.106 | −9.787 | 76.727 | 1.00 | 57.51 | D000 | C |
| ATOM | 8341 | N | GLU | P | 253 | −1.712 | −15.376 | 81.188 | 1.00 | 57.88 | D000 | N |
| ATOM | 8342 | CA | GLU | P | 253 | −3.063 | −15.516 | 80.648 | 1.00 | 58.93 | D000 | C |
| ATOM | 8343 | C | GLU | P | 253 | −3.184 | −15.191 | 79.148 | 1.00 | 57.34 | D000 | C |
| ATOM | 8344 | O | GLU | P | 253 | −3.809 | −14.204 | 78.771 | 1.00 | 60.57 | D000 | O |
| ATOM | 8345 | CB | GLU | P | 253 | −4.028 | −14.606 | 81.410 | 1.00 | 67.05 | D000 | C |
| ATOM | 8346 | CG | GLU | P | 253 | −4.239 | −14.925 | 82.886 | 1.00 | 65.01 | D000 | C |
| ATOM | 8347 | CD | GLU | P | 253 | −4.871 | −13.746 | 83.619 | 1.00 | 78.11 | D000 | C |
| ATOM | 8348 | OE1 | GLU | P | 253 | −6.039 | −13.406 | 83.290 | 1.00 | 74.19 | D000 | O |
| ATOM | 8349 | OE2 | GLU | P | 253 | −4.210 | −13.174 | 84.525 | 1.00 | 80.72 | D000 | O1− |
| ATOM | 8350 | N | ASP | P | 254 | −2.582 | −16.015 | 78.297 | 1.00 | 59.04 | D000 | N |
| ATOM | 8351 | CA | ASP | P | 254 | −2.582 | −15.774 | 76.863 | 1.00 | 57.72 | D000 | C |

TABLE 10.4-continued

| | | | | | | | | | | | |
|---|---|---|---|---|---|---|---|---|---|---|---|
| ATOM | 8352 | C | ASP | P | 254 | −3.509 | −16.705 | 76.087 | 1.00 | 51.09 | D000 C |
| ATOM | 8353 | O | ASP | P | 254 | −3.528 | −16.640 | 74.857 | 1.00 | 48.82 | D000 O |
| ATOM | 8354 | CB | ASP | P | 254 | −1.159 | −15.911 | 76.296 | 1.00 | 61.92 | D000 C |
| ATOM | 8355 | CG | ASP | P | 254 | −0.161 | −14.973 | 76.935 | 1.00 | 62.66 | D000 C |
| ATOM | 8356 | OD1 | ASP | P | 254 | −0.567 | −13.960 | 77.547 | 1.00 | 61.96 | D000 O |
| ATOM | 8357 | OD2 | ASP | P | 254 | 1.048 | −15.281 | 76.834 | 1.00 | 65.49 | D000 O1− |
| ATOM | 8358 | N | CYS | P | 255 | −4.265 | −17.574 | 76.753 | 1.00 | 47.05 | D000 N |
| ATOM | 8359 | CA | CYS | P | 255 | −5.063 | −18.571 | 76.051 | 1.00 | 41.26 | D000 C |
| ATOM | 8360 | C | CYS | P | 255 | −6.488 | −18.590 | 76.580 | 1.00 | 38.11 | D000 C |
| ATOM | 8361 | O | CYS | P | 255 | −6.716 | −18.454 | 77.783 | 1.00 | 39.54 | D000 O |
| ATOM | 8362 | CB | CYS | P | 255 | −4.450 | −19.956 | 76.186 | 1.00 | 44.58 | D000 C |
| ATOM | 8363 | SG | CYS | P | 255 | −2.846 | −20.164 | 75.353 | 1.00 | 52.24 | D000 S |
| ATOM | 8364 | N | ALA | P | 256 | −7.440 | −18.776 | 75.674 | 1.00 | 36.50 | D000 N |
| ATOM | 8365 | CA | ALA | P | 256 | −8.857 | −18.645 | 75.980 | 1.00 | 35.39 | D000 C |
| ATOM | 8366 | C | ALA | P | 256 | −9.527 | −20.010 | 76.077 | 1.00 | 31.26 | D000 C |
| ATOM | 8367 | O | ALA | P | 256 | −9.240 | −20.914 | 75.281 | 1.00 | 30.62 | D000 O |
| ATOM | 8368 | CB | ALA | P | 256 | −9.555 | −17.793 | 74.921 | 1.00 | 38.76 | D000 C |
| ATOM | 8369 | N | HIS | P | 257 | −10.412 | −20.157 | 77.066 | 1.00 | 30.17 | D000 N |
| ATOM | 8370 | CA | HIS | P | 257 | −11.139 | −21.406 | 77.272 | 1.00 | 32.66 | D000 C |
| ATOM | 8371 | C | HIS | P | 257 | −12.600 | −21.131 | 77.611 | 1.00 | 33.59 | D000 C |
| ATOM | 8372 | O | HIS | P | 257 | −12.962 | −20.057 | 78.108 | 1.00 | 31.39 | D000 O |
| ATOM | 8373 | CB | HIS | P | 257 | −10.517 | −22.263 | 78.384 | 1.00 | 28.03 | D000 C |
| ATOM | 8374 | CG | HIS | P | 257 | −10.526 | −21.604 | 79.727 | 1.00 | 34.24 | D000 C |
| ATOM | 8375 | ND1 | HIS | P | 257 | −11.562 | −21.751 | 80.621 | 1.00 | 34.37 | D000 N |
| ATOM | 8376 | CD2 | HIS | P | 257 | −9.620 | −20.802 | 80.335 | 1.00 | 38.40 | D000 C |
| ATOM | 8377 | CE1 | HIS | P | 257 | −11.298 | −21.068 | 81.718 | 1.00 | 34.64 | D000 C |
| ATOM | 8378 | NE2 | HIS | P | 257 | −10.128 | −20.479 | 81.569 | 1.00 | 37.12 | D000 N |
| ATOM | 8379 | N | PHE | P | 258 | −13.444 | −22.124 | 77.309 | 1.00 | 33.23 | D000 N |
| ATOM | 8380 | CA | PHE | P | 258 | −14.808 | −22.141 | 77.823 | 1.00 | 32.25 | D000 C |
| ATOM | 8381 | C | PHE | P | 258 | −14.773 | −22.392 | 79.319 | 1.00 | 32.26 | D000 C |
| ATOM | 8382 | O | PHE | P | 258 | −13.956 | −23.171 | 79.811 | 1.00 | 29.18 | D000 O |
| ATOM | 8383 | CB | PHE | P | 258 | −15.652 | −23.232 | 77.153 | 1.00 | 30.58 | D000 C |
| ATOM | 8384 | CG | PHE | P | 258 | −15.651 | −23.174 | 75.659 | 1.00 | 27.36 | D000 C |
| ATOM | 8385 | CD1 | PHE | P | 258 | −16.550 | −22.394 | 74.987 | 1.00 | 28.97 | D000 C |
| ATOM | 8386 | CD2 | PHE | P | 258 | −14.738 | −23.912 | 74.931 | 1.00 | 28.24 | D000 C |
| ATOM | 8387 | CE1 | PHE | P | 258 | −16.541 | −22.343 | 73.614 | 1.00 | 34.71 | D000 C |
| ATOM | 8388 | CE2 | PHE | P | 258 | −14.723 | −23.869 | 73.566 | 1.00 | 30.59 | D000 C |
| ATOM | 8389 | CZ | PHE | P | 258 | −15.623 | −23.079 | 72.902 | 1.00 | 33.75 | D000 C |
| ATOM | 8390 | N | THR | P | 259 | −15.684 | −21.742 | 80.033 | 1.00 | 36.07 | D000 N |
| ATOM | 8391 | CA | THR | P | 259 | −15.852 | −21.887 | 81.471 | 1.00 | 37.54 | D000 C |
| ATOM | 8392 | C | THR | P | 259 | −17.106 | −22.709 | 81.741 | 1.00 | 38.73 | D000 C |
| ATOM | 8393 | O | THR | P | 259 | −17.882 | −23.018 | 80.828 | 1.00 | 40.70 | D000 O |
| ATOM | 8394 | CB | THR | P | 259 | −15.949 | −20.510 | 82.148 | 1.00 | 41.98 | D000 C |
| ATOM | 8395 | OG1 | THR | P | 259 | −17.200 | −19.888 | 81.813 | 1.00 | 41.80 | D000 O |
| ATOM | 8396 | CG2 | THR | P | 259 | −14.799 | −19.598 | 81.696 | 1.00 | 30.57 | D000 C |
| ATOM | 8397 | N | ASP | P | 260 | −17.342 | −23.006 | 83.020 | 1.00 | 37.73 | D000 N |
| ATOM | 8398 | CA | ASP | P | 260 | −18.446 | −23.894 | 83.380 | 1.00 | 37.79 | D000 C |
| ATOM | 8399 | C | ASP | P | 260 | −19.814 | −23.404 | 82.896 | 1.00 | 38.90 | D000 C |
| ATOM | 8400 | O | ASP | P | 260 | −20.758 | −24.201 | 82.869 | 1.00 | 41.70 | D000 O |
| ATOM | 8401 | CB | ASP | P | 260 | −18.483 | −24.128 | 84.901 | 1.00 | 35.64 | D000 C |
| ATOM | 8402 | CG | ASP | P | 260 | −18.619 | −22.834 | 85.712 | 1.00 | 42.82 | D000 C |
| ATOM | 8403 | OD1 | ASP | P | 260 | −18.241 | −21.740 | 85.225 | 1.00 | 48.13 | D000 O |
| ATOM | 8404 | OD2 | ASP | P | 260 | −19.161 | −22.907 | 86.836 | 1.00 | 44.48 | D000 O1− |
| ATOM | 8405 | N | ASP | P | 261 | −19.955 | −22.136 | 82.499 | 1.00 | 41.54 | D000 N |
| ATOM | 8406 | CA | ASP | P | 261 | −21.226 | −21.648 | 81.973 | 1.00 | 42.82 | D000 C |
| ATOM | 8407 | C | ASP | P | 261 | −21.155 | −21.336 | 80.487 | 1.00 | 41.84 | D000 C |
| ATOM | 8408 | O | ASP | P | 261 | −22.099 | −20.769 | 79.939 | 1.00 | 43.69 | D000 O |
| ATOM | 8409 | CB | ASP | P | 261 | −21.727 | −20.412 | 82.738 | 1.00 | 43.58 | D000 C |
| ATOM | 8410 | CG | ASP | P | 261 | −20.950 | −19.119 | 82.416 | 1.00 | 49.58 | D000 C |
| ATOM | 8411 | OD1 | ASP | P | 261 | −19.993 | −19.120 | 81.605 | 1.00 | 52.04 | D000 O |
| ATOM | 8412 | OD2 | ASP | P | 261 | −21.333 | −18.065 | 82.974 | 1.00 | 48.73 | D000 O1− |
| ATOM | 8413 | N | GLY | P | 262 | −20.046 | −21.659 | 79.826 | 1.00 | 41.79 | D000 N |
| ATOM | 8414 | CA | GLY | P | 262 | −19.923 | −21.469 | 78.406 | 1.00 | 35.80 | D000 C |
| ATOM | 8415 | C | GLY | P | 262 | −19.239 | −20.181 | 78.005 | 1.00 | 34.51 | D000 C |
| ATOM | 8416 | O | GLY | P | 262 | −18.649 | −20.125 | 76.926 | 1.00 | 35.57 | D000 O |
| ATOM | 8417 | N | ARG | P | 263 | −19.315 | −19.141 | 78.829 | 1.00 | 35.18 | D000 N |
| ATOM | 8418 | CA | ARG | P | 263 | −18.644 | −17.901 | 78.475 | 1.00 | 39.45 | D000 C |
| ATOM | 8419 | C | ARG | P | 263 | −17.120 | −18.052 | 78.581 | 1.00 | 36.67 | D000 C |
| ATOM | 8420 | O | ARG | P | 263 | −16.588 | −18.949 | 79.235 | 1.00 | 34.59 | D000 O |
| ATOM | 8421 | CB | ARG | P | 263 | −19.177 | −16.755 | 79.332 | 1.00 | 39.46 | D000 C |
| ATOM | 8422 | CG | ARG | P | 263 | −20.633 | −16.427 | 79.008 | 1.00 | 41.29 | D000 C |
| ATOM | 8423 | CD | ARG | P | 263 | −21.171 | −15.300 | 79.852 | 1.00 | 41.58 | D000 C |
| ATOM | 8424 | NE | ARG | P | 263 | −21.060 | −15.629 | 81.269 | 1.00 | 57.11 | D000 N |
| ATOM | 8425 | CZ | ARG | P | 263 | −21.316 | −14.794 | 82.274 | 1.00 | 54.20 | D000 C |
| ATOM | 8426 | NH1 | ARG | P | 263 | −21.702 | −13.543 | 82.039 | 1.00 | 46.67 | D000 N1+ |
| ATOM | 8427 | NH2 | ARG | P | 263 | −21.168 | −15.216 | 83.524 | 1.00 | 49.65 | D000 N |
| ATOM | 8428 | N | TRP | P | 264 | −16.414 | −17.184 | 77.879 | 1.00 | 39.86 | D000 N |
| ATOM | 8429 | CA | TRP | P | 264 | −14.984 | −17.349 | 77.652 | 1.00 | 38.07 | D000 C |
| ATOM | 8430 | C | TRP | P | 264 | −14.144 | −16.707 | 78.750 | 1.00 | 36.92 | D000 C |
| ATOM | 8431 | O | TRP | P | 264 | −14.565 | −15.769 | 79.434 | 1.00 | 38.51 | D000 O |

TABLE 10.4-continued

| | | | | | | | | | | | |
|---|---|---|---|---|---|---|---|---|---|---|---|
| ATOM | 8432 | CB | TRP | P | 264 | −14.596 | −16.743 | 76.311 | 1.00 | 36.59 | D000 | C |
| ATOM | 8433 | CG | TRP | P | 264 | −15.334 | −17.316 | 75.157 | 1.00 | 33.59 | D000 | C |
| ATOM | 8434 | CD1 | TRP | P | 264 | −16.124 | −18.422 | 75.156 | 1.00 | 28.12 | D000 | C |
| ATOM | 8435 | CD2 | TRP | P | 264 | −15.343 | −16.808 | 73.823 | 1.00 | 37.35 | D000 | C |
| ATOM | 8436 | NE1 | TRP | P | 264 | −16.627 | −18.635 | 73.909 | 1.00 | 31.66 | D000 | N |
| ATOM | 8437 | CE2 | TRP | P | 264 | −16.158 | −17.661 | 73.064 | 1.00 | 38.06 | D000 | C |
| ATOM | 8438 | CE3 | TRP | P | 264 | −14.736 | −15.714 | 73.194 | 1.00 | 34.20 | D000 | C |
| ATOM | 8439 | CZ2 | TRP | P | 264 | −16.384 | −17.455 | 71.697 | 1.00 | 36.24 | D000 | C |
| ATOM | 8440 | CZ3 | TRP | P | 264 | −14.966 | −15.510 | 71.854 | 1.00 | 34.62 | D000 | C |
| ATOM | 8441 | CH2 | TRP | P | 264 | −15.783 | −16.375 | 71.118 | 1.00 | 35.86 | D000 | C |
| ATOM | 8442 | N | ASN | P | 265 | −12.908 | −17.179 | 78.854 | 1.00 | 32.60 | D000 | N |
| ATOM | 8443 | CA | ASN | P | 265 | −11.991 | −16.649 | 79.844 | 1.00 | 35.02 | D000 | C |
| ATOM | 8444 | C | ASN | P | 265 | −10.562 | −16.955 | 79.416 | 1.00 | 35.40 | D000 | C |
| ATOM | 8445 | O | ASN | P | 265 | −10.303 | −17.966 | 78.762 | 1.00 | 34.37 | D000 | O |
| ATOM | 8446 | CB | ASN | P | 265 | −12.302 | −17.268 | 81.206 | 1.00 | 41.49 | D000 | C |
| ATOM | 8447 | CG | ASN | P | 265 | −11.391 | −16.785 | 82.295 | 1.00 | 45.67 | D000 | C |
| ATOM | 8448 | OD1 | ASN | P | 265 | −11.470 | −15.634 | 82.725 | 1.00 | 46.99 | D000 | O |
| ATOM | 8449 | ND2 | ASN | P | 265 | −10.486 | −17.660 | 82.730 | 1.00 | 42.25 | D000 | N |
| ATOM | 8450 | N | ASP | P | 266 | −9.635 | −16.081 | 79.804 | 1.00 | 41.02 | D000 | N |
| ATOM | 8451 | CA | ASP | P | 266 | −8.210 | −16.284 | 79.555 | 1.00 | 44.53 | D000 | C |
| ATOM | 8452 | C | ASP | P | 266 | −7.533 | −16.874 | 80.790 | 1.00 | 44.46 | D000 | C |
| ATOM | 8453 | O | ASP | P | 266 | −7.836 | −16.493 | 81.922 | 1.00 | 42.76 | D000 | O |
| ATOM | 8454 | CB | ASP | P | 266 | −7.513 | −14.977 | 79.143 | 1.00 | 48.13 | D000 | C |
| ATOM | 8455 | CG | ASP | P | 266 | −7.889 | −13.788 | 80.036 | 1.00 | 60.01 | D000 | C |
| ATOM | 8456 | OD1 | ASP | P | 266 | −9.096 | −13.510 | 80.179 | 1.00 | 60.58 | D000 | O |
| ATOM | 8457 | OD2 | ASP | P | 266 | −6.988 | −13.158 | 80.633 | 1.00 | 64.47 | D000 | O1− |
| ATOM | 8458 | N | ASP | P | 267 | −6.622 | −17.815 | 80.563 | 1.00 | 44.24 | D000 | N |
| ATOM | 8459 | CA | ASP | P | 267 | −5.909 | −18.469 | 81.647 | 1.00 | 42.61 | D000 | C |
| ATOM | 8460 | C | ASP | P | 267 | −4.508 | −18.821 | 81.152 | 1.00 | 44.14 | D000 | C |
| ATOM | 8461 | O | ASP | P | 267 | −4.233 | −18.787 | 79.952 | 1.00 | 41.89 | D000 | O |
| ATOM | 8462 | CB | ASP | P | 267 | −6.688 | −19.697 | 82.122 | 1.00 | 38.52 | D000 | C |
| ATOM | 8463 | CG | ASP | P | 267 | −6.223 | −20.188 | 83.464 | 1.00 | 45.95 | D000 | C |
| ATOM | 8464 | OD1 | ASP | P | 267 | −5.365 | −19.510 | 84.068 | 1.00 | 48.74 | D000 | O |
| ATOM | 8465 | OD2 | ASP | P | 267 | −6.710 | −21.244 | 83.919 | 1.00 | 43.95 | D000 | O1− |
| ATOM | 8466 | N | VAL | P | 268 | −3.612 | −19.180 | 82.076 | 1.00 | 47.41 | D000 | N |
| ATOM | 8467 | CA | VAL | P | 268 | −2.258 | −19.507 | 81.643 | 1.00 | 46.28 | D000 | C |
| ATOM | 8468 | C | VAL | P | 268 | −2.306 | −20.765 | 80.793 | 1.00 | 45.81 | D000 | C |
| ATOM | 8469 | O | VAL | P | 268 | −3.051 | −21.717 | 81.079 | 1.00 | 42.24 | D000 | O |
| ATOM | 8470 | CB | VAL | P | 268 | −1.274 | −19.643 | 82.822 | 1.00 | 45.28 | D000 | C |
| ATOM | 8471 | CG1 | VAL | P | 268 | −1.359 | −18.423 | 83.707 | 1.00 | 40.04 | D000 | C |
| ATOM | 8472 | CG2 | VAL | P | 268 | −1.489 | −20.937 | 83.609 | 1.00 | 40.72 | D000 | C |
| ATOM | 8473 | N | CYS | P | 269 | −1.525 | −20.756 | 79.717 | 1.00 | 45.30 | D000 | N |
| ATOM | 8474 | CA | CYS | P | 269 | −1.620 | −21.777 | 78.695 | 1.00 | 34.95 | D000 | C |
| ATOM | 8475 | C | CYS | P | 269 | −1.113 | −23.121 | 79.167 | 1.00 | 39.62 | D000 | C |
| ATOM | 8476 | O | CYS | P | 269 | −1.267 | −24.107 | 78.438 | 1.00 | 44.44 | D000 | O |
| ATOM | 8477 | CB | CYS | P | 269 | −0.849 | −21.317 | 77.456 | 1.00 | 47.03 | D000 | C |
| ATOM | 8478 | SG | CYS | P | 269 | −1.435 | −19.698 | 76.766 | 1.00 | 60.08 | D000 | S |
| ATOM | 8479 | N | GLN | P | 270 | −0.551 | −23.199 | 80.371 | 1.00 | 40.97 | D000 | N |
| ATOM | 8480 | CA | GLN | P | 270 | 0.007 | −24.461 | 80.837 | 1.00 | 39.29 | D000 | C |
| ATOM | 8481 | C | GLN | P | 270 | −1.038 | −25.378 | 81.448 | 1.00 | 33.15 | D000 | C |
| ATOM | 8482 | O | GLN | V | 270 | −0.769 | −26.577 | 81.579 | 1.00 | 30.99 | D000 | O |
| ATOM | 8483 | CB | GLN | P | 270 | 1.128 | −24.207 | 81.857 | 1.00 | 52.36 | D000 | C |
| ATOM | 8484 | CG | GLN | P | 270 | 2.531 | −23.978 | 81.256 | 1.00 | 68.27 | D000 | C |
| ATOM | 8485 | CD | GLN | P | 270 | 3.672 | −24.458 | 82.188 | 1.00 | 90.18 | D000 | C |
| ATOM | 8486 | OE1 | GLN | P | 270 | 3.426 | −25.009 | 83.272 | 1.00 | 96.23 | D000 | O |
| ATOM | 8487 | NE2 | GLN | P | 270 | 4.921 | −24.250 | 81.760 | 1.00 | 83.33 | D000 | N |
| ATOM | 8488 | N | ARG | P | 271 | −2.213 | −24.847 | 81.803 | 1.00 | 35.97 | D000 | N |
| ATOM | 8489 | CA | ARG | P | 271 | −3.258 | −25.641 | 82.453 | 1.00 | 35.38 | D000 | C |
| ATOM | 8490 | C | ARG | P | 271 | −3.614 | −26.831 | 81.577 | 1.00 | 34.50 | D000 | C |
| ATOM | 8491 | O | ARG | P | 271 | −3.835 | −26.657 | 80.369 | 1.00 | 35.09 | D000 | O |
| ATOM | 8492 | CB | ARG | P | 271 | −4.533 | −24.825 | 82.699 | 1.00 | 32.78 | D000 | C |
| ATOM | 8493 | CG | ARG | P | 271 | −4.404 | −23.700 | 83.663 | 1.00 | 35.79 | D000 | C |
| ATOM | 8494 | CD | ARG | P | 271 | −4.885 | −24.052 | 85.062 | 1.00 | 38.85 | D000 | C |
| ATOM | 8495 | NE | ARG | P | 271 | −4.351 | −23.079 | 86.026 | 1.00 | 53.17 | D000 | N |
| ATOM | 8496 | CZ | ARG | P | 271 | −3.487 | −23.363 | 87.009 | 1.00 | 57.60 | D000 | C |
| ATOM | 8497 | NH1 | ARG | P | 271 | −3.061 | −24.616 | 87.211 | 1.00 | 48.15 | D000 | N1+ |
| ATOM | 8498 | NH2 | ARG | P | 271 | −3.054 | −22.387 | 87.805 | 1.00 | 54.98 | D000 | N |
| ATOM | 8499 | N | PRO | P | 272 | −3.709 | −27.959 | 82.102 | 1.00 | 34.18 | D000 | N |
| ATOM | 8500 | CA | PRO | P | 272 | −4.104 | −29.152 | 81.304 | 1.00 | 30.39 | D000 | C |
| ATOM | 8501 | C | PRO | P | 272 | −5.617 | −29.326 | 81.191 | 1.00 | 30.82 | D000 | C |
| ATOM | 8502 | O | PRO | P | 272 | −6.222 | −30.227 | 81.774 | 1.00 | 30.88 | D000 | O |
| ATOM | 8503 | CB | PRO | P | 272 | −3.446 | −30.296 | 82.079 | 1.00 | 29.98 | D000 | C |
| ATOM | 8504 | CG | PRO | P | 272 | −3.279 | −29.776 | 83.527 | 1.00 | 33.19 | D000 | C |
| ATOM | 8505 | CD | PRO | P | 272 | −3.502 | −28.269 | 83.527 | 1.00 | 30.33 | D000 | C |
| ATOM | 8506 | N | TYR | P | 273 | −6.260 | −28.438 | 80.435 | 1.00 | 29.69 | D000 | N |
| ATOM | 8507 | CA | TYR | P | 273 | −7.685 | −28.556 | 80.183 | 1.00 | 26.06 | D000 | C |
| ATOM | 8508 | C | TYR | P | 273 | −7.957 | −29.510 | 79.021 | 1.00 | 31.32 | D000 | C |
| ATOM | 8509 | O | TYR | P | 273 | −7.075 | −29.834 | 78.220 | 1.00 | 34.09 | D000 | O |
| ATOM | 8510 | CB | TYR | P | 273 | −8.289 | −27.199 | 79.848 | 1.00 | 29.36 | D000 | C |
| ATOM | 8511 | CG | TYR | P | 273 | −8.313 | −26.189 | 80.968 | 1.00 | 31.45 | D000 | C |

TABLE 10.4-continued

| | | | | | | | | | | |
|---|---|---|---|---|---|---|---|---|---|---|
| ATOM | 8512 | CD1 | TYR | P | 273 | −8.404 | −26.586 | 82.310 | 1.00 | 29.10 | D000 | C |
| ATOM | 8513 | CD2 | TYR | P | 273 | −8.243 | −24.832 | 80.685 | 1.00 | 26.14 | D000 | C |
| ATOM | 8514 | CE1 | TYR | P | 273 | −8.422 | −25.650 | 83.325 | 1.00 | 23.99 | D000 | C |
| ATOM | 8515 | CE2 | TYR | P | 273 | −8.275 | −23.900 | 81.688 | 1.00 | 30.08 | D000 | C |
| ATOM | 8516 | CZ | TYR | P | 273 | −8.364 | −24.312 | 83.001 | 1.00 | 27.73 | D000 | C |
| ATOM | 8517 | OH | TYR | P | 273 | −8.380 | −23.357 | 83.973 | 1.00 | 30.77 | D000 | O |
| ATOM | 8518 | N | ARG | P | 274 | −9.208 | −29.949 | 78.931 | 1.00 | 28.38 | D000 | N |
| ATOM | 8519 | CA | ARG | P | 274 | −9.699 | −30.608 | 77.733 | 1.00 | 26.38 | D000 | C |
| ATOM | 8520 | C | ARG | P | 274 | −9.755 | −29.604 | 76.570 | 1.00 | 28.97 | D000 | C |
| ATOM | 8521 | O | ARG | P | 274 | −9.693 | −28.383 | 76.762 | 1.00 | 29.05 | D000 | O |
| ATOM | 8522 | CB | ARG | P | 274 | −11.090 | −31.183 | 78.003 | 1.00 | 26.93 | D000 | C |
| ATOM | 8523 | CG | ARG | P | 274 | −11.108 | −32.298 | 78.990 | 1.00 | 27.16 | D000 | C |
| ATOM | 8524 | CD | ARG | P | 274 | −12.512 | −32.728 | 79.284 | 1.00 | 29.23 | D000 | C |
| ATOM | 8525 | NE | ARG | P | 274 | −12.531 | −33.815 | 80.262 | 1.00 | 31.79 | D000 | N |
| ATOM | 8526 | CZ | ARG | P | 274 | −13.610 | −34.234 | 80.917 | 1.00 | 28.61 | D000 | C |
| ATOM | 8527 | NH1 | ARG | P | 274 | −14.801 | −33.662 | 80.721 | 1.00 | 27.83 | D000 | N1+ |
| ATOM | 8528 | NH2 | ARG | P | 274 | −13.495 | −35.241 | 81.767 | 1.00 | 30.68 | D000 | N |
| ATOM | 8529 | N | TRP | P | 275 | −9.894 | −30.113 | 75.345 | 1.00 | 23.49 | D000 | N |
| ATOM | 8530 | CA | TRP | P | 275 | −9.938 | −29.226 | 74.188 | 1.00 | 25.18 | D000 | C |
| ATOM | 8531 | C | TRP | P | 275 | −10.855 | −29.837 | 73.136 | 1.00 | 28.35 | D000 | C |
| ATOM | 8532 | O | TRP | P | 275 | −11.240 | −31.009 | 73.214 | 1.00 | 27.63 | D000 | O |
| ATOM | 8533 | CB | TRP | P | 275 | −8.524 | −28.953 | 73.614 | 1.00 | 26.97 | D000 | C |
| ATOM | 8534 | CG | TRP | P | 275 | −7.949 | −30.164 | 72.960 | 1.00 | 26.87 | D000 | C |
| ATOM | 8535 | CD1 | TRP | P | 275 | −7.973 | −30.473 | 71.628 | 1.00 | 25.57 | D000 | C |
| ATOM | 8536 | CD2 | TRP | P | 275 | −7.346 | −31.284 | 73.625 | 1.00 | 26.80 | D000 | C |
| ATOM | 8537 | NE1 | TRP | P | 275 | −7.403 | −31.713 | 71.419 | 1.00 | 26.56 | D000 | N |
| ATOM | 8538 | CE2 | TRP | P | 275 | −7.008 | −32.230 | 72.626 | 1.00 | 28.11 | D000 | C |
| ATOM | 8539 | CE3 | TRP | P | 275 | −7.044 | −31.573 | 74.966 | 1.00 | 24.47 | D000 | C |
| ATOM | 8540 | CZ2 | TRP | P | 275 | −6.388 | −33.439 | 72.926 | 1.00 | 26.32 | D000 | C |
| ATOM | 8541 | CZ3 | TRP | P | 275 | −6.439 | −32.772 | 75.265 | 1.00 | 25.01 | D000 | C |
| ATOM | 8542 | CH2 | TRP | P | 275 | −6.114 | −33.692 | 74.250 | 1.00 | 29.39 | D000 | C |
| ATOM | 8543 | N | VAL | P | 276 | −11.186 | −29.023 | 72.135 | 1.00 | 27.49 | D000 | N |
| ATOM | 8544 | CA | VAL | P | 276 | −12.064 | −29.405 | 71.039 | 1.00 | 29.28 | D000 | C |
| ATOM | 8545 | C | VAL | P | 276 | −11.347 | −29.157 | 69.720 | 1.00 | 32.15 | D000 | C |
| ATOM | 8546 | O | VAL | P | 276 | −11.010 | −28.009 | 69.399 | 1.00 | 30.70 | D000 | O |
| ATOM | 8547 | CB | VAL | P | 276 | −13.381 | −28.615 | 71.076 | 1.00 | 32.24 | D000 | C |
| ATOM | 8548 | CG1 | VAL | P | 276 | −14.255 | −28.997 | 69.881 | 1.00 | 28.45 | D000 | C |
| ATOM | 8549 | CG2 | VAL | P | 276 | −14.099 | −28.838 | 72.418 | 1.00 | 27.44 | D000 | C |
| ATOM | 8550 | N | CYS | P | 277 | −11.188 | −30.212 | 68.926 | 1.00 | 31.02 | D000 | N |
| ATOM | 8551 | CA | CYS | P | 277 | −10.688 | −30.089 | 67.560 | 1.00 | 33.70 | D000 | C |
| ATOM | 8552 | C | CYS | P | 277 | −11.856 | −29.883 | 66.594 | 1.00 | 36.60 | D000 | C |
| ATOM | 8553 | O | CYS | P | 277 | −12.924 | −30.476 | 66.769 | 1.00 | 35.91 | D000 | O |
| ATOM | 8554 | CB | CYS | P | 277 | −9.893 | −31.339 | 67.158 | 1.00 | 33.14 | D000 | C |
| ATOM | 8555 | SG | CYS | P | 277 | −8.261 | −31.627 | 67.947 | 1.00 | 35.59 | D000 | S |
| ATOM | 8556 | N | GLU | P | 278 | −11.644 | −29.037 | 65.572 | 1.00 | 36.89 | D000 | N |
| ATOM | 8557 | CA | GLU | P | 278 | −12.627 | −28.753 | 64.525 | 1.00 | 39.14 | D000 | C |
| ATOM | 8558 | C | GLU | P | 278 | −11.998 | −28.940 | 63.144 | 1.00 | 44.48 | D000 | C |
| ATOM | 8559 | O | GLU | P | 278 | −10.812 | −28.657 | 62.944 | 1.00 | 39.34 | D000 | O |
| ATOM | 8560 | CB | GLU | P | 278 | −13.201 | −27.309 | 64.639 | 1.00 | 33.16 | D000 | C |
| ATOM | 8561 | CG | GLU | P | 278 | −14.353 | −26.998 | 63.675 | 1.00 | 36.59 | D000 | C |
| ATOM | 8562 | CD | GLU | P | 278 | −14.820 | −25.530 | 63.719 | 1.00 | 44.66 | D000 | C |
| ATOM | 8563 | OE1 | GLU | P | 278 | −14.202 | −24.714 | 64.445 | 1.00 | 39.06 | D000 | O |
| ATOM | 8564 | OE2 | GLU | P | 278 | −15.829 | −25.200 | 63.049 | 1.00 | 41.28 | D000 | O1− |
| ATOM | 8565 | N | THR | P | 279 | −12.790 | −29.443 | 62.197 | 1.00 | 50.44 | D000 | N |
| ATOM | 8566 | CA | THR | P | 279 | −12.402 | −29.459 | 60.790 | 1.00 | 53.12 | D000 | C |
| ATOM | 8567 | C | THR | P | 279 | −13.617 | −29.195 | 59.898 | 1.00 | 49.51 | D000 | C |
| ATOM | 8568 | O | THR | P | 279 | −14.703 | −29.717 | 60.154 | 1.00 | 53.00 | D000 | O |
| ATOM | 8569 | CB | THR | P | 279 | −11.717 | −30.798 | 60.436 | 1.00 | 45.79 | D000 | C |
| ATOM | 8570 | OG1 | THR | P | 279 | −11.049 | −30.673 | 59.179 | 1.00 | 51.68 | D000 | O |
| ATOM | 8571 | CG2 | THR | P | 279 | −12.709 | −31.937 | 60.373 | 1.00 | 41.88 | D000 | C |
| ATOM | 8572 | N | GLU | P | 280 | −13.431 | −28.398 | 58.839 | 1.00 | 54.11 | D000 | N |
| ATOM | 8573 | CA | GLU | P | 280 | −14.518 | −28.026 | 57.929 | 1.00 | 55.44 | D000 | C |
| ATOM | 8574 | C | GLU | P | 280 | −14.664 | −29.061 | 56.808 | 1.00 | 60.78 | D000 | C |
| ATOM | 8575 | O | GLU | P | 280 | −13.673 | −29.610 | 56.323 | 1.00 | 66.29 | D000 | O |
| ATOM | 8576 | CB | GLU | P | 280 | −14.275 | −26.632 | 57.350 | 1.00 | 58.37 | D000 | C |
| ATOM | 8577 | CG | GLU | P | 280 | −14.341 | −25.476 | 58.376 | 1.00 | 56.42 | D000 | C |
| ATOM | 8578 | CD | GLU | P | 280 | −13.124 | −25.396 | 59.315 | 1.00 | 59.60 | D000 | C |
| ATOM | 8579 | OE1 | GLU | P | 280 | −12.166 | −26.179 | 59.134 | 1.00 | 63.77 | D000 | O |
| ATOM | 8580 | OE2 | GLU | P | 280 | −13.129 | −24.553 | 60.247 | 1.00 | 61.91 | D000 | O1− |
| ATOM | 8581 | N | LEU | P | 281 | −15.911 | −29.308 | 56.389 | 1.00 | 64.56 | D000 | N |
| ATOM | 8582 | CA | LEU | P | 281 | −16.292 | −30.535 | 55.682 | 1.00 | 69.60 | D000 | C |
| ATOM | 8583 | C | LEU | P | 281 | −16.310 | −30.448 | 54.149 | 1.00 | 73.85 | D000 | C |
| ATOM | 8584 | O | LEU | P | 281 | −16.945 | −31.306 | 53.521 | 1.00 | 77.45 | D000 | O |
| ATOM | 8585 | CB | LEU | P | 281 | −17.662 | −31.015 | 56.164 | 1.00 | 60.03 | D000 | C |
| ATOM | 8586 | CG | LEU | P | 281 | −17.690 | −32.374 | 56.863 | 1.00 | 56.08 | D000 | C |
| ATOM | 8587 | CD1 | LEU | P | 281 | −19.116 | −32.776 | 57.171 | 1.00 | 66.41 | D000 | C |
| ATOM | 8588 | CD2 | LEU | P | 281 | −17.006 | −33.448 | 56.066 | 1.00 | 58.00 | D000 | C |
| ATOM | 8589 | N | ASP | P | 282 | −15.668 | −29.445 | 53.538 | 1.00 | 74.94 | D000 | N |
| ATOM | 8590 | CA | ASP | P | 282 | −15.590 | −29.289 | 52.056 | 1.00 | 74.61 | D000 | C |
| ATOM | 8591 | C | ASP | P | 282 | −16.879 | −28.715 | 51.457 | 1.00 | 69.05 | D000 | C |

TABLE 10.4-continued

| | | | | | | | | | | | |
|---|---|---|---|---|---|---|---|---|---|---|---|
| ATOM | 8592 | O | ASP | P | 282 | −17.285 | −27.589 | 51.750 | 1.00 | 68.03 | D000 O |
| ATOM | 8593 | CB | ASP | P | 282 | −15.291 | −30.618 | 51.327 | 1.00 | 75.72 | D000 C |
| ATOM | 8594 | CG | ASP | P | 282 | −13.973 | −31.262 | 51.748 | 1.00 | 83.45 | D000 C |
| ATOM | 8595 | OD2 | ASP | P | 282 | −14.017 | −32.153 | 52.639 | 1.00 | 81.11 | D000 O |
| ATOM | 8596 | OD1 | ASP | P | 282 | −12.912 | −30.910 | 51.169 | 1.00 | 76.47 | D000 O1− |
| TER | | | | | | | | | | | |
| HETATM | 8597 | CA | CA | E | 1 | −46.046 | −40.018 | 63.255 | 1.00 | 40.77 | Ca |
| HETATM | 8598 | CA | CA | E | 2 | −15.968 | −22.911 | 63.354 | 1.00 | 43.19 | Ca |
| TER | | | | | | | | | | | |

TABLE 15

Antibody Constant Regions

| Designation | SEQ ID NO: | CL Domain Amino Acid Sequence |
|---|---|---|
| CL-1 | 32681 | GQPKANPTVTLFPPSSEELQANKATLVCLISDFYPGAVTVAWKADGSP VKAGVETTKPSKQSNNKYAASSYLSLTPEQWKSHRSYSCQVTHEGSTV EKTVAPTECS |
| CL-2 | 32682 | GQPKAAPSVTLFPPSSEELQANKATLVCLISDFYPGAVTVAWKADSSPV KAGVETTTPSKQSNNKYAASSYLSLTPEQWKSHRSYSCQVTHEGSTVEK TVAPTECS |
| CL-2.1 | 32683 | QPKAAPSVTLFPPSSEELQANKATLVCLISDFYPGAVTVAWKADSSPVK AGVETTTPSKQSNNKYAASSYLSLTPEQWKSHRSYSCQVTHEGSTVEKT VAPTECS |
| CL-3 | 32684 | GQPKAAPSVTLFPPSSEELQANKATLVCLISDFYPGAVTVAWKADSSPV KAGVETTTPSKQSNNKYAASSYLSLTPEQWKSHRSYSCQVTHEGSTVEK TVAPTECS |
| CL-7 | 32685 | GQPKAAPSVTLFPPSSEELQANKATLVCLVSDFYPGAVTVAWKADGSP VKVGVETTKPSKQSNNKYAASSYLSLTPEQWKSHRSYSCRVTHEGSTVE KTVAPAECS |
| Human kappa v1 | 32686 | TVAAPSVFIFPPSDEQLKSGTASVVCLLNNFYPREAKVQWKVDNALQS GNSQESVTEQDSKDSTYSLSSTLTLSKADYEKHKVYACEVTHQGLSSPVT KSFNRGEC |
| Human kappa v2 | 32687 | RTVAAPSVFIFPPSDEQLKSGTASVVCLLNNFYPREAKVQWKVDNALQ SGNSQESVTEQDSKDSTYSLSSTLTLSKADYEKHKVYACEVTHQGLSSPV TKSFNRGEC |

| Ig isotype | SEQ ID NO: | Heavy Chain Constant Region Amino Acid Sequence |
|---|---|---|
| Human IgG1z | 32688 | ASTKGPSVFPLAPSSKSTSGGTAALGCLVKDYFPEPVTVSWNSGALTSGV HTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVS HEDPEVKFNWYVDGVEVHNAKTKPREEQYNSTYRVVSVLTVLHQDWL NGKEYKCKVSNKALPAPIEKTISKAKGQPREPQVYTLPPSREEMTKNQVS LTCLVKGFYPSDIAVEWESNGQPENNYKTTPPVLDSDGSFFLYSKLTVDK SRWQQGNVFSCSVMHEALHNHYTQKSLSLSPGK |
| Human IgG1za | 32689 | ASTKGPSVFPLAPSSKSTSGGTAALGCLVKDYFPEPVTVSWNSGALTSGV HTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVS HEDPEVKFNWYVDGVEVHNAKTKPREEQYNSTYRVVSVLTVLHQDWL NGKEYKCKVSNKALPAPIEKTISKAKGQPREPQVYTLPPSRDELTKNQVSL TCLVKGFYPSDIAVEWESNGQPENNYKTTPPVLDSDGSFFLYSKLTVDKS RWQQGNVFSCSVMHEALHNHYTQKSLSLSPGK |
| Human IgG1f | 32690 | ASTKGPSVFPLAPSSKSTSGGTAALGCLVKDYFPEPVTVSWNSGALTSGV HTFPAVLQSSGLYSLSSVVTVPSSSLGTQTYICNVNHKPSNTKVDKRVEP KSCDKTHTCPPCPAPELLGGPSVFLFPPKPKDTLMISRTPEVTCVVVDVS HEDPEVKFNWYVDGVEVHNAKTKPREEQYNSTYRVVSVLTVLHQDWL NGKEYKCKVSNKALPAPIEKTISKAKGQPREPQVYTLPPSREEMTKNQVS LTCLVKGFYPSDIAVEWESNGQPENNYKTTPPVLDSDGSFFLYSKLTVDK SRWQQGNVFSCSVMHEALHNHYTQKSLSLSPGK |
| Human IgG1fa | 32691 | ASTKGPSVFPLAPSSKSTSGGTAALGCLVKDYFPEPVTVSWNSGALTSGV HTFPAVLQSSGLYSLSSVVTVPSSSLGTQTYICNVNHKPSNTKVDKRVEP KSCDKTHTCPPCPAPELLGGPSVFLFPPKPKDTLMISRTPEVTCVVVDVS HEDPEVKFNWYVDGVEVHNAKTKPREEQYNSTYRVVSVLTVLHQDWL NGKEYKCKVSNKALPAPIEKTISKAKGQPREPQVYTLPPSRDELTKNQVSL |

TABLE 15-continued

Antibody Constant Regions

| | | |
|---|---|---|
| | | TCLVKGFYPSDIAVEWESNGQPENNYKTTPPVLDSDGSFFLYSKLTVDKS<br>RWQQGNVFSCSVMHEALHNHYTQKSLSLSPGK |
| Human IgG2 | 32692 | ASTKGPSVFPLAPCSRSTSESTAALGCLVKDYFPEPVTVSWNSGALTSGV<br>HTFPAVLQSSGLYSLSSVVTVPSSNFGTQTYTCNVDHKPSNTKVDKTVER<br>KCCVECPPCPAPPVAGPSVFLFPPKPKDTLMISRTPEVTCVVVDVSHEDP<br>EVQFNWYVDGVEVHNAKTKPREEQFNSTFRVVSVLTVVHQDWLNGKE<br>YKCKVSNKGLPAPIEKTISKTKGQPREPQVYTLPPSREEMTKNQVSLTCLV<br>KGFYPSDIAVEWESNGQPENNYKTTPPMLDSDGSFFLYSKLTVDKSRW<br>QQGNVFSCSVMHEALHNHYTQKSLSLSPGK |
| Human IgG4 | 32693 | ASTKGPSVFPLAPCSRSTSESTAALGCLVKDYFPEPVTVSWNSGALTSGV<br>HTFPAVLQSSGLYSLSSVVTVPSSSLGTKTYTCNVDHKPSNTKVDKRVES<br>KYGPPCPSCPAPEFLGGPSVFLFPPKPKDTLMISRTPEVTCVVVDVSQED<br>PEVQFNWYVDGVEVHNAKTKPREEQFNSTYRVVSVLTVLHQDWLNGK<br>EYKCKVSNKGLPSSIEKTISKAKGQPREPQVYTLPPSQEEMTKNQVSLTCL<br>VKGFYPSDIAVEWESNGQPENNYKTTPPVLDSDGSFFLYSRLTVDKSRW<br>QEGNVFSCSVMHEALHNHYTQKSLSLSLGK |
| Human<br>IgG1-SEFL2 | 32694 | ASTKGPSVFPLAPSSKSTSGGTAALGCLVKDYFPEPVTVSWNSGALTSGV<br>HTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVS<br>HEDPEVKFNWYVDGVEVHNAKTKPCEEQYGSTYRCVSVLTVLHQDWL<br>NGKEYKCKVSNKALPAPIEKTISKAKGQPREPQVYTLPPSREEMTKNQVS<br>LTCLVKGFYPSDIAVEWESNGQPENNYKTTPPVLDSDGSFFLYSKLTVDK<br>SRWQQGNVFSCSVMHEALHNHYTQKSLSLSPGK |

Each reference cited herein is hereby incorporated by reference in its entirety for all that it teaches and for all purposes.

The present invention is not to be limited in scope by the specific embodiments described herein, which are intended as single illustrations of individual embodiments of the invention, and functionally equivalent methods and components are invention. Indeed, various modifications of the invention, in addition to those shown and described herein will become apparent to those skilled in the art from the foregoing description and accompanying drawings. Such modifications are intended to fall within the scope of the appended claims.

SEQUENCE LISTING (50759 sequences)

SEQ ID NO: 1 - protein, 284 aa, Mus sp.
MTKDYQDFQHLDNDNDHHQLRRGPPPTPRLLQRLCSGSRLLLLSSSLSILLLVVVCVITSQNSQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPYRWVCETKLDKAN

SEQ ID NO: 2 - protein, 301 aa, Mus sp.
MEKDCQDIQQLDSEENDHQLSGDDEHGSHVQDPRIENPHWKGQPLSRPFPQRLCSTFRLSLLALAFNILLLVVICVVSSQSIQLQEEFRTLKETFSNFSSSTLMEFGALDTLGGSTNAILTSWLAQLEEKQQQLKADHSTLLFHLKHFPMDLRTLTCQLAYFQSNGTECCPVNWVEFGGSCYWFSRDGLTWAEADQYCQLENAHLLVINSREEQDFVVKHRSQFHIWIGLTDRDGSWKWVDGTDYRSNYRNWAFTQPDNWQGHEQGGGEDCAEILSDGHWNDNFCQQVNRWVCEKRRNITH

SEQ ID NO: 3 - protein, 222 aa, Mus sp.
SQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPYRWVCETKLDKAN

SEQ ID NO: 4 - protein, 132 aa, Mus sp.
CPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPYRWVCETKLDKAN

SEQ ID NO: 5 - protein, 291 aa, Homo sapiens
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 6 - protein, 287 aa, Homo sapiens
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 7 - protein, 228 aa, Homo sapiens
SQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 8 - protein, 138 aa, Homo sapiens
CPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 9 - protein, 227 aa, Homo sapiens
QSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 10 - protein, 135 aa, Homo sapiens
CPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 11 - protein, 129 aa, Homo sapiens
MCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETEL

SEQ ID NO: 12 - protein, 145 aa, Homo sapiens
MGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 13 - protein, 146 aa, Homo sapiens
MAGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 14 - protein, 130 aa, Homo sapiens
MACPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETEL

SEQ ID NO: 15 - protein, 96 aa, Homo sapiens
MAGSQNSQLQEELRGLRETFSNFTASTEAQVKGLSTQGGNVGRKMKSLESQLEKQQKDLSEDHSSLLLHVKQFVSDLRSLSCQMAALQGNGSERTC

SEQ ID NO: 16 - protein, 234 aa, Homo sapiens
MAGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 17 - protein, 94 aa, Homo sapiens
MAQNSQLQEELRGLRETFSNFTASTEAQVKGLSTQGGNVGRKMKSLESQLEKQQKDLSEDHSSLLLHVKQFVSDLRSLSCQMAALQGNGSERTC

SEQ ID NO: 18 - protein, 98 aa, Homo sapiens
MAVIGSQNSQLQEELRGLRETFSNFTASTEAQVKGLSTQGGNVGRKMKSLESQLEKQQKDLSEDHSSLLLHVKQFVSDLRSLSCQMAALQGNGSERTC

SEQ ID NO: 19 - protein, 88 aa, Homo sapiens
MAVIGSQNSQLQEELRGLRETFSNFTASTEAQVKGLSTQGGNVGRKMKSLESQLEKQQKDLSEDHSSLLLHVKQFVSDLRSLSCQMAA

SEQ ID NO: 20 - protein, 84 aa, Homo sapiens
MAQNSQLQEELRGLRETFSNFTASTEAQVKGLSTQGGNVGRKMKSLESQLEKQQKDLSEDHSSLLLHVKQFVSDLRSLSCQMAA

SEQ ID NO: 21 - protein, 86 aa, Homo sapiens
MAGSQNSQLQEELRGLRETFSNFTASTEAQVKGLSTQGGNVGRKMKSLESQLEKQQKDLSEDHSSLLLHVKQFVSDLRSLSCQMAA

SEQ ID NO: 22 - protein, 225 aa, Homo sapiens
MAGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELD

SEQ ID NO: 23 - protein, 232 aa, Homo sapiens
MAQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 24 - protein, 233 aa, Homo sapiens
MASQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 25 - protein, 236 aa, Homo sapiens
MAVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 26 - protein, 231 aa, Homo sapiens
MANSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 27 - protein, 231 aa, Homo sapiens
MAGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 28 - protein, 233 aa, Homo sapiens
MAVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 29 - protein, 230 aa, Homo sapiens
MASQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 30 - protein, 229 aa, Homo sapiens
MAQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 31 - protein, 228 aa, Homo sapiens
MASAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 32 - protein, 475 aa, Artificial Sequence
  Description of Artificial Sequence: Synthetic polypeptide
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLLGSMDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTALSGNPVPILIPCHRVVQGDLDVGGYEGGLAVKEWLLAHEGHRLGKPGLG

SEQ ID NO: 33 - protein, 490 aa, Artificial Sequence
  Description of Artificial Sequence: Synthetic polypeptide
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLLGSGGGGSGGGGSGGGGSMDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTALSGNPVPILIPCHRVVQGDLDVGGYEGGLAVKEWLLAHEGHRLGKPGLG

SEQ ID NO: 34 - protein, 475 aa, Artificial Sequence
  Description of Artificial Sequence: Synthetic polypeptide
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLLGSMDKDCEMKRTTLDSPLGKLELSGCEQGLHRIIFLGKGTSAADAVEVPAPAAVLGGPEPLIQATAWLNAYFHQPEAIEEFPVPALHHPVFQQESFTRQVLWKLLKVVKFGEVISESHLAALVGNPAATAAVNTALDGNPVPILIPCHRVVQGDSDVGPYLGGLAVKEWLLAHEGHRLGKPGLG

SEQ ID NO: 35 - protein, 490 aa, Artificial Sequence
  Description of Artificial Sequence: Synthetic polypeptide
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLLGSGGGGSGGGGSGGGGSMDKDCEMKRTTLDSPLGKLELSGCEQGLHRIIFLGKGTSAADAVEVPAPAAVLGGPEPLIQATAWLNAYFHQPEAIEEFPVPALHHPVFQQESFTRQVLWKLLKVVKFGEVISESHLAALVGNPAATAAVNTALDGNPVPILIPCHRVVQGDSDVGPYLGGLAVKEWLLAHEGHRLGKPGLG

SEQ ID NO: 36 - protein, 471 aa, Artificial Sequence
  Description of Artificial Sequence: Synthetic polypeptide
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSMDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTALSGNPVPILIPCHRVVQGDLDVGGYEGGLAVKEWLLAHEGHRLGKPGLG

SEQ ID NO: 37 - protein, 486 aa, Artificial Sequence
  Description of Artificial Sequence: Synthetic polypeptide
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSGGGGSGGGGSGGGGSMDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTALSGNPVPILIPCHRVVQGDLDVGGYEGGLAVKEWLLAHEGHRLGKPGLG

SEQ ID NO: 38 - protein, 471 aa, Artificial Sequence
  Description of Artificial Sequence: Synthetic polypeptide
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSMDKDCEMKRTTLDSPLGKLELSGCEQGLHRIIFLGKGTSAADAVEVPAPAAVLGGPEPLIQATAWLNAYFHQPEAIEEFPVPALHHPVFQQESFTRQVLWKLLKVVKFGEVISESHLAALVGNPAATAAVNTALDGNPVPILIPCHRVVQGDSDVGPYLGGLAVKEWLLAHEGHRLGKPGLG

SEQ ID NO: 39 - protein, 486 aa, Artificial Sequence
  Description of Artificial Sequence: Synthetic polypeptide
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSGGGGSGGGGSGGGGSMDKDCEMKRTTLDSPLGKLELSGCEQGLHRIIFLGKGTSAADAVEVPAPAAVLGGPEPLIQATAWLNAYFHQPEAIEEFPVPALHHPVFQQESFTRQVLWKLLKVVKFGEVISESHLAALVGNPAATAAVNTALDGNPVPILIPCHRVVQGDSDVGPYLGGLAVKEWLLAHEGHRLGKPGLG

SEQ ID NO: 40 - protein, 490 aa, Artificial Sequence
  Description of Artificial Sequence: Synthetic polypeptide
MAKDFQDIQQLSSEENDHPFHQGEGPGTRRLNPRRGNPFLKGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSMDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTALSGNPVPILIPCHRVVQGDLDVGGYEGGLAVKEWLLAHEGHRLGKPGLG

SEQ ID NO: 41 - protein, 505 aa, Artificial Sequence
  Description of Artificial Sequence: Synthetic polypeptide
MAKDFQDIQQLSSEENDHPFHQGEGPGTRRLNPRRGNPFLKGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSGGGGSGGGGSGGGGSMDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTALSGNPVPILIPCHRVVQGDLDVGGYEGGLAVKEWLLAHEGHRLGKPGLG

SEQ ID NO: 42 - protein, 490 aa, Artificial Sequence
  Description of Artificial Sequence: Synthetic polypeptide
MAKDFQDIQQLSSEENDHPFHQGEGPGTRRLNPRRGNPFLKGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSMDKDCEMKRTTLDSPLGKLELSGCEQGLHRIIFLGKGTSAADAVEVPAPAAVLGGPEPLIQATAWLNAYFHQPEAIEEFPVPALHHPVFQQESFTRQVLWKLLKVVKFGEVISESHLAALVGNPAATAAVNTALDGNPVPILIPCHRVVQGDSDVGPYLGGLAVKEWLLAHEGHRLGKPGLG

SEQ ID NO: 43 - protein, 505 aa, Artificial Sequence
  Description of Artificial Sequence: Synthetic polypeptide
MAKDFQDIQQLSSEENDHPFHQGEGPGTRRLNPRRGNPFLKGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSGGGGSGGGGSGGGGSMDKDCEMKRTTLDSPLGKLELSGCEQGLHRIIFLGKGTSAADAVEVPAPAAVLGGPEPLIQATAWLNAYFHQPEAIEEFPVPALHHPVFQQESFTRQVLWKLLKVVKFGEVISESHLAALVGNPAATAAVNTALDGNPVPILIPCHRVVQGDSDVGPYLGGLAVKEWLLAHEGHRLGKPGLG

SEQ ID NO: 44 - protein, 291 aa, Homo sapiens; identical to SEQ ID NO: 5

SEQ ID NO: 45 - protein, 291 aa, Homo sapiens
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPCRWVCETELDKASQEPPLL

SEQ ID NO: 46 - protein, 299 aa, Artificial Sequence
  Description of Artificial Sequence: Synthetic polypeptide
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLLDYKDDDDK

SEQ ID NO: 47 - protein, 299 aa, Artificial Sequence
  Description of Artificial Sequence: Synthetic polypeptide
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPCRWVCETELDKASQEPPLLDYKDDDDK

SEQ ID NO: 48 - protein, 291 aa, Macaca fascicularis
MTKEYQDLQHLDNEESDHHQLGKGPPPPQSLLRRLCSGPRLLLLSLGLSLLLLVVVCVIGSQNAQLQRELRGLRETLSNFTASTEAQVKGLSTQGGNVGRKMKSLESQLEKQQKDLSEDHSSLLLHVKQFVSDLRSLSCQMAALQGNGSERACCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 49 - protein, 291 aa, Macaca fascicularis
MTKEYQDLQHLDNEESDHHQLGKGPPPPQSLLRRLCSGPRLLLLSLGLSLLLLVVVCVIGSQNAQLQRELRGLRETLSNFTASTEAQVKGLSTQGGNVGRKMKSLESQLEKQQKDLSEDHSSLLLHVKQFVSDLRSLSCQMAALQGNGSERACCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPCRWVCETELDKASQEPPLL

SEQ ID NO: 50 - protein, 299 aa, Artificial Sequence
  Description of Artificial Sequence: Synthetic polypeptide
MTKEYQDLQHLDNEESDHHQLGKGPPPPQSLLRRLCSGPRLLLLSLGLSLLLLVVVCVIGSQNAQLQRELRGLRETLSNFTASTEAQVKGLSTQGGNVGRKMKSLESQLEKQQKDLSEDHSSLLLHVKQFVSDLRSLSCQMAALQGNGSERACCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLLDYKDDDDK

SEQ ID NO: 51 - protein, 299 aa, Artificial Sequence
  Description of Artificial Sequence: Synthetic polypeptide
MTKEYQDLQHLDNEESDHHQLGKGPPPPQSLLRRLCSGPRLLLLSLGLSLLLLVVVCVIGSQNAQLQRELRGLRETLSNFTASTEAQVKGLSTQGGNVGRKMKSLESQLEKQQKDLSEDHSSLLLHVKQFVSDLRSLSCQMAALQGNGSERACCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPCRWVCETELDKASQEPPLLDYKDDDDK

SEQ ID NO: 52 - protein, 284 aa, Mus sp.; identical to SEQ ID NO: 1

SEQ ID NO: 53 - protein, 284 aa, Mus sp.
MTKDYQDFQHLDNDNDHHQLRRGPPPTPRLLQRLCSGSRLLLLSSSLSILLLVVVCVITSQNSQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPCRWVCETKLDKAN

SEQ ID NO: 54 - protein, 284 aa, Rattus sp.
MTKDYQDFQHLDNENDHHQLQRGPPPAPRLLQRLCSGFRLFLLSLGLSILLLVVVCVITSQNSQLREDLRVLRQNFSNFTVSTEDQVKALTTQGERVGRKMKLVESQLEKHQEDLREDHSRLLLHVKQLVSDVRSLSCQMAALRGNGSERICCPINWVEYEGSCYWFSSSVKPWTEADKYCQLENAHLVVVTSWEEQRFVQQHMGPLNTWIGLTDQNGPWKWVDGTDYETGFKNWRPGQPDDWYGHGLGGGEDCAHFTTDGHWNDDVCRRPYRWVCETELGKAN

SEQ ID NO: 55 - protein, 284 aa, Rattus sp.
MTKDYQDFQHLDNENDHHQLQRGPPPAPRLLQRLCSGFRLFLLSLGLSILLLVVVCVITSQNSQLREDLRVLRQNFSNFTVSTEDQVKALTTQGERVGRKMKLVESQLEKHQEDLREDHSRLLLHVKQLVSDVRSLSCQMAALRGNGSERICCPINWVEYEGSCYWFSSSVKPWTEADKYCQLENAHLVVVTSWEEQRFVQQHMGPLNTWIGLTDQNGPWKWVDGTDYETGFKNWRPGQPDDWYGHGLGGGEDCAHFTTDGHWNDDVCRRPCRWVCETELGKAN

SEQ ID NO: 56 - protein, 292 aa, Artificial Sequence
  Description of Artificial Sequence: Synthetic polypeptide
MTKDYQDFQHLDNDNDHHQLRRGPPPTPRLLQRLCSGSRLLLLSSSLSILLLVVVCVITSQNSQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPYRWVCETKLDKANDYKDDDDK

SEQ ID NO: 57 - protein, 292 aa, Artificial Sequence
  Description of Artificial Sequence: Synthetic polypeptide
MTKDYQDFQHLDNDNDHHQLRRGPPPTPRLLQRLCSGSRLLLLSSSLSILLLVVVCVITSQNSQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPCRWVCETKLDKANDYKDDDDK

SEQ ID NO: 58 - protein, 292 aa, Artificial Sequence
  Description of Artificial Sequence: Synthetic polypeptide
MTKDYQDFQHLDNENDHHQLQRGPPPAPRLLQRLCSGFRLFLLSLGLSILLLVVVCVITSQNSQLREDLRVLRQNFSNFTVSTEDQVKALTTQGERVGRKMKLVESQLEKHQEDLREDHSRLLLHVKQLVSDVRSLSCQMAALRGNGSERICCPINWVEYEGSCYWFSSSVKPWTEADKYCQLENAHLVVVTSWEEQRFVQQHMGPLNTWIGLTDQNGPWKWVDGTDYETGFKNWRPGQPDDWYGHGLGGGEDCAHFTTDGHWNDDVCRRPYRWVCETELGKANDYKDDDDK

SEQ ID NO: 59 - protein, 292 aa, Artificial Sequence
  Description of Artificial Sequence: Synthetic polypeptide
MTKDYQDFQHLDNENDHHQLQRGPPPAPRLLQRLCSGFRLFLLSLGLSILLLVVVCVITSQNSQLREDLRVLRQNFSNFTVSTEDQVKALTTQGERVGRKMKLVESQLEKHQEDLREDHSRLLLHVKQLVSDVRSLSCQMAALRGNGSERICCPINWVEYEGSCYWFSSSVKPWTEADKYCQLENAHLVVVTSWEEQRFVQQHMGPLNTWIGLTDQNGPWKWVDGTDYETGFKNWRPGQPDDWYGHGLGGGEDCAHFTTDGHWNDDVCRRPCRWVCETELGKANDYKDDDDK

SEQ ID NO: 60 - protein, 287 aa, Homo sapiens; identical to SEQ ID NO: 6

SEQ ID NO: 61 - protein, 301 aa, Mus sp.; identical to SEQ ID NO: 2

SEQ ID NO: 62 - protein, 301 aa, Rattus sp.
MEKDFQDIQQLDSEENDHQLIGDEEQGSHVQNLRTENPRWGGQPPSRPFPQRLCSKFRLSLLALAFNILLLVVICVVSSQSMQLQKEFWTLKETLSNFSTTTLMEFKALDSHGGSRNDNLTSWETILEKKQKDIKADHSTLLFHLKHFPLDLRTLTCQLAFFLSNGTECCPVNWVEFGGSCYWFSRDGLTWAEADQYCQMENAHLLVINSREEQEFVVKHRGAFHIWIGLTDKDGSWKWVDGTEYRSNFKNWAFTQPDNWQGHEEGGSEDCAEILSDGLWNDNFCQQVNRWACERKRDITY

SEQ ID NO: 63 - protein, 293 aa, Artificial Sequence
  Description of Artificial Sequence: Synthetic polypeptide
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAHHHHHH

SEQ ID NO: 64 - protein, 307 aa, Artificial Sequence
  Description of Artificial Sequence: Synthetic polypeptide
MEKDCQDIQQLDSEENDHQLSGDDEHGSHVQDPRIENPHWKGQPLSRPFPQRLCSTFRLSLLALAFNILLLVVICVVSSQSIQLQEEFRTLKETFSNFSSSTLMEFGALDTLGGSTNAILTSWLAQLEEKQQQLKADHSTLLFHLKHFPMDLRTLTCQLAYFQSNGTECCPVNWVEFGGSCYWFSRDGLTWAEADQYCQLENAHLLVINSREEQDFVVKHRSQFHIWIGLTDRDGSWKWVDGTDYRSNYRNWAFTQPDNWQGHEQGGGEDCAEILSDGHWNDNFCQQVNRWVCEKRRNITHHHHHHH

SEQ ID NO: 65 - protein, 307 aa, Artificial Sequence
  Description of Artificial Sequence: Synthetic polypeptide
MEKDFQDIQQLDSEENDHQLIGDEEQGSHVQNLRTENPRWGGQPPSRPFPQRLCSKFRLSLLALAFNILLLVVICVVSSQSMQLQKEFWTLKETLSNFSTTTLMEFKALDSHGGSRNDNLTSWETILEKKQKDIKADHSTLLFHLKHFPLDLRTLTCQLAFFLSNGTECCPVNWVEFGGSCYWFSRDGLTWAEADQYCQMENAHLLVINSREEQEFVVKHRGAFHIWIGLTDKDGSWKWVDGTEYRSNFKNWAFTQPDNWQGHEEGGSEDCAEILSDGLWNDNFCQQVNRWACERKRDITYHHHHHH

SEQ ID NO: 66 - protein, 308 aa, Artificial Sequence
  Description of Artificial Sequence: Synthetic polypeptide
MAKDCQDIQQLDSEDSDQQLGRGEGPGPRGHGPRREDRFCRRLPPHQPLLLQRLCSGYRLNLLVLGFNVLMLVAICVIGSQRAQLEEELRILKENFSHFSSGVLMELGVLLSDGGGASSQLTSLEAKLEKQQRDVKADHATLLLHLKHFPSDLRILTCQVAFFQSNGTDCCPVNWLEYEGSCYWFSRSGKTWEEAEKYCQLESAHLVVVNSREEQKFILQHTNPFDTWIGLTDSDGSWRWVDGTDYQQSYKNWAATQPDDWQGHEVGGGEDCAEVRANGRWNDNFCKQVQRWVCEMRRNVTGHHHHHH

SEQ ID NO: 67 - protein, 302 aa, Canis lupus familiaris
MAKDCQDIQQLDSEDSDQQLGRGEGPGPRGHGPRREDRFCRRLPPHQPLLLQRLCSGYRLNLLVLGFNVLMLVAICVIGSQRAQLEEELRILKENFSHFSSGVLMELGVLLSDGGGASSQLTSLEAKLEKQQRDVKADHATLLLHLKHFPSDLRILTCQVAFFQSNGTDCCPVNWLEYEGSCYWFSRSGKTWEEAEKYCQLESAHLVVVNSREEQKFILQHTNPFDTWIGLTDSDGSWRWVDGTDYQQSYKNWAATQPDDWQGHEVGGGEDCAEVRANGRWNDNFCKQVQRWVCEMRRNVTG

SEQ ID NO: 68 - protein, 306 aa, Macaca fascicularis
MAKDFQDIQQLSSEENDHPFHRGEGPGPRGLNLRRGNPSLKGPPPAQPLAQRLCSMVRFSLLALSFNILLLVAICVIGSQSAQLQAELWSLKEAFSNFSSSTLMEVHALGTHGGSVGDKITSLGDKLEKQQQDLKADHDILLLHLKHFPVDLRFVACQMELLHSNGSQRTCCPVNWVEHQGSCYWFSRSGKAWAEAEKYCQLENSHLVVINSWEEQKFIVQHTNLFNTWIGLTDSDGSWKWVDGTDYRHNYKNWAVTQPDDWHGHELGGSEDCVEVRPDGRWNDDFCLQVHRWVCEKRRNATGEAA

SEQ ID NO: 69 - protein, 312 aa, Artificial Sequence
  Description of Artificial Sequence: Synthetic polypeptide
MAKDFQDIQQLSSEENDHPFHRGEGPGPRGLNLRRGNPSLKGPPPAQPLAQRLCSMVRFSLLALSFNILLLVAICVIGSQSAQLQAELWSLKEAFSNFSSSTLMEVHALGTHGGSVGDKITSLGDKLEKQQQDLKADHDILLLHLKHFPVDLRFVACQMELLHSNGSQRTCCPVNWVEHQGSCYWFSRSGKAWAEAEKYCQLENSHLVVINSWEEQKFIVQHTNPFNTWIGLTDSDGSWKWVDGTDYRHNYKNWAVTQPDDWHGHELGGSEDCVEVRPDGRWNDDFCLQVHRWVCEKRRNATGEAAHHHHHH

SEQ ID NO: 70 - protein, 289 aa, Artificial Sequence
  Description of Artificial Sequence: Synthetic polypeptide
MARDFQDIQQLDSEENDHQLGRGTPLPQPLVLQRLCSKLRLSLLVLGFNVLMLVAVCVVGSQRTQLQMELQTLKETFSNFSSSLLMEMLTLSTRGGSAGDKVTSLEAKMEKQQQDLKADHATLRLHLKHFPRDVRTLTCRLVFLQSNGTECCPVNWVDYEGSCYWFSRSGKAWAEAEKYCQLENAHLVVINSREEQKFIAQRTNPFQTWIGLTDSDGSWKWVDGTDYGNGYKNWGALQPDDWQGHELGGSEDCVEIQGDGRWNDDFCQQVKRWVCEMKQNITMHHHHHH

SEQ ID NO: 71 - protein, 306 aa, Macaca fascicularis
MAKDFQDIQQLSSEENDHPFHRGEGPGPRGLNLRRGNPSLKGPPPAQPLAQRLCSMVRFSLLALSFNILLLVAICVIGSQSAQLQAELWSLKEAFSNFSSSTLMEVHALGTHGGSVGDKITSLGDKLEKQQQDLKADHDILLLHLKHFPVDLRFVACQMELLHSNGSQRTCCPVNWVEHQGSCYWFSRSGKAWAEAEKYCQLENSHLVVINSWEEQKFIVQHTNPFNTWIGLTDSDGSWKWVDGTDYRHNYKNWAVTQPDDWHGHELGGSEDCVEVRPDGRWNDDFCLQVHRWVCEKRRNATGEAA

SEQ ID NO: 72 - protein, 283 aa, Sus sp.
MARDFQDIQQLDSEENDHQLGRGTPLPQPLVLQRLCSKLRLSLLVLGFNVLMLVAVCVVGSQRTQLQMELQTLKETFSNFSSSLLMEMLTLSTRGGSAGDKVTSLEAKMEKQQQDLKADHATLRLHLKHFPRDVRTLTCRLVFLQSNGTECCPVNWVDYEGSCYWFSRSGKAWAEAEKYCQLENAHLVVINSREEQKFIAQRTNPFQTWIGLTDSDGSWKWVDGTDYGNGYKNWGALQPDDWQGHELGGSEDCVEIQGDGRWNDDFCQQVKRWVCEMKQNITM

SEQ ID NO: 73 - protein, 284 aa, Canis lupus familiaris
MTNDYQDLQHLDNEDNDHHLRQVPPAPQPLLRRLCSGPCLLLLSLGLSVLLLVVVCVIGSQNSKLRGELQALRETFSNFTASTEVEVKALSSQGGNVGRKMKSLESQLEKQQKDLSEDHSDLLLHVKQFVSDLRSLSCQIAALHGNGSTLTCCPVNWLEYEGSCYWFSRSGKSWPEADKYCQLESAHLVVVNSREEQKFIQHHMGPVNTWMGLTDQSGPWKWVDGTDYETGFKNWRPEQPDDWYGHGLGGGEDCAHFTDDGRWNDDVCQRPYRWVCEAARDPAT

SEQ ID NO: 74 - protein, 286 aa, Sus sp.
MTKEYQDLQHLDNEENDQQHRKGPPPQPSLLRRLCSGPCLLLISMGLSLLLLVVVCVIGSQNSKLQEELQALRETFSNLTASTDAKVKTLSMQGGNVGRKMKSLESQLEKQQQDLSEDHSSLLLHVKQFVSDLRSLSCQMAVLQGNGSERTCCPVNWVGYEGSCYWFSRSGKPWPEAEKYCQLENAHLVVVGSWEEQKFIQHHVGPVNSWIGLTDQSGPWKWVDGTDYESGFKNWRPEQPDDWYGHGLGGGEDCAHFTEDGGWNDDICQRPYRWVCETQRDRDSGS

SEQ ID NO: 75 - protein, 292 aa, Artificial Sequence
  Description of Artificial Sequence: Synthetic polypeptide
MTNDYQDLQHLDNEDNDHHLRQVPPAPQPLLRRLCSGPCLLLLSLGLSVLLLVVVCVIGSQNSKLRGELQALRETFSNFTASTEVEVKALSSQGGNVGRKMKSLESQLEKQQKDLSEDHSDLLLHVKQFVSDLRSLSCQIAALHGNGSTLTCCPVNWLEYEGSCYWFSRSGKSWPEADKYCQLESAHLVVVNSREEQKFIQHHMGPVNTWMGLTDQSGPWKWVDGTDYETGFKNWRPEQPDDWYGHGLGGGEDCAHFTDDGRWNDDVCQRPYRWVCEAARDPATDYKDDDDK

SEQ ID NO: 76 - protein, 294 aa, Artificial Sequence
  Description of Artificial Sequence: Synthetic polypeptide
MTKEYQDLQHLDNEENDQQHRKGPPPQPSLLRRLCSGPCLLLISMGLSLLLLVVVCVIGSQNSKLQEELQALRETFSNLTASTDAKVKTLSMQGGNVGRKMKSLESQLEKQQQDLSEDHSSLLLHVKQFVSDLRSLSCQMAVLQGNGSERTCCPVNWVGYEGSCYWFSRSGKPWPEAEKYCQLENAHLVVVGSWEEQKFIQHHVGPVNSWIGLTDQSGPWKWVDGTDYESGFKNWRPEQPDDWYGHGLGGGEDCAHFTEDGGWNDDICQRPYRWVCETQRDRDSGSDYKDDDDK

SEQ ID NO: 77 - protein, 94 aa, Homo sapiens
MTKEYQDLQHLDNEESDHHQLRKGPPPPQPLLQRLCSGPRLLLLSLGLSLLLLVVVCVIGSQNSQLQEELRGLRETFSNFTASTEAQEAMWEER

SEQ ID NO: 78 - protein, 105 aa, Artificial Sequence
  Description of Artificial Sequence: Synthetic polypeptide
MTKEYQDLQHLDNEESDHHQLRKGPPPPQPLLQRLCSGPRLLLLSLGLSLLLLVVVCVIGSQNSQLQEELRGLRETFSNFTASTEAQEAMWEERGQQKLISEEDL

SEQ ID NO: 79 - DNA, 33 bp, Artificial Sequence
  Description of Artificial Sequence: Synthetic oligonucleotide
cgggcaagtcggagcgttagcagatatttaaat

SEQ ID NO: 80 - protein, 11 aa, Artificial Sequence
  Description of Artificial Sequence: Synthetic peptide
RASRSVSRYLN

SEQ ID NO: 81 - DNA, 51 bp, Artificial Sequence
  Description of Artificial Sequence: Synthetic oligonucleotide
aagtccagccagagtcttttaaagagctccaacaataagagctacttagct

SEQ ID NO: 82 - protein, 17 aa, Artificial Sequence
  Description of Artificial Sequence: Synthetic peptide
KSSQSLLKSSNNKSYLA

SEQ ID NO: 83 - DNA, 51 bp, Artificial Sequence
  Description of Artificial Sequence: Synthetic oligonucleotide
aagtccagccagagtgttttattcagctccaacaattataactacttagct

SEQ ID NO: 84 - protein, 17 aa, Artificial Sequence
  Description of Artificial Sequence: Synthetic peptide
KSSQSVLFSSNNYNYLA

SEQ ID NO: 85 - DNA, 48 bp, Artificial Sequence
  Description of Artificial Sequence: Synthetic oligonucleotide
aagtctagtcagagcctcctgcgtagtgatggaaagacccatttgtat

SEQ ID NO: 86 - protein, 16 aa, Artificial Sequence
  Description of Artificial Sequence: Synthetic peptide
KSSQSLLRSDGKTHLY

SEQ ID NO: 87 - DNA, 33 bp, Artificial Sequence
  Description of Artificial Sequence: Synthetic oligonucleotide
ccggcgagtcagggcattagcaattatttagct

SEQ ID NO: 88 - protein, 11 aa, Artificial Sequence
  Description of Artificial Sequence: Synthetic peptide
PASQGISNYLA

SEQ ID NO: 89 - DNA, 33 bp, Artificial Sequence
  Description of Artificial Sequence: Synthetic oligonucleotide
tctggagataaattgggtaataaatatgtttgt

SEQ ID NO: 90 - protein, 11 aa, Artificial Sequence
  Description of Artificial Sequence: Synthetic peptide
SGDKLGNKYVC

SEQ ID NO: 91 - DNA, 33 bp, Artificial Sequence
  Description of Artificial Sequence: Synthetic oligonucleotide
cgggggggtcagggtattagcacatggttagca

SEQ ID NO: 92 - protein, 11 aa, Artificial Sequence
  Description of Artificial Sequence: Synthetic peptide
RGGQGISTWLA

SEQ ID NO: 93 - DNA, 33 bp, Artificial Sequence
  Description of Artificial Sequence: Synthetic oligonucleotide
cggacaagtcagggcattagaaatgatttaggc

SEQ ID NO: 94 - protein, 11 aa, Artificial Sequence
  Description of Artificial Sequence: Synthetic peptide
RTSQGIRNDLG

SEQ ID NO: 95 - DNA, 33 bp, Artificial Sequence
  Description of Artificial Sequence: Synthetic oligonucleotide
cgggcgagtcagggtattagcaaatggttagcc

SEQ ID NO: 96 - protein, 11 aa, Artificial Sequence
  Description of Artificial Sequence: Synthetic peptide
RASQGISKWLA

SEQ ID NO: 97 - DNA, 33 bp, Artificial Sequence
  Description of Artificial Sequence: Synthetic oligonucleotide
cgggcgagtcagggtattagcaagtggttagcc

SEQ ID NO: 98 - protein, 11 aa, Artificial Sequence
  Description of Artificial Sequence: Synthetic peptide
RASQGISKWLA

SEQ ID NO: 99 - DNA, 36 bp, Artificial Sequence
  Description of Artificial Sequence: Synthetic oligonucleotide
agggccagtcagagtgttaacagcaactacttagcc

SEQ ID NO: 100 - protein, 12 aa, Artificial Sequence
  Description of Artificial Sequence: Synthetic peptide
RASQSVNSNYLA

SEQ ID NO: 101 - DNA, 33 bp, Artificial Sequence
  Description of Artificial Sequence: Synthetic oligonucleotide
cgggcaagtcgagacattagaaatgatttaggc

SEQ ID NO: 102 - protein, 11 aa, Artificial Sequence
  Description of Artificial Sequence: Synthetic peptide
RASRDIRNDLG

SEQ ID NO: 103 - DNA, 48 bp, Artificial Sequence
  Description of Artificial Sequence: Synthetic oligonucleotide
aagtctagtcagagcctcctgcatagtgaaggaaagacctatttgtat

SEQ ID NO: 104 - protein, 16 aa, Artificial Sequence
  Description of Artificial Sequence: Synthetic peptide
KSSQSLLHSEGKTYLY

SEQ ID NO: 105 - DNA, 33 bp, Artificial Sequence
  Description of Artificial Sequence: Synthetic oligonucleotide
cgggcgagtcagggcattagcaattatttagcc

SEQ ID NO: 106 - protein, 11 aa, Artificial Sequence
  Description of Artificial Sequence: Synthetic peptide
RASQGISNYLA

SEQ ID NO: 107 - DNA, 48 bp, Artificial Sequence
  Description of Artificial Sequence: Synthetic oligonucleotide
aagtctagtcagcgcctcctgcatggtgatggaaagacctatttgtat

SEQ ID NO: 108 - protein, 16 aa, Artificial Sequence
  Description of Artificial Sequence: Synthetic peptide
KSSQRLLHGDGKTYLY

SEQ ID NO: 109 - DNA, 33 bp, Artificial Sequence
  Description of Artificial Sequence: Synthetic oligonucleotide
cgggcaagtcagggcattagaaatgatttaggc

SEQ ID NO: 110 - protein, 11 aa, Artificial Sequence
  Description of Artificial Sequence: Synthetic peptide
RASQGIRNDLG

SEQ ID NO: 111 - DNA, 33 bp, Artificial Sequence; identical to SEQ ID NO: 109
  Description of Artificial Sequence: Synthetic oligonucleotide

SEQ ID NO: 112 - protein, 11 aa, Artificial Sequence
  Description of Artificial Sequence: Synthetic peptide
RASQGIRNDLG

SEQ ID NO: 113 - DNA, 33 bp, Artificial Sequence
  Description of Artificial Sequence: Synthetic oligonucleotide
cgggcaagtcagggcattagacatgatttaggc

SEQ ID NO: 114 - protein, 11 aa, Artificial Sequence
  Description of Artificial Sequence: Synthetic peptide
RASQGIRHDLG

SEQ ID NO: 115 - DNA, 33 bp, Artificial Sequence
  Description of Artificial Sequence: Synthetic oligonucleotide
agggccagtcagactgttaacagcaacttagcc

SEQ ID NO: 116 - protein, 11 aa, Artificial Sequence
  Description of Artificial Sequence: Synthetic peptide
RASQTVNSNLA

SEQ ID NO: 117 - DNA, 33 bp, Artificial Sequence
  Description of Artificial Sequence: Synthetic oligonucleotide
aggaccagtcagagtgtttggattagcgtagcc

SEQ ID NO: 118 - protein, 11 aa, Artificial Sequence
  Description of Artificial Sequence: Synthetic peptide
RTSQSVWISVA

SEQ ID NO: 119 - DNA, 33 bp, Artificial Sequence
  Description of Artificial Sequence: Synthetic oligonucleotide
cgggcaagtcaggacattagaaattatttaggc

SEQ ID NO: 120 - protein, 11 aa, Artificial Sequence
  Description of Artificial Sequence: Synthetic peptide
RASQDIRNYLG

SEQ ID NO: 121 - DNA, 36 bp, Artificial Sequence; identical to SEQ ID NO: 99
  Description of Artificial Sequence: Synthetic oligonucleotide

SEQ ID NO: 122 - protein, 12 aa, Artificial Sequence
  Description of Artificial Sequence: Synthetic peptide
RASQSVNSNYLA

SEQ ID NO: 123 - DNA, 33 bp, Artificial Sequence
  Description of Artificial Sequence: Synthetic oligonucleotide
cgggcaagtcagggcataagaaaagatttaggc

SEQ ID NO: 124 - protein, 11 aa, Artificial Sequence
  Description of Artificial Sequence: Synthetic peptide
RASQGIRKDLG

SEQ ID NO: 125 - DNA, 36 bp, Artificial Sequence
  Description of Artificial Sequence: Synthetic oligonucleotide
agggccagtcagagcgttaacagcaactacttagcc

SEQ ID NO: 126 - protein, 12 aa, Artificial Sequence
  Description of Artificial Sequence: Synthetic peptide
RASQSVNSNYLA

SEQ ID NO: 127 - DNA, 33 bp, Artificial Sequence; identical to SEQ ID NO: 109
  Description of Artificial Sequence: Synthetic oligonucleotide

SEQ ID NO: 128 - protein, 11 aa, Artificial Sequence
  Description of Artificial Sequence: Synthetic peptide
RASQGIRNDLG

SEQ ID NO: 129 - DNA, 36 bp, Artificial Sequence; identical to SEQ ID NO: 99
  Description of Artificial Sequence: Synthetic oligonucleotide

SEQ ID NO: 130 - protein, 12 aa, Artificial Sequence
  Description of Artificial Sequence: Synthetic peptide
RASQSVNSNYLA

SEQ ID NO: 131 - DNA, 33 bp, Artificial Sequence; identical to SEQ ID NO: 109
  Description of Artificial Sequence: Synthetic oligonucleotide

SEQ ID NO: 132 - protein, 11 aa, Artificial Sequence
  Description of Artificial Sequence: Synthetic peptide
RASQGIRNDLG

SEQ ID NO: 133 - DNA, 33 bp, Artificial Sequence
  Description of Artificial Sequence: Synthetic oligonucleotide
cgggcaagtcagggcattagaagtgatttaggc

SEQ ID NO: 134 - protein, 11 aa, Artificial Sequence
  Description of Artificial Sequence: Synthetic peptide
RASQGIRSDLG

SEQ ID NO: 135 - DNA, 33 bp, Artificial Sequence; identical to SEQ ID NO: 119
  Description of Artificial Sequence: Synthetic oligonucleotide

SEQ ID NO: 136 - protein, 11 aa, Artificial Sequence
  Description of Artificial Sequence: Synthetic peptide
RASQDIRNYLG

SEQ ID NO: 137 - DNA, 33 bp, Artificial Sequence
  Description of Artificial Sequence: Synthetic oligonucleotide
cgggcaagtcagaacattagcagctatttaaat

SEQ ID NO: 138 - protein, 11 aa, Artificial Sequence
  Description of Artificial Sequence: Synthetic peptide
RASQNISSYLN

SEQ ID NO: 139 - DNA, 51 bp, Artificial Sequence
  Description of Artificial Sequence: Synthetic oligonucleotide
aagtccagccagagtgttttatccagctccaacaataacaactacttagct

SEQ ID NO: 140 - protein, 17 aa, Artificial Sequence
  Description of Artificial Sequence: Synthetic peptide
KSSQSVLSSSNNNNYLA

SEQ ID NO: 141 - DNA, 51 bp, Artificial Sequence
  Description of Artificial Sequence: Synthetic oligonucleotide
aagtccagccagagtgttttatccaactccaacaataacaactacttagct

SEQ ID NO: 142 - protein, 17 aa, Artificial Sequence
  Description of Artificial Sequence: Synthetic peptide
KSSQSVLSNSNNNNYLA

SEQ ID NO: 143 - DNA, 48 bp, Artificial Sequence
  Description of Artificial Sequence: Synthetic oligonucleotide
aggtctggtcaaagcctcgtatacagtgatggaaacacctacttgaat

SEQ ID NO: 144 - protein, 16 aa, Artificial Sequence
  Description of Artificial Sequence: Synthetic peptide
RSGQSLVYSDGNTYLN

SEQ ID NO: 145 - DNA, 48 bp, Artificial Sequence
  Description of Artificial Sequence: Synthetic oligonucleotide
aggtctagtcaaagcctcgtttacagtgttggaaacacctccttgagt

SEQ ID NO: 146 - protein, 16 aa, Artificial Sequence
  Description of Artificial Sequence: Synthetic peptide
RSSQSLVYSVGNTSLS

SEQ ID NO: 147 - DNA, 33 bp, Artificial Sequence
  Description of Artificial Sequence: Synthetic oligonucleotide
cgggcaagtcggggcattagagatgatttaggc

SEQ ID NO: 148 - protein, 11 aa, Artificial Sequence
  Description of Artificial Sequence: Synthetic peptide
RASRGIRDDLG

SEQ ID NO: 149 - DNA, 33 bp, Artificial Sequence; identical to SEQ ID NO: 109
  Description of Artificial Sequence: Synthetic oligonucleotide

SEQ ID NO: 150 - protein, 11 aa, Artificial Sequence
  Description of Artificial Sequence: Synthetic peptide
RASQGIRNDLG

SEQ ID NO: 151 - DNA, 42 bp, Artificial Sequence
  Description of Artificial Sequence: Synthetic oligonucleotide
actggaaccagcagtgacgttggtggttataattttgtctcc

SEQ ID NO: 152 - protein, 14 aa, Artificial Sequence
  Description of Artificial Sequence: Synthetic peptide
TGTSSDVGGYNFVS

SEQ ID NO: 153 - DNA, 39 bp, Artificial Sequence
  Description of Artificial Sequence: Synthetic oligonucleotide
tctggaagcagctccaacatcggaagtaatactgtaaac

SEQ ID NO: 154 - protein, 13 aa, Artificial Sequence
  Description of Artificial Sequence: Synthetic peptide
SGSSSNIGSNTVN

SEQ ID NO: 155 - DNA, 33 bp, Artificial Sequence
  Description of Artificial Sequence: Synthetic oligonucleotide
actggagatgcaatgccgaaaaaatatgcttat

SEQ ID NO: 156 - protein, 11 aa, Artificial Sequence
  Description of Artificial Sequence: Synthetic peptide
TGDAMPKKYAY

SEQ ID NO: 157 - DNA, 33 bp, Artificial Sequence; identical to SEQ ID NO: 109
  Description of Artificial Sequence: Synthetic oligonucleotide

SEQ ID NO: 158 - protein, 11 aa, Artificial Sequence
  Description of Artificial Sequence: Synthetic peptide
RASQGIRNDLG

SEQ ID NO: 159 - DNA, 51 bp, Artificial Sequence
  Description of Artificial Sequence: Synthetic oligonucleotide
aagtccagccagagtgttttgtacagctccaacagtcacaactacttagct

SEQ ID NO: 160 - protein, 17 aa, Artificial Sequence
  Description of Artificial Sequence: Synthetic peptide
KSSQSVLYSSNSHNYLA

SEQ ID NO: 161 - DNA, 33 bp, Artificial Sequence
  Description of Artificial Sequence: Synthetic oligonucleotide
cgggcaagtcaggacattagagataatttaggc

SEQ ID NO: 162 - protein, 11 aa, Artificial Sequence
  Description of Artificial Sequence: Synthetic peptide
RASQDIRDNLG

SEQ ID NO: 163 - DNA, 33 bp, Artificial Sequence
  Description of Artificial Sequence: Synthetic oligonucleotide
tctggagataaattgggggataaatatgcttac

SEQ ID NO: 164 - protein, 11 aa, Artificial Sequence
  Description of Artificial Sequence: Synthetic peptide
SGDKLGDKYAY

SEQ ID NO: 165 - DNA, 48 bp, Artificial Sequence
  Description of Artificial Sequence: Synthetic oligonucleotide
aggtctagtcaaagcctcgtatacagtgatggaaacaccttcttgaat

SEQ ID NO: 166 - protein, 16 aa, Artificial Sequence
  Description of Artificial Sequence: Synthetic peptide
RSSQSLVYSDGNTFLN

SEQ ID NO: 167 - DNA, 42 bp, Artificial Sequence; identical to SEQ ID NO: 151
  Description of Artificial Sequence: Synthetic oligonucleotide

SEQ ID NO: 168 - protein, 14 aa, Artificial Sequence
  Description of Artificial Sequence: Synthetic peptide
TGTSSDVGGYNFVS

SEQ ID NO: 169 - DNA, 33 bp, Artificial Sequence; identical to SEQ ID NO: 133
  Description of Artificial Sequence: Synthetic oligonucleotide

SEQ ID NO: 170 - protein, 11 aa, Artificial Sequence
  Description of Artificial Sequence: Synthetic peptide
RASQGIRSDLG

SEQ ID NO: 171 - DNA, 33 bp, Artificial Sequence
  Description of Artificial Sequence: Synthetic oligonucleotide
cgggcgagtcagggtattagcagctggttagcc

SEQ ID NO: 172 - protein, 11 aa, Artificial Sequence
  Description of Artificial Sequence: Synthetic peptide
RASQGISSWLA

SEQ ID NO: 173 - DNA, 33 bp, Artificial Sequence
  Description of Artificial Sequence: Synthetic oligonucleotide
cgggcgagtcagggtattagcaggtggttagcc

SEQ ID NO: 174 - protein, 11 aa, Artificial Sequence
  Description of Artificial Sequence: Synthetic peptide
RASQGISRWLA

SEQ ID NO: 175 - DNA, 33 bp, Artificial Sequence; identical to SEQ ID NO: 109
  Description of Artificial Sequence: Synthetic oligonucleotide

SEQ ID NO: 176 - protein, 11 aa, Artificial Sequence
  Description of Artificial Sequence: Synthetic peptide
RASQGIRNDLG

SEQ ID NO: 177 - DNA, 33 bp, Artificial Sequence
  Description of Artificial Sequence: Synthetic oligonucleotide
tctggagataaattgggggataaatatgtttac

SEQ ID NO: 178 - protein, 11 aa, Artificial Sequence
  Description of Artificial Sequence: Synthetic peptide
SGDKLGDKYVY

SEQ ID NO: 179 - DNA, 48 bp, Artificial Sequence
  Description of Artificial Sequence: Synthetic oligonucleotide
aggtctagtcaaagcctcgtatccagtgatggaaacaccttcttgaat

SEQ ID NO: 180 - protein, 16 aa, Artificial Sequence
  Description of Artificial Sequence: Synthetic peptide
RSSQSLVSSDGNTFLN

SEQ ID NO: 181 - DNA, 33 bp, Artificial Sequence
  Description of Artificial Sequence: Synthetic oligonucleotide
tctggagataaattgggggataaatatacttac

SEQ ID NO: 182 - protein, 11 aa, Artificial Sequence
  Description of Artificial Sequence: Synthetic peptide
SGDKLGDKYTY

SEQ ID NO: 183 - DNA, 42 bp, Artificial Sequence
  Description of Artificial Sequence: Synthetic oligonucleotide
actggaaccagcagtgacgttggtggttataactatgtctcc

SEQ ID NO: 184 - protein, 14 aa, Artificial Sequence
  Description of Artificial Sequence: Synthetic peptide
TGTSSDVGGYNYVS

SEQ ID NO: 185 - DNA, 33 bp, Artificial Sequence
  Description of Artificial Sequence: Synthetic oligonucleotide
tctggagataaattggggaataaatatgcttgg

SEQ ID NO: 186 - protein, 11 aa, Artificial Sequence
  Description of Artificial Sequence: Synthetic peptide
SGDKLGNKYAW

SEQ ID NO: 187 - DNA, 33 bp, Artificial Sequence
  Description of Artificial Sequence: Synthetic oligonucleotide
tctggagataaattgggggaaaaatatgtttgc

SEQ ID NO: 188 - protein, 11 aa, Artificial Sequence
  Description of Artificial Sequence: Synthetic peptide
SGDKLGEKYVC

SEQ ID NO: 189 - DNA, 33 bp, Artificial Sequence
  Description of Artificial Sequence: Synthetic oligonucleotide
tctggagagaaattgggggataaatatgtttgt

SEQ ID NO: 190 - protein, 11 aa, Artificial Sequence
  Description of Artificial Sequence: Synthetic peptide
SGEKLGDKYVC

SEQ ID NO: 191 - DNA, 33 bp, Artificial Sequence
  Description of Artificial Sequence: Synthetic oligonucleotide
tctggagataaattgggggataaatatgcttcc

SEQ ID NO: 192 - protein, 11 aa, Artificial Sequence
  Description of Artificial Sequence: Synthetic peptide
SGDKLGDKYAS

SEQ ID NO: 193 - DNA, 33 bp, Artificial Sequence
  Description of Artificial Sequence: Synthetic oligonucleotide
gggggaaacaacattggaagtaaagctgtgcac

SEQ ID NO: 194 - protein, 11 aa, Artificial Sequence
  Description of Artificial Sequence: Synthetic peptide
GGNNIGSKAVH

SEQ ID NO: 195 - DNA, 36 bp, Artificial Sequence
  Description of Artificial Sequence: Synthetic oligonucleotide
accctaagcagtgagcacagcacctacaccatcgaa

SEQ ID NO: 196 - protein, 12 aa, Artificial Sequence
  Description of Artificial Sequence: Synthetic peptide
TLSSEHSTYTIE

SEQ ID NO: 197 - DNA, 33 bp, Artificial Sequence
  Description of Artificial Sequence: Synthetic oligonucleotide
tctggagatagattgggggataaatatgcttgg

SEQ ID NO: 198 - protein, 11 aa, Artificial Sequence
  Description of Artificial Sequence: Synthetic peptide
SGDRLGDKYAW

SEQ ID NO: 199 - DNA, 48 bp, Artificial Sequence
  Description of Artificial Sequence: Synthetic oligonucleotide
aagtctagtcagagcctcctgcatagtgatggaaagacccatttgaat

SEQ ID NO: 200 - protein, 16 aa, Artificial Sequence
  Description of Artificial Sequence: Synthetic peptide
KSSQSLLHSDGKTHLN

SEQ ID NO: 201 - DNA, 33 bp, Artificial Sequence; identical to SEQ ID NO: 105
  Description of Artificial Sequence: Synthetic oligonucleotide

SEQ ID NO: 202 - protein, 11 aa, Artificial Sequence
  Description of Artificial Sequence: Synthetic peptide
RASQGISNYLA

SEQ ID NO: 203 - DNA, 33 bp, Artificial Sequence; identical to SEQ ID NO: 109
  Description of Artificial Sequence: Synthetic oligonucleotide

SEQ ID NO: 204 - protein, 11 aa, Artificial Sequence
  Description of Artificial Sequence: Synthetic peptide
RASQGIRNDLG

SEQ ID NO: 205 - DNA, 33 bp, Artificial Sequence
  Description of Artificial Sequence: Synthetic oligonucleotide
cgggcaagtcaggacattagaaatgatttaggc

SEQ ID NO: 206 - protein, 11 aa, Artificial Sequence
  Description of Artificial Sequence: Synthetic peptide
RASQDIRNDLG

SEQ ID NO: 207 - DNA, 33 bp, Artificial Sequence; identical to SEQ ID NO: 109
  Description of Artificial Sequence: Synthetic oligonucleotide

SEQ ID NO: 208 - protein, 11 aa, Artificial Sequence
  Description of Artificial Sequence: Synthetic peptide
RASQGIRNDLG

SEQ ID NO: 209 - DNA, 33 bp, Artificial Sequence; identical to SEQ ID NO: 109
  Description of Artificial Sequence: Synthetic oligonucleotide

SEQ ID NO: 210 - protein, 11 aa, Artificial Sequence
  Description of Artificial Sequence: Synthetic peptide
RASQGIRNDLG

SEQ ID NO: 211 - DNA, 33 bp, Artificial Sequence; identical to SEQ ID NO: 109
  Description of Artificial Sequence: Synthetic oligonucleotide

SEQ ID NO: 212 - protein, 11 aa, Artificial Sequence
  Description of Artificial Sequence: Synthetic peptide
RASQGIRNDLG

SEQ ID NO: 213 - DNA, 33 bp, Artificial Sequence
  Description of Artificial Sequence: Synthetic oligonucleotide
cgggcaagtcaggacattagaaatcatttaggc

SEQ ID NO: 214 - protein, 11 aa, Artificial Sequence
  Description of Artificial Sequence: Synthetic peptide
RASQDIRNHLG

SEQ ID NO: 215 - DNA, 33 bp, Artificial Sequence; identical to SEQ ID NO: 133
  Description of Artificial Sequence: Synthetic oligonucleotide

SEQ ID NO: 216 - protein, 11 aa, Artificial Sequence
  Description of Artificial Sequence: Synthetic peptide
RASQGIRSDLG

SEQ ID NO: 217 - DNA, 33 bp, Artificial Sequence
  Description of Artificial Sequence: Synthetic oligonucleotide
cgggcaagtcagaccattagcaactatttaaat

SEQ ID NO: 218 - protein, 11 aa, Artificial Sequence
  Description of Artificial Sequence: Synthetic peptide
RASQTISNYLN

SEQ ID NO: 219 - DNA, 33 bp, Artificial Sequence
  Description of Artificial Sequence: Synthetic oligonucleotide
cgggcaagtcaggtcattagaaatgatttaggc

SEQ ID NO: 220 - protein, 11 aa, Artificial Sequence
  Description of Artificial Sequence: Synthetic peptide
RASQVIRNDLG

SEQ ID NO: 221 - DNA, 33 bp, Artificial Sequence; identical to SEQ ID NO: 109
  Description of Artificial Sequence: Synthetic oligonucleotide

SEQ ID NO: 222 - protein, 11 aa, Artificial Sequence
  Description of Artificial Sequence: Synthetic peptide
RASQGIRNDLG

SEQ ID NO: 223 - DNA, 33 bp, Artificial Sequence; identical to SEQ ID NO: 93
  Description of Artificial Sequence: Synthetic oligonucleotide

SEQ ID NO: 224 - protein, 11 aa, Artificial Sequence
  Description of Artificial Sequence: Synthetic peptide
RTSQGIRNDLG

SEQ ID NO: 225 - DNA, 33 bp, Artificial Sequence; identical to SEQ ID NO: 109
  Description of Artificial Sequence: Synthetic oligonucleotide

SEQ ID NO: 226 - protein, 11 aa, Artificial Sequence
  Description of Artificial Sequence: Synthetic peptide
RASQGIRNDLG

SEQ ID NO: 227 - DNA, 33 bp, Artificial Sequence; identical to SEQ ID NO: 109
  Description of Artificial Sequence: Synthetic oligonucleotide

SEQ ID NO: 228 - protein, 11 aa, Artificial Sequence
  Description of Artificial Sequence: Synthetic peptide
RASQGIRNDLG

SEQ ID NO: 229 - DNA, 33 bp, Artificial Sequence; identical to SEQ ID NO: 217
  Description of Artificial Sequence: Synthetic oligonucleotide

SEQ ID NO: 230 - protein, 11 aa, Artificial Sequence
  Description of Artificial Sequence: Synthetic peptide
RASQTISNYLN

SEQ ID NO: 231 - DNA, 33 bp, Artificial Sequence
  Description of Artificial Sequence: Synthetic oligonucleotide
cgggcgagtcagggtattggcaactggttagcc

SEQ ID NO: 232 - protein, 11 aa, Artificial Sequence
  Description of Artificial Sequence: Synthetic peptide
RASQGIGNWLA

SEQ ID NO: 233 - DNA, 33 bp, Artificial Sequence
  Description of Artificial Sequence: Synthetic oligonucleotide
cgggcaagtcagagcattaatacttatttaaat

SEQ ID NO: 234 - protein, 11 aa, Artificial Sequence
  Description of Artificial Sequence: Synthetic peptide
RASQSINTYLN

SEQ ID NO: 235 - DNA, 33 bp, Artificial Sequence; identical to SEQ ID NO: 109
  Description of Artificial Sequence: Synthetic oligonucleotide

SEQ ID NO: 236 - protein, 11 aa, Artificial Sequence
  Description of Artificial Sequence: Synthetic peptide
RASQGIRNDLG

SEQ ID NO: 237 - DNA, 33 bp, Artificial Sequence; identical to SEQ ID NO: 109
  Description of Artificial Sequence: Synthetic oligonucleotide

SEQ ID NO: 238 - protein, 11 aa, Artificial Sequence
  Description of Artificial Sequence: Synthetic peptide
RASQGIRNDLG

SEQ ID NO: 239 - DNA, 33 bp, Artificial Sequence; identical to SEQ ID NO: 109
  Description of Artificial Sequence: Synthetic oligonucleotide

SEQ ID NO: 240 - protein, 11 aa, Artificial Sequence
  Description of Artificial Sequence: Synthetic peptide
RASQGIRNDLG

SEQ ID NO: 241 - DNA, 33 bp, Artificial Sequence
  Description of Artificial Sequence: Synthetic oligonucleotide
cgggcaggtcagaacattatcaactatttaaat

SEQ ID NO: 242 - protein, 11 aa, Artificial Sequence
  Description of Artificial Sequence: Synthetic peptide
RAGQNIINYLN

SEQ ID NO: 243 - DNA, 33 bp, Artificial Sequence
  Description of Artificial Sequence: Synthetic oligonucleotide
cgggcaagtcagagcattatcacctatttaaat

SEQ ID NO: 244 - protein, 11 aa, Artificial Sequence
  Description of Artificial Sequence: Synthetic peptide
RASQSIITYLN

SEQ ID NO: 245 - DNA, 33 bp, Artificial Sequence; identical to SEQ ID NO: 109
  Description of Artificial Sequence: Synthetic oligonucleotide

SEQ ID NO: 246 - protein, 11 aa, Artificial Sequence
  Description of Artificial Sequence: Synthetic peptide
RASQGIRNDLG

SEQ ID NO: 247 - DNA, 33 bp, Artificial Sequence
  Description of Artificial Sequence: Synthetic oligonucleotide
cgggcaagtcagaacattagtagttatttaaat

SEQ ID NO: 248 - protein, 11 aa, Artificial Sequence
  Description of Artificial Sequence: Synthetic peptide
RASQNISSYLN

SEQ ID NO: 249 - DNA, 33 bp, Artificial Sequence; identical to SEQ ID NO: 109
  Description of Artificial Sequence: Synthetic oligonucleotide

SEQ ID NO: 250 - protein, 11 aa, Artificial Sequence
  Description of Artificial Sequence: Synthetic peptide
RASQGIRNDLG

SEQ ID NO: 251 - DNA, 33 bp, Artificial Sequence
  Description of Artificial Sequence: Synthetic oligonucleotide
cgggcaagtcagggcataagaaatgatttaggc

SEQ ID NO: 252 - protein, 11 aa, Artificial Sequence
  Description of Artificial Sequence: Synthetic peptide
RASQGIRNDLG

SEQ ID NO: 253 - DNA, 33 bp, Artificial Sequence
  Description of Artificial Sequence: Synthetic oligonucleotide
cgggcaagtcagagcattagtagttatttatat

SEQ ID NO: 254 - protein, 11 aa, Artificial Sequence
  Description of Artificial Sequence: Synthetic peptide
RASQSISSYLY

SEQ ID NO: 255 - DNA, 33 bp, Artificial Sequence; identical to SEQ ID NO: 109
  Description of Artificial Sequence: Synthetic oligonucleotide

SEQ ID NO: 256 - protein, 11 aa, Artificial Sequence
  Description of Artificial Sequence: Synthetic peptide
RASQGIRNDLG

SEQ ID NO: 257 - DNA, 33 bp, Artificial Sequence
  Description of Artificial Sequence: Synthetic oligonucleotide
cgggcgagtcaggccattaacacttatttagcc

SEQ ID NO: 258 - protein, 11 aa, Artificial Sequence
  Description of Artificial Sequence: Synthetic peptide
RASQAINTYLA

SEQ ID NO: 259 - DNA, 33 bp, Artificial Sequence; identical to SEQ ID NO: 109
  Description of Artificial Sequence: Synthetic oligonucleotide

SEQ ID NO: 260 - protein, 11 aa, Artificial Sequence
  Description of Artificial Sequence: Synthetic peptide
RASQGIRNDLG

SEQ ID NO: 261 - DNA, 33 bp, Artificial Sequence; identical to SEQ ID NO: 109
  Description of Artificial Sequence: Synthetic oligonucleotide

SEQ ID NO: 262 - protein, 11 aa, Artificial Sequence
  Description of Artificial Sequence: Synthetic peptide
RASQGIRNDLG

SEQ ID NO: 263 - DNA, 33 bp, Artificial Sequence; identical to SEQ ID NO: 109
  Description of Artificial Sequence: Synthetic oligonucleotide

SEQ ID NO: 264 - protein, 11 aa, Artificial Sequence
  Description of Artificial Sequence: Synthetic peptide
RASQGIRNDLG

SEQ ID NO: 265 - DNA, 33 bp, Artificial Sequence
  Description of Artificial Sequence: Synthetic oligonucleotide
cgggcgagtcaggacattagctattatttagcc

SEQ ID NO: 266 - protein, 11 aa, Artificial Sequence
  Description of Artificial Sequence: Synthetic peptide
RASQDISYYLA

SEQ ID NO: 267 - DNA, 33 bp, Artificial Sequence
  Description of Artificial Sequence: Synthetic oligonucleotide
cgggcaagtcagaacattatcaactatttaaat

SEQ ID NO: 268 - protein, 11 aa, Artificial Sequence
  Description of Artificial Sequence: Synthetic peptide
RASQNIINYLN

SEQ ID NO: 269 - DNA, 33 bp, Artificial Sequence
  Description of Artificial Sequence: Synthetic oligonucleotide
cgggcaagtcagagcattatcaactatttaaat

SEQ ID NO: 270 - protein, 11 aa, Artificial Sequence
  Description of Artificial Sequence: Synthetic peptide
RASQSIINYLN

SEQ ID NO: 271 - DNA, 33 bp, Artificial Sequence; identical to SEQ ID NO: 109
  Description of Artificial Sequence: Synthetic oligonucleotide

SEQ ID NO: 272 - protein, 11 aa, Artificial Sequence
  Description of Artificial Sequence: Synthetic peptide
RASQGIRNDLG

SEQ ID NO: 273 - DNA, 33 bp, Artificial Sequence
  Description of Artificial Sequence: Synthetic oligonucleotide
cgggcaagtcagaccattagtagttttttaaat

SEQ ID NO: 274 - protein, 11 aa, Artificial Sequence
  Description of Artificial Sequence: Synthetic peptide
RASQTISSFLN

SEQ ID NO: 275 - DNA, 33 bp, Artificial Sequence
  Description of Artificial Sequence: Synthetic oligonucleotide
cgggcaagtcggaccattaacaactatttaaat

SEQ ID NO: 276 - protein, 11 aa, Artificial Sequence
  Description of Artificial Sequence: Synthetic peptide
RASRTINNYLN

SEQ ID NO: 277 - DNA, 33 bp, Artificial Sequence; identical to SEQ ID NO: 109
  Description of Artificial Sequence: Synthetic oligonucleotide

SEQ ID NO: 278 - protein, 11 aa, Artificial Sequence
  Description of Artificial Sequence: Synthetic peptide
RASQGIRNDLG

SEQ ID NO: 279 - DNA, 33 bp, Artificial Sequence
  Description of Artificial Sequence: Synthetic oligonucleotide
cgggcgagtcagggcattagctattatttagcc

SEQ ID NO: 280 - protein, 11 aa, Artificial Sequence
  Description of Artificial Sequence: Synthetic peptide
RASQGISYYLA

SEQ ID NO: 281 - DNA, 33 bp, Artificial Sequence
  Description of Artificial Sequence: Synthetic oligonucleotide
cgggcaagtcagggcattagaactgatttaggc

SEQ ID NO: 282 - protein, 11 aa, Artificial Sequence
  Description of Artificial Sequence: Synthetic peptide
RASQGIRTDLG

SEQ ID NO: 283 - DNA, 33 bp, Artificial Sequence
  Description of Artificial Sequence: Synthetic oligonucleotide
cgggcgagtcaggacattagcaattatttagcc

SEQ ID NO: 284 - protein, 11 aa, Artificial Sequence
  Description of Artificial Sequence: Synthetic peptide
RASQDISNYLA

SEQ ID NO: 285 - DNA, 33 bp, Artificial Sequence; identical to SEQ ID NO: 109
  Description of Artificial Sequence: Synthetic oligonucleotide

SEQ ID NO: 286 - protein, 11 aa, Artificial Sequence
  Description of Artificial Sequence: Synthetic peptide
RASQGIRNDLG

SEQ ID NO: 287 - DNA, 48 bp, Artificial Sequence
  Description of Artificial Sequence: Synthetic oligonucleotide
aggtctagtcagagcctcctgcatagtaatgggaacaactctttggat

SEQ ID NO: 288 - protein, 16 aa, Artificial Sequence
  Description of Artificial Sequence: Synthetic peptide
RSSQSLLHSNGNNSLD

SEQ ID NO: 289 - DNA, 33 bp, Artificial Sequence
  Description of Artificial Sequence: Synthetic oligonucleotide
cgggcaagtcagagcattagtagttatttaaat

SEQ ID NO: 290 - protein, 11 aa, Artificial Sequence
  Description of Artificial Sequence: Synthetic peptide
RASQSISSYLN

SEQ ID NO: 291 - DNA, 33 bp, Artificial Sequence; identical to SEQ ID NO: 289
  Description of Artificial Sequence: Synthetic oligonucleotide

SEQ ID NO: 292 - protein, 11 aa, Artificial Sequence
  Description of Artificial Sequence: Synthetic peptide
RASQSISSYLN

SEQ ID NO: 293 - DNA, 33 bp, Artificial Sequence
  Description of Artificial Sequence: Synthetic oligonucleotide
cgggcgagtcagggcattaacaattatttagcc

SEQ ID NO: 294 - protein, 11 aa, Artificial Sequence
  Description of Artificial Sequence: Synthetic peptide
RASQGINNYLA

SEQ ID NO: 295 - DNA, 33 bp, Artificial Sequence; identical to SEQ ID NO: 171
  Description of Artificial Sequence: Synthetic oligonucleotide

SEQ ID NO: 296 - protein, 11 aa, Artificial Sequence
  Description of Artificial Sequence: Synthetic peptide
RASQGISSWLA

SEQ ID NO: 297 - DNA, 33 bp, Artificial Sequence
  Description of Artificial Sequence: Synthetic oligonucleotide
cgggcaagtcagaacattaacaattatttaaat

SEQ ID NO: 298 - protein, 11 aa, Artificial Sequence
  Description of Artificial Sequence: Synthetic peptide
RASQNINNYLN

SEQ ID NO: 299 - DNA, 33 bp, Artificial Sequence; identical to SEQ ID NO: 109
  Description of Artificial Sequence: Synthetic oligonucleotide

SEQ ID NO: 300 - protein, 11 aa, Artificial Sequence
  Description of Artificial Sequence: Synthetic peptide
RASQGIRNDLG

SEQ ID NO: 301 - DNA, 33 bp, Artificial Sequence
  Description of Artificial Sequence: Synthetic oligonucleotide
agggccagtcagagtgttagcagcaacttagcc

SEQ ID NO: 302 - protein, 11 aa, Artificial Sequence
  Description of Artificial Sequence: Synthetic peptide
RASQSVSSNLA

SEQ ID NO: 303 - DNA, 33 bp, Artificial Sequence
  Description of Artificial Sequence: Synthetic oligonucleotide
cgggcaagtcagaatattaacaactatttaaat

SEQ ID NO: 304 - protein, 11 aa, Artificial Sequence
  Description of Artificial Sequence: Synthetic peptide
RASQNINNYLN

SEQ ID NO: 305 - DNA, 33 bp, Artificial Sequence
  Description of Artificial Sequence: Synthetic oligonucleotide
cgggcaagtcagagcattatcagctatttaaat

SEQ ID NO: 306 - protein, 11 aa, Artificial Sequence
  Description of Artificial Sequence: Synthetic peptide
RASQSIISYLN

SEQ ID NO: 307 - DNA, 33 bp, Artificial Sequence; identical to SEQ ID NO: 109
  Description of Artificial Sequence: Synthetic oligonucleotide

SEQ ID NO: 308 - protein, 11 aa, Artificial Sequence
  Description of Artificial Sequence: Synthetic peptide
RASQGIRNDLG

SEQ ID NO: 309 - DNA, 33 bp, Artificial Sequence; identical to SEQ ID NO: 205
  Description of Artificial Sequence: Synthetic oligonucleotide

SEQ ID NO: 310 - protein, 11 aa, Artificial Sequence
  Description of Artificial Sequence: Synthetic peptide
RASQDIRNDLG

SEQ ID NO: 311 - DNA, 33 bp, Artificial Sequence; identical to SEQ ID NO: 109
  Description of Artificial Sequence: Synthetic oligonucleotide

SEQ ID NO: 312 - protein, 11 aa, Artificial Sequence
  Description of Artificial Sequence: Synthetic peptide
RASQGIRNDLG

SEQ ID NO: 313 - DNA, 33 bp, Artificial Sequence
  Description of Artificial Sequence: Synthetic oligonucleotide
cggacgagtcagggcattaacaattatttagtc

SEQ ID NO: 314 - protein, 11 aa, Artificial Sequence
  Description of Artificial Sequence: Synthetic peptide
RTSQGINNYLV

SEQ ID NO: 315 - DNA, 33 bp, Artificial Sequence
  Description of Artificial Sequence: Synthetic oligonucleotide
cgggcgagtcagggcattaataattatttagtc

SEQ ID NO: 316 - protein, 11 aa, Artificial Sequence
  Description of Artificial Sequence: Synthetic peptide
RASQGINNYLV

SEQ ID NO: 317 - DNA, 33 bp, Artificial Sequence; identical to SEQ ID NO: 109
  Description of Artificial Sequence: Synthetic oligonucleotide

SEQ ID NO: 318 - protein, 11 aa, Artificial Sequence
  Description of Artificial Sequence: Synthetic peptide
RASQGIRNDLG

SEQ ID NO: 319 - DNA, 33 bp, Artificial Sequence
  Description of Artificial Sequence: Synthetic oligonucleotide
cgggcaagtcagagcattactggttattcaaat

SEQ ID NO: 320 - protein, 11 aa, Artificial Sequence
  Description of Artificial Sequence: Synthetic peptide
RASQSITGYSN

SEQ ID NO: 321 - DNA, 33 bp, Artificial Sequence; identical to SEQ ID NO: 109
  Description of Artificial Sequence: Synthetic oligonucleotide

SEQ ID NO: 322 - protein, 11 aa, Artificial Sequence
  Description of Artificial Sequence: Synthetic peptide
RASQGIRNDLG

SEQ ID NO: 323 - DNA, 33 bp, Artificial Sequence
  Description of Artificial Sequence: Synthetic oligonucleotide
cgggcaagtcagagcattagtaattatttaaat

SEQ ID NO: 324 - protein, 11 aa, Artificial Sequence
  Description of Artificial Sequence: Synthetic peptide
RASQSISNYLN

SEQ ID NO: 325 - DNA, 33 bp, Artificial Sequence; identical to SEQ ID NO: 137
  Description of Artificial Sequence: Synthetic oligonucleotide

SEQ ID NO: 326 - protein, 11 aa, Artificial Sequence
  Description of Artificial Sequence: Synthetic peptide
RASQNISSYLN

SEQ ID NO: 327 - DNA, 33 bp, Artificial Sequence
  Description of Artificial Sequence: Synthetic oligonucleotide
cgggcaagtcagagcattttcagctatttaaat

SEQ ID NO: 328 - protein, 11 aa, Artificial Sequence
  Description of Artificial Sequence: Synthetic peptide
RASQSIFSYLN

SEQ ID NO: 329 - DNA, 33 bp, Artificial Sequence
  Description of Artificial Sequence: Synthetic oligonucleotide
cgggcaagtcagagcattagcaggtatttaaat

SEQ ID NO: 330 - protein, 11 aa, Artificial Sequence
  Description of Artificial Sequence: Synthetic peptide
RASQSISRYLN

SEQ ID NO: 331 - DNA, 33 bp, Artificial Sequence; identical to SEQ ID NO: 301
  Description of Artificial Sequence: Synthetic oligonucleotide

SEQ ID NO: 332 - protein, 11 aa, Artificial Sequence
  Description of Artificial Sequence: Synthetic peptide
RASQSVSSNLA

SEQ ID NO: 333 - DNA, 33 bp, Artificial Sequence
  Description of Artificial Sequence: Synthetic oligonucleotide
cgggcaagtcaccatattagcaactatttaaat

SEQ ID NO: 334 - protein, 11 aa, Artificial Sequence
  Description of Artificial Sequence: Synthetic peptide
RASHHISNYLN

SEQ ID NO: 335 - DNA, 33 bp, Artificial Sequence; identical to SEQ ID NO: 109
  Description of Artificial Sequence: Synthetic oligonucleotide

SEQ ID NO: 336 - protein, 11 aa, Artificial Sequence
  Description of Artificial Sequence: Synthetic peptide
RASQGIRNDLG

SEQ ID NO: 337 - DNA, 33 bp, Artificial Sequence; identical to SEQ ID NO: 109
  Description of Artificial Sequence: Synthetic oligonucleotide

SEQ ID NO: 338 - protein, 11 aa, Artificial Sequence
  Description of Artificial Sequence: Synthetic peptide
RASQGIRNDLG

SEQ ID NO: 339 - DNA, 33 bp, Artificial Sequence
  Description of Artificial Sequence: Synthetic oligonucleotide
cgggcgagtcaaggcattagcaaatatttagcc

SEQ ID NO: 340 - protein, 11 aa, Artificial Sequence
  Description of Artificial Sequence: Synthetic peptide
RASQGISKYLA

SEQ ID NO: 341 - DNA, 33 bp, Artificial Sequence
  Description of Artificial Sequence: Synthetic oligonucleotide
cgggcaagtcaggacattagaaataatttaggc

SEQ ID NO: 342 - protein, 11 aa, Artificial Sequence
  Description of Artificial Sequence: Synthetic peptide
RASQDIRNNLG

SEQ ID NO: 343 - DNA, 33 bp, Artificial Sequence; identical to SEQ ID NO: 109
  Description of Artificial Sequence: Synthetic oligonucleotide

SEQ ID NO: 344 - protein, 11 aa, Artificial Sequence
  Description of Artificial Sequence: Synthetic peptide
RASQGIRNDLG

SEQ ID NO: 345 - DNA, 33 bp, Artificial Sequence; identical to SEQ ID NO: 283
  Description of Artificial Sequence: Synthetic oligonucleotide

SEQ ID NO: 346 - protein, 11 aa, Artificial Sequence
  Description of Artificial Sequence: Synthetic peptide
RASQDISNYLA

SEQ ID NO: 347 - DNA, 33 bp, Artificial Sequence
  Description of Artificial Sequence: Synthetic oligonucleotide
cgggcgagtcagggcattggcatttatttagcc

SEQ ID NO: 348 - protein, 11 aa, Artificial Sequence
  Description of Artificial Sequence: Synthetic peptide
RASQGIGIYLA

SEQ ID NO: 349 - DNA, 51 bp, Artificial Sequence
  Description of Artificial Sequence: Synthetic oligonucleotide
aagtccagccagagtgttttatacacctccaacaataacaactacttaact

SEQ ID NO: 350 - protein, 17 aa, Artificial Sequence
  Description of Artificial Sequence: Synthetic peptide
KSSQSVLYTSNNNNYLT

SEQ ID NO: 351 - DNA, 33 bp, Artificial Sequence; identical to SEQ ID NO: 109
  Description of Artificial Sequence: Synthetic oligonucleotide

SEQ ID NO: 352 - protein, 11 aa, Artificial Sequence
  Description of Artificial Sequence: Synthetic peptide
RASQGIRNDLG

SEQ ID NO: 353 - DNA, 33 bp, Artificial Sequence; identical to SEQ ID NO: 109
  Description of Artificial Sequence: Synthetic oligonucleotide

SEQ ID NO: 354 - protein, 11 aa, Artificial Sequence
  Description of Artificial Sequence: Synthetic peptide
RASQGIRNDLG

SEQ ID NO: 355 - DNA, 33 bp, Artificial Sequence; identical to SEQ ID NO: 105
  Description of Artificial Sequence: Synthetic oligonucleotide

SEQ ID NO: 356 - protein, 11 aa, Artificial Sequence
  Description of Artificial Sequence: Synthetic peptide
RASQGISNYLA

SEQ ID NO: 357 - DNA, 33 bp, Artificial Sequence; identical to SEQ ID NO: 109
  Description of Artificial Sequence: Synthetic oligonucleotide

SEQ ID NO: 358 - protein, 11 aa, Artificial Sequence
  Description of Artificial Sequence: Synthetic peptide
RASQGIRNDLG

SEQ ID NO: 359 - DNA, 33 bp, Artificial Sequence; identical to SEQ ID NO: 109
  Description of Artificial Sequence: Synthetic oligonucleotide

SEQ ID NO: 360 - protein, 11 aa, Artificial Sequence
  Description of Artificial Sequence: Synthetic peptide
RASQGIRNDLG

SEQ ID NO: 361 - DNA, 33 bp, Artificial Sequence
  Description of Artificial Sequence: Synthetic oligonucleotide
cgggcaagtcagaacattatcagctatttaaat

SEQ ID NO: 362 - protein, 11 aa, Artificial Sequence
  Description of Artificial Sequence: Synthetic peptide
RASQNIISYLN

SEQ ID NO: 363 - DNA, 33 bp, Artificial Sequence; identical to SEQ ID NO: 109
  Description of Artificial Sequence: Synthetic oligonucleotide

SEQ ID NO: 364 - protein, 11 aa, Artificial Sequence
  Description of Artificial Sequence: Synthetic peptide
RASQGIRNDLG

SEQ ID NO: 365 - DNA, 33 bp, Artificial Sequence; identical to SEQ ID NO: 105
  Description of Artificial Sequence: Synthetic oligonucleotide

SEQ ID NO: 366 - protein, 11 aa, Artificial Sequence
  Description of Artificial Sequence: Synthetic peptide
RASQGISNYLA

SEQ ID NO: 367 - DNA, 33 bp, Artificial Sequence; identical to SEQ ID NO: 301
  Description of Artificial Sequence: Synthetic oligonucleotide

SEQ ID NO: 368 - protein, 11 aa, Artificial Sequence
  Description of Artificial Sequence: Synthetic peptide
RASQSVSSNLA

SEQ ID NO: 369 - DNA, 33 bp, Artificial Sequence; identical to SEQ ID NO: 329
  Description of Artificial Sequence: Synthetic oligonucleotide

SEQ ID NO: 370 - protein, 11 aa, Artificial Sequence
  Description of Artificial Sequence: Synthetic peptide
RASQSISRYLN

SEQ ID NO: 371 - DNA, 33 bp, Artificial Sequence
  Description of Artificial Sequence: Synthetic oligonucleotide
cgggcaagtcagggcattagaaatgatttagac

SEQ ID NO: 372 - protein, 11 aa, Artificial Sequence
  Description of Artificial Sequence: Synthetic peptide
RASQGIRNDLD

SEQ ID NO: 373 - DNA, 33 bp, Artificial Sequence
  Description of Artificial Sequence: Synthetic oligonucleotide
cgggcaagtcagaacattggtagttatttaaat

SEQ ID NO: 374 - protein, 11 aa, Artificial Sequence
  Description of Artificial Sequence: Synthetic peptide
RASQNIGSYLN

SEQ ID NO: 375 - DNA, 48 bp, Artificial Sequence
  Description of Artificial Sequence: Synthetic oligonucleotide
aagtctagtcagagcctcctgcatagtggtggaaagacctatttatat

SEQ ID NO: 376 - protein, 16 aa, Artificial Sequence
  Description of Artificial Sequence: Synthetic peptide
KSSQSLLHSGGKTYLY

SEQ ID NO: 377 - DNA, 33 bp, Artificial Sequence; identical to SEQ ID NO: 247
  Description of Artificial Sequence: Synthetic oligonucleotide

SEQ ID NO: 378 - protein, 11 aa, Artificial Sequence
  Description of Artificial Sequence: Synthetic peptide
RASQNISSYLN

SEQ ID NO: 379 - DNA, 33 bp, Artificial Sequence
  Description of Artificial Sequence: Synthetic oligonucleotide
cggacaagtcagaacagtaacagttatttaaat

SEQ ID NO: 380 - protein, 11 aa, Artificial Sequence
  Description of Artificial Sequence: Synthetic peptide
RTSQNSNSYLN

SEQ ID NO: 381 - DNA, 33 bp, Artificial Sequence
  Description of Artificial Sequence: Synthetic oligonucleotide
cgggcaagtcagggcatcagaaatgatttaggc

SEQ ID NO: 382 - protein, 11 aa, Artificial Sequence
  Description of Artificial Sequence: Synthetic peptide
RASQGIRNDLG

SEQ ID NO: 383 - DNA, 33 bp, Artificial Sequence; identical to SEQ ID NO: 205
  Description of Artificial Sequence: Synthetic oligonucleotide

SEQ ID NO: 384 - protein, 11 aa, Artificial Sequence
  Description of Artificial Sequence: Synthetic peptide
RASQDIRNDLG

SEQ ID NO: 385 - DNA, 33 bp, Artificial Sequence; identical to SEQ ID NO: 109
  Description of Artificial Sequence: Synthetic oligonucleotide

SEQ ID NO: 386 - protein, 11 aa, Artificial Sequence
  Description of Artificial Sequence: Synthetic peptide
RASQGIRNDLG

SEQ ID NO: 387 - DNA, 33 bp, Artificial Sequence; identical to SEQ ID NO: 105
  Description of Artificial Sequence: Synthetic oligonucleotide

SEQ ID NO: 388 - protein, 11 aa, Artificial Sequence
  Description of Artificial Sequence: Synthetic peptide
RASQGISNYLA

SEQ ID NO: 389 - DNA, 33 bp, Artificial Sequence
  Description of Artificial Sequence: Synthetic oligonucleotide
cgggcaagtcagaccattagcagccatttaaat

SEQ ID NO: 390 - protein, 11 aa, Artificial Sequence
  Description of Artificial Sequence: Synthetic peptide
RASQTISSHLN

SEQ ID NO: 391 - DNA, 33 bp, Artificial Sequence; identical to SEQ ID NO: 109
  Description of Artificial Sequence: Synthetic oligonucleotide

SEQ ID NO: 392 - protein, 11 aa, Artificial Sequence
  Description of Artificial Sequence: Synthetic peptide
RASQGIRNDLG

SEQ ID NO: 393 - DNA, 33 bp, Artificial Sequence; identical to SEQ ID NO: 93
  Description of Artificial Sequence: Synthetic oligonucleotide

SEQ ID NO: 394 - protein, 11 aa, Artificial Sequence
  Description of Artificial Sequence: Synthetic peptide
RTSQGIRNDLG

SEQ ID NO: 395 - DNA, 33 bp, Artificial Sequence
  Description of Artificial Sequence: Synthetic oligonucleotide
cgggcaagtcaggtcattagagatgatttaggc

SEQ ID NO: 396 - protein, 11 aa, Artificial Sequence
  Description of Artificial Sequence: Synthetic peptide
RASQVIRDDLG

SEQ ID NO: 397 - DNA, 33 bp, Artificial Sequence; identical to SEQ ID NO: 93
  Description of Artificial Sequence: Synthetic oligonucleotide

SEQ ID NO: 398 - protein, 11 aa, Artificial Sequence
  Description of Artificial Sequence: Synthetic peptide
RTSQGIRNDLG

SEQ ID NO: 399 - DNA, 33 bp, Artificial Sequence; identical to SEQ ID NO: 105
  Description of Artificial Sequence: Synthetic oligonucleotide

SEQ ID NO: 400 - protein, 11 aa, Artificial Sequence
  Description of Artificial Sequence: Synthetic peptide
RASQGISNYLA

SEQ ID NO: 401 - DNA, 33 bp, Artificial Sequence
  Description of Artificial Sequence: Synthetic oligonucleotide
cgggcgagtcagggcattagaaattatttagcc

SEQ ID NO: 402 - protein, 11 aa, Artificial Sequence
  Description of Artificial Sequence: Synthetic peptide
RASQGIRNYLA

SEQ ID NO: 403 - DNA, 33 bp, Artificial Sequence; identical to SEQ ID NO: 109
  Description of Artificial Sequence: Synthetic oligonucleotide

SEQ ID NO: 404 - protein, 11 aa, Artificial Sequence
  Description of Artificial Sequence: Synthetic peptide
RASQGIRNDLG

SEQ ID NO: 405 - DNA, 33 bp, Artificial Sequence; identical to SEQ ID NO: 205
  Description of Artificial Sequence: Synthetic oligonucleotide

SEQ ID NO: 406 - protein, 11 aa, Artificial Sequence
  Description of Artificial Sequence: Synthetic peptide
RASQDIRNDLG

SEQ ID NO: 407 - DNA, 33 bp, Artificial Sequence; identical to SEQ ID NO: 105
  Description of Artificial Sequence: Synthetic oligonucleotide

SEQ ID NO: 408 - protein, 11 aa, Artificial Sequence
  Description of Artificial Sequence: Synthetic peptide
RASQGISNYLA

SEQ ID NO: 409 - DNA, 33 bp, Artificial Sequence
  Description of Artificial Sequence: Synthetic oligonucleotide
cgggcaagtcagggcattaaaaataatttaggc

SEQ ID NO: 410 - protein, 11 aa, Artificial Sequence
  Description of Artificial Sequence: Synthetic peptide
RASQGIKNNLG

SEQ ID NO: 411 - DNA, 33 bp, Artificial Sequence
  Description of Artificial Sequence: Synthetic oligonucleotide
cgggcaagtcagagtattagtagttatttaaat

SEQ ID NO: 412 - protein, 11 aa, Artificial Sequence
  Description of Artificial Sequence: Synthetic peptide
RASQSISSYLN

SEQ ID NO: 413 - DNA, 33 bp, Artificial Sequence; identical to SEQ ID NO: 109
  Description of Artificial Sequence: Synthetic oligonucleotide

SEQ ID NO: 414 - protein, 11 aa, Artificial Sequence
  Description of Artificial Sequence: Synthetic peptide
RASQGIRNDLG

SEQ ID NO: 415 - DNA, 33 bp, Artificial Sequence; identical to SEQ ID NO: 283
  Description of Artificial Sequence: Synthetic oligonucleotide

SEQ ID NO: 416 - protein, 11 aa, Artificial Sequence
  Description of Artificial Sequence: Synthetic peptide
RASQDISNYLA

SEQ ID NO: 417 - DNA, 33 bp, Artificial Sequence; identical to SEQ ID NO: 109
  Description of Artificial Sequence: Synthetic oligonucleotide

SEQ ID NO: 418 - protein, 11 aa, Artificial Sequence
  Description of Artificial Sequence: Synthetic peptide
RASQGIRNDLG

SEQ ID NO: 419 - DNA, 48 bp, Artificial Sequence
  Description of Artificial Sequence: Synthetic oligonucleotide
aagtctagtcagagcctcctgcatagtgatggaaagacctttttgtat

SEQ ID NO: 420 - protein, 16 aa, Artificial Sequence
  Description of Artificial Sequence: Synthetic peptide
KSSQSLLHSDGKTFLY

SEQ ID NO: 421 - DNA, 36 bp, Artificial Sequence
  Description of Artificial Sequence: Synthetic oligonucleotide
agggccagtcagaatgtttacagcagctacttagcc

SEQ ID NO: 422 - protein, 12 aa, Artificial Sequence
  Description of Artificial Sequence: Synthetic peptide
RASQNVYSSYLA

SEQ ID NO: 423 - DNA, 33 bp, Artificial Sequence; identical to SEQ ID NO: 371
  Description of Artificial Sequence: Synthetic oligonucleotide

SEQ ID NO: 424 - protein, 11 aa, Artificial Sequence
  Description of Artificial Sequence: Synthetic peptide
RASQGIRNDLD

SEQ ID NO: 425 - DNA, 33 bp, Artificial Sequence
  Description of Artificial Sequence: Synthetic oligonucleotide
caggcgagtcaggacattaacaactatttaaat

SEQ ID NO: 426 - protein, 11 aa, Artificial Sequence
  Description of Artificial Sequence: Synthetic peptide
QASQDINNYLN

SEQ ID NO: 427 - DNA, 33 bp, Artificial Sequence; identical to SEQ ID NO: 109
  Description of Artificial Sequence: Synthetic oligonucleotide

SEQ ID NO: 428 - protein, 11 aa, Artificial Sequence
  Description of Artificial Sequence: Synthetic peptide
RASQGIRNDLG

SEQ ID NO: 429 - DNA, 33 bp, Artificial Sequence
  Description of Artificial Sequence: Synthetic oligonucleotide
cgggcaagtcagggcattggaaatgatttaggc

SEQ ID NO: 430 - protein, 11 aa, Artificial Sequence
  Description of Artificial Sequence: Synthetic peptide
RASQGIGNDLG

SEQ ID NO: 431 - DNA, 33 bp, Artificial Sequence
  Description of Artificial Sequence: Synthetic oligonucleotide
cgggcaagtcagagcattagcgactatttaaat

SEQ ID NO: 432 - protein, 11 aa, Artificial Sequence
  Description of Artificial Sequence: Synthetic peptide
RASQSISDYLN

SEQ ID NO: 433 - DNA, 33 bp, Artificial Sequence; identical to SEQ ID NO: 205
  Description of Artificial Sequence: Synthetic oligonucleotide

SEQ ID NO: 434 - protein, 11 aa, Artificial Sequence
  Description of Artificial Sequence: Synthetic peptide
RASQDIRNDLG

SEQ ID NO: 435 - DNA, 33 bp, Artificial Sequence; identical to SEQ ID NO: 137
  Description of Artificial Sequence: Synthetic oligonucleotide

SEQ ID NO: 436 - protein, 11 aa, Artificial Sequence
  Description of Artificial Sequence: Synthetic peptide
RASQNISSYLN

SEQ ID NO: 437 - DNA, 33 bp, Artificial Sequence; identical to SEQ ID NO: 109
  Description of Artificial Sequence: Synthetic oligonucleotide

SEQ ID NO: 438 - protein, 11 aa, Artificial Sequence
  Description of Artificial Sequence: Synthetic peptide
RASQGIRNDLG

SEQ ID NO: 439 - DNA, 33 bp, Artificial Sequence; identical to SEQ ID NO: 109
  Description of Artificial Sequence: Synthetic oligonucleotide

SEQ ID NO: 440 - protein, 11 aa, Artificial Sequence
  Description of Artificial Sequence: Synthetic peptide
RASQGIRNDLG

SEQ ID NO: 441 - DNA, 33 bp, Artificial Sequence; identical to SEQ ID NO: 109
  Description of Artificial Sequence: Synthetic oligonucleotide

SEQ ID NO: 442 - protein, 11 aa, Artificial Sequence
  Description of Artificial Sequence: Synthetic peptide
RASQGIRNDLG

SEQ ID NO: 443 - DNA, 51 bp, Artificial Sequence
  Description of Artificial Sequence: Synthetic oligonucleotide
aagtccagccagagtgttttatacagctccaacaataacaattatttagct

SEQ ID NO: 444 - protein, 17 aa, Artificial Sequence
  Description of Artificial Sequence: Synthetic peptide
KSSQSVLYSSNNNNYLA

SEQ ID NO: 445 - DNA, 48 bp, Artificial Sequence
  Description of Artificial Sequence: Synthetic oligonucleotide
aagtctagtcagagcctcctacatagtgaaggaaagacctatttgtat

SEQ ID NO: 446 - protein, 16 aa, Artificial Sequence
  Description of Artificial Sequence: Synthetic peptide
KSSQSLLHSEGKTYLY

SEQ ID NO: 447 - DNA, 33 bp, Artificial Sequence; identical to SEQ ID NO: 105
  Description of Artificial Sequence: Synthetic oligonucleotide

SEQ ID NO: 448 - protein, 11 aa, Artificial Sequence
  Description of Artificial Sequence: Synthetic peptide
RASQGISNYLA

SEQ ID NO: 449 - DNA, 33 bp, Artificial Sequence; identical to SEQ ID NO: 283
  Description of Artificial Sequence: Synthetic oligonucleotide

SEQ ID NO: 450 - protein, 11 aa, Artificial Sequence
  Description of Artificial Sequence: Synthetic peptide
RASQDISNYLA

SEQ ID NO: 451 - DNA, 33 bp, Artificial Sequence; identical to SEQ ID NO: 109
  Description of Artificial Sequence: Synthetic oligonucleotide

SEQ ID NO: 452 - protein, 11 aa, Artificial Sequence
  Description of Artificial Sequence: Synthetic peptide
RASQGIRNDLG

SEQ ID NO: 453 - DNA, 33 bp, Artificial Sequence
  Description of Artificial Sequence: Synthetic oligonucleotide
cgggcaagtcagggcgttagaaatgatttaggc

SEQ ID NO: 454 - protein, 11 aa, Artificial Sequence
  Description of Artificial Sequence: Synthetic peptide
RASQGVRNDLG

SEQ ID NO: 455 - DNA, 36 bp, Artificial Sequence
  Description of Artificial Sequence: Synthetic oligonucleotide
agggccagtcagagttttagcagcagctacttagcc

SEQ ID NO: 456 - protein, 12 aa, Artificial Sequence
  Description of Artificial Sequence: Synthetic peptide
RASQSFSSSYLA

SEQ ID NO: 457 - DNA, 33 bp, Artificial Sequence; identical to SEQ ID NO: 109
  Description of Artificial Sequence: Synthetic oligonucleotide

SEQ ID NO: 458 - protein, 11 aa, Artificial Sequence
  Description of Artificial Sequence: Synthetic peptide
RASQGIRNDLG

SEQ ID NO: 459 - DNA, 33 bp, Artificial Sequence
  Description of Artificial Sequence: Synthetic oligonucleotide
cgggcaagtcagaacatttttagttatttaaat

SEQ ID NO: 460 - protein, 11 aa, Artificial Sequence
  Description of Artificial Sequence: Synthetic peptide
RASQNIFSYLN

SEQ ID NO: 461 - DNA, 33 bp, Artificial Sequence; identical to SEQ ID NO: 109
  Description of Artificial Sequence: Synthetic oligonucleotide

SEQ ID NO: 462 - protein, 11 aa, Artificial Sequence
  Description of Artificial Sequence: Synthetic peptide
RASQGIRNDLG

SEQ ID NO: 463 - DNA, 33 bp, Artificial Sequence; identical to SEQ ID NO: 109
  Description of Artificial Sequence: Synthetic oligonucleotide

SEQ ID NO: 464 - protein, 11 aa, Artificial Sequence
  Description of Artificial Sequence: Synthetic peptide
RASQGIRNDLG

SEQ ID NO: 465 - DNA, 33 bp, Artificial Sequence; identical to SEQ ID NO: 109
  Description of Artificial Sequence: Synthetic oligonucleotide

SEQ ID NO: 466 - protein, 11 aa, Artificial Sequence
  Description of Artificial Sequence: Synthetic peptide
RASQGIRNDLG

SEQ ID NO: 467 - DNA, 33 bp, Artificial Sequence; identical to SEQ ID NO: 93
  Description of Artificial Sequence: Synthetic oligonucleotide

SEQ ID NO: 468 - protein, 11 aa, Artificial Sequence
  Description of Artificial Sequence: Synthetic peptide
RTSQGIRNDLG

SEQ ID NO: 469 - DNA, 33 bp, Artificial Sequence; identical to SEQ ID NO: 171
  Description of Artificial Sequence: Synthetic oligonucleotide

SEQ ID NO: 470 - protein, 11 aa, Artificial Sequence
  Description of Artificial Sequence: Synthetic peptide
RASQGISSWLA

SEQ ID NO: 471 - DNA, 33 bp, Artificial Sequence; identical to SEQ ID NO: 109
  Description of Artificial Sequence: Synthetic oligonucleotide

SEQ ID NO: 472 - protein, 11 aa, Artificial Sequence
  Description of Artificial Sequence: Synthetic peptide
RASQGIRNDLG

SEQ ID NO: 473 - DNA, 33 bp, Artificial Sequence; identical to SEQ ID NO: 109
  Description of Artificial Sequence: Synthetic oligonucleotide

SEQ ID NO: 474 - protein, 11 aa, Artificial Sequence
  Description of Artificial Sequence: Synthetic peptide
RASQGIRNDLG

SEQ ID NO: 475 - DNA, 33 bp, Artificial Sequence
  Description of Artificial Sequence: Synthetic oligonucleotide
cgggcaactcagaacattttcagctatttaaat

SEQ ID NO: 476 - protein, 11 aa, Artificial Sequence
  Description of Artificial Sequence: Synthetic peptide
RATQNIFSYLN

SEQ ID NO: 477 - DNA, 48 bp, Artificial Sequence
  Description of Artificial Sequence: Synthetic oligonucleotide
aggtctagtcagagcctcctccatagtgatggaaggacctatttgtat

SEQ ID NO: 478 - protein, 16 aa, Artificial Sequence
  Description of Artificial Sequence: Synthetic peptide
RSSQSLLHSDGRTYLY

SEQ ID NO: 479 - DNA, 51 bp, Artificial Sequence
  Description of Artificial Sequence: Synthetic oligonucleotide
aagtccagccagagtgttttatacagctcccacaataacaactacttagct

SEQ ID NO: 480 - protein, 17 aa, Artificial Sequence
  Description of Artificial Sequence: Synthetic peptide
KSSQSVLYSSHNNNYLA

SEQ ID NO: 481 - DNA, 48 bp, Artificial Sequence
  Description of Artificial Sequence: Synthetic oligonucleotide
aagtctagtcagagcctcctgcatggtgatggaaagacctatttgttt

SEQ ID NO: 482 - protein, 16 aa, Artificial Sequence
  Description of Artificial Sequence: Synthetic peptide
KSSQSLLHGDGKTYLF

SEQ ID NO: 483 - DNA, 33 bp, Artificial Sequence; identical to SEQ ID NO: 109
  Description of Artificial Sequence: Synthetic oligonucleotide

SEQ ID NO: 484 - protein, 11 aa, Artificial Sequence
  Description of Artificial Sequence: Synthetic peptide
RASQGIRNDLG

SEQ ID NO: 485 - DNA, 48 bp, Artificial Sequence
  Description of Artificial Sequence: Synthetic oligonucleotide
cggtctagtcaaagcctcgtatatagtgatggagacacctacttgaat

SEQ ID NO: 486 - protein, 16 aa, Artificial Sequence
  Description of Artificial Sequence: Synthetic peptide
RSSQSLVYSDGDTYLN

SEQ ID NO: 487 - DNA, 48 bp, Artificial Sequence
  Description of Artificial Sequence: Synthetic oligonucleotide
aagtctagtcagagcctcctgcatagtgatggaaagacctatttgtat

SEQ ID NO: 488 - protein, 16 aa, Artificial Sequence
  Description of Artificial Sequence: Synthetic peptide
KSSQSLLHSDGKTYLY

SEQ ID NO: 489 - DNA, 33 bp, Artificial Sequence; identical to SEQ ID NO: 109
  Description of Artificial Sequence: Synthetic oligonucleotide

SEQ ID NO: 490 - protein, 11 aa, Artificial Sequence
  Description of Artificial Sequence: Synthetic peptide
RASQGIRNDLG

SEQ ID NO: 491 - DNA, 33 bp, Artificial Sequence
  Description of Artificial Sequence: Synthetic oligonucleotide
cgggcaagtcaggacattagagatgatttaggc

SEQ ID NO: 492 - protein, 11 aa, Artificial Sequence
  Description of Artificial Sequence: Synthetic peptide
RASQDIRDDLG

SEQ ID NO: 493 - DNA, 33 bp, Artificial Sequence
  Description of Artificial Sequence: Synthetic oligonucleotide
cgggcaagtcaggacattagaagtgatttaggc

SEQ ID NO: 494 - protein, 11 aa, Artificial Sequence
  Description of Artificial Sequence: Synthetic peptide
RASQDIRSDLG

SEQ ID NO: 495 - DNA, 33 bp, Artificial Sequence; identical to SEQ ID NO: 205
  Description of Artificial Sequence: Synthetic oligonucleotide

SEQ ID NO: 496 - protein, 11 aa, Artificial Sequence
  Description of Artificial Sequence: Synthetic peptide
RASQDIRNDLG

SEQ ID NO: 497 - DNA, 33 bp, Artificial Sequence; identical to SEQ ID NO: 105
  Description of Artificial Sequence: Synthetic oligonucleotide

SEQ ID NO: 498 - protein, 11 aa, Artificial Sequence
  Description of Artificial Sequence: Synthetic peptide
RASQGISNYLA

SEQ ID NO: 499 - DNA, 33 bp, Artificial Sequence; identical to SEQ ID NO: 283
  Description of Artificial Sequence: Synthetic oligonucleotide

SEQ ID NO: 500 - protein, 11 aa, Artificial Sequence
  Description of Artificial Sequence: Synthetic peptide
RASQDISNYLA

SEQ ID NO: 501 - DNA, 33 bp, Artificial Sequence
  Description of Artificial Sequence: Synthetic oligonucleotide
cgggcaagtcagagcattagcagctatttaaat

SEQ ID NO: 502 - protein, 11 aa, Artificial Sequence
  Description of Artificial Sequence: Synthetic peptide
RASQSISSYLN

SEQ ID NO: 503 - DNA, 33 bp, Artificial Sequence
  Description of Artificial Sequence: Synthetic oligonucleotide
cgggcgagtcagggtattagtagttggttagcc

SEQ ID NO: 504 - protein, 11 aa, Artificial Sequence
  Description of Artificial Sequence: Synthetic peptide
RASQGISSWLA

SEQ ID NO: 505 - DNA, 33 bp, Artificial Sequence; identical to SEQ ID NO: 109
  Description of Artificial Sequence: Synthetic oligonucleotide

SEQ ID NO: 506 - protein, 11 aa, Artificial Sequence
  Description of Artificial Sequence: Synthetic peptide
RASQGIRNDLG

SEQ ID NO: 507 - DNA, 51 bp, Artificial Sequence
  Description of Artificial Sequence: Synthetic oligonucleotide
aagtccagccagagtgttttatacagctcccacaataactactacttaact

SEQ ID NO: 508 - protein, 17 aa, Artificial Sequence
  Description of Artificial Sequence: Synthetic peptide
KSSQSVLYSSHNNYYLT

SEQ ID NO: 509 - DNA, 33 bp, Artificial Sequence; identical to SEQ ID NO: 105
  Description of Artificial Sequence: Synthetic oligonucleotide

SEQ ID NO: 510 - protein, 11 aa, Artificial Sequence
  Description of Artificial Sequence: Synthetic peptide
RASQGISNYLA

SEQ ID NO: 511 - DNA, 33 bp, Artificial Sequence; identical to SEQ ID NO: 493
  Description of Artificial Sequence: Synthetic oligonucleotide

SEQ ID NO: 512 - protein, 11 aa, Artificial Sequence
  Description of Artificial Sequence: Synthetic peptide
RASQDIRSDLG

SEQ ID NO: 513 - DNA, 33 bp, Artificial Sequence
  Description of Artificial Sequence: Synthetic oligonucleotide
cgggcgagtcaggccattagcaattatttagcc

SEQ ID NO: 514 - protein, 11 aa, Artificial Sequence
  Description of Artificial Sequence: Synthetic peptide
RASQAISNYLA

SEQ ID NO: 515 - DNA, 33 bp, Artificial Sequence; identical to SEQ ID NO: 109
  Description of Artificial Sequence: Synthetic oligonucleotide

SEQ ID NO: 516 - protein, 11 aa, Artificial Sequence
  Description of Artificial Sequence: Synthetic peptide
RASQGIRNDLG

SEQ ID NO: 517 - DNA, 33 bp, Artificial Sequence; identical to SEQ ID NO: 133
  Description of Artificial Sequence: Synthetic oligonucleotide

SEQ ID NO: 518 - protein, 11 aa, Artificial Sequence
  Description of Artificial Sequence: Synthetic peptide
RASQGIRSDLG

SEQ ID NO: 519 - DNA, 33 bp, Artificial Sequence
  Description of Artificial Sequence: Synthetic oligonucleotide
cgggcaagtcaggccattagaaatgatttaggc

SEQ ID NO: 520 - protein, 11 aa, Artificial Sequence
  Description of Artificial Sequence: Synthetic peptide
RASQAIRNDLG

SEQ ID NO: 521 - DNA, 33 bp, Artificial Sequence; identical to SEQ ID NO: 105
  Description of Artificial Sequence: Synthetic oligonucleotide

SEQ ID NO: 522 - protein, 11 aa, Artificial Sequence
  Description of Artificial Sequence: Synthetic peptide
RASQGISNYLA

SEQ ID NO: 523 - DNA, 33 bp, Artificial Sequence; identical to SEQ ID NO: 109
  Description of Artificial Sequence: Synthetic oligonucleotide

SEQ ID NO: 524 - protein, 11 aa, Artificial Sequence
  Description of Artificial Sequence: Synthetic peptide
RASQGIRNDLG

SEQ ID NO: 525 - DNA, 33 bp, Artificial Sequence; identical to SEQ ID NO: 109
  Description of Artificial Sequence: Synthetic oligonucleotide

SEQ ID NO: 526 - protein, 11 aa, Artificial Sequence
  Description of Artificial Sequence: Synthetic peptide
RASQGIRNDLG

SEQ ID NO: 527 - DNA, 33 bp, Artificial Sequence; identical to SEQ ID NO: 493
  Description of Artificial Sequence: Synthetic oligonucleotide

SEQ ID NO: 528 - protein, 11 aa, Artificial Sequence
  Description of Artificial Sequence: Synthetic peptide
RASQDIRSDLG

SEQ ID NO: 529 - DNA, 33 bp, Artificial Sequence
  Description of Artificial Sequence: Synthetic oligonucleotide
cgggcaagtcagagcattagcaactatttaaat

SEQ ID NO: 530 - protein, 11 aa, Artificial Sequence
  Description of Artificial Sequence: Synthetic peptide
RASQSISNYLN

SEQ ID NO: 531 - DNA, 33 bp, Artificial Sequence; identical to SEQ ID NO: 493
  Description of Artificial Sequence: Synthetic oligonucleotide

SEQ ID NO: 532 - protein, 11 aa, Artificial Sequence
  Description of Artificial Sequence: Synthetic peptide
RASQDIRSDLG

SEQ ID NO: 533 - DNA, 33 bp, Artificial Sequence; identical to SEQ ID NO: 109
  Description of Artificial Sequence: Synthetic oligonucleotide

SEQ ID NO: 534 - protein, 11 aa, Artificial Sequence
  Description of Artificial Sequence: Synthetic peptide
RASQGIRNDLG

SEQ ID NO: 535 - DNA, 33 bp, Artificial Sequence
  Description of Artificial Sequence: Synthetic oligonucleotide
cgggcaagtcggggcattagaaatgatttaggc

SEQ ID NO: 536 - protein, 11 aa, Artificial Sequence
  Description of Artificial Sequence: Synthetic peptide
RASRGIRNDLG

SEQ ID NO: 537 - DNA, 51 bp, Artificial Sequence
  Description of Artificial Sequence: Synthetic oligonucleotide
aagtccagccagagtgttttataccgctccaacaattacaactacttagct

SEQ ID NO: 538 - protein, 17 aa, Artificial Sequence
  Description of Artificial Sequence: Synthetic peptide
KSSQSVLYRSNNYNYLA

SEQ ID NO: 539 - DNA, 48 bp, Artificial Sequence
  Description of Artificial Sequence: Synthetic oligonucleotide
aagtctagtcagaccctcctgcatggtgaaggaaagacctatttgtat

SEQ ID NO: 540 - protein, 16 aa, Artificial Sequence
  Description of Artificial Sequence: Synthetic peptide
KSSQTLLHGEGKTYLY

SEQ ID NO: 541 - DNA, 33 bp, Artificial Sequence
  Description of Artificial Sequence: Synthetic oligonucleotide
cgggcgagtcaggctatcaatgactggttagcc

SEQ ID NO: 542 - protein, 11 aa, Artificial Sequence
  Description of Artificial Sequence: Synthetic peptide
RASQAINDWLA

SEQ ID NO: 543 - DNA, 33 bp, Artificial Sequence; identical to SEQ ID NO: 109
  Description of Artificial Sequence: Synthetic oligonucleotide

SEQ ID NO: 544 - protein, 11 aa, Artificial Sequence
  Description of Artificial Sequence: Synthetic peptide
RASQGIRNDLG

SEQ ID NO: 545 - DNA, 33 bp, Artificial Sequence; identical to SEQ ID NO: 109
  Description of Artificial Sequence: Synthetic oligonucleotide

SEQ ID NO: 546 - protein, 11 aa, Artificial Sequence
  Description of Artificial Sequence: Synthetic peptide
RASQGIRNDLG

SEQ ID NO: 547 - DNA, 33 bp, Artificial Sequence
  Description of Artificial Sequence: Synthetic oligonucleotide
cgggcaagtcagaacatttacagctatttaaat

SEQ ID NO: 548 - protein, 11 aa, Artificial Sequence
  Description of Artificial Sequence: Synthetic peptide
RASQNIYSYLN

SEQ ID NO: 549 - DNA, 33 bp, Artificial Sequence; identical to SEQ ID NO: 493
  Description of Artificial Sequence: Synthetic oligonucleotide

SEQ ID NO: 550 - protein, 11 aa, Artificial Sequence
  Description of Artificial Sequence: Synthetic peptide
RASQDIRSDLG

SEQ ID NO: 551 - DNA, 33 bp, Artificial Sequence; identical to SEQ ID NO: 109
  Description of Artificial Sequence: Synthetic oligonucleotide

SEQ ID NO: 552 - protein, 11 aa, Artificial Sequence
  Description of Artificial Sequence: Synthetic peptide
RASQGIRNDLG

SEQ ID NO: 553 - DNA, 33 bp, Artificial Sequence
  Description of Artificial Sequence: Synthetic oligonucleotide
cgggcgagtcagggtattagcaactggttagcc

SEQ ID NO: 554 - protein, 11 aa, Artificial Sequence
  Description of Artificial Sequence: Synthetic peptide
RASQGISNWLA

SEQ ID NO: 555 - DNA, 48 bp, Artificial Sequence
  Description of Artificial Sequence: Synthetic oligonucleotide
aagtctagtcagagcctcctgcatagtgagggaaagacctatttgtat

SEQ ID NO: 556 - protein, 16 aa, Artificial Sequence
  Description of Artificial Sequence: Synthetic peptide
KSSQSLLHSEGKTYLY

SEQ ID NO: 557 - DNA, 33 bp, Artificial Sequence; identical to SEQ ID NO: 503
  Description of Artificial Sequence: Synthetic oligonucleotide

SEQ ID NO: 558 - protein, 11 aa, Artificial Sequence
  Description of Artificial Sequence: Synthetic peptide
RASQGISSWLA

SEQ ID NO: 559 - DNA, 33 bp, Artificial Sequence; identical to SEQ ID NO: 553
  Description of Artificial Sequence: Synthetic oligonucleotide

SEQ ID NO: 560 - protein, 11 aa, Artificial Sequence
  Description of Artificial Sequence: Synthetic peptide
RASQGISNWLA

SEQ ID NO: 561 - DNA, 33 bp, Artificial Sequence; identical to SEQ ID NO: 109
  Description of Artificial Sequence: Synthetic oligonucleotide

SEQ ID NO: 562 - protein, 11 aa, Artificial Sequence
  Description of Artificial Sequence: Synthetic peptide
RASQGIRNDLG

SEQ ID NO: 563 - DNA, 33 bp, Artificial Sequence
  Description of Artificial Sequence: Synthetic oligonucleotide
caggcgagtcagtacattagcaactatttaaat

SEQ ID NO: 564 - protein, 11 aa, Artificial Sequence
  Description of Artificial Sequence: Synthetic peptide
QASQYISNYLN

SEQ ID NO: 565 - DNA, 33 bp, Artificial Sequence; identical to SEQ ID NO: 109
  Description of Artificial Sequence: Synthetic oligonucleotide

SEQ ID NO: 566 - protein, 11 aa, Artificial Sequence
  Description of Artificial Sequence: Synthetic peptide
RASQGIRNDLG

SEQ ID NO: 567 - DNA, 33 bp, Artificial Sequence
  Description of Artificial Sequence: Synthetic oligonucleotide
cgggcgagtcagggtattaccagctggttaact

SEQ ID NO: 568 - protein, 11 aa, Artificial Sequence
  Description of Artificial Sequence: Synthetic peptide
RASQGITSWLT

SEQ ID NO: 569 - DNA, 33 bp, Artificial Sequence; identical to SEQ ID NO: 109
  Description of Artificial Sequence: Synthetic oligonucleotide

SEQ ID NO: 570 - protein, 11 aa, Artificial Sequence
  Description of Artificial Sequence: Synthetic peptide
RASQGIRNDLG

SEQ ID NO: 571 - DNA, 33 bp, Artificial Sequence
  Description of Artificial Sequence: Synthetic oligonucleotide
cgggcgagtcaggatattttcgactggttagcc

SEQ ID NO: 572 - protein, 11 aa, Artificial Sequence
  Description of Artificial Sequence: Synthetic peptide
RASQDIFDWLA

SEQ ID NO: 573 - DNA, 33 bp, Artificial Sequence; identical to SEQ ID NO: 281
  Description of Artificial Sequence: Synthetic oligonucleotide

SEQ ID NO: 574 - protein, 11 aa, Artificial Sequence
  Description of Artificial Sequence: Synthetic peptide
RASQGIRTDLG

SEQ ID NO: 575 - DNA, 48 bp, Artificial Sequence
  Description of Artificial Sequence: Synthetic oligonucleotide
aagtctagtcagagcctcctgcatggtgatggaaagacctatttgtat

SEQ ID NO: 576 - protein, 16 aa, Artificial Sequence
  Description of Artificial Sequence: Synthetic peptide
KSSQSLLHGDGKTYLY

SEQ ID NO: 577 - DNA, 33 bp, Artificial Sequence; identical to SEQ ID NO: 109
  Description of Artificial Sequence: Synthetic oligonucleotide

SEQ ID NO: 578 - protein, 11 aa, Artificial Sequence
  Description of Artificial Sequence: Synthetic peptide
RASQGIRNDLG

SEQ ID NO: 579 - DNA, 48 bp, Artificial Sequence
  Description of Artificial Sequence: Synthetic oligonucleotide
aagtctagtcagagcctcctacatggtgatggaaagacctatttgtat

SEQ ID NO: 580 - protein, 16 aa, Artificial Sequence
  Description of Artificial Sequence: Synthetic peptide
KSSQSLLHGDGKTYLY

SEQ ID NO: 581 - DNA, 33 bp, Artificial Sequence; identical to SEQ ID NO: 109
  Description of Artificial Sequence: Synthetic oligonucleotide

SEQ ID NO: 582 - protein, 11 aa, Artificial Sequence
  Description of Artificial Sequence: Synthetic peptide
RASQGIRNDLG

SEQ ID NO: 583 - DNA, 33 bp, Artificial Sequence; identical to SEQ ID NO: 491
  Description of Artificial Sequence: Synthetic oligonucleotide

SEQ ID NO: 584 - protein, 11 aa, Artificial Sequence
  Description of Artificial Sequence: Synthetic peptide
RASQDIRDDLG

SEQ ID NO: 585 - DNA, 33 bp, Artificial Sequence
  Description of Artificial Sequence: Synthetic oligonucleotide
cgggcaagtcagaggattagcagctatttaaat

SEQ ID NO: 586 - protein, 11 aa, Artificial Sequence
  Description of Artificial Sequence: Synthetic peptide
RASQRISSYLN

SEQ ID NO: 587 - DNA, 33 bp, Artificial Sequence
  Description of Artificial Sequence: Synthetic oligonucleotide
agggccagtcagagtgttagaagtaatttagcc

SEQ ID NO: 588 - protein, 11 aa, Artificial Sequence
  Description of Artificial Sequence: Synthetic peptide
RASQSVRSNLA

SEQ ID NO: 589 - DNA, 33 bp, Artificial Sequence
  Description of Artificial Sequence: Synthetic oligonucleotide
cgggcaagtcaggccattagagatgatttaggc

SEQ ID NO: 590 - protein, 11 aa, Artificial Sequence
  Description of Artificial Sequence: Synthetic peptide
RASQAIRDDLG

SEQ ID NO: 591 - DNA, 33 bp, Artificial Sequence; identical to SEQ ID NO: 109
  Description of Artificial Sequence: Synthetic oligonucleotide

SEQ ID NO: 592 - protein, 11 aa, Artificial Sequence
  Description of Artificial Sequence: Synthetic peptide
RASQGIRNDLG

SEQ ID NO: 593 - DNA, 33 bp, Artificial Sequence; identical to SEQ ID NO: 301
  Description of Artificial Sequence: Synthetic oligonucleotide

SEQ ID NO: 594 - protein, 11 aa, Artificial Sequence
  Description of Artificial Sequence: Synthetic peptide
RASQSVSSNLA

SEQ ID NO: 595 - DNA, 33 bp, Artificial Sequence; identical to SEQ ID NO: 109
  Description of Artificial Sequence: Synthetic oligonucleotide

SEQ ID NO: 596 - protein, 11 aa, Artificial Sequence
  Description of Artificial Sequence: Synthetic peptide
RASQGIRNDLG

SEQ ID NO: 597 - DNA, 33 bp, Artificial Sequence; identical to SEQ ID NO: 109
  Description of Artificial Sequence: Synthetic oligonucleotide

SEQ ID NO: 598 - protein, 11 aa, Artificial Sequence
  Description of Artificial Sequence: Synthetic peptide
RASQGIRNDLG

SEQ ID NO: 599 - DNA, 33 bp, Artificial Sequence; identical to SEQ ID NO: 491
  Description of Artificial Sequence: Synthetic oligonucleotide

SEQ ID NO: 600 - protein, 11 aa, Artificial Sequence
  Description of Artificial Sequence: Synthetic peptide
RASQDIRDDLG

SEQ ID NO: 601 - DNA, 33 bp, Artificial Sequence; identical to SEQ ID NO: 493
  Description of Artificial Sequence: Synthetic oligonucleotide

SEQ ID NO: 602 - protein, 11 aa, Artificial Sequence
  Description of Artificial Sequence: Synthetic peptide
RASQDIRSDLG

SEQ ID NO: 603 - DNA, 33 bp, Artificial Sequence
  Description of Artificial Sequence: Synthetic oligonucleotide
caggcgagtcaggacatttccaactttttaaat

SEQ ID NO: 604 - protein, 11 aa, Artificial Sequence
  Description of Artificial Sequence: Synthetic peptide
QASQDISNFLN

SEQ ID NO: 605 - DNA, 33 bp, Artificial Sequence
  Description of Artificial Sequence: Synthetic oligonucleotide
cgggcaagtcagagcattagcaggtatttaagt

SEQ ID NO: 606 - protein, 11 aa, Artificial Sequence
  Description of Artificial Sequence: Synthetic peptide
RASQSISRYLS

SEQ ID NO: 607 - DNA, 33 bp, Artificial Sequence; identical to SEQ ID NO: 547
  Description of Artificial Sequence: Synthetic oligonucleotide

SEQ ID NO: 608 - protein, 11 aa, Artificial Sequence
  Description of Artificial Sequence: Synthetic peptide
RASQNIYSYLN

SEQ ID NO: 609 - DNA, 33 bp, Artificial Sequence; identical to SEQ ID NO: 493
  Description of Artificial Sequence: Synthetic oligonucleotide

SEQ ID NO: 610 - protein, 11 aa, Artificial Sequence
  Description of Artificial Sequence: Synthetic peptide
RASQDIRSDLG

SEQ ID NO: 611 - DNA, 33 bp, Artificial Sequence; identical to SEQ ID NO: 493
  Description of Artificial Sequence: Synthetic oligonucleotide

SEQ ID NO: 612 - protein, 11 aa, Artificial Sequence
  Description of Artificial Sequence: Synthetic peptide
RASQDIRSDLG

SEQ ID NO: 613 - DNA, 33 bp, Artificial Sequence; identical to SEQ ID NO: 93
  Description of Artificial Sequence: Synthetic oligonucleotide

SEQ ID NO: 614 - protein, 11 aa, Artificial Sequence
  Description of Artificial Sequence: Synthetic peptide
RTSQGIRNDLG

SEQ ID NO: 615 - DNA, 33 bp, Artificial Sequence
  Description of Artificial Sequence: Synthetic oligonucleotide
cgggcaagtcaggacattagaaatgatgtaggc

SEQ ID NO: 616 - protein, 11 aa, Artificial Sequence
  Description of Artificial Sequence: Synthetic peptide
RASQDIRNDVG

SEQ ID NO: 617 - DNA, 33 bp, Artificial Sequence
  Description of Artificial Sequence: Synthetic oligonucleotide
tgggcgagtcagggcattaacagttatttagcc

SEQ ID NO: 618 - protein, 11 aa, Artificial Sequence
  Description of Artificial Sequence: Synthetic peptide
WASQGINSYLA

SEQ ID NO: 619 - DNA, 33 bp, Artificial Sequence
  Description of Artificial Sequence: Synthetic oligonucleotide
cgggcgagtcagggtattagtaagtggttagcc

SEQ ID NO: 620 - protein, 11 aa, Artificial Sequence
  Description of Artificial Sequence: Synthetic peptide
RASQGISKWLA

SEQ ID NO: 621 - DNA, 33 bp, Artificial Sequence
  Description of Artificial Sequence: Synthetic oligonucleotide
cgggcaagtcagaacattaggaactttttaaat

SEQ ID NO: 622 - protein, 11 aa, Artificial Sequence
  Description of Artificial Sequence: Synthetic peptide
RASQNIRNFLN

SEQ ID NO: 623 - DNA, 33 bp, Artificial Sequence; identical to SEQ ID NO: 95
  Description of Artificial Sequence: Synthetic oligonucleotide

SEQ ID NO: 624 - protein, 11 aa, Artificial Sequence
  Description of Artificial Sequence: Synthetic peptide
RASQGISKWLA

SEQ ID NO: 625 - DNA, 33 bp, Artificial Sequence
  Description of Artificial Sequence: Synthetic oligonucleotide
cgggcgagtcagggtattagcagatggttagcc

SEQ ID NO: 626 - protein, 11 aa, Artificial Sequence
  Description of Artificial Sequence: Synthetic peptide
RASQGISRWLA

SEQ ID NO: 627 - DNA, 51 bp, Artificial Sequence
  Description of Artificial Sequence: Synthetic oligonucleotide
aagtccatccagagtgttttatacagatccaacaataagaactacttaact

SEQ ID NO: 628 - protein, 17 aa, Artificial Sequence
  Description of Artificial Sequence: Synthetic peptide
KSIQSVLYRSNNKNYLT

SEQ ID NO: 629 - DNA, 33 bp, Artificial Sequence
  Description of Artificial Sequence: Synthetic oligonucleotide
cgggcgagtcagggcattagcaattacttagcc

SEQ ID NO: 630 - protein, 11 aa, Artificial Sequence
  Description of Artificial Sequence: Synthetic peptide
RASQGISNYLA

SEQ ID NO: 631 - DNA, 33 bp, Artificial Sequence; identical to SEQ ID NO: 305
  Description of Artificial Sequence: Synthetic oligonucleotide

SEQ ID NO: 632 - protein, 11 aa, Artificial Sequence
  Description of Artificial Sequence: Synthetic peptide
RASQSIISYLN

SEQ ID NO: 633 - DNA, 33 bp, Artificial Sequence; identical to SEQ ID NO: 109
  Description of Artificial Sequence: Synthetic oligonucleotide

SEQ ID NO: 634 - protein, 11 aa, Artificial Sequence
  Description of Artificial Sequence: Synthetic peptide
RASQGIRNDLG

SEQ ID NO: 635 - DNA, 33 bp, Artificial Sequence; identical to SEQ ID NO: 493
  Description of Artificial Sequence: Synthetic oligonucleotide

SEQ ID NO: 636 - protein, 11 aa, Artificial Sequence
  Description of Artificial Sequence: Synthetic peptide
RASQDIRSDLG

SEQ ID NO: 637 - DNA, 33 bp, Artificial Sequence
  Description of Artificial Sequence: Synthetic oligonucleotide
cgggcgagtcagggtattagccggtggttagcc

SEQ ID NO: 638 - protein, 11 aa, Artificial Sequence
  Description of Artificial Sequence: Synthetic peptide
RASQGISRWLA

SEQ ID NO: 639 - DNA, 33 bp, Artificial Sequence; identical to SEQ ID NO: 305
  Description of Artificial Sequence: Synthetic oligonucleotide

SEQ ID NO: 640 - protein, 11 aa, Artificial Sequence
  Description of Artificial Sequence: Synthetic peptide
RASQSIISYLN

SEQ ID NO: 641 - DNA, 33 bp, Artificial Sequence
  Description of Artificial Sequence: Synthetic oligonucleotide
cggacaagtcaggacattagaagtgatttaggc

SEQ ID NO: 642 - protein, 11 aa, Artificial Sequence
  Description of Artificial Sequence: Synthetic peptide
RTSQDIRSDLG

SEQ ID NO: 643 - DNA, 33 bp, Artificial Sequence; identical to SEQ ID NO: 493
  Description of Artificial Sequence: Synthetic oligonucleotide

SEQ ID NO: 644 - protein, 11 aa, Artificial Sequence
  Description of Artificial Sequence: Synthetic peptide
RASQDIRSDLG

SEQ ID NO: 645 - DNA, 33 bp, Artificial Sequence
  Description of Artificial Sequence: Synthetic oligonucleotide
cggacaagtcaggacatcagaaatgatttaggc

SEQ ID NO: 646 - protein, 11 aa, Artificial Sequence
  Description of Artificial Sequence: Synthetic peptide
RTSQDIRNDLG

SEQ ID NO: 647 - DNA, 33 bp, Artificial Sequence
  Description of Artificial Sequence: Synthetic oligonucleotide
cgggcaagtcagaacattaacaggtatttaaat

SEQ ID NO: 648 - protein, 11 aa, Artificial Sequence
  Description of Artificial Sequence: Synthetic peptide
RASQNINRYLN

SEQ ID NO: 649 - DNA, 33 bp, Artificial Sequence; identical to SEQ ID NO: 493
  Description of Artificial Sequence: Synthetic oligonucleotide

SEQ ID NO: 650 - protein, 11 aa, Artificial Sequence
  Description of Artificial Sequence: Synthetic peptide
RASQDIRSDLG

SEQ ID NO: 651 - DNA, 33 bp, Artificial Sequence; identical to SEQ ID NO: 173
  Description of Artificial Sequence: Synthetic oligonucleotide

SEQ ID NO: 652 - protein, 11 aa, Artificial Sequence
  Description of Artificial Sequence: Synthetic peptide
RASQGISRWLA

SEQ ID NO: 653 - DNA, 33 bp, Artificial Sequence; identical to SEQ ID NO: 529
  Description of Artificial Sequence: Synthetic oligonucleotide

SEQ ID NO: 654 - protein, 11 aa, Artificial Sequence
  Description of Artificial Sequence: Synthetic peptide
RASQSISNYLN

SEQ ID NO: 655 - DNA, 33 bp, Artificial Sequence
  Description of Artificial Sequence: Synthetic oligonucleotide
cgggcgagtcagcttattagcaagtggttagcc

SEQ ID NO: 656 - protein, 11 aa, Artificial Sequence
  Description of Artificial Sequence: Synthetic peptide
RASQLISKWLA

SEQ ID NO: 657 - DNA, 33 bp, Artificial Sequence; identical to SEQ ID NO: 205
  Description of Artificial Sequence: Synthetic oligonucleotide

SEQ ID NO: 658 - protein, 11 aa, Artificial Sequence
  Description of Artificial Sequence: Synthetic peptide
RASQDIRNDLG

SEQ ID NO: 659 - DNA, 33 bp, Artificial Sequence
  Description of Artificial Sequence: Synthetic oligonucleotide
cgggcgagtcaggccattagtaattatttagcc

SEQ ID NO: 660 - protein, 11 aa, Artificial Sequence
  Description of Artificial Sequence: Synthetic peptide
RASQAISNYLA

SEQ ID NO: 661 - DNA, 33 bp, Artificial Sequence; identical to SEQ ID NO: 305
  Description of Artificial Sequence: Synthetic oligonucleotide

SEQ ID NO: 662 - protein, 11 aa, Artificial Sequence
  Description of Artificial Sequence: Synthetic peptide
RASQSIISYLN

SEQ ID NO: 663 - DNA, 33 bp, Artificial Sequence; identical to SEQ ID NO: 109
  Description of Artificial Sequence: Synthetic oligonucleotide

SEQ ID NO: 664 - protein, 11 aa, Artificial Sequence
  Description of Artificial Sequence: Synthetic peptide
RASQGIRNDLG

SEQ ID NO: 665 - DNA, 33 bp, Artificial Sequence; identical to SEQ ID NO: 493
  Description of Artificial Sequence: Synthetic oligonucleotide

SEQ ID NO: 666 - protein, 11 aa, Artificial Sequence
  Description of Artificial Sequence: Synthetic peptide
RASQDIRSDLG

SEQ ID NO: 667 - DNA, 33 bp, Artificial Sequence; identical to SEQ ID NO: 493
  Description of Artificial Sequence: Synthetic oligonucleotide

SEQ ID NO: 668 - protein, 11 aa, Artificial Sequence
  Description of Artificial Sequence: Synthetic peptide
RASQDIRSDLG

SEQ ID NO: 669 - DNA, 33 bp, Artificial Sequence; identical to SEQ ID NO: 109
  Description of Artificial Sequence: Synthetic oligonucleotide

SEQ ID NO: 670 - protein, 11 aa, Artificial Sequence
  Description of Artificial Sequence: Synthetic peptide
RASQGIRNDLG

SEQ ID NO: 671 - DNA, 33 bp, Artificial Sequence; identical to SEQ ID NO: 637
  Description of Artificial Sequence: Synthetic oligonucleotide

SEQ ID NO: 672 - protein, 11 aa, Artificial Sequence
  Description of Artificial Sequence: Synthetic peptide
RASQGISRWLA

SEQ ID NO: 673 - DNA, 33 bp, Artificial Sequence
  Description of Artificial Sequence: Synthetic oligonucleotide
cgggcaagtcagagaattatcagctatttaaat

SEQ ID NO: 674 - protein, 11 aa, Artificial Sequence
  Description of Artificial Sequence: Synthetic peptide
RASQRIISYLN

SEQ ID NO: 675 - DNA, 33 bp, Artificial Sequence
  Description of Artificial Sequence: Synthetic oligonucleotide
cgggcaagtcagatcattatcagctatttaaat

SEQ ID NO: 676 - protein, 11 aa, Artificial Sequence
  Description of Artificial Sequence: Synthetic peptide
RASQIIISYLN

SEQ ID NO: 677 - DNA, 33 bp, Artificial Sequence
  Description of Artificial Sequence: Synthetic oligonucleotide
caggcgagtcaggacattttcaactatttaaat

SEQ ID NO: 678 - protein, 11 aa, Artificial Sequence
  Description of Artificial Sequence: Synthetic peptide
QASQDIFNYLN

SEQ ID NO: 679 - DNA, 33 bp, Artificial Sequence; identical to SEQ ID NO: 625
  Description of Artificial Sequence: Synthetic oligonucleotide

SEQ ID NO: 680 - protein, 11 aa, Artificial Sequence
  Description of Artificial Sequence: Synthetic peptide
RASQGISRWLA

SEQ ID NO: 681 - DNA, 33 bp, Artificial Sequence; identical to SEQ ID NO: 293
  Description of Artificial Sequence: Synthetic oligonucleotide

SEQ ID NO: 682 - protein, 11 aa, Artificial Sequence
  Description of Artificial Sequence: Synthetic peptide
RASQGINNYLA

SEQ ID NO: 683 - DNA, 48 bp, Artificial Sequence; identical to SEQ ID NO: 487
  Description of Artificial Sequence: Synthetic oligonucleotide

SEQ ID NO: 684 - protein, 16 aa, Artificial Sequence
  Description of Artificial Sequence: Synthetic peptide
KSSQSLLHSDGKTYLY

SEQ ID NO: 685 - DNA, 33 bp, Artificial Sequence; identical to SEQ ID NO: 493
  Description of Artificial Sequence: Synthetic oligonucleotide

SEQ ID NO: 686 - protein, 11 aa, Artificial Sequence
  Description of Artificial Sequence: Synthetic peptide
RASQDIRSDLG

SEQ ID NO: 687 - DNA, 33 bp, Artificial Sequence; identical to SEQ ID NO: 501
  Description of Artificial Sequence: Synthetic oligonucleotide

SEQ ID NO: 688 - protein, 11 aa, Artificial Sequence
  Description of Artificial Sequence: Synthetic peptide
RASQSISSYLN

SEQ ID NO: 689 - DNA, 33 bp, Artificial Sequence
  Description of Artificial Sequence: Synthetic oligonucleotide
cggacaagtcaggacattagaaatgatttaggc

SEQ ID NO: 690 - protein, 11 aa, Artificial Sequence
  Description of Artificial Sequence: Synthetic peptide
RTSQDIRNDLG

SEQ ID NO: 691 - DNA, 33 bp, Artificial Sequence; identical to SEQ ID NO: 171
  Description of Artificial Sequence: Synthetic oligonucleotide

SEQ ID NO: 692 - protein, 11 aa, Artificial Sequence
  Description of Artificial Sequence: Synthetic peptide
RASQGISSWLA

SEQ ID NO: 693 - DNA, 33 bp, Artificial Sequence
  Description of Artificial Sequence: Synthetic oligonucleotide
tctggagataaattgggggataaatatgcttgc

SEQ ID NO: 694 - protein, 11 aa, Artificial Sequence
  Description of Artificial Sequence: Synthetic peptide
SGDKLGDKYAC

SEQ ID NO: 695 - DNA, 33 bp, Artificial Sequence; identical to SEQ ID NO: 163
  Description of Artificial Sequence: Synthetic oligonucleotide

SEQ ID NO: 696 - protein, 11 aa, Artificial Sequence
  Description of Artificial Sequence: Synthetic peptide
SGDKLGDKYAY

SEQ ID NO: 697 - DNA, 33 bp, Artificial Sequence
  Description of Artificial Sequence: Synthetic oligonucleotide
tctggagataaattgggggaaaaatatgcttgc

SEQ ID NO: 698 - protein, 11 aa, Artificial Sequence
  Description of Artificial Sequence: Synthetic peptide
SGDKLGEKYAC

SEQ ID NO: 699 - DNA, 36 bp, Artificial Sequence; identical to SEQ ID NO: 195
  Description of Artificial Sequence: Synthetic oligonucleotide

SEQ ID NO: 700 - protein, 12 aa, Artificial Sequence
  Description of Artificial Sequence: Synthetic peptide
TLSSEHSTYTIE

SEQ ID NO: 701 - DNA, 33 bp, Artificial Sequence
  Description of Artificial Sequence: Synthetic oligonucleotide
tctggagataaattggggaataaatatgcttgc

SEQ ID NO: 702 - protein, 11 aa, Artificial Sequence
  Description of Artificial Sequence: Synthetic peptide
SGDKLGNKYAC

SEQ ID NO: 703 - DNA, 33 bp, Artificial Sequence
  Description of Artificial Sequence: Synthetic oligonucleotide
tctggagataaattgggggagaaatatgcttac

SEQ ID NO: 704 - protein, 11 aa, Artificial Sequence
  Description of Artificial Sequence: Synthetic peptide
SGDKLGEKYAY

SEQ ID NO: 705 - DNA, 39 bp, Artificial Sequence
  Description of Artificial Sequence: Synthetic oligonucleotide
tctggaaccaactccaacatcggaagttatactgtaaac

SEQ ID NO: 706 - protein, 13 aa, Artificial Sequence
  Description of Artificial Sequence: Synthetic peptide
SGTNSNIGSYTVN

SEQ ID NO: 707 - DNA, 33 bp, Artificial Sequence; identical to SEQ ID NO: 693
  Description of Artificial Sequence: Synthetic oligonucleotide

SEQ ID NO: 708 - protein, 11 aa, Artificial Sequence
  Description of Artificial Sequence: Synthetic peptide
SGDKLGDKYAC

SEQ ID NO: 709 - DNA, 33 bp, Artificial Sequence
  Description of Artificial Sequence: Synthetic oligonucleotide
tctggagataaattgggggagaaatatgcttgc

SEQ ID NO: 710 - protein, 11 aa, Artificial Sequence
  Description of Artificial Sequence: Synthetic peptide
SGDKLGEKYAC

SEQ ID NO: 711 - DNA, 33 bp, Artificial Sequence
  Description of Artificial Sequence: Synthetic oligonucleotide
tctggatataaattgggggataaatatgcttgc

SEQ ID NO: 712 - protein, 11 aa, Artificial Sequence
  Description of Artificial Sequence: Synthetic peptide
SGYKLGDKYAC

SEQ ID NO: 713 - DNA, 33 bp, Artificial Sequence
  Description of Artificial Sequence: Synthetic oligonucleotide
tctggagataaattgggggagaaatatgtttcc

SEQ ID NO: 714 - protein, 11 aa, Artificial Sequence
  Description of Artificial Sequence: Synthetic peptide
SGDKLGEKYVS

SEQ ID NO: 715 - DNA, 33 bp, Artificial Sequence; identical to SEQ ID NO: 693
  Description of Artificial Sequence: Synthetic oligonucleotide

SEQ ID NO: 716 - protein, 11 aa, Artificial Sequence
  Description of Artificial Sequence: Synthetic peptide
SGDKLGDKYAC

SEQ ID NO: 717 - DNA, 33 bp, Artificial Sequence; identical to SEQ ID NO: 693
  Description of Artificial Sequence: Synthetic oligonucleotide

SEQ ID NO: 718 - protein, 11 aa, Artificial Sequence
  Description of Artificial Sequence: Synthetic peptide
SGDKLGDKYAC

SEQ ID NO: 719 - DNA, 33 bp, Artificial Sequence; identical to SEQ ID NO: 697
  Description of Artificial Sequence: Synthetic oligonucleotide

SEQ ID NO: 720 - protein, 11 aa, Artificial Sequence
  Description of Artificial Sequence: Synthetic peptide
SGDKLGEKYAC

SEQ ID NO: 721 - DNA, 33 bp, Artificial Sequence; identical to SEQ ID NO: 693
  Description of Artificial Sequence: Synthetic oligonucleotide

SEQ ID NO: 722 - protein, 11 aa, Artificial Sequence
  Description of Artificial Sequence: Synthetic peptide
SGDKLGDKYAC

SEQ ID NO: 723 - DNA, 33 bp, Artificial Sequence
  Description of Artificial Sequence: Synthetic oligonucleotide
tctggagataaattgggggaaaaatatgcttac

SEQ ID NO: 724 - protein, 11 aa, Artificial Sequence
  Description of Artificial Sequence: Synthetic peptide
SGDKLGEKYAY

SEQ ID NO: 725 - DNA, 33 bp, Artificial Sequence; identical to SEQ ID NO: 693
  Description of Artificial Sequence: Synthetic oligonucleotide

SEQ ID NO: 726 - protein, 11 aa, Artificial Sequence
  Description of Artificial Sequence: Synthetic peptide
SGDKLGDKYAC

SEQ ID NO: 727 - DNA, 33 bp, Artificial Sequence; identical to SEQ ID NO: 193
  Description of Artificial Sequence: Synthetic oligonucleotide

SEQ ID NO: 728 - protein, 11 aa, Artificial Sequence
  Description of Artificial Sequence: Synthetic peptide
GGNNIGSKAVH

SEQ ID NO: 729 - DNA, 33 bp, Artificial Sequence; identical to SEQ ID NO: 693
  Description of Artificial Sequence: Synthetic oligonucleotide

SEQ ID NO: 730 - protein, 11 aa, Artificial Sequence
  Description of Artificial Sequence: Synthetic peptide
SGDKLGDKYAC

SEQ ID NO: 731 - DNA, 33 bp, Artificial Sequence
  Description of Artificial Sequence: Synthetic oligonucleotide
gggggaaacaacattggaagtaaaagtgtgcac

SEQ ID NO: 732 - protein, 11 aa, Artificial Sequence
  Description of Artificial Sequence: Synthetic peptide
GGNNIGSKSVH

SEQ ID NO: 733 - DNA, 33 bp, Artificial Sequence; identical to SEQ ID NO: 177
  Description of Artificial Sequence: Synthetic oligonucleotide

SEQ ID NO: 734 - protein, 11 aa, Artificial Sequence
  Description of Artificial Sequence: Synthetic peptide
SGDKLGDKYVY

SEQ ID NO: 735 - DNA, 33 bp, Artificial Sequence
  Description of Artificial Sequence: Synthetic oligonucleotide
tctggagataaattgggtaataaatatgcttgc

SEQ ID NO: 736 - protein, 11 aa, Artificial Sequence
  Description of Artificial Sequence: Synthetic peptide
SGDKLGNKYAC

SEQ ID NO: 737 - DNA, 33 bp, Artificial Sequence
  Description of Artificial Sequence: Synthetic oligonucleotide
tctggagataaattgggggataaatttgtttat

SEQ ID NO: 738 - protein, 11 aa, Artificial Sequence
  Description of Artificial Sequence: Synthetic peptide
SGDKLGDKFVY

SEQ ID NO: 739 - DNA, 33 bp, Artificial Sequence
  Description of Artificial Sequence: Synthetic oligonucleotide
tctggagataaattgggggataaatatgtttgc

SEQ ID NO: 740 - protein, 11 aa, Artificial Sequence
  Description of Artificial Sequence: Synthetic peptide
SGDKLGDKYVC

SEQ ID NO: 741 - DNA, 33 bp, Artificial Sequence; identical to SEQ ID NO: 697
  Description of Artificial Sequence: Synthetic oligonucleotide

SEQ ID NO: 742 - protein, 11 aa, Artificial Sequence
  Description of Artificial Sequence: Synthetic peptide
SGDKLGEKYAC

SEQ ID NO: 743 - DNA, 33 bp, Artificial Sequence
  Description of Artificial Sequence: Synthetic oligonucleotide
tctggagataaattgggaaataaatatgcttgc

SEQ ID NO: 744 - protein, 11 aa, Artificial Sequence
  Description of Artificial Sequence: Synthetic peptide
SGDKLGNKYAC

SEQ ID NO: 745 - DNA, 33 bp, Artificial Sequence; identical to SEQ ID NO: 163
  Description of Artificial Sequence: Synthetic oligonucleotide

SEQ ID NO: 746 - protein, 11 aa, Artificial Sequence
  Description of Artificial Sequence: Synthetic peptide
SGDKLGDKYAY

SEQ ID NO: 747 - DNA, 39 bp, Artificial Sequence; identical to SEQ ID NO: 705
  Description of Artificial Sequence: Synthetic oligonucleotide

SEQ ID NO: 748 - protein, 13 aa, Artificial Sequence
  Description of Artificial Sequence: Synthetic peptide
SGTNSNIGSYTVN

SEQ ID NO: 749 - DNA, 42 bp, Artificial Sequence
  Description of Artificial Sequence: Synthetic oligonucleotide
actggagccagcagtgacgttggtgattataactctgtctcc

SEQ ID NO: 750 - protein, 14 aa, Artificial Sequence
  Description of Artificial Sequence: Synthetic peptide
TGASSDVGDYNSVS

SEQ ID NO: 751 - DNA, 33 bp, Artificial Sequence; identical to SEQ ID NO: 739
  Description of Artificial Sequence: Synthetic oligonucleotide

SEQ ID NO: 752 - protein, 11 aa, Artificial Sequence
  Description of Artificial Sequence: Synthetic peptide
SGDKLGDKYVC

SEQ ID NO: 753 - DNA, 33 bp, Artificial Sequence; identical to SEQ ID NO: 185
  Description of Artificial Sequence: Synthetic oligonucleotide

SEQ ID NO: 754 - protein, 11 aa, Artificial Sequence
  Description of Artificial Sequence: Synthetic peptide
SGDKLGNKYAW

SEQ ID NO: 755 - DNA, 51 bp, Artificial Sequence
  Description of Artificial Sequence: Synthetic oligonucleotide
aggtccagccagactattttacacagctccaacaattacaactacttagct

SEQ ID NO: 756 - protein, 17 aa, Artificial Sequence
  Description of Artificial Sequence: Synthetic peptide
RSSQTILHSSNNYNYLA

SEQ ID NO: 757 - DNA, 33 bp, Artificial Sequence; identical to SEQ ID NO: 693
  Description of Artificial Sequence: Synthetic oligonucleotide

SEQ ID NO: 758 - protein, 11 aa, Artificial Sequence
  Description of Artificial Sequence: Synthetic peptide
SGDKLGDKYAC

SEQ ID NO: 759 - DNA, 36 bp, Artificial Sequence
  Description of Artificial Sequence: Synthetic oligonucleotide
agggccagtcagagtgttagcagcagctacttagcc

SEQ ID NO: 760 - protein, 12 aa, Artificial Sequence
  Description of Artificial Sequence: Synthetic peptide
RASQSVSSSYLA

SEQ ID NO: 761 - DNA, 33 bp, Artificial Sequence; identical to SEQ ID NO: 109
  Description of Artificial Sequence: Synthetic oligonucleotide

SEQ ID NO: 762 - protein, 11 aa, Artificial Sequence
  Description of Artificial Sequence: Synthetic peptide
RASQGIRNDLG

SEQ ID NO: 763 - DNA, 33 bp, Artificial Sequence; identical to SEQ ID NO: 109
  Description of Artificial Sequence: Synthetic oligonucleotide

SEQ ID NO: 764 - protein, 11 aa, Artificial Sequence
  Description of Artificial Sequence: Synthetic peptide
RASQGIRNDLG

SEQ ID NO: 765 - DNA, 33 bp, Artificial Sequence; identical to SEQ ID NO: 109
  Description of Artificial Sequence: Synthetic oligonucleotide

SEQ ID NO: 766 - protein, 11 aa, Artificial Sequence
  Description of Artificial Sequence: Synthetic peptide
RASQGIRNDLG

SEQ ID NO: 767 - DNA, 33 bp, Artificial Sequence
  Description of Artificial Sequence: Synthetic oligonucleotide
cgggcgagtcagggtattagcacctggttagcc

SEQ ID NO: 768 - protein, 11 aa, Artificial Sequence
  Description of Artificial Sequence: Synthetic peptide
RASQGISTWLA

SEQ ID NO: 769 - DNA, 33 bp, Artificial Sequence; identical to SEQ ID NO: 109
  Description of Artificial Sequence: Synthetic oligonucleotide

SEQ ID NO: 770 - protein, 11 aa, Artificial Sequence
  Description of Artificial Sequence: Synthetic peptide
RASQGIRNDLG

SEQ ID NO: 771 - DNA, 33 bp, Artificial Sequence; identical to SEQ ID NO: 93
  Description of Artificial Sequence: Synthetic oligonucleotide

SEQ ID NO: 772 - protein, 11 aa, Artificial Sequence
  Description of Artificial Sequence: Synthetic peptide
RTSQGIRNDLG

SEQ ID NO: 773 - DNA, 33 bp, Artificial Sequence; identical to SEQ ID NO: 519
  Description of Artificial Sequence: Synthetic oligonucleotide

SEQ ID NO: 774 - protein, 11 aa, Artificial Sequence
  Description of Artificial Sequence: Synthetic peptide
RASQAIRNDLG

SEQ ID NO: 775 - DNA, 33 bp, Artificial Sequence; identical to SEQ ID NO: 109
  Description of Artificial Sequence: Synthetic oligonucleotide

SEQ ID NO: 776 - protein, 11 aa, Artificial Sequence
  Description of Artificial Sequence: Synthetic peptide
RASQGIRNDLG

SEQ ID NO: 777 - DNA, 33 bp, Artificial Sequence; identical to SEQ ID NO: 109
  Description of Artificial Sequence: Synthetic oligonucleotide

SEQ ID NO: 778 - protein, 11 aa, Artificial Sequence
  Description of Artificial Sequence: Synthetic peptide
RASQGIRNDLG

SEQ ID NO: 779 - DNA, 33 bp, Artificial Sequence; identical to SEQ ID NO: 109
  Description of Artificial Sequence: Synthetic oligonucleotide

SEQ ID NO: 780 - protein, 11 aa, Artificial Sequence
  Description of Artificial Sequence: Synthetic peptide
RASQGIRNDLG

SEQ ID NO: 781 - DNA, 33 bp, Artificial Sequence; identical to SEQ ID NO: 247
  Description of Artificial Sequence: Synthetic oligonucleotide

SEQ ID NO: 782 - protein, 11 aa, Artificial Sequence
  Description of Artificial Sequence: Synthetic peptide
RASQNISSYLN

SEQ ID NO: 783 - DNA, 33 bp, Artificial Sequence; identical to SEQ ID NO: 109
  Description of Artificial Sequence: Synthetic oligonucleotide

SEQ ID NO: 784 - protein, 11 aa, Artificial Sequence
  Description of Artificial Sequence: Synthetic peptide
RASQGIRNDLG

SEQ ID NO: 785 - DNA, 33 bp, Artificial Sequence; identical to SEQ ID NO: 109
  Description of Artificial Sequence: Synthetic oligonucleotide

SEQ ID NO: 786 - protein, 11 aa, Artificial Sequence
  Description of Artificial Sequence: Synthetic peptide
RASQGIRNDLG

SEQ ID NO: 787 - DNA, 33 bp, Artificial Sequence; identical to SEQ ID NO: 109
  Description of Artificial Sequence: Synthetic oligonucleotide

SEQ ID NO: 788 - protein, 11 aa, Artificial Sequence
  Description of Artificial Sequence: Synthetic peptide
RASQGIRNDLG

SEQ ID NO: 789 - DNA, 33 bp, Artificial Sequence; identical to SEQ ID NO: 109
  Description of Artificial Sequence: Synthetic oligonucleotide

SEQ ID NO: 790 - protein, 11 aa, Artificial Sequence
  Description of Artificial Sequence: Synthetic peptide
RASQGIRNDLG

SEQ ID NO: 791 - DNA, 33 bp, Artificial Sequence; identical to SEQ ID NO: 105
  Description of Artificial Sequence: Synthetic oligonucleotide

SEQ ID NO: 792 - protein, 11 aa, Artificial Sequence
  Description of Artificial Sequence: Synthetic peptide
RASQGISNYLA

SEQ ID NO: 793 - DNA, 33 bp, Artificial Sequence; identical to SEQ ID NO: 109
  Description of Artificial Sequence: Synthetic oligonucleotide

SEQ ID NO: 794 - protein, 11 aa, Artificial Sequence
  Description of Artificial Sequence: Synthetic peptide
RASQGIRNDLG

SEQ ID NO: 795 - DNA, 33 bp, Artificial Sequence
  Description of Artificial Sequence: Synthetic oligonucleotide
cgggcaagtcagagtattctcagctatttaaat

SEQ ID NO: 796 - protein, 11 aa, Artificial Sequence
  Description of Artificial Sequence: Synthetic peptide
RASQSILSYLN

SEQ ID NO: 797 - DNA, 33 bp, Artificial Sequence
  Description of Artificial Sequence: Synthetic oligonucleotide
cgggcaagtcagaacatttacaggtatttaaat

SEQ ID NO: 798 - protein, 11 aa, Artificial Sequence
  Description of Artificial Sequence: Synthetic peptide
RASQNIYRYLN

SEQ ID NO: 799 - DNA, 33 bp, Artificial Sequence
  Description of Artificial Sequence: Synthetic oligonucleotide
cgggcaattcagaacattagcagctatttaaat

SEQ ID NO: 800 - protein, 11 aa, Artificial Sequence
  Description of Artificial Sequence: Synthetic peptide
RAIQNISSYLN

SEQ ID NO: 801 - DNA, 33 bp, Artificial Sequence; identical to SEQ ID NO: 547
  Description of Artificial Sequence: Synthetic oligonucleotide

SEQ ID NO: 802 - protein, 11 aa, Artificial Sequence
  Description of Artificial Sequence: Synthetic peptide
RASQNIYSYLN

SEQ ID NO: 803 - DNA, 33 bp, Artificial Sequence
  Description of Artificial Sequence: Synthetic oligonucleotide
ctggcaagtcagggcattagaaatgatttaggc

SEQ ID NO: 804 - protein, 11 aa, Artificial Sequence
  Description of Artificial Sequence: Synthetic peptide
LASQGIRNDLG

SEQ ID NO: 805 - DNA, 33 bp, Artificial Sequence; identical to SEQ ID NO: 371
  Description of Artificial Sequence: Synthetic oligonucleotide

SEQ ID NO: 806 - protein, 11 aa, Artificial Sequence
  Description of Artificial Sequence: Synthetic peptide
RASQGIRNDLD

SEQ ID NO: 807 - DNA, 33 bp, Artificial Sequence
  Description of Artificial Sequence: Synthetic oligonucleotide
cgggcaagtcagaacattattagttatttaaat

SEQ ID NO: 808 - protein, 11 aa, Artificial Sequence
  Description of Artificial Sequence: Synthetic peptide
RASQNIISYLN

SEQ ID NO: 809 - DNA, 33 bp, Artificial Sequence
  Description of Artificial Sequence: Synthetic oligonucleotide
cgggcaagtcggggcatcagaggtgatttaggt

SEQ ID NO: 810 - protein, 11 aa, Artificial Sequence
  Description of Artificial Sequence: Synthetic peptide
RASRGIRGDLG

SEQ ID NO: 811 - DNA, 33 bp, Artificial Sequence; identical to SEQ ID NO: 109
  Description of Artificial Sequence: Synthetic oligonucleotide

SEQ ID NO: 812 - protein, 11 aa, Artificial Sequence
  Description of Artificial Sequence: Synthetic peptide
RASQGIRNDLG

SEQ ID NO: 813 - DNA, 33 bp, Artificial Sequence
  Description of Artificial Sequence: Synthetic oligonucleotide
cgggcaagtcagaacattagaaattatttaaat

SEQ ID NO: 814 - protein, 11 aa, Artificial Sequence
  Description of Artificial Sequence: Synthetic peptide
RASQNIRNYLN

SEQ ID NO: 815 - DNA, 33 bp, Artificial Sequence
  Description of Artificial Sequence: Synthetic oligonucleotide
cgggcgagtcaggacattagcaatcatttagtc

SEQ ID NO: 816 - protein, 11 aa, Artificial Sequence
  Description of Artificial Sequence: Synthetic peptide
RASQDISNHLV

SEQ ID NO: 817 - DNA, 33 bp, Artificial Sequence; identical to SEQ ID NO: 109
  Description of Artificial Sequence: Synthetic oligonucleotide

SEQ ID NO: 818 - protein, 11 aa, Artificial Sequence
  Description of Artificial Sequence: Synthetic peptide
RASQGIRNDLG

SEQ ID NO: 819 - DNA, 33 bp, Artificial Sequence; identical to SEQ ID NO: 109
  Description of Artificial Sequence: Synthetic oligonucleotide

SEQ ID NO: 820 - protein, 11 aa, Artificial Sequence
  Description of Artificial Sequence: Synthetic peptide
RASQGIRNDLG

SEQ ID NO: 821 - DNA, 33 bp, Artificial Sequence
  Description of Artificial Sequence: Synthetic oligonucleotide
cgggcaagtcagggcattagaaatgatttaggg

SEQ ID NO: 822 - protein, 11 aa, Artificial Sequence
  Description of Artificial Sequence: Synthetic peptide
RASQGIRNDLG

SEQ ID NO: 823 - DNA, 33 bp, Artificial Sequence; identical to SEQ ID NO: 303
  Description of Artificial Sequence: Synthetic oligonucleotide

SEQ ID NO: 824 - protein, 11 aa, Artificial Sequence
  Description of Artificial Sequence: Synthetic peptide
RASQNINNYLN

SEQ ID NO: 825 - DNA, 33 bp, Artificial Sequence; identical to SEQ ID NO: 109
  Description of Artificial Sequence: Synthetic oligonucleotide

SEQ ID NO: 826 - protein, 11 aa, Artificial Sequence
  Description of Artificial Sequence: Synthetic peptide
RASQGIRNDLG

SEQ ID NO: 827 - DNA, 33 bp, Artificial Sequence; identical to SEQ ID NO: 109
  Description of Artificial Sequence: Synthetic oligonucleotide

SEQ ID NO: 828 - protein, 11 aa, Artificial Sequence
  Description of Artificial Sequence: Synthetic peptide
RASQGIRNDLG

SEQ ID NO: 829 - DNA, 33 bp, Artificial Sequence; identical to SEQ ID NO: 109
  Description of Artificial Sequence: Synthetic oligonucleotide

SEQ ID NO: 830 - protein, 11 aa, Artificial Sequence
  Description of Artificial Sequence: Synthetic peptide
RASQGIRNDLG

SEQ ID NO: 831 - DNA, 33 bp, Artificial Sequence
  Description of Artificial Sequence: Synthetic oligonucleotide
cgggcaagtcagggcattagaaatgatttaggt

SEQ ID NO: 832 - protein, 11 aa, Artificial Sequence
  Description of Artificial Sequence: Synthetic peptide
RASQGIRNDLG

SEQ ID NO: 833 - DNA, 33 bp, Artificial Sequence
  Description of Artificial Sequence: Synthetic oligonucleotide
cgggcaagtcagagcattagaagttatttaaat

SEQ ID NO: 834 - protein, 11 aa, Artificial Sequence
  Description of Artificial Sequence: Synthetic peptide
RASQSIRSYLN

SEQ ID NO: 835 - DNA, 33 bp, Artificial Sequence
  Description of Artificial Sequence: Synthetic oligonucleotide
cgggcaagtcataccattagaacctatttaaac

SEQ ID NO: 836 - protein, 11 aa, Artificial Sequence
  Description of Artificial Sequence: Synthetic peptide
RASHTIRTYLN

SEQ ID NO: 837 - DNA, 33 bp, Artificial Sequence
  Description of Artificial Sequence: Synthetic oligonucleotide
caggcgagtcaggacattagcaactatttaaat

SEQ ID NO: 838 - protein, 11 aa, Artificial Sequence
  Description of Artificial Sequence: Synthetic peptide
QASQDISNYLN

SEQ ID NO: 839 - DNA, 33 bp, Artificial Sequence; identical to SEQ ID NO: 105
  Description of Artificial Sequence: Synthetic oligonucleotide

SEQ ID NO: 840 - protein, 11 aa, Artificial Sequence
  Description of Artificial Sequence: Synthetic peptide
RASQGISNYLA

SEQ ID NO: 841 - DNA, 33 bp, Artificial Sequence; identical to SEQ ID NO: 105
  Description of Artificial Sequence: Synthetic oligonucleotide

SEQ ID NO: 842 - protein, 11 aa, Artificial Sequence
  Description of Artificial Sequence: Synthetic peptide
RASQGISNYLA

SEQ ID NO: 843 - DNA, 33 bp, Artificial Sequence
  Description of Artificial Sequence: Synthetic oligonucleotide
cgggcaagtcagaccattagtagttatttaaat

SEQ ID NO: 844 - protein, 11 aa, Artificial Sequence
  Description of Artificial Sequence: Synthetic peptide
RASQTISSYLN

SEQ ID NO: 845 - DNA, 33 bp, Artificial Sequence
  Description of Artificial Sequence: Synthetic oligonucleotide
cgggcaagtcagaacatttacagttatttaaat

SEQ ID NO: 846 - protein, 11 aa, Artificial Sequence
  Description of Artificial Sequence: Synthetic peptide
RASQNIYSYLN

SEQ ID NO: 847 - DNA, 33 bp, Artificial Sequence; identical to SEQ ID NO: 93
  Description of Artificial Sequence: Synthetic oligonucleotide

SEQ ID NO: 848 - protein, 11 aa, Artificial Sequence
  Description of Artificial Sequence: Synthetic peptide
RTSQGIRNDLG

SEQ ID NO: 849 - DNA, 33 bp, Artificial Sequence; identical to SEQ ID NO: 361
  Description of Artificial Sequence: Synthetic oligonucleotide

SEQ ID NO: 850 - protein, 11 aa, Artificial Sequence
  Description of Artificial Sequence: Synthetic peptide
RASQNIISYLN

SEQ ID NO: 851 - DNA, 33 bp, Artificial Sequence
  Description of Artificial Sequence: Synthetic oligonucleotide
agggccagtcagactgttagcagcaacttagcc

SEQ ID NO: 852 - protein, 11 aa, Artificial Sequence
  Description of Artificial Sequence: Synthetic peptide
RASQTVSSNLA

SEQ ID NO: 853 - DNA, 33 bp, Artificial Sequence; identical to SEQ ID NO: 493
  Description of Artificial Sequence: Synthetic oligonucleotide

SEQ ID NO: 854 - protein, 11 aa, Artificial Sequence
  Description of Artificial Sequence: Synthetic peptide
RASQDIRSDLG

SEQ ID NO: 855 - DNA, 33 bp, Artificial Sequence
  Description of Artificial Sequence: Synthetic oligonucleotide
caggcgaatcaggacattaccaactttttaaat

SEQ ID NO: 856 - protein, 11 aa, Artificial Sequence
  Description of Artificial Sequence: Synthetic peptide
QANQDITNFLN

SEQ ID NO: 857 - DNA, 33 bp, Artificial Sequence; identical to SEQ ID NO: 855
  Description of Artificial Sequence: Synthetic oligonucleotide

SEQ ID NO: 858 - protein, 11 aa, Artificial Sequence
  Description of Artificial Sequence: Synthetic peptide
QANQDITNFLN

SEQ ID NO: 859 - DNA, 33 bp, Artificial Sequence; identical to SEQ ID NO: 293
  Description of Artificial Sequence: Synthetic oligonucleotide

SEQ ID NO: 860 - protein, 11 aa, Artificial Sequence
  Description of Artificial Sequence: Synthetic peptide
RASQGINNYLA

SEQ ID NO: 861 - DNA, 33 bp, Artificial Sequence; identical to SEQ ID NO: 109
  Description of Artificial Sequence: Synthetic oligonucleotide

SEQ ID NO: 862 - protein, 11 aa, Artificial Sequence
  Description of Artificial Sequence: Synthetic peptide
RASQGIRNDLG

SEQ ID NO: 863 - DNA, 33 bp, Artificial Sequence; identical to SEQ ID NO: 797
  Description of Artificial Sequence: Synthetic oligonucleotide

SEQ ID NO: 864 - protein, 11 aa, Artificial Sequence
  Description of Artificial Sequence: Synthetic peptide
RASQNIYRYLN

SEQ ID NO: 865 - DNA, 33 bp, Artificial Sequence; identical to SEQ ID NO: 109
  Description of Artificial Sequence: Synthetic oligonucleotide

SEQ ID NO: 866 - protein, 11 aa, Artificial Sequence
  Description of Artificial Sequence: Synthetic peptide
RASQGIRNDLG

SEQ ID NO: 867 - DNA, 33 bp, Artificial Sequence
  Description of Artificial Sequence: Synthetic oligonucleotide
cgggcaagtcagaccattatcagctatttaaat

SEQ ID NO: 868 - protein, 11 aa, Artificial Sequence
  Description of Artificial Sequence: Synthetic peptide
RASQTIISYLN

SEQ ID NO: 869 - DNA, 33 bp, Artificial Sequence; identical to SEQ ID NO: 109
  Description of Artificial Sequence: Synthetic oligonucleotide

SEQ ID NO: 870 - protein, 11 aa, Artificial Sequence
  Description of Artificial Sequence: Synthetic peptide
RASQGIRNDLG

SEQ ID NO: 871 - DNA, 33 bp, Artificial Sequence
  Description of Artificial Sequence: Synthetic oligonucleotide
cgggcaagtcaaaacattatcagctatttaaat

SEQ ID NO: 872 - protein, 11 aa, Artificial Sequence
  Description of Artificial Sequence: Synthetic peptide
RASQNIISYLN

SEQ ID NO: 873 - DNA, 33 bp, Artificial Sequence; identical to SEQ ID NO: 797
  Description of Artificial Sequence: Synthetic oligonucleotide

SEQ ID NO: 874 - protein, 11 aa, Artificial Sequence
  Description of Artificial Sequence: Synthetic peptide
RASQNIYRYLN

SEQ ID NO: 875 - DNA, 33 bp, Artificial Sequence; identical to SEQ ID NO: 109
  Description of Artificial Sequence: Synthetic oligonucleotide

SEQ ID NO: 876 - protein, 11 aa, Artificial Sequence
  Description of Artificial Sequence: Synthetic peptide
RASQGIRNDLG

SEQ ID NO: 877 - DNA, 33 bp, Artificial Sequence
  Description of Artificial Sequence: Synthetic oligonucleotide
cgggcaagtcagagcattagcagttatttaaat

SEQ ID NO: 878 - protein, 11 aa, Artificial Sequence
  Description of Artificial Sequence: Synthetic peptide
RASQSISSYLN

SEQ ID NO: 879 - DNA, 33 bp, Artificial Sequence
  Description of Artificial Sequence: Synthetic oligonucleotide
cgggcaagtcagagcattagcggctatttaaat

SEQ ID NO: 880 - protein, 11 aa, Artificial Sequence
  Description of Artificial Sequence: Synthetic peptide
RASQSISGYLN

SEQ ID NO: 881 - DNA, 51 bp, Artificial Sequence
  Description of Artificial Sequence: Synthetic oligonucleotide
aagtccagccagagtgttttatacagctccaacaataacaactacttaact

SEQ ID NO: 882 - protein, 17 aa, Artificial Sequence
  Description of Artificial Sequence: Synthetic peptide
KSSQSVLYSSNNNNYLT

SEQ ID NO: 883 - DNA, 33 bp, Artificial Sequence; identical to SEQ ID NO: 213
  Description of Artificial Sequence: Synthetic oligonucleotide

SEQ ID NO: 884 - protein, 11 aa, Artificial Sequence
  Description of Artificial Sequence: Synthetic peptide
RASQDIRNHLG

SEQ ID NO: 885 - DNA, 33 bp, Artificial Sequence
  Description of Artificial Sequence: Synthetic oligonucleotide
cgggcgagtcaggacattagtaattatttagcc

SEQ ID NO: 886 - protein, 11 aa, Artificial Sequence
  Description of Artificial Sequence: Synthetic peptide
RASQDISNYLA

SEQ ID NO: 887 - DNA, 33 bp, Artificial Sequence; identical to SEQ ID NO: 109
  Description of Artificial Sequence: Synthetic oligonucleotide

SEQ ID NO: 888 - protein, 11 aa, Artificial Sequence
  Description of Artificial Sequence: Synthetic peptide
RASQGIRNDLG

SEQ ID NO: 889 - DNA, 33 bp, Artificial Sequence; identical to SEQ ID NO: 697
  Description of Artificial Sequence: Synthetic oligonucleotide

SEQ ID NO: 890 - protein, 11 aa, Artificial Sequence
  Description of Artificial Sequence: Synthetic peptide
SGDKLGEKYAC

SEQ ID NO: 891 - DNA, 33 bp, Artificial Sequence; identical to SEQ ID NO: 293
  Description of Artificial Sequence: Synthetic oligonucleotide

SEQ ID NO: 892 - protein, 11 aa, Artificial Sequence
  Description of Artificial Sequence: Synthetic peptide
RASQGINNYLA

SEQ ID NO: 893 - DNA, 33 bp, Artificial Sequence; identical to SEQ ID NO: 173
  Description of Artificial Sequence: Synthetic oligonucleotide

SEQ ID NO: 894 - protein, 11 aa, Artificial Sequence
  Description of Artificial Sequence: Synthetic peptide
RASQGISRWLA

SEQ ID NO: 895 - DNA, 33 bp, Artificial Sequence; identical to SEQ ID NO: 431
  Description of Artificial Sequence: Synthetic oligonucleotide

SEQ ID NO: 896 - protein, 11 aa, Artificial Sequence
  Description of Artificial Sequence: Synthetic peptide
RASQSISDYLN

SEQ ID NO: 897 - DNA, 33 bp, Artificial Sequence; identical to SEQ ID NO: 109
  Description of Artificial Sequence: Synthetic oligonucleotide

SEQ ID NO: 898 - protein, 11 aa, Artificial Sequence
  Description of Artificial Sequence: Synthetic peptide
RASQGIRNDLG

SEQ ID NO: 899 - DNA, 33 bp, Artificial Sequence; identical to SEQ ID NO: 109
  Description of Artificial Sequence: Synthetic oligonucleotide

SEQ ID NO: 900 - protein, 11 aa, Artificial Sequence
  Description of Artificial Sequence: Synthetic peptide
RASQGIRNDLG

SEQ ID NO: 901 - DNA, 33 bp, Artificial Sequence; identical to SEQ ID NO: 109
  Description of Artificial Sequence: Synthetic oligonucleotide

SEQ ID NO: 902 - protein, 11 aa, Artificial Sequence
  Description of Artificial Sequence: Synthetic peptide
RASQGIRNDLG

SEQ ID NO: 903 - DNA, 33 bp, Artificial Sequence
  Description of Artificial Sequence: Synthetic oligonucleotide
cggacaagtcagaacattatcagctatttaaat

SEQ ID NO: 904 - protein, 11 aa, Artificial Sequence
  Description of Artificial Sequence: Synthetic peptide
RTSQNIISYLN

SEQ ID NO: 905 - DNA, 33 bp, Artificial Sequence; identical to SEQ ID NO: 429
  Description of Artificial Sequence: Synthetic oligonucleotide

SEQ ID NO: 906 - protein, 11 aa, Artificial Sequence
  Description of Artificial Sequence: Synthetic peptide
RASQGIGNDLG

SEQ ID NO: 907 - DNA, 33 bp, Artificial Sequence; identical to SEQ ID NO: 105
  Description of Artificial Sequence: Synthetic oligonucleotide

SEQ ID NO: 908 - protein, 11 aa, Artificial Sequence
  Description of Artificial Sequence: Synthetic peptide
RASQGISNYLA

SEQ ID NO: 909 - DNA, 33 bp, Artificial Sequence
  Description of Artificial Sequence: Synthetic oligonucleotide
cgggcaagtcagggcattagaaacgatttaggc

SEQ ID NO: 910 - protein, 11 aa, Artificial Sequence
  Description of Artificial Sequence: Synthetic peptide
RASQGIRNDLG

SEQ ID NO: 911 - DNA, 33 bp, Artificial Sequence; identical to SEQ ID NO: 109
  Description of Artificial Sequence: Synthetic oligonucleotide

SEQ ID NO: 912 - protein, 11 aa, Artificial Sequence
  Description of Artificial Sequence: Synthetic peptide
RASQGIRNDLG

SEQ ID NO: 913 - DNA, 33 bp, Artificial Sequence; identical to SEQ ID NO: 109
  Description of Artificial Sequence: Synthetic oligonucleotide

SEQ ID NO: 914 - protein, 11 aa, Artificial Sequence
  Description of Artificial Sequence: Synthetic peptide
RASQGIRNDLG

SEQ ID NO: 915 - DNA, 33 bp, Artificial Sequence; identical to SEQ ID NO: 109
  Description of Artificial Sequence: Synthetic oligonucleotide

SEQ ID NO: 916 - protein, 11 aa, Artificial Sequence
  Description of Artificial Sequence: Synthetic peptide
RASQGIRNDLG

SEQ ID NO: 917 - DNA, 33 bp, Artificial Sequence
  Description of Artificial Sequence: Synthetic oligonucleotide
cggacaagtcagagcattagtacttatttaaat

SEQ ID NO: 918 - protein, 11 aa, Artificial Sequence
  Description of Artificial Sequence: Synthetic peptide
RTSQSISTYLN

SEQ ID NO: 919 - DNA, 33 bp, Artificial Sequence
  Description of Artificial Sequence: Synthetic oligonucleotide
cgggcaagtcagggcattagaagtaatttaggc

SEQ ID NO: 920 - protein, 11 aa, Artificial Sequence
  Description of Artificial Sequence: Synthetic peptide
RASQGIRSNLG

SEQ ID NO: 921 - DNA, 33 bp, Artificial Sequence; identical to SEQ ID NO: 109
  Description of Artificial Sequence: Synthetic oligonucleotide

SEQ ID NO: 922 - protein, 11 aa, Artificial Sequence
  Description of Artificial Sequence: Synthetic peptide
RASQGIRNDLG

SEQ ID NO: 923 - DNA, 33 bp, Artificial Sequence; identical to SEQ ID NO: 109
  Description of Artificial Sequence: Synthetic oligonucleotide

SEQ ID NO: 924 - protein, 11 aa, Artificial Sequence
  Description of Artificial Sequence: Synthetic peptide
RASQGIRNDLG

SEQ ID NO: 925 - DNA, 33 bp, Artificial Sequence
  Description of Artificial Sequence: Synthetic oligonucleotide
cgggcgagtcaggacattaggaattatttagcc

SEQ ID NO: 926 - protein, 11 aa, Artificial Sequence
  Description of Artificial Sequence: Synthetic peptide
RASQDIRNYLA

SEQ ID NO: 927 - DNA, 33 bp, Artificial Sequence; identical to SEQ ID NO: 109
  Description of Artificial Sequence: Synthetic oligonucleotide

SEQ ID NO: 928 - protein, 11 aa, Artificial Sequence
  Description of Artificial Sequence: Synthetic peptide
RASQGIRNDLG

SEQ ID NO: 929 - DNA, 33 bp, Artificial Sequence; identical to SEQ ID NO: 279
  Description of Artificial Sequence: Synthetic oligonucleotide

SEQ ID NO: 930 - protein, 11 aa, Artificial Sequence
  Description of Artificial Sequence: Synthetic peptide
RASQGISYYLA

SEQ ID NO: 931 - DNA, 33 bp, Artificial Sequence
  Description of Artificial Sequence: Synthetic oligonucleotide
cgggcaagtcaggccattagaaatgatttagac

SEQ ID NO: 932 - protein, 11 aa, Artificial Sequence
  Description of Artificial Sequence: Synthetic peptide
RASQAIRNDLD

SEQ ID NO: 933 - DNA, 33 bp, Artificial Sequence; identical to SEQ ID NO: 109
  Description of Artificial Sequence: Synthetic oligonucleotide

SEQ ID NO: 934 - protein, 11 aa, Artificial Sequence
  Description of Artificial Sequence: Synthetic peptide
RASQGIRNDLG

SEQ ID NO: 935 - DNA, 33 bp, Artificial Sequence; identical to SEQ ID NO: 109
  Description of Artificial Sequence: Synthetic oligonucleotide

SEQ ID NO: 936 - protein, 11 aa, Artificial Sequence
  Description of Artificial Sequence: Synthetic peptide
RASQGIRNDLG

SEQ ID NO: 937 - DNA, 33 bp, Artificial Sequence; identical to SEQ ID NO: 837
  Description of Artificial Sequence: Synthetic oligonucleotide

SEQ ID NO: 938 - protein, 11 aa, Artificial Sequence
  Description of Artificial Sequence: Synthetic peptide
QASQDISNYLN

SEQ ID NO: 939 - DNA, 33 bp, Artificial Sequence; identical to SEQ ID NO: 109
  Description of Artificial Sequence: Synthetic oligonucleotide

SEQ ID NO: 940 - protein, 11 aa, Artificial Sequence
  Description of Artificial Sequence: Synthetic peptide
RASQGIRNDLG

SEQ ID NO: 941 - DNA, 33 bp, Artificial Sequence; identical to SEQ ID NO: 425
  Description of Artificial Sequence: Synthetic oligonucleotide

SEQ ID NO: 942 - protein, 11 aa, Artificial Sequence
  Description of Artificial Sequence: Synthetic peptide
QASQDINNYLN

SEQ ID NO: 943 - DNA, 33 bp, Artificial Sequence
  Description of Artificial Sequence: Synthetic oligonucleotide
caggcgagtcaggacattaccaactatttaaat

SEQ ID NO: 944 - protein, 11 aa, Artificial Sequence
  Description of Artificial Sequence: Synthetic peptide
QASQDITNYLN

SEQ ID NO: 945 - DNA, 33 bp, Artificial Sequence; identical to SEQ ID NO: 109
  Description of Artificial Sequence: Synthetic oligonucleotide

SEQ ID NO: 946 - protein, 11 aa, Artificial Sequence
  Description of Artificial Sequence: Synthetic peptide
RASQGIRNDLG

SEQ ID NO: 947 - DNA, 33 bp, Artificial Sequence; identical to SEQ ID NO: 283
  Description of Artificial Sequence: Synthetic oligonucleotide

SEQ ID NO: 948 - protein, 11 aa, Artificial Sequence
  Description of Artificial Sequence: Synthetic peptide
RASQDISNYLA

SEQ ID NO: 949 - DNA, 33 bp, Artificial Sequence; identical to SEQ ID NO: 305
  Description of Artificial Sequence: Synthetic oligonucleotide

SEQ ID NO: 950 - protein, 11 aa, Artificial Sequence
  Description of Artificial Sequence: Synthetic peptide
RASQSIISYLN

SEQ ID NO: 951 - DNA, 33 bp, Artificial Sequence; identical to SEQ ID NO: 289
  Description of Artificial Sequence: Synthetic oligonucleotide

SEQ ID NO: 952 - protein, 11 aa, Artificial Sequence
  Description of Artificial Sequence: Synthetic peptide
RASQSISSYLN

SEQ ID NO: 953 - DNA, 33 bp, Artificial Sequence
  Description of Artificial Sequence: Synthetic oligonucleotide
cgggcaagtcagagcattttcagctacttaaat

SEQ ID NO: 954 - protein, 11 aa, Artificial Sequence
  Description of Artificial Sequence: Synthetic peptide
RASQSIFSYLN

SEQ ID NO: 955 - DNA, 33 bp, Artificial Sequence; identical to SEQ ID NO: 105
  Description of Artificial Sequence: Synthetic oligonucleotide

SEQ ID NO: 956 - protein, 11 aa, Artificial Sequence
  Description of Artificial Sequence: Synthetic peptide
RASQGISNYLA

SEQ ID NO: 957 - DNA, 33 bp, Artificial Sequence; identical to SEQ ID NO: 109
  Description of Artificial Sequence: Synthetic oligonucleotide

SEQ ID NO: 958 - protein, 11 aa, Artificial Sequence
  Description of Artificial Sequence: Synthetic peptide
RASQGIRNDLG

SEQ ID NO: 959 - DNA, 33 bp, Artificial Sequence; identical to SEQ ID NO: 137
  Description of Artificial Sequence: Synthetic oligonucleotide

SEQ ID NO: 960 - protein, 11 aa, Artificial Sequence
  Description of Artificial Sequence: Synthetic peptide
RASQNISSYLN

SEQ ID NO: 961 - DNA, 33 bp, Artificial Sequence; identical to SEQ ID NO: 109
  Description of Artificial Sequence: Synthetic oligonucleotide

SEQ ID NO: 962 - protein, 11 aa, Artificial Sequence
  Description of Artificial Sequence: Synthetic peptide
RASQGIRNDLG

SEQ ID NO: 963 - DNA, 33 bp, Artificial Sequence; identical to SEQ ID NO: 105
  Description of Artificial Sequence: Synthetic oligonucleotide

SEQ ID NO: 964 - protein, 11 aa, Artificial Sequence
  Description of Artificial Sequence: Synthetic peptide
RASQGISNYLA

SEQ ID NO: 965 - DNA, 33 bp, Artificial Sequence; identical to SEQ ID NO: 425
  Description of Artificial Sequence: Synthetic oligonucleotide

SEQ ID NO: 966 - protein, 11 aa, Artificial Sequence
  Description of Artificial Sequence: Synthetic peptide
QASQDINNYLN

SEQ ID NO: 967 - DNA, 33 bp, Artificial Sequence
  Description of Artificial Sequence: Synthetic oligonucleotide
cgggcaagtcagggcattcgaaatcatttaggc

SEQ ID NO: 968 - protein, 11 aa, Artificial Sequence
  Description of Artificial Sequence: Synthetic peptide
RASQGIRNHLG

SEQ ID NO: 969 - DNA, 33 bp, Artificial Sequence
  Description of Artificial Sequence: Synthetic oligonucleotide
caggcgagtcagggcattagcaactctttaaat

SEQ ID NO: 970 - protein, 11 aa, Artificial Sequence
  Description of Artificial Sequence: Synthetic peptide
QASQGISNSLN

SEQ ID NO: 971 - DNA, 33 bp, Artificial Sequence; identical to SEQ ID NO: 109
  Description of Artificial Sequence: Synthetic oligonucleotide

SEQ ID NO: 972 - protein, 11 aa, Artificial Sequence
  Description of Artificial Sequence: Synthetic peptide
RASQGIRNDLG

SEQ ID NO: 973 - DNA, 33 bp, Artificial Sequence; identical to SEQ ID NO: 109
  Description of Artificial Sequence: Synthetic oligonucleotide

SEQ ID NO: 974 - protein, 11 aa, Artificial Sequence
  Description of Artificial Sequence: Synthetic peptide
RASQGIRNDLG

SEQ ID NO: 975 - DNA, 33 bp, Artificial Sequence
  Description of Artificial Sequence: Synthetic oligonucleotide
cgggcaagtcagagtattaataattatttaaat

SEQ ID NO: 976 - protein, 11 aa, Artificial Sequence
  Description of Artificial Sequence: Synthetic peptide
RASQSINNYLN

SEQ ID NO: 977 - DNA, 33 bp, Artificial Sequence; identical to SEQ ID NO: 109
  Description of Artificial Sequence: Synthetic oligonucleotide

SEQ ID NO: 978 - protein, 11 aa, Artificial Sequence
  Description of Artificial Sequence: Synthetic peptide
RASQGIRNDLG

SEQ ID NO: 979 - DNA, 33 bp, Artificial Sequence; identical to SEQ ID NO: 425
  Description of Artificial Sequence: Synthetic oligonucleotide

SEQ ID NO: 980 - protein, 11 aa, Artificial Sequence
  Description of Artificial Sequence: Synthetic peptide
QASQDINNYLN

SEQ ID NO: 981 - DNA, 33 bp, Artificial Sequence; identical to SEQ ID NO: 109
  Description of Artificial Sequence: Synthetic oligonucleotide

SEQ ID NO: 982 - protein, 11 aa, Artificial Sequence
  Description of Artificial Sequence: Synthetic peptide
RASQGIRNDLG

SEQ ID NO: 983 - DNA, 33 bp, Artificial Sequence
  Description of Artificial Sequence: Synthetic oligonucleotide
cgggcaagtcagagcattgccagttatttaaat

SEQ ID NO: 984 - protein, 11 aa, Artificial Sequence
  Description of Artificial Sequence: Synthetic peptide
RASQSIASYLN

SEQ ID NO: 985 - DNA, 33 bp, Artificial Sequence; identical to SEQ ID NO: 109
  Description of Artificial Sequence: Synthetic oligonucleotide

SEQ ID NO: 986 - protein, 11 aa, Artificial Sequence
  Description of Artificial Sequence: Synthetic peptide
RASQGIRNDLG

SEQ ID NO: 987 - DNA, 33 bp, Artificial Sequence; identical to SEQ ID NO: 279
  Description of Artificial Sequence: Synthetic oligonucleotide

SEQ ID NO: 988 - protein, 11 aa, Artificial Sequence
  Description of Artificial Sequence: Synthetic peptide
RASQGISYYLA

SEQ ID NO: 989 - DNA, 33 bp, Artificial Sequence; identical to SEQ ID NO: 109
  Description of Artificial Sequence: Synthetic oligonucleotide

SEQ ID NO: 990 - protein, 11 aa, Artificial Sequence
  Description of Artificial Sequence: Synthetic peptide
RASQGIRNDLG

SEQ ID NO: 991 - DNA, 33 bp, Artificial Sequence; identical to SEQ ID NO: 109
  Description of Artificial Sequence: Synthetic oligonucleotide

SEQ ID NO: 992 - protein, 11 aa, Artificial Sequence
  Description of Artificial Sequence: Synthetic peptide
RASQGIRNDLG

SEQ ID NO: 993 - DNA, 48 bp, Artificial Sequence
  Description of Artificial Sequence: Synthetic oligonucleotide
aggtctagtcagagcctcctccatagtaatggatacaactatttggat

SEQ ID NO: 994 - protein, 16 aa, Artificial Sequence
  Description of Artificial Sequence: Synthetic peptide
RSSQSLLHSNGYNYLD

SEQ ID NO: 995 - DNA, 33 bp, Artificial Sequence; identical to SEQ ID NO: 109
  Description of Artificial Sequence: Synthetic oligonucleotide

SEQ ID NO: 996 - protein, 11 aa, Artificial Sequence
  Description of Artificial Sequence: Synthetic peptide
RASQGIRNDLG

SEQ ID NO: 997 - DNA, 51 bp, Artificial Sequence
  Description of Artificial Sequence: Synthetic oligonucleotide
aagtccaaccagagagttttatccagctccaacaatcacaactacttagct

SEQ ID NO: 998 - protein, 17 aa, Artificial Sequence
  Description of Artificial Sequence: Synthetic peptide
KSNQRVLSSSNNHNYLA

SEQ ID NO: 999 - DNA, 33 bp, Artificial Sequence; identical to SEQ ID NO: 109
  Description of Artificial Sequence: Synthetic oligonucleotide

SEQ ID NO: 1000 - protein, 11 aa, Artificial Sequence
  Description of Artificial Sequence: Synthetic peptide
RASQGIRNDLG

SEQ ID NO: 1001 - DNA, 33 bp, Artificial Sequence
  Description of Artificial Sequence: Synthetic oligonucleotide
cgggcaagtcagggcattagagatattttaggc

SEQ ID NO: 1002 - protein, 11 aa, Artificial Sequence
  Description of Artificial Sequence: Synthetic peptide
RASQGIRDILG

SEQ ID NO: 1003 - DNA, 48 bp, Artificial Sequence
  Description of Artificial Sequence: Synthetic oligonucleotide
aggtctagtcagagcctcctgcatagtaagggatacaactatttggat

SEQ ID NO: 1004 - protein, 16 aa, Artificial Sequence
  Description of Artificial Sequence: Synthetic peptide
RSSQSLLHSKGYNYLD

SEQ ID NO: 1005 - DNA, 33 bp, Artificial Sequence; identical to SEQ ID NO: 109
  Description of Artificial Sequence: Synthetic oligonucleotide

SEQ ID NO: 1006 - protein, 11 aa, Artificial Sequence
  Description of Artificial Sequence: Synthetic peptide
RASQGIRNDLG

SEQ ID NO: 1007 - DNA, 33 bp, Artificial Sequence; identical to SEQ ID NO: 109
  Description of Artificial Sequence: Synthetic oligonucleotide

SEQ ID NO: 1008 - protein, 11 aa, Artificial Sequence
  Description of Artificial Sequence: Synthetic peptide
RASQGIRNDLG

SEQ ID NO: 1009 - DNA, 33 bp, Artificial Sequence; identical to SEQ ID NO: 323
  Description of Artificial Sequence: Synthetic oligonucleotide

SEQ ID NO: 1010 - protein, 11 aa, Artificial Sequence
  Description of Artificial Sequence: Synthetic peptide
RASQSISNYLN

SEQ ID NO: 1011 - DNA, 33 bp, Artificial Sequence; identical to SEQ ID NO: 109
  Description of Artificial Sequence: Synthetic oligonucleotide

SEQ ID NO: 1012 - protein, 11 aa, Artificial Sequence
  Description of Artificial Sequence: Synthetic peptide
RASQGIRNDLG

SEQ ID NO: 1013 - DNA, 33 bp, Artificial Sequence; identical to SEQ ID NO: 425
  Description of Artificial Sequence: Synthetic oligonucleotide

SEQ ID NO: 1014 - protein, 11 aa, Artificial Sequence
  Description of Artificial Sequence: Synthetic peptide
QASQDINNYLN

SEQ ID NO: 1015 - DNA, 33 bp, Artificial Sequence; identical to SEQ ID NO: 305
  Description of Artificial Sequence: Synthetic oligonucleotide

SEQ ID NO: 1016 - protein, 11 aa, Artificial Sequence
  Description of Artificial Sequence: Synthetic peptide
RASQSIISYLN

SEQ ID NO: 1017 - DNA, 51 bp, Artificial Sequence
  Description of Artificial Sequence: Synthetic oligonucleotide
aagtccagccagaatgttttatacaactccaacaataacaactacttagct

SEQ ID NO: 1018 - protein, 17 aa, Artificial Sequence
  Description of Artificial Sequence: Synthetic peptide
KSSQNVLYNSNNNNYLA

SEQ ID NO: 1019 - DNA, 33 bp, Artificial Sequence
  Description of Artificial Sequence: Synthetic oligonucleotide
cgggcaagtcagaacatttatagttatttaaat

SEQ ID NO: 1020 - protein, 11 aa, Artificial Sequence
  Description of Artificial Sequence: Synthetic peptide
RASQNIYSYLN

SEQ ID NO: 1021 - DNA, 33 bp, Artificial Sequence; identical to SEQ ID NO: 133
  Description of Artificial Sequence: Synthetic oligonucleotide

SEQ ID NO: 1022 - protein, 11 aa, Artificial Sequence
  Description of Artificial Sequence: Synthetic peptide
RASQGIRSDLG

SEQ ID NO: 1023 - DNA, 33 bp, Artificial Sequence; identical to SEQ ID NO: 109
  Description of Artificial Sequence: Synthetic oligonucleotide

SEQ ID NO: 1024 - protein, 11 aa, Artificial Sequence
  Description of Artificial Sequence: Synthetic peptide
RASQGIRNDLG

SEQ ID NO: 1025 - DNA, 33 bp, Artificial Sequence; identical to SEQ ID NO: 109
  Description of Artificial Sequence: Synthetic oligonucleotide

SEQ ID NO: 1026 - protein, 11 aa, Artificial Sequence
  Description of Artificial Sequence: Synthetic peptide
RASQGIRNDLG

SEQ ID NO: 1027 - DNA, 33 bp, Artificial Sequence; identical to SEQ ID NO: 109
  Description of Artificial Sequence: Synthetic oligonucleotide

SEQ ID NO: 1028 - protein, 11 aa, Artificial Sequence
  Description of Artificial Sequence: Synthetic peptide
RASQGIRNDLG

SEQ ID NO: 1029 - DNA, 33 bp, Artificial Sequence; identical to SEQ ID NO: 109
  Description of Artificial Sequence: Synthetic oligonucleotide

SEQ ID NO: 1030 - protein, 11 aa, Artificial Sequence
  Description of Artificial Sequence: Synthetic peptide
RASQGIRNDLG

SEQ ID NO: 1031 - DNA, 33 bp, Artificial Sequence
  Description of Artificial Sequence: Synthetic oligonucleotide
tctggagataaattggggaataaatatgcttac

SEQ ID NO: 1032 - protein, 11 aa, Artificial Sequence
  Description of Artificial Sequence: Synthetic peptide
SGDKLGNKYAY

SEQ ID NO: 1033 - DNA, 33 bp, Artificial Sequence; identical to SEQ ID NO: 177
  Description of Artificial Sequence: Synthetic oligonucleotide

SEQ ID NO: 1034 - protein, 11 aa, Artificial Sequence
  Description of Artificial Sequence: Synthetic peptide
SGDKLGDKYVY

SEQ ID NO: 1035 - DNA, 33 bp, Artificial Sequence
  Description of Artificial Sequence: Synthetic oligonucleotide
cggtcaagtcagagcattaacagctatttaaat

SEQ ID NO: 1036 - protein, 11 aa, Artificial Sequence
  Description of Artificial Sequence: Synthetic peptide
RSSQSINSYLN

SEQ ID NO: 1037 - DNA, 33 bp, Artificial Sequence
  Description of Artificial Sequence: Synthetic oligonucleotide
cgggcaagtcagaacattaacgactatttaaat

SEQ ID NO: 1038 - protein, 11 aa, Artificial Sequence
  Description of Artificial Sequence: Synthetic peptide
RASQNINDYLN

SEQ ID NO: 1039 - DNA, 33 bp, Artificial Sequence; identical to SEQ ID NO: 105
  Description of Artificial Sequence: Synthetic oligonucleotide

SEQ ID NO: 1040 - protein, 11 aa, Artificial Sequence
  Description of Artificial Sequence: Synthetic peptide
RASQGISNYLA

SEQ ID NO: 1041 - DNA, 33 bp, Artificial Sequence
  Description of Artificial Sequence: Synthetic oligonucleotide
cggacaagtcagaatattagcaactatttaaat

SEQ ID NO: 1042 - protein, 11 aa, Artificial Sequence
  Description of Artificial Sequence: Synthetic peptide
RTSQNISNYLN

SEQ ID NO: 1043 - DNA, 33 bp, Artificial Sequence
  Description of Artificial Sequence: Synthetic oligonucleotide
cgggcgagtcgggacattagcaattatttagcc

SEQ ID NO: 1044 - protein, 11 aa, Artificial Sequence
  Description of Artificial Sequence: Synthetic peptide
RASRDISNYLA

SEQ ID NO: 1045 - DNA, 33 bp, Artificial Sequence; identical to SEQ ID NO: 109
  Description of Artificial Sequence: Synthetic oligonucleotide

SEQ ID NO: 1046 - protein, 11 aa, Artificial Sequence
  Description of Artificial Sequence: Synthetic peptide
RASQGIRNDLG

SEQ ID NO: 1047 - DNA, 33 bp, Artificial Sequence
  Description of Artificial Sequence: Synthetic oligonucleotide
cgggcaagtcataccattaccagctatttaaat

SEQ ID NO: 1048 - protein, 11 aa, Artificial Sequence
  Description of Artificial Sequence: Synthetic peptide
RASHTITSYLN

SEQ ID NO: 1049 - DNA, 33 bp, Artificial Sequence; identical to SEQ ID NO: 693
  Description of Artificial Sequence: Synthetic oligonucleotide

SEQ ID NO: 1050 - protein, 11 aa, Artificial Sequence
  Description of Artificial Sequence: Synthetic peptide
SGDKLGDKYAC

SEQ ID NO: 1051 - DNA, 33 bp, Artificial Sequence; identical to SEQ ID NO: 1031
  Description of Artificial Sequence: Synthetic oligonucleotide

SEQ ID NO: 1052 - protein, 11 aa, Artificial Sequence
  Description of Artificial Sequence: Synthetic peptide
SGDKLGNKYAY

SEQ ID NO: 1053 - DNA, 33 bp, Artificial Sequence
  Description of Artificial Sequence: Synthetic oligonucleotide
cgggcgagtcagggcattaggaattttttagcc

SEQ ID NO: 1054 - protein, 11 aa, Artificial Sequence
  Description of Artificial Sequence: Synthetic peptide
RASQGIRNFLA

SEQ ID NO: 1055 - DNA, 42 bp, Artificial Sequence
  Description of Artificial Sequence: Synthetic oligonucleotide
actggaaccagcagtgacgttggtggttataactctgtctcc

SEQ ID NO: 1056 - protein, 14 aa, Artificial Sequence
  Description of Artificial Sequence: Synthetic peptide
TGTSSDVGGYNSVS

SEQ ID NO: 1057 - DNA, 51 bp, Artificial Sequence
  Description of Artificial Sequence: Synthetic oligonucleotide
aagtccagccagagtgttttacacagctccaacaataacaactacttagct

SEQ ID NO: 1058 - protein, 17 aa, Artificial Sequence
  Description of Artificial Sequence: Synthetic peptide
KSSQSVLHSSNNNNYLA

SEQ ID NO: 1059 - DNA, 33 bp, Artificial Sequence; identical to SEQ ID NO: 709
  Description of Artificial Sequence: Synthetic oligonucleotide

SEQ ID NO: 1060 - protein, 11 aa, Artificial Sequence
  Description of Artificial Sequence: Synthetic peptide
SGDKLGEKYAC

SEQ ID NO: 1061 - DNA, 33 bp, Artificial Sequence; identical to SEQ ID NO: 283
  Description of Artificial Sequence: Synthetic oligonucleotide

SEQ ID NO: 1062 - protein, 11 aa, Artificial Sequence
  Description of Artificial Sequence: Synthetic peptide
RASQDISNYLA

SEQ ID NO: 1063 - DNA, 33 bp, Artificial Sequence
  Description of Artificial Sequence: Synthetic oligonucleotide
cgggcgagtcagggtattaccaagtggttagcc

SEQ ID NO: 1064 - protein, 11 aa, Artificial Sequence
  Description of Artificial Sequence: Synthetic peptide
RASQGITKWLA

SEQ ID NO: 1065 - DNA, 33 bp, Artificial Sequence
  Description of Artificial Sequence: Synthetic oligonucleotide
tctggagaaaaattgggggataaatatgtttgt

SEQ ID NO: 1066 - protein, 11 aa, Artificial Sequence
  Description of Artificial Sequence: Synthetic peptide
SGEKLGDKYVC

SEQ ID NO: 1067 - DNA, 51 bp, Artificial Sequence
  Description of Artificial Sequence: Synthetic oligonucleotide
aagtccagccagagtattttattcagctccaacaataacaactacttagct

SEQ ID NO: 1068 - protein, 17 aa, Artificial Sequence
  Description of Artificial Sequence: Synthetic peptide
KSSQSILFSSNNNNYLA

SEQ ID NO: 1069 - DNA, 48 bp, Artificial Sequence
  Description of Artificial Sequence: Synthetic oligonucleotide
aggtctagtcaaagcctcgtatacagtgatggaaacacctacttgaat

SEQ ID NO: 1070 - protein, 16 aa, Artificial Sequence
  Description of Artificial Sequence: Synthetic peptide
RSSQSLVYSDGNTYLN

SEQ ID NO: 1071 - DNA, 51 bp, Artificial Sequence
  Description of Artificial Sequence: Synthetic oligonucleotide
aagtccagccagagtgttttatacagctccaacaataagaactacttagct

SEQ ID NO: 1072 - protein, 17 aa, Artificial Sequence
  Description of Artificial Sequence: Synthetic peptide
KSSQSVLYSSNNKNYLA

SEQ ID NO: 1073 - DNA, 51 bp, Artificial Sequence
  Description of Artificial Sequence: Synthetic oligonucleotide
aagtccagccagagtgttttataccactccaacaattacaactacttagct

SEQ ID NO: 1074 - protein, 17 aa, Artificial Sequence
  Description of Artificial Sequence: Synthetic peptide
KSSQSVLYHSNNYNYLA

SEQ ID NO: 1075 - DNA, 51 bp, Artificial Sequence; identical to SEQ ID NO: 1071
  Description of Artificial Sequence: Synthetic oligonucleotide

SEQ ID NO: 1076 - protein, 17 aa, Artificial Sequence
  Description of Artificial Sequence: Synthetic peptide
KSSQSVLYSSNNKNYLA

SEQ ID NO: 1077 - DNA, 33 bp, Artificial Sequence; identical to SEQ ID NO: 95
  Description of Artificial Sequence: Synthetic oligonucleotide

SEQ ID NO: 1078 - protein, 11 aa, Artificial Sequence
  Description of Artificial Sequence: Synthetic peptide
RASQGISKWLA

SEQ ID NO: 1079 - DNA, 51 bp, Artificial Sequence
  Description of Artificial Sequence: Synthetic oligonucleotide
aagtccagccagagtgttttatacagctccaacaattacaactacttagct

SEQ ID NO: 1080 - protein, 17 aa, Artificial Sequence
  Description of Artificial Sequence: Synthetic peptide
KSSQSVLYSSNNYNYLA

SEQ ID NO: 1081 - DNA, 51 bp, Artificial Sequence
  Description of Artificial Sequence: Synthetic oligonucleotide
aagtccagccagagtgttttacacagctccaacaataagaactacttagct

SEQ ID NO: 1082 - protein, 17 aa, Artificial Sequence
  Description of Artificial Sequence: Synthetic peptide
KSSQSVLHSSNNKNYLA

SEQ ID NO: 1083 - DNA, 33 bp, Artificial Sequence; identical to SEQ ID NO: 105
  Description of Artificial Sequence: Synthetic oligonucleotide

SEQ ID NO: 1084 - protein, 11 aa, Artificial Sequence
  Description of Artificial Sequence: Synthetic peptide
RASQGISNYLA

SEQ ID NO: 1085 - DNA, 33 bp, Artificial Sequence
  Description of Artificial Sequence: Synthetic oligonucleotide
cgggcaagtcaggacatgagaagtgatttaggc

SEQ ID NO: 1086 - protein, 11 aa, Artificial Sequence
  Description of Artificial Sequence: Synthetic peptide
RASQDMRSDLG

SEQ ID NO: 1087 - DNA, 48 bp, Artificial Sequence
  Description of Artificial Sequence: Synthetic oligonucleotide
aggtcaagtcaaagcctcgtatacagtgatggaaacacctacttgaat

SEQ ID NO: 1088 - protein, 16 aa, Artificial Sequence
  Description of Artificial Sequence: Synthetic peptide
RSSQSLVYSDGNTYLN

SEQ ID NO: 1089 - DNA, 33 bp, Artificial Sequence
  Description of Artificial Sequence: Synthetic oligonucleotide
cgggcgagtcaggacattagcaattatttggcc

SEQ ID NO: 1090 - protein, 11 aa, Artificial Sequence
  Description of Artificial Sequence: Synthetic peptide
RASQDISNYLA

SEQ ID NO: 1091 - DNA, 33 bp, Artificial Sequence; identical to SEQ ID NO: 493
  Description of Artificial Sequence: Synthetic oligonucleotide

SEQ ID NO: 1092 - protein, 11 aa, Artificial Sequence
  Description of Artificial Sequence: Synthetic peptide
RASQDIRSDLG

SEQ ID NO: 1093 - DNA, 33 bp, Artificial Sequence
  Description of Artificial Sequence: Synthetic oligonucleotide
cgggcaagtcagagcattagaagctatttaaat

SEQ ID NO: 1094 - protein, 11 aa, Artificial Sequence
  Description of Artificial Sequence: Synthetic peptide
RASQSIRSYLN

SEQ ID NO: 1095 - DNA, 51 bp, Artificial Sequence; identical to SEQ ID NO: 1079
  Description of Artificial Sequence: Synthetic oligonucleotide

SEQ ID NO: 1096 - protein, 17 aa, Artificial Sequence
  Description of Artificial Sequence: Synthetic peptide
KSSQSVLYSSNNYNYLA

SEQ ID NO: 1097 - DNA, 33 bp, Artificial Sequence; identical to SEQ ID NO: 493
  Description of Artificial Sequence: Synthetic oligonucleotide

SEQ ID NO: 1098 - protein, 11 aa, Artificial Sequence
  Description of Artificial Sequence: Synthetic peptide
RASQDIRSDLG

SEQ ID NO: 1099 - DNA, 36 bp, Artificial Sequence; identical to SEQ ID NO: 195
  Description of Artificial Sequence: Synthetic oligonucleotide

SEQ ID NO: 1100 - protein, 12 aa, Artificial Sequence
  Description of Artificial Sequence: Synthetic peptide
TLSSEHSTYTIE

SEQ ID NO: 1101 - DNA, 33 bp, Artificial Sequence; identical to SEQ ID NO: 693
  Description of Artificial Sequence: Synthetic oligonucleotide

SEQ ID NO: 1102 - protein, 11 aa, Artificial Sequence
  Description of Artificial Sequence: Synthetic peptide
SGDKLGDKYAC

SEQ ID NO: 1103 - DNA, 33 bp, Artificial Sequence; identical to SEQ ID NO: 109
  Description of Artificial Sequence: Synthetic oligonucleotide

SEQ ID NO: 1104 - protein, 11 aa, Artificial Sequence
  Description of Artificial Sequence: Synthetic peptide
RASQGIRNDLG

SEQ ID NO: 1105 - DNA, 33 bp, Artificial Sequence; identical to SEQ ID NO: 105
  Description of Artificial Sequence: Synthetic oligonucleotide

SEQ ID NO: 1106 - protein, 11 aa, Artificial Sequence
  Description of Artificial Sequence: Synthetic peptide
RASQGISNYLA

SEQ ID NO: 1107 - DNA, 33 bp, Artificial Sequence; identical to SEQ ID NO: 625
  Description of Artificial Sequence: Synthetic oligonucleotide

SEQ ID NO: 1108 - protein, 11 aa, Artificial Sequence
  Description of Artificial Sequence: Synthetic peptide
RASQGISRWLA

SEQ ID NO: 1109 - DNA, 33 bp, Artificial Sequence; identical to SEQ ID NO: 693
  Description of Artificial Sequence: Synthetic oligonucleotide

SEQ ID NO: 1110 - protein, 11 aa, Artificial Sequence
  Description of Artificial Sequence: Synthetic peptide
SGDKLGDKYAC

SEQ ID NO: 1111 - DNA, 33 bp, Artificial Sequence
  Description of Artificial Sequence: Synthetic oligonucleotide
cgggcaagtcagggcattagaaattatttaggc

SEQ ID NO: 1112 - protein, 11 aa, Artificial Sequence
  Description of Artificial Sequence: Synthetic peptide
RASQGIRNYLG

SEQ ID NO: 1113 - DNA, 33 bp, Artificial Sequence; identical to SEQ ID NO: 697
  Description of Artificial Sequence: Synthetic oligonucleotide

SEQ ID NO: 1114 - protein, 11 aa, Artificial Sequence
  Description of Artificial Sequence: Synthetic peptide
SGDKLGEKYAC

SEQ ID NO: 1115 - DNA, 33 bp, Artificial Sequence
  Description of Artificial Sequence: Synthetic oligonucleotide
cgggcgagtcaggacataagtaattatttagcc

SEQ ID NO: 1116 - protein, 11 aa, Artificial Sequence
  Description of Artificial Sequence: Synthetic peptide
RASQDISNYLA

SEQ ID NO: 1117 - DNA, 33 bp, Artificial Sequence; identical to SEQ ID NO: 293
  Description of Artificial Sequence: Synthetic oligonucleotide

SEQ ID NO: 1118 - protein, 11 aa, Artificial Sequence
  Description of Artificial Sequence: Synthetic peptide
RASQGINNYLA

SEQ ID NO: 1119 - DNA, 33 bp, Artificial Sequence
  Description of Artificial Sequence: Synthetic oligonucleotide
cgggcgagtcagggcattgccaattatttagcc

SEQ ID NO: 1120 - protein, 11 aa, Artificial Sequence
  Description of Artificial Sequence: Synthetic peptide
RASQGIANYLA

SEQ ID NO: 1121 - DNA, 33 bp, Artificial Sequence; identical to SEQ ID NO: 109
  Description of Artificial Sequence: Synthetic oligonucleotide

SEQ ID NO: 1122 - protein, 11 aa, Artificial Sequence
  Description of Artificial Sequence: Synthetic peptide
RASQGIRNDLG

SEQ ID NO: 1123 - DNA, 33 bp, Artificial Sequence; identical to SEQ ID NO: 547
  Description of Artificial Sequence: Synthetic oligonucleotide

SEQ ID NO: 1124 - protein, 11 aa, Artificial Sequence
  Description of Artificial Sequence: Synthetic peptide
RASQNIYSYLN

SEQ ID NO: 1125 - DNA, 33 bp, Artificial Sequence
  Description of Artificial Sequence: Synthetic oligonucleotide
cgggcaagtcagggcattaggagtgatttaggc

SEQ ID NO: 1126 - protein, 11 aa, Artificial Sequence
  Description of Artificial Sequence: Synthetic peptide
RASQGIRSDLG

SEQ ID NO: 1127 - DNA, 33 bp, Artificial Sequence; identical to SEQ ID NO: 709
  Description of Artificial Sequence: Synthetic oligonucleotide

SEQ ID NO: 1128 - protein, 11 aa, Artificial Sequence
  Description of Artificial Sequence: Synthetic peptide
SGDKLGEKYAC

SEQ ID NO: 1129 - DNA, 51 bp, Artificial Sequence
  Description of Artificial Sequence: Synthetic oligonucleotide
aagtccagccagagtattttacacagctccaacaataacaactacttagct

SEQ ID NO: 1130 - protein, 17 aa, Artificial Sequence
  Description of Artificial Sequence: Synthetic peptide
KSSQSILHSSNNNNYLA

SEQ ID NO: 1131 - DNA, 51 bp, Artificial Sequence; identical to SEQ ID NO: 1129
  Description of Artificial Sequence: Synthetic oligonucleotide

SEQ ID NO: 1132 - protein, 17 aa, Artificial Sequence
  Description of Artificial Sequence: Synthetic peptide
KSSQSILHSSNNNNYLA

SEQ ID NO: 1133 - DNA, 33 bp, Artificial Sequence; identical to SEQ ID NO: 163
  Description of Artificial Sequence: Synthetic oligonucleotide

SEQ ID NO: 1134 - protein, 11 aa, Artificial Sequence
  Description of Artificial Sequence: Synthetic peptide
SGDKLGDKYAY

SEQ ID NO: 1135 - DNA, 48 bp, Artificial Sequence
  Description of Artificial Sequence: Synthetic oligonucleotide
aggtctagtcaaagcctcatatacagtgatggaaacaccttcttgaat

SEQ ID NO: 1136 - protein, 16 aa, Artificial Sequence
  Description of Artificial Sequence: Synthetic peptide
RSSQSLIYSDGNTFLN

SEQ ID NO: 1137 - DNA, 51 bp, Artificial Sequence
  Description of Artificial Sequence: Synthetic oligonucleotide
aagtccagccagagtgttttacacagctccaacaattataactacttagct

SEQ ID NO: 1138 - protein, 17 aa, Artificial Sequence
  Description of Artificial Sequence: Synthetic peptide
KSSQSVLHSSNNYNYLA

SEQ ID NO: 1139 - DNA, 51 bp, Artificial Sequence; identical to SEQ ID NO: 479
  Description of Artificial Sequence: Synthetic oligonucleotide

SEQ ID NO: 1140 - protein, 17 aa, Artificial Sequence
  Description of Artificial Sequence: Synthetic peptide
KSSQSVLYSSHNNNYLA

SEQ ID NO: 1141 - DNA, 33 bp, Artificial Sequence; identical to SEQ ID NO: 871
  Description of Artificial Sequence: Synthetic oligonucleotide

SEQ ID NO: 1142 - protein, 11 aa, Artificial Sequence
  Description of Artificial Sequence: Synthetic peptide
RASQNIISYLN

SEQ ID NO: 1143 - DNA, 33 bp, Artificial Sequence; identical to SEQ ID NO: 95
  Description of Artificial Sequence: Synthetic oligonucleotide

SEQ ID NO: 1144 - protein, 11 aa, Artificial Sequence
  Description of Artificial Sequence: Synthetic peptide
RASQGISKWLA

SEQ ID NO: 1145 - DNA, 33 bp, Artificial Sequence; identical to SEQ ID NO: 171
  Description of Artificial Sequence: Synthetic oligonucleotide

SEQ ID NO: 1146 - protein, 11 aa, Artificial Sequence
  Description of Artificial Sequence: Synthetic peptide
RASQGISSWLA

SEQ ID NO: 1147 - DNA, 51 bp, Artificial Sequence
  Description of Artificial Sequence: Synthetic oligonucleotide
aagtccagccagactgttttattcagctccaacaataaccactacttagca

SEQ ID NO: 1148 - protein, 17 aa, Artificial Sequence
  Description of Artificial Sequence: Synthetic peptide
KSSQTVLFSSNNNHYLA

SEQ ID NO: 1149 - DNA, 33 bp, Artificial Sequence; identical to SEQ ID NO: 109
  Description of Artificial Sequence: Synthetic oligonucleotide

SEQ ID NO: 1150 - protein, 11 aa, Artificial Sequence
  Description of Artificial Sequence: Synthetic peptide
RASQGIRNDLG

SEQ ID NO: 1151 - DNA, 33 bp, Artificial Sequence; identical to SEQ ID NO: 519
  Description of Artificial Sequence: Synthetic oligonucleotide

SEQ ID NO: 1152 - protein, 11 aa, Artificial Sequence
  Description of Artificial Sequence: Synthetic peptide
RASQAIRNDLG

SEQ ID NO: 1153 - DNA, 33 bp, Artificial Sequence; identical to SEQ ID NO: 547
  Description of Artificial Sequence: Synthetic oligonucleotide

SEQ ID NO: 1154 - protein, 11 aa, Artificial Sequence
  Description of Artificial Sequence: Synthetic peptide
RASQNIYSYLN

SEQ ID NO: 1155 - DNA, 33 bp, Artificial Sequence; identical to SEQ ID NO: 361
  Description of Artificial Sequence: Synthetic oligonucleotide

SEQ ID NO: 1156 - protein, 11 aa, Artificial Sequence
  Description of Artificial Sequence: Synthetic peptide
RASQNIISYLN

SEQ ID NO: 1157 - DNA, 51 bp, Artificial Sequence
  Description of Artificial Sequence: Synthetic oligonucleotide
aagtccagccagagtgttttacacaactccaacaattataactatttagct

SEQ ID NO: 1158 - protein, 17 aa, Artificial Sequence
  Description of Artificial Sequence: Synthetic peptide
KSSQSVLHNSNNYNYLA

SEQ ID NO: 1159 - DNA, 33 bp, Artificial Sequence; identical to SEQ ID NO: 109
  Description of Artificial Sequence: Synthetic oligonucleotide

SEQ ID NO: 1160 - protein, 11 aa, Artificial Sequence
  Description of Artificial Sequence: Synthetic peptide
RASQGIRNDLG

SEQ ID NO: 1161 - DNA, 33 bp, Artificial Sequence
  Description of Artificial Sequence: Synthetic oligonucleotide
cgggcgagtcagggtattagcgactggttagcc

SEQ ID NO: 1162 - protein, 11 aa, Artificial Sequence
  Description of Artificial Sequence: Synthetic peptide
RASQGISDWLA

SEQ ID NO: 1163 - DNA, 33 bp, Artificial Sequence; identical to SEQ ID NO: 109
  Description of Artificial Sequence: Synthetic oligonucleotide

SEQ ID NO: 1164 - protein, 11 aa, Artificial Sequence
  Description of Artificial Sequence: Synthetic peptide
RASQGIRNDLG

SEQ ID NO: 1165 - DNA, 33 bp, Artificial Sequence; identical to SEQ ID NO: 293
  Description of Artificial Sequence: Synthetic oligonucleotide

SEQ ID NO: 1166 - protein, 11 aa, Artificial Sequence
  Description of Artificial Sequence: Synthetic peptide
RASQGINNYLA

SEQ ID NO: 1167 - DNA, 33 bp, Artificial Sequence
  Description of Artificial Sequence: Synthetic oligonucleotide
cgggcgagtcagggtattatcaactggttagcc

SEQ ID NO: 1168 - protein, 11 aa, Artificial Sequence
  Description of Artificial Sequence: Synthetic peptide
RASQGIINWLA

SEQ ID NO: 1169 - DNA, 33 bp, Artificial Sequence; identical to SEQ ID NO: 109
  Description of Artificial Sequence: Synthetic oligonucleotide

SEQ ID NO: 1170 - protein, 11 aa, Artificial Sequence
  Description of Artificial Sequence: Synthetic peptide
RASQGIRNDLG

SEQ ID NO: 1171 - DNA, 51 bp, Artificial Sequence
  Description of Artificial Sequence: Synthetic oligonucleotide
aagtccagccagagtgttttaatgacctccaacgataagaactacttaact

SEQ ID NO: 1172 - protein, 17 aa, Artificial Sequence
  Description of Artificial Sequence: Synthetic peptide
KSSQSVLMTSNDKNYLT

SEQ ID NO: 1173 - DNA, 33 bp, Artificial Sequence; identical to SEQ ID NO: 553
  Description of Artificial Sequence: Synthetic oligonucleotide

SEQ ID NO: 1174 - protein, 11 aa, Artificial Sequence
  Description of Artificial Sequence: Synthetic peptide
RASQGISNWLA

SEQ ID NO: 1175 - DNA, 33 bp, Artificial Sequence; identical to SEQ ID NO: 109
  Description of Artificial Sequence: Synthetic oligonucleotide

SEQ ID NO: 1176 - protein, 11 aa, Artificial Sequence
  Description of Artificial Sequence: Synthetic peptide
RASQGIRNDLG

SEQ ID NO: 1177 - DNA, 33 bp, Artificial Sequence
  Description of Artificial Sequence: Synthetic oligonucleotide
cgggcgagtcaggatattagcagctggttagcc

SEQ ID NO: 1178 - protein, 11 aa, Artificial Sequence
  Description of Artificial Sequence: Synthetic peptide
RASQDISSWLA

SEQ ID NO: 1179 - DNA, 48 bp, Artificial Sequence
  Description of Artificial Sequence: Synthetic oligonucleotide
aagtctagtcagagcctcctgcacagtgatggaaggacctatttgtat

SEQ ID NO: 1180 - protein, 16 aa, Artificial Sequence
  Description of Artificial Sequence: Synthetic peptide
KSSQSLLHSDGRTYLY

SEQ ID NO: 1181 - DNA, 33 bp, Artificial Sequence; identical to SEQ ID NO: 109
  Description of Artificial Sequence: Synthetic oligonucleotide

SEQ ID NO: 1182 - protein, 11 aa, Artificial Sequence
  Description of Artificial Sequence: Synthetic peptide
RASQGIRNDLG

SEQ ID NO: 1183 - DNA, 33 bp, Artificial Sequence; identical to SEQ ID NO: 109
  Description of Artificial Sequence: Synthetic oligonucleotide

SEQ ID NO: 1184 - protein, 11 aa, Artificial Sequence
  Description of Artificial Sequence: Synthetic peptide
RASQGIRNDLG

SEQ ID NO: 1185 - DNA, 33 bp, Artificial Sequence
  Description of Artificial Sequence: Synthetic oligonucleotide
cgggcaagtcagggcattagagatgatttaggc

SEQ ID NO: 1186 - protein, 11 aa, Artificial Sequence
  Description of Artificial Sequence: Synthetic peptide
RASQGIRDDLG

SEQ ID NO: 1187 - DNA, 33 bp, Artificial Sequence; identical to SEQ ID NO: 1161
  Description of Artificial Sequence: Synthetic oligonucleotide

SEQ ID NO: 1188 - protein, 11 aa, Artificial Sequence
  Description of Artificial Sequence: Synthetic peptide
RASQGISDWLA

SEQ ID NO: 1189 - DNA, 33 bp, Artificial Sequence
  Description of Artificial Sequence: Synthetic oligonucleotide
cgggcaagtcaggacattagaaaagatttaggc

SEQ ID NO: 1190 - protein, 11 aa, Artificial Sequence
  Description of Artificial Sequence: Synthetic peptide
RASQDIRKDLG

SEQ ID NO: 1191 - DNA, 36 bp, Artificial Sequence
  Description of Artificial Sequence: Synthetic oligonucleotide
agggccagtcagagtgttagtggaagctacttagcc

SEQ ID NO: 1192 - protein, 12 aa, Artificial Sequence
  Description of Artificial Sequence: Synthetic peptide
RASQSVSGSYLA

SEQ ID NO: 1193 - DNA, 33 bp, Artificial Sequence; identical to SEQ ID NO: 109
  Description of Artificial Sequence: Synthetic oligonucleotide

SEQ ID NO: 1194 - protein, 11 aa, Artificial Sequence
  Description of Artificial Sequence: Synthetic peptide
RASQGIRNDLG

SEQ ID NO: 1195 - DNA, 33 bp, Artificial Sequence; identical to SEQ ID NO: 109
  Description of Artificial Sequence: Synthetic oligonucleotide

SEQ ID NO: 1196 - protein, 11 aa, Artificial Sequence
  Description of Artificial Sequence: Synthetic peptide
RASQGIRNDLG

SEQ ID NO: 1197 - DNA, 48 bp, Artificial Sequence
  Description of Artificial Sequence: Synthetic oligonucleotide
aagtctagtcagagcctcctgcatagtgagggaaggacctatttgtat

SEQ ID NO: 1198 - protein, 16 aa, Artificial Sequence
  Description of Artificial Sequence: Synthetic peptide
KSSQSLLHSEGRTYLY

SEQ ID NO: 1199 - DNA, 33 bp, Artificial Sequence; identical to SEQ ID NO: 1185
  Description of Artificial Sequence: Synthetic oligonucleotide

SEQ ID NO: 1200 - protein, 11 aa, Artificial Sequence
  Description of Artificial Sequence: Synthetic peptide
RASQGIRDDLG

SEQ ID NO: 1201 - DNA, 33 bp, Artificial Sequence; identical to SEQ ID NO: 1161
  Description of Artificial Sequence: Synthetic oligonucleotide

SEQ ID NO: 1202 - protein, 11 aa, Artificial Sequence
  Description of Artificial Sequence: Synthetic peptide
RASQGISDWLA

SEQ ID NO: 1203 - DNA, 48 bp, Artificial Sequence
  Description of Artificial Sequence: Synthetic oligonucleotide
aggtctagtcagagcctcctgcatagtaatggatacagctatttggag

SEQ ID NO: 1204 - protein, 16 aa, Artificial Sequence
  Description of Artificial Sequence: Synthetic peptide
RSSQSLLHSNGYSYLE

SEQ ID NO: 1205 - DNA, 33 bp, Artificial Sequence; identical to SEQ ID NO: 553
  Description of Artificial Sequence: Synthetic oligonucleotide

SEQ ID NO: 1206 - protein, 11 aa, Artificial Sequence
  Description of Artificial Sequence: Synthetic peptide
RASQGISNWLA

SEQ ID NO: 1207 - DNA, 33 bp, Artificial Sequence; identical to SEQ ID NO: 93
  Description of Artificial Sequence: Synthetic oligonucleotide

SEQ ID NO: 1208 - protein, 11 aa, Artificial Sequence
  Description of Artificial Sequence: Synthetic peptide
RTSQGIRNDLG

SEQ ID NO: 1209 - DNA, 33 bp, Artificial Sequence; identical to SEQ ID NO: 109
  Description of Artificial Sequence: Synthetic oligonucleotide

SEQ ID NO: 1210 - protein, 11 aa, Artificial Sequence
  Description of Artificial Sequence: Synthetic peptide
RASQGIRNDLG

SEQ ID NO: 1211 - DNA, 33 bp, Artificial Sequence; identical to SEQ ID NO: 1185
  Description of Artificial Sequence: Synthetic oligonucleotide

SEQ ID NO: 1212 - protein, 11 aa, Artificial Sequence
  Description of Artificial Sequence: Synthetic peptide
RASQGIRDDLG

SEQ ID NO: 1213 - DNA, 33 bp, Artificial Sequence; identical to SEQ ID NO: 1177
  Description of Artificial Sequence: Synthetic oligonucleotide

SEQ ID NO: 1214 - protein, 11 aa, Artificial Sequence
  Description of Artificial Sequence: Synthetic peptide
RASQDISSWLA

SEQ ID NO: 1215 - DNA, 33 bp, Artificial Sequence; identical to SEQ ID NO: 491
  Description of Artificial Sequence: Synthetic oligonucleotide

SEQ ID NO: 1216 - protein, 11 aa, Artificial Sequence
  Description of Artificial Sequence: Synthetic peptide
RASQDIRDDLG

SEQ ID NO: 1217 - DNA, 33 bp, Artificial Sequence; identical to SEQ ID NO: 1161
  Description of Artificial Sequence: Synthetic oligonucleotide

SEQ ID NO: 1218 - protein, 11 aa, Artificial Sequence
  Description of Artificial Sequence: Synthetic peptide
RASQGISDWLA

SEQ ID NO: 1219 - DNA, 33 bp, Artificial Sequence
  Description of Artificial Sequence: Synthetic oligonucleotide
cgggcgagtcaggatattagcgactggttagct

SEQ ID NO: 1220 - protein, 11 aa, Artificial Sequence
  Description of Artificial Sequence: Synthetic peptide
RASQDISDWLA

SEQ ID NO: 1221 - DNA, 33 bp, Artificial Sequence; identical to SEQ ID NO: 293
  Description of Artificial Sequence: Synthetic oligonucleotide

SEQ ID NO: 1222 - protein, 11 aa, Artificial Sequence
  Description of Artificial Sequence: Synthetic peptide
RASQGINNYLA

SEQ ID NO: 1223 - DNA, 33 bp, Artificial Sequence; identical to SEQ ID NO: 109
  Description of Artificial Sequence: Synthetic oligonucleotide

SEQ ID NO: 1224 - protein, 11 aa, Artificial Sequence
  Description of Artificial Sequence: Synthetic peptide
RASQGIRNDLG

SEQ ID NO: 1225 - DNA, 48 bp, Artificial Sequence
  Description of Artificial Sequence: Synthetic oligonucleotide
aagtctagtcagagcctcctgcatggtgatggaaagacatatttgtat

SEQ ID NO: 1226 - protein, 16 aa, Artificial Sequence
  Description of Artificial Sequence: Synthetic peptide
KSSQSLLHGDGKTYLY

SEQ ID NO: 1227 - DNA, 33 bp, Artificial Sequence; identical to SEQ ID NO: 1185
  Description of Artificial Sequence: Synthetic oligonucleotide

SEQ ID NO: 1228 - protein, 11 aa, Artificial Sequence
  Description of Artificial Sequence: Synthetic peptide
RASQGIRDDLG

SEQ ID NO: 1229 - DNA, 33 bp, Artificial Sequence
  Description of Artificial Sequence: Synthetic oligonucleotide
cgggcaagtcagggcattagaaaagatttaggc

SEQ ID NO: 1230 - protein, 11 aa, Artificial Sequence
  Description of Artificial Sequence: Synthetic peptide
RASQGIRKDLG

SEQ ID NO: 1231 - DNA, 33 bp, Artificial Sequence
  Description of Artificial Sequence: Synthetic oligonucleotide
cggacaagtcaggacattagaaaagatttaggc

SEQ ID NO: 1232 - protein, 11 aa, Artificial Sequence
  Description of Artificial Sequence: Synthetic peptide
RTSQDIRKDLG

SEQ ID NO: 1233 - DNA, 33 bp, Artificial Sequence; identical to SEQ ID NO: 553
  Description of Artificial Sequence: Synthetic oligonucleotide

SEQ ID NO: 1234 - protein, 11 aa, Artificial Sequence
  Description of Artificial Sequence: Synthetic peptide
RASQGISNWLA

SEQ ID NO: 1235 - DNA, 33 bp, Artificial Sequence; identical to SEQ ID NO: 109
  Description of Artificial Sequence: Synthetic oligonucleotide

SEQ ID NO: 1236 - protein, 11 aa, Artificial Sequence
  Description of Artificial Sequence: Synthetic peptide
RASQGIRNDLG

SEQ ID NO: 1237 - DNA, 33 bp, Artificial Sequence; identical to SEQ ID NO: 1229
  Description of Artificial Sequence: Synthetic oligonucleotide

SEQ ID NO: 1238 - protein, 11 aa, Artificial Sequence
  Description of Artificial Sequence: Synthetic peptide
RASQGIRKDLG

SEQ ID NO: 1239 - DNA, 48 bp, Artificial Sequence; identical to SEQ ID NO: 555
  Description of Artificial Sequence: Synthetic oligonucleotide

SEQ ID NO: 1240 - protein, 16 aa, Artificial Sequence
  Description of Artificial Sequence: Synthetic peptide
KSSQSLLHSEGKTYLY

SEQ ID NO: 1241 - DNA, 33 bp, Artificial Sequence; identical to SEQ ID NO: 109
  Description of Artificial Sequence: Synthetic oligonucleotide

SEQ ID NO: 1242 - protein, 11 aa, Artificial Sequence
  Description of Artificial Sequence: Synthetic peptide
RASQGIRNDLG

SEQ ID NO: 1243 - DNA, 33 bp, Artificial Sequence; identical to SEQ ID NO: 205
  Description of Artificial Sequence: Synthetic oligonucleotide

SEQ ID NO: 1244 - protein, 11 aa, Artificial Sequence
  Description of Artificial Sequence: Synthetic peptide
RASQDIRNDLG

SEQ ID NO: 1245 - DNA, 48 bp, Artificial Sequence
  Description of Artificial Sequence: Synthetic oligonucleotide
acgtctagtcagagcctcctgcatagtgaaggaaagacctatttgtat

SEQ ID NO: 1246 - protein, 16 aa, Artificial Sequence
  Description of Artificial Sequence: Synthetic peptide
TSSQSLLHSEGKTYLY

SEQ ID NO: 1247 - DNA, 33 bp, Artificial Sequence; identical to SEQ ID NO: 109
  Description of Artificial Sequence: Synthetic oligonucleotide

SEQ ID NO: 1248 - protein, 11 aa, Artificial Sequence
  Description of Artificial Sequence: Synthetic peptide
RASQGIRNDLG

SEQ ID NO: 1249 - DNA, 48 bp, Artificial Sequence
  Description of Artificial Sequence: Synthetic oligonucleotide
aggtctagtcagagcctcctgcatagtaatggatacaactatttggaa

SEQ ID NO: 1250 - protein, 16 aa, Artificial Sequence
  Description of Artificial Sequence: Synthetic peptide
RSSQSLLHSNGYNYLE

SEQ ID NO: 1251 - DNA, 48 bp, Artificial Sequence
  Description of Artificial Sequence: Synthetic oligonucleotide
aagtctagtcagagcctcctgcatagtgatggaaggacctatttgtat

SEQ ID NO: 1252 - protein, 16 aa, Artificial Sequence
  Description of Artificial Sequence: Synthetic peptide
KSSQSLLHSDGRTYLY

SEQ ID NO: 1253 - DNA, 33 bp, Artificial Sequence; identical to SEQ ID NO: 553
  Description of Artificial Sequence: Synthetic oligonucleotide

SEQ ID NO: 1254 - protein, 11 aa, Artificial Sequence
  Description of Artificial Sequence: Synthetic peptide
RASQGISNWLA

SEQ ID NO: 1255 - DNA, 33 bp, Artificial Sequence; identical to SEQ ID NO: 93
  Description of Artificial Sequence: Synthetic oligonucleotide

SEQ ID NO: 1256 - protein, 11 aa, Artificial Sequence
  Description of Artificial Sequence: Synthetic peptide
RTSQGIRNDLG

SEQ ID NO: 1257 - DNA, 33 bp, Artificial Sequence; identical to SEQ ID NO: 93
  Description of Artificial Sequence: Synthetic oligonucleotide

SEQ ID NO: 1258 - protein, 11 aa, Artificial Sequence
  Description of Artificial Sequence: Synthetic peptide
RTSQGIRNDLG

SEQ ID NO: 1259 - DNA, 33 bp, Artificial Sequence
  Description of Artificial Sequence: Synthetic oligonucleotide
cgggcaagtcagagcattagcagctatttaatt

SEQ ID NO: 1260 - protein, 11 aa, Artificial Sequence
  Description of Artificial Sequence: Synthetic peptide
RASQSISSYLI

SEQ ID NO: 1261 - DNA, 33 bp, Artificial Sequence; identical to SEQ ID NO: 147
  Description of Artificial Sequence: Synthetic oligonucleotide

SEQ ID NO: 1262 - protein, 11 aa, Artificial Sequence
  Description of Artificial Sequence: Synthetic peptide
RASRGIRDDLG

SEQ ID NO: 1263 - DNA, 33 bp, Artificial Sequence
  Description of Artificial Sequence: Synthetic oligonucleotide
cgggcaagtcagagcattatcagctatttaatt

SEQ ID NO: 1264 - protein, 11 aa, Artificial Sequence
  Description of Artificial Sequence: Synthetic peptide
RASQSIISYLI

SEQ ID NO: 1265 - DNA, 33 bp, Artificial Sequence
  Description of Artificial Sequence: Synthetic oligonucleotide
cgggcgagtcaaaatattaccagctggttagcc

SEQ ID NO: 1266 - protein, 11 aa, Artificial Sequence
  Description of Artificial Sequence: Synthetic peptide
RASQNITSWLA

SEQ ID NO: 1267 - DNA, 33 bp, Artificial Sequence; identical to SEQ ID NO: 109
  Description of Artificial Sequence: Synthetic oligonucleotide

SEQ ID NO: 1268 - protein, 11 aa, Artificial Sequence
  Description of Artificial Sequence: Synthetic peptide
RASQGIRNDLG

SEQ ID NO: 1269 - DNA, 33 bp, Artificial Sequence
  Description of Artificial Sequence: Synthetic oligonucleotide
cgggcaagtcagagcattaggaagtatttaaat

SEQ ID NO: 1270 - protein, 11 aa, Artificial Sequence
  Description of Artificial Sequence: Synthetic peptide
RASQSIRKYLN

SEQ ID NO: 1271 - DNA, 33 bp, Artificial Sequence; identical to SEQ ID NO: 109
  Description of Artificial Sequence: Synthetic oligonucleotide

SEQ ID NO: 1272 - protein, 11 aa, Artificial Sequence
  Description of Artificial Sequence: Synthetic peptide
RASQGIRNDLG

SEQ ID NO: 1273 - DNA, 33 bp, Artificial Sequence; identical to SEQ ID NO: 1269
  Description of Artificial Sequence: Synthetic oligonucleotide

SEQ ID NO: 1274 - protein, 11 aa, Artificial Sequence
  Description of Artificial Sequence: Synthetic peptide
RASQSIRKYLN

SEQ ID NO: 1275 - DNA, 33 bp, Artificial Sequence; identical to SEQ ID NO: 1269
  Description of Artificial Sequence: Synthetic oligonucleotide

SEQ ID NO: 1276 - protein, 11 aa, Artificial Sequence
  Description of Artificial Sequence: Synthetic peptide
RASQSIRKYLN

SEQ ID NO: 1277 - DNA, 33 bp, Artificial Sequence; identical to SEQ ID NO: 371
  Description of Artificial Sequence: Synthetic oligonucleotide

SEQ ID NO: 1278 - protein, 11 aa, Artificial Sequence
  Description of Artificial Sequence: Synthetic peptide
RASQGIRNDLD

SEQ ID NO: 1279 - DNA, 48 bp, Artificial Sequence
  Description of Artificial Sequence: Synthetic oligonucleotide
aagtctagtcagagcctcctgcatagggaaggaaagacctatttgtac

SEQ ID NO: 1280 - protein, 16 aa, Artificial Sequence
  Description of Artificial Sequence: Synthetic peptide
KSSQSLLHREGKTYLY

SEQ ID NO: 1281 - DNA, 33 bp, Artificial Sequence
  Description of Artificial Sequence: Synthetic oligonucleotide
cgggcgagtcgggatattaacggctggttagcc

SEQ ID NO: 1282 - protein, 11 aa, Artificial Sequence
  Description of Artificial Sequence: Synthetic peptide
RASRDINGWLA

SEQ ID NO: 1283 - DNA, 48 bp, Artificial Sequence; identical to SEQ ID NO: 103
  Description of Artificial Sequence: Synthetic oligonucleotide

SEQ ID NO: 1284 - protein, 16 aa, Artificial Sequence
  Description of Artificial Sequence: Synthetic peptide
KSSQSLLHSEGKTYLY

SEQ ID NO: 1285 - DNA, 33 bp, Artificial Sequence
  Description of Artificial Sequence: Synthetic oligonucleotide
cgggcgagtcagggttttagcacctggttagcc

SEQ ID NO: 1286 - protein, 11 aa, Artificial Sequence
  Description of Artificial Sequence: Synthetic peptide
RASQGFSTWLA

SEQ ID NO: 1287 - DNA, 33 bp, Artificial Sequence; identical to SEQ ID NO: 109
  Description of Artificial Sequence: Synthetic oligonucleotide

SEQ ID NO: 1288 - protein, 11 aa, Artificial Sequence
  Description of Artificial Sequence: Synthetic peptide
RASQGIRNDLG

SEQ ID NO: 1289 - DNA, 48 bp, Artificial Sequence
  Description of Artificial Sequence: Synthetic oligonucleotide
aagtctagtcagatcttcttgcatagtgaaggaaagacctatttgtat

SEQ ID NO: 1290 - protein, 16 aa, Artificial Sequence
  Description of Artificial Sequence: Synthetic peptide
KSSQIFLHSEGKTYLY

SEQ ID NO: 1291 - DNA, 48 bp, Artificial Sequence
  Description of Artificial Sequence: Synthetic oligonucleotide
aagtctaatcagagcctcgtgcataatgaaggaaagacctatttgtat

SEQ ID NO: 1292 - protein, 16 aa, Artificial Sequence
  Description of Artificial Sequence: Synthetic peptide
KSNQSLVHNEGKTYLY

SEQ ID NO: 1293 - DNA, 33 bp, Artificial Sequence; identical to SEQ ID NO: 173
  Description of Artificial Sequence: Synthetic oligonucleotide

SEQ ID NO: 1294 - protein, 11 aa, Artificial Sequence
  Description of Artificial Sequence: Synthetic peptide
RASQGISRWLA

SEQ ID NO: 1295 - DNA, 33 bp, Artificial Sequence
  Description of Artificial Sequence: Synthetic oligonucleotide
cggtcaagtcagagcattagtacctatttaatg

SEQ ID NO: 1296 - protein, 11 aa, Artificial Sequence
  Description of Artificial Sequence: Synthetic peptide
RSSQSISTYLM

SEQ ID NO: 1297 - DNA, 33 bp, Artificial Sequence; identical to SEQ ID NO: 109
  Description of Artificial Sequence: Synthetic oligonucleotide

SEQ ID NO: 1298 - protein, 11 aa, Artificial Sequence
  Description of Artificial Sequence: Synthetic peptide
RASQGIRNDLG

SEQ ID NO: 1299 - DNA, 33 bp, Artificial Sequence; identical to SEQ ID NO: 1259
  Description of Artificial Sequence: Synthetic oligonucleotide

SEQ ID NO: 1300 - protein, 11 aa, Artificial Sequence
  Description of Artificial Sequence: Synthetic peptide
RASQSISSYLI

SEQ ID NO: 1301 - DNA, 33 bp, Artificial Sequence
  Description of Artificial Sequence: Synthetic oligonucleotide
cgggcaagtcagggcattagaaataatttaggc

SEQ ID NO: 1302 - protein, 11 aa, Artificial Sequence
  Description of Artificial Sequence: Synthetic peptide
RASQGIRNNLG

SEQ ID NO: 1303 - DNA, 33 bp, Artificial Sequence
  Description of Artificial Sequence: Synthetic oligonucleotide
cgggcaagtcagagcatttacagctatttaatt

SEQ ID NO: 1304 - protein, 11 aa, Artificial Sequence
  Description of Artificial Sequence: Synthetic peptide
RASQSIYSYLI

SEQ ID NO: 1305 - DNA, 33 bp, Artificial Sequence; identical to SEQ ID NO: 109
  Description of Artificial Sequence: Synthetic oligonucleotide

SEQ ID NO: 1306 - protein, 11 aa, Artificial Sequence
  Description of Artificial Sequence: Synthetic peptide
RASQGIRNDLG

SEQ ID NO: 1307 - DNA, 33 bp, Artificial Sequence; identical to SEQ ID NO: 289
  Description of Artificial Sequence: Synthetic oligonucleotide

SEQ ID NO: 1308 - protein, 11 aa, Artificial Sequence
  Description of Artificial Sequence: Synthetic peptide
RASQSISSYLN

SEQ ID NO: 1309 - DNA, 48 bp, Artificial Sequence; identical to SEQ ID NO: 555
  Description of Artificial Sequence: Synthetic oligonucleotide

SEQ ID NO: 1310 - protein, 16 aa, Artificial Sequence
  Description of Artificial Sequence: Synthetic peptide
KSSQSLLHSEGKTYLY

SEQ ID NO: 1311 - DNA, 33 bp, Artificial Sequence
  Description of Artificial Sequence: Synthetic oligonucleotide
caggcgagtcgggacattaccttctatttaaat

SEQ ID NO: 1312 - protein, 11 aa, Artificial Sequence
  Description of Artificial Sequence: Synthetic peptide
QASRDITFYLN

SEQ ID NO: 1313 - DNA, 33 bp, Artificial Sequence; identical to SEQ ID NO: 109
  Description of Artificial Sequence: Synthetic oligonucleotide

SEQ ID NO: 1314 - protein, 11 aa, Artificial Sequence
  Description of Artificial Sequence: Synthetic peptide
RASQGIRNDLG

SEQ ID NO: 1315 - DNA, 33 bp, Artificial Sequence; identical to SEQ ID NO: 105
  Description of Artificial Sequence: Synthetic oligonucleotide

SEQ ID NO: 1316 - protein, 11 aa, Artificial Sequence
  Description of Artificial Sequence: Synthetic peptide
RASQGISNYLA

SEQ ID NO: 1317 - DNA, 33 bp, Artificial Sequence
  Description of Artificial Sequence: Synthetic oligonucleotide
cgggcgagtcaggatgttaacaactacttagcc

SEQ ID NO: 1318 - protein, 11 aa, Artificial Sequence
  Description of Artificial Sequence: Synthetic peptide
RASQDVNNYLA

SEQ ID NO: 1319 - DNA, 33 bp, Artificial Sequence
  Description of Artificial Sequence: Synthetic oligonucleotide
cgggcgagtcaggatattagcagttggttagcc

SEQ ID NO: 1320 - protein, 11 aa, Artificial Sequence
  Description of Artificial Sequence: Synthetic peptide
RASQDISSWLA

SEQ ID NO: 1321 - DNA, 33 bp, Artificial Sequence; identical to SEQ ID NO: 173
  Description of Artificial Sequence: Synthetic oligonucleotide

SEQ ID NO: 1322 - protein, 11 aa, Artificial Sequence
  Description of Artificial Sequence: Synthetic peptide
RASQGISRWLA

SEQ ID NO: 1323 - DNA, 33 bp, Artificial Sequence
  Description of Artificial Sequence: Synthetic oligonucleotide
cgggcaagtcagggcattagaaatgatttgggc

SEQ ID NO: 1324 - protein, 11 aa, Artificial Sequence
  Description of Artificial Sequence: Synthetic peptide
RASQGIRNDLG

SEQ ID NO: 1325 - DNA, 33 bp, Artificial Sequence
  Description of Artificial Sequence: Synthetic oligonucleotide
cgggcgagtcagggtattagcagttggttagcc

SEQ ID NO: 1326 - protein, 11 aa, Artificial Sequence
  Description of Artificial Sequence: Synthetic peptide
RASQGISSWLA

SEQ ID NO: 1327 - DNA, 33 bp, Artificial Sequence
  Description of Artificial Sequence: Synthetic oligonucleotide
cgggcaagtcagggcattaggactgatttaggc

SEQ ID NO: 1328 - protein, 11 aa, Artificial Sequence
  Description of Artificial Sequence: Synthetic peptide
RASQGIRTDLG

SEQ ID NO: 1329 - DNA, 33 bp, Artificial Sequence
  Description of Artificial Sequence: Synthetic oligonucleotide
cgggcaagtcagagcattagtacctatttaatg

SEQ ID NO: 1330 - protein, 11 aa, Artificial Sequence
  Description of Artificial Sequence: Synthetic peptide
RASQSISTYLM

SEQ ID NO: 1331 - DNA, 33 bp, Artificial Sequence; identical to SEQ ID NO: 93
  Description of Artificial Sequence: Synthetic oligonucleotide

SEQ ID NO: 1332 - protein, 11 aa, Artificial Sequence
  Description of Artificial Sequence: Synthetic peptide
RTSQGIRNDLG

SEQ ID NO: 1333 - DNA, 33 bp, Artificial Sequence; identical to SEQ ID NO: 109
  Description of Artificial Sequence: Synthetic oligonucleotide

SEQ ID NO: 1334 - protein, 11 aa, Artificial Sequence
  Description of Artificial Sequence: Synthetic peptide
RASQGIRNDLG

SEQ ID NO: 1335 - DNA, 33 bp, Artificial Sequence
  Description of Artificial Sequence: Synthetic oligonucleotide
cgggcgagtcaggatattcgcacctggttagcc

SEQ ID NO: 1336 - protein, 11 aa, Artificial Sequence
  Description of Artificial Sequence: Synthetic peptide
RASQDIRTWLA

SEQ ID NO: 1337 - DNA, 33 bp, Artificial Sequence; identical to SEQ ID NO: 109
  Description of Artificial Sequence: Synthetic oligonucleotide

SEQ ID NO: 1338 - protein, 11 aa, Artificial Sequence
  Description of Artificial Sequence: Synthetic peptide
RASQGIRNDLG

SEQ ID NO: 1339 - DNA, 33 bp, Artificial Sequence
  Description of Artificial Sequence: Synthetic oligonucleotide
cgggcgagtcagaatattaccaactggttagcc

SEQ ID NO: 1340 - protein, 11 aa, Artificial Sequence
  Description of Artificial Sequence: Synthetic peptide
RASQNITNWLA

SEQ ID NO: 1341 - DNA, 33 bp, Artificial Sequence; identical to SEQ ID NO: 105
  Description of Artificial Sequence: Synthetic oligonucleotide

SEQ ID NO: 1342 - protein, 11 aa, Artificial Sequence
  Description of Artificial Sequence: Synthetic peptide
RASQGISNYLA

SEQ ID NO: 1343 - DNA, 33 bp, Artificial Sequence
  Description of Artificial Sequence: Synthetic oligonucleotide
caggcgagtcaggacattagtaactatttacat

SEQ ID NO: 1344 - protein, 11 aa, Artificial Sequence
  Description of Artificial Sequence: Synthetic peptide
QASQDISNYLH

SEQ ID NO: 1345 - DNA, 33 bp, Artificial Sequence; identical to SEQ ID NO: 109
  Description of Artificial Sequence: Synthetic oligonucleotide

SEQ ID NO: 1346 - protein, 11 aa, Artificial Sequence
  Description of Artificial Sequence: Synthetic peptide
RASQGIRNDLG

SEQ ID NO: 1347 - DNA, 48 bp, Artificial Sequence; identical to SEQ ID NO: 103
  Description of Artificial Sequence: Synthetic oligonucleotide

SEQ ID NO: 1348 - protein, 16 aa, Artificial Sequence
  Description of Artificial Sequence: Synthetic peptide
KSSQSLLHSEGKTYLY

SEQ ID NO: 1349 - DNA, 33 bp, Artificial Sequence
  Description of Artificial Sequence: Synthetic oligonucleotide
cgggcgagtcagggtattagtaattatttaggc

SEQ ID NO: 1350 - protein, 11 aa, Artificial Sequence
  Description of Artificial Sequence: Synthetic peptide
RASQGISNYLG

SEQ ID NO: 1351 - DNA, 33 bp, Artificial Sequence
  Description of Artificial Sequence: Synthetic oligonucleotide
cgggcgagtcaggatattaacagttggttagcc

SEQ ID NO: 1352 - protein, 11 aa, Artificial Sequence
  Description of Artificial Sequence: Synthetic peptide
RASQDINSWLA

SEQ ID NO: 1353 - DNA, 33 bp, Artificial Sequence
  Description of Artificial Sequence: Synthetic oligonucleotide
cgggcaagtcagggcataagaaataatttaggc

SEQ ID NO: 1354 - protein, 11 aa, Artificial Sequence
  Description of Artificial Sequence: Synthetic peptide
RASQGIRNNLG

SEQ ID NO: 1355 - DNA, 33 bp, Artificial Sequence; identical to SEQ ID NO: 109
  Description of Artificial Sequence: Synthetic oligonucleotide

SEQ ID NO: 1356 - protein, 11 aa, Artificial Sequence
  Description of Artificial Sequence: Synthetic peptide
RASQGIRNDLG

SEQ ID NO: 1357 - DNA, 33 bp, Artificial Sequence; identical to SEQ ID NO: 109
  Description of Artificial Sequence: Synthetic oligonucleotide

SEQ ID NO: 1358 - protein, 11 aa, Artificial Sequence
  Description of Artificial Sequence: Synthetic peptide
RASQGIRNDLG

SEQ ID NO: 1359 - DNA, 33 bp, Artificial Sequence
  Description of Artificial Sequence: Synthetic oligonucleotide
cgggcaagtcagagttttagccactatttaaat

SEQ ID NO: 1360 - protein, 11 aa, Artificial Sequence
  Description of Artificial Sequence: Synthetic peptide
RASQSFSHYLN

SEQ ID NO: 1361 - DNA, 33 bp, Artificial Sequence
  Description of Artificial Sequence: Synthetic oligonucleotide
caggcgagtcaggacattagcaactatttacat

SEQ ID NO: 1362 - protein, 11 aa, Artificial Sequence
  Description of Artificial Sequence: Synthetic peptide
QASQDISNYLH

SEQ ID NO: 1363 - DNA, 33 bp, Artificial Sequence
  Description of Artificial Sequence: Synthetic oligonucleotide
cgggcgagtcaggtcattagcaattatttagcc

SEQ ID NO: 1364 - protein, 11 aa, Artificial Sequence
  Description of Artificial Sequence: Synthetic peptide
RASQVISNYLA

SEQ ID NO: 1365 - DNA, 33 bp, Artificial Sequence
  Description of Artificial Sequence: Synthetic oligonucleotide
cgggcaagtcagtacagtagcgactatttaaat

SEQ ID NO: 1366 - protein, 11 aa, Artificial Sequence
  Description of Artificial Sequence: Synthetic peptide
RASQYSSDYLN

SEQ ID NO: 1367 - DNA, 33 bp, Artificial Sequence; identical to SEQ ID NO: 109
  Description of Artificial Sequence: Synthetic oligonucleotide

SEQ ID NO: 1368 - protein, 11 aa, Artificial Sequence
  Description of Artificial Sequence: Synthetic peptide
RASQGIRNDLG

SEQ ID NO: 1369 - DNA, 33 bp, Artificial Sequence
  Description of Artificial Sequence: Synthetic oligonucleotide
caggcgagtcaagacattaccaactatttagat

SEQ ID NO: 1370 - protein, 11 aa, Artificial Sequence
  Description of Artificial Sequence: Synthetic peptide
QASQDITNYLD

SEQ ID NO: 1371 - DNA, 33 bp, Artificial Sequence; identical to SEQ ID NO: 173
  Description of Artificial Sequence: Synthetic oligonucleotide

SEQ ID NO: 1372 - protein, 11 aa, Artificial Sequence
  Description of Artificial Sequence: Synthetic peptide
RASQGISRWLA

SEQ ID NO: 1373 - DNA, 36 bp, Artificial Sequence
  Description of Artificial Sequence: Synthetic oligonucleotide
agggccagtcagagtattacaagcagctacttagcc

SEQ ID NO: 1374 - protein, 12 aa, Artificial Sequence
  Description of Artificial Sequence: Synthetic peptide
RASQSITSSYLA

SEQ ID NO: 1375 - DNA, 33 bp, Artificial Sequence; identical to SEQ ID NO: 109
  Description of Artificial Sequence: Synthetic oligonucleotide

SEQ ID NO: 1376 - protein, 11 aa, Artificial Sequence
  Description of Artificial Sequence: Synthetic peptide
RASQGIRNDLG

SEQ ID NO: 1377 - DNA, 33 bp, Artificial Sequence; identical to SEQ ID NO: 109
  Description of Artificial Sequence: Synthetic oligonucleotide

SEQ ID NO: 1378 - protein, 11 aa, Artificial Sequence
  Description of Artificial Sequence: Synthetic peptide
RASQGIRNDLG

SEQ ID NO: 1379 - DNA, 33 bp, Artificial Sequence; identical to SEQ ID NO: 171
  Description of Artificial Sequence: Synthetic oligonucleotide

SEQ ID NO: 1380 - protein, 11 aa, Artificial Sequence
  Description of Artificial Sequence: Synthetic peptide
RASQGISSWLA

SEQ ID NO: 1381 - DNA, 33 bp, Artificial Sequence
  Description of Artificial Sequence: Synthetic oligonucleotide
cgggcaagtcaggacattagaaatattttaggc

SEQ ID NO: 1382 - protein, 11 aa, Artificial Sequence
  Description of Artificial Sequence: Synthetic peptide
RASQDIRNILG

SEQ ID NO: 1383 - DNA, 48 bp, Artificial Sequence; identical to SEQ ID NO: 555
  Description of Artificial Sequence: Synthetic oligonucleotide

SEQ ID NO: 1384 - protein, 16 aa, Artificial Sequence
  Description of Artificial Sequence: Synthetic peptide
KSSQSLLHSEGKTYLY

SEQ ID NO: 1385 - DNA, 33 bp, Artificial Sequence; identical to SEQ ID NO: 109
  Description of Artificial Sequence: Synthetic oligonucleotide

SEQ ID NO: 1386 - protein, 11 aa, Artificial Sequence
  Description of Artificial Sequence: Synthetic peptide
RASQGIRNDLG

SEQ ID NO: 1387 - DNA, 33 bp, Artificial Sequence; identical to SEQ ID NO: 109
  Description of Artificial Sequence: Synthetic oligonucleotide

SEQ ID NO: 1388 - protein, 11 aa, Artificial Sequence
  Description of Artificial Sequence: Synthetic peptide
RASQGIRNDLG

SEQ ID NO: 1389 - DNA, 33 bp, Artificial Sequence
  Description of Artificial Sequence: Synthetic oligonucleotide
cgggcgagtcaggttattagccgctggttagcc

SEQ ID NO: 1390 - protein, 11 aa, Artificial Sequence
  Description of Artificial Sequence: Synthetic peptide
RASQVISRWLA

SEQ ID NO: 1391 - DNA, 33 bp, Artificial Sequence
  Description of Artificial Sequence: Synthetic oligonucleotide
agggccagtcagagtgttagcagcgacttagcc

SEQ ID NO: 1392 - protein, 11 aa, Artificial Sequence
  Description of Artificial Sequence: Synthetic peptide
RASQSVSSDLA

SEQ ID NO: 1393 - DNA, 48 bp, Artificial Sequence
  Description of Artificial Sequence: Synthetic oligonucleotide
aaatctagtcagagcctcctgcatagtgaaggaaagacctatttgtat

SEQ ID NO: 1394 - protein, 16 aa, Artificial Sequence
  Description of Artificial Sequence: Synthetic peptide
KSSQSLLHSEGKTYLY

SEQ ID NO: 1395 - DNA, 48 bp, Artificial Sequence
  Description of Artificial Sequence: Synthetic oligonucleotide
aagtctagtcagagcctcgtgcatagtgaaggaaagacctatttgtat

SEQ ID NO: 1396 - protein, 16 aa, Artificial Sequence
  Description of Artificial Sequence: Synthetic peptide
KSSQSLVHSEGKTYLY

SEQ ID NO: 1397 - DNA, 33 bp, Artificial Sequence; identical to SEQ ID NO: 109
  Description of Artificial Sequence: Synthetic oligonucleotide

SEQ ID NO: 1398 - protein, 11 aa, Artificial Sequence
  Description of Artificial Sequence: Synthetic peptide
RASQGIRNDLG

SEQ ID NO: 1399 - DNA, 33 bp, Artificial Sequence
  Description of Artificial Sequence: Synthetic oligonucleotide
cgggcgagtcaggacattagcaattatttaatc

SEQ ID NO: 1400 - protein, 11 aa, Artificial Sequence
  Description of Artificial Sequence: Synthetic peptide
RASQDISNYLI

SEQ ID NO: 1401 - DNA, 33 bp, Artificial Sequence; identical to SEQ ID NO: 519
  Description of Artificial Sequence: Synthetic oligonucleotide

SEQ ID NO: 1402 - protein, 11 aa, Artificial Sequence
  Description of Artificial Sequence: Synthetic peptide
RASQAIRNDLG

SEQ ID NO: 1403 - DNA, 48 bp, Artificial Sequence
  Description of Artificial Sequence: Synthetic oligonucleotide
aagtctagtcaaagcctcctgcatagtgaaggaaagacctatttgtat

SEQ ID NO: 1404 - protein, 16 aa, Artificial Sequence
  Description of Artificial Sequence: Synthetic peptide
KSSQSLLHSEGKTYLY

SEQ ID NO: 1405 - DNA, 33 bp, Artificial Sequence
  Description of Artificial Sequence: Synthetic oligonucleotide
caggcgagtcaagacattagcaactatttagat

SEQ ID NO: 1406 - protein, 11 aa, Artificial Sequence
  Description of Artificial Sequence: Synthetic peptide
QASQDISNYLD

SEQ ID NO: 1407 - DNA, 33 bp, Artificial Sequence
  Description of Artificial Sequence: Synthetic oligonucleotide
cgggcaagtcagagcattctcagctatttgaat

SEQ ID NO: 1408 - protein, 11 aa, Artificial Sequence
  Description of Artificial Sequence: Synthetic peptide
RASQSILSYLN

SEQ ID NO: 1409 - DNA, 33 bp, Artificial Sequence
  Description of Artificial Sequence: Synthetic oligonucleotide
cgggcgagtcaggatattagcagctggttggcc

SEQ ID NO: 1410 - protein, 11 aa, Artificial Sequence
  Description of Artificial Sequence: Synthetic peptide
RASQDISSWLA

SEQ ID NO: 1411 - DNA, 33 bp, Artificial Sequence; identical to SEQ ID NO: 109
  Description of Artificial Sequence: Synthetic oligonucleotide

SEQ ID NO: 1412 - protein, 11 aa, Artificial Sequence
  Description of Artificial Sequence: Synthetic peptide
RASQGIRNDLG

SEQ ID NO: 1413 - DNA, 33 bp, Artificial Sequence
  Description of Artificial Sequence: Synthetic oligonucleotide
caggcgagtcaggacattaccaactttttaaat

SEQ ID NO: 1414 - protein, 11 aa, Artificial Sequence
  Description of Artificial Sequence: Synthetic peptide
QASQDITNFLN

SEQ ID NO: 1415 - DNA, 33 bp, Artificial Sequence
  Description of Artificial Sequence: Synthetic oligonucleotide
cgggcgagtcaggacattaacatttatttagcc

SEQ ID NO: 1416 - protein, 11 aa, Artificial Sequence
  Description of Artificial Sequence: Synthetic peptide
RASQDINIYLA

SEQ ID NO: 1417 - DNA, 51 bp, Artificial Sequence
  Description of Artificial Sequence: Synthetic oligonucleotide
aagtccagccagagtgttttacatagttccaacaataagaactacttagtt

SEQ ID NO: 1418 - protein, 17 aa, Artificial Sequence
  Description of Artificial Sequence: Synthetic peptide
KSSQSVLHSSNNKNYLV

SEQ ID NO: 1419 - DNA, 33 bp, Artificial Sequence; identical to SEQ ID NO: 341
  Description of Artificial Sequence: Synthetic oligonucleotide

SEQ ID NO: 1420 - protein, 11 aa, Artificial Sequence
  Description of Artificial Sequence: Synthetic peptide
RASQDIRNNLG

SEQ ID NO: 1421 - DNA, 33 bp, Artificial Sequence; identical to SEQ ID NO: 1359
  Description of Artificial Sequence: Synthetic oligonucleotide

SEQ ID NO: 1422 - protein, 11 aa, Artificial Sequence
  Description of Artificial Sequence: Synthetic peptide
RASQSFSHYLN

SEQ ID NO: 1423 - DNA, 33 bp, Artificial Sequence
  Description of Artificial Sequence: Synthetic oligonucleotide
cgggcaagtcaggacattagaaatcttttaggc

SEQ ID NO: 1424 - protein, 11 aa, Artificial Sequence
  Description of Artificial Sequence: Synthetic peptide
RASQDIRNLLG

SEQ ID NO: 1425 - DNA, 33 bp, Artificial Sequence
  Description of Artificial Sequence: Synthetic oligonucleotide
cgggcgagtcagggtattaggaagtggttagcc

SEQ ID NO: 1426 - protein, 11 aa, Artificial Sequence
  Description of Artificial Sequence: Synthetic peptide
RASQGIRKWLA

SEQ ID NO: 1427 - DNA, 33 bp, Artificial Sequence
  Description of Artificial Sequence: Synthetic oligonucleotide
cgggcaagtcagagcattttcagatatttaaat

SEQ ID NO: 1428 - protein, 11 aa, Artificial Sequence
  Description of Artificial Sequence: Synthetic peptide
RASQSIFRYLN

SEQ ID NO: 1429 - DNA, 33 bp, Artificial Sequence; identical to SEQ ID NO: 171
  Description of Artificial Sequence: Synthetic oligonucleotide

SEQ ID NO: 1430 - protein, 11 aa, Artificial Sequence
  Description of Artificial Sequence: Synthetic peptide
RASQGISSWLA

SEQ ID NO: 1431 - DNA, 33 bp, Artificial Sequence
  Description of Artificial Sequence: Synthetic oligonucleotide
cgggtgagtcaggatattagcaaatggttagcc

SEQ ID NO: 1432 - protein, 11 aa, Artificial Sequence
  Description of Artificial Sequence: Synthetic peptide
RVSQDISKWLA

SEQ ID NO: 1433 - DNA, 33 bp, Artificial Sequence; identical to SEQ ID NO: 109
  Description of Artificial Sequence: Synthetic oligonucleotide

SEQ ID NO: 1434 - protein, 11 aa, Artificial Sequence
  Description of Artificial Sequence: Synthetic peptide
RASQGIRNDLG

SEQ ID NO: 1435 - DNA, 33 bp, Artificial Sequence; identical to SEQ ID NO: 109
  Description of Artificial Sequence: Synthetic oligonucleotide

SEQ ID NO: 1436 - protein, 11 aa, Artificial Sequence
  Description of Artificial Sequence: Synthetic peptide
RASQGIRNDLG

SEQ ID NO: 1437 - DNA, 48 bp, Artificial Sequence
  Description of Artificial Sequence: Synthetic oligonucleotide
aagtctagtcagagcctccagcatggtgaaggaaagacctatttgtat

SEQ ID NO: 1438 - protein, 16 aa, Artificial Sequence
  Description of Artificial Sequence: Synthetic peptide
KSSQSLQHGEGKTYLY

SEQ ID NO: 1439 - DNA, 33 bp, Artificial Sequence; identical to SEQ ID NO: 1229
  Description of Artificial Sequence: Synthetic oligonucleotide

SEQ ID NO: 1440 - protein, 11 aa, Artificial Sequence
  Description of Artificial Sequence: Synthetic peptide
RASQGIRKDLG

SEQ ID NO: 1441 - DNA, 48 bp, Artificial Sequence; identical to SEQ ID NO: 103
  Description of Artificial Sequence: Synthetic oligonucleotide

SEQ ID NO: 1442 - protein, 16 aa, Artificial Sequence
  Description of Artificial Sequence: Synthetic peptide
KSSQSLLHSEGKTYLY

SEQ ID NO: 1443 - DNA, 33 bp, Artificial Sequence; identical to SEQ ID NO: 109
  Description of Artificial Sequence: Synthetic oligonucleotide

SEQ ID NO: 1444 - protein, 11 aa, Artificial Sequence
  Description of Artificial Sequence: Synthetic peptide
RASQGIRNDLG

SEQ ID NO: 1445 - DNA, 33 bp, Artificial Sequence; identical to SEQ ID NO: 109
  Description of Artificial Sequence: Synthetic oligonucleotide

SEQ ID NO: 1446 - protein, 11 aa, Artificial Sequence
  Description of Artificial Sequence: Synthetic peptide
RASQGIRNDLG

SEQ ID NO: 1447 - DNA, 51 bp, Artificial Sequence; identical to SEQ ID NO: 1071
  Description of Artificial Sequence: Synthetic oligonucleotide

SEQ ID NO: 1448 - protein, 17 aa, Artificial Sequence
  Description of Artificial Sequence: Synthetic peptide
KSSQSVLYSSNNKNYLA

SEQ ID NO: 1449 - DNA, 33 bp, Artificial Sequence; identical to SEQ ID NO: 629
  Description of Artificial Sequence: Synthetic oligonucleotide

SEQ ID NO: 1450 - protein, 11 aa, Artificial Sequence
  Description of Artificial Sequence: Synthetic peptide
RASQGISNYLA

SEQ ID NO: 1451 - DNA, 33 bp, Artificial Sequence
  Description of Artificial Sequence: Synthetic oligonucleotide
cgggcgagtcaggtcattaagaattatttagtc

SEQ ID NO: 1452 - protein, 11 aa, Artificial Sequence
  Description of Artificial Sequence: Synthetic peptide
RASQVIKNYLV

SEQ ID NO: 1453 - DNA, 33 bp, Artificial Sequence; identical to SEQ ID NO: 109
  Description of Artificial Sequence: Synthetic oligonucleotide

SEQ ID NO: 1454 - protein, 11 aa, Artificial Sequence
  Description of Artificial Sequence: Synthetic peptide
RASQGIRNDLG

SEQ ID NO: 1455 - DNA, 33 bp, Artificial Sequence
  Description of Artificial Sequence: Synthetic oligonucleotide
agggccagtcagagtgttagcagttccttagcc

SEQ ID NO: 1456 - protein, 11 aa, Artificial Sequence
  Description of Artificial Sequence: Synthetic peptide
RASQSVSSSLA

SEQ ID NO: 1457 - DNA, 33 bp, Artificial Sequence
  Description of Artificial Sequence: Synthetic oligonucleotide
cgggcgagtcaggttattagcaactggttagcc

SEQ ID NO: 1458 - protein, 11 aa, Artificial Sequence
  Description of Artificial Sequence: Synthetic peptide
RASQVISNWLA

SEQ ID NO: 1459 - DNA, 48 bp, Artificial Sequence; identical to SEQ ID NO: 555
  Description of Artificial Sequence: Synthetic oligonucleotide

SEQ ID NO: 1460 - protein, 16 aa, Artificial Sequence
  Description of Artificial Sequence: Synthetic peptide
KSSQSLLHSEGKTYLY

SEQ ID NO: 1461 - DNA, 33 bp, Artificial Sequence; identical to SEQ ID NO: 501
  Description of Artificial Sequence: Synthetic oligonucleotide

SEQ ID NO: 1462 - protein, 11 aa, Artificial Sequence
  Description of Artificial Sequence: Synthetic peptide
RASQSISSYLN

SEQ ID NO: 1463 - DNA, 33 bp, Artificial Sequence; identical to SEQ ID NO: 501
  Description of Artificial Sequence: Synthetic oligonucleotide

SEQ ID NO: 1464 - protein, 11 aa, Artificial Sequence
  Description of Artificial Sequence: Synthetic peptide
RASQSISSYLN

SEQ ID NO: 1465 - DNA, 33 bp, Artificial Sequence; identical to SEQ ID NO: 1229
  Description of Artificial Sequence: Synthetic oligonucleotide

SEQ ID NO: 1466 - protein, 11 aa, Artificial Sequence
  Description of Artificial Sequence: Synthetic peptide
RASQGIRKDLG

SEQ ID NO: 1467 - DNA, 33 bp, Artificial Sequence; identical to SEQ ID NO: 1185
  Description of Artificial Sequence: Synthetic oligonucleotide

SEQ ID NO: 1468 - protein, 11 aa, Artificial Sequence
  Description of Artificial Sequence: Synthetic peptide
RASQGIRDDLG

SEQ ID NO: 1469 - DNA, 48 bp, Artificial Sequence; identical to SEQ ID NO: 103
  Description of Artificial Sequence: Synthetic oligonucleotide

SEQ ID NO: 1470 - protein, 16 aa, Artificial Sequence
  Description of Artificial Sequence: Synthetic peptide
KSSQSLLHSEGKTYLY

SEQ ID NO: 1471 - DNA, 51 bp, Artificial Sequence
  Description of Artificial Sequence: Synthetic oligonucleotide
aagtccagccagagtgttttacacatctccaacaataacaattacttagct

SEQ ID NO: 1472 - protein, 17 aa, Artificial Sequence
  Description of Artificial Sequence: Synthetic peptide
KSSQSVLHISNNNNYLA

SEQ ID NO: 1473 - DNA, 51 bp, Artificial Sequence
  Description of Artificial Sequence: Synthetic oligonucleotide
aagtccagccagagtgttttatacagctccaacaataacaactccttaact

SEQ ID NO: 1474 - protein, 17 aa, Artificial Sequence
  Description of Artificial Sequence: Synthetic peptide
KSSQSVLYSSNNNNSLT

SEQ ID NO: 1475 - DNA, 33 bp, Artificial Sequence
  Description of Artificial Sequence: Synthetic oligonucleotide
cgggcaagtcagagcattaccaactttttaaat

SEQ ID NO: 1476 - protein, 11 aa, Artificial Sequence
  Description of Artificial Sequence: Synthetic peptide
RASQSITNFLN

SEQ ID NO: 1477 - DNA, 33 bp, Artificial Sequence; identical to SEQ ID NO: 429
  Description of Artificial Sequence: Synthetic oligonucleotide

SEQ ID NO: 1478 - protein, 11 aa, Artificial Sequence
  Description of Artificial Sequence: Synthetic peptide
RASQGIGNDLG

SEQ ID NO: 1479 - DNA, 48 bp, Artificial Sequence
  Description of Artificial Sequence: Synthetic oligonucleotide
aggtctagtcagagcctcctacatagtaatggatacaactatttggat

SEQ ID NO: 1480 - protein, 16 aa, Artificial Sequence
  Description of Artificial Sequence: Synthetic peptide
RSSQSLLHSNGYNYLD

SEQ ID NO: 1481 - DNA, 33 bp, Artificial Sequence
  Description of Artificial Sequence: Synthetic oligonucleotide
cgggcaagtcagaacattttcagctatttaaat

SEQ ID NO: 1482 - protein, 11 aa, Artificial Sequence
  Description of Artificial Sequence: Synthetic peptide
RASQNIFSYLN

SEQ ID NO: 1483 - DNA, 33 bp, Artificial Sequence
  Description of Artificial Sequence: Synthetic oligonucleotide
cgggcaagtcagagcattatcagttatttaaat

SEQ ID NO: 1484 - protein, 11 aa, Artificial Sequence
  Description of Artificial Sequence: Synthetic peptide
RASQSIISYLN

SEQ ID NO: 1485 - DNA, 33 bp, Artificial Sequence; identical to SEQ ID NO: 109
  Description of Artificial Sequence: Synthetic oligonucleotide

SEQ ID NO: 1486 - protein, 11 aa, Artificial Sequence
  Description of Artificial Sequence: Synthetic peptide
RASQGIRNDLG

SEQ ID NO: 1487 - DNA, 33 bp, Artificial Sequence; identical to SEQ ID NO: 341
  Description of Artificial Sequence: Synthetic oligonucleotide

SEQ ID NO: 1488 - protein, 11 aa, Artificial Sequence
  Description of Artificial Sequence: Synthetic peptide
RASQDIRNNLG

SEQ ID NO: 1489 - DNA, 33 bp, Artificial Sequence; identical to SEQ ID NO: 109
  Description of Artificial Sequence: Synthetic oligonucleotide

SEQ ID NO: 1490 - protein, 11 aa, Artificial Sequence
  Description of Artificial Sequence: Synthetic peptide
RASQGIRNDLG

SEQ ID NO: 1491 - DNA, 33 bp, Artificial Sequence
  Description of Artificial Sequence: Synthetic oligonucleotide
agggccagtcagagtgttaacagcaacttagcc

SEQ ID NO: 1492 - protein, 11 aa, Artificial Sequence
  Description of Artificial Sequence: Synthetic peptide
RASQSVNSNLA

SEQ ID NO: 1493 - DNA, 33 bp, Artificial Sequence; identical to SEQ ID NO: 519
  Description of Artificial Sequence: Synthetic oligonucleotide

SEQ ID NO: 1494 - protein, 11 aa, Artificial Sequence
  Description of Artificial Sequence: Synthetic peptide
RASQAIRNDLG

SEQ ID NO: 1495 - DNA, 33 bp, Artificial Sequence; identical to SEQ ID NO: 1177
  Description of Artificial Sequence: Synthetic oligonucleotide

SEQ ID NO: 1496 - protein, 11 aa, Artificial Sequence
  Description of Artificial Sequence: Synthetic peptide
RASQDISSWLA

SEQ ID NO: 1497 - DNA, 33 bp, Artificial Sequence
  Description of Artificial Sequence: Synthetic oligonucleotide
cgggcgagtcagggcattagcacttatttagcc

SEQ ID NO: 1498 - protein, 11 aa, Artificial Sequence
  Description of Artificial Sequence: Synthetic peptide
RASQGISTYLA

SEQ ID NO: 1499 - DNA, 33 bp, Artificial Sequence; identical to SEQ ID NO: 205
  Description of Artificial Sequence: Synthetic oligonucleotide

SEQ ID NO: 1500 - protein, 11 aa, Artificial Sequence
  Description of Artificial Sequence: Synthetic peptide
RASQDIRNDLG

SEQ ID NO: 1501 - DNA, 33 bp, Artificial Sequence
  Description of Artificial Sequence: Synthetic oligonucleotide
cgggcaagtcagggcattagaaatgctttaggc

SEQ ID NO: 1502 - protein, 11 aa, Artificial Sequence
  Description of Artificial Sequence: Synthetic peptide
RASQGIRNALG

SEQ ID NO: 1503 - DNA, 33 bp, Artificial Sequence; identical to SEQ ID NO: 501
  Description of Artificial Sequence: Synthetic oligonucleotide

SEQ ID NO: 1504 - protein, 11 aa, Artificial Sequence
  Description of Artificial Sequence: Synthetic peptide
RASQSISSYLN

SEQ ID NO: 1505 - DNA, 33 bp, Artificial Sequence
  Description of Artificial Sequence: Synthetic oligonucleotide
agggccagtcagagtgttagcagcagcttagcc

SEQ ID NO: 1506 - protein, 11 aa, Artificial Sequence
  Description of Artificial Sequence: Synthetic peptide
RASQSVSSSLA

SEQ ID NO: 1507 - DNA, 33 bp, Artificial Sequence; identical to SEQ ID NO: 109
  Description of Artificial Sequence: Synthetic oligonucleotide

SEQ ID NO: 1508 - protein, 11 aa, Artificial Sequence
  Description of Artificial Sequence: Synthetic peptide
RASQGIRNDLG

SEQ ID NO: 1509 - DNA, 33 bp, Artificial Sequence
  Description of Artificial Sequence: Synthetic oligonucleotide
cgggcgagtcaggatattagcaactggttagcc

SEQ ID NO: 1510 - protein, 11 aa, Artificial Sequence
  Description of Artificial Sequence: Synthetic peptide
RASQDISNWLA

SEQ ID NO: 1511 - DNA, 33 bp, Artificial Sequence; identical to SEQ ID NO: 219
  Description of Artificial Sequence: Synthetic oligonucleotide

SEQ ID NO: 1512 - protein, 11 aa, Artificial Sequence
  Description of Artificial Sequence: Synthetic peptide
RASQVIRNDLG

SEQ ID NO: 1513 - DNA, 33 bp, Artificial Sequence; identical to SEQ ID NO: 173
  Description of Artificial Sequence: Synthetic oligonucleotide

SEQ ID NO: 1514 - protein, 11 aa, Artificial Sequence
  Description of Artificial Sequence: Synthetic peptide
RASQGISRWLA

SEQ ID NO: 1515 - DNA, 33 bp, Artificial Sequence; identical to SEQ ID NO: 1391
  Description of Artificial Sequence: Synthetic oligonucleotide

SEQ ID NO: 1516 - protein, 11 aa, Artificial Sequence
  Description of Artificial Sequence: Synthetic peptide
RASQSVSSDLA

SEQ ID NO: 1517 - DNA, 33 bp, Artificial Sequence; identical to SEQ ID NO: 429
  Description of Artificial Sequence: Synthetic oligonucleotide

SEQ ID NO: 1518 - protein, 11 aa, Artificial Sequence
  Description of Artificial Sequence: Synthetic peptide
RASQGIGNDLG

SEQ ID NO: 1519 - DNA, 33 bp, Artificial Sequence; identical to SEQ ID NO: 553
  Description of Artificial Sequence: Synthetic oligonucleotide

SEQ ID NO: 1520 - protein, 11 aa, Artificial Sequence
  Description of Artificial Sequence: Synthetic peptide
RASQGISNWLA

SEQ ID NO: 1521 - DNA, 51 bp, Artificial Sequence
  Description of Artificial Sequence: Synthetic oligonucleotide
aagtccagccaaagtgttttacacagctccaacaattataactacttagct

SEQ ID NO: 1522 - protein, 17 aa, Artificial Sequence
  Description of Artificial Sequence: Synthetic peptide
KSSQSVLHSSNNYNYLA

SEQ ID NO: 1523 - DNA, 51 bp, Artificial Sequence
  Description of Artificial Sequence: Synthetic oligonucleotide
aagtccagccagagtgttttattcagctccaacaattacaattacttagct

SEQ ID NO: 1524 - protein, 17 aa, Artificial Sequence
  Description of Artificial Sequence: Synthetic peptide
KSSQSVLFSSNNYNYLA

SEQ ID NO: 1525 - DNA, 33 bp, Artificial Sequence; identical to SEQ ID NO: 1391
  Description of Artificial Sequence: Synthetic oligonucleotide

SEQ ID NO: 1526 - protein, 11 aa, Artificial Sequence
  Description of Artificial Sequence: Synthetic peptide
RASQSVSSDLA

SEQ ID NO: 1527 - DNA, 33 bp, Artificial Sequence; identical to SEQ ID NO: 1391
  Description of Artificial Sequence: Synthetic oligonucleotide

SEQ ID NO: 1528 - protein, 11 aa, Artificial Sequence
  Description of Artificial Sequence: Synthetic peptide
RASQSVSSDLA

SEQ ID NO: 1529 - DNA, 33 bp, Artificial Sequence; identical to SEQ ID NO: 109
  Description of Artificial Sequence: Synthetic oligonucleotide

SEQ ID NO: 1530 - protein, 11 aa, Artificial Sequence
  Description of Artificial Sequence: Synthetic peptide
RASQGIRNDLG

SEQ ID NO: 1531 - DNA, 51 bp, Artificial Sequence
  Description of Artificial Sequence: Synthetic oligonucleotide
aagtccggccagagtattttatacagctccaacaataacaactacttagct

SEQ ID NO: 1532 - protein, 17 aa, Artificial Sequence
  Description of Artificial Sequence: Synthetic peptide
KSGQSILYSSNNNNYLA

SEQ ID NO: 1533 - DNA, 33 bp, Artificial Sequence
  Description of Artificial Sequence: Synthetic oligonucleotide
agggccagtcagagtgttagcagctccttagcc

SEQ ID NO: 1534 - protein, 11 aa, Artificial Sequence
  Description of Artificial Sequence: Synthetic peptide
RASQSVSSSLA

SEQ ID NO: 1535 - DNA, 33 bp, Artificial Sequence
  Description of Artificial Sequence: Synthetic oligonucleotide
cgggcaagtcagggcattagaagtgatttagac

SEQ ID NO: 1536 - protein, 11 aa, Artificial Sequence
  Description of Artificial Sequence: Synthetic peptide
RASQGIRSDLD

SEQ ID NO: 1537 - DNA, 33 bp, Artificial Sequence
  Description of Artificial Sequence: Synthetic oligonucleotide
agggccagtcagagtgttagcagcgacttagtc

SEQ ID NO: 1538 - protein, 11 aa, Artificial Sequence
  Description of Artificial Sequence: Synthetic peptide
RASQSVSSDLV

SEQ ID NO: 1539 - DNA, 48 bp, Artificial Sequence; identical to SEQ ID NO: 555
  Description of Artificial Sequence: Synthetic oligonucleotide

SEQ ID NO: 1540 - protein, 16 aa, Artificial Sequence
  Description of Artificial Sequence: Synthetic peptide
KSSQSLLHSEGKTYLY

SEQ ID NO: 1541 - DNA, 51 bp, Artificial Sequence
  Description of Artificial Sequence: Synthetic oligonucleotide
aagtccagccagagtgttttatacagctccaacaataacaactacttagct

SEQ ID NO: 1542 - protein, 17 aa, Artificial Sequence
  Description of Artificial Sequence: Synthetic peptide
KSSQSVLYSSNNNNYLA

SEQ ID NO: 1543 - DNA, 36 bp, Artificial Sequence
  Description of Artificial Sequence: Synthetic oligonucleotide
tgggccagtcagagtgtttacagcagcttcttagcc

SEQ ID NO: 1544 - protein, 12 aa, Artificial Sequence
  Description of Artificial Sequence: Synthetic peptide
WASQSVYSSFLA

SEQ ID NO: 1545 - DNA, 33 bp, Artificial Sequence; identical to SEQ ID NO: 305
  Description of Artificial Sequence: Synthetic oligonucleotide

SEQ ID NO: 1546 - protein, 11 aa, Artificial Sequence
  Description of Artificial Sequence: Synthetic peptide
RASQSIISYLN

SEQ ID NO: 1547 - DNA, 36 bp, Artificial Sequence
  Description of Artificial Sequence: Synthetic oligonucleotide
agggccagtcagagtgttagcagcatctacttagcc

SEQ ID NO: 1548 - protein, 12 aa, Artificial Sequence
  Description of Artificial Sequence: Synthetic peptide
RASQSVSSIYLA

SEQ ID NO: 1549 - DNA, 33 bp, Artificial Sequence; identical to SEQ ID NO: 109
  Description of Artificial Sequence: Synthetic oligonucleotide

SEQ ID NO: 1550 - protein, 11 aa, Artificial Sequence
  Description of Artificial Sequence: Synthetic peptide
RASQGIRNDLG

SEQ ID NO: 1551 - DNA, 33 bp, Artificial Sequence; identical to SEQ ID NO: 109
  Description of Artificial Sequence: Synthetic oligonucleotide

SEQ ID NO: 1552 - protein, 11 aa, Artificial Sequence
  Description of Artificial Sequence: Synthetic peptide
RASQGIRNDLG

SEQ ID NO: 1553 - DNA, 33 bp, Artificial Sequence; identical to SEQ ID NO: 501
  Description of Artificial Sequence: Synthetic oligonucleotide

SEQ ID NO: 1554 - protein, 11 aa, Artificial Sequence
  Description of Artificial Sequence: Synthetic peptide
RASQSISSYLN

SEQ ID NO: 1555 - DNA, 33 bp, Artificial Sequence; identical to SEQ ID NO: 205
  Description of Artificial Sequence: Synthetic oligonucleotide

SEQ ID NO: 1556 - protein, 11 aa, Artificial Sequence
  Description of Artificial Sequence: Synthetic peptide
RASQDIRNDLG

SEQ ID NO: 1557 - DNA, 51 bp, Artificial Sequence
  Description of Artificial Sequence: Synthetic oligonucleotide
aagtccagccagactgttttatacaggtccaacaattacaactacttagct

SEQ ID NO: 1558 - protein, 17 aa, Artificial Sequence
  Description of Artificial Sequence: Synthetic peptide
KSSQTVLYRSNNYNYLA

SEQ ID NO: 1559 - DNA, 33 bp, Artificial Sequence; identical to SEQ ID NO: 327
  Description of Artificial Sequence: Synthetic oligonucleotide

SEQ ID NO: 1560 - protein, 11 aa, Artificial Sequence
  Description of Artificial Sequence: Synthetic peptide
RASQSIFSYLN

SEQ ID NO: 1561 - DNA, 33 bp, Artificial Sequence; identical to SEQ ID NO: 327
  Description of Artificial Sequence: Synthetic oligonucleotide

SEQ ID NO: 1562 - protein, 11 aa, Artificial Sequence
  Description of Artificial Sequence: Synthetic peptide
RASQSIFSYLN

SEQ ID NO: 1563 - DNA, 33 bp, Artificial Sequence; identical to SEQ ID NO: 105
  Description of Artificial Sequence: Synthetic oligonucleotide

SEQ ID NO: 1564 - protein, 11 aa, Artificial Sequence
  Description of Artificial Sequence: Synthetic peptide
RASQGISNYLA

SEQ ID NO: 1565 - DNA, 33 bp, Artificial Sequence; identical to SEQ ID NO: 171
  Description of Artificial Sequence: Synthetic oligonucleotide

SEQ ID NO: 1566 - protein, 11 aa, Artificial Sequence
  Description of Artificial Sequence: Synthetic peptide
RASQGISSWLA

SEQ ID NO: 1567 - DNA, 33 bp, Artificial Sequence
  Description of Artificial Sequence: Synthetic oligonucleotide
cgggcaagtcagagcattttcagctatttacat

SEQ ID NO: 1568 - protein, 11 aa, Artificial Sequence
  Description of Artificial Sequence: Synthetic peptide
RASQSIFSYLH

SEQ ID NO: 1569 - DNA, 33 bp, Artificial Sequence; identical to SEQ ID NO: 109
  Description of Artificial Sequence: Synthetic oligonucleotide

SEQ ID NO: 1570 - protein, 11 aa, Artificial Sequence
  Description of Artificial Sequence: Synthetic peptide
RASQGIRNDLG

SEQ ID NO: 1571 - DNA, 33 bp, Artificial Sequence; identical to SEQ ID NO: 109
  Description of Artificial Sequence: Synthetic oligonucleotide

SEQ ID NO: 1572 - protein, 11 aa, Artificial Sequence
  Description of Artificial Sequence: Synthetic peptide
RASQGIRNDLG

SEQ ID NO: 1573 - DNA, 33 bp, Artificial Sequence
  Description of Artificial Sequence: Synthetic oligonucleotide
cgggcaagtcagaacattaagaaatatttaaat

SEQ ID NO: 1574 - protein, 11 aa, Artificial Sequence
  Description of Artificial Sequence: Synthetic peptide
RASQNIKKYLN

SEQ ID NO: 1575 - DNA, 33 bp, Artificial Sequence; identical to SEQ ID NO: 109
  Description of Artificial Sequence: Synthetic oligonucleotide

SEQ ID NO: 1576 - protein, 11 aa, Artificial Sequence
  Description of Artificial Sequence: Synthetic peptide
RASQGIRNDLG

SEQ ID NO: 1577 - DNA, 48 bp, Artificial Sequence
  Description of Artificial Sequence: Synthetic oligonucleotide
aagtctagtcagagcctccttcatggtgatggaaagacctatttgttt

SEQ ID NO: 1578 - protein, 16 aa, Artificial Sequence
  Description of Artificial Sequence: Synthetic peptide
KSSQSLLHGDGKTYLF

SEQ ID NO: 1579 - DNA, 33 bp, Artificial Sequence; identical to SEQ ID NO: 171
  Description of Artificial Sequence: Synthetic oligonucleotide

SEQ ID NO: 1580 - protein, 11 aa, Artificial Sequence
  Description of Artificial Sequence: Synthetic peptide
RASQGISSWLA

SEQ ID NO: 1581 - DNA, 33 bp, Artificial Sequence; identical to SEQ ID NO: 109
  Description of Artificial Sequence: Synthetic oligonucleotide

SEQ ID NO: 1582 - protein, 11 aa, Artificial Sequence
  Description of Artificial Sequence: Synthetic peptide
RASQGIRNDLG

SEQ ID NO: 1583 - DNA, 33 bp, Artificial Sequence
  Description of Artificial Sequence: Synthetic oligonucleotide
cgggcgagtcaggacattagcaattatttaaat

SEQ ID NO: 1584 - protein, 11 aa, Artificial Sequence
  Description of Artificial Sequence: Synthetic peptide
RASQDISNYLN

SEQ ID NO: 1585 - DNA, 33 bp, Artificial Sequence
  Description of Artificial Sequence: Synthetic oligonucleotide
cgggcgagtcagaatattaccacctggttagcc

SEQ ID NO: 1586 - protein, 11 aa, Artificial Sequence
  Description of Artificial Sequence: Synthetic peptide
RASQNITTWLA

SEQ ID NO: 1587 - DNA, 33 bp, Artificial Sequence
  Description of Artificial Sequence: Synthetic oligonucleotide
cgggcgagtcaggtcattagcagttatttacat

SEQ ID NO: 1588 - protein, 11 aa, Artificial Sequence
  Description of Artificial Sequence: Synthetic peptide
RASQVISSYLH

SEQ ID NO: 1589 - DNA, 33 bp, Artificial Sequence; identical to SEQ ID NO: 171
  Description of Artificial Sequence: Synthetic oligonucleotide

SEQ ID NO: 1590 - protein, 11 aa, Artificial Sequence
  Description of Artificial Sequence: Synthetic peptide
RASQGISSWLA

SEQ ID NO: 1591 - DNA, 33 bp, Artificial Sequence
  Description of Artificial Sequence: Synthetic oligonucleotide
cgggcgagtcaggacattaacaattatttagcc

SEQ ID NO: 1592 - protein, 11 aa, Artificial Sequence
  Description of Artificial Sequence: Synthetic peptide
RASQDINNYLA

SEQ ID NO: 1593 - DNA, 33 bp, Artificial Sequence; identical to SEQ ID NO: 1491
  Description of Artificial Sequence: Synthetic oligonucleotide

SEQ ID NO: 1594 - protein, 11 aa, Artificial Sequence
  Description of Artificial Sequence: Synthetic peptide
RASQSVNSNLA

SEQ ID NO: 1595 - DNA, 33 bp, Artificial Sequence
  Description of Artificial Sequence: Synthetic oligonucleotide
cgggcgagtcaggacattagcacttatttagcc

SEQ ID NO: 1596 - protein, 11 aa, Artificial Sequence
  Description of Artificial Sequence: Synthetic peptide
RASQDISTYLA

SEQ ID NO: 1597 - DNA, 33 bp, Artificial Sequence; identical to SEQ ID NO: 171
  Description of Artificial Sequence: Synthetic oligonucleotide

SEQ ID NO: 1598 - protein, 11 aa, Artificial Sequence
  Description of Artificial Sequence: Synthetic peptide
RASQGISSWLA

SEQ ID NO: 1599 - DNA, 33 bp, Artificial Sequence; identical to SEQ ID NO: 171
  Description of Artificial Sequence: Synthetic oligonucleotide

SEQ ID NO: 1600 - protein, 11 aa, Artificial Sequence
  Description of Artificial Sequence: Synthetic peptide
RASQGISSWLA

SEQ ID NO: 1601 - DNA, 33 bp, Artificial Sequence
  Description of Artificial Sequence: Synthetic oligonucleotide
cgggcgagtcagggcattagcaattatttacat

SEQ ID NO: 1602 - protein, 11 aa, Artificial Sequence
  Description of Artificial Sequence: Synthetic peptide
RASQGISNYLH

SEQ ID NO: 1603 - DNA, 33 bp, Artificial Sequence; identical to SEQ ID NO: 1481
  Description of Artificial Sequence: Synthetic oligonucleotide

SEQ ID NO: 1604 - protein, 11 aa, Artificial Sequence
  Description of Artificial Sequence: Synthetic peptide
RASQNIFSYLN

SEQ ID NO: 1605 - DNA, 33 bp, Artificial Sequence
  Description of Artificial Sequence: Synthetic oligonucleotide
cgggcaagtcaggacattagaaatgttttaggc

SEQ ID NO: 1606 - protein, 11 aa, Artificial Sequence
  Description of Artificial Sequence: Synthetic peptide
RASQDIRNVLG

SEQ ID NO: 1607 - DNA, 33 bp, Artificial Sequence; identical to SEQ ID NO: 519
  Description of Artificial Sequence: Synthetic oligonucleotide

SEQ ID NO: 1608 - protein, 11 aa, Artificial Sequence
  Description of Artificial Sequence: Synthetic peptide
RASQAIRNDLG

SEQ ID NO: 1609 - DNA, 33 bp, Artificial Sequence; identical to SEQ ID NO: 831
  Description of Artificial Sequence: Synthetic oligonucleotide

SEQ ID NO: 1610 - protein, 11 aa, Artificial Sequence
  Description of Artificial Sequence: Synthetic peptide
RASQGIRNDLG

SEQ ID NO: 1611 - DNA, 33 bp, Artificial Sequence
  Description of Artificial Sequence: Synthetic oligonucleotide
cgggagagtcagggtattagcatctggttagcc

SEQ ID NO: 1612 - protein, 11 aa, Artificial Sequence
  Description of Artificial Sequence: Synthetic peptide
RESQGISIWLA

SEQ ID NO: 1613 - DNA, 33 bp, Artificial Sequence; identical to SEQ ID NO: 1491
  Description of Artificial Sequence: Synthetic oligonucleotide

SEQ ID NO: 1614 - protein, 11 aa, Artificial Sequence
  Description of Artificial Sequence: Synthetic peptide
RASQSVNSNLA

SEQ ID NO: 1615 - DNA, 33 bp, Artificial Sequence; identical to SEQ ID NO: 171
  Description of Artificial Sequence: Synthetic oligonucleotide

SEQ ID NO: 1616 - protein, 11 aa, Artificial Sequence
  Description of Artificial Sequence: Synthetic peptide
RASQGISSWLA

SEQ ID NO: 1617 - DNA, 33 bp, Artificial Sequence; identical to SEQ ID NO: 109
  Description of Artificial Sequence: Synthetic oligonucleotide

SEQ ID NO: 1618 - protein, 11 aa, Artificial Sequence
  Description of Artificial Sequence: Synthetic peptide
RASQGIRNDLG

SEQ ID NO: 1619 - DNA, 33 bp, Artificial Sequence; identical to SEQ ID NO: 279
  Description of Artificial Sequence: Synthetic oligonucleotide

SEQ ID NO: 1620 - protein, 11 aa, Artificial Sequence
  Description of Artificial Sequence: Synthetic peptide
RASQGISYYLA

SEQ ID NO: 1621 - DNA, 33 bp, Artificial Sequence; identical to SEQ ID NO: 1301
  Description of Artificial Sequence: Synthetic oligonucleotide

SEQ ID NO: 1622 - protein, 11 aa, Artificial Sequence
  Description of Artificial Sequence: Synthetic peptide
RASQGIRNNLG

SEQ ID NO: 1623 - DNA, 33 bp, Artificial Sequence; identical to SEQ ID NO: 109
  Description of Artificial Sequence: Synthetic oligonucleotide

SEQ ID NO: 1624 - protein, 11 aa, Artificial Sequence
  Description of Artificial Sequence: Synthetic peptide
RASQGIRNDLG

SEQ ID NO: 1625 - DNA, 33 bp, Artificial Sequence; identical to SEQ ID NO: 109
  Description of Artificial Sequence: Synthetic oligonucleotide

SEQ ID NO: 1626 - protein, 11 aa, Artificial Sequence
  Description of Artificial Sequence: Synthetic peptide
RASQGIRNDLG

SEQ ID NO: 1627 - DNA, 33 bp, Artificial Sequence
  Description of Artificial Sequence: Synthetic oligonucleotide
cgggcaggtcagaccatttacaattatttaaat

SEQ ID NO: 1628 - protein, 11 aa, Artificial Sequence
  Description of Artificial Sequence: Synthetic peptide
RAGQTIYNYLN

SEQ ID NO: 1629 - DNA, 33 bp, Artificial Sequence
  Description of Artificial Sequence: Synthetic oligonucleotide
cgggcgagtcagggtgttagcaggtggttagcc

SEQ ID NO: 1630 - protein, 11 aa, Artificial Sequence
  Description of Artificial Sequence: Synthetic peptide
RASQGVSRWLA

SEQ ID NO: 1631 - DNA, 33 bp, Artificial Sequence; identical to SEQ ID NO: 1491
  Description of Artificial Sequence: Synthetic oligonucleotide

SEQ ID NO: 1632 - protein, 11 aa, Artificial Sequence
  Description of Artificial Sequence: Synthetic peptide
RASQSVNSNLA

SEQ ID NO: 1633 - DNA, 33 bp, Artificial Sequence; identical to SEQ ID NO: 95
  Description of Artificial Sequence: Synthetic oligonucleotide

SEQ ID NO: 1634 - protein, 11 aa, Artificial Sequence
  Description of Artificial Sequence: Synthetic peptide
RASQGISKWLA

SEQ ID NO: 1635 - DNA, 33 bp, Artificial Sequence
  Description of Artificial Sequence: Synthetic oligonucleotide
cggacaagtcagagcattttcaactatttaaat

SEQ ID NO: 1636 - protein, 11 aa, Artificial Sequence
  Description of Artificial Sequence: Synthetic peptide
RTSQSIFNYLN

SEQ ID NO: 1637 - DNA, 51 bp, Artificial Sequence
  Description of Artificial Sequence: Synthetic oligonucleotide
aagtccagccagagtgttttatacagctccaacaataacaactacttggct

SEQ ID NO: 1638 - protein, 17 aa, Artificial Sequence
  Description of Artificial Sequence: Synthetic peptide
KSSQSVLYSSNNNNYLA

SEQ ID NO: 1639 - DNA, 33 bp, Artificial Sequence
  Description of Artificial Sequence: Synthetic oligonucleotide
cgggcaagtcagggcattagaaaggatttaggc

SEQ ID NO: 1640 - protein, 11 aa, Artificial Sequence
  Description of Artificial Sequence: Synthetic peptide
RASQGIRKDLG

SEQ ID NO: 1641 - DNA, 33 bp, Artificial Sequence; identical to SEQ ID NO: 1177
  Description of Artificial Sequence: Synthetic oligonucleotide

SEQ ID NO: 1642 - protein, 11 aa, Artificial Sequence
  Description of Artificial Sequence: Synthetic peptide
RASQDISSWLA

SEQ ID NO: 1643 - DNA, 33 bp, Artificial Sequence; identical to SEQ ID NO: 171
  Description of Artificial Sequence: Synthetic oligonucleotide

SEQ ID NO: 1644 - protein, 11 aa, Artificial Sequence
  Description of Artificial Sequence: Synthetic peptide
RASQGISSWLA

SEQ ID NO: 1645 - DNA, 33 bp, Artificial Sequence
  Description of Artificial Sequence: Synthetic oligonucleotide
cgggcaagtcagggcattaacaataatttaaac

SEQ ID NO: 1646 - protein, 11 aa, Artificial Sequence
  Description of Artificial Sequence: Synthetic peptide
RASQGINNNLN

SEQ ID NO: 1647 - DNA, 33 bp, Artificial Sequence
  Description of Artificial Sequence: Synthetic oligonucleotide
cgtgcaagtcagggcattagaaatgatttagga

SEQ ID NO: 1648 - protein, 11 aa, Artificial Sequence
  Description of Artificial Sequence: Synthetic peptide
RASQGIRNDLG

SEQ ID NO: 1649 - DNA, 51 bp, Artificial Sequence
  Description of Artificial Sequence: Synthetic oligonucleotide
aagtccagccagagtgttttacacagctccaacaataacaactacttagat

SEQ ID NO: 1650 - protein, 17 aa, Artificial Sequence
  Description of Artificial Sequence: Synthetic peptide
KSSQSVLHSSNNNNYLD

SEQ ID NO: 1651 - DNA, 33 bp, Artificial Sequence
  Description of Artificial Sequence: Synthetic oligonucleotide
cgggcaagtcagggcattagaaatgatttagat

SEQ ID NO: 1652 - protein, 11 aa, Artificial Sequence
  Description of Artificial Sequence: Synthetic peptide
RASQGIRNDLD

SEQ ID NO: 1653 - DNA, 33 bp, Artificial Sequence
  Description of Artificial Sequence: Synthetic oligonucleotide
cgggcaagtcagggcattagaaatgttttaggc

SEQ ID NO: 1654 - protein, 11 aa, Artificial Sequence
  Description of Artificial Sequence: Synthetic peptide
RASQGIRNVLG

SEQ ID NO: 1655 - DNA, 33 bp, Artificial Sequence; identical to SEQ ID NO: 171
  Description of Artificial Sequence: Synthetic oligonucleotide

SEQ ID NO: 1656 - protein, 11 aa, Artificial Sequence
  Description of Artificial Sequence: Synthetic peptide
RASQGISSWLA

SEQ ID NO: 1657 - DNA, 33 bp, Artificial Sequence; identical to SEQ ID NO: 1651
  Description of Artificial Sequence: Synthetic oligonucleotide

SEQ ID NO: 1658 - protein, 11 aa, Artificial Sequence
  Description of Artificial Sequence: Synthetic peptide
RASQGIRNDLD

SEQ ID NO: 1659 - DNA, 33 bp, Artificial Sequence; identical to SEQ ID NO: 137
  Description of Artificial Sequence: Synthetic oligonucleotide

SEQ ID NO: 1660 - protein, 11 aa, Artificial Sequence
  Description of Artificial Sequence: Synthetic peptide
RASQNISSYLN

SEQ ID NO: 1661 - DNA, 33 bp, Artificial Sequence
  Description of Artificial Sequence: Synthetic oligonucleotide
cgggcgagtcagggcattagcagttatttaaat

SEQ ID NO: 1662 - protein, 11 aa, Artificial Sequence
  Description of Artificial Sequence: Synthetic peptide
RASQGISSYLN

SEQ ID NO: 1663 - DNA, 33 bp, Artificial Sequence; identical to SEQ ID NO: 171
  Description of Artificial Sequence: Synthetic oligonucleotide

SEQ ID NO: 1664 - protein, 11 aa, Artificial Sequence
  Description of Artificial Sequence: Synthetic peptide
RASQGISSWLA

SEQ ID NO: 1665 - DNA, 33 bp, Artificial Sequence; identical to SEQ ID NO: 553
  Description of Artificial Sequence: Synthetic oligonucleotide

SEQ ID NO: 1666 - protein, 11 aa, Artificial Sequence
  Description of Artificial Sequence: Synthetic peptide
RASQGISNWLA

SEQ ID NO: 1667 - DNA, 33 bp, Artificial Sequence; identical to SEQ ID NO: 109
  Description of Artificial Sequence: Synthetic oligonucleotide

SEQ ID NO: 1668 - protein, 11 aa, Artificial Sequence
  Description of Artificial Sequence: Synthetic peptide
RASQGIRNDLG

SEQ ID NO: 1669 - DNA, 33 bp, Artificial Sequence
  Description of Artificial Sequence: Synthetic oligonucleotide
cgggcaagtcaggacatcagaaatgatttaggc

SEQ ID NO: 1670 - protein, 11 aa, Artificial Sequence
  Description of Artificial Sequence: Synthetic peptide
RASQDIRNDLG

SEQ ID NO: 1671 - DNA, 33 bp, Artificial Sequence; identical to SEQ ID NO: 109
  Description of Artificial Sequence: Synthetic oligonucleotide

SEQ ID NO: 1672 - protein, 11 aa, Artificial Sequence
  Description of Artificial Sequence: Synthetic peptide
RASQGIRNDLG

SEQ ID NO: 1673 - DNA, 36 bp, Artificial Sequence
  Description of Artificial Sequence: Synthetic oligonucleotide
agggcccgtcagaatgttgacagcagctacttagcc

SEQ ID NO: 1674 - protein, 12 aa, Artificial Sequence
  Description of Artificial Sequence: Synthetic peptide
RARQNVDSSYLA

SEQ ID NO: 1675 - DNA, 36 bp, Artificial Sequence
  Description of Artificial Sequence: Synthetic oligonucleotide
agggccagtcagaatatttacagcaactacctagcc

SEQ ID NO: 1676 - protein, 12 aa, Artificial Sequence
  Description of Artificial Sequence: Synthetic peptide
RASQNIYSNYLA

SEQ ID NO: 1677 - DNA, 51 bp, Artificial Sequence; identical to SEQ ID NO: 1079
  Description of Artificial Sequence: Synthetic oligonucleotide

SEQ ID NO: 1678 - protein, 17 aa, Artificial Sequence
  Description of Artificial Sequence: Synthetic peptide
KSSQSVLYSSNNYNYLA

SEQ ID NO: 1679 - DNA, 51 bp, Artificial Sequence
  Description of Artificial Sequence: Synthetic oligonucleotide
aagtccagccagagtgttttacacagctccaacaataacaattacttagcc

SEQ ID NO: 1680 - protein, 17 aa, Artificial Sequence
  Description of Artificial Sequence: Synthetic peptide
KSSQSVLHSSNNNNYLA

SEQ ID NO: 1681 - DNA, 36 bp, Artificial Sequence
  Description of Artificial Sequence: Synthetic oligonucleotide
agggccagtcagagtgttagcagcagctacttagtc

SEQ ID NO: 1682 - protein, 12 aa, Artificial Sequence
  Description of Artificial Sequence: Synthetic peptide
RASQSVSSSYLV

SEQ ID NO: 1683 - DNA, 51 bp, Artificial Sequence
  Description of Artificial Sequence: Synthetic oligonucleotide
aagtccagccagagtgttttacacagctccaacaataagaactacttaact

SEQ ID NO: 1684 - protein, 17 aa, Artificial Sequence
  Description of Artificial Sequence: Synthetic peptide
KSSQSVLHSSNNKNYLT

SEQ ID NO: 1685 - DNA, 51 bp, Artificial Sequence
  Description of Artificial Sequence: Synthetic oligonucleotide
aagtccagccagagtgttttatacagctccaacaatgcgaactacttagct

SEQ ID NO: 1686 - protein, 17 aa, Artificial Sequence
  Description of Artificial Sequence: Synthetic peptide
KSSQSVLYSSNNANYLA

SEQ ID NO: 1687 - DNA, 33 bp, Artificial Sequence
  Description of Artificial Sequence: Synthetic oligonucleotide
agggccagtgtgagtgttgtcaacagcttagcc

SEQ ID NO: 1688 - protein, 11 aa, Artificial Sequence
  Description of Artificial Sequence: Synthetic peptide
RASVSVVNSLA

SEQ ID NO: 1689 - DNA, 51 bp, Artificial Sequence
  Description of Artificial Sequence: Synthetic oligonucleotide
aagtccagccagagtgttttacacagctccaacaattacaactacttagct

SEQ ID NO: 1690 - protein, 17 aa, Artificial Sequence
  Description of Artificial Sequence: Synthetic peptide
KSSQSVLHSSNNYNYLA

SEQ ID NO: 1691 - DNA, 33 bp, Artificial Sequence; identical to SEQ ID NO: 109
  Description of Artificial Sequence: Synthetic oligonucleotide

SEQ ID NO: 1692 - protein, 11 aa, Artificial Sequence
  Description of Artificial Sequence: Synthetic peptide
RASQGIRNDLG

SEQ ID NO: 1693 - DNA, 51 bp, Artificial Sequence
  Description of Artificial Sequence: Synthetic oligonucleotide
aagtccagccagagtgttttattcagctccaacaattataattacttagct

SEQ ID NO: 1694 - protein, 17 aa, Artificial Sequence
  Description of Artificial Sequence: Synthetic peptide
KSSQSVLFSSNNYNYLA

SEQ ID NO: 1695 - DNA, 36 bp, Artificial Sequence
  Description of Artificial Sequence: Synthetic oligonucleotide
agggccagtcagaatatttacagcagttacttagcc

SEQ ID NO: 1696 - protein, 12 aa, Artificial Sequence
  Description of Artificial Sequence: Synthetic peptide
RASQNIYSSYLA

SEQ ID NO: 1697 - DNA, 36 bp, Artificial Sequence
  Description of Artificial Sequence: Synthetic oligonucleotide
agggccagtcagagtgtttacagcagctacttagcc

SEQ ID NO: 1698 - protein, 12 aa, Artificial Sequence
  Description of Artificial Sequence: Synthetic peptide
RASQSVYSSYLA

SEQ ID NO: 1699 - DNA, 36 bp, Artificial Sequence; identical to SEQ ID NO: 1697
  Description of Artificial Sequence: Synthetic oligonucleotide

SEQ ID NO: 1700 - protein, 12 aa, Artificial Sequence
  Description of Artificial Sequence: Synthetic peptide
RASQSVYSSYLA

SEQ ID NO: 1701 - DNA, 33 bp, Artificial Sequence; identical to SEQ ID NO: 109
  Description of Artificial Sequence: Synthetic oligonucleotide

SEQ ID NO: 1702 - protein, 11 aa, Artificial Sequence
  Description of Artificial Sequence: Synthetic peptide
RASQGIRNDLG

SEQ ID NO: 1703 - DNA, 36 bp, Artificial Sequence; identical to SEQ ID NO: 99
  Description of Artificial Sequence: Synthetic oligonucleotide

SEQ ID NO: 1704 - protein, 12 aa, Artificial Sequence
  Description of Artificial Sequence: Synthetic peptide
RASQSVNSNYLA

SEQ ID NO: 1705 - DNA, 51 bp, Artificial Sequence
  Description of Artificial Sequence: Synthetic oligonucleotide
aagtccagccagagtgtattacacagctccaacagttacaactacttagct

SEQ ID NO: 1706 - protein, 17 aa, Artificial Sequence
  Description of Artificial Sequence: Synthetic peptide
KSSQSVLHSSNSYNYLA

SEQ ID NO: 1707 - DNA, 51 bp, Artificial Sequence
  Description of Artificial Sequence: Synthetic oligonucleotide
aagtccagccagagtattttatacaactccaacaataacaactacttagct

SEQ ID NO: 1708 - protein, 17 aa, Artificial Sequence
  Description of Artificial Sequence: Synthetic peptide
KSSQSILYNSNNNNYLA

SEQ ID NO: 1709 - DNA, 36 bp, Artificial Sequence; identical to SEQ ID NO: 759
  Description of Artificial Sequence: Synthetic oligonucleotide

SEQ ID NO: 1710 - protein, 12 aa, Artificial Sequence
  Description of Artificial Sequence: Synthetic peptide
RASQSVSSSYLA

SEQ ID NO: 1711 - DNA, 36 bp, Artificial Sequence; identical to SEQ ID NO: 1681
  Description of Artificial Sequence: Synthetic oligonucleotide

SEQ ID NO: 1712 - protein, 12 aa, Artificial Sequence
  Description of Artificial Sequence: Synthetic peptide
RASQSVSSSYLV

SEQ ID NO: 1713 - DNA, 36 bp, Artificial Sequence
  Description of Artificial Sequence: Synthetic oligonucleotide
agggccagtccgagtgttgacagcagctacttagcc

SEQ ID NO: 1714 - protein, 12 aa, Artificial Sequence
  Description of Artificial Sequence: Synthetic peptide
RASPSVDSSYLA

SEQ ID NO: 1715 - DNA, 36 bp, Artificial Sequence
  Description of Artificial Sequence: Synthetic oligonucleotide
aggaccagtccgaatgttgacagcagctacttagcc

SEQ ID NO: 1716 - protein, 12 aa, Artificial Sequence
  Description of Artificial Sequence: Synthetic peptide
RTSPNVDSSYLA

SEQ ID NO: 1717 - DNA, 36 bp, Artificial Sequence
  Description of Artificial Sequence: Synthetic oligonucleotide
agggccagtcagagtgttagcagcaggtacttagcc

SEQ ID NO: 1718 - protein, 12 aa, Artificial Sequence
  Description of Artificial Sequence: Synthetic peptide
RASQSVSSRYLA

SEQ ID NO: 1719 - DNA, 51 bp, Artificial Sequence
  Description of Artificial Sequence: Synthetic oligonucleotide
aagtccagccagactgttttacacagctccaacaattataactacttagct

SEQ ID NO: 1720 - protein, 17 aa, Artificial Sequence
  Description of Artificial Sequence: Synthetic peptide
KSSQTVLHSSNNYNYLA

SEQ ID NO: 1721 - DNA, 36 bp, Artificial Sequence; identical to SEQ ID NO: 1681
  Description of Artificial Sequence: Synthetic oligonucleotide

SEQ ID NO: 1722 - protein, 12 aa, Artificial Sequence
  Description of Artificial Sequence: Synthetic peptide
RASQSVSSSYLV

SEQ ID NO: 1723 - DNA, 36 bp, Artificial Sequence
  Description of Artificial Sequence: Synthetic oligonucleotide
agggccagtcagagtgttagcagcagttacttatcc

SEQ ID NO: 1724 - protein, 12 aa, Artificial Sequence
  Description of Artificial Sequence: Synthetic peptide
RASQSVSSSYLS

SEQ ID NO: 1725 - DNA, 36 bp, Artificial Sequence
  Description of Artificial Sequence: Synthetic oligonucleotide
agggccagtcagaatatttacagcaactacttagcc

SEQ ID NO: 1726 - protein, 12 aa, Artificial Sequence
  Description of Artificial Sequence: Synthetic peptide
RASQNIYSNYLA

SEQ ID NO: 1727 - DNA, 33 bp, Artificial Sequence
  Description of Artificial Sequence: Synthetic oligonucleotide
cgggcgagtcagggcattggcaagtatttagcc

SEQ ID NO: 1728 - protein, 11 aa, Artificial Sequence
  Description of Artificial Sequence: Synthetic peptide
RASQGIGKYLA

SEQ ID NO: 1729 - DNA, 33 bp, Artificial Sequence
  Description of Artificial Sequence: Synthetic oligonucleotide
agggccagtctgagtgttgtcaacagcttagcc

SEQ ID NO: 1730 - protein, 11 aa, Artificial Sequence
  Description of Artificial Sequence: Synthetic peptide
RASLSVVNSLA

SEQ ID NO: 1731 - DNA, 48 bp, Artificial Sequence
  Description of Artificial Sequence: Synthetic oligonucleotide
aggtctagtcagagcctcctgcatagtaatggacacaactatttggat

SEQ ID NO: 1732 - protein, 16 aa, Artificial Sequence
  Description of Artificial Sequence: Synthetic peptide
RSSQSLLHSNGHNYLD

SEQ ID NO: 1733 - DNA, 36 bp, Artificial Sequence; identical to SEQ ID NO: 99
  Description of Artificial Sequence: Synthetic oligonucleotide

SEQ ID NO: 1734 - protein, 12 aa, Artificial Sequence
  Description of Artificial Sequence: Synthetic peptide
RASQSVNSNYLA

SEQ ID NO: 1735 - DNA, 51 bp, Artificial Sequence
  Description of Artificial Sequence: Synthetic oligonucleotide
aagtcccgccagagtgttttacacagctccaacaattacaactacttagct

SEQ ID NO: 1736 - protein, 17 aa, Artificial Sequence
  Description of Artificial Sequence: Synthetic peptide
KSRQSVLHSSNNYNYLA

SEQ ID NO: 1737 - DNA, 51 bp, Artificial Sequence
  Description of Artificial Sequence: Synthetic oligonucleotide
aagtccagccagagtattttatacagctccaacaataataactacttagct

SEQ ID NO: 1738 - protein, 17 aa, Artificial Sequence
  Description of Artificial Sequence: Synthetic peptide
KSSQSILYSSNNNNYLA

SEQ ID NO: 1739 - DNA, 36 bp, Artificial Sequence; identical to SEQ ID NO: 1697
  Description of Artificial Sequence: Synthetic oligonucleotide

SEQ ID NO: 1740 - protein, 12 aa, Artificial Sequence
  Description of Artificial Sequence: Synthetic peptide
RASQSVYSSYLA

SEQ ID NO: 1741 - DNA, 36 bp, Artificial Sequence; identical to SEQ ID NO: 1697
  Description of Artificial Sequence: Synthetic oligonucleotide

SEQ ID NO: 1742 - protein, 12 aa, Artificial Sequence
  Description of Artificial Sequence: Synthetic peptide
RASQSVYSSYLA

SEQ ID NO: 1743 - DNA, 48 bp, Artificial Sequence
  Description of Artificial Sequence: Synthetic oligonucleotide
aggtctagtcagagcctcctgcatagtagtggatacaactatttggat

SEQ ID NO: 1744 - protein, 16 aa, Artificial Sequence
  Description of Artificial Sequence: Synthetic peptide
RSSQSLLHSSGYNYLD

SEQ ID NO: 1745 - DNA, 36 bp, Artificial Sequence
  Description of Artificial Sequence: Synthetic oligonucleotide
agggccagtccgagtgttaacagctactacttagcc

SEQ ID NO: 1746 - protein, 12 aa, Artificial Sequence
  Description of Artificial Sequence: Synthetic peptide
RASPSVNSYYLA

SEQ ID NO: 1747 - DNA, 33 bp, Artificial Sequence; identical to SEQ ID NO: 1505
  Description of Artificial Sequence: Synthetic oligonucleotide

SEQ ID NO: 1748 - protein, 11 aa, Artificial Sequence
  Description of Artificial Sequence: Synthetic peptide
RASQSVSSSLA

SEQ ID NO: 1749 - DNA, 36 bp, Artificial Sequence
  Description of Artificial Sequence: Synthetic oligonucleotide
agggccagtcagagtgttgacagcaactacttagcc

SEQ ID NO: 1750 - protein, 12 aa, Artificial Sequence
  Description of Artificial Sequence: Synthetic peptide
RASQSVDSNYLA

SEQ ID NO: 1751 - DNA, 33 bp, Artificial Sequence
  Description of Artificial Sequence: Synthetic oligonucleotide
cgggcgagtcagggcattagcaagtatttagcc

SEQ ID NO: 1752 - protein, 11 aa, Artificial Sequence
  Description of Artificial Sequence: Synthetic peptide
RASQGISKYLA

SEQ ID NO: 1753 - DNA, 51 bp, Artificial Sequence; identical to SEQ ID NO: 1719
  Description of Artificial Sequence: Synthetic oligonucleotide

SEQ ID NO: 1754 - protein, 17 aa, Artificial Sequence
  Description of Artificial Sequence: Synthetic peptide
KSSQTVLHSSNNYNYLA

SEQ ID NO: 1755 - DNA, 36 bp, Artificial Sequence
  Description of Artificial Sequence: Synthetic oligonucleotide
agggccagtcagagtgtttacagcagctacttagcg

SEQ ID NO: 1756 - protein, 12 aa, Artificial Sequence
  Description of Artificial Sequence: Synthetic peptide
RASQSVYSSYLA

SEQ ID NO: 1757 - DNA, 36 bp, Artificial Sequence; identical to SEQ ID NO: 1697
  Description of Artificial Sequence: Synthetic oligonucleotide

SEQ ID NO: 1758 - protein, 12 aa, Artificial Sequence
  Description of Artificial Sequence: Synthetic peptide
RASQSVYSSYLA

SEQ ID NO: 1759 - DNA, 36 bp, Artificial Sequence; identical to SEQ ID NO: 759
  Description of Artificial Sequence: Synthetic oligonucleotide

SEQ ID NO: 1760 - protein, 12 aa, Artificial Sequence
  Description of Artificial Sequence: Synthetic peptide
RASQSVSSSYLA

SEQ ID NO: 1761 - DNA, 36 bp, Artificial Sequence; identical to SEQ ID NO: 1717
  Description of Artificial Sequence: Synthetic oligonucleotide

SEQ ID NO: 1762 - protein, 12 aa, Artificial Sequence
  Description of Artificial Sequence: Synthetic peptide
RASQSVSSRYLA

SEQ ID NO: 1763 - DNA, 36 bp, Artificial Sequence; identical to SEQ ID NO: 1681
  Description of Artificial Sequence: Synthetic oligonucleotide

SEQ ID NO: 1764 - protein, 12 aa, Artificial Sequence
  Description of Artificial Sequence: Synthetic peptide
RASQSVSSSYLV

SEQ ID NO: 1765 - DNA, 36 bp, Artificial Sequence
  Description of Artificial Sequence: Synthetic oligonucleotide
agggccagtcagagtgttcacagcaggtacttagcc

SEQ ID NO: 1766 - protein, 12 aa, Artificial Sequence
  Description of Artificial Sequence: Synthetic peptide
RASQSVHSRYLA

SEQ ID NO: 1767 - DNA, 51 bp, Artificial Sequence
  Description of Artificial Sequence: Synthetic oligonucleotide
aagtccagccagagtgttttatacacctccaacaataacaactacttagct

SEQ ID NO: 1768 - protein, 17 aa, Artificial Sequence
  Description of Artificial Sequence: Synthetic peptide
KSSQSVLYTSNNNNYLA

SEQ ID NO: 1769 - DNA, 36 bp, Artificial Sequence; identical to SEQ ID NO: 1681
  Description of Artificial Sequence: Synthetic oligonucleotide

SEQ ID NO: 1770 - protein, 12 aa, Artificial Sequence
  Description of Artificial Sequence: Synthetic peptide
RASQSVSSSYLV

SEQ ID NO: 1771 - DNA, 36 bp, Artificial Sequence
  Description of Artificial Sequence: Synthetic oligonucleotide
agggccaggcagagtgttgacagcagttatttagcc

SEQ ID NO: 1772 - protein, 12 aa, Artificial Sequence
  Description of Artificial Sequence: Synthetic peptide
RARQSVDSSYLA

SEQ ID NO: 1773 - DNA, 51 bp, Artificial Sequence
  Description of Artificial Sequence: Synthetic oligonucleotide
aggtccagccagagtgttttatacagctccaacaattataactacttagct

SEQ ID NO: 1774 - protein, 17 aa, Artificial Sequence
  Description of Artificial Sequence: Synthetic peptide
RSSQSVLYSSNNYNYLA

SEQ ID NO: 1775 - DNA, 33 bp, Artificial Sequence
  Description of Artificial Sequence: Synthetic oligonucleotide
cgggcgagtcaggtcattagcaagtatttagcc

SEQ ID NO: 1776 - protein, 11 aa, Artificial Sequence
  Description of Artificial Sequence: Synthetic peptide
RASQVISKYLA

SEQ ID NO: 1777 - DNA, 51 bp, Artificial Sequence
  Description of Artificial Sequence: Synthetic oligonucleotide
aagtccagccagagtgttttacacagctctaataaaaagaactacttagct

SEQ ID NO: 1778 - protein, 17 aa, Artificial Sequence
  Description of Artificial Sequence: Synthetic peptide
KSSQSVLHSSNKKNYLA

SEQ ID NO: 1779 - DNA, 51 bp, Artificial Sequence; identical to SEQ ID NO: 1767
  Description of Artificial Sequence: Synthetic oligonucleotide

SEQ ID NO: 1780 - protein, 17 aa, Artificial Sequence
  Description of Artificial Sequence: Synthetic peptide
KSSQSVLYTSNNNNYLA

SEQ ID NO: 1781 - DNA, 33 bp, Artificial Sequence
  Description of Artificial Sequence: Synthetic oligonucleotide
agggccagtcagagtgttagcagaaatttagcc

SEQ ID NO: 1782 - protein, 11 aa, Artificial Sequence
  Description of Artificial Sequence: Synthetic peptide
RASQSVSRNLA

SEQ ID NO: 1783 - DNA, 33 bp, Artificial Sequence
  Description of Artificial Sequence: Synthetic oligonucleotide
agggccagtcagagtgttgccagcagcttagcc

SEQ ID NO: 1784 - protein, 11 aa, Artificial Sequence
  Description of Artificial Sequence: Synthetic peptide
RASQSVASSLA

SEQ ID NO: 1785 - DNA, 36 bp, Artificial Sequence
  Description of Artificial Sequence: Synthetic oligonucleotide
agggccagtcagagttttagcagcgcctacttagcc

SEQ ID NO: 1786 - protein, 12 aa, Artificial Sequence
  Description of Artificial Sequence: Synthetic peptide
RASQSFSSAYLA

SEQ ID NO: 1787 - DNA, 51 bp, Artificial Sequence; identical to SEQ ID NO: 159
  Description of Artificial Sequence: Synthetic oligonucleotide

SEQ ID NO: 1788 - protein, 17 aa, Artificial Sequence
  Description of Artificial Sequence: Synthetic peptide
KSSQSVLYSSNSHNYLA

SEQ ID NO: 1789 - DNA, 36 bp, Artificial Sequence
  Description of Artificial Sequence: Synthetic oligonucleotide
agggccagtcagaatgttgacagcaactacttagcc

SEQ ID NO: 1790 - protein, 12 aa, Artificial Sequence
  Description of Artificial Sequence: Synthetic peptide
RASQNVDSNYLA

SEQ ID NO: 1791 - DNA, 51 bp, Artificial Sequence; identical to SEQ ID NO: 1719
  Description of Artificial Sequence: Synthetic oligonucleotide

SEQ ID NO: 1792 - protein, 17 aa, Artificial Sequence
  Description of Artificial Sequence: Synthetic peptide
KSSQTVLHSSNNYNYLA

SEQ ID NO: 1793 - DNA, 51 bp, Artificial Sequence
  Description of Artificial Sequence: Synthetic oligonucleotide
aagtccagccagagtgttttatacagcttcaacaattacaactacttagct

SEQ ID NO: 1794 - protein, 17 aa, Artificial Sequence
  Description of Artificial Sequence: Synthetic peptide
KSSQSVLYSFNNYNYLA

SEQ ID NO: 1795 - DNA, 51 bp, Artificial Sequence; identical to SEQ ID NO: 83
  Description of Artificial Sequence: Synthetic oligonucleotide

SEQ ID NO: 1796 - protein, 17 aa, Artificial Sequence
  Description of Artificial Sequence: Synthetic peptide
KSSQSVLFSSNNYNYLA

SEQ ID NO: 1797 - DNA, 51 bp, Artificial Sequence
  Description of Artificial Sequence: Synthetic oligonucleotide
aagtccagccagactgttttacacagcttcaacaattataactacttagct

SEQ ID NO: 1798 - protein, 17 aa, Artificial Sequence
  Description of Artificial Sequence: Synthetic peptide
KSSQTVLHSFNNYNYLA

SEQ ID NO: 1799 - DNA, 36 bp, Artificial Sequence; identical to SEQ ID NO: 1697
  Description of Artificial Sequence: Synthetic oligonucleotide

SEQ ID NO: 1800 - protein, 12 aa, Artificial Sequence
  Description of Artificial Sequence: Synthetic peptide
RASQSVYSSYLA

SEQ ID NO: 1801 - DNA, 36 bp, Artificial Sequence; identical to SEQ ID NO: 1697
  Description of Artificial Sequence: Synthetic oligonucleotide

SEQ ID NO: 1802 - protein, 12 aa, Artificial Sequence
  Description of Artificial Sequence: Synthetic peptide
RASQSVYSSYLA

SEQ ID NO: 1803 - DNA, 51 bp, Artificial Sequence
  Description of Artificial Sequence: Synthetic oligonucleotide
aagtccagccagagtgttttatacagttccaacaataataactacttagct

SEQ ID NO: 1804 - protein, 17 aa, Artificial Sequence
  Description of Artificial Sequence: Synthetic peptide
KSSQSVLYSSNNNNYLA

SEQ ID NO: 1805 - DNA, 33 bp, Artificial Sequence; identical to SEQ ID NO: 1751
  Description of Artificial Sequence: Synthetic oligonucleotide

SEQ ID NO: 1806 - protein, 11 aa, Artificial Sequence
  Description of Artificial Sequence: Synthetic peptide
RASQGISKYLA

SEQ ID NO: 1807 - DNA, 36 bp, Artificial Sequence
  Description of Artificial Sequence: Synthetic oligonucleotide
agggccagtcagatttttagcagcagctacttagcc

SEQ ID NO: 1808 - protein, 12 aa, Artificial Sequence
  Description of Artificial Sequence: Synthetic peptide
RASQIFSSSYLA

SEQ ID NO: 1809 - DNA, 33 bp, Artificial Sequence; identical to SEQ ID NO: 1729
  Description of Artificial Sequence: Synthetic oligonucleotide

SEQ ID NO: 1810 - protein, 11 aa, Artificial Sequence
  Description of Artificial Sequence: Synthetic peptide
RASLSVVNSLA

SEQ ID NO: 1811 - DNA, 51 bp, Artificial Sequence
  Description of Artificial Sequence: Synthetic oligonucleotide
atgtccagccagagtgttttacacagcttcaacaataagaactacttaact

SEQ ID NO: 1812 - protein, 17 aa, Artificial Sequence
  Description of Artificial Sequence: Synthetic peptide
MSSQSVLHSFNNKNYLT

SEQ ID NO: 1813 - DNA, 51 bp, Artificial Sequence; identical to SEQ ID NO: 159
  Description of Artificial Sequence: Synthetic oligonucleotide

SEQ ID NO: 1814 - protein, 17 aa, Artificial Sequence
  Description of Artificial Sequence: Synthetic peptide
KSSQSVLYSSNSHNYLA

SEQ ID NO: 1815 - DNA, 51 bp, Artificial Sequence; identical to SEQ ID NO: 1737
  Description of Artificial Sequence: Synthetic oligonucleotide

SEQ ID NO: 1816 - protein, 17 aa, Artificial Sequence
  Description of Artificial Sequence: Synthetic peptide
KSSQSILYSSNNNNYLA

SEQ ID NO: 1817 - DNA, 36 bp, Artificial Sequence; identical to SEQ ID NO: 1697
  Description of Artificial Sequence: Synthetic oligonucleotide

SEQ ID NO: 1818 - protein, 12 aa, Artificial Sequence
  Description of Artificial Sequence: Synthetic peptide
RASQSVYSSYLA

SEQ ID NO: 1819 - DNA, 51 bp, Artificial Sequence; identical to SEQ ID NO: 1693
  Description of Artificial Sequence: Synthetic oligonucleotide

SEQ ID NO: 1820 - protein, 17 aa, Artificial Sequence
  Description of Artificial Sequence: Synthetic peptide
KSSQSVLFSSNNYNYLA

SEQ ID NO: 1821 - DNA, 36 bp, Artificial Sequence; identical to SEQ ID NO: 1771
  Description of Artificial Sequence: Synthetic oligonucleotide

SEQ ID NO: 1822 - protein, 12 aa, Artificial Sequence
  Description of Artificial Sequence: Synthetic peptide
RARQSVDSSYLA

SEQ ID NO: 1823 - DNA, 36 bp, Artificial Sequence; identical to SEQ ID NO: 1697
  Description of Artificial Sequence: Synthetic oligonucleotide

SEQ ID NO: 1824 - protein, 12 aa, Artificial Sequence
  Description of Artificial Sequence: Synthetic peptide
RASQSVYSSYLA

SEQ ID NO: 1825 - DNA, 51 bp, Artificial Sequence
  Description of Artificial Sequence: Synthetic oligonucleotide
aagtccagccagagtattttatacagctccaacaattacaactacttagct

SEQ ID NO: 1826 - protein, 17 aa, Artificial Sequence
  Description of Artificial Sequence: Synthetic peptide
KSSQSILYSSNNYNYLA

SEQ ID NO: 1827 - DNA, 36 bp, Artificial Sequence; identical to SEQ ID NO: 1697
  Description of Artificial Sequence: Synthetic oligonucleotide

SEQ ID NO: 1828 - protein, 12 aa, Artificial Sequence
  Description of Artificial Sequence: Synthetic peptide
RASQSVYSSYLA

SEQ ID NO: 1829 - DNA, 36 bp, Artificial Sequence; identical to SEQ ID NO: 1697
  Description of Artificial Sequence: Synthetic oligonucleotide

SEQ ID NO: 1830 - protein, 12 aa, Artificial Sequence
  Description of Artificial Sequence: Synthetic peptide
RASQSVYSSYLA

SEQ ID NO: 1831 - DNA, 36 bp, Artificial Sequence; identical to SEQ ID NO: 1697
  Description of Artificial Sequence: Synthetic oligonucleotide

SEQ ID NO: 1832 - protein, 12 aa, Artificial Sequence
  Description of Artificial Sequence: Synthetic peptide
RASQSVYSSYLA

SEQ ID NO: 1833 - DNA, 36 bp, Artificial Sequence; identical to SEQ ID NO: 1681
  Description of Artificial Sequence: Synthetic oligonucleotide

SEQ ID NO: 1834 - protein, 12 aa, Artificial Sequence
  Description of Artificial Sequence: Synthetic peptide
RASQSVSSSYLV

SEQ ID NO: 1835 - DNA, 51 bp, Artificial Sequence; identical to SEQ ID NO: 1767
  Description of Artificial Sequence: Synthetic oligonucleotide

SEQ ID NO: 1836 - protein, 17 aa, Artificial Sequence
  Description of Artificial Sequence: Synthetic peptide
KSSQSVLYTSNNNNYLA

SEQ ID NO: 1837 - DNA, 36 bp, Artificial Sequence; identical to SEQ ID NO: 1697
  Description of Artificial Sequence: Synthetic oligonucleotide

SEQ ID NO: 1838 - protein, 12 aa, Artificial Sequence
  Description of Artificial Sequence: Synthetic peptide
RASQSVYSSYLA

SEQ ID NO: 1839 - DNA, 51 bp, Artificial Sequence
  Description of Artificial Sequence: Synthetic oligonucleotide
aagtccagccagagtgttttacacaggtccaacaattacaactacttagcg

SEQ ID NO: 1840 - protein, 17 aa, Artificial Sequence
  Description of Artificial Sequence: Synthetic peptide
KSSQSVLHRSNNYNYLA

SEQ ID NO: 1841 - DNA, 36 bp, Artificial Sequence
  Description of Artificial Sequence: Synthetic oligonucleotide
agggccagtcagaatatttacagcagctacttagcc

SEQ ID NO: 1842 - protein, 12 aa, Artificial Sequence
  Description of Artificial Sequence: Synthetic peptide
RASQNIYSSYLA

SEQ ID NO: 1843 - DNA, 36 bp, Artificial Sequence
  Description of Artificial Sequence: Synthetic oligonucleotide
agggccagtcagagtgttgacagcggctacttagcc

SEQ ID NO: 1844 - protein, 12 aa, Artificial Sequence
  Description of Artificial Sequence: Synthetic peptide
RASQSVDSGYLA

SEQ ID NO: 1845 - DNA, 36 bp, Artificial Sequence
  Description of Artificial Sequence: Synthetic oligonucleotide
agggccagtcagagtattaacagcaactacttagcc

SEQ ID NO: 1846 - protein, 12 aa, Artificial Sequence
  Description of Artificial Sequence: Synthetic peptide
RASQSINSNYLA

SEQ ID NO: 1847 - DNA, 51 bp, Artificial Sequence
  Description of Artificial Sequence: Synthetic oligonucleotide
aagtccagacagagtgttttatacagctccaacaattacaactacttaact

SEQ ID NO: 1848 - protein, 17 aa, Artificial Sequence
  Description of Artificial Sequence: Synthetic peptide
KSRQSVLYSSNNYNYLT

SEQ ID NO: 1849 - DNA, 51 bp, Artificial Sequence; identical to SEQ ID NO: 1767
  Description of Artificial Sequence: Synthetic oligonucleotide

SEQ ID NO: 1850 - protein, 17 aa, Artificial Sequence
  Description of Artificial Sequence: Synthetic peptide
KSSQSVLYTSNNNNYLA

SEQ ID NO: 1851 - DNA, 36 bp, Artificial Sequence
  Description of Artificial Sequence: Synthetic oligonucleotide
agggccagtcagagtgttgacagcagctacttagcc

SEQ ID NO: 1852 - protein, 12 aa, Artificial Sequence
  Description of Artificial Sequence: Synthetic peptide
RASQSVDSSYLA

SEQ ID NO: 1853 - DNA, 33 bp, Artificial Sequence; identical to SEQ ID NO: 1727
  Description of Artificial Sequence: Synthetic oligonucleotide

SEQ ID NO: 1854 - protein, 11 aa, Artificial Sequence
  Description of Artificial Sequence: Synthetic peptide
RASQGIGKYLA

SEQ ID NO: 1855 - DNA, 33 bp, Artificial Sequence
  Description of Artificial Sequence: Synthetic oligonucleotide
cgggcgagtcagggcattggcaggtatttagcc

SEQ ID NO: 1856 - protein, 11 aa, Artificial Sequence
  Description of Artificial Sequence: Synthetic peptide
RASQGIGRYLA

SEQ ID NO: 1857 - DNA, 36 bp, Artificial Sequence; identical to SEQ ID NO: 1697
  Description of Artificial Sequence: Synthetic oligonucleotide

SEQ ID NO: 1858 - protein, 12 aa, Artificial Sequence
  Description of Artificial Sequence: Synthetic peptide
RASQSVYSSYLA

SEQ ID NO: 1859 - DNA, 36 bp, Artificial Sequence; identical to SEQ ID NO: 759
  Description of Artificial Sequence: Synthetic oligonucleotide

SEQ ID NO: 1860 - protein, 12 aa, Artificial Sequence
  Description of Artificial Sequence: Synthetic peptide
RASQSVSSSYLA

SEQ ID NO: 1861 - DNA, 36 bp, Artificial Sequence; identical to SEQ ID NO: 1697
  Description of Artificial Sequence: Synthetic oligonucleotide

SEQ ID NO: 1862 - protein, 12 aa, Artificial Sequence
  Description of Artificial Sequence: Synthetic peptide
RASQSVYSSYLA

SEQ ID NO: 1863 - DNA, 36 bp, Artificial Sequence; identical to SEQ ID NO: 1697
  Description of Artificial Sequence: Synthetic oligonucleotide

SEQ ID NO: 1864 - protein, 12 aa, Artificial Sequence
  Description of Artificial Sequence: Synthetic peptide
RASQSVYSSYLA

SEQ ID NO: 1865 - DNA, 51 bp, Artificial Sequence; identical to SEQ ID NO: 1693
  Description of Artificial Sequence: Synthetic oligonucleotide

SEQ ID NO: 1866 - protein, 17 aa, Artificial Sequence
  Description of Artificial Sequence: Synthetic peptide
KSSQSVLFSSNNYNYLA

SEQ ID NO: 1867 - DNA, 51 bp, Artificial Sequence; identical to SEQ ID NO: 1767
  Description of Artificial Sequence: Synthetic oligonucleotide

SEQ ID NO: 1868 - protein, 17 aa, Artificial Sequence
  Description of Artificial Sequence: Synthetic peptide
KSSQSVLYTSNNNNYLA

SEQ ID NO: 1869 - DNA, 36 bp, Artificial Sequence; identical to SEQ ID NO: 759
  Description of Artificial Sequence: Synthetic oligonucleotide

SEQ ID NO: 1870 - protein, 12 aa, Artificial Sequence
  Description of Artificial Sequence: Synthetic peptide
RASQSVSSSYLA

SEQ ID NO: 1871 - DNA, 36 bp, Artificial Sequence; identical to SEQ ID NO: 1697
  Description of Artificial Sequence: Synthetic oligonucleotide

SEQ ID NO: 1872 - protein, 12 aa, Artificial Sequence
  Description of Artificial Sequence: Synthetic peptide
RASQSVYSSYLA

SEQ ID NO: 1873 - DNA, 36 bp, Artificial Sequence; identical to SEQ ID NO: 759
  Description of Artificial Sequence: Synthetic oligonucleotide

SEQ ID NO: 1874 - protein, 12 aa, Artificial Sequence
  Description of Artificial Sequence: Synthetic peptide
RASQSVSSSYLA

SEQ ID NO: 1875 - DNA, 36 bp, Artificial Sequence
  Description of Artificial Sequence: Synthetic oligonucleotide
agggccagtgagagtgttagcagcagctacttagtc

SEQ ID NO: 1876 - protein, 12 aa, Artificial Sequence
  Description of Artificial Sequence: Synthetic peptide
RASESVSSSYLV

SEQ ID NO: 1877 - DNA, 36 bp, Artificial Sequence; identical to SEQ ID NO: 1875
  Description of Artificial Sequence: Synthetic oligonucleotide

SEQ ID NO: 1878 - protein, 12 aa, Artificial Sequence
  Description of Artificial Sequence: Synthetic peptide
RASESVSSSYLV

SEQ ID NO: 1879 - DNA, 36 bp, Artificial Sequence; identical to SEQ ID NO: 1697
  Description of Artificial Sequence: Synthetic oligonucleotide

SEQ ID NO: 1880 - protein, 12 aa, Artificial Sequence
  Description of Artificial Sequence: Synthetic peptide
RASQSVYSSYLA

SEQ ID NO: 1881 - DNA, 36 bp, Artificial Sequence; identical to SEQ ID NO: 759
  Description of Artificial Sequence: Synthetic oligonucleotide

SEQ ID NO: 1882 - protein, 12 aa, Artificial Sequence
  Description of Artificial Sequence: Synthetic peptide
RASQSVSSSYLA

SEQ ID NO: 1883 - DNA, 33 bp, Artificial Sequence; identical to SEQ ID NO: 205
  Description of Artificial Sequence: Synthetic oligonucleotide

SEQ ID NO: 1884 - protein, 11 aa, Artificial Sequence
  Description of Artificial Sequence: Synthetic peptide
RASQDIRNDLG

SEQ ID NO: 1885 - DNA, 36 bp, Artificial Sequence; identical to SEQ ID NO: 1697
  Description of Artificial Sequence: Synthetic oligonucleotide

SEQ ID NO: 1886 - protein, 12 aa, Artificial Sequence
  Description of Artificial Sequence: Synthetic peptide
RASQSVYSSYLA

SEQ ID NO: 1887 - DNA, 36 bp, Artificial Sequence; identical to SEQ ID NO: 1681
  Description of Artificial Sequence: Synthetic oligonucleotide

SEQ ID NO: 1888 - protein, 12 aa, Artificial Sequence
  Description of Artificial Sequence: Synthetic peptide
RASQSVSSSYLV

SEQ ID NO: 1889 - DNA, 51 bp, Artificial Sequence; identical to SEQ ID NO: 1767
  Description of Artificial Sequence: Synthetic oligonucleotide

SEQ ID NO: 1890 - protein, 17 aa, Artificial Sequence
  Description of Artificial Sequence: Synthetic peptide
KSSQSVLYTSNNNNYLA

SEQ ID NO: 1891 - DNA, 51 bp, Artificial Sequence; identical to SEQ ID NO: 1767
  Description of Artificial Sequence: Synthetic oligonucleotide

SEQ ID NO: 1892 - protein, 17 aa, Artificial Sequence
  Description of Artificial Sequence: Synthetic peptide
KSSQSVLYTSNNNNYLA

SEQ ID NO: 1893 - DNA, 36 bp, Artificial Sequence; identical to SEQ ID NO: 1875
  Description of Artificial Sequence: Synthetic oligonucleotide

SEQ ID NO: 1894 - protein, 12 aa, Artificial Sequence
  Description of Artificial Sequence: Synthetic peptide
RASESVSSSYLV

SEQ ID NO: 1895 - DNA, 36 bp, Artificial Sequence; identical to SEQ ID NO: 1843
  Description of Artificial Sequence: Synthetic oligonucleotide

SEQ ID NO: 1896 - protein, 12 aa, Artificial Sequence
  Description of Artificial Sequence: Synthetic peptide
RASQSVDSGYLA

SEQ ID NO: 1897 - DNA, 36 bp, Artificial Sequence; identical to SEQ ID NO: 1755
  Description of Artificial Sequence: Synthetic oligonucleotide

SEQ ID NO: 1898 - protein, 12 aa, Artificial Sequence
  Description of Artificial Sequence: Synthetic peptide
RASQSVYSSYLA

SEQ ID NO: 1899 - DNA, 51 bp, Artificial Sequence; identical to SEQ ID NO: 1719
  Description of Artificial Sequence: Synthetic oligonucleotide

SEQ ID NO: 1900 - protein, 17 aa, Artificial Sequence
  Description of Artificial Sequence: Synthetic peptide
KSSQTVLHSSNNYNYLA

SEQ ID NO: 1901 - DNA, 36 bp, Artificial Sequence
  Description of Artificial Sequence: Synthetic oligonucleotide
agggccagtccgagtgttcacagcaactacttagcc

SEQ ID NO: 1902 - protein, 12 aa, Artificial Sequence
  Description of Artificial Sequence: Synthetic peptide
RASPSVHSNYLA

SEQ ID NO: 1903 - DNA, 51 bp, Artificial Sequence
  Description of Artificial Sequence: Synthetic oligonucleotide
aagtccagacagagtgttttacacagctccaacaattacaactacttagct

SEQ ID NO: 1904 - protein, 17 aa, Artificial Sequence
  Description of Artificial Sequence: Synthetic peptide
KSRQSVLHSSNNYNYLA

SEQ ID NO: 1905 - DNA, 51 bp, Artificial Sequence; identical to SEQ ID NO: 1719
  Description of Artificial Sequence: Synthetic oligonucleotide

SEQ ID NO: 1906 - protein, 17 aa, Artificial Sequence
  Description of Artificial Sequence: Synthetic peptide
KSSQTVLHSSNNYNYLA

SEQ ID NO: 1907 - DNA, 33 bp, Artificial Sequence; identical to SEQ ID NO: 1775
  Description of Artificial Sequence: Synthetic oligonucleotide

SEQ ID NO: 1908 - protein, 11 aa, Artificial Sequence
  Description of Artificial Sequence: Synthetic peptide
RASQVISKYLA

SEQ ID NO: 1909 - DNA, 36 bp, Artificial Sequence; identical to SEQ ID NO: 1845
  Description of Artificial Sequence: Synthetic oligonucleotide

SEQ ID NO: 1910 - protein, 12 aa, Artificial Sequence
  Description of Artificial Sequence: Synthetic peptide
RASQSINSNYLA

SEQ ID NO: 1911 - DNA, 33 bp, Artificial Sequence
  Description of Artificial Sequence: Synthetic oligonucleotide
agggccagtcaggatgttatcacctacttagcc

SEQ ID NO: 1912 - protein, 11 aa, Artificial Sequence
  Description of Artificial Sequence: Synthetic peptide
RASQDVITYLA

SEQ ID NO: 1913 - DNA, 51 bp, Artificial Sequence; identical to SEQ ID NO: 1777
  Description of Artificial Sequence: Synthetic oligonucleotide

SEQ ID NO: 1914 - protein, 17 aa, Artificial Sequence
  Description of Artificial Sequence: Synthetic peptide
KSSQSVLHSSNKKNYLA

SEQ ID NO: 1915 - DNA, 36 bp, Artificial Sequence; identical to SEQ ID NO: 1697
  Description of Artificial Sequence: Synthetic oligonucleotide

SEQ ID NO: 1916 - protein, 12 aa, Artificial Sequence
  Description of Artificial Sequence: Synthetic peptide
RASQSVYSSYLA

SEQ ID NO: 1917 - DNA, 36 bp, Artificial Sequence; identical to SEQ ID NO: 1697
  Description of Artificial Sequence: Synthetic oligonucleotide

SEQ ID NO: 1918 - protein, 12 aa, Artificial Sequence
  Description of Artificial Sequence: Synthetic peptide
RASQSVYSSYLA

SEQ ID NO: 1919 - DNA, 36 bp, Artificial Sequence
  Description of Artificial Sequence: Synthetic oligonucleotide
aggtccagtcagagtgttagcagcagctacttagtc

SEQ ID NO: 1920 - protein, 12 aa, Artificial Sequence
  Description of Artificial Sequence: Synthetic peptide
RSSQSVSSSYLV

SEQ ID NO: 1921 - DNA, 36 bp, Artificial Sequence; identical to SEQ ID NO: 1717
  Description of Artificial Sequence: Synthetic oligonucleotide

SEQ ID NO: 1922 - protein, 12 aa, Artificial Sequence
  Description of Artificial Sequence: Synthetic peptide
RASQSVSSRYLA

SEQ ID NO: 1923 - DNA, 36 bp, Artificial Sequence; identical to SEQ ID NO: 1713
  Description of Artificial Sequence: Synthetic oligonucleotide

SEQ ID NO: 1924 - protein, 12 aa, Artificial Sequence
  Description of Artificial Sequence: Synthetic peptide
RASPSVDSSYLA

SEQ ID NO: 1925 - DNA, 36 bp, Artificial Sequence; identical to SEQ ID NO: 1841
  Description of Artificial Sequence: Synthetic oligonucleotide

SEQ ID NO: 1926 - protein, 12 aa, Artificial Sequence
  Description of Artificial Sequence: Synthetic peptide
RASQNIYSSYLA

SEQ ID NO: 1927 - DNA, 36 bp, Artificial Sequence; identical to SEQ ID NO: 99
  Description of Artificial Sequence: Synthetic oligonucleotide

SEQ ID NO: 1928 - protein, 12 aa, Artificial Sequence
  Description of Artificial Sequence: Synthetic peptide
RASQSVNSNYLA

SEQ ID NO: 1929 - DNA, 51 bp, Artificial Sequence; identical to SEQ ID NO: 1839
  Description of Artificial Sequence: Synthetic oligonucleotide

SEQ ID NO: 1930 - protein, 17 aa, Artificial Sequence
  Description of Artificial Sequence: Synthetic peptide
KSSQSVLHRSNNYNYLA

SEQ ID NO: 1931 - DNA, 36 bp, Artificial Sequence
  Description of Artificial Sequence: Synthetic oligonucleotide
agggccagtcagagtgtttggagcggctacttagcc

SEQ ID NO: 1932 - protein, 12 aa, Artificial Sequence
  Description of Artificial Sequence: Synthetic peptide
RASQSVWSGYLA

SEQ ID NO: 1933 - DNA, 51 bp, Artificial Sequence
  Description of Artificial Sequence: Synthetic oligonucleotide
aagtccagccagagtgttttgtacagctccaacagtcacaacttcttagct

SEQ ID NO: 1934 - protein, 17 aa, Artificial Sequence
  Description of Artificial Sequence: Synthetic peptide
KSSQSVLYSSNSHNFLA

SEQ ID NO: 1935 - DNA, 36 bp, Artificial Sequence; identical to SEQ ID NO: 1919
  Description of Artificial Sequence: Synthetic oligonucleotide

SEQ ID NO: 1936 - protein, 12 aa, Artificial Sequence
  Description of Artificial Sequence: Synthetic peptide
RSSQSVSSSYLV

SEQ ID NO: 1937 - DNA, 36 bp, Artificial Sequence; identical to SEQ ID NO: 1697
  Description of Artificial Sequence: Synthetic oligonucleotide

SEQ ID NO: 1938 - protein, 12 aa, Artificial Sequence
  Description of Artificial Sequence: Synthetic peptide
RASQSVYSSYLA

SEQ ID NO: 1939 - DNA, 36 bp, Artificial Sequence; identical to SEQ ID NO: 1697
  Description of Artificial Sequence: Synthetic oligonucleotide

SEQ ID NO: 1940 - protein, 12 aa, Artificial Sequence
  Description of Artificial Sequence: Synthetic peptide
RASQSVYSSYLA

SEQ ID NO: 1941 - DNA, 51 bp, Artificial Sequence
  Description of Artificial Sequence: Synthetic oligonucleotide
aagtccagccagagtgttttgcacagatccaacaattataattacttagct

SEQ ID NO: 1942 - protein, 17 aa, Artificial Sequence
  Description of Artificial Sequence: Synthetic peptide
KSSQSVLHRSNNYNYLA

SEQ ID NO: 1943 - DNA, 36 bp, Artificial Sequence; identical to SEQ ID NO: 1697
  Description of Artificial Sequence: Synthetic oligonucleotide

SEQ ID NO: 1944 - protein, 12 aa, Artificial Sequence
  Description of Artificial Sequence: Synthetic peptide
RASQSVYSSYLA

SEQ ID NO: 1945 - DNA, 36 bp, Artificial Sequence; identical to SEQ ID NO: 1749
  Description of Artificial Sequence: Synthetic oligonucleotide

SEQ ID NO: 1946 - protein, 12 aa, Artificial Sequence
  Description of Artificial Sequence: Synthetic peptide
RASQSVDSNYLA

SEQ ID NO: 1947 - DNA, 36 bp, Artificial Sequence; identical to SEQ ID NO: 1697
  Description of Artificial Sequence: Synthetic oligonucleotide

SEQ ID NO: 1948 - protein, 12 aa, Artificial Sequence
  Description of Artificial Sequence: Synthetic peptide
RASQSVYSSYLA

SEQ ID NO: 1949 - DNA, 33 bp, Artificial Sequence; identical to SEQ ID NO: 105
  Description of Artificial Sequence: Synthetic oligonucleotide

SEQ ID NO: 1950 - protein, 11 aa, Artificial Sequence
  Description of Artificial Sequence: Synthetic peptide
RASQGISNYLA

SEQ ID NO: 1951 - DNA, 36 bp, Artificial Sequence; identical to SEQ ID NO: 1697
  Description of Artificial Sequence: Synthetic oligonucleotide

SEQ ID NO: 1952 - protein, 12 aa, Artificial Sequence
  Description of Artificial Sequence: Synthetic peptide
RASQSVYSSYLA

SEQ ID NO: 1953 - DNA, 36 bp, Artificial Sequence; identical to SEQ ID NO: 759
  Description of Artificial Sequence: Synthetic oligonucleotide

SEQ ID NO: 1954 - protein, 12 aa, Artificial Sequence
  Description of Artificial Sequence: Synthetic peptide
RASQSVSSSYLA

SEQ ID NO: 1955 - DNA, 51 bp, Artificial Sequence
  Description of Artificial Sequence: Synthetic oligonucleotide
aagtccagccagagtgttttacacagctccaacaatatgaactacttagct

SEQ ID NO: 1956 - protein, 17 aa, Artificial Sequence
  Description of Artificial Sequence: Synthetic peptide
KSSQSVLHSSNNMNYLA

SEQ ID NO: 1957 - DNA, 36 bp, Artificial Sequence; identical to SEQ ID NO: 1697
  Description of Artificial Sequence: Synthetic oligonucleotide

SEQ ID NO: 1958 - protein, 12 aa, Artificial Sequence
  Description of Artificial Sequence: Synthetic peptide
RASQSVYSSYLA

SEQ ID NO: 1959 - DNA, 51 bp, Artificial Sequence
  Description of Artificial Sequence: Synthetic oligonucleotide
aagtccagccagagtgttttacacagctccaacaattacaactacttaact

SEQ ID NO: 1960 - protein, 17 aa, Artificial Sequence
  Description of Artificial Sequence: Synthetic peptide
KSSQSVLHSSNNYNYLT

SEQ ID NO: 1961 - DNA, 36 bp, Artificial Sequence; identical to SEQ ID NO: 1697
  Description of Artificial Sequence: Synthetic oligonucleotide

SEQ ID NO: 1962 - protein, 12 aa, Artificial Sequence
  Description of Artificial Sequence: Synthetic peptide
RASQSVYSSYLA

SEQ ID NO: 1963 - DNA, 51 bp, Artificial Sequence; identical to SEQ ID NO: 1767
  Description of Artificial Sequence: Synthetic oligonucleotide

SEQ ID NO: 1964 - protein, 17 aa, Artificial Sequence
  Description of Artificial Sequence: Synthetic peptide
KSSQSVLYTSNNNNYLA

SEQ ID NO: 1965 - DNA, 51 bp, Artificial Sequence
  Description of Artificial Sequence: Synthetic oligonucleotide
aagtccagccagagtgttttatacatctccaacaataataattacttagct

SEQ ID NO: 1966 - protein, 17 aa, Artificial Sequence
  Description of Artificial Sequence: Synthetic peptide
KSSQSVLYISNNNNYLA

SEQ ID NO: 1967 - DNA, 33 bp, Artificial Sequence; identical to SEQ ID NO: 109
  Description of Artificial Sequence: Synthetic oligonucleotide

SEQ ID NO: 1968 - protein, 11 aa, Artificial Sequence
  Description of Artificial Sequence: Synthetic peptide
RASQGIRNDLG

SEQ ID NO: 1969 - DNA, 36 bp, Artificial Sequence; identical to SEQ ID NO: 1697
  Description of Artificial Sequence: Synthetic oligonucleotide

SEQ ID NO: 1970 - protein, 12 aa, Artificial Sequence
  Description of Artificial Sequence: Synthetic peptide
RASQSVYSSYLA

SEQ ID NO: 1971 - DNA, 36 bp, Artificial Sequence; identical to SEQ ID NO: 1697
  Description of Artificial Sequence: Synthetic oligonucleotide

SEQ ID NO: 1972 - protein, 12 aa, Artificial Sequence
  Description of Artificial Sequence: Synthetic peptide
RASQSVYSSYLA

SEQ ID NO: 1973 - DNA, 36 bp, Artificial Sequence; identical to SEQ ID NO: 1697
  Description of Artificial Sequence: Synthetic oligonucleotide

SEQ ID NO: 1974 - protein, 12 aa, Artificial Sequence
  Description of Artificial Sequence: Synthetic peptide
RASQSVYSSYLA

SEQ ID NO: 1975 - DNA, 51 bp, Artificial Sequence
  Description of Artificial Sequence: Synthetic oligonucleotide
aagtccagccagagtgttttacacagctccaacaattggaattacttagct

SEQ ID NO: 1976 - protein, 17 aa, Artificial Sequence
  Description of Artificial Sequence: Synthetic peptide
KSSQSVLHSSNNWNYLA

SEQ ID NO: 1977 - DNA, 36 bp, Artificial Sequence; identical to SEQ ID NO: 1697
  Description of Artificial Sequence: Synthetic oligonucleotide

SEQ ID NO: 1978 - protein, 12 aa, Artificial Sequence
  Description of Artificial Sequence: Synthetic peptide
RASQSVYSSYLA

SEQ ID NO: 1979 - DNA, 48 bp, Artificial Sequence; identical to SEQ ID NO: 1743
  Description of Artificial Sequence: Synthetic oligonucleotide

SEQ ID NO: 1980 - protein, 16 aa, Artificial Sequence
  Description of Artificial Sequence: Synthetic peptide
RSSQSLLHSSGYNYLD

SEQ ID NO: 1981 - DNA, 36 bp, Artificial Sequence; identical to SEQ ID NO: 1697
  Description of Artificial Sequence: Synthetic oligonucleotide

SEQ ID NO: 1982 - protein, 12 aa, Artificial Sequence
  Description of Artificial Sequence: Synthetic peptide
RASQSVYSSYLA

SEQ ID NO: 1983 - DNA, 36 bp, Artificial Sequence; identical to SEQ ID NO: 99
  Description of Artificial Sequence: Synthetic oligonucleotide

SEQ ID NO: 1984 - protein, 12 aa, Artificial Sequence
  Description of Artificial Sequence: Synthetic peptide
RASQSVNSNYLA

SEQ ID NO: 1985 - DNA, 36 bp, Artificial Sequence; identical to SEQ ID NO: 1697
  Description of Artificial Sequence: Synthetic oligonucleotide

SEQ ID NO: 1986 - protein, 12 aa, Artificial Sequence
  Description of Artificial Sequence: Synthetic peptide
RASQSVYSSYLA

SEQ ID NO: 1987 - DNA, 36 bp, Artificial Sequence
  Description of Artificial Sequence: Synthetic oligonucleotide
agggccagtcagagtgttgacagcaacttcttagcc

SEQ ID NO: 1988 - protein, 12 aa, Artificial Sequence
  Description of Artificial Sequence: Synthetic peptide
RASQSVDSNFLA

SEQ ID NO: 1989 - DNA, 36 bp, Artificial Sequence; identical to SEQ ID NO: 1697
  Description of Artificial Sequence: Synthetic oligonucleotide

SEQ ID NO: 1990 - protein, 12 aa, Artificial Sequence
  Description of Artificial Sequence: Synthetic peptide
RASQSVYSSYLA

SEQ ID NO: 1991 - DNA, 36 bp, Artificial Sequence; identical to SEQ ID NO: 1697
  Description of Artificial Sequence: Synthetic oligonucleotide

SEQ ID NO: 1992 - protein, 12 aa, Artificial Sequence
  Description of Artificial Sequence: Synthetic peptide
RASQSVYSSYLA

SEQ ID NO: 1993 - DNA, 36 bp, Artificial Sequence; identical to SEQ ID NO: 1697
  Description of Artificial Sequence: Synthetic oligonucleotide

SEQ ID NO: 1994 - protein, 12 aa, Artificial Sequence
  Description of Artificial Sequence: Synthetic peptide
RASQSVYSSYLA

SEQ ID NO: 1995 - DNA, 33 bp, Artificial Sequence; identical to SEQ ID NO: 109
  Description of Artificial Sequence: Synthetic oligonucleotide

SEQ ID NO: 1996 - protein, 11 aa, Artificial Sequence
  Description of Artificial Sequence: Synthetic peptide
RASQGIRNDLG

SEQ ID NO: 1997 - DNA, 51 bp, Artificial Sequence; identical to SEQ ID NO: 1719
  Description of Artificial Sequence: Synthetic oligonucleotide

SEQ ID NO: 1998 - protein, 17 aa, Artificial Sequence
  Description of Artificial Sequence: Synthetic peptide
KSSQTVLHSSNNYNYLA

SEQ ID NO: 1999 - DNA, 51 bp, Artificial Sequence
  Description of Artificial Sequence: Synthetic oligonucleotide
aagtccagccagagtgttttacacaactccaacaataataactacttggct

SEQ ID NO: 2000 - protein, 17 aa, Artificial Sequence
  Description of Artificial Sequence: Synthetic peptide
KSSQSVLHNSNNNNYLA

SEQ ID NO: 2001 - DNA, 36 bp, Artificial Sequence; identical to SEQ ID NO: 1697
  Description of Artificial Sequence: Synthetic oligonucleotide

SEQ ID NO: 2002 - protein, 12 aa, Artificial Sequence
  Description of Artificial Sequence: Synthetic peptide
RASQSVYSSYLA

SEQ ID NO: 2003 - DNA, 48 bp, Artificial Sequence
  Description of Artificial Sequence: Synthetic oligonucleotide
aggtatagtcagagcctcgtgcatagtagtggatacaactatttggat

SEQ ID NO: 2004 - protein, 16 aa, Artificial Sequence
  Description of Artificial Sequence: Synthetic peptide
RYSQSLVHSSGYNYLD

SEQ ID NO: 2005 - DNA, 51 bp, Artificial Sequence; identical to SEQ ID NO: 1767
  Description of Artificial Sequence: Synthetic oligonucleotide

SEQ ID NO: 2006 - protein, 17 aa, Artificial Sequence
  Description of Artificial Sequence: Synthetic peptide
KSSQSVLYTSNNNNYLA

SEQ ID NO: 2007 - DNA, 36 bp, Artificial Sequence; identical to SEQ ID NO: 1697
  Description of Artificial Sequence: Synthetic oligonucleotide

SEQ ID NO: 2008 - protein, 12 aa, Artificial Sequence
  Description of Artificial Sequence: Synthetic peptide
RASQSVYSSYLA

SEQ ID NO: 2009 - DNA, 36 bp, Artificial Sequence; identical to SEQ ID NO: 1697
  Description of Artificial Sequence: Synthetic oligonucleotide

SEQ ID NO: 2010 - protein, 12 aa, Artificial Sequence
  Description of Artificial Sequence: Synthetic peptide
RASQSVYSSYLA

SEQ ID NO: 2011 - DNA, 36 bp, Artificial Sequence; identical to SEQ ID NO: 1697
  Description of Artificial Sequence: Synthetic oligonucleotide

SEQ ID NO: 2012 - protein, 12 aa, Artificial Sequence
  Description of Artificial Sequence: Synthetic peptide
RASQSVYSSYLA

SEQ ID NO: 2013 - DNA, 36 bp, Artificial Sequence; identical to SEQ ID NO: 1697
  Description of Artificial Sequence: Synthetic oligonucleotide

SEQ ID NO: 2014 - protein, 12 aa, Artificial Sequence
  Description of Artificial Sequence: Synthetic peptide
RASQSVYSSYLA

SEQ ID NO: 2015 - DNA, 51 bp, Artificial Sequence; identical to SEQ ID NO: 1767
  Description of Artificial Sequence: Synthetic oligonucleotide

SEQ ID NO: 2016 - protein, 17 aa, Artificial Sequence
  Description of Artificial Sequence: Synthetic peptide
KSSQSVLYTSNNNNYLA

SEQ ID NO: 2017 - DNA, 36 bp, Artificial Sequence; identical to SEQ ID NO: 1755
  Description of Artificial Sequence: Synthetic oligonucleotide

SEQ ID NO: 2018 - protein, 12 aa, Artificial Sequence
  Description of Artificial Sequence: Synthetic peptide
RASQSVYSSYLA

SEQ ID NO: 2019 - DNA, 36 bp, Artificial Sequence
  Description of Artificial Sequence: Synthetic oligonucleotide
agggccagtcagagtgttggcagcaactacttagcc

SEQ ID NO: 2020 - protein, 12 aa, Artificial Sequence
  Description of Artificial Sequence: Synthetic peptide
RASQSVGSNYLA

SEQ ID NO: 2021 - DNA, 48 bp, Artificial Sequence
  Description of Artificial Sequence: Synthetic oligonucleotide
aggtctagtcagagcctcgtgcatagtagtggatacaactatttggat

SEQ ID NO: 2022 - protein, 16 aa, Artificial Sequence
  Description of Artificial Sequence: Synthetic peptide
RSSQSLVHSSGYNYLD

SEQ ID NO: 2023 - DNA, 33 bp, Artificial Sequence
  Description of Artificial Sequence: Synthetic oligonucleotide
cgggccagtcaggatgttatcacctacttagcc

SEQ ID NO: 2024 - protein, 11 aa, Artificial Sequence
  Description of Artificial Sequence: Synthetic peptide
RASQDVITYLA

SEQ ID NO: 2025 - DNA, 36 bp, Artificial Sequence; identical to SEQ ID NO: 1697
  Description of Artificial Sequence: Synthetic oligonucleotide

SEQ ID NO: 2026 - protein, 12 aa, Artificial Sequence
  Description of Artificial Sequence: Synthetic peptide
RASQSVYSSYLA

SEQ ID NO: 2027 - DNA, 51 bp, Artificial Sequence
  Description of Artificial Sequence: Synthetic oligonucleotide
aagtccagtcagaatattttatccagctccaacaataagaactacttaact

SEQ ID NO: 2028 - protein, 17 aa, Artificial Sequence
  Description of Artificial Sequence: Synthetic peptide
KSSQNILSSSNNKNYLT

SEQ ID NO: 2029 - DNA, 36 bp, Artificial Sequence; identical to SEQ ID NO: 1697
  Description of Artificial Sequence: Synthetic oligonucleotide

SEQ ID NO: 2030 - protein, 12 aa, Artificial Sequence
  Description of Artificial Sequence: Synthetic peptide
RASQSVYSSYLA

SEQ ID NO: 2031 - DNA, 51 bp, Artificial Sequence; identical to SEQ ID NO: 1839
  Description of Artificial Sequence: Synthetic oligonucleotide

SEQ ID NO: 2032 - protein, 17 aa, Artificial Sequence
  Description of Artificial Sequence: Synthetic peptide
KSSQSVLHRSNNYNYLA

SEQ ID NO: 2033 - DNA, 36 bp, Artificial Sequence; identical to SEQ ID NO: 1697
  Description of Artificial Sequence: Synthetic oligonucleotide

SEQ ID NO: 2034 - protein, 12 aa, Artificial Sequence
  Description of Artificial Sequence: Synthetic peptide
RASQSVYSSYLA

SEQ ID NO: 2035 - DNA, 36 bp, Artificial Sequence; identical to SEQ ID NO: 1697
  Description of Artificial Sequence: Synthetic oligonucleotide

SEQ ID NO: 2036 - protein, 12 aa, Artificial Sequence
  Description of Artificial Sequence: Synthetic peptide
RASQSVYSSYLA

SEQ ID NO: 2037 - DNA, 36 bp, Artificial Sequence
  Description of Artificial Sequence: Synthetic oligonucleotide
agggccagtcagagtgttgacagcagctacctagcc

SEQ ID NO: 2038 - protein, 12 aa, Artificial Sequence
  Description of Artificial Sequence: Synthetic peptide
RASQSVDSSYLA

SEQ ID NO: 2039 - DNA, 36 bp, Artificial Sequence; identical to SEQ ID NO: 1717
  Description of Artificial Sequence: Synthetic oligonucleotide

SEQ ID NO: 2040 - protein, 12 aa, Artificial Sequence
  Description of Artificial Sequence: Synthetic peptide
RASQSVSSRYLA

SEQ ID NO: 2041 - DNA, 33 bp, Artificial Sequence; identical to SEQ ID NO: 589
  Description of Artificial Sequence: Synthetic oligonucleotide

SEQ ID NO: 2042 - protein, 11 aa, Artificial Sequence
  Description of Artificial Sequence: Synthetic peptide
RASQAIRDDLG

SEQ ID NO: 2043 - DNA, 51 bp, Artificial Sequence; identical to SEQ ID NO: 1719
  Description of Artificial Sequence: Synthetic oligonucleotide

SEQ ID NO: 2044 - protein, 17 aa, Artificial Sequence
  Description of Artificial Sequence: Synthetic peptide
KSSQTVLHSSNNYNYLA

SEQ ID NO: 2045 - DNA, 51 bp, Artificial Sequence
  Description of Artificial Sequence: Synthetic oligonucleotide
aagtccagccagagtgttttacacaactccaacaattacaactacttaact

SEQ ID NO: 2046 - protein, 17 aa, Artificial Sequence
  Description of Artificial Sequence: Synthetic peptide
KSSQSVLHNSNNYNYLT

SEQ ID NO: 2047 - DNA, 51 bp, Artificial Sequence; identical to SEQ ID NO: 1693
  Description of Artificial Sequence: Synthetic oligonucleotide

SEQ ID NO: 2048 - protein, 17 aa, Artificial Sequence
  Description of Artificial Sequence: Synthetic peptide
KSSQSVLFSSNNYNYLA

SEQ ID NO: 2049 - DNA, 51 bp, Artificial Sequence; identical to SEQ ID NO: 1839
  Description of Artificial Sequence: Synthetic oligonucleotide

SEQ ID NO: 2050 - protein, 17 aa, Artificial Sequence
  Description of Artificial Sequence: Synthetic peptide
KSSQSVLHRSNNYNYLA

SEQ ID NO: 2051 - DNA, 36 bp, Artificial Sequence; identical to SEQ ID NO: 1755
  Description of Artificial Sequence: Synthetic oligonucleotide

SEQ ID NO: 2052 - protein, 12 aa, Artificial Sequence
  Description of Artificial Sequence: Synthetic peptide
RASQSVYSSYLA

SEQ ID NO: 2053 - DNA, 36 bp, Artificial Sequence; identical to SEQ ID NO: 1697
  Description of Artificial Sequence: Synthetic oligonucleotide

SEQ ID NO: 2054 - protein, 12 aa, Artificial Sequence
  Description of Artificial Sequence: Synthetic peptide
RASQSVYSSYLA

SEQ ID NO: 2055 - DNA, 33 bp, Artificial Sequence
  Description of Artificial Sequence: Synthetic oligonucleotide
agggccagtatgagtgttgtcaacagcttagcc

SEQ ID NO: 2056 - protein, 11 aa, Artificial Sequence
  Description of Artificial Sequence: Synthetic peptide
RASMSVVNSLA

SEQ ID NO: 2057 - DNA, 51 bp, Artificial Sequence
  Description of Artificial Sequence: Synthetic oligonucleotide
aagtccagccagagtgttttattcagatccaacaattataattacttagct

SEQ ID NO: 2058 - protein, 17 aa, Artificial Sequence
  Description of Artificial Sequence: Synthetic peptide
KSSQSVLFRSNNYNYLA

SEQ ID NO: 2059 - DNA, 36 bp, Artificial Sequence; identical to SEQ ID NO: 1697
  Description of Artificial Sequence: Synthetic oligonucleotide

SEQ ID NO: 2060 - protein, 12 aa, Artificial Sequence
  Description of Artificial Sequence: Synthetic peptide
RASQSVYSSYLA

SEQ ID NO: 2061 - DNA, 36 bp, Artificial Sequence; identical to SEQ ID NO: 1755
  Description of Artificial Sequence: Synthetic oligonucleotide

SEQ ID NO: 2062 - protein, 12 aa, Artificial Sequence
  Description of Artificial Sequence: Synthetic peptide
RASQSVYSSYLA

SEQ ID NO: 2063 - DNA, 36 bp, Artificial Sequence; identical to SEQ ID NO: 1697
  Description of Artificial Sequence: Synthetic oligonucleotide

SEQ ID NO: 2064 - protein, 12 aa, Artificial Sequence
  Description of Artificial Sequence: Synthetic peptide
RASQSVYSSYLA

SEQ ID NO: 2065 - DNA, 51 bp, Artificial Sequence; identical to SEQ ID NO: 1685
  Description of Artificial Sequence: Synthetic oligonucleotide

SEQ ID NO: 2066 - protein, 17 aa, Artificial Sequence
  Description of Artificial Sequence: Synthetic peptide
KSSQSVLYSSNNANYLA

SEQ ID NO: 2067 - DNA, 36 bp, Artificial Sequence
  Description of Artificial Sequence: Synthetic oligonucleotide
agggccagtcagagcgttagcagcagctacttagct

SEQ ID NO: 2068 - protein, 12 aa, Artificial Sequence
  Description of Artificial Sequence: Synthetic peptide
RASQSVSSSYLA

SEQ ID NO: 2069 - DNA, 51 bp, Artificial Sequence; identical to SEQ ID NO: 1777
  Description of Artificial Sequence: Synthetic oligonucleotide

SEQ ID NO: 2070 - protein, 17 aa, Artificial Sequence
  Description of Artificial Sequence: Synthetic peptide
KSSQSVLHSSNKKNYLA

SEQ ID NO: 2071 - DNA, 33 bp, Artificial Sequence; identical to SEQ ID NO: 109
  Description of Artificial Sequence: Synthetic oligonucleotide

SEQ ID NO: 2072 - protein, 11 aa, Artificial Sequence
  Description of Artificial Sequence: Synthetic peptide
RASQGIRNDLG

SEQ ID NO: 2073 - DNA, 33 bp, Artificial Sequence; identical to SEQ ID NO: 205
  Description of Artificial Sequence: Synthetic oligonucleotide

SEQ ID NO: 2074 - protein, 11 aa, Artificial Sequence
  Description of Artificial Sequence: Synthetic peptide
RASQDIRNDLG

SEQ ID NO: 2075 - DNA, 51 bp, Artificial Sequence
  Description of Artificial Sequence: Synthetic oligonucleotide
aagtccagccagagtgttttgcacagctccaacaattataattacttagct

SEQ ID NO: 2076 - protein, 17 aa, Artificial Sequence
  Description of Artificial Sequence: Synthetic peptide
KSSQSVLHSSNNYNYLA

SEQ ID NO: 2077 - DNA, 51 bp, Artificial Sequence; identical to SEQ ID NO: 159
  Description of Artificial Sequence: Synthetic oligonucleotide

SEQ ID NO: 2078 - protein, 17 aa, Artificial Sequence
  Description of Artificial Sequence: Synthetic peptide
KSSQSVLYSSNSHNYLA

SEQ ID NO: 2079 - DNA, 33 bp, Artificial Sequence; identical to SEQ ID NO: 105
  Description of Artificial Sequence: Synthetic oligonucleotide

SEQ ID NO: 2080 - protein, 11 aa, Artificial Sequence
  Description of Artificial Sequence: Synthetic peptide
RASQGISNYLA

SEQ ID NO: 2081 - DNA, 51 bp, Artificial Sequence; identical to SEQ ID NO: 2027
  Description of Artificial Sequence: Synthetic oligonucleotide

SEQ ID NO: 2082 - protein, 17 aa, Artificial Sequence
  Description of Artificial Sequence: Synthetic peptide
KSSQNILSSSNNKNYLT

SEQ ID NO: 2083 - DNA, 36 bp, Artificial Sequence; identical to SEQ ID NO: 1697
  Description of Artificial Sequence: Synthetic oligonucleotide

SEQ ID NO: 2084 - protein, 12 aa, Artificial Sequence
  Description of Artificial Sequence: Synthetic peptide
RASQSVYSSYLA

SEQ ID NO: 2085 - DNA, 51 bp, Artificial Sequence; identical to SEQ ID NO: 1767
  Description of Artificial Sequence: Synthetic oligonucleotide

SEQ ID NO: 2086 - protein, 17 aa, Artificial Sequence
  Description of Artificial Sequence: Synthetic peptide
KSSQSVLYTSNNNNYLA

SEQ ID NO: 2087 - DNA, 36 bp, Artificial Sequence; identical to SEQ ID NO: 1697
  Description of Artificial Sequence: Synthetic oligonucleotide

SEQ ID NO: 2088 - protein, 12 aa, Artificial Sequence
  Description of Artificial Sequence: Synthetic peptide
RASQSVYSSYLA

SEQ ID NO: 2089 - DNA, 33 bp, Artificial Sequence
  Description of Artificial Sequence: Synthetic oligonucleotide
cgggcgagtcagggtattaacaactggttagtc

SEQ ID NO: 2090 - protein, 11 aa, Artificial Sequence
  Description of Artificial Sequence: Synthetic peptide
RASQGINNWLV

SEQ ID NO: 2091 - DNA, 33 bp, Artificial Sequence; identical to SEQ ID NO: 109
  Description of Artificial Sequence: Synthetic oligonucleotide

SEQ ID NO: 2092 - protein, 11 aa, Artificial Sequence
  Description of Artificial Sequence: Synthetic peptide
RASQGIRNDLG

SEQ ID NO: 2093 - DNA, 33 bp, Artificial Sequence; identical to SEQ ID NO: 431
  Description of Artificial Sequence: Synthetic oligonucleotide

SEQ ID NO: 2094 - protein, 11 aa, Artificial Sequence
  Description of Artificial Sequence: Synthetic peptide
RASQSISDYLN

SEQ ID NO: 2095 - DNA, 48 bp, Artificial Sequence; identical to SEQ ID NO: 575
  Description of Artificial Sequence: Synthetic oligonucleotide

SEQ ID NO: 2096 - protein, 16 aa, Artificial Sequence
  Description of Artificial Sequence: Synthetic peptide
KSSQSLLHGDGKTYLY

SEQ ID NO: 2097 - DNA, 51 bp, Artificial Sequence; identical to SEQ ID NO: 1541
  Description of Artificial Sequence: Synthetic oligonucleotide

SEQ ID NO: 2098 - protein, 17 aa, Artificial Sequence
  Description of Artificial Sequence: Synthetic peptide
KSSQSVLYSSNNNNYLA

SEQ ID NO: 2099 - DNA, 36 bp, Artificial Sequence
  Description of Artificial Sequence: Synthetic oligonucleotide
agggccagtcagaatattatcagcagctatttagcc

SEQ ID NO: 2100 - protein, 12 aa, Artificial Sequence
  Description of Artificial Sequence: Synthetic peptide
RASQNIISSYLA

SEQ ID NO: 2101 - DNA, 33 bp, Artificial Sequence; identical to SEQ ID NO: 553
  Description of Artificial Sequence: Synthetic oligonucleotide

SEQ ID NO: 2102 - protein, 11 aa, Artificial Sequence
  Description of Artificial Sequence: Synthetic peptide
RASQGISNWLA

SEQ ID NO: 2103 - DNA, 51 bp, Artificial Sequence
  Description of Artificial Sequence: Synthetic oligonucleotide
aagtccagccagagtgttttacacagctccaacaattataattacttagct

SEQ ID NO: 2104 - protein, 17 aa, Artificial Sequence
  Description of Artificial Sequence: Synthetic peptide
KSSQSVLHSSNNYNYLA

SEQ ID NO: 2105 - DNA, 33 bp, Artificial Sequence; identical to SEQ ID NO: 431
  Description of Artificial Sequence: Synthetic oligonucleotide

SEQ ID NO: 2106 - protein, 11 aa, Artificial Sequence
  Description of Artificial Sequence: Synthetic peptide
RASQSISDYLN

SEQ ID NO: 2107 - DNA, 51 bp, Artificial Sequence
  Description of Artificial Sequence: Synthetic oligonucleotide
aagtccagccagaatattttacacagctccaacaataacaactacttagct

SEQ ID NO: 2108 - protein, 17 aa, Artificial Sequence
  Description of Artificial Sequence: Synthetic peptide
KSSQNILHSSNNNNYLA

SEQ ID NO: 2109 - DNA, 33 bp, Artificial Sequence; identical to SEQ ID NO: 109
  Description of Artificial Sequence: Synthetic oligonucleotide

SEQ ID NO: 2110 - protein, 11 aa, Artificial Sequence
  Description of Artificial Sequence: Synthetic peptide
RASQGIRNDLG

SEQ ID NO: 2111 - DNA, 33 bp, Artificial Sequence
  Description of Artificial Sequence: Synthetic oligonucleotide
cgggcaagtcaggacattagaaataattttggc

SEQ ID NO: 2112 - protein, 11 aa, Artificial Sequence
  Description of Artificial Sequence: Synthetic peptide
RASQDIRNNFG

SEQ ID NO: 2113 - DNA, 48 bp, Artificial Sequence; identical to SEQ ID NO: 103
  Description of Artificial Sequence: Synthetic oligonucleotide

SEQ ID NO: 2114 - protein, 16 aa, Artificial Sequence
  Description of Artificial Sequence: Synthetic peptide
KSSQSLLHSEGKTYLY

SEQ ID NO: 2115 - DNA, 36 bp, Artificial Sequence
  Description of Artificial Sequence: Synthetic oligonucleotide
agggccagtcagagtgttggcagcagctacttagcc

SEQ ID NO: 2116 - protein, 12 aa, Artificial Sequence
  Description of Artificial Sequence: Synthetic peptide
RASQSVGSSYLA

SEQ ID NO: 2117 - DNA, 36 bp, Artificial Sequence
  Description of Artificial Sequence: Synthetic oligonucleotide
agggccagtcagagtgttatcagtagctacttagcc

SEQ ID NO: 2118 - protein, 12 aa, Artificial Sequence
  Description of Artificial Sequence: Synthetic peptide
RASQSVISSYLA

SEQ ID NO: 2119 - DNA, 51 bp, Artificial Sequence; identical to SEQ ID NO: 1689
  Description of Artificial Sequence: Synthetic oligonucleotide

SEQ ID NO: 2120 - protein, 17 aa, Artificial Sequence
  Description of Artificial Sequence: Synthetic peptide
KSSQSVLHSSNNYNYLA

SEQ ID NO: 2121 - DNA, 51 bp, Artificial Sequence; identical to SEQ ID NO: 1541
  Description of Artificial Sequence: Synthetic oligonucleotide

SEQ ID NO: 2122 - protein, 17 aa, Artificial Sequence
  Description of Artificial Sequence: Synthetic peptide
KSSQSVLYSSNNNNYLA

SEQ ID NO: 2123 - DNA, 33 bp, Artificial Sequence; identical to SEQ ID NO: 147
  Description of Artificial Sequence: Synthetic oligonucleotide

SEQ ID NO: 2124 - protein, 11 aa, Artificial Sequence
  Description of Artificial Sequence: Synthetic peptide
RASRGIRDDLG

SEQ ID NO: 2125 - DNA, 51 bp, Artificial Sequence
  Description of Artificial Sequence: Synthetic oligonucleotide
aagtccagccagagtgttttatacagctccaacagtaacaactacttagct

SEQ ID NO: 2126 - protein, 17 aa, Artificial Sequence
  Description of Artificial Sequence: Synthetic peptide
KSSQSVLYSSNSNNYLA

SEQ ID NO: 2127 - DNA, 48 bp, Artificial Sequence
  Description of Artificial Sequence: Synthetic oligonucleotide
aagactagtcagagcctcctgcatagtgaaggaaagacctatttgtat

SEQ ID NO: 2128 - protein, 16 aa, Artificial Sequence
  Description of Artificial Sequence: Synthetic peptide
KTSQSLLHSEGKTYLY

SEQ ID NO: 2129 - DNA, 36 bp, Artificial Sequence
  Description of Artificial Sequence: Synthetic oligonucleotide
agggccagtcagagaattttcagcaactacttagcc

SEQ ID NO: 2130 - protein, 12 aa, Artificial Sequence
  Description of Artificial Sequence: Synthetic peptide
RASQRIFSNYLA

SEQ ID NO: 2131 - DNA, 33 bp, Artificial Sequence; identical to SEQ ID NO: 1591
  Description of Artificial Sequence: Synthetic oligonucleotide

SEQ ID NO: 2132 - protein, 11 aa, Artificial Sequence
  Description of Artificial Sequence: Synthetic peptide
RASQDINNYLA

SEQ ID NO: 2133 - DNA, 33 bp, Artificial Sequence
  Description of Artificial Sequence: Synthetic oligonucleotide
cgggcgagtcagaatattagcaactggttaacc

SEQ ID NO: 2134 - protein, 11 aa, Artificial Sequence
  Description of Artificial Sequence: Synthetic peptide
RASQNISNWLT

SEQ ID NO: 2135 - DNA, 33 bp, Artificial Sequence; identical to SEQ ID NO: 553
  Description of Artificial Sequence: Synthetic oligonucleotide

SEQ ID NO: 2136 - protein, 11 aa, Artificial Sequence
  Description of Artificial Sequence: Synthetic peptide
RASQGISNWLA

SEQ ID NO: 2137 - DNA, 48 bp, Artificial Sequence
  Description of Artificial Sequence: Synthetic oligonucleotide
aagtctagtcagagcctcctgcatggtgatggaaagacctatttttat

SEQ ID NO: 2138 - protein, 16 aa, Artificial Sequence
  Description of Artificial Sequence: Synthetic peptide
KSSQSLLHGDGKTYFY

SEQ ID NO: 2139 - DNA, 33 bp, Artificial Sequence; identical to SEQ ID NO: 553
  Description of Artificial Sequence: Synthetic oligonucleotide

SEQ ID NO: 2140 - protein, 11 aa, Artificial Sequence
  Description of Artificial Sequence: Synthetic peptide
RASQGISNWLA

SEQ ID NO: 2141 - DNA, 51 bp, Artificial Sequence
  Description of Artificial Sequence: Synthetic oligonucleotide
aagtccagccaacgtgttttacacagctccaacaattataactacttagct

SEQ ID NO: 2142 - protein, 17 aa, Artificial Sequence
  Description of Artificial Sequence: Synthetic peptide
KSSQRVLHSSNNYNYLA

SEQ ID NO: 2143 - DNA, 33 bp, Artificial Sequence; identical to SEQ ID NO: 269
  Description of Artificial Sequence: Synthetic oligonucleotide

SEQ ID NO: 2144 - protein, 11 aa, Artificial Sequence
  Description of Artificial Sequence: Synthetic peptide
RASQSIINYLN

SEQ ID NO: 2145 - DNA, 48 bp, Artificial Sequence; identical to SEQ ID NO: 103
  Description of Artificial Sequence: Synthetic oligonucleotide

SEQ ID NO: 2146 - protein, 16 aa, Artificial Sequence
  Description of Artificial Sequence: Synthetic peptide
KSSQSLLHSEGKTYLY

SEQ ID NO: 2147 - DNA, 33 bp, Artificial Sequence
  Description of Artificial Sequence: Synthetic oligonucleotide
cgggcgagtcagggcattagcaaatatttagcc

SEQ ID NO: 2148 - protein, 11 aa, Artificial Sequence
  Description of Artificial Sequence: Synthetic peptide
RASQGISKYLA

SEQ ID NO: 2149 - DNA, 51 bp, Artificial Sequence
  Description of Artificial Sequence: Synthetic oligonucleotide
aagtccagccagagtgctttacacagctccaacaattacaactacttagct

SEQ ID NO: 2150 - protein, 17 aa, Artificial Sequence
  Description of Artificial Sequence: Synthetic peptide
KSSQSALHSSNNYNYLA

SEQ ID NO: 2151 - DNA, 33 bp, Artificial Sequence
  Description of Artificial Sequence: Synthetic oligonucleotide
cgggcaagtcagagcattagtaactatttaaat

SEQ ID NO: 2152 - protein, 11 aa, Artificial Sequence
  Description of Artificial Sequence: Synthetic peptide
RASQSISNYLN

SEQ ID NO: 2153 - DNA, 48 bp, Artificial Sequence; identical to SEQ ID NO: 575
  Description of Artificial Sequence: Synthetic oligonucleotide

SEQ ID NO: 2154 - protein, 16 aa, Artificial Sequence
  Description of Artificial Sequence: Synthetic peptide
KSSQSLLHGDGKTYLY

SEQ ID NO: 2155 - DNA, 48 bp, Artificial Sequence; identical to SEQ ID NO: 555
  Description of Artificial Sequence: Synthetic oligonucleotide

SEQ ID NO: 2156 - protein, 16 aa, Artificial Sequence
  Description of Artificial Sequence: Synthetic peptide
KSSQSLLHSEGKTYLY

SEQ ID NO: 2157 - DNA, 33 bp, Artificial Sequence; identical to SEQ ID NO: 109
  Description of Artificial Sequence: Synthetic oligonucleotide

SEQ ID NO: 2158 - protein, 11 aa, Artificial Sequence
  Description of Artificial Sequence: Synthetic peptide
RASQGIRNDLG

SEQ ID NO: 2159 - DNA, 33 bp, Artificial Sequence
  Description of Artificial Sequence: Synthetic oligonucleotide
cgggcaagtcagggcattagaaatgccttaggc

SEQ ID NO: 2160 - protein, 11 aa, Artificial Sequence
  Description of Artificial Sequence: Synthetic peptide
RASQGIRNALG

SEQ ID NO: 2161 - DNA, 48 bp, Artificial Sequence; identical to SEQ ID NO: 2137
  Description of Artificial Sequence: Synthetic oligonucleotide

SEQ ID NO: 2162 - protein, 16 aa, Artificial Sequence
  Description of Artificial Sequence: Synthetic peptide
KSSQSLLHGDGKTYFY

SEQ ID NO: 2163 - DNA, 33 bp, Artificial Sequence; identical to SEQ ID NO: 109
  Description of Artificial Sequence: Synthetic oligonucleotide

SEQ ID NO: 2164 - protein, 11 aa, Artificial Sequence
  Description of Artificial Sequence: Synthetic peptide
RASQGIRNDLG

SEQ ID NO: 2165 - DNA, 51 bp, Artificial Sequence
  Description of Artificial Sequence: Synthetic oligonucleotide
aagtccagccagagtgttttatacagtcccaacaataacaactacttagct

SEQ ID NO: 2166 - protein, 17 aa, Artificial Sequence
  Description of Artificial Sequence: Synthetic peptide
KSSQSVLYSPNNNNYLA

SEQ ID NO: 2167 - DNA, 33 bp, Artificial Sequence; identical to SEQ ID NO: 877
  Description of Artificial Sequence: Synthetic oligonucleotide

SEQ ID NO: 2168 - protein, 11 aa, Artificial Sequence
  Description of Artificial Sequence: Synthetic peptide
RASQSISSYLN

SEQ ID NO: 2169 - DNA, 51 bp, Artificial Sequence
  Description of Artificial Sequence: Synthetic oligonucleotide
aagtccagccagactgttttacacaactccaataatcacaattactttgct

SEQ ID NO: 2170 - protein, 17 aa, Artificial Sequence
  Description of Artificial Sequence: Synthetic peptide
KSSQTVLHNSNNHNYFA

SEQ ID NO: 2171 - DNA, 51 bp, Artificial Sequence
  Description of Artificial Sequence: Synthetic oligonucleotide
aagtccagccagagtgttttatccagctccaacgataacaactacttagct

SEQ ID NO: 2172 - protein, 17 aa, Artificial Sequence
  Description of Artificial Sequence: Synthetic peptide
KSSQSVLSSSNDNNYLA

SEQ ID NO: 2173 - DNA, 33 bp, Artificial Sequence; identical to SEQ ID NO: 2159
  Description of Artificial Sequence: Synthetic oligonucleotide

SEQ ID NO: 2174 - protein, 11 aa, Artificial Sequence
  Description of Artificial Sequence: Synthetic peptide
RASQGIRNALG

SEQ ID NO: 2175 - DNA, 33 bp, Artificial Sequence
  Description of Artificial Sequence: Synthetic oligonucleotide
cgggcgagtcagggtattatcagttggttagcc

SEQ ID NO: 2176 - protein, 11 aa, Artificial Sequence
  Description of Artificial Sequence: Synthetic peptide
RASQGIISWLA

SEQ ID NO: 2177 - DNA, 33 bp, Artificial Sequence; identical to SEQ ID NO: 553
  Description of Artificial Sequence: Synthetic oligonucleotide

SEQ ID NO: 2178 - protein, 11 aa, Artificial Sequence
  Description of Artificial Sequence: Synthetic peptide
RASQGISNWLA

SEQ ID NO: 2179 - DNA, 36 bp, Artificial Sequence
  Description of Artificial Sequence: Synthetic oligonucleotide
agggccagtcagagtattatcagcaactacttagcc

SEQ ID NO: 2180 - protein, 12 aa, Artificial Sequence
  Description of Artificial Sequence: Synthetic peptide
RASQSIISNYLA

SEQ ID NO: 2181 - DNA, 33 bp, Artificial Sequence; identical to SEQ ID NO: 553
  Description of Artificial Sequence: Synthetic oligonucleotide

SEQ ID NO: 2182 - protein, 11 aa, Artificial Sequence
  Description of Artificial Sequence: Synthetic peptide
RASQGISNWLA

SEQ ID NO: 2183 - DNA, 33 bp, Artificial Sequence; identical to SEQ ID NO: 535
  Description of Artificial Sequence: Synthetic oligonucleotide

SEQ ID NO: 2184 - protein, 11 aa, Artificial Sequence
  Description of Artificial Sequence: Synthetic peptide
RASRGIRNDLG

SEQ ID NO: 2185 - DNA, 33 bp, Artificial Sequence; identical to SEQ ID NO: 2133
  Description of Artificial Sequence: Synthetic oligonucleotide

SEQ ID NO: 2186 - protein, 11 aa, Artificial Sequence
  Description of Artificial Sequence: Synthetic peptide
RASQNISNWLT

SEQ ID NO: 2187 - DNA, 33 bp, Artificial Sequence; identical to SEQ ID NO: 109
  Description of Artificial Sequence: Synthetic oligonucleotide

SEQ ID NO: 2188 - protein, 11 aa, Artificial Sequence
  Description of Artificial Sequence: Synthetic peptide
RASQGIRNDLG

SEQ ID NO: 2189 - DNA, 51 bp, Artificial Sequence
  Description of Artificial Sequence: Synthetic oligonucleotide
aagtccagccagagtgttttatacagatccaacagtaagaaatacttaact

SEQ ID NO: 2190 - protein, 17 aa, Artificial Sequence
  Description of Artificial Sequence: Synthetic peptide
KSSQSVLYRSNSKKYLT

SEQ ID NO: 2191 - DNA, 33 bp, Artificial Sequence; identical to SEQ ID NO: 429
  Description of Artificial Sequence: Synthetic oligonucleotide

SEQ ID NO: 2192 - protein, 11 aa, Artificial Sequence
  Description of Artificial Sequence: Synthetic peptide
RASQGIGNDLG

SEQ ID NO: 2193 - DNA, 33 bp, Artificial Sequence
  Description of Artificial Sequence: Synthetic oligonucleotide
cgggcgagtcagggtattaacaactggttagcc

SEQ ID NO: 2194 - protein, 11 aa, Artificial Sequence
  Description of Artificial Sequence: Synthetic peptide
RASQGINNWLA

SEQ ID NO: 2195 - DNA, 51 bp, Artificial Sequence
  Description of Artificial Sequence: Synthetic oligonucleotide
aagtccagccagaatgttttatacagctcccacaataacaactacttagct

SEQ ID NO: 2196 - protein, 17 aa, Artificial Sequence
  Description of Artificial Sequence: Synthetic peptide
KSSQNVLYSSHNNNYLA

SEQ ID NO: 2197 - DNA, 33 bp, Artificial Sequence; identical to SEQ ID NO: 109
  Description of Artificial Sequence: Synthetic oligonucleotide

SEQ ID NO: 2198 - protein, 11 aa, Artificial Sequence
  Description of Artificial Sequence: Synthetic peptide
RASQGIRNDLG

SEQ ID NO: 2199 - DNA, 33 bp, Artificial Sequence
  Description of Artificial Sequence: Synthetic oligonucleotide
cgggcgagtcagggcattagccattatttagcc

SEQ ID NO: 2200 - protein, 11 aa, Artificial Sequence
  Description of Artificial Sequence: Synthetic peptide
RASQGISHYLA

SEQ ID NO: 2201 - DNA, 48 bp, Artificial Sequence
  Description of Artificial Sequence: Synthetic oligonucleotide
aagtctagtcagagcctcgtgcatggtgatggaaagacctatttgtat

SEQ ID NO: 2202 - protein, 16 aa, Artificial Sequence
  Description of Artificial Sequence: Synthetic peptide
KSSQSLVHGDGKTYLY

SEQ ID NO: 2203 - DNA, 33 bp, Artificial Sequence; identical to SEQ ID NO: 501
  Description of Artificial Sequence: Synthetic oligonucleotide

SEQ ID NO: 2204 - protein, 11 aa, Artificial Sequence
  Description of Artificial Sequence: Synthetic peptide
RASQSISSYLN

SEQ ID NO: 2205 - DNA, 48 bp, Artificial Sequence; identical to SEQ ID NO: 555
  Description of Artificial Sequence: Synthetic oligonucleotide

SEQ ID NO: 2206 - protein, 16 aa, Artificial Sequence
  Description of Artificial Sequence: Synthetic peptide
KSSQSLLHSEGKTYLY

SEQ ID NO: 2207 - DNA, 33 bp, Artificial Sequence; identical to SEQ ID NO: 431
  Description of Artificial Sequence: Synthetic oligonucleotide

SEQ ID NO: 2208 - protein, 11 aa, Artificial Sequence
  Description of Artificial Sequence: Synthetic peptide
RASQSISDYLN

SEQ ID NO: 2209 - DNA, 33 bp, Artificial Sequence
  Description of Artificial Sequence: Synthetic oligonucleotide
agggccagtcagagtattaacatcaatatagcc

SEQ ID NO: 2210 - protein, 11 aa, Artificial Sequence
  Description of Artificial Sequence: Synthetic peptide
RASQSININIA

SEQ ID NO: 2211 - DNA, 48 bp, Artificial Sequence; identical to SEQ ID NO: 107
  Description of Artificial Sequence: Synthetic oligonucleotide

SEQ ID NO: 2212 - protein, 16 aa, Artificial Sequence
  Description of Artificial Sequence: Synthetic peptide
KSSQRLLHGDGKTYLY

SEQ ID NO: 2213 - DNA, 33 bp, Artificial Sequence
  Description of Artificial Sequence: Synthetic oligonucleotide
cgggcaagtcagagcattagcaactttttaaat

SEQ ID NO: 2214 - protein, 11 aa, Artificial Sequence
  Description of Artificial Sequence: Synthetic peptide
RASQSISNFLN

SEQ ID NO: 2215 - DNA, 33 bp, Artificial Sequence; identical to SEQ ID NO: 1751
  Description of Artificial Sequence: Synthetic oligonucleotide

SEQ ID NO: 2216 - protein, 11 aa, Artificial Sequence
  Description of Artificial Sequence: Synthetic peptide
RASQGISKYLA

SEQ ID NO: 2217 - DNA, 48 bp, Artificial Sequence; identical to SEQ ID NO: 575
  Description of Artificial Sequence: Synthetic oligonucleotide

SEQ ID NO: 2218 - protein, 16 aa, Artificial Sequence
  Description of Artificial Sequence: Synthetic peptide
KSSQSLLHGDGKTYLY

SEQ ID NO: 2219 - DNA, 33 bp, Artificial Sequence; identical to SEQ ID NO: 431
  Description of Artificial Sequence: Synthetic oligonucleotide

SEQ ID NO: 2220 - protein, 11 aa, Artificial Sequence
  Description of Artificial Sequence: Synthetic peptide
RASQSISDYLN

SEQ ID NO: 2221 - DNA, 51 bp, Artificial Sequence
  Description of Artificial Sequence: Synthetic oligonucleotide
aagtccagccagagtgttttacacagctccaacaattacaactacttagtt

SEQ ID NO: 2222 - protein, 17 aa, Artificial Sequence
  Description of Artificial Sequence: Synthetic peptide
KSSQSVLHSSNNYNYLV

SEQ ID NO: 2223 - DNA, 51 bp, Artificial Sequence
  Description of Artificial Sequence: Synthetic oligonucleotide
aagtccagccagagtgttttgcacagctccaacaattacaactacttaact

SEQ ID NO: 2224 - protein, 17 aa, Artificial Sequence
  Description of Artificial Sequence: Synthetic peptide
KSSQSVLHSSNNYNYLT

SEQ ID NO: 2225 - DNA, 51 bp, Artificial Sequence; identical to SEQ ID NO: 1079
  Description of Artificial Sequence: Synthetic oligonucleotide

SEQ ID NO: 2226 - protein, 17 aa, Artificial Sequence
  Description of Artificial Sequence: Synthetic peptide
KSSQSVLYSSNNYNYLA

SEQ ID NO: 2227 - DNA, 33 bp, Artificial Sequence; identical to SEQ ID NO: 431
  Description of Artificial Sequence: Synthetic oligonucleotide

SEQ ID NO: 2228 - protein, 11 aa, Artificial Sequence
  Description of Artificial Sequence: Synthetic peptide
RASQSISDYLN

SEQ ID NO: 2229 - DNA, 48 bp, Artificial Sequence
  Description of Artificial Sequence: Synthetic oligonucleotide
aagtctagtcagagcctccggcatggtgatggaaagacctatttgact

SEQ ID NO: 2230 - protein, 16 aa, Artificial Sequence
  Description of Artificial Sequence: Synthetic peptide
KSSQSLRHGDGKTYLT

SEQ ID NO: 2231 - DNA, 36 bp, Artificial Sequence
  Description of Artificial Sequence: Synthetic oligonucleotide
agggccagtcagagtgttatcagcagctacttagcc

SEQ ID NO: 2232 - protein, 12 aa, Artificial Sequence
  Description of Artificial Sequence: Synthetic peptide
RASQSVISSYLA

SEQ ID NO: 2233 - DNA, 33 bp, Artificial Sequence; identical to SEQ ID NO: 109
  Description of Artificial Sequence: Synthetic oligonucleotide

SEQ ID NO: 2234 - protein, 11 aa, Artificial Sequence
  Description of Artificial Sequence: Synthetic peptide
RASQGIRNDLG

SEQ ID NO: 2235 - DNA, 33 bp, Artificial Sequence; identical to SEQ ID NO: 1509
  Description of Artificial Sequence: Synthetic oligonucleotide

SEQ ID NO: 2236 - protein, 11 aa, Artificial Sequence
  Description of Artificial Sequence: Synthetic peptide
RASQDISNWLA

SEQ ID NO: 2237 - DNA, 33 bp, Artificial Sequence; identical to SEQ ID NO: 109
  Description of Artificial Sequence: Synthetic oligonucleotide

SEQ ID NO: 2238 - protein, 11 aa, Artificial Sequence
  Description of Artificial Sequence: Synthetic peptide
RASQGIRNDLG

SEQ ID NO: 2239 - DNA, 51 bp, Artificial Sequence; identical to SEQ ID NO: 1071
  Description of Artificial Sequence: Synthetic oligonucleotide

SEQ ID NO: 2240 - protein, 17 aa, Artificial Sequence
  Description of Artificial Sequence: Synthetic peptide
KSSQSVLYSSNNKNYLA

SEQ ID NO: 2241 - DNA, 33 bp, Artificial Sequence; identical to SEQ ID NO: 553
  Description of Artificial Sequence: Synthetic oligonucleotide

SEQ ID NO: 2242 - protein, 11 aa, Artificial Sequence
  Description of Artificial Sequence: Synthetic peptide
RASQGISNWLA

SEQ ID NO: 2243 - DNA, 33 bp, Artificial Sequence; identical to SEQ ID NO: 431
  Description of Artificial Sequence: Synthetic oligonucleotide

SEQ ID NO: 2244 - protein, 11 aa, Artificial Sequence
  Description of Artificial Sequence: Synthetic peptide
RASQSISDYLN

SEQ ID NO: 2245 - DNA, 48 bp, Artificial Sequence
  Description of Artificial Sequence: Synthetic oligonucleotide
aagtctagtcagagcctcctgcatggtgatggaaagacctatttatat

SEQ ID NO: 2246 - protein, 16 aa, Artificial Sequence
  Description of Artificial Sequence: Synthetic peptide
KSSQSLLHGDGKTYLY

SEQ ID NO: 2247 - DNA, 51 bp, Artificial Sequence
  Description of Artificial Sequence: Synthetic oligonucleotide
acgtccagccagagtattttacacagctccaataattacaactacttagct

SEQ ID NO: 2248 - protein, 17 aa, Artificial Sequence
  Description of Artificial Sequence: Synthetic peptide
TSSQSILHSSNNYNYLA

SEQ ID NO: 2249 - DNA, 33 bp, Artificial Sequence; identical to SEQ ID NO: 1363
  Description of Artificial Sequence: Synthetic oligonucleotide

SEQ ID NO: 2250 - protein, 11 aa, Artificial Sequence
  Description of Artificial Sequence: Synthetic peptide
RASQVISNYLA

SEQ ID NO: 2251 - DNA, 48 bp, Artificial Sequence; identical to SEQ ID NO: 2229
  Description of Artificial Sequence: Synthetic oligonucleotide

SEQ ID NO: 2252 - protein, 16 aa, Artificial Sequence
  Description of Artificial Sequence: Synthetic peptide
KSSQSLRHGDGKTYLT

SEQ ID NO: 2253 - DNA, 36 bp, Artificial Sequence; identical to SEQ ID NO: 2231
  Description of Artificial Sequence: Synthetic oligonucleotide

SEQ ID NO: 2254 - protein, 12 aa, Artificial Sequence
  Description of Artificial Sequence: Synthetic peptide
RASQSVISSYLA

SEQ ID NO: 2255 - DNA, 51 bp, Artificial Sequence; identical to SEQ ID NO: 1071
  Description of Artificial Sequence: Synthetic oligonucleotide

SEQ ID NO: 2256 - protein, 17 aa, Artificial Sequence
  Description of Artificial Sequence: Synthetic peptide
KSSQSVLYSSNNKNYLA

SEQ ID NO: 2257 - DNA, 48 bp, Artificial Sequence; identical to SEQ ID NO: 487
  Description of Artificial Sequence: Synthetic oligonucleotide

SEQ ID NO: 2258 - protein, 16 aa, Artificial Sequence
  Description of Artificial Sequence: Synthetic peptide
KSSQSLLHSDGKTYLY

SEQ ID NO: 2259 - DNA, 51 bp, Artificial Sequence
  Description of Artificial Sequence: Synthetic oligonucleotide
aagtccagccagagtgttttatacagctccaacaattacaagtacttagct

SEQ ID NO: 2260 - protein, 17 aa, Artificial Sequence
  Description of Artificial Sequence: Synthetic peptide
KSSQSVLYSSNNYKYLA

SEQ ID NO: 2261 - DNA, 51 bp, Artificial Sequence
  Description of Artificial Sequence: Synthetic oligonucleotide
aagtccagccagagtgttttacacagttccaacaattacaactatttagct

SEQ ID NO: 2262 - protein, 17 aa, Artificial Sequence
  Description of Artificial Sequence: Synthetic peptide
KSSQSVLHSSNNYNYLA

SEQ ID NO: 2263 - DNA, 33 bp, Artificial Sequence; identical to SEQ ID NO: 1509
  Description of Artificial Sequence: Synthetic oligonucleotide

SEQ ID NO: 2264 - protein, 11 aa, Artificial Sequence
  Description of Artificial Sequence: Synthetic peptide
RASQDISNWLA

SEQ ID NO: 2265 - DNA, 51 bp, Artificial Sequence
  Description of Artificial Sequence: Synthetic oligonucleotide
aggtcaagccagagtgttttacacagctccaacaattataactacttagct

SEQ ID NO: 2266 - protein, 17 aa, Artificial Sequence
  Description of Artificial Sequence: Synthetic peptide
RSSQSVLHSSNNYNYLA

SEQ ID NO: 2267 - DNA, 33 bp, Artificial Sequence; identical to SEQ ID NO: 553
  Description of Artificial Sequence: Synthetic oligonucleotide

SEQ ID NO: 2268 - protein, 11 aa, Artificial Sequence
  Description of Artificial Sequence: Synthetic peptide
RASQGISNWLA

SEQ ID NO: 2269 - DNA, 33 bp, Artificial Sequence; identical to SEQ ID NO: 1509
  Description of Artificial Sequence: Synthetic oligonucleotide

SEQ ID NO: 2270 - protein, 11 aa, Artificial Sequence
  Description of Artificial Sequence: Synthetic peptide
RASQDISNWLA

SEQ ID NO: 2271 - DNA, 33 bp, Artificial Sequence; identical to SEQ ID NO: 501
  Description of Artificial Sequence: Synthetic oligonucleotide

SEQ ID NO: 2272 - protein, 11 aa, Artificial Sequence
  Description of Artificial Sequence: Synthetic peptide
RASQSISSYLN

SEQ ID NO: 2273 - DNA, 48 bp, Artificial Sequence; identical to SEQ ID NO: 575
  Description of Artificial Sequence: Synthetic oligonucleotide

SEQ ID NO: 2274 - protein, 16 aa, Artificial Sequence
  Description of Artificial Sequence: Synthetic peptide
KSSQSLLHGDGKTYLY

SEQ ID NO: 2275 - DNA, 51 bp, Artificial Sequence
  Description of Artificial Sequence: Synthetic oligonucleotide
aagtccagccagagtgttttatccagctccaacaataataattatttagct

SEQ ID NO: 2276 - protein, 17 aa, Artificial Sequence
  Description of Artificial Sequence: Synthetic peptide
KSSQSVLSSSNNNNYLA

SEQ ID NO: 2277 - DNA, 51 bp, Artificial Sequence
  Description of Artificial Sequence: Synthetic oligonucleotide
aagtccagccagagtgttttacacagctccaataattacaactacttagct

SEQ ID NO: 2278 - protein, 17 aa, Artificial Sequence
  Description of Artificial Sequence: Synthetic peptide
KSSQSVLHSSNNYNYLA

SEQ ID NO: 2279 - DNA, 33 bp, Artificial Sequence
  Description of Artificial Sequence: Synthetic oligonucleotide
agggccagtcagagtgttagtagtaacttagcc

SEQ ID NO: 2280 - protein, 11 aa, Artificial Sequence
  Description of Artificial Sequence: Synthetic peptide
RASQSVSSNLA

SEQ ID NO: 2281 - DNA, 33 bp, Artificial Sequence; identical to SEQ ID NO: 109
  Description of Artificial Sequence: Synthetic oligonucleotide

SEQ ID NO: 2282 - protein, 11 aa, Artificial Sequence
  Description of Artificial Sequence: Synthetic peptide
RASQGIRNDLG

SEQ ID NO: 2283 - DNA, 51 bp, Artificial Sequence; identical to SEQ ID NO: 1541
  Description of Artificial Sequence: Synthetic oligonucleotide

SEQ ID NO: 2284 - protein, 17 aa, Artificial Sequence
  Description of Artificial Sequence: Synthetic peptide
KSSQSVLYSSNNNNYLA

SEQ ID NO: 2285 - DNA, 33 bp, Artificial Sequence; identical to SEQ ID NO: 501
  Description of Artificial Sequence: Synthetic oligonucleotide

SEQ ID NO: 2286 - protein, 11 aa, Artificial Sequence
  Description of Artificial Sequence: Synthetic peptide
RASQSISSYLN

SEQ ID NO: 2287 - DNA, 33 bp, Artificial Sequence; identical to SEQ ID NO: 105
  Description of Artificial Sequence: Synthetic oligonucleotide

SEQ ID NO: 2288 - protein, 11 aa, Artificial Sequence
  Description of Artificial Sequence: Synthetic peptide
RASQGISNYLA

SEQ ID NO: 2289 - DNA, 33 bp, Artificial Sequence
  Description of Artificial Sequence: Synthetic oligonucleotide
cgggcgagtcaggacattagcaattatttagtc

SEQ ID NO: 2290 - protein, 11 aa, Artificial Sequence
  Description of Artificial Sequence: Synthetic peptide
RASQDISNYLV

SEQ ID NO: 2291 - DNA, 33 bp, Artificial Sequence; identical to SEQ ID NO: 109
  Description of Artificial Sequence: Synthetic oligonucleotide

SEQ ID NO: 2292 - protein, 11 aa, Artificial Sequence
  Description of Artificial Sequence: Synthetic peptide
RASQGIRNDLG

SEQ ID NO: 2293 - DNA, 33 bp, Artificial Sequence
  Description of Artificial Sequence: Synthetic oligonucleotide
cgggcaagtcagaacattagcagttatttaaat

SEQ ID NO: 2294 - protein, 11 aa, Artificial Sequence
  Description of Artificial Sequence: Synthetic peptide
RASQNISSYLN

SEQ ID NO: 2295 - DNA, 33 bp, Artificial Sequence; identical to SEQ ID NO: 105
  Description of Artificial Sequence: Synthetic oligonucleotide

SEQ ID NO: 2296 - protein, 11 aa, Artificial Sequence
  Description of Artificial Sequence: Synthetic peptide
RASQGISNYLA

SEQ ID NO: 2297 - DNA, 33 bp, Artificial Sequence; identical to SEQ ID NO: 109
  Description of Artificial Sequence: Synthetic oligonucleotide

SEQ ID NO: 2298 - protein, 11 aa, Artificial Sequence
  Description of Artificial Sequence: Synthetic peptide
RASQGIRNDLG

SEQ ID NO: 2299 - DNA, 33 bp, Artificial Sequence; identical to SEQ ID NO: 293
  Description of Artificial Sequence: Synthetic oligonucleotide

SEQ ID NO: 2300 - protein, 11 aa, Artificial Sequence
  Description of Artificial Sequence: Synthetic peptide
RASQGINNYLA

SEQ ID NO: 2301 - DNA, 33 bp, Artificial Sequence
  Description of Artificial Sequence: Synthetic oligonucleotide
cgggcaagtcagagctttagcagctatttaaat

SEQ ID NO: 2302 - protein, 11 aa, Artificial Sequence
  Description of Artificial Sequence: Synthetic peptide
RASQSFSSYLN

SEQ ID NO: 2303 - DNA, 33 bp, Artificial Sequence; identical to SEQ ID NO: 109
  Description of Artificial Sequence: Synthetic oligonucleotide

SEQ ID NO: 2304 - protein, 11 aa, Artificial Sequence
  Description of Artificial Sequence: Synthetic peptide
RASQGIRNDLG

SEQ ID NO: 2305 - DNA, 33 bp, Artificial Sequence
  Description of Artificial Sequence: Synthetic oligonucleotide
cgggcgagtcaggacattagcaattttttagcc

SEQ ID NO: 2306 - protein, 11 aa, Artificial Sequence
  Description of Artificial Sequence: Synthetic peptide
RASQDISNFLA

SEQ ID NO: 2307 - DNA, 48 bp, Artificial Sequence; identical to SEQ ID NO: 2245
  Description of Artificial Sequence: Synthetic oligonucleotide

SEQ ID NO: 2308 - protein, 16 aa, Artificial Sequence
  Description of Artificial Sequence: Synthetic peptide
KSSQSLLHGDGKTYLY

SEQ ID NO: 2309 - DNA, 33 bp, Artificial Sequence; identical to SEQ ID NO: 109
  Description of Artificial Sequence: Synthetic oligonucleotide

SEQ ID NO: 2310 - protein, 11 aa, Artificial Sequence
  Description of Artificial Sequence: Synthetic peptide
RASQGIRNDLG

SEQ ID NO: 2311 - DNA, 33 bp, Artificial Sequence
  Description of Artificial Sequence: Synthetic oligonucleotide
cgggcgagtcagggcattaccaattatttagcc

SEQ ID NO: 2312 - protein, 11 aa, Artificial Sequence
  Description of Artificial Sequence: Synthetic peptide
RASQGITNYLA

SEQ ID NO: 2313 - DNA, 33 bp, Artificial Sequence
  Description of Artificial Sequence: Synthetic oligonucleotide
cgggcaagtcagggcattagaaatgattttggc

SEQ ID NO: 2314 - protein, 11 aa, Artificial Sequence
  Description of Artificial Sequence: Synthetic peptide
RASQGIRNDFG

SEQ ID NO: 2315 - DNA, 33 bp, Artificial Sequence; identical to SEQ ID NO: 109
  Description of Artificial Sequence: Synthetic oligonucleotide

SEQ ID NO: 2316 - protein, 11 aa, Artificial Sequence
  Description of Artificial Sequence: Synthetic peptide
RASQGIRNDLG

SEQ ID NO: 2317 - DNA, 33 bp, Artificial Sequence
  Description of Artificial Sequence: Synthetic oligonucleotide
cgggcaagtcaggacattagaaaggatttaggc

SEQ ID NO: 2318 - protein, 11 aa, Artificial Sequence
  Description of Artificial Sequence: Synthetic peptide
RASQDIRKDLG

SEQ ID NO: 2319 - DNA, 33 bp, Artificial Sequence
  Description of Artificial Sequence: Synthetic oligonucleotide
cgggcaagtcagaacattagaaagtatttacat

SEQ ID NO: 2320 - protein, 11 aa, Artificial Sequence
  Description of Artificial Sequence: Synthetic peptide
RASQNIRKYLH

SEQ ID NO: 2321 - DNA, 33 bp, Artificial Sequence; identical to SEQ ID NO: 109
  Description of Artificial Sequence: Synthetic oligonucleotide

SEQ ID NO: 2322 - protein, 11 aa, Artificial Sequence
  Description of Artificial Sequence: Synthetic peptide
RASQGIRNDLG

SEQ ID NO: 2323 - DNA, 33 bp, Artificial Sequence
  Description of Artificial Sequence: Synthetic oligonucleotide
cgggcaagtcagggcatgagaattgatttaggg

SEQ ID NO: 2324 - protein, 11 aa, Artificial Sequence
  Description of Artificial Sequence: Synthetic peptide
RASQGMRIDLG

SEQ ID NO: 2325 - DNA, 33 bp, Artificial Sequence; identical to SEQ ID NO: 133
  Description of Artificial Sequence: Synthetic oligonucleotide

SEQ ID NO: 2326 - protein, 11 aa, Artificial Sequence
  Description of Artificial Sequence: Synthetic peptide
RASQGIRSDLG

SEQ ID NO: 2327 - DNA, 33 bp, Artificial Sequence; identical to SEQ ID NO: 205
  Description of Artificial Sequence: Synthetic oligonucleotide

SEQ ID NO: 2328 - protein, 11 aa, Artificial Sequence
  Description of Artificial Sequence: Synthetic peptide
RASQDIRNDLG

SEQ ID NO: 2329 - DNA, 51 bp, Artificial Sequence
  Description of Artificial Sequence: Synthetic oligonucleotide
aagtccagccagaatgttttacacagctccaacaataacaactacttaact

SEQ ID NO: 2330 - protein, 17 aa, Artificial Sequence
  Description of Artificial Sequence: Synthetic peptide
KSSQNVLHSSNNNNYLT

SEQ ID NO: 2331 - DNA, 33 bp, Artificial Sequence; identical to SEQ ID NO: 293
  Description of Artificial Sequence: Synthetic oligonucleotide

SEQ ID NO: 2332 - protein, 11 aa, Artificial Sequence
  Description of Artificial Sequence: Synthetic peptide
RASQGINNYLA

SEQ ID NO: 2333 - DNA, 33 bp, Artificial Sequence
  Description of Artificial Sequence: Synthetic oligonucleotide
cgggcaagtcagcgcgtcagaaatgatttaggc

SEQ ID NO: 2334 - protein, 11 aa, Artificial Sequence
  Description of Artificial Sequence: Synthetic peptide
RASQRVRNDLG

SEQ ID NO: 2335 - DNA, 33 bp, Artificial Sequence
  Description of Artificial Sequence: Synthetic oligonucleotide
cgggcaagtcagagcattagcaaatatttaaat

SEQ ID NO: 2336 - protein, 11 aa, Artificial Sequence
  Description of Artificial Sequence: Synthetic peptide
RASQSISKYLN

SEQ ID NO: 2337 - DNA, 33 bp, Artificial Sequence
  Description of Artificial Sequence: Synthetic oligonucleotide
caggcgagtcaggacattagcgactatttaaat

SEQ ID NO: 2338 - protein, 11 aa, Artificial Sequence
  Description of Artificial Sequence: Synthetic peptide
QASQDISDYLN

SEQ ID NO: 2339 - DNA, 33 bp, Artificial Sequence; identical to SEQ ID NO: 93
  Description of Artificial Sequence: Synthetic oligonucleotide

SEQ ID NO: 2340 - protein, 11 aa, Artificial Sequence
  Description of Artificial Sequence: Synthetic peptide
RTSQGIRNDLG

SEQ ID NO: 2341 - DNA, 33 bp, Artificial Sequence
  Description of Artificial Sequence: Synthetic oligonucleotide
cgggcaagtcaggacattagaaaggatttaggg

SEQ ID NO: 2342 - protein, 11 aa, Artificial Sequence
  Description of Artificial Sequence: Synthetic peptide
RASQDIRKDLG

SEQ ID NO: 2343 - DNA, 33 bp, Artificial Sequence
  Description of Artificial Sequence: Synthetic oligonucleotide
cgggcaagtcgggacattggaaatgatttaggc

SEQ ID NO: 2344 - protein, 11 aa, Artificial Sequence
  Description of Artificial Sequence: Synthetic peptide
RASRDIGNDLG

SEQ ID NO: 2345 - DNA, 33 bp, Artificial Sequence
  Description of Artificial Sequence: Synthetic oligonucleotide
cgggcgagtcagggcattagcaaatatttagtc

SEQ ID NO: 2346 - protein, 11 aa, Artificial Sequence
  Description of Artificial Sequence: Synthetic peptide
RASQGISKYLV

SEQ ID NO: 2347 - DNA, 48 bp, Artificial Sequence
  Description of Artificial Sequence: Synthetic oligonucleotide
aagtctagtcagagcctcctgcatggtgatgggaagacctatttctat

SEQ ID NO: 2348 - protein, 16 aa, Artificial Sequence
  Description of Artificial Sequence: Synthetic peptide
KSSQSLLHGDGKTYFY

SEQ ID NO: 2349 - DNA, 33 bp, Artificial Sequence; identical to SEQ ID NO: 1591
  Description of Artificial Sequence: Synthetic oligonucleotide

SEQ ID NO: 2350 - protein, 11 aa, Artificial Sequence
  Description of Artificial Sequence: Synthetic peptide
RASQDINNYLA

SEQ ID NO: 2351 - DNA, 33 bp, Artificial Sequence; identical to SEQ ID NO: 205
  Description of Artificial Sequence: Synthetic oligonucleotide

SEQ ID NO: 2352 - protein, 11 aa, Artificial Sequence
  Description of Artificial Sequence: Synthetic peptide
RASQDIRNDLG

SEQ ID NO: 2353 - DNA, 33 bp, Artificial Sequence; identical to SEQ ID NO: 109
  Description of Artificial Sequence: Synthetic oligonucleotide

SEQ ID NO: 2354 - protein, 11 aa, Artificial Sequence
  Description of Artificial Sequence: Synthetic peptide
RASQGIRNDLG

SEQ ID NO: 2355 - DNA, 33 bp, Artificial Sequence; identical to SEQ ID NO: 1591
  Description of Artificial Sequence: Synthetic oligonucleotide

SEQ ID NO: 2356 - protein, 11 aa, Artificial Sequence
  Description of Artificial Sequence: Synthetic peptide
RASQDINNYLA

SEQ ID NO: 2357 - DNA, 33 bp, Artificial Sequence; identical to SEQ ID NO: 109
  Description of Artificial Sequence: Synthetic oligonucleotide

SEQ ID NO: 2358 - protein, 11 aa, Artificial Sequence
  Description of Artificial Sequence: Synthetic peptide
RASQGIRNDLG

SEQ ID NO: 2359 - DNA, 51 bp, Artificial Sequence
  Description of Artificial Sequence: Synthetic oligonucleotide
aagtccagccagagtgttttacacagctccaacaataataactacttagct

SEQ ID NO: 2360 - protein, 17 aa, Artificial Sequence
  Description of Artificial Sequence: Synthetic peptide
KSSQSVLHSSNNNNYLA

SEQ ID NO: 2361 - DNA, 33 bp, Artificial Sequence; identical to SEQ ID NO: 2341
  Description of Artificial Sequence: Synthetic oligonucleotide

SEQ ID NO: 2362 - protein, 11 aa, Artificial Sequence
  Description of Artificial Sequence: Synthetic peptide
RASQDIRKDLG

SEQ ID NO: 2363 - DNA, 33 bp, Artificial Sequence; identical to SEQ ID NO: 109
  Description of Artificial Sequence: Synthetic oligonucleotide

SEQ ID NO: 2364 - protein, 11 aa, Artificial Sequence
  Description of Artificial Sequence: Synthetic peptide
RASQGIRNDLG

SEQ ID NO: 2365 - DNA, 33 bp, Artificial Sequence
  Description of Artificial Sequence: Synthetic oligonucleotide
cgggcgagtcaggacattagtaattatttagtc

SEQ ID NO: 2366 - protein, 11 aa, Artificial Sequence
  Description of Artificial Sequence: Synthetic peptide
RASQDISNYLV

SEQ ID NO: 2367 - DNA, 33 bp, Artificial Sequence; identical to SEQ ID NO: 109
  Description of Artificial Sequence: Synthetic oligonucleotide

SEQ ID NO: 2368 - protein, 11 aa, Artificial Sequence
  Description of Artificial Sequence: Synthetic peptide
RASQGIRNDLG

SEQ ID NO: 2369 - DNA, 48 bp, Artificial Sequence
  Description of Artificial Sequence: Synthetic oligonucleotide
aagtctagtcagagcctcctgcacggtgatggaaagacctatttgtat

SEQ ID NO: 2370 - protein, 16 aa, Artificial Sequence
  Description of Artificial Sequence: Synthetic peptide
KSSQSLLHGDGKTYLY

SEQ ID NO: 2371 - DNA, 33 bp, Artificial Sequence
  Description of Artificial Sequence: Synthetic oligonucleotide
aggtccagtcagagtgttaacagcaacttagcc

SEQ ID NO: 2372 - protein, 11 aa, Artificial Sequence
  Description of Artificial Sequence: Synthetic peptide
RSSQSVNSNLA

SEQ ID NO: 2373 - DNA, 33 bp, Artificial Sequence
  Description of Artificial Sequence: Synthetic oligonucleotide
caggcgagtcaggacatttacaattatttaaat

SEQ ID NO: 2374 - protein, 11 aa, Artificial Sequence
  Description of Artificial Sequence: Synthetic peptide
QASQDIYNYLN

SEQ ID NO: 2375 - DNA, 33 bp, Artificial Sequence; identical to SEQ ID NO: 1323
  Description of Artificial Sequence: Synthetic oligonucleotide

SEQ ID NO: 2376 - protein, 11 aa, Artificial Sequence
  Description of Artificial Sequence: Synthetic peptide
RASQGIRNDLG

SEQ ID NO: 2377 - DNA, 33 bp, Artificial Sequence
  Description of Artificial Sequence: Synthetic oligonucleotide
caggcgagtcaggacatttacaaccatttaagt

SEQ ID NO: 2378 - protein, 11 aa, Artificial Sequence
  Description of Artificial Sequence: Synthetic peptide
QASQDIYNHLS

SEQ ID NO: 2379 - DNA, 33 bp, Artificial Sequence; identical to SEQ ID NO: 1323
  Description of Artificial Sequence: Synthetic oligonucleotide

SEQ ID NO: 2380 - protein, 11 aa, Artificial Sequence
  Description of Artificial Sequence: Synthetic peptide
RASQGIRNDLG

SEQ ID NO: 2381 - DNA, 33 bp, Artificial Sequence; identical to SEQ ID NO: 2341
  Description of Artificial Sequence: Synthetic oligonucleotide

SEQ ID NO: 2382 - protein, 11 aa, Artificial Sequence
  Description of Artificial Sequence: Synthetic peptide
RASQDIRKDLG

SEQ ID NO: 2383 - DNA, 33 bp, Artificial Sequence; identical to SEQ ID NO: 109
  Description of Artificial Sequence: Synthetic oligonucleotide

SEQ ID NO: 2384 - protein, 11 aa, Artificial Sequence
  Description of Artificial Sequence: Synthetic peptide
RASQGIRNDLG

SEQ ID NO: 2385 - DNA, 33 bp, Artificial Sequence; identical to SEQ ID NO: 109
  Description of Artificial Sequence: Synthetic oligonucleotide

SEQ ID NO: 2386 - protein, 11 aa, Artificial Sequence
  Description of Artificial Sequence: Synthetic peptide
RASQGIRNDLG

SEQ ID NO: 2387 - DNA, 51 bp, Artificial Sequence
  Description of Artificial Sequence: Synthetic oligonucleotide
aagtccaaccatagtgttttatacaggtccaacaataatcaatacttagct

SEQ ID NO: 2388 - protein, 17 aa, Artificial Sequence
  Description of Artificial Sequence: Synthetic peptide
KSNHSVLYRSNNNQYLA

SEQ ID NO: 2389 - DNA, 51 bp, Artificial Sequence; identical to SEQ ID NO: 2329
  Description of Artificial Sequence: Synthetic oligonucleotide

SEQ ID NO: 2390 - protein, 17 aa, Artificial Sequence
  Description of Artificial Sequence: Synthetic peptide
KSSQNVLHSSNNNNYLT

SEQ ID NO: 2391 - DNA, 48 bp, Artificial Sequence
  Description of Artificial Sequence: Synthetic oligonucleotide
aagtctactcagagcctcctgcatggtgatggaaagacctatttgtat

SEQ ID NO: 2392 - protein, 16 aa, Artificial Sequence
  Description of Artificial Sequence: Synthetic peptide
KSTQSLLHGDGKTYLY

SEQ ID NO: 2393 - DNA, 33 bp, Artificial Sequence; identical to SEQ ID NO: 283
  Description of Artificial Sequence: Synthetic oligonucleotide

SEQ ID NO: 2394 - protein, 11 aa, Artificial Sequence
  Description of Artificial Sequence: Synthetic peptide
RASQDISNYLA

SEQ ID NO: 2395 - DNA, 33 bp, Artificial Sequence; identical to SEQ ID NO: 205
  Description of Artificial Sequence: Synthetic oligonucleotide

SEQ ID NO: 2396 - protein, 11 aa, Artificial Sequence
  Description of Artificial Sequence: Synthetic peptide
RASQDIRNDLG

SEQ ID NO: 2397 - DNA, 33 bp, Artificial Sequence; identical to SEQ ID NO: 2289
  Description of Artificial Sequence: Synthetic oligonucleotide

SEQ ID NO: 2398 - protein, 11 aa, Artificial Sequence
  Description of Artificial Sequence: Synthetic peptide
RASQDISNYLV

SEQ ID NO: 2399 - DNA, 33 bp, Artificial Sequence; identical to SEQ ID NO: 491
  Description of Artificial Sequence: Synthetic oligonucleotide

SEQ ID NO: 2400 - protein, 11 aa, Artificial Sequence
  Description of Artificial Sequence: Synthetic peptide
RASQDIRDDLG

SEQ ID NO: 2401 - DNA, 33 bp, Artificial Sequence; identical to SEQ ID NO: 341
  Description of Artificial Sequence: Synthetic oligonucleotide

SEQ ID NO: 2402 - protein, 11 aa, Artificial Sequence
  Description of Artificial Sequence: Synthetic peptide
RASQDIRNNLG

SEQ ID NO: 2403 - DNA, 51 bp, Artificial Sequence; identical to SEQ ID NO: 1683
  Description of Artificial Sequence: Synthetic oligonucleotide

SEQ ID NO: 2404 - protein, 17 aa, Artificial Sequence
  Description of Artificial Sequence: Synthetic peptide
KSSQSVLHSSNNKNYLT

SEQ ID NO: 2405 - DNA, 33 bp, Artificial Sequence
  Description of Artificial Sequence: Synthetic oligonucleotide
cgggcgagtcaggacattagccattatttagcc

SEQ ID NO: 2406 - protein, 11 aa, Artificial Sequence
  Description of Artificial Sequence: Synthetic peptide
RASQDISHYLA

SEQ ID NO: 2407 - DNA, 48 bp, Artificial Sequence
  Description of Artificial Sequence: Synthetic oligonucleotide
aagtctagtcagagcctcctgcacggtgatgggaagacctatttgtat

SEQ ID NO: 2408 - protein, 16 aa, Artificial Sequence
  Description of Artificial Sequence: Synthetic peptide
KSSQSLLHGDGKTYLY

SEQ ID NO: 2409 - DNA, 48 bp, Artificial Sequence; identical to SEQ ID NO: 2369
  Description of Artificial Sequence: Synthetic oligonucleotide

SEQ ID NO: 2410 - protein, 16 aa, Artificial Sequence
  Description of Artificial Sequence: Synthetic peptide
KSSQSLLHGDGKTYLY

SEQ ID NO: 2411 - DNA, 33 bp, Artificial Sequence; identical to SEQ ID NO: 293
  Description of Artificial Sequence: Synthetic oligonucleotide

SEQ ID NO: 2412 - protein, 11 aa, Artificial Sequence
  Description of Artificial Sequence: Synthetic peptide
RASQGINNYLA

SEQ ID NO: 2413 - DNA, 33 bp, Artificial Sequence
  Description of Artificial Sequence: Synthetic oligonucleotide
cgggctagtcagggcattagaaatgatttaggc

SEQ ID NO: 2414 - protein, 11 aa, Artificial Sequence
  Description of Artificial Sequence: Synthetic peptide
RASQGIRNDLG

SEQ ID NO: 2415 - DNA, 51 bp, Artificial Sequence
  Description of Artificial Sequence: Synthetic oligonucleotide
aagtccagccagagtgttttatacatctccaacaataaaaactacttagct

SEQ ID NO: 2416 - protein, 17 aa, Artificial Sequence
  Description of Artificial Sequence: Synthetic peptide
KSSQSVLYISNNKNYLA

SEQ ID NO: 2417 - DNA, 48 bp, Artificial Sequence
  Description of Artificial Sequence: Synthetic oligonucleotide
aggtctagtcagagcctcctgcataataatggatacaagtatttggat

SEQ ID NO: 2418 - protein, 16 aa, Artificial Sequence
  Description of Artificial Sequence: Synthetic peptide
RSSQSLLHNNGYKYLD

SEQ ID NO: 2419 - DNA, 33 bp, Artificial Sequence; identical to SEQ ID NO: 109
  Description of Artificial Sequence: Synthetic oligonucleotide

SEQ ID NO: 2420 - protein, 11 aa, Artificial Sequence
  Description of Artificial Sequence: Synthetic peptide
RASQGIRNDLG

SEQ ID NO: 2421 - DNA, 51 bp, Artificial Sequence; identical to SEQ ID NO: 2415
  Description of Artificial Sequence: Synthetic oligonucleotide

SEQ ID NO: 2422 - protein, 17 aa, Artificial Sequence
  Description of Artificial Sequence: Synthetic peptide
KSSQSVLYISNNKNYLA

SEQ ID NO: 2423 - DNA, 48 bp, Artificial Sequence; identical to SEQ ID NO: 2417
  Description of Artificial Sequence: Synthetic oligonucleotide

SEQ ID NO: 2424 - protein, 16 aa, Artificial Sequence
  Description of Artificial Sequence: Synthetic peptide
RSSQSLLHNNGYKYLD

SEQ ID NO: 2425 - DNA, 33 bp, Artificial Sequence; identical to SEQ ID NO: 109
  Description of Artificial Sequence: Synthetic oligonucleotide

SEQ ID NO: 2426 - protein, 11 aa, Artificial Sequence
  Description of Artificial Sequence: Synthetic peptide
RASQGIRNDLG

SEQ ID NO: 2427 - DNA, 33 bp, Artificial Sequence; identical to SEQ ID NO: 283
  Description of Artificial Sequence: Synthetic oligonucleotide

SEQ ID NO: 2428 - protein, 11 aa, Artificial Sequence
  Description of Artificial Sequence: Synthetic peptide
RASQDISNYLA

SEQ ID NO: 2429 - DNA, 33 bp, Artificial Sequence; identical to SEQ ID NO: 283
  Description of Artificial Sequence: Synthetic oligonucleotide

SEQ ID NO: 2430 - protein, 11 aa, Artificial Sequence
  Description of Artificial Sequence: Synthetic peptide
RASQDISNYLA

SEQ ID NO: 2431 - DNA, 33 bp, Artificial Sequence; identical to SEQ ID NO: 1185
  Description of Artificial Sequence: Synthetic oligonucleotide

SEQ ID NO: 2432 - protein, 11 aa, Artificial Sequence
  Description of Artificial Sequence: Synthetic peptide
RASQGIRDDLG

SEQ ID NO: 2433 - DNA, 48 bp, Artificial Sequence; identical to SEQ ID NO: 481
  Description of Artificial Sequence: Synthetic oligonucleotide

SEQ ID NO: 2434 - protein, 16 aa, Artificial Sequence
  Description of Artificial Sequence: Synthetic peptide
KSSQSLLHGDGKTYLF

SEQ ID NO: 2435 - DNA, 33 bp, Artificial Sequence; identical to SEQ ID NO: 105
  Description of Artificial Sequence: Synthetic oligonucleotide

SEQ ID NO: 2436 - protein, 11 aa, Artificial Sequence
  Description of Artificial Sequence: Synthetic peptide
RASQGISNYLA

SEQ ID NO: 2437 - DNA, 33 bp, Artificial Sequence; identical to SEQ ID NO: 109
  Description of Artificial Sequence: Synthetic oligonucleotide

SEQ ID NO: 2438 - protein, 11 aa, Artificial Sequence
  Description of Artificial Sequence: Synthetic peptide
RASQGIRNDLG

SEQ ID NO: 2439 - DNA, 33 bp, Artificial Sequence; identical to SEQ ID NO: 535
  Description of Artificial Sequence: Synthetic oligonucleotide

SEQ ID NO: 2440 - protein, 11 aa, Artificial Sequence
  Description of Artificial Sequence: Synthetic peptide
RASRGIRNDLG

SEQ ID NO: 2441 - DNA, 33 bp, Artificial Sequence; identical to SEQ ID NO: 109
  Description of Artificial Sequence: Synthetic oligonucleotide

SEQ ID NO: 2442 - protein, 11 aa, Artificial Sequence
  Description of Artificial Sequence: Synthetic peptide
RASQGIRNDLG

SEQ ID NO: 2443 - DNA, 33 bp, Artificial Sequence; identical to SEQ ID NO: 109
  Description of Artificial Sequence: Synthetic oligonucleotide

SEQ ID NO: 2444 - protein, 11 aa, Artificial Sequence
  Description of Artificial Sequence: Synthetic peptide
RASQGIRNDLG

SEQ ID NO: 2445 - DNA, 33 bp, Artificial Sequence; identical to SEQ ID NO: 281
  Description of Artificial Sequence: Synthetic oligonucleotide

SEQ ID NO: 2446 - protein, 11 aa, Artificial Sequence
  Description of Artificial Sequence: Synthetic peptide
RASQGIRTDLG

SEQ ID NO: 2447 - DNA, 33 bp, Artificial Sequence
  Description of Artificial Sequence: Synthetic oligonucleotide
cgggcgagtcaggacattggcaattgtttagcc

SEQ ID NO: 2448 - protein, 11 aa, Artificial Sequence
  Description of Artificial Sequence: Synthetic peptide
RASQDIGNCLA

SEQ ID NO: 2449 - DNA, 51 bp, Artificial Sequence; identical to SEQ ID NO: 1689
  Description of Artificial Sequence: Synthetic oligonucleotide

SEQ ID NO: 2450 - protein, 17 aa, Artificial Sequence
  Description of Artificial Sequence: Synthetic peptide
KSSQSVLHSSNNYNYLA

SEQ ID NO: 2451 - DNA, 33 bp, Artificial Sequence; identical to SEQ ID NO: 109
  Description of Artificial Sequence: Synthetic oligonucleotide

SEQ ID NO: 2452 - protein, 11 aa, Artificial Sequence
  Description of Artificial Sequence: Synthetic peptide
RASQGIRNDLG

SEQ ID NO: 2453 - DNA, 33 bp, Artificial Sequence; identical to SEQ ID NO: 281
  Description of Artificial Sequence: Synthetic oligonucleotide

SEQ ID NO: 2454 - protein, 11 aa, Artificial Sequence
  Description of Artificial Sequence: Synthetic peptide
RASQGIRTDLG

SEQ ID NO: 2455 - DNA, 33 bp, Artificial Sequence; identical to SEQ ID NO: 109
  Description of Artificial Sequence: Synthetic oligonucleotide

SEQ ID NO: 2456 - protein, 11 aa, Artificial Sequence
  Description of Artificial Sequence: Synthetic peptide
RASQGIRNDLG

SEQ ID NO: 2457 - DNA, 33 bp, Artificial Sequence
  Description of Artificial Sequence: Synthetic oligonucleotide
cgggcgagtcagggtgttaacgactggttagcc

SEQ ID NO: 2458 - protein, 11 aa, Artificial Sequence
  Description of Artificial Sequence: Synthetic peptide
RASQGVNDWLA

SEQ ID NO: 2459 - DNA, 48 bp, Artificial Sequence
  Description of Artificial Sequence: Synthetic oligonucleotide
aggtctagtcagagcctcctgtatcataatggatacaactatttggat

SEQ ID NO: 2460 - protein, 16 aa, Artificial Sequence
  Description of Artificial Sequence: Synthetic peptide
RSSQSLLYHNGYNYLD

SEQ ID NO: 2461 - DNA, 33 bp, Artificial Sequence; identical to SEQ ID NO: 553
  Description of Artificial Sequence: Synthetic oligonucleotide

SEQ ID NO: 2462 - protein, 11 aa, Artificial Sequence
  Description of Artificial Sequence: Synthetic peptide
RASQGISNWLA

SEQ ID NO: 2463 - DNA, 33 bp, Artificial Sequence
  Description of Artificial Sequence: Synthetic oligonucleotide
cgggcgagtcaggatattaccacctggttagcc

SEQ ID NO: 2464 - protein, 11 aa, Artificial Sequence
  Description of Artificial Sequence: Synthetic peptide
RASQDITTWLA

SEQ ID NO: 2465 - DNA, 33 bp, Artificial Sequence; identical to SEQ ID NO: 1301
  Description of Artificial Sequence: Synthetic oligonucleotide

SEQ ID NO: 2466 - protein, 11 aa, Artificial Sequence
  Description of Artificial Sequence: Synthetic peptide
RASQGIRNNLG

SEQ ID NO: 2467 - DNA, 33 bp, Artificial Sequence; identical to SEQ ID NO: 2413
  Description of Artificial Sequence: Synthetic oligonucleotide

SEQ ID NO: 2468 - protein, 11 aa, Artificial Sequence
  Description of Artificial Sequence: Synthetic peptide
RASQGIRNDLG

SEQ ID NO: 2469 - DNA, 48 bp, Artificial Sequence
  Description of Artificial Sequence: Synthetic oligonucleotide
aagtctagtcagagcctcctgcatggtgatggaaagacctatttctat

SEQ ID NO: 2470 - protein, 16 aa, Artificial Sequence
  Description of Artificial Sequence: Synthetic peptide
KSSQSLLHGDGKTYFY

SEQ ID NO: 2471 - DNA, 33 bp, Artificial Sequence; identical to SEQ ID NO: 453
  Description of Artificial Sequence: Synthetic oligonucleotide

SEQ ID NO: 2472 - protein, 11 aa, Artificial Sequence
  Description of Artificial Sequence: Synthetic peptide
RASQGVRNDLG

SEQ ID NO: 2473 - DNA, 51 bp, Artificial Sequence; identical to SEQ ID NO: 1057
  Description of Artificial Sequence: Synthetic oligonucleotide

SEQ ID NO: 2474 - protein, 17 aa, Artificial Sequence
  Description of Artificial Sequence: Synthetic peptide
KSSQSVLHSSNNNNYLA

SEQ ID NO: 2475 - DNA, 33 bp, Artificial Sequence
  Description of Artificial Sequence: Synthetic oligonucleotide
cgtgcaagtcagaccattagcaactatttaaat

SEQ ID NO: 2476 - protein, 11 aa, Artificial Sequence
  Description of Artificial Sequence: Synthetic peptide
RASQTISNYLN

SEQ ID NO: 2477 - DNA, 48 bp, Artificial Sequence; identical to SEQ ID NO: 575
  Description of Artificial Sequence: Synthetic oligonucleotide

SEQ ID NO: 2478 - protein, 16 aa, Artificial Sequence
  Description of Artificial Sequence: Synthetic peptide
KSSQSLLHGDGKTYLY

SEQ ID NO: 2479 - DNA, 48 bp, Artificial Sequence
  Description of Artificial Sequence: Synthetic oligonucleotide
aagtctagtcagagcctcctgcatagtgagggaaagacctacttgtat

SEQ ID NO: 2480 - protein, 16 aa, Artificial Sequence
  Description of Artificial Sequence: Synthetic peptide
KSSQSLLHSEGKTYLY

SEQ ID NO: 2481 - DNA, 33 bp, Artificial Sequence; identical to SEQ ID NO: 109
  Description of Artificial Sequence: Synthetic oligonucleotide

SEQ ID NO: 2482 - protein, 11 aa, Artificial Sequence
  Description of Artificial Sequence: Synthetic peptide
RASQGIRNDLG

SEQ ID NO: 2483 - DNA, 51 bp, Artificial Sequence
  Description of Artificial Sequence: Synthetic oligonucleotide
aagtccagccagagtgtattacacagctccaacaattacaactacttaact

SEQ ID NO: 2484 - protein, 17 aa, Artificial Sequence
  Description of Artificial Sequence: Synthetic peptide
KSSQSVLHSSNNYNYLT

SEQ ID NO: 2485 - DNA, 33 bp, Artificial Sequence; identical to SEQ ID NO: 553
  Description of Artificial Sequence: Synthetic oligonucleotide

SEQ ID NO: 2486 - protein, 11 aa, Artificial Sequence
  Description of Artificial Sequence: Synthetic peptide
RASQGISNWLA

SEQ ID NO: 2487 - DNA, 33 bp, Artificial Sequence; identical to SEQ ID NO: 1185
  Description of Artificial Sequence: Synthetic oligonucleotide

SEQ ID NO: 2488 - protein, 11 aa, Artificial Sequence
  Description of Artificial Sequence: Synthetic peptide
RASQGIRDDLG

SEQ ID NO: 2489 - DNA, 33 bp, Artificial Sequence; identical to SEQ ID NO: 281
  Description of Artificial Sequence: Synthetic oligonucleotide

SEQ ID NO: 2490 - protein, 11 aa, Artificial Sequence
  Description of Artificial Sequence: Synthetic peptide
RASQGIRTDLG

SEQ ID NO: 2491 - DNA, 33 bp, Artificial Sequence
  Description of Artificial Sequence: Synthetic oligonucleotide
cgggcgagtcaggacattagcaatgatttagcc

SEQ ID NO: 2492 - protein, 11 aa, Artificial Sequence
  Description of Artificial Sequence: Synthetic peptide
RASQDISNDLA

SEQ ID NO: 2493 - DNA, 33 bp, Artificial Sequence
  Description of Artificial Sequence: Synthetic oligonucleotide
cgggcgagtcagggcattgggaattatttagcc

SEQ ID NO: 2494 - protein, 11 aa, Artificial Sequence
  Description of Artificial Sequence: Synthetic peptide
RASQGIGNYLA

SEQ ID NO: 2495 - DNA, 33 bp, Artificial Sequence
  Description of Artificial Sequence: Synthetic oligonucleotide
cgggcgagtcagggtattaccgactggttagcc

SEQ ID NO: 2496 - protein, 11 aa, Artificial Sequence
  Description of Artificial Sequence: Synthetic peptide
RASQGITDWLA

SEQ ID NO: 2497 - DNA, 51 bp, Artificial Sequence; identical to SEQ ID NO: 1541
  Description of Artificial Sequence: Synthetic oligonucleotide

SEQ ID NO: 2498 - protein, 17 aa, Artificial Sequence
  Description of Artificial Sequence: Synthetic peptide
KSSQSVLYSSNNNNYLA

SEQ ID NO: 2499 - DNA, 33 bp, Artificial Sequence
  Description of Artificial Sequence: Synthetic oligonucleotide
cgggcaagtcagaccattggcaactatttaaat

SEQ ID NO: 2500 - protein, 11 aa, Artificial Sequence
  Description of Artificial Sequence: Synthetic peptide
RASQTIGNYLN

SEQ ID NO: 2501 - DNA, 48 bp, Artificial Sequence; identical to SEQ ID NO: 575
  Description of Artificial Sequence: Synthetic oligonucleotide

SEQ ID NO: 2502 - protein, 16 aa, Artificial Sequence
  Description of Artificial Sequence: Synthetic peptide
KSSQSLLHGDGKTYLY

SEQ ID NO: 2503 - DNA, 48 bp, Artificial Sequence; identical to SEQ ID NO: 2417
  Description of Artificial Sequence: Synthetic oligonucleotide

SEQ ID NO: 2504 - protein, 16 aa, Artificial Sequence
  Description of Artificial Sequence: Synthetic peptide
RSSQSLLHNNGYKYLD

SEQ ID NO: 2505 - DNA, 33 bp, Artificial Sequence; identical to SEQ ID NO: 109
  Description of Artificial Sequence: Synthetic oligonucleotide

SEQ ID NO: 2506 - protein, 11 aa, Artificial Sequence
  Description of Artificial Sequence: Synthetic peptide
RASQGIRNDLG

SEQ ID NO: 2507 - DNA, 33 bp, Artificial Sequence; identical to SEQ ID NO: 109
  Description of Artificial Sequence: Synthetic oligonucleotide

SEQ ID NO: 2508 - protein, 11 aa, Artificial Sequence
  Description of Artificial Sequence: Synthetic peptide
RASQGIRNDLG

SEQ ID NO: 2509 - DNA, 33 bp, Artificial Sequence; identical to SEQ ID NO: 2311
  Description of Artificial Sequence: Synthetic oligonucleotide

SEQ ID NO: 2510 - protein, 11 aa, Artificial Sequence
  Description of Artificial Sequence: Synthetic peptide
RASQGITNYLA

SEQ ID NO: 2511 - DNA, 33 bp, Artificial Sequence; identical to SEQ ID NO: 109
  Description of Artificial Sequence: Synthetic oligonucleotide

SEQ ID NO: 2512 - protein, 11 aa, Artificial Sequence
  Description of Artificial Sequence: Synthetic peptide
RASQGIRNDLG

SEQ ID NO: 2513 - DNA, 33 bp, Artificial Sequence
  Description of Artificial Sequence: Synthetic oligonucleotide
cgggcaagtcaggacattagcaatgatttaggc

SEQ ID NO: 2514 - protein, 11 aa, Artificial Sequence
  Description of Artificial Sequence: Synthetic peptide
RASQDISNDLG

SEQ ID NO: 2515 - DNA, 48 bp, Artificial Sequence; identical to SEQ ID NO: 107
  Description of Artificial Sequence: Synthetic oligonucleotide

SEQ ID NO: 2516 - protein, 16 aa, Artificial Sequence
  Description of Artificial Sequence: Synthetic peptide
KSSQRLLHGDGKTYLY

SEQ ID NO: 2517 - DNA, 51 bp, Artificial Sequence
  Description of Artificial Sequence: Synthetic oligonucleotide
aagtccagccagagtgttttacacagctccaacaataacaactacttaact

SEQ ID NO: 2518 - protein, 17 aa, Artificial Sequence
  Description of Artificial Sequence: Synthetic peptide
KSSQSVLHSSNNNNYLT

SEQ ID NO: 2519 - DNA, 33 bp, Artificial Sequence; identical to SEQ ID NO: 553
  Description of Artificial Sequence: Synthetic oligonucleotide

SEQ ID NO: 2520 - protein, 11 aa, Artificial Sequence
  Description of Artificial Sequence: Synthetic peptide
RASQGISNWLA

SEQ ID NO: 2521 - DNA, 33 bp, Artificial Sequence
  Description of Artificial Sequence: Synthetic oligonucleotide
cgggcgagtcaggatattactgactggttagcc

SEQ ID NO: 2522 - protein, 11 aa, Artificial Sequence
  Description of Artificial Sequence: Synthetic peptide
RASQDITDWLA

SEQ ID NO: 2523 - DNA, 33 bp, Artificial Sequence; identical to SEQ ID NO: 109
  Description of Artificial Sequence: Synthetic oligonucleotide

SEQ ID NO: 2524 - protein, 11 aa, Artificial Sequence
  Description of Artificial Sequence: Synthetic peptide
RASQGIRNDLG

SEQ ID NO: 2525 - DNA, 48 bp, Artificial Sequence; identical to SEQ ID NO: 575
  Description of Artificial Sequence: Synthetic oligonucleotide

SEQ ID NO: 2526 - protein, 16 aa, Artificial Sequence
  Description of Artificial Sequence: Synthetic peptide
KSSQSLLHGDGKTYLY

SEQ ID NO: 2527 - DNA, 33 bp, Artificial Sequence
  Description of Artificial Sequence: Synthetic oligonucleotide
cgggcgagtcaggatattagcgactggttagcc

SEQ ID NO: 2528 - protein, 11 aa, Artificial Sequence
  Description of Artificial Sequence: Synthetic peptide
RASQDISDWLA

SEQ ID NO: 2529 - DNA, 48 bp, Artificial Sequence
  Description of Artificial Sequence: Synthetic oligonucleotide
aaatctagtcagagcctcctgcatagtgagggaaagacctacttgtat

SEQ ID NO: 2530 - protein, 16 aa, Artificial Sequence
  Description of Artificial Sequence: Synthetic peptide
KSSQSLLHSEGKTYLY

SEQ ID NO: 2531 - DNA, 33 bp, Artificial Sequence
  Description of Artificial Sequence: Synthetic oligonucleotide
cgggcgagtcaggatattaccagctggttagcc

SEQ ID NO: 2532 - protein, 11 aa, Artificial Sequence
  Description of Artificial Sequence: Synthetic peptide
RASQDITSWLA

SEQ ID NO: 2533 - DNA, 48 bp, Artificial Sequence; identical to SEQ ID NO: 575
  Description of Artificial Sequence: Synthetic oligonucleotide

SEQ ID NO: 2534 - protein, 16 aa, Artificial Sequence
  Description of Artificial Sequence: Synthetic peptide
KSSQSLLHGDGKTYLY

SEQ ID NO: 2535 - DNA, 33 bp, Artificial Sequence; identical to SEQ ID NO: 109
  Description of Artificial Sequence: Synthetic oligonucleotide

SEQ ID NO: 2536 - protein, 11 aa, Artificial Sequence
  Description of Artificial Sequence: Synthetic peptide
RASQGIRNDLG

SEQ ID NO: 2537 - DNA, 33 bp, Artificial Sequence
  Description of Artificial Sequence: Synthetic oligonucleotide
cgggcaagtcagaccattctcagctatttaaat

SEQ ID NO: 2538 - protein, 11 aa, Artificial Sequence
  Description of Artificial Sequence: Synthetic peptide
RASQTILSYLN

SEQ ID NO: 2539 - DNA, 48 bp, Artificial Sequence; identical to SEQ ID NO: 575
  Description of Artificial Sequence: Synthetic oligonucleotide

SEQ ID NO: 2540 - protein, 16 aa, Artificial Sequence
  Description of Artificial Sequence: Synthetic peptide
KSSQSLLHGDGKTYLY

SEQ ID NO: 2541 - DNA, 33 bp, Artificial Sequence; identical to SEQ ID NO: 105
  Description of Artificial Sequence: Synthetic oligonucleotide

SEQ ID NO: 2542 - protein, 11 aa, Artificial Sequence
  Description of Artificial Sequence: Synthetic peptide
RASQGISNYLA

SEQ ID NO: 2543 - DNA, 33 bp, Artificial Sequence
  Description of Artificial Sequence: Synthetic oligonucleotide
cgggcaagtcacagcattagcaactatttaaat

SEQ ID NO: 2544 - protein, 11 aa, Artificial Sequence
  Description of Artificial Sequence: Synthetic peptide
RASHSISNYLN

SEQ ID NO: 2545 - DNA, 51 bp, Artificial Sequence; identical to SEQ ID NO: 1959
  Description of Artificial Sequence: Synthetic oligonucleotide

SEQ ID NO: 2546 - protein, 17 aa, Artificial Sequence
  Description of Artificial Sequence: Synthetic peptide
KSSQSVLHSSNNYNYLT

SEQ ID NO: 2547 - DNA, 33 bp, Artificial Sequence; identical to SEQ ID NO: 109
  Description of Artificial Sequence: Synthetic oligonucleotide

SEQ ID NO: 2548 - protein, 11 aa, Artificial Sequence
  Description of Artificial Sequence: Synthetic peptide
RASQGIRNDLG

SEQ ID NO: 2549 - DNA, 48 bp, Artificial Sequence; identical to SEQ ID NO: 575
  Description of Artificial Sequence: Synthetic oligonucleotide

SEQ ID NO: 2550 - protein, 16 aa, Artificial Sequence
  Description of Artificial Sequence: Synthetic peptide
KSSQSLLHGDGKTYLY

SEQ ID NO: 2551 - DNA, 33 bp, Artificial Sequence; identical to SEQ ID NO: 2531
  Description of Artificial Sequence: Synthetic oligonucleotide

SEQ ID NO: 2552 - protein, 11 aa, Artificial Sequence
  Description of Artificial Sequence: Synthetic peptide
RASQDITSWLA

SEQ ID NO: 2553 - DNA, 33 bp, Artificial Sequence; identical to SEQ ID NO: 837
  Description of Artificial Sequence: Synthetic oligonucleotide

SEQ ID NO: 2554 - protein, 11 aa, Artificial Sequence
  Description of Artificial Sequence: Synthetic peptide
QASQDISNYLN

SEQ ID NO: 2555 - DNA, 33 bp, Artificial Sequence
  Description of Artificial Sequence: Synthetic oligonucleotide
cgggcaagtcggaacatcagcaactatttaaat

SEQ ID NO: 2556 - protein, 11 aa, Artificial Sequence
  Description of Artificial Sequence: Synthetic peptide
RASRNISNYLN

SEQ ID NO: 2557 - DNA, 36 bp, Artificial Sequence
  Description of Artificial Sequence: Synthetic oligonucleotide
agggccagtccgagtgttagcagcagattcttagcc

SEQ ID NO: 2558 - protein, 12 aa, Artificial Sequence
  Description of Artificial Sequence: Synthetic peptide
RASPSVSSRFLA

SEQ ID NO: 2559 - DNA, 33 bp, Artificial Sequence
  Description of Artificial Sequence: Synthetic oligonucleotide
cgggccagtcagagtattggtagtaacttacac

SEQ ID NO: 2560 - protein, 11 aa, Artificial Sequence
  Description of Artificial Sequence: Synthetic peptide
RASQSIGSNLH

SEQ ID NO: 2561 - DNA, 33 bp, Artificial Sequence
  Description of Artificial Sequence: Synthetic oligonucleotide
cggacgagtcagggcattggcaattatttagcc

SEQ ID NO: 2562 - protein, 11 aa, Artificial Sequence
  Description of Artificial Sequence: Synthetic peptide
RTSQGIGNYLA

SEQ ID NO: 2563 - DNA, 33 bp, Artificial Sequence
  Description of Artificial Sequence: Synthetic oligonucleotide
agggccagtcagagttttcgcatcaacttagcc

SEQ ID NO: 2564 - protein, 11 aa, Artificial Sequence
  Description of Artificial Sequence: Synthetic peptide
RASQSFRINLA

SEQ ID NO: 2565 - DNA, 33 bp, Artificial Sequence
  Description of Artificial Sequence: Synthetic oligonucleotide
cgggccagtcagaacattggtagtagcttacac

SEQ ID NO: 2566 - protein, 11 aa, Artificial Sequence
  Description of Artificial Sequence: Synthetic peptide
RASQNIGSSLH

SEQ ID NO: 2567 - DNA, 33 bp, Artificial Sequence; identical to SEQ ID NO: 2561
  Description of Artificial Sequence: Synthetic oligonucleotide

SEQ ID NO: 2568 - protein, 11 aa, Artificial Sequence
  Description of Artificial Sequence: Synthetic peptide
RTSQGIGNYLA

SEQ ID NO: 2569 - DNA, 48 bp, Artificial Sequence
  Description of Artificial Sequence: Synthetic oligonucleotide
aagtctagtcagagcctcctccatagtgatggaaggacctatttgtat

SEQ ID NO: 2570 - protein, 16 aa, Artificial Sequence
  Description of Artificial Sequence: Synthetic peptide
KSSQSLLHSDGRTYLY

SEQ ID NO: 2571 - DNA, 33 bp, Artificial Sequence
  Description of Artificial Sequence: Synthetic oligonucleotide
cgggccagtcagagtattggtagtagcttacac

SEQ ID NO: 2572 - protein, 11 aa, Artificial Sequence
  Description of Artificial Sequence: Synthetic peptide
RASQSIGSSLH

SEQ ID NO: 2573 - DNA, 33 bp, Artificial Sequence; identical to SEQ ID NO: 1229
  Description of Artificial Sequence: Synthetic oligonucleotide

SEQ ID NO: 2574 - protein, 11 aa, Artificial Sequence
  Description of Artificial Sequence: Synthetic peptide
RASQGIRKDLG

SEQ ID NO: 2575 - DNA, 33 bp, Artificial Sequence; identical to SEQ ID NO: 105
  Description of Artificial Sequence: Synthetic oligonucleotide

SEQ ID NO: 2576 - protein, 11 aa, Artificial Sequence
  Description of Artificial Sequence: Synthetic peptide
RASQGISNYLA

SEQ ID NO: 2577 - DNA, 33 bp, Artificial Sequence; identical to SEQ ID NO: 1727
  Description of Artificial Sequence: Synthetic oligonucleotide

SEQ ID NO: 2578 - protein, 11 aa, Artificial Sequence
  Description of Artificial Sequence: Synthetic peptide
RASQGIGKYLA

SEQ ID NO: 2579 - DNA, 33 bp, Artificial Sequence
  Description of Artificial Sequence: Synthetic oligonucleotide
cggacgagtcagggcattggcaagtatttagcc

SEQ ID NO: 2580 - protein, 11 aa, Artificial Sequence
  Description of Artificial Sequence: Synthetic peptide
RTSQGIGKYLA

SEQ ID NO: 2581 - DNA, 48 bp, Artificial Sequence
  Description of Artificial Sequence: Synthetic oligonucleotide
aggtctagtcagagcctcctgcatagtgatggaaagacctatttgttt

SEQ ID NO: 2582 - protein, 16 aa, Artificial Sequence
  Description of Artificial Sequence: Synthetic peptide
RSSQSLLHSDGKTYLF

SEQ ID NO: 2583 - DNA, 51 bp, Artificial Sequence
  Description of Artificial Sequence: Synthetic oligonucleotide
aggtccagccagagtgttttacacagctccaacaattacaactacttagct

SEQ ID NO: 2584 - protein, 17 aa, Artificial Sequence
  Description of Artificial Sequence: Synthetic peptide
RSSQSVLHSSNNYNYLA

SEQ ID NO: 2585 - DNA, 36 bp, Artificial Sequence
  Description of Artificial Sequence: Synthetic oligonucleotide
agggccagtcagagtattagcctcaacttcttagcc

SEQ ID NO: 2586 - protein, 12 aa, Artificial Sequence
  Description of Artificial Sequence: Synthetic peptide
RASQSISLNFLA

SEQ ID NO: 2587 - DNA, 33 bp, Artificial Sequence; identical to SEQ ID NO: 105
  Description of Artificial Sequence: Synthetic oligonucleotide

SEQ ID NO: 2588 - protein, 11 aa, Artificial Sequence
  Description of Artificial Sequence: Synthetic peptide
RASQGISNYLA

SEQ ID NO: 2589 - DNA, 36 bp, Artificial Sequence
  Description of Artificial Sequence: Synthetic oligonucleotide
agggccagtcagagtattcgcagcagcttcttagcc

SEQ ID NO: 2590 - protein, 12 aa, Artificial Sequence
  Description of Artificial Sequence: Synthetic peptide
RASQSIRSSFLA

SEQ ID NO: 2591 - DNA, 36 bp, Artificial Sequence; identical to SEQ ID NO: 2589
  Description of Artificial Sequence: Synthetic oligonucleotide

SEQ ID NO: 2592 - protein, 12 aa, Artificial Sequence
  Description of Artificial Sequence: Synthetic peptide
RASQSIRSSFLA

SEQ ID NO: 2593 - DNA, 36 bp, Artificial Sequence
  Description of Artificial Sequence: Synthetic oligonucleotide
agggccggtcaaagtattagaaccaacttcttagcc

SEQ ID NO: 2594 - protein, 12 aa, Artificial Sequence
  Description of Artificial Sequence: Synthetic peptide
RAGQSIRTNFLA

SEQ ID NO: 2595 - DNA, 48 bp, Artificial Sequence; identical to SEQ ID NO: 2569
  Description of Artificial Sequence: Synthetic oligonucleotide

SEQ ID NO: 2596 - protein, 16 aa, Artificial Sequence
  Description of Artificial Sequence: Synthetic peptide
KSSQSLLHSDGRTYLY

SEQ ID NO: 2597 - DNA, 51 bp, Artificial Sequence
  Description of Artificial Sequence: Synthetic oligonucleotide
aagtccagccagagtgttttacacagctccaacagttacaactacttagct

SEQ ID NO: 2598 - protein, 17 aa, Artificial Sequence
  Description of Artificial Sequence: Synthetic peptide
KSSQSVLHSSNSYNYLA

SEQ ID NO: 2599 - DNA, 33 bp, Artificial Sequence; identical to SEQ ID NO: 1229
  Description of Artificial Sequence: Synthetic oligonucleotide

SEQ ID NO: 2600 - protein, 11 aa, Artificial Sequence
  Description of Artificial Sequence: Synthetic peptide
RASQGIRKDLG

SEQ ID NO: 2601 - DNA, 33 bp, Artificial Sequence; identical to SEQ ID NO: 2561
  Description of Artificial Sequence: Synthetic oligonucleotide

SEQ ID NO: 2602 - protein, 11 aa, Artificial Sequence
  Description of Artificial Sequence: Synthetic peptide
RTSQGIGNYLA

SEQ ID NO: 2603 - DNA, 33 bp, Artificial Sequence
  Description of Artificial Sequence: Synthetic oligonucleotide
cgggcgagtcaggggattggcaatcatttagcc

SEQ ID NO: 2604 - protein, 11 aa, Artificial Sequence
  Description of Artificial Sequence: Synthetic peptide
RASQGIGNHLA

SEQ ID NO: 2605 - DNA, 33 bp, Artificial Sequence
  Description of Artificial Sequence: Synthetic oligonucleotide
cgggccaatcagagcattggtagtagcttacac

SEQ ID NO: 2606 - protein, 11 aa, Artificial Sequence
  Description of Artificial Sequence: Synthetic peptide
RANQSIGSSLH

SEQ ID NO: 2607 - DNA, 36 bp, Artificial Sequence
  Description of Artificial Sequence: Synthetic oligonucleotide
agggccagtcagagtgttagcagcaggttcttagcc

SEQ ID NO: 2608 - protein, 12 aa, Artificial Sequence
  Description of Artificial Sequence: Synthetic peptide
RASQSVSSRFLA

SEQ ID NO: 2609 - DNA, 33 bp, Artificial Sequence
  Description of Artificial Sequence: Synthetic oligonucleotide
cgggccagtcagagcattggtagtagcttacac

SEQ ID NO: 2610 - protein, 11 aa, Artificial Sequence
  Description of Artificial Sequence: Synthetic peptide
RASQSIGSSLH

SEQ ID NO: 2611 - DNA, 33 bp, Artificial Sequence; identical to SEQ ID NO: 401
  Description of Artificial Sequence: Synthetic oligonucleotide

SEQ ID NO: 2612 - protein, 11 aa, Artificial Sequence
  Description of Artificial Sequence: Synthetic peptide
RASQGIRNYLA

SEQ ID NO: 2613 - DNA, 48 bp, Artificial Sequence; identical to SEQ ID NO: 2569
  Description of Artificial Sequence: Synthetic oligonucleotide

SEQ ID NO: 2614 - protein, 16 aa, Artificial Sequence
  Description of Artificial Sequence: Synthetic peptide
KSSQSLLHSDGRTYLY

SEQ ID NO: 2615 - DNA, 33 bp, Artificial Sequence
  Description of Artificial Sequence: Synthetic oligonucleotide
cgggcgagtcaggacattggcagatatttagcc

SEQ ID NO: 2616 - protein, 11 aa, Artificial Sequence
  Description of Artificial Sequence: Synthetic peptide
RASQDIGRYLA

SEQ ID NO: 2617 - DNA, 33 bp, Artificial Sequence; identical to SEQ ID NO: 2193
  Description of Artificial Sequence: Synthetic oligonucleotide

SEQ ID NO: 2618 - protein, 11 aa, Artificial Sequence
  Description of Artificial Sequence: Synthetic peptide
RASQGINNWLA

SEQ ID NO: 2619 - DNA, 33 bp, Artificial Sequence; identical to SEQ ID NO: 105
  Description of Artificial Sequence: Synthetic oligonucleotide

SEQ ID NO: 2620 - protein, 11 aa, Artificial Sequence
  Description of Artificial Sequence: Synthetic peptide
RASQGISNYLA

SEQ ID NO: 2621 - DNA, 33 bp, Artificial Sequence; identical to SEQ ID NO: 109
  Description of Artificial Sequence: Synthetic oligonucleotide

SEQ ID NO: 2622 - protein, 11 aa, Artificial Sequence
  Description of Artificial Sequence: Synthetic peptide
RASQGIRNDLG

SEQ ID NO: 2623 - DNA, 33 bp, Artificial Sequence; identical to SEQ ID NO: 109
  Description of Artificial Sequence: Synthetic oligonucleotide

SEQ ID NO: 2624 - protein, 11 aa, Artificial Sequence
  Description of Artificial Sequence: Synthetic peptide
RASQGIRNDLG

SEQ ID NO: 2625 - DNA, 33 bp, Artificial Sequence; identical to SEQ ID NO: 105
  Description of Artificial Sequence: Synthetic oligonucleotide

SEQ ID NO: 2626 - protein, 11 aa, Artificial Sequence
  Description of Artificial Sequence: Synthetic peptide
RASQGISNYLA

SEQ ID NO: 2627 - DNA, 33 bp, Artificial Sequence; identical to SEQ ID NO: 105
  Description of Artificial Sequence: Synthetic oligonucleotide

SEQ ID NO: 2628 - protein, 11 aa, Artificial Sequence
  Description of Artificial Sequence: Synthetic peptide
RASQGISNYLA

SEQ ID NO: 2629 - DNA, 48 bp, Artificial Sequence
  Description of Artificial Sequence: Synthetic oligonucleotide
aagtctagtcagagcctcctgcatggtgatggaaagacctatttgtgt

SEQ ID NO: 2630 - protein, 16 aa, Artificial Sequence
  Description of Artificial Sequence: Synthetic peptide
KSSQSLLHGDGKTYLC

SEQ ID NO: 2631 - DNA, 33 bp, Artificial Sequence; identical to SEQ ID NO: 2531
  Description of Artificial Sequence: Synthetic oligonucleotide

SEQ ID NO: 2632 - protein, 11 aa, Artificial Sequence
  Description of Artificial Sequence: Synthetic peptide
RASQDITSWLA

SEQ ID NO: 2633 - DNA, 33 bp, Artificial Sequence; identical to SEQ ID NO: 105
  Description of Artificial Sequence: Synthetic oligonucleotide

SEQ ID NO: 2634 - protein, 11 aa, Artificial Sequence
  Description of Artificial Sequence: Synthetic peptide
RASQGISNYLA

SEQ ID NO: 2635 - DNA, 33 bp, Artificial Sequence
  Description of Artificial Sequence: Synthetic oligonucleotide
cgggcgaatcaggatatttccagctggttagcc

SEQ ID NO: 2636 - protein, 11 aa, Artificial Sequence
  Description of Artificial Sequence: Synthetic peptide
RANQDISSWLA

SEQ ID NO: 2637 - DNA, 33 bp, Artificial Sequence; identical to SEQ ID NO: 105
  Description of Artificial Sequence: Synthetic oligonucleotide

SEQ ID NO: 2638 - protein, 11 aa, Artificial Sequence
  Description of Artificial Sequence: Synthetic peptide
RASQGISNYLA

SEQ ID NO: 2639 - DNA, 48 bp, Artificial Sequence
  Description of Artificial Sequence: Synthetic oligonucleotide
atgtctagtcagagcctcctgcatggtgatggaaagacctatttatat

SEQ ID NO: 2640 - protein, 16 aa, Artificial Sequence
  Description of Artificial Sequence: Synthetic peptide
MSSQSLLHGDGKTYLY

SEQ ID NO: 2641 - DNA, 48 bp, Artificial Sequence; identical to SEQ ID NO: 481
  Description of Artificial Sequence: Synthetic oligonucleotide

SEQ ID NO: 2642 - protein, 16 aa, Artificial Sequence
  Description of Artificial Sequence: Synthetic peptide
KSSQSLLHGDGKTYLF

SEQ ID NO: 2643 - DNA, 51 bp, Artificial Sequence
  Description of Artificial Sequence: Synthetic oligonucleotide
aagtccagccagagtgttttattcaactccaacaataagaactacttagct

SEQ ID NO: 2644 - protein, 17 aa, Artificial Sequence
  Description of Artificial Sequence: Synthetic peptide
KSSQSVLFNSNNKNYLA

SEQ ID NO: 2645 - DNA, 36 bp, Artificial Sequence
  Description of Artificial Sequence: Synthetic oligonucleotide
agggccagtcagaatataaggagcaacttcttagcc

SEQ ID NO: 2646 - protein, 12 aa, Artificial Sequence
  Description of Artificial Sequence: Synthetic peptide
RASQNIRSNFLA

SEQ ID NO: 2647 - DNA, 33 bp, Artificial Sequence; identical to SEQ ID NO: 1229
  Description of Artificial Sequence: Synthetic oligonucleotide

SEQ ID NO: 2648 - protein, 11 aa, Artificial Sequence
  Description of Artificial Sequence: Synthetic peptide
RASQGIRKDLG

SEQ ID NO: 2649 - DNA, 33 bp, Artificial Sequence
  Description of Artificial Sequence: Synthetic oligonucleotide
cgggcgagtcagggtcttaacaactggttagcc

SEQ ID NO: 2650 - protein, 11 aa, Artificial Sequence
  Description of Artificial Sequence: Synthetic peptide
RASQGLNNWLA

SEQ ID NO: 2651 - DNA, 36 bp, Artificial Sequence; identical to SEQ ID NO: 2589
  Description of Artificial Sequence: Synthetic oligonucleotide

SEQ ID NO: 2652 - protein, 12 aa, Artificial Sequence
  Description of Artificial Sequence: Synthetic peptide
RASQSIRSSFLA

SEQ ID NO: 2653 - DNA, 36 bp, Artificial Sequence
  Description of Artificial Sequence: Synthetic oligonucleotide
agggccagtcagagtgttagaagcaacttcttagcc

SEQ ID NO: 2654 - protein, 12 aa, Artificial Sequence
  Description of Artificial Sequence: Synthetic peptide
RASQSVRSNFLA

SEQ ID NO: 2655 - DNA, 51 bp, Artificial Sequence; identical to SEQ ID NO: 1689
  Description of Artificial Sequence: Synthetic oligonucleotide

SEQ ID NO: 2656 - protein, 17 aa, Artificial Sequence
  Description of Artificial Sequence: Synthetic peptide
KSSQSVLHSSNNYNYLA

SEQ ID NO: 2657 - DNA, 33 bp, Artificial Sequence; identical to SEQ ID NO: 2559
  Description of Artificial Sequence: Synthetic oligonucleotide

SEQ ID NO: 2658 - protein, 11 aa, Artificial Sequence
  Description of Artificial Sequence: Synthetic peptide
RASQSIGSNLH

SEQ ID NO: 2659 - DNA, 33 bp, Artificial Sequence; identical to SEQ ID NO: 1229
  Description of Artificial Sequence: Synthetic oligonucleotide

SEQ ID NO: 2660 - protein, 11 aa, Artificial Sequence
  Description of Artificial Sequence: Synthetic peptide
RASQGIRKDLG

SEQ ID NO: 2661 - DNA, 33 bp, Artificial Sequence; identical to SEQ ID NO: 109
  Description of Artificial Sequence: Synthetic oligonucleotide

SEQ ID NO: 2662 - protein, 11 aa, Artificial Sequence
  Description of Artificial Sequence: Synthetic peptide
RASQGIRNDLG

SEQ ID NO: 2663 - DNA, 51 bp, Artificial Sequence; identical to SEQ ID NO: 2643
  Description of Artificial Sequence: Synthetic oligonucleotide

SEQ ID NO: 2664 - protein, 17 aa, Artificial Sequence
  Description of Artificial Sequence: Synthetic peptide
KSSQSVLFNSNNKNYLA

SEQ ID NO: 2665 - DNA, 51 bp, Artificial Sequence
  Description of Artificial Sequence: Synthetic oligonucleotide
aagtccagccagagtgttttatccagctccaacaattacaactatttagtt

SEQ ID NO: 2666 - protein, 17 aa, Artificial Sequence
  Description of Artificial Sequence: Synthetic peptide
KSSQSVLSSSNNYNYLV

SEQ ID NO: 2667 - DNA, 48 bp, Artificial Sequence; identical to SEQ ID NO: 2569
  Description of Artificial Sequence: Synthetic oligonucleotide

SEQ ID NO: 2668 - protein, 16 aa, Artificial Sequence
  Description of Artificial Sequence: Synthetic peptide
KSSQSLLHSDGRTYLY

SEQ ID NO: 2669 - DNA, 33 bp, Artificial Sequence; identical to SEQ ID NO: 2609
  Description of Artificial Sequence: Synthetic oligonucleotide

SEQ ID NO: 2670 - protein, 11 aa, Artificial Sequence
  Description of Artificial Sequence: Synthetic peptide
RASQSIGSSLH

SEQ ID NO: 2671 - DNA, 33 bp, Artificial Sequence; identical to SEQ ID NO: 2561
  Description of Artificial Sequence: Synthetic oligonucleotide

SEQ ID NO: 2672 - protein, 11 aa, Artificial Sequence
  Description of Artificial Sequence: Synthetic peptide
RTSQGIGNYLA

SEQ ID NO: 2673 - DNA, 33 bp, Artificial Sequence; identical to SEQ ID NO: 2609
  Description of Artificial Sequence: Synthetic oligonucleotide

SEQ ID NO: 2674 - protein, 11 aa, Artificial Sequence
  Description of Artificial Sequence: Synthetic peptide
RASQSIGSSLH

SEQ ID NO: 2675 - DNA, 33 bp, Artificial Sequence; identical to SEQ ID NO: 1727
  Description of Artificial Sequence: Synthetic oligonucleotide

SEQ ID NO: 2676 - protein, 11 aa, Artificial Sequence
  Description of Artificial Sequence: Synthetic peptide
RASQGIGKYLA

SEQ ID NO: 2677 - DNA, 36 bp, Artificial Sequence
  Description of Artificial Sequence: Synthetic oligonucleotide
agggccggtcaaagtattagaaccgacttcttagcc

SEQ ID NO: 2678 - protein, 12 aa, Artificial Sequence
  Description of Artificial Sequence: Synthetic peptide
RAGQSIRTDFLA

SEQ ID NO: 2679 - DNA, 33 bp, Artificial Sequence
  Description of Artificial Sequence: Synthetic oligonucleotide
aggcccagtcagagttttagcagaaacttagcc

SEQ ID NO: 2680 - protein, 11 aa, Artificial Sequence
  Description of Artificial Sequence: Synthetic peptide
RPSQSFSRNLA

SEQ ID NO: 2681 - DNA, 33 bp, Artificial Sequence
  Description of Artificial Sequence: Synthetic oligonucleotide
cgggccagtcagagtattggtagtagtttacac

SEQ ID NO: 2682 - protein, 11 aa, Artificial Sequence
  Description of Artificial Sequence: Synthetic peptide
RASQSIGSSLH

SEQ ID NO: 2683 - DNA, 33 bp, Artificial Sequence; identical to SEQ ID NO: 1727
  Description of Artificial Sequence: Synthetic oligonucleotide

SEQ ID NO: 2684 - protein, 11 aa, Artificial Sequence
  Description of Artificial Sequence: Synthetic peptide
RASQGIGKYLA

SEQ ID NO: 2685 - DNA, 33 bp, Artificial Sequence; identical to SEQ ID NO: 1727
  Description of Artificial Sequence: Synthetic oligonucleotide

SEQ ID NO: 2686 - protein, 11 aa, Artificial Sequence
  Description of Artificial Sequence: Synthetic peptide
RASQGIGKYLA

SEQ ID NO: 2687 - DNA, 51 bp, Artificial Sequence; identical to SEQ ID NO: 2643
  Description of Artificial Sequence: Synthetic oligonucleotide

SEQ ID NO: 2688 - protein, 17 aa, Artificial Sequence
  Description of Artificial Sequence: Synthetic peptide
KSSQSVLFNSNNKNYLA

SEQ ID NO: 2689 - DNA, 33 bp, Artificial Sequence; identical to SEQ ID NO: 2561
  Description of Artificial Sequence: Synthetic oligonucleotide

SEQ ID NO: 2690 - protein, 11 aa, Artificial Sequence
  Description of Artificial Sequence: Synthetic peptide
RTSQGIGNYLA

SEQ ID NO: 2691 - DNA, 33 bp, Artificial Sequence
  Description of Artificial Sequence: Synthetic oligonucleotide
cgggcgaatcagggcattaacaattatttagcc

SEQ ID NO: 2692 - protein, 11 aa, Artificial Sequence
  Description of Artificial Sequence: Synthetic peptide
RANQGINNYLA

SEQ ID NO: 2693 - DNA, 33 bp, Artificial Sequence; identical to SEQ ID NO: 105
  Description of Artificial Sequence: Synthetic oligonucleotide

SEQ ID NO: 2694 - protein, 11 aa, Artificial Sequence
  Description of Artificial Sequence: Synthetic peptide
RASQGISNYLA

SEQ ID NO: 2695 - DNA, 33 bp, Artificial Sequence
  Description of Artificial Sequence: Synthetic oligonucleotide
cgggcgagtcagggtataagtagttggatagcc

SEQ ID NO: 2696 - protein, 11 aa, Artificial Sequence
  Description of Artificial Sequence: Synthetic peptide
RASQGISSWIA

SEQ ID NO: 2697 - DNA, 36 bp, Artificial Sequence
  Description of Artificial Sequence: Synthetic oligonucleotide
agggccagtcagagtgttcgcagcagcttccttgcc

SEQ ID NO: 2698 - protein, 12 aa, Artificial Sequence
  Description of Artificial Sequence: Synthetic peptide
RASQSVRSSFLA

SEQ ID NO: 2699 - DNA, 33 bp, Artificial Sequence; identical to SEQ ID NO: 105
  Description of Artificial Sequence: Synthetic oligonucleotide

SEQ ID NO: 2700 - protein, 11 aa, Artificial Sequence
  Description of Artificial Sequence: Synthetic peptide
RASQGISNYLA

SEQ ID NO: 2701 - DNA, 36 bp, Artificial Sequence
  Description of Artificial Sequence: Synthetic oligonucleotide
agggccagtcagagtgttagcagcaacttcttagcc

SEQ ID NO: 2702 - protein, 12 aa, Artificial Sequence
  Description of Artificial Sequence: Synthetic peptide
RASQSVSSNFLA

SEQ ID NO: 2703 - DNA, 33 bp, Artificial Sequence
  Description of Artificial Sequence: Synthetic oligonucleotide
cgggcgagtcagggcattggcaattatttagcc

SEQ ID NO: 2704 - protein, 11 aa, Artificial Sequence
  Description of Artificial Sequence: Synthetic peptide
RASQGIGNYLA

SEQ ID NO: 2705 - DNA, 33 bp, Artificial Sequence; identical to SEQ ID NO: 283
  Description of Artificial Sequence: Synthetic oligonucleotide

SEQ ID NO: 2706 - protein, 11 aa, Artificial Sequence
  Description of Artificial Sequence: Synthetic peptide
RASQDISNYLA

SEQ ID NO: 2707 - DNA, 33 bp, Artificial Sequence
  Description of Artificial Sequence: Synthetic oligonucleotide
cgggccagtcagagcattggtaggagtttacac

SEQ ID NO: 2708 - protein, 11 aa, Artificial Sequence
  Description of Artificial Sequence: Synthetic peptide
RASQSIGRSLH

SEQ ID NO: 2709 - DNA, 33 bp, Artificial Sequence; identical to SEQ ID NO: 109
  Description of Artificial Sequence: Synthetic oligonucleotide

SEQ ID NO: 2710 - protein, 11 aa, Artificial Sequence
  Description of Artificial Sequence: Synthetic peptide
RASQGIRNDLG

SEQ ID NO: 2711 - DNA, 33 bp, Artificial Sequence; identical to SEQ ID NO: 2561
  Description of Artificial Sequence: Synthetic oligonucleotide

SEQ ID NO: 2712 - protein, 11 aa, Artificial Sequence
  Description of Artificial Sequence: Synthetic peptide
RTSQGIGNYLA

SEQ ID NO: 2713 - DNA, 33 bp, Artificial Sequence; identical to SEQ ID NO: 1229
  Description of Artificial Sequence: Synthetic oligonucleotide

SEQ ID NO: 2714 - protein, 11 aa, Artificial Sequence
  Description of Artificial Sequence: Synthetic peptide
RASQGIRKDLG

SEQ ID NO: 2715 - DNA, 33 bp, Artificial Sequence; identical to SEQ ID NO: 105
  Description of Artificial Sequence: Synthetic oligonucleotide

SEQ ID NO: 2716 - protein, 11 aa, Artificial Sequence
  Description of Artificial Sequence: Synthetic peptide
RASQGISNYLA

SEQ ID NO: 2717 - DNA, 36 bp, Artificial Sequence
  Description of Artificial Sequence: Synthetic oligonucleotide
agggccagtcagagtattagcagcagctacttagcc

SEQ ID NO: 2718 - protein, 12 aa, Artificial Sequence
  Description of Artificial Sequence: Synthetic peptide
RASQSISSSYLA

SEQ ID NO: 2719 - DNA, 33 bp, Artificial Sequence; identical to SEQ ID NO: 2561
  Description of Artificial Sequence: Synthetic oligonucleotide

SEQ ID NO: 2720 - protein, 11 aa, Artificial Sequence
  Description of Artificial Sequence: Synthetic peptide
RTSQGIGNYLA

SEQ ID NO: 2721 - DNA, 48 bp, Artificial Sequence; identical to SEQ ID NO: 2569
  Description of Artificial Sequence: Synthetic oligonucleotide

SEQ ID NO: 2722 - protein, 16 aa, Artificial Sequence
  Description of Artificial Sequence: Synthetic peptide
KSSQSLLHSDGRTYLY

SEQ ID NO: 2723 - DNA, 33 bp, Artificial Sequence; identical to SEQ ID NO: 1727
  Description of Artificial Sequence: Synthetic oligonucleotide

SEQ ID NO: 2724 - protein, 11 aa, Artificial Sequence
  Description of Artificial Sequence: Synthetic peptide
RASQGIGKYLA

SEQ ID NO: 2725 - DNA, 33 bp, Artificial Sequence; identical to SEQ ID NO: 529
  Description of Artificial Sequence: Synthetic oligonucleotide

SEQ ID NO: 2726 - protein, 11 aa, Artificial Sequence
  Description of Artificial Sequence: Synthetic peptide
RASQSISNYLN

SEQ ID NO: 2727 - DNA, 33 bp, Artificial Sequence; identical to SEQ ID NO: 1727
  Description of Artificial Sequence: Synthetic oligonucleotide

SEQ ID NO: 2728 - protein, 11 aa, Artificial Sequence
  Description of Artificial Sequence: Synthetic peptide
RASQGIGKYLA

SEQ ID NO: 2729 - DNA, 36 bp, Artificial Sequence
  Description of Artificial Sequence: Synthetic oligonucleotide
agggccagtcagagtgtcagaagcgacttcttagcc

SEQ ID NO: 2730 - protein, 12 aa, Artificial Sequence
  Description of Artificial Sequence: Synthetic peptide
RASQSVRSDFLA

SEQ ID NO: 2731 - DNA, 36 bp, Artificial Sequence; identical to SEQ ID NO: 2653
  Description of Artificial Sequence: Synthetic oligonucleotide

SEQ ID NO: 2732 - protein, 12 aa, Artificial Sequence
  Description of Artificial Sequence: Synthetic peptide
RASQSVRSNFLA

SEQ ID NO: 2733 - DNA, 36 bp, Artificial Sequence; identical to SEQ ID NO: 2653
  Description of Artificial Sequence: Synthetic oligonucleotide

SEQ ID NO: 2734 - protein, 12 aa, Artificial Sequence
  Description of Artificial Sequence: Synthetic peptide
RASQSVRSNFLA

SEQ ID NO: 2735 - DNA, 33 bp, Artificial Sequence; identical to SEQ ID NO: 2193
  Description of Artificial Sequence: Synthetic oligonucleotide

SEQ ID NO: 2736 - protein, 11 aa, Artificial Sequence
  Description of Artificial Sequence: Synthetic peptide
RASQGINNWLA

SEQ ID NO: 2737 - DNA, 36 bp, Artificial Sequence; identical to SEQ ID NO: 2589
  Description of Artificial Sequence: Synthetic oligonucleotide

SEQ ID NO: 2738 - protein, 12 aa, Artificial Sequence
  Description of Artificial Sequence: Synthetic peptide
RASQSIRSSFLA

SEQ ID NO: 2739 - DNA, 36 bp, Artificial Sequence
  Description of Artificial Sequence: Synthetic oligonucleotide
agggccggtcaaagtattagaaccgacttcttagtc

SEQ ID NO: 2740 - protein, 12 aa, Artificial Sequence
  Description of Artificial Sequence: Synthetic peptide
RAGQSIRTDFLV

SEQ ID NO: 2741 - DNA, 33 bp, Artificial Sequence
  Description of Artificial Sequence: Synthetic oligonucleotide
cggccgagtcagggcattagcatttatttagcc

SEQ ID NO: 2742 - protein, 11 aa, Artificial Sequence
  Description of Artificial Sequence: Synthetic peptide
RPSQGISIYLA

SEQ ID NO: 2743 - DNA, 51 bp, Artificial Sequence
  Description of Artificial Sequence: Synthetic oligonucleotide
aagtccagccagagtgttttatacagctccaacaattataactacttgact

SEQ ID NO: 2744 - protein, 17 aa, Artificial Sequence
  Description of Artificial Sequence: Synthetic peptide
KSSQSVLYSSNNYNYLT

SEQ ID NO: 2745 - DNA, 33 bp, Artificial Sequence; identical to SEQ ID NO: 821
  Description of Artificial Sequence: Synthetic oligonucleotide

SEQ ID NO: 2746 - protein, 11 aa, Artificial Sequence
  Description of Artificial Sequence: Synthetic peptide
RASQGIRNDLG

SEQ ID NO: 2747 - DNA, 33 bp, Artificial Sequence; identical to SEQ ID NO: 2609
  Description of Artificial Sequence: Synthetic oligonucleotide

SEQ ID NO: 2748 - protein, 11 aa, Artificial Sequence
  Description of Artificial Sequence: Synthetic peptide
RASQSIGSSLH

SEQ ID NO: 2749 - DNA, 36 bp, Artificial Sequence
  Description of Artificial Sequence: Synthetic oligonucleotide
agggccagtcagagtgttaggagcggttacttagcc

SEQ ID NO: 2750 - protein, 12 aa, Artificial Sequence
  Description of Artificial Sequence: Synthetic peptide
RASQSVRSGYLA

SEQ ID NO: 2751 - DNA, 36 bp, Artificial Sequence; identical to SEQ ID NO: 2593
  Description of Artificial Sequence: Synthetic oligonucleotide

SEQ ID NO: 2752 - protein, 12 aa, Artificial Sequence
  Description of Artificial Sequence: Synthetic peptide
RAGQSIRTNFLA

SEQ ID NO: 2753 - DNA, 33 bp, Artificial Sequence; identical to SEQ ID NO: 1727
  Description of Artificial Sequence: Synthetic oligonucleotide

SEQ ID NO: 2754 - protein, 11 aa, Artificial Sequence
  Description of Artificial Sequence: Synthetic peptide
RASQGIGKYLA

SEQ ID NO: 2755 - DNA, 33 bp, Artificial Sequence; identical to SEQ ID NO: 109
  Description of Artificial Sequence: Synthetic oligonucleotide

SEQ ID NO: 2756 - protein, 11 aa, Artificial Sequence
  Description of Artificial Sequence: Synthetic peptide
RASQGIRNDLG

SEQ ID NO: 2757 - DNA, 36 bp, Artificial Sequence; identical to SEQ ID NO: 2589
  Description of Artificial Sequence: Synthetic oligonucleotide

SEQ ID NO: 2758 - protein, 12 aa, Artificial Sequence
  Description of Artificial Sequence: Synthetic peptide
RASQSIRSSFLA

SEQ ID NO: 2759 - DNA, 36 bp, Artificial Sequence
  Description of Artificial Sequence: Synthetic oligonucleotide
agggccagtcagagtataaggaccaacttcttagcc

SEQ ID NO: 2760 - protein, 12 aa, Artificial Sequence
  Description of Artificial Sequence: Synthetic peptide
RASQSIRTNFLA

SEQ ID NO: 2761 - DNA, 33 bp, Artificial Sequence
  Description of Artificial Sequence: Synthetic oligonucleotide
cgggcgagtcagggcgttagcaatcatttagcc

SEQ ID NO: 2762 - protein, 11 aa, Artificial Sequence
  Description of Artificial Sequence: Synthetic peptide
RASQGVSNHLA

SEQ ID NO: 2763 - DNA, 36 bp, Artificial Sequence
  Description of Artificial Sequence: Synthetic oligonucleotide
agggccagtcagagtgttagaaccaacttcttagcc

SEQ ID NO: 2764 - protein, 12 aa, Artificial Sequence
  Description of Artificial Sequence: Synthetic peptide
RASQSVRTNFLA

SEQ ID NO: 2765 - DNA, 33 bp, Artificial Sequence; identical to SEQ ID NO: 2707
  Description of Artificial Sequence: Synthetic oligonucleotide

SEQ ID NO: 2766 - protein, 11 aa, Artificial Sequence
  Description of Artificial Sequence: Synthetic peptide
RASQSIGRSLH

SEQ ID NO: 2767 - DNA, 33 bp, Artificial Sequence; identical to SEQ ID NO: 105
  Description of Artificial Sequence: Synthetic oligonucleotide

SEQ ID NO: 2768 - protein, 11 aa, Artificial Sequence
  Description of Artificial Sequence: Synthetic peptide
RASQGISNYLA

SEQ ID NO: 2769 - DNA, 36 bp, Artificial Sequence
  Description of Artificial Sequence: Synthetic oligonucleotide
agggccagtccgagtgttagcagcagctacttagcc

SEQ ID NO: 2770 - protein, 12 aa, Artificial Sequence
  Description of Artificial Sequence: Synthetic peptide
RASPSVSSSYLA

SEQ ID NO: 2771 - DNA, 36 bp, Artificial Sequence; identical to SEQ ID NO: 2589
  Description of Artificial Sequence: Synthetic oligonucleotide

SEQ ID NO: 2772 - protein, 12 aa, Artificial Sequence
  Description of Artificial Sequence: Synthetic peptide
RASQSIRSSFLA

SEQ ID NO: 2773 - DNA, 33 bp, Artificial Sequence; identical to SEQ ID NO: 1505
  Description of Artificial Sequence: Synthetic oligonucleotide

SEQ ID NO: 2774 - protein, 11 aa, Artificial Sequence
  Description of Artificial Sequence: Synthetic peptide
RASQSVSSSLA

SEQ ID NO: 2775 - DNA, 33 bp, Artificial Sequence; identical to SEQ ID NO: 105
  Description of Artificial Sequence: Synthetic oligonucleotide

SEQ ID NO: 2776 - protein, 11 aa, Artificial Sequence
  Description of Artificial Sequence: Synthetic peptide
RASQGISNYLA

SEQ ID NO: 2777 - DNA, 33 bp, Artificial Sequence; identical to SEQ ID NO: 2559
  Description of Artificial Sequence: Synthetic oligonucleotide

SEQ ID NO: 2778 - protein, 11 aa, Artificial Sequence
  Description of Artificial Sequence: Synthetic peptide
RASQSIGSNLH

SEQ ID NO: 2779 - DNA, 36 bp, Artificial Sequence
  Description of Artificial Sequence: Synthetic oligonucleotide
agggccagtcggggtgttagcaacatctacttagcc

SEQ ID NO: 2780 - protein, 12 aa, Artificial Sequence
  Description of Artificial Sequence: Synthetic peptide
RASRGVSNIYLA

SEQ ID NO: 2781 - DNA, 48 bp, Artificial Sequence; identical to SEQ ID NO: 2569
  Description of Artificial Sequence: Synthetic oligonucleotide

SEQ ID NO: 2782 - protein, 16 aa, Artificial Sequence
  Description of Artificial Sequence: Synthetic peptide
KSSQSLLHSDGRTYLY

SEQ ID NO: 2783 - DNA, 36 bp, Artificial Sequence; identical to SEQ ID NO: 2593
  Description of Artificial Sequence: Synthetic oligonucleotide

SEQ ID NO: 2784 - protein, 12 aa, Artificial Sequence
  Description of Artificial Sequence: Synthetic peptide
RAGQSIRTNFLA

SEQ ID NO: 2785 - DNA, 36 bp, Artificial Sequence
  Description of Artificial Sequence: Synthetic oligonucleotide
agggccagtcagagtattagaagcaacttcttagcc

SEQ ID NO: 2786 - protein, 12 aa, Artificial Sequence
  Description of Artificial Sequence: Synthetic peptide
RASQSIRSNFLA

SEQ ID NO: 2787 - DNA, 33 bp, Artificial Sequence; identical to SEQ ID NO: 2147
  Description of Artificial Sequence: Synthetic oligonucleotide

SEQ ID NO: 2788 - protein, 11 aa, Artificial Sequence
  Description of Artificial Sequence: Synthetic peptide
RASQGISKYLA

SEQ ID NO: 2789 - DNA, 33 bp, Artificial Sequence; identical to SEQ ID NO: 173
  Description of Artificial Sequence: Synthetic oligonucleotide

SEQ ID NO: 2790 - protein, 11 aa, Artificial Sequence
  Description of Artificial Sequence: Synthetic peptide
RASQGISRWLA

SEQ ID NO: 2791 - DNA, 36 bp, Artificial Sequence
  Description of Artificial Sequence: Synthetic oligonucleotide
agggccagtccgagtgttaacagcggctacttagcc

SEQ ID NO: 2792 - protein, 12 aa, Artificial Sequence
  Description of Artificial Sequence: Synthetic peptide
RASPSVNSGYLA

SEQ ID NO: 2793 - DNA, 33 bp, Artificial Sequence; identical to SEQ ID NO: 109
  Description of Artificial Sequence: Synthetic oligonucleotide

SEQ ID NO: 2794 - protein, 11 aa, Artificial Sequence
  Description of Artificial Sequence: Synthetic peptide
RASQGIRNDLG

SEQ ID NO: 2795 - DNA, 33 bp, Artificial Sequence; identical to SEQ ID NO: 105
  Description of Artificial Sequence: Synthetic oligonucleotide

SEQ ID NO: 2796 - protein, 11 aa, Artificial Sequence
  Description of Artificial Sequence: Synthetic peptide
RASQGISNYLA

SEQ ID NO: 2797 - DNA, 33 bp, Artificial Sequence
  Description of Artificial Sequence: Synthetic oligonucleotide
cgggcgagtcagggcattggcaagtatttagca

SEQ ID NO: 2798 - protein, 11 aa, Artificial Sequence
  Description of Artificial Sequence: Synthetic peptide
RASQGIGKYLA

SEQ ID NO: 2799 - DNA, 36 bp, Artificial Sequence
  Description of Artificial Sequence: Synthetic oligonucleotide
agggccagtccgagtgttaacagtaactacttagcc

SEQ ID NO: 2800 - protein, 12 aa, Artificial Sequence
  Description of Artificial Sequence: Synthetic peptide
RASPSVNSNYLA

SEQ ID NO: 2801 - DNA, 33 bp, Artificial Sequence; identical to SEQ ID NO: 173
  Description of Artificial Sequence: Synthetic oligonucleotide

SEQ ID NO: 2802 - protein, 11 aa, Artificial Sequence
  Description of Artificial Sequence: Synthetic peptide
RASQGISRWLA

SEQ ID NO: 2803 - DNA, 33 bp, Artificial Sequence; identical to SEQ ID NO: 2609
  Description of Artificial Sequence: Synthetic oligonucleotide

SEQ ID NO: 2804 - protein, 11 aa, Artificial Sequence
  Description of Artificial Sequence: Synthetic peptide
RASQSIGSSLH

SEQ ID NO: 2805 - DNA, 33 bp, Artificial Sequence; identical to SEQ ID NO: 2579
  Description of Artificial Sequence: Synthetic oligonucleotide

SEQ ID NO: 2806 - protein, 11 aa, Artificial Sequence
  Description of Artificial Sequence: Synthetic peptide
RTSQGIGKYLA

SEQ ID NO: 2807 - DNA, 36 bp, Artificial Sequence; identical to SEQ ID NO: 2589
  Description of Artificial Sequence: Synthetic oligonucleotide

SEQ ID NO: 2808 - protein, 12 aa, Artificial Sequence
  Description of Artificial Sequence: Synthetic peptide
RASQSIRSSFLA

SEQ ID NO: 2809 - DNA, 33 bp, Artificial Sequence; identical to SEQ ID NO: 105
  Description of Artificial Sequence: Synthetic oligonucleotide

SEQ ID NO: 2810 - protein, 11 aa, Artificial Sequence
  Description of Artificial Sequence: Synthetic peptide
RASQGISNYLA

SEQ ID NO: 2811 - DNA, 33 bp, Artificial Sequence; identical to SEQ ID NO: 123
  Description of Artificial Sequence: Synthetic oligonucleotide

SEQ ID NO: 2812 - protein, 11 aa, Artificial Sequence
  Description of Artificial Sequence: Synthetic peptide
RASQGIRKDLG

SEQ ID NO: 2813 - DNA, 33 bp, Artificial Sequence; identical to SEQ ID NO: 2609
  Description of Artificial Sequence: Synthetic oligonucleotide

SEQ ID NO: 2814 - protein, 11 aa, Artificial Sequence
  Description of Artificial Sequence: Synthetic peptide
RASQSIGSSLH

SEQ ID NO: 2815 - DNA, 33 bp, Artificial Sequence; identical to SEQ ID NO: 2609
  Description of Artificial Sequence: Synthetic oligonucleotide

SEQ ID NO: 2816 - protein, 11 aa, Artificial Sequence
  Description of Artificial Sequence: Synthetic peptide
RASQSIGSSLH

SEQ ID NO: 2817 - DNA, 51 bp, Artificial Sequence; identical to SEQ ID NO: 2643
  Description of Artificial Sequence: Synthetic oligonucleotide

SEQ ID NO: 2818 - protein, 17 aa, Artificial Sequence
  Description of Artificial Sequence: Synthetic peptide
KSSQSVLFNSNNKNYLA

SEQ ID NO: 2819 - DNA, 33 bp, Artificial Sequence; identical to SEQ ID NO: 2193
  Description of Artificial Sequence: Synthetic oligonucleotide

SEQ ID NO: 2820 - protein, 11 aa, Artificial Sequence
  Description of Artificial Sequence: Synthetic peptide
RASQGINNWLA

SEQ ID NO: 2821 - DNA, 51 bp, Artificial Sequence
  Description of Artificial Sequence: Synthetic oligonucleotide
aagtccagccagagtattttattcagctccaacaataagaggtacttagct

SEQ ID NO: 2822 - protein, 17 aa, Artificial Sequence
  Description of Artificial Sequence: Synthetic peptide
KSSQSILFSSNNKRYLA

SEQ ID NO: 2823 - DNA, 51 bp, Artificial Sequence; identical to SEQ ID NO: 2643
  Description of Artificial Sequence: Synthetic oligonucleotide

SEQ ID NO: 2824 - protein, 17 aa, Artificial Sequence
  Description of Artificial Sequence: Synthetic peptide
KSSQSVLFNSNNKNYLA

SEQ ID NO: 2825 - DNA, 33 bp, Artificial Sequence; identical to SEQ ID NO: 171
  Description of Artificial Sequence: Synthetic oligonucleotide

SEQ ID NO: 2826 - protein, 11 aa, Artificial Sequence
  Description of Artificial Sequence: Synthetic peptide
RASQGISSWLA

SEQ ID NO: 2827 - DNA, 33 bp, Artificial Sequence
  Description of Artificial Sequence: Synthetic oligonucleotide
cgggcaagtcagcgcattcacagctatttaaat

SEQ ID NO: 2828 - protein, 11 aa, Artificial Sequence
  Description of Artificial Sequence: Synthetic peptide
RASQRIHSYLN

SEQ ID NO: 2829 - DNA, 33 bp, Artificial Sequence
  Description of Artificial Sequence: Synthetic oligonucleotide
cgggcgaatcaggccattagcaattatttagcc

SEQ ID NO: 2830 - protein, 11 aa, Artificial Sequence
  Description of Artificial Sequence: Synthetic peptide
RANQAISNYLA

SEQ ID NO: 2831 - DNA, 51 bp, Artificial Sequence; identical to SEQ ID NO: 1057
  Description of Artificial Sequence: Synthetic oligonucleotide

SEQ ID NO: 2832 - protein, 17 aa, Artificial Sequence
  Description of Artificial Sequence: Synthetic peptide
KSSQSVLHSSNNNNYLA

SEQ ID NO: 2833 - DNA, 33 bp, Artificial Sequence
  Description of Artificial Sequence: Synthetic oligonucleotide
cgggcgagtcagggtattagcaactgcttagcc

SEQ ID NO: 2834 - protein, 11 aa, Artificial Sequence
  Description of Artificial Sequence: Synthetic peptide
RASQGISNCLA

SEQ ID NO: 2835 - DNA, 33 bp, Artificial Sequence; identical to SEQ ID NO: 173
  Description of Artificial Sequence: Synthetic oligonucleotide

SEQ ID NO: 2836 - protein, 11 aa, Artificial Sequence
  Description of Artificial Sequence: Synthetic peptide
RASQGISRWLA

SEQ ID NO: 2837 - DNA, 33 bp, Artificial Sequence; identical to SEQ ID NO: 109
  Description of Artificial Sequence: Synthetic oligonucleotide

SEQ ID NO: 2838 - protein, 11 aa, Artificial Sequence
  Description of Artificial Sequence: Synthetic peptide
RASQGIRNDLG

SEQ ID NO: 2839 - DNA, 36 bp, Artificial Sequence
  Description of Artificial Sequence: Synthetic oligonucleotide
agggccagtccgagtgttagcaacagcttcttagcc

SEQ ID NO: 2840 - protein, 12 aa, Artificial Sequence
  Description of Artificial Sequence: Synthetic peptide
RASPSVSNSFLA

SEQ ID NO: 2841 - DNA, 33 bp, Artificial Sequence
  Description of Artificial Sequence: Synthetic oligonucleotide
cgggcaagtcagggcattagaaatgatctaggc

SEQ ID NO: 2842 - protein, 11 aa, Artificial Sequence
  Description of Artificial Sequence: Synthetic peptide
RASQGIRNDLG

SEQ ID NO: 2843 - DNA, 36 bp, Artificial Sequence; identical to SEQ ID NO: 2653
  Description of Artificial Sequence: Synthetic oligonucleotide

SEQ ID NO: 2844 - protein, 12 aa, Artificial Sequence
  Description of Artificial Sequence: Synthetic peptide
RASQSVRSNFLA

SEQ ID NO: 2845 - DNA, 33 bp, Artificial Sequence; identical to SEQ ID NO: 2561
  Description of Artificial Sequence: Synthetic oligonucleotide

SEQ ID NO: 2846 - protein, 11 aa, Artificial Sequence
  Description of Artificial Sequence: Synthetic peptide
RTSQGIGNYLA

SEQ ID NO: 2847 - DNA, 33 bp, Artificial Sequence
  Description of Artificial Sequence: Synthetic oligonucleotide
cgggcgagtcagggcattggcaatcatttagcc

SEQ ID NO: 2848 - protein, 11 aa, Artificial Sequence
  Description of Artificial Sequence: Synthetic peptide
RASQGIGNHLA

SEQ ID NO: 2849 - DNA, 36 bp, Artificial Sequence; identical to SEQ ID NO: 2589
  Description of Artificial Sequence: Synthetic oligonucleotide

SEQ ID NO: 2850 - protein, 12 aa, Artificial Sequence
  Description of Artificial Sequence: Synthetic peptide
RASQSIRSSFLA

SEQ ID NO: 2851 - DNA, 51 bp, Artificial Sequence
  Description of Artificial Sequence: Synthetic oligonucleotide
aggtccagccagagtgttttacacagcttcaacaattacaactacttagct

SEQ ID NO: 2852 - protein, 17 aa, Artificial Sequence
  Description of Artificial Sequence: Synthetic peptide
RSSQSVLHSFNNYNYLA

SEQ ID NO: 2853 - DNA, 33 bp, Artificial Sequence
  Description of Artificial Sequence: Synthetic oligonucleotide
cgggcgagtcagggcattggcaaatatttagcc

SEQ ID NO: 2854 - protein, 11 aa, Artificial Sequence
  Description of Artificial Sequence: Synthetic peptide
RASQGIGKYLA

SEQ ID NO: 2855 - DNA, 51 bp, Artificial Sequence; identical to SEQ ID NO: 2583
  Description of Artificial Sequence: Synthetic oligonucleotide

SEQ ID NO: 2856 - protein, 17 aa, Artificial Sequence
  Description of Artificial Sequence: Synthetic peptide
RSSQSVLHSSNNYNYLA

SEQ ID NO: 2857 - DNA, 51 bp, Artificial Sequence
  Description of Artificial Sequence: Synthetic oligonucleotide
aagtccagccagagtgttttacacagttccaacaataagaactacttagct

SEQ ID NO: 2858 - protein, 17 aa, Artificial Sequence
  Description of Artificial Sequence: Synthetic peptide
KSSQSVLHSSNNKNYLA

SEQ ID NO: 2859 - DNA, 48 bp, Artificial Sequence
  Description of Artificial Sequence: Synthetic oligonucleotide
aagtctagtcagaacctcctgcatagtgatggaaagacctatttgtat

SEQ ID NO: 2860 - protein, 16 aa, Artificial Sequence
  Description of Artificial Sequence: Synthetic peptide
KSSQNLLHSDGKTYLY

SEQ ID NO: 2861 - DNA, 33 bp, Artificial Sequence; identical to SEQ ID NO: 553
  Description of Artificial Sequence: Synthetic oligonucleotide

SEQ ID NO: 2862 - protein, 11 aa, Artificial Sequence
  Description of Artificial Sequence: Synthetic peptide
RASQGISNWLA

SEQ ID NO: 2863 - DNA, 33 bp, Artificial Sequence; identical to SEQ ID NO: 109
  Description of Artificial Sequence: Synthetic oligonucleotide

SEQ ID NO: 2864 - protein, 11 aa, Artificial Sequence
  Description of Artificial Sequence: Synthetic peptide
RASQGIRNDLG

SEQ ID NO: 2865 - DNA, 33 bp, Artificial Sequence
  Description of Artificial Sequence: Synthetic oligonucleotide
cgggcgagtcagggcattaacaagtatttatcc

SEQ ID NO: 2866 - protein, 11 aa, Artificial Sequence
  Description of Artificial Sequence: Synthetic peptide
RASQGINKYLS

SEQ ID NO: 2867 - DNA, 33 bp, Artificial Sequence; identical to SEQ ID NO: 2561
  Description of Artificial Sequence: Synthetic oligonucleotide

SEQ ID NO: 2868 - protein, 11 aa, Artificial Sequence
  Description of Artificial Sequence: Synthetic peptide
RTSQGIGNYLA

SEQ ID NO: 2869 - DNA, 36 bp, Artificial Sequence; identical to SEQ ID NO: 2593
  Description of Artificial Sequence: Synthetic oligonucleotide

SEQ ID NO: 2870 - protein, 12 aa, Artificial Sequence
  Description of Artificial Sequence: Synthetic peptide
RAGQSIRTNFLA

SEQ ID NO: 2871 - DNA, 36 bp, Artificial Sequence
  Description of Artificial Sequence: Synthetic oligonucleotide
agggccagtcagagtataaggagcaacttcttagcc

SEQ ID NO: 2872 - protein, 12 aa, Artificial Sequence
  Description of Artificial Sequence: Synthetic peptide
RASQSIRSNFLA

SEQ ID NO: 2873 - DNA, 36 bp, Artificial Sequence
  Description of Artificial Sequence: Synthetic oligonucleotide
agggccagtcagagtgttagaagcagctacttagcc

SEQ ID NO: 2874 - protein, 12 aa, Artificial Sequence
  Description of Artificial Sequence: Synthetic peptide
RASQSVRSSYLA

SEQ ID NO: 2875 - DNA, 33 bp, Artificial Sequence; identical to SEQ ID NO: 2703
  Description of Artificial Sequence: Synthetic oligonucleotide

SEQ ID NO: 2876 - protein, 11 aa, Artificial Sequence
  Description of Artificial Sequence: Synthetic peptide
RASQGIGNYLA

SEQ ID NO: 2877 - DNA, 33 bp, Artificial Sequence; identical to SEQ ID NO: 123
  Description of Artificial Sequence: Synthetic oligonucleotide

SEQ ID NO: 2878 - protein, 11 aa, Artificial Sequence
  Description of Artificial Sequence: Synthetic peptide
RASQGIRKDLG

SEQ ID NO: 2879 - DNA, 48 bp, Artificial Sequence
  Description of Artificial Sequence: Synthetic oligonucleotide
aagtctagtcagagcctcctctatagtgatggaaggacctatttgtat

SEQ ID NO: 2880 - protein, 16 aa, Artificial Sequence
  Description of Artificial Sequence: Synthetic peptide
KSSQSLLYSDGRTYLY

SEQ ID NO: 2881 - DNA, 36 bp, Artificial Sequence; identical to SEQ ID NO: 2589
  Description of Artificial Sequence: Synthetic oligonucleotide

SEQ ID NO: 2882 - protein, 12 aa, Artificial Sequence
  Description of Artificial Sequence: Synthetic peptide
RASQSIRSSFLA

SEQ ID NO: 2883 - DNA, 36 bp, Artificial Sequence; identical to SEQ ID NO: 2589
  Description of Artificial Sequence: Synthetic oligonucleotide

SEQ ID NO: 2884 - protein, 12 aa, Artificial Sequence
  Description of Artificial Sequence: Synthetic peptide
RASQSIRSSFLA

SEQ ID NO: 2885 - DNA, 33 bp, Artificial Sequence; identical to SEQ ID NO: 109
  Description of Artificial Sequence: Synthetic oligonucleotide

SEQ ID NO: 2886 - protein, 11 aa, Artificial Sequence
  Description of Artificial Sequence: Synthetic peptide
RASQGIRNDLG

SEQ ID NO: 2887 - DNA, 33 bp, Artificial Sequence; identical to SEQ ID NO: 1751
  Description of Artificial Sequence: Synthetic oligonucleotide

SEQ ID NO: 2888 - protein, 11 aa, Artificial Sequence
  Description of Artificial Sequence: Synthetic peptide
RASQGISKYLA

SEQ ID NO: 2889 - DNA, 33 bp, Artificial Sequence; identical to SEQ ID NO: 2679
  Description of Artificial Sequence: Synthetic oligonucleotide

SEQ ID NO: 2890 - protein, 11 aa, Artificial Sequence
  Description of Artificial Sequence: Synthetic peptide
RPSQSFSRNLA

SEQ ID NO: 2891 - DNA, 33 bp, Artificial Sequence; identical to SEQ ID NO: 123
  Description of Artificial Sequence: Synthetic oligonucleotide

SEQ ID NO: 2892 - protein, 11 aa, Artificial Sequence
  Description of Artificial Sequence: Synthetic peptide
RASQGIRKDLG

SEQ ID NO: 2893 - DNA, 36 bp, Artificial Sequence; identical to SEQ ID NO: 2759
  Description of Artificial Sequence: Synthetic oligonucleotide

SEQ ID NO: 2894 - protein, 12 aa, Artificial Sequence
  Description of Artificial Sequence: Synthetic peptide
RASQSIRTNFLA

SEQ ID NO: 2895 - DNA, 36 bp, Artificial Sequence; identical to SEQ ID NO: 2873
  Description of Artificial Sequence: Synthetic oligonucleotide

SEQ ID NO: 2896 - protein, 12 aa, Artificial Sequence
  Description of Artificial Sequence: Synthetic peptide
RASQSVRSSYLA

SEQ ID NO: 2897 - DNA, 33 bp, Artificial Sequence; identical to SEQ ID NO: 501
  Description of Artificial Sequence: Synthetic oligonucleotide

SEQ ID NO: 2898 - protein, 11 aa, Artificial Sequence
  Description of Artificial Sequence: Synthetic peptide
RASQSISSYLN

SEQ ID NO: 2899 - DNA, 33 bp, Artificial Sequence; identical to SEQ ID NO: 205
  Description of Artificial Sequence: Synthetic oligonucleotide

SEQ ID NO: 2900 - protein, 11 aa, Artificial Sequence
  Description of Artificial Sequence: Synthetic peptide
RASQDIRNDLG

SEQ ID NO: 2901 - DNA, 33 bp, Artificial Sequence
  Description of Artificial Sequence: Synthetic oligonucleotide
cgggccagtcagaacattggtaataccttgcac

SEQ ID NO: 2902 - protein, 11 aa, Artificial Sequence
  Description of Artificial Sequence: Synthetic peptide
RASQNIGNTLH

SEQ ID NO: 2903 - DNA, 51 bp, Artificial Sequence; identical to SEQ ID NO: 1057
  Description of Artificial Sequence: Synthetic oligonucleotide

SEQ ID NO: 2904 - protein, 17 aa, Artificial Sequence
  Description of Artificial Sequence: Synthetic peptide
KSSQSVLHSSNNNNYLA

SEQ ID NO: 2905 - DNA, 33 bp, Artificial Sequence; identical to SEQ ID NO: 2559
  Description of Artificial Sequence: Synthetic oligonucleotide

SEQ ID NO: 2906 - protein, 11 aa, Artificial Sequence
  Description of Artificial Sequence: Synthetic peptide
RASQSIGSNLH

SEQ ID NO: 2907 - DNA, 33 bp, Artificial Sequence
  Description of Artificial Sequence: Synthetic oligonucleotide
cgggcaactcagggcattagaaaagatttaggc

SEQ ID NO: 2908 - protein, 11 aa, Artificial Sequence
  Description of Artificial Sequence: Synthetic peptide
RATQGIRKDLG

SEQ ID NO: 2909 - DNA, 36 bp, Artificial Sequence
  Description of Artificial Sequence: Synthetic oligonucleotide
agggccagtcagaatattcgcagcagcttcttagcc

SEQ ID NO: 2910 - protein, 12 aa, Artificial Sequence
  Description of Artificial Sequence: Synthetic peptide
RASQNIRSSFLA

SEQ ID NO: 2911 - DNA, 33 bp, Artificial Sequence; identical to SEQ ID NO: 109
  Description of Artificial Sequence: Synthetic oligonucleotide

SEQ ID NO: 2912 - protein, 11 aa, Artificial Sequence
  Description of Artificial Sequence: Synthetic peptide
RASQGIRNDLG

SEQ ID NO: 2913 - DNA, 33 bp, Artificial Sequence
  Description of Artificial Sequence: Synthetic oligonucleotide
cgggcaagtcagggcattaggaatgatttaggc

SEQ ID NO: 2914 - protein, 11 aa, Artificial Sequence
  Description of Artificial Sequence: Synthetic peptide
RASQGIRNDLG

SEQ ID NO: 2915 - DNA, 36 bp, Artificial Sequence
  Description of Artificial Sequence: Synthetic oligonucleotide
agggccagtccgagtattaacagcggcttcttagcc

SEQ ID NO: 2916 - protein, 12 aa, Artificial Sequence
  Description of Artificial Sequence: Synthetic peptide
RASPSINSGFLA

SEQ ID NO: 2917 - DNA, 39 bp, Artificial Sequence
  Description of Artificial Sequence: Synthetic oligonucleotide
tctggaagcaactccaacatcggaagtaatattgtaacc

SEQ ID NO: 2918 - protein, 13 aa, Artificial Sequence
  Description of Artificial Sequence: Synthetic peptide
SGSNSNIGSNIVT

SEQ ID NO: 2919 - DNA, 33 bp, Artificial Sequence
  Description of Artificial Sequence: Synthetic oligonucleotide
agggccagtcagaatattaaaaacaacttagcc

SEQ ID NO: 2920 - protein, 11 aa, Artificial Sequence
  Description of Artificial Sequence: Synthetic peptide
RASQNIKNNLA

SEQ ID NO: 2921 - DNA, 36 bp, Artificial Sequence
  Description of Artificial Sequence: Synthetic oligonucleotide
agggccagtcagagtgttagcagcaactacttagcc

SEQ ID NO: 2922 - protein, 12 aa, Artificial Sequence
  Description of Artificial Sequence: Synthetic peptide
RASQSVSSNYLA

SEQ ID NO: 2923 - DNA, 33 bp, Artificial Sequence
  Description of Artificial Sequence: Synthetic oligonucleotide
cgggccagtcagaacattggtcgtagtttacac

SEQ ID NO: 2924 - protein, 11 aa, Artificial Sequence
  Description of Artificial Sequence: Synthetic peptide
RASQNIGRSLH

SEQ ID NO: 2925 - DNA, 33 bp, Artificial Sequence; identical to SEQ ID NO: 109
  Description of Artificial Sequence: Synthetic oligonucleotide

SEQ ID NO: 2926 - protein, 11 aa, Artificial Sequence
  Description of Artificial Sequence: Synthetic peptide
RASQGIRNDLG

SEQ ID NO: 2927 - DNA, 33 bp, Artificial Sequence
  Description of Artificial Sequence: Synthetic oligonucleotide
cgggcaagtcacaacattaacagctatttaaat

SEQ ID NO: 2928 - protein, 11 aa, Artificial Sequence
  Description of Artificial Sequence: Synthetic peptide
RASHNINSYLN

SEQ ID NO: 2929 - DNA, 48 bp, Artificial Sequence
  Description of Artificial Sequence: Synthetic oligonucleotide
aggtctagtcagagcctcctccataataatagatacaaccatttggat

SEQ ID NO: 2930 - protein, 16 aa, Artificial Sequence
  Description of Artificial Sequence: Synthetic peptide
RSSQSLLHNNRYNHLD

SEQ ID NO: 2931 - DNA, 33 bp, Artificial Sequence; identical to SEQ ID NO: 109
  Description of Artificial Sequence: Synthetic oligonucleotide

SEQ ID NO: 2932 - protein, 11 aa, Artificial Sequence
  Description of Artificial Sequence: Synthetic peptide
RASQGIRNDLG

SEQ ID NO: 2933 - DNA, 33 bp, Artificial Sequence
  Description of Artificial Sequence: Synthetic oligonucleotide
aggtccagtcagaatattaaaagcaacttagcc

SEQ ID NO: 2934 - protein, 11 aa, Artificial Sequence
  Description of Artificial Sequence: Synthetic peptide
RSSQNIKSNLA

SEQ ID NO: 2935 - DNA, 33 bp, Artificial Sequence
  Description of Artificial Sequence: Synthetic oligonucleotide
agggccagtcagagaattaacaacaacttagcc

SEQ ID NO: 2936 - protein, 11 aa, Artificial Sequence
  Description of Artificial Sequence: Synthetic peptide
RASQRINNNLA

SEQ ID NO: 2937 - DNA, 48 bp, Artificial Sequence
  Description of Artificial Sequence: Synthetic oligonucleotide
aggtctagtcagagcctcctgcataataataaatacaaccatttggat

SEQ ID NO: 2938 - protein, 16 aa, Artificial Sequence
  Description of Artificial Sequence: Synthetic peptide
RSSQSLLHNNKYNHLD

SEQ ID NO: 2939 - DNA, 36 bp, Artificial Sequence
  Description of Artificial Sequence: Synthetic oligonucleotide
agggccagtcagagtgttaacagcggctacttagcc

SEQ ID NO: 2940 - protein, 12 aa, Artificial Sequence
  Description of Artificial Sequence: Synthetic peptide
RASQSVNSGYLA

SEQ ID NO: 2941 - DNA, 33 bp, Artificial Sequence
  Description of Artificial Sequence: Synthetic oligonucleotide
agggccagtcagagtgttctgaacaacttagcc

SEQ ID NO: 2942 - protein, 11 aa, Artificial Sequence
  Description of Artificial Sequence: Synthetic peptide
RASQSVLNNLA

SEQ ID NO: 2943 - DNA, 33 bp, Artificial Sequence; identical to SEQ ID NO: 2703
  Description of Artificial Sequence: Synthetic oligonucleotide

SEQ ID NO: 2944 - protein, 11 aa, Artificial Sequence
  Description of Artificial Sequence: Synthetic peptide
RASQGIGNYLA

SEQ ID NO: 2945 - DNA, 33 bp, Artificial Sequence; identical to SEQ ID NO: 2927
  Description of Artificial Sequence: Synthetic oligonucleotide

SEQ ID NO: 2946 - protein, 11 aa, Artificial Sequence
  Description of Artificial Sequence: Synthetic peptide
RASHNINSYLN

SEQ ID NO: 2947 - DNA, 33 bp, Artificial Sequence; identical to SEQ ID NO: 113
  Description of Artificial Sequence: Synthetic oligonucleotide

SEQ ID NO: 2948 - protein, 11 aa, Artificial Sequence
  Description of Artificial Sequence: Synthetic peptide
RASQGIRHDLG

SEQ ID NO: 2949 - DNA, 33 bp, Artificial Sequence; identical to SEQ ID NO: 109
  Description of Artificial Sequence: Synthetic oligonucleotide

SEQ ID NO: 2950 - protein, 11 aa, Artificial Sequence
  Description of Artificial Sequence: Synthetic peptide
RASQGIRNDLG

SEQ ID NO: 2951 - DNA, 51 bp, Artificial Sequence
  Description of Artificial Sequence: Synthetic oligonucleotide
aagtccagccagagtgtttttttccactcgaacaataagaactacttagct

SEQ ID NO: 2952 - protein, 17 aa, Artificial Sequence
  Description of Artificial Sequence: Synthetic peptide
KSSQSVFFHSNNKNYLA

SEQ ID NO: 2953 - DNA, 51 bp, Artificial Sequence
  Description of Artificial Sequence: Synthetic oligonucleotide
aagtccagccagagtgttttatacagttccaacaataagaactacttagtt

SEQ ID NO: 2954 - protein, 17 aa, Artificial Sequence
  Description of Artificial Sequence: Synthetic peptide
KSSQSVLYSSNNKNYLV

SEQ ID NO: 2955 - DNA, 33 bp, Artificial Sequence; identical to SEQ ID NO: 109
  Description of Artificial Sequence: Synthetic oligonucleotide

SEQ ID NO: 2956 - protein, 11 aa, Artificial Sequence
  Description of Artificial Sequence: Synthetic peptide
RASQGIRNDLG

SEQ ID NO: 2957 - DNA, 33 bp, Artificial Sequence; identical to SEQ ID NO: 2927
  Description of Artificial Sequence: Synthetic oligonucleotide

SEQ ID NO: 2958 - protein, 11 aa, Artificial Sequence
  Description of Artificial Sequence: Synthetic peptide
RASHNINSYLN

SEQ ID NO: 2959 - DNA, 33 bp, Artificial Sequence
  Description of Artificial Sequence: Synthetic oligonucleotide
agggccagtcagaatattaaaagcaacttagcc

SEQ ID NO: 2960 - protein, 11 aa, Artificial Sequence
  Description of Artificial Sequence: Synthetic peptide
RASQNIKSNLA

SEQ ID NO: 2961 - DNA, 33 bp, Artificial Sequence
  Description of Artificial Sequence: Synthetic oligonucleotide
cgggcaagtcggagcgttcacacctatttaaat

SEQ ID NO: 2962 - protein, 11 aa, Artificial Sequence
  Description of Artificial Sequence: Synthetic peptide
RASRSVHTYLN

SEQ ID NO: 2963 - DNA, 33 bp, Artificial Sequence; identical to SEQ ID NO: 2561
  Description of Artificial Sequence: Synthetic oligonucleotide

SEQ ID NO: 2964 - protein, 11 aa, Artificial Sequence
  Description of Artificial Sequence: Synthetic peptide
RTSQGIGNYLA

SEQ ID NO: 2965 - DNA, 33 bp, Artificial Sequence
  Description of Artificial Sequence: Synthetic oligonucleotide
cgggcgagtcagggcataagtaatcatttagcc

SEQ ID NO: 2966 - protein, 11 aa, Artificial Sequence
  Description of Artificial Sequence: Synthetic peptide
RASQGISNHLA

SEQ ID NO: 2967 - DNA, 33 bp, Artificial Sequence; identical to SEQ ID NO: 109
  Description of Artificial Sequence: Synthetic oligonucleotide

SEQ ID NO: 2968 - protein, 11 aa, Artificial Sequence
  Description of Artificial Sequence: Synthetic peptide
RASQGIRNDLG

SEQ ID NO: 2969 - DNA, 36 bp, Artificial Sequence
  Description of Artificial Sequence: Synthetic oligonucleotide
agggccagtcagaatgttagttacagctacttagcc

SEQ ID NO: 2970 - protein, 12 aa, Artificial Sequence
  Description of Artificial Sequence: Synthetic peptide
RASQNVSYSYLA

SEQ ID NO: 2971 - DNA, 33 bp, Artificial Sequence
  Description of Artificial Sequence: Synthetic oligonucleotide
cgggcgagtcaggccattagtaatcatttagcc

SEQ ID NO: 2972 - protein, 11 aa, Artificial Sequence
  Description of Artificial Sequence: Synthetic peptide
RASQAISNHLA

SEQ ID NO: 2973 - DNA, 33 bp, Artificial Sequence; identical to SEQ ID NO: 2959
  Description of Artificial Sequence: Synthetic oligonucleotide

SEQ ID NO: 2974 - protein, 11 aa, Artificial Sequence
  Description of Artificial Sequence: Synthetic peptide
RASQNIKSNLA

SEQ ID NO: 2975 - DNA, 33 bp, Artificial Sequence; identical to SEQ ID NO: 2703
  Description of Artificial Sequence: Synthetic oligonucleotide

SEQ ID NO: 2976 - protein, 11 aa, Artificial Sequence
  Description of Artificial Sequence: Synthetic peptide
RASQGIGNYLA

SEQ ID NO: 2977 - DNA, 36 bp, Artificial Sequence
  Description of Artificial Sequence: Synthetic oligonucleotide
agggccagtcagagtgttttcagcaactacttagcc

SEQ ID NO: 2978 - protein, 12 aa, Artificial Sequence
  Description of Artificial Sequence: Synthetic peptide
RASQSVFSNYLA

SEQ ID NO: 2979 - DNA, 48 bp, Artificial Sequence
  Description of Artificial Sequence: Synthetic oligonucleotide
aggtctagtcagagcctcctgcataataatagatacaaccatttggat

SEQ ID NO: 2980 - protein, 16 aa, Artificial Sequence
  Description of Artificial Sequence: Synthetic peptide
RSSQSLLHNNRYNHLD

SEQ ID NO: 2981 - DNA, 33 bp, Artificial Sequence
  Description of Artificial Sequence: Synthetic oligonucleotide
agggccagtcagagtgttaatagctacttagcc

SEQ ID NO: 2982 - protein, 11 aa, Artificial Sequence
  Description of Artificial Sequence: Synthetic peptide
RASQSVNSYLA

SEQ ID NO: 2983 - DNA, 33 bp, Artificial Sequence; identical to SEQ ID NO: 109
  Description of Artificial Sequence: Synthetic oligonucleotide

SEQ ID NO: 2984 - protein, 11 aa, Artificial Sequence
  Description of Artificial Sequence: Synthetic peptide
RASQGIRNDLG

SEQ ID NO: 2985 - DNA, 36 bp, Artificial Sequence; identical to SEQ ID NO: 1845
  Description of Artificial Sequence: Synthetic oligonucleotide

SEQ ID NO: 2986 - protein, 12 aa, Artificial Sequence
  Description of Artificial Sequence: Synthetic peptide
RASQSINSNYLA

SEQ ID NO: 2987 - DNA, 33 bp, Artificial Sequence; identical to SEQ ID NO: 2927
  Description of Artificial Sequence: Synthetic oligonucleotide

SEQ ID NO: 2988 - protein, 11 aa, Artificial Sequence
  Description of Artificial Sequence: Synthetic peptide
RASHNINSYLN

SEQ ID NO: 2989 - DNA, 33 bp, Artificial Sequence
  Description of Artificial Sequence: Synthetic oligonucleotide
cgggccagtcagagcattggtcgtagcttacac

SEQ ID NO: 2990 - protein, 11 aa, Artificial Sequence
  Description of Artificial Sequence: Synthetic peptide
RASQSIGRSLH

SEQ ID NO: 2991 - DNA, 33 bp, Artificial Sequence; identical to SEQ ID NO: 2927
  Description of Artificial Sequence: Synthetic oligonucleotide

SEQ ID NO: 2992 - protein, 11 aa, Artificial Sequence
  Description of Artificial Sequence: Synthetic peptide
RASHNINSYLN

SEQ ID NO: 2993 - DNA, 33 bp, Artificial Sequence; identical to SEQ ID NO: 401
  Description of Artificial Sequence: Synthetic oligonucleotide

SEQ ID NO: 2994 - protein, 11 aa, Artificial Sequence
  Description of Artificial Sequence: Synthetic peptide
RASQGIRNYLA

SEQ ID NO: 2995 - DNA, 33 bp, Artificial Sequence; identical to SEQ ID NO: 109
  Description of Artificial Sequence: Synthetic oligonucleotide

SEQ ID NO: 2996 - protein, 11 aa, Artificial Sequence
  Description of Artificial Sequence: Synthetic peptide
RASQGIRNDLG

SEQ ID NO: 2997 - DNA, 33 bp, Artificial Sequence; identical to SEQ ID NO: 113
  Description of Artificial Sequence: Synthetic oligonucleotide

SEQ ID NO: 2998 - protein, 11 aa, Artificial Sequence
  Description of Artificial Sequence: Synthetic peptide
RASQGIRHDLG

SEQ ID NO: 2999 - DNA, 48 bp, Artificial Sequence; identical to SEQ ID NO: 2937
  Description of Artificial Sequence: Synthetic oligonucleotide

SEQ ID NO: 3000 - protein, 16 aa, Artificial Sequence
  Description of Artificial Sequence: Synthetic peptide
RSSQSLLHNNKYNHLD

SEQ ID NO: 3001 - DNA, 36 bp, Artificial Sequence; identical to SEQ ID NO: 2921
  Description of Artificial Sequence: Synthetic oligonucleotide

SEQ ID NO: 3002 - protein, 12 aa, Artificial Sequence
  Description of Artificial Sequence: Synthetic peptide
RASQSVSSNYLA

SEQ ID NO: 3003 - DNA, 33 bp, Artificial Sequence; identical to SEQ ID NO: 2927
  Description of Artificial Sequence: Synthetic oligonucleotide

SEQ ID NO: 3004 - protein, 11 aa, Artificial Sequence
  Description of Artificial Sequence: Synthetic peptide
RASHNINSYLN

SEQ ID NO: 3005 - DNA, 36 bp, Artificial Sequence
  Description of Artificial Sequence: Synthetic oligonucleotide
agggccagtcagagtgttagcaacaactacttagcc

SEQ ID NO: 3006 - protein, 12 aa, Artificial Sequence
  Description of Artificial Sequence: Synthetic peptide
RASQSVSNNYLA

SEQ ID NO: 3007 - DNA, 33 bp, Artificial Sequence; identical to SEQ ID NO: 2927
  Description of Artificial Sequence: Synthetic oligonucleotide

SEQ ID NO: 3008 - protein, 11 aa, Artificial Sequence
  Description of Artificial Sequence: Synthetic peptide
RASHNINSYLN

SEQ ID NO: 3009 - DNA, 33 bp, Artificial Sequence; identical to SEQ ID NO: 109
  Description of Artificial Sequence: Synthetic oligonucleotide

SEQ ID NO: 3010 - protein, 11 aa, Artificial Sequence
  Description of Artificial Sequence: Synthetic peptide
RASQGIRNDLG

SEQ ID NO: 3011 - DNA, 33 bp, Artificial Sequence; identical to SEQ ID NO: 113
  Description of Artificial Sequence: Synthetic oligonucleotide

SEQ ID NO: 3012 - protein, 11 aa, Artificial Sequence
  Description of Artificial Sequence: Synthetic peptide
RASQGIRHDLG

SEQ ID NO: 3013 - DNA, 33 bp, Artificial Sequence; identical to SEQ ID NO: 93
  Description of Artificial Sequence: Synthetic oligonucleotide

SEQ ID NO: 3014 - protein, 11 aa, Artificial Sequence
  Description of Artificial Sequence: Synthetic peptide
RTSQGIRNDLG

SEQ ID NO: 3015 - DNA, 33 bp, Artificial Sequence
  Description of Artificial Sequence: Synthetic oligonucleotide
agggccagtcagagtgttaaaagcaacttagcc

SEQ ID NO: 3016 - protein, 11 aa, Artificial Sequence
  Description of Artificial Sequence: Synthetic peptide
RASQSVKSNLA

SEQ ID NO: 3017 - DNA, 33 bp, Artificial Sequence; identical to SEQ ID NO: 2927
  Description of Artificial Sequence: Synthetic oligonucleotide

SEQ ID NO: 3018 - protein, 11 aa, Artificial Sequence
  Description of Artificial Sequence: Synthetic peptide
RASHNINSYLN

SEQ ID NO: 3019 - DNA, 33 bp, Artificial Sequence
  Description of Artificial Sequence: Synthetic oligonucleotide
cgggcgagtcagggtattagcatctggttagcc

SEQ ID NO: 3020 - protein, 11 aa, Artificial Sequence
  Description of Artificial Sequence: Synthetic peptide
RASQGISIWLA

SEQ ID NO: 3021 - DNA, 48 bp, Artificial Sequence
  Description of Artificial Sequence: Synthetic oligonucleotide
aggtctagtcagagcctcctgcattataatggacacaactttttggat

SEQ ID NO: 3022 - protein, 16 aa, Artificial Sequence
  Description of Artificial Sequence: Synthetic peptide
RSSQSLLHYNGHNFLD

SEQ ID NO: 3023 - DNA, 33 bp, Artificial Sequence; identical to SEQ ID NO: 2703
  Description of Artificial Sequence: Synthetic oligonucleotide

SEQ ID NO: 3024 - protein, 11 aa, Artificial Sequence
  Description of Artificial Sequence: Synthetic peptide
RASQGIGNYLA

SEQ ID NO: 3025 - DNA, 33 bp, Artificial Sequence
  Description of Artificial Sequence: Synthetic oligonucleotide
cgggcgagtcaggccattgggaaacatttagcc

SEQ ID NO: 3026 - protein, 11 aa, Artificial Sequence
  Description of Artificial Sequence: Synthetic peptide
RASQAIGKHLA

SEQ ID NO: 3027 - DNA, 36 bp, Artificial Sequence
  Description of Artificial Sequence: Synthetic oligonucleotide
agggccagtcagagtgttagcagcagcttcttagcc

SEQ ID NO: 3028 - protein, 12 aa, Artificial Sequence
  Description of Artificial Sequence: Synthetic peptide
RASQSVSSSFLA

SEQ ID NO: 3029 - DNA, 33 bp, Artificial Sequence; identical to SEQ ID NO: 1727
  Description of Artificial Sequence: Synthetic oligonucleotide

SEQ ID NO: 3030 - protein, 11 aa, Artificial Sequence
  Description of Artificial Sequence: Synthetic peptide
RASQGIGKYLA

SEQ ID NO: 3031 - DNA, 33 bp, Artificial Sequence
  Description of Artificial Sequence: Synthetic oligonucleotide
cgggcgagtcagggcattagcagatatttagcc

SEQ ID NO: 3032 - protein, 11 aa, Artificial Sequence
  Description of Artificial Sequence: Synthetic peptide
RASQGISRYLA

SEQ ID NO: 3033 - DNA, 48 bp, Artificial Sequence; identical to SEQ ID NO: 993
  Description of Artificial Sequence: Synthetic oligonucleotide

SEQ ID NO: 3034 - protein, 16 aa, Artificial Sequence
  Description of Artificial Sequence: Synthetic peptide
RSSQSLLHSNGYNYLD

SEQ ID NO: 3035 - DNA, 33 bp, Artificial Sequence
  Description of Artificial Sequence: Synthetic oligonucleotide
cgggcgagtcagggcattagcaatcatttagcc

SEQ ID NO: 3036 - protein, 11 aa, Artificial Sequence
  Description of Artificial Sequence: Synthetic peptide
RASQGISNHLA

SEQ ID NO: 3037 - DNA, 33 bp, Artificial Sequence; identical to SEQ ID NO: 3035
  Description of Artificial Sequence: Synthetic oligonucleotide

SEQ ID NO: 3038 - protein, 11 aa, Artificial Sequence
  Description of Artificial Sequence: Synthetic peptide
RASQGISNHLA

SEQ ID NO: 3039 - DNA, 33 bp, Artificial Sequence
  Description of Artificial Sequence: Synthetic oligonucleotide
cgggcgagtcagggcattagcagttatttagcc

SEQ ID NO: 3040 - protein, 11 aa, Artificial Sequence
  Description of Artificial Sequence: Synthetic peptide
RASQGISSYLA

SEQ ID NO: 3041 - DNA, 33 bp, Artificial Sequence; identical to SEQ ID NO: 1783
  Description of Artificial Sequence: Synthetic oligonucleotide

SEQ ID NO: 3042 - protein, 11 aa, Artificial Sequence
  Description of Artificial Sequence: Synthetic peptide
RASQSVASSLA

SEQ ID NO: 3043 - DNA, 33 bp, Artificial Sequence
  Description of Artificial Sequence: Synthetic oligonucleotide
cgggcgagtcagggcattagcaattatttagac

SEQ ID NO: 3044 - protein, 11 aa, Artificial Sequence
  Description of Artificial Sequence: Synthetic peptide
RASQGISNYLD

SEQ ID NO: 3045 - DNA, 33 bp, Artificial Sequence; identical to SEQ ID NO: 109
  Description of Artificial Sequence: Synthetic oligonucleotide

SEQ ID NO: 3046 - protein, 11 aa, Artificial Sequence
  Description of Artificial Sequence: Synthetic peptide
RASQGIRNDLG

SEQ ID NO: 3047 - DNA, 33 bp, Artificial Sequence; identical to SEQ ID NO: 3025
  Description of Artificial Sequence: Synthetic oligonucleotide

SEQ ID NO: 3048 - protein, 11 aa, Artificial Sequence
  Description of Artificial Sequence: Synthetic peptide
RASQAIGKHLA

SEQ ID NO: 3049 - DNA, 33 bp, Artificial Sequence; identical to SEQ ID NO: 3035
  Description of Artificial Sequence: Synthetic oligonucleotide

SEQ ID NO: 3050 - protein, 11 aa, Artificial Sequence
  Description of Artificial Sequence: Synthetic peptide
RASQGISNHLA

SEQ ID NO: 3051 - DNA, 33 bp, Artificial Sequence; identical to SEQ ID NO: 1727
  Description of Artificial Sequence: Synthetic oligonucleotide

SEQ ID NO: 3052 - protein, 11 aa, Artificial Sequence
  Description of Artificial Sequence: Synthetic peptide
RASQGIGKYLA

SEQ ID NO: 3053 - DNA, 33 bp, Artificial Sequence
  Description of Artificial Sequence: Synthetic oligonucleotide
cgggcgagtcaggccattaggaattatttagcc

SEQ ID NO: 3054 - protein, 11 aa, Artificial Sequence
  Description of Artificial Sequence: Synthetic peptide
RASQAIRNYLA

SEQ ID NO: 3055 - DNA, 33 bp, Artificial Sequence; identical to SEQ ID NO: 3025
  Description of Artificial Sequence: Synthetic oligonucleotide

SEQ ID NO: 3056 - protein, 11 aa, Artificial Sequence
  Description of Artificial Sequence: Synthetic peptide
RASQAIGKHLA

SEQ ID NO: 3057 - DNA, 33 bp, Artificial Sequence; identical to SEQ ID NO: 3035
  Description of Artificial Sequence: Synthetic oligonucleotide

SEQ ID NO: 3058 - protein, 11 aa, Artificial Sequence
  Description of Artificial Sequence: Synthetic peptide
RASQGISNHLA

SEQ ID NO: 3059 - DNA, 51 bp, Artificial Sequence
  Description of Artificial Sequence: Synthetic oligonucleotide
aagtccagccagaatgttttagacatctccaacaataagaattccttaggt

SEQ ID NO: 3060 - protein, 17 aa, Artificial Sequence
  Description of Artificial Sequence: Synthetic peptide
KSSQNVLDISNNKNSLG

SEQ ID NO: 3061 - DNA, 51 bp, Artificial Sequence
  Description of Artificial Sequence: Synthetic oligonucleotide
aagtccagccagaatgttttaaagacctccaacaataggaactacttagct

SEQ ID NO: 3062 - protein, 17 aa, Artificial Sequence
  Description of Artificial Sequence: Synthetic peptide
KSSQNVLKTSNNRNYLA

SEQ ID NO: 3063 - DNA, 33 bp, Artificial Sequence; identical to SEQ ID NO: 2703
  Description of Artificial Sequence: Synthetic oligonucleotide

SEQ ID NO: 3064 - protein, 11 aa, Artificial Sequence
  Description of Artificial Sequence: Synthetic peptide
RASQGIGNYLA

SEQ ID NO: 3065 - DNA, 33 bp, Artificial Sequence; identical to SEQ ID NO: 105
  Description of Artificial Sequence: Synthetic oligonucleotide

SEQ ID NO: 3066 - protein, 11 aa, Artificial Sequence
  Description of Artificial Sequence: Synthetic peptide
RASQGISNYLA

SEQ ID NO: 3067 - DNA, 33 bp, Artificial Sequence
  Description of Artificial Sequence: Synthetic oligonucleotide
cgggccagtcagagcattggtgttagcttacac

SEQ ID NO: 3068 - protein, 11 aa, Artificial Sequence
  Description of Artificial Sequence: Synthetic peptide
RASQSIGVSLH

SEQ ID NO: 3069 - DNA, 33 bp, Artificial Sequence; identical to SEQ ID NO: 3035
  Description of Artificial Sequence: Synthetic oligonucleotide

SEQ ID NO: 3070 - protein, 11 aa, Artificial Sequence
  Description of Artificial Sequence: Synthetic peptide
RASQGISNHLA

SEQ ID NO: 3071 - DNA, 33 bp, Artificial Sequence; identical to SEQ ID NO: 109
  Description of Artificial Sequence: Synthetic oligonucleotide

SEQ ID NO: 3072 - protein, 11 aa, Artificial Sequence
  Description of Artificial Sequence: Synthetic peptide
RASQGIRNDLG

SEQ ID NO: 3073 - DNA, 33 bp, Artificial Sequence; identical to SEQ ID NO: 109
  Description of Artificial Sequence: Synthetic oligonucleotide

SEQ ID NO: 3074 - protein, 11 aa, Artificial Sequence
  Description of Artificial Sequence: Synthetic peptide
RASQGIRNDLG

SEQ ID NO: 3075 - DNA, 33 bp, Artificial Sequence; identical to SEQ ID NO: 109
  Description of Artificial Sequence: Synthetic oligonucleotide

SEQ ID NO: 3076 - protein, 11 aa, Artificial Sequence
  Description of Artificial Sequence: Synthetic peptide
RASQGIRNDLG

SEQ ID NO: 3077 - DNA, 33 bp, Artificial Sequence; identical to SEQ ID NO: 109
  Description of Artificial Sequence: Synthetic oligonucleotide

SEQ ID NO: 3078 - protein, 11 aa, Artificial Sequence
  Description of Artificial Sequence: Synthetic peptide
RASQGIRNDLG

SEQ ID NO: 3079 - DNA, 33 bp, Artificial Sequence; identical to SEQ ID NO: 3035
  Description of Artificial Sequence: Synthetic oligonucleotide

SEQ ID NO: 3080 - protein, 11 aa, Artificial Sequence
  Description of Artificial Sequence: Synthetic peptide
RASQGISNHLA

SEQ ID NO: 3081 - DNA, 33 bp, Artificial Sequence; identical to SEQ ID NO: 3035
  Description of Artificial Sequence: Synthetic oligonucleotide

SEQ ID NO: 3082 - protein, 11 aa, Artificial Sequence
  Description of Artificial Sequence: Synthetic peptide
RASQGISNHLA

SEQ ID NO: 3083 - DNA, 33 bp, Artificial Sequence
  Description of Artificial Sequence: Synthetic oligonucleotide
cgggccagtcagagcatcggtgttagcttacac

SEQ ID NO: 3084 - protein, 11 aa, Artificial Sequence
  Description of Artificial Sequence: Synthetic peptide
RASQSIGVSLH

SEQ ID NO: 3085 - DNA, 36 bp, Artificial Sequence
  Description of Artificial Sequence: Synthetic oligonucleotide
agggccagtcagaggattaccaccaacttcttagct

SEQ ID NO: 3086 - protein, 12 aa, Artificial Sequence
  Description of Artificial Sequence: Synthetic peptide
RASQRITTNFLA

SEQ ID NO: 3087 - DNA, 33 bp, Artificial Sequence; identical to SEQ ID NO: 109
  Description of Artificial Sequence: Synthetic oligonucleotide

SEQ ID NO: 3088 - protein, 11 aa, Artificial Sequence
  Description of Artificial Sequence: Synthetic peptide
RASQGIRNDLG

SEQ ID NO: 3089 - DNA, 33 bp, Artificial Sequence
  Description of Artificial Sequence: Synthetic oligonucleotide
cggacgagtcaggacattggcaattatttagcc

SEQ ID NO: 3090 - protein, 11 aa, Artificial Sequence
  Description of Artificial Sequence: Synthetic peptide
RTSQDIGNYLA

SEQ ID NO: 3091 - DNA, 36 bp, Artificial Sequence
  Description of Artificial Sequence: Synthetic oligonucleotide
agggccagtcagagtgttagcagcagcttcttagct

SEQ ID NO: 3092 - protein, 12 aa, Artificial Sequence
  Description of Artificial Sequence: Synthetic peptide
RASQSVSSSFLA

SEQ ID NO: 3093 - DNA, 33 bp, Artificial Sequence
  Description of Artificial Sequence: Synthetic oligonucleotide
agggccagtcagagtgttaacaacaacttagcc

SEQ ID NO: 3094 - protein, 11 aa, Artificial Sequence
  Description of Artificial Sequence: Synthetic peptide
RASQSVNNNLA

SEQ ID NO: 3095 - DNA, 36 bp, Artificial Sequence; identical to SEQ ID NO: 3027
  Description of Artificial Sequence: Synthetic oligonucleotide

SEQ ID NO: 3096 - protein, 12 aa, Artificial Sequence
  Description of Artificial Sequence: Synthetic peptide
RASQSVSSSFLA

SEQ ID NO: 3097 - DNA, 33 bp, Artificial Sequence; identical to SEQ ID NO: 109
  Description of Artificial Sequence: Synthetic oligonucleotide

SEQ ID NO: 3098 - protein, 11 aa, Artificial Sequence
  Description of Artificial Sequence: Synthetic peptide
RASQGIRNDLG

SEQ ID NO: 3099 - DNA, 33 bp, Artificial Sequence; identical to SEQ ID NO: 109
  Description of Artificial Sequence: Synthetic oligonucleotide

SEQ ID NO: 3100 - protein, 11 aa, Artificial Sequence
  Description of Artificial Sequence: Synthetic peptide
RASQGIRNDLG

SEQ ID NO: 3101 - DNA, 33 bp, Artificial Sequence; identical to SEQ ID NO: 2609
  Description of Artificial Sequence: Synthetic oligonucleotide

SEQ ID NO: 3102 - protein, 11 aa, Artificial Sequence
  Description of Artificial Sequence: Synthetic peptide
RASQSIGSSLH

SEQ ID NO: 3103 - DNA, 33 bp, Artificial Sequence; identical to SEQ ID NO: 109
  Description of Artificial Sequence: Synthetic oligonucleotide

SEQ ID NO: 3104 - protein, 11 aa, Artificial Sequence
  Description of Artificial Sequence: Synthetic peptide
RASQGIRNDLG

SEQ ID NO: 3105 - DNA, 33 bp, Artificial Sequence; identical to SEQ ID NO: 2703
  Description of Artificial Sequence: Synthetic oligonucleotide

SEQ ID NO: 3106 - protein, 11 aa, Artificial Sequence
  Description of Artificial Sequence: Synthetic peptide
RASQGIGNYLA

SEQ ID NO: 3107 - DNA, 33 bp, Artificial Sequence; identical to SEQ ID NO: 3025
  Description of Artificial Sequence: Synthetic oligonucleotide

SEQ ID NO: 3108 - protein, 11 aa, Artificial Sequence
  Description of Artificial Sequence: Synthetic peptide
RASQAIGKHLA

SEQ ID NO: 3109 - DNA, 33 bp, Artificial Sequence; identical to SEQ ID NO: 109
  Description of Artificial Sequence: Synthetic oligonucleotide

SEQ ID NO: 3110 - protein, 11 aa, Artificial Sequence
  Description of Artificial Sequence: Synthetic peptide
RASQGIRNDLG

SEQ ID NO: 3111 - DNA, 33 bp, Artificial Sequence; identical to SEQ ID NO: 109
  Description of Artificial Sequence: Synthetic oligonucleotide

SEQ ID NO: 3112 - protein, 11 aa, Artificial Sequence
  Description of Artificial Sequence: Synthetic peptide
RASQGIRNDLG

SEQ ID NO: 3113 - DNA, 33 bp, Artificial Sequence; identical to SEQ ID NO: 109
  Description of Artificial Sequence: Synthetic oligonucleotide

SEQ ID NO: 3114 - protein, 11 aa, Artificial Sequence
  Description of Artificial Sequence: Synthetic peptide
RASQGIRNDLG

SEQ ID NO: 3115 - DNA, 33 bp, Artificial Sequence; identical to SEQ ID NO: 3043
  Description of Artificial Sequence: Synthetic oligonucleotide

SEQ ID NO: 3116 - protein, 11 aa, Artificial Sequence
  Description of Artificial Sequence: Synthetic peptide
RASQGISNYLD

SEQ ID NO: 3117 - DNA, 36 bp, Artificial Sequence
  Description of Artificial Sequence: Synthetic oligonucleotide
agggccagtcagagtattagccgcagccacttagtc

SEQ ID NO: 3118 - protein, 12 aa, Artificial Sequence
  Description of Artificial Sequence: Synthetic peptide
RASQSISRSHLV

SEQ ID NO: 3119 - DNA, 33 bp, Artificial Sequence; identical to SEQ ID NO: 109
  Description of Artificial Sequence: Synthetic oligonucleotide

SEQ ID NO: 3120 - protein, 11 aa, Artificial Sequence
  Description of Artificial Sequence: Synthetic peptide
RASQGIRNDLG

SEQ ID NO: 3121 - DNA, 33 bp, Artificial Sequence; identical to SEQ ID NO: 171
  Description of Artificial Sequence: Synthetic oligonucleotide

SEQ ID NO: 3122 - protein, 11 aa, Artificial Sequence
  Description of Artificial Sequence: Synthetic peptide
RASQGISSWLA

SEQ ID NO: 3123 - DNA, 33 bp, Artificial Sequence; identical to SEQ ID NO: 105
  Description of Artificial Sequence: Synthetic oligonucleotide

SEQ ID NO: 3124 - protein, 11 aa, Artificial Sequence
  Description of Artificial Sequence: Synthetic peptide
RASQGISNYLA

SEQ ID NO: 3125 - DNA, 33 bp, Artificial Sequence; identical to SEQ ID NO: 171
  Description of Artificial Sequence: Synthetic oligonucleotide

SEQ ID NO: 3126 - protein, 11 aa, Artificial Sequence
  Description of Artificial Sequence: Synthetic peptide
RASQGISSWLA

SEQ ID NO: 3127 - DNA, 33 bp, Artificial Sequence; identical to SEQ ID NO: 171
  Description of Artificial Sequence: Synthetic oligonucleotide

SEQ ID NO: 3128 - protein, 11 aa, Artificial Sequence
  Description of Artificial Sequence: Synthetic peptide
RASQGISSWLA

SEQ ID NO: 3129 - DNA, 51 bp, Artificial Sequence
  Description of Artificial Sequence: Synthetic oligonucleotide
aagtccagccagagtgttttgaaaagttccaaccataggaactacttagct

SEQ ID NO: 3130 - protein, 17 aa, Artificial Sequence
  Description of Artificial Sequence: Synthetic peptide
KSSQSVLKSSNHRNYLA

SEQ ID NO: 3131 - DNA, 33 bp, Artificial Sequence
  Description of Artificial Sequence: Synthetic oligonucleotide
cgggcgagtcagggcattagcaattatttggcc

SEQ ID NO: 3132 - protein, 11 aa, Artificial Sequence
  Description of Artificial Sequence: Synthetic peptide
RASQGISNYLA

SEQ ID NO: 3133 - DNA, 33 bp, Artificial Sequence
  Description of Artificial Sequence: Synthetic oligonucleotide
cgggcaagtcagaacattagtaattatgttaat

SEQ ID NO: 3134 - protein, 11 aa, Artificial Sequence
  Description of Artificial Sequence: Synthetic peptide
RASQNISNYVN

SEQ ID NO: 3135 - DNA, 36 bp, Artificial Sequence
  Description of Artificial Sequence: Synthetic oligonucleotide
agggccagtcagagtgtttacagcaactacttagcc

SEQ ID NO: 3136 - protein, 12 aa, Artificial Sequence
  Description of Artificial Sequence: Synthetic peptide
RASQSVYSNYLA

SEQ ID NO: 3137 - DNA, 33 bp, Artificial Sequence; identical to SEQ ID NO: 171
  Description of Artificial Sequence: Synthetic oligonucleotide

SEQ ID NO: 3138 - protein, 11 aa, Artificial Sequence
  Description of Artificial Sequence: Synthetic peptide
RASQGISSWLA

SEQ ID NO: 3139 - DNA, 33 bp, Artificial Sequence; identical to SEQ ID NO: 3133
  Description of Artificial Sequence: Synthetic oligonucleotide

SEQ ID NO: 3140 - protein, 11 aa, Artificial Sequence
  Description of Artificial Sequence: Synthetic peptide
RASQNISNYVN

SEQ ID NO: 3141 - DNA, 33 bp, Artificial Sequence; identical to SEQ ID NO: 3131
  Description of Artificial Sequence: Synthetic oligonucleotide

SEQ ID NO: 3142 - protein, 11 aa, Artificial Sequence
  Description of Artificial Sequence: Synthetic peptide
RASQGISNYLA

SEQ ID NO: 3143 - DNA, 33 bp, Artificial Sequence
  Description of Artificial Sequence: Synthetic oligonucleotide
cgggtgagtcagggtattagcagctggttagcc

SEQ ID NO: 3144 - protein, 11 aa, Artificial Sequence
  Description of Artificial Sequence: Synthetic peptide
RVSQGISSWLA

SEQ ID NO: 3145 - DNA, 51 bp, Artificial Sequence
  Description of Artificial Sequence: Synthetic oligonucleotide
aagtccagccagagtattttactcagctccaacaataagaactacttagct

SEQ ID NO: 3146 - protein, 17 aa, Artificial Sequence
  Description of Artificial Sequence: Synthetic peptide
KSSQSILLSSNNKNYLA

SEQ ID NO: 3147 - DNA, 33 bp, Artificial Sequence
  Description of Artificial Sequence: Synthetic oligonucleotide
cgggcgagtcagggcattagtaattatttggcc

SEQ ID NO: 3148 - protein, 11 aa, Artificial Sequence
  Description of Artificial Sequence: Synthetic peptide
RASQGISNYLA

SEQ ID NO: 3149 - DNA, 33 bp, Artificial Sequence
  Description of Artificial Sequence: Synthetic oligonucleotide
cgggcaagtcagggcattgaaaatgatttaggc

SEQ ID NO: 3150 - protein, 11 aa, Artificial Sequence
  Description of Artificial Sequence: Synthetic peptide
RASQGIENDLG

SEQ ID NO: 3151 - DNA, 33 bp, Artificial Sequence
  Description of Artificial Sequence: Synthetic oligonucleotide
cgggcaagtcagggcattagtaatgatttaggc

SEQ ID NO: 3152 - protein, 11 aa, Artificial Sequence
  Description of Artificial Sequence: Synthetic peptide
RASQGISNDLG

SEQ ID NO: 3153 - DNA, 33 bp, Artificial Sequence; identical to SEQ ID NO: 1185
  Description of Artificial Sequence: Synthetic oligonucleotide

SEQ ID NO: 3154 - protein, 11 aa, Artificial Sequence
  Description of Artificial Sequence: Synthetic peptide
RASQGIRDDLG

SEQ ID NO: 3155 - DNA, 48 bp, Artificial Sequence
  Description of Artificial Sequence: Synthetic oligonucleotide
aagtctggtcagagcctcctgcatagtgatggaaagacctttttgtct

SEQ ID NO: 3156 - protein, 16 aa, Artificial Sequence
  Description of Artificial Sequence: Synthetic peptide
KSGQSLLHSDGKTFLS

SEQ ID NO: 3157 - DNA, 33 bp, Artificial Sequence; identical to SEQ ID NO: 205
  Description of Artificial Sequence: Synthetic oligonucleotide

SEQ ID NO: 3158 - protein, 11 aa, Artificial Sequence
  Description of Artificial Sequence: Synthetic peptide
RASQDIRNDLG

SEQ ID NO: 3159 - DNA, 33 bp, Artificial Sequence; identical to SEQ ID NO: 109
  Description of Artificial Sequence: Synthetic oligonucleotide

SEQ ID NO: 3160 - protein, 11 aa, Artificial Sequence
  Description of Artificial Sequence: Synthetic peptide
RASQGIRNDLG

SEQ ID NO: 3161 - DNA, 51 bp, Artificial Sequence
  Description of Artificial Sequence: Synthetic oligonucleotide
aagtccagccagagtgttttatacagctccaacaatttcaactacttaact

SEQ ID NO: 3162 - protein, 17 aa, Artificial Sequence
  Description of Artificial Sequence: Synthetic peptide
KSSQSVLYSSNNFNYLT

SEQ ID NO: 3163 - DNA, 33 bp, Artificial Sequence; identical to SEQ ID NO: 171
  Description of Artificial Sequence: Synthetic oligonucleotide

SEQ ID NO: 3164 - protein, 11 aa, Artificial Sequence
  Description of Artificial Sequence: Synthetic peptide
RASQGISSWLA

SEQ ID NO: 3165 - DNA, 48 bp, Artificial Sequence; identical to SEQ ID NO: 419
  Description of Artificial Sequence: Synthetic oligonucleotide

SEQ ID NO: 3166 - protein, 16 aa, Artificial Sequence
  Description of Artificial Sequence: Synthetic peptide
KSSQSLLHSDGKTFLY

SEQ ID NO: 3167 - DNA, 51 bp, Artificial Sequence; identical to SEQ ID NO: 1071
  Description of Artificial Sequence: Synthetic oligonucleotide

SEQ ID NO: 3168 - protein, 17 aa, Artificial Sequence
  Description of Artificial Sequence: Synthetic peptide
KSSQSVLYSSNNKNYLA

SEQ ID NO: 3169 - DNA, 51 bp, Artificial Sequence
  Description of Artificial Sequence: Synthetic oligonucleotide
aagtccagccagagtgttttatacaattccaacaataagaactacttagct

SEQ ID NO: 3170 - protein, 17 aa, Artificial Sequence
  Description of Artificial Sequence: Synthetic peptide
KSSQSVLYNSNNKNYLA

SEQ ID NO: 3171 - DNA, 33 bp, Artificial Sequence; identical to SEQ ID NO: 109
  Description of Artificial Sequence: Synthetic oligonucleotide

SEQ ID NO: 3172 - protein, 11 aa, Artificial Sequence
  Description of Artificial Sequence: Synthetic peptide
RASQGIRNDLG

SEQ ID NO: 3173 - DNA, 48 bp, Artificial Sequence; identical to SEQ ID NO: 419
  Description of Artificial Sequence: Synthetic oligonucleotide

SEQ ID NO: 3174 - protein, 16 aa, Artificial Sequence
  Description of Artificial Sequence: Synthetic peptide
KSSQSLLHSDGKTFLY

SEQ ID NO: 3175 - DNA, 51 bp, Artificial Sequence
  Description of Artificial Sequence: Synthetic oligonucleotide
aagtccagccagagtgttttatccagctccaacaatcacaactacttagct

SEQ ID NO: 3176 - protein, 17 aa, Artificial Sequence
  Description of Artificial Sequence: Synthetic peptide
KSSQSVLSSSNNHNYLA

SEQ ID NO: 3177 - DNA, 48 bp, Artificial Sequence; identical to SEQ ID NO: 419
  Description of Artificial Sequence: Synthetic oligonucleotide

SEQ ID NO: 3178 - protein, 16 aa, Artificial Sequence
  Description of Artificial Sequence: Synthetic peptide
KSSQSLLHSDGKTFLY

SEQ ID NO: 3179 - DNA, 33 bp, Artificial Sequence; identical to SEQ ID NO: 1185
  Description of Artificial Sequence: Synthetic oligonucleotide

SEQ ID NO: 3180 - protein, 11 aa, Artificial Sequence
  Description of Artificial Sequence: Synthetic peptide
RASQGIRDDLG

SEQ ID NO: 3181 - DNA, 36 bp, Artificial Sequence
  Description of Artificial Sequence: Synthetic oligonucleotide
agggccagtcagaatcttagcagcagctacttaggc

SEQ ID NO: 3182 - protein, 12 aa, Artificial Sequence
  Description of Artificial Sequence: Synthetic peptide
RASQNLSSSYLG

SEQ ID NO: 3183 - DNA, 51 bp, Artificial Sequence
  Description of Artificial Sequence: Synthetic oligonucleotide
aagtccagccagagtgttttatatagctccaacaataagaactacttagct

SEQ ID NO: 3184 - protein, 17 aa, Artificial Sequence
  Description of Artificial Sequence: Synthetic peptide
KSSQSVLYSSNNKNYLA

SEQ ID NO: 3185 - DNA, 48 bp, Artificial Sequence; identical to SEQ ID NO: 419
  Description of Artificial Sequence: Synthetic oligonucleotide

SEQ ID NO: 3186 - protein, 16 aa, Artificial Sequence
  Description of Artificial Sequence: Synthetic peptide
KSSQSLLHSDGKTFLY

SEQ ID NO: 3187 - DNA, 51 bp, Artificial Sequence; identical to SEQ ID NO: 1017
  Description of Artificial Sequence: Synthetic oligonucleotide

SEQ ID NO: 3188 - protein, 17 aa, Artificial Sequence
  Description of Artificial Sequence: Synthetic peptide
KSSQNVLYNSNNNNYLA

SEQ ID NO: 3189 - DNA, 33 bp, Artificial Sequence
  Description of Artificial Sequence: Synthetic oligonucleotide
cgggcaagtcagggcatgagaaaagatttaggc

SEQ ID NO: 3190 - protein, 11 aa, Artificial Sequence
  Description of Artificial Sequence: Synthetic peptide
RASQGMRKDLG

SEQ ID NO: 3191 - DNA, 33 bp, Artificial Sequence; identical to SEQ ID NO: 109
  Description of Artificial Sequence: Synthetic oligonucleotide

SEQ ID NO: 3192 - protein, 11 aa, Artificial Sequence
  Description of Artificial Sequence: Synthetic peptide
RASQGIRNDLG

SEQ ID NO: 3193 - DNA, 36 bp, Artificial Sequence; identical to SEQ ID NO: 1697
  Description of Artificial Sequence: Synthetic oligonucleotide

SEQ ID NO: 3194 - protein, 12 aa, Artificial Sequence
  Description of Artificial Sequence: Synthetic peptide
RASQSVYSSYLA

SEQ ID NO: 3195 - DNA, 33 bp, Artificial Sequence; identical to SEQ ID NO: 109
  Description of Artificial Sequence: Synthetic oligonucleotide

SEQ ID NO: 3196 - protein, 11 aa, Artificial Sequence
  Description of Artificial Sequence: Synthetic peptide
RASQGIRNDLG

SEQ ID NO: 3197 - DNA, 51 bp, Artificial Sequence; identical to SEQ ID NO: 1541
  Description of Artificial Sequence: Synthetic oligonucleotide

SEQ ID NO: 3198 - protein, 17 aa, Artificial Sequence
  Description of Artificial Sequence: Synthetic peptide
KSSQSVLYSSNNNNYLA

SEQ ID NO: 3199 - DNA, 51 bp, Artificial Sequence; identical to SEQ ID NO: 1079
  Description of Artificial Sequence: Synthetic oligonucleotide

SEQ ID NO: 3200 - protein, 17 aa, Artificial Sequence
  Description of Artificial Sequence: Synthetic peptide
KSSQSVLYSSNNYNYLA

SEQ ID NO: 3201 - DNA, 51 bp, Artificial Sequence
  Description of Artificial Sequence: Synthetic oligonucleotide
aagtccagccagagtgttttatacagctccaacaatcagaactacttagct

SEQ ID NO: 3202 - protein, 17 aa, Artificial Sequence
  Description of Artificial Sequence: Synthetic peptide
KSSQSVLYSSNNQNYLA

SEQ ID NO: 3203 - DNA, 51 bp, Artificial Sequence
  Description of Artificial Sequence: Synthetic oligonucleotide
aagtccagccagagtgttttatacaactccaacaataacaactacttagct

SEQ ID NO: 3204 - protein, 17 aa, Artificial Sequence
  Description of Artificial Sequence: Synthetic peptide
KSSQSVLYNSNNNNYLA

SEQ ID NO: 3205 - DNA, 48 bp, Artificial Sequence; identical to SEQ ID NO: 575
  Description of Artificial Sequence: Synthetic oligonucleotide

SEQ ID NO: 3206 - protein, 16 aa, Artificial Sequence
  Description of Artificial Sequence: Synthetic peptide
KSSQSLLHGDGKTYLY

SEQ ID NO: 3207 - DNA, 48 bp, Artificial Sequence; identical to SEQ ID NO: 579
  Description of Artificial Sequence: Synthetic oligonucleotide

SEQ ID NO: 3208 - protein, 16 aa, Artificial Sequence
  Description of Artificial Sequence: Synthetic peptide
KSSQSLLHGDGKTYLY

SEQ ID NO: 3209 - DNA, 33 bp, Artificial Sequence; identical to SEQ ID NO: 109
  Description of Artificial Sequence: Synthetic oligonucleotide

SEQ ID NO: 3210 - protein, 11 aa, Artificial Sequence
  Description of Artificial Sequence: Synthetic peptide
RASQGIRNDLG

SEQ ID NO: 3211 - DNA, 51 bp, Artificial Sequence
  Description of Artificial Sequence: Synthetic oligonucleotide
aggtccagccagagtattttatacatctccaacaataagaactacttagct

SEQ ID NO: 3212 - protein, 17 aa, Artificial Sequence
  Description of Artificial Sequence: Synthetic peptide
RSSQSILYISNNKNYLA

SEQ ID NO: 3213 - DNA, 51 bp, Artificial Sequence; identical to SEQ ID NO: 1825
  Description of Artificial Sequence: Synthetic oligonucleotide

SEQ ID NO: 3214 - protein, 17 aa, Artificial Sequence
  Description of Artificial Sequence: Synthetic peptide
KSSQSILYSSNNYNYLA

SEQ ID NO: 3215 - DNA, 48 bp, Artificial Sequence; identical to SEQ ID NO: 575
  Description of Artificial Sequence: Synthetic oligonucleotide

SEQ ID NO: 3216 - protein, 16 aa, Artificial Sequence
  Description of Artificial Sequence: Synthetic peptide
KSSQSLLHGDGKTYLY

SEQ ID NO: 3217 - DNA, 33 bp, Artificial Sequence
  Description of Artificial Sequence: Synthetic oligonucleotide
cgggcaagtcagggcattgggaatgatttaggc

SEQ ID NO: 3218 - protein, 11 aa, Artificial Sequence
  Description of Artificial Sequence: Synthetic peptide
RASQGIGNDLG

SEQ ID NO: 3219 - DNA, 48 bp, Artificial Sequence; identical to SEQ ID NO: 419
  Description of Artificial Sequence: Synthetic oligonucleotide

SEQ ID NO: 3220 - protein, 16 aa, Artificial Sequence
  Description of Artificial Sequence: Synthetic peptide
KSSQSLLHSDGKTFLY

SEQ ID NO: 3221 - DNA, 33 bp, Artificial Sequence; identical to SEQ ID NO: 109
  Description of Artificial Sequence: Synthetic oligonucleotide

SEQ ID NO: 3222 - protein, 11 aa, Artificial Sequence
  Description of Artificial Sequence: Synthetic peptide
RASQGIRNDLG

SEQ ID NO: 3223 - DNA, 48 bp, Artificial Sequence; identical to SEQ ID NO: 419
  Description of Artificial Sequence: Synthetic oligonucleotide

SEQ ID NO: 3224 - protein, 16 aa, Artificial Sequence
  Description of Artificial Sequence: Synthetic peptide
KSSQSLLHSDGKTFLY

SEQ ID NO: 3225 - DNA, 48 bp, Artificial Sequence; identical to SEQ ID NO: 419
  Description of Artificial Sequence: Synthetic oligonucleotide

SEQ ID NO: 3226 - protein, 16 aa, Artificial Sequence
  Description of Artificial Sequence: Synthetic peptide
KSSQSLLHSDGKTFLY

SEQ ID NO: 3227 - DNA, 48 bp, Artificial Sequence; identical to SEQ ID NO: 419
  Description of Artificial Sequence: Synthetic oligonucleotide

SEQ ID NO: 3228 - protein, 16 aa, Artificial Sequence
  Description of Artificial Sequence: Synthetic peptide
KSSQSLLHSDGKTFLY

SEQ ID NO: 3229 - DNA, 51 bp, Artificial Sequence
  Description of Artificial Sequence: Synthetic oligonucleotide
aagtccagccagaatgttttacacagctccaacagtaataactacttagtt

SEQ ID NO: 3230 - protein, 17 aa, Artificial Sequence
  Description of Artificial Sequence: Synthetic peptide
KSSQNVLHSSNSNNYLV

SEQ ID NO: 3231 - DNA, 48 bp, Artificial Sequence; identical to SEQ ID NO: 419
  Description of Artificial Sequence: Synthetic oligonucleotide

SEQ ID NO: 3232 - protein, 16 aa, Artificial Sequence
  Description of Artificial Sequence: Synthetic peptide
KSSQSLLHSDGKTFLY

SEQ ID NO: 3233 - DNA, 33 bp, Artificial Sequence; identical to SEQ ID NO: 93
  Description of Artificial Sequence: Synthetic oligonucleotide

SEQ ID NO: 3234 - protein, 11 aa, Artificial Sequence
  Description of Artificial Sequence: Synthetic peptide
RTSQGIRNDLG

SEQ ID NO: 3235 - DNA, 51 bp, Artificial Sequence
  Description of Artificial Sequence: Synthetic oligonucleotide
aagtccagccagaatgttttatacagttccaacaataacaactacttagct

SEQ ID NO: 3236 - protein, 17 aa, Artificial Sequence
  Description of Artificial Sequence: Synthetic peptide
KSSQNVLYSSNNNNYLA

SEQ ID NO: 3237 - DNA, 48 bp, Artificial Sequence
  Description of Artificial Sequence: Synthetic oligonucleotide
aagtctagtaagaccctcctgcatagtgatggaaagacctttttgtat

SEQ ID NO: 3238 - protein, 16 aa, Artificial Sequence
  Description of Artificial Sequence: Synthetic peptide
KSSKTLLHSDGKTFLY

SEQ ID NO: 3239 - DNA, 48 bp, Artificial Sequence; identical to SEQ ID NO: 419
  Description of Artificial Sequence: Synthetic oligonucleotide

SEQ ID NO: 3240 - protein, 16 aa, Artificial Sequence
  Description of Artificial Sequence: Synthetic peptide
KSSQSLLHSDGKTFLY

SEQ ID NO: 3241 - DNA, 48 bp, Artificial Sequence; identical to SEQ ID NO: 419
  Description of Artificial Sequence: Synthetic oligonucleotide

SEQ ID NO: 3242 - protein, 16 aa, Artificial Sequence
  Description of Artificial Sequence: Synthetic peptide
KSSQSLLHSDGKTFLY

SEQ ID NO: 3243 - DNA, 33 bp, Artificial Sequence; identical to SEQ ID NO: 109
  Description of Artificial Sequence: Synthetic oligonucleotide

SEQ ID NO: 3244 - protein, 11 aa, Artificial Sequence
  Description of Artificial Sequence: Synthetic peptide
RASQGIRNDLG

SEQ ID NO: 3245 - DNA, 33 bp, Artificial Sequence; identical to SEQ ID NO: 1167
  Description of Artificial Sequence: Synthetic oligonucleotide

SEQ ID NO: 3246 - protein, 11 aa, Artificial Sequence
  Description of Artificial Sequence: Synthetic peptide
RASQGIINWLA

SEQ ID NO: 3247 - DNA, 33 bp, Artificial Sequence; identical to SEQ ID NO: 205
  Description of Artificial Sequence: Synthetic oligonucleotide

SEQ ID NO: 3248 - protein, 11 aa, Artificial Sequence
  Description of Artificial Sequence: Synthetic peptide
RASQDIRNDLG

SEQ ID NO: 3249 - DNA, 51 bp, Artificial Sequence
  Description of Artificial Sequence: Synthetic oligonucleotide
aagtccagccagagtgttttatacagctccaacgataagaactacttagct

SEQ ID NO: 3250 - protein, 17 aa, Artificial Sequence
  Description of Artificial Sequence: Synthetic peptide
KSSQSVLYSSNDKNYLA

SEQ ID NO: 3251 - DNA, 51 bp, Artificial Sequence
  Description of Artificial Sequence: Synthetic oligonucleotide
aggtccagccagattgttttatccgactccaacaataacaactacttagct

SEQ ID NO: 3252 - protein, 17 aa, Artificial Sequence
  Description of Artificial Sequence: Synthetic peptide
RSSQIVLSDSNNNNYLA

SEQ ID NO: 3253 - DNA, 48 bp, Artificial Sequence; identical to SEQ ID NO: 419
  Description of Artificial Sequence: Synthetic oligonucleotide

SEQ ID NO: 3254 - protein, 16 aa, Artificial Sequence
  Description of Artificial Sequence: Synthetic peptide
KSSQSLLHSDGKTFLY

SEQ ID NO: 3255 - DNA, 51 bp, Artificial Sequence; identical to SEQ ID NO: 1057
  Description of Artificial Sequence: Synthetic oligonucleotide

SEQ ID NO: 3256 - protein, 17 aa, Artificial Sequence
  Description of Artificial Sequence: Synthetic peptide
KSSQSVLHSSNNNNYLA

SEQ ID NO: 3257 - DNA, 51 bp, Artificial Sequence
  Description of Artificial Sequence: Synthetic oligonucleotide
aagtccagccagagtgttttacacagttccaacaataataactacttagct

SEQ ID NO: 3258 - protein, 17 aa, Artificial Sequence
  Description of Artificial Sequence: Synthetic peptide
KSSQSVLHSSNNNNYLA

SEQ ID NO: 3259 - DNA, 48 bp, Artificial Sequence
  Description of Artificial Sequence: Synthetic oligonucleotide
tggtctagtcagagcctcctgcatagtaatggatacaactatttggat

SEQ ID NO: 3260 - protein, 16 aa, Artificial Sequence
  Description of Artificial Sequence: Synthetic peptide
WSSQSLLHSNGYNYLD

SEQ ID NO: 3261 - DNA, 33 bp, Artificial Sequence; identical to SEQ ID NO: 109
  Description of Artificial Sequence: Synthetic oligonucleotide

SEQ ID NO: 3262 - protein, 11 aa, Artificial Sequence
  Description of Artificial Sequence: Synthetic peptide
RASQGIRNDLG

SEQ ID NO: 3263 - DNA, 33 bp, Artificial Sequence; identical to SEQ ID NO: 191
  Description of Artificial Sequence: Synthetic oligonucleotide

SEQ ID NO: 3264 - protein, 11 aa, Artificial Sequence
  Description of Artificial Sequence: Synthetic peptide
SGDKLGDKYAS

SEQ ID NO: 3265 - DNA, 33 bp, Artificial Sequence; identical to SEQ ID NO: 191
  Description of Artificial Sequence: Synthetic oligonucleotide

SEQ ID NO: 3266 - protein, 11 aa, Artificial Sequence
  Description of Artificial Sequence: Synthetic peptide
SGDKLGDKYAS

SEQ ID NO: 3267 - DNA, 33 bp, Artificial Sequence; identical to SEQ ID NO: 191
  Description of Artificial Sequence: Synthetic oligonucleotide

SEQ ID NO: 3268 - protein, 11 aa, Artificial Sequence
  Description of Artificial Sequence: Synthetic peptide
SGDKLGDKYAS

SEQ ID NO: 3269 - DNA, 39 bp, Artificial Sequence
  Description of Artificial Sequence: Synthetic oligonucleotide
tctggaagcagctcctacatcggaagtaatactgtagac

SEQ ID NO: 3270 - protein, 13 aa, Artificial Sequence
  Description of Artificial Sequence: Synthetic peptide
SGSSSYIGSNTVD

SEQ ID NO: 3271 - DNA, 33 bp, Artificial Sequence
  Description of Artificial Sequence: Synthetic oligonucleotide
tctggagataaattgggggataaatttgcttgc

SEQ ID NO: 3272 - protein, 11 aa, Artificial Sequence
  Description of Artificial Sequence: Synthetic peptide
SGDKLGDKFAC

SEQ ID NO: 3273 - DNA, 33 bp, Artificial Sequence; identical to SEQ ID NO: 191
  Description of Artificial Sequence: Synthetic oligonucleotide

SEQ ID NO: 3274 - protein, 11 aa, Artificial Sequence
  Description of Artificial Sequence: Synthetic peptide
SGDKLGDKYAS

SEQ ID NO: 3275 - DNA, 33 bp, Artificial Sequence; identical to SEQ ID NO: 739
  Description of Artificial Sequence: Synthetic oligonucleotide

SEQ ID NO: 3276 - protein, 11 aa, Artificial Sequence
  Description of Artificial Sequence: Synthetic peptide
SGDKLGDKYVC

SEQ ID NO: 3277 - DNA, 33 bp, Artificial Sequence
  Description of Artificial Sequence: Synthetic oligonucleotide
tctggagataaattgggggataaatatgtttcc

SEQ ID NO: 3278 - protein, 11 aa, Artificial Sequence
  Description of Artificial Sequence: Synthetic peptide
SGDKLGDKYVS

SEQ ID NO: 3279 - DNA, 33 bp, Artificial Sequence
  Description of Artificial Sequence: Synthetic oligonucleotide
tctggagataaattgggtaataaatatgtttgc

SEQ ID NO: 3280 - protein, 11 aa, Artificial Sequence
  Description of Artificial Sequence: Synthetic peptide
SGDKLGNKYVC

SEQ ID NO: 3281 - DNA, 33 bp, Artificial Sequence
  Description of Artificial Sequence: Synthetic oligonucleotide
tctggagatgaattggggaataaatatgcttgc

SEQ ID NO: 3282 - protein, 11 aa, Artificial Sequence
  Description of Artificial Sequence: Synthetic peptide
SGDELGNKYAC

SEQ ID NO: 3283 - DNA, 33 bp, Artificial Sequence; identical to SEQ ID NO: 693
  Description of Artificial Sequence: Synthetic oligonucleotide

SEQ ID NO: 3284 - protein, 11 aa, Artificial Sequence
  Description of Artificial Sequence: Synthetic peptide
SGDKLGDKYAC

SEQ ID NO: 3285 - DNA, 33 bp, Artificial Sequence; identical to SEQ ID NO: 191
  Description of Artificial Sequence: Synthetic oligonucleotide

SEQ ID NO: 3286 - protein, 11 aa, Artificial Sequence
  Description of Artificial Sequence: Synthetic peptide
SGDKLGDKYAS

SEQ ID NO: 3287 - DNA, 33 bp, Artificial Sequence; identical to SEQ ID NO: 191
  Description of Artificial Sequence: Synthetic oligonucleotide

SEQ ID NO: 3288 - protein, 11 aa, Artificial Sequence
  Description of Artificial Sequence: Synthetic peptide
SGDKLGDKYAS

SEQ ID NO: 3289 - DNA, 39 bp, Artificial Sequence
  Description of Artificial Sequence: Synthetic oligonucleotide
tctggaagcagctccaacatcggaagttatgctgtaaac

SEQ ID NO: 3290 - protein, 13 aa, Artificial Sequence
  Description of Artificial Sequence: Synthetic peptide
SGSSSNIGSYAVN

SEQ ID NO: 3291 - DNA, 39 bp, Artificial Sequence
  Description of Artificial Sequence: Synthetic oligonucleotide
tctggaagcagctccaacatcggaagtaattctataaac

SEQ ID NO: 3292 - protein, 13 aa, Artificial Sequence
  Description of Artificial Sequence: Synthetic peptide
SGSSSNIGSNSIN

SEQ ID NO: 3293 - DNA, 39 bp, Artificial Sequence
  Description of Artificial Sequence: Synthetic oligonucleotide
tctggaagcagctccaacatcggaagtaatgctgtaaac

SEQ ID NO: 3294 - protein, 13 aa, Artificial Sequence
  Description of Artificial Sequence: Synthetic peptide
SGSSSNIGSNAVN

SEQ ID NO: 3295 - DNA, 33 bp, Artificial Sequence; identical to SEQ ID NO: 191
  Description of Artificial Sequence: Synthetic oligonucleotide

SEQ ID NO: 3296 - protein, 11 aa, Artificial Sequence
  Description of Artificial Sequence: Synthetic peptide
SGDKLGDKYAS

SEQ ID NO: 3297 - DNA, 33 bp, Artificial Sequence; identical to SEQ ID NO: 3277
  Description of Artificial Sequence: Synthetic oligonucleotide

SEQ ID NO: 3298 - protein, 11 aa, Artificial Sequence
  Description of Artificial Sequence: Synthetic peptide
SGDKLGDKYVS

SEQ ID NO: 3299 - DNA, 33 bp, Artificial Sequence
  Description of Artificial Sequence: Synthetic oligonucleotide
tctggagataaattggggaataaatatgtttgc

SEQ ID NO: 3300 - protein, 11 aa, Artificial Sequence
  Description of Artificial Sequence: Synthetic peptide
SGDKLGNKYVC

SEQ ID NO: 3301 - DNA, 33 bp, Artificial Sequence
  Description of Artificial Sequence: Synthetic oligonucleotide
tctggagataaattgggggataaatttgcttcc

SEQ ID NO: 3302 - protein, 11 aa, Artificial Sequence
  Description of Artificial Sequence: Synthetic peptide
SGDKLGDKFAS

SEQ ID NO: 3303 - DNA, 39 bp, Artificial Sequence; identical to SEQ ID NO: 3293
  Description of Artificial Sequence: Synthetic oligonucleotide

SEQ ID NO: 3304 - protein, 13 aa, Artificial Sequence
  Description of Artificial Sequence: Synthetic peptide
SGSSSNIGSNAVN

SEQ ID NO: 3305 - DNA, 33 bp, Artificial Sequence
  Description of Artificial Sequence: Synthetic oligonucleotide
tctggatataaattggggtataaatatgtttgc

SEQ ID NO: 3306 - protein, 11 aa, Artificial Sequence
  Description of Artificial Sequence: Synthetic peptide
SGYKLGYKYVC

SEQ ID NO: 3307 - DNA, 33 bp, Artificial Sequence
  Description of Artificial Sequence: Synthetic oligonucleotide
tctggaaataaattgggggataaatatgcttcc

SEQ ID NO: 3308 - protein, 11 aa, Artificial Sequence
  Description of Artificial Sequence: Synthetic peptide
SGNKLGDKYAS

SEQ ID NO: 3309 - DNA, 42 bp, Artificial Sequence
  Description of Artificial Sequence: Synthetic oligonucleotide
accttacgcagtggcatcactgttactacctataggatatac

SEQ ID NO: 3310 - protein, 14 aa, Artificial Sequence
  Description of Artificial Sequence: Synthetic peptide
TLRSGITVTTYRIY

SEQ ID NO: 3311 - DNA, 33 bp, Artificial Sequence; identical to SEQ ID NO: 191
  Description of Artificial Sequence: Synthetic oligonucleotide

SEQ ID NO: 3312 - protein, 11 aa, Artificial Sequence
  Description of Artificial Sequence: Synthetic peptide
SGDKLGDKYAS

SEQ ID NO: 3313 - DNA, 33 bp, Artificial Sequence
  Description of Artificial Sequence: Synthetic oligonucleotide
tctggagataaattggggaataaatatgtttcc

SEQ ID NO: 3314 - protein, 11 aa, Artificial Sequence
  Description of Artificial Sequence: Synthetic peptide
SGDKLGNKYVS

SEQ ID NO: 3315 - DNA, 33 bp, Artificial Sequence; identical to SEQ ID NO: 3281
  Description of Artificial Sequence: Synthetic oligonucleotide

SEQ ID NO: 3316 - protein, 11 aa, Artificial Sequence
  Description of Artificial Sequence: Synthetic peptide
SGDELGNKYAC

SEQ ID NO: 3317 - DNA, 33 bp, Artificial Sequence; identical to SEQ ID NO: 191
  Description of Artificial Sequence: Synthetic oligonucleotide

SEQ ID NO: 3318 - protein, 11 aa, Artificial Sequence
  Description of Artificial Sequence: Synthetic peptide
SGDKLGDKYAS

SEQ ID NO: 3319 - DNA, 39 bp, Artificial Sequence; identical to SEQ ID NO: 3293
  Description of Artificial Sequence: Synthetic oligonucleotide

SEQ ID NO: 3320 - protein, 13 aa, Artificial Sequence
  Description of Artificial Sequence: Synthetic peptide
SGSSSNIGSNAVN

SEQ ID NO: 3321 - DNA, 33 bp, Artificial Sequence; identical to SEQ ID NO: 191
  Description of Artificial Sequence: Synthetic oligonucleotide

SEQ ID NO: 3322 - protein, 11 aa, Artificial Sequence
  Description of Artificial Sequence: Synthetic peptide
SGDKLGDKYAS

SEQ ID NO: 3323 - DNA, 33 bp, Artificial Sequence; identical to SEQ ID NO: 739
  Description of Artificial Sequence: Synthetic oligonucleotide

SEQ ID NO: 3324 - protein, 11 aa, Artificial Sequence
  Description of Artificial Sequence: Synthetic peptide
SGDKLGDKYVC

SEQ ID NO: 3325 - DNA, 33 bp, Artificial Sequence; identical to SEQ ID NO: 191
  Description of Artificial Sequence: Synthetic oligonucleotide

SEQ ID NO: 3326 - protein, 11 aa, Artificial Sequence
  Description of Artificial Sequence: Synthetic peptide
SGDKLGDKYAS

SEQ ID NO: 3327 - DNA, 33 bp, Artificial Sequence; identical to SEQ ID NO: 693
  Description of Artificial Sequence: Synthetic oligonucleotide

SEQ ID NO: 3328 - protein, 11 aa, Artificial Sequence
  Description of Artificial Sequence: Synthetic peptide
SGDKLGDKYAC

SEQ ID NO: 3329 - DNA, 33 bp, Artificial Sequence; identical to SEQ ID NO: 191
  Description of Artificial Sequence: Synthetic oligonucleotide

SEQ ID NO: 3330 - protein, 11 aa, Artificial Sequence
  Description of Artificial Sequence: Synthetic peptide
SGDKLGDKYAS

SEQ ID NO: 3331 - DNA, 33 bp, Artificial Sequence
  Description of Artificial Sequence: Synthetic oligonucleotide
tctggagataatttgggggataaatatgcttcc

SEQ ID NO: 3332 - protein, 11 aa, Artificial Sequence
  Description of Artificial Sequence: Synthetic peptide
SGDNLGDKYAS

SEQ ID NO: 3333 - DNA, 33 bp, Artificial Sequence; identical to SEQ ID NO: 693
  Description of Artificial Sequence: Synthetic oligonucleotide

SEQ ID NO: 3334 - protein, 11 aa, Artificial Sequence
  Description of Artificial Sequence: Synthetic peptide
SGDKLGDKYAC

SEQ ID NO: 3335 - DNA, 33 bp, Artificial Sequence; identical to SEQ ID NO: 191
  Description of Artificial Sequence: Synthetic oligonucleotide

SEQ ID NO: 3336 - protein, 11 aa, Artificial Sequence
  Description of Artificial Sequence: Synthetic peptide
SGDKLGDKYAS

SEQ ID NO: 3337 - DNA, 33 bp, Artificial Sequence; identical to SEQ ID NO: 191
  Description of Artificial Sequence: Synthetic oligonucleotide

SEQ ID NO: 3338 - protein, 11 aa, Artificial Sequence
  Description of Artificial Sequence: Synthetic peptide
SGDKLGDKYAS

SEQ ID NO: 3339 - DNA, 33 bp, Artificial Sequence
  Description of Artificial Sequence: Synthetic oligonucleotide
tctggcgataaattgggaaataaatatgcttgc

SEQ ID NO: 3340 - protein, 11 aa, Artificial Sequence
  Description of Artificial Sequence: Synthetic peptide
SGDKLGNKYAC

SEQ ID NO: 3341 - DNA, 33 bp, Artificial Sequence; identical to SEQ ID NO: 693
  Description of Artificial Sequence: Synthetic oligonucleotide

SEQ ID NO: 3342 - protein, 11 aa, Artificial Sequence
  Description of Artificial Sequence: Synthetic peptide
SGDKLGDKYAC

SEQ ID NO: 3343 - DNA, 33 bp, Artificial Sequence
  Description of Artificial Sequence: Synthetic oligonucleotide
tctggaagtaaattgggtaataaatatgtttgc

SEQ ID NO: 3344 - protein, 11 aa, Artificial Sequence
  Description of Artificial Sequence: Synthetic peptide
SGSKLGNKYVC

SEQ ID NO: 3345 - DNA, 33 bp, Artificial Sequence; identical to SEQ ID NO: 693
  Description of Artificial Sequence: Synthetic oligonucleotide

SEQ ID NO: 3346 - protein, 11 aa, Artificial Sequence
  Description of Artificial Sequence: Synthetic peptide
SGDKLGDKYAC

SEQ ID NO: 3347 - DNA, 33 bp, Artificial Sequence; identical to SEQ ID NO: 739
  Description of Artificial Sequence: Synthetic oligonucleotide

SEQ ID NO: 3348 - protein, 11 aa, Artificial Sequence
  Description of Artificial Sequence: Synthetic peptide
SGDKLGDKYVC

SEQ ID NO: 3349 - DNA, 33 bp, Artificial Sequence; identical to SEQ ID NO: 191
  Description of Artificial Sequence: Synthetic oligonucleotide

SEQ ID NO: 3350 - protein, 11 aa, Artificial Sequence
  Description of Artificial Sequence: Synthetic peptide
SGDKLGDKYAS

SEQ ID NO: 3351 - DNA, 33 bp, Artificial Sequence
  Description of Artificial Sequence: Synthetic oligonucleotide
tctggagataaattgggaaataaatatgtttgt

SEQ ID NO: 3352 - protein, 11 aa, Artificial Sequence
  Description of Artificial Sequence: Synthetic peptide
SGDKLGNKYVC

SEQ ID NO: 3353 - DNA, 33 bp, Artificial Sequence; identical to SEQ ID NO: 191
  Description of Artificial Sequence: Synthetic oligonucleotide

SEQ ID NO: 3354 - protein, 11 aa, Artificial Sequence
  Description of Artificial Sequence: Synthetic peptide
SGDKLGDKYAS

SEQ ID NO: 3355 - DNA, 33 bp, Artificial Sequence; identical to SEQ ID NO: 693
  Description of Artificial Sequence: Synthetic oligonucleotide

SEQ ID NO: 3356 - protein, 11 aa, Artificial Sequence
  Description of Artificial Sequence: Synthetic peptide
SGDKLGDKYAC

SEQ ID NO: 3357 - DNA, 39 bp, Artificial Sequence
  Description of Artificial Sequence: Synthetic oligonucleotide
tctggaagcagctccaacatcggaaataatgctgtaagc

SEQ ID NO: 3358 - protein, 13 aa, Artificial Sequence
  Description of Artificial Sequence: Synthetic peptide
SGSSSNIGNNAVS

SEQ ID NO: 3359 - DNA, 42 bp, Artificial Sequence
  Description of Artificial Sequence: Synthetic oligonucleotide
actgggagcagctccaatatcggggcaggttatgatgtacac

SEQ ID NO: 3360 - protein, 14 aa, Artificial Sequence
  Description of Artificial Sequence: Synthetic peptide
TGSSSNIGAGYDVH

SEQ ID NO: 3361 - DNA, 33 bp, Artificial Sequence
  Description of Artificial Sequence: Synthetic oligonucleotide
tctggagataagttgggggataaatatgtttgc

SEQ ID NO: 3362 - protein, 11 aa, Artificial Sequence
  Description of Artificial Sequence: Synthetic peptide
SGDKLGDKYVC

SEQ ID NO: 3363 - DNA, 33 bp, Artificial Sequence; identical to SEQ ID NO: 739
  Description of Artificial Sequence: Synthetic oligonucleotide

SEQ ID NO: 3364 - protein, 11 aa, Artificial Sequence
  Description of Artificial Sequence: Synthetic peptide
SGDKLGDKYVC

SEQ ID NO: 3365 - DNA, 33 bp, Artificial Sequence; identical to SEQ ID NO: 3277
  Description of Artificial Sequence: Synthetic oligonucleotide

SEQ ID NO: 3366 - protein, 11 aa, Artificial Sequence
  Description of Artificial Sequence: Synthetic peptide
SGDKLGDKYVS

SEQ ID NO: 3367 - DNA, 33 bp, Artificial Sequence; identical to SEQ ID NO: 3277
  Description of Artificial Sequence: Synthetic oligonucleotide

SEQ ID NO: 3368 - protein, 11 aa, Artificial Sequence
  Description of Artificial Sequence: Synthetic peptide
SGDKLGDKYVS

SEQ ID NO: 3369 - DNA, 39 bp, Artificial Sequence
  Description of Artificial Sequence: Synthetic oligonucleotide
tctggaagcagctccaacatcggaagtaatactgtaaat

SEQ ID NO: 3370 - protein, 13 aa, Artificial Sequence
  Description of Artificial Sequence: Synthetic peptide
SGSSSNIGSNTVN

SEQ ID NO: 3371 - DNA, 33 bp, Artificial Sequence; identical to SEQ ID NO: 739
  Description of Artificial Sequence: Synthetic oligonucleotide

SEQ ID NO: 3372 - protein, 11 aa, Artificial Sequence
  Description of Artificial Sequence: Synthetic peptide
SGDKLGDKYVC

SEQ ID NO: 3373 - DNA, 33 bp, Artificial Sequence; identical to SEQ ID NO: 739
  Description of Artificial Sequence: Synthetic oligonucleotide

SEQ ID NO: 3374 - protein, 11 aa, Artificial Sequence
  Description of Artificial Sequence: Synthetic peptide
SGDKLGDKYVC

SEQ ID NO: 3375 - DNA, 33 bp, Artificial Sequence; identical to SEQ ID NO: 739
  Description of Artificial Sequence: Synthetic oligonucleotide

SEQ ID NO: 3376 - protein, 11 aa, Artificial Sequence
  Description of Artificial Sequence: Synthetic peptide
SGDKLGDKYVC

SEQ ID NO: 3377 - DNA, 33 bp, Artificial Sequence; identical to SEQ ID NO: 739
  Description of Artificial Sequence: Synthetic oligonucleotide

SEQ ID NO: 3378 - protein, 11 aa, Artificial Sequence
  Description of Artificial Sequence: Synthetic peptide
SGDKLGDKYVC

SEQ ID NO: 3379 - DNA, 33 bp, Artificial Sequence
  Description of Artificial Sequence: Synthetic oligonucleotide
tctggagatagattgggggataaatatgtttgc

SEQ ID NO: 3380 - protein, 11 aa, Artificial Sequence
  Description of Artificial Sequence: Synthetic peptide
SGDRLGDKYVC

SEQ ID NO: 3381 - DNA, 33 bp, Artificial Sequence; identical to SEQ ID NO: 739
  Description of Artificial Sequence: Synthetic oligonucleotide

SEQ ID NO: 3382 - protein, 11 aa, Artificial Sequence
  Description of Artificial Sequence: Synthetic peptide
SGDKLGDKYVC

SEQ ID NO: 3383 - DNA, 33 bp, Artificial Sequence
  Description of Artificial Sequence: Synthetic oligonucleotide
tctggagataaattgggtgataaatatgcttgc

SEQ ID NO: 3384 - protein, 11 aa, Artificial Sequence
  Description of Artificial Sequence: Synthetic peptide
SGDKLGDKYAC

SEQ ID NO: 3385 - DNA, 33 bp, Artificial Sequence; identical to SEQ ID NO: 3383
  Description of Artificial Sequence: Synthetic oligonucleotide

SEQ ID NO: 3386 - protein, 11 aa, Artificial Sequence
  Description of Artificial Sequence: Synthetic peptide
SGDKLGDKYAC

SEQ ID NO: 3387 - DNA, 33 bp, Artificial Sequence
  Description of Artificial Sequence: Synthetic oligonucleotide
tctggagataaattgggggataaatatgttcac

SEQ ID NO: 3388 - protein, 11 aa, Artificial Sequence
  Description of Artificial Sequence: Synthetic peptide
SGDKLGDKYVH

SEQ ID NO: 3389 - DNA, 33 bp, Artificial Sequence
  Description of Artificial Sequence: Synthetic oligonucleotide
tctggagataaattgggggataaatatgtttgt

SEQ ID NO: 3390 - protein, 11 aa, Artificial Sequence
  Description of Artificial Sequence: Synthetic peptide
SGDKLGDKYVC

SEQ ID NO: 3391 - DNA, 33 bp, Artificial Sequence; identical to SEQ ID NO: 3389
  Description of Artificial Sequence: Synthetic oligonucleotide

SEQ ID NO: 3392 - protein, 11 aa, Artificial Sequence
  Description of Artificial Sequence: Synthetic peptide
SGDKLGDKYVC

SEQ ID NO: 3393 - DNA, 33 bp, Artificial Sequence
  Description of Artificial Sequence: Synthetic oligonucleotide
tctggagataaattggggggaaaatatgcttcc

SEQ ID NO: 3394 - protein, 11 aa, Artificial Sequence
  Description of Artificial Sequence: Synthetic peptide
SGDKLGGKYAS

SEQ ID NO: 3395 - DNA, 33 bp, Artificial Sequence; identical to SEQ ID NO: 693
  Description of Artificial Sequence: Synthetic oligonucleotide

SEQ ID NO: 3396 - protein, 11 aa, Artificial Sequence
  Description of Artificial Sequence: Synthetic peptide
SGDKLGDKYAC

SEQ ID NO: 3397 - DNA, 39 bp, Artificial Sequence
  Description of Artificial Sequence: Synthetic oligonucleotide
acccgcagcagtggcagcattaccggcaactatgtgcag

SEQ ID NO: 3398 - protein, 13 aa, Artificial Sequence
  Description of Artificial Sequence: Synthetic peptide
TRSSGSITGNYVQ

SEQ ID NO: 3399 - DNA, 33 bp, Artificial Sequence
  Description of Artificial Sequence: Synthetic oligonucleotide
tctggagataaattgggggataaatattcttgc

SEQ ID NO: 3400 - protein, 11 aa, Artificial Sequence
  Description of Artificial Sequence: Synthetic peptide
SGDKLGDKYSC

SEQ ID NO: 3401 - DNA, 33 bp, Artificial Sequence
  Description of Artificial Sequence: Synthetic oligonucleotide
tctggagataaattgggggataaatatgcttgt

SEQ ID NO: 3402 - protein, 11 aa, Artificial Sequence
  Description of Artificial Sequence: Synthetic peptide
SGDKLGDKYAC

SEQ ID NO: 3403 - DNA, 33 bp, Artificial Sequence; identical to SEQ ID NO: 3393
  Description of Artificial Sequence: Synthetic oligonucleotide

SEQ ID NO: 3404 - protein, 11 aa, Artificial Sequence
  Description of Artificial Sequence: Synthetic peptide
SGDKLGGKYAS

SEQ ID NO: 3405 - DNA, 33 bp, Artificial Sequence
  Description of Artificial Sequence: Synthetic oligonucleotide
caaggagacagcctcagaagctattatgcaagc

SEQ ID NO: 3406 - protein, 11 aa, Artificial Sequence
  Description of Artificial Sequence: Synthetic peptide
QGDSLRSYYAS

SEQ ID NO: 3407 - DNA, 33 bp, Artificial Sequence; identical to SEQ ID NO: 693
  Description of Artificial Sequence: Synthetic oligonucleotide

SEQ ID NO: 3408 - protein, 11 aa, Artificial Sequence
  Description of Artificial Sequence: Synthetic peptide
SGDKLGDKYAC

SEQ ID NO: 3409 - DNA, 33 bp, Artificial Sequence
  Description of Artificial Sequence: Synthetic oligonucleotide
caaggagacagcctcagaaactattatgtaagc

(The sequence listing continues in the following parts.)

What is claimed is:

1. A method of treating or preventing a cardiovascular disease comprising administering to a patient in need thereof a therapeutically effective dose of an interfering RNA of ASGR (asialoglycoprotein receptor), ASGR-1 (asialoglycoprotein receptor 1), and/or ASGR-2 (asialoglycoprotein receptor 2).

2. The method of claim 1, wherein said cardiovascular disease is coronary artery disease or myocardial infarction.

3. A method of reducing LDL (low density lipoprotein) cholesterol levels in a patient comprising administering to a patient in need thereof a therapeutically effective dose of an interfering RNA of ASGR (asialoglycoprotein receptor), ASGR-1 (asialoglycoprotein receptor 1), and/or ASGR-2 (asialoglycoprotein receptor 2).

4. A method of reducing non-HDL (non-high density lipoprotein) cholesterol levels in a patient comprising administering to a patient in need thereof a therapeutically effective dose of an interfering RNA of ASGR (asialoglycoprotein receptor), ASGR-1 (asialoglycoprotein receptor 1), and/or ASGR-2 (asialoglycoprotein receptor 2).

5. A method of increasing ALP (alkaline phosphatase) levels in a patient comprising administering to a patient in need thereof a therapeutically effective dose of an interfering RNA of ASGR (asialoglycoprotein receptor), ASGR-1 (asialoglycoprotein receptor 1), and/or ASGR-2 (asialoglycoprotein receptor 2).

6. The methods of any one of claims 1-5, wherein the interfering RNA comprises siRNA or shRNA.

7. The method of claim 1, wherein the interfering RNA is siRNA or shRNA.

8. The method of claim 3, wherein the interfering RNA is siRNA or shRNA.

9. The method of claim 4, wherein the interfering RNA is siRNA or shRNA.

10. The method of claim 5, wherein the interfering RNA is siRNA or shRNA.

11. The method of claim 1, wherein the interfering RNA is administered simultaneously or sequentially with at least one agent that lowers cholesterol.

12. The method of claim 11, wherein the at least one agent is a statin, an anti-PCSK9 inhibitor or a combination thereof.

13. The method of claim 3, wherein the interfering RNA is administered simultaneously or sequentially with at least one agent that lowers cholesterol.

14. The methods of claim 13, wherein the at least one agent is a statin, an anti-PCSK9 inhibitor or a combination thereof.

15. The method of claim 4, wherein the interfering RNA is administered simultaneously or sequentially with at least one agent that lowers cholesterol.

16. The methods of claim 15, wherein the at least one agent is a statin, an anti-PCSK9 inhibitor or a combination thereof.

17. The method of claim 5, wherein the interfering RNA is administered simultaneously or sequentially with at least one agent that lowers cholesterol.

18. The methods of claim 17, wherein the at least one agent is a statin, an anti-PCSK9 inhibitor or a combination thereof.

19. The method of claim 3, wherein the patient has coronary artery disease or myocardial infarction.

20. The method of claim 4, wherein the patient has coronary artery disease or myocardial infarction.

21. The method of claim 5, wherein the patient has coronary artery disease or myocardial infarction.

22. The method of claim 1, wherein the interfering RNA reduces expression of ASGR-1 (asialoglycoprotein receptor 1).

23. The method of claim 3, wherein the interfering RNA reduces expression of ASGR-1 (asialoglycoprotein receptor 1).

24. The method of claim 4, wherein the interfering RNA reduces expression of ASGR-1 (asialoglycoprotein receptor 1).

25. The method of claim 5, wherein the interfering RNA reduces expression of ASGR-1 (asialoglycoprotein receptor 1).

26. The method of claim 1, wherein the interfering RNA reduces expression of ASGR-2 (asialoglycoprotein receptor 2).

27. The method of claim 3, wherein the interfering RNA reduces expression of ASGR-2 (asialoglycoprotein receptor 2).

28. The method of claim 4, wherein the interfering RNA reduces expression of ASGR-2 (asialoglycoprotein receptor 2).

29. The method of claim 5, wherein the interfering RNA reduces expression of ASGR-2 (asialoglycoprotein receptor 2).

30. The method of claim 1, wherein the interfering RNA is siRNA.

31. The method of claim 1, wherein the interfering RNA is at least partially double stranded.

32. The method of claim 30, wherein the siRNA comprises a duplex region of about 19 to about 25 base pairs in length.

33. The method of claim 30, wherein the siRNA comprises:
a sense strand of about 15-30 nucleotides; and
an antisense strand of about 15-30 nucleotides.

34. The method of claim 30, wherein the siRNA comprises:
a sense strand of about 19-25 nucleotides; and
an antisense strand of about 19-25 nucleotides.

35. The method of claim 3, wherein the interfering RNA is siRNA.

36. The method of claim 3, wherein the interfering RNA is at least partially double stranded.

37. The method of claim 35, wherein the siRNA comprises a duplex region of about 19 to about 25 base pairs in length.

38. The method of claim 35, wherein the siRNA comprises:
a sense strand of about 15-30 nucleotides; and
an antisense strand of about 15-30 nucleotides.

39. The method of claim 35, wherein the siRNA comprises:
a sense strand of about 19-25 nucleotides; and
an antisense strand of about 19-25 nucleotides.

40. The method of claim 4, wherein the interfering RNA is siRNA.

41. The method of claim 4, wherein the interfering RNA is at least partially double stranded.

42. The method of claim 40, wherein the siRNA comprises a duplex region of about 19 to about 25 base pairs in length.

43. The method of claim 40, wherein the siRNA comprises:
a sense strand of about 15-30 nucleotides; and
an antisense strand of about 15-30 nucleotides.

44. The method of claim 40, wherein the siRNA comprises:
a sense strand of about 19-25 nucleotides; and
an antisense strand of about 19-25 nucleotides.

45. The method of claim 5, wherein the interfering RNA is siRNA.

46. The method of claim 5, wherein the interfering RNA is at least partially double stranded.

47. The method of claim 45, wherein the siRNA comprises a duplex region of about 19 to about 25 base pairs in length.

48. The method of claim 45, wherein the siRNA comprises:
a sense strand of about 15-30 nucleotides; and
an antisense strand of about 15-30 nucleotides.

49. The method of claim 45, wherein the siRNA comprises:
a sense strand of about 19-25 nucleotides; and
an antisense strand of about 19-25 nucleotides.

50. The method of claim 1, wherein the interfering RNA is shRNA.

51. The method of claim 3, wherein the interfering RNA is shRNA.

52. The method of claim 4, wherein the interfering RNA is shRNA.

53. The method of claim 5, wherein the interfering RNA is shRNA.

54. The method of claim 1, wherein the interfering RNA is a siRNA that comprises a sense strand and an antisense strand, wherein the antisense strand comprises a region having a sequence that is complementary to an ASGR-1 (asialoglycoprotein receptor 1) sequence, or an ASGR-2 (asialoglycoprotein receptor 2) sequence, and wherein said region comprises at least 15 contiguous nucleotides.

55. The method of claim 3, wherein the interfering RNA is a siRNA that comprises a sense strand and an antisense strand, wherein the antisense strand comprises a region having a sequence that is complementary to an ASGR-1 (asialoglycoprotein receptor 1) sequence, or an ASGR-2 (asialoglycoprotein receptor 2) sequence, and wherein said region comprises at least 15 contiguous nucleotides.

56. The method of claim 4, wherein the interfering RNA is a siRNA that comprises a sense strand and an antisense strand, wherein the antisense strand comprises a region having a sequence that is complementary to an ASGR-1 (asialoglycoprotein receptor 1) sequence, or an ASGR-2 (asialoglycoprotein receptor 2) sequence, and wherein said region comprises at least 15 contiguous nucleotides.

57. The method of claim 5, wherein the interfering RNA is a siRNA that comprises a sense strand and an antisense strand, wherein the antisense strand comprises a region having a sequence that is complementary to an ASGR-1 (asialoglycoprotein receptor 1) sequence, or an ASGR-2 (asialoglycoprotein receptor 2) sequence, and wherein said region comprises at least 15 contiguous nucleotides.

58. The method of claim 1, wherein the interfering RNA comprises a sense strand and an anti-sense strand, wherein the sense strand comprises a sequence that is substantially complementary to a sequence of the antisense strand to form a duplex region of about 15 to about 30 base pairs in length.

59. The method of claim 3, wherein the interfering RNA comprises a sense strand and an anti-sense strand, wherein the sense strand comprises a sequence that is substantially complementary to a sequence of the antisense strand to form a duplex region of about 15 to about 30 base pairs in length.

60. The method of claim 4, wherein the interfering RNA comprises a sense strand and an anti-sense strand, wherein the sense strand comprises a sequence that is substantially complementary to a sequence of the antisense strand to form a duplex region of about 15 to about 30 base pairs in length.

61. The method of claim 5, wherein the interfering RNA comprises a sense strand and an anti-sense strand, wherein the sense strand comprises a sequence that is substantially complementary to a sequence of the antisense strand to form a duplex region of about 15 to about 30 base pairs in length.

62. The method of claim 1, wherein the interfering RNA comprises a sense strand and an anti-sense strand, wherein the sense strand comprises a sequence that is complementary to a sequence of the antisense strand to form a duplex region of about 15 to about 30 base pairs in length.

63. The method of claim 3, wherein the interfering RNA comprises a sense strand and an anti-sense strand, wherein the sense strand comprises a sequence that is complementary to a sequence of the antisense strand to form a duplex region of about 15 to about 30 base pairs in length.

64. The method of claim 4, wherein the interfering RNA comprises a sense strand and an anti-sense strand, wherein the sense strand comprises a sequence that is complementary to a sequence of the antisense strand to form a duplex region of about 15 to about 30 base pairs in length.

65. The method of claim 5, wherein the interfering RNA comprises a sense strand and an anti-sense strand, wherein the sense strand comprises a sequence that is complementary to a sequence of the antisense strand to form a duplex region of about 15 to about 30 base pairs in length.

66. The method of claim 1, wherein the cardiovascular disease is thereby treated.

67. The method of claim 1, wherein the cardiovascular disease is thereby prevented.

68. The method of claim 3, wherein LDL is reduced by at least 20%.

69. The method of claim 4, wherein non-HDL is reduced by at least 20%.

70. The method of claim 5, wherein ALP is increased by at least 40%.

71. The method of claim 1, wherein the interfering RNA comprises a duplex region of about 19 to about 25 base pairs in length.

72. The method of claim 3, wherein the interfering RNA comprises a duplex region of about 19 to about 25 base pairs in length.

73. The method of claim 4, wherein the interfering RNA comprises a duplex region of about 19 to about 25 base pairs in length.

74. The method of claim 5, wherein the interfering RNA comprises a duplex region of about 19 to about 25 base pairs in length.

75. The method of claim 1, wherein the interfering RNA comprises a modified nucleotide.

76. The method of claim 3, wherein the interfering RNA comprises a modified nucleotide.

77. The method of claim 4, wherein the interfering RNA comprises a modified nucleotide.

78. The method of claim 5, wherein the interfering RNA comprises a modified nucleotide.

79. The method of claim 1, wherein the interfering RNA comprises a sequence that is 15 to 30 nucleotides in length and is 100% complementary to a sequence within ASGR (asialoglycoprotein receptor), ASGR-1 (asialoglycoprotein receptor 1), and/or ASGR-2 (asialoglycoprotein receptor 2), wherein the sequence within ASGR (asialoglycoprotein receptor), ASGR-1 (asialoglycoprotein receptor 1), and/or ASGR-2 (asialoglycoprotein receptor 2) is 15 to 30 nucleotides in length.

80. The method of claim 79, wherein the ASGR-1 (asialoglycoprotein receptor 1) is a human ASGR-1 having the sequence in SEQ ID NO: 32699), and the ASGR-2 (asialoglycoprotein receptor 2) is a human ASGR-2 having the sequence in SEQ ID NO: 32713.

81. The method of claim 80, wherein the interfering RNA consists essentially of:
a sense strand that is 15 to 30 nucleotides in length; and
an anti-sense strand that is 15 to 30 nucleotides in length.

82. The method of claim 81, wherein, the sense strand is at least 90% complementary to the anti-sense strand, wherein a duplex formed by the sense stand and the anti-sense strand is from 15-30 base pairs in length.

83. The method of claim 3, wherein the interfering RNA comprises a sequence that is 15 to 30 nucleotides in length and is 100% complementary to a sequence within ASGR (asialoglycoprotein receptor), ASGR-1 (asialoglycoprotein receptor 1), and/or ASGR-2 (asialoglycoprotein receptor 2), wherein the sequence within ASGR (asialoglycoprotein receptor), ASGR-1 (asialoglycoprotein receptor 1), and/or ASGR-2 (asialoglycoprotein receptor 2) is 15 to 30 nucleotides in length.

84. The method of claim 83, wherein the ASGR-1 (asialoglycoprotein receptor 1) is a human ASGR-1 having the sequence in SEQ ID NO: 32699), and the ASGR-2 (asialoglycoprotein receptor 2) is a human ASGR-2 having the sequence in SEQ ID NO: 32713.

85. The method of claim 84, wherein the interfering RNA consists essentially of:
a sense strand that is 15 to 30 nucleotides in length; and
an anti-sense strand that is 15 to 30 nucleotides in length.

86. The method of claim 85, wherein, wherein the sense strand is at least 90% complementary to the anti-sense strand, and wherein a duplex formed by the sense stand and the anti-sense strand is from 15-30 base pairs in length.

87. The method of claim 4, wherein the interfering RNA comprises a sequence that is 15 to 30 nucleotides in length and is 100% complementary to a sequence within ASGR (asialoglycoprotein receptor), ASGR-1 (asialoglycoprotein receptor 1), and/or ASGR-2 (asialoglycoprotein receptor 2), wherein the sequence within ASGR (asialoglycoprotein receptor), ASGR-1 (asialoglycoprotein receptor 1), and/or ASGR-2 (asialoglycoprotein receptor 2) is 15 to 30 nucleotides in length.

88. The method of claim 87, wherein the ASGR-1 (asialoglycoprotein receptor 1) is a human ASGR-1 having the sequence in SEQ ID NO: 32699), and the ASGR-2 (asialoglycoprotein receptor 2) is a human ASGR-2 having the sequence in SEQ ID NO: 32713.

89. The method of claim 88, wherein the interfering RNA consists essentially of:
a sense strand that is 15 to 30 nucleotides in length; and
an anti-sense strand that is 15 to 30 nucleotides in length.

90. The method of claim 89, wherein, the sense strand is at least 90% complementary to the anti-sense strand, and wherein a duplex formed by the sense stand and the anti-sense strand is from 15-30 base pairs in length.

91. The method of claim 5, wherein the interfering RNA comprises a sequence that is 15 to 30 nucleotides in length and is 100% complementary to a sequence within ASGR (asialoglycoprotein receptor), ASGR-1 (asialoglycoprotein receptor 1), and/or ASGR-2 (asialoglycoprotein receptor 2), wherein the sequence within ASGR (asialoglycoprotein receptor), ASGR-1 (asialoglycoprotein receptor 1), and/or ASGR-2 (asialoglycoprotein receptor 2) is 15 to 30 nucleotides in length.

92. The method of claim 91, wherein the ASGR-1 (asialoglycoprotein receptor 1) is a human ASGR-1 having the sequence in SEQ ID NO: 32699), and the ASGR-2 (asialoglycoprotein receptor 2) is a human ASGR-2 having the sequence in SEQ ID NO: 32713.

93. The method of claim 92, wherein the interfering RNA consists essentially of:
a sense strand that is 15 to 30 nucleotides in length; and
an anti-sense strand that is 15 to 30 nucleotides in length.

94. The method of claim 93, wherein, the sense strand is at least 90% complementary to the anti-sense strand, and wherein a duplex formed by the sense stand and the anti-sense strand is from 15-30 base pairs in length.

95. The method of claim 1, wherein the interfering RNA is conjugated to a targeting moiety, wherein the targeting moiety targets a cell in the liver.

96. The method of claim 3, wherein the interfering RNA is conjugated to a targeting moiety, wherein the targeting moiety targets a cell in the liver.

97. The method of claim 4, wherein the interfering RNA is conjugated to a targeting moiety, wherein the targeting moiety targets a cell in the liver.

98. The method of claim 5, wherein the interfering RNA is conjugated to a targeting moiety, wherein the targeting moiety targets a cell in the liver.

99. The method of claim 1, wherein the interfering RNA is administered parenterally.

100. The method of claim 3, wherein the interfering RNA is administered parenterally.

101. The method of claim 4, wherein the interfering RNA is administered parenterally.

102. The method of claim 5, wherein the interfering RNA is administered parenterally.

103. The method of claim 1, wherein the interfering RNA consists of a small interfering RNA.

104. The method of claim 3, wherein the interfering RNA consists of a small interfering RNA.

105. The method of claim 4, wherein the interfering RNA consists of a small interfering RNA.

106. The method of claim 5, wherein the interfering RNA consists of a small interfering RNA.

107. A method of treating a cardiovascular disease or myocardial infarction, said method comprising administering to a patient in need thereof a therapeutically effective dose of an siRNA targeting ASGR-1 (asialoglycoprotein receptor 1), wherein the siRNA comprises:
a sense strand that is about 15 to about 30 nucleotides in length; and
an anti-sense strand that is about 15 to about 30 nucleotides in length,
wherein the antisense strand comprises a sequence that is complementary to an ASGR1 sequence, and wherein the sense strand comprises a sequence that is complementary to a sequence of the antisense strand and thereby forms a duplex that is about 15 to about 30 base pairs in length, wherein said cardiovascular disease is coronary artery disease or myocardial infarction.

108. A method of increasing ALP (alkaline phosphatase) levels in a patient comprising administering to a patient in need thereof a therapeutically effective dose of an siRNA targeting ASGR-1 (asialoglycoprotein receptor 1), wherein the siRNA comprises:
a sense strand that is about 15 to about 30 nucleotides in length; and
an anti-sense strand that is about 15 to about 30 nucleotides in length,
wherein the antisense strand comprises a sequence that is complementary to an ASGR1 sequence, and wherein the sense strand comprises a sequence that is complementary to a sequence of the antisense strand and thereby forms a duplex that is about 15 to about 30 base pairs in length.

* * * * *

UNITED STATES PATENT AND TRADEMARK OFFICE
CERTIFICATE OF CORRECTION

| | | |
|---|---|---|
| PATENT NO. | : 10,358,497 B2 | |
| APPLICATION NO. | : 15/279162 | |
| DATED | : July 23, 2019 | |
| INVENTOR(S) | : Nioi et al. | |

It is certified that error appears in the above-identified patent and that said Letters Patent is hereby corrected as shown below:

On the Title Page

Item (71), Line 1, under Applicant, change "Inc," to --Inc.,--.

On Page 3, Column 1, Item (56), Line 31, under Other Publications, change "Pectrometry" to --Spectrometry--.

On Page 3, Column 1, Item (56), Line 55, under Other Publications, change "og" to --of--.

On Page 4, Column 1, Item (56), Line 25, under Other Publications, change "carboxymethycellulose," to --carboxymethylcellulose,--.

On Page 4, Column 1, Item (56), Line 28, under Other Publications, after "Hardonk" insert --et--.

On Page 5, Column 1, Item (56), Line 34, under Other Publications, change "Bacteriophae" to --Bacteriophage--.

On Page 5, Column 1, Item (56), Line 39, under Other Publications, change "asialogycoprotein" to --asialoglycoprotein--.

On Page 5, Column 1, Item (56), Line 46, under Other Publications, change "Immunication:" to --Immunization:--.

On Page 5, Column 2, Item (56), Line 7, under Other Publications, change "*coil*" to --*coli*--.

On Page 5, Column 2, Item (56), Line 51, under Other Publications, change "Crystralline" to --Crystalline--.

On Page 6, Column 1, Item (56), Line 66, under Other Publications, change "alpha2,6-" to --alpha 2,6- --.

Signed and Sealed this
Twenty-first Day of July, 2020

Andrei Iancu
*Director of the United States Patent and Trademark Office*

On Page 6, Column 2, Item (56), Line 8, under Other Publications, change "immunoglobuline" to --immunoglobulin--.

On Page 6, Column 2, Item (56), Line 43, under Other Publications, change "HPR" to --HPRT--.

On Page 7, Column 1, Item (56), Line 50, under Other Publications, change "TNF-60" to --TNF-α--.

On Page 7, Column 1, Item (56), Line 59, under Other Publications, change "asiaglycoprotein" to -- asialoglycoprotein--.

On Page 7, Column 2, Line 72, Item (56), under Other Publications, change "Aantibody,"" to --Antibody,"--.

On Page 8, Column 2, Item (56), Line 9, under Other Publications, change "GaINAc" to --GalNAc--.

In the Drawings

On Sheet 9 of 4126, Figure 8B, Y-axis, change "Expresssion" to --Expression--.

On Sheet 9 of 4126, Figure 8B, X-axis, change "Untrasnfected" to --Untransfected--.

On Sheet 11 of 4126, Figure 10B, X-axis, change "Untrasnfected" to --Untransfected--.

On Sheet 13 of 4126, Figure 12B, X-axis, change "Untansfected" to --Untransfected--.

On Sheet 13 of 4126, Figure 12C, X-axis, change "Untansfected" to --Untransfected--.

On Sheet 95 of 4126, Figure 49 (Continued), Line 29 (Approx.), change "21 225 29E6" to --21-225_29E6--.

On Sheet 136 of 4126, Figure 49 (Continued), Line 29 (Approx.), change "21 225 12D2" to --21-225_12D2--.

On Sheet 162 of 4126, Figure 49 (Continued), Line 29 (Approx.), change "21 225 49E7" to --21-225_49E7--.

On Sheet 170 of 4126, Figure 49 (Continued), Line 29 (Approx.), change "21 225 54D4" to --21-225_54D4--.

On Sheet 173 of 4126, Figure 49 (Continued), Line 29 (Approx.), change "21 225 56A1" to --21-225_56A1--.

On Sheet 182 of 4126, Figure 49 (Continued), Line 29 (Approx.), change "21 225 57A11" to --21-225_57A11--.

On Sheet 227 of 4126, Figure 49 (Continued), Line 29 (Approx.), change "21 225 92F12" to

--21-225_92F12--.

On Sheet 239 of 4126, Figure 49 (Continued), Line 29 (Approx.), change "21 225 149F1" to --21-225_149F1--.

On Sheet 242 of 4126, Figure 49 (Continued), Line 29 (Approx.), change "21 225 150B7" to --21-225_150B7--.

On Sheet 254 of 4126, Figure 49 (Continued), Line 29 (Approx.), change "21 225 158B12" to --21-225_158B12--.

On Sheet 259 of 4126, Figure 49 (Continued), Line 29 (Approx.), change "21 225 162D5" to --21-225_162D5--.

On Sheet 261 of 4126, Figure 49 (Continued), Line 29 (Approx.), change "21 225 167H10" to --21-225_167H10--.

On Sheet 284 of 4126, Figure 49 (Continued), Line 29 (Approx.), change "21 225 190E7" to --21-225_190E7--.

On Sheet 298 of 4126, Figure 49 (Continued), Line 29 (Approx.), change "21 225 196G8" to --21-225_196G8--.

On Sheet 335 of 4126, Figure 49 (Continued), Line 29 (Approx.), change "21 225 227C7" to --21-225_227C7--.

On Sheet 380 of 4126, Figure 49 (Continued), Line 29 (Approx.), change "21 225 218G4" to --21-225_218G4--.

On Sheet 382 of 4126, Figure 49 (Continued), Line 29 (Approx.), change "21 225 226F8" to --21-225_226F8--.

On Sheet 390 of 4126, Figure 49 (Continued), Line 29 (Approx.), change "21 225 74B1" to --21-225_74B1--.

On Sheet 420 of 4126, Figure 49 (Continued), Line 26 (Approx.), change "21 225 190C1" to --21-225_190C1--.

On Sheet 432 of 4126, Figure 49 (Continued), Line 26 (Approx.), change "21 225 17F4" to --21-225_17F4--.

On Sheet 438 of 4126, Figure 49 (Continued), Line 23 (Approx.), change "21 225 20H7" to --21-225_20H7--.

On Sheet 445 of 4126, Figure 49 (Continued), Line 27 (Approx.), change "21 225 22E4" to --21-225_22E4--.

On Sheet 449 of 4126, Figure 49 (Continued), Line 26 (Approx.), change "21 225 21E5" to --21-225_21E5--.

On Sheet 454 of 4126, Figure 49 (Continued), Line 26 (Approx.), change "21 225 21H10" to --21-225_21H10--.

On Sheet 460 of 4126, Figure 49 (Continued), Line 26 (Approx.), change "21 225 28C7" to --21-225_28C7--.

On Sheet 468 of 4126, Figure 49 (Continued), Line 26 (Approx.), change "21 225 25H11" to --21-225_25H11--.

On Sheet 476 of 4126, Figure 49 (Continued), Line 26 (Approx.), change "21 225 33F1" to --21-225_33F1--.

On Sheet 477 of 4126, Figure 49 (Continued), Line 28 (Approx.), change "21 225 33G1" to --21-225_33G1--.

On Sheet 487 of 4126, Figure 49 (Continued), Line 27 (Approx.), change "21 225 14G3" to --21-225_14G3--.

On Sheet 497 of 4126, Figure 49 (Continued), Line 26 (Approx.), change "21 225 15A1" to --21-225_15A1--.

On Sheet 501 of 4126, Figure 49 (Continued), Line 26 (Approx.), change "21 225 2G4" to --21-225_2G4--.

On Sheet 502 of 4126, Figure 49 (Continued), Line 23 (Approx.), change "21 225 4E10" to --21-225_4E10--.

On Sheet 530 of 4126, Figure 49 (Continued), Line 28 (Approx.), change "21 225 16D10" to --21-225_16D10--.

On Sheet 531 of 4126, Figure 49 (Continued), Line 29 (Approx.), change "21 225 8F11" to --21-225_8F11--.

On Sheet 536 of 4126, Figure 49 (Continued), Line 27 (Approx.), change "21 225 43H4" to --21-225_43H4--.

On Sheet 548 of 4126, Figure 49 (Continued), Line 27 (Approx.), change "21 225 48A9" to --21-225_48A9--.

On Sheet 553 of 4126, Figure 49 (Continued), Line 27 (Approx.), change "21 225 51B4" to --21-225_51B4--.

On Sheet 559 of 4126, Figure 49 (Continued), Line 26 (Approx.), change "21 225 53E4" to

--21-225_53E4--.

On Sheet 561 of 4126, Figure 49 (Continued), Line 22 (Approx.), change "21 225 54G3" to --21-225_54G3--.

On Sheet 575 of 4126, Figure 49 (Continued), Line 26 (Approx.), change "21 225 56H7" to --21-225_56H7--.

On Sheet 577 of 4126, Figure 49 (Continued), Line 27 (Approx.), change "21 225 57B8" to --21-225_57B8--.

On Sheet 586 of 4126, Figure 49 (Continued), Line 26 (Approx.), change "21 225 65A6" to --21-225_65A6--.

On Sheet 601 of 4126, Figure 49 (Continued), Line 26 (Approx.), change "21 225 76C9" to --21-225_76C9--.

On Sheet 610 of 4126, Figure 49 (Continued), Line 25 (Approx.), change "21 225 79F3" to --21-225_79F3--.

On Sheet 611 of 4126, Figure 49 (Continued), Line 26 (Approx.), change "21 225 74E3" to --21-225_74E3--.

On Sheet 613 of 4126, Figure 49 (Continued), Line 27 (Approx.), change "21 225 79G12" to --21-225_79G12--.

On Sheet 617 of 4126, Figure 49 (Continued), Line 26 (Approx.), change "21 225 81C5" to --21-225_81C5--.

On Sheet 638 of 4126, Figure 49 (Continued), Line 26 (Approx.), change "21 225 95D2" to --21-225_95D2--.

On Sheet 640 of 4126, Figure 49 (Continued), Line 26 (Approx.), change "21 225 96A3" to --21-225_96A3--.

On Sheet 650 of 4126, Figure 49 (Continued), Line 26 (Approx.), change "21 225 148F12" to --21-225_148F12--.

On Sheet 658 of 4126, Figure 49 (Continued), Line 25 (Approx.), change "21 225 152F6" to --21-225_152F6--.

On Sheet 676 of 4126, Figure 49 (Continued), Line 26 (Approx.), change "21 225 162H6" to --21-225_162H6--.

On Sheet 681 of 4126, Figure 49 (Continued), Line 27 (Approx.), change "21 225 170H1" to --21-225_170H1--.

On Sheet 701 of 4126, Figure 49 (Continued), Line 26 (Approx.), change "21 225 190B1" to --21-225_190B1--.

On Sheet 732 of 4126, Figure 49 (Continued), Line 26 (Approx.), change "21 225 199C2" to --21-225_199C2--.

On Sheet 737 of 4126, Figure 49 (Continued), Line 28 (Approx.), change "21 225 201G6" to --21-225_201G6--.

On Sheet 761 of 4126, Figure 49 (Continued), Line 26 (Approx.), change "21 225 222E1" to --21-225_222E1--.

On Sheet 769 of 4126, Figure 49 (Continued), Line 24 (Approx.), change "21 225 225F8" to --21-225_225F8--.

On Sheet 818 of 4126, Figure 49 (Continued), Line 28 (Approx.), change "21 225 193A6" to --21-225_193A6--.

On Sheet 820 of 4126, Figure 49 (Continued), Line 27 (Approx.), change "21 225 195E9" to --21-225_195E9--.

On Sheet 821 of 4126, Figure 49 (Continued), Line 29 (Approx.), change "21 225 197B11" to --21-225_197B11--.

On Sheet 839 of 4126, Figure 49 (Continued), Line 28 (Approx.), change "21 225 64E2" to --21-225_64E2--.

On Sheet 841 of 4126, Figure 49 (Continued), Line 26 (Approx.), change "21 225 171H12" to --21-225_171H12--.

On Sheet 856 of 4126, Figure 49 (Continued), Line 25 (Approx.), change "21 225 4H6 005" to --21-225_4H6.005--.

On Sheet 857 of 4126, Figure 49 (Continued), Line 29 (Approx.), change "21 225 4H6 010" to --21-225_4H6.010--.

On Sheet 869 of 4126, Figure 49 (Continued), Line 27 (Approx.), change "21 225 45F6" to --21-225_45F6--.

On Sheet 2847 of 4126, Figure 55 (Continued), Line 22, change "49) )" to --49)--.

On Sheet 2847 of 4126, Figure 55 (Continued), Line 27, change "50) )" to --50)--.

On Sheet 2847 of 4126, Figure 55 (Continued), Line 32, change "51) )" to --51)--.

On Sheet 2847 of 4126, Figure 55 (Continued), Line 37, change "52) )" to --52)--.

On Sheet 2910 of 4126, Figure 55 (Continued), Line 42-43, change "(SEQ ID NO: 50221)" to --SEQ ID NO: 50221--.

On Sheet 2914 of 4126, Figure 56 (Continued), Line 31, change "21-225 31C4 HC" to --21-225_31C4_HC--.

On Sheet 2914 of 4126, Figure 56 (Continued), Line 46, change "21-225 31C4 HC" to --21-225_31C4_HC--.

On Sheet 2916 of 4126, Figure 56 (Continued), Line 29, change "21-225 21D12 HC" to --21-225_21D12_HC--.

On Sheet 2918 of 4126, Figure 56 (Continued), Line 26, change "21-225 21D12 HC" to --21-225_21D12_HC--.

On Sheet 2920 of 4126, Figure 56 (Continued), Line 18, change "21-225 34H7 HC" to --21-225_34H7_HC--.

On Sheet 2924 of 4126, Figure 56 (Continued), Line 18, change "21-225 34H7 HC" to --21-225_34H7_HC--.

On Sheet 2938 of 4126, Figure 56 (Continued), Line 26, change "21-225 32B3 LC" to --21-225_32B3_LC--.

On Sheet 2962 of 4126, Figure 56 (Continued), Line 28, change "21-225 11A5 HC" to --21-225_11A5_HC--.

On Sheet 2969 of 4126, Figure 56 (Continued), Line 16, change "21-225 16E6 HC" to --21-225_16E6_HC--.

On Sheet 2969 of 4126, Figure 56 (Continued), Line 33, change "21-225 16E6 HC" to --21-225_16E6_HC--.

On Sheet 2971 of 4126, Figure 56 (Continued), Line 25, change "21-225 5E5 HC" to --21-225_5E5_HC--.

On Sheet 2986 of 4126, Figure 56 (Continued), Line 19, change "21-225 16H4 HC" to --21-225_16H4_HC--.

On Sheet 2990 of 4126, Figure 56 (Continued), Line 33, change "21-225 1C12 HC" to --21-225_1C12_HC--.

On Sheet 2992 of 4126, Figure 56 (Continued), Line 34, change "21-225 1C12 HC" to --21-225_1C12_HC--.

CERTIFICATE OF CORRECTION (continued)
U.S. Pat. No. 10,358,497 B2

On Sheet 2995 of 4126, Figure 56 (Continued), Line 42, change "21-225 29B8 HC" to --21-225_29B8_HC--.

On Sheet 2996 of 4126, Figure 56 (Continued), Line 42, change "21-225 29B8 HC" to --21-225_29B8_HC--.

On Sheet 3004 of 4126, Figure 56 (Continued), Line 34, change "21-225 1C12 HC" to --21-225_1C12_HC--.

On Sheet 3009 of 4126, Figure 56 (Continued), Line 23, change "21-225 8D12 HC" to --21-225_8D12_HC--.

On Sheet 3010 of 4126, Figure 56 (Continued), Line 23, change "21-225 8D12 HC" to --21-225_8D12_HC--.

On Sheet 3011 of 4126, Figure 56 (Continued), Line 23, change "21-225 8D12 HC" to --21-225_8D12_HC--.

On Sheet 3013 of 4126, Figure 56 (Continued), Line 24, change "21-225 8D12 HC" to --21-225_8D12_HC--.

On Sheet 3015 of 4126, Figure 56 (Continued), Line 16, change "21-225 11F5 HC" to --21-225_11F5_HC--.

On Sheet 3015 of 4126, Figure 56 (Continued), Line 32, change "21-225 11F5 HC" to --21-225_11F5_HC--.

On Sheet 3019 of 4126, Figure 56 (Continued), Line 17, change "21-225 31C4 LC" to --21-225_31C4_LC--.

On Sheet 3021 of 4126, Figure 56 (Continued), Line 31, change "21-225 31C4 LC" to --21-225_31C4_LC--.

On Sheet 3024 of 4126, Figure 56 (Continued), Line 17, change "21-225 9G9 LC" to --21-225_9G9_LC--.

On Sheet 3026 of 4126, Figure 56 (Continued), Line 31, change "21-225 9G9 LC" to --21-225_9G9_LC--.

On Sheet 3029 of 4126, Figure 56 (Continued), Line 19, change "21-225 32A5 LC" to --21-225_32A5_LC--.

On Sheet 3036 of 4126, Figure 56 (Continued), Line 25, change "21-225 32B3 LC" to --21-225_32B3_LC--.

On Sheet 3064 of 4126, Figure 56 (Continued), Line 29, change "21-225 8E12 LC" to

--21-225_8E12_LC--.

On Sheet 3067 of 4126, Figure 56 (Continued), Line 28, change "21-225 8E12 LC" to --21-225_8E12_LC--.

On Sheet 3069 of 4126, Figure 56 (Continued), Line 28, change "21-225 8E12 LC" to --21-225_8E12_LC--.

On Sheet 3072 of 4126, Figure 56 (Continued), Line 28, change "21-225 8E12 LC" to --21-225_8E12_LC--.

On Sheet 3073 of 4126, Figure 56 (Continued), Line 35, change "21-225 16E6 LC" to --21-225_16E6_LC--.

On Sheet 3077 of 4126, Figure 56 (Continued), Line 28, change "21-225 16E6 LC" to --21-225_16E6_LC--.

On Sheet 3080 of 4126, Figure 56 (Continued), Line 28, change "21-225 3H10 LC" to --21-225_3H10_LC--.

On Sheet 3091 of 4126, Figure 56 (Continued), Line 19, change "21-225 16H4 LC" to --21-225_16H4_LC--.

On Sheet 3094 of 4126, Figure 56 (Continued), Line 43, change "21-225 29B8 LC" to --21-225_29B8_LC--.

On Sheet 3109 of 4126, Figure 56 (Continued), Line 34, change "21-225 1C12 LC" to --21-225_1C12_LC--.

On Sheet 3116 of 4126, Figure 56 (Continued), Line 23, change "21-225 16A1 LC" to --21-225_16A1_LC--.

On Sheet 3117 of 4126, Figure 56 (Continued), Line 24, change "21-225 16A1 LC" to --21-225_16A1_LC--.

On Sheet 3121 of 4126, Figure 56 (Continued), Line 15, change "21-225 4H4 LC" to --21-225_4H4_LC--.

On Sheet 3123 of 4126, Figure 56 (Continued), Line 16, change "21-225 4H4 LC" to --21-225_4H4_LC--.

On Sheet 3288 of 4126, Figure 57 (Continued), Line 3, change "(-)or" to --(-) or--.

On Sheet 3288 of 4126, Figure 57 (Continued), Line 4, change "(-," to --(-),--.

On Sheet 3301 of 4126, Figure 57 (Continued), Line 3, change "Sat" to --S at--.

On Sheet 3443 of 4126, Figure 57 (Continued), Line 20, change "substitute" to --substituted--.

On Sheet 3451 of 4126, Figure 57 (Continued), Line 10, change "substitute" to --substituted--.

On Sheet 4098 of 4126, Figure 57 (Continued), Line 13, change "L." to --L,--.

On Sheet 4116 of 4126, Figure 57 (Continued), Line 15, change "null(-)" to --null (-)--.

In the Specification

In Column 1, Line 25, change "size." to --size, and updated by a file entitled APMOL017ASEQUENCEREPLACEMENT2.txt, created on February 26, 2019, which is 14,782,582 bytes in size.--.

In Column 6, Line 51, change "Tables" to --Table--.

In Column 6, Line 65, change "Tables" to --Table--.

In Column 7, Line 2, change "18amino" to --18 amino--.

In Column 7, Line 7, change "14amino" to --14 amino--.

In Column 7, Line 15, change "Tables" to --Table--.

In Column 7, Line 19, change "Tables" to --Table--.

In Column 7, Line 28, change "14amino" to --14 amino--.

In Column 7, Line 36, change "Tables" to --Table--.

In Column 7, Line 40, change "Tables" to --Table--.

In Column 7, Line 44, change "18amino" to --18 amino--.

In Column 7, Line 48, change "14amino" to --14 amino--.

In Column 7, Line 57, change "Tables" to --Table--.

In Column 7, Line 61, change "Tables" to --Table--.

In Column 7, Line 65, change "18amino" to --18 amino--.

In Column 8, Line 2, change "14amino" to --14 amino--.

In Column 8, Line 11, change "Tables" to --Table--.

CERTIFICATE OF CORRECTION (continued)
U.S. Pat. No. 10,358,497 B2

In Column 8, Line 14, change "Tables" to --Table--.

In Column 12, Line 31, change "G252, :" to --G252,--.

In Column 15, Line 26, change "G252, :" to --G252,--.

In Column 23, Line 64, change "G252, :" to --G252,--.

In Column 29, Line 10, change "5'splice" to --5' splice--.

In Column 32, Line 33, change "cynomologous" to --cynomolgus--.

In Column 32, Line 35, change "cynomologous" to --cynomolgus--.

In Column 32, Line 39, change "cynomologous" to --cynomolgus--.

In Column 32, Line 41, change "cynomologous" to --cynomolgus--.

In Column 33, Line 31, change "respresented" to --represented--.

In Column 37, Line 46, change "antibody." to --antibody--.

In Column 37, Line 55, change "5;" to --5--.

In Column 38, Line 9, change "(c. 469-" to --(c.469- --.

In Column 39, Line 47, change "desialated" to --desialylated--.

In Column 40, Line 39, change "alpha2,6-" to --alpha 2,6- --.

In Column 45, Line 47, change "neocarzinostain," to --neocarzinostatin,--.

In Column 47, Line 55, change "radioimmunoas say" to --radioimmunoassay--.

In Column 50, Line 2, change "and or" to --and/or--.

In Column 50, Line 58, change "ISO," to --I50,--.

In Column 54, Line 27, change "phylogenic" to --phylogenetic--.

In Column 54, Line 46, change "(phylogenic" to --(phylogenetic--.

In Column 91, Line 3, change "Tables" to --Table--.

In Column 91, Line 17, change "Tables" to --Table--.

CERTIFICATE OF CORRECTION (continued)
U.S. Pat. No. 10,358,497 B2

In Column 91, Line 21, change "18amino" to --18 amino--.

In Column 91, Line 22, change "inserions" to --insertions--.

In Column 91, Line 26, change "14amino" to --14 amino--.

In Column 91, Line 34, change "Tables" to --Table--.

In Column 91, Line 38, change "Tables" to --Table--.

In Column 91, Line 47, change "14amino" to --14 amino--.

In Column 91, Line 55, change "Tables" to --Table--.

In Column 91, Line 59, change "Tables" to --Table--.

In Column 91, Line 67, change "14amino" to --14 amino--.

In Column 92, Line 9 (Approx.), change "Tables" to --Table--.

In Column 92, Line 14 (Approx.), change "Tables" to --Table--.

In Column 92, Line 18, change "18amino" to --18 amino--.

In Column 92, Line 22, change "14amino" to --14 amino--.

In Column 92, Line 31, change "Tables" to --Table--.

In Column 92, Line 34, change "Tables" to --Table--.

In Column 96, Line 52, change "G252, :" to --G252,--.

In Column 99, Line 47, change "G252, :" to --G252,--.

In Column 108, Line 18, change "G252, :" to --G252,--.

In Column 111, Line 22, change "forteBIO" to --ForteBio--.

In Column 111, Line 34, change "radioimmunoas say" to --radioimmunoassay--.

In Column 112, Line 14, change "ASGR-2)(See" to --ASGR-2) (See--.

In Column 112, Line 42, change "VH1||-" to --VH1|1--.

In Column 112, Line 48, change "VH111-" to --VH1|1- --.

CERTIFICATE OF CORRECTION (continued)
U.S. Pat. No. 10,358,497 B2

In Column 112, Line 61, change "VH1||-" to --VH1|1- --.

In Column 113, Line 13 (Approx.), change "Be" to --Ile--.

In Columns 131-132, Line 16 (Approx.), change "50264," to --50264--.

In Column 135, Line 33, change "Ser. No. 05/011," to --Pub. No. 2005/011--.

In Column 135, Lines 44-45, change "NS1/1.Ag 41," to --NS1/1.Ag41,--.

In Column 137, Line 9, change "λlmmunoZap™(H)" to --λImmunoZap™(H)--.

In Column 137, Line 65, change "diketopiperizine" to --diketopiperazine--.

In Column 138, Lines 39-40, change "cynomologous" to --cynomolgus--.

In Column 138, Line 40, change "chimpanzee))." to --chimpanzee).--.

In Column 139, Line 58, change "2.10A. 1-2.10A. 5." to --2.10A.1-2.10A.5.--.

In Column 143, Line 44, change "anti-sense" to --antisense--.

In Column 145, Lines 19-20, change "metallothionin" to --metallothionein--.

In Column 150, Line 34, change "-imidozoyl)" to -- -imidazolyl)--.

In Column 150, Line 51, change "0-methylisourea," to --O-methylisourea,--.

In Column 150, Line 66, change "N-acetylimidizole" to --N-acetylimidazole--.

In Column 160, Lines 11-12, change "moietymay" to --moiety may--.

In Column 160, Line 17, change "moietypromotes" to --moiety promotes--.

In Column 160, Line 20, change "moietiesinclude" to --moieties include--.

In Column 160, Line 54, change "-glycolied)" to -- -glycolide)--.

In Column 160, Line 57, change "-ethylacryllic" to -- -ethylacrylic--.

In Column 161, Line 5, change "-gulucosamine" to -- -glucosamine--.

In Column 161, Line 17, delete "206 ligonucle acetic acid,".

In Column 161, Line 40, change "-gulucosamine" to -- -glucosamine--.

In Column 161, Line 49, change "japlakinolide," to --jasplakinolide,--.

In Column 161, Line 50, change "myoservin." to --myoseverin.--.

In Column 163, Line 32, change "Ceropin" to --Cecropin--.

In Column 163, Line 45, change "paradaxins," to --pardaxins,--.

In Column 163, Line 47, change "magainines," to --magainins,--.

In Column 163, Line 49, change "esculentinis-1" to --esculentin-1--.

In Column 163, Line 50, change "moietiesinclude" to --moieties include--.

In Column 163, Line 60, change "apatamer." to --aptamer.--.

In Column 164, Line 3, change "polycaboxylates, polyacations," to --polycarboxylates, polycations,--.

In Column 164, Lines 4-5, change "/polyketyals," to --/polyketals,--.

In Column 164, Line 10, change "Examplary" to --Exemplary--.

In Column 164, Line 49, change "phosphorodithiotate," to --phosphorodithioate,--.

In Column 165, Line 37, change "targeting targeting" to --targeting--.

In Column 170, Line 6, change "inhbiitor" to --inhibitor--.

In Column 170, Line 23, change "gal or galNAc," to --Gal or GalNAc,--.

In Column 172, Line 4, change "of of" to --of--.

In Column 175, Line 33 (Approx.), change "agonsits," to --agonists,--.

In Column 175, Line 37 (Approx.), change "inhibitoris" to --inhibitors--.

In Column 176, Line 60, change "luceriferases," to --luciferases,--.

In Column 178, Line 56, change "LDLcholesterol" to --LDL cholesterol--.

In Column 179, Line 4, change "I22.*." to --I22.*,--.

In Column 179, Line 41, change "20×)(Samani" to --20×) (Samani--.

In Column 181, Line 26, change "by" to --bp--.

In Column 181, Line 27, change ":c. 469_" to --:c.469_--.

In Column 181, Line 32, change "c. 469_" to --c.469_--.

In Column 181, Line 33, change "c. 469_" to --c.469_--.

In Column 183, Line 46, after "32608)" insert --.--.

In Column 183, Lines 46-47, delete "Introduction of 22 bp deletion in ASGR-1:" and insert the same on Column 183, Line 47 as a new heading.

In Column 186, Line 8, change "10-9)(Table" to --10-9) (Table--.

In Column 186, Line 16, change ":c. 284-" to --:c.284- --.

In Column 186, Line 39, change "10-16)(Table" to --10-16) (Table--.

In Column 186, Line 45, change "by" to --bp--.

In Column 186, Line 46, change ":c. 469_" to --:c.469_--.

In Column 186, Line 54, change "c. 469_" to --c.469_--.

In Column 186, Line 56, change "C1-34.2" to --CI-34.2--.

In Column 186, Line 58, change "c. 469_" to --c.469_--.

In Column 187, Lines 1-2, change "(c. 469_" to --(c.469_--.

In Column 187, Lines 3-4, change "(c. 469_" to --(c.469_--.

In Column 187, Lines 38-39, change "asioaloglycoprotein" to --asialoglycoprotein--.

In Columns 189-190, Line 3, change "Assertainment" to --Ascertainment--.

In Columns 189-190, Line 9, change "I22.*." to --I22.*,--.

In Columns 191-192, Line 3, change "Assertainment" to --Ascertainment--.

In Columns 193-194, Line 3, change "Assertainment" to --Ascertainment--.

In Columns 193-194, Line 44, change "Univerity" to --University--.

In Columns 193-194, Line 62, change "hospitls" to --hospitals--.

In Columns 195-196, Line 27, change "(2007)[5]," to --(2007)[5].--.

CERTIFICATE OF CORRECTION (continued)
U.S. Pat. No. 10,358,497 B2

In Columns 195-196, Line 28, change "(2003)⁶," to --(2003)⁶.--.

In Columns 205-206, Line 44, after "0.02586" insert --.--.

In Columns 207-208, Line 13, after "0.02586" insert --.--.

In Column 208, Line 24 (Approx.), change "Constucts" to --Constructs--.

In Column 209, Line 38, change "RNAMAX" to --RNAIMAX--.

In Column 209, Line 48, change "4 C" to --4° C.--.

In Column 209, Line 58, change "4 C." to --4° C.--.

In Column 209, Line 67, change "strepavidin-" to --streptavidin- --.

In Column 210, Line 59, change "Dulbeco's" to --Dulbecco's--.

In Column 211, Line 57, change "Lipfectamine" to --Lipofectamine--.

In Column 212, Line 35, change "carbinicillin." to --carbenicillin.--.

In Column 212, Line 37, change "carbinicillin)" to --carbenicillin)--.

In Column 212, Line 46, change "containin" to --containing--.

In Column 216, Line 67 (Approx.), change "Stabilguard®" to --StabilGuard®--.

In Column 218, Line 9, change "Stabilguard®" to --StabilGuard®--.

In Column 219, Line 49 (Approx.), change "Fortebio" to --ForteBio--.

In Column 225, Line 34, change "Cat#L101-" to --Cat#:L101- --.

In Column 225, Line 40, change "Stabilguard®" to --StabilGuard®--.

In Column 231, Line 26, change "M. 1" to --M.1--.

In Column 232, Line 41, change "strepavidin-" to --streptavidin- --.

In Column 232, Line 47, change "strepavidin-" to --streptavidin- --.

In Column 232, Line 62, change "-strepavidin-" to -- -streptavidin- --.

In Column 233, Line 11, change "Desialated" to --Desialylated--.

In Column 233, Lines 26-27, change "desialated" to --desialylated--.

In Column 233, Line 38, change "desialated" to --desialylated--.

In Column 233, Line 59, change "desialated" to --desialylated--.

In Column 234, Line 3, change "desialated" to --desialylated--.

In Column 234, Line 17, change "Stucture" to --Structure--.

In Column 235, Line 67, after "21C" insert --.--.

In Column 236, Line 11 (Approx.), change "W244W244," to --W244,--.

In Column 239, Line 67, change "N0:5)." to --NO:5).--.

In Column 240, Line 7, change "N0:5)." to --NO:5).--.

In Column 240, Line 37, change "Rfree=" to --$R_{free}$=--.

In Column 241, Line 9, change "129," to --I29,--.

In Column 245, Line 13 (Approx.), change "deicted" to --depicted--.

In Column 249, Line 56, after "25.9" insert --.--.

In Column 251, Line 26, after "21.6" insert --.--.

In Column 252, Line 63, after "23.3" insert --.--.

In Column 256, Line 36 (Approx.), change "cytometery-" to --cytometry- --.

In Column 256, Line 42, change "4 C" to --4° C.--.

In Column 256, Line 49, change "4 C" to --4° C.--.

In Column 256, Line 52, change "4 C" to --4° C.--.

In Column 256, Line 67, change "TABLE12.1." to --TABLE 12.1.--.

In Column 257, Line 49, change "4 C." to --4° C.--.

In Column 257, Line 53, change "4 C," to --4° C.,--.

In Column 257, Line 56, change "4 C," to --4° C.,--.

CERTIFICATE OF CORRECTION (continued)
U.S. Pat. No. 10,358,497 B2

In Column 257, Line 64, change "GALNAc-" to --GalNAc- --.

In Column 258, Line 57, change "tryptohphans" to --tryptophans--.

In Column 260, Line 17, change "criterea" to --criteria--.

In Column 260, Line 19, change "dylipidemic." to --dyslipidemic.--.

In Column 260, Line 23, change "cynolgous" to --cynomolgus--.

In Column 260, Line 29, change "-SEFL2)(100" to -- -SEFL2) (100--.

In Column 261, Line 2, change "human.$^1$." to --human$^1$.--.

In Column 261, Line 47, change "i th" to --i$^{th}$--.

In Column 261, Line 48, change "i th" to --i$^{th}$--.

In Column 266, Line 38 (Approx.), change "CD 166" to --CD166--.

In Columns 267-268, Line 56, change "ROB03" to --ROBO3--.

In the Claims

In Column 848, Line 57 (Approx.), Claim 6, change "methods" to --method--.

In Column 849, Line 9 (Approx.), Claim 14, change "methods" to --method--.

In Column 849, Line 16, Claim 16, change "methods" to --method--.

In Column 849, Line 22, Claim 18, change "methods" to --method--.

In Column 851, Line 21, Claim 58, change "anti-sense" to --antisense--.

In Column 851, Line 26, Claim 59, change "anti-sense" to --antisense--.

In Column 851, Line 31, Claim 60, change "anti-sense" to --antisense--.

In Column 851, Line 36, Claim 61, change "anti-sense" to --antisense--.

In Column 851, Line 41, Claim 62, change "anti-sense" to --antisense--.

In Column 851, Line 46, Claim 63, change "anti-sense" to --antisense--.

In Column 851, Line 51, Claim 64, change "anti-sense" to --antisense--.

In Column 851, Line 56, Claim 65, change "anti-sense" to --antisense--.

In Column 852, Line 35, Claim 80, change "32699)," to --32699,--.

In Column 852, Line 41, Claim 81, change "anti-sense" to --antisense--.

In Column 852, Line 43, Claim 82, change "anti-sense" to --antisense--.

In Column 852, Line 44, Claim 82, change "stand" to --strand--.

In Column 852, Lines 44-45, Claim 82, change "anti-sense" to --antisense--.

In Column 852, Line 63, Claim 85, change "anti-sense" to --antisense--.

In Column 852, Line 65, Claim 86, change "anti-sense" to --antisense--.

In Column 852, Line 67, Claim 86, change "anti-sense" to --antisense--.

In Column 852, Line 57, Claim 84, change "32699)," to --32699,--.

In Column 853, Line 12, Claim 88, change "32699)," to --32699,--.

In Column 853, Line 18, Claim 89, change "anti-sense" to --antisense--.

In Column 853, Line 20, Claim 90, change "anti-sense" to --antisense--.

In Column 853, Lines 21-22, Claim 90, change "anti-sense" to --antisense--.

In Column 853, Line 34, Claim 92, change "32699)," to --32699,--.

In Column 853, Line 40, Claim 93, change "anti-sense" to --antisense--.

In Column 853, Line 42, Claim 94, change "anti-sense" to --antisense--.

In Column 853, Lines 43-44, Claim 94, change "anti-sense" to --antisense--.

In Column 854, Line 29 (Approx.), Claim 107, change "anti-sense" to --antisense--.

In Column 854, Line 45 (Approx.), Claim 108, change "anti-sense" to --antisense--.